(12) United States Patent
Schøller et al.

(10) Patent No.: US 10,968,269 B1
(45) Date of Patent: Apr. 6, 2021

(54) MHC MULTIMERS IN BORRELIA DIAGNOSTICS AND DISEASE

(75) Inventors: Jørgen Schøller, Lyngby (DK); Liselotte Brix, Bagsværd (DK); Henrik Pedersen, Lynge (DK)

(73) Assignee: Agilent Technologies, Inc., Santa Clara, CA (US)

( * ) Notice: Subject to any disclaimer, the term of this patent is extended or adjusted under 35 U.S.C. 154(b) by 722 days.

(21) Appl. No.: 12/919,405

(22) PCT Filed: Dec. 30, 2008

(86) PCT No.: PCT/DK2008/000451
§ 371 (c)(1),
(2), (4) Date: Jan. 20, 2011

(87) PCT Pub. No.: WO2009/106073
PCT Pub. Date: Sep. 3, 2009

Related U.S. Application Data

(60) Provisional application No. 61/067,831, filed on Feb. 28, 2008, provisional application No. 61/083,481, filed on Jul. 24, 2008, provisional application No. 61/101,931, filed on Oct. 1, 2008.

(30) Foreign Application Priority Data

| Feb. 28, 2008 | (DK) | PA 2008 00295 |
| Jul. 17, 2008 | (DK) | PA 2008 01011 |
| Oct. 1, 2008 | (DK) | PA 2008 01380 |

(51) Int. Cl.
C07K 14/74 (2006.01)
A61K 39/00 (2006.01)

(52) U.S. Cl.
CPC .............. C07K 14/70539 (2013.01)

(58) Field of Classification Search
None
See application file for complete search history.

(56) References Cited

U.S. PATENT DOCUMENTS

| 4,281,061 A | 7/1981 | Zuk et al. |
| 4,336,173 A | 6/1982 | Ugelstad |
| 4,387,164 A | 6/1983 | Hevey et al. |
| 4,459,378 A | 7/1984 | Ugelstad |
| 4,654,267 A | 3/1987 | Ugelstad et al. |
| 4,876,190 A | 10/1989 | Recktenwald |
| 5,039,487 A | 8/1991 | Smith |
| 5,130,297 A | 7/1992 | Sharma et al. |
| 5,194,425 A | 3/1993 | Sharma et al. |
| 5,260,422 A | 11/1993 | Clark et al. |
| 5,284,935 A | 2/1994 | Clark et al. |
| 5,312,744 A | 5/1994 | Shibata |
| 5,468,481 A | 11/1995 | Sharma et al. |
| 5,583,031 A | 12/1996 | Stern |
| 5,627,037 A | 5/1997 | Ward et al. |
| 5,635,363 A | 7/1997 | Altman et al. |
| 5,652,342 A | 7/1997 | Zimmerman et al. |
| 5,807,552 A | 9/1998 | Stanton et al. |
| 5,869,270 A | 2/1999 | Rhode et al. |
| 5,891,741 A | 4/1999 | Siiman et al. |
| 5,955,079 A | 9/1999 | Mond et al. |
| 5,994,089 A | 11/1999 | Siiman et al. |
| 5,998,204 A | 12/1999 | Tsien et al. |
| 6,015,884 A | 1/2000 | Schneck et al. |
| 6,156,317 A | 5/2000 | Diamond et al. |
| 6,074,645 A | 6/2000 | Diamond et al. |
| 6,090,587 A | 7/2000 | Rhode et al. |
| 6,096,315 A | 8/2000 | Zimmerman et al. |
| 6,106,840 A | 8/2000 | Clark et al. |
| 6,129,916 A | 10/2000 | Chang |
| 6,140,113 A | 10/2000 | Schneck et al. |
| 6,156,514 A | 12/2000 | Acevedo et al. |
| 6,197,302 B1 | 3/2001 | Hirsch et al. |
| 6,197,928 B1 | 3/2001 | Tsien et al. |

(Continued)

FOREIGN PATENT DOCUMENTS

| DE | 197 40 735 | 3/1999 |
| DE | 102 47 014 | 4/2004 |

(Continued)

OTHER PUBLICATIONS

Denkberg et al (Eur. J. Immunol., 2000, 30: 3522-3532).*
Busch et al (J. Immunol. 1996, 157: 3534-3541).*
Schueler-Furman et al (Protein Science, 2000, 9: 1838-1846).*
DiBrino et al (J. Immunology 151(11) 5390-5935, 1993).*
Celis et al (Molecular Immunol. 3: 1423-1430, 1994).*
Ochoa-Garay et al (Mol. Immunol., 1997, 34(3): 273-281).*
HLA Nomenclature (2015).*
Song et al (Cell. Mol. Immunol., 2013, 10: 40-496) (Year: 2013).*
Lundegaard et al (Bioinformatics, Apr. 14, 2008,24(11):1397-1398) (Year: 2008).*

(Continued)

*Primary Examiner* — Michael Szperka
*Assistant Examiner* — Marianne DiBrino
(74) *Attorney, Agent, or Firm* — Verrill Dana, LLP

(57) ABSTRACT

Novel compounds carrying ligands capable of binding to counter receptors on relevant target cells are disclosed. The compounds possess a number of advantageous features, rendering them very suitable for a wide range of applications, including use as detection systems, detection of relevant target cells as well as a number of other methods. In particular, novel MHC complexes comprising one or more MHC molecules containing one or more *Borrelia* derived peptides are disclosed. The possibility of presenting to the target cells a plurality of MHC-peptide complexes makes the MHC complexes according to the present invention an extremely powerful tool e.g. in the field of therapy and diagnosis. The invention generally relates to the sample-mounted use of MHC complexes and MHC multimers.

Also comprised by the invention is the field of therapy and vaccine, including therapeutic/vaccine methods and therapeutic/vaccine compositions.

12 Claims, 1622 Drawing Sheets

Specification includes a Sequence Listing.

(56) References Cited

U.S. PATENT DOCUMENTS

| | | |
|---|---|---|
| 6,211,342 B1 | 4/2001 | Hirsch et al. |
| 6,232,445 B1 | 5/2001 | Rhode et al. |
| 6,248,564 B1 | 6/2001 | Walter et al. |
| 6,251,399 B1 | 6/2001 | Diamond et al. |
| 6,268,411 B1 | 7/2001 | Schneck et al. |
| 6,306,605 B1 | 10/2001 | Acevedo et al. |
| 6,309,645 B1 | 10/2001 | Rhode et al. |
| 6,335,173 B1 | 1/2002 | Kaplan |
| 6,387,622 B1 | 5/2002 | Siiman et al. |
| 6,448,071 B1 | 9/2002 | Schneck et al. |
| 6,451,314 B1 | 9/2002 | Clark et al. |
| 6,451,769 B1 | 9/2002 | Huebner et al. |
| 6,458,354 B1 | 10/2002 | Schneck et al. |
| 6,458,933 B1 | 10/2002 | Hansen |
| 6,486,130 B1 | 11/2002 | Livey et al. |
| 6,517,838 B1* | 2/2003 | Hook et al. ............... 424/185.1 |
| 6,534,633 B1 | 3/2003 | Weidanz et al. |
| 6,548,067 B1 | 4/2003 | Seeman et al. |
| 6,605,711 B1 | 8/2003 | Valmori et al. |
| 6,734,013 B2 | 5/2004 | Schneck et al. |
| 7,041,442 B1 | 5/2006 | Kern et al. |
| 7,060,869 B2 | 6/2006 | Tsien et al. |
| 7,064,190 B1 | 6/2006 | Endl et al. |
| 7,074,904 B2 | 7/2006 | Wong et al. |
| 7,094,555 B2 | 8/2006 | Kwok et al. |
| 7,116,407 B2 | 10/2006 | Hansen et al. |
| 7,141,656 B2 | 11/2006 | Rhode et al. |
| 7,202,349 B2 | 4/2007 | Davis et al. |
| 7,364,869 B2 | 4/2008 | Nixon et al. |
| 7,502,580 B2 | 3/2009 | Hays |
| 7,519,318 B2 | 4/2009 | Kurogawa et al. |
| 7,524,503 B2 | 4/2009 | Khanna et al. |
| 7,706,782 B1 | 4/2010 | Hosmer et al. |
| 7,902,121 B2 | 3/2011 | Chen et al. |
| 8,114,669 B2 | 2/2012 | Choo |
| 8,268,964 B2 | 9/2012 | Scholler et al. |
| 8,298,782 B2 | 10/2012 | Busch et al. |
| 2002/0006903 A1 | 1/2002 | Schneck et al. |
| 2002/0034513 A1 | 3/2002 | Rhode et al. |
| 2002/0058787 A1 | 5/2002 | Strominger et al. |
| 2002/0082411 A1 | 6/2002 | Carter et al. |
| 2002/0091079 A1 | 7/2002 | Rhode et al. |
| 2002/0119149 A1 | 8/2002 | Jakobsen et al. |
| 2002/0127231 A1 | 9/2002 | Schneck et al. |
| 2002/0164340 A1 | 11/2002 | Brumeanu et al. |
| 2002/0165364 A1 | 11/2002 | Tsien et al. |
| 2002/0198144 A1 | 12/2002 | Wong et al. |
| 2003/0017447 A1 | 1/2003 | Bernardo et al. |
| 2003/0073102 A1 | 4/2003 | Kwok et al. |
| 2003/0096432 A1 | 5/2003 | Jakobsen |
| 2003/0104635 A1 | 6/2003 | Jakobsen |
| 2003/0118594 A1* | 6/2003 | Nag et al. ............... 424/184.1 |
| 2003/0171290 A1 | 9/2003 | Carr et al. |
| 2003/0199438 A1 | 10/2003 | Shaw et al. |
| 2003/0228258 A1 | 12/2003 | Scheinberg et al. |
| 2004/0068100 A1 | 4/2004 | Mach et al. |
| 2004/0072262 A1 | 4/2004 | Montero-Julian et al. |
| 2004/0082012 A1 | 4/2004 | Busch et al. |
| 2004/0086520 A1 | 5/2004 | Diamond |
| 2004/0137642 A1 | 7/2004 | Erfle et al. |
| 2004/0141958 A1 | 7/2004 | Steinaa et al. |
| 2004/0143094 A1 | 7/2004 | Donda et al. |
| 2004/0204565 A1 | 10/2004 | Schneck et al. |
| 2004/0209295 A1 | 10/2004 | Schwabe et al. |
| 2004/0209314 A1 | 10/2004 | Lang et al. |
| 2004/0223977 A1 | 11/2004 | Diamond |
| 2004/0253632 A1 | 12/2004 | Rhode et al. |
| 2005/0003431 A1 | 1/2005 | Wucherpfennig et al. |
| 2005/0074822 A1 | 4/2005 | Nixon et al. |
| 2005/0074848 A1 | 4/2005 | Schwabe |
| 2005/0079152 A1 | 4/2005 | Bot et al. |
| 2005/0095655 A1 | 5/2005 | Montero-Julian et al. |
| 2005/0208529 A1 | 9/2005 | Winther et al. |
| 2005/0214284 A1 | 9/2005 | Price-Schiavi et al. |
| 2005/0214852 A1* | 9/2005 | Gaynor et al. ............... 435/6 |
| 2005/0239160 A1 | 10/2005 | Shaw et al. |
| 2006/0018878 A1 | 1/2006 | Cooper et al. |
| 2006/0018929 A1 | 1/2006 | Zaia et al. |
| 2006/0073159 A1 | 4/2006 | Vonderheide et al. |
| 2006/0078563 A1 | 4/2006 | Srivastava |
| 2006/0084116 A1 | 4/2006 | Muchhal |
| 2006/0112440 A1 | 5/2006 | Tsien et al. |
| 2006/0141540 A1 | 6/2006 | Miltenyi et al. |
| 2006/0155115 A1 | 7/2006 | Jakobsen et al. |
| 2006/0166214 A1 | 7/2006 | Kato et al. |
| 2006/0166875 A1 | 7/2006 | Jakobsen et al. |
| 2006/0171954 A1 | 8/2006 | Endl et al. |
| 2006/0228758 A1 | 10/2006 | Muchhal et al. |
| 2006/0228759 A1 | 10/2006 | Muchhal et al. |
| 2006/0234309 A1 | 10/2006 | Shankar et al. |
| 2006/0234310 A1 | 10/2006 | Cai et al. |
| 2006/0240482 A1 | 10/2006 | Kwok et al. |
| 2007/0026503 A1 | 2/2007 | Lacey |
| 2007/0134814 A1 | 6/2007 | Kajander et al. |
| 2007/0154953 A1 | 7/2007 | Brunner et al. |
| 2007/0178532 A1 | 8/2007 | Jacobson et al. |
| 2007/0184022 A1 | 8/2007 | Wang et al. |
| 2007/0280957 A1 | 12/2007 | Falk et al. |
| 2008/0219947 A1 | 9/2008 | Linette et al. |
| 2009/0004213 A1 | 1/2009 | Singh et al. |
| 2009/0061478 A1 | 3/2009 | Poulsen et al. |
| 2009/0232766 A1 | 9/2009 | Wang et al. |
| 2009/0324630 A1 | 12/2009 | Jensen |
| 2010/0159594 A1 | 6/2010 | Hansen et al. |
| 2012/0020998 A1 | 1/2012 | Plumas et al. |

FOREIGN PATENT DOCUMENTS

| | | |
|---|---|---|
| EP | 0 106 873 | 5/1984 |
| EP | 0 352 761 | 1/1990 |
| EP | 0 516 953 | 12/1992 |
| EP | 0 633 028 | 1/1995 |
| EP | 0 636 696 | 2/1995 |
| EP | 0 420 913 | 11/1995 |
| EP | 0 423 201 | 6/1996 |
| EP | 0 742 014 | 11/1996 |
| EP | 0 949 508 | 10/1999 |
| EP | 0946592 | 10/1999 |
| EP | 1023319 | 8/2000 |
| EP | 0 776 339 | 10/2000 |
| EP | 1 051 619 | 11/2000 |
| EP | 1181313 | 2/2002 |
| EP | 0 981 747 | 7/2002 |
| EP | 1 227 321 | 7/2002 |
| EP | 0 630 255 | 12/2002 |
| EP | 0 812 331 | 5/2004 |
| EP | 0 935 607 | 7/2004 |
| EP | 1 437 366 | 7/2004 |
| EP | 0 877 760 | 9/2004 |
| EP | 1 526 141 | 8/2005 |
| EP | 0 997 477 | 3/2006 |
| EP | 1 017 799 | 3/2006 |
| EP | 1 349 569 | 4/2007 |
| EP | 0 665 289 | 5/2007 |
| EP | 1 012 320 | 10/2007 |
| RU | 2 260 047 | 4/2005 |
| WO | WO 89/12458 | 12/1989 |
| WO | WO 89/12459 | 12/1989 |
| WO | WO 90/04411 | 5/1990 |
| WO | WO 91/09870 | 7/1991 |
| WO | WO 91/15766 | 10/1991 |
| WO | WO 92/00055 | 1/1992 |
| WO | WO 92/08983 | 5/1992 |
| WO | WO 92/18150 | 10/1992 |
| WO | WO 92/21972 | 12/1992 |
| WO | WO 93/01498 | 1/1993 |
| WO | WO 93/04175 | 3/1993 |
| WO | WO 93/08306 | 4/1993 |
| WO | WO 93/10220 | 5/1993 |
| WO | WO 94/11078 | 5/1994 |
| WO | WO 94/12196 | 6/1994 |
| WO | WO 95/11998 | 5/1995 |
| WO | WO 95/12676 | 5/1995 |
| WO | WO 95/14781 | 6/1995 |

(56) References Cited

FOREIGN PATENT DOCUMENTS

| | | |
|---|---|---|
| WO | WO 96/04314 | 2/1996 |
| WO | WO 96/26962 | 9/1996 |
| WO | WO 97/05239 | 2/1997 |
| WO | WO 97/28191 | 8/1997 |
| WO | WO 97/35991 | 10/1997 |
| WO | WO 97/42221 | 11/1997 |
| WO | WO 97/44667 | 11/1997 |
| WO | WO 98/03552 | 1/1998 |
| WO | WO 98/05965 | 2/1998 |
| WO | WO 98/06749 | 2/1998 |
| WO | WO 98/05684 | 5/1998 |
| WO | WO 1999/002183 | 1/1999 |
| WO | WO 99/11661 | 3/1999 |
| WO | WO 99/11775 | 3/1999 |
| WO | WO 99/14236 | 3/1999 |
| WO | 1999024577 A1 | 5/1999 |
| WO | WO 99/21572 | 5/1999 |
| WO | WO 99/13095 | 7/1999 |
| WO | WO 1999/36568 | 7/1999 |
| WO | WO 99/42597 | 8/1999 |
| WO | WO 99/50637 | 10/1999 |
| WO | WO 99/58557 | 11/1999 |
| WO | WO 99/60119 | 11/1999 |
| WO | WO 2000/006745 | 2/2000 |
| WO | WO 2000/015665 | 3/2000 |
| WO | 200021989 A1 | 4/2000 |
| WO | WO 2000/023053 | 4/2000 |
| WO | WO 2000/075180 | 12/2000 |
| WO | WO 2000/078966 | 12/2000 |
| WO | WO 2003/000720 | 1/2001 |
| WO | WO 2001/63286 | 8/2001 |
| WO | 2001073443 A3 | 10/2001 |
| WO | WO 2001/72782 | 10/2001 |
| WO | WO 2001/072782 | 10/2001 |
| WO | WO 2001/070245 | 11/2001 |
| WO | WO 2001/080833 | 11/2001 |
| WO | WO 2001/090198 | 11/2001 |
| WO | WO 2001/090747 | 11/2001 |
| WO | WO 2002/016422 | 2/2002 |
| WO | WO 2002/054065 | 7/2002 |
| WO | WO 2002/072631 | 9/2002 |
| WO | WO 2002/089837 | 11/2002 |
| WO | WO 03/016905 | 2/2003 |
| WO | WO 2002/055992 | 3/2003 |
| WO | WO 2003/073097 | 9/2003 |
| WO | WO 2002/083906 | 10/2003 |
| WO | WO 2003/101473 | 12/2003 |
| WO | WO 2004/000873 | 12/2003 |
| WO | WO 2004/014957 | 2/2004 |
| WO | WO 2004-018520 | 3/2004 |
| WO | WO 2004-033497 | 4/2004 |
| WO | WO 2004/093905 | 11/2004 |
| WO | 2005003394 A2 | 1/2005 |
| WO | WO 2005/002621 | 1/2005 |
| WO | WO 2005/007689 | 1/2005 |
| WO | WO 2005/035567 | 4/2005 |
| WO | WO 2005/049073 | 6/2005 |
| WO | WO 2005/116051 | 12/2005 |
| WO | WO 2006/009838 | 1/2006 |
| WO | WO 2006/014292 | 2/2006 |
| WO | WO 2006/056027 | 6/2006 |
| WO | WO 2006/071990 | 7/2006 |
| WO | WO 2006/081826 | 8/2006 |
| WO | WO 2006/082387 | 8/2006 |
| WO | WO 2006/090283 | 8/2006 |
| WO | WO 2006/113622 | 10/2006 |
| WO | 2007015168 A2 | 2/2007 |
| WO | WO 2007/065098 | 6/2007 |
| WO | WO 2007/085266 | 8/2007 |
| WO | WO 2007/136778 | 11/2007 |
| WO | WO 2008/019366 | 2/2008 |
| WO | WO 2008/031133 | 3/2008 |
| WO | WO 2008/116468 | 10/2008 |
| WO | WO 2009/003492 | 1/2009 |
| WO | WO 2009/003493 | 1/2009 |
| WO | WO 2009/039854 | 4/2009 |
| WO | WO 2009/106073 | 9/2009 |
| WO | WO 2009/114207 | 9/2009 |
| WO | 2009126828 A2 | 10/2009 |
| WO | WO 2009/125231 | 10/2009 |
| WO | WO 2009/126816 | 10/2009 |
| WO | WO 2009/155535 | 11/2009 |
| WO | WO 2010/009735 | 1/2010 |
| WO | WO 2010/032022 | 3/2010 |
| WO | WO 2010/037395 | 4/2010 |
| WO | WO 2010/037397 | 4/2010 |
| WO | WO 2010/037402 | 4/2010 |

OTHER PUBLICATIONS

U.S. Appl. No. 08/374,468 dated Jan. 18, 1995, Boehringer Mannheim.
Altman et al., "Formation of functional peptide complexes of class II major histocompatibility complex proteins from subunits produced in *Escherichia coli*," Proc. Natl. Acad. Sci. USA, pp. 10330-10334, Nov. 1993, vol. 90.
Altman et al., "Phenotypic Analysis of Antigen-Specific T Lymphocytes," Science 274:94-97, 1996.
Appel et al., "Anergy induction by dimeric TCR ligands," J. Immunol., pp. 5279-5285, Apr. 15, 2001, vol. 166.
Appel et al., " Kinetics of T-cell receptor binding by bivalent HLA-DR-peptide complexes that activate antigen-specific human T-cells," J. Biol. Chem., pp. 312-321, Jan. 7, 2000, vol. 275.
Andersen et al., "Spontaneous cytotoxic T-cell responses against survivin MHC class I-restricted T-cell epttopes in situ as well as ex vivo in cancer patients," Cancer Res., vol. 61, pp. 5964-5968, Aug. 15, 2001.
Ausubel et al., "Characterization of in vivo expanded OspA-specific human T-cell clones," Clinical Immunology, Academic Press, pp. 313-322, Jun. 1, 2005 (Jun. 1, 2005), vol. 115, No. 3.
Bakker et al., "MHC multimer technology: Current status and future prospects," Current Opinion in Immunology, 17:428-433, 2005.
Barany et al., "Solid-phase peptide synthesis: A silver anniversary report," Int. J. Peptide Protein Res., 30:705-739, 1987 (Abstract Only).
Batard et al., "Dextramers: New generation of fluorescent MHC class I—peptide multimers for visualization of antigen-specific CD8<+> T cells," Journal of Immunological Methods, Elsevier Science Publishers, pp. 136-148, Mar. 20, 2006 (Mar. 20, 2006), vol. 310, No. 1-2.
Berger et al., "Circulation and hoimg of melanoma-reactive T cells to both cutaneous and visceral metastases after vaccinnation with monocyte-derived dendritic cells," Int. J. Cancer, pp. 229-237, 2004, vol. 111.
Bergmeier et al., "Innate and adoptive mucosal immunity in protection against HIV infection," Advances in Dental Research 2006, pp. 21-28, 2006, vol. 19, No. 1, XP002562924.
Bill et al., "Use of soluble MHC class II—peptide multimers to detect antigen-specific T cells in human disease," Arthritis Res., pp. 261-265, Feb. 28, 2002, vol. 4.
Bjorkman et al., "The foreign antigen binding site and T cell recognition regions of class I histocompatibility antigen," Nature 329:512-518, 1987.
Bogers, "CCR5 targeted SIV vaccination strategy preventing or inhabiting SIV infection," Vaccine, Butterworth Scientific, pp. 2974-2984, Aug. 13, 2004 (Aug. 13, 2004), vol. 22, No. 23-24. Guildford, GB.
Burlingham et al., "Soluble MHC, Immunoregulation, and tolerance: A progress report," Human Immunol., pp. 1316-1319, Dec. 2000, vol. 61.
Callan et al., "Direct Visualizing of Antigen.specific CD8+ T Cells during th ePRimary Immune Response to Epstein-Barr Virus in Vivo," J. Exp. Med., May 1998, pp. 1395-1402, vol. 187, No. 9.
Cameron et al., "Labeling antigen-specific DC4(+) T cells with class II MHC oligomers," J. Immunol. Methods, pp. 51-69, Oct. 1, 2002, vol. 268.
Carena et al., "Major Histocompatibility Complex Class I Molecules Modulate Activation Threshold and Early Signaling of T-Cell

(56) References Cited

OTHER PUBLICATIONS

Antigen Receptor-γδ Stimulated by Nonpeptidic Ligands," J. Exp. Med., Nov. 17, 1997, pp. 1769-1774, 186 (10).
Casares et al., "Antigen-specific downregulation of T cells by doxorubicin delivered through a recombinant MHC II—peptide chimera," Nature Biotech., pp. 142-147, Feb. 2001, vol. 19.
Cochran et al., "Receptor clustering and transmembrane signaling T cells," TIBS, pp. 304-310, May 2001, vol. 26 (Abstract Only).
Coles et al., "Memory CD8 T lymphocytes express inhibitory MHC-specific Ly49 receptors," Eur. J. Immunol. 30:236-244, 2000.
Constantin et al., "Major histocompatibility complex (MHC) tetramer technologt: An evaluation," Biol. Res. Nursing, pp. 115-127, Oct. 2002, vol. 4.
Dal Porto et al, "A soluble divalent class I major histocompatibility complex molecule inhibits alloreactive T cells at nanomolar concentrations," Porc. Natl. Acad. Sci. 90.6671-6675, 1993.
Dako: "MHC Dextramers" Internet Article Jul. 6, 2006 URL: pri.dako.com-00207_mhcdex_0406.pdf.
Devito-Haynes et al., "Soluble donor HLA class I and β2-m-free heavy chain in serum of lung transplant recipients: Steady-state levels and increases in patients with recurrent CMV infection, acute rejection episodes, and poor outcome," Human Immunol., pp. 1370-1382, Dec. 2000, vol. 61.
Drouin et al., "Searching for borrelial T-cell epitopes associated with antibiotic-refractory Lyme arthritis," Molecular Immunology, pp. 2323-2332, Jan. 11, 2008 (Jan. 11, 2008), vol. 45, No. 8, GB.
Ed. Charron, "HLA: Genetic diversity of HLA. Functional and Medical Implication," EDK Press, pages corresponding to Tables 1A and 1B, 1997.
Erout et al., "Preparation of Conjugates between Oligonucleotide and N-Vinylpyrrolidone-N-Acryoxysuccinimide Coplymers and Applications in Nucleic Acid Assays to Improve Sensitivity," Bioconjugate Chem. 1996, pp. 568-575, vol. 7.
Fields et al., "Solid phase peptide synthesis utilizing 9-fluorenylmethoxycarbonyl amino acids," Int. J. Peptide Res., 353:161-214, 1990 (Abstract Only).
Frayser et al., "Empty and peptide-loaded class II major histocompatibility complex proteins produced by expression in *Escherichia coli* and folding in vitro," Protein Expression and Purification, pp. 105-114, Feb. 1999, vol. 15 (Abstract Only).
Garboczi et al., "HLA-A2.peptide complexes: Refolding and crystallization of molecules expressed in *Escherichia coli* and complexed with single antigenic peptides," Proc. Natl. Acad. Sci., 89:3429-3433, 1992.
Gordon et al., "Applications of Combinatorial Technologies to Drug Discovery. 2. Combinatorial Organic Synthesis, Library Screening Strategies, and Future Directions," Journal of Medicinal Chemistry, 37 (10):1385-1401, 1994 (Abstract Only).
Haanen et al., "In situ detection of virus- and tumor-specific T-cell Immunity," Nature Medicine, Sep. 2000, pp. 1056-1060, vol. 6 (Abstract Only).
Hadrup et al., "Persistence of survivin specific T cells for seven years in a melanoma patient during complete remission," Cancer Biol. Ther., pp. 480-482, May 2006, vol. 5.
Houghten et al., "Generation and use of synthetic peptide combinatorial libraries for basic research and drug discovery," Nature, 354:84-86, 1991 (Abstract Only).
Huges et al., "Generation and use of alternative multimers of peptide-MHC complexes," Journal of Immunological Methods, 268:83-92, 2002.
Jung et al., "Multiple Peptide Synthesis Methods and their Applications," Angewandte Chemie, 31 (4):367-486, 1992 (Abstract Only).
Kalandadze et al., "Expression of Recombinant HLA-DR2 molecules," J. Biol. Chem., pp. 20156-20162, Aug. 16, 1996, vol. 271.
Knabel et al., "Reversible MHC multimer staining for functional isolation of T-cell populations and effective adoptive transfer," Nature Medicine, Nature Publishing Group, pp. 631-637, Jun. 1, 2002 (Jun. 1, 2006), vol. 8, No. 6.

König, "Interactions between MHC molecules and co-receptors of the TCR," Current Opinion in Immunology, pp. 75-83, 2002, vol. 14.
Kozono et al., "Production of soluble MHC class II proteins with covalently bound single peptides," Nature, pp. 151-154, May 12, 1994, vol. 369 (Abstract Only).
Kuroda et al., "Analysis of Gag-specific Cytotoxic T Lymphocytes in Simian Immunodeficiency Virus-intected Rhesus Monkeys by Cell Staining with Tetrameric Major Histocompatibility Complex Class I—Peptide Complex," J.Exp. Med., May 4, 1998, 1373-1381, vol. 187, No. 9.
Kuttler et al., "An Algorithm for the Prediction of Proteasomal Cleavages," J. Miol. Biol., 298:417-429, 2000.
Larsson, "Immunocytochemical detection systems," in Immunocytohemistry: Theory and Practice, pp. 77-145, CRC Press, 1988.
Lee et al., "Characterizatio of circulating T cells specific for tumor-associateda ntigens in melanoma patients," Nature Medicine, Jun. 1999, pp. 677-685, vol. 5, No. 6.
Lehner, "Allomicrovac: A combined microbicidal-immunising strategy against SIV and HIV infection," Vaccines for Humans, pp. 64-65, Dec. 5, 2008 (Dec. 5, 2008), XP0025629223, URL: http:--www.biblioteca.porto.ucp.pt-docbweb-MULTIMEDIA-ASSOCIA-PDF-VAC.PDF.
Ljunggren et al., "Empty MHC class I molecules come out in the cold," Nature 346:476-480, 1990.
Mallone et al., "MHC class II tetramers and the pursuit of antigen-specific T cells: Define, deviate, delete," Clin. Immunol., pp. 232-242, 2004, vol. 110.
Marchand et al., "Tumor regression responses in melanoma patients treated with a peptide encoded by gene MAGE-3,"Int. J. Cancer, 63:883-885, 1995.
Matsumura et al., "Emerging Principles for the Recognition of Peptide Antigen by MHC class I Molecules," Science 257:927-934, 1992.
Matsumura et al., "In vitro peptide binding to soluble empty calss I major histocompatibility complex molecules isolated from transfected *Drosophila melanogaster* cells," J. Biol. Chem., pp. 23589-23595, Nov. 25, 1992, vol. 267.
McCluskey et al., "T-cell activation by purified, soluble , class I MHC molecules: Requirement for polyvalency," *J. lmmunol.* 141(5): 1451-55, 1988.
McHeyser-Williams et al., "Tracking antigen-specific helper T cell responses," Current Opinion in Immunology, pp. 278-284, 1996, vol. 8.
Merrifield et al., "Instrument for Automated Synthesis of peptides," Analytical Chemistry, 38 (13):1905-1914, 1966 (Abstract Only).
Merrifield, "Solid Phase Synthesis," Science 232:341-347, 1986 (Abstract Only).
Meyer et al., "Direct enumeration of Borrelia-reactive CD4 T-cell ex vivo by using MHC class II tetramers," Proceedings of the National Academy of Sciences of USA. (PNAS), National Academy of Science, pp. 11433-11438, Oct. 10, 2000 (Oct. 10, 2000), vol. 97, No. 21, Washington D.C., US.
Mutis et al., "Tetrameric HLA class I—minor histocompatability antigen peptide complexes demnstrate minor histocompatibility antigen-specific cytoxic T lymphocytes in patients with graft-visus-host disease," Nature Medicine, Jul. 1999, pp. 839-842, vol. 5, No. 7.
Neudorfer et al., " Reversible HLA multimers (streptamers) for the isolation of human cytotoxic T lymphocytes functionally active against tumor- and virus-derived antigens," Journal of Immunological Methods, 320:119-131, 2007.
O'Herrin et al., "Analysis of the Expression of Peptide-Major Histocaompatibility Complexes using high affinity Soluble Divalent T-Cell Receptors," The Journal of Biological Chemistry, Oct. 20, 1997, pp. 1333-1345, vol. 186, No. 8.
Reich et al., "Stability of empty and peptide-loaded class II major histocompatibility complex molecules at neutral and endosomal pH: Comparison to class I proteins," Proc. Natl. Acad. Sci. USA, pp. 2495-2500, Mar. 1997, vol. 94.

(56) References Cited

OTHER PUBLICATIONS

Reijonen et al., "Use of HLA class II tetramers in tracking antigen-specific T cell and mapping T-call epitopes," pp. 282-288, 2003, vol. 29.

Scheirle et al., "Peptide binding to soluble HLA-DR4 molecules produced by insect cells," J. Immunol., pp. 1994-1999, Sep. 15, 1992, vol. 149 (Abstract Only).

Scheffold et al., "Recent Development in Flow Cytometry," Journal of Clinical Immunology, Aug. 2000, vol. 20, No. 6.

Sengupta et al., "Heat shock protein-mediated cross-presentation of exogenous HIV antigen on HLA class I and class II," Journal of Immunology, American Association of Immunologists, pp. 1987-1993, Aug. 1, 2004 (Aug. 1, 2004), vol. 173, No. 3.

Shambrook, Fritsch and Maniatis, "Molecular Cloning," Cold Spring Harbor Press, 1989, Index and Table of Contents pp. xi to xxxviii and I-1 to I-47.

Shields et al., "The Effect of Human $\beta$2-Microglobulin on Major Histocompatibility Complex I Peptide Loading and the Engineering of a High Affinity Variant," The Journal of Biological Chemistry, Oct. 23, 1998, pp. 28010-28018, vol. 273, No. 43.

Siiman et al., Bioconjugate Chem. 1999, pp. 1090-1106.

Skinner et al., "In situ tetramer staining," J. Immunol. Meth., pp. 29-34, 2002, vol. 268.

Sørensen et al., "Efficient tumor cell lysis mediated by a bcl-X(L) specific T cell clone isolated from a breast cancer patient," Cancer Immunology, Immunotherapy, Springer, pp. 527-533, Jul. 19, 2006 (Jul. 19, 2006), vol. 56, No. 4.

Stern et al., "The human class II MHC protein HLA-DR1 assembles as empty alpha beta heterodimers in the absence of antigenic peptide," Cell, pp. 465-477, Feb. 7, 1992, vol. 68 (Abstract Only).

Stratmann et al., "Susceptible MHC Alleles, not background genes, select an autoimmune T cell reactivity," The Journal of Clinical Investigation, pp. 902-914, Sep. 2003, vol. 112, No. 6.

Stöckel et al., "Refolding of human class II major histocompatibility complex molecules isolated from *Escherichia coli*", J. Biol. Chem., pp. 29571-29578, Nov. 25, 1994, vol. 269.

Sun et al., "MHC class I multimers," Arthritis Res., pp. 265-269, Jul. 2001, vol. 3.

Ugolini et al., "Regulation of T cell function by NK cell receptors for classical MHC class I molecules," Current Opinion in Immunology 12:295-300, 2000.

Valmori et al., "Enhanced generation of specific tumor-reactive CTL in vitro by selected Melan-A-MART-1 immunodominant peptide analogues," J. Immunol., pp. 1750-1758, Feb. 15, 1998, vol. 160.

Viola et al., "T-cell activation and the dynamic world of rafts.," APMIS 107:615-623, 1999.

Vyth-Dreese et al., "In situ visualization of antigen specific T cells in cryopreserved human tissues," J. Immunol. Meth., pp. 78-85, 2006, vol. 310.

White et al., "Soluble class I MHC with $\beta$2-microglobulin covalently linked peptides: Specific binding to a T cell hybridoma," J. Immunol., pp. 2671-2676, Mar. 1, 1999, vol. 162.

Xu et al., "MHC-peptide tetramer-based studies of T cell function," J. Immunol Meth., pp. 21-28, 2002, vol. 268.

Zhang et al., "Essential role of LAT in T cell development," Immunity 10:323-332, 1999.

U.S. Appl. No. 12/619,039, filed Nov. 16, 2009, Jorgen Scholler.

U.S. Appl. No. 12/644,554, filed Dec. 22, 2009, Liselotte Brix.

U.S. Appl. No. 12/647,747, filed Dec. 18, 2009, Kivin Jacobsen.

U.S. Appl. No. 12/680,248, filed Mar. 26, 2010, Jorgen Scholler.

Alp et al., "Fine specificity of cellular immune responses in humans to human cytomegalovirus immediate-early 1 protein", Journal of Virology, vol. 65, No. 9, 1991 pp. 4812-4820.

Bleesing, et al., "Cell Function-Based Flow Cytometry" Seminars in Hematology, Apr. 2001, pp. 169-178, vol. 38, No. 2.

Bross, et al., "Approval summary: Gemtuzumab ozogamicin in relapsed acute myeloid leukemia", Clin. Cancer Res., 2001, 7:1490-1496.

Cecconi, et al., "Use of MHC Class II Tetramers to Investigate CD4 + T Cell Responses: Problems and Solutions," Cytometry, 2008, Part A 73, No. 11, pp. 1010-10018.

Chattopadhyay, et al.,"Techniques to improve the direct Ex Vivo detection of low frequency antigen-specific CD8+T cells with peptide-major histocompatibility complex class I tetramers," Cytometry, 2008, Part A, vol. 73, pp. 1001-1009.

Drouin, et al., "Molecular Characterization of the OspA161-175 T cell epitope associated with the treatment-resistant Lyme Arthritis: difference among the three pathogenic species of *Borrelia burgdorferu sensu lato*", Journal of Autoimmunology, 2004, vol. 23, No. 3, pp. 281-292.

Ferré, et al., "Purification of correctly oxidized MHC class I heavy-chain molecules under denaturing conditions: A novel strategy exploiting disulfide assisted protein folding", Protein Science, 2003, 12, pp. 551-559.

Fornas, et al., Flow Cytometry Counting of CD34+ cells in whole blood, Nature Medicine, 6 (2000) 7:833-836.

Heijnen, et al., " Enumeration of Antigen-Specific CD8+ T Lymphocytes by Single-Platform, HLA Tetramer-Based Flow Cytometry: A European Multicenter Evaluation", Clinical Cytometry, 2004, pp. 1-13, vol. 62B.

International Search report dated May 6, 2007 in International Application No. PCT/DK2007/000045.

Lissina, et al., "Protein Kinase Inhibitors Substantially Improve the Physical Detection of T-Cells with Peptide-MHC Tetramers," J. Immunol. Methods, 2009, vol. 340, pp. 11-24.

Maloney, et al., "IDEC-C2B8 (Rituximab) anti-CD20 monoclonal antibody therapy in patients with relapsed low-grade non-Hodgkin's lymphoma," Sep. 1997, Blood, 90 (6):21 :88-2195.

Melenhorst, et al.," Detection of Low Avidity CD8+ T Cell Populations with Coreceptor-Enhanced Peptide-Major Histompatibility Complex Class I Tetramers", j. Immunol. Methods, 2008, vol. 338, No. 1-2, pp. 31-39.

Vollers, et al., "Class II Major Histocompatibility Complex Tetramer Staining: Progress, Problems, and Prospects," Immunology, 2008, vol. 123, pp. 305-313.

Weichsel, et al. ,"Profound Inhibition of Antigen-Specific T-Cell Effector Functions by Dasatinib," Clin. Cancer Res.2008, vol: 14, pp. 2484-2491.

Wolfl, et al., "Quantitation of MHC Tetramer-Positive Cells From Whole Blood: Evaluation of Single-Platform, Six-parameter Flow Cytometric Method", Cytometry Part A, 2004, pp. 120-130, vol. 57A.

Akiyama, "Analysis of HLA-A24-restricted CMVpp65 peptide-specific CTL with HLA-A*2402-CMVpp65 tetramer," Immunology Letters, vol. 95, Issue 2, pp. 199-205 (2004).

Celis, "Identification of potential CTL Epitopes of Tumor-Associated Antigen Mage-1 for Five Common HLA-A Alleles," Molecular Immunology, vol. 31, No. 18, pp. 1423-1430 (1994).

Chen, "Modulation of CD1d-restricted NKT cell responses by CD4," Journal of Leukocyte Biology, vol. 82, pp. 1455-1465 (2007).

DiBrino, "Endogenous peptides bound to HLA-A3 possess a specific combination of anchor residues that permit identification of potential antigenic peptides," Proc. Natl. Acad. Sci. USA, vol. 90, pp. 1508-1512 (1993).

Drake, "Cutting Edge: Lipid Raft Integrity Affects the Efficiency of MHC Class I Tetramer Binding and Cell Surface TCR Arrangement on CD8+ T Cells," The Journal of Immunology, vol. 166, No. 12, pp. 7009-7013 (2001).

He, "Procedure for preparing peptide-major histocompatibility complex tetramers for direct quantification of antigen specific cytotoxic T lymphocytes," World J Gastroenterol, vol. 11, No. 27, pp. 4180-4187 (2005).

Kao, "Loss of CD8 and TCR binding to Class I MHC ligands following T cell activation," International Immunology, vol. 17, No. 12, pp. 1607-1617 (2005).

Karin, "Reversal of Experimental Autoimmune Encephalomyelitis by a Soluble Peptide Variant of a Myelin Basic Protein Epitope: T Cell Receptor Antagonism and Reduction of Interferon $\gamma$ and Tumor Necrosis Factor $\alpha$ Production," J. Exp. Med., vol. 180, pp. 2227-2237 (1994).

(56) References Cited

OTHER PUBLICATIONS

Kronenberg, "The Unconventional Lifestyle of NKT Cells," Nature Reviews Immunology, vol. 2, pp. 557-568 (2002).
Nepom, "MHC Multimers: expanding the clinical toolkit," Clinical Immunology, vol. 106, pp. 1-4 (2003).
Parker, "Peptide Binding to HLA-A2 and HLA-B27 Isolated from *Escherichia coli*," The Journal of Biological Chemistry, vol. 267, pp. 5451-5459 (1992).
Rognan, "Rational design of nonnatural peptides as high-affinity ligands for the HLA-B*2705 human leukocyte antigen," Proc. Natl. Acad. Sci. USA, vol. 92, pp. 753-757 (1995).
Ruan, "Preparation of HLA-A*0201 NLVPMVATV peptide tetramers and application to detect cytomegalovirus specific CTL," Zhonghua Weishengwuxue He Mianyixue Zazhi, vol. 26., No. 9, pp. 855-858 (2006)—English Abstract Only.
Ruan, "Improved preparation of class I HLA tetramers and their use in detecting CMV-specific CTL," Journal of Immunological Methods, vol. 312, pp. 148-156 (2006).
Schueler-Furman, "Structure-based prediction of binding peptides to MHC class I molecules: Application to a broad range of MHC alleles," Protein Science, vol. 9, pp. 1838-1846 (2000).
Theisen, "Evolution of the borrelia burgdorferi outer surface protein OspC," Journal of Bacteriology vol. 177, No. 11, pp. 3036-3044 (1995).
Weinberg, "The Biology of Cancer," Garland Science, pp. 737-747 (2007).
Wulff, "Guide to Flow Cytometry," Dako Educational Guide, dako. com, (2006) pp. i-v, 1-21.
Andersen, "Parallel detection of antigen-specific T-cell responses by combinatorial encoding of MHC multimers," Nat Protoc. (2012).
Bauer, Maximizing Immune Responses: The Effects of Covalent Peptide Linkage to Beta-2-Microglobulin, Oncology Research, vol. 17, pp. 205-216 (2008).
Cortez-Gonzales, Immunogenic HLA-B7-restricted peptides of hTRT. Intl Immunology, vol. 18 No. 12 pp. 1707-1718 (2006).
Desrosiers, "Prospects for an AIDS vaccine," Nature Medicine, vol. 10, No. 3, (2004).
Greten, "Peptide-beta-2-microglubulin-MHC fusion molecules bind antigen-specific T cells and can be used for multivalent MHC-Ig complexes," J. Immunological Methods, 271,pp. 125-135 (2002).
Hackett, "Frontiers in peptide-MHC class II multimer technology," Nature Immunology, vol. 3, No. 10 (2002).
Lauritsen, Two distinct pathways exist for down-regulation of the TCR, J, Immunology, 161:260-7 (1998).
Matthews, "Prospects for Development of a Vaccine Against HTLV-III-Related Disorders," AIDS Research and Human Retroviruses, vol. 3 Supplement I, (1987).
Nikolich-Zugich, "The many important facets of t-cell repertoire diversity. Nature Reviews Immunology," vol. 4, 123-132 (2004).
Oka, "Induction of WT1 (Wilms' tumor gene)-specific cytotoxic T lymphocytes by WT1 peptide vaccine and the resultant cancer regression," PNAS, vol. 101 No. 38, 13885-13890 (2004).
Rammensee, "MHC ligands and peptide motifs: first listing. Immunogenetics," 41:178-228 (1995).
Hadrup, "Parallel detection of antigen-specific T-cell responses by multidimensional encoding of MHC multimers", Nature Methods (Nature Publishing Group), Basingstoke GB, vol. 6, No. 7, doi:10.1038/NMETH.1345, ISSN 1548-7091, pp. 520-528, (2009).
Schroers, "Identification of HLA DR7-restricted epitopes from human telomerase reverse transcriptase recognized by CD4+ T-helper cells," Cancer Research 62, 2600-2605, (2002).
Speiser, In Vivo Activation of Melanoma-Specific CD8(+) T Cells by Endogenous Tumor Antigen and Peptide Vaccines. A Comparison to Virus-Specific T Cells, Eur. J. Immunol. 32: 731-741 (2002).
Stoeva, "Multiplexed Detection of Protein Cancer Markers with Biobarcoded Nanoparticle Probes", J. American Chemical Society, vol. 128, No. 26, doi:10.1021/JA0613106, ISSN 0002-7863, pp. 8378-8379, (2006).
Sang, "Immuno-PCR: Very sensitive antigen detection by means of specific antibody-DNA conjugates," Science American Association for the Advancement of Science, UA, vol. 258, No. 5079, 120-122 (1992).
Xu, "Preparation and Characterization of HLA-A *0201 Tretamer Loaded with IE-1 316-324 Antigenic Peptide of Human Cytomegalovirus," Cullular & Molecular Immunology, vol. 3, No. 5, pp. 367-371 (2006).
Yang et al. "Immunization with recombinant macaque major histocompatibility complex class I and II and human immunodeficiency virus gp140 inhibits simian-human immunodeficiency virus infection in macaques," Journal of General Virology, vol. 93, pp. 1506-1518 (2012).
Le Doussal et al., "Phage display of peptide/major histocompatibility complex", Journal of Immunological Methods, vol. 241, issues 1-2, 31, pp. 147-158, 2000.
Seneci, Pierfausto, "Encoding Techniques for Pool Libraries of Small Organic Molecules", Journal of Receptors and Signal Transduction, vol. 21, 2001—Issue 4. pp. 409-445. doi.org/10.1081/RRS-100107925.

* cited by examiner

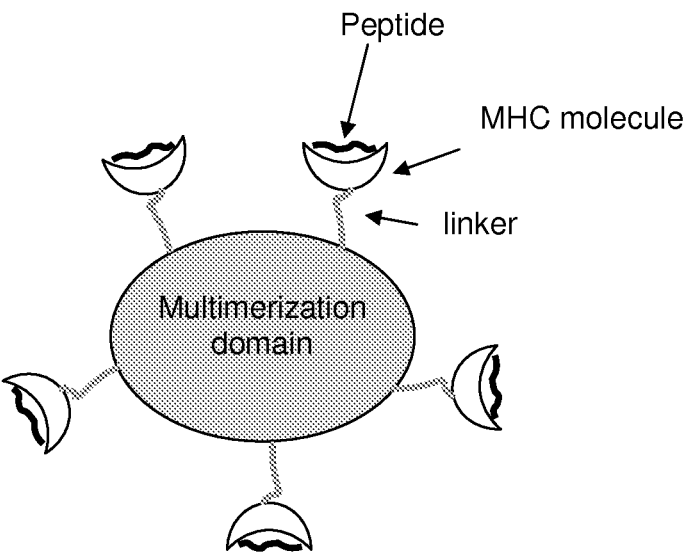
Fig 1. Schematic representation of MHC multimer

Fig. 2.
Program for peptide sequence motifs prediction

Imports System.IO

Public Class Form1

Dim TRACE_LOG = ""
   Dim CR = "-"
   Dim BACKSLASH = "\"
   Dim COLON = ":"
   Dim SPACE = " "

Private Sub Button_valgmappe_Click(ByVal sender As System.Object, ByVal e As System.EventArgs) Handles Button_valgmappe.Click
      Dim fdlg As FolderBrowserDialog = New FolderBrowserDialog()

If fdlg.ShowDialog() = Windows.Forms.DialogResult.OK Then
         Txt_mappe.Text = fdlg.SelectedPath
      End If
   End Sub Private Sub Button_gem_Click(ByVal sender As System.Object, ByVal e As System.EventArgs) Handles Button_gem.Click
      If Txt_sekvens.Text = Nothing Then
         MessageBox.Show("Indtast sekvens")
         Exit Sub
      End If
      If Txt_fil.Text = Nothing Then
         MessageBox.Show("Indtast filnavn")
         Exit Sub
      End If
      If Txt_mappe.Text = Nothing Then
         MessageBox.Show("Vælg mappe")
         Exit Sub
      End If TRACE_LOG = Txt_mappe.Text + "/" + Txt_fil.Text + ".txt"
      If File.Exists(TRACE_LOG) Then
         MessageBox.Show("Filen findes allerede og kan ikke overskrives")
         Exit Sub
      End If Dim n = Txt_sekvens.Text.Length
      Trace_skriv("Sequence length: " & n)
      Trace_skriv("CR")

```
Trace_skriv("CR")

Dim min = CInt(Txt_min.Text)
Dim max = CInt(Txt_max.Text)
Dim j As Integer
Dim i As Integer
Dim tmptxt As String
Dim peptid As String For j = min To max
    Trace_skriv(j & " mers:")
    Trace_skriv("CR")
    tmptxt = ""
    For i = 0 To n - j
        peptid = Txt_sekvens.Text.Substring(i, j)
        If CheckBox_validering.Checked Then
            If valideret(peptid) Then
                tmptxt = tmptxt + peptid & CR
            End If
        Else
            tmptxt = tmptxt + peptid & CR
        End If
    Next
    Trace_skriv(tmptxt)
    Trace_skriv("CR")
    Trace_skriv("CR")
Next End Sub Private Function valideret(ByVal peptid As String)
    If CheckBox_validering_stopkodon.Checked Then
        If InStr(peptid, "*") Then
            Return False
        Else
            Return True
        End If
    Else
        Return True
    End If
End Function Private Sub Form1_Load(ByVal sender As System.Object, ByVal e As System.EventArgs) Handles MyBase.Load
    Txt_min.Text = 8
    Txt_max.Text = 11
```

Fig. 2 continued

```
    End Sub

Friend Sub Trace_skriv(ByVal texttoadd As String)
        Dim logtext() As String
        Dim fileline() As String
        Dim fs As StreamWriter
        Dim strace As New StackTrace(True)
        Try
            If Not File.Exists(TRACE_LOG) Then
                fs = File.CreateText(TRACE_LOG)
                fs.Write("Trace Log " & Format(Now) & CR & CR)
                fs.Flush()
                fs.Close()
            End If
            logtext = strace.GetFrame(1).ToString.Split(Space)
            fileline = logtext(6).Split(BACKSLASH)
            Dim i As Integer = fileline.GetUpperBound(0)
            fs = File.AppendText(TRACE_LOG)
            If texttoadd = "CR" Then
                fs.WriteLine()
            Else
                Dim tmp = Split(texttoadd, CR)
                If UBound(tmp) = 0 Then
                    fs.Write(tmp(0))
                Else
                    For i = LBound(tmp) To UBound(tmp) - 1
                        fs.Write(tmp(i))
                        If Me.CheckBox_semikolon.Checked Then
                            fs.Write("; ")
                        End If
                        If Me.CheckBox_linie.Checked And i < UBound(tmp) - 1 Then
                            fs.WriteLine()
                        End If
                    Next
                End If
            End If
            fs.Flush()
            fs.Close()
        Catch ex As Exception
            MsgBox(ex.ToString)
        End Try
    End Sub
End Class
```

Fig. 2 continued

Fig. 3.
Full List of HLA Class I alleles assigned as of January 2007 from
http://www.anthonynolan.org.uk/HIG/lists/class1list.html

```
HLA-AHLA-BHLA-CHLA-EHLA-FHLA-G
A*01010101B*070201Cw*010201E*01010101F*01010101G*01010101
A*01010102NB*070202Cw*010202E*01010102F*01010102G*01010102
A*010102B*070203Cw*010203E*01010103F*01010103G*01010103
A*010103B*070204Cw*010204E*01030101F*01010104G*01010104
A*010104B*0703Cw*0103E*01030102F*01010105G*01010105
A*0102B*0704Cw*0104E*010302F*01010106G*01010201
A*0103B*070501Cw*0105E*010303F*01010107G*01010202
A*0104NB*070502Cw*0106E*010304F*01010108G*010103
A*0106B*070503Cw*0107E*0104F*01010201G*010104
A*0107B*0706Cw*0108F*01010202G*010105
A*0108B*0707Cw*0109F*01010203G*010106
A*0109B*0708Cw*0110F*01010204G*010107
A*0110B*0709Cw*0111F*01010205G*010108
A*0111NB*0710Cw*0112F*01010301G*010109
A*0112B*0711Cw*0113F*01010302G*010110
A*0113B*0712Cw*020201F*01010303G*0102
A*0114B*0713Cw*020202F*01010304G*0103
A*0115NB*0714Cw*020203F*0102G*010401
A*0116NB*0715Cw*020205F*01030101G*010402
A*0117B*0716Cw*0203F*01030102G*010403
A*0118NB*0717Cw*0204F*0104G*0105N
A*0119B*0718Cw*0205G*0106
A*0120B*0719Cw*0206G*0107
A*02010101B*0720Cw*0207
A*02010102LB*0721Cw*0208
A*020102B*0722Cw*0209
A*020103B*0723Cw*0210
A*020104B*0724Cw*0211
A*020105B*0725Cw*0212
A*020106B*0726Cw*0213
A*020107B*0727Cw*0214
A*020108B*0728Cw*0215
A*020109B*0729Cw*0216
A*020110B*0730Cw*0217
A*020111B*0731Cw*030201
A*020112B*0732Cw*030202
A*0202B*0733Cw*030301
A*020301B*0734Cw*030302
A*020302B*0735Cw*030303
A*0204B*0736Cw*030304
A*0205B*0737Cw*030305
```

A*0206O1B*0738Cw*030401
A*0206O2B*0739Cw*030402
A*0206O3B*0740Cw*030403
A*0207B*0741Cw*030404
A*0208B*0742Cw*030405
A*0209B*0743Cw*0305
A*0210B*0744Cw*0306
A*0211B*0745Cw*0307
A*0212B*0746Cw*0308
A*0213B*0747Cw*0309
A*0214B*0748Cw*0310
A*0215NB*0749NCw*031101
A*0216B*0750Cw*031102
A*0217O1B*0751Cw*0312
A*0217O2B*080101Cw*0313
A*0218B*080102Cw*0314
A*0219B*080103Cw*0315
A*0220O1B*0802Cw*0316
A*0220O2B*0803Cw*0317
A*0221B*0804Cw*0318
A*0222B*0805Cw*0319
A*0224B*0806Cw*0320N
A*0225B*0807Cw*0321
A*0226B*0808NCw*0322Q
A*0227B*0809Cw*0323
A*0228B*0810Cw*0324
A*0229B*0811Cw*0325
A*0230B*0812Cw*0326
A*0231B*0813Cw*0327
A*0232NB*0814Cw*0328
A*0233B*0815Cw*0329
A*0234B*0816Cw*0330
A*0235O1B*0817Cw*0331
A*0235O2B*0818Cw*0332
A*0236B*0819NCw*0333
A*0237B*0820Cw*0334
A*0238B*0821Cw*0335
A*0239B*0822Cw*04010101
A*0240B*0823Cw*04010102
A*0241B*0824Cw*040102
A*0242B*0825Cw*040103
A*0243NB*0826Cw*040104
A*0244B*0827Cw*0403
A*0245B*0828Cw*040401
A*0246B*0829Cw*040402
A*0247B*0830NCw*0405

Fig. 3 continued

A*0248B*0831Cw*0406
A*0249B*1301Cw*0407
A*0250B*130201Cw*0408
A*0251B*130202Cw*0409N
A*0252B*130203Cw*0410
A*0253NB*1303Cw*0411
A*0254B*1304Cw*0412
A*0255B*1306Cw*0413
A*0256B*1307NCw*0414
A*0257B*1308Cw*0415
A*0258B*1309Cw*0416
A*0259B*1310Cw*0417
A*0260B*1311Cw*0418
A*0261B*1312Cw*0419
A*0262B*1313Cw*0420
A*0263B*1314Cw*0421
A*0264B*1315Cw*0423
A*0265B*1316Cw*0424
A*0266B*1317Cw*050101
A*0267B*1401Cw*050102
A*0268B*140201Cw*050103
A*0269B*140202Cw*0502
A*0270B*1403Cw*0503
A*0271B*1404Cw*0504
A*0272B*1405Cw*0505
A*0273B*140601Cw*0506
A*027401B*140602Cw*0507N
A*027402B*1407NCw*0508
A*0275B*15010101Cw*0509
A*0276B*15010102NCw*0510
A*0277B*150102Cw*0511
A*0278B*150103Cw*0512
A*0279B*150104Cw*0513
A*0280B*1502Cw*0514
A*0281B*1503Cw*0515
A*0282NB*1504Cw*06020101
A*0283NB*1505Cw*06020102
A*0284B*1506Cw*060202
A*0285B*1507Cw*0603
A*0286B*1508Cw*0604
A*0287B*1509Cw*0605
A*0288NB*1510Cw*0606
A*0289B*151101Cw*0607
A*0290B*151102Cw*0608
A*0291B*151103Cw*0609
A*0292B*1512Cw*0610

Fig. 3 continued

```
A*0293B*1513Cw*0611
A*0294NB*1514Cw*0612
A*0295B*1515Cw*0613
A*0296B*1516Cw*0614
A*0297B*15170101Cw*070101
A*0299B*15170102Cw*070102
A*030101011B*15702Cw*070103
A*03010102NB*1518Cw*070104
A*03010103B*1519Cw*070105
A*030102B*1520Cw*070106
A*030103B*1521Cw*070107
A*030104B*1523Cw*07020101
A*030105B*1524Cw*07020102
A*0302B*1525Cw*07020103
A*0303NB*1526NCw*0703
A*0304B*1527Cw*070401
A*0305B*1528Cw*070402
A*0306B*1529Cw*0705
A*0307B*1530Cw*0706
A*0308B*1531Cw*0707
A*0309B*1532Cw*0708
A*0310B*1533Cw*0709
A*0311NB*1534Cw*0710
A*0312B*1535Cw*0711
A*0313B*1536Cw*0712
A*0314B*1537Cw*0713
A*0315B*1538Cw*0714
A*0316B*1539Cw*0715
A*0317B*1540Cw*0716
A*0318B*1542Cw*0717
A*0319B*1543Cw*0718
A*0320B*1544Cw*0719
A*0321NB*1545Cw*0720
A*0322B*1546Cw*0721
A*0323B*1547Cw*0722
A*0324B*1548Cw*0723
A*0325B*1549Cw*0724
A*0326B*1550Cw*0725
A*110101B*1551Cw*0726
A*110102B*1552Cw*0727
A*110103B*1553Cw*0728
A*110104B*1554Cw*0729
A*110105B*1555Cw*0730
A*110106B*1556Cw*0731
A*110201B*1557Cw*0732N
A*110202B*1558Cw*0733N
```

Fig. 3 continued

A*1103B*1560Cw*0734
A*1104B*1561Cw*0735
A*1105B*1562Cw*0736
A*1106B*1563Cw*0737
A*1107B*1564Cw*0738
A*1108B*1565Cw*0739
A*1109B*1566Cw*0740
A*1110B*1567Cw*0741
A*1111B*1568Cw*0742
A*1112B*1569Cw*0743
A*1113B*1570Cw*0744
A*1114B*1571Cw*0745
A*1115B*1572Cw*080101
A*1116B*1573Cw*080102
A*1117B*1574Cw*0802
A*1118B*1575Cw*0803
A*1119B*1576Cw*0804
A*1120B*1577Cw*0805
A*1121NB*1578Cw*0806
A*1122B*1579NCw*0807
A*1123B*1580Cw*0808
A*1124B*1581Cw*0809
A*1125B*1582Cw*0810
A*1126B*1583Cw*0811
A*1127B*1584Cw*0812
A*1128B*1585Cw*0813
A*1129B*1586Cw*0814
A*2301B*1587Cw*120201
A*2302B*1588Cw*120202
A*2303B*1589Cw*120203
A*2304B*1590Cw*12030101
A*2305B*1591Cw*12030102
A*2306B*1592Cw*120302
A*2307NB*1593Cw*120303
A*2308NB*1594NCw*120304
A*2309B*1595Cw*120401
A*2310B*1596Cw*120402
A*2311NB*1597Cw*1205
A*2312B*1598Cw*1206
A*2313B*1599Cw*1207
A*2314B*9501Cw*1208
A*240201O1B*9502Cw*1209
A*240201O2LB*9503Cw*1210
A*240202B*9504Cw*1211
A*240203B*9505Cw*1212
A*240204B*9506Cw*1213

Fig. 3 continued

A*2402O5B*9507Cw*1214
A*2402O6B*9508Cw*1215
A*2402O7B*9509Cw*1216
A*2402O8B*9510Cw*1217
A*2402O9B*9511NCw*1218
A*2402l0B*9512Cw*1219
A*240211B*9513Cw*140201
A*240212B*9514Cw*140202
A*240213B*9515Cw*140203
A*240301B*9516Cw*140204
A*240302B*9517Cw*1403
A*2404B*9518Cw*1404
A*2405B*9519Cw*1405
A*2406B*9520Cw*1406
A*2407B*9521Cw*1407N
A*2408B*9522Cw*1408
A*2409NB*180101Cw*150201
A*2410B*180102Cw*150202
A*2411NB*180103Cw*150203
A*2413B*1802Cw*1503
A*2414B*1803Cw*1504
A*2415B*1804Cw*150501
A*2417B*1805Cw*150502
A*2418B*1806Cw*150503
A*2419B*1807Cw*150504
A*2420B*1808Cw*1506
A*2421B*1809Cw*1507
A*2422B*1810Cw*1508
A*2423B*1811Cw*1509
A*2424B*1812Cw*1510
A*2425B*1813Cw*1511
A*2426B*1814Cw*1512
A*2427B*1815Cw*1513
A*2428B*1817NCw*1514
A*2429B*1818Cw*1515
A*2430B*1819Cw*1516
A*2431B*1820Cw*1517
A*2432B*1821Cw*160101
A*2433B*1822Cw*160102
A*2434B*1823NCw*1602
A*2435B*1824Cw*160401
A*2436NB*2701Cw*1606
A*2437B*2702Cw*1607
A*2438B*2703Cw*1608
A*2439B*270401Cw*1609
A*2440NB*270402Cw*1701

B*5804
B*5805
B*5806
B*5807
B*5808
B*5809
B*5810N
B*5811
B*5812
B*5813
B*5814
B*5901
B*5902
B*670101
B*670102
B*6702
B*7301
B*7801
B*780201
B*780202
B*7803
B*7804
B*7805
B*8101
B*8102
B*8201
B*8202
B*8301
HLA-H HLA-J HLA-K HLA-L HLA-P
H*01010101 J*01010101 K*01010101 L*01010101 P*01010101
H*01010102 J*01010102 K*01010102 L*01010102 P*01010102
H*01010103 J*01010103 K*01010103 L*01010103 P*02010101
H*0102 J*01010104 K*01010104 L*010102 P*02010102
H*02010101 J*01010105 K*0102 L*0102
H*02010102 J*01010106 K*0103
H*0202 J*01010107
H*0203 J*01010108
H*0204 J*0201
H*0205
H*0206
H*0301

Fig. 3 continued

Fig. 4.
Top 30 HLA class 1 allele frequency in human ethnic groups

% chance of allele expressed in an individual

Top 30 expressed alleles

| Allele | Caucasian | Allele | African-American | Allele | Hispanic | Allele | Oriental |
|---|---|---|---|---|---|---|---|
| A*0201 | 45.6% | C*0401 | 29.0% | A*0201 | 37.1% | A*1101 | 38.4% |
| C*0701 | 27.7% | C*0701 | 25.4% | C*0401 | 25.4% | A*2402 | 33.7% |
| A*0101 | 27.4% | C*0602 | 23.0% | A*2402 | 24.9% | C*0702 | 33.3% |
| A*0301 | 23.8% | A*0201 | 22.3% | C*0702 | 24.2% | C*0102 | 27.7% |
| C*0702 | 21.5% | A*2301 | 20.7% | C*0701 | 20.8% | A*3303 | 23.3% |
| C*0401 | 21.2% | C*0202 | 19.0% | C*0304 | 14.4% | C*0801 | 21.6% |
| B*4402 | 20.2% | A*0301 | 18.7% | A*0301 | 14.3% | C*0304 | 19.9% |
| B*0702 | 18.1% | C*0702 | 18.1% | B*0702 | 13.2% | A*0201 | 18.1% |
| B*0801 | 18.1% | B*5301 | 18.1% | B*3501 | 12.8% | B*4001 | 15.2% |
| C*0501 | 17.2% | B*0702 | 15.8% | C*0602 | 12.3% | C*0401 | 14.0% |
| C*0304 | 16.8% | C*1601 | 15.7% | C*0501 | 11.9% | B*5801 | 13.3% |
| C*0602 | 15.7% | B*1503 | 13.9% | A*0101 | 11.4% | B*4601 | 12.7% |
| A*1101 | 15.3% | B*5801 | 13.5% | A*1101 | 11.0% | B*5101 | 12.4% |
| B*4001 | 13.6% | A*6802 | 12.7% | B*5101 | 10.8% | C*0302 | 12.0% |
| A*2402 | 12.1% | C*1701 | 11.7% | C*1601 | 10.6% | B*3802 | 11.4% |
| B*3501 | 10.7% | B*4501 | 10.8% | B*4403 | 9.9% | A*0207 | 11.0% |
| C*0303 | 10.6% | B*4201 | 10.5% | C*0102 | 9.7% | B*1501 | 9.4% |
| B*5101 | 10.4% | A*3001 | 10.4% | A*2902 | 9.7% | A*0206 | 9.3% |
| C*1203 | 9.9% | B*3501 | 10.1% | C*0802 | 9.3% | C*0303 | 9.2% |
| B*1501 | 9.6% | A*0101 | 10.0% | B*1801 | 9.1% | B*1502 | 9.1% |
| A*2902 | 8.9% | C*0304 | 9.3% | A*3101 | 8.9% | A*0203 | 8.8% |
| A*2601 | 8.2% | A*3002 | 9.2% | B*5201 | 8.6% | B*4403 | 8.6% |
| A*3201 | 8.2% | B*0801 | 8.5% | B*1402 | 8.6% | C*1402 | 8.4% |
| C*0802 | 7.7% | A*3402 | 8.4% | C*0202 | 7.6% | B*3501 | 7.2% |
| A*2501 | 7.5% | A*7401 | 8.4% | C*1203 | 7.6% | C*0602 | 7.0% |
| B*5701 | 7.1% | A*3303 | 8.0% | A*2601 | 7.6% | B*5401 | 6.9% |
| B*1402 | 6.7% | C*1801 | 7.3% | A*6801 | 7.1% | B*1301 | 6.6% |
| C*0202 | 6.6% | A*2902 | 7.2% | B*0801 | 7.0% | B*4002 | 6.3% |
| B*1801 | 6.4% | B*4403 | 6.9% | A*3002 | 6.8% | B*5502 | 6.3% |
| B*4403 | 6.4% | B*4901 | 6.9% | B*4402 | 6.5% | A*2601 | 6.0% |

Data from HLA Matchmaker, http://tpis.upmc.edu/tpis/HLAMatchmaker/

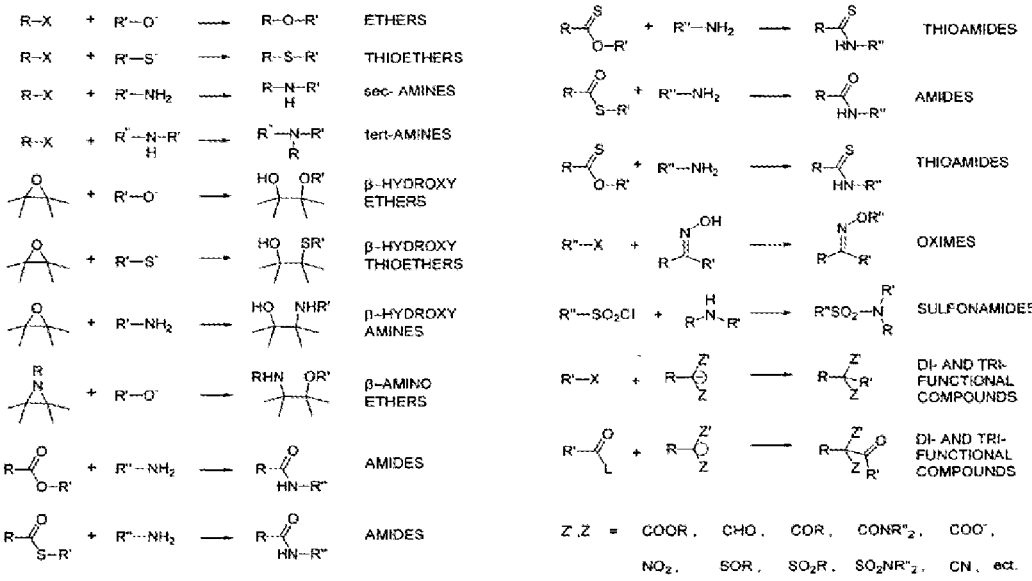
Fig. 5. Reactive groups and the bonds formed upon their reaction.

B
Addition to carbon-carbon multiplebonds
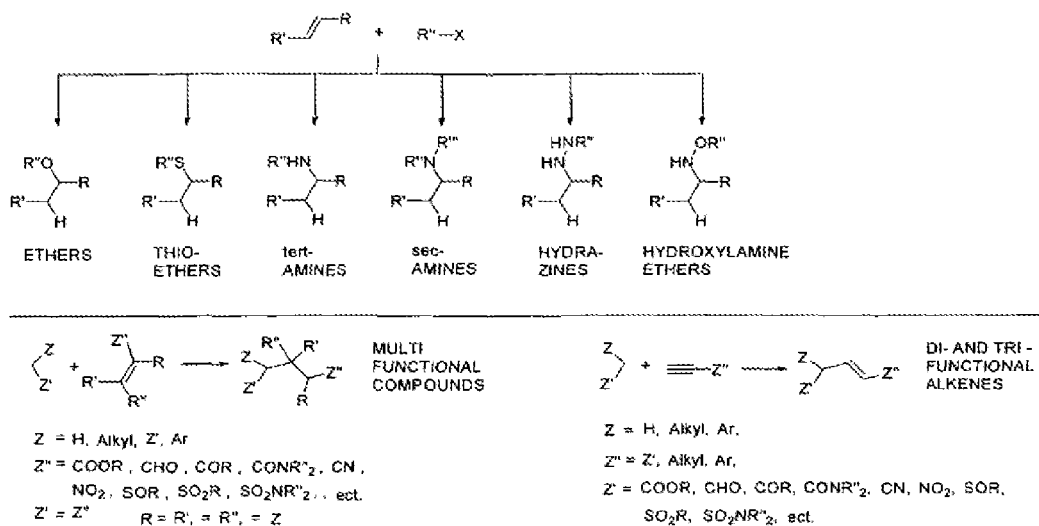
Cycloaddition to multiple bounds
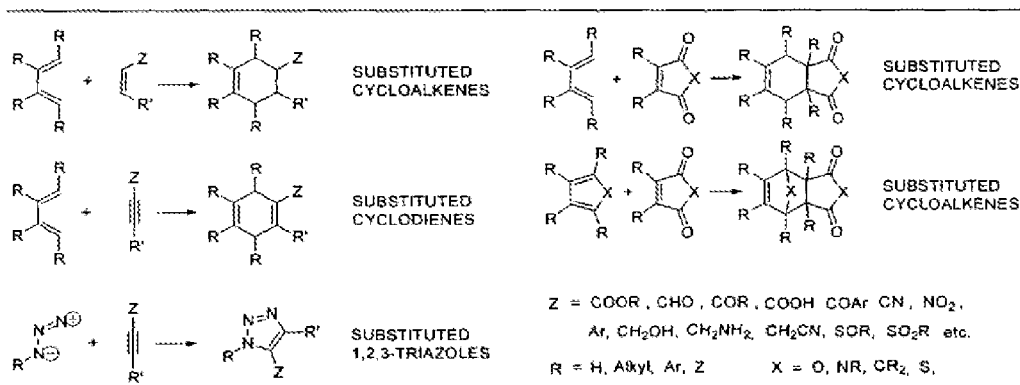
Fig. 5., continued. Reactive groups and the bonds formed upon their reaction.

C

Addition to carbon-hetero multiple bonds

Fig. 5., continued. Reactive groups and the bonds formed upon their reaction.

Fig. 6. Cleavable linkers, conditions for cleaving them and the resulting products of the cleavage.

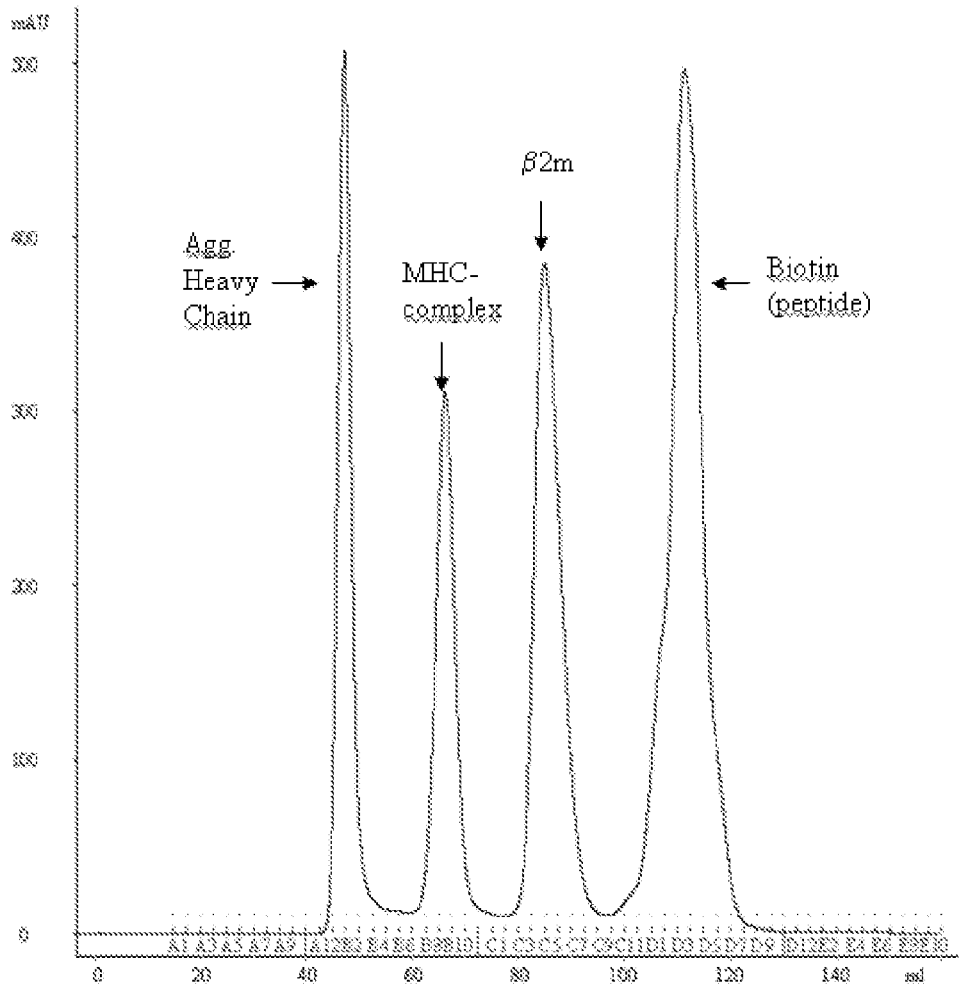
Fig 7. Size exclusion chromatography of folded HLA-A*0201-β2m-QLFEELQEL-complex.

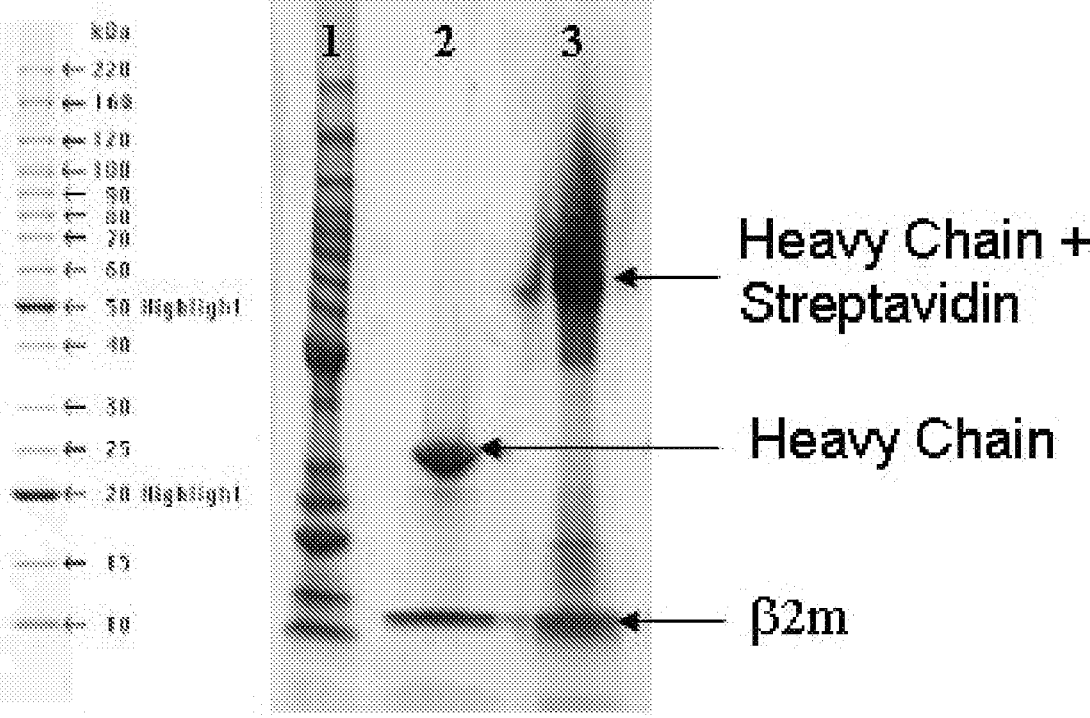
Fig. 8. MHC-SHIFT Assay

A
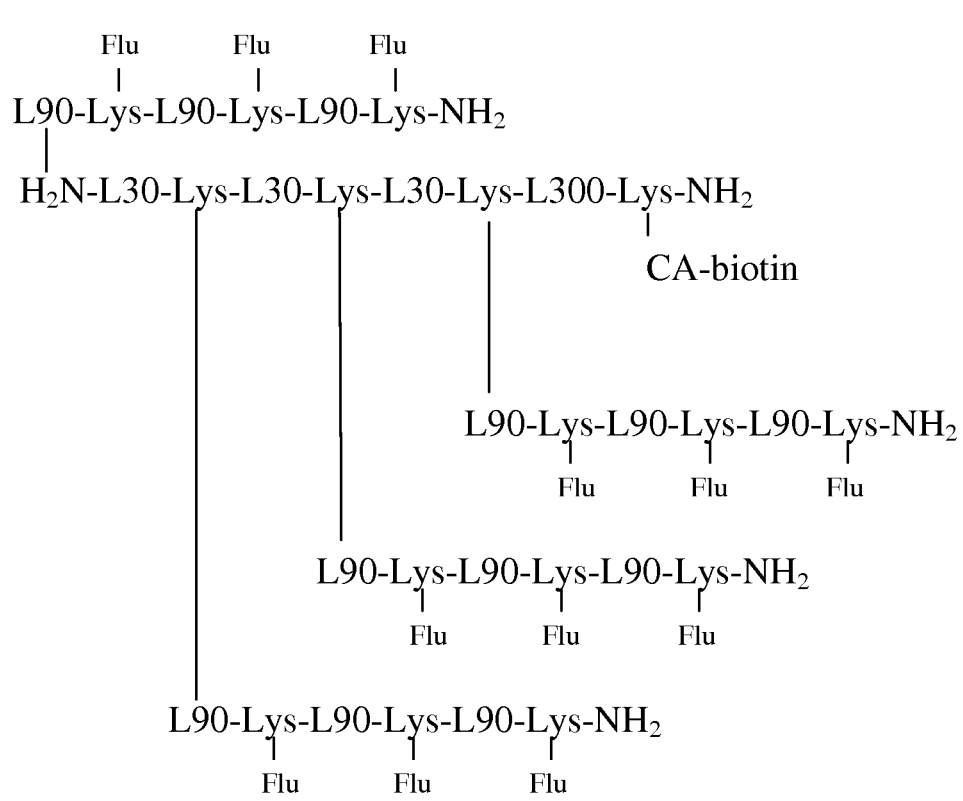
B
L15 linker composition:
Fig. 9. Composition of a Fluorescein-linker molecule

| Database | Alleles |
|---|---|
| http://www.cbs.dtu.dk/services/NetMHC/ | HLA-A0101, HLA-A0201, HLA-A0202, HLA-A0203, HLA-A0204, HLA-A0206, HLA-A0211, HLA-A0212, HLA-A0216, HLA-A0219, HLA-A0301, HLA-A1101, HLA-A2301, HLA-A2402, HLA-A2403, HLA-A2601, HLA-A2602, HLA-A2902, HLA-A3002, HLA-A3101, HLA-A3301, HLA-A6801, HLA-A6802, HLA-A6901 |
| http://www.cbs.dtu.dk/services/NetMHCII/ | HLA-DRB1*0101, HLA-DRB1*0301, HLA-DRB1*0401, HLA-DRB1*0404, HLA-DRB1*0405, HLA-DRB1*0701, HLA-DRB1*0802, HLA-DRB1*0901, HLA-DRB1*1101, HLA-DRB1*1302, HLA-DRB1*1501, HLA-DRB3*0101, HLA-DRB4*0101, HLA-DRB1*0501 |

Fig. 10. HLA alleles of the NetMHC databases

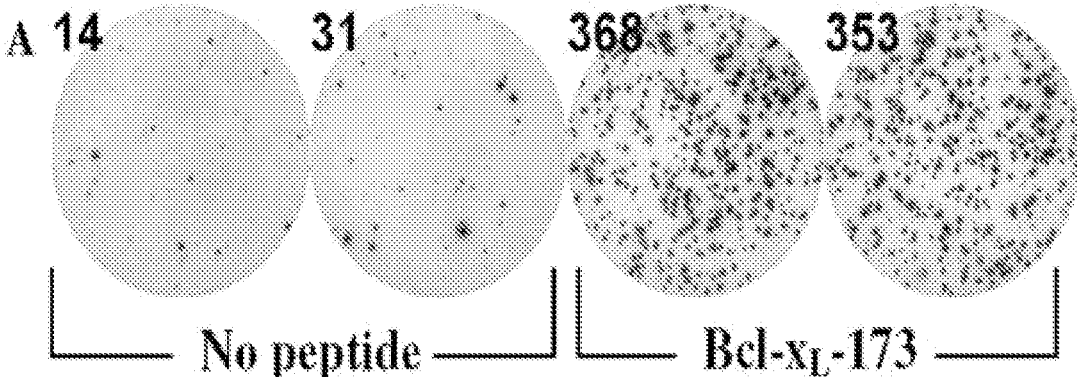
Fig. 11. Ex vivo ELISPOT analysis of BclX(L)-specific

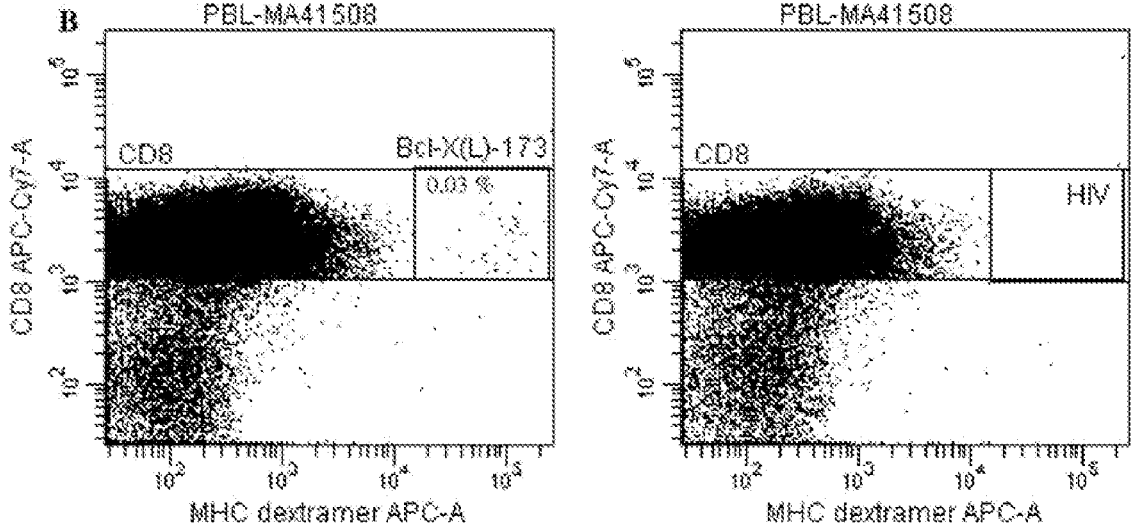
Fig 12. PBL from a breast cancer patient analyzed by flow cytometry.

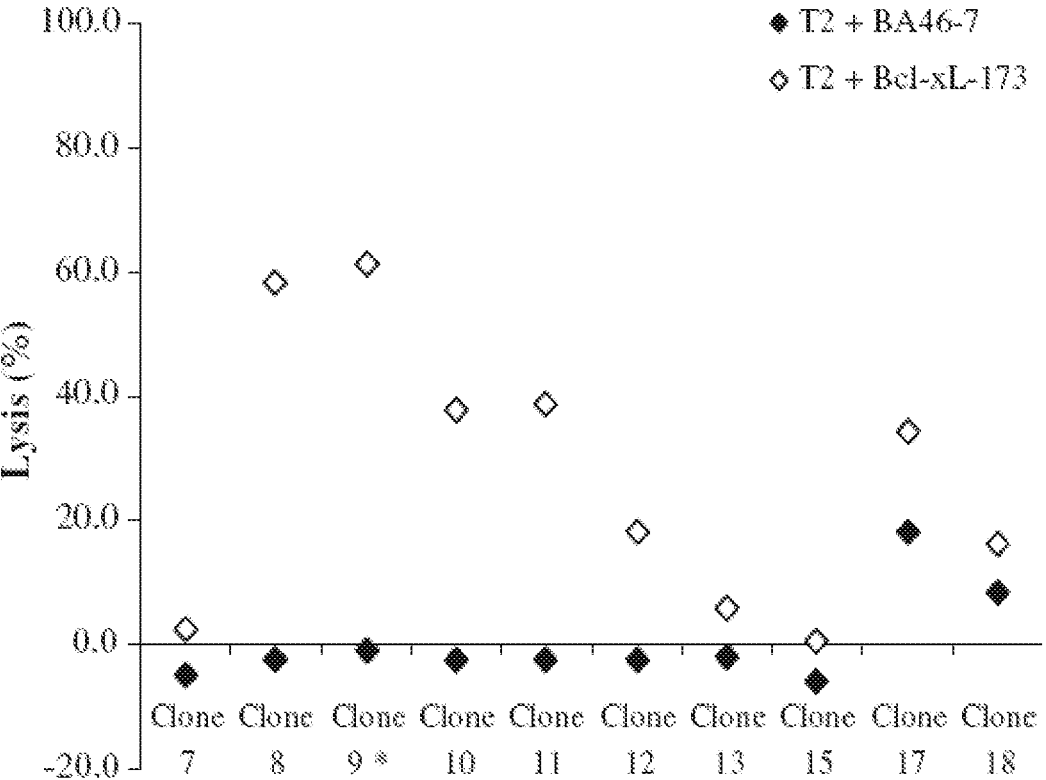
Fig. 13. 51-Cr release assay of isolated T cell clones.

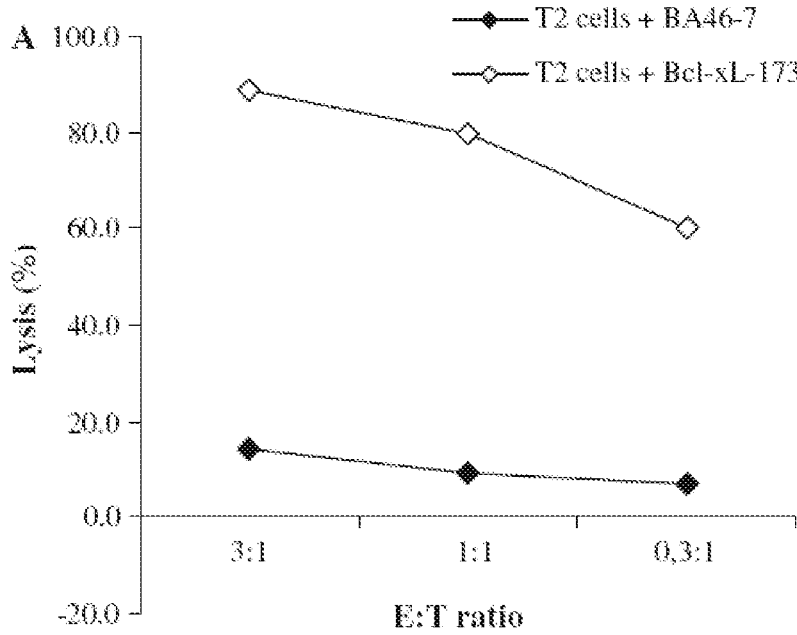
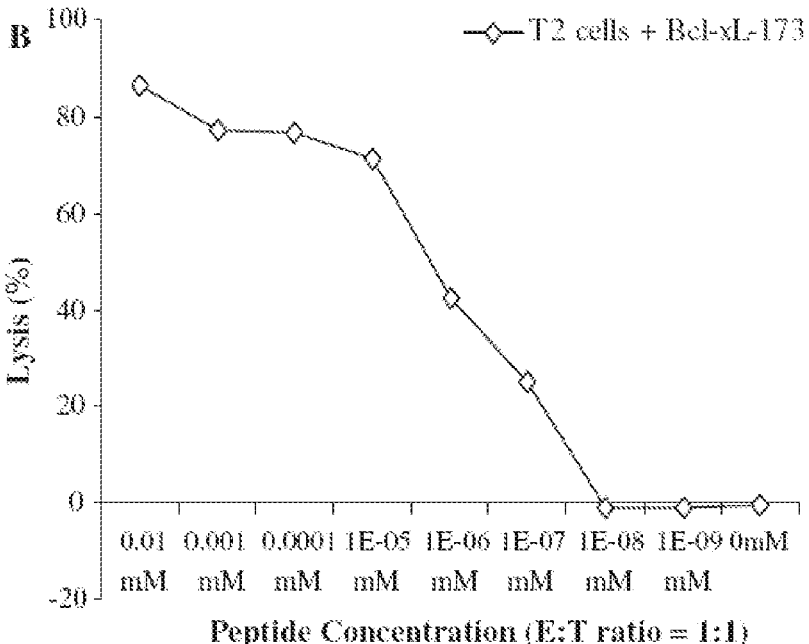
Fig. 14. Bcl-X(L)173–182 specific clone tested for its cytotoxic potential in 51Cr-release assays.

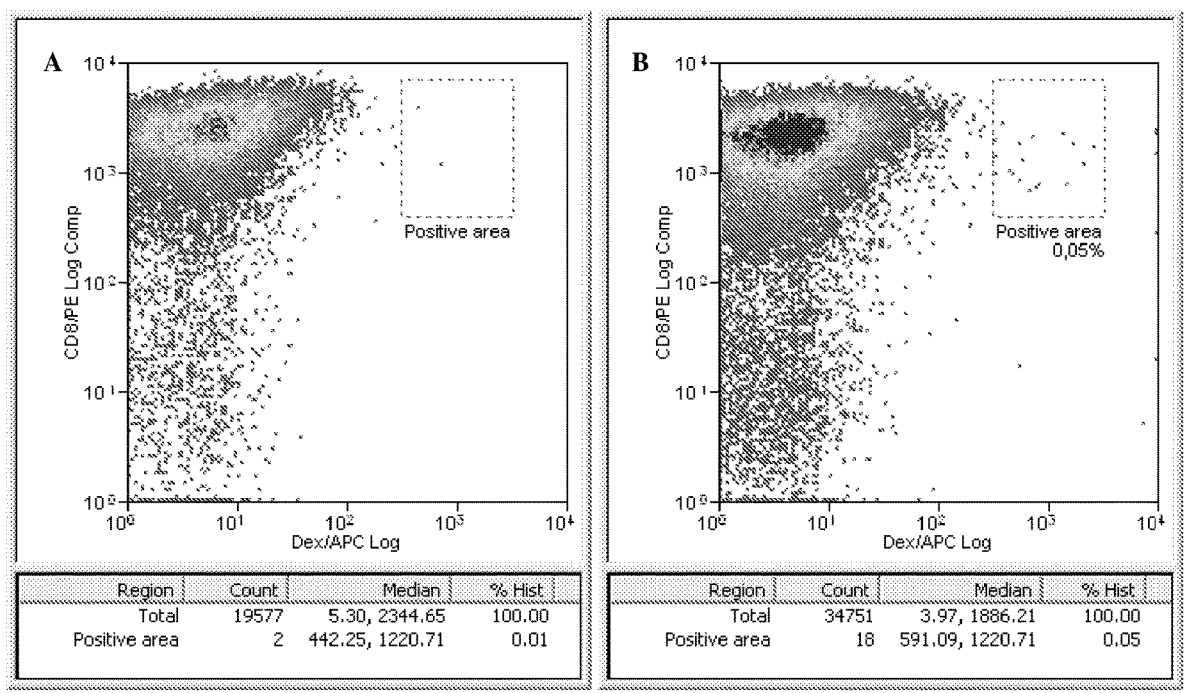
Fig. 15. Detection of Borrelia specific T cells using MHC dextramers

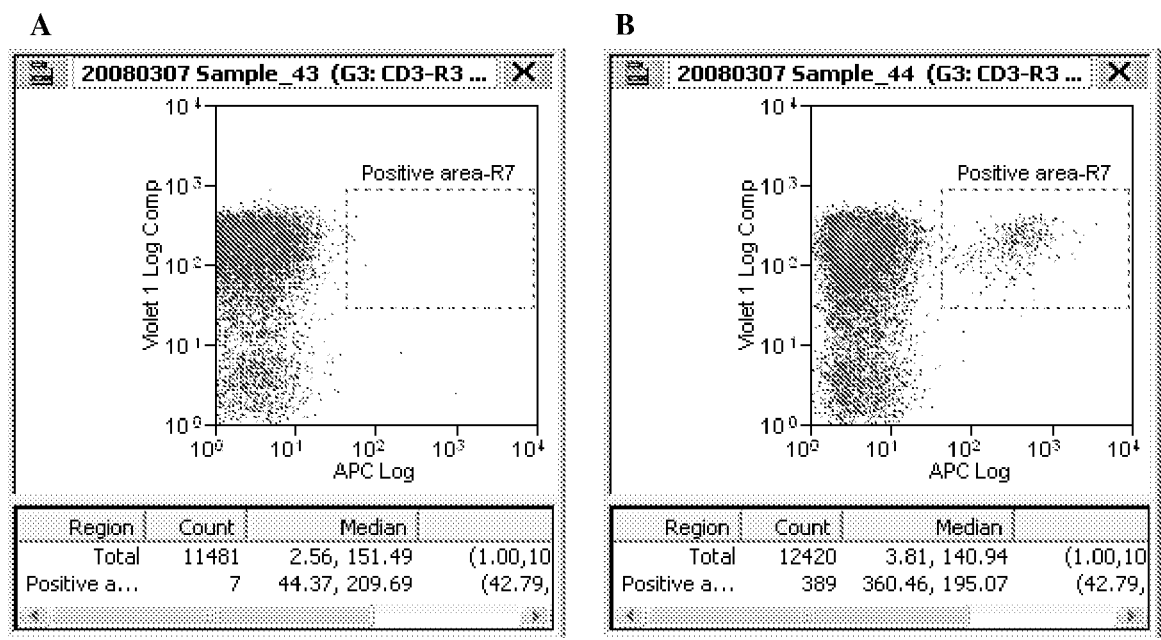
Fig. 16. Detection of CMV specific T cells using MHC dextramers

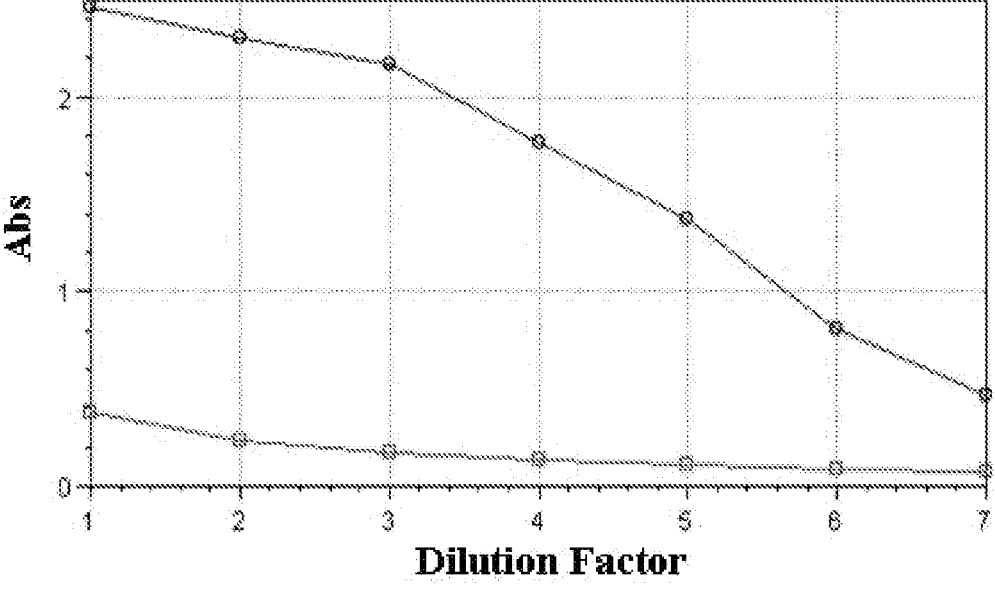
Fig. 17. Conformational ELISA

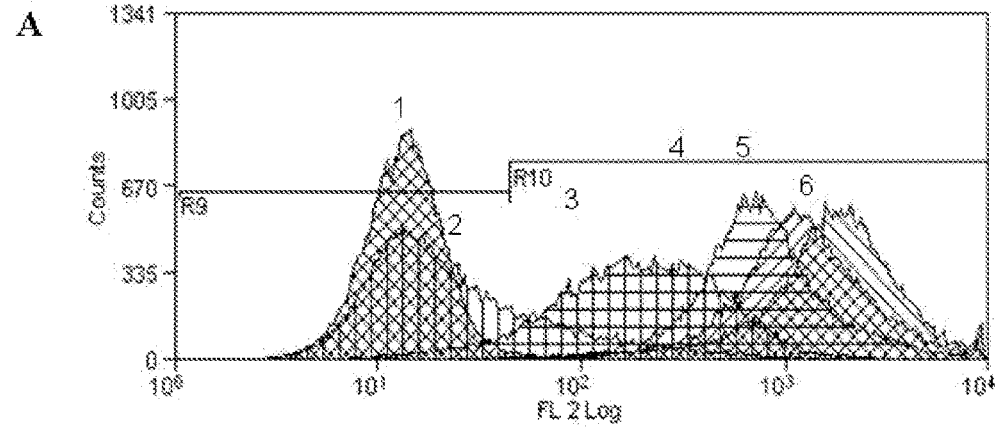
Fig. 18. Carboxylate-modified beads coupled to different amounts of TCR and stained with HLA-A*0201(NLVPMVATV)/RPE or HLA-A*0201(ILKEPVHGV)/RPE.

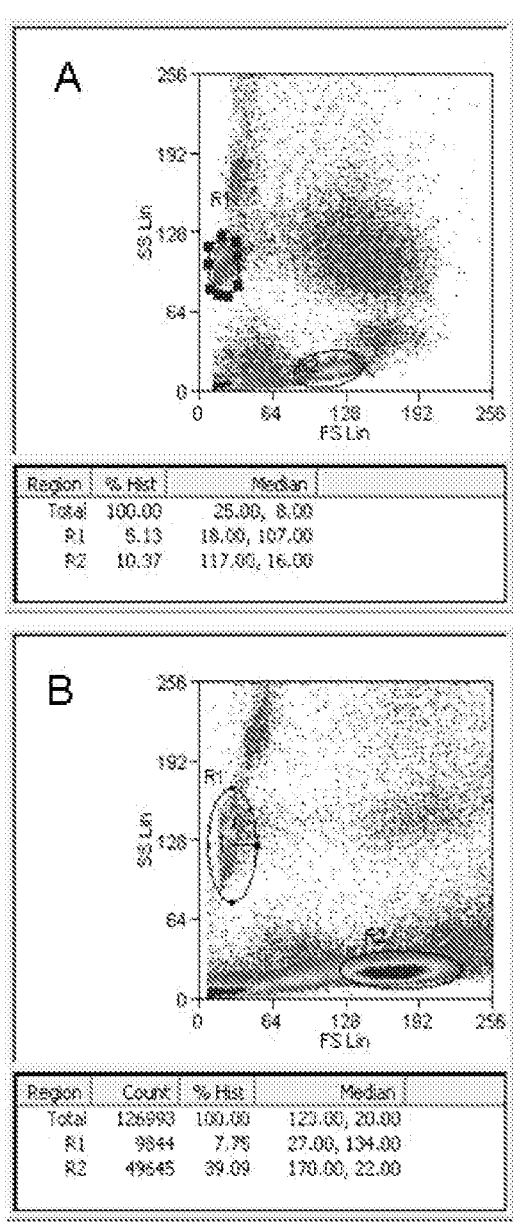
Fig. 19. TCR added into human peripheral whole blood (A), or into HPBMCs (B).

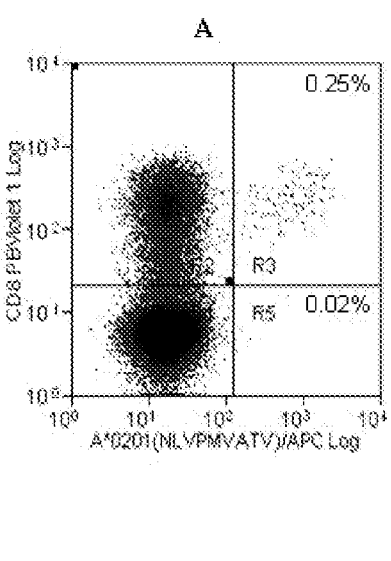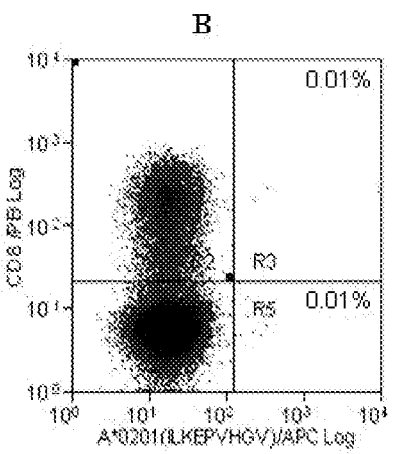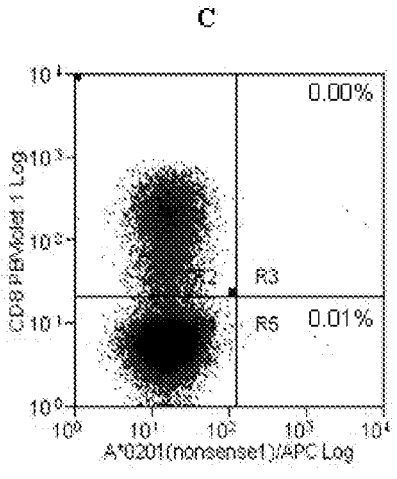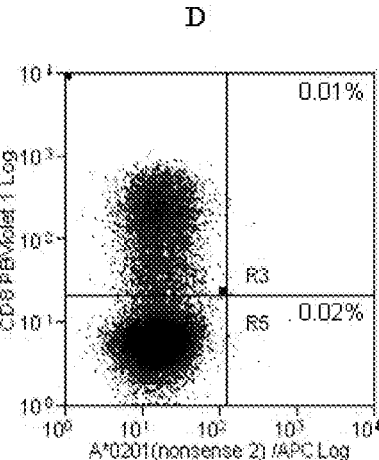
Fig. 20. Flow cytometry analysis of MHC multimer constructs carrying nonsense peptides

| | Positive | Negative | Construct 1 | Construct 2 | Construct 3 | Construct 4 | Construct 5 |
|---|---|---|---|---|---|---|---|
| Donor | | | | | | | |
| 1 | - | A2(NLVPMVATV) A2(ILKEPVHGV) | - | - | - | nt | - |
| 2 | A2(NLVPMVATV) | A2(ILKEPVHGV) | - | - | + | nt | - |
| 3 | A2(NLVPMVATV) | A2(ILKEPVHGV) | - | - | + | nt | - |
| 4 | A2(NLVPMVATV) | A2(ILKEPVHGV) | - | - | + | nt | - |
| 5 | A2(NLVPMVATV) | A2(ILKEPVHGV) | - | - | + | nt | - |
| 6 | A2(NLVPMVATV) | A2(ILKEPVHGV) | - | - | + | nt | - |
| 7 | - | A2(ILKEPVHGV) A2(GLCTLVAML) | - | - | nt | - | - |
| 8 | A2(GLCTLVAML) | A2(ILKEPVHGV) | - | - | nt | + | - |
| 9 | A2(GLCTLVAML) | A2(ILKEPVHGV) | - | - | nt | + | - |

Fig. 21. Summary of flow cytometry analysis of the binding of different MHC multimer constructs to specific T cells in purified Human Peripheral Blood

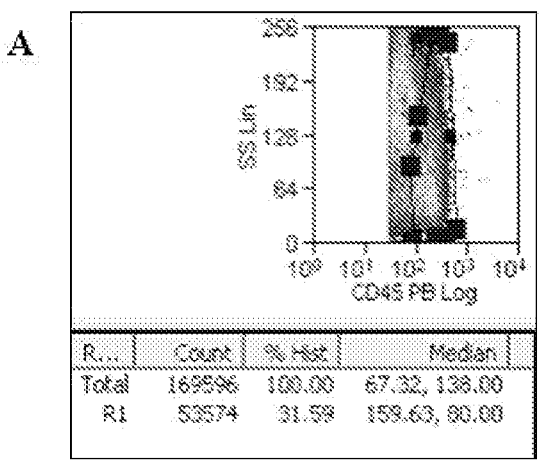
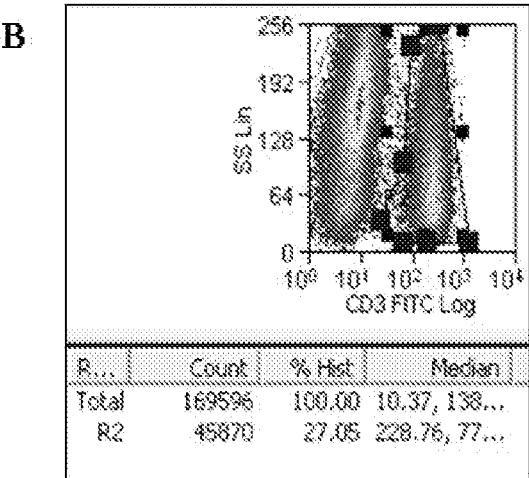
Fig. 22. Gating strategy for no-lyse no-wash procedure

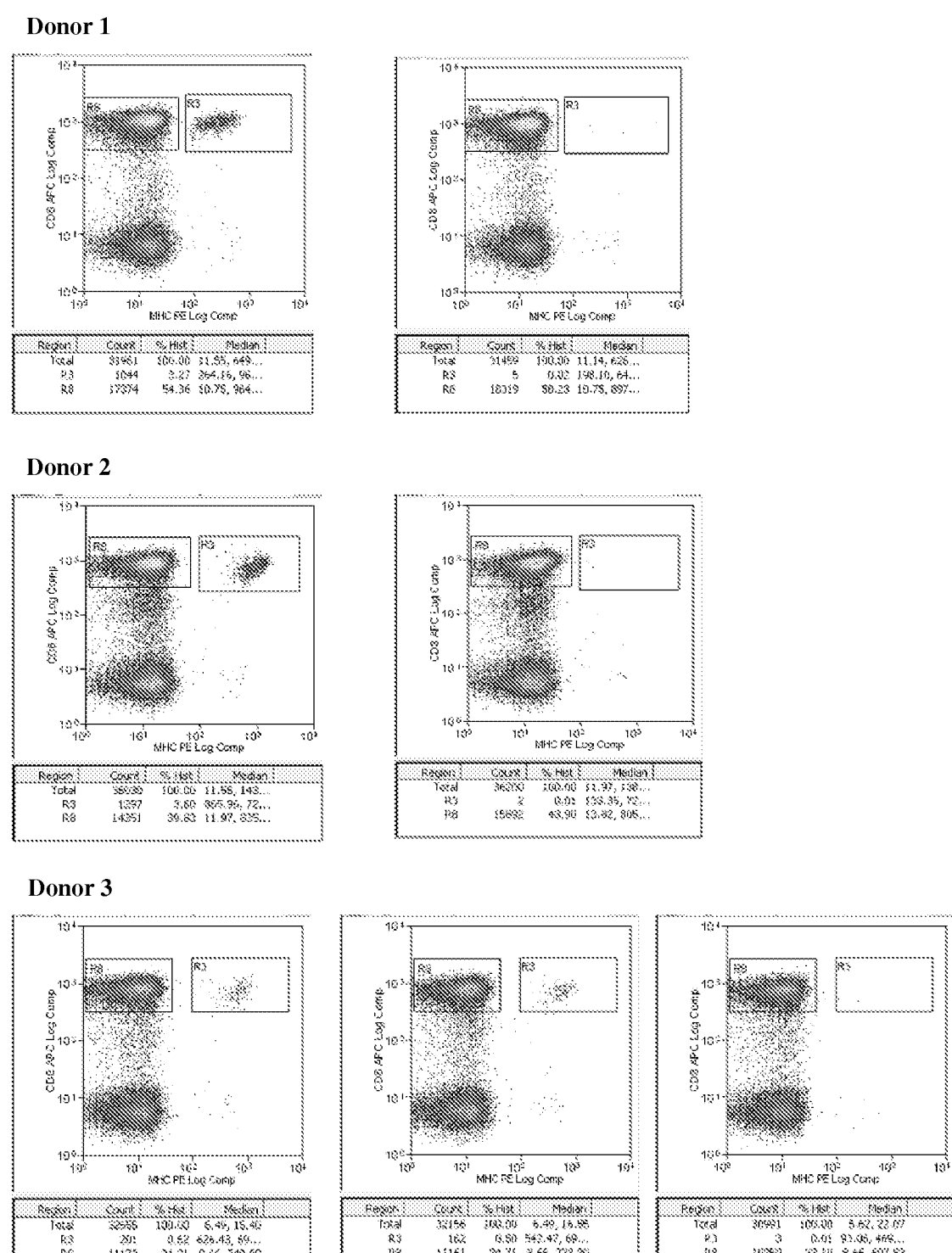
Fig. 23. Identification of CMV-specific T cells in a blood sample using no-lyse no-wash procedure

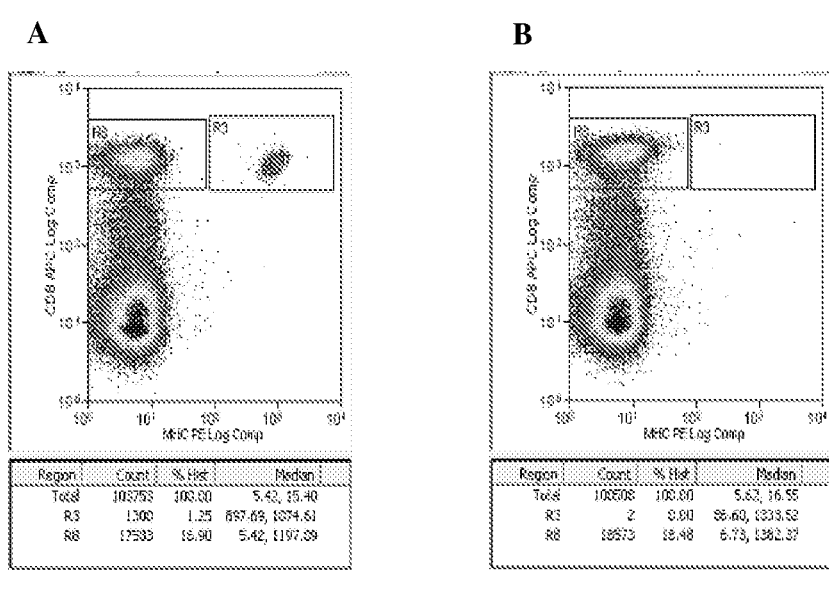
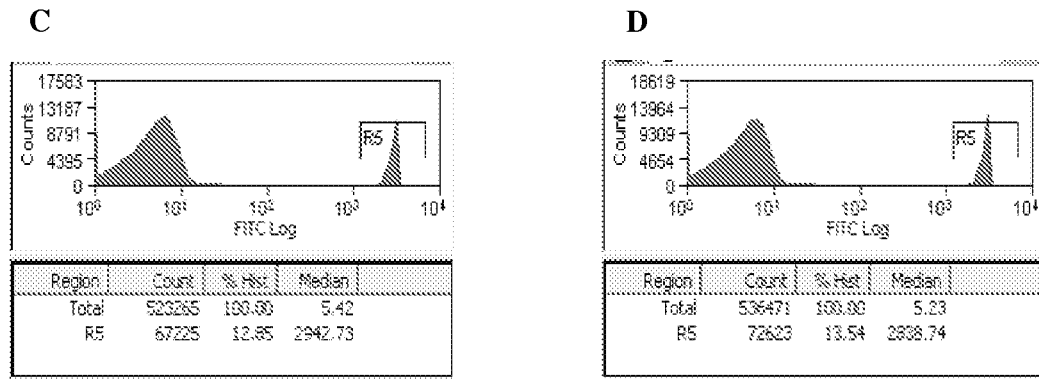
Fig. 24. Enumeration of specific T cells using CytoCount™ beads.

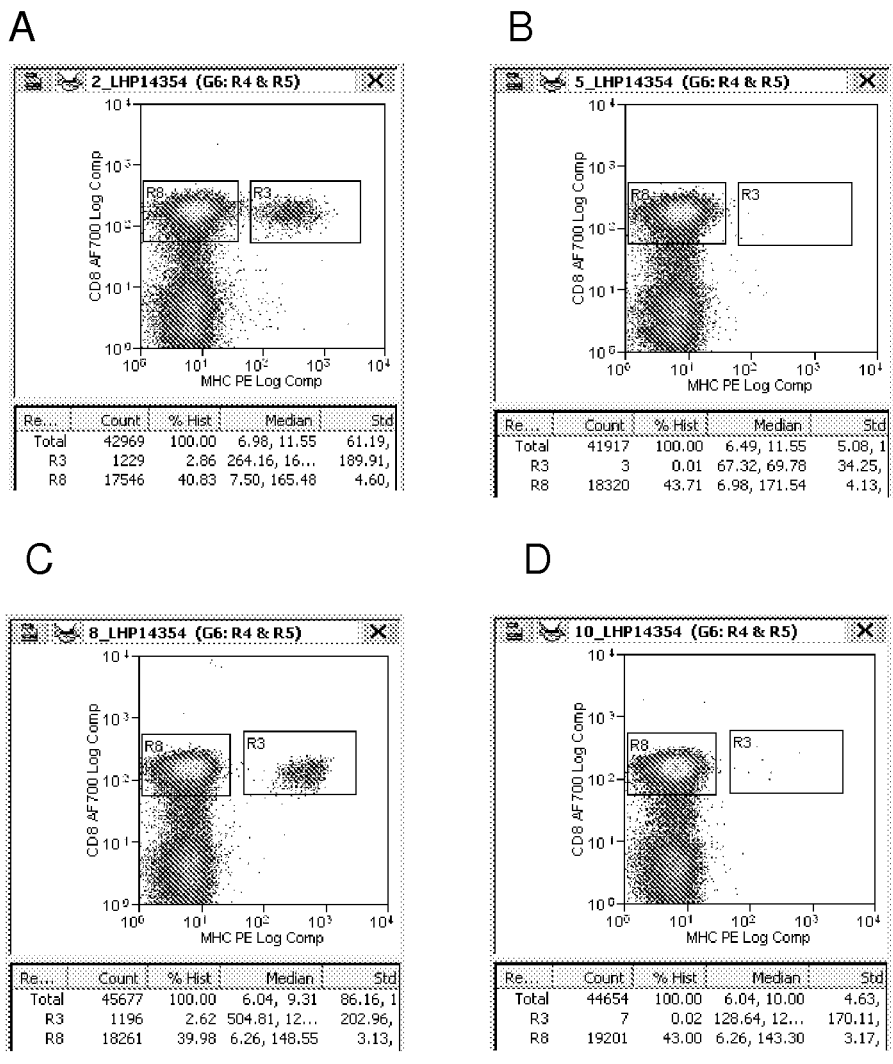
Fig. 25. MHC-peptide complexes can be embedded in a sugar matrix together with antibodies and used for detection of specific T cells in a blood sample

| Borrelia | burgdorferi B31 | afzelii PKo | garini PBi |
|---|---|---|---|
| Genome | NC_001318  851 proteins | NC_008277 855 proteins | NC_006156 832 proteins |
| Plasmids | lp5  NC_000957 | lp25  NC_008569 | lp54  NC_006129 |
| | lp 17  NC_001849 | lp28  NC_0085698 | cp26  NC_006128 |
| | lp21  NC_000955 | lp32  NC_008567 | Variable plasmid segments not finally assembled to whole plasmids NT_108239; NT_108263; NT_108262; NT_108261 NT_108260; NT_108259 NT_108258; NT_108257 NT_108256; NT_108255 NT_108254; NT_108253 NT_108252; NT_108251 NT_108250; NT_108249 NT_108248; NT_108247 NT_108246, NT_108245 NT_108244, NT_108243 NT_108242, NT_108241 NT_108238, NT_108237 NT_108236, NT_108235 NT_108234, NT_108233 NT_108232, NT_108231 NT_108230, NT_108229 NT_108228, NT_108227 |
| | lp25  NC_001850 | lp34  NC_008566 | |
| | lp28-1  NC_001851 | lp60  NC_008564 | |
| | lp28-2  NC_001852 | lp60-2  NC_008565 | |
| | lp28-3  NC_001853 | cp27  NC_008274 | |
| | lp28-4  NC_001854 | cp30  NC_008273 | |
| | lp36  NC_001855 | | |
| | lp38  NC_001856 | | |
| | lp56  NC_000956 | | |
| | cp9  NC_001904 | | |
| | cp26  NC_001903 | | |
| | cp32-1  NC_000948 | | |
| | cp32-3  NC_000949 | | |
| | cp32-4  NC_000950 | | |
| | cp32-6  NC_000951 | | |
| | cp32-7  NC_000952 | | |
| | cp32-8  NC_000953 | | |
| | cp32-9  NC_000954 | | |

Fig. 26.

Fig. 27. Borrelia bulgdorferi

| Plasmid or genome | Product Name | Start | End | Strand | Length | Gi | GeneID |
|---|---|---|---|---|---|---|---|
| Plasmid cp32-1(Accession number NC_000948) | hypothetical protein BB_P01 | 66 | 1289 | + | 407 | 11497090 | 1194468 |
| Plasmid cp32-1(Accession number NC_000948) | hypothetical protein BB_P02 | 1306 | 1998 | + | 230 | 11497091 | 1194469 |
| Plasmid cp32-1(Accession number NC_000948) | hypothetical protein BB_P03 | 2011 | 2568 | + | 185 | 11497092 | 1194470 |
| Plasmid cp32-1(Accession number NC_000948) | hypothetical protein BB_P04 | 2575 | 3339 | + | 254 | 11497093 | 1194471 |
| Plasmid cp32-1(Accession number NC_000948) | hypothetical protein BB_P05 | 3369 | 3941 | + | 190 | 11497094 | 1194472 |
| Plasmid cp32-1(Accession number NC_000948) | hypothetical protein BB_P06 | 3948 | 4922 | + | 324 | 11497064 | 1194442 |
| Plasmid cp32-1(Accession number NC_000948) | hypothetical protein BB_P07 | 4936 | 5397 | + | 153 | 11497065 | 1194443 |
| Plasmid cp32-1(Accession number NC_000948) | hypothetical protein BB_P08 | 5379 | 5780 | + | 133 | 11497066 | 1194444 |
| Plasmid cp32-1(Accession number NC_000948) | hypothetical protein BB_P09 | 5768 | 6157 | + | 129 | 11497067 | 1194445 |
| Plasmid cp32-1(Accession number NC_000948) | hypothetical protein BB_P10 | 6154 | 6720 | + | 188 | 11497068 | 1194446 |
| Plasmid cp32-1(Accession number NC_000948) | hypothetical protein BB_P11 | 6701 | 7813 | + | 370 | 11497095 | 1194473 |
| Plasmid cp32-1(Accession number NC_000948) | hypothetical protein BB_P12 | 7828 | 8256 | + | 142 | 11497096 | 1194474 |
| Plasmid cp32-1(Accession number NC_000948) | hypothetical protein BB_P13 | 8272 | 8727 | + | 151 | 11497097 | 1194475 |
| Plasmid cp32-1(Accession number NC_000948) | hypothetical protein BB_P14 | 8724 | 8960 | + | 78 | 11497098 | 1194476 |
| Plasmid cp32-1(Accession number NC_000948) | hypothetical protein BB_P15 | 8968 | 10242 | + | 424 | 11497099 | 1194477 |
| Plasmid cp32-1(Accession number NC_000948) | hypothetical protein BB_P16 | 10265 | 10948 | + | 227 | 11497100 | 1194478 |

| Plasmid cp32-1(Accession number NC_000948) | hypothetical protein BB_P17 | 10952 | 11902 | + | 316 | 11497101 | 1194479 |
|---|---|---|---|---|---|---|---|
| Plasmid cp32-1(Accession number NC_000948) | hypothetical protein BB_P18 | 11920 | 12465 | + | 181 | 11497102 | 1194480 |
| Plasmid cp32-1(Accession number NC_000948) | hypothetical protein BB_P19 | 12495 | 12827 | + | 110 | 11497069 | 1194447 |
| Plasmid cp32-1(Accession number NC_000948) | hypothetical protein BB_P20 | 12824 | 13699 | + | 291 | 11497070 | 1194448 |
| Plasmid cp32-1(Accession number NC_000948) | hypothetical protein BB_P21 | 13709 | 14314 | + | 201 | 11497071 | 1194449 |
| Plasmid cp32-1(Accession number NC_000948) | hypothetical protein BB_P22 | 14324 | 15139 | + | 271 | 11497072 | 1194450 |
| Plasmid cp32-1(Accession number NC_000948) | pore-forming hemolysin | 15215 | 15418 | + | 67 | 11497073 | 1194451 |
| Plasmid cp32-1(Accession number NC_000948) | hemolysin accessory protein | 15422 | 15769 | + | 115 | 11497074 | 1194452 |
| Plasmid cp32-1(Accession number NC_000948) | hypothetical protein BB_P25 | 15759 | 16094 | + | 111 | 11497075 | 1194453 |
| Plasmid cp32-1(Accession number NC_000948) | hypothetical protein BB_P26 | 16081 | 16440 | + | 119 | 11497076 | 1194454 |
| Plasmid cp32-1(Accession number NC_000948) | rev protein | 16578 | 17060 | - | 160 | 11497077 | 1194455 |
| Plasmid cp32-1(Accession number NC_000948) | lipoprotein | 17232 | 17678 | + | 148 | 11497078 | 1194456 |
| Plasmid cp32-1(Accession number NC_000948) | hypothetical protein BB_P29 | 17715 | 18728 | - | 337 | 11497079 | 1194457 |
| Plasmid cp32-1(Accession number NC_000948) | hypothetical protein BB_P30 | 19114 | 20214 | + | 366 | 11497080 | 1194458 |
| Plasmid cp32-1(Accession number NC_000948) | hypothetical protein BB_P31 | 20224 | 20790 | + | 188 | 11497081 | 1194459 |
| Plasmid cp32-1(Accession number NC_000948) | plasmid partition protein, putative | 20766 | 21506 | + | 246 | 11497082 | 1194460 |
| Plasmid cp32-1(Accession number NC_000948) | hypothetical protein BB_P33 | 21510 | 22118 | + | 202 | 11497083 | 1194461 |
| Plasmid cp32-1(Accession number | BdrA | 22131 | 22763 | + | 210 | 11497084 | 1194462 |

Fig. 27 continued

| | | | | | | | |
|---|---|---|---|---|---|---|---|
| NC_000948) | | | | | | | |
| Plasmid cp32-1(Accession number NC_000948) | BppA | 23231 | 24556 | + | 441 | 11497085 | 1194463 |
| Plasmid cp32-1(Accession number NC_000948) | BppB | 24609 | 25034 | + | 141 | 11497086 | 1194464 |
| Plasmid cp32-1(Accession number NC_000948) | BppC | 25040 | 25816 | - | 258 | 11497087 | 1194465 |
| Plasmid cp32-1(Accession number NC_000948) | ErpA | 26247 | 26768 | + | 173 | 11497061 | 1194439 |
| Plasmid cp32-1(Accession number NC_000948) | ErpB | 26796 | 27932 | + | 378 | 11497062 | 1194440 |
| Plasmid cp32-1(Accession number NC_000948) | hypothetical protein BB_P40 | 28074 | 28655 | + | 193 | 11497088 | 1194466 |
| Plasmid cp32-1(Accession number NC_000948) | hypothetical protein BB_P41 | 28835 | 29401 | + | 188 | 11497089 | 1194467 |
| Plasmid cp32-1(Accession number NC_000948) | hypothetical protein BB_P42 | 29398 | 30750 | + | 450 | 11497063 | 1194441 |
| Plasmid cp32-3 (Accession number NC_000949) | hypothetical protein BB_S01 | 66 | 1289 | + | 407 | 11497136 | 1194513 |
| Plasmid cp32-3 (Accession number NC_000949) | hypothetical protein BB_S02 | 1306 | 1998 | + | 230 | 11497137 | 1194514 |
| Plasmid cp32-3 (Accession number NC_000949) | hypothetical protein BB_S03 | 2011 | 2568 | + | 185 | 11497138 | 1194515 |
| Plasmid cp32-3 (Accession number NC_000949) | hypothetical protein BB_S04 | 2575 | 3339 | + | 254 | 11497139 | 1194516 |
| Plasmid cp32-3 (Accession number NC_000949) | hypothetical protein BB_S05 | 3369 | 3941 | + | 190 | 11497140 | 1194517 |
| Plasmid cp32-3 (Accession number NC_000949) | hypothetical protein BB_S06 | 3963 | 4922 | + | 319 | 11497125 | 1194502 |
| Plasmid cp32-3 (Accession number NC_000949) | hypothetical protein BB_S07 | 4936 | 5397 | + | 153 | 11497126 | 1194503 |
| Plasmid cp32-3 (Accession number NC_000949) | hypothetical protein BB_S08 | 5379 | 5780 | + | 133 | 11497127 | 1194504 |
| Plasmid cp32-3 (Accession number NC_000949) | hypothetical protein BB_S09 | 5768 | 6157 | + | 129 | 11497128 | 1194505 |

Fig. 27 continued

| | | | | | | | |
|---|---|---|---|---|---|---|---|
| Plasmid cp32-3 (Accession number NC_000949) | hypothetical protein BB_S10 | 6154 | 6720 | + | 188 | 11497129 | 1194506 |
| Plasmid cp32-3 (Accession number NC_000949) | hypothetical protein BB_S11 | 6701 | 7813 | + | 370 | 11497141 | 1194518 |
| Plasmid cp32-3 (Accession number NC_000949) | hypothetical protein BB_S12 | 7828 | 8256 | + | 142 | 11497142 | 1194519 |
| Plasmid cp32-3 (Accession number NC_000949) | hypothetical protein BB_S13 | 8272 | 8727 | + | 151 | 11497143 | 1194520 |
| Plasmid cp32-3 (Accession number NC_000949) | hypothetical protein BB_S14 | 8724 | 8960 | + | 78 | 11497144 | 1194521 |
| Plasmid cp32-3 (Accession number NC_000949) | hypothetical protein BB_S15 | 8968 | 10242 | + | 424 | 11497145 | 1194522 |
| Plasmid cp32-3 (Accession number NC_000949) | hypothetical protein BB_S16 | 10265 | 10948 | + | 227 | 11497146 | 1194523 |
| Plasmid cp32-3 (Accession number NC_000949) | hypothetical protein BB_S17 | 10952 | 11902 | + | 316 | 11497147 | 1194524 |
| Plasmid cp32-3 (Accession number NC_000949) | hypothetical protein BB_S18 | 11920 | 12465 | + | 181 | 11497148 | 1194525 |
| Plasmid cp32-3 (Accession number NC_000949) | hypothetical protein BB_S19 | 12495 | 12827 | + | 110 | 11497130 | 1194507 |
| Plasmid cp32-3 (Accession number NC_000949) | hypothetical protein BB_S20 | 12824 | 13699 | + | 291 | 11497131 | 1194508 |
| Plasmid cp32-3 (Accession number NC_000949) | hypothetical protein BB_S21 | 13784 | 14314 | + | 176 | 11497104 | 1194481 |
| Plasmid cp32-3 (Accession number NC_000949) | hypothetical protein BB_S22 | 14324 | 15136 | + | 270 | 11497105 | 1194482 |
| Plasmid cp32-3 (Accession number NC_000949) | pore-forming hemolysin | 15212 | 15415 | + | 67 | 11497106 | 1194483 |
| Plasmid cp32-3 (Accession number NC_000949) | hemolysin accessory protein | 15419 | 15766 | + | 115 | 11497107 | 1194484 |
| Plasmid cp32-3 (Accession number NC_000949) | hypothetical protein BB_S25 | 15756 | 16091 | + | 111 | 11497108 | 1194485 |
| Plasmid cp32-3 (Accession number NC_000949) | hypothetical protein BB_S26 | 16078 | 16437 | + | 119 | 11497109 | 1194486 |
| Plasmid cp32-3 (Accession number NC_000949) | hypothetical protein BB_S27 | 16586 | 16903 | + | 105 | 11497132 | 1194509 |

Fig. 27 continued

| | | | | | | | |
|---|---|---|---|---|---|---|---|
| Plasmid cp32-3 (Accession number NC_000949) | hypothetical protein BB_S28 | 16915 | 17049 | + | 44 | 11497133 | 1194510 |
| Plasmid cp32-3 (Accession number NC_000949) | BdrF | 17068 | 17697 | + | 209 | 11497110 | 1194487 |
| Plasmid cp32-3 (Accession number NC_000949) | lipoprotein | 17803 | 18249 | + | 148 | 11497111 | 1194488 |
| Plasmid cp32-3 (Accession number NC_000949) | hypothetical protein BB_S31 | 18287 | 19159 | - | 290 | 11497112 | 1194489 |
| Plasmid cp32-3 (Accession number NC_000949) | hypothetical protein BB_S32 | 19198 | 19395 | + | 65 | 11497113 | 1194490 |
| Plasmid cp32-3 (Accession number NC_000949) | hypothetical protein BB_S33 | 19605 | 20705 | + | 366 | 11497114 | 1194491 |
| Plasmid cp32-3 (Accession number NC_000949) | hypothetical protein BB_S34 | 20715 | 21281 | + | 188 | 11497115 | 1194492 |
| Plasmid cp32-3 (Accession number NC_000949) | plasmid partition protein, putative | 21257 | 21997 | + | 246 | 11497116 | 1194493 |
| Plasmid cp32-3 (Accession number NC_000949) | hypothetical protein BB_S36 | 22038 | 22580 | + | 180 | 11497117 | 1194494 |
| Plasmid cp32-3 (Accession number NC_000949) | BdrE | 22593 | 23183 | + | 196 | 11497118 | 1194495 |
| Plasmid cp32-3 (Accession number NC_000949) | BppA | 23649 | 25016 | + | 455 | 11497119 | 1194496 |
| Plasmid cp32-3 (Accession number NC_000949) | BppB | 25069 | 25494 | + | 141 | 11497120 | 1194497 |
| Plasmid cp32-3 (Accession number NC_000949) | BppC | 25500 | 26276 | - | 258 | 11497121 | 1194498 |
| Plasmid cp32-3 (Accession number NC_000949) | ErpG | 26708 | 27298 | + | 196 | 11497122 | 1194499 |
| Plasmid cp32-3 (Accession number NC_000949) | BapA | 27410 | 27919 | + | 169 | 11497123 | 1194500 |
| Plasmid cp32-3 (Accession number NC_000949) | hypothetical protein BB_S43 | 28067 | 28249 | + | 60 | 11497134 | 1194511 |
| Plasmid cp32-3 (Accession number NC_000949) | hypothetical protein BB_S44 | 28236 | 28874 | + | 212 | 11497135 | 1194512 |
| Plasmid cp32-3 (Accession number NC_000949) | hypothetical protein BB_S45 | 28871 | 30223 | + | 450 | 11497124 | 1194501 |

Fig. 27 continued

| | | | | | | | |
|---|---|---|---|---|---|---|---|
| Plasmid cp32-4 (Accession number NC_000950) | hypothetical protein BB_R01 | 66 | 1289 | + | 407 | 11497179 | 1194556 |
| Plasmid cp32-4 (Accession number NC_000950) | hypothetical protein BB_R03 | 2013 | 2576 | + | 187 | 11497180 | 1194557 |
| Plasmid cp32-4 (Accession number NC_000950) | hypothetical protein BB_R04 | 2580 | 3347 | + | 255 | 11497181 | 1194558 |
| Plasmid cp32-4 (Accession number NC_000950) | hypothetical protein BB_R05 | 3340 | 3951 | + | 203 | 11497182 | 1194559 |
| Plasmid cp32-4 (Accession number NC_000950) | hypothetical protein BB_R06 | 3958 | 4932 | + | 324 | 11497153 | 1194529 |
| Plasmid cp32-4 (Accession number NC_000950) | hypothetical protein BB_R07 | 4952 | 5407 | + | 151 | 11497154 | 1194530 |
| Plasmid cp32-4 (Accession number NC_000950) | hypothetical protein BB_R08 | 5389 | 5790 | + | 133 | 11497155 | 1194531 |
| Plasmid cp32-4 (Accession number NC_000950) | hypothetical protein BB_R09 | 5778 | 6167 | + | 129 | 11497156 | 1194532 |
| Plasmid cp32-4 (Accession number NC_000950) | hypothetical protein BB_R10 | 6164 | 6730 | + | 188 | 11497157 | 1194533 |
| Plasmid cp32-4 (Accession number NC_000950) | hypothetical protein BB_R11 | 6711 | 7823 | + | 370 | 11497183 | 1194560 |
| Plasmid cp32-4 (Accession number NC_000950) | hypothetical protein BB_R12 | 7838 | 8266 | + | 142 | 11497184 | 1194561 |
| Plasmid cp32-4 (Accession number NC_000950) | hypothetical protein BB_R13 | 8282 | 8737 | + | 151 | 11497185 | 1194562 |
| Plasmid cp32-4 (Accession number NC_000950) | hypothetical protein BB_R14 | 8734 | 8970 | + | 78 | 11497186 | 1194563 |
| Plasmid cp32-4 (Accession number NC_000950) | hypothetical protein BB_R15 | 8978 | 10273 | + | 431 | 11497187 | 1194564 |
| Plasmid cp32-4 (Accession number NC_000950) | hypothetical protein BB_R16 | 10296 | 10892 | + | 198 | 11497188 | 1194565 |
| Plasmid cp32-4 (Accession number NC_000950) | hypothetical protein BB_R17 | 10896 | 11846 | + | 316 | 11497189 | 1194566 |
| Plasmid cp32-4 (Accession number NC_000950) | hypothetical protein BB_R18 | 11864 | 12416 | + | 184 | 11497190 | 1194567 |
| Plasmid cp32-4 (Accession number NC_000950) | hypothetical protein BB_R19 | 12448 | 12780 | + | 110 | 11497158 | 1194534 |

Fig. 27 continued

| | | | | | | | |
|---|---|---|---|---|---|---|---|
| Plasmid cp32-4 (Accession number NC_000950) | hypothetical protein BB_R20 | 12777 | 13652 | + | 291 | 11497159 | 1194535 |
| Plasmid cp32-4 (Accession number NC_000950) | hypothetical protein BB_R21 | 13662 | 14267 | + | 201 | 11497160 | 1194536 |
| Plasmid cp32-4 (Accession number NC_000950) | hypothetical protein BB_R22 | 14277 | 15092 | + | 271 | 11497161 | 1194537 |
| Plasmid cp32-4 (Accession number NC_000950) | pore-forming hemolysin | 15167 | 15370 | + | 67 | 11497162 | 1194538 |
| Plasmid cp32-4 (Accession number NC_000950) | hemolysin accessory protein | 15374 | 15721 | + | 115 | 11497163 | 1194539 |
| Plasmid cp32-4 (Accession number NC_000950) | hypothetical protein BB_R25 | 15711 | 16046 | + | 111 | 11497164 | 1194540 |
| Plasmid cp32-4 (Accession number NC_000950) | hypothetical protein BB_R26 | 16033 | 16392 | + | 119 | 11497165 | 1194541 |
| Plasmid cp32-4 (Accession number NC_000950) | BdrH | 16467 | 16997 | + | 176 | 11497166 | 1194542 |
| Plasmid cp32-4 (Accession number NC_000950) | lipoprotein | 17103 | 17525 | + | 140 | 11497167 | 1194543 |
| Plasmid cp32-4 (Accession number NC_000950) | hypothetical protein BB_R29 | 17573 | 18664 | - | 363 | 11497168 | 1194544 |
| Plasmid cp32-4 (Accession number NC_000950) | hypothetical protein BB_R30 | 18734 | 18829 | - | 31 | 11497191 | 1194568 |
| Plasmid cp32-4 (Accession number NC_000950) | hypothetical protein BB_R31 | 18960 | 20057 | + | 365 | 11497169 | 1194545 |
| Plasmid cp32-4 (Accession number NC_000950) | hypothetical protein BB_R32 | 20067 | 20633 | + | 188 | 11497170 | 1194546 |
| Plasmid cp32-4 (Accession number NC_000950) | plasmid partition protein, putative | 20609 | 21364 | + | 251 | 11497171 | 1194547 |
| Plasmid cp32-4 (Accession number NC_000950) | hypothetical protein BB_R34 | 21415 | 21960 | + | 181 | 11497172 | 1194548 |
| Plasmid cp32-4 (Accession number NC_000950) | BdrG | 21974 | 22252 | + | 92 | 21538986 | 1194549 |
| Plasmid cp32-4 (Accession number NC_000950) | BppA | 22831 | 24156 | + | 441 | 11497173 | 1194550 |
| Plasmid cp32-4 (Accession number | BppB | 24210 | 24635 | + | 141 | 11497174 | 1194551 |

Fig. 27 continued

| | | | | | | | |
|---|---|---|---|---|---|---|---|
| NC_000950) | | | | | | | |
| Plasmid cp32-4 (Accession number NC_000950) | BppC | 24641 | 25435 | - | 264 | 11497175 | 1194552 |
| Plasmid cp32-4 (Accession number NC_000950) | hypothetical protein BB_R39 | 25535 | 25636 | - | 33 | 11497192 | 1194569 |
| Plasmid cp32-4 (Accession number NC_000950) | ErpH | 25865 | 25969 | + | 34 | 11497176 | 1194553 |
| Plasmid cp32-4 (Accession number NC_000950) | hypothetical protein BB_R41 | 26077 | 26820 | + | 247 | 11497150 | 1194526 |
| Plasmid cp32-4 (Accession number NC_000950) | ErpY | 26853 | 27527 | + | 224 | 11497151 | 1194527 |
| Plasmid cp32-4 (Accession number NC_000950) | hypothetical protein BB_R43 | 27634 | 28203 | + | 189 | 11497177 | 1194554 |
| Plasmid cp32-4 (Accession number NC_000950) | hypothetical protein BB_R44 | 28384 | 28950 | + | 188 | 11497178 | 1194555 |
| Plasmid cp32-4 (Accession number NC_000950) | hypothetical protein BB_R45 | 28947 | 30299 | + | 450 | 11497152 | 1194528 |
| Plasmid cp32-6 (Accession number NC_000951) | hypothetical protein BB_M01 | 66 | 1289 | + | 407 | 11497225 | 1194601 |
| Plasmid cp32-6 (Accession number NC_000951) | hypothetical protein BB_M02 | 1306 | 1998 | + | 230 | 11497226 | 1194602 |
| Plasmid cp32-6 (Accession number NC_000951) | hypothetical protein BB_M03 | 2010 | 2573 | + | 187 | 11497227 | 1194603 |
| Plasmid cp32-6 (Accession number NC_000951) | hypothetical protein BB_M04 | 2577 | 3344 | + | 255 | 11497228 | 1194604 |
| Plasmid cp32-6 (Accession number NC_000951) | hypothetical protein BB_M05 | 3337 | 3948 | + | 203 | 11497229 | 1194605 |
| Plasmid cp32-6 (Accession number NC_000951) | hypothetical protein BB_M06 | 3955 | 4929 | + | 324 | 11497215 | 1194591 |
| Plasmid cp32-6 (Accession number NC_000951) | hypothetical protein BB_M07 | 4949 | 5404 | + | 151 | 11497216 | 1194592 |
| Plasmid cp32-6 (Accession number NC_000951) | hypothetical protein BB_M08 | 5386 | 5787 | + | 133 | 11497217 | 1194593 |
| Plasmid cp32-6 (Accession number NC_000951) | hypothetical protein BB_M09 | 5775 | 6164 | + | 129 | 11497218 | 1194594 |

Fig. 27 continued

| | | | | | | | |
|---|---|---|---|---|---|---|---|
| Plasmid cp32-6 (Accession number NC_000951) | hypothetical protein BB_M10 | 6161 | 6730 | + | 189 | 11497219 | 1194595 |
| Plasmid cp32-6 (Accession number NC_000951) | hypothetical protein BB_M11 | 6711 | 7823 | + | 370 | 11497230 | 1194606 |
| Plasmid cp32-6 (Accession number NC_000951) | hypothetical protein BB_M12 | 7838 | 8266 | + | 142 | 11497231 | 1194607 |
| Plasmid cp32-6 (Accession number NC_000951) | hypothetical protein BB_M13 | 8282 | 8737 | + | 151 | 11497232 | 1194608 |
| Plasmid cp32-6 (Accession number NC_000951) | hypothetical protein BB_M14 | 8734 | 8970 | + | 78 | 11497233 | 1194609 |
| Plasmid cp32-6 (Accession number NC_000951) | hypothetical protein BB_M15 | 8978 | 10252 | + | 424 | 11497234 | 1194610 |
| Plasmid cp32-6 (Accession number NC_000951) | hypothetical protein BB_M16 | 10275 | 10958 | + | 227 | 11497235 | 1194611 |
| Plasmid cp32-6 (Accession number NC_000951) | hypothetical protein BB_M17 | 10962 | 11912 | + | 316 | 11497220 | 1194596 |
| Plasmid cp32-6 (Accession number NC_000951) | hypothetical protein BB_M18 | 11930 | 12484 | + | 184 | 11497221 | 1194597 |
| Plasmid cp32-6 (Accession number NC_000951) | hypothetical protein BB_M19 | 12514 | 12846 | + | 110 | 11497194 | 1194570 |
| Plasmid cp32-6 (Accession number NC_000951) | hypothetical protein BB_M20 | 12843 | 13718 | + | 291 | 11497195 | 1194571 |
| Plasmid cp32-6 (Accession number NC_000951) | hypothetical protein BB_M21 | 13728 | 14333 | + | 201 | 11497196 | 1194572 |
| Plasmid cp32-6 (Accession number NC_000951) | hypothetical protein BB_M22 | 14343 | 15155 | + | 270 | 11497197 | 1194573 |
| Plasmid cp32-6 (Accession number NC_000951) | pore-forming hemolysin | 15231 | 15434 | + | 67 | 11497198 | 1194574 |
| Plasmid cp32-6 (Accession number NC_000951) | hemolysin accessory protein | 15438 | 15785 | + | 115 | 11497199 | 1194575 |
| Plasmid cp32-6 (Accession number NC_000951) | hypothetical protein BB_M25 | 15775 | 16110 | + | 111 | 11497200 | 1194576 |
| Plasmid cp32-6 (Accession number NC_000951) | hypothetical protein BB_M26 | 16097 | 16456 | + | 119 | 11497201 | 1194577 |
| Plasmid cp32-6 (Accession number NC_000951) | rev protein | 16593 | 17075 | - | 160 | 11497202 | 1194578 |

Fig. 27 continued

| | | | | | | | |
|---|---|---|---|---|---|---|---|
| Plasmid cp32-6 (Accession number NC_000951) | lipoprotein | 17247 | 17696 | + | 149 | 11497203 | 1194579 |
| Plasmid cp32-6 (Accession number NC_000951) | hypothetical protein BB_M29 | 17733 | 18680 | - | 315 | 11497204 | 1194580 |
| Plasmid cp32-6 (Accession number NC_000951) | hypothetical protein BB_M30 | 19069 | 20169 | + | 366 | 11497205 | 1194581 |
| Plasmid cp32-6 (Accession number NC_000951) | hypothetical protein BB_M31 | 20179 | 20745 | + | 188 | 11497206 | 1194582 |
| Plasmid cp32-6 (Accession number NC_000951) | plasmid partition protein, putative | 20721 | 21470 | + | 249 | 11497207 | 1194583 |
| Plasmid cp32-6 (Accession number NC_000951) | hypothetical protein BB_M33 | 21520 | 22098 | + | 192 | 11497208 | 1194584 |
| Plasmid cp32-6 (Accession number NC_000951) | BdrK | 22102 | 22770 | + | 222 | 11497209 | 1194585 |
| Plasmid cp32-6 (Accession number NC_000951) | BppA | 23241 | 24566 | + | 441 | 11497210 | 1194586 |
| Plasmid cp32-6 (Accession number NC_000951) | BppB | 24619 | 25044 | + | 141 | 11497211 | 1194587 |
| Plasmid cp32-6 (Accession number NC_000951) | BppC | 25050 | 25820 | - | 256 | 11497212 | 1194588 |
| Plasmid cp32-6 (Accession number NC_000951) | ErpK | 26245 | 27015 | + | 256 | 11497213 | 1194589 |
| Plasmid cp32-6 (Accession number NC_000951) | hypothetical protein BB_M39 | 27077 | 27745 | - | 222 | 11497223 | 1194599 |
| Plasmid cp32-6 (Accession number NC_000951) | hypothetical protein BB_M40 | 27731 | 27853 | + | 40 | 11497222 | 1194598 |
| Plasmid cp32-6 (Accession number NC_000951) | hypothetical protein BB_M41 | 27923 | 28489 | + | 188 | 11497224 | 1194600 |
| Plasmid cp32-6 (Accession number NC_000951) | hypothetical protein BB_M42 | 28486 | 29836 | + | 450 | 11497214 | 1194590 |
| Plasmid cp32-7 (Accession number NC_000952) | hypothetical protein BB_O01 | 65 | 1288 | + | 407 | 11497267 | 1194642 |
| Plasmid cp32-7 (Accession number NC_000952) | hypothetical protein BB_O02 | 1305 | 1997 | + | 230 | 11497268 | 1194643 |

Fig. 27 continued

| | | | | | | | |
|---|---|---|---|---|---|---|---|
| Plasmid cp32-7 (Accession number NC_000952) | hypothetical protein BB_O03 | 2010 | 2567 | + | 185 | 11497269 | 1194644 |
| Plasmid cp32-7 (Accession number NC_000952) | hypothetical protein BB_O04 | 2574 | 3338 | + | 254 | 11497270 | 1194645 |
| Plasmid cp32-7 (Accession number NC_000952) | hypothetical protein BB_O05 | 3368 | 3940 | + | 190 | 11497271 | 1194646 |
| Plasmid cp32-7 (Accession number NC_000952) | hypothetical protein BB_O06 | 3962 | 4921 | + | 319 | 11497248 | 1194623 |
| Plasmid cp32-7 (Accession number NC_000952) | hypothetical protein BB_O07 | 4935 | 5396 | + | 153 | 11497249 | 1194624 |
| Plasmid cp32-7 (Accession number NC_000952) | hypothetical protein BB_O08 | 5378 | 5779 | + | 133 | 11497250 | 1194625 |
| Plasmid cp32-7 (Accession number NC_000952) | hypothetical protein BB_O09 | 5767 | 6156 | + | 129 | 11497251 | 1194626 |
| Plasmid cp32-7 (Accession number NC_000952) | hypothetical protein BB_O10 | 6153 | 6722 | + | 189 | 11497252 | 1194627 |
| Plasmid cp32-7 (Accession number NC_000952) | hypothetical protein BB_O11 | 6703 | 7815 | + | 370 | 11497272 | 1194647 |
| Plasmid cp32-7 (Accession number NC_000952) | hypothetical protein BB_O12 | 7830 | 8258 | + | 142 | 11497273 | 1194648 |
| Plasmid cp32-7 (Accession number NC_000952) | hypothetical protein BB_O13 | 8274 | 8729 | + | 151 | 11497274 | 1194649 |
| Plasmid cp32-7 (Accession number NC_000952) | hypothetical protein BB_O14 | 8726 | 8962 | + | 78 | 11497275 | 1194650 |
| Plasmid cp32-7 (Accession number NC_000952) | hypothetical protein BB_O15 | 8970 | 10304 | + | 444 | 11497276 | 1194651 |
| Plasmid cp32-7 (Accession number NC_000952) | hypothetical protein BB_O16 | 10317 | 10958 | + | 213 | 11497277 | 1194652 |
| Plasmid cp32-7 (Accession number NC_000952) | hypothetical protein BB_O17 | 10962 | 11903 | + | 313 | 11497278 | 1194653 |
| Plasmid cp32-7 (Accession number NC_000952) | hypothetical protein BB_O18 | 11904 | 12473 | + | 189 | 11497279 | 1194654 |
| Plasmid cp32-7 (Accession number NC_000952) | hypothetical protein BB_O19 | 12503 | 12835 | + | 110 | 11497253 | 1194628 |

Fig. 27 continued

| | | | | | | | |
|---|---|---|---|---|---|---|---|
| Plasmid cp32-7 (Accession number NC_000952) | hypothetical protein BB_O20 | 12832 | 13710 | + | 292 | 11497254 | 1194629 |
| Plasmid cp32-7 (Accession number NC_000952) | hypothetical protein BB_O21 | 13716 | 14321 | + | 201 | 11497255 | 1194630 |
| Plasmid cp32-7 (Accession number NC_000952) | hypothetical protein BB_O22 | 14331 | 15146 | + | 271 | 11497256 | 1194631 |
| Plasmid cp32-7 (Accession number NC_000952) | pore-forming hemolysin | 15222 | 15425 | + | 67 | 11497257 | 1194632 |
| Plasmid cp32-7 (Accession number NC_000952) | hemolysin accessory protein | 15429 | 15785 | + | 118 | 11497258 | 1194633 |
| Plasmid cp32-7 (Accession number NC_000952) | hypothetical protein BB_O25 | 15766 | 16101 | + | 111 | 11497259 | 1194634 |
| Plasmid cp32-7 (Accession number NC_000952) | hypothetical protein BB_O26 | 16088 | 16447 | + | 119 | 11497260 | 1194635 |
| Plasmid cp32-7 (Accession number NC_000952) | BdrN | 16522 | 17139 | + | 205 | 11497261 | 1194636 |
| Plasmid cp32-7 (Accession number NC_000952) | lipoprotein | 17245 | 17667 | + | 140 | 11497262 | 1194637 |
| Plasmid cp32-7 (Accession number NC_000952) | hypothetical protein BB_O29 | 17712 | 18770 | - | 352 | 11497280 | 1194655 |
| Plasmid cp32-7 (Accession number NC_000952) | hypothetical protein BB_O30 | 19117 | 20214 | + | 365 | 11497237 | 1194612 |
| Plasmid cp32-7 (Accession number NC_000952) | hypothetical protein BB_O31 | 20224 | 20790 | + | 188 | 11497238 | 1194613 |
| Plasmid cp32-7 (Accession number NC_000952) | plasmid partition protein, putative | 20766 | 21515 | + | 249 | 11497239 | 1194614 |
| Plasmid cp32-7 (Accession number NC_000952) | hypothetical protein BB_O33 | 21522 | 22076 | + | 184 | 11497240 | 1194615 |
| Plasmid cp32-7 (Accession number NC_000952) | BdrM | 22088 | 22660 | + | 190 | 11497241 | 1194616 |
| Plasmid cp32-7 (Accession number NC_000952) | hypothetical protein BB_O35 | 22627 | 22755 | - | 42 | 11497263 | 1194638 |
| Plasmid cp32-7 (Accession number NC_000952) | BppA | 23093 | 24460 | + | 455 | 11497242 | 1194617 |
| Plasmid cp32-7 (Accession number | BppB | 24513 | 24938 | + | 141 | 11497243 | 1194618 |

Fig. 27 continued

| | | | | | | | |
|---|---|---|---|---|---|---|---|
| NC_000952) | | | | | | | |
| Plasmid cp32-7 (Accession number NC_000952) | BppC | 24944 | 25720 | - | 258 | 11497244 | 1194619 |
| Plasmid cp32-7 (Accession number NC_000952) | ErpL | 26152 | 26841 | + | 229 | 11497245 | 1194620 |
| Plasmid cp32-7 (Accession number NC_000952) | ErpM | 26893 | 27984 | + | 363 | 11497246 | 1194621 |
| Plasmid cp32-7 (Accession number NC_000952) | hypothetical protein BB_O41 | 28004 | 28117 | - | 37 | 11497264 | 1194639 |
| Plasmid cp32-7 (Accession number NC_000952) | hypothetical protein BB_O42 | 28134 | 28703 | + | 189 | 11497265 | 1194640 |
| Plasmid cp32-7 (Accession number NC_000952) | hypothetical protein BB_O43 | 28885 | 29451 | + | 188 | 11497266 | 1194641 |
| Plasmid cp32-7 (Accession number NC_000952) | hypothetical protein BB_O44 | 29448 | 30800 | + | 450 | 11497247 | 1194622 |
| Plasmid cp32-8 (Accession number NC_000953) | hypothetical protein BB_L01 | 66 | 1289 | + | 407 | 11497312 | 1194686 |
| Plasmid cp32-8 (Accession number NC_000953) | hypothetical protein BB_L02 | 1306 | 1998 | + | 230 | 11497313 | 1194687 |
| Plasmid cp32-8 (Accession number NC_000953) | hypothetical protein BB_L03 | 2011 | 2568 | + | 185 | 11497314 | 1194688 |
| Plasmid cp32-8 (Accession number NC_000953) | hypothetical protein BB_L04 | 2575 | 3339 | + | 254 | 11497315 | 1194689 |
| Plasmid cp32-8 (Accession number NC_000953) | hypothetical protein BB_L05 | 3369 | 3941 | + | 190 | 11497316 | 1194690 |
| Plasmid cp32-8 (Accession number NC_000953) | hypothetical protein BB_L06 | 3948 | 4922 | + | 324 | 11497293 | 1194667 |
| Plasmid cp32-8 (Accession number NC_000953) | hypothetical protein BB_L07 | 4936 | 5397 | + | 153 | 11497294 | 1194668 |

Fig. 27 continued

| | | | | | | | |
|---|---|---|---|---|---|---|---|
| Plasmid cp32-8 (Accession number NC_000953) | hypothetical protein BB_L08 | 5379 | 5780 | + | 133 | 11497295 | 1194669 |
| Plasmid cp32-8 (Accession number NC_000953) | hypothetical protein BB_L09 | 5768 | 6157 | + | 129 | 11497296 | 1194670 |
| Plasmid cp32-8 (Accession number NC_000953) | hypothetical protein BB_L10 | 6154 | 6720 | + | 188 | 11497297 | 1194671 |
| Plasmid cp32-8 (Accession number NC_000953) | hypothetical protein BB_L11 | 6701 | 7813 | + | 370 | 11497317 | 1194691 |
| Plasmid cp32-8 (Accession number NC_000953) | hypothetical protein BB_L12 | 7828 | 8256 | + | 142 | 11497318 | 1194692 |
| Plasmid cp32-8 (Accession number NC_000953) | hypothetical protein BB_L13 | 8272 | 8727 | + | 151 | 11497319 | 1194693 |
| Plasmid cp32-8 (Accession number NC_000953) | hypothetical protein BB_L14 | 8724 | 8960 | + | 78 | 11497320 | 1194694 |
| Plasmid cp32-8 (Accession number NC_000953) | hypothetical protein BB_L15 | 8968 | 10242 | + | 424 | 11497321 | 1194695 |
| Plasmid cp32-8 (Accession number NC_000953) | hypothetical protein BB_L16 | 10265 | 10948 | + | 227 | 11497322 | 1194696 |
| Plasmid cp32-8 (Accession number NC_000953) | hypothetical protein BB_L17 | 10952 | 11902 | + | 316 | 11497323 | 1194697 |
| Plasmid cp32-8 (Accession number NC_000953) | hypothetical protein BB_L18 | 11920 | 12465 | + | 181 | 11497324 | 1194698 |
| Plasmid cp32-8 (Accession number NC_000953) | hypothetical protein BB_L19 | 12495 | 12827 | + | 110 | 11497298 | 1194672 |

Fig. 27 continued

| | | | | | | | |
|---|---|---|---|---|---|---|---|
| Plasmid cp32-8 (Accession number NC_000953) | hypothetical protein BB_L20 | 12824 | 13699 | + | 291 | 11497299 | 1194673 |
| Plasmid cp32-8 (Accession number NC_000953) | hypothetical protein BB_L21 | 13709 | 14314 | + | 201 | 11497300 | 1194674 |
| Plasmid cp32-8 (Accession number NC_000953) | hypothetical protein BB_L22 | 14324 | 15139 | + | 271 | 11497301 | 1194675 |
| Plasmid cp32-8 (Accession number NC_000953) | pore forming hemolysin | 15215 | 15416 | + | 67 | 11497302 | 1194676 |
| Plasmid cp32-8 (Accession number NC_000953) | hemolysin accessory protein | 15422 | 15769 | + | 115 | 11497303 | 1194677 |
| Plasmid cp32-8 (Accession number NC_000953) | hypothetical protein BB_L25 | 15759 | 16094 | + | 111 | 11497304 | 1194678 |
| Plasmid cp32-8 (Accession number NC_000953) | hypothetical protein BB_L26 | 16081 | 16440 | + | 119 | 11497305 | 1194679 |
| Plasmid cp32-8 (Accession number NC_000953) | BdrP | 16515 | 17099 | + | 194 | 11497306 | 1194680 |
| Plasmid cp32-8 (Accession number NC_000953) | lipoprotein | 17205 | 17651 | + | 148 | 11497307 | 1194681 |
| Plasmid cp32-8 (Accession number NC_000953) | hypothetical protein BB_L29 | 17688 | 18761 | – | 357 | 11497308 | 1194682 |
| Plasmid cp32-8 (Accession number NC_000953) | hypothetical protein BB_L30 | 19091 | 20188 | + | 365 | 11497282 | 1194656 |
| Plasmid cp32-8 (Accession number NC_000953) | hypothetical protein BB_L31 | 20198 | 20764 | + | 188 | 11497283 | 1194657 |
| Plasmid cp32-8 (Accession number NC_000953) | plasmid partition protein, putative | 20740 | 21480 | + | 246 | 11497284 | 1194658 |

Fig. 27 continued

| | | | | | | | |
|---|---|---|---|---|---|---|---|
| Plasmid cp32-8 (Accession number NC_000953) | hypothetical protein BB_L33 | 21467 | 21559 | + | 30 | 11497309 | 1194683 |
| Plasmid cp32-8 (Accession number NC_000953) | hypothetical protein BB_L34 | 21540 | 22100 | + | 186 | 11497285 | 1194659 |
| Plasmid cp32-8 (Accession number NC_000953) | BdrO | 22113 | 22691 | + | 192 | 11497286 | 1194660 |
| Plasmid cp32-8 (Accession number NC_000953) | BppA | 23306 | 24691 | + | 461 | 11497287 | 1194661 |
| Plasmid cp32-8 (Accession number NC_000953) | BppB | 24744 | 25169 | + | 141 | 11497288 | 1194662 |
| Plasmid cp32-8 (Accession number NC_000953) | BppC | 25175 | 25951 | - | 258 | 11497289 | 1194663 |
| Plasmid cp32-8 (Accession number NC_000953) | ErpN | 26370 | 26903 | + | 177 | 11497290 | 1194664 |
| Plasmid cp32-8 (Accession number NC_000953) | ErpO | 26931 | 28067 | + | 378 | 11497291 | 1194665 |
| Plasmid cp32-8 (Accession number NC_000953) | hypothetical protein BB_L41 | 28209 | 28790 | + | 193 | 11497310 | 1194684 |
| Plasmid cp32-8 (Accession number NC_000953) | hypothetical protein BB_L42 | 28970 | 29536 | + | 188 | 11497311 | 1194685 |
| Plasmid cp32-8 (Accession number NC_000953) | hypothetical protein BB_L43 | 29533 | 30885 | + | 450 | 11497292 | 1194666 |
| Plasmid cp32-9 (Accession number NC_000954) | hypothetical protein BBN01 | 66 | 1292 | + | 408 | 11497348 | 1194725 |
| Plasmid cp32-9 (Accession number NC_000954) | hypothetical protein BBN02 | 1309 | 2001 | + | 230 | 11497349 | 1194726 |
| Plasmid cp32-9 (Accession number NC_000954) | hypothetical protein BBN03 | 2013 | 2579 | + | 188 | 11497350 | 1194727 |

Fig. 27 continued

| | | | | | | | |
|---|---|---|---|---|---|---|---|
| Plasmid cp32-9 (Accession number NC_000954) | hypothetical protein BBN04 | 2583 | 3350 | + | 255 | 11497351 | 1194728 |
| Plasmid cp32-9 (Accession number NC_000954) | hypothetical protein BBN07 | 4958 | 5413 | + | 151 | 11497326 | 1194699 |
| Plasmid cp32-9 (Accession number NC_000954) | hypothetical protein BBN08 | 5395 | 5796 | + | 133 | 11497327 | 1194700 |
| Plasmid cp32-9 (Accession number NC_000954) | hypothetical protein BBN09 | 5784 | 6173 | + | 129 | 11497328 | 1194701 |
| Plasmid cp32-9 (Accession number NC_000954) | hypothetical protein BBN10 | 6170 | 6736 | + | 188 | 11497329 | 1194702 |
| Plasmid cp32-9 (Accession number NC_000954) | hypothetical protein BBN11 | 6717 | 7805 | + | 362 | 11497352 | 1194729 |
| Plasmid cp32-9 (Accession number NC_000954) | hypothetical protein BBN12 | 7845 | 8273 | + | 142 | 11497353 | 1194730 |
| Plasmid cp32-9 (Accession number NC_000954) | hypothetical protein BBN14 | 8742 | 8978 | + | 78 | 11497354 | 1194731 |
| Plasmid cp32-9 (Accession number NC_000954) | hypothetical protein BBN15 | 8986 | 10260 | + | 424 | 11497355 | 1194732 |
| Plasmid cp32-9 (Accession number NC_000954) | hypothetical protein BBN17 | 11041 | 11991 | + | 316 | 11497356 | 1194733 |
| Plasmid cp32-9 (Accession number NC_000954) | hypothetical protein BBN19 | 12593 | 12925 | + | 110 | 11497330 | 1194703 |
| Plasmid cp32-9 (Accession number NC_000954) | hypothetical protein BBN20 | 12922 | 13797 | + | 291 | 11497331 | 1194704 |

Fig. 27 continued

| | | | | | | | |
|---|---|---|---|---|---|---|---|
| Plasmid cp32-9 (Accession number NC_000954) | pore-forming hemolysin | 15312 | 15515 | + | 67 | 11497332 | 1194707 |
| Plasmid cp32-9 (Accession number NC_000954) | hemolysin accessory protein | 15519 | 15866 | + | 115 | 11497333 | 1194708 |
| Plasmid cp32-9 (Accession number NC_000954) | hypothetical protein BBN25 | 15856 | 16191 | + | 111 | 11497334 | 1194709 |
| Plasmid cp32-9 (Accession number NC_000954) | outer surface protein, putative | 16178 | 16537 | + | 119 | 11497335 | 1194710 |
| Plasmid cp32-9 (Accession number NC_000954) | BdrR | 16612 | 17196 | + | 194 | 11497336 | 1194711 |
| Plasmid cp32-9 (Accession number NC_000954) | lipoprotein | 17302 | 17730 | + | 142 | 11497337 | 1194712 |
| Plasmid cp32-9 (Accession number NC_000954) | hypothetical protein BBN30 | 19164 | 20264 | + | 366 | 11497338 | 1194714 |
| Plasmid cp32-9 (Accession number NC_000954) | hypothetical protein BBN31 | 20275 | 20841 | + | 188 | 11497339 | 1194715 |
| Plasmid cp32-9 (Accession number NC_000954) | plasmid partition protein, putative | 20817 | 21572 | + | 251 | 11497340 | 1194716 |
| Plasmid cp32-9 (Accession number NC_000954) | hypothetical protein BBN33 | 21614 | 22174 | + | 186 | 11497341 | 1194717 |
| Plasmid cp32-9 (Accession number NC_000954) | BdrQ | 22184 | 22723 | + | 179 | 11497342 | 1194718 |
| Plasmid cp32-9 (Accession number NC_000954) | BppA | 23194 | 24519 | + | 441 | 11497343 | 1194719 |
| Plasmid cp32-9 (Accession number NC_000954) | BppB | 24572 | 24997 | + | 141 | 11497344 | 1194720 |
| Plasmid cp32-9 (Accession number NC_000954) | BppC | 25558 | 25779 | - | 73 | 21536987 | 1194721 |
| Plasmid cp32-9 (Accession number | ErpP | 26210 | 26770 | + | 186 | 11497345 | 1194722 |

Fig. 27 continued

| | | | | | | | |
|---|---|---|---|---|---|---|---|
| NC_000954) | | | | | | | |
| Plasmid cp32-9 (Accession number NC_000954) | ErpQ | 26798 | 27829 | + | 343 | 11497346 | 1194723 |
| Plasmid cp32-9 (Accession number NC_000954) | hypothetical protein BBN40 | 27881 | 27991 | - | 36 | 11497358 | 1194735 |
| Plasmid cp32-9 (Accession number NC_000954) | hypothetical protein BBN41 | 27984 | 28544 | + | 186 | 11497357 | 1194734 |
| Plasmid cp32-9 (Accession number NC_000954) | hypothetical protein BBN42 | 28736 | 29302 | + | 188 | 11497359 | 1194736 |
| Plasmid cp32-9 (Accession number NC_000954) | hypothetical protein BBN43 | 29299 | 30651 | + | 450 | 11497347 | 1194724 |
| Plasmid lp21 (Accession number NC_000955) | hypothetical protein BBU01 | 184 | 618 | + | 144 | 11497367 | 1194744 |
| Plasmid lp21 (Accession number NC_000955) | hypothetical protein BBU02 | 746 | 1114 | + | 122 | 11497368 | 1194745 |
| Plasmid lp21 (Accession number NC_000955) | hypothetical protein BBU03 | 1238 | 1357 | - | 39 | 11497369 | 1194746 |
| Plasmid lp21 (Accession number NC_000955) | hypothetical protein BBU04 | 1486 | 2628 | + | 380 | 11497361 | 1194737 |
| Plasmid lp21 (Accession number NC_000955) | plasmid partition protein, putative | 2868 | 3656 | + | 262 | 11497362 | 1194738 |
| Plasmid lp21 (Accession number NC_000955) | hypothetical protein BBU06 | 14633 | 15235 | + | 200 | 11497363 | 1194739 |
| Plasmid lp21 (Accession number NC_000955) | hypothetical protein BBU07 | 15349 | 15813 | + | 154 | 11497364 | 1194740 |

Fig. 27 continued

| | | | | | | | |
|---|---|---|---|---|---|---|---|
| Plasmid lp21 (Accession number NC_000955) | hypothetical protein BBU08 | 15791 | 16084 | + | 97 | 11497370 | 1194747 |
| Plasmid lp21 (Accession number NC_000955) | hypothetical protein BBU09 | 16228 | 16548 | - | 106 | 11497365 | 1194741 |
| Plasmid lp21 (Accession number NC_000955) | hypothetical protein BBU10 | 16603 | 16800 | + | 65 | 11497371 | 1194748 |
| Plasmid lp21 (Accession number NC_000955) | hypothetical protein BBU11 | 16886 | 17876 | + | 330 | 11497366 | 1194742 |
| Plasmid lp56 (Accession number NC_000956) | hypothetical protein BB_Q01 | 279 | 548 | + | 89 | 11497373 | 1194749 |
| Plasmid lp56 (Accession number NC_000956) | hypothetical protein BB_Q02 | 710 | 802 | + | 30 | 11497407 | 1194793 |
| Plasmid lp56 (Accession number NC_000956) | outer membrane protein, putative | 856 | 1407 | + | 183 | 11497374 | 1194750 |
| Plasmid lp56 (Accession number NC_000956) | antigen, P35, putative | 2744 | 3496 | + | 250 | 11497375 | 1194752 |
| Plasmid lp56 (Accession number NC_000956) | hypothetical protein BB_Q06 | 3623 | 4108 | + | 161 | 11497376 | 1194753 |
| Plasmid lp56 (Accession number NC_000956) | hypothetical protein BB_Q07 | 4249 | 4986 | - | 245 | 11497377 | 1194754 |
| Plasmid lp56 (Accession number NC_000956) | plasmid partition protein, putative | 5069 | 5830 | - | 253 | 11497378 | 1194755 |
| Plasmid lp56 (Accession number NC_000956) | hypothetical protein BB_Q09 | 5803 | 6339 | - | 178 | 11497379 | 1194756 |

Fig. 27 continued

| | | | | | | | |
|---|---|---|---|---|---|---|---|
| Plasmid lp56 (Accession number NC_000956) | hypothetical protein BB_Q10 | 6336 | 6674 | - | 112 | 11497408 | 1194794 |
| Plasmid lp56 (Accession number NC_000956) | hypothetical protein BB_Q12 | 6800 | 7411 | + | 203 | 11497409 | 1194795 |
| Plasmid lp56 (Accession number NC_000956) | hypothetical protein BB_Q13 | 7418 | 8392 | + | 324 | 11497380 | 1194757 |
| Plasmid lp56 (Accession number NC_000956) | hypothetical protein BB_Q14 | 8406 | 8867 | + | 153 | 11497381 | 1194758 |
| Plasmid lp56 (Accession number NC_000956) | hypothetical protein BB_Q15 | 8849 | 9250 | + | 133 | 11497382 | 1194759 |
| Plasmid lp56 (Accession number NC_000956) | hypothetical protein BB_Q17 | 9624 | 10190 | + | 188 | 11497383 | 1194761 |
| Plasmid lp56 (Accession number NC_000956) | hypothetical protein BB_Q18 | 10171 | 11283 | + | 370 | 11497410 | 1194796 |
| Plasmid lp56 (Accession number NC_000956) | hypothetical protein BB_Q19 | 11276 | 11725 | + | 149 | 11497411 | 1194797 |
| Plasmid lp56 (Accession number NC_000956) | hypothetical protein BB_Q20 | 11741 | 12196 | + | 151 | 11497412 | 1194798 |
| Plasmid lp56 (Accession number NC_000956) | hypothetical protein BB_Q21 | 12193 | 12429 | + | 78 | 11497413 | 1194799 |
| Plasmid lp56 (Accession number NC_000956) | hypothetical protein BB_Q22 | 12437 | 13732 | + | 431 | 11497414 | 1194800 |
| Plasmid lp56 (Accession number NC_000956) | hypothetical protein BB_Q23 | 13755 | 14438 | + | 227 | 11497415 | 1194801 |

Fig. 27 continued

| Plasmid lp56 (Accession number NC_000956) | hypothetical protein BB_Q24 | 14442 | 15392 | + | 316 | 11497416 | 1194802 |
|---|---|---|---|---|---|---|---|
| Plasmid lp56 (Accession number NC_000956) | hypothetical protein BB_Q25 | 15410 | 15964 | + | 184 | 11497417 | 1194803 |
| Plasmid lp56 (Accession number NC_000956) | hypothetical protein BB_Q26 | 15994 | 16326 | + | 110 | 11497384 | 1194762 |
| Plasmid lp56 (Accession number NC_000956) | hypothetical protein BB_Q27 | 16323 | 17196 | + | 291 | 11497385 | 1194763 |
| Plasmid lp56 (Accession number NC_000956) | hypothetical protein BB_Q28 | 17208 | 17813 | + | 201 | 11497386 | 1194764 |
| Plasmid lp56 (Accession number NC_000956) | hypothetical protein BB_Q29 | 17823 | 18638 | + | 271 | 11497387 | 1194765 |
| Plasmid lp56 (Accession number NC_000956) | pore-forming hemolysin | 18713 | 18916 | + | 67 | 11497388 | 1194766 |
| Plasmid lp56 (Accession number NC_000956) | hemolysin accessory protein | 18920 | 19267 | + | 115 | 11497389 | 1194767 |
| Plasmid lp56 (Accession number NC_000956) | hypothetical protein BB_Q32 | 19257 | 19592 | + | 111 | 11497390 | 1194768 |
| Plasmid lp56 (Accession number NC_000956) | hypothetical protein BB_Q33 | 19579 | 19938 | + | 119 | 11497391 | 1194769 |
| Plasmid lp56 (Accession number NC_000956) | BdrW | 20022 | 20738 | + | 238 | 11497392 | 1194770 |
| Plasmid lp56 (Accession number NC_000956) | MlpJ | 20844 | 21455 | + | 203 | 11497393 | 1194771 |
| Plasmid lp56 (Accession number NC_000956) | hypothetical protein BB_Q36 | 21424 | 21516 | + | 30 | 11497418 | 1194804 |

Fig. 27 continued

| | | | | | | | |
|---|---|---|---|---|---|---|---|
| Plasmid lp56 (Accession number NC_000956) | hypothetical protein BB_Q37 | 21532 | 22479 | - | 315 | 11497394 | 1194772 |
| Plasmid lp56 (Accession number NC_000956) | hypothetical protein BB_Q38 | 22869 | 23966 | + | 365 | 11497395 | 1194773 |
| Plasmid lp56 (Accession number NC_000956) | hypothetical protein BB_Q39 | 23976 | 24542 | + | 188 | 11497396 | 1194774 |
| Plasmid lp56 (Accession number NC_000956) | plasmid partition protein, putative | 24518 | 25273 | + | 251 | 11497397 | 1194775 |
| Plasmid lp56 (Accession number NC_000956) | hypothetical protein BB_Q41 | 25317 | 25877 | + | 186 | 11497398 | 1194776 |
| Plasmid lp56 (Accession number NC_000956) | BdrV | 25890 | 26426 | + | 178 | 11497399 | 1194777 |
| Plasmid lp56 (Accession number NC_000956) | BppA | 26879 | 28246 | + | 455 | 11497400 | 1194778 |
| Plasmid lp56 (Accession number NC_000956) | BppB | 28299 | 28724 | + | 141 | 11497401 | 1194779 |
| Plasmid lp56 (Accession number NC_000956) | BppC | 28730 | 29506 | - | 258 | 11497402 | 1194780 |
| Plasmid lp56 (Accession number NC_000956) | hypothetical protein BB_Q46 | 29559 | 29654 | + | 31 | 11497419 | 1194805 |
| Plasmid lp56 (Accession number NC_000956) | ErpX | 29937 | 30974 | + | 345 | 11497403 | 1194781 |
| Plasmid lp56 (Accession number NC_000956) | hypothetical protein BB_Q48 | 31117 | 31710 | + | 197 | 11497420 | 1194806 |
| Plasmid lp56 (Accession number NC_000956) | hypothetical protein BB_Q49 | 31892 | 32458 | + | 188 | 11497421 | 1194807 |
| Plasmid lp56 (Accession number NC_000956) | hypothetical protein BB_Q50 | 32455 | 33807 | + | 450 | 11497404 | 1194782 |

Fig. 27 continued

| | | | | | | | |
|---|---|---|---|---|---|---|---|
| Plasmid lp56 (Accession number NC_000956) | hypothetical protein BB_Q52 | 35115 | 35807 | + | 230 | 11497422 | 1194808 |
| Plasmid lp56 (Accession number NC_000956) | hypothetical protein BB_Q53 | 35819 | 36385 | + | 188 | 11497423 | 1194809 |
| Plasmid lp56 (Accession number NC_000956) | hypothetical protein BB_Q54 | 36389 | 37135 | + | 248 | 11497424 | 1194810 |
| Plasmid lp56 (Accession number NC_000956) | hypothetical protein BB_Q56 | 37669 | 37809 | - | 46 | 11497425 | 1194811 |
| Plasmid lp56 (Accession number NC_000956) | hypothetical protein BB_Q57 | 37816 | 38223 | - | 135 | 11497426 | 1194812 |
| Plasmid lp56 (Accession number NC_000956) | hypothetical protein BB_Q58 | 38416 | 38514 | - | 32 | 11497427 | 1194813 |
| Plasmid lp56 (Accession number NC_000956) | hypothetical protein BB_Q59 | 38565 | 39077 | - | 170 | 11497428 | 1194814 |
| Plasmid lp56 (Accession number NC_000956) | hypothetical protein BB_Q61 | 39357 | 39482 | - | 41 | 11497429 | 1194815 |
| Plasmid lp56 (Accession number NC_000956) | hypothetical protein BB_Q62 | 39531 | 39905 | + | 124 | 11497430 | 1194816 |
| Plasmid lp56 (Accession number NC_000956) | hypothetical protein BB_Q64 | 39959 | 40186 | - | 75 | 11497431 | 1194817 |
| Plasmid lp56 (Accession number NC_000956) | hypothetical protein BB_Q66 | 40317 | 40412 | + | 31 | 11497432 | 1194818 |
| Plasmid lp56 (Accession number NC_000956) | adenine specific DNA methyltransferase | 40436 | 43732 | - | 1098 | 11497405 | 1194785 |

Fig. 27 continued

| | | | | | | | |
|---|---|---|---|---|---|---|---|
| Plasmid lp56 (Accession number NC_000956) | hypothetical protein BB_Q68 | 43915 | 44232 | - | 105 | 11497433 | 1194819 |
| Plasmid lp56 (Accession number NC_000956) | hypothetical protein BB_Q70 | 44508 | 44612 | - | 34 | 11497434 | 1194820 |
| Plasmid lp56 (Accession number NC_000956) | hypothetical protein BB_Q72 | 45314 | 45430 | + | 38 | 11497435 | 1194821 |
| Plasmid lp56 (Accession number NC_000956) | hypothetical protein BB_Q76 | 46982 | 47080 | + | 32 | 11497436 | 1194822 |
| Plasmid lp56 (Accession number NC_000956) | hypothetical protein BB_Q78 | 47295 | 47396 | + | 33 | 11497437 | 1194823 |
| Plasmid lp56 (Accession number NC_000956) | hypothetical protein BB_Q82 | 49344 | 49538 | - | 64 | 11497438 | 1194824 |
| Plasmid lp56 (Accession number NC_000956) | hypothetical protein BB_Q83 | 49752 | 49868 | - | 38 | 11497439 | 1194825 |
| Plasmid lp56 (Accession number NC_000956) | hypothetical protein BB_Q84 | 50395 | 50550 | - | 51 | 11497440 | 1194826 |
| Plasmid lp56 (Accession number NC_000956) | hypothetical protein BB_Q85 | 51172 | 51528 | - | 118 | 11497406 | 1194792 |
| Plasmid lp56 (Accession number NC_000956) | hypothetical protein BB_Q86 | 51719 | 51823 | - | 34 | 11497441 | 1194827 |
| Plasmid lp56 (Accession number NC_000956) | hypothetical protein BB_Q87 | 51918 | 52067 | - | 49 | 11497442 | 1194828 |
| Plasmid lp56 (Accession number NC_000956) | hypothetical protein BB_Q88 | 52135 | 52608 | - | 157 | 11497443 | 1194829 |

Fig. 27 continued

| | | | | | | | |
|---|---|---|---|---|---|---|---|
| Plasmid lp56 (Accession number NC_000956) | hypothetical protein BB_Q89 | 52532 | 52726 | - | 64 | 11497444 | 1194830 |
| Plasmid lp5 (Accession number NC_000957) | hypothetical protein BB_T01 | 195 | 638 | + | 147 | 11497450 | 1194835 |
| Plasmid lp5 (Accession number NC_000957) | hypothetical protein BB_T02 | 744 | 1097 | + | 117 | 11497446 | 1194831 |
| Plasmid lp5 (Accession number NC_000957) | hypothetical protein BB_T03 | 1208 | 1576 | + | 122 | 11497451 | 1194836 |
| Plasmid lp5 (Accession number NC_000957) | hypothetical protein BB_T04 | 2148 | 3254 | + | 368 | 11497447 | 1194832 |
| Plasmid lp5 (Accession number NC_000957) | hypothetical protein BB_T06 | 3340 | 4332 | + | 330 | 11497448 | 1194833 |
| Plasmid lp5 (Accession number NC_000957) | outer membrane protein | 4388 | 4819 | + | 143 | 11497449 | 1194834 |
| Plasmid lp17 (Accession number NC_001849) | hypothetical protein BBD01 | 332 | 805 | + | 157 | 11496586 | 1194013 |
| Plasmid lp17 (Accession number NC_001849) | hypothetical protein BBD02 | 873 | 1022 | + | 49 | 11496599 | 1194028 |
| Plasmid lp17 (Accession number NC_001849) | hypothetical protein BBD03 | 1117 | 1221 | + | 34 | 11496598 | 1194027 |
| Plasmid lp17 (Accession number NC_001849) | hypothetical protein BBD04 | 1412 | 1768 | + | 118 | 11496585 | 1194012 |
| Plasmid lp17 (Accession number NC_001849) | hypothetical protein BBD05 | 2389 | 2544 | + | 51 | 11496584 | 1194011 |

Fig. 27 continued

| | | | | | | | |
|---|---|---|---|---|---|---|---|
| Plasmid lp17 (Accession number NC_001849) | hypothetical protein BBD06 | 3143 | 3607 | + | 154 | 11496596 | 1194024 |
| Plasmid lp17 (Accession number NC_001849) | hypothetical protein BBD07 | 4257 | 4373 | - | 38 | 11496606 | 1194035 |
| Plasmid lp17 (Accession number NC_001849) | hypothetical protein BBD08 | 4707 | 4805 | + | 32 | 11496605 | 1194034 |
| Plasmid lp17 (Accession number NC_001849) | hypothetical protein BBD09 | 5058 | 5741 | + | 227 | 11496595 | 1194023 |
| Plasmid lp17 (Accession number NC_001849) | hypothetical protein BBD10 | 5876 | 6454 | - | 192 | 11496594 | 1194022 |
| Plasmid lp17 (Accession number NC_001849) | hypothetical protein BBD11 | 6681 | 7634 | + | 317 | 11496593 | 1194021 |
| Plasmid lp17 (Accession number NC_001849) | hypothetical protein BBD12 | 7621 | 7752 | - | 43 | 11496604 | 1194033 |
| Plasmid lp17 (Accession number NC_001849) | hypothetical protein BBD13 | 7787 | 8113 | + | 108 | 11496592 | 1194020 |
| Plasmid lp17 (Accession number NC_001849) | hypothetical protein BBD14 | 8269 | 9381 | + | 370 | 11496591 | 1194019 |
| Plasmid lp17 (Accession number NC_001849) | hypothetical protein BBD15 | 9593 | 10015 | - | 140 | 11496590 | 1194018 |
| Plasmid lp17 (Accession number NC_001849) | hypothetical protein BBD16 | 10425 | 10520 | - | 31 | 11496603 | 1194032 |
| Plasmid lp17 (Accession number NC_001849) | hypothetical protein BBD17 | 10591 | 10686 | + | 31 | 11496601 | 1194030 |

Fig. 27 continued

| | | | | | | | |
|---|---|---|---|---|---|---|---|
| Plasmid lp17 (Accession number NC_001849) | hypothetical protein BBD18 | 10986 | 11646 | - | 220 | 11496588 | 1194015 |
| Plasmid lp17 (Accession number NC_001849) | hypothetical protein BBD19 | 12057 | 12170 | + | 37 | 11496600 | 1194029 |
| Plasmid lp17 (Accession number NC_001849) | hypothetical protein BBD21 | 13341 | 14081 | + | 246 | 11496587 | 1194014 |
| Plasmid lp17 (Accession number NC_001849) | hypothetical protein BBD22 | 14072 | 14341 | + | 89 | 11496589 | 1194017 |
| Plasmid lp17 (Accession number NC_001849) | hypothetical protein BBD24 | 15891 | 16121 | - | 76 | 11496597 | 1194026 |
| Plasmid lp17 (Accession number NC_001849) | hypothetical protein BBD25 | 16212 | 16370 | + | 52 | 11496602 | 1194031 |
| Plasmid lp25 (Accession number NC_001850) | hypothetical protein BBE01 | 154 | 255 | - | 33 | 11496632 | 1194063 |
| Plasmid lp25 (Accession number NC_001850) | hypothetical protein BBE02 | 323 | 4156 | - | 1277 | 11496616 | 1194047 |
| Plasmid lp25 (Accession number NC_001850) | hypothetical protein BBE03 | 4419 | 4613 | - | 64 | 11496617 | 1194048 |
| Plasmid lp25 (Accession number NC_001850) | hypothetical protein BBE04 | 4719 | 4859 | + | 46 | 11496618 | 1194049 |
| Plasmid lp25 (Accession number NC_001850) | hypothetical protein BBE05 | 5377 | 5529 | + | 50 | 11496615 | 1194046 |
| Plasmid lp25 (Accession number NC_001850) | hypothetical protein BBE06 | 5757 | 5906 | + | 49 | 11496625 | 1194056 |

Fig. 27 continued

| | | | | | | | |
|---|---|---|---|---|---|---|---|
| Plasmid lp25 (Accession number NC_001850) | hypothetical protein BBE07 | 6182 | 6355 | - | 57 | 11496626 | 1194057 |
| Plasmid lp25 (Accession number NC_001850) | hypothetical protein BBE08 | 6555 | 6701 | - | 48 | 11496627 | 1194058 |
| Plasmid lp25 (Accession number NC_001850) | protein p23 | 6898 | 7761 | + | 287 | 11496612 | 1194043 |
| Plasmid lp25 (Accession number NC_001850) | hypothetical protein BBE10 | 7874 | 7972 | - | 32 | 11496628 | 1194059 |
| Plasmid lp25 (Accession number NC_001850) | hypothetical protein BBE11 | 8312 | 8446 | - | 44 | 11496629 | 1194060 |
| Plasmid lp25 (Accession number NC_001850) | hypothetical protein BBE12 | 8521 | 8646 | - | 41 | 11496630 | 1194061 |
| Plasmid lp25 (Accession number NC_001850) | hypothetical protein BBE13 | 8863 | 8958 | + | 31 | 11496631 | 1194062 |
| Plasmid lp25 (Accession number NC_001850) | hypothetical protein BBE14 | 9163 | 9378 | + | 71 | 11496633 | 1194064 |
| Plasmid lp25 (Accession number NC_001850) | hypothetical protein BBE15 | 9353 | 9490 | - | 45 | 11496634 | 1194065 |
| Plasmid lp25 (Accession number NC_001850) | hypothetical protein BBE16 | 9567 | 10187 | - | 206 | 11496635 | 1194066 |
| Plasmid lp25 (Accession number NC_001850) | hypothetical protein BBE17 | 10200 | 10709 | - | 169 | 11496636 | 1194067 |
| Plasmid lp25 (Accession number NC_001850) | hypothetical protein BBE18 | 11498 | 12079 | - | 193 | 11496613 | 1194044 |
| Plasmid lp25 (Accession number NC_001850) | hypothetical protein BBE19 | 12096 | 12854 | - | 252 | 11496614 | 1194045 |

Fig. 27 continued

| | | | | | | | |
|---|---|---|---|---|---|---|---|
| Plasmid lp25 (Accession number NC_001850) | hypothetical protein BBE20 | 12830 | 13393 | - | 187 | 11496608 | 1194036 |
| Plasmid lp25 (Accession number NC_001850) | hypothetical protein BBE21 | 13403 | 14530 | - | 375 | 11496609 | 1194037 |
| Plasmid lp25 (Accession number NC_001850) | pyrazinamidase/nicotinamidase (pncA) | 15042 | 15578 | - | 178 | 11496610 | 1194038 |
| Plasmid lp25 (Accession number NC_001850) | hypothetical protein BBE23 | 15973 | 16158 | + | 61 | 11496620 | 1194051 |
| Plasmid lp25 (Accession number NC_001850) | hypothetical protein BBE25 | 18502 | 18606 | - | 34 | 11496621 | 1194052 |
| Plasmid lp25 (Accession number NC_001850) | hypothetical protein BBE26 | 18586 | 18714 | + | 42 | 11496619 | 1194050 |
| Plasmid lp25 (Accession number NC_001850) | hypothetical protein BBE27 | 19055 | 19198 | + | 47 | 11496622 | 1194053 |
| Plasmid lp25 (Accession number NC_001850) | hypothetical protein BBE28 | 19337 | 19489 | - | 50 | 11496623 | 1194054 |
| Plasmid lp25 (Accession number NC_001850) | hypothetical protein BBE30 | 21558 | 21704 | + | 48 | 11496624 | 1194055 |
| Plasmid lp25 (Accession number NC_001850) | antigen, P35, putative | 21946 | 22677 | - | 243 | 11496611 | 1194040 |
| Plasmid lp28-1 (Accession number NC_001851) | erpD protein, putative | 467 | 1465 | + | 332 | 11496643 | 1194073 |
| Plasmid lp28-1 (Accession number NC_001851) | hypothetical protein BBF02 | 1720 | 2076 | + | 118 | 11496642 | 1194072 |

Fig. 27 continued

| | | | | | | | |
|---|---|---|---|---|---|---|---|
| Plasmid lp28-1 (Accession number NC_001851) | hypothetical protein BBF03 | 2098 | 2619 | - | 173 | 11496641 | 1194071 |
| Plasmid lp28-1 (Accession number NC_001851) | hypothetical protein BBF04 | 2658 | 2807 | + | 49 | 11496658 | 1194094 |
| Plasmid lp28-1 (Accession number NC_001851) | hypothetical protein BBF05 | 2777 | 3076 | + | 99 | 11496657 | 1194093 |
| Plasmid lp28-1 (Accession number NC_001851) | hypothetical protein BBF06 | 3201 | 3380 | + | 59 | 11496640 | 1194070 |
| Plasmid lp28-1 (Accession number NC_001851) | hypothetical protein BBF07 | 3410 | 3529 | - | 39 | 11496656 | 1194092 |
| Plasmid lp28-1 (Accession number NC_001851) | hypothetical protein BBF08 | 3682 | 3849 | - | 55 | 11496655 | 1194091 |
| Plasmid lp28-1 (Accession number NC_001851) | hypothetical protein BBF09 | 4027 | 4182 | + | 51 | 11496654 | 1194090 |
| Plasmid lp28-1 (Accession number NC_001851) | hypothetical protein BBF10 | 4488 | 4985 | + | 165 | 11496653 | 1194089 |
| Plasmid lp28-1 (Accession number NC_001851) | hypothetical protein BBF11 | 5435 | 5542 | + | 35 | 11496652 | 1194088 |
| Plasmid lp28-1 (Accession number NC_001851) | hypothetical protein BBF13 | 6632 | 7381 | - | 249 | 11496639 | 1194069 |
| Plasmid lp28-1 (Accession number NC_001851) | hypothetical protein BBF14 | 7354 | 7911 | - | 185 | 11496638 | 1194068 |
| Plasmid lp28-1 (Accession number NC_001851) | hypothetical protein BBF15 | 8239 | 8370 | + | 43 | 11496651 | 1194087 |

Fig. 27 continued

| | | | | | | | |
|---|---|---|---|---|---|---|---|
| Plasmid lp28-1 (Accession number NC_001851) | hypothetical protein BBF16 | 8389 | 8574 | + | 61 | 11496650 | 1194086 |
| Plasmid lp28-1 (Accession number NC_001851) | hypothetical protein BBF17 | 8772 | 9029 | + | 85 | 11496660 | 1194096 |
| Plasmid lp28-1 (Accession number NC_001851) | hypothetical protein BBF20 | 10698 | 10991 | - | 97 | 11496649 | 1194079 |
| Plasmid lp28-1 (Accession number NC_001851) | hypothetical protein BBF21 | 11446 | 11550 | - | 34 | 11496659 | 1194095 |
| Plasmid lp28-1 (Accession number NC_001851) | protein p23, putative | 11791 | 12018 | - | 75 | 11496648 | 1194078 |
| Plasmid lp28-1 (Accession number NC_001851) | hypothetical protein BBF23 | 12441 | 12992 | - | 183 | 11496647 | 1194077 |
| Plasmid lp28-1 (Accession number NC_001851) | hypothetical protein BBF24 | 13029 | 13793 | - | 254 | 11496646 | 1194076 |
| Plasmid lp28-1 (Accession number NC_001851) | hypothetical protein BBF25 | 13769 | 14329 | - | 186 | 11496645 | 1194075 |
| Plasmid lp28-1 (Accession number NC_001851) | hypothetical protein BBF26 | 14351 | 15451 | - | 366 | 11496644 | 1194074 |
| Plasmid lp28-1 (Accession number NC_001851) | hypothetical protein BBF27 | 15755 | 15925 | - | 56 | 11496663 | 1194099 |
| Plasmid lp28-1 (Accession number NC_001851) | hypothetical protein BBF28 | 15998 | 16129 | - | 43 | 11496662 | 1194098 |
| Plasmid lp28-1 (Accession number NC_001851) | hypothetical protein BBF30 | 17167 | 17415 | - | 82 | 11496661 | 1194097 |

Fig. 27 continued

| | | | | | | | |
|---|---|---|---|---|---|---|---|
| Plasmid lp28-2 (Accession number NC_001852) | hypothetical protein BBG01 | 116 | 1009 | + | 297 | 11496686 | 1194123 |
| Plasmid lp28-2 (Accession number NC_001852) | hypothetical protein BBG02 | 1047 | 1928 | + | 293 | 11496666 | 1194101 |
| Plasmid lp28-2 (Accession number NC_001852) | hypothetical protein BBG04 | 2750 | 2857 | - | 35 | 11496687 | 1194124 |
| Plasmid lp28-2 (Accession number NC_001852) | hypothetical protein BBG06 | 4208 | 5368 | + | 386 | 11496667 | 1194102 |
| Plasmid lp28-2 (Accession number NC_001852) | hypothetical protein BBG07 | 5378 | 5950 | + | 190 | 11496668 | 1194103 |
| Plasmid lp28-2 (Accession number NC_001852) | stage 0 sporulation protein J (spo0J) | 5911 | 6678 | + | 255 | 11496669 | 1194104 |
| Plasmid lp28-2 (Accession number NC_001852) | hypothetical protein BBG09 | 6737 | 7286 | + | 183 | 11496670 | 1194105 |
| Plasmid lp28-2 (Accession number NC_001852) | hypothetical protein BBG10 | 7483 | 10779 | - | 1098 | 11496688 | 1194125 |
| Plasmid lp28-2 (Accession number NC_001852) | hypothetical protein BBG11 | 10776 | 11015 | - | 79 | 11496689 | 1194126 |
| Plasmid lp28-2 (Accession number NC_001852) | hypothetical protein BBG12 | 11063 | 11491 | - | 142 | 11496690 | 1194127 |
| Plasmid lp28-2 (Accession number NC_001852) | hypothetical protein BBG13 | 11501 | 12355 | - | 284 | 11496691 | 1194128 |
| Plasmid lp28-2 (Accession number NC_001852) | hypothetical protein BBG14 | 12309 | 12752 | - | 147 | 11496676 | 1194113 |

Fig. 27 continued

| | | | | | | | |
|---|---|---|---|---|---|---|---|
| Plasmid lp28-2 (Accession number NC_001852) | hypothetical protein BBG15 | 12681 | 13169 | + | 162 | 11496692 | 1194129 |
| Plasmid lp28-2 (Accession number NC_001852) | hypothetical protein BBG16 | 13157 | 13495 | - | 112 | 11496677 | 1194114 |
| Plasmid lp28-2 (Accession number NC_001852) | hypothetical protein BBG17 | 13508 | 14341 | - | 277 | 11496678 | 1194115 |
| Plasmid lp28-2 (Accession number NC_001852) | hypothetical protein BBG18 | 14376 | 14885 | - | 169 | 11496679 | 1194116 |
| Plasmid lp28-2 (Accession number NC_001852) | hypothetical protein BBG19 | 14886 | 15431 | - | 181 | 11496680 | 1194117 |
| Plasmid lp28-2 (Accession number NC_001852) | hypothetical protein BBG20 | 15457 | 16482 | - | 341 | 11496681 | 1194118 |
| Plasmid lp28-2 (Accession number NC_001852) | hypothetical protein BBG21 | 16494 | 17684 | - | 396 | 11496682 | 1194119 |
| Plasmid lp28-2 (Accession number NC_001852) | hypothetical protein BBG22 | 18030 | 18827 | - | 265 | 11496683 | 1194120 |
| Plasmid lp28-2 (Accession number NC_001852) | hypothetical protein BBG23 | 18837 | 19619 | - | 260 | 11496684 | 1194121 |
| Plasmid lp28-2 (Accession number NC_001852) | hypothetical protein BBG24 | 19620 | 22310 | - | 896 | 11496685 | 1194122 |
| Plasmid lp28-2 (Accession number NC_001852) | hypothetical protein BBG25 | 22273 | 22659 | - | 128 | 11496665 | 1194100 |
| Plasmid lp28-2 (Accession number NC_001852) | hypothetical protein BBG26 | 22659 | 23033 | - | 124 | 11496693 | 1194130 |

Fig. 27 continued

| | | | | | | | |
|---|---|---|---|---|---|---|---|
| Plasmid lp28-2 (Accession number NC_001852) | hypothetical protein BBG27 | 23033 | 23725 | - | 230 | 11496671 | 1194106 |
| Plasmid lp28-2 (Accession number NC_001852) | hypothetical protein BBG28 | 23722 | 24108 | - | 128 | 11496694 | 1194131 |
| Plasmid lp28-2 (Accession number NC_001852) | hypothetical protein BBG29 | 24489 | 25955 | + | 488 | 11496672 | 1194107 |
| Plasmid lp28-2 (Accession number NC_001852) | hypothetical protein BBG30 | 25962 | 26390 | + | 142 | 11496695 | 1194132 |
| Plasmid lp28-2 (Accession number NC_001852) | hypothetical protein BBG31 | 26567 | 27085 | + | 172 | 11496673 | 1194108 |
| Plasmid lp28-2 (Accession number NC_001852) | replicative DNA helicase, putative | 27113 | 27940 | + | 275 | 11496674 | 1194109 |
| Plasmid lp28-2 (Accession number NC_001852) | hypothetical protein BBG33 | 28031 | 28831 | + | 266 | 11496675 | 1194110 |
| Plasmid lp28-2 (Accession number NC_001852) | hypothetical protein BBG34 | 28854 | 29618 | - | 254 | 11496696 | 1194133 |
| Plasmid lp28-3 (Accession number NC_001853) | hypothetical protein BBH01 | 273 | 467 | + | 64 | 11496702 | 1194139 |
| Plasmid lp28-3 (Accession number NC_001853) | hypothetical protein BBH02 | 391 | 858 | + | 155 | 11496704 | 1194141 |
| Plasmid lp28-3 (Accession number NC_001853) | hypothetical protein BBH03 | 926 | 1075 | + | 49 | 11496709 | 1194148 |
| Plasmid lp28-3 (Accession number NC_001853) | hypothetical protein BBH04 | 1045 | 1368 | + | 107 | 11496698 | 1194134 |

Fig. 27 continued

| Plasmid lp28-3 (Accession number NC_001853) | hypothetical protein BBH05 | 1498 | 1680 | + | 60 | 11496703 | 1194140 |
| --- | --- | --- | --- | --- | --- | --- | --- |
| Plasmid lp28-3 (Accession number NC_001853) | hypothetical protein BBH06 | 2260 | 2970 | - | 236 | 11496710 | 1194149 |
| Plasmid lp28-3 (Accession number NC_001853) | hypothetical protein BBH08 | 3590 | 3730 | - | 46 | 11496711 | 1194150 |
| Plasmid lp28-3 (Accession number NC_001853) | hypothetical protein BBH09 | 3892 | 7728 | - | 1278 | 11496712 | 1194151 |
| Plasmid lp28-3 (Accession number NC_001853) | hypothetical protein BBH10 | 8000 | 8203 | - | 67 | 11496713 | 1194152 |
| Plasmid lp28-3 (Accession number NC_001853) | hypothetical protein BBH11 | 8701 | 8796 | - | 31 | 11496714 | 1194153 |
| Plasmid lp28-3 (Accession number NC_001853) | hypothetical protein BBH12 | 9455 | 9592 | + | 45 | 11496715 | 1194154 |
| Plasmid lp28-3 (Accession number NC_001853) | hypothetical protein BBH13 | 9848 | 10516 | - | 222 | 11496699 | 1194136 |
| Plasmid lp28-3 (Accession number NC_001853) | hypothetical protein BBH14 | 10818 | 10934 | - | 38 | 11496716 | 1194155 |
| Plasmid lp28-3 (Accession number NC_001853) | hypothetical protein BBH15 | 10910 | 11005 | - | 31 | 11496717 | 1194156 |
| Plasmid lp28-3 (Accession number NC_001853) | hypothetical protein BBH16 | 11068 | 11190 | + | 40 | 11496732 | 1194171 |
| Plasmid lp28-3 (Accession number NC_001853) | hypothetical protein BBH17 | 11837 | 12028 | + | 63 | 11496733 | 1194172 |

Fig. 27 continued

| | | | | | | | |
|---|---|---|---|---|---|---|---|
| Plasmid lp28-3 (Accession number NC_001853) | hypothetical protein BBH18 | 12105 | 13220 | + | 371 | 11496734 | 1194173 |
| Plasmid lp28-3 (Accession number NC_001853) | hypothetical protein BBH19 | 13590 | 13712 | + | 40 | 11496718 | 1194157 |
| Plasmid lp28-3 (Accession number NC_001853) | hypothetical protein BBH22 | 14763 | 14870 | - | 35 | 11496719 | 1194158 |
| Plasmid lp28-3 (Accession number NC_001853) | hypothetical protein BBH23 | 15051 | 15161 | + | 36 | 11496720 | 1194159 |
| Plasmid lp28-3 (Accession number NC_001853) | hypothetical protein BBH24 | 15136 | 15345 | + | 69 | 11496721 | 1194160 |
| Plasmid lp28-3 (Accession number NC_001853) | hypothetical protein BBH25 | 15565 | 15810 | - | 81 | 11496722 | 1194161 |
| Plasmid lp28-3 (Accession number NC_001853) | hypothetical protein BBH26 | 16519 | 17415 | + | 298 | 11496723 | 1194162 |
| Plasmid lp28-3 (Accession number NC_001853) | hypothetical protein BBH27 | 17408 | 17974 | + | 188 | 11496705 | 1194142 |
| Plasmid lp28-3 (Accession number NC_001853) | hypothetical protein BBH28 | 17947 | 18702 | + | 251 | 11496706 | 1194143 |
| Plasmid lp28-3 (Accession number NC_001853) | hypothetical protein BBH29 | 18798 | 19427 | + | 209 | 11496707 | 1194144 |
| Plasmid lp28-3 (Accession number NC_001853) | hypothetical protein BBH31 | 20997 | 21107 | + | 36 | 11496725 | 1194164 |
| Plasmid lp28-3 (Accession number NC_001853) | antigen, P35, putative | 21470 | 22219 | + | 249 | 11496708 | 1194146 |

Fig. 27 continued

| | | | | | | | |
|---|---|---|---|---|---|---|---|
| Plasmid lp28-3 (Accession number NC_001853) | hypothetical protein BBH33 | 22678 | 22953 | + | 91 | 11496726 | 1194165 |
| Plasmid lp28-3 (Accession number NC_001853) | hypothetical protein BBH34 | 23189 | 23383 | - | 64 | 11496727 | 1194166 |
| Plasmid lp28-3 (Accession number NC_001853) | hypothetical protein BBH35 | 23447 | 23563 | + | 38 | 11496728 | 1194167 |
| Plasmid lp28-3 (Accession number NC_001853) | hypothetical protein BBH36 | 24028 | 24180 | - | 50 | 11496729 | 1194168 |
| Plasmid lp28-3 (Accession number NC_001853) | hypothetical protein BBH37 | 25433 | 26371 | - | 312 | 11496730 | 1194169 |
| Plasmid lp28-3 (Accession number NC_001853) | hypothetical protein BBH38 | 26495 | 26614 | - | 39 | 11496731 | 1194170 |
| Plasmid lp28-3 (Accession number NC_001853) | hypothetical protein BBH39 | 26754 | 26856 | + | 34 | 11496724 | 1194163 |
| Plasmid lp28-3 (Accession number NC_001853) | transposase-like protein, putative | 26978 | 27445 | - | 155 | 11496700 | 1194137 |
| Plasmid lp28-3 (Accession number NC_001853) | hypothetical protein BBH41 | 27625 | 28197 | - | 190 | 11496701 | 1194138 |
| Plasmid lp28-4 (Accession number NC_001854) | hypothetical protein BBI01 | 174 | 608 | + | 144 | 11496764 | 1194202 |
| Plasmid lp28-4 (Accession number NC_001854) | hypothetical protein BBI02 | 736 | 1104 | + | 122 | 11496742 | 1194180 |
| Plasmid lp28-4 (Accession number NC_001854) | hypothetical protein BBI03 | 1847 | 1972 | - | 41 | 11496765 | 1194203 |

Fig. 27 continued

| | | | | | | | |
|---|---|---|---|---|---|---|---|
| Plasmid lp28-4 (Accession number NC_001854) | hypothetical protein BBI04 | 2124 | 2219 | - | 31 | 11496766 | 1194204 |
| Plasmid lp28-4 (Accession number NC_001854) | hypothetical protein BBI05 | 2188 | 2310 | - | 40 | 11496767 | 1194205 |
| Plasmid lp28-4 (Accession number NC_001854) | pfs protein (pfs) | 2536 | 3351 | + | 271 | 11496743 | 1194181 |
| Plasmid lp28-4 (Accession number NC_001854) | hypothetical protein BBI07 | 3343 | 3441 | - | 32 | 11496768 | 1194206 |
| Plasmid lp28-4 (Accession number NC_001854) | hypothetical protein BBI08 | 3576 | 3755 | + | 59 | 11496749 | 1194187 |
| Plasmid lp28-4 (Accession number NC_001854) | hypothetical protein BBI09 | 3745 | 3882 | + | 45 | 11496750 | 1194188 |
| Plasmid lp28-4 (Accession number NC_001854) | hypothetical protein BBI10 | 3911 | 4315 | + | 134 | 11496751 | 1194189 |
| Plasmid lp28-4 (Accession number NC_001854) | hypothetical protein BBI11 | 4623 | 4721 | - | 32 | 11496752 | 1194190 |
| Plasmid lp28-4 (Accession number NC_001854) | hypothetical protein BBI12 | 5128 | 5346 | + | 72 | 11496753 | 1194191 |
| Plasmid lp28-4 (Accession number NC_001854) | hypothetical protein BBI13 | 5609 | 5707 | + | 32 | 11496736 | 1194174 |
| Plasmid lp28-4 (Accession number NC_001854) | hypothetical protein BBI14 | 6159 | 6272 | + | 37 | 11496754 | 1194192 |
| Plasmid lp28-4 (Accession number NC_001854) | hypothetical protein BBI15 | 6603 | 6833 | + | 76 | 11496755 | 1194193 |

Fig. 27 continued

| | | | | | | | |
|---|---|---|---|---|---|---|---|
| Plasmid lp28-4 (Accession number NC_001854) | hypothetical protein BBI16 | 7183 | 8538 | + | 451 | 11496756 | 1194194 |
| Plasmid lp28-4 (Accession number NC_001854) | hypothetical protein BBI17 | 8821 | 8967 | - | 48 | 11496757 | 1194195 |
| Plasmid lp28-4 (Accession number NC_001854) | hypothetical protein BBI18 | 10495 | 10647 | - | 50 | 11496758 | 1194196 |
| Plasmid lp28-4 (Accession number NC_001854) | hypothetical protein BBI19 | 10749 | 11927 | + | 392 | 11496737 | 1194175 |
| Plasmid lp28-4 (Accession number NC_001854) | hypothetical protein BBI20 | 11924 | 12478 | + | 184 | 11496738 | 1194176 |
| Plasmid lp28-4 (Accession number NC_001854) | hypothetical protein BBI21 | 12454 | 13206 | + | 250 | 11496739 | 1194177 |
| Plasmid lp28-4 (Accession number NC_001854) | conserved hypothetical protein. | 13265 | 13837 | + | 190 | 11496740 | 1194178 |
| Plasmid lp28-4 (Accession number NC_001854) | hypothetical protein BBI23 | 13989 | 14093 | + | 34 | 11496759 | 1194197 |
| Plasmid lp28-4 (Accession number NC_001854) | hypothetical protein BBI24 | 14334 | 14441 | + | 35 | 11496760 | 1194198 |
| Plasmid lp28-4 (Accession number NC_001854) | hypothetical protein BBI25 | 15211 | 15342 | + | 43 | 11496769 | 1194207 |
| Plasmid lp28-4 (Accession number NC_001854) | multidrug-efflux transporter | 15352 | 16530 | + | 392 | 11496744 | 1194182 |
| Plasmid lp28-4 (Accession number NC_001854) | hypothetical protein BBI27 | 17093 | 17272 | - | 59 | 11496770 | 1194208 |

Fig. 27 continued

| | | | | | | | |
|---|---|---|---|---|---|---|---|
| Plasmid lp28-4 (Accession number NC_001854) | hypothetical protein BBI28 | 17302 | 17874 | - | 190 | 11496771 | 1194209 |
| Plasmid lp28-4 (Accession number NC_001854) | hypothetical protein BBI29 | 18518 | 19183 | - | 221 | 11496772 | 1194210 |
| Plasmid lp28-4 (Accession number NC_001854) | hypothetical protein BBI30 | 19403 | 19510 | + | 35 | 11496773 | 1194211 |
| Plasmid lp28-4 (Accession number NC_001854) | hypothetical protein BBI31 | 19615 | 20127 | - | 170 | 11496747 | 1194185 |
| Plasmid lp28-4 (Accession number NC_001854) | hypothetical protein BBI32 | 20270 | 20479 | - | 69 | 11496774 | 1194212 |
| Plasmid lp28-4 (Accession number NC_001854) | hypothetical protein BBI33 | 20482 | 20592 | + | 36 | 11496775 | 1194213 |
| Plasmid lp28-4 (Accession number NC_001854) | hypothetical protein BBI34 | 20771 | 21562 | - | 263 | 11496776 | 1194214 |
| Plasmid lp28-4 (Accession number NC_001854) | hypothetical protein BBI35 | 21992 | 22093 | + | 33 | 11496777 | 1194215 |
| Plasmid lp28-4 (Accession number NC_001854) | antigen, P35, putative | 22095 | 22931 | - | 278 | 11496748 | 1194186 |
| Plasmid lp28-4 (Accession number NC_001854) | hypothetical protein BBI37 | 23056 | 23157 | + | 33 | 11496778 | 1194216 |
| Plasmid lp28-4 (Accession number NC_001854) | hypothetical protein BBI38 | 23159 | 23995 | - | 278 | 11496761 | 1194199 |
| Plasmid lp28-4 (Accession number NC_001854) | hypothetical protein BBI39 | 24223 | 25089 | - | 288 | 11496762 | 1194200 |

Fig. 27 continued

| | | | | | | | |
|---|---|---|---|---|---|---|---|
| Plasmid lp28-4 (Accession number NC_001854) | hypothetical protein BBI40 | 25518 | 25805 | + | 95 | 11496741 | 1194179 |
| Plasmid lp28-4 (Accession number NC_001854) | hypothetical protein BBI41 | 25794 | 26036 | - | 80 | 11496763 | 1194201 |
| Plasmid lp28-4 (Accession number NC_001854) | hypothetical protein BBI42 | 26360 | 26914 | + | 184 | 11496745 | 1194183 |
| Plasmid lp28-4 (Accession number NC_001854) | hypothetical protein BBI43 | 26881 | 27069 | - | 62 | 11496746 | 1194184 |
| Plasmid lp36 (Accession number NC_001855) | hypothetical protein BBK01 | 188 | 1081 | + | 297 | 11496795 | 1194235 |
| Plasmid lp36 (Accession number NC_001855) | hypothetical protein BBK02 | 1210 | 2478 | - | 422 | 11496796 | 1194236 |
| Plasmid lp36 (Accession number NC_001855) | hypothetical protein BBK03 | 2818 | 3222 | - | 134 | 11496797 | 1194237 |
| Plasmid lp36 (Accession number NC_001855) | hypothetical protein BBK04 | 3416 | 3595 | - | 59 | 11496798 | 1194238 |
| Plasmid lp36 (Accession number NC_001855) | hypothetical protein BBK05 | 4902 | 5096 | - | 64 | 11496799 | 1194239 |
| Plasmid lp36 (Accession number NC_001855) | hypothetical protein BBK06 | 5126 | 5236 | + | 36 | 11496800 | 1194240 |
| Plasmid lp36 (Accession number NC_001855) | hypothetical protein BBK07 | 5288 | 6040 | - | 250 | 11496801 | 1194241 |
| Plasmid lp36 (Accession number NC_001855) | hypothetical protein BBK08 | 6177 | 6281 | - | 34 | 11496802 | 1194242 |

Fig. 27 continued

| | | | | | | | |
|---|---|---|---|---|---|---|---|
| Plasmid lp36 (Accession number NC_001855) | hypothetical protein BBK09 | 6366 | 6650 | + | 94 | 11496803 | 1194243 |
| Plasmid lp36 (Accession number NC_001855) | hypothetical protein BBK10 | 6804 | 6983 | - | 59 | 11496805 | 1194245 |
| Plasmid lp36 (Accession number NC_001855) | hypothetical protein BBK11 | 6956 | 7063 | + | 35 | 11496804 | 1194244 |
| Plasmid lp36 (Accession number NC_001855) | hypothetical protein BBK12 | 7335 | 8033 | + | 232 | 11496806 | 1194246 |
| Plasmid lp36 (Accession number NC_001855) | hypothetical protein BBK13 | 8164 | 8880 | - | 238 | 11496780 | 1194217 |
| Plasmid lp36 (Accession number NC_001855) | hypothetical protein BBK14 | 8921 | 9016 | + | 31 | 11496807 | 1194247 |
| Plasmid lp36 (Accession number NC_001855) | antigen, P35, putative | 9373 | 9999 | + | 208 | 11496781 | 1194218 |
| Plasmid lp36 (Accession number NC_001855) | hypothetical protein BBK16 | 10098 | 10223 | - | 41 | 11496819 | 1194259 |
| Plasmid lp36 (Accession number NC_001855) | adenine deaminase (adeC) | 10301 | 11947 | + | 548 | 11496787 | 1194225 |
| Plasmid lp36 (Accession number NC_001855) | hypothetical protein BBK18 | 12051 | 12143 | - | 30 | 11496788 | 1194226 |
| Plasmid lp36 (Accession number NC_001855) | hypothetical protein BBK19 | 12602 | 13237 | + | 211 | 11496820 | 1194260 |
| Plasmid lp36 (Accession number NC_001855) | hypothetical protein BBK20 | 13212 | 13304 | + | 30 | 11496821 | 1194261 |
| Plasmid lp36 (Accession number NC_001855) | hypothetical protein BBK21 | 13577 | 14326 | - | 249 | 11496789 | 1194227 |

Fig. 27 continued

| Plasmid lp36 (Accession number NC_001855) | hypothetical protein BBK22 | 14302 | 14841 | - | 179 | 11496790 | 1194228 |
|---|---|---|---|---|---|---|---|
| Plasmid lp36 (Accession number NC_001855) | hypothetical protein BBK23 | 14834 | 15760 | - | 308 | 11496822 | 1194262 |
| Plasmid lp36 (Accession number NC_001855) | hypothetical protein BBK24 | 16275 | 16886 | + | 203 | 11496791 | 1194229 |
| Plasmid lp36 (Accession number NC_001855) | hypothetical protein BBK26 | 18346 | 18465 | + | 39 | 11496823 | 1194263 |
| Plasmid lp36 (Accession number NC_001855) | hypothetical protein BBK27 | 18804 | 19094 | - | 96 | 11496809 | 1194249 |
| Plasmid lp36 (Accession number NC_001855) | hypothetical protein BBK28 | 19232 | 19351 | + | 39 | 11496810 | 1194250 |
| Plasmid lp36 (Accession number NC_001855) | hypothetical protein BBK29 | 19715 | 19807 | - | 30 | 11496811 | 1194251 |
| Plasmid lp36 (Accession number NC_001855) | hypothetical protein BBK30 | 19935 | 20036 | + | 33 | 11496812 | 1194252 |
| Plasmid lp36 (Accession number NC_001855) | hypothetical protein BBK31 | 20026 | 20169 | + | 47 | 11496813 | 1194253 |
| Plasmid lp36 (Accession number NC_001855) | immunogenic protein P35 | 20389 | 21453 | + | 354 | 11496782 | 1194219 |
| Plasmid lp36 (Accession number NC_001855) | hypothetical protein BBK33 | 21720 | 21893 | + | 57 | 11496808 | 1194248 |
| Plasmid lp36 (Accession number NC_001855) | hypothetical protein BBK34 | 21912 | 22133 | + | 73 | 11496814 | 1194254 |

Fig. 27 continued

| | | | | | | | |
|---|---|---|---|---|---|---|---|
| Plasmid lp36 (Accession number NC_001855) | hypothetical protein BBK35 | 22294 | 22467 | + | 57 | 11496815 | 1194255 |
| Plasmid lp36 (Accession number NC_001855) | hypothetical protein BBK36 | 22545 | 22649 | + | 34 | 11496816 | 1194256 |
| Plasmid lp36 (Accession number NC_001855) | hypothetical protein BBK38 | 23919 | 24146 | - | 75 | 11496824 | 1194264 |
| Plasmid lp36 (Accession number NC_001855) | hypothetical protein BBK39 | 24293 | 24670 | + | 125 | 11496825 | 1194265 |
| Plasmid lp36 (Accession number NC_001855) | hypothetical protein BBK40 | 25103 | 25657 | + | 184 | 11496792 | 1194231 |
| Plasmid lp36 (Accession number NC_001855) | hypothetical protein BBK41 | 25813 | 26379 | - | 188 | 11496826 | 1194266 |
| Plasmid lp36 (Accession number NC_001855) | hypothetical protein BBK42 | 26585 | 26803 | - | 72 | 11496827 | 1194267 |
| Plasmid lp36 (Accession number NC_001855) | hypothetical protein BBK43 | 26937 | 27044 | + | 35 | 11496828 | 1194268 |
| Plasmid lp36 (Accession number NC_001855) | hypothetical protein BBK44 | 27234 | 27353 | + | 39 | 11496829 | 1194269 |
| Plasmid lp36 (Accession number NC_001855) | immunogenic protein P37, putative | 27383 | 28315 | - | 310 | 11496793 | 1194232 |
| Plasmid lp36 (Accession number NC_001855) | hypothetical protein BBK47 | 29477 | 30463 | - | 328 | 11496830 | 1194270 |
| Plasmid lp36 (Accession number NC_001855) | immunogenic protein P37, putative | 30719 | 31585 | - | 288 | 11496794 | 1194233 |

Fig. 27 continued

| | | | | | | | |
|---|---|---|---|---|---|---|---|
| Plasmid lp36 (Accession number NC_001855) | hypothetical protein BBK49 | 31827 | 32822 | - | 331 | 11496817 | 1194257 |
| Plasmid lp36 (Accession number NC_001855) | immunogenic protein P37 | 33081 | 34079 | - | 332 | 11496783 | 1194221 |
| Plasmid lp36 (Accession number NC_001855) | hypothetical protein BBK51 | 34232 | 34330 | + | 32 | 11496818 | 1194258 |
| Plasmid lp36 (Accession number NC_001855) | protein p23 | 34595 | 35443 | - | 282 | 11496784 | 1194222 |
| Plasmid lp36 (Accession number NC_001855) | outer membrane protein | 35868 | 36422 | + | 184 | 11496785 | 1194223 |
| Plasmid lp36 (Accession number NC_001855) | hypothetical protein BBK54 | 36389 | 36577 | - | 62 | 11496786 | 1194224 |
| Plasmid lp38 (Accession number NC_001856) | hypothetical protein BBJ01 | 482 | 667 | + | 61 | 11496862 | 1194305 |
| Plasmid lp38 (Accession number NC_001856) | hypothetical protein BBJ02 | 927 | 1211 | + | 94 | 11496863 | 1194306 |
| Plasmid lp38 (Accession number NC_001856) | hypothetical protein BBJ03 | 1593 | 1745 | + | 50 | 11496840 | 1194283 |
| Plasmid lp38 (Accession number NC_001856) | hypothetical protein BBJ04 | 2268 | 2381 | - | 37 | 11496841 | 1194284 |
| Plasmid lp38 (Accession number NC_001856) | hypothetical protein BBJ06 | 3486 | 3632 | + | 48 | 11496842 | 1194285 |
| Plasmid lp38 (Accession number NC_001856) | hypothetical protein BBJ07 | 4164 | 4307 | - | 47 | 11496843 | 1194286 |
| Plasmid lp38 (Accession number NC_001856) | hypothetical protein BBJ08 | 4576 | 5496 | + | 306 | 11496844 | 1194287 |

Fig. 27 continued

| | | | | | | | |
|---|---|---|---|---|---|---|---|
| Plasmid lp38 (Accession number NC_001856) | outer surface protein D (ospD) | 6089 | 6862 | + | 257 | 11496832 | 1194272 |
| Plasmid lp38 (Accession number NC_001856) | hypothetical protein BBJ10 | 7270 | 7476 | + | 68 | 11496845 | 1194288 |
| Plasmid lp38 (Accession number NC_001856) | hypothetical protein BBJ11 | 7780 | 7965 | - | 61 | 11496846 | 1194289 |
| Plasmid lp38 (Accession number NC_001856) | hypothetical protein BBJ12 | 8633 | 8725 | - | 30 | 11496847 | 1194290 |
| Plasmid lp38 (Accession number NC_001856) | hypothetical protein BBJ13 | 8877 | 9155 | - | 92 | 11496848 | 1194291 |
| Plasmid lp38 (Accession number NC_001856) | hypothetical protein BBJ14 | 9125 | 9286 | + | 53 | 11496833 | 1194273 |
| Plasmid lp38 (Accession number NC_001856) | hypothetical protein BBJ15 | 10040 | 10168 | - | 42 | 11496849 | 1194292 |
| Plasmid lp38 (Accession number NC_001856) | hypothetical protein BBJ16 | 10518 | 11105 | - | 195 | 11496834 | 1194274 |
| Plasmid lp38 (Accession number NC_001856) | hypothetical protein BBJ17 | 11152 | 11889 | - | 245 | 11496835 | 1194275 |
| Plasmid lp38 (Accession number NC_001856) | hypothetical protein BBJ18 | 11852 | 12452 | - | 196 | 11496836 | 1194276 |
| Plasmid lp38 (Accession number NC_001856) | hypothetical protein BBJ19 | 12445 | 13440 | - | 331 | 11496837 | 1194277 |
| Plasmid lp38 (Accession number NC_001856) | hypothetical protein BBJ20 | 13772 | 13936 | - | 54 | 11496864 | 1194307 |

Fig. 27 continued

| | | | | | | | |
|---|---|---|---|---|---|---|---|
| Plasmid lp38 (Accession number NC_001856) | hypothetical protein BBJ21 | 15514 | 15660 | + | 48 | 11496865 | 1194308 |
| Plasmid lp38 (Accession number NC_001856) | hypothetical protein BBJ22 | 15902 | 16003 | - | 33 | 11496866 | 1194309 |
| Plasmid lp38 (Accession number NC_001856) | hypothetical protein BBJ23 | 16505 | 17329 | + | 274 | 11496867 | 1194310 |
| Plasmid lp38 (Accession number NC_001856) | hypothetical protein BBJ24 | 17388 | 18170 | + | 260 | 11496868 | 1194311 |
| Plasmid lp38 (Accession number NC_001856) | hypothetical protein BBJ25 | 18202 | 19254 | + | 350 | 11496869 | 1194312 |
| Plasmid lp38 (Accession number NC_001856) | ABC transporter, ATP-binding protein | 19313 | 20008 | + | 231 | 11496838 | 1194278 |
| Plasmid lp38 (Accession number NC_001856) | hypothetical protein BBJ27 | 19995 | 21230 | + | 411 | 11496870 | 1194313 |
| Plasmid lp38 (Accession number NC_001856) | hypothetical protein BBJ28 | 21220 | 21948 | + | 242 | 11496850 | 1194293 |
| Plasmid lp38 (Accession number NC_001856) | hypothetical protein BBJ29 | 21971 | 23008 | + | 345 | 11496851 | 1194294 |
| Plasmid lp38 (Accession number NC_001856) | hypothetical protein BBJ30 | 23018 | 23122 | + | 34 | 11496852 | 1194295 |
| Plasmid lp38 (Accession number NC_001856) | hypothetical protein BBJ31 | 23366 | 24086 | + | 240 | 11496853 | 1194296 |
| Plasmid lp38 (Accession number NC_001856) | hypothetical protein BBJ32 | 24386 | 24517 | - | 43 | 11496854 | 1194297 |

Fig. 27 continued

| | | | | | | | |
|---|---|---|---|---|---|---|---|
| Plasmid lp38 (Accession number NC_001856) | hypothetical protein BBJ33 | 24681 | 24794 | + | 37 | 11496855 | 1194298 |
| Plasmid lp38 (Accession number NC_001856) | hypothetical protein BBJ34 | 25337 | 26407 | - | 356 | 11496856 | 1194299 |
| Plasmid lp38 (Accession number NC_001856) | hypothetical protein BBJ35 | 26858 | 26962 | + | 34 | 11496857 | 1194300 |
| Plasmid lp38 (Accession number NC_001856) | hypothetical protein BBJ36 | 26995 | 28053 | - | 352 | 11496858 | 1194301 |
| Plasmid lp38 (Accession number NC_001856) | hypothetical protein BBJ37 | 28278 | 28442 | - | 54 | 11496859 | 1194302 |
| Plasmid lp38 (Accession number NC_001856) | hypothetical protein BBJ38 | 28605 | 28703 | - | 32 | 11496860 | 1194303 |
| Plasmid lp38 (Accession number NC_001856) | hypothetical protein BBJ39 | 29264 | 29401 | - | 45 | 11496861 | 1194304 |
| Plasmid lp38 (Accession number NC_001856) | hypothetical protein BBJ40 | 29827 | 29922 | + | 31 | 11496871 | 1194314 |
| Plasmid lp38 (Accession number NC_001856) | antigen, P35, putative | 29905 | 30771 | - | 288 | 11496839 | 1194279 |
| Plasmid lp38 (Accession number NC_001856) | hypothetical protein BBJ42 | 30942 | 31133 | - | 63 | 11496872 | 1194315 |
| Plasmid lp38 (Accession number NC_001856) | hypothetical protein BBJ43 | 31220 | 32140 | + | 306 | 11496873 | 1194316 |
| Plasmid lp38 (Accession number NC_001856) | hypothetical protein BBJ44 | 32150 | 32254 | + | 34 | 11496874 | 1194317 |

Fig. 27 continued

| | | | | | | | |
|---|---|---|---|---|---|---|---|
| Plasmid lp38 (Accession number NC_001856) | hypothetical protein BBJ45 | 32498 | 33220 | + | 240 | 11496875 | 1194318 |
| Plasmid lp38 (Accession number NC_001856) | hypothetical protein BBJ46 | 34372 | 34668 | - | 98 | 11496876 | 1194319 |
| Plasmid lp38 (Accession number NC_001856) | hypothetical protein BBJ47 | 34905 | 35591 | - | 228 | 11496877 | 1194320 |
| Plasmid lp38 (Accession number NC_001856) | hypothetical protein BBJ48 | 35634 | 36272 | - | 212 | 11496878 | 1194321 |
| Plasmid lp38 (Accession number NC_001856) | hypothetical protein BBJ49 | 36312 | 36455 | - | 47 | 11496879 | 1194322 |
| Plasmid cp26 (Accession number NC_001903) | hypothetical protein BBB01 | 16 | 324 | + | 102 | 11497020 | 1194411 |
| Plasmid cp26 (Accession number NC_001903) | hypothetical protein BBB02 | 308 | 751 | - | 147 | 11497029 | 1194420 |
| Plasmid cp26 (Accession number NC_001903) | hypothetical protein BBB03 | 837 | 2186 | - | 449 | 11497028 | 1194419 |
| Plasmid cp26 (Accession number NC_001903) | PTS system, cellobiose-specific IIC component (celB) | 2476 | 3807 | - | 443 | 11497019 | 1194410 |
| Plasmid cp26 (Accession number NC_001903) | PTS system, cellobiose-specific IIA component (celC) | 4084 | 4431 | + | 115 | 11497018 | 1194409 |

Fig. 27 continued

| | | | | | | | |
|---|---|---|---|---|---|---|---|
| Plasmid cp26 (Accession number NC_001903) | PTS system, cellobiose-specific IIB component (celA) | 4440 | 4757 | + | 105 | 11497017 | 1194408 |
| Plasmid cp26 (Accession number NC_001903) | outer surface protein, putative | 4769 | 5866 | + | 365 | 11497016 | 1194407 |
| Plasmid cp26 (Accession number NC_001903) | hypothetical protein BBB08 | 5888 | 6517 | - | 209 | 11497027 | 1194418 |
| Plasmid cp26 (Accession number NC_001903) | hypothetical protein BBB09 | 6677 | 7714 | + | 345 | 11497026 | 1194417 |
| Plasmid cp26 (Accession number NC_001903) | hypothetical protein BBB10 | 7836 | 8765 | + | 309 | 11497015 | 1194406 |
| Plasmid cp26 (Accession number NC_001903) | hypothetical protein BBB11 | 8781 | 9299 | + | 172 | 11497014 | 1194405 |
| Plasmid cp26 (Accession number NC_001903) | hypothetical protein BBB12 | 9275 | 10036 | + | 253 | 11497013 | 1194404 |
| Plasmid cp26 (Accession number NC_001903) | hypothetical protein BBB13 | 10104 | 10652 | + | 182 | 11497012 | 1194403 |
| Plasmid cp26 (Accession number NC_001903) | hypothetical protein BBB14 | 10920 | 11417 | - | 165 | 11497011 | 1194402 |
| Plasmid cp26 (Accession number NC_001903) | hypothetical protein BBB15 | 11636 | 11740 | + | 34 | 11497025 | 1194416 |

Fig. 27 continued

| | | | | | | | |
|---|---|---|---|---|---|---|---|
| Plasmid cp26 (Accession number NC_001903) | oligopeptide ABC transporter, periplasmic oligopeptide-binding protein (oppAIV) | 12014 | 13606 | + | 530 | 11497010 | 1194401 |
| Plasmid cp26 (Accession number NC_001903) | inositol-5-monophosphate dehydrogenase | 13893 | 15107 | - | 404 | 11497009 | 1194400 |
| Plasmid cp26 (Accession number NC_001903) | bifunctional GMP synthase/glutamine amidotransferase protein | 15132 | 16718 | - | 528 | 11497008 | 1194399 |
| Plasmid cp26 (Accession number NC_001903) | outer surface protein C (ospC) | 16903 | 17535 | + | 210 | 11497024 | 1194415 |
| Plasmid cp26 (Accession number NC_001903) | hypothetical protein BBB20 | 17623 | 17733 | - | 36 | 11497036 | 1194427 |
| Plasmid cp26 (Accession number NC_001903) | hypothetical protein BBB21 | 17750 | 17845 | + | 31 | 11497035 | 1194426 |
| Plasmid cp26 (Accession number NC_001903) | hypothetical protein BBB22 | 17966 | 19321 | - | 451 | 11497023 | 1194414 |
| Plasmid cp26 (Accession number NC_001903) | hypothetical protein BBB23 | 19431 | 20822 | - | 463 | 11497022 | 1194413 |
| Plasmid cp26 (Accession number NC_001903) | hypothetical protein BBB24 | 20858 | 21364 | - | 168 | 11497034 | 1194425 |
| Plasmid cp26 (Accession number NC_001903) | hypothetical protein BBB25 | 21339 | 21851 | - | 170 | 11497033 | 1194424 |

Fig. 27 continued

| | | | | | | | |
|---|---|---|---|---|---|---|---|
| Plasmid cp26 (Accession number NC_001903) | hypothetical protein BBB26 | 21898 | 22593 | + | 231 | 11497032 | 1194423 |
| Plasmid cp26 (Accession number NC_001903) | hypothetical protein BBB27 | 22603 | 23154 | - | 183 | 11497031 | 1194422 |
| Plasmid cp26 (Accession number NC_001903) | hypothetical protein BBB28 | 23255 | 24499 | + | 414 | 11497030 | 1194421 |
| Plasmid cp26 (Accession number NC_001903) | PTS system, maltose and glucose-specific IIABC component (malX) | 24825 | 26453 | + | 542 | 11497021 | 1194412 |
| Plasmid cp9 (Accession number NC_001904) | hypothetical protein BBC01 | 163 | 1272 | + | 369 | 11497057 | 1194436 |
| Plasmid cp9 (Accession number NC_001904) | hypothetical protein BBC02 | 1282 | 1839 | + | 185 | 11497049 | 1194428 |
| Plasmid cp9 (Accession number NC_001904) | hypothetical protein BBC03 | 1892 | 2452 | + | 186 | 11497050 | 1194429 |
| Plasmid cp9 (Accession number NC_001904) | hypothetical protein BBC04 | 2590 | 2700 | - | 36 | 11497058 | 1194437 |
| Plasmid cp9 (Accession number NC_001904) | hypothetical protein BBC05 | 2804 | 3712 | + | 302 | 11497051 | 1194430 |
| Plasmid cp9 (Accession number NC_001904) | exported protein A (eppA) | 3853 | 4377 | - | 174 | 11497052 | 1194431 |
| Plasmid cp9 (Accession number NC_001904) | hypothetical protein BBC07 | 4504 | 4788 | - | 94 | 11497059 | 1194438 |

Fig. 27 continued

| | | | | | | | |
|---|---|---|---|---|---|---|---|
| Plasmid cp9 (Accession number NC_001904) | hypothetical protein BBC08 | 5534 | 5980 | + | 148 | 11497053 | 1194432 |
| Plasmid cp9 (Accession number NC_001904) | rev protein (rev) | 6281 | 6808 | - | 175 | 11497054 | 1194433 |
| Plasmid cp9 (Accession number NC_001904) | hypothetical protein BBC11 | 6974 | 7771 | + | 265 | 11497055 | 1194434 |
| Plasmid cp9 (Accession number NC_001904) | hypothetical protein BBC12 | 7911 | 9203 | - | 430 | 11497056 | 1194435 |
| Complete genome (Accession number NC_001318) | hypothetical protein BB0001 | 105 | 677 | + | | 15594347 | 1194837 |
| Complete genome (Accession number NC_001318) | beta-N-acetylhexosaminidase, putative | 768 | 1796 | - | | 15594348 | 1194838 |
| Complete genome (Accession number NC_001318) | hypothetical protein BB0003 | 1784 | 3148 | - | | 15594349 | 1194839 |
| Complete genome (Accession number NC_001318) | phosphoglucomutase (femD) | 3395 | 5188 | + | | 15594350 | 1194840 |
| Complete genome (Accession number NC_001318) | tryptophanyl-tRNA synthetase | 5251 | 6312 | - | | 15594351 | 1194841 |
| Complete genome (Accession number NC_001318) | hypothetical protein BB0006 | 6309 | 7433 | - | | 15594352 | 1194842 |
| Complete genome (Accession number NC_001318) | hypothetical protein BB0007 | 7458 | 8315 | - | | 15594353 | 1194843 |
| Complete genome (Accession number NC_001318) | hypothetical protein BB0008 | 8412 | 9197 | + | | 15594354 | 1194844 |

Fig. 27 continued

| Complete genome (Accession number NC_001318) | hypothetical protein BB0009 | 9202 | 10206 | + | | 15594355 | 1194845 |
|---|---|---|---|---|---|---|---|
| Complete genome (Accession number NC_001318) | holo-acyl-carrier protein synthase, putative | 10203 | 10577 | + | | 15594356 | 1194846 |
| Complete genome (Accession number NC_001318) | hypothetical protein BB0011 | 10581 | 11420 | + | | 15594357 | 1194847 |
| Complete genome (Accession number NC_001318) | tRNA pseudouridine synthase A | 11421 | 12161 | + | | 15594358 | 1194848 |
| Complete genome (Accession number NC_001318) | hypothetical protein BB0013 | 12154 | 12753 | + | | 15594359 | 1194849 |
| Complete genome (Accession number NC_001318) | primosomal protein N (priA) | 12746 | 14728 | + | | 15594360 | 1194850 |
| Complete genome (Accession number NC_001318) | uridine kinase | 14725 | 15348 | - | | 15594361 | 1194851 |
| Complete genome (Accession number NC_001318) | gipE protein (gipE) | 15345 | 15722 | - | | 15594362 | 1194852 |
| Complete genome (Accession number NC_001318) | hypothetical protein BB0017 | 15845 | 16804 | + | | 15594363 | 1194853 |
| Complete genome (Accession number NC_001318) | hypothetical protein BB0018 | 16807 | 17817 | - | | 15594364 | 1194854 |
| Complete genome (Accession number NC_001318) | hypothetical protein BB0019 | 17792 | 18304 | - | | 15594365 | 1194855 |
| Complete genome (Accession number NC_001318) | diphosphate--fructose-6-phosphate 1-phosphotransferase | 18312 | 19979 | - | | 15594366 | 1194856 |

Fig. 27 continued

| | | | | | | | |
|---|---|---|---|---|---|---|---|
| Complete genome (Accession number NC_001318) | S-adenosylmethionine: tRNA ribosyltransferase-isomerase | 20445 | 21092 | - | | 15594367 | 1194857 |
| Complete genome (Accession number NC_001318) | Holliday junction DNA helicase B | 21058 | 22101 | - | | 15594368 | 1194858 |
| Complete genome (Accession number NC_001318) | Holliday junction DNA helicase (ruvA) | 22146 | 22739 | - | | 15594369 | 1194859 |
| Complete genome (Accession number NC_001318) | hypothetical protein BB0024 | 22819 | 23958 | + | | 15594370 | 1194860 |
| Complete genome (Accession number NC_001318) | hypothetical protein BB0025 | 23965 | 24696 | - | | 15594371 | 1194861 |
| Complete genome (Accession number NC_001318) | methylenetetrahydrofolate dehydrogenase (folD) | 24697 | 25623 | - | | 15594372 | 1194862 |
| Complete genome (Accession number NC_001318) | hypothetical protein BB0027 | 25753 | 26391 | + | | 15594373 | 1194863 |
| Complete genome (Accession number NC_001318) | hypothetical protein BB0028 | 26399 | 27448 | + | | 15594374 | 1194864 |
| Complete genome (Accession number NC_001318) | hypothetical protein BB0029 | 27434 | 27865 | - | | 15594375 | 1194865 |
| Complete genome (Accession number NC_001318) | signal peptidase I (lepB-1) | 27855 | 28490 | - | | 15594376 | 1194866 |
| Complete genome (Accession number NC_001318) | signal peptidase I (lepB-2) | 28492 | 29472 | - | | 15594377 | 1194867 |

Fig. 27 continued

| | | | | | | | |
|---|---|---|---|---|---|---|---|
| Complete genome (Accession number NC_001318) | hypothetical protein BB0032 | 29543 | 31015 | + | | 15594378 | 1194868 |
| Complete genome (Accession number NC_001318) | SsrA-binding protein | 31027 | 31479 | + | | 15594379 | 1194869 |
| Complete genome (Accession number NC_001318) | hypothetical protein BB0034 | 31550 | 32089 | - | | 15594380 | 1194870 |
| Complete genome (Accession number NC_001318) | DNA topoisomerase IV subunit A | 32157 | 34037 | - | | 15594381 | 1194871 |
| Complete genome (Accession number NC_001318) | DNA topoisomerase IV subunit B | 34037 | 35836 | - | | 15594382 | 1194872 |
| Complete genome (Accession number NC_001318) | 1-acyl-sn-glycerol-3-phosphate acetyltransferase (plsC) | 35857 | 36609 | - | | 15594383 | 1194873 |
| Complete genome (Accession number NC_001318) | hypothetical protein BB0038 | 36606 | 38123 | - | | 15594384 | 1194874 |
| Complete genome (Accession number NC_001318) | hypothetical protein BB0039 | 38136 | 39638 | - | | 15594385 | 1194875 |
| Complete genome (Accession number NC_001318) | chemotaxis protein methyltransferase (cheR-1) | 39826 | 40677 | + | | 15594386 | 1194876 |
| Complete genome (Accession number NC_001318) | hypothetical protein BB0041 | 40677 | 40769 | + | | 15594387 | 1194877 |
| Complete genome (Accession number NC_001318) | phosphate transport system regulatory protein (phoU) | 40761 | 41432 | - | | 15594388 | 1194878 |

Fig. 27 continued

| | | | | | | | |
|---|---|---|---|---|---|---|---|
| Complete genome (Accession number NC_001318) | hypothetical protein BB0043 | 41443 | 42483 | - | | 15594389 | 1194879 |
| Complete genome (Accession number NC_001318) | hypothetical protein BB0044 | 42480 | 42881 | - | | 15594390 | 1194880 |
| Complete genome (Accession number NC_001318) | P115 protein | 42907 | 45366 | - | | 15594391 | 1194881 |
| Complete genome (Accession number NC_001318) | ribonuclease H (rnhB) | 45446 | 45991 | + | | 15594392 | 1194882 |
| Complete genome (Accession number NC_001318) | hypothetical protein BB0047 | 46011 | 46394 | - | | 15594393 | 1194883 |
| Complete genome (Accession number NC_001318) | hypothetical protein BB0048 | 46601 | 46771 | - | | 15594394 | 1194884 |
| Complete genome (Accession number NC_001318) | hypothetical protein BB0049 | 46921 | 47040 | - | | 15594395 | 1194885 |
| Complete genome (Accession number NC_001318) | hypothetical protein BB0050 | 47167 | 47841 | + | | 15594396 | 1194886 |
| Complete genome (Accession number NC_001318) | hypothetical protein BB0051 | 47905 | 48606 | + | | 15594397 | 1194887 |
| Complete genome (Accession number NC_001318) | spoU protein (spoU) | 48603 | 49259 | - | | 15594398 | 1194888 |
| Complete genome (Accession number NC_001318) | uracil-DNA glycosylase | 49341 | 50012 | + | | 15594399 | 1194889 |
| Complete genome (Accession number NC_001318) | preprotein translocase subunit SecG | 50112 | 50489 | - | | 15594400 | 1194890 |
| Complete genome (Accession number NC_001318) | triosephosphate isomerase | 50490 | 51251 | - | | 15594401 | 1194891 |

Fig. 27 continued

| Complete genome (Accession number NC_001318) | phosphoglycerate kinase | 51253 | 52434 | - | | 15594402 | 1194892 |
|---|---|---|---|---|---|---|---|
| Complete genome (Accession number NC_001318) | glyceraldehyde 3-phosphate dehydrogenase (gap) | 52454 | 53461 | - | | 15594403 | 1194893 |
| Complete genome (Accession number NC_001318) | hypothetical protein BB0058 | 53534 | 55504 | - | | 15594404 | 1194894 |
| Complete genome (Accession number NC_001318) | hemolysin (tlyC) | 55501 | 56280 | - | | 15594405 | 1194895 |
| Complete genome (Accession number NC_001318) | hypothetical protein BB0060 | 56281 | 56748 | - | | 15594406 | 1194896 |
| Complete genome (Accession number NC_001318) | thioredoxin (trxA) | 56832 | 57185 | - | | 15594407 | 1194897 |
| Complete genome (Accession number NC_001318) | hypothetical protein BB0062 | 57259 | 57975 | + | | 15594408 | 1194898 |
| Complete genome (Accession number NC_001318) | hypothetical protein BB0063 | 58029 | 59036 | - | | 15594409 | 1194899 |
| Complete genome (Accession number NC_001318) | methionyl-tRNA formyltransferase (fmt) | 59101 | 60039 | - | | 15594410 | 1194900 |
| Complete genome (Accession number NC_001318) | polypeptide deformylase (def) | 60036 | 60554 | - | | 15594411 | 1194901 |
| Complete genome (Accession number NC_001318) | hypothetical protein BB0066 | 60568 | 61257 | - | | 15594412 | 1194902 |
| Complete genome (Accession number NC_001318) | peptidase, putative | 61254 | 63032 | - | | 15594413 | 1194903 |

Fig. 27 continued

| Complete genome (Accession number NC_001318) | hypothetical protein BB0068 | 63147 | 64026 | + | | 15594414 | 1194904 |
|---|---|---|---|---|---|---|---|
| Complete genome (Accession number NC_001318) | aminopeptidase II | 64038 | 65276 | + | | 15594415 | 1194905 |
| Complete genome (Accession number NC_001318) | hypothetical protein BB0070 | 65291 | 65752 | + | | 15594416 | 1194906 |
| Complete genome (Accession number NC_001318) | hypothetical protein BB0071 | 65766 | 67240 | + | | 15594417 | 1194907 |
| Complete genome (Accession number NC_001318) | hypothetical protein BB0072 | 67248 | 69569 | + | | 15594418 | 1194908 |
| Complete genome (Accession number NC_001318) | hypothetical protein BB0073 | 69566 | 70126 | + | | 15594419 | 1194909 |
| Complete genome (Accession number NC_001318) | peptide chain release factor 2 | 70173 | 71219 | + | | 15594420 | 1194910 |
| Complete genome (Accession number NC_001318) | hypothetical protein BB0075 | 71201 | 72610 | + | | 15594421 | 1194911 |
| Complete genome (Accession number NC_001318) | cell division protein, putative | 72647 | 73492 | + | | 15594422 | 1194912 |
| Complete genome (Accession number NC_001318) | hypothetical protein BB0077 | 73489 | 74517 | + | | 15594423 | 1194913 |
| Complete genome (Accession number NC_001318) | hypothetical protein BB0078 | 74518 | 75039 | + | | 15594424 | 1194914 |
| Complete genome (Accession number NC_001318) | hypothetical protein BB0079 | 75110 | 75772 | + | | 15594425 | 1194915 |

Fig. 27 continued

| Complete genome (Accession number NC_001318) | ABC transporter, ATP-binding protein | 75732 | 76454 | + | | 15594426 | 1194916 |
|---|---|---|---|---|---|---|---|
| Complete genome (Accession number NC_001318) | hypothetical protein BB0081 | 76451 | 77701 | + | | 15594427 | 1194917 |
| Complete genome (Accession number NC_001318) | hypothetical protein BB0082 | 77711 | 79009 | - | | 15594428 | 1194918 |
| Complete genome (Accession number NC_001318) | hypothetical protein BB0083 | 79002 | 79376 | - | | 15594429 | 1194919 |
| Complete genome (Accession number NC_001318) | aminotransferase (nifS) | 79505 | 80773 | + | | 15594430 | 1194920 |
| Complete genome (Accession number NC_001318) | hypothetical protein BB0085 | 80983 | 81408 | + | | 15594431 | 1194921 |
| Complete genome (Accession number NC_001318) | hypothetical protein BB0086 | 81405 | 82940 | + | | 15594432 | 1194922 |
| Complete genome (Accession number NC_001318) | L-lactate dehydrogenase (ldh) | 82970 | 83920 | - | | 15594433 | 1194923 |
| Complete genome (Accession number NC_001318) | GTP-binding protein LepA | 84041 | 85720 | - | | 15594434 | 1194924 |
| Complete genome (Accession number NC_001318) | hypothetical protein BB0089 | 85880 | 86854 | - | | 15594435 | 1194925 |
| Complete genome (Accession number NC_001318) | V-type ATP synthase subunit K | 86926 | 87360 | - | | 15594436 | 1194926 |
| Complete genome (Accession number NC_001318) | V-type ATP synthase subunit I | 87377 | 89203 | - | | 15594437 | 1194927 |

Fig. 27 continued

| | | | | | | | |
|---|---|---|---|---|---|---|---|
| Complete genome (Accession number NC_001318) | V-type ATP synthase subunit D | 89200 | 89814 | - | | 15594438 | 1194928 |
| Complete genome (Accession number NC_001318) | V-type ATP synthase subunit B | 89811 | 91115 | - | | 15594439 | 1194929 |
| Complete genome (Accession number NC_001318) | V-type ATP synthase subunit A | 91137 | 92864 | - | | 1.62E+08 | 1194930 |
| Complete genome (Accession number NC_001318) | hypothetical protein BB0095 | 92878 | 93423 | - | | 15594441 | 1194931 |
| Complete genome (Accession number NC_001318) | V-type ATP synthase subunit E | 93433 | 94035 | - | | 15594442 | 1194932 |
| Complete genome (Accession number NC_001318) | hypothetical protein BB0097 | 94219 | 94605 | - | | 15594443 | 1194933 |
| Complete genome (Accession number NC_001318) | recombination and DNA strand exchange inhibitor protein | 94611 | 96953 | - | | 15594444 | 1194934 |
| Complete genome (Accession number NC_001318) | hypothetical protein BB0099 | 96943 | 97866 | - | | 15594445 | 1194935 |
| Complete genome (Accession number NC_001318) | glutamate racemase (murl) | 97863 | 98648 | - | | 15594446 | 1194936 |
| Complete genome (Accession number NC_001318) | asparaginyl-tRNA synthetase | 98805 | 100205 | + | | 15594447 | 1194937 |
| Complete genome (Accession number NC_001318) | hypothetical protein BB0102 | 100228 | 100749 | + | | 15594448 | 1194938 |
| Complete genome (Accession number NC_001318) | hypothetical protein BB0103 | 100746 | 101339 | - | | 15594449 | 1194939 |

Fig. 27 continued

| | | | | | | | |
|---|---|---|---|---|---|---|---|
| Complete genome (Accession number NC_001318) | periplasmic serine protease DO (htrA) | 101525 | 102976 | - | | 15594450 | 1194940 |
| Complete genome (Accession number NC_001318) | methionine aminopeptidase (map) | 103016 | 103771 | - | | 15594451 | 1194941 |
| Complete genome (Accession number NC_001318) | hypothetical protein BB0106 | 103764 | 105473 | - | | 15594452 | 1194942 |
| Complete genome (Accession number NC_001318) | transcription antitermination protein NusB | 105418 | 105855 | - | | 15594453 | 1194943 |
| Complete genome (Accession number NC_001318) | basic membrane protein | 105884 | 106894 | - | | 15594454 | 1194944 |
| Complete genome (Accession number NC_001318) | acetyl-CoA C-acetyltransferase (fadA) | 106974 | 108170 | - | | 15594455 | 1194945 |
| Complete genome (Accession number NC_001318) | hypothetical protein BB0110 | 108307 | 109671 | + | | 15594456 | 1194946 |
| Complete genome (Accession number NC_001318) | replicative DNA helicase (dnaB) | 109675 | 111042 | - | | 15594457 | 1194947 |
| Complete genome (Accession number NC_001318) | 50S ribosomal protein L9 | 111046 | 111567 | - | | 15594458 | 1194948 |
| Complete genome (Accession number NC_001318) | 30S ribosomal protein S18 | 111585 | 111875 | - | | 15594459 | 1194949 |
| Complete genome (Accession number NC_001318) | single-stranded DNA-binding protein (ssb) | 111889 | 112338 | - | | 15594460 | 1194950 |

Fig. 27 continued

| Complete genome (Accession number NC_001318) | 30S ribosomal protein S6 | 112350 | 112769 | - | | 15594461 | 1194951 |
| --- | --- | --- | --- | --- | --- | --- | --- |
| Complete genome (Accession number NC_001318) | PTS system, maltose and glucose-specific IIABC component (malX) | 112909 | 114633 | - | | 15594462 | 1194952 |
| Complete genome (Accession number NC_001318) | hemolysin III (yplQ) | 114807 | 115508 | + | | 15594463 | 1194953 |
| Complete genome (Accession number NC_001318) | zinc protease, putative | 115505 | 116618 | - | | 15594464 | 1194954 |
| Complete genome (Accession number NC_001318) | phosphatidate cytidylyltransferase | 116825 | 117763 | - | | 15595197 | 1195711 |
| Complete genome (Accession number NC_001318) | hypothetical protein BB0120 | 117678 | 118370 | - | | 15594465 | 1194955 |
| Complete genome (Accession number NC_001318) | ribosome releasing factor (frr) | 118375 | 118929 | - | | 15594466 | 1194956 |
| Complete genome (Accession number NC_001318) | elongation factor Ts | 118964 | 119803 | - | | 15594467 | 1194957 |
| Complete genome (Accession number NC_001318) | 30S ribosomal protein S2 | 119807 | 120589 | - | | 15594468 | 1194958 |
| Complete genome (Accession number NC_001318) | hypothetical protein BB0124 | 120804 | 121082 | - | | 15594469 | 1194959 |
| Complete genome (Accession number NC_001318) | hypothetical protein BB0125 | 121101 | 121823 | - | | 15594470 | 1194960 |
| Complete genome (Accession number NC_001318) | hypothetical protein BB0126 | 121880 | 122491 | - | | 15594471 | 1194961 |

Fig. 27 continued

| | | | | | | | |
|---|---|---|---|---|---|---|---|
| Complete genome (Accession number NC_001318) | 30S ribosomal protein S1 | 122491 | 124152 | - | | 15594472 | 1194962 |
| Complete genome (Accession number NC_001318) | cytidylate kinase (cmk-1) | 124149 | 124814 | - | | 15594473 | 1194963 |
| Complete genome (Accession number NC_001318) | hypothetical protein BB0129 | 124798 | 125547 | - | | 15594474 | 1194964 |
| Complete genome (Accession number NC_001318) | hypothetical protein BB0130 | 125534 | 126301 | - | | 15594475 | 1194965 |
| Complete genome (Accession number NC_001318) | recombinase A | 126316 | 127413 | - | | 15594476 | 1194966 |
| Complete genome (Accession number NC_001318) | transcript cleavage factor/unknown domain fusion protein | 127427 | 130132 | - | | 15594477 | 1194967 |
| Complete genome (Accession number NC_001318) | hypothetical protein BB0133 | 130170 | 131114 | - | | 15594478 | 1194968 |
| Complete genome (Accession number NC_001318) | hypothetical protein BB0134 | 131277 | 132425 | + | | 15594479 | 1194969 |
| Complete genome (Accession number NC_001318) | histidyl-tRNA synthetase | 132472 | 133845 | - | | 15594480 | 1194970 |
| Complete genome (Accession number NC_001318) | penicillin-binding protein (pbp-1) | 133975 | 135864 | + | | 15594481 | 1194971 |
| Complete genome (Accession number NC_001318) | long-chain-fatty-acid CoA ligase | 135874 | 137766 | - | | 15594482 | 1194972 |
| Complete genome (Accession number NC_001318) | hypothetical protein BB0138 | 137880 | 138089 | - | | 15594483 | 1194973 |

Fig. 27 continued

| Complete genome (Accession number NC_001318) | hypothetical protein BB0139 | 138434 | 138823 | - | | 15594484 | 1194974 |
|---|---|---|---|---|---|---|---|
| Complete genome (Accession number NC_001318) | acriflavine resistance protein (acrB) | 138850 | 141960 | - | | 15594485 | 1194975 |
| Complete genome (Accession number NC_001318) | membrane fusion protein (mtrC) | 141979 | 142935 | - | | 15594486 | 1194976 |
| Complete genome (Accession number NC_001318) | hypothetical protein BB0142 | 142944 | 144266 | - | | 15594487 | 1194977 |
| Complete genome (Accession number NC_001318) | alpha-hemolysin (hlyA) | 144307 | 144597 | + | | 15594488 | 1194978 |
| Complete genome (Accession number NC_001318) | glycine betaine, L-proline ABC transporter, glycine/betaine/L-proline-binding protein (proX) | 144586 | 145458 | - | | 15594489 | 1194979 |
| Complete genome (Accession number NC_001318) | glycine betaine, L-proline ABC transporter, permease protein (proW) | 145471 | 146370 | - | | 15594490 | 1194980 |
| Complete genome (Accession number NC_001318) | glycine betaine, L-proline ABC transporter, ATP-binding protein (proV) | 146377 | 147495 | - | | 15594491 | 1194981 |
| Complete genome (Accession number | flagellin | 147649 | 148659 | - | | 15594492 | 1194982 |

Fig. 27 continued

| | | | | | | | |
|---|---|---|---|---|---|---|---|
| NC_001318) | | | | | | | |
| Complete genome (Accession number NC_001318) | hypothetical protein BB0148 | 148710 | 148805 | + | | 15594493 | 1194983 |
| Complete genome (Accession number NC_001318) | flagellar hook-associated protein FliD | 148786 | 150783 | - | | 15594494 | 1194984 |
| Complete genome (Accession number NC_001318) | hypothetical protein BB0150 | 150805 | 150897 | - | | 15594495 | 1194985 |
| Complete genome (Accession number NC_001318) | N-acetylglucosamine-6-phosphate deacetylase (nagA) | 150974 | 152179 | + | | 15594496 | 1194986 |
| Complete genome (Accession number NC_001318) | glucosamine-6-phosphate deaminase | 152206 | 153012 | + | | 15594497 | 1194987 |
| Complete genome (Accession number NC_001318) | superoxide dismutase (sodA) | 153075 | 153719 | - | | 15594498 | 1194988 |
| Complete genome (Accession number NC_001318) | preprotein translocase subunit SecA | 153701 | 156400 | - | | 15594499 | 1194989 |
| Complete genome (Accession number NC_001318) | hypothetical protein BB0155 | 156462 | 157598 | + | | 15594500 | 1194990 |
| Complete genome (Accession number NC_001318) | hypothetical protein BB0156 | 157627 | 158061 | + | | 15594501 | 1194991 |
| Complete genome (Accession number NC_001318) | hypothetical protein BB0157 | 158058 | 158474 | + | | 15594502 | 1194992 |

Fig. 27 continued

| Complete genome (Accession number NC_001318) | antigen, S2, putative | 158628 | 159344 | + | | 15594503 | 1194993 |
|---|---|---|---|---|---|---|---|
| Complete genome (Accession number NC_001318) | hypothetical protein BB0159 | 159368 | 160042 | + | | 15594504 | 1194994 |
| Complete genome (Accession number NC_001318) | alanine racemase (alr) | 160090 | 161208 | + | | 15594505 | 1194995 |
| Complete genome (Accession number NC_001318) | hypothetical protein BB0161 | 161200 | 162864 | - | | 15594506 | 1194996 |
| Complete genome (Accession number NC_001318) | hypothetical protein BB0162 | 162878 | 163045 | + | | 15594507 | 1194997 |
| Complete genome (Accession number NC_001318) | hypothetical protein BB0163 | 163072 | 164820 | - | | 15594508 | 1194998 |
| Complete genome (Accession number NC_001318) | Na+/Ca+ exchange protein, putative | 164901 | 165914 | - | | 15594509 | 1194999 |
| Complete genome (Accession number NC_001318) | hypothetical protein BB0165 | 165915 | 167759 | - | | 15594510 | 1195000 |
| Complete genome (Accession number NC_001318) | 4-alpha-glucanotransferase (malQ) | 167879 | 169399 | - | | 15594511 | 1195001 |
| Complete genome (Accession number NC_001318) | outer membrane protein (tpn50) | 169539 | 170706 | + | | 15594512 | 1195002 |
| Complete genome (Accession number NC_001318) | dnaK suppressor, putative | 170720 | 171097 | - | | 15594513 | 1195003 |
| Complete genome (Accession number NC_001318) | translation initiation factor IF-1 | 171212 | 171484 | + | | 15594514 | 1195004 |

Fig. 27 continued

| Complete genome (Accession number NC_001318) | hypothetical protein BB0170 | 171532 | 173560 | - | | 15594515 | 1195005 |
|---|---|---|---|---|---|---|---|
| Complete genome (Accession number NC_001318) | hypothetical protein BB0171 | 173529 | 174116 | - | | 15594516 | 1195006 |
| Complete genome (Accession number NC_001318) | hypothetical protein BB0172 | 174098 | 175138 | - | | 15594517 | 1195007 |
| Complete genome (Accession number NC_001318) | hypothetical protein BB0173 | 175081 | 176106 | - | | 15594518 | 1195008 |
| Complete genome (Accession number NC_001318) | hypothetical protein BB0174 | 176069 | 176974 | - | | 15594519 | 1195009 |
| Complete genome (Accession number NC_001318) | hypothetical protein BB0175 | 176978 | 177853 | - | | 15594520 | 1195010 |
| Complete genome (Accession number NC_001318) | methanol dehydrogenase regulator (moxR) | 177868 | 178881 | - | | 15594521 | 1195011 |
| Complete genome (Accession number NC_001318) | glucose inhibited division protein B (gidB) | 178917 | 179543 | - | | 15594522 | 1195012 |
| Complete genome (Accession number NC_001318) | tRNA uridine 5-carboxymethylaminomethyl modification enzyme GidA | 179540 | 181423 | - | | 15594523 | 1195013 |
| Complete genome (Accession number NC_001318) | tRNA modification GTPase TrmE | 181408 | 182802 | - | | 15594524 | 1195014 |

Fig. 27 continued

| | | | | | | | |
|---|---|---|---|---|---|---|---|
| Complete genome (Accession number NC_001318) | flagellar protein, putative | 182886 | 183360 | + | | 15594525 | 1195015 |
| Complete genome (Accession number NC_001318) | flagellar hook-associated protein FlgK | 183392 | 185275 | + | | 15594526 | 1195016 |
| Complete genome (Accession number NC_001318) | flagellar hook-associated protein FlgL | 185278 | 186552 | + | | 15594527 | 1195017 |
| Complete genome (Accession number NC_001318) | flagellar assembly protein FliW | 186554 | 186946 | + | | 15594528 | 1195018 |
| Complete genome (Accession number NC_001318) | carbon storage regulator (csrA) | 186949 | 187194 | + | | 15594529 | 1195019 |
| Complete genome (Accession number NC_001318) | hypothetical protein BB0185 | 187178 | 187831 | - | | 15594530 | 1195020 |
| Complete genome (Accession number NC_001318) | hypothetical protein BB0186 | 187824 | 188237 | - | | 15594531 | 1195021 |
| Complete genome (Accession number NC_001318) | hypothetical protein BB0187 | 188234 | 188494 | - | | 15594532 | 1195022 |
| Complete genome (Accession number NC_001318) | 50S ribosomal protein L20 | 188708 | 189055 | - | | 15594533 | 1195023 |
| Complete genome (Accession number NC_001318) | 50S ribosomal protein L35 | 189076 | 189276 | - | | 15594534 | 1195024 |
| Complete genome (Accession number NC_001318) | translation initiation factor IF-3 | 189299 | 189859 | - | | 15594535 | 1195025 |
| Complete genome (Accession number NC_001318) | hypothetical protein BB0191 | 189949 | 190044 | + | | 15594536 | 1195026 |

Fig. 27 continued

| | | | | | | | |
|---|---|---|---|---|---|---|---|
| Complete genome (Accession number NC_001318) | hypothetical protein BB0192 | 190064 | 190717 | + | | 15594537 | 1195027 |
| Complete genome (Accession number NC_001318) | hypothetical protein BB0193 | 190719 | 191459 | + | | 15594538 | 1195028 |
| Complete genome (Accession number NC_001318) | hypothetical protein BB0194 | 191518 | 192327 | - | | 15594539 | 1195029 |
| Complete genome (Accession number NC_001318) | cell division control protein 27, putative | 192324 | 193463 | - | | 15594540 | 1195030 |
| Complete genome (Accession number NC_001318) | peptide chain release factor 1 | 193800 | 194873 | + | | 15594541 | 1195031 |
| Complete genome (Accession number NC_001318) | protoporphyrinogen oxidase, putative | 194876 | 195736 | + | | 15594542 | 1195032 |
| Complete genome (Accession number NC_001318) | guanosine-3',5'-bis(diphosphate) 3'-pyrophosphohydrolase (spoT) | 195693 | 197696 | + | | 15594543 | 1195033 |
| Complete genome (Accession number NC_001318) | hypothetical protein BB0199 | 197686 | 199950 | + | | 15594544 | 1195034 |
| Complete genome (Accession number NC_001318) | D-alanine--D-alanine ligase (ddlA) | 199965 | 201035 | - | | 15594545 | 1195035 |

Fig. 27 continued

| | | | | | | | |
|---|---|---|---|---|---|---|---|
| Complete genome (Accession number NC_001318) | UDP-N-acetylmuramoylal anyl-D-glutamate--2,6-diaminopimelate ligase (murE) | 201052 | 202578 | - | | 15594546 | 1195036 |
| Complete genome (Accession number NC_001318) | hemolysin, putative | 202850 | 204088 | + | | 15594547 | 1195038 |
| Complete genome (Accession number NC_001318) | Lambda CII stability-governing protein (hflK) | 204137 | 205072 | + | | 15594548 | 1195039 |
| Complete genome (Accession number NC_001318) | Lambda CII stability-governing protein (hflC) | 205073 | 206044 | + | | 15594549 | 1195040 |
| Complete genome (Accession number NC_001318) | hypothetical protein BB0205 | 206529 | 208106 | + | | 15594550 | 1195042 |
| Complete genome (Accession number NC_001318) | hypothetical protein BB0206 | 208084 | 208653 | - | | 15594551 | 1195043 |
| Complete genome (Accession number NC_001318) | UTP--glucose-1-phosphate uridylyltransferase (gtaB) | 208706 | 209542 | + | | 15594552 | 1195044 |
| Complete genome (Accession number NC_001318) | hypothetical protein BB0208 | 209529 | 211274 | + | | 15594553 | 1195045 |
| Complete genome (Accession number NC_001318) | hypothetical protein BB0209 | 211301 | 212068 | + | | 15594554 | 1195046 |

Fig. 27 continued

| Complete genome (Accession number NC_001318) | surface-located membrane protein 1 (lmp1) | 212061 | 215420 | + | | 15594555 | 1195047 |
|---|---|---|---|---|---|---|---|
| Complete genome (Accession number NC_001318) | DNA mismatch repair protein (mutL) | 215427 | 217259 | + | | 15594556 | 1195048 |
| Complete genome (Accession number NC_001318) | hypothetical protein BB0212 | 217278 | 218312 | + | | 15594557 | 1195049 |
| Complete genome (Accession number NC_001318) | hypothetical protein BB0213 | 218425 | 219078 | - | | 15594558 | 1195050 |
| Complete genome (Accession number NC_001318) | translation elongation factor P (efp) | 219056 | 219634 | - | | 15594559 | 1195051 |
| Complete genome (Accession number NC_001318) | phosphate ABC transporter, periplasmic phosphate-binding protein (pstS) | 219797 | 220639 | + | | 15594560 | 1195052 |
| Complete genome (Accession number NC_001318) | phosphate ABC transporter, permease protein (pstC) | 220729 | 221637 | + | | 15594561 | 1195053 |
| Complete genome (Accession number NC_001318) | phosphate ABC transporter, permease protein (pstA) | 222192 | 223178 | + | | 15594562 | 1195054 |

Fig. 27 continued

| | | | | | | | |
|---|---|---|---|---|---|---|---|
| Complete genome (Accession number NC_001318) | phosphate ABC transporter, ATP-binding protein (pstB) | 223179 | 223961 | + | | 15594563 | 1195055 |
| Complete genome (Accession number NC_001318) | gutA protein | 223964 | 224785 | - | | 15594564 | 1195056 |
| Complete genome (Accession number NC_001318) | alanyl-tRNA synthetase | 224826 | 226610 | - | | 15594565 | 1195057 |
| Complete genome (Accession number NC_001318) | flagellar motor switch protein (fliG-1) | 226610 | 227836 | - | | 15594566 | 1195058 |
| Complete genome (Accession number NC_001318) | glucose-6-phosphate 1-dehydrogenase, putative | 227814 | 228521 | - | | 15594567 | 1195059 |
| Complete genome (Accession number NC_001318) | hypothetical protein BB0223 | 228542 | 228895 | - | | 15594568 | 1195060 |
| Complete genome (Accession number NC_001318) | hypothetical protein BB0224 | 228864 | 229148 | - | | 15594569 | 1195061 |
| Complete genome (Accession number NC_001318) | tRNA-dihydrouridine synthase A | 229217 | 230224 | + | | 15594570 | 1195062 |
| Complete genome (Accession number NC_001318) | seryl-tRNA synthetase | 230214 | 231491 | - | | 15594571 | 1195063 |
| Complete genome (Accession number NC_001318) | hypothetical protein BB0227 | 231621 | 232322 | + | | 15594572 | 1195064 |
| Complete genome (Accession number NC_001318) | hypothetical protein BB0228 | 232338 | 235253 | + | | 15594573 | 1195065 |

Fig. 27 continued

| | | | | | | | |
|---|---|---|---|---|---|---|---|
| Complete genome (Accession number NC_001318) | 50S ribosomal protein L31 type B | 235289 | 235534 | - | | 15594574 | 1195066 |
| Complete genome (Accession number NC_001318) | transcription termination factor Rho | 235595 | 237142 | - | | 15594575 | 1195067 |
| Complete genome (Accession number NC_001318) | hypothetical protein BB0231 | 237222 | 237629 | - | | 15594576 | 1195068 |
| Complete genome (Accession number NC_001318) | hbbU protein | 237630 | 237956 | - | | 15594577 | 1195069 |
| Complete genome (Accession number NC_001318) | 30S ribosomal protein S20 | 237969 | 238226 | - | | 1.62E+08 | 1195070 |
| Complete genome (Accession number NC_001318) | hypothetical protein BB0234 | 238301 | 239128 | - | | 15594579 | 1195071 |
| Complete genome (Accession number NC_001318) | translation-associated GTPase | 239144 | 240250 | - | | 15594580 | 1195072 |
| Complete genome (Accession number NC_001318) | hypothetical protein BB0236 | 240263 | 242289 | - | | 15594581 | 1195073 |
| Complete genome (Accession number NC_001318) | apolipoprotein N-acyltransferase | 242438 | 244003 | + | | 15594582 | 1195074 |
| Complete genome (Accession number NC_001318) | hypothetical protein BB0238 | 243943 | 244731 | - | | 15594583 | 1195075 |
| Complete genome (Accession number NC_001318) | deoxyguanosine/deoxyadenosine kinase(I) subunit 2 (dck) | 244777 | 245394 | - | | 15594584 | 1195076 |

Fig. 27 continued

| Complete genome (Accession number NC_001318) | glycerol uptake facilitator (glpF) | 245790 | 246554 | + | | 15594585 | 1195077 |
|---|---|---|---|---|---|---|---|
| Complete genome (Accession number NC_001318) | glycerol kinase (glpK) | 246597 | 248102 | + | | 15594586 | 1195078 |
| Complete genome (Accession number NC_001318) | hypothetical protein BB0242 | 248156 | 248434 | + | | 15594587 | 1195079 |
| Complete genome (Accession number NC_001318) | glycerol-3-phosphate dehydrogenase, anaerobic (glpA) | 248506 | 250089 | + | | 15594588 | 1195080 |
| Complete genome (Accession number NC_001318) | hypothetical protein BB0244 | 250176 | 250670 | − | | 15594589 | 1195081 |
| Complete genome (Accession number NC_001318) | hypothetical protein BB0245 | 250657 | 251211 | − | | 15594590 | 1195082 |
| Complete genome (Accession number NC_001318) | hypothetical protein BB0246 | 251212 | 252237 | − | | 15594591 | 1195083 |
| Complete genome (Accession number NC_001318) | hypothetical protein BB0247 | 252434 | 253039 | + | | 15594592 | 1195084 |
| Complete genome (Accession number NC_001318) | oligoendopeptidase F (pepF) | 253159 | 254931 | + | | 15594593 | 1195085 |
| Complete genome (Accession number NC_001318) | phosphatidyltransferase | 254945 | 255649 | + | | 15594594 | 1195086 |
| Complete genome (Accession number NC_001318) | dedA protein (dedA) | 255646 | 256260 | + | | 15594595 | 1195087 |
| Complete genome (Accession number NC_001318) | leucyl-tRNA synthetase | 256463 | 258985 | + | | 15594596 | 1195088 |

Fig. 27 continued

| Complete genome (Accession number NC_001318) | hypothetical protein BB0252 | 259000 | 261303 | + | | 15594597 | 1195089 |
|---|---|---|---|---|---|---|---|
| Complete genome (Accession number NC_001318) | ATP-dependent protease LA (lon-1) | 261292 | 263712 | - | | 15594598 | 1195090 |
| Complete genome (Accession number NC_001318) | single-stranded-DNA-specific exonuclease (recJ) | 263988 | 266114 | + | | 15594599 | 1195091 |
| Complete genome (Accession number NC_001318) | hypothetical protein BB0255 | 266095 | 267051 | + | | 15594600 | 1195092 |
| Complete genome (Accession number NC_001318) | 30S ribosomal protein S21 | 267066 | 267275 | + | | 15594601 | 1195093 |
| Complete genome (Accession number NC_001318) | cell division protein, putative | 267313 | 269676 | - | | 15594602 | 1195094 |
| Complete genome (Accession number NC_001318) | undecaprenyl pyrophosphate phosphatase | 269673 | 270473 | - | | 15594603 | 1195095 |
| Complete genome (Accession number NC_001318) | hypothetical protein BB0259 | 270488 | 272701 | - | | 15594604 | 1195096 |
| Complete genome (Accession number NC_001318) | hypothetical protein BB0260 | 272634 | 273647 | - | | 15594605 | 1195097 |
| Complete genome (Accession number NC_001318) | hypothetical protein BB0261 | 273854 | 275236 | + | | 15594606 | 1195098 |
| Complete genome (Accession number NC_001318) | hypothetical protein BB0262 | 275243 | 276496 | - | | 15594607 | 1195099 |

Fig. 27 continued

| Complete genome (Accession number NC_001318) | signal peptidase I (lepB-3) | 276758 | 277064 | + | | 15594608 | 1195100 |
| --- | --- | --- | --- | --- | --- | --- | --- |
| Complete genome (Accession number NC_001318) | heat shock protein 70 (dnaK-1) | 277090 | 278565 | - | | 15594609 | 1195101 |
| Complete genome (Accession number NC_001318) | hypothetical protein BB0265 | 278537 | 279058 | - | | 15594610 | 1195102 |
| Complete genome (Accession number NC_001318) | hypothetical protein BB0266 | 279078 | 279386 | - | | 15594611 | 1195103 |
| Complete genome (Accession number NC_001318) | hypothetical protein BB0267 | 279407 | 281311 | - | | 15594612 | 1195104 |
| Complete genome (Accession number NC_001318) | hypothetical protein BB0268 | 281314 | 281793 | - | | 15594613 | 1195105 |
| Complete genome (Accession number NC_001318) | ATP-binding protein (ylxH-1) | 281800 | 282687 | - | | 15594614 | 1195106 |
| Complete genome (Accession number NC_001318) | flagellar biosynthesis regulator FlhF | 282699 | 283865 | - | | 15594615 | 1195107 |
| Complete genome (Accession number NC_001318) | flagellar biosynthesis protein A | 283869 | 285962 | - | | 15594616 | 1195108 |
| Complete genome (Accession number NC_001318) | flagellar biosynthesis protein FlhB | 285971 | 287089 | - | | 15594617 | 1195109 |
| Complete genome (Accession number NC_001318) | flagellar biosynthesis protein (fliR) | 287089 | 287896 | - | | 15594618 | 1195110 |

Fig. 27 continued

| | | | | | | | |
|---|---|---|---|---|---|---|---|
| Complete genome (Accession number NC_001318) | flagellar biosynthesis protein (fliQ) | 287910 | 288173 | - | | 15594619 | 1195111 |
| Complete genome (Accession number NC_001318) | flagellar biosynthesis protein FliP | 288182 | 288946 | - | | 15594620 | 1195112 |
| Complete genome (Accession number NC_001318) | flagellar biosynthesis protein (fliZ) | 288957 | 289583 | - | | 15594621 | 1195113 |
| Complete genome (Accession number NC_001318) | flagellar motor switch protein (fliN) | 289576 | 289917 | - | | 15594622 | 1195114 |
| Complete genome (Accession number NC_001318) | flagellar motor switch protein FliM | 289963 | 291021 | - | | 15594623 | 1195115 |
| Complete genome (Accession number NC_001318) | flagellar basal body-associated protein FliL | 291059 | 291595 | - | | 15594624 | 1195116 |
| Complete genome (Accession number NC_001318) | flagellar motor protein MotB | 291644 | 292426 | - | | 15594625 | 1195117 |
| Complete genome (Accession number NC_001318) | flagellar motor rotation protein A (motA) | 292426 | 293208 | - | | 15594626 | 1195118 |
| Complete genome (Accession number NC_001318) | flagellar protein (flbD) | 293205 | 293429 | - | | 15594627 | 1195119 |
| Complete genome (Accession number NC_001318) | flagellar hook protein FlgE | 293452 | 294780 | - | | 15594628 | 1195120 |

Fig. 27 continued

| | | | | | | | |
|---|---|---|---|---|---|---|---|
| Complete genome (Accession number NC_001318) | flagellar basal body rod modification protein | 294785 | 295226 | - | | 15594629 | 1195121 |
| Complete genome (Accession number NC_001318) | flagellar protein (flbC) | 295242 | 296426 | - | | 15594630 | 1195122 |
| Complete genome (Accession number NC_001318) | flagellar protein (flbB) | 296428 | 297051 | - | | 15594631 | 1195123 |
| Complete genome (Accession number NC_001318) | flagellar protein (flbA) | 297038 | 297469 | - | | 15594632 | 1195124 |
| Complete genome (Accession number NC_001318) | flagellum-specific ATP synthase (fliI) | 297466 | 298776 | - | | 15594633 | 1195125 |
| Complete genome (Accession number NC_001318) | flagellar assembly protein H | 298795 | 299715 | - | | 15594634 | 1195126 |
| Complete genome (Accession number NC_001318) | flagellar motor switch protein G | 299730 | 300764 | - | | 15594635 | 1195127 |
| Complete genome (Accession number NC_001318) | flagellar MS-ring protein | 300780 | 302489 | - | | 15594636 | 1195128 |
| Complete genome (Accession number NC_001318) | flagellar hook-basal body protein FliE | 302504 | 302839 | - | | 15594637 | 1195129 |
| Complete genome (Accession number NC_001318) | flagellar basal body rod protein FlgC | 302851 | 303309 | - | | 15594638 | 1195130 |
| Complete genome (Accession number NC_001318) | flagellar basal body rod protein FlgB | 303333 | 303740 | - | | 15594639 | 1195131 |

Fig. 27 continued

| Complete genome (Accession number NC_001318) | ATP-dependent protease ATP-binding subunit | 303774 | 305141 | - | | 15594640 | 1195132 |
| Complete genome (Accession number NC_001318) | ATP-dependent protease peptidase subunit | 305113 | 305661 | - | | 15594641 | 1195133 |
| Complete genome (Accession number NC_001318) | smg protein | 305671 | 306618 | - | | 15594642 | 1195134 |
| Complete genome (Accession number NC_001318) | hypothetical protein BB0298 | 306625 | 307317 | - | | 15594643 | 1195135 |
| Complete genome (Accession number NC_001318) | cell division protein FtsZ | 307318 | 308532 | - | | 15594644 | 1195136 |
| Complete genome (Accession number NC_001318) | cell division protein (ftsA) | 308539 | 309780 | - | | 15594645 | 1195137 |
| Complete genome (Accession number NC_001318) | cell division protein (divIB) | 309780 | 310523 | - | | 15594646 | 1195138 |
| Complete genome (Accession number NC_001318) | cell division protein (ftsW) | 310559 | 311653 | - | | 15594647 | 1195139 |
| Complete genome (Accession number NC_001318) | phospho-N-acetylmuramoyl-pentapeptide-transferase (mraY) | 311660 | 312715 | - | | 15594648 | 1195140 |

Fig. 27 continued

| | | | | | | | |
|---|---|---|---|---|---|---|---|
| Complete genome (Accession number NC_001318) | UDP-N-acetylmuramoylalanyl-D-glutamyl-2,6-diaminopimelate--D-alanyl-D-alanine ligase (murF) | 312729 | 314123 | - | | 15594649 | 1195141 |
| Complete genome (Accession number NC_001318) | hypothetical protein BB0305 | 314146 | 314427 | - | | 15594650 | 1195142 |
| Complete genome (Accession number NC_001318) | hypothetical protein BB0306 | 314424 | 315314 | - | | 15594651 | 1195143 |
| Complete genome (Accession number NC_001318) | hypothetical protein BB0307 | 315307 | 316143 | - | | 15594652 | 1195144 |
| Complete genome (Accession number NC_001318) | hypothetical protein BB0308 | 316140 | 317216 | - | | 15594653 | 1195145 |
| Complete genome (Accession number NC_001318) | hypothetical protein BB0309 | 317247 | 318026 | - | | 15594654 | 1195146 |
| Complete genome (Accession number NC_001318) | hypothetical protein BB0310 | 318119 | 318256 | - | | 15594655 | 1195147 |
| Complete genome (Accession number NC_001318) | hypothetical protein BB0311 | 318277 | 319158 | - | | 15594656 | 1195148 |
| Complete genome (Accession number NC_001318) | purine-binding chemotaxis protein (cheW-1) | 319106 | 319636 | - | | 15594657 | 1195149 |
| Complete genome (Accession number NC_001318) | cell division protein (ftsJ) | 319680 | 320258 | - | | 15594658 | 1195150 |

Fig. 27 continued

| | | | | | | | |
|---|---|---|---|---|---|---|---|
| Complete genome (Accession number NC_001318) | octaprenyl-diphosphate synthase (ispB) | 320309 | 321352 | + | | 15594659 | 1195151 |
| Complete genome (Accession number NC_001318) | hypothetical protein BB0315 | 321352 | 322038 | + | | 15594660 | 1195152 |
| Complete genome (Accession number NC_001318) | hypothetical protein BB0316 | 322040 | 322846 | - | | 15594661 | 1195153 |
| Complete genome (Accession number NC_001318) | hypothetical protein BB0317 | 322847 | 323779 | - | | 15594662 | 1195154 |
| Complete genome (Accession number NC_001318) | methylgalactoside ABC transporter, ATP-binding protein (mglA) | 323776 | 325236 | - | | 15594663 | 1195155 |
| Complete genome (Accession number NC_001318) | exported protein (tpn38b) | 325236 | 326288 | - | | 15594664 | 1195156 |
| Complete genome (Accession number NC_001318) | hypothetical protein BB0320 | 326325 | 326432 | - | | 15594665 | 1195157 |
| Complete genome (Accession number NC_001318) | hypothetical protein BB0321 | 326469 | 326666 | - | | 15594666 | 1195158 |
| Complete genome (Accession number NC_001318) | hypothetical protein BB0322 | 326699 | 327757 | - | | 15594667 | 1195159 |
| Complete genome (Accession number NC_001318) | hypothetical protein BB0323 | 328032 | 329165 | + | | 15594668 | 1195160 |
| Complete genome (Accession number NC_001318) | hypothetical protein BB0324 | 329262 | 329621 | + | | 15594669 | 1195161 |

Fig. 27 continued

| | | | | | | | |
|---|---|---|---|---|---|---|---|
| Complete genome (Accession number NC_001318) | hypothetical protein BB0325 | 329643 | 330752 | - | | 15594670 | 1195162 |
| Complete genome (Accession number NC_001318) | hypothetical protein BB0326 | 330803 | 333598 | - | | 15594671 | 1195163 |
| Complete genome (Accession number NC_001318) | glycerol-3-phosphate O-acyltransferase, putative | 333619 | 334515 | - | | 15594672 | 1195164 |
| Complete genome (Accession number NC_001318) | oligopeptide ABC transporter, periplasmic oligopeptide-binding protein (oppA-1) | 334919 | 336508 | + | | 15594673 | 1195165 |
| Complete genome (Accession number NC_001318) | oligopeptide ABC transporter, periplasmic oligopeptide-binding protein (oppA-2) | 336629 | 338215 | + | | 15594674 | 1195166 |
| Complete genome (Accession number NC_001318) | oligopeptide ABC transporter, periplasmic oligopeptide-binding protein (oppA-3) | 338358 | 339983 | + | | 15594675 | 1195167 |
| Complete genome (Accession number NC_001318) | hypothetical protein BB0331 | 340062 | 340217 | - | | 15594676 | 1195168 |

Fig. 27 continued

| | | | | | | | |
|---|---|---|---|---|---|---|---|
| Complete genome (Accession number NC_001318) | oligopeptide ABC transporter, permease protein (oppB-1) | 340341 | 341261 | + | | 15594677 | 1195169 |
| Complete genome (Accession number NC_001318) | oligopeptide ABC transporter, permease protein (oppC-1) | 341274 | 342323 | + | | 15594678 | 1195170 |
| Complete genome (Accession number NC_001318) | oligopeptide ABC transporter, ATP-binding protein (oppD) | 342335 | 343207 | + | | 15594679 | 1195171 |
| Complete genome (Accession number NC_001318) | oligopeptide ABC transporter, ATP-binding protein (oppF) | 343208 | 344179 | + | | 15594680 | 1195172 |
| Complete genome (Accession number NC_001318) | P26 | 344192 | 344947 | - | | 15594681 | 1195173 |
| Complete genome (Accession number NC_001318) | enolase (eno) | 345063 | 346364 | + | | 15594682 | 1195174 |
| Complete genome (Accession number NC_001318) | 30S ribosomal protein S9 | 346431 | 346841 | - | | 15594683 | 1195175 |
| Complete genome (Accession number NC_001318) | 50S ribosomal protein L13 | 346861 | 347301 | - | | 15594684 | 1195176 |
| Complete genome (Accession number NC_001318) | hypothetical protein BB0340 | 347351 | 348160 | - | | 15594685 | 1195177 |

Fig. 27 continued

| Complete genome (Accession number NC_001318) | aspartyl/glutamyl-tRNA amidotransferase subunit B | 348153 | 349610 | - | | 15594686 | 1195178 |
|---|---|---|---|---|---|---|---|
| Complete genome (Accession number NC_001318) | glu-tRNA amidotransferase, subunit A (gluA) | 349600 | 351090 | - | | 15594687 | 1195179 |
| Complete genome (Accession number NC_001318) | aspartyl/glutamyl-tRNA amidotransferase subunit C | 351056 | 351331 | - | | 15594688 | 1195180 |
| Complete genome (Accession number NC_001318) | DNA helicase (uvrD) | 351341 | 353440 | - | | 15594689 | 1195181 |
| Complete genome (Accession number NC_001318) | hypothetical protein BB0345 | 353440 | 354636 | - | | 15594690 | 1195182 |
| Complete genome (Accession number NC_001318) | hypothetical protein BB0346 | 354648 | 355298 | - | | 15594691 | 1195183 |
| Complete genome (Accession number NC_001318) | fibronectin/fibrinogen-binding protein, putative | 355482 | 356909 | + | | 15594692 | 1195184 |
| Complete genome (Accession number NC_001318) | pyruvate kinase | 357007 | 358440 | + | | 15594693 | 1195185 |
| Complete genome (Accession number NC_001318) | hypothetical protein BB0349 | 358458 | 359198 | + | | 15594694 | 1195186 |
| Complete genome (Accession number NC_001318) | 50S ribosomal protein L28 | 359217 | 359495 | - | | 15594695 | 1195187 |
| Complete genome (Accession number NC_001318) | hypothetical protein BB0351 | 359513 | 361081 | - | | 15594696 | 1195188 |

Fig. 27 continued

| Complete genome (Accession number NC_001318) | hypothetical protein BB0352 | 361188 | 362321 | + | | 15594697 | 1195189 |
|---|---|---|---|---|---|---|---|
| Complete genome (Accession number NC_001318) | hypothetical protein BB0353 | 362318 | 364117 | - | | 15594698 | 1195190 |
| Complete genome (Accession number NC_001318) | hypothetical protein BB0354 | 364130 | 365170 | - | | 15594699 | 1195191 |
| Complete genome (Accession number NC_001318) | transcription factor, putative | 365115 | 365603 | - | | 15594700 | 1195192 |
| Complete genome (Accession number NC_001318) | hypothetical protein BB0356 | 365643 | 366137 | - | | 15594701 | 1195193 |
| Complete genome (Accession number NC_001318) | hypothetical protein BB0357 | 366144 | 366236 | - | | 15594702 | 1195194 |
| Complete genome (Accession number NC_001318) | hypothetical protein BB0358 | 366229 | 366960 | - | | 15594703 | 1195195 |
| Complete genome (Accession number NC_001318) | carboxyl-terminal protease (ctp) | 366964 | 368391 | - | | 15594704 | 1195196 |
| Complete genome (Accession number NC_001318) | hypothetical protein BB0360 | 368456 | 368881 | + | | 15594705 | 1195197 |
| Complete genome (Accession number NC_001318) | ATP-binding protein (ylxH-2) | 368885 | 370027 | + | | 15594706 | 1195198 |
| Complete genome (Accession number NC_001318) | prolipoprotein diacylglyceryl transferase | 370027 | 371013 | + | | 15594707 | 1195199 |
| Complete genome (Accession number NC_001318) | periplasmic protein | 371034 | 373046 | + | | 15594708 | 1195200 |
| Complete genome (Accession number NC_001318) | methylglyoxal synthase | 373140 | 373520 | + | | 15594709 | 1195201 |

Fig. 27 continued

| | | | | | | | |
|---|---|---|---|---|---|---|---|
| Complete genome (Accession number NC_001318) | lipoprotein LA7 | 373567 | 374151 | - | | 15594710 | 1195202 |
| Complete genome (Accession number NC_001318) | putative aminopeptidase 1 | 374277 | 375653 | + | | 15594711 | 1195203 |
| Complete genome (Accession number NC_001318) | hypothetical protein BB0367 | 375661 | 375939 | + | | 15594712 | 1195204 |
| Complete genome (Accession number NC_001318) | NAD(P)H-dependent glycerol-3-phosphate dehydrogenase | 375961 | 377052 | - | | 15594713 | 1195205 |
| Complete genome (Accession number NC_001318) | ATP-dependent Clp protease, subunit A (clpA) | 377039 | 379330 | - | | 15594714 | 1195206 |
| Complete genome (Accession number NC_001318) | tyrosyl-tRNA synthetase (tyrS) | 379341 | 380558 | - | | 15594715 | 1195207 |
| Complete genome (Accession number NC_001318) | glycyl-tRNA synthetase | 380555 | 381892 | - | | 15594716 | 1195208 |
| Complete genome (Accession number NC_001318) | glutamyl-tRNA synthetase | 381910 | 383382 | - | | 15594717 | 1195209 |
| Complete genome (Accession number NC_001318) | hypothetical protein BB0373 | 383395 | 384162 | - | | 15594718 | 1195210 |
| Complete genome (Accession number NC_001318) | hypothetical protein BB0374 | 384287 | 385426 | + | | 15594719 | 1195211 |
| Complete genome (Accession number NC_001318) | pfs protein (pfs-1) | 385449 | 386162 | + | | 15594720 | 1195212 |

Fig. 27 continued

| | | | | | | | |
|---|---|---|---|---|---|---|---|
| Complete genome (Accession number NC_001318) | S-adenosylmethionine synthetase | 386159 | 387337 | + | | 15594721 | 1195213 |
| Complete genome (Accession number NC_001318) | S-ribosylhomocysteinase | 387334 | 387807 | + | | 1.62E+08 | 1195214 |
| Complete genome (Accession number NC_001318) | hypothetical protein BB0378 | 387818 | 388480 | - | | 15594723 | 1195215 |
| Complete genome (Accession number NC_001318) | protein kinase C1 inhibitor (pkci) | 388507 | 388956 | - | | 15594724 | 1195216 |
| Complete genome (Accession number NC_001318) | Mg2+ transport protein (mgtE) | 388977 | 390341 | - | | 15594725 | 1195217 |
| Complete genome (Accession number NC_001318) | hypothetical protein BB0381 | 390392 | 391819 | - | | 15594726 | 1195218 |
| Complete genome (Accession number NC_001318) | basic membrane protein B (bmpB) | 391932 | 392957 | - | | 15594727 | 1195219 |
| Complete genome (Accession number NC_001318) | basic membrane protein A (bmpA) | 393044 | 394063 | - | | 15594728 | 1195220 |
| Complete genome (Accession number NC_001318) | basic membrane protein C (bmpC) | 394105 | 395166 | - | | 15594729 | 1195221 |
| Complete genome (Accession number NC_001318) | basic membrane protein D (bmpD) | 395481 | 396563 | - | | 15594730 | 1195222 |
| Complete genome (Accession number NC_001318) | 30S ribosomal protein S7 | 396604 | 397077 | - | | 15594731 | 1195223 |

Fig. 27 continued

| Complete genome (Accession number NC_001318) | 30S ribosomal protein S12 | 397102 | 397476 | - | | 15594732 | 1195224 |
|---|---|---|---|---|---|---|---|
| Complete genome (Accession number NC_001318) | DNA-directed RNA polymerase subunit beta' | 397544 | 401677 | - | | 15594733 | 1195225 |
| Complete genome (Accession number NC_001318) | DNA-directed RNA polymerase subunit beta | 401693 | 405160 | - | | 15594734 | 1195226 |
| Complete genome (Accession number NC_001318) | 50S ribosomal protein L7/L12 | 405243 | 405617 | - | | 15594735 | 1195227 |
| Complete genome (Accession number NC_001318) | 50S ribosomal protein L10 | 405688 | 406194 | - | | 15594736 | 1195228 |
| Complete genome (Accession number NC_001318) | 50S ribosomal protein L1 | 406181 | 406861 | - | | 15594737 | 1195229 |
| Complete genome (Accession number NC_001318) | 50S ribosomal protein L11 | 406861 | 407292 | - | | 15594738 | 1195230 |
| Complete genome (Accession number NC_001318) | transcription antitermination factor (nusG) | 407344 | 407898 | - | | 15594739 | 1195231 |
| Complete genome (Accession number NC_001318) | preprotein translocase subunit SecE | 407922 | 408092 | - | | 15594740 | 1195232 |
| Complete genome (Accession number NC_001318) | 50S ribosomal protein L33 | 408201 | 408380 | - | | 15594741 | 1195234 |

Fig. 27 continued

| | | | | | | | |
|---|---|---|---|---|---|---|---|
| Complete genome (Accession number NC_001318) | hypothetical protein BB0397 | 408554 | 409402 | - | | 15594742 | 1195235 |
| Complete genome (Accession number NC_001318) | hypothetical protein BB0398 | 409416 | 410447 | - | | 15594743 | 1195236 |
| Complete genome (Accession number NC_001318) | hypothetical protein BB0399 | 410787 | 411446 | + | | 15594744 | 1195237 |
| Complete genome (Accession number NC_001318) | hypothetical protein BB0400 | 411456 | 413006 | - | | 15594745 | 1195238 |
| Complete genome (Accession number NC_001318) | glutamate transporter, putative | 413113 | 414315 | + | | 15594746 | 1195239 |
| Complete genome (Accession number NC_001318) | prolyl-tRNA synthetase | 414327 | 415793 | - | | 15594747 | 1195240 |
| Complete genome (Accession number NC_001318) | hypothetical protein BB0403 | 415846 | 416523 | - | | 15594748 | 1195241 |
| Complete genome (Accession number NC_001318) | hypothetical protein BB0404 | 416689 | 417105 | + | | 15594749 | 1195242 |
| Complete genome (Accession number NC_001318) | hypothetical protein BB0405 | 417102 | 417713 | + | | 15594750 | 1195243 |
| Complete genome (Accession number NC_001318) | hypothetical protein BB0406 | 417724 | 418335 | + | | 15594751 | 1195244 |
| Complete genome (Accession number NC_001318) | mannose-6-phosphate isomerase (manA) | 418388 | 419506 | - | | 15594752 | 1195245 |

Fig. 27 continued

| | | | | | | | |
|---|---|---|---|---|---|---|---|
| Complete genome (Accession number NC_001318) | PTS system, fructose-specific IIABC component (fruA-1) | 419503 | 421360 | - | | 15594753 | 1195246 |
| Complete genome (Accession number NC_001318) | hypothetical protein BB0409 | 421554 | 422183 | + | | 15594754 | 1195247 |
| Complete genome (Accession number NC_001318) | hypothetical protein BB0410 | 422180 | 422299 | + | | 15594755 | 1195248 |
| Complete genome (Accession number NC_001318) | endonuclease precursor (nucA) | 422471 | 423058 | + | | 15594756 | 1195249 |
| Complete genome (Accession number NC_001318) | hypothetical protein BB0412 | 423055 | 423834 | + | | 15594757 | 1195250 |
| Complete genome (Accession number NC_001318) | hypothetical protein BB0413 | 423822 | 424445 | - | | 15594758 | 1195251 |
| Complete genome (Accession number NC_001318) | chemotaxis protein methyltransferase (cheR-2) | 424694 | 425551 | + | | 15594759 | 1195252 |
| Complete genome (Accession number NC_001318) | protein-glutamate methylesterase (cheB-1) | 425584 | 426711 | + | | 15594760 | 1195253 |
| Complete genome (Accession number NC_001318) | pheromone shutdown protein (traB) | 426736 | 427950 | + | | 15594761 | 1195254 |
| Complete genome (Accession number NC_001318) | adenylate kinase (adk) | 427987 | 428622 | + | | 15594762 | 1195255 |
| Complete genome (Accession number NC_001318) | hypothetical protein BB0418 | 428646 | 429674 | + | | 15594763 | 1195256 |

Fig. 27 continued

| | | | | | | | |
|---|---|---|---|---|---|---|---|
| Complete genome (Accession number NC_001318) | response regulatory protein (rrp-1) | 429693 | 430616 | - | | 15594764 | 1195257 |
| Complete genome (Accession number NC_001318) | sensory transduction histidine kinase, putative | 430619 | 435103 | - | | 15594765 | 1195258 |
| Complete genome (Accession number NC_001318) | hydrolase | 441713 | 442552 | - | | 15594766 | 1195263 |
| Complete genome (Accession number NC_001318) | 3-methyladenine DNA glycosylase (mag) | 442688 | 443248 | - | | 15594767 | 1195264 |
| Complete genome (Accession number NC_001318) | hypothetical protein BB0423 | 443763 | 444053 | - | | 15594768 | 1195266 |
| Complete genome (Accession number NC_001318) | hypothetical protein BB0424 | 444150 | 444299 | + | | 15594769 | 1195267 |
| Complete genome (Accession number NC_001318) | hypothetical protein BB0425 | 446113 | 446205 | - | | 15594770 | 1195270 |
| Complete genome (Accession number NC_001318) | hypothetical protein BB0426 | 446327 | 446890 | - | | 15594771 | 1195271 |
| Complete genome (Accession number NC_001318) | hypothetical protein BB0427 | 446969 | 447760 | - | | 15594772 | 1195272 |
| Complete genome (Accession number NC_001318) | hypothetical protein BB0428 | 447855 | 448172 | + | | 15594773 | 1195273 |
| Complete genome (Accession number NC_001318) | hypothetical protein BB0429 | 448202 | 448591 | - | | 15594774 | 1195274 |
| Complete genome (Accession number NC_001318) | proline dipeptidase (pepQ) | 448705 | 449310 | + | | 15594775 | 1195275 |

Fig. 27 continued

| Complete genome (Accession number NC_001318) | hypothetical protein BB0431 | 449419 | 450171 | + | | 15594776 | 1195276 |
|---|---|---|---|---|---|---|---|
| Complete genome (Accession number NC_001318) | hypothetical protein BB0432 | 450174 | 450887 | + | | 15594777 | 1195277 |
| Complete genome (Accession number NC_001318) | hypothetical protein BB0433 | 450972 | 451070 | - | | 15594778 | 1195278 |
| Complete genome (Accession number NC_001318) | stage 0 sporulation protein J (spo0J) | 451139 | 451921 | - | | 15594779 | 1195279 |
| Complete genome (Accession number NC_001318) | DNA gyrase, subunit A (gyrA) | 452040 | 454472 | - | | 15594780 | 1195280 |
| Complete genome (Accession number NC_001318) | DNA gyrase, subunit B (gyrB) | 454484 | 456403 | - | | 15594781 | 1195281 |
| Complete genome (Accession number NC_001318) | chromosomal replication initiator protein (dnaA) | 456576 | 458036 | + | | 15594782 | 1195282 |
| Complete genome (Accession number NC_001318) | DNA polymerase III, subunit beta (dnaN) | 458277 | 459434 | + | | 15594783 | 1195283 |
| Complete genome (Accession number NC_001318) | hypothetical protein BB0439 | 459525 | 459824 | + | | 15594784 | 1195284 |
| Complete genome (Accession number NC_001318) | 50S ribosomal protein L34 | 459916 | 460071 | + | | 15594785 | 1195285 |
| Complete genome (Accession number NC_001318) | ribonuclease P protein component (rnpA) | 460052 | 460411 | + | | 15594786 | 1195286 |

Fig. 27 continued

| | | | | | | | |
|---|---|---|---|---|---|---|---|
| Complete genome (Accession number NC_001318) | putative inner membrane protein translocase component YidC | 460398 | 462032 | + | | 15594787 | 1195287 |
| Complete genome (Accession number NC_001318) | spoIIIJ-associated protein (jag) | 462045 | 462773 | + | | 15594788 | 1195288 |
| Complete genome (Accession number NC_001318) | nucleotide sugar epimerase | 462819 | 463686 | + | | 15594789 | 1195289 |
| Complete genome (Accession number NC_001318) | fructose-bisphosphate aldolase | 464053 | 465132 | + | | 15594790 | 1195290 |
| Complete genome (Accession number NC_001318) | aspartyl-tRNA synthetase | 465518 | 467278 | - | | 1.62E+08 | 1195291 |
| Complete genome (Accession number NC_001318) | Na+/H+ antiporter (napA) | 467282 | 469387 | - | | 15594792 | 1195292 |
| Complete genome (Accession number NC_001318) | phosphocarrier protein HPr (ptsH-1) | 469390 | 469665 | - | | 15594793 | 1195293 |
| Complete genome (Accession number NC_001318) | hypothetical protein BB0449 | 469678 | 469971 | - | | 15594794 | 1195294 |
| Complete genome (Accession number NC_001318) | RNA polymerase sigma-54 factor (ntrA) | 469961 | 471220 | - | | 15594795 | 1195295 |
| Complete genome (Accession number NC_001318) | chromate transport protein, putative | 471223 | 471756 | - | | 15594796 | 1195296 |
| Complete genome (Accession number NC_001318) | hypothetical protein BB0452 | 471771 | 472475 | - | | 15594797 | 1195297 |

Fig. 27 continued

| | | | | | | | |
|---|---|---|---|---|---|---|---|
| Complete genome (Accession number NC_001318) | hypothetical protein BB0453 | 472566 | 473408 | + | | 15594798 | 1195298 |
| Complete genome (Accession number NC_001318) | lipopolysaccharide biosynthesis-related protein | 473405 | 474556 | - | | 15594799 | 1195299 |
| Complete genome (Accession number NC_001318) | hypothetical protein BB0455 | 474613 | 475602 | + | | 15594800 | 1195300 |
| Complete genome (Accession number NC_001318) | hypothetical protein BB0456 | 475606 | 476211 | + | | 15594801 | 1195301 |
| Complete genome (Accession number NC_001318) | excinuclease ABC, subunit C (uvrC) | 476263 | 478074 | - | | 15594802 | 1195302 |
| Complete genome (Accession number NC_001318) | hypothetical protein BB0458 | 478139 | 479716 | + | | 15594803 | 1195303 |
| Complete genome (Accession number NC_001318) | hypothetical protein BB0459 | 479709 | 481019 | + | | 15594804 | 1195304 |
| Complete genome (Accession number NC_001318) | hypothetical protein BB0460 | 481344 | 482057 | - | | 15594805 | 1195305 |
| Complete genome (Accession number NC_001318) | DNA polymerase III subunits gamma and tau | 482600 | 484282 | + | | 15594806 | 1195307 |
| Complete genome (Accession number NC_001318) | hypothetical protein BB0462 | 484254 | 484586 | + | | 15594807 | 1195308 |
| Complete genome (Accession number NC_001318) | nucleoside-diphosphate kinase (ndk) | 484757 | 485266 | + | | 15594808 | 1195309 |

Fig. 27 continued

| | | | | | | | |
|---|---|---|---|---|---|---|---|
| Complete genome (Accession number NC_001318) | hypothetical protein BB0464 | 485550 | 486077 | + | | 15594809 | 1195310 |
| Complete genome (Accession number NC_001318) | hypothetical protein BB0465 | 486074 | 486769 | + | | 15594810 | 1195311 |
| Complete genome (Accession number NC_001318) | ABC transporter, ATP-binding protein | 486705 | 487538 | + | | 15594811 | 1195312 |
| Complete genome (Accession number NC_001318) | hypothetical protein BB0467 | 487535 | 488224 | + | | 15594812 | 1195313 |
| Complete genome (Accession number NC_001318) | hypothetical protein BB0468 | 488226 | 488972 | + | | 15594813 | 1195314 |
| Complete genome (Accession number NC_001318) | signal peptidase II | 488983 | 489495 | + | | 15594814 | 1195315 |
| Complete genome (Accession number NC_001318) | hypothetical protein BB0470 | 489492 | 489719 | + | | 15594815 | 1195316 |
| Complete genome (Accession number NC_001318) | hypothetical protein BB0471 | 489733 | 490554 | + | | 15594816 | 1195317 |
| Complete genome (Accession number NC_001318) | UDP-N-acetylglucosamine 1-carboxyvinyltransferase | 490599 | 491927 | + | | 15594817 | 1195318 |
| Complete genome (Accession number NC_001318) | hypothetical protein BB0473 | 492588 | 493952 | + | | 15594818 | 1195319 |
| Complete genome (Accession number NC_001318) | hypothetical protein BB0474 | 493991 | 494092 | + | | 15594819 | 1195320 |

Fig. 27 continued

| Complete genome (Accession number NC_001318) | hypothetical protein BB0475 | 494150 | 494542 | - | | 15594820 | 1195321 |
|---|---|---|---|---|---|---|---|
| Complete genome (Accession number NC_001318) | elongation factor Tu | 495033 | 496217 | + | | 1.62E+08 | 1195322 |
| Complete genome (Accession number NC_001318) | 30S ribosomal protein S10 | 496268 | 496579 | + | | 15594822 | 1195323 |
| Complete genome (Accession number NC_001318) | 50S ribosomal protein L3 | 496615 | 497235 | + | | 15594823 | 1195324 |
| Complete genome (Accession number NC_001318) | 50S ribosomal protein L4 | 497245 | 497874 | + | | 15594824 | 1195325 |
| Complete genome (Accession number NC_001318) | 50S ribosomal protein L23 | 497880 | 498191 | + | | 15594825 | 1195326 |
| Complete genome (Accession number NC_001318) | 50S ribosomal protein L2 | 498213 | 499046 | + | | 15594826 | 1195327 |
| Complete genome (Accession number NC_001318) | 30S ribosomal protein S19 | 499056 | 499334 | + | | 15594827 | 1195328 |
| Complete genome (Accession number NC_001318) | 50S ribosomal protein L22 | 499341 | 499703 | + | | 15594828 | 1195329 |
| Complete genome (Accession number NC_001318) | 30S ribosomal protein S3 | 499707 | 500568 | + | | 15594829 | 1195330 |
| Complete genome (Accession number NC_001318) | 50S ribosomal protein L16 | 500593 | 501009 | + | | 15594830 | 1195331 |
| Complete genome (Accession number NC_001318) | 50S ribosomal protein L29 | 501012 | 501212 | + | | 15594831 | 1195332 |
| Complete genome (Accession number NC_001318) | 30S ribosomal protein S17 | 501215 | 501469 | + | | 15594832 | 1195333 |

Fig. 27 continued

| | | | | | | | |
|---|---|---|---|---|---|---|---|
| Complete genome (Accession number NC_001318) | 50S ribosomal protein L14 | 501497 | 501865 | + | | 1.62E+08 | 1195334 |
| Complete genome (Accession number NC_001318) | 50S ribosomal protein L24 | 501880 | 502185 | + | | 15594834 | 1195335 |
| Complete genome (Accession number NC_001318) | 50S ribosomal protein L5 | 502191 | 502739 | + | | 15594835 | 1195336 |
| Complete genome (Accession number NC_001318) | 30S ribosomal protein S14 | 502756 | 502941 | + | | 1.62E+08 | 1195337 |
| Complete genome (Accession number NC_001318) | 30S ribosomal protein S8 | 502951 | 503349 | + | | 15594837 | 1195338 |
| Complete genome (Accession number NC_001318) | 50S ribosomal protein L6 | 503366 | 503908 | + | | 15594838 | 1195339 |
| Complete genome (Accession number NC_001318) | 50S ribosomal protein L18 | 503926 | 504285 | + | | 15594839 | 1195340 |
| Complete genome (Accession number NC_001318) | 30S ribosomal protein S5 | 504298 | 504795 | + | | 15594840 | 1195341 |
| Complete genome (Accession number NC_001318) | ribosomal protein L30 (rpmD) | 504799 | 505104 | + | | 15594841 | 1195342 |
| Complete genome (Accession number NC_001318) | 50S ribosomal protein L15 | 505104 | 505541 | + | | 15594842 | 1195343 |
| Complete genome (Accession number NC_001318) | preprotein translocase subunit SecY | 505554 | 506858 | + | | 15594843 | 1195344 |
| Complete genome (Accession number NC_001318) | 50S ribosomal protein L36 | 506865 | 506984 | + | | 15594844 | 1195345 |

Fig. 27 continued

| | | | | | | | |
|---|---|---|---|---|---|---|---|
| Complete genome (Accession number NC_001318) | 30S ribosomal protein S13 | 507002 | 507379 | + | | 15594845 | 1195346 |
| Complete genome (Accession number NC_001318) | 30S ribosomal protein S11 | 507394 | 507798 | + | | 15594846 | 1195347 |
| Complete genome (Accession number NC_001318) | DNA-directed RNA polymerase subunit alpha | 507811 | 508848 | + | | 15594847 | 1195348 |
| Complete genome (Accession number NC_001318) | 50S ribosomal protein L17 | 508870 | 509241 | + | | 15594848 | 1195349 |
| Complete genome (Accession number NC_001318) | hypothetical protein BB0504 | 509314 | 510846 | + | | 15594849 | 1195350 |
| Complete genome (Accession number NC_001318) | hypothetical protein BB0505 | 510836 | 511624 | + | | 15594850 | 1195351 |
| Complete genome (Accession number NC_001318) | hemolysin (tlyA) | 511605 | 512396 | + | | 15594851 | 1195352 |
| Complete genome (Accession number NC_001318) | hypothetical protein BB0507 | 512393 | 513148 | − | | 15594852 | 1195353 |
| Complete genome (Accession number NC_001318) | GTP-binding protein EngA | 513226 | 514527 | + | | 15594853 | 1195354 |
| Complete genome (Accession number NC_001318) | hypothetical protein BB0509 | 514524 | 515783 | + | | 15594854 | 1195355 |
| Complete genome (Accession number NC_001318) | hypothetical protein BB0510 | 515780 | 515998 | + | | 15594855 | 1195356 |
| Complete genome (Accession number NC_001318) | hypothetical protein BB0511 | 516090 | 516473 | + | | 15594856 | 1195357 |

Fig. 27 continued

| Complete genome (Accession number NC_001318) | hypothetical protein BB0512 | 516493 | 522993 | + | | 15594857 | 1195358 |
| --- | --- | --- | --- | --- | --- | --- | --- |
| Complete genome (Accession number NC_001318) | phenylalanyl-tRNA synthetase subunit alpha | 522990 | 524576 | + | | 15594858 | 1195359 |
| Complete genome (Accession number NC_001318) | phenylalanyl-tRNA synthetase subunit beta | 524554 | 526254 | + | | 15594859 | 1195360 |
| Complete genome (Accession number NC_001318) | thioredoxin reductase (trxB) | 526325 | 527305 | + | | 15594860 | 1195361 |
| Complete genome (Accession number NC_001318) | rRNA methylase (yacO) | 527361 | 528047 | - | | 15594861 | 1195362 |
| Complete genome (Accession number NC_001318) | heat shock protein (dnaJ-1) | 528104 | 529198 | - | | 15594862 | 1195363 |
| Complete genome (Accession number NC_001318) | molecular chaperone DnaK | 529198 | 531105 | - | | 15594863 | 1195364 |
| Complete genome (Accession number NC_001318) | grpE protein (grpE) | 531129 | 531692 | - | | 15594864 | 1195365 |
| Complete genome (Accession number NC_001318) | hypothetical protein BB0520 | 531851 | 531967 | - | | 15594865 | 1195366 |
| Complete genome (Accession number NC_001318) | hypothetical protein BB0521 | 532069 | 532521 | + | | 15594866 | 1195367 |
| Complete genome (Accession number NC_001318) | NH(3)-dependent NAD+ synthetase | 532938 | 533606 | + | | 15594867 | 1195368 |
| Complete genome (Accession number NC_001318) | hypothetical protein BB0523 | 523980 | 534072 | + | | 15594868 | 1195369 |

Fig. 27 continued

| | | | | | | | |
|---|---|---|---|---|---|---|---|
| Complete genome (Accession number NC_001318) | inositol monophosphatase | 534301 | 535155 | + | | 15594869 | 1195370 |
| Complete genome (Accession number NC_001318) | hypothetical protein BB0525 | 535178 | 535600 | -- | | 15594870 | 1195371 |
| Complete genome (Accession number NC_001318) | hypothetical protein BB0526 | 535704 | 537527 | + | | 15594871 | 1195372 |
| Complete genome (Accession number NC_001318) | pantothenate kinase | 537520 | 538308 | + | | 15594872 | 1195373 |
| Complete genome (Accession number NC_001318) | aldose reductase, putative | 538328 | 539275 | - | | 15594873 | 1195374 |
| Complete genome (Accession number NC_001318) | hypothetical protein BB0529 | 539256 | 539372 | + | | 15594874 | 1195375 |
| Complete genome (Accession number NC_001318) | hypothetical protein BB0530 | 539367 | 540020 | -- | | 15594875 | 1195376 |
| Complete genome (Accession number NC_001318) | hypothetical protein BB0531 | 540159 | 540773 | -- | | 15594876 | 1195377 |
| Complete genome (Accession number NC_001318) | hypothetical protein BB0532 | 541182 | 542069 | -- | | 15594877 | 1195378 |
| Complete genome (Accession number NC_001318) | phnP protein (phnP) | 542263 | 543024 | + | | 15594878 | 1195379 |
| Complete genome (Accession number NC_001318) | exodeoxyribonuclease III (exoA) | 543049 | 543816 | + | | 15594879 | 1195380 |
| Complete genome (Accession number NC_001318) | hypothetical protein BB0535 | 543832 | 544605 | + | | 15594880 | 1195381 |
| Complete genome (Accession number NC_001318) | zinc protease, putative | 544586 | 547387 | + | | 15594881 | 1195382 |

Fig. 27 continued

| | | | | | | | |
|---|---|---|---|---|---|---|---|
| Complete genome (Accession number NC_001318) | hypothetical protein BB0537 | 547846 | 548490 | - | | 15594882 | 1195384 |
| Complete genome (Accession number NC_001318) | hypothetical protein BB0538 | 548487 | 548865 | - | | 15594883 | 1195385 |
| Complete genome (Accession number NC_001318) | hypothetical protein BB0539 | 548920 | 549618 | - | | 15594884 | 1195386 |
| Complete genome (Accession number NC_001318) | elongation factor G | 549642 | 551723 | - | | 15594885 | 1195387 |
| Complete genome (Accession number NC_001318) | hypothetical protein BB0541 | 552007 | 552225 | + | | 15594886 | 1195388 |
| Complete genome (Accession number NC_001318) | hypothetical protein BB0542 | 552440 | 553018 | + | | 15594887 | 1195389 |
| Complete genome (Accession number NC_001318) | hypothetical protein BB0543 | 553133 | 553789 | + | | 15594888 | 1195390 |
| Complete genome (Accession number NC_001318) | phosphoribosylpyrophosphate synthetase | 553992 | 555212 | + | | 15594889 | 1195391 |
| Complete genome (Accession number NC_001318) | xylulokinase (xylB) | 555216 | 556560 | + | | 15594890 | 1195392 |
| Complete genome (Accession number NC_001318) | hypothetical protein BB0546 | 556563 | 557423 | - | | 15594891 | 1195393 |
| Complete genome (Accession number NC_001318) | dephospho-CoA kinase | 557407 | 558024 | - | | 15594892 | 1195394 |
| Complete genome (Accession number NC_001318) | DNA polymerase I (polA) | 558006 | 560732 | - | | 15594893 | 1195395 |
| Complete genome (Accession number NC_001318) | hypothetical protein BB0549 | 560729 | 561127 | - | | 15594894 | 1195396 |

Fig. 27 continued

| | | | | | | | |
|---|---|---|---|---|---|---|---|
| Complete genome (Accession number NC_001318) | flagellar protein (flaJ) | 561117 | 561554 | - | | 15594895 | 1195397 |
| Complete genome (Accession number NC_001318) | chemotaxis response regulator (cheY-1) | 561563 | 561964 | - | | 15594896 | 1195398 |
| Complete genome (Accession number NC_001318) | DNA ligase (lig) | 562185 | 564167 | + | | 15594897 | 1195399 |
| Complete genome (Accession number NC_001318) | hypothetical protein BB0553 | 564188 | 565681 | - | | 15594898 | 1195400 |
| Complete genome (Accession number NC_001318) | hypothetical protein BB0554 | 565943 | 567823 | + | | 15594899 | 1195401 |
| Complete genome (Accession number NC_001318) | hypothetical protein BB0555 | 567810 | 568277 | + | | 15594900 | 1195402 |
| Complete genome (Accession number NC_001318) | hypothetical protein BB0556 | 568270 | 569139 | + | | 15594901 | 1195403 |
| Complete genome (Accession number NC_001318) | phosphocarrier protein HPr (ptsH-2) | 569278 | 569638 | + | | 15594902 | 1195404 |
| Complete genome (Accession number NC_001318) | phosphoenolpyruvate-protein phosphatase (ptsI) | 569559 | 571280 | + | | 15594903 | 1195405 |
| Complete genome (Accession number NC_001318) | glucose-specific PTS system component | 571283 | 571852 | + | | 15594904 | 1195406 |
| Complete genome (Accession number NC_001318) | heat shock protein 90 | 571890 | 573842 | - | | 15594905 | 1195407 |

Fig. 27 continued

| | | | | | | | |
|---|---|---|---|---|---|---|---|
| Complete genome (Accession number NC_001318) | 6-phosphogluconate dehydrogenase | 573853 | 575247 | + | | 15594906 | 1195408 |
| Complete genome (Accession number NC_001318) | hypothetical protein BB0562 | 575274 | 575816 | - | | 15594907 | 1195409 |
| Complete genome (Accession number NC_001318) | hypothetical protein BB0563 | 575981 | 576526 | - | | 15594908 | 1195410 |
| Complete genome (Accession number NC_001318) | hypothetical protein BB0564 | 576582 | 577187 | - | | 15594909 | 1195411 |
| Complete genome (Accession number NC_001318) | purine-binding chemotaxis protein (cheW-2) | 577395 | 577937 | + | | 15594910 | 1195412 |
| Complete genome (Accession number NC_001318) | hypothetical protein BB0566 | 577950 | 578261 | + | | 15594911 | 1195413 |
| Complete genome (Accession number NC_001318) | chemotaxis histidine kinase (cheA-1) | 578277 | 580421 | + | | 15594912 | 1195414 |
| Complete genome (Accession number NC_001318) | protein-glutamate methylesterase (cheB-2) | 580486 | 581643 | + | | 15594913 | 1195415 |
| Complete genome (Accession number NC_001318) | hypothetical protein BB0569 | 581645 | 583417 | + | | 15594914 | 1195416 |
| Complete genome (Accession number NC_001318) | chemotaxis response regulator (cheY-2) | 583458 | 583832 | + | | 15594915 | 1195417 |
| Complete genome (Accession number NC_001318) | uridylate kinase | 584191 | 584880 | - | | 15594916 | 1195418 |
| Complete genome (Accession number NC_001318) | glycosyl transferase (lgtD) | 585080 | 586156 | + | | 15594917 | 1195419 |

Fig. 27 continued

| | | | | | | | |
|---|---|---|---|---|---|---|---|
| Complete genome (Accession number NC_001318) | ABC transporter, ATP-binding protein | 586212 | 587024 | + | | 15594918 | 1195420 |
| Complete genome (Accession number NC_001318) | hypothetical protein BB0574 | 587031 | 587882 | + | | 15594919 | 1195421 |
| Complete genome (Accession number NC_001318) | CTP synthetase | 588066 | 589667 | + | | 15594920 | 1195422 |
| Complete genome (Accession number NC_001318) | hypothetical protein BB0576 | 589684 | 590232 | - | | 15594921 | 1195423 |
| Complete genome (Accession number NC_001318) | hypothetical protein BB0577 | 590348 | 590935 | + | | 15594922 | 1195424 |
| Complete genome (Accession number NC_001318) | methyl-accepting chemotaxis protein (mcp-1) | 591188 | 592357 | + | | 15594923 | 1195425 |
| Complete genome (Accession number NC_001318) | DNA polymerase III subunit alpha | 592446 | 595931 | + | | 15594924 | 1195426 |
| Complete genome (Accession number NC_001318) | hypothetical protein BB0580 | 595943 | 596521 | + | | 15594925 | 1195427 |
| Complete genome (Accession number NC_001318) | DNA recombinase (recG) | 596531 | 598591 | + | | 15594926 | 1195428 |
| Complete genome (Accession number NC_001318) | carboxypeptidase, putative | 598588 | 599376 | - | | 15594927 | 1195429 |
| Complete genome (Accession number NC_001318) | hypothetical protein BB0583 | 599495 | 600844 | + | | 15594928 | 1195430 |
| Complete genome (Accession number NC_001318) | hypothetical protein BB0584 | 600998 | 602344 | + | | 15594929 | 1195431 |

Fig. 27 continued

| | | | | | | | |
|---|---|---|---|---|---|---|---|
| Complete genome (Accession number NC_001318) | UDP-N-acetylmuramoylalanine--D-glutamate ligase (murD) | 602374 | 603729 | + | | 15594930 | 1195432 |
| Complete genome (Accession number NC_001318) | femA protein (femA) | 603726 | 604769 | - | | 15594931 | 1195433 |
| Complete genome (Accession number NC_001318) | methionyl-tRNA synthetase | 604779 | 606983 | - | | 15594932 | 1195434 |
| Complete genome (Accession number NC_001318) | pfs protein (pfs-2) | 607138 | 607935 | + | | 15594933 | 1195435 |
| Complete genome (Accession number NC_001318) | phosphate acetyltransferase (pta) | 608020 | 609078 | + | | 15594934 | 1195436 |
| Complete genome (Accession number NC_001318) | dimethyladenosine transferase | 608061 | 609906 | - | | 15594935 | 1195437 |
| Complete genome (Accession number NC_001318) | competence locus E, putative | 609943 | 611193 | - | | 15594936 | 1195438 |
| Complete genome (Accession number NC_001318) | hypothetical protein BB0592 | 611309 | 612022 | + | | 15594937 | 1195439 |
| Complete genome (Accession number NC_001318) | long-chain-fatty-acid CoA ligase | 612048 | 613985 | + | | 15594938 | 1195440 |
| Complete genome (Accession number NC_001318) | arginyl-tRNA synthetase | 614014 | 615789 | - | | 15594939 | 1195441 |
| Complete genome (Accession number NC_001318) | hypothetical protein BB0595 | 615764 | 616390 | - | | 15594940 | 1195442 |

Fig. 27 continued

| Complete genome (Accession number NC_001318) | methyl-accepting chemotaxis protein (mcp-2) | 616412 | 618559 | - | | 15594941 | 1195443 |
| --- | --- | --- | --- | --- | --- | --- | --- |
| Complete genome (Accession number NC_001318) | methyl-accepting chemotaxis protein (mcp-3) | 618828 | 621035 | + | | 15594942 | 1195444 |
| Complete genome (Accession number NC_001318) | UDP-N-acetylmuramate dehydrogenase (murB) | 621045 | 621953 | - | | 15594943 | 1195445 |
| Complete genome (Accession number NC_001318) | cysteinyl-tRNA synthetase (cysS) | 622005 | 623447 | + | | 15594944 | 1195446 |
| Complete genome (Accession number NC_001318) | hypothetical protein BB0600 | 623451 | 625007 | + | | 15594945 | 1195447 |
| Complete genome (Accession number NC_001318) | serine hydroxymethyltransferase (glyA) | 625007 | 626260 | + | | 15594946 | 1195448 |
| Complete genome (Accession number NC_001318) | chaperonin, putative | 626286 | 627038 | + | | 15594947 | 1195449 |
| Complete genome (Accession number NC_001318) | membrane-associated protein p66 | 627092 | 628948 | - | | 15594948 | 1195450 |
| Complete genome (Accession number NC_001318) | L-lactate permease (lctP) | 629196 | 630698 | - | | 15594949 | 1195451 |
| Complete genome (Accession number NC_001318) | serine-type D-Ala-D-Ala carboxypeptidase (dacA) | 630769 | 631986 | + | | 15594950 | 1195452 |
| Complete genome (Accession number NC_001318) | hypothetical protein BB0606 | 631991 | 632482 | + | | 15594951 | 1195453 |

Fig. 27 continued

| Complete genome (Accession number NC_001318) | rep helicase, single-stranded DNA-dependent ATPase (rep) | 632485 | 634464 | + | | 15594952 | 1195454 |
| --- | --- | --- | --- | --- | --- | --- | --- |
| Complete genome (Accession number NC_001318) | aminoacyl-histidine dipeptidase (pepD) | 634581 | 636011 | + | | 15594953 | 1195455 |
| Complete genome (Accession number NC_001318) | hypothetical protein BB0609 | 636024 | 636134 | – | | 15594954 | 1195456 |
| Complete genome (Accession number NC_001318) | trigger factor | 636593 | 637957 | + | | 15594955 | 1195459 |
| Complete genome (Accession number NC_001318) | ATP-dependent Clp protease proteolytic component (clpP-1) | 637963 | 638556 | + | | 15594956 | 1195460 |
| Complete genome (Accession number NC_001318) | ATP-dependent protease ATP-binding subunit | 638580 | 639872 | + | | 15594957 | 1195461 |
| Complete genome (Accession number NC_001318) | ATP-dependent protease LA (lon-2) | 639808 | 642249 | + | | 15594958 | 1195462 |
| Complete genome (Accession number NC_001318) | hypothetical protein BB0614 | 642289 | 642441 | + | | 15594959 | 1195463 |
| Complete genome (Accession number NC_001318) | 30S ribosomal protein S4 | 642500 | 643129 | – | | 15594960 | 1195464 |

Fig. 27 continued

| | | | | | | | |
|---|---|---|---|---|---|---|---|
| Complete genome (Accession number NC_001318) | hypothetical protein BB0616 | 643295 | 644650 | - | | 15594961 | 1195465 |
| Complete genome (Accession number NC_001318) | hypothetical protein BB0617 | 644772 | 645140 | + | | 15594962 | 1195466 |
| Complete genome (Accession number NC_001318) | cytidine deaminase (cdd) | 645137 | 645601 | - | | 15594963 | 1195467 |
| Complete genome (Accession number NC_001318) | hypothetical protein BB0619 | 645689 | 646681 | + | | 15594964 | 1195468 |
| Complete genome (Accession number NC_001318) | beta-glucosidase, putative | 646659 | 648326 | - | | 15594965 | 1195469 |
| Complete genome (Accession number NC_001318) | 4-methyl-5(b-hydroxyethyl)-thiazole monophosphate biosynthesis protein (thiJ) | 648553 | 649107 | + | | 15594966 | 1195471 |
| Complete genome (Accession number NC_001318) | acetate kinase (ackA) | 649170 | 650411 | - | | 15594967 | 1195472 |
| Complete genome (Accession number NC_001318) | transcription-repair coupling factor (mfd) | 650413 | 653790 | - | | 15594968 | 1195473 |
| Complete genome (Accession number NC_001318) | hypothetical protein BB0624 | 653887 | 654849 | + | | 15594969 | 1195474 |
| Complete genome (Accession number NC_001318) | N-acetylmuramoyl-L-alanine amidase, putative | 654809 | 656902 | + | | 15594970 | 1195475 |

Fig. 27 continued

| Complete genome (Accession number NC_001318) | hypothetical protein BB0626 | 656998 | 657543 | - | | 15594971 | 1195477 |
|---|---|---|---|---|---|---|---|
| Complete genome (Accession number NC_001318) | putative aminopeptidase 2 | 657546 | 658817 | - | | 15594972 | 1195478 |
| Complete genome (Accession number NC_001318) | hypothetical protein BB0628 | 658898 | 659623 | + | | 15594973 | 1195479 |
| Complete genome (Accession number NC_001318) | PTS system, fructose-specific IIABC component (fruA-2) | 659644 | 661524 | - | | 15594974 | 1195480 |
| Complete genome (Accession number NC_001318) | 1-phosphofructokinase (fruK) | 661506 | 662529 | + | | 15594975 | 1195481 |
| Complete genome (Accession number NC_001318) | hypothetical protein BB0631 | 662603 | 662917 | - | | 15594976 | 1195482 |
| Complete genome (Accession number NC_001318) | exodeoxyribonuclease V, alpha chain (recD) | 663179 | 665011 | - | | 15594977 | 1195484 |
| Complete genome (Accession number NC_001318) | exodeoxyribonuclease V, beta chain (recB) | 665008 | 668517 | - | | 15594978 | 1195485 |
| Complete genome (Accession number NC_001318) | exodeoxyribonuclease V, gamma chain (recC) | 668848 | 671763 | - | | 15594979 | 1195486 |
| Complete genome (Accession number NC_001318) | nicotinate phosphoribosyltransferase | 671767 | 673212 | - | | 15594980 | 1195487 |

Fig. 27 continued

| Complete genome (Accession number NC_001318) | glucose-6-phosphate 1-dehydrogenase | 673342 | 674778 | + | | 15594981 | 1195488 |
| Complete genome (Accession number NC_001318) | Na+/H+ antiporter (nhaC-1) | 675029 | 676378 | + | | 15594982 | 1195489 |
| Complete genome (Accession number NC_001318) | Na+/H+ antiporter (nhaC-2) | 676472 | 677860 | + | | 15594983 | 1195490 |
| Complete genome (Accession number NC_001318) | spermidine/putrescine ABC transporter, spermidine/putrescine-binding periplasmic protein (potD) | 677892 | 678938 | - | | 15594984 | 1195491 |
| Complete genome (Accession number NC_001318) | spermidine/putrescine ABC transporter, permease protein (potC) | 678959 | 679750 | - | | 15594985 | 1195492 |
| Complete genome (Accession number NC_001318) | spermidine/putrescine ABC transporter, permease protein (potB) | 679754 | 680563 | - | | 15594986 | 1195493 |
| Complete genome (Accession number NC_001318) | spermidine/putrescine ABC transporter, ATP-binding protein (potA) | 680563 | 681606 | - | | 15594987 | 1195494 |
| Complete genome (Accession number NC_001318) | ribosomal biogenesis GTPase | 681685 | 682524 | - | | 15594988 | 1195495 |

Fig. 27 continued

| | | | | | | | |
|---|---|---|---|---|---|---|---|
| Complete genome (Accession number NC_001318) | N-acetylmannosamine-6-phosphate 2-epimerase | 682679 | 683377 | + | | 15594989 | 1195496 |
| Complete genome (Accession number NC_001318) | PTS system, glucose-specific IIBC component (ptsG) | 683423 | 684967 | + | | 15594990 | 1195497 |
| Complete genome (Accession number NC_001318) | hypothetical protein BB0646 | 684997 | 685980 | - | | 15594991 | 1195498 |
| Complete genome (Accession number NC_001318) | ferric uptake regulation protein (fur) | 685977 | 686507 | - | | 15594992 | 1195499 |
| Complete genome (Accession number NC_001318) | serine/threonine kinase, putative | 686607 | 688295 | - | | 15594993 | 1195500 |
| Complete genome (Accession number NC_001318) | chaperonin GroEL | 688490 | 690127 | + | | 15594994 | 1195501 |
| Complete genome (Accession number NC_001318) | hypothetical protein BB0650 | 690151 | 690489 | + | | 15594995 | 1195502 |
| Complete genome (Accession number NC_001318) | hypothetical protein BB0651 | 690482 | 690799 | + | | 15594996 | 1195503 |
| Complete genome (Accession number NC_001318) | preprotein translocase subunit SecD | 690885 | 692645 | + | | 15594997 | 1195504 |
| Complete genome (Accession number NC_001318) | preprotein translocase subunit SecF | 692629 | 693528 | + | | 15594998 | 1195505 |

Fig. 27 continued

| | | | | | | | |
|---|---|---|---|---|---|---|---|
| Complete genome (Accession number NC_001318) | hypothetical protein BB0654 | 693554 | 694696 | + | | 15594999 | 1195506 |
| Complete genome (Accession number NC_001318) | heat shock protein (dnaJ-2) | 694693 | 695523 | - | | 15595000 | 1195507 |
| Complete genome (Accession number NC_001318) | oxygen-independent coproporphyrinogen III oxidase, putative | 695631 | 696764 | + | | 15595001 | 1195508 |
| Complete genome (Accession number NC_001318) | ribose 5-phosphate isomerase (rpi) | 696751 | 697437 | - | | 15595002 | 1195509 |
| Complete genome (Accession number NC_001318) | phosphoglycerate mutase (gpmA) | 697571 | 698332 | + | | 15595003 | 1195510 |
| Complete genome (Accession number NC_001318) | lysyl-tRNA synthetase | 698400 | 699965 | - | | 15595004 | 1195511 |
| Complete genome (Accession number NC_001318) | GTP-binding protein Era | 700052 | 700924 | - | | 15595005 | 1195512 |
| Complete genome (Accession number NC_001318) | hypothetical protein BB0661 | 701014 | 701385 | + | | 15595006 | 1195513 |
| Complete genome (Accession number NC_001318) | hypothetical protein BB0662 | 701395 | 701805 | + | | 15595007 | 1195514 |
| Complete genome (Accession number NC_001318) | hypothetical protein BB0663 | 701825 | 702274 | + | | 15595008 | 1195515 |
| Complete genome (Accession number NC_001318) | hypothetical protein BB0664 | 702283 | 702966 | - | | 15595009 | 1195516 |

Fig. 27 continued

| Complete genome (Accession number NC_001318) | hypothetical protein BB0665 | 703009 | 703968 | + | | 15595010 | 1195517 |
| --- | --- | --- | --- | --- | --- | --- | --- |
| Complete genome (Accession number NC_001318) | hypothetical protein BB0666 | 703931 | 704959 | + | | 15595011 | 1195518 |
| Complete genome (Accession number NC_001318) | hypothetical protein BB0667 | 704949 | 705500 | + | | 15595012 | 1195519 |
| Complete genome (Accession number NC_001318) | flagellar filament outer layer protein (flaA) | 705571 | 706605 | + | | 15595013 | 1195520 |
| Complete genome (Accession number NC_001318) | chemotaxis histidine kinase (cheA-2) | 706673 | 709267 | + | | 15595014 | 1195521 |
| Complete genome (Accession number NC_001318) | purine-binding chemotaxis protein (cheW-3) | 709274 | 710674 | + | | 15595015 | 1195522 |
| Complete genome (Accession number NC_001318) | chemotaxis operon protein (cheX) | 710686 | 711171 | + | | 15595016 | 1195523 |
| Complete genome (Accession number NC_001318) | chemotaxis response regulator (cheY-3) | 711211 | 711651 | + | | 15595017 | 1195524 |
| Complete genome (Accession number NC_001318) | hypothetical protein BB0673 | 711692 | 712207 | - | | 15595018 | 1195525 |
| Complete genome (Accession number NC_001318) | hypothetical protein BB0674 | 712204 | 713250 | - | | 15595019 | 1195526 |
| Complete genome (Accession number NC_001318) | hypothetical protein BB0675 | 713244 | 714107 | - | | 15595020 | 1195527 |

Fig. 27 continued

| Complete genome (Accession number NC_001318) | phosphoglycolate phosphatase (gph) | 714104 | 714766 | - | | 15595021 | 1195528 |
| --- | --- | --- | --- | --- | --- | --- | --- |
| Complete genome (Accession number NC_001318) | ribose/galactose ABC transporter, ATP-binding protein (mglA) | 715009 | 716619 | + | | 15595022 | 1195529 |
| Complete genome (Accession number NC_001318) | ribose/galactose ABC transporter, permease protein (rbsC-1) | 716620 | 717771 | + | | 15595023 | 1195530 |
| Complete genome (Accession number NC_001318) | ribose/galactose ABC transporter, permease protein (rbsC-2) | 717734 | 718669 | + | | 15595024 | 1195531 |
| Complete genome (Accession number NC_001318) | methyl-accepting chemotaxis protein (mcp-4) | 718827 | 721088 | + | | 15595025 | 1195532 |
| Complete genome (Accession number NC_001318) | methyl-accepting chemotaxis protein (mcp-5) | 721110 | 723020 | + | | 15595026 | 1195533 |
| Complete genome (Accession number NC_001318) | tRNA (5-methylaminomethyl-2-thiouridylate)-methyltransferase | 723063 | 724130 | - | | 15595027 | 1195534 |
| Complete genome (Accession number NC_001318) | 3-hydroxy-3-methylglutaryl-CoA synthase | 724224 | 725447 | + | | 15595028 | 1195535 |

Fig. 27 continued

| | | | | | | | |
|---|---|---|---|---|---|---|---|
| Complete genome (Accession number NC_001318) | isopentenyl pyrophosphate isomerase | 725413 | 726495 | + | | 15595029 | 1195536 |
| Complete genome (Accession number NC_001318) | 3-hydroxy-3-methylglutaryl-CoA reductase (mvaA) | 726458 | 727753 | + | | 15595030 | 1195537 |
| Complete genome (Accession number NC_001318) | mevalonate pyrophosphate decarboxylase | 727737 | 728675 | + | | 15595031 | 1195538 |
| Complete genome (Accession number NC_001318) | phosphomevalonate kinase, putative | 728666 | 729619 | + | | 15595032 | 1195539 |
| Complete genome (Accession number NC_001318) | mevalonate kinase | 729613 | 730506 | + | | 15595033 | 1195540 |
| Complete genome (Accession number NC_001318) | hypothetical protein BB0689 | 730532 | 731099 | - | | 15595034 | 1195542 |
| Complete genome (Accession number NC_001318) | neutrophil activating protein (napA) | 731151 | 731720 | + | | 15595035 | 1195543 |
| Complete genome (Accession number NC_001318) | elongation factor G | 731794 | 733803 | + | | 15595036 | 1195544 |
| Complete genome (Accession number NC_001318) | hypothetical protein BB0692 | 733809 | 733922 | + | | 15595037 | 1195545 |
| Complete genome (Accession number NC_001318) | xylose operon regulatory protein (xylR-1) | 734081 | 735289 | + | | 15595038 | 1195546 |
| Complete genome (Accession number NC_001318) | signal recognition particle protein (ffh) | 735343 | 736686 | + | | 15595039 | 1195547 |

Fig. 27 continued

| | | | | | | | |
|---|---|---|---|---|---|---|---|
| Complete genome (Accession number NC_001318) | 30S ribosomal protein S16 | 736699 | 736959 | + | | 15595040 | 1195548 |
| Complete genome (Accession number NC_001318) | hypothetical protein BB0696 | 736960 | 737208 | + | | 15595041 | 1195549 |
| Complete genome (Accession number NC_001318) | hypothetical protein BB0697 | 737212 | 737712 | + | | 15595042 | 1195550 |
| Complete genome (Accession number NC_001318) | tRNA (guanine-N(1)-)-methyltransferase | 737709 | 738426 | + | | 15595043 | 1195551 |
| Complete genome (Accession number NC_001318) | 50S ribosomal protein L19 | 738406 | 738771 | + | | 15595044 | 1195552 |
| Complete genome (Accession number NC_001318) | hypothetical protein BB0700 | 738851 | 738964 | + | | 15595045 | 1195553 |
| Complete genome (Accession number NC_001318) | hypothetical protein BB0701 | 739144 | 739683 | + | | 15595046 | 1195554 |
| Complete genome (Accession number NC_001318) | lipopolysaccharide biosynthesis-related protein (kdtB) | 739685 | 740176 | + | | 15595047 | 1195555 |
| Complete genome (Accession number NC_001318) | 50S ribosomal protein L32 | 740240 | 740422 | + | | 15595048 | 1195556 |
| Complete genome (Accession number NC_001318) | acyl carrier protein | 740446 | 740686 | + | | 15595049 | 1195557 |
| Complete genome (Accession number NC_001318) | ribonuclease III (rnc) | 740685 | 741425 | + | | 15595050 | 1195558 |

Fig. 27 continued

| | | | | | | | |
|---|---|---|---|---|---|---|---|
| Complete genome (Accession number NC_001318) | polynucleotide adenylyltransferase (papS) | 741396 | 742628 | - | | 15595051 | 1195559 |
| Complete genome (Accession number NC_001318) | hypothetical protein BB0707 | 742690 | 744516 | + | | 15595052 | 1195560 |
| Complete genome (Accession number NC_001318) | hypothetical protein BB0708 | 744522 | 744845 | + | | 15595053 | 1195561 |
| Complete genome (Accession number NC_001318) | hypothetical protein BB0709 | 745302 | 746333 | + | | 15595054 | 1195563 |
| Complete genome (Accession number NC_001318) | DNA primase (dnaG) | 746339 | 747910 | + | | 15595055 | 1195564 |
| Complete genome (Accession number NC_001318) | hypothetical protein BB0711 | 747925 | 748119 | + | | 15595056 | 1195565 |
| Complete genome (Accession number NC_001318) | RNA polymerase sigma factor RpoD | 748123 | 750018 | + | | 15595057 | 1195566 |
| Complete genome (Accession number NC_001318) | hypothetical protein BB0713 | 750028 | 750789 | + | | 15595058 | 1195567 |
| Complete genome (Accession number NC_001318) | hypothetical protein BB0714 | 751191 | 752159 | + | | 15595059 | 1195568 |
| Complete genome (Accession number NC_001318) | rod shape-determining protein (mreB-1) | 752134 | 753219 | + | | 15595060 | 1195569 |
| Complete genome (Accession number NC_001318) | rod shape-determining protein (mreC) | 753223 | 754068 | + | | 15595061 | 1195570 |
| Complete genome (Accession number NC_001318) | hypothetical protein BB0717 | 754068 | 754550 | + | | 15595062 | 1195571 |

Fig. 27 continued

| Complete genome (Accession number NC_001318) | penicillin-binding protein (pbp-2) | 754550 | 756349 | + | | 15595063 | 1195572 |
| --- | --- | --- | --- | --- | --- | --- | --- |
| Complete genome (Accession number NC_001318) | rod shape-determining protein (mreB-2) | 756291 | 757670 | + | | 15595064 | 1195573 |
| Complete genome (Accession number NC_001318) | threonyl-tRNA synthetase (thrZ) | 757836 | 759581 | + | | 15595065 | 1195574 |
| Complete genome (Accession number NC_001318) | CDP-diacylglycerol--glycerol-3-phosphate 3-phosphatidyltransferase | 759586 | 760215 | + | | 15595066 | 1195575 |
| Complete genome (Accession number NC_001318) | hypothetical protein BB0722 | 760202 | 761647 | + | | 15595067 | 1195576 |
| Complete genome (Accession number NC_001318) | hypothetical protein BB0723 | 761621 | 762154 | − | | 15595068 | 1195577 |
| Complete genome (Accession number NC_001318) | K+ transport protein (ntpJ) | 762242 | 763573 | + | | 15595069 | 1195578 |
| Complete genome (Accession number NC_001318) | hypothetical protein BB0725 | 763570 | 764361 | + | | 15595070 | 1195579 |
| Complete genome (Accession number NC_001318) | ATP-binding protein (ylxH-3) | 764371 | 765342 | + | | 15595071 | 1195580 |
| Complete genome (Accession number NC_001318) | diphosphate--fructose-6-phosphate 1-phosphotransferase | 765370 | 766716 | + | | 15595072 | 1195581 |

Fig. 27 continued

| Complete genome (Accession number NC_001318) | coenzyme A disulfide reductase | 766733 | 768067 | - | | 15595073 | 1195582 |
| --- | --- | --- | --- | --- | --- | --- | --- |
| Complete genome (Accession number NC_001318) | glutamate transporter (gltP) | 768079 | 769470 | - | | 15595074 | 1195583 |
| Complete genome (Accession number NC_001318) | glucose-6-phosphate isomerase | 769547 | 771145 | - | | 15595075 | 1195584 |
| Complete genome (Accession number NC_001318) | hypothetical protein BB0731 | 771162 | 771563 | - | | 15595076 | 1195585 |
| Complete genome (Accession number NC_001318) | penicillin-binding protein (pbp-3) | 771570 | 774368 | - | | 15595077 | 1195586 |
| Complete genome (Accession number NC_001318) | hypothetical protein BB0733 | 774632 | 775462 | + | | 15595078 | 1195587 |
| Complete genome (Accession number NC_001318) | hypothetical protein BB0734 | 775666 | 776679 | - | | 15595079 | 1195588 |
| Complete genome (Accession number NC_001318) | rare lipoprotein A (rlpA) | 776746 | 777573 | + | | 15595080 | 1195589 |
| Complete genome (Accession number NC_001318) | hypothetical protein BB0736 | 777625 | 777768 | + | | 15595081 | 1195590 |
| Complete genome (Accession number NC_001318) | histidine phosphokinase/ph ophatase, putative | 777747 | 778754 | + | | 15595082 | 1195591 |
| Complete genome (Accession number NC_001318) | valyl-tRNA synthetase | 778758 | 781385 | + | | 15595083 | 1195592 |
| Complete genome (Accession number NC_001318) | hypothetical protein BB0739 | 781486 | 782073 | - | | 15595084 | 1195593 |

Fig. 27 continued

| | | | | | | | |
|---|---|---|---|---|---|---|---|
| Complete genome (Accession number NC_001318) | hypothetical protein BB0740 | 782152 | 782829 | - | | 15595085 | 1195594 |
| Complete genome (Accession number NC_001318) | co-chaperonin GroES | 782976 | 783257 | - | | 15595086 | 1195595 |
| Complete genome (Accession number NC_001318) | ABC transporter, ATP-binding protein | 783324 | 785021 | + | | 15595087 | 1195596 |
| Complete genome (Accession number NC_001318) | hypothetical protein BB0743 | 785057 | 786754 | + | | 15595088 | 1195597 |
| Complete genome (Accession number NC_001318) | antigen, p83/100 | 786860 | 788962 | + | | 15595089 | 1195598 |
| Complete genome (Accession number NC_001318) | endonuclease III (nth) | 789270 | 789938 | + | | 15595090 | 1195601 |
| Complete genome (Accession number NC_001318) | oligopeptide ABC transporter, permease protein (oppC-2) | 789947 | 790807 | - | | 15595091 | 1195602 |
| Complete genome (Accession number NC_001318) | oligopeptide ABC transporter, permease protein (oppB-2) | 790807 | 791787 | - | | 15595092 | 1195603 |
| Complete genome (Accession number NC_001318) | hypothetical protein BB0748 | 791794 | 792252 | - | | 15595093 | 1195604 |
| Complete genome (Accession number NC_001318) | hypothetical protein BB0749 | 792333 | 793625 | + | | 15595094 | 1195605 |
| Complete genome (Accession number NC_001318) | hypothetical protein BB0750 | 793693 | 793836 | + | | 15595095 | 1195606 |

Fig. 27 continued

| | | | | | | | |
|---|---|---|---|---|---|---|---|
| Complete genome (Accession number NC_001318) | hypothetical protein BB0751 | 793842 | 794915 | - | | 15595096 | 1195607 |
| Complete genome (Accession number NC_001318) | hypothetical protein BB0752 | 794875 | 796363 | - | | 15595097 | 1195608 |
| Complete genome (Accession number NC_001318) | membrane spanning protein, putative | 796388 | 797122 | - | | 15595098 | 1195609 |
| Complete genome (Accession number NC_001318) | ABC transporter, ATP-binding protein | 797119 | 798048 | - | | 15595099 | 1195610 |
| Complete genome (Accession number NC_001318) | ribonuclease Z | 798057 | 799016 | - | | 15595100 | 1195611 |
| Complete genome (Accession number NC_001318) | hypothetical protein BB0756 | 799208 | 800275 | - | | 15595101 | 1195612 |
| Complete genome (Accession number NC_001318) | ATP-dependent Clp protease proteolytic subunit | 800452 | 801072 | + | | 15595102 | 1195613 |
| Complete genome (Accession number NC_001318) | hypothetical protein BB0758 | 800996 | 801778 | + | | 15595103 | 1195614 |
| Complete genome (Accession number NC_001318) | hypothetical protein BB0759 | 801941 | 802798 | - | | 15595104 | 1195616 |
| Complete genome (Accession number NC_001318) | hypothetical protein BB0760 | 802838 | 803212 | - | | 15595105 | 1195617 |
| Complete genome (Accession number NC_001318) | hypothetical protein BB0761 | 803278 | 804165 | + | | 15595106 | 1195618 |
| Complete genome (Accession number NC_001318) | hypothetical protein BB0762 | 804240 | 804353 | - | | 15595107 | 1195619 |

Fig. 27 continued

| | | | | | | | |
|---|---|---|---|---|---|---|---|
| Complete genome (Accession number NC_001318) | response regulatory protein (rrp-2) | 804417 | 805776 | - | | 15595108 | 1195620 |
| Complete genome (Accession number NC_001318) | sensory transduction histidine kinase, putative | 805775 | 806923 | - | | 15595109 | 1195621 |
| Complete genome (Accession number NC_001318) | hypothetical protein BB0765 | 806920 | 807966 | - | | 15595110 | 1195622 |
| Complete genome (Accession number NC_001318) | colicin V production protein, putative | 807976 | 808464 | - | | 15595111 | 1195623 |
| Complete genome (Accession number NC_001318) | UDP-N-acetylglucosamine--N-acetylmuramyl-(pentapeptide) pyrophosphoryl-undecaprenol N-acetylglucosamine transferase (murG) | 808461 | 809552 | - | | 15595112 | 1195624 |
| Complete genome (Accession number NC_001318) | pyridoxal kinase (pdxK) | 809701 | 810495 | - | | 15595113 | 1195625 |
| Complete genome (Accession number NC_001318) | O-sialoglycoprotein endopeptidase | 810470 | 811510 | - | | 15595114 | 1195626 |
| Complete genome (Accession number NC_001318) | hypothetical protein BB0770 | 811507 | 812388 | - | | 15595115 | 1195627 |
| Complete genome (Accession number NC_001318) | RNA polymerase sigma factor (rpoS) | 812439 | 813239 | - | | 15595116 | 1195628 |

Fig. 27 continued

| | | | | | | | |
|---|---|---|---|---|---|---|---|
| Complete genome (Accession number NC_001318) | flagellar basal body P-ring protein | 813690 | 814697 | - | | 15595117 | 1195629 |
| Complete genome (Accession number NC_001318) | hypothetical protein BB0773 | 814868 | 815302 | - | | 15595118 | 1195630 |
| Complete genome (Accession number NC_001318) | flagellar basal body rod protein FlgG | 815502 | 816299 | - | | 15595119 | 1195631 |
| Complete genome (Accession number NC_001318) | flagellar hook-basal body complex protein (flhO) | 816312 | 817214 | - | | 15595120 | 1195632 |
| Complete genome (Accession number NC_001318) | hypothetical protein BB0776 | 817393 | 817956 | + | | 15595121 | 1195633 |
| Complete genome (Accession number NC_001318) | adenine phosphoribosyltransferase | 818018 | 818548 | + | | 15595122 | 1195634 |
| Complete genome (Accession number NC_001318) | 50S ribosomal protein L21 | 818605 | 818916 | + | | 15595123 | 1195635 |
| Complete genome (Accession number NC_001318) | hypothetical protein BB0779 | 818922 | 819242 | + | | 15595124 | 1195636 |
| Complete genome (Accession number NC_001318) | 50S ribosomal protein L27 | 819242 | 819487 | + | | 15595125 | 1195637 |
| Complete genome (Accession number NC_001318) | GTPase ObgE | 819542 | 820528 | + | | 15595126 | 1195638 |
| Complete genome (Accession number NC_001318) | hypothetical protein BB0782 | 820568 | 821188 | + | | 15595127 | 1195639 |

Fig. 27 continued

| | | | | | | | |
|---|---|---|---|---|---|---|---|
| Complete genome (Accession number NC_001318) | hypothetical protein BB0783 | 821185 | 822369 | + | | 15595128 | 1195640 |
| Complete genome (Accession number NC_001318) | hypothetical protein BB0784 | 822335 | 822694 | + | | 15595129 | 1195641 |
| Complete genome (Accession number NC_001318) | regulatory protein SpoVG | 822810 | 823103 | + | | 15595130 | 1195642 |
| Complete genome (Accession number NC_001318) | 50S ribosomal protein L25/general stress protein Ctc | 823263 | 823811 | + | | 1.62E+08 | 1195643 |
| Complete genome (Accession number NC_001318) | peptidyl-tRNA hydrolase | 823816 | 824382 | + | | 15595132 | 1195645 |
| Complete genome (Accession number NC_001318) | hypothetical protein BB0788 | 824382 | 825704 | + | | 15595133 | 1195646 |
| Complete genome (Accession number NC_001318) | cell division protein (ftsH) | 825701 | 827620 | + | | 15595134 | 1195647 |
| Complete genome (Accession number NC_001318) | hypothetical protein BB0790 | 827625 | 829112 | + | | 15595135 | 1195648 |
| Complete genome (Accession number NC_001318) | thymidine kinase (tdk) | 829218 | 830321 | + | | 15595136 | 1195649 |
| Complete genome (Accession number NC_001318) | hypothetical protein BB0792 | 830318 | 830941 | - | | 15595137 | 1195650 |
| Complete genome (Accession number NC_001318) | thymidylate kinase (tmk) | 830955 | 831728 | - | | 15595138 | 1195651 |
| Complete genome (Accession number NC_001318) | hypothetical protein BB0794 | 831646 | 836043 | + | | 15595139 | 1195652 |
| Complete genome (Accession number NC_001318) | outer membrane protein | 836061 | 838526 | + | | 15595140 | 1195653 |

Fig. 27 continued

| Complete genome (Accession number NC_001318) | hypothetical protein BB0796 | 838523 | 839060 | + | | 15595141 | 1195654 |
| --- | --- | --- | --- | --- | --- | --- | --- |
| Complete genome (Accession number NC_001318) | DNA mismatch repair protein | 839244 | 841832 | + | | 15595142 | 1195655 |
| Complete genome (Accession number NC_001318) | competence protein F, putative | 841834 | 842451 | + | | 15595143 | 1195656 |
| Complete genome (Accession number NC_001318) | hypothetical protein BB0799 | 842501 | 842989 | + | | 15595144 | 1195657 |
| Complete genome (Accession number NC_001318) | transcription elongation factor NusA | 843003 | 844451 | + | | 15595145 | 1195658 |
| Complete genome (Accession number NC_001318) | translation initiation factor IF-2 | 844454 | 847102 | + | | 15595146 | 1195659 |
| Complete genome (Accession number NC_001318) | ribosome-binding factor A (rbfA) | 847105 | 847488 | + | | 15595147 | 1195660 |
| Complete genome (Accession number NC_001318) | tRNA pseudouridine 55 synthase (truB) | 847491 | 848339 | + | | 15595148 | 1195661 |
| Complete genome (Accession number NC_001318) | 30S ribosomal protein S15 | 848538 | 848804 | + | | 15595149 | 1195662 |
| Complete genome (Accession number NC_001318) | polynucleotide phosphorylase/polyadenylase | 848819 | 850987 | + | | 15595150 | 1195663 |
| Complete genome (Accession number NC_001318) | hypothetical protein BB0806 | 850994 | 852514 | + | | 15595151 | 1195664 |

Fig. 27 continued

| | | | | | | | |
|---|---|---|---|---|---|---|---|
| Complete genome (Accession number NC_001318) | hypothetical protein BB0607 | 852489 | 853776 | + | | 15595152 | 1195665 |
| Complete genome (Accession number NC_001318) | hypothetical protein BB0608 | 853775 | 854842 | + | | 15595153 | 1195666 |
| Complete genome (Accession number NC_001318) | tRNA-guanine transglycosylase (tgt) | 854869 | 855996 | + | | 15595154 | 1195667 |
| Complete genome (Accession number NC_001318) | virulence factor mviN protein (mviN) (SP:P37169) | 855971 | 857509 | + | | 15595155 | 1195668 |
| Complete genome (Accession number NC_001318) | hypothetical protein BB0811 | 857506 | 858915 | + | | 15595156 | 1195669 |
| Complete genome (Accession number NC_001318) | pantothenate metabolism flavoprotein (dfp) | 858939 | 860111 | - | | 15595157 | 1195670 |
| Complete genome (Accession number NC_001318) | hypothetical protein BB0813 | 860186 | 860362 | + | | 15595158 | 1195671 |
| Complete genome (Accession number NC_001318) | sodium/pantothenate symporter | 860440 | 861774 | + | | 15595159 | 1195672 |
| Complete genome (Accession number NC_001318) | hypothetical protein BB0815 | 861784 | 862677 | + | | 15595160 | 1195673 |
| Complete genome (Accession number NC_001318) | hypothetical protein BB0816 | 862696 | 863646 | + | | 15595161 | 1195674 |

Fig. 27 continued

| | | | | | | | |
|---|---|---|---|---|---|---|---|
| Complete genome (Accession number NC_001318) | UDP-N-acetylmuramate--L-alanine ligase | 863636 | 865042 | + | | 15595162 | 1195675 |
| Complete genome (Accession number NC_001318) | hypothetical protein BB0818 | 865053 | 865919 | + | | 15595163 | 1195676 |
| Complete genome (Accession number NC_001318) | cytidylate kinase | 865916 | 866458 | + | | 15595164 | 1195677 |
| Complete genome (Accession number NC_001318) | hypothetical protein BB0820 | 866494 | 866694 | + | | 15595165 | 1195678 |
| Complete genome (Accession number NC_001318) | 2-methylthio-N6-isopentyladenosine tRNA modification enzyme (miaA) | 866681 | 867601 | + | | 15595166 | 1195679 |
| Complete genome (Accession number NC_001318) | hypothetical protein BB0822 | 867605 | 867700 | + | | 15595167 | 1195680 |
| Complete genome (Accession number NC_001318) | hypothetical protein BB0823 | 867743 | 868114 | - | | 15595168 | 1195681 |
| Complete genome (Accession number NC_001318) | hypothetical protein BB0824 | 868189 | 868740 | + | | 15595169 | 1195682 |
| Complete genome (Accession number NC_001318) | hypothetical protein BB0825 | 868733 | 869515 | - | | 15595170 | 1195683 |
| Complete genome (Accession number NC_001318) | hypothetical protein BB0826 | 869508 | 870023 | - | | 15595171 | 1195684 |
| Complete genome (Accession number NC_001318) | ATP-dependent helicase (hrpA) | 870112 | 872583 | - | | 15595172 | 1195685 |

Fig. 27 continued

| | | | | | | | |
|---|---|---|---|---|---|---|---|
| Complete genome (Accession number NC_001318) | DNA topoisomerase I (topA) | 872586 | 875132 | - | | 15595173 | 1195686 |
| Complete genome (Accession number NC_001318) | exonuclease SbcD (sbcD) | 875207 | 876448 | + | | 15595174 | 1195687 |
| Complete genome (Accession number NC_001318) | exonuclease SbcC (sbcC) | 876429 | 879281 | + | | 15595175 | 1195688 |
| Complete genome (Accession number NC_001318) | xylose operon regulatory protein (xylR-2) | 879303 | 880250 | + | | 15595176 | 1195689 |
| Complete genome (Accession number NC_001318) | hypothetical protein BB0832 | 880267 | 881091 | - | | 15595177 | 1195690 |
| Complete genome (Accession number NC_001318) | isoleucyl-tRNA synthetase | 881085 | 884213 | - | | 15595178 | 1195691 |
| Complete genome (Accession number NC_001318) | ATP-dependent Clp protease, subunit C (clpC) | 884228 | 886447 | - | | 15595179 | 1195692 |
| Complete genome (Accession number NC_001318) | phosphomannomutase (cpsG) | 886470 | 888182 | - | | 15595180 | 1195693 |
| Complete genome (Accession number NC_001318) | excinuclease ABC subunit B | 888297 | 890318 | + | | 15595181 | 1195694 |
| Complete genome (Accession number NC_001318) | excinuclease ABC, subunit A (uvrA) | 890322 | 893174 | + | | 15595182 | 1195695 |
| Complete genome (Accession number NC_001318) | hypothetical protein BB0838 | 893129 | 896569 | + | | 15595183 | 1195696 |
| Complete genome (Accession number NC_001318) | hypothetical protein BB0839 | 897096 | 897740 | - | | 15595184 | 1195697 |

Fig. 27 continued

| Complete genome (Accession number NC_001318) | hypothetical protein BB0640 | 897704 | 899320 | - | | 15595185 | 1195698 |
| Complete genome (Accession number NC_001318) | arginine deiminase (arcA) | 899499 | 900731 | + | | 15595186 | 1195699 |
| Complete genome (Accession number NC_001318) | ornithine carbamoyltransferase, catabolic (arcB) | 900796 | 901782 | + | | 15595187 | 1195700 |
| Complete genome (Accession number NC_001318) | hypothetical protein BB0843 | 901810 | 903258 | + | | 15595188 | 1195701 |
| Complete genome (Accession number NC_001318) | hypothetical protein BB0844 | 903929 | 904900 | - | | 15595189 | 1195702 |
| Complete genome (Accession number NC_001318) | hypothetical protein BB0845 | 905120 | 905227 | + | | 15595190 | 1195703 |
| Complete genome (Accession number NC_001318) | hypothetical protein BB0846 | 905752 | 905865 | - | | 15595191 | 1195704 |
| Complete genome (Accession number NC_001318) | hypothetical protein BB0847 | 905839 | 905946 | + | | 15595192 | 1195705 |
| Complete genome (Accession number NC_001318) | hypothetical protein BB0848 | 905928 | 906032 | + | | 15595193 | 1195706 |
| Complete genome (Accession number NC_001318) | hypothetical protein BB0849 | 906162 | 906263 | + | | 15595194 | 1195707 |
| Complete genome (Accession number NC_001318) | hypothetical protein BB0851 | 907935 | 908081 | + | | 15595195 | 1195708 |
| Complete genome (Accession number NC_001318) | hypothetical protein BB0852 | 908407 | 909591 | + | | 15595196 | 1195709 |

Fig. 27 continued

Fig. 28. Borrelia afzelli

| Plasmid or genome | Product Name | Start | End | Strand | Length | Gi | GeneID |
|---|---|---|---|---|---|---|---|
| Plasmid cp30 (Accession number NC_008273) | hypothetical protein BAPKO_4000 | 63 | 632 | + | 189 | 111074075 | 4227522 |
| Plasmid cp30 (Accession number NC_008273) | hypothetical protein BAPKO_4001 | 671 | 916 | - | 81 | 111074076 | 4227523 |
| Plasmid cp30 (Accession number NC_008273) | hypothetical protein BAPKO_4002 | 1038 | 1367 | - | 109 | 111074077 | 4227524 |
| Plasmid cp30 (Accession number NC_008273) | hypothetical protein BAPKO_4003 | 1371 | 1568 | - | 65 | 111074078 | 4227525 |
| Plasmid cp30 (Accession number NC_008273) | hypothetical protein BAPKO_4004 | 1642 | 2457 | - | 271 | 111074079 | 4227485 |
| Plasmid cp30 (Accession number NC_008273) | hypothetical protein BAPKO_4005 | 2569 | 3081 | - | 170 | 111074080 | 4227486 |
| Plasmid cp30 (Accession number NC_008273) | hypothetical protein BAPKO_4006 | 3078 | 3956 | - | 292 | 111074081 | 4227487 |
| Plasmid cp30 (Accession number NC_008273) | hypothetical protein BAPKO_4007 | 3953 | 4285 | - | 110 | 111074082 | 4227488 |
| Plasmid cp30 (Accession number NC_008273) | hypothetical protein BAPKO_4008 | 4403 | 4564 | + | 53 | 111074083 | 4227489 |

| Plasmid cp30 (Accession number NC_008273) | hypothetical protein BAPKO_4009 | 4795 | 4875 | - | 26 | 111074084 | 4227490 |
| --- | --- | --- | --- | --- | --- | --- | --- |
| Plasmid cp30 (Accession number NC_008273) | hypothetical protein BAPKO_4010 | 4877 | 4996 | - | 39 | 111074085 | 4227491 |
| Plasmid cp30 (Accession number NC_008273) | hypothetical protein BAPKO_4011 | 5038 | 5883 | - | 281 | 111074086 | 4227492 |
| Plasmid cp30 (Accession number NC_008273) | hypothetical protein BAPKO_4012 | 5887 | 6519 | - | 210 | 111074087 | 4227493 |
| Plasmid cp30 (Accession number NC_008273) | hypothetical protein BAPKO_4013 | 6513 | 7817 | - | 434 | 111074088 | 4227494 |
| Plasmid cp30 (Accession number NC_008273) | hypothetical protein BAPKO_4014 | 7825 | 8061 | - | 78 | 111074089 | 4227495 |
| Plasmid cp30 (Accession number NC_008273) | hypothetical protein BAPKO_4015 | 8058 | 8180 | - | 40 | 111074090 | 4227496 |
| Plasmid cp30 (Accession number NC_008273) | hypothetical protein BAPKO_4016 | 8186 | 8503 | - | 105 | 111074091 | 4227497 |
| Plasmid cp30 (Accession number NC_008273) | hypothetical protein BAPKO_4017 | 8519 | 8947 | - | 142 | 111074092 | 4227498 |
| Plasmid cp30 (Accession number NC_008273) | hypothetical protein BAPKO_4018 | 8961 | 10073 | - | 370 | 111074093 | 4227499 |

Fig. 28 continued

| | | | | | | | |
|---|---|---|---|---|---|---|---|
| Plasmid cp30 (Accession number NC_008273) | hypothetical protein BAPKO_4019 | 10054 | 10623 | - | 189 | 111074094 | 4227500 |
| Plasmid cp30 (Accession number NC_008273) | hypothetical protein BAPKO_4020 | 10620 | 11006 | - | 128 | 111074095 | 4227501 |
| Plasmid cp30 (Accession number NC_008273) | hypothetical protein BAPKO_4021 | 10994 | 11377 | - | 127 | 111074096 | 4227502 |
| Plasmid cp30 (Accession number NC_008273) | hypothetical protein BAPKO_4022 | 11377 | 11832 | - | 151 | 111074097 | 4227503 |
| Plasmid cp30 (Accession number NC_008273) | hypothetical protein BAPKO_4023 | 11851 | 12810 | - | 319 | 111074098 | 4227504 |
| Plasmid cp30 (Accession number NC_008273) | hypothetical protein BAPKO_4024 | 12832 | 13404 | - | 190 | 111074099 | 4227505 |
| Plasmid cp30 (Accession number NC_008273) | hypothetical protein BAPKO_4025 | 13429 | 14187 | - | 252 | 111074100 | 4227506 |
| Plasmid cp30 (Accession number NC_008273) | hypothetical protein BAPKO_4026 | 14195 | 14758 | - | 187 | 111074101 | 4227507 |
| Plasmid cp30 (Accession number NC_008273) | hypothetical protein BAPKO_4027 | 14770 | 15465 | - | 231 | 111074102 | 4227508 |
| Plasmid cp30 (Accession number NC_008273) | hypothetical protein BAPKO_4028 | 15482 | 16705 | - | 407 | 111074103 | 4227266 |

Fig. 28 continued

| | | | | | | | |
|---|---|---|---|---|---|---|---|
| Plasmid cp30 (Accession number NC_008273) | hypothetical protein BAPKO_4029 | 16771 | 18123 | - | 450 | 111074104 | 4227267 |
| Plasmid cp30 (Accession number NC_008273) | hypothetical protein BAPKO_4030 | 18154 | 18639 | - | 161 | 111074105 | 4227509 |
| Plasmid cp30 (Accession number NC_008273) | hypothetical protein BAPKO_4031 | 18809 | 19525 | + | 238 | 111074106 | 4227510 |
| Plasmid cp30 (Accession number NC_008273) | hypothetical protein BAPKO_4032 | 19660 | 20169 | - | 169 | 111074107 | 4227511 |
| Plasmid cp30 (Accession number NC_008273) | hypothetical protein BAPKO_4033 | 20281 | 20901 | - | 206 | 111074108 | 4227512 |
| Plasmid cp30 (Accession number NC_008273) | hypothetical protein BAPKO_4034 | 20929 | 21477 | - | 182 | 111074109 | 4227513 |
| Plasmid cp30 (Accession number NC_008273) | hypothetical protein BAPKO_4035 | 21910 | 22686 | + | 258 | 111074110 | 4227514 |
| Plasmid cp30 (Accession number NC_008273) | hypothetical protein BAPKO_4036 | 22691 | 23038 | - | 115 | 111074111 | 4227515 |
| Plasmid cp30 (Accession number NC_008273) | hypothetical protein BAPKO_4037 | 23168 | 24496 | - | 442 | 111074112 | 4227516 |
| Plasmid cp30 (Accession number NC_008273) | hypothetical protein BAPKO_4038 | 25236 | 25760 | - | 174 | 111074113 | 4227517 |

Fig. 28 continued

| | | | | | | | |
|---|---|---|---|---|---|---|---|
| Plasmid cp30 (Accession number NC_008273) | hypothetical protein BAPKO_4039 | 25773 | 26330 | - | 185 | 111074114 | 4227518 |
| Plasmid cp30 (Accession number NC_008273) | hypothetical protein BAPKO_4040 | 26372 | 27127 | - | 251 | 111074115 | 4227519 |
| Plasmid cp30 (Accession number NC_008273) | hypothetical protein BAPKO_4041 | 27103 | 27681 | - | 192 | 111074116 | 4227520 |
| Plasmid cp30 (Accession number NC_008273) | hypothetical protein BAPKO_4042 | 27691 | 28785 | - | 364 | 111074117 | 4227521 |
| Plasmid cp27 (Accession number NC_008274) | hypothetical protein BAPKO_5000 | 46 | 327 | + | 93 | 111074119 | 4227268 |
| Plasmid cp27 (Accession number NC_008274) | hypothetical protein BAPKO_5001 | 311 | 757 | - | 148 | 111074120 | 4227269 |
| Plasmid cp27 (Accession number NC_008274) | hypothetical protein BAPKO_5002 | 843 | 2192 | - | 449 | 111074121 | 4227270 |
| Plasmid cp27 (Accession number NC_008274) | PTS system, cellobiose-specific IIC component | 2436 | 3758 | - | 440 | 111074122 | 4227271 |
| Plasmid cp27 (Accession number NC_008274) | PTS system, cellobiose-specific IIA component | 3961 | 4308 | + | 115 | 111074123 | 4227272 |

Fig. 28 continued

| | | | | | | | |
|---|---|---|---|---|---|---|---|
| Plasmid cp27 (Accession number NC_008274) | PTS system, cellobiose-specific IIB component | 4317 | 4643 | + | 108 | 111074124 | 4227273 |
| Plasmid cp27 (Accession number NC_008274) | hypothetical protein BAPKO_5006 | 4645 | 5742 | + | 365 | 111074125 | 4227274 |
| Plasmid cp27 (Accession number NC_008274) | hypothetical protein BAPKO_5007 | 5764 | 6393 | - | 209 | 111074126 | 4227275 |
| Plasmid cp27 (Accession number NC_008274) | hypothetical protein BAPKO_5008 | 6535 | 7563 | + | 342 | 111074127 | 4227276 |
| Plasmid cp27 (Accession number NC_008274) | hypothetical protein BAPKO_5009 | 7695 | 8633 | + | 312 | 111074128 | 4227277 |
| Plasmid cp27 (Accession number NC_008274) | hypothetical protein BAPKO_5010 | 8633 | 9151 | + | 172 | 111074129 | 4227278 |
| Plasmid cp27 (Accession number NC_008274) | hypothetical protein BAPKO_5011 | 9127 | 9888 | + | 253 | 111074130 | 4227279 |
| Plasmid cp27 (Accession number NC_008274) | hypothetical protein BAPKO_5012 | 9954 | 10523 | + | 189 | 111074131 | 4227280 |
| Plasmid cp27 (Accession number NC_008274) | hypothetical protein BAPKO_5013 | 10773 | 11270 | - | 165 | 111074132 | 4227281 |

Fig. 28 continued

| | | | | | | | |
|---|---|---|---|---|---|---|---|
| Plasmid cp27 (Accession number NC_008274) | oligopeptide ABC transporter, periplasmic oligopeptide-binding protein | 12028 | 13620 | + | 530 | 111074133 | 4227282 |
| Plasmid cp27 (Accession number NC_008274) | hypothetical protein BAPKO_5015 | 13672 | 13800 | - | 42 | 111074134 | 4227283 |
| Plasmid cp27 (Accession number NC_008274) | inositol-5-monophosphate dehydrogenase | 13901 | 15112 | - | 403 | 111074135 | 4227284 |
| Plasmid cp27 (Accession number NC_008274) | bifunctional GMP synthase/glutamine amidotransferase protein | 15137 | 16672 | - | 511 | 111074136 | 4227285 |
| Plasmid cp27 (Accession number NC_008274) | outer surface protein C | 16925 | 17563 | + | 212 | 111074137 | 4227286 |
| Plasmid cp27 (Accession number NC_008274) | hypothetical protein BAPKO_5019 | 17997 | 19352 | - | 451 | 111074138 | 4227287 |
| Plasmid cp27 (Accession number NC_008274) | hypothetical protein BAPKO_5020 | 19461 | 20816 | - | 451 | 111074139 | 4227288 |
| Plasmid cp27 (Accession number NC_008274) | hypothetical protein BAPKO_5021 | 20891 | 21394 | - | 167 | 111074140 | 4227289 |
| Plasmid cp27 (Accession number NC_008274) | hypothetical protein BAPKO_5022 | 21369 | 21881 | - | 170 | 111074141 | 4227290 |

Fig. 28 continued

| | | | | | | | |
|---|---|---|---|---|---|---|---|
| Plasmid cp27 (Accession number NC_008274) | hypothetical protein BAPKO_5023 | 21928 | 22623 | + | 231 | 111074142 | 4227291 |
| Plasmid cp27 (Accession number NC_008274) | hypothetical protein BAPKO_5024 | 22633 | 23184 | - | 183 | 111074143 | 4227292 |
| Plasmid cp27 (Accession number NC_008274) | hypothetical protein BAPKO_5025 | 23286 | 24530 | + | 414 | 111074144 | 4227293 |
| Plasmid cp27 (Accession number NC_008274) | hypothetical protein BAPKO_5026 | 24831 | 24926 | - | 31 | 111074145 | 4227294 |
| Plasmid cp27 (Accession number NC_008274) | PTS system, maltose and glucose-specific IIABC component | 24925 | 26487 | + | 520 | 111074146 | 4227295 |
| Plasmid lp60 (Accession number NC_008564) | hypothetical protein BAPKO_2000 | 782 | 1336 | - | 184 | 117621571 | 4491022 |
| Plasmid lp60 (Accession number NC_008564) | hypothetical protein BAPKO_2001 | 1691 | 2500 | + | 269 | 117621572 | 4491023 |
| Plasmid lp60 (Accession number NC_008564) | hypothetical protein BAPKO_2002 | 2785 | 2973 | + | 62 | 117621573 | 4491024 |
| Plasmid lp60 (Accession number NC_008564) | hypothetical protein BAPKO_2003 | 3222 | 3707 | + | 161 | 117621574 | 4491025 |
| Plasmid lp60 (Accession number NC_008564) | outer membrane protein | 3949 | 4467 | + | 172 | 117621575 | 4491026 |
| Plasmid lp60 (Accession number NC_008564) | antigen, S2 | 4545 | 5387 | - | 280 | 117621576 | 4491027 |
| Plasmid lp60 (Accession number NC_008564) | antigen, S1 | 5488 | 6735 | - | 415 | 117621577 | 4491028 |

Fig. 28 continued

| Plasmid lp60 (Accession number NC_008564) | hypothetical protein BAPKO_2007 | 6967 | 7086 | - | 39 | 117621578 | 4491029 |
|---|---|---|---|---|---|---|---|
| Plasmid lp60 (Accession number NC_008564) | chpAI protein, putative | 7147 | 7617 | - | 156 | 117621579 | 4491050 |
| Plasmid lp60 (Accession number NC_008564) | hypothetical protein BAPKO_2009 | 7788 | 8123 | + | 111 | 117621580 | 4491051 |
| Plasmid lp60 (Accession number NC_008564) | hypothetical protein BAPKO_2010 | 8120 | 8992 | + | 290 | 117621581 | 4491052 |
| Plasmid lp60 (Accession number NC_008564) | hypothetical protein BAPKO_2011 | 8995 | 9621 | + | 208 | 117621582 | 4491053 |
| Plasmid lp60 (Accession number NC_008564) | hypothetical protein BAPKO_2012 | 9677 | 10711 | + | 344 | 117621583 | 4491054 |
| Plasmid lp60 (Accession number NC_008564) | hypothetical protein BAPKO_2013 | 10735 | 10914 | + | 59 | 117621584 | 4491055 |
| Plasmid lp60 (Accession number NC_008564) | hypothetical protein BAPKO_2014 | 10911 | 11330 | + | 139 | 117621585 | 4491056 |
| Plasmid lp60 (Accession number NC_008564) | hypothetical protein BAPKO_2015 | 11320 | 11685 | + | 121 | 117621586 | 4491057 |
| Plasmid lp60 (Accession number NC_008564) | outer surface protein A | 11891 | 12712 | + | 273 | 117621587 | 4491058 |
| Plasmid lp60 (Accession number NC_008564) | outer surface protein B | 12726 | 13625 | + | 299 | 117621588 | 4491059 |
| Plasmid lp60 (Accession number NC_008564) | hypothetical protein BAPKO_2018 | 14200 | 15399 | + | 399 | 117621589 | 4491060 |
| Plasmid lp60 (Accession number NC_008564) | hypothetical protein BAPKO_2019 | 15447 | 16031 | + | 194 | 117621590 | 4491061 |
| Plasmid lp60 (Accession number NC_008564) | hypothetical protein BAPKO_2020 | 16007 | 16759 | + | 250 | 117621591 | 4491062 |

Fig. 28 continued

| | | | | | | | |
|---|---|---|---|---|---|---|---|
| Plasmid lp60 (Accession number NC_008564) | hypothetical protein BAPKO_2021 | 16789 | 17334 | + | 181 | 117621592 | 4491063 |
| Plasmid lp60 (Accession number NC_008564) | hypothetical protein BAPKO_2022 | 17599 | 17718 | + | 39 | 117621593 | 4491064 |
| Plasmid lp60 (Accession number NC_008564) | hypothetical protein BAPKO_2023 | 18044 | 18475 | + | 143 | 117621594 | 4491065 |
| Plasmid lp60 (Accession number NC_008564) | decorin binding protein A | 18591 | 19103 | - | 170 | 117621595 | 4491066 |
| Plasmid lp60 (Accession number NC_008564) | decorin binding protein B | 19219 | 19770 | - | 183 | 117621596 | 4491067 |
| Plasmid lp60 (Accession number NC_008564) | hypothetical protein BAPKO_2026 | 20199 | 20516 | - | 105 | 117621597 | 4491068 |
| Plasmid lp60 (Accession number NC_008564) | hypothetical protein BAPKO_2027 | 20638 | 21231 | + | 197 | 117621598 | 4491069 |
| Plasmid lp60 (Accession number NC_008564) | hypothetical protein BAPKO_2028 | 21235 | 22587 | + | 450 | 117621599 | 4491070 |
| Plasmid lp60 (Accession number NC_008564) | hypothetical protein BAPKO_2029 | 22676 | 22804 | + | 42 | 117621600 | 4491071 |
| Plasmid lp60 (Accession number NC_008564) | hypothetical protein BAPKO_2030 | 22886 | 23311 | + | 141 | 117621601 | 4491072 |
| Plasmid lp60 (Accession number NC_008564) | hypothetical protein BAPKO_2031 | 23444 | 23638 | + | 64 | 117621602 | 4491073 |
| Plasmid lp60 (Accession number NC_008564) | hypothetical protein BAPKO_2032 | 23801 | 24340 | + | 179 | 117621603 | 4491074 |
| Plasmid lp60 (Accession number NC_008564) | oligopeptide ABC transporter, periplasmic | 24430 | 26016 | - | 528 | 117621604 | 4491075 |
| Plasmid lp60 (Accession number NC_008564) | lipoprotein | 26531 | 27181 | + | 216 | 117621605 | 4491076 |

Fig. 28 continued

| Plasmid lp60 (Accession number NC_008564) | hypothetical protein BAPKO_2035 | 27289 | 27897 | + | 202 | 117621606 | 4491077 |
|---|---|---|---|---|---|---|---|
| Plasmid lp60 (Accession number NC_008564) | hypothetical protein BAPKO_2036 | 28263 | 29492 | + | 409 | 117621607 | 4491078 |
| Plasmid lp60 (Accession number NC_008564) | hypothetical protein BAPKO_2037 | 29504 | 30103 | + | 199 | 117621608 | 4491079 |
| Plasmid lp60 (Accession number NC_008564) | hypothetical protein BAPKO_2038 | 30158 | 30769 | + | 203 | 117621609 | 4491080 |
| Plasmid lp60 (Accession number NC_008564) | hypothetical protein BAPKO_2039 | 30786 | 31703 | + | 305 | 117621610 | 4491081 |
| Plasmid lp60 (Accession number NC_008564) | hypothetical protein BAPKO_2040 | 31706 | 32161 | + | 151 | 117621611 | 4491082 |
| Plasmid lp60 (Accession number NC_008564) | hypothetical protein BAPKO_2041 | 32158 | 32547 | + | 129 | 117621612 | 4491083 |
| Plasmid lp60 (Accession number NC_008564) | hypothetical protein BAPKO_2042 | 32544 | 32897 | + | 117 | 117621613 | 4491084 |
| Plasmid lp60 (Accession number NC_008564) | hypothetical protein BAPKO_2043 | 32894 | 33433 | + | 179 | 117621614 | 4491085 |
| Plasmid lp60 (Accession number NC_008564) | hypothetical protein BAPKO_2044 | 33492 | 34562 | + | 356 | 117621615 | 4491086 |
| Plasmid lp60 (Accession number NC_008564) | hypothetical protein BAPKO_2045 | 34562 | 34984 | + | 140 | 117621616 | 4491087 |
| Plasmid lp60 (Accession number NC_008564) | hypothetical protein BAPKO_2046 | 35026 | 35517 | + | 163 | 117621617 | 4491088 |
| Plasmid lp60 (Accession number NC_008564) | hypothetical protein BAPKO_2047 | 35510 | 35728 | + | 72 | 117621618 | 4491030 |
| Plasmid lp60 (Accession number NC_008564) | hypothetical protein BAPKO_2048 | 35737 | 37116 | + | 459 | 117621619 | 4491031 |

Fig. 28 continued

| Plasmid lp60 (Accession number NC_008564) | hypothetical protein BAPKO_2049 | 37147 | 37710 | + | 187 | 117621620 | 4491032 |
| --- | --- | --- | --- | --- | --- | --- | --- |
| Plasmid lp60 (Accession number NC_008564) | outer membrane protein | 37750 | 38667 | + | 305 | 117621621 | 4491033 |
| Plasmid lp60 (Accession number NC_008564) | hypothetical protein BAPKO_2051 | 38748 | 39026 | + | 92 | 117621622 | 4491034 |
| Plasmid lp60 (Accession number NC_008564) | hypothetical protein BAPKO_2052 | 39056 | 39328 | + | 90 | 117621623 | 4491035 |
| Plasmid lp60 (Accession number NC_008564) | hypothetical protein BAPKO_2053 | 39391 | 40329 | + | 312 | 117621624 | 4491036 |
| Plasmid lp60 (Accession number NC_008564) | hypothetical protein BAPKO_2054 | 40319 | 40882 | + | 187 | 117621625 | 4491037 |
| Plasmid lp60 (Accession number NC_008564) | hypothetical protein BAPKO_2055 | 40946 | 42145 | - | 399 | 117621626 | 4491038 |
| Plasmid lp60 (Accession number NC_008564) | lipoprotein | 42628 | 42861 | - | 77 | 117621627 | 4491039 |
| Plasmid lp60 (Accession number NC_008564) | surface lipoprotein P27 | 42958 | 43734 | - | 258 | 117621628 | 4491040 |
| Plasmid lp60 (Accession number NC_008564) | hypothetical protein BAPKO_2058 | 44112 | 44738 | - | 208 | 117621629 | 4491041 |
| Plasmid lp60 (Accession number NC_008564) | lipoprotein | 44987 | 45166 | + | 59 | 117621630 | 4491042 |
| Plasmid lp60 (Accession number NC_008564) | antigen, P35 | 45371 | 46345 | - | 324 | 117621631 | 4491043 |
| Plasmid lp60 (Accession number NC_008564) | hypothetical protein BAPKO_2061 | 46511 | 47362 | - | 283 | 117621632 | 4491044 |
| Plasmid lp60 (Accession number NC_008564) | antigen, P35, putative | 47529 | 48776 | - | 415 | 117621633 | 4491045 |

Fig. 28 continued

| | | | | | | | |
|---|---|---|---|---|---|---|---|
| Plasmid lp60 (Accession number NC_008564) | hypothetical protein BAPKO_2063 | 48934 | 49629 | - | 231 | 117621634 | 4491046 |
| Plasmid lp60 (Accession number NC_008564) | hypothetical protein BAPKO_2064 | 49707 | 50426 | - | 239 | 117621635 | 4491047 |
| Plasmid lp60 (Accession number NC_008564) | hypothetical protein BAPKO_2065 | 50661 | 51437 | - | 258 | 117621636 | 4491048 |
| Plasmid lp60 (Accession number NC_008564) | hypothetical protein BAPKO_2066 | 51638 | 52450 | - | 270 | 117621637 | 4491049 |
| Plasmid lp60 (Accession number NC_008564) | hypothetical protein BAPKO_2067 | 52651 | 53397 | - | 248 | 117621638 | 4491014 |
| Plasmid lp60 (Accession number NC_008564) | hypothetical protein BAPKO_2068 | 53673 | 54398 | - | 241 | 117621639 | 4491015 |
| Plasmid lp60 (Accession number NC_008564) | hypothetical protein BAPKO_2069 | 54670 | 55425 | - | 251 | 117621640 | 4491016 |
| Plasmid lp60 (Accession number NC_008564) | hypothetical protein BAPKO_2070 | 55736 | 56434 | - | 232 | 117621641 | 4491017 |
| Plasmid lp60 (Accession number NC_008564) | antigen, P35, putative | 56660 | 57541 | - | 293 | 117621642 | 4491018 |
| Plasmid lp60 (Accession number NC_008564) | hypothetical protein BAPKO_2072 | 57699 | 57836 | - | 45 | 117621643 | 4491019 |
| Plasmid lp60 (Accession number NC_008564) | outer membrane porin | 58076 | 58897 | + | 273 | 117621644 | 4491020 |
| Plasmid lp60 (Accession number NC_008564) | FAD-dependent thymidylate synthase | 59105 | 59908 | + | 267 | 117621645 | 4491021 |
| Plasmid lp60-2 (Accession number NC_008565) | hypothetical protein BAPKO_2500 | 120 | 683 | + | 187 | 117621647 | 4491089 |
| Plasmid lp60-2 (Accession number NC_008565) | hypothetical protein BAPKO_2501 | 866 | 1363 | + | 165 | 117621648 | 4491090 |

Fig. 28 continued

| | | | | | | | |
|---|---|---|---|---|---|---|---|
| Plasmid lp60-2 (Accession number NC_008565) | hypothetical protein BAPKO_2502 | 1360 | 1545 | - | 61 | 117621649 | 4491091 |
| Plasmid lp60-2 (Accession number NC_008565) | hypothetical protein BAPKO_2503 | 1777 | 1989 | + | 70 | 117621650 | 4491092 |
| Plasmid lp60-2 (Accession number NC_008565) | hypothetical protein BAPKO_2504 | 2513 | 3337 | + | 274 | 117621651 | 4491093 |
| Plasmid lp60-2 (Accession number NC_008565) | hypothetical protein BAPKO_2505 | 3901 | 4251 | + | 116 | 117621652 | 4491094 |
| Plasmid lp60-2 (Accession number NC_008565) | hypothetical protein BAPKO_2506 | 4400 | 5080 | + | 226 | 117621653 | 4491095 |
| Plasmid lp60-2 (Accession number NC_008565) | hypothetical protein BAPKO_2507 | 5952 | 6845 | + | 297 | 117621654 | 4491096 |
| Plasmid lp60-2 (Accession number NC_008565) | hypothetical protein BAPKO_2508 | 7447 | 11277 | - | 1276 | 117621655 | 4491097 |
| Plasmid lp60-2 (Accession number NC_008565) | hypothetical protein BAPKO_2509 | 11397 | 11627 | - | 76 | 117621656 | 4491098 |
| Plasmid lp60-2 (Accession number NC_008565) | hypothetical protein BAPKO_2510 | 11700 | 11903 | - | 67 | 117621657 | 4491099 |
| Plasmid lp60-2 (Accession number NC_008565) | hypothetical protein BAPKO_2511 | 11818 | 11961 | - | 47 | 117621658 | 4491100 |
| Plasmid lp60-2 (Accession number NC_008565) | hypothetical protein BAPKO_2512 | 12703 | 13620 | + | 305 | 117621659 | 4491101 |
| Plasmid lp60-2 (Accession number NC_008565) | hypothetical protein BAPKO_2513 | 13613 | 14179 | + | 188 | 117621660 | 4491102 |
| Plasmid lp60-2 (Accession number NC_008565) | hypothetical protein BAPKO_2514 | 14152 | 14907 | + | 251 | 117621661 | 4491103 |
| Plasmid lp60-2 (Accession number NC_008565) | hypothetical protein BAPKO_2515 | 15003 | 15632 | + | 209 | 117621662 | 4491104 |

Fig. 28 continued

| | | | | | | | |
|---|---|---|---|---|---|---|---|
| Plasmid lp60-2 (Accession number NC_008565) | hypothetical protein BAPKO_2516 | 15791 | 16135 | + | 114 | 117621663 | 4491105 |
| Plasmid lp60-2 (Accession number NC_008565) | hypothetical protein BAPKO_2517 | 16427 | 16534 | + | 35 | 117621664 | 4491106 |
| Plasmid lp60-2 (Accession number NC_008565) | hypothetical protein BAPKO_2518 | 16914 | 17174 | - | 86 | 117621665 | 4491107 |
| Plasmid lp60-2 (Accession number NC_008565) | hypothetical protein BAPKO_2519 | 17628 | 18611 | - | 327 | 117621666 | 4491108 |
| Plasmid lp60-2 (Accession number NC_008565) | hypothetical protein BAPKO_2520 | 19291 | 20145 | + | 284 | 117621667 | 4491109 |
| Plasmid lp60-2 (Accession number NC_008565) | hypothetical protein BAPKO_2521 | 20892 | 21902 | - | 336 | 117621668 | 4491110 |
| Plasmid lp60-2 (Accession number NC_008565) | hypothetical protein BAPKO_2522 | 22598 | 23146 | + | 182 | 117621669 | 4491111 |
| Plasmid lp60-2 (Accession number NC_008565) | hypothetical protein BAPKO_2523 | 23546 | 24028 | - | 160 | 117621670 | 4491112 |
| Plasmid lp60-2 (Accession number NC_008565) | hypothetical protein BAPKO_2524 | 24605 | 24928 | - | 107 | 117621671 | 4491113 |
| Plasmid lp60-2 (Accession number NC_008565) | hypothetical protein BAPKO_2525 | 25621 | 26796 | - | 391 | 117621672 | 4491114 |
| Plasmid lp60-2 (Accession number NC_008565) | hypothetical protein BAPKO_2526 | 26919 | 27104 | - | 61 | 117621673 | 4491115 |
| Plasmid lp60-2 (Accession number NC_008565) | hypothetical protein BAPKO_2527 | 27194 | 31027 | - | 1277 | 117621674 | 4491116 |
| Plasmid lp60-2 (Accession number NC_008565) | hypothetical protein BAPKO_2528 | 32613 | 32786 | + | 57 | 117621675 | 4491117 |
| Plasmid lp60-2 (Accession number NC_008565) | hypothetical protein BAPKO_2529 | 32875 | 33033 | - | 52 | 117621676 | 4491118 |

Fig. 28 continued

| Plasmid lp60-2 (Accession number NC_008565) | hypothetical protein BAPKO_2530 | 34078 | 34218 | + | 46 | 117621677 | 4491119 |
|---|---|---|---|---|---|---|---|
| Plasmid lp60-2 (Accession number NC_008565) | hypothetical protein BAPKO_2531 | 34708 | 34941 | + | 77 | 117621678 | 4491120 |
| Plasmid lp60-2 (Accession number NC_008565) | hypothetical protein BAPKO_2532 | 36466 | 36561 | - | 31 | 117621679 | 4491121 |
| Plasmid lp60-2 (Accession number NC_008565) | hypothetical protein BAPKO_2533 | 36485 | 36577 | - | 30 | 117621680 | 4491122 |
| Plasmid lp60-2 (Accession number NC_008565) | hypothetical protein BAPKO_2534 | 36811 | 36957 | - | 48 | 117621681 | 4491123 |
| Plasmid lp60-2 (Accession number NC_008565) | hypothetical protein BAPKO_2535 | 37016 | 37069 | - | 17 | 117621682 | 4491124 |
| Plasmid lp60-2 (Accession number NC_008565) | hypothetical protein BAPKO_2536 | 37128 | 37880 | - | 250 | 117621683 | 4491125 |
| Plasmid lp60-2 (Accession number NC_008565) | hypothetical protein BAPKO_2537 | 37856 | 38410 | - | 184 | 117621684 | 4491126 |
| Plasmid lp60-2 (Accession number NC_008565) | hypothetical protein BAPKO_2538 | 38452 | 39522 | - | 356 | 117621685 | 4491127 |
| Plasmid lp60-2 (Accession number NC_008565) | hypothetical protein BAPKO_2539 | 39691 | 39885 | + | 64 | 117621686 | 4491128 |
| Plasmid lp60-2 (Accession number NC_008565) | hypothetical protein BAPKO_2540 | 40723 | 40896 | + | 57 | 117621687 | 4491129 |
| Plasmid lp60-2 (Accession number NC_008565) | hypothetical protein BAPKO_2541 | 41188 | 41796 | - | 202 | 117621688 | 4491130 |
| Plasmid lp60-2 (Accession number NC_008565) | hypothetical protein BAPKO_2542 | 43297 | 44079 | - | 260 | 117621689 | 4491131 |
| Plasmid lp60-2 (Accession number NC_008565) | hypothetical protein BAPKO_2543 | 44529 | 44606 | - | 25 | 117621690 | 4491132 |

Fig. 28 continued

| | | | | | | | |
|---|---|---|---|---|---|---|---|
| Plasmid lp60-2 (Accession number NC_008565) | hypothetical protein BAPKO_2544 | 45087 | 45770 | - | 227 | 117621691 | 4491133 |
| Plasmid lp60-2 (Accession number NC_008565) | hypothetical protein BAPKO_2545 | 46660 | 46971 | + | 103 | 117621692 | 4491134 |
| Plasmid lp60-2 (Accession number NC_008565) | hypothetical protein BAPKO_2546 | 47035 | 47256 | - | 73 | 117621693 | 4491135 |
| Plasmid lp60-2 (Accession number NC_008565) | hypothetical protein BAPKO_2547 | 47854 | 48042 | + | 62 | 117621694 | 4491136 |
| Plasmid lp60-2 (Accession number NC_008565) | hypothetical protein BAPKO_2548 | 48072 | 48290 | + | 72 | 117621695 | 4491137 |
| Plasmid lp60-2 (Accession number NC_008565) | hypothetical protein BAPKO_2549 | 48442 | 49368 | - | 308 | 117621696 | 4491138 |
| Plasmid lp60-2 (Accession number NC_008565) | hypothetical protein BAPKO_2550 | 49361 | 49819 | - | 152 | 117621697 | 4491139 |
| Plasmid lp60-2 (Accession number NC_008565) | hypothetical protein BAPKO_2551 | 50125 | 50427 | - | 100 | 117621698 | 4491140 |
| Plasmid lp60-2 (Accession number NC_008565) | hypothetical protein BAPKO_2552 | 51127 | 51678 | + | 183 | 117621699 | 4491141 |
| Plasmid lp60-2 (Accession number NC_008565) | hypothetical protein BAPKO_2553 | 51837 | 52424 | - | 195 | 117621700 | 4491142 |
| Plasmid lp60-2 (Accession number NC_008565) | hypothetical protein BAPKO_2554 | 56948 | 57054 | + | 368 | 117621701 | 4491143 |
| Plasmid lp60-2 (Accession number NC_008565) | hypothetical protein BAPKO_2555 | 57064 | 57300 | + | 78 | 117621702 | 4491144 |
| Plasmid lp60-2 (Accession number NC_008565) | hypothetical protein BAPKO_2556 | 57293 | 58045 | + | 250 | 117621703 | 4491145 |
| Plasmid lp60-2 (Accession number NC_008565) | hypothetical protein BAPKO_2557 | 58340 | 58684 | + | 114 | 117621704 | 4491146 |

Fig. 28 continued

| | | | | | | | |
|---|---|---|---|---|---|---|---|
| Plasmid lp60-2 (Accession number NC_008565) | hypothetical protein BAPKO_2558 | 58870 | 59328 | + | 152 | 117621705 | 4491147 |
| Plasmid lp34 (Accession number NC_008566) | hypothetical protein BAPKO_3000 | 921 | 1748 | + | 275 | 117621707 | 4491157 |
| Plasmid lp34 (Accession number NC_008566) | hypothetical protein BAPKO_3001 | 2473 | 2664 | - | 63 | 117621708 | 4491158 |
| Plasmid lp34 (Accession number NC_008566) | hypothetical protein BAPKO_3002 | 3113 | 3391 | - | 92 | 117621709 | 4491159 |
| Plasmid lp34 (Accession number NC_008566) | hypothetical protein BAPKO_3003 | 3345 | 3806 | - | 153 | 117621710 | 4491160 |
| Plasmid lp34 (Accession number NC_008566) | hypothetical protein BAPKO_3004 | 3796 | 3912 | - | 38 | 117621711 | 4491161 |
| Plasmid lp34 (Accession number NC_008566) | hypothetical protein BAPKO_3005 | 4259 | 4783 | - | 174 | 117621712 | 4491162 |
| Plasmid lp34 (Accession number NC_008566) | hypothetical protein BAPKO_3006 | 5150 | 5473 | - | 107 | 117621713 | 4491163 |
| Plasmid lp34 (Accession number NC_008566) | hypothetical protein BAPKO_3007 | 5657 | 5908 | - | 83 | 117621714 | 4491164 |
| Plasmid lp34 (Accession number NC_008566) | hypothetical protein BAPKO_3008 | 6922 | 7803 | - | 293 | 117621715 | 4491165 |
| Plasmid lp34 (Accession number NC_008566) | hypothetical protein BAPKO_3009 | 8618 | 8731 | + | 37 | 117621716 | 4491166 |
| Plasmid lp34 (Accession number NC_008566) | hypothetical protein BAPKO_3010 | 8863 | 9375 | + | 170 | 117621717 | 4491167 |
| Plasmid lp34 (Accession number NC_008566) | hypothetical protein BAPKO_3011 | 9826 | 10143 | - | 105 | 117621718 | 4491168 |
| Plasmid lp34 (Accession number NC_008566) | hypothetical protein BAPKO_3012 | 11425 | 12402 | + | 325 | 117621719 | 4491169 |

Fig. 28 continued

| Plasmid lp34 (Accession number NC_008566) | hypothetical protein BAPKO_3013 | 12395 | 12874 | + | 159 | 117621720 | 4491170 |
| Plasmid lp34 (Accession number NC_008566) | hypothetical protein BAPKO_3014 | 12956 | 13693 | + | 245 | 117621721 | 4491171 |
| Plasmid lp34 (Accession number NC_008566) | hypothetical protein BAPKO_3015 | 13740 | 14360 | + | 206 | 117621722 | 4491172 |
| Plasmid lp34 (Accession number NC_008566) | hypothetical protein BAPKO_3016 | 15785 | 16540 | - | 251 | 117621723 | 4491173 |
| Plasmid lp34 (Accession number NC_008566) | hypothetical protein BAPKO_3017 | 17870 | 18028 | + | 52 | 117621724 | 4491174 |
| Plasmid lp34 (Accession number NC_008566) | hypothetical protein BAPKO_3018 | 18237 | 18410 | + | 57 | 117621725 | 4491175 |
| Plasmid lp34 (Accession number NC_008566) | hypothetical protein BAPKO_3019 | 18705 | 18905 | + | 66 | 117621726 | 4491176 |
| Plasmid lp34 (Accession number NC_008566) | hypothetical protein BAPKO_3020 | 19482 | 19679 | - | 65 | 117621727 | 4491177 |
| Plasmid lp34 (Accession number NC_008566) | hypothetical protein BAPKO_3021 | 19801 | 20007 | - | 68 | 117621728 | 4491178 |
| Plasmid lp34 (Accession number NC_008566) | hypothetical protein BAPKO_3022 | 20673 | 20780 | - | 35 | 117621729 | 4491179 |
| Plasmid lp34 (Accession number NC_008566) | hypothetical protein BAPKO_3023 | 20844 | 21080 | - | 78 | 117621730 | 4491180 |
| Plasmid lp34 (Accession number NC_008566) | hypothetical protein BAPKO_3024 | 22176 | 22337 | - | 53 | 117621731 | 4491181 |
| Plasmid lp34 (Accession number NC_008566) | hypothetical protein BAPKO_3025 | 24087 | 25163 | - | 358 | 117621732 | 4491182 |
| Plasmid lp34 (Accession number NC_008566) | hypothetical protein BAPKO_3026 | 25511 | 26326 | + | 271 | 117621733 | 4491183 |

Fig. 28 continued

| | | | | | | | |
|---|---|---|---|---|---|---|---|
| Plasmid lp34 (Accession number NC_008566) | hypothetical protein BAPKO_3027 | 26254 | 26343 | - | 29 | 117621734 | 4491148 |
| Plasmid lp34 (Accession number NC_008566) | hypothetical protein BAPKO_3028 | 26358 | 26489 | + | 43 | 117621735 | 4491149 |
| Plasmid lp34 (Accession number NC_008566) | hypothetical protein BAPKO_3029 | 26500 | 26748 | + | 82 | 117621736 | 4491150 |
| Plasmid lp34 (Accession number NC_008566) | hypothetical protein BAPKO_3030 | 27001 | 27123 | + | 40 | 117621737 | 4491151 |
| Plasmid lp34 (Accession number NC_008566) | hypothetical protein BAPKO_3031 | 28470 | 28571 | + | 33 | 117621738 | 4491152 |
| Plasmid lp34 (Accession number NC_008566) | hypothetical protein BAPKO_3032 | 28516 | 29262 | + | 248 | 117621739 | 4491153 |
| Plasmid lp34 (Accession number NC_008566) | hypothetical protein BAPKO_3033 | 29847 | 31493 | + | 548 | 117621740 | 4491154 |
| Plasmid lp34 (Accession number NC_008566) | hypothetical protein BAPKO_3034 | 32390 | 33085 | - | 231 | 117621741 | 4491155 |
| Plasmid lp34 (Accession number NC_008566) | hypothetical protein BAPKO_3035 | 33488 | 34153 | + | 221 | 117621742 | 4491156 |
| Plasmid lp32 (Accession number NC_008567) | hypothetical protein BAPKO_3500 | 598 | 1212 | - | 204 | 117621744 | 4491204 |
| Plasmid lp32 (Accession number NC_008567) | hypothetical protein BAPKO_3501 | 1714 | 1890 | + | 58 | 117621745 | 4491205 |
| Plasmid lp32 (Accession number NC_008567) | hypothetical protein BAPKO_3502 | 1863 | 2105 | + | 80 | 117621746 | 4491206 |
| Plasmid lp32 (Accession number NC_008567) | hypothetical protein BAPKO_3503 | 2247 | 2402 | - | 51 | 117621747 | 4491207 |
| Plasmid lp32 (Accession number NC_008567) | hypothetical protein BAPKO_3504 | 2426 | 2809 | + | 127 | 117621748 | 4491208 |

Fig. 28 continued

| Plasmid lp32 (Accession number NC_008567) | hypothetical protein BAPKO_3505 | 2877 | 3035 | + | 52 | 117621749 | 4491209 |
|---|---|---|---|---|---|---|---|
| Plasmid lp32 (Accession number NC_008567) | hypothetical protein BAPKO_3506 | 3342 | 3674 | + | 110 | 117621750 | 4491210 |
| Plasmid lp32 (Accession number NC_008567) | hypothetical protein BAPKO_3507 | 3722 | 4102 | + | 126 | 117621751 | 4491211 |
| Plasmid lp32 (Accession number NC_008567) | hypothetical protein BAPKO_3508 | 4166 | 4321 | + | 51 | 117621752 | 4491212 |
| Plasmid lp32 (Accession number NC_008567) | hypothetical protein BAPKO_3509 | 4522 | 4776 | + | 84 | 117621753 | 4491213 |
| Plasmid lp32 (Accession number NC_008567) | hypothetical protein BAPKO_3510 | 5340 | 5537 | + | 65 | 117621754 | 4491214 |
| Plasmid lp32 (Accession number NC_008567) | hypothetical protein BAPKO_3511 | 5719 | 6273 | + | 184 | 117621755 | 4491215 |
| Plasmid lp32 (Accession number NC_008567) | hypothetical protein BAPKO_3512 | 6397 | 6852 | + | 151 | 117621756 | 4491216 |
| Plasmid lp32 (Accession number NC_008567) | hypothetical protein BAPKO_3513 | 7298 | 7624 | + | 108 | 117621757 | 4491217 |
| Plasmid lp32 (Accession number NC_008567) | hypothetical protein BAPKO_3514 | 7706 | 8302 | + | 198 | 117621758 | 4491218 |
| Plasmid lp32 (Accession number NC_008567) | hypothetical protein BAPKO_3515 | 8264 | 8374 | - | 36 | 117621759 | 4491219 |
| Plasmid lp32 (Accession number NC_008567) | hypothetical protein BAPKO_3516 | 8394 | 8510 | + | 38 | 117621760 | 4491220 |
| Plasmid lp32 (Accession number NC_008567) | hypothetical protein BAPKO_3517 | 9142 | 9468 | - | 108 | 117621761 | 4491221 |
| Plasmid lp32 (Accession number NC_008567) | hypothetical protein BAPKO_3518 | 9888 | 13100 | + | 1070 | 117621762 | 4491222 |

Fig. 28 continued

| | | | | | | | |
|---|---|---|---|---|---|---|---|
| Plasmid lp32 (Accession number NC_008567) | hypothetical protein BAPKO_3519 | 13803 | 14180 | + | 125 | 117621763 | 4491223 |
| Plasmid lp32 (Accession number NC_008567) | hypothetical protein BAPKO_3520 | 14183 | 14701 | + | 172 | 117621764 | 4491224 |
| Plasmid lp32 (Accession number NC_008567) | hypothetical protein BAPKO_3521 | 14691 | 14912 | + | 73 | 117621765 | 4491225 |
| Plasmid lp32 (Accession number NC_008567) | hypothetical protein BAPKO_3522 | 14928 | 15380 | + | 150 | 117621766 | 4491226 |
| Plasmid lp32 (Accession number NC_008567) | hypothetical protein BAPKO_3523 | 15496 | 15654 | + | 52 | 117621767 | 4491227 |
| Plasmid lp32 (Accession number NC_008567) | hypothetical protein BAPKO_3524 | 15983 | 16051 | + | 22 | 117621768 | 4491228 |
| Plasmid lp32 (Accession number NC_008567) | hypothetical protein BAPKO_3525 | 16044 | 16397 | + | 117 | 117621769 | 4491229 |
| Plasmid lp32 (Accession number NC_008567) | hypothetical protein BAPKO_3526 | 16571 | 17122 | + | 183 | 117621770 | 4491230 |
| Plasmid lp32 (Accession number NC_008567) | hypothetical protein BAPKO_3527 | 16984 | 17187 | - | 67 | 117621771 | 4491184 |
| Plasmid lp32 (Accession number NC_008567) | hypothetical protein BAPKO_3528 | 17240 | 17329 | + | 29 | 117621772 | 4491185 |
| Plasmid lp32 (Accession number NC_008567) | hypothetical protein BAPKO_3529 | 17274 | 17435 | + | 53 | 117621773 | 4491186 |
| Plasmid lp32 (Accession number NC_008567) | hypothetical protein BAPKO_3530 | 17756 | 17926 | - | 56 | 117621774 | 4491187 |
| Plasmid lp32 (Accession number NC_008567) | hypothetical protein BAPKO_3531 | 17878 | 18561 | - | 227 | 117621775 | 4491188 |
| Plasmid lp32 (Accession number NC_008567) | hypothetical protein BAPKO_3532 | 18637 | 18795 | - | 52 | 117621776 | 4491189 |

Fig. 28 continued

| Plasmid lp32 (Accession number NC_008567) | hypothetical protein BAPKO_3533 | 19187 | 20278 | + | 363 | 117621777 | 4491190 |
|---|---|---|---|---|---|---|---|
| Plasmid lp32 (Accession number NC_008567) | hypothetical protein BAPKO_3534 | 20288 | 20845 | + | 185 | 117621778 | 4491191 |
| Plasmid lp32 (Accession number NC_008567) | hypothetical protein BAPKO_3535 | 20821 | 21576 | + | 251 | 117621779 | 4491192 |
| Plasmid lp32 (Accession number NC_008567) | hypothetical protein BAPKO_3536 | 21620 | 22180 | + | 186 | 117621780 | 4491193 |
| Plasmid lp32 (Accession number NC_008567) | hypothetical protein BAPKO_3537 | 22193 | 22444 | + | 83 | 117621781 | 4491194 |
| Plasmid lp32 (Accession number NC_008567) | hypothetical protein BAPKO_3538 | 22965 | 23087 | + | 40 | 117621782 | 4491195 |
| Plasmid lp32 (Accession number NC_008567) | hypothetical protein BAPKO_3539 | 23555 | 23836 | - | 93 | 117621783 | 4491196 |
| Plasmid lp32 (Accession number NC_008567) | hypothetical protein BAPKO_3540 | 23848 | 24291 | - | 147 | 117621784 | 4491197 |
| Plasmid lp32 (Accession number NC_008567) | hypothetical protein BAPKO_3541 | 24303 | 24521 | - | 72 | 117621785 | 4491198 |
| Plasmid lp32 (Accession number NC_008567) | outer surface protein D | 25555 | 26034 | + | 159 | 117621786 | 4491199 |
| Plasmid lp32 (Accession number NC_008567) | hypothetical protein BAPKO_3543 | 26148 | 26282 | + | 44 | 117621787 | 4491200 |
| Plasmid lp32 (Accession number NC_008567) | hypothetical protein BAPKO_3544 | 26530 | 26595 | - | 21 | 117621788 | 4491201 |
| Plasmid lp32 (Accession number NC_008567) | hypothetical protein BAPKO_3545 | 26598 | 26840 | - | 80 | 117621789 | 4491202 |
| Plasmid lp32 (Accession number NC_008567) | hypothetical protein BAPKO_3546 | 27551 | 27685 | - | 44 | 117621790 | 4491203 |

Fig. 28 continued

| Plasmid lp32 (Accession number NC_008567) | hypothetical protein BAPKO_3547 | 28099 | 28935 | + | 278 | 117621791 | 4491231 |
|---|---|---|---|---|---|---|---|
| Plasmid lp32 (Accession number NC_008567) | hypothetical protein BAPKO_3548 | 29331 | 29852 | - | 173 | 117621792 | 4491232 |
| Plasmid lp32 (Accession number NC_008567) | hypothetical protein BAPKO_3549 | 29895 | 30086 | - | 63 | 117621793 | 4491233 |
| Plasmid lp32 (Accession number NC_008567) | hypothetical protein BAPKO_3550 | 30228 | 30452 | + | 74 | 117621794 | 4491234 |
| Plasmid lp32 (Accession number NC_008567) | hypothetical protein BAPKO_3551 | 30445 | 30498 | + | 17 | 117621795 | 4491235 |
| Plasmid lp32 (Accession number NC_008567) | hypothetical protein BAPKO_3552 | 30521 | 30640 | + | 39 | 117621796 | 4491236 |
| Plasmid lp32 (Accession number NC_008567) | hypothetical protein BAPKO_3553 | 30809 | 31156 | + | 115 | 117621797 | 4491237 |
| Plasmid lp32 (Accession number NC_008567) | hypothetical protein BAPKO_3554 | 31215 | 31841 | + | 208 | 117621798 | 4491238 |
| Plasmid lp28 (Accession number NC_008568) | hypothetical protein BAPKO_4500 | 351 | 542 | - | 63 | 117621800 | 4491239 |
| Plasmid lp28 (Accession number NC_008568) | hypothetical protein BAPKO_4501 | 699 | 926 | - | 75 | 117621801 | 4491240 |
| Plasmid lp28 (Accession number NC_008568) | hypothetical protein BAPKO_4502 | 1398 | 1670 | - | 90 | 117621802 | 4491241 |
| Plasmid lp28 (Accession number NC_008568) | hypothetical protein BAPKO_4503 | 1661 | 2401 | - | 246 | 117621803 | 4491242 |
| Plasmid lp28 (Accession number NC_008568) | hypothetical protein BAPKO_4504 | 4910 | 5569 | + | 219 | 117621804 | 4491243 |
| Plasmid lp28 (Accession number NC_008568) | hypothetical protein BAPKO_4505 | 6396 | 7079 | + | 227 | 117621805 | 4491244 |

Fig. 28 continued

| | | | | | | | |
|---|---|---|---|---|---|---|---|
| Plasmid lp28 (Accession number NC_008568) | hypothetical protein BAPKO_4506 | 7231 | 7809 | - | 192 | 117621806 | 4491245 |
| Plasmid lp28 (Accession number NC_008568) | hypothetical protein BAPKO_4507 | 7986 | 8990 | + | 334 | 117621807 | 4491246 |
| Plasmid lp28 (Accession number NC_008568) | hypothetical protein BAPKO_4508 | 9140 | 9466 | + | 108 | 117621808 | 4491254 |
| Plasmid lp28 (Accession number NC_008568) | hypothetical protein BAPKO_4509 | 9622 | 10728 | + | 368 | 117621809 | 4491255 |
| Plasmid lp28 (Accession number NC_008568) | hypothetical protein BAPKO_4510 | 10600 | 10833 | - | 77 | 117621810 | 4491256 |
| Plasmid lp28 (Accession number NC_008568) | hypothetical protein BAPKO_4511 | 11681 | 11857 | + | 58 | 117621811 | 4491257 |
| Plasmid lp28 (Accession number NC_008568) | hypothetical protein BAPKO_4512 | 11916 | 12974 | + | 352 | 117621812 | 4491258 |
| Plasmid lp28 (Accession number NC_008568) | hypothetical protein BAPKO_4513 | 13919 | 14218 | + | 99 | 117621813 | 4491259 |
| Plasmid lp28 (Accession number NC_008568) | hypothetical protein BAPKO_4514 | 14600 | 15385 | - | 261 | 117621814 | 4491260 |
| Plasmid lp28 (Accession number NC_008568) | hypothetical protein BAPKO_4515 | 16400 | 17338 | - | 312 | 117621815 | 4491261 |
| Plasmid lp28 (Accession number NC_008568) | hypothetical protein BAPKO_4516 | 17467 | 17592 | + | 41 | 117621816 | 4491262 |
| Plasmid lp28 (Accession number NC_008568) | hypothetical protein BAPKO_4517 | 18068 | 18586 | - | 172 | 117621817 | 4491263 |
| Plasmid lp28 (Accession number NC_008568) | hypothetical protein BAPKO_4518 | 18866 | 18955 | + | 29 | 117621818 | 4491264 |
| Plasmid lp28 (Accession number NC_008568) | hypothetical protein BAPKO_4519 | 19045 | 19212 | + | 55 | 117621819 | 4491265 |

Fig. 28 continued

| Plasmid lp28 (Accession number NC_008568) | hypothetical protein BAPKO_4520 | 19406 | 20053 | + | 215 | 117621820 | 4491266 |
|---|---|---|---|---|---|---|---|
| Plasmid lp28 (Accession number NC_008568) | hypothetical protein BAPKO_4521 | 20238 | 20570 | - | 110 | 117621821 | 4491267 |
| Plasmid lp28 (Accession number NC_008568) | hypothetical protein BAPKO_4522 | 20905 | 22041 | + | 378 | 117621822 | 4491268 |
| Plasmid lp28 (Accession number NC_008568) | hypothetical protein BAPKO_4523 | 22127 | 22345 | - | 72 | 117621823 | 4491269 |
| Plasmid lp28 (Accession number NC_008568) | hypothetical protein BAPKO_4524 | 22338 | 22457 | - | 39 | 117621824 | 4491270 |
| Plasmid lp28 (Accession number NC_008568) | hypothetical protein BAPKO_4525 | 22828 | 22908 | + | 26 | 117621825 | 4491271 |
| Plasmid lp28 (Accession number NC_008568) | hypothetical protein BAPKO_4526 | 22903 | 23469 | - | 188 | 117621826 | 4491272 |
| Plasmid lp28 (Accession number NC_008568) | hypothetical protein BAPKO_4527 | 23475 | 23708 | - | 77 | 117621827 | 4491247 |
| Plasmid lp28 (Accession number NC_008568) | hypothetical protein BAPKO_4528 | 23953 | 24729 | + | 258 | 117621828 | 4491248 |
| Plasmid lp28 (Accession number NC_008568) | hypothetical protein BAPKO_4529 | 24757 | 25074 | + | 105 | 117621829 | 4491249 |
| Plasmid lp28 (Accession number NC_008568) | hypothetical protein BAPKO_4530 | 26091 | 26446 | - | 451 | 117621830 | 4491250 |
| Plasmid lp28 (Accession number NC_008568) | hypothetical protein BAPKO_4531 | 26427 | 27755 | - | 442 | 117621831 | 4491251 |
| Plasmid lp28 (Accession number NC_008568) | hypothetical protein BAPKO_4532 | 27974 | 28156 | - | 60 | 117621832 | 4491252 |
| Plasmid lp28 (Accession number NC_008568) | hypothetical protein BAPKO_4533 | 28389 | 28526 | - | 45 | 117621833 | 4491253 |

Fig. 28 continued

| | | | | | | | |
|---|---|---|---|---|---|---|---|
| Plasmid lp25 (Accession number NC_008569) | hypothetical protein BAPKO_5500 | 685 | 1254 | - | 189 | 117621835 | 4491275 |
| Plasmid lp25 (Accession number NC_008569) | hypothetical protein BAPKO_5501 | 1351 | 2727 | - | 458 | 117621836 | 4491276 |
| Plasmid lp25 (Accession number NC_008569) | hypothetical protein BAPKO_5502 | 2747 | 3385 | - | 212 | 117621837 | 4491277 |
| Plasmid lp25 (Accession number NC_008569) | hypothetical protein BAPKO_5503 | 3469 | 3903 | - | 144 | 117621838 | 4491278 |
| Plasmid lp25 (Accession number NC_008569) | hypothetical protein BAPKO_5504 | 3928 | 5292 | - | 454 | 117621839 | 4491279 |
| Plasmid lp25 (Accession number NC_008569) | hypothetical protein BAPKO_5505 | 5658 | 6032 | + | 124 | 117621840 | 4491280 |
| Plasmid lp25 (Accession number NC_008569) | hypothetical protein BAPKO_5506 | 6025 | 6471 | + | 148 | 117621841 | 4491281 |
| Plasmid lp25 (Accession number NC_008569) | hypothetical protein BAPKO_5507 | 6497 | 6829 | + | 110 | 117621842 | 4491282 |
| Plasmid lp25 (Accession number NC_008569) | hypothetical protein BAPKO_5508 | 6842 | 9544 | + | 900 | 117621843 | 4491283 |
| Plasmid lp25 (Accession number NC_008569) | hypothetical protein BAPKO_5509 | 9544 | 10374 | + | 276 | 117621844 | 4491284 |
| Plasmid lp25 (Accession number NC_008569) | hypothetical protein BAPKO_5510 | 10383 | 10721 | + | 112 | 117621845 | 4491285 |
| Plasmid lp25 (Accession number NC_008569) | hypothetical protein BAPKO_5511 | 10738 | 11130 | + | 130 | 117621846 | 4491286 |
| Plasmid lp25 (Accession number NC_008569) | hypothetical protein BAPKO_5512 | 11127 | 11570 | + | 147 | 117621847 | 4491287 |
| Plasmid lp25 (Accession number NC_008569) | hypothetical protein BAPKO_5513 | 11560 | 12378 | + | 272 | 117621848 | 4491288 |

Fig. 28 continued

| | | | | | | | |
|---|---|---|---|---|---|---|---|
| Plasmid lp25 (Accession number NC_008569) | hypothetical protein BAPKO_5514 | 12399 | 12827 | + | 142 | 117621849 | 4491289 |
| Plasmid lp25 (Accession number NC_008569) | hypothetical protein BAPKO_5515 | 12917 | 13114 | + | 65 | 117621850 | 4491290 |
| Plasmid lp25 (Accession number NC_008569) | hypothetical protein BAPKO_5516 | 13111 | 14988 | + | 625 | 117621851 | 4491291 |
| Plasmid lp25 (Accession number NC_008569) | hypothetical protein BAPKO_5517 | 15006 | 15458 | + | 150 | 117621852 | 4491292 |
| Plasmid lp25 (Accession number NC_008569) | hypothetical protein BAPKO_5518 | 15487 | 15564 | + | 25 | 117621853 | 4491293 |
| Plasmid lp25 (Accession number NC_008569) | hypothetical protein BAPKO_5519 | 15565 | 16116 | + | 183 | 117621854 | 4491294 |
| Plasmid lp25 (Accession number NC_008569) | hypothetical protein BAPKO_5520 | 16514 | 17086 | + | 190 | 117621855 | 4491295 |
| Plasmid lp25 (Accession number NC_008569) | hypothetical protein BAPKO_5521 | 17236 | 17775 | + | 179 | 117621856 | 4491296 |
| Plasmid lp25 (Accession number NC_008569) | hypothetical protein BAPKO_5522 | 17751 | 18512 | + | 253 | 117621857 | 4491297 |
| Plasmid lp25 (Accession number NC_008569) | hypothetical protein BAPKO_5523 | 18584 | 19141 | + | 185 | 117621858 | 4491298 |
| Plasmid lp25 (Accession number NC_008569) | hypothetical protein BAPKO_5524 | 19296 | 19838 | - | 180 | 117621859 | 4491299 |
| Plasmid lp25 (Accession number NC_008569) | hypothetical protein BAPKO_5525 | 19869 | 20411 | - | 180 | 117621860 | 4491300 |
| Plasmid lp25 (Accession number NC_008569) | hypothetical protein BAPKO_5526 | 20545 | 22722 | + | 725 | 117621861 | 4491301 |
| Plasmid lp25 (Accession number NC_008569) | hypothetical protein BAPKO_5527 | 22650 | 23780 | + | 376 | 117621862 | 4491273 |

Fig. 28 continued

| | | | | | | | |
|---|---|---|---|---|---|---|---|
| Plasmid lp25 (Accession number NC_008569) | hypothetical protein BAPKO_5528 | 23844 | 24347 | - | 167 | 117621863 | 4491274 |
| Complete genome (Accession number NC_008277) | hypothetical protein BAPKO_0001 | 531 | 1550 | - | 339 | 111114824 | 4227028 |
| Complete genome (Accession number NC_008277) | hypothetical protein BAPKO_0002 | 1538 | 3013 | - | 491 | 111114825 | 4227029 |
| Complete genome (Accession number NC_008277) | phosphoglucomutase | 3156 | 4946 | + | 596 | 111114826 | 4227030 |
| Complete genome (Accession number NC_008277) | tryptophanyl-tRNA synthetase | 5023 | 6069 | - | 348 | 111114827 | 4227031 |
| Complete genome (Accession number NC_008277) | hypothetical protein BAPKO_0005 | 6072 | 7160 | - | 362 | 111114828 | 4227032 |
| Complete genome (Accession number NC_008277) | hypothetical protein BAPKO_0006 | 7218 | 8075 | - | 285 | 111114829 | 4227033 |
| Complete genome (Accession number NC_008277) | hypothetical protein BAPKO_0007 | 8184 | 8954 | + | 256 | 111114830 | 4227034 |
| Complete genome (Accession number NC_008277) | hypothetical protein BAPKO_0008 | 8959 | 9963 | + | 334 | 111114831 | 4227174 |
| Complete genome (Accession number NC_008277) | holo-acyl-carrier protein synthase, putative | 9960 | 10334 | + | 124 | 111114832 | 4227175 |
| Complete genome (Accession number NC_008277) | hypothetical protein BAPKO_0010 | 10338 | 11177 | + | 279 | 111114833 | 4227176 |
| Complete genome (Accession | tRNA pseudouridine synthase A | 11178 | 11918 | + | 246 | 111114834 | 4227177 |

Fig. 28 continued

| | | | | | | | |
|---|---|---|---|---|---|---|---|
| number NC_008277) | | | | | | | |
| Complete genome (Accession number NC_008277) | hypothetical protein BAPKO_0012 | 11911 | 12510 | + | 199 | 111114835 | 4227178 |
| Complete genome (Accession number NC_008277) | primosomal protein N | 12503 | 14494 | + | 663 | 111114836 | 4227179 |
| Complete genome (Accession number NC_008277) | uridine kinase | 14491 | 15114 | - | 207 | 111114837 | 4227180 |
| Complete genome (Accession number NC_008277) | glpE protein | 15114 | 15486 | - | 124 | 111114838 | 4227181 |
| Complete genome (Accession number NC_008277) | hypothetical protein BAPKO_0016 | 15616 | 16590 | + | 324 | 111114839 | 4227182 |
| Complete genome (Accession number NC_008277) | hypothetical protein BAPKO_0017 | 16587 | 17567 | - | 326 | 111114840 | 4227183 |
| Complete genome (Accession number NC_008277) | hypothetical protein BAPKO_0018 | 17574 | 18086 | - | 170 | 111114841 | 4227184 |
| Complete genome (Accession number NC_008277) | diphosphate--fructose-6-phosphate 1-phosphotransferase | 18094 | 19761 | - | 555 | 111114842 | 4227185 |
| Complete genome (Accession number NC_008277) | S-adenosylmethionine:tRNA ribosyltransferase-isomerase | 19841 | 20881 | - | 346 | 111114843 | 4227186 |
| Complete genome (Accession number NC_008277) | Holliday junction DNA helicase B | 20856 | 21899 | - | 347 | 111114844 | 4227187 |
| Complete genome (Accession number number | Holliday junction DNA helicase | 21959 | 22549 | - | 196 | 111114845 | 4227188 |

Fig. 28 continued

| | | | | | | | |
|---|---|---|---|---|---|---|---|
| NC_008277) | | | | | | | |
| Complete genome (Accession number NC_008277) | hypothetical protein BAPKO_0023 | 22619 | 23758 | + | 379 | 111114846 | 4227189 |
| Complete genome (Accession number NC_008277) | hypothetical protein BAPKO_0024 | 23773 | 24504 | - | 243 | 111114847 | 4227190 |
| Complete genome (Accession number NC_008277) | methylenetetrahydrofolate dehydrogenase | 24505 | 25410 | - | 301 | 111114848 | 4227191 |
| Complete genome (Accession number NC_008277) | hypothetical protein BAPKO_0026 | 25557 | 26192 | + | 211 | 111114849 | 4227192 |
| Complete genome (Accession number NC_008277) | lipoprotein, putative | 26200 | 27249 | + | 349 | 111114850 | 4227035 |
| Complete genome (Accession number NC_008277) | hypothetical protein BAPKO_0028 | 27235 | 27666 | - | 143 | 111114851 | 4227036 |
| Complete genome (Accession number NC_008277) | signal peptidase I | 27656 | 28291 | - | 211 | 111114852 | 4227037 |
| Complete genome (Accession number NC_008277) | signal peptidase I | 28293 | 29273 | - | 326 | 111114853 | 4227038 |
| Complete genome (Accession number NC_008277) | hypothetical protein BAPKO_0031 | 29344 | 30807 | + | 487 | 111114854 | 4227039 |
| Complete genome (Accession number NC_008277) | SsrA-binding protein | 30810 | 31262 | + | 150 | 111114855 | 4227040 |
| Complete genome (Accession number number | hypothetical protein BAPKO_0033 | 31133 | 31285 | - | 50 | 111114856 | 4227041 |

Fig. 28 continued

| | | | | | | | |
|---|---|---|---|---|---|---|---|
| NC_008277) | | | | | | | |
| Complete genome (Accession number NC_008277) | hypothetical protein BAPKO_0034 | 31344 | 31880 | - | 178 | 111114857 | 4227042 |
| Complete genome (Accession number NC_008277) | DNA topoisomerase IV subunit A | 31948 | 33828 | - | 626 | 111114858 | 4227043 |
| Complete genome (Accession number NC_008277) | DNA topoisomerase IV subunit B | 33828 | 35627 | - | 599 | 111114859 | 4227044 |
| Complete genome (Accession number NC_008277) | 1-acyl-sn-glycerol-3-phosphate acyltransferase | 35648 | 36385 | - | 245 | 111114860 | 4227045 |
| Complete genome (Accession number NC_008277) | hypothetical protein BAPKO_0038 | 36394 | 37917 | - | 507 | 111114861 | 4227046 |
| Complete genome (Accession number NC_008277) | hypothetical protein BAPKO_0039 | 37930 | 39432 | - | 500 | 111114862 | 4227047 |
| Complete genome (Accession number NC_008277) | chemotaxis protein methyltransferase | 39622 | 40479 | + | 285 | 111114863 | 4227048 |
| Complete genome (Accession number NC_008277) | phosphate transport system regulatory protein | 40544 | 41215 | - | 223 | 111114864 | 4227049 |
| Complete genome (Accession number NC_008277) | hypothetical protein BAPKO_0042 | 41226 | 42260 | - | 344 | 111114865 | 4227050 |
| Complete genome (Accession number NC_008277) | hypothetical protein BAPKO_0043 | 42257 | 42658 | - | 133 | 111114866 | 4227051 |
| Complete genome (Accession number | P115 protein | 42684 | 45134 | - | 816 | 111114867 | 4227052 |

Fig. 28 continued

| | | | | | | | |
|---|---|---|---|---|---|---|---|
| NC_008277) | | | | | | | |
| Complete genome (Accession number NC_008277) | ribonuclease H | 45227 | 45772 | + | 181 | 111114868 | 4227053 |
| Complete genome (Accession number NC_008277) | hypothetical protein BAPKO_0047 | 45790 | 46161 | - | 123 | 111114869 | 4227054 |
| Complete genome (Accession number NC_008277) | hypothetical protein BAPKO_0049 | 46695 | 46814 | - | 39 | 111114870 | 4227592 |
| Complete genome (Accession number NC_008277) | hypothetical protein BAPKO_0050 | 46933 | 47607 | + | 224 | 111114871 | 4227593 |
| Complete genome (Accession number NC_008277) | hypothetical protein BAPKO_0051 | 47654 | 48373 | + | 239 | 111114872 | 4227594 |
| Complete genome (Accession number NC_008277) | spoU protein | 48370 | 49038 | - | 222 | 111114873 | 4227595 |
| Complete genome (Accession number NC_008277) | uracil-DNA glycosylase | 49108 | 49779 | + | 223 | 111114874 | 4227596 |
| Complete genome (Accession number NC_008277) | preprotein translocase subunit SecG | 49853 | 50215 | - | 120 | 111114875 | 4227597 |
| Complete genome (Accession number NC_008277) | triosephosphate isomerase | 50231 | 50992 | - | 253 | 111114876 | 4227598 |
| Complete genome (Accession number NC_008277) | phosphoglycerate kinase | 50994 | 52175 | - | 393 | 111114877 | 4227599 |
| Complete genome (Accession number NC_008277) | glyceraldehyde 3-phosphate dehydrogenase | 52200 | 53207 | - | 335 | 111114878 | 4227600 |

Fig. 28 continued

| | | | | | | | |
|---|---|---|---|---|---|---|---|
| Complete genome (Accession number NC_008277) | hypothetical protein BAPKO_0058 | 53282 | 55252 | - | 656 | 111114879 | 4227601 |
| Complete genome (Accession number NC_008277) | hemolysin | 55249 | 56028 | - | 259 | 111114880 | 4227602 |
| Complete genome (Accession number NC_008277) | hypothetical protein BAPKO_0060 | 56029 | 56487 | - | 152 | 111114881 | 4227603 |
| Complete genome (Accession number NC_008277) | thioredoxin | 56570 | 56923 | - | 117 | 111114882 | 4227604 |
| Complete genome (Accession number NC_008277) | hypothetical protein BAPKO_0062 | 56997 | 57713 | + | 238 | 111114883 | 4227605 |
| Complete genome (Accession number NC_008277) | hypothetical protein BAPKO_0063 | 57764 | 58771 | - | 335 | 111114884 | 4227606 |
| Complete genome (Accession number NC_008277) | methionyl-tRNA formyltransferase | 58821 | 59768 | - | 315 | 111114885 | 4227607 |
| Complete genome (Accession number NC_008277) | polypeptide deformylase | 59765 | 60262 | - | 165 | 111114886 | 4227608 |
| Complete genome (Accession number NC_008277) | hypothetical protein BAPKO_0066 | 60269 | 60322 | - | 17 | 111114887 | 4227722 |
| Complete genome (Accession number NC_008277) | hypothetical protein BAPKO_0067 | 60295 | 60981 | - | 228 | 111114888 | 4227723 |
| Complete genome (Accession number NC_008277) | peptidase, putative | 60978 | 62756 | - | 592 | 111114889 | 4227724 |

Fig. 28 continued

| | | | | | | | |
|---|---|---|---|---|---|---|---|
| Complete genome (Accession number NC_008277) | hypothetical protein BAPKO_0069 | 62871 | 63779 | + | 302 | 111114890 | 4227725 |
| Complete genome (Accession number NC_008277) | aminopeptidase II | 63764 | 65002 | + | 412 | 111114891 | 4227726 |
| Complete genome (Accession number NC_008277) | hypothetical protein BAPKO_0071 | 65017 | 65478 | + | 153 | 111114892 | 4227727 |
| Complete genome (Accession number NC_008277) | hypothetical protein BAPKO_0072 | 65495 | 66967 | + | 490 | 111114893 | 4227728 |
| Complete genome (Accession number NC_008277) | hypothetical protein BAPKO_0073 | 66975 | 69293 | + | 772 | 111114894 | 4227729 |
| Complete genome (Accession number NC_008277) | hypothetical protein BAPKO_0074 | 69290 | 69850 | + | 186 | 111114895 | 4227730 |
| Complete genome (Accession number NC_008277) | peptide chain release factor 2 | 70134 | 70943 | + | 269 | 111114896 | 4227731 |
| Complete genome (Accession number NC_008277) | hypothetical protein BAPKO_0076 | 70925 | 72334 | + | 469 | 111114897 | 4227732 |
| Complete genome (Accession number NC_008277) | signal recognition particle-docking protein FtsY | 72371 | 73216 | + | 281 | 111114898 | 4227733 |
| Complete genome (Accession number NC_008277) | hypothetical protein BAPKO_0078 | 73213 | 74241 | + | 342 | 111114899 | 4227734 |
| Complete genome (Accession number NC_008277) | hypothetical protein BAPKO_0079 | 74242 | 75495 | + | 417 | 111114900 | 4227735 |

Fig. 28 continued

| | | | | | | | |
|---|---|---|---|---|---|---|---|
| Complete genome (Accession number NC_008277) | ABC transporter, ATP-binding protein | 75485 | 76177 | + | 230 | 111114901 | 4227736 |
| Complete genome (Accession number NC_008277) | hypothetical protein BAPKO_0081 | 76174 | 77427 | + | 417 | 111114902 | 4227737 |
| Complete genome (Accession number NC_008277) | hypothetical protein BAPKO_0082 | 77438 | 78733 | - | 431 | 111114903 | 4227738 |
| Complete genome (Accession number NC_008277) | hypothetical protein BAPKO_0083 | 78726 | 79046 | - | 106 | 111114904 | 4227829 |
| Complete genome (Accession number NC_008277) | nifS protein | 79231 | 80499 | + | 422 | 111114905 | 4227424 |
| Complete genome (Accession number NC_008277) | hypothetical protein BAPKO_0085 | 80709 | 81137 | + | 142 | 111114906 | 4227425 |
| Complete genome (Accession number NC_008277) | hypothetical protein BAPKO_0086 | 81134 | 82669 | + | 511 | 111114907 | 4227333 |
| Complete genome (Accession number NC_008277) | hypothetical protein BAPKO_0087 | 82507 | 82698 | - | 63 | 111114908 | 4227334 |
| Complete genome (Accession number NC_008277) | L-lactate dehydrogenase | 82699 | 83649 | - | 316 | 111114909 | 4227335 |
| Complete genome (Accession number NC_008277) | GTP-binding protein LepA | 83770 | 85575 | - | 601 | 111114910 | 4227336 |
| Complete genome (Accession number NC_008277) | hypothetical protein BAPKO_0090 | 85609 | 86571 | - | 320 | 111114911 | 4227337 |

Fig. 28 continued

| | | | | | | | |
|---|---|---|---|---|---|---|---|
| Complete genome (Accession number NC_008277) | V-type ATP synthase subunit K | 86658 | 87092 | - | 144 | 111114912 | 4227338 |
| Complete genome (Accession number NC_008277) | V-type ATP synthase subunit I | 87109 | 88962 | - | 617 | 111114913 | 4227339 |
| Complete genome (Accession number NC_008277) | V-type ATP synthase subunit D | 88946 | 89545 | - | 199 | 111114914 | 4227340 |
| Complete genome (Accession number NC_008277) | V-type ATP synthase subunit B | 89548 | 90852 | - | 434 | 111114915 | 4227341 |
| Complete genome (Accession number NC_008277) | V-type ATP synthase subunit A | 90874 | 92628 | - | 584 | 111114916 | 4227342 |
| Complete genome (Accession number NC_008277) | hypothetical protein BAPKO_0096 | 92615 | 93157 | - | 180 | 111114917 | 4227343 |
| Complete genome (Accession number NC_008277) | V-type ATP synthase subunit E | 93170 | 93769 | - | 199 | 111114918 | 4227344 |
| Complete genome (Accession number NC_008277) | hypothetical protein BAPKO_0098 | 93955 | 94341 | - | 128 | 111114919 | 4227345 |
| Complete genome (Accession number NC_008277) | DNA mismatch repair protein, putative | 94347 | 96683 | - | 778 | 111114920 | 4227346 |
| Complete genome (Accession number NC_008277) | hypothetical protein BAPKO_0100 | 96673 | 97596 | - | 307 | 111114921 | 4227347 |
| Complete genome (Accession number NC_008277) | glutamate racemase | 97593 | 98378 | - | 261 | 111114922 | 4227348 |

Fig. 28 continued

| | | | | | | | |
|---|---|---|---|---|---|---|---|
| Complete genome (Accession number NC_008277) | asparaginyl-tRNA synthetase | 98540 | 99928 | + | 462 | 111114923 | 4227349 |
| Complete genome (Accession number NC_008277) | hypothetical protein BAPKO_0103 | 99951 | 100472 | + | 173 | 111114924 | 4227350 |
| Complete genome (Accession number NC_008277) | hypothetical protein BAPKO_0104 | 100469 | 101062 | - | 197 | 111114925 | 4227351 |
| Complete genome (Accession number NC_008277) | periplasmic serine protease DO | 101193 | 102617 | - | 474 | 111114926 | 4227385 |
| Complete genome (Accession number NC_008277) | methionine aminopeptidase | 102684 | 103439 | - | 251 | 111114927 | 4227386 |
| Complete genome (Accession number NC_008277) | hypothetical protein BAPKO_0107 | 103432 | 105099 | - | 555 | 111114928 | 4227387 |
| Complete genome (Accession number NC_008277) | transcription antitermination protein NusB | 105101 | 105514 | - | 137 | 111114929 | 4227388 |
| Complete genome (Accession number NC_008277) | basic membrane protein | 105551 | 106561 | - | 336 | 111114930 | 4227389 |
| Complete genome (Accession number NC_008277) | acetyl-CoA C-acetyltransferase | 106639 | 107832 | - | 397 | 111114931 | 4227390 |
| Complete genome (Accession number NC_008277) | hypothetical protein BAPKO_0111 | 107947 | 109311 | + | 454 | 111114932 | 4227391 |
| Complete genome (Accession number NC_008277) | replicative DNA helicase | 109328 | 110695 | - | 455 | 111114933 | 4227392 |

Fig. 28 continued

| | | | | | | | |
|---|---|---|---|---|---|---|---|
| Complete genome (Accession number NC_008277) | 50S ribosomal protein L9 | 110699 | 111220 | - | 173 | 111114934 | 4227393 |
| Complete genome (Accession number NC_008277) | 30S ribosomal protein S18 | 111237 | 111527 | - | 96 | 111114935 | 4227394 |
| Complete genome (Accession number NC_008277) | single-stranded DNA-binding protein | 111542 | 111991 | - | 149 | 111114936 | 4227395 |
| Complete genome (Accession number NC_008277) | 30S ribosomal protein S6 | 112003 | 112422 | - | 139 | 111114937 | 4227396 |
| Complete genome (Accession number NC_008277) | PTS system, maltose and glucose-specific IIABC component | 112561 | 114255 | - | 564 | 111114938 | 4227397 |
| Complete genome (Accession number NC_008277) | hemolysin III | 114457 | 115158 | + | 233 | 111114939 | 4227398 |
| Complete genome (Accession number NC_008277) | zinc protease, putative | 115155 | 116456 | - | 433 | 111114940 | 4227399 |
| Complete genome (Accession number NC_008277) | phosphatidate cytidylyltransferase | 116478 | 117320 | - | 280 | 111114941 | 4227400 |
| Complete genome (Accession number NC_008277) | undecaprenyl diphosphate synthase | 117325 | 118017 | - | 230 | 111114942 | 4227401 |
| Complete genome (Accession number NC_008277) | ribosome releasing factor | 118023 | 118577 | - | 184 | 111114943 | 4227402 |
| Complete genome (Accession number NC_008277) | elongation factor Ts | 118615 | 119454 | - | 279 | 111114944 | 4227403 |

Fig. 28 continued

| Complete genome (Accession number NC_008277) | 30S ribosomal protein S2 | 119451 | 120224 | - | 257 | 111114945 | 4227404 |
|---|---|---|---|---|---|---|---|
| Complete genome (Accession number NC_008277) | hypothetical protein BAPKO_0125 | 120452 | 120730 | - | 92 | 111114946 | 4227366 |
| Complete genome (Accession number NC_008277) | hypothetical protein BAPKO_0126 | 120561 | 120740 | - | 59 | 111114947 | 4227367 |
| Complete genome (Accession number NC_008277) | hypothetical protein BAPKO_0127 | 120749 | 121390 | - | 213 | 111114948 | 4227368 |
| Complete genome (Accession number NC_008277) | hypothetical protein BAPKO_0128 | 121531 | 122142 | - | 203 | 111114949 | 4227369 |
| Complete genome (Accession number NC_008277) | 30S ribosomal protein S1 | 122142 | 123797 | - | 551 | 111114950 | 4227370 |
| Complete genome (Accession number NC_008277) | cytidylate kinase | 123800 | 124465 | - | 221 | 111114951 | 4227371 |
| Complete genome (Accession number NC_008277) | hypothetical protein BAPKO_0131 | 124449 | 125198 | - | 249 | 111114952 | 4227372 |
| Complete genome (Accession number NC_008277) | hypothetical protein BAPKO_0132 | 125185 | 125949 | - | 254 | 111114953 | 4227373 |
| Complete genome (Accession number NC_008277) | recombinase A | 125964 | 127061 | - | 365 | 111114954 | 4227374 |
| Complete genome (Accession number NC_008277) | transcript cleavage factor/unknown domain fusion protein | 127075 | 129777 | - | 900 | 111114955 | 4227375 |

Fig. 28 continued

| | | | | | | | |
|---|---|---|---|---|---|---|---|
| Complete genome (Accession number NC_008277) | hypothetical protein BAPKO_0135 | 129814 | 130758 | - | 314 | 111114956 | 4227376 |
| Complete genome (Accession number NC_008277) | hypothetical protein BAPKO_0136 | 130943 | 132070 | + | 375 | 111114957 | 4227377 |
| Complete genome (Accession number NC_008277) | histidyl-tRNA synthetase | 132115 | 133485 | - | 456 | 111114958 | 4227378 |
| Complete genome (Accession number NC_008277) | penicillin-binding protein | 133618 | 135504 | + | 628 | 111114959 | 4227379 |
| Complete genome (Accession number NC_008277) | long-chain-fatty-acid CoA ligase | 135505 | 137397 | - | 630 | 111114960 | 4227380 |
| Complete genome (Accession number NC_008277) | hypothetical protein BAPKO_0140 | 137747 | 137875 | - | 42 | 111114961 | 4227381 |
| Complete genome (Accession number NC_008277) | hypothetical protein BAPKO_0141 | 137875 | 138261 | - | 128 | 111114962 | 4227382 |
| Complete genome (Accession number NC_008277) | acriflavine resistance protein | 138185 | 141397 | - | 1070 | 111114963 | 4227383 |
| Complete genome (Accession number NC_008277) | membrane fusion protein | 141416 | 142369 | - | 317 | 111114964 | 4227384 |
| Complete genome (Accession number NC_008277) | hypothetical protein BAPKO_0144 | 142381 | 143616 | - | 411 | 111114965 | 4227426 |
| Complete genome (Accession number NC_008277) | hypothetical protein BAPKO_0145 | 143745 | 144035 | + | 96 | 111114966 | 4227427 |

Fig. 28 continued

| | | | | | | | |
|---|---|---|---|---|---|---|---|
| Complete genome (Accession number NC_008277) | glycine betaine, L-proline ABC transporter, binding protein | 144024 | 144908 | - | 294 | 111114967 | 4227428 |
| Complete genome (Accession number NC_008277) | glycine betaine, L-proline ABC transporter, permease protein | 144923 | 145822 | - | 299 | 111114968 | 4227429 |
| Complete genome (Accession number NC_008277) | glycine betaine, L-proline ABC transporter, ATP-binding protein | 145829 | 146947 | - | 372 | 111114969 | 4227430 |
| Complete genome (Accession number NC_008277) | flagellin | 147100 | 148110 | - | 336 | 111114970 | 4227431 |
| Complete genome (Accession number NC_008277) | flagellar hook-associated protein FliD | 148233 | 150230 | - | 665 | 111114971 | 4227432 |
| Complete genome (Accession number NC_008277) | N-acetylglucosamine-6-phosphate deacetylase | 150413 | 151618 | + | 401 | 111114972 | 4227433 |
| Complete genome (Accession number NC_008277) | glucosamine-6-phosphate deaminase | 151645 | 152451 | + | 268 | 111114973 | 4227434 |
| Complete genome (Accession number NC_008277) | superoxide dismutase | 152514 | 153125 | - | 203 | 111114974 | 4227435 |
| Complete genome (Accession number NC_008277) | preprotein translocase subunit SecA | 153140 | 155839 | - | 899 | 111114975 | 4227436 |
| Complete genome (Accession number NC_008277) | lipoprotein, putative | 155909 | 157045 | + | 378 | 111114976 | 4227437 |
| Complete genome (Accession number NC_008277) | hypothetical protein BAPKO_0157 | 157074 | 157502 | + | 142 | 111114977 | 4227438 |

Fig. 28 continued

| Complete genome (Accession number NC_008277) | hypothetical protein BAPKO_0158 | 157506 | 157922 | + | 138 | 111114978 | 4227439 |
|---|---|---|---|---|---|---|---|
| Complete genome (Accession number NC_008277) | antigen, S2, putative | 158071 | 158805 | + | 244 | 111114979 | 4227440 |
| Complete genome (Accession number NC_008277) | antigen S2-related protein | 158832 | 159506 | + | 224 | 111114980 | 4227441 |
| Complete genome (Accession number NC_008277) | alanine racemase | 159571 | 160671 | + | 366 | 111114981 | 4227442 |
| Complete genome (Accession number NC_008277) | hypothetical protein BAPKO_0162 | 160663 | 162264 | - | 533 | 111114982 | 4227443 |
| Complete genome (Accession number NC_008277) | hypothetical protein BAPKO_0163 | 162340 | 162507 | + | 55 | 111114983 | 4227444 |
| Complete genome (Accession number NC_008277) | hypothetical protein BAPKO_0164 | 162535 | 164263 | - | 582 | 111114984 | 4227445 |
| Complete genome (Accession number NC_008277) | Na+/Ca+ exchange protein, putative | 164363 | 165349 | - | 328 | 111114985 | 4227092 |
| Complete genome (Accession number NC_008277) | hypothetical protein BAPKO_0166 | 165377 | 167215 | - | 612 | 111114986 | 4227093 |
| Complete genome (Accession number NC_008277) | 4-alpha-glucanotransferase | 167341 | 168861 | - | 506 | 111114987 | 4227094 |
| Complete genome (Accession number NC_008277) | outer membrane protein | 169002 | 170171 | + | 389 | 111114988 | 4227095 |

Fig. 28 continued

| Complete genome (Accession number NC_008277) | hypothetical protein BAPKO_0169 | 170160 | 170237 | - | 25 | 111114989 | 4227096 |
|---|---|---|---|---|---|---|---|
| Complete genome (Accession number NC_008277) | dnaK suppressor, putative | 170182 | 170559 | - | 125 | 111114990 | 4227097 |
| Complete genome (Accession number NC_008277) | translation initiation factor IF-1 | 170725 | 170946 | + | 73 | 111114991 | 4227098 |
| Complete genome (Accession number NC_008277) | hypothetical protein BAPKO_0172 | 170994 | 173000 | - | 668 | 111114992 | 4227099 |
| Complete genome (Accession number NC_008277) | hypothetical protein BAPKO_0173 | 172994 | 173581 | - | 195 | 111114993 | 4227100 |
| Complete genome (Accession number NC_008277) | hypothetical protein BAPKO_0174 | 173563 | 174603 | - | 346 | 111114994 | 4227101 |
| Complete genome (Accession number NC_008277) | hypothetical protein BAPKO_0175 | 174546 | 175547 | - | 333 | 111114995 | 4227102 |
| Complete genome (Accession number NC_008277) | hypothetical protein BAPKO_0176 | 175534 | 176433 | - | 299 | 111114996 | 4227103 |
| Complete genome (Accession number NC_008277) | hypothetical protein BAPKO_0177 | 176437 | 177312 | - | 291 | 111114997 | 4227104 |
| Complete genome (Accession number NC_008277) | MoxR-related protein | 177326 | 178318 | - | 330 | 111114998 | 4227105 |
| Complete genome (Accession number NC_008277) | glucose inhibited division protein B | 178375 | 179001 | - | 208 | 111114999 | 4227106 |

Fig. 28 continued

| | | | | | | | |
|---|---|---|---|---|---|---|---|
| Complete genome (Accession number NC_008277) | tRNA uridine 5-carboxymethylaminomethyl modification enzyme GidA | 178998 | 180863 | - | 621 | 111115000 | 4227617 |
| Complete genome (Accession number NC_008277) | tRNA modification GTPase TrmE | 180866 | 182260 | - | 464 | 111115001 | 4227959 |
| Complete genome (Accession number NC_008277) | flagellar protein, putative | 182343 | 182837 | + | 164 | 111115002 | 4227960 |
| Complete genome (Accession number NC_008277) | flagellar hook-associated protein FlgK | 182849 | 184732 | + | 627 | 111115003 | 4227961 |
| Complete genome (Accession number NC_008277) | flagellar hook-associated protein FlgL | 184735 | 186009 | + | 424 | 111115004 | 4227783 |
| Complete genome (Accession number NC_008277) | flagellar assembly protein FliW | 186011 | 186409 | + | 132 | 111115005 | 4227784 |
| Complete genome (Accession number NC_008277) | carbon storage regulator | 186412 | 186657 | + | 81 | 111115006 | 4227785 |
| Complete genome (Accession number NC_008277) | hypothetical protein BAPKO_0187 | 186641 | 187294 | - | 217 | 111115007 | 4227786 |
| Complete genome (Accession number NC_008277) | hypothetical protein BAPKO_0188 | 187287 | 187700 | - | 137 | 111115008 | 4227787 |
| Complete genome (Accession number NC_008277) | hypothetical protein BAPKO_0189 | 187697 | 187957 | - | 86 | 111115009 | 4227788 |
| Complete genome (Accession number NC_008277) | hypothetical protein BAPKO_0190 | 188164 | 188295 | + | 43 | 111115010 | 4227789 |

Fig. 28 continued

| | | | | | | | |
|---|---|---|---|---|---|---|---|
| Complete genome (Accession number NC_008277) | 50S ribosomal protein L20 | 1881 72 | 1885 19 | - | 115 | 111115011 | 4227790 |
| Complete genome (Accession number NC_008277) | 50S ribosomal protein L35 | 1885 40 | 1887 40 | - | 66 | 111115012 | 4227791 |
| Complete genome (Accession number NC_008277) | translation initiation factor IF-3 | 1887 63 | 1893 23 | - | 186 | 111115013 | 4227792 |
| Complete genome (Accession number NC_008277) | hypothetical protein BAPKO_0194 | 1895 17 | 1901 70 | + | 217 | 111115014 | 4227793 |
| Complete genome (Accession number NC_008277) | lipoprotein, putative | 1901 57 | 1909 12 | + | 251 | 111115015 | 4227794 |
| Complete genome (Accession number NC_008277) | hypothetical protein BAPKO_0196 | 1909 68 | 1917 74 | - | 268 | 111115016 | 4227795 |
| Complete genome (Accession number NC_008277) | hypothetical protein BAPKO_0197 | 1917 74 | 1929 13 | - | 379 | 111115017 | 4227796 |
| Complete genome (Accession number NC_008277) | peptide chain release factor 1 | 1932 51 | 1943 24 | + | 357 | 111115018 | 4227797 |
| Complete genome (Accession number NC_008277) | HemK family methylase, putative | 1943 27 | 1951 48 | + | 273 | 111115019 | 4227798 |
| Complete genome (Accession number NC_008277) | guanosine-3,5-bis(diphosphate) 3-pyrophosphohydrolase | 1951 45 | 1971 46 | + | 667 | 111115020 | 4227799 |
| Complete genome (Accession number NC_008277) | hypothetical protein BAPKO_0201 | 1971 38 | 1993 99 | + | 753 | 111115021 | 4227800 |

Fig. 28 continued

| Complete genome (Accession number NC_008277) | hypothetical protein BAPKO_0202 | 199344 | 199454 | - | 36 | 111115022 | 4227801 |
|---|---|---|---|---|---|---|---|
| Complete genome (Accession number NC_008277) | D-alanine--D-alanine ligase | 199396 | 200481 | - | 361 | 111115023 | 4227802 |
| Complete genome (Accession number NC_008277) | UDP-N-acetylmuramoyl alanyl-D-glutamate--2,6-diaminopimelate ligase | 200483 | 202000 | - | 505 | 111115024 | 4227686 |
| Complete genome (Accession number NC_008277) | hypothetical protein BAPKO_0206 | 202273 | 202647 | + | 124 | 111115025 | 4227688 |
| Complete genome (Accession number NC_008277) | hemolysin, putative | 202743 | 203510 | + | 255 | 111115026 | 4227689 |
| Complete genome (Accession number NC_008277) | Lambda CII stability-governing protein | 203563 | 204498 | + | 311 | 111115027 | 4227690 |
| Complete genome (Accession number NC_008277) | Lambda CII stability-governing protein | 204499 | 205470 | + | 323 | 111115028 | 4227691 |
| Complete genome (Accession number NC_008277) | hypothetical protein BAPKO_0212 | 205930 | 207480 | + | 516 | 111115029 | 4227694 |
| Complete genome (Accession number NC_008277) | hypothetical protein BAPKO_0213 | 207485 | 208054 | - | 189 | 111115030 | 4227695 |
| Complete genome (Accession number NC_008277) | UTP--glucose-1-phosphate uridylyltransferase | 208107 | 208943 | + | 278 | 111115031 | 4227696 |
| Complete genome (Accession number NC_008277) | hypothetical protein BAPKO_0215 | 208930 | 210669 | + | 579 | 111115032 | 4227697 |

Fig. 28 continued

| Complete genome (Accession number NC_008277) | hypothetical protein BAPKO_0216 | 210706 | 211473 | + | 255 | 111115033 | 4227698 |
|---|---|---|---|---|---|---|---|
| Complete genome (Accession number NC_008277) | surface-located membrane protein 1 | 211466 | 214507 | + | 1013 | 111115034 | 4227699 |
| Complete genome (Accession number NC_008277) | DNA mismatch repair protein | 214514 | 216349 | + | 611 | 111115035 | 4227700 |
| Complete genome (Accession number NC_008277) | hypothetical protein BAPKO_0219 | 216368 | 217402 | + | 344 | 111115036 | 4227701 |
| Complete genome (Accession number NC_008277) | lipoprotein, putative | 217515 | 218168 | - | 217 | 111115037 | 4227831 |
| Complete genome (Accession number NC_008277) | translation elongation factor P | 218146 | 218724 | - | 192 | 111115038 | 4227832 |
| Complete genome (Accession number NC_008277) | phosphate ABC transporter, periplasmic phosphate-binding protein | 218890 | 219729 | + | 279 | 111115039 | 4227833 |
| Complete genome (Accession number NC_008277) | phosphate ABC transporter, permease protein | 219819 | 220727 | + | 302 | 111115040 | 4227834 |
| Complete genome (Accession number NC_008277) | phosphate ABC transporter, permease protein | 220724 | 222268 | + | 514 | 111115041 | 4227835 |
| Complete genome (Accession number NC_008277) | phosphate ABC transporter, ATP-binding protein | 222269 | 223051 | + | 260 | 111115042 | 4227836 |
| Complete genome (Accession number NC_008277) | gufA protein | 223054 | 223875 | - | 273 | 111115043 | 4227837 |
| Complete genome | alanyl-tRNA synthetase | 223916 | 225700 | - | 594 | 111115044 | 4227838 |

Fig. 28 continued

| | | | | | | | |
|---|---|---|---|---|---|---|---|
| (Accession number NC_008277) | | | | | | | |
| Complete genome (Accession number NC_008277) | flagellar motor switch protein | 225700 | 226917 | - | 405 | 111115045 | 4227839 |
| Complete genome (Accession number NC_008277) | 6-phosphogluconolactonase | 226904 | 227611 | - | 235 | 111115046 | 4227840 |
| Complete genome (Accession number NC_008277) | hypothetical protein BAPKO_0231 | 227716 | 227853 | - | 45 | 111115047 | 4227841 |
| Complete genome (Accession number NC_008277) | hypothetical protein BAPKO_0232 | 227874 | 228041 | - | 55 | 111115048 | 4227842 |
| Complete genome (Accession number NC_008277) | tRNA-dihydrouridine synthase A | 228118 | 229119 | + | 333 | 111115049 | 4227843 |
| Complete genome (Accession number NC_008277) | seryl-tRNA synthetase | 229109 | 230386 | - | 425 | 111115050 | 4227844 |
| Complete genome (Accession number NC_008277) | hypothetical protein BAPKO_0235 | 230526 | 231242 | + | 238 | 111115051 | 4227845 |
| Complete genome (Accession number NC_008277) | hypothetical protein BAPKO_0236 | 231243 | 234161 | + | 972 | 111115052 | 4227846 |
| Complete genome (Accession number NC_008277) | hypothetical protein BAPKO_0237 | 234158 | 234232 | - | 24 | 111115053 | 4227847 |
| Complete genome (Accession number NC_008277) | 50S ribosomal protein L31 type B | 234198 | 234443 | - | 81 | 111115054 | 4227702 |
| Complete genome (Accession number | transcription termination factor Rho | 234504 | 236051 | - | 515 | 111115055 | 4227703 |

Fig. 28 continued

| | | | | | | | |
|---|---|---|---|---|---|---|---|
| NC_008277) | | | | | | | |
| Complete genome (Accession number NC_008277) | hypothetical protein BAPKO_0240 | 236131 | 236538 | - | 135 | 111115056 | 4227704 |
| Complete genome (Accession number NC_008277) | hbbLi protein | 236539 | 236865 | - | 108 | 111115057 | 4227705 |
| Complete genome (Accession number NC_008277) | 30S ribosomal protein S20 | 236878 | 237135 | - | 85 | 111115058 | 4227706 |
| Complete genome (Accession number NC_008277) | hypothetical protein BAPKO_0243 | 237206 | 238033 | - | 275 | 111115059 | 4227707 |
| Complete genome (Accession number NC_008277) | translation-associated GTPase | 238043 | 239149 | - | 368 | 111115060 | 4227708 |
| Complete genome (Accession number NC_008277) | hypothetical protein BAPKO_0245 | 239185 | 241191 | - | 668 | 111115061 | 4227709 |
| Complete genome (Accession number NC_008277) | apolipoprotein N-acyltransferase | 241352 | 242920 | + | 522 | 111115062 | 4227710 |
| Complete genome (Accession number NC_008277) | hypothetical protein BAPKO_0247 | 242857 | 243630 | - | 257 | 111115063 | 4227711 |
| Complete genome (Accession number NC_008277) | deoxyguanosine/deoxyadenosine kinase(l) subunit 2 | 243695 | 244297 | - | 200 | 111115064 | 4227712 |
| Complete genome (Accession number NC_008277) | glycerol uptake facilitator | 244705 | 245469 | + | 254 | 111115065 | 4227713 |
| Complete genome (Accession number number | glycerol kinase | 245507 | 247012 | + | 501 | 111115066 | 4227714 |

Fig. 28 continued

| | | | | | | | |
|---|---|---|---|---|---|---|---|
| NC_008277) | | | | | | | |
| Complete genome (Accession number NC_008277) | hypothetical protein BAPKO_0251 | 247067 | 247306 | + | 79 | 111115067 | 4227715 |
| Complete genome (Accession number NC_008277) | glycerol-3-phosphate dehydrogenase, anaerobic | 247440 | 249008 | + | 522 | 111115068 | 4227716 |
| Complete genome (Accession number NC_008277) | hypothetical protein BAPKO_0253 | 249095 | 249589 | - | 164 | 111115069 | 4227717 |
| Complete genome (Accession number NC_008277) | hypothetical protein BAPKO_0254 | 249576 | 250130 | - | 184 | 111115070 | 4227718 |
| Complete genome (Accession number NC_008277) | hypothetical protein BAPKO_0255 | 250131 | 251156 | - | 341 | 111115071 | 4227719 |
| Complete genome (Accession number NC_008277) | hypothetical protein BAPKO_0256 | 251354 | 251959 | + | 201 | 111115072 | 4227720 |
| Complete genome (Accession number NC_008277) | oligoendopeptidase F | 252079 | 253851 | + | 590 | 111115073 | 4227721 |
| Complete genome (Accession number NC_008277) | phosphatidyltransferase | 253865 | 254569 | + | 234 | 111115074 | 4227466 |
| Complete genome (Accession number NC_008277) | dedA protein | 254566 | 255180 | + | 204 | 111115075 | 4227467 |
| Complete genome (Accession number NC_008277) | leucyl-tRNA synthetase | 255376 | 257898 | + | 840 | 111115076 | 4227469 |
| Complete genome (Accession number NC_008277) | hypothetical protein BAPKO_0262 | 257913 | 260216 | + | 767 | 111115077 | 4227470 |

Fig. 28 continued

| | | | | | | | |
|---|---|---|---|---|---|---|---|
| Complete genome (Accession number NC_008277) | ATP-dependent protease LA | 260205 | 262625 | - | 806 | 111115078 | 4227471 |
| Complete genome (Accession number NC_008277) | single-stranded-DNA-specific exonuclease | 262898 | 265018 | + | 706 | 111115079 | 4227472 |
| Complete genome (Accession number NC_008277) | hypothetical protein BAPKO_0265 | 265011 | 265955 | + | 314 | 111115080 | 4227473 |
| Complete genome (Accession number NC_008277) | 30S ribosomal protein S21 | 265970 | 266179 | + | 69 | 111115081 | 4227474 |
| Complete genome (Accession number NC_008277) | cell division protein, putative | 266218 | 268569 | - | 783 | 111115082 | 4227475 |
| Complete genome (Accession number NC_008277) | undecaprenyl pyrophosphate phosphatase | 268573 | 269367 | - | 264 | 111115083 | 4227476 |
| Complete genome (Accession number NC_008277) | hypothetical protein BAPKO_0269 | 269382 | 271550 | - | 722 | 111115084 | 4227477 |
| Complete genome (Accession number NC_008277) | hypothetical protein BAPKO_0270 | 271528 | 272536 | - | 336 | 111115085 | 4227478 |
| Complete genome (Accession number NC_008277) | hypothetical protein BAPKO_0271 | 272741 | 274123 | + | 460 | 111115086 | 4227479 |
| Complete genome (Accession number NC_008277) | hypothetical protein BAPKO_0272 | 274130 | 275383 | - | 417 | 111115087 | 4227480 |
| Complete genome (Accession number NC_008277) | signal peptidase I | 275559 | 275951 | + | 130 | 111115088 | 4227481 |
| Complete genome | heat shock protein 70 | 275975 | 277744 | - | 489 | 111115089 | 4227482 |

Fig. 28 continued

| | | | | | | | |
|---|---|---|---|---|---|---|---|
| (Accession number NC_008277) | | | | | | | |
| Complete genome (Accession number NC_008277) | hypothetical protein BAPKO_0275 | 277422 | 277943 | - | 173 | 111115090 | 4227483 |
| Complete genome (Accession number NC_008277) | hypothetical protein BAPKO_0276 | 277963 | 278265 | - | 100 | 111115091 | 4227260 |
| Complete genome (Accession number NC_008277) | hypothetical protein BAPKO_0277 | 278292 | 280196 | - | 634 | 111115092 | 4227261 |
| Complete genome (Accession number NC_008277) | hypothetical protein BAPKO_0278 | 280199 | 280678 | - | 159 | 111115093 | 4227262 |
| Complete genome (Accession number NC_008277) | minD-related ATP-binding protein | 280688 | 281575 | - | 295 | 111115094 | 4227263 |
| Complete genome (Accession number NC_008277) | flagellar biosynthesis regulator FlhF | 281587 | 282753 | - | 388 | 111115095 | 4227264 |
| Complete genome (Accession number NC_008277) | flagellar biosynthesis protein A | 282758 | 284848 | - | 696 | 111115096 | 4227265 |
| Complete genome (Accession number NC_008277) | flagellar biosynthesis protein FlhB | 284860 | 285978 | - | 372 | 111115097 | 4227618 |
| Complete genome (Accession number NC_008277) | flagellar biosynthesis protein | 285978 | 286766 | - | 262 | 111115098 | 4227619 |
| Complete genome (Accession number NC_008277) | flagellar biosynthesis protein | 286802 | 287065 | - | 87 | 111115099 | 4227620 |
| Complete genome (Accession number | flagellar biosynthesis protein FliP | 287073 | 287837 | - | 254 | 111115100 | 4227621 |

Fig. 28 continued

| | | | | | | | |
|---|---|---|---|---|---|---|---|
| NC_008277) | | | | | | | |
| Complete genome (Accession number NC_008277) | flagellar biosynthesis protein | 287848 | 288474 | - | 208 | 111115101 | 4227622 |
| Complete genome (Accession number NC_008277) | flagellar motor switch protein | 288467 | 288808 | - | 113 | 111115102 | 4227623 |
| Complete genome (Accession number NC_008277) | flagellar motor switch protein FliM | 288851 | 289909 | - | 352 | 111115103 | 4227624 |
| Complete genome (Accession number NC_008277) | flagellar basal body-associated protein FliL | 289930 | 290466 | - | 178 | 111115104 | 4227625 |
| Complete genome (Accession number NC_008277) | flagellar motor protein MotB | 290514 | 291296 | - | 260 | 111115105 | 4227626 |
| Complete genome (Accession number NC_008277) | flagellar motor rotation protein A | 291296 | 292078 | - | 260 | 111115106 | 4227627 |
| Complete genome (Accession number NC_008277) | flagellar protein | 292075 | 292299 | - | 74 | 111115107 | 4227628 |
| Complete genome (Accession number NC_008277) | flagellar hook protein FlgE | 292320 | 293648 | - | 442 | 111115108 | 4227629 |
| Complete genome (Accession number NC_008277) | flagellar basal body rod modification protein | 293653 | 294096 | - | 147 | 111115109 | 4227630 |
| Complete genome (Accession number NC_008277) | flagellar protein | 294110 | 295294 | - | 394 | 111115110 | 4227631 |
| Complete genome (Accession number number | flagellar protein | 295302 | 295919 | - | 205 | 111115111 | 4227213 |

Fig. 28 continued

| | | | | | | | |
|---|---|---|---|---|---|---|---|
| NC_008277) | | | | | | | |
| Complete genome (Accession number NC_008277) | flagellar protein | 295912 | 296343 | - | 143 | 111115112 | 4227214 |
| Complete genome (Accession number NC_008277) | flagellum-specific ATP synthase | 296340 | 297650 | - | 436 | 111115113 | 4227215 |
| Complete genome (Accession number NC_008277) | flagellar assembly protein H | 297669 | 298589 | - | 306 | 111115114 | 4227216 |
| Complete genome (Accession number NC_008277) | flagellar motor switch protein G | 298604 | 299638 | - | 344 | 111115115 | 4227217 |
| Complete genome (Accession number NC_008277) | flagellar MS-ring protein | 299654 | 301363 | - | 569 | 111115116 | 4227218 |
| Complete genome (Accession number NC_008277) | flagellar hook-basal body protein FliE | 301378 | 301713 | - | 111 | 111115117 | 4227219 |
| Complete genome (Accession number NC_008277) | flagellar basal body rod protein FlgC | 301725 | 302183 | - | 152 | 111115118 | 4227220 |
| Complete genome (Accession number NC_008277) | flagellar basal body rod protein FlgB | 302207 | 302614 | - | 135 | 111115119 | 4227221 |
| Complete genome (Accession number NC_008277) | ATP-dependent protease ATP-binding subunit | 302648 | 303994 | - | 448 | 111115120 | 4227222 |
| Complete genome (Accession number NC_008277) | ATP-dependent protease peptidase subunit | 303987 | 304535 | - | 182 | 111115121 | 4227223 |
| Complete genome (Accession number NC_008277) | smf protein | 304544 | 305491 | - | 315 | 111115122 | 4227224 |

Fig. 28 continued

| | | | | | | | |
|---|---|---|---|---|---|---|---|
| Complete genome (Accession number NC_008277) | hypothetical protein BAPKO_0308 | 305498 | 306190 | - | 230 | 111115123 | 4227225 |
| Complete genome (Accession number NC_008277) | cell division protein FtsZ | 306191 | 307390 | - | 399 | 111115124 | 4227226 |
| Complete genome (Accession number NC_008277) | cell division protein | 307412 | 308653 | - | 413 | 111115125 | 4227227 |
| Complete genome (Accession number NC_008277) | cell division protein | 308653 | 309396 | - | 247 | 111115126 | 4227228 |
| Complete genome (Accession number NC_008277) | cell division protein | 309432 | 309989 | - | 185 | 111115127 | 4227229 |
| Complete genome (Accession number NC_008277) | hypothetical protein BAPKO_0313 | 310062 | 310490 | - | 142 | 111115128 | 4227230 |
| Complete genome (Accession number NC_008277) | phospho-N-acetylmuramoyl-pentapeptide-transferase | 310533 | 311588 | - | 351 | 111115129 | 4227231 |
| Complete genome (Accession number NC_008277) | UDP-N-acetylmuramoyl alanyl-D-glutamyl-2, 6-diaminopimelate--D-alanyl-D-alanine | 311606 | 312997 | - | 463 | 111115130 | 4227405 |
| Complete genome (Accession number NC_008277) | hypothetical protein BAPKO_0316 | 313020 | 313301 | - | 93 | 111115131 | 4227406 |
| Complete genome (Accession number NC_008277) | hypothetical protein BAPKO_0317 | 313298 | 314188 | - | 296 | 111115132 | 4227407 |
| Complete genome (Accession number NC_008277) | hypothetical protein BAPKO_0318 | 314181 | 315017 | - | 278 | 111115133 | 4227408 |

Fig. 28 continued

| | | | | | | | |
|---|---|---|---|---|---|---|---|
| Complete genome (Accession number NC_008277) | hypothetical protein BAPKO_0319 | 315014 | 316090 | - | 358 | 111115134 | 4227409 |
| Complete genome (Accession number NC_008277) | hypothetical protein BAPKO_0320 | 316120 | 316878 | - | 252 | 111115135 | 4227410 |
| Complete genome (Accession number NC_008277) | hypothetical protein BAPKO_0321 | 317194 | 318033 | - | 279 | 111115136 | 4227411 |
| Complete genome (Accession number NC_008277) | purine-binding chemotaxis protein | 318023 | 318553 | - | 176 | 111115137 | 4227412 |
| Complete genome (Accession number NC_008277) | cell division protein | 318599 | 319168 | - | 189 | 111115138 | 4227413 |
| Complete genome (Accession number NC_008277) | octaprenyl-diphosphate synthase | 319228 | 320271 | + | 347 | 111115139 | 4227414 |
| Complete genome (Accession number NC_008277) | hypothetical protein BAPKO_0325 | 320271 | 320954 | + | 227 | 111115140 | 4227415 |
| Complete genome (Accession number NC_008277) | hypothetical protein BAPKO_0326 | 320956 | 321762 | - | 268 | 111115141 | 4227416 |
| Complete genome (Accession number NC_008277) | hypothetical protein BAPKO_0327 | 321763 | 322695 | - | 310 | 111115142 | 4227417 |
| Complete genome (Accession number NC_008277) | methylgalactoside ABC transporter, ATP-binding protein | 322692 | 324152 | - | 486 | 111115143 | 4227418 |
| Complete genome (Accession number NC_008277) | exported protein | 324152 | 325189 | - | 345 | 111115144 | 4227419 |

Fig. 28 continued

| Complete genome (Accession number NC_008277) | hypothetical protein BAPKO_0330 | 325323 | 325574 | - | 83 | 111115145 | 4227420 |
|---|---|---|---|---|---|---|---|
| Complete genome (Accession number NC_008277) | hypothetical protein BAPKO_0331 | 325609 | 326667 | - | 352 | 111115146 | 4227421 |
| Complete genome (Accession number NC_008277) | hypothetical protein BAPKO_0332 | 326941 | 328080 | + | 379 | 111115147 | 4227422 |
| Complete genome (Accession number NC_008277) | hypothetical protein BAPKO_0333 | 328176 | 328541 | + | 121 | 111115148 | 4227423 |
| Complete genome (Accession number NC_008277) | hypothetical protein BAPKO_0334 | 328548 | 329657 | - | 369 | 111115149 | 4227647 |
| Complete genome (Accession number NC_008277) | hypothetical protein BAPKO_0335 | 329708 | 332512 | - | 934 | 111115150 | 4227667 |
| Complete genome (Accession number NC_008277) | glycerol-3-phosphate O-acyltransferase, putative | 332536 | 333429 | - | 297 | 111115151 | 4227668 |
| Complete genome (Accession number NC_008277) | oligopeptide ABC transporter, periplasmic oligopeptide-binding protein | 333829 | 335400 | + | 523 | 111115152 | 4227669 |
| Complete genome (Accession number NC_008277) | oligopeptide ABC transporter, periplasmic oligopeptide-binding protein | 335499 | 337082 | + | 527 | 111115153 | 4227670 |
| Complete genome (Accession number NC_008277) | oligopeptide ABC transporter, periplasmic oligopeptide-binding protein | 337227 | 338852 | + | 541 | 111115154 | 4227671 |
| Complete genome (Accession number | oligopeptide ABC transporter, permease | 339148 | 340068 | + | 306 | 111115155 | 4227672 |

Fig. 28 continued

| | | | | | | | |
|---|---|---|---|---|---|---|---|
| NC_008277) | protein | | | | | | |
| Complete genome (Accession number NC_008277) | oligopeptide ABC transporter, permease protein | 340081 | 341130 | + | 349 | 111115156 | 4227673 |
| Complete genome (Accession number NC_008277) | hypothetical protein BAPKO_0342 | 341102 | 341185 | + | 27 | 111115157 | 4227674 |
| Complete genome (Accession number NC_008277) | oligopeptide ABC transporter, ATP-binding protein | 341142 | 342017 | + | 291 | 111115158 | 4227675 |
| Complete genome (Accession number NC_008277) | oligopeptide ABC transporter, ATP-binding protein | 342018 | 342989 | + | 323 | 111115159 | 4227676 |
| Complete genome (Accession number NC_008277) | hypothetical protein BAPKO_0345 | 343003 | 343734 | - | 243 | 111115160 | 4227677 |
| Complete genome (Accession number NC_008277) | enolase | 343868 | 345169 | + | 433 | 111115161 | 4227678 |
| Complete genome (Accession number NC_008277) | 30S ribosomal protein S9 | 345234 | 345644 | - | 136 | 111115162 | 4227679 |
| Complete genome (Accession number NC_008277) | 50S ribosomal protein L13 | 345646 | 346104 | - | 152 | 111115163 | 4227680 |
| Complete genome (Accession number NC_008277) | hypothetical protein BAPKO_0349 | 346157 | 346966 | - | 269 | 111115164 | 4227681 |
| Complete genome (Accession number NC_008277) | aspartyl/glutamyl-tRNA amidotransferase subunit B | 346959 | 348416 | - | 485 | 111115165 | 4227682 |
| Complete genome (Accession | Glu-tRNA(Gln) amidotransferase, subunit A | 348406 | 349851 | - | 481 | 111115166 | 4227683 |

Fig. 28 continued

| | | | | | | | |
|---|---|---|---|---|---|---|---|
| number NC_008277) | | | | | | | |
| Complete genome (Accession number NC_008277) | aspartyl/glutamyl-tRNA amidotransferase subunit C | 349862 | 350137 | - | 91 | 111115167 | 4227684 |
| Complete genome (Accession number NC_008277) | DNA helicase | 350147 | 352243 | - | 698 | 111115168 | 4227685 |
| Complete genome (Accession number NC_008277) | hypothetical protein BAPKO_0354 | 352246 | 353445 | - | 399 | 111115169 | 4227446 |
| Complete genome (Accession number NC_008277) | hypothetical protein BAPKO_0355 | 353456 | 354106 | - | 216 | 111115170 | 4227447 |
| Complete genome (Accession number NC_008277) | fibronectin/fibrinogen-binding protein, putative | 354298 | 355716 | + | 472 | 111115171 | 4227448 |
| Complete genome (Accession number NC_008277) | pyruvate kinase | 355812 | 357245 | + | 477 | 111115172 | 4227449 |
| Complete genome (Accession number NC_008277) | hypothetical protein BAPKO_0358 | 357314 | 358003 | + | 229 | 111115173 | 4227450 |
| Complete genome (Accession number NC_008277) | 50S ribosomal protein L28 | 358022 | 358300 | - | 92 | 111115174 | 4227451 |
| Complete genome (Accession number NC_008277) | hypothetical protein BAPKO_0360 | 358322 | 359884 | - | 520 | 111115175 | 4227452 |
| Complete genome (Accession number NC_008277) | hypothetical protein BAPKO_0361 | 359994 | 361127 | + | 377 | 111115176 | 4227453 |
| Complete genome (Accession BAPKO_0362 | hypothetical protein | 361124 | 362923 | - | 599 | 111115177 | 4227454 |

Fig. 28 continued

| | | | | | | | |
|---|---|---|---|---|---|---|---|
| number NC_008277) | | | | | | | |
| Complete genome (Accession number NC_008277) | hypothetical protein BAPKO_0363 | 362936 | 363886 | - | 316 | 111115178 | 4227455 |
| Complete genome (Accession number NC_008277) | transcription factor, putative | 363920 | 364408 | - | 162 | 111115179 | 4227456 |
| Complete genome (Accession number NC_008277) | hypothetical protein BAPKO_0365 | 364448 | 365041 | - | 197 | 111115180 | 4227457 |
| Complete genome (Accession number NC_008277) | hypothetical protein BAPKO_0366 | 365034 | 365765 | - | 243 | 111115181 | 4227458 |
| Complete genome (Accession number NC_008277) | carboxyl-terminal protease | 365769 | 367202 | - | 477 | 111115182 | 4227459 |
| Complete genome (Accession number NC_008277) | minD-related ATP-binding protein | 367702 | 368844 | + | 380 | 111115183 | 4227460 |
| Complete genome (Accession number NC_008277) | prolipoprotein diacylglyceryl transferase | 368844 | 369815 | + | 323 | 111115184 | 4227461 |
| Complete genome (Accession number NC_008277) | hypothetical protein BAPKO_0370 | 369850 | 371862 | + | 670 | 111115185 | 4227462 |
| Complete genome (Accession number NC_008277) | methylglyoxal synthase | 371958 | 372341 | + | 127 | 111115186 | 4227463 |
| Complete genome (Accession number NC_008277) | lipoprotein LA7 | 372384 | 372971 | - | 195 | 111115187 | 4227464 |
| Complete genome (Accession number number | putative aminopeptidas e 1 | 373108 | 374484 | + | 458 | 111115188 | 4227465 |

Fig. 28 continued

| | | | | | | | |
|---|---|---|---|---|---|---|---|
| NC_008277) | | | | | | | |
| Complete genome (Accession number NC_008277) | hypothetical protein BAPKO_0375 | 374435 | 374770 | + | 111 | 111115189 | 4227554 |
| Complete genome (Accession number NC_008277) | hypothetical protein BAPKO_0376 | 374754 | 375215 | + | 153 | 111115190 | 4227555 |
| Complete genome (Accession number NC_008277) | NAD(P)H-dependent glycerol-3-phosphate dehydrogenase | 374792 | 375850 | - | 352 | 111115191 | 4227556 |
| Complete genome (Accession number NC_008277) | ATP-dependent Clp protease, subunit A | 375868 | 378165 | - | 765 | 111115192 | 4227557 |
| Complete genome (Accession number NC_008277) | tyrosyl-tRNA synthetase | 378176 | 379393 | - | 405 | 111115193 | 4227558 |
| Complete genome (Accession number NC_008277) | glycyl-tRNA synthetase | 379390 | 380727 | - | 445 | 111115194 | 4227559 |
| Complete genome (Accession number NC_008277) | glutamyl-tRNA synthetase | 380745 | 382217 | - | 490 | 111115195 | 4227560 |
| Complete genome (Accession number NC_008277) | hypothetical protein BAPKO_0382 | 382230 | 382997 | - | 255 | 111115196 | 4227561 |
| Complete genome (Accession number NC_008277) | hypothetical protein BAPKO_0383 | 383127 | 384263 | + | 378 | 111115197 | 4227562 |
| Complete genome (Accession number NC_008277) | 5-methylthioadenosine/S-adenosylhomocysteine nucleosidase, putative | 384285 | 384996 | + | 237 | 111115198 | 4227563 |
| Complete genome | S-adenosylmethio | 384995 | 386173 | + | 392 | 111115199 | 4227564 |

Fig. 28 continued

| | | | | | | | |
|---|---|---|---|---|---|---|---|
| (Accession number NC_008277) | nine synthetase | | | | | | |
| Complete genome (Accession number NC_008277) | S-ribosylhomocysteinase | 386170 | 386643 | + | 157 | 111115200 | 4227565 |
| Complete genome (Accession number NC_008277) | hypothetical protein BAPKO_0387 | 386654 | 387316 | - | 220 | 111115201 | 4227566 |
| Complete genome (Accession number NC_008277) | protein kinase C1 inhibitor | 387343 | 387762 | - | 139 | 111115202 | 4227567 |
| Complete genome (Accession number NC_008277) | Mg2+ transport protein | 387811 | 389175 | - | 454 | 111115203 | 4227568 |
| Complete genome (Accession number NC_008277) | hypothetical protein BAPKO_0390 | 389229 | 390653 | - | 474 | 111115204 | 4227569 |
| Complete genome (Accession number NC_008277) | basic membrane protein B | 390767 | 391792 | - | 341 | 111115205 | 4227570 |
| Complete genome (Accession number NC_008277) | basic membrane protein A | 391879 | 392898 | - | 339 | 111115206 | 4227571 |
| Complete genome (Accession number NC_008277) | hypothetical protein BAPKO_0393 | 392942 | 393100 | - | 52 | 111115207 | 4227572 |
| Complete genome (Accession number NC_008277) | hypothetical protein BAPKO_0394 | 393299 | 393385 | - | 28 | 111115208 | 4227803 |
| Complete genome (Accession number NC_008277) | hypothetical protein BAPKO_0395 | 393563 | 394582 | - | 339 | 111115209 | 4227804 |
| Complete genome (Accession number NC_008277) | hypothetical protein BAPKO_0396 | 394626 | 394904 | - | 92 | 111115210 | 4227805 |

Fig. 28 continued

| | | | | | | | |
|---|---|---|---|---|---|---|---|
| NC_008277) | | | | | | | |
| Complete genome (Accession number NC_008277) | hypothetical protein BAPKO_0397 | 394980 | 395066 | - | 28 | 111115211 | 4227806 |
| Complete genome (Accession number NC_008277) | hypothetical protein BAPKO_0398 | 395244 | 396263 | - | 339 | 111115212 | 4227807 |
| Complete genome (Accession number NC_008277) | basic membrane protein C | 396307 | 397368 | - | 353 | 111115213 | 4227808 |
| Complete genome (Accession number NC_008277) | basic membrane protein D | 397682 | 398707 | - | 341 | 111115214 | 4227809 |
| Complete genome (Accession number NC_008277) | 30S ribosomal protein S7 | 398808 | 399281 | - | 157 | 111115215 | 4227810 |
| Complete genome (Accession number NC_008277) | 30S ribosomal protein S12 | 399306 | 399680 | - | 124 | 111115216 | 4227811 |
| Complete genome (Accession number NC_008277) | DNA-directed RNA polymerase subunit beta' | 399748 | 403881 | - | 1377 | 111115217 | 4227812 |
| Complete genome (Accession number NC_008277) | DNA-directed RNA polymerase subunit beta | 403897 | 407364 | - | 1155 | 111115218 | 4227813 |
| Complete genome (Accession number NC_008277) | 50S ribosomal protein L7/L12 | 407447 | 407821 | - | 124 | 111115219 | 4227814 |
| Complete genome (Accession number NC_008277) | 50S ribosomal protein L10 | 407892 | 408380 | - | 162 | 111115220 | 4227815 |
| Complete genome (Accession number number | 50S ribosomal protein L1 | 408385 | 409065 | - | 226 | 111115221 | 4227816 |

Fig. 28 continued

| | | | | | | | |
|---|---|---|---|---|---|---|---|
| NC_008277) | | | | | | | |
| Complete genome (Accession number NC_008277) | 50S ribosomal protein L11 | 409065 | 409496 | - | 143 | 111115222 | 4227817 |
| Complete genome (Accession number NC_008277) | transcription antitermination factor | 409550 | 410104 | - | 184 | 111115223 | 4227818 |
| Complete genome (Accession number NC_008277) | preprotein translocase subunit SecE | 410128 | 410298 | - | 56 | 111115224 | 4227819 |
| Complete genome (Accession number NC_008277) | 50S ribosomal protein L33 | 410406 | 410585 | - | 59 | 111115225 | 4227821 |
| Complete genome (Accession number NC_008277) | hypothetical protein BAPKO_0414 | 410750 | 411607 | - | 285 | 111115226 | 4227610 |
| Complete genome (Accession number NC_008277) | lipoprotein, putative | 411621 | 412643 | - | 340 | 111115227 | 4227611 |
| Complete genome (Accession number NC_008277) | hypothetical protein BAPKO_0416 | 412990 | 413601 | + | 203 | 111115228 | 4227612 |
| Complete genome (Accession number NC_008277) | hypothetical protein BAPKO_0417 | 413658 | 415313 | - | 551 | 111115229 | 4227613 |
| Complete genome (Accession number NC_008277) | glutamate transporter, putative | 415314 | 416516 | + | 400 | 111115230 | 4227614 |
| Complete genome (Accession number NC_008277) | prolyl-tRNA synthetase | 416528 | 417994 | - | 488 | 111115231 | 4227615 |
| Complete genome (Accession number NC_008277) number | hypothetical protein BAPKO_0420 | 418047 | 418724 | - | 225 | 111115232 | 4227616 |

Fig. 28 continued

| | | | | | | | |
|---|---|---|---|---|---|---|---|
| NC_008277) | | | | | | | |
| Complete genome (Accession number NC_008277) | hypothetical protein BAPKO_0421 | 41888 | 419304 | + | 138 | 111115233 | 4227739 |
| Complete genome (Accession number NC_008277) | hypothetical protein BAPKO_0422 | 419301 | 419906 | + | 201 | 111115234 | 4227740 |
| Complete genome (Accession number NC_008277) | hypothetical protein BAPKO_0423 | 419917 | 420528 | + | 203 | 111115235 | 4227741 |
| Complete genome (Accession number NC_008277) | mannose-6-phosphate isomerase | 420581 | 421696 | - | 371 | 111115236 | 4227742 |
| Complete genome (Accession number NC_008277) | PTS system, fructose-specific IIABC component | 421697 | 423574 | - | 625 | 111115237 | 4227743 |
| Complete genome (Accession number NC_008277) | hypothetical protein BAPKO_0426 | 423746 | 424375 | + | 209 | 111115238 | 4227744 |
| Complete genome (Accession number NC_008277) | endonuclease precursor | 424372 | 425253 | + | 293 | 111115239 | 4227745 |
| Complete genome (Accession number NC_008277) | hypothetical protein BAPKO_0428 | 425250 | 426029 | + | 259 | 111115240 | 4227746 |
| Complete genome (Accession number NC_008277) | hypothetical protein BAPKO_0429 | 426017 | 426637 | - | 206 | 111115241 | 4227747 |
| Complete genome (Accession number NC_008277) | chemotaxis protein methyltransferase | 426883 | 427740 | + | 285 | 111115242 | 4227748 |
| Complete genome (Accession number number | protein-glutamate methylesterase | 427773 | 428900 | + | 375 | 111115243 | 4227749 |

Fig. 28 continued

| | | | | | | | |
|---|---|---|---|---|---|---|---|
| NC_008277) | | | | | | | |
| Complete genome (Accession number NC_008277) | pheromone shutdown protein | 428926 | 430140 | + | 404 | 111115244 | 4227750 |
| Complete genome (Accession number NC_008277) | adenylate kinase | 430179 | 430814 | + | 211 | 111115245 | 4227751 |
| Complete genome (Accession number NC_008277) | hypothetical protein BAPKO_0434 | 430815 | 431864 | + | 349 | 111115246 | 4227752 |
| Complete genome (Accession number NC_008277) | response regulatory protein | 431896 | 432819 | - | 307 | 111115247 | 4227753 |
| Complete genome (Accession number NC_008277) | sensory transduction histidine kinase/response regulator | 432822 | 437303 | - | 1493 | 111115248 | 4227754 |
| Complete genome (Accession number NC_008277) | hydrolase | 443902 | 444744 | - | 280 | 111115249 | 4227759 |
| Complete genome (Accession number NC_008277) | 3-methyladenine DNA glycosylase | 444880 | 445440 | - | 186 | 111115250 | 4227760 |
| Complete genome (Accession number NC_008277) | hypothetical protein BAPKO_0443 | 445966 | 446049 | + | 27 | 111115251 | 4227761 |
| Complete genome (Accession number NC_008277) | hypothetical protein BAPKO_0448 | 450181 | 450729 | - | 182 | 111115253 | 4227575 |
| Complete genome (Accession number NC_008277) | hypothetical protein BAPKO_0449 | 450619 | 451496 | - | 225 | 111115254 | 4227576 |
| Complete genome (Accession number | hypothetical protein BAPKO_0450 | 451709 | 452026 | + | 105 | 111115255 | 4227577 |

Fig. 28 continued

| | | | | | | | |
|---|---|---|---|---|---|---|---|
| NC_008277) | | | | | | | |
| Complete genome (Accession number NC_008277) | hypothetical protein BAPKO_0451 | 452057 | 452446 | - | 129 | 111115256 | 4227578 |
| Complete genome (Accession number NC_008277) | hypothetical protein BAPKO_0452 | 452573 | 453169 | + | 198 | 111115257 | 4227579 |
| Complete genome (Accession number NC_008277) | chromosome segregation protein, putative | 453278 | 454030 | + | 250 | 111115258 | 4227580 |
| Complete genome (Accession number NC_008277) | hypothetical protein BAPKO_0454 | 454033 | 454746 | + | 237 | 111115259 | 4227581 |
| Complete genome (Accession number NC_008277) | stage 0 sporulation protein J | 455034 | 455816 | - | 260 | 111115260 | 4227582 |
| Complete genome (Accession number NC_008277) | hypothetical protein BAPKO_0456 | 455862 | 455951 | + | 29 | 111115261 | 4227583 |
| Complete genome (Accession number NC_008277) | DNA gyrase, subunit A | 455934 | 458366 | - | 810 | 111115262 | 4227584 |
| Complete genome (Accession number NC_008277) | DNA gyrase, subunit B | 458378 | 460282 | - | 634 | 111115263 | 4227585 |
| Complete genome (Accession number NC_008277) | chromosomal replication initiator protein | 460469 | 461926 | + | 485 | 111115264 | 4227586 |
| Complete genome (Accession number NC_008277) | DNA polymerase III, subunit beta | 462159 | 463319 | + | 386 | 111115265 | 4227587 |
| Complete genome (Accession number NC_008277) | hypothetical protein BAPKO_0461 | 463411 | 463710 | + | 99 | 111115266 | 4227588 |

Fig. 28 continued

| | | | | | | | |
|---|---|---|---|---|---|---|---|
| NC_008277) | | | | | | | |
| Complete genome (Accession number NC_008277) | 50S ribosomal protein L34 | 463802 | 463957 | + | 51 | 111115267 | 4227589 |
| Complete genome (Accession number NC_008277) | ribonuclease P protein component | 463938 | 464273 | + | 111 | 111115268 | 4227590 |
| Complete genome (Accession number NC_008277) | putative inner membrane protein translocase component YidC | 464284 | 465918 | + | 544 | 111115269 | 4227764 |
| Complete genome (Accession number NC_008277) | spoIIIJ-associated protein | 465932 | 466660 | + | 242 | 111115270 | 4227765 |
| Complete genome (Accession number NC_008277) | nucleotide sugar epimerase | 466704 | 467771 | + | 355 | 111115271 | 4227766 |
| Complete genome (Accession number NC_008277) | fructose-bisphosphate aldolase | 467933 | 469012 | + | 359 | 111115272 | 4227767 |
| Complete genome (Accession number NC_008277) | aspartyl-tRNA synthetase | 469419 | 471179 | - | 586 | 111115273 | 4227768 |
| Complete genome (Accession number NC_008277) | Na+/H+ antiporter | 471183 | 472288 | - | 701 | 111115274 | 4227769 |
| Complete genome (Accession number NC_008277) | phosphocarrier protein HPr | 473291 | 473566 | - | 91 | 111115275 | 4227770 |
| Complete genome (Accession number NC_008277) | hypothetical protein BAPKO_0471 | 473579 | 473872 | - | 97 | 111115276 | 4227771 |
| Complete genome (Accession | RNA polymerase sigma-54 factor | 473862 | 475121 | - | 419 | 111115277 | 4227772 |

Fig. 28 continued

| | | | | | | | |
|---|---|---|---|---|---|---|---|
| number NC_008277) | | | | | | | |
| Complete genome (Accession number NC_008277) | chromate transport protein, putative | 475124 | 475657 | - | 177 | 111115278 | 4227773 |
| Complete genome (Accession number NC_008277) | hypothetical protein BAPKO_0474 | 475654 | 476259 | - | 201 | 111115279 | 4227774 |
| Complete genome (Accession number NC_008277) | hypothetical protein BAPKO_0475 | 476471 | 477313 | + | 280 | 111115280 | 4227775 |
| Complete genome (Accession number NC_008277) | hypothetical protein BAPKO_0476 | 477288 | 477404 | - | 38 | 111115281 | 4227776 |
| Complete genome (Accession number NC_008277) | lipopolysaccharide biosynthesis-related protein | 477310 | 478458 | - | 382 | 111115282 | 4227777 |
| Complete genome (Accession number NC_008277) | hypothetical protein BAPKO_0478 | 478533 | 479504 | + | 323 | 111115283 | 4227778 |
| Complete genome (Accession number NC_008277) | hypothetical protein BAPKO_0479 | 479508 | 480146 | + | 212 | 111115284 | 4227779 |
| Complete genome (Accession number NC_008277) | hypothetical protein BAPKO_0480 | 480209 | 480352 | + | 47 | 111115285 | 4227780 |
| Complete genome (Accession number NC_008277) | excinuclease ABC, subunit C | 480235 | 481962 | - | 575 | 111115286 | 4227781 |
| Complete genome (Accession number NC_008277) | hypothetical protein BAPKO_0482 | 482153 | 483670 | + | 505 | 111115287 | 4227782 |
| Complete genome (Accession number number | hypothetical protein BAPKO_0483 | 483663 | 484973 | + | 436 | 111115288 | 4227352 |

Fig. 28 continued

| | | | | | | | |
|---|---|---|---|---|---|---|---|
| NC_008277) | | | | | | | |
| Complete genome (Accession number NC_008277) | lipoprotein, putative | 485299 | 486024 | - | 241 | 111115289 | 4227641 |
| Complete genome (Accession number NC_008277) | hypothetical protein BAPKO_0489 | 486225 | 486536 | + | 103 | 111115290 | 4227644 |
| Complete genome (Accession number NC_008277) | DNA polymerase III subunits gamma and tau | 486587 | 488287 | + | 566 | 111115291 | 4227645 |
| Complete genome (Accession number NC_008277) | hypothetical protein BAPKO_0491 | 488292 | 488591 | + | 99 | 111115292 | 4227646 |
| Complete genome (Accession number NC_008277) | nucleoside-diphosphate kinase | 488761 | 489270 | + | 169 | 111115293 | 4227254 |
| Complete genome (Accession number NC_008277) | hypothetical protein BAPKO_0493 | 489566 | 490093 | + | 175 | 111115294 | 4227255 |
| Complete genome (Accession number NC_008277) | hypothetical protein BAPKO_0494 | 490090 | 490785 | + | 231 | 111115295 | 4227256 |
| Complete genome (Accession number NC_008277) | ABC transporter, ATP-binding protein | 490754 | 491554 | + | 266 | 111115296 | 4227257 |
| Complete genome (Accession number NC_008277) | hypothetical protein BAPKO_0496 | 491551 | 492240 | + | 229 | 111115297 | 4227258 |
| Complete genome (Accession number NC_008277) | hypothetical protein BAPKO_0497 | 492242 | 492988 | + | 248 | 111115298 | 4227259 |
| Complete genome (Accession number number | signal peptidase II | 492999 | 493511 | + | 170 | 111115299 | 4227949 |

Fig. 28 continued

| | | | | | | | |
|---|---|---|---|---|---|---|---|
| NC_008277) | | | | | | | |
| Complete genome (Accession number NC_008277) | hypothetical protein BAPKO_0499 | 493508 | 493735 | + | 75 | 111115300 | 4227950 |
| Complete genome (Accession number NC_008277) | hypothetical protein BAPKO_0500 | 493749 | 494570 | + | 273 | 111115301 | 4227951 |
| Complete genome (Accession number NC_008277) | UDP-N-acetylglucosamine 1-carboxyvinyltransferase | 494676 | 495959 | + | 427 | 111115302 | 4227952 |
| Complete genome (Accession number NC_008277) | hypothetical protein BAPKO_0502 | 496449 | 497813 | + | 454 | 111115303 | 4227953 |
| Complete genome (Accession number NC_008277) | lipoprotein, putative | 497902 | 498291 | - | 129 | 111115304 | 4227954 |
| Complete genome (Accession number NC_008277) | elongation factor Tu | 498782 | 499966 | + | 394 | 111115305 | 4227955 |
| Complete genome (Accession number NC_008277) | 30S ribosomal protein S10 | 500018 | 500329 | + | 103 | 111115306 | 4227956 |
| Complete genome (Accession number NC_008277) | 50S ribosomal protein L3 | 500365 | 500985 | + | 206 | 111115307 | 4227957 |
| Complete genome (Accession number NC_008277) | 50S ribosomal protein L4 | 500995 | 501624 | + | 209 | 111115308 | 4227958 |
| Complete genome (Accession number NC_008277) | 50S ribosomal protein L23 | 501645 | 501941 | + | 98 | 111115309 | 4227164 |
| Complete genome (Accession number NC_008277) | 50S ribosomal protein L2 | 501963 | 502796 | + | 277 | 111115310 | 4227165 |

Fig. 28 continued

| | | | | | | | |
|---|---|---|---|---|---|---|---|
| Complete genome (Accession number NC_008277) | 30S ribosomal protein S19 | 502806 | 503084 | + | 92 | 111115311 | 4227166 |
| Complete genome (Accession number NC_008277) | 50S ribosomal protein L22 | 503092 | 503454 | + | 120 | 111115312 | 4227167 |
| Complete genome (Accession number NC_008277) | 30S ribosomal protein S3 | 503458 | 504333 | + | 291 | 111115313 | 4227168 |
| Complete genome (Accession number NC_008277) | 50S ribosomal protein L16 | 504338 | 504754 | + | 138 | 111115314 | 4227169 |
| Complete genome (Accession number NC_008277) | 50S ribosomal protein L29 | 504757 | 504957 | + | 66 | 111115315 | 4227170 |
| Complete genome (Accession number NC_008277) | 30S ribosomal protein S17 | 504960 | 505214 | + | 84 | 111115316 | 4227171 |
| Complete genome (Accession number NC_008277) | 50S ribosomal protein L14 | 505242 | 505610 | + | 122 | 111115317 | 4227172 |
| Complete genome (Accession number NC_008277) | 50S ribosomal protein L24 | 505625 | 505930 | + | 101 | 111115318 | 4227173 |
| Complete genome (Accession number NC_008277) | 50S ribosomal protein L5 | 505936 | 506484 | + | 182 | 111115319 | 4227895 |
| Complete genome (Accession number NC_008277) | 30S ribosomal protein S14 | 506502 | 506687 | + | 61 | 111115320 | 4227896 |
| Complete genome (Accession number NC_008277) | 30S ribosomal protein S8 | 506697 | 507095 | + | 132 | 111115321 | 4227897 |

Fig. 28 continued

| | | | | | | | |
|---|---|---|---|---|---|---|---|
| Complete genome (Accession number NC_008277) | 50S ribosomal protein L6 | 507112 | 507654 | + | 180 | 111115322 | 4227898 |
| Complete genome (Accession number NC_008277) | 50S ribosomal protein L18 | 507672 | 508031 | + | 119 | 111115323 | 4227899 |
| Complete genome (Accession number NC_008277) | 30S ribosomal protein S5 | 508044 | 508541 | + | 165 | 111115324 | 4227900 |
| Complete genome (Accession number NC_008277) | ribosomal protein L30 | 508545 | 508856 | + | 103 | 111115325 | 4227901 |
| Complete genome (Accession number NC_008277) | 50S ribosomal protein L15 | 508849 | 509286 | + | 145 | 111115326 | 4227902 |
| Complete genome (Accession number NC_008277) | preprotein translocase subunit SecY | 509299 | 510603 | + | 434 | 111115327 | 4227903 |
| Complete genome (Accession number NC_008277) | 50S ribosomal protein L36 | 510616 | 510729 | + | 37 | 111115328 | 4227904 |
| Complete genome (Accession number NC_008277) | 30S ribosomal protein S13 | 510747 | 511124 | + | 125 | 111115329 | 4227905 |
| Complete genome (Accession number NC_008277) | 30S ribosomal protein S11 | 511152 | 511544 | + | 130 | 111115330 | 4227906 |
| Complete genome (Accession number NC_008277) | DNA-directed RNA polymerase subunit alpha | 511560 | 512594 | + | 344 | 111115331 | 4227907 |
| Complete genome (Accession number NC_008277) | 50S ribosomal protein L17 | 512616 | 512987 | + | 123 | 111115332 | 4227908 |

Fig. 28 continued

| Complete genome (Accession number NC_008277) | hypothetical protein BAPKO_0532 | 513064 | 514593 | + | 509 | 111115333 | 4227909 |
|---|---|---|---|---|---|---|---|
| Complete genome (Accession number NC_008277) | hypothetical protein BAPKO_0533 | 514583 | 515371 | + | 262 | 111115334 | 4227910 |
| Complete genome (Accession number NC_008277) | hemolysin | 515352 | 516143 | + | 263 | 111115335 | 4227911 |
| Complete genome (Accession number NC_008277) | hypothetical protein BAPKO_0535 | 516140 | 516886 | - | 248 | 111115336 | 4227912 |
| Complete genome (Accession number NC_008277) | GTP-binding protein EngA | 516973 | 518274 | + | 433 | 111115337 | 4227913 |
| Complete genome (Accession number NC_008277) | hypothetical protein BAPKO_0537 | 518271 | 519530 | + | 419 | 111115338 | 4227193 |
| Complete genome (Accession number NC_008277) | hypothetical protein BAPKO_0538 | 519527 | 520213 | + | 228 | 111115339 | 4227194 |
| Complete genome (Accession number NC_008277) | hypothetical protein BAPKO_0539 | 520233 | 526721 | + | 2162 | 111115340 | 4227195 |
| Complete genome (Accession number NC_008277) | phenylalanyl-tRNA synthetase subunit alpha | 526733 | 528295 | + | 520 | 111115341 | 4227196 |
| Complete genome (Accession number NC_008277) | phenylalanyl-tRNA synthetase subunit beta | 528283 | 529986 | + | 567 | 111115342 | 4227197 |
| Complete genome (Accession number NC_008277) | thioredoxin reductase | 530055 | 531035 | + | 326 | 111115343 | 4227198 |
| Complete genome | rRNA methylase | 531056 | 531796 | - | 246 | 111115344 | 4227199 |

Fig. 28 continued

| | | | | | | | |
|---|---|---|---|---|---|---|---|
| (Accession number NC_008277) | | | | | | | |
| Complete genome (Accession number NC_008277) | heat shock protein | 531798 | 532892 | - | 364 | 111115345 | 4227200 |
| Complete genome (Accession number NC_008277) | heat shock protein 70 | 532892 | 534799 | - | 635 | 111115346 | 4227201 |
| Complete genome (Accession number NC_008277) | grpE protein | 534823 | 535386 | - | 187 | 111115347 | 4227202 |
| Complete genome (Accession number NC_008277) | NH(3)-dependent NAD+ synthetase | 535764 | 537302 | + | 512 | 111115348 | 4227203 |
| Complete genome (Accession number NC_008277) | hypothetical protein BAPKO_0548 | 537545 | 537724 | + | 59 | 111115349 | 4227204 |
| Complete genome (Accession number NC_008277) | hypothetical protein BAPKO_0549 | 538068 | 538154 | + | 28 | 111115350 | 4227205 |
| Complete genome (Accession number NC_008277) | hypothetical protein BAPKO_0550 | 538208 | 539062 | + | 284 | 111115351 | 4227206 |
| Complete genome (Accession number NC_008277) | hypothetical protein BAPKO_0551 | 539089 | 539511 | - | 140 | 111115352 | 4227207 |
| Complete genome (Accession number NC_008277) | hypothetical protein BAPKO_0552 | 539616 | 541427 | + | 603 | 111115353 | 4227208 |
| Complete genome (Accession number NC_008277) | pantothenate kinase | 541420 | 542196 | + | 258 | 111115354 | 4227209 |
| Complete genome (Accession number number | aldose reductase, putative | 542231 | 543178 | - | 315 | 111115355 | 4227210 |

Fig. 28 continued

| | | | | | | | |
|---|---|---|---|---|---|---|---|
| NC_008277) | | | | | | | |
| Complete genome (Accession number NC_008277) | hypothetical protein BAPKO_0555 | 543264 | 544073 | - | 269 | 111115356 | 4227211 |
| Complete genome (Accession number NC_008277) | hypothetical protein BAPKO_0556 | 544057 | 544671 | - | 204 | 111115357 | 4227212 |
| Complete genome (Accession number NC_008277) | hypothetical protein BAPKO_0557 | 544674 | 545981 | - | 435 | 111115358 | 4227128 |
| Complete genome (Accession number NC_008277) | pfnP protein | 546177 | 546938 | + | 253 | 111115359 | 4227129 |
| Complete genome (Accession number NC_008277) | exodeoxyribonuclease III | 546959 | 547726 | + | 255 | 111115360 | 4227130 |
| Complete genome (Accession number NC_008277) | hypothetical protein BAPKO_0560 | 547742 | 548512 | + | 256 | 111115361 | 4227131 |
| Complete genome (Accession number NC_008277) | zinc protease, putative | 548493 | 551294 | + | 933 | 111115362 | 4227132 |
| Complete genome (Accession number NC_008277) | hypothetical protein BAPKO_0565 | 551746 | 552390 | - | 214 | 111115363 | 4227136 |
| Complete genome (Accession number NC_008277) | hypothetical protein BAPKO_0566 | 552387 | 552743 | - | 118 | 111115364 | 4227137 |
| Complete genome (Accession number NC_008277) | hypothetical protein BAPKO_0567 | 552828 | 553526 | - | 232 | 111115365 | 4227138 |
| Complete genome (Accession number number | elongation factor G | 553561 | 555642 | - | 693 | 111115366 | 4227139 |

Fig. 28 continued

| | | | | | | | |
|---|---|---|---|---|---|---|---|
| NC_008277) | | | | | | | |
| Complete genome (Accession number NC_008277) | hypothetical protein BAPKO_0569 | 555941 | 556168 | + | 75 | 111115367 | 4227140 |
| Complete genome (Accession number NC_008277) | hypothetical protein BAPKO_0570 | 556400 | 556927 | + | 175 | 111115368 | 4227141 |
| Complete genome (Accession number NC_008277) | hypothetical protein BAPKO_0571 | 557048 | 557698 | + | 216 | 111115369 | 4227142 |
| Complete genome (Accession number NC_008277) | hypothetical protein BAPKO_0572 | 557771 | 557905 | + | 44 | 111115370 | 4227143 |
| Complete genome (Accession number NC_008277) | phosphoribosyl pyrophosphate synthetase | 557892 | 559112 | + | 406 | 111115371 | 4227108 |
| Complete genome (Accession number NC_008277) | xylulokinase | 559116 | 560480 | + | 454 | 111115372 | 4227109 |
| Complete genome (Accession number NC_008277) | hypothetical protein BAPKO_0575 | 560463 | 561209 | - | 248 | 111115373 | 4227110 |
| Complete genome (Accession number NC_008277) | dephospho-CoA kinase | 561193 | 561810 | - | 205 | 111115374 | 4227111 |
| Complete genome (Accession number NC_008277) | DNA polymerase I | 561792 | 564461 | - | 889 | 111115375 | 4227112 |
| Complete genome (Accession number NC_008277) | hypothetical protein BAPKO_0578 | 564515 | 564925 | - | 136 | 111115376 | 4227113 |
| Complete genome (Accession number NC_008277) | flagellar protein | 564915 | 565334 | - | 139 | 111115377 | 4227114 |

Fig. 28 continued

| | | | | | | | |
|---|---|---|---|---|---|---|---|
| Complete genome (Accession number NC_008277) | chemotaxis response regulator | 565343 | 565723 | - | 126 | 111115378 | 4227115 |
| Complete genome (Accession number NC_008277) | DNA ligase | 565973 | 567955 | + | 660 | 111115379 | 4227116 |
| Complete genome (Accession number NC_008277) | hypothetical protein BAPKO_0582 | 567979 | 569484 | - | 501 | 111115380 | 4227117 |
| Complete genome (Accession number NC_008277) | hypothetical protein BAPKO_0583 | 569764 | 571626 | + | 620 | 111115381 | 4227118 |
| Complete genome (Accession number NC_008277) | hypothetical protein BAPKO_0584 | 571613 | 571984 | + | 123 | 111115382 | 4227119 |
| Complete genome (Accession number NC_008277) | hypothetical protein BAPKO_0585 | 572073 | 572942 | + | 289 | 111115383 | 4227120 |
| Complete genome (Accession number NC_008277) | phosphocarrier protein HPr | 573080 | 573340 | + | 86 | 111115384 | 4227121 |
| Complete genome (Accession number NC_008277) | phosphoenolpyruvate-protein phosphatase | 573361 | 575082 | + | 573 | 111115385 | 4227122 |
| Complete genome (Accession number NC_008277) | glucose-specific PTS system component | 575085 | 575654 | + | 189 | 111115386 | 4227123 |
| Complete genome (Accession number NC_008277) | heat shock protein 90 | 575691 | 577541 | - | 616 | 111115387 | 4227124 |
| Complete genome (Accession number NC_008277) | 6-phosphogluconate dehydrogenase | 577654 | 579048 | + | 464 | 111115388 | 4227125 |

Fig. 28 continued

| | | | | | | | |
|---|---|---|---|---|---|---|---|
| Complete genome (Accession number NC_008277) | hypothetical protein BAPKO_0591 | 579079 | 579624 | - | 181 | 111115389 | 4227126 |
| Complete genome (Accession number NC_008277) | hypothetical protein BAPKO_0592 | 579727 | 579816 | + | 29 | 111115390 | 4227127 |
| Complete genome (Accession number NC_008277) | hypothetical protein BAPKO_0593 | 579809 | 580327 | - | 172 | 111115391 | 4227296 |
| Complete genome (Accession number NC_008277) | hypothetical protein BAPKO_0594 | 580410 | 580997 | - | 195 | 111115392 | 4227297 |
| Complete genome (Accession number NC_008277) | purine-binding chemotaxis protein | 581210 | 581746 | + | 178 | 111115393 | 4227298 |
| Complete genome (Accession number NC_008277) | hypothetical protein BAPKO_0596 | 581759 | 582070 | + | 103 | 111115394 | 4227299 |
| Complete genome (Accession number NC_008277) | chemotaxis histidine kinase | 582086 | 584227 | + | 713 | 111115395 | 4227300 |
| Complete genome (Accession number NC_008277) | protein-glutamate methylesterase | 584285 | 585442 | + | 385 | 111115396 | 4227301 |
| Complete genome (Accession number NC_008277) | hypothetical protein BAPKO_0599 | 585445 | 587217 | + | 590 | 111115397 | 4227302 |
| Complete genome (Accession number NC_008277) | chemotaxis response regulator | 587258 | 587632 | + | 124 | 111115398 | 4227303 |
| Complete genome (Accession number NC_008277) | uridylate kinase | 587959 | 588648 | - | 229 | 111115399 | 4227305 |
| Complete genome | glycosyl transferase | 588861 | 589925 | + | 354 | 111115400 | 4227306 |

Fig. 28 continued

| | | | | | | | |
|---|---|---|---|---|---|---|---|
| (Accession number NC_008277) | | | | | | | |
| Complete genome (Accession number NC_008277) | ABC transporter, ATP-binding protein | 589988 | 590794 | + | 268 | 111115401 | 4227307 |
| Complete genome (Accession number NC_008277) | hypothetical protein BAPKO_0605 | 590801 | 591652 | + | 283 | 111115402 | 4227308 |
| Complete genome (Accession number NC_008277) | CTP synthetase | 591839 | 593440 | + | 533 | 111115403 | 4227309 |
| Complete genome (Accession number NC_008277) | hypothetical protein BAPKO_0607 | 593457 | 593981 | - | 174 | 111115404 | 4227310 |
| Complete genome (Accession number NC_008277) | hypothetical protein BAPKO_0608 | 594119 | 594709 | + | 196 | 111115405 | 4227311 |
| Complete genome (Accession number NC_008277) | methyl-accepting chemotaxis protein | 594956 | 596128 | + | 390 | 111115406 | 4227312 |
| Complete genome (Accession number NC_008277) | DNA polymerase III subunit alpha | 596216 | 599701 | + | 1161 | 111115407 | 4227313 |
| Complete genome (Accession number NC_008277) | hypothetical protein BAPKO_0611 | 599710 | 600291 | + | 193 | 111115408 | 4227914 |
| Complete genome (Accession number NC_008277) | DNA recombinase | 600301 | 602361 | + | 686 | 111115409 | 4227915 |
| Complete genome (Accession number NC_008277) | hypothetical protein BAPKO_0613 | 602358 | 603146 | - | 262 | 111115410 | 4227916 |
| Complete genome (Accession number | hypothetical protein BAPKO_0614 | 603275 | 604624 | + | 449 | 111115411 | 4227917 |

Fig. 28 continued

| | | | | | | | |
|---|---|---|---|---|---|---|---|
| NC_008277) | | | | | | | |
| Complete genome (Accession number NC_008277) | hypothetical protein BAPKO_0615 | 604779 | 606125 | + | 448 | 111115412 | 4227918 |
| Complete genome (Accession number NC_008277) | UDP-N-acetylmuramoyl alanine--D-glutamate ligase | 606144 | 607499 | + | 451 | 111115413 | 4227919 |
| Complete genome (Accession number NC_008277) | femA protein | 607496 | 608539 | - | 347 | 111115414 | 4227920 |
| Complete genome (Accession number NC_008277) | methionyl-tRNA synthetase | 608549 | 610723 | - | 724 | 111115415 | 4227921 |
| Complete genome (Accession number NC_008277) | 5-methylthioaden osine/S-adenosylhomoc ysteine nucleosidase, putative | 610882 | 611676 | + | 264 | 111115416 | 4227922 |
| Complete genome (Accession number NC_008277) | phosphate acetyltransfera se | 611768 | 612805 | + | 345 | 111115417 | 4227923 |
| Complete genome (Accession number NC_008277) | dimethyladenos ine transferase | 612788 | 613633 | - | 281 | 111115418 | 4227924 |
| Complete genome (Accession number NC_008277) | competence locus E, putative | 613666 | 614922 | - | 418 | 111115419 | 4227925 |
| Complete genome (Accession number NC_008277) | hypothetical protein BAPKO_0623 | 615078 | 615752 | + | 224 | 111115420 | 4227926 |
| Complete genome (Accession number NC_008277) | long-chain-fatty-acid CoA ligase | 615778 | 617715 | + | 645 | 111115421 | 4227927 |
| Complete genome | arginyl-tRNA synthetase | 617744 | 619501 | - | 585 | 111115422 | 4227928 |

Fig. 28 continued

| | | | | | | | |
|---|---|---|---|---|---|---|---|
| (Accession number NC_008277) | | | | | | | |
| Complete genome (Accession number NC_008277) | hypothetical protein BAPKO_0626 | 619494 | 619544 | - | 16 | 111115423 | 4227929 |
| Complete genome (Accession number NC_008277) | hypothetical protein BAPKO_0627 | 619547 | 620146 | - | 199 | 111115424 | 4227930 |
| Complete genome (Accession number NC_008277) | methyl-accepting chemotaxis protein | 620168 | 622315 | - | 715 | 111115425 | 4227931 |
| Complete genome (Accession number NC_008277) | methyl-accepting chemotaxis protein | 622583 | 624790 | + | 735 | 111115426 | 4227932 |
| Complete genome (Accession number NC_008277) | UDP-N-acetylmuramate dehydrogenase | 624795 | 625706 | - | 303 | 111115427 | 4227933 |
| Complete genome (Accession number NC_008277) | cysteinyl-tRNA synthetase | 625758 | 627200 | + | 480 | 111115428 | 4227934 |
| Complete genome (Accession number NC_008277) | hypothetical protein BAPKO_0632 | 627097 | 627240 | + | 47 | 111115429 | 4227935 |
| Complete genome (Accession number NC_008277) | hypothetical protein BAPKO_0633 | 627204 | 628760 | + | 518 | 111115430 | 4227936 |
| Complete genome (Accession number NC_008277) | serine hydroxymethyltransferase | 628760 | 630013 | + | 417 | 111115431 | 4227937 |
| Complete genome (Accession number NC_008277) | DnaJ domain containing protein | 630040 | 630792 | + | 250 | 111115432 | 4227938 |
| Complete genome (Accession number | membrane-associated protein p66 | 630853 | 632712 | - | 619 | 111115433 | 4227939 |

Fig. 28 continued

| | | | | | | | |
|---|---|---|---|---|---|---|---|
| NC_008277) | | | | | | | |
| Complete genome (Accession number NC_008277) | L-lactate permease | 632951 | 634453 | - | 500 | 111115434 | 4227940 |
| Complete genome (Accession number NC_008277) | serine-type D-Ala-D-Ala carboxypeptidase | 634538 | 635743 | + | 401 | 111115435 | 4227941 |
| Complete genome (Accession number NC_008277) | hypothetical protein BAPKO_0639 | 635760 | 636261 | + | 163 | 111115436 | 4227942 |
| Complete genome (Accession number NC_008277) | rep helicase, single-stranded DNA-dependent ATPase | 636254 | 638233 | + | 659 | 111115437 | 4227943 |
| Complete genome (Accession number NC_008277) | aminoacyl-histidine dipeptidase | 638346 | 639776 | + | 476 | 111115438 | 4227944 |
| Complete genome (Accession number NC_008277) | trigger factor | 640354 | 641712 | + | 452 | 111115439 | 4227232 |
| Complete genome (Accession number NC_008277) | ATP-dependent Clp protease proteolytic component | 641718 | 642311 | + | 197 | 111115440 | 4227233 |
| Complete genome (Accession number NC_008277) | ATP-dependent protease ATP-binding subunit | 642336 | 643628 | + | 430 | 111115441 | 4227234 |
| Complete genome (Accession number NC_008277) | ATP-dependent protease LA | 643597 | 646005 | + | 802 | 111115442 | 4227235 |
| Complete genome (Accession number NC_008277) | hypothetical protein BAPKO_0650 | 646045 | 646197 | + | 50 | 111115443 | 4227236 |
| Complete genome (Accession number | hypothetical protein BAPKO_0651 | 646142 | 646249 | + | 35 | 111115444 | 4227237 |

Fig. 28 continued

| | | | | | | | |
|---|---|---|---|---|---|---|---|
| NC_008277) | | | | | | | |
| Complete genome (Accession number NC_008277) | 30S ribosomal protein S4 | 646261 | 646887 | - | 208 | 111115445 | 4227238 |
| Complete genome (Accession number NC_008277) | hypothetical protein BAPKO_0654 | 647064 | 648425 | - | 453 | 111115446 | 4227240 |
| Complete genome (Accession number NC_008277) | hypothetical protein BAPKO_0655 | 648546 | 648914 | + | 122 | 111115447 | 4227241 |
| Complete genome (Accession number NC_008277) | cytidine deaminase | 648937 | 649377 | - | 146 | 111115448 | 4227242 |
| Complete genome (Accession number NC_008277) | hypothetical protein BAPKO_0657 | 649497 | 650459 | + | 320 | 111115449 | 4227243 |
| Complete genome (Accession number NC_008277) | hypothetical protein BAPKO_0658 | 650437 | 652032 | - | 531 | 111115450 | 4227244 |
| Complete genome (Accession number NC_008277) | 4-methyl-5(b-hydroxyethyl)-thiazole monophosphate biosynthesis protein | 652331 | 652885 | + | 184 | 111115451 | 4227246 |
| Complete genome (Accession number NC_008277) | hypothetical protein BAPKO_0661 | 652882 | 652974 | + | 30 | 111115452 | 4227247 |
| Complete genome (Accession number NC_008277) | acetate kinase | 652947 | 654128 | - | 393 | 111115453 | 4227248 |
| Complete genome (Accession number NC_008277) | transcription-repair coupling factor | 654189 | 657563 | - | 1124 | 111115454 | 4227249 |
| Complete genome (Accession | hypothetical protein BAPKO_0664 | 657660 | 658622 | + | 320 | 111115455 | 4227250 |

Fig. 28 continued

| | | | | | | | |
|---|---|---|---|---|---|---|---|
| number NC_008277) | | | | | | | |
| Complete genome (Accession number NC_008277) | N-acetylmuramoyl-L-alanine amidase, putative | 658636 | 660678 | + | 680 | 111115456 | 4227251 |
| Complete genome (Accession number NC_008277) | small primase-like protein | 660772 | 661317 | - | 181 | 111115457 | 4227253 |
| Complete genome (Accession number NC_008277) | hypothetical protein BAPKO_0668 | 661286 | 661336 | - | 16 | 111115458 | 4227353 |
| Complete genome (Accession number NC_008277) | putative aminopeptidase 2 | 661320 | 662591 | - | 423 | 111115459 | 4227354 |
| Complete genome (Accession number NC_008277) | hypothetical protein BAPKO_0670 | 662676 | 663401 | + | 241 | 111115460 | 4227355 |
| Complete genome (Accession number NC_008277) | PTS system, fructose-specific IIABC component | 663429 | 665294 | - | 621 | 111115461 | 4227356 |
| Complete genome (Accession number NC_008277) | 1-phosphofructokinase | 665384 | 666307 | + | 307 | 111115462 | 4227357 |
| Complete genome (Accession number NC_008277) | hypothetical protein BAPKO_0673 | 666356 | 666673 | - | 105 | 111115463 | 4227358 |
| Complete genome (Accession number NC_008277) | exodeoxyribonuclease V, alpha chain | 666937 | 668769 | - | 610 | 111115464 | 4227360 |
| Complete genome (Accession number NC_008277) | exodeoxyribonuclease V, beta chain | 668766 | 672278 | - | 1170 | 111115465 | 4227361 |
| Complete genome (Accession number | exodeoxyribonuclease V, gamma chain | 672284 | 675523 | - | 1079 | 111115466 | 4227362 |

Fig. 28 continued

| | | | | | | | |
|---|---|---|---|---|---|---|---|
| NC_008277) | | | | | | | |
| Complete genome (Accession number NC_008277) | nicotinate phosphoribosyl transferase | 675527 | 676972 | - | 481 | 111115467 | 4227363 |
| Complete genome (Accession number NC_008277) | glucose-6-phosphate 1-dehydrogenase | 677105 | 678541 | + | 478 | 111115468 | 4227364 |
| Complete genome (Accession number NC_008277) | Na+/H+ antiporter | 678842 | 680185 | + | 447 | 111115469 | 4227365 |
| Complete genome (Accession number NC_008277) | hypothetical protein BAPKO_0681 | 680133 | 680219 | - | 28 | 111115470 | 4227848 |
| Complete genome (Accession number NC_008277) | Na+/H+ antiporter | 680285 | 681640 | + | 451 | 111115471 | 4227849 |
| Complete genome (Accession number NC_008277) | spermidine/putrescine ABC transporter, binding periplasmic protein | 681686 | 682732 | - | 348 | 111115472 | 4227850 |
| Complete genome (Accession number NC_008277) | spermidine/putrescine ABC transporter, permease protein | 682752 | 683543 | - | 263 | 111115473 | 4227851 |
| Complete genome (Accession number NC_008277) | spermidine/putrescine ABC transporter, permease protein | 683547 | 684356 | - | 269 | 111115474 | 4227852 |
| Complete genome (Accession number NC_008277) | spermidine/putrescine ABC transporter, ATP-binding protein | 684356 | 685399 | - | 347 | 111115475 | 4227853 |
| Complete genome (Accession number NC_008277) | ribosomal biogenesis GTPase | 685478 | 686284 | - | 268 | 111115476 | 4227854 |
| Complete genome (Accession | N-acetylmannosamine-6- | 686488 | 687186 | + | 232 | 111115477 | 4227855 |

Fig. 28 continued

| | | | | | | | |
|---|---|---|---|---|---|---|---|
| number NC_008277) | phosphate 2-epimerase | | | | | | |
| Complete genome (Accession number NC_008277) | PTS system, glucose-specific IIBC component | 687235 | 688779 | + | 514 | 111115478 | 4227856 |
| Complete genome (Accession number NC_008277) | hypothetical protein BAPKO_0690 | 688805 | 689788 | - | 327 | 111115479 | 4227857 |
| Complete genome (Accession number NC_008277) | ferric uptake regulation protein | 689785 | 690312 | - | 175 | 111115480 | 4227858 |
| Complete genome (Accession number NC_008277) | serine/threonine kinase, putative | 690412 | 692100 | - | 562 | 111115481 | 4227859 |
| Complete genome (Accession number NC_008277) | chaperonin GroEL | 692291 | 693928 | + | 545 | 111115482 | 4227860 |
| Complete genome (Accession number NC_008277) | hypothetical protein BAPKO_0694 | 693995 | 694291 | + | 98 | 111115483 | 4227861 |
| Complete genome (Accession number NC_008277) | hypothetical protein BAPKO_0695 | 694304 | 694618 | + | 104 | 111115484 | 4227862 |
| Complete genome (Accession number NC_008277) | preprotein translocase subunit SecD | 694684 | 696444 | + | 586 | 111115485 | 4227863 |
| Complete genome (Accession number NC_008277) | preprotein translocase subunit SecF | 696428 | 697327 | + | 299 | 111115486 | 4227864 |
| Complete genome (Accession number NC_008277) | hypothetical protein BAPKO_0698 | 697354 | 698496 | + | 380 | 111115487 | 4227865 |
| Complete genome (Accession number number | heat shock protein | 698493 | 699323 | - | 276 | 111115488 | 4227866 |

Fig. 28 continued

| | | | | | | | |
|---|---|---|---|---|---|---|---|
| NC_008277) | | | | | | | |
| Complete genome (Accession number NC_008277) | HemN-related protein | 699432 | 700565 | + | 377 | 111115489 | 4227647 |
| Complete genome (Accession number NC_008277) | ribose 5-phosphate isomerase | 700552 | 701238 | - | 228 | 111115490 | 4227648 |
| Complete genome (Accession number NC_008277) | phosphoglycerate mutase | 701383 | 702129 | + | 248 | 111115491 | 4227649 |
| Complete genome (Accession number NC_008277) | lysyl-tRNA synthetase | 702199 | 703764 | - | 521 | 111115492 | 4227650 |
| Complete genome (Accession number NC_008277) | GTP-binding protein Era | 703837 | 704709 | - | 290 | 111115493 | 4227651 |
| Complete genome (Accession number NC_008277) | hypothetical protein BAPKO_0705 | 704816 | 705172 | + | 118 | 111115494 | 4227652 |
| Complete genome (Accession number NC_008277) | hypothetical protein BAPKO_0706 | 705182 | 705592 | + | 136 | 111115495 | 4227653 |
| Complete genome (Accession number NC_008277) | hypothetical protein BAPKO_0707 | 705612 | 706061 | + | 149 | 111115496 | 4227654 |
| Complete genome (Accession number NC_008277) | hypothetical protein BAPKO_0708 | 706070 | 706759 | - | 229 | 111115497 | 4227655 |
| Complete genome (Accession number NC_008277) | hypothetical protein BAPKO_0709 | 706802 | 707761 | + | 319 | 111115498 | 4227656 |
| Complete genome (Accession number NC_008277) | hypothetical protein BAPKO_0710 | 707745 | 708752 | + | 335 | 111115499 | 4227657 |

Fig. 28 continued

| | | | | | | | |
|---|---|---|---|---|---|---|---|
| Complete genome (Accession number NC_008277) | hypothetical protein BAPKO_0711 | 708742 | 709293 | + | 183 | 111115500 | 4227658 |
| Complete genome (Accession number NC_008277) | flagellar filament outer layer protein | 709376 | 710401 | + | 341 | 111115501 | 4227659 |
| Complete genome (Accession number NC_008277) | chemotaxis histidine kinase | 710476 | 713070 | + | 864 | 111115502 | 4227660 |
| Complete genome (Accession number NC_008277) | purine-binding chemotaxis protein | 713078 | 714478 | + | 466 | 111115503 | 4227661 |
| Complete genome (Accession number NC_008277) | chemotaxis operon protein | 714490 | 714975 | + | 161 | 111115504 | 4227662 |
| Complete genome (Accession number NC_008277) | chemotaxis response regulator | 715015 | 715455 | + | 146 | 111115505 | 4227663 |
| Complete genome (Accession number NC_008277) | hypothetical protein BAPKO_0717 | 715504 | 716010 | - | 168 | 111115506 | 4227664 |
| Complete genome (Accession number NC_008277) | hypothetical protein BAPKO_0718 | 716007 | 717053 | - | 348 | 111115507 | 4227665 |
| Complete genome (Accession number NC_008277) | hypothetical protein BAPKO_0719 | 717047 | 717910 | - | 287 | 111115508 | 4227666 |
| Complete genome (Accession number NC_008277) | phosphoglycolate phosphatase | 717907 | 718569 | - | 220 | 111115509 | 4227962 |
| Complete genome (Accession number NC_008277) | ribose/galactose ABC transporter, ATP-binding protein | 718812 | 720422 | + | 536 | 111115510 | 4227963 |

Fig. 28 continued

| | | | | | | | |
|---|---|---|---|---|---|---|---|
| Complete genome (Accession number NC_008277) | ribose/galactose ABC transporter, permease protein | 720423 | 721574 | + | 383 | 111115511 | 4227964 |
| Complete genome (Accession number NC_008277) | ribose/galactose ABC transporter, permease protein | 721546 | 722472 | + | 308 | 111115512 | 4227965 |
| Complete genome (Accession number NC_008277) | methyl-accepting chemotaxis protein | 722629 | 724890 | + | 753 | 111115513 | 4227966 |
| Complete genome (Accession number NC_008277) | methyl-accepting chemotaxis protein | 724921 | 726822 | + | 633 | 111115514 | 4227967 |
| Complete genome (Accession number NC_008277) | tRNA (5-methylaminomethyl-2-thiouridylate)-methyltransferase | 726864 | 727931 | - | 355 | 111115515 | 4227968 |
| Complete genome (Accession number NC_008277) | 3-hydroxy-3-methylglutaryl-CoA synthase | 728027 | 729250 | + | 407 | 111115516 | 4227969 |
| Complete genome (Accession number NC_008277) | isopentenyl pyrophosphate isomerase | 729234 | 730298 | + | 354 | 111115517 | 4227970 |
| Complete genome (Accession number NC_008277) | 3-hydroxy-3-methylglutaryl-CoA reductase | 730288 | 731556 | + | 422 | 111115518 | 4227971 |
| Complete genome (Accession number NC_008277) | mevalonate pyrophosphate decarboxylase | 731540 | 732478 | + | 312 | 111115519 | 4227972 |
| Complete genome (Accession number NC_008277) | phosphomevalonate kinase, putative | 732469 | 733422 | + | 317 | 111115520 | 4227973 |
| Complete genome (Accession number NC_008277) | mevalonate kinase, putative | 733416 | 734309 | + | 297 | 111115521 | 4227974 |

Fig. 28 continued

| Complete genome (Accession number NC_008277) | hypothetical protein BAPKO_0734 | 734432 | 734899 | - | 155 | 111115522 | 4227976 |
|---|---|---|---|---|---|---|---|
| Complete genome (Accession number NC_008277) | neutrophil activating protein | 734984 | 735514 | + | 176 | 111115523 | 4227977 |
| Complete genome (Accession number NC_008277) | elongation factor G | 735591 | 737600 | + | 669 | 111115524 | 4227978 |
| Complete genome (Accession number NC_008277) | xylose operon regulatory protein | 737879 | 739087 | + | 402 | 111115525 | 4227107 |
| Complete genome (Accession number NC_008277) | signal recognition particle protein | 739150 | 740484 | + | 444 | 111115526 | 4227074 |
| Complete genome (Accession number NC_008277) | 30S ribosomal protein S16 | 740497 | 740757 | + | 86 | 111115527 | 4227075 |
| Complete genome (Accession number NC_008277) | hypothetical protein BAPKO_0740 | 740758 | 741006 | + | 82 | 111115528 | 4227076 |
| Complete genome (Accession number NC_008277) | hypothetical protein BAPKO_0741 | 741010 | 741510 | + | 166 | 111115529 | 4227077 |
| Complete genome (Accession number NC_008277) | tRNA (guanine-N(1)-)-methyltransferase | 741507 | 742226 | + | 239 | 111115530 | 4227078 |
| Complete genome (Accession number NC_008277) | 50S ribosomal protein L19 | 742204 | 742563 | + | 119 | 111115531 | 4227079 |
| Complete genome (Accession number NC_008277) | hypothetical protein BAPKO_0744 | 742944 | 743483 | + | 179 | 111115532 | 4227080 |

Fig. 28 continued

| | | | | | | | |
|---|---|---|---|---|---|---|---|
| Complete genome (Accession number NC_008277) | lipopolysaccharide biosynthesis-related protein | 743485 | 743976 | + | 163 | 111115533 | 4227081 |
| Complete genome (Accession number NC_008277) | 50S ribosomal protein L32 | 744039 | 744221 | + | 60 | 111115534 | 4227082 |
| Complete genome (Accession number NC_008277) | acyl carrier protein | 744245 | 744487 | + | 80 | 111115535 | 4227083 |
| Complete genome (Accession number NC_008277) | ribonuclease III | 744487 | 745224 | + | 245 | 111115536 | 4227084 |
| Complete genome (Accession number NC_008277) | polynucleotide adenylyltransferase | 745195 | 746427 | − | 410 | 111115537 | 4227085 |
| Complete genome (Accession number NC_008277) | hypothetical protein BAPKO_0750 | 746545 | 748317 | + | 590 | 111115538 | 4227086 |
| Complete genome (Accession number NC_008277) | hypothetical protein BAPKO_0751 | 748323 | 748646 | + | 107 | 111115539 | 4227087 |
| Complete genome (Accession number NC_008277) | hypothetical protein BAPKO_0754 | 749104 | 750135 | + | 343 | 111115540 | 4227090 |
| Complete genome (Accession number NC_008277) | DNA primase | 750141 | 751922 | + | 593 | 111115541 | 4227091 |
| Complete genome (Accession number NC_008277) | RNA polymerase sigma factor RpoD | 751926 | 753821 | + | 631 | 111115542 | 4227055 |
| Complete genome (Accession number NC_008277) | hypothetical protein BAPKO_0757 | 753818 | 754594 | + | 258 | 111115543 | 4227056 |

Fig. 28 continued

| Complete genome (Accession number NC_008277) | hypothetical protein BAPKO_0758 | 754999 | 755967 | + | 322 | 111115544 | 4227057 |
|---|---|---|---|---|---|---|---|
| Complete genome (Accession number NC_008277) | rod shape-determining protein | 755942 | 757027 | + | 361 | 111115545 | 4227058 |
| Complete genome (Accession number NC_008277) | rod shape-determining protein | 757031 | 757876 | + | 281 | 111115546 | 4227059 |
| Complete genome (Accession number NC_008277) | hypothetical protein BAPKO_0761 | 757876 | 758358 | + | 160 | 111115547 | 4227060 |
| Complete genome (Accession number NC_008277) | penicillin-binding protein | 758358 | 760157 | + | 599 | 111115548 | 4227061 |
| Complete genome (Accession number NC_008277) | rod shape-determining protein | 760162 | 761478 | + | 438 | 111115549 | 4227062 |
| Complete genome (Accession number NC_008277) | threonyl-tRNA synthetase | 761645 | 763390 | + | 581 | 111115550 | 4227063 |
| Complete genome (Accession number NC_008277) | CDP-diacylglycerol--glycerol-3-phosphate 3-phosphatidyltransferase | 763395 | 764024 | + | 209 | 111115551 | 4227064 |
| Complete genome (Accession number NC_008277) | hypothetical protein BAPKO_0766 | 764011 | 765456 | + | 481 | 111115552 | 4227065 |
| Complete genome (Accession number NC_008277) | adenylyl cyclase, CyaB-type, putative | 765430 | 765963 | - | 177 | 111115553 | 4227066 |
| Complete genome (Accession number NC_008277) | K+ transport protein | 766063 | 767382 | + | 439 | 111115554 | 4227067 |

Fig. 28 continued

| | | | | | | | |
|---|---|---|---|---|---|---|---|
| Complete genome (Accession number NC_008277) | hypothetical protein BAPKO_0769 | 767386 | 768168 | + | 260 | 111115555 | 4227068 |
| Complete genome (Accession number NC_008277) | minD-related ATP-binding protein | 768178 | 769149 | + | 323 | 111115556 | 4227069 |
| Complete genome (Accession number NC_008277) | diphosphate--fructose-6-phosphate 1-phosphotransferase | 769180 | 770523 | + | 447 | 111115557 | 4227070 |
| Complete genome (Accession number NC_008277) | coenzyme A disulfide reductase | 770538 | 771869 | - | 443 | 111115558 | 4227071 |
| Complete genome (Accession number NC_008277) | glutamate transporter | 771884 | 773275 | - | 463 | 111115559 | 4227072 |
| Complete genome (Accession number NC_008277) | glucose-6-phosphate isomerase | 773340 | 774932 | - | 530 | 111115560 | 4227073 |
| Complete genome (Accession number NC_008277) | hypothetical protein BAPKO_0775 | 774955 | 775356 | - | 133 | 111115561 | 4227484 |
| Complete genome (Accession number NC_008277) | penicillin-binding protein | 775363 | 778134 | - | 923 | 111115562 | 4227526 |
| Complete genome (Accession number NC_008277) | hypothetical protein BAPKO_0777 | 778429 | 779214 | + | 261 | 111115563 | 4227527 |
| Complete genome (Accession number NC_008277) | hypothetical protein BAPKO_0778 | 779420 | 780424 | - | 334 | 111115564 | 4227528 |
| Complete genome (Accession number NC_008277) | rare lipoprotein A | 780504 | 781316 | + | 270 | 111115565 | 4227529 |

Fig. 28 continued

| Complete genome (Accession number NC_008277) | histidine phosphokinase/ phophatase, putative | 781512 | 782516 | + | 334 | 111115566 | 4227530 |
|---|---|---|---|---|---|---|---|
| Complete genome (Accession number NC_008277) | valyl-tRNA synthetase | 782506 | 785133 | + | 875 | 111115567 | 4227531 |
| Complete genome (Accession number NC_008277) | hypothetical protein BAPKO_0782 | 785224 | 785823 | - | 199 | 111115568 | 4227532 |
| Complete genome (Accession number NC_008277) | hypothetical protein BAPKO_0783 | 785897 | 786244 | - | 115 | 111115569 | 4227533 |
| Complete genome (Accession number NC_008277) | co-chaperonin GroES | 786733 | 787005 | - | 90 | 111115570 | 4227534 |
| Complete genome (Accession number NC_008277) | ABC transporter, ATP-binding protein | 787163 | 788794 | + | 543 | 111115571 | 4227535 |
| Complete genome (Accession number NC_008277) | hypothetical protein BAPKO_0786 | 788854 | 790509 | + | 551 | 111115572 | 4227536 |
| Complete genome (Accession number NC_008277) | antigen, p83/100 | 790613 | 792604 | + | 663 | 111115573 | 4227537 |
| Complete genome (Accession number NC_008277) | hypothetical protein BAPKO_0788 | 792637 | 792738 | - | 33 | 111115574 | 4227538 |
| Complete genome (Accession number NC_008277) | endonuclease III | 792921 | 793565 | + | 214 | 111115575 | 4227541 |
| Complete genome (Accession number NC_008277) | oligopeptide ABC transporter, permease protein | 793574 | 794434 | - | 266 | 111115576 | 4227542 |

Fig. 28 continued

| Complete genome (Accession number NC_008277) | oligopeptide ABC transporter, permease protein | 794434 | 795414 | - | 326 | 111115577 | 4227632 |
|---|---|---|---|---|---|---|---|
| Complete genome (Accession number NC_008277) | hypothetical protein BAPKO_0794 | 795421 | 795879 | - | 152 | 111115578 | 4227633 |
| Complete genome (Accession number NC_008277) | hypothetical protein BAPKO_0795 | 795978 | 797099 | + | 373 | 111115579 | 4227634 |
| Complete genome (Accession number NC_008277) | hypothetical protein BAPKO_0796 | 797334 | 798347 | - | 337 | 111115580 | 4227635 |
| Complete genome (Accession number NC_008277) | hypothetical protein BAPKO_0797 | 798364 | 799872 | - | 502 | 111115581 | 4227636 |
| Complete genome (Accession number NC_008277) | hypothetical protein BAPKO_0798 | 799877 | 800611 | - | 244 | 111115582 | 4227637 |
| Complete genome (Accession number NC_008277) | ABC transporter, ATP-binding protein | 800608 | 801537 | - | 309 | 111115583 | 4227638 |
| Complete genome (Accession number NC_008277) | ribonuclease Z | 801546 | 802505 | - | 319 | 111115584 | 4227639 |
| Complete genome (Accession number NC_008277) | hypothetical protein BAPKO_0801 | 802635 | 802739 | + | 34 | 111115585 | 4227640 |
| Complete genome (Accession number NC_008277) | hypothetical protein BAPKO_0802 | 802675 | 802788 | + | 37 | 111115586 | 4227868 |
| Complete genome (Accession number NC_008277) | hypothetical protein BAPKO_0803 | 802696 | 803763 | - | 355 | 111115587 | 4227869 |

Fig. 28 continued

| | | | | | | | |
|---|---|---|---|---|---|---|---|
| Complete genome (Accession number NC_008277) | ATP-dependent Clp protease proteolytic subunit | 803962 | 804558 | + | 198 | 111115588 | 4227870 |
| Complete genome (Accession number NC_008277) | hypothetical protein BAPKO_0805 | 804536 | 805264 | + | 242 | 111115589 | 4227871 |
| Complete genome (Accession number NC_008277) | hypothetical protein BAPKO_0807 | 805419 | 806276 | - | 285 | 111115590 | 4227873 |
| Complete genome (Accession number NC_008277) | hypothetical protein BAPKO_0808 | 806316 | 806645 | - | 109 | 111115591 | 4227874 |
| Complete genome (Accession number NC_008277) | hypothetical protein BAPKO_0809 | 806756 | 807643 | + | 295 | 111115592 | 4227875 |
| Complete genome (Accession number NC_008277) | response regulatory protein | 807890 | 809248 | - | 452 | 111115593 | 4227876 |
| Complete genome (Accession number NC_008277) | hypothetical protein BAPKO_0811 | 809251 | 809646 | - | 131 | 111115594 | 4227877 |
| Complete genome (Accession number NC_008277) | sensory transduction histidine kinase, putative | 809639 | 810400 | - | 253 | 111115595 | 4227878 |
| Complete genome (Accession number NC_008277) | hypothetical protein BAPKO_0813 | 810397 | 811443 | - | 348 | 111115596 | 4227879 |
| Complete genome (Accession number NC_008277) | colicin V production protein, putative | 811454 | 811942 | - | 162 | 111115597 | 4227880 |
| Complete genome (Accession number NC_008277) | UDP-N-acetylglucosamine--N-acetylmuramyl-(pentapeptide) pyrophosphoryl-undecapr | 811939 | 813030 | - | 363 | 111115598 | 4227881 |

Fig. 28 continued

| | | | | | | | |
|---|---|---|---|---|---|---|---|
| Complete genome (Accession number NC_008277) | pyridoxal kinase | 813208 | 814002 | - | 264 | 111115599 | 4227882 |
| Complete genome (Accession number NC_008277) | O-sialoglycoprotein endopeptidase | 813977 | 815017 | - | 346 | 111115600 | 4227883 |
| Complete genome (Accession number NC_008277) | hypothetical protein BAPKO_0818 | 815014 | 815895 | - | 293 | 111115601 | 4227884 |
| Complete genome (Accession number NC_008277) | RNA polymerase sigma factor | 815946 | 816746 | - | 266 | 111115602 | 4227885 |
| Complete genome (Accession number NC_008277) | hypothetical protein BAPKO_0820 | 816886 | 817206 | - | 106 | 111115603 | 4227886 |
| Complete genome (Accession number NC_008277) | flagellar basal body P-ring protein | 817196 | 818206 | - | 336 | 111115604 | 4227887 |
| Complete genome (Accession number NC_008277) | hypothetical protein BAPKO_0822 | 818380 | 818943 | - | 187 | 111115605 | 4227888 |
| Complete genome (Accession number NC_008277) | flagellar basal body rod protein FlgG | 819014 | 819811 | - | 265 | 111115606 | 4227889 |
| Complete genome (Accession number NC_008277) | flagellar hook-basal body complex protein | 819824 | 820672 | - | 282 | 111115607 | 4227890 |
| Complete genome (Accession number NC_008277) | hypothetical protein BAPKO_0825 | 820921 | 821481 | + | 186 | 111115608 | 4227891 |
| Complete genome (Accession number NC_008277) | adenine phosphoribosyl transferase | 821546 | 822076 | + | 176 | 111115609 | 4227892 |

Fig. 28 continued

| | | | | | | | |
|---|---|---|---|---|---|---|---|
| Complete genome (Accession number NC_008277) | 50S ribosomal protein L21 | 822134 | 822445 | + | 103 | 111115610 | 4227893 |
| Complete genome (Accession number NC_008277) | hypothetical protein BAPKO_0828 | 822451 | 822771 | + | 106 | 111115611 | 4227894 |
| Complete genome (Accession number NC_008277) | 50S ribosomal protein L27 | 822771 | 823016 | + | 81 | 111115612 | 4227314 |
| Complete genome (Accession number NC_008277) | GTPase ObgE | 823058 | 824044 | + | 328 | 111115613 | 4227315 |
| Complete genome (Accession number NC_008277) | hypothetical protein BAPKO_0831 | 824001 | 824081 | + | 26 | 111115614 | 4227316 |
| Complete genome (Accession number NC_008277) | hypothetical protein BAPKO_0832 | 824127 | 824708 | + | 193 | 111115615 | 4227317 |
| Complete genome (Accession number NC_008277) | hypothetical protein BAPKO_0833 | 824705 | 825869 | + | 394 | 111115616 | 4227318 |
| Complete genome (Accession number NC_008277) | hypothetical protein BAPKO_0834 | 825864 | 826214 | + | 116 | 111115617 | 4227319 |
| Complete genome (Accession number NC_008277) | hypothetical protein BAPKO_0835 | 826168 | 826317 | + | 49 | 111115618 | 4227320 |
| Complete genome (Accession number NC_008277) | regulatory protein SpoVG | 826318 | 826611 | + | 97 | 111115619 | 4227321 |
| Complete genome (Accession number NC_008277) | 50S ribosomal protein L25/general stress protein Ctc | 826768 | 827316 | + | 182 | 111115620 | 4227323 |
| Complete genome | peptidyl-tRNA hydrolase | 827321 | 827887 | + | 188 | 111115621 | 4227324 |

Fig. 28 continued

| | | | | | | | |
|---|---|---|---|---|---|---|---|
| (Accession number NC_008277) | | | | | | | |
| Complete genome (Accession number NC_008277) | hypothetical protein BAPKO_0840 | 827887 | 829209 | + | 440 | 111115622 | 4227325 |
| Complete genome (Accession number NC_008277) | cell division protein | 829206 | 831125 | + | 639 | 111115623 | 4227326 |
| Complete genome (Accession number NC_008277) | hypothetical protein BAPKO_0842 | 831131 | 832615 | + | 494 | 111115624 | 4227327 |
| Complete genome (Accession number NC_008277) | thymidine kinase | 832720 | 833823 | + | 367 | 111115625 | 4227328 |
| Complete genome (Accession number NC_008277) | hypothetical protein BAPKO_0844 | 833753 | 833896 | - | 47 | 111115626 | 4227329 |
| Complete genome (Accession number NC_008277) | hypothetical protein BAPKO_0845 | 833820 | 834437 | - | 205 | 111115627 | 4227330 |
| Complete genome (Accession number NC_008277) | thymidylate kinase | 834463 | 835071 | - | 202 | 111115628 | 4227331 |
| Complete genome (Accession number NC_008277) | hypothetical protein BAPKO_0847 | 835157 | 839560 | + | 1467 | 111115629 | 4227332 |
| Complete genome (Accession number NC_008277) | outer membrane protein | 839578 | 842043 | + | 821 | 111115630 | 4227822 |
| Complete genome (Accession number NC_008277) | hypothetical protein BAPKO_0849 | 842064 | 842597 | + | 177 | 111115631 | 4227823 |
| Complete genome (Accession number number | DNA mismatch repair protein | 843020 | 845608 | + | 862 | 111115632 | 4227824 |

Fig. 28 continued

| | | | | | | | |
|---|---|---|---|---|---|---|---|
| NC_008277) | | | | | | | |
| Complete genome (Accession number NC_008277) | competence protein F, putative | 845610 | 846227 | + | 205 | 111115633 | 4227825 |
| Complete genome (Accession number NC_008277) | hypothetical protein BAPKO_0852 | 846328 | 846765 | + | 145 | 111115634 | 4227826 |
| Complete genome (Accession number NC_008277) | transcription elongation factor NusA | 846779 | 848227 | + | 482 | 111115635 | 4227827 |
| Complete genome (Accession number NC_008277) | translation initiation factor IF-2 | 848230 | 850578 | + | 782 | 111115636 | 4227828 |
| Complete genome (Accession number NC_008277) | ribosome-binding factor A | 850601 | 850963 | + | 120 | 111115637 | 4227016 |
| Complete genome (Accession number NC_008277) | tRNA pseudouridine 55 synthase | 850966 | 851814 | + | 282 | 111115638 | 4227017 |
| Complete genome (Accession number NC_008277) | 30S ribosomal protein S15 | 851990 | 852256 | + | 88 | 111115639 | 4227018 |
| Complete genome (Accession number NC_008277) | polynucleotide phosphorylase/ polyadenylase | 852271 | 854439 | + | 722 | 111115640 | 4227019 |
| Complete genome (Accession number NC_008277) | hypothetical protein BAPKO_0859 | 854446 | 855987 | + | 513 | 111115641 | 4227020 |
| Complete genome (Accession number NC_008277) | hypothetical protein BAPKO_0860 | 855962 | 857251 | + | 429 | 111115642 | 4227021 |
| Complete genome (Accession number number | hypothetical protein BAPKO_0861 | 857248 | 858315 | + | 355 | 111115643 | 4227022 |

Fig. 28 continued

| | | | | | | | |
|---|---|---|---|---|---|---|---|
| NC_008277) | | | | | | | |
| Complete genome (Accession number NC_008277) | tRNA-guanine transglycosylase | 858347 | 859474 | + | 375 | 111115644 | 4227023 |
| Complete genome (Accession number NC_008277) | virulence factor mviN protein | 859467 | 860987 | + | 506 | 111115645 | 4227024 |
| Complete genome (Accession number NC_008277) | hypothetical protein BAPKO_0864 | 860984 | 862390 | + | 468 | 111115646 | 4227025 |
| Complete genome (Accession number NC_008277) | pantothenate metabolism flavoprotein | 862415 | 863476 | - | 353 | 111115647 | 4227026 |
| Complete genome (Accession number NC_008277) | hypothetical protein BAPKO_0866 | 863730 | 863834 | - | 34 | 111115648 | 4227027 |
| Complete genome (Accession number NC_008277) | sodium/pantothenate symporter | 863916 | 865250 | + | 444 | 111115649 | 4227144 |
| Complete genome (Accession number NC_008277) | hypothetical protein BAPKO_0868 | 865263 | 866210 | + | 315 | 111115650 | 4227145 |
| Complete genome (Accession number NC_008277) | hypothetical protein BAPKO_0869 | 866179 | 867126 | + | 315 | 111115651 | 4227146 |
| Complete genome (Accession number NC_008277) | UDP-N-acetylmuramate--L-alanine ligase | 867116 | 868522 | + | 468 | 111115652 | 4227147 |
| Complete genome (Accession number NC_008277) | hypothetical protein BAPKO_0871 | 868533 | 869399 | + | 288 | 111115653 | 4227148 |
| Complete genome (Accession number NC_008277) | cytidylate kinase | 869396 | 869932 | + | 178 | 111115654 | 4227149 |

Fig. 28 continued

| | | | | | | | |
|---|---|---|---|---|---|---|---|
| NC_008277) | | | | | | | |
| Complete genome (Accession number NC_008277) | hypothetical protein BAPKO_0873 | 869972 | 870172 | + | 66 | 111115655 | 4227150 |
| Complete genome (Accession number NC_008277) | 2-methylthio-N6-isopentyladenosine tRNA modification enzyme | 870159 | 871061 | + | 300 | 111115656 | 4227151 |
| Complete genome (Accession number NC_008277) | hypothetical protein BAPKO_0875 | 871083 | 871178 | + | 31 | 111115657 | 4227152 |
| Complete genome (Accession number NC_008277) | hypothetical protein BAPKO_0876 | 871222 | 871593 | - | 123 | 111115658 | 4227153 |
| Complete genome (Accession number NC_008277) | hypothetical protein BAPKO_0877 | 871674 | 872219 | + | 181 | 111115659 | 4227154 |
| Complete genome (Accession number NC_008277) | hypothetical protein BAPKO_0878 | 872212 | 872994 | - | 260 | 111115660 | 4227155 |
| Complete genome (Accession number NC_008277) | hypothetical protein BAPKO_0879 | 872987 | 873502 | - | 171 | 111115661 | 4227156 |
| Complete genome (Accession number NC_008277) | ATP-dependent helicase | 873629 | 876100 | - | 823 | 111115662 | 4227157 |
| Complete genome (Accession number NC_008277) | DNA topoisomerase I | 876103 | 878652 | - | 849 | 111115663 | 4227158 |
| Complete genome (Accession number NC_008277) | exonuclease SbcD | 878728 | 879969 | + | 413 | 111115664 | 4227159 |
| Complete genome (Accession number number | exonuclease SbcC | 879956 | 882796 | + | 946 | 111115665 | 4227160 |

Fig. 28 continued

| | | | | | | | |
|---|---|---|---|---|---|---|---|
| NC_008277) | | | | | | | |
| Complete genome (Accession number NC_008277) | xylose operon regulatory protein | 882830 | 883768 | + | 312 | 111115666 | 4227161 |
| Complete genome (Accession number NC_008277) | lipoprotein, putative | 883782 | 884621 | - | 279 | 111115667 | 4227162 |
| Complete genome (Accession number NC_008277) | isoleucyl-tRNA synthetase | 884615 | 887743 | - | 1042 | 111115668 | 4227163 |
| Complete genome (Accession number NC_008277) | ATP-dependent Clp protease, subunit C | 887764 | 889911 | - | 715 | 111115669 | 4227543 |
| Complete genome (Accession number NC_008277) | phosphomanno mutase | 890006 | 891715 | - | 569 | 111115670 | 4227544 |
| Complete genome (Accession number NC_008277) | excinuclease ABC subunit B | 891858 | 893852 | + | 664 | 111115671 | 4227545 |
| Complete genome (Accession number NC_008277) | excinuclease ABC, subunit A | 893869 | 896721 | + | 950 | 111115672 | 4227546 |
| Complete genome (Accession number NC_008277) | hypothetical protein BAPKO_0891 | 896724 | 900125 | + | 1133 | 111115673 | 4227547 |
| Complete genome (Accession number NC_008277) | hypothetical protein BAPKO_0892 | 900091 | 900477 | + | 128 | 111115674 | 4227548 |
| Complete genome (Accession number NC_008277) | hypothetical protein BAPKO_0893 | 900135 | 900674 | - | 179 | 111115675 | 4227549 |
| Complete genome (Accession number NC_008277) | hypothetical protein BAPKO_0894 | 900652 | 901251 | - | 199 | 111115676 | 4227550 |

Fig. 28 continued

| Complete genome (Accession number NC_008277) | lipoprotein, putative | 901261 | 902847 | - | 528 | 111115677 | 4227551 |
|---|---|---|---|---|---|---|---|
| Complete genome (Accession number NC_008277) | arginine deiminase | 903057 | 904286 | + | 409 | 111115678 | 4227552 |
| Complete genome (Accession number NC_008277) | ornithine carbamoyltransferase, catabolic | 904351 | 905337 | + | 328 | 111115679 | 4227553 |

Fig. 28 continued

Fig. 29. Borrelia garinii

| Plasmid or genome | Product Name | Start | End | Strand | Length | Gi | GeneID |
|---|---|---|---|---|---|---|---|
| Plasmid cp26 (Accession number NC_006128) | hypothetical protein BGB01 | 45 | 326 | + | 93 | 51038598 | 2942824 |
| Plasmid cp26 (Accession number NC_006128) | hypothetical protein BGB02 | 310 | 756 | - | 148 | 51038599 | 2942818 |
| Plasmid cp26 (Accession number NC_006128) | hypothetical protein BGB03 | 844 | 2193 | - | 449 | 51038600 | 2942810 |
| Plasmid cp26 (Accession number NC_006128) | PTS system, cellobiose-specific IIC component | 2471 | 3802 | - | 443 | 51038601 | 2942815 |
| Plasmid cp26 (Accession number NC_006128) | PTS system, cellobiose-specific IIA | 3993 | 4340 | + | 115 | 51038602 | 2942820 |
| Plasmid cp26 (Accession number NC_006128) | PTS system, cellobiose-specific IIB component | 4349 | 4666 | + | 105 | 51038603 | 2942809 |
| Plasmid cp26 (Accession number NC_006128) | outer surface protein, putative | 4678 | 5775 | + | 365 | 51038604 | 2942806 |
| Plasmid cp26 (Accession number NC_006128) | hypothetical protein BGB08 | 5796 | 6428 | - | 210 | 51038605 | 2942805 |
| Plasmid cp26 (Accession number NC_006128) | hypothetical protein BGB09 | 6570 | 7613 | + | 347 | 51038606 | 2942823 |

| | | | | | | | |
|---|---|---|---|---|---|---|---|
| Plasmid cp26 (Accession number NC_006128) | hypothetical protein BGB10 | 7729 | 8673 | + | 314 | 51036607 | 2942821 |
| Plasmid cp26 (Accession number NC_006128) | hypothetical protein BGB11 | 8663 | 9181 | + | 172 | 51036608 | 2942826 |
| Plasmid cp26 (Accession number NC_006128) | hypothetical protein BGB12 | 9157 | 9918 | + | 253 | 51036609 | 2942807 |
| Plasmid cp26 (Accession number NC_006128) | hypothetical protein BGB13 | 9986 | 10534 | + | 182 | 51036610 | 2942822 |
| Plasmid cp26 (Accession number NC_006128) | hypothetical protein BGB14 | 10804 | 11319 | - | 171 | 51036611 | 2942814 |
| Plasmid cp26 (Accession number NC_006128) | oligopeptide ABC transporter, periplasmic oligopeptide-binding protein | 12545 | 14146 | + | 533 | 51036612 | 2942812 |
| Plasmid cp26 (Accession number NC_006128) | inositol-5-monophosphate dehydrogenase | 14482 | 15696 | - | 404 | 51036613 | 2942827 |
| Plasmid cp26 (Accession number NC_006128) | bifunctional GMP synthase/glutamine amidotransferase protein | 15721 | 17307 | - | 528 | 51036614 | 2942828 |
| Plasmid cp26 (Accession number NC_006128) | outer surface protein C | 17531 | 18154 | + | 207 | 51036615 | 2942825 |
| Plasmid cp26 (Accession number NC_006128) | hypothetical protein BGB19 | 18596 | 19951 | - | 451 | 51036616 | 2942829 |

Fig. 29 continued

| | | | | | | | |
|---|---|---|---|---|---|---|---|
| Plasmid cp26 (Accession number NC_006128) | hypothetical protein BGB20 | 20061 | 21416 | - | 451 | 51038617 | 2942830 |
| Plasmid cp26 (Accession number NC_006128) | hypothetical protein BGB21 | 21484 | 21990 | - | 168 | 51038618 | 2942817 |
| Plasmid cp26 (Accession number NC_006128) | hypothetical protein BGB22 | 21965 | 22450 | - | 161 | 51038619 | 2942819 |
| Plasmid cp26 (Accession number NC_006128) | hypothetical protein BGB23 | 22524 | 23219 | + | 231 | 51038620 | 2942813 |
| Plasmid cp26 (Accession number NC_006128) | hypothetical protein BGB24 | 23229 | 23780 | - | 183 | 51038621 | 2942816 |
| Plasmid cp26 (Accession number NC_006128) | hypothetical protein BGB25 | 24096 | 25136 | + | 346 | 51038622 | 2942811 |
| Plasmid cp26 (Accession number NC_006128) | PTS system, maltose and glucose-specific IIABC component | 25437 | 27065 | + | 542 | 51038623 | 2942808 |
| Plasmid lp54 (Accession number NC_006129) | hypothetical protein BGA01 | 1024 | 1509 | + | 161 | 51038625 | 2942865 |
| Plasmid lp54 (Accession number NC_006129) | outer membrane protein | 1825 | 2343 | + | 172 | 51038626 | 2942881 |
| Plasmid lp54 (Accession number NC_006129) | antigen, S2 | 2434 | 3255 | - | 273 | 51038627 | 2942890 |
| Plasmid lp54 (Accession number NC_006129) | antigen, S1 | 3380 | 4573 | - | 397 | 51038628 | 2942835 |
| Plasmid lp54 (Accession number | chpAI protein, putative | 4982 | 5455 | - | 157 | 51038629 | 2942880 |

Fig. 29 continued

| | | | | | | | |
|---|---|---|---|---|---|---|---|
| NC_006129) | | | | | | | |
| Plasmid lp54 (Accession number NC_006129) | hypothetical protein BGA06 | 5599 | 5961 | + | 120 | 51038630 | 2942838 |
| Plasmid lp54 (Accession number NC_006129) | hypothetical protein BGA07 | 6163 | 6351 | + | 62 | 51038631 | 2942867 |
| Plasmid lp54 (Accession number NC_006129) | hypothetical protein BGA08 | 6606 | 6812 | + | 68 | 51038632 | 2942892 |
| Plasmid lp54 (Accession number NC_006129) | hypothetical protein BGA09 | 6825 | 7430 | + | 201 | 51038633 | 2942894 |
| Plasmid lp54 (Accession number NC_006129) | hypothetical protein BGA10 | 7885 | 8547 | + | 220 | 51038634 | 2942871 |
| Plasmid lp54 (Accession number NC_006129) | hypothetical protein BGA11 | 8640 | 8750 | + | 36 | 51038635 | 2942802 |
| Plasmid lp54 (Accession number NC_006129) | hypothetical protein BGA12 | 8747 | 9106 | + | 119 | 51038636 | 2942874 |
| Plasmid lp54 (Accession number NC_006129) | hypothetical protein BGA13 | 9302 | 9649 | + | 115 | 51038637 | 2942833 |
| Plasmid lp54 (Accession number NC_006129) | outer surface protein A | 9700 | 10521 | + | 273 | 51038638 | 2942836 |
| Plasmid lp54 (Accession number NC_006129) | outer surface protein B | 10531 | 11415 | + | 294 | 51038639 | 2942852 |
| Plasmid lp54 (Accession number NC_006129) | hypothetical protein BGA16 | 11967 | 13166 | + | 399 | 51038640 | 2942854 |
| Plasmid lp54 (Accession number NC_006129) | hypothetical protein BGA17 | 13172 | 13795 | + | 207 | 51038641 | 2942853 |

Fig. 29 continued

| | | | | | | | |
|---|---|---|---|---|---|---|---|
| Plasmid lp54 (Accession number NC_006129) | hypothetical protein BGA18 | 13771 | 14523 | + | 250 | 51038642 | 2942834 |
| Plasmid lp54 (Accession number NC_006129) | hypothetical protein BGA19 | 14524 | 15096 | + | 190 | 51038643 | 2942855 |
| Plasmid lp54 (Accession number NC_006129) | hypothetical protein BGA20 | 15991 | 16314 | + | 107 | 51038644 | 2942841 |
| Plasmid lp54 (Accession number NC_006129) | decorin binding protein A | 16429 | 16956 | - | 175 | 51038645 | 2942886 |
| Plasmid lp54 (Accession number NC_006129) | decorin binding protein B | 17077 | 17631 | - | 184 | 51038646 | 2942878 |
| Plasmid lp54 (Accession number NC_006129) | hypothetical protein BGA23 | 18024 | 18335 | - | 103 | 51038647 | 2942885 |
| Plasmid lp54 (Accession number NC_006129) | hypothetical protein BGA24 | 19210 | 19773 | + | 187 | 51038648 | 2942831 |
| Plasmid lp54 (Accession number NC_006129) | hypothetical protein BGA25 | 19900 | 20406 | + | 168 | 51038649 | 2942803 |
| Plasmid lp54 (Accession number NC_006129) | hypothetical protein BGA26 | 20749 | 21120 | + | 123 | 51038650 | 2942839 |
| Plasmid lp54 (Accession number NC_006129) | hypothetical protein BGA27 | 21685 | 22152 | + | 155 | 51038651 | 2942897 |
| Plasmid lp54 (Accession number NC_006129) | oligopeptide ABC transporter, periplasmic | 22316 | 23902 | - | 528 | 51038652 | 2942887 |
| Plasmid lp54 (Accession number NC_006129) | hypothetical protein BGA29 | 23865 | 24053 | + | 62 | 51038653 | 2942844 |

Fig. 29 continued

| | | | | | | | |
|---|---|---|---|---|---|---|---|
| Plasmid lp54 (Accession number NC_006129) | lipoprotein | 24377 | 25060 | + | 227 | 51038654 | 2942896 |
| Plasmid lp54 (Accession number NC_006129) | hypothetical protein BGA31 | 25181 | 25789 | + | 202 | 51038655 | 2942895 |
| Plasmid lp54 (Accession number NC_006129) | hypothetical protein BGA32 | 26382 | 26540 | + | 52 | 51038656 | 2942891 |
| Plasmid lp54 (Accession number NC_006129) | hypothetical protein BGA33 | 26718 | 27389 | + | 223 | 51038657 | 2942866 |
| Plasmid lp54 (Accession number NC_006129) | hypothetical protein BGA34 | 27401 | 27928 | + | 175 | 51038658 | 2942889 |
| Plasmid lp54 (Accession number NC_006129) | hypothetical protein BGA35 | 28057 | 28188 | + | 43 | 51038659 | 2942883 |
| Plasmid lp54 (Accession number NC_006129) | hypothetical protein BGA36 | 28188 | 28520 | + | 110 | 51038660 | 2942868 |
| Plasmid lp54 (Accession number NC_006129) | hypothetical protein BGA37 | 28551 | 29495 | + | 314 | 51038661 | 2942856 |
| Plasmid lp54 (Accession number NC_006129) | hypothetical protein BGA38 | 29499 | 29840 | + | 113 | 51038662 | 2942857 |
| Plasmid lp54 (Accession number NC_006129) | hypothetical protein BGA39 | 29956 | 30330 | + | 124 | 51038663 | 2942872 |
| Plasmid lp54 (Accession number NC_006129) | hypothetical protein BGA40 | 30416 | 30700 | + | 94 | 51038664 | 2942875 |
| Plasmid lp54 (Accession number NC_006129) | hypothetical protein BGA41 | 30681 | 30851 | + | 56 | 51038665 | 2942832 |

Fig. 29 continued

| | | | | | | | |
|---|---|---|---|---|---|---|---|
| Plasmid lp54 (Accession number NC_006129) | hypothetical protein BGA42 | 31004 | 31228 | + | 74 | 51038666 | 2942899 |
| Plasmid lp54 (Accession number NC_006129) | hypothetical protein BGA43 | 31264 | 31494 | + | 76 | 51038667 | 2942876 |
| Plasmid lp54 (Accession number NC_006129) | hypothetical protein BGA44 | 31501 | 31971 | + | 156 | 51038668 | 2942860 |
| Plasmid lp54 (Accession number NC_006129) | hypothetical protein BGA45 | 32334 | 32756 | + | 140 | 51038669 | 2942870 |
| Plasmid lp54 (Accession number NC_006129) | hypothetical protein BGA46 | 32799 | 33290 | + | 163 | 51038670 | 2942862 |
| Plasmid lp54 (Accession number NC_006129) | hypothetical protein BGA47 | 33515 | 34081 | + | 188 | 51038671 | 2942848 |
| Plasmid lp54 (Accession number NC_006129) | hypothetical protein BGA48 | 34103 | 34834 | + | 243 | 51038672 | 2942849 |
| Plasmid lp54 (Accession number NC_006129) | hypothetical protein BGA49 | 34923 | 35078 | + | 51 | 51038673 | 2942884 |
| Plasmid lp54 (Accession number NC_006129) | hypothetical protein BGA50 | 35263 | 35487 | + | 74 | 51038674 | 2942847 |
| Plasmid lp54 (Accession number NC_006129) | outer membrane protein | 35526 | 36293 | + | 255 | 51038675 | 2942843 |
| Plasmid lp54 (Accession number NC_006129) | hypothetical protein BGA52 | 36438 | 36668 | + | 76 | 51038676 | 2942846 |
| Plasmid lp54 (Accession number NC_006129) | hypothetical protein BGA53 | 36707 | 36970 | + | 87 | 51038677 | 2942804 |

Fig. 29 continued

| | | | | | | | |
|---|---|---|---|---|---|---|---|
| Plasmid lp54 (Accession number NC_006129) | hypothetical protein BGA54 | 37048 | 37251 | + | 67 | 51036678 | 2942893 |
| Plasmid lp54 (Accession number NC_006129) | hypothetical protein BGA55 | 37254 | 38015 | + | 253 | 51036679 | 2942901 |
| Plasmid lp54 (Accession number NC_006129) | hypothetical protein BGA56 | 37997 | 38344 | + | 115 | 51036680 | 2942879 |
| Plasmid lp54 (Accession number NC_006129) | hypothetical protein BGA57 | 38392 | 38547 | + | 51 | 51036681 | 2942873 |
| Plasmid lp54 (Accession number NC_006129) | hypothetical protein BGA58 | 38600 | 39739 | - | 379 | 51036682 | 2942851 |
| Plasmid lp54 (Accession number NC_006129) | lipoprotein | 40298 | 40510 | - | 70 | 51036683 | 2942877 |
| Plasmid lp54 (Accession number NC_006129) | surface lipoprotein P27 | 40610 | 41443 | - | 277 | 51036684 | 2942842 |
| Plasmid lp54 (Accession number NC_006129) | hypothetical protein BGA61 | 41798 | 42421 | - | 207 | 51036685 | 2942869 |
| Plasmid lp54 (Accession number NC_006129) | lipoprotein | 42689 | 42847 | + | 52 | 51036686 | 2942863 |
| Plasmid lp54 (Accession number NC_006129) | antigen, P35 | 43007 | 43963 | - | 318 | 51036687 | 2942861 |
| Plasmid lp54 (Accession number NC_006129) | hypothetical protein BGA64 | 44130 | 44960 | - | 276 | 51036688 | 2942859 |
| Plasmid lp54 (Accession number NC_006129) | antigen, P35, putative | 45129 | 46403 | - | 424 | 51036689 | 2942900 |
| Plasmid lp54 (Accession number NC_006129) | hypothetical protein BGA66 | 46747 | 47499 | - | 250 | 51036690 | 2942882 |

Fig. 29 continued

| | | | | | | | |
|---|---|---|---|---|---|---|---|
| Plasmid lp54 (Accession number NC_006129) | hypothetical protein BGA67 | 47824 | 48606 | - | 260 | 51036691 | 2942898 |
| Plasmid lp54 (Accession number NC_006129) | hypothetical protein BGA68 | 48839 | 49546 | - | 235 | 51036692 | 2942845 |
| Plasmid lp54 (Accession number NC_006129) | hypothetical protein BGA69 | 49872 | 50075 | - | 67 | 51036693 | 2942837 |
| Plasmid lp54 (Accession number NC_006129) | hypothetical protein BGA70 | 50205 | 50573 | - | 122 | 51036694 | 2942850 |
| Plasmid lp54 (Accession number NC_006129) | hypothetical protein BGA71 | 50845 | 51600 | - | 251 | 51036695 | 2942864 |
| Plasmid lp54 (Accession number NC_006129) | hypothetical protein BGA72 | 51911 | 52684 | - | 257 | 51036696 | 2942858 |
| Plasmid lp54 (Accession number NC_006129) | antigen, P35, putative | 52835 | 53692 | - | 285 | 51036697 | 2942888 |
| Plasmid lp54 (Accession number NC_006129) | outer membrane porin | 54230 | 55003 | + | 257 | 51036698 | 2942840 |
| Complete genome (Accession number NC_006156) | hypothetical protein BG0001 | 443 | 526 | - | 27 | 51598264 | 2957747 |
| Complete genome (Accession number NC_006156) | beta-N-acetylhexosaminidase, putative | 629 | 1648 | - | 339 | 51598265 | 2957836 |
| Complete genome (Accession number NC_006156) | hypothetical protein BG0003 | 1636 | 3114 | - | 492 | 51598266 | 2957388 |
| Complete genome (Accession number NC_006156) | phosphoglucomutase | 3254 | 5041 | + | 595 | 51598267 | 2957341 |

Fig. 29 continued

| | | | | | | | |
|---|---|---|---|---|---|---|---|
| Complete genome (Accession number NC_006156) | tryptophanyl-tRNA synthetase | 5126 | 6163 | - | 345 | 51598268 | 2957736 |
| Complete genome (Accession number NC_006156) | hypothetical protein BG0006 | 6166 | 7254 | - | 362 | 51598269 | 2957926 |
| Complete genome (Accession number NC_006156) | hypothetical protein BG0007 | 7308 | 8168 | - | 286 | 51598270 | 2957823 |
| Complete genome (Accession number NC_006156) | hypothetical protein BG0008 | 8277 | 9047 | + | 256 | 51598271 | 2957719 |
| Complete genome (Accession number NC_006156) | hypothetical protein BG0009 | 9052 | 10056 | + | 334 | 51598272 | 2957763 |
| Complete genome (Accession number NC_006156) | holo-acyl-carrier protein synthase, putative | 10053 | 10427 | + | 124 | 51598273 | 2957930 |
| Complete genome (Accession number NC_006156) | hypothetical protein BG0011 | 10431 | 11270 | + | 279 | 51598274 | 2958006 |
| Complete genome (Accession number NC_006156) | tRNA pseudouridine synthase A | 11271 | 12011 | + | 246 | 51598275 | 2957468 |
| Complete genome (Accession number NC_006156) | hypothetical protein BG0013 | 12004 | 12594 | + | 196 | 51598276 | 2957813 |
| Complete genome (Accession number NC_006156) | primosomal protein N | 12587 | 14569 | + | 660 | 51598277 | 2957928 |
| Complete genome (Accession number NC_006156) | uridine kinase | 14566 | 15186 | - | 206 | 51598278 | 2957927 |

Fig. 29 continued

| Complete genome (Accession number NC_006156) | glpE protein | 15186 | 15467 | - | 93 | 51598279 | 2957998 |
|---|---|---|---|---|---|---|---|
| Complete genome (Accession number NC_006156) | hypothetical protein BG0017 | 15690 | 16655 | + | 321 | 51598280 | 2957916 |
| Complete genome (Accession number NC_006156) | hypothetical protein BG0018 | 16652 | 17635 | - | 327 | 51598281 | 2957605 |
| Complete genome (Accession number NC_006156) | hypothetical protein BG0019 | 17637 | 18149 | - | 170 | 51598282 | 2957659 |
| Complete genome (Accession number NC_006156) | diphosphate--fructose-6-phosphate 1-phosphotransferase | 18157 | 19827 | - | 556 | 51598283 | 2957509 |
| Complete genome (Accession number NC_006156) | S-adenosylmethionine:tRNA ribosyltransferase-isomerase | 19905 | 20945 | - | 346 | 51598284 | 2957477 |
| Complete genome (Accession number NC_006156) | Holliday junction DNA helicase B | 20920 | 21963 | - | 347 | 51598285 | 2957993 |
| Complete genome (Accession number NC_006156) | Holliday junction DNA helicase | 22008 | 22598 | - | 196 | 51598286 | 2957957 |
| Complete genome (Accession number NC_006156) | hypothetical protein BG0024 | 22668 | 23807 | + | 379 | 51598287 | 2957981 |
| Complete genome (Accession number number | hypothetical protein BG0025 | 23822 | 24553 | - | 243 | 51598288 | 2957984 |

Fig. 29 continued

| | | | | | | | |
|---|---|---|---|---|---|---|---|
| NC_006156) | | | | | | | |
| Complete genome (Accession number NC_006156) | methylenetetrahydrofolate dehydrogenase | 24554 | 25459 | - | 301 | 51598289 | 2957612 |
| Complete genome (Accession number NC_006156) | hypothetical protein BG0027 | 25610 | 26248 | + | 212 | 51598290 | 2957660 |
| Complete genome (Accession number NC_006156) | lipoprotein, putative | 26256 | 27305 | + | 349 | 51598291 | 2957613 |
| Complete genome (Accession number NC_006156) | hypothetical protein BG0029 | 27291 | 27722 | - | 143 | 51598292 | 2957982 |
| Complete genome (Accession number NC_006156) | signal peptidase I | 27712 | 28347 | - | 211 | 51598293 | 2957611 |
| Complete genome (Accession number NC_006156) | signal peptidase I | 28349 | 29329 | - | 326 | 51598294 | 2957616 |
| Complete genome (Accession number NC_006156) | hypothetical protein BG0032 | 29400 | 30863 | + | 487 | 51598295 | 2957950 |
| Complete genome (Accession number NC_006156) | SsrA-binding protein | 30875 | 31327 | + | 150 | 51598296 | 2957961 |
| Complete genome (Accession number NC_006156) | hypothetical protein BG0034 | 31401 | 31934 | - | 177 | 51598297 | 2957962 |
| Complete genome (Accession number NC_006156) | DNA topoisomerase IV subunit A | 32002 | 33882 | - | 626 | 51598298 | 2957933 |

Fig. 29 continued

| Complete genome (Accession number NC_006156) | DNA topoisomerase IV subunit B | 33882 | 35681 | - | 599 | 51598299 | 2957619 |
|---|---|---|---|---|---|---|---|
| Complete genome (Accession number NC_006156) | 1-acyl-sn-glycerol-3-phosphate acyltransferase | 35702 | 36439 | - | 245 | 51598300 | 2957945 |
| Complete genome (Accession number NC_006156) | hypothetical protein BG0038 | 36448 | 37986 | - | 512 | 51598301 | 2957952 |
| Complete genome (Accession number NC_006156) | hypothetical protein BG0039 | 37998 | 39500 | - | 500 | 51598302 | 2957938 |
| Complete genome (Accession number NC_006156) | chemotaxis protein methyltransferase | 39692 | 40543 | + | 283 | 51598303 | 2957856 |
| Complete genome (Accession number NC_006156) | phosphate transport system regulatory protein | 40626 | 41297 | - | 223 | 51598304 | 2957623 |
| Complete genome (Accession number NC_006156) | hypothetical protein BG0042 | 41308 | 42342 | - | 344 | 51598305 | 2957939 |
| Complete genome (Accession number NC_006156) | hypothetical protein BG0043 | 42339 | 42740 | - | 133 | 51598306 | 2957624 |
| Complete genome (Accession number NC_006156) | P115 protein | 42766 | 45213 | - | 815 | 51598307 | 2957969 |
| Complete genome (Accession number NC_006156) | ribonuclease H | 45306 | 45851 | + | 181 | 51598308 | 2957615 |

Fig. 29 continued

| | | | | | | | |
|---|---|---|---|---|---|---|---|
| Complete genome (Accession number NC_006156) | hypothetical protein BG0046 | 45866 | 46228 | - | 120 | 51598309 | 2957992 |
| Complete genome (Accession number NC_006156) | hypothetical protein BG0048 | 46765 | 46884 | - | 39 | 51598310 | 2957882 |
| Complete genome (Accession number NC_006156) | hypothetical protein BG0049 | 47007 | 47681 | + | 224 | 51598311 | 2957860 |
| Complete genome (Accession number NC_006156) | hypothetical protein BG0050 | 47758 | 48447 | + | 229 | 51598312 | 2957631 |
| Complete genome (Accession number NC_006156) | spoU protein | 48444 | 49100 | - | 218 | 51598313 | 2957632 |
| Complete genome (Accession number NC_006156) | uracil-DNA glycosylase | 49183 | 49854 | + | 223 | 51598314 | 2957874 |
| Complete genome (Accession number NC_006156) | preprotein translocase subunit SecG | 49952 | 50314 | - | 120 | 51598315 | 2957870 |
| Complete genome (Accession number NC_006156) | triosephosphate isomerase | 50330 | 51091 | - | 253 | 51598316 | 2957633 |
| Complete genome (Accession number NC_006156) | phosphoglycerate kinase | 51093 | 52274 | - | 393 | 51598317 | 2957894 |
| Complete genome (Accession number NC_006156) | glyceraldehyde 3-phosphate dehydrogenase | 52300 | 53307 | - | 335 | 51598318 | 2957866 |
| Complete genome (Accession number | hypothetical protein BG0057 | 53382 | 55352 | - | 656 | 51598319 | 2957635 |

Fig. 29 continued

| | | | | | | | |
|---|---|---|---|---|---|---|---|
| NC_006156) | | | | | | | |
| Complete genome (Accession number NC_006156) | hemolysin | 55349 | 56128 | - | 259 | 51598320 | 2957634 |
| Complete genome (Accession number NC_006156) | hypothetical protein BG0059 | 56129 | 56587 | - | 152 | 51598321 | 2957642 |
| Complete genome (Accession number NC_006156) | thioredoxin | 56676 | 57029 | - | 117 | 51598322 | 2957639 |
| Complete genome (Accession number NC_006156) | hypothetical protein BG0061 | 57103 | 57819 | + | 238 | 51598323 | 2957637 |
| Complete genome (Accession number NC_006156) | hypothetical protein BG0062 | 57871 | 58815 | - | 314 | 51598324 | 2957640 |
| Complete genome (Accession number NC_006156) | methionyl-tRNA formyltransferase | 58928 | 59875 | - | 315 | 51598325 | 2957645 |
| Complete genome (Accession number NC_006156) | polypeptide deformylase | 59872 | 60432 | - | 186 | 51598326 | 2957647 |
| Complete genome (Accession number NC_006156) | hypothetical protein BG0065 | 60405 | 61091 | - | 228 | 51598327 | 2957646 |
| Complete genome (Accession number NC_006156) | peptidase, putative | 61088 | 62866 | - | 592 | 51598328 | 2957644 |
| Complete genome (Accession number NC_006156) | hypothetical protein BG0067 | 62979 | 63869 | + | 296 | 51598329 | 2957641 |
| Complete genome | aminopeptidase II | 63870 | 65108 | + | 412 | 51598330 | 2957650 |

Fig. 29 continued

| | | | | | | | |
|---|---|---|---|---|---|---|---|
| (Accession number NC_006156) | | | | | | | |
| Complete genome (Accession number NC_006156) | hypothetical protein BG0069 | 65123 | 65584 | + | 153 | 51598331 | 2957684 |
| Complete genome (Accession number NC_006156) | hypothetical protein BG0070 | 65601 | 67073 | + | 490 | 51598332 | 2957655 |
| Complete genome (Accession number NC_006156) | hypothetical protein BG0071 | 67081 | 69399 | + | 772 | 51598333 | 2957685 |
| Complete genome (Accession number NC_006156) | hypothetical protein BG0072 | 69396 | 69956 | + | 186 | 51598334 | 2957667 |
| Complete genome (Accession number NC_006156) | peptide chain release factor 2 | 69997 | 71049 | + | 350 | 51598335 | 2957657 |
| Complete genome (Accession number NC_006156) | hypothetical protein BG0074 | 71031 | 72440 | + | 469 | 51598336 | 2957675 |
| Complete genome (Accession number NC_006156) | signal recognition particle-docking protein FtsY | 72477 | 73322 | + | 281 | 51598337 | 2957669 |
| Complete genome (Accession number NC_006156) | hypothetical protein BG0076 | 73319 | 74347 | + | 342 | 51598338 | 2957700 |
| Complete genome (Accession number NC_006156) | hypothetical protein BG0077 | 74348 | 75601 | + | 417 | 51598339 | 2957676 |
| Complete genome (Accession number NC_006156) | ABC transporter, ATP-binding protein | 75603 | 76283 | + | 226 | 51598340 | 2957668 |

Fig. 29 continued

| | | | | | | | |
|---|---|---|---|---|---|---|---|
| Complete genome (Accession number NC_006156) | hypothetical protein BG0079 | 76280 | 77533 | + | 417 | 51598341 | 2957671 |
| Complete genome (Accession number NC_006156) | hypothetical protein BG0080 | 77545 | 78843 | - | 432 | 51598342 | 2957670 |
| Complete genome (Accession number NC_006156) | hypothetical protein BG0081 | 78836 | 79156 | - | 106 | 51598343 | 2957673 |
| Complete genome (Accession number NC_006156) | nifS protein | 79339 | 80607 | + | 422 | 51598344 | 2957672 |
| Complete genome (Accession number NC_006156) | hypothetical protein BG0083 | 80538 | 80690 | - | 50 | 51598345 | 2957677 |
| Complete genome (Accession number NC_006156) | hypothetical protein BG0084 | 80811 | 81239 | + | 142 | 51598346 | 2957674 |
| Complete genome (Accession number NC_006156) | hypothetical protein BG0085 | 81232 | 81492 | - | 86 | 51598347 | 2957678 |
| Complete genome (Accession number NC_006156) | hypothetical protein BG0086 | 81551 | 82342 | + | 263 | 51598348 | 2957680 |
| Complete genome (Accession number NC_006156) | hypothetical protein BG0087 | 82379 | 82771 | + | 130 | 51598349 | 2957679 |
| Complete genome (Accession number NC_006156) | L-lactate dehydrogenase | 82801 | 83751 | - | 316 | 51598350 | 2957681 |
| Complete genome (Accession number NC_006156) | GTP-binding protein LepA | 83874 | 85679 | - | 601 | 51598351 | 2957827 |

Fig. 29 continued

| Complete genome (Accession number NC_006156) | hypothetical protein BG0090 | 85713 | 86699 | - | 328 | 51598352 | 2957845 |
|---|---|---|---|---|---|---|---|
| Complete genome (Accession number NC_006156) | V-type ATP synthase subunit K | 86759 | 87193 | - | 144 | 51598353 | 2957887 |
| Complete genome (Accession number NC_006156) | V-type ATP synthase subunit I | 87210 | 89036 | - | 608 | 51598354 | 2957465 |
| Complete genome (Accession number NC_006156) | V-type ATP synthase subunit D | 89047 | 89643 | - | 198 | 51598355 | 2957466 |
| Complete genome (Accession number NC_006156) | V-type ATP synthase subunit B | 89646 | 90950 | - | 434 | 51598356 | 2957463 |
| Complete genome (Accession number NC_006156) | V-type ATP synthase subunit A | 90972 | 92699 | - | 575 | 51598357 | 2957476 |
| Complete genome (Accession number NC_006156) | hypothetical protein BG0096 | 92713 | 93258 | - | 181 | 51598358 | 2957174 |
| Complete genome (Accession number NC_006156) | V-type ATP synthase subunit E | 93268 | 93867 | - | 199 | 51598359 | 2957175 |
| Complete genome (Accession number NC_006156) | hypothetical protein BG0098 | 94053 | 94439 | - | 128 | 51598360 | 2957472 |
| Complete genome (Accession number NC_006156) | recombination and DNA strand exchange inhibitor protein | 94445 | 96781 | - | 778 | 51598361 | 2957607 |

Fig. 29 continued

| | | | | | | | |
|---|---|---|---|---|---|---|---|
| Complete genome (Accession number NC_006156) | hypothetical protein BG0100 | 96771 | 97694 | - | 307 | 51598362 | 2957453 |
| Complete genome (Accession number NC_006156) | glutamate racemase | 97691 | 98473 | - | 260 | 51598363 | 2957454 |
| Complete genome (Accession number NC_006156) | asparaginyl-tRNA synthetase | 98636 | 100024 | + | 462 | 51598364 | 2957176 |
| Complete genome (Accession number NC_006156) | hypothetical protein BG0103 | 100039 | 100560 | + | 173 | 51598365 | 2957386 |
| Complete genome (Accession number NC_006156) | hypothetical protein BG0104 | 100557 | 101153 | - | 198 | 51598366 | 2957447 |
| Complete genome (Accession number NC_006156) | periplasmic serine protease DO | 101341 | 102765 | - | 474 | 51598367 | 2957448 |
| Complete genome (Accession number NC_006156) | methionine aminopeptidase | 102836 | 103591 | - | 251 | 51598368 | 2957271 |
| Complete genome (Accession number NC_006156) | hypothetical protein BG0107 | 103584 | 105251 | - | 555 | 51598369 | 2957464 |
| Complete genome (Accession number NC_006156) | transcription antitermination protein NusB | 105238 | 105666 | - | 142 | 51598370 | 2957181 |
| Complete genome (Accession number NC_006156) | basic membrane protein | 105704 | 106714 | - | 336 | 51598371 | 2957182 |
| Complete genome (Accession number NC_006156) | acetyl-CoA C-acetyltransferase | 106794 | 107987 | - | 397 | 51598372 | 2957180 |

Fig. 29 continued

| | | | | | | | |
|---|---|---|---|---|---|---|---|
| Complete genome (Accession number NC_006156) | hypothetical protein BG0111 | 108130 | 109494 | + | 454 | 51598373 | 2957457 |
| Complete genome (Accession number NC_006156) | replicative DNA helicase | 109505 | 110672 | - | 455 | 51598374 | 2957189 |
| Complete genome (Accession number NC_006156) | 50S ribosomal protein L9 | 110897 | 111397 | - | 166 | 51598375 | 2957190 |
| Complete genome (Accession number NC_006156) | 30S ribosomal protein S18 | 111414 | 111704 | - | 96 | 51598376 | 2957348 |
| Complete genome (Accession number NC_006156) | single-stranded DNA-binding protein | 111719 | 112168 | - | 149 | 51598377 | 2957347 |
| Complete genome (Accession number NC_006156) | 30S ribosomal protein S6 | 112180 | 112599 | - | 139 | 51598378 | 2957314 |
| Complete genome (Accession number NC_006156) | PTS system, maltose and glucose-specific IIABC component | 112743 | 114437 | - | 564 | 51598379 | 2957315 |
| Complete genome (Accession number NC_006156) | hemolysin III | 114639 | 115340 | + | 233 | 51598380 | 2957387 |
| Complete genome (Accession number NC_006156) | zinc protease, putative | 115337 | 116638 | - | 433 | 51598381 | 2957585 |
| Complete genome (Accession number NC_006156) | phosphatidate cytidylyltransferase | 116660 | 117517 | - | 285 | 51598382 | 2957185 |

Fig. 29 continued

| | | | | | | | |
|---|---|---|---|---|---|---|---|
| Complete genome (Accession number NC_006156) | undecaprenyl diphosphate synthase | 117507 | 118199 | - | 230 | 51598383 | 2957186 |
| Complete genome (Accession number NC_006156) | ribosome releasing factor | 118204 | 118758 | - | 184 | 51598384 | 2957218 |
| Complete genome (Accession number NC_006156) | elongation factor Ts | 118796 | 119635 | - | 279 | 51598385 | 2957433 |
| Complete genome (Accession number NC_006156) | 30S ribosomal protein S2 | 119632 | 120420 | - | 262 | 51598386 | 2957197 |
| Complete genome (Accession number NC_006156) | hypothetical protein BG0125 | 120640 | 120918 | - | 92 | 51598387 | 2957198 |
| Complete genome (Accession number NC_006156) | hypothetical protein BG0126 | 120824 | 120937 | - | 37 | 51598388 | 2957431 |
| Complete genome (Accession number NC_006156) | hypothetical protein BG0127 | 120938 | 121720 | - | 260 | 51598389 | 2957536 |
| Complete genome (Accession number NC_006156) | hypothetical protein BG0128 | 121722 | 122333 | - | 203 | 51598390 | 2957195 |
| Complete genome (Accession number NC_006156) | 30S ribosomal protein S1 | 122333 | 123986 | - | 551 | 51598391 | 2957196 |
| Complete genome (Accession number NC_006156) | cytidylate kinase | 123991 | 124656 | - | 221 | 51598392 | 2957248 |
| Complete genome (Accession number NC_006156) | hypothetical protein BG0131 | 124640 | 125389 | - | 249 | 51598393 | 2957455 |

Fig. 29 continued

| | | | | | | | |
|---|---|---|---|---|---|---|---|
| Complete genome (Accession number NC_006156) | hypothetical protein BG0132 | 125376 | 126125 | - | 249 | 51598394 | 2957512 |
| Complete genome (Accession number NC_006156) | recombinase A | 126149 | 127237 | - | 362 | 51598395 | 2957513 |
| Complete genome (Accession number NC_006156) | transcript cleavage factor/unknown domain fusion protein | 127251 | 129953 | - | 900 | 51598396 | 2957425 |
| Complete genome (Accession number NC_006156) | hypothetical protein BG0135 | 129990 | 130934 | - | 314 | 51598397 | 2957531 |
| Complete genome (Accession number NC_006156) | hypothetical protein BG0136 | 131119 | 132246 | + | 375 | 51598398 | 2957206 |
| Complete genome (Accession number NC_006156) | histidyl-tRNA synthetase | 132293 | 133663 | - | 456 | 51598399 | 2957207 |
| Complete genome (Accession number NC_006156) | penicillin-binding protein | 133796 | 135685 | + | 629 | 51598400 | 2957421 |
| Complete genome (Accession number NC_006156) | long-chain-fatty-acid CoA ligase | 135686 | 137578 | - | 630 | 51598401 | 2957519 |
| Complete genome (Accession number NC_006156) | hypothetical protein BG0140 | 138021 | 138329 | - | 102 | 51598402 | 2957440 |
| Complete genome (Accession number NC_006156) | acriflavine resistance protein | 138331 | 141543 | - | 1070 | 51598403 | 2957441 |
| Complete genome (Accession | membrane fusion protein | 141562 | 142515 | - | 317 | 51598404 | 2957414 |

Fig. 29 continued

| | | | | | | | |
|---|---|---|---|---|---|---|---|
| number NC_006156) | | | | | | | |
| Complete genome (Accession number NC_006156) | hypothetical protein BG0143 | 142527 | 143762 | - | 411 | 51598405 | 2957479 |
| Complete genome (Accession number NC_006156) | glycine betaine, L-proline ABC transporter, binding protein | 144170 | 145054 | - | 294 | 51598406 | 2957481 |
| Complete genome (Accession number NC_006156) | glycine betaine, L-proline ABC transporter, permease protein | 145069 | 145968 | - | 299 | 51598407 | 2957482 |
| Complete genome (Accession number NC_006156) | glycine betaine, L-proline ABC transporter, ATP-binding protein | 145975 | 147093 | - | 372 | 51598408 | 2957400 |
| Complete genome (Accession number NC_006156) | flagellin | 147245 | 148255 | - | 336 | 51598409 | 2957384 |
| Complete genome (Accession number NC_006156) | flagellar hook-associated protein FliD | 148382 | 150379 | - | 665 | 51598410 | 2957361 |
| Complete genome (Accession number NC_006156) | N-acetylglucosamine-6-phosphate deacetylase | 150550 | 151755 | + | 401 | 51598411 | 2957362 |

Fig. 29 continued

| | | | | | | | |
|---|---|---|---|---|---|---|---|
| Complete genome (Accession number NC_006156) | glucosamine-6-phosphate deaminase | 151782 | 152588 | + | 268 | 51598412 | 2957532 |
| Complete genome (Accession number NC_006156) | superoxide dismutase | 152655 | 153266 | - | 203 | 51598413 | 2957282 |
| Complete genome (Accession number NC_006156) | preprotein translocase subunit SecA | 153281 | 155980 | - | 899 | 51598414 | 2957227 |
| Complete genome (Accession number NC_006156) | lipoprotein, putative | 156049 | 157182 | + | 377 | 51598415 | 2957228 |
| Complete genome (Accession number NC_006156) | hypothetical protein BG0154 | 157214 | 157642 | + | 142 | 51598416 | 2957377 |
| Complete genome (Accession number NC_006156) | hypothetical protein BG0155 | 157646 | 158062 | + | 138 | 51598417 | 2957373 |
| Complete genome (Accession number NC_006156) | antigen, S2, putative | 158208 | 158945 | + | 245 | 51598418 | 2957237 |
| Complete genome (Accession number NC_006156) | antigen S2-related protein | 158969 | 159643 | + | 224 | 51598419 | 2957238 |
| Complete genome (Accession number NC_006156) | alanine racemase | 159709 | 160809 | + | 366 | 51598420 | 2957370 |
| Complete genome (Accession number NC_006156) | hypothetical protein BG0159 | 160801 | 162402 | - | 533 | 51598421 | 2957252 |
| Complete genome (Accession number number | hypothetical protein BG0160 | 162479 | 162646 | + | 55 | 51598422 | 2957217 |

Fig. 29 continued

| | | | | | | | |
|---|---|---|---|---|---|---|---|
| NC_006156) | | | | | | | |
| Complete genome (Accession number NC_006156) | hypothetical protein BG0161 | 162673 | 164421 | - | 582 | 51598423 | 2957218 |
| Complete genome (Accession number NC_006156) | Na+/Ca+ exchange protein, putative | 164502 | 165488 | - | 328 | 51598424 | 2957357 |
| Complete genome (Accession number NC_006156) | hypothetical protein BG0163 | 165516 | 167360 | - | 614 | 51598425 | 2957349 |
| Complete genome (Accession number NC_006156) | 4-alpha-glucanotransferase | 167472 | 168992 | - | 506 | 51598426 | 2957578 |
| Complete genome (Accession number NC_006156) | outer membrane protein | 169134 | 170303 | + | 389 | 51598427 | 2957579 |
| Complete genome (Accession number NC_006156) | hypothetical protein BG0166 | 170305 | 170370 | - | 21 | 51598428 | 2957296 |
| Complete genome (Accession number NC_006156) | dnaK suppressor, putative | 170315 | 170692 | - | 125 | 51598429 | 2957329 |
| Complete genome (Accession number NC_006156) | translation initiation factor IF-1 | 170858 | 171079 | + | 73 | 51598430 | 2957208 |
| Complete genome (Accession number NC_006156) | hypothetical protein BG0169 | 171126 | 173177 | - | 683 | 51598431 | 2957209 |
| Complete genome (Accession number NC_006156) | hypothetical protein BG0170 | 173126 | 173713 | - | 195 | 51598432 | 2957331 |

Fig. 29 continued

| | | | | | | | |
|---|---|---|---|---|---|---|---|
| Complete genome (Accession number NC_006156) | hypothetical protein BG0171 | 173695 | 174681 | - | 328 | 51598433 | 2957326 |
| Complete genome (Accession number NC_006156) | hypothetical protein BG0172 | 174678 | 175679 | - | 333 | 51598434 | 2957266 |
| Complete genome (Accession number NC_006156) | hypothetical protein BG0173 | 175666 | 176565 | - | 299 | 51598435 | 2957267 |
| Complete genome (Accession number NC_006156) | hypothetical protein BG0174 | 176572 | 177444 | - | 290 | 51598436 | 2957269 |
| Complete genome (Accession number NC_006156) | MoxR-related protein | 177462 | 178454 | - | 330 | 51598437 | 2957444 |
| Complete genome (Accession number NC_006156) | glucose inhibited division protein B | 178511 | 179137 | - | 208 | 51598438 | 2957279 |
| Complete genome (Accession number NC_006156) | tRNA uridine 5-carboxymethylaminomethyl modification enzyme GidA | 179134 | 180999 | - | 621 | 51598439 | 2957280 |
| Complete genome (Accession number NC_006156) | tRNA modification GTPase TrmE | 181002 | 182396 | - | 464 | 51598440 | 2957200 |
| Complete genome (Accession number NC_006156) | flagellar protein, putative | 182479 | 182973 | + | 164 | 51598441 | 2957214 |
| Complete genome (Accession number NC_006156) | flagellar hook-associated protein FlgK | 182985 | 184868 | + | 627 | 51598442 | 2957159 |

Fig. 29 continued

| Complete genome (Accession number NC_006156) | flagellar hook-associated protein FlgL | 184871 | 186145 | + | 424 | 51598443 | 2957160 |
|---|---|---|---|---|---|---|---|
| Complete genome (Accession number NC_006156) | flagellar assembly protein FliW | 186147 | 186539 | + | 130 | 51598444 | 2957533 |
| Complete genome (Accession number NC_006156) | carbon storage regulator | 186542 | 186787 | + | 81 | 51598445 | 2957289 |
| Complete genome (Accession number NC_006156) | hypothetical protein BG0184 | 186771 | 187424 | - | 217 | 51598446 | 2957285 |
| Complete genome (Accession number NC_006156) | hypothetical protein BG0185 | 187417 | 187830 | - | 137 | 51598447 | 2957286 |
| Complete genome (Accession number NC_006156) | hypothetical protein BG0186 | 187827 | 188087 | - | 86 | 51598448 | 2957262 |
| Complete genome (Accession number NC_006156) | 50S ribosomal protein L20 | 188301 | 188648 | - | 115 | 51598449 | 2957298 |
| Complete genome (Accession number NC_006156) | 50S ribosomal protein L35 | 188669 | 188869 | - | 66 | 51598450 | 2957283 |
| Complete genome (Accession number NC_006156) | translation initiation factor IF-3 | 188892 | 189452 | - | 186 | 51598451 | 2957284 |
| Complete genome (Accession number NC_006156) | hypothetical protein BG0190 | 190055 | 190297 | - | 80 | 51598452 | 2957529 |
| Complete genome (Accession number NC_006156) | lipoprotein, putative | 190318 | 191058 | + | 246 | 51598453 | 2957272 |

Fig. 29 continued

| | | | | | | | |
|---|---|---|---|---|---|---|---|
| Complete genome (Accession number NC_006156) | hypothetical protein BG0192 | 191111 | 191920 | - | 269 | 51598454 | 2957287 |
| Complete genome (Accession number NC_006156) | hypothetical protein BG0193 | 191917 | 193056 | - | 379 | 51598455 | 2957288 |
| Complete genome (Accession number NC_006156) | peptide chain release factor 1 | 193392 | 194465 | + | 357 | 51598456 | 2957534 |
| Complete genome (Accession number NC_006156) | HemK family methylase, putative | 194468 | 195289 | + | 273 | 51598457 | 2957216 |
| Complete genome (Accession number NC_006156) | guanosine-3,5-bis(diphosphate) 3-pyrophosphohydrolase | 195286 | 197289 | + | 667 | 51598458 | 2957301 |
| Complete genome (Accession number NC_006156) | hypothetical protein BG0197 | 197279 | 199543 | + | 754 | 51598459 | 2957302 |
| Complete genome (Accession number NC_006156) | hypothetical protein BG0198 | 199488 | 199592 | - | 34 | 51598460 | 2957167 |
| Complete genome (Accession number NC_006156) | D-alanine--D-alanine ligase | 199540 | 200625 | - | 361 | 51598461 | 2957253 |
| Complete genome (Accession number NC_006156) | UDP-N-acetylmuramoylalanyl-D-glutamate--2,6-diaminopimelate ligase | 200627 | 202153 | - | 508 | 51598462 | 2957178 |
| Complete genome (Accession | hemolysin, putative | 202426 | 203664 | + | 412 | 51598463 | 2957244 |

Fig. 29 continued

| | | | | | | | |
|---|---|---|---|---|---|---|---|
| number NC_006156) | | | | | | | |
| Complete genome (Accession number NC_006156) | Lambda CII stability-governing protein | 203717 | 204652 | + | 311 | 51598464 | 2957245 |
| Complete genome (Accession number NC_006156) | Lambda CII stability-governing protein | 204653 | 205624 | + | 323 | 51598465 | 2957303 |
| Complete genome (Accession number NC_006156) | hypothetical protein BG0207 | 206124 | 207701 | + | 525 | 51598466 | 2957310 |
| Complete genome (Accession number NC_006156) | hypothetical protein BG0208 | 207679 | 208218 | - | 179 | 51598467 | 2957304 |
| Complete genome (Accession number NC_006156) | UTP--glucose-1-phosphate uridylyltransferase | 208304 | 209140 | + | 278 | 51598468 | 2957219 |
| Complete genome (Accession number NC_006156) | hypothetical protein BG0210 | 209127 | 210875 | + | 582 | 51598469 | 2957164 |
| Complete genome (Accession number NC_006156) | hypothetical protein BG0211 | 210902 | 211657 | + | 251 | 51598470 | 2957165 |
| Complete genome (Accession number NC_006156) | surface-located membrane protein 1 | 211650 | 214370 | + | 906 | 51598471 | 2957308 |
| Complete genome (Accession number NC_006156) | DNA mismatch repair protein | 214377 | 216212 | + | 611 | 51598472 | 2957412 |
| Complete genome (Accession number NC_006156) | hypothetical protein BG0214 | 216231 | 217262 | + | 343 | 51598473 | 2957306 |

Fig. 29 continued

| | | | | | | | |
|---|---|---|---|---|---|---|---|
| Complete genome (Accession number NC_006156) | lipoprotein, putative | 217345 | 217998 | - | 217 | 51598474 | 2957183 |
| Complete genome (Accession number NC_006156) | translation elongation factor P | 218006 | 218584 | - | 192 | 51598475 | 2957184 |
| Complete genome (Accession number NC_006156) | phosphate ABC transporter, periplasmic phosphate-binding protein | 218750 | 219586 | + | 278 | 51598476 | 2957320 |
| Complete genome (Accession number NC_006156) | phosphate ABC transporter, permease protein | 219676 | 220584 | + | 302 | 51598477 | 2957311 |
| Complete genome (Accession number NC_006156) | phosphate ABC transporter, permease protein | 220755 | 222125 | + | 456 | 51598478 | 2957324 |
| Complete genome (Accession number NC_006156) | phosphate ABC transporter, ATP-binding protein | 222126 | 222908 | + | 260 | 51598479 | 2957325 |
| Complete genome (Accession number NC_006156) | gufA protein | 222911 | 223732 | - | 273 | 51598480 | 2957265 |
| Complete genome (Accession number NC_006156) | alanyl-tRNA synthetase | 223767 | 225551 | - | 594 | 51598481 | 2957270 |
| Complete genome (Accession number NC_006156) | flagellar motor switch protein | 225551 | 226768 | - | 405 | 51598482 | 2957169 |

Fig. 29 continued

| Complete genome (Accession number NC_006156) | 6-phosphogluconolactonase | 226755 | 227462 | - | 235 | 51598483 | 2957170 |
|---|---|---|---|---|---|---|---|
| Complete genome (Accession number NC_006156) | hypothetical protein BG0226 | 227601 | 227747 | - | 48 | 51598484 | 2957249 |
| Complete genome (Accession number NC_006156) | lipoprotein, putative | 227865 | 228092 | - | 75 | 51598485 | 2957435 |
| Complete genome (Accession number NC_006156) | tRNA-dihydrouridine synthase A | 228169 | 229170 | + | 333 | 51598486 | 2957514 |
| Complete genome (Accession number NC_006156) | seryl-tRNA synthetase | 229160 | 230437 | - | 425 | 51598487 | 2957515 |
| Complete genome (Accession number NC_006156) | hypothetical protein BG0230 | 230567 | 231268 | + | 233 | 51598488 | 2957401 |
| Complete genome (Accession number NC_006156) | hypothetical protein BG0231 | 231284 | 234202 | + | 972 | 51598489 | 2957330 |
| Complete genome (Accession number NC_006156) | 50S ribosomal protein L31 type B | 234238 | 234483 | - | 81 | 51598490 | 2957332 |
| Complete genome (Accession number NC_006156) | transcription termination factor Rho | 234544 | 236091 | - | 515 | 51598491 | 2957333 |
| Complete genome (Accession number NC_006156) | hypothetical protein BG0234 | 236171 | 236578 | - | 135 | 51598492 | 2957268 |
| Complete genome (Accession number NC_006156) | hbbU protein | 236579 | 236905 | - | 108 | 51598493 | 2957489 |

Fig. 29 continued

| | | | | | | | |
|---|---|---|---|---|---|---|---|
| Complete genome (Accession number NC_006156) | 30S ribosomal protein S20 | 236918 | 237175 | - | 65 | 51598494 | 2957260 |
| Complete genome (Accession number NC_006156) | hypothetical protein BG0237 | 237246 | 238073 | - | 275 | 51598495 | 2957261 |
| Complete genome (Accession number NC_006156) | translation-associated GTPase | 238088 | 239194 | - | 368 | 51598496 | 2957275 |
| Complete genome (Accession number NC_006156) | hypothetical protein BG0239 | 239224 | 241230 | - | 668 | 51598497 | 2957254 |
| Complete genome (Accession number NC_006156) | apolipoprotein N-acyltransferase | 241377 | 242942 | + | 521 | 51598498 | 2957352 |
| Complete genome (Accession number NC_006156) | hypothetical protein BG0241 | 242882 | 243652 | - | 256 | 51598499 | 2957353 |
| Complete genome (Accession number NC_006156) | deoxyguanosine/deoxyadenosine kinase(I) subunit 2 | 243717 | 244319 | - | 200 | 51598500 | 2957355 |
| Complete genome (Accession number NC_006156) | glycerol uptake facilitator | 244731 | 245495 | + | 254 | 51598501 | 2957340 |
| Complete genome (Accession number NC_006156) | glycerol kinase | 245534 | 247039 | + | 501 | 51598502 | 2957503 |
| Complete genome (Accession number NC_006156) | glycerol-3-phosphate dehydrogenase, anaerobic | 247316 | 248884 | + | 522 | 51598503 | 2957504 |

Fig. 29 continued

| | | | | | | | |
|---|---|---|---|---|---|---|---|
| Complete genome (Accession number NC_006156) | hypothetical protein BG0246 | 248971 | 249465 | - | 164 | 51598504 | 2957259 |
| Complete genome (Accession number NC_006156) | hypothetical protein BG0247 | 249482 | 250006 | - | 184 | 51598505 | 2957356 |
| Complete genome (Accession number NC_006156) | hypothetical protein BG0248 | 250007 | 251032 | - | 341 | 51598506 | 2957473 |
| Complete genome (Accession number NC_006156) | hypothetical protein BG0249 | 251229 | 251834 | + | 201 | 51598507 | 2957474 |
| Complete genome (Accession number NC_006156) | oligoendopeptidase F | 251955 | 253727 | + | 590 | 51598508 | 2957490 |
| Complete genome (Accession number NC_006156) | phosphatidyltransferase | 253741 | 254445 | + | 234 | 51598509 | 2957246 |
| Complete genome (Accession number NC_006156) | dedA protein | 254442 | 255056 | + | 204 | 51598510 | 2957359 |
| Complete genome (Accession number NC_006156) | leucyl-tRNA synthetase | 255253 | 257775 | + | 840 | 51598511 | 2957256 |
| Complete genome (Accession number NC_006156) | hypothetical protein BG0255 | 257790 | 260090 | + | 766 | 51598512 | 2957257 |
| Complete genome (Accession number NC_006156) | ATP-dependent protease LA | 260087 | 262507 | - | 806 | 51598513 | 2957369 |

Fig. 29 continued

| | | | | | | | |
|---|---|---|---|---|---|---|---|
| Complete genome (Accession number NC_006156) | single-stranded-DNA-specific exonuclease | 262784 | 264910 | + | 708 | 51598514 | 2957309 |
| Complete genome (Accession number NC_006156) | hypothetical protein BG0258 | 264903 | 265847 | + | 314 | 51598515 | 2957415 |
| Complete genome (Accession number NC_006156) | 30S ribosomal protein S21 | 265862 | 266071 | + | 69 | 51598516 | 2957416 |
| Complete genome (Accession number NC_006156) | cell division protein, putative | 266107 | 268458 | - | 783 | 51598517 | 2957488 |
| Complete genome (Accession number NC_006156) | undecaprenyl pyrophosphate phosphatase | 268455 | 269255 | - | 266 | 51598518 | 2957365 |
| Complete genome (Accession number NC_006156) | hypothetical protein BG0262 | 269270 | 271417 | - | 715 | 51598519 | 2957242 |
| Complete genome (Accession number NC_006156) | hypothetical protein BG0263 | 271410 | 272426 | - | 338 | 51598520 | 2957243 |
| Complete genome (Accession number NC_006156) | hypothetical protein BG0264 | 272630 | 274012 | + | 460 | 51598521 | 2957297 |
| Complete genome (Accession number NC_006156) | hypothetical protein BG0265 | 274019 | 275272 | - | 417 | 51598522 | 2957291 |
| Complete genome (Accession number NC_006156) | signal peptidase I | 275448 | 275840 | + | 130 | 51598523 | 2957336 |
| Complete genome (Accession | heat shock protein 70 | 275865 | 277334 | - | 489 | 51598524 | 2957337 |

Fig. 29 continued

| | | | | | | |
|---|---|---|---|---|---|---|
| number NC_006156) | | | | | | |
| Complete genome (Accession number NC_006156) | hypothetical protein BG0268 | 277312 | 277833 | - | 173 | 51598525 | 2957344 |
| Complete genome (Accession number NC_006156) | hypothetical protein BG0269 | 277853 | 278155 | - | 100 | 51598526 | 2957234 |
| Complete genome (Accession number NC_006156) | hypothetical protein BG0270 | 278182 | 280086 | - | 634 | 51598527 | 2957350 |
| Complete genome (Accession number NC_006156) | hypothetical protein BG0271 | 280089 | 280568 | - | 159 | 51598528 | 2957351 |
| Complete genome (Accession number NC_006156) | minD-related ATP-binding protein | 280578 | 281465 | - | 295 | 51598529 | 2957478 |
| Complete genome (Accession number NC_006156) | flagellar biosynthesis regulator FlhF | 281477 | 282643 | - | 388 | 51598530 | 2957354 |
| Complete genome (Accession number NC_006156) | flagellar biosynthesis protein A | 282648 | 284738 | - | 696 | 51598531 | 2957235 |
| Complete genome (Accession number NC_006156) | flagellar biosynthesis protein FlhB | 284750 | 285868 | - | 372 | 51598532 | 2957236 |
| Complete genome (Accession number NC_006156) | flagellar biosynthesis protein | 285868 | 286656 | - | 262 | 51598533 | 2957430 |
| Complete genome (Accession number NC_006156) | flagellar biosynthesis protein | 286692 | 286955 | - | 87 | 51598534 | 2957371 |

Fig. 29 continued

| | | | | | | | |
|---|---|---|---|---|---|---|---|
| Complete genome (Accession number NC_006156) | flagellar biosynthesis protein FliP | 286964 | 287728 | - | 254 | 51598535 | 2957451 |
| Complete genome (Accession number NC_006156) | flagellar biosynthesis protein | 287739 | 288365 | - | 208 | 51598536 | 2957452 |
| Complete genome (Accession number NC_006156) | flagellar motor switch protein | 288358 | 288699 | - | 113 | 51598537 | 2957233 |
| Complete genome (Accession number NC_006156) | flagellar motor switch protein FliM | 288745 | 289803 | - | 352 | 51598538 | 2957229 |
| Complete genome (Accession number NC_006156) | flagellar basal body-associated protein FliL | 289828 | 290364 | - | 178 | 51598539 | 2957375 |
| Complete genome (Accession number NC_006156) | flagellar motor protein MotB | 290412 | 291194 | - | 260 | 51598540 | 2957376 |
| Complete genome (Accession number NC_006156) | flagellar motor rotation protein A | 291194 | 291976 | - | 260 | 51598541 | 2957338 |
| Complete genome (Accession number NC_006156) | flagellar protein | 291973 | 292197 | - | 74 | 51598542 | 2957417 |
| Complete genome (Accession number NC_006156) | flagellar hook protein FlgE | 292219 | 293547 | - | 442 | 51598543 | 2957199 |
| Complete genome (Accession number NC_006156) | flagellar basal body rod modification protein | 293552 | 293995 | - | 147 | 51598544 | 2957200 |
| Complete genome (Accession | flagellar protein | 294009 | 295196 | - | 395 | 51598545 | 2957379 |

Fig. 29 continued

| | | | | | | | |
|---|---|---|---|---|---|---|---|
| number NC_006156) | | | | | | | |
| Complete genome (Accession number NC_006156) | flagellar protein | 295204 | 295782 | - | 192 | 51598546 | 2957255 |
| Complete genome (Accession number NC_006156) | flagellar protein | 295814 | 296245 | - | 143 | 51598547 | 2957381 |
| Complete genome (Accession number NC_006156) | flagellum-specific ATP synthase | 296242 | 297552 | - | 436 | 51598548 | 2957382 |
| Complete genome (Accession number NC_006156) | flagellar assembly protein H | 297571 | 298491 | - | 306 | 51598549 | 2957396 |
| Complete genome (Accession number NC_006156) | flagellar motor switch protein G | 298506 | 299540 | - | 344 | 51598550 | 2957172 |
| Complete genome (Accession number NC_006156) | flagellar MS-ring protein | 299556 | 301265 | - | 569 | 51598551 | 2957154 |
| Complete genome (Accession number NC_006156) | flagellar hook-basal body protein FliE | 301280 | 301615 | - | 111 | 51598552 | 2957155 |
| Complete genome (Accession number NC_006156) | flagellar basal body rod protein FlgC | 301627 | 302085 | - | 152 | 51598553 | 2957191 |
| Complete genome (Accession number NC_006156) | flagellar basal body rod protein FlgB | 302109 | 302516 | - | 135 | 51598554 | 2957391 |

Fig. 29 continued

| | | | | | | | |
|---|---|---|---|---|---|---|---|
| Complete genome (Accession number NC_006156) | ATP-dependent protease ATP-binding subunit | 302550 | 303896 | - | 448 | 51598555 | 2957193 |
| Complete genome (Accession number NC_006156) | ATP-dependent protease peptidase subunit | 303889 | 304437 | - | 182 | 51598556 | 2957194 |
| Complete genome (Accession number NC_006156) | hypothetical protein BG0300 | 304447 | 304563 | - | 38 | 51598557 | 2957398 |
| Complete genome (Accession number NC_006156) | smg protein | 304538 | 305395 | - | 285 | 51598558 | 2957406 |
| Complete genome (Accession number NC_006156) | hypothetical protein BG0302 | 305402 | 306094 | - | 230 | 51598559 | 2957404 |
| Complete genome (Accession number NC_006156) | cell division protein FtsZ | 306095 | 307294 | - | 399 | 51598560 | 2957405 |
| Complete genome (Accession number NC_006156) | cell division protein | 307316 | 308557 | - | 413 | 51598561 | 2957222 |
| Complete genome (Accession number NC_006156) | cell division protein | 308557 | 309300 | - | 247 | 51598562 | 2957399 |
| Complete genome (Accession number NC_006156) | cell division protein | 309336 | 310394 | - | 352 | 51598563 | 2957520 |

Fig. 29 continued

| | | | | | | | |
|---|---|---|---|---|---|---|---|
| Complete genome (Accession number NC_006156) | phospho-N-acetylmuramoyl-pentapeptide-transferase | 310437 | 311492 | - | 351 | 51598564 | 2957521 |
| Complete genome (Accession number NC_006156) | UDP-N-acetylmuramoylalanyl-D-glutamyl-2, 6-diaminopimelate--D-alanyl-D-alanine ligase | 311510 | 312901 | - | 463 | 51598565 | 2957545 |
| Complete genome (Accession number NC_006156) | hypothetical protein BG0309 | 312923 | 313204 | - | 93 | 51598566 | 2957403 |
| Complete genome (Accession number NC_006156) | hypothetical protein BG0310 | 313201 | 314091 | - | 296 | 51598567 | 2957410 |
| Complete genome (Accession number NC_006156) | hypothetical protein BG0311 | 314084 | 314920 | - | 278 | 51598568 | 2957411 |
| Complete genome (Accession number NC_006156) | hypothetical protein BG0312 | 314917 | 315993 | - | 358 | 51598569 | 2957168 |
| Complete genome (Accession number NC_006156) | hypothetical protein BG0313 | 316022 | 316780 | - | 252 | 51598570 | 2957456 |
| Complete genome (Accession number NC_006156) | hypothetical protein BG0314 | 317096 | 317935 | - | 279 | 51598571 | 2957418 |
| Complete genome (Accession number NC_006156) | purine-binding chemotaxis protein | 317925 | 318455 | - | 176 | 51598572 | 2957419 |

Fig. 29 continued

| Complete genome (Accession number NC_006156) | cell division protein | 318501 | 319079 | - | 192 | 51598573 | 2957413 |
|---|---|---|---|---|---|---|---|
| Complete genome (Accession number NC_006156) | octaprenyl-diphosphate synthase | 319130 | 320173 | + | 347 | 51598574 | 2957201 |
| Complete genome (Accession number NC_006156) | hypothetical protein BG0318 | 320173 | 320856 | + | 227 | 51598575 | 2957203 |
| Complete genome (Accession number NC_006156) | hypothetical protein BG0319 | 320858 | 321664 | - | 268 | 51598576 | 2957204 |
| Complete genome (Accession number NC_006156) | hypothetical protein BG0320 | 321665 | 322597 | - | 310 | 51598577 | 2957526 |
| Complete genome (Accession number NC_006156) | methylgalactoside ABC transporter, ATP-binding protein | 322594 | 324054 | - | 486 | 51598578 | 2957527 |
| Complete genome (Accession number NC_006156) | exported protein | 324054 | 325106 | - | 350 | 51598579 | 2957140 |
| Complete genome (Accession number NC_006156) | hypothetical protein BG0323 | 325524 | 326564 | - | 346 | 51598580 | 2957141 |
| Complete genome (Accession number NC_006156) | hypothetical protein BG0324 | 326853 | 327983 | + | 376 | 51598581 | 2957205 |
| Complete genome (Accession number NC_006156) | hypothetical protein BG0325 | 328078 | 328443 | + | 121 | 51598582 | 2957220 |

Fig. 29 continued

| Complete genome (Accession number NC_006156) | hypothetical protein BG0326 | 328450 | 328559 | - | 369 | 51598583 | 2957423 |
|---|---|---|---|---|---|---|---|
| Complete genome (Accession number NC_006156) | hypothetical protein BG0327 | 329610 | 332414 | - | 934 | 51598584 | 2957424 |
| Complete genome (Accession number NC_006156) | glycerol-3-phosphate O-acyltransferase, putative | 332438 | 333331 | - | 297 | 51598585 | 2957420 |
| Complete genome (Accession number NC_006156) | oligopeptide ABC transporter, periplasmic oligopeptide-binding protein | 333722 | 335293 | + | 523 | 51598586 | 2957449 |
| Complete genome (Accession number NC_006156) | oligopeptide ABC transporter, periplasmic oligopeptide-binding protein | 335391 | 336974 | + | 527 | 51598587 | 2957540 |
| Complete genome (Accession number NC_006156) | oligopeptide ABC transporter, periplasmic oligopeptide-binding protein | 337116 | 338741 | + | 541 | 51598588 | 2957541 |
| Complete genome (Accession number NC_006156) | oligopeptide ABC transporter, permease protein | 339078 | 339998 | + | 306 | 51598589 | 2957496 |

Fig. 29 continued

| | | | | | | | |
|---|---|---|---|---|---|---|---|
| Complete genome (Accession number NC_006156) | oligopeptide ABC transporter, permease protein | 340011 | 341060 | + | 349 | 51598590 | 2957142 |
| Complete genome (Accession number NC_006156) | hypothetical protein BG0334 | 341068 | 341115 | + | 15 | 51598591 | 2957427 |
| Complete genome (Accession number NC_006156) | oligopeptide ABC transporter, ATP-binding protein | 341072 | 341944 | + | 290 | 51598592 | 2957428 |
| Complete genome (Accession number NC_006156) | oligopeptide ABC transporter, ATP-binding protein | 341945 | 342916 | + | 323 | 51598593 | 2957537 |
| Complete genome (Accession number NC_006156) | P26 | 342930 | 343685 | - | 251 | 51598594 | 2957439 |
| Complete genome (Accession number NC_006156) | enolase | 343804 | 345120 | + | 438 | 51598595 | 2957276 |
| Complete genome (Accession number NC_006156) | 30S ribosomal protein S9 | 345172 | 345582 | - | 136 | 51598596 | 2957277 |
| Complete genome (Accession number NC_006156) | 50S ribosomal protein L13 | 345579 | 346043 | - | 154 | 51598597 | 2957528 |
| Complete genome (Accession number NC_006156) | hypothetical protein BG0341 | 346096 | 346932 | - | 278 | 51598598 | 2957443 |
| Complete genome (Accession number NC_006156) | aspartyl/glutamyl-tRNA amidotransferase subunit B | 346898 | 348355 | - | 485 | 51598599 | 2957239 |

Fig. 29 continued

| Complete genome (Accession number NC_006156) | Glu-tRNA(Gln) amidotransferase, subunit A | 348345 | 349790 | - | 481 | 51598600 | 2957240 |
|---|---|---|---|---|---|---|---|
| Complete genome (Accession number NC_006156) | aspartyl/glutamyl-tRNA amidotransferase subunit C | 349801 | 350076 | - | 91 | 51598601 | 2957436 |
| Complete genome (Accession number NC_006156) | DNA helicase | 350086 | 352182 | - | 698 | 51598602 | 2957535 |
| Complete genome (Accession number NC_006156) | hypothetical protein BG0346 | 352185 | 353384 | - | 399 | 51598603 | 2957393 |
| Complete genome (Accession number NC_006156) | hypothetical protein BG0347 | 353395 | 354045 | - | 216 | 51598604 | 2957394 |
| Complete genome (Accession number NC_006156) | fibronectin/fibrinogen-binding protein, putative | 354239 | 355657 | + | 472 | 51598605 | 2957187 |
| Complete genome (Accession number NC_006156) | pyruvate kinase | 355755 | 357188 | + | 477 | 51598606 | 2957437 |
| Complete genome (Accession number NC_006156) | hypothetical protein BG0350 | 357206 | 357946 | + | 246 | 51598607 | 2957442 |
| Complete genome (Accession number NC_006156) | 50S ribosomal protein L28 | 357965 | 358243 | - | 92 | 51598608 | 2957273 |
| Complete genome (Accession number NC_006156) | hypothetical protein BG0352 | 358265 | 359827 | - | 520 | 51598609 | 2957274 |

Fig. 29 continued

| | | | | | | | |
|---|---|---|---|---|---|---|---|
| Complete genome (Accession number NC_006156) | hypothetical protein BG0353 | 359950 | 361071 | + | 373 | 51598610 | 2957480 |
| Complete genome (Accession number NC_006156) | hypothetical protein BG0354 | 361068 | 362867 | - | 599 | 51598611 | 2957471 |
| Complete genome (Accession number NC_006156) | hypothetical protein BG0355 | 362880 | 363830 | - | 316 | 51598612 | 2957334 |
| Complete genome (Accession number NC_006156) | transcription factor, putative | 363864 | 364352 | - | 162 | 51598613 | 2957499 |
| Complete genome (Accession number NC_006156) | hypothetical protein BG0357 | 364392 | 364985 | - | 197 | 51598614 | 2957500 |
| Complete genome (Accession number NC_006156) | hypothetical protein BG0358 | 364978 | 365709 | - | 243 | 51598615 | 2957475 |
| Complete genome (Accession number NC_006156) | carboxyl-terminal protease | 365713 | 367143 | - | 476 | 51598616 | 2957226 |
| Complete genome (Accession number NC_006156) | minD-related ATP-binding protein | 367637 | 368779 | + | 380 | 51598617 | 2957450 |
| Complete genome (Accession number NC_006156) | prolipoprotein diacylglyceryl transferase | 368779 | 369765 | + | 328 | 51598618 | 2957263 |
| Complete genome (Accession number NC_006156) | periplasmic protein | 369786 | 371798 | + | 670 | 51598619 | 2957264 |
| Complete genome (Accession number number | methylglyoxal synthase | 371893 | 372273 | + | 126 | 51598620 | 2957171 |

Fig. 29 continued

| | | | | | | | |
|---|---|---|---|---|---|---|---|
| NC_006156) | | | | | | | |
| Complete genome (Accession number NC_006156) | lipoprotein LA7 | 372327 | 372914 | - | 195 | 51598621 | 2957422 |
| Complete genome (Accession number NC_006156) | putative aminopeptidase 1 | 373038 | 374414 | + | 458 | 51598622 | 2957317 |
| Complete genome (Accession number NC_006156) | hypothetical protein BG0366 | 374421 | 374699 | + | 92 | 51598623 | 2957445 |
| Complete genome (Accession number NC_006156) | NAD(P)H-dependent glycerol-3-phosphate dehydrogenase | 374725 | 375780 | - | 351 | 51598624 | 2957213 |
| Complete genome (Accession number NC_006156) | ATP-dependent Clp protease, subunit A | 375798 | 378065 | - | 755 | 51598625 | 2957467 |
| Complete genome (Accession number NC_006156) | tyrosyl-tRNA synthetase | 378103 | 379320 | - | 405 | 51598626 | 2957409 |
| Complete genome (Accession number NC_006156) | glycyl-tRNA synthetase | 379317 | 380654 | - | 445 | 51598627 | 2957156 |
| Complete genome (Accession number NC_006156) | glutamyl-tRNA synthetase | 380672 | 382144 | - | 490 | 51598628 | 2957485 |
| Complete genome (Accession number NC_006156) | hypothetical protein BG0372 | 382157 | 382924 | - | 255 | 51598629 | 2957511 |

Fig. 29 continued

| | | | | | | | |
|---|---|---|---|---|---|---|---|
| Complete genome (Accession number NC_006156) | hypothetical protein BG0373 | 383050 | 384186 | + | 378 | 51598630 | 2957544 |
| Complete genome (Accession number NC_006156) | 5-methylthioadenosine/S-adenosylhomocysteine nucleosidase, putative | 384209 | 384922 | + | 237 | 51598631 | 2957392 |
| Complete genome (Accession number NC_006156) | S-adenosylmethionine synthetase | 384919 | 386097 | + | 392 | 51598632 | 2957498 |
| Complete genome (Accession number NC_006156) | S-ribosylhomocysteinase | 386094 | 386567 | + | 157 | 51598633 | 2957157 |
| Complete genome (Accession number NC_006156) | hypothetical protein BG0377 | 386578 | 387237 | - | 219 | 51598634 | 2957158 |
| Complete genome (Accession number NC_006156) | protein kinase C1 inhibitor | 387264 | 387683 | - | 139 | 51598635 | 2957225 |
| Complete genome (Accession number NC_006156) | Mg2+ transport protein | 387734 | 389098 | - | 454 | 51598636 | 2957364 |
| Complete genome (Accession number NC_006156) | hypothetical protein BG0380 | 389152 | 390576 | - | 474 | 51598637 | 2957374 |
| Complete genome (Accession number NC_006156) | basic membrane protein B | 390589 | 391714 | - | 341 | 51598638 | 2957152 |

Fig. 29 continued

| Complete genome (Accession number NC_006156) | basic membrane protein A | 391811 | 392824 | - | 337 | 51598639 | 2957497 |
|---|---|---|---|---|---|---|---|
| Complete genome (Accession number NC_006156) | basic membrane protein A | 393689 | 394702 | - | 337 | 51598640 | 2957518 |
| Complete genome (Accession number NC_006156) | basic membrane protein C | 394743 | 395804 | - | 353 | 51598641 | 2957339 |
| Complete genome (Accession number NC_006156) | basic membrane protein D | 396127 | 397152 | - | 341 | 51598642 | 2957188 |
| Complete genome (Accession number NC_006156) | 30S ribosomal protein S7 | 397254 | 397727 | - | 157 | 51598643 | 2957395 |
| Complete genome (Accession number NC_006156) | 30S ribosomal protein S12 | 397752 | 398126 | - | 124 | 51598644 | 2957507 |
| Complete genome (Accession number NC_006156) | DNA-directed RNA polymerase subunit beta' | 398192 | 402325 | - | 1377 | 51598645 | 2957150 |
| Complete genome (Accession number NC_006156) | DNA-directed RNA polymerase subunit beta | 402341 | 405808 | - | 1155 | 51598646 | 2957177 |
| Complete genome (Accession number NC_006156) | 50S ribosomal protein L7/L12 | 405891 | 406265 | - | 124 | 51598647 | 2957147 |
| Complete genome (Accession number NC_006156) | 50S ribosomal protein L10 | 406336 | 406824 | - | 162 | 51598648 | 2957161 |

Fig. 29 continued

| | | | | | | | |
|---|---|---|---|---|---|---|---|
| Complete genome (Accession number NC_006156) | 50S ribosomal protein L1 | 40682 9 | 40750 9 | - | 226 | 51598649 | 2957163 |
| Complete genome (Accession number NC_006156) | 50S ribosomal protein L11 | 40750 9 | 40794 0 | - | 143 | 51598650 | 2957510 |
| Complete genome (Accession number NC_006156) | transcription antitermination factor | 40799 2 | 40854 6 | - | 184 | 51598651 | 2957539 |
| Complete genome (Accession number NC_006156) | preprotein translocase subunit SecE | 40857 0 | 40874 0 | - | 56 | 51598652 | 2957517 |
| Complete genome (Accession number NC_006156) | 50S ribosomal protein L33 | 40884 8 | 40902 7 | - | 59 | 51598653 | 2957146 |
| Complete genome (Accession number NC_006156) | hypothetical protein BG0400 | 40919 2 | 41004 9 | - | 285 | 51598654 | 2957293 |
| Complete genome (Accession number NC_006156) | lipoprotein, putative | 41006 3 | 41109 4 | - | 343 | 51598655 | 2957294 |
| Complete genome (Accession number NC_006156) | hypothetical protein BG0402 | 41141 8 | 41207 7 | + | 219 | 51598656 | 2957148 |
| Complete genome (Accession number NC_006156) | hypothetical protein BG0403 | 41208 7 | 41361 0 | - | 507 | 51598657 | 2957144 |
| Complete genome (Accession number NC_006156) | glutamate transporter, putative | 41374 4 | 41494 6 | + | 400 | 51598658 | 2957524 |
| Complete genome (Accession number NC_006156) | prolyl-tRNA synthetase | 41495 8 | 41642 4 | - | 488 | 51598659 | 2957143 |

Fig. 29 continued

| Complete genome (Accession number NC_006156) | hypothetical protein BG0406 | 416477 | 417046 | - | 189 | 51598660 | 2957880 |
|---|---|---|---|---|---|---|---|
| Complete genome (Accession number NC_006156) | hypothetical protein BG0407 | 417734 | 418345 | + | 203 | 51598661 | 2957426 |
| Complete genome (Accession number NC_006156) | hypothetical protein BG0408 | 418356 | 418967 | + | 203 | 51598662 | 2957865 |
| Complete genome (Accession number NC_006156) | mannose-6-phosphate isomerase | 419020 | 420135 | - | 371 | 51598663 | 2957881 |
| Complete genome (Accession number NC_006156) | PTS system, fructose-specific IIABC component | 420132 | 422009 | - | 625 | 51598664 | 2957530 |
| Complete genome (Accession number NC_006156) | hypothetical protein BG0411 | 422179 | 422808 | + | 209 | 51598665 | 2957868 |
| Complete genome (Accession number NC_006156) | endonuclease precursor | 422805 | 423686 | + | 293 | 51598666 | 2957869 |
| Complete genome (Accession number NC_006156) | hypothetical protein BG0413 | 423683 | 424462 | + | 259 | 51598667 | 2957542 |
| Complete genome (Accession number NC_006156) | hypothetical protein BG0414 | 424450 | 425070 | - | 206 | 51598668 | 2957543 |
| Complete genome (Accession number NC_006156) | hypothetical protein BG0415 | 425063 | 425125 | - | 20 | 51598669 | 2957871 |

Fig. 29 continued

| Complete genome (Accession number NC_006156) | chemotaxis protein methyltransferase | 425317 | 426174 | + | 285 | 51598670 | 2957886 |
|---|---|---|---|---|---|---|---|
| Complete genome (Accession number NC_006156) | hypothetical protein BG0417 | 426110 | 426193 | + | 27 | 51598671 | 2957385 |
| Complete genome (Accession number NC_006156) | protein-glutamate methylesterase | 426207 | 427334 | + | 375 | 51598672 | 2957875 |
| Complete genome (Accession number NC_006156) | pheromone shutdown protein | 427358 | 428572 | + | 404 | 51598673 | 2957888 |
| Complete genome (Accession number NC_006156) | adenylate kinase | 428611 | 429246 | + | 211 | 51598674 | 2957295 |
| Complete genome (Accession number NC_006156) | hypothetical protein BG0421 | 429269 | 430312 | + | 347 | 51598675 | 2957892 |
| Complete genome (Accession number NC_006156) | response regulatory protein | 430331 | 431254 | - | 307 | 51598676 | 2957915 |
| Complete genome (Accession number NC_006156) | sensory transduction histidine kinase/response regulator | 431257 | 435747 | - | 1496 | 51598677 | 2957342 |
| Complete genome (Accession number NC_006156) | hydrolase | 442357 | 443196 | - | 279 | 51598678 | 2957895 |
| Complete genome (Accession number NC_006156) | 3-methyladenine DNA glycosylase | 443330 | 443890 | - | 186 | 51598679 | 2957903 |

Fig. 29 continued

| Complete genome (Accession number NC_006156) | hypothetical protein BG0431 | 445610 | 445708 | - | 32 | 51598680 | 2957893 |
|---|---|---|---|---|---|---|---|
| Complete genome (Accession number NC_006156) | hypothetical protein BG0434 | 448522 | 449070 | - | 182 | 51598681 | 2957912 |
| Complete genome (Accession number NC_006156) | hypothetical protein BG0435 | 449165 | 449839 | - | 224 | 51598682 | 2957995 |
| Complete genome (Accession number NC_006156) | hypothetical protein BG0436 | 450048 | 450365 | + | 105 | 51598683 | 2957890 |
| Complete genome (Accession number NC_006156) | hypothetical protein BG0437 | 450395 | 450784 | - | 129 | 51598684 | 2957891 |
| Complete genome (Accession number NC_006156) | hypothetical protein BG0438 | 450902 | 451507 | + | 201 | 51598685 | 2957564 |
| Complete genome (Accession number NC_006156) | chromosome segregation protein, putative | 451516 | 452368 | + | 250 | 51598686 | 2957996 |
| Complete genome (Accession number NC_006156) | hypothetical protein BG0440 | 452371 | 453084 | + | 237 | 51598687 | 2957994 |
| Complete genome (Accession number NC_006156) | stage 0 sporulation protein J | 453353 | 454135 | - | 260 | 51598688 | 2957565 |
| Complete genome (Accession number NC_006156) | DNA gyrase, subunit A | 454254 | 456686 | - | 810 | 51598689 | 2957946 |
| Complete genome (Accession number NC_006156) | DNA gyrase, subunit B | 456698 | 458602 | - | 634 | 51598690 | 2957949 |

Fig. 29 continued

| Complete genome (Accession number NC_006156) | chromosomal replication initiator protein | 458789 | 460243 | + | 484 | 51598691 | 2957604 |
|---|---|---|---|---|---|---|---|
| Complete genome (Accession number NC_006156) | DNA polymerase III, subunit beta | 460484 | 461644 | + | 386 | 51598692 | 2957989 |
| Complete genome (Accession number NC_006156) | hypothetical protein BG0446 | 461737 | 462036 | + | 99 | 51598693 | 2957944 |
| Complete genome (Accession number NC_006156) | 50S ribosomal protein L34 | 462128 | 462283 | + | 51 | 51598694 | 2957566 |
| Complete genome (Accession number NC_006156) | ribonuclease P protein component | 462264 | 462599 | + | 111 | 51598695 | 2957951 |
| Complete genome (Accession number NC_006156) | putative inner membrane protein translocase component YidC | 462610 | 464244 | + | 544 | 51598696 | 2957947 |
| Complete genome (Accession number NC_006156) | spoIIIJ-associated protein | 464257 | 464985 | + | 242 | 51598697 | 2957586 |
| Complete genome (Accession number NC_006156) | hypothetical protein BG0451 | 464912 | 465016 | + | 34 | 51598698 | 2957948 |
| Complete genome (Accession number NC_006156) | nucleotide sugar epimerase | 465031 | 466098 | + | 355 | 51598699 | 2957941 |
| Complete genome (Accession number NC_006156) | fructose-bisphosphate aldolase | 466260 | 467339 | + | 359 | 51598700 | 2957942 |

Fig. 29 continued

| | | | | | | | |
|---|---|---|---|---|---|---|---|
| Complete genome (Accession number NC_006156) | aspartyl-tRNA synthetase | 467793 | 468553 | - | 586 | 51598701 | 2957979 |
| Complete genome (Accession number NC_006156) | Na+/H+ antiporter | 469557 | 471662 | - | 701 | 51598702 | 2957954 |
| Complete genome (Accession number NC_006156) | phosphocarrier protein HPr | 471677 | 471940 | - | 87 | 51598703 | 2957583 |
| Complete genome (Accession number NC_006156) | hypothetical protein BG0457 | 471953 | 472246 | - | 97 | 51598704 | 2957970 |
| Complete genome (Accession number NC_006156) | RNA polymerase sigma-54 factor | 472236 | 473393 | - | 385 | 51598705 | 2957971 |
| Complete genome (Accession number NC_006156) | chromate transport protein, putative | 473498 | 474031 | - | 177 | 51598706 | 2957588 |
| Complete genome (Accession number NC_006156) | hypothetical protein BG0460 | 474028 | 474621 | - | 197 | 51598707 | 2957589 |
| Complete genome (Accession number NC_006156) | hypothetical protein BG0461 | 474590 | 474709 | - | 39 | 51598708 | 2957953 |
| Complete genome (Accession number NC_006156) | hypothetical protein BG0462 | 474840 | 475682 | + | 280 | 51598709 | 2957983 |
| Complete genome (Accession number NC_006156) | lipopolysaccharide biosynthesis-related protein | 475679 | 476827 | - | 382 | 51598710 | 2957584 |
| Complete genome (Accession number NC_006156) | hypothetical protein BG0464 | 476884 | 477873 | + | 329 | 51598711 | 2957976 |

Fig. 29 continued

| | | | | | | | |
|---|---|---|---|---|---|---|---|
| Complete genome (Accession number NC_006156) | hypothetical protein BG0466 | 477940 | 478518 | + | 192 | 51598712 | 2957937 |
| Complete genome (Accession number NC_006156) | excinuclease ABC, subunit C | 478590 | 480332 | - | 580 | 51598713 | 2957594 |
| Complete genome (Accession number NC_006156) | hypothetical protein BG0467 | 480523 | 482040 | + | 505 | 51598714 | 2957988 |
| Complete genome (Accession number NC_006156) | hypothetical protein BG0468 | 482033 | 483352 | + | 439 | 51598715 | 2957977 |
| Complete genome (Accession number NC_006156) | lipoprotein, putative | 483664 | 484368 | - | 234 | 51598716 | 2957602 |
| Complete genome (Accession number NC_006156) | DNA polymerase III subunits gamma and tau | 484951 | 486633 | + | 560 | 51598717 | 2957980 |
| Complete genome (Accession number NC_006156) | hypothetical protein BG0475 | 486638 | 486937 | + | 99 | 51598718 | 2957965 |
| Complete genome (Accession number NC_006156) | nucleoside-diphosphate kinase | 487109 | 487618 | + | 169 | 51598719 | 2957595 |
| Complete genome (Accession number NC_006156) | hypothetical protein BG0477 | 487889 | 488431 | + | 180 | 51598720 | 2957975 |
| Complete genome (Accession number NC_006156) | hypothetical protein BG0478 | 488428 | 489123 | + | 231 | 51598721 | 2957972 |

Fig. 29 continued

| Complete genome (Accession number NC_006156) | ABC transporter, ATP-binding protein | 489092 | 489892 | + | 266 | 51598722 | 2957603 |
|---|---|---|---|---|---|---|---|
| Complete genome (Accession number NC_006156) | hypothetical protein BG0480 | 489889 | 490578 | + | 229 | 51598723 | 2957955 |
| Complete genome (Accession number NC_006156) | hypothetical protein BG0481 | 490580 | 491326 | + | 248 | 51598724 | 2957973 |
| Complete genome (Accession number NC_006156) | signal peptidase II | 491337 | 491849 | + | 170 | 51598725 | 2957974 |
| Complete genome (Accession number NC_006156) | hypothetical protein BG0483 | 492085 | 492915 | + | 276 | 51598726 | 2957967 |
| Complete genome (Accession number NC_006156) | UDP-N-acetylglucosamine 1-carboxyvinyltransferase | 493043 | 494326 | + | 427 | 51598727 | 2957968 |
| Complete genome (Accession number NC_006156) | hypothetical protein BG0485 | 494922 | 496280 | + | 452 | 51598728 | 2957600 |
| Complete genome (Accession number NC_006156) | lipoprotein, putative | 496574 | 496705 | - | 43 | 51598729 | 2957601 |
| Complete genome (Accession number NC_006156) | elongation factor Tu | 497347 | 498531 | + | 394 | 51598730 | 2957964 |
| Complete genome (Accession number NC_006156) | 30S ribosomal protein S10 | 498583 | 498894 | + | 103 | 51598731 | 2957963 |
| Complete genome (Accession | 50S ribosomal protein L3 | 498935 | 499555 | + | 206 | 51598732 | 2957609 |

Fig. 29 continued

| | | | | | | | |
|---|---|---|---|---|---|---|---|
| number NC_006156) | | | | | | | |
| Complete genome (Accession number NC_006156) | 50S ribosomal protein L4 | 49965 | 50194 | + | 209 | 51598733 | 2957966 |
| Complete genome (Accession number NC_006156) | hypothetical protein BG0491 | 50184 | 50228 | + | 14 | 51598734 | 2957960 |
| Complete genome (Accession number NC_006156) | 50S ribosomal protein L23 | 50215 | 50511 | + | 98 | 51598735 | 2957617 |
| Complete genome (Accession number NC_006156) | 50S ribosomal protein L2 | 50533 | 50366 | + | 277 | 51598736 | 2957956 |
| Complete genome (Accession number NC_006156) | 30S ribosomal protein S19 | 50376 | 50654 | + | 92 | 51598737 | 2957742 |
| Complete genome (Accession number NC_006156) | 50S ribosomal protein L22 | 50623 | 50224 | + | 133 | 51598738 | 2957745 |
| Complete genome (Accession number NC_006156) | 30S ribosomal protein S3 | 50228 | 50906 | + | 292 | 51598739 | 2957824 |
| Complete genome (Accession number NC_006156) | 50S ribosomal protein L16 | 50911 | 50327 | + | 138 | 51598740 | 2957904 |
| Complete genome (Accession number NC_006156) | 50S ribosomal protein L29 | 50330 | 50530 | + | 66 | 51598741 | 2957898 |
| Complete genome (Accession number NC_006156) | 30S ribosomal protein S17 | 50533 | 50787 | + | 84 | 51598742 | 2957877 |

Fig. 29 continued

| | | | | | | | |
|---|---|---|---|---|---|---|---|
| Complete genome (Accession number NC_006156) | 50S ribosomal protein L14 | 503815 | 504183 | + | 122 | 51598743 | 2957221 |
| Complete genome (Accession number NC_006156) | 50S ribosomal protein L24 | 504198 | 504503 | + | 101 | 51598744 | 2957343 |
| Complete genome (Accession number NC_006156) | 50S ribosomal protein L5 | 504509 | 505057 | + | 182 | 51598745 | 2957434 |
| Complete genome (Accession number NC_006156) | 30S ribosomal protein S14 | 505075 | 505260 | + | 61 | 51598746 | 2957162 |
| Complete genome (Accession number NC_006156) | 30S ribosomal protein S8 | 505270 | 505668 | + | 132 | 51598747 | 2957577 |
| Complete genome (Accession number NC_006156) | 50S ribosomal protein L6 | 505686 | 506228 | + | 180 | 51598748 | 2957438 |
| Complete genome (Accession number NC_006156) | 50S ribosomal protein L18 | 506246 | 506605 | + | 119 | 51598749 | 2957548 |
| Complete genome (Accession number NC_006156) | 30S ribosomal protein S5 | 506618 | 507118 | + | 166 | 51598750 | 2957487 |
| Complete genome (Accession number NC_006156) | ribosomal protein L30 | 507122 | 507433 | + | 103 | 51598751 | 2957321 |
| Complete genome (Accession number NC_006156) | 50S ribosomal protein L15 | 507426 | 507863 | + | 145 | 51598752 | 2957597 |
| Complete genome (Accession number NC_006156) | preprotein translocase subunit SecY | 507876 | 509180 | + | 434 | 51598753 | 2957590 |

Fig. 29 continued

| | | | | | | | |
|---|---|---|---|---|---|---|---|
| Complete genome (Accession number NC_006156) | 50S ribosomal protein L36 | 509193 | 509306 | + | 37 | 51598754 | 2957550 |
| Complete genome (Accession number NC_006156) | 30S ribosomal protein S13 | 509324 | 509701 | + | 125 | 51598755 | 2957560 |
| Complete genome (Accession number NC_006156) | 30S ribosomal protein S11 | 509729 | 510121 | + | 130 | 51598756 | 2957610 |
| Complete genome (Accession number NC_006156) | DNA-directed RNA polymerase subunit alpha | 510137 | 511171 | + | 344 | 51598757 | 2957563 |
| Complete genome (Accession number NC_006156) | 50S ribosomal protein L17 | 511193 | 511564 | + | 123 | 51598758 | 2957618 |
| Complete genome (Accession number NC_006156) | hypothetical protein BG0516 | 511634 | 513166 | + | 510 | 51598759 | 2957599 |
| Complete genome (Accession number NC_006156) | hypothetical protein BG0517 | 513156 | 513944 | + | 262 | 51598760 | 2957627 |
| Complete genome (Accession number NC_006156) | hemolysin | 513997 | 514716 | + | 239 | 51598761 | 2957662 |
| Complete genome (Accession number NC_006156) | hypothetical protein BG0519 | 514713 | 515459 | - | 248 | 51598762 | 2957653 |
| Complete genome (Accession number NC_006156) | GTP-binding protein EngA | 515546 | 516847 | + | 433 | 51598763 | 2957651 |

Fig. 29 continued

| | | | | | | | |
|---|---|---|---|---|---|---|---|
| Complete genome (Accession number NC_006156) | hypothetical protein BG0521 | 516844 | 518103 | + | 419 | 51598764 | 2957690 |
| Complete genome (Accession number NC_006156) | hypothetical protein BG0522 | 518100 | 518786 | + | 228 | 51598765 | 2957691 |
| Complete genome (Accession number NC_006156) | hypothetical protein BG0523 | 518806 | 525294 | + | 2162 | 51598766 | 2957710 |
| Complete genome (Accession number NC_006156) | phenylalanyl-tRNA synthetase subunit alpha | 525306 | 526868 | + | 520 | 51598767 | 2957709 |
| Complete genome (Accession number NC_006156) | phenylalanyl-tRNA synthetase subunit beta | 526856 | 528556 | + | 566 | 51598768 | 2957705 |
| Complete genome (Accession number NC_006156) | thioredoxin reductase | 528627 | 529607 | + | 326 | 51598769 | 2957706 |
| Complete genome (Accession number NC_006156) | rRNA methylase | 529657 | 530397 | - | 246 | 51598770 | 2957718 |
| Complete genome (Accession number NC_006156) | heat shock protein | 530400 | 531494 | - | 364 | 51598771 | 2957722 |
| Complete genome (Accession number NC_006156) | molecular chaperone DnaK | 531494 | 533401 | - | 635 | 51598772 | 2957753 |
| Complete genome (Accession number NC_006156) | grpE protein | 533425 | 533988 | - | 187 | 51598773 | 2957794 |
| Complete genome (Accession number NC_006156) | NH(3)-dependent NAD+ synthetase | 534365 | 535903 | + | 512 | 51598774 | 2957720 |

Fig. 29 continued

| | | | | | | | |
|---|---|---|---|---|---|---|---|
| Complete genome (Accession number NC_006156) | hypothetical protein BG0532 | 536747 | 536842 | + | 31 | 51598775 | 2957783 |
| Complete genome (Accession number NC_006156) | inositol monophosphatase | 537167 | 537343 | + | 58 | 51598776 | 2957767 |
| Complete genome (Accession number NC_006156) | hypothetical protein BG0534 | 537370 | 537786 | - | 138 | 51598777 | 2957768 |
| Complete genome (Accession number NC_006156) | hypothetical protein BG0535 | 537927 | 539708 | + | 593 | 51598778 | 2957782 |
| Complete genome (Accession number NC_006156) | pantothenate kinase | 539701 | 540489 | + | 262 | 51598779 | 2957785 |
| Complete genome (Accession number NC_006156) | aldose reductase, putative | 540511 | 541458 | - | 315 | 51598780 | 2957784 |
| Complete genome (Accession number NC_006156) | hypothetical protein BG0538 | 541547 | 542356 | - | 269 | 51598781 | 2957786 |
| Complete genome (Accession number NC_006156) | hypothetical protein BG0539 | 542340 | 542954 | - | 204 | 51598782 | 2957788 |
| Complete genome (Accession number NC_006156) | hypothetical protein BG0540 | 542957 | 544252 | - | 431 | 51598783 | 2957789 |
| Complete genome (Accession number NC_006156) | phnP protein | 544446 | 545207 | + | 253 | 51598784 | 2957787 |
| Complete genome (Accession number NC_006156) | exodeoxyribonuclease III | 545228 | 545995 | + | 255 | 51598785 | 2957798 |

Fig. 29 continued

| | | | | | | | |
|---|---|---|---|---|---|---|---|
| Complete genome (Accession number NC_006156) | hypothetical protein BG0543 | 546011 | 546784 | + | 257 | 51598786 | 2957793 |
| Complete genome (Accession number NC_006156) | zinc protease, putative | 546765 | 549566 | + | 933 | 51598787 | 2957799 |
| Complete genome (Accession number NC_006156) | hypothetical protein BG0547 | 549999 | 550643 | - | 214 | 51598788 | 2957837 |
| Complete genome (Accession number NC_006156) | hypothetical protein BG0548 | 550640 | 550996 | - | 118 | 51598789 | 2957809 |
| Complete genome (Accession number NC_006156) | hypothetical protein BG0549 | 551081 | 551779 | - | 232 | 51598790 | 2957812 |
| Complete genome (Accession number NC_006156) | elongation factor G | 551802 | 553883 | - | 693 | 51598791 | 2957985 |
| Complete genome (Accession number NC_006156) | hypothetical protein BG0551 | 554195 | 554422 | + | 75 | 51598792 | 2957990 |
| Complete genome (Accession number NC_006156) | hypothetical protein BG0552 | 554653 | 555180 | + | 175 | 51598793 | 2957991 |
| Complete genome (Accession number NC_006156) | hypothetical protein BG0553 | 555289 | 555939 | + | 216 | 51598794 | 2957935 |
| Complete genome (Accession number NC_006156) | phosphoribosylpyrophosphate synthetase | 556145 | 557365 | + | 406 | 51598795 | 2957913 |
| Complete genome (Accession number NC_006156) | xylulokinase | 557369 | 558736 | + | 455 | 51598796 | 2957906 |

Fig. 29 continued

| | | | | | | | |
|---|---|---|---|---|---|---|---|
| Complete genome (Accession number NC_006156) | hypothetical protein BG0556 | 558719 | 559402 | - | 227 | 51598797 | 2957909 |
| Complete genome (Accession number NC_006156) | dephospho-CoA kinase | 559386 | 560003 | - | 205 | 51598798 | 2957910 |
| Complete genome (Accession number NC_006156) | DNA polymerase I | 559985 | 562714 | - | 909 | 51598799 | 2957902 |
| Complete genome (Accession number NC_006156) | hypothetical protein BG0559 | 562711 | 563115 | - | 134 | 51598800 | 2957900 |
| Complete genome (Accession number NC_006156) | flagellar protein | 563105 | 563524 | - | 139 | 51598801 | 2957889 |
| Complete genome (Accession number NC_006156) | chemotaxis response regulator | 563533 | 563913 | - | 126 | 51598802 | 2957899 |
| Complete genome (Accession number NC_006156) | DNA ligase | 564160 | 566142 | + | 660 | 51598803 | 2957884 |
| Complete genome (Accession number NC_006156) | hypothetical protein BG0563 | 566167 | 567654 | - | 495 | 51598804 | 2957872 |
| Complete genome (Accession number NC_006156) | hypothetical protein BG0564 | 567938 | 569800 | + | 620 | 51598805 | 2957873 |
| Complete genome (Accession number NC_006156) | hypothetical protein BG0565 | 569787 | 570254 | + | 155 | 51598806 | 2957151 |
| Complete genome (Accession number NC_006156) | hypothetical protein BG0566 | 570247 | 571116 | + | 289 | 51598807 | 2957145 |

Fig. 29 continued

| Complete genome (Accession number NC_006156) | phosphocarrier protein HPr | 571254 | 571514 | + | 86 | 51598808 | 2957328 |
|---|---|---|---|---|---|---|---|
| Complete genome (Accession number NC_006156) | phosphoenolpyruvate-protein phosphatase | 571535 | 573256 | + | 573 | 51598809 | 2957389 |
| Complete genome (Accession number NC_006156) | glucose-specific PTS system component | 573259 | 573828 | + | 189 | 51598810 | 2957390 |
| Complete genome (Accession number NC_006156) | heat shock protein 90 | 573866 | 575716 | - | 616 | 51598811 | 2957327 |
| Complete genome (Accession number NC_006156) | 6-phosphogluconate dehydrogenase | 575829 | 577223 | + | 464 | 51598812 | 2957345 |
| Complete genome (Accession number NC_006156) | hypothetical protein BG0572 | 577254 | 577793 | - | 179 | 51598813 | 2957549 |
| Complete genome (Accession number NC_006156) | hypothetical protein BG0573 | 577947 | 578465 | - | 172 | 51598814 | 2957570 |
| Complete genome (Accession number NC_006156) | hypothetical protein BG0574 | 578547 | 579131 | - | 194 | 51598815 | 2957322 |
| Complete genome (Accession number NC_006156) | purine-binding chemotaxis protein | 579337 | 579879 | + | 180 | 51598816 | 2957323 |
| Complete genome (Accession number NC_006156) | hypothetical protein BG0576 | 579891 | 580202 | + | 103 | 51598817 | 2957551 |

Fig. 29 continued

| Complete genome (Accession number NC_006156) | chemotaxis histidine kinase | 580218 | 582359 | + | 713 | 51598818 | 2957620 |
|---|---|---|---|---|---|---|---|
| Complete genome (Accession number NC_006156) | protein-glutamate methylesterase | 582415 | 583572 | + | 385 | 51598819 | 2957569 |
| Complete genome (Accession number NC_006156) | hypothetical protein BG0579 | 583575 | 585347 | + | 590 | 51598820 | 2957652 |
| Complete genome (Accession number NC_006156) | chemotaxis response regulator | 585388 | 585762 | + | 124 | 51598821 | 2957571 |
| Complete genome (Accession number NC_006156) | uridylate kinase | 586119 | 586808 | - | 229 | 51598822 | 2957643 |
| Complete genome (Accession number NC_006156) | glycosyl transferase | 587026 | 588090 | + | 354 | 51598823 | 2957701 |
| Complete genome (Accession number NC_006156) | ABC transporter, ATP-binding protein | 588153 | 588959 | + | 268 | 51598824 | 2957614 |
| Complete genome (Accession number NC_006156) | hypothetical protein BG0585 | 588966 | 589817 | + | 283 | 51598825 | 2957694 |
| Complete genome (Accession number NC_006156) | CTP synthetase | 590007 | 591606 | + | 533 | 51598826 | 2957695 |
| Complete genome (Accession number NC_006156) | hypothetical protein BG0587 | 591625 | 592149 | - | 174 | 51598827 | 2957689 |
| Complete genome (Accession number NC_006156) | hypothetical protein BG0588 | 592285 | 592875 | + | 196 | 51598828 | 2957725 |

Fig. 29 continued

| Complete genome (Accession number NC_006156) | hypothetical protein BG0589 | 593107 | 593169 | + | 20 | 51598829 | 2957687 |
|---|---|---|---|---|---|---|---|
| Complete genome (Accession number NC_006156) | methyl-accepting chemotaxis protein | 593123 | 594295 | + | 390 | 51598830 | 2957726 |
| Complete genome (Accession number NC_006156) | DNA polymerase III subunit alpha | 594425 | 597868 | + | 1147 | 51598831 | 2957727 |
| Complete genome (Accession number NC_006156) | hypothetical protein BG0592 | 597877 | 598458 | + | 193 | 51598832 | 2957724 |
| Complete genome (Accession number NC_006156) | DNA recombinase | 598468 | 600528 | + | 686 | 51598833 | 2957735 |
| Complete genome (Accession number NC_006156) | carboxypeptidase, putative | 600525 | 601211 | - | 228 | 51598834 | 2957732 |
| Complete genome (Accession number NC_006156) | MATE efflux family protein | 601450 | 602787 | + | 445 | 51598835 | 2957728 |
| Complete genome (Accession number NC_006156) | hypothetical protein BG0596 | 602800 | 602997 | + | 65 | 51598836 | 2957733 |
| Complete genome (Accession number NC_006156) | hypothetical protein BG0597 | 602966 | 604321 | + | 451 | 51598837 | 2957734 |
| Complete genome (Accession number NC_006156) | UDP-N-acetylmuramoylalanine--D-glutamate ligase | 604334 | 605689 | + | 451 | 51598838 | 2957769 |
| Complete genome (Accession number | femA protein | 605686 | 606729 | - | 347 | 51598839 | 2957744 |

Fig. 29 continued

| | | | | | | | |
|---|---|---|---|---|---|---|---|
| NC_006156) | | | | | | | |
| Complete genome (Accession number NC_006156) | methionyl-tRNA synthetase | 606739 | 608913 | - | 724 | 51598840 | 2957737 |
| Complete genome (Accession number NC_006156) | 5-methylthioadenosine/S-adenosylhomocysteine nucleosidase, putative | 609072 | 609866 | + | 264 | 51598841 | 2957358 |
| Complete genome (Accession number NC_006156) | phosphate acetyltransferase | 609978 | 611015 | + | 345 | 51598842 | 2957781 |
| Complete genome (Accession number NC_006156) | dimethyladenosine transferase | 610998 | 611843 | - | 281 | 51598843 | 2957791 |
| Complete genome (Accession number NC_006156) | competence locus E, putative | 612518 | 613132 | - | 204 | 51598844 | 2957792 |
| Complete genome (Accession number NC_006156) | hypothetical protein BG0605 | 613249 | 613962 | + | 237 | 51598845 | 2957750 |
| Complete genome (Accession number NC_006156) | long-chain-fatty-acid CoA ligase | 613988 | 615925 | + | 645 | 51598846 | 2957801 |
| Complete genome (Accession number NC_006156) | arginyl-tRNA synthetase | 615954 | 617711 | - | 585 | 51598847 | 2957800 |
| Complete genome (Accession number NC_006156) | hypothetical protein BG0608 | 617777 | 618073 | + | 98 | 51598848 | 2957806 |

Fig. 29 continued

| | | | | | | | |
|---|---|---|---|---|---|---|---|
| Complete genome (Accession number NC_006156) | methyl-accepting chemotaxis protein | 618325 | 620472 | - | 715 | 51598849 | 2957807 |
| Complete genome (Accession number NC_006156) | methyl-accepting chemotaxis protein | 620741 | 622948 | + | 735 | 51598850 | 2957808 |
| Complete genome (Accession number NC_006156) | UDP-N-acetylmuramate dehydrogenase | 622945 | 623865 | - | 306 | 51598851 | 2957815 |
| Complete genome (Accession number NC_006156) | cysteinyl-tRNA synthetase | 623917 | 625359 | + | 480 | 51598852 | 2957814 |
| Complete genome (Accession number NC_006156) | hypothetical protein BG0613 | 625363 | 626934 | + | 523 | 51598853 | 2957817 |
| Complete genome (Accession number NC_006156) | serine hydroxymethyltransferase | 626934 | 628187 | + | 417 | 51598854 | 2957830 |
| Complete genome (Accession number NC_006156) | DnaJ domain containing protein | 628214 | 628966 | + | 250 | 51598855 | 2957828 |
| Complete genome (Accession number NC_006156) | membrane-associated protein p66 | 629026 | 630891 | - | 621 | 51598856 | 2957829 |
| Complete genome (Accession number NC_006156) | L-lactate permease | 631139 | 632647 | - | 502 | 51598857 | 2957833 |
| Complete genome (Accession number NC_006156) | serine-type D-Ala-D-Ala carboxypeptidase | 632719 | 633924 | + | 401 | 51598858 | 2957825 |
| Complete genome (Accession number NC_006156) | hypothetical protein BG0619 | 633941 | 634432 | + | 163 | 51598859 | 2957839 |

Fig. 29 continued

| | | | | | | | |
|---|---|---|---|---|---|---|---|
| Complete genome (Accession number NC_006156) | rep helicase, single-stranded DNA-dependent ATPase | 634435 | 636411 | + | 658 | 51598860 | 2957835 |
| Complete genome (Accession number NC_006156) | aminoacyl-histidine dipeptidase | 636526 | 637956 | + | 476 | 51598861 | 2957834 |
| Complete genome (Accession number NC_006156) | trigger factor | 638527 | 639885 | + | 452 | 51598862 | 2957844 |
| Complete genome (Accession number NC_006156) | ATP-dependent Clp protease proteolytic component | 639900 | 640484 | + | 194 | 51598863 | 2957855 |
| Complete genome (Accession number NC_006156) | ATP-dependent protease ATP-binding subunit | 640493 | 641800 | + | 435 | 51598864 | 2957854 |
| Complete genome (Accession number NC_006156) | ATP-dependent protease LA | 641769 | 644177 | + | 802 | 51598865 | 2957856 |
| Complete genome (Accession number NC_006156) | hypothetical protein BG0630 | 644211 | 644363 | + | 50 | 51598866 | 2957852 |
| Complete genome (Accession number NC_006156) | hypothetical protein BG0631 | 644293 | 644400 | + | 35 | 51598867 | 2957858 |
| Complete genome (Accession number NC_006156) | 30S ribosomal protein S4 | 644425 | 645051 | - | 208 | 51598868 | 2957863 |

Fig. 29 continued

| Complete genome (Accession number NC_006156) | hypothetical protein BG0634 | 645228 | 646589 | - | 453 | 51598869 | 2957843 |
|---|---|---|---|---|---|---|---|
| Complete genome (Accession number NC_006156) | hypothetical protein BG0635 | 646710 | 647078 | + | 122 | 51598870 | 2957846 |
| Complete genome (Accession number NC_006156) | cytidine deaminase | 647101 | 647541 | - | 146 | 51598871 | 2957847 |
| Complete genome (Accession number NC_006156) | hypothetical protein BG0637 | 647662 | 648624 | + | 320 | 51598872 | 2957816 |
| Complete genome (Accession number NC_006156) | beta-glucosidase, putative | 648602 | 650197 | - | 531 | 51598873 | 2957848 |
| Complete genome (Accession number NC_006156) | 4-methyl-5(b-hydroxyethyl)-thiazole monophosphate biosynthesis protein | 650496 | 651050 | + | 184 | 51598874 | 2957822 |
| Complete genome (Accession number NC_006156) | acetate kinase | 651105 | 652322 | - | 405 | 51598875 | 2957780 |
| Complete genome (Accession number NC_006156) | transcription-repair coupling factor | 652347 | 655721 | - | 1124 | 51598876 | 2957821 |
| Complete genome (Accession number NC_006156) | hypothetical protein BG0643 | 655818 | 656780 | + | 320 | 51598877 | 2957795 |

Fig. 29 continued

| | | | | | | | |
|---|---|---|---|---|---|---|---|
| Complete genome (Accession number NC_006156) | N-acetylmuramoyl-L-alanine amidase, putative | 656749 | 658836 | + | 695 | 51598878 | 2957778 |
| Complete genome (Accession number NC_006156) | small primase-like protein | 658919 | 659467 | - | 182 | 51598879 | 2957779 |
| Complete genome (Accession number NC_006156) | hypothetical protein BG0647 | 659436 | 659486 | - | 16 | 51598880 | 2957746 |
| Complete genome (Accession number NC_006156) | putative aminopeptidase 2 | 659470 | 660741 | - | 423 | 51598881 | 2957290 |
| Complete genome (Accession number NC_006156) | hypothetical protein BG0649 | 660825 | 661553 | + | 242 | 51598882 | 2957501 |
| Complete genome (Accession number NC_006156) | PTS system, fructose-specific IIABC component | 661581 | 663446 | - | 621 | 51598883 | 2957502 |
| Complete genome (Accession number NC_006156) | 1-phosphofructokinase | 663536 | 664459 | + | 307 | 51598884 | 2957749 |
| Complete genome (Accession number NC_006156) | hypothetical protein BG0652 | 664534 | 664848 | - | 104 | 51598885 | 2957372 |
| Complete genome (Accession number NC_006156) | exodeoxyribonuclease V, alpha chain | 665118 | 666948 | - | 610 | 51598886 | 2957522 |
| Complete genome (Accession number NC_006156) | exodeoxyribonuclease V, beta chain | 666945 | 670451 | - | 1168 | 51598887 | 2957523 |

Fig. 29 continued

| Complete genome (Accession number NC_006156) | exodeoxyribonuclease V, gamma chain | 670457 | 673696 | - | 1079 | 51598888 | 2957299 |
|---|---|---|---|---|---|---|---|
| Complete genome (Accession number NC_006156) | nicotinate phosphoribosyltransferase | 673700 | 675145 | - | 481 | 51598889 | 2957368 |
| Complete genome (Accession number NC_006156) | glucose-6-phosphate 1-dehydrogenase | 675258 | 676694 | + | 478 | 51598890 | 2957173 |
| Complete genome (Accession number NC_006156) | Na+/H+ antiporter | 676956 | 678299 | + | 447 | 51598891 | 2957305 |
| Complete genome (Accession number NC_006156) | hypothetical protein BG0660 | 678247 | 678333 | - | 28 | 51598892 | 2957483 |
| Complete genome (Accession number NC_006156) | Na+/H+ antiporter | 678399 | 679754 | + | 451 | 51598893 | 2957484 |
| Complete genome (Accession number NC_006156) | spermidine/putrescine ABC transporter, binding periplasmic protein | 679803 | 680849 | - | 348 | 51598894 | 2957462 |
| Complete genome (Accession number NC_006156) | spermidine/putrescine ABC transporter, permease protein | 680869 | 681660 | - | 263 | 51598895 | 2957491 |
| Complete genome (Accession number NC_006156) | spermidine/putrescine ABC transporter, permease protein | 681663 | 682472 | - | 269 | 51598896 | 2957380 |

Fig. 29 continued

| | | | | | | | |
|---|---|---|---|---|---|---|---|
| Complete genome (Accession number NC_006156) | spermidine/putresci ne ABC transporter, ATP-binding protein | 682472 | 683515 | - | 347 | 51598897 | 2957525 |
| Complete genome (Accession number NC_006156) | ribosomal biogenesis GTPase | 683594 | 684433 | - | 279 | 1,62E+08 | 2957366 |
| Complete genome (Accession number NC_006156) | N-acetylmannosamin e-6-phosphate 2-epimerase | 684598 | 685296 | + | 232 | 51598899 | 2957774 |
| Complete genome (Accession number NC_006156) | PTS system, glucose-specific IIBC component | 685344 | 686888 | + | 514 | 51598900 | 2957775 |
| Complete genome (Accession number NC_006156) | hydrolase, alpha/beta fold family | 686916 | 687899 | - | 327 | 51598901 | 2957711 |
| Complete genome (Accession number NC_006156) | ferric uptake regulation protein | 687896 | 688423 | - | 175 | 51598902 | 2957776 |
| Complete genome (Accession number NC_006156) | serine/threonine kinase, putative | 688521 | 690209 | - | 562 | 51598903 | 2957224 |
| Complete genome (Accession number NC_006156) | chaperonin GroEL | 690400 | 692037 | + | 545 | 51598904 | 2957762 |
| Complete genome (Accession number NC_006156) | hypothetical protein BG0673 | 692105 | 692401 | + | 98 | 51598905 | 2957765 |

Fig. 29 continued

| Complete genome (Accession number NC_006156) | hypothetical protein BG0674 | 692416 | 692730 | + | 104 | 51598906 | 2957766 |
|---|---|---|---|---|---|---|---|
| Complete genome (Accession number NC_006156) | preprotein translocase subunit SecD | 692808 | 694566 | + | 586 | 1,62E+08 | 2957759 |
| Complete genome (Accession number NC_006156) | preprotein translocase subunit SecF | 694552 | 695451 | + | 299 | 51598908 | 2957773 |
| Complete genome (Accession number NC_006156) | hypothetical protein BG0677 | 695477 | 696619 | + | 380 | 51598909 | 2957755 |
| Complete genome (Accession number NC_006156) | heat shock protein | 696616 | 697446 | - | 276 | 51598910 | 2957721 |
| Complete genome (Accession number NC_006156) | HemN-related protein | 697555 | 698688 | + | 377 | 51598911 | 2957760 |
| Complete genome (Accession number NC_006156) | ribose 5-phosphate isomerase | 698675 | 699361 | - | 228 | 51598912 | 2957761 |
| Complete genome (Accession number NC_006156) | phosphoglycerate mutase | 699508 | 700254 | + | 246 | 51598913 | 2957699 |
| Complete genome (Accession number NC_006156) | lysyl-tRNA synthetase | 700321 | 701886 | - | 521 | 51598914 | 2957658 |
| Complete genome (Accession number NC_006156) | GTP-binding protein Era | 701959 | 702831 | - | 290 | 51598915 | 2957697 |
| Complete genome (Accession number NC_006156) | hypothetical protein BG0684 | 702937 | 703293 | + | 118 | 51598916 | 2957688 |

Fig. 29 continued

| Complete genome (Accession number NC_006156) | hypothetical protein BG0685 | 703303 | 703713 | + | 136 | 51598917 | 2957665 |
| --- | --- | --- | --- | --- | --- | --- | --- |
| Complete genome (Accession number NC_006156) | hypothetical protein BG0686 | 703775 | 704182 | + | 135 | 51598918 | 2957666 |
| Complete genome (Accession number NC_006156) | hypothetical protein BG0687 | 704191 | 704880 | - | 229 | 51598919 | 2957664 |
| Complete genome (Accession number NC_006156) | hypothetical protein BG0688 | 704923 | 705882 | + | 319 | 51598920 | 2957661 |
| Complete genome (Accession number NC_006156) | hypothetical protein BG0689 | 705866 | 706873 | + | 335 | 51598921 | 2957698 |
| Complete genome (Accession number NC_006156) | hypothetical protein BG0690 | 706863 | 707414 | + | 183 | 51598922 | 2958007 |
| Complete genome (Accession number NC_006156) | flagellar filament outer layer protein | 707492 | 708517 | + | 341 | 51598923 | 2958008 |
| Complete genome (Accession number NC_006156) | chemotaxis histidine kinase | 708560 | 711181 | + | 873 | 51598924 | 2957663 |
| Complete genome (Accession number NC_006156) | purine-binding chemotaxis protein | 711189 | 712592 | + | 467 | 51598925 | 2957408 |
| Complete genome (Accession number NC_006156) | chemotaxis operon protein | 712604 | 713089 | + | 161 | 51598926 | 2957625 |
| Complete genome (Accession number NC_006156) | chemotaxis response regulator | 713131 | 713571 | + | 146 | 51598927 | 2957598 |

Fig. 29 continued

| | | | | | | | |
|---|---|---|---|---|---|---|---|
| Complete genome (Accession number NC_006156) | hypothetical protein BG0696 | 713611 | 714123 | - | 170 | 51598928 | 2958001 |
| Complete genome (Accession number NC_006156) | hypothetical protein BG0697 | 714120 | 715166 | - | 348 | 51598929 | 2958002 |
| Complete genome (Accession number NC_006156) | hypothetical protein BG0698 | 715160 | 716023 | - | 287 | 51598930 | 2958003 |
| Complete genome (Accession number NC_006156) | phosphoglycolate phosphatase | 716020 | 716682 | - | 220 | 51598931 | 2958004 |
| Complete genome (Accession number NC_006156) | ribose/galactose ABC transporter, ATP-binding protein | 716930 | 718540 | + | 536 | 51598932 | 2958005 |
| Complete genome (Accession number NC_006156) | ribose/galactose ABC transporter, permease protein | 718541 | 719692 | + | 383 | 51598933 | 2957921 |
| Complete genome (Accession number NC_006156) | ribose/galactose ABC transporter, permease protein | 719664 | 720590 | + | 308 | 51598934 | 2957925 |
| Complete genome (Accession number NC_006156) | methyl-accepting chemotaxis protein | 720747 | 723008 | + | 753 | 51598935 | 2957919 |
| Complete genome (Accession number NC_006156) | methyl-accepting chemotaxis protein | 723038 | 724939 | + | 633 | 51598936 | 2957999 |

Fig. 29 continued

| Complete genome (Accession number NC_006156) | tRNA (5-methylaminomethyl-2-thiouridylate)-methyltransferase | 724982 | 726049 | - | 355 | 51598937 | 2958000 |
|---|---|---|---|---|---|---|---|
| Complete genome (Accession number NC_006156) | 3-hydroxy-3-methylglutaryl-CoA synthase | 726143 | 727366 | + | 407 | 51598938 | 2957920 |
| Complete genome (Accession number NC_006156) | isopentenyl pyrophosphate isomerase | 727350 | 728414 | + | 354 | 51598939 | 2957917 |
| Complete genome (Accession number NC_006156) | 3-hydroxy-3-methylglutaryl-CoA reductase | 728404 | 729678 | + | 424 | 51598940 | 2957918 |
| Complete genome (Accession number NC_006156) | mevalonate pyrophosphate decarboxylase | 729656 | 730594 | + | 312 | 51598941 | 2957923 |
| Complete genome (Accession number NC_006156) | phosphomevalonate kinase, putative | 730585 | 731538 | + | 317 | 51598942 | 2957924 |
| Complete genome (Accession number NC_006156) | mevalonate kinase, putative | 731532 | 732425 | + | 297 | 51598943 | 2957929 |
| Complete genome (Accession number NC_006156) | hypothetical protein BG0713 | 732549 | 733016 | - | 155 | 51598944 | 2957757 |
| Complete genome (Accession number NC_006156) | neutrophil activating protein | 733101 | 733631 | + | 176 | 51598945 | 2957758 |
| Complete genome (Accession | elongation factor G | 733712 | 735721 | + | 669 | 51598946 | 2957723 |

Fig. 29 continued

| | | | | | | | |
|---|---|---|---|---|---|---|---|
| number NC_006156) | | | | | | | |
| Complete genome (Accession number NC_006156) | xylose operon regulatory protein | 735998 | 737206 | + | 402 | 51598947 | 2957756 |
| Complete genome (Accession number NC_006156) | signal recognition particle protein | 737269 | 738603 | + | 444 | 51598948 | 2957764 |
| Complete genome (Accession number NC_006156) | 30S ribosomal protein S16 | 738616 | 738876 | + | 86 | 51598949 | 2957378 |
| Complete genome (Accession number NC_006156) | hypothetical protein BG0719 | 738877 | 739125 | + | 82 | 51598950 | 2957460 |
| Complete genome (Accession number NC_006156) | hypothetical protein BG0720 | 739129 | 739629 | + | 166 | 51598951 | 2957461 |
| Complete genome (Accession number NC_006156) | tRNA (guanine-N(1)-)-methyltransferase | 739626 | 740345 | + | 239 | 51598952 | 2957212 |
| Complete genome (Accession number NC_006156) | 50S ribosomal protein L19 | 740323 | 740688 | + | 121 | 51598953 | 2957247 |
| Complete genome (Accession number NC_006156) | hypothetical protein BG0723 | 741039 | 741578 | + | 179 | 51598954 | 2957166 |
| Complete genome (Accession number NC_006156) | lipopolysaccharide biosynthesis-related protein | 741580 | 742071 | + | 163 | 51598955 | 2957752 |
| Complete genome (Accession number NC_006156) | 50S ribosomal protein L32 | 742134 | 742316 | + | 60 | 51598956 | 2957446 |

Fig. 29 continued

| Complete genome (Accession number NC_006156) | acyl carrier protein | 742340 | 742582 | + | 80 | 51598957 | 2957804 |
|---|---|---|---|---|---|---|---|
| Complete genome (Accession number NC_006156) | ribonuclease III | 742582 | 743319 | + | 245 | 51598958 | 2957805 |
| Complete genome (Accession number NC_006156) | polynucleotide adenylyltransferase | 743290 | 744522 | - | 410 | 51598959 | 2957818 |
| Complete genome (Accession number NC_006156) | hypothetical protein BG0729 | 744639 | 746411 | + | 590 | 51598960 | 2957849 |
| Complete genome (Accession number NC_006156) | hypothetical protein BG0730 | 746417 | 746740 | + | 107 | 51598961 | 2957853 |
| Complete genome (Accession number NC_006156) | hypothetical protein BG0732 | 747199 | 748230 | + | 343 | 51598962 | 2957851 |
| Complete genome (Accession number NC_006156) | DNA primase | 748236 | 750017 | + | 593 | 51598963 | 2957838 |
| Complete genome (Accession number NC_006156) | RNA polymerase sigma factor RpoD | 750021 | 751916 | + | 631 | 51598964 | 2957841 |
| Complete genome (Accession number NC_006156) | hypothetical protein BG0735 | 751930 | 752686 | + | 252 | 51598965 | 2957826 |
| Complete genome (Accession number NC_006156) | hypothetical protein BG0736 | 753093 | 754061 | + | 322 | 51598966 | 2957819 |
| Complete genome (Accession number NC_006156) | rod shape-determining protein | 754078 | 755121 | + | 347 | 51598967 | 2957820 |

Fig. 29 continued

| | | | | | | | |
|---|---|---|---|---|---|---|---|
| Complete genome (Accession number NC_006156) | rod shape-determining protein | 755125 | 755970 | + | 281 | 51598968 | 2957810 |
| Complete genome (Accession number NC_006156) | hypothetical protein BG0739 | 755970 | 756452 | + | 160 | 51598969 | 2957802 |
| Complete genome (Accession number NC_006156) | penicillin-binding protein | 756452 | 758251 | + | 599 | 51598970 | 2957790 |
| Complete genome (Accession number NC_006156) | rod shape-determining protein | 758256 | 759572 | + | 438 | 51598971 | 2957748 |
| Complete genome (Accession number NC_006156) | threonyl-tRNA synthetase | 759739 | 761487 | + | 582 | 51598972 | 2957754 |
| Complete genome (Accession number NC_006156) | CDP-diacylglycerol--glycerol-3-phosphate 3-phosphatidyltransferase | 761489 | 762118 | + | 209 | 51598973 | 2957730 |
| Complete genome (Accession number NC_006156) | hypothetical protein BG0744 | 762105 | 763550 | + | 481 | 51598974 | 2957731 |
| Complete genome (Accession number NC_006156) | adenylyl cyclase, CyaB-type, putative | 763524 | 764054 | - | 176 | 51598975 | 2957714 |
| Complete genome (Accession number NC_006156) | K+ transport protein | 764154 | 765473 | + | 439 | 51598976 | 2957704 |
| Complete genome (Accession number NC_006156) | hypothetical protein BG0747 | 765470 | 766261 | + | 263 | 51598977 | 2957654 |

Fig. 29 continued

| | | | | | | | |
|---|---|---|---|---|---|---|---|
| Complete genome (Accession number NC_006156) | minD-related ATP-binding protein | 766271 | 767242 | + | 323 | 51598978 | 2957648 |
| Complete genome (Accession number NC_006156) | diphosphate--fructose-6-phosphate 1-phosphotransferase | 767273 | 768616 | + | 447 | 51598979 | 2957649 |
| Complete genome (Accession number NC_006156) | coenzyme A disulfide reductase | 768633 | 769964 | - | 443 | 51598980 | 2957553 |
| Complete genome (Accession number NC_006156) | glutamate transporter | 769979 | 771370 | - | 463 | 51598981 | 2957580 |
| Complete genome (Accession number NC_006156) | glucose-6-phosphate isomerase | 771437 | 773029 | - | 530 | 51598982 | 2957575 |
| Complete genome (Accession number NC_006156) | hypothetical protein BG0753 | 773052 | 773453 | - | 133 | 51598983 | 2957508 |
| Complete genome (Accession number NC_006156) | penicillin-binding protein | 773460 | 776246 | - | 928 | 51598984 | 2957538 |
| Complete genome (Accession number NC_006156) | hypothetical protein BG0755 | 776543 | 777328 | + | 261 | 51598985 | 2957505 |
| Complete genome (Accession number NC_006156) | hypothetical protein BG0756 | 777535 | 778548 | - | 337 | 51598986 | 2957506 |
| Complete genome (Accession number NC_006156) | rare lipoprotein A | 778658 | 779446 | + | 262 | 51598987 | 2957494 |

Fig. 29 continued

| Complete genome (Accession number NC_006156) | histidine phosphokinase/pho phatase, putative | 779639 | 780628 | + | 329 | 51598988 | 2957335 |
|---|---|---|---|---|---|---|---|
| Complete genome (Accession number NC_006156) | valyl-tRNA synthetase | 780633 | 783260 | + | 875 | 51598989 | 2957319 |
| Complete genome (Accession number NC_006156) | hypothetical protein BG0760 | 783354 | 783950 | - | 198 | 51598990 | 2957281 |
| Complete genome (Accession number NC_006156) | hypothetical protein BG0761 | 784028 | 784705 | - | 225 | 51598991 | 2957231 |
| Complete genome (Accession number NC_006156) | co-chaperonin GroES | 785024 | 785296 | - | 90 | 51598992 | 2957232 |
| Complete genome (Accession number NC_006156) | ABC transporter, ATP-binding protein | 785440 | 787071 | + | 543 | 51598993 | 2957883 |
| Complete genome (Accession number NC_006156) | hypothetical protein BG0764 | 787131 | 788786 | + | 551 | 51598994 | 2957862 |
| Complete genome (Accession number NC_006156) | antigen, p83/100 | 788892 | 790973 | + | 693 | 51598995 | 2957934 |
| Complete genome (Accession number NC_006156) | endonuclease III | 791299 | 791916 | + | 205 | 51598996 | 2957958 |
| Complete genome (Accession number NC_006156) | oligopeptide ABC transporter, permease protein | 791926 | 792786 | - | 286 | 51598997 | 2957959 |

Fig. 29 continued

| | | | | | | | |
|---|---|---|---|---|---|---|---|
| Complete genome (Accession number NC_006156) | oligopeptide ABC transporter, permease protein | 792786 | 793766 | - | 326 | 51598998 | 2957987 |
| Complete genome (Accession number NC_006156) | hypothetical protein BG0771 | 793772 | 794230 | - | 152 | 51598999 | 2957936 |
| Complete genome (Accession number NC_006156) | hypothetical protein BG0772 | 794329 | 795480 | + | 383 | 51599000 | 2957911 |
| Complete genome (Accession number NC_006156) | hypothetical protein BG0773 | 795725 | 796738 | - | 337 | 51599001 | 2957907 |
| Complete genome (Accession number NC_006156) | hypothetical protein BG0774 | 796755 | 798263 | - | 502 | 51599002 | 2957908 |
| Complete genome (Accession number NC_006156) | membrane spanning protein, putative | 798268 | 799002 | - | 244 | 51599003 | 2957932 |
| Complete genome (Accession number NC_006156) | ABC transporter, ATP-binding protein | 799005 | 799928 | - | 307 | 51599004 | 2957905 |
| Complete genome (Accession number NC_006156) | ribonuclease Z | 799937 | 800896 | - | 319 | 51599005 | 2957857 |
| Complete genome (Accession number NC_006156) | hypothetical protein BG0778 | 801087 | 802154 | - | 355 | 51599006 | 2957878 |
| Complete genome (Accession number NC_006156) | ATP-dependent Clp protease proteolytic subunit | 802353 | 802949 | + | 198 | 51599007 | 2957879 |

Fig. 29 continued

| | | | | | | | |
|---|---|---|---|---|---|---|---|
| Complete genome (Accession number NC_006156) | hypothetical protein BG0780 | 803027 | 803404 | + | 125 | 51599008 | 2957885 |
| Complete genome (Accession number NC_006156) | lipoprotein, putative | 803374 | 803661 | + | 95 | 51599009 | 2957867 |
| Complete genome (Accession number NC_006156) | hypothetical protein BG0783 | 803824 | 804678 | - | 284 | 51599010 | 2957258 |
| Complete genome (Accession number NC_006156) | hypothetical protein BG0784 | 804718 | 805047 | - | 109 | 51599011 | 2957192 |
| Complete genome (Accession number NC_006156) | hypothetical protein BG0785 | 805159 | 806043 | + | 294 | 51599012 | 2957876 |
| Complete genome (Accession number NC_006156) | response regulatory protein | 806288 | 807646 | - | 452 | 51599013 | 2957250 |
| Complete genome (Accession number NC_006156) | sensory transduction histidine kinase, putative | 807649 | 808797 | - | 382 | 51599014 | 2957251 |
| Complete genome (Accession number NC_006156) | hypothetical protein BG0788 | 808794 | 809840 | - | 348 | 51599015 | 2957241 |
| Complete genome (Accession number NC_006156) | colicin V production protein, putative | 809851 | 810339 | - | 162 | 51599016 | 2957210 |

Fig. 29 continued

| | | | | | | | |
|---|---|---|---|---|---|---|---|
| Complete genome (Accession number NC_006156) | UDP-N-acetylglucosamine--N-acetylmuramyl-(pentapeptide) pyrophosphoryl-undecaprenol N-acetylglucosamine transferase | 810336 | 811427 | - | 363 | 51599017 | 2957493 |
| Complete genome (Accession number NC_006156) | pyridoxal kinase | 811580 | 812374 | - | 264 | 51599018 | 2957223 |
| Complete genome (Accession number NC_006156) | O-sialoglycoprotein endopeptidase | 812374 | 813390 | - | 338 | 51599019 | 2957312 |
| Complete genome (Accession number NC_006156) | hypothetical protein BG0793 | 813387 | 814253 | - | 288 | 51599020 | 2957313 |
| Complete genome (Accession number NC_006156) | RNA polymerase sigma factor | 814304 | 815104 | - | 266 | 51599021 | 2957292 |
| Complete genome (Accession number NC_006156) | hypothetical protein BG0795 | 815249 | 815569 | - | 106 | 51599022 | 2957316 |
| Complete genome (Accession number NC_006156) | flagellar basal body P-ring protein | 815559 | 816554 | - | 331 | 51599023 | 2957211 |
| Complete genome (Accession number NC_006156) | hypothetical protein BG0797 | 816724 | 817158 | - | 144 | 51599024 | 2957383 |

Fig. 29 continued

| | | | | | | | |
|---|---|---|---|---|---|---|---|
| Complete genome (Accession number NC_006156) | flagellar basal body rod protein FlgG | 817358 | 818155 | - | 265 | 51599025 | 2957469 |
| Complete genome (Accession number NC_006156) | flagellar hook-basal body complex protein | 818168 | 819016 | - | 282 | 51599026 | 2957470 |
| Complete genome (Accession number NC_006156) | hypothetical protein BG0800 | 819271 | 819831 | + | 186 | 51599027 | 2957346 |
| Complete genome (Accession number NC_006156) | adenine phosphoribosyltransferase | 819893 | 820423 | + | 176 | 51599028 | 2957397 |
| Complete genome (Accession number NC_006156) | 50S ribosomal protein L21 | 820481 | 820792 | + | 103 | 51599029 | 2957581 |
| Complete genome (Accession number NC_006156) | hypothetical protein BG0803 | 820798 | 821118 | + | 106 | 51599030 | 2957402 |
| Complete genome (Accession number NC_006156) | 50S ribosomal protein L27 | 821118 | 821363 | + | 81 | 51599031 | 2957486 |
| Complete genome (Accession number NC_006156) | GTPase ObgE | 821406 | 822397 | + | 329 | 51599032 | 2957458 |
| Complete genome (Accession number NC_006156) | hypothetical protein BG0806 | 822484 | 823077 | + | 197 | 51599033 | 2957459 |
| Complete genome (Accession number NC_006156) | hypothetical protein BG0807 | 823062 | 824246 | + | 394 | 51599034 | 2957429 |
| Complete genome (Accession number | hypothetical protein BG0808 | 824221 | 824571 | + | 116 | 51599035 | 2957407 |

Fig. 29 continued

| | | | | | | | |
|---|---|---|---|---|---|---|---|
| NC_006156) | | | | | | | |
| Complete genome (Accession number NC_006156) | regulatory protein SpoVG | 824675 | 824968 | + | 97 | 51599036 | 2957432 |
| Complete genome (Accession number NC_006156) | 50S ribosomal protein L25/general stress protein Ctc | 825125 | 825673 | + | 182 | 51599037 | 2957552 |
| Complete genome (Accession number NC_006156) | peptidyl-tRNA hydrolase | 825687 | 826244 | + | 185 | 51599038 | 2957492 |
| Complete genome (Accession number NC_006156) | hypothetical protein BG0813 | 826244 | 827566 | + | 440 | 51599039 | 2957363 |
| Complete genome (Accession number NC_006156) | cell division protein | 827563 | 829482 | + | 639 | 51599040 | 2957561 |
| Complete genome (Accession number NC_006156) | hypothetical protein BG0815 | 829495 | 830976 | + | 493 | 51599041 | 2957562 |
| Complete genome (Accession number NC_006156) | thymidine kinase | 831084 | 832187 | + | 367 | 51599042 | 2957555 |
| Complete genome (Accession number NC_006156) | hypothetical protein BG0817 | 832117 | 832209 | - | 30 | 51599043 | 2957556 |
| Complete genome (Accession number NC_006156) | hypothetical protein BG0818 | 832184 | 832813 | - | 209 | 51599044 | 2957554 |
| Complete genome (Accession number | thymidylate kinase | 832827 | 833435 | - | 202 | 51599045 | 2957587 |

Fig. 29 continued

| | | | | | | | |
|---|---|---|---|---|---|---|---|
| NC_006156) | | | | | | | |
| Complete genome (Accession number NC_006156) | hypothetical protein BG0820 | 833541 | 837941 | + | 1466 | 51599046 | 2957557 |
| Complete genome (Accession number NC_006156) | outer membrane protein | 837959 | 840424 | + | 821 | 51599047 | 2957558 |
| Complete genome (Accession number NC_006156) | hypothetical protein BG0822 | 840446 | 840979 | + | 177 | 51599048 | 2957546 |
| Complete genome (Accession number NC_006156) | DNA mismatch repair protein | 841169 | 843757 | + | 862 | 51599049 | 2957568 |
| Complete genome (Accession number NC_006156) | competence protein F, putative | 843791 | 844303 | + | 170 | 51599050 | 2957559 |
| Complete genome (Accession number NC_006156) | hypothetical protein BG0825 | 844476 | 844913 | + | 145 | 51599051 | 2957572 |
| Complete genome (Accession number NC_006156) | transcription elongation factor NusA | 844927 | 846375 | + | 462 | 51599052 | 2957573 |
| Complete genome (Accession number NC_006156) | translation initiation factor IF-2 | 846378 | 849029 | + | 883 | 51599053 | 2957567 |
| Complete genome (Accession number NC_006156) | ribosome-binding factor A | 849053 | 849415 | + | 120 | 51599054 | 2957574 |
| Complete genome (Accession number NC_006156) | tRNA pseudouridine 55 synthase | 849418 | 850266 | + | 282 | 51599055 | 2957576 |

Fig. 29 continued

| | | | | | | | |
|---|---|---|---|---|---|---|---|
| Complete genome (Accession number NC_006156) | 30S ribosomal protein S15 | 850436 | 850702 | + | 88 | 51599056 | 2957593 |
| Complete genome (Accession number NC_006156) | polynucleotide phosphorylase/poly adenylase | 850735 | 852882 | + | 715 | 51599057 | 2957582 |
| Complete genome (Accession number NC_006156) | hypothetical protein BG0832 | 852854 | 854401 | + | 515 | 51599058 | 2957591 |
| Complete genome (Accession number NC_006156) | hypothetical protein BG0833 | 854376 | 855665 | + | 429 | 51599059 | 2957592 |
| Complete genome (Accession number NC_006156) | hypothetical protein BG0834 | 855662 | 856729 | + | 355 | 51599060 | 2957621 |
| Complete genome (Accession number NC_006156) | tRNA-guanine transglycosylase | 856759 | 857886 | + | 375 | 51599061 | 2957596 |
| Complete genome (Accession number NC_006156) | virulence factor mviN protein | 857879 | 859399 | + | 506 | 51599062 | 2957608 |
| Complete genome (Accession number NC_006156) | hypothetical protein BG0837 | 859396 | 860802 | + | 468 | 51599063 | 2957606 |
| Complete genome (Accession number NC_006156) | pantothenate metabolism flavoprotein | 860828 | 861889 | - | 353 | 51599064 | 2957628 |
| Complete genome (Accession number NC_006156) | sodium/pantothen ate symporter | 862327 | 863661 | + | 444 | 51599065 | 2957629 |

Fig. 29 continued

| | | | | | | | |
|---|---|---|---|---|---|---|---|
| Complete genome (Accession number NC_006156) | hypothetical protein BG0840 | 863674 | 864621 | + | 315 | 51599066 | 2957622 |
| Complete genome (Accession number NC_006156) | hypothetical protein BG0841 | 864596 | 865537 | + | 313 | 51599067 | 2957630 |
| Complete genome (Accession number NC_006156) | UDP-N-acetylmuramate--L-alanine ligase | 865527 | 866933 | + | 468 | 51599068 | 2957638 |
| Complete genome (Accession number NC_006156) | hypothetical protein BG0843 | 866944 | 867813 | + | 289 | 51599069 | 2957686 |
| Complete genome (Accession number NC_006156) | cytidylate kinase | 867810 | 868346 | + | 178 | 51599070 | 2957682 |
| Complete genome (Accession number NC_006156) | hypothetical protein BG0845 | 868386 | 868586 | + | 66 | 51599071 | 2957683 |
| Complete genome (Accession number NC_006156) | 2-methylthio-N6-isopentyladenosine tRNA modification enzyme | 868573 | 869493 | + | 306 | 51599072 | 2957636 |
| Complete genome (Accession number NC_006156) | hypothetical protein BG0847 | 869635 | 870006 | - | 123 | 51599073 | 2957698 |
| Complete genome (Accession number NC_006156) | hypothetical protein BG0848 | 870087 | 870632 | + | 181 | 51599074 | 2957707 |
| Complete genome (Accession number NC_006156) | hypothetical protein BG0849 | 870625 | 871272 | - | 215 | 51599075 | 2957702 |

Fig. 29 continued

| Complete genome (Accession number NC_006156) | hypothetical protein BG0850 | 871331 | 871453 | + | 40 | 51599076 | 2957703 |
|---|---|---|---|---|---|---|---|
| Complete genome (Accession number NC_006156) | hypothetical protein BG0851 | 871400 | 871810 | - | 136 | 51599077 | 2957693 |
| Complete genome (Accession number NC_006156) | ATP-dependent helicase | 872044 | 874518 | - | 824 | 51599078 | 2957708 |
| Complete genome (Accession number NC_006156) | DNA topoisomerase I | 874521 | 877070 | - | 849 | 51599079 | 2957712 |
| Complete genome (Accession number NC_006156) | exonuclease SbcD | 877145 | 878386 | + | 413 | 51599080 | 2957717 |
| Complete genome (Accession number NC_006156) | exonuclease SbcC | 878373 | 881219 | + | 948 | 51599081 | 2957715 |
| Complete genome (Accession number NC_006156) | xylose operon regulatory protein | 881253 | 882188 | + | 311 | 51599082 | 2957716 |
| Complete genome (Accession number NC_006156) | lipoprotein, putative | 882208 | 883032 | - | 274 | 51599083 | 2957713 |
| Complete genome (Accession number NC_006156) | isoleucyl-tRNA synthetase | 883026 | 886154 | - | 1042 | 51599084 | 2957738 |
| Complete genome (Accession number NC_006156) | ATP-dependent Clp protease, subunit C | 886169 | 888388 | - | 739 | 51599085 | 2957740 |
| Complete genome (Accession number NC_006156) | phosphomannomutase | 888411 | 890120 | - | 569 | 51599086 | 2957729 |

Fig. 29 continued

| | | | | | | | |
|---|---|---|---|---|---|---|---|
| Complete genome (Accession number NC_006156) | excinuclease ABC subunit B | 890270 | 892264 | + | 664 | 51599087 | 2957739 |
| Complete genome (Accession number NC_006156) | excinuclease ABC, subunit A | 892281 | 895133 | + | 950 | 51599088 | 2957772 |
| Complete genome (Accession number NC_006156) | hypothetical protein BG0863 | 895136 | 898537 | + | 1133 | 51599089 | 2957770 |
| Complete genome (Accession number NC_006156) | hypothetical protein BG0864 | 898503 | 898559 | + | 18 | 51599090 | 2957771 |
| Complete genome (Accession number NC_006156) | hypothetical protein BG0865 | 898546 | 899091 | - | 181 | 51599091 | 2957741 |
| Complete genome (Accession number NC_006156) | hypothetical protein BG0866 | 899069 | 899668 | - | 199 | 51599092 | 2957743 |
| Complete genome (Accession number NC_006156) | lipoprotein, putative | 899678 | 901300 | - | 540 | 51599093 | 2957796 |
| Complete genome (Accession number NC_006156) | arginine deiminase | 901481 | 902710 | + | 409 | 51599094 | 2957797 |
| Complete genome (Accession number NC_006156) | ornithine carbamoyltransferase, catabolic | 902782 | 903765 | + | 327 | 51599095 | 2957777 |
| Variable plasmid segment G1a19c04.r1 (Accession number NT_108239) | hypothetical protein BGP227 | 431 | 874 | + | 147 | 56561105 | 3189711 |
| Variable plasmid segment G1a19c04.r1 (Accession number | hypothetical protein BGP228 | 1203 | 1631 | - | 142 | 56561106 | 3189707 |

Fig. 29 continued

| | | | | | | | |
|---|---|---|---|---|---|---|---|
| NT_108239) | | | | | | | |
| Variable plasmid segment G1a19c04.r1 (Accession number NT_108239) | hypothetical protein BGP229 | 1600 | 1689 | - | 29 | 56561107 | 3189708 |
| Variable plasmid segment G1a19c04.r1 (Accession number NT_108239) | hypothetical protein BGP230 | 1690 | 2106 | - | 138 | 56561108 | 3189710 |
| Variable plasmid segment G1a19c04.r1 (Accession number NT_108239) | hypothetical protein BGP231 | 2116 | 2316 | - | 66 | 56561109 | 3189714 |
| Variable plasmid segment G1a19c04.r1 (Accession number NT_108239) | hypothetical protein BGP232 | 2304 | 2771 | - | 155 | 56561110 | 3189704 |
| Variable plasmid segment G1a19c04.r1 (Accession number NT_108239) | hypothetical protein BGP233 | 2966 | 3055 | - | 29 | 56561111 | 3189705 |
| Variable plasmid segment G1a19c04.r1 (Accession number NT_108239) | hypothetical protein BGP234 | 3742 | 3858 | - | 38 | 56561112 | 3189709 |
| Variable plasmid segment G1a19c04.r1 (Accession number NT_108239) | hypothetical protein BGP235 | 3946 | 4299 | - | 117 | 56561113 | 3189706 |
| Variable plasmid segment G1a19c04.r1 (Accession number NT_108239) | hypothetical protein BGP236 | 4312 | 4710 | - | 132 | 56561114 | 3189715 |
| Variable plasmid segment G1a19c04.r1 (Accession | hypothetical protein BGP237 | 4921 | 5076 | - | 51 | 56561115 | 3189713 |

Fig. 29 continued

| | | | | | | |
|---|---|---|---|---|---|---|
| number NT_108239) | | | | | | |
| Variable plasmid segment G1a19c04.r1 (Accession number NT_108239) | hypothetical protein BGP238 | 5037 | 5762 | - | 241 | 56561116 | 3189712 |
| Variable plasmid segment G11a15f12.s1 (Accession number NT_108263) | hypothetical protein BGP334 | 74 | 286 | + | 70 | 56561236 | 3189985 |
| Variable plasmid segment G11a15f12.s1 (Accession number NT_108263) | hypothetical protein BGP335 | 635 | 1195 | - | 186 | 56561237 | 3189987 |
| Variable plasmid segment G11a15f12.s1 (Accession number NT_108263) | hypothetical protein BGP336 | 1210 | 1695 | - | 161 | 56561238 | 3189986 |
| Variable plasmid segment G11a15f12.s1 (Accession number NT_108263) | hypothetical protein BGP337 | 1902 | 1970 | - | 22 | 56561239 | 3189984 |
| Variable plasmid segment G1M1b11b03.s1( Accession number NT_108262) | hypothetical protein BGP332 | 1 | 365 | - | 122 | 56561233 | 3189982 |
| Variable plasmid segment G1M1b11b03.s1( Accession number NT_108262) | hypothetical protein BGP333 | 795 | 1928 | + | 377 | 56561234 | 3189983 |
| Variable plasmid segment G1M1b15c06.r1 (Accession number NT_108261) | hypothetical protein BGP329 | 3 | 488 | + | 161 | 56561229 | 3189981 |
| Variable plasmid segment G1M1b15c06.r1 (Accession | hypothetical protein BGP330 | 1652 | 1984 | + | 110 | 56561230 | 3189979 |

Fig. 29 continued

| | | | | | | | |
|---|---|---|---|---|---|---|---|
| number NT_108261) | | | | | | | |
| Variable plasmid segment G1M1b15c06.r1 (Accession number NT_108261) | hypothetical protein BGP331 | 2120 | 2242 | + | 40 | 56561231 | 3189980 |
| Variable plasmid segment G11a14d08.s1 (Accession number NT_108260) | hypothetical protein BGP326 | 1 | 852 | - | 284 | 56561225 | 3189978 |
| Variable plasmid segment G11a14d08.s1 (Accession number NT_108260) | hypothetical protein BGP327 | 849 | 1415 | - | 188 | 56561226 | 3189977 |
| Variable plasmid segment G11a14d08.s1 (Accession number NT_108260) | hypothetical protein BGP328 | 1604 | 1858 | - | 84 | 56561227 | 3189976 |
| Variable plasmid segment PBi1a03e01.s1 (Accession number NT_108259) | hypothetical protein BGP325 | 845 | 1096 | + | 83 | 56561223 | 3189975 |
| Variable plasmid segment G1a13d03.r1 (Accession number NT_108258) | hypothetical protein BGP321 | 1 | 203 | - | 67 | 56561218 | 3189973 |
| Variable plasmid segment G1a13d03.r1 (Accession number NT_108258) | hypothetical protein BGP322 | 370 | 990 | - | 206 | 56561219 | 3189974 |
| Variable plasmid segment G1a13d03.r1 (Accession number NT_108258) | hypothetical protein BGP323 | 1088 | 1843 | - | 251 | 56561220 | 3189972 |
| Variable plasmid segment G1a13d03.r1 (Accession | hypothetical protein BGP324 | 1816 | 1986 | - | 56 | 56561221 | 3189971 |

Fig. 29 continued

| | | | | | | | |
|---|---|---|---|---|---|---|---|
| number NT_108258) | | | | | | | |
| Variable plasmid segment G1Mb19g09.r1 (Accession number NT_108257) | hypothetical protein BGP320 | 1700 | 1819 | + | 39 | 56561216 | 3189970 |
| Variable plasmid segment G11a19d04.r1 (Accession number NT_108256) | hypothetical protein BGP317 | 531 | 644 | + | 37 | 56561212 | 3189967 |
| Variable plasmid segment G11a19d04.r1 (Accession number NT_108256) | hypothetical protein BGP318 | 960 | 1049 | + | 29 | 56561213 | 3189968 |
| Variable plasmid segment G11a19d04.r1 (Accession number NT_108256) | hypothetical protein BGP319 | 2065 | 2438 | + | 124 | 56561214 | 3189969 |
| Variable plasmid segment G1a13d06.s1 (Accession number NT_108255) | hypothetical protein BGP316 | 1 | 2417 | - | 806 | 56561210 | 3189966 |
| Variable plasmid segment G1a18e10.s1 (Accession number NT_108254) | hypothetical protein BGP312 | 60 | 719 | + | 219 | 56561205 | 3189965 |
| Variable plasmid segment G1a18e10.s1 (Accession number NT_108254) | hypothetical protein BGP313 | 759 | 1280 | + | 173 | 56561206 | 3189962 |
| Variable plasmid segment G1a18e10.s1 (Accession number NT_108254) | hypothetical protein BGP314 | 1292 | 1693 | + | 133 | 56561207 | 3189964 |
| Variable plasmid segment G1a18e10.s1 (Accession | hypothetical protein BGP315 | 2408 | 2543 | + | 45 | 56561208 | 3189963 |

Fig. 29 continued

| | | | | | | | |
|---|---|---|---|---|---|---|---|
| number NT_108254) | | | | | | | |
| Variable plasmid segment G1a22b07.r1 (Accession number NT_108253) | hypothetical protein BGP309 | 123 | 239 | + | 38 | 56561201 | 3189960 |
| Variable plasmid segment G1a22b07.r1 (Accession number NT_108253) | hypothetical protein BGP310 | 695 | 1249 | - | 184 | 56561202 | 3189961 |
| Variable plasmid segment G1a22b07.r1 (Accession number NT_108253) | hypothetical protein BGP311 | 1559 | 2380 | + | 273 | 56561203 | 3189959 |
| Variable plasmid segment G11a15h12.r1 (Accession number NT_108252) | hypothetical protein BGP303 | 405 | 1022 | - | 205 | 56561194 | 3189958 |
| Variable plasmid segment G11a15h12.r1 (Accession number NT_108252) | hypothetical protein BGP304 | 1035 | 1544 | - | 169 | 56561195 | 3189957 |
| Variable plasmid segment G11a15h12.r1 (Accession number NT_108252) | hypothetical protein BGP305 | 2190 | 2342 | - | 50 | 56561196 | 3189953 |
| Variable plasmid segment G11a15h12.r1 (Accession number NT_108252) | hypothetical protein BGP306 | 2348 | 2509 | - | 53 | 56561197 | 3189954 |
| Variable plasmid segment G11a15h12.r1 (Accession number NT_108252) | hypothetical protein BGP307 | 2532 | 2705 | - | 57 | 56561198 | 3189955 |
| Variable plasmid segment G11a15h12.r1 (Accession | hypothetical protein BGP308 | 3059 | 3140 | - | 26 | 56561199 | 3189956 |

Fig. 29 continued

| | | | | | | | |
|---|---|---|---|---|---|---|---|
| number NT_108252) | | | | | | | |
| Variable plasmid segment G1a18d09.s1 (Accession number NT_108251) | hypothetical protein BGP296 | 237 | 359 | + | 40 | 56561186 | 3189951 |
| Variable plasmid segment G1a18d09.s1 (Accession number NT_108251) | hypothetical protein BGP297 | 389 | 811 | + | 140 | 56561187 | 3189949 |
| Variable plasmid segment G1a18d09.s1 (Accession number NT_108251) | hypothetical protein BGP298 | 774 | 1088 | + | 104 | 56561188 | 3189788 |
| Variable plasmid segment G1a18d09.s1 (Accession number NT_108251) | hypothetical protein BGP299 | 1098 | 1511 | + | 137 | 56561189 | 3189948 |
| Variable plasmid segment G1a18d09.s1 (Accession number NT_108251) | hypothetical protein BGP300 | 1630 | 2370 | + | 246 | 56561190 | 3189787 |
| Variable plasmid segment G1a18d09.s1 (Accession number NT_108251) | hypothetical protein BGP301 | 2411 | 2953 | + | 180 | 56561191 | 3189950 |
| Variable plasmid segment G1a18d09.s1 (Accession number NT_108251) | hypothetical protein BGP302 | 2966 | 3140 | + | 58 | 56561192 | 3189952 |
| Variable plasmid segment G1a07g11.r1 (Accession number NT_108250) | hypothetical protein BGP294 | 435 | 2342 | - | 635 | 56561183 | 3189786 |
| Variable plasmid segment G1a07g11.r1 (Accession | hypothetical protein BGP295 | 2580 | 3029 | - | 149 | 56561184 | 3189785 |

Fig. 29 continued

| | | | | | | | |
|---|---|---|---|---|---|---|---|
| number NT_108250) | | | | | | | |
| Variable plasmid segment G1Mb28a10.r1 (Accession number NT_108249) | hypothetical protein BGP291 | 320 | 946 | + | 208 | 56561179 | 3189784 |
| Variable plasmid segment G1Mb28a10.r1 (Accession number NT_108249) | hypothetical protein BGP292 | 1023 | 1970 | - | 315 | 56561180 | 3189782 |
| Variable plasmid segment G1Mb28a10.r1 (Accession number NT_108249) | hypothetical protein BGP293 | 2358 | 3380 | + | 341 | 56561181 | 3189783 |
| Variable plasmid segment G1a23g09.r1 (Accession number NT_108248) | hypothetical protein BGP287 | 226 | 777 | + | 183 | 56561174 | 3189780 |
| Variable plasmid segment G1a23g09.r1 (Accession number NT_108248) | hypothetical protein BGP288 | 1065 | 1388 | - | 107 | 56561175 | 3189781 |
| Variable plasmid segment G1a23g09.r1 (Accession number NT_108248) | hypothetical protein BGP289 | 2136 | 2675 | - | 179 | 56561176 | 3189779 |
| Variable plasmid segment G1a23g09.r1 (Accession number NT_108248) | hypothetical protein BGP290 | 3009 | 3236 | - | 75 | 56561177 | 3189778 |
| Variable plasmid segment PBiIM1b05c04.r1 (Accession number NT_108247) | hypothetical protein BGP283 | 392 | 547 | + | 51 | 56561169 | 3189763 |
| Variable plasmid segment PBiIM1b05c04.r1 (Accession | hypothetical protein BGP284 | 630 | 1139 | + | 169 | 56561170 | 3189762 |

Fig. 29 continued

| | | | | | | | |
|---|---|---|---|---|---|---|---|
| number NT_108247) | | | | | | | |
| Variable plasmid segment PBilM1b05c04.r1 (Accession number NT_108247) | hypothetical protein BGP285 | 2210 | 2392 | - | 60 | 56561171 | 3189761 |
| Variable plasmid segment PBilM1b05c04.r1 (Accession number NT_108247) | hypothetical protein BGP286 | 2699 | 2860 | + | 53 | 56561172 | 3189760 |
| Variable plasmid segment G1M1b09a03.r1 (Accession number NT_108246) | hypothetical protein BGP278 | 1 | 187 | - | 62 | 56561163 | 3189759 |
| Variable plasmid segment G1M1b09a03.r1 (Accession number NT_108246) | hypothetical protein BGP279 | 191 | 388 | - | 65 | 56561164 | 3189758 |
| Variable plasmid segment G1M1b09a03.r1 (Accession number NT_108246) | hypothetical protein BGP280 | 731 | 1276 | - | 181 | 56561165 | 3189756 |
| Variable plasmid segment G1M1b09a03.r1 (Accession number NT_108246) | hypothetical protein BGP281 | 1286 | 1594 | - | 102 | 56561166 | 3189755 |
| Variable plasmid segment G1M1b09a03.r1 (Accession number NT_108246) | hypothetical protein BGP282 | 1563 | 2039 | - | 158 | 56561167 | 3189757 |
| Variable plasmid segment G1a10e03.r1 (Accession number NT_108245) | hypothetical protein BGP277 | 1 | 72 | + | 23 | 56561152 | 3189745 |
| Variable plasmid segment G1a10e03.r1 (Accession | hypothetical protein BGP276 | 38 | 682 | - | 214 | 56561153 | 3189752 |

Fig. 29 continued

| | | | | | | | |
|---|---|---|---|---|---|---|---|
| number NT_108245) | | | | | | | |
| Variable plasmid segment G1a10e03.r1 (Accession number NT_108245) | hypothetical protein BGP275 | 1246 | 1410 | + | 54 | 56561154 | 3189749 |
| Variable plasmid segment G1a10e03.r1 (Accession number NT_108245) | hypothetical protein BGP274 | 1420 | 1548 | + | 42 | 56561155 | 3189747 |
| Variable plasmid segment G1a10e03.r1 (Accession number NT_108245) | hypothetical protein BGP273 | 2070 | 2186 | + | 38 | 56561156 | 3189754 |
| Variable plasmid segment G1a10e03.r1 (Accession number NT_108245) | hypothetical protein BGP272 | 2137 | 2280 | - | 47 | 56561157 | 3189750 |
| Variable plasmid segment G1a10e03.r1 (Accession number NT_108245) | hypothetical protein BGP271 | 2228 | 2662 | - | 144 | 56561158 | 3189753 |
| Variable plasmid segment G1a10e03.r1 (Accession number NT_108245) | hypothetical protein BGP270 | 2824 | 3306 | + | 160 | 56561159 | 3189746 |
| Variable plasmid segment G1a10e03.r1 (Accession number NT_108245) | hypothetical protein BGP269 | 3592 | 3798 | - | 68 | 56561160 | 3189748 |
| Variable plasmid segment G1a10e03.r1 (Accession number NT_108245) | hypothetical protein BGP268 | 3791 | 4050 | - | 85 | 56561161 | 3189751 |
| Variable plasmid segment G1Mb12b07.s1 (Accession | hypothetical protein BGP262 | 98 | 433 | + | 111 | 56561145 | 3189742 |

Fig. 29 continued

| | | | | | | | |
|---|---|---|---|---|---|---|---|
| number NT_108244) | | | | | | | |
| Variable plasmid segment G1Mb12b07.s1 (Accession number NT_108244) | hypothetical protein BGP263 | 417 | 1067 | + | 216 | 56561146 | 3189739 |
| Variable plasmid segment G1Mb12b07.s1 (Accession number NT_108244) | hypothetical protein BGP264 | 1356 | 1541 | - | 61 | 56561147 | 3189743 |
| Variable plasmid segment G1Mb12b07.s1 (Accession number NT_108244) | hypothetical protein BGP265 | 1959 | 2210 | + | 83 | 56561148 | 3189744 |
| Variable plasmid segment G1Mb12b07.s1 (Accession number NT_108244) | hypothetical protein BGP266 | 2367 | 2861 | + | 164 | 56561149 | 3189741 |
| Variable plasmid segment G1Mb12b07.s1 (Accession number NT_108244) | hypothetical protein BGP267 | 3835 | 4017 | - | 60 | 56561150 | 3189740 |
| Variable plasmid segment G1a25a05.r1 (Accession number NT_108243) | hypothetical protein BGP257 | 84 | 1193 | + | 369 | 56561139 | 3189737 |
| Variable plasmid segment G1a25a05.r1 (Accession number NT_108243) | hypothetical protein BGP258 | 1246 | 1671 | + | 141 | 56561140 | 3189738 |
| Variable plasmid segment G1a25a05.r1 (Accession number NT_108243) | hypothetical protein BGP259 | 1677 | 2453 | - | 258 | 56561141 | 3189734 |
| Variable plasmid segment G1a25a05.r1 (Accession | hypothetical protein BGP260 | 2885 | 3568 | + | 227 | 56561142 | 3189735 |

Fig. 29 continued

| | | | | | | | |
|---|---|---|---|---|---|---|---|
| number NT_108243) | | | | | | | |
| Variable plasmid segment G1a25a05.r1 (Accession number NT_108243) | hypothetical protein BGP261 | 3620 | 4649 | + | 343 | 56561143 | 3189736 |
| Variable plasmid segment G11a16g12.s1 (Accession number NT_108242) | hypothetical protein BGP253 | 3193 | 3768 | - | 191 | 56561134 | 3189731 |
| Variable plasmid segment G11a16g12.s1 (Accession number NT_108242) | hypothetical protein BGP254 | 3791 | 4549 | - | 252 | 56561135 | 3189730 |
| Variable plasmid segment G11a16g12.s1 (Accession number NT_108242) | hypothetical protein BGP255 | 4525 | 4821 | - | 98 | 56561136 | 3189733 |
| Variable plasmid segment G11a16g12.s1 (Accession number NT_108242) | hypothetical protein BGP256 | 5002 | 5088 | - | 28 | 56561137 | 3189732 |
| Variable plasmid segment G11a14a06.r1 (Accession number NT_108241) | hypothetical protein BGP247 | 242 | 322 | - | 26 | 56561127 | 3189726 |
| Variable plasmid segment G11a14a06.r1 (Accession number NT_108241) | hypothetical protein BGP248 | 1108 | 1905 | + | 265 | 56561128 | 3189724 |
| Variable plasmid segment G11a14a06.r1 (Accession number NT_108241) | hypothetical protein BGP249 | 2017 | 2244 | + | 75 | 56561129 | 3189728 |
| Variable plasmid segment G11a14a06.r1 (Accession | hypothetical protein BGP250 | 2989 | 3123 | - | 44 | 56561130 | 3189729 |

Fig. 29 continued

| | | | | | | | |
|---|---|---|---|---|---|---|---|
| number NT_108241) | | | | | | | |
| Variable plasmid segment G11a14a06.r1 (Accession number NT_108241) | hypothetical protein BGP251 | 3473 | 4315 | - | 280 | 56561131 | 3189725 |
| Variable plasmid segment G11a14a06.r1 (Accession number NT_108241) | hypothetical protein BGP252 | 5334 | 5558 | + | 74 | 56561132 | 3189727 |
| Variable plasmid segment G1Mb03b12.r1 (Accession number NT_108238) | hypothetical protein BGP223 | 236 | 3274 | + | 1012 | 56561100 | 3189703 |
| Variable plasmid segment G1Mb03b12.r1 (Accession number NT_108238) | hypothetical protein BGP224 | 3315 | 4643 | + | 442 | 56561101 | 3189700 |
| Variable plasmid segment G1Mb03b12.r1 (Accession number NT_108238) | hypothetical protein BGP225 | 4633 | 4965 | + | 110 | 56561102 | 3189701 |
| Variable plasmid segment G1Mb03b12.r1 (Accession number NT_108238) | hypothetical protein BGP226 | 4943 | 5982 | + | 347 | 56561103 | 3189702 |
| Variable plasmid segment G11a16d07.r1 (Accession number NT_108237) | hypothetical protein BGP216 | 108 | 1019 | + | 303 | 56561092 | 3189697 |
| Variable plasmid segment G11a16d07.r1 (Accession number NT_108237) | hypothetical protein BGP217 | 1029 | 1583 | + | 184 | 56561093 | 3189699 |
| Variable plasmid segment G11a16d07.r1 (Accession | hypothetical protein BGP218 | 1559 | 2311 | + | 250 | 56561094 | 3189694 |

Fig. 29 continued

| | | | | | | | |
|---|---|---|---|---|---|---|---|
| number NT_108237) | | | | | | | |
| Variable plasmid segment G11a16d07.r1 (Accession number NT_108237) | hypothetical protein BGP219 | 2370 | 2939 | + | 189 | 56561095 | 3189693 |
| Variable plasmid segment G11a16d07.r1 (Accession number NT_108237) | hypothetical protein BGP220 | 3806 | 4621 | - | 271 | 56561096 | 3189696 |
| Variable plasmid segment G11a16d07.r1 (Accession number NT_108237) | hypothetical protein BGP221 | 5841 | 5978 | - | 45 | 56561097 | 3189695 |
| Variable plasmid segment G11a16d07.r1 (Accession number NT_108237) | hypothetical protein BGP222 | 6089 | 6265 | - | 58 | 56561098 | 3189698 |
| Variable plasmid segment G1a09h07.r1 (Accession number NT_108236) | hypothetical protein BGP207 | 69 | 530 | - | 153 | 56561082 | 3189685 |
| Variable plasmid segment G1a09h07.r1 (Accession number NT_108236) | hypothetical protein BGP208 | 686 | 1012 | - | 108 | 56561083 | 3189688 |
| Variable plasmid segment G1a09h07.r1 (Accession number NT_108236) | hypothetical protein BGP209 | 1081 | 1257 | + | 58 | 56561084 | 3189686 |
| Variable plasmid segment G1a09h07.r1 (Accession number NT_108236) | hypothetical protein BGP210 | 1164 | 2117 | - | 317 | 56561085 | 3189687 |
| Variable plasmid segment G1a09h07.r1 (Accession | hypothetical protein BGP211 | 2345 | 2923 | + | 192 | 56561086 | 3189684 |

Fig. 29 continued

| | | | | | | | |
|---|---|---|---|---|---|---|---|
| number NT_108236) | | | | | | | |
| Variable plasmid segment G1a09h07.r1 (Accession number NT_108236) | hypothetical protein BGP212 | 3069 | 3752 | - | 227 | 56561087 | 3189690 |
| Variable plasmid segment G1a09h07.r1 (Accession number NT_108236) | hypothetical protein BGP213 | 4580 | 5242 | - | 220 | 56561088 | 3189689 |
| Variable plasmid segment G1a09h07.r1 (Accession number NT_108236) | hypothetical protein BGP214 | 6192 | 6932 | + | 246 | 56561089 | 3189691 |
| Variable plasmid segment G1a09h07.r1 (Accession number NT_108236) | hypothetical protein BGP215 | 6923 | 7198 | + | 91 | 56561090 | 3189692 |
| Variable plasmid segment G1a07d05.r1 (Accession number NT_108235) | hypothetical protein BGP195 | 41 | 181 | + | 46 | 56561069 | 3189677 |
| Variable plasmid segment G1a07d05.r1 (Accession number NT_108235) | hypothetical protein BGP196 | 181 | 303 | + | 40 | 56561070 | 3189678 |
| Variable plasmid segment G1a07d05.r1 (Accession number NT_108235) | hypothetical protein BGP197 | 506 | 778 | + | 90 | 56561071 | 3189685 |
| Variable plasmid segment G1a07d05.r1 (Accession number NT_108235) | hypothetical protein BGP198 | 726 | 953 | + | 75 | 56561072 | 3189675 |
| Variable plasmid segment G1a07d05.r1 (Accession | hypothetical protein BGP199 | 2140 | 5724 | - | 1194 | 56561073 | 3189683 |

Fig. 29 continued

| | | | | | | | |
|---|---|---|---|---|---|---|---|
| number NT_108235) | | | | | | | |
| Variable plasmid segment G1a07d05.r1 (Accession number NT_108235) | hypothetical protein BGP200 | 5840 | 6196 | - | 118 | 56561074 | 3190011 |
| Variable plasmid segment G1a07d05.r1 (Accession number NT_108235) | hypothetical protein BGP201 | 6141 | 6332 | - | 63 | 56561075 | 3189674 |
| Variable plasmid segment G1a07d05.r1 (Accession number NT_108235) | hypothetical protein BGP202 | 6811 | 7422 | - | 203 | 56561076 | 3189682 |
| Variable plasmid segment G1a07d05.r1 (Accession number NT_108235) | hypothetical protein BGP203 | 7403 | 7480 | - | 25 | 56561077 | 3189681 |
| Variable plasmid segment G1a07d05.r1 (Accession number NT_108235) | hypothetical protein BGP204 | 8141 | 8314 | - | 57 | 56561078 | 3189679 |
| Variable plasmid segment G1a07d05.r1 (Accession number NT_108235) | hypothetical protein BGP205 | 8337 | 8864 | + | 175 | 56561079 | 3189676 |
| Variable plasmid segment G1a07d05.r1 (Accession number NT_108235) | hypothetical protein BGP206 | 8857 | 9174 | + | 106 | 56561080 | 3189680 |
| Variable plasmid segment G1M1b07c12.s1 (Accession number NT_108234) | hypothetical protein BGP175 | 39 | 734 | + | 231 | 56561048 | 3189849 |
| Variable plasmid segment G1M1b07c12.s1 (Accession | hypothetical protein BGP176 | 1588 | 1974 | + | 128 | 56561049 | 3189864 |

Fig. 29 continued

| | | | | | | | |
|---|---|---|---|---|---|---|---|
| number NT_108234) | | | | | | | |
| Variable plasmid segment G1M1b07c12.s1 (Accession number NT_108234) | hypothetical protein BGP177 | 1971 | 2540 | + | 189 | 56561050 | 3189863 |
| Variable plasmid segment G1M1b07c12.s1 (Accession number NT_108234) | hypothetical protein BGP178 | 2521 | 2841 | + | 106 | 56561051 | 3189854 |
| Variable plasmid segment G1M1b07c12.s1 (Accession number NT_108234) | hypothetical protein BGP179 | 2870 | 3217 | + | 115 | 56561052 | 3189853 |
| Variable plasmid segment G1M1b07c12.s1 (Accession number NT_108234) | hypothetical protein BGP180 | 3241 | 3876 | + | 211 | 56561053 | 3189851 |
| Variable plasmid segment G1M1b07c12.s1 (Accession number NT_108234) | hypothetical protein BGP181 | 3880 | 4827 | + | 315 | 56561054 | 3189850 |
| Variable plasmid segment G1M1b07c12.s1 (Accession number NT_108234) | hypothetical protein BGP182 | 4839 | 5384 | + | 181 | 56561055 | 3189862 |
| Variable plasmid segment G1M1b07c12.s1 (Accession number NT_108234) | hypothetical protein BGP183 | 5414 | 5614 | + | 66 | 56561056 | 3189858 |
| Variable plasmid segment G1M1b07c12.s1 (Accession number NT_108234) | hypothetical protein BGP184 | 5745 | 6623 | + | 292 | 56561057 | 3189847 |
| Variable plasmid segment G1M1b07c12.s1 (Accession | hypothetical protein BGP185 | 6626 | 7225 | + | 199 | 56561058 | 3189856 |

Fig. 29 continued

| | | | | | | | |
|---|---|---|---|---|---|---|---|
| number NT_108234) | | | | | | | |
| Variable plasmid segment G1M1b07c12.s1 (Accession number NT_108234) | hypothetical protein BGP186 | 7242 | 7292 | + | 16 | 56561059 | 3189860 |
| Variable plasmid segment G1M1b07c12.s1 (Accession number NT_108234) | hypothetical protein BGP187 | 7302 | 8057 | + | 251 | 56561060 | 3189848 |
| Variable plasmid segment G1M1b07c12.s1 (Accession number NT_108234) | hypothetical protein BGP188 | 8132 | 8326 | + | 64 | 56561061 | 3189852 |
| Variable plasmid segment G1M1b07c12.s1 (Accession number NT_108234) | hypothetical protein BGP189 | 8330 | 8668 | + | 112 | 56561062 | 3189861 |
| Variable plasmid segment G1M1b07c12.s1 (Accession number NT_108234) | hypothetical protein BGP190 | 8668 | 9003 | + | 111 | 56561063 | 3189859 |
| Variable plasmid segment G1M1b07c12.s1 (Accession number NT_108234) | hypothetical protein BGP191 | 8996 | 9349 | + | 117 | 56561064 | 3189855 |
| Variable plasmid segment G1M1b07c12.s1 (Accession number NT_108234) | hypothetical protein BGP192 | 9546 | 10184 | + | 212 | 56561065 | 3189846 |
| Variable plasmid segment G1M1b07c12.s1 (Accession number NT_108234) | hypothetical protein BGP193 | 10287 | 11189 | - | 300 | 56561066 | 3189845 |
| Variable plasmid segment G1M1b07c12.s1 (Accession | hypothetical protein BGP194 | 11562 | 11868 | + | 102 | 56561067 | 3189857 |

Fig. 29 continued

| | | | | | | | |
|---|---|---|---|---|---|---|---|
| number NT_108234) | | | | | | | |
| Variable plasmid segment G11a15e03.s1 (Accession number NT_108233) | hypothetical protein BGP157 | 1 | 721 | - | 240 | 56561029 | 3189837 |
| Variable plasmid segment G11a15e03.s1 (Accession number NT_108233) | hypothetical protein BGP158 | 731 | 1336 | - | 201 | 56561030 | 3189844 |
| Variable plasmid segment G11a15e03.s1 (Accession number NT_108233) | hypothetical protein BGP159 | 1346 | 2221 | - | 291 | 56561031 | 3189830 |
| Variable plasmid segment G11a15e03.s1 (Accession number NT_108233) | hypothetical protein BGP160 | 2218 | 2550 | - | 110 | 56561032 | 3189836 |
| Variable plasmid segment G11a15e03.s1 (Accession number NT_108233) | hypothetical protein BGP161 | 2580 | 3125 | - | 181 | 56561033 | 3189842 |
| Variable plasmid segment G11a15e03.s1 (Accession number NT_108233) | hypothetical protein BGP162 | 3150 | 4091 | - | 313 | 56561034 | 3189835 |
| Variable plasmid segment G11a15e03.s1 (Accession number NT_108233) | hypothetical protein BGP163 | 4095 | 4778 | - | 227 | 56561035 | 3189839 |
| Variable plasmid segment G11a15e03.s1 (Accession number NT_108233) | hypothetical protein BGP164 | 4800 | 6110 | - | 436 | 56561036 | 3189838 |
| Variable plasmid segment G11a15e03.s1 (Accession | hypothetical protein BGP165 | 6118 | 6354 | - | 78 | 56561037 | 3189833 |

Fig. 29 continued

| | | | | | | | |
|---|---|---|---|---|---|---|---|
| number NT_108233) | | | | | | | |
| Variable plasmid segment G11a15e03.s1 (Accession number NT_108233) | hypothetical protein BGP166 | 6351 | 6806 | - | 151 | 56561038 | 3189827 |
| Variable plasmid segment G11a15e03.s1 (Accession number NT_108233) | hypothetical protein BGP167 | 6822 | 7151 | - | 109 | 56561039 | 3189828 |
| Variable plasmid segment G11a15e03.s1 (Accession number NT_108233) | hypothetical protein BGP168 | 7264 | 8376 | - | 370 | 56561040 | 3189841 |
| Variable plasmid segment G11a15e03.s1 (Accession number NT_108233) | hypothetical protein BGP169 | 8357 | 8926 | - | 189 | 56561041 | 3189834 |
| Variable plasmid segment G11a15e03.s1 (Accession number NT_108233) | hypothetical protein BGP170 | 8923 | 9312 | - | 129 | 56561042 | 3189832 |
| Variable plasmid segment G11a15e03.s1 (Accession number NT_108233) | hypothetical protein BGP171 | 9300 | 9683 | - | 127 | 56561043 | 3189829 |
| Variable plasmid segment G11a15e03.s1 (Accession number NT_108233) | hypothetical protein BGP172 | 9683 | 10138 | - | 151 | 56561044 | 3189843 |
| Variable plasmid segment G11a15e03.s1 (Accession number NT_108233) | hypothetical protein BGP173 | 10158 | 11117 | - | 319 | 56561045 | 3189831 |
| Variable plasmid segment G11a15e03.s1 (Accession | hypothetical protein BGP174 | 11139 | 11648 | - | 169 | 56561046 | 3189840 |

Fig. 29 continued

| | | | | | | | |
|---|---|---|---|---|---|---|---|
| number NT_108233) | | | | | | | |
| Variable plasmid segment G1M1b09g01.s1 (Accession number NT_108232) | hypothetical protein BGP338 | 1 | 306 | + | 101 | 56561002 | 3189814 |
| Variable plasmid segment G1M1b09g01.s1 (Accession number NT_108232) | hypothetical protein BGP132 | 383 | 646 | - | 87 | 56561003 | 3189812 |
| Variable plasmid segment G1M1b09g01.s1 (Accession number NT_108232) | hypothetical protein BGP133 | 726 | 980 | - | 84 | 56561004 | 3189806 |
| Variable plasmid segment G1M1b09g01.s1 (Accession number NT_108232) | hypothetical protein BGP134 | 1203 | 2081 | - | 292 | 56561005 | 3189817 |
| Variable plasmid segment G1M1b09g01.s1 (Accession number NT_108232) | hypothetical protein BGP135 | 2501 | 2617 | + | 38 | 56561006 | 3189821 |
| Variable plasmid segment G1M1b09g01.s1 (Accession number NT_108232) | hypothetical protein BGP136 | 3506 | 3682 | + | 58 | 56561007 | 3189825 |
| Variable plasmid segment G1M1b09g01.s1 (Accession number NT_108232) | hypothetical protein BGP137 | 3691 | 3897 | + | 68 | 56561008 | 3189803 |
| Variable plasmid segment G1M1b09g01.s1 (Accession number NT_108232) | hypothetical protein BGP138 | 4472 | 5548 | + | 358 | 56561009 | 3189801 |
| Variable plasmid segment G1M1b09g01.s1 (Accession | hypothetical protein BGP139 | 6229 | 6387 | + | 52 | 56561010 | 3189805 |

Fig. 29 continued

| | | | | | | | |
|---|---|---|---|---|---|---|---|
| number NT_108232) | | | | | | | |
| Variable plasmid segment G1M1b09g01.s1 (Accession number NT_108232) | hypothetical protein BGP140 | 6428 | 6529 | + | 33 | 56561011 | 3189807 |
| Variable plasmid segment G1M1b09g01.s1 (Accession number NT_108232) | hypothetical protein BGP141 | 6456 | 6905 | - | 149 | 56561012 | 3189804 |
| Variable plasmid segment G1M1b09g01.s1 (Accession number NT_108232) | hypothetical protein BGP142 | 6902 | 7105 | - | 67 | 56561013 | 3189816 |
| Variable plasmid segment G1M1b09g01.s1 (Accession number NT_108232) | hypothetical protein BGP143 | 7102 | 7434 | - | 110 | 56561014 | 3189813 |
| Variable plasmid segment G1M1b09g01.s1 (Accession number NT_108232) | hypothetical protein BGP144 | 7701 | 7937 | + | 78 | 56561015 | 3189802 |
| Variable plasmid segment G1M1b09g01.s1 (Accession number NT_108232) | hypothetical protein BGP145 | 8062 | 9087 | + | 341 | 56561016 | 3189820 |
| Variable plasmid segment G1M1b09g01.s1 (Accession number NT_108232) | hypothetical protein BGP146 | 9157 | 9294 | + | 45 | 56561017 | 3189810 |
| Variable plasmid segment G1M1b09g01.s1 (Accession number NT_108232) | hypothetical protein BGP147 | 9312 | 9443 | + | 43 | 56561018 | 3189811 |
| Variable plasmid segment G1M1b09g01.s1 (Accession | hypothetical protein BGP148 | 9584 | 9799 | + | 71 | 56561019 | 3189806 |

Fig. 29 continued

| | | | | | | | |
|---|---|---|---|---|---|---|---|
| number NT_108232) | | | | | | | |
| Variable plasmid segment G1M1b09g01.s1 (Accession number NT_108232) | hypothetical protein BGP149 | 9880 | 10008 | + | 42 | 56561020 | 3189826 |
| Variable plasmid segment G1M1b09g01.s1 (Accession number NT_108232) | hypothetical protein BGP150 | 10020 | 10112 | + | 30 | 56561021 | 3189823 |
| Variable plasmid segment G1M1b09g01.s1 (Accession number NT_108232) | hypothetical protein BGP151 | 10869 | 11063 | - | 64 | 56561022 | 3189809 |
| Variable plasmid segment G1M1b09g01.s1 (Accession number NT_108232) | hypothetical protein BGP152 | 11076 | 11501 | - | 141 | 56561023 | 3189819 |
| Variable plasmid segment G1M1b09g01.s1 (Accession number NT_108232) | hypothetical protein BGP153 | 11507 | 11836 | - | 109 | 56561024 | 3189818 |
| Variable plasmid segment G1M1b09g01.s1 (Accession number NT_108232) | hypothetical protein BGP154 | 12022 | 12168 | + | 48 | 56561025 | 3189824 |
| Variable plasmid segment G1M1b09g01.s1 (Accession number NT_108232) | hypothetical protein BGP155 | 12327 | 12728 | + | 133 | 56561026 | 3189822 |
| Variable plasmid segment G1M1b09g01.s1 (Accession number NT_108232) | hypothetical protein BGP156 | 12794 | 13081 | - | 95 | 56561027 | 3189815 |
| Variable plasmid segment G1a34h09.s1 (Accession | hypothetical protein BGP109 | 1 | 572 | - | 190 | 56560978 | 3189793 |

Fig. 29 continued

| | | | | | | | |
|---|---|---|---|---|---|---|---|
| number NT_108231) | | | | | | | |
| Variable plasmid segment G1a34h09.s1 (Accession number NT_108231) | hypothetical protein BGP110 | 683 | 1504 | - | 273 | 56560979 | 3189940 |
| Variable plasmid segment G1a34h09.s1 (Accession number NT_108231) | hypothetical protein BGP111 | 1563 | 1754 | - | 63 | 56560980 | 3189944 |
| Variable plasmid segment G1a34h09.s1 (Accession number NT_108231) | hypothetical protein BGP112 | 1736 | 2113 | - | 125 | 56560981 | 3189799 |
| Variable plasmid segment G1a34h09.s1 (Accession number NT_108231) | hypothetical protein BGP113 | 2269 | 2481 | - | 70 | 56560982 | 3189945 |
| Variable plasmid segment G1a34h09.s1 (Accession number NT_108231) | hypothetical protein BGP114 | 2548 | 3318 | + | 256 | 56560983 | 3189792 |
| Variable plasmid segment G1a34h09.s1 (Accession number NT_108231) | hypothetical protein BGP115 | 3329 | 3676 | + | 115 | 56560984 | 3189789 |
| Variable plasmid segment G1a34h09.s1 (Accession number NT_108231) | hypothetical protein BGP116 | 3673 | 4683 | + | 336 | 56560985 | 3189798 |
| Variable plasmid segment G1a34h09.s1 (Accession number NT_108231) | hypothetical protein BGP117 | 4680 | 4865 | + | 61 | 56560986 | 3189942 |
| Variable plasmid segment G1a34h09.s1 (Accession | hypothetical protein BGP118 | 4876 | 5073 | + | 65 | 56560987 | 3189790 |

Fig. 29 continued

| | | | | | | | |
|---|---|---|---|---|---|---|---|
| number NT_108231) | | | | | | | |
| Variable plasmid segment G1a34h09.s1 (Accession number NT_108231) | hypothetical protein BGP119 | 5127 | 5903 | + | 258 | 56560988 | 3189791 |
| Variable plasmid segment G1a34h09.s1 (Accession number NT_108231) | hypothetical protein BGP120 | 5940 | 6488 | + | 182 | 56560989 | 3189794 |
| Variable plasmid segment G1a34h09.s1 (Accession number NT_108231) | hypothetical protein BGP121 | 6489 | 6998 | + | 169 | 56560990 | 3189937 |
| Variable plasmid segment G1a34h09.s1 (Accession number NT_108231) | hypothetical protein BGP122 | 7034 | 7864 | + | 276 | 56560991 | 3189800 |
| Variable plasmid segment G1a34h09.s1 (Accession number NT_108231) | hypothetical protein BGP123 | 7880 | 8218 | + | 112 | 56560992 | 3189946 |
| Variable plasmid segment G1a34h09.s1 (Accession number NT_108231) | hypothetical protein BGP124 | 8234 | 8626 | + | 130 | 56560993 | 3189943 |
| Variable plasmid segment G1a34h09.s1 (Accession number NT_108231) | hypothetical protein BGP125 | 8623 | 9066 | + | 147 | 56560994 | 3189796 |
| Variable plasmid segment G1a34h09.s1 (Accession number NT_108231) | hypothetical protein BGP126 | 9056 | 9874 | + | 272 | 56560995 | 3189939 |
| Variable plasmid segment G1a34h09.s1 (Accession | hypothetical protein BGP127 | 9884 | 10312 | + | 142 | 56560996 | 3189938 |

Fig. 29 continued

| | | | | | | | |
|---|---|---|---|---|---|---|---|
| number NT_108231) | | | | | | | |
| Variable plasmid segment G1a34h09.s1 (Accession number NT_108231) | hypothetical protein BGP128 | 10402 | 10599 | + | 65 | 56560997 | 3189936 |
| Variable plasmid segment G1a34h09.s1 (Accession number NT_108231) | hypothetical protein BGP129 | 10596 | 12584 | + | 662 | 56560998 | 3189941 |
| Variable plasmid segment G1a34h09.s1 (Accession number NT_108231) | hypothetical protein BGP130 | 12644 | 13846 | + | 400 | 56560999 | 3189797 |
| Variable plasmid segment G1a34h09.s1 (Accession number NT_108231) | hypothetical protein BGP131 | 14167 | 14531 | + | 121 | 56561000 | 3189795 |
| Variable plasmid segment G1a08d08.s1 (Accession number NT_108230) | hypothetical protein BGP085 | 117 | 590 | - | 157 | 56560953 | 3189927 |
| Variable plasmid segment G1a08d08.s1 (Accession number NT_108230) | hypothetical protein BGP086 | 916 | 1065 | - | 49 | 56560954 | 3189931 |
| Variable plasmid segment G1a08d08.s1 (Accession number NT_108230) | hypothetical protein BGP087 | 1076 | 1807 | - | 243 | 56560955 | 3189921 |
| Variable plasmid segment G1a08d08.s1 (Accession number NT_108230) | hypothetical protein BGP088 | 2048 | 3022 | + | 324 | 56560956 | 3189925 |
| Variable plasmid segment G1a08d08.s1 (Accession | hypothetical protein BGP089 | 3398 | 3535 | + | 45 | 56560957 | 3189920 |

Fig. 29 continued

| | | | | | | | |
|---|---|---|---|---|---|---|---|
| number NT_108230) | | | | | | | |
| Variable plasmid segment G1a08d08.s1 (Accession number NT_108230) | hypothetical protein BGP090 | 3453 | 3644 | - | 63 | 56560958 | 3189923 |
| Variable plasmid segment G1a08d08.s1 (Accession number NT_108230) | hypothetical protein BGP091 | 3664 | 3849 | + | 61 | 56560959 | 3189913 |
| Variable plasmid segment G1a08d08.s1 (Accession number NT_108230) | hypothetical protein BGP092 | 3926 | 4060 | - | 44 | 56560960 | 3189928 |
| Variable plasmid segment G1a08d08.s1 (Accession number NT_108230) | hypothetical protein BGP093 | 4358 | 4960 | + | 200 | 56560961 | 3189933 |
| Variable plasmid segment G1a08d08.s1 (Accession number NT_108230) | hypothetical protein BGP094 | 5333 | 5482 | - | 49 | 56560962 | 3189915 |
| Variable plasmid segment G1a08d08.s1 (Accession number NT_108230) | hypothetical protein BGP095 | 5569 | 5709 | - | 46 | 56560963 | 3189929 |
| Variable plasmid segment G1a08d08.s1 (Accession number NT_108230) | hypothetical protein BGP096 | 5773 | 6714 | + | 313 | 56560964 | 3189922 |
| Variable plasmid segment G1a08d08.s1 (Accession number NT_108230) | hypothetical protein BGP097 | 7435 | 7521 | - | 28 | 56560965 | 3189926 |
| Variable plasmid segment G1a08d08.s1 (Accession | hypothetical protein BGP098 | 7737 | 7904 | + | 55 | 56560966 | 3189935 |

Fig. 29 continued

| | | | | | | | |
|---|---|---|---|---|---|---|---|
| number NT_108230) | | | | | | | |
| Variable plasmid segment G1a08d08.s1 (Accession number NT_108230) | hypothetical protein BGP099 | 8066 | 8536 | + | 156 | 56560967 | 3189918 |
| Variable plasmid segment G1a08d08.s1 (Accession number NT_108230) | hypothetical protein BGP100 | 9297 | 10361 | + | 354 | 56560968 | 3189934 |
| Variable plasmid segment G1a08d08.s1 (Accession number NT_108230) | hypothetical protein BGP101 | 10715 | 10783 | - | 22 | 56560969 | 3189932 |
| Variable plasmid segment G1a08d08.s1 (Accession number NT_108230) | hypothetical protein BGP102 | 11124 | 11264 | - | 46 | 56560970 | 3189912 |
| Variable plasmid segment G1a08d08.s1 (Accession number NT_108230) | hypothetical protein BGP103 | 11266 | 11451 | - | 61 | 56560971 | 3189919 |
| Variable plasmid segment G1a08d08.s1 (Accession number NT_108230) | hypothetical protein BGP104 | 11475 | 11837 | - | 120 | 56560972 | 3189930 |
| Variable plasmid segment G1a08d08.s1 (Accession number NT_108230) | hypothetical protein BGP105 | 12397 | 12570 | + | 57 | 56560973 | 3189917 |
| Variable plasmid segment G1a08d08.s1 (Accession number NT_108230) | hypothetical protein BGP106 | 12967 | 13152 | + | 61 | 56560974 | 3189924 |
| Variable plasmid segment G1a08d08.s1 (Accession | hypothetical protein BGP107 | 13796 | 14089 | + | 97 | 56560975 | 3189916 |

Fig. 29 continued

| | | | | | | | |
|---|---|---|---|---|---|---|---|
| number NT_108230) | | | | | | | |
| Variable plasmid segment G1a08d08.s1 (Accession number NT_108230) | hypothetical protein BGP108 | 15520 | 16067 | - | 181 | 56560976 | 3189914 |
| Variable plasmid segment G1M1b13a11.r1 (Accession number NT_108229) | hypothetical protein BGP056 | 56 | 478 | + | 140 | 56560923 | 3189894 |
| Variable plasmid segment G1M1b13a11.r1 (Accession number NT_108229) | hypothetical protein BGP057 | 495 | 1190 | + | 231 | 56560924 | 3189906 |
| Variable plasmid segment G1M1b13a11.r1 (Accession number NT_108229) | hypothetical protein BGP058 | 1202 | 1765 | + | 187 | 56560925 | 3189910 |
| Variable plasmid segment G1M1b13a11.r1 (Accession number NT_108229) | hypothetical protein BGP059 | 1785 | 2744 | + | 319 | 56560926 | 3189907 |
| Variable plasmid segment G1M1b13a11.r1 (Accession number NT_108229) | hypothetical protein BGP060 | 2763 | 3215 | + | 150 | 56560927 | 3189889 |
| Variable plasmid segment G1M1b13a11.r1 (Accession number NT_108229) | hypothetical protein BGP061 | 3215 | 3598 | + | 127 | 56560928 | 3189902 |
| Variable plasmid segment G1M1b13a11.r1 (Accession number NT_108229) | hypothetical protein BGP062 | 3586 | 3972 | + | 128 | 56560929 | 3189898 |
| Variable plasmid segment G1M1b13a11.r1 (Accession | hypothetical protein BGP063 | 3975 | 4538 | + | 187 | 56560930 | 3189890 |

Fig. 29 continued

| | | | | | | | |
|---|---|---|---|---|---|---|---|
| number NT_108229) | | | | | | | |
| Variable plasmid segment G1M1b13a11.r1 (Accession number NT_108229) | hypothetical protein BGP064 | 4519 | 5640 | + | 373 | 56560931 | 3189911 |
| Variable plasmid segment G1M1b13a11.r1 (Accession number NT_108229) | hypothetical protein BGP065 | 5654 | 6082 | + | 142 | 56560932 | 3189900 |
| Variable plasmid segment G1M1b13a11.r1 (Accession number NT_108229) | hypothetical protein BGP066 | 6098 | 6553 | + | 151 | 56560933 | 3189909 |
| Variable plasmid segment G1M1b13a11.r1 (Accession number NT_108229) | hypothetical protein BGP067 | 6550 | 6786 | + | 78 | 56560934 | 3189896 |
| Variable plasmid segment G1M1b13a11.r1 (Accession number NT_108229) | hypothetical protein BGP068 | 6794 | 7042 | + | 82 | 56560935 | 3189908 |
| Variable plasmid segment G1M1b13a11.r1 (Accession number NT_108229) | hypothetical protein BGP069 | 7096 | 7875 | + | 259 | 56560936 | 3189888 |
| Variable plasmid segment G1M1b13a11.r1 (Accession number NT_108229) | hypothetical protein BGP070 | 7888 | 8076 | - | 62 | 56560937 | 3189891 |
| Variable plasmid segment G1M1b13a11.r1 (Accession number NT_108229) | hypothetical protein BGP071 | 8110 | 8796 | + | 228 | 56560938 | 3189883 |
| Variable plasmid segment G1M1b13a11.r1 (Accession | hypothetical protein BGP072 | 8800 | 9789 | + | 329 | 56560939 | 3189886 |

Fig. 29 continued

| | | | | | | | |
|---|---|---|---|---|---|---|---|
| number NT_108229) | | | | | | | |
| Variable plasmid segment G1M1b13a11.r1 (Accession number NT_108229) | hypothetical protein BGP073 | 9786 | 10331 | + | 181 | 56560940 | 3189884 |
| Variable plasmid segment G1M1b13a11.r1 (Accession number NT_108229) | hypothetical protein BGP074 | 10361 | 10693 | + | 110 | 56560941 | 3189892 |
| Variable plasmid segment G1M1b13a11.r1 (Accession number NT_108229) | hypothetical protein BGP075 | 10690 | 11568 | + | 292 | 56560942 | 3189904 |
| Variable plasmid segment G1M1b13a11.r1 (Accession number NT_108229) | hypothetical protein BGP076 | 11573 | 12175 | + | 200 | 56560943 | 3189903 |
| Variable plasmid segment G1M1b13a11.r1 (Accession number NT_108229) | hypothetical protein BGP077 | 12185 | 12997 | + | 270 | 56560944 | 3189895 |
| Variable plasmid segment G1M1b13a11.r1 (Accession number NT_108229) | hypothetical protein BGP078 | 13070 | 13267 | + | 65 | 56560945 | 3189893 |
| Variable plasmid segment G1M1b13a11.r1 (Accession number NT_108229) | hypothetical protein BGP079 | 12271 | 13507 | + | 78 | 56560946 | 3189901 |
| Variable plasmid segment G1M1b13a11.r1 (Accession number NT_108229) | hypothetical protein BGP080 | 13608 | 13943 | + | 111 | 56560947 | 3189897 |
| Variable plasmid segment G1M1b13a11.r1 (Accession | hypothetical protein BGP081 | 13936 | 14289 | + | 117 | 56560948 | 3189885 |

Fig. 29 continued

| | | | | | | | |
|---|---|---|---|---|---|---|---|
| number NT_108229) | | | | | | | |
| Variable plasmid segment G1M1b13a11.r1 (Accession number NT_108229) | hypothetical protein BGP082 | 14542 | 14976 | + | 144 | 56560949 | 3189905 |
| Variable plasmid segment G1M1b13a11.r1 (Accession number NT_108229) | hypothetical protein BGP083 | 14998 | 15426 | + | 142 | 56560950 | 3189899 |
| Variable plasmid segment G1M1b13a11.r1 (Accession number NT_108229) | hypothetical protein BGP084 | 15467 | 16033 | - | 188 | 56560951 | 3189887 |
| Variable plasmid segment G11a17h03.s1 (Accession number NT_108228) | hypothetical protein BGP033 | 360 | 458 | - | 32 | 56560899 | 3189874 |
| Variable plasmid segment G11a17h03.s1 (Accession number NT_108228) | hypothetical protein BGP034 | 680 | 853 | - | 57 | 56560900 | 3189867 |
| Variable plasmid segment G11a17h03.s1 (Accession number NT_108228) | hypothetical protein BGP035 | 1425 | 2240 | - | 271 | 56560901 | 3189773 |
| Variable plasmid segment G11a17h03.s1 (Accession number NT_108228) | hypothetical protein BGP036 | 2594 | 3760 | + | 388 | 56560902 | 3189873 |
| Variable plasmid segment G11a17h03.s1 (Accession number NT_108228) | hypothetical protein BGP037 | 5389 | 5583 | - | 64 | 56560903 | 3189878 |
| Variable plasmid segment G11a17h03.s1 (Accession | hypothetical protein BGP038 | 5974 | 6075 | - | 33 | 56560904 | 3189880 |

Fig. 29 continued

| | | | | | | | |
|---|---|---|---|---|---|---|---|
| number NT_108228) | | | | | | | |
| Variable plasmid segment G11a17h03.s1 (Accession number NT_108228) | hypothetical protein BGP039 | 6075 | 6530 | - | 151 | 56560905 | 3189882 |
| Variable plasmid segment G11a17h03.s1 (Accession number NT_108228) | hypothetical protein BGP040 | 6549 | 7508 | - | 319 | 56560906 | 3189878 |
| Variable plasmid segment G11a17h03.s1 (Accession number NT_108228) | hypothetical protein BGP041 | 7530 | 8099 | - | 189 | 56560907 | 3189777 |
| Variable plasmid segment G11a17h03.s1 (Accession number NT_108228) | hypothetical protein BGP042 | 8114 | 8684 | - | 256 | 56560908 | 3189875 |
| Variable plasmid segment G11a17h03.s1 (Accession number NT_108228) | hypothetical protein BGP043 | 8892 | 9449 | - | 185 | 56560909 | 3189775 |
| Variable plasmid segment G11a17h03.s1 (Accession number NT_108228) | hypothetical protein BGP044 | 9461 | 10150 | - | 229 | 56560910 | 3189879 |
| Variable plasmid segment G11a17h03.s1 (Accession number NT_108228) | hypothetical protein BGP045 | 10167 | 11390 | - | 407 | 56560911 | 3189871 |
| Variable plasmid segment G11a17h03.s1 (Accession number NT_108228) | hypothetical protein BGP046 | 11458 | 12808 | - | 450 | 56560912 | 3189869 |
| Variable plasmid segment G11a17h03.s1 (Accession | hypothetical protein BGP047 | 12805 | 13371 | - | 188 | 56560913 | 3189881 |

Fig. 29 continued

| | | | | | | | |
|---|---|---|---|---|---|---|---|
| number NT_108228) | | | | | | | |
| Variable plasmid segment G11a17h03.s1 (Accession number NT_108228) | hypothetical protein BGP048 | 13586 | 13831 | + | 81 | 56560914 | 3189866 |
| Variable plasmid segment G11a17h03.s1 (Accession number NT_108228) | hypothetical protein BGP049 | 13930 | 14991 | - | 353 | 56560915 | 3189872 |
| Variable plasmid segment G11a17h03.s1 (Accession number NT_108228) | hypothetical protein BGP050 | 15429 | 15635 | + | 68 | 56560916 | 3189870 |
| Variable plasmid segment G11a17h03.s1 (Accession number NT_108228) | hypothetical protein BGP051 | 15713 | 16204 | + | 163 | 56560917 | 3189877 |
| Variable plasmid segment G11a17h03.s1 (Accession number NT_108228) | hypothetical protein BGP052 | 16210 | 16635 | - | 141 | 56560918 | 3190010 |
| Variable plasmid segment G11a17h03.s1 (Accession number NT_108228) | hypothetical protein BGP053 | 16693 | 16872 | - | 59 | 56560919 | 3189776 |
| Variable plasmid segment G11a17h03.s1 (Accession number NT_108228) | hypothetical protein BGP054 | 16854 | 16970 | - | 38 | 56560920 | 3189774 |
| Variable plasmid segment G11a17h03.s1 (Accession number NT_108228) | hypothetical protein BGP055 | 17191 | 17640 | - | 149 | 56560921 | 3189868 |
| Variable plasmid segment G1a19d06.s1 (Accession | hypothetical protein BGP001 | 427 | 1122 | - | 231 | 56560866 | 3189995 |

Fig. 29 continued

| | | | | | | | |
|---|---|---|---|---|---|---|---|
| number NT_108227) | | | | | | | |
| Variable plasmid segment Gla19d06.s1 (Accession number NT_108227) | hypothetical protein BGP002 | 1181 | 1732 | - | 183 | 56560867 | 3190009 |
| Variable plasmid segment Gla19d06.s1 (Accession number NT_108227) | hypothetical protein BGP003 | 1872 | 2129 | - | 85 | 56560868 | 3189991 |
| Variable plasmid segment Gla19d06.s1 (Accession number NT_108227) | hypothetical protein BGP004 | 2192 | 2353 | + | 53 | 56560869 | 3189765 |
| Variable plasmid segment Gla19d06.s1 (Accession number NT_108227) | hypothetical protein BGP005 | 2350 | 2445 | - | 31 | 56560870 | 3189993 |
| Variable plasmid segment Gla19d06.s1 (Accession number NT_108227) | hypothetical protein BGP006 | 2442 | 3857 | - | 471 | 56560871 | 3189992 |
| Variable plasmid segment Gla19d06.s1 (Accession number NT_108227) | hypothetical protein BGP007 | 3981 | 4133 | + | 50 | 56560872 | 3189772 |
| Variable plasmid segment Gla19d06.s1 (Accession number NT_108227) | hypothetical protein BGP008 | 4232 | 4645 | + | 137 | 56560873 | 3189996 |
| Variable plasmid segment Gla19d06.s1 (Accession number NT_108227) | hypothetical protein BGP009 | 4638 | 5330 | + | 230 | 56560874 | 3189990 |
| Variable plasmid segment Gla19d06.s1 (Accession | hypothetical protein BGP010 | 5330 | 5701 | + | 123 | 56560875 | 3189947 |

Fig. 29 continued

| | | | | | | | |
|---|---|---|---|---|---|---|---|
| number NT_108227) | | | | | | | |
| Variable plasmid segment Gla19d06.s1 (Accession number NT_108227) | hypothetical protein BGP011 | 5704 | 6090 | + | 128 | 56560876 | 3189988 |
| Variable plasmid segment Gla19d06.s1 (Accession number NT_108227) | hypothetical protein BGP012 | 6102 | 8726 | + | 874 | 56560877 | 3189989 |
| Variable plasmid segment Gla19d06.s1 (Accession number NT_108227) | hypothetical protein BGP013 | 8727 | 9509 | + | 260 | 56560878 | 3190001 |
| Variable plasmid segment Gla19d06.s1 (Accession number NT_108227) | hypothetical protein BGP014 | 9522 | 10292 | + | 256 | 56560879 | 3189770 |
| Variable plasmid segment Gla19d06.s1 (Accession number NT_108227) | hypothetical protein BGP015 | 10303 | 10650 | + | 115 | 56560880 | 3189768 |
| Variable plasmid segment Gla19d06.s1 (Accession number NT_108227) | hypothetical protein BGP016 | 10647 | 11837 | + | 396 | 56560881 | 3190004 |
| Variable plasmid segment Gla19d06.s1 (Accession number NT_108227) | hypothetical protein BGP017 | 11849 | 12877 | + | 342 | 56560882 | 3189997 |
| Variable plasmid segment Gla19d06.s1 (Accession number NT_108227) | hypothetical protein BGP018 | 12911 | 13459 | + | 182 | 56560883 | 3189769 |
| Variable plasmid segment Gla19d06.s1 (Accession | hypothetical protein BGP019 | 13460 | 13969 | + | 169 | 56560884 | 3189998 |

Fig. 29 continued

| | | | | | | | |
|---|---|---|---|---|---|---|---|
| number NT_108227) | | | | | | | |
| Variable plasmid segment Gla19d06.s1 (Accession number NT_108227) | hypothetical protein BGP020 | 14005 | 14835 | + | 276 | 56560885 | 3189999 |
| Variable plasmid segment Gla19d06.s1 (Accession number NT_108227) | hypothetical protein BGP021 | 14851 | 15189 | + | 112 | 56560886 | 3190002 |
| Variable plasmid segment Gla19d06.s1 (Accession number NT_108227) | hypothetical protein BGP022 | 15205 | 15597 | + | 130 | 56560887 | 3190007 |
| Variable plasmid segment Gla19d06.s1 (Accession number NT_108227) | hypothetical protein BGP023 | 15594 | 16037 | + | 147 | 56560888 | 3190005 |
| Variable plasmid segment Gla19d06.s1 (Accession number NT_108227) | hypothetical protein BGP024 | 16027 | 16845 | + | 272 | 56560889 | 3189771 |
| Variable plasmid segment Gla19d06.s1 (Accession number NT_108227) | hypothetical protein BGP025 | 16855 | 17283 | + | 142 | 56560890 | 3189994 |
| Variable plasmid segment Gla19d06.s1 (Accession number NT_108227) | hypothetical protein BGP026 | 17373 | 17570 | + | 65 | 56560891 | 3189766 |
| Variable plasmid segment Gla19d06.s1 (Accession number NT_108227) | hypothetical protein BGP027 | 17567 | 20812 | + | 1081 | 56560892 | 3189767 |
| Variable plasmid segment Gla19d06.s1 (Accession | hypothetical protein BGP028 | 21133 | 22245 | + | 370 | 56560893 | 3190003 |

| | | | | | | | |
|---|---|---|---|---|---|---|---|
| number NT_108227) | | | | | | | |
| Variable plasmid segment Gla19d06.s1 (Accession number NT_108227) | hypothetical protein BGP029 | 22199 | 22252 | + | 17 | 56560894 | 3189764 |
| Variable plasmid segment Gla19d06.s1 (Accession number NT_108227) | hypothetical protein BGP030 | 22255 | 22815 | + | 186 | 56560895 | 3190006 |
| Variable plasmid segment Gla19d06.s1 (Accession number NT_108227) | hypothetical protein BGP031 | 22791 | 23555 | + | 254 | 56560896 | 3190008 |
| Variable plasmid segment Gla19d06.s1 (Accession number NT_108227) | hypothetical protein BGP032 | 23897 | 24163 | + | 88 | 56560897 | 3190000 |

| Antigen designation | Amino acid sequence |
|---|---|
| NP_212517.1 Basic membrane protein A (bmpA) [Borrelia burgdorferi B31 SEQ ID NO 1 | MNKILLLILLESIVFLSCSGKGSLGSEIPKVSLIIDGTFDDKSFNESALNGVKKVKEEFK IELVLKESSSSNSYLSDLEGLKDAGSDLIWLIGYRFSDVAKVAALQNPDMKYAIIDPIYS NDPIPANLVGMTFRAQEGAFLTGYIAAKLSKTGKIGFLGGIEGEIVDAFRYGYEAGAK YANKDIKISTQYIGSFADLEAGRSVATRMYSDEIDIIHHAAGLGGIGAIEVAKELGSGH YIIGVDEDQAYLAPDNVITSTTKDVGRALNIFTSNHLKTNTFEGGKLINYGLKEGVVG FVRNPKMISFELEKEIDNLSSKIINKEIIVPSNKESYEKFLKEFI |
| NP_212516.1 Basic membrane protein B (bmpB) [Borrelia burgdorferi B31 SEQ ID NO 2 | MRIVIFIFGILLTSCFSRNGIESSSKKIKISMLVDGVLDDKSFNSSANEALLRLKKDFPE NIEEVFSCAISGVYSSYVSDLDNLKRNGSDLIWLVGYMLTDASLLVSSENPKISYGII DPIYGDDVQIPENLIAVVFRVEQGAFLAGYIAAKKSFSGKIGFIGGMKGNIVDAFRYG YESGAKYANKDIEIISEYSNSFSDVDIGRTIASKMYSKGIDVIHFAAGLAGIGVIETAKN LGDGYYVIGADQDQSYLAPKNFITSVIKNIGDALYLITGEYIKNNNVWEGGKVVQMG LRDGVIGLPNANEFEYIKVLERKIINKEIIVPCNQEEYEIFIKQILKL |
| NP_212518.1 Basic membrane protein C (bmpC) [Borrelia burgdorferi B31 SEQ ID NO 3 | MFKRFIFITLSLLVFACFKSNKKSIKSDKVVVGVLAHGSFYDKGYNQSVHDGVVKLR DNFGIKLITKSLRPYPIEGKRLLTVDEAMTEDAYEVQKNPLNLFWLIGYRFSDLSVKL SYERPDIYYGIIDAFDYGDIQVPKNSLAIKFRNEEAAFLAGYIAAKMSRKEKIGFLTGP MSEHVKDFKFGFKAGIFYANPKLRLVSKKAPSLFDKEKGKAMALFMYKEDKVGVIF PIAGITGLGVYDAAKELGPKYYVIGLNQDQSYIAPQNVITSIIKDIGKVIYSISSEYINNR VFKGGIIIDRGLKEGVIEIVKDPDVLNNRLVDEVIDLENKIISGEIIVPDSEYAFDLFKSK L |
| NP_212519.1B Basic membrane protein D (bmpD) [Borrelia burgdorferi B31 SEQ ID NO 4 | MDNYYEIYFLYFFIKSKEDIFMLKKVYYFLIFLFIVACSSSDDGKSEAKTVSLIVDGAF DDKGFNESSSKAIRKLKADLNINIIEKASTGNSYLGDIANLEDGNSNLIWGIGFRLSDI LFQRASENVSVNYAIIEGVYDEIQIPKNLLNISFRSEEVAFLAGYFASKASKTGKIGFV GGVRGKVLESFMYGYEAGAKYANSNIKVVSQYVGTFGDFGLGRSTASNMYRDGV DIIFAAAGLSGIGVIEAAKELGPDHYIIGVDQDQSYLAPNNVIVSAVKKVDSLMYSLTK KYLETGVLDGGKTMFLGLKEDGLGLVLNENLKSNYSEIYNKSLKIGQSIMNGIIKVPY DKVSYFVLQMEN |
| AAC70056.1 Decorin binding protein A; DbpA [Borrelia afzelii SEQ ID NO 5 | MIKYNKIILTLTLLASLLAACSLTGKARLESSVKDITNEIEKAIKEAEDAGVKTDAFTET QTGGKVGGSQIRAAKIRVADLTIKFLEATEEETITFKENGAGEEDFSGIYDLILNAAKA VEKIGMQGMKQAVEEAAKEKPKTTADGIIAIVKVMKAKVENIKEKQTKNQK |
| AAC70057.1 Decorin binding protein A; DbpA [Borrelia garinii] SEQ ID NO 6 | MIKYNKILLKLSLIVSLLVACGLTGETKIRLESSAQEIKDEINKIKANAKKEGVKFEAFT NTQTGSKISEKPEFILKAKIKAIQVAERFVKAIKEEAEKLKKSGSSGAFSAMYDLMIDV SKPLEEIGIQKMTGTVTKEAEKTPPTTADGIIAIAQAMEEKLNNVNKKQHDALKNLEE KANTAATTT |
| AAC70021.1 Decorin binding protein B; DbpB [Borrelia burgdorferi] SEQ ID NO 7 | SIVIALFFKLLVACSIGLVERTNAALESSSKDLKNKILKIKKEATGKGVLFEAFTGLKTG SKVTSGGLALREAKVQAIVETGKFLKIIEEEALKLKETGNSGQFLAMFDLMLEVVESL EDVGIIGLKARVLEESKNNPINTAERLLAAKAQIENQLKVVKEKQNIENGGEKKNNKS KKKK |
| NP_212694.1 Heat shock protein 90 [Borrelia burgdorferi B31] SEQ ID NO 8 | MILIFYFKQIALFIIFRLCYIIKKVKIKLKRKSCMKKQFDTEVNDLLYLIIHSLYSHKEIFLR ELISNASDAIDKLKFLSLTNEKFKNIALEPKIEISFDDKSILIKDNGIGMDEQDLTNHLG VIAKSGTKEFINNLKQDEKKSASLIGQFGVGFYSAFIVSEKVEVTSKKALESDAYIWS SDGKTGYEIEKAKKEESGTEIKLYLNKEGLEYANKWKIQEIIKKYSNHINYPIYIKYSE PIMKDGKQEGIEEKEEKLNETTALWTKNKSEIKAEEYNEFYKNTTFDYENPLMHIHT KAEGNLEYTNLFYVPSKAPYDLYYPNTKPGVKLFINRIFITDSEGSLLPNYLRFIKGIID CQDLPLNVSREILQQNKILSKIKSSSVKKILSELEKLSKKNPEKFSEFSKEFGRCIKEG VYSDFENREKLISLIRFKSSSVDGFVSFKEYKERMNESQKSIYYITGGKENILKENPIV AAYKEKGFEILIMDDELDEAILNLIPEYEGLKLKAINKNETSNELKDENFKKIEEEFKDT LTKVKEILKDHIKEVNLSATLIKEPSAIIIDSNDPTYQMQKIMLSMGQEVKEIKPILELNP |

| | NNKIVQNLKNLEPEKLEKISILLFEEAMLTSGMPSKNPGKFINIINEFIEKDFL |
|---|---|
| CAA44492.1\| Outer surface protein A [Borrelia burgdorferi] SEQ ID NO 9 | MKKYLLGIGLILALIACKQNVSTLDEKNSVSVDLPGGMTELVSKEKDKDGKYSLEAT VDKLELKGTSDKNNGSGTLEGEKTDKSKVKLTIADDLSQTKFEIFKEDAKTLVSKKV TLKDKSSTEEKFNEKGETSEKTIVRANGTRLEYTDIKSDGSGKAKEVLKDFTLEGTL AADGKTTLKVTEGTVVLSKNILKSGEITVALDDSDTTQATKKTGKWDSKTSTLTISVN SQKTKNLVFTKEDTITVQKYDSAGTNLEGKAVEITTLKELKNALK |
| BAA22351.1\| Outer surface protein B [Borrelia garinii] SEQ ID NO 10 | MKKYLLGFALVLALIACGQKGAEPKHNDQEVEDSKKDQKDASKKDLPVTEDTVKL FNDTKIFISKEKNKDGKYELRATVDTVELKGVADKNDGSGGKLEGVKSDQSKVTMS ITDDLNTITVETYDSSNTKVASKVFKKQGSLTEETEETYKTGKLSTKKITRTNGTTLE YSDMTNDENATKAVETLKNGIMLEGNLVGGKTSVEIKEGTVTLKKEIEKAGTVKLFL DDTSSGSTKKTAVWSDTSNTLTVSADSKKIKDFVFLTDGTITVQNYDTAGTKLAGTA TEIKDLEALKAALK |
| AAM22469.1\| Outer surface protein C [Borrelia afzelii] SEQ ID NO 11 | MKKNTLSAILMTLFLFISCNNSGKGGDSASTNPADESAKGPNLTEISKKITDSNAFVL AVKEVETLVSSIDELANKAIGKKIQQNGLGAEANRNESLLAGVHEISTLITEKLSKLKN SGELKAKIEDAKKCSEEFTNKLRVSHADLGKQGVNDDDAKKAILKTNADKTKGAEE LGKLFKSVEGLVKAAQEALTNSVKELTSPVVAESPKKP |
| AAC62927.1\| OspE-related lipoprotein [Borrelia garinii] SEQ ID NO 12 | MNKKMKMFIICAVFVLISSCGNFRSSLSDQGSLSDQGSLSDQGSLSDQGGLSGQA SSDTIKFSEFTVNIKNKKDNNGDWSNLGTLVIRKEQDGVETGLNVIGTINGQLRGHS ATFFCIEEAEVNNFVKAMTNVGSFKTSLYYGYKEEQSSTNGIKGKEITTKIETINNSE HITFSGDKI |
| CAA57806.1\| Outer surface protein G [Borrelia burgdorferi] SEQ ID NO 13 | MNKKMKNLIICAVFVLIISCKIDASSEDLKQNVKEKVEGFLDKELMQGDDPNNSLFNP PPVLPASSHDNTPVLKAVQAKDGGQQEGKEEKEKEIQELKDKIDKRKKELEEARKK FQEFKEQVESATGESTEKVKKQGNIGQKALKYAKELGVNGSYSVNDGTNTNDFVK KVIDDALKNIEEELEKLAEPQNIEDKK |
| AAC44770.1\| FlaA protein (Borrelia burgdorferi) SEQ ID NO 14 | MKRKAKSILFFLLSTVLFAQETDGLAEGSKRAEPGELVLDFAELARDPSSTRLDLTN YVDYVYSGASGIVKPEDMVVDLGINNWSVLLTPSARLQAYVKNSVVAPAVVKSESK RYAGDTILGVRVLFPSYSQSSAMIMPPFKIPFYSGESGNQFLGKGLIDNIKTMKEIKV SVYSLGYEIDLEVLFEDMNGMEYAYSMGTLKFKGWADLIWSNPNYIPNISSRIIKDD VPNYPLASSKMRFKAFRVSKSHSSKVKNFIFYVKDLRVLYDKLSVSIDSDIDSESVFK VYETSGTESLRKLKAHETFKRVLKLREKISIAEGSFQNFVEKIESEKPEESSPKN |
| BAD18055.1\| FlaB protein [Borrelia garinii] SEQ ID NO 15 | NTSKAINFIQTTEGNLNEVEKVLVRMKELAVQSGNGTYSDADRGSIQIEIEQLTDEIN RIADQAQYNQMHMLSNKSASQNVRTAEELGMQPAKINTPASLSGSQASWTLRVHV GANQDEAIAVNIYAANVANLFSGEGAQAAQTAPVQEGVQQEGAQQPAPATAPSQG GVNSPVNVTTTVDANTSLAKIENAIRMISDQ |
| AAU07005.1\| flagellar filament 41 kDa core protein [Borrelia garinii PBi] SEQ ID NO 16 | MIINHNTSAINASRNNSINAANLSKTQEKLSSGYRINRASDDAAGMGVSGKINAQIRG LSQASRNTSKAINFIQTTEGNLNEVEKVLVRMKELAVQSGNGTYSDADRGSIQIEIE QLTDEINRIADQAQYNQMHMLSNKSASQNVRTAEELGMQPAKINTPASLSGSQAS WTLRVHVGANQDEAIAVNIYAANVANLFSGEGSQAAQTAPVQEGAQQEGAQQPA PATAPSQGGVNSPVNVTTTVDANTSLAKIENAIRMISDQRANLGAFQNRLESIKDST EYAIENLKASYAQIKDATMTDEVVASTTNSILTQSAMAMIAQANQVPQYVLSLLR |
| 1L8W A Chain A, Crystal Structure Of Lyme Disease Variable Surface Antigen VlsE1 Of Borrelia Burgdorferi SEQ ID NO 17 | MRGSHHHHHHGSSQVADKDDPTNKFYQSVIQLGNGFLDVFTSFGGLVAEAFGFKS DPKKSDVKTYFTTVAAKLEKTKTDLNSLPKEKSDISSTTGKPDSTGSVGTAVEGAIK EVSELLDKLVKAVKTAEGASSGTAAIGEVVADADAAKVADKASVKGIAKGIKEIVEAA GGSEKLKAVAAAKGENNKGAGKLFGKAGAAAHGDSEAASKAAGAVSAVSGEQILS AIVTAADAAEQDGKKPEEAKNPIAAAIGDKDGGAEFGQDEXKKDDQIAAAIALRGXA KDGKFAVKDGEKEKAEGAIKGAAESAVRKVLGAITGLIGDAVSSGLRKVGDSVKAA SKETPPALNK |
| CAA57807.1 Associated protein A | MKKISLLIFLFLFVVSLSANIEENYTETKRAFSKEDFNLINKRLDNYDFKNEYEKSHVF SDAPRIRGDLRKIGIKEKSVFLDALEAIEYLIKIKISTDSIFLSEDMIRLIGSYPDSIFNYLI QLNSDKIDYAEKYGDNARNNFKKDYSEDKANTVKQILKQILADLPKD |

Fig. 30 continued

| | |
|---|---|
| (BapA)[Borrelia burgdorferi] SEQ ID NO 18 | |
| AAL25643.1\| P37-47 [Borrelia burgdorferi] SEQ ID NO 19 | MCAFLLLNLVNCKFDSLNLSTKSVDDKNNSIAKLLQHLSKSEDQANKTSTSEDQKEL EITENKEQEHEKLSQVAQHAPNSKIEKVKSDGKPVPGDKILSSNKDIYNSYIPEVKEE IVYEILEEVIIPETKIPEITEEVIMPIPQTIDFYIEPRPISSFLTQGTSPSITSTIKSYKELAK EKINNGLNIVQKITQNIDNITENLNSKETPKEISGKEVEEKITHPIFDHITGSGNNPGQD SISNTWGEGLEIGGDSNFFTNLEEVRSSIRTKIKVSDGTEQTKDKVEIDEIIEDLQKLK EFLEKLKKYLKDTNNLSAIEESVKGLS |
| NP_212481.1\| fibronectin/fibrino gen-binding protein, putative [Borrelia burgdorferi B31] SEQ ID NO 20 | MIKMSLNYTEINTLIKEIPFTNSLITKIIQPDYKSLVLEIYNKIDNKKFKILIGLNPNTTRFH ITKKNFKKNALKLRFSDFLKSKIQNGKIIKAFQMKNERIISLEILQKDMIILFIKLWPSSP NIIATNSNFKILDAYYRRPKIKETTGEIFLKAKEIHESNKMSDKKIMELKEEYNNTSYTS YSEFLENYYESLNDQIKKTNIKELLIEKYKKELIVLEKRIDSLKQQIKLLENIENEKEKG ELILLNINKIQKGIKEINLLNYKEEKIKISLNQSLSPKENALQYFKAYKKGKNSFKTIQN QLKDNLDKFNLIQSKITMLKVENLIPEEEYNQEKTAIKEKEKTPKIGLHFTYCGFEILIG RNAKENDKLLRHCVKGNDYWLHTRDYPGAYVFIKNQKNKTPSLDVLLGAGNLCVF YTKLAKKSGKADLYYTQVKNLRRVKNKKLGLVIPKAEKNLHIKLDENLIKKIKNQT |
| AAC44656.1\| P30 Borrelia burgdorferi SEQ ID NO 21 | MKLQRSLSLIIFSLTVLCCDNKERKEGVSTKISLGAEPRSLDPQLAEDNVASKMIDTL YRGIVTGDPNTGGHKPGLAKGWETSSDGTAYPFYLRDNLTWSDGVAITAEGIRKSY LRILNKETGSTYVDMVKSIIKNGQEYFDGQVTDSELGIRAIDSKTLEITLASPKPYFIDL LVHQSFIPVPVHVTDKYGQNWTSPENMVTSGPFKLKERIPSEKYVFEKDNKYYDSN EVELEEITFYTTNDSSTAYKMYVNEELDAILVPYPQI |
| NP_045619.1\| immunogenic protein P37, putative [Borrelia burgdorferi B31] SEQ ID NO 22 | MNLINKLFILTILFSSVISCKLYKKITYNADQVIDKLKSNNGSFNTLKSNDDSKRSGRK PRSVDNTYMDQDTGKKPLMADMQPDMGNDNSSSNHTLQVNIQDNEASEARNIMT EIESSKEEYNRINEDLAKVKASLDKIKSLLSTAKSYLEQTRRGVGSSKANLALLPSLE EAIAKVKSNHASADTHCNDAIAALKRAKNDFEYAQRKADRALEEALSNSNASRHES YYYAGYHQFMADAKASMSSTKSLLEVAKNKQKELNENMTKTNKDFQELNDIYKKL QDMDSR |
| NP_212281.1\| flagellin [Borrelia burgdorferi B31] SEQ ID NO 23 | MIINHNTSAINASRNNGINAANLSKTQEKLSSGYRINRASDDAAGMGVSGKINAQIR GLSQASRNTSKAINFIQTTEGNLNEVEKVLVRMKELAVQSGNGTYSDADRGSIQIEI EQLTDEINRIADQAQYNQMHHMLSNKSASQNVRTAEELGMQAPAKINTPASLSGSOAS WTLRVHVGANQDEAIAVNIYAANVANLFSGEAQTAQAAPVQEGVQQEGAQQPA PATAPSQGGVNSPVNVTTTVDANTSLAKIENAIRMISDQRANLGAFQNRLESIKNST EYAIENLKASYAQIKDATMTDEVVAATTNSILTQSAMAMIAQANQVPQYVLSLLR |
| NP_212463.1\| oligopeptide ABC transporter, periplasmic oligopeptide-binding protein (oppA-2) [Borrelia burgdorferi B31] SEQ ID NO 24 | MKLQRSLFLIIFFLTFLCCNNKERKEGVSFKISLGAEPSSLDPQLAEDNVASKMIDTM FRGIVTGDPNTGGNKPGLAKGWDISSDGTVYTFNLREKITWSDGVAITAEGIRKSYL RILNKETGSKYVEMVKSVIKNGQKYFDGQVTDSELGIRAIDEKTLEITLESPKPYFID MLVHQSFIPVPVHVTEKYGQNWTSPENMVTSGPFKLKERIPNEKYVFEKNNKYYDS NEVELEEITFYTTNDSSTAYKMYENEELDAIFGSIPPDLIKNLKLRSDYYSSAVNAIYF YAFNTHIKPLDNVKIRKALTLAIDRETLTYKVLDNGTTPTRRATPNFSSYSYAKSLELF NPEIAKTLLAEAGYPNGNGFPILKLKYNTNEANKKICEFIQNQWKKNLNIDVELENEE WTTYLNTKANGNYEIARAGWIGDYADPLTFLSIFTQGYTQFSSHNYSNPEYNELIKK SDLELDPIKRQDILRQAEEIIEKDFPIAPIYIYGNSYLFRNDKWTGWNTNILERFDLSQ LKLKNK |
| AAC44381.1\| outer membrane porin protein Oms28 precursor SEQ ID NO 25 | MTKIFSNLIINGLLFGFVSLNVFADSNNANILKPQSNVLEHSDQKDNKKLDQKDQVN QALDTINKVTEDVSSKLEGVRESSLELVESNDAGVVKKFVGSMSLMSDVAKGTVVA SGEATIVAKCSGMVAEGANKVVEMSKKAVQETQKAVSVAGEATFLIEKQIMLNKSP NNKELELTKEEFAKVDEVKETLMASERALDETVQEAQKVLNMVNGLNPSNKDQVL AKKDVRKAISNVVKVAQGARDLTKVMAISLYMR |
| CAA49829.1\| p93 [Borrelia burgdorferi] SEQ ID NO 26 | MKKMLLIFSFFLIFLNGFPLNARKVDKEKLKDFVNMDLEFVNYKGPYDSTNTYEQIV GIGEFLARPLTNSNSNSSYYGKYFINRFIDDQDKKASVDVFSISSKSELDSILNLRRIL TGYIIKSFDYDRSSAELIAKVITIYNAVYRGDLDYYKGFYIEPALKSLTKENAGLSRVY SQWAGKTQIFIPLKKDILSGNIESDIDIDSLVTDKVIAALLSENEAGVNFARDITDIQGE THKADQDKIDTELDNIHESDSNITETIENLRDQLEKATDEEHKKEIESQVDAKKKEKE ELDKKAINLDKAGQKLDSAEDNLDVQRDTVREKIQEDINEINKEKNLPKGDVSSPK VDKQLQIKESLEDLQEQLKEAGDENQKREIEKQIEIKKRDEELLKSKDGKVSKDYEA |

Fig. 30 continued

| | |
|---|---|
| | LDLDRELSKASSKEKSKVKEEEITKGKSRASLGDLNNDKNLMLPEDQKLPEDKKLD SKLDGKKEFKPVSEVEKLDKISKSNNNEVGKLSPLDKPSYDDIDSKEEVDNKAINLQ KIDPKVKDQTTSLNEDLDKDLTTMSIDSSSPVFLEVIDPITNLGTLQLIDLNTGVRLKE STQQGIQRYGIYEREKDLVVIKMDSGKAKLQILNKLENLKVVSESNFEINKNSSLYVD SKMILAAVRDKDDSNAWRLAKFSPKNLDEFILSENKILPFTSFSVRKNFIYLQDELKN LVILDVNTLKKVK |
| NP_212375.1\| glycerol kinase (glpK) [Borrelia burgdorferi B31] SEQ ID NO 27 | MKYILSIDQGTTSSRAMVFDKNANIKGFAQKEFTQIYPQPSWVEHDPTEIWGSQLG VITEAMANARILPNEIDAIGITNQRETTVIWEKNTGKPIYNAIVWQDRRTAKICDQLKK EGKDKIILEKTGLVLDSYFSGTKIMWILDNVEGARQRAENGELCFGTIDTWILWNLTQ KKEHATDYSNASRTLLLNIKTLEWDDELLSILNVPRAILPELKESSTIYGKTDKALFGA EIPIAGIAGDQFAATFGQACLKKGMAKNTYGTGCFLTVNIGKEPIISHDKLLTSIAWG RKKSVTYVLEGSVFIGGAVIQWLRDGLEFFRKSSDAEALASSVSDNGGVYFVPAFV GLGAPHWDSYARGTIIGITRGSTKAHITRAALESIAFQSFDILNTMKKSIPNFEIQELR VDGGASQNNLLMQFQADLLECKVVRPKITETTALGAAYLAGLATGYWQSAEEIVSL WQVDKIFEPSMPKNQKEKLLENWNKAVGKAKSWIQNSHSS |
| NP_212342.1\| hypothetical protein BB0208 [Borrelia burgdorferi B31] SEQ ID NO 28 | MKTIKKDSEFYDSLATLKKHINKYIEEKVLKYSISSQLYKLEKPEIIELIKISNDYEKEKN AFNTSLEECYYKNTQNEAIKKWILEIVRNKNFIQISKEANLNTKKLGTTYKLKSSNFLK LIEIQNSPYYSQEKKDIYKQIILNFSSNINIDSLEQTIDILVAVRNRNKIKILNILNKNLKY RPENQKVFKSSLTNKESRLIKLKRMLILTYWPVGCLSKNIFIKILIKXYKYLEEEILALK YNEILNYLRALKTLSLNEIFYKGSSKNISFNYFFSDFTQYAPKDFQDTLKCYLYVIEKT ITKKYLTWFFKDKISNNWESFIDALEYIEKHKLINIKEKIKEIITAKFQTEDFFISFDKTNF NPYESSIFKERYIKSAFLEIIMHYVKKNSQNIETYGWIAFYIYADNKDKKIFCQRMKEF FKSKTFEIQNQIFVYFLSFYPNIEYKHFKFISDILLYLDENKITIPKKIIKIQKINPNQLDY QKSYLLIKSLKTRSRILKIIKNIRFNLIEKLEDENEKKLLPAMCYLIYCENLVELKNNRKI KSNEKNSLLEFISFFKTKLKQKINFKKELMKSKGI |
| NP_045482.1\| hypothetical protein BBG22 [Borrelia burgdorferi B31] SEQ ID NO 29 | MITGQDYTEIKKKLENTKTRIQFRNGNKIDSLGYQGSLGEPILLKDKLTFSICDGKNID NRKEYEITKNAPSLDSLIEYLEHMILFFLEKTPVGTLTAKFAMEGSILTRSKLIQAFTN TNKFCIPDGRSLPSNCYAYKVLGISSAPKLSGRFLRHYDSGGSTDSDGTRSLGHTQ EDSYKNHDHDLDFSRINFKGKLVKRMTMIYRSADTWYTWYWAEEIMSPFITGYSYE EIDPEYLLPPFTSQSGSKETKPKNTCYISFYRYDL |
| NP_212885.1\| hypothetical protein BB0751 [Borrelia burgdorferi B31] SEQ ID NO 30 | MDLLDLLEKEKQINKNKGVFMTKPKIFSINKEKIKILIVVLTSTFLLGIIFSNENKVARIL EEKFFDFDFNLISKIETELEGTLTKLGKDWILTYNKQNIPVDNKKVNSLIKALDELQKN KLVSRDQKKHKELGIGENPSFKLFDNNNKLLTEIFVGKSGEGDSRLAYIKGSDENVY LTKNIFLSYKGNSYNTFSDTTLFQEKNTKLENLSFKIIRKLNKENENNINNNYEIISKD GLYFLNNQKMTKERPLNIIAEFKADGLEIDKSKIDDYNLQYKIEVKWSNKSVNNIEVY FNKNEENDKDILIKKDKDEYYYTTSKWTFFDVFDLEKKLTEKDDISSNDNQEDHHEH HNNAD |
| AAC67038.1\| predicted coding region BB0689 [Borrelia burgdorferi B31] SEQ ID NO 31 | MKKLIIIFTLFLSQACNLSTMHKIDTKEDMKILYSEIAELRKKLNLNHLEIDDTLEKVAK EYAIKLGENRTITHTLFGTTPMQRIHKYDQSFNLTREILASGIELNRVVNAWLNSPSH KEALINTDTDKIGGYRLKTTDNIDIFVVLFGKRKYKN |
| NP_045709.1\| lipoprotein BBA36[Borrelia burgdorferi B31] SEQ ID NO 32 | MMQRISILLMLLAVFSCKQFGDVKSLTEIDSGNGIPLVVSDVVKDLIPKEISLTPEEAE KLESLKVFLKDAMSVNGREEALKAEYEKSYKEFFDWLSKDVNRQKEFISSFDNISSI VSKAVDASKKRRPTEQQSLGFKEYVCYKIKNSKGEALSLFFQKVVDAFGADPYKKD NDESVQKPVKCNEEIFKVIKKVLTESESNNELKNLKNYGNV |
| AAT93769.1 lipoprotein BBA36 (homolog 67%)[Borrelia garinii PBi] SEQ ID NO 33 | MKRISILSILLLLLLFSCKQYGDVKSLTEVATDLEDDNSFASGSVESKDQIIEKGPVLT SEEFERLEALKTFLKDAMGVNGREGDTKAEYEKSYKEFFDWLSKDVNRQKEFVSF FNNICGIITKAVDASKKRYNSNPKSLGFNEYVCYDIKTRTGDDLSLFFQKVADAFGT QEYNKDEDDENNQKPEKCNEEIFKVIKRVFTESENNNELANLKNLNSYNLNSNNK |
| NP_045739.1\| BBA69 antigen, | MKIKPLIQLKLLGLFLFSCTIDANLNEDYKNKVKGILNKAADDEETTSADTNSNAAKNI PIADNDKVAAELKKQSQAAKTVAAAPNKGSQNQPQTTPNKGSQNQQAAPSPQLQ |

Fig. 30 continued

| | |
|---|---|
| P35, putative [Borrelia burgdorferi B31] SEQ ID NO 34 | SLSFSADLSNLPKTTAARAASLTKQRIPIQAVTTVPGNTRTFNSRNSGLPTFALNYSF SQPTRQQTNSSSAVQTTTSSGSKLQTLKNELIRAISEEKNKTQNNFGFRETYDQFK MKDSAFELLDVISSAKVYDRSYAPQLNSNTPEAENERNKFYALMDFDQYKIEQFGSI MEALYNENQNHSLIRELMISGLGTQISFELALEEINKKIEIFNQDYLNAKINSFDFTMK LKELKSKLNQILDKRKEWSRQADGLIANASSNSSLSDSKSLAEYIKKRYLDNMQNAR QSVLEAYISIM |
| AAT93824.1 BBA 66 antigen, P35, putative [Borrelia garinii PBi] SEQ ID NO 35 | MSSCTIDANLNKDYKNKVEELLNSSTDDQAKISINTGSNATKNKTNIKVAGLQKNTQ SKKNNNLQGLNPANQVNPGNPMQIANQANQANQANQANQASQASQASQVA SSASQASPVASPATNVQATPPKQIASAQAIQTVPNNTSTPNQSIIKPQQYTFSSSFS QPTSQTNFNNSQSNNVLTNYRHQTQPSFVVPVYSGNSPLQKLKNNLLRRIAEEKNK THNHGFRETYDQFKMKDSAFTLLDVISNISVFDRGSAPQLSSNTPEAESERNRLYA MMDFDQAKTTEFGSIMNILYQENQNHSLIRSLIISGLGIQISLESTLEEIEKKIESFNTQ YLNTIINSYTFKDKLKELESKLNSILAEKKEWLNYADAIITNTSSNSKRNDPQSLGQYI KNKYLDKMQDARQSALDLYLNITEIR |
| NP_045742.1 hypothetical protein BBA69 [Borrelia burgdorferi B31] SEQ ID NO 36 | MKKAKLNIIKINIITMILTLICISCAPFNKINPKANENTKLKKNTRLKKPANPGENIQNFK DKSGDLGASDEKFMGTTASELKAIGKELEDRKNQYDIQIAKITNEESNLLDTYIRAYE LANENEKMLLKRFLLSSLDYKKENIETLKEILEKLINNYENDPKIAANFLYRIALDIQLK LEKHLKSINEKLDTLSKENSKEDLEALLEQVKSALQLQEKFKKTLNKTLEDYRKNTN NIQENKVLAEHFNKYYKDSDSLQSAFY |
| AAT93826.1 conserved hypothetical protein BBA69 [Borrelia garinii PBi] SEQ ID NO 37 | MKKTKLNIIKLNILTTTLTLICISCAVNKIDPEPKSKTNKKENIKNFVNKFQDLEPSKKQ NKDLEPLREKYPEATASKLETTLKILEAQKEKENIEIAKIDNTQIDFLKTFKTDPHDSL PEDEKMQMKKIIYSSLNYETEKIKILQEILEKLDKNLQHKKIAKNFIYDIPIIQSRLDIISK VIKNPIKDELQILNQKEIEELLMRIESELKIKENFKKALNKTIDAYNQDSENIKTSAEQL EKHINENYKEFNSLKPIY |
| NP_045573.1 hypothetical protein BBI42 [Borrelia burgdorferi B31] SEQ ID NO 38 | MRILVGVCIIALALLGCYLPDNQEQAVQTFFENSESSDMGSDEIVTEGIFSSLKLYAS EHRLLVEIKKTLISLKDPNYRGVVLPVSDYNEEYFNKFFLDLGSEQSKDLIKLFIMVK NEQNNNKFMRIVRWLYSCIEELYSPDIKYSGEEGSPEYYRNMPRPTAYQQYLKVKR YDYNRPVPILPT |
| NP_051318.1 revA protein [Borrelia burgdorferi B31] SEQ ID NO 39 | MRNKNIFKLFFASMLFVMACKAYVEEKKEIDSLMEDVLALVNDSSGGKFKDYKDKIN ELKENLKDIGNAELKEKLLNLQNSFQDKLAAKLAALKAAKNTIENITDKDQDISKRKI WSEAKLVGVTVPLLGSNTSGNGDKMSKNAVEQIDKVIKFLEEGTN |
| NP_045737.1 BBA64 antigen, P35 [Borrelia burgdorferi B31] SEQ ID NO 40 | MKDNILKNNKLIAIFLLHVLTVLILISCSLEVKDSNESKKHKKEKRKGKVENLLVAINNL KNPTKPAAGKNKANSKASKQKNNPNANANNAPKKILDPEVAKLIQKILDRSENIIQIS EMDSSRGEPNDQFGMRAEIFSKIFFNANSTVHFDSHEYTEERRMLYTSLNFNEGKI FNLGQILSKLSQDSNYRGLVKETLINRGFSIQLAMEEISAKILNVKDKLQQLNKPNLE TLYNDFEKLTSLKEKWLKDTDDLIDEYNTNPDLQTDVSKLNDTLRSKNSRAQFANIH DILDLVNTTTNILAPIQ |
| AAT93822.1 BBA64 antigen, P35 [Borrelia garinii PBi] SEQ ID NO 41 | MKNNKLIAIFLLHILTGLILLSCSLEVNQDDNQEKQKKAKTKTSKSENNSSKMKKLSK NAKNKKPTVDNLLVAINTLKNPPKTAGKNKSNSAAALKQPNNANALKQIDPEAKELI QKILERSEDIVQISEIDANKGEPDDQFEMKAEIFSKIFFNAGSTVTFDDNEYVNERRIL YTSLNFNENKILNLGKILSKLSQDSNYRSLVKEILNRGFSIQLAIEEISLRTLNVKDKIQ HLNKPNLKTLYHDFNKLIPLKEKWLKDVDDIIKDYNANPELRTDISKLNDYIISKNSKA QFTDIHNIILNLINTTTNILAPIQ |
| AAL84596.1 BBK32 [Borrelia burgdorferi] SEQ ID NO 42 | MKKVKSKYLALGLLFGFISCDLFIRYEMKEESPGLFDKGNSILETSEESIKKPMNKKG KGKIARKKGKSKVSRKEPYIHSLKRDSANKSNFLQKNVILEEESLKTELLKEQSETR KEKIQKQQDEYKGMTQGSLNSLSGESGELKETIESNEIDITIDSDLRPKSSLQDIAGS NSISYTDEIEEEDYARYYLDEDDEDDEYYEDDYEEIRLSNRYQSYLEGVKYNVDSAI NTINKIYDTYTLFSTKLTQMYSTRLDNLAKAKAKEEAAKFTKEDLEKNFKTLLNYIQV SVKTAANFVYINDTHAKRKLENIEAEIKTLIAKIKEQSNLYEAYKAIVTSILLMRDSLKE |

Fig. 30 continued

| | VQGIIDKNGVWY |
|---|---|
| AAL84590.1 BBK32 [Borrelia afzelii] SEQ ID NO 43 | MKIKSKCLALGLLFGFISCDLFIRDEIKEKSLGLCDEESSILETGDKSVKKSLNKKGKD KVARKKVEGNAVKKDPFNHHVKRESVNNSNLSQKNVISEEEILKTKLLRERPETRK EEIQKQQDEHKRMLQGSLSFLSGESGELKDTIESNEIDFTIDSDLRLKSDLQAISGSN SISYTDEIEEEDYDQYSLEEDYYYDGETRLSNRYESYLEGVKYNVSSAIKTIVKIYDN YTLLSTKQTQMYSTRLDNLAKAKAREEAKKFTKEELEKDLKTLLNYIQVSARTATNF VYAREIYSKRKLDAIETEIKNLILKIKGQSDLYEAYKAIVRSILLMKDSLKIIEIVIDKNGV WY |
| AAL84595.1 BBK32 [Borrelia garinii] SEQ ID NO 44 | MKKVKSKYLALGLLFGFISCDLFIRYEMKEESPGLFDKGNSILETSEESIKKPMNKKG KGKIARKNGKSKVSGKEPFIHSFKRDAANKSNFLQKNVMLEEESLKTELLKEQSET RKEKIQKQQDEYKGMTKGSLNSLSGESGELKETIESNEIDITIDSDLRPKSSLQDIAG SNSISYTDEIEEEDYARYYLDEDDEDDEYYEDDYEEIRLSNRYQSYLEGVKYNVDSA INTINKIYDTYTLFSTKLTQMYSTRLDNLAKAKAKEEAAKFTKEDLEKNFKTLLNYIQV SVKTATNFVYINEMHAKRKLENIEAKIKTLIAKIKEKSNLYSAYKAIVSSILLMRDSLKE VQYAIDKNGIWY |

| Antigen designation | Class I Antigen peptide sequences SEQ ID NO/sequences |
|---|---|
| NP_212517.1 Basic membrane protein A (bmpA) [Borrelia burgdorferi B31 | SEQ ID NO 45-1366/ 8 mers: MNKILLLI; NKILLLIL; KILLLILL; ILLLILLE; LLLILLES; LLILLESI; LILLESIV; ILLESIVF; LLESIVFL; LESIVFLS; ESIVFLSC; SIVFLSCS; IVFLSCSG; VFLSCSGK; FLSCSGKG; LSCSGKGS; SCSGKGSL; CSGKGSLG; SGKGSLGS; GKGSLGSE; KGSLGSEI; GSLGSEIP; SLGSEIPK; LGSEIPKV; GSEIPKVS; SEIPKVSL; EIPKVSLI; IPKVSLII; PKVSLIID; KVSLIIDG; VSLIIDGT; SLIIDGTF; LIIDGTFD; IIDGTFDD; IDGTFDDK; DGTFDDKS; GTFDDKSF; TFDDKSFN; FDDKSFNE; DDKSFNES; DKSFNESA; KSFNESAL; SFNESALN; FNESALNG; NESALNGV; ESALNGVK; SALNGVKK; ALNGVKKV; LNGVKKVK; NGVKKVKE; GVKKVKEE; VKKVKEEF; KKVKEEFK; KVKEEFKI; VKEEFKIE; KEEFKIEL; EEFKIELV; EFKIELVL; FKIELVLK; KIELVLKE; IELVLKES; ELVLKESS; LVLKESSS; VLKESSSN; LKESSSNS; KESSSNSY; ESSSNSYL; SSSNSYLS; SSNSYLSD; SNSYLSDL; NSYLSDLE; SYLSDLEG; YLSDLEGL; LSDLEGLK; SDLEGLKD; DLEGLKDA; LEGLKDAG; EGLKDAGS; GLKDAGSD; LKDAGSDL; KDAGSDLI; DAGSDLIW; AGSDLIWL; GSDLIWLI; SDLIWLIG; DLIWLIGY; LIWLIGYR; IWLIGYRF; WLIGYRFS; LIGYRFSD; IGYRFSDV; GYRFSDVA; YRFSDVAK; RFSDVAKV; FSDVAKVA; SDVAKVAA; DVAKVAAL; VAKVAALQ; AKVAALQN; KVAALQNP; VAALQNPD; AALQNPDM; ALQNPDMK; LQNPDMKY; QNPDMKYA; NPDMKYAI; PDMKYAII; DMKYAIID; MKYAIIDP; KYAIIDPI; YAIIDPIY; AIIDPIYS; IIDPIYSN; IDPIYSND; DPIYSNDP; PIYSNDPI; IYSNDPIP; YSNDPIPA; SNDPIPAN; NDPIPANL; DPIPANLV; PIPANLVG; IPANLVGM; PANLVGMT; ANLVGMTF; NLVGMTFR; LVGMTFRA; VGMTFRAQ; GMTFRAQE; MTFRAQEG; TFRAQEGA; FRAQEGAF; RAQEGAFL; AQEGAFLT; QEGAFLTG; EGAFLTGY; GAFLTGYI; AFLTGYIA; FLTGYIAA; LTGYIAAK; TGYIAAKL; GYIAAKLS; YIAAKLSK; IAAKLSKT; AAKLSKTG; AKLSKTGK; KLSKTGKI; LSKTGKIG; SKTGKIGF; KTGKIGFL; TGKIGFLG; GKIGFLGG; KIGFLGGI; IGFLGGIE; GFLGGIEG; FLGGIEGE; LGGIEGEI; GGIEGEIV; GIEGEIVD; IEGEIVDA; EGEIVDAF; GEIVDAFR; EIVDAFRY; IVDAFRYG; VDAFRYGY; DAFRYGYE; AFRYGYEA; FRYGYEAG; RYGYEAGA; YGYEAGAK; GYEAGAKY; YEAGAKYA; EAGAKYAN; AGAKYANK; GAKYANKD; AKYANKDI; KYANKDIK; YANKDIKI; ANKDIKIS; NKDIKIST; KDIKISTQ; DIKISTQY; IKISTQYI; KISTQYIG; ISTQYIGS; STQYIGSF; TQYIGSFA; QYIGSFAD; YIGSFADL; IGSFADLE; GSFADLEA; SFADLEAG; FADLEAGR; ADLEAGRS; DLEAGRSV; LEAGRSVA; EAGRSVAT; AGRSVATR; GRSVATRM; RSVATRMY; SVATRMYS; VATRMYSD; ATRMYSDE; TRMYSDEI; RMYSDEID; MYSDEIDI; YSDEIDII; SDEIDIIH; DEIDIIHH; EIDIIHHA; IDIIHHAA; DIIHHAAG; IIHHAAGL; IHHAAGLG; HHAAGLGG; HAAGLGGI; AAGLGGIG; AGLGGIGA; GLGGIGAI; LGGIGAIE; GGIGAIEV; GIGAIEVA; IGAIEVAK; GAIEVAKE; AIEVAKEL; IEVAKELG; EVAKELGS; VAKELGSG; AKELGSGH; KELGSGHY; ELGSGHYI; LGSGHYII; GSGHYIIG; SGHYIIGV; GHYIIGVD; HYIIGVDE; YIIGVDED; IIGVDEDQ; IGVDEDQA; GVDEDQAY; VDEDQAYL; DEDQAYLA; EDQAYLAP; DQAYLAPD; QAYLAPDN; AYLAPDNV; YLAPDNVI; LAPDNVIT; APDNVITS; PDNVITST; DNVITSTT; NVITSTTK; VITSTTKD; ITSTTKDV; TSTTKDVG; STTKDVGR; TTKDVGRA; TKDVGRAL; KDVGRALN; DVGRALNI; VGRALNIF; GRALNIFT; RALNIFTS; ALNIFTSN; LNIFTSNH; NIFTSNHL; IFTSNHLK; FTSNHLKT; TSNHLKTN; SNHLKTNT; NHLKTNTF; HLKTNTFE; LKTNTFEG; KTNTFEGG; TNTFEGGK; NTFEGGKL; TFEGGKLI; FEGGKLIN; EGGKLINY; GGKLINYG; GKLINYGL; KLINYGLK; LINYGLKE; INYGLKEG; NYGLKEGV; YGLKEGVV; GLKEGVVG; LKEGVVGF; KEGVVGFV; EGVVGFVR; GVVGFVRN; VVGFVRNP; VGFVRNPK; GFVRNPKM; FVRNPKMI; VRNPKMIS; RNPKMISF; NPKMISFE; PKMISFEL; KMISFELE; |

STQYLGSPAD; TQYLGSPADL; QYLGSPADLE; YLGSPADLEA; LGSPADLEAG;
GSPADLEAGR; SPADLEAGRS; PADLEAGRSV; ADLEAGRSVA; DLEAGRSVAT;
LEAGRSVATR; EAGRSVATRM; AGRSVATRMY; GRSVATRMYS; RSVATRMYSD;
SVATRMYSDF; VATRMYSDFT; ATRMYSDFTD; TRMYSDFTDT; RMYSDFTDTI;
MYSDFTDTIH; YSDFTDTIHH; SDFTDTIHHA; DFTDTIHHAA; FTDTIHHAAG;
TDTIHHAAGL; DTIHHAAGLG; TIHHAAGLGG

QYPDNKYALLD; YPDNKYALLDP; PDNKYALLDPL; DNKYALLDPLY;
NKYALLDPLYS; KYALLDPLYSN; YALLDPLYSND; ALLDPLYSNDP;
LLDPLYSNDPL; LDPLYSNDPLP; DPLYSNDPLPA; PLYSNDPLPAN;
LYSNDPLPANL; YSNDPLPANLV; SNDPLPANLVG; NDPLPANLVGM;
DPLPANLVGME; PLPANLVGMEP; LPANLVGMEPR; PANLVGMEPRA;
ANLVGMEPRAQ; NLVGMEPRAQF; LVGMEPRAQFQ; VGMEPRAQFQA;
GMEPRAQFQAF; MEPRAQFQAFL; EPRAQFQAFLT; PRAQFQAFLTG;
RAQFQAFLTGY; AQFQAFLTGYT; QFQAFLTGYTA; FQAFLTGYTAA;
QAFLTGYTAAK; AF

| | | | | | | |
|---|---|---|---|---|---|---|
| protein C (bmpC) [Borrelia burgdorferi B31 | MFKRSIFI; FITISLLV; LVFACFKG; RSNKKSTR; LKSDKVVV; VVGVLAHG; HQSFYDRQ; KQYNQSVH; VHDQVVKL; KLRDNFQI; QIKLTTKS; KSLRPYPT; PTFQKRLL; LLTVDFAM; AMTFDAYF; YFVQKNPL; PLNLFWLT; LTGYRFSD; SDLSVKLS; LSYRRPDI; DIYYGTTD; IDAFDYGD; GDIQVPK; KNSLAIKF; KFRNFFAA; AAFLAGYI; YIAAKMSR; QRKEKIGF; GFLLGPKL; KSEHVKDF; DFKFGFKA; KAGIFYAN; ANPKLRLV; LVSKKAPL; PQLFDKEK; EKGRAMAL; ALFMYKED; EDKVGVLF; TPPTAGTT; ITGLGVYD; YDAAKFLQ; LQPKYYVT; VTGLNQDQ; LQSYTAPQ; PQNVTTST; STTKDTQK; QKVTYSTS; TSSFYTNN; NNRVFKGQ; GQTTTDRQ; RQLKFGVT; VTFTVKDP; DPPVINRL; NRLVDFVT; VTDFNKT; RTTSGFTT; LLVPDSLY | SKRIFIQI; TTLSLLVF; VFACFKG; SNKKSTKS; KSDKVVVG; VGVLAHGS; HQSFYDKQ; QYNQSVHD; HDQVVKLR; LRDNFQIK; IKLTTKSL; SLRPYPTR; TFQKRLLT; LTVDFAMT; MTFDAYFV; FVQKNPLN; NLFWLTGY; TGYRFSDL; DLSVKLSY; SYRRPDIY; TYYGTTDA; DAFDYGDL; GDIQVPKN; NSLAIKFR; FRNFFAAFL; AFLAGYIA; LAAKMSRK; RKEKIGFL; FLLGPKLF; SEHVKDFK; FKFGFKAG; AGIFYANP; NPKLRLVS; VSKKAPLF; QLFDKEKS; KGRAMALF; LFMYKEDK; DKVGVLFP; PPTAGTTG; TGLGVYDA; DAAKFLQP; QPKYYVTG; TGLNQDQS; QSYTAPQN; QNVTTSTT; TTKDTQKV; KVTYSTSS; SSFYTNNR; NRVFKGQT; QTTTDRQI; QLKFGVTF; TFTVKDPD; PPVINRLV; RLVDFVTD; TDFNKTTD; TTSGFTTV; LVPDSLYA | KRIFIQIS; TLSLLVFT; FACFKSN; NKKSTKSD; SDKVVVGV; GVLAHGSF; QSFYDKQY; YNQSVHDQ; DQVVKLRD; RDNFQIKL; KLTTKSLR; LRPYPTFQ; FQKRLLTV; TVDFAMTF; TFDAYFVQ; VQKNPLNL; LFWLTGYR; GYRFSDLS; LSVKLSYR; YRRPDIYY; YYGTTDAF; AFDYGDIQ; DIQVPKNS; SLAIKFRN; RNFFAAFLA; FLAGYIAA; AAKMSRKE; KEKIGFLL; LLGPKLFL; EHVKDFKF; KFGFKAGI; GIFYANPK; PKLRLVCK; SKKAPLFD; LFDKEKGK; GRAMALFM; FMYKEDKV; KVGVLFPL; PTAGTTGL; GLGVYDAA; AAKFLQPK; PKYYVTGL; GLNQDQSY; SYTAPQNV; NVTTSTTK; TKDTQKVT; VTYSTSSF; SFYTNNRV; RVFKGQTT; TTTDRQLK; LKFGVTFT; FTVKDPDP; PVINRLVN; LVDFVTDL; DFNKTTSG; TSGFTTVP; VPDSLYAF | RFISILLS; LSLLVFAC; ACFKSNKK; KKSTKSDK; DKVVVGVL; VLAHGSFY; SFYDKQYN; NQSVHDQV; QVVKLRDN; DNFQIKLT; LTTKSLRP; RPYPTFQK; QKRLLTVD; VDFAMTFD; FDAYFVQK; QKNPLNLF; FWLTGYRF; YRFSDLSV; SVKLSYRR; RPDIYYG; YGTTDAFD; FDYGDIQV; IQVPKNSL; LAIKFRNF; NFFAAFLAG; LAGYIAAK; AKMSRKEK; KIGFLLGP; LGPKLFLT; HVKDFKFG; FGFKAGIF; IFYANPK; KLRLVCKK; KKAPLFDK; FDKEKGKA; RAMALFMY; MYKEDKVG; VGVLFPLA; TAGTTGLG; LGVYDAAK; AKFLQPKY; KYYVTGLN; LNQDQSYT; YTAPQNVT; VTTSTTKD; KDTQKVTY; TYSTSSFY; FYTNNRVF; VFKGQTTT; TTDRQLKF; KFGVTFTV; TVKDPDPV; VINRLVND; VDFVTDLF; FNKTTSGF; SGFTTVPD; PDSLYAFD | FIFITLSI; SLLVFACF; CFKSNKKS; KSTKSDKV; KVVVGVLA; LAHGSFYD; FYDKQYNQ; QSVHDQVV; VVKLRDNF; NFQIKLTT; TTKSLRPY; PYPTFQKR; KRLLTVDF; DFAMTFDA; DAYFVQKN; KNPLNLFW; WLTGYRFS; RFSDLSVK; VKLSYRRP; RPDIYYG; GTTDAFDY; DYGDIQVP; QVPKNSLA; AIKFRNFF; FFAAFLACY; AGYIAAKM; KMSRKEKI; IGFLLGPK; GPKLFLTG; VKDFKFGF; GFKAGIFY; FYANPKLR; LRLVSKKA; KAPLFDKE; DKEKGKAM; AMALFMYK; YKEDKVGV; GVLFPLAG; AGTTGLGV; GVYDAAKF; KFLQPKYY; YYVTGLNQ; NQDQSYTA; TAPQNVTT; TTSTTKDT; DTQKVTYS; YSTSSFYT; YTNNRVFK; FKGQTTTD; TDRQLKFG; FGVTFTVK; VKDPDPVI; INRLVNDR; DFVTDLFN; NKTTSGFT; GFTTVPDS; DSLYAFDL | IFITLSLL; LLVFACFK; FKSNRKSI; STKSDKVV; VVGVLAE; VVGVLAH; AHGSFYDK; DKQYNQSV; SVHDQVVK; VKLRDNFQ; QIKLTTKS; TKSLRPYP; YPTFQKRL; RLLTVDFA; FAMTFDAY; AYFVQKNP; NPLNLFWL; FSLTGYRF; WLTGYRFS; PSDLSVKL; SYRRPDIY; POTYYGTT; TTDAFDYG; GDIQVPK; PKNSLAIK; IKFRNFFA; FAAFLAGY; GYIAAKMS; KMSRKEKI; RKEKIGFLL; ISFLLGPK; PSEHVKD; KDFKFGFK; FKAGIFYA; FYANPKLRL; KLRLVSKK; RKAPLFDK; KAPLFDK; KEKGKAM; MYKEDKVG; KEDKVGVI; VLFPLAGL; GTTGLGVY; VYDAAKFL; KFLQPKYV; YVTGLNQD; LNQDQSYT; QNVTTSTT; TSTTKDTQ; KVTYSTS; TSSFYTN; NRVFKGQT; TDRQLKFG; LKFGVTF; DPVINRLV; VNRLVDFV; DFVTDLF; NKTTSGF; GFTTVPDS; FTTVPDSL; SLYAFDLS |

| | | | |
|---|---|---|---|
| GYRFSDLGVKL; | YRFSDLGVKLS; | RFSDLGVKLSY; | FSDLGVKLSYF; |
| SDLGVKLSYFR; | DLGVKLSYFRP; | LGVKLSYFRPE; | GVKLSYFRPE; |
| VKLSYFRPDIY; | KLSYFRPDIY; | LSYFRPDIYYG; | SYFRPDIYYGI; |
| YFRPDIYYGII; | FRPDIYYGIID; | RPDIYYGIIDA; | PDIYYGIIDAF; |
| DIYYGIIDAFD; | IYYGIIDAFDY; | YYGIIDAFDYG; | YGIIDAFDYGD; |
| GIIDAFDYGDT; | IIDAFDYGDTQ; | IDAFDYGDTQV; | DAFDYGDTQVP; |
| AFDYGDTQVPK; | FDYGDTQVPKN; | DYGDTQVPKNS; | YGDTQVPKNSL; |
| GDTQVPKNSLA; | DTQVPKNSLAT; | TQVPKNSLATK; | QVPKNSLATKF; |
| VPKNSLATKFR; | PKNSLATKFRN; | KNSLATKFRNF; | NSLATKFRNFF; |
| SLATKFRNFFA; | LATKFRNFFAA; | ATKFRNFFAAF; | TKFRNFFAAFL; |
| KFRNFFAAFLA; | FRNFFAAFLAG; | RNFFAAFLAGY; | NFFAAFLAGYT; |
| FFAAFLAGYTA; | FAAFLAGYTAA; | AAFLAGYTAAK; | AFLAGYTAAKM; |
| FLAGYTAAKMS; | LAGYTAAKMSR; | AGYTAAKMSRK; | GYTAAKMSRKF; |
| YTAAKMSRKFK; | TAAKMSRKFKT; | AAKMSRKFKTQ; | AKMSRKFKTQF; |
| FMSRKFKTQFI; | MSRKFKTQFIT; | SRKFKTQFITQ; | RKFKTQFITQF; |
| FKKTQFLTQPM; | KTQFLTQPMS; | KTQFLTQPMSF; | TQFLTQPMSFH; |
| QFLTQPMSFRV; | FLTQPMSFRVK; | LTQPMSFRVKD; | TQPMSFRVKDF; |
| QPMSFRVKDFK; | PMSFRVKDFKF; | MSFRVKDFKFQ; | SFRVKDFKFQF; |
| FRVKDFKFQFK; | RVKDFKFQFKA; | VKDFKFQFKAQ; | KDFKFQFKAQT; |
| DFKFQFKAQTF; | FKFQFKAQTFY; | KFQFKAQTFYA; | FQFKAQTFYAN; |
| QFKAQTFYANP; | FKAQTFYANPK; | KAQTFYANPKL; | AQTFYANPKLR; |
| QTFYANPKLRL; | TFYANPKLRLV; | FYANPKLRLVS; | YANPKLRLVSK; |
| ANPKLRLVSKK; | NPKLRLVSKKA; | PKLRLVSKKAP; | KLRLVSKKAPS; |
| LRLVSKKAPSL; | RLVSKKAPSLF; | LVSKKAPSLFD; | VSKKAPSLFDK; |
| SKKAPSLFDKF; | KKAPSLFDKFK; | KAPSLFDKFKQ; | APSLFDKFKQK; |
| PSLFDKKGKA; | SLFDKKGKAM; | LFDKKGKAMA; | FDKKGKAMAL; |
| DKKGKAMALF; | KKGKAMALFMY; | KGKAMALFMY; | GKAMALFMYK; |
| GKAMALFMYKF; | KAMALFMYKED; | AMALFMYKEDK; | MALFMYKEDKV; |
| ALFMYKEDKVG; | LFMYKEDKVGV; | FMYKEDKVGVI; | MYKEDKVGVIF; |
| YKEDKVGVIFP; | KEDKVGVIFPL; | EDKVGVIFPLA; | DKVGVIFPLAG; |
| KVGVIFPLAGI; | VGVIFPLAGIT; | GVIFPLAGITG; | VIFPLAGITGL; |
| IFPLAGITGLG; | FPLAGITGLGV; | PLAGITGLGVY; | LAGITGLGVYD; |
| AGITGLGVYDA; | GITGLGVYDAA; | ITGLGVYDAAK; | TGLGVYDAAKE; |
| GLGVYDAAKEL; | LGVYDAAKELG; | GVYDAAKELGP; | VYDAAKELGPK; |
| YDAAKELGPKY; | DAAKELGPKYY; | AAKELGPKYYV; | AKELGPKYYVI; |
| KELGPKYYVIG; | ELGPKYYVIGL; | LGPKYYVIGLN; | GPKYYVIGLNQ; |
| PKYYVIGLNQD; | KYYVIGLNQDQ; | YYVIGLNQDQS; | YVIGLNQDQSY; |
| VIGLNQDQSYL; | IGLNQDQSYLA; | GLNQDQSYLAF; | LNQDQSYLAFQ; |
| NQDQSYLAFQN; | QDQSYLAFQNV; | DQSYLAFQNVT; | QSYLAFQNVTT; |
| SYLAFQNVTTS; | YLAFQNVTTSI; | LAFQNVTTSII; | AFQNVTTSIIK; |
| FQNVTTSIIKD; | QNVTTSIIKDT; | NVTTSIIKDTQ; | VTTSIIKDTQK; |
| TTSIIKDTQKV; | TSIIKDTQKVT; | SIIKDTQKVTY; | IIKDTQKVTYS; |
| IKDTQKVTYST; | KDTQKVTYSTS; | DTQKVTYSTSS; | TQKVTYSTSSF; |
| QKVTYSTSSFY; | KVTYSTSSFYT; | VTYSTSSFYTN; | TYSTSSFYTNN; |
| YSTSSFYTNNR; | STSSFYTNNRV; | TSSFYTNNRVF; | SSFYTNNRVFK; |
| SFYTNNRVFKQ; | FYTNNRVFKQG; | YTNNRVFKQGT; | TNNRVFKQGTT; |
| NNRVFKQGTTT; | NRVFKQGTTTD; | RVFKQGTTTDR; | VFKQGTTTDRG; |
| FKQGTTTDRGL; | KQGTTTDRGLK; | QGTTTDRGLKF; | GTTTDRGLKFQ; |
| TTTDRGLKFQV; | TTDRGLKFQVT; | TDRGLKFQVTF; | DRGLKFQVTFT; |
| RGLKFQVTFTV; | GLKFQVTFTVK; | LKFQVTFTVKD; | KFQVTFTVKDP; |
| FQVTFTVKDPD; | QVTFTVKDPDV; | VTFTVKDPDVL; | TFTVKDPDVLN; |
| FTVKDPDVLNN; | TVKDPDVLNNR; | VKDPDVLNNRL; | KDPDVLNNRLV; |
| DPDVLNNRLVD; | PDVLNNRLVDF; | DVLNNRLVDFV; | VLNNRLVDFVI; |
| LNNRLVDFVID; | NNRLVDFVIDL; | NRLVDFVIDLF; | RLVDFVIDLFN; |
| LVDFVIDLFNK; | VDFVIDLFNKT; | DFVIDLFNKTT; | FVIDLFNKTTS; |
| VIDLFNKTTSG; | IDLFNKTTSGF; | DLFNKTTSGFY; | LFNKTTSGFYY; |
| FNKIISGLLVP; | NKIISGLLVPD; | KIISGLLVPDG; | IISGLLVPDG; |

Fig. 31 continued

| | |
|---|---|
| | IGGELIVPDSE; GGELIVPDSEY; GELIVPDSEYA; ELIVPDSEYAF; LIVPDSEYAFD; IVPDSEYAFDL; VPDSEYAFDLF; PDSEYAFDLFK; DSEYAFDLFKS; SEYAFDLFKSK; EYAFDLFKSKL; |
| NP_212519.1B Basic membrane protein D (bmpD) [Borrelia burgdorferi B31] | SEQ ID NO 407; 5480/ 8 mers: MKNYYELY; KNYYELYF; NYYELYFF; YYELYFFT; YELYFFTK; ELYFFTKS; LYFFTKSK; YFFTKSKF; FFTKSKFD; FTKSKFDT; TKSKFDTF; KSKFDTFM; SKFDTFML; KFDTFMLK; FDTFMLKK; DTFMLKKV; TFMLKKVY; FMLKKVYF; MLKKVYFL; LKKVYFLT; KKVYFLTF; KVYFLTFV; VYFLTFVY; YFLTFVYS; FLTFVYSV; LTFVYSVA; TFVYSVAC; FVYSVACS; VYSVACSS; YSVACSSD; SVACSSDD; VACSSDDC; ACSSDDCK; CSSDDCKS; SSDDCKSF; SDDCKSFA; DDCKSFAK; DCKSFAKT; CKSFAKTV; KSFAKTVS; SFAKTVSL; FAKTVSLT; AKTVSLTV; KTVSLTVD; TVSLTVDG; VSLTVDGA; SLTVDGAF; LTVDGAFD; TVDGAFDD; VDGAFDDK; DGAFDDKG; GAFDDKGF; AFDDKGFN; FDDKGFNP; DDKGFNPS; DKGFNPSS; KGFNPSSS; GFNPSSSK; FNPSSSKA; NPSSSKAT; PSSSKATR; SSSKATRK; SSKATRKL; SKATRKLK; KATRKLKA; ATRKLKAD; TRKLKADL; RKLKADLN; KLKADLNT; LKADLNTN; KADLNTNT; ADLNTNTT; DLNTNTTF; LNTNTTFK; NTNTTFKA; TNTTFKAS; NTTFKAST; TTFKASTG; TFKASTGN; FKASTGNS; KASTGNSY; ASTGNSYL; STGNSYLG; TGNSYLGD; GNSYLGDT; NSYLGDTA; SYLGDTAN; YLGDTANL; LGDTANLR; GDTANLRD; DTANLRDG; TANLRDGN; ANLRDGNS; NLRDGNSN; LRDGNSNL; RDGNSNLT; DGNSNLTW; GNSNLWG; NSNLWGLG; SNLWGLGF; NLWGLGFR; LWGLGFRL; WGLGFRLS; GLGFRLSD; LGFRLSDL; GFRLSDLF; FRLSDLFQ; RLSDLFQR; LSDLFQRA; SDLFQRAS; DLFQRASE; LFQRASEN; FQRASENV; QRASENVG; RASENVGV; ASENVGVN; SENVGVNY; ENVGVNYA; NVGVNYAL; VGVNYALL; GVNYALLE; VNYALLEG; NYALLEGV; YALLEGVY; ALLEGVYD; LLEGVYDE; LEGVYDEL; EGVYDELQ; GVYDELQL; VYDELQLP; YDELQLPK; DELQLPKN; ELQLPKNL; LQLPKNLL; QLPKNLLN; LPKNLLNL; PKNLLNLS; KNLLNLSF; LLNLSFR; LNLSFRS; NLSFRSE; LSFRSEE; SFRSEEV; FRSEEVA; RSEEVAF; SEEVAFL; EEVAFLA; EVAFLAG; VAFLAGY; AFLAGYF; FLAGYFA; LAGYFAS; AGYFASK; GYFASKA; YFASKAS; FASKASK; ASKASKT; SKASKTG; KASKTGK; ASKTGKI; SKTGKIG; KTGKIGV; TGKIGVG; GKIGVGG; KIGVGGV; IGVGGVR; GVGGVRG; VGGVRGK; GGVRGKV; GVRGKVL; VRGKVLE; RGKVLES; GKVLESF; KVLESFY; VLESFYG; LESFYGY; ESFYGYE; SFYGYEA; FYGYEAG; YGYEAGA; GYEAGAK; YEAGAKY; EAGAKYA; AGAKYAN; GAKYANS; AKYANSN; KYANSNT; YANSNTK; ANSNTKV; NSNTKVV; SNTKVVS; NTKVVSQ; TKVVSQY; KVVSQYV; VVSQYVG; VSQYVGT; SQYVGTF; QYVGTFG; YVGTFGD; VGTFGDF; GTFGDFG; TFGDFGL; FGDFGLG; GDFGLGR; DFGLGRS; FGLGRST; GLGRSTA; LGRSTAS; GRSTASN; RSTASNM; STASNMY; TASNMYR; ASNMYRD; SNMYRDG; NMYRDGV; MYRDGVD; YRDGVDT; RDGVDTT; DGVDTTF; GVDTTFA; VDTTFAA; DTTFAAA; TTFAAAG; TFAAAGL; FAAAGLS; AAAGLSG; AAGLSGT; AGLSGTG; GLSGTGV; LSGTGVT; SGTGVTF; GTGVTFA; TGVTFAA; GVTFAAK; VTFAAKF; TFAAKFL; FAAKFLG; AAKFLGP; AKFLGPD; KFLGPDH; FLGPDHY; LGPDHYT; GPDHYTG; PDHYTGV; DHYTGVD; HYTGVDQ; YTGVDQD; TGVDQDQ; GVDQDQS; VDQDQSY; DQDQSYL; QDQSYLA; DQSYLAP; QSYLAPN; SYLAPNN; YLAPNNV; LAPNNVT; APNNVTV; PNNVTVS; NNVTVSA; NVTVSAV; VTVSAVK; TVSAVKK; VSAVKKV; SAVKKVD; AVKKVDS; VKKVDSL; KKVDSLM; KVDSLMY; VDSLMYS; DSLMYSL; SLMYSLT; LMYSLTK; MYSLTKK; YSLTKKY; SLTKKYL; LTKKYLE; TKKYLET; KKYLETG; KYLETGV; YLETGVL; LETGVLD; ETGVLDG; TGVLDGG; GVLDGGK; VLDGGKT; LDGGKTM; DGGKTMF; GGKTMFL; GKTMFLG; KTMFLGL; TMFLGLK; MFLGLKF; FLGLKFD; LGLKFDQ; |

| | | | |
|---|---|---|---|
| DKGFNFGGKAI; | KGFNFGGKAIR; | GFNFGGKAIRK; | FNFGGKAIRKL; |
| NFGGKATRKL; | FGGKATRKLK; | GGKATRKLKA; | GGKATRKLKAD; |
| GKAIRKLKADL; | KAIRKLKADLN; | AIRKLKADLNI; | IRKLKADLNIN; |
| RKLKADLNTNT; | KLKADLNTNTT; | LKADLNTNTTK; | KADLNTNTTKK; |
| ADLNINIIEKA; | DLNINIIEKAS; | LNINIIEKAST; | NINIIEKASTG; |
| IIIEKASTGN; | IIEKASTGNS; | IEKASTGNSV; | EKASTGNSYL; |
| KASTGNSYLG; | ASTGNSYLGD; | ASTGNSYLGDT; | STGNSYLGDTA; |
| TGNSYLGDTAN; | GNSYLGDTANL; | NSYLGDTANLE; | SYLGDTANLED; |
| YLGDTANLEDG; | LGDTANLEDGN; | GDTANLEDGNS; | DTANLEDGNSN; |
| TANLEDGNSNL; | ANLEDGNSNLT; | NLEDGNSNLTW; | LEDGNSNLTWG; |
| EDGNSNLTWGT; | DGNSNLTWGTG; | GNSNLTWGTGF; | NSNLTWGTGFR; |
| SNLTWGTGFRL; | NLTWGTGFRLS; | LTWGTGFRLSD; | TWGTGFRLSDT; |
| WGTGFRLSDTI; | GTGFRLSDTLF; | TGFRLSDTLFQ; | GFRLSDTLFQR; |
| FRLSDTLFQRA; | RLSDTLFQRAS; | LSDTLFQRASE; | SDTLFQRASEN; |
| DTLFQRASENV; | TLFQRASENVS; | LFQRASENVSV; | FQRASENVSVN; |
| QRASENVSVNY; | RASENVSVNYA; | ASENVSVNYAT; | SENVSVNYATT; |
| ENVSVNYATTF; | NVSVNYATTFG; | VSVNYATTFGV; | SVNYATTFGVY; |
| VNYATTFGVYD; | NYATTFGVYDE; | YATTFGVYDET; | ATTFGVYDETQ; |
| TTFGVYDETQT; | TFGVYDETQTP; | FGVYDETQTPK; | GVYDETQTPKN; |
| VYDETQTPKNL; | YDETQTPKNLL; | DETQTPKNLLN; | ETQTPKNLLNT; |
| TQTPKNLLNTS; | QTPKNLLNTSF; | TPKNLLNTSFR; | PKNLLNTSFRS; |
| KNLLNTSFRSE; | NLLNTSFRSEE; | LLNTSFRSEEV; | LNTSFRSEEVA; |
| NTSFRSEEVAF; | TSFRSEEVAFL; | SFRSEEVAFLA; | FRSEEVAFLAG; |
| RSEEVAFLAGY; | SEEVAFLAGYF; | EEVAFLAGYFA; | EVAFLAGYFAS; |
| VAFLAGYFASK; | AFLAGYFASKA; | FLAGYFASKAS; | LAGYFASKASK; |
| AGYFASKASKI; | GYFASKASKIG; | YFASKASKIGK; | FASKASKIGKI; |
| ASKASKTGKIG; | SKASKTGKIGF; | KASKTGKIGFV; | ASKTGKIGFVG; |
| SKTGKIGFVGG; | KTGKIGFVGGV; | TGKIGFVGGVR; | GKIGFVGGVRG; |
| KIGFVGGVRGK; | IGFVGGVRGKV; | GFVGGVRGKVL; | FVGGVRGKVLE; |
| VGGVRGKVLES; | GGVRGKVLESF; | GVRGKVLESFM; | VRGKVLESFMY; |
| RGKVLESFMYG; | GKVLESFMYGY; | KVLESFMYGYF; | VLESFMYGYFA; |
| LESFMYGYFAG; | ESFMYGYFAGA; | SFMYGYFAGAK; | FMYGYFAGAKY; |
| MYGYFAGAKYA; | YGYFAGAKYAD; | GYFAGAKYADS; | YFAGAKYADSN; |
| FAGAKYADSNI; | AGAKYADSNIK; | GAKYADSNIKV; | AKYADSNIKVV; |
| KYADSNIKVVS; | YADSNIKVVSQ; | ADSNIKVVSQY; | DSNIKVVSQYV; |
| SNIKVVSQYVG; | NIKVVSQYVGT; | IKVVSQYVGTF; | KVVSQYVGTFG; |
| VVSQYVGTFGD; | VSQYVGTFGDF; | SQYVGTFGDFG; | QYVGTFGDFGL; |
| YVGTFGDFGLG; | VGTFGDFGLGR; | GTFGDFGLGRS; | TFGDFGLGRST; |
| FGDFGLGRSTA; | GDFGLGRSTAS; | DFGLGRSTASN; | FGLGRSTASNM; |
| GLGRSTASNMY; | LGRSTASNMYR; | GRSTASNMYRD; | RSTASNMYRDG; |
| STASNMYRDGV; | TASNMYRDGVD; | ASNMYRDGVDT; | SNMYRDGVDTF; |
| NMYRDGVDTFA; | MYRDGVDTFAA; | YRDGVDTFAAA; | RDGVDTFAAAG; |
| DGVDTFAAAGI; | GVDTFAAAGIS; | VDTFAAAGISG; | DTFAAAGISGT; |
| TFAAAGISGT; | FAAAGISGTGV; | AAAGISGTGVT; | AAGISGTGVTA; |
| AAGISGTGVTA; | AGISGTGVTAA; | GISGTGVTAAK; | ISGTGVTAAKR; |
| SGTGVTAAKR; | GTGVTAAKRL; | TGVTAAKRLQ; | GVTAAKRLQP; |
| VTAAKRLQPD; | TAAKRLQPDE; | AAKRLQPDEY; | AKRLQPDEYT; |
| AKRLQPDHYT; | KRLQPDHYTT; | RLQPDHYTTG; | LQPDHYTTGV; |
| QPDHYTTGVD; | PDHYTTGVDQ; | DHYTTGVDQQ; | HYTTGVDQQS; |
| YTTGVDQQSY; | TTGVDQQSYL; | TGVDQQSYLA; | GVDQQSYLAP; |
| VDQQSYLAPN; | DQQSYLAPNN; | QQSYLAPNNV; | QSYLAPNNVT; |
| QSYLAPNNVTV; | SYLAPNNVTVS; | YLAPNNVTVSA; | LAPNNVTVSAV; |
| APNNVTVSAVK; | PNNVTVSAVKK; | NNVTVSAVKKV; | NVTVSAVKKVS; |
| VTVSAVKKVDS; | TVSAVKKVDSL; | VSAVKKVDSLM; | SAVKKVDSLMY; |
| AVKKVDSLMYS; | VKKVDSLMYSL; | KKVDSLMYSLT; | KVDSLMYSLTK; |
| VDSLMYSLTKK; | DSLMYSLTKKY; | SLMYSLTKKYL; | LMYSLTKKYLE; |
| MYSLTKKYLET; | YSLTKKYLETG; | SLTKKYLETGV; | LTKKYLETGVL; |

Fig. 31 continued

| | |
|---|---|
| | TKKYLETGVLD; KKYLETGVLDG; KYLETGVLDGG; YLETGVLDGGK; LETGVLDGGKT; ETGVLDGGKTM; TGVLDGGKTMF; GVLDGGKTMFL; VLDGGKTMFLG; LDGGKTMFLGL; DGGKTMFLGLK; GGKTMFLGLKE; GKTMFLGLKED; KTMFLGLKEDG; TMFLGLKEDGL; MFLGLKEDGLG; FLGLKEDGLGL; LGLKEDGLGLV; GLKEDGLGLVL; LKEDGLGLVLN; KEDGLGLVLNF; EDGLGLVLNPG; DGLGLVLNPGL; GLGLVLNPGLK; LGLVLNPGLKS; GLVLNPGLKSN; LVLNPGLKSNY; VLNPGLKSNYS; LNPGLKSNYSF; NPGLKSNYSFT; PGLKSNYSFTY; GLKSNYSFTYN; LKSNYSFTYNK; KSNYSFTYNKS; SNYSFTYNKSL; NYSFTYNKSLK; YSFTYNKSLKT; SFTYNKSLKTQ; FTYNKSLKTQQ; TYNKSLKTQQS; YNKSLKTQQST; NKSLKTQQSTM; KSLKTQQSTMN; SLKTQQSTMNG; LKTQQSTMNGT; KTQQSTMNGTT; TQQSTMNGTTK; QQSTMNGTTKV; QSTMNGTTKVP; STMNGTTKVPY; TMNGTTKVPYD; MNGTTKVPYDK; NGTTKVPYDKV; GTTKVPYDKVS; TTKVPYDKVSY; TKVPYDKVSYF; KVPYDKVSYFV; VPYDKVSYFVL; PYDKVSYFVLQ; YDKVSYFVLQM; DKVSYFVLQMF; KVSYFVLQMFN; |
| AAC70056.1 Decorin binding protein A; DbpA [Borrelia afzelii] | SEQ ID NO 5481-6126/ 9 mers: MIKYNKTT; IKYNKTTL; KYNKTTLT; YNKTTLTL; NKTTLTLT; KTTLTLTL; TTLTLTLL; TLTLTLLA; LTLTLLAS; TLTLLASL; LTLLASLL; TLLASLLA; LLASLLAA; LASLLAAC; ASLLAACS; SLLAACSL; LLAACSLT; LAACSLTG; AACSLTGK; ACSLTGKA; CSLTGKAR; SLTGKARL; LTGKARLE; TGKARLES; GKARLESS; KARLESSV; ARLESSVK; RLESSVKD; LESSVKDT; ESSVKDTT; SSVKDTTN; SVKDTTNE; VKDTTNEI; KDTTNEIE; DTTNEIEK; TTNEIEKA; TNEIEKAT; NEIEKATK; EIEKATKE; IEKATKEA; EKATKEAE; KATKEAED; ATKEAEDA; TKEAEDAG; KEAEDAGV; EAEDAGVK; AEDAGVKT; EDAGVKTD; DAGVKTDA; AGVKTDAF; GVKTDAFT; VKTDAFTE; KTDAFTET; TDAFTETQ; DAFTETQT; AFTETQTG; FTETQTGG; TETQTGGK; ETQTGGKV; TQTGGKVG; QTGGKVGS; TGGKVGSS; GGKVGSSQ; GKVGSSQL; KVGSSQLR; VGSSQLRA; GSSQLRAA; SSQLRAAK; SQLRAAKI; QLRAAKIR; LRAAKIRV; RAAKIRVA; AAKIRVAD; AKIRVADL; KIRVADLT; IRVADLTI; RVADLTIK; VADLTIKF; ADLTIKFL; DLTIKFLE; LTIKFLEA; TIKFLEAT; IKFLEATE; KFLEATEE; FLEATEEL; LEATEELT; EATEELTI; ATEELTIE; TEELTIEF; EELTIEFK; ELTIEFKE; LTIEFKEG; TIEFKEGA; IEFKEGAG; FKEGAGEE; KEGAGEEE; EGAGEEED; GAGEEEDS; AGEEEDSG; GEEEDSGI; EEEDSGIY; EEDSGIYD; EDSGIYDL; DSGIYDLI; SGIYDLIL; GIYDLILN; IYDLILNA; YDLILNAA; DLILNAAK; LILNAAKA; ILNAAKAV; LNAARAVE; NAARAVER; AARAVERK; ARAVERKT; RAVERKTG; AVERKTGR; VERKTGRQ; ERKTGRQG; RKTGRQGM; KTGRQGMK; TGRQGMKQ; GRQGMKQA; RQGMKQAV; QGMKQAVE; GMKQAVEE; MKQAVEEA; KQAVEEAA; QAVEEAAK; AVEEAAKE; VEEAAKEK; EEAAKEKP; EAAKEKPK; AAKEKPKT; AKEKPKTT; KEKPKTTA; EKPKTTAD; KPKTTADG; PKTTADGT; KTTADGTT; TTADGTTA; TADGTTAT; ADGTTATV; DGTTATVK; GTTATVKV; TTATVKVK; TATVKVKA; ATVKVKAK; TVKVKAKV; VKVKAKVE; KVKAKVEV; VKAKVEVT; KAKVENTK; AKVENTKE; KVENTKEK; VENTKEKQ; ENTKEKQT; NTKEKQTK; TKEKQTKN; KEKQTKNQ; EKQTKNQK;

9 mers: MIKYNKTT; IKYNKTTL; KYNKTTLT; YNKTTLTL; NKTTLTLT; KTTLTLTL; TTLTLTLL; TLTLTLLA; LTLTLLAS; TLTLLASL; LTLLASLL; TLLASLLA; LLASLLAA; LASLLAAC; ASLLAACS; SLLAACSL; LLAACSLT; LAACSLTG; AACSLTGK; ACSLTGKA; CSLTGKAR; SLTGKARL; LTGKARLE; TGKARLES; GKARLESS; KARLESSV; ARLESSVK; RLESSVKD; LESSVKDT; ESSVKDTT; SSVKDTTN; SVKDTTNE; VKDTTNEI; KDTTNEIE; DTTNEIEK; TTNEIEKA; TNEIEKAT; NEIEKATK; EIEKATKE; IEKATKEA; EKATKEAE; |

KFEAFINT; FEAFTNTQ; EAFTNTQT; AFTNTQTG; FTNTQTGS; TNTQTGSK;
NTQTGSKI; TQTGSKIS; QTGSKISE; TGSKISEK; GSKISEKP; SKISEKPF;
KISEKPEF; ISEKPEFI; SEKPEFIL; EKPEFILK; KPEFILKA; PEFILKAK;
EFILKAKI; FILKAKIK; ILKAKIKA; LKAKIKAI; KAKIKAIQ; AKIKAIQV;
KIKAIQVA; IKAIQVAE; KAIQVAE

ALKNLEEKA; LKNLEEKAN; KNLEEKANT; NLEEKANTA; LEEKANTAA;
EEKANTAAT; EKANTAATT; KANTAATTT;

10 mers:
MIKYNKILLK; IKYNKILLKL; KYNKILLKLS; YNKILLKLSL; NKILLKLSLT;
TLLKLSLTV; TLLKLSLTVS; LLKLSLTVSL; LKLSLTVSLL; KLSLTVSLLV;
LSLTVSLLVA; SLTVSLLVAC; LTVSLLVACC; TVSLLVACCL; VSLLVACCLT;
SLLVACCLTC; LLVACCLTCF; LVACCLTCFT; VACCLTCFTK; ACCLTCFTKT;
CCLTCFTKTR; CLTCFTKTRL; LTCFTKTRLF; TCFTKTRLFS; CFTKTRLFSS;
FTKTRLFSSA; TKTRLFSSAQ; KTRLFSSAQF; TRLFSSAQFT; RLFSSAQFTK;
LFSSAQFTKD; FSSAQFTKDF; SSAQFTKDFT; SAQFTKDFTN; AQFTKDFTNK;
QFTKDFTNKT; FTKDFTNKTK; TKDFTNKTKA; KDFTNKTKAN; DFTNKTKANA;
FTNKTKANAK; TNKTKANAKK; NKTKANAKKF; KTKANAKKFC; TKANAKKFCV;
KANAKKFCVK; ANAKKFCVKF; NAKKFCVKFF; AKKFCVKFFA; KKFCVKFFAF;
FCVKFFAFT; CVKFFAFTN; VKFFAFTNT; KFFAFTNTQ;
FFAFTNTQTC; FAFTNTQTCS; AFTNTQTCSK; FTNTQTCSKT; TNTQTCSKTS;
NTQTCSKTSF; TQTCSKTSFK; QTCSKTSFKF; TCSKTSFKFF; CSKTSFKFFT;
SKTSFKFFTL; KTSFKFFTLK; TSFKFFTLKA; SFKFFTLKAK; FKFFTLKAKT;
KFFTLKAKTK; FFTLKAKTKA; FTLKAKTKAT; TLKAKTKATQ;
LKAKTKATQV; KAKTKATQVA; AKTKATQVAF; KTKATQVAFF; TKATQVAFFF;
KATQVAFFFV; ATQVAFFFVK; TQVAFFFVKA; QVAFFFVKAT; VAFFFVKATK;
AFFFVKATKF; FFFVKATKFF; FFVKATKFFA; FVKATKFFAF; VKATKFFAFK;
KATKFFAFKL; ATKFFAFKLK; TKFFAFKLKK; KFFAFKLKKS; FFAFKLKKSC;
LAFKLKKSGS; AFKLKKSGCS; FKLKKSGSCG; KLKKSGSCGA; LKKSGSSGAF;
KKSGSSGAFS; KSGSSGAFSA; SGSSGAFSAM; GSSGAFSAMY; SSGAFSAMYD;
SGAFSAMYDL; GAFSAMYDLM; AFSAMYDLMI; FSAMYDLMID; SAMYDLMIDV;
AMYDLMIDVS; MYDLMIDVSK; YDLMIDVSKF; DLMIDVSKFL; LMIDVSKFLE;
MIDVSKFLEE; IDVSKFLEEI; DVSKFLEEIG; VSKFLEEIGL; SKFLEEIGLQ;
KFLEEIGLQK; FLEEIGLQKE; LEEIGLQKEI; EEIGLQKMTG; EIGLQKMTGI;
IGLQKMTGTV; GLQKMTGTVI; LQKMTGTVIK; QKMTGTVIKF; KMTGTVIKFA;
MTGTVIKFAF; TGTVIKFAFK; GTVIKFAFKI; TVTKFAFKTF; VTKFAFKTFF;
TKFAFKTFFL; KFAFKTFFTT; FAFKTFFTTA; AFKTFFTTAD; FKTFFTTADG;
KTFFTTADGL; TFFTTADGLL; FFTTADGLLA; FTTADGLLAL; TTADGLLALA;
TADGLLALAQ; ADGLLALAQA; DGLLALAQAM; GLLALAQAMF; LLALAQAMFF;
LALAQAMFFK; ALAQAMFFKL; LAQAMFFKLN; AQAMFFKLNN; QAMFFKLNNV;
AMFFKLNNVK; MFFKLNNVKK; FFKLNNVKKQ; FKLNNVKKQH; KLNNVKKQHD;
LNNVKKQHDA; NNVKKQHDAL; NVKKQHDALK; VKKQHDALKN; KKQHDALKNL;
KKQHDALKNL; KQHDALKNLE; QHDALKNLEE; HDALKNLEEK; DALKNLEEKA;
ALKNLEEKAN; LKNLEEKANT; KNLEEKANTA; NLEEKANTAA; LEEKANTAAT;
EEKANTAATT; EKANTAATTT;

11 mers:
MIKYNKTLLKL; IKYNKTLLKLS; KYNKTLLKLSL; YNKTLLKLSLT;
NKTLLKLSLTV; KTLLKLSLTVS; TLLKLSLTVSL; LLKLSLTVSLL;
LKLSLTVSLLV; KLSLTVSLLVA; LSLTVSLLVAC; SLTVSLLVACC;
LTVSLLVACCL; TVSLLVACCLT; VSLLVACCLTC; SLLVACCLTCF;
LLVACCLTCFT; LVACCLTCFTK; VACCLTCFTKT; ACCLTCFTKTR;
CCLTCFTKTRL; CLTCFTKTRLF; LTCFTKTRLFS; TCFTKTRLFSS;
CFTKTRLFSSA; FTKTRLFSSAQ; TKTRLFSSAQF; KTRLFSSAQFT;
TRLFSSAQFTK; RLFSSAQFTKD; LFSSAQFTKDF; FSSAQFTKDFT;
SSAQFTKDFTN; SAQFTKDFTNK; AQFTKDFTNKT; QFTKDFTNKTK;
FTKDFTNKTKA; TKDFTNKTKAN; KDFTNKTKANA; DFTNKTKANAK;
FTNKTKANAKK; TNKTKANAKKF; NKTKANAKKFC; KTKANAKKFCV;
TKANAKKFCVK; KANAKKFCVKF; ANAKKFCVKFF; NAKKFCVKFFA;
AKKFCVKFFAF; KKFCVKFFAFT; KFCVKFFAFTN; FCVKFFAFTNT;
CVKFFAFTNTQ; VKFFAFTNTQT; KFFAFTNTQTC; FFAFTNTQTCS;
FAFTNTQTCSK; AFTNTQTCSKT; FTNTQTCSKTS; TNTQTCSKTSF;

Fig. 31 continued

The image quality is too low to reliably transcribe the peptide sequence tables. Key readable elements:

| | |
|---|---|
| | NTQTGSKISEK; TQTGSKISEKP; QTGSKISEKPE; TGSKISEKPEF; <br> GSKISEKPEFT; SKISEKPEFTL; KISEKPEFTLK; ISEKPEFTLKA; <br> SEKPEFTLKAK; EKPEFTLKAKI; KPEFTLKAKIK; PEFTLKAKIKA; <br> EFTLKAKIKAT; FTLKAKIKATQ; TLKAKIKATQV; LKAKIKATQVA; <br> KAKIKATQVAE; AKIKATQVAER; KIKATQVAERF; IKATQVAERFV; <br> KATQVAERFVK; ATQVAERFVKA; TQVAERFVKAT; QVAERFVKATK; <br> VAERFVKATKE; AERFVKATKEF; ERFVKATKEFA; RFVKATKEFAK; <br> FVKATKEFAKI; VKATKEFAKIK; KATKEFAKIKK; ATKEFAKIKKS; <br> TKEFAKIKKSG; KEFAKIKKSGS; EFAKIKKSGSS; FAKIKKSGSSG; <br> AKIKKSGSSGA; KIKKSGSSGAF; IKKSGSSGAFS; KKSGSSGAFSA; <br> KSGSSGAFSAM; SGSSGAFSAMY; GSSGAFSAMYD; SSGAFSAMYDL; <br> SGAFSAMYDLM; GAFSAMYDLMT; AFSAMYDLMTD; FSAMYDLMTDV; <br> SAMYDLMTDVS; AMYDLMTDVSK; MYDLMTDVSKP; YDLMTDVSKPL; <br> DLMTDVSKPLE; LMTDVSKPLEE; MTDVSKPLEET; TDVSKPLEETG; <br> DVSKPLEETGQ; VSKPLEETGQK; SKPLEETGQKM; KPLEETGQKMT; <br> PLEETGQKMTG; LEETGQKMTGT; EETGQKMTGTV; ETGQKMTGTVT; <br> TGQKMTGTVTK; GQKMTGTVTKE; QKMTGTVTKEA; KMTGTVTKEAE; <br> MTGTVTKEAEK; TGTVTKEAEKT; GTVTKEAEKTP; TVTKEAEKTPP; <br> VTKEAEKTPPT; TKEAEKTPPTT; KEAEKTPPTTA; EAEKTPPTTAD; <br> AEKTPPTTADG; EKTPPTTADGT; KTPPTTADGTT; TPPTTADGTTA; <br> PPTTADGTTAT; PTTADGTTATA; TTADGTTATAQ; TADGTTATAQA; <br> ADGTTATAQAK; DGTTATAQAKE; GTTATAQAKEE; TTATAQAKEEK; <br> TATAQAKEEKL; ATAQAKEEKLN; TAQAKEEKLNN; AQAKEEKLNNV; <br> QAKEEKLNNVK; AKEEKLNNVKK; KEEKLNNVKKQ; EEKLNNVKKQH; <br> EKLNNVKKQHD; KLNNVKKQHDA; LNNVKKQHDAL; NNVKKQHDALK; <br> NVKKQHDALKN; VKKQHDALKNL; KKQHDALKNLE; KQHDALKNLEE; <br> QHDALKNLEEK; HDALKNLEEKA; DALKNLEEKAN; ALKNLEEKANT; LKNLEEKANTA; <br> KNLEEKANTAA; NLEEKANTAAT; LEEKANTAATT; EEKANTAATTT; |
| AAC70021.1 <br> Decorin binding <br> protein B; DbpB <br> [Borrelia burgdorferi] | SEQ ID NO 6827-7522 <br> (peptide fragments, unreadable due to image quality) |

| | |
|---|---|
| | NPINIAERLLA; PINIAERLLAA; INIAERLLAAK; NIAERLLAAKA; TAERLLAAKAQ; AERLLAAKAQT; ERLLAAKAQTE; RLLAAKAQTEN; LLAAKAQIENQ; LAAKAQIENQL; AAKAQIENQLK; AKAQIENQLKV; KAQIENQLKVV; AQIENQLKVVE; QIENQLKVVEE; IENQLKVVEEK; ENQLKVVEEKQ; NQLKVVEEKQN; QLKVVEEKQNI; LKVVEEKQNIE; VV

| | |
|---|---|
| | SYELKDENFKK; NELKDENFKKI; ELKDENFKKIE; LKDENFKKIEE;<br>KDENFKKIEEF; DENFKKIEEFK; ENFKKIEEFKK; NFKKIEEFKKD;<br>FKKIEEFKDI; KKIEEFKDIL; KIEEFKDILT; IEEFKDILTK;<br>EEFKDTLTKV; EFKDTLTKVE; FKDTLTKVEF; (illegible);<br>KDTLKVKEIL; DTLKVKEILK; TLKVKEILKD; LKVKEILKDH;<br>TKVKEILKDET; KVKEILKDETI; VKEILKDETIK; KEILKDETIKV;<br>EILKDETKEVN; ILKDETKEVNI; LKDETKEVNIS; KDETKEVNISA;<br>DETKEVNLSAT; ETKEVNLSATI; TKEVNLSATIE; KEVNLSATIEK;<br>EVNLSATLKEF; VNLSATLKEFS; NLSATLKEFSA; LSATLKEFSAT;<br>SATLKEFSATI; ATLKEFSATII; TLKEFSATIID; LKEFSATIIDS;<br>KEFSATIIDS; EFSATIIDSN; FSATIIDSNE; SATIIDSNDP;<br>ATIIDSNDPT; TIIDSNDPTY; IIDSNDPTYQ; IDSNDPTYQM;<br>DSNDPTYQMQ; SNDPTYQMQK; NDPTYQMQKI; DPTYQMQKIM;<br>PTYQMQKIMLS; TYQMQKIMLSM; YQMQKIMLSMQ;<br>QMQKIMLSMQQ; MQKIMLSMQQF; QKIMLSMQQFV; KIMLSMQQFVK;<br>IMLSMQQFVKE; MLSMQQFVKEI; LSMQQFVKEIK; SMQQFVKEIKP;<br>MQQFVKEIKPT; QQFVKEIKPTI; QFVKEIKPTIE; FVKEIKPTIEL;<br>VKEIKPTIELN; KEIKPTIELNP; EIKPTIELNPN; IKPTIELNPNN;<br>KPTIELNPNNK; PTIELNPNNKT; TIELNPNNKTV; IELNPNNKTVQ;<br>ELNPNNKTVQN; LNPNNKTVQNL; NPNNKTVQNLK; PNNKTVQNLKN;<br>NNKTVQNLKNI; NKTVQNLKNIE; KTVQNLKNIEP; TVQNLKNIEPE;<br>VQNLKNIEPEK; QNLKNIEPEKL; NLKNIEPEKLE; LKNIEPEKLEK;<br>KNIEPEKLEKI; NIEPEKLEKIS; IEPEKLEKIST; EPEKLEKISTL;<br>PEKLEKISTLL; EKLEKISTLLF; KLEKISTLLFE; LEKISTLLFEE;<br>EKISTLLFEEA; KISTLLFEEAM; ISTLLFEEAML; STLLFEEAMLT;<br>TLLFEEAMLTS; LLFEEAMLTSG; LFEEAMLTSGM; FEEAMLTSGMP;<br>EEAMLTSGMPS; EAMLTSGMPSK; AMLTSGMPSKN; MLTSGMPSKNP;<br>LTSGMPSKNPG; TSGMPSKNPGK; SGMPSKNPGKF; GMPSKNPGKFI;<br>MPSKNPGKFIN; PSKNPGKFINI; SKNPGKFINII; KNPGKFINIIN;<br>NPGKFINIINE; PGKFINIINEF; GKFINIINEFI; KFINIINEFIE;<br>FINIINEFIEK; INIINEFIEKD; NIINEFIEKDF; IINEFIEKDFL; |
| CAA44492.1 Outer surface protein A [Borrelia burgdorferi] | SEQ ID NO 10088 111497<br>8 mers:<br>MKKYLLGI; KKYLLGIG; KYLLGIGL; YLLGIGLL; LLGIGLLL; LGIGLLLA;<br>GIGLLLAL; IGLLLALI; GLLLALIA; LLLALIAC; LLALIACK; LALIACKQ;<br>ALIACKQN; LIACKQNV; IACKQNVS; ACKQNVST; CKQNVSTL; KQNVSTLD;<br>QNVSTLDE; NVSTLDEK; VSTLDEKN; STLDEKNS; TLDEKNSV; LDEKNSVS;<br>DEKNSVSV; EKNSVSVD; KNSVSVDL; NSVSVDLP; SVSVDLPG; VSVDLPGG;<br>SVDLPGGM; VDLPGGMT; DLPGGMTE; LPGGMTEL; PGGMTELV; GGMTELVS;<br>GMTELVSK; MTELVSKE; TELVSKEK; ELVSKEKD; LVSKEKDK; VSKEKDKD;<br>SKEKDKDG; KEKDKDGK; EKDKDGKY; KDKDGKYS; DKDGKYSL; KDGKYSLE;<br>DGKYSLEA; GKYSLEAT; KYSLEATV; YSLEATVD; SLEATVDK; LEATVDKI;<br>EATVDKLF; ATVDKLFI; TVDKLFLK; VDKLFLKQ; DKLFLKQT; KLFLKQTS;<br>LFLKQTSD; FLKQTSDK; LKQTSDKN; KQTSDKNN; QTSDKNNG; TSDKNNGS;<br>SDKNNGSQ; DKNNGSQT; KNNGSQTL; NNGSQTLE; NGSQTLEG; GSQTLEGK;<br>SQTLEGKE; QTLEGKET; TLEGKETD; LEGKETDK; EGKETDKS; GKETDKSK;<br>KETDKSKV; ETDKSKVE; TDKSKVKI; DKSKVKLT; KSKVKLTI; SKVKLTIA;<br>KVKLTIAD; VKLTIADD; KLTIADDL; LTIADDLS; TIADDLSQ; IADDLSQT;<br>ADDLSQTK; DDLSQTKF; DLSQTKFE; LSQTKFEI; SQTKFEIE; QTKFEIEK;<br>TKFEIEEK; KFEIEKFD; FEIEKFDA; EIEKFDAK; IEKFDAKT; FKFDAKTI;<br>KFDAKTIV; FDAKTIVS; DAKTIVSK; AKTIVSKK; KTIVSKKV; TIVSKKVT;<br>IVSKKVTL; VSKKVTLK; SKKVTLKD; KKVTLKDK; KVTLKDKS; VTLKDKSS;<br>TLKDKSST; LKDKSSTE; KDKSSTEE; DKSSTEEK; KSSTEEKF; SSTEEKFN;<br>STEEKFNE; TEEKFNEK; EEKFNEKG; EKFNEKGE; KFNEKGET; FNEKGETS;<br>NEKGETSE; EKGETSEK; KGETSEKT; GETSEKTI; ETSEKTIV; TSEKTIVR;<br>SEKTIVRA; EKTIVRAN; KTIVRANG; TIVRANGT; IVRANGTR; VRANGTRL; |

LAADGKITLK; AADGKITLKV; ADGKITLKVT; DGKITLKVTE; GKITLKVTEG;
KITLKVTEGT; TILKVTEGTV; TLKVTEGTVV; LKVTEGTVVL; KVTEGTVVLS;
VTEGTVVLSK; TEGTVVLSKN; EGTVVLSKNI; GTVVLSKNIL; TVVLSKNILK;
VVLSKNILKS; VLSKNILKSG; LSKNILKSGE; SKNILKSGEI; KNILKSGEIT;
NILKSGEITV; ILKSGEITVA; LKSGEITVAL; KSGEITVALD; SGEITVALDD;
GEITVALDDS; EITVALDDSD; ITVALDDSDT; TVALDDSDTT; VALDDSDTTQ;
ALDDSDTTQA; LDDSDTTQAT; DDSDTTQATK; DSDTTQAT

| | |
|---|---|
| | LEYIDIKSDGS; EYIDIKSDGSG; YIDIKSDGSGK; IDIKSDGSGKA; DIKSDGSGKAK; IKSDGSGKAKF; KSDGSGKAKFV; SDGSGKAKFVL; DGSGKAKFVLK; GSGKAKFVLKD; SGKAKFVLKDF; GKAKFVLKDFT; KAKFVLKDFTL; AKFVLKDFTLE; KFVLKDFTLEG; FVLKDFTLEGT; VLKDFTLEGTL; LKDFTLEGTLA; KDFTLEGTLAA; DFTLEGTLAAD; FTLEGTLAADG; TLEGTLAADGK; LEGTLAADGKT; EGTLAADGKTT; GTLAADGKTTL; TLAADGKTTLK; LAADGKTTLKV; AADGKTTLKVT; ADGKTTLKVTF; DGKTTLKVTFG; GKTTLKVTFGT; KTTLKVTFGTV; TTLKVTFGTVV; TLKVTFGTVVL; LKVTFGTVVLS; KVTFGTVVLSK; VTFGTVVLSKN; TFGTVVLSKNI; FGTVVLSKNIL; GTVVLSKNILK; TVVLSKNILKS; VVLSKNILKSG; VLSKNILKSGE; LSKNILKSGEI; SKNILKSGEII; KNILKSGEIIV; NILKSGEIIVA; ILKSGEIIVAL; LKSGEIIVALD; KSGEIIVALDD; SGEIIVALDDS; GEIIVALDDSE; EIIVALDDSDI; IIVALDDSDII; IVALDDSDIIQ; VALDDSDIIQA; ALDDSDIIQAI; LDDSDIIQAIK; DDSDIIQAIKI; DSDIIQAIKIT; SDIIQAIKITG; DIIQAIKITGT; IIQAIKITGTV; IQAIKITGTVL; QAIKITGTVLG; AIKITGTVLGK; IKITGTVLGKV; KITGTVLGKVS; ITGTVLGKVSV; TGTVLGKVSVE; GTVLGKVSVEV; TVLGKVSVEVG; VLGKVSVEVGD; LGKVSVEVGDE; GKVSVEVGDEK; KVSVEVGDEKT; VSVEVGDEKTL; SVEVGDEKTLT; VEVGDEKTLTV; EVGDEKTLTVN; VGDEKTLTVNS; GDEKTLTVNSQ; DEKTLTVNSQK; EKTLTVNSQKT; KTLTVNSQKTK; TLTVNSQKTKN; LTVNSQKTKNL; TVNSQKTKNLV; VNSQKTKNLVF; NSQKTKNLVFT; SQKTKNLVFTK; QKTKNLVFTKE; KTKNLVFTKED; TKNLVFTKEDT; KNLVFTKEDTI; NLVFTKEDTIT; LVFTKEDTITV; VFTKEDTITVQ; FTKEDTITVQK; TKEDTITVQKY; KEDTITVQKYD; EDTITVQKYDS; DTITVQKYDSA; TITVQKYDSAG; ITVQKYDSAGT; TVQKYDSAGTN; VQKYDSAGTNL; QKYDSAGTNLE; KYDSAGTNLEG; YDSAGTNLEGK; DSAGTNLEGKA; SAGTNLEGKAV; AGTNLEGKAVE; GTNLEGKAVEI; TNLEGKAVEIT; NLEGKAVEITT; LEGKAVEITTL; EGKAVEITTLK; GKAVEITTLKE; KAVEITTLKEL; AVEITTLKELK; VEITTLKELKN; EITTLKELKNA; ITTLKELKNAL; TTLKELKNALK; |
| [BAA22361.1] Outer surface protein B [Borrelia garinii] | SEQ ID NO 11158-12377<br>8 mers:<br>PKKYLLGF; KKYLLGFA; KYLLGFAL; YLLGFALV; LLGFALVL; LGFALVLA; GFALVLAL; FALVLALL; ALVLALLA; LVLALLAC; VLALLACG; LALLACGQ; ALLACGQK; LLACGQKG; LACGQKGA; ACGQKGAE; CGQKGAEP; GQKGAEPK; QKGAEPKH; KGAEPKHN; GAEPKHNQ; AEPKHNQE; EPKHNQEV; PKHNQEVE; KHNQEVEE; HNQEVEED; NQEVEEDQ; QEVEEDQK; EVEEDQKK; VEEDQKKD; EEDQKKDS; EDQKKDSK; DQKKDSKK; QKKDSKKD; KKDSKKDQ; KDSKKDQK; DSKKDQKE; SKKDQKEA; KKDQKEAS; KDQKEASK; DQKEASKK; QKEASKKD; KEASKKDL; EASKKDLP; ASKKDLPL; SKKDLPLV; KKDLPLVT; KDLPLVTE; DLPLVTEE; LPLVTEET; PLVTEETV; LVTEETVK; VTEETVKL; TEETVKLE; EETVKLEN; ETVKLEND; TVKLENDT; VKLENDTK; KLENDTKF; LENDTKFL; ENDTKFLE; NDTKFLET; DTKFLETS; TKFLETSK; KFLETSKE; FLETSKEN; LETSKENK; ETSKENKK; TSKENKKK; SKENKKKD; KENKKKDK; ENKKKDKY; NKKKDKYE; KKKDKYEL; KKDKYELR; KDKYELRA; DKYELRAT; KYELRATV; YELRATVD; ELRATVDT; LRATVDTV; RATVDTVE; ATVDTVEL; TVDTVELK; VDTVELKQ; DTVELKQV; TVELKQVA; VELKQVAD; ELKQVADK; LKQVADKN; KQVADKND; QVADKNDG; VADKNDGS; ADKNDGSG; DKNDGSGG; KNDGSGGR; NDGSGGKL; DGSGGKLF; GSGGKLFQ; SGGKLFQV; GGKLFQVK; GKLFQVKS; KLFQVKSD; LFQVKSDQ; FQVKSDQS; QVKSDQSK; VKSDQSKV; KSDQSKVT; SDQSKVTM; DQSKVTMS; QSKVTMST; SKVTMSTT; KVTMSTTD; VTMSTTDD; TMSTTDDI; MSTTDDIN; STTDDINT; TTDDINTI; TDDINTIT; DDINTITV; DINTITVF; INTITVFY; NTITVFYD; TITVFYDS; ITVFYDSN; TVFYDSNT; VFYDSNTK; FYDSNTKV; YDSNTKVA; DSNTKVAS; SNTKVASK; NTKVASKV; TKVASKVF; KVASKVFK; VASKVFKK; ASKVFKKQ; SKVFKKQG; KVFKKQGS; VFKKQGSL; FKKQGSLT; KQGSLTEE; QGSLTEET; GSLTEETE; SLTEETEE; LTEETEET; TEETEETY; |

Fig. 31 continued

EETEEIYK; EIEETYKI; EETYKIG; EETYKIGK; ETYKIGKI; TYKIGKLS;
YKIGKLST; KIGKLSTK; IGKLSTKK; GKLSTKKI; KLSTKKII; LSTKKIIR;
STKKIIRI; KKIIRIN; KKIIRING; KIIRINGT; IIRINGTI; IRINGTTL;
RINGTTLR; INGTTLEY; NGTTLEYS; GTTLEYSD; TTLEYSDM; TLEYSDMI;
LEYSDMIN; EYSDMIND; YSDMINDE; SDMINDEN; DMINDENA; MINDENAI;
IDENAIK; NDENAIKA; DENAIKAV; ENAIKAVE; NAIKAVET; AIKAVETI;
IKAVETLR; KAVETLRN; AVETLRNG; VETLRNGI; ETLRNGIM; TLRNGIMI;
LRNGIMLE; RNGIMLEG

YKTGKLSTK; KTGKLSTKK; TGKLSTKKI; GKLSTKKIT; KLSTKKITR;
LSTKKITRT; STKKITRTN; TKKITRTNG; KKITRTNGT; KITRTNGTT;
ITRTNGTTL; TRTNGTTLE; RTNGTTLEY; TNGTTLEYS; NGTTLEYSD;
GTTLEYSDM; TTLEYSDMT; TLEYSDMTN; LEYSDMTND; EYSDMTNDE;
YSDMTNDEN; SDMTNDENA; DMTNDENAT; MTNDENATK; TNDENATKA;
NDENATKAV; DENATKAVE; ENATKAVET; NATKAVETL; ATKAVETLK;
TKAVETLKN; KAVETLKNG; AVETLKNGT; VETLKNGTM; ETLKNGTML;
TLKNGTMLE; LKNGTMLEG; KNGTMLEGN; NGTMLEGNL; GTMLEGNLV;
TMLEGNLVG; MLEGNLVGG; LEGNLVGGK; EGNLVGGKT; GNLVGGKTS;
NLVGGKTSV; LVGGKTSVE; VGGKTSVET; GGKTSVETK; GKTSVETKE;
KTSVETKEG; TSVETKEGT; SVETKEGTV; VETKEGTVT; ETKEGTVTL;
TKEGTVTLK; KEGTVTLKK; EGTVTLKKE; GTVTLKKEI; TVTLKKEIE;
VTLKKEIEK; TLKKEIEKA; LKKEIEKAG; KKEIEKAGT; KEIEKAGTV;
EIEKAGTVK; IEKAGTVKL; EKAGTVKLF; KAGTVKLFL; AGTVKLFLD;
GTVKLFLDD; TVKLFLDDT; VKLFLDDTS; KLFLDDTSS; LFLDDTSSG;
FLDDTSSGS; LDDTSSGST; DDTSSGSTK; DTSSGSTKK; TSSGSTKKT;
SSGSTKKTA; SGSTKKTAV; GSTKKTAVW; STKKTAVWS; TKKTAVWSD;
KKTAVWSDT; KTAVWSDTS; TAVWSDTSN; AVWSDTSNT; VWSDTSNTL;
WSDTSNTLT; SDTSNTLTV; DTSNTLTVS; TSNTLTVSA; SNTLTVSAD;
NTLTVSADS; TLTVSADSK; LTVSADSKK; TVSADSKKT; VSADSKKTK;
SADSKKTKD; ADSKKTKDF; DSKKTKDFV; SKKTKDFVF; KKTKDFVFL;
KTKDFVFLT; TKDFVFLTD; KDFVFLTDG; DFVFLTDGT; FVFLTDGTI;
VFLTDGTIT; FLTDGTITV; LTDGTITVQ; TDGTITVQN; DGTITVQNY;
GTITVQNYD; TITVQNYDT; ITVQNYDTA; TVQNYDTAG; VQNYDTAGT;
QNYDTAGTK; NYDTAGTKL; YDTAGTKLA; DTAGTKLAG; TAGTKLAGT;
AGTKLAGTA; GTKLAGTAT; TKLAGTATE; KLAGTATEI; LAGTATEIK;
AGTATEIKD; GTATEIKDL; TATEIKDLE; ATEIKDLEA; TEIKDLEAL;
EIKDLEALK; IKDLEALKA; KDLEALKAA; DLEALKAAL; LEALKAALK;

10 mers:
MKKYLLGFAL; KKYLLGFALV; KYLLGFALVL; YLLGFALVLA; LLGFALVLAL;
LGFALVLALL; GFALVLALLA; FALVLALLAC; ALVLALLACG; LVLALLACGQ;
VLALLACGQK; LALLACGQKG; ALLACGQKGA; LLACGQKGAE; LACGQKGAEP;
ACGQKGAEPK; CGQKGAEPKH; GQKGAEPKHN; QKGAEPKHND; KGAEPKHNDQ;
GAEPKHNDQE; AEPKHNDQEV; EPKHNDQEVE; PKHNDQEVED; KHNDQEVEDS;
HNDQEVEDSK; NDQEVEDSKK; DQEVEDSKKD; QEVEDSKKDQ; EVEDSKKDQK;
VEDSKKDQKD; EDSKKDQKDA; DSKKDQKDAS; SKKDQKDASK; KKDQKDASKK;
KDQKDASKKD; DQKDASKKDL; QKDASKKDLP; KDASKKDLPL; DASKKDLPLV;
ASKKDLPLVT; SKKDLPLVTE; KKDLPLVTED; KDLPLVTEDT; DLPLVTEDTV;
LPLVTEDTVK; PLVTEDTVKL; LVTEDTVKLF; VTEDTVKLFN; TEDTVKLFND;
EDTVKLFNDT; DTVKLFNDTK; TVKLFNDTKI; VKLFNDTKIF; KLFNDTKIFT;
LFNDTKIFTS; FNDTKIFTSK; NDTKIFTSKE; DTKIFTSKEK; TKIFTSKEKN;
KIFTSKEKNK; IFTSKEKNKD; FTSKEKNKDG; TSKEKNKDGK; SKEKNKDGKY;
KEKNKDGKYE; EKNKDGKYEL; KNKDGKYELR; NKDGKYELRA; KDGKYELRAT;
DGKYELRATV; GKYELRATVD; KYELRATVDT; YELRATVDTV; ELRATVDTVE;
LRATVDTVEL; RATVDTVELK; ATVDTVELKG; TVDTVELKGV; VDTVELKGVA;
DTVELKGVAD; TVELKGVADK; VELKGVADKN; ELKGVADKND; LKGVADKNDG;
KGVADKNDGS; GVADKNDGSG; VADKNDGSGG; ADKNDGSGGK; DKNDGSGGKL;
KNDGSGGKLE; NDGSGGKLEG; DGSGGKLEGV; GSGGKLEGVK; SGGKLEGVKS;
GGKLEGVKSD; GKLEGVKSDQ; KLEGVKSDQS; LEGVKSDQSK; EGVKSDQSKV;
GVKSDQSKVT; VKSDQSKVTM; KSDQSKVTMS; SDQSKVTMST; DQSKVTMSTT;
QSKVTMSTTD; SKVTMSTTDD; KVTMSTTDDL; VTMSTTDDLN; TMSTTDDLNT;
MSTTDDLNTT; STTDDLNTTT; TTDDLNTTTV; TDDLNTTTVE; DDLNTTTVET;
DLNTTTVETY; LNTTTVETYD; NTTTVETYDS; TTTVETYDSS; TTVETYDSSN;
TVETYDSSNT; VETYDSSNTK; ETYDSSNTKV; TYDSSNTKVA; YDSSNTKVAS;
DSSNTKVASK; SSNTKVASKV; SNTKVASKVF; NTKVASKVFK; TKVASKVFKK;
KVASKVFKKQ; VASKVFKKQG; ASKVFKKQGS; SKVFKKQGSL; KVFKKQGSLI;

Fig. 31 continued

VFKQGSLTEE; FKQGSLTEEE; KQGSLTEEEE; KQGSLTEEETE; QGSLTEETEE;
QSLTEETEET; SLTEETEETY; LTEETEETYK; TEETEETYKT; EETEETYKTG;
ETEETYKTGK; TEETYKTGKL; EETYKTGKLS; ETYKTGKLST; TYKTGKLSTK;
YKTGKLSTKK; KTGKLSTKKT; TGKLSTKKTT; GKLSTKKTTR; KLSTKKTTRT;
LSTKKITRTN; STKKITRTNG; TKKITRTNGT; KKITRTNGTT; KITRTNGTTL;
ITRTNGTTLE; TRTNGTTLEY; RTNGTTLEYS; TNGTTLEYSD; NGTTLEYSDM;
GTTLEYSDMT; TTLEYSDMTN; TLEYSDMTND; LEYSDMTNDE; EYSDMTNDEN;
YSDMTNDENA; SDMTNDENAT; DMTNDENATK; MTNDENATKA; TNDENATKAV;
NDENATKAVE; DENATKAVET; ENATKAVETL; NATKAVETLK; ATKAVETLKN;
TKAVETLKNG; KAVETLKNGT; AVETLKNGTM; VETLKNGTML; ETLKNGTMLE;
TLKNGTMLEG; LKNGTMLEGN; KNGTMLEGNL; NGTMLEGNLV; GTMLEGNLVG;
TMLEGNLVGG; MLEGNLVGGK; LEGNLVGGKT; EGNLVGGKTS; GNLVGGKTSV;
NLVGGKTSVE; LVGGKTSVET; VGGKTSVETK; GGKTSVETKE; GKTSVETKEG;
KTSVETKEGT; TSVETKEGTV; SVETKEGTVT; VETKEGTVTL; ETKEGTVTLK;
TKEGTVTLKK; KEGTVTLKKE; EGTVTLKKET; GTVTLKKETE; TVTLKKETEK;
VTLKKETEKA; TLKKETEKAG; LKKETEKAGT; KKETEKAGTV; KETEKAGTVK;
ETEKAGTVKL; TEKAGTVKLF; EKAGTVKLFL; KAGTVKLFLD; AGTVKLFLDD;
GTVKLFLDDT; TVKLFLDDTS; VKLFLDDTSS; KLFLDDTSSG; LFLDDTSSGS;
FLDDTSSGST; LDDTSSGSTK; DDTSSGSTKK; DTSSGSTKKT; TSSGSTKKTA;
SSGSTKKTAV; SGSTKKTAVW; GSTKKTAVWS; STKKTAVWSD; TKKTAVWSDT;
KKTAVWSDTS; KTAVWSDTSN; TAVWSDTSNT; AVWSDTSNTL; VWSDTSNTLT;
WSDTSNTLTV; SDTSNTLTVS; DTSNTLTVSA; TSNTLTVSAD; SNTLTVSADS;
NTLTVSADSK; TLTVSADSKK; LTVSADSKKT; TVSADSKKTK; VSADSKKTKD;
SADSKKTKDT; ADSKKTKDTV; DSKKTKDTVF; SKKTKDTVFL; KKTKDTVFLT;
KTKDTVFLTD; TKDTVFLTDG; KDTVFLTDGT; DTVFLTDGTI; TVFLTDGTIT;
VFLTDGTITV; FLTDGTITVQ; LTDGTITVQN; TDGTITVQNY; DGTITVQNYD;
GTITVQNYDT; TITVQNYDTA; ITVQNYDTAG; TVQNYDTAGT; VQNYDTAGTK;
QNYDTAGTKL; NYDTAGTKLA; YDTAGTKLAG; DTAGTKLAGT; TAGTKLAGTA;
AGTKLAGTAT; GTKLAGTATE; TKLAGTATEL; KLAGTATELK; LAGTATELKD;
AGTATELKDL; GTATELKDLE; TATELKDLEA; ATELKDLEAL; TELKDLEALK;
ELKDLEALKA; LKDLEALKAA; KDLEALKAAL; DLEALKAALK;

11 mers:
KKKYLLGFALV; KKYLLGFALVL; KYLLGFALVLA; YLLGFALVLAL;
LLGFALVLALL; LGFALVLALLA; GFALVLALLAG; FALVLALLACG;
ALVLALLACGQ; LVLALLACGQK; VLALLACGQKS; LALLACGQKSA;
ALLACGQKSAP; LLACGQKSAPK; LACGQKSAPKH; ACGQKSAPKHN;
CGQKSAPKHN; GQKSAPKHNDQ; QKSAPKHNDQE; KSAPKHNDQEV;
SAPKHNDQEVE; APKHNDQEVED; PKHNDQEVEDS; KHNDQEVEDSK;
HNDQEVEDSKK; NDQEVEDSKKD; DQEVEDSKKDQ;
QEVEDSKKDQK; EVEDSKKDQKD; VEDSKKDQKDA; EDSKKDQKDAS;
DSKKDQKDASK; SKKDQKDASKK; KKDQKDASKKD; KDQKDASKKDL;
DQKDASKKDLP; QKDASKKDLPL; KDASKKDLPLV; DASKKDLPLVT;
ASKKDLPLVTE; SKKDLPLVTED; KKDLPLVTEDT; KDLPLVTEDTV;
DLPLVTEDTVK; LPLVTEDTVKL; PLVTEDTVKLF; LVTEDTVKLFN;
VTEDTVKLFND; TEDTVKLFNDT; EDTVKLFNDTK; DTVKLFNDTKT;
TVKLFNDTKTF; VKLFNDTKTFT; KLFNDTKTFTS; LFNDTKTFTSK;
FNDTKTFTSKF; NDTKTFTSKFN; DTKTFTSKFNK; TKTFTSKFNKD;
KTFTSKFNKDQ; TFTSKFNKDQK; FTSKFNKDQKY;
SKFNKDQKYF; KFNKDQKYFL; FNKDQKYFLR; NKDQKYFLRA;
KDQKYFLRAT; DQKYFLRATV; QKYFLRATVD; KYFLRATVDT;
YFLRATVDTV; FLRATVDTVE; LRATVDTVEL; RATVDTVELK;
ATVDTVELKQ; TVDTVELKQV; VDTVELKQVA;
DTVELKQVAD; TVELKQVADK; VELKQVADKN; ELKQVADKND;
LKQVADKNDG; KQVADKNDGS; QVADKNDGSG; VADKNDGSGG;
ADKNDGSGGK; DKNDGSGGKL; KNDGSGGKLE; NDGSGGKLEG;
DGSGGKLEGVK; GSGGKLEGVKS; SGGKLEGVKSD; GGKLEGVKSDG;

Fig. 31 continued

| | |
|---|---|
| | SKLEGVKSDQS; KLEGVKSDQSK; LEGVKSDQSKV; EGVKSDQSKVT; GVKSDQSKVTM; VKSDQSKVTMS; KSDQSKVTMST; SDQSKVTMSTT; DQSKVTMSTTD; QSKVTMSTTDD; SKVTMSTTDDL; KVTMSTTDDLN; VTMSTTDDLNT; TMSTTDDLNTT; MSTTDDLNTTT; STTDDLNTTTV; TTDDLNTTTVE; TDDLNTTTVET; DDLNTTTVETY; DLNTTTVETYD; LNTTTVETYDS; NTTTVETYDSS; TTTVETYDSSN; TTVETYDSSNT; TVETYDSSNTK; VETYDSSNTKV; ETYDSSNTKVA; TYDSSNTKVAS; YDSSNTKVASK; DSSNTKVASKV; SSNTKVASKVF; SNTKVASKVFK; NTKVASKVFKK; TKVASKVFKKQ; KVASKVFKKQQ; VASKVFKKQQS; ASKVFKKQQSL; SKVFKKQQSLT; KVFKKQQSLTE; VFKKQQSLTEE; FKKQQSLTEET; KKQQSLTEETE; KQQSLTEETEE; QQSLTEETEET; QSLTEETEETY; SLTEETEETYK; LTEETEETYKT; TEETEETYKTQ; EETEETYKTQK; ETEETYKTQKL; TEETYKTQKLS; EETYKTQKLST; ETYKTQKLSTK; TYKTQKLSTKK; YKTQKLSTKKT; KTQKLSTKKTT; TQKLSTKKTTR; QKLSTKKTTRT; KLSTKKTTRTN; LSTKKTTRTNG; STKKTTRTNGT; TKKTTRTNGTT; KKTTRTNGTTL; KTTRTNGTTLF; TTRTNGTTLFY; TRTNGTTLFYS; RTNGTTLFYSD; TNGTTLFYSDK; NGTTLFYSDKT; GTTLFYSDKTN; TTLFYSDKTND; TLFYSDKTNDF; LFYSDKTNDFN; FYSDKTNDFNA; YSDKTNDFNAT; SDKTNDFNATK; DKTNDFNATKA; KTNDFNATKAV; TNDFNATKAVE; NDFNATKAVET; DFNATKAVETL; FNATKAVETLK; NATKAVETLKN; ATKAVETLKNG; TKAVETLKNGI; KAVETLKNGIM; AVETLKNGIML; VETLKNGIMLE; ETLKNGIMLEG; TLKNGIMLEGN; LKNGIMLEGNL; KNGIMLEGNLV; NGIMLEGNLVG; GIMLEGNLVGG; IMLEGNLVGGK; MLEGNLVGGKT; LEGNLVGGKTS; EGNLVGGKTSV; GNLVGGKTSVE; NLVGGKTSVEL; LVGGKTSVELK; VGGKTSVELKE; GGKTSVELKEG; GKTSVELKEGT; KTSVELKEGTV; TSVELKEGTVT; SVELKEGTVTL; VELKEGTVTLK; ELKEGTVTLKK; LKEGTVTLKKE; KEGTVTLKKEI; EGTVTLKKEIE; GTVTLKKEIEK; TVTLKKEIEKA; VTLKKEIEKAG; TLKKEIEKAGT; LKKEIEKAGTV; KKEIEKAGTVK; KEIEKAGTVKL; EIEKAGTVKLF; IEKAGTVKLFL; EKAGTVKLFLD; KAGTVKLFLDD; AGTVKLFLDDT; GTVKLFLDDTS; TVKLFLDDTSS; VKLFLDDTSSG; KLFLDDTSSGS; LFLDDTSSGST; FLDDTSSGSTK; LDDTSSGSTKK; DDTSSGSTKKT; DTSSGSTKKTA; TSSGSTKKTAV; SSGSTKKTAVW; SGSTKKTAVWS; GSTKKTAVWSD; STKKTAVWSDT; TKKTAVWSDTS; KKTAVWSDTSN; KTAVWSDTSNI; TAVWSDTSNIL; AVWSDTSNILT; VWSDTSNILTV; WSDTSNILTVS; SDTSNILTVSA; DTSNILTVSAD; TSNILTVSADS; SNILTVSADSK; NILTVSADSKK; ILTVSADSKKI; LTVSADSKKIK; TVSADSKKIKD; VSADSKKIKDF; SADSKKIKDFV; ADSKKIKDFVF; DSKKIKDFVFL; SKKIKDFVFLT; KKIKDFVFLTD; KIKDFVFLTDG; IKDFVFLTDGT; KDFVFLTDGTT; DFVFLTDGTTT; FVFLTDGTTTV; VFLTDGTTTVQ; FLTDGTTTVQN; LTDGTTTVQNY; TDGTTTVQNYD; DGTTTVQNYDT; GTTTVQNYDTA; TTTVQNYDTAG; TTVQNYDTAGT; TVQNYDTAGTK; VQNYDTAGTKL; QNYDTAGTKLA; NYDTAGTKLAG; YDTAGTKLAGT; DTAGTKLAGTA; TAGTKLAGTAT; AGTKLAGTATE; GTKLAGTATEI; TKLAGTATEIK; KLAGTATEIKD; LAGTATEIKDL; AGTATEIKDLF; GTATEIKDLFA; TATEIKDLFAL; ATEIKDLFALK; TEIKDLFALKA; EIKDLFALKAA; IKDLFALKAAL; KDLFALKAALK; |
| AAM22469.1\| Outer surface protein C [Borrelia afzelii] | SEQ ID NO 12309-13317/ 9 mers: MKKNTLSA; KNTLSAI; KNTLSAIL; NTLSAILM; TLSAILMT; LSAILMTI; SAILMTIF; AILMTIFL; ILMTIFLF; LMTIFLFI; MTIFLFIS; TIFLFISC; IFLFISCN; FLFISCNN; LFISCNNS; FISCNNSG; ISCNNSGK; SCNNSGKG; CNNSGKGG; NNSGKGGD; NSGKGGDS; SGKGGDSA; GKGGDSAS; KGGDSAST; GGDSASTN; GDSASTNP; DSASTNPA; SASTNPAD; ASTNPADE; STNPADES; TNPADESA; NPADESAK; PADESAKG; ADESAKGP; DESAKGPN; ESAKGPNL; SAKGPNLT; AKGPNLTE; KGPNLTEI; GPNLTEIS; PNLTEISK; NLTEISKK; LTEISKKI; |

| | |
|---|---|
| | 11 mers:<br>KKKNTLSATLM; KKNTLSATLMT; KNTLSATLMTL; NTLSATLMTLF;<br>TLSALLKTLFL; LSALLKTLFLF; SALLKTLFLFI; ALLKTLFLFIS;<br>LLKTLFLFTSC; LKTLFLFTSCN; KTLFLFTSCNN; TLFLFTSCNNS;<br>LFLFTSCNNSG; FLFTSCNNSGK; LFTSCNNSGKG; FTSCNNSGKGG;<br>TSCNNSGKGGD; SCNNSGKGGDS; CNNSGKGGDSA; NNSGKGGDSAS;<br>NSGKGGDSAST; SGKGGDSASTN; GKGGDSASTNP; KGGDSASTNPA;<br>GGDSASTNPAD; GDSASTNPADF; DSASTNPADFS; SASTNPADFSA;<br>ASTNPADFSAK; STNPADFSAKG; TNPADFSAKGP; NPADFSAKGPN;<br>PADFSAKGPNL; ADFSAKGPNLT; DFSAKGPNLTF; FSAKGPNLTFT;<br>SAKGPNLTFTS; AKGPNLTFTSK; KGPNLTFTSKK; GPNLTFTSKKT;<br>PNLTFTSKKTT; NLTFTSKKTTD; LTFTSKKTTDS; TFTSKKTTDSN;<br>FTSKKTTDSNA; TSKKTTDSNAF; SKKTTDSNAFV; KKTTDSNAFVL;<br>KTTDSNAFVLA; TTDSNAFVLAV; TDSNAFVLAVK; DSNAFVLAVKF;<br>SNAFVLAVKFV; NAFVLAVKFVF; AFVLAVKFVFT; FVLAVKFVFTL;<br>VLAVKFVFTLV; LAVKFVFTLVS; AVKFVFTLVSS; VKFVFTLVSST;<br>KFVFTLVSSTD; FVFTLVSSTDF; VFTLVSSTDFL; FTLVSSTDFLA;<br>TLVSSTDFLAN; LVSSTDFLANK; VSSTDFLANKA; SSTDFLANKAT;<br>STDFLANKATG; TDFLANKATGK; DFLANKATGKK; FLANKATGKKT;<br>LANKATGKKTQ; ANKATGKKTQQ; NKATGKKTQQN; KATGKKTQQNG;<br>ATGKKTQQNGL; TGKKTQQNGLG; GKKTQQNGLGA; KKTQQNGLGAF;<br>KTQQNGLGAFA; TQQNGLGAFAN; QQNGLGAFANR; QNGLGAFANRN;<br>NGLGAFANRNF; GLGAFANRNFS; LGAFANRNFSL; GAFANRNFSLL;<br>AFANRNFSLLA; FANRNFSLLAG; ANRNFSLLAGV; NRNFSLLAGVH;<br>RNFSLLAGVHF; NFSLLAGVHFT; FSLLAGVHFTS; SLLAGVHFTST;<br>LLAGVHFTSTL; LAGVHFTSTLL; AGVHFTSTLLT; GVHFTSTLLTE;<br>VHFTSTLLTEK; HFTSTLLTEKL; FTSTLLTEKLS; TSTLLTEKLSK;<br>STLLTEKLSKL; TLLTEKLSKLK; LLTEKLSKLKN; LTEKLSKLKNS;<br>TEKLSKLKNSG; EKLSKLKNSGE; KLSKLKNSGEL; LSKLKNSGELK;<br>SKLKNSGELKA; KLKNSGELKAK; LKNSGELKAKI; KNSGELKAKIE;<br>NSGELKAKIED; SGELKAKIEDA; GELKAKIEDAK; ELKAKIEDAKK;<br>LKAKIEDAKKG; KAKIEDAKKGS; AKIEDAKKGSE; KIEDAKKGSEE;<br>IEDAKKGSEEF; EDAKKGSEEFT; DAKKGSEEFTN; AKKGSEEFTNK;<br>KKGSEEFTNKL; KGSEEFTNKLR; GSEEFTNKLRV; SEEFTNKLRVS;<br>EEFTNKLRVSH; EFTNKLRVSHA; FTNKLRVSHAD; TNKLRVSHADL;<br>NKLRVSHADLG; KLRVSHADLGK; LRVSHADLGKQ; RVSHADLGKQG;<br>VSHADLGKQGV; SHADLGKQGVN; HADLGKQGVND; ADLGKQGVNDD;<br>DLGKQGVNDDD; LGKQGVNDDDA; GKQGVNDDDAK; KQGVNDDDAKK;<br>QGVNDDDAKKA; GVNDDDAKKAT; VNDDDAKKATL; NDDDAKKATLK;<br>DDDAKKATLKI; DDAKKATLKIN; DAKKATLKINA; AKKATLKINAD;<br>KKATLKTNADK; KATLKTNADKT; ATLKTNADKTK; TLKTNADKTKG;<br>LKTNADKTKGA; KTNADKTKGAF; TNADKTKGAFF; NADKTKGAFFL;<br>ADKTKGAFFLG; DKTKGAFFLGK; KTKGAFFLGKL; TKGAFFLGKLF;<br>KGAFFLGKLFK; GAFFLGKLFKS; AFFLGKLFKSV; FFLGKLFKSVF;<br>FLGKLFKSVFG; LGKLFKSVFGL; GKLFKSVFGLV; KLFKSVFGLVK;<br>LFKSVFGLVKA; FKSVFGLVKAA; KSVFGLVKAAQ; SVFGLVKAAQF;<br>VFGLVKAAQFA; FGLVKAAQFAL; GLVKAAQFALT; LVKAAQFALTN;<br>VKAAQFALTNS; KAAQFALTNSV; AAQFALTNSVK; AQFALTNSVKF;<br>QFALTNSVKFL; FALTNSVKFLT; ALTNSVKFLTS; LTNSVKFLTSP;<br>TNSVKFLTSPV; NSVKFLTSPVV; SVKFLTSPVVA; VKFLTSPVVAF;<br>KFLTSPVVAFS; FLTSPVVAFSP; LTSPVVAFSPK; TSPVVAFSPKK;<br>SPVVAFSPKKP; |
| AAC62927.1| OspE-related lipoprotein [Borrelia garinii] | SEQ ID NO 13118 13799<br>8 mers:<br>KNKKMKFI; NKKMKFIL; KKMKFILC; KMKFILCA; MKFILCAV;<br>KFILCAVF; FILCAVFV; ILCAVFVL; LCAVFVLT; CAVFVLTS; AVFVLTSS; |

```
YYGKEEQS; YGYKEEQSG; GYKEEQSST; YKEEQSSTN; KEEQSSTNG;
EEQSSTNGT; EQSSTNGTK; QSSTNGTKG; SSTNGTKGK; STNGTKGKE;
TNGIKGKEI; NGIKGKEIT; GIKGKEITT; IKGKEITTK; KGKEITTKI;
GKEITTKIE; KEITTKIET; EITTKIETI; ITTKIETIN; TTKIETINN;
TKIETINNS; KIETINNSE; IETINNSEH; ETINNSEHI; TINNSEHIT;
INNSEHITF; NSEHITFS; NSEHITFSQ; SEHITFSQD; EHITFSQDF;
HITFSQDFI;

10 mers:
MNKKMKMFTT; NKKMKMFTTC; KKMKMFTTCA; KMKMFTTCAV; MKMFTTCAVF;
KMFTTCAVFV; MFTTCAVFVL; FTTCAVFVLT; TTCAVFVLTS; TCAVFVLTSS;
CAVFVLTSSC; AVFVLTSSCG; VFVLTSSCGN; FVLTSSCGNF; VLTSSCGNFR;
LTSSCGNFRS; TSSCGNFRSS; SSCGNFRSSL; SCGNFRSSLS; CGNFRSSLSD;
GNFRSSLSDQ; NFRSSLSDQG; FRSSLSDQGS; RSSLSDQGSL; SSLSDQGSLS;
SLSDQGSLSD; LSDQGSLSDQ; SDQGSLSDQG; DQGSLSDQGS; QGSLSDQGSL;
GSLSDQGSLS; SLSDQGSLSD; LSDQGSLSDQ; SDQGSLSDQG; DQGSLSDQGS;
QGSLSDQGSL; GSLSDQGSLS; SLSDQGSLSD; LSDQGSLSDQ; SDQGSLSDQG;
DQGSLSDQGG; QGSLSDQGGL; GSLSDQGGLS; SLSDQGGLSG; LSDQGGLSGQ;
SDQGGLSGQA; DQGGLSGQAS; QGGLSGQASS; GGLSGQASSD; GLSGQASSDT;
LSGQASSDTT; SGQASSDTTK; GQASSDTTKF; QASSDTTKFS; ASSDTTKFSF;
SSDTTKFSFF; SDTTKFSFFT; DTTKFSFFTV; TTKFSFFTVN; TKFSFFTVNL;
KFSFFTVNLK; FSFFTVNLKN; SFFTVNLKNK; FFTVNLKNKK; FTVNLKNKKD;
TVNLKNKKDN; VNLKNKKDNN; NLKNKKDNNG; LKNKKDNNGD; KNKKDNNGDW;
NKKDNNGDWS; KKDNNGDWSN; KDNNGDWSNL; DNNGDWSNLG; NNGDWSNLGT;
NGDWSNLGTL; GDWSNLGTLV; DWSNLGTLVI; WSNLGTLVIR; SNLGTLVIRK;
NLGTLVIRKE; GTLVIRKEQ; GTLVIRKEQD; TLVIRKEQDG; LVIRKEQDGV;
VIRKEQDGVE; IRKEQDGVET; RKEQDGVETG; KEQDGVETGL; EQDGVETGLN;
QDGVETGLNV; DGVETGLNVI; GVETGLNVIG; VETGLNVIGT; ETGLNVIGTL;
TGLNVIGTLN; GLNVIGTLNG; LNVIGTLNGQ; NVIGTLNGQL; VIGTLNGQLR;
IGTLNGQLRG; GTLNGQLRGH; TLNGQLRGHS; LNGQLRGHSA; NGQLRGHSAT;
GQLRGHSATF; QLRGHSATFF; LRGHSATFFC; RGHSATFFCI; GHSATFFCIE;
HSATFFCIEE; SATFFCIEEA; ATFFCIEEAE; TFFCIEEAEV; FFCIEEAEVN;
FCIEEAEVNF; CIEEAEVNFV; IEEAEVNFVK; EEAEVNFVKA; EAEVNFVKAM;
AEVNFVKAM; EVNFVKAMT; VNFVKAMTN; NFVKAMTNV; FVKAMTNVG;
FVKAMTNVGS; VKAMTNVGSF; KAMTNVGSFK; AMTNVGSFKT; MTNVGSFKTS;
TNVGSFKTSL; NVGSFKTSLY; VGSFKTSLYY; GSFKTSLYYG; SFKTSLYYGY;
FKTSLYYGYK; KTSLYYGYKE; TSLYYGYKEE; SLYYGYKEEQ; LYYGYKEEQS;
YYGYKEEQSS; YGYKEEQSST; GYKEEQSSTN; YKEEQSSTNG; KEEQSSTNGT;
EEQSSTNGTK; EQSSTNGTKG; QSSTNGTKGK; SSTNGTKGKE; STNGTKGKEI;
TNGIKGKEIT; NGIKGKEITT; GIKGKEITTK; IKGKEITTKI; KGKEITTKIE;
GKEITTKIET; KEITTKIETI; EITTKIETIN; ITTKIETINN; TTKIETINNS;
TKIETINNSE; KIETINNSEH; IETINNSEHI; ETINNSEHIT; TINNSEHITF;
INNSEHITFS; NSEHITFSQ; NSEHITFSQD; SEHITFSQDF; EHITFSQDFI;

11 mers:
MNKKMKMFTTC; NKKMKMFTTCA; KKMKMFTTCAV; KMKMFTTCAVF;
MKMFTTCAVFV; KMFTTCAVFVL; MFTTCAVFVLT; FTTCAVFVLTS;
TTCAVFVLTSS; TCAVFVLTSSC; CAVFVLTSSCG; AVFVLTSSCGN;
VFVLTSSCGNF; FVLTSSCGNFR; VLTSSCGNFRS; LTSSCGNFRSS;
TSSCGNFRSSL; SSCGNFRSSLS; SCGNFRSSLSD; CGNFRSSLSDQ;
GNFRSSLSDQG; NFRSSLSDQGS; FRSSLSDQGSL; RSSLSDQGSLS;
SSLSDQGSLSD; SLSDQGSLSDQ; LSDQGSLSDQG; SDQGSLSDQGS;
DQGSLSDQGSL; QGSLSDQGSLS; GSLSDQGSLSD; SLSDQGSLSDQ;
LSDQGSLSDQG; SDQGSLSDQGS; DQGSLSDQGSL; QGSLSDQGSLS;
GSLSDQGSLSD; SLSDQGSLSDQ; LSDQGSLSDQG; SDQGSLSDQGG;
DQGSLSDQGGL; QGSLSDQGGLS; GSLSDQGGLSG; SLSDQGGLSGQ;
LSDQGGLSGQA; SDQGGLSGQAS; DQGGLSGQASS; QGGLSGQASSD;
```

Fig. 31 continued

| | |
|---|---|
| | GGLSGQASSDT; GLSGQASSDTI; LSGQASSDTIK; SGQASSDTIKF; GQASSDTIKFS; QASSDTIKFSE; ASSDTIKFSEF; SSDTIKFSEFT; SDTIKFSEFTV; DTIKFSEFTVN; TIKFSEFTVNI; IKFSEFTVNIK; KFSEFTVNIKN; FSEFTVNIKNK; SEFTVNIKNKK; EFTVNIKNKKD; FTVNIKNKKDN; TVNIKNKKDNN; VNIKNKKDNNG; NIKNKKDNNGD; IKNKKDNNGDW; KNKKDNNGDWS; NKKDNNGDWSN; KKDNNGDWSNL; KDNNGDWSNLG; DNNGDWSNLGT; NNGDWSNLGTL; NGDWSNLGTLV; GDWSNLGTLVT; DWSNLGTLVTR; WSNLGTLVTRK; SNLGTLVTRKE; NLGTLVTRKEQ; LGTLVTRKEQD; GTLVTRKEQDG; TLVTRKEQDGV; LVTRKEQDGVE; VTRKEQDGVET; TRKEQDGVETG; RKEQDGVETGL; KEQDGVETGLN; EQDGVETGLNV; QDGVETGLNVT; DGVETGLNVTG; GVETGLNVTGT; VETGLNVTGTT; ETGLNVTGTTN; TGLNVTGTTNG; GLNVTGTTNGQ; LNVTGTTNGQL; NVTGTTNGQLR; VTGTTNGQLRG; TGTTNGQLRGH; GTTNGQLRGHS; TTNGQLRGHSA; TNGQLRGHSAT; NGQLRGHSATF; GQLRGHSATFF; QLRGHSATFFG; LRGHSATFFGT; RGHSATFFGTE; GHSATFFGTEE; HSATFFGTEEA; SATFFGTEEAE; ATFFGTEEAEV; TFFGTEEAEVN; FFGTEEAEVNN; FGTEEAEVNNF; GTEEAEVNNFV; TEEAEVNNFVK; EEAEVNNFVKA; EAEVNNFVKAM; AEVNNFVKAMT; EVNNFVKAMTN; VNNFVKAMTNV; NNFVKAMTNVG; NFVKAMTNVGS; FVKAMTNVGSF; VKAMTNVGSFK; KAMTNVGSFKT; AMTNVGSFKTS; MTNVGSFKTSL; TNVGSFKTSLY; NVGSFKTSLYY; VGSFKTSLYYG; GSFKTSLYYGY; SFKTSLYYGYK; FKTSLYYGYKE; KTSLYYGYKEE; TSLYYGYKEEQ; SLYYGYKEEQS; LYYGYKEEQSS; YYGYKEEQSST; YGYKEEQSSTN; GYKEEQSSTNG; YKEEQSSTNGI; KEEQSSTNGIK; EEQSSTNGIKG; EQSSTNGIKGK; QSSTNGIKGKE; SSTNGIKGKEI; STNGIKGKEII; TNGIKGKEIIT; NGIKGKEIITK; GIKGKEIITKI; IKGKEIITKIE; KGKEIITKIET; GKEIITKIETI; KEIITKIETIN; EIITKIETINN; IITKIETINNS; ITKIETINNSE; TKIETINNSEH; KIETINNSEHL; IETINNSEHLT; ETINNSEHLTF; TINNSEHLTFS; INNSEHLTFSG; NNSEHLTFSGD; NSEHLTFSGDK; SEHLTFSGDKI |
| CAA57806.1\| Outer surface protein G [Borrelia burgdorferi] | SEQ ID NO 13808 14549/<br>8 mers:<br>MNKKMKNL; NKKMKNLI; KKMKNLII; KMKNLIIC; MKNLIICA; KNLIICAV; NLIICAVF; LIICAVFV; IICAVFVL; ICAVFVLI; CAVFVLII; AVFVLIIS; VFVLIISC; FVLIISCK; VLIISCKI; LIISCKID; IISCKIDA; ISCKIDAS; SCKIDASS; CKIDASSE; KIDASSED; IDASSEDL; DASSEDLK; ASSEDLKQ; SSEDLKQN; SEDLKQNV; EDLKQNVK; DLKQNVKE; LKQNVKEK; KQNVKEKV; QNVKEKVE; NVKEKVEG; VKEKVEGF; KEKVEGFL; EKVEGFLD; KVEGFLDK; VEGFLDKE; EGFLDKEL; GFLDKELM; FLDKELMQ; LDKELMQG; DKELMQGD; KELMQGDD; ELMQGDDP; LMQGDDPN; MQGDDPNN; QGDDPNNS; GDDPNNSL; DDPNNSLF; DPNNSLFN; PNNSLFNP; NNSLFNPP; NSLFNPPP; SLFNPPPV; LFNPPPVL; FNPPPVLP; NPPPVLPA; PPPVLPAS; PPVLPASS; PVLPASSH; VLPASSHD; LPASSHDN; PASSHDNT; ASSHDNTP; SSHDNTPV; SHDNTPVL; HDNTPVLK; DNTPVLKA; NTPVLKAV; TPVLKAVQ; PVLKAVQA; VLKAVQAK; LKAVQAKD; KAVQAKDG; AVQAKDGG; VQAKDGGQ; QAKDGGQQ; AKDGGQQE; KDGGQQEG; DGGQQEGK; GGQQEGKE; GQQEGKEE; QQEGKEEK; QEGKEEKE; EGKEEKEK; GKEEKEKE; KEEKEKEI; EEKEKEIQ; EKEKEIQE; KEKEIQEL; EKEIQELK; KEIQELKD; EIQELKDK; IQELKDKI; QELKDKID; ELKDKIDK; LKDKIDKR; KDKIDKRK; DKIDKRKK; KIDKRKKE; IDKRKKEI; DKRKKEIE; KRKKEIEE; RKKEIEEA; KKEIEEAR; KEIEEARK; EIEEARKK; IEEARKKF; EEARKKFQ; EARKKFQE; ARKKFQEF; RKKFQEFK; KKFQEFKE; KFQEFKEQ; FQEFKEQV; QEFKEQVE; EFKEQVES; FKEQVESA; KEQVESAT; EQVESATG; QVESATGE; VESATGES; ESATGEST; SATGESTE; ATGESTEK; TGESTEKV; GESTEKVK; ESTEKVKK; STEKVKKQ; TEKVKKQG; EKVKKQGN; KVKKQGNT; VKKQGNTG; KKQGNTGQ; KQGNTGQK; QGNTGQKA; GNTGQKAL; NTGQKALK; |

Fig. 31 continued

ISQRALKY; QQKALKYA; QKALKYAR; KALKYAKE; ALKYAKEL; LKYAKELG;
KYAKELGV; YAKELGVN; AKELGVNG; KELGVNGS; ELGVNGSY; LGVNGSYS;
GVNGSYSV; VNGSYSVN; NGSYSVND; GSYSVNDG

QVKEKVEGF; NVKEKVEGFL; VKEKVEGFLD; KEKVEGFLDK; EKVEGFLDKE;
KVEGFLDKEI; VEGFLDKEIM; EGFLDKEIMQ; GFLDKEIMQQ; FLDKEIMQQD;
LDKEIMQQDD; DKEIMQQDDP; KEIMQQDDPN; EIMQQDDPNN; IMQQDDPNNS;
MQQDDPNNSL; QQDDPNNSLF; QDDPNNSLFN; DDPNNSLFNP; DPNNSLFNPP;
PNNSLFNPPV; NSLFNPPVL; SLFNPPVLP; LFNPPVLPA;
FNPPVLPAS; NPPVLPASS; PPPVLPASSH; PVLPASSHDN;
VLPASSHDNT; LPASSHDNTP; PASSHDNTPV; ASSHDNTPVL; SSHDNTPVLK;
SHDNTPVLKA; HDNTPVLKAV; DNTPVLKAVQ; NTPVLKAVQA; TPVLKAVQAK;
PVLKAVQAKD; VLKAVQAKDG; LKAVQAKDGG; KAVQAKDGGQ; AVQAKDGGQQ;
VQAKDGGQQF; QAKDGGQQFG; AKDGGQQFGK; KDGGQQFGKF; DGGQQFGKFK;
GGQQFGKFKF; GQQFGKFKFK; QQFGKFKFKF; QFGKFKFKFT;
GKFKFKFTQ; KFKFKFTQF; FKFKFTQFL; KFKFTQFLK; FKFTQFLKD;
FKFTQFLKDK; KFTQFLKDKT; FTQFLKDKID; TQFLKDKIDK; QFLKDKIDKR;
FLKDKIDKRK; LKDKIDKRKK; KDKIDKRKKF; DKIDKRKKFI; KIDKRKKFI

The page image is too faded/low-resolution to reliably transcribe the peptide sequence content.

| | |
|---|---|
| | SHSSKVKNFIF; HSSKVKNFIFY; SSKVKNFIFYV; SKVKNFIFYVK;<br>KVKNFIFYVKD; VKNFIFYVKDL; KNFIFYVKDLR; NFIFYVKDLRV;<br>FIFYVKDLRVL; IFYVKDLRVLY; FYVKDLRVLYD; YVKDLRVLYDK;<br>VKDLRVLYDKL; KDLRVLYDKLS; DLRVLYDKLSV; LRVLYDKLSVS;<br>RVLYDKLSVSI; VLYDKLSVSID; LYDKLSVSIDS; YDKLSVSIDSD;<br>DKLSVSIDSDI; KLSVSIDSDID; LSVSIDSDIDS; SVSIDSDIDSE;<br>VSIDSDIDSES; SIDSDIDSESV; IDSDIDSESVF; DSDIDSESVFK;<br>SDIDSESVFKV; DIDSESVFKVY; IDSESVFKVYE; DSESVFKVYET;<br>SESVFKVYETS; ESVFKVYETSG; SVFKVYETSGT; VFKVYETSGTE;<br>FKVYETSGTES; KVYETSGTESL; VYETSGTESLR; YETSGTESLRK;<br>ETSGTESLRKL; TSGTESLRKLK; SGTESLRKLKA; GTESLRKLKAH;<br>TESLRKLKAHE; ESLRKLKAHET; SLRKLKAHETF; LRKLKAHETFK;<br>RKLKAHETFKR; KLKAHETFKRV; LKAHETFKRVL; KAHETFKRVLK;<br>AHETFKRVLKL; HETFKRVLKLR; ETFKRVLKLRE; TFKRVLKLREK;<br>FKRVLKLREKT; KRVLKLREKTS; RVLKLREKTST; VLKLREKTSTA;<br>LKLREKTSTAE; KLREKTSTAEG; LREKTSTAEGS; REKTSTAEGSF;<br>EKTSTAEGSFQ; KTSTAEGSFQN; TSTAEGSFQNF; STAEGSFQNFV;<br>TAEGSFQNFVE; AEGSFQNFVEK; EGSFQNFVEKT; GSFQNFVEKTE;<br>SFQNFVEKTES; FQNFVEKTESE; QNFVEKTESEK; NFVEKTESEKP;<br>FVEKTESEKPE; VEKTESEKPEE; EKTESEKPEES; KTESEKPEESS;<br>TESEKPEESSP; ESEKPEESSPK; SEKPEESSPKN; |
| AAU07005.1\| flagellar filament 41 kDa core protein [Borrelia garinii PBi] | SEQ ID NO 15880-16189<br>8 mers:<br>MIINHNTS; IINHNTSA; INHNTSAI; NHNTSAIN; HNTSAINA; NTSAINAS;<br>TSAINASR; SAINASRN; AINASRNN; INASRNNG; NASRNNGI; ASRNNGIN;<br>SRNNGINA; RNNGINAA; NNGINAAN; NGINAANL; GINAANLS; INAANLSK;<br>NAANLSKT; AANLSKTQ; ANLSKTQE; NLSKTQEK; LSKTQEKL; SKTQEKLS;<br>KTQEKLSS; TQEKLSSG; QEKLSSGY; EKLSSGYR; KLSSGYRI; LSSGYRIN;<br>SSGYRINR; SGYRINRA; GYRINRAS; YRINRASD; RINRASDD; INRASDDA;<br>NRASDDAA; RASDDAAG; ASDDAAGM; SDDAAGMG; DDAAGMGV; DAAGMGVS;<br>AAGMGVSG; AGMGVSGK; GMGVSGKI; MGVSGKIN; GVSGKINA; VSGKINAQ;<br>SGKINAQI; GKINAQIR; KINAQIRG; INAQIRGL; NAQIRGLS; AQIRGLSQ;<br>QIRGLSQA; IRGLSQAS; RGLSQASR; GLSQASRN; LSQASRNT; SQASRNTS;<br>QASRNTSK; ASRNTSKA; SRNTSKAI; RNTSKAIN; NTSKAINF; TSKAINFI;<br>SKAINFIQ; KAINFIQT; AINFIQTT; INFIQTTE; NFIQTTEG; FIQTTEGN;<br>IQTTEGNL; QTTEGNLN; TTEGNLNE; TEGNLNEV; EGNLNEVE; GNLNEVEK;<br>NLNEVEKV; LNEVEKVL; NEVEKVLV; EVEKVLVR; VEKVLVRM; EKVLVRMK;<br>KVLVRMKE; VLVRMKEL; LVRMKELA; VRMKELAV; RMKELAVQ; MKELAVQS;<br>KELAVQSG; ELAVQSGN; LAVQSGNG; AVQSGNGT; VQSGNGTY; QSGNGTYS;<br>SGNGTYSD; GNGTYSDA; NGTYSDAD; GTYSDADR; TYSDADRG; YSDADRGS;<br>SDADRGSI; DADRGSIQ; ADRGSIQI; DRGSIQIE; RGSIQIEI; GSIQIEIE;<br>SIQIEIEQ; IQIEIEQL; QIEIEQLT; IEIEQLTD; EIEQLTDE; IEQLTDEI;<br>EQLTDEIN; QLTDEINR; LTDEINRI; TDEINRIA; DEINRIAD; EINRIADQ;<br>INRIADQA; NRIADQAQ; RIADQAQY; IADQAQYN; ADQAQYNQ; DQAQYNQM;<br>QAQYNQMH; AQYNQMHM; QYNQMHML; YNQMHMLS; NQMHMLSN; QMHMLSNK;<br>MHMLSNKS; HMLSNKSA; MLSNKSAS; LSNKSASQ; SNKSASQN; NKSASQNV;<br>KSASQNVR; SASQNVRT; ASQNVRTA; SQNVRTAE; QNVRTAEE; NVRTAEEL;<br>VRTAEELG; RTAEELGM; TAEELGMQ; AEELGMQP; EELGMQPA; ELGMQPAK;<br>LGMQPAKI; GMQPAKIN; MQPAKINT; QPAKINTP; PAKINTPA; AKINTPAS;<br>KINTPASL; INTPASLS; NTPASLSG; TPASLSGS; PASLSGSQ; ASLSGSQA;<br>SLSGSQAS; LSGSQASW; SGSQASWT; GSQASWTL; SQASWTLR; QASWTLRV;<br>ASWTLRVH; SWTLRVHV; WTLRVHVG; TLRVHVGA; LRVHVGAN; RVHVGANQ;<br>VHVGANQD; HVGANQDE; VGANQDEA; GANQDEAI; ANQDEAIA; NQDEAIAV;<br>QDEAIAVN; DEAIAVNI; EAIAVNIY; AIAVNIYA; IAVNIYAA; AVNIYAAN;<br>VNIYAANV; NIYAANVA; IYAANVAN; YAANVANL; AANVANLF; ANVANLFS;<br>NVANLFSG; VANLFSGE; ANLFSGEG; NLFSGEGS; LFSGEGSQ; FSGEGSQA; |

Fig. 31 continued

SSGSGQAA; GSGSQAAQ; SGSQAAQT; GSQAAQTA; SQAAQTAP; QAAQTAPV;
AAQTAPVQ; AQTAPVQF; QTAPVQFG; TAPVQFGA; APVQFGAQ; PVQFGAQQ;
VQFGAQQE; QFGAQQEG; FGAQQEGA; GAQQEGAQ; AQQEGAQQ; QQEGAQQP;
QEGAQQPA; EGAQQPAP; GAQQPAPA; AQQPAPAT; QQPAPATA; QPAPATAP;
PAPATAPS; APATAPSQ; PATAPSQG; ATAPSQGG; TAPSQGGV; APSQGGVN;
PSQGGVNS; SQGGVNSP; QGGVNSPV; GGVNSPVN; GVNSPVNV; VNSPVNVT;
NSPVNVTT; SPVNVTTV; PVNVTTVD; VNVTTVDA; NVTTVDAN; VTTVDANT;
TTVDANTS; TVDANTSL; VDANTSLA; DANTSLAK; ANTSLAKT;
NTSLAKTE; TSLAKTEN; SLAKTENA; LAKTENAT; AKTENATR; KTENATRM;
TENATRMT; ENATRMTS; NATRMTSD; ATRMTSDQ; TRMTSDQR; RMTSDQRA;
MTSDQRAN; TSDQRANL; SDQRANLG; DQRANLGA; QRANLGAF; RANLGAFQ;
ANLGAFQN; NLGAFQNR; LGAFQNRL; GAFQNRLF; AFQNRLFS; FQNRLFST;
QNRLFSTK; NRLFSTKD; RLFSTKDS; LFSTKDST; FSTKDSTF; STKDSTFY;
TKDSTFYA; KDSTFYAT; DSTFYATF; STFYATFN; TFYATFNL; FYATFNLK;
YATFNLKA; ATFNLKAS; TFNLKASY; FNLKASYA; NLKASYAQ; LKASYAQT;
KASYAQTK; ASYAQTKD; SYAQTKDA; YAQTKDAT; AQTKDATM; QTKDATMT;
TKDATMTD; KDATMTDF; DATMTDFV; ATMTDFVV; TMTDFVVA; MTDFVVAS;
TDFVVAST; DFVVASTT; FVVASTTN; VVASTTNS; VASTTNST; ASTTNSTL;
STTNSTLT; TTNSTLTQ; TNSTLTQS; NSTLTQSA; STLTQSAM; TLTQSAMA;
LTQSAMAM; TQSAMAMT; QSAMAMTA; SAMAMTAQ; AMAMTAQA; MAMTAQAN;
AMTAQANQ; MTAQANQV; TAQANQVP; AQANQVPQ; QANQVPQY; ANQVPQYV;
NQVPQYVL; QVPQYVLS; VPQYVLSL; PQYVLSLL; QYVLSLLR;

9 mers:
MTFNHNTSA; TFNHNTSAT; FNHNTSATN; NHNTSATNA; HNTSATNAS;
NTSATNASR; TSATNASRN; SATNASRNN; ATNASRNNS; TNASRNNSI;
NASRNNSIN; ASRNNSINA; SRNNSINAA; RNNSINAAN; NNSINAANL;
NSINAANLS; SINAANLSK; INAANLSKT; NAANLSKTQ; AANLSKTQE;
ANLSKTQEK; NLSKTQEKL; LSKTQEKLS; SKTQEKLSG; KTQEKLSGG;
TQEKLSGGY; QEKLSGGYR; EKLSGGYRI; KLSGGYRIN; LSGGYRINR;
SGGYRINRA; GGYRINRAS; GYRINRASD; YRINRASDD; RINRASDDA;
INRASDDAA; NRASDDAAG; RASDDAAGM; ASDDAAGMG; DDAAGMGV;
DDAAGMGVS; DAAGMGVSG; AAGMGVSGK; AGMGVSGKI; GMGVSGKIN;
MGVSGKINA; GVSGKINAQ; VSGKINAQI; SGKINAQIR; GKINAQIRG;
KINAQIRGL; INAQIRGLS; NAQIRGLSQ; AQIRGLSQA; QIRGLSQAS;
IRGLSQASR; RGLSQASRN; GLSQASRNT; LSQASRNTS; SQASRNTSK;
QASRNTSKA; ASRNTSKAT; SRNTSKATN; RNTSKATNF; NTSKATNFT;
TSKATNFTQ; SKATNFTQT; KATNFTQTT; ATNFTQTTF; TNFTQTTFG;
NFTQTTFGN; FTQTTFGNL; TQTTFGNLN; QTTFGNLNF; TTFGNLNFV;
TFGNLNFVE; FGNLNFVEK; GNLNFVEKV; NLNFVEKVL; LNFVEKVLV;
NFVEKVLVR; FVEKVLVRM; VEKVLVRMK; EKVLVRMKF; KVLVRMKFL;
VLVRMKFLA; LVRMKFLAV; VRMKFLAVQ; RMKFLAVQS; MKFLAVQSG;
KFLAVQSGN; FLAVQSGNG; LAVQSGNGT; AVQSGNGTY; VQSGNGTYS;
QSGNGTYSD; SGNGTYSDA; GNGTYSDAD; NGTYSDADR; GTYSDADRG;
TYSDADRGS; YSDADRGST; SDADRGSTQ; DADRGSTQT; ADRGSTQTF;
DRGSTQTFT; RGSTQTFTF; GSTQTFTFQ; STQTFTFQL; TQTFTFQLT;
QTFTFQLTF; TFTFQLTFR; FTFQLTFRT; TFQLTFRTN; FQLTFRTNR;
QLTFRTNRT; LTFRTNRTA; TFRTNRTAD; FRTNRTADQ; RTNRTADQA;
TNRTADQAQ; NRTADQAQY; RTADQAQYN; TADQAQYNQ; ADQAQYNQM;
DQAQYNQMH; QAQYNQMHM; AQYNQMHMS; QYNQMHMLS; YNQMHMLSN;
NQMHMLSNK; QMHMLSNKS; MHMLSNKSA; HMLSNKSAS; MLSNKSASQ;
LSNKSASQN; SNKSASQNV; NKSASQNVR; KSASQNVRT; SASQNVRTA;
ASQNVRTAF; SQNVRTAFF; QNVRTAFFL; NVRTAFFLQ; VRTAFFLQM;
RTAFFLQMQ; TAFFLQMQP; AFFLQMQPA; FFLQMQPAK; FLQMQPAKT;
LQMQPAKTN; QMQPAKTNT; MQPAKTNTP; QPAKTNTPA; PAKTNTPAS;
AKTNTPASL; KTNTPASLG; TNTPASLGS; NTPASLGSQ; TPASLGSQA;
PASLGSQAS; ASLGSQASW; SLGSQASWL; LGSQASWTL; GSQASWTL;

GQQASKTLR; SQASKTLRV; QASKTLRVH; ASKTLRVHV; SKTLRVHVG;
KTLRVHVGA; TLRVHVGAN; LRVHVGANQ; RVHVGANQD; VHVGANQDE;
HVGANQDEA; VGANQDEAI; GANQDEAIA; ANQDEAIAV; NQDEAIAVN;
QDEAIAVNT; DEAIAVNTY; EAIAVNTYA; AIAVNTYAA; IAVNTYAAN;
AVNTYAANV; VNTYAANVA; NTYAANVAN; TYAANVANL; YAANVANLF;
AANVANLF

QIEIEQLTDEI; IEIEQLTDEIN; IEQLTDEINR; EQLTDEINRI;
QLTDEINRTA; LTDEINRTAD; TDEINRTADQ; DEINRTADQA; EINRTADQAQ;
INRTADQAQY; NRIADQAQYN; RIADQAQYNQ; IADQAQYNQE; ADQAQYNQEH;
DQAQYNQHHM; QAQYNQMHMI; AQYNQMHMLS; QYNQMHMLSN; YNQMHMLSNK;
NQMHMLSNKS; QMHMLSNKSA; MHMLSNKSAS; HMLSNKSASQ; MLSNKSASQN;
LSNKSASQNV; SNKSASQNVR; NKSASQNVRT; KSASQNVRTA; SASQNVRTAP;
ASQNVRTAPE; SQNVRTAPEL; QNVRTAPELC; NVRTAPELCM; VRTAPELCMQ;
RTAPELCMQP; TA

| | | | |
|---|---|---|---|
| SKGVSGKINAQ; | KGVSGKINAQI; | GVSGKINAQIR; | VSGKINAQIRG; |
| SGKINAQIRGL; | GKINAQIRGLS; | KINAQIRGLSQ; | INAQIRGLSQA; |
| NAQIRGLSQAS; | AQIRGLSQASR; | QIRGLSQASRN; | IRGLSQASRNY; |
| RGLSQASRNYS; | GLSQASRNYSK; | LSQASRNYSKA; | SQASRNYSKAI; |
| QASRNYSKAIN; | ASRNYSKAINF; | SRNYSKAINFI; | RNYSKAINFIQ; |
| NYSKAINFIQT; | YSKAINFIQTT; | SKAINFIQTTE; | KAINFIQTTEQ; |
| AINFIQTTEQN; | INFIQTTEQNI; | NFIQTTEQNIE; | FIQTTEQNIEE; |
| IQTTEQNIEEV; | QTTEQNIEEVE; | TTEQNIEEVEK; | TEQNIEEVEKV; |
| EQNIEEVEKVI; | QNIEEVEKVIV; | NIEEVEKVIVR; | IEEVEKVIVRM; |
| EEVEKVIVRMK; | EVEKVIVRMKE; | VEKVIVRMKEL; | EKVIVRMKELA; |
| KVIVRMKELAV; | VIVRMKELAVQ; | IVRMKELAVQS; | VRMKELAVQSG; |
| RMKELAVQSGN; | MKELAVQSGNG; | KELAVQSGNGT; | ELAVQSGNGTY; |
| LAVQSGNGTYS; | AVQSGNGTYSD; | VQSGNGTYSDA; | QSGNGTYSDAR; |
| SGNGTYSDARG; | GNGTYSDARGS; | NGTYSDARGST; | GTYSDARGSTQ; |
| TYSDARGSTQT; | YSDARGSTQTE; | SDARGSTQTET; | DARGSTQTETF; |
| ARGSTQTETFQ; | RGSTQTETFQL; | GSTQTETFQLT; | STQTETFQLTD; |
| TQTETFQLTDF; | QTETFQLTDFT; | TETFQLTDFTN; | ETFQLTDFTNR; |
| TFQLTDFTNRI; | FQLTDFTNRIA; | QLTDFTNRIAD; | LTDFTNRIADQ; |
| TDFTNRIADQA; | DFTNRIADQAQ; | FTNRIADQAQY; | TNRIADQAQYN; |
| NRIADQAQYNQ; | RIADQAQYNQM; | IADQAQYNQME; | ADQAQYNQMEM; |
| DQAQYNQMEML; | QAQYNQMEMLS; | AQYNQMEMLSN; | QYNQMEMLSNK; |
| YNQMEMLSNKS; | NQMEMLSNKSA; | QMEMLSNKSAS; | MEMLSNKSASQ; |
| EMLSNKSASQN; | MLSNKSASQNV; | LSNKSASQNVR; | SNKSASQNVRT; |
| NKSASQNVRTA; | KSASQNVRTAE; | SASQNVRTAEE; | ASQNVRTAEEL; |
| SQNVRTAEELG; | QNVRTAEELGM; | NVRTAEELGMQ; | VRTAEELGMQP; |
| RTAEELGMQPA; | TAEELGMQPAK; | AEELGMQPAKI; | EELGMQPAKIN; |
| ELGMQPAKINT; | LGMQPAKINTP; | GMQPAKINTPA; | MQPAKINTPAS; |
| QPAKINTPASL; | PAKINTPASLG; | AKINTPASLGG; | KINTPASLGGS; |
| INTPASLGGSQ; | NTPASLGGSQA; | TPASLGGSQAS; | PASLGGSQASW; |
| ASLGGSQASWT; | SLGGSQASWTL; | LGGSQASWTLR; | GGSQASWTLRV; |
| GSQASWTLRVH; | SQASWTLRVHV; | QASWTLRVHVG; | ASWTLRVHVGA; |
| SWTLRVHVGAN; | WTLRVHVGANQ; | TLRVHVGANQD; | LRVHVGANQDE; |
| RVHVGANQDEA; | VHVGANQDEAL; | HVGANQDEALA; | VGANQDEALAV; |
| GANQDEALAVN; | ANQDEALAVNI; | NQDEALAVNIY; | QDEALAVNIYA; |
| DEALAVNIYAA; | EALAVNIYAAN; | ALAVNIYAANV; | LAVNIYAANVA; |
| AVNIYAANVAN; | VNIYAANVANL; | NIYAANVANLF; | IYAANVANLFS; |
| YAANVANLFSG; | AANVANLFSGE; | ANVANLFSGEG; | NVANLFSGEGS; |
| VANLFSGEGSQ; | ANLFSGEGSQA; | NLFSGEGSQAA; | LFSGEGSQAAQ; |
| FSGEGSQAAQT; | SGEGSQAAQTA; | GEGSQAAQTAP; | EGSQAAQTAPV; |
| GSQAAQTAPVQ; | SQAAQTAPVQE; | QAAQTAPVQEG; | AAQTAPVQEGA; |
| AQTAPVQEGAQ; | QTAPVQEGAQQ; | TAPVQEGAQQE; | APVQEGAQQEG; |
| PVQEGAQQEGA; | VQEGAQQEGAQ; | QEGAQQEGAQQ; | EGAQQEGAQQP; |
| GAQQEGAQQPA; | AQQEGAQQPAP; | QQEGAQQPAPA; | QEGAQQPAPAT; |
| EGAQQPAPATA; | GAQQPAPATAP; | AQQPAPATAPS; | QQPAPATAPSQ; |
| QPAPATAPSQG; | PAPATAPSQGV; | APATAPSQGVN; | PATAPSQGVNS; |
| ATAPSQGVNSP; | TAPSQGVNSPV; | APSQGVNSPVH; | PSQGVNSPVHV; |
| SQGVNSPVHVT; | QGVNSPVHVTT; | GVNSPVHVTTV; | VNSPVHVTTVG; |
| NSPVHVTTVGA; | SPVHVTTVGAN; | PVHVTTVGANT; | VHVTTVGANTS; |
| HVTTVGANTSL; | TTTVGANTSLA; | TTVGANTSLAK; | TVGANTSLAKT; | VGANTSLAKTE; |
| GANTSLAKTEN; | ANTSLAKTENA; | NTSLAKTENAT; | TSLAKTENATR; |
| SLAKTENATRM; | LAKTENATRMT; | AKTENATRMTS; | KTENATRMTSD; |
| TENATRMTSDQ; | ENATRMTSDQR; | NATRMTSDQRA; | ATRMTSDQRAN; |
| TRMTSDQRANL; | RMTSDQRANLC; | MTSDQRANLCA; | TSDQRANLCAF; |
| SDQRANLCAFQ; | DQRANLCAFQN; | QRANLCAFQNR; | RANLCAFQNRL; |
| ANLCAFQNRLF; | NLCAFQNRLFS; | LCAFQNRLFST; | CAFQNRLFSTK; |
| AFQNRLFSTKD; | FQNRLFSTKDS; | QNRLFSTKDST; | NRLFSTKDSTE; |

Fig. 31 continued

| | |
|---|---|
| | RLESIKESTEY; LESIKESTEYA; ESIKESTEYAI; SIKESTEYAIE; TKESTEYATEN; KESTEYATEN; ESTEYATENLK; STEYATENLKA; TEYALENLKAS; EYALENLKASY; YALENLKASYA; ALENLKASYAQ; LENLKASYAQT; ENLKASYAQTK; NLKASYAQTKE; LKASYAQTKEA; KASYAQTKEAI; ASYAQTKEAIM; SYAQTKEAIMT; YAQTKEAIMTE; AQTKEAIMTEE; QTKEAIMTEEV; TKEAIMTEEVV; KEAIMTEEVVA; EATMTEEVVAS; ATMTEEVVAST; TMTEEVVASTT; MTEEVVASTTN; TEEVVASTTNS; EEVVASTTNST; EVVASTTNSTL; VVASTTNSTLT; VASTTNSTLTQ; ASTTNSTLTQS; STTNSTLTQSA; TTNSTLTQSAM; TNSTLTQSAMA; NSTLTQSAMAM; STLTQSAMAMT; TLTQSAMAMTA; LTQSAMAMTAQ; TQSAMAMTAQA; QSAMAMTAQAN; SAMAMTAQANQ; AMAMTAQANQV; MAMTAQANQVP; AMTAQANQVPQ; MTAQANQVPQY; TAQANQVPQYV; AQANQVPQYVL; QANQVPQYVLS; ANQVPQYVLSL; NQVPQYVLSLR; QVPQYVLSLRE; |
| 1L8W A Chain A, Crystal Structure Of Lyme Disease Variable Surface Antigen VlsE Of Borrelia Burgdorferi | SEQ ID NO: 7/180-18947; 8 mers: MRGSHHHH; RGSHHHHH; GSHHHHHH; SHHHHHHG; HHHHHHGS; HHHHHGSS; HHHHGSSQ; HHHGSSQV; HHGSSQVA; HGSSQVAE; GSSQVAEK; SSQVAEKD; SQVAEKDD; QVAEKDDP; VAEKDDPT; AEKDDPTN; EKDDPTNK; KDDPTNKF; DDPTNKFY; DPTNKFYQ; PTNKFYQS; TNKFYQSV; NKFYQSVT; KFYQSVTQ; FYQSVTQL; YQSVTQLG; QSVTQLGN; SVTQLGNG; VTQLGNGF; TQLGNGFL; QLGNGFLD; LGNGFLDV; GNGFLDVF; NGFLDVFT; GFLDVFTS; FLDVFTSF; LDVFTSFG; DVFTSFGG; VFTSFGGL; FTSFGGLV; TSFGGLVA; SFGGLVAE; FGGLVAEA; GGLVAEAF; GLVAEAFG; LVAEAFGF; VAEAFGFK; AEAFGFKS; EAFGFKSD; AFGFKSDP; FGFKSDPK; GFKSDPKK; FKSDPKKS; KSDPKKSD; SDPKKSDV; DPKKSDVK; PKKSDVKT; KKSDVKTY; KSDVKTYF; SDVKTYFT; DVKTYFTT; VKTYFTTV; KTYFTTVA; TYFTTVAA; YFTTVAAK; FTTVAAKL; TTVAAKLE; TVAAKLEK; VAAKLEKT; AAKLEKTK; AKLEKTKT; KLEKTKTD; LEKTKTDL; EKTKTDLN; KTKTDLNS; TKTDLNSL; KTDLNSLP; TDLNSLPK; DLNSLPKE; LNSLPKEK; NSLPKEKS; SLPKEKSD; LPKEKSDI; PKEKSDIS; KEKSDISS; EKSDISSG; KSDISSTT; SDISSTTG; DISSTTGK; ISSTTGKP; SSTTGKPD; STTGKPDS; TTGKPDST; TGKPDSTG; GKPDSTGS; KPDSTGSV; PDSTGSVG; DSTGSVGT; STGSVGTA; TGSVGTAV; GSVGTAVE; SVGTAVEG; VGTAVEGA; GTAVEGAL; TAVEGALK; AVEGALKE; VEGALKEV; EGALKEVS; GALKEVSE; ALKEVSEL; LKEVSELL; KEVSELLD; EVSELLDK; VSELLDKL; SELLDKLV; ELLDKLVK; LLDKLVKA; LDKLVKAV; DKLVKAVK; KLVKAVKT; LVKAVKTA; VKAVKTAE; KAVKTAEG; AVKTAEGA; VKTAEGAS; KTAEGASS; TAEGASSG; AEGASSGT; EGASSGTA; GASSGTAA; ASSGTAAI; SSGTAAIG; SGTAAIGE; GTAAIGEV; TAAIGEVV; AAIGEVVA; AIGEVVAD; IGEVVADA; GEVVADAD; EVVADADA; VVADADAA; VADADAAK; ADADAAKV; DADAAKVA; ADAAKVAD; DAAKVADK; AAKVADKA; AKVADKAS; KVADKASV; VADKASVK; ADKASVKQ; DKASVKQT; KASVKQTA; ASVKQTAK; SVKQTAKG; VKQTAKGT; KQTAKGTA; QTAKGTAE; TAKGTAET; AKGTAETV; KGTAETVE; GTAETVEA; TAETVEAA; AETVEAAG; ETVEAAGS; TVEAAGSE; VEAAGSEK; EAAGSEKL; AAGSEKLK; AGSEKLKA; GSEKLKAV; SEKLKAVA; EKLKAVAA; KLKAVAAA; LKAVAAAK; KAVAAAKG; AVAAAKGE; VAAAKGEN; AAAKGENN; AAKGENNK; AKGENNKG; KGENNKGA; GENNKGAG; ENNKGAGK; NNKGAGKL; NKGAGKLF; KGAGKLFG; GAGKLFGK; AGKLFGKA; GKLFGKAG; KLFGKAGA; LFGKAGAA; FGKAGAAA; GKAGAAAH; KAGAAAHG; AGAAAHGD; GAAAHGDS; AAAHGDSE; AAHGDSEA; AHGDSEAA; HGDSEAAS; GDSEAASK; DSEAASKA; SEAASKAA; EAASKAAG; AASKAAGA; ASKAAGAV; SKAAGAVS; KAAGAVSA; AAGAVSAV; AGAVSAVG; GAVSAVGG; AVSAVGGE; VSAVGGEQ; SAVGGEQI; AVGGEQIL; VGGEQILS; GGEQILSA; GEQILSAL; EQILSALV; QILSALVI; ILSALVTA; LSALVTAA; SALVTAAD; ALVTAADA; LVTAADAA; VTAADAAE; TAADAAEQ; AADAAEQD; ADAAEQDG; DAAEQDGK; AAEQDGKK; AEQDGKKP; EQDGKKPE; QDGKKPEE; DGKKPEEA; GKKPEEAK; KKPEEAKN; KPEEAKNP; |

GKLFGKAGA; KLFGKAGAA; LFGKAGAAA; FGKAGAAAH; GKAGAAAHG;
KAGAAAHGD; AGAAAHGDS; GAAAHGDSF; AAAHGDSFA; AAHGDSFAA;
AHGDSFAAS; HGDSFAASK; GDSFAASKA; DSFAASKAA; SFAASKAAG;
FAASKAAGA; AASKAAGAV; ASKAAGAVS; SKAAGAVSA; KAAGAVSAV;
AAGAVSAVS; AGAVSAVSG; GAVSAVSGE; AVSAVSGEQ; VSAVSGEQL;
SAVSGEQTL; AVSGEQTLS; VSGEQTLSA; SGEQTLSAT; GEQTLSATV;
EQTLSATVT; QTLSATVTA; TLSATVTAA; LSATVTAAD; SATVTAADA;
ATVTAADAA; TVTAADAAF; VTAADAAFQ; TAADAAFQD; AADAAFQDG;
ADAAFQDGK; DAAFQDGKK; AAFQDGKKP; AFQDGKKPF; FQDGKKPFF;
QDGKKPFFA; DGKKPFFAK; GKKPFFAKN; KKPFFAKNP; KPFFAKNPT;
PFFAKNPTA; FFAKNPTAA; FAKNPTAAA; AKNPTAAAT; KNPTAAATG;
NPTAAATGD; PTAAATGDK; TAAATGDKD; AAATGDKDG; AATGDKDGG;
ATGDKDGGA; TGDKDGGAF; GDKDGGAFF; DKDGGAFFG; KDGGAFFGQ;
DGGAFFGQD; GGAFFGQDF; GAFFGQDFK; AFFGQDFKK; FFGQDFKKE;
FGQDFKKFG; GQDFKKFGG

| | |
|---|---|
| | ALRGXAKEGKFA; LRGXAKEGKFAV; RGXAKEGKFAVK; GXAKEGKFAVKD; XAKEGKFAVKDG; AKEGKFAVKDGE; KEGKFAVKDGER; EGKFAVKDGERE; GKFAVKDGEREK; KFAVKDGEREKA; FAVKDGEREKAE; AVKDGEREKAEG; VKDGEREKAEG; KDGEREKAEGAT; DGEREKAEGATK; GEREKAEGATKG; EREKAEGATKGA; REKAEGATKGAA; EKAEGATKGAAE; KAEGATKGAAES; AEGATKGAAESA; EGATKGAAESAV; GATKGAAESAVR; ATKGAAESAVRK; TKGAAESAVRKV; KGAAESAVRKVL; GAAESAVR

Fig. 31 continued

| | |
|---|---|
| | KQILKQILAD; QILKQILADL; ILKQILADLP; LKQILADLPK; KQILADLPKD;<br><br>11 mers:<br>MKKTSLTFLF; KKTSLTFLFL; KTSLTFLFLF; TSLTFLFLFV; SLTFLFLFVV; LTFLFLFVVS; TFLFLFVVSL; FLFLFVVSLS; LFLFVVSLSA; FLFVVSLSAN; LFVVSLSANT; FVVSLSANTF; VVSLSANTFN; VSLSANTFNY; SLSANTFNYT; LSANTFNYTF; SANTFNYTFT; ANTFNYTFTR; NTFNYTFTRR; TFNYTFTRRA; FNYTFTRRAF; NYTFTRRAFS; YTFTRRAFSK; TFTRRAFSKE; FTRRAFSKED; TRRAFSKEDF; RRAFSKEDFN; RAFSKEDFNL; AFSKEDFNLT; FSKEDFNLTY; SKEDFNLTYK; KEDFNLTYKR; EDFNLTYKRL; DFNLTYKRLD; FNLTYKRLDN; NLTYKRLDNY; LTYKRLDNYD; TYKRLDNYDF; YKRLDNYDFK; KRLDNYDFKN; RLDNYDFKNF; LDNYDFKNFV; DNYDFKNFVF; NYDFKNFVFK; YDFKNFVFKS; DFKNFVFKSH; FKNFVFKSHV; KNFVFKSHVF; NFVFKSHVFS; FVFKSHVFSD; VFKSHVFSDA; FKSHVFSDAP; KSHVFSDAPR; SHVFSDAPRT; HVFSDAPRTR; VFSDAPRTRQ; FSDAPRTRQD; SDAPRTRQDL; DAPRTRQDLR; APRTRQDLRK; PRTRQDLRKT; RTRQDLRKTQ; TRQDLRKTQT; RQDLRKTQTK; QDLRKTQTKR; DLRKTQTKRS; LRKTQTKRSV; RKTQTKRSVF; KTQTKRSVFL; TQTKRSVFLD; QTKRSVFLDA; TKRSVFLDAL; KRSVFLDALE; RSVFLDALEA; SVFLDALEAT; VFLDALEATF; FLDALEATFV; LDALEATFVL; DALEATFVLL; ALEATFVLLK; LEATFVLLKI; EATFVLLKIK; ATFVLLKIKI; TFVLLKIKTQ; FVLLKIKTQT; VLLKIKTQTQ; LLKIKTQTQS; LKIKTQTQSL; KIKTQTQSLF; IKTQTQSLFL; KTQTQSLFLS; TQTQSLFLSE; QTQSLFLSED; TQSLFLSEDM; QSLFLSEDMI; SLFLSEDMIR; LFLSEDMIRL; FLSEDMIRLG; LSEDMIRLGS; SEDMIRLGSY; EDMIRLGSYP; DMIRLGSYPD; MIRLGSYPDS; IRLGSYPDSI; RLGSYPDSIF; LGSYPDSIFN; GSYPDSIFNY; SYPDSIFNYL; YPDSIFNYLI; PDSIFNYLIQ; DSIFNYLIQL; SIFNYLIQLN; IFNYLIQLNS; FNYLIQLNSD; NYLIQLNSDK; YLIQLNSDKI; LIQLNSDKID; IQLNSDKIDY; QLNSDKIDYA; LNSDKIDYAE; NSDKIDYAEK; SDKIDYAEKY; DKIDYAEKYG; KIDYAEKYGD; IDYAEKYGDN; DYAEKYGDNA; YAEKYGDNAR; AEKYGDNARN; EKYGDNARNF; KYGDNARNFE; YGDNARNFEK; GDNARNFEKD; DNARNFEKDY; NARNFEKDYS; ARNFEKDYSE; RNFEKDYSED; NFEKDYSEDK; FEKDYSEDKA; EKDYSEDKAN; KDYSEDKANT; DYSEDKANTV; YSEDKANTVK; SEDKANTVKQ; EDKANTVKQI; DKANTVKQIL; KANTVKQILK; ANTVKQILKQ; NTVKQILKQI; TVKQILKQIL; VKQILKQILA; KQILKQILAD; QILKQILADL; ILKQILADLP; LKQILADLPK; KQILADLPKD; |
| Seq19 | SEQ ID NO 19190-20455/<br>8 mers:<br>MCAFLLLN; CAFLLLNL; AFLLLNLV; FLLLNLVN; LLLNLVNC; LLNLVNCK; LNLVNCKF; NLVNCKFD; LVNCKFDS; VNCKFDSL; NCKFDSLN; CKFDSLNL; KFDSLNLS; FDSLNLST; DSLNLSTK; SLNLSTKS; LNLSTKSV; NLSTKSVD; LSTKSVDD; STKSVDDK; TKSVDDKN; KSVDDKNK; SVDDKNKS; VDDKNKST; DDKNKSTA; DKNKSTAK; KNKSTAKL; NKSTAKLL; KSTAKLLQ; STAKLLQH; TAKLLQHL; AKLLQHLS; KLLQHLSK; LLQHLSKS; LQHLSKSE; QHLSKSED; HLSKSEDQ; LSKSEDQA; SKSEDQAN; KSEDQANK; SEDQANKT; EDQANKTS; DQANKTST; QANKTSTS; ANKTSTSF; |

Fig. 31 continued

EKTSTSED; KTSTSEDQ; TSTSEDQK; STSEDQKE; TSEDQKEL;
SEDQKEL; EDQKLET; DQKLETT; QKLETTE; KLETTEK;
LETTEKE; ETTEKFQ; TTEKFQE; TEKFQEH; EKFQEHE;
KFQEHEK; FQEHEKL; QEHEKLS; EHEKLSQ; HEKLSQV;
EKLSQVA; KLSQVAQ; LSQVAQH; SQVAQHA; QVAQHAP;
VAQHAPN; AQHAPNS; QHAPNSK; HAPNSKT; APNSKTP;
PNSKTPK; NSKTPKV; SKTPKVK; KTPKVKS; TPKVKSD;
PKVKSDG; KVKSDGK; VKSDGKP; KSDGKPV; SDGKPVP;
DGKPVPG; GKPVPGD; KPVPGDK; PVPGDKT; VPGDKTL;
PGDKTLS; GDKTLSS; DKTLSSN; KTLSSNK; TLSSNKD;
LSSNKDT; SSNKDTY; SNKDTYN; NKDTYNS; KDTYNSY;
DTYNSYL; TYNSYLP; YNSYLPE; NSYLPEV; SYLPEVK;
YLPEVKR; LPEVKRE; PEVKRET; EVKRETV; VKRETVY;
KRETVYE; RETVYEL; ETVYELL; TVYELLE; VYELLEV;
YELLEVL; ELLEVLL; LLEVLLP; LEVLLPE; EVLLPET;
VLLPETK; LLPETKL; LPETKLP; PETKLPF; ETKLPFT;
TKLPFTE; KLPFTEV; LPFTEVL; PFTEVLM; FTEVLMP;
TEVLMPT; EVLMPTP; VLMPTPQ; LMPTP

LEKLKKYL; EKLKKYLK; KLKKYLKD; LKKYLKDT; KKYLKDTN;
KYLKDTKN; YLKDTNNL; LKDTNNLS; KDTNNLSA; DTNNLSAT;
TNNLSATE; NNLSATEE; NLSATEES; LSATEESV; SATEESVK;
ATEESVKG; TEESVKGL; EESVKGLS;

9 mers:
MCAFLLNL; CAFLLNLV; AFLLNLVN; FLLNLVNC; LLNLVNCK;
LNLVNCKF; NLVNCKFD; LVNCKFDS; VNCKFDSL; NCKFDSLN;
CKFDSLNL; KFDSLNLS; FDSLNLST; DSLNLSTK; SLNLSTKS;
LNLSTKSV; NLSTKSVD; LSTKSVDD; STKSVDDK; TKSVDDKN;
KSVDDKNS; SVDDKNST; VDDKNSTA; DDKNSTAK; DKNSTAKL;
KNSTAKLL; NSTAKLLQ; STAKLLQH; TAKLLQHL; AKLLQHLS;
KLLQHLSK; LLQHLSKS; LQHLSKSE; QHLSKSED; HLSKSEDQ;
LSKSEDQA; SKSEDQAK; KSEDQAKK; SEDQAKKT; EDQAKKTS;
DQAKKTST; QAKKTSTS; AKKTSTSE; KKTSTSED; KTSTSEDQ;
TSTSEDQK; STSEDQKE; TSEDQKEL; SEDQKELE; EDQKELET;
DQKELETT; QKELETTK; KELETTKE; ELETTKEQ; LETTKEQH;
ETTKEQHE; TTKEQHEK; TKEQHEKL; KEQHEKLS; EQHEKLSQ;
QHEKLSQV; HEKLSQVA; EKLSQVAQ; KLSQVAQH; LSQVAQHA;
SQVAQHAP; QVAQHAPN; VAQHAPNS; AQHAPNSK; QHAPNSKI;
HAPNSKIE; APNSKIEK; PNSKIEKV; NSKIEKVK; SKIEKVKS;
KIEKVKSD; IEKVKSDG; EKVKSDGK; KVKSDGKP; VKSDGKPV;
KSDGKPVP; SDGKPVPG; DGKPVPGD; GKPVPGDK; KPVPGDKI;
PVPGDKIL; VPGDKILS; PGDKILSS; GDKILSSN; DKILSSNK;
KILSSNKD; ILSSNKDI; LSSNKDIY; SSNKDIYN; SNKDIYNS;
NKDIYNSY; KDIYNSYI; DIYNSYIP; IYNSYIPE; YNSYIPEV;
NSYIPEVK; SYIPEVKE; YIPEVKEE; IPEVKEET; PEVKEETV;
EVKEETVY; VKEETVYE; KEETVYET; EETVYETL; ETVYETLE;
TVYETLEE; VYETLEEV; YETLEEVI; ETLEEVIL; TLEEVILP;
LEEVILPE; EEVILPET; EVILPETK; VILPETKI; ILPETKIP;
LPETKIPE; PETKIPEI; ETKIPEIT; TKIPEITE; KIPEITEV;
IPEITEVI; PEITEVIM; EITEVIMP; ITEVIMPT; TEVIMPTP;
EVIMPTPQ; VIMPTPQT; IMPTPQTI; MPTPQTID; PTPQTIDY;
TPQTIDYT; PQTIDYTE; QTIDYTEP; TIDYTEPR; IDYTEPRP;
DYTEPRPT; YTEPRPTS; TEPRPTSS; EPRPTSSF; PRPTSSFL;
RPTSSFLT; PTSSFLTQ; TSSFLTQG; SSFLTQGT; SFLTQGTS;
FLTQGTSP; LTQGTSPS; TQGTSPST; QGTSPSTS; GTSPSTST;
TSPSTSTT; SPSTSTTK; PSTSTTKS; STSTTKSY; TSTTKSYK;
STTKSYKE; TTKSYKEL; TKSYKELA; KSYKELAK; SYKELAKE;
YKELAKEK; KELAKEKI; ELAKEKIN; LAKEKING; AKEKINGL;
KEKINGLN; EKINGLNT; KINGLNTV; INGLNTVQ; NGLNTVQK;
GLNTVQKT; LNTVQKTT; NTVQKTTQ; TVQKTTQT; VQKTTQTD;
QKTTQTDN; KTTQTDNL; TTQTDNLT; TQTDNLTE; QTDNLTEN;
TDNLTENL; DNLTENLN; NLTENLNS; LTENLNSK; TENLNSKE;
ENLNSKET; NLNSKETP; LNSKETPK; NSKETPKE; SKETPKET;
KETPKETS; ETPKETSQ; TPKETSQK; PKETSQKE; KETSQKEV;
ETSQKEVE; TSQKEVEK; SQKEVEKI; QKEVEKIE; KEVEKIEP;
EVEKIEPI; VEKIEPIE; EKIEPIED; KIEPIEDH;
TTPTPNT; TPTPNTTG; PTPNTTGS; TPNTTGSS;

FDKLTGSGN; DKLTGSGNK; KLTGSGNKP; LTGSGKNPG; TGSGNKPGQ;
GSGNKPGQD; SGNKPGQDST; GNKPGQDST; NKPGQDSTS; KPGQDSTSN;
PGQDSTSNT; GQDSTSNTW; QDSTSNTWG; DSTSNTWGE; STSNTWGEG;
TSNTWGEGL; SNTWGEGLE; NTWGEGLEI; TWGEGLEIG; WGEGLEIGG;
GEGLEIGGD; EGLEIGGDS; GLEIGGDSN; LEIGGDSNF; EIGGDSNFF;
IGGDSNFFT; GGDSNFFTK; GDSNFFTNL; DSNFFTNLE; SNFFTNLEF;
NFFTNLEFV; FFTNLEFVR; FTNLEFVRS; TNLEFVRSS; NLEFVRSST;
LEFVRSSLK; EFVRSSLKT; FVRSSLRTK; VRSSLRTKT; RSSLRTKTK;
SSLRTKTKV; SLRTKTKVS; LRTKTKVSD; RTKTKVSDG; TKTKVSDGT;
KTKVSDGTP; TKVSDGTPQ; KVSDGTPQT; VSDGTPQTK; SDGTPQTKD;
DGTPQTKDK; GTPQTKDKV; TPQTKDKVF; PQTKDKVFI; QTKDKVFID;
TKDKVFIDS; KDKVFIDSI; DKVFIDSII; KVFIDSIIE; VFIDSIIED;
FIDSIIEDL; IDSIIEDLQ; DSIIEDLQK; SIIEDLQKL; IIEDLQKLR;
IEDLQKLRF; EDLQKLRFF; DLQKLRFFL; LQKLRFFLE; QKLRFFLEK;
KLRFFLEKL; LRFFLEKLK; RFFLEKLKK; FFLEKLKKY; FLEKLKKYL;
LEKLKKYLK; EKLKKYLKD; KLKKYLKDT; LKKYLKDTN; KKYLKDTNN;
KYLKDTNNL; YLKDTNNLS; LKDTNNLSA; KDTNNLSAT; DTNNLSATF;
TNNLSATFF; NNLSATFFS; NLSATFFSV; LSATFFSVK; SATFFSVKS;
ATFFSVKSL; TFFSVKSLS;

10 mers:
NCAFLLLNLV; CAFLLLNLVN; AFLLLNLVNC; FLLLNLVNCK;
LLLNLVNCKF; LLNLVNCKFD; LNLVNCKFDS; NLVNCKFDSL;
LVNCKFDSLK; VNCKFDSLNL; NCKFDSLNLS; CKFDSLNLST;
KFDSLNLSTK; FDSLNLSTKS; DSLNLSTKSV; SLNLSTKSVD;
LNLSTKSVDD; NLSTKSVDDK; LSTKSVDDKN; STKSVDDKN;
TKSVDDKNNS; KSVDDKNNSA; SVDDKNNSAK; VDDKNNSAKL;
DDKNNSAKLL; DKNNSAKLLQ; KNNSAKLLQH; NNSAKLLQHL;
NSAKLLQHL; SAKLLQHLS; AKLLQHLSK; KLLQHLSKS;
KLLQHLSKSE; LLQHLSKSED; LQHLSKSEDQ; QHLSKSEDQA;
HLSKSEDQAN; LSKSEDQANK; SKSEDQANKT; KSEDQANKTS;
SEDQANKTST; EDQANKTSTS; DQANKTSTSE; QANKTSTSED;
ANKTSTSEDQ; NKTSTSEDQK; KTSTSEDQKE; TSTSEDQKEL;
STSEDQKELL; TSEDQKELEI; SEDQKELEIT; EDQKELEITE;
DQKELEITEK; QKELEITENK; KELEITENKE; ELEITENKEQ;
LEITENKFQR; EITENKFQRE; ITFNKEQREE; TENKEQREEK;
ENKEQREEKL; NKEQREEKLS; KEQREEKLSQ; EQREEKLSQV;
QEEEKLSQVA; EREKLSQVAQ; REKLSQVAQH; EKLSQVAQHA;
KLSQVAQHAP; LSQVAQHAPN; SQVAQHAPNS; QVAQHAPNSK;
VAQHAPNSKT; AQHAPNSKTF; QHAPNSKTFK; HAPNSKTFKV;
APNSKIFKVK; PNSKIFKVKS; NSKIFKVKSD; SKIFKVKSDG;
KIEKVKSDGK; IEKVKSDGKP; EKVKSDGKPV; KVKSDGKPVP;
VKSDGKPVPG; KSDGKPVPGD; SDGKPVPGDK; DGKPVPGDKT;
GKPVPGDKTL; KPVPGDKTLS; PVPGDKTLSS; VPGDKTLSSN;
PGDKTLSSNK; GDKTLSSNKD; DKTLSSNKDI; KTLSSNKDIY;
TLSSNKDIYK; LSSNKDIYKS; SSNKDIYKSY; SNKDIYNSYI;
NKDTYNSYTP; KDTYNSYTPE; DTYNSYTPEV; TYNSYTPEVK;
YNSYTPEVKE; NSYTPEVKEE; SYTPEVKEEI; YTPEVKEEIV;
TPEVKEEIVY; PEVKEEIVYE; EVKEEIVYEI; VKEEIVYEIL;
KEEIVYEILE; EEIVYEILEE; EIVYEILEEV; IVYEILEEVI;
VYEILEEVIL; YEILEEVILP; EILEEVILPK; ILEEVILPKT;

LEEVIIPYTK; EEVIIPYTKI; EVIIPYTKIP; VIIPYTKIPT;
IIPYTKIPTI; IPYTKIPTI; PYTKIPTTP; YTKIPTTPR;
TKIPTTPRV; KIPTTPRVI; IPTTPRVIM; PTTPRVIMP;
TTPRVIMPI; TPRVIMPIP; PRVIMPIPQ; RVIMPIPQT;
VIMPIPQTI; IMPIPQTID; MPIPQTIDF; PIPQTIDFY;
IPQTIDFYT; PQTIDFYTP; QTIDFYTPR;
TIDFYTPRP; IDFYTPRPT; DFYTPRPTS; FYTPRPTSS;
YTPRPTSSF; TPRPTSSFL; PRPTSSFLT; RPTSSFLTQ;
PTSSFLTQG; TSSFLTQGT; SSFLTQGTS; SFLTQGTSP;
FLTQGTSPS; LTQGTSPST; TQGTSPSTT; QGTSPSTTS;
GTSPSTTST; TSPSTTSTT; SPSTTSTTK; PSTTSTTKS;
STTSTTKSY

Fig. 31 continued

| | |
|---|---|
| | SKTPKELSCKE; KETPKELSCKEV; ETPKELSCKEVE; TPKELSCKEVE; PKETSCKEVEF; KETSCKEVEFK; ETSCKEVEFKT; TSCKEVEFKTT; SCKEVEFKTTH; CKEVEFKTTHP; KEVEFKTTHPT; EVEFKTTHPTF; VEFKTTHPTFD; EFKTTHPTFDH; FKTTHPTFDHI; KTTHPTFDHIT; TTHPTFDHITG; THPTFDHITGS; HPTFDHITGSG; PTFDHITGSGN; TFDHITGSGNN; FDHITGSGNKP; DHITGSGKNPG; HITGSGNPGQ; ITGSGNPGQD; TGSGNPGQDS; GSGNPGQDST; SGNPGQDSTS; GNPGQDSTSN; NPGQDSTSNT; PGQDSTSNTW; GQDSTSNTWGF; QDSTSNTWGFG; DSTSNTWGFGT; STSNTWGFGLF; TSNTWGFGLFT; SNTWGFGLFTG; NTWGFGLFTGG; TWGFGLFTGGD; WGFGLFTGGDS; GFGLFTGGDSN; FGLFTGGDSNF; GLFTGGDSNFF; LFTGGDSNFFT; FTGGDSNFFTN; TGGDSNFFTNL; GGDSNFFTNLF; GDSNFFTNLFF; DSNFFTNLFFV; SNFFTNLFFVR; NFFTNLFFVRS; FFTNLFFVRSS; FTNLFFVRSST; TNLFFVRSSTR; NLFFVRSSTRT; LFFVRSSTRTK; FFVRSSTRTKT; FVRSSTRTKTK; VRSSTRTKTKV; RSSTRTKTKVS; SSTRTKTKVSD; STRTKTKVSDG; TRTKTKVSDGT; RTRTKVSDGTF; TRTKVSDGTFQ; RTKVSDGTFQT; TKVSDGTFQTK; KVSDGTFQTKD; VSDGTFQTKDK; SDGTFQTKDKV; DGTFQTKDKVE; GTFQTKDKVEI; TFQTKDKVEID; FQTKDKVEIDF; QTKDKVEIDFL; TKDKVEIDFLI; KDKVEIDFLIE; DKVEIDFLIED; KVEIDFLIEDL; VEIDFLIEDLQ

QKKNERII; MKKERIIS; KKERIISL; KERIISLE; ERIISLEI;
RIISLEIL; IISLEILQ; ISLEILQK; SLEILQKD; LEILQKDM;
EILQKDMT; ILQKDMTT; LQKDMTTL; QKDMTTLF; KDMTTLFI;
DMTTLFIK; MTTLFIKL; TLFIKLW; LFIKLWP; FIKLWPS;
FIKLWPSS; IKLWPSSF; KLWPSSFK; LWPSSFKI; WPSSFKII

RDYWLHTRD; DYWLHTRDY; YWLHTRDYP; WLHTRDYPG; LHTRDYPGA;
HTRDYPGAY; TRDYPGAYV; RDYPGAYVF; DYPGAYVFT; YPGAYVFTK;
PGAYVFTKN; GAYVFTKNQ; AYVFTKNQK; YVFTKNQKK; VFTKNQKKR;
FTKNQKKRT; TKNQKKRTP; KNQKKRTPS; NQKKRTPSL; QKKRTPSLD;
KKRTPSLDV; KRTPSLDVL; RTPSLDVLL; TPSLDVLLG; PSLDVLLGA;
SLDVLLGAG; LDVLLGAGN; DVLLGAGNL; VLLGAGNLG; LLGAGNLGV;
LGAGNLGVF; GAGNLGVFY; AGNLGVFYT; GNLGVFYTK; NLGVFYTKL;
LGVFYTKLA; GVFYTKLAK; VFYTKLAKK; FYTKLAKKS; YTKLAKKSG;
TKLAKKSGK; KLAKKSGKA; LAKKSGKAD; AKKSGKADL; KKSGKADLY;
KSGKADLYY; SGKADLYYT; GKADLYYTQ; KADLYYTQV; ADLYYTQVK;
DLYYTQVKN; LYYTQVKNI; YYTQVKNLR; YTQVKNLRR; TQVKNLRRV;
QVKNLRRVK; VKNLRRVKN; KNLRRVKNK; NLRRVKNKK; LRRVKNKKL;
RRVKNKKLG; RVKNKKLGL; VKNKKLGLV; KNKKLGLVT; NKKLGLVTP;
KKLGLVTPK; KLGLVTPKA; LGLVTPKAF; GLVTPKAFK; LVTPKAFKN;
VTPKAFKNL; TPKAFKNLH; PKAFKNLHI; KAFKNLHIK; AFKNLHIKL;
FKNLHIKLD; KNLHIKLDE; NLHIKLDEN; LHIKLDENL; HIKLDENLI;
IKLDENLIKK; KLDENLIKK; LDENLIKKT; DENLIKKTK; ENLIKKTKN;
NLIKKTKNQ; LIKKTKNQT;

10 mers:
MTKMSLKYTF; TKMSLKYTFT; KMSLKYTFTN; MSLKYTFTNT;
SLKYTFTNTL; LN

KLATNSFKI; LATNSFKIL; ATKSNFKILD;
TKSNFKILDA; KSNFKILDAY; SKFKILDAYY; KFKILDAYYR;
FKILDAYYRR; KILDAYYRRP; ILDAYYRRPK; LDAYYRRPKI;
DAYYRRPKIK; AYYRRPKIKE; YYRRPKIKET; YRRPKIKETT;
RRPKIKETTG; RPKIKETTGE; PKIKETTGEI; KIKETTGEIF;
IKETTGEFPL; KETTGEFPLK; ETTG

| | | | |
|---|---|---|---|
| IKLLKYKEEKI; | NLLKYKEEKIK; | LLKYKEEKIKI; | LKYKEEKIKIS; |
| KYKEEKIKISL; | YKEEKIKISLN; | KEEKIKISLNQ; | EEKIKISLNQS; |
| EKIKISLNQSL; | KIKISLNQSLS; | IKISLNQSLSP; | KISLNQSLSPK; |
| ISLNQSLSPKE; | SLNQSLSPKEN; | LNQSLSPKENA; | NQSLSPKENAL; |
| QSLSPKENALQ; | SLSPKENALQY; | LSPKENALQYF; | SPKENALQYFK; |
| PKENALQYFKA; | KENALQYFKAY; | ENALQYFKAYK; | NALQYFKAYKK; |
| ALQYFKAYKKG; | LQYFKAYKKGK; | QYFKAYKKGKN; | YFKAYKKGKNS; |
| FKAYKKGKNSF; | KAYKKGKNSFK; | AYKKGKNSFKT; | YKKGKNSFKTT; |
| KKGKNSFKTTQ; | KGKNSFKTTQN; | GKNSFKTTQNQ; | KNSFKTTQNQL; |
| NSFKTTQNQLK; | SFKTTQNQLKD; | FKTTQNQLKDN; | KTTQNQLKDNL; |
| TTQNQLKDNLD; | TQNQLKDNLDK; | QNQLKDNLDKF; | NQLKDNLDKFN; |
| QLKDNLDKFNL; | LKDNLDKFNLI; | KDNLDKFNLIQ; | DNLDKFNLIQS; |
| NLDKFNLIQSK; | LDKFNLIQSKT; | DKFNLIQSKTT; | KFNLIQSKTTM; |
| FNLIQSKTTML; | NLIQSKTTMLK; | LIQSKTTMLKV; | IQSKTTMLKVE; |
| QSKTTMLKVEN; | SKTTMLKVENL; | KTTMLKVENLI; | TTMLKVENLIP; |
| TMLKVENLIPE; | MLKVENLIPEE; | LKVENLIPEEF; | KVENLIPEEFY; |
| VENLIPEEFYN; | ENLIPEEFYNQ; | NLIPEEFYNQE; | LIPEEFYNQEK; |
| IPEEFYNQEKT; | PEEFYNQEKTA; | EEFYNQEKTAI; | EFYNQEKTAIK; |
| FYNQEKTAIKE; | YNQEKTAIKEK; | NQEKTAIKEKE; | QEKTAIKEKEK; |
| EKTAIKEKEKT; | KTAIKEKEKTP; | TAIKEKEKTPK; | AIKEKEKTPKI; |
| IKEKEKTPKIG; | KEKEKTPKIGL; | EKEKTPKIGLH; | KEKTPKIGLHF; |
| EKTPKIGLHFT; | KTPKIGLHFTY; | TPKIGLHFTYC; | PKIGLHFTYCG; |
| KIGLHFTYCGF; | IGLHFTYCGFE; | GLHFTYCGFEI; | LHFTYCGFEIL; |
| HFTYCGFEILL; | FTYCGFEILLG; | TYCGFEILLGR; | YCGFEILLGRN; |
| CGFEILLGRNA; | GFEILLGRNAK; | FEILLGRNAKE; | EILLGRNAKEK; |
| ILLGRNAKEKD; | LLGRNAKEKDK; | LGRNAKEKDKL; | GRNAKEKDKLL; |
| RNAKEKDKLLR; | NAKEKDKLLRH; | AKEKDKLLRHC; | KEKDKLLRHCV; |
| EKDKLLRHCVK; | KDKLLRHCVKG; | DKLLRHCVKGN; | KLLRHCVKGND; |
| LLRHCVKGNDY; | LRHCVKGNDYW; | RHCVKGNDYWL; | HCVKGNDYWLH; |
| CVKGNDYWLHT; | VKGNDYWLHTR; | KGNDYWLHTRD; | GNDYWLHTRDY; |
| NDYWLHTRDYP; | DYWLHTRDYPG; | YWLHTRDYPGA; | WLHTRDYPGAY; |
| LHTRDYPGAYV; | HTRDYPGAYVF; | TRDYPGAYVFT; | RDYPGAYVFTK; |
| DYPGAYVFTKN; | YPGAYVFTKNQ; | PGAYVFTKNQK; | GAYVFTKNQKN; |
| AYVFTKNQKNK; | YVFTKNQKNKT; | VFTKNQKNKTP; | FTKNQKNKTPS; |
| TKNQKNKTPSL; | KNQKNKTPSLD; | NQKNKTPSLDV; | QKNKTPSLDVL; |
| KNKTPSLDVLL; | NKTPSLDVLLG; | KTPSLDVLLGA; | TPSLDVLLGAG; |
| PSLDVLLGAGN; | SLDVLLGAGNL; | LDVLLGAGNLC; | DVLLGAGNLCV; |
| VLLGAGNLCVF; | LLGAGNLCVFY; | LGAGNLCVFYT; | GAGNLCVFYTK; |
| AGNLCVFYTKL; | GNLCVFYTKLA; | NLCVFYTKLAK; | LCVFYTKLAKK; |
| CVFYTKLAKKS; | VFYTKLAKKSG; | FYTKLAKKSGK; | YTKLAKKSGKA; |
| TKLAKKSGKAD; | KLAKKSGKADL; | LAKKSGKADLY; | AKKSGKADLYY; |
| KKSGKADLYYT; | KSGKADLYYTQ; | SGKADLYYTQV; | GKADLYYTQVK; |
| KADLYYTQVKN; | ADLYYTQVKNL; | DLYYTQVKNLR; | LYYTQVKNLRR; |
| YYTQVKNLRRV; | YTQVKNLRRVK; | TQVKNLRRVKN; | QVKNLRRVKNK; |
| VKNLRRVKNKK; | KNLRRVKNKKL; | NLRRVKNKKLG; | LRRVKNKKLGL; |
| RRVKNKKLGLV; | RVKNKKLGLVI; | VKNKKLGLVIP; | KNKKLGLVIPK; |
| NKKLGLVIPKA; | KKLGLVIPKAE; | KLGLVIPKAEK; | LGLVIPKAEKN; |
| GLVIPKAEKNL; | LVIPKAEKNLH; | VIPKAEKNLHI; | IPKAEKNLHIK; |
| PKAEKNLHIKL; | KAEKNLHIKLD; | AEKNLHIKLDE; | EKNLHIKLDEN; |
| KNLHIKLDENL; | NLHIKLDENLI; | LHIKLDENLIK; | HIKLDENLIKK; |
| IKLDENLIKKT; | KLDENLIKKTK; | LDENLIKKTKK; | DENLIKKTKKQ; |

Fig. 31 continued

| | |
|---|---|
| | EKLTKKIKNQT; |
| Seq 21 | SEQ ID NO 22322-23355/<br>8 mers:<br>MKLQRSLS; KLQRSLSL; LQRSLSLL; QRSLSLLL; RSLSLLLF;<br>SLSLLTFS; LSLLTFSL; SLLTFSLT; LLTFSLTV; LTFSLTVL;<br>TFSLTVLC; FSLTVLCC; SLTVLCCD; LTVLCCDN; TVLCCDNK;<br>VLCCDNKE; LCCDNKER; CCDNKERK; CDNKERKE; DNKERKEG;<br>NKERKEGV; KERKEGVS; ERKEGVST; RKEGVSTK; KEGVSTKT;<br>EGVSTKTS; GVSTKTSI; VSTKTSLG; STKTSLGA; TKTSLGAE;<br>KLSLGAEP; LSLGAEPR; SLGAEPRS; LGAEPRSL; GAEPRSLD;<br>AEPRSLDP; EPRSLDPQ; PRSLDPQL; RSLDPQLA; SLDPQLAE;<br>LDPQLAED; DPQLAEDK; PQLAEDKV; QLAEDKVA; LAEDKVAS;<br>AEDKVASK; EDKVASKM; DKVASKMT; KVASKMTD; VASKMTDT;<br>ASKMTDTL; SKMTDTLY; KMTDTLYR; MTDTLYRG; TDTLYRGT;<br>DTLYRGTV; TLYRGTVT; LYRGTVTG; YRGTVTGD; RGTVTGDP;<br>GTVTGDPN; TVTGDPNT; VTGDPNTG; TGDPNTGG; GDPNTGGH;<br>DPNTGGHK; PNTGGHKP; NTGGHKPG; TGGHKPGL; GGHKPGLA;<br>GHKPGLAK; HKPGLAKG; KPGLAKGW; PGLAKGWE; GLAKGWET;<br>LAKGWETS; AKGWETSG; KGWETSGD; GWETSGDG; WETSGDGT;<br>ETSGDGTA; TSGDGTAY; SGDGTAYP; GDGTAYPF; DGTAYPFY;<br>GTAYPFYL; TAYPFYLR; AYPFYLRD; YPFYLRDN; PFYLRDNL;<br>FYLRDNLT; YLRDNLTW; LRDNLTWS; RDNLTWSD; DNLTWSDG;<br>NLTWSDGV; LTWSDGVA; TWSDGVAT; WSDGVATT; SDGVATTA;<br>DGVATTAE; GVATTAEG; VATTAEGT; ATTAEGTR; TTAEGTRK;<br>TAEGTRKS; AEGTRKSY; EGTRKSYL; GTRKSYLR; TRKSYLRT;<br>RKSYLRTT; KSYLRTTK; SYLRTTKE; YLRTTKET; LRTTKETG;<br>RTTKETGS; TTKETGST; TKETGSTY; KETGSTYV; ETGSTYVD;<br>TGSTYVDK; GSTYVDKV; STYVDKVK; TYVDKVKS;<br>YVDKVKST; VDKVKSTT; DKVKSTLK; KVKSTLKN; VKSLLKNG;<br>KSLLKNGQ; SLLKNGQE; LLKNGQEY; LKNGQEYF; KNGQEYFD;<br>NGQEYFDG; GQEYFDGQ; QEYFDGQV; EYFDGQVT; YFDGQVTD;<br>FDGQVTDS; DGQVTDSE; GQVTDSEL; QVTDSELG; VTDSELGT;<br>TDSELGTR; DSELGTRA; SELGTRAT; ELGTRATD; LGTRATDS;<br>GTRATDSK; TRATDSKT; RATDSKTL; ATDSKTLE; TDSKTLET;<br>DSKTLETT; SKTLETTL; KTLETTLA; TLETTLAS; LETTLASP;<br>ETTLASPK; TTLASPKP; TLASPKPY; LASPKPYF; ASPKPYFT;<br>SPKPYFTD; PKPYFTDL; KPYFTDLL; PYFTDLLV; YFTDLLVH;<br>FTDLLVHQ; TDLLVHQS; DLLVHQSF; LLVHQSFT; LVHQSFTP;<br>VHQSFTPV; HQSFTPVP; QSFTPVPV; SFTPVPVH; FTPVPVHV;<br>TPVPVHVT; PVPVHVTD; VPVHVTDK; PVHVTDKY; VHVTDKYG;<br>HVTDKYGQ; VTDKYGQE; TDKYGQEW; DKYGQEWT; KYGQEWTS;<br>YGQEWTSP; GQEWTSPE; QEWTSPEK; EWTSPEKM; WTSPEKMV;<br>TSPEKMVT; SPEKMVTS; PEKMVTSG; EKMVTSGP; KMVTSGPE;<br>MVTSGPEK; VTSGPEKL; TSGPEKLK; SGPEKLKE; GPEKLKER;<br>PEKLKERT; EKLKERTP; KLKERTPS; LKERTPSE; KERTPSEK;<br>ERTPSEKY; RTPSEKYV; TPSEKYVF; PSEKYVFE; SEKYVFEK;<br>EKYVFEKD; KYVFEKDK; YVFEKDKK; VFEKDKKY; FEKDKKYY;<br>EKDKKYYD; KDKKYYDS; DKKYYDSN; KKYYDSNE; KYYDSNEV;<br>YYDSNEVF; YDSNEVFT; DSNEVFLF; SNEVFLFF; NEVFLFT;<br>EVFLFFTT; VFLFFTTP; FLFFTTFY; LFFTTFYT; FFTTFYTT; |

Fig. 31 continued

```
ELTYYTN;  LTYYTND;  TYYTNDS;  YYTNDSS;  YTNDSST;
TTNDSSTA; TNDSSTAY; NDSSTAYK; DSSTAYKM; SSTAYKMY;
STAYKMYV; TAYKMYVN; AYKMYVNE; YKMYVNEF; KMYVNEFL;
MYVNEFLD; YVNEFLDA; VNEFLDAI; NEFLDAIL; EFLDAILV;
FLDAILVF; LDAILVFY; DAILVFYP; AILVFYPQ; ILVFYPQL;

9 mers:
KKLQRSLSL; KLQRSLSLL; LQRSLSLLI; QRSLSLLIF; RSLSLLIFS;
SLSLLIFSL; LSLLIFSLT; SLLIFSLTV; LLIFSLTVL; IFSLTVLC;
IFSLTVLCC; FSLTVLCCD; SLTVLCCDN; LTVLCCDNK; TVLCCDNKF;
VLCCDNKER; LCCDNKERK; CCDNKERKF; CDNKERKFG; DNKERKFGV;
NKERKFGVS; KERKFGVST; ERKFGVSTK; RKFGVSTKI; KFGVSTKIS;
FGVSTKISL; GVSTKISLG; VSTKISLGA; STKISLGAF; TKISLGAFP;
KISLGAFPR; ISLGAFPRS; SLGAFPRSL; LGAFPRSLD; GAFPRSLDP;
AFPRSLDPQ; FPRSLDPQL; PRSLDPQLA; RSLDPQLAE; SLDPQLAED;
LDPQLAEDN; DPQLAEDNV; PQLAEDVA; QLAEDVAS; LAEDVASK;
AEDNVASKM; EDNVASKMI; DNVASKMID; NVASKMIDT; VASKMIDTL;
ASKMIDTLY; SKMIDTLYR; KMIDTLYRG; MIDTLYRGI; IDTLYRGIV;
DTLYRGIVT; TLYRGIVTG; LYRGIVTGD; YRGIVTGDP; RGIVTGDPN;
GIVTGDPNT; IVTGDPNTG; VTGDPNTGG; TGDPNTGGH; GDPNTGGHK;
DPNTGGHKP; PNTGGHKPG; NTGGHKPGL; TGGHKPGLA; GGHKPGLAK;
GHKPGLAKG; HKPGLAKGW; KPGLAKGWE; PGLAKGWET; GLAKGWETS;
LAKGWETSS; AKGWETSSE; KGWETSSDG; GWETSSDGT; WETSSDGTA;
ETSSDGTAY; TSSDGTAYP; SSDGTAYPF; SDGTAYPFY; DGTAYPFYL;
GTAYPFYLR; TAYPFYLRD; AYPFYLRDN; YPFYLRDNL; PFYLRDNLT;
FYLRDNLTW; YLRDNLTWS; LRDNLTWSD; RDNLTWSDG; DNLTWSDGV;
NLTWSDGVA; LTWSDGVAL; TWSDGVALT; WSDGVALTA; SDGVALTAF;
DGVATTAFG; GVATTAFGT; VATTAFGTR; ATTAFGTRK; TTAFGTRKS;
TAFGTRKSY; AFGTRKSYI; FGTRKSYIR; GTRKSYIRI; TRKSYIRIL;
RKSYIRILN; KSYLRILNK; SYLRILNKE; YLRILNKET; LRILNKETC;
RILNKETCS; ILNKETCST; LKETCSTY; KETCSTYV; KETCSTYVD;
ETCSTYVDM; TCSTYVDMV; CSTYVDMVK; STYVDMVKS; TYVDMVKST;
YVDMVKSTT; VDMVKSTTK; DMVKSTTKG; MVKSTTKGG; VKSTTKGGQ;
KSTTKGGQE; STTKGGQEY; TTKGGQEYF; TKGGQEYFD; KGGQEYFDG;
GGQEYFDGQ; GQEYFDGQV; QEYFDGQVT; EYFDGQVTD; YFDGQVTDS;
FDGQVTDSF; DGQVTDSFL; GQVTDSFLG; QVTDSFLGT; VTDSFLGTR;
TDSFLGTRA; DSFLGTRAT; SFLGTRATD; FLGTRATDS; LGTRATDSK;
GTRATDSKT; TRATDSKTL; RATDSKTLE; ATDSKTLEI; TDSKTLEIT;
DSKTLEITL; SKTLEITLA; KTLEITLAS; TLEITLASP; LEITLASPK;
EITLASPKP; ITLASPKPY; TLASPKPYF; LASPKPYFI; ASPKPYFID;
SPKPYFIDL; PKPYFIDLL; KPYFIDLLV; PYFIDLLVH; YFIDLLVHQ;
FIDLLVHQS; IDLLVHQSF; DLLVHQSFI; LLVHQSFIP; LVHQSFIPV;
VHQSFIPVP; HQSFIPVPV; QSFIPVPVH; SFIPVPVHV; FIPVPVHVT;
IPVPVHVTD; PVPVHVTDK; VPVHVTDKY; PVHVTDKYG; VHVTDKYGQ;
HVTDKYGQN; VTDKYGQNW; TDKYGQNWT; DKYGQNWTS; KYGQNWTSP;
YGQNWTSPE; GQNWTSPEK; QNWTSPEKM; NWTSPEKMV; WTSPEKMVT;
TSPEKMVTS; SPEKMVTSG; PEKMVTSGP; EKMVTSGPF; KMVTSGPFK;
MVTSGPFKL; VTSGPFKLK; TSGPFKLKE; SGPFKLKER; GPFKLKERI;
PFKLKERIP; FKLKERIPS; KLKERIPSE; LKERIPSEK; KERIPSEKY;
ERIPSEKYV; RIPSEKYVF; IPSEKYVFE; PSEKYVFEK; SEKYVFEKD;
EKYVFEKDN; KYVFEKDNK; YVFEKDNKY; VFEKDNKYY; FEKDNKYYD;
```

Fig. 31 continued

EKNKYYDS; KNKYYDSK; NKYYDSNE; KYYDSNEV; YYDSNEVE;
YYDSNEVEL; YDSNEVELE; DSNEVELEE; SNEVELEET; NEVELEETT;
EVELEETTY; VELEETTPY; ELEETTPYT; LEETTPYTL; EETTPYTN;
ELTTYLRDS; LTTYLRDS; TTYLRDSS; TYLRDSST; YLRDSSTA;
LRDSSTAY; RDSSTAYK; DSSTAYKM; SSTAYKMY; STAYKMYV;
STAYKMYVN; TAYKMYVNE; AYKMYVNEE; YKMYVNEEL; KMYVNEELD;
MYVNEELDA; YVNEELDAT; VNEELDATL; NEELDATLV

ASPKPYFIDL; SPKPYFIDLL; PKPYFIDLLV; KPYFIDLLVH;
PYFIDLLVHQ; YFIDLLVHQS; FIDLLVHQSF; IDLLVHQSFP;
DLLVHQSFPP; LLVHQSFPPV; LVHQSFPVPV; VHQSFPVPVH;
HQSFPVPVH; QSFPVPVEV; SFPVPVHVL; FPVPVHVID;
LPVPVHVDK; PVPVHVIDKY; VPVHVIDKYG; PVHVIDKYGQ;
VHVIDKYGQN; HVIDKYGQNW; VIDKYGQNWT; IDKYGQNWTS;
DKYGQNWTSP; KYGQNWTSPF; YGQNWTSPFK; GQNWTSPFKM;
QNWTSPFKMV; NWTSPFKMVT; WTSPFKMVTS; TSPFKMVTSG;
SPFKMVTSGP; PFKMVTSGPF; FKMVTSGPFK; KMVTSGPFKL;
MVTSGPFKLK; VTSGPFKLKF; TSGPFKLKER; SGPFKLKERT;
GPFKLKERTP; PFKLKERTPS; FKLKERTPSF; KLKERTPSFK;
LKERTPSFKY; KERTPSFKYV; ERTPSFKYVF; RTPSFKYVFE;
TPSFKYVFEK; PSFKYVFEKD; SFKYVFEKDN; FKYVFEKDNK;
KYVFEKDNKY; YVFEKDNKYY; VFEKDNKYYD; FEKDNKYYDS;
EKDNKYYDSN; KDNKYYDSNE; DKNYYDSNEV; KNYYDSNEVL;
KYYDSNEVEL; YYDSNEVELE; YDSNEVELEE; DSNEVELEEL;
SNEVELEELT; NEVELEELTF; EVELEELTFY; VELEELTFYT;
ELEELTFYT; LEELTFYTTN; EELTFYTTND; ELTFYTTNDS;
LTFYTTNDSS; TFYTTNDSST; FYTTNDSSTA; YTTNDSSTAY;
TTNDSSTAYK; TNDSSTAYKM; NDSSTAYKMY; DSSTAYKMYV;
SSTAYKMYVE; STAYKMYVEF; TAYKMYVEFE; AYKMYVNEEL;
YKMYNEELD; KMYVNEELDA; MYVNEELDAL; YVNEELDALL;
VNEELDALLV; NEELDAILVP; EELDAILVPY; ELDAILVPYP;
LDAILVFYPQ; DAILVPYPQL;

L1 more:
NKLQRSLSLLI; KLQRSLSLLIF; LQRSLSLLIFS; QRSLSLLIFSL;
RSLSLLIFSLT; SLSLIFSLTV; LSLIFSLTVL; SLIFSLTVLC;
LIFSLTVLCC; IFSLTVLCCD; FSLTVLCCDK; SLTVLCCDNK;
SLTVLCCDNKE; LTVLCCDNKER; TVLCCDNKERK; VLCCDNKERKE;
LCCDNKERKEG; CCDNKERKEGV; CDNKERKEGVS; DNKERKEGVST;
NKERKEGVSTK; KERKEGVSTKT; ERKEGVSTKTS; RKEGVSTKTSI;
KEGVSTKTSLG; EGVSTKTSLGA; GVSTKTSLGAE; VSTKTSLGAEP;
STKTSLGAEPR; TKTSLGAEPRS; KTSLGAEPRSL; TSLGAEPRSLD;
SLGAEPRSLDP; LGAEPRSLDPQ; GAEPRSLDPQL; AEPRSLDPQLA;
EPRSLDPQLAE; PRSLDPQLAED; RSLDPQLAEDN; SLDPQLAEDNV;
LDPQLAEDNVA; DPQLAEDNVAS; PQLAEDNVASK; QLAEDNVASKM;
LAEDNVASKMI; AEDNVASKMID; EDNVASKMIDT; DNVASKMIDTL;
NVASKMIDTLY; VASKMIDTLYR; ASKMIDTLYRG; SKMIDTLYRGT;
KMIDTLYRGTV; MIDTLYRGTVT; IDTLYRGTVTG; DTLYRGTVTGD;
TLYRGTVTGD; LYRGTVTGDPN; YRGTVTGDPNT; RGTVTGDPNTG;
GTVTGDPNTGG; TVTGDPNTGGH; VTGDPNTGGHK; TGDPNTGGHKP;
GDPNTGGHKPG; DPNTGGHKPGL; PKTGGHKPGLA; NTGGHKPGLAK;
TGGHKPGLAKG; GGHKPGLAKGW; GHKPGLAKGWE; HKPGLAKGWET;
KPGLAKGWETS; PGLAKGWETSS; GLAKGWETSSD; LAKGWETSSDG;
AKGWETSSDGT; KGWETSSDGTA; GWETSSDGTAY; WETSSDGTAYP;
ETSSDGTAYPF; TSSDGTAYPFY; SSDGTAYPFYL; SDGTAYPFYLR;
DGTAYPFYLRD; GTAYPFYLRDN; TAYPFYLRDNL; AYPFYLRDNLW;
YPFYLRDNLW; PFYLRDNLWS; FYLRDNLTWSD; YLRDNLTWSDG;
LRDNLTWSDGV; RDNLTWSDGVA; DNLTWSDGVAL; NLTWSDGVALT;
LTWSDGVALTA; TSDGVATTAE; WSDGVATTAEG; SDGVATTAEGT;

Fig. 31 continued

| | |
|---|---|
| | DQVAITAEGIR; QVAITAEGIRK; VAITAEGIRKS; AITAEGIRKSY; ITAEGIRKSYL; TAEGIRKSYLR; AEGIRKSYLRI; EGIRKSYLRTL; GIRKSYLRTLN; IRKSYLRTLNK; RKSYLRTLNKE; KSYLRTLNKET; SYLRTLNKETG; YLRTLNKETGS; LRTLNKETGSI; RTLNKETGSTY; TLNKETGSTYV; LNKETGSTYVD; NKETGSTYVDM; KETGSTYVDMV; ETGSTYVDMVK; TGSTYVDMVKS; GSTYVDMVKST; STYVDMVKSTT; TYVDMVKSTTK; YVDMVKSTTKN; VDMVKSTTKNG; DMVKSTTKNGQ; MVKSTTKNGQE; VKSTTKNGQEY; KSTTKNGQEYF; STTKNGQEYFD; TTKNGQEYFDG; TKNGQEYFDGQ; KNGQEYFDGQV; NGQEYFDGQVT; GQEYFDGQVTD; QEYFDGQVTDS; EYFDGQVTDSE; YFDGQVTDSEL; FDGQVTDSELG; DGQVTDSELGT; GQVTDSELGTR; QVTDSELGTRA; VTDSELGTRAI; TDSELGTRAID; DSELGTRAIDS; SELGTRAIDSK; ELGTRAIDSKT; LGTRAIDSKTL; GTRAIDSKTLE; TRAIDSKTLET; RAIDSKTLETI; AIDSKTLETIL; IDSKTLETILA; DSKTLETILAS; SKTLETILASP; KTLETILASPK; TLETILASPKP; LETILASPKPY; ETILASPKPYF; TILASPKPYFI; ILASPKPYFID; LASPKPYFIDL; ASPKPYFIDLL; SPKPYFIDLLV; PKPYFIDLLVH; KPYFIDLLVHQ; PYFIDLLVHQS; YFIDLLVHQSF; FIDLLVHQSFI; IDLLVHQSFIP; DLLVHQSFIPV; LLVHQSFIPVP; LVHQSFIPVPV; VHQSFIPVPVH; HQSFIPVPVHV; QSFIPVPVHVT; SFIPVPVHVTD; FIPVPVHVTDK; IPVPVHVTDKY; PVPVHVTDKYG; VPVHVTDKYGQ; PVHVTDKYGQN; VHVTDKYGQNW; HVTDKYGQNWT; VTDKYGQNWTS; TDKYGQNWTSP; DKYGQNWTSPE; KYGQNWTSPEN; YGQNWTSPENM; GQNWTSPENMV; QNWTSPENMVT; NWTSPENMVTS; WTSPENMVTSG; TSPENMVTSGP; SPENMVTSGPF; PENMVTSGPFK; ENMVTSGPFKL; NMVTSGPFKLE; MVTSGPFKLER; VTSGPFKLERI; TSGPFKLERIP; SGPFKLERIPS; GPFKLERIPSE; PFKLERIPSEK; FKLERIPSEKY; KLERIPSEKYV; LERIPSEKYVF; ERIPSEKYVFF; RIPSEKYVFFK; IPSEKYVFFKD; PSEKYVFFKDN; SEKYVFFKDNK; EKYVFFKDNKY; KYVFFKDNKYY; YVFFKDNKYYD; VFFKDNKYYDS; FFKDNKYYDSN; FKDNKYYDSNE; KDNKYYDSNEV; DNKYYDSNEVE; NKYYDSNEVEL; KYYDSNEVELF; YYDSNEVELEF; YDSNEVELFFT; DSNEVELFFTI; SNEVELFFTIF; NEVELFFTIFY; EVELFFTIFYT; VELFFTIFYTI; ELFFTIFYTIN; LFFTIFYTINQ; FFTIFYTINQS; FTIFYTINQSS; TIFYTINQSST; IFYTINQSSTA; FYTINQSSTAY; YTINQSSTAYK; TINQSSTAYKM; INQSSTAYKMY; NQSSTAYKMYV; QSSTAYKMYVE; SSTAYKMYVEE; STAYKMYVEEL; TAYKMYVEELD; AYKMYVEELDA; YKMYVEELDAI; KMYVEELDAIL; MYVEELDAILV; YVEELDAILVP; VEELDAILVPY; EELDAILVPYP; ELDAILVPYPQ; LDAILVPYPQT; |
| Seq 22 | SEQ ID NO 23356 244737 8 mers: MNLIEKLE; NLIEKLEL; LIEKLELT; IEKLELTI; EKLELTIL; KLELTILF; LELTILFS; ELTILFSS; LTILFSSV; TILFSSVT; ILFSSVTS; LFSSVTSC; FSSVTSCK; SSVTSCKL; SVTSCKLY; VTSCKLYK; TSCKLYKK; SCKLYKKI; CKLYKKIT; KLYKKITY; LYKKITYN; YKKITYNA; KKITYNAD; KITYNADQ; ITYNADQV; TYNADQVT; YNADQVTD; NADQVTDK; ADQVTDKL; DQVTDKLK; QVTDKLKS; VTDKLKSN; TDKLKSNK; DKLKSNKG; KLKSNKGS; LKSNKGSF; KSNKGSFN; SNKGSFNT; NKGSFNTL; |

Fig. 31 continued

RGSFKTLK; GSFKTLKS; SFKTLKSF; FKTLKSFD; KTLKSNDD;
TLKSNDDS; LKSNDDSK; KSNDDSKR; SNDDSKRS; NDDSKRSG;
DDSKRSGR; DSKRSGRK; SKRSGRKP; KRSGRKPR; RSGRKPRS;
SGRKPRSV; GRKPRSVD; RKPRSVDK; KPRSVDKT; PRSVDKTY;
RSVDKTYM; SVDKTYMD; VDKTYMDQ; DKTYMDQD; KTYMDQDT;
TYMDQDTG; YMDQDTGK; MDQDTGKK; DQDTGKKP; QDTGKKPL;
DTGKKPLM; TGKKPLMA; GKKPLMAD; KKPLMADM; KPLMADMQ;
PLMADMQP; LMADMQPL; MADMQPLM; ADMQPLMQ; DMQPLMQD;
MQPLMQKD; QPLMQKDL; PLMQKDNS; LMQKDNSS; MQKDNSSN;
QKDNSSNN; KDNSSNNL; DNSSNNLT; NSSNNLTQ; SSNNLTQV;
SSNNLTQV; SNNLTQVK; NNLTQVKT; NLTQVKTQ; TLQVKTQD;
LQVNLQDD; QVKLQDDL; VNLQDDLA; NLQDDLAS; LQDDLASF

Fig. 31 continued

RKQKELKEN; KQKELNENM; QKELNENMT; KELNENMTK; ELNENMTKT;
LNENMTKTN; NENMTKTNK; ENMTKTNKD; NMTKTNKDF; MTKTNKDFQ;
TKTNKDFQF; KTNKDFQFL; TNKDFQFLN; NKDFQFLND; KDFQFLNDI;
DFQFLNDIY; FQFLNDIYK; QFLNDIYKK; FLNDIYKKL; LNDIYKKLQ;
NDIYKKLQD; DIYKKLQDM; IYKKLQDMD; YKKLQDMDS; KKLQDMDSR;

10 mers:
NKLINKLFIL; KLINKLFILI; LINKLFILTL; INKLFILTLF;
NKLFILTLFS; KLFILTLFSS; LFILTLFSSV; FILTLFSSVT;
ILTLFSSVTS; LTLFSSVTSC; TLFSSVTSCK; LFSSVTSCKL;
FSSVTSCKLY; SSVTSCKLYK; SVTSCKLYKK; VTSCKLYKKI;
TSCKLYKKIT; SCKLYKKITY; CKLYKKITYN; KLYKKITYNA;
LYKKITYNAD; YKKITYNADQ; KKITYNADQV; KITYNADQVI;
ITYNADQVID; TYNADQVIDK; YNADQVIDKL; NADQVIDKLK;
ADQVIDKLKS; DQVIDKLKSN; QVIDKLKSNN; VIDKLKSNNG;
IDKLKSNNGS; DKLKSNNGSF; KLKSNNGSFN; LKSNNGSFNT;
KSNNGSFNTL; SNNGSFNTLK; NNGSFNTLKS; NGSFNTLKSN;
GSFNTLKSND; SFNTLKSNDD; FNTLKSNDDS; NTLKSNDDSK;
TLKSNDDSKR; LKSNDDSKRS; KSNDDSKRSG; SNDDSKRSGK;
NDDSKRSGKR; DDSKRSGKRP; DSKRSGKRPS; SKRSGKRPSV;
KRSGKRPSVD; RSGKRPSVDK; SGKRPSVDKT; GKRPSVDKTY;
KRPSVDKTYM; RPSVDKTYMD; PSVDKTYMDQ; SVDKTYMDQD;
VDKTYMDQDT; DKTYMDQDTG; KTYMDQDTGK; TYMDQDTGKK;
YMDQDTGKKP; MDQDTGKKPL; DQDTGKKPLM; QDTGKKPLMA;
DTGKKPLMAD; TGKKPLMADM; GKKPLMADMQ; KKPLMADMQP;
KPLMADMQPD; PLMADMQPDM; LMADMQPDMQ; MADMQPDMQD;
ADMQPDMQDT; DMQPDMQDTS; MQPDMQDTSS; QPDMQDTSSS;
PDMQDTSSSN; DMQDTSSSNN; MQDTSSSNNH; QDTSSSNNHT;
DTSSSNNHTL; TSSSNNHTLQ; SSSNNHTLQV; SSNNHTLQVN;
SNNHTLQVNL; NNHTLQVNLQ; NHTLQVNLQD; HTLQVNLQDN;
TLQVNLQDNF; LQVNLQDNFA; QVNLQDNFAS; VNLQDNFASF;
NLQDNFASFA; LQDNFASFAR; QDNFASFARN; DNFASFARNT;
NFASFARNTM; FASFARNTMT; ASFARNTMTE; SFARNTMTEI;
FARNTMTEIE; ARNTMTEIES; RNTMTEIESS; NTMTEIESSK;
TMTEIESSKF; MTEIESSKFY; TEIESSKFYN; EIESSKFYNR;
IESSKFYNRT; ESSKFYNRTN; SSKFYNRTNE; SKFYNRTNED;
KFYNRTNEDL; FYNRTNEDLA; YNRTNEDLAK; NRTNEDLAKV;
RTNEDLAKVK; TNEDLAKVKA; NEDLAKVKAS; EDLAKVKASL;
DLAKVKASLD; LAKVKASLDK; AKVKASLDKT; KVKASLDKTK;
VKASLDKTKS; KASLDKTKSL; ASLDKIKSLL; SLDKIKSLLS; LDKIKSLLST;
DKIKSLLSTA; KIKSLLSTAK; IKSLLSTAKS; KSLLSTAKSY;
SLLSTAKSYL; LLSTAKSYLF; LSTAKSYLFQ; STAKSYLFQT;
TAKSYLFQTR; AKSYLFQTRR; KSYLFQTRRG; SYLFQTRRGV;
YLFQTRRGVG; LFQTRRGVGS; FQTRRGVGSS; QTRRGVGSSK;
TRRGVGSSKA; RRGVGSSKAN; RGVGSSKANL; GVGSSKANLA;
VGSSKANLAL; GSSKANLALL; SSKANLALLP; SKANLALLPS;
KANLALLPSL; ANLALLPSLE; NLALLPSLEE; LALLPSLEEA;
ALLPSLEEAL; LLPSLEEALA; LPSLEEALAK; PSLEEALAKV;
SLEEALAKVK; LEEALAKVKS; EEALAKVKSN; EALAKVKSNH;
ALAKVKSNHA; LAKVKSNHAS; AKVKSNHASA; KVKSNHASAD;

| | | | | |
|---|---|---|---|---|
| RDSALDAS; | TSALKASR; | SALDASRK; | ALDASRKN; | LKASRKNG; |
| KASRKNGT; | ASRKNGTK; | SRNGTKA; | RNGTKAA; | NGTKAAN; |
| KGTKAANL; | GTKAANLS; | TKAANLSK; | KAANLSKT; | AANLSKTQ; |
| ANLSKTQE; | NLSKTQEK; | LSKTQEKL; | SKTQEKLS; | KTQEKLSS; |
| TQEKLSSG; | QEKLSSGY; | EKLSSGYR; | KLSSGYRL; | LSSGYRLN; |
| SSGYRTNR; | SGYRTNRA; | GYRTNRAS; | YRTNRASD; | RTNRASDD; |
| TNRASDDA; | NRASDDAA; | RASDDAAG; | ASDDAAGM; | SDDAAGMG; |
| DDAAGMGV; | DAAGMGVS; | AAGMGVSG; | AGMGVSGK; | GMGVSGKT; |
| MGVSGKTN; | GVSGKTNA; | VSGKTNAQ; | SGKTNAQT; | GKTNAQTR; |
| KTNAQTRG; | TNAQTRGL; | NAQTRGLS; | AQTRGLSQ; | QTRGLSQA; |
| TRGLSQAS; | RGLSQASR; | GLSQASRK; | LSQASRKT; | SQASRKTS; |
| QASRKTSK; | ASRKTSKA; | SRKTSKAI; | RKTSKAIN; | NTSKAINF; |
| TSKAINFT; | SKAINFTQ; | KAINFTQT; | AINFTQT; | INFTQTT; |
| NFTQTTEG; | FTQTTEGN; | TQTTEGNL; | QTTEGNLN; | TTEGNLNE; |
| TEGNLNEV; | EGNLNEVE; | GNLNEVEK; | NLNEVEKV; | LNEVEKVL; |
| NEVEKVLV; | EVEKVLVR; | VEKVLVRK; | EKVLVRKE; | KVLVRKEL; |
| VLVRMKEL; | LVRMKELA; | VRMKELAV; | RMKELAVQ; | MKELAVQS; |
| KELAVQSG; | ELAVQSGK; | LAVQSGKG; | AVQSGKGT; | VQSGKGTY; |
| QSGKGTYS; | SGKGTYSD; | GKGTYSDA; | KGTYSDAD; | GTYSLADR; |
| TYSDADRG; | YSDADRGS; | SDADRGSI; | DADRGSIQ; | ADRGSIQT; |
| DRGSIQTR; | RGSTQTET; | GSTQTETE; | STQTETEQ; | TQTETEQL; |
| QTETEQLT; | TETEQLTE; | ETEQLTDE; | TEQLTDEI; | EQLTDEIN; |
| QLTDEIKR; | LTDEINRL; | TDEIKRLA; | DEIKRLAD; | EINRLADQ; |
| INRLADQA; | NRLADQAQ; | RLADQAQY; | LADQAQYN; | ADQAQYKQ; |
| DQAQYKQM; | QAQYKQMH; | AQYKQMHM; | QYKQMHML; | YKQMHMLS; |
| KQMHMLSN; | QMHMLSNK; | MHMLSNKS; | HMLSNKSA; | MLSNKSAS; |
| LSNKSASQ; | SNKSASQN; | NKSASQNV; | KSASQKVR; | SASQKVRT; |
| ASQNVRTA; | SQNVRTAF; | QNVRTAFE; | NVRTAFEL; | VRTAFELG; |
| RTAFELGM; | TAFELGMQ; | AFELGMQP; | FELGMQPA; | ELGMQPAK; |
| LGMQPAKI; | GMQPAKIE; | MQPAKIN; | QPAKINTP; | PAKINTPA; |
| AKINTPAS; | KINTPASL; | INTPASLS; | NTPASLSG; | TPASLSGS; |
| PASLSGSQ; | ASLSGSQA; | SLSGSQAS; | LSGSQASN; | SGSQASNT; |
| GSQASNT; | SQASNTR; | QASNTRV; | ASNTRVH; | SNTRVHV; |
| NTRVHVG; | TLRVHVGA; | LRVHVGAK; | RVHVGAKQ; | VHVGAKQD; |
| HVGAKQEE; | VGAKQDFA; | GAKQDFAT; | AKQDFATA; | KQDFATAV; |
| QDFATAVN; | DFATAVNT; | FATAVNTY; | ATAVNTYA; | TAVNTYAA; |
| AVNTYAAN; | VNTYAANV; | NTYAANVA; | TYAANVAN; | YAANVANL; |
| AANVANLF; | ANVANLFS; | NVANLFSG; | VANLFSGE; | ANLFSGEG; |
| NLFSGEGA; | LFSGEGAQ; | FSGEGAQT; | SGEGAQTA; | GEGAQTAG; |
| EGAQTAQA; | GAQTAQAA; | AQTAQAAP; | QTAQAAPV; | TAQAAPVQ; |
| AQAAPVQE; | QAAPVQEG; | AAPVQECV; | APVQECVQ; | PVQECVQQ; |
| VQECVQQE; | QECVQQEG; | ECVQQEGA; | CVQQEGAQ; | VQQEGAQQ; |
| QQEGAQQP; | QEGAQQPA; | EGAQQPAP; | GAQQPAPA; | AQQPAPAT; |
| QQPAPATA; | QPAPATAP; | PAPATAPS; | APATAPSQ; | PATAPSQG; |
| ATAPSQGG; | TAPSQGV; | APSQGVE; | PSQGVES; | SQGVNSP; |
| QGGVESPV; | GGVNSPVK; | GVESPVNV; | VKSPVKVT; | NSPVKVTT; |
| SPVNVTTT; | PVNVTTTV; | VNVTTTVD; | NVTTTVDA; | VTTTVDAN; |
| TTTVDANT; | TTVDANTS; | TVDANTSL; | VDANTSLA; | DANTSLAK; |
| ANTSLAKI; | NTSLAKIE; | TSLAKIEK; | SLAKIEKA; | LAKIENAI; |
| AKIENAIR; | KIENAIRK; | IENAIRKI; | ENAIRKIS; | NAIRKISD; |
| AIRMSDQ; | TRMSDQR; | RMSDQRA; | MSDQRAN; | TSDQRAKI; |

Fig. 31 continued

SDQRADLG; DQRADLGA; QRADLGAE; RADLGAEQ; ADLGAEQR;
DLGAEQKR; LGAEQKRL; GAEQKRLE; AEQKRLES; EQKRLEST;
QKRLESTK; KRLESTKN; RLESTKNS; LESTKNST; ESTKNSTE;
STKNSTEY; TKNSTEYA; KNSTEYAI; NSTEYAIE; STEYAIEN;
TEYAIENL; EYAIENLK; YAIENLKA; AIENLKAS; IENLKASY;
ENLKASYA; NLKASYAQ; LKASYAQT; KASYAQTK; ASYAQTKD;
SYAQTKDA; YAQTKDAT; AQTKDATM; Q

RVQAKQDEA; VQAKQDEAI; QAKQDEAIA; AKQDEAIAV; KQDEAIAVK;
QDEAIAVKT; DEAIAVKTY; EAIAVKTYA; AIAVKTYAA; IAVKTYAAN;
AVKTYAANV; VKTYAANVA; KTYAANVAK; TYAANVAKL; YAANVAKLF;
AANVAKLFS; ANVAKLFSG; NVAKLFSGG; VAKLFSGGA; AKLFSGGAQ;
KLFSGGAQT; LFSGGAQTA; FSGGAQTAQ; SGGAQTAQA; GGAQTAQAA;
GAQTAQAAP; AQTAQAAPV; QTAQAAPVQ; TAQAAPVQF;
AQAAPVQFG; QAAPVQFGV; AAPVQFGVQ; APVQFGVQQ; PVQFGVQQF;
VQFGVQQFG; QFGVQQFGA; FGVQQFGAQ; GVQQFGAQQ; VQQFGAQQF;
QQFGAQQPA; QFGAQQPAP; FGAQQPAPA; GAQQPAPAT; AQQPAPATA;
QQPAPATAP; QPAPATAPS; PAPATAPSQ; APATAPSQG; PATAPSQGG;
ATAPSQGGV; TAPSQGGVK; APSQGGVKS; PSQGGVKSP; SQGGVKSPV;
QGGVKSPVD; GGVKSPVDV; GVKSPVDVT; VKSPVDVTT; KSPVDVTTV;
SPVDVTTVD; PVDVTTVDA; VDVTTVDAN; DVTTVDANT; VTTVDANTS;
TTVDANTSL; TVDANTSLA; VDANTSLAK; DANTSLAKT;
ANTSLAKLE; NTSLAKLEN; TSLAKLENA; SLAKLENAI; LAKLENAIR;
AKLENAIRM; KLENAIRMT; LENAIRKLS; ENAIRMTSD; NAIRMTSDQ;
ATRMTSDQR; TRMTSDQRA; RMTSDQRAK; MTSDQRAKL; TSDQRAKLG;
SDQRAKLGA; DQRAKLGAF; QRAKLGAFQ; RAKLGAFQK; AKLGAFQKR;
KLGAFQKRL; LGAFQKRLE; GAFQKRLES; AFQKRLESI; FQKRLESIK;
QKRLESIKN; KRLESIKNS; RLESIKNST; LESIKNSTE; ESIKNSTEY;
SIKNSTEYA; IKNSTEYAT; KNSTEYATF; NSTEYATEN; STEYATENL;
TEYALENLK; EYALENLKA; YALENLKAS; ALENLKASY; LENLKASYA;
ENLKASYAQ; NLKASYAQI; LKASYAQIK; KASYAQIKD; ASYAQIKDA;
SYAQIKDAT; YAQIKDATM; AQIKDATMT; QIKDATMTD; IKDATMTDF;
KDATMTDFV; DATMTDFVV; ATMT

IQTTEGKLNE; QTTEGKLKEV; TTEGKLKEVE; TEGKLKEVEK;
EGKLKEVEKV; GKLKEVEKVL; KLKEVEKVLR; LKEVEKVLVR;
KEVEKVLVRK; EVEKVLVRMK; VEKVLVRMKE; EKVLVRMKEL;
KVLVRMKELA; VLVRMKELAV; LVRMKELAVQ; VRMKELAVQS;
RMKELAVQSG; MKELAVQSGN; KELAVQSGNG; ELAVQSGNGT;
LAVQSGNGTY; AVQSGNGTYS; VQSGNGTYSD; QSGNGTYSDA;
SGNGTYSDAR; GNGTYSDADR; NGTYSDADRG; GTYSDADRGS;
TYSDADRGSL; YSDADRGSLQ; SDADRGSLQT; DADRGSLQTF;
ADRGSLQTFT; DRGSLQTFTF; RGSLQTFTFQ; GSLQTFTFQL;
SLQTFTFQLT; LQTFTFQLTD; QTFTFQLTDE; TFTFQLTDET;
FTFQLTDETN; TFQLTDETNR; FQLTDETNRT; QLTDETNRTA;
LTDETNRTAD; TDETNRTADQ; DETNRTADQA; ETNRTADQAQ;
TNRTADQAQY; NRTADQAQYN; RTADQAQYNQ; TADQAQYNQM;
ADQAQYNQMH; DQAQYNQMHM; QAQYNQMHML; AQYNQMHMLS;
QYNQMHMLSK; YNQMHMLSNK; NQMHMLSNKS; QMHMLSNKSA;
MHMLSNKSAS; HMLSNKSASQ; MLSNKSASQN; LSNKSASQNV;
SNKSASQNVR; NKSASQNVRT; KSASQNVRTA; SASQNVRTAF;
ASQNVRTAFE; SQNVRTAFEL; QNVRTAFELG; NVRTAFELGM;
VRTAFELGMQ; RTAFELGMQP; TAFELGMQPA; AFELGMQPAK;
FELGMQPAKI; ELGMQPAKIN; LGMQPAKINT; GMQPAKINTP;
MQPAKINTPA; QPAKINTPAS; PAKINTPASL; AKINTPASLS;
KINTPASLSG; INTPASLSGS; NTPASLSGSQ; TPASLSGSQA;
PASLSGSQAS; ASLSGSQASW; SLSGSQASWT; LSGSQASWTL;
SGSQASWTLR; GSQASWTLRV; SQASWTLRVH; QASWTLRVHV;
ASWTLRVHVG; SWTLRVHVGA; WTLRVHVGAN; TLRVHVGANQ;
LRVHVGANQD; RVHVGANQDE; VHVGANQDEA; HVGANQDEAL;
VGANQDEALA; GANQDEALAV; ANQDEALAVN; NQDEALAVNT;
QDEATAVNTY; DEATAVNTYA; EATAVNTYAA; ATAVNTYAAN;
TAVNTYAANV; AVNTYAANVA; VNTYAANVAN; NTYAANVANL;
TYAANVANLF; YAANVANLFS; AANVANLFSG; ANVANLFSGE;
NVANLFSGEG; VANLFSGEGA; ANLFSGEGAQ; NLFSGEGAQT;
LFSGEGAQTA; FSGEGAQTAQ; SGEGAQTAQA; GEGAQTAQAA;
EGAQTAQAAP; GAQTAQAAPV; AQTAQAAPVQ; QTAQAAPVQE;
TAQAAPVQEG; AQAAPVQEGV; QAAPVQEGVQ; AAPVQEGVQQ;
APVQEGVQQF; PVQEGVQQFG; VQEGVQQFGA; QEGVQQFGAQ;
EGVQQFGAQQ; GVQQFGAQQP; VQQFGAQQPA; QQFGAQQPAP;
QFGAQQPAPA; FGAQQPAPAT; GAQQPAPATA; AQQPAPATAP;
QQPAPATAPS; QPAPATAPSQ; PAPATAPSQG; APATAPSQGG;
PATAPSQGGV; ATAPSQGGVN; TAPSQGGVNS; APSQGGVNSP;
PSQGGVNSPV; SQGGVNSPVN; QGGVNSPVNV; GGVNSPVNVT;
GVNSPVNVTT; VNSPVNVTTV; NSPVNVTTVD; SPVNVTTVDA;
PVNVTTVDAN; VNVTTVDANT; NVTTVDANTS; VTTVDANTSI;
TTVDANTSIA; TVDANTSIAK; VDANTSIAKT; DANTSIAKTE;
ANTSIAKTEN; NTSIAKTENA; TSIAKTENAI; SIAKTENAIR;
IAKTENAIRM; AKTENAIRMI; KTENAIRMIS; TENAIRMISD;
ENAIRMISDQ; NAIRMISDQR; AIRMISDQRA; IRMISDQRAN;
RMISDQRANL; MISDQRANLG; ISDQRANLGA; SDQRANLGAF;
DQRANLGAFQ; QRANLGAFQN; RANLGAFQNR; ANLGAFQNRL;
NLGAFQNRLE; LGAFQNRLES; GAFQNRLESI; AFQNRLESIK;
FQNRLESIKN; QNRLESIKNS; NRLESIKNST; RLESIKNSTE;
LESIKNSTEY; ESIKNSTEYA; SIKNSTEYAT;

```
IKNSTEYAIE; KNSTEYAIEN; NSTEYAIENL; STEYAIENLK;
TEYAIENLKA; EYAIENLKAS; YAIENLKASY; AIENLKASYA;
IENLKASYAQ; ENLKASYAQI; NLKASYAQIK; LKASYAQIKD;
KASYAQIKDA; ASYAQIKDAT; SYAQIKDATM; YAQIKDATMI;
AQIKDATMID; QIKDATMIDE; IKDATMIDEV; KDATMIDEVV;
DATMIDEVVA; ATMIDEVVAA; TMIDEVVAAT; MIDEVVAATT;
IDEVVAATTN; DEVVAATTNS; EVVAATTNSI; VVAATTNSIL;
VAATTNSILI; AATTNSILIQ; ATTNSILIQS; TTNSILTQSA;
TNSILTQSAM; NSILTQSAMA; SILTQSAMAM; ILTQSAMAMT;
LTQSAMAMT

|  | |
|---|---|
|  | VKTAEELGMQF; RIAEELGMQPA; TAEELGMQPAK; AEELGMQPAKL; EELGMQPAKTN; ELGMQPAKTNT; LGMQPAKTNTP; GMQPAKTNTPA; MQPAKTNTPAS; QPAKTNTPASL; PAKTNTPASLS; AKTNTPASLSG; KTNTPASLSGS; TNTPASLSGSQ; NTPASLSGSQA; TPASLSGSQAS; PASLSGSQASW; ASLSGSQASWT; SLSGSQASWTL; LSGSQASWTLR; SGSQASWTLRV; GSQASWTLRVH; SQASWTLRVHV; QASWTLRVHVG; ASWTLRVHVGA; SWTLRVHVGAN; WTLRVHVGANQ; TLRVHVGANQD; LRVHVGANQDF; RVHVGANQDFA; VHVGANQDFAT; HVGANQDFATA; VGANQDFATAV; GANQDFATAVN; ANQDFATAVNT; NQDFATAVNTY; QDFATAVNTYA; DFATAVNTYAA; FATAVNTYAAK; ATAVNTYAAKV; TAVNTYAAKVA; AVNTYAAKVAN; VNTYAAKVANL; NTYAAKVANLF; TYAAKVANLFS; YAAKVANLFSG; AAKVANLFSGF; AKVANLFSGFG; KVANLFSGFGA; VANLFSGFGAQ; ANLFSGFGAQT; NLFSGFGAQTA; LFSGFGAQTAQ; FSGFGAQTAQA; SGFGAQTAQAA; GFGAQTAQAAP; FGAQTAQAAPV; GAQTAQAAPVQ; AQTAQAAPVQE; QTAQAAPVQEG; TAQAAPVQEGV; AQAAPVQEGVQ; QAAPVQEGVQQ; AAPVQEGVQQF; APVQEGVQQFG; PVQEGVQQFGA; VQEGVQQFGAQ; QEGVQQFGAQQ; EGVQQFGAQQP; GVQQFGAQQPA; VQQFGAQQPAP; QQFGAQQPAPA; QFGAQQPAPAT; FGAQQPAPATA; GAQQPAPATAP; AQQPAPATAPS; QQPAPATAPSQ; QPAPATAPSQG; PAPATAPSQGG; APATAPSQGGV; PATAPSQGGVN; ATAPSQGGVNS; TAPSQGGVNSP; APSQGGVNSPV; PSQGGVNSPVN; SQGGVNSPVNV; QGGVNSPVNVT; GGVNSPVNVTT; GVNSPVNVTTV; VNSPVNVTTVD; NSPVNVTTVDA; SPVNVTTVDAN; PVNVTTVDANT; VNVTTVDANTS; NVTTVDANTSL; VTTVDANTSLA; TTVDANTSLAK; TVDANTSLAKT; VDANTSLAKTE; DANTSLAKTEN; ANTSLAKTENA; NTSLAKTENAI; TSLAKTENAIR; SLAKTENAIRM; LAKTENAIRMI; AKTENAIRMIS; KTENAIRMISD; TENAIRMISDQ; ENAIRMISDQR; NAIRMISDQRA; AIRMISDQRAK; IRMISDQRAKL; RMISDQRAKLG; MISDQRAKLGA; ISDQRAKLGAF; SDQRAKLGAFQ; DQRAKLGAFQN; QRAKLGAFQNR; RAKLGAFQNRL; AKLGAFQNRLF; KLGAFQNRLFS; LGAFQNRLFST; GAFQNRLFSTK; AFQNRLFSTKN; FQNRLFSTKNS; QNRLFSTKNST; NRLFSTKNSTF; RLFSTKNSTFY; LFSTKNSTFYA; FSTKNSTFYAT; STKNSTFYATE; TKNSTFYATEN; KNSTFYATENL; NSTFYATENLK; STFYATENLKA; TFYATENLKAS; FYATENLKASY; YATENLKASYA; ATENLKASYAQ; TENLKASYAQT; ENLKASYAQTK; NLKASYAQTKD; LKASYAQTKDA; KASYAQTKDAT; ASYAQTKDATM; SYAQTKDATMT; YAQTKDATMTD; AQTKDATMTDE; QTKDATMTDEV; TKDATMTDEVV; KDATMTDEVVA; DATMTDEVVAA; ATMTDEVVAAT; TMTDEVVAATT; MTDEVVAATTK; TDEVVAATTKS; DEVVAATTKST; EVVAATTKSTL; VVAATTKSTLT; VAATTKSTLTQ; AATTKSTLTQS; ATTKSTLTQSA; TTKSTLTQSAM; TKSTLTQSAMA; KSTLTQSAMAM; STLTQSAMAMI; TLTQSAMAMIA; LTQSAMAMIAQ; TQSAMAMIAQA; QSAMAMIAQAN; SAMAMIAQANQ; AMAMIAQANQV; MAMIAQANQVP; AMIAQANQVPQ; MIAQANQVPQY; IAQANQVPQYV; AQANQVPQYVL; QANQVPQYVLS; ANQVPQYVLSL; NQVPQYVLSLL; QVPQYVLSLLR; |
| Seq 24 | SEQ ID NO 25784-27661/ 8 mers: MKIQRSLF; KIQRSLFL; IQRSLFLT; QRSLFLTT; RSLFLTTF; SLFLTTFL; LFLTTFLI; FLTTFLII; LTTFLIIF; TTFLIIFL; |

```
SQLKLKK;

9 mers:
MKLQRSLFL; KLQRSLFLI; LQRSLFLII; QRSLFLIIF; RSLFLIIFS;
SLFLIIFSL; LFLIIFSLT; FLIIFSLTF; LIIFSLTFL; IIFSLTFLC;
IFSLTFLCC; FSLTFLCCN; SLTFLCCNK; LTFLCCNKF; TFLCCNKFR;
FLCCNKFRK; LCCNKFRKE; CCNKFRKEG; CNKFRKEGV; NKFRKEGVS;
KFRKEGVSF; FRKEGVSFK; RKEGVSFKT; KEGVSFKTS; EGVSFKTSL;
GVSFKTSLG; VSFKTSLGA; SFKTSLGAF; FKTSLGAFP; KTSLGAFPS;
TSLGAFPSS; SLGAFPSSL; LGAFPSSLD; GAFPSSLDP; AFPSSLDPQ;
FPSSLDPQI; PSSLDPQLA; SSLDPQLAE; SLDPQLAED; LDPQLAEDD;
DPQLAEDDV; PQLAEDDVA; QLAEDDVAS; LAEDDVASK; AEDDVASKM;
EDDVASKMT; DDVASKMTD; DVASKMTDT; VASKMTDTM; ASKMTDTMF;
SKMTDTMFR; KMTDTMFRG; MTDTMFRGT; TDTMFRGTV; DTMFRGTVT;
TMFRGTVTG; MFRGTVTGL; FRGTVTGLP; RGTVTGLPN; GTVTGLPNT;
TVTGLPNTG; VTGLPNTGG; TGLPNTGGK; GLPNTGGKP; LPNTGGKPG;
PNTGGKPGL; NTGGKPGLA; TGGKPGLAK; GGKPGLAKG; GKPGLAKGN;
KPGLAKGND; PGLAKGNDI; GLAKGNDIS; LAKGNDISS; AKGNDISSD;
KGNDISSDG; GNDISSDGV; NDISSDGVY; DISSDGVYT; ISSDGVYTF;
SSDGVYTFN; SDGVYTFNL; DGVYTFNLR; GVYTFNLRE; VYTFNLREK;
YTFNLREKI; TFNLREKIT; FNLREKITW; NLREKITWS; LREKITWSD;
REKITWSDG; EKITWSDGV; KITWSDGVA; ITWSDGVAL; TWSDGVALT;
WSDGVALTA; SDGVALTAE; DGVALTAEG; GVALTAEGI; VALTAEGIR;
ALTAEGIRK; LTAEGIRKS; TAEGIRKSY; AEGIRKSYL; EGIRKSYLR;
GIRKSYLRI; IRKSYLRIL; RKSYLRILN; KSYLRILNK; SYLRILNKE;
YLRILNKET; LRILNKETG; RILNKETGS; ILNKETGSK; LNKETGSKY;
NKETGSKYV; KETGSKYVF; ETGSKYVFM; TGSKYVFMV; GSKYVFMVK;
SKYVFMVKS; KYVFMVKSV; YVFMVKSVT; VFMVKSVTK; FMVKSVTKN;
MVKSVTKNG; VKSVTKNGQ; KSVTKNGQK; SVTKNGQKY; VTKNGQKYF;
TKNGQKYFD; KNGQKYFDG; NGQKYFDGQ; GQKYFDGQV; QKYFDGQVT;
KYFDGQVTD; YFDGQVTDS; FDGQVTDSF; DGQVTDSFL; GQVTDSFLG;
QVTDSFLGT; VTDSFLGTR; TDSFLGTRA; DSFLGTRAI; SFLGTRAID;
FLGTRAIDE; LGTRAIDEK; GTRAIDEKT; TRAIDEKTL; RAIDEKTLF;
AIDEKTLFI; IDEKTLFIT; DEKTLFITL; EKTLFITLF; KTLFITLFS;
TLFITLFSP; LFITLFSPK; FITLFSPKP; ITLFSPKPY; TLFSPKPYF;
LFSPKPYFI; FSPKPYFID; SPKPYFIDM; PKPYFIDML; KPYFIDMLV;
PYFIDMLVH; YFIDMLVHQ; FIDMLVHQS; IDMLVHQSF; DMLVHQSFL;
MLVHQSFLP; LVHQSFLPV; VHQSFLPVF; HQSFLPVFV; QSFLPVFVH;
SFLPVFVHV; FLPVFVHVT; LPVFVHVTF; PVFVHVTFK; VFVHVTFKY;
FVHVTFKYG; VHVTFKYGQ; HVTFKYGQN; VTFKYGQNW; TFKYGQNWI;
FKYGQNWIS; KYGQNWISF; YGQNWISFE; GQNWISFEN; QNWISFENM;
NWISFENMV; WISFENMVT; ISFENMVTS; SFENMVTSG; FENMVTSGP;
ENMVTSGPF; NMVTSGPFK; MVTSGPFKL; VTSGPFKLK; TSGPFKLKE;
SGPFKLKER; GPFKLKERI; PFKLKERIP; FKLKERIPN; KLKERIPNE;
LKERIPNEK; KERIPNEKY; ERIPNEKYV; RIPNEKYVF; IPNEKYVFE;
PNEKYVFEK; NEKYVFEKN; EKYVFEKNN; KYVFEKNNK; YVFEKNNKY;
VFEKNNKYY; FEKNNKYYD; EKNNKYYDS; KNNKYYDSE; NNKYYDSEV;
NKYYDSEVE; KYYDSEVEL; YYDSEVELE; YDSEVELEE; DSEVELEEI;
SEVELEEIT; EVELEEITF; VELEEITFY; ELEEITFYT; LEEITFYTT;
EEITFYTTD; EITFYTTDS; ITFYTTDSS; TFYTTDSST; FYTTDSSTA;
```

| | |
|---|---|
| | LELDPIKRQDI; ELDPIKRQDIL; LDPIKRQDILR; DPIKRQDILRQ; PIKRQDILRQA; IKRQDILRQAF; KRQDILRQAFF; RQDILRQAFFI; QDILRQAFFII; DILRQAFFIIT; ILRQAFFIIIK; LRQAFFIIIKD; RQAFFIIIKDF; QAFFIIIKDFP; AFFIIIKDFPI; FFIIIKDFPIA; FIIIKDFPIAF; IIIKDFPIAFI; IIKDFPIAFIY; IKDFPIAFIYI; KDFPIAFIYT; DFPIAFIYTG; FPIAFIYTGK; PIAFIYTGKS; IAFIYTGKSY; AFIYTGKSYL; FIYTGKSYLF; IYTGKSYLFR; YTGKSYLFRN; TGKSYLFRNK; GKSYLFRNDK; KSYLFRNDKW; SYLFRNDKWT; YLFRNDKWTG; LFRNDKWTGN; FRNDKWTGNT; RNDKWTGNTN; NDKWTGNTNI; DKWTGNTNIL; KWTGNTNILF; WTGNTNILFR; TGNTNILFRF; GNTNILFRFD; NTNILFRFDL; TNILFRFDLSQ; NILFRFDLSQ; ILFRFDLSQK; LFRFDLSQKL; FRFDLSQKLK; RFDLSQKLKN; FDLSQKLKNK; |
| Seq 25 | SEQ ID NO 27862-28855/ 8 mers: MKIFSNL; KIFSNLT; IFSNLTT; FSNLTTN; SNLTTNG; NLTTNGL; LTTNGLF; TTNGLFG; TNGLFGF; NGLFGFV; GLFGFVS; LFGFVSL; FGFVSLV; GFVSLVF; FVSLVFA; VSLVFAD; SLVFADS; LVFADSN; VFADSNN; FADSNNA; ADSNNAI; DSNNAIL; SNNAILK; NNAILKP; NAILKPQ; AILKPQS; ILKPQSE; LKPQSEV; KPQSEVL; PQSEVLE; QSEVLEH; SEVLEHS; EVLEHSD; VLEHSDQ; LEHSDQK; EHSDQKD; HSDQKDN; SDQKDNK; DQKDNKK; QKDNKKL; KDNKKLD; DNKKLDQ; NKKLDQK; KKLDQKD; KLDQKDQ; LDQKDQV; DQKDQVN; QKDQVNQ; KDQVNQA; DQVNQAL; QVNQALD; VNQALDT; NQALDTT; QALDTTN; ALDTTNK; LDTTNKV; DTTNKVT; TTNKVTF; TNKVTFD; NKVTFDV; KVTFDVS; VTFDVSS; TFDVSSK; FDVSSKL; DVSSKLE; VSSKLEG; SSKLEGV; SKLEGVR; KLEGVRE; LEGVRES; EGVRESS; GVRESSL; VRESSLF; RESSLFV; ESSLFVS; SSLFVSN; SLFVSND; LFVSNDA; FVSNDAG; VSNDAGV; SNDAGVV; NDAGVVK; DAGVVKK; AGVVKKF; GVVKKFV; VVKKFVG; VKKFVGS; KFVGSMS; FVGSMSL; VGSMSLM; GSMSLMS; SMSLMSD; MSLMSDV; SLMSDVA; LMSDVAK; MSDVAKG; SDVAKGT; DVAKGTV; VAKGTVV; AKGTVVA; KGTVVAS; GTVVASQ; TVVASQE; VVASQEA; VASQEAT; ASQEATT; SQEATTV; QEATTVA; EATTVAK; ATTVAKS; TTVAKSG; TVAKSGM; VAKSGMV; AKSGMVA; KSGMVAE; SGMVAEG; GMVAEGA; MVAEGAK; VAEGAKV; AEGAKVV; EGAKVVE; GAKVVEM; AKVVEMS; KVVEMSK; VVEMSKK; VEMSKKA; EMSKKAV; MSKKAVQ; SKKAVQE; KKAVQET; KAVQETQ; AVQETQK; VQETQKA; QETQKAV; ETQKAVS; TQKAVSV; QKAVSVA; KAVSVAG; AVSVAGE; VSVAGEA; SVAGEAT; VAGEATF; AGEATFL; GEATFLF; EATFLFK; ATFLFKQ; TFLFKQL; FLFKQLF; LFKQLFL; FKQLFLK; KQLFLKS; QLFLKSP; LFLKSPN; FLKSPNK; LKSPNKK; KSPNKKL; SPNKKLF; PNKKLFL; NKKLFLT; |

Fig. 31 continued

EKELEDTK; KELEDTKE; ELEDTKEE; LEDTKEEF; EDTKEEFA;
DTKEEFAK; TKEEFAKV; KEEFAKVD; EEFAKVDE; FAKVDEV;
FAKVDEVK; AKVDEVKE; KVDEVKET; VDEVKETL; DEVKETLM;
EVKETLMA; VKETLMAS; KETLMASE; ETLMASER; TLMASERA;
LMASERAL; MASERALD; ASERALDE; SERALDET; ERALDETV;
RALDETVQ; ALDETVQF; LDETVQFA; DETVQFAQ; ETVQFAQK;
TVQFAQKV; VQFAQKVL; QFAQKVLM; FAQKVLMV; AQKVLMVN;
QKVLMVN; KVLMVNG; VLMVNGL; LMVNGLN; MVNGLNP;
MVNGLNPS; VNGLNPSN; NGLNPSNK; GLNPSNKD; LNPSNKDQ;
NPSNKDQV; PSNKDQVL; SNKDQVLA; NKDQVLAK; KDQVLAKK;
DQVLAKKD; QVLAKKDV; VLAKKDVR; LAKKDVRK; AKKDVRKA;
KKDVRKAI; KDVRKAIS; DVRKAISE; VRKAISEV; RKAISEVV;
KAISEVVK; AISEVVKV; ISEVVKVA; SEVVKVAQ; EVVKVAQG;
VVKVAQGA; VKVAQGAR; KVAQGARD; VAQGARDL; AQGARDLT;
QGARDLTK; GARDLTKV; ARDLTKVM; RLTKVMA; DLTKVMAI;
LTKVMAIS; TKVMAISL; KVMAISLY; VMAISLYM; MAISLYKR;

9 mers:
KIKIFSNLL; IKIFSNLLI; KIFSNLLIK; IFSNLLIKG; FSNLLIKGL;
SNLLIKGLL; NLLIKGLLF; LLIKGLLFG; LIKGLLFGF; IKGLLFGFV;
KGLLFGFVS; GLLFGFVSL; LLFGFVSLD; LFGFVSLDV; FGFVSLDVF;
GFVSLDVFA; FVSLDVFAD; VSLDVFADS; SLDVFADSE; LDVFADSEN;
DVFADSENA; VFADSENAE; FADSENAEL; ADSENAELL; DSENAELLK;
SENAELLKP; ENAELLKPQ; NAELLKPQS; AELLKPQSE; ELLKPQSEV;
LLKPQSEVL; LKPQSEVLE; KPQSEVLEH; PQSEVLEHS; QSEVLEHSD;
SEVLEHSDQ; EVLEHSDQK; VLEHSDQKD; LEHSDQKDE; EHSDQKDEK;
HSDQKDEKK; SDQKDEKKL; DQKDEKKLD; QKDEKKLDQ; KDEKKLDQK;
DEKKLDQKD; EKKLDQKDQ; KKLDQKDQV; KLDQKDQVK; LDQKDQVKQ;
DQKDQVKQA; QKDQVKQAL; KDQVKQALD; DQVKQALDT; QVKQALDTT;
VKQALDTIN; KQALDTINK; QALDTINKV; ALDTINKVT; LDTINKVTE;
DTINKVTED; TINKVTEDV; INKVTEDVS; NKVTEDVSS; KVTEDVSSK;
VTEDVSSKL; TEDVSSKLF; EDVSSKLFG; DVSSKLFGV; VSSKLFGVR;
SSKLFGVRF; SKLFGVRFS; KLFGVRFSS; LFGVRFSSL; FGVRFSSLF;
GVRFSSLEL; VRFSSLELV; RFSSLELVE; FSSLELVES; SSLELVESN;
SLELVFSND; LELVFSNDA; ELVFSNDAG; LVFSNDAGV; VFSNDAGVV;
FSNDAGVVK; SNDAGVVKK; NDAGVVKKF; DAGVVKKFV; AGVVKKFVG;
GVVKKFVGS; VVKKFVGSM; VKKFVGSMS; KKFVGSMSL; KFVGSMSLM;
FVGSMSLMS; VGSMSLMSD; GSMSLMSDV; SMSLMSDVA; MSLMSDVAK;
SLMSDVAKG; LMSDVAKGT; MSDVAKGTV; SDVAKGTVV; DVAKGTVVA;
VAKGTVVAS; AKGTVVASQ; KGTVVASQF; GTVVASQFA; TVVASQFAT;
VVASQFATI; VASQFATIV; ASQFATIVA; SQFATIVAK; QFATIVAKC;
FATIVAKCS; ATIVAKCSC; TIVAKCSCM; IVAKCSCMV; VAKCSCMVA;
AKCSCMVAR; KCSCMVARG; CSCMVARGA; SCMVARGAK; CMVARGAKV;
MVARGAKVV; VARGAKVVE; ARGAKVVEM; RGAKVVEMS; GAKVVEMSK;
AKVVEMSKK; KVVEMSKKA; VVEMSKKAV; VEMSKKAVQ;
EMSKKAVQE; MSKKAVQEI; SKKAVQEIQ; KKAVQEIQK; KAVQEIQKA;
AVQEIQKAV; VQEIQKAVS; QEIQKAVSV; EIQKAVSVA; IQKAVSVAG;
QKAVSVAGE; KAVSVAGEA; AVSVAGEAT; VSVAGEATF; SVAGEATFL;
VAGEATFLL; AGEATFLLE; GEATFLLEK; EATFLLEKQ; ATFLLEKQI;
TFLLEKQIM; FLLEKQIML; LLEKQIMLN; LEKQIMLNK; EKQIMLNKS;
KQTMLNKSP; QTMLNKSPE; TMLNKSPNK; MLNKSPNKE; LNKSPNKEE;

Fig. 31 continued

EKSPKDKEL; KSPKDKELE; SPKDKELEL; PKDKELELT; KDKELELTK;
DKELELTKE; KELELTKEE; ELELTKEEF; LELTKEEFA; ELTKEEFAK;
LTKEEFAKV; TKEEFAKVD; KEEFAKVDE; EEFAKVDEV; EFAKVDEVK;
FAKVDEVKE; AKVDEVKET; KVDEVKETL; VDEVKETLM; DEVKETLMA;
EVKETLMAS; VKETLMASE; KETLMASER; ETLMASERA; TLMASERAL;
LMASERALD; MASERALDE; ASERALDET; SERALDETV; ERALDETVQ;
RALDETVQF; ALDETVQFA; LDETVQFAQ; DETVQFAQK; ETVQFAQKV;
TVQFAQKVL; VQFAQKVLK; QFAQKVLKM; FAQKVLKMV; AQKVLKMVN;
QKVLKMVNG; KVLKMVNGL; VLKMVNGLN; LKMVNGLNP; KMVNGLNPS;
MVNGLNPSN; VNGLNPSNK; NGLNPSNKD; GLNPSNKDQ; LNPSNKDQV;
NPSNKDQVL; PSNKDQVLA; SNKDQVLAK; NKDQVLAKK; KDQVLAKKD;
DQVLAKKDV; QVLAKKDVR; VLAKKDVRK; LAKKDVRKA; AKKDVRKAT;
KKDVRKATS; KDVRKATSK; DVRKATSKV; VRKATSKVV; RKATSKVVK;
KATSKVVKV; ATSKVVKVA; TSKVVKVAQ; SKVVKVAQG; KVVKVAQGA;
VVKVAQGAR; VKVAQGARD; KVAQGARDL; VAQGARDLT; AQGARDLTK;
QGARDLTKV; GARDLTKVK; ARDLTKVMA; RDLTKVMAT; DLTKVMATS;
LTKVMATSL; TKVMATSLY; KVMATSLYM; VMATSLYMR;

10 mers:
MDKLFSLLLI; DKLFSLLLIN; KLFSLLLING; LFSLLLINGL;
FSLLLINGLL; SLLLINGLLF; LLLINGLLFG; LLINGLLFGF;
LINGLLFGFV; INGLLFGFVS; NGLLFGFVSL; GLLFGFVSLN;
LLFGFVSLNV; LFGFVSLNVF; FGFVSLNVFA; GFVSLNVFAD;
FVSLNVFADS; VSLNVFADSN; SLNVFADSNK; LNVFADSNKA;
NVFADSNKAK; VFADSNKAKT; FADSNKAKTL; ADSNKAKTLK;
DSNKAKTLKP; SNKAKTLKPQ; NKAKTLKPQS; KAKTLKPQSN;
AKTLKPQSNV; KTLKPQSNVL; TLKPQSNVLF; LKPQSNVLFH;
KPQSNVLFHS; PQSNVLFHSD; QSNVLFHSDQ; SNVLFHSDQK;
NVLFHSDQKD; VLFHSDQKDN; LFHSDQKDNK; FHSDQKDKKK;
HSDQKDKKKL; SDQKDKKKLD; DQKDKKKLDQ; QKDKKKLDQK;
KDKKKLDQKD; DKKKLDQKDQ; KKKLDQKDQV; KKLDQKDQVN;
KLDQKDQVNQ; LDQKDQVNQA; DQKDQVNQAL; QKDQVNQALD;
KDQVNQALDT; DQVNQALDTT; QVNQALDTTK; VNQALDTTNK;
NQALDTTNKV; QALDTTNKVT; ALDTTNKVTE; LDTTNKVTED;
DTTNKVTEDV; TTNKVTEDVS; TNKVTEDVSS; NKVTEDVSSK;
KVTEDVSSKL; VTEDVSSKLE; TEDVSSKLEG; EDVSSKLEGV;
DVSSKLEGVR; VSSKLEGVRE; SSKLEGVRES; SKLEGVRESS;
KLEGVRESSL; LEGVRESSLE; EGVRESSLEL; GVRESSLELV;
VRESSLELVE; RESSLELVES; ESSLELVESN; SSLELVESND;
SLELVESNDA; LELVESNDAG; ELVESNDAGV; LVESNDAGVV;
VESNDAGVVK; ESNDAGVVKE; SNDAGVVKEV; NDAGVVKEV;
DAGVVKEVG; AGVVKEVGS; GVVKEVGSK; VVKEVGSKS;
VKEVGSMSL; KEVGSMSLM; EVGSMSLMS; VGSMSLMSD;
VGSMSLMSDV; GSMSLMSDVA; SMSLMSDVAK; MSLMSDVAKG;
SLMSDVAKGT; LMSDVAKGTV; MSDVAKGTVV; SDVAKGTVVA;
DVAKGTVVAS; VAKGTVVASQ; AKGTVVASQE; KGTVVASQEA;
GTVVASQEAT; TVVASQEATT; VVASQEATTV; VASQEATTVA;
ASQEATVAK; SQEATVAKC; QEATVAKCS; EATVAKCSC;
ATVAKCSCM; TVAKCSCMV; VAKCSCMVA; AKCSCMVAE;
AKCSCMVAEG; KCSCMVAEGA; CSCMVAEGAK; SCMVAEGAKK;
CMVAEGANKV; MVAEGANKVV; VAEGANKVVE; AEGANKVVEM;

Fig. 31 continued

EQANKVVEMSK; QAKKVVEMSKK; AKKVVEMSKKA; KKVVEMSKKAV;
KVVEMSKKAV; VVEMSKKAVQ; VEMSKKAVQE; EMSKKAVQET;
MSKKAVQETQ; SKKAVQETQK; KKAVQETQKA; KAVQETQKAV;
AVQETQKAVS; VQETQKAVSV; QETQKAVSVA; ETQKAVSVAG;
TQKAVSVAGE; QKAVSVAGEA; KAVSVAGEAT; AVSVAGEATF;
VSVAGEATFL; SVAGEATFLT; VAGEATFLTE; AGEATFLTEK;
GEATFLTEKQ; EATFLTEKQT; ATFLTEKQTM; TFLTEKQTML;
FLTEKQTMLE; LTEKQTMLEK; TEKQTMLEKS; EKQTMLEKSP;
KQTMLEKSPN; QTMLEKSPNN; TMLEKSPNKN; MLEKSPNKKF;
LEKSPNKKEL; EKSPNKKELF; KSPNKKELFL; SPNKKELFLT;
PNKKELFLTK; NKKELFLTKE; KKELFLTKEE; KELFLTKEEF;
ELFLTKEEFA; LFLTKEEFAK; FLTKEEFAKV; LTKEEFAKVD;
TKEEFAKVDE; KEEFAKVDEV; EEFAKVDEVK; EFAKVDEVKE;
FAKVDEVKET; AKVDEVKETL; KVDEVKETLM; VDEVKETLMA;
DEVKETLMAS; EVKETLMASE; VKETLMASER; KETLMASERA;
ETLMASERAL; TLMASERALD; LMASERALDE; MASERALDET;
ASERALDETV; SERALDETVQ; ERALDETVQE; RALDETVQEA;
ALDETVQEAQ; LDETVQEAQK; DETVQEAQKV; ETVQEAQKVL;
TVQEAQKVLE; VQEAQKVLEN; QEAQKVLENV; EAQKVLENVN;
AQKVLENVNG; QKVLENVNGL; KVLENVNGLE; VLENVNGLEP;
LENVNGLEPS; ENVNGLEPSN; NVNGLEPSNK; VNGLEPSKKD;
EGLNPSEKQQ; GLEPSEKDQV; LEPSEKDQVL; EPSNKDQVLA;
PSNKDQVLAK; SNKDQVLAKK; NKDQVLAKKD; KDQVLAKKDV;
DQVLAKKDVR; QVLAKKDVRK; VLAKKDVRKA; LAKKDVRKAT;
AKKDVRKATS; KKDVRKATSN; KDVRKATSNV; DVRKATSKVV;
VRKATSKVVK; RKATSKVVKV; KATSKVVKVA; ATSNVVKVAQ;
TSNVVKVAQG; SNVVKVAQGA; NVVKVAQGAR; VVKVAQGARD;
VKVAQGARDL; KVAQGARDLT; VAQGARDLTK; AQGARDLTKV;
QGARDLTKVM; GARDLTKVMA; ARDLTKVMAT; RDLTKVMATS;
DLTKVMATSL; LTKVMATSLV; TKVMATSLVM; KVMATSLVMK;

11-mers:
MTKTFSNLTNN; TKTFSNLTNGL; KTFSNLTNGLF; TFSNLTNGLLF;
FSNLTNGLLF; SNLINGLLFG; NLINGLLFGF; LINGLLFGFV;
TNGLLFGFVS; NGLLFGFVSL; NGLLFGFVSLN; GLLFGFVSLNV;
LLFGFVSLNVF; LFGFVSLNVFA; FGFVSLNVFAD; GFVSLNVFADS;
FVSLNVFADSN; VSLNVFADSNN; SLNVFADSNNA; LNVFADSNNAK;
NVFADSNNAKI; VFADSNNAKIL; FADSNNAKILK; ADSNNAKILKE;
DSNNANTLKPQ; SNNAKTLKPQS; NNAKTLKPQSN; NAKTLKPQSNV;
AKTLKPQSNVL; NTLKPQSNVLE; TLKPQSNVLEN; LKPQSNVLEHS;
KPQSNVLEHSD; PQSNVLEHSDQ; QSNVLEHSDQK; SNVLEHSDQKD;
NVLEHSDQKDN; VLEHSDQKDNK; LEHSDQKDNKK; EHSDQKDNKKL;
HSDQKDNKKLD; SDQKDNKKLDQ; DQKDNKKLDQK; QKDNKKLDQKD;
KDNKKLDQKDQ; DNKKLDQKDQV; NKKLDQKDQVL; KKLDQKDQVNQ;
KLDQKDQVNQA; LDQKDQVNQAL; DQKDQVNQALD; QKDQVNQALDT;
KDQVNQALDTI; DQVNQALDTIN; QVNQALDTINK; VNQALDTINKV;
NQALDTINKVT; QALDTINKVTE; ALDTINKVTED; LDTINKVTEDV;
DTINKVTEDVS; TINKVTEDVSS; INKVTEDVSSK; NKVTEDVSSKL;
KVTEDVSSKLE; VTEDVSSKLEG; TEDVSSKLEGV; EDVSSKLEGVR;
DVSSKLEGVRE; VSSKLEGVRES; SSKLEGVRESS; SKLEGVRESSL;
KLEGVRESSLE; LEGVRESSLEV; EGVRESSLEVR; GVRESSLEVRE;

Fig. 31 continued

|  | |
|---|---|
|  | VRESSLELVES; RESSLELVESN; ESSLELVESND; SSLELVESNDA; SLEVESNDAG; LEVESNDAGV; EVESNDAGVV; VESNDAGVVK; VESNDAGVVKK; ESNDAGVVKKF; SNDAGVVKKFV; NDAGVVKKFVG; DAGVVKKFVGS; AGVVKKFVGSM; GVVKKFVGSMS; VVKKFVGSMSL; VKKFVGSMSLM; KKFVGSMSLMS; KFVGSMSLMSD; FVGSMSLMSDV; VGSMSLMSDVA; GSMSLMSDVAK; SMSLMSDVAKG; MSLMSDVAKGT; SLMSDVAKGTV; LMSDVAKGTVV; MSDVAKGTVVA; SDVAKGTVVAS; DVAKGTVVASQ; VAKGTVVASQF; AKGTVVASQFA; KGTVVASQFAT; GTVVASQFATT; TVVASQFATTV; VVASQFATTVA; VASQFATTVAK; ASQFATTVAKG; SQFATTVAKGS; QFATTVAKGSG; FATTVAKGSGM; ATTVAKGSGMV; TTVAKGSGMVA; TVAKGSGMVAE; VAKGSGMVAEG; AKGSGMVAEGA; KGSGMVAEGAN; GSGMVAEGANK; SGMVAEGANKV; GMVAEGANKVV; MVAEGANKVVE; VAEGANKVVEM; AEGANKVVEMS; EGANKVVEMSK; GANKVVEMSKK; ANKVVEMSKKA; NKVVEMSKKAV; KVVEMSKKAVQ; VVEMSKKAVQE; VEMSKKAVQET; EMSKKAVQETQ; KSKKAVQETQK; SKKAVQETQKA; KKAVQETQKAV; KAVQETQKAVS; AVQETQKAVSV; VQETQKAVSVA; QETQKAVSVAG; ETQKAVSVAGE; TQKAVSVAGEA; QKAVSVAGEAT; KAVSVAGEATF; AVSVAGEATFL; VSVAGEATFLI; SVAGEATFLIE; VAGEATFLIEK; AGEATFLIEKQ; GEATFLIEKQI; EATFLIEKQIM; ATFLIEKQIML; TFLIEKQIMLK; FLIEKQIMLKK; LIEKQIMLKKS; IEKQIMLKKSP; EKQIMLKKSPN; KQIMLKKSPNK; QIMLKKSPNKK; IMLKKSPNKKE; MLKKSPNKKEL; LKKSPNKKELE; KKSPNKKELEL; KSPNKKELELT; SPNKKELELTK; PNKKELELTKE; NKKELELTKEF; KKELELTKEFF; KELELTKEFFA; ELELTKEFFAK; LELTKEFFAKV; ELTKEFFAKVD; LTKEFFAKVDE; TKEFFAKVDEV; KEFFAKVDEVK; EFFAKVDEVKE; FFAKVDEVKET; FAKVDEVKETL; AKVDEVKETLM; KVDEVKETLMA; VDEVKETLMAS; DEVKETLMASE; EVKETLMASER; VKETLMASERA; KETLMASERAL; ETLMASERALD; TLMASERALDE; LMASERALDET; MASERALDETV; ASERALDETVQ; SERALDETVQE; ERALDETVQEA; RALDETVQEAQ; ALDETVQEAQK; LDETVQEAQKV; DETVQEAQKVL; ETVQEAQKVLN; TVQEAQKVLNM; VQEAQKVLNMV; QEAQKVLNMVN; EAQKVLNMVNG; AQKVLNMVNGL; QKVLNMVNGLN; KVLNMVNGLNP; VLNMVNGLNPS; LNMVNGLNPSN; NMVNGLNPSNK; MVNGLNPSNKD; VNGLNPSNKDQ; NGLNPSNKDQV; GLNPSNKDQVL; LNPSNKDQVLA; NPSNKDQVLAK; PSNKDQVLAKK; SNKDQVLAKKD; NKDQVLAKKDV; KDQVLAKKDVR; DQVLAKKDVRK; QVLAKKDVRKA; VLAKKDVRKAT; LAKKDVRKATS; AKKDVRKATSN; KKDVRKATSNV; KDVRKATSNVV; DVRKATSNVVK; VRKATSNVVKV; RKATSNVVKVA; KATSNVVKVAQ; ATSNVVKVAQG; TSNVVKVAQGA; SNVVKVAQGAR; NVVKVAQGARD; VVKVAQGARDL; VKVAQGARDLT; KVAQGARDLTK; VAQGARDLTKV; AQGARDLTKVM; QGARDLTKVMA; GARDLTKVMAI; ARDLTKVMAIS; RDLTKVMAISL; DLTKVMAISLY; LTKVMAISLYM; TKVMAISLYMR; |
| Seq 26 | SEQ ID NO 28856 31653 / 8 mers: MKKMLIF; KKMLIFS; KMLIFSF; MLIFSFF; LIFSFFL; IFSFFLI; FSFFLIF; SFFLIFN; FFLIFNG; FLIFNGF; LIFNGFP; IFNGFPL; FNGFPLN; NGFPLNA; GFPLNAR; FPLNARK; PLNARKV; LNARKVD; NARKVDE; ARKVDEK; RKVDEKL; KVDEKLK; VDEKLKD; |

DLDKDLTT; LDKDLTTM; DKDLTTMS; KDLTTMSI; DLTTMSID;
LTTMSIDS; TTMSIDSS; TMSIDSSS; MSIDSSSP; SIDSSSPV;
IDSSSPVI; DSSSPVFL; SSSPVFLE; SSPVFLEV; SPVFLEVI;
PVFLEVID; VFLEVIDP; FLEVIDPI; LEVIDPIT; EVIDPITN;
VIDPITNL; IDPITNLG; DPITNLGI; PITNLGTL; ITNLGTLQ;
TNLGTLQN; NLGTLQTI; LGTLQI

YYCKYPINR; YCKYPIRRF; CKYPIRRFI; KYPINRFID; YPINRFIDD;
PINRFIDDQ; INRFIDDQD; NRFIDDQDK; RFIDDQDKK; FIDDQDKKA;
IDDQDKKAS; DDQDKKASV; DQKKASVD; QKKASVDV; KKASVDVF

IKEIKKEKN; KEIKKEKNL; EIKKEKNLP; IKKEKNLPK; KKEKNLPKP;
KEKNLPKPG; EKNLPKPGD; KNLPKPGDV; NLPKPGDVS; LPKPGDVSS;
PKPGDVSSP; KPGDVSSPK; PGDVSSPKV; GDVSSPKVD; DVSSPKVDK;
VSSPKVDKQ; SSPKVDKQL; SPKVDKQLQ; PKVDKQLQI; KVDKQLQIK;
VDKQLQIKE; DKQLQIKES; KQLQIKESL; QLQIKESLE; LQIKESLED;
QIKESLEDL; IKESLEDLQ; KESLEDLQE; ESLEDLQEQ; SLEDLQEQL;
LEDLQEQLK; EDLQEQLKE; DLQEQLKEA; LQEQLKEAG; QEQLKEAGD;
EQLKEAGDE; QLKEAGDEK; LKEAGDEKQ; KEAGDEKQK; EAGDEKQKR;
AGDEKQKRF; GDEKQKRFT; DEKQKRFTE; EKQKRFTEK; KQKRFTEKQ;
QKRFTEKQT; KRFTEKQTE; RFTEKQTET; FTEKQTETK; TEKQTETKK;
EKQTETKKR; KQTETKKRD; QTETKKRDF; TETKKRDFE; ETKKRDFEL;
TKKRDFELL; KKRDFELLK; KRDFELLKS; RDFELLKSK; DFELLKSKD;
FELLKSKDG; ELLKSKDGK; LLKSKDGKV; LKSKDGKVS; KSKDGKVSK;
SKDGKVSKD; KDGKVSKDY; DGKVSKDYE; GKVSKDYEA; KVSKDYEAL;
VSKDYEALD; SKDYEALDL; KDYEALDLD;

Fig. 31 continued

ELDSIDLRRI; LDSIDLRRIL; DSIDLRRILG; SIDLRRILGY;
IDLRRILGY; IDLRRILGYI; DLRRILGYIT; LRRILGYITG;
RRILGYITGY; RILGYITGYI; ILGYITGYIT; LGYITGYITG;
TGYITKSFD; GYITKSFDY; YITKSFDYDR; ITKSFDYDRS;
IKSFDYDRSS; KSFDYDRSSA; SFDYDRSSAE; FDYDRSSAEL;
DYD

| | | | |
|---|---|---|---|
| LDSAEDLDVQ; | DSAEDLDVQR; | SAEDLDVQRD; | AEDLDVQRDT; |
| EDLDVQRDT; | DLDVQRDTV; | LDVQRDTVR; | DVQRDTVRE; |
| DVQRDTVREK; | VQRDTVREKI; | QRDTVREKIQ; | RDTVREKIQE; |
| DTVREKIQED; | TVREKIQEDI; | VREKIQEDIK; | REKIQEDIKE; |
| EKIQEDINEI; | KIQEDINEIN; | IQEDINEINK; | QEDINEIKKE; |
| EDINEIKKEK; | DIKFINKEKI; | INFINKEKNL; | NFINKEKNLP; |
| FINKEKNLPK; | INKEKNLPKP; | KEKKLPKPG; | KEKNLPKPGD; |
| EKNLPKPGDV; | KNLPKPGDVS; | NLPKPGDVSS; | LPKPGDVSSP; |
| PKPGDVSSPK; | KPGDVSSPKV; | PGDVSSPKVD; | GDVSSPKVDK; |
| DVSSPKVDKQ; | VSSPKVDKQL; | SSPKVDKQLQ; | SPKVDKQLQT; |
| PKVDKQLQTK; | KVDKQLQTKF; | VDKQLQTKFS; | DKQLQTKFSL; |
| KQLQIKESLE; | QLQIKESLED; | LQIKESLEDL; | QIKESLEDLQ; |
| IKESLEDLQF; | KESLEDLQFQ; | ESLEDLQFQL; | SLEDLQFQLK; |
| LEDLQFQLKE; | EDLQFQLKEA; | DLQFQLKEAG; | LQFQLKEAGD; |
| QFQLKEAGDE; | FQLKEAGDEN; | QLKEAGDENQ; | LKEAGDENQK; |
| KEAGDENQKR; | EAGDENQKRE; | AGDENQKREI; | GDENQKREIE; |
| DENQKREIEK; | ENQKREIEKQ; | NQKREIEKQT; | QKREIEKQTE; |
| KREIEKQTET; | REIEKQTETK; | EIEKQTETKK; | IEKQTETKKR; |
| EKQIEIKKRD; | KQIEIKKRDE; | QIEIKKRDEE; | IEIKKRDEEL; |
| EIKKRDEELL; | IKKRDEELLK; | KKRDEELLKS; | KRDEELLKSK; |
| RDEELLKSKD; | DEELLKSKDG; | EELLKSKDGK; | ELLKSKDGKV; |
| LLKSKDGKVS; | LKSKDGKVSK; | KSKDGKVSKD; | SKDGKVSKDY; |
| KDGKVSKDYE; | DGKVSKDYEA; | GKVSKDYEAL; | KVSKDYEALD; |
| VSKDYEALDL; | SKDYEALDLD; | KDYEALDLDR; | DYEALDLDRE; |
| YEALDLDREL; | EALDLDRELS; | ALDLDRELSK; | LDLDRELSKA; |
| DLDRELSKAS; | LDRELSKASS; | DRELSKASSK; | RELSKASSKE; |
| ELSKASSKEK; | LSKASSKEKS; | SKASSKEKSK; | KASSKEKSKV; |
| ASSKEKSKVK; | SSKEKSKVKE; | SKEKSKVKEE; | KEKSKVKEEF; |
| EKSKVKEEFT; | KSKVKEEFTT; | SKVKEEFTTK; | KVKEEFTTKG; |
| VKEEFITKGK; | KEEFITKGKS; | EEFITKGKSR; | EFITKGKSRA; |
| FITKGKSRAS; | ITKGKSRASL; | TKGKSRASLG; | KGKSRASLGD; |
| GKSRASLGDL; | KSRASLGDIN; | SRASLGDINN; | RASLGDINND; |
| ASLGDINNDK; | SLGDINNDKI; | LGDINNDKIL; | GDINNDKILM; |
| DINNDKILML; | INNDKILMLP; | NNDKILMLPE; | NDKNLMLPED; |
| DKNMLPEDQ; | KNIMLPEDQK; | NLMLPEDQKL; | LMLPEDQKLP; |
| MLPEDQKLPE; | LPEDQKLPED; | PEDQKLPEDK; | EDQKLPEDKK; |
| DQKLPEDKKL; | QKLPEDKKLD; | KLPEDKKLDS; | LPEDKKLDSK; |
| PEDKKLDSKL; | EDKKLDSKLD; | DKKLDSKLDG; | KKLDSKLLGK; |
| KLDSKLDGKK; | LDSKLDGKKE; | DSKLDGKKEF; | SKLDGKKEFK; |
| KLDGKKEFKP; | LDGKKEFKPV; | DGKKEFKPVS; | GKKEFKPVSE; |
| KKEFKPVSEV; | KEFKPVSEVE; | EFKPVSEVEK; | FKPVSEVEKL; |
| KPVSEVEKLD; | PVSEVEKLDK; | VSEVEKLDKI; | SEVEKLDKIS; |
| EVEKLDKTSK; | VEKLDKTSKS; | EKLDKTSKSE; | KLDKTSKSES; |
| LDKTSKSNNN; | DKTSKSNNNE; | KTSKSNNEV; | TSKSNNEVG; |
| SKSNNEVGK; | KSNNEVGKL; | SNNEVGKLS; | NNEVGKLSP; |
| NEVGKLSPL; | EVGKLSPLD; | VGKLSPLDK; | GKLSPLDKP; |
| KLSPLDKPS; | LSPLDKPSY; | SPLDKPSYD; | PLDKPSYDD; |
| LDKPSYDDI; | DKPSYDDID; | KPSYDDIDS; | PSYDDIDSK; |
| SYDDIDSKE; | YDDIDSKEE; | DDIDSKEEV; | DIDSKEEVD; |
| IDSKEEVDK; | DSKEEVDNK; | SKEEVDNKA; | KEEVDNKAI; |
| EEVDNKATK; | EVDNKATNL; | VDNKATNLQ; | DNKATNLQK; |

Fig. 31 continued

DKKAIDLQKI; KAIDLQKID; AIDLQKIDP; IDLQKIDPK;
DLQKIDPKV; LQKIDPKVK; QKIDPKVKD; KIDPKVKDQ;
IDPKVKDQT; DPKVKDQTT; PKVKDQTTS; KVKDQTTSL;
VKDQTTSLN; KDQTTSLNE; DQTTSLNED; QTTSLNEDL;
TTSLNEDLD; TSLNEDLDK; SLNEDLDKD; LNEDLDKDL;
NEDLDKDLT; EDLDKDLTT; DLDKDLTTM; LDKDLTTMS;
DKDLTTMST; KDLTT

Fig. 31 continued

| | | | |
|---|---|---|---|
| AALSEKEAGV; | ALSEKEAGVN; | LSEKEAGVNE; | SEKEAGVNEA; |
| EKEAGVNFAR; | KEAGVNFARD; | EAGVNFARDI; | AGVNFARDII; |
| GVNFARDIIDT; | VNFARDIIDTQ; | NFARDIIDTQG; | FARDIIDTQGE; |
| ARDIIDTQGEI; | RDIIDTQGEIH; | DIIDTQGEIHK; | IIDTQGEIHKA; |
| IDTQGEIHKAD; | DTQGEIHKADQ; | TQGEIHKADQK; | QGEIHKADQKI; |
| GEIHKADQKID; | EIHKADQKIDT; | IHKADQKIDTE; | HKADQKIDTEL; |
| KADQKIDTELD; | ADQKIDTELDN; | DQKIDTELDNI; | QKIDTELDNIE; |
| KIDTELDNIEE; | IDTELDNIEES; | DTELDNIEESD; | TELDNIEESDS; |
| ELDNIEESDSN; | LDNIEESDSNI; | DNIEESDSNIT; | NIEESDSNITT; |
| IEESDSNITTE; | EESDSNITTET; | ESDSNITTETT; | SDSNITTETTE; |
| DSNITTETTEN; | SNITTETTENL; | NITTETTENLR; | ITTETTENLRD; |
| TTETTENLRDQ; | TETTENLRDQL; | ETTENLRDQLE; | TTENLRDQLEK; |
| TENLRDQLEKA; | ENLRDQLEKAT; | NLRDQLEKATD; | LRDQLEKATDE; |
| RDQLEKATDEE; | DQLEKATDEEH; | QLEKATDEEHK; | LEKATDEEHKK; |
| EKATDEEHKKE; | KATDEEHKKEI; | ATDEEHKKEIE; | TDEEHKKEIES; |
| DEEHKKEIESQ; | EEHKKEIESQV; | EHKKEIESQVD; | HKKEIESQVDA; |
| KKEIESQVDAK; | KEIESQVDAKK; | EIESQVDAKKK; | IESQVDAKKKE; |
| ESQVDAKKKEK; | SQVDAKKKEKE; | QVDAKKKEKEE; | VDAKKKEKEEL; |
| DAKKKEKEELD; | AKKKEKEELDK; | KKKEKEELDKK; | KKEKEELDKKA; |
| KEKEELDKKAI; | EKEELDKKAIN; | KEELDKKAINL; | EELDKKAINLD; |
| ELDKKAINLDK; | LDKKAINLDKA; | DKKAINLDKAQ; | KKAINLDKAQQ; |
| KAINLDKAQQK; | AINLDKAQQKL; | INLDKAQQKLD; | NLDKAQQKLDS; |
| LDKAQQKLDSA; | DKAQQKLDSAE; | KAQQKLDSAED; | AQQKLDSAEDN; |
| QQKLDSAEDNL; | QKLDSAEDNLD; | KLDSAEDNLDV; | LDSAEDNLDVQ; |
| DSAEDNLDVQR; | SAEDNLDVQRD; | AEDNLDVQRDT; | EDNLDVQRDTV; |
| DNLDVQRDTVR; | NLDVQRDTVRE; | LDVQRDTVREK; | DVQRDTVREKI; |
| VQRDTVREKIQ; | QRDTVREKIQE; | RDTVREKIQED; | DTVREKIQEDT; |
| TVREKIQEDTN; | VREKIQEDTNE; | REKIQEDTNET; | EKIQEDTNETE; |
| KIQEDTNETEI; | IQEDTNETEINK; | QEDTNETEINKE; | EDINEINKEKN; |
| DINEINKEKNL; | INEINKEKNLP; | NEINKEKNLPK; | EINKEKNLPKP; |
| INKEKNLPKPG; | NKEKNLPKPGD; | KEKNLPKPGDV; | EKNLPKPGDVS; |
| KNLPKPGDVSS; | NLPKPGDVSSP; | LPKPGDVSSPK; | PKPGDVSSPKV; |
| KPGDVSSPKVD; | PGDVSSPKVDQ; | GDVSSPKVDQL; | DVSSPKVDQLQ; |
| VSSPKVDQLQT; | SSPKVDQLQTK; | SPKVDQLQTKE; | PKVDQLQTKES; |
| KVDQLQTKESL; | VDQLQTKESLE; | DQLQTKESLED; | QLQTKESLEDI; |
| LQTKESLEDIQ; | QTKESLEDIQE; | TKESLEDIQEQ; | KESLEDIQEQL; |
| ESLEDIQEQLK; | SLEDIQEQLKE; | LEDIQEQLKEA; | EDIQEQLKEAG; |
| DIQEQLKEAGD; | IQEQLKEAGDE; | QEQLKEAGDEN; | EQLKEAGDENQ; |
| QLKEAGDENQK; | LKEAGDENQKR; | KEAGDENQKRE; | EAGDENQKRET; |
| AGDENQKRETE; | GDENQKRETEK; | DENQKRETEKQ; | ENQKRETEKQI; |
| NQKRETEKQIE; | QKRETEKQIEL; | KRETEKQIELK; | RETEKQIELKK; |
| ETEKQIELKKR; | TEKQIELKKRD; | EKQIELKKRDF; | KQIELKKRDFL; |
| QIELKKRDFLK; | IELKKRDFLKS; | ELKKRDFLKSK; | LKKRDFLKSKD; |
| KKRDFLKSKDC; | KRDFLKSKDCK; | RDFLKSKDCKV; | DFLKSKDCKVS; |
| FLKSKDCKVSK; | LKSKDCKVSKD; | KSKDCKVSKDY; | SKDCKVSKDYE; |
| KDCKVSKDYEA; | DCKVSKDYEAL; | CKVSKDYEALD; | KVSKDYEALDL; |
| VSKDYEALDLD; | SKDYEALDLDR; | KDYEALDLDRE; | DYEALDLDREL; |
| YEALDLDRELS; | EALDLDRELSK; | ALDLDRELSKA; | LDLDRELSKAS; |
| DLDRELSKASS; | LDRELSKASSK; | DRELSKASSKE; | RELSKASSKEK; |
| ELSKASSKEKS; | LSKASSKEKSK; | SKASSKEKSKV; | KASSKEKSKVK; |

IQELRVDGG; QELRVDGGA; ELRVDGGAS; LRVDGGASQ; RVDGGASQN;
VDGGASQNH; DGGASQNHL; GGASQNHLI; GASQNHLIM; ASQNHLIMQ;
SQNHLIMQF; QNHLIMQFQ; NHLIMQFQA; HLIMQFQAD; LIMQFQADL;
IMQFQADLL; MQFQADLLE; QFQADLLEC; FQADLLECK; QADLLECKV;
ADLLECKVV; DLLECKVVR; LLECKVVRP; LECKVVRPK; ECKVVRPKI;
CKVVRPKIT; KVVRPKITT; VVRPKITTT; VRPKITTTT; RPKITTTTA;
PKITTTTAL; KITTTTALG; ITTTTALGA; TTTTALGAA; TTTALGAAY;
TTALGAAYL; TALGAAYLA; ALGAAYLAG; LGAAYLAGL; GAAYLAGLA;
AAYLAGLAT; AYLAGLATG; YLAGLATGY; LAGLATGYN; AGLATGYNQ;
GLATGYNQS; LATGYNQSA; ATGYNQSAF; TGYNQSAFF; GYNQSAFFT;
YNQSAFFTV; NQSAFFTVS; QSAFFTVSL; SAFFTVSLW; AFFTVSLWQ;
FFTVSLWQV; FTVSLWQVD; TVSLWQVDK; VSLWQVDKI; SLWQVDKIF;
LWQVDKIFP; WQVDKIFPP; QVDKIFPPS; VDKIFPPSM; DKIFPPSMP;
KIFPPSMPK; IFPPSMPKN; FPPSMPKNQ; PPSMPKNQK; PSMPKNQKE;
SMPKNQKEK; MPKNQKEKL; PKNQKEKLL; KNQKEKLLE; NQKEKLLEN;
QKEKLLENW; KEKLLENWK; EKLLENWNK; KLLENWNKA; LLENWNKAV;
LENWNKAVG; ENWNKAVGK; NWNKAVGKA; WNKAVGKAK; NKAVGKAKS;
KAVGKAKSN; AVGKAKSNT; VGKAKSNTQ; GKAKSNTQN; KAKSNTQNS;
AKSNTQNSH; KSNTQNSHS; SNTQNSHSS;

10 mers:
NKYILSIDQG; KYILSIDQGT; YILSIDQGTT; ILSIDQGTTS;
LSIDQGTTSS; SIDQGTTSSR; IDQGTTSSRA; DQGTTSSRAM;
QGTTSSRAMV; GTTSSRAMVF; TTSSRAMVFD; TSSRAMVFDK;
SSRAMVFDKN; SRAMVFDKNA; RAMVFDKNAK; AMVFDKNAKI;
MVFDKNAKIK; VFDKNAKIKG; FDKNAKIKGF; DKNAKIKGFA;
KNAKIKGFAQ; NAKIKGFAQK; AKIKGFAQKF; KIKGFAQKFT;
IKGFAQKFTT; KGFAQKFTTQ; GFAQKFTQT; FAQKFTQTY;
AQKFTQTYP; QKFTQTYPQ; KFTQTYPQP; FTQTYPQPS;
TQTYPQPSW; QTYPQPSWV; TYPQPSWVE; YPQPSWVEH;
YPQPSWVEHD; PQPSWVEHDP; QPSWVEHDPT; PSWVEHDPTE;
SWVEHDPTET; WVEHDPTETW; VEHDPTETWG; EHDPTETWGS;
HDPTETWGSQ; DPTETWGSQL; PTETWGSQLG; TETWGSQLGV;
ETWGSQLGVI; TWGSQLGVIT; WGSQLGVITE; GSQLGVITEA;
SQLGVITEAM; QLGVITEAMA; LGVITEAMAN; GVITEAMANA;
VITEAMANAR; ITEAMANARI; TEAMANARIL; EAMANARILP;
AMANARILPK; MANARILPKF; ANARILPKFT; NARILPKFTD;
ARILPKFTDA; RILPKFTDAL; ILPKFTDALG; LPKFTDALGI;
PKFTDALGIT; KFTDALGITN; FTDALGITNQ; TDALGITNQR;
DALGITNQRE; ALGITNQREF; LGITNQREFT; GITNQREFTV;
ITNQREFTVI; TNQREFTVIW; NQREFTVIWE; QREFTVIWEK;
REFTVIWEKN; EFTVIWEKNT; FTVIWEKNTG; TVIWEKNTGK;
VIWEKNTGKP; IWEKNTGKPT; WEKNTGKPTY; EKNTGKPTYN;
KNTGKPTYNA; NTGKPTYNAI; TGKPTYNAIV; GKPTYNAIVW;
KPTYNAIVWQ; PTYNAIVWQD; TYNAIVWQDR; YNAIVWQDRR;
NAIVWQDRRT; AIVWQDRRTA; IVWQDRRTAK; VWQDRRTAKI;
WQDRRTAKIC; QDRRTAKICD; DRRTAKICDQ; RRTAKICDQL;
RTAKICDQLK; TAKICDQLKK; AKICDQLKKE; KICDQLKKEC;
ICDQLKKECK; CDQLKKECKD; DQLKKECKDK; QLKKECKDKI;
LKKECKDKII; KKECKDKIIL; ECKDKIILE; ECKDKIILEK;
GKDKIILEKT; KDKIILEKTG; DKIILEKTGL; KIILEKTGLV;

DAHALASSVS; AHALASSVSD; HALASSVSDK; ALASSVSDKG;
LASSVSDKGG; ASSVSDKGGV; SSVSDKGGVY; SVSDKGGVYF;
VSDKGGVYFV; SDKGGVYFVP; DKGGVYFVPA; KGGVYFVPAF;
GGVYFVPAFV; GVYFVPAFVG; VYFVPAFVGL; YFVPAFVGLG;
FVPAFVGLGA; VPAFVGLGAF; PAFVGLGAFH; AFVGLGAFHK;
FVGLGAFHKD; VGLGAFHKDS; GLGAFHKDSY; LGAFHKDSYA;
GAFHKDSYAR; AFHKDSYARG; FHKDSYARGT; HKDSYARGTT;
KDSYARGTTL; DSYARGTTLG; SYARGTTLGT; YARGTTLGTT;
ARGTTLGTTR; RGTTLGTTRG; GTTLGTTRGS; TTLGTTRGST;
TLGTTRGSTK; LGTTRGSTKA; GTTRGSTKAH; TTRGSTKAHT;
TRGSTKAHTT; RGSTKAHTTR; GSTKAHTTRA; STKAHTTRAA;
TKAHTTRAAL; KAHTTRAALE; AHTTRAALES; HTTRAALEST;
TTRAALESTA; TRAALESTAF; RAALESTAFQ; AALESTAFQS;
ALESTAFQSF; LESTAFQSFD; ESTAFQSFDT; STAFQSFDTL;
TAFQSFDTLK; AFQSFDTLKN; FQSFDTLKNT; QSFDTLKNTK;
SFDTLKNTKK; FDTLKNTKKS; DTLKNTKKSL; TLKNTKKSLP;
LKNTKKSLPN; KNTKKSLPNF; NTKKSLPNFE; TKKSLPNFET;
KKSLPNFETQ; KSLPNFETQE; SLPNFETQEL; LPNFETQELR;
PNFETQELRV; NFETQELRVD; FETQELRVDG; ETQELRVDGG;
TQELRVDGGA; QELRVDGGAS; ELRVDGGASQ; LRVDGGASQN;
RVDGGASQNE; VDGGASQNEL; DGGASQNELL; GGASQNELLM;
GASQNELLMQ; ASQNELLMQF; SQNELLMQFQ; QNELLMQFQA;
NELLMQFQAD; ELLMQFQADL; LLMQFQADLL; LMQFQADLLE;
MQFQADLLEC; QFQADLLECK; FQADLLECKV; QADLLECKVV;
ADLLECKVVR; DLLECKVVRP; LLECKVVRPK; LECKVVRPKI;
ECKVVRPKIT; CKVVRPKITE; KVVRPKITET; VVRPKITETT;
VRPKITETTA; RPKITETTAL; PKITETTALG; KITETTALGA;
ITETTALGAA; TETTALGAAY; ETTALGAAYL; TTALGAAYLA;
TALGAAYLAG; ALGAAYLAGL; LGAAYLAGLA; GAAYLAGLAT;
AAYLAGLATG; AYLAGLATGY; YLAGLATGYW; LAGLATGYWQ;
AGLATGYWQS; GLATGYWQSA; LATGYWQSAE; ATGYWQSAEF;
TGYWQSAEFT; GYWQSAEFTV; YWQSAEFTVS; WQSAEFTVSL;
QSAEFTVSLW; SAEFTVSLWQ; AEFTVSLWQV; EFTVSLWQVD;
FTVSLWQVDK; TVSLWQVDKI; VSLWQVDKIF; SLWQVDKIFE;
LWQVDKIFEP; WQVDKIFEPS; QVDKIFEPSM; VDKIFEPSMP;
DKIFEPSMPK; KIFEPSMPKN; IFEPSMPKNQ; FEPSMPKNQK;
EPSMPKNQKE; PSMPKNQKEF; SMPKNQKEFL; MPKNQKEFLL;
PKNQKEFLLE; KNQKEFLLEN; NQKEFLLENW; QKEFLLENWN;
KEFLLENWNK; EFLLENWNKA; FLLENWNKAV; LLENWNKAVG;
LENWNKAVGK; ENWNKAVGKA; NWNKAVGKAK; WNKAVGKAKS;
NKAVGKAKSW; KAVGKAKSWL; AVGKAKSWLQ; VGKAKSWLQN;
GKAKSWLQNS; KAKSWLQNSH; AKSWLQNSHS; KSWLQNSHGS;

11 mers:
MKYILSIDQGT; KYILSIDQGTT; YILSIDQGTTS; ILSIDQGTTSS;
LSIDQGTTSSA; SIDQGTTSSRA; IDQGTTSSRAM; DQGTTSSRAMV;
QGTTSSRAMVF; GTTSSRAMVFD; TTSSRAMVFDK; TSSRAMVFDKK;
SSRAMVFDKKA; SRAMVFDKKAN; RAMVFDKKANI; AMVFDKKANIK;
MVFDKKANIKG; VFDKKANIKGF; FDKKANIKGFA; DKKANIKGFAQ;
KKANIKGFAQK; KANIKGFAQKE; ANIKGFAQKEF; NIKGFAQKEFT;
IKGFAQKEFTQ; KGFAQKEFTQI; GFAQKEFTQIY; FAQKEFTQIYP;

KPFLQKQ; TFFLQNQL; FLQNQLFV; LQNQLFVY;
QKQTFVYF; NQTFVYFL; QTFVYFLS; TFVYFLSF; FVYFLSFY;
VYFLSFYP; YFLSFYPN; FLSFYPNT; LSFYPNT

LKKHINKYIE; KKHINKYIEE; KHIKKYIEEK; HIKKYIEEKV;
IKKYIEEKVI; KKYIEEKVIK; KYIEEKVIKY; YIEEKVIKYS;
IEEKVIKYST; EEKVIKYSTS; EKVIKYSTSS; KVIKYSTSSQ;
VIKYSTSSQL; IKYSTSSQLY; KYSTSSQLYK; YSTSSQLYKL;
STSSQLYKLE; SSQLYKLEK; SSQLYKLEKP; SQLYKLEKPE;
QLYKLEKPEI; LYKLEKPEII; YKLEKPEIIE; KLEKPEIIEL;
LEKPEIIELI; EKPEIIELIK; KPEIIELIKI; PEIIELIKIS;
EIIELIKISK; IIELIKISID; IELIKISIDY; ELIKISIDYE;
LIKISIDYEK; IKISIDYEKE; KISIDYEKEK; ISIDYEKEKN;
SIDYEKEKNA; IDYEKEKNAF; DYEKEKNAFK; YEKEKNAFKT;
EKEKNAFNTS; KEKNAFNTSL; EKNAFNTSLE; KNAFNTSLEE;
NAFNTSLEEC; AFNTSLEECY; FT

KISYKILIKX; LYIKILIKXY; YIKILIKXYK; IKILIKXYKY;
KILIKXYKYL; ILIKXYKYLF; LIKXYKYLFF; IKXYKYLFFE;
KXYKYLFFEI; XYKYLFFEIL; YKYLFFEILA; KYLFFEILAL;
YLFFEILALK; LFFEILALKY; FFEILALKYK; FEILALKYKE;
EILALKYNEI; ILALKYNEIL; LALKYNEILR; ALKYNEILRY;
LKYNEIINYL; KYNEIINYLR; YNEIINYLRA; NEIINYLRAL;
EIINYLRALK; IINYLRALKT; INYLRALKTL; NYLRALKTLS;
YLRALKTLSL; LRALKTLSLN; RALKTLSLNE; ALKTLSLNEI;
LKTLSLNEIF; KTLSLNEIFY; TLSLNEIFYK; LSLNEIFYKG;
SLNEIFYKGS; LNEIFYKGSS; NEIFYKGSSK; EIFYKGSSKN;
IFYKGSSKNI; FYKGSSKNIS; YKGSSKNISF; KGSSKNISFN;
GSSKNISFNY; SSKNISFNYF; SKNISFNYFS; KNISFNYFSD;
NISFNYFSD; ISFNYFFSDF; SFNYFFSDFT; FNYFFSDFTQ;
NYFFSDFTQY; YFFSDFTQYA; FFSDFTQYAP; FSDFTQYAPK;
SDFTQYAPKD; DFTQYAPKDF; FTQYAPKDFQ; TQYAPKDFQD;
QYAPKDFQDT; YAPKDFQ

SKTFELQNQI; KTFELQNQIF; TFELQNQIFV; FELQNQIFVY;
ELQNQIFVYF; LQNQIFVYFL; QNQIFVYFLS; NQIFVYFLSF;
QIFVYFLSFY; IFVYFLSFYP; FVYFLSFYPN; VYFLSFYPNI;
YFLSFYPNIE; FLSFYPNIEY; LSFYPNIEYK; SFYPNIEYKH;
FYPNIEYKHF; YPNIEYKHFK; PNIEYKHFKE; NIEYKHFKEL;
IEYKHFKELS; EYKHFKELSD; YKHFKELSDI; KHFKELSDIL;
HFKELSDILY; FKELSDILYL; KELSDILYLD; ELSDILYLDE;
LSDILYLDEN; SDILYLDENK; DILYLDENKL; ILYLDENKLI;
LYLDENKLIL; YLDENKLILP; LDENKLILPK; DENKLILPKK;
ENKLILPKKL; NKLILPKKLI; KLILPKKLIK; LILPKKLIKI;
ILPKKLIKIQ; LPKKLIKIQK; PKKLIKIQKI; KKLIKIQKIN;
KLIKIQKINP; LIKIQKINPQ; IKIQKINPQL; KIQKINPQLD;
IQKINPQLDY; QKINPQLDYQ; KINPQLDYQK; INPQLDYQKS;
NPQLDYQKSY; PQLDYQKSYL; QLDYQKSYLL; LDYQKSYLLI;
DYQKSYLLIK; YQKSYLLIKS; QKSYLLIKSL; KSYLLIKSLK;
SYLLIKSLKT; YLLIKSLKTR; LLIKSLKTRS; LIKSLKTRSR;
IKSLKTRSRT; KSLKTRSRTI; SLKTRSRTIK; LKTRSRTIKT;
KTRSRTIKTT; TRSRTIKTTI; RSRTIKTTIK; SRTIKTTIKN;
RTIKTTIKNI; TIKTTIKNIR; IKTTIKNIRE; KTTIKNIREN;
TTIKNIRENI; TIKNIRENIL; IKNIRENILI; KNIRENILIT;
NIRENILITK; IRENILITKN; RENILITKNT; ENILITKNTF;
NILITKNTFK; ILITKNTFKL; LITKNTFKLE; ITKNTFKLER;
TKNTFKLERE; KNTFKLEREN; NTFKLERENL; TFKLERENLI;
FKLERENLIE; KLERENLIEK; LERENLIEKL; ERENLIEKLE;
RENLIEKLED; ENLIEKLEDE; NLIEKLEDEN; LIEKLEDENE;
IEKLEDENEK; EKLEDENEKK; KLEDENEKKL; LEDENEKKLL;
EDENEKKLLP; DENEKKLLPA; ENEKKLLPAM; NEKKLLPAMC;
EKKLLPAMCY; KKLLPAMCYL; KLLPAMCYLI; LLPAMCYLIY;
LPAMCYLIYC; PAMCYLIYCN; AMCYLIYCNL; MCYLIYCNLV;
CYLIYCNLVE; YLIYCNLVEL; LIYCNLVELK; IYCNLVELKN;
YCNLVELKNN; CNLVELKNNR; NLVELKNNRK; LVELKNNRKT;
VELKNNRKTK; ELKNNRKTKS; LKNNRKTKSE; KNNRKTKSER;
NNRKTKSERK; NRKTKSERKK; RKTKSERKKI; KTKSERKKIK;
TKSERKKIKS; KSERKKIKSE; SERKKIKSEK; ERKKIKSEKN;
RKKIKSEKNS; KKIKSEKNSL; KIKSEKNSLL; IKSEKNSLLE;
KSEKNSLLEF; SEKNSLLEFT; EKNSLLEFTS; KNSLLEFTSF;
NSLLEFTSFK; SLLEFTSFKL; LLEFTSFKLE; LEFTSFKLEK;
EFTSFKLEKQ; FTSFKLEKQK; TSFKLEKQKI; SFKLEKQKIK;
FKLEKQKIKT; KLEKQKIKTK; LEKQKIKTKL; EKQKIKTKLK;
KQKIKTKLKQ; QKIKTKLKQK; KIKTKLKQKT; IKTKLKQKTN;
KTKLKQKTNF; TKLKQKTNFK; KLKQKTNFKK; LKQKTNFKKE;
KQKTNFKKEL; QKTNFKKELM; KTNFKKELMK; TNFKKELMKS;
NFKKELMKSK; FKKELMKSKG; KKELMKSKGT;

11 mers:
MKTTKKDSFFY; KTTKKDSFFYD; TTKKDSFFYDS; TKKDSFFYDSL;
KKDSFFYDSLA; KDSFFYDSLAT; DSFFYDSLATL; SFFYDSLATLK;
FFYDSLATLKK; FYDSLATLKKH; YDSLATLKKHI; DSLATLKKHIN;
SLATLKKHINK; LATLKKHINKY; ATLKKHINKYT; TLKKHINKYTF;
LKKHINKYTFK; KKHINKYTFKV; KHINKYTFKVL; HINKYTFKVLE;
INKYTFKVLEK; NKYTFKVLEKV; KYTFKVLEKVL; YTFKVLEKVLK;
TFKVLEKVLKY; FKVLEKVLKYS; KVLEKVLKYSI; VLEKVLKYSIS;
LEKVLKYSISS; EKVLKYSISSQ; KVLKYSISSQL; VLKYSISSQLY;
LKYSISSQLYK; KYSISSQLYKI; YSISSQLYKIE; SISSQLYKIEK;
ISSQLYKIEKP; SSQLYKIEKPE; SQLYKIEKPEI; QLYKIEKPEII;
LYKIEKPEIIE; YKIEKPEIIEL; KIEKPEIIELI; IEKPEIIELIK;
EKPEIIELIKI; KPEIIELIKIS; PEIIELIKISN; EIIELIKISND;
IIELIKISNDY; IELIKISNDYE; ELIKISNDYEK;

| | |
|---|---|
| | LLYDEKKITI; LYDEKKITIP; YDEKKITIPK; DEKKITIPKK; DEKKITPKKT; EKITTPKKTT; KITTPKKTTK; KTTPKTTKT; TTPKKTTKTQ; TPKKTTKTQK; PKKTTKTQKT; PKKTKTQKTN; KKIIKIQKIEP; KIIKIQKINPQ; IIKIQKIKPIQ; IKIQKINENQL; KIQKINPNQLD; IQKIKPEQLDY; QKINPKQLDYQ; KINPKQLDYQK; INPNQLDYQKS; PNQLDYQKSY; PNQLDYQKSYI; NQLDYQKSYIL; QLDYQKSYILT; LDYQKSYILTK; DYQKSYILTKS; YQKSYILTKSI; QKSYLLIKSLK; KSYLIIKSLKT; SYLLIKSLKTK; YLLIKSLKIKS; LLIKSLKTRSR; LIKSIKTRSRI; IKSIKTRSRT; KSIKTRSRILK; SIKTRSRILKT; IKTRSRILKTI; KTRSRILKTT; TRSRILKTTK; RSRILKTTKU; SRILKTTKMT; RILKTTKNTR; ILKTTKNTRF; LKIIIKNIRFN; KIIKOIRFKL; IIKNIRFOLI; IKNIRFPLIE; IKNTRPKIEK; KNTRFHLFKL; NTRFKIFKLE; TRFNLIFKLFD; RFNLTEKIEDF; FKLTEKLEDFN; MLTKLEDFNE; LTEKLEDENEK; IEKLEDENEKK; KLEDENEKKL; KLEDENEKKLL; LEDEKEKKLLP; EDEKEKKLLPA; DEKEKKLLPAM; EKEKKLLPAMC; EKKLLPAMCY; EKKLLPAMCYL; KKLLPAMCYLT; KLLPAMCYLTY; LLPAMCYLTYC; LPAMCYLTYCE; PAMCYLTYCEN; AMCYLTYCEKL; MCYLTYCENLV; CYLTYCENLVE; YLTYCENLVEL; LLYCENLVELK; LYCENLVELKN; YCENLVELKEN; CENLVELKNKR; ENLVELKNKRK; NLVELKNRKL; LVFLKNRKATK; VELKKRKTKS; ELKKRKTKSK; LKNRKTKSNF; KENRKIKSNEK; NRKIKSNEKN; NRKIKSNEKES; RKIKSEYKNSL; KIKSEKNSLL; IKSNEKSLLF; KSEEKNSLLFP; SNEKKSLLEFI; EKNSLLEFIS; KNSLLEFISP; KNSLLEFISFF; NSLLEFISFFK; SLLEFTSFFKT; LLFFTSFFKTK; LEFTSFFKTKI; EFTSFFKTKLK; FISFFKTKLKQ; ISFFKTKLKQK; SFFKTKLKQKI; FFKTKLKQKIN; FKTKLKQKINF; KTKLKQKINFK; TKLKQKINFKK; KLKQKINFKKE; LKQKINFKKEL; KQKINFKKELM; QKINFKKEIMK; KINFKKEIMKS; INFKKELMKSK; NFKKELMKSKS; FKKELMKSKGI; |
| Seq 29 | SEQ ID NO 35914-36939/<br>8 mers:<br>MITQQDYF; ITQQDYFT; TQQDYTEI; QQDYTELK; QDYTELKK; DYFTLKKK; YTELKKKI; FTLKKKIF; ETKKKIFN; TKKKIFNT; KKKIFNTK; KKIFNTKI; KIFNTKIR; IFNTKIRI; FNTKIRIQ; NTKIRIQF; TKIRIQFK; KIRIQFKR; IRIQFKKG; RIQFKNGN; TQFKNGNK; QFKNGNKT; FKNGNKTD; KNGKKTDS; NGNKTDSL; GNKTDSLG; NKTDSLGY; KTDSLGYQ; TDSLGYQG; DSLGYQGS; SLGYQGSL; LGYQGSLG; GYQGSLGE; YQGSLGEP; QGSLGEPI; GSLGEPIL; SLGEPILL; LGEPILLK; GEPILLKD; EPILLKDK; PILLKDKL; ILLKDKLT; LLKDKLTF; IKDKLTFS; KDKLTFST; DKLTFSTG; KLTFSTGD; LTFSTGDG; TFSTGDGK; FSTGDGKN; STGDGKNI; TGDGKNID; GDGKNIDN; DGKNIDNR; GKNIDNRK; KNIDNRKE; NIDNRKEY; IDNRKEYF; DNRKEYFT; NRKEYFTT; RKEYFTTK; KEYFTTKN; EYFTTKNA; YFTTKNAP; FTTKNAPS; TTKNAPSL; TKNAPSLD; KNAPSLDS; NAPSLDSL; APSLDSLI; PSLDSLIE; SLDSLIEY; LDSLIEYL; DSLIEYLE; SLIEYLEH; LIEYLEHM; IEYLEHMT; EYLEHMTI; YLEHMTIF; LEHMTIFF; EHMTIFFL; HMTIFFLE; MTIFFLEK; TIFFLEKT; IFFLEKTP; FFLEKTPV; FLEKTPVG; LEKTPVGT; EKTPVGTL; KTPVGTLT; |

KRTCYISFYR; RTCYISFYRY; TCYISFYRYD; CYISFYRYDL;

11 mers:
MITQQDYTELK; ITQQDYTELKK; TQQDYTELKKK; QQDYTELKKKL;
QDYTELKKKLE; DYTELKKKLEN; YTELKKKLENT; TELKKKLENTK;
ELKKKLENTKT; LKKKLENTKTR; KKKLENTKTRT; KKLENTKTRTQ;
KLENTKTRTQF; LENTKTRTQFR; ENTKTRTQFRN; NTKTRTQFRNG;
TKTRTQFRNGN; KTRTQFRNGNK; TRTQFRNGNKT; RTQFRNGNKTD;
TQFRNGNKTDS; QFRNGNKTDSL; FRNGNKTDSLG; RNGNKTDSLGY;
NGNKTDSLGYQ; GNKTDSLGYQG; NKTDSLGYQGS; KTDSLGYQGSL;
TDSLGYQGSLG; DSLGYQGSLGF; SLGYQGSLGFP; LGYQGSLGFPT;
GYQGSLGFPTL; YQGSLGFPTLL; QGSLGFPTLLK; GSLGFPTLLKD;
SLGFPTLLKDK; LGFPTLLKDKL; GFPTLLKDKLT; FPTLLKDKLTF;
PTLLKDKLTFS; TLLKDKLTFST; LLKDKLTFSTC; LKDKLTFSTCD;
KDKLTFSTCDC; DKLTFSTCDCK; KLTFSTCDCKK; LTFSTCDCKKI;
TFSTCDCKKID; FSTCDCKKIDN; STCDCKKIDNR; TCDCKKIDNRK;
CDCKKIDNRKF; DCKKIDNRKEY; CKKIDNRKEYF; KKIDNRKEYFT;
KIDNRKEYFTT; IDNRKEYFTTK; DNRKEYFTTKN; NRKEYFTTKNA;
RKEYFTTKNAP; KEYFTTKNAPS; EYFTTKNAPSL; YFTTKNAPSLD;
FTTKNAPSLDS; TTKNAPSLDSL; TKNAPSLDSLI; KNAPSLDSLIE;
NAPSLDSLIEY; APSLDSLIEYL; PSLDSLIEYLE; SLDSLIEYLEH;
LDSLIEYLEHM; DSLIEYLEHMI; SLIEYLEHMIL; LIEYLEHMILF;
IEYLEHMILFF; EYLEHMILFFL; YLEHMILFFLE; LEHMILFFLEK;
EHMILFFLEKT; HMILFFLEKTP; MILFFLEKTPV; ILFFLEKTPVG;
LFFLEKTPVGT; FFLEKTPVGTL; FLEKTPVGTLT; LEKTPVGTLTA;
EKTPVGTLTAK; KTPVGTLTAKF; TPVGTLTAKFA; PVGTLTAKFAM;
VGTLTAKFAME; GTLTAKFAMEG; TLTAKFAMEGS; LTAKFAMEGST;
TAKFAMEGSTL; AKFAMEGSTLT; KFAMEGSTLTR; FAMEGSTLTRS;
AMEGSTLTRSK; MEGSTLTRSKL; EGSTLTRSKLI; GSTLTRSKLIQ;
STLTRSKLIQA; TLTRSKLIQAF; LTRSKLIQAFT; TRSKLIQAFTK;
RSKLIQAFTKT; SKLIQAFTNTN; KLIQAFTNTNK; LIQAFTNTNKF;
IQAFTNTNKFC; QAFTNTNKFCT; AFTNTNKFCTP; FTNTNKFCTPD;
TNTNKFCTPDG; NTNKFCTPDGR; TNKFCTPDGRS; NKFCTPDGRSL;
KFCTPDGRSLP; FCTPDGRSLPS; CTPDGRSLPSN; TPDGRSLPSNC;
PDGRSLPSNCY; DGRSLPSNCYA; GRSLPSNCYAY; RSLPSNCYAYK;
SLPSNCYAYKV; LPSNCYAYKVL; PSNCYAYKVLG; SNCYAYKVLGT;
NCYAYKVLGTS; CYAYKVLGTSS; YAYKVLGTSSA; AYKVLGTSSAP;
YKVLGTSSAPK; KVLGTSSAPKL; VLGTSSAPKLS; LGTSSAPKLSG;
GTSSAPKLSGR; TSSAPKLSGRF; SSAPKLSGRFL; SAPKLSGRFLR;
APKLSGRFLRH; PKLSGRFLRHY; KLSGRFLRHYD; LSGRFLRHYDS;
SGRFLRHYDSG; GRFLRHYDSGG; RFLRHYDSGGS; FLRHYDSGGST;
LRHYDSGGSTD; RHYDSGGSTDS; HYDSGGSTDSD; YDSGGSTDSDG;
DSGGSTDSDGT; SGGSTDSDGTR; GGSTDSDGTRS; GSTDSDGTRSL;
STDSDGTRSLG; TDSDGTRSLGH; DSDGTRSLGHT; SDGTRSLGHTQ;
DGTRSLGHTQE; GTRSLGHTQED; TRSLGHTQEDS; RSLGHTQEDSY;
SLGHTQEDSYK; LGHTQEDSYKN; GHTQEDSYKNH; HTQEDSYKNHD;
TQEDSYKNHDI; QEDSYKNHDID; EDSYKNHDIDI; DSYKNHDIDLD;
SYKNHDLDFS; YKNHDLDFSR; KNHDLDFSRI; NHDLDFSRIK;
HDLDFSRIKN; DHDLDFSRIKF; HDLDFSRIKFK; DLDFSRIKFKG;
LDFSRIKFKGK; DFSRIKFKGKL; FSRIKFKGKLV; SRIKFKGKLVK;
RIKFKGKLVKR; IKFKGKLVKRM; KFKGKLVKRMT; FKGKLVKRMTM;

Fig. 31 continued

The image is too faded/low-resolution to reliably transcribe the sequence content.

DKDYYYTT; KDYYYTTS; DYYYTTSK; YYYTTSKW; YYTTSKWT;
YYTTSKWTF; YTTSKWTFF; TTSKWTFFD; TSKWTFFDV; SKWTFFDVF;
KWTFFDVFD; WTFFDVFDL; TFFDVFDLF; FFDVFDLFK; FDVFDLFKK;
DVFDLFKKL; VFDLFKKLT; FDLFKKLTF; DLFKKLTFK; LFKKLTFKD;
FKKLTFKDD; KKLTFKDDI; KLTFKDDIS; LTFKDDISS; TFKDDISSN;
FKDDISSND; KDDISSNDN; DDISSNDNQ; DISSNDNQF; ISSNDNQFD;
SSNDNQFDH; SNDNQFDHH; NDNQFDHHE; DNQFDHHEH; NQFDHHEHH;
QFDHHEHHN; FDHHEHHNE; DHHEHHNEA; HHEHHNEAD;

10 mers:
MDLLDLLFKF; DLLDLLFKFK; LLDLLFKFKQ; LDLLFKFKQI;
DLLFKFKQIK; LLFKFKQIKN; LFKFKQIKNK; FKFKQIKNKG;
KFKQIKNKG; FKQIKNKGV; KQIKNKGVF; QIKNKGVFM;
IKNKGVFMT; KNKGVFMTK; NKGVFMTKP; KGVFMTKPK;
GVFMTKPKI; VFMTKPKIF; FMTKPKIFS; MTKPKIFST;
TKPKIFSTN; KPKIFSTNK; PKIFSTNKK; KIFSTNKKT;
IFSTNKKTK; FSTNKKTKI; STNKKTKIL; TNKKTKILV;
NKKTKILVV; KKTKILVVL; KTKILVVLT; TKILVVLTF;
KILVVLTFF; ILVVLTFFL; LVVLTFFLG; VVLTFFLGL;
VLTFFLGLI; LTFFLGLIF; TFFLGLIFS; FFLGLIFSN;
FLGLIFSNE; LGLIFSNEK; GLIFSNEKV; LIFSNEKVA;
IFSNEKVAR; FSNEKVARI; SNEKVARIL; NEKVARILF;
EKVARILFF; KVARILFFF; VARILFFFD; ARILFFFDF;
RILFFFDFD; ILFFFDFDF; LFFFDFDFN; FFFDFDFNL;
FFDFDFNLT; FDFDFNLTS; DFDFNLTSK; FDFNLTSKT;
DFNLTSKTF; FNLTSKTFF; NLTSKTFFK; LTSKTFFKI;
TSKTFFKIF; SKTFFKIFL; KTFFKIFLF; TFFKIFLFG;
FFKIFLGTI; FKIFLGTIF; KIFLGTIFK; IFLGTIFKL;
FLGTIFKLS; LGTIFKLSK; GTIFKLSKD; TIFKLSKDW;
IFKLSKDWI; FKLSKDWIL; KLSKDWILT; LSKDWILTY;
SKDWILTYK; KDWILTYKQ; DWILTYKQK; WILTYKQKI;
ILTYKQKIF; LTYKQNIF; TYKQNIFV; YKQNIFVD;
KQNIFVDN; QNIFVDNK; NIFVDNKK; IFVDNKKV;
FVDNKKVS; VDNKKVSL; DNKKVSLI; NKKVSLIK;
KKVSLIKA; KVSLIKAL; VSLIKALD; SLIKALDF;
LIKALDFL; IKALDFLQ; KALDFLQK; ALDFLQKN;
LDFLQKNK; DFLQKNKI; FLQKNKIV; LQKNKIVS;
QKNKIVSR; KNKIVSRD; NKIVSRDQ; KIVSRDQK;
IVSRDQKK; VSRDQKKH; SRDQKKHK; RDQKKHKI;
DQKKHKIG; QKKHKIGT; KKHKIGTG; KHKIGTGN;
HKIGTGNP; KIGTGNPS; IGTGNPSF; GTGNPSFK;
TGNPSFKL; GNPSFKLD; NPSFKLDN; PSFKLDNN;
SFKLDNNK; FKLDNNKI; KLDNNKII; LDNNKIIT;
DNNKIITE; NNKIITEI; NKIITEIF; KIITEIFV;
IITEIFVG; ITEIFVGK; TEIFVGKS; EIFVGKSG;
IFVGKSGE; FVGKSGEG; VGKSGEGD; GKSGEGDS;
KSGEGDSR; SGEGDSRL; GEGDSRLA;

GKGDSRLAYI; KGDSRLAYIK; GDSRLAYIKG; DSRLAYIKGS;
SRLAYIKGSD; RLAYIKGSDF; LAYIKGSDFN; AYIKGSDFNV;
YIKGSDFNVY; IKGSDFNVYL; KGSDFNVYLT; GSDFNVYLTK;
SDFNVYLTKN; DFNVYLTKNI; FNVYLTKNIF; NVYLTKNIFL;
VYLTK

Fig. 31 continued

|  |  |
|---|---|
|  | FKLIRKLNKEN; KLIRKLKKEKE; IRKLKKENEK; IRKLKKEKENK; RKLNKFKNKT; KLNKEKNNTN; LEKFKENKTKK; NKENEKTNNN; KENFKNTNNKY; FKENNTKNYF; NKNTKNKYET; KNKTKNNYTI; FKTNKNYT,TS; NTKNKYTISK; TKKNYTTTSKN; NNKYEIISKDG; NKYTTSKDGL; NYTITSKDGTY; YTTSKDCGIYF; YTISKDCGIYFL; TTSKDGTYFLN; TSKDGIYFLNK; SKDGLYFLNKQ; KDGLYFLNKQK; DGLYFLNKQKM; GLYFLNKQKMT; LYFLNKQKMTK; YFLNKQKMTKE; FLNQKMTKER; LNQKMTKERF; NKQKMTKEKFL; QKMTKERPLK; QKMTKERPLNT; KMTKERPLNTT; MTKERPLNTTA; TKERPLNTTAF; KERPLNTTAFF; RPLNTTAFFK; PLNTTAFFKA; LNTTAFFKAD; LTTAFFKADG; NTTAFFKADGL; TTAFFKADGLE; TAFFKADGLET; AFFKADGLETD; FFKADGLETDK; FKADGLETDKS; KADGLETDKSK; ADGLETDKSKT; DGLETDKSKTD; GLETDKSKTDD; LETDKSKTDDY; ETDKSKTDDYN; TDKSKTDDYNL; DKSKTDDYNLQ; KSKTDDYNLQY; SKTDDYNLQYK; KTDDYNLQYKL; TDDYNLQYKLE; DDYNLQYKLEV; DYNLQYKLEVK; YNLQYKLEVKS; NLQYKLEVKSK; LQYKLEVKSKS; QYKLEVKSKSV; YKLEVKSKSV; KLEVKSKSV; LEVKSKSVK; EVKSKSVKN; VKSKSVKNT; KSKSVKNTE; SKSVKNTEV; SKSVKNLEVY; KSVKNLEVYF; SVKNLEVYFK; VKNLEVYFNK; NLEVYFNKE; LEVYFNKEE; LEVYFNKEEK; EVYFNKEEKD; VYFNKEEDK; YFNKEEDKD; FNKEEDKDT; KNEEDKDIL; KEEDKDILI; EEDKDILIK; EEDKDILIKK; EDKDILIKKD; DKDILIKKDK; DKDILIKKDKD; KDILIKKDKDE; DILIKKDKDEY; ILIKKDKDEYY; LIKKDKDEYYY; IKKDKDEYYYT; KKDKDEYYYTT; KDKDEYYYTTS; DKDEYYYTTSK; KDEYYYTTSKW; DEYYYTTSKWT; EYYYTTSKWTF; YYYTTSKWTFF; YYTTSKWTFFD; YTTSKWTFFDV; TTSKWTFFDVF; TSKWTFFDVFD; SKWTFFDVFDL; KWTFFDVFDLE; WTFFDVFDLEK; TFFDVFDLEKK; FFDVFDLEKKL; FDVFDLEKKLT; DVFDLEKKLTF; VFDLEKKLTFK; FDLEKKLTFKD; DLEKKLTFKDD; LEKKLTFKDDI; EKKLTFKDDIS; KKLTFKDDISS; KLTFKDDISSN; LTFKDDISSND; TFKDDISSNDK; FKDDISSNDNQ; KDDTSSNDNQF; DDTSSNDNQED; DTSSNDNQEDH; TSSNDNQEDHH; SSNDNQEDHHF; SNDNQEDHHEE; NDNQEDHHENK; DNQEDHHENKA; NQEDHHENKAD; |
| Seq 31 | SEQ ID NO 38334-38919/ 8 mers: MKRLTTCF; KRLTTFT; RLTTFTL; LTTFTLF; TTFTLFL; TFTLFLS; FTLFLSQ; TLFLSQA; LFLSQAC; FLSQACN; LSQACNL; SQACNLS; QACNLST; ACNLSTM; CNLSTMH; NLSTMHK; LSTMHKT; STMHKTD; TMHKTDT; MHKTDTK; HKTDTKE; KTDTKED; TDTKEDM; DTKEDMK; TKEDMKT; KEDMKIL; EDMKILY; DMKILYS; MKILYSE; KILYSET; TLYSETA; LYSETAF; YSETAFL; SETAFLR; ETAFLRK; TAFLRKK; AFLRKKL; FLRKKLN; LRKKLNL; RKKLNLE; KKLNLEH; KLNLEHL; LNLEHLE; NLEHLEI; LEHLEID; EHLEIDD; HLEIDDT; LEIDDTL; EIDDTLE; IDDTLEK; DDTLEKV; DTLEKVA; TLEKVAK; LEKVAKE; EKVAKEY; KVAKEYA; VAKEYAL; AKEYALK; KEYALKL; EYALKLG; YALKLGE; ALKLGEK; LKLGEKR; KLGEKRT; LGEKRTT; GEKRTTH; EKRTTHT; KRTTHTL; RTTHTLF; |

| | |
|---|---|
| | DILEKVAKEYA; LEKVAKEYAI; LEKVAKEYAIK; KVAKEYAIKL; KVAKEYAIKLG; VAKEYAIKLGE; AKEYAIKLGEN; KEYAIKLGENR; EYAIKLGENRT; YAIKLGENRTI; AIKLGENRTIT; IKLGENRTITH; KLGENRTITHL; LGENRTITHLF; GENRTITHLFG; ENRTITHLFGT; RTITHLFGTT; RTITHLFGTTP; TITHLFGTTPM; ITHLFGTTPMQ; THLFGTTPMQR; HLFGTTPMQRT; LFGTTPMQRTH; FGTTPMQRTHK; GTTPMQRTHKY; TTPMQRTHKYD; TPMQRTHKYDQ; PMQRTHKYDQS; MQRTHKYDQSF; QRTHKYDQSFN; RTHKYDQSFNL; THKYDQSFNLT; HKYDQSFNLTR; KYDQSFNLTRE; YDQSFNLTRET; DQSFNLTRETL; QSFNLTRETLA; SFNLTRETLAS; FNLTRETLASG; NLTRETLASGI; LTRETLASGIE; TRETLASGIEL; RETLASGIELN; ETLASGIELNR; TLASGIELNRV; LASGIELNRVV; ASGIELNRVVK; SGIELNRVVKA; GIELNRVVKAN; IELNRVVKANL; ELNRVVNANL; LNRVVNANLN; NRVVNANLNSP; RVVNANLNSPS; VVNANLNSPSH; VNANLNSPSHK; NANLNSPSHKE; ANLNSPSHKEA; NLNSPSHKEAL; LNSPSHKEALI; NSPSHKEALIN; SPSHKEALINT; PSHKEALINTD; SHKEALINTDT; HKEALINTDTD; KEALINTDTDK; EALINTDTDKI; ALINTDTDKIG; LINTDTDKIGG; INTDTDKIGGY; NTDTDKIGGYR; TDTDKIGGYRL; DTDKIGGYRLK; TDKIGGYRLKT; DKIGGYRLKTT; KIGGYRLKTTD; IGGYRLKTTDN; GGYRLKTTDNI; GYRLKTTDNID; YRLKTTDNIDF; RLKTTDNIDFV; LKTTDNIDFVV; KTTDNIDFVVL; TTDNIDFVVLF; TDNIDFVVLFG; DNIDFVVLFGK; NIDFVVLFGKR; IDFVVLFGKRR; DFVVLFGKRRY; FVVLFGKRRYK; VVLFGKRRYKN; |
| Seq 32 | SEQ ID NO 38920-39737<br>8 mers:<br>MMQRISLL; MQRISLL; QRISLLM; RISLLML; ISLLML; SLLMLA; LLMLAV; LMLAVF; MLAVFS; LAVFSC; LAVFSCK; AVFSCKQ; VFSCKQF; FSCKQFG; SCKQFGD; CKQFGDV; KQFGDVK; QFGDVKS; FGDVKSL; GDVKSLT; DVKSLTE; VKSLTEL; KSLTELD; SLTELDS; LTELDSG; TELDSGN; ELDSGNG; LDSGNGT; DSGNGTP; SGNGTPL; GNGTPLV; NGTPLVV; GTPLVVG; TPLVVGD; PLVVGDV; LVVGDVV; VVGDVVK; VGDVVKD; GDVVKDL; DVVKDLT; VVKDLTP; VKDLTPK; KDLTPKE; DLTPKET; LTPKETS; TPKETSL; PKETSLT; KETSLTP; ETSLTPF; TSLTPFE; SLTPFEA; LTPFEAK; TPFEAKL; PFEAKLE; FEAKLES; EAKLESL; AKLESLK; KLESLKV; LESLKVF; ESLKVFL; SLKVFLK; LKVFLKD; KVFLKDA; VFLKDAM; FLKDAMS; LKDAMSV; KDAMSVN; DAMSVNG; AMSVNGR; MSVNGRE; SVNGREE; VNGREEA; NGREEAL; GREEALK; REEALKA; EEALKAE; EALKAEY; ALKAEYE; LKAEYEK; KAEYEKS; AEYEKSY; EYEKSYK; YEKSYKE; EKSYKEF; KSYKEFF; SYKEFFD; YKEFFDN; KEFFDNL; EFFDNLS; FFDNLSK; FDNLSKD; DNLSKDV; NLSKDVR; LSKDVRQ; SKDVRQK; KDVRQKE; DVRQKEF; VRQKEFI; RQKEFIS; QKEFISS; KEFISSF; EFISSFD; FISSFDN; ISSFDNI; SSFDNIS; SFDNISS; FDNISSI; DNISSIV; NISSIVS; ISSIVSK; SSIVSKA; SIVSKAV; IVSKAVD; VSKAVDA; SKAVDAS; KAVDASK; AVDASKK; VDASKKR; DASKKRP; ASKKRPT; SKKRPTE; KKRPTEQ; |

Fig. 31 continued

KRRPTEQQ; RRPTEQQS; RPTEQQSL; PTEQQSLG; TEQQSLGF;
EQQSLGFK; QQSLGFKE; QSLGFKEY; SLGFKEYV; LGFKEYVC;
GFKEYVCY; FKEYVCYK; KEYVCYKT; EYVCYKTK; YVCYKTKN;
VCYKTKNS; CYKTKNSK; YKTKNSKG; KTKNSKGE; TKNSKGEA;
KNSKGEAL; NSKGEALS; SKGEALSL; KGEALSLF; GEALSLFF;
EALSLFFQ; ALSLFFQK; LSLFFQKV; SLFFQKVV; LFFQKVVD;
FFQKVVDA; FQKVVDAF; QKVVDAFG; KVVDAFGA; VVDAFGAD;
VDAFGADP; DAFGADPY; AFGADPYK; FGADPYKK; GADPYKKD;
ADPYKKDN; DPYKKDND; PYKKDNDE; YKKDNDES; KKDNDESV;
KDNDESVQ; DNDESVQK; NDESVQKP; DESVQKPV; ESVQKPVK;
SVQKPVKC; VQKPVKCN; QKPVKCNE; KPVKCNEE; PVKCNEEI;
VKCNEEIF; KCNEE

VDAFGADPY; DAFGADPYK; AFGADPYKK; FGADPYKKD; GADPYKKDD;
ADPYKKDDF; DPYKKDDFS; PYKKDDFSV; YKKDDFSVQ; KDDDFSVQ;
KDDFSVQK; DDFSVQKP; DFSVQKPV; FSVQKPVK; SVQKPVKC;
SVQKPVKCR; VQKPVKCRE; QKPVKCREE; KPVKCREEL; PVKCREELF;
VKCREELFK; KCREELFKV; CREELFKVI; REELFKVIK; EELFKVIKK;
ELFKVIKKV; LFKVIKKVL; FKVIKKVLT; KVIKKVLTE; VIKKVLTES;
IKKVLTESF; KKVLTESFG; KVLTESFSN; VLTESFSNK; LTESFSNNE;
TESFSNN

VDAFCADPYK; DAFCADPYKK; AFCADPYKKD; FCADPYKKDN;
GADPYKKDND; ADPYKKDNDF; DPYKKDNDFS; PYKKDNDFSV;
YKKDNDFSVQ; KKDNDFSVQK; KDNDFSVQKP; DNDFSVQKPV;
NDFSVQKPVK; DFSVQKPVKC; FSVQKPVKCK; SVQKPVKCKE;
VQKPVKCNEE; QKPVKCNEEI; KPVKCNEEIF; PVKCNEEIFK;
VKCNEEIFKV; KCNEEIFKVT; CNEEIFKVTK; NEEIFKVTKK;
EEIFKVTKKV; EIFKVTKKVL; IFKVTKKVLT; FKVTKKVLTE;
KVTKKVLTES; VTKKVLTESE; TKKVLTESES; KKVLTESESN;
KVLTESESNF; VLTESESNFE; LTESESNFEK; TESESNFEKR;
ESESNFEKRK; SESNFEKRKL; ESNFEKRKLK; SNFEKRKLKN;
NFEKRKLKNY

| | |
|---|---|
| | LSLFFQKVVDA; SLFFQKVVDAF; LFFQKVVDAFG; FFQKVVDAFGA; FQKVVDAFGAD; QKVVDAFGADP; KVVDAFGADPY; VVDAFGADPYK; VDAFGADPYKK; DAFGADPYKKD; AFGADPYKKDN; FGADPYKKDND; GADPYKKDNDE; ADPYKKDNDES; DPYKKDNDESV; PYKKDNDESVQ; YKKDNDESVQK; KKDNDESVQKP; KDNDESVQKPV; DNDESVQKPVK; NDESVQKPVKC; DESVQKPVKCN; ESVQKPVKCNF; SVQKPVKCNFF; VQKPVKCNFFT; QKPVKCNFFTF; KPVKCNFFTFK; PVKCNFFTFKV; VKCNFFTFKVI; KCNFFTFKVIK; CNFFTFKVIKK; NFFTFKVIKKV; FFTFKVIKKVL; FTFKVIKKVLT; TFKVIKKVLTF; FKVIKKVLTFS; KVIKKVLTFSF; VIKKVLTFSFS; IKKVLTFSFSN; KKVLTFSFSNN; KVLTFSFSNNF; VLTFSFSNNFL; LTFSFSNNFLK; TFSFSNNFLKN; FSFSNNFLKNL; SFSNNFLKNLK; FSNNFLKNLKN; SNNFLKNLKNY; NNFLKNLKNYG; NFLKNLKNYGN; FLKNLKNYGKV; |
| Seq 33 | SEQ ID NO 39738-40661/ <br> 8 mers: <br> MKRISILS; KRISILSL; RISILSLL; ISILSLLL; SILSLLLL; ILSLLLLI; LSLLLLIL; SLLLLILS; LLLLILSL; LLLILSLL; LLILSLLL; LILSLLLF; ILSLLLFS; LSLLLFSC; SLLLFSCK; LLLFSCKQ; LLFSCKQY; LFSCKQYG; FSCKQYGD; SCKQYGDV; CKQYGDVK; KQYGDVKS; QYGDVKSL; YGDVKSLT; GDVKSLTE; DVKSLTEV; VKSLTEVA; KSLTEVAT; SLTEVATD; LTEVATDI; TEVATDIF; EVATDIFD; VATDIFDD; ATDIFDDN; TDIFDDNS; DIFDDNSF; IFDDNSFA; FDDNSFAS; DDNSFASG; DNSFASGS; NSFASGSV; SFASGSVE; FASGSVES; ASGSVESK; SGSVESKD; GSVESKDQ; SVESKDQI; VESKDQII; ESKDQIIR; SKDQIIRK; KDQIIRKG; DQIIRKGP; QIIRKGPV; IIRKGPVL; IRKGPVLI; RKGPVLIS; KGPVLISE; GPVLISEE; PVLISEEF; VLISEEFE; LISEEFER; ISEEFERL; SEEFERLF; EEFERLFA; EFERLFAI; FERLFAIK; ERLFAIKT; RLFAIKTF; LFAIKTFL; FAIKTFLK; AIKTFLKD; IKTFLKDA; KTFLKDAM; TFLKDAMG; FLKDAMGV; LKDAMGVN; KDAMGVNG; DAMGVNGR; AMGVNGRG; MGVNGRGG; GVNGRGGD; VNGRGGDT; NGRGGDTK; GRGGDTKA; RGGDTKAF; GGDTKAFF; GDTKAFFE; DTKAFFEK; TKAFFEKS; KAFFEKSY; AFFEKSYK; FFEKSYKF; FEKSYKFF; EKSYKFFD; KSYKFFDW; SYKFFDWL; YKFFDWLS; KFFDWLSK; FFDWLSKD; FDWLSKDV; DWLSKDVN; WLSKDVNR; LSKDVNRQ; SKDVNRQK; KDVNRQKF; DVNRQKFF; VNRQKFFV; NRQKFFVS; RQKFFVSF; QKFFVSFF; KFFVSFFN; FFVSFFNK; FVSFFNKL; VSFFNKLG; SFFNKLGG; FFNKLGGI; FNKLGGIT; NKLGGITT; KLGGITTK; LGGITTKA; GGITTKAV; GITTKAVD; ITTKAVDA; TTKAVDAS; TKAVDASK; KAVDASKK; AVDASKKR; VDASKKRY; DASKKRYK; ASKKRYKS; SKKRYKSN; KKRYKSNF; KRYKSNFK; RYKSNFKS; YKSNFKSL; KSNFKSLG; SNFKSLGF; NFKSLGFN; FKSLGFNF; KSLGFNFY; SLGFNFYV; LGFNFYVC; GFNFYVCY; FNFYVCYD; NFYVCYDT; FYVCYDTK; YVCYDTKT; VCYDTKTR; CYDTKTRG; YDTKTRGD; DTKTRGDD; TKTRGDDL; KTRGDDLS; TRGDDLSL; RGDDLSLF; GDDLSLFF; DDLSLFFQ; DLSLFFQK; LSLFFQKV; SLFFQKVA; LFFQKVAD; FFQKVADA; FQKVADAF; QKVADAFG; KVADAFGT; VADAFGTQ; ADAFGTQE; DAFGTQEY; AFGTQEYK; FGTQEYKN; GTQEYKNK; TQEYKNKD; QEYKNKDE; EYKNKDED; YKNKDEDD; KNKDEDDF; |

Fig. 31 continued

FKDEDDEN; KDEDDENE; DEDDENQ; EDDENQK; DDENQKP;
DENNQKPF; ENNQKPFK; NNQKPFKC; NQKPFKCN; QKPFKCNF;
KPFKCNEF; PFKCNEFF; FKCNEFFK; KCNEFFKV; CNEFFKVI;
NEFFKVI; EFFKVIK; FFKVIKR; FKVIKRV; KVIKRVF;
KVIKRVFT; VIKRVFTS; IKRVFTSS; KRVFTSSE; RVFTSSEN;
VFTSSENN; FTSSENNE; TSSENNEL; SSENNELA; SENNELAN;
ENNELAN; NNELANL; NELANLK; ELANLKS; LANLKSL;
LANLKNLN; ANLKNLNS; NLKNLKSY; LKNLNSYN; KNLKSYEL;
NLNSYNLN; LNSYKLNG; NSYNLNGN; SYNLNGNN; YKLNGNPK;

9 mers:
MKRLSILSL; KRLSILSLL; RLSILSLLL; LSILSLLL; SILSLLLL;
LSTLLLLL; ISTLLLLL; STLLLLLE; TLLLLLFS; LLLLLFSC;
LLLLFSCK; LLLFSCKQ; LLFSCKQY; LFSCKQYG; FSCKQYGD;
FSCKQYGDV; SCKQYGDVK; CKQYGDVKS; KQYGDVKSL; QYGDVKSLT;
YGDVKSLTE; GDVKSLTEV; DVKSLTEVA; VKSLTEVAT; KSLTEVATD;
SLTEVATDL; LTEVATDLE; TEVATDLED; EVATDLEDD; VATDLEDDS;
ATDLEDDSF; TDLEDDSFA; LEDDSFAS; EDDSFASS;
DDSFASCS; DSFASCSV; SFASCSVE; SFASCSVES; FASCSVESK;
ASCSVESKD; SCSVESKDQ; CSVESKDQL; SVESKDQLI; VESKDQLIE;
ESKDQLIEK; SKDQLIEKG; KDQLIEKGP; DQLIEKGPV; QLIEKGPVL;
LIEKGPVLT; IEKGPVLTS; EKGPVLTSE; KGPVLTSEF; GPVLTSEFF;
PVLTSEFER; VLTSEFFER; LTSEFFERL; TSEFFERLE; SEFFERLEA;
EFFERLEAL; FFERLEALK; FERLEALKT; ERLEALKTF; RLEALKTFL;
LEALKTFLK; EALKTFLKD; ALKTFLKDA; LKTFLKDAM; KTFLKDAMG;
TFLKDAMGV; FLKDAMGVE; LKDAMGVEC; KDAMGVECR; DAMGVECRE;
AMGVECREG; MGVECREGD; GVECREGDT; VECREGDTK; ECREGDTKA;
CREGDTKAF; REGDTKAFY; EGDTKAFYE; GDTKAFYEK; DTKAFYEKS;
TKAFYEKSY; KAFYEKSYK; AFYEKSYKF; FYEKSYKFF; YEKSYKFFT;
EKSYKFFTD; KSYKFFTDW; SYKFFTDWL; YKFFTDWLS; KFFTDWLSK;
FFTDWLSKD; FTDWLSKDV; TDWLSKDVN; DWLSKDVNR; WLSKDVNRQ;
LSKDVNRQK; SKDVNRQKF; KDVNRQKFF; DVNRQKFFV; VNRQKFFVS;
NRQKFFVSF; RQKFFVSFF; QKFFVSFFK; KFFVSFFKN; FFVSFFKNT;
FVSFFKNTC; VSFFKNTCC; SFFKNTCCL; FFKNTCCLT; FKNTCCLTT;
KNTCGTTTK; NTCGTTTKA; TCGTTTKAV; CGTTTKAVD; GTTTKAVDA;
TTTKAVDAS; TTKAVDASK; TKAVDASKK; KAVDASKKR; AVDASKKRY;
VDASKKRYN; DASKKRYNS; ASKKRYNSN; SKKRYNSNP; KKRYNSNPK;
KRYNSNPKS; RYNSNPKSL; YNSNPKSLG; NSNPKSLGF; SNPKSLGFN;
NPKSLGFNF; PKSLGFNFY; KSLGFNFYV; SLGFNFYVC; LGFNFYVCY;
GFNFYVCYD; FNFYVCYDT; NFYVCYDTK; FYVCYDTKT; YVCYDTKTR;
VCYDTKTRT; CYDTKTRTG; YDTKTRTGD; DTKTRTGDD; TKTRTGDDL;
KTRTGDDLS; TRTGDDLSL; RTGDDLSLF; TGDDLSLFF; GDDLSLFFQ;
DDLSLFFQK; DLSLFFQKV; LSLFFQKVA; SLFFQKVAD; LFFQKVADA;
FFQKVADAF; FQKVADAFG; QKVADAFGT; KVADAFGTQ; VADAFGTQF;
ADAFGTQFY; DAFGTQFYK; AFGTQFYKN; FGTQFYKNK; GTQFYKNKD;
TQFYKNKDE; QFYKNKDED; FYKNKDEDD; YKNKDEDDN; KNKDEDDEN;
FKDEDDENN; KDDDEINQ; DDDFFNQK; EDDENNQKP; DDENNQKPF;
DENNQKPFK; ENNQKPFKC; NNQKPFKCN; NQKPFKCNE; QKPFKCNEF;
KPFKCNEFI; PFKCNEFIF; FKCNEFIFK; KCNEFIFKV; CNEFIFKVI;
NEFIFKVIK; EFIFKVIKR; FIFKVIKRV; IFKVIKRVF; FKVIKRVFT;
KVIKRVFTS; VIKRVFTSS; IKRVFTSSE; KRVFTSSEN; RVFTSSENN;

Fig. 31 continued

VFTESEKNS; FTESENLNE; TESENRFL; ESENKKLA; SENNKLAN;
FNNKLANL; NNKLANLK; NKLANLKK; KLANLKNL; LANLKNLN;
ANLKNLNS; NLKNLNSY; LKNLNSYN; KNLNSYNLN;
FLNSYNLNS; LNSYNLNSE; NSYNLNSNN; SYNLNSNNK;

10 mers:
MKRTSTLSTL; KRTSTLSTLL; RTSTLSTLLL; TSTLSTLLLS;
SLLSLLLLL; LLSLLLLLS; LSLLLLLLS; SLLLLLLFS;
TLLLLLFSC; LLLLLFSCR; LLLLFSCRQ; LLLFSCRQY;
LLFSCRQYG; LFSCRQYGD; FSCRQYGDV; SCRQYGDVK;
SCRQYGDVKS; CRQYGDVKSL; RQYGDVKSLT; QYGDVKSLTE;
YGDVKSLTEV; GDVKSLTEVA; DVKSLTEVAT; VKSLTEVATD;
KSLTEVATDL; SLTEVATDLF; LTEVATDLFD; TEVATDLFDD;
EVATDLFDDN; VATDLFDDNS; ATDLFDDNSF; TDLFDDNSFA;
DLFDDNSFAS; LFDDNSFASC; FDDNSFASCS; DDNSFASCSV;
DNSFASCSVE; NSFASCSVES; SFASCSVESK; FASCSVESKD;
ASCSVESKDQ; SCSVESKDQT; CSVESKDQTT; SVESKDQTTF;
VESKDQTTFK; ESKDQTTFKG; SKDQTTFKGP; KDQTTFKGPV;
DQTTFKGPVL; QTTFKGPVLT; TTFKGPVLTS; TFKGPVLTSE;
FKGPVLTSEF; KGPVLTSEFF; GPVLTSEFFR; PVLTSEFFRK;
VLTSEFFRKL; LTSEFFRKLF; TSEFFRKLFA; SEFFRKLFAL;
EFFRKLFALK; FFRKLFALKF; FRKLEALKFF; RKLEALKFFL;
KLEALKFFLK; LEALKFFLKD; EALKFFLKDA; ALKFFLKDAM;
LKFFLKDAMG; KFFLKDAMGV; FFLKDAMGVN; FLKDAMGVNG;
LKDAMGVNGR; KDAMGVNGRE; DAMGVNGREG; AMGVNGREGD;
MGVNGREGDT; GVNGREGDTK; VNGREGDTKA; NGREGDTKAE;
GREGDTKAEY; REGDTKAEYE; EGDTKAEYEK; GDTKAEYEKS;
DTKAEYEKSY; TKAEYEKSYK; KAEYEKSYKF; AEYEKSYKFF;
EYEKSYKFFD; YEKSYKFFDW; EKSYKFFDWL; KSYKFFDWLS;
SYKFFDWLS; YKFFDWLSK; KFFDWLSKD; FFDWLSKDV;
FDWLSKDVN; DWLSKDVNR; WLSKDVNRQ; LSKDVNRQK;
SKDVNRQKF; KDVNRQKFF; DVNRQKFFV; VNRQKFFVS;
NRQKFFVSF; RQKFFVSFF; QKFFVSFFN; KFFVSFFNN;
FFVSFFNNI; FVSFFNNIG; VSFFNNIGG; SFFNNIGGL;
FFNNIGGLT; FNNIGGLTT; NNIGGLTTK; NIGGLTTKA;
IGGLTTKAV; GGLTTKAVD; GLTTKAVDA; LTTKAVDAS;
TTKAVDASK; TKAVDASKK; KAVDASKKR; AVDASKKRY;
VDASKKRYN; DASKKRYNS; ASKKRYNSP; SKKRYNSPK;
KKRYNSPKS; KRYNSPKSL; RYNSPKSLG; YNSPKSLGF;
NSPKSLGFN; SPKSLGFNK; PKSLGFNKF; KSLGFNKFV;
SLGFNKFVC; LGFNKFVCY; GFNKFVCYD; FNKFVCYDT;
NKFVCYDTK; KFVCYDTKR; FVCYDTKRT; VCYDTKRTG;
CYDTKRTGD; YDTKRTGDD; DTKRTGDDL; TKRTGDDLS;
KRTGDDLSF; RTGDDLSFF; TGDDLSFFQ; GDDLSFFQK;
DDLSFFQKV; DLSFFQKVA; LSFFQKVAD; SFFQKVADA;
FFQKVADAF; FQKVADAFG; QKVADAFGT; KVADAFGTQ;
VADAFGTQE; ADAFGTQEY; DAFGTQEYK; AFGTQEYKN;
FGTQEYKNK; GTQEYKNKD; TQEYKNKDE; QEYKNKDED;
EYKNKDEDE; YKNKDEDEN; KNKDEDENK; NKDEDENKQ;
KDEDENKQK; DEDENKQKP; EDENKQKPK; DENKQKPKK;

Fig. 31 continued

DENNQKPEKC; ENKQKPEKCN; NQKPEKCNE; KQKPEKCNEE;
QKPEKCNEET; KPEKCNEETF; PEKCNEETFK; EKCNEETFKV;
KCNEETFKVT; CNEETFKVTK; NEETFKVTKR; EETFKVTKRV;
ETFKVIKRVE; TFKVIKRVET; FKVIKRVETE; KVIKRVETES;
VIKRVETESE; IKRVETESEN; KRVETESENK; RVETESENKN;
VETESENKNE; ETESENKNEL; TESENNKELA; ESENNKELAN;
SENNKELANL; ENKNELANLK; NNELANLKN; NELANLKNL;
ELANLKNLK; ELANLKNLS; LANLKJLKSY; ANLKDLNSYN;
NLKNLNSYNL; LKNLNSYNLN; KNLNSYNLNS; NLNSYNLNSN;
LNSYNLNSNK; NSYNLNSNN

Fig. 31 continued

MKIPLIQL; KIPLIQLK; IPLIQLKL; PLIQLKLL; LIQLKLLG;
LIQLKLLG; IQLKLLGL; QLKLLGLF; LKLLGLFL; KLLGLFLS;
LLGLFLSG; LGLFLSGT; GLFLSGTT; LFLSGTTD; FLSGTTDA;
LSGTTDAN; SGTTDANL; GTTDANLN

KPEAEKEK; TEAEKEKK; EAEEEKNK; AEEKKKEY;
EEEKKEYA; EEKKEYAL; KKKEYALM; KKEYALMD;
KEYALMDF; EYALMDFQ; YALMDFDQY; ALMDFDQYK; LMDFDQYKI;
MDFDQYKL; DFDQYKLE; FDQYKLEQF; DQYKLEQFG; QYKLEQFGS;
YKLEQFGSL; KLEQFGSLM; LEQFGSLME; EQFGSLMEA; QFGSLMEAL;
FGSLMEALY; GSLMEALYN; SLMEALYNE; LMEALYNEK; MEALYNEKQ;
EALYNEKQN

| | | | |
|---|---|---|---|
| AAKTVAAAPK; | AKTVAAAPKK; | KTVAAAPKKG; | TVAAAPKKGS; |
| VAAAPKKGSQ; | AAAPKKGSQN; | AAPKKGSQNQ; | APKKGSQNQP; |
| PKKGSQNQPQ; | KKGSQNQPQT; | KGSQNQPQTT; | GSQNQPQTTP; |
| SQNQPQTTPK; | QNQPQTTPKK; | KQPQTTPKKG; | QPQTTPKKGS; |
| PQTTPKKGSQ; | QTTPKKGSQN; | TTPKKGSQNQ; | TPKKGSQNQQ; |
| PKKGSQNQQA; | KKGSQNQQAA; | KGSQNQQAAP; | GSQNQQAAPS; |
| SQNQQAAPSP; | QNQQAAPSPQ; | KQQAAPSPQT; | QQAAPSPQLQ; |
| QAAPSPQLQS; | AAPSPQLQSL; | APSPQLQSLS; | PSPQLQSLSF; |
| SPQLQSLSFS; | PQLQSLSFSA; | QLQSLSFSAD; | LQSLSFSADL; |
| QSLSFSADLS; | SLSFSADLSN; | LSFSADLSNL; | SFSADLSNLP; |
| FSADLSNLPK; | SADLSNLPKT; | ADLSNLPKTT; | DLSNLPKTTA; |
| LSNLPKTTAA; | SNLPKTTAAR; | NLPKTTAARA; | LPKTTAARAA; |
| PKTTAARAAS; | KTTAARAASL; | TTAARAASLT; | TAARAASLTK; |
| AARAASLTKQ; | ARAASLTKQR; | RAASLTKQRT; | AASLTKQRTP; |
| ASLTKQRLPL; | SLTKQRLPLQ; | LTKQRLPLQA; | TKQRLPLQAV; |
| KQRLPLQAVT; | QRLPLQAVTT; | RLPLQAVTTV; | LPLQAVTTVP; |
| PLQAVTTVPG; | LQAVTTVPGN; | QAVTTVPGNT; | AVTTVPGNTR; |
| VTTVPGNTRT; | TTVPGNTRTF; | TVPGNTRTFK; | VPGNTRTFKS; |
| PGNTRTFNSR; | GNTRTFNSRK; | NTRTFNSRKS; | TRTFNSRKSG; |
| RTFNSRKSGL; | TFNSRKSGLP; | FNSRKSGLPT; | NSKNSGLPTF; |
| SRNSGLPTFA; | RNSGLPTFAL; | NSGLPTFALN; | SGLPTFALNY; |
| GLPTFALNYS; | LPTFALNYSF; | PTFALNYSFS; | TFALNYSFSQ; |
| FALNYSFSQF; | ALNYSFSQFT; | LNYSFSQFTR; | NYSFSQFTRQ; |
| YSFSQFTRQQ; | SFSQFTRQQT; | FSQFTRQQTN; | SQFTRQQTNS; |
| QFTRQQTNSS; | FTRQQTNSSS; | TRQQTNSSSA; | RQQTNSSSAV; |
| QQTNSSSAVQ; | QTNSSSAVQT; | TNSSSAVQTT; | NSSSAVQTTT; |
| SSSAVQTTTS; | SSAVQTTTSS; | SAVQTTTSSG; | AVQTTTSSGS; |
| VQTTTSSGSK; | QTTTSSGSKL; | TTTSSGSKLQ; | TTSSGSKLQT; |
| TSSGSKLQTL; | SSGSKLQTLK; | SGSKLQTLKN; | GSKLQTLKNE; |
| SKLQTLKNEL; | KLQTLKNELL; | LQTLKNELLR; | QTLKNELLRA; |
| TLKNELLRAL; | LKNELLRALS; | KNELLRALSE; | NELLRALSEF; |
| ELLRALSEFK; | LLRALSEFKN; | LRALSEFKNK; | RALSEFKNKT; |
| ALSEFKNKTQ; | LSEFKNKTQN; | SEFKNKTQNK; | EFKNKTQNKF; |
| FKNKTQKNEG; | KNKTQKNFGF; | KTQKNFGFR; | KTQNNFGFRE; |
| TQNNFGFRET; | QNNFGFRETY; | NNFGFRETYD; | NFGFRETYDQ; |
| FGFRETYDQF; | GFRETYDQFK; | FRETYDQFKM; | RETYDQFKMK; |
| ETYDQFKMKD; | TYDQFKMKDS; | YDQFKMKDSA; | DQFKMKDSAF; |
| QFKMKDSAFE; | FKMKDSAFEL; | KMKDSAFELL; | MKDSAFELLD; |
| KDSAFELLDV; | DSAFELLDVT; | SAFELLDVTS; | AFELLDVTSS; |
| FELLDVTSSA; | ELLDVTSSAK; | LLDVTSSAKV; | LDVTSSAKVY; |
| DVTSSAKVYD; | VTSSAKVYDR; | TSSAKVYDRS; | SSAKVYDRSY; |
| SAKVYDRSYA; | AKVYDRSYAP; | KVYDRSYAPQ; | VYDRSYAPQL; |
| YDRSYAPQLK; | DRSYAPQLNS; | RSYAPQLNSF; | SYAPQLNSFT; |
| YAPQLNSFTP; | APQLNSFTPA; | PQLNSFTPAF; | QLNSFTPAFT; |
| LNSFTPAFN; | NSFTPAFNF; | SFTPAFNFR; | FTPAFNFRN; |
| TPFAFNFRNK; | PFAFNFRKKF; | FAFNFRKKFY; | AFNFRKKFYA; |
| FNFRKKFYAL; | NFRKKFYALM; | FRKKFYALMD; | RKKFYALMDF; |
| KKFYALMDFD; | KFYALMDFDQ; | FYALMDFDQY; | YALMDFDQYK; |
| ALMDFDQYKL; | LMDFDQYKLE; | MDFDQYKLEQ; | DFDQYKLEQF; |
| FDQYKLEQFG; | DQYKLEQFGS; | QYKLEQFGSL; | YKLEQFGSLM; |
| KLFQFGSTMF; | LFQFGSTMFA; | FQFGSTMFAL; | QFGSTMFALY; |

Fig. 31 continued

EQSLEEALYNE; QSLEEALYNE; SLEEALYNEK; LEEALYNEKQ;
EEALYNEKQE; EALYNEKQEE; ALYNEKQEES; LYNEKQEESL;
YNEKQEESLT; NEKQEESLTR; EKQEESLTRE; KQEESLTREL;
QEESLTRELM; EESLTRELML; ESLTRELMLS; SLTRELMLSG;
LTRELML

Fig. 31 continued

| | |
|---|---|
| | KLEQFGSLMEA; LEQFGSLMEAL; EQFGSLMEALY; QFGSLMEALYK; FGSLMEALYKF; GSLMEALYKFN; SLMEALYKFNQ; LMEALYKFNQN; MEALYKFNQNH; EALYKFNQNHS; ALYKFNQNHSL; LYKFNQNHSLI; YKFNQNHSLIR; KFNQNHSLIRE; FNQNHSLIREL; NQNHSLIRELM; QNHSLIRELMI; NHSLIRELMIS; HSLIRELMISG; SLIRELMISGL; LIRELMISGLG; IRELMISGLGT; RELMISGLGTQ; ELMISGLGTQT; LMISGLGTQTS; MISGLGTQTSF; ISGLGTQTSFF; SGLGTQTSFFL; GLGTQTSFFLA; LGTQTSFFLAL; GTQTSFFLALE; TQTSFFLALEE; QTSFFLALEET; TSFFLALEETK; SFFLALEETKK; FFLALEETKKT; FLALEETKKTE; LALEETKKTEL; ALEETKKTELF; LEETKKTELFE; EETKKTELFEN; ETKKTELFENQ; TKKTELFENQD; KKTELFENQDY; KTELFENQDYL; TELFENQDYLN; ELFENQDYLNAK; LFENQDYLNAKT; FENQDYLNAKT; ENQDYLNAKTN; NQDYLNAKTNS; QDYLNAKTNSF; DYLNAKTNSFD; YLNAKTNSFDF; LNAKTNSFDFT; NAKTNSFDFTM; AKTNSFDFTMK; KTNSFDFTMKL; TNSFDFTMKLK; NSFDFTMKLKE; SFDFTMKLKEL; FDFTMKLKELK; DFTMKLKELKS; FTMKLKELKSK; TMKLKELKSKL; MKLKELKSKLN; KLKELKSKLNQ; LKELKSKLNQI; KELKSKLNQIL; ELKSKLNQILD; LKSKLNQILDK; KSKLNQILDKR; SKLNQILDKRK; KLNQILDKRKE; LNQILDKRKEW; NQILDKRKEWS; QILDKRKEWSR; ILDKRKEWSRQ; LDKRKEWSRQA; DKRKEWSRQAD; KRKEWSRQADG; RKEWSRQADGL; KEWSRQADGLT; EWSRQADGLTA; WSRQADGLTAN; SRQADGLTANA; RQADGLTANAS; QADGLTANASS; ADGLTANASSN; DGLTANASSNS; GLTANASSNSS; LTANASSNSSL; TANASSNSSLS; ANASSNSSLSD; NASSNSSLSDS; ASSNSSLSDSK; SSNSSLSDSKS; SNSSLSDSKSS; NSSLSDSKSSL; SSLSDSKSLAE; SLSDSKSLAEY; LSDSKSLAEYI; SDSKSLAEYIK; DSKSLAEYIKK; SKSLAEYIKKR; KSLAEYIKKRY; SLAEYIKKRYL; LAEYIKKRYLD; AEYIKKRYLDN; EYIKKRYLDNM; YIKKRYLDNMQ; IKKRYLDNMQK; KKRYLDNMQKA; KRYLDNMQKAR; RYLDNMQKARQ; YLDNMQKARQS; LDNMQKARQSV; DNMQKARQSVL; NMQKARQSVLE; MQKARQSVLEA; QKARQSVLEAY; KARQSVLEAYI; ARQSVLEAYIS; RQSVLEAYIST; QSVLEAYISTM; |
| Seq 35 | SEQ ID NO 43321-43880 8 mers: MSSCTIDA; SSCTIDAK; SCTIDAKL; CTIDAKLN; TIDAKLNK; IDAKLNKD; DAKLNKDY; AKLNKDYK; KLNKDYKN; LNKDYKNK; NKDYKNKV; KDYKNKVE; DYKNKVEE; YKNKVEEL; KNKVEELL; NKVEELLN; KVEELLNS; VEELLNSS; EELLNSST; ELLNSSTD; LLNSSTDQ; LNSSTDQA; NSSTDQAK; SSTDQAKT; STDQAKTS; TDQAKTSI; DQAKTSIN; QAKTSINT; AKTSINTS; KTSINTOS; TSINTOSK; SINTOSKA; INTOSKAT; NTOSKATK; TOSKATKN; OSKATKNK; SKATKNKT; KATKNKTI; ATKNKTIK; TKNKTIKV; KNKTIKVA; NKTIKVAG; KTIKVAGL; TIKVAGLQ; IKVAGLQK; KVAGLQKN; VAGLQKNT; AGLQKNTQ; GLQKNTQS; LQKNTQSK; QKNTQSKK; KNTQSKKN; NTQSKKNR; TQSKKNRL; QSKKNRLQ; SKKNRLQG; KKNRLQGL; KNRLQGLN; NRLQGLNP; RLQGLNPA; LQGLNPAN; QGLNPANQ; GLNPANQV; LNPANQVE; NPANQVEP; PANQVEPG; ANQVEPGN; NQVEPGNP; QVEPGNPK; VEPGNPKM; EPGNPKMQ; PGNPKMQL; GNPKMQLA; NPKMQLAN; PKMQLANQ; KMQLANQA; MQLANQAN; QLANQANQ; |

Fig. 31 continued

IANQANQA; AKQAKQAK; NQANQANQ; QANQAKQA; AKQAKQAN;
KQANQAKQ; QANQANQA; ANQAKQAK; KQANQAKQ; QANQAKQA;
AKQAKQAN; NQAKQANQ; QAKQANQA; AKQANQAS; NQANQASQ;
QANQASQA; AKQASQAS; NQASQASQ; QASQASQA; ASQASQAS;
SQASQASQ; QASQASQV; ASQASQVA; SQASQVAS; QASQVASS;
ASQVASSA; QVASSASQ; VASSASQA; ASSASQAS;
SSASQASP; SASQASPV; ASQASPVA; SQASPVAS; QASPVASP;
ASPVASPA; SPVASPAT; PVASPATK; VASPATKV; ASPATKVQ;
SPATKVQA; PATKVQAT; ATKVQATP; TKVQATPP; KVQATPPK;
VQATPPKQ; QATPPKQT; ATPPKQTA; TPPKQTAS; PPKQTASA;
PKQTASAQ; KQTASAQA; QTASAQAT; TASAQATQ; ASAQATQT;
SAQATQIV; AQATQIVP; QATQIVPK; ATQIVPKN; TQIVPKNT;
QIVPKNTS; IVPKNTST; VPKNTSTP; PKNTSTPK; KNTSTPKQ;
NTSTPKQS; TSTPKQST; STPKQSTP; TPKQSTPK; PKQSTPKP;
KQSTPKPQ; QSTPKPQQ; STPKPQQY; TPKPQQYT; PKPQQYTP;
KPQQYTPS; PQQYTPSS; QQYTPSSS; QYTPSSSP; YTPSSSPS;
TPSSSPSQ

ERTQYLKT; NTQYLKTI; TQYLKTII; QYLKTIIN; YLKTIINS;
LKTIINSY; KTIINSYT; TIINSYTF; IINSYTFK; NSYTFKD;
KSYTFKDK; SYTFKDKL; YTFKDKLK; TFKDKLKE; FKDKLKEL;
KDKLKELE; DKLKELES; KLKELESK; LKELESKL; KELESKLN;
ELESKLNS; LESKLNSI; ESKLNSIL; SKLNSILA; KLNSILAK;
LNSILAKK; NSILAKKE; SILAKKEK; ILAKKEKE; LAKKEKW;
AKKEKWLN; KKEKWLNV; KEKWLNVA; KEWLNVAD; EWLNVADA;
WLNVADAL; LNVADALL; NVADALLT; VADALLTE; ADALLTET;
DALLTETS; ALLTETSS; LLTETSSN; LTETSSNS; TETSSNSK;
ETSSNSKR; TSSNSKRK; SSNSKRKD; SNSKRKDP; NSKRKDPQ;
SKRKDPQS; KRKDPQSL; RKDPQSLG; KDPQSLGQ; DPQSLGQY;
PQSLGQYL; QSLGQYLK; SLGQYLKK; LGQYLKKK; GQYLKKKY;
QYLKKKYL; YLKKKYLD; LKKKYLDK; KKKYLDKM; KKYLDKMQ;
KYLDKMQD; YLDKMQDA; LDKMQDAR; DKMQDARQ; KMQDARQS;
MQDARQSA; QDARQSAL; DARQSALD; ARQSALDL; RQSALDLY;
QSALDLYL

Fig. 31 continued 10 mers:
MSSCTTDANI; SSCTTDANIN; SCTTDANINK; CTTDANINKD;
TTDANLKKDY; TDANLKKDYK; DANLKKDYKK; ANLKDYKKK;
NLKDYKNKV; LKDYKNKVE; KDYKNKVEE; DYKNKVEEL;
YKNKVEFLN; KNKVEFLNS; NKVEFLNSS;
KVEFLNSST; VEFLNSSTD; EFLNSSTDD; FLNSSTDDQ;
LNSSTDDQA; NSSTDDQAK; SSTDDQAKI; STDDQAKIS;
TDDQAKIST; DDQAKISTN; DQAKISTNT; QAKISTNTG;
AKISTNTGS; KISTNTGSN; ISTNTGSNA; STNTGSNAT;
TNTGSNATK; NTGSNATKN; TGSNATKNK; GSNATKNKT;
SNATKNKTN; NATKNKTNI; ATKNKTNIKV;
TKNKTNIKVA; KNKTNIKVAG; NKTNIKVAGL; KTNIKVAGLQ;
TNIKVAGLQK; NIKVAGLQKN; IKVAGLQKNT; KVAGLQKNTQ;
VAGLQKNTQS; AGLQKNTQSK; GLQKNTQSKK; LQKNTQSKKN;
QKNTQSKKNK; KNTQSKKNKN; NTQSKKKNL; TQSKKNNLQ;
QSKKNNLQG; SKKNNLQGL; KKNNLQGLN; KNNLQGLNP;
NNLQGLNPA; NLQGLNPAN; LQGLNPANQ; QGLNPANQV;
GLNPANQVE; LNPANQVEP; NPANQVEPG; PANQVNPGN;
ANQVNPGNP; NQVNPGNPM; QVNPGNPMQ; VNPGNPMQT;
NPGNPMQTA; PGNPMQTAN; GNPMQTANQ; NPMQTANQA;
PMQTANQAK; MQTANQAKQ; QTANQAKQA; TANQANQAN;
ANQANQANQ; NQANQANQA; QANQANQAN; ANQANQAN;
NQANQANQA; QANQANQAN; ANQANQANQ; NQANQANQA;
QANQANQAK; ANQANQAKQ; NQANQAKQA; QANQAKQAS;
ANQAKQASQ; NQAKQASQA; QAKQASQAS; AKQASQASQ;
KQASQASQA; QASQASQAS; ASQASQASQ; SQASQASQV;
QASQASQVA; ASQASQVAS; SQASQVASS; QASQVASSA;
ASQVASSAS; SQVASSASQ; QVASSASQA; VASSASQAS;
ASSASQASP; SSASQASPV; SASQASPVA; ASQASPVAS;
SQASPVASP; QASPVASPA; ASPVASPAT; SPVASPATN;
PVASPATNV; VASPATNVQ; ASPATNVQA; SPATNVQAT;
PATNVQATP; ATNVQATPP; TNVQATPPK; NVQATPPKQ;
VQATPPKQI; QATPPKQIA; ATPPKQIAS; TPPKQIASA;
PPKQIASAQ; PKQIASAQA; KQIASAQAT; QIASAQATQ;
IASAQATQV; ASAQATQVP; SAQATQVPN; AQATQVPNK;
QATQVPNKT; ATQVPNKTS; TQVPNKTST; QVPNKTSTP;
VPNKTSTPN; PNKTSTPNQ; NKTSTPNQS; KTSTPNQST;
TSTPNQSTI; STPNQSTIK; TPNQSTIKP;
PNQSTIKPQ; NQSTIKPQG; QSTIKPQGY; STIKPQGYT;
TIKPQGYTE; IKPQGYTES; KPQGYTESS;
PQGYTESSE; QGYTESSES; GYTESSESQ; YTESSESQP;
TESSESQPT; ESSESQPTS; SSESQPTSQ; SESQPTSQT;
ESQPTSQTN; SQPTSQTNE; QPTSQTNEN;
PTSQTNENS; TSQTNENSQ; SQTNENSQS; QTNENSQSN;
TNENSQSNK; NENSQSNKV; ENSQSNKVL; NSQSNKVLT;
SQSNKVLTN; QSNKVLTNY; SNKVLTNYR;
NKVLTNYRH; KVLTNYRHQ; VLTNYRHQT; LTNYRHQTP;
TNYRHQTPS; NYRHQTPSE; YRHQTPSEV; RHQTPSEVV;
HQTPSEVVP; QTPSEVVPV; TPSEVVPVY; PSEVVPVYS;
SEVVPVYSG; EVVPVYSGN; VVPVYSGNS; VPVYSGNSP;

Fig. 31 continued

VPVYSGKSPL; PVYSGKSPLQ; VYSGKSPLQK; YSGKSPLQKL;
SGKSPLQKLK; GKSPLQKLKN; KSPLQKLKNL; SPLQKLKNLL;
PLQKLKNLL; LQKLKNLLR; QKLKNLLRR; KLKNLLRRI;
LKNLLRRIA; KNLLRRIAE; LLRRIAEE; LLRRIAEEK;
LLRRIAEEK; LRRIAEEKK; RRIAEEKKL; RIAEEKNKT;
IAEEKNKTH; AEEKNKTHN; EEKNKTHNG; EKNKTHNGF;
KKTHNGFR; NKTHNGFRE; KTHNGFRET; THNGFRETY;
HNGFRETYD; NGFRETYDQ; HGFRETYDQF; GFRETYDQFK;
FRETYDQFKM; RETYDQFKMR; ETYDQFKMKD; TYDQFKMKDS;
YDQFKMKDSA; DQFKMKDSAF; QFKMKDSAFT; FKMKDSAFTL;
KMKDSAFTL; MKDSAFTLL; KDSAFT

KYLDKSQDAK; YLDKSQDAKQ; LDKMQDAKQS; DKMQDAKQSA;
KMQDARQSAL; MQDARQSALD; QDARQSALDL; DARQSALDLY;
ARQSALDLYL; RQSALDLYLN; QSALDLYLNT; SALDLYLNTT;
ALDLYLNTTL; LDLYLNTTLT; DLYLNTTLTR;

11 mers:
MSSCTTDANLN; SSCTTDANLNK; SCTTDANLNKD; CTTDANLNKDY;
TTDANLNKDYK; TDANLNKDYKN; DANLNKDYKNK; ANLNKDYKNKV;
NLNKDYKNKVE; LNKDYKNKVEF; NKDYKNKVEFL; KDYKNKVEFLL;
DYKNKVEFLLN; YKNKVEFLLNS; KNKVEFLLNSS; NKVEFLLNSST;
KVEFLLNSSTD; VEFLLNSSTDD; EFLLNSSTDDQ; FLLNSSTDDQA;
LLNSSTDDQAK; LNSSTDDQAKI; NSSTDDQAKIS; SSTDDQAKISL;
STDDQAKISLN; TDDQAKISLNT; DDQAKISLNTG; DQAKISLNTGS;
QAKISLNTGSN; AKISLNTGSNA; KISLNTGSNAT; ISLNTGSNATK;
SLNTGSNATKN; LNTGSNATKNK; NTGSNATKNKT; TGSNATKNKTE;
GSNATKNKTEI; SNATKNKTEIK; NATKNKTEIKV; ATKNKTEIKVA;
TKNKTEIKVAG; KNKTEIKVAGL; NKTEIKVAGLQ; KTEIKVAGLQK;
TEIKVAGLQKN; EIKVAGLQKNT; IKVAGLQKNTQ; KVAGLQKNTQS;
VAGLQKNTQSK; AGLQKNTQSKK; GLQKNTQSKKK; LQKNTQSKKKN;
QKNTQSKKKNK; KNTQSKKKNKL; NTQSKKKNKLQ; TQSKKKNKLQG;
QSKKKNKLQGL; SKKKNKLQGLN; KKNKLQGLNPA; KNKLQGLNPAK;
KNLQGLNPAKQ; NLQGLNPAKQV; LQGLNPAKQVK;
QGLNPAKQVKP; GLNPAKQVKPG; LNPAKQVKPGK; NPAKQVKPGKP;
PAKQVKPGKPM; AKQVKPGKPMQ; KQVKPGKPMQT; QVKPGKPMQTA;
VKPGKPMQTAN; KPGKPMQTANQ; PGKPMQTANQA; GKPMQTANQAK;
KPMQTANQAKQ; PMQTANQANQA; MQTANQANQAK; QTANQANQAKQ;
TANQANQAKQA; ANQANQAKQAN; NQANQAKQANQ; QANQAKQANQA;
ANQAKQANQAN; NQANQAKQAKQ; QANQAKQANQA; ANQAKQANQAK;
NQANQAKQAKQ; QANQAKQANQA; ANQAKQAKQAS; NQAKQAKQASQ;
QAKQAKQASQA; AKQAKQASQAS; KQAKQASQASQ; QAKQASQASQA;
AKQASQASQAS; NQASQASQASQ; QASQASQASQV; ASQASQASQVA;
SQASQASQVAS; QASQASQVASS; ASQASQVASSA; SQASQVASSAS;
QASQVASSASQ; ASQVASSASQA; SQVASSASQAS; QVASSASQASP;
VASSASQASPV; ASSASQASPVA; SSASQASPVAS; SASQASPVASP;
ASQASPVASPA; SQASPVASPAT; QASPVASPATK; ASPVASPATNV;
SPVASPATNVQ; PVASPATNVQA; VASPATNVQAT; ASPATNVQATP;
SPATNVQATPP; PATNVQATPPK; ATNVQATPPKQ; TNVQATPPKQT;
NVQATPPKQLA; VQATPPKQLAS; QATPPKQLASA; ATPPKQLASAQ;
TPPKQLASAQA; PPKQLASAQAT; PKQLASAQATQ; KQLASAQATQT;
QLASAQATQTV; LASAQATQTVP; ASAQATQTVPK; SAQATQTVPKN;
AQATQTVPKNT; QATQTVPKNTS; ATQTVPKNTSI; TQTVPKNTSIE;
QTVPKNTSIEN; TVPKNTSIENQ; VPKNTSIENQS; PKNTSIENQSI;
KNTSTPNQSTI; NTSTPNQSTIK; TSTPNQSTIKP; STPNQSTIKPQ;
TPNQSTIKPQQ; PNQSTIKPQQY; NQSTIKPQQYT; QSTIKPQQYTF;
STIKPQQYTFS; TIKPQQYTFSS; IKPQQYTFSSS; KPQQYTFSSSF;
PQQYTFSSSFS; QQYTFSSSFSQ; QYTFSSSFSQP; YTFSSSFSQPT;
TFSSSFSQPTS; FSSSFSQPTSQ; SSSFSQPTSQT; SSFSQPTSQTK;
SFSQPTSQTKK; FSQPTSQTKKN; SQPTSQTKKKN; QPTSQTKKNSQ;
PTSQTKKNSQS; TSQTKKNSQSE; SQTKKNSQSNK; QTKKNSQSNKV;
TKKNSQSNKVL; KKNSQSNKVLT; KNSQSNKVLTK; NSQSNKVLTKY;
KSQSNKVLTKY; SQSNKVLTKYR; QSNKVLTKYRH; SNKVLTKYRHQ;

RKVLTDYRHQT; NVLTDYRHQTQ; VLTDYRHQTQP; LTDYRHQTQPS;
TDYRHQTQPSF; DYRHQTQPSFV; YRHQTQPSFVV; RHQTQPSFVVP;
HQTQPSFVVPV; QTQPSFVVPVY; TQPSFVVPVYS; QPSFVVPVYSG;
PSFVVPVYSGN; SFVVPVYSGNS; FVVPVYSGNSP; VVPVYSGNSPL;
VPVYSGNSPLQ; PVYSGNSPLQK; VYSGNSPLQKL; YSGNSPLQKLK;
SGNSPLQKLKN; GNSPLQKLKNI; NSPLQKLKNIL; SPLQKLKNILR;
PLQKLKNILRR; LQKLKNILRRT; QKLKNILRRTA; KLKNILRRTAF;
LKNILRRTAFF; KNILRRTAFFK; NILRRTAFFKK; ILRRTAFFKKT;
LRRTAFFKKTH; RRTAFFKKTHH; RTAFFKKTHHG; TAFFKKTHHGF;
AFFKKTHHGFR; FFKKTHHGFRE; FKKTHHGFRET; KKTHHGFRETY;
KTHHGFRETYD; THHGFRETYDQ; HHGFRETYDQF; HGFRETYDQFK;
GFRETYDQFKM; FRETYDQFKMK; RETYDQFKMKD; ETYDQFKMKDS; TYDQFKMKDSA;
YDQFKMKDSAF; DQFKMKDSAFT; QFKMKDSAFTL

| | |
|---|---|
| | KSKRKDPQSLG; SKRKDPQSLGQ; KRKDPQSLGQY; RKDPQSLGQYT; RDPQSLGQYTK; DPQSLGQYTKN; PQSLGQYTKNK; QSLGQYTKNKY; SLGQYTKNKYL; LGQYTKNKYLD; GQYTKNKYLDK; QYTKNKYLDKM; YTKNKYLDKMQ; TKNKYLDKMQD; KNKYLDKMQDA; NKYLDKMQDAR; KYLDKMQDARQ; YLDKMQDARQS; LDKMQDARQSA; DKMQDARQSAL; KMQDARQSALD; MQDARQSALDL; QDARQSALDLY; DARQSALDLYL; ARQSALDLYLN; RQSALDLYLNT; QSALDLYLNTT; SALDLYLNTTE; ALDLYLNTTEL; LDLYLNTTELR; |
| Seq 36 | SEQ ID NO 43881-44898/<br>8 mers:<br>MKKAKLKL; KKAKLKLL; KAKLKLLR; AKLKLLRL; KLKLLRLN; LKLLRLNL; KLLRLNLL; LLRLNLLL; LRLNLLLM; RLNLLLMI; LNLLLMIL; NLLLMILT; LLLMILTL; LLMILTLC; LMILTLCL; MILTLCLS; ILTLCLSC; LTLCLSCA; TLCLSCAP; LCLSCAPF; CLSCAPFN; LSCAPFNK; SCAPFNKL; CAPFNKLP; APFNKLPP; PFNKLPPK; FNKLPPKA; NKLPPKAN; KLPPKANE; LPPKANEN; PPKANENT; PKANENTL; KANENTLK; ANENTLKK; NENTLKKE; ENTLKKEN; NTLKKENT; TLKKENTR; LKKENTRL; KKENTRLK; KENTRLKK; ENTRLKKP; NTRLKKPA; TRLKKPAN; RLKKPANP; LKKPANPG; KKPANPGK; KPANPGKN; PANPGKNQ; ANPGKNQK; NPGKNQKP; PGKNQKPQ; GKNQKPKD; KNQKPKDS; NQKPKDSG; QKPKDSGD; KPKDSGDL; PKDSGDLG; KDSGDLGA; DSGDLGAS; SGDLGASD; GDLGASDE; DLGASDEK; LGASDEKF; GASDEKFM; ASDEKFMG; SDEKFMGT; DEKFMGTT; EKFMGTTA; KFMGTTAS; FMGTTASE; MGTTASEL; GTTASELK; TTASELKA; TASELKAI; ASELKAIG; SELKAIGK; ELKAIGKF; LKAIGKFL; KAIGKFLP; AIGKFLPD; IGKFLPDR; GKFLPDRK; KFLPDRKN; FLPDRKNQ; LPDRKNQY; PDRKNQYD; DRKNQYDI; RKNQYDIQ; KNQYDIQI; NQYDIQIA; QYDIQIAK; YDIQIAKI; DIQIAKIT; IQIAKITN; QIAKITNE; IAKITNEF; AKITNEFS; KITNEFSN; ITNEFSNL; TNEFSNLD; NEFSNLDT; EFSNLDTY; FSNLDTYT; SNLDTYTR; NLDTYTRA; LDTYTRAY; DTYTRAYE; TYTRAYEL; YTRAYELA; TRAYELAN; RAYELANF; AYELANFN; YELANFNE; ELANFNEK; LANFNEKM; ANFNEKML; NFNEKMLK; FNEKMLKR; NEKMLKRF; EKMLKRFL; KMLKRFLL; MLKRFLLS; LKRFLLSS; KRFLLSSL; RFLLSSLD; FLLSSLDY; LLSSLDYK; LSSLDYKK; SSLDYKKE; SLDYKKEN; LDYKKENT; DYKKENTE; YKKENTET; KKENTETL; KENTETLK; ENTETLKR; NTETLKRT; TETLKRTL; ETLKRTLE; TLKRTLEK; LKRTLEKL; KRTLEKLI; RTLEKLIN; TLEKLINK; LEKLINKY; EKLINKYE; KLINKYEN; LINKYEND; INKYENDP; NKYENDPK; KYENDPKT; YENDPKTA; ENDPKTAA; NDPKTAAN; DPKTAANF; PKTAANFL; KTAANFLY; TAANFLYR; AANFLYRI; ANFLYRIA; NFLYRIAL; FLYRIALD; LYRIALDI; YRIALDIQ; RIALDIQK; IALDIQKL; ALDIQKLE; LDIQKLEK; DIQKLEKF; IQKLEKFE; QKLEKFEL; KLEKFELS; LEKFELSI; EKFELSIN; KFELSINE; FELSINEK; ELSINEKL; LSINEKLD; SINEKLDT; INEKLDTL; NEKLDTLS; EKLDTLSK; KLDTLSKE; LDTLSKEN; DTLSKENS; TLSKENSK; LSKENSKE; SKENSKED; KENSKEDL; ENSKEDLE; NSKEDLEA; SKEDLEAL; KEDLEALL; |

Fig. 31 continued

The image is too low-resolution to reliably transcribe the peptide sequences without fabrication.

| | |
|---|---|
| | ELKAICKELED; LKAICKELEDR; KAICKELEDRK; AICKELEDRKK; ICKELEDRKKQ; CKELEDRKNQV; KELEDRKNQYD; ELEDRKNQYDT; LEDRKNQYDTQ; EDRKNQYDTQT; DRKNQYDTQTA; RKNQYDTQTAK; KNQYDTQTAKI; NQYDTQTAKIT; QYDTQTAKITN; YDTQTAKITNE; DTQTAKITNEE; TQTAKITNEES; QTAKITNEESK; TAKITNEESKL; AKITNEESKLD; KITNEESKLDT; ITNEESKLDTY; TNEESKLDTYT; NEESKLDTYTR; EESKLDTYTRA; ESKLDTYTRAY; SKLDTYTRAYE; KLDTYTRAYEL; LDTYTRAYELA; DTYTRAYELAK; TYTRAYELAKE; YTRAYELAKEN; TRAYELAKENE; RAYELAKENEK; AYELAKENEKM; YELAKENEKML; ELAKENEKMLL; LAKENEKMLLK; AKENEKMLLKR; KENEKMLLKRF; ENEKMLLKRFL; NEKMLLKRFLL; EKMLLKRFLLS; KMLLKRFLLSS; MLLKRFLLSSL; LLKRFLLSSLD; LKRFLLSSLDY; KRFLLS

ICISCAVN; CISCAVNK; ISCAVNKI; SCAVNKID; CAVNKIDP;
AVNKIDPP; VNKIDPPP; NKIDPPPK; KIDPPPKS; IDPPPKSK;
DPPPKSKT; PPPKSKTN; PPKSKTNK; PKSKTNKK; KSKTNKKE;
SKTNKKEN; KTNKKENI; TNKKENIK; NKKENIKN; KKENIKNF;
KENIKNFV; ENIKNFVK; NIKNFVNK; IKNFVNKF; KNFVNKFQ;
NFVNKFQD; FVNKFQDI; VNKFQDIF; NKFQDIFP; KFQDIFPS;
FQDIFPSK; QDIFPSKK; DIFPSKKQ; IFPSKKQN; FPSKKQNK;
PSKKQNKD; SKKQNKDL; KKQNKDLE; KQNKDLEP; QNKDLEPL;
NKDLEPLR; KDLEPLRE; DLEPLRFK; LEPLREKY; EPLREKYP;
PLREKYPE; LREKYPEA; REKYPEAT; EKYPEATA; KYPEATAS;
YPEATASK; PEATASKL; EATASKLE; ATASKLET; TASKLETT;
ASKLETTL; SKLETTLK; KLETTLKI; LETTLKIL; ETTLKILE;
TTLKILEA; TLKILEAQ; LKILEAQK; KILEAQKE; ILEAQKEK;
LEAQKEKE; EAQKEKEN; AQKEKENI; QKEKENIE; KEKENIEI;
EKENIEIA; KENIEIAK; ENIEIAKI; NIEIAKID; IEIAKIDN;
EIAKI

LFTMVKEQ; FTMVKEQQ; TMVKEQQK; MVKEQQKN; VKEQQNKN;
KEQQNKK; EQQNKKF; QQNKKFM; QNKKFMR; NKKFMRT;
KKFMRTV; NKFMRTVR; KFMRTVRW; FMRTVRWL; MRTVRWLY;
RTVRWLYS; TVRWLYSC; VRWLYSCT; RWLYSCTE; WLYSCTEE;
LYSCTEEL; YSCTEELY; SCTEELYS; CTEELYSP; TEELYSPD;
EELYSPDT; ELYSPDTK; LYSPDTKY; YSPDTKYS; SPDTKYSG;
PDTKYSGE; D

RKPVPILPT;

10 mers:
MRILVGVCLL; RILVGVCLLA; ILVGVCLLAL; LVGVCLLALA;
VGVCLLALAL; GVCLLALALG; VCLLALALGG; CLLALALGGY;
LLALALGGYL; LALALGGYLP; ALALGGYLP; LALGGYLPD;
ALGGYLPDK; LGGYLPDNQ; LGCYLPDNQE; GCYLPDNQEQ;
CYLPDNQEQA; YLPDNQEQAV; LPDNQEQAVQ; PDNQEQAVQT;
DNQEQAVQTF; NQEQAVQTFF; QEQAVQTFFE; EQAVQTFFFN;
QAVQTFFNS; AVQTFFNSF; VQTFFNSFS; QTFFNSFSS;
TFFNSFSSD; FFNSFSSDM; FNSFSSDMG; NSFSSDMGS;
SFSSDMGSE; SSSDMGSDE; SSDMGSDEL; SDMGSDELV;
SDMGSDEIVT; DMGSDEIVTF; MGSDEIVTFG; GSDEIVTFGI;
SDEIVTFGIF; DEIVTFGIFS; EIVTFGIFSS; IVTFGIFSSL;
VTFGIFSSLK; TFGIFSSLKY; FGIFSSLKYA; GIFSSLKYAS;
IFSSLKYAS; FSSLKYASE; SSLKYASEH; SLKYASEHR;
LKYASEHRI; KLYASEHRIL; LYASEHRLV; YASEHRIVF;
ASEHRILVF; SEHRILVFK; EHRILVFTKK; HRILVFTKKT;
RILVFTKKTL; LVFTKKTLL; VFTKKTLLS; FTKKTLLSL;
FKKTLISLK; KKTLISLKD; KKTLISLKDP; KTLISLKDPN;
TLISLKDPNY; LISLKDPNYR; ISLKDPNYRG; SLKDPNYRGV;
LKDPNYRGVV; KDPNYRGVVL; DPNYRGVVLP; PNYRGVVLPV;
NYRGVVLPVS; YRGVVLPVSD; RGVVLPVSDY; GVVLPVSDYN;
VVLPVSDYNE; VLPVSDYNEE; LPVSDYNEEY; PVSDYNEEYR;
VSDYNEEYFK; SDYNEEYFNK; DYNEEYFKKF; YNEEYFNKFF;
NEEYFNKFFL; EEYFNKFFLD; EYFKKFFLDL; YFKFFLDLG;
FKFFLDLGS; KFFLDLGSE; FFLDLGSEQ; FFLDLGSEQS;
FLDLGSEQSK; LDLGSEQSKD; DLGSEQSKDL; LGSEQSKDLT;
GSEQSKDLTK; SEQSKDLTKL; EQSKDLTKLF; QSKDLTKLFI;
SKDLIKLFIM; KDLIKLFIMV; DLIKLFIMVK; LIKLFIMVKN;
IKLFIMVKNE; KLFIMVKNEQ; LFIMVKNEQH; FIMVKNEQHN;
IMVKNEQNNK; MVKNEQHNK; VKNEQHNKF; KNEQHNKFM;
NEQHNKFMR; EQNNKFMRT; QNNKFMRTV; NNKFMRTVR;
NKFMRLVRW; KFMRLVRWL; FMRLVRWLY; MRIVRWLYS;
MRTVRWLYSC; RTVRWLYSCT; TVRWLYSCTF; VRWLYSCTFE;
RWLYSCTFF; WLYSCTFEL; LYSCTFELYS; YSCTFELYSP;
SCTFELYSPD; CTFELYSPDT; TFELYSPDTK; FELYSPDTKY;
ELYSPDTKYS; LYSPDTKYSG; YSPDTKYSGE; SPDTKYSGEE;
PDTKYSGEEG; DTKYSGEEGS; TKYSGEEGSP; KYSGEEGSPE;
YSGEEGSPEY; SGEEGSPEYY; GEEGSPEYYR; EEGSPEYYRN;
EGSPEYYRNM; GSPEYYRNMP; SPEYYRNMPR; PEYYRNMPRP;
EYYRNMPRPT; YYRNMPRPTA; YRNMPRPTAY; RNMPRPTAYQ;
NMPRPTAYQQ; MPRPTAYQQY; PRPTAYQQYL; RPTAYQQYLK;
PTAYQQYLKV; TAYQQYLKVR; AYQQYLKVRR; YQQYLKVRRY;
QQYLKVRRYD; QYLKVRRYDY; YLKVRRYDYN; LKVRRYDYNR;
KVRRYDYNRP; VRRYDYNRPV; RRYDYNRPVP; RYDYNRPVPI;
YDYNRPVPIL; DYNRPVPILP; YNRPVPILPT;

11 mers:
MRILVGVCLLA; RILVGVCLLAL; ILVGVCLLALA; LVGVCLLALAL;
VGVCLLALALG; GVCLLALALGG; VCLLALALGGY; CLLALALGGYL;

Fig. 31 continued

DSLMEDVL; SLMEDVLA; LMEDVLAL; MEDVLALV; EDVLALVN;
DVLALVKD; VLALVNDS; LALVNDSG; ALVNDSGG; LVNDSSGG;
VNDSSGGK; NDSSGGKF; DSSGGKFK; SSGGKFKD; SGGKFKDY;
GGKFKDYK; GKFKDYKD; KFKDYKDK; FKDYKDKI; KDYKDKIN;
DYKDKIKE; YKDKINEL; KDKINELK; DKINELKE; KINELKEN;
INELKENL; NELKENLK; ELKENLKD; LKENLKDT; KENLKDTG;
ENLKDTGN; NLKDTGNA; LKDTGNAE; KDTGNAEL; DTGNAELK;
TGNAELKE; GNAELKEK; NAELKEKL; AELKEKLL; ELKEKLLN;
LKEKLLKL; KEKLLNLQ; ELLNLQN; KLLNLQNS; LLNLQNSF;
LNLQNSFQ; NLQNSFQD; LQNSFQDK; QNSFQDKL; NSFQDKLA;
SFQDKLAA; FQDKLAAK; QDKLAAKL; DKLAAKLA; KLAAKLAA;
LAAKLAAL; AAKLAALK; AKLAALKA; KLAALKAA; LAALKAAK;
AALKAAKN; ALKAAKNT; LKAAKNTI; KAAKNTIE; AAKNTIEN;
AKNTIENT; KNTIENTT; NTIENTTD; TIENTTDK; IENTTDKD;
ENTTDKDQ; NTTDKDQD; TTDKDQDI; TDKDQDIS; DKDQDISK;
KDQDISKR; DQDISKRK; QDISKRKL; DISKRKLW; ISKRKLWS;
SKRKLWSF; KRKLWSFA; RRKLWSEAK; KLWSEAKL; LWSEAKLV;
WSFAKLVG; SFAKLVGV; FAKLVGVT; AKLVGVTV; KLVGVTVP;
LVGVTVPL; VGVTVPLL; GVTVPLLG; VTVPLLGS; TVPLLGSN;
VPLLGSNT; PLLGSNTS; LLGSNTSG; LGSNTSGN; GSNTSGNG;
SNTSGNGD; NTSGNGDK; TSGNGDKM; SGNGDKMS; GNGDKMSK;
NGDKMSKN; GDKMSKNA; DKMSKNAV; KMSKNAVE; MSKNAVEQ;
SKNAVEQL; KNAVEQLD; NAVEQLDK; AVEQLDKV; VEQLDKVL;
EQLDKVLK; QLDKVLKF; LDKVLKFL; DKVLKFLE; KVLKFLEE;
VLKFLEEG; LKFLEEGT; KFLEEGTK;

9 mers:
MRNKNTFKL; RNKKTFKLF; NKKTFKLFF; KKTFKLFFA; KTFKLFFAS;
TFKLFFASM; FKLFFASMI; KLFFASMIF; LFFASMIFV; FFASMIFVM;
FASMIFVMA; ASMIFVMAC; SMIFVMACK; MIFVMACKA; IFVMACKAY;
FVMACKAYV; VMACKAYVE; MACKAYVEE; ACKAYVEEK; CKAYVEEKK;
KAYVEEKK; AYVEEKKT; YVEEKKTD; VEEKKTDS; EEKKTDSL;
EKKTDSLM; KKTDSLME; KTDSLMED; TDSLMEDV; DSLMEDVL;
DSLMEDVLA; SLMEDVLAL; LMEDVLALV; MEDVLALVN; EDVLALVKD;
DVLALVNDS; VLALVNDSG; LALVNDSGG; ALVNDSGGK; LVNDSSGGK;
VNDSSGGKF; NDSSGGKFK; DSSGGKFKD; SSGGKFKDY; SGGKFKDYK;
GGKFKDYKD; GKFKDYKDK; KFKDYKDKI; FKDYKDKIN; KDYKDKINE;
DYKDKINEL; YKDKINELK; KDKINELKE; DKINELKEN; KINELKENL;
INELKENLK; NELKENLKD; ELKENLKDT; LKENLKDTG; KENLKDTGN;
ENLKDTGNA; NLKDTGNAE; LKDTGNAEL; KDTGNAELK; DTGNAELKE;
TGNAELKEK; GNAELKEKL; NAELKEKLL; AELKEKLLN; ELKEKLLNL;
LKEKLLNLQ; KEKLLNLQN; EKLLNLQNS; KLLNLQNSF; LLNLQNSFQ;
LNLQNSFQD; NLQNSFQDK; LQNSFQDKL; QNSFQDKLA; NSFQDKLAA;
SFQDKLAAK; FQDKLAAKL; QDKLAAKLA; DKLAAKLAA; KLAAKLAAL;
LAAKLAALK; AAKLAALKA; AKLAALKAA; KLAALKAAK; LAALKAAKN;
AALKAAKNT; ALKAAKNTI; LKAAKNTIE; KAAKNTIEN; AAKNTIENT;
AKNTIENTT; KNTIENTTD; NTIENTTDK; TIENTTDKD; IENTTDKDQ;
ENTTDKDQD; NTTDKDQDI; TTDKDQDIS; TDKDQDISK; DKDQDISKR;
KDQDISKRK; DQDISKRKL; QDISKRKLW; DISKRKLWS; ISKRKLWSF;
SKRKLWSFA; KRKLWSFAK; RKLWSFAKL; KLWSFAKLV; LWSFAKLVG;
WSFAKLVGV; SFAKLVGVT; FAKLVGVTV; AKLVGVTVP; KLVGVTVPL;

Fig. 31 continued

LVGVTVPLL; VGVTVPLLG; GVTVPLLGS; VTVPLLGSK; TVPLLGSKT;
VPLLGSKTS; PLLGSNTSG; LLGSNTSGN; LGSNTSGNG; GSNTSGNGD;
SNTSGNGDK; KTSGNGDKM; TSGNGDKMS; SGNGDKMSK; GNGDKMSKN;
NGDKMSKNA; GDKMSKNAV; DKMSKNAVE; KMSKNAVEQ; MSKNAVEQI;
SKNAVEQID; KNAVEQIDK; NAVEQIDKV; AVEQIDKVI; VEQIDKVIK;
EQIDKVIKF; QIDKVIKFL; IDKVIKFLE; DKVIKFLEE; KVIKFLEEG;
VIKFLEEGT; IKFLEEGTN;

10 mers:
MRNKNIFKLF; RNKNIFKLFF; NKNIFKLFFA; KNIFKLFFAS;
NIFKLFFASM; IFKLFFASML; FKLFFASMLF; KLFFASMLFV;
LFFASMLFVM; FFASMLFVMA; FASMLFVMAC; ASMLFVMACK;
SMLFVMACKA; MLFVMACKAY; LFVMACKAYV; FVMACKAYVE;
VMACKAYVEK; MACKAYVEKK; ACKAYVEKKE; CKAYVEKKEI;
KAYVEKKEID; AYVEKKEIDS; YVEKKEIDSL; VEKKEIDSLM;
EKKEIDSLME; KKEIDSLMED; KEIDSLMEDV; EIDSLMEDVL;
IDSLMEDVLA; DSLMEDVLAL; SLMEDVLALV; LMEDVLALVN;
MEDVLALVND; EDVLALVNDS; DVLALVNDSS;
VLALVNDSSG; LALVNDSSGG; ALVNDSSGGK; LVNDSSGGKF;
VNDSSGGKFK; NDSSGGKFKD; DSSGGKFKDY; SSGGKFKDYK;
SGGKFKDYKD; GGKFKDYKDK; GKFKDYKDKI; KFKDYKDKIE;
FKDYKDKIEL; KDYKDKIELL; DYKDKIELLK; YKDKIELLKE;
KDKIELLKEK; DKIELLKENL; KIELLKENLK; IELLKENLKD;
ELLKENLKDI; LLKENLKDIG; LKENLKDIGK; KENLKDIGKA;
ENLKDIGNAE; NLKDIGNAEL; LKDIGNAELK; KDIGNAELKE;
DIGNAELKEK; IGNAELKEKL; GNAELKEKLL; NAELKEKLLN;
AELKEKLLNL; ELKEKLLNLQ; LKEKLLNLQN; KEKLLNLQNS;
EKLLNLQNSF; KLLNLQNSFQ; LLNLQNSFQD; LNLQNSFQDK;
NLQNSFQDKL; LQNSFQDKLA; QNSFQDKLAA; NSFQDKLAAK;
SFQDKLAAKL; FQDKLAAKLA; QDKLAAKLAA; DKLAAKLAAL;
KLAAKLAALK; LAAKLAALKA; AAKLAALKAA; AKLAALKAAK;
KLAALKAAKN; LAALKAAKNI; AALKAAKNIE; ALKAAKNIEK;
LKAAKNIEKI; KAAKNIEKIT; AAKNIEKITK; AKNIEKITKD;
KNIEKITKDQ; NIEKITKDQD; IEKITKDQDI; EKITKDQDIS;
KITKDQDISK; ITKDQDISKR; TKDQDISKRK; KDQDISKRKI;
DQDISKRKIN; QDISKRKINS; DISKRKINSE;
ISKRKINSEA; SKRKINSEAK; KRKINSEAKL;
RKINSEAKLV; KINSEAKLVG; INSEAKLVGV; NSEAKLVGVT;
SEAKLVGVTV; EAKLVGVTVP; AKLVGVTVPL; KLVGVTVPLL;
LVGVTVPLLG; VGVTVPLLGS; GVTVPLLGSK; VTVPLLGSKT;
TVPLLGSNTS; VPLLGSNTSG; PLLGSNTSGN; LLGSNTSGNG;
LGSNTSGNGD; GSNTSGNGDK; SNTSGNGDKM; NTSGNGDKMS;
TSGNGDKMSK; SGNGDKMSKN; GNGDKMSKNA; NGDKMSKNAV;
GDKMSKNAVE; DKMSKNAVEQ; KMSKNAVEQI; MSKNAVEQID;
SKNAVEQIDK; KNAVEQIDKV; NAVEQIDKVI; AVEQIDKVIK;
VEQIDKVIKF; EQIDKVIKFL; QIDKVIKFLE; IDKVIKFLEE;
DKVIKFLEEG; KVIKFLEEGT; VIKFLEEGTN;

11 mers:
MRNKNIFKLFF; RNKNIFKLFFA; NKNIFKLFFAS; KNIFKLFFASM;
NIFKLFFASML; IFKLFFASMLF; FKLFFASMLFV; KLFFASMLFVM;

Fig. 31 continued

|         | |
|---------|---|
|         | LFTASMLFVMA; FASMLFVMAC; FASMLFVMACK; ASMLFVMACKA; SMLFVMACKAY; MLFVMACKAYV; LFVMACKAYVE; FVMACKAYVEE; VMACKAYVEEK; MACKAYVEEKK; ACKAYVEEKKE; CKAYVEEKKEI; KAYVEEKKEID; AYVEEKKEIDS; YVEEKKEIDSL; VEEKKEIDSLM; EEKKEIDSLME; EKKEIDSLMED; KKEIDSLMEDV; KEIDSLMEDVL; EIDSLMEDVLA; IDSLMEDVLAI; DSLMEDVLAIV; SLMEDVLAIVK; LMEDVLAIVKD; MEDVLAIVKDS; EDVLAIVKDSS; DVLAIVKDSSG; VLAIVKDSSGG; LAIVKDSSGGK; AIVKDSSGGKF; IVKDSSGGKFK; VKDSSGGKFKD; KDSSGGKFKDY; DSSGGKFKDYK; SSGGKFKDYKD; SGGKFKDYKDK; GGKFKDYKDKT; GKFKDYKDKTN; KFKDYKDKTNF; FKDYKDKTNFL; KDYKDKTNFLK; DYKDKTNFLKE; YKDKTNFLKEL; KDKTNFLKELK; DKTNFLKELKE; KTNFLKELKED; TNFLKELKEDL; NFLKELKEDLK; FLKELKEDLKD; LKELKEDLKDT; KELKEDLKDTG; ELKEDLKDTGN; LKEDLKDTGNA; KEDLKDTGNAE; EDLKDTGNAEL; DLKDTGNAELK; LKDTGNAELKE; KDTGNAELKEK; DTGNAELKEKL; TGNAELKEKLL; GNAELKEKLLN; NAELKEKLLNL; AELK

KPTKPAA; NPTKPAAG; PTKPAAGK; TKPAAGKN; KPAAGKNK;
PAAGKNKA; AAGKNKAK; AGKNKAKS; GKNKAKSK; KNKAKSKA;
KKAKSKAS; KAKSKASK; AKSKASKQ; KSKASKQK; SKASKQKN;
KASKQKN; ASKQKNP; SKQKKPN; KQKKPKA; QKKKPKAN;
KKKPKAKA; KKPKAKAK; KPKAKAKK; PKAKAKKA; KAKAKKAP;
AKAKKAPK; KAKKAPKK; AKKAPKKI; KKAPKKIL; KAPKKILD;
APKKILDP; PKKILDPE; KKILDPEV; KILDPEVA; ILDPEVAK;
LDPEVAKL; DPEVAKLL; PEVAKLLQ; EVAKLLQK; VAKLLQKI;
AKLLQKIL; KLLQKILD; LLQKILDR; LQKILDRG; QKILDRGF;
KILDRGFN; ILDRGFNT; LDRGFNTL; DRGFNTLQ; RGFNTLQT;
GFNTLQTS; FNTLQTSF; NTLQTSFM; TLQTSFMD; LQTSFMDS;
QTSFMDSS; TSFMDSSR; SFMDSSRG; FMDSSRGF; MDSSRGFP;
DSSRGFPN; SSRGFPND; SRGFPNDQ; RGFPNDQF; GFPNDQFG;
FPNDQFGM; PNDQFGMR; NDQFGMRA; DQFGMRAF; QFGMRAFL;
FGMRAFLS; GMRAFLSS; MRAFLSSK; RAFLSSKL; AFLSSKLF;
FLSSKLFF; LSSKLFFK; SSKLFFKA; SKLFFKAN; KLFFKAKS;
LFFKAKST; FFKAKSTV; FKAKSTVF; KAKSTVFD; AKSTVFDS;
KSTVFDSH; STVFDSHF; TVFDSHFY; VFDSHFYT; FDSHFYTF;
DSHFYTFF; SHFYTFFR; HFYTFFRR; FYTFFRRM; YTFFRRML;
TFFRRMLY; FFRRMLYT; FRRMLYTS; RRMLYTSL; RMLYTSLN;
MLYTSLNF; LYTSLNFK; YTSLNFKF; TSLNFKFG; SLNFKFGK;
LNFKFGKL; NFKFGKLF; FKFGKLFN; KFGKLFNL; FGKLFNLG;
GKLFNLGQ; KLFNLGQI; LFNLGQIL; FNLGQILS; NLGQILSK;
LGQILSKL; GQILSKLS; QILSKLSQ; ILSKLSQD; LSKLSQDS;
SKLSQDSN; KLSQDSNY; LSQDSNYR; SQDSNYRG; QDSNYRGL;
DSNYRGLV; SNYRGLVK; NYRGLVKF; YRGLVKFT; RGLVKFTL;
GLVKFTLL; LVKFTLLN; VKFTLLNR; KFTLLNRG; FTLLNRGF;
TLLNRGFS; LLNRGFST; LNRGFSTQ; NRGFSTQL; RGFSTQLA;
GFSTQLAM; FSTQLAME; STQLAMFE; TQLAMFET; QLAMFETS;
LAMFETSA; AMFETSAK; MFETSAKL; FETSAKLL; ETSAKLLV;
TSAKLLVK; SAKLLVKF; AKLLVKFD; KLLVKFDK; LLVKFDKL;
LVKFDKLQ; VKFDKLQQ; KFDKLQQL; FDKLQQLK; DKLQQLKP;
KLQQLKPN; LQQLKPNL; QQLKPNLF; QLKPNLFF; LKPNLFFL;
KPNLFFLY; PNLFFLYN; NLFFLYND; LFFLYNDF; FFLYNDFF;
FLYNDFFK; LYNDFFKL; YNDFFKLT; NDFFKLTS; DFFKLTSL;
FFKLTSLK; FKLTSLKF; KLTSLKFW; LTSLKFWL; TSLKFWLK;
SLKFWLKD; LKFWLKDT; KFWLKDTD; FWLKDTDL; WLKDTDLL;
LKDTDLLI; KDTDLLID; DTDLLIDF; TDLLIDFY; DLLIDFYK;
LLIDFYKP; LIDFYKPD; IDFYKPDY; DFYKPDYN; FYKPDYNT;
YKPDYNTP; KPDYNTPD; PDYNTPDL; DYNTPDLQ; YNTPDLQT;
NTPDLQTD; TPDLQTDV; PDLQTDVS; DLQTDVSK; LQTDVSKL;
QTDVSKLN; TDVSKLND; DVSKLNDT; VSKLNDTL; SKLNDTLR;
KLNDTLRS; LNDTLRSK; NDTLRSKK; DTLRSKKS; TLRSKKSR;
LRSKKSRA; RSKKSRAQ; SKKSRAQF; KKSRAQFA; KSRAQFAN;
SRAQFANI; RAQFANIH; AQFANIHD; QFANIHDI; FANIHDII;
ANIHDIIL; NIHDIILD; IHDIILDL; HDIILDLV; DIILDLVN;
IILDLVNT; ILDLVNTT; LDLVNTTT; DLVNTTTS; LVNTTTST;
VNTTTSTL; NTTTSTLA; TTTSTLAP; TTSTLAPI; TSTLAPIQ;

9 mers:
MKDNIKNN; KDNIKNNK; DNIKNNKI; NIKNNKIT; IKNNKITA;

Fig. 31 continued

SRPDLQTDV; RPDLQTDVS; PDLQTDVSK; DLQTDVSKL; LQTDVSKLN;
QTDVSKLND; TDVSKLNDT; DVSKLNDTL; VSKLNDTLR; SKLNDTLRS;
KLNDTLRSK; LNDTLRSKN; NDTLRSKNS; DTLRSKNSR; TLRSKNSRA;
LRSKNSRAQ; RSKNSRAQF; SKNSRAQFA; KNSRAQFAK; NSRAQFAKL;
SRAQFAKLH; RAQFAKLHD; AQFAKLHDI; QFAKLHDII; FAKLHDIIL;
AKLHDIILD; KLHDIILDL; LHDIILDLV; HDIILDLVK; DIILDLVKT;
IILDLVKTT; ILDLVKTTN; LDLVKTTNI; DLVKTTNIL; LVKTTNILA;
VKTTNILAP; KTTNILAPI; TTNILAPIQ; TNILAPIQ;

10 mers:
MKDNLKNSK; KDNLKNSKL; DNLKNSKLT; NLKNSKLTA;
LKNSKLTAI; KNSKLTAIF; NSKLTAIFL; SKLTAIFLL;
KLTAIFLLH; LTAIFLLHV; TAIFLLHVL; AIFLLHVLT;
IFLLHVLTV; FLLHVLTVL; LLHVLTVLI; LHVLTVLIL;
HVLTVLILS; VLTVLILSC; LTVLILSCS; TVLILSCSL;
VLILSCSLE; LILSCSLEV; ILSCSLEVK; LSCSLEVKD;
SCSLEVKDS; CSLEVKDSK; SLEVKDSKK; LEVKDSKKH;
EVKDSKKHK; VKDSKKHKK; KDSKKHKKE; DSKKHKKEK;
SKKHKKEKR; KKHKKEKRG; KHKKEKRGK; HKKEKRGKV;
KKEKRGKVE; KEKRGKVEN; EKRGKVENL; KRGKVENLL;
RGKVENLLV; GKVENLLVA; KVENLLVAI; VENLLVAIN;
ENLLVAINN; NLLVAINNL; LLVAINNLK; LVAINNLKP;
VAINNLKPT; AINNLKPTK; INNLKPTKP; NNLKPTKPA;
NLKPTKPAA; LKPTKPAAG; KPTKPAAGK; PTKPAAGKN;
TKPAAGKNK; KPAAGKNKA; PAAGKNKAN; AAGKNKANS;
AGKNKANSK; GKNKANSKA; KNKANSKAS; NKANSKASK;
KANSKASKQ; ANSKASKQK; NSKASKQKN; SKASKQKNP;
KASKQKNPN; ASKQKNPNA; SKQKNPNAN; KQKNPNANA;
QKNPNANAP; KNPNANAPK; NPNANAPKK; PNANAPKKT;
NANAPKKTL; ANAPKKTLD; NAPKKTLDP; APKKTLDPE;
PKKTLDPEV; KKTLDPEVA; KTLDPEVAK; TLDPEVAKL;
LDPEVAKLQ; DPEVAKLQK; PEVAKLQKT; EVAKLQKTL;
VAKLQKTLD; AKLQKTLDR; KLQKTLDRS; LQKTLDRSE;
QKTLDRSEN; KTLDRSENT; TLDRSENTQ; LDRSENTQT;
DRSENTQTS; RSENTQTSE; SENTQTSEM; ENTQTSEMD;
NTQTSEMDS; TQTSEMDSS; QTSEMDSSR; TSEMDSSRG;
SEMDSSRGE; EMDSSRGEP; MDSSRGEPK; DSSRGEPKD;
SSRGEPKDQ; SRGEPKDQF; RGEPKDQFG; GEPKDQFGM;
EPKDQFGMR; PKDQFGMRA; KDQFGMRAE; DQFGMRAEF;
QFGMRAEFS; FGMRAEFSK; GMRAEFSKI; MRAEFSKIF;
RAEFSKIFF; AEFSKIFFN; EFSKIFFNA; FSKIFFNAN;
SKIFFNANS; KIFFNANSV; IFFNANSVH; FFNANSVHF;
FNANSVHFD; NANSVHFDS; ANSVHFDSH; NSVHFDSHY;
SVHFDSHYT; VHFDSHYTE; HFDSHYTEE; FDSHYTEER;
DSHYTEERK; SHYTEERKM; HYTEERKML; YTEERKMLY;
TEERKMLYT; EERKMLYTS; ERKMLYTSL; RKMLYTSLE;
KMLYTSLEF; MLYTSLEFN; LYTSLEFNG; YTSLEFNEG;

Fig. 31 continued

TSLNFDGKL; SLNFDGKLF; LNFDGKLFK; NFDGKLFKL;
FDGKLFKLG; DGKLFKLGQ; GKLFKLGQT; KLFKLGQTL;
LFKLGQTLS; FKLGQTLSK; KLGQTLSKL; LGQTLSKLS;
GQTLSKLSQ; QTLSKLSQD; TLSKLSQDS; LSKLSQDSN;
SKLSQDSNY; KLSQDSNYR; LSQDSNYRG; SQDSNYRGL;
QDSNYRGLV; DSNYRGLVK; SNYRGLVKT; NYRGLVKTL;
YRGLVKTLI; RGLVKTLIN; GLVKTLINR; LVKTLINRG;
VKTLINRGF; KTLINRGFS; TLINRGFST; LINRGFSTQ;
INRGFSTQL; NRGFSTQLA; RGFSTQLAM; GFSTQLAME;
FSTQLAMEE; STQLAMEET; TQLAMEETS; QLAMEETSA;
LAMEETSAK; AMEETSAKI; MEETSAKIL; EETSAKILN;
ETSAKILNV; TSAKILNVK; SAKILNVKD; AKILNVKDK;
KILNVKDKL; ILNVKDKLQ; LNVKDKLQQ; NVKDKLQQL;
VKDKLQQLK; KDKLQQLKP; DKLQQLKPN; KLQQLKPNL;
LQQLKPNLE; QQLKPNLET; QLKPNLETL; LKPNLETLY;
KPNLETLYN; PNLETLYND; NLETLYNDF; LETLYNDFE;
ETLYNDFEK; TLYNDFEKL; LYNDFEKLT; YNDFEKLTS;
NDFEKLTSL; DFEKLTSLK; FEKLTSLKE; EKLTSLKEK;
KLTSLKEKW; LTSLKEKWL; TSLKEKWLK; SLKEKWLKD;
LKEKWLKDT; KEKWLKDTD; EKWLKDTDD; KWLKDTDDL;
WLKDTDDLI; LKDTDDLID; KDTDDLIDE; DTDDLIDEY;
TDDLIDEYN; DDLIDEYNT; DLIDEYNTN; LIDEYNTNP;
IDEYNTNPD; DEYNTNPDL; EYNTNPDLQ; YNTNPDLQT;
NTNPDLQTD; TNPDLQTDV; NPDLQTDVS; PDLQTDVSK;
DLQTDVSKL; LQTDVSKLN; QTDVSKLND; TDVSKLNDT;
DVSKLNDTL; VSKLNDTLR; SKLNDTLRS; KLNDTLRSK;
LNDTLRSKN; NDTLRSKNS; DTLRSKNSR; TLRSKNSRA;
LRSKNSRAQ; RSKNSRAQF; SKNSRAQFA; KNSRAQFAN;
NSRAQFANI; SRAQFANIH; RAQFANIHD; AQFANIHDI;
QFANIHDII; FANIHDIIE; ANIHDIIEL; NIHDIIELV;
IHDIIELVN; HDIIELVNT; DIIELVKTT; IIELVKTTP;
IELVKTTPN; ELVKTTPNL; LVKTTPNLA; VKTTPNLAP;
KTTPNLAPI; TTPNLAPIQ;

11 mers:
MKNLKNKLTAT; KNLKNKLTAT; NLKNKLTATF; LKNKLTATFL;
KNKLTATFLL; NKLTATFLLH; KLTATFLLHV; LTATFLLHVT;
TATFLLHVTV; ATFLLHVTVL; TFLLHVTVLL; FLLHVTVLLI;
LLHVTVLLIS; LHVTVLLISC; HVTVLLISCS; VTVLLISCSL;
TVLLISCSLE; VLLISCSLEV; LLISCSLEVK; LISCSLEVKD;
ISCSLEVKDS; SCSLEVKDSN; CSLEVKDSNF; SLEVKDSNFS;
LEVKDSNFSK; EVKDSNFSKK; VKDSNFSKKH; KDSNFSKKHK;
DSNFSKKHKK; SNFSKKHKKK; NFSKKHKKKR; FSKKHKKKRK;
SKKHKKKRKG; KKHKKKRKGK; KHKKKRKGKV; HKKKRKGKVE;
KKKRKGKVEN; KKRKGKVENL; KRKGKVENLL; RKGKVENLLV;
KGKVENLLVA; GKVENLLVAI; KVENLLVAIN; VENLLVAINK;
ENLLVAINKL; NLLVAINKLK; LLVAINKLKN; LVAINKLKNP;
VAINKLKNPT; AINKLKNPTK; INKLKNPTKP; NKLKNPTKPA;
KLKNPTKPAA; LKNPTKPAAG; KNPTKPAAGK;

Fig. 31 continued

KPTKPAACKN; NPTKPAACKKK; PTKPAACKNKA; TKPAACKKKAK;
KPAAGKKKAKS; PAAGKKKANSK; AAGKKKANSKA; AGKNKANSKAS;
GKNKANSKASK; KNKANSKASKQ; NKANSKASKQK; KANSKASKQKN;
ANSKASKQKNP; NSKASKQKNPN; SKASKQKNPNA; KASKQKNPNAN;
ASKQKNPNANA; SKQKNPNANAK; KQKNPNANAKN; QKNPNAKANKN;
KNPNAKANKA; NPNAKANKAP; PNAKANKAPK; NAKANKAPKK;
KANKNAPKKT; AKANKAPKKTL; KANKAPKKTLD; ANKAPKKTLDP;
NKAPKKTLDPE; KAPKKTLDPEV; APKKTLDPEVA; PKKTLDPEVAK;
KKTLDPEVAKL; KTLDPEVAKLT; TLDPEVAKLTQ; LDPEVAKLTQK;
DPEVAKLTQKT; PEVAKLTQKTL; EVAKLTQKTLD; VAKLTQKTLDR;
AKLTQKTLDRS; KLTQKTLDRSF; LTQKTLDRSFN; TQKTLDRSFNT;
QKTLDRSFNTI; KTLDRSFNTIQ; TLDRSFNTIQT; LDRSFNTIQTS;
DRSFNTIQTSF; RSFNTIQTSFM; SFNTIQTSFMD; FNTIQTSFMDS;
NTIQTSFMDSS; TIQTSFMDSSR; IQTSFMDSSRG; QTSFMDSSRGF;
TSFMDSSRGFP; SFMDSSRGFPN; FMDSSRGFPND; MDSSRGFPNDQ;
DSSRGFPNDQF; SSRGFPNDQFG; SRGFPNDQFGM; RGFPNDQFGMR;
GFPNDQFGMRA; FPNDQFGMRAF; PNDQFGMRAFT; NDQFGMRAFTF;
DQFGMRAFTFS; QFGMRAFTFSK; FGMRAFTFSKI; GMRAFTFSKIF;
MRAFTFSKIFF; RAFTFSKIFFN; AFTFSKIFFNA; FTFSKIFFNAK;
TFSKIFFNAKS; FSKIFFNAKST; SKIFFNAKSTV; KIFFNAKSTVH;
IFFNAKSTVHF; FFNAKSTVHFD; FNAKSTVHFDS; NAKSTVHFDSH;
AKSTVHFDSHE; NSTVHFDSHEY; STVHFDSHEYE; TVHFDSHEYTE;
VHFDSHEYTEE; HFDSHEYTEER; FDSHEYTEERR; DSHEYTEERRM;
SHEYTEERRML; HEYTEERRMLY; EYTEERRMLYT; YTEERRMLYTS;
TEERRMLYTSL; EERRMLYTSLN; ERRMLYTSLNF; RRMLYTSLNFK;
RMLYTSLNFKE; MLYTSLNFKEG; LYTSLNFKEGK; YTSLNFKEGKL;
TSLNFKEGKLF; SLNFKEGKLFN; LNFKEGKLFNL; NFKEGKLFNLG;
FKEGKLFNLGQ; KEGKLFNLGQT; EGKLFNLGQTL; GKLFNLGQTLS;
KLFNLGQTLSK; LFNLGQTLSKL; FNLGQTLSKLS; NLGQTLSKLSQ;
LGQTLSKLSQD; GQTLSKLSQDS; QTLSKLSQDSN; TLSKLSQDSNY;
LSKLSQDSNYR; SKLSQDSNYRG; KLSQDSNYRGL; LSQDSNYRGLV;
SQDSNYRGLVK; QDSNYRGLVKE; DSNYRGLVKET; SNYRGLVKETI;
NYRGLVKETIL; YRGLVKETILN; RGLVKETILNR; GLVKETILNRG;
LVKETILNRGF; VKETILNRGFS; KETILNRGFST; ETILNRGFSTQ;
TILNRGFSTQL; ILNRGFSTQLA; LNRGFSTQLAM; NRGFSTQLAME;
RGFSTQLAMEE; GFSTQLAMEET; FSTQLAMEETS; STQLAMEETSA;
TQLAMEETSAK; QLAMEETSAKT; LAMEETSAKTL; AMEETSAKTLN;
MEETSAKTLNV; EETSAKTLNVK; ETSAKTLNVKD; TSAKTLNVKDK;
SAKTLNVKDKL; AKTLNVKDKLQ; KTLNVKDKLQQ; TLNVKDKLQQL;
LNVKDKLQQLN; NVKDKLQQLNK; VKDKLQQLNKP; KDKLQQLNKPN;
DKLQQLNKPNL; KLQQLNKPNLE; LQQLNKPNLET; QQLNKPNLETL;
QLNKPNLETLY; LNKPNLETLYN; NKPNLETLYND; KPNLETLYNDF;
PNLETLYNDFF; NLETLYNDFFK; LETLYNDFFKL; ETLYNDFFKLT;
TLYNDFFKLTS; LYNDFFKLTSL; YNDFFKLTSLK; NDFFKLTSLKE;
DFFKLTSLKEK; FFKLTSLKEKW; FKLTSLKEKWL; KLTSLKEKWLK;
LTSLKEKWLKD; TSLKEKWLKDT; SLKEKWLKDTD; LKEKWLKDTDD;
KEKWLKDTDDL; EKWLKDTDDLT; KWLKDTDDLTD; WLKDTDDLTDF;
LKDTDDLTDFY; KDTDDLTDFYN; DTDDLTDFYNT; TDDLTDFYNTP;
DDLTDFYNTPD; DLTDFYKPNPD; LTDFYKTPDL; TDFYKTPDLQ;
DFYNTPDLQT; FYNTPDLQTD; YNTPDLQTDV; NTPDLQTDVS;
TPDLQTDVSK; PDLQTDVSKL; DLQTDVSKLK; LQTDVSKLND;

Fig. 31 continued

| | |
|---|---|
| | LQTDVSKLNDT; QTDVSKLNDTL; TDVSKLNDTLR; DVSKLNDTLRS; VSKLNDTLRSK; SKLNDTLRSKN; KLNDTLRSKNS; LNDTLRSKNSR; NDTLRSKNSRA; DTLRSKNSRAQ; TLRSKNSRAQF; LRSKNSRAQFA; RSKNSRAQFAN; SKNSRAQFANL; KNSRAQFANLH; NSRAQFANLHD; SRAQFANLHDI; RAQFANLHDII; AQFANLHDIIL; QFANLHDIILD; FANLHDIILDL; ANLHDIILDLV; NLHDIILDLVN; LHDIILDLVNT; HDIILDLVNTT; DIILDLVNTTI; IILDLVNTTIL; ILDLVNTTILA; LDLVNTTILAL; DLVNTTILALA; LVNTTILALAP; VNTTILALAPT; NTTILALAPTQ; |
| Seq 41 | SEQ ID NO 48407-49644? 8 mers: MKNNKITA; KNNKITAT; NNKITATF; NKITATFL; KITATFLL; ITATFLLS; TATFLLST; ATFLLSTI; TFLLSTIT; FLLSTITS; LLSTITSL; LSTITSLL; STITSLLI; TITSLLLS; ITSLLLSC; TSLLLSCL; SLLLSCLL; LLLSCLLS; LLSCLLSV; LSCLLSVN; SCLLSVNQ; CLLSVNQD; LLSVNQDD; LSVNQDDN; SVNQDDNQ; VNQDDNQF; NQDDNQFK; QDDNQFKQ; DDNQFKQK; DNQFKQKK; NQFKQKKA; QFKQKKAK; FKQKKAKI; KQKKAKIK; QKKAKIKT; KKAKIKTS; KAKIKTSK; AKIKTSKS; KIKTSKSE; IKTSKSEN; KTSKSENK; TSKSENKS; SKSENKSS; KSENKSSK; SENKSSKN; ENKSSKNK; NKSSKNKK; KSSKNKKL; SSKNKKLS; SKNKKLSK; KNKKLSKK; NKKLSKNA; KKLSKNAK; KLSKNAKN; LSKNAKNK; SKNAKNKK; KNAKNKKP; NAKNKKPT; AKNKKPTV; KNKKPTVD; NKKPTVDN; KKPTVDNL; KPTVDNLL; PTVDNLLV; TVDNLLVA; VDNLLVAI; DNLLVAIN; NLLVAINT; LLVAINTL; LVAINTLK; VAINTLKN; AINTLKNP; INTLKNPP; NTLKNPPK; TLKNPPKT; LKNPPKTA; KNPPKTAG; NPPKTAGK; PPKTAGKN; PKTAGKNK; KTAGKNKS; TAGKNKSN; AGKNKSNS; GKNKSNSA; KNKSNSAA; NKSNSAAA; KSNSAAAL; SNSAAALK; NSAAALKQ; SAAALKQP; AAALKQPK; AALKQPKN; ALKQPKNA; LKQPKNAN; KQPKNANA; QPKNANAL; PKNANALK; KNANALKQ; NANALKQT; ANALKQTD; NALKQTDP; ALKQTDPF; LKQTDPFA; KQTDPFAK; QTDPFAKE; TDPFAKEL; DPFAKELI; PFAKELIQ; FAKELIQK; AKELIQKF; KELIQKFI; ELIQKFIF; LIQKFIFR; IQKFIFRS; QKFIFRSF; KFIFRSFD; FIFRSFDT; IFRSFDTV; FRSFDTVQ; RSFDTVQT; SFDTVQTS; FDTVQTSI; DTVQTSID; TVQTSIDA; VQTSIDAK; QTSIDAKG; TSIDAKGF; SIDAKGFD; IDAKGFDD; DAKGFDDQ; AKGFDDQF; KGFDDQFE; GFDDQFEM; FDDQFEMK; DDQFEMKA; DQFEMKAE; QFEMKAEI; FEMKAEIF; EMKAEIFS; MKAEIFSK; KAEIFSKI; AEIFSKIF; EIFSKIFN; IFSKIFNA; FSKIFNAC; SKIFNACS; KIFNACST; IFNACSTV; FNACSTVT; NACSTVTF; ACSTVTFD; CSTVTFDD; STVTFDDN; TVTFDDNF; VTFDDNFY; TFDDNFYV; FDDNFYVK; DDNFYVKR; DNFYVKRR; NFYVKRRI; FYVKRRIL; YVKRRILY; VKRRILYT; KRRILYTS; RRILYTSL; RILYTSLF; ILYTSLFN; LYTSLFNF; YTSLFNFN; TSLFNFNK; SLFNFNKI; LFNFNKIL; FNFNKILN; NFNKILNL; FNKILNLG; NKILNLGK; KILNLGKI; ILNLGKIL; LNLGKILS; NLGKILSK; LGKILSKL; GKILSKLS; KILSKLSQ; ILSKLSQD; LSKLSQDS; SKLSQDSN; KLSQDSNY; LSQDSNYR; |

VQSEIDAN; QSEIDANK; SEIDANKG; EIDANKGE; IDANKGEP;
TDANKGEPD; DANKGEPDD; ANKGEPDDQ; NKGEPDDQF; KGEPDDQFE;
GEPDDQFEM; EPDDQFEMK; PDDQFEMKA; DDQFEMKAE; DQFEMKAEI;
QFEMKAEIF; FEMKAEIFS; EMKAEIFSK; MKAEIFSKI; KAEIFSKIF;
AEIFSKIFF; EIFSKIFFN; IFSKIFFNA; FSKIFFNAG; SKIFFNAGS;
KIFFNAGST; IFFNAGSTV; FFNAGSTVT; FNAGSTVTF; NAGSTVTFD;
AGSTVTFDD; GSTVTFDDN; STVTFDDNE; TVTFDDNEY; VTFDDNEYV;
TFDDNEYVN; FDDNEYVNE; DDNEYVNER; DNEYVNERR; NEYVNERRI;
EYVNERRIL; YVNERRILY; VNERRILYT; NERRILYTS; ERRILYTSL;
RRILYTSLN; RILYTSLNF; ILYTSLNFN; LYTSLNFNE; YTSLNFNER;
TSLNFNERK; SLNFNERKI; LNFNERKII; NFNERKIIL; FNERKIILL;
ENKIILLCK; NKIILLGKI; KIILLGKII; IILLGKII

| | |
|---|---|
| | EPDQFEMKAE; PDQFEMKAEI; DQFEMKAEIF; QFEMKAEIFS; QFEMKAEIFSK; FEMKAEIFSKI; EMKAEIFSKIF; MKAEIFSKIFF; KAEIFSKIFFN; AEIFSKIFFNA; EIFSKIFFNAG; IFSKIFFNAGS; FSKIFFNAGST; SKIFFNAGSTV; KIFFNAGSTVI; IFFNAGSTVFF; FFNAGSTVFFD; FNAGSTVFFDD; NAGSTVFFDDN; AGSTVFFDDNE; GSTVFFDDNEY; STVFFDDNEYV; TVFFDDNEYVN; VFFDDNEYVNE; FFDDNEYVNER; FDDNEYVNERR; DDNEYVNERRI; DNEYVNERRIL; NEYVNERRILY; EYVNERRILYT; YVNERRILYTS; VNERRILYTSL; NERRILYTSLN; ERRILYTSLNF; RRILYTSLNFN; RILYTSLNFNE; ILYTSLNFNEN; LYTSLNFNENK; YTSLNFNENKI; TSLNFNENKIL; SLNFNENKILN; LNFNENKILNL; NFNENKILNLG; FNENKILNLGK; NENKILNLGKI; ENKILNLGKIL; NKILNLGKILS; KILNLGKILSK; ILNLGKILSKI; LNLGKILSKIS; NLGKILSKISQ; LGKILSKISQD; GKILSKISQDS; KILSKISQDSN; ILSKISQDSNY; LSKISQDSNYR; SKISQDSNYRS; KISQDSNYRSL; ISQDSNYRSLV; SQDSNYRSLVK; QDSNYRSLVKE; DSNYRSLVKEI; SNYRSLVKEIL; NYRSLVKEILL; YRSLVKEILLN; RSLVKEILNRG; SLVKEILNRG; LVKEILNRGF; VKEILNRGFS; KEILNRGFST; EILNRGFSTQ; ILNRGFSTQL; LNRGFSTQLA; NRGFSTQLAI; RGFSTQLAIEE; GFSTQLAIEEL; FSTQLAIEELS; STQLAIEELSL; TQLAIEELSLR; QLAIEELSLRT; LAIEELSLRTL; AIEELSLRTLN; IEELSLRTLNV; EELSLRTLNVK; ELSLRTLNVKD; LSLRTLNVKDK; SLRTLNVKDKI; LRTLNVKDKIQ; RTLNVKDKIQH; TLNVKDKIQHL; LNVKDKIQHLN; NVKDKIQHLNK; VKDKIQHLNKP; KDKIQHLNKPN; DKIQHLNKPNL; KIQHLNKPNLK; IQHLNKPNLKT; QHLNKPNLKTL; HLNKPNLKTLY; LNKPNLKTLYH; NKPNLKTLYHD; KPNLKTLYHDF; PNLKTLYHDFN; NLKTLYHDFNK; LKTLYHDFNKL; KTLYHDFNKLI; TLYHDFNKLIP; LYHDFNKLIPL; YHDFNKLIPLK; HDFNKLIPLKF; DFNKLIPLKFK; FNKLIPLKFKW; NKLIPLKFKWL; KLIPLKFKWLK; LIPLKFKWLKD; IPLKFKWLKDV; PLKFKWLKDVD; LKFKWLKDVDD; KFKWLKDVDDI; FKWLKDVDDIL; KWLKDVDDIIK; WLKDVDDIIKD; LKDVDDIIKDY; KDVDDIIKDYN; DVDDIIKDYNA; VDDIIKDYNAK; DDIIKDYNANP; DIIKDYNANPF; IIKDYNANPFL; IKDYNANPFLR; KDYNANPFLRT; DYNANPFLRTD; YNANPFLRTDI; NANPFLRTDIS; ANPFLRTDISK; NPFLRTDISKI; PFLRTDISKIN; FLRTDISKIND; LRTDISKINDY; RTDISKINDYT; TDISKINDYTT; DISKINDYTTS; ISKINDYTTSK; SKINDYTTSKN; KINDYTTSKNS; INDYTTSKNSK; NDYTTSKNSKA; DYTTSKNSKAQ; YTTSKNSKAQF; TTSKNSKAQFT; TSKNSKAQFTD; SKNSKAQFTDT; KNSKAQFTDTH; NSKAQFTDTHN; SKAQFTDTHNT; KAQFTDTHNTL; AQFTDTHNTLL; QFTDTHNTLLK; FTDTHNTLLNL; TDTHNTLLNLI; DTHNTLLNLIN; THNTLLNLINT; HNTLLNLINTT; NTLLNLINTTK; TLLNLINTTKI; LLNLINTTKIL; LNLINTTKILA; NLINTTKILAP; LINTTKILAPT; INTTKILAPTQ; |
| Seq 42 | SEQ ID NO 49645-51056/<br>8 mers:<br>MKKVKSKY; KVKSKYL; KVKSKYLA; VKSKYLAL; KSKYLALC; SKYLALCL; KYLALCLL; YLALCLLF; LALCLLFG; ALCLLFGF; LCLLFGFI; CLLFGFIS; LLFGFISC; LFGFISCD; FGFISCDL; GFISCDLF; FISCDLFI; ISCDLFIR; SCDLFIRY; CDLFIRYE; DLFIRYEM; LFIRYEMK; FIRYEMKE; IRYEMKEE; RYEMKEES; |

ELLNYLQV; LLNYLQVS; LNYLQVSV; NYLQVSVK; YLQVSVKT;
LQVSVKTA; QVSVKTAA; VSVKTAAE; SVKTAAEF; VKTAAEFV;
KTAAEFVY; TAAEFVYT; AAEFVYTK; AEFVYTKD; EFVYTKDT;
FVYTKDTH; VYTKDTHA; YTKDTHAK; TKDTHAKR; KDTHAKRK;
DTHAKRKL; THAKRKLE; HAKRKLEK; AKRKLEKT; KRKLEKTE;
RKLEKTEA; KLEKTEAF; LEKTEAFT; EKTEAFTK; KTEAFTKT;
TEAFTKTL; EAFTKTLT; AFTKTLTA; FTKTLTAK; TKTLTAKT;
KTLTAKTK; TLTAKTKE; LTAKTKEQ; TAKTKEQS; AKTKEQSE;
KTKEQSEL; TKEQSELY; KEQSELYE; EQSELYEA; QSELYEAY;
SELYEAYK; ELYEAYKA; LYEAYKAT; YEAYKATV; EAYKATVT;
AYKATVTS; YKATVTST; KATVTSTL; ATVTSTLL; TVTSTLLM;
VTSTLLMR; TSTLLMRD; STLLMRDS; TLLMRDSL; LLMRDSLK;
LMRDSLKE; MRDSLKEV; RDSLKEVQ; DSLKEVQG; SLKEVQGT;
LKEVQGTT; KEVQGTTD; EVQGTTDK; VQGTTDKN; QGTTDKNE;
GTTDKNGV; TTDKNGVW; TDKNGVWY;

9 mers:
MKKVKSKYL; KKVKSKYLA; KVKSKYLAL; VKSKYLALG; KSKYLALGL;
SKYLALGLL; KYLALGLLF; YLALGLLFG; LALGLLFGF; ALGLLFGFT;
LGLLFGFTS; GLLFGFTSC; LLFGFTSCD; LFGFTSCDL; FGFTSCDLF;
GFTSCDLFT; FTSCDLFTR; TSCDLFTRY; SCDLFTRYE; CDLFTRYEM;
DLFTRYEMK; LFTRYEMKE; FTRYEMKEE; TRYEMKEES; RYEMKEESP;
YEMKEESPG; EMKEESPGL; MKEESPGLF; KEESPGLFD; EESPGLFDK;
ESPGLFDKG; SPGLFDKGH; PGLFDKGHS; GLFDKGHSI; LFDKGHSIL;
FDKGHSILF; DKGHSILFT; KGHSILFTS; GHSILFTSE; HSILFTSEE;
SILFTSEES; ILFTSEESI; LFTSEESIK; FTSEESIKK; TSEESIKKE;
SEESIKKEM; EESIKKEMK; ESIKKEMKK; SIKKEMKKK; IKKEMKKKG;
KKEMKKKGK; KEMKKKGKG; EMKKKGKGK; MKKKGKGKT; KKKGKGKTA;
KKGKGKTAR; KGKGKTARK; GKGKTARKK; KGKTARKKG; GKTARKKGK;
KTARKKGKS; TARKKGKSK; ARKKGKSKV; RKKGKSKVS; KKGKSKVSR;
KGKSKVSRK; GKSKVSRKE; KSKVSRKEP; SKVSRKEPY; KVSRKEPYT;
VSRKEPYTS; SRKEPYTHS; RKEPYTHSL; KEPYTHSLK; EPYTHSLKR;
PYTHSLKRD; YTHSLKRDS; THSLKRDSA; HSLKRDSAK; SLKRDSAKE;
LKRDSAKES; KRDSAKESE; RDSAKESEL; DSAKESELQ; SAKESELQ;
AKESELQK; KESELQKE; ESELQKEV; SELQKEVT; ELQKEVTL;
LQKEVTLE; QKEVTLEE; KEVTLEEE; EVTLEEES; VTLEEESL;
TLEEESLE; LEEESLET; EEESLETE; EESLETEL; ESLETELK;
SLETELKE; LETELKEQ; ETELKEQS; TELKEQSE; ELKEQSEE;
LKEQSEET; KEQSETR; EQSETRK; QSETRKE; SETRKEK;
QSETRKET; SETRKETQ; ETRKETQK; TRKETQKQ; RKETQKQQ;
KETQKQQD; ETQKQQDE; TQKQQDEY; QKQQDEYK; KQQDEYKG;
QQDEYKGM; QDEYKGMT; DEYKGMTQ; EYKGMTQG; YKGMTQGS;
YKGMTQGSL; KGMTQGSL; GMTQGSLNS; MTQGSLNSL; TQGSLNSLS;
QGSLNSLSG; GSLNSLSGF; SLNSLSGFS; LNSLSGFSG; NSLSGFSGF;
SLSGFSGEL; LSGFSGELK; SGFSGELKE; GFSGELKET; FSGELKETL;
SGELKETLE; GELKETLES; ELKETLESK; LKETLESKE; KETLESKET;
ETLESKETD; TLESKETDT; LESKETDTT; ESKETDTTD; SKETDTTDE;
KETDTTDS; ETDTTDSD; TDTTDSDL; DTTDSDLR; TTDSDLRP;
TTDSDLRPK; TDSDLRPKS; DSDLRPKSS; SDLRPKSSL; DLRPKSSLQ;
LRPKSSLQD; RPKSSLQDT; PKSSLQDTA; KSSLQDTAG; SSLQDTAGS;
SLQDTAGSN; LQDTAGSNS; QDTAGSNST; DTAGSNSTS; TAGSNSTSY;

Fig. 31 continued

AQSNSISYT; QSNSISYTD; SNSISYTDE; KSISYTDEI; SISYTDEIE;
ISYTDEIEE; SYTDEIEEF; YTDEIEEFD; TDEIEEFDY; DEIEEFDYA;
EIEEDYAR; IEEDYARY; EEDYARYY; EDYARYYL; DYARYYLD;
DYARYYLDE; YARYYLDED; ARYYLDEDE; RYYLDEDE; YYLDEDDE;
YLDEDDED; LDEDDEDE; DEDDEDEY; EDDEDDYY; DDEDDEYY;
DEDDEYYD; EDDEYYDD; DDEYYDDY; DEYYDDYE; EYYDDYEE;
YYEDDYEE; YEDDYEIR; EDDYEIRL; DDYEIRLS; DYEIRLSN;
YEIRLSNR; EIRLSNRY; IRLSNRYQ; RLSNRYQS; LSNRYQSY;
LSNRYQSYL; SRYQSYLE; RYQSYLEG; YQSYLEGV; QSYLEGVK;
QSYLEGVKY; SYLEGVKYE; YLEGVKYEV; LEGVKYEVD; EGVKYEVDS;
GVKYEVDSA; VKYEVDSAT; KYEVDSATE; YEVDSATET; EVDSATETT;
VDSATETED; DSATETEDR; SATETEDRL; ATETEDRLY; TETEDRLYD;
RTETEDRT; TETEDRTY; ETEDRTYT; TEDRTYTL; EDRTYTLE;
DRTYTLEG; RTYTLEST; TYTLESTR; YTLESTRL; TLESTRLT;
LESTRLQ; ESTRLQM; STRLQMY; STRLQMYS; TRLQMYST;
RLQMYSTR; LQMYSTRL; QMYSTRLD; MYSTRLDE; YSTRLDEL;
YSTRLDEIA; STRLDEIAK; TRLDEIAKA; RLDEIAKAK; LDEIAKAKA;
DEIAKAKAK; EIAKAKAKE; IAKAKAKEE; AKAKAKEEA; KAKAKEEAA;
AKAKEEAAK; KAKEEAAKE; AKEEAAKEE; KEEAAKEEK; EEAAKEEKE;
EAAKEEKED; AAKEEKEDL; AKEEKEDLE; KEEKEDLEK; EEKEDLEKE;
EKEDLEKEE; KEDLEKEEK; EDLEKEEKT; DLEKEEKTL; LEKEEKTLL;
EKEEKTLLN; KEEKTLLNY; EEKTLLNYL; EKTLLNYLQ; KTLLNYLQV;
TLLNYLQVS; LLNYLQVSV; LNYLQVSVK; NYLQVSVKT; YLQVSVKTA;
LQVSVKTAA; QVSVKTAAE; VSVKTAAEE; SVKTAAEEV; VKTAAEEVY;
KTAAEEVYE; TAAEEVYER; AAEEVYERD; AEEVYERDT; EEVYERDTH;
EVYERDTHA; VYERDTHAK; YERDTHAKR; ERDTHAKRK; RDTHAKRKL;
DTHAKRKLE; THAKRKLEE; HAKRKLEEL; AKRKLEELE; KRKLEELEA;
RKLEELEAE; KLEELEAET; LEELEAETK; EELEAETKT; ELEAETKTL;
LEAETKTLT; EAETKTLTA; AETKTLTAK; ETKTLTAKT; TKTLTAKTK;
KTLTAKTKE; TLTAKTKEQ; LTAKTKEQS; TAKTKEQSE; AKTKEQSEL;
KTKEQSELY; TKEQSELYE; KEQSELYEA; EQSELYEAY; QSELYEAYR;
SELYEAYRA; ELYEAYRAT; LYEAYRATV; YEAYRATVT; EAYRATVTS;
AYRATVTST; YRATVTSTL; RATVTSTLL; ATVTSTLLM; TVTSTLLMR;
VTSTLLMRD; TSTLLMRDS; STLLMRDSL; TLLMRDSLK; LLMRDSLKE;
LMRDSLKEV; MRDSLKEVQ; RDSLKEVQG; DSLKEVQGT; SLKEVQGTT;
LKEVQGTTD; KEVQGTTDK; EVQGTTDKN; VQGTTDKNG; QGTTDKNGV;
GTTDKNGVW; TTDKNGVWY;

10 mers:
MKKVKSKYLA; KKVKSKYLAL; KVKSKYLALG; VKSKYLALGL;
KSKYLALGLL; SKYLALGLLE; KYLALGLLEG; YLALGLLEGT;
LALGLLEGTS; ALGLLEGTSC; LGLLEGTSCD; GLLEGTSCDL;
LLEGTSCDL; LEGTSCDLE; EGTSCDLET; GTSCDLETR;
TSCDLETRY; SCDLETRYE; CDLETRYEM; DLETRYEMK;
DLETRYEMKE; LETRYEMKEE; ETRYEMKEES; TRYEMKEESP;
RYEMKEESPG; YEMKEESPGL; EMKEESPGLE; MKEESPGLED;
KEESPGLEDK; EESPGLEDKG; ESPGLEDKGS; SPGLEDKGSL;
PGLEDKGSIL; GLEDKGSILE; LEDKGSILET; EDKGSILET;
DKGSILETS; KGSILETSE; GSILETSEE; SILETSEES;
SILETSEESI; ILETSEESIK; LETSEESIKK; ETSEESIKKF;
TSEESIKKPM; SEESIKKPMK; EESIKKPMKK; ESIKKPMKKX;

SKKPRKKGK; LKKPRKKGKK; KKPMKKGKG; KPMNKKGKGK;
PMNKKGKGT; MNKKGKGKTA; KKGKGKTARK; KGKGKTARKK;
KGKGKTARKK; GKGKTARKKG; KGKTARKKGK; GKTARKKGKS;
KTARKKGKSK; TARKKGKSKV; ARKKGKSKVS; RKKGKSKVSR;
KKGKSKVSRK; KGKSKVSRKE; GKSKVSRKEP; KSKVSRKEPY;
SKVSRKEPYT; KVSRKEPYTS; VSRKEPYTHS; SRKEPYTHSL;
RKEPYTHSLK; KEPYTHSLKR; EPYTHSLKRD; PYTHSLKRDS;
YTHSLKRDSA; THSLKRDSAN; HSLKRDSANK; SLKRDSANKS;
LKRDSANKSN; KRDSANKSNF; RDSANKSNFL; DSANKSNFLQ;
SANKSNFLQK; ANKSNFLQKN; NKSNFLQKNV; KSNFLQKNVI;
SNFLQKNVTL; NFLQKNVTLE; FLQKNVTLFE; LQKNVTLFEF;
QKNVTLFEFS; KNVTLFEFSL; NVTLFEFSLK; VTLFEFSLKT;
TLFEFSLKTF; LFEFSLKTFL; FEFSLKTFLL; EFSLKTFLLK;
FSLKTFLLKF; SLKTFLLKFQ; LKTFLLKFQS; KTFLLKFQST;
TFLLKFQSET; FLLKFQSETR; LLKFQSETRK; LKFQSETRKE;
KFQSETRKEK; FQSETRKEKI; QSETRKEKIQ; SETRKEKIQK;
ETRKEKIQKQ; TRKEKIQKQD; RKEKIQKQDF; KEKIQKQDFY;
EKIQKQDFYK; KIQKQDFYKG; IQKQDFYKGM; QKQDFYKGMI;
KQDFYKGMI; QDFYKGMIQ; DFYKGMIQG; FYKGMIQGS;
YKGMIQGSL; KGMIQGSLN; GMIQGSLNS; MIQGSLNSL;
IQGSLNSLS; QGSLNSLSG; GSLNSLSGE; SLNSLSGES;
LNSLSGESG; NSLSGESGE; SLSGESGEL; LSGESGELK;
SGESGELKE; GESGELKET; ESGELKETI; SGELKETIE;
GELKETIES; ELKETIESN; LKETIESNE; KETIESNEI;
ETIESNEID; TIESNEIDI; IESNEIDIT; ESNEIDITS;
SNEIDITSD; NEIDITSDL; EIDITSDLR; IDITSDLRP;
DITSDLRPK; ITSDLRPKS; TSDLRPKSS; SDLRPKSSL;
DLRPKSSLQ; LRPKSSLQD; RPKSSLQDT; PKSSLQDTA;
KSSLQDTAG; SSLQDTAGS; SLQDTAGSN; LQDTAGSNS;
QDTAGSNSI; DTAGSNSIS; TAGSNSISY; AGSNSISYT;
GSNSISYTD; SNSISYTDE; NSISYTDET; SISYTDETE;
ISYTDETEF; SYTDETEFE; YTDETEFED; TDETEFEDY;
DETEFEDYA; ETEFEDYAR; TEFEDYARY; EFEDYARYY;
FEDYARYYL; EDYARYYLD; DYARYYLDD; YARYLDDD;
ARYYLDDDD; RYYLDDDDE; YYLDDDDED; YLDDDDEDE;
LDDDDEDEY; DDDDEDEYY; DDDEDEYYE; DDEDEYYED;
DEDEYYEDD; EDEYYEDDY; DEYYEDDYE; EYYEDDYEE;
YYEDDYEET; YEDDYEETR; EDDYEETRL; DDYEETRLS;
DYEETRLSN; YEETRLSNR; EETRLSNRY; ETRLSNRYQ;
TRLSNRYQS; RLSNRYQSY; LSNRYQSYL; SNRYQSYLE;
NRYQSYLEG; RYQSYLEGV; YQSYLEGVK; QSYLEGVKY;
SYLEGVKYN; YLEGVKYNV; LEGVKYNVD; EGVKYNVDS;
GVKYNVDSA; VKYNVDSAI; KYNVDSAIN; YNVDSAINT;
NVDSAINTK; VDSAINTKI; DSAINTKIK; SAINTKIKL;
AINTKIKLD; INTKIKLDY; NTKIKLDYT; TKIKLDYTY;
TKIYDYTY; KIYDYTYL; IYDYTYLF; YDYTYLFS;
YDYTYLFST; DYTYLFSTK; YTYLFSTKL; TYLFSTKLT;
YLFSTKLTQ; LFSTKLTQM; FSTKLTQMY; STKLTQMYS;
TKLTQMYST; KLTQMYSTR; LTQMYSTRL; TQMYSTRLD;
QMYSTRLDN; MYSTRLDNI; YSTRLDNIA; STRLDNIAK;

Fig. 31 continued

TRLDKLAKAK; RLDDLAKAKA; LDDLAKAKAK; DDLAKAKAKF;
DLAKAKAKFF; LAKAKAKFFA; AKAKAKFFAA; KAKAKFFAAK;
AKAKFFAAKF; KAKFFAAKFT; AKFFAAKFTK; KFFAAKFTKF;
FFAAKFTKED; FAAKFTKEDL; AAKFTKEDLE; AKFTKEDLEK;
KFTKEDLEKF; FTKEDLEKFK; TKEDLEKFKF; KEDLEKNFKF;
EDLEKNFKFL; DLEKNFKFLL; LEKNFKFLLK; EKNFKFLLKY;
KNFKFLLKYT; NFKFLLKYTQ; FKFLLKYTQV; KFLLKYTQVS;
FLLKYTQVSV; LLKYTQVSVK; LKYTQVSVKT; KYTQVSVKTA;
YTQVSVKTAA; TQVSVKTAAN; QVSVKTAANF; VSVKTAANFV;
SVKTAANFVY; VKTAANFV

Fig. 31 continued

| | |
|---|---|
| | DTHAKRKLEKI; THAKRKLEKIE; HAKRKLEKIEA; AKRKLEKIEAE; RKKLEKIEAET; RKIEKIEAETK; KIEKIEAETKT; IEKIEAETKTL; EKIEAETKTLI; KIEAETKTLIA; IEAETKTLIAK; EAETKTLIAKI; AETKTLIAKIK; ETKTLIAKIKE; TKTLIAKIKEQ; KTLIAKIKEQS; TLIAKIKEQSN; LIAKIKEQSNL; IAKIKEQSNLY; AKIKEQSNLYE; KIKEQSNLYEA; IKEQSNLYEAY; KEQSNLYEAYK; EQSNLYEAYKA; QSNLYEAYKAT; SNLYEAYKATV; NLYEAYKATVT; LYEAYKATVTS; YEAYKATVTSI; EAYKATVTSIL; AYKATVTSILL; YKATVTSILLM; KATVTSILLMR; ATVTSILLMRD; TVTSILLMRDS; VTSILLMRDSL; TSILLMRDSLK; SILLMRDSLKE; ILLMRDSLKEV; LLMRDSLKEVQ; LMRDSLKEVQG; MRDSLKEVQGT; RDSLKEVQGTI; DSLKEVQGTID; SLKEVQGTIDK; LKEVQGTIDKN; KEVQGTIDKNG; EVQGTIDKNGV; VQGTIDKNGVD; QGTIDKNGVDY; |
| Seq 43 | SEQ ID NO 510051-524047 8 mers: MKTKSKGL; KTKSKGLA; TKSKGLAL; KSKGLALG; SKGLALGL; KGLALGLL; GLALGLLF; LALGLLFG; ALGLLFGF; LGLLFGFT; GLLFGFTS; LLFGFTSC; LFGFTSCD; FGFTSCDL; GFTSCDLF; FTSCDLFL; TSCDLFLR; SCDLFLRD; CDLFLRDE; DLFLRDEL; LFLRDETK; FLRDETKR; LRDETKRK; RDETKRKS; DETKRKSL; ETKRKSLG; TKRKSLGL; KRKSLGLG; RKSLGLGD; KSLGLGDE; SLGLGDEE; LGLGDEES; GLGDEESS; LGDEESSI; GDEESSIL; DEESSILF; EESSILFT; ESSILFTG; SSILFTGD; SILFTGDK; ILFTGDKS; LFTGDKSV; FTGDKSVK; TGDKSVKK; GDKSVKKS; DKSVKKSL; KSVKKSLK; SVKKSLKK; VKKSLKKK; KKSLKKKG; KSLKKKGK; SLKKKGKD; LKKKGKDK; KKKGKDKV; KKGKDKVA; KGKDKVAR; GKDKVARK; KDKVARKK; DKVARKKV; KVARKKVE; VARKKVEG; ARKKVEGN; RKKVEGNA; KKVEGNAV; KVEGNAVK; VEGNAVKK; EGNAVKKD; GNAVKKDF; NAVKKDFN; AVKKDFNH; VKKDFNHH; KKDFNHHV; KDFNHHVK; DFNHHVKR; FNHHVKRE; NHHVKRES; HHVKRESV; HVKRESVN; VKRESVNS; KRESVNSL; RESVNSLS; ESVNSLSQ; SVNSLSQK; VNSLSQKK; NSLSQKKV; SLSQKKVL; LSQKKVLS; SQKKVLSF; QKKVLSFL; KKVLSFLS; KVLSFLSG; VLSFLSGE; LSFLSGEE; SFLSGEEL; FLSGEELK; LSGEELKD; SGEELKDT; GEELKDTI; EELKDTIE; ELKDTIES; LKDTIESN; KDTIESNL; DTIESNLI; TIESNLID; IESNLIDF; ESNLIDFT; SNLIDFTI; NLIDFTID; LIDFTIDS; IDFTIDSD; DFTIDSDL; FTIDSDLR; TIDSDLRL; IDSDLRLK; DSDLRLKS; SDLRLKSD; DLRLKSDL; LRLKSDLQ; RLKSDLQA; LKSDLQAI; KSDLQAIS; SDLQAISG; DLQAISGS; LQAISGSN; QAISGSNS; AISGSNSI; ISGSNSIS; SGSNSISY; GSNSISYT; SNSISYTD; NSISYTDE; SISYTDEI; ISYTDEIR; |

ILMKDSLK; LLMKDSLKI; LMKDSLKII; MKDSLKIIE; KDSLKIIEI;
DSLKIIEIV; SLKIIEIVT; LKIIEIVTD; KIIEIVTDK; IIEIVTDKN;
IEIVTDKNG; EIVTDKNGV; IVTDKNGVY; VTDKNGVYY;

10 mers:
MKIRSKCIAL; KIRSKCIALG; IRSKCIALGI; RSKCIALGIL;
SKCIALGILF; KCIALGILFG; CIALGILFGF; IALGILFGFT;
ALGILFGFIS; LGLFGFISG; GLFGFISGD; LFGFISGDL;
LFGFISGDLF; FGFISGDLFT; GFISGDLFTR; FISGDLFTRD;
ISGDLFTRDF; SGDLFTRDFT; GDLFTRDFTK; DLFTRDFTKR;
LFTRDFTKRK; FTRDFTKRKS; TRDFTKRKSL; RDFTKRKSLG;
DFTKRKSLGL; FTKRKSLGLC; TKRKSLGLCD; KRKSLGLCDF;
RKSLGLCDFF; KSLGLCDFFS; SLGLCDFFSS; LGLCDFFSST;
GLCDFFSSTL; LCDFFSSTLF; CDFFSSTLFT; DFFSSTLFTS;
FFSSTLFTSD; FSSTLFTSDK; SSTLFTSDKS; STLFTSDKSV;
TLFTSDKSVK; LFTSDKSVKK; FTSDKSVKKS; TSDKSVKKSL;
SDKSVKKSLN; DKSVKKSLNR; KSVKKSLNKK; SVKKSLNKKG;
VKKSLNKKGK; KKSLNKKGKD; KSLNKKGKDK; SLNKKGKDKV;
LNKKGKDKVA; NKKGKDKVAR; KKGKDKVARKK; KGKDKVARKK;
GKDKVARKKV; KDKVARKKVE; DKVARKKVEG; KVARKKVEGN;
VARKKVEGNA; ARKKVEGNAV; RKKVEGNAVK; KKVEGNAVKK;
KVEGNAVKKD; VEGNAVKKDP; EGNAVKKDPF; GNAVKKDPFN;
NAVKKDPFNH; AVKKDPFNHH; VKKDPFNHHV; KKDPFNHHVK;
KDPFNHHVKR; DPFNHHVKRE; PFNHHVKRES; FNHHVKRESV;
NHHVKRESVN; HHVKRESVNN; HVKRESVNNS; VKRESVNNSN;
KRESVNNSNL; RESVNNSNLS; ESVNNSNLSQ; SVNNSNLSQK;
VNNSNLSQKN; NNSNLSQKNV; NSNLSQKNVI; SNLSQKNVIS;
NLSQKNVISF; LSQKNVISFF; SQKNVISFFT; QKNVISFFTI;
KNVISFFTIK; NVISFFTIKT; VISFFTIKTK; ISFFTIKTKL;
SFFTIKTKLL; FFTIKTKLLR; FTIKTKLLRE; TIKTKLLRER;
IKTKLLRER; KTKLLRERP; TKLLRERPF; KLLRERPFT;
KLLRERPFTR; LLRERPFTRK; LRERPFTRKF; RERPFTRKFE;
ERPFTRKFET; RPFTRKFETQ; PFTRKFETQK; FTRKFETQKQ;
TRKFETQKQQ; RKFETQKQQD; KFETQKQQDE; FETQKQQDEH;
ETQKQQDEHK; TQKQQDEHKR; QKQQDEHKRM; KQQDEHKRML;
QQDEHKRMLQ; QDEHKRMLQG; DEHKRMLQGS; EHKRMLQGSL;
HKRMLQGSLS; KRMLQGSLSF; RMLQGSLSFL; MLQGSLSFLS;
LQGSLSFLSG; QGSLSFLSGE; GSLSFLSGES; SLSFLSGESG;
LSFLSGESGE; SFLSGESGEL; FLSGESGELK; LSGESGELKD;
SGESGELKDT; GESGELKDTF; ESGELKDTFE; SGELKDTFES;
GELKDTFESN; ELKDTFESNE; LKDTFESNEI; KDTFESNEID;
DTFESNEIDF; TFESNEIDFT; FESNEIDFTI; ESNEIDFTID;
SNEIDFTIDS; NEIDFTIDSD; EIDFTIDSDL; IDFTIDSDLR;
DFTIDSDLRL; FTIDSDLRLK; TIDSDLRLKS; IDSDLRLKSD;
DSDLRLKSDL; SDLRLKSDLQ; DLRLKSDLQA; LRLKSDLQAI;
RLKSDLQAIS; LKSDLQAISG; KSDLQAISGS; SDLQAISGSN;
DLQAISGSNS; LQAISGSNST; QAISGSNSTS; AISGSNSTSY;
ISGSNSTSYT; SGSNSTSYTD; GSNSTSYTDE; SNSTSYTDEL;
NSTSYTDELE; STSYTDELEE; TSYTDELEEE; SYTDELEEED;
YTDELEEEDY; TDELEEEDYD; DELEEEDYDQ; ELEEEDYDQY;
LEEEDYDQYS; EEEDYDQYSL; EEDYDQYSLR; EDYDQYSLRF;

DYDQYSLEDY; YDQYSLEDYY; DQYSLEDYYY; QYSLEDYYYD;
YSLEDYYYDG; SLEDYYYDGE; LEDYYYDGET; EDYYYDGETR;
DYYYDGETRL; YYYDGETRLS; YYDGETRLSN;
YDGETRLSNR; DGETRLSNRY; GETRLSNRYE; ETRLSNRYES;
TRLSNRYESY; RLSNRYESYL; LSNRYESYLE; SNRYESYLEG;
NRYESYLEGV; RYESYLEGVK; YESYLEGVKY; ESYLEGVKYN;
SYLEGVKYNV; YLEGVKYNVS; LEGVKYNVSS; EGVKYNVSSA;
GVKYNVSSAI; VKYNVSSAIK; KYNVSSAIKT; YNVSSAIKTT;
NVSSAIKTTV; VSSAIKTTVK; SSAIKTTVKT; SAIKTTVKTY;
AIKTTVKTYD; IKTTVKTYDN; KTTVKTYDNY; TTVKTYDNYT;
TVKTYDNYTL; VKTYDNYTLL; KTYDNYTLLS; TYDNYTLLST;
YDNYTLLSTK; DNYTLLSTKQ; NYTLLSTKQT; YTLLSTKQTQ;
TLLSTKQTQM; LLSTKQTQMY; LSTKQTQMYS; STKQTQMYST;
TKQTQMYSTR; KQTQMYSTRL; QTQMYSTRLD; TQMYSTRLDN;
QMYSTRLDNL; MYSTRLDNLA; YSTRLDNLAK; STRLDNLAKA;
TRLDNLAKAK; RLDNLAKAKA; LDNLAKAKAR; DNLAKAKARE;
NLAKAKAREE; LAKAKAREEA; AKAKAREEAK; KAKAREEAKK;
AKAREEAKKF; KAREEAKKFT; AREEAKKFTK; REEAKKFTKE;
EEAKKFTKEE; EAKKFTKEEL; AKKFTKEELE; KKFTKEELEK;
KFTKEELEKD; FTKEELEKDL; TKEELEKDLK; KEELEKDLKT;
EELEKDLKTL; ELEKDLKTLL; LEKDLKTLLN; EKDLKTLLNY;
KDLKTLLNYL; DLKTLLNYLQ; LKTLLNYLQV; KTLLNYLQVS;
TLLNYLQVSA; LLNYLQVSAR; LNYLQVSART; NYLQVSARTA;
YLQVSARTAT; LQVSARTATN; QVSARTATNF; VSARTATNFV;
SARTATNFVY; ARTATNFVYA; RTATNFVYAR; TATNFVYARE;
ATNFVYAREL; TNFVYARELY; NFVYARELYS; FVYARELYSK;
VYARELYSKR; YARELYSKRK; ARELYSKRKL; RELYSKRKLD;
ELYSKRKLDA; LYSKRKLDAT; YSKRKLDATE; SKRKLDATET;
KRKLDATETE; RKLDATETET; KLDATETETK; LDATETETKE;
DATETETKNL; ATETETKNLI; TETETKNLLK; ETETKNLLKI;
TETKNLLKIK; ETKNLLKIKG; TKNLLKIKGQ; KNLLKIKGQ;
NLLKIKGQS; LLKIKGQSD; LKIKGQSDL; KIKGQSDLY;
KIKGQSDLYE; IKGQSDLYEA; KGQSDLYEAY; GQSDLYEAYK;
QSDLYEAYKA; SDLYEAYKAL; DLYEAYKALV; LYEAYKALVR;
YEAYKALVRS; EAYKALVRST; AYKALVRSTL; YKALVRSTLL;
KALVRSTLLM; ALVRSTLLMK; LVRSTLLMKD; VRSTLLMKDS;
RSTLLMKDSL; STLLMKDSLK; TLLMKDSLKT; LLMKDSLKTT;
LMKDSLKTTE; MKDSLKTTEI; KDSLKTTEIV; DSLKTTEIVI;
SLKTTEIVID; LKTTEIVIDK; KTTEIVIDKK; TTEIVIDKKG;
TEIVIDKKGV; EIVIDKKGVY; IVIDKKGVYY;

11 mers:
MKTKSKCIAIG; KTKSKCIAIGL; TKSKCIAIGLL; KSKCIAIGLLF;
SKCIAIGLLFG; KCIAIGLLFGF; CIAIGLLFGFI; IAIGLLFGFIS;
AIGLLFGFISC; IGLLFGFISCD; GLLFGFISCDL; LLFGFISCDLF;
LFGFISCDLFT; FGFISCDLFTR; GFISCDLFTRD; FISCDLFTRDE;
ISCDLFTRDET; SCDLFTRDETK; CDLFTRDETKE; DLFTRDETKEK;
LFTRDETKEKS; FTRDETKEKSL; TRDETKEKSLG; RDETKEKSLGL;
DETKEKSLGLG; ETKEKSLGLGE; TKEKSLGLGEE; KEKSLGLGEES;
EKSLGLGEESS; KSLGLGEESSL; SLGLGEESSIL; LGLGEESSILT;
GLGEESSILTE; LGEESSILTET; GEESSILTETG; EESSILTETGD;

| | |
|---|---|
| | QMYSTRLDNLA; MYSTRLDNLAK; YSTRLDNLAKA; STRLDNLAKAK; TRLDNLAKAKA; RLDNLAKAKAR; LDNLAKAKARE; DNLAKAKAREE; NLAKAKAREEA; LAKAKAREEAK; AKAKAREEAKK; KAKAREEAKKE; AKAREEAKKET; KAREEAKKETK; AREEAKKETKE; REEAKKETKEE; EEAKKETKEEL; EAKKETKEELE; AKKETKEELEK; KKETKEELEKD; KETKEELEKDL; ETKEELEKDLK; TKEELEKDLKT; KEELEKDLKTL; EELEKDLKTLL; ELEKDLKTLLN; LEKDLKTLLNY; EKDLKTLLNYT; KDLKTLLNYLQ; DLKTLLNYLQV; LKTLLNYLQVS; KTLLNYLQVSA; TLLNYLQVSAR; LLNYLQVSART; LNYLQVSARTA; NYLQVSARTAT; YLQVSARTATN; LQVSARTATNF; QVSARTATNFV; VSARTATNFVY; SARTATNFVYA; ARTATNFVYAR; RTATNFVYARE; TATNFVYAREL; ATNFVYARELY; TNFVYARELYS; NFVYARELYSK; FVYARELYSKR; VYARELYSKRK; YARELYSKRKL; ARELYSKRKLD; RELYSKRKLDA; ELYSKRKLDAT; LYSKRKLDATE; YSKRKLDATET; SKRKLDATETE; KRKLDATETEI; RKLDATETEIK; KLDATETEIKK; LDATETEIKNL; DATETEIKNLI; ATETEIKNLIL; TETEIKNLILK; ETEIKNLILKI; TEIKNLILKIK; EIKNLILKIKT; IKNLILKIKTR; KNLILKIKTRG; NLILKIKTRGQ; LILKIKTRGQS; ILKIKTRGQSD; LKIKTRGQSDL; KIKTRGQSDLY; IKTRGQSDLYE; KTRGQSDLYEA; TRGQSDLYEAY; RGQSDLYEAYK; GQSDLYEAYKA; QSDLYEAYKAL; SDLYEAYKALV; DLYEAYKALVR; LYEAYKALVRS; YEAYKALVRST; EAYKALVRSTL; AYKALVRSTLL; YKALVRSTLLM; KALVRSTLLMK; ALVRSTLLMKD; LVRSTLLMKDS; VRSTLLMKDSL; RSTLLMKDSLK; STLLMKDSLKI; TLLMKDSLKIE; LLMKDSLKIEI; LMKDSLKIEIV; MKDSLKIEIVL; KDSLKIEIVLD; DSLKIEIVLDK; SLKIEIVLDKN; LKIEIVLDKNG; KIEIVLDKNGV; IEIVLDKNGVW; EIVLDKNGVWY; |
| Seq 44 | SEQ ID NO 52425-540507 8 mers: MKKVKSKY; KKVKSKYL; KVKSKYLA; VKSKYLAL; KSKYLALG; SKYLALGL; KYLALGLL; YLALGLLE; LALGLLEG; ALGLLEGF; LGLLEGFT; GLLEGFTS; LLEGFTSC; LEGFTSCD; EGFTSCDL; GFTSCDLF; FTSCDLFT; TSCDLFTR; SCDLFTRY; CDLFTRYE; DLFTRYEM; LFTRYEMK; FTRYEMKE; TRYEMKEE; RYEMKEES; YEMKEESP; EMKEESPG; MKEESPGL; KEESPGLF; EESPGLFD; ESPGLFDK; SPGLFDKG; PGLFDKGN; GLFDKGNS; LFDKGNST; FDKGNSTL; DKGNSTLE; KGNSTLETS; GNSTLETSE; NSTLETSEE; STLETSEES; TLETSEESL; LETSEESLK; ETSEESLKK; TSEESLKK; SEESTKKP; EESTKKPM; ESTKKPMK; STKKPMKK; TKKPMKKG; KKPMKKGK; KPMKKGKG; PMKKGKGK; MKKGKGKT; KKGKGKTA; KGKGKTAR; GKGKTARK; KGKTARKN; GKTARKNG; KTARKNGK; TARKNGKS; ARKNGKSK; RKNGKSKV; KNGKSKVS; NGKSKVSG; GKSKVSGK; KSKVSGKE; SKVSGKEE; KVSGKEEE; VSGKEEET; SGKEEETH; GKEEETHS; KEEETHSE; EEETHSEK; EETHSEKR; ETHSEKRD; THSEKRDA; HSEKRDAA; SEKRDAAE; EKRDAAEK; KRDAAEKS; RDAAEKSN; DAAEKSNF; AAEKSNFL; AEKSNFLQ; EKSNFLQK; KSNFLQKN; SNFLQKNV; NFLQKNVM; FLQKNVML; LQKNVMLE; QKNVMLEE; KNVMLEEE; NVMLEEES; VMLEEESL; MLEEESLK; LEEESLKT; EEESLKTE; EESLKTEL; ESLKTELL; SLKTELLK; LKTELLKE; KTELLKEQ; TELLKEQS; ELLKEQSE; LLKEQSET; LKEQSETR; KEQSETRK; EQSETRKE; |

IETEIKKL; ETEIKKLI; TEIKKLIL; EIKKLILK; IKKLILKI;
KLILKIK; ILLKIKG; LILKIKGQ; LIKIKGQS; IKIKGQSD;
KIKGQSDI; IKGQSDIY; KGQSDIYE; GQSDIYEA; QSDIYEAY;
SDIYEAYK; DIYEAYKA; IYEAYKAL; YEAYKAIV; EAYKAIVR;
AYKAIVRS; YKAI

YYEDYEEIR; YEDYEEIRL; EDYEEIRLS; DYEEIRLSN;
YEEIRLSNR; EEIRLSNRY; EIRLSNRYQ; IRLSNRYQS; RLSNRYQSY;
LSNRYQSYL; SNRYQSYLE; NRYQSYLEG; RYQSYLEGV; YQSYLEGVK;
QSYLEGVKY; SYLEGVKYN; YLEGVKYNV; LEGVKYNVD; EGVKYNVDS;
GVKYNVDSA; VKYNVDSAI; KYNVDSAIN; YNVDSAINL; NVDSAINLL;
VDSAINLLN; DSAINLLNK; SAINLLNKI; AINLLNKIY; INLLNKIYD;
NLLNKIYDT; LLNKIYDTY; LNKIYDTYL; NKIYDTYLE; KIYDTYLES;
IYDTYLESI; YDTYLESIK; DTYLESIKL; TYLESIKLI; YLESIKLIQ;
LES

| | | | |
|---|---|---|---|
| KKSPGLFDK; | KSPGLFDKG; | SPGLFDKGK; | PGLFDKGKS; |
| PGLFDKGNST; | GLFDKGNSTL; | LFDKGNSTLF; | FDKGNSTLFT; |
| DKGNSTLFTS; | KGNSTLFTSF; | GNSTLFTSFF; | NSTLFTSFFS; |
| SLLFTSFFSI; | TLFTSFFSIK; | LFTSFFSIKK; | FTSFFSIKKF; |
| TSFFSIKKFM; | SFFSIKKFMN; | FFSIKKFMNK; | FSIKKFMNKK; |
| SIKKFMNKKG; | IKKFMNKKGK; | KKFMNKKGKG; | KFMNKKGKGK; |
| FMNKKGKGKT; | MNKKGKGKTA; | NKKGKGKTAR; | KKGKGKTARK; |
| KGKGKTARKK; | GKGKTARKKG; | KGKTARKKGK; | GKTARKKGKS; |
| KTARKKGKSK; | TARKKGKSKV; | ARKKGKSKVS; | RKKGKSKVSG; |
| KKGKSKVSGK; | KGKSKVSGKF; | GKSKVSGKFP; | KSKVSGKFPF; |
| SKVSGKFPFT; | KVSGKFPFTH; | VSGKFPFTHS; | SGKFPFTHSF; |
| GKFPFTHSFK; | KFPFTHSFKR; | FPFTHSFKRD; | PFTHSFKRDA; |
| FTHSFKRDAA; | THSFKRDAAN; | HSFKRDAANK; | SFKRDAANKS; |
| FKRDAANKSN; | KRDAANKSNF; | RDAANKSNFL; | DAANKSNFLQ; |
| AANKSNFLQK; | ANKSNFLQKN; | NKSNFLQKNV; | KSNFLQKNVM; |
| SNFLQKNVML; | NFLQKNVMLF; | FLQKNVMLFF; | LQKNVMLFFS; |
| QKNVMLFFS; | KNVMLFFSL; | NVMLFFSLK; | VMLFFSLKT; |
| MLFFSLKTF; | LFFSLKTFL; | FFSLKTFLL; | FSLKTFLLK; |
| FSLKTFLLKF; | SLKTFLLKFG; | LKTFLLKFGS; | KTFLLKFGSF; |
| TFLLKFGSFT; | FLLKFGSFTR; | LLKFGSFTRK; | LKFGSFTRKF; |
| KFGSFTRKF; | FGSFTRKFT; | GSFTRKFTQ; | SFTRKFTQK; |
| FTRKKFTQKQ; | TRKKFTQKQQ; | RKKFTQKQQD; | KKFTQKQQDF; |
| KFTQKQQDFY; | FTQKQQDFYK; | TQKQQDFYKG; | QKQQDFYKGM; |
| KQQDFYKGMT; | QQDFYKGMTK; | QDFYKGMTKG; | DFYKGMTKGS; |
| FYKGMTKGSL; | YKGMTKGSLN; | KGMTKGSLNS; | GMTKGSLNSL; |
| MTKGSLNSLS; | TKGSLNSLSG; | KGSLNSLSGS; | GSLNSLSGSS; |
| SLNSLSGSSG; | LNSLSGSSGS; | NSLSGSSGSL; | SLSGSSGSLK; |
| LSGSSGLKF; | SGSSGLKFT; | GSSGLKFTT; | SSGLKFTTF; |
| SGFLKFTFS; | GFLKFTFSN; | FLKFTFSNF; | LKFTFSNFT; |
| KFTFSNFTD; | FTFSNFTDT; | TFSNFTDTT; | FSNFTDTTT; |
| SNFTDTTTS; | NFTDTTTSD; | FTDTTTSDL; | TDTTTSDLR; |
| TDTTDSDLR; | DTTDSDLRP; | TTDSDLRPK; | TDSDLRPKS; |
| TDSDLRPKSS; | DSDLRPKSSL; | SDLRPKSSLQ; | DLRPKSSLQD; |
| LRPKSSLQDI; | RPKSSLQDIA; | PKSSLQDIAG; | KSSLQDIAGS; |
| SSLQDTAGSN; | SLQDTAGSNS; | LQDTAGSNST; | QDTAGSNSTS; |
| DTAGSNSTSY; | TAGSNSTSYT; | AGSNSTSYTD; | GSNSTSYTDF; |
| SNSTSYTDFF; | NSTSYTDFFF; | STSYTDFFFF; | TSYTDFFFF; |
| SYTDFFFFD; | YTDFFFFDY; | TDFFFFDYA; | DFFFFDYAR; |
| FFFFDYARY; | FFFDYARYY; | FFDYARYYL; | FDYARYYLD; |
| FDYARYYLDE; | DYARYYLDED; | YARYYLDEDD; | ARYYLDEDDD; |
| RYYLDEDDD; | YYLDEDDEDD; | YLDEDDEDDE; | LDEDDEDDEY; |
| DEDDEDDEYY; | EDDEDDEYYE; | DDEDDEYYED; | DEDDEYYEDD; |
| EDDEYYEDDY; | DDEYYEDDYE; | DEYYEDDYE; | EYYEDDYEF; |
| YYEDDYEFR; | YEDDYEFTRL; | EDDYEFTRLS; | DDYEFTRLSN; |
| DYEFTRLSNF; | YEFTRLSNRY; | EFTRLSNRYQ; | FTRLSNRYQS; |
| TRLSNRYQSY; | RLSNRYQSYL; | LSNRYQSYLF; | SNRYQSYLFG; |
| NRYQSYLFGV; | RYQSYLFGVK; | YQSYLFGVKY; | QSYLFGVKYN; |
| SYLFGVKYNV; | YLFGVKYNVD; | LFGVKYNVDS; | FGVKYNVDSA; |
| GVKYNVDSAI; | VKYNVDSAIN; | KYNVDSAINT; | YNVDSAINTT; |
| NVDSAINTTN; | VDSAINTTNK; | DSAINTTNKI; | SAINTTNKIY; |
| AINTTNKIYD; | INTTNKIYDT; | NTTNKIYDTY; | TTNKIYDTYT; |

Fig. 31 continued

IKKIYDYYLF; KKYDYYLFS; KYDYYLFST;
YDYYLFSTK; DYYLFSTKL; YYLFSTKLT; YLFSTKLTQ;
LFSTKLTQM; FSTKLTQMY; STKLTQMYS; TKLTQMYST;
KLTQMYSTR; LTQMYSTRL; TQMYS

Fig. 31 continued

EVDSAIKTIKK; VDSAIKTIKKIY; DSAIKTIKKIYD; SAIKTIKKIYDT; AIKTIKKIYDT; IKTIKKIYDTY; KTIKKIYDTYT; TIKKIYDTYTL; IKKIYDTYTLF; KKIYDTYTLFS; KIYDTYTLFST; IYDTYTLFSTK; YDTYTLFSTKL; DTYTLFSTKLI; TYTLFSTKLIQ; YTLFSTKLIQM; TLFSTKLIQMY; LFSTKLIQMYS; FSTKLIQMYST; STKLIQMYSTR; TKLIQMYSTRL; KLIQMYSTRLD; LIQMYSTRLDN; IQMYSTRLDNL; QMYSTRLDNLA; MYSTRLDNLAK; YSTRLDNLAKA; STRLDNLAKAK; TRLDNLAKAKA; R

Fig. 32.

| Antigen designation | HLA-chain; Class 1 | Amino acid sequence |
|---|---|---|
| NP_212517.1; Basic membrane protein A (bmpA) [Borrelia burgdorferi B31; Seq1 | HLA-A0101 | YSDEIDIIH; IVDAFRYGY; GSDLIWLIGY; YSDEIDIIHH; YSDEIDIIHHA; FTSNHLKTNTF |
| | HLA-A0201 | ILLESIVFL; SLGSEIPKV; LLLILLESI; NLVGMTFRA; YLAPDNVIT; RMYSDEIDI; GVDEDQAYL; KIINKEIIV; FLGGIEGEI; LLILLESIV; ILLLILLES; FLTGYIAAK; LLESIVFLS; GSGHYIIGV; YIAAKLSKT; LIGYRFSDV; FLTGYIAAKL; ILLLILLESI; RMYSDEIDII; FLGGIEGEIV; WLIGYRFSDV; LLLILLESIV; ILLESIVFLS; GLGGIGAIEV; YLAPDNVITS; LILLESIVFL; FLSCSGKGSL; YIGSFADLEA; GLKEGVVGFV; ALNIFTSNHL; LINYGLKEGV; YIIGVDEDQA; ALQNPDMKYA; MISFELEKEI; GVDEDQAYLA; YLAPDNVITST; KLINYGLKEGV; ILLLILLESIV; KMISFELEKEI; KILLLILLESI; LLILLESIVFL; SLGSEIPKVSL; WLIGYRFSDVA; YLSDLEGLKDA; ILLESIVFLSC; VLKESSSNSYL; IIDPIYSNDPI; NLSSKIINKEI; ALQNPDMKYAI; MTFRAQEGAFL; KSFNESALNGV; ELGSGHYIIGV; KLSKTGKIGFL; KISTQYIGSFA; SVATRMYSDEI; FLTGYIAAKLS; GLGGIGAIEVA; YSDEIDIIHHA; YSNDPIPANLV; IVDAFRYGYEA |
| | HLA-A0301 | IVFLSCSGK; KMISFELEK; NLSSKIINK; NIFTSNHLK; FLTGYIAAK; ALNGVKKVK; KTNTFEGGK; VVGFVRNPK; GSLGSEIPK; GIGAIEVAK; YLSDLEGLK; ALQNPDMKY; SIVFLSCSGK; TGYIAAKLSK; GVVGFVRNPK; AFLTGYIAAK; LIIDGTFDDK; SALNGVKKVK; LNIFTSNHLK; IAAKLSTGK; GVKKVKEEFK; KGSLGSEIPK; SYLSDLEGLK; IGYRFSDVAK; FRYGYEAGAK; RYGYEAGAKY; ALNIFTSNHLK; LTGYIAAKLSK; HLKTNTFEGGK; RMYSDEIDIIH; YIAAKLSKTGK; KVAALQNPDMK; GAFLTGYIAAK; NSYLSDLEGLK; LIGYRFSDVAK; SFNESALNGVK; SLIIDGTFDDK |
| | HLA-A1101 | KMISFELEK; IVFLSCSGK; NIFTSNHLK; KTNTFEGGK; VVGFVRNPK; GSLGSEIPK; GIGAIEVAK; AALQNPDMK; NLSSKIINK; IVDAFRYGY; YLSDLEGLK; GYIAAKLSK; PSNKESYEK; ALNGVKKVK; IIDGTFDDK; AAKLSKTGK; FLTGYIAAK; ESALNGVKK; KESYEKFLK; ALQNPDMKY; KEIIVPSNK; KEIDNLSSK; EAGAKYANK; SIVFLSCSGK; GVVGFVRNPK; LIIDGTFDDK; SALNGVKKVK; GVKKVKEEFK; VAALQNPDMK; SYLSDLEGLK; GSFADLEAGR; IAAKLSKTGK; TGYIAAKLSK; AFLTGYIAAK; IGYRFSDVAK; ITSTTKDVGR; KGSLGSEIPK; LNIFTSNHLK; PANLVGMTFR; GSDLIWLIGY; AALQNPDMKY; ALNIFTSNHLK; KVAALQNPDMK; GAFLTGYIAAK; NSYLSDLEGLK; LTGYIAAKLSK; SLIIDGTFDDK; YIAAKLSKTGK; IVPSNKESYEK; SFNESALNGVK; ESIVFLSCSGK; LIGYRFSDVAK; GSDLIWLIGYR; RAQEGAFLTGY; NTFEGGKLINY; HLKTNTFEGGK; SNKESYEKFLK |
| | HLA-A2402 | KYANKDIKI; SYEKFLKEF; QYIGSFADL; MYSDEIDII; AYLAPDNVI; SYLSDLEGL; GFVRNPKMI; KYAIIDPIY; SYEKFLKEFI; SYLSDLEGLK; IYSNDPIPANL; NYGLKEGVVGF; GFVRNPKMISF; AFLTGYIAAKL; VFLSCSGKGSL |
| | HLA-A2902 | KYAIIDPIY; ALQNPDMKY; YGYEAGAKY; KDIKISTQY; IVPSNKESY; IVDAFRYGY; GEIVDAFRY; LIWLIGYRF; IGVDEDQAY; RYGYEAGAKY; IIGVDEDQAY; VAKELGSGHY; TFEGGKLINY; EIVDAFRYGY; LLILLESIVF; FVRNPKMISF; YIIGVDEDQAY; EIIVPSNKESY; EVAKELGSGHY; VAALQNPDMKY; RAQEGAFLTGY; LVLKESSSNSY; NTFEGGKLINY |
| | HLA-A6801 | NIFTSNHLK; DLIWLIGYR; IVFLSCSGK; EAGRSVATR; ESALNGVKK; FLTGYIAAK; EGEIVDAFR; TSTTKDVGR; KTNTFEGGK; YLSDLEGLK; SFADLEAGR; DVAKVAALQ; VVGFVRNPK; EAGAKYANK; KMISFELEK; |

| | | |
|---|---|---|
| | | NLSSKIINK; EFKIELVLK; DNVITSTTK; ESSSNSYLS; SIVFLSCSGK; ITSTTKDVGR; EEFKIELVLK; GSFADLEAGR; LNIFTSNHLK; GVVGFVRNPK; EIVDAFRYGY; LIIDGTFDDK; IAAKLSKTGK; GVKKVKEEFK; VAALQNPDMK; PANLVGMTFR; MTFRAQEGAF; TGYIAAKLSK; IGYRFSDVAK; MKYAIIDPIY; LEAGRSVATR; YEAGAKYANK; IEGEIVDAFR; ESIVFLSCSGK; NSYLSDLEGLK; IPANLVGMTFR; YIAAKLSKTGK; ESALNGVKKVK; LTGYIAAKLSK; IVPSNKESYEK; NPKMISFELEK; DLEAGRSVATR; GIEGEIVDAFR; GAFLTGYIAAK; VITSTTKDVGR; HLKTNTFEGGK; ALNIFTSNHLK; KVAALQNPDMK; MTFRAQEGAFL; NTFEGGKLINY; EVAKELGSGHY; IGSFADLEAGR; EIIVPSNKESY; LIGYRFSDVAK; SLIIDGTFDDK; EGVVGFVRNPK; YIIGVDEDQAY; SFNESALNGVK; GSDLIWLIGYR |
| | HLA-B0702 | APDNVITST; IPANLVGMT; NPKMISFEL; DPIYSNDPI; TTKDVGRAL; NPDMKYAII; IPANLVGMTF; FVRNPKMISF; APDNVITSTT; VPSNKESYEKF; RALNIFTSNHL; HAAGLGGIGAI |
| | HLA-B0801 | NPKMISFEL; FVRNPKMISF; |
| | HLA-B1501 | GLKEGVVGF; YGYEAGAKY; ALQNPDMKY; ISTQYIGSF; IGVDEDQAY; LILLESIVF; TFRAQEGAF; LSKTGKIGF; TTKDVGRAL; VSLIIDGTF; SNHLKTNTF; VLKESSSNSY; FVRNPKMISF; LLILLESIVF; AQEGAFLTGY; VAKELGSGHY; MTFRAQEGAF; KLSKTGKIGF; TQYIGSFADL; KVSLIIDGTF; IIVPSNKESY; KISTQYIGSF; TSNHLKTNTF; YGLKEGVVGF; IIGVDEDQAY; KVAALQNPDM; LQNPDMKYAI; MKYAIIDPIY; FLSCSGKGSL; YIIGVDEDQAY; LVLKESSSNSY; GMTFRAQEGAF; RAQEGAFLTGY; FTSNHLKTNTF; LLLILLESIVF; NTFEGGKLINY; VLKESSSNSYL; DMKYAIIDPIY; GGIEGEIVDAF; RMYSDEIDIIH; EIIVPSNKESY; VAALQNPDMKY; EVAKELGSGHY |
| | HLA-B2705 | FRYGYEAGA; YRFSDVAKV; VRNPKMISF; GRSVATRMY; FRAQEGAFL; FRYGYEAGAK; YRFSDVAKVA; YRFSDVAKVAA; GRALNIFTSNH |
| | HLA-B3501 | IGVDEDQAY; YGYEAGAKY; LIWLIGYRF; NPKMISFEL; LILLESIVF; DPIYSNDPI; PANLVGMTF; VAALQNPDM; DVGRALNIF; IPANLVGMT; TFRAQEGAF; LKESSSNSY; DPIPANLVG; YSDEIDIIH; VSLIIDGTF; IEGEIVDAF; IPANLVGMTF; DPIPANLVGM; MTFRAQEGAF; MKYAIIDPIY; EIVDAFRYGY; IIGVDEDQAY; AALQNPDMKY; EAGRSVATRM; LLILLESIVF; FSDVAKVAAL; TSNHLKTNTF; IIVPSNKESY; KVSLIIDGTF; DLIWLIGYRF; VAKELGSGHY; FVRNPKMISF; YIIGVDEDQAY; EAGRSVATRMY; FTSNHLKTNTF; VAALQNPDMKY; LVLKESSSNSY; VPSNKESYEKF; DPIYSNDPIPA; RAQEGAFLTGY; FRYGYEAGAKY; DMKYAIIDPIY; DPIPANLVGMT; LLLILLESIVF; EVAKELGSGHY; HAAGLGGIGAI; EIIVPSNKESY |
| | HLA-B4403 | EEFKIELVL; GEIVDAFRY; SEIPKVSLI; DEIDIIHHA; SEIPKVSLII; EEFKIELVLK; DEIDIIHHAA; KEIDNLSSKI; GEIVDAFRYGY; EEFKIELVLKE; KEIIVPSNKES; KEIDNLSSKII; KESYEKFLKEF; SEIPKVSLIID |
| | HLA-B5101 | IPKVSLIID; IPANLVGMT; DPIYSNDPI; IPANLVGMTF; IPKVSLIIDG; DPIPANLVGM; IPKVSLIIDGT |
| | HLA-B5701 | |
| NP_212516.1; Basic membrane protein B (bmpB) [Borrelia burgdorferi B31; SEQ ID NO:2, SEQ | HLA-A0101 | FSCAISGVY; SSENPKISY; IVDAFRYGY; GSDLIWLVGY; ETAKNLGDGY; VSSENPKISY; NKDIEIISEY; ETAKNLGDGYY |
| | HLA-A0201 | MLTDASLLV; NLIAVVFRV; YMLTDASLL; KMYSKGIDV; RIVIFIFGI; YLAPKNFIT; NIGDALYLI; GLRDGVIGL; NLGDGYYVI; KISMLVDGV; FIFGILLTS; QIPENLIAV; KIINKEIIV; VIFIFGILL; FITSVIKNI; FLAGYIAAK; LIWLVGYML; VLDDKSFNS; KGIDVIHFA; GIDVIHFAA; SANEALLRL; ISGVYSSYV; NGSDLIWLV; YANKDIEII; YMLTDASLLV; KMYSKGIDVI; AISGVYSSYV; ALYLITGEYI; KISYGIIDPI; WLVGYMLTDA; LLVSSENPKI; YLAPKNFITS; VQIPENLIAV; GLAGIGVIET; FAAGLAGIGV; QIPENLIAVV; |

Fig. 32 continued

| ID NO: 54447-54934 | | MLTDASLLVS; FIFGILLTSC; GVYSSYVSDL; EVFSCAISGV; IVIFIFGILL; LAPKNFITSV; RIVIFIFGIL; VLDDKSFNSS; FIGGMKGNIV; FLAGYIAAKK; YLAPKNFITSV; VLDDKSFNSSA; GLPNANEFEYI; NLGDGYYVIGA; SLLVSSENPKI; GLAGIGVIETA; MLTDASLLVSS; RIVIFIFGILL; LLTSCFSRNGI; YMLTDASLLVS; GIIDPIYGDDV; CAISGVYSSYV; VQIPENLIAVV; GIDVIHFAAGL; FLAGYIAAKKS; QMGLRDGVIGL; VVFRVEQGAFL; MLVDGVLDDKS; VIGADQDQSYL; TIASKMYSKGI |
|---|---|---|
| | HLA-A0301 | FLAGYIAAK; TIASKMYSK; KIGFIGGMK; VLERKIINK; ILLTSCFSR; EIFIKQILK; ALYLITGEY; LAGYIAAKK; AAKKSFSGK; LLVSSENPK; AISGVYSSY; SSANEALLR; KMYSKGIDV; KNFITSVIK; GIGVIETAK; RTIASKMYSK; FLAGYIAAKK; KVLERKIINK; SLLVSSENPK; AFLAGYIAAK; MLVDGVLDDK; IAAKKSFSGK; YEIFIKQILK; GKIGFIGGMK; GILLTSCFSR; SANEALLRLK; LYLITGEYIK; FRYGYESGAK; CAISGVYSSY; SRNGIESSSK; VDIGRTIASK; RYGYESGAKY; RNGIESSSKK; YESGAKYANK; AGIGVIETAK; PKNFITSVIK; FEYIKVLERK; VFSCAISGVY; ALYLITGEYIK; YIAAKKSFSGK; KMYSKGIDVIH; SSANEALLRLK; FSRNGIESSSK; SSYVSDLDNLK; GAFLAGYIAAK; SANEALLRLKK; AFLAGYIAAKK; ASLLVSSENPK; EVFSCAISGVY; KISYGIIDPIY; RVEQGAFLAGY; SMLVDGVLDDK; LVSSENPKISY |
| | HLA-A1101 | TIASKMYSK; SSANEALLR; YVSDLDNLK; KIGFIGGMK; AAKKSFSGK; EIFIKQILK; NANEFEYIK; IVDAFRYGY; VLERKIINK; AISGVYSSY; ALYLITGEY; ILLTSCFSR; LLVSSENPK; FLAGYIAAK; LVDGVLDDK; GIGVIETAK; YLITGEYIK; LAGYIAAKK; KNFITSVIK; ESGAKYANK; SSENPKISY; RTIASKMYS; RTIASKMYSK; KVLERKIINK; SANEALLRLK; SLLVSSENPK; IAAKKSFSGK; GILLTSCFSR; AFLAGYIAAK; MLVDGVLDDK; NSSANEALLR; FLAGYIAAKK; SYVSDLDNLK; YVSDLDNLKR; ISYGIIDPIY; NQEEYEIFIK; NSFSDVDIGR; GIESSSKKIK; AGIGVIETAK; SSYVSDLDNLK; SSANEALLRLK; SANEALLRLKK; ASLLVSSENPK; ALYLITGEYIK; GAFLAGYIAAK; YIAAKKSFSGK; SMLVDGVLDDK; SVIKNIGDALY; AFLAGYIAAKK; LAGIGVIETAK; RVEQGAFLAGY; ADQDQSYLAPK; EVFSCAISGVY; LVSSENPKISY; KISYGIIDPIY; LPNANEFEYIK |
| | HLA-A2402 | VYSSYVSDL; LYLITGEYI; KYANKDIEI; EYIKNNNVW; SYLAPKNFI; GYMLTDASL; MYSKGIDVI; IFIKQILKL; SYVSDLDNL; GYIAAKKSF; EYEIFIKQI; EYIKVLERK; EYSNSFSDV; EYIKVLERKI; KYANKDIEII; GYMLTDASLL; IFGILLTSCF; NFITSVIKNI; DFPENIEEVF; EYEIFIKQIL; SYVSDLDNLK; LYLITGEYIK; EYIKNNNVWE; MYSKGIDVHF; EYIKVLERKII; EYSNSFSDVDI; GYMLTDASLLV; SFSDVDIGRTI; EYIKNNNVWEG |
| | HLA-A2902 | SYGIIDPIY; IVPCNQEEY; FSCAISGVY; GNIVDAFRY; ALYLITGEY; YGYESGAKY; LPNANEFEY; IVDAFRYGY; SSENPKISY; VFRVEQGAF; RYGYESGAKY; GLPNANEFEY; VFSCAISGVY; CAISGVYSSY; IIVPCNQEEY; VVFRVEQGAF; VIGADQDQSY; DALYLITGEY; VIKNIGDALY; KGNIVDAFRY; TAKNLGDGYY; ISYGIIDPIY; VSSENPKISY; EVFSCAISGVY; YVIGADQDQSY; EIIVPCNQEEY; SVIKNIGDALY; LVSSENPKISY; IGLPNANEFEY; ETAKNLGDGYY; FIFGILLTSCF; SCAISGVYSSY; RVEQGAFLAGY; KISYGIIDPIY; GNIVDAFRYGY |
| | HLA-A6801 | TIASKMYSK; EIFIKQILK; YVSDLDNLK; NANEFEYIK; SSANEALLR; FLAGYIAAK; EYIKVLERK; ENLIAVVFR; LAGYIAAKK; ILLTSCFSR; YLITGEYIK; SFSDVDIGR; FSCAISGVY; ESGAKYANK; LLVSSENPK; KGNIVDAFR; DIGRTIASK; FEYIKVLER; NGIESSSKK; IVPCNQEEY; LVDGVLDDK; NSFSDVDIGR; NSSANEALLR; YVSDLDNLKR; FLAGYIAAKK; RTIASKMYSK; EFEYIKVLER; IAAKKSFSGK; ETAKNLGDGY; MKGNIVDAFR; MLVDGVLDDK; SANEALLRLK; |

Fig. 32 continued

| | | |
|---|---|---|
| | | ISYGIIDPIY; CAISGVYSSY; GILLTSCFSR; YEIFIKQILK; SYVSDLDNLK; NIVDAFRYGY; DALYLITGEY; NQEEYEIFIK; EVFSCAISGVY; YIAAKKSFSGK; SSYVSDLDNLK; ETAKNLGDGYY; FGILLTSCFSR; FNSSANEALLR; SSANEALLRLK; EFEYIKVLERK; GAFLAGYIAAK; SANEALLRLKK; SNSFSDVDIGR; GMKGNIVDAFR; NEFEYIKVLER; IPENLIAVVFR; SYVSDLDNLKR; SVIKNIGDALY; EYEIFIKQILK; EIIVPCNQEEY; LPNANEFEYIK; ALYLITGEYIK; FSRNGIESSSK; YVIGADQDQSY; DVDIGRTIASK; EGGKVVQMGLR; NLIAVVFRVEQ; LAGIGVIETAK; FIFGILLTSCF |
| | HLA-B0702 | APKNFITSV; IPENLIAVV; NPKISYGII; FPENIEEVF; VIKNIGDAL; APKNFITSVI; IPENLIAVVF; SVIKNIGDAL; LPNANEFEYI; AVVFRVEQGAF |
| | HLA-B0801 | YIKVLERKI; NLKRNGSDL; YIKVLERKII; |
| | HLA-B1501 | FSCAISGVY; IISEYSNSF; ALYLITGEY; AISGVYSSY; YGYESGAKY; EQGAFLAGY; FGILLTSCF; IGADQDQSY; VFRVEQGAF; KSFSGKIGF; YMLTDASLL; GLRDGVIGL; TAKNLGDGY; VQIPENLIA; KDIEIISEY; SSENPKISY; IGLPNANEF; ISMLVDGVL; GMKGNIVDAF; VVFRVEQGAF; YSKGIDVIHF; ISYGIIDPIY; VSSENPKISY; VQIPENLIAV; VIKNIGDALY; VQMGLRDGVI; TAKNLGDGYY; IIVPCNQEEY; VFSCAISGVY; VIGADQDQSY; IGRTIASKMY; CAISGVYSSY; EIISEYSNSF; VIGLPNANEF; YVIGADQDQSY; FIFGILLTSCF; GVIGLPNANEF; SVIKNIGDALY; LVSSENPKISY; VQIPENLIAVV; AVVFRVEQGAF; EVFSCAISGVY; RVEQGAFLAGY; KISYGIIDPIY; KSFNSSANEAL; ANKDIEIISEY; KMYSKGIDVIH; SCAISGVYSSY; YLAPKNFITSV; IEIISEYSNSF; QIPENLIAVVF; GGMKGNIVDAF; EIIVPCNQEEY |
| | HLA-B2705 | FRYGYESGA; FRVEQGAFL; GRTIASKMY; SRNGIESSS; KRNGSDLIW; FRYGYESGAK; SRNGIESSSK; KRNGSDLIWL; MRIVIFIFGI; SRNGIESSSKK; GRTIASKMYSK; KRNGSDLIWLV; MRIVIFIFGIL |
| | HLA-B3501 | FPENIEEVF; LPNANEFEY; TAKNLGDGY; FSCAISGVY; IISEYSNSF; IGADQDQSY; DPIYGDDVQ; MKGNIVDAF; YGYESGAKY; IPENLIAVV; IKNIGDALY; LIWLVGYML; FNSSANEAL; IGLPNANEF; IVPCNQEEY; FGILLTSCF; FRVEQGAFL; SANEALLRL; YMLTDASLL; IPENLIAVVF; DALYLITGEY; TAKNLGDGYY; CAISGVYSSY; FPENIEEVFS; ISYGIIDPIY; IIVPCNQEEY; VFSCAISGVY; NIVDAFRYGY; EIISEYSNSF; DPIYGDDVQI; VVFRVEQGAF; LPNANEFEYI; DFPENIEEVF; VIKNIGDALY; SFNSSANEAL; VPCNQEEYEI; YSKGIDVIHF; ETAKNLGDGY; FAAGLAGIGV; YVIGADQDQSY; VPCNQEEYEIF; EVFSCAISGVY; NVWEGGKVVQM; NANEFEYIKVL; LVSSENPKISY; FIFGILLTSCF; FPENIEEVFSC; LAGYIAAKKSF; FAAGLAGIGVI; RVEQGAFLAGY; SVIKNIGDALY; KISYGIIDPIY; LVDGVLDDKSF; IGLPNANEFEY; QIPENLIAVVF; FRYGYESGAKY; MKGNIVDAFRY; GVIGLPNANEF; AVVFRVEQGAF; NGSDLIWLVGY; EIIVPCNQEEY; TSVIKNIGDAL; LVGYMLTDASL; ETAKNLGDGYY |
| | HLA-B4403 | NEFEYIKVL; KEIIVPCNQ; EEYEIFIKQ; PENLIAVVF; EEVFSCAIS; EEYEIFIKQI; SENPKISYGI; NEFEYIKVLE; GEYIKNNNVW; KEIIVPCNQE; EEVFSCAISG; EEYEIFIKQIL; SENPKISYGII; IEIISEYSNSF; NEFEYIKVLER; YEIFIKQILKL; EEVFSCAISGV; KEIIVPCNQEE; NEALLRLKKDF |
| | HLA-B5101 | IPENLIAVV; NPKISYGII; LPNANEFEYI; DPIYGDDVQI; LAPKNFITSV; APKNFITSVI; IPENLIAVVF; VPCNQEEYEI; LAPKNFITSVI; FPENIEEVFSC |
| | HLA-B5701 | ISYGIIDPIY; TGEYIKNNNVW |
| NP_212518.1 ; Basic | HLA-A0101 | FSDLSVKLSY; TVDEAMTEDAY |
| | HLA-A0201 | AMTEDAYEV; RLVDEVIDL; FIFITLSLL; KIISGEIIV; GLKEGVIEI; |

Fig. 32 continued

| | | |
|---|---|---|
| membrane protein C (bmpC) [Borrelia burgdorferi B31; SEQ ID NO:3, SEQ ID NO: 54935-55486 | | GIFYANPKL; GLNQDQSYI; ITLSLLVFA; RLLTVDEAM; FLAGYIAAK; SIIKDIGKV; SVHDGVVKL; IIVPDSEYA; KSDKVVVGV; KLSYERPDI; YIAPQNVIT; KVGVIFPIA; YANPKLRLV; FMYKEDKVGV; FLAGYIAAKM; FIFITLSLLV; FLTGPMSEHV; VLNNRLVDEV; ALFMYKEDKV; VIYSISSEYI; FITLSLLVFA; WLIGYRFSDL; GLKEGVIEIV; RLVSKKAPSL; KLRDNFGIKL; FGFKAGIFYA; GLNQDQSYIA; YAFDLFKSKL; RLLTVDEAMT; IIDRGLKEGV; ISSEYINNRV; YIAPQNVITSI; FMYKEDKVGVI; KVIYSISSEYI; VIFPIAGITGL; SISSEYINNRV; IIDRGLKEGV; LIGYRFSDLSV; VLNNRLVDEVI; YINNRVFKGGI; FLAGYIAAKMS; GIFYANPKLRL; KMSRKEKIGFL; SLAIKFRNEEA; SFYDKGYNQSV; KLRDNFGIKLI; LITKSLRPYPI; RFIFITLSLLV; KVGVIFPIAGI; GVIEIVKDPDV; GLGVYDAAKEL; IVPDSEYAFDL; SLFDKEKGKAM |
| | HLA-A0301 | KAMALFMYK; FLAGYIAAK; YIAAKMSRK; SLLVFACFK; KLRDNFGIK; GVLAHGSFY; NLFWLIGYR; VIYSISSEY; ALFMYKEDK; LAHGSFYDK; GIIIDRGLK; SLFDKEKGK; VFACFKSNK; IFYANPKLR; MSEHVKDFK; SEYAFDLFK; YAFDLFKSK; FACFKSNKK; KAMALFMYK; FLAGYIAAK; YIAAKMSRK; SLLVFACFK; KLRDNFGIK; GVLAHGSFY; NLFWLIGYR; VIYSISSEY; ALFMYKEDK; LAHGSFYDK; GIIIDRGLK; SLFDKEKGK; VFACFKSNK; IFYANPKLR; MSEHVKDFK; SEYAFDLFK; YAFDLFKSK; FACFKSNKK; LVFACFKSNKK; KSNKKSIKSDK; TLSLLVFACFK; GVLAHGSFYDK; KSLRPYPIEGK; LLVFACFKSNK; RVFKGGIIIDR; FLTGPMSEHVK; KGKAMALFMYK; KLSYERPDIYY; YIAAKMSRKEK; GLKEGVIEIVK; VSKKAPSLFDK; AMALFMYKEDK; AAFLAGYIAAK; IGYRFSDLSVK; YANPKLRLVSK; VITSIIKDIGK; IQVPKNSLAIK; AMTEDAYEVQK; VVGVLAHGSFY; VVKLRDNFGIK; RFSDLSVKLSY; ITGLGVYDAAK; SSEYINNRVFK; AGYIAAKMSRK; SLRPYPIEGKR; PLNLFWLIGYR; RDNFGIKLITK |
| | HLA-A1101 | KAMALFMYK; SLLVFACFK; SEYAFDLFK; YIAAKMSRK; GIIIDRGLK; MSEHVKDFK; TSIIKDIGK; YAFDLFKSK; GVLAHGSFY; ALFMYKEDK; LAHGSFYDK; VIYSISSEY; SLFDKEKGK; AGIFYANPK; NLFWLIGYR; AAKMSRKEK; FLAGYIAAK; ISSEYINNR; FACFKSNKK; VFACFKSNK; QSVHDGVVK; KLRDNFGIK; LSVKLSYER; GLGVYDAAK; EYINNRVFK; LVFACFKSNK; LSLLVFACFK; HVKDFKFGFK; VLAHGSFYDK; KAGIFYANPK; MTEDAYEVQK; ITSIIKDIGK; KVIYSISSEY; SISSEYINNR; MALFMYKEDK; LTGPMSEHVK; AFLAGYIAAK; SVHDGVVKLR; GYIAAKMSRK; GIFYANPKLR; GKAMALFMYK; IAAKMSRKEK; SEYINNRVFK; KAPSLFDKEK; QVPKNSLAIK; SLRPYPIEGK; DSEYAFDLFK; LSYERPDIYY; KAMALFMYKE; PMSEHVKDFK; VFACFKSNKK; PQNVITSIIK; KLITKSLRPY; NQSVHDGVVK; SKKAPSLFDK; TLSLLVFACFK; GVLAHGSFYDK; LVFACFKSNKK; AAFLAGYIAAK; SSEYINNRVFK; KSLRPYPIEGK; AMALFMYKEDK; AMTEDAYEVQK; KSNKKSIKSDK; ITGLGVYDAAK; KGKAMALFMYK; YIAAKMSRKEK; VSKKAPSLFDK; SEYAFDLFKSK; VVKLRDNFGIK; LVDEVIDLENK; VITSIIKDIGK; YANPKLRLVSK; LLVFACFKSNK; RVFKGGIIIDR; VVGVLAHGSFY; AGYIAAKMSRK; YSISSEYINNR; FLTGPMSEHVK; GPMSEHVKDFK; APQNVITSIIK; IGYRFSDLSVK; IVKDPDVLNNR; IQVPKNSLAIK; GLKEGVIEIVK; AFDYGDIQVPK; KLSYERPDIYY; SIIKDIGKVIY |
| | HLA-A2402 | IYSISSEYI; IYYGIIDAF; IFITLSLLV; SYIAPQNVI; RFIFITLSL; LFWLIGYRF; FYANPKLRL; EYINNRVFK; KFGFKAGIF; IVPDSEYAF; VSKKAPSLF; LSLLVFACF; NPLNLFWLI; IFITLSLLVF; RFIFITLSLL; MYKEDKVGVI; MFKRFIFITL; FYANPKLRLV; EVQKNPLNLF; EYAFDLFKSK; PYPIEGKRLL; YYGIIDAFDY; KNPLNLFWLI; EYAFDLFKSKL; RFIFITLSLLV; SYERPDIYYGI; MYKEDKVGVIF; ITLSLLVFACF; AYEVQKNPLNL; IYYGIIDAFDY; GYRFSDLSVKL; |

Fig. 32 continued

| | | |
|---|---|---|
| | | QVPKNSLAIKF |
| | HLA-A2902 | SYERPDIYY; YGIIDAFDY; VIYSISSEY; EIIVPDSEY; FGFKAGIFY; LFWLIGYRF; IVPDSEYAF; HVKDFKFGF; IFITLSLLV; YYGIIDAFDY; IFITLSLLVF; KVIYSISSEY; KLITKSLRPY; KFGFKAGIFY; VIGLNQDQSY; IIKDIGKVIY; PLNLFWLIGY; LSYERPDIYY; DAAKELGPKY; IIVPDSEYAF; IAGITGLGVY; YVIGLNQDQSY; RFSDLSVKLSY; IYYGIIDAFDY; VVGVLAHGSFY; KLSYERPDIYY; SIIKDIGKVIY; EIIVPDSEYAF; YDAAKELGPKY; PIAGITGLGVY; FIFITLSLLVF; FKFGFKAGIFY; TVDEAMTEDAY; QVPKNSLAIKF; PMSEHVKDFKF |
| | HLA-A6801 | NLFWLIGYR; EYINNRVFK; MSEHVKDFK; LSVKLSYER; ISSEYINNR; YIAAKMSRK; FLAGYIAAK; SLLVFACFK; YAFDLFKSK; FACFKSNKK; KAMALFMYK; TSIIKDIGK; IFYANPKLR; SEYAFDLFK; LAHGSFYDK; VIYSISSEY; VFACFKSNK; GYIAAKMSR; DAAKELGPK; GIIDRGLK; EIIVPDSEY; RPYPIEGKR; DYGDIQVPK; ALFMYKEDK; MTEDAYEVQ; QSVHDGVVK; YRFSDLSVK; EAAFLAGYI; MTEDAYEVQK; HVKDFKFGFK; DSEYAFDLFK; LVFACFKSNK; SVHDGVVKLR; SISSEYINNR; GIFYANPKLR; LSLLVFACFK; ITSIIKDIGK; DLSVKLSYER; EYAFDLFKSK; MALFMYKEDK; IAAKMSRKEK; LTGPMSEHVK; GIKLITKSLR; DNFGIKLITK; KVIYSISSEY; SEYINNRVFK; QVPKNSLAIK; LNLFWLIGYR; VFACFKSNKK; LSYERPDIYY; VLAHGSFYDK; FDYGDIQVPK; GYIAAKMSRK; YSISSEYINNR; TLSLLVFACFK; SSEYINNRVFK; LAGYIAAKMSR; YIAAKMSRKEK; LLVFACFKSNK; LVFACFKSNKK; IVKDPDVLNNR; QSVHDGVVKLR; FLTGPMSEHVK; FGIKLITKSLR; RVFKGGIIDR; AAFLAGYIAAK; YANPKLRVSK; ITGLGVYDAAK; YVIGLNQDQSY; VITSIIKDIGK; FKAGIFYANPK; LVDEVIDLENK; IGYRFSDLSVK; EHVKDFKFGFK; AMALFMYKEDK; AMTEDAYEVQK; IYYGIIDAFDY; SLRPYPIEGKR; PLNLFWLIGYR; GVLAHGSFYDK; VVKLRDNFGIK; AGIFYANPKLR; VPKNSLAIKFR |
| | HLA-B0702 | APQNVITSI; YPIEGKRLL; FPIAGITGL; RPDIYYGII; GPKYYVIGL; LVSKKAPSL; QVPKNSLAI; RPYPIEGKRL; APQNVITSII; VPKNSLAIKF; YPIEGKRLLT; GPMSEHVKDF; KLRDNFGIKL; RLVSKKAPSL; RPYPIEGKRLL; YPIEGKRLLTV; FPIAGITGLGV; FKRFIFITLSL; NPKLRLVSKKA |
| | HLA-B0801 | FDKEKGKAM; KEKGKAMAL; FKRFIFITL; MFKRFIFITL; FGIKLITKSL; FDKEKGKAMAL; AIKFRNEEAAF; FMYKEDKVGVI; NPKLRLVSKKA; FKRFIFITLSL |
| | HLA-B1501 | VQKNPLNLF; GVLAHGSFY; VIYSISSEY; AAKELGPKY; KFRNEEAAF; KVVVGVLAH; IVPDSEYAF; EIIVPDSEY; HVKDFKFGF; LITKSLRPY; FITLSLLVF; FGFKAGIFY; LSYERPDIY; PMSEHVKDF; YGIIDAFDY; AGITGLGVY; RLLTVDEAM; LSLLVFACF; IGLNQDQSY; KVIYSISSEY; KLITKSLRPY; LSYERPDIYY; KMSRKEKGF; IIKDIGKVIY; IQVPKNSLAI; AAKELGPKYY; IIVPDSEYAF; IFITLSLLVF; VQKNPLNLFW; VVGVLAHGSF; TLSLLVFACF; IAGITGLGVY; FLAGYIAAKM; KLSYERPDIY; KGKAMALFMY; NLFWLIGYRF; LVSKKAPSLF; WLIGYRFSDL; SSEYINNRVF; YVIGLNQDQSY; ISSEYINNRVF; VVVGVLAHGSF; FIFITLSLLVF; KLSYERPDIYY; AIKFRNEEAAF; RFSDLSVKLSY; SLFDKEKGKAM; VVGVLAHGSFY; LAHGSFYDKGY; EIIVPDSEYAF; FMYKEDKVGVI; RLVSKKAPSLF; VQKNPLNLFWL; SIIKDIGKVIY; PMSEHVKDFKF |
| | HLA-B2705 | YRFSDLSVK; KRFIFITLS; FRNEEAAFL; FKFGFKAGI; KRFIFITLSL; YRFSDLSVKL; KRLLTVDEAM; KRFIFITLSLL; LRLVSKKAPSL; FKFGFKAGIFY; KRLLTVDEAMT |
| | HLA-B3501 | FPIAGITGL; IVPDSEYAF; YPIEGKRLL; LFWLIGYRF; LAGYIAAKM; DPDVLNNRL; IGLNQDQSY; FITLSLLVF; DEAMTEDAY; DSEYAFDLF; EIIVPDSEY; IYYGIIDAF; FGFKAGIFY; NPLNLFWLI; RLLTVDEAM; |

Fig. 32 continued

| | | |
|---|---|---|
| | | VIYSISSEY; LSLLVFACF; LSYERPDIY; YGIIDAFDY; KFRNEEAAF; AAKELGPKY; YIAPQNVIT; IIVPDSEYAF; IAGITGLGVY; VPKNSLAIKF; DIYYGIIDAF; FLAGYIAAKM; DAAKELGPKY; IFITLSLLVF; DAYEVQKNPL; YPIEGKRLLT; YAFDLFKSKL; KVIYSISSEY; NLFWLIGYRF; FSDLSVKLSY; TLSLLVFACF; FPIAGITGLG; VDEAMTEDAY; VPDSEYAFDL; IKFRNEEAAF; EKIGFLTGPM; EAAFLAGYIA; LSYERPDIYY; EAMTEDAYEV; NEEAAFLAGY; NPLNLFWLIGY; TVDEAMTEDAY; YVIGLNQDQSY; VPDSEYAFDLF; LAHGSFYDKGY; EIIVPDSEYAF; FIFITLSLLVF; YPIEGKRLLTV; FPIAGITGLGV; EAAFLAGYIAA; DAAKELGPKYY; ISSEYINNRVF; FKFGFKAGIFY; VVVGVLAHGSF; YEVQKNPLNLF; VVVGVLAHGSFY; RFSDLSVKLSY; ITLSLLVFACF |
| | HLA-B4403 | SEHVKDFKF; KEDKVGVIF; SEYINNRVF; EEAAFLAGY; SEYAFDLFK; GEIIVPDSEY; YEVQKNPLNL; EEAAFLAGYI; NEEAAFLAGY; SEYAFDLFKS; KEKGKAMALF; SEHVKDFKFGF; GEIIVPDSEYA; KEKGKAMALFM; KEDKVGVIFPI; YEVQKNPLNLF; KEKIGFLTGPM; EEAAFLAGYIA |
| | HLA-B5101 | NPLNLFWLI; FPIAGITGL; YPIEGKRLL; APQNVITSI; APQNVITSII; VPKNSLAIKF; IAPQNVITSI; FPIAGITGLG; YPIEGKRLLT; YPIEGKRLLTV; FPIAGITGLGV; IAPQNVITSII |
| | HLA-B5701 | EVQKNPLNLFW |
| NP_212519.1 B; Basic membrane protein D (bmpD) [Borrelia burgdorferi B31; SEQ ID NO:4, SEQ ID NO: 55487-56052 | HLA-A0101 | ASENVSVNY; VLESFMYGY; NSNIKVVSQY; RSEEVAFLAGY |
| | HLA-A0201 | FMGYEAGA; YLAPNNVIV; SIMNGIIKV; LIWGIGFRL; KVYYFLIFL; FLIFLFIVA; KVDSLMYSL; YFLIFLFIV; MLKKVYYFL; FAAAGLSGI; FMLKKVYYF; FLAGYFASK; FLGLKEDGL; YYFLIFLFI; EIYFLYFFI; NLLNISFRS; GLKEDGLGL; NISFRSEEV; FLFIVACSS; KVSYFVLQM; SLTKKYLET; FMLKKVYYFL; FLAGYFASKA; RLSDILFQRA; SVNYAIIEGV; VLDGGKTMFL; MLKKVYYFLI; NLIWGIGFRL; ILFQRASENV; AIIEGVYDEI; GLSGIGVIEA; LMYSLTKKYL; YYFLIFLFIV; YVGTFGDFGL; KLKADLNINI; YEIYFLYFFI; YLAPNNVIVS; FLIFLFIVAC; NMYRDGVDII; KIGQSIMNGI; FLFIVACSSS; FQRASENVSV; GIIKVPYDKV; GLKEDGLGLV; GLGLVLNENL; KKVYYFLIFL; FMLKKVYYFLI; YLAPNNVIVSA; KVYYFLIFLFI; FAAAGLSGIGV; SLTKKYLETGV; SLMYSLTKKYL; LLNISFRSEEV; FLGLKEDGLGL; VLESFMYGYEA; KVPYDKVSYFV; GLSGIGVIEAA; FLIFLFIVACS; GVLDGGKTMFL; FIKSKEDIFML; IIFAAAGLSGI; FLAGYFASKAS; TMFLGLKEDGL; STASNMYRDGV; ELGPDHYIIGV; VYYFLIFLFIV; RLSDILFQRAS; KLKADLNINII; KTGKIGFVGGV; VSVNYAIIEGV; YAIIEGVYDEI |
| | HLA-A0301 | FLAGYFASK; FLYFFIKSK; SLMYSLTKK; RSTASNMYR; RLSDILFQR; IYFLYFFIK; LMYSLTKKY; KGFNESSSS; SSKAIRKLK; KIGFVGGVR; GIIKVPYDK; GYFASKASK; ESSSKAIRK; NVIVSAVKK; KVYYFLIFL; ASKASKTGK; NLIWGIGFR; GLVLNENLK; QSIMNGIIK; FMGYEAGAK; GVYDEIQIPK; AFLAGYFASK; EIYFLYFFIK; AGYFASKASK; IMNGIIKVPY; SLMYSLTKKY; KSKEDIFMLK; YFLYFFIKSK; KSNYSEIYNK; KVLESFMYGY; SSSKAIRKLK; GQSIMNGIIK; LIVDGAFDDK; DSLMYSLTKK; KVYYFLIFLF; VDSLMYSLTK; ADLNINIIEK; YSEIYNKSLK; GTFGDFGLGR; FASKASKTGK; GAKYANSNIK; DIFMLKKVYY; SSDDGKSEAK; GGKTMFLGLK; RASENVSVNY; AVKKVDSLMY; VYYFLIFLFI; KVDSLMYSLTK; KIGFVGGVRGK; VAFLAGYFASK; KSKEDIFMLKK; GLGLVLNENLK; IYFLYFFIKSK; FMGYEAGAKY; IVACSSSDDGK; KVYYFLIFLFI; SIMNGIIKVPY; LAGYFASKASK; ESSSKAIRKLK; NSNLIWGIGFR; SVNYAIIEGVY; GLGRSTASNMY; YFASKASKTGK |
| | HLA-A1101 | SLMYSLTKK; RSTASNMYR; GIIKVPYDK; SSKAIRKLK; QSIMNGIIK; |

Fig. 32 continued

| | | |
|---|---|---|
| | | IYFLYFFIK; NVIVSAVKK; RLSDILFQR; SNYSEIYNK; ASKASKTGK; DSLMYSLTK; FLAGYFASK; FLYFFIKSK; ESSSKAIRK; GYFASKASK; IVDGAFDDK; SKEDIFMLK; KVYYFLIFL; GIGVIEAAK; GLVLNENLK; KGFNESSSK; ASENVSVNY; NLIWGIGFR; VLESFMYGY; VYDEIQIPK; KIGFVGGVR; KTMFLGLKE; DLNINIIEK; KEDIFMLKK; AKYANSNIK; SEIYNKSLK; GKTMFLGLK; GVYDEIQIPK; KSNYSEIYNK; EIYFLYFFIK; KSKEDIFMLK; KVLESFMYGY; SSSKAIRKLK; GTFGDFGLGR; AFLAGYFASK; FMYGYEAGAK; SSDDGKSEAK; VACSSSDDGK; GQSIMNGIIK; DSLMYSLTKK; KVYYFLIFLF; LIVDGAFDDK; SLMYSLTKKY; AGYFASKASK; YSEIYNKSLK; YFLYFFIKSK; AVKKVDSLMY; GAKYANSNIK; RASENVSVNY; SGIGVIEAAK; SKEDIFMLKK; GGKTMFLGLK; IMNGIIKVPY; FASKASKTGK; KVDSLMYSLTK; VAFLAGYFASK; KSKEDIFMLKK; SIMNGIIKVPY; SSSDDGKSEAK; IVACSSSDDGK; SLIVDGAFDDK; KADLNINIIEK; KIGFVGGVRGK; SFMYGYEAGAK; IYFLYFFIKSK; GLGLVLNENLK; SVNYAIIEGVY; KVYYFLIFLFI; LAGYFASKASK; NSNLIWGIGFR; ESSSKAIRKLK; LSGIGVIEAAK; APNNVIVSAVK; YEIYFLYFFIK; RSEEVAFLAGY; LVLNENLKSNY |
| | HLA-A2402 | MDNYYEIYF; DNYYEIYFL; VYYFLIFLF; YYFLIFLFI; YYEIYFLYF; NYYEIYFLY; QYVGTFGDF; IYFLYFFIK; PYDKVSYFV; SYLAPNNVI; SYLGDIANL; KYANSNIKV; FMLKKVYYF; MYRDGVDII; YFLIFLFIV; EIYFLYFFI; YEIYFLYFF; VYYFLIFLFI; YYEIYFLYFF; NYYEIYFLYF; PYDKVSYFVL; IFMLKKVYYF; YYFLIFLFIV; MYRDGVDIIF; KVYYFLIFLF; NYSEIYNKSL; KYANSNIKVV; FFIKSKEDIF; IFAAAGLSGI; SYLAPNNVIV; MLKKVYYFLI; YEIYFLYFFI; KVVSQYVGTF; NYYEIYFLYFF; YYEIYFLYFFI; VYYFLIFLFIV; IFMLKKVYYFL; FMLKKVYYFLI; QYVGTFGDFGL; LYFFIKSKEDI; VYDEIQIPKNL; YYFLIFLFIVA; NYSEIYNKSLK; IWGIGFRLSDI; YFFIKSKEDIF; KKVYYFLIFLF; IYFLYFFIKSK |
| | HLA-A2902 | NYYEIYFLY; VYYFLIFLF; LMYSLTKKY; NYAIIEGVY; IFMLKKVYY; KVPYDKVSY; VLESFMYGY; YYEIYFLYF; YGYEAGAKY; DIFMLKKVY; EVAFLAGYF; YYFLIFLFI; FMLKKVYYF; EIYFLYFFI; MNGIIKVPY; SFRSEEVAF; YEIYFLYFF; ASENVSVNY; YFLIFLFIV; MYGYEAGAKY; IMNGIIKVPY; DIFMLKKVYY; NYYEIYFLYF; DNYYEIYFLY; KVYYFLIFLF; SLMYSLTKKY; YYEIYFLYFF; KVLESFMYGY; YYFLIFLFIV; IIGVDQDQSY; AVKKVDSLMY; VLNENLKSNY; VNYAIIEGVY; VYYFLIFLFI; IFMLKKVYYF; RGKVLESFMY; RASENVSVNY; YIIGVDQDQSY; FMYGYEAGAKY; SIMNGIIKVPY; NYYEIYFLYFF; SVNYAIIEGVY; LVLNENLKSNY; MDNYYEIYFLY; IIKVPYDKVSY; VYYFLIFLFIV; YFFIKSKEDIF; QRASENVSVNY; NMYRDGVDIIF; YYEIYFLYFFI; DIFMLKKVYYF; SAVKKVDSLMY; VRGKVLESFMY; EDIFMLKKVYY |
| | HLA-A6801 | NLIWGIGFR; NVIVSAVKK; RSTASNMYR; RLSDILFQR; FLAGYFASK; ESSSKAIRK; NYYEIYFLY; FLYFFIKSK; IYFLYFFIK; SSKAIRKLK; DSLMYSLTK; ETGVLDGGK; SLMYSLTKK; DLNINIIEK; EVAFLAGYF; NNVIVSAVK; EIYFLYFFI; SNYSEIYNK; QSIMNGIIK; SEIYNKSLK; GIIKVPYDK; MYGYEAGAK; GYFASKASK; NESSSKAIR; GLVLNENLK; TFGDFGLGR; IVDGAFDDK; SKEDIFMLK; EIYFLYFFIK; GTFGDFGLGR; FMYGYEAGAK; YSEIYNKSLK; FASKASKTGK; SSSKAIRKLK; DSLMYSLTKK; DNYYEIYFLY; GVYDEIQIPK; LIVDGAFDDK; NNVIVSAVKK; DIFMLKKVYY; KSNYSEIYNK; VACSSSDDGK; EVAFLAGYFA; YFLYFFIKSK; NSNIKVVSQY; SGIGVIEAAK; KSKEDIFMLK; GAKYANSNIK; FNESSSKAIR; FRLSDILFQR; SNLIWGIGFR; KVYYFLIFLF; NSNLIWGIGFR; ESSSKAIRKLK; IVACSSSDDGK; NYSEIYNKSLK; VAFLAGYFASK; YEIYFLYFFIK; LAGYFASKASK; IPKNLLNISFR; IYFLYFFIKSK; YFASKASKTGK; |

Fig. 32 continued

| | | |
|---|---|---|
| | | MDNYYEIYFLY; EGVYDEIQIPK; SVNYAIIEGVY; NYYEIYFLYFF; SFMYGYEAGAK; FMYGYEAGAKY; EAAKELGPDHY; SLIVDGAFDDK; EVAFLAGYFAS; LGRSTASNMYR; YIIGVDQDQSY; SSSDDGKSEAK; EIYFLYFFIKS; NSYLGDIANLE; MNGIIKVPYDK; SIMNGIIKVPY; LSGIGVIEAAK |
| | HLA-B0702 | APNNVIVSA; VPYDKVSYF; SAVKKVDSL; AIRKLKADL; KASTGNSYL; KVSYFVLQM; APNNVIVSAV; IPKNLLNISF; VPYDKVSYFV; FVGGVRGKVL; GVRGKVLESF; VPYDKVSYFVL; IVSAVKKVDSL |
| | HLA-B0801 | YDKVSYFVL; MLKKVYYFL; FMLKKVYYF; FMLKKVYYFL; MLKKVYYFLI; IPKNLLNISF; FIKSKEDIFM; MLKKVYYFLIF; YDKVSYFVLQM; FIKSKEDIFML; FMLKKVYYFLI |
| | HLA-B1501 | LMYSLTKKY; YGYEAGAKY; FMLKKVYYF; VVSQYVGTF; FQRASENVS; VSLIVDGAF; IGVDQDQSY; GLKEDGLGL; GVLDGGKTM; ASKTGKIGF; SLKIGQSIM; KVPYDKVSY; SFRSEEVAF; GVIEAAKEL; IMNGIIKVPY; SQYVGTFGDF; FQRASENVSV; ISFRSEEVAF; IEKASTGNSY; RASENVSVNY; GVRGKVLESF; AVKKVDSLMY; SLMYSLTKKY; VLNENLKSNY; TVSLIVDGAF; KVLESFMYGY; KVYYFLIFLF; GVLDGGKTMF; VNYAIIEGVY; KVVSQYVGTF; LGRSTASNMY; RGKVLESFMY; AAKELGPDHY; IQIPKNLLNI; NLKSNYSEIY; KASKTGKIGF; IIGVDQDQSY; LMYSLTKKYL; IGFRLSDILF; FMYGYEAGAKY; YIIGVDQDQSY; SIMNGIIKVPY; NMYRDGVDIIF; SVNYAIIEGVY; IIKVPYDKVSY; MLKKVYYFLIF; GLGRSTASNMY; GLKEDGLGLVL; KTVSLIVDGAF; RSEEVAFLAGY; IIEKASTGNSY; LVLNENLKSNY; FQRASENVSVN; VSQYVGTFGDF; YFFIKSKEDIF |
| | HLA-B2705 | YRDGVDIIF; FRSEEVAFL; GRSTASNMY; QRASENVSV; FRLSDILFQR; GRSTASNMYR; KKVDSLMYSL; QRASENVSVNY |
| | HLA-B3501 | YGYEAGAKY; IGVDQDQSY; VPYDKVSYF; VVSQYVGTF; EVAFLAGYF; LKSNYSEIY; VSLIVDGAF; EKASTGNSY; YRDGVDIIF; MDNYYEIYF; YYEIYFLYF; SFRSEEVAF; NYAIIEGVY; YEIYFLYFF; MNGIIKVPY; EEVAFLAGY; LIWGIGFRL; IPKNLLNISF; TVSLIVDGAF; RASENVSVNY; IMNGIIKVPY; KVVSQYVGTF; ISFRSEEVAF; MYRDGVDIIF; MYGYEAGAKY; YVGTFGDFGL; FFIKSKEDIF; KVLESFMYGY; IKVPYDKVSY; YANSNIKVVS; TGVLDGGKTM; IIGVDQDQSY; YYEIYFLYFF; SAVKKVDSLM; APNNVIVSAV; YIIGVDQDQSY; SVNYAIIEGVY; FMYGYEAGAKY; EAAKELGPDHY; SAVKKVDSLMY; SIMNGIIKVPY; VPYDKVSYFVL; NISFRSEEVAF; MDNYYEIYFLY; NMYRDGVDIIF; YFFIKSKEDIF; LVLNENLKSNY; IIEKASTGNSY; KTVSLIVDGAF; IVDGAFDDKGF; YAIIEGVYDEI; FFIKSKEDIFM; TGVLDGGKTMF; DSLMYSLTKKY |
| | HLA-B4403 | EEVAFLAGY; YEIYFLYFF; DEIQIPKNL; KEDGLGLVL; KELGPDHYI; EEVAFLAGYF; SEIYNKSLKI; YEIYFLYFFI; SEEVAFLAGY; SENVSVNYAI; DEIQIPKNLL; SEAKTVSLIV; SEEVAFLAGYF; EEVAFLAGYFA; DEIQIPKNLLN; SENVSVNYAII; KEDIFMLKKVY |
| | HLA-B5101 | VPYDKVSYF; FAAAGLSGI; IPKNLLNIS; VPYDKVSYFV; IPKNLLNISF; VPYDKVSYFVL; LAPNNVIVSAV; FAAAGLSGIGV |
| | HLA-B5701 | ISFRSEEVAF |
| AAC70056.1; Decorin binding protein A; DbpA (Borrelia afzelii; SEQ ID NO:5, SEQ ID NO: | HLA-A0101 | ATEEETITF; FTETQTGGKV; |
| | HLA-A0201 | GIYDLILNA; TLLASLLAA; IILTLTLLA; LTLTLLASL; TTADGIIAI; SLLAACSLT; KIILTLTLL; TADGIIAIV; GMQGMKQAV; VMKAKVENI; LLASLLAAC; GMKQAVEEA; FLEATEEET; GIYDLILNAA; TTADGIIAIV; ILTLTLLASL; FLEATEEETI; RVADLTIKFL; KIILTLTLLA; KVMKAKVENI; LTLTLLASLL; KTTADGIIAI; AIVKVMKAKV; LTLLASLLAA; LLASLLAACS; IILTLTLLASL; LLASLLAACSL; LLAACSLTGKA; ILNAAKAVEKI; KTTADGIIAIV; LTLTLLASLLA; TADGIIAIVKV; ILTLTLLASLL; TLTLLASLLAA; GIIAIVKVMKA |

Fig. 32 continued

| | | |
|---|---|---|
| 56053-56237 | HLA-A0301 | IIAIVKVMK; LAACSLTGK; KARLESSVK; AIVKVMKAK; FTETQTGGK; LLAACSLTGK; ILNAAKAVEK; GIIAIVKVMK; KIRVADLTIK; ATEEETITFK; IAIVKVMKAK; TADGIIAIVK; IYDLILNAAK; VMKAKVENIK; ITNEIEKAIK; AFTETQTGGK; GIYDLILNAAK; SLLAACSLTGK; KVGGSQIRAAK; IIAIVKVMKAK; KVMKAKVENIK; TTADGIIAIVK; LILNAAKAVEK; AVEKIGMQGMK; KVENIKEKQTK; SVKDITNEIEK |
| | HLA-A1101 | IIAIVKVMK; AIVKVMKAK; LAACSLTGK; AVEEAAKEK; KQAVEEAAK; FTETQTGGK; KARLESSVK; ATEEETITFK; GIIAIVKVMK; ILNAAKAVEK; TADGIIAIVK; LLAACSLTGK; ITNEIEKAIK; IAIVKVMKAK; VMKAKVENIK; AACSLTGKAR; KIRVADLTIK; KAKVENIKEK; AFTETQTGGK; TTADGIIAIVK; GIYDLILNAAK; SLLAACSLTGK; SVKDITNEIEK; KVMKAKVENIK; KVGGSQIRAAK; AVEKIGMQGMK; IIAIVKVMKAK; LILNAAKAVEK; AVEEAAKEKPK; KVENIKEKQTK; AIKEAEDAGVK; KQAVEEAAKEK; GMKQAVEEAAK; EATEEETITFK; RVADLTIKFLE; DAFTETQTGGK |
| | HLA-A2402 | KYNKIILTL; DFSGIYDLI; KYNKIILTLT; IYDLILNAAK; KYNKIILTLTL; KFLEATEEETI |
| | HLA-A2902 | RVADLTIKF; GAGEEDFSGIY |
| | HLA-A6801 | IIAIVKVMK; FTETQTGGK; LAACSLTGK; EKIGMQGMK; MKAKVENIK; LNAAKAVEK; AIVKVMKAK; ENIKEKQTK; ITNEIEKAIK; TADGIIAIVK; GIIAIVKVMK; QAVEEAAKEK; ILNAAKAVEK; IAIVKVMKAK; LLAACSLTGK; ATEEETITFK; AACSLTGKAR; TTADGIIAIVK; EATEEETITFK; DAFTETQTGGK; SVKDITNEIEK; IIAIVKVMKAK; LAACSLTGKAR; DITNEIEKAIK; GIYDLILNAAK; NIKEKQTKNQK; DGIIAIVKVMK; LILNAAKAVEK; KVMKAKVENIK; MKAKVENIKEK; SLLAACSLTGK; AVEKIGMQGMK; KVENIKEKQTK; KVGGSQIRAAK |
| | HLA-B0702 | RVADLTIKF; KPKTTADGI; MIKYNKIIL; RAAKIRVADL; KPKTTADGII; RVADLTIKFL; LASLLAACSL; KPKTTADGIIA; MIKYNKIILTL |
| | HLA-B0801 | MIKYNKIIL; YNKIILTLTL; RAAKIRVADL; MIKYNKIILTL |
| | HLA-B1501 | RVADLTIKF; GIIAIVKVM; ATEEETITF; RVADLTIKFL; KIRVADLTIKF; SQIRAAKIRVA |
| | HLA-B2705 | KQAVEEAAK; IRVADLTIKF; IRAAKIRVADL |
| | HLA-B3501 | DAGVKTDAF; RVADLTIKF; ATEEETITF; FSGIYDLIL; EATEEETITF; LASLLAACSL; EDAGVKTDAF; NAAKAVEKIGM; LEATEEETITF; GAGEEDFSGIY; KAVEKIGMQGM |
| | HLA-B4403 | GEEDFSGIY; EEDFSGIYD; NEIEKAIKEA; EEDFSGIYDL; KENGAGEEDF; EEDFSGIYDLI; AEDAGVKTDAF |
| | HLA-B5101 | KPKTTADGI; KPKTTADGII; LASLLAACSL; |
| | HLA-B5701 | ATEEETITF; |
| AAC70057.1; Decorin binding protein A; DbpA [Borrelia garinii]; SEQ ID NO:6, SEQ ID NO: 56238-56436 | HLA-A0101 | SSGAFSAMY; FSAMYDLMI; GSSGAFSAMY; |
| | HLA-A0201 | AMYDLMIDV; ILLKLSLIV; LMIDVSKPL; KLSLIVSLL; KISEKPEFI; SLIVSLLVA; AMEEKLNNV; TTADGIIAI; FILKAKIKA; KILLKLSLI; LSLIVSLLV; FSAMYDLMI; GAFSAMYDL; KLSLIVSLLV; SAMYDLMIDV; KILLKLSLIV; FILKAKIKAI; KMTGTVTKEA; KISEKPEFIL; LLKLSLIVSL; GLTGETKIRL; TTADGIIAIA; AMYDLMIDVS; AIAQAMEEKL; ILLKLSLIVSL; KLSLIVSLLVA; FSAMYDLMIDV; MIDVSKPLEEI; LIVSLLVACGL; LKLSLIVSLLV; GAFSAMYDLMI; LLVACGLTGET; ILKAKIKAIQV; LLKLSLIVSLL |
| | HLA-A0301 | FTNTQTGSK; QTGSKISEK; IKYNKILLK; IQVAERFVK; MIKYNKILLK; IQKMTGTVTK; AIQVAERFVK; AFTNTQTGSK; VACGLTGETK; TQTGSKISEK; GSSGAFSAMY; IAIAQAMEEK; ISEKPEFILK; KPLEEIGIQK; KANAKKEGVK; RLESSAQEIK; MYDLMIDVSK; KIKAIQVAER; AMYDLMIDVSK; KISEKPEFILK; GIQKMTGTVTK; QVAERFVKAIK; MTGTVTKEAEK; NVNKKQHDALK; LVACGLTGETK; KAIQVAERFVK; IIAIAQAMEEK; EINKIKANAKK; EAFTNTQTGSK; |

Fig. 32 continued

| | | |
|---|---|---|
| | | AMEEKLNNVNK; AIKEEAEKLKK |
| | HLA-A1101 | AIAQAMEEK; FTNTQTGSK; IQVAERFVK; QTGSKISEK; SSGAFSAMY; GTVTKEAEK; KAIKEEAEK; IKYNKILLK; SEKPEFILK; MIKYNKILLK; IAIAQAMEEK; AIQVAERFVK; ISEKPEFILK; TQTGSKISEK; VACGLTGETK; KANAKKEGVK; IQKMTGTVTK; VAERFVKAIK; AIKEEAEKLK; GSSGAFSAMY; RLESSAQEIK; AFTNTQTGSK; AQEIKDEINK; KIKAIQVAER; EINKIKANAK; MYDLMIDVSK; AMYDLMIDVSK; KISEKPEFILK; KAIQVAERFVK; SAQEIKDEINK; GIQKMTGTVTK; MTGTVTKEAEK; QVAERFVKAIK; NVNKKQHDALK; AMEEKLNNVNK; NTQTGSKISEK; IIAIAQAMEEK; LVACGLTGETK; KAIKEEAEKLK; AIKEEAEKLKK; EAFTNTQTGSK; FVKAIKEEAEK; EINKIKANAKK |
| | HLA-A2402 | KYNKILLKL; AFSAMYDLMI; KYNKILLKLSL |
| | HLA-A2902 | SSGAFSAMY; ; SGSSGAFSAMY |
| | HLA-A6801 | FTNTQTGSK; QTGSKISEK; AIAQAMEEK; DALKNLEEK; GTVTKEAEK; IKAIQVAER; IQVAERFVK; EFILKAKIK; KAIKEEAEK; SSGAFSAMY; IAIAQAMEEK; EINKIKANAK; MIKYNKILLK; KIKAIQVAER; EIKDEINKIK; TQTGSKISEK; MYDLMIDVSK; VACGLTGETK; ISEKPEFILK; TGTVTKEAEK; VAERFVKAIK; EAFTNTQTGSK; MTGTVTKEAEK; EINKIKANAKK; FVKAIKEEAEK; IIAIAQAMEEK; NVNKKQHDALK; QVAERFVKAIK; NTQTGSKISEK; KAIQVAERFVK; LVACGLTGETK; SAQEIKDEINK; AMYDLMIDVSK; TTADGIIAIAQ |
| | HLA-B0702 | KPEFILKAKI; KPLEEIGIQKM; PPTTADGIIAI |
| | HLA-B0801 | ILKAKIKAI; LLKLSLIVSL; FILKAKIKAI; YNKILLKLSL; KLKKSGSSGAF; LLKLSLIVSLL |
| | HLA-B1501 | LMIDVSKPL; SSGAFSAMY; GIIAIAQAM; KQHDALKNL; IQKMTGTVT; KKSGSSGAF; ILKAKIKAI; KAIQVAERF; GSSGAFSAMY; LLKLSLIVSL; LKKSGSSGAF; GSKISEKPEF; KLKKSGSSGAF; IQVAERFVKAI; KIKAIQVAERF; SGSSGAFSAMY |
| | HLA-B2705 | IRLESSAQEIK |
| | HLA-B3501 | KAIQVAERF; GSSGAFSAM; SSGAFSAMY; KANTAATTT; DGIIAIAQAM; SGSSGAFSAM; GSSGAFSAMY; GAFSAMYDLM; KPLEEIGIQKM; SGSSGAFSAMY; TPPTTADGIIA |
| | HLA-B4403 | EEIGIQKMT; EEIGIQKMTG; SEKPEFILKA; QEIKDEINKI; EEIGIQKMTGT |
| | HLA-B5101 | TPPTTADGI; PPTTADGII; TPPTTADGII; KPEFILKAKI; PPTTADGIIA; PPTTADGIIAI; TPPTTADGIIA |
| | HLA-B5701 | |
| AAC70021.1; Decorin binding protein B; DbpB [Borrelia burgdorferi]; SEQ ID NO:7, SEQ ID NO: 56437-56639 | HLA-A0101 | |
| | HLA-A0201 | AMFDLMLEV; VLFEAFTGL; LMLEVVESL; FLAMFDLML; LLVACSIGL; IVIALFFKL; ALFFKLLVA; LVACSIGLV; GLVERTNAA; RLLAAKAQI; FLKIIEEEA; GLALREAKV; AQIENQLKV; GIIGLKARV; IALFFKLLV; GQFLAMFDL; AMFDLMLEVV; LAMFDLMLEV; KLLVACSIGL; SLEDVGIIGL; LLVACSIGLV; GLVERTNAAL; SIVIALFFKL; KIIEEEALKL; VIALFFKLLV; FLKIIEEEAL; GVLFEAFTGL; IVIALFFKLL; DLMLEVVESL; ALREAKVQAI; ATGKGVLFEA; FLAMFDLMLEV; KLLVACSIGLV; IVIALFFKLLV; VLFEAFTGLKT; LAMFDLMLEVV; MLEVVESLEDV; ALREAKVQAIV; GQFLAMFDLML; SIVIALFFKLL; AIVETGKFLKI |
| | HLA-A0301 | FTGLKTGSK; KIKKEATGK; SIVIALFFK; IVETGKFLK; KIIEEEALK; VTSGGLALR; LFEAFTGLK; VLFEAFTGLK; KVQAIVETGK; AFTGLKTGSK; AIVETGKFLK; KVTSGGLALR; NTAERLLAAK; ALESSSKDLK; KQNIENGGEK; TNAALESSSK; QIENQLKVVK; DLKNKILKIK; IIEEEALKLK; RTNAALESSSK; GVLFEAFTGLK; GLKARVLEESK; ILKIKKEATGK; SLEDVGIIGLK; KIIEEEALKLK; FLKIIEEEALK; TSGGLALREAK; KQNIENGGEKK; SSKDLKNKILK; |

Fig. 32 continued

| | | LVACSIGLVER; EAFTGLKTGSK; AALESSSKDLK |
|---|---|---|
| | HLA-A1101 | SIVIALFFK; IVETGKFLK; KIIEEEALK; SSSKDLKNK; TAERLLAAK; VTSGGLALR; KAQIENQLK; FTGLKTGSK; NAALESSSK; VQAIVETGK; LFEAFTGLK; KIKKEATGK; IVIALFFKL; NQLKVVKEK; KARVLEESK; VLFEAFTGLK; KVQAIVETGK; AIVETGKFLK; NTAERLLAAK; KVTSGGLALR; KQNIENGGEK; ALESSSKDLK; VACSIGLVER; IIEEEALKLK; TNAALESSSK; AFTGLKTGSK; ESSSKDLKNK; QIENQLKVVK; RTNAALESSSK; GVLFEAFTGLK; AALESSSKDLK; SSKDLKNKILK; TSGGLALREAK; SLEDVGIIGLK; QAIVETGKFLK; KIIEEEALKLK; AQIENQLKVVK; AAKAQIENQLK; GLKARVLEESK; LVACSIGLVER; KQNIENGGEKK; EAFTGLKTGSK; IVIALFFKLLV |
| | HLA-A2402 | QFLAMFDLML; FFKLLVACSI; LFFKLLVACSI; KFLKIIEEEAL |
| | HLA-A2902 | IVIALFFKL; |
| | HLA-A6801 | SIVIALFFK; NAALESSSK; VTSGGLALR; IVETGKFLK; EDVGIIGLK; NNPINTAER; FTGLKTGSK; LFEAFTGLK; TAERLLAAK; KIIEEEALK; NIENGGEKK; NTAERLLAAK; VACSIGLVER; VLFEAFTGLK; KVTSGGLALR; ESSSKDLKNK; TNAALESSSK; DVGIIGLKAR; KVQAIVETGK; AIVETGKFLK; KNNPINTAER; LVACSIGLVER; EAFTGLKTGSK; QAIVETGKFLK; RTNAALESSSK; GVLFEAFTGLK; FLKIIEEEALK; TSGGLALREAK; SSKDLKNKILK; EDVGIIGLKAR; SLEDVGIIGLK; SKNNPINTAER; AALESSSKDLK; SKVTSGGLALR |
| | HLA-B0702 | KVTSGGLAL; NPINTAERL; LVERTNAAL; NPINTAERLL; ALREAKVQAI; SKVTSGGLAL; |
| | HLA-B0801 | ILKIKKEAT; LVERTNAAL; FLKIIEEEAL; FFKLLVACSI; |
| | HLA-B1501 | LMLEVVESL; KVTSGGLAL; QAIVETGKF; AMFDLMLEV; FLAMFDLML; GQFLAMFDL; LLVACSIGL; VLFEAFTGL; AQIENQLKV; VQAIVETGKF; GLVERTNAAL; AQIENQLKVV; GQFLAMFDLM; KLKETGNSGQF; KVQAIVETGKF; GQFLAMFDLML; VQAIVETGKFL; GSKVTSGGLAL |
| | HLA-B2705 | GQFLAMFDL; GQFLAMFDLML |
| | HLA-B3501 | NPINTAERL; QFLAMFDLM; LVERTNAAL; EATGKGVLF; QAIVETGKF; FLAMFDLML; NSGQFLAMF; NPINTAERLL; TGNSGQFLAM; ETGNSGQFLAM; LAAKAQIENQL; TGNSGQFLAMF |
| | HLA-B4403 | KETGNSGQF; KEATGKGVLF; EESKNNPINT; AERLLAAKAQI |
| | HLA-B5101 | LAMFDLMLEV; LAMFDLMLEVV |
| | HLA-B5701 | |
| NP_212694.1; Heat shock protein 90 [Borrelia burgdorferi B31]; SEQ ID NO:8, SEQ ID NO: 56640-57579 | HLA-A0101 | DTEVNDLLY; NLEYTNLFY; KSEIKAEEY; YLNKEGLEY; KAEEYNEFY; WSSDGKTGY; ITDSEGSLL; IIDSNDPTY; HTKAEGNLEY; YSNHINYPIY; DSEGSLLPNY; ASDAIDKLKF; SVDGFVSFKEY; QFDTEVNDLLY |
| | HLA-A0201 | LLYLIIHSL; FINIINEFI; IMLSMGQEV; FLRELISNA; FIIFRLCYI; IMDDELDEA; FIVSEKVEV; LLPNYLRFI; KILSELEKL; KLFINRIFI; KLEKISILL; QMQKIMLSM; ELDEAILNL; YLIIHSLYS; LLFEEAMLT; IALFIIFRL; KALESDAYI; NLIPEYEGL; TTFDYENPL; ILLFEEAML; RLCYIIKKV; NILKENPIV; LEYTNLFYV; ILKDHIKEV; IIFRLCYII; ILIFYFKQI; IIDCQDLPL; YSNHINYPI; YQMQKIMLS; TLIKEPSAI; FITDSEGSL; KLYLNKEGL; RMNESQKSI; SAFIVSEKV; ASLIGQFGV; NLFYVPSKA; SMGQEVKEI; GVGFYSAFI; EVNDLLYLI; YLNKEGLEYA; SLLPNYLRFI; IMDDELDEAI; SLYSHKEIFL; YQMQKIMLSM; NLEYTNLFYV; FIIFRLCYII; SLIRFKSSSV; LIMDDELDEA; KIMLSMGQEV; GIIDCQDLPL; ILSKIKSSSV; QIALFIIFRL; FITDSEGSLL; KLNETTALWT; ALWTKNKSEI; ELDEAILNLI; KLFINRIFIT; LLFEEAMLTS; LIFYFKQIAL; KISILLFEEA; YSAFIVSEKV; GQFGVGFYSA; YIIKKVKIKL; MILIFYFKQI; AIDKLKFLSL; GVGFYSAFIV; TLIKEPSAII; DLLYLIIHSL; ILIKDNGIGM; FYFKQIALFI; TTFDYENPLM; YANKWKIQEI; SILLFEEAML; YVPSKAPYDL; KLISLIRFKS; FRLCYIIKKV; ILIFYFKQIA; LIPEYEGLKL; SASLIGQFGV; SLTNEKFKNI; ILLFEEAMLT; |

Fig. 32 continued

| | | |
|---|---|---|
| | | KQFDTEVNDL; KQIALFIIFRL; IMDDELDEAIL; ALFIIFRLCYI; KILSKIKSSSV; LIMDDELDEAI; ILIFYFKQIAL; GMDEQDLTNHL; KQFDTEVNDLL; IIDCQDLPLNV; ILNLIPEYEGL; ILIMDDELDEA; MLSMGQEVKEI; IINEFIEKDFL; NLIPEYEGLKL; LLYLIIHSLYS; YSNHINYPIYI; TLIKEPSAIII; GNLEYTNLFYV; ILQQNKILSKI; KSASLIGQFGV; FYSAFIVSEKV; SAFIVSEKVEV; MILIFYFKQIA; FYFKQIALFII; ILKDHIKEVNL; RLCYIIKKVKI; GMPSKNPGKFI |
| | HLA-A0301 | KLISLIRFK; IIHSLYSHK; MLTSGMPSK; KIKSSSVKK; SIYYITGGK; HINYPIYIK; KLSKKNPEK; GLKLKAINK; KLKRKSCMK; GVIAKSGTK; SVDGFVSFK; TTALWTKNK; YSAFIVSEK; LQQNKILSK; KVKIKLRRK; MLSMGQEVK; KFLSLTNEK; GMPSKNPGK; QIALFIIFR; ILELNPNNK; LTKVKEILK; IFRLCYIIK; YLNKEGLEY; GVYSDFENR; KIQEIIKKY; NIINEFIEK; LSLTNEKFK; YSHKEIFLR; GLEYANKWK; GSLLPNYLR; KSIYYITGGK; RLCYIKKVK; KLKRKSCMKK; AMLTSGMPSK; LIIHSLYSHK; ILQQNKILSK; SSVDGFVSFK; ILSELEKLSK; LLYLIIHSLY; IIFRLCYIIK; ITGGKENILK; LTNHLGVIAK; IMLSMGQEVK; TLTKVKEILK; FYSAFIVSEK; YTNLFYVPSK; ALFIIFRLCY; HINYPIYIKY; LLPNYLRFIK; LSKIKSSSVK; YIKYSEPIMK; IIKKVKIKLK; KENPIVAAYK; KFKNIALEPK; FLSLTNEKFK; GTKEFINNLK; IFRLCYIIKK; GTEIKLYLNK; KQIALFIIFR; LYLNKEGLEY; LIGQFGVGFY; EVNLSATLIK; NLIPEYEGLK; IKLKRKSCMK; LFYVPSKAPY; FINNLKQDEK; KTGYEIEKAK; VYSDFENREK; LGVIAKSGTK; CYIKKVKIK; GNLEYTNLFY; SFDDKSILIK; RMNESQKSIY; KNLEPEKLEK; DAYIWSSDGK; SKIKSSSVKK; SGMPSKNPGK; ININEFIEK; ISNASDAIDK; YYPNTKPGVK; SMGQEVKEIK; NHINYPIYIK; IIFRLCYIIKK; ILSKIKSSSVK; KLKFLSLTNEK; RMNESQKSIYY; KLNETTALWTK; SLLPNYLRFIK; SLYSHKEIFLR; KILSELEKLSK; HLGVIAKSGTK; YLIIHSLYSHK; ILSELEKLSKK; KIMLSMGQEVK; GFYSAFIVSEK; FIIFRLCYIIK; KLYLNKEGLEY; ISFDDKSILIK; GVYSDFENREK; FINIINEFIEK; KIKLKRKSCMK; LSKIKSSSVKK; IVSEKVEVTSK; SSSVDGFVSFK; KFLSLTNEKFK; SLIGQFGVGFY; ALWTKNKSEIK; SVKKILSELEK; KTGYEIEKAKK; TSGMPSKNPGK; VSEKVEVTSKK; IIKKVKIKLKR; YIIKKVKIKLK; EILQQNKILSK; NVSREILQQNK; KVKEILKDHIK; LISNASDAIDK; FINNLKQDEKK; IIKKYSNHINY; NLFYVPSKAPY; YITGGKENILK; VQNLKNLEPEK; ILKENPIVAAY; IALFIIFRLCY; LYYPNTKPGVK; TSNELKDENFK; DSNDPTYQMQK; LSMGQEVKEIK |
| | HLA-A1101 | SVDGFVSFK; SIYYITGGK; TTALWTKNK; GVIAKSGTK; KLISLIRFK; HINYPIYIK; MLTSGMPSK; YSAFIVSEK; NIINEFIEK; IIHSLYSHK; GVYSDFENR; GSLLPNYLR; KIKSSSVVK; QIALFIIFR; LQQNKILSK; KLSKKNPEK; ASDAIDKLK; AILNLIPEY; LTKVKEILK; KFLSLTNEK; TNLFYVPSK; MLSMGQEVK; LSLTNEKFK; GLKLKAINK; KIEISFDDK; AYIWSSDGK; KVKIKLKRK; LSELEKLSK; TEIKLYLNK; GMPSKNPGK; LIPEYEGLK; YSHKEIFLR; ILELNPNNK; KLKRKSCMK; LPNYLRFIK; GFVSFKEYK; VNLSATLIK; YIIKKVKIK; TNHLGVIAK; NLKNLEPEK; SSVDGFVSFK; AMLTSGMPSK; YTNLFYVPSK; KSIYYITGGK; KQIALFIIFR; IIFRLCYIIK; LTNHLGVIAK; LIIHSLYSHK; GTEIKLYLNK; GTKEFINNLK; ISNASDAIDK; KAEEYNEFYK; ITGGKENILK; ILQQNKILSK; TLTKVKEILK; EVNLSATLIK; IMLSMGQEVK; ETTALWTKNK; ALFIIFRLCY; ILSELEKLSK; KTGYEIEKAK; VSEKVEVTSK; KLKRKSCMKK; RLCYIKKVK; SFDDKSILIK; YIKYSEPIMK; IIKKVKIKLK; LLPNYLRFIK; VSREILQQNK; SMGQEVKEIK; PILELNPNNK; FINNLKQDEK; LSKIKSSSVK; SGMPSKNPGK; LSELEKLSKK; NLIPEYEGLK; NASDAIDKLK; DAYIWSSDGK; LLYLIIHSLY; QQNKILSKIK; FLSLTNEKFK; FYSAFIVSEK; HINYPIYIKY; KFKNIALEPK; KENPIVAAYK; IIIDSNDPTY; |

Fig. 32 continued

| | | |
|---|---|---|
| | | INIINEFIEK; SSSVDGFVSFK; IIFRLCYIIKK; SLLPNYLRFIK; TSNELKDENFK; KIMLSMGQEVK; GVYSDFENREK; SVKKILSELEK; KILSELEKLSK; ISFDDKSILIK; KLNETTALWTK; TSGMPSKNPGK; SLYSHKEIFLR; IVSEKVEVTSK; YLIIHSLYSHK; FIIFRLCYIIK; GFYSAFIVSEK; KLKFLSLTNEK; FINIINEFIEK; VQNLKNLEPEK; DSNDPTYQMQK; NVSREILQQNK; EAMLTSGMPSK; KTGYEIEKAKK; LSMGQEVKEIK; APYDLYYPNTK; SLIGQFGVGFY; LISNASDAIDK; IALFIIFRLCY; TTFDYENPLMH; ILSKIKSSSVK; VSEKVEVTSKK; YITGGKENILK; KVKEILKDHIK; ILSELEKLSKK; KFLSLTNEKFK; YIIKKVKIKLK; KIKLRKSCMK; DTLTKVKEILK; SVDGFVSFKEY; LSKIKSSSVKK; RMNESQKSIYY; SGTEIKLYLNK; IYIKYSEPIMK; EILQQNKILSK; LQQNKILSKIK; ALWTKNKSEIK; LIPEYEGLKLK; KLYLNKEGLEY; KYSEPIMKDGK; SGTKEFINNLK; FINNLKQDEKK; KPILELNPNNK; HLGVIAKSGTK; AIIIDSNDPTY; SNHINYPIYIK |
| | HLA-A2402 | IYIKYSEPI; FYFKQIALF; KFINIINEF; LYLIIHSLY; AYKEKGFEI; YFKQIALFI; TYQMQKIML; LYSHKEIFL; NYLRFIKGI; CYIIKKVKI; DYENPLMHI; KQIALFIIF; SLLPNYLRF; FYKNTTFDY; YYPNTKPGV; SFDDKSILI; LWTKNKSEI; AYIWSSDGK; KFSEFSKEF; NFKKIEEEF; KYSNHINYPI; FYFKQIALFI; IFYFKQIALF; KFLSLTNEKF; KFINIINEFI; IYIKYSEPIM; YFKQIALFII; NYLRFIKGII; YYITGGKENI; QFGVGFYSAF; RFKSSSVDGF; YYPNTKPGVK; EYEGLKLKAI; AYKEKGFEIL; IFITDSEGSL; LFIIFRLCYI; FYSAFIVSEK; LYSHKEIFLR; FYFKQIALFII; EYANKWKIQEI; EYNEFYKNTTF; YFKQIALFIIF; YYPNTKPGVKL; YYITGGKENIL; AYKEKGFEILI; IYIKYSEPIMK; IFITDSEGSLL; IFYFKQIALFI; IYYITGGKENI; FYVPSKAPYDL; TYQMQKIMLSM; VYSDFENREKL; KYSNHINYPIY; LFIIFRLCYII; CYIIKKVKIKL; EYTNLFYVPSK; KFKNIALEPKI; QFGVGFYSAFI; FYSAFIVSEKV; TFDYENPLMHI |
| | HLA-A2902 | FYKNTTFDY; YLNKEGLEY; LFIIFRLCY; FYVPSKAPY; INYPIYIKY; NLEYTNLFY; LYLIIHSLY; SKAPYDLYY; TKAEGNLEY; DTEVNDLLY; FYFKQIALF; KFINIINEF; AILNLIPEY; YSNHINYPI; IIDSNDPTY; KIQEIIKKY; EFYKNTTFDY; HINYPIYIKY; YSNHINYPIY; LYLNKEGLEY; LFYVPSKAPY; IIDSNDPTYI; IWSSDGKTGY; LLYLIIHSLY; ALFIIFRLCY; EAILNLIPEY; HTKAEGNLEY; FDTEVNDLLY; LIGQFGVGFY; KFLSLTNEKF; IFYFKQIALF; RMNESQKSIY; PSKAPYDLYY; YVPSKAPYDLY; YIWSSDGKTGY; IALFIIFRLCY; KLYLNKEGLEY; NLFYVPSKAPY; RMNESQKSIYY; QFDTEVNDLLY; YFKQIALFIIF; DLLYLIIHSLY; EYNEFYKNTTF; KYSNHINYPIY; SLIGQFGVGFY; EGNLEYTNLFY; EFGRCIKEGVY; AIIIDSNDPTY; ILKENPIVAAY; NEFYKNTTFDY; NHINYPIYIKY; EIKAEEYNEFY; IIKKYSNHINY; KWKIQEIIKKY |
| | HLA-A6801 | YSAFIVSEK; QIALFIIFR; YSHKEIFLR; TTALWTKNK; SIYYITGGK; SVDGFVSFK; HINYPIYIK; MLTSGMPSK; GVYSDFENR; NIINEFIEK; ENPIVAAYK; MLSMGQEVK; IIHSLYSHK; ELKDENFKK; LPNYLRFIK; EKVEVTSKK; NLKNLEPEK; VSFKEYKER; TKEFINNLK; GFVSFKEYK; GSLLPNYLR; LTKVKEILK; WTKNKSEIK; SEFSKEFGR; LIPEYEGLK; TNLFYVPSK; EEFKDTLTK; NNKIVQNLK; YIIKKVKIK; EGIEEKEEK; GVIAKSGTK; LSLTNEKFK; AYIWSSDGK; KLISLIRFK; YSDFENREK; NPLMHIHTK; DTEVNDLLY; TGYEIEKAK; MGQEVKEIK; SNASDAIDK; ETTALWTKNK; YTNLFYVPSK; FSEFSKEFGR; EVNLSATLIK; SSVDGFVSFK; FVSFKEYKER; DAYIWSSDGK; FYSAFIVSEK; NASDAIDKLK; GTKEFINNLK; LIIHSLYSHK; EGVYSDFENR; TLTKVKEILK; EAILNLIPEY; EGSLLPNYLR; KSIYYITGGK; FLSLTNEKFK; FINNLKQDEK; NLIPEYEGLK; YIKYSEPIMK; LYSHKEIFLR; EFYKNTTFDY; IIFRLCYIIK; NFKKIEEEFK; FSKEFGRCIK; LTNHLGVIAK; NPEKFSEFSK; TTFDYENPLM; DGFVSFKEYK; |

Fig. 32 continued

| | | |
|---|---|---|
| | | KAEEYNEFYK; LLYLIIHSLY; NPIVAAYKEK; YSEPIMKDGK; ISNASDAIDK; YSNHINYPIY; ITGGKENILK; HINYPIYIKY; ENPLMHIHTK; TGYEIEKAKK; KQIALFIIFR; INIINEFIEK; LLPNYLRFIK; IIKKVKIKLK; LSKIKSSSVK; NHINYPIYIK; HTKAEGNLEY; EFKDTLTKVK; IIDSNDPTY; LKFLSLTNEK; SLYSHKEIFLR; EAMLTSGMPSK; TSNELKDENFK; DSNDPTYQMQK; FINIINEFIEK; EYTNLFYVPSK; FIIFRLCYIIK; SSSVDGFVSFK; YITGGKENILK; IIFRLCYIIKK; YLIIHSLYSHK; SVKKILSELEK; ENFKKIEEEFK; NVSREILQQNK; ISFDDKSILIK; GVYSDFENREK; EFINNLKQDEK; LSMGQEVKEIK; FINNLKQDEKK; IIKKVKIKLKR; DTLTKVKEILK; YIIKKVKIKLK; EYKERMNESQK; TTFDYENPLMH; ILSKIKSSSVK; IVSEKVEVTSK; NPNNKIVQNLK; EIKAEEYNEFY; EILQQNKILSK; EFSKEFGRCIK; LISNASDAIDK; GFYSAFIVSEK; IYIKYSEPIMK; EKFKNIALEPK; NLFYVPSKAPY; DLTNHLGVIAK; FKQIALFIIFR; ENPIVAAYKEK; TSGMPSKNPGK; VSEKVEVTSKK; SLIGQFGVGFY; LSKIKSSSVKK; YVPSKAPYDLY; SNASDAIDKLK; LYYPNTKPGVK; SLLPNYLRFIK; SDAYIWSSDGK; GFVSFKEYKER; KFSEFSKEFGR; TKPGVKLFINR; NTTFDYENPLM; IALFIIFRLCY; EEFKDTLTKVK; KIMLSMGQEVK; SGTKEFINNLK; EVNDLLYLIIH; LIPEYEGLKLK; EAILNLIPEYE; EPKIEISFDDK; ILSELEKLSKK; DLLYLIIHSLY; IKAEEYNEFYK; HLGVIAKSGTK; KTGYEIEKAKK |
| | HLA-B0702 | MPSKNPGKF; IPEYEGLKL; VPSKAPYDL; LPLNVSREI; YPIYIKYSE; LIRFKSSSV; SVKKILSEL; YPNTKPGVKL; MPSKNPGKFI; LPLNVSREIL; KVEVTSKKAL; NPNNKIVQNL; YPIYIKYSEPI; YPNTKPGVKLF; LPNYLRFIKGI; KPGVKLFINRI; IPEYEGLKLKA; DPTYQMQKIML; SATLIKEPSAI; AAYKEKGFEIL; EPEKLEKISIL |
| | HLA-B0801 | IDKLKFLSL; NEKFKNIAL; IIKKVKIKL; QMQKIMLSM; IFYFKQIAL; FIIFRLCYI; YLRFIKGII; KIKLKRKSCM; YIIKKVKIKL; HIKEVNLSATL; YFKQIALFIIF; ILIFYFKQIAL |
| | HLA-B1501 | KQIALFIIF; YLNKEGLEY; SSVDGFVSF; WSSDGKTGY; RMNESQKSI; FGVGFYSAF; IAKSGTKEF; QMQKIMLSM; KFINIINEF; FLSLTNEKF; KFSEFSKEF; LLYLIIHSL; KENPIVAAY; KIQEIIKKY; LFIIFRLCY; AILNLIPEY; KSASLIGQF; SLLPNYLRF; TKAEGNLEY; YQMQKIMLS; KLNETTALW; LIGQFGVGF; NTKPGVKLF; IKAEEYNEF; INYPIYIKY; IGQFGVGFY; FYVPSKAPY; YQMQKIMSM; RMNESQKSIY; HTKAEGNLEY; YSNHINYPIY; LLYLIIHSLY; SLIGQFGVGF; LFYVPSKAPY; IIDSNDPTY; KQFDTEVNDL; ALFIIFRLCY; SSSVDGFVSF; VIAKSGTKEF; GVKLFINRIF; YLIIHSLYSH; IVAAYKEKGF; HINYPIYIKY; ILIKDNGIGM; IINEFIEKDF; GQFGVGFYSA; PSKAPYDLYY; RFKSSSVDGF; ALEPKIEISF; QFGVGFYSAF; LIGQFGVGFY; KLEKISILLF; EIKAEEYNEF; GQFGVGFYSAF; RMNESQKSIYY; ILKENPIVAAY; GVIAKSGTKEF; SLIGQFGVGFY; KLYLNKEGLEY; KQIALFIIFRL; NLFYVPSKAPY; KQFDTEVNDLL; YFKQIALFIIF; KSSSVDGFVSF; AIIIDSNDPTY; YIWSSDGKTGY; IIKKYSNHINY; TSKKALESDAY; IALEPKIEISF; LIFYFKQIALF; YVPSKAPYDLY; ASLIGQFGVGF; HIKEVNLSATL; ILIFYFKQIAL; IALFIIFRLCY; RIFITDSEGSL; KNKSEIKAEEY |
| | HLA-B2705 | FRLCYIIKK; KQIALFIIF; LQQNKILSK; GRCIKEGVY; KKVKIKLKR; SREILQQNK; YQMQKIMLSM; KRKSCMKKQF; FRLCYIIKKV; KQIALFIIFR; FRLCYIIKKVK; GQFGVGFYSAF; IRFKSSSVDGF; KQIALFIIFRL; ERMNESQKSIY; NREKLISLIRF |
| | HLA-B3501 | MPSKNPGKF; FYVPSKAPY; FGVGFYSAF; WSSDGKTGY; IIDSNDPTY; SSVDGFVSF; KAEEYNEFY; TKAEGNLEY; IPEYEGLKL; TTFDYENPL; YLNKEGLEY; IAKSGTKEF; DTEVNDLLY; NASDAIDKL; YIKYSEPIM; EILMDDEL; KENPIVAAY; SILLFEEAM; KFINIINEF; LPLNVSREI; KKALESDAY; TFDYENPLM; LISNASDAI; YPIYIKYSE; EKLNETTAL; |

Fig. 32 continued

| | | |
|---|---|---|
| | | FYFKQIALF; IIDCQDLPL; AILNLIPEY; SKAPYDLYY; IKAEEYNEF; MNESQKSIY; NLEYTNLFY; NPLMHIHTK; EAILNLIPEY; DPTYQMQKIM; YSNHINYPIY; IIIDSNDPTY; VPSKAPYDLY; LPLNVSREIL; YPNTKPGVKL; LFYVPSKAPY; TTFDYENPLM; ISILLFEEAM; LKENPIVAAY; QFGVGFYSAF; SSSVDGFVSF; FDTEVNDLLY; NPNNKIVQNL; YNEFYKNTTF; FKQIALFIIF; EGNLEYTNLF; EFYKNTTFDY; NKSEIKAEEY; HTKAEGNLEY; MDDELDEAIL; IKAEEYNEFY; YQMQKIMLSM; YPNTKPGVKLF; VPSKAPYDLYY; YIWSSDGKTGY; YPIYIKYSEPI; NASDAIDKLKF; IALFIIFRLCY; YFKQIALFIIF; DPTYQMQKIML; IALEPKIEISF; NLFYVPSKAPY; ILKENPIVAAY; LFEEAMLTSGM; AIIIDSNDPTY; TSKKALESDAY; FVSFKEYKERM; YVPSKAPYDLY; QFDTEVNDLLY; EPEKLEKISIL; NPLMHIHTKAE; LIFYFKQIALF; SVDGFVSFKEY; ERMNESQKSIY; EVNDLLYLIIH; DEAILNLIPEY; EYNEFYKNTTF; YKEKGFEILIM |
| | HLA-B4403 | KEIKPILEL; KENPIVAAY; NEFYKNTTF; EEAMLTSGM; KEFINNLKQ; NESQKSIYY; EEFKDTLTK; SEGSLLPNY; REILQQNKI; SEIKAEEYN; TEIKLYLNK; NEFIEKDFL; KEVNLSATL; SEFSKEFGR; TEVNDLLYL; LEKISILLF; KEKGFEILI; QEVKEIKPI; KEILKDHIK; KEIFLRELI; REILQQNKIL; REKLISLIRF; DELDEAILNL; KEIFLRELIS; KEVNLSATLI; SEGSLLPNYL; AEGNLEYTNL; EEFKDTLTKV; EEKLNETTAL; FEILMDDEL; KEKGFEILIM; KEGLEYANKW; EESGTEIKLY; QEVKEIKPIL; SEIKAEEYNE; KEPSAIIIDS; KEFINNLKQD; TEVNDLLYLI; SEIKAEEYNEF; AEGNLEYTNLF; SEFSKEFGRCI; REILQQNKILS; NEFYKNTTFDY; KEILKDHIKEV; EEKLNETTALW; EEAMLTSGMPS; EESGTEIKLYL; EEFKDTLTKVK; TEVNDLLYLII; DEAILNLIPEY; RELISNASDAI; KEVNLSATLIK; DELDEAILNLI; TEIKLYLNKEG; KEESGTEIKLY; KENILKENPIV; KEFGRCIKEGV |
| | HLA-B5101 | LPLNVSREI; IALEPKIEI; NPGKFINII; MPSKNPGKFI; LPLNVSREIL; EPEKLEKISI; YPNTKPGVKL; YPIYIKYSEPI; LPNYLRFIKGI; KPGVKLFINRI |
| | HLA-B5701 | EGLEYANKW; KLNETTALW; KALESDAYIW; HTKAEGNLEY; |
| CAA44492.1 Outer surface protein A [Borrelia burgdorferi]; SEQ ID NO:9, SEQ ID NO: 57580-57833 | HLA-A0101 | |
| | HLA-A0201 | YLLGIGLIL; FTLEGTLAA; KTSTLTISV; FTKEDTITV; ALIACKQNV; LLGIGLILA; SLEATVDKL; ILKSGEITV; KVTEGTVVL; STLDEKNSV; TLVSKKVTL; GIGLILALI; YLLGIGLILA; TLDEKNSVSV; ALDDSDTTQA; LLGIGLILAL; NILKSGEITV; TLAADGKTTL; VLKDFTLEGT; YSLEATVDKL; YLLGIGLILAL; LVFTKEDTITV; LLGIGLILALI; ILALIACKQNV; STLDEKNSVSV; ALDDSDTTQAT; VLKDFTLEGTL; SLEATVDKLEL; ILKSGEITVAL; ALIACKQNVST; TTLKVTEGTVV; LAADGKTTLKV; LIACKQNVSTL |
| | HLA-A0301 | VVLSKNILK; KTKNLVFTK; LVSKKVTLK; LILALIACK; LTISVNSQK; KAVEITTLK; AADGKTTLK; ISVNSQKTK; RANGTRLEY; SQTKFEIFK; KSDGSGKAK; TQATKKTGK; MTELVSKEK; TLVSKKVTLK; TLTISVNSQK; TVVLSKNILK; GLILALIACK; TLKELKNALK; LSQTKFEIFK; LAADGKTTLK; VTEGTVVLSK; KLELKGTSDK; TTQATKKTGK; GMTELVSKEK; KYSLEATVDK; KQNVSTLDEK; TIADDLSQTK; TISVNSQKTK; KEDAKTLVSK; GSGKAKEVLK; KTIVRANGTR; GTLEGEKTDK; GKAVEITTLK; GTRLEYTDIK; VSKKVTLKDK; IKSDGSGKAK; TLAADGKTTLK; STLTISVNSQK; KTLVSKKVTLK; KVTEGTVVLSK; TTLKELKNALK; LTISVNSQKTK; GTVVLSKNILK; FTKEDTITVQK; IVRANGTRLEY; TLKDKSSTEEK; LVSKKVTLKDK; KFNEKGETSEK; LTIADDLSQTK; SQKTKNLVFTK; KSSTEEKFNEK; ATKKTGKWDSK |
| | HLA-A1101 | VVLSKNILK, KTKNLVFTK, SQTKFEIFK, LTISVNSQK, ATVDKLELK, LILALIACK, STEEKFNEK, KAVEITTLK, LVSKKVTLK, MTELVSKEK, |

Fig. 32 continued

| | | |
|---|---|---|
| | | AADGKTTLK; SAGTNLEGK; YSLEATVDK; GSGTLEGEK; TQATKKTGK; RANGTRLEY; IADDLSQTK; ISVNSQKTK; KSDGSGKAK; GGMTELVSK; TEGTVVLSK; EITTLKELK; TIVRANGTR; TVVLSKNILK; TTQATKKTGK; TIADDLSQTK; VTEGTVVLSK; LSQTKFEIFK; SSTEEKFNEK; GLILALIACK; KQNVSTLDEK; TLTISVNSQK; TLVSKKVTLK; TISVNSQKTK; LAADGKTTLK; GMTELVSKEK; TLKELKNALK; KTIVRANGTR; GSGKAKEVLK; GTLEGEKTDK; VSKKVTLKDK; GTRLEYTDIK; KLELKGTSDK; DSAGTNLEGK; STLTISVNSQK; TTLKELKNALK; KVTEGTVVLSK; KTLVSKKVTLK; GTVVLSKNILK; LTIADDLSQTK; TLAADGKTTLK; AVEITTLKELK; LTISVNSQKTK; SQKTKNLVFTK; KSSTEEKFNEK; ATKKTGKWDSK; TLKDKSSTEEK; FTKEDTITVQK; TLEGTLAADGK; LVSKKVTLKDK; MTELVSKEKDK; DLSQTKFEIFK; YTDIKSDGSGK; LVSKEKDKDGK; KFNEKGETSEK; IGLILALIACK |
| | HLA-A2402 | KYLLGIGLI; KWDSKTSTL; KYDSAGTNL; KYLLGIGLIL; KWDSKTSTLTI; KYSLEATVDKL |
| | HLA-A2902 | IVRANGTRLEY; TIADDLSQTKF |
| | HLA-A6801 | LTISVNSQK; ETSEKTIVR; MTELVSKEK; EITTLKELK; TIVRANGTR; KAVEITTLK; DAKTLVSKK; KTKNLVFTK; STEEKFNEK; ATVDKLELK; LVSKKVTLK; SQTKFEIFK; YSLEATVDK; EGTLAADGK; ISVNSQKTK; LILALIACK; DIKSDGSGK; VVLSKNILK; EDAKTLVSK; DSDTTQATK; SAGTNLEGK; TVVLSKNILK; TLTISVNSQK; EATVDKLELK; TIADDLSQTK; DSAGTNLEGK; TTQATKKTGK; LAADGKTTLK; KTIVRANGTR; TISVNSQKTK; TLVSKKVTLK; SSTEEKFNEK; TLKELKNALK; LSQTKFEIFK; VTEGTVVLSK; EDAKTLVSKK; DSDTTQATKK; GLILALIACK; |
| | HLA-B0702 | IVRANGTRL; KVTEGTVVL; LAADGKTTL; LPGGMTELV; TVVLSKNIL; KAVEITTLKEL |
| | HLA-B0801 | TLKELKNAL; ILKSGEITVAL; YLLGIGLILAL; TLKVTEGTVVL |
| | HLA-B1501 | SQKTKNLVF; RANGTRLEY; YLLGIGLIL; KVTEGTVVL; TLKELKNAL; KAKEVLKDF; IVRANGTRL; LGIGLILAL; TLAADGKTTL; IVRANGTRLEY; YLLGIGLILAL; VQKYDSAGTNL; ILKSGEITVAL; VSKEKDKDGKY; VLKDFTLEGTL; TLKVTEGTVVL; VNSQKTKNLVF |
| | HLA-B2705 | KKYLLGIGL; VRANGTRLEY; GKWDSKTSTL; KKYLLGIGLIL |
| | HLA-B3501 | LAADGKTTL; RANGTRLEY; FTLEGTLAA; TVVLSKNIL; VALDDSDTT; YLLGIGLIL; LPGGMTELV; IADDLSQTKF; LPGGMTELVS; LKVTEGTVVL; YSLEATVDKL; YLLGIGLILAL; NSVSVDLPGGM; IVRANGTRLEY; TIADDLSQTKF; KAVEITTLKEL |
| | HLA-B4403 | KEVLKDFTL; GEITVALDD; KEKDKDGKY; KEDAKTLVS; GEITVALDDS; KEDTITVQKY; GEITVALDDSD; KEVLKDFTLEG |
| | HLA-B5101 | LPGGMTELV; |
| | HLA-B5701 | TTQATKKTGKW; |
| [BAA22351.1] Outer surface protein B [Borrelia garinii]; SEQ ID NO:10, SEQ ID NO: 57834-58137 | HLA-A0101 | LTEETEETY; RTNGTTLEY; WSDTSNTLT; ITDDLNTIT; WSDTSNTLTV; ITDDLNTITV; LTDGTITVQNY; ITRTNGTTLEY; WSDTSNTLTVS; YSDMTNDENAT |
| | HLA-A0201 | FLTDGTITV; YLLGFALVL; KLAGTATEI; LLGFALVLA; SLTEETEET; KIKDFVFLT; FLDDTSSGS; SITDDLNTI; GIMLEGNLV; NLVGGKTSV; LVTEDTVKL; VTMSITDDL; YLLGFALVLA; KLFNDTKIFI; LLGFALVLAL; FLDDTSSGST; ITDDLNTITV; FLTDGTITVQ; AVWSDTSNTL; ALIACGQKGA; KLSTKKITRT; KKYLLGFALV; YLLGFALVLAL; FVFLTDGTITV; SITDDLNTITV; LLGFALVLALI; KLFNDTKIFIS; NLVGGKTSVEI; TMSITDDLNTI; MTNDENATKAV; ATVDTVELKGV |
| | HLA-A0301 | KVASKVFKK; KTGKLSTKK; RTNGTTLEY; SSNTKVASK; ATKAVETLK; KLSTKKITR; MTNDENATK; VTLKKEIEK; ETYDSSNTK; TLTVSADSK; KEGTVTLKK; VLALIACGQK; KLAGTATEIK; NTKVASKVFK; |

Fig. 32 continued

| | | |
|---|---|---|
| | | NTLTVSADSK; TYKTGKLSTK; MLEGNLVGGK; KIFISKEKNK; VQNYDTAGTK; TVTLKKEIEK; TLTVSADSKK; EIKEGTVTLK; DLEALKAALK; DSSNTKVASK; RATVDTVELK; KEIEKAGTVK; YKTGKLSTKK; GSGGKLEGVK; TVELKGVADK; DTKIFISKEK; IKEGTVTLKK; FNDTKIFISK; IMLEGNLVGGK; LVLALIACGQK; ETYKTGKLSTK; KLEGVKSDQSK; FLDDTSSGSTK; LFNDTKIFISK; LVGGKTSVEIK; ITRTNGTTLEY; NTLTVSADSKK; SLTEETEETYK; TVQNYDTAGTK; EIKEGTVTLKK |
| | HLA-A1101 | KVASKVFKK; ATVDTVELK; SSNTKVASK; ATKAVETLK; MTNDENATK; ETYDSSNTK; KTGKLSTKK; VTLKKEIEK; TVKLFNDTK; RTNGTTLEY; TLTVSADSK; LTVSADSKK; VSADSKKIK; LALIACGQK; DTSSGSTKK; TKVASKVFK; EIKDLEALK; KLSTKKITR; TVTLKKEIEK; NTLTVSADSK; TVSADSKKIK; KIFISKEKNK; RATVDTVELK; VQNYDTAGTK; VLALIACGQK; KLAGTATEIK; TVELKGVADK; TLTVSADSKK; NTKVASKVFK; LTEETEETYK; MLEGNLVGGK; GSGGKLEGVK; NATKAVETLK; DSSNTKVASK; DTVKLFNDTK; TKVASKVFKK; EIKEGTVTLK; TVQNYDTAGTK; LVLALIACGQK; ATEIKDLEALK; TVETYDSSNTK; GTVTLKKEIEK; NTLTVSADSKK; IMLEGNLVGGK; SLTEETEETYK; ETYKTGKLSTK; IACGQKGAEPK; NTKVASKVFKK; LFNDTKIFISK; LVGGKTSVEIK; LTVSADSKKIK; SNTKVASKVFK; KLEGVKSDQSK; VADKNDGSGGK; EIKEGTVTLKK |
| | HLA-A2402 | VWSDTSNTL; KYLLGFALV; GFALVLALI; NYDTAGTKL; KYLLGFALVL; DFVFLTDGTI; VWSDTSNTLTV; KYELRATVDTV; KYLLGFALVLA |
| | HLA-A2902 | RTNGTTLEY; DLNTITVETY; SLTEETEETY; ITRTNGTTLEY |
| | HLA-A6801 | ETYDSSNTK; MTNDENATK; DTSSGSTKK; LTVSADSKK; TVKLFNDTK; EIKDLEALK; ATVDTVELK; ATKAVETLK; TLTVSADSK; KVASKVFKK; TKVASKVFK; TKIFISKEK; SSNTKVASK; RTNGTTLEY; EIEKAGTVK; LALIACGQK; QNYDTAGTK; LAGTATEIK; NDTKIFISK; TATEIKDLE; VTLKKEIEK; DTVKLFNDTK; DTKIFISKEK; NATKAVETLK; NTLTVSADSK; NTKVASKVFK; ETEETYKTGK; EIKEGTVTLK; TVTLKKEIEK; TLTVSADSKK; DSSNTKVASK; EVEDSKKDQK; TVSADSKKIK; LTEETEETYK; VLALIACGQK; RATVDTVELK; MLEGNLVGGK; DLEALKAALK; DMTNDENATK; TKVASKVFKK; TVELKGVADK; ETYDSSNTKV; DLNTITVETY; TEIKDLEALK; KIFISKEKNK; KLAGTATEIK; TYKTGKLSTK; ETYKTGKLSTK; NTLTVSADSKK; DTVELKGVADK; TVETYDSSNTK; NTKVASKVFKK; TVQNYDTAGTK; EIKEGTVTLKK; LTVSADSKKIK; ENATKAVETLK; FISKEKNKDGK; LVLALIACGQK; SNTKVASKVFK; SLTEETEETYK; GTVTLKKEIEK; IACGQKGAEPK; DLPLVTEDTVK; LVGGKTSVEIK; ATEIKDLEALK; LFNDTKIFISK; EETEETYKTGK; EKNKDGKYELR; TKIFISKEKNK; TYKTGKLSTKK; NDTKIFISKEK; DSKKDQKDASK; SNTLTVSADSK; EDTVKLFNDTK |
| | HLA-B0702 | ITRTNGTTL; RATVDTVEL; KVFKKQGSL; AVWSDTSNTL; KITRTNGTTL; LPLVTEDTVKL; TAVWSDTSNTL; AVETLKNGIML |
| | HLA-B0801 | MKKYLLGFAL; YLLGFALVLAL |
| | HLA-B1501 | RTNGTTLEY; KLFNDTKIF; YLLGFALVL; NTKVASKVF; LGFALVLAL; LTEETEETY; SLTEETEETY; LVTEDTVKLF; IEKAGTVKLF; ITRTNGTTLEY; YLLGFALVLAL; ISKEKNKDGKY; SSNTKVASKVF; TVKLFNDTKIF; VQNYDTAGTKL; VSADSKKIKDF |
| | HLA-B2705 | KKYLLGFAL; TRTNGTTLEY; LRATVDTVEL; KKYLLGFALVL; LRATVDTVELK |
| | HLA-B3501 | LTEETEETY; FALVLALIA; LPLVTEDTV; RTNGTTLEY; TAVWSDTSN; YLLGFALVL; DASKKDLPL; RATVDTVEL; DLNTITVETY; AVWSDTSNTL; FALVLALIAC; LVTEDTVKLF; TAVWSDTSNT; TRTNGTTLEY; FVFLTDGTIT; SLTEETEETY; LPLVTEDTVK; |

Fig. 32 continued

| | | |
|---|---|---|
| | | TAVWSDTSNTL; LPLVTEDTVKL; TATEIKDLEAL; YLLGFALVLAL; KAVETLKNGIM; ITRTNGTTLEY; TVKLFNDTKIF; DDLNTITVETY; FVFLTDGTITV |
| | HLA-B4403 | KEIEKAGTV; KEKNKDGKY; EETYKTGKL; AEPKHNDQE; EETEETYKT; AEPKHNDQEV; EETYKTGKLS; VEIKEGTVTL; KEIEKAGTVKL; KEGTVTLKKEI |
| | HLA-B5101 | LPLVTEDTV; FALVLALIA; LPLVTEDTVK; LPLVTEDTVKL |
| | HLA-B5701 | LTEETEETY; GSTKKTAVW; RTNGTTLEY; ; SSGSTKKTAVW; GSLTEETEETY,; ITRTNGTTLEY |
| AAM22469.1\| Outer surface protein C [Borrelia afzelii]; SEQ ID NO:11, SEQ ID NO: 58138-58345 | HLA-A0101 | LSAILMTLF; ITDSNAFVL; ; ITDSNAFVLAV |
| | HLA-A0201 | ILMTLFLFI; SLLAGVHEI; KITDSNAFV; KLFKSVEGL; TLSAILMTL; TLVSSIDEL; ALTNSVKEL; GVHEISTLI; SAILMTLFL; FLFISCNNS; SVKELTSPV; LITEKLSKL; LMTLFLFIS; LVSSIDELA; AQEALTNSV; KLFKSVEGLV; AILMTLFLFI; KITDSNAFVL; NTLSAILMTL; TLVSSIDELA; ILMTLFLFIS; VLAVKEVETL; TLITEKLSKL; LLAGVHEIST; GLVKAAQEAL; AAQEALTNSV; FVLAVKEVET; TLSAILMTLFL; VLAVKEVETLV; LLAGVHEISTL; FVLAVKEVETL; KITDSNAFVLA; SLLAGVHEIST; ITDSNAFVLAV; ILMTLFLFISC; KAAQEALTNSV; SAILMTLFLFI |
| | HLA-A0301 | KLKNSGELK; TLITEKLSK; ELANKAIGK; LANKAIGKK; RVSHADLGK; FISCNNSGK; ITEKLSKLK; AILKTNADK; EISTLITEK; ILMTLFLFI; STLITEKLSK; LITEKLSKLK; KTKGAEELGK; KAILKTNADK; ELANKAIGKK; LFKSVEGLVK; AQEALTNSVK; LFISCNNSGK; DSNAFVLAVK; TSPVVAESPK; GAEELGKLFK; ILKTNADKTK; SKLKNSGELK; VSSIDELANK; HEISTLITEK; ; KLFKSVEGLVK; FLFISCNNSGK; KLRVSHADLGK; TLITEKLSKLK; KLKNSGELKAK; ISTLITEKLSK; LTSPVVAESPK; LVSSIDELANK; LSKLKNSGELK; TLSAILMTLFL; KGAEELGKLFK; AILKTNADKTK |
| | HLA-A1101 | SSIDELANK; TLITEKLSK; RVSHADLGK; AILKTNADK; GVNDDDAKK; ITEKLSKLK; LANKAIGKK; KLKNSGELK; FISCNNSGK; EISTLITEK; PVVAESPKK; SNAFVLAVK; AILMTLFLF; ELANKAIGK; GPNLTEISK; STLITEKLSK; STNPADESAK; VSSIDELANK; TSPVVAESPK; KAILKTNADK; DSNAFVLAVK; AQEALTNSVK; KTKGAEELGK; GAEELGKLFK; LITEKLSKLK; AILMTLFLFI; LFISCNNSGK; LTSPVVAESPK; KLFKSVEGLVK; ASTNPADESAK; LVSSIDELANK; AAQEALTNSVK; TLITEKLSKLK; ISTLITEKLSK; TSPVVAESPKK; AILKTNADKTK; FLFISCNNSGK; LSKLKNSGELK; KGAEELGKLFK; KLKNSGELKAK; KLRVSHADLGK |
| | HLA-A2402 | AILMTLFLF; ILMTLFLFI; SAILMTLFL; LSAILMTLFL; NTLSAILMTLF |
| | HLA-A2902 | SAILMTLFLF; |
| | HLA-A6801 | EISTLITEK; FISCNNSGK; ELANKAIGK; SSIDELANK; SNAFVLAVK; LANKAIGKK; ITEKLSKLK; TLITEKLSK; RVSHADLGK; GVNDDDAKK; SPVVAESPK; DSNAFVLAVK; STNPADESAK; CSEEFTNKLR; TSPVVAESPK; ELANKAIGKK; LFISCNNSGK; STLITEKLSK; ELKAKIEDAK; LITEKLSKLK; HEISTLITEK; KTKGAEELGK; SPVVAESPKK; SAILMTLFLF; VSSIDELANK; LTSPVVAESPK; FLFISCNNSGK; LVSSIDELANK; TSPVVAESPKK; ISTLITEKLSK; TLITEKLSKLK; ELKAKIEDAKK; LSKLKNSGELK; QQNGLGAEANR; ASTNPADESAK; TDSNAFVLAVK; MTLFLFISCNN |
| | HLA-B0702 | SVKELTSPV; LVKAAQEAL; SAILMTLFL; AAQEALTNSV; KAAQEALTNSV; GPNLTEISKKI |
| | HLA-B0801 | KLRVSHADL; LVKAAQEAL; ; |
| | HLA-B1501 | LVKAAQEAL; QQNGLGAEA; AQEALTNSV; KKITDSNAF; IQQNGLGAE; SVKELTSPV; KLRVSHADL; LSAILMTLF; TLSAILMTLF; IQQNGLGAEA; SAILMTLFLF; ISKKITDSNAF; LLAGVHEISTL; LSAILMTLFLF |

Fig. 32 continued

| | HLA-B2705 | LRVSHADLGK; |
|---|---|---|
| | HLA-B3501 | KKITDSNAF; SAILMTLFL; LAVKEVETL; LSAILMTLF; DAKKCSEEF; NPADESAKG; SAILMTLFLF; EALTNSVKEL; LAGVHEISTL; NPADESAKGPN; NTLSAILMTLF; FVLAVKEVETL; ISKKITDSNAF |
| | HLA-B4403 | EEFTNKLRV; KELTSPVVA; AEANRNESL; EEFTNKLRVS; AEANRNESLL; AEANRNESLLA; EEFTNKLRVSH; KELTSPVVAES |
| | HLA-B5101 | GPNLTEISKKI; LAGVHEISTLI |
| | HLA-B5701 | ISKKITDSNAF |
| AAC62927.1\| OspE-related lipoprotein [Borrelia garinii]; SEQ ID NO:12, Seq ID NO: 58346-58523 | HLA-A0101 | GSFKTSLYY; SSDTIKFSEF; |
| | HLA-A0201 | FIICAVFVL; KMKMFIICA; MKMFIICAV; ATFFCIEEA; IICAVFVLI; MFIICAVFV; KMFIICAVFV; FIICAVFVLI; KMKMFIICAV; KMFIICAVFVL; ATFFCIEEAEV; MKMFIICAVFV; KKMKMFIICAV; GLSGQASSDTI; FIICAVFVLIS; TLVIRKEQDGV |
| | HLA-A0301 | AMTNVGSFK; KTSLYYGYK; GSFKTSLYY; NLGTLVIRK; LISSCGNFR; FTVNIKNKK; GQASSDTIK; KAMTNVGSFK; GIKGKEITTK; VGSFKTSLYY; SNLGTLVIRK; VLISSCGNFR; NVGSFKTSLY; KFSEFTVNIK; QLRGHSATFF; FKTSLYYGYK; QSSTNGIKGK; WSNLGTLVIRK; GSFKTSLYYGY; SFKTSLYYGYK; FVLISSCGNFR |
| | HLA-A1101 | KTSLYYGYK; AMTNVGSFK; GSFKTSLYY; SSTNGIKGK; NLGTLVIRK; GQASSDTIK; FTVNIKNKK; LISSCGNFR; FSEFTVNIK; KAMTNVGSFK; VLISSCGNFR; SNLGTLVIRK; QSSTNGIKGK; KFSEFTVNIK; GIKGKEITTK; SEFTVNIKNK; SGQASSDTIK; NVGSFKTSLY; WSNLGTLVIRK; GSFKTSLYYGY; SFKTSLYYGYK; NSEHITFSGDK; FVLISSCGNFR; NVGSFKTSLYY; NVIGTINGQLR; LSGQASSDTIK; SEFTVNIKNKK; FSEFTVNIKNK |
| | HLA-A2402 | KAMTNVGSF; DWSNLGTLV; KFSEFTVNI; MFIICAVFVL; DWSNLGTLVI; MFIICAVFVLI; VFVLISSCGNF; ETINNSEHITF |
| | HLA-A2902 | GSFKTSLYY; FKTSLYYGY; KMFIICAVF; SFKTSLYYGY; NVGSFKTSLY; VGSFKTSLYY; NVGSFKTSLYY; GSFKTSLYYGY |
| | HLA-A6801 | FTVNIKNKK; LISSCGNFR; EAEVNNFVK; KTSLYYGYK; FSEFTVNIK; AMTNVGSFK; EFTVNIKNK; DTIKFSEFT; SSTNGIKGK; EQSSTNGIK; EHITFSGDK; HSATFFCIE; NLGTLVIRK; MTNVGSFKT; NVIGTINGQ; ETINNSEHI; VLISSCGNFR; EEAEVNNFVK; KAMTNVGSFK; EFTVNIKNKK; WSNLGTLVIR; NVGSFKTSLY; VIGTINGQLR; FKTSLYYGYK; HSATFFCIEE; QSSTNGIKGK; ETINNSEHIT; DTIKFSEFTV; NVIGTINGQLR; FVLISSCGNFR; NSEHITFSGDK; FSEFTVNIKNK; WSNLGTLVIRK; ETINNSEHITF; SFKTSLYYGYK; DWSNLGTLVIR; NVGSFKTSLYY; EQSSTNGIKGK; SEFTVNIKNKK; TNVGSFKTSLY |
| | HLA-B0702 | KAMTNVGSF; FVKAMTNVGSF |
| | HLA-B0801 | QLRGHSATF; FVKAMTNVGSF; NGQLRGHSATF |
| | HLA-B1501 | KMFIICAVF; QLRGHSATF; GSFKTSLYY; KAMTNVGSF; VLISSCGNF; GQLRGHSAT; GQLRGHSATF; QLRGHSATFF; GQASSDTIKF; FVLISSCGNF; TINNSEHITF; KMKMFIICAV; VGSFKTSLYY; FVKAMTNVGSF; KMKMFIICAVF; GQLRGHSATFF; KMFIICAVFVL; GSFKTSLYYGY; ASSDTIKFSEF; ETINNSEHITF; FCIEEAEVNNF |
| | HLA-B2705 | GQLRGHSATF; FRSSLSDQGSL |
| | HLA-B3501 | EVNNFVKAM; QASSDTIKF; FIICAVFVL; KAMTNVGSF; QLRGHSATF; MKMFIICAVF; TINNSEHITF; MFIICAVFVL; FVLISSCGNF; NVGSFKTSLY; EAEVNNFVKAM; FVKAMTNVGSF; ETINNSEHITF; FCIEEAEVNNF; NVGSFKTSLYY; MTNVGSFKTSL |
| | HLA-B4403 | SEFTVNIKN; EEAEVNNFV; KEITTKIET; EEQSSTNGI; AEVNNFVKA; AEVNNFVKAM; SEFTVNIKNK; KEITTKIETI; AEVNNFVKAMT; SEFTVNIKNKK; EEAEVNNFVKA |
| | HLA-B5101 | |

Fig. 32 continued

| | HLA-B5701 | |
|---|---|---|
| CAA57806.1 Outer surface protein G [Borrelia burgdorferi]; SEQ ID NO:13, SEQ ID NO: 58524-58669 | HLA-A0101 | |
| | HLA-A0201 | LIICAVFVL; NLIICAVFV; SLFNPPPVL; KMKNLIICA; FVLIISCKI; ALKNIEEEL; IICAVFVLI; VIDDALKNI; ATGESTEKV; KMKNLIICAV; LIICAVFVLI; NLIICAVFVL; ALKYAKELGV; KVIDDALKNI; IICAVFVLII; SLFNPPPVLPA; LIICAVFVLII; LMQGDDPNNSL; NLIICAVFVLI; KALKYAKELGV; FVLIISCKIDA; KKMKNLIICAV; AVFVLIISCKI |
| | HLA-A0301 | GTNTNDFVK; VFVLIISCK; AVFVLIISCK; SSHDNTPVLK; GTNTNDFVKK; KIDASSEDLK; ESATGESTEK; KVKKQGNIGQK; KLAEPQNIEDK; KQGNIGQKALK; ASSHDNTPVLK; CAVFVLIISCK; FVKKVIDDALK; ATGESTEKVKK; ALKNIEEELEK |
| | HLA-A1101 | GTNTNDFVK; SATGESTEK; GQKALKYAK; VFVLIISCK; PVLKAVQAK; GQQEGKEEK; AVFVLIISCK; SSHDNTPVLK; GTNTNDFVKK; KIDASSEDLK; SSEDLKQNVK; ATGESTEKVK; ESATGESTEK; ASSHDNTPVLK; ATGESTEKVKK; CAVFVLIISCK; ASSEDLKQNVK; KVKKQGNIGQK; KQGNIGQKALK; NIGQKALKYAK; SATGESTEKVK; ALKNIEEELEK; KLAEPQNIEDK; FVKKVIDDALK; NTPVLKAVQAK |
| | HLA-A2402 | |
| | HLA-A2902 | NIGQKALKY; YAKELGVNGSY |
| | HLA-A6801 | GTNTNDFVK; SATGESTEK; ELKDKIDKR; VFVLIISCK; EPQNIEDKK; TNTNDFVKK; DLKQNVKEK; IDASSEDLK; ESATGESTEK; EARKKFQEFK; AVFVLIISCK; SSHDNTPVLK; GTNTNDFVKK; TPVLKAVQAK; DGTNTNDFVK; ELKDKIDKRK; LAEPQNIEDK; SSEDLKQNVK; CAVFVLIISCK; FVKKVIDDALK; NTPVLKAVQAK; EEARKKFQEFK; EIQELKDKIDK; SATGESTEKVK; NIGQKALKYAK; LAEPQNIEDKK; CKIDASSEDLK; QAKDGGQQEGK; DGTNTNDFVKK; ELKDKIDKRKK; ASSHDNTPVLK |
| | HLA-B0702 | TPVLKAVQA; LPASSHDNT; ; LPASSHDNTPV |
| | HLA-B0801 | EARKKFQEF; FVKKVIDDAL; |
| | HLA-B1501 | SLFNPPPVL; KELGVNGSY; NVKEKVEGF; KQGNIGQKAL; MQGDDPNNSL; KMKNLIICAV; YAKELGVNGSY; KMKNLIICAVF; KQNVKEKVEGF; MQGDDPNNSLF; SVNDGTNTNDF; LMQGDDPNNSL; GQKALKYAKEL |
| | HLA-B2705 | GQKALKYAK; ; KRKKELEEARK; KQGNIGQKALK |
| | HLA-B3501 | NPPPVLPAS; EARKKFQEF; LIICAVFVL; MKNLIICAVF; FVKKVIDDAL; TPVLKAVQAK; LPASSHDNTP; YAKELGVNGSY; SVNDGTNTNDF; LPASSHDNTPV; PASSHDNTPVL; NPPPVLPASSH; MQGDDPNNSLF |
| | HLA-B4403 | QEFKEQVES; KELGVNGSY; EEARKKFQEF; EEKEKEIQEL; KELEEARKKF; KEIQELKDKI; EEELEKLAEPQ; QEFKEQVESAT; EELEKLAEPQN |
| | HLA-B5101 | PPPVLPASS; TPVLKAVQA; LPASSHDNT; LPASSHDNTP; NPPPVLPASS; CAVFVLIISC; LPASSHDNTPV |
| | HLA-B5701 | |
| AAC44770.1 FlaA protein (Borrelia burgdorferi); SEQ ID NO:14, SEQ ID NO: 58670-59232 | HLA-A0101 | LTNYVDYVY; KVSVYSLGY; FEDMNGMEY; DSESVFKVY; RLDLTNYVDY; SSKVKNFIFY; LTPSARLQAY; SSTRLDLTNY; HSSKVKNFIFY; WADLIWSNPNY; PSSTRLDLTNY; DIDSESVFKVY; KTMKEIKVSVY |
| | HLA-A0201 | FLLSTVLFA; ILFFLLSTV; KVKNFIFYV; YAGDTILGV; VLFEDMNGM; LIWSNPNYI; AMIMPPFKI; YVYSGASGI; GINNWSVLL; VLLTPSARL; KMRFKAFRV; YVDYVYSGA; LVLDFAELA; YIPNISSRI; TMKEIKVSV; GLIDNIKTM; DLTNYVDYV; RVLYDKLSV; SVYSLGYEI; KAKSILFFL; LLSTVLFAQ; KLREKISIA; LQAYVKNSV; SILFFLLST; LGYEIDLEV; VLYDKLSVS; GLAEGSKRA; VLYDKLSVSI; FIFYVKDLRV; FLGKGLIDNI; SLGYEIDLEV; SILFFLLSTV; FLLSTVLFAQ; RLQAYVKNSV; KTMKEIKVSV; VLFAQETDGL; ILFFLLSTVL; YVYSGASGIV; |

Fig. 32 continued

| | | |
|---|---|---|
| | | KLSVSIDSDI; FFLLSTVLFA; SKVKNFIFYV; VLFPSYSQSS; LQAYVKNSVV; KAKSILFFLL; YIPNISSRII; YVKNSVVAPA; LLTPSARLQA; RLDLTNYVDYV; SIAEGSFQNFV; SIDSDIDSESV; VLFPSYSQSSA; YSLGYEIDLEV; RLQAYVKNSVV; KVYETSGTESL; YAGDTILGVRV; SLGYEIDLEVL; VVDLGINNWSV; SILFFLLSTVL; KVSVYSLGYEI; FIFYVKDLRVL; LLSTVLFAQET; KSILFFLLSTV; VLLTPSARLQA; SVYSLGYEIDL; YVKNSVVAPAV; LTPSARLQAYV; VLFAQETDGLA; IMPPFKIPFYS; IIKDDVPNYPL; RVLYDKLSVSI; KLKAHETFKRV |
| | HLA-A0301 | KLKAHETFK; RVSKSHSSK; YAYSMGTLK; GSFQNFVEK; LASSKMRFK; KVSVYSLGY; SVVAPAVVK; SAMIMPPFK; RFKAFRVSK; TSGTESLRK; YSMGTLKFK; YSGASGIVK; LIDNIKTMK; GTESLRKLK; GVRVLFPSY; KAFRVSKSH; KVKNFIFYVK; AYSMGTLKFK; SSAMIMPPFK; VYSGASGIVK; GLIDNIKTMK; PLASSKMRFK; EYAYSMGTLK; RKLKAHETFK; VPNYPLASSK; ETSGTESLRK; VSKSHSSKVK; IMPPFKIPFY; SDIDSESVFK; SSKVKNFIFY; NSVVAPAVVK; RLDLTNYVDY; KLKAHETFKR; MRFKAFRVSK; APAVVKSESK; AHETFKRVLK; GESGNQFLGK; SSKMRFKAFR; LVLDFAELAR; FRVSKSHSSK; MIMPPFKIPF; IPNISSRIIK; KISIAEGSFQ; KMRFKAFRVSK; YVVYSGASGIVK; RVSKSHSSKVK; MEYAYSMGTLK; MIMPPFKIPFY; KAHETFKRVLK; QSSAMIMPPFK; YAYSMGTLKFK; HSSKVKNFIFY; ILGVRVLFPSY; KTMKEIKVSVY; VLFEDMNGMEY; FLGKGLIDNIK; TSGTESLRKLK; YIPNISSRIIK; ASSKMRFKAFR; LLTPSARLQAY |
| | HLA-A1101 | SAMIMPPFK; SVVAPAVVK; GSFQNFVEK; RVSKSHSSK; YAYSMGTLK; YSMGTLKFK; TSGTESLRK; SVLLTPSAR; KLKAHETFK; GTESLRKLK; LASSKMRFK; KVSVYSLGY; YSGASGIVK; SARLQAYVK; RFKAFRVSK; ESGNQFLGK; VKNFIFYVK; LIDNIKTMK; LTNYVDYVY; DIDSESVFK; AVVKSESKR; RVLFPSYSQ; FVEKIESEK; KSILFFLLS; FIFYVKDLR; GVRVLFPSY; YVKDLRVLY; SVYSLGYEI; STRLDLTNY; SSAMIMPPFK; KVKNFIFYVK; SSKMRFKAFR; ETSGTESLRK; GLIDNIKTMK; AYSMGTLKFK; SSKVKNFIFY; LVLDFAELAR; VSKSHSSKVK; NSVVAPAVVK; PSARLQAYVK; PLASSKMRFK; SSTRLDLTNY; ETFKRVLKLR; SDIDSESVFK; RIIKDDVPNY; KLKAHETFKR; VPNYPLASSK; VYSGASGIVK; ETDGLAEGSK; QSSAMIMPPFK; YVVYSGASGIVK; YAYSMGTLKFK; MIMPPFKIPFY; KAHETFKRVLK; ASSKMRFKAFR; RVSKSHSSKVK; TSGTESLRKLK; KMRFKAFRVSK; MEYAYSMGTLK; YVKDLRVLYDK; TPSARLQAYVK; KTMKEIKVSVY; VAPAVVKSESK; YIPNISSRIIK; HSSKVKNFIFY; VLFEDMNGMEY; DVPNYPLASSK; KNSVVAPAVVK; SKVKNFIFYVK; SGESGNQFLGK; AEGSFQNFVEK |
| | HLA-A2402 | SYSQSSAMI; EYAYSMGTL; FFLLSTVLF; LYDKLSVSI; AYSMGTLKF; FYVKDLRVL; SFQNFVEKI; NYPLASSKM; VYSGASGIV; KFKGWADLI; NYIPNISSRI; FYSGESGNQF; LFFLLSTVLF; GYEIDLEVLF; EYAYSMGTLK; DYVYSGASGI; VYETSGTESL; VYSLGYEIDL; RYAGDTILGV; SYSQSSAMIM; FYVKDLRVLY; EYAYSMGTLKF; NYPLASSKMRF; NYIPNISSRII; IWSNPNYIPNI; FYSGESGNQFL; DYVYSGASGIV |
| | HLA-A2902 | YVKDLRVLY; DMNGMEYAY; LTNYVDYVY; KVSVYSLGY; IMPPFKIPF; YEIDLEVLF; GVRVLFPSY; AYSMGTLKF; DLIWSNPNY; FFLLSTVLF; FYVKDLRVLY; IMPPFKIPFY; YAYSMGTLKF; LFEDMNGMEY; DLTNYVDYVY; LFFLLSTVLF; TMKEIKVSVY; SSTRLDLTNY; RIIKDDVPNY; MIMPPFKIPF; SSKVKNFIFY; RLDLTNYVDY; EDMNGMEYAY; IFYVKDLRVLY; VLFEDMNGMEY; MIMPPFKIPFY; AMIMPPFKIPF; EYAYSMGTLKF; HSSKVKNFIFY; ILGVRVLFPSY; ILFFLLSTVLF; FEDMNGMEYAY; DIDSESVFKVY |

Fig. 32 continued

| | HLA-A6801 | ETSGTESLR; FIFYVKDLR; YAYSMGTLK; FVEKIESEK; NYIPNISSR; YSMGTLKFK; SAMIMPPFK; LTNYVDYVY; GSFQNFVEK; SVVAPAVVK; SVLLTPSAR; AVVKSESKR; LASSKMRFK; SKMRFKAFR; RVSKSHSSK; NIKTMKEIK; DIDSESVFK; LARDPSSTR; YVKDLRVLY; TFKRVLKLR; ESGNQFLGK; DLIWSNPNY; LIDNIKTMK; SARLQAYVK; MPPFKIPFY; GTESLRKLK; HETFKRVLK; YPLASSKMR; LKAHETFKR; DMNGMEYAY; VKNFIFYVK; RFKAFRVSK; ETFKRVLKLR; ETSGTESLRK; SSAMIMPPFK; NFIFYVKDLR; EYAYSMGTLK; WSVLLTPSAR; LVLDFAELAR; SSKMRFKAFR; ETDGLAEGSK; ELARDPSSTR; EGSFQNFVEK; NSVVAPAVVK; KVKNFIFYVK; YAGDTILGVR; YETSGTESLR; NFVEKIESEK; MRFKAFRVSK; NYPLASSKMR; DLTNYVDYVY; DTILGVRVLF; SDIDSESVFK; GLIDNIKTMK; KLKAHETFKR; DNIKTMKEIK; YAYSMGTLKFK; YVYSGASGIVK; QSSAMIMPPFK; ELVLDFAELAR; ASSKMRFKAFR; ETDGLAEGSKR; NPNYIPNISSR; DVPNYPLASSK; YVKDLRVLYDK; MEYAYSMGTLK; YIPNISSRIIK; MIMPPFKIPFY; HSSKVKNFIFY; TPSARLQAYVK; KNFIFYVKDLR; ESEKPEESSPK; DSDIDSESVFK; HETFKRVLKLR; QNFVEKIESEK; ETFKRVLKLRE; RYAGDTILGVR; TSGTESLRKLK; APAVVKSESKR; RVSKSHSSKVK; YPLASSKMRFK; NWSVLLTPSAR; VAPAVVKSESK; KAHETFKRVLK; VYETSGTESLR; SKVKNFIFYVK |
|---|---|---|
| | HLA-B0702 | FPSYSQSSA; IPNISSRII; TPSARLQAY; MKRKAKSIL; VPNYPLASS; DPSSTRLDL; APAVVKSES; RVLYDKLSV; IPFYSGESG; KPEDMVVDL; RAEPGELVL; LARDPSSTRL; YPLASSKMRF; RVSKSHSSKV; TPSARLQAYV; KAHETFKRVL; SKRYAGDTIL; APAVVKSESK; YAYSMGTLKF; FPSYSQSSAMI; VPNYPLASSKM; KVYETSGTESL; RVLYDKLSVSI; RVLKLREKISI; LASSKMRFKAF; YVKNSVVAPAV |
| | HLA-B0801 | SSKMRFKAF; EIKVSVYSL; QAYVKNSVV; FPSYSQSSAM; VLKLREKISI; LRKLKAHETF; SLRKLKAHETF; LASSKMRFKAF; FKRVLKLREKI; VLKLREKISIA |
| | HLA-B1501 | YVKDLRVLY; YSGESGNQF; IMPPFKIPF; KVSVYSLGY; GVRVLFPSY; SSAMIMPPF; SSKMRFKAF; LTNYVDYVY; IIKDDVPNY; DMNGMEYAY; VVKSESKRY; GLIDNIKTM; SSKVKNFIF; VLFEDMNGM; LQAYVKNSV; KISIAEGSF; YSQSSAMIM; STRLDLTNY; DLIWSNPNY; YEIDLEVLF; FFLLSTVLF; TMKEIKVSVY; QSSAMIMPPF; MIMPPFKIPF; SIAEGSFQNF; IMPPFKIPFY; YAYSMGTLKF; RIIKDDVPNY; LQAYVKNSVV; SSKVKNFIFY; LFFLLSTVLF; ILFFLLSTVL; ASSKMRFKAF; LTPSARLQAY; LGVRVLFPSY; YVKNSVVAPA; AVVKSESKRY; TMKEIKVSVY; QSSAMIMPPF; MIMPPFKIPF; SIAEGSFQNF; IMPPFKIPFY; YAYSMGTLKF; RIIKDDVPNY; LQAYVKNSVV; SSKVKNFIFY; LFFLLSTVLF; ILFFLLSTVL; ASSKMRFKAF; LTPSARLQAY; LGVRVLFPSY; YVKNSVVAPA; AVVKSESKRY |
| | HLA-B2705 | KRKAKSILF; KRVLKLREK; KRYAGDTIL; RKAKSILFF; RKLKAHETF; ARLQAYVKN; MRFKAFRVSK; FRVSKSHSSK; KRKAKSILFF; KRVLKLREKI; KRAEPGELVL; RKLKAHETFK; KRYAGDTILGV; KRKAKSILFFL; TRLDLTNYVDY; FRVSKSHSSKV; SRIIKDDVPNY; ARLQAYVKNSV; RKLKAHETFKR |
| | HLA-B3501 | TPSARLQAY; MPPFKIPFY; DMNGMEYAY; LTNYVDYVY; EPGELVLDF; FFLLSTVLF; IAEGSFQNF; FPSYSQSSA; NPNYIPNIS; YVKDLRVLY; YSGESGNQF; YSQSSAMIM; SSAMIMPPF; FEDMNGMEY; KVSVYSLGY; DLIWSNPNY; ELVLDFAEL; YEIDLEVLF; LFFLLSTVL; NGMEYAYSM; KPEDMVVDL; FAELARDPS; DSESVFKVY; RAEPGELVL; FKGWADLIW; PSYSQSSAM; IPNISSRII; FPSYSQSSAM; YPLASSKMRF; YAYSMGTLKF; LFEDMNGMEY; EDMNGMEYAY; MIMPPFKIPF; EVLFEDMNGM; QSSAMIMPPF; LFFLLSTVLF; DLTNYVDYVY; MVVDLGINNW; LTPSARLQAY; NPNYIPNISS; |

Fig. 32 continued

| | | |
|---|---|---|
| | | FYSGESGNQF; LGVRVLFPSY; FYVKDLRVLY; FAQETDGLAE; DSDIDSESVF; SIAEGSFQNF; FPSYSQSSAMI; WADLIWSNPNY; VPNYPLASSKM; FEDMNGMEYAY; LASSKMRFKAF; LFPSYSQSSAM; DMNGMEYAYSM; MIMPPFKIPFY; VLFEDMNGMEY; LLTPSARLQAY; LDLTNYVDYVY; EPGELVLDFAE; DIDSESVFKVY; RAEPGELVLDF; SQSSAMIMPPF; WSVLLTPSARL; IDSDIDSESVF; LGYEIDLEVLF; TVLFAQETDGL |
| | HLA-B4403 | YEIDLEVLF; KEIKVSVYS; AELARDPSS; AEGSFQNFV; GELVLDFAE; KEIKVSVYSL; AEPGELVLDF; GELVLDFAEL; YEIDLEVLFE; REKISIAEGSF; KEIKVSVYSLG; GELVLDFAELA; YEIDLEVLFED |
| | HLA-B5101 | IPNISSRII; FPSYSQSSA; IPFYSGESG; MPPFKIPFY; EPGELVLDF; MPPFKIPFYS; FPSYSQSSAM; YPLASSKMRF; EPGELVLDFA; TPSARLQAYV; FPSYSQSSAMI; MPPFKIPFYSG; KPEDMVVDLGI; VPNYPLASSKM |
| | HLA-B5701 | YSMGTLKFKGW; KTMKEIKVSVY |
| BAD18055.1; FlaB protein [Borrelia garinii]; SEQ ID NO:15, SEQ ID NO: 59233-59392 | HLA-A0101 | NQDEAIAVNIY; ELAVQSGNGTY |
| | HLA-A0201 | SQASWTLRV; QLTDEINRI; AQAAQTAPV; AIAVNIYAA; SLAKIENAI; AVNIYAANV; AQYNQMHML; TTVDANTSL; SQGGVNSPV; QTAPVQEGV; NIYAANVANL; NLNEVEKVLV; VLVRMKELAV; QLTDEINRIA; NLFSGEGAQA; IAVNIYAANV; SLSGSQASWTL; MLSNKSASQNV; AIAVNIYAANV; SQASWTLRVHV; GMQPAKINTPA; KVLVRMKELAV; SLAKIENAIRM; NLFSGEGAQAA |
| | HLA-A0301 | NQMHMLSNK; GSQASWTLR; TVDANTSLAK; YNQMHMLSNK; LSGSQASWTLR; TTVDANTSLAK; LSNKSASQNVR |
| | HLA-A1101 | NQMHMLSNK; GSQASWTLR; AVQSGNGTY; TVDANTSLAK; YNQMHMLSNK; EVEKVLVRMK; TTVDANTSLAK; TTEGNLNEVEK; TAEELGMQPAK; TSLAKIENAIR; QYNQMHMLSNK; LSGSQASWTLR; LSNKSASQNVR |
| | HLA-A2402 | IYAANVANL; YAANVANLF; IYAANVANLF; TYSDADRGSI; IYAANVANLFS |
| | HLA-A2902 | AVQSGNGTY; YAANVANLF; ; ELAVQSGNGTY; EINRIADQAQY |
| | HLA-A6801 | LAKIENAIR; EGNLNEVEK; YAANVANLF; NGTYSDADR; GSQASWTLR; NQMHMLSNK; TSKAINFIQ; NKSASQNVR; EVEKVLVRMK; SLAKIENAIR; TVDANTSLAK; NTSKAINFIQ; SGSQASWTLR; TTVDANTSLA; TTVDANTSLAK; TTEGNLNEVEK; EIEQLTDEINR; LSNKSASQNVR; TSLAKIENAIR; EINRIADQAQY; NLNEVEKVLVR; LSGSQASWTLR; TAEELGMQPAK; QYNQMHMLSNK; NIYAANVANLF; QTAPVQEGVQQ |
| | HLA-B0702 | SPVNVTTTV; QPAKINTPA; QPAPATAPS; LVRMKELAV; TPASLSGSQ; APSQGGVNS; APATAPSQG; APVQEGVQQ; TPASLSGSQA; SPVNVTTTVD; APSQGGVNSP; QPAKINTPAS; APSQGGVNSPV; QPAKINTPASL; APATAPSQGGV; SPVNVTTTVDA; TPASLSGSQAS |
| | HLA-B0801 | KVLVRMKEL; VEKVLVRMKEL |
| | HLA-B1501 | YAANVANLF; AVQSGNGTY; AQAAQTAPV; AQYNQMHML; SQGGVNSPV; SLSGSQASW; SQASWTLRV; IQIEIEQLT; LAVQSGNGTY; SQASWTLRVH; SQNVRTAEEL; VQQEGAQQPA; INRIADQAQY; AQAAQTAPVQ; MQPAKINTPA; ELAVQSGNGTY; NIYAANVANLF; NQDEAIAVNIY; SLSGSQASWTL |
| | HLA-B2705 | NRIADQAQY; |
| | HLA-B3501 | YAANVANLF; QPAPATAPS; SPVNVTTTV; DEAIAVNIY; TTVDANTSL; LAVQSGNGT; QPAKINTPA; AVQSGNGTY; QASWTLRVH; IAVNIYAAN; LAVQSGNGTY; IADQAQYNQM; QPAKINTPAS; LAKIENAIRM; QPAPATAPSQ; YAANVANLFS; TAEELGMQPA; EAIAVNIYAA; QAQYNQMHML; TPASLSGSQA; SPVNVTTTVD; TPASLSGSQAS; ELAVQSGNGTY; NQDEAIAVNIY; QPAKINTPASL; IAVNIYAANVA; |

Fig. 32 continued

| | | |
|---|---|---|
| | | NIYAANVANLF; SPVNVTTTVDA; EINRIADQAQY; IADQAQYNQMH; APSQGGVNSPV; LAVQSGNGTYS |
| | HLA-B4403 | EELGMQPAKI; NEVEKVLVRM; DEINRIADQA; DEINRIADQAQ |
| | HLA-B5101 | SPVNVTTTV; APATAPSQGGV; APSQGGVNSPV |
| | HLA-B5701 | ASLSGSQASW; |
| AAU07005.1\| flagellar filament 41 kDa core protein [Borrelia garinii PBi]; SEQ ID NO:16, SEQ ID NO: 59393-59741 | HLA-A0101 | KTQEKLSSGY; MTDEVVASTT; ASDDAAGMGV; NQDEAIAVNIY; ISDQRANLGAF; RLESIKDSTEY; ELAVQSGNGTY; MIAQANQVPQY |
| | HLA-A0201 | SQASWTLRV; QLTDEINRI; SQAAQTAPV; AMIAQANQV; MIINHNTSA; QVPQYVLSL; AIAVNIYAA; SLAKIENAI; AVNIYAANV; AQYNQMHML; MTDEVVAST; SIKDSTEYA; TTVDANTSL; NLGAFQNRL; SQGGVNSPV; SAMAMIAQA; VVASTTNSI; MISDQRANL; ILTQSAMAM; SILTQSAMA; LTQSAMAMI; TMTDEVVAST; AQANQVPQYV; MIINHNTSAI; ILTQSAMAMI; NIYAANVANL; RMISDQRANL; NLNEVEKVLV; VLVRMKELAV; MAMIAQANQV; QLTDEINRIA; QVPQYVLSLL; NQVPQYVLSL; IAVNIYAANV; SLSGSQASWTL; MLSNKSASQNV; AMAMIAQANQV; AIAVNIYAANV; SQASWTLRVHV; KLSSGYRINRA; SILTQSAMAMI; GMQPAKINTPA; KVLVRMKELAV; MISDQRANLGA; NLFSGEGSQAA; YAIENLKASYA; SLAKIENAIRM; TMTDEVVASTT; ILTQSAMAMIA |
| | HLA-A0301 | SINAANLSK; SQASRNTSK; NQMHMLSNK; GSQASWTLR; FQNRLESIK; LSSGYRINR; NSINAANLSK; TVDANTSLAK; LSQASRNTSK; KLSSGYRINR; NLKASYAQIK; AANLSKTQEK; STEYAIENLK; KTQEKLSSGY; YNQMHMLSNK; AFQNRLESIK; QIRGLSQASR; VPQYVLSLLR; GLSQASRNTSK; MIAQANQVPQY; LSGSQASWTLR; GAFQNRLESIK; KTQEKLSSGYR; TTVDANTSLAK; KINAQIRGLSQ; RLESIKDSTEY; LSNKSASQNVR |
| | HLA-A1101 | SINAANLSK; SQASRNTSK; NQMHMLSNK; GSQASWTLR; AAGMGVSGK; LSSGYRINR; NTSAINASR; TEYAIENLK; AVQSGNGTY; PQYVLSLLR; FQNRLESIK; AQANQVPQY; TVDANTSLAK; STEYAIENLK; LSQASRNTSK; NSINAANLSK; AANLSKTQEK; RANLGAFQNR; KTQEKLSSGY; KLSSGYRINR; AFQNRLESIK; YNQMHMLSNK; IAQANQVPQY; TQEKLSSGYR; NLKASYAQIK; EVEKVLVRMK; TTVDANTSLAK; TTEGNLNEVEK; KTQEKLSSGYR; GAFQNRLESIK; TAEELGMQPAK; GLSQASRNTSK; TSLAKIENAIR; QYNQMHMLSNK; NAANLSKTQEK; QVPQYVLSLLR; AQIRGLSQASR; DSTEYAIENLK; LSGSQASWTLR; GVSGKINAQIR; MIAQANQVPQY; LSNKSASQNVR; SAMAMIAQANQ |
| | HLA-A2402 | IYAANVANL; YAANVANLF; AFQNRLESI; IYAANVANLF; TYSDADRGSI; SYAQIKDATM; IYAANVANLFS |
| | HLA-A2902 | ESIKDSTEY; AVQSGNGTY; YAANVANLF; AIENLKASY; YAIENLKASY; IAQANQVPQY; EYAIENLKASY; ELAVQSGNGTY; EINRIADQAQY; MIAQANQVPQY; RLESIKDSTEY |
| | HLA-A6801 | NTSAINASR; LSSGYRINR; TEYAIENLK; SINAANLSK; ESIKDSTEY; AIRMISDQR; LAKIENAIR; EGNLNEVEK; YAANVANLF; NGTYSDADR; GSQASWTLR; NQMHMLSNK; TSKAINFIQ; MAMIAQANQ; NKSASQNVR; TTNSILTQS; SQASRNTSK; NAIRMISDQR; STEYAIENLK; NSINAANLSK; DAAGMGVSGK; HNTSAINASR; EVEKVLVRMK; SLAKIENAIR; TVDANTSLAK; RANLGAFQNR; QIRGLSQASR; NTSKAINFIQ; LSQASRNTSK; NLKASYAQIK; SGSQASWTLR; TQEKLSSGYR; VPQYVLSLLR; AANLSKTQEK; YAIENLKASY; VSGKINAQIR; TTVDANTSLA; KLSSGYRINR; MIAQANQVPQ; NTSAINASRN; DSTEYAIENLK; TTVDANTSLAK; TTEGNLNEVEK; EIEQLTDEINR; QVPQYVLSLLR; NAANLSKTQEK; ENAIRMISDQR; LSNKSASQNVR; MIAQANQVPQY; TSLAKIENAIR; EINRIADQAQY; NLNEVEKVLVR; LSGSQASWTLR; GAFQNRLESIK; |

Fig. 32 continued

| | | |
|---|---|---|
| | | TAEELGMQPAK; QYNQMHMLSNK; GVSGKINAQIR; KTQEKLSSGYR; NHNTSAINASR; NIYAANVANLF; EKLSSGYRINR; NNSINAANLSK; QTAPVQEGAQQ; ENLKASYAQIK |
| | HLA-B0702 | SPVNVTTTV; VPQYVLSLL; QPAKINTPA; VVASTTNSI; QPAPATAPS; LVRMKELAV; ASRNTSKAI; IINHNTSAI; TPASLSGSQ; APSQGGVNS; APVQEGAQQ; APATAPSQG; VASTTNSIL; ILTQSAMAM; TPASLSGSQA; VVASTTNSIL; SPVNVTTVD; APSQGGVNSP; QPAKINTPAS; QASRNTSKAI; MIINHNTSAI; APSQGGVNSPV; QPAKINTPASL; APATAPSQGGV; SPVNVTTTVDA; TPASLSGSQAS; SAINASRNNSI; AANLSKTQEKL; RANLGAFQNRL |
| | HLA-B0801 | YAQIKDATM; KVLVRMKEL; ; VEKVLVRMKEL |
| | HLA-B1501 | AQANQVPQY; DQRANLGAF; YAANVANLF; SQAAQTAPV; AVQSGNGTY; TQEKLSSGY; ILTQSAMAM; AQYNQMHML; SQGGVNSPV; ESIKDSTEY; SLSGSQASW; SQASWTLRV; IQIEIEQLT; AMIAQANQV; YAIENLKASY; LAVQSGNGTY; SQASWTLRVH; KTQEKLSSGY; SQNVRTAEEL; RMISDQRANL; IAQANQVPQY; AQQEGAQQPA; AQIRGLSQAS; NQVPQYVLSL; SQAAQTAPVQ; INRIADQAQY; MQPAKINTPA; SQASRNTSKAI; AQANQVPQYVL; MIAQANQVPQY; ASRNTSKAINF; ELAVQSGNGTY; NIYAANVANLF; NQDEAIAVNIY; RLESIKDSTEY; SLSGSQASWTL |
| | HLA-B2705 | NRIADQAQY; IRGLSQASR; QRANLGAFQ; SRNTSKAINF; QRANLGAFQNR; SRNNSINAANL; IRMISDQRANL |
| | HLA-B3501 | YAANVANLF; YAQIKDATM; QPAPATAPS; RASDDAAGM; ESIKDSTEY; SPVNVTTTV; ILTQSAMAM; DEAIAVNIY; TTVDANTSL; LAVQSGNGT; QPAKINTPA; NSILTQSAM; YAIENLKAS; AVQSGNGTY; QASWTLRVH; VASTTNSIL; IAVNIYAAN; FSGEGSQAA; VPQYVLSLL; LAVQSGNGTY; YAIENLKASY; IADQAQYNQM; SILTQSAMAM; IAQANQVPQY; QPAKINTPAS; LAKIENAIRM; QANQVPQYVL; QPAPATAPSQ; YAANVANLFS; TAEELGMQPA; MIINHNTSAI; EAIAVNIYAA; NRASDDAAGM; QAQYNQMHML; TPASLSGSQA; SPVNVTTTVD; SYAQIKDATM; MAMIAQANQV; MIAQANQVPQY; TPASLSGSQAS; ELAVQSGNGTY; NQDEAIAVNIY; QPAKINTPASL; IAVNIYAANVA; NSILTQSAMAM; NIYAANVANLF; TTNSILTQSAM; EVVASTTNSIL; SPVNVTTTVDA; EINRIADQAQY; IADQAQYNQMH; NASRNNSINAA; ISDQRANLGAF; APSQGGVNSPV; LAVQSGNGTYS; EYAIENLKASY |
| | HLA-B4403 | EELGMQPAKI; NEVEKVLVRM; DEINRIADQA; DEINRIADQAQ |
| | HLA-B5101 | SPVNVTTTV; VPQYVLSLL; APATAPSQGGV; APSQGGVNSPV |
| | HLA-B5701 | ASLSGSQASW; |
| 1L8W\|A Chain A, Crystal Structure Of Lyme Disease Variable Surface Antigen VlsE1 Of Borrelia Burgdorferi; SEQ ID NO:17, SEQ ID NO: 59742-60008 | HLA-A0101 | KSDVKTYFTTV |
| | HLA-A0201 | ILSAIVTAA; KVLGAITGL; LLDKLVKAV; QILSAIVTA; VLGAITGLI; ELLDKLVKA; QLGNGFLDV; KAAGAVSAV; KLVKAVKTA; KTYFTTVAA; FLDVFTSFG; AIGEVVADA; GTAAIGEVV; QILSAIVTAA; KVLGAITGLI; VVADADAAKV; LIGDAVSSGL; KLFGKAGAAA; ELLDKLVKAV; GIAKGIKEIV; AITGLIGDAV; IQLGNGFLDV; AVSGEQILSA; FLDVFTSFGG; FLDVFTSFGGL; GLIGDAVSSGL; ILSAIVTAADA; KSDVKTYFTTV; FTSFGGLVAEA; KTYFTTVAAKL |
| | HLA-A0301 | KLKAVAAAK; KVADKASVK; LVAEAFGFK; AIALRGXAK; KTDLNSLPK; GAAESAVRK; QIAAAIALR; KASVKGIAK; TTVAAKLEK; KGAGKLFGK; KETPPALNK; GTAVEGAIK; TYFTTVAAK; KTYFTTVAAK; GLVAEAFGFK; AAIALRGXAK; FTTVAAKLEK; ALRGXAKDGK; IVEAAGGSEK; KSDISSTTGK; LLDKLVKAVK; SVKGIAKGIK; GLRKVGDSVK; XAKDGKFAVK; TKTDLNSLPK; EAFGFKSDPK; GDAVSSGLRK; KSDPKKSDVK; TVAAKLEKTK; KGAAESAVRK; KVGDSVKAASK; KTKTDLNSLPK; KLFGKAGAAAH; ASKETPPALNK; AVAAAKGENNK; KTDLNSLPKEK; AIKEVSELLDK; ELLDKLVKAVK; |

Fig. 32 continued

| | | AAHGDSEAASK; GXAKDGKFAVK |
|---|---|---|
| | HLA-A1101 | TTVAAKLEK; KTDLNSLPK; LVAEAFGFK; KVADKASVK; AIALRGXAK; GAAESAVRK; VVADADAAK; KASVKGIAK; KLKAVAAAK; GTAVEGAIK; TYFTTVAAK; AAAKGENNK; QIAAAIALR; AAGGSEKLK; AVKDGEKEK; KGAGKLFGK; AFGFKSDPK; DAVSSGLRK; VAAKLEKTK; PIAAAIGDK; AVSAVSGEQ; SDISSTTGK; KTYFTTVAA; KETPPALNK; KTYFTTVAAK; AAIALRGXAK; GLVAEAFGFK; TVAAKLEKTK; KSDISSTTGK; IVEAAGGSEK; SVKGIAKGIK; VAAAKGENNK; FTTVAAKLEK; EAFGFKSDPK; VSELLDKLVK; AADAAEQDGK; XAKDGKFAVK; KSDPKKSDVK; EVVADADAAK; VADKDDPTNK; KGAAESAVRK; TKTDLNSLPK; AFGFKSDPKK; GAEFGQDEXK; AVAAAKGENNK; KTKTDLNSLPK; ASKETPPALNK; TTVAAKLEKTK; KVGDSVKAASK; KTDLNSLPKEK; SVGTAVEGAIK; QVADKDDPTNK; AAAIALRGXAK; TAADAAEQDGK; AIKEVSELLDK; AAHGDSEAASK; ASVKGIAKGIK; EVSELLDKLVK; EAFGFKSDPKK; IALRGXAKDGK; AADAAEQDGKK; AAKVADKASVK; GXAKDGKFAVK; GAEFGQDEXKK; GGLVAEAFGFK; ELLDKLVKAVK; LIGDAVSSGLR |
| | HLA-A2402 | GFLDVFTSF; TYFTTVAAK; YFTTVAAKL; KFYQSVIQL; FYQSVIQLG; TYFTTVAAKL; SFGGLVAEAF; IQLGNGFLDVF |
| | HLA-A2902 | GFLDVFTSF; SVIQLGNGF; . . |
| | HLA-A6801 | TTVAAKLEK; QIAAAIALR; LVAEAFGFK; TYFTTVAAK; VVADADAAK; DAAEQDGKK; DAVSSGLRK; GAAESAVRK; KVADKASVK; FGFKSDPKK; DLNSLPKEK; SDISSTTGK; KLKAVAAAK; GTAVEGAIK; AAAKGENNK; FTTVAAKLEK; EVVADADAAK; EAFGFKSDPK; EAAGGSEKLK; KTYFTTVAAK; DQIAAAIALR; TVAAKLEKTK; SVKGIAKGIK; IVEAAGGSEK; FAVKDGEKEK; NPIAAAIGDK; GLVAEAFGFK; XAKDGKFAVK; VAAAKGENNK; AAIALRGXAK; DADAAKVADK; EAFGFKSDPKK; TTVAAKLEKTK; EIVEAAGGSEK; TAADAAEQDGK; EVSELLDKLVK; YFTTVAAKLEK; LIGDAVSSGLR; AVAAAKGENNK; QVADKDDPTNK; EKSDISSTTGK; ELLDKLVKAVK; AIKGAAESAVR; DDQIAAAIALR; SVGTAVEGAIK; AAHGDSEAASK |
| | HLA-B0702 | AVRKVLGAI; KPEEAKNPI; AASKAAGAV; GASSGTAAI; KAAGAVSAV; KPDSTGSVG; AASKETPPAL; AAESAVRKVL; AVRKVLGAIT; SAVRKVLGAI; KPDSTGSVGT; KPEEAKNPIA; KPEEAKNPIAA; KAASKETPPAL; KPDSTGSVGTA; GAAESAVRKVL; LPKEKSDISST; AVSGEQILSAI; AVSAVSGEQIL; AASKAAGAVSA |
| | HLA-B0801 | . . |
| | HLA-B1501 | SVIQLGNGF; DQIAAAIAL; GLVAEAFGF; FGKAGAAAH; QLGNGFLDVF; QSVIQLGNGF; YQSVIQLGNGF; IQLGNGFLDVF; TSFGGLVAEAF; KLFGKAGAAAH; ALRGXAKDGKF; GLIGDAVSSGL; AIGDKDGGAEF |
| | HLA-B2705 | RKVLGAITGL; |
| | HLA-B3501 | SVIQLGNGF; SAVSGEQIL; FGGLVAEAF; EAAGGSEKL; KPEEAKNPI; EVVADADAA; LGNGFLDVF; TAAIGEVVA; DPKKSDVKTY; SFGGLVAEAF; AASKETPPAL; QSVIQLGNGF; QLGNGFLDVF; SAIVTAADAA; TSFGGLVAEAF; DPKKSDVKTYF; TAEGASSGTAA; VADKDDPTNKF; KPEEAKNPIAA; YQSVIQLGNGF; KAASKETPPAL; TAVEGAIKEVS |
| | HLA-B4403 | EEAKNPIAA; GEVVADADA; AEFGQDEXK; AEGAIKGAA; KEIVEAAGGS; EEAKNPIAAA; GEVVADADAA; EEAKNPIAAAI; GENNKGAGKLF; AEGASSGTAAI; KEVSELLDKLV; AEGAIKGAAES; SELLDKLVKAV; AEFGQDEXKKD |
| | HLA-B5101 | KPEEAKNPI; LPKEKSDISS; LPKEKSDISST |
| | HLA-B5701 | |
| CAA57807.1; Associated | HLA-A0101 | LSANIEENY; YSEDKANTV; FLDALEAIEY; NSDKIDYAEKY; RLDNYDFKNEY; STDSIFLSEDM |

Fig. 32 continued

| protein A (BapA)[Borrelia burgdorferi]; SEQ ID NO:18, SEQ ID NO: 60009-60203 | HLA-A0201 | FLSEDMIRL; FLFLFVVSL; LLIFLFLFV; FLFVVSLSA; SIFNYLIQL; LIFLFLFVV; YLIKIKIST; KISTDSIFL; ALEAIEYLI; FVVSLSANI; ILKQILADL; LIGSYPDSI; KKISLLIFL; HVFSDAPRI; ISLLIFLFL; FLSEDMIRLI; SLLIFLFLFV; LLIFLFLFVV; RLIGSYPDSI; YLIQLNSDKI; KISLLIFLFL; FLFLFVVSLS; QLNSDKIDYA; QILKQILADL; SVFLDALEAI; FLDALEAIEYL; SLLIFLFLFVV; FLFVVSLSANI; FLFLFVVSLSA; LIFLFLFVVSL; ALEAIEYLIKI; ISLLIFLFLFV; SIFLSEDMIRL; SLSANIEENYT; KKISLLIFLFL |
|---|---|---|
| | HLA-A0301 | YLIQLNSDK; KANTVKQILK; ALEAIEYLIK; YTETKRAFSK; NYLIQLNSDK; SLLIFLFLFV; APRIRGDLRK; NLINKRLDNY; ILKQILADLPK; FSKEDFNLINK; FNYLIQLNSDK |
| | HLA-A1101 | KQILADLPK; AIEYLIKIK; YLIQLNSDK; TETKRAFSK; GDNARNNFK; KEDFNLINK; KANTVKQILK; YTETKRAFSK; GSYPDSIFNY; SIFLSEDMIR; ALEAIEYLIK; KSHVFSDAPR; HVFSDAPRIR; NSDKIDYAEK; YSEDKANTVK; EAIEYLIKIK; SLSANIEENY; NIEENYTETK; SKEDFNLINK; ILKQILADLPK; FSKEDFNLINK; KYGDNARNNFK |
| | HLA-A2402 | SYPDSIFNY; KISLLIFLF; NYTETKRAF; VFLDALEAI; SLLIFLFLF; SYPDSIFNYL; KYGDNARNNF; ISLLIFLFLF; IFLFLFVVSL; AFSKEDFNLI; KKISLLIFLF; LFVVSLSANI; IFLSEDMIRL; SYPDSIFNYLI; NYLIQLNSDKI; IFLSEDMIRLI; KISLLIFLFL; KYGDNARNNFK |
| | HLA-A2902 | SYPDSIFNY; DMIRLIGSY; KISLLIFLF; SLLIFLFLF; QLNSDKIDY; FLDALEAIEY; GSYPDSIFNY; SLSANIEENY; NLINKRLDNY; VFLDALEAIEY; KISLLIFLFLF; RLDNYDFKNEY; IGSYPDSIFNY; VSLSANIEENY |
| | HLA-A6801 | YLIQLNSDK; EDFNLINKR; DNARNNFKK; YDFKNEYEK; EENYTETKR; LSANIEENY; SHVFSDAPR; TETKRAFSK; IFLSEDMIR; DNYDFKNEY; HVFSDAPRIR; SIFLSEDMIR; EAIEYLIKIK; YTETKRAFSK; DAPRIRGDLR; YAEKYGDNAR; NIEENYTETK; NSDKIDYAEK; KSHVFSDAPR; YSEDKANTVK; KANTVKQILK; NYDFKNEYEK; GSYPDSIFNY; DSIFLSEDMIR; DNYDFKNEYEK; NIEENYTETKR; NYTETKRAFSK; FNYLIQLNSDK; EKSHVFSDAPR; DYAEKYGDNAR; FSKEDFNLINK; DAPRIRGDLRK; DALEAIEYLIK; DYSEDKANTVK; NNFKKDYSEDK; ILKQILADLPK |
| | HLA-B0702 | YPDSIFNYL; APRIRGDLR; APRIRGDLRK; YPDSIFNYLI; APRIRGDLRKI; RIRGDLRKIGI |
| | HLA-B0801 | |
| | HLA-B1501 | DMIRLIGSY; FLFLFVVSL; LSANIEENY; IGSYPDSIF; KISLLIFLF; NEYEKSHVF; QLNSDKIDY; IQLNSDKIDY; GSYPDSIFNY; SLSANIEENY; KIKISTDSIF; FLDALEAIEY; RLIGSYPDSIF; KQILKQILADL; FKNEYEKSHVF; IGSYPDSIFNY |
| | HLA-B2705 | KRLDNYDFK; KQILADLPK; KRAFSKEDF; ARNNFKKDY; RKIGIKEKSVF; KRAFSKEDFNL; KQILKQILADL |
| | HLA-B3501 | YPDSIFNYL; DALEAIEYL; LDALEAIEY; LSANIEENY; NEYEKSHVF; YPDSIFNYLI; FLDALEAIEY; LDNYDFKNEY; YAEKYGDNAR; VFLDALEAIEY; FKNEYEKSHVF; YPDSIFNYLIQ; RLDNYDFKNEY |
| | HLA-B4403 | NEYEKSHVF; SEDMIRLIGS; EENYTETKRAF; SEDMIRLIGSY; SEDKANTVKQI |
| | HLA-B5101 | EAIEYLIKI; YPDSIFNYL; YPDSIFNYLI; EAIEYLIKIKI |
| | HLA-B5701 | GSYPDSIFNY; VSLSANIEENY |
| AAL25643.1, P37-47 [Borrelia burgdorferi]; SEQ ID | HLA-A0101 | SSNKDIYNSY; LSSNKDIYNSY |
| | HLA-A0201 | IVYEILEEV; KIPEITEEV; NLSAIEESV; KLKEFLEKL; VIMPIPQTI; YIPEVKEEI; SLNLSTKSV; KINNGLNIV; IYNSYIPEV; FLTQGTSPS; NIDNITENL; FLLLNLVNC; SIAKLLQHL; ITEEVIMPI; KLSQVAQHA; NTWGEGLEI; CAFLLLNLV; FLEKLKKYL; FLTQGTSPSI; YLKDTNNLSA; |

Fig. 32 continued

| NO:19, SEQ ID NO: 60204-60500 | | ILEEVIIPET; YIPEVKEEIV; NLVNCKFDSL; IIPETKIPEI; DIYNSYIPEV; IVYEILEEVI; KIPEITEEVI; EIVYEILEEV; MCAFLLLNLV; YLKDTNNLSAI; VIIPETKIPEI; IVYEILEEVII; YIEPRPISSFL; FLTQGTSPSIT; KIPEITEEVIM; TIDFYIEPRPI |
|---|---|---|
| | HLA-A0301 | ITSTIKSYK; LLLNLVNCK; RSSIRTKIK; NLNSKETPK; KITHPIFDH; EVRSSIRTK; KTSTSEDQK; IIEDLQKLK; SITSTIKSYK; IAKLLQHLSK; TIKSYKELAK; FLLLNLVNCK; KLKEFLEKLK; LQKLKEFLEK; QVAQHAPNSK; KVSDGTEQTK; TSPSITSTIK; IYNSYIPEVK; KSYKELAKEK; FLEKLKKYLK; NLSAIEESVK; KFDSLNLSTK; NLSTKSVDDK; KIEKVKSDGK; INNGLNIVQK; QHAPNSKIEK; KINNGLNIVQK; SIAKLLQHLSK; KLKEFLEKLKK; HLSKSEDQANK; GTSPSITSTIK; AQHAPNSKIEK; STIKSYKELAK; ILEEVIIPETK; PSITSTIKSYK; KSDGKPVPGDK; DIYNSYIPEVK |
| | HLA-A1101 | ITSTIKSYK; KTSTSEDQK; VAQHAPNSK; LLLNLVNCK; RSSIRTKIK; TIDFYIEPR; IIEDLQKLK; NLNSKETPK; NITENLNSK; LSAIEESVK; HAPNSKIEK; ISGKEVEEK; VSDGTEQTK; LSTKSVDDK; SPSITSTIK; SITSTIKSY; AKLLQHLSK; SITSTIKSYK; KSYKELAKEK; QVAQHAPNSK; KVSDGTEQTK; TSPSITSTIK; TIKSYKELAK; QTIDFYIEPR; IAKLLQHLSK; FLLLNLVNCK; SSNKDIYNSY; LQKLKEFLEK; KLKEFLEKLK; KIEKVKSDGK; KFDSLNLSTK; NLSAIEESVK; IYNSYIPEVK; EIIEDLQKLK; LSKSEDQANK; FLEKLKKYLK; SIAKLLQHLSK; STIKSYKELAK; KINNGLNIVQK; SVDDKNNSIAK; GTSPSITSTIK; AQHAPNSKIEK; SQVAQHAPNSK; PSITSTIKSYK; AFLLLNLVNCK; KSDGKPVPGDK; ITENKEQEHEK; KLKEFLEKLKK; DIYNSYIPEVK; HLSKSEDQANK; ILEEVIIPETK; DLQKLKEFLEK |
| | HLA-A2402 | KYLKDTNNL; VYEILEEVI; IYNSYIPEV; VIMPIPQTI; TSPSITSTI; SYIPEVKEEI; VYEILEEVII; SYKELAKEKI; IYNSYIPEVK; KYLKDTNNLS; FYIEPRPISSF; SFLTQGTSPSI; SYIPEVKEEIV |
| | HLA-A2902 | LLNLVNCKF; EFLEKLKKY; SSNKDIYNSY; IMPIPQTIDF; YIPEVKEEIVY; IMPIPQTIDFY; FYIEPRPISSF; FLLLNLVNCKF |
| | HLA-A6801 | ITSTIKSYK; ETPKEISGK; TIDFYIEPR; NITENLNSK; EVRSSIRTK; HAPNSKIEK; FFTNLEEVR; KTSTSEDQK; LSAIEESVK; LSTKSVDDK; DSNFFTNLE; YNSYIPEVK; EEVIIPETK; NLNSKETPK; ENKEQEHEK; IIEDLQKLK; QTIDFYIEPR; SITSTIKSYK; EIIEDLQKLK; EISGKEVEEK; QVAQHAPNSK; TSPSITSTIK; NFFTNLEEVR; NLSAIEESVK; NLEEVRSSIR; TIKSYKELAK; MPIPQTIDFY; IYNSYIPEVK; IAKLLQHLSK; FLEKLKKYLK; KVSDGTEQTK; FLLLNLVNCK; NLSTKSVDDK; KSYKELAKEK; LSKSEDQANK; INNGLNIVQK; DTNNLSAIEE; DSNFFTNLEE; SSNKDIYNSY; DIYNSYIPEVK; STIKSYKELAK; SNFFTNLEEVR; SIAKLLQHLSK; EIDEIIEDLQK; ITENKEQEHEK; EVRSSIRTKIK; HLSKSEDQANK; GTSPSITSTIK; HAPNSKIEKVK; PSITSTIKSYK; CKFDSLNLSTK; DLQKLKEFLEK; KINNGLNIVQK; ILEEVIIPETK; EFLEKLKKYLK |
| | HLA-B0702 | EPRPISSFL; KPVPGDKIL; RPISSFLTQ; MPIPQTIDF; APNSKIEKV; RPISSFLTQG; TPKEISGKEV; SPSITSTIKS; IPEITEEVIM; EVRSSIRTKI; EPRPISSFLT; RPISSFLTQGT; SPSITSTIKSY; KPVPGDKILSS; MPIPQTIDFYI; HPIFDHITGSG |
| | HLA-B0801 | FLEKLKKYL; ; YLKDTNNLSAI |
| | HLA-B1501 | SNKDIYNSY; SITSTIKSY; LLNLVNCKF; AQHAPNSKI; LEIGGDSNF; SSNKDIYNSY; YIEPRPISSF; IMPIPQTIDF; PSITSTIKSY; LLLNLVNCKF; YLKDTNNLSA; LEIGGDSNFF; LSSNKDIYNSY; YLKDTNNLSAI; IMPIPQTIDFY; FYIEPRPISSF; VIMPIPQTIDF; YIPEVKEEIVY; TQNIDNITENL; FLLLNLVNCKF |
| | HLA-B2705 | VRSSIRTKIK; |
| | HLA-B3501 | MPIPQTIDF; KPVPGDKIL; EPRPISSFL; EIGGDSNFF; ILSSNKDIY; |

Fig. 32 continued

| | | |
|---|---|---|
| | | IPEITEEVI; MPIPQTIDFY; IPEVKEEIVY; IPEITEEVIM; LEIGGDSNFF; SPSITSTIKSY; NPGQDSISNTW; MPIPQTIDFYI; YIPEVKEEIVY; LSSNKDIYNSY; EVEEKITHPIF |
| | HLA-B4403 | EEVIMPIPQ; EEIVYEILE; EEKITHPIF; EEVRSSIRT; YEILEEVII; DEIIEDLQK; SEDQKELEI; PEITEEVIM; PEVKEEIVY; SEDQANKTS; LEIGGDSNF; EEVIMPIPQT; EEIVYEILEE; KEFLEKLKKY; EEVIIPETKI; EEKITHPIFD; VEIDEIIEDL; KEKINNGLNI; DEIIEDLQKL; EEVIMPIPQTI; KEFLEKLKKYL; EEIVYEILEEV; KEVEEKITHPI; EEVRSSIRTKI; PEITEEVIMPI; VEIDEIIEDLQ; YEILEEVIIPE |
| | HLA-B5101 | IPQTIDFYI; MPIPQTIDF; IPETKIPEI; IPEITEEVI; CAFLLLNLV; IPEVKEEIV; KPVPGDKIL; EPRPISSFL; MPIPQTIDFY; TPKEISGKEV; MPIPQTIDFYI |
| | HLA-B5701 | PGQDSISNTW; |
| NP_212481.1 \| fibronectin/fibrinogen-binding protein, putative [Borrelia burgdorferi B31]; SEQ ID NO:20, SEQ ID NO: 60501-61184 | HLA-A0101 | YSEFLENYY; HTRDYPGAY; KSGKADLYY; YTEINTLIK; MSDKKIMEL; LSPKENALQY; NSNFKILDAY; MSDKKIMELK; TSYSEFLENY; YTSYSEFLENY; NSNFKILDAYY; KTPKIGLHFTY; TSYSEFLENYY; SLSPKENALQY; WLHTRDYPGAY |
| | HLA-A0201 | FLENYYESL; KLWPSSPNII; LLGAGNLCV; KMSLNYTEI; TLIKEIPFT; FTYCGFEIL; ILQKDMIIL; FTNSLITKI; KLGLVIPKA; KADLYYTQV; ILFIKLWPS; LVLEIYNKI; VLEKRIDSL; LIQSKITML; TMLKVENLI; ILICLNPNT; IQPDYKSLV; LLNYKEEKI; SLSPKENAL; NLCVFYTKL; KTPSLDVLL; KMSDKKIMEL; KLWPSSPNII; VLLGAGNLCV; KLDENLIKKI; FTYCGFEILI; SLVLEIYNKI; NLIQSKITML; NLLNYKEEKI; SLNYTEINTL; IIATNSNFKI; IQSKITMLKV; WLHTRDYPGA; LQKDMIILFI; LLIEKYKKEL; IVLEKRIDSL; IIQPDYKSLV; FTNSLITKII; YTQVKNLRRV; QMKNERIISL; KILICLNPNT; ILFIKLWPSS; KLWPSSPNIIA; ILQKDMIILFI; FQMKNERIISL; ILDAYYRRPKI; LIQSKITMLKV; SLNYTEINTLI; LLIEKYKKELI; KIIQPDYKSLV; SLNDQIKKTNI; GLHFTYCGFEI; CLNPNTTRFHI; NIIATNSNFKI; LLNYKEEKIKI; FLKSKIQNGKI; KIDNKKFKILI; MSLNYTEINTL; LIKEIPFTNSL; FIKLWPSSPNI; SLDVLLGAGNL; QLKDNLDKFNL; NTSYTSYSEFL |
| | HLA-A0301 | KLRFSDFLK; IQSKITMLK; SLNQSLSPK; TTRFHITKK; LQYFKAYKK; IIATNSNFK; HITKKNFKK; KIIKAFQMK; VFYTKLAKK; CVFYTKLAK; LLNINKIQK; IISLEILQK; KLDENLIKK; KNFKKNALK; ALQYFKAYK; KIQNGKIIK; SLVLEIYNK; NLRRVKNKK; GLVIPKAEK; ELILLNINK; KENALQYFK; EIYNKIDNK; KSGKADLYY; NTTRFHITK; QVKNLRRVK; ETTGEIFLK; KTAIKEKEK; KILDAYYRR; AYYRRPKIK; LIQSKITMLK; ILLNINKIQK; ALQYFKAYKK; ISLNQSLSPK; CVFYTKLAKK; RIISLEILQK; ILDAYYRRPK; AYKKGKNSFK; NIIATNSNFK; LCVFYTKLAK; NALQYFKAYK; KSLVLEIYNK; KKNFKKNALK; GAYVFIKNQK; RFHITKKNFK; YTKLAKKSGK; IPFTNSLITK; KLLENIENEK; ITKIIQPDYK; NTTRFHITKK; RIDSLKQQIK; FLKSKIQNGK; KADLYYTQVK; AIKEKEKTPK; MSDKKIMELK; LLNYKEEKIK; AGNLCVFYTK; VLEKRIDSLK; YVFIKNQKNK; SFKTIQNQLK; GELILLNINK; LKLRFSDFLK; TTGEIFLKAK; GKIIKAFQMK; HIKLDENLIK; QYFKAYKKGK; NINKIQKGIK; EIYNKIDNKK; KETTGEIFLK; LGLVIPKAEK; KELLIEKYKK; GLHFTYCGFE; NYTEINTLIK; KNLRRVKNKK; KAYKKGKNSFK; KLRFSDFLKSK; KISLNQSLSPK; KLGLVIPKAEK; NLIQSKITMLK; ALKLRFSDFLK; KMSDKKIMELK; IVLEKRIDSLK; KTNIKELLIEK; NSFKTIQNQLK; KILDAYYRRPK; LQYFKAYKKGK; LILLNINKIQK; GIKEINLLNYK; RFHITKKNFKK; LLGAGNLCVFY; KSKIQNGKIIK; KTPKIGLHFTY; TSYSEFLENYY; HIKLDENLIKK; RDYPGAYVFIK; ILICLNPNTTR; LITKIIQPDYK; NLDKFNLIQSK; KLDENLIKKIK; SLSPKENALQY; QVKNLRRVKNK; SLITKIIQPDY; EIHESNKMSDK; NLCVFYTKLAK; GAGNLCVFYTK; LQKDMIILFIK; IQNQLKDNLDK |

Fig. 32 continued

| | | |
|---|---|---|
| | HLA-A1101 | SLNQSLSPK; IQSKITMLK; IIATNSNFK; ALQYFKAYK; CVFYTKLAK; SLVLEIYNK; KIIKAFQMK; LQYFKAYKK; NTTRFHITK; IISLEILQK; TTRFHITKK; ETTGEIFLK; KENALQYFK; KIQNGKIIK; KLRFSDFLK; KILDAYYRR; HITKKNFKK; YTEINTLIK; KLDENLIKK; ELILLNINK; KTAIKEKEK; EIYNKIDNK; KAEKNLHIK; NIKELLIEK; LLNINKIQK; GNLCVFYTK; YTQVKNLRR; VFYTKLAKK; KDMIILFIK; KAFQMKNER; RFSDFLKSK; KEINLLNYK; GLVIPKAEK; ESLNDQIKK; KKLGLVIPK; KIMELKEEY; ESNKMSDKK; KNFKKNALK; AYYRRPKIK; NLLNYKEEK; QVKNLRRVK; AYVFIKNQK; YPGAYVFIK; EILIGRNAK; NQLKDNLDK; GAGNLCVFY; KSGKADLYY; TSYSEFLEN; KSLVLEIYNK; RIISLEILQK; ISLNQSLSPK; LIQSKITMLK; NIIATNSNFK; TTGEIFLKAK; ALQYFKAYKK; CVFYTKLAKK; GAYVFIKNQK; TSYSEFLENY; MSDKKIMELK; NTTRFHITKK; YVFIKNQKNK; ITKIIQPDYK; AGNLCVFYTK; NALQYFKAYK; KLLENIENEK; KADLYYTQVK; ILLNINKIQK; KAKEIHESNK; RIDSLKQQIK; ILDAYYRRPK; AIKEKEKTPK; VLEKRIDSLK; EIYNKIDNKK; IPFTNSLITK; TQVKNLRRVK; TNIKELLIEK; YTKLAKKSGK; NINKIQKGIK; HIKLDENLIK; KETTGEIFLK; SFKTIQNQLK; DAYYRRPKIK; LICLNPNTTR; GIKEINLLNY; RFHITKKNFK; KTNIKELLIEK; KISLNQSLSPK; KAYKKGKNSFK; KILDAYYRRPK; KMSDKKIMELK; IVLEKRIDSLK; ALKLRFSDFLK; TSYSEFLENYY; GAGNLCVFYTK; NLIQSKITMLK; NSFKTIQNQLK; GIKEINLLNYK; TAIKEKEKTPK; LILLNINKIQK; KLGLVIPKAEK; NALQYFKAYKK; LITKIIQPDYK; YTQVKNLRRVK; LQYFKAYKKGK; NLCVFYTKLAK; LQKDMIILFIK; IQNQLKDNLDK; KSKIQNGKIIK; KLRFSDFLKSK; SPKENALQYFK; EINLLNYKEEK; KTPKIGLHFTY; ETTGEIFLKAK; QVKNLRRVKNK; HIKLDENLIKK; YTSYSEFLENY; NIKELLIEKYK; EIPFTNSLITK; RDYPGAYVFIK; NLDKFNLIQSK; VLEIYNKIDNK; ILICLNPNTTR; IIKAFQMKNER; KLDENLIKKIK; KGELILLNINK; RFHITKKNFKK; LIPEEEYNQEK; SNFKILDAYYR; SLITKIIQPDY; TYCGFEILIGR; TSYTSYSEFLE; SLSPKENALQY |
| | HLA-A2402 | DYPGAYVFI; DYKSLVLEI; LWPSSPNII; SYTSYSEFL; YYESLNDQI; NYTEINTLI; TYCGFEILI; KYKKELIVL; LYYTQVKNL; TMLKVENLI; HFTYCGFEI; AYKKGKNSF; KTPKIGLHF; IYNKIDNKK; EYNQEKTAI; TSYTSYSEF; EYNNTSYTS; KFNLIQSKI; IYNKIDNKKF; DYPGAYVFIK; NYYESLNDQI; EFLENYYESL; EYNNTSYTSY; ITMLKVENLI; IIATNSNFKI; SYTSYSEFLE; NTSYTSYSEF; HFTYCGFEILI; NFKKNALKLRF; YYTQVKNLRRV; KYKKELIVLEK |
| | HLA-A2902 | YSEFLENYY; YNNTSYTSY; NFKILDAYY; SYSEFLENY; PKIGLHFTY; GAGNLCVFY; KIMELKEEY; KSGKADLYY; KEEYNNTSY; EYNNTSYTSY; SYSEFLENYY; SNFKILDAYY; TSYSEFLENY; DYKSLVLEIY; LSPKENALQY; GIKEINLLNY; IYNKIDNKKF; ENALQYFKAY; NIKELLIEKY; KTPKIGLHFTY; TSYSEFLENYY; SLSPKENALQY; YTSYSEFLENY; ELKEEYNNTSY; SLITKIIQPDY; LLGAGNLCVFY; KVENLIPEEEY; WLHTRDYPGAY; EEYNNTSYTSY; NSNFKILDAYY; TNIKELLIEKY |
| | HLA-A6801 | ETTGEIFLK; NTTRFHITK; YYTQVKNLR; CVFYTKLAK; IIATNSNFK; EIYNKIDNK; ESNKMSDKK; TTRFHITKK; ELILLNINK; HITKKNFKK; KAFQMKNER; YTQVKNLRR; FKILDAYYR; YTEINTLIK; YTSYSEFLE; SLVLEIYNK; IQSKITMLK; EILIGRNAK; ESLNDQIKK; NIKELLIEK; NLLNYKEEK; CGFEILIGR; LQYFKAYKK; IISLEILQK; YPGAYVFIK; LLENIENEK; ALQYFKAYK; NTSYTSYSE; KILDAYYRR; AYVFIKNQK; QVKNLRRVK; IYNKIDNKK; YSEFLENYY; SLNQSLSPK; LLNINKIQK; ELLIEKYKK; ENIENEKEK; KIIKAFQMK; KLRFSDFLK; TSYTSYSEF; DKFNLIQSK; NLRRVKNKK; KTAIKEKEK; ITKIIQPDY; NIIATNSNFK; NTTRFHITKK; CVFYTKLAKK; EIYNKIDNKK; YVFIKNQKNK; NALQYFKAYK; YTKLAKKSGK; NFKILDAYYR; ITKIIQPDYK; |

Fig. 32 continued

| | | |
|---|---|---|
| | | YYTQVKNLRR; DAYYRRPKIK; NAKENDKLLR; TTGEIFLKAK; LIOLNPNTTR; LYYTQVKNLR; MSDKKIMELK; LIQSKITMLK; TSYSEFLENY; NINKIQKGIK; GAYVFIKNQK; NYTEINTLIK; FKILDAYYRR; RIISLEILQK; DYPGAYVFIK; IPFTNSLITK; EYNQEKTAIK; NFKKNALKLR; NTSYTSYSEF; HIKLDENLIK; IKAFQMKNER; FLKSKIQNGK; TSYTSYSEFL; TNIKELLIEK; SFKTIQNQLK; ILLNINKIQK; EYNNTSYTSY; QYFKAYKKGK; NSNFKILDAY; EKTAIKEKEK; ISLNQSLSPK; YYESLNDQIK; ALQYFKAYKK; KAKEIHESNK; DLYYTQVKNLR; ETTGEIFLKAK; EINLLNYKEEK; NSFKTIQNQLK; TYCGFEILIGR; IIKAFQMKNER; NLIQSKITMLK; SNFKILDAYYR; EIPFTNSLITK; ENALQYFKAYK; YTSYSEFLENY; TSYSEFLENYY; ILIOLNPNTTR; EIHESNKMSDK; LITKIIQPDYK; NALQYFKAYKK; NFKILDAYYRR; TAIKEKEKTPK; NIKELLIEKYK; NLCVFYTKLAK; TSYTSYSEFLE; IVLEKRIDSLK; NPNTTRFHITK; HIKLDENLIKK; NYYESLNDQIK; YTQVKNLRRVK; LYYTQVKNLRR; NSNFKILDAYY; IYNKIDNKKFK; LILLNINKIQK; KAYKKGKNSFK; SPKENALQYFK; FYTKLAKKSGK; TRFHITKKNFK; NTSYTSYSEFL; GIKEINLLNYK; QVKNLRRVKNK; KTNIKELLIEK; EEYNQEKTAIK; LIPEEEYNQEK; YYESLNDQIKK; KISLNQSLSPK; EEYNNTSYTSY; LQYFKAYKKGK; ERIISLEILQK; LNYTEINTLIK; GAGNLCVFYTK; LLENIENEKEK; NLDKFNLIQSK; NGKIIKAFQMK |
| | HLA-B0702 | QPDYKSLVL; RVKNKKLGL; NPNTTRFHI; WPSSPNIIA; RPKIKETTG; IPFTNSLIT; WPSSPNIIAT; SPKENALQYF; IPKAEKNLHI; KAYKKGKNSF; IVLEKRIDSL; LAKKSGKADL; RPKIKETTGE; NPNTTRFHIT; RPKIKETTGEI; SPNIIATNSNF; RVKNKKLGLVI; IPFTNSLITKI; QPDYKSLVLEI; TPKIGLHFTYC |
| | HLA-B0801 | ALKLRFSDF; LRRVKNKKL; NLRRVKNKKL; QIKKTNIKEL; QMKNERIISL; ITKKNFKKNAL; FLKSKIQNGKI; RPKIKETTGEI; QIKKTNIKELL |
| | HLA-B1501 | LQKDMIILF; YNNTSYTSY; HTRDYPGAY; NQKNKTPSL; TSYTSYSEF; KIMELKEEY; ALKLRFSDF; NIIATNSNF; ITKIIQPDY; YSEFLENYY; GLHFTYCGF; RDYPGAYVF; KSGKADLYY; IQNGKIIKAF; KIKETTGEIF; LLGAGNLCVF; QMKNERIISL; KAYKKGKNSF; GIKEINLLNY; ILQKDMIILF; KMSDKKIMEL; IQKGIKEINL; IQPDYKSLVL; LQKDMIILFI; TSYSEFLENY; NTSYTSYSEF; WLHTRDYPGAY; LLRHCVKGNDY; FQMKNERIISL; ELKEEYNNTSY; LLGAGNLCVFY; VLLGAGNLCVF; HTRDYPGAYVF; KIQNGKIIKAF; SLSPKENALQY; YTSYSEFLENY; IQKGIKEINLL; SLITKIIQPDY; TSYSEFLENYY; LAKKSGKADLY; NQSLSPKENAL; KENALQYFKAY; KVENLIPEEEY; KTPKIGLHFTY; LIKEIPFTNSL; NSNFKILDAYY |
| | HLA-B2705 | KKLGLVIPK; KKNALKLRF; GRNAKENDK; LQYFKAYKK; RRVKNKKLGL; LRFSDFLKSK; TRFHITKKNF; KRIDSLKQQI; KRIDSLKQQIK; RRVKNKKLGLV; TRFHITKKNFK; LRFSDFLKSKI; LRRVKNKKLGL; FQMKNERIISL |
| | HLA-B3501 | NALQYFKAY; SPKENALQY; YSEFLENYY; QPDYKSLVL; IPFTNSLIT; WPSSPNIIA; HTRDYPGAY; FTYCGFEIL; YNNTSYTSY; NFKILDAYY; YKSLVLEIY; TSYTSYSEF; NLIQSKITM; TPKIGLHFTY; WPSSPNIIAT; SPKENALQYF; NSNFKILDAY; NPNTTRFHIT; LKEEYNNTSY; ENALQYFKAY; EYNNTSYTSY; NTSYTSYSEF; TPSLDVLLGA; TSYSEFLENY; FNLIQSKITM; SPNIIATNSNF; WLHTRDYPGAY; MSLNYTEINTL; TSYSEFLENYY; EINTLIKEIPF; YTSYSEFLENY; WPSSPNIIATN; EILQKDMIILF; LAKKSGKADLY; NSNFKILDAYY; TNSNFKILDAY; KVENLIPEEEY; HTRDYPGAYVF; TPSLDVLLGAG; EEYNNTSYTSY; VLLGAGNLCVF; LIOLNPNTTRF; ELKEEYNNTSY; IPFTNSLITKI |
| | HLA-B4403 | KEIPFTNSL; SEFLENYYE; AEKNLHIKL; KEIHESNKM; KETTGEIFL; |

Fig. 32 continued

| | | EEYNNTSYT; KEEYNNTSY; FEILIGRNA; SEFLENYYES; KEIPFTNSLI; KEIHESNKMS; GEIFLKAKEI; EEYNQEKTAI; TEINTLIKEI; LEILQKDMII; EEYNNTSYTS; AEKNLHIKLD; EEKIKISLNQ; SEFLENYYESL; KEIPFTNSLIT; KENALQYFKAY; EEYNNTSYTSY; KEKTPKIGLHF; KEKEKTPKIGL |
|---|---|---|
| | HLA-B5101 | IPFTNSLIT; WPSSPNIIA; NPNTTRFHI; IPFTNSLITK; IPKAEKNLHI; WPSSPNIIAT; IPFTNSLITKI; QPDYKSLVLEI |
| | HLA-B5701 | TSYSEFLENY; LSPKENALQY; TSYSEFLENYY; KTPKIGLHFTY |
| AAC44656.1; P30 Borrelia burgdorferi; SEQ ID NO:21, Seq ID NO: 61185-61566 | HLA-A0101 | TTNDSSTAY; ETSSDGTAY; DSSTAYKMY; ASKMIDTLY; ELDAILVPY; SSDGTAYPFY; YTTNDSSTAY; VASKMIDTLY; EVELEEITFY; TSSDGTAYPFY; NVASKMIDTLY; VTDKYGQNWTS |
| | HLA-A0201 | SLSLIIFSL; SLIIFSLTV; KLQRSLSLI; AIDSKTLEI; YVNEELDAI; LVHQSFIPV; HQSFIPVPV; MVTSGPFKL; YKMYVNEEL; ELEEITFYT; LTWSDGVAI; LIIFSLTVL; YLRDNLTWS; KMIDTLYRG; SSTAYKMYV; MIDTLYRGI; KMIDTLYRGI; LLVHQSFIPV; TLASPKPYFI; SLIIFSLTVL; KLQRSLSLII; RSLSLIIFSL; NMVTSGPFKL; YVNEELDAIL; SLSLIIFSLT; KMYVNEELDA; LSLIIFSLTV; MIDTLYRGIV; RAIDSKTLEI; SLSLIIFSLTV; YVNEELDAILV; ILNKETGSTYV; KMIDTLYRGIV; SLDPQLAEDNV; KMYVNEELDAI; FIDLLVHQSFI; LVHQSFIPVPV; AIDSKTLEITL; ITLASPKPYFI; LTWSDGVAITA; QLAEDNVASKM; DLLVHQSFIPV; SSDGTAYPFYL |
| | HLA-A0301 | KSYLRILNK; NMVTSGPFK; VTSGPFKLK; GTAYPFYLR; AITAEGIRK; TTNDSSTAY; GSTYVDMVK; GGHKPGLAK; RSLSLIIFS; TTNDSSTAYK; MVTSGPFKLK; KLKERIPSEK; TLEITLASPK; YVDMVKSIIK; RKSYLRILNK; VAITAEGIRK; SLTVLCCDNK; ILNKETGSTY; ENMVTSGPFK; ELGIRAIDSK; QLAEDNVASK; TGGHKPGLAK; SSDGTAYPFY; VLCCDNKERK; TGSTYVDMVK; KTLEITLASPK; NMVTSGPFKLK; GVAITAEGIRK; RIPSEKYVFEK; YTTNDSSTAYK; RILNKETGSTY; KLKERIPSEKY; VTGDPNTGGHK; NTGGHKPGLAK; NVASKMIDTLY; TSSDGTAYPFY; FSLTVLCCDNK; FIPVPVHVTDK |
| | HLA-A1101 | KSYLRILNK; GTAYPFYLR; VTSGPFKLK; AITAEGIRK; GSTYVDMVK; TTNDSSTAY; NMVTSGPFK; LTVLCCDNK; ITLASPKPY; PSEKYVFEK; KISLGAEPR; LAEDNVASK; TNDSSTAYK; ASKMIDTLY; VTDSELGIR; SIIKNGQEY; TTNDSSTAYK; MVTSGPFKLK; TLEITLASPK; VAITAEGIRK; YVDMVKSIIK; SLTVLCCDNK; KLKERIPSEK; ASKMIDTLYR; SSDGTAYPFY; QLAEDNVASK; VLCCDNKERK; TVLCCDNKER; TGSTYVDMVK; RKSYLRILNK; IPSEKYVFEK; TSGPFKLKER; QVTDSELGIR; GVAITAEGIR; KTLEITLASPK; GVAITAEGIRK; TVLCCDNKERK; YTTNDSSTAYK; RIPSEKYVFEK; VTGDPNTGGHK; TSSDGTAYPFY; NTGGHKPGLAK; FSLTVLCCDNK; NMVTSGPFKLK; VASKMIDTLYR; STKISLGAEPR; VTSGPFKLKER; ETGSTYVDMVK; TAEGIRKSYLR; TYVDMVKSIIK; NVASKMIDTLY |
| | HLA-A2402 | FYLRDNLTW; TYVDMVKSI; YYDSNEVEL; SFIPVPVHV; SYLRILNKE; TYVDMVKSII; MYVNEELDAI; AYPFYLRDNL; AYKMYVNEEL; KYYDSNEVEL; YFIDLLVHQSF; MYVNEELDAIL; ITLASPKPYFI; FYTTNDSSTAY |
| | HLA-A2902 | YVFEKDNKY; ETSSDGTAY; SIIKNGQEY; TTNDSSTAY; VFEKDNKYY; ELDAILVPY; FYLRDNLTW; ASKMIDTLY; YFIDLLVHQ; YVFEKDNKYY; YTTNDSSTAY; EVELEEITFY; KYVFEKDNKY; VASKMIDTLY; ILNKETGSTY; KSIIKNGQEY; PVPVHVTDKY; FYTTNDSSTAY; YFIDLLVHQSF; NVASKMIDTLY; KYVFEKDNKYY; GWETSSDGTAY; RILNKETGSTY |
| | HLA-A6801 | GTAYPFYLR; LTVLCCDNK; NMVTSGPFK; GSTYVDMVK; TTNDSSTAY; EGIRKSYLR; VAITAEGIR; ETSSDGTAY; VTSGPFKLK; LAEDNVASK; YVFEKDNKY; TNDSSTAYK; SKMIDTLYR; KISLGAEPR; KSYLRILNK; |

Fig. 32 continued

| | | |
|---|---|---|
| | | VLCCDNKER; PSEKYVFEK; TTNDSSTAYK; MVTSGPFKLK; TVLCCDNKER; DGTAYPFYLR; QVTDSELGIR; YTTNDSSTAY; ASKMIDTLYR; TSGPFKLKER; ENMVTSGPFK; GVAITAEGIR; YVFEKDNKYY; YVDMVKSIIK; QLAEDNVASK; TGSTYVDMVK; SLTVLCCDNK; IPSEKYVFEK; EVELEEITFY; TLEITLASPK; ITAEGIRKSY; TKISLGAEPR; VAITAEGIRK; ELGIRAIDSK; TAYKMYVNEE; EKYVFEKDNK; STAYKMYVNE; MVKSIIKNGQ; VASKMIDTLY; IPVPVHVTDK; EITLASPKPY; YTTNDSSTAYK; TAEGIRKSYLR; LTVLCCDNKER; ETGSTYVDMVK; STKISLGAEPR; TVLCCDNKERK; VASKMIDTLYR; TSSDGTAYPFY; NVASKMIDTLY; VTSGPFKLKER; DGVAITAEGIR; FSLTVLCCDNK; NMVTSGPFKLK; KTLEITLASPK; TYVDMVKSIIK; NTGGHKPGLAK; GVAITAEGIRK; RIPSEKYVFEK; STAYKMYVNEE; ETSSDGTAYPF; FIPVPVHVTDK; MVTSGPFKLKE; TTNDSSTAYKM |
| | HLA-B0702 | YPFYLRDNL; SPKPYFIDL; KPYFIDLLV; EPRSLDPQL; SPENMVTSG; SPKPYFIDLL; RAIDSKTLEI; GIRKSYLRIL; KPGLAKGWET; SPENMVTSGPF; YPFYLRDNLTW; SPKPYFIDLLV; KISLGAEPRSL |
| | HLA-B0801 | |
| | HLA-B1501 | YVFEKDNKY; TTNDSSTAY; ITLASPKPY; LNKETGSTY; SIIKNGQEY; IIKNGQEYF; ASKMIDTLY; LQRSLSLII; ETSSDGTAY; TLASPKPYF; ENMVTSGPF; SLSLIIFSL; YVFEKDNKYY; LQRSLSLIIF; ITAEGIRKSY; YTTNDSSTAY; ILNKETGSTY; TSSDGTAYPF; KSIIKNGQEY; HQSFIPVPVH; SIIKNGQEYF; GQNWTSPENM; ITLASPKPYF; YVNEELDAIL; SLIIFSLTVL; KMIDTLYRGI; WETSSDGTAY; KLKERIPSEKY; YFIDLLVHQSF; KLQRSLSLIIF; RILNKETGSTY; TSSDGTAYPFY; AITAEGIRKSY; KSIIKNGQEYF; LEITLASPKPY; QLAEDNVASKM; ETSSDGTAYPF |
| | HLA-B2705 | QRSLSLIIF; RKSYLRILNK; QRSLSLIIFSL; RKEGVSTKISL; IRKSYLRILNK |
| | HLA-B3501 | VPVHVTDKY; TTNDSSTAY; ETSSDGTAY; YVFEKDNKY; EVELEEITF; YPFYLRDNL; YVNEELDAI; ELDAILVPY; TAEGIRKSY; LTWSDGVAI; EPRSLDPQL; DSSTAYKMY; VASKMIDTL; SSDGTAYPF; SIIKNGQEY; ENMVTSGPF; YTTNDSSTAY; YVNEELDAIL; VASKMIDTLY; TSSDGTAYPF; YVFEKDNKYY; YPFYLRDNLT; WETSSDGTAY; LAEDNVASKM; EVELEEITFY; EELDAILVPY; KPYFIDLLVH; EITLASPKPY; DPQLAEDNVA; NEVELEEITF; FIDLLVHQSF; ILNKETGSTY; SPKPYFIDLL; LTWSDGVAIT; SPENMVTSGPF; IPVPVHVTDKY; YPFYLRDNLTW; FYTTNDSSTAY; ETSSDGTAYPF; TSSDGTAYPFY; DPNTGGHKPGL; YFIDLLVHQSF; NVASKMIDTLY; DPQLAEDNVAS; TTNDSSTAYKM; MYVNEELDAIL; NEVELEEITFY; NEELDAILVPY; TAYKMYVNEEL; YFDGQVTDSEL; LEITLASPKPY |
| | HLA-B4403 | EELDAILVP; EEITFYTTN; AEDNVASKM; AEGIRKSYL; VELEEITFY; EELDAILVPY; NEVELEEITF; EEITFYTTND; AEPRSLDPQL; AEDNVASKM; PENMVTSGPF; WETSSDGTAY; EEITFYTTNDS; NEVELEEITFY; LEITLASPKPY; EELDAILVPYP; AEGIRKSYLRI; NEELDAILVPY; AEPRSLDPQLA |
| | HLA-B5101 | KPYFIDLLV; IPVPVHVTD; GPFKLKERI; LASPKPYFI; ; IPVPVHVTDKY; SPKPYFIDLLV |
| | HLA-B5701 | VTDKYGQNW; |
| NP_045619.1 immunogenic protein P37, putative [Borrelia | HLA-A0101 | FSSVISCKLY; NSNASRHESY; MSSTKSLLEV; MTEIESSKEEY; NSNASRHESYY; ISCKLYKKITY |
| | HLA-A0201 | FMADAKASM; ALLPSLEEA; SLEEAIAKV; NLINKLFIL; FILTILFSS; ILTILFSSV; RINEDLAKV; LLSTAKSYL; SLDKIKSLL; LMADMQPDM; LLPSLEEAI; SMSSTKSLL; ILFSSVISC; YAGYHQFMA; KITYNADQV; FILTILFSSV; KLYKKITYNA; ALLPSLEEAI; SLLSTAKSYL; KLFILTILFS |

| | | |
|---|---|---|
| burgdorferi B31]; SEQ ID NO:22, SEQ ID NO: 61567-61910 | | LINKLFILTI; NLINKLFILT; FMADAKASMS; ILTILFSSVI; MSSTKSLLEV; KANLALLPSL; LLPSLEEAIA; FILTILFSSVI; SMSSTKSLLEV; NLINKLFILTI; ILFSSVISCKL; KLFILTILFSS; ALLPSLEEAIA; YMDQDTGKKPL; FMADAKASMSS; LINKLFILTIL; NLALLPSLEEA; SLDKIKSLLST; ALEEALSNSNA; YYYAGYHQFMA |
| | HLA-A0301 | SVISCKLYK; SLLEVAKNK; VISCKLYKK; IMTEIESSK; KSYLEQTRR; KLYKKITYN; AIAALKRAK; LFSSVISCK; ALSNSNASR; KLFILTILF; SLLSTAKSY; ILFSSVISCK; KIKSLLSTAK; QTRRGVGSSK; SSVISCKLYK; NIMTEIESSK; SVISCKLYKK; KSLLEVAKNK; LAKVKASLDK; STKSLLEVAK; HCNDAIAALK; KSLLSTAKSY; SNNGSFNTLK; LLEVAKNKQK; GYHQFMADAK; TYMDQDTGKK; KLFILTILFS; SLEEAIAKVK; NTYMDQDTGK; DAKASMSSTK; RINEDLAKVK; SMSSTKSLLE; KSNNGSFNTLK; TILFSSVISCK; ITYNADQVIDK; SLLEVAKNKQK; FSSVISCKLYK; NTYMDQDTGKK; ELNENMTKTNK; KQKELNENMTK; LLPSLEEAIAK; SSTKSLLEVAK; KLFILTILFSS; DLAKVKASLDK; AGYHQFMADAK |
| | HLA-A1101 | SVISCKLYK; VISCKLYKK; AIAALKRAK; SLLEVAKNK; KSYLEQTRR; IMTEIESSK; LFSSVISCK; ALSNSNASR; TYMDQDTGK; PSLEEAIAK; TLKSNDDSK; ASRHESYYY; STAKSYLEQ; FQELNDIYK; YMDQDTGKK; SVISCKLYKK; ILFSSVISCK; SSVISCKLYK; STKSLLEVAK; KSLLEVAKNK; KIKSLLSTAK; NTYMDQDTGK; NIMTEIESSK; RINEDLAKVK; KVKASLDKIK; SNNGSFNTLK; NTLKSNDDSK; TYMDQDTGKK; TYNADQVIDK; QTRRGVGSSK; SLEEAIAKVK; KSLLSTAKSY; LAKVKASLDK; GYHQFMADAK; TILFSSVISCK; KSNNGSFNTLK; SSTKSLLEVAK; ITYNADQVIDK; NTYMDQDTGKK; SSVISCKLYKK; FSSVISCKLYK; SLLEVAKNKQK; STAKSYLEQTR; AGYHQFMADAK; KQKELNENMTK; KSNDDSKRSGR; NSNASRHESYY; ELNENMTKTNK; LLPSLEEAIAK; RNIMTEIESSK; TAKSYLEQTRR; ASMSSTKSLLE; AKNDFEYAQRK; THCNDAIAALK; PSLEEAIAKVK |
| | HLA-A2402 | YYYAGYHQF; YYAGYHQFM; EYNRINEDL; SYYYAGYHQF; YYYAGYHQFM; YYAGYHQFMA; LFSSVISCKL; SYYYAGYHQFM; EYAQRKADRAL; TYNADQVIDKL; YYYAGYHQFMA |
| | HLA-A2902 | YYYAGYHQF; DFQELNDIY; ASRHESYYY; KRAKNDFEY; KLFILTILF; SLLSTAKSY; SYYYAGYHQF; NASRHESYYY; FSSVISCKLY; SNASRHESYYY; ALKRAKNDFEY; LFSSVISCKLY; ISCKLYKKITY |
| | HLA-A6801 | ESSKEEYNR; SVISCKLYK; ESYYYAGYH; IMTEIESSK; EYAQRKADR; LFSSVISCK; KSYLEQTRR; MTKTNKDFQ; TLKSNDDSK; NNGSFNTLK; NDAIAALKR; TYMDQDTGK; NASRHESYY; CNDAIAALK; ALSNSNASR; NDFEYAQRK; EIESSKEEY; VISCKLYKK; NSSSNHTLQ; NTYMDQDTGK; EALSNSNASR; SVISCKLYKK; TAKSYLEQTR; DAKASMSSTK; NIMTEIESSK; ILFSSVISCK; NTLKSNDDSK; STKSLLEVAK; ESYYYAGYHQ; TLKSNDDSKR; SSVISCKLYK; DAIAALKRAK; NADQVIDKLK; TYMDQDTGKK; NASRHESYYY; NSNASRHESY; SNNGSFNTLK; HCNDAIAALK; QTRRGVGSSK; FSSVISCKLY; TYNADQVIDK; DFQELNDIYK; MTKTNKDFQE; CNDAIAALKR; DSKRSGRKPR; FEYAQRKADR; NTYMDQDTGKK; STAKSYLEQTR; EIESSKEEYNR; NTLKSNDDSKR; TAKSYLEQTRR; FSSVISCKLYK; TILFSSVISCK; ITYNADQVIDK; NIQDNEASEAR; ELNENMTKTNK; EEALSNSNASR; NSNASRHESYY; SSVISCKLYKK; MTEIESSKEEY; ESYYYAGYHQF; EYNRINEDLAK; SSTKSLLEVAK; DLAKVKASLDK; RAKNDFEYAQR; KSNNGSFNTLK; THCNDAIAALK; YNADQVIDKLK; HCNDAIAALKR; KSNDDSKRSGR; DFEYAQRKADR; DFQELNDIYKK; DNTYMDQDTGK; IYKKLQDMDSR; EQTRRGVGSSK |
| | HLA-B0702 | AQRKADRAL; KPRSVDNTY; ASMSSTKSL; KPRSVDNTYM; KASMSSTKSL; YAQRKADRAL; KASLDKIKSL; KANLALLPSL; KASMSSTKSLL; KPRSVDNTYMD; LPSLEEAIAKV; GVGSSKANLAL; |

Fig. 32 continued

| | | |
|---|---|---|
| | | KPLMADMQPDM; KASLDKIKSLL; RKADRALEEAL; SKRSGRKPRSV |
| | HLA-B0801 | YAQRKADRAL; |
| | HLA-B1501 | KLKSNNGSF; FMADAKASM; KQKELNENM; AQRKADRAL; KLFILTILF; SLLSTAKSY; ASRHESYYY; YYYAGYHQF; LMADMQPDM; ALKRAKNDF; SSVISCKLY; SNASRHESY; NMTKTNKDF; MQNDNSSSNH; KSLLSTAKSY; NSNASRHESY; FSSVISCKLY; KQKELNENMT; HQFMADAKASM; ALKRAKNDFEY; NSNASRHESYY; MQNDNSSSNHT; SNSNASRHESY; INKLFILTILF; ISCKLYKKITY; IKSLLSTAKSY |
| | HLA-B2705 | TRRGVGSSK; KRAKNDFEY; NRINEDLAK; KRSGRKPRS; KRSGRKPRSV; SRHESYYYAGY; RRGVGSSKANL; NRINEDLAKVK; HQFMADAKASM; KRAKNDFEYAQ; KQKELNENMTK; GRKPRSVDNTY |
| | HLA-B3501 | EASEARNIM; KPRSVDNTY; FMADAKASM; NASRHESYY; LPSLEEAIA; DFQELNDIY; HCNDAIAAL; EALSNSNAS; LMADMQPDM; YYYAGYHQF; EIESSKEEY; YYAGYHQFM; HESYYYAGY; NASRHESYYY; KPRSVDNTYM; YAQRKADRAL; LPSLEEAIAK; FSSVISCKLY; QFMADAKASM; QPDMQNDNSS; EASEARNIMT; THCNDAIAAL; TEIESSKEEY; KPLMADMQPDM; MTEIESSKEEY; DTHCNDAIAAL; ESYYYAGYHQF; HQFMADAKASM; IAALKRAKNDF; YMDQDTGKKPL; LPSLEEAIAKV; NSNASRHESYY; EALSNSNASRH; NKDFQELNDIY |
| | HLA-B4403 | HESYYYAGY; EEALSNSNA; TEIESSKEEY; EEALSNSNAS; EEYNRINEDL; EEYNRINEDLA |
| | HLA-B5101 | LPSLEEAIA; ; LPSLEEAIAKV; LALLPSLEEAI |
| | HLA-B5701 | ISCKLYKKITY |
| NP_212281.1 \| flagellin [Borrelia burgdorferi B31]; SEQ ID NO:23, SEQ ID NO: 61911-62261 | HLA-A0101 | ESIKNSTEY; KTQEKLSSGY; MTDEVVAATT; ASDDAAGMGV; NQDEAIAVNIY; RLESIKNSTEY; ISDQRANLGAF; ELAVQSGNGTY; MIAQANQVPQY |
| | HLA-A0201 | SQASWTLRV; TMTDEVVAA; QLTDEINRI; AMIAQANQV; MIINHNTSA; QVPQYVLSL; AIAVNIYAA; SLAKIENAI; AVNIYAANV; AQYNQMHML; TTVDANTSL; NLGAFQNRL; SQGGVNSPV; MTDEVVAAT; SAMAMIAQA; AQTAQAAPV; VVAATTNSI; MISDQRANL; ILTQSAMAM; SILTQSAMA; LTQSAMAMI; AQANQVPQYV; MIINHNTSAI; ILTQSAMAMI; NIYAANVANL; TMTDEVVAAT; RMISDQRANL; NLNEVEKVLV; VLVRMKELAV; MAMIAQANQV; AQAAPVQEGV; QLTDEINRIA; ATMTDEVVAA; QVPQYVLSLL; NQVPQYVLSL; IAVNIYAANV; SLSGSQASWTL; MLSNKSASQNV; AMAMIAQANQV; AIAVNIYAANV; SQASWTLRVHV; KLSSGYRINRA; SILTQSAMAMI; GMQPAKINTPA; KVLVRMKELAV; TMTDEVVAATT; MISDQRANLGA; YAIENLKASYA; SLAKIENAIRM; NLFSGEGAQTA; ILTQSAMAMIA |
| | HLA-A0301 | GINAANLSK; SQASRNTSK; NQMHMLSNK; GSQASWTLR; FQNRLESIK; LSSGYRINR; TVDANTSLAK; LSQASRNTSK; KLSSGYRINR; NLKASYAQIK; NGINAANLSK; AANLSKTQEK; STEYAIENLK; KTQEKLSSGY; YNQMHMLSNK; AFQNRLESIK; QIRGLSQASR; VPQYVLSLLR; GLSQASRNTSK; MIAQANQVPQY; LSGSQASWTLR; GAFQNRLESIK; KTQEKLSSGYR; RLESIKNSTEY; TTVDANTSLAK; KINAQIRGLSQ; LSNKSASQNVR |
| | HLA-A1101 | GINAANLSK; SQASRNTSK; NQMHMLSNK; GSQASWTLR; AAGMGVSGK; LSSGYRINR; NTSAINASR; TEYAIENLK; AVQSGNGTY; PQYVLSLLR; FQNRLESIK; AQANQVPQY; TVDANTSLAK; STEYAIENLK; LSQASRNTSK; AANLSKTQEK; RANLGAFQNR; KTQEKLSSGY; KLSSGYRINR; AFQNRLESIK; YNQMHMLSNK; IAQANQVPQY; TQEKLSSGYR; NLKASYAQIK; EVEKVLVRMK; TTVDANTSLAK; TTEGNLNEVEK; KTQEKLSSGYR; GAFQNRLESIK; TAEELGMQPAK; NSTEYAIENLK; GLSQASRNTSK; TSLAKIENAIR; QYNQMHMLSNK; NAANLSKTQEK; QVPQYVLSLLR; AQIRGLSQASR; |

Fig. 32 continued

| | | |
|---|---|---|
| | | LSGSQASWTLR; GVSGKINAQIR; MIAQANQVPQY; LSNKSASQNVR; SAMAMIAQANQ; |
| | HLA-A2402 | IYAANVANL; YAANVANLF; AFQNRLESI; IYAANVANLF; TYSDADRGSI; SYAQIKDATM; IYAANVANLFS |
| | HLA-A2902 | ESIKNSTEY; AVQSGNGTY; YAANVANLF; AIENLKASY; YAIENLKASY; IAQANQVPQY; EYAIENLKASY; ELAVQSGNGTY; RLESIKNSTEY; EINRIADQAQY; MIAQANQVPQY |
| | HLA-A6801 | NTSAINASR; LSSGYRINR; ESIKNSTEY; TEYAIENLK; AIRMISDQR; LAKIENAIR; EGNLNEVEK; YAANVANLF; NGTYSDADR; GSQASWTLR; NQMHMLSNK; QTAQAAPVQ; TSKAINFIQ; MAMIAQANQ; NKSASQNVR; GINAANLSK; TTNSILTQS; SQASRNTSK; NAIRMISDQR; STEYAIENLK; DAAGMGVSGK; HNTSAINASR; EVEKVLVRMK; SLAKIENAIR; TVDANTSLAK; RANLGAFQNR; QIRGLSQASR; NTSKAINFIQ; LSQASRNTSK; NLKASYAQIK; SGSQASWTLR; TQEKLSSGYR; VPQYVLSLLR; NGINAANLSK; AANLSKTQEK; YAIENLKASY; VSGKINAQIR; TTVDANTSLA; KLSSGYRINR; MIAQANQVPQ; QTAQAAPVQE; NTSAINASRN; NSTEYAIENLK; TTVDANTSLAK; TTEGNLNEVEK; EIEQLTDEINR; QVPQYVLSLLR; NAANLSKTQEK; ENAIRMISDQR; LSNKSASQNVR; MIAQANQVPQY; TSLAKIENAIR; EINRIADQAQY; NLNEVEKVLVR; LSGSQASWTLR; GAFQNRLESIK; TAEELGMQPAK; QYNQMHMLSNK; GVSGKINAQIR; KTQEKLSSGYR; NHNTSAINASR; NIYAANVANLF; EKLSSGYRINR; ENLKASYAQIK |
| | HLA-B0702 | SPVNVTTTV; VPQYVLSLL; QPAKINTPA; VVAATTNSI; QPAPATAPS; LVRMKELAV; ASRNTSKAI; IINHNTSAI; TPASLSGSQ; APSQGGVNS; VAATTNSIL; APATAPSQG; APVQEGVQQ; ILTQSAMAM; TPASLSGSQA; SPVNVTTTVD; VVAATTNSIL; APSQGGVNSP; QPAKINTPAS; QASRNTSKAI; MIINHNTSAI; APSQGGVNSPV; QPAKINTPASL; APATAPSQGGV; SPVNVTTTVDA; TPASLSGSQAS; AANLSKTQEKL; RANLGAFQNRL |
| | HLA-B0801 | YAQIKDATM; KVLVRMKEL; ; VEKVLVRMKEL |
| | HLA-B1501 | AQANQVPQY; DQRANLGAF; YAANVANLF; AVQSGNGTY; TQEKLSSGY; ILTQSAMAM; AQYNQMHML; VVAATTNSI; AQTAQAAPV; SQGGVNSPV; ESIKNSTEY; SLSGSQASW; SQASWTLRV; IQIEIEQLT; AMIAQANQV; YAIENLKASY; LAVQSGNGTY; SQASWTLRVH; KTQEKLSSGY; SQNVRTAEEL; RMISDQRANL; VQQEGAQQPA; IAQANQVPQY; VVAATTNSIL; AQAAPVQEGV; AQIRGLSQAS; NQVPQYVLSL; INRIADQAQY; MQPAKINTPA; SQASRNTSKAI; AQANQVPQYVL; MIAQANQVPQY; ASRNTSKAINF; ELAVQSGNGTY; RLESIKNSTEY; NIYAANVANLF; NQDEAIAVNIY; SLSGSQASWTL |
| | HLA-B2705 | NRIADQAQY; IRGLSQASR; QRANLGAFQ; SRNTSKAINF; QRANLGAFQNR; IRMISDQRANL; SRNNGINAANL |
| | HLA-B3501 | YAANVANLF; YAQIKDATM; QPAPATAPS; RASDDAAGM; SPVNVTTTV; ESIKNSTEY; ILTQSAMAM; DEAIAVNIY; TTVDANTSL; LAVQSGNGT; QPAKINTPA; NSILTQSAM; YAIENLKAS; AVQSGNGTY; QASWTLRVH; VAATTNSIL; IAVNIYAAN; MTDEVVAAT; VPQYVLSLL; LAVQSGNGTY; YAIENLKASY; IADQAQYNQM; SILTQSAMAM; IAQANQVPQY; QPAKINTPAS; LAKIENAIRM; QANQVPQYVL; QPAPATAPSQ; YAANVANLFS; TAEELGMQPA; MIINHNTSAI; EAIAVNIYAA; NRASDDAAGM; QAQYNQMHML; TPASLSGSQA; SPVNVTTTVD; SYAQIKDATM; MAMIAQANQV; MIAQANQVPQY; TPASLSGSQAS; ELAVQSGNGTY; NQDEAIAVNIY; QPAKINTPASL; IAVNIYAANVA; NSILTQSAMAM; NIYAANVANLF; EVVAATTNSIL; TTNSILTQSAM; SPVNVTTTVDA; EINRIADQAQY; NASRNNGINAA; IADQAQYNQMH; ISDQRANLGAF; APSQGGVNSPV; LAVQSGNGTYS; EYAIENLKASY |
| | HLA-B4403 | EELGMQPAKI; NEVEKVLVRM; DEINRIADQA; EEYNRINEDLA |

Fig. 32 continued

| | HLA-B5101 | LPSLEEAIA; APATAPSQGGV; APSQGGVNSPV |
|---|---|---|
| | HLA-B5701 | ASLSGSQASW; |
| NP_212463.1 \| oligopeptide ABC transporter, periplasmic oligopeptide-binding protein (oppA-2); [Borrelia burgdorferi B31]; Seq ID NO:24, SEQ ID NO: 62262-63060 | HLA-A0101 | YSSAVNAIY; TTNDSSTAY; YTQFSSHNY; AIDRETLTY; DSSTAYKMY; FLSIFTQGY; RSDYYSSAV; SSDGTVYTF; YTTNDSSTAY; SSAVNAIYFY; SSHNYSNPEY; YLNTKANGNY; ATPNFSSYSY; ELENEEWTTY; YSSAVNAIYF; EVELEEITFY; YSSAVNAIYFY; FSSHNYSNPEY; TLAIDRETLTY; LTFLSIFTQGY; YADPLTFLSIF |
| | HLA-A0201 | SLFLIIFFL; KLQRSLFLI; IIIEKDFPI; AVNAIYFYA; AIDEKTLEI; LIIFFLTFL; LVHQSFIPV; VLDNGTTPT; SLELFNPEI; YSYAKSLEL; SLGAEPSSL; HQSFIPVPV; WIGDYADPL; MVTSGPFKL; ELEEITFYT; KMIDTMFRG; AIYFYAFNT; KTLEITLES; ITWSDGVAI; FLIIFFLTF; MIDTMFRGI; RSDYYSSAV; YKMYENEEL; YFYAFNTHI; FLIIFFLTFL; MLVHQSFIPV; KMIDTMFRGI; KLQRSLFLII; SLFLIIFFLT; YADPLTFLSI; KMYENEELDA; AIFGSIPPDL; FLSIFTQGYT; NMVTSGPFKL; KLRSDYYSSA; RSLFLIIFFL; SAVNAIYFYA; IIIEKDFPIA; KSLELFNPEI; YAFNTHIKPL; MIDTMFRGIV; TLESPKPYFI; ILERFDLSQL; KVLDNGTTPT; SIPPDLIKNL; RAIDEKTLEI; FLIIFFLTFL; MLVHQSFIPV; KMIDTMFRGI; KLQRSLFLII; SLFLIIFFLT; YADPLTFLSI; KMYENEELDA; AIFGSIPPDL; FLSIFTQGYT; NMVTSGPFKL; KLRSDYYSSA; RSLFLIIFFL; SAVNAIYFYA; IIIEKDFPIA; KSLELFNPEI; YAFNTHIKPL; MIDTMFRGIV; TLESPKPYFI; ILERFDLSQL; KVLDNGTTPT; SIPPDLIKNL; RAIDEKTLEI |
| | HLA-A0301 | KSYLRILNK; ILNKETGSK; NMVTSGPFK; VTSGPFKLK; ELFNPEIAK; LTFLCCNNK; KSVIKNGQK; GSKYVEMVK; AITAEGIRK; TTNDSSTAY; GSIPPDLIK; RATPNFSSY; NSYLFRNDK; GGNKPGLAK; RILNKETGSK; YIYGNSYLFR; TVYTFNLREK; TTNDSSTAYK; MVTSGPFKLK; AIDRETLTYK; FLTFLCCNNK; ATPNFSSYSY; RKSYLRILNK; YFYAFNTHIK; VAITAEGIRK; KLKERIPNEK; YVEMVKSVIK; KPLDNVKIRK; RQAEEIIIEK; TLEITLESPK; SSAVNAIYFY; GNGFPILKLK; TGGNKPGLAK; ENMVTSGPFK; ILNKETGSKY; QLAEDNVASK; RFDLSQLKLK; AIYFYAFNTH; IPVPVHVTEK; YLNTKANGNY; LELFNPEIAK; ASKMIDTMFR; FLCCNNKERK; VLDNGTTPTR; ELGIRAIDEK; KERKEGVSFK; DLSQLKLKNK; RRATPNFSSY; LERFDLSQLK; LKYNTNEANK; KTLEITLESPK; KLKYNTNEANK; MVKSVIKNGQK; KICEFIQNQWK; ILERFDLSQLK; NMVTSGPFKLK; GVAITAEGIRK; RILNKETGSKY; YTTNDSSTAYK; RIPNEKYVFEK; VTGDPNTGGNK; KVLDNGTTPTR; KLKERIPNEKY; TLAIDRETLTY; SLELFNPEIAK; IYFYAFNTHIK; FIPVPVHVTEK; LTFLSIFTQGY; LAIDRETLTYK; GTVYTFNLREK; IFGSIPPDLIK; VLDNGTTPTRR; RATPNFSSYSY; SIPPDLIKNLK; NTGGNKPGLAK; YSSAVNAIYFY |
| | HLA-A1101 | KSYLRILNK; VTSGPFKLK; LTFLCCNNK; AITAEGIRK; NSYLFRNDK; TTNDSSTAY; GSIPPDLIK; GTVYTFNLR; NMVTSGPFK; GSKYVEMVK; SAVNAIYFY; KSVIKNGQK; YTQFSSHNY; ILNKETGSK; LSQLKLKNK; QAEEIIIEK; ELFNPEIAK; AVNAIYFYA; NFSSYSYAK; KALTLAIDR; TVYTFNLRE; NGNGFPILK; LAEDNVASK; TNDSSTAYK; SVIKNGQKY; KYNTNEANK; SKMIDTMFR; AIYFYAFNT; ITLESPKPY; SLFLIIFFL; KTLLAEAGY; LTFLSIFTQ; VTDSELGIR; PVPVHVTEK; RATPNFSSY; AIDRETLTY; GGNKPGLAK; TTNDSSTAYK; TVYTFNLREK; MVTSGPFKLK; SSAVNAIYFY; AIDRETLTYK; YIYGNSYLFR; RILNKETGSK; RQAEEIIIEK; VAITAEGIRK; ATPNFSSYSY; ASKMIDTMFR; TLEITLESPK; KSDLELDPIK; YFYAFNTHIK; YVEMVKSVIK; KLKERIPNEK; AIYFYAFNTH; SSHNYSNPEY; QLAEDNVASK; FLTFLCCNNK; IPNEKYVFEK; KANGNYEIAR; RKSYLRILNK; TGSKYVEMVK; AVNAIYFYAF; KPLDNVKIRK; TSGPFKLKER; YVFEKNNKYY; QVTDSELGIR; KYNTNEANKK; GVAITAEGIR; RFDLSQLKLK; FLCCNNKERK; KTLEITLESPK; KICEFIQNQWK; GVAITAEGIRK; YTTNDSSTAYK; GTVYTFNLREK; |

Fig. 32 continued

| | | |
|---|---|---|
| | | VTGDPNTGGNK; MVKSVIKNGQK; SLELFNPEIAK; LAIDRETLTYK; TPNFSSYSYAK; SIPPDLIKNLK; RIPNEKYVFEK; KVLDNGTTPTR; VASKMIDTMFR; YSSAVNAIYFY; NTGGNKPGLAK; NMVTSGPFKLK; ILERFDLSQLK; LTFLSIFTQGY; YSNPEYNELIK; VTSGPFKLKER; IYFYAFNTHIK; ETGSKYVEMVK; KLKYNTNEANK; NTHIKPLDNVK; LTFLCCNNKER; TAEGIRKSYLR; AVNAIYFYAFN; RATPNFSSYSY; FIPVPVHVTEK; YPNGNGFPILK; TFLCCNNKERK; KSDLELDPIKR; WTGWNTNILER; IYIYGNSYLFR |
| | HLA-A2402 | SYAKSLELF; YYSSAVNAI; IYIYGNSYL; YYDSNEVEL; FYAFNTHIK; DFPIAPIYI; SYLFRNDKW; DYADPLTFL; IYGNSYLFR; IFTQGYTQF; KLQRSLFLI; YIYGNSYLF; SFIPVPVHV; KYVEMVKSV; IFGSIPPDL; RSLFLIIFF; YFYAFNTHI; KWTGWNTNI; SYLRILNKE; LFLIIFFLT; IYFYAFNTH; IYIYGNSYLF; IYFYAFNTHI; LFLIIFFLTF; DYYSSAVNAI; VYTFNLREKI; KYVEMVKSVI; SYSYAKSLEL; IFGSIPPDLI; GYPNGNGFPI; GWNTNILERF; NYSNPEYNEL; MYENEELDAI; KYYDSNEVEL; NYEIARAGWI; YYSSAVNAIY; KWTGWNTNIL; AYKMYENEEL; KYNTNEANKK; AVNAIYFYAF; YYSSAVNAIYF; SYSYAKSLELF; YFIDMLVHQSF; DYADPLTFLSI; FYAFNTHIKPL; NYSNPEYNELI; KYNTNEANKKI; MYENEELDAIF; IYFYAFNTHIK; LFLIIFFLTFL; IYIYGNSYLFR; GYPNGNGFPIL; ITLESPKPYFI; TTPTRRATPNF; FYTTNDSSTAY |
| | HLA-A2902 | YVFEKNNKY; SVIKNGQKY; GFPILKLKY; DISSDGTVY; YTQFSSHNY; YSSAVNAIY; TTNDSSTAY; FLSIFTQGY; YIYGNSYLF; FLIIFFLTF; YFYAFNTHI; VFEKNNKYY; FPIAPIYIY; PIYIYGNSY; IFTQGYTQF; SAVNAIYFY; AIDRETLTY; YVFEKNNKYY; YYSSAVNAIY; YTTNDSSTAY; TFLSIFTQGY; YLNTKANGNY; IYIYGNSYLF; ELENEEWTTY; EVELEEITFY; GYTQFSSHNY; KYVFEKNNKY; LAIDRETLTY; SSAVNAIYFY; ILNKETGSKY; SIFTQGYTQF; PVPVHVTEKY; DFPIAPIYIY; ATPNFSSYSY; AVNAIYFYAF; NGFPILKLKY; LFLIIFFLTF; YFYAFNTHIK; YSSAVNAIYF; SVIKNGQKYF; RRATPNFSSY; WDISSDGTVY; EITLESPKPY; FYTTNDSSTAY; YFIDMLVHQSF; DYYSSAVNAIY; YSSAVNAIYFY; TYLNTKANGNY; TLAIDRETLTY; KYVFEKNNKYY; YYSSAVNAIYF; SLFLIIFFLTF; FSSHNYSNPEY; RILNKETGSKY; MYENEELDAIF; EIARAGWIGDY; KDFPIAPIYIY; GWDISSDGTVY; RATPNFSSYSY; LTFLSIFTQGY; YADPLTFLSIF; NVASKMIDTMF |
| | HLA-A6801 | GTVYTFNLR; NSYLFRNDK; FYAFNTHIK; LTFLCCNNK; SAVNAIYFY; ELFNPEIAK; NFSSYSYAK; EFIQNQWKK; DLIKNLKLR; YTQFSSHNY; FLCCNNKER; NMVTSGPFK; QAEEIIIEK; TTNDSSTAY; EGIRKSYLR; SKMIDTMFR; YSSAVNAIY; YIYGNSYLF; VAITAEGIR; LTFLSIFTQ; HIKPLDNVK; YVFEKNNKY; TPNFSSYSY; ERFDLSQLK; VTSGPFKLK; NGNGFPILK; GSKYVEMVK; NGFPILKLK; EWTTYLNTK; LAEDNVASK; NAIYFYAFN; TNDSSTAYK; KSYLRILNK; IYGNSYLFR; TVYTFNLRE; SLFLIIFFL; DLELDPIKR; VYTFNLREK; LDNGTTPTR; FPIAPIYIY; KALTLAIDR; SSTAYKMYE; ILNKETGSK; STAYKMYEN; YIYGNSYLFR; TTNDSSTAYK; TVYTFNLREK; MVTSGPFKLK; YFYAFNTHIK; ASKMIDTMFR; QVTDSELGIR; FLTFLCCNNK; DGTVYTFNLR; SSAVNAIYFY; YVEMVKSVIK; YTTNDSSTAY; YVFEKNNKYY; TSGPFKLKER; ENMVTSGPFK; GVAITAEGIR; DPIKRQDILR; FLCCNNKERK; KANGNYEIAR; QLAEDNVASK; TFLCCNNKER; TGSKYVEMVK; IPVPVHVTEK; ELGIRAIDEK; EVELEEITFY; IPNEKYVFEK; TGWNTNILER; SSHNYSNPEY; SSYSYAKSLE; ITAEGIRKSY; TLEITLESPK; EKYVFEKNNK; VAITAEGIRK; ATPNFSSYSY; DLSQLKLKNK; CEFIQNQWKK; STAYKMYENE; NAIYFYAFNT; TAYKMYENEE; YTTNDSSTAYK; LTFLCCNNKER; TAEGIRKSYLR; MVKSVIKNGQK; VASKMIDTMFR; IYIYGNSYLFR |

Fig. 32 continued

| | | |
|---|---|---|
| | | YSSAVNAIYFY; WTGWNTNILER; ETGSKYVEMVK; TPNFSSYSYAK; LAIDRETLTYK; GTVYTFNLREK; IYFYAFNTHIK; LTFLSIFTQGY; NTHIKPLDNVK; VTSGPFKLKER; HIKPLDNVKIR; DGVAITAEGIR, NMVTSGPFKLK; YSNPEYNELIK, YPNGNGFPILK; FSSHNYSNPEY; TKANGNYEIAR; NTGGNKPGLAK; DYYSSAVNAIY; FIPVPVHVTEK; KTLEITLESPK; SIPPDLIKNLK; KVLDNGTTPTR; NAIYFYAFNTH; GVAITAEGIRK; RIPNEKYVFEK; SLELFNPEIAK; STAYKMYENEE; NGNGFPILKLK; ERFDLSQLKLK; KICEFIQNQWK; TFLCCNNKERK; ILERFDLSQLK; YGNSYLFRNDK; EIARAGWIGDY; FFLTFLCCNNK; MVTSGPFKLKE; FTQGYTQFSSH; TTNDSSTAYKM |
| | HLA-B0702 | YPNGNGFPI; NPEIAKTLL; SPKPYFIDM; TPTRRATPN; TPNFSSYSY; SPENMVTSG; KPYFIDMLV; DPIKRQDIL; YPNGNGFPIL; KIRKALTLAI; TPTRRATPNF; SPKPYFIDML; APIYIYGNSY; TPNFSSYSYA; KPGLAKGWDI; GIRKSYLRIL; SPENMVTSGPF; APIYIYGNSYL; IPPDLIKNLKL; KPLDNVKIRKA; KISLGAEPSSL; TPTRRATPNFS |
| | HLA-B0801 | FLIIFFLTF; IRKALTLAI; NVKIRKALTL; KIRKALTLAI; |
| | HLA-B1501 | YVFEKNNKY; YSSAVNAIY; TTNDSSTAY; YTQFSSHNY; FLSIFTQGY; FLIIFFLTF; ITLESPKPY; YIYGNSYLF; SVIKNGQKY; VIKNGQKYF; RATPNFSSY; LNKETGSKY; YSYAKSLEL; IQNQWKKNL; SSAVNAIYF; AGYPNGNGF; NLKLRSDYY; ASKMIDTMF; PIYIYGNSY; ENMVTSGPF; KERKEGVSF; RSLFLIIFF; LENEEWTTY; RQAEEIIIE; KTLLAEAGY; YSNPEYNEL; YVFEKNNKYY; ITAEGIRKSY; YTTNDSSTAY; YSSAVNAIYF; IARAGWIGDY; YLNTKANGNY; LQRSLFLIIF; YSYAKSLELF; ISSDGTVYTF; AVNAIYFYAF; SSHNYSNPEY; LAIDRETLTY; ILNKETGSKY; SVIKNGQKYF; HQSFIPVPVH; SSAVNAIYFY; GQNWTSPENM; YAFNTHIKPL; ATPNFSSYSY; SIFTQGYTQF; KSVIKNGQKY; ITLESPKPYF; YENEELDAIF; YYSSAVNAIY; WDISSDGTVY; GQKYFDGQVT; KMIDTMFRGI; YSSAVNAIYFY; LQRSLFLIIFF; LTFLSIFTQGY; KLKERIPNEKY; YFIDMLVHQSF; FSSHNYSNPEY; SLFLIIFFLTF; TLAIDRETLTY; RATPNFSSYSY; LSIFTQGYTQF; KLQRSLFLIIF; AITAEGIRKSY; IAKTLLAEAGY; KSVIKNGQKYF; RILNKETGSKY; LIKNLKLRSDY; LEITLESPKPY; YLFRNDKWTGW; WIGDYADPLTF; QGYTQFSSHNY; IAPIYIYGNSY; QLAEDNVASKM; SAVNAIYFYAF; IQNQWKKNLNI; KMYENEELDAI; IEKDFPIAPIY |
| | HLA-B2705 | ARAGWIGDY; RRATPNFSSY; RQAEEIIIEK; ERFDLSQLKL; QRSLFLIIFF; RKSYLRILNK; KRQDILRQAE; LRILNKETGSK; RRATPNFSSYS; RKEGVSFKISL; QRSLFLIIFFL; LRQAEEIIIEK; ERFDLSQLKLK; IRKSYLRILNK |
| | HLA-B3501 | TPNFSSYSY; FPIAPIYIY; TTNDSSTAY; DPLTFLSIF; SAVNAIYFY; YPNGNGFPI; VPVHVTEKY; YSSAVNAIY; DISSDGTVY; YVFEKNNKY; EPSSLDPQL; VASKMIDTM; EVELEEITF; FLIIFFLTF; YIYGNSYLF; FLSIFTQGY; WTGWNTNIL; YTQFSSHNY; SPKPYFIDM; NPEIAKTLL; RATPNFSSY; WIGDYADPL; LENEEWTTY; ENEELDAIF; TAEGIRKSY; YSNPEYNEL; ITLESPKPY; DSSTAYKMY; VNAIYFYAF; ITWSDGVAI; EANKKICEF; SHNYSNPEY; YYSSAVNAI; ENMVTSGPF; IFTQGYTQF; YPNGNGFPIL; YTTNDSSTAY; LAIDRETLTY; APIYIYGNSY; VASKMIDTMF; YYSSAVNAIY; YENEELDAIF; WDISSDGTVY; LAEDNVASKM; YVFEKNNKYY; YAFNTHIKPL; EVELEEITFY; TPTRRATPNF; ELENEEWTTY; ISSDGTVYTF; AVNAIYFYAF; TFLSIFTQGY; YSSAVNAIYF; LFLIIFFLTF; SSHNYSNPEY; KPYFIDMLVH; NVASKMIDTM; EAGYPNGNGF; DPQLAEDNVA; SPKPYFIDML; NEVELEEITF; EPSSLDPQLA; TPNFSSYSYA; EITLESPKPY; FIDMLVHQSF; SSAVNAIYFY; YLNTKANGNY; YADPLTFLSI; DPLTFLSIFT; IGDYADPLTF; SIFTQGYTQF; YSYAKSLELF; DPNTGGNKPG; DFPIAPIYIY; SPENMVTSGPF; |

Fig. 32 continued

| | | |
|---|---|---|
| | | SAVNAIYFYAF; IPVPVHVTEKY; YADPLTFLSIF; FYTTNDSSTAY; IAPIYIYGNSY; YSSAVNAIYFY; YFIDMLVHQSF; IAKTLLAEAGY; DPNTGGNKPGL; FSSHNYSNPEY; WIGDYADPLTF; RATPNFSSYSY; NAIYFYAFNTH; TPNFSSYSYAK; NVASKMIDTMF; MYENEELDAIF; YYSSAVNAIYF; DISSDGTVYTF; TLAIDRETLTY; DPQLAEDNVAS; LTFLSIFTQGY; EPSSLDPQLAE; TTNDSSTAYKM; NEVELEEITFY; QAEEIIIEKDF; YPNGNGFPILK; TAYKMYENEEL; TGWNTNILERF; YFDGQVTDSEL; DKWTGWNTNIL; EIARAGWIGDY; DYYSSAVNAIY; LEITLESPKPY; NPEIAKTLLAE; AGWIGDYADPL; APIYIYGNSYL; DAIFGSIPPDL; FYAFNTHIKPL; FPILKLKYNTN |
| | HLA-B4403 | EELDAIFGS; EEIIIEKDF; EEITFYTTN; AEDNVASKM; YEIARAGWI; AEGIRKSYL; KERKEGVSF; AEAGYPNGN; VELEEITFY; NEVELEEITF; EELDAIFGSI; EEITFYTTND; AEPSSLDPQL; YENEELDAIF; AEDNVASKMI; AEEIIIEKDF; NEANKKICEF; PENMVTSGPF; NEELDAIFGS; EEIIIEKDFPI; AEAGYPNGNGF; EEITFYTTNDS; NEVELEEITFY; LEITLESPKPY; IEKDFPIAPIY; AEGIRKSYLRI; NELIKKSDLEL; EELDAIFGSIP |
| | HLA-B5101 | KPYFIDMLV; FPIAPIYIY; YPNGNGFPI; IPVPVHVTE; IPPDLIKNL; GPFKLKERI; DPLTFLSIF; FPIAPIYIYG; FPILKLKYNT; DPLTFLSIFT; IPVPVHVTEK; YPNGNGFPIL; IPPDLIKNLKL; IPVPVHVTEKY; FPILKLKYNTN; SPKPYFIDMLV; FPIAPIYIYGN |
| | HLA-B5701 | RATPNFSSY; DVELENEEW; KICEFIQNQW; NSYLFRNDKW; YTFNLREKITW; LTFLSIFTQGY |
| AAC44381.1 outer membrane porin protein Oms28 precursor; SEQ ID NO:25, SEQ ID NO: 63061-63322 | HLA-A0101 | MSDVAKGTV; LTKVMAISLY; MSDVAKGTVV; FSNLIINGLLF |
| | HLA-A0201 | FLIEKQIML; KVMAISLYM; ALDETVQEA; GLLFGFVSL; KVLNMVNGL; VAGEATFLI; KAISNVVKV; TLMASERAL; QALDTINKV; FADSNNANI; MVAEGANKV; SVAGEATFL; TINKVTEDV; KVDEVKETL; LLFGFVSLNV; IINGLLFGFV; SVAGEATFLI; LMSDVAKGTV; GMVAEGANKV; SLMSDVAKGT; RALDETVQEA; KVTEDVSSKL; GLNPSNKDQV; VVASQEATIV; GLLFGFVSLNV; SLMSDVAKGTV; KIFSNLIINGL; LMSDVAKGTVV; LIINGLLFGFV; FVGSMSLMSDV; KLDQKDQVNQA; MLNKSPNNKEL; GMVAEGANKVV; KVDEVKETLMA; LMASERALDET; FLIEKQIMLNK; AVQETQKAVSV; MASERALDETV |
| | HLA-A0301 | MLNKSPNNK; VLAKKDVRK; KVTEDVSSK; GMVAEGANK; KVMAISLYM; MSLMSDVAK; VMAISLYMR; NQALDTINK; IMLNKSPNNK; KVMAISLYMR; MVNGLNPSNK; SMSLMSDVAK; LIEKQIMLNK; ASQEATIVAK; QVLAKKDVRK; GANKVVEMSK; ADSNNANILK; SGMVAEGANK; VAQGARDLTK; LTKVMAISLY; ESNDAGVVKK; FLIEKQIMLNK; KVAQGARDLTK; GSMSLMSDVAK; QIMLNKSPNNK; GANKVVEMSKK; MSKKAVQETQK; QVNQALDTINK; NMVNGLNPSNK; CSGMVAEGANK; ALDETVQEAQK; PSNKDQVLAKK |
| | HLA-A1101 | MSLMSDVAK; KVTEDVSSK; SQEATIVAK; MLNKSPNNK; AQGARDLTK; NVLEHSDQK; GMVAEGANK; VMAISLYMR; DSNNANILK; NQALDTINK; KVMAISLYM; VLAKKDVRK; ESNDAGVVK; GEATFLIEK; MVNGLNPSNK; KVMAISLYMR; ASQEATIVAK; SMSLMSDVAK; GANKVVEMSK; IMLNKSPNNK; QVLAKKDVRK; VAQGARDLTK; LIEKQIMLNK; ESNDAGVVKK; AGEATFLIEK; PSNKDQVLAK; SGMVAEGANK; VNQALDTINK; LTKVMAISLY; GSMSLMSDVAK; QVNQALDTINK; QIMLNKSPNNK; KVAQGARDLTK; VAGEATFLIEK; GANKVVEMSKK; QSNVLEHSDQK; VASQEATIVAK; FLIEKQIMLNK; CSGMVAEGANK; NMVNGLNPSNK; MSKKAVQETQK; ALDETVQEAQK; LVESNDAGVVK; FADSNNANILK; SPNNKELELTK; PSNKDQVLAKK; VLEHSDQKDNK |
| | HLA-A2402 | LFGFVSLNVF; VFADSNNANI; TFLIEKQIML; IFSNLIINGLL; VFADSNNANIL |

Fig. 32 continued

| | HLA-A2902 | IINGLLFGF; LIINGLLFGF; NLIINGLLFGF |
|---|---|---|
| | HLA-A6801 | DSNNANILK; MSLMSDVAK; NVLEHSDQK; EFAKVDEVK; VMAISLYMR; ELTKEEFAK; ESNDAGVVK; MLNKSPNNK; VVKVAQGAR; KVTEDVSSK; QVLAKKDVR; EATFLIEKQ; VSSKLEGVR; NQALDTINK; MVNGLNPSNK; NVVKVAQGAR; KVMAISLYMR; DVSSKLEGVR; ESNDAGVVKK; SMSLMSDVAK; GANKVVEMSK; LTKVMAISLY; EEFAKVDEVK; LIEKQIMLNK; QVLAKKDVRK; VAQGARDLTK; EVKETLMASER; MSKKAVQETQK; QVNQALDTINK; TKVMAISLYMR; QIMLNKSPNNK; QSNVLEHSDQK; FADSNNANILK; FLIEKQIMLNK; EGANKVVEMSK; DVRKAISNVVK; ELELTKEEFAK; NMVNGLNPSNK; CSGMVAEGANK; DLTKVMAISLY; GSMSLMSDVAK; LVESNDAGVVK; EDVSSKLEGVR; GANKVVEMSKK; VASQEATIVAK; VAGEATFLIEK; KVAQGARDLTK; MVAEGANKVVE |
| | HLA-B0702 | GVRESSLEL; SPNNKELEL; GARDLTKVM; NPSNKDQVL; KVAQGARDL; VVKKFVGSM; KVMAISLYM; AVQETQKAV; KVVEMSKKAV; KVTEDVSSKL; KAVQETQKAV; GARDLTKVMAI; AVSVAGEATFL; VVKKFVGSMSL; AVQETQKAVSV |
| | HLA-B0801 | ILKPQSNVL; FLIEKQIML; LAKKDVRKA; FAKVDEVKETL; VLAKKDVRKAI; VVKKFVGSMSL |
| | HLA-B1501 | VSVAGEATF; KVMAISLYM; FGFVSLNVF; TLMASERAL; ILKPQSNVL; GVRESSLEL; NLIINGLLF; FLIEKQIML; IINGLLFGF; VVKKFVGSM; AVSVAGEATF; LTKVMAISLY; LIINGLLFGF; DQKDQVNQAL; MVAEGANKVV; LLFGFVSLNVF; AQGARDLTKVM; FSNLIINGLLF; AQKVLNMVNGL; LMSDVAKGTVV; VVKKFVGSMSL; NLIINGLLFGF; KAVSVAGEATF; ILKPQSNVLEH; GMVAEGANKVV; TQKAVSVAGEA |
| | HLA-B2705 | RKAISNVVK; KKFVGSMSL; VRKAISNVVK; |
| | HLA-B3501 | NPSNKDQVL; FGFVSLNVF; VSVAGEATF; SPNNKELEL; TKVMAISLY; TFLIEKQIM; FSNLIINGL; AVSVAGEATF; LFGFVSLNVF; MASERALDET; VASQEATIVA; NPSNKDQVLA; LIINGLLFGF; MVAEGANKVV; ETLMASERAL; LTKVMAISLY; KAVSVAGEATF; VAEGANKVVEM; EATFLIEKQIM; FSNLIINGLLF; LLFGFVSLNVF; FAKVDEVKETL; NPSNKDQVLAK; ESNDAGVVKKF; VFADSNNANIL; MASERALDETV |
| | HLA-B4403 | DEVKETLMA; EEFAKVDEV; QEAQKVLNM; KELELTKEEF; AEGANKVVEM; DEVKETLMAS; KETLMASERAL; GEATFLIEKQI; AEGANKVVEMS |
| | HLA-B5101 | |
| | HLA-B5701 | |
| CAA49829.1\| p93 [Borrelia burgdorferi]; SEQ ID NO:26, SEQ ID NO: 63323-64135 | HLA-A0101 | DLDYYKGFY; NSNSNSSYY; NMDLEFVNY; STQQGIQRY; FSVRKNFIY; LIAKVITIY; ITDIQGETH; LTNSNSNSSY; NSNSSYYGKY; ESTQQGIQRY; VTDKVIAALL; ESDIDIDSLV; LTNSNSNSSYY; LTGYIIKSFDY; VTDKVIAALLS; TSFSVRKNFIY |
| | HLA-A0201 | MLLIFSFFL; LLIFSFFLI; FLNGFPLNA; QLIDLNTGV; FVNMDLEFV; ILPFTSFSV; YLQDELKNL; LLSENEAGV; VVSESNFEI; KIQEDINEI; YVDSKMILA; NLQKIDPKV; KVITIYNAV; LMLPEDQKL; SLTKENAGL; SLEDLQEQL; LIFLNGFPL; KMDSGKAKL; KLDSAEDNL; FILSENKIL; NTYEQIVGI; KASVDVFSI; SSAELIAKV; KIDTELDNI; KILPFTSFS; ILTGYIIKS; MSIDSSSPV; LVTDKVIAA; VTDKVIAAL; ELIAKVITI; QILNKLENL; FLEVIDPIT; NITETIENL; QIVGIGEFL; SSSPVFLEV; KQLQIKESL; SLYVDSKMI; LQDELKNLV; NLDKAQQKL; STNTYEQIV; KILPFTSFSV; KMLLIFSFFL; MLLIFSFFLI; FLIFLNGFPL; YLQDELKNLV; ALLSENEAGV; LIFSFFLIFL; TMSIDSSSPV; YVDSKMILAA; ILNKLENLKV; SIDSSSPVFL; ILDVNTLKKV; LQLIDLNTGV; KVVSESNFEI; KLKDFVNMDL; SLYVDSKMIL; SLVTDKVIAA; LVTDKVIAAL; ILSGNIESDI; KISKSNNNEV; RLAKFSPKNL; SLNEDLDKDL; GIYEREKDLV; GLSRVYSQWA; VTDKVIAALL; |

Fig. 32 continued

| | | |
|---|---|---|
| | | NLVILDVNTL; FSVRKNFIYL; RLKESTQQGI; NLGTLQLIDL; GIGEFLARPL; QIVGIGEFLA; KMLLIFSFFLI; YVDSKMILAAV; LLIFSFFLIFL; YLQDELKNLVI; FLEVIDPITNL; FIDDQDKKASV; QLIDLNTGVRL; KLDSAEDNLDV; TTMSIDSSSPV; TLQLIDLNTGV; VILDVNTLKKV; SLVTDKVIAAL; ILSENKILPFT; KMDSGKAKLQI; KLDGKKEFKPV; QILNKLENLKV; SQWAGKTQIFI; KKMLLIFSFFL; GIYEREKDLVV; SLYVDSKMILA; FIYLQDELKNL; KLQILNKLENL; LIAKVITIYNA; LVTDKVIAALL; FFLIFLNGFPL; MSIDSSSPVFL; ILNKLENLKVV; VIDPITNLGTL; SLGDLNNDKNL; LIFLNGFPLNA; SISSKSELDSI; VIAALLSENEA; FEINKNSSLYV; FTSFSVRKNFI; KVDKEKLKDFV |
| | HLA-A0301 | RVYSQWAGK; RILTGYIIK; ILNKLENLK; KTQIFIPLK; ILDVNTLKK; VILDVNTLK; TQIFIPLKK; KAKLQILNK; RSSAELIAK; KLDGKKEFK; MILAAVRDK; KVDKQLQIK; GFYIEPALK; LIAKVITIY; RELSKASSK; FIYLQDELK; KSNNNEVGK; AVYRGDLDY; KLDSKLDGK; KSKDGKVSK; PLNARKVDK; NSNSSYYGK; EINKNSSLY; KVKEEEITK; DLNTGVRLK; ITIYNAVYR; NLRRILTGY; LSKASSKEK; NSNSNSSYY; KMLLIFSFF; VVIKMDSGK; KASSKEKSK; DSNAWRLAK; KTQIFIPLKK; VILDVNTLKK; KMILAAVRDK; SVDVFSISSK; LVILDVNTLK; AWRLAKFSPK; QILNKLENLK; AINLQKIDPK; LPFTSFSVRK; ILPFTSFSVR; SYYGKYFINR; ALDLDRELSK; LVVIKMDSGK; ITDIQGETHK; KVITIYNAVY; KGFYIEPALK; VITIYNAVYR; RRILTGYIIK; AVYRGDLDYY; IDLNTGVRLK; SKLDGKKEFK; AINLDKAQQK; ELSKASSKEK; IEPALKSLTK; LNGFPLNARK; LTNSNSNSSY; NMDLEFVNYK; EINKEKNLPK; SLEDLQEQLK; SNSNSSYYGK; VIKMDSGKAK; KLDSKLDGKK; LLIFSFFLIF; IVGIGEFLAR; FPLNARKVDK; SRVYSQWAGK; ASSKEKSKVK; FLNGFPLNAR; ASLGDLNNDK; SQVDAKKKEK; VYRGDLDYYK; KKLDSKLDGK; EVGKLSPLDK; VDNKAINLQK; KLSPLDKPSY; KNSSLYVDSK; FLNGFPLNARK; ILPFTSFSVRK; KILPFTSFSVR; ILNLRRILTGY; AVYRGDLDYYK; SSYYGKYFINR; LLKSKDGKVSK; ASVDVFSISSK; VVSESNFEINK; LVILDVNTLKK; TSFSVRKNFIY; LSRVYSQWAGK; LTNSNSNSSYY; KVITIYNAVYR; LIDLNTGVRLK; ILDVNTLKKVK; KIQEDINEINK; NSNSNSSYYGK; KAINLDKAQQK; NLVILDVNTLK; NAWRLAKFSPK; KVKEEEITKGK; KEFKPVSEVEK; RVYSQWAGKTQ; LSKASSKEKSK; KASSKEKSKVK; KLPEDKKLDSK; VVIKMDSGKAK; KMLLIFSFFLI; EVDNKAINLQK; ELDKKAINLDK; KAINLQKIDPK |
| | HLA-A1101 | KTQIFIPLK; RVYSQWAGK; TQIFIPLKK; RSSAELIAK; VILDVNTLK; NSNSSYYGK; VVIKMDSGK; RILTGYIIK; KSNNNEVGK; DSNAWRLAK; ITIYNAVYR; KAKLQILNK; TSLNEDLDK; ILNKLENLK; NSSLYVDSK; MILAAVRDK; KSKDGKVSK; KVKEEEITK; FIYLQDELK; KVDKQLQIK; ILDVNTLKK; KATDEEHKK; SLGDLNNDK; AVYRGDLDY; STQQGIQRY; GFYIEPALK; NLMLPEDQK; PSYDDIDSK; KASSKEKSK; KLDGKKEFK; LSKASSKEK; SESNFEINK; KLDSKLDGK; SSKEKSKVK; KPGDVSSPK; QVDAKKKEK; VSEVEKLDK; DVSSPKVDK; NSNSNSSYY; ITETIENLR; KVIAALLSE; MDLEFVNYK; KTQIFIPLKK; SVDVFSISSK; VILDVNTLKK; AINLQKIDPK; LVILDVNTLK; TTSLNEDLDK; AINLDKAQQK; ASLGDLNNDK; VSESNFEINK; AVYRGDLDYY; QILNKLENLK; KMILAAVRDK; SLEDLQEQLK; ALDLDRELSK; GIQRYGIYER; ASSKEKSKVK; NMDLEFVNYK; LVVIKMDSGK; SNSNSSYYGK; SYYGKYFINR; KVITIYNAVY; KGFYIEPALK; ITDIQGETHK; EINKEKNLPK; LPFTSFSVRK; VITIYNAVYR; IVGIGEFLAR; KLDSKLDGKK; VIKMDSGKAK; IQEDINEINK; LTNSNSNSSY; EVGKLSPLDK; SQVDAKKKEK; YIIKSFDYDR; DVQRDTVREK; KNSSLYVDSK; PVSEVEKLDK; LTKENAGLSR; ILPFTSFSVR; FLNGFPLNAR; AVYRGDLDYYK; ASVDVFSISSK; SSYYGKYFINR; |

Fig. 32 continued

| | | |
|---|---|---|
| | | VVSESNFEINK; LVILDVNTLKK; NSNSNSSYYGK; KIQEDINEINK; KAINLQKIDPK; TIENLRDQLEK; KVITIYNAVYR; TSFSVRKNFIY; VVIKMDSGKAK; ILPFTSFSVRK; KAINLDKAQQK; KILPFTSFSVR; FLNGFPLNARK; QTTSLNEDLDK; LQILNKLENLK; NAWRLAKFSPK; RASLGDLNNDK; VNMDLEFVNYK; LTNSNSNSSYY; EVDNKAINLQK; ISKSNNNEVGK; KASSKEKSKVK; LIDLNTGVRLK; KVKEEEITKGK; KSKVKEEEITK; KSELDSILNLR; NLVILDVNTLK; NLDEFILSENK; YIEPALKSLTK; FVNMDLEFVNY; EALDLDRELSK; LSRVYSQWAGK; LSKASSKEKSK; ESLEDLQEQLK; FINRFIDDQDK; KNFIYLQDELK; SGKAKLQILNK; AGKTQIFIPLK; SLTKENAGLSR; KEFKPVSEVEK; QIVGIGEFLAR; ILDVNTLKKVK; LIFSFFLIFLN; KLPEDKKLDSK |
| | HLA-A2402 | QWAGKTQIF; KMLLIFSFF; DYDRSSAEL; VFLEVIDPI; DFVNMDLEF; FFLIFLNGF; LYVDSKMIL; EFILSENKI; IFSFFLIFL; SFSVRKNFI; LLIFSFFLI; IYEREKDLV; GYIIKSFDY; KKMLLIFSF; YYGKYFINRF; DYDRSSAELI; QWAGKTQIFI; IYLQDELKNL; SFFLIFLNGF; IYNAVYRGDL; KFSPKNLDEF; KMLLIFSFFL; FYIEPALKSL; IYEREKDLVV; KKMLLIFSFF; MLLIFSFFLI; SYYGKYFINRF; YYGKYFINRFI; IYEREKDLVVI; KMLLIFSFFLI; YYKGFYIEPAL; TYEQIVGIGEF; IYLQDELKNLV; PYDSTNTYEQI; VYSQWAGKTQI; KFSPKNLDEFI; FFLIFLNGFPL; SFSVRKNFIYL |
| | HLA-A2902 | GYIIKSFDY; FSVRKNFIY; AVYRGDLDY; LIAKVITIY; EFVNYKGPY; VITIYNAVY; EINKNSSLY; NMDLEFVNY; LIFSFFLIF; DFVNMDLEF; NSNSNSSYY; ENAGLSRVY; VYRGDLDYY; NLRRILTGY; KVITIYNAVY; SFSVRKNFIY; VNMDLEFVNY; ELIAKVITIY; FLIFLNGFPL; AVYRGDLDYY; KLSPLDKPSY; TGYIIKSFDY; FEINKNSSLY; SFFLIFLNGF; LLIFSFFLIF; FVNMDLEFVNY; TSFSVRKNFIY; DLEFVNYKGPY; YNAVYRGDLDY; MLLIFSFFLIF; FILSENKILPF; LTNSNSNSSYY; ILNLRRILTGY; LTGYIIKSFDY; FSFFLIFLNGF; SYYGKYFINRF; NFEINKNSSLY |
| | HLA-A6801 | ITIYNAVYR; ITETIENLR; FIYLQDELK; NSNSSYYGK; ESTQQGIQR; NSSLYVDSK; ELDSILNLR; ETHKADQDK; IIKSFDYDR; DINEINKEK; NEAGVNFAR; DSNAWRLAK; NSNSNSSYY; VVIKMDSGK; LPFTSFSVR; EINKNSSLY; EIESQVDAK; RVYSQWAGK; EAGDENQKR; KTQIFIPLK; DVSSPKVDK; TQIFIPLKK; DVNTLKKVK; EIEKQIEIK; MILAAVRDK; FSFFLIFLN; VILDVNTLK; NLMLPEDQK; ILNKLENLK; MDLEFVNYK; EPALKSLTK; DNKAINLQK; ESQVDAKKK; YYGKYFINR; DSKEEVDNK; NGFPLNARK; NARKVDKEK; LIDLNTGVR; DLNTGVRLK; LSKASSKEK; TTMSIDSSS; DVFSISSKS; DYEALDLDR; FSVRKNFIY; ELLKSKDGK; IQRYGIYER; LIAKVITIY; EKATDEEHK; DIDSLVTDK; SKMILAAVR; TSLNEDLDK; PSYDDIDSK; NITETIENLR; YIIKSFDYDR; LVILDVNTLK; VITIYNAVYR; DSKMILAAVR; TTSLNEDLDK; SYYGKYFINR; QLIDLNTGVR; EIESQVDAKK; NFIYLQDELK; LTKENAGLSR; FLNGFPLNAR; LVVIKMDSGK; SAEDNLDVQR; ELDSILNLRR; ENEAGVNFAR; ELSKASSKEK; ILPFTSFSVR; EIEKQIEIKK; LPFTSFSVRK; EFKPVSEVEK; LTNSNSNSSY; EVEKLDKISK; SVDVFSISSK; DVQRDTVREK; EINKEKNLPK; EVGKLSPLDK; KTQIFIPLKK; IVGIGEFLAR; NSNSSYYGKY; GIQRYGIYER; SNSNSSYYGK; NMDLEFVNYK; ESTQQGIQRY; QILNKLENLK; EDINEINKEK; ELIAKVITIY; ITDIQGETHK; VILDVNTLKK; TNSNSNSSYY; MSIDSSSPVF; DVFSISSKSE; VSESNFEINK; EKATDEEHKK; SLEDLQEQLK; TGYIIKSFDY; NLQKIDPKVK; KGFYIEPALK; NLDVQRDTVR; SSYYGKYFINR; NSNSNSSYYGK; KVITIYNAVYR; DSAEDNLDVQR; DITDIQGETHK; QIVGIGEFLAR; TSFSVRKNFIY; NLVILDVNTLK; QTTSLNEDLDK; LVILDVNTLKK; LTNSNSNSSYY; DLVVIKMDSGK; EVDNKAINLQK; FLNGFPLNARK; AVYRGDLDYYK; ASVDVFSISSK; VVSESNFEINK; ESLEDLQEQLK; TIENLRDQLEK |

Fig. 32 continued

| | | |
|---|---|---|
| | | EIEKQIEIKKR; EIKKRDEELLK; SNITETIENLR; EALDLDRELSK; FINRFIDDQDK; KILPFTSFSVR; ILPFTSFSVRK; EIESQVDAKKK; NAVYRGDLDYY; QGIQRYGIYER; ISKSNNNEVGK; DSKLDGKKEFK; ESQVDAKKKEK; VVIKMDSGKAK; NAWRLAKFSPK; FVNMDLEFVNY; SLTKENAGLSR; NARKVDKEKLK; NLDEFILSENK; KSELDSILNLR; GYIIKSFDYDR; VNMDLEFVNYK; ETIENLRDQLE; KAINLDKAQQK; DVFSISSKSEL; FSFFLIFLNGF; SENEAGVNFAR; YIEPALKSLTK; MSIDSSSPVFL; FSVRKNFIYLQ; LQILNKLENLK; QLEKATDEEHK; LSRVYSQWAGK |
| | HLA-B0702 | SVRKNFIYL; KVKDQTTSL; KPVSEVEKL; RPLTNSNSN; KVSKDYEAL; GPYDSTNTY; DPITNLGTL; KPGDVSSPKV; SPKVDKQLQI; LVTDKVIAAL; SPKNLDEFIL; RPLTNSNSNS; ITKGKSRASL; RPLTNSNSNSS; SPVFLEVIDPI; LPEDKKLDSKL; DPKVKDQTTSL; AVRDKDDSNAW; DPITNLGTLQL; SPLDKPSYDDI |
| | HLA-B0801 | EIKKRDEEL; EIKKRDEELL; ITKGKSRASL; FLIFLNGFPL; IAKVITIYNAV; DPKVKDQTTSL; YYKGFYIEPAL; NLRRILTGYII |
| | HLA-B1501 | EQIVGIGEF; AVYRGDLDY; KMLLIFSFF; FSVRKNFIY; STQQGIQRY; LSENKILPF; TNSNSNSSY; LIAKVITIY; QGIQRYGIY; YGKYFINRF; KVKDQTTSL; NLRRILTGY; VITIYNAVY; LTGYIIKSF; LIFSFFLIF; LVILDVNTL; MSIDSSSPV; KQLQIKESL; LIFLNGFPL; NSNSNSSYY; ENAGLSRVY; SQWAGKTQIF; MSIDSSSPVF; KVITIYNAVY; ILSENKILPF; LTNSNSNSSY; KLSPLDKPSY; ILTGYIIKSF; QQGIQRYGIY; LLIFSFFLIF; ELIAKVITIY; AVYRGDLDYY; FLIFLNGFPL; LQIKESLEDL; KENAGLSRVY; YEQIVGIGEF; EQIVGIGEFL; NLKVVSESNF; LQILNKLENL; LEFVNYKGPY; TNSNSNSSYY; FTSFSVRKNF; FEINKNSSLY; KLKDFVNMDL; TMSIDSSSPV; RLKESTQQGI; ITKGKSRASL; LVTDKVIAAL; VNMDLEFVNY; TQQGIQRYGIY; TMSIDSSSPVF; YSQWAGKTQIF; LLSENEAGVNF; ILNLRRILTGY; KSKDGKVSKDY; LTNSNSNSSYY; FSFFLIFLNGF; RILTGYIIKSF; FILSENKILPF; MLLIFSFFLIF; YNAVYRGDLDY; FVNMDLEFVNY; TSFSVRKNFIY; PLTNSNSNSSY; QQKLDSAEDNL; AVRDKDDSNAW; QLIDLNTGVRL; YLQDELKNLVI |
| | HLA-B2705 | WRLAKFSPK; RRILTGYII; YRGDLDYYK; KKMLLIFSF; QRYGIYERE; KQLQIKESL; RRILTGYIIK; QRYGIYEREK; SRVYSQWAGK; KRDEELLKSK; SQWAGKTQIF; KKMLLIFSFF; WRLAKFSPKN; RRILTGYIIKS; YRGDLDYYKGF; WRLAKFSPKNL; LRRILTGYIIK |
| | HLA-B3501 | GPYDSTNTY; DFVNMDLEF; EFVNYKGPY; DPITNLGTL; EALDLDREL; FFLIFLNGF; LIFSFFLIF; LVILDVNTL; VITIYNAVY; FSVRKNFIY; NSNSNSSYY; LPEDQKLPE; LIAKVITIY; LPKPGDVSS; SIDSSSPVF; LSENKILPF; LPFTSFSVR; EINKNSSLY; ENAGLSRVY; LIFLNGFPL; MSIDSSSPVF; NAVYRGDLDY; KVITIYNAVY; LTNSNSNSSY; ESTQQGIQRY; LLIFSFFLIF; SPKNLDEFIL; LVTDKVIAAL; ILSENKILPF; AVYRGDLDYY; SQWAGKTQIF; LSENEAGVNF; ELIAKVITIY; NLVILDVNTL; EDLDKDLTTM; NAVYRGDLDYY; FVNMDLEFVNY; YSQWAGKTQIF; YKGPYDSTNTY; TMSIDSSSPVF; SPVFLEVIDPI; FILSENKILPF; MLLIFSFFLIF; DPITNLGTLQL; LTNSNSNSSYY; FSFFLIFLNGF; WAGKTQIFIPL; FFLIFLNGFPL; TKENAGLSRVY; DPKVKDQTTSL; DLEFVNYKGPY; LPEDKKLDSKL; LLSENEAGVNF; MSIDSSSPVFL; NFEINKNSSLY |
| | HLA-B4403 | SENEAGVNF; SELDSILNL; REIEKQIEI; GEFLARPLT; AEDNLDVQR; EEHKKEIES; KEIESQVDA; AELIAKVIT; KESLEDLQE; EEVDNKAIN; SENKILPFT; NEINKEKNL; TELDNIHES; EEVDNKAINL; EELDKKAINL; SENKILPFTS; GEFLARPLTN; AELIAKVITI; SENEAGVNFA; REKDLVVIKM; SEVEKLDKIS; FEINKNSSLY; KEKLKDFVNM; LEFVNYKGPY; EEITKGKSRA; YEQIVGIGEF; SELDSILNLR; AELIAKVITIY; EEITKGKSRAS; EEVDNKAINLQ; SENKILPFTSF; |

Fig. 32 continued

| | | |
|---|---|---|
| | | SENEAGVNFAR; KESLEDLQEQL; GEFLARPLTNS; EEHKKEIESQV; SELDSILNLRR; FEINKNSSLYV; DEFILSENKIL; SESNFEINKNS; EELLKSKDGKV; AEDNLDVQRDT; KESTQQGIQRY; EELDKKAINLD |
| | HLA-B5101 | LPFTSFSVR; LPKPGDVSS; DPITNLGTL; LPFTSFSVRK; LPKPGDVSSP; SPVFLEVIDPI; LPFTSFSVRKN; LPKPGDVSSPK; SPLDKPSYDDI |
| | HLA-B5701 | STQQGIQRY; ; NAGLSRVYSQW |
| NP_212375.1 \| glycerol kinase (gipK) [Borrelia burgdorferi B31]; SEQ ID NO:27, SEQ ID NO: 64136-64773 | HLA-A0101 | ETTALGAAY; SVSDNGGVY; YLAGLATGY; SSDAEALAS; VSDNGGVYF; SSVSDNGGVY; FAQKEFTQIY; VSDNGGVYFV; ITETTALGAAY; ASSVSDNGGVY; LTQKKEHATDY; SSDAEALASSV |
| | HLA-A0201 | KIMWILDNV; YVLEGSVFI; ALFGAEIPI; LLMQFQADL; VLDSYFSGT; KTLEWDDEL; MVFDKNANI; ILPNEIDAI; WILDNVEGA; GVYFVPAFV; KTDKALFGA; IILEKTGLV; SQLGVITEA; KLLENWNKA; QIYPQPSWV; YILSIDQGT; GMAKNTYGT; EIWGSQLGV; VITEAMANA; LLENWNKAV; LMQFQADLL; GIAGDQFAA; TLEWDDELL; FQSFDILNT; KLLTSIAWG; SIAFQSFDI; QLGVITEAM; FSGTKIMWI; TLLLNIKTL; TIDTWILWNL; ALGAAYLAGL; LLMQFQADLL; ALFGAEIPIA; FIGGAVIQWL; FQADLLECKV; KLLENWNKAV; KTLEWDDELL; LLSILNVPRA; GLATGYWQSA; LVLDSYFSGT; FVPAFVGLGA; KITETTALGA; FQSFDILNTM; FAATFGQACL; IILEKTGLVL; AMVFDKNANI; NLLMQFQADL; RILPNEIDAI; SIPNFEIQEL; SVTYVLEGSV; KIILEKTGLV; VSDNGGVYFV; FSGTKIMWIL; WQSAEEIVSL; SIAFQSFDIL; TQIYPQPSWV; SQLGVITEAM; NVPRAILPEL; VLDSYFSGTKI; FLTVNIGKEPI; IMWILDNVEGA; FTQIYPQPSWV; FQADLLECKVV; ILPNEIDAIGI; SVSDNGGVYFV; NTYGTGCFLTV; TLEWDDELLSI; GTIDTWILWNL; ILPELKESSTI; VITEAMANARI; VIWEKNTGKPI; KTDKALFGAEI; GVYFVPAFVGL; TMKKSIPNFEI; YLAGLATGYWQ; LLSILNVPRAI; GLGAPHWDSYA; ELLSILNVPRA; TALGAAYLAGL; NLLMQFQADLL; LLECKVVRPKI; VLEGSVFIGGA; IISHDKLLTSI; WQVDKIFEPSM; KSVTYVLEGSV; SAEEIVSLWQV; ALGAAYLAGLA; KITETTALGAA; SQLGVITEAMA; GLVLDSYFSGT |
| | HLA-A0301 | KIFEPSMPK; ILWNLTQKK; ATFGQACLK; TSIAWGRKK; IVSLWQVDK; VIWEKNTGK; SSRAMVFDK; LTSIAWGRK; WILWNLTQK; YLAGLATGY; CFLTVNIGK; STIYGKTDK; ATFGQACLKK; LLTSIAWGRK; IIGITRGSTK; VLDSYFSGTK; AATFGQACLK; KLLTSIAWGR; QACLKKGMAK; LTSIAWGRKK; QSFDILNTMK; LLECKVVRPK; WILWNLTQKK; TVIWEKNTGK; MVFDKNANIK; ASRTLLLNIK; SSTIYGKTDK; TSSRAMVFDK; AYLAGLATGY; SFDILNTMKK; NANIKGFAQK; IVWQDRRTAK; GCFLTVNIGK; TWILWNLTQK; RTAKICDQLK; GLGAPHWDSY; DKIFEPSMPK; LLLNIKTLEW; SIDQGTTSSR; ELLSILNVPR; WLRDGLEFFR; EIVSLWQVDK; KLLTSIAWGRK; RTAKICDQLKK; LLTSIAWGRKK; TIIGITRGSTK; QSFDILNTMKK; TTSSRAMVFDK; LVLDSYFSGTK; FAATFGQACLK; GQACLKKGMAK; LLENWNKAVGK; FQSFDILNTMK; KNANIKGFAQK; AIVWQDRRTAK; MQFQADLLECK; AATFGQACLKK; QIYPQPSWVEH; AMVFDKNANIK; WLRDGLEFFRK; AAYLAGLATGY |
| | HLA-A1101 | KIFEPSMPK; ATFGQACLK; SSRAMVFDK; TSIAWGRKK; LTSIAWGRK; STIYGKTDK; IVSLWQVDK; WILWNLTQK; ATDYSNASR; ILWNLTQKK; VIWEKNTGK; TAKICDQLK; ITEAMANAR; FQADLLECK; SVSDNGGVY; KTGLVLDSY; KESSTIYGK; SFDILNTMK; CFLTVNIGK; SMPKNQKEK; ANIKGFAQK; TFGQACLKK; LLSILNVPR; GSTKAHITR; VVWQDRRTAK; ATFGQACLKK; TSSRAMVFDK; MVFDKNANIK; TVIWEKNTGK; QSFDILNTMK; RTAKICDQLK; AATFGQACLK; LTSIAWGRKK; VLDSYFSGTK; ASRTLLLNIK; QACLKKGMAK; SSTIYGKTDK; NANIKGFAQK; LLTSIAWGRK; IVWQDRRTAK; WILWNLTQKK; IIGITRGSTK; TWILWNLTQK; TAKICDQLKK; SFDILNTMKK; |

Fig. 32 continued

| | | |
|---|---|---|
| | | SIDQGTTSSR; KLLTSIAWGR; QFQADLLECK; VITEAMANAR; EIVSLWQVDK; LLECKVVRPK; PSMPKNQKEK; GCFLTVNIGK; TTSSRAMVFDK; QSFDILNTMKK; LVLDSYFSGTK; TIIGITRGSTK; RTAKICDQLKK; KLLTSIAWGRK; MQFQADLLECK; TTVIWEKNTGK; AATFGQACLKK; AIVWQDRRTAK; KICDQLKKEGK; AMVFDKNANIK; GQACLKKGMAK; GVITEAMANAR; TGCFLTVNIGK; NASRTLLLNIK; FAATFGQACLK; NVPRAILPELK; FQSFDILNTMK; AAYLAGLATGY; TWILWNLTQKK; DTWILWNLTQK; SIPNFEIQELR; LLTSIAWGRKK; LSIDQGTTSSR; LLENWNKAVGK; WLRDGLEFFRK; KNANIKGFAQK; ASQNNLLMQFQ |
| | HLA-A2402 | QWLRDGLEF; TYVLEGSVF; DYSNASRTL; IWGSQLGVI; IYGKTDKAL; CFGTIDTWI; IYPQPSWVE; YWQSAEEIV; EWDDELLSI; YFVPAFVGL; TYGTGCFLT; GYWQSAEEI; IYGKTDKALF; QWLRDGLEFF; TYVLEGSVFI; SYARGTIIGI; DYSNASRTLL; TYGTGCFLTV; VWQDRRTAKI; VYFVPAFVGL; SWVEHDPTEI; YFSGTKIMWI; IWEKNTGKPI; SYFSGTKIMW; CFGTIDTWIL; GFAQKEFTQI; IYNAIVWQDR; DYSNASRTLLL; SYFSGTKIMWI; YWQSAEEIVSL; YFSGTKIMWIL; AYLAGLATGYW; VFIGGAVIQWL; VFDKNANIKGF |
| | HLA-A2902 | YLAGLATGY; SVSDNGGVY; ETTALGAAY; ELKESSTIY; QWLRDGLEF; FAQKEFTQIY; AYLAGLATGY; SVSDNGGVYF; SSVSDNGGVY; VTYVLEGSVF; AWGRKKSVTY; GFAQKEFTQIY; ITETTALGAAY; AAYLAGLATGY; IWEKNTGKPIY |
| | HLA-A6801 | DAIGITNQR; ATFGQACLK; LLTSIAWGR; ITEAMANAR; STIYGKTDK; NAIVWQDRR; TAKICDQLK; ETTALGAAY; TSIAWGRKK; LTSIAWGRK; IVSLWQVDK; LLSILNVPR; ATDYSNASR; SSRAMVFDK; WILWNLTQK; EPSMPKNQK; GSTKAHITR; NTYGTGCFL; ESIAFQSFD; DLLECKVVR; TTSSRAMVF; FDILNTMKK; GGAVIQWLR; KIFEPSMPK; YNAIVWQDR; TTALGAAYL; CFLTVNIGK; PNFEIQELR; FQADLLECK; APHWDSYAR; DNVEGARQR; YLAGLATGY; ILDNVEGAR; ENWNKAVGK; MVFDKNANIK; HATDYSNASR; TVIWEKNTGK; QSFDILNTMK; TSSRAMVFDK; ATFGQACLKK; EIVSLWQVDK; RTAKICDQLK; ELLSILNVPR; IPNFEIQELR; VITEAMANAR; AATFGQACLK; NANIKGFAQK; LLTSIAWGRK; WLRDGLEFFR; LTSIAWGRKK; TAKICDQLKK; YNAIVWQDRR; WILDNVEGAR; IYNAIVWQDR; TWILWNLTQK; SIDQGTTSSR; NTYGTGCFLT; SSTIYGKTDK; IVWQDRRTAK; WILWNLTQKK; GAPHWDSYAR; TTALGAAYLA; IDAIGITNQR; IGGAVIQWLR; QACLKKGMAK; ETTALGAAYL; EGKDKIILEK; TTSSRAMVFD; KLLTSIAWGR; DKIFEPSMPK; TTSSRAMVFDK; QSFDILNTMKK; FAATFGQACLK; TTVIWEKNTGK; SIPNFEIQELR; EIDAIGITNQR; TIIGITRGSTK; FIGGAVIQWLR; ESSTIYGKTDK; LSIDQGTTSSR; GVITEAMANAR; DTWILWNLTQK; RTAKICDQLKK; MWILDNVEGAR; IYNAIVWQDRR; MQFQADLLECK; YARGTIIGITR; NVPRAILPELK; LVLDSYFSGTK; ELKESSTIYGK; EHATDYSNASR; NASRTLLLNIK; TGCFLTVNIGK; LLTSIAWGRKK; FQSFDILNTMK; EPSMPKNQKEK; QADLLECKVVR; AATFGQACLKK; TWILWNLTQKK; ETTALGAAYLA; EEIVSLWQVDK; NTMKKSIPNFE; AIVWQDRRTAK; PIYNAIVWQDR; LGAPHWDSYAR; TIYGKTDKALF; ILDNVEGARQR; QWLRDGLEFFR |
| | HLA-B0702 | KAHITRAAL; KPIYNAIVW; VPRAILPEL; MPKNQKEKL; RAALESIAF; RPKITETTA; VPAFVGLGA; AAYLAGLAT; IPNFEIQEL; EPIISHDKL; LPELKESST; IAWGRKKSV; RPKITETTAL; MPKNQKEKLL; LPELKESSTI; DPTEIWGSQL; VPAFVGLGAP; TKAHITRAAL; SVSDNGGVYF; EPIISHDKLL; IPIAGIAGDQF; GARQRAENGEL; VPAFVGLGAPH; APHWDSYARGT; FFRKSSDAEAL; WGRKKSVTYVL; IVWQDRRTAKI; RPKITETTALG; STKAHITRAAL |
| | HLA-B0801 | KAHITRAAL; MPKNQKEKL; RKKSVTYVL; RPKITETTAL; |

Fig. 32 continued

| | | |
|---|---|---|
| | | FRKSSDAEAL; MPKNQKEKLL; WGRKKSVTYV; WGRKKSVTYVL; FFRKSSDAEAL |
| | HLA-B1501 | AQKEFTQIY; YLAGLATGY; RQRAENGEL; SVSDNGGVY; RAALESIAF; TMKKSIPNF; SQNNLLMQF; WLRDGLEFF; ELKESSTIY; TQIYPQPSW; ETTALGAAY; NQRETTVIW; WGRKKSVTY; ITRGSTKAH; TTSSRAMVF; SLWQVDKIF; QSFDILNTM; SVFIGGAVI; QSAEEIVSL; LGAPHWDSY; WQSAEEIVS; YSNASRTLL; GGVYFVPAF; IQWLRDGLEF; WQSAEEIVSL; TQKKEHATDY; SQLGVITEAM; SVSDNGGVYF; FQSFDILNTM; VTYVLEGSVF; SSVSDNGGVY; GLGAPHWDSY; YLAGLATGYW; FAQKEFTQIY; WEKNTGKPIY; YSNASRTLLL; IAGDQFAATF; RQRAENGELQ; ALESIAFQSF; NIKGFAQKEF; ASQNNLLMQF; RQRAENGELCF; ITRAALESIAF; WQVDKIFEPSM; IQWLRDGLEFF; ASSVSDNGGVY; MAKNTYGTGCF; WQSAEEIVSLW; ITETTALGAAY; IVSLWQVDKIF; AAYLAGLATGY; GIAGDQFAATF; IAWGRKKSVTY; AALESIAFQSF; FQADLLECKVV; SVTYVLEGSVF; VIQWLRDGLEF; SSVSDNGGVYF; LTQKKEHATDY; AQKEFTQIYPQ; CLKKGMAKNTY; STKAHITRAAL; GFAQKEFTQIY |
| | HLA-B2705 | RKKSVTYVL; GRKKSVTYVL; QRAENGELCF; RRTAKICDQL; TRAALESIAF; QRETTVIWEK; LRDGLEFFRK; ARGTIIGITR; RRTAKICDQLK; GQACLKKGMAK; RQRAENGELCF |
| | HLA-B3501 | RAALESIAF; IPNFEIQEL; ETTALGAAY; SVSDNGGVY; YPQPSWVEH; LPNEIDAIG; IAFQSFDIL; YLAGLATGY; FAATFGQAC; YFVPAFVGL; IAGDQFAAT; QSFDILNTM; IAGIAGDQF; KPIYNAIVW; HATDYSNAS; MPKNQKEKL; SLWQVDKIF; RAENGELCF; ELKESSTIY; EKNTGKPIY; TYVLEGSVF; APHWDSYAR; QLGVITEAM; LESIAFQSF; YVLEGSVFI; GASQNNLLM; LGAPHWDSY; EAMANARIL; VPRAILPEL; AAYLAGLAT; TTSSRAMVF; TLEWDDELL; EPIISHDKL; VSDNGGVYF; FAQKEFTQIY; IAGDQFAATF; FAATFGQACL; QPSWVEHDPT; LPNEIDAIGI; FQSFDILNTM; SVSDNGGVYF; TETTALGAAY; RPKITETTAL; SSVSDNGGVY; MPKNQKEKLL; EPIISHDKLL; VSLWQVDKIF; TRAALESIAF; NGGVYFVPAF; IQWLRDGLEF; DPTEIWGSQL; SQLGVITEAM; DSYFSGTKIM; QVDKIFEPSM; LPELKESSTI; LPELKESSTIY; IPIAGIAGDQF; IAWGRKKSVTY; VPAFVGLGAPH; LPNEIDAIGIT; AAYLAGLATGY; MAKNTYGTGCF; ITETTALGAAY; AALESIAFQSF; TALGAAYLAGL; IVSLWQVDKIF; QPSWVEHDPTE; ASSVSDNGGVY; WQVDKIFEPSM; ITRAALESIAF; SVTYVLEGSVF; MANARILPNEI; SSVSDNGGVYF; YFSGTKIMWIL; APHWDSYARGT; FFRKSSDAEAL; GASQNNLLMQF |
| | HLA-B4403 | AEIPIAGIA; EEIVSLWQV; NEIDAIGIT; KEFTQIYPQ; AEALASSVS; AEEIVSLWQ; QELRVDGGA; TEIWGSQLG; DELLSILNV; AEIPIAGIAG; TEIWGSQLGV; AEEIVSLWQV; NEIDAIGITN; TETTALGAAY; EEIVSLWQVD; AENGELCFGT; KEFTQIYPQP; QELRVDGGAS; KEFTQIYPQPS; AEIPIAGIAGD; NEIDAIGITNQ; TEIWGSQLGVI; KEPIISHDKLL; AENGELCFGTI; TETTALGAAYL; KEHATDYSNAS; GELCFGTIDTW |
| | HLA-B5101 | VPAFVGLGA; VPRAILPEL; LPNEIDAIG; LPELKESSTI; EPIISHDKLL; LPNEIDAIGIT; IPIAGIAGDQF; IPNFEIQELRV |
| | HLA-B5701 | GTIDTWILW; SAEEIVSLW; KTGLVLDSY; LCFGTIDTW; FTQIYPQPSW; QSAEEIVSLW; TNQRETTVIW; FAQKEFTQIY; ITNQRETTVIW; TGKPIYNAIVW; DSYFSGTKIMW; KNQKEKLLENW |
| NP_212342.1 \| hypothetical protein BB0208 [Borrelia | HLA-A0101 | |
| | | YIEEKVLKY; NTSLEECYY; YSQEKKDIY; ESSIFKERY; LIEIQNSPY; NTKKLGTTY; ESFIDALEY; LSFYPNIEY; SSKNISFNY; ETYGWIAFY; QTEDFFISF; TLSLNEIFY; FQDTLKCYLY; GSSKNISFNY; FLSFYPNIEY; LIEIQNSPYY; KTLSLNEIFY; KTIKKDSEFY; ATLKKHINKY; YLEEEILALKY; NIETYGWIAFY; KSAFLEIIMHY; NLNTKKLGTTY; |

Fig. 32 continued

| burgdorferi B31]; SEQ ID NO:28, SEQ ID NO: 64774-65881 | | ETYGWIAFYIY; ISFDKTNFNPY |
|---|---|---|
| | HLA-A0201 | FISDILLYL; MLILTYWPV; YLEEEILAL; FLEIIMHYV; KLLPAMCYL; YLIYCENLV; YLDENKITI; LLPAMCYLI; QTIDILVAV; YLYVIEKTI; KLINIKEKI; SISSQLYKL; YIKSAFLEI; YLLIKSLKT; FFSDFTQYA; TLKCYLYVI; FISFFKTKL; FQDTLKCYL; ILIKXYKYL; SLLEFISFF; IILNFSSNI; KTFEIQNQI; AIKKWILEI; YFLSFYPNI; SLEQTIDIL; QLDYQKSYL; ILALKYNEI; SFIDALEYI; LLYLDENKI; LALKYNEIL; FQTEDFFIS; RMLILTYWPV; KLLPAMCYLI; YLTWFFKDKI; LIYCENLVEL; YLRALKTLSL; SLEQTIDILV; AFLEIIMHYV; CLSKNIFIKI; IQNQIFVYFL; ILNFSSNINI; KXYKYLEEEI; ILTYWPVGCL; QLDYQKSYLL; HINKYIEEKV; ETYGWIAFYI; KFISDILLYL; KLKSSNFLKL; RILKIIIKNI; KLEKPEIIEL; ILALKYNEIL; YFFSDFTQYA; YIKSAFLEII; QLYKLEKPEI; ILLYLDENKI; AIKKWILEIV; KILNILNKNL; KILIKXYKYL; NQLDYQKSYL; KISNNWESFI; YGWIAFYIYA; IIIKNIRFNL; YSISSQLYKL; YLYVIEKTIT; SLLEFISFFK; LLEFISFFKT; FIQISKEANL; VLKYSISSQL; ALKTLSLNEI; RLIKLKRMLI; FSSNINIDSL; YLIYCENLVEL; FQDTLKCYLYV; KTFEIQNQIFV; FVYFLSFYPNI; SLLEFISFFKT; SAFLEIIMHYV; AMCYLIYCENL; IILNFSSNINI; KVLKYSISSQL; NQLDYQKSYLL; YIEEKVLKYSI; QLDYQKSYLLI; LLYLDENKITI; KIIIKNIRFNL; ALKYNEILNYL; KLEKPEIIELI; KXYKYLEEEIL; RLIKLKRMLIL; KLKSSNFLKLI; LILTYWPVGCL; FKFISDILLYL; KRMLILTYWPV; QLYKLEKPEII; ILNYLRALKTL; KQIILNFSSNI; LLPAMCYLIYC; YIYADNKDKKI; CLSKNIFIKIL; YKLEKPEIIEL; KLEDENEKKLL; YQKSYLLIKSL; SQLYKLEKPEI; IIIKNIRFNLI |
| | HLA-A0301 | KLKSSNFLK; ILNYLRALK; ISFFKTKLK; LLEFISFFK; KLKQKINFK; KLGTTYKLK; CLSKNIFIK; LSLNEIFYK; YSISSQLYK; RMKEFFKSK; NIFIKILIK; ATLKKHINK; KIKEIITAK; EIFYKGSSK; HINKYIEEK; SIFKERYIK; KINPNQLDY; KKYLTWFFK; ITIPKKIIK; VIEKTITKK; ETYGWIAFY; LVAVRNRNK; KCYLYVIEK; ILNKNLKYR; YVIEKTITK; VFKSSLTNK; TLSLNEIFY; KFISDILLY; TLKKHINKY; SFYPNIEYK; CQRMKEFFK; EIIMHYVKK; NIRFNLIEK; SSKNISFNY; KILIKXYKY; KVFKSSLTN; AVRNRNKIK; YQKSYLLIK; YLTWFFKDK; SSQLYKLEK; NPYESSIFK; YIYADNKDK; ILLYLDENK; NILNKNLKY; KEANLNTKK; SYLLIKSLK; AFYIYADNK; LSFYPNIEY; NTQNEAIKK; SLLEFISFFK; KSYLLIKSLK; FISFFKTKLK; KINFKKELMK; KYSISSQLYK; SLKTRSRILK; ILVAVRNRNK; TLSLNEIFYK; KVFKSSLTNK; KITIPKKIIK; FIKILIKXYK; KLKQKINFKK; KIKILNILNK; RSRILKIIIK; EILNYLRALK; KYLTWFFKDK; QIFVYFLSFY; ILNILNKNLK; LSFYPNIEYK; FLSFYPNIEY; TYWPVGCLSK; ISSQLYKLEK; NTKKLGTTYK; TKKYLTWFFK; FSDFTQYAPK; KLINIKEKIK; RNKNFIQISK; KKLGTTYKLK; LYVIEKTITK; KLKRMLILTY; FLEIIMHYVK; SSIFKERYIK; KTLSLNEIFY; KNIFIKILIK; NEIFYKGSSK; NTSLEECYYK; ALKYNEILNY; IAFYIYADNK; YVIEKTITKK; LATLKKHINK; FIDALEYIEK; KLIEIQNSPY; FYDSLATLKK; YLEEEILALK; EFYDSLATLK; LTNKESRLIK; LKCYLYVIEK; SAFLEIIMHY; KNIRFNLIEK; YLLIKSLKTR; NLVELKNNRK; NLKYRPENQK; LLPAMCYLIY; FNPYESSIFK; YKLKSSNFLK; TEDFFISFDK; SFFKTKLKQK; IYCENLVELK; YIYADNKDKK; TKLKQKINFK; KISNDYEKEK; LEIIMHYVKK; YSQEKKDIYK; LKYSISSQLY; KHINKYIEEK; NILNKNLKYR; QNSPYYSQEK; ISKEANLNTK; LEFISFFKTK; LDENKITIPK; YLYVIEKTITK; FLSFYPNIEYK; KSAFLEIIMHY; KTKLKQKINFK; KLLPAMCYLIY; TLKCYLYVIEK; NSLLEFISFFK; IQNSPYYSQEK; KINPNQLDYQK; KLIEIQNSPYY; SLTNKESRLIK; LLEFISFFKTK; FLEIIMHYVKK; ILNILNKNLKY; SISSQLYKLEK; TIPKKIIKIQK; IFIKILIKXYK; ISKEANLNTKK; VLKYSISSQLY; RILKIIIKNIR; LVAVRNRNKIK; |

| | | |
|---|---|---|
| | | LKYSISSQLYK; EFYDSLATLKK; LLIKSLKTRSR; IFCQRMKEFFK; NFNPYESSIFK; ISFDKTNFNPY; NLNTKKLGTTY; YLDENKITIPK; QISKEANLNTK; ETYGWIAFYIY; SEFYDSLATLK; AFLEIIMHYVK; HFKFISDILLY; KYLEEEILALK; WIAFYIYADNK |
| | HLA-A1101 | SSQLYKLEK; ATLKKHINK; YSISSQLYK; SIFKERYIK; TSLEECYYK; LSLNEIFYK; LLEFISFFK; ISFFKTKLK; KLKSSNFLK; ILNYLRALK; YVIEKTITK; KKYLTWFFK; ITIPKKIIK; NTQNEAIKK; NIFIKILIK; SSKNISFNY; SFYPNIEYK; HINKYIEEK; AFYIYADNK; RMKEFFKSK; LVAVRNRNK; ETYGWIAFY; SYLLIKSLK; EIIMHYVKK; ISNDYEKEK; KLKQKINFK; KIKEIITAK; CLSKNIFIK; CQRMKEFFK; SQEKKDIYK; NPYESSIFK; EIFYKGSSK; KCYLYVIEK; YQKSYLLIK; VIEKTITKK; ILLYLDENK; LVELKNNRK; YIYADNKDK; KLGTTYKLK; NIRFNLIEK; TLSLNEIFY; YLTWFFKDK; LSFYPNIEY; SPYYSQEKK; KILIKXYKY; WILEIVRNK; NSPYYSQEK; AVRNRNKIK; KYIEEKVLK; SSLTNKESR; SDFTQYAPK; VFKSSLTNK; KFISDILLY; KINPNQLDY; TIDILVAVR; ALEYIEKHK; SAFLEIIMH; SLLEFISFFK; KVFKSSLTNK; KSYLLIKSLK; TLSLNEIFYK; SSIFKERYIK; LSFYPNIEYK; KINFKKELMK; IAFYIYADNK; ISSQLYKLEK; KIKILNILNK; YVIEKTITKK; QIFVYFLSFY; LTNKESRLIK; KTLSLNEIFY; NTSLEECYYK; SLKTRSRILK; SAFLEIIMHY; ILNILNKNLK; KYSISSQLYK; FISFFKTKLK; YIYADNKDKK; YSQEKKDIYK; ILVAVRNRNK; KLKQKINFKK; KISNDYEKEK; FSDFTQYAPK; KITIPKKIIK; NTKKLGTTYK; EILNYLRALK; FIDALEYIEK; QTIDILVAVR; ISKEANLNTK; LATLKKHINK; SFFKTKLQK; KTIKKDSEFY; GSSKNISFNY; KNIRFNLIEK; RSRILKIIK; KYLTWFFKDK; LIKISNDYEK; TKKYLTWFFK; ATLKKHINKY; KLINIKEKIK; KNIFIKILIK; IYCENLVELK; FLEIIMHYVK; EFYDSLATLK; TYWPVGCLSK; YLEEEILALK; FIKILIKXYK; TEDFFISFDK; KSSLTNKESR; VAVRNRNKIK; KLIEIQNSPY; KYNEILNYLR; DILLYLDENK; NSPYYSQEKK; FVYFLSFYPN; KWILEIVRNK; LEFISFFKTK; KTLSLNEIFYK; LTYWPVGCLSK; SISSQLYKLEK; KSLKTRSRILK; NSLLEFISFFK; ITKKYLTWFFK; KILNILNKNLK; QTEDFFISFDK; KINPNQLDYQK; LIYCENLVELK; ISFFKTKLQK; SLATLKKHINK; TLKCYLYVIEK; IQNSPYYSQEK; KTKLKQKINFK; SLTNKESRLIK; WIAFYIYADNK; TIPKKIIKIQK; SFIDALEYIEK; AFLEIIMHYVK; KSAFLEIIMHY; IFCQRMKEFFK; ISFDKTNFNPY; YLYVIEKTITK; FLSFYPNIEYK; SEFYDSLATLK; QISKEANLNTK; TYKLKSSNFLK; ISKEANLNTKK; LLEFISFFKTK; LVAVRNRNKIK; ETYGWIAFYIY; IFIKILIKXYK; KYLEEEILALK; YLDENKITIPK; NQIFVYFLSFY; KLIEIQNSPYY; NFNPYESSIFK; ESSIFKERYIK; LKYSISSQLYK; EFYDSLATLKK; AFYIYADNKDK; ELIKISNDYEK; FLEIIMHYVKK; AIKKWILEIVR; FFSDFTQYAPK; LVELKNNRKIK; KKYLTWFFKDK; RILKIIKNIR; YIEKHKLINIK; KLLPAMCYLIY; VGCLSKNIFIK; CQRMKEFFKSK; SKNIFIKILIK; TIDILVAVRNR; YAPKDFQDTLK |
| | HLA-A2402 | DYQKSYLLI; TYGWIAFYI; IYKQIILNF; TYKLKSSNF; KFQTEDFFI; EYIEKHKLI; YFLSFYPNI; NYLRALKTL; XYKYLEEEI; KYNEILNYL; IYCENLVEL; KYSISSQLY; RYIKSAFLE; SFNYFFSDF; DYEKEKNAF; FFKSKTFEI; SYLLIKSLK; FYKGSSKNI; TFEIQNQIF; KYLTWFFKD; SFIDALEYI; LYKLEKPEI; IQNQIFVYF; CYLIYCENL; FYDSLATLK; TKKYLTWFF; IFCQRMKEF; RYIKSAFLEI; FYPNIEYKHF; VYFLSFYPNI; CYLYVIEKTI; YYKNTQNEAI; TYKLKSSNFL; LYLDENKITI; HYVKKNSQNI; IYADNKDKKI; KYLEEEILAL; TYGWIAFYIY; KYRPENQKVF; NQIFVYFLSF; KFISDILLYL; LYKLEKPEII; XYKYLEEEIL; KYLTWFFKDK; CYLIYCENLV; DYQKSYLLIK; IFCQRMKEFF; ITKKYLTWFF; FFISFDKTNF; IYCENLVELK; EFFKSKTFEI; KYSISSQLYK; NFNPYESSIF; KYIEEKVLKY; KYNEILNYLR; RYIKSAFLEII; KYLTWFFKDKI; KYSISSQLYKL; KFQTEDFFISF; |

Fig. 32 continued

| | | |
|---|---|---|
| | | EYIEKHKLINI; NYLRALKTLSL; IYADNKDKKIF; QYYKNTQNEAI; FYKGSSKNISF; QYAPKDFQDTL; YWPVGCLSKNI; EYKHFKFISDI; IFKERYIKSAF; SFYPNIEYKHF; FYPNIEYKHFK; TYKLKSSNFLK; TYGWIAFYIYA; KYLEEEILALK; KTITKKYLTWF; TITKKYLTWFF; IIKNIRFNLI; SSKNISFNYFF; YYKNTQNEAIK; FYIYADNKDKK; ITAKFQTEDFF |
| | HLA-A2902 | YFFSDFTQY; KFISDILLY; EIQNQIFVY; LSFYPNIEY; YIEEKVLKY; NILNKNLKY; SSKNISFNY; ESFIDALEY; AFLEIIMHY; IFVYFLSFY; KINPNQLDY; TLSLNEIFY; ELIKISNDY; KILIKXYKY; KYSISSQLY; ETYGWIAFY; YGWIAFYIY; NTKKLGTTY; NTSLEECYY; KNISFNYFF; FNTSLEECY; FVYFLSFYP; QIFVYFLSF; IEIQNSPYY; FYPNIEYKH; LIEIQNSPY; FIKILIKXY; FISFDKTNF; NYFFSDFTQY; KYIEEKVLKY; KLIEIQNSPY; TYGWIAFYIY; IFIKILIKXY; FEIQNQIFVY; FLSFYPNIEY; QIFVYFLSFY; SAFLEIIMHY; FFISFDKTNF; SFDKTNFNPY; YYSQEKKDIY; FYPNIEYKHF; KTLSLNEIFY; FNTSLEECYY; LLPAMCYLIY; FQDTLKCYLY; QKINPNQLDY; KLKRMLILTY; FKFISDILLY; KTIKKDSEFY; LNILNKNLKY; IKILIKXYKY; VIEKTITKKY; GSSKNISFNY; ALKYNEILNY; AFNTSLEECY; EIQNQIFVYF; LIEIQNSPYY; YFLSFYPNIEY; YLEEEILALKY; YVIEKTITKKY; ILNILNKNLKY; KLIEIQNSPYY; TFEIQNQIFVY; FNYFFSDFTQY; HFKFISDILLY; KSAFLEIIMHY; NLNTKKLGTTY; ISFDKTNFNPY; NQIFVYFLSFY; FIKILIKXYKY; KLLPAMCYLIY; NAFNTSLEECY; NWESFIDALEY; PYYSQEKKDIY; DFQDTLKCYLY; ETYGWIAFYIY; AFNTSLEECYY; KGSSKNISFNY; KFQTEDFFISF; PYESSIFKERY; SFYPNIEYKHF; NIFIKILIKXY; NIETYGWIAFY; IIELIKISNDY |
| | HLA-A6801 | ETYGWIAFY; YSISSQLYK; LLEFISFFK; HINKYIEEK; EIIMHYVKK; EIFYKGSSK; EDFFISFDK; YVIEKTITK; ISFFKTKLK; NSPYYSQEK; ESRLIKLKR; NPYESSIFK; SIFKERYIK; ESFIDALEY; ILNYLRALK; EFISFFKTK; NLVELKNNR; NTQNEAIKK; TSLEECYYK; LSLNEIFYK; SFYPNIEYK; NTSLEECYY; YIYADNKDK; YNEILNYLR; NIRFNLIEK; NPNQLDYQK; ESSIFKERY; SPYYSQEKK; LVAVRNRNK; NIFIKILIK; CLSKNIFIK; ITIPKKIIK; TIDILVAVR; YLTWFFKDK; SSQLYKLEK; SSLTNKESR; SYLLIKSLK; LSFYPNIEY; SSKNISFNY; IFVYFLSFY; DILVAVRNR; EIQNQIFVY; ILNKNLKYR; FVYFLSFYP; ISNDYEKEK; NKNFIQISK; YESSIFKER; LNILNKNLK; ELIKISNDY; NYFFSDFTQ; TLSLNEIFY; FYDSLATLK; YFFSDFTQY; KLKSSNFLK; LVELKNNRK; LLIKSLKTR; TIKKDSEFY; IYADNKDKK; IKILIKXYK; NISFNYFFS; ILLYLDENK; ELKNNRKIK; IKISNDYEK; WILEIVRNK; ENKITIPKK; DENKITIPK; AFYIYADNK; KIKEIITAK; LKIIIKNIR; CQRMKEFFK; LEIIMHYVK; QTIDILVAVR; NTSLEECYYK; EFYDSLATLK; IAFYIYADNK; LSFYPNIEYK; YVIEKTITKK; FISFFKTKLK; SLLEFISFFK; EILNYLRALK; TLSLNEIFYK; YIYADNKDKK; NTKKLGTTYK; ETYGWIAFYI; NSPYYSQEKK; SSIFKERYIK; LIKISNDYEK; QIFVYFLSFY; SAFLEIIMHY; FIKILIKXYK; NYFFSDFTQY; FLEIIMHYVK; NILNKNLKYR; KSYLLIKSLK; DALEYIEKHK; KVFKSSLTNK; YPNIEYKHFK; ISSQLYKLEK; LTNKESRLIK; DILLYLDENK; KYNEILNYLR; ILVAVRNRNK; NLVELKNNRK; TKKYLTWFFK; FYIYADNKDK; ILNILNKNLK; LIKSLKTRSR; LATLKKHINK; FSDFTQYAPK; ILKIIIKNIR; YSQEKKDIYK; FIDALEYIEK; IYCENLVELK; NLKYRPENQK; KSSLTNKESR; YLEEEILALK; FNPYESSIFK; TTYKLKSSNF; EKIKEIITAK; ISKEANLNTK; FLSFYPNIEY; QNSPYYSQEK; TYGWIAFYIY; TYWPVGCLSK; TEDFFISFDK; SFFKTKLQK; FVYFLSFYPN; NEIFYKGSSK; IDILVAVRNR; FNYFFSDFTQ; LTYWPVGCLS; IPKKIIKIQK; YKLKSSNFLK; KTIKKDSEFY; SLKTRSRILK; DENKITIPKK; LYVIEKTITK; ETYGWIAFYIY; ELIKISNDYEK; WIAFYIYADNK; ESSIFKERYIK; LTYWPVGCLSK; |

Fig. 32 continued

| | | |
|---|---|---|
| | | QTEDFFISFDK; FLSFYPNIEYK; EFYDSLATLKK; NSLLEFISFFK; NPYESSIFKER; ITKKYLTWFFK; EFISFFKTKLK; LIYCENLVELK; FYPNIEYKHFK; NFNPYESSIFK; YLYVIEKTITK; ISFFKTKLKQK; SISSQLYKLEK; KTLSLNEIFYK; FYIYADNKDKK; TLKCYLYVIEK; NQIFVYFLSFY; IFIKILIKXYK; FNTSLEECYYK; NAFNTSLEECY; TYKLKSSNFLK; IFCQRMKEFFK; EQTIDILVAVR; QISKEANLNTK; YAPKDFQDTLK; LKYNEILNYLR; FFSDFTQYAPK; SFIDALEYIEK; TIPKKIIKIQK; FNYFFSDFTQY; LKYSISSQLYK; TTYKLKSSNFL; TIDILVAVRNR; LLEFISFFKTK; LVAVRNRNKIK; FLEIIMHYVKK; LNILNKNLKYR; SEFYDSLATLK; DNKDKKIFCQR; LLIKSLKTRSR; NEILNYLRALK; YVIEKTITKKY; RILKIIIKNIR; ISFDKTNFNPY; SLATLKKHINK; YYSQEKKDIYK; FKSSLTNKESR; ITAKFQTEDFF; ISKEANLNTKK; LIEKLEDENEK; KTKLKQINFK; ESFIDALEYIE; KINPNQLDYQK; YYKNTQNEAIK; KSAFLEIIMHY; YIEKHKLINIK; NIETYGWIAFY; INKYIEEKVLK; SYLLIKSLKTR; AIKKWILEIVR; DILVAVRNRNK; SSKNISFNYFF; HFKFISDILLY; KILNILNKNLK; QKSYLLIKSLK; NKIKILNILNK; LYVIEKTITKK; SLTNKESRLIK; ISFNYFFSDFT; QNSPYYSQEKK; FSSNINIDSLE; LSFYPNIEYKH; CENLVELKNNR |
| | HLA-B0702 | APKDFQDTL; KERYIKSAF; YPNIEYKHF; VAVRNRNKI; AVRNRNKIKI; YLRALKTLSL; IVRNKNFIQI; WPVGCLSKNI; LPAMCYLIYC; AVRNRNKIKIL; WPVGCLSKNIF; SPYYSQEKKDI; YPNIEYKHFKF; RPENQKVFKSS; APKDFQDTLKC; IPKKIIKIQKI; KVLKYSISSQL |
| | HLA-B0801 | SLKTRSRIL; FFKSKTFEI; LIKLKRMLI; RLIKLKRML; YLYVIEKTI; ILIKXYKYL; YIKSAFLEI; YLRALKTLSL; LIKLKRMLIL; FFKTKLKQKI; ILALKYNEIL; YIKSAFLEII; YYKNTQNEAI; FKERYIKSAF; IFKERYIKSAF; RMKEFFKSKTF; RLIKLKRMLIL; YIKSAFLEIIM; IPKKIIKIQKI; YQKSYLLIKSL |
| | HLA-B1501 | LSFYPNIEY; IQNQIFVYF; NQLDYQKSY; QIFVYFLSF; SSKNISFNY; SLLEFISFF; FIKILIKXY; YLEEEILAL; ETYGWIAFY; KISNNWESF; TLKKHINKY; KTIKKDSEF; KINPNQLDY; ELIKISNDY; NTKKLGTTY; ESFIDALEY; LIEIQNSPY; IQISKEANL; YSQEKKDIY; YIEEKVLKY; IQKINPNQL; NQKVFKSSL; YFFSDFTQY; IEIQNSPYY; AFLEIIMHY; KFISDILLY; QTEDFFISF; TQNEAIKKW; KIIIKNIRF; KQIILNFSS; IETYGWIAF; TLSLNEIFY; KNSQNIETY; FDKTNFNPY; SQNIETYGW; KLIEIQNSPY; FQTEDFFISF; NQIFVYFLSF; KTFEIQNQIF; KLKRMLILTY; FLSFYPNIEY; YLRALKTLSL; ALKYNEILNY; KIKEIITAKF; SSKNISFNYF; SAFLEIIMHY; ISFNYFFSDF; QIFVYFLSFY; KQKINFKKEL; LLPAMCYLIY; KTIKKDSEFY; IQNQIFVYFL; FEIQNQIFVY; KIFCQRMKEF; IFIKILIKXY; ITAKFQTEDF; GSSKNISFNY; FQDTLKCYLY; WESFIDALEY; VLKYSISSQL; RMKEFFKSKTF; ISFDKTNFNPY; YVIEKTITKKY; KLIEIQNSPYY; IQKINPNQLDY; VLKYSISSQLY; YQKSYLLIKSL; QNIETYGWIAF; KSNEKNSLLEF; NQIFVYFLSFY; YLEEEILALKY; ILNILNKNLKY; IFKERYIKSAF; KSAFLEIIMHY; ALKTLSLNEIF; KLLPAMCYLIY; ILKIIIKNIRF; YFLSFYPNIEY; WILEIVRNKNF; KQIILNFSSNI; YLIYCENLVEL; SSKNISFNYFF; ETYGWIAFYIY; FYKGSSKNISF; FIKILIKXYKY; NLNTKKLGTTY; KQKINFKKELM; TNFNPYESSIF; KFQTEDFFISF; NAFNTSLEECY; TQNEAIKKWIL; GSSKNISFNYF; HFKFISDILLY |
| | HLA-B2705 | SRILKIIIK; LRALKTLSL; KRMLILTYW; IRFNLIEKL; KKLGTTYKL; ERYIKSAFL; YRPENQKVF; SRLIKLKRM; KKWILEIVR; KKYLTWFFK; QRMKEFFKSK; KRMLILTYWP; SRLIKLKRML; YRPENQKVFK; KKLGTTYKLK; NQIFVYFLSF; NRNKIKILNI; KRMLILTYWPV; VRNKNFIQISK; KKWILEIVRNK; SRLIKLKRMLI; SRILKIIIKNI |
| | HLA-B3501 | LPAMCYLIY; YGWIAFYIY; YPNIEYKHF; YFFSDFTQY; LIEIQNSPY; FDKTNFNPY; EIQNQIFVY; ETYGWIAFY; ESFIDALEY; TFEIQNQIF; |

| | | |
|---|---|---|
| | | YLEEEILAL; TAKFQTEDF; LSFYPNIEY; IFVYFLSFY; QTEDFFISF; QIFVYFLSF; EFYDSLATL; NSLLEFISF; IQNQIFVYF; FISFDKTNF; YSQEKKDIY; LALKYNEIL; TLSLNEIFY; IEIQNSPYY; APKDFQDTL; IETYGWIAF; NTKKLGTTY; YIEEKVLKY; FLSFYPNIEY; NIETYGWIAF; WESFIDALEY; YADNKDKKIF; FEIQNQIFVY; NFNPYESSIF; TAKFQTEDFF; SAFLEIIMHY; LIEIQNSPYY; FQTEDFFISF; TYGWIAFYIY; FFISFDKTNF; SFDKTNFNPY; FKFISDILLY; YAPKDFQDTL; EIQNQIFVYF; NYFFSDFTQY; KLIEIQNSPY; NPNQLDYQKS; QIFVYFLSFY; WPVGCLSKNI; YYSQEKKDIY; NNWESFIDAL; FKERYIKSAF; LPAMCYLIYC; FSSNINIDSL; YESSIFKERY; WPVGCLSKNIF; NPNQLDYQKSY; YPNIEYKHFKF; NAFNTSLEECY; ETYGWIAFYIY; ISFDKTNFNPY; TFEIQNQIFVY; YFLSFYPNIEY; YVIEKTITKKY; NIETYGWIAFY; LALKYNEILNY; YLEEEILALKY; YIKSAFLEIIM; LATLKKHINKY; FEIQNQIFVYF; FNYFFSDFTQY; NLNTKKLGTTY; LKLIEIQNSPY; YLIYCENLVEL; HFKFISDILLY |
| | HLA-B4403 | EEEILALKY; SEFYDSLAT; IEIQNSPYY; NEILNYLRA; EEILALKYN; FEIQNQIFV; KEFFKSKTF; NEKNSLLEF; LEIVRNKNF; IETYGWIAF; NEIFYKGSS; KEIITAKFQ; FEIQNQIFVY; SEFYDSLATL; NEILNYLRAL; KEIITAKFQT; WESFIDALEY; EEILALKYNE; IEIQNSPYYS; EEILALKYNEI; FEIQNQIFVYF; KEFFKSKTFEI; NEKKLLPAMCY; SEFYDSLATLK; EEKVLKYSISS; DENEKKLLPAM; NEILNYLRALK |
| | HLA-B5101 | LPAMCYLIY; WPVGCLSKNI; LPAMCYLIYC; KPEIIELIKI; IPKKIIKIQKI; WPVGCLSKNIF; SPYYSQEKKDI |
| | HLA-B5701 | KTLSLNEIF; TITKKYLTW; NTKKLGTTY; KTITKKYLTW; NSQNIETYGW; KTFEIQNQI; NTQNEAIKKW; KTLSLNEIFY; ITAKFQTEDFF; KNSQNIETYGW; ISFDKTNFNPY |
| NP_045482.1 \| hypothetical protein BBG22 [Borrelia burgdorferi B31]; SEQ ID NO:29, SEQ ID NO: 65882-66290 | HLA-A0101 | SADTWYTWY; YLEHMILFF; ETKPKNTCY; NTCYISFYRY; RSADTWYTWY; MSPFITGYSY; YSYEEIDPEY; |
| | HLA-A0201 | SLDSLIEYL; SLIEYLEHM; YTWYWAEEI; KLVKRMTMI; FAMEGSILT; KLIQAFTNT; YLLPPFTSQ; YISFYRYDL; FTNTNKFCI; MILFFLEKT; RMTMIYRSA; YQGSLGEPI; FLEKTPVGT; YLEHMILFFL; SLIEYLEHMI; FITGYSYEEI; LLKDKLTFSI; ILFFLEKTPV; YLLPPFTSQS; YTWYWAEEIM; FLEKTPVGTL; VLGISSAPKL; MITQQDYTEI; HMILFFLEKT; IMSPFITGYS; ILTRSKLIQA; SLIEYLEHMIL; MILFFLEKTPV; ILLKDKLTFSI; SLPSNCYAYKV; YSYEEIDPEYL; KVLGISSAPKL; MIYRSADTWYT; YQGSLGEPILL; YAYKVLGISSA; KIDSLGYQGSL; YWAEEIMSPFI; FAMEGSILTRS; SILTRSKLIQA |
| | HLA-A0301 | HMILFFLEK; SLGEPILLK; RIQFRNGNK; KLSGRFLRH; VLGISSAPK; IQAFTNTNK; LVKRMTMIY; IMSPFITGY; LTFSICDGK; LDFSRINFK; INFKGKLVK; AMEGSILTR; KVLGISSAPK; RINFKGKLVK; LIQAFTNTNK; KLTFSICDGK; SLPSNCYAYK; GSLGEPILLK; KLSGRFLRHY; KLVKRMTMIY; KTPVGTLTAK; RSADTWYTWY; LVKRMTMIYR; EHMILFFLEK; MIYRSADTWY; DLDFSRINFK; NTCYISFYRY; MSPFITGYSY; RSLPSNCYAY; EIMSPFITGY; TQQDYTEIKK; ISSAPKLSGR; TSQSGSKETK; QSGSKETKPK; KNTCYISFYR; KLIQAFTNTNK; RSLPSNCYAYK; KLVKRMTMIYR; KTRIQFRNGNK; RINFKGKLVKR; AMEGSILTRSK; SLGHTQEDSYK; IMSPFITGYSY; SLGEPILLKDK; TMIYRSADTWY; ITQQDYTEIKK; FTSQSGSKETK; RSLGHTQEDSY; MITQQDYTEIK |
| | HLA-A1101 | HMILFFLEK; SLGEPILLK; RIQFRNGNK; LTFSICDGK; NTCYISFYR; TQQDYTEIK; IQAFTNTNK; VLGISSAPK; SQSGSKETK; SSAPKLSGR; AMEGSILTR; NTKTRIQFR; KLSGRFLRH; QQDYTEIKK; LVKRMTMIY; LDFSRINFK; SADTWYTWY; TPVGTLTAK; IMSPFITGY; MITQQDYTEI; ITQQDYTEIK; KVLGISSAPK; GSLGEPILLK; LIQAFTNTNK; |

Fig. 32 continued

| | | |
|---|---|---|
| | | TQQDYTEIKK; TSQSGSKETK; RINFKGKLVK; KTPVGTLTAK; SLPSNCYAYK; NTCYISFYRY; KLTFSICDGK; RSADTWYTWY; LVKRMTMIYR; ISSAPKLSGR; MIYRSADTWY; RSLPSNCYAY; QSGSKETKPK; FAMEGSILTR; MSPFITGYSY; EIMSPFITGY; KLSGRFLRHY; DLDFSRINFK; KLVKRMTMIY; MITQQDYTEIK; RSLPSNCYAYK; KLIQAFTNTNK; ITQQDYTEIKK; AMEGSILTRSK; SQSGSKETKPK; KTRIQFRNGNK; TQQDYTEIKKK; SLGHTQEDSYK; FTSQSGSKETK; KLVKRMTMIYR; SICDGKNIDNR; SLGEPILLKDK; SAPKLSGRFLR; RINFKGKLVKR; NTNKFCIPDGR; LEHMILFFLEK; IMSPFITGYSY; GISSAPKLSGR; TMIYRSADTWY |
| | HLA-A2402 | EYLEHMILF; CYAYKVLGI; SYKNHDHDL; EYLLPPFTS; EYLEHMILFF; YWAEEIMSPF; WYTWYWAEEI; CYISFYRYDL; IQAFTNTNKF; GYQGSLGEPI; AFTNTNKFCI; SYEEIDPEYL; EYLEHMILFFL; YWAEEIMSPFI; WYWAEEIMSPF; TWYTWYWAEEI; IYRSADTWYTW; SYKNHDHDLDF; SYEEIDPEYLL; EYEITKNAPSL; PFITGYSYEEI; WYTWYWAEEIM |
| | HLA-A2902 | SLPSNCYAY; IMSPFITGY; IYRSADTWY; SYEEIDPEY; SADTWYTWY; YLEHMILFF; SPFITGYSY; ETKPKNTCY; TCYISFYRY; LVKRMTMIY; EIMSPFITGY; YSYEEIDPEY; MSPFITGYSY; YWAEEIMSPF; MIYRSADTWY; RSADTWYTWY; NTCYISFYRY; RSLPSNCYAY; EYLEHMILFF; KLVKRMTMIY; SLGHTQEDSY; TMIYRSADTWY; IMSPFITGYSY; GYSYEEIDPEY; YRSADTWYTWY; NAPSLDSLIEY; WYWAEEIMSPF |
| | HLA-A6801 | NTCYISFYR; LTFSICDGK; NTKTRIQFR; HMILFFLEK; SSAPKLSGR; LDFSRINFK; LPSNCYAYK; TPVGTLTAK; NKFCIPDGR; GSTDSDGTR; HDHDLDFSR; IQAFTNTNK; MSPFITGYS; ETKPKNTCY; TQQDYTEIK; NFKGKLVKR; FITGYSYEE; MTMIYRSAD; RIQFRNGNK; LVKRMTMIY; NTCYISFYRY; FAMEGSILTR; LVKRMTMIYR; ENTKTRIQFR; MIYRSADTWY; MSPFITGYSY; KNTCYISFYR; ISSAPKLSGR; LIQAFTNTNK; YSYEEIDPEY; TSQSGSKETK; DLDFSRINFK; EHMILFFLEK; EIKKKLENTK; EIMSPFITGY; SLPSNCYAYK; TNKFCIPDGR; DFSRINFKGK; KLTFSICDGK; INFKGKLVKR; KVLGISSAPK; TRIQFRNGNK; TQQDYTEIKK; NTNKFCIPDGR; MITQQDYTEIK; FTSQSGSKETK; SAPKLSGRFLR; SICDGKNIDNR; ITQQDYTEIKK; MSPFITGYSE; KLVKRMTMIYR; MTMIYRSADTW; GISSAPKLSGR; TMIYRSADTWY; RSLPSNCYAYK; RINFKGKLVKR; MIYRSADTWYT; NTCYISFYRYD; EKTPVGTLTAK; NAPSLDSLIEY; KLIQAFTNTNK |
| | HLA-B0702 | APKLSGRFL; IPDGRSLPS; TPVGTLTAK; TPVGTLTAKF; KPKNTCYISF; LPSNCYAYKV; LPSNCYAYKVL; APSLDSLIEYL; TPVGTLTAKFA; APKLSGRFLRH; IPDGRSLPSNC; EPILLKDKLTF |
| | HLA-B0801 | KGKLVKRMTM; LTRSKLIQAF; ILTRSKLIQAF |
| | HLA-B1501 | IMSPFITGY; LVKRMTMIY; WAEEIMSPF; YLEHMILFF; IQFRNGNKI; YQGSLGEPI; KNIDNRKEY; QAFTNTNKF; SLPSNCYAY; ETKPKNTCY; ILLKDKLTF; IQAFTNTNKF; YSYEEIDPEY; RSLPSNCYAY; RSADTWYTWY; KLSGRFLRHY; LTRSKLIQAF; KLVKRMTMIY; YQGSLGEPIL; MSPFITGYSY; MIYRSADTWY; YWAEEIMSPF; TMIYRSADTW; EIMSPFITGY; SLGHTQEDSY; SSAPKLSGRF; IMSPFITGYSY; TMIYRSADTWY; ILTRSKLIQAF; LIQAFTNTNKF; RSLGHTQEDSY; ISSAPKLSGRF; YQGSLGEPILL |
| | HLA-B2705 | KRMTMIYRS; SRINFKGKL; NRKEYEITK; TRSKLIQAF; GRFLRHYDS; KRMTMIYRSA; FRNGNKIDSL; TRIQFRNGNK; SRINFKGKLVK; YRSADTWYTWY; KRMTMIYRSAD; GRSLPSNCYAY; YKVLGISSAPK |
| | HLA-B3501 | DPEYLLPPF; WAEEIMSPF; SPFITGYSY; QAFTNTNKF; FAMEGSILT; LVKRMTMIY; SADTWYTWY; TPVGTLTAK; SYEEIDPEY; YLEHMILFF; |

Fig. 32 continued

| | | |
|---|---|---|
| | | IMSPFITGY; YTWYWAEEI; TWYWAEEIM; EPILLKDKL; LGHTQEDSY; TCYISFYRY; IPDGRSLPS; TRSKLIQAF; TPVGTLTAKF; APSLDSLIEY; YTWYWAEEIM; YSYEEIDPEY; MIYRSADTWY; MSPFITGYSY; YWAEEIMSPF; KPKNTCYISF; EIMSPFITGY; RSLPSNCYAY; NTCYISFYRY; WAEEIMSPFI; DPEYLLPPFT; LPSNCYAYKV; EPILLKDKLTF; LPSNCYAYKVL; NAPSLDSLIEY; WYWAEEIMSPF; WYTWYWAEEIM; IMSPFITGYSY; EIDPEYLLPPF; KPKNTCYISFY; TMIYRSADTWY; APSLDSLIEYL; WAEEIMSPFIT; LIEYLEHMILF; TPVGTLTAKFA; FAMEGSILTRS; YRSADTWYTWY; RSLGHTQEDSY; DPEYLLPPFTS; LIQAFTNTNKF; MTMIYRSADTW; PVGTLTAKFAM |
| | HLA-B4403 | EEIDPEYLL; EEIMSPFIT; AEEIMSPFI; YEITKNAPS; EEIDPEYLLP; EEIMSPFITG; AEEIMSPFIT; IEYLEHMILF; YEITKNAPSL; KETKPKNTCY; EEIMSPFITGY; EEIDPEYLLPP; IEYLEHMILFF; KEYEITKNAPS |
| | HLA-B5101 | LPPFTSQSG; LPSNCYAYKV; LPPFTSQSGS; LPSNCYAYKVL; LPPFTSQSGSK; EPILLKDKLTF |
| | HLA-B5701 | RSADTWYTW; ETKPKNTCY; IMSPFITGY; MIYRSADTW; YSYEEIDPEY; MTMIYRSADTW; RSADTWYTWYW |
| NP_212885.1 \| hypothetical protein BB0751 [Borrelia burgdorferi B31]; SEQ ID NO:30, SEQ ID NO: 66291-66734 | HLA-A0101 | KIDDYNLQY; LTKNIFLSY; FLSYKGNSY; YTTSKWTFF; EIDKSKIDDY; YLTKNIFLSY; FSDTTLFQEK; LTSTFLLGIIF; TTSKWTFFDVF; KSGEGDSRLAY |
| | HLA-A0201 | KLFDNNNKL; VVLTSTFLL; SLIKALDEL; FLLGIIFSN; KLENLSFKI; YLTKNIFLS; LTSTFLLGI; KFFDFDFNL; KILIIVVLT; WTFFDVFDL; IIFSNENKV; LISKIETEL; MTKPKIFSI; KIKILIIVV; KLLTEIFVG; FMTKPKIFSI; VLTSTFLLGI; KLFDNNNKLL; NLISKIETEL; LTYNKQNIPV; IISKDGLYFL; TTSKWTFFDV; KMTKERPLNI; TLFQEKNTKL; ILIIVVLTST; FLLGIIFSNE; KIFSINKEKI; KLNKENENNI; IVVLTSTFLL; NLSFKIIRKL; ALDELQKNKL; IIVVLTSTFL; KFFDFDFNLI; IIAEFKADGL; KLENLSFKII; GIIFSNENKV; KIDDYNLQYKI; VVLTSTFLLGI; ILTYNKQNIPV; KLFDNNNKLLT; ALDELQKNKLV; IIVVLTSTFLL; YTTSKWTFFDV; FLSYKGNSYNT; LIIVVLTSTFL; VLTSTFLLGII; YIKGSDENVYL; KILIIVVLTST; KMTKERPLNII; FLLGIIFSNEN; TLTKLGKDWIL; KLLTEIFVGKS |
| | HLA-A0301 | GLYFLNNQK; FLNNQKMTK; KIFSINKEK; NLSFKIIRK; KIEVKWSNK; KLVSRDQKK; LLTEIFVGK; GIGENPSFK; KVARILEEK; LTKNIFLSY; TLFQEKNTK; KNKGVFMTK; GIIFSNENK; PLNIIAEFK; KIDDYNLQY; KQNIPVDNK; ALDELQKNK; KLLTEIFVGK; LTKNIFLSYK; RPLNIIAEFK; KIDDYNLQYK; YFLNNQKMTK; TTLFQEKNTK; YLTKNIFLSY; NTKLENLSFK; SFKIIRKLNK; GSDENVYLTK; INNNYEIISK; TFFDVFDLEK; KDEYYYTTSK; IFLSYKGNSY; LIKALDELQK; NKNKGVFMTK; LEGTLTKLGK; FDFDFNLISK; KLGKDWILTY; FSDTTLFQEK; LLEKEKQINK; KALDELQKNK; LGIGENPSFK; ENLSFKIIRK; LVSRDQKKHK; LSFKIIRKLNK; MTKPKIFSINK; KIFSINKEKIK; YLTKNIFLSYK; SVNNIEVYFNK; KLVSRDQKKHK; LLGIIFSNENK; SLIKALDELQK; NINNNYEIISK; KLENLSFKIIR; FLNNQKMTKER; LYFLNNQKMTK; IIFSNENKVAR; WTFFDVFDLEK; TFFDVFDLEKK; ELGIGENPSFK |
| | HLA-A1101 | GLYFLNNQK; GIIFSNENK; KVARILEEK; KIFSINKEK; GIGENPSFK; KQNIPVDNK; KIEVKWSNK; NLSFKIIRK; TLFQEKNTK; LLTEIFVGK; TKNIFLSYK; FLNNQKMTK; KADGLEIDK; LTKNIFLSY; KLVSRDQKK; KIDDYNLQY; PLNIIAEFK; KNKGVFMTK; ALDELQKNK; TKLENLSFK; NNIEVYFNK; KPKIFSINK; TELEGTLTK; NLQYKIEVK; KDWILTYNK; KGVFMTKPK; LTKNIFLSYK; TTLFQEKNTK; KIDDYNLQYK; TFFDVFDLEK; KLLTEIFVGK; GSDENVYLTK; NTKLENLSFK; KALDELQKNK; KQNIPVDNKK; FSDTTLFQEK; LIKALDELQK; |

Fig. 32 continued

| | | |
|---|---|---|
| | | VNNIEVYFNK; RPLNIIAEFK; LVSRDQKKHK; ETELEGTLTK; SFKIIRKLNK; STFLLGIIFS; NTFSDTTLFQ; SFKLFDNNNK; INNNYEIISK; SVNNIEVYFNK; MTKPKIFSINK; WTFFDVFDLEK; LSFKIIRKLNK; SLIKALDELQK; KIFSINKEKIK; TFSDTTLFQEK; YLTKNIFLSYK; TFFDVFDLEKK; NINNNYEIISK; PSFKLFDNNNK; LLGIIFSNENK; IIFSNENKVAR; KADGLEIDKSK; KLVSRDQKKHK; STFLLGIIFSN; LYFLNNQKMTK; KGSDENVYLTK; KLENLSFKIIR; SKIDDYNLQYK; KNTKLENLSFK; DTTLFQEKNTK |
| | HLA-A2402 | YYTTSKWTF; VYLTKNIFL; VFMTKPKIF; EYYYTTSKW; VVLTSTFLL; FFDFDFNLI; YYYTTSKWT; LYFLNNQKM; YTTSKWTFF; TYNKQNIPV; YYYTTSKWTF; SYKGNSYNTF; YYTTSKWTFF; KWSNKSVNNI; SYNTFSDTTL; KFFDFDFNLI; VYLTKNIFLS; KWTFFDVFDL; IVVLTSTFLL; TSKWTFFDVF; EYYYTTSKWTF; YYYTTSKWTFF; SYNTFSDTTLF; VFMTKPKIFSI; DWILTYNKQNI; VYLTKNIFLSY; ILIIVVLTSTF; IFSNENKVARI; TTSKWTFFDVF |
| | HLA-A2902 | KIDDYNLQY; SVNNIEVYF; EIISKDGLY; FLSYKGNSY; YYTTSKWTF; KFFDFDFNL; LTKNIFLSY; IISKDGLYF; STFLLGIIF; YLTKNIFLSY; YYYTTSKWTF; IFLSYKGNSY; YYTTSKWTFF; KLGKDWILTY; SKIDDYNLQY; EIISKDGLYF; YIKGSDENVY; ILIKKDKDEY; VYLTKNIFLSY; YYYTTSKWTFF; AYIKGSDENVY; ILIKKDKDEYY; SYNTFSDTTLF; EYYYTTSKWTF; NYEIISKDGLY; LIKKDKDEYYY; KSKIDDYNLQY; NIFLSYKGNSY; ILIIVVLTSTF; ILEEKFFDFDF |
| | HLA-A6801 | FSNENKVAR; NNIEVYFNK; NTFSDTTLF; TLFQEKNTK; GIIFSNENK; KVARILEEK; KIFSINKEK; EVYFNKNEE; ENLSFKIIR; GLYFLNNQK; DEYYYTTSK; LLTEIFVGK; TKNIFLSYK; FLNNQKMTK; NLSFKIIRK; TTSKWTFFD; PLNIIAEFK; FSINKEKIK; NNNYEIISK; NLQYKIEVK; EIISKDGLY; LTKNIFLSY; YTTSKWTFF; EGTLTKLGK; SVNNIEVYF; QNIPVDNKK; NNQKMTKER; FFDVFDLEK; NTKLENLSFK; TFFDVFDLEK; LTKNIFLSYK; TTLFQEKNTK; NTFSDTTLFQ; ETELEGTLTK; ELQKNKLVSR; WTFFDVFDLE; LIKALDELQK; FDFDFNLISK; ENLSFKIIRK; EVYFNKNEEN; LGIGENPSFK; IFSNENKVAR; LVSRDQKKHK; FSDTTLFQEK; LGIIFSNENK; SFKLFDNNNK; RPLNIIAEFK; YLTKNIFLSY; YTTSKWTFFD; NKVARILEEK; NKNKGVFMTK; YKIEVKWSNK; WTFFDVFDLEK; SVNNIEVYFNK; DTTLFQEKNTK; IIFSNENKVAR; MTKPKIFSINK; YLTKNIFLSYK; TFFDVFDLEKK; NTFSDTTLFQE; LSFKIIRKLNK; FLNNQKMTKER; NINNNYEIISK; LYFLNNQKMTK; TFSDTTLFQEK; FVGKSGEGDSR; SLIKALDELQK; ELGIGENPSFK; ELEGTLTKLGK; ENKVARILEEK; KIFSINKEKIK; TTSKWTFFDVF; LLGIIFSNENK; PSFKLFDNNNK; ERPLNIIAEFK; NVYLTKNIFLS; NIFLSYKGNSY; EFKADGLEIDK; DYNLQYKIEVK; STFLLGIIFSN |
| | HLA-B0702 | RPLNIIAEF; KVNSLIKAL; IVVLTSTFL; IVVLTSTFLL; IPVDNKKVNSL; RPLNIIAEFKA |
| | HLA-B0801 | RDQKKHKEL; KIKILIIVVL; NKKVNSLIKAL; YIKGSDENVYL |
| | HLA-B1501 | FLSYKGNSY; LTKNIFLSY; LGKDWILTY; KSVNNIEVY; STFLLGIIF; IIVVLTSTF; LGIGENPSF; IISKDGLYF; NTKLENLSF; SVNNIEVYF; KQINKNGV; KLFDNNNKL; KVNSLIKAL; KQINKNKGVF; YIKGSDENVY; YLTKNIFLSY; LIIVVLTSTF; KLGKDWILTY; KSVNNIEVYF; ILIKKDKDEY; TSKWTFFDVF; KLFDNNNKLL; KVARILEEKF; IFLSYKGNSY; GVFMTKPKIF; NQKMTKERPL; KQINKNKGVF; YIKGSDENVY; YLTKNIFLSY; LIIVVLTSTF; KLGKDWILTY; KSVNNIEVYF; ILIKKDKDEY; TSKWTFFDVF; KLFDNNNKLL; KVARILEEKF; IFLSYKGNSY; GVFMTKPKIF; NQKMTKERPL |
| | HLA-B2705 | KQINKNKGVF; ARILEEKFFDF; KQINKNKGVFM |

Fig. 32 continued

| | HLA-B3501 | RPLNIIAEF; IIVVLTSTF; SKWTFFDVF; FLSYKGNSY; NVYLTKNIF; NTFSDTTLF; SVNNIEVYF; KSVNNIEVY; YKGNSYNTF; LTKNIFLSY; LGKDWILTY; STFLLGIIF; YYTTSKWTF; IKGSDENVY; IVVLTSTFL; NENNINNNY; YIKGSDENVY; TSKWTFFDVF; LIIVVLTSTF; NKSVNNIEVY; YYYTTSKWTF; YLTKNIFLSY; IFLSYKGNSY; YNTFSDTTLF; SGEGDSRLAY; TSTFLLGIIF; IVVLTSTFLL; IPVDNKKVNSL; TTSKWTFFDVF; LTSTFLLGIIF; LSYKGNSYNTF; NIFLSYKGNSY; KSGEGDSRLAY; TKLGKDWILTY; ILIIVVLTSTF; FSNENKVARIL; NSYNTFSDTTL |
|---|---|---|
| | HLA-B4403 | EENDKDILI; EEKFFDFDF; AEFKADGLE; GEGDSRLAY; GENPSFKLF; NENNINNNY; NENKVARIL; KENENNINN; KERPLNIIA; YEIISKDGL; AEFKADGLEI; YEIISKDGLY; EENDKDILIK; GEGDSRLAYI; YEIISKDGLYF; EEKFFDFDFNL; KENENNINNNY; AEFKADGLEID; KERPLNIIAEF; KELGIGENPSF; NENNINNNYEI; EENDKDILIKK |
| | HLA-B5101 | IPVDNKKVNSL |
| | HLA-B5701 | LTKNIFLSY; KSVNNIEVY; KSKIDDYNLQY; KSGEGDSRLAY; LSYKGNSYNTF |
| AAC67038.1\| predicted coding region BB0689 [Borrelia burgdorferi B31]; SEQ ID NO:31, SEQ ID NO: 66735-66934 | HLA-A0101 | TTDNIDIFV; TLEKVAKEY; NTDTDKIGGY; TTDNIDIFVV; TTPMQRIHKY; DTKEDMKILY; GTTPMQRIHKY; TTDNIDIFVVL |
| | HLA-A0201 | ILYSEIAEL; LIIIFTLFL; TTDNIDIFV; KLNLNHLEI; KKLIIIFTL; FLSQACNLS; TLFGTTPMQ; KLIIIFTLFL; FLSQACNLST; KILYSEIAEL; KTTDNIDIFV; TTDNIDIFVV; ALINTDTDKI; TLFLSQACNL; IIFTLFLSQA; KVAKEYAIKL; ILASGIELNRV; FLSQACNLSTM; TLFGTTPMQRI; KTTDNIDIFVV; KLIIIFTLFLS; FTLFLSQACNL; RIHKYDQSFNL; KKLIIIFTLFL; WLNSPSHKEAL; NLTREILASGI; NLNHLEIDDTL; HLEIDDTLEKV; IIFTLFLSQA |
| | HLA-A0301 | VLFGKRKYK; KVAKEYAIK; STMHKIDTK; ACNLSTMHK; TTPMQRIHK; IIFTLFLSQ; DIFVVLFGK; VVLFGKRKYK; QACNLSTMHK; TLFGTTPMQR; GTTPMQRIHK; IDIFVVLFGK; ILYSEIAELR; LSTMHKIDTK; IFVVLFGKRK; IIIFTLFLSQ; ILASGIELNR; LYSEIAELRK; NAWLNSPSHK; ILYSEIAELRK; HTLFGTTPMQR; SQACNLSTMHK; KILYSEIAELR; VVNAWLNSPSH; FVVLFGKRKYK |
| | HLA-A1101 | STMHKIDTK; TTPMQRIHK; DIFVVLFGK; KVAKEYAIK; VLFGKRKYK; ACNLSTMHK; ALINTDTDK; YSEIAELRK; FVVLFGKRK; KIDTKEDMK; AWLNSPSHK; IIFTLFLSQ; LASGIELNR; QACNLSTMHK; TLFGTTPMQR; GTTPMQRIHK; VVLFGKRKYK; LSTMHKIDTK; ILYSEIAELR; NAWLNSPSHK; TTPMQRIHKY; IDIFVVLFGK; ILASGIELNR; HLEIDDTLEK; IIIFTLFLSQ; LYSEIAELRK; DIFVVLFGKR; YSEIAELRKK; SQACNLSTMHK; ILYSEIAELRK; HTLFGTTPMQR; NIDIFVVLFGK; KILYSEIAELR; FVVLFGKRKYK; DIFVVLFGKRK; VVNAWLNSPSH; NLSTMHKIDTK; EILASGIELNR; VNAWLNSPSHK |
| | HLA-A2402 | KLIIIFTLF; KYDQSFNLT; LFGTTPMQRI; KKLIIIFTLF; GYRLKTTDNI; |
| | HLA-A2902 | VVLFGKRKY; KLIIIFTLF; FVVLFGKRKY; TTPMQRIHKY; IFVVLFGKRKY; GTTPMQRIHKY |
| | HLA-A6801 | DIFVVLFGK; LASGIELNR; TTPMQRIHK; LYSEIAELR; YAIKLGENR; DTDKIGGYR; STMHKIDTK; FVVLFGKRK; YSEIAELRK; TLFGTTPMQ; IFVVLFGKR; YDQSFNLTR; VLFGKRKYK; KVAKEYAIK; TLFGTTPMQR; DIFVVLFGKR; ILYSEIAELR; QACNLSTMHK; ILASGIELNR; NAWLNSPSHK; EYAIKLGENR; EALINTDTDK; GTTPMQRIHK; TTPMQRIHKY; LSTMHKIDTK; IDIFVVLFGK; LYSEIAELRK; DTKEDMKILY; HTLFGTTPMQ; HLEIDDTLEK; TDTDKIGGYR; YSEIAELRKK; VVLFGKRKYK; HTLFGTTPMQR; EILASGIELNR; FVVLFGKRKYK; DIFVVLFGKRK; NTDTDKIGGYR; HKYDQSFNLTR; NIDIFVVLFGK; ILYSEIAELRK; KILYSEIAELR; DTDKIGGYRLK; NLSTMHKIDTK; SQACNLSTMHK; IDIFVVLFGKR; EIDDTLEKVAK; |

Fig. 32 continued

| | | |
|---|---|---|
| | | LYSEIAELRKK; VNAWLNSPSHK |
| | HLA-B0702 | SPSHKEALI; TPMQRIHKY; |
| | HLA-B0801 | RIHKYDQSF; ELRKKLNLNHL |
| | HLA-B1501 | RIHKYDQSF; SQACNLSTM; KLIIFTLF; ILYSEIAEL; FVVLFGKRKY; SQACNLSTMH; LSQACNLSTM; MQRIHKYDQSF; RLKTTDNIDIF; VVNAWLNSPSH; FLSQACNLSTM; WLNSPSHKEAL |
| | HLA-B2705 | YRLKTTDNI; QRIHKYDQSF; YRLKTTDNIDI |
| | HLA-B3501 | TPMQRIHKY; HTLFGTTPM; NAWLNSPSH; QACNLSTMH; FVVLFGKRKY; THTLFGTTPM; FLSQACNLSTM; ITHTLFGTTPM; TTDNIDIFVVL; WLNSPSHKEAL |
| | HLA-B4403 | AELRKKLNL; REILASGIE; KEDMKILYS; REILASGIEL; SEIAELRKKL; GENRTITHTLF; AELRKKLNLNH; REILASGIELN |
| | HLA-B5101 | |
| | HLA-B5701 | ELNRVVNAW; KTTDNIDIF; |
| NP_045709.1 \| lipoprotein BBA36[Borrelia burgdorferi B31]; SEQ ID NO:32, SEQ ID NO: 66935-67186 | HLA-A0101 | VVDAFGADPY; |
| | HLA-A0201 | MMQRISILL; SILLMLLAV; ALSLFFQKV; KLESLKVFL; RISILLMLL; LMLLAVFSC; LLMLLAVFS; KCNEEIFKV; KQFGDVKSL; MMQRISILLM; KVFLKDAMSV; ALSLFFQKVV; SLTPEEAEKL; SSFDNISSIV; LLMLLAVFSC; SLFFQKVVDA; RISILLMLLA; NISSIVSKAV; MLLAVFSCKQ; ISILLMLLAV; MMQRISILLML; FISSFDNISSI; SLTEIDSGNGI; RISILLMLLAV; VLTESESNNEL |
| | HLA-A0301 | MLLAVFSCK; KEFFDWLSK; EALSLFFQK; VSKAVDASK; VCYKIKNSK; LMLLAVFSCK; KLESLKVFLK; YVCYKIKNSK; SLGFKEYVCY; SVNGREEALK; ISLTPEEAEK; IVSKAVDASK; WLSKDVNRQK; PTEQQSLGFK; IPLVVSDVVK; MLLAVFSCKQ; VSKAVDASKK; LKAEYEKSYK; LLMLLAVFSCK; SLGFKEYVCYK; IVSKAVDASKK; ALKAEYEKSYK; SIVSKAVDASK; MSVNGREEALK; VVDAFGADPYK; KGEALSLFFQK; GIPLVVSDVVK |
| | HLA-A1101 | MLLAVFSCK; EALSLFFQK; VSKAVDASK; KEFFDWLSK; KAEYEKSYK; DVVKDLIPK; AFGADPYKK; TEQQSLGFK; SLTPEEAEK; DAFGADPYK; LSKDVNRQK; SNNELKNLK; LESLKVFLK; AVDASKKRR; EALKAEYEK; GFKEYVCYK; SVNGREEALK; LMLLAVFSCK; KLESLKVFLK; IVSKAVDASK; YVCYKIKNSK; ISLTPEEAEK; VSKAVDASKK; GEALSLFFQK; PTEQQSLGFK; FSCKQFGDVK; ESNNELKNLK; DAFGADPYKK; VVDAFGADPY; PVKCNEEIFK; LGFKEYVCYK; LLMLLAVFSCK; SIVSKAVDASK; VVDAFGADPYK; SLGFKEYVCYK; MSVNGREEALK; IVSKAVDASKK; VSDVVKDLIPK; LTESESNNELK; KGEALSLFFQK; ALKAEYEKSYK; SYKEFFDWLSK; KVVDAFGADPY; SFDNISSIVSK; GIPLVVSDVVK; EISLTPEEAEK; VFSCKQFGDVK; RPTEQQSLGFK |
| | HLA-A2402 | FFQKVVDAF; EYEKSYKEF; SYKEFFDWL; EFISSFDNI; MMQRISILL; EYEKSYKEFF; LFFQKVVDAF; ISILLMLLAVF |
| | HLA-A2902 | LGFKEYVCY; SLGFKEYVCY; VVDAFGADPY; EQQSLGFKEY; KVVDAFGADPY |
| | HLA-A6801 | DAFGADPYK; EALSLFFQK; ESESNNELK; EAEKLESLK; EALKAEYEK; MLLAVFSCK; DNISSIVSK; DVVKDLIPK; VSKAVDASK; EEIFKVIKK; LSKDVNRQK; GFKEYVCYK; KAVDASKKR; SLTPEEAEK; KAEYEKSYK; DAFGADPYKK; YVCYKIKNSK; ESNNELKNLK; SVNGREEALK; IVSKAVDASK; FSCKQFGDVK; EEALKAEYEK; LGFKEYVCYK; VSKAVDASKK; LMLLAVFSCK; EEAEKLESLK; KAVDASKKRR; TESESNNELK; WLSKDVNRQK; ISLTPEEAEK; MSVNGREEALK; EISLTPEEAEK; LTESESNNELK; EYVCYKIKNSK; IVSKAVDASKK; FLKDAMSVNGR; SIVSKAVDASK; LLMLLAVFSCK; SLGFKEYVCYK; VSKAVDASKKR; VVDAFGADPYK; SYKEFFDWLSK; FFDWLSKDVNR |
| | HLA-B0702 | KPVKCNEEI; IPLVVSDVV; SVNGREEAL; RPTEQQSLGF; |

Fig. 32 continued

| | | |
|---|---|---|
| | | KPVKCNEEIF; KIKNSKGEAL; IPKEISLTPE; TPEEAEKLESL; KKRRPTEQQSL |
| | HLA-B0801 | IFKVIKKVL; FFQKVVDAF; MMQRISILL; KIKNSKGEAL; YKIKNSKGEAL; MMQRISILLML |
| | HLA-B1501 | RQKEFISSF; QQSLGFKEY; KQFGDVKSL; MQRISILLM; ILLMLLAVF; MMQRISILL; FFQKVVDAF; LGFKEYVCY; ALKAEYEKSY; MQRISILLML; EQQSLGFKEY; MMQRISILLM; LLAVFSCKQF; VVDAFGADPY; LFFQKVVDAF; NSKGEALSLF; KVVDAFGADPY; ISILLMLLAVF; LSKDVNRQKEF; MQRISILLMLL; MLLAVFSCKQF; SLFFQKVVDAF; AMSVNGREEAL; MMQRISILLML; QSLGFKEYVCY; NSKGEALSLFF; KQFGDVKSLTE; VNRQKEFISSF |
| | HLA-B2705 | QRISILLML; RQKEFISSF; RRPTEQQSL; KQFGDVKSL; QRISILLMLL; NRQKEFISSF; GREEALKAEY; KRRPTEQQSL; RRPTEQQSLGF; QRISILLMLLA |
| | HLA-B3501 | FFQKVVDAF; VDAFGADPY; LAVFSCKQF; LKVFLKDAM; ILLMLLAVF; IPLVVSDVV; QQSLGFKEY; RPTEQQSLGF; KPVKCNEEIF; VVDAFGADPY; LFFQKVVDAF; MSVNGREEAL; SILLMLLAVF; MMQRISILLM; TPEEAEKLES; KVVDAFGADPY; EALKAEYEKSY; TPEEAEKLESL; EAEKLESLKVF; ISILLMLLAVF; ESLKVFLKDAM; SLFFQKVVDAF |
| | HLA-B4403 | TEIDSGNGI; AEKLESLKV; KEISLTPEE; AEKLESLKVF; AEYEKSYKEF; KEFISSFDNI; KEISLTPEEA; EEIFKVIKKV; TEIDSGNGIPL; KEFISSFDNIS; AEYEKSYKEFF; AEKLESLKVFL; EEIFKVIKKVL; KEFFDWLSKDV |
| | HLA-B5101 | IPLVVSDVV; IPKEISLTP; IPLVVSDVVK; DPYKKDNDESV; IPLVVSDVVKD |
| | HLA-B5701 | KSYKEFFDW; |
| AAT93789.1\| lipoprotein BBA36 (homolog 67%)[Borrelia garinii PBi]; SEQ ID NO:33, SEQ ID NO: 67187-67422 | HLA-A0101 | VADAFGTQEY; FTESENNNEL; ATDLEDDNSF; |
| | HLA-A0201 | SILSILLLL; KSLGFNEYV; ILSILLLLL; SLTEVATDL; RISILSILL; ILLLLLLFS; LLLLLLFSC; RLEALKTFL; KQYGDVKSL; KCNEEIFKV; LTSEEFERL; SILSILLLLL; ILSILLLLLL; VLTSEEFERL; KTFLKDAMGV; RISILSILLL; SLFFQKVADA; SILSILLLLLL; FVSFFNNICGI; LLFSCKQYGDV; RISILSILLLL |
| | HLA-A0301 | LLLLLFSCK; KEFFDWLSK; ITKAVDASK; LEALKTFLK; RLEALKTFLK; LLLLLLFSCK; LLLLFSCKQY; NSYNLNSNNK; IITKAVDASK; ADAFGTQEYK; SLGFNEYVCY; ITKAVDASKK; GVNGREGDTK; SFASGSVESK; WLSKDVNRQK; TKAEYEKSYK; ILLLLLLFSCK; NSFASGSVESK; IITKAVDASKK; GIITKAVDASK; KVADAFGTQEY; FFNNICGIITK; ASKKRYNSNPK; RISILSILLLL |
| | HLA-A1101 | LLLLLFSCK; ITKAVDASK; KEFFDWLSK; SYNLNSNNK; KAEYEKSYK; FASGSVESK; DAFGTQEYK; ESKDQIIEK; LSKDVNRQK; LEALKTFLK; VLTSEEFER; NSYNLNSNNK; RLEALKTFLK; LLLLLLFSCK; ITKAVDASKK; GVNGREGDTK; IITKAVDASK; SFASGSVESK; FSCKQYGDVK; SILLLLLFS; ILLLLLLFSCK; NSFASGSVESK; SVESKDQIIEK; GIITKAVDASK; ASKKRYNSNPK; VADAFGTQEYK; TGDDLSLFFQK; KVADAFGTQEY; IITKAVDASKK; SYKEFFDWLSK; KSLGFNEYVCY; SENNNELANLK; RTGDDLSLFFQ; DTKAEYEKSYK; GFNEYVCYDIK |
| | HLA-A2402 | EYEKSYKEF; RYNSNPKSL; FFQKVADAF; SYKEFFDWL; EFVSFFNNI; IFKVIKRVF; SYNLNSNNK; SILLLLLLF; EYEKSYKEFF; LSILLLLLLF; LFFQKVADAF; RYNSNPKSLGF; EFERLEALKTF; ILSILLLLLLF |
| | HLA-A2902 | LGFNEYVCY; SLGFNEYVCY; VADAFGTQEY; LLLLFSCKQY; KVADAFGTQEY; ELANLKNLNSY; KSLGFNEYVCY; ILSILLLLLLF |
| | HLA-A6801 | DAFGTQEYK; YVCYDIKTR; ITKAVDASK; FASGSVESK; ESKDQIIEK; VLTSEEFER; EEIFKVIKR; NNNELANLK; EFERLEALK; LSKDVNRQK; |

Fig. 32 continued

| | | |
|---|---|---|
| | | SYNLNSNNK; EKCNEEIFK; NNICGIITK; KAVDASKKR; LEALKTFLK; DDLSLFFQK; TKAVDASKK; KAEYEKSYK; NSYNLNSNNK; ITKAVDASKK; EYVCYDIKTR; IITKAVDASK; ENNNELANLK; EEFERLEALK; FSCKQYGDVK; SFASGSVESK; TKAEYEKSYK; PVLTSEEFER; WLSKDVNRQK; TKAVDASKKR; RLEALKTFLK; FNEYVCYDIK; NSFASGSVESK; DTKAEYEKSYK; ITKAVDASKKR; DAFGTQEYKNK; IITKAVDASKK; FLKDAMGVNGR; FFNNICGIITK; SVESKDQIIEK; ELANLKNLNSY; GPVLTSEEFER; GIITKAVDASK; VADAFGTQEYK; LNSYNLNSNNK; SYKEFFDWLSK; MGVNGREGDTK; FFDWLSKDVNR; NEYVCYDIKTR |
| | HLA-B0702 | GPVLTSEEF; KPEKCNEEI; KPEKCNEEIF; KTRTGDDLSL; KKRYNSNPKSL |
| | HLA-B0801 | IFKVIKRVF; FFQKVADAF; |
| | HLA-B1501 | RQKEFVSFF; KQYGDVKSL; LLLFSCKQY; LGFNEYVCY; QIIEKGPVL; FFQKVADAF; IFKVIKRVF; NSNPKSLGF; LANLKNLNSY; LLLLFSCKQY; LFFQKVADAF; LSILLLLLF; YNSNPKSLGF; RTGDDLSLFF; SLGFNEYVCY; VADAFGTQEY; KVADAFGTQEY; LSKDVNRQKEF; KSLGFNEYVCY; SLFFQKVADAF; ELANLKNLNSY; ILSILLLLLF; LLLLLFSCKQY; KTRTGDDLSLF; KQYGDVKSLTE; VATDLEDDNSF |
| | HLA-B2705 | KRISILSIL; NRQKEFVSF; KRYNSNPKS; KQYGDVKSL; RQKEFVSFF; ERLEALKTF; TRTGDDLSL; KRYNSNPKSL; KRISILSILL; GREGDTKAEY; NRQKEFVSFF; KRISILSILLL; ERLEALKTFLK; TRTGDDLSLFF |
| | HLA-B3501 | GPVLTSEEF; FFQKVADAF; TDLEDDNSF; ADAFGTQEY; NPKSLGFNEY; VADAFGTQEY; LANLKNLNSY; LFFQKVADAF; KPEKCNEEIF; KAVDASKKRY; FTESENNNEL; KVADAFGTQEY; EALKTFLKDAM; VATDLEDDNSF; ELANLKNLNSY; SLFFQKVADAF; DVNRQKEFVSF; EFERLEALKTF; NGREGDTKAEY |
| | HLA-B4403 | EEFERLEAL; SENNNELAN; REGDTKAEY; TEVATDLED; AEYEKSYKEF; SENNNELANL; KEFVSFFNNI; EEFERLEALK; EEIFKVIKRV; EEIFKVIKRVF; EEFERLEALKT; AEYEKSYKEFF; KEFFDWLSKDV; SENNNELANLK |
| | HLA-B5101 | |
| | HLA-B5701 | KSYKEFFDW; KSLGFNEYVCY |
| NP_045739.1 \| BBA66 antigen, P35, putative [Borrelia burgdorferi B31]; SEQ ID NO:34, SEQ ID NO: 67423-67916 | HLA-A0101 | KIEIFNQDY; LSDSKSLAEY; TIDANLNEDY; SSAKVYDRSY; CTIDANLNEDY; LLDVISSAKVY; NSGLPTFALNY; ISSAKVYDRSY; SLSDSKSLAEY; LSDSKSLAEYI |
| | HLA-A0201 | FLFSCTIDA; KMKDSAFEL; LMDFDQYKI; QLQSLSFSA; KLLGLFLFS; SVLEAYISI; QLNSNTPEA; ELLDVISSA; KINSFDFTM; GLFLFSCTI; VLEAYISIM; SLSDSKSLA; NMQNARQSV; FALNYSFSQ; KLQTLKNEL; NSFDFTMKL; TQISFELAL; ALMDFDQYK; SLTKQRIPI; MISGLGTQI; LIQLKLLGL; ALMDFDQYKI; LLDVISSAKV; GLGTQISFEL; KMKDSAFELL; LMISGLGTQI; KLLGLFLFSC; KLQTLKNELI; FKMKDSAFEL; RQADGLIANA; SVLEAYISIM; NLNEDYKNKV; IQLKLLGLFL; ALNYSFSQPT; LLGLFLFSCT; RIPIQAVTTV; LIRELMISGL; FLFSCTIDANL; ALYNENQNHSL; KVYDRSYAPQL; SLIRELMISGL; KINSFDFTMKL; SLAEYIKKRYL; KLLGLFLFSCT; ELLDVISSAKV; SLSFSADLSNL; LLGLFLFSCTI; QLQSLSFSADL; GLFLFSCTIDA; FALNYSFSQPT; LIANASSNSSL; ALEEINKKIEI; GLGTQISFELA; YALMDFDQYKI; FKMKDSAFELL; MQNARQSVLEA; QISFELALEEI; RQSVLEAYISI; KAADDQETTSA; SIMEALYNENQ |
| | HLA-A0301 | KIKPLIQLK; KSLAEYIKK; KTVAAAPNK; LLDVISSAK; QTTTSSGSK; KTQNNFGFR; FTMKLKELK; KLLGLFLFS; ALMDFDQYK; RSYAPQLNS; KLNQILDKR; AARAASLTK; LIRAISEEK; GLPTFALNY; ETYDQFKMK; RAASLTKQR; SLAEYIKKR; ALYNENQNH; ELLDVISSAK; |

Fig. 32 continued

| | | |
|---|---|---|
| | | KINSFDFTMK; TAARAASLTK; FSADLSNLPK; NSFDFTMKLK; VQTTTSSGSK; SSGSKLQTLK; TMKLKELKSK; KSKLNQILDK; ELIRAISEEK; SSNSSLSDSK; KLNQILDKRK; KVYDRSYAPQ; SKSLAEYIKK; SLAEYIKKRY; SADTNSNAAK; KNKVKGILNK; ELKKQSQAAK; MKIKPLIQLK; AVTTVPGNTR; TTAARAASLTK; TSSGSKLQTLK; ALNYSFSQPTR; AVQTTTSSGSK; SQNQPQTTPNK; FTMKLKELKSK; ASSNSSLSDSK; TSADTNSNAAK; LIRAISEEKNK; AAKTVAAAPNK; SLSDSKSLAEY; SFSADLSNLPK; EIFNQDYLNAK; KLQTLKNELIR; KFYALMDFDQY; KSLAEYIKKRY; LSNLPKTTAAR |
| | HLA-A1101 | KTVAAAPNK; ALMDFDQYK; KSLAEYIKK; KTQNNFGFR; SADLSNLPK; QTTTSSGSK; FTMKLKELK; KIKPLIQLK; AARAASLTK; ETYDQFKMK; ISSAKVYDR; RAISEEKNK; SFDFTMKLK; SGSKLQTLK; LLDVISSAK; LIRAISEEK; LALEEINKK; SNSSLSDSK; NQPQTTPNK; RAASLTKQR; VTTVPGNTR; QTLKNELIR; SIMEALYNE; KLNQILDKR; INSFDFTMK; KVYDRSYAP; GLPTFALNY; SSNSSLSDSK; KINSFDFTMK; NSFDFTMKLK; TAARAASLTK; SSGSKLQTLK; FSADLSNLPK; YALMDFDQYK; SADTNSNAAK; KSKLNQILDK; VQTTTSSGSK; KLNQILDKRK; AVTTVPGNTR; KVYDRSYAPQ; TMKLKELKSK; ELLDVISSAK; KSLAEYIKKR; VISSAKVYDR; IFNQDYLNAK; ELIRAISEEK; MKIKPLIQLK; KTQNNFGFRE; TTAARAASLTK; AVQTTTSSGSK; TSSGSKLQTLK; ASSNSSLSDSK; TSADTNSNAAK; SQNQPQTTPNK; SFSADLSNLPK; TIDANLNEDYK; AAKTVAAAPNK; FTMKLKELKSK; ALNYSFSQPTR; EIFNQDYLNAK; SLSDSKSLAEY; TQNNFGFRETY; KFYALMDFDQY; AKINSFDFTMK; LSNLPKTTAAR; SFELALEEINK; KSLAEYIKKRY; LIRAISEEKNK; KLQTLKNELIR; SIMEALYNENQ; NSGLPTFALNY; INSFDFTMKLK |
| | HLA-A2402 | IQLKLLGLF; DYKNKVKGI; DYLNAKINSF; VYDRSYAPQL; QYKIEQFGSI; EWSRQADGLI; LYNENQNHSL; FYALMDFDQY; DYKNKVKGIL; RYLDNMQNAR; LYNENQNHSLI; IQLKLLGLFLF; EYIKKRYLDNM; NFGFRETYDQF; IFNQDYLNAKI; FYALMDFDQYK; SYAPQLNSNTP |
| | HLA-A2902 | GLPTFALNY; PTFALNYSF; YALMDFDQY; DVISSAKVY; KIEIFNQDY; IDANLNEDY; FYALMDFDQY; QFGSIMEALY; KFYALMDFDQY; CTIDANLNEDY; NSGLPTFALNY; TQNNFGFRETY; YLNAKINSFDF |
| | HLA-A6801 | ETYDQFKMK; FTMKLKELK; NTPEAENER; NYSFSQPTR; DANLNEDYK; QTTTSSGSK; KTVAAAPNK; KTQNNFGFR; RAASLTKQR; ISSAKVYDR; SLAEYIKKR; QTLKNELIR; LIRAISEEK; ELALEEINK; NLPKTTAAR; VTTVPGNTR; YLDNMQNAR; NIPIADNDK; ALMDFDQYK; DVISSAKVY; NNFGFRETY; KLNQILDKR; INSFDFTMK; LLDVISSAK; NSFDFTMKL; ENQNHSLIR; TTSSGSKLQ; QTNSSSAVQ; EIFNQDYLN; LALEEINKK; NSFDFTMKLK; ELIRAISEEK; TAARAASLTK; FSADLSNLPK; ELLDVISSAK; YALMDFDQYK; DSKSLAEYIK; SSNSSLSDSK; LNYSFSQPTR; ELALEEINKK; NKTQNNFGFR; VISSAKVYDR; KINSFDFTMK; AVTTVPGNTR; TTAARAASLT; ELKKQSQAAK; DFTMKLKELK; MKIKPLIQLK; SNTPEAENER; TTTSSGSKLQ; FYALMDFDQY; SSGSKLQTLK; NENQNHSLIR; SADTNSNAAK; ETYDQFKMKD; TTAARAASLTK; DVISSAKVYDR; EIFNQDYLNAK; TSADTNSNAAK; TSSGSKLQTLK; NSNTPEAENER; FYALMDFDQYK; FTMKLKELKSK; LSNLPKTTAAR; QAVTTVPGNTR; NTPEAENERNK; TIDANLNEDYK; EQFGSIMEALY; DSKSLAEYIKK; FGFRETYDQFK; ALNYSFSQPTR; CTIDANLNEDY; DANLNEDYKNK; FDFTMKLKELK; QILDKRKEWSR; INSFDFTMKLK; AAKTVAAAPNK; NSFDFTMKLKE; KSKLNQILDKR; SFSADLSNLPK; AVQTTTSSGSK; LIRAISEEKNK; ASSNSSLSDSK; AARAASLTKQR; TTVPGNTRTFN |
| | HLA-B0702 | SPQLQSLSF; APSPQLQSL; IPIQAVTTV; KPLIQLKLL; APQLNSNTP; KPEKCNEEIF; KTRTGDDLSL; APSPQLQSLSF; APQLNSNTPEA; |

Fig. 32 continued

| | | |
|---|---|---|
| | | SPQLQSLSFSA; KPLIQLKLLGL; IPIADNDKVAA; IPIQAVTTVPG; AASLTKQRIPI; LPKTTAARAAS; LIANASSNSSL; TPEAENERNKF; KVYDRSYAPQL; APNKGSQNQPQ |
| | HLA-B0801 | QFKMKDSAF; ELKKQSQAA; NERNKFYAL; QLKLLGLFL; KLKELKSKL; YIKKRYLDNM; ELKSKLNQIL; YDQFKMKDSAF |
| | HLA-B1501 | YLNAKINSF; MQNARQSVL; QQAAPSPQL; KQRIPIQAV; KMKDSAFEL; TQISFELAL; IQLKLLGLF; SAKVYDRSY; SQAAKTVAA; QQTNSSSAV; QFKMKDSAF; RQQTNSSSA; RQADGLIAN; TVPGNTRTF; PTFALNYSF; KQSQAAKTV; RQSVLEAYI; SGLGTQISF; DVISSAKVY; TTAARAASL; RQQTNSSSAV; EQFGSIMEAL; QLKLLGLFLF; ISGLGTQISF; SQAAKTVAAA; LQSLSFSADL; TTVPGNTRTF; SSAKVYDRSY; NSRNSGLPTF; KQRIPIQAVT; SLAEYIKKRY; KMKDSAFELL; RQADGLIANA; DQFKMKDSAF; NARQSVLEAY; IANASSNSSL; NQQAAPSPQL; NMQNARQSVL; IQLKLLGLFL; NQNHSLIREL; QNNFGFRETY; RTFNSRNSGL; LMISGLGTQI; YLNAKINSFDF; TQNNFGFRETY; EQFGSIMEALY; MISGLGTQISF; ISSAKVYDRSY; SLSDSKSLAEY; IQLKLLGLFLF; RQADGLIANAS; VTTVPGNTRTF; RQSVLEAYISI; MQNARQSVLEA; ALYNENQNHSL; KQSQAAKTVAA; LLDVISSAKVY; KQRIPIQAVTT; RQQTNSSSAVQ; QNARQSVLEAY; VQTTTSSGSKL; GLPTFALNYSF; KSLAEYIKKRY; FNSRNSGLPTF; KVYDRSYAPQL |
| | HLA-B2705 | SRNSGLPTF; ERNKFYALM; KRKEWSRQA; KRYLDNMQN; ARQSVLEAY; KRYLDNMQNA; ARAASLTKQR; RQQTNSSSAV; KRYLDNMQNAR; QRIPIQAVTTV; ERNKFYALMDF; RQSVLEAYISI; SRNSGLPTFAL; FRETYDQFKMK |
| | HLA-B3501 | YALMDFDQY; SPQLQSLSF; DVISSAKVY; FGSIMEALY; IPIQAVTTV; EAENERNKF; APSPQLQSL; SAKVYDRSY; TVPGNTRTF; LAEYIKKRY; LPTFALNYS; SADTNSNAA; YLNAKINSF; KINSFDFTM; FALNYSFSQ; NAKINSFDF; LPTFALNYSF; NARQSVLEAY; TTVPGNTRTF; FYALMDFDQY; EAENERNKFY; SVLEAYISIM; YKIEQFGSIM; LPKTTAARAA; IANASSNSSL; LSDSKSLAEY; IPIADNDKVA; QFGSIMEALY; LDVISSAKVY; NSRNSGLPTF; IPIQAVTTVP; APSPQLQSLSF; TPEAENERNKF; FALNYSFSQPT; NAKINSFDFTM; IPIADNDKVAA; IPIQAVTTVPG; MISGLGTQISF; LPKTTAARAAS; IADNDKVAAEL; EQFGSIMEALY; LLDVISSAKVY; QSVLEAYISIM; TQNNFGFRETY; QAAPSPQLQSL; SLSDSKSLAEY; QNARQSVLEAY; FNSRNSGLPTF |
| | HLA-B4403 | AENERNKFY; EEINKKIEI; NENQNHSLI; EEINKKIEIF; AENERNKFYA; EEKNKTQNNF; RELMISGLGT; AELKKQSQAA; EEIFKVIKRVF; EEFERLEALKT; AEYEKSYKEFF; KEFFDWLSKDV; SENNNELANLK |
| | HLA-B5101 | IPIQAVTTV; LPKTTAARA; LPTFALNYS; IPIADNDKV; APSPQLQSL; KPLIQLKLL; LPTFALNYSF; LPKTTAARAA; IPIQAVTTVP; LALEEINKKI; IPIQAVTTVPG; LPTFALNYSFS; KPLIQLKLLGL |
| | HLA-B5701 | KTHNHGFRETY; QTQPSFVVPVY |
| AAT93824.1\| BBA66 antigen, P35, putative [Borrelia garinii PBi]; SEQ ID NO:35, SEQ ID NO: 67917-68425 | HLA-A0101 | QSNNVLTNY; YLNTIINSY; KIESFNTQY; LAEKKEWLNY; TIDANLNKDY; EAESERNRLY; NSQSNNVLTNY; CTIDANLNKDY; QTQPSFVVPVY; KTHNHGFRETY |
| | HLA-A0201 | TLLDVISNI; KMKDSAFTL; QLSSNTPEA; TQPSFVVPV; ILAEKKEWL; KMQDARQSA; SLIISGLGI; SLESTLEEI; RQSALDLYL; WLNYADAII; SALDLYLNI; MMDFDQAKT; ALDLYLNIT; YADAIITNT; YAMMDFDQA; YTFSSSFSQ; ASAQAIQTV; YLNTIINSYT; LLDVISNISV; AMMDFDQAKT; KMKDSAFTLL; KMQDARQSAL; FTLLDVISNI; KIESFNTQYL; FKMKDSAFTL; QTQPSFVVPV; LIISGLGIQI; YTFKDKLKEL; LLNSSTDDQA; TLLDVISNIS; LIRSLIISGL; ISLESTLEEI; TLLDVISNISV; ALDLYLNITEI; SLIRSLIISGL; ILYQENQNHSL; |

Fig. 32 continued

| | | |
|---|---|---|
| | | RLYAMMDFDQA; QIASAQAIQTV; SLGQYIKNKYL; AMMDFDQAKTT; IISGLGIQISL; SLIISGLGIQI; SVFDRGSAPQL; YTFSSSFSQPT; IINSYTFKDKL; FKMKDSAFTLL; NLQGLNPANQV; YLNTIINSYTF; KTTEFGSIMNI; HQTQPSFVVPV; RQSALDLYLNI |
| | HLA-A0301 | KLNSILAEK; TIINSYTFK; ITNTSSNSK; GLQKNTQSK; KLKNNLLRR; SLGQYIKNK; YSGNSPLQK; LLRRIAEEK; STPNQSIIK; QSNNVLTNY; CTIDANLNK; ATKNKTNIK; KIESFNTQY; LQKNTQSKK; YIKNKYLDK; ETYDQFKMK; NLNKDYKNK; YLNTIINSY; ISNISVFDR; NIKVAGLQK; NTIINSYTFK; IITNTSSNSK; IINSYTFKDK; SINTGSNATK; ATNVQATPPK; KLNSILAEKK; VYSGNSPLQK; NLLRRIAEEK; GLQKNTQSKK; SKLNSILAEK; TSTPNQSIIK; NSYTFKDKLK; QSLGQYIKNK; TNIKVAGLQK; QYIKNKYLDK; QYLNTIINSY; SQSNNVLTNY; NTGSNATKNK; SLGQYIKNKY; AGLQKNTQSK; VISNISVFDR; KTNIKVAGLQK; PVYSGNSPLQK; ISINTGSNATK; AIITNTSSNSK; LLNSSTDDQAK; GQYIKNKYLDK; ILAEKKEWLNY; LLRRIAEEKNK; TIINSYTFKDK; KTHNHGFRETY; NTSTPNQSIIK; YSGNSPLQKLK; IITNTSSNSKR; TQYLNTIINSY; HGFRETYDQFK; SSCTIDANLNK |
| | HLA-A1101 | TIINSYTFK; ITNTSSNSK; CTIDANLNK; AMMDFDQAK; KLNSILAEK; STLEEIEKK; STPNQSIIK; YSGNSPLQK; ATKNKTNIK; ETYDQFKMK; ISNISVFDR; SLGQYIKNK; GLQKNTQSK; YTFSSSFSQ; QSNNVLTNY; NIKVAGLQK; SIMNILYQE; KIESFNTQY; KLKNNLLRR; YIKNKYLDK; TNVQATPPK; NSSTDDQAK; ESTLEEIEK; ATNVQATPPK; SINTGSNATK; NTIINSYTFK; IITNTSSNSK; KLNSILAEKK; TSTPNQSIIK; IINSYTFKDK; YAMMDFDQAK; NSYTFKDKLK; ITNTSSNSKR; QSLGQYIKNK; QSNNVLTNYR; GLQKNTQSKK; VISNISVFDR; NTGSNATKNK; VYSGNSPLQK; SQSNNVLTNY; SVFDRGSAPQ; NLLRRIAEEK; SGNSPLQKLK; TNIKVAGLQK; SKLNSILAEK; TQPSFVVPVY; MSSCTIDANLN; SSCTIDANLNK; KTNIKVAGLQK; AIITNTSSNSK; ISINTGSNATK; TIINSYTFKDK; TIDANLNKDYK; PVYSGNSPLQK; NTSTPNQSIIK; SLESTLEEIEK; GQYIKNKYLDK; SQSNNVLTNYR; SSNTPEAESER; YSGNSPLQKLK; TQYLNTIINSY; QTQPSFVVPVY; LLNSSTDDQAK; KTHNHGFRETY; PATNVQATPPK; VAGLQKNTQSK; ESKLNSILAEK; IITNTSSNSKR; SIMNILYQENQ; HGFRETYDQFK |
| | HLA-A2402 | EWLNYADAI; NTIINSYTF; DYKNKVEEL; VYSGNSPLQ; EFGSIMNIL; NYRHQTQPSF; EWLNYADAII; LYQENQNHSL; SFNTQYLNTI; DYKNKVEELL; VYSGNSPLQK; QYLNTIINSY; QYIKNKYLDK; PQQYTFSSSF; LYQENQNHSLI; VYSGNSPLQKL; SFNTQYLNTII; QYIKNKYLDKM; YLNTIINSYTF; NYRHQTQPSFV; SYTFKDKLKEL; LYAMMDFDQAK; SFSQPTSQTNF |
| | HLA-A2902 | YLNTIINSY; KIESFNTQY; QSNNVLTNY; FGSIMNILY; EFGSIMNILY; QYLNTIINSY; SIIKPQQYTF; SQSNNVLTNY; KKIESFNTQY; SLGQYIKNKY; TQPSFVVPVY; YLNTIINSYTF; CTIDANLNKDY; ILAEKKEWLNY; NSQSNNVLTNY; SFSQPTSQTNF; TQYLNTIINSY; KTHNHGFRETY; QTQPSFVVPVY |
| | HLA-A6801 | ETYDQFKMK; TIINSYTFK; NTPEAESER; CTIDANLNK; YTFSSSFSQ; ITNTSSNSK; ISNISVFDR; DANLNKDYK; ESTLEEIEK; TNTSSNSKR; STLEEIEKK; SNNVLTNYR; LYLNITEIR; NKTHNHGFR; STPNQSIIK; NSSTDDQAK; TNVQATPPK; KLNSILAEK; NTIINSYTF; ESFNTQYLN; NIKVAGLQK; LLRRIAEEK; YLDKMQDAR; YSGNSPLQK; DVISNISVF; ENQNHSLIR; QSNNVLTNY; INTGSNATK; SYTFKDKLK; YLNTIINSY; ATKNKTNIK; NTIINSYTFK; ITNTSSNSKR; QSNNVLTNYR; DLYLNITEIR; NSYTFKDKLK; YAMMDFDQAK; ESTLEEIEKK; VISNISVFDR; NTGSNATKNK; TSTPNQSIIK; NATKNKTNIK; IITNTSSNSK; SINTGSNATK; IINSYTFKDK; TNIKVAGLQK; |

Fig. 32 continued

| | | |
|---|---|---|
| | | ATNVQATPPK; NLLRRIAEEK; SNTPEAESER; YTFSSSFSQP; QYIKNKYLDK; KLNSILAEKK; TPEAESERNR; QSLGQYIKNK; ETYDQFKMKD; EFGSIMNILY; DVISNISVFDR; ITNTSSNSKR; ESKLNSILAEK; NTPEAESERNR; SSNTPEAESER; NTSTPNQSIIK; TIINSYTFKDK; SSCTIDANLNK; ISINTGSNATK; LNTIINSYTFK; TIDANLNKDYK; EKNKTHNHGFR; HGFRETYDQFK; LYAMMDFDQAK; SQSNNVLTNYR; DANLNKDYKNK; AIITNTSSNSK; PVYSGNSPLQK; NKYLDKMQDAR; YTFKDKLKELE; LLNSSTDDQAK; QTQPSFVVPVY; CTIDANLNKDY; TEFGSIMNILY; YSGNSPLQKLK; KTNIKVAGLQK; YTFSSSFSQPT; SLESTLEEIEK; PATNVQATPPK; NSQSNNVLTNY |
| | HLA-B0702 | SPATNVQAT; VPVYSGNSP; KPQQYTFSS; VPNNTSTPN; SERNRLYAM; SPVASPATN; NPMQIANQA; APQLSSNTP; SKRNDPQSL; VPVYSGNSPL; SPVASPATNV; KPQQYTFSSS; APQLSSNTPE; SPLQKLKNNL; KMQDARQSAL; KPQQYTFSSSF; SPLQKLKNNLL; APQLSSNTPEA; SPVASPATNVQ; TPEAESERNRL; PPKQIASAQAI; SPATNVQATPP; VPVYSGNSPLQ; VASSASQASPV; VPNNTSTPNQS |
| | HLA-B0801 | QFKMKDSAF; IIKPQQYTF; YIKNKYLDKM; YDQFKMKDSAF |
| | HLA-B1501 | QQYTFSSSF; YLNTIINSY; KQIASAQAI; NQVNPGNPM; RQSALDLYL; KMKDSAFTL; YQENQNHSL; IQISLESTL; LQKLKNNLL; SQPTSQTNF; MQDARQSAL; SQVASSASQ; QFKMKDSAF; QSNNVLTNY; IIKPQQYTF; GQYIKNKYL; HQTQPSFVV; KNKTHNHGF; QSIIKPQQY; HNHGFRETY; TQSKKNNNL; KMQDARQSA; MQIANQANQ; SQSNNVLTNY; KMQDARQSAL; PQQYTFSSSF; TQPSFVVPVY; FSQPTSQTNF; KMKDSAFTLL; DQFKMKDSAF; KQIASAQAIQ; SIIKPQQYTF; NQNHSLIRSL; SQASPVASPA; NQSIIKPQQY; MQIANQANQA; IQTVPNNTST; SQVASSASQA; TQYLNTIINSY; YLNTIINSYTF; QTQPSFVVPVY; KTHNHGFRETY; ILAEKKEWLNY; RQSALDLYLNI; ILYQENQNHSL; SQVASSASQAS; KQIASAQAIQT; MQIANQANQAN; SQASPVASPAT; HQTQPSFVVPV; QSIIKPQQYTF; SVFDRGSAPQL; LLDVISNISVF; QQYTFSSSFSQ; TNYRHQTQPSF; SLIRSLIISGL; AMMDFDQAKTT |
| | HLA-B2705 | RRIAEEKNK; YRHQTQPSF; NRLYAMMDF; QQYTFSSSF; RQSALDLYL; ERNRLYAMM; IRSLIISGL; KRNDPQSLGQ; ARQSALDLYL; RRIAEEKNKTH; KRNDPQSLGQY; GQYIKNKYLDK; ERNRLYAMMDF; RQSALDLYLNI; YRHQTQPSFVV; FRETYDQFKMK |
| | HLA-B3501 | QPSFVVPVY; YLNTIINSY; NPANQVNPG; SPATNVQAT; QANQASQAS; QASQASQAS; DVISNISVF; QANQANQAS; NTIINSYTF; FGSIMNILY; NPMQIANQA; QASQASQVA; NQVNPGNPM; VPNNTSTPN; SASQASPVA; VASSASQAS; IANQANQAN; WLNYADAII; QANQANQAN; QANQANQAN; QANQANQAN; YAMMDFDQA; YQENQNHSL; VASPATNVQ; FSSSFSQPT; VPVYSGNSPL; DARQSALDLY; NPMQIANQAN; EAESERNRLY; QASPVASPAT; EFGSIMNILY; DFDQAKTTEF; YAMMDFDQAK; QASQASQVAS; TPNQSIIKPQ; SASQASPVAS; YADAIITNTS; FSQPTSQTNF; MSSCTIDANL; QASQVASSAS; ESERNRLYAM; THNHGFRETY; LDVISNISVF; FNNSQSNNVL; NPANQVNPGN; KPQQYTFSSSF; YLNTIINSYTF; PANQVNPGNPM; TPEAESERNRL; VASPATNVQAT; SPVASPATNVQ; QTQPSFVVPVY; MDFDQAKTTEF; TQYLNTIINSY; QAKTTEFGSIM; LLDVISNISVF; YAMMDFDQAKT; VPVYSGNSPLQ; IANQANQANQA; NFNNSQSNNVL; VPNNTSTPNQS; QANQANQANQA; QANQANQANQA; QANQANQANQA; SPLQKLKNNLL |
| | HLA-B4403 | AEKKEWLNY; EEIEKKIES; AESERNRLY; TEFGSIMNI; KELESKLNS; QENQNHSLI; EEINKKIEIF; AENERNKFYA; EEKNKTQNNF; RELMISGLGT; AELKKQSQAA; TEFGSIMNILY; EEKNKTHNHGF; AESERNRLYAM; EEIEKKIESFN; KELESKLNSIL; AEKKEWLNYAD; EELLNSSTDDQ |

Fig. 32 continued

| | HLA-B5101 | VPVYSGNSP; DPQSLGQYI; TPPKQIASA; SPVASPATNV; VPVYSGNSPL; PPKQIASAQAI |
|---|---|---|
| | HLA-B5701 | FSQPTSQTNF; NSILAEKKEW; |
| NP_045742.1 \| hypothetical protein BBA69 [Borrelia burgdorferi B31]; SEQ ID NO:36, Seq ID NO: 68426-68757 | HLA-A0101 | LLDTYIRAY; LAEHFNKYY; DSDSLQSAF; ILEKLINNY; DSDSLQSAFY; KTLNKTLEDY; |
| | HLA-A0201 | FLYRIALDI; NLLDTYIRA; FMGTTASEL; KMLLKRFLL; NIITMILTL; ALLEQVKSA; TMILTLICI; TLKEILEKL; KLNIIKINI; IITMILTLI; IALDIQLKL; KINIITMIL; FLLSSLDYK; SINEKLDTL; MLLKRFLLS; IAANFLYRI; LTLICISCA; SLDYKKENI; KIAANFLYRI; ALLEQVKSAL; NIITMILTLI; MLLKRFLLSS; ILTLICISCA; ITMILTLICI; KLNIIKINII; NQYDIQIAKI; LLKRFLLSSL; RIALDIQLKL; FLYRIALDIQ; NIIKINIITM; FLYRIALDIQL; MLLKRFLLSSL; LLDTYIRAYEL; MILTLICISCA; FMGTTASELKA; KINIITMILTL; NIIKINIITMI; IITMILTLICI; KLNIIKINIIT; KMLLKRFLLSS |
| | HLA-A0301 | KLKKNTRLK; KVLAEHFNK; RIALDIQLK; KIAANFLYR; FLLSSLDYK; KSALQLQEK; CISCAPFNK; KANENTKLK; MLLKRFLLS; VLAEHFNKY; LLSSLDYKK; NQYDIQIAK; QLKLEKHLK; ALQLQEKFK; RFLLSSLDY; NTNNIQENK; ETLKEILEK; RFLLSSLDYK; KLKKNTRLKK; ALDIQLKLEK; FMGTTASELK; ALQLQEKFKK; LINNYENDPK; IQLKLEKHLK; KTLNKTLEDY; FLLSSLDYKK; VLAEHFNKYY; KANENTKLKK; QEKFKKTLNK; SALQLQEKFK; TASELKAIGK; LAEHFNKYYK; KVLAEHFNKY; CAPFNKINPK; ICISCAPFNK; NLLDTYIRAY; ANENEKMLLK; KRFLLSSLDY; TKLKKNTRLK; KMLLKRFLLS; KNQYDIQIAK; VLAEHFNKYYK; KSALQLQEKFK; KINPKANENTK; KLDTLSKENSK; SINEKLDTLSK; KFMGTTASELK; RAYELANENEK; KVLAEHFNKYY; TTASELKAIGK; TLNKTLEDYRK; KLINNYENDPK; RFLLSSLDYKK; LICISCAPFNK; LANENEKMLLK; IALDIQLKLEK; QVKSALQLQEK; KTLNKTLEDYR; NTKLKKNTRLK |
| | HLA-A1101 | KVLAEHFNK; KIAANFLYR; CISCAPFNK; RIALDIQLK; KSALQLQEK; NTNNIQENK; NQYDIQIAK; ASELKAIGK; KANENTKLK; FLLSSLDYK; LLSSLDYKK; ETLKEILEK; ALQLQEKFK; APFNKINPK; LQLQEKFKK; KLKKNTRLK; AEHFNKYYK; QLKLEKHLK; DTLSKENSK; TASELKAIGK; SALQLQEKFK; KANENTKLKK; KVLAEHFNKY; ALQLQEKFKK; LINNYENDPK; RFLLSSLDYK; LAEHFNKYYK; FLLSSLDYKK; IQLKLEKHLK; ALDIQLKLEK; AIGKELEDRK; KLKKNTRLKK; ICISCAPFNK; FMGTTASELK; CAPFNKINPK; KTLNKTLEDY; TLNKTLEDYR; SINEKLDTLSK; TTASELKAIGK; LICISCAPFNK; RAYELANENEK; SALQLQEKFKK; VLAEHFNKYYK; IALDIQLKLEK; KSALQLQEKFK; TLNKTLEDYRK; KLINNYENDPK; KTLNKTLEDYR; KSGDLGASDEK; KINPKANENTK; KFMGTTASELK; LANENEKMLLK; KAIGKELEDRK; KVLAEHFNKYY; RFLLSSLDYKK; QVKSALQLQEK; KLDTLSKENSK; NTKLKKNTRLK; NIETLKEILEK; LQEKFKKTLNK; DIQLKLEKHLK; KRFLLSSLDYK |
| | HLA-A2402 | DYRKNTNNI; TYIRAYELA; KYYKDSDSL; QYDIQIAKI; NFLYRIALDI; DYKKENIETL; KFMGTTASEL; LYRIALDIQL; ITMILTLICI; |
| | HLA-A2902 | VLAEHFNKY; RFLLSSLDY; PKIAANFLY; LAEHFNKYY; ILEKLINNY; VLAEHFNKYY; KVLAEHFNKY; NLLDTYIRAY; TLICISCAPF; EILEKLINNY; KVLAEHFNKYY |
| | HLA-A6801 | NTNNIQENK; ETLKEILEK; NTKLKKNTR; CISCAPFNK; KIAANFLYR; MGTTASELK; NQYDIQIAK; DTLSKENSK; LLSSLDYKK; FLLSSLDYK; RIALDIQLK; KVLAEHFNK; DTYIRAYEL; EKFKKTLNK; ENEKMLLKR; NPKANENTK; ENIQNFKDK; LNKTLEDYR; QLKLEKHLK; KSALQLQEK; KANENTKLK; ESNLLDTYIR; TLNKTLEDYR; TASELKAIGK; LAEHFNKYYK; LINNYENDPK; CAPFNKINPK; FMGTTASELK; FLLSSLDYKK; SALQLQEKFK; ENTKLKKNTR; NPGENIQNFK; NKVLAEHFNK; KAIGKELEDR; ICISCAPFNK; DTYIRAYELA; |

Fig. 32 continued

| | | |
|---|---|---|
| | | DLEALLEQVK; TTASELKAIGK; NTKLKKNTRLK; LICISCAPFNK; RAYELANENEK; DPKIAANFLYR; QVKSALQLQEK; KTLNKTLEDYR; TLNKTLEDYRK; LANENEKMLLK; NIETLKEILEK; VLAEHFNKYYK; IALDIQLKLEK; SALQLQEKFKK; DIQLKLEKHLK; EESNLLDTYIR; SINEKLDTLSK; ENKVLAEHFNK; DYKKENIETLK; NPKANENTKLK; KSALQLQEKFK; KFMGTTASELK |
| | HLA-B0702 | KPANPGENI; AANFLYRIAL; NPKANENTKL; IAANFLYRIAL |
| | HLA-B0801 | FKKTLNKTL; ELKAIGKEL; HLKSINEKL; LLKRFLLSSL; QLQEKFKKTL; KFKKTLNKTL; MLLKRFLLSSL; FLYRIALDIQL; IIKINIITMIL |
| | HLA-B1501 | VLAEHFNKY; LICISCAPF; RFLLSSLDY; ILEKLINNY; FMGTTASEL; LLDTYIRAY; TLNKTLEDY; TLICISCAPF; VLAEHFNKYY; KVLAEHFNKY; NLLDTYIRAY; IQIAKITNEE; LLKRFLLSSL; IQENKVLAEH; KTLNKTLEDY; KVLAEHFNKYY; IQENKVLAEHF; LTLICISCAPF; IQNFKDKSGDL; YENDPKIAANF; IQIAKITNEES; FLYRIALDIQL |
| | HLA-B2705 | YRIALDIQL; NQYDIQIAK; KRFLLSSLD; KRFLLSSLDY; YRIALDIQLK; YRIALDIQLKL; KRFLLSSLDYK; RKNQYDIQIAK |
| | HLA-B3501 | NPGENIQNF; LLDTYIRAY; LAEHFNKYY; EESNLLDTY; DPKIAANFL; VLAEHFNKY; LICISCAPF; LANENEKML; SALQLQEKF; DSDSLQSAF; NIITMILTL; SDSLQSAFY; DPKIAANFLY; NLLDTYIRAY; TLICISCAPF; LANENEKMLL; DSDSLQSAFY; AANFLYRIAL; NPKANENTKL; NIIKINIITM; VLAEHFNKYY; IAANFLYRIAL; EALLEQVKSAL; YKDSDSLQSAF; LTLICISCAPF; NKVLAEHFNKY; TNEESNLLDTY; PANPGENIQNF |
| | HLA-B4403 | KEILEKLIN; EESNLLDTY; SELKAIGKEL; EESNLLDTYI; KELEDRKNQY; KEILEKLINN; QENKVLAEHF; KENSKEDLEA; KEDLEALLEQ; KEILEKLINNY; YENDPKIAANF; KENIETLKEIL; NENEKMLLKRF; AEHFNKYYKDS |
| | HLA-B5101 | KPANPGENI; IAANFLYRI; |
| | HLA-B5701 | |
| AAT93826.1\| conserved hypothetical protein BBA69[Borrelia garinii PBi]; SEQ ID NO:37, SEQ ID NO: 68758-69026 | HLA-A0101 | QLEKHINENY; |
| | HLA-A0201 | FIYDIPIII; ILQEILEKL; TLICISCAV; LLMRIESEL; KLNILTTTL; ILTTTLTLI; SLNYETEKI; NILTTTLTL; KLNIIKLNI; MQMKKIIYS; KQNKDLEPL; LTLICISCA; KILQEILEKL; ILNQKEIEEL; LTLICISCAV; KIAKNFIYDI; KIDNTQIDFL; NILTTTLTLI; FIYDIPIIIQ; KLNILTTTLT; IIYSSLNYET; TLTLICISCA; KLNIIKLNIL; QMKKIIYSSL; MQMKKIIYSS; LTTTLTLICI; LLMRIESELKI; MQMKKIIYSSL; KLNILTTTLTL; ILTTTLTLICI; TLTLICISCAV; FIYDIPIIIQS; ILNQKEIEELL; SLNYETEKIKI; KLETTLKILEA; KIIYSSLNYET; KLNIIKLNILT; QILNQKEIEEL; KLDKNLQHKKI |
| | HLA-A0301 | KIIYSSLNY; KLDKNLQHK; KILQEILEK; KTSAEQLEK; QIDFLKTFK; KTNKKENIK; ASKLETTLK; KMQMKKIIY; TLKILEAQK; KILEAQKEK; SSLNYETEK; NLQHKKIAK; LMRIESELK; QSRLDIISK; KIDPEPKSK; LLMRIESELK; TQIDFLKTFK; RLDIISKVIK; LICISCAVNK; KENFKKALNK; KNLQHKKIAK; TTLKILEAQK; TASKLETTLK; SLNYETEKIK; IQSRLDIISK; KLDKNLQHKK; KKIIYSSLNY; YSSLNYETEK; KENIKNFVNK; ISKVIKNPIK; KFQDLEPSKK; ELKIKENFKK; IKILQEILEK; KALNKTIDAY; IKTSAEQLEK; TLICISCAVNK; ATASKLETTLK; IISKVIKNPIK; IIQSRLDIISK; KIDNTQIDFLK; KIKILQEILEK; ILQEILEKLDK; QLEKHINENYK; ELLMRIESELK; NTQIDFLKTFK; TLKILEAQKEK; NIKTSAEQLEK; LMRIESELKIK |
| | HLA-A1101 | KTSAEQLEK; SSLNYETEK; KILQEILEK; KIIYSSLNY; ASKLETTLK; QIDFLKTFK; KTNKKENIK; KILEAQKEK; KFQDLEPSK; TLKILEAQK; KLDKNLQHK; QSRLDIISK; NLQHKKIAK; KIDPEPKSK; RIESELKIK; KMQMKKIIY; ICISCAVNK; TQIDFLKTFK; TTLKILEAQK; AVNKIDPEPK; TASKLETTLK; LICISCAVNK; LLMRIESELK; IQSRLDIISK; YSSLNYETEK; |

| | | |
|---|---|---|
| | | SLNYETEKIK; KLDKNLQHKK; KFQDLEPSKK; ISKVIKNPIK; KQNKDLEPLR; RLDIISKVIK; KENIKNFVNK; KENFKKALNK; AYNQDSENIK; ATASKLETTLK; TLICISCAVNK; IIQSRLDIISK; NTQIDFLKTFK; KIDNTQIDFLK; SSLNYETEKIK; IISKVIKNPIK; KIKILQEILEK; ILQEILEKLDK; ETTLKILEAQK; NIKTSAEQLEK; CAVNKIDPEPK; IYSSLNYETEK; ELLMRIESELK; SLPEDEKMQMK; TLKILEAQKEK; KSKTNKKENIK; QLEKHINENYK |
| | HLA-A2402 | NFIYDIPII; AYNQDSENI; NYETEKIKI; IYSSLNYET; KYPEATASK; KYPEATASKL; NFIYDIPIII; IYSSLNYETE; NYKEFNSLKPI; IYSSLNYETEK |
| | HLA-A2902 | KIIYSSLNY; EFNSLKPIY; KKIAKNFIY; KMQMKKIIY; DLEPLREKY; YKEFNSLKPIY |
| | HLA-A6801 | DNTQIDFLK; DIPIIIQSR; NYKEFNSLK; QIDFLKTFK; ENIKNFVNK; SSLNYETEK; TLKILEAQK; ELKIKENFK; ENFKKALNK; KTSAEQLEK; ETEKIKILQ; QNKDLEPLR; EPKSKTNKK; EKHINENYK; EIAKIDNTQ; EKENIEIAK; TTLKILEAQK; TASKLETTLK; YSSLNYETEK; ENYKEFNSLK; TQIDFLKTFK; LLMRIESELK; LICISCAVNK; YDIPIIIQSR; EKYPEATASK; ELKIKENFKK; AVNKIDPEPK; ISKVIKNPIK; ETTLKILEAQ; SLNYETEKIK; IDNTQIDFLK; ETTLKILEAQK; TLICISCAVNK; NTQIDFLKTFK; DAYNQDSENIK; ATASKLETTLK; ESELKIKENFK; NIKTSAEQLEK; IYSSLNYETEK; ELLMRIESELK; IISKVIKNPIK; CAVNKIDPEPK; NENYKEFNSLK; TLKILEAQKEK; NQKEIEELLMR; DPHDSLPEDEK; IIQSRLDIISK; QLEKHINENYK; SSLNYETEKIK |
| | HLA-B0702 | YPEATASKL; IPIIQSRL; LPEDEKMQM; KIKENFKKAL; EPSKKQNKDL; NPIKDELQIL; IPIIQSRLDI; YPEATASKLET |
| | HLA-B0801 | MKKIIYSSL; FKKALNKTI; KIKILQEIL; QMKKIIYSSL; KIKENFKKAL; IIKLNILTTTL |
| | HLA-B1501 | TQIDFLKTF; KIIYSSLNY; ALNKTIDAY; KMQMKKIIY; HINENYKEF; KQNKDLEPL; LQILNQKEI; KLNILTTTL; KKIAKNFIY; LQHKKIAKNF; QMKKIIYSSL; KALNKTIDAY; AQKEKENIEI; NQKEIEELLM; QLEKHINENY; MQMKKIIYSSL; EQLEKHINENY; KLNILTTTLTL; IAKIDNTQIDF |
| | HLA-B2705 | SRLDIISKV; MRIESELKI; MRIESELKIK; SRLDIISKVI; SRLDIISKVIK; MQMKKIIYSSL |
| | HLA-B3501 | LPEDEKMQM; YPEATASKL; EFNSLKPIY; TASKLETTL; IPIIQSRL; KALNKTIDAY; NPIKDELQIL; EKMQMKKIIY; YPEATASKLET; EPLREKYPEAT; YKEFNSLKPIY; EATASKLETTL |
| | HLA-B4403 | EELLMRIES; SELKIKENF; KEIEELLMR; KEFNSLKPI; KEFNSLKPIY; KEIEELLMRI; QEILEKLDKNL; EELLMRIESEL; SENIKTSAEQL; KENIKNFVNKF |
| | HLA-B5101 | IPIIQSRL; NPIKDELQI; IPIIQSRLDI |
| | HLA-B5701 | |
| NP_045573.1 \| hypothetical protein BBI42 [Borrelia burgdorferi B31]; SEQ ID NO:38, SEQ ID NO: 69027-69299 | HLA-A0101 | PVSDYNEEY; FMRIVRWLY; VSDYNEEYF; YSGEEGSPEY; SSDMGSDEIV; YSGEEGSPEYY; GSDEIVTEGIF |
| | HLA-A0201 | WLYSCIEEL; KLYASEHRL; YLPDNQEQA; ILVGVCIIA; ALALLGCYL; YASEHRLLV; LVGVCIIAL; LLVEIKKTL; DLIKLFIMV; TAYQQYLKV; YLPDNQEQAV; ILVGVCIIAL; KLYASEHRLL; LLVEIKKTLI; GIFSSLKLYA; IVTEGIFSSL; RIVRWLYSCI; SLKDPNYRGV; RLLVEIKKTL; LVGVCIIALA; RILVGVCIIA; KLYASEHRLLV; ILVGVCIIALA; RILVGVCIIAL; WLYSCIEELYS; YASEHRLLVEI; RLLVEIKKTLI; IIALALLGCYL |
| | HLA-A0301 | LIKLFIMVK; GIFSSLKLY; PTAYQQYLK; ELYSPDIKY; VTEGIFSSLK; KFMRIVRWLY; RPTAYQQYLK; DLIKLFIMVK; TAYQQYLKVK; SLKLYASEHR; FLDLGSEQSK; IIALALLGCY; EIKKTLISLK; |

Fig. 32 continued

| | | |
|---|---|---|
| | | WLYSCIEELY; MVKNEQNNNK; SDYNEEYFNK; IVTEGIFSSLK; KLYASEHRLLV; IMVKNEQNNNK; CIIALALLGCY; TAYQQYLKVKR |
| | HLA-A1101 | LIKLFIMVK; PTAYQQYLK; GIFSSLKLY; IALALLGCY; KVKRYDYNR; ISLKDPNYR; TEGIFSSLK; AYQQYLKVK; VTEGIFSSLK; TAYQQYLKVK; MVKNEQNNNK; DLIKLFIMVK; SDYNEEYFNK; RPTAYQQYLK; GSEQSKDLIK; IIALALLGCY; EIKKTLISLK; TLISLKDPNY; LISLKDPNYR; KFMRIVRWLY; IVTEGIFSSLK; ASEHRLLVEIK; VSDYNEEYFNK; TAYQQYLKVKR; TLISLKDPNYR; SSLKLYASEHR; CIIALALLGCY; KTLISLKDPNY; IMVKNEQNNNK; PTAYQQYLKVK; GSPEYYRNMPR; CIEELYSPDIK; KDLIKLFIMVK |
| | HLA-A2402 | LYASEHRLL; KFMRIVRWL; DYNRPVPIL; DYNEEYFNK; NYRGVVLPV; DYNEEYFNKF; RYDYNRPVPI; EYFNKFFLDL; LYASEHRLLV; RWLYSCIEEL; KFMRIVRWLY; DYNEEYFNKFF; RYDYNRPVPIL; RWLYSCIEELY; CYLPDNQEQAV; YYRNMPRPTAY |
| | HLA-A2902 | ELYSPDIKY; FMRIVRWLY; LYSCIEELY; PVSDYNEEY; YLKVKRYDY; IALALLGCY; KFMRIVRWLY; QYLKVKRYDY; TLISLKDPNY; YSGEEGSPEY; WLYSCIEELY; YRNMPRPTAY; IIALALLGCY; YQQYLKVKRY; DYNEEYFNKF; YYRNMPRPTAY; CIIALALLGCY; NMPRPTAYQQY; VLPVSDYNEEY; KYSGEEGSPEY; YSGEEGSPEYY; RWLYSCIEELY; DYNEEYFNKFF |
| | HLA-A6801 | EQNNNKFMR; PTAYQQYLK; KVKRYDYNR; NNKFMRIVR; LIKLFIMVK; DYNEEYFNK; ISLKDPNYR; YQQYLKVKR; EEGSPEYYR; LYSCIEELY; ELYSPDIKY; QTFFENSES; TEGIFSSLK; FMRIVRWLY; MVKNEQNNNK; EIKKTLISLK; VTEGIFSSLK; TAYQQYLKVK; SLKLYASEHR; DLIKLFIMVK; LISLKDPNYR; NNNKFMRIVR; SPEYYRNMPR; RPTAYQQYLK; WLYSCIEELY; SDYNEEYFNK; NEQNNNKFMR; EGIFSSLKLY; TAYQQYLKVKR; IVTEGIFSSLK; TLISLKDPNYR; SSLKLYASEHR; YLKVKRYDYNR; IMVKNEQNNNK; PTAYQQYLKVK; CIEELYSPDIK; QNNNKFMRIVR; CIIALALLGCY; GSPEYYRNMPR; NKFMRIVRWLY |
| | HLA-B0702 | DPNYRGVVL; RPTAYQQYL; YASEHRLLV; MPRPTAYQQ; SPEYYRNMP; IVTEGIFSSL; SPEYYRNMPR; MPRPTAYQQY; MPRPTAYQQYL; RPTAYQQYLKV; DPNYRGVVLPV; LPVSDYNEEYF; RILVGVCIIAL; YASEHRLLVEI |
| | HLA-B0801 | YLKVKRYDY; EIKKTLISL; ; MPRPTAYQQYL; FMRIVRWLYSC |
| | HLA-B1501 | QQYLKVKRY; FMRIVRWLY; YLKVKRYDY; RNMPRPTAY; QSKDLIKLF; NQEQAVQTF; GVVLPVSDY; IALALLGCY; ELYSPDIKY; KLYASEHRL; SGEEGSPEY; YQQYLKVKRY; YSGEEGSPEY; WLYSCIEELY; IIALALLGCY; ILVGVCIIAL; EQSKDLIKLF; NQEQAVQTFF; IVTEGIFSSL; TLISLKDPNY; KLYASEHRLL; RGVVLPVSDY; QQYLKVKRYDY; YSGEEGSPEYY; MVKNEQNNNKF; NMPRPTAYQQY; YYRNMPRPTAY; VLPVSDYNEEY; CIIALALLGCY |
| | HLA-B2705 | HRLLVEIKK; KRYDYNRPV; MRILVGVCI; YQQYLKVKR; QQYLKVKRY; YRNMPRPTAY; KRYDYNRPVP; KRYDYNRPVPI; HRLLVEIKKTL; YRGVVLPVSDY; VRWLYSCIEEL; QQYLKVKRYDY; MRIVRWLYSCI |
| | HLA-B3501 | DPNYRGVVL; LPDNQEQAV; NQEQAVQTF; IALALLGCY; LPVSDYNEE; PVSDYNEEY; SGEEGSPEY; YNEEYFNKF; LVGVCIIAL; LPVSDYNEEY; MPRPTAYQQY; YSGEEGSPEY; LPDNQEQAVQ; WLYSCIEELY; YRNMPRPTAY; FFENSESSDM; IIALALLGCY; LPVSDYNEEYF; MPRPTAYQQYL; LPDNQEQAVQT; YSGEEGSPEYY; MVKNEQNNNKF; YYRNMPRPTAY; YASEHRLLVEI; LVGVCIIALAL; DPNYRGVVLPV; TFFENSESSDM |
| | HLA-B4403 | NEEYFNKFF; EEYFNKFFL; VEIKKTLIS; DEIVTEGIF; SEHRLLVEI; GEEGSPEYY; EELYSPDIKY; DEIVTEGIFS; VEIKKTLISL; SEQSKDLIKLF; EELYSPDIKYS; EEYFNKFFLDL; EEGSPEYYRNM; |

Fig. 32 continued

| | | |
|---|---|---|
| | | TEGIFSSLKLY |
| | HLA-B5101 | LPDNQEQAV; LPVSDYNEEY; LPVSDYNEEYF; MPRPTAYQQYL |
| | HLA-B5701 | |
| NP_051318.1 \| revA protein[Borrelia burgdorferi B31]; SEQ ID NO:39, SEQ ID NO: 69300-69486 | HLA-A0101 | |
| | HLA-A0201 | SLMEDVLAL; FVMACKAYV; KLVGVTVPL; LMEDVLALV; KLAAKLAAL; KIWSEAKLV; LFFASMLFV; MLFVMACKA; FQDKLAAKL; LVGVTVPLL; FASMLFVMA; FFASMLFVM; SLMEDVLALV; KLFFASMLFV; KLVGVTVPLL; KMSKNAVEQI; SMLFVMACKA; NIFKLFFASM; NLKDIGNAEL; NLQNSFQDKL; FFASMLFVMA; MLFVMACKAY; KIWSEAKLGV; KLFFASMLFV; KLAAKLAALKA; FKLFFASMLFV; NIFKLFFASML; FQDKLAAKLAA |
| | HLA-A0301 | SMLFVMACK; KLAALKAAK; LAAKLAALK; LVNDSSGGK; KLFFASMLF; NLQNSFQDK; KLAAKLAALK; ASMLFVMACK; ALVNDSSGGK; SSGGKFKDYK; KLFFASMLFV; KLLNLQNSFQ; AKLAALKAAK; TSGNGDKMSK; MLFVMACKAY; KINELKENLK; GSNTSGNGDK; NSFQDKLAAK; LLNLQNSFQDK; LVNDSSGGKFK; VMACKAYVEEK; FASMLFVMACK; KLFFASMLFV; ISKRKIWSEAK; KLAAKLAALKA; SMLFVMACKAY; MSKNAVEQIDK; NTSGNGDKMSK |
| | HLA-A1101 | SMLFVMACK; LVNDSSGGK; KLAALKAAK; LAAKLAALK; NTIENITDK; SFQDKLAAK; SGNGDKMSK; NLQNSFQDK; ASMLFVMACK; KLAAKLAALK; KINELKENLK; MACKAYVEEK; SSGGKFKDYK; NSFQDKLAAK; TSGNGDKMSK; GSNTSGNGDK; ALVNDSSGGK; ITDKQDISK; AVEQIDKVIK; LVNDSSGGKFK; FASMLFVMACK; VMACKAYVEEK; NTSGNGDKMSK; MACKAYVEEKK; AAKLAALKAAK; MSKNAVEQIDK; LLNLQNSFQDK; ISKRKIWSEAK; LALVNDSSGGK; SMLFVMACKAY; NITDKQDISK; DSSGGKFKDYK |
| | HLA-A2402 | FFASMLFVM; DYKDKINEL; KLFFASMLF; IFKLFFASML; IFKLFFASMLF |
| | HLA-A2902 | FFASMLFVM; KLLNLQNSF; MLFVMACKAY; SMLFVMACKAY |
| | HLA-A6801 | NTIENITDK; LAAKLAALK; LVNDSSGGK; SMLFVMACK; CKAYVEEKK; KLAALKAAK; NLQNSFQDK; MACKAYVEEK; NSFQDKLAAK; ASMLFVMACK; MLFVMACKAY; DYKDKINELK; TSGNGDKMSK; SSGGKFKDYK; KLAAKLAALK; KINELKENLK; DIGNAELKEK; ITDKQDISK; MACKAYVEEKK; NTSGNGDKMSK; FASMLFVMACK; DSSGGKFKDYK; LVNDSSGGKFK; MSKNAVEQIDK; NLKDIGNAELK; NAVEQIDKVIK; ITDKQDISKR; VMACKAYVEEK; NITDKQDISK; LALVNDSSGGK; LLNLQNSFQDK; ISKRKIWSEAK |
| | HLA-B0702 | KLAAKLAAL; VPLLGSNTSG |
| | HLA-B0801 | IFKLFFASM; KLAAKLAAL; IFKLFFASML; EAKLVGVTVPL; QDKLAAKLAAL |
| | HLA-B1501 | KLLNLQNSF; KLFFASMLF; SLMEDVLAL; EQIDKVIKF; KLVGVTVPL; KLAAKLAAL; LFVMACKAY; MLFVMACKAY; LVNDSSGGKF; NLKDIGNAEL; KLVGVTVPLL; EQIDKVIKFL; SMLFVMACKAY; ALVNDSSGGKF; KLFFASMLFV; IFKLFFASMLF; KEKLLNLQNSF |
| | HLA-B2705 | KRKIWSEAK; RKIWSEAKL; MRNKNIFKL; KRKIWSEAKL; MRNKNIFKLF; MRNKNIFKLFF |
| | HLA-B3501 | FFASMLFVM; LFVMACKAY; VPLLGSNTS; FASMLFVMA; MLFVMACKAY; FASMLFVMAC; LVNDSSGGKF; LFFASMLFVM; FKLFFASMLF; NAVEQIDKVI; NIFKLFFASM; DSLMEDVLAL; EAKLVGVTVPL; SMLFVMACKAY |
| | HLA-B4403 | AELKEKLLN; KEKLLNLQN; KENLKDIGN; KEIDSLMED; EEKKEIDSL; AELKEKLLNL; EEKKEIDSLM; KENLKDIGNA; SEAKLVGVTV; KEIDSLMEDVL; KEKLLNLQNSF; AELKEKLLNLQ |
| | HLA-B5101 | VPLLGSNTS; LAALKAAKNTI |
| | HLA-B5701 | |
| NP_045737.1 | HLA-A0101 | YTEERRMLY; DTDDLIDEY; STVHFDSHEY; NSTVHFDSHEY; |

Fig. 32 continued

| | | |
|---|---|---|
| BBA64 antigen, P35 [Borrelia burgdorferi B31]; SEQ ID NO:40, SEQ ID NO: 69487-69835 | | QTDVSKLNDTL; LKDTDDLIDEY; QLNKPNLETLY |
| | HLA-A0201 | ILISCSLEV; FLLHVLTVL; ILDPEVAKL; TLINRGFSI; TLYNDFEKL; LIAIFLLHV; KILDRSENI; VLILISCSL; LLHVLTVLI; HVLTVLILI; AMEEISAKI; NLLVAINNL; NIHDIILDL; NLGQILSKL; KIFNLGQIL; IILDLVNTT; QLAMEEISA; TTTNILAPI; AQFANIHDI; KLIAIFLLHV; FLLHVLTVLI; LILISCSLEV; NIHDIILDLV; AIFLLHVLTV; KIFFNANSTV; KILDPEVAKL; ILDPEVAKLI; LLHVLTVLIL; LAMEEISAKI; KILDRSENII; GMRAEIFSKI; KLQQLNKPNL; LIAIFLLHVL; QLNKPNLETL; IILDLVNTTT; TVLILISCSL; EIFSKIFFNA; KLTSLKEKWL; FSIQLAMEEI; FLLHVLTVLIL; KLIAIFLLHVL; VLILISCSLEV; TLINRGFSIQL; LLHVLTVLILI; ILDLVNTTTNI; LIDEYNTNPDL; ILDRSENIIQI; QLAMEEISAKI; KLSQDSNYRGL; IAIFLLHVLTV; KILDPEVAKLI; AQFANIHDIIL; AIFLLHVLTVL; LTVLILISCSL; ILNVKDKLQQL; NILKNNKLIAI; FANIHDIILDL |
| | HLA-A0301 | KLIAIFLLH; GMRAEIFSK; KLNDTLRSK; LLVAINNLK; ISAKILNVK; KILDPEVAK; KLIQKILDR; LISCSLEVK; KLSQDSNYR; TSLKEKWLK; TVHFDSHEY; KLIAIFLLH; GMRAEIFSK; KLNDTLRSK; LLVAINNLK; ISAKILNVK; KILDPEVAK; KLIQKILDR; LISCSLEVK; KLSQDSNYR; TSLKEKWLK; TVHFDSHEY; KIFNLGQILSK; KLTSLKEKWLK; QLNKPNLETLY; KIFFNANSTVH; LILISCSLEVK; ISAKILNVKDK; ILSKLSQDSNY; IQLAMEEISAK; NVKDKLQQLNK |
| | HLA-A1101 | TSLNFNEGK; TSLKEKWLK; KILDPEVAK; GMRAEIFSK; NANANNAPK; ISAKILNVK; KLNDTLRSK; LAMEEISAK; ETLYNDFEK; LLVAINNLK; LISCSLEVK; KLIAIFLLH; TVHFDSHEY; DSNYRGLVK; YTEERRMLY; KLSQDSNYR; LVKETLINR; KLIQKILDR; EVKDSNESK; AINNLKNPTK; YTSLNFNEGK; ILISCSLEVK; LTSLKEKWLK; KANSKASKQK; NANANNAPKK; STVHFDSHEY; NLLVAINNLK; QLAMEEISAK; EISAKILNVK; IFNLGQILSK; AAGKNKANSK; SAKILNVKDK; FGMRAEIFSK; IQISEMDSSR; EVKDSNESKK; KIFNLGQILSK; VAINNLKNPTK; KLTSLKEKWLK; IQLAMEEISAK; LILISCSLEVK; SQDSNYRGLVK; NVKDKLQQLNK; ISAKILNVKDK; VSKLNDTLRSK; SLEVKDSNESK; IIQISEMDSSR; QFGMRAEIFSK; NLETLYNDFEK; KIFFNANSTVH |
| | HLA-A2402 | RMLYTSLNF; QFANIHDII; IFLLHVLTV; EYNTNPDLQ; KWLKDTDDL; QFGMRAEIF; KWLKDTDDLI; IFLLHVLTVL; FFNANSTVHF; QFANIHDIIL; NYRGLVKETL; IFLLHVLTVLI; IFFNANSTVHF; NYRGLVKETLI; LYNDFEKLTSL |
| | HLA-A2902 | TVHFDSHEY; NKPNLETLY; YTEERRMLY; RMLYTSLNF; STVHFDSHEY; FFNANSTVHF; EYTEERRMLY; QLNKPNLETLY; IFFNANSTVHF; ILSKLSQDSNY |
| | HLA-A6801 | ETLYNDFEK; DSHEYTEER; EVKDSNESK; QISEMDSSR; LLVAINNLK; TSLNFNEGK; DTLRSKNSR; NANANNAPK; TVHFDSHEY; ISAKILNVK; EPNDQFGMR; LAMEEISAK; TSLKEKWLK; YTEERRMLY; VSKLNDTLR; DFEKLTSLK; LISCSLEVK; LVKETLINR; EIFSKIFFN; DSNESKKHK; DSNYRGLVK; ESKKHKKEK; TTNILAPIQ; KLSQDSNYR; NPTKPAAGK; STVHFDSHE; FSIQLAMEE; DTDDLIDEY; YTSLNFNEGK; DVSKLNDTLR; DSHEYTEERR; EVKDSNESKK; NANANNAPKK; EISAKILNVK; STVHFDSHEY; LTSLKEKWLK; ESKKHKKEKR; NLLVAINNLK; DSNESKKHKK; TTTNILAPIQ; ILISCSLEVK; QLAMEEISAK; IQISEMDSSR; FGMRAEIFSK; NDFEKLTSLK; LETLYNDFEK; FDSHEYTEER; EYTEERRMLY; MLYTSLNFNE; IFNLGQILSK; AINNLKNPTK; SAKILNVKDK; LSKLSQDSNYR; IIQISEMDSSR; LYTSLNFNEGK; ENLLVAINNLK; NLETLYNDFEK; ISAKILNVKDK; NVKDKLQQLNK; NPNANANNAPK; HFDSHEYTEER; VAINNLKNPTK; NSTVHFDSHEY; EEISAKILNVK; TDVSKLNDTLR; KIFNLGQILSK; LILISCSLEVK; NTTTNILAPIQ; VAKLIQKILDR; |

Fig. 32 continued

| | | |
|---|---|---|
| | | KLTSLKEKWLK; ESKKHKKEKRK; ETLINRGFSIQ |
| | HLA-B0702 | KPAAGKNKA; LVNTTTNIL; KPAAGKNKAN; APKKILDPEV; KPNLETLYNDF; APKKILDPEVA; NPDLQTDVSKL; KPAAGKNKANS |
| | HLA-B0801 | VAKLIQKIL; ILKNNKLIAI; LLHVLTVLIL; |
| | HLA-B1501 | RMLYTSLNF; TVHFDSHEY; RSKNSRAQF; AQFANIHDI; YTEERRMLY; FNANSTVHF; LNFNEGKIF; VLILISCSL; KLIAIFLLH; KIFNLGQIL; TLINRGFSI; STVHFDSHEY; FFNANSTVHF; DQFGMRAEIF; LSKLSQDSNY; SLNFNEGKIF; AQFANIHDII; SSRGEPNDQF; GMRAEIFSKIF; AQFANIHDIIL; LVKETLINRGF; QLNKPNLETLY; ILKNNKLIAIF; ILSKLSQDSNY; KLIAIFLLHVL; IFFNANSTVHF; TLRSKNSRAQF; IQKILDRSENI; TLINRGFSIQL; QQLNKPNLETL; INRGFSIQLAM; TSLNFNEGKIF |
| | HLA-B2705 | KRKGKVENL; RRMLYTSLN; YRGLVKETL; ERRMLYTSL; MRAEIFSKI; RMLYTSLNF; RRMLYTSLNF; MRAEIFSKIF; LRSKNSRAQF; KRKGKVENLL; MRAEIFSKIFF; KRKGKVENLLV; ERRMLYTSLNF; RRMLYTSLNFN |
| | HLA-B3501 | TVHFDSHEY; FANIHDIIL; IAIFLLHVL; NPDLQTDVS; LVNTTTNIL; DTDDLIDEY; FFNANSTVH; RAEIFSKIF; EPNDQFGMR; FNANSTVHF; NPNANANNA; FFNANSTVHF; STVHFDSHEY; EPNDQFGMRA; MRAEIFSKIF; NPNANANNAP; RAEIFSKIFF; DLVNTTTNIL; KPNLETLYNDF; FANIHDIILDL; NSTVHFDSHEY; EPNDQFGMRAE; NPDLQTDVSKL; LAMEEISAKIL; IFFNANSTVHF; LKDTDDLIDEY; NPNANANNAPK; NANSTVHFDSH; MRAEIFSKIFF; TSLNFNEGKIF |
| | HLA-B4403 | AEIFSKIFF; EEISAKILN; KETLINRGF; SEMDSSRGE; GEPNDQFGM; EEISAKILNV; SENIIQISEM; AEIFSKIFFN; AEIFSKIFFNA; SEMDSSRGEPN; EEISAKILNVK; KETLINRGFSI; HEYTEERRMLY; SENIIQISEMD |
| | HLA-B5101 | IAIFLLHVL; LAMEEISAKI; LHVLTVLILI; IAIFLLHVLTV |
| | HLA-B5701 | KLTSLKEKW; STVHFDSHEY; NSTVHFDSHEY |
| AAT93822.1\| BBA64 antigen, P35 [Borrelia garinii PBi]; SEQ ID NO:41, SEQ ID NO: 69836-70189 | HLA-A0101 | FTDIHNIIL; YVNERRILY; DVDDIIKDY; RTDISKLNDY; STVTFDDNEY; FTDIHNIILN; FTDIHNIILNL; HLNKPNLKTLY; GSTVTFDDNEY; RTDISKLNDYI |
| | HLA-A0201 | FLLHILTGL; ILLSCSLEV; VTFDDNEYV; ILINRGFSI; NLINTTTNI; HILTGLILL; NLLVAINTL; TLYHDFNKL; KLNDYIISK; AQFTDIHNI; LIAIFLLHI; GLILLSCSL; QLAIEEISL; FTDIHNIIL; YIISKNSKA; NLGKILSKL; KILERSEDI; SIQLAIEEI; TTTNILAPI; LLHILTGLI; TVDNLLVAI; ALKQIDPEA; ILTGLILLS; ILNLINTTT; KLIAIFLLHI; FLLHILTGLI; LILLSCSLEV; TLYHDFNKLI; KIFFNAGSTV; KILERSEDIV; NLINTTTNIL; LIAIFLLHIL; YVNERRILYT; KLIPLKEKWL; IQLAIEEISL; KTLYHDFNKL; TVTFDDNEYV; FSIQLAIEEI; LLHILTGLIL; SQDSNYRSLV; LINTTTNILA; EIFSKIFFNA; AQFTDIHNII; FLLHILTGLIL; KLIAIFLLHIL; GLILLSCSLEV; ILINRGFSIQL; ILNLINTTTNI; FTDIHNIILNL; STVTFDDNEYV; NLINTTTNILA; AIFLLHILTGL; LLHILTGLILL; KLSQDSNYRSL; AQFTDIHNIIL; IIKDYNANPEL; KLNDYIISKNS; ILNLGKILSKL; KTLYHDFNKLI; SIQLAIEEISL; ILERSEDIVQI |
| | HLA-A0301 | KLNDYIISK; KSNSAAALK; KLIAIFLLH; LLVAINTLK; KTLYHDFNK; KLSKNAKNK; ISLRTLNVK; YVNERRILY; SSKMKKLSK; EMKAEIFSK; KLSQDSNYR; TSLNFNENK; DSNYRSLVK; LNLGKILSK; ILNLGKILSK; NLLVAINTLK; AINTLKNPPK; LIPLKEKWLK; KQPNNANALK; KMKKLSKNAK; QDSNYRSLVK; KLSKNAKNKK; NSSKMKKLSK; SLRTLNVKDK; KSENNSSKMK; SENNSSKMKK; EISLRTLNVK; SKLNDYIISK; IQHLNKPNLK; YTSLNFNENK; NKSNSAAALK; LKNPPKTAGK; TSKSENNSSK; QKKAKTKTSK; HDFNKLIPLK; SLVKEILINR; ALKQIDPEAK; FEMKAEIFSK; KILNLGKILSK; |

Fig. 32 continued

| | | |
|---|---|---|
| | | HLNKPNLKTLY; KLIPLKEKWLK; KIQHLNKPNLK; TSKSENNSSK; TLKNPPKTAGK; KSENNSSKMKK; KQKKAKTKTSK; NLKTLYHDFNK; ILSKLSQDSNY; ISKLNDYIISK; RSLVKEILINR; ISLRTLNVKDK; IVQISEIDANK; NVKDKIQHLNK |
| | HLA-A1101 | KTLYHDFNK; KSNSAAALK; KLNDYIISK; TSLNFNENK; SSKMKKLSK; ISLRTLNVK; LLVAINTLK; KLIAIFLLH; QISEIDANK; DSNYRSLVK; YVNERRILY; EMKAEIFSK; KLSKNAKNK; LVKEILINR; KLSQDSNYR; LAIEEISLR; AINTLKNPPK; YTSLNFNENK; ILNLGKILSK; TSKSENNSSK; VQISEIDANK; NSSKMKKLSK; KSENNSSKMK; IQHLNKPNLK; NLLVAINTLK; KQPNNANALK; EISLRTLNVK; KLSKNAKNKK; KMKKLSKNAK; SLVKEILINR; ALKQIDPEAK; STVTFDDNEY; SENNSSKMKK; SKLNDYIISK; EVNQDDNQEK; LIPLKEKWLK; SLRTLNVKDK; HDFNKLIPLK; KTSKSENNSSK; KIQHLNKPNLK; KILNLGKILSK; VAINTLKNPPK; IVQISEIDANK; KSENNSSKMKK; KLIPLKEKWLK; SQDSNYRSLVK; ISKLNDYIISK; RSLVKEILINR; NVKDKIQHLNK; ISLRTLNVKDK; TLKNPPKTAGK; NLKTLYHDFNK; IQLAIEEISLR; KQKKAKTKTSK; NALKQIDPEAK; LYTSLNFNENK |
| | HLA-A2402 | LYHDFNKLI; KWLKDVDDI; NYRSLVKEI; QFTDIHNII; RILYTSLNF; EYVNERRIL; KWLKDVDDII; FFNAGSTVTF; IFLLHILTGL; NYRSLVKEIL; IFLLHILTGLI; IFFNAGSTVTF; NYRSLVKEIL; LYHDFNKLIPL |
| | HLA-A2902 | YVNERRILY; TVTFDDNEY; EYVNERRILY; FFNAGSTVTF; STVTFDDNEY; HLNKPNLKTLY; ILSKLSQDSNY; YIISKNSKAQF; IFFNAGSTVTF |
| | HLA-A6801 | LAIEEISLR; ELIQKILER; TSLNFNENK; LLVAINTLK; QISEIDANK; EMKAEIFSK; LVKEILINR; DYNANPELR; TVTFDDNEY; DSNYRSLVK; KSNSAAALK; DFNKLIPLK; ENNSSKMKK; KTLYHDFNK; QPNNANALK; EIFSKIFFN; DNEYVNERR; DYIISKNSK; YVNERRILY; DDNEYVNER; LSKNAKNKK; TTNILAPIQ; KLSQDSNYR; KLNDYIISK; ENKILNLGK; YTSLNFNENK; EVNQDDNQEK; EISLRTLNVK; QLAIEEISLR; TSKSENNSSK; STVTFDDNEY; SLVKEILINR; NLLVAINTLK; NSSKMKKLSK; TTTNILAPIQ; DDNEYVNERR; HDFNKLIPLK; NKSNSAAALK; FEMKAEIFSK; LIPLKEKWLK; ILNLGKILSK; NDYIISKNSK; LKTLYHDFNK; LSKLSQDSNYR; LYTSLNFNENK; IVQISEIDANK; KTSKSENNSSK; NVKDKIQHLNK; NLKTLYHDFNK; TFDDNEYVNER; ISKLNDYIISK; DNLLVAINTLK; IQLAIEEISLR; EEISLRTLNVK; VAINTLKNPPK; NALKQIDPEAK; DFNKLIPLKEK; NTTTNILAPIQ; TLKNPPKTAGK |
| | HLA-B0702 | KPTVDNLLV; KPNLKTLYH; KPTVDNLLVA; KPTVDNLLVAI; NPELRTDISKL; KPNLKTLYHDF; QPNNANALKQI |
| | HLA-B0801 | |
| | HLA-B1501 | YVNERRILY; FNAGSTVTF; KQPNNANAL; RILYTSLNF; ISKNSKAQF; ILINRGFSI; TVTFDDNEY; NLKTLYHDF; AQFTDIHNI; KLIAIFLLH; GLILSCSL; IQHLNKPNL; FFNAGSTVTF; KQIDPEAKEL; IQLAIEEISL; LSKLSQDSNY; DQFEMKAEIF; AQFTDIHNII; STVTFDDNEY; IISKNSKAQF; EMKAEIFSKIF; IFFNAGSTVTF; LVKEILINRGF; AQFTDIHNIIL; ALKQPNNANAL; ILSKLSQDSNY; HLNKPNLKTLY; YIISKNSKAQF; ILINRGFSIQL; KLIAIFLLHIL; KLSQDSNYRSL; KQIDPEAKELI |
| | HLA-B2705 | RRILYTSLN; KKAKTKTSK; ERRILYTSL; YRSLVKEIL; RRILYTSLNF; KQKKAKTKTSK; ERRILYTSLNF; RRILYTSLNFN |
| | HLA-B3501 | TVTFDDNEY; YVNERRILY; FNAGSTVTF; IAIFLLHIL; FFNAGSTVT; LINTTTNIL; NKSNSAAAL; NLLVAINTL; EPDDQFEMK; KAEIFSKIF; FFNAGSTVTF; STVTFDDNEY; MKAEIFSKIF; MKNNKLIAIF; EPDDQFEMKA; DQFEMKAEIF; IFFNAGSTVTF; KPNLKTLYHDF; |

Fig. 32 continued

| | | |
|---|---|---|
| | | DANKGEPDDQF; LAIEEISLRTL; EPDDQFEMKAE; MKAEIFSKIFF; NPELRTDISKL; YIISKNSKAQF |
| | HLA-B4403 | KEILINRGF; AEIFSKIFF; SEIDANKGE; FEMKAEIFS; GEPDDQFEM; EEISLRTLN; EEISLRTLNV; KEILINRGFS; AEIFSKIFFN; SEIDANKGEP; SEDIVQISEI; KEILINRGFSI; AEIFSKIFFNA; SEIDANKGEPD; NEYVNERRILY |
| | HLA-B5101 | IAIFLLHIL; IPLKEKWLKDV; KPTVDNLLVAI |
| | HLA-B5701 | KLIPLKEKW; STVTFDDNEY; GSTVTFDDNEY |
| AAL84596.1\| BBK32 [Borrelia burgdorferi]; SEQ ID NO:42, SEQ ID NO: 70190-70651 | HLA-A0101 | FSTKLTQMY; ISCDLFIRY; IIDKNGVWY; YTDEIEEEDY; NTINKIYDTY; FISCDLFIRY; YLDEDDEDDEY; DSAINTINKIY |
| | HLA-A0201 | LLNYIQVSV; GLFDKGNSI; YLEGVKYNV; KTAANFVYI; KLENIEAEI; NLYEAYKAI; AIVTSILLM; KTLLNYIQV; LMRDSLKEV; YLALGLLFG; TLLNYIQVS; ILETSEESI; ALGLLFGFI; SLSGESGEL; MTQGSLNSL; TLLNYIQVSV; LLMRDSLKEV; LLFGFISCDL; GLFDKGNSIL; RLSNRYQSYL; NLYEAYKAIV; KLTQMYSTRL; QMYSTRLDNL; KIYDTYTLFS; GMTQGSLNSL; SILETSEESI; YLALGLLFGF; TLFSTKLTQM; LALGLLFGFI; YLALGLLFGFI; KIYDTYTLFST; SLQDIAGSNSI; KTLLNYIQVSV; ILLMRDSLKEV; GLLFGFISCDL; YTDEIEEEDYA; ILEEESLKTEL; TINKIYDTYTL; QMYSTRLDNLA; LLNYIQVSVKT; TQMYSTRLDNL; NLYEAYKAIVT; YINDTHAKRKL |
| | HLA-A0301 | ILLMRDSLK; RLSNRYQSY; SIKKPMNKK; SLKRDSANK; RLDNLAKAK; DTYTLFSTK; QSNLYEAYK; IVTSILLMR; KLTQMYSTR; KIKEQSNLY; VILEEESLK; ESIKKPMNK; STRLDNLAK; ISCDLFIRY; ESLKTELLK; KGKSKVSRK; IARKKGKSK; KNFKTLLNY; QSYLEGVKY; LNYIQVSVK; LLNYIQVSVK; SLSGESGELK; SILLMRDSLK; KIARKKGKSK; KPMNKKGKGK; AIVTSILLMR; RYQSYLEGVK; GIIDKNGVWY; FVYINDTHAK; SANKSNFLQK; ITIDSDLRPK; RKEPYIHSLK; LLKEQSETRK; CDLFIRYEMK; YDTYTLFSTK; EQSNLYEAYK; YINDTHAKRK; KLENIEAEIK; HSLKRDSANK; SVKTAANFVY; KIQKQQDEYK; NVILEEESLK; KIYDTYTLFS; YSTRLDNLAK; FISCDLFIRY; ILETSEESIK; YTLFSTKLTQ; TLLNYIQVSVK; TLFSTKLTQMY; RLDNLAKAKAK; TSILLMRDSLK; SLKEVQGIIDK; ILETSEESIKK; ELLKEQSETRK; SIKKPMNKKGK; SILETSEESIK; FVYINDTHAKR; KAKEEAAKFTK; STRLDNLAKAK; DSANKSNFLQK; NVDSAINTINK |
| | HLA-A1101 | DTYTLFSTK; QSNLYEAYK; STRLDNLAK; ILLMRDSLK; SIKKPMNKK; ISCDLFIRY; VILEEESLK; IVTSILLMR; TIDSDLRPK; ESIKKPMNK; ESLKTELLK; SLKRDSANK; ETSEESIKK; DSAINTINK; LSGESGELK; VYINDTHAK; ANKSNFLQK; RLDNLAKAK; YQSYLEGVK; AEIKTLIAK; FISCDLFIR; YINDTHAKR; KLTQMYSTR; SANKSNFLQ; SANKSNFLQK; SILLMRDSLK; ITIDSDLRPK; SLSGESGELK; FVYINDTHAK; KIQKQQDEYK; AIVTSILLMR; NVILEEESLK; HSLKRDSANK; YINDTHAKRK; YSTRLDNLAK; LLNYIQVSVK; KIARKKGKSK; SVKTAANFVY; ESIKKPMNKK; KAKAKEEAAK; EQSNLYEAYK; RYQSYLEGVK; KIYDTYTLFS; KLENIEAEIK; FISCDLFIRY; TSILLMRDSLK; SILETSEESIK; TLLNYIQVSVK; NVDSAINTINK; KAIVTSILLMR; STRLDNLAKAK; STKLTQMYSTR; NSLSGESGELK; KAKEEAAKFTK; AAKFTKEDLEK; TLFSTKLTQMY; SIKKPMNKKGK; DSANKSNFLQK; SLKEVQGIIDK; MYSTRLDNLAK; FTKEDLEKNFK; KEQSNLYEAYK; ILETSEESIKK; QSETRKEKIQK; IYDTYTLFSTK; RLDNLAKAKAK; FVYINDTHAKR; VYINDTHAKRK; VSVKTAANFVY |
| | HLA-A2402 | KYLALGLLF; AYKAIVTSI; YYEDDYEEI; TYTLFSTKL; MYSTRLDNL; VYINDTHAK; GFISCDLFI; NFKTLLNYI; RYQSYLEGV; KIYDTYTLF; LFGFISCDLF; EYYEDDYEEI; AYKAIVTSIL; EYKGMTQGSL; IYDTYTLFST; SYLEGVKYNV; RYQSYLEGVK; VYINDTHAKR; |

Fig. 32 continued

| | | |
|---|---|---|
| | | KYLALGLLFGF; KYNVDSAINTI; AYKAIVTSILL; YYEDDYEEIRL; IYDTYTLFSTK; LFGFISCDLFI; VYINDTHAKRK; RYQSYLEGVKY; MYSTRLDNLAK |
| | HLA-A2902 | QSYLEGVKY; FSTKLTQMY; IAGSNSISY; KYLALGLLF; ISCDLFIRY; IIDKNGVWY; EQSNLYEAY; AINTINKIY; VKTAANFVY; KIYDTYTLF; TINKIYDTY; RLSNRYQSY; KNFKTLLNY; YQSYLEGVKY; FISCDLFIRY; SVKTAANFVY; GIIDKNGVWY; LFSTKLTQMY; YLALGLLFGF; SAINTINKIY; EIEEEDYARY; YTDEIEEEDY; DIAGSNSISY; NTINKIYDTY; TLFSTKLTQMY; GFISCDLFIRY; RYQSYLEGVKY; VSVKTAANFVY; YLDEDDEDDEY; EIEEEDYARYY; KYLALGLLFGF; SYTDEIEEEDY; DYEEIRLSNRY |
| | HLA-A6801 | DTYTLFSTK; IVTSILLMR; YINDTHAKR; ETSEESIKK; DITIDSDLR; QSNLYEAYK; FISCDLFIR; DSAINTINK; EPYIHSLKR; ESIKKPMNK; EIEEEDYAR; DLFIRYEMK; ETRKEKIQK; ESLKTELLK; KLTQMYSTR; FSTKLTQMY; TINKIYDTY; STRLDNLAK; ILLMRDSLK; LLKEQSETR; VYINDTHAK; LNYIQVSVK; SIKKPMNKK; SANKSNFLQ; EQSETRKEK; TAANFVYIN; EESPGLFDK; VILEEESLK; YQSYLEGVK; FVYINDTHAK; NVILEEESLK; ESIKKPMNKK; NTINKIYDTY; SANKSNFLQK; ITIDSDLRPK; EQSNLYEAYK; YSTRLDNLAK; LLNYIQVSVK; EIKTLIAKIK; AIVTSILLMR; SILLMRDSLK; YINDTHAKRK; ELLKEQSETR; DYEEIRLSNR; VYINDTHAKR; EAEIKTLIAK; HSLKRDSANK; DIAGSNSISY; IDITIDSDLR; GFISCDLFIR; YYEDDYEEIR; SVKTAANFVY; SLSGESGELK; YDTYTLFSTK; DSANKSNFLQ; FISCDLFIRY; SAINTINKIY; EESLKTELLK; DEIEEEDYAR; CDLFIRYEMK; FVYINDTHAKR; STKLTQMYSTR; EYYEDDYEEIR; TSILLMRDSLK; FTKEDLEKNFK; DSANKSNFLQK; NFVYINDTHAK; EIDITIDSDLR; FGFISCDLFIR; NVDSAINTINK; KAIVTSILLMR; NSLSGESGELK; TLLNYIQVSVK; MYSTRLDNLAK; TLFSTKLTQMY; DITIDSDLRPK; STRLDNLAKAK; ELLKEQSETRK; SILETSEESIK; DSAINTINKIY; DDYEEIRLSNR; EKIQKQQDEYK; MNKKGKGKIAR; EAAKFTKEDLE; QSETRKEKIQK; DTYTLFSTKLT |
| | HLA-B0702 | KVKSKYLAL; RPKSSLQDI; KPMNKKGKG; IARKKGKSKV; RPKSSLQDIA; KPMNKKGKGKI; SPGLFDKGNSI; RPKSSLQDIAG; KVKSKYLALGL |
| | HLA-B0801 | KVKSKYLAL; MKKVKSKYL; HAKRKLENI; YIQVSVKTAA; MKKVKSKYLAL |
| | HLA-B1501 | RLSNRYQSY; EQSNLYEAY; KIKEQSNLY; KQQDEYKGM; KIYDTYTLF; QSYLEGVKY; FSTKLTQMY; KAKEEAAKF; IAGSNSISY; AINTINKIY; KVKSKYLAL; VSVKTAANF; LMRDSLKEV; GLFDKGNSI; EMKEESPGL; LQKNVILEE; ISCDLFIRY; KNFKTLLNY; YQSYLEGVKY; YLALGLLFGF; SVKTAANFVY; KSKVSRKEPY; EMKEESPGLF; QVSVKTAANF; SAINTINKIY; GMTQGSLNSL; GIIDKNGVWY; FTKEDLEKNF; GLFDKGNSIL; RLSNRYQSYL; DIAGSNSISY; LLFGFISCDL; IQVSVKTAANF; LLFGFISCDLF; TLFSTKLTQMY; KSKYLALGLLF; IQKQQDEYKGM; VSVKTAANFVY; EIRLSNRYQSY; QDIAGSNSISY; IAKIKEQSNLY; KAKAKEEAAKF; TQMYSTRLDNL; YLDEDDEDDEY |
| | HLA-B2705 | IRLSNRYQSY; TRLDNLAKAK; KRDSANKSNF; RKKGKSKVSR; NRYQSYLEGV; NRYQSYLEGVK; IRLSNRYQSYL; RKKGKSKVSRK; ARKKGKSKVSR; SRKEPYIHSLK; KRKLENIEAEI |
| | HLA-B3501 | IAGSNSISY; EQSNLYEAY; LALGLLFGF; FSTKLTQMY; TINKIYDTY; DEDDEDDEY; ISCDLFIRY; EDDEDDEYY; NFVYINDTH; SAINTINKIY; FISCDLFIRY; EIEEEDYARY; SVKTAANFVY; DIAGSNSISY; LFSTKLTQMY; YQSYLEGVKY; YLALGLLFGF; YTDEIEEEDY; LDEDDEDDEY; NTINKIYDTY; KAIVTSILLM; QVSVKTAANF; DEDDEDDEYY; YLDEDDEDDEY; EIEEEDYARYY; ETSEESIKKPM; |

Fig. 32 continued

| | | |
|---|---|---|
| | | IAKIKEQSNLY; EAYKAIVTSIL; VSVKTAANFVY; IKEQSNLYEAY; TLFSTKLTQMY; DSAINTINKIY; YTLFSTKLTQM; ISCDLFIRYEM; LDEDDEDDEYY; YKAIVTSILLM; QDIAGSNSISY |
| | HLA-B4403 | EEEDYARYY; EEIRLSNRY; NEIDITIDS; GELKETIES; EEDYARYYL; DEDDEDDEY; EESLKTELL; AEIKTLIAK; DEIEEEDYA; SEESIKKPM; EEIRLSNRYQ; EEEDYARYYL; AEIKTLIAKI; DEDDEDDEYY; YEMKEESPGL; NEIDITIDSD; EEESLKTELL; EEIRLSNRYQS; NEIDITIDSDL; YEMKEESPGLF; DEIEEEDYARY; EEEDYARYYLD; AEIKTLIAKIK; KEKIQKQQDEY; DEDDEYYEDDY |
| | HLA-B5101 | LALGLLFGFI; SPGLFDKGNSI |
| | HLA-B5701 | ISCDLFIRY; ; VSVKTAANFVY |
| AAL84590.1\| BBK32 [Borrelia afzelii]; SEQ ID NO:43, SEQ ID NO: 70652-71087 | HLA-A0101 | LSTKQTQMY; YSLEEDYYY; VIDKNGVWY; ISGSNSISY; YTDEIEEEDY; LLSTKQTQMY; SSAIKTIVKIY; ATNFVYAREIY; VSARTATNFVY |
| | HLA-A0201 | LLMKDSLKI; KIYDNYTLL; MLQGSLSFL; KLDAIETEI; FTIDSDLRL; LLNYIQVSA; YLEGVKYNV; FLSGESGEL; KTLLNYIQV; GLCDEESSI; RTATNFVYA; TLLNYIQVS; RLKSDLQAI; LLSTKQTQM; AIVRSILLM; ALGLLFGFI; RMLQGSLSFL; TLLNYIQVSA; LLFGFISCDL; LLMKDSLKII; RLSNRYESYL; QMYSTRLDNL; ILLMKDSLKI; SILETGDKSV; KIYDNYTLLS; MLQGSLSFLS; GLCDEESSIL; LALGLLFGFI; KIYDNYTLLST; LMKDSLKIIEI; GLLFGFISCDL; QVSARTATNFV; ILLMKDSLKII; RMLQGSLSFLS; QMYSTRLDNLA; LLNYIQVSART; TQMYSTRLDNL; TIVKIYDNYTL; CLALGLLFGFI; SLGLCDEESSI; KTLLNYIQVSA |
| | HLA-A0301 | KSVKKSLNK; IVRSILLMK; ILLMKDSLK; SSAIKTIVK; KIIEIVIDK; RLDNLAKAK; KVEGNAVKK; RLSNRYESY; SVKKSLNKK; SLNKKGKDK; ISGSNSISY; TIDSDLRLK; STRLDNLAK; KYNVSSAIK; VISEEEILK; KIKGQSDLY; AIVRSILLMK; FVYAREIYSK; SILLMKDSLK; FLSGESGELK; VSSAIKTIVK; KSLNKKGKDK; VKYNVSSAIK; AISGSNSISY; SVNNSNLSQK; GQSDLYEAYK; LLRERPETRK; IVIDKNGVWY; KLDAIETEIK; LLNYIQVSAR; KSVKKSLNKK; LLSTKQTQMY; YDNYTLLSTK; RTATNFVYAR; FTIDSDLRLK; ILETGDKSVK; NVISEEEILK; KTIVKIYDNY; EIKNLILKIK; YSTRLDNLAK; ILKTKLLRER; KKFTKEELEK; RYESYLEGVK; ETEIKNLILK; KLLRERPETRK; RSILLMKDSLK; FVYAREIYSKR; KAIVRSILLMK; TLLNYIQVSAR; GVKYNVSSAIK; SLKIIEIVIDK; ILETGDKSVKK; VSARTATNFVY; TLLSTKQTQMY; NVSSAIKTIVK; SILETGDKSVK; RMLQGSLSFLS; KAREEAKKFTK; STRLDNLAKAK; SVKKSLNKKGK |
| | HLA-A1101 | SSAIKTIVK; KSVKKSLNK; SSILETGDK; KIIEIVIDK; SVKKSLNKK; IVRSILLMK; STRLDNLAK; VISEEEILK; TATNFVYAR; TIDSDLRLK; KVEGNAVKK; ILLMKDSLK; QSDLYEAYK; KAKAREEAK; LSGESGELK; TEIKNLILK; VYAREIYSK; ETGDKSVKK; KYNVSSAIK; SVNNSNLSQ; RLDNLAKAK; FISCDLFIR; SLNKKGKDK; ISGSNSISY; VNNSNLSQK; SVNNSNLSQK; FVYAREIYSK; AIVRSILLMK; SILLMKDSLK; VSSAIKTIVK; RTATNFVYAR; FTIDSDLRLK; KSVKKSLNKK; GQSDLYEAYK; NVISEEEILK; YSTRLDNLAK; AISGSNSISY; KTIVKIYDNY; ETEIKNLILK; KSLNKKGKDK; KLDAIETEIK; KAKAREEAKK; ISEEEILKTK; IVIDKNGVWY; FLSGESGELK; KAIVRSILLMK; RSILLMKDSLK; SILETGDKSVK; NVSSAIKTIVK; KLLRERPETRK; GVKYNVSSAIK; STRLDNLAKAK; SVKKSLNKKGK; FVYAREIYSKR; ATNFVYAREIY; STKQTQMYSTR; VISEEEILKTK; SFLSGESGELK; SLKIIEIVIDK; MYSTRLDNLAK; VSARTATNFVY; KGQSDLYEAYK; TLLNYIQVSAR; ESVNNSNLSQK; KAREEAKKFTK; FTKEELEKDLK; IYDNYTLLSTK; QAISGSNSISY; SSAIKTIVKIY; ILETGDKSVKK; LAKAKAREEAK |
| | HLA-A2402 | AYKAIVRSI; MYSTRLDNL; VYAREIYSK; GFISCDLFI; KYNVSSAIK; |

Fig. 32 continued

| | |
|---|---|
| | YYYDGETRL; IYSKRKLDAI; LFGFISCDLF; AYKAIVRSIL; VYAREIYSKR; DYYYDGETRL; SYLEGVKYNV; KYNVSSAIKTI; AYKAIVRSILL; LFGFISCDLFI; IYDNYTLLSTK; VYAREIYSKRK; MYSTRLDNLAK |
| HLA-A2902 | YSLEEDYYY; ESYLEGVKY; QYSLEEDYY; VIDKNGVWY; ISGSNSISY; YYYDGETRL; DQYSLEEDY; RMLQGSLSF; TIVKIYDNY; IVIDKNGVWY; QYSLEEDYYY; YESYLEGVKY; SARTATNFVY; LLSTKQTQMY; YTDEIEEEDY; DQYSLEEDYY; EIEEEDYDQY; KTIVKIYDNY; SAIKTIVKIY; VSARTATNFVY; DQYSLEEDYYY; QAISGSNSISY; RYESYLEGVKY; SYTDEIEEEDY; TLLSTKQTQMY; EIVIDKNGVWY; DYDQYSLEEDY |
| HLA-A6801 | TATNFVYAR; FISCDLFIR; DPFNHHVKR; YAREIYSKR; EILKTKLLR; DYYYDGETR; ETRKEEIQK; ETGDKSVKK; DFTIDSDLR; DLFIRDEIK; QSDLYEAYK; SVKKSLNKK; SSILETGDK; IVRSILLMK; LNYIQVSAR; SSAIKTIVK; TIVKIYDNY; DNYTLLSTK; ESYLEGVKY; STRLDNLAK; KIIEIVIDK; YEAYKAIVR; VISEEEILK; KVEGNAVKK; TIDSDLRLK; TEIKNLILK; ILLMKDSLK; NFVYAREIY; VYAREIYSK; FVYAREIYSK; RTATNFVYAR; FTIDSDLRLK; NVISEEEILK; SVNNSNLSQK; LLNYIQVSAR; ETEIKNLILK; ESSILETGDK; EDYYYDGETR; YSTRLDNLAK; EIQKQQDEHK; FLSGESGELK; EIKNLILKIK; IDFTIDSDLR; SILLMKDSLK; EEILKTKLLR; YAREIYSKRK; VYAREIYSKR; VSSAIKTIVK; GFISCDLFIR; LYEAYKAIVR; AIVRSILLMK; TATNFVYARE; ESVNNSNLSQ; TKQTQMYSTR; FVYAREIYSKR; ESVNNSNLSQK; STKQTQMYSTR; EIDFTIDSDLR; DLYEAYKAIVR; NVSSAIKTIVK; EIQKQQDEHKR; FTKEELEKDLK; TLLNYIQVSAR; FGFISCDLFIR; EILKTKLLRER; NFVYAREIYSK; DLFIRDEIKEK; MYSTRLDNLAK; RSILLMKDSLK; GVKYNVSSAIK; ATNFVYAREIY; ETRLSNRYESY; DFTIDSDLRLK; STRLDNLAKAK; SVKKSLNKKGK; KAIVRSILLMK; LAKAKAREEAK; QAISGSNSISY; SLKIIEIVIDK; EESSILETGDK; EIVIDKNGVWY; DQYSLEEDYYY; YYDGETRLSNR; SILETGDKSVK; DTIESNEIDFT |
| HLA-B0702 | RPETRKEEI; SARTATNFV; KAIVRSILL; KIKSKCLAL; GVKYNVSSAI; YAREIYSKRKL; VARKKVEGNAV; SARTATNFVYA |
| HLA-B0801 | YSKRKLDAI; KIKSKCLAL; EIKEKSLGL; RLKSDLQAI; EAKKFTKEEL; ILKIKGQSDL; YIQVSARTAT; YAREIYSKRKL; VARKKVEGNAV |
| HLA-B1501 | RMLQGSLSF; GQSDLYEAY; RLSNRYESY; YSLEEDYYY; VSARTATNF; ISGSNSISY; KQQDEHKRM; AIKTIVKIY; FLSGESGEL; KIKGQSDLY; KAREEAKKF; IVIDKNGVW; LSTKQTQMY; AISGSNSISY; QVSARTATNF; IVIDKNGVWY; LQAISGSNSI; SARTATNFVY; LLSTKQTQMY; RMLQGSLSFL; KQQDEHKRML; SAIKTIVKIY; KTIVKIYDNY; KQTQMYSTRL; LLFGFISCDL; IQVSARTATNF; QAISGSNSISY; VSARTATNFVY; LLFGFISCDLF; ILKIKGQSDLY; KSKCLALGLLF; SSAIKTIVKIY; IQKQQDEHKRM; ETRLSNRYESY; KAKAREEAKKF; TLLSTKQTQMY; TQMYSTRLDNL; DQYSLEEDYYY; LMKDSLKIIEI; ATNFVYAREIY; SQKNVISEEEI |
| HLA-B2705 | RMLQGSLSF; ARTATNFVY; KRMLQGSLS; KQTQMYSTR; KRMLQGSLSF; TRLSNRYESY; TRLDNLAKAK; AREEAKKFTK; KRESVNNSNL; NRYESYLEGV; KKVEGNAVKK; KRMLQGSLSFL; NRYESYLEGVK; TRLSNRYESYL; ARTATNFVYAR; ARKKVEGNAVK |
| HLA-B3501 | YSLEEDYYY; NFVYAREIY; LALGLLFGF; LSTKQTQMY; FTIDSDLRL; ESYLEGVKY; RMLQGSLSF; ISGSNSISY; SARTATNFVY; EIEEEDYDQY; YTDEIEEEDY; SAIKTIVKIY; YESYLEGVKY; LLSTKQTQMY; IVIDKNGVWY; QAISGSNSISY; TLLSTKQTQMY; EIVIDKNGVWY; IKGQSDLYEAY; VSARTATNFVY; YTLLSTKQTQM; YDQYSLEEDYY; EAYKAIVRSIL |
| HLA-B4403 | EEILKTKLL; NEIDFTIDS; EEEDYDQYS; EELEKDLKT; GELKDTIES; |

Fig. 32 continued

| | | GETRLSNRY; REIYSKRKL; KEKSLGLCD; EEILKTKLLR; EEEDYDQYSL; TEIKNLILKI; DEIKEKSLGL; EEIQKQQDEH; EEDYYYDGET; EELEKDLKTL; EEEILKTKLL; NEIDFTIDSD; NEIDFTIDSDL; DEIEEEDYDQY; EELEKDLKTLL; IEIVIDKNGVW; EEILKTKLLRE; REIYSKRKLDA; EEEDYDQYSLE; SEEEILKTKLL |
|---|---|---|
| | HLA-B5101 | LALGLLFGFI; |
| | HLA-B5701 | VSARTATNF; ; VSARTATNFVY |
| AAL84595.1] BBK32 [Borrelia garinii]; SEQ ID NO:44, SEQ ID NO: 71088-71575 | HLA-A0101 | FSTKLTQMY; AIDKNGIWY; ISCDLFIRY; YTDEIEEEDY; NTINKIYDTY; FISCDLFIRY; YLDEDDEDEY; DSAINTINKIY; VSVKTATNFVY |
| | HLA-A0201 | LLNYIQVSV; GLFDKGNSI; YLEGVKYNV; KTATNFVYI; SLKEVQYAI; AIVSSILLM; KTLLNYIQV; LMRDSLKEV; NLYSAYKAI; KLENIEAKI; YLALGLLFG; KVSGKEPFI; TLLNYIQVS; ILETSEESI; ALGLLFGFI; SLSGESGEL; KAIVSSILL; MLEEESLKT; TLLNYIQVSV; LLMRDSLKEV; LLFGFISCDL; GLFDKGNSIL; RLSNRYQSYL; NLYSAYKAIV; KLTQMYSTRL; QMYSTRLDNL; KIYDTYTLFS; GMTKGSLNSL; SILETSEESI; VMLEEESLKT; YLALGLLFGF; TLFSTKLTQM; SAYKAIVSSI; LALGLLFGFI; YLALGLLFGFI; KIYDTYTLFST; SLQDIAGSNSI; KTLLNYIQVSV; ILLMRDSLKEV; MLEEESLKTEL; GLLFGFISCDL; YTDEIEEEDYA; TINKIYDTYTL; QMYSTRLDNLA; LLNYIQVSVKT; TQMYSTRLDNL; QVSVKTATNFV; YINEMHAKRKL |
| | HLA-A0301 | KSNLYSAYK; ILLMRDSLK; RLSNRYQSY; SIKKPMNKK; TLIAKIKEK; RLDNLAKAK; DTYTLFSTK; VMLEEESLK; IVSSILLMR; KLTQMYSTR; KIKEKSNLY; ESIKKPMNK; STRLDNLAK; KEPFIHSFK; ISCDLFIRY; ESLKTELLK; KNFKTLLNY; QSYLEGVKY; LNYIQVSVK; AIDKNGIWY; LLNYIQVSVK; SLSGESGELK; SILLMRDSLK; KTLIAKIKEK; FVYINEMHAK; KIARKNGKSK; KPMNKKGKGK; KIKTLIAKIK; QQDEYKGMTK; AIVSSILLMR; AANKSNFLQK; RYQSYLEGVK; NVMLEEESLK; ITIDSDLRPK; GKEPFIHSFK; LLKEQSETRK; CDLFIRYEMK; YDTYTLFSTK; EKSNLYSAYK; KLENIEAKIK; SVKTATNFVY; KIQKQQDEYK; EAKIKTLIAK; KIYDTYTLFS; YINEMHAKRK; YSTRLDNLAK; FISCDLFIRY; ILETSEESIK; HSFKRDAANK; YTLFSTKLTQ; TLLNYIQVSVK; TLFSTKLTQMY; RLDNLAKAKAK; SLKEVQYAIDK; SSILLMRDSLK; ILETSEESIKK; FVYINEMHAKR; ELLKEQSETRK; SIKKPMNKKGK; SILETSEESIK; KQQDEYKGMTK; KAKEEAAKFTK; STRLDNLAKAK; NVDSAINTINK |
| | HLA-A1101 | KSNLYSAYK; DTYTLFSTK; IVSSILLMR; STRLDNLAK; ILLMRDSLK; SIKKPMNKK; TLIAKIKEK; ISCDLFIRY; TIDSDLRPK; ESIKKPMNK; VMLEEESLK; ESLKTELLK; ETSEESIKK; VYINEMHAK; DSAINTINK; LSGESGELK; ANKSNFLQK; RLDNLAKAK; YQSYLEGVK; FISCDLFIR; YINEMHAKR; AKIKTLIAK; KEPFIHSFK; KLTQMYSTR; SFKRDAANK; ATNFVYINE; AANKSNFLQK; SILLMRDSLK; ITIDSDLRPK; FVYINEMHAK; KTLIAKIKEK; HSFKRDAANK; SLSGESGELK; NVMLEEESLK; AIVSSILLMR; KIQKQQDEYK; YINEMHAKRK; KIARKNGKSK; YSTRLDNLAK; LLNYIQVSVK; SVKTATNFVY; ESIKKPMNKK; KIKTLIAKIK; KAKAKEEAAK; RYQSYLEGVK; QQDEYKGMTK; KIYDTYTLFS; FISCDLFIRY; SSILLMRDSLK; SILETSEESIK; TLLNYIQVSVK; KAIVSSILLMR; NVDSAINTINK; KQQDEYKGMTK; SLKEVQYAIDK; STRLDNLAKAK; STKLTQMYSTR; NSLSGESGELK; KAKEEAAKFTK; AAKFTKEDLEK; TLFSTKLTQMY; SIKKPMNKKGK; MYSTRLDNLAK; SGKEPFIHSFK; FTKEDLEKNFK; FVYINEMHAKR; DAANKSNFLQK; ILETSEESIKK; QSETRKEKIQK; ATNFVYINEMH; VYINEMHAKRK; IYDTYTLFSTK; RLDNLAKAKAK; VSVKTATNFVY |
| | HLA-A2402 | KYLALGLLF; AYKAIVSSI; YYEDDYEEI; TYTLFSTKL; MYSTRLDNL; GFISCDLFI; VYINEMHAK; NFKTLLNYI; KTATNFVYI; RYQSYLEGV; |

Fig. 32 continued

| | | |
|---|---|---|
| | | QYAIDKNGI; KIYDTYTLF; LFGFISCDLF; AYKAIVSSIL; EYYEDDYEEI; IYDTYTLFST; SYLEGVKYNV; RYQSYLEGVK; KYLALGLLFGF; KYNVDSAINTI; AYKAIVSSILL; YYEDDYEEIRL; IYDTYTLFSTK; LFGFISCDLFI; RYQSYLEGVKY; VYINEMHAKRK; MYSTRLDNLAK |
| | HLA-A2902 | QSYLEGVKY; FSTKLTQMY; IAGSNSISY; VKTATNFVY; KYLALGLLF; ISCDLFIRY; AINTINKIY; KIYDTYTLF; TINKIYDTY; RLSNRYQSY; KNFKTLLNY; VYINEMHAK; EKSNLYSAY; YAIDKNGIWY; YQSYLEGVKY; SVKTATNFVY; FISCDLFIRY; LFSTKLTQMY; YLALGLLFGF; SAINTINKIY; EIEEEDYARY; YTDEIEEEDY; DIAGSNSISY; NTINKIYDTY; TLFSTKLTQMY; GFISCDLFIRY; VSVKTATNFVY; QYAIDKNGIWY; RYQSYLEGVKY; YLDEDDEDDEY; EIEEEDYARYY; KYLALGLLFGF; SYTDEIEEEDY; DYEEIRLSNRY; LMRDSLKEVQY |
| | HLA-A6801 | DTYTLFSTK; EPFIHSFKR; YINEMHAKR; IVSSILLMR; ETSEESIKK; DITIDSDLR; FISCDLFIR; DSAINTINK; ESIKKPMNK; EIEEEDYAR; DLFIRYEMK; ETRKEKIQK; ESLKTELLK; KSNLYSAYK; TLIAKIKEK; KLTQMYSTR; FSTKLTQMY; TINKIYDTY; STRLDNLAK; ILLMRDSLK; LLKEQSETR; LNYIQVSVK; VYINEMHAK; SIKKPMNKK; EQSETRKEK; EESPGLFDK; YQSYLEGVK; FVYINEMHAK; HSFKRDAANK; NVMLEEESLK; ESIKKPMNKK; NTINKIYDTY; ITIDSDLRPK; AIVSSILLMR; YINEMHAKRK; YSTRLDNLAK; LLNYIQVSVK; SILLMRDSLK; EKSNLYSAYK; ELLKEQSETR; DYEEIRLSNR; VYINEMHAKR; EAKIKTLIAK; DIAGSNSISY; AANKSNFLQK; IDITIDSDLR; GFISCDLFIR; YYEDDYEEIR; SVKTATNFVY; SLSGESGELK; DAANKSNFLQ; YDTYTLFSTK; FISCDLFIRY; SAINTINKIY; EESLKTELLK; TATNFVYINE; DEIEEEDYAR; CDLFIRYEMK; FVYINEMHAKR; STKLTQMYSTR; EYYEDDYEEIR; FTKEDLEKNFK; DAANKSNFLQK; NFVYINEMHAK; SSILLMRDSLK; EIDITIDSDLR; FGFISCDLFIR; KAIVSSILLMR; NVDSAINTINK; NSLSGESGELK; TLLNYIQVSVK; MYSTRLDNLAK; TLFSTKLTQMY; DITIDSDLRPK; STRLDNLAKAK; ELLKEQSETRK; SILETSEESIK; DSAINTINKIY; SLKEVQYAIDK; DDYEEIRLSNR; EKIQKQQDEYK; MNKKGKGKIAR; EAAKFTKEDLE; QSETRKEKIQK; SGKEPFIHSFK; DTYTLFSTKLT |
| | HLA-B0702 | KVKSKYLAL; RPKSSLQDI; KPMNKKGKG; IARKNGKSKV; RPKSSLQDIA; SAYKAIVSSI; KPMNKKGKGI; SPGLFDKGNSI; SAYKAIVSSIL; RPKSSLQDIAG; KVKSKYLALGL |
| | HLA-B0801 | KVKSKYLAL; MKKVKSKYL; HAKRKLENI; ; MKKVKSKYLAL |
| | HLA-B1501 | RLSNRYQSY; KIKEKSNLY; KQQDEYKGM; KIYDTYTLF; QSYLEGVKY; FSTKLTQMY; KAKEEAAKF; IAGSNSISY; AINTINKIY; KVKSKYLAL; LMRDSLKEV; MTKGSLNSL; VSVKTATNF; GLFDKGNSI; EMKEESPGL; ISCDLFIRY; KNFKTLLNY; YQSYLEGVKY; YLALGLLFGF; SVKTATNFVY; KSKVSGKEPF; YAIDKNGIWY; EMKEESPGLF; SAINTINKIY; SGKEPFIHSF; QVSVKTATNF; FTKEDLEKNF; GMTKGSLNSL; GLFDKGNSIL; VQYAIDKNGI; RLSNRYQSYL; DIAGSNSISY; KEKSNLYSAY; LLFGFISCDL; LMRDSLKEVQY; IQVSVKTATNF; LLFGFISCDLF; TLFSTKLTQMY; KSKYLALGLLF; IQKQQDEYKGM; VSVKTATNFVY; VQYAIDKNGIW; EIRLSNRYQSY; QDIAGSNSISY; IAKIKEKSNLY; KAKAKEEAAKF; TQMYSTRLDNL; YLDEDDEDDEY; VSGKEPFIHSF |
| | HLA-B2705 | RKLENIEAK; IRLSNRYQSY; KRKLENIEAK; KRDAANKSNF; TRLDNLAKAK; NRYQSYLEGV; NRYQSYLEGVK; RKNGKSKVSGK; IRLSNRYQSYL; KRKLENIEAKI; KQQDEYKGMTK |
| | HLA-B3501 | IAGSNSISY; LALGLLFGF; EKSNLYSAY; FSTKLTQMY; TINKIYDTY; DEDDEDDEY; ISCDLFIRY; EDDEDDEYY; YAIDKNGIW; DAANKSNFL; |

Fig. 32 continued

| | | TNFVYINEM; YAIDKNGIWY; SAINTINKIY; FISCDLFIRY; EIEEEDYARY; SVKTATNFVY; DIAGSNSISY; LFSTKLTQMY; YQSYLEGVKY; YLALGLLFGF; YTDEIEEEDY; LDEDDEDDEY; NTINKIYDTY; KAIVSSILLM; DEDDEDDEYY; QVSVKTATNF; TATNFVYINEM; YLDEDDEDDEY; EIEEEDYARYY; ETSEESIKKPM; TLFSTKLTQMY; DSAINTINKIY; VSVKTATNFVY; YTLFSTKLTQM; ISCDLFIRYEM; LDEDDEDDEYY; IAKIKEKSNLY; QDIAGSNSISY; NKSNFLQKNVM; YKAIVSSILLM |
|---|---|---|
| | HLA-B4403 | EEEDYARYY; EEIRLSNRY; NEIDITIDS; GELKETIES; EEDYARYYL; DEDDEDDEY; EESLKTELL; KEVQYAIDK; DEIEEEDYA; SEESIKKPM; EEIRLSNRYQ; EEEDYARYYL; DEDDEDDEYY; YEMKEESPGL; NEIDITIDSD; EEESLKTELL; EEIRLSNRYQS; NEIDITIDSDL; YEMKEESPGLF; DEIEEEDYARY; EEEDYARYYLD; KEKIQKQQDEY; KEVQYAIDKNG; DEDDEYYEDDY |
| | HLA-B5101 | LALGLLFGFI; SPGLFDKGNSI |
| | HLA-B5701 | VSVKTATNF; ISCDLFIRY; VSGKEPFIHSF; VSVKTATNFVY |

| Antigen designation | Class 2 Antigen peptide sequences |
|---|---|
| NP_212517.1 Basic membrane protein A (bmpA) [Borrelia burgdorferi B31] | 13 mers:<br>MNKILLLILLESI; NKILLLILLESIV; KILLLILLESIVF; ILLLILLESIVFL;<br>LLLILLESIVFLS; LLILLESIVFLSC; LILLESIVFLSCS; ILLESIVFLSCSG;<br>LLESIVFLSCSGK; LESIVFLSCSGKG; ESIVFLSCSGKGS; SIVFLSCSGKGSL;<br>IVFLSCSGKGSLG; VFLSCSGKGSLGS; FLSCSGKGSLGSE; LSCSGKGSLGSEI;<br>SCSGKGSLGSEIP; CSGKGSLGSEIPK; SGKGSLGSEIPKV; GKGSLGSEIPKVS;<br>KGSLGSEIPKVSL; GSLGSEIPKVSLI; SLGSEIPKVSLII; LGSEIPKVSLIID;<br>GSEIPKVSLIIDG; SEIPKVSLIIDGT; EIPKVSLIIDGTF; IPKVSLIIDGTFD;<br>PKVSLIIDGTFDD; KVSLIIDGTFDDK; VSLIIDGTFDDKS; SLIIDGTFDDKSF;<br>LIIDGTFDDKSFN; IIDGTFDDKSFNE; IDGTFDDKSFNES; DGTFDDKSFNESA;<br>GTFDDKSFNESAL; TFDDKSFNESALN; FDDKSFNESALNG; DDKSFNESALNGV;<br>DKSFNESALNGVK; KSFNESALNGVKK; SFNESALNGVKKV; FNESALNGVKKVK;<br>NESALNGVKKVKE; ESALNGVKKVKEE; SALNGVKKVKEEF; ALNGVKKVKEEFK;<br>LNGVKKVKEEFKI; NGVKKVKEEFKIE; GVKKVKEEFKIEL; VKKVKEEFKIELV;<br>KKVKEEFKIELVL; KVKEEFKIELVLK; VKEEFKIELVLKE; KEEFKIELVLKES;<br>EEFKIELVLKESS; EFKIELVLKESSS; FKIELVLKESSSN; KIELVLKESSSNS;<br>IELVLKESSSNSY; ELVLKESSSNSYL; LVLKESSSNSYLS; VLKESSSNSYLSD;<br>LKESSSNSYLSDL; KESSSNSYLSDLE; ESSSNSYLSDLEG; SSSNSYLSDLEGL;<br>SSNSYLSDLEGLK; SNSYLSDLEGLKD; NSYLSDLEGLKDA; SYLSDLEGLKDAG;<br>YLSDLEGLKDAGS; LSDLEGLKDAGSD; SDLEGLKDAGSDL; DLEGLKDAGSDLI;<br>LEGLKDAGSDLIW; EGLKDAGSDLIWL; GLKDAGSDLIWLI; LKDAGSDLIWLIG;<br>KDAGSDLIWLIGY; DAGSDLIWLIGYR; AGSDLIWLIGYRF; GSDLIWLIGYRFS;<br>SDLIWLIGYRFSD; DLIWLIGYRFSDV; LIWLIGYRFSDVA; IWLIGYRFSDVAK;<br>WLIGYRFSDVAKV; LIGYRFSDVAKVA; IGYRFSDVAKVAA; GYRFSDVAKVAAL;<br>YRFSDVAKVAALQ; RFSDVAKVAALQN; FSDVAKVAALQNP; SDVAKVAALQNPD;<br>DVAKVAALQNPDM; VAKVAALQNPDMK; AKVAALQNPDMKY; KVAALQNPDMKYA;<br>VAALQNPDMKYAI; AALQNPDMKYAII; ALQNPDMKYAIID; LQNPDMKYAIIDP;<br>QNPDMKYAIIDPI; NPDMKYAIIDPIY; PDMKYAIIDPIYS; DMKYAIIDPIYSN;<br>MKYAIIDPIYSND; KYAIIDPIYSNDP; YAIIDPIYSNDPI; AIIDPIYSNDPIP;<br>IIDPIYSNDPIPA; IDPIYSNDPIPAN; DPIYSNDPIPANL; PIYSNDPIPANLV;<br>IYSNDPIPANLVG; YSNDPIPANLVGM; SNDPIPANLVGMT; NDPIPANLVGMTF;<br>DPIPANLVGMTFR; PIPANLVGMTFRA; IPANLVGMTFRAQ; PANLVGMTFRAQE;<br>ANLVGMTFRAQEG; NLVGMTFRAQEGA; LVGMTFRAQEGAF; VGMTFRAQEGAFL;<br>GMTFRAQEGAFLT; MTFRAQEGAFLTG; TFRAQEGAFLTGY; FRAQEGAFLTGYI;<br>RAQEGAFLTGYIA; AQEGAFLTGYIAA; QEGAFLTGYIAAK; EGAFLTGYIAAKL;<br>GAFLTGYIAAKLS; AFLTGYIAAKLSK; FLTGYIAAKLSKT; LTGYIAAKLSKTG;<br>TGYIAAKLSKTGK; GYIAAKLSKTGKI; YIAAKLSKTGKIG; IAAKLSKTGKIGF;<br>AAKLSKTGKIGFL; AKLSKTGKIGFLG; KLSKTGKIGFLGG; LSKTGKIGFLGGI;<br>SKTGKIGFLGGIE; KTGKIGFLGGIEG; TGKIGFLGGIEGE; GKIGFLGGIEGEI;<br>KIGFLGGIEGEIV; IGFLGGIEGEIVD; GFLGGIEGEIVDA; FLGGIEGEIVDAF;<br>LGGIEGEIVDAFR; GGIEGEIVDAFRY; GIEGEIVDAFRYG; IEGEIVDAFRYGY;<br>EGEIVDAFRYGYE; GEIVDAFRYGYEA; EIVDAFRYGYEAG; IVDAFRYGYEAGA;<br>VDAFRYGYEAGAK; DAFRYGYEAGAKY; AFRYGYEAGAKYA; FRYGYEAGAKYAN;<br>RYGYEAGAKYANK; YGYEAGAKYANKD; GYEAGAKYANKDI; YEAGAKYANKDIK;<br>EAGAKYANKDIKI; AGAKYANKDIKIS; GAKYANKDIKIST; AKYANKDIKISTQ;<br>KYANKDIKISTQY; YANKDIKISTQYI; ANKDIKISTQYIG; NKDIKISTQYIGS;<br>KDIKISTQYIGSF; DIKISTQYIGSFA; IKISTQYIGSFAD; KISTQYIGSFADL;<br>ISTQYIGSFADLE; STQYIGSFADLEA; TQYIGSFADLEAG; QYIGSFADLEAGR;<br>YIGSFADLEAGRS; IGSFADLEAGRSV; GSFADLEAGRSVA; SFADLEAGRSVAT;<br>FADLEAGRSVATR; ADLEAGRSVATRM; DLEAGRSVATRMY; LEAGRSVATRMYS;<br>EAGRSVATRMYSD; AGRSVATRMYSDE; GRSVATRMYSDEI; RSVATRMYSDEID;<br>SVATRMYSDEIDI; VATRMYSDEIDII; ATRMYSDEIDIIH; TRMYSDEIDIIHH; |

Fig. 33 continued

| | | |
|---|---|---|
| YLSDLEGLKDAGSD; | LSDLEGLKDAGSDL; | SDLEGLKDAGSDLI; |
| DLEGLKDAGSDLIW; | LEGLKDAGSDLIWL; | EGLKDAGSDLIWLI; |
| GLKDAGSDLIWLIG; | LKDAGSDLIWLIGY; | KDAGSDLIWLIGYR; |
| DAGSDLIWLIGYRF; | AGSDLIWLIGYRFS; | GSDLIWLIGYRFSD; |
| SDLIWLIGYRFSDV; | DLIWLIGYRFSDVA; | LIWLIGYRFSDVAK; |
| IWLIGYRFSDVAKV; | WLIGYRFSDVAKVA; | LIGYRFSDVAKVAA; |
| IGYRFSDVAKVAAL; | GYRFSDVAKVAALQ; | YRFSDVAKVAALQN; |
| RFSDVAKVAALQNP; | FSDVAKVAALQNPD; | SDVAKVAALQNPDM; |
| DVAKVAALQNPDMK; | VAKVAALQNPDMKY; | AKVAALQNPDMKYA; |
| KVAALQNPDMKYAT; | VAALQNPDMKYATT; | AALQNPDMKYATTD; |
| ALQNPDMKYATTDP; | LQNPDMKYATTDPT; | QNPDMKYATTDPTY; |
| NPDMKYATTDPTYS; | PDMKYATTDPTYSN; | DMKYATTDPTYSND; |
| MKYATTDPTYSNDP; | KYATTDPTYSNDPT; | YATTDPTYSNDPTP; |
| ATTDPTYSNDPTPA; | TTDPTYSNDPTPAN; | TDPTYSNDPTPANL; |
| DPTYSNDPTPANLV; | PTYSNDPTPANLVG; | TYSNDPTPANLVGM; |
| YSNDPTPANLVGMT; | SNDPTPANLVGMTF; | NDPTPANLVGMTFR; |
| DPTPANLVGMTFRA; | PTPANLVGMTFRAQ; | TPANLVGMTFRAQF; |
| PANLVGMTFRAQFG; | ANLVGMTFRAQFGA; | NLVGMTFRAQFGAF; |
| LVGMTFRAQFGAFL; | VGMTFRAQFGAFLT; | GMTFRAQFGAFLTG; |
| MTFRAQFGAFLTGY; | TFRAQFGAFLTGYT; | FRAQFGAFLTGYTA; |
| RAQFGAFLTGYTAA; | AQFGAFLTGYTAAK; | QFGAFLTGYTAAKL; |
| FGAFLTGYTAAKLS; | GAFLTGYTAAKLSK; | AFLTGYTAAKLSKT; |
| FLTGYTAAKLSKTG; | LTGYTAAKLSKTGK; | TGYTAAKLSKTGKI; |
| GYTAAKLSKTGKIG; | YTAAKLSKTGKIGF; | TAAKLSKTGKIGFL; |
| AAKLSKTGKIGFLG; | AKLSKTGKIGFLGG; | KLSKTGKIGFLGGI; |
| LSKTGKIGFLGGIE; | SKTGKIGFLGGIEG; | KTGKIGFLGGIEGE; |
| TGKIGFLGGIEGEI; | GKIGFLGGIEGEIV; | KIGFLGGIEGEIVD; |
| IGFLGGIEGEIVDA; | GFLGGIEGEIVDAF; | FLGGIEGEIVDAFR; |
| LGGIEGEIVDAFRY; | GGIEGEIVDAFRYG; | GIEGEIVDAFRYGY; |
| IEGEIVDAFRYGYE; | EGEIVDAFRYGYEA; | GEIVDAFRYGYEAG; |
| EIVDAFRYGYEAGA; | IVDAFRYGYEAGAK; | VDAFRYGYEAGAKY; |
| DAFRYGYEAGAKYA; | AFRYGYEAGAKYAN; | FRGYEAGAKYANK; |
| RYGYEAGAKYANKD; | YGYEAGAKYANKDI; | GYEAGAKYANKDIK; |
| YEAGAKYANKDIKI; | EAGAKYANKDIKIS; | AGAKYANKDIKIST; |
| GAKYANKDIKISTQ; | AKYANKDIKISTQY; | KYANKDIKISTQYI; |
| YANKDIKISTQYIG; | ANKDIKISTQYIGS; | NKDIKISTQYIGSF; |
| KDIKISTQYIGSFA; | DIKISTQYIGSFAD; | IKISTQYIGSFADL; |
| KISTQYIGSFADLE; | ISTQYIGSFADLEA; | STQYIGSFADLEAG; |
| TQYIGSFADLEAGR; | QYIGSFADLEAGRS; | YIGSFADLEAGRSV; |
| IGSFADLEAGRSVA; | GSFADLEAGRSVAT; | SFADLEAGRSVATR; |
| FADLEAGRSVATRM; | ADLEAGRSVATRMY; | DLEAGRSVATRMYS; |
| LEAGRSVATRMYSD; | EAGRSVATRMYSDF; | AGRSVATRMYSDFI; |
| GRSVATRMYSDFIR; | RSVATRMYSDFIRT; | SVATRMYSDFIRTT; |
| VATRMYSDFIRTTH; | ATRMYSDFIRTTHH; | TRMYSDFIRTTHHA; |
| RMYSDFIRTTHHAA; | MYSDFIRTTHHAAG; | YSDFIRTTHHAAGL; |
| SDFIRTTHHAAGLG; | DFIRTTHHAAGLGG; | FIRTTHHAAGLGGT; |
| IRTTHHAAGLGGTG; | RTTHHAAGLGGTGA; | TTHHAAGLGGTGAT; |
| THHAAGLGGTGATF; | HHAAGLGGTGATFV; | HAAGLGGTGATFVA; |
| AAGLGGTGATFVAK; | AGLGGTGATFVAKF; | GLGGTGATFVAKFL; |
| LGGTGATFVAKFLG; | GGTGATFVAKFLGS; | GTGATFVAKFLGSG; |
| TGATFVAKFLGSGH; | GATFVAKFLGSGHY; | ATFVAKFLGSGHYT; |
| TFVAKFLGSGHYTT; | FVAKFLGSGHYTTG; | VAKFLGSGHYTTGV; |
| AKFLGSGHYTTGVD; | KFLGSGHYTTGVDF; | FLGSGHYTTGVDFD; |
| LGSGHYTTGVDFDQ; | GSGHYTTGVDFDQA; | SGHYTTGVDFDQAY; |
| GHYTTGVDFDQAYL; | HYTTGVDFDQAYLA; | YTTGVDFDQAYLAP; |
| TTGVDFDQAYLAPD; | TGVDFDQAYLAPDN; | GVDFDQAYLAPDNV; |
| VDFDQAYLAPDNVI; | DFDQAYLAPDNVIT; | FDQAYLAPDNVITS; |

Fig. 33 continued

DQAYLAPDNVIIST; QAYLAPDNVITSTT; AYLAPDNVITSTTK;
YLAPDNVITSTTKD; LAPDNVITSTTKDV; APDNVITSTTKDVG;
PDNVITSTTKDVGR; DNVITSTTKDVGRA; NVITSTTKDVGRAL;
VITSTTKDVGRALN; ITSTTKDVGRALNI; TSTTKDVGRALNIF;
STTKDVGRALNIFT; TTKDVGRALNIFTS; TKDVGRALNIFTSN;
KDVGRALNIFTSNH; DVGRALNIFTSNHL; VGRALNIFTSNHLK;
GRALNIFTSNHLKT; RALNIFTSNHLKTN; ALNIFTSNHLKTNT;
LNIFTSNHLKTNTF; NIFTSNHLKTNTFP; IFTSNHLKTNTFPG;
FTSNHLKTNTFPGG; TSNHLKTNTFPGGK; SNHLKTNTFPGGKL;
NHLKTNTFPGGKLT; HLKTNTFPGGKLTN; LKTNTFPGGKLTNY;
KTNTFPGGKLTNYG; TNTFPGGKLTNYGL; NTFPGGKLTNYGLK;
TFPGGKLTNYGLKF; FPGGKLTNYGLKFG; PGGKLTNYGLKFGV;
GGKLTNYGLKFGVV; GKLTNYGLKFGVVG; KLTNYGLKFGVVGF;
LTNYGLKFGVVGFV; TNYGLKFGVVGFVR; NYGLKFGVVGFVRN;
YGLKFGVVGFVRNP; GLKFGVVGFVRNPK; LKFGVVGFVRNPKM;
KFGVVGFVRNPKMT; FGVVGFVRNPKMTS; GVVGFVRNPKMTSF;
VVGFVRNPKMTSFE; VGFVRNPKMTSFEL; GFVRNPKMTSFELE;
FVRNPKMTSFELEK; VRNPKMTSFELEKF; RNPKMTSFELEKFT;
NPKMTSFELEKFTD; PKMTSFELEKFTDN; KMTSFELEKFTDNL;
MTSFELEKFTDNLS; TSFELEKFTDNLSS; SFELEKFTDNLSSK;
FELEKFTDNLSSKT; ELEKFTDNLSSKTT; LEKFTDNLSSKTTN;
EKFTDNLSSKTTNK; KFTDNLSSKTTNKE; FTDNLSSKTTNKEI;
TDNLSSKTTNKEIT; DNLSSKTTNKEITV; NLSSKTTNKEITVP;
LSSKTTNKEITVPG; SSKTTNKEITVPGN; SKTTNKEITVPGNK;
KTTNKEITVPGNKE; TTNKEITVPGNKES; TNKEITVPGNKESY;
NKEITVPGNKESYE; KEITVPGNKESYEK; EITVPGNKESYEKF;
ITVPGNKESYEKFL; TVPGNKESYEKFLK; VPGNKESYEKFLKF;
PGNKESYEKFLKFF; GNKESYEKFLKFFL;

15 mers:
MNKILLLILLESIVF; NKILLLILLESIVFL; KILLLILLESIVFLS;
ILLLILLESIVFLSG; LLLILLESIVFLSGG; LLILLESIVFLSGGK;
LILLESIVFLSGGKG; ILLESIVFLSGGKGS; LLESIVFLSGGKGSL;
LESIVFLSGGKGSLG; ESIVFLSGGKGSLGS; SIVFLSGGKGSLGSE;
IVFLSGGKGSLGSEI; VFLSGGKGSLGSEIP; FLSGGKGSLGSEIPK;
LSGGKGSLGSEIPKV; SGGKGSLGSEIPKVS; GGKGSLGSEIPKVSL;
GKGSLGSEIPKVSLI; KGSLGSEIPKVSLII; GSLGSEIPKVSLIID;
SLGSEIPKVSLIIDG; LGSEIPKVSLIIDGT; GSEIPKVSLIIDGTF;
SEIPKVSLIIDGTFD; EIPKVSLIIDGTFDD; IPKVSLIIDGTFDDK;
PKVSLIIDGTFDDKS; KVSLIIDGTFDDKSF; VSLIIDGTFDDKSFN;
SLIIDGTFDDKSFNE; LIIDGTFDDKSFNES; IIDGTFDDKSFNESA;
IDGTFDDKSFNESAL; DGTFDDKSFNESALN; GTFDDKSFNESALNG;
TFDDKSFNESALNGV; FDDKSFNESALNGVK; DDKSFNESALNGVKK;
DKSFNESALNGVKKV; KSFNESALNGVKKVE; SFNESALNGVKKVEF;
FNESALNGVKKVEFF; NESALNGVKKVEFFK; ESALNGVKKVEFFKT;
SALNGVKKVEFFKTI; ALNGVKKVEFFKTIL; LNGVKKVEFFKTILV;
NGVKKVEFFKTILVL; GVKKVEFFKTILVLK; VKKVEFFKTILVLKF;
KKVEFFKTILVLKFS; KVEFFKTILVLKFSS; VEFFKTILVLKFSSS;
EFFKTILVLKFSSSN; FFKTILVLKFSSSNS; FKTILVLKFSSSNSY;
KTILVLKFSSSNSYL; TILVLKFSSSNSYLS; ILVLKFSSSNSYLSD;
LVLKFSSSNSYLSDL; VLKFSSSNSYLSDLF; LKFSSSNSYLSDLFG;
KFSSSNSYLSDLFGL; FSSSNSYLSDLFGLK; SSSNSYLSDLFGLKD;
SSNSYLSDLFGLKDA; SNSYLSDLFGLKDAQ; NSYLSDLFGLKDAQS;
SYLSDLFGLKDAQSD; YLSDLFGLKDAQSDL; LSDLFGLKDAQSDLT;
SDLFGLKDAQSDLTW; DLFGLKDAQSDLTWL; LFGLKDAQSDLTWLT;
FGLKDAQSDLTWLTG; GLKDAQSDLTWLTGY; LKDAQSDLTWLTGYR; KDAQSDLTWLTGYRS;

Fig. 33 continued

| | | |
|---|---|---|
| DAGSDLIWLIGYRFS; | AGSDLIWLIGYRFSD; | GSDLIWLIGYRFSDV; |
| SDLIWLIGYRFSDVA; | DLIWLIGYRFSDVAK; | LIWLIGYRFSDVAKV; |
| IWLIGYRFSDVAKVA; | WLIGYRFSDVAKVAA; | LIGYRFSDVAKVAAL; |
| IGYRFSDVAKVAALQ; | GYRFSDVAKVAALQN; | YRFSDVAKVAALQNP; |
| RFSDVAKVAALQNPD; | FSDVAKVAALQNPDM; | SDVAKVAALQNPDMK; |
| DVAKVAALQNPDMKY; | VAKVAALQNPDMKYA; | AKVAALQNPDMKYAT; |
| KVAALQNPDMKYATI; | VAALQNPDMKYATIP; | AALQNPDMKYATIDP; |
| ALQNPDMKYATIDPT; | LQNPDMKYATIDPTY; | QNPDMKYATIDPTYS; |
| NPDMKYATIDPTYSN; | PDMKYATIDPTYSND; | DMKYATIDPTYSNDP; |
| MKYATIDPTYSNDPT; | KYATIDPTYSNDPTP; | YATIDPTYSNDPTPA; |
| ATIDPTYSNDPTPAN; | TIDPTYSNDPTPANL; | IDPTYSNDPTPANLV; |
| DPTYSNDPTPANLVQ; | PTYSNDPTPANLVQM; | TYSNDPTPANLVQMT; |
| YSNDPTPANLVQMTF; | SNDPTPANLVQMTFR; | NDPTPANLVQMTFRA; |
| DPTPANLVQMTFRAQ; | PTPANLVQMTFRAQE; | TPANLVQMTFRAQEC; |
| PANLVQMTFRAQECA; | ANLVQMTFRAQECAF; | NLVQMTFRAQECAFL; |
| LVQMTFRAQECAFLT; | VQMTFRAQECAFLTC; | QMTFRAQECAFLTCY; |
| MTFRAQECAFLTCYT; | TFRAQECAFLTCYTA; | FRAQECAFLTCYTAA; |
| RAQECAFLTCYTAAK; | AQECAFLTCYTAAKL; | QECAFLTCYTAAKLS; |
| ECAFLTCYTAAKLSK; | CAFLTCYTAAKLSKT; | AFLTCYTAAKLSKTG; |
| FLTCYTAAKLSKTGK; | LTCYTAAKLSKTGKI; | TCYTAAKLSKTGKIG; |
| CYTAAKLSKTGKIGF; | YTAAKLSKTGKIGFL; | TAAKLSKTGKIGFLG; |
| AAKLSKTGKIGFLGG; | AKLSKTGKIGFLGGI; | KLSKTGKIGFLGGIE; |
| LSKTGKIGFLGGIEG; | SKTGKIGFLGGIEGE; | KTGKIGFLGGIEGEI; |
| TGKIGFLGGIEGEIV; | GKIGFLGGIEGEIVD; | KIGFLGGIEGEIVDA; |
| IGFLGGIEGEIVDAF; | GFLGGIEGEIVDAFR; | FLGGIEGEIVDAFRY; |
| LGGIEGEIVDAFRYG; | GGIEGEIVDAFRYGY; | GIEGEIVDAFRYGYE; |
| IEGEIVDAFRYGYEA; | EGEIVDAFRYGYEAG; | GEIVDAFRYGYEAGA; |
| EIVDAFRYGYEAGAK; | IVDAFRYGYEAGAKY; | VDAFRYGYEAGAKYA; |
| DAFRYGYEAGAKYAN; | AFRYGYEAGAKYANK; | FRYGYEAGAKYANKD; |
| RYGYEAGAKYANKDI; | YGYEAGAKYANKDIK; | GYEAGAKYANKDIKI; |
| YEAGAKYANKDIKIS; | EAGAKYANKDIKIST; | AGAKYANKDIKISTQ; |
| GAKYANKDIKISTQY; | AKYANKDIKISTQYI; | KYANKDIKISTQYIG; |
| YANKDIKISTQYIGS; | ANKDIKISTQYIGSF; | NKDIKISTQYIGSFA; |
| KDIKISTQYIGSFAD; | DIKISTQYIGSFADL; | IKISTQYIGSFADLE; |
| KISTQYIGSFADLEA; | ISTQYIGSFADLEAG; | STQYIGSFADLEAGR; |
| TQYIGSFADLEAGRS; | QYIGSFADLEAGRSV; | YIGSFADLEAGRSVA; |
| IGSFADLEAGRSVAT; | GSFADLEAGRSVATR; | SFADLEAGRSVATRM; |
| FADLEAGRSVATRMY; | ADLEAGRSVATRMYS; | DLEAGRSVATRMYSD; |
| LEAGRSVATRMYSDF; | EAGRSVATRMYSDFI; | AGRSVATRMYSDFID; |
| GRSVATRMYSDFIDI; | RSVATRMYSDFIDII; | SVATRMYSDFIDIIH; |
| VATRMYSDFIDIIHH; | ATRMYSDFIDIIHHA; | TRMYSDFIDIIHHAA; |
| RMYSDFIDIIHHAAG; | MYSDFIDIIHHAAGL; | YSDFIDIIHHAAGLG; |
| SDFIDIIHHAAGLGG; | DFIDIIHHAAGLGGT; | FIDIIHHAAGLGGTG; |
| IDIIHHAAGLGGTGA; | DIIHHAAGLGGTGAT; | IIHHAAGLGGTGATF; |
| IHHAAGLGGTGATFV; | HHAAGLGGTGATFVA; | HAAGLGGTGATFVAK; |
| AAGLGGTGATFVAKF; | AGLGGTGATFVAKFL; | GLGGTGATFVAKFLG; |
| LGGTGATFVAKFLGS; | GGTGATFVAKFLGSG; | GTGATFVAKFLGSGE; |
| TGATFVAKFLGSGHY; | GATFVAKFLGSGHYT; | ATFVAKFLGSGHYTT; |
| TFVAKFLGSGHYTTG; | FVAKFLGSGHYTTGV; | VAKFLGSGHYTTGVD; |
| AKFLGSGHYTTGVDF; | KFLGSGHYTTGVDFD; | FLGSGHYTTGVDFDQ; |
| LGSGHYTTGVDFDQA; | GSGHYTTGVDFDQAY; | SGHYTTGVDFDQAYL; |
| GHYTTGVDFDQAYLA; | HYTTGVDFDQAYLAP; | YTTGVDFDQAYLAPD; |
| TTGVDFDQAYLAPDN; | TGVDFDQAYLAPDNV; | GVDFDQAYLAPDNVT; |
| VDFDQAYLAPDNVTT; | DFDQAYLAPDNVTTS; | FDQAYLAPDNVTTST; |
| DQAYLAPDNVTTSTT; | QAYLAPDNVTTSTTK; | AYLAPDNVTTSTTKD; |
| YLAPDNVTTSTTKDV; | LAPDNVTTSTTKDVG; | APDNVTTSTTKDVGR; |
| PDNVTTSTTKDVGRA; | DNVTTSTTKDVGRAL; | NVTTSTTKDVGRALN; |

| | | |
|---|---|---|
| IGYRFSDVAKVAALQN; | GYRFSDVAKVAALQNP; | YRFSDVAKVAALQNPD; |
| RFSDVAKVAALQNPDK; | FSDVAKVAALQNPDMK; | SDVAKVAALQNPDMKY; |
| DVAKVAALQNPDMKYA; | VAKVAALQNPDMKYAI; | AKVAALQNPDMKYAIL; |
| KVAALQNPDMKYAIIP; | VAALQNPDKKYAIIDP; | AALQNPDMKYAIIDPT; |
| ALQNPDMKYAIIDPIY; | LQNPDMKYAIIDPIYG; | QNPDMKYAIIDPIYGN; |
| NPDMKYAIIDPIYSND; | PDMKYAIIDPIYSNDP; | DMKYAIIDPIYSNDPT; |
| MKYAIIDPIYSNDPIP; | KYAIIDPIYSNDPIPA; | YAIIDPIYSNDPIPAN; |
| AIIDPIYSNDPIPANL; | IIDPIYSNDPIPANLV; | IDPIYSNDPIPANLVQ; |
| DPIYSNDPIPANLVQM; | PIYSNDPIPANLVQMT; | IYSNDPIPANLVQMTF; |
| YSNDPIPANLVQMTFR; | SNDPIPANLVQMTFRA; | NDPIPANLVQMTFRAQ; |
| DPIPANLVQMTFRAQF; | PIPANLVQMTFRAQFC; | IPANLVQMTFRAQFCA; |
| PANLVQMTFRAQFCAF; | ANLVQMTFRAQFCAFL; | NLVQMTFRAQFCAFLT; |
| LVQMTFRAQFCAFLTG; | VQMTFRAQFCAFLTGY; | QMTFRAQFCAFLTGYI; |
| MTFRAQFCAFLTGYIA; | TFRAQFCAFLTGYIAA; | FRAQFCAFLTGYIAAR; |
| RAQFCAFLTGYIAARL; | AQFCAFLTGYIAARLS; | QFCAFLTGYIAARLSK; |
| FCAFLTGYIAARLSKT; | CAFLTGYIAARLSKTQ; | AFLTGYIAARLSKTQR; |
| FLTGYIAARLSKTQRT; | LTGYIAARLSKTQRTG; | TGYIAARLSKTQRTGF; |
| GYIAARLSKTQRTGFL; | YIAARLSKTQRTGFLG; | IAARLSKTQRTGFLGG; |
| AARLSKTQRTGFLGGI; | ARLSKTQRTGFLGGIE; | RLSKTQRTGFLGGIEG; |
| LSKTQRTGFLGGIEGI; | SKTQRTGFLGGIEGIV; | KTQRTGFLGGIEGIVD; |
| TQRTGFLGGIEGIVDA; | QRTGFLGGIEGIVDAF; | RTGFLGGIEGIVDAFR; |
| TGFLGGIEGIVDAFRY; | GFLGGIEGIVDAFRYG; | FLGGIEGIVDAFRYGE; |
| LGGIEGIVDAFRYGEA; | GGIEGIVDAFRYGEAG; | GIEGIVDAFRYGEAGA; |
| IEGIVDAFRYGEAGAK; | EGIVDAFRYGEAGAKY; | GIVDAFRYGEAGAKYA; |
| IVDAFRYGEAGAKYAN; | VDAFRYGEAGAKYANK; | DAFRYGEAGAKYANKD; |
| AFRYGEAGAKYANKDI; | FRYGEAGAKYANKDIK; | RYGEAGAKYANKDIKI; |
| YGEAGAKYANKDIKIS; | GEAGAKYANKDIKIST; | EAGAKYANKDIKISTQ; |
| AGAKYANKDIKISTQY; | GAKYANKDIKISTQYI; | AKYANKDIKISTQYIG; |
| KYANKDIKISTQYIGS; | YANKDIKISTQYIGSF; | ANKDIKISTQYIGSFA; |
| NKDIKISTQYIGSFAD; | KDIKISTQYIGSFADL; | DIKISTQYIGSFADLE; |
| IKISTQYIGSFADLEA; | KISTQYIGSFADLEAG; | ISTQYIGSFADLEAGR; |
| STQYIGSFADLEAGRS; | TQYIGSFADLEAGRSV; | QYIGSFADLEAGRSVA; |
| YIGSFADLEAGRSVAT; | IGSFADLEAGRSVATR; | GSFADLEAGRSVATRM; |
| SFADLEAGRSVATRMY; | FADLEAGRSVATRMYS; | ADLEAGRSVATRMYSD; |
| DLEAGRSVATRMYSDE; | LEAGRSVATRMYSDEI; | EAGRSVATRMYSDEID; |
| AGRSVATRMYSDEIDI; | GRSVATRMYSDEIDII; | RSVATRMYSDEIDIIH; |
| SVATRMYSDEIDIIHH; | VATRMYSDEIDIIHHA; | ATRMYSDEIDIIHHAA; |
| TRMYSDEIDIIHHAAG; | RMYSDEIDIIHHAAGL; | MYSDEIDIIHHAAGLG; |
| YSDEIDIIHHAAGLGG; | SDEIDIIHHAAGLGGI; | DEIDIIHHAAGLGGIG; |
| EIDIIHHAAGLGGIGA; | IDIIHHAAGLGGIGAT; | DIIHHAAGLGGIGATF; |
| IIHHAAGLGGIGATFV; | IHHAAGLGGIGATFVA; | HHAAGLGGIGATFVAK; |
| HAAGLGGIGATFVAKF; | AAGLGGIGATFVAKFL; | AGLGGIGATFVAKFLG; |
| GLGGIGATFVAKFLGS; | LGGIGATFVAKFLGSQ; | GGIGATFVAKFLGSQH; |
| GIGATFVAKFLGSQHY; | IGATFVAKFLGSQHYT; | GATFVAKFLGSQHYTT; |
| ATFVAKFLGSQHYTTG; | TFVAKFLGSQHYTTGV; | FVAKFLGSQHYTTGVD; |
| VAKFLGSQHYTTGVDF; | AKFLGSQHYTTGVDFD; | KFLGSQHYTTGVDFDQ; |
| FLGSQHYTTGVDFDQA; | LGSQHYTTGVDFDQAY; | GSQHYTTGVDFDQAYL; |
| SQHYTTGVDFDQAYLA; | QHYTTGVDFDQAYLAP; | HYTTGVDFDQAYLAPD; |
| YTTGVDFDQAYLAPDN; | TTGVDFDQAYLAPDNV; | TGVDFDQAYLAPDNVT; |
| GVDFDQAYLAPDNVTT; | VDFDQAYLAPDNVTTS; | DFDQAYLAPDNVTTST; | 
| FDQAYLAPDNVTTSTT; | DQAYLAPDNVTTSTTK; | QAYLAPDNVTTSTTKD; | AYLAPDNVTTSTTKDV; |
| YLAPDNVTTSTTKDVG; | LAPDNVTTSTTKDVGR; | APDNVTTSTTKDVGRA; |
| PDNVTTSTTKDVGRAL; | DNVTTSTTKDVGRALN; | NVTTSTTKDVGRALNI; |
| VTTSTTKDVGRALNIF; | TTSTTKDVGRALNIFT; | TSTTKDVGRALNIFTS; |
| STTKDVGRALNIFTSH; | TTKDVGRALNIFTSHL; | TKDVGRALNIFTSHLK; |
| KDVGRALNIFTSHLKT; | DVGRALNIFTSHLKTI; | VGRALNIFTSHLKTN; |

Fig. 33 continued

| | |
|---|---|
| | GRALNIFTSNHLKTNT; RALNIFTSNHLKTNTF; ALNIFTSNHLKTNTFE; LNIFTSNHLKTNTFEG; NIFTSNHLKTNTFEGG; IFTSNHLKTNTFEGGK; FTSNHLKTNTFEGGKL; TSNHLKTNTFEGGKLI; SNHLKTNTFEGGKLIN; NHLKTNTFEGGKLINY; HLKTNTFEGGKLINYG; LKTNTFEGGKLINYGL; KTNTFEGGKLINYGLK; TNTFEGGKLINYGLKE; NTFEGGKLINYGLKEG; TFEGGKLINYGLKEGV; FEGGKLINYGLKEGVV; EGGKLINYGLKEGVVG; GGKLINYGLKEGVVGF; GKLINYGLKEGVVGFV; KLINYGLKEGVVGFVR; LINYGLKEGVVGFVRN; INYGLKEGVVGFVRNP; NYGLKEGVVGFVRNPK; YGLKEGVVGFVRNPKM; GLKEGVVGFVRNPKMI; LKEGVVGFVRNPKMIS; KEGVVGFVRNPKMISF; EGVVGFVRNPKMISFE; GVVGFVRNPKMISFEL; VVGFVRNPKMISFELE; VGFVRNPKMISFELEK; GFVRNPKMISFELEKE; FVRNPKMISFELEKEI; VRNPKMISFELEKEID; RNPKMISFELEKEIDN; NPKMISFELEKEIDNL; PKMISFELEKEIDNLS; KMISFELEKEIDNLSS; MISFELEKEIDNLSSK; ISFELEKEIDNLSSKI; SFELEKEIDNLSSKII; FELEKEIDNLSSKIIN; ELEKEIDNLSSKIINK; LEKEIDNLSSKIINKE; EKEIDNLSSKIINKEI; KEIDNLSSKIINKEII; EIDNLSSKIINKEIIV; IDNLSSKIINKEIIVP; DNLSSKIINKEIIVPS; NLSSKIINKEIIVPSN; LSSKIINKEIIVPSNK; SSKIINKEIIVPSNKE; SKIINKEIIVPSNKES; KIINKEIIVPSNKESY; IINKEIIVPSNKESYE; INKEIIVPSNKESYEK; NKEIIVPSNKESYEKF; KEIIVPSNKESYEKFL; EIIVPSNKESYEKFLK; IIVPSNKESYEKFLKE; IVPSNKESYEKFLKEF; VPSNKESYEKFLKEFL; |
| NP_212516.1 Basic membrane protein B (bmpB) [Borrelia burgdorferi B31, SEQ ID NO: 72878-74187 | 13 mers: MRIVIFIFGILLT; RIVIFIFGILLTS; IVIFIFGILLTSC; VIFIFGILLTSCF; IFIFGILLTSCFS; FIFGILLTSCFSR; IFGILLTSCFSRN; FGILLTSCFSRNG; GILLTSCFSRNGI; ILLTSCFSRNGIE; LLTSCFSRNGIES; LTSCFSRNGIESS; TSCFSRNGIESSS; SCFSRNGIESSSK; CFSRNGIESSSKK; FSRNGIESSSKKI; SRNGIESSSKKIK; RNGIESSSKKIKI; NGIESSSKKIKIS; GIESSSKKIKISM; IESSSKKIKISML; ESSSKKIKISMLV; SSSKKIKISMLVD; SSKKIKISMLVDG; SKKIKISMLVDGV; KKIKISMLVDGVL; KIKISMLVDGVLD; IKISMLVDGVLDD; KISMLVDGVLDDK; ISMLVDGVLDDKS; SMLVDGVLDDKSF; MLVDGVLDDKSFN; LVDGVLDDKSFNS; VDGVLDDKSFNSS; DGVLDDKSFNSSA; GVLDDKSFNSSAN; VLDDKSFNSSANE; LDDKSFNSSANEA; DDKSFNSSANEAL; DKSFNSSANEALL; KSFNSSANEALLR; SFNSSANEALLRL; FNSSANEALLRLK; NSSANEALLRLKK; SSANEALLRLKKD; SANEALLRLKKDF; ANEALLRLKKDFP; NEALLRLKKDFPE; EALLRLKKDFPEN; ALLRLKKDFPENI; LLRLKKDFPENIE; LRLKKDFPENIEE; RLKKDFPENIEEV; LKKDFPENIEEVF; KKDFPENIEEVFS; KDFPENIEEVFSC; DFPENIEEVFSCA; FPENIEEVFSCAI; PENIEEVFSCAIS; ENIEEVFSCAISG; NIEEVFSCAISGV; IEEVFSCAISGVY; EEVFSCAISGVYS; EVFSCAISGVYSS; VFSCAISGVYSSY; FSCAISGVYSSYV; SCAISGVYSSYVS; CAISGVYSSYVSD; AISGVYSSYVSDL; ISGVYSSYVSDLD; SGVYSSYVSDLDN; GVYSSYVSDLDNL; VYSSYVSDLDNLK; YSSYVSDLDNLKR; SSYVSDLDNLKRN; SYVSDLDNLKRNG; YVSDLDNLKRNGS; VSDLDNLKRNGSD; SDLDNLKRNGSDL; DLDNLKRNGSDLI; LDNLKRNGSDLIW; DNLKRNGSDLIWL; NLKRNGSDLIWLV; LKRNGSDLIWLVG; KRNGSDLIWLVGY; RNGSDLIWLVGYM; NGSDLIWLVGYML; GSDLIWLVGYMLT; SDLIWLVGYMLTD; DLIWLVGYMLTDA; LIWLVGYMLTDAS; IWLVGYMLTDASL; WLVGYMLTDASLL; LVGYMLTDASLLV; VGYMLTDASLLVS; GYMLTDASLLVSS; YMLTDASLLVSSE; MLTDASLLVSSEN; LTDASLLVSSENP; TDASLLVSSENPK; DASLLVSSENPKI; ASLLVSSENPKIS; SLLVSSENPKISY; LLVSSENPKISYG; LVSSENPKISYGI; VSSENPKISYGII; SSENPKISYGIID; SENPKISYGIIDP; ENPKISYGIIDPI; NPKISYGIIDPIY; PKISYGIIDPIYG; KISYGIIDPIYGD; ISYGIIDPIYGDD; SYGIIDPIYGDDV; YGIIDPIYGDDVQ; GIIDPIYGDDVQI; IIDPIYGDDVQIP; IDPIYGDDVQIPE; DPIYGDDVQIPEN; PIYGDDVQIPENL; IYGDDVQIPENLI; YGDDVQIPENLIA; GDDVQIPENLIAV; DDVQIPENLIAVV; DVQIPENLIAVVF; VQIPENLIAVVFR; QIPENLIAVVFRV; IPENLIAVVFRVE; PENLIAVVFRVEQ; ENLIAVVFRVEQG; NLIAVVFRVEQGA; LIAVVFRVEQGAF; |

| | | |
|---|---|---|
| FSRNGIESSSKKIK; | SRNGIESSSKKIKI; | RNGIESSSKKIKIS; |
| NGIESSSKKIKISM; | GIESSSKKIKISML; | IESSSKKIKISMLV; |
| ESSSKKIKISMLVD; | SSSKKIKISMLVDG; | SSKKIKISMLVDGV; |
| SKKIKISMLVDGVL; | KKIKISMLVDGVLD; | KIKISMLVDGVLDD; |
| IKISMLVDGVLDDK; | KISMLVDGVLDDKS; | ISMLVDGVLDDKSF; |
| SMLVDGVLDDKSFN; | MLVDGVLDDKSFNS; | LVDGVLDDKSFNSS; |
| VDGVLDDKSFNSSA; | DGVLDDKSFNSSAN; | GVLDDKSFNSSANF; |
| VLDDKSFNSSANFA; | LDDKSFNSSANFAL; | DDKSFNSSANFALL; |
| DKSFNSSANFALLR; | KSFNSSANFALLRL; | SFNSSANFALLRLK; |
| FNSSANFALLRLKK; | NSSANFALLRLKKD; | SSANFALLRLKKDF; |
| SANFALLRLKKDFP; | ANFALLRLKKDFPP; | NFALLRLKKDFPPN; |
| FALLRLKKDFPPNT; | ALLRLKKDFPPNTF; | LLRLKKDFPPNTFF; |
| LRLKKDFPPNTFFV; | RLKKDFPPNTFFVF; | LKKDFPPNTFFVFS; |
| KKDFPPNTFFVFSQ; | KDFPPNTFFVFSCA; | DFPPNTFFVFSCAT; |
| FPPNTFFVFSCATS; | PPNTFFVFSCATSC; | PNTFFVFSCATSCV; |
| NTFFVFSCATSCVY; | TFFVFSCATSCVYS; | FFVFSCATSCVYSS; |
| FVFSCATSCVYSSY; | VFSCATSCVYSSYV; | FSCATSCVYSSYVS; |
| SCATSCVYSSYVSD; | CATSCVYSSYVSDL; | ATSCVYSSYVSDLD; |
| TSCVYSSYVSDLDN; | SCVYSSYVSDLDNL; | CVYSSYVSDLDLK; |
| VYSSYVSDLDNLKR; | YSSYVSDLDNLKRN; | SSYVSDLDNLKRNG; |
| SYVSDLDNLKRNGS; | YVSDLDNLKRNGSD; | VSDLDNLKRNGSDL; |
| SDLDNLKRNGSDLI; | DLDNLKRNGSDLIW; | LDNLKRNGSDLIWL; |
| DNLKRNGSDLIWLV; | NLKRNGSDLIWLVG; | LKRNGSDLIWLVGY; |
| KRNGSDLIWLVGEK; | RNGSDLIWLVGYKL; | NGSDLIWLVGYKLT; |
| GSDLIWLVGYKLTD; | SDLIWLVGYKLTDA; | DLIWLVGYKLTDAS; |
| LIWLVGYKLTDASL; | IWLVGYKLTDASLL; | WLVGYKLTDASLLV; |
| LVGYKLTDASLLVS; | VGYKLTDASLLVSS; | GYKLTDASLLVSSE; |
| YKLTDASLLVSSEN; | KLTDASLLVSSENP; | LTDASLLVSSENPK; |
| TDASLLVSSENPKI; | DASLLVSSENPKIS; | ASLLVSSENPKISY; |
| SLLVSSENPKISYG; | LLVSSENPKISYGI; | LVSSENPKISYGII; |
| VSSENPKISYGIID; | SSENPKISYGIIDP; | SENPKISYGIIDPL; |
| ENPKISYGIIDPLY; | NPKISYGIIDPLYG; | PKISYGIIDPLYGD; |
| KISYGIIDPLYGDV; | ISYGIIDPLYGDDV; | SYGIIDPLYGDDVQ; |
| YGIIDPLYGDDVQI; | GIIDPLYGDDVQIP; | IIDPLYGDDVQIPE; |
| IDPLYGDDVQIPEN; | DPLYGDDVQIPENL; | PLYGDDVQIPENLL; |
| LYGDDVQIPENLLA; | YGDDVQIPENLLAV; | GDDVQIPENLLAVV; |
| DDVQIPENLLAVVF; | DVQIPENLLAVVFR; | VQIPENLLAVVFRV; |
| QIPENLLAVVFRVE; | IPENLLAVVFRVEQ; | PENLLAVVFRVEQG; |
| ENLLAVVFRVEQGA; | NLLAVVFRVEQGAF; | LLAVVFRVEQGAFL; |
| LAVVFRVEQGAFLA; | AVVFRVEQGAFLAG; | VVFRVEQGAFLAGY; |
| VFRVEQGAFLAGYT; | FRVEQGAFLAGYTA; | RVEQGAFLAGYTAA; |
| VEQGAFLAGYTAAK; | EQGAFLAGYTAAKK; | QGAFLAGYTAAKKS; |
| GAFLAGYTAAKKSF; | AFLAGYTAAKKSFS; | FLAGYTAAKKSFSG; |
| LAGYTAAKKSFSGF; | AGYTAAKKSFSGKT; | GYTAAKKSFSGKTG; |
| YTAAKKSFSGKTGF; | TAAKKSFSGKTGFT; | AAKKSFSGKTGFTG; |
| AKKSFSGKTGFTGG; | KKSFSGKTGFTGGM; | KSFSGKTGFTGGMK; |
| SFSGKTGFTGGMKG; | FSGKTGFTGGMKGN; | SGKTGFTGGMKGNT; |
| GKTGFTGGMKGNTV; | KTGFTGGMKGNTVD; | TGFTGGMKGNTVDA; |
| GFTGGMKGNTVDAF; | FTGGMKGNTVDAFR; | TGGMKGNTVDAFRY; |
| GGMKGNTVDAFRYG; | GMKGNTVDAFRYGY; | MKGNTVDAFRYGYF; |
| KGNTVDAFRYGYFS; | GNTVDAFRYGYFSG; | NTVDAFRYGYFSGA; |
| TVDAFRYGYFSGAK; | VDAFRYGYFSGAKY; | DAFRYGYFSGAKYA; |
| AFRYGYFSGAKYAN; | FRYGYFSGAKYANK; | RYGYFSGAKYANKD; |
| YGYFSGAKYANKDT; | GYFSGAKYANKDTF; | YFSGAKYANKDTFT; |
| FSGAKYANKDTFTT; | SGAKYANKDTFTTS; | GAKYANKDTFTTSF; |
| AKYANKDTFTTSFY; | KYANKDTFTTSFYS; | YANKDTFTTSFYSN; |
| ANKDTFTTSFYSNC; | NKDTFTTSFYSNCF; | KDTFTTSFYSNCFS; |

Fig. 33 continued

DIELISEYSNSFSD; IELISEYSNSFSDV; ELISEYSNSFSDVD;
IISEYSNSFSDVDT; ISEYSNSFSDVDTG; SEYSNSFSDVDTGR;
EYSNSFSDVDTGRT; YSNSFSDVDTGRTI; SNSFSDVDTGRTIA;
NSFSD

Fig. 33 continued

EYSNSFSDVDLGRTI; YSNSFSDVDLGRTLA; SNSFSDVDLGRTIAS;
NSFSDVDTGRTIASK; SFDVDTGRTIASKMY; FSDVDTGRTIASKMY;
SDVDLGRTIASKMYS; DVDLGRTIASKMYSK; VDLGRTIASKKYSKG;
DTGRTTASKMYSKGI; TGRTTASKMYSKGID; GRTIASKMYSKGIDV;
RTIASKMYSKGIDVI; TI

Fig. 33 continued

| | |
|---|---|
| | DIGRTIASKMYSKGID; IGRTIASKMYSKGIDV; GRTIASKMYSKGIDVI;<br>RTIASKMYSKGIDVIH; TIASKMYSKGIDVIHF; IASKMYSKGIDVIHFA;<br>ASKMYSKGIDVIHFAA; SKMYSKGIDVIHFAAG; KMYSKGIDVIHFAAGL;<br>MYSKGIDVIHFAAGLA; YSKGIDVIHFAAGLAG; SKGIDVIHFAAGLAGI;<br>KGIDVIHFAAGLAGIG; GIDVIHFAAGLAGIGV; IDVIHFAAGLAGIGVI;<br>DVIHFAAGLAGIGVIE; VIHFAAGLAGIGVIET; IHFAAGLAGIGVIETA;<br>HFAAGLAGIGVIETAK; FAAGLAGIGVIETAKN; AAGLAGIGVIETAKNL;<br>AGLAGIGVIETAKNLG; GLAGIGVIETAKNLGD; LAGIGVIETAKNLGDG;<br>AGIGVIETAKNLGDGY; GIGVIETAKNLGDGYY; IGVIETAKNLGDGYYV;<br>GVIETAKNLGDGYYVI; VIETAKNLGDGYYVIG; IETAKNLGDGYYVIGA;<br>ETAKNLGDGYYVIGAD; TAKNLGDGYYVIGADQ; AKNLGDGYYVIGADQD;<br>KNLGDGYYVIGADQDQ; NLGDGYYVIGADQDQS; LGDGYYVIGADQDQSY;<br>GDGYYVIGADQDQSYL; DGYYVIGADQDQSYLA; GYYVIGADQDQSYLAP;<br>YYVIGADQDQSYLAPK; YVIGADQDQSYLAPKN; VIGADQDQSYLAPKNF;<br>IGADQDQSYLAPKNFI; GADQDQSYLAPKNFIT; ADQDQSYLAPKNFITS;<br>DQDQSYLAPKNFITSV; QDQSYLAPKNFITSVI; DQSYLAPKNFITSVIK;<br>QSYLAPKNFITSVIKN; SYLAPKNFITSVIKNI; YLAPKNFITSVIKNIG;<br>LAPKNFITSVIKNIGD; APKNFITSVIKNIGDA; PKNFITSVIKNIGDAL;<br>KNFITSVIKNIGDALY; NFITSVIKNIGDALYL; FITSVIKNIGDALYLI;<br>ITSVIKNIGDALYLIT; TSVIKNIGDALYLITG; SVIKNIGDALYLITGE;<br>VIKNIGDALYLITGEY; IKNIGDALYLITGEYI; KNIGDALYLITGEYIK;<br>NIGDALYLITGEYIKN; IGDALYLITGEYIKNN; GDALYLITGEYIKNNN;<br>DALYLITGEYIKNNNV; ALYLITGEYIKNNNVW; LYLITGEYIKNNNVWE;<br>YLITGEYIKNNNVWEG; LITGEYIKNNNVWEGG; ITGEYIKNNNVWEGGK;<br>TGEYIKNNNVWEGGKV; GEYIKNNNVWEGGKVV; EYIKNNNVWEGGKVVQ;<br>YIKNNNVWEGGKVVQM; IKNNNVWEGGKVVQMG; KNNNVWEGGKVVQMGL;<br>NNNVWEGGKVVQMGLR; NNVWEGGKVVQMGLRD; NVWEGGKVVQMGLRDG;<br>VWEGGKVVQMGLRDGV; WEGGKVVQMGLRDGVL; EGGKVVQMGLRDGVIG;<br>GGKVVQMGLRDGVIGL; GKVVQMGLRDGVIGLP; KVVQMGLRDGVIGLPN;<br>VVQMGLRDGVIGLPNA; VQMGLRDGVIGLPNAN; QMGLRDGVIGLPNANE;<br>MGLRDGVIGLPNANEF; GLRDGVIGLPNANEFE; LRDGVIGLPNANEFEY;<br>RDGVIGLPNANEFEYI; DGVIGLPNANEFEYIK; GVIGLPNANEFEYIKV;<br>VIGLPNANEFEYIKVL; IGLPNANEFEYIKVLE; GLPNANEFEYIKVLER;<br>LPNANEFEYIKVLERK; PNANEFEYIKVLERKI; NANEFEYIKVLERKII;<br>ANEFEYIKVLERKIIN; NEFEYIKVLERKIINK; EFEYIKVLERKIINKE;<br>FEYIKVLERKIINKEI; EYIKVLERKIINKEII; YIKVLERKIINKEIIV;<br>IKVLERKIINKEIIVP; KVLERKIINKEIIVPC; VLERKIINKEIIVPCN;<br>LERKIINKEIIVPCNQ; ERKIINKEIIVPCNQE; RKIINKEIIVPCNQEE;<br>KIINKEIIVPCNQEEY; IINKEIIVPCNQEEYE; INKEIIVPCNQEEYEI;<br>NKEIIVPCNQEEYEIF; KEIIVPCNQEEYEIFI; EIIVPCNQEEYEIFIK;<br>IIVPCNQEEYEIFIKQ; IVPCNQEEYEIFIKQI; VPCNQEEYEIFIKQIL;<br>PCNQEEYEIFIKQILK; CNQEEYEIFIKQILKL; |
| NP_212518.1<br>Basic membrane<br>protein C (bmpC)<br>[Borrelia<br>burgdorferi B31,<br>SEQ ID NO:<br>74188-75545 | 13 mers:<br>MKKFIFITLSLL; KKFIFITLSLLV; KFIFITLSLLVF; FIFITLSLLVFA;<br>IFITLSLLVFAC; FITLSLLVFACF; ITLSLLVFACFK; TLSLLVFACFKS;<br>LSLLVFACFKSN; SLLVFACFKSNK; LLVFACFKSNKK; LVFACFKSNKKS;<br>VFACFKSNKKSI; FACFKSNKKSIK; ACFKSNKKSIKS; CFKSNKKSIKSD;<br>FKSNKKSIKSDK; KSNKKSIKSDKV; SNKKSIKSDKVV; NKKSIKSDKVVG;<br>KKSIKSDKVVGV; KSIKSDKVVGVL; SIKSDKVVGVLA; IKSDKVVGVLAH;<br>KSDKVVGVLAHG; SDKVVGVLAHGS; DKVVGVLAHGSF; KVVGVLAHGSFY;<br>VVGVLAHGSFYD; VGVLAHGSFYDK; GVLAHGSFYDKG; VLAHGSFYDKGY;<br>LAHGSFYDKGYN; AHGSFYDKGYNQ; HGSFYDKGYNQS; GSFYDKGYNQSV;<br>SFYDKGYNQSVH; FYDKGYNQSVHD; YDKGYNQSVHDG; DKGYNQSVHDGV;<br>KGYNQSVHDGVV; GYNQSVHDGVVK; YNQSVHDGVVKL; NQSVHDGVVKLR;<br>QSVHDGVVKLRD; SVHDGVVKLRDN; |

LSYERPDIYYGIID; SYERPDIYYGIIDA; YERPDIYYGIIDAF;
FRPDIYYGIIDAFD; RPDIYYGIIDAFDY; PDIYYGIIDAFDYG;
DIYYGIIDAFDYGD; IYYGIIDAFDYGDI; YYGIIDAFDYGDIQ;
YGIIDAFDYGDIQV; GIIDAFDYGDIQVP; IIDAFDYGDIQVPK;
IDAFDYGDIQVPKN; DAFDYGDIQVPKNS; AFDYGDIQVPKNSL;
FDYGDIQVPKNSLA; DYGDIQVPKNSLAT; YGDIQVPKNSLATF;
GDIQVPKNSLATKF; DIQVPKNSLATKFR; IQVPKNSLATKFRN;
QVPKNSLATKFRNE; VPKNSLATKFRNEE; PKNSLATKFRNEEA;
KNSLATKFRNEEAA; NSLATKFRNEEAAF; SLATKFRNEEAAFL;
LATKFRNEEAAFLA; ATKFRNEEAAFLAG; TKFRNEEAAFLAGY;
KFRNEEAAFLAGYT; FRNEEAAFLAGYTA; RNEEAAFLAGYTAA;
NEEAAFLAGYTAAK; EEAAFLAGYTAAKM; EAAFLAGYTAAKMS;
AAFLAGYTAAKMSR; AFLAGYTAAKMSRK; FLAGYTAAKMSRKE;
LAGYTAAKMSRKEK; AGYTAAKMSRKEKT; GYTAAKMSRKEKTG;
YTAAKMSRKEKTGF; TAAKMSRKEKTGFL; AAKMSRKEKTGFLT;
AKMSRKEKTGFLTG; KMSRKEKTGFLTGP; MSRKEKTGFLTGPM;
SRKEKTGFLTGPMS; RKEKTGFLTGPMSE; KEKTGFLTGPMSEH;
EKTGFLTGPMSEHV; KTGFLTGPMSEHVK; TGFLTGPMSEHVKD;
GFLTGPMSEHVKDP; FLTGPMSEHVKDPK; LTGPMSEHVKDPKF;
TGPMSEHVKDPKFG; GPMSEHVKDPKFGF; PMSEHVKDPKFGFK;
MSEHVKDPKFGFKA; SEHVKDPKFGFKAG; EHVKDPKFGFKAGI;
HVKDPKFGFKAGIF; VKDPKFGFKAGIFY; KDPKFGFKAGIFYA;
DPKFGFKAGIFYAN; PKFGFKAGIFYANP; KFGFKAGIFYANPK;
FGFKAGIFYANPKL; GFKAGIFYANPKLR; FKAGIFYANPKLRL;
KAGIFYANPKLRLV; AGIFYANPKLRLVS; GIFYANPKLRLVSK;
IFYANPKLRLVSKK; FYANPKLRLVSKKA; YANPKLRLVSKKAP;
ANPKLRLVSKKAPS; NPKLRLVSKKAPSL; PKLRLVSKKAPSLF;
KLRLVSKKAPSLFD; LRLVSKKAPSLFDK; RLVSKKAPSLFDKE;
LVSKKAPSLFDKEK; VSKKAPSLFDKEKG; SKKAPSLFDKEKGK;
KKAPSLFDKEKGKA; KAPSLFDKEKGKAM; APSLFDKEKGKAMA;
PSLFDKEKGKAMAL; SLFDKEKGKAMALF; LFDKEKGKAMALFM;
FDKEKGKAMALFMY; DKEKGKAMALFMYK; KEKGKAMALFMYKE;
EKGKAMALFMYKED; KGKAMALFMYKEDK; GKAMALFMYKEDKV;
KAMALFMYKEDKVG; AMALFMYKEDKVGV; MALFMYKEDKVGVI;
ALFMYKEDKVGVIF; LFMYKEDKVGVIFP; FMYKEDKVGVIFPL;
MYKEDKVGVIFPLA; YKEDKVGVIFPLAG; KEDKVGVIFPLAGI;
EDKVGVIFPLAGIT; DKVGVIFPLAGITG; KVGVIFPLAGITGL;
VGVIFPLAGITGLG; GVIFPLAGITGLGV; VIFPLAGITGLGVY;
IFPLAGITGLGVYD; FPLAGITGLGVYDA; PLAGITGLGVYDAA;
LAGITGLGVYDAAK; AGITGLGVYDAAKE; GITGLGVYDAAKEL;
ITGLGVYDAAKELG; TGLGVYDAAKELGP; GLGVYDAAKELGPK;
LGVYDAAKELGPKY; GVYDAAKELGPKYY; VYDAAKELGPKYYV;
YDAAKELGPKYYVT; DAAKELGPKYYVTG; AAKELGPKYYVTGL;
AKELGPKYYVTGLN; KELGPKYYVTGLNQ; ELGPKYYVTGLNQD;
LGPKYYVTGLNQDQ; GPKYYVTGLNQDQS; PKYYVTGLNQDQSY;
KYYVTGLNQDQSYT; YYVTGLNQDQSYTA; YVTGLNQDQSYTAP;
VTGLNQDQSYTAPQ; TGLNQDQSYTAPQN; GLNQDQSYTAPQNV;
LNQDQSYTAPQNVT; NQDQSYTAPQNVTT; QDQSYTAPQNVTTS;
DQSYTAPQNVTTST; QSYTAPQNVTTSTT; SYTAPQNVTTSTTK;
YTAPQNVTTSTTKD; TAPQNVTTSTTKDT; APQNVTTSTTKDTG;
PQNVTTSTTKDTGK; QNVTTSTTKDTGKV; NVTTSTTKDTGKVT;
VTTSTTKDTGKVTY; TTSTTKDTGKVTYS; TSTTKDTGKVTYST;
STTKDTGKVTYSTS; TTKDTGKVTYSTSS; TKDTGKVTYSTSSF;
KDTGKVTYSTSSFY; DTGKVTYSTSSFYT; TGKVTYSTSSFYTN;
GKVTYSTSSFYTNR; KVTYSTSSFYTNRV; VTYSTSSFYTNRVF;
TYSTSSFYTNRVFK; YSTSSFYTNRVFKG; STSSFYTNRVFKGG;
TSSFYTNRVFKGGI; SSFYTNRVFKGGII; SFYTNRVFKGGIIF;

GELSVKLSYERPDIYY; DLSVKLSYERPDIYY; LSVKLSYERPDIYYG;
SVKLSYERPDIYYGT; VKLSYERPDIYYGTT; KLSYERPDIYYGTTD;
LSYERPDIYYGTTDA; SYERPDIYYGTTDAF; YERPDIYYGTTDAFD;
ERPDIYYGTTDAFDY; RPDIYYGTTDAFDYG; PDIYYGTTDAFDYGD;
DIYYGTTDAFDYGDT; IYYGTTDAFDYGDTQ; YYGTTDAFDYGDTQV;
YGTTDAFDYGDTQVP; GTTDAFDYGDTQVPK; TTDAFD

LYSISSEYINNRVFK; YSISSEYINNRVFKGG; SISSEYINNRVFKGG;
ISSEYINNRVFKGGI; SSEYINNRVFKGGII; SEYINNRVFKGGIII;
EYINNRVFKGGIIID; YINNRVFKGGIIIDR; INNRVFKGGIIIDRG;
NNRVFKGGIIIDRGL; NRVFKGGIIIDRGLK; RVFKGGIIIDRGLKE;
VFKGGIIIDRGLKEG; FKGGIIIDRGLKEGV; KGGIIIDRGLKEGVI;
GGIIIDRGLKEGVIE; GIIIDRGLKEGVIEI; IIIDRGLKEGVIEIV;
IIDRGLKEGVIEIVK; IDRGLKEGVIEIVKD; DRGLKEGVIEIVKDP;
RGLKEGVIEIVKDPD; GLKEGVIEIVKDPDV; LKEGVIEIVKDPDVL;
KEGVIEIVKDPDVLN; EGVIEIVKDPDVLNN; GVIEIVKDPDVLNNR;
VIEIVKDPDVLNNRL; IEIVKDPDVLNNRLV; EIVKDPDVLNNRLVD;
IVKDPDVLNNRLVDF; VKDPDVLNNRLVDFV; KDPDVLNNRLVDFVI;
DPDVLNNRLVDFVID; PDVLNNRLVDFVIDL; DVLNNRLVDFVIDLE;
VLNNRLVDFVIDLEN; LNNRLVDFVIDLENK; NNRLVDFVIDLENKI;
NRLVDFVIDLENKII; RLVDFVIDLENKIIS; LVDFVIDLENKIISG;
VDFVIDLENKIISGE; DFVIDLENKIISGET; FVIDLENKIISGEII;
VIDLENKIISGEIIV; IDLENKIISGEIIVP; DLENKIISGEIIVPD;
LENKIISGEIIVPDS; ENKIISGEIIVPDSF; NKIISGEIIVPDSFY;
KIISGEIIVPDSFYA; IISGEIIVPDSFYAF; ISGEIIVPDSFYAFD;
SGEIIVPDSFYAFDL; GEIIVPDSFYAFDLP; EIIVPDSFYAFDLPK;
IIVPDSFYAFDLPKS; IVPDSFYAFDLPKSK; VPDSFYAFDLPKSKI;

16 mers:
MFKRFIFITLSLLVFA; FKRFIFITLSLLVFAC; KRFIFITLSLLVFACF;
RFIFITLSLLVFACFK; FIFITLSLLVFACFKS; IFITLSLLVFACFKSN;
FITLSLLVFACFKSNK; ITLSLLVFACFKSNKK; TLSLLVFACFKSNKKS;
LSLLVFACFKSNKKSI; SLLVFACFKSNKKSIK; LLVFACFKSNKKSIKS;
LVFACFKSNKKSIKSD; VFACFKSNKKSIKSDK; FACFKSNKKSIKSDKV;
ACFKSNKKSIKSDKVV; CFKSNKKSIKSDKVVV; FKSNKKSIKSDKVVVG;
KSNKKSIKSDKVVVGV; SNKKSIKSDKVVVGVL; NKKSIKSDKVVVGVLA;
KKSIKSDKVVVGVLAH; KSIKSDKVVVGVLAHG; SIKSDKVVVGVLAHGS;
IKSDKVVVGVLAHGSF; KSDKVVVGVLAHGSFY; SDKVVVGVLAHGSFYD;
DKVVVGVLAHGSFYDK; KVVVGVLAHGSFYDKG; VVVGVLAHGSFYDKGY;
VVGVLAHGSFYDKGYN; VGVLAHGSFYDKGYNQ; GVLAHGSFYDKGYNQS;
VLAHGSFYDKGYNQSV; LAHGSFYDKGYNQSVH; AHGSFYDKGYNQSVHD;
HGSFYDKGYNQSVHDG; GSFYDKGYNQSVHDGV; SFYDKGYNQSVHDGVV;
FYDKGYNQSVHDGVVK; YDKGYNQSVHDGVVKL; DKGYNQSVHDGVVKLR;
KGYNQSVHDGVVKLRD; GYNQSVHDGVVKLRDN; YNQSVHDGVVKLRDNF;
NQSVHDGVVKLRDNFG; QSVHDGVVKLRDNFGI; SVHDGVVKLRDNFGIK;
VHDGVVKLRDNFGIKL; HDGVVKLRDNFGIKLI; DGVVKLRDNFGIKLIT;
GVVKLRDNFGIKLITK; VVKLRDNFGIKLITKS; VKLRDNFGIKLITKSL;
KLRDNFGIKLITKSLR; LRDNFGIKLITKSLRP; RDNFGIKLITKSLRPY;
DNFGIKLITKSLRPYP; NFGIKLITKSLRPYPT; FGIKLITKSLRPYPTF;
GIKLITKSLRPYPTFQ; IKLITKSLRPYPTFQK; KLITKSLRPYPTFQKR;
LITKSLRPYPTFQKRL; ITKSLRPYPTFQKRLL; TKSLRPYPTFQKRLLT;
KSLRPYPTFQKRLLTV; SLRPYPTFQKRLLTVD; LRPYPTFQKRLLTVDF;
RPYPTFQKRLLTVDFA; PYPTFQKRLLTVDFAM; YPTFQKRLLTVDFAMT;
PTFQKRLLTVDFAMTE; TFQKRLLTVDFAMTED; FQKRLLTVDFAMTEDA;
QKRLLTVDFAMTEDAY; KRLLTVDFAMTEDAYF; RLLTVDFAMTEDAYFV;
LLTVDFAMTEDAYFVQ; LTVDFAMTEDAYFVQK; TVDFAMTEDAYFVQKN;
VDFAMTEDAYFVQKNP; DFAMTEDAYFVQKNPL; FAMTEDAYFVQKNPLN;
AMTEDAYFVQKNPLNL; MTEDAYFVQKNPLNLF; TEDAYFVQKNPLNLFW;
EDAYFVQKNPLNLFWL; DAYFVQKNPLNLFWLT; AYFVQKNPLNLFWLTC;
YFVQKNPLNLFWLTCY; FVQKNPLNLFWLTCYR; VQKNPLNLFWLTCYRF;
QKNPLNLFWLTCYRFS; KNPLNLFWLTCYRFSD; NPLNLFWLTCYRFSDL;
PLNLFWLTCYRFSDLS; LNLFWLTCYRFSDLSV; NLFWLTCYRFSDLSVK;
LFWLTCYRFSDLSVKL; FWLTCYRFSDLSVKLS; WLTCYRFSDLSVKLSY;
LTCYRFSDLSVKLSYE; TCYRFSDLSVKLSYER; CYRFSDLSVKLSYERP;

Fig. 33 continued

| | | |
|---|---|---|
| YRFSDLSVKLSYERPD; | RFSDLSVKLSYERPDI; | FSDLSVKLSYERPDIY; |
| SDLSVKLSYERPDIYY; | DLSVKLSYERPDIYYG; | LSVKLSYERPDIYYGI; |
| SVKLSYERPDIYYGII; | VKLSYERPDIYYGIID; | KLSYERPDIYYGIIDA; |
| LSYERPDIYYGIIDAF; | SYERPDIYYGIIDAFD; | YERPDIYYGIIDAFDY; |
| ERPDIYYGIIDAFDYG; | RPDIYYGIIDAFDYGD; | PDIYYGIIDAFDYGDI; |
| DIYYGIIDAFDYGDIQ; | IYYGIIDAFDYGDIQV; | YYGIIDAFDYGDIQVP; |
| YGIIDAFDYGDIQVPK; | GIIDAFDYGDIQVPKN; | IIDAFDYGDIQVPKNS; |
| IDAFDYGDIQVPKNSL; | DAFDYGDIQVPKNSLA; | AFDYGDIQVPKNSLAT; |
| FDYGDIQVPKNSLATK; | DYGDIQVPKNSLATKF; | YGDIQVPKNSLATKFR; |
| GDIQVPKNSLATKFRN; | DIQVPKNSLATKFRNE; | IQVPKNSLATKFRNEE; |
| QVPKNSLATKFRNEEA; | VPKNSLATKFRNEEAA; | PKNSLATKFRNEEAAF; |
| KNSLATKFRNEEAAFL; | NSLATKFRNEEAAFLA; | SLATKFRNEEAAFLAG; |
| LATKFRNEEAAFLAGY; | ATKFRNEEAAFLAGYT; | TKFRNEEAAFLAGYTA; |
| KFRNEEAAFLAGYTAA; | FRNEEAAFLAGYTAAK; | RNEEAAFLAGYTAAKM; |
| NEEAAFLAGYTAAKMS; | EEAAFLAGYTAAKMSR; | EAAFLAGYTAAKMSRE; |
| AAFLAGYTAAKMSREK; | AFLAGYTAAKMSREKE; | FLAGYTAAKMSREKEI; |
| LAGYTAAKMSREKEIQ; | AGYTAAKMSREKEIQF; | GYTAAKMSREKEIQFL; |
| YTAAKMSREKEIQFLT; | TAAKMSREKEIQFLTQ; | AAKMSREKEIQFLTQP; |
| AKMSREKEIQFLTQPM; | KMSREKEIQFLTQPMS; | MSREKEIQFLTQPMSE; |
| SREKEIQFLTQPMSEH; | REKEIQFLTQPMSEHV; | EKEIQFLTQPMSEHVK; |
| KEIQFLTQPMSEHVKD; | EIQFLTQPMSEHVKDF; | IQFLTQPMSEHVKDFK; |
| QFLTQPMSEHVKDFKF; | FLTQPMSEHVKDFKFG; | LTQPMSEHVKDFKFGE; |
| TQPMSEHVKDFKFGEK; | QPMSEHVKDFKFGEKA; | PMSEHVKDFKFGEKAG; |
| MSEHVKDFKFGEKAGI; | SEHVKDFKFGEKAGIF; | EHVKDFKFGEKAGIFY; |
| HVKDFKFGEKAGIFYA; | VKDFKFGEKAGIFYAN; | KDFKFGEKAGIFYANP; |
| DFKFGEKAGIFYANPK; | FKFGEKAGIFYANPKL; | KFGEKAGIFYANPKLR; |
| FGEKAGIFYANPKLRL; | GEKAGIFYANPKLRLV; | EKAGIFYANPKLRLVS; |
| KAGIFYANPKLRLVSK; | AGIFYANPKLRLVSKK; | GIFYANPKLRLVSKKA; |
| IFYANPKLRLVSKKAP; | FYANPKLRLVSKKAPS; | YANPKLRLVSKKAPSL; |
| ANPKLRLVSKKAPSLF; | NPKLRLVSKKAPSLFD; | PKLRLVSKKAPSLFDK; |
| KLRLVSKKAPSLFDKE; | LRLVSKKAPSLFDKEK; | RLVSKKAPSLFDKEKG; |
| LVSKKAPSLFDKEKGK; | VSKKAPSLFDKEKGKA; | SKKAPSLFDKEKGKAM; |
| KKAPSLFDKEKGKAMA; | KAPSLFDKEKGKAMAL; | APSLFDKEKGKAMALF; |
| PSLFDKEKGKAMALFM; | SLFDKEKGKAMALFMY; | LFDKEKGKAMALFMYK; |
| FDKEKGKAMALFMYKE; | DKEKGKAMALFMYKED; | KEKGKAMALFMYKEDK; |
| EKGKAMALFMYKEDKV; | KGKAMALFMYKEDKVG; | GKAMALFMYKEDKVGV; |
| KAMALFMYKEDKVGVI; | AMALFMYKEDKVGVIF; | MALFMYKEDKVGVIFP; |
| ALFMYKEDKVGVIFPL; | LFMYKEDKVGVIFPLA; | FMYKEDKVGVIFPLAG; |
| MYKEDKVGVIFPLAGI; | YKEDKVGVIFPLAGIT; | KEDKVGVIFPLAGITG; |
| EDKVGVIFPLAGITGL; | DKVGVIFPLAGITGLG; | KVGVIFPLAGITGLGV; |
| VGVIFPLAGITGLGVY; | GVIFPLAGITGLGVYD; | VIFPLAGITGLGVYDA; |
| IFPLAGITGLGVYDAA; | FPLAGITGLGVYDAAK; | PLAGITGLGVYDAAKE; |
| LAGITGLGVYDAAKEL; | AGITGLGVYDAAKELQ; | GITGLGVYDAAKELQP; |
| ITGLGVYDAAKELQPK; | TGLGVYDAAKELQPKY; | GLGVYDAAKELQPKYY; |
| LGVYDAAKELQPKYYV; | GVYDAAKELQPKYYVT; | VYDAAKELQPKYYVTG; |
| YDAAKELQPKYYVTGL; | DAAKELQPKYYVTGLN; | AAKELQPKYYVTGLNQ; |
| AKELQPKYYVTGLNQD; | KELQPKYYVTGLNQDQ; | ELQPKYYVTGLNQDQS; |
| LQPKYYVTGLNQDQSY; | QPKYYVTGLNQDQSYT; | PKYYVTGLNQDQSYTA; |
| KYYVTGLNQDQSYTAP; | YYVTGLNQDQSYTAPQ; | YVTGLNQDQSYTAPQN; |
| VTGLNQDQSYTAPQNV; | TGLNQDQSYTAPQNVT; | GLNQDQSYTAPQNVTT; |
| LNQDQSYTAPQNVTTS; | NQDQSYTAPQNVTTST; | QDQSYTAPQNVTTSTT; |
| DQSYTAPQNVTTSTTK; | QSYTAPQNVTTSTTKD; | SYTAPQNVTTSTTKDT; |
| YTAPQNVTTSTTKDTG; | TAPQNVTTSTTKDTGK; | APQNVTTSTTKDTGKV; |
| PQNVTTSTTKDTGKVT; | QNVTTSTTKDTGKVTY; | NVTTSTTKDTGKVTYS; |
| VTTSTTKDTGKVTYST; | TTSTTKDTGKVTYSTS; | TSTTKDTGKVTYSTSS; |
| STTKDTGKVTYSTSSE; | TTKDTGKVTYSTSSEY; | TKDTGKVTYSTSSEYT; |
| KDTGKVTYSTSSEYIN; | DTGKVTYSTSSEYINN; | TGKVTYSTSSEYINNR; |

Fig. 33 continued

| | |
|---|---|
| | GKVIYSISSEYINNRV; KVIYSISSEYINNRVF; VIYSISSEYINNRVFK; IYSISSEYINNRVFKG; YSISSEYINNRVFKGG; SISSEYINNRVFKGGI; ISSEYINNRVFKGGII; SSEYINNRVFKGGIII; SEYINNRVFKGGIIID; EYINNRVFKGGIIIDR; YINNRVFKGGIIIDRG; INNRVFKGGIIIDRGL; NNRVFKGGIIIDRGLK; NRVFKGGIIIDRGLKE; RVFKGGIIIDRGLKEG; VFKGGIIIDRGLKEGV; FKGGIIIDRGLKEGVI; KGGIIIDRGLKEGVIE; GGIIIDRGLKEGVIEI; GIIIDRGLKEGVIEIV; IIIDRGLKEGVIEIVK; IIDRGLKEGVIEIVKD; IDRGLKEGVIEIVKDP; DRGLKEGVIEIVKDPD; RGLKEGVIEIVKDPDV; GLKEGVIEIVKDPDVL; LKEGVIEIVKDPDVLN; KEGVIEIVKDPDVLNN; EGVIEIVKDPDVLNNR; GVIEIVKDPDVLNNRL; VIEIVKDPDVLNNRLV; IEIVKDPDVLNNRLVD; EIVKDPDVLNNRLVDE; IVKDPDVLNNRLVDEV; VKDPDVLNNRLVDEVI; KDPDVLNNRLVDEVID; DPDVLNNRLVDEVIDL; PDVLNNRLVDEVIDLE; DVLNNRLVDEVIDLEN; VLNNRLVDEVIDLENK; LNNRLVDEVIDLENKI; NNRLVDEVIDLENKII; NRLVDEVIDLENKIIS; RLVDEVIDLENKIISG; LVDEVIDLENKIISGE; VDEVIDLENKIISGEI; DEVIDLENKIISGEII; EVIDLENKIISGEIIV; VIDLENKIISGEIIVP; IDLENKIISGEIIVPD; DLENKIISGEIIVPDS; LENKIISGEIIVPDSE; ENKIISGEIIVPDSEY; NKIISGEIIVPDSEYA; KIISGEIIVPDSEYAF; IISGEIIVPDSEYAFD; ISGEIIVPDSEYAFDL; SGEIVPDSEYAFDLF; GEIVPDSEYAFDLFK; EIIVPDSEYAFDLFKS; IIVPDSEYAFDLFKSK; IVPDSEYAFDLFKSKL; |
| NP_212519.1B Basic membrane protein D (bmpD) (Borrelia burgdorferi B31, SEQ ID NO: 75546-76931 | 13 mers: MDNYYEIYFLYFF; DNYYEIYFLYFFI; NYYEIYFLYFFIK; YYEIYFLYFFIKS; YEIYFLYFFIKSK; EIYFLYFFIKSKE; IYFLYFFIKSKED; YFLYFFIKSKEDI; FLYFFIKSKEDIF; LYFFIKSKEDIFM; YFFIKSKEDIFML; FFIKSKEDIFMLK; FIKSKEDIFMLKK; IKSKEDIFMLKKV; KSKEDIFMLKKVY; SKEDIFMLKKVYY; KEDIFMLKKVYYF; EDIFMLKKVYYFL; DIFMLKKVYYFLI; IFMLKKVYYFLIF; FMLKKVYYFLIFL; MLKKVYYFLIFLF; LKKVYYFLIFLFI; KKVYYFLIFLFIV; KVYYFLIFLFIVA; VYYFLIFLFIVAC; YYFLIFLFIVACS; YFLIFLFIVACSS; FLIFLFIVACSSS; LIFLFIVACSSSD; IFLFIVACSSSDD; FLFIVACSSSDDG; LFIVACSSSDDGK; FIVACSSSDDGKS; IVACSSSDDGKSE; VACSSSDDGKSEA; ACSSSDDGKSEAK; CSSSDDGKSEAKT; SSSDDGKSEAKTV; SSDDGKSEAKTVS; SDDGKSEAKTVSL; DDGKSEAKTVSLI; DGKSEAKTVSLIV; GKSEAKTVSLIVD; KSEAKTVSLIVDG; SEAKTVSLIVDGA; EAKTVSLIVDGAF; AKTVSLIVDGAFD; KTVSLIVDGAFDD; TVSLIVDGAFDDK; VSLIVDGAFDDKG; SLIVDGAFDDKGF; LIVDGAFDDKGFN; IVDGAFDDKGFNE; VDGAFDDKGFNES; DGAFDDKGFNESS; GAFDDKGFNESSS; AFDDKGFNESSSK; FDDKGFNESSSKA; DDKGFNESSSKAI; DKGFNESSSKAIR; KGFNESSSKAIRK; GFNESSSKAIRKL; FNESSSKAIRKLK; NESSSKAIRKLKA; ESSSKAIRKLKAD; SSSKAIRKLKADL; SSKAIRKLKADLN; SKAIRKLKADLNI; KAIRKLKADLNIN; AIRKLKADLNINI; IRKLKADLNINII; RKLKADLNINIIE; KLKADLNINIIEK; LKADLNINIIEKA; KADLNINIIEKAS; ADLNINIIEKAST; DLNINIIEKASTG; LNINIIEKASTGN; NINIIEKASTGNS; INIIEKASTGNSY; NIIEKASTGNSYL; IIEKASTGNSYLG; IEKASTGNSYLGD; EKASTGNSYLGDI; KASTGNSYLGDIA; ASTGNSYLGDIAN; STGNSYLGDIANL; TGNSYLGDIANLE; GNSYLGDIANLED; NSYLGDIANLEDG; SYLGDIANLEDGN; YLGDIANLEDGNS; LGDIANLEDGNSN; GDIANLEDGNSNL; DIANLEDGNSNLI; IANLEDGNSNLIW; ANLEDGNSNLIWG; NLEDGNSNLIWGI; LEDGNSNLIWGIG; EDGNSNLIWGIGF; DGNSNLIWGIGFR; GNSNLIWGIGFRL; NSNLIWGIGFRLS; SNLIWGIGFRLSD; NLIWGIGFRLSDI; LIWGIGFRLSDIL; IWGIGFRLSDILF; WGIGFRLSDILFQ; GIGFRLSDILFQR; IGFRLSDILFQRA; GFRLSDILFQRAS; FRLSDILFQRASE; RLSDILFQRASEN; LSDILFQRASENV; SDILFQRASENVS; DILFQRASENVSV; ILFQRASENVSVN; LFQRASENVSVNY; FQRASENVSVNYA; QRASENVSVNYAI; RASENVSVNYAII; ASENVSVNYAIIE; SENVSVNYAIIEG; ENVSVNYAIIEGV; NVSVNYAIIEGVY; VSVNYAIIEGVYD; SVNYAIIEGVYDE; VNYAIIEGVYDEI; NYAIIEGVYDEIQ; YAIIEGVYDEIQI; AIIEGVYDEIQIP; |

Fig. 33 continued

```
IEGVYDEIQIPKX;  IEGVYDEIQIPKN;  EGVYDEIQIPKNL;  GVYDEIQIPKNLL;
VYDEIQTPKNLLN;  YDEIQTPKNLLNI;  DEIQTPKNLLNIS;  EIQTPKNLLNISF;
IQIPKNLLNISFR;  QIPKNLLNISFRS;  IPKNLLNISFRSE;  PKNLLNISFRSEE;
KNLLNTSFRSEEV;  LLNTSFRSEEVA;   LNTSFRSEEVAF;   LNTSFRSEEVAFL;
NISFRSEEVAFLA;  ISFRSEEVAFLAG;  SFRSEEVAFLAGY;  FRSEEVAFLAGYF;
RSEEVAFLAGYFA;  SEEVAFLAGYFAS;  EEVAFLAGYFASK;  EVAFLAGYFASKA;
VAFLAGYFASKAS;  AFLAGYFASKASK;  FLAGYFASKASKT;  LAGYFASKASKTO;
AGYFASKASKTCK;  GYFASKASKTCKT;  YFASKASKTCKTG;  FASKASKTCKTGF;
ASKASKTCKTGFV;  SKASKTCKTGFVG;  KASKTCKTGFVGG;  ASKTCKTGFVGGV;
SKTCKTGFVGGVR;  KTCKTGFVGGVRG;  TCKTGFVGGVRGK;  CKTGFVGGVRGKV;
KTGFVGGVRGKVL;  TGFVGGVRGKVLF;  GFVGGVRGKVLFS;  FVGGVRGKVLFSF;
VGGVRGKVLFSFM;  GGVRGKVLFSFMY;  GVRGKVLFSFMYG;  VRGKVLFSFMYGY;
RGKVLFSFMYGYF;  GKVLFSFMYGYFA;  KVLFSFMYGYFAG;  VLFSFMYGYFAGA;
LFSFMYGYFAGAK;  FSFMYGYFAGAKY;  SFMYGYFAGAKYA;  FMYGYFAGAKYAN;
MYGYFAGAKYANS;  YGYFAGAKYANSN;  GYFAGAKYANSNT;  YFAGAKYANSNTK;
FAGAKYANSNTKV;  AGAKYANSNTKVV;  GAKYANSNTKVVS;  AKYANSNTKVVSQ;
KYANSNTKVVSQY;  YANSNTKVVSQYV;  ANSNTKVVSQYVG;  NSNTKVVSQYVGT;
SNTKVVSQYVGTF;  NTKVVSQYVGTFG;  TKVVSQYVGTFGD;  KVVSQYVGTFGDF;
VVSQYVGTFGDFG;  VSQYVGTFGDFGL;  SQYVGTFGDFGLG;  QYVGTFGDFGLGR;
YVGTFGDFGLGRS;  VGTFGDFGLGRST;  GTFGDFGLGRSTA;  TFGDFGLGRSTAS;
FGDFGLGRSTASN;  GDFGLGRSTASNM;  DFGLGRSTASNMY;  FGLGRSTASNMYR;
GLGRSTASNMYRD;  LGRSTASNMYRDG;  GRSTASNMYRDGV;  RSTASNMYRDGVD;
STASNMYRDGVDT;  TASNMYRDGVDTT;  ASNMYRDGVDTTF;  SNMYRDGVDTTFA;
NMYRDGVDTTFAA;  MYRDGVDTTFAAA;  YRDGVDTTFAAAG;  RDGVDTTFAAAGL;
DGVDTTFAAAGLS;  GVDTTFAAAGLSG;  VDTTFAAAGLSGI;  DTTFAAAGLSGIG;
TTFAAAGLSGIGV;  TFAAAGLSGIGVI;  FAAAGLSGIGVIE;  AAAGLSGIGVIEA;
AAGLSGIGVIEAA;  AGLSGIGVIEAAK;  GLSGIGVIEAAKE;  LSGIGVIEAAKEL;
SGIGVIEAAKELG;  GIGVIEAAKELGP;  IGVIEAAKELGPD;  GVIEAAKELGPDH;
VIEAAKELGPDHY;  IEAAKELGPDHYI;  EAAKELGPDHYIL;  AAKELGPDHYILG;
AKELGPDHYILGV;  KELGPDHYILGVD;  ELGPDHYILGVDQ;  LGPDHYILGVDQQ;
GPDHYILGVDQQ;   PDHYILGVDQQSY;  DHYILGVDQQSY;   HYILGVDQQSYL;
YILGVDQQSYLA;   ILGVDQQSYLAP;   LGVDQQSYLAPN;   GVDQQSYLAPNN;
VDQQSYLAPNNV;   DQQSYLAPNNVI;   QQSYLAPNNVIV;   DQSYLAPNNVIVS;
QSYLAPNNVIVSA;  SYLAPNNVIVSAV;  YLAPNNVIVSAVK;  LAPNNVIVSAVKK;
APNNVIVSAVKKV;  PNNVIVSAVKKVD;  NNVIVSAVKKVDS;  NVIVSAVKKVDSL;
VIVSAVKKVDSLM;  IVSAVKKVDSLMY;  VSAVKKVDSLMYS;  SAVKKVDSLMYSL;
AVKKVDSLMYSLT;  VKKVDSLMYSLTK;  KKVDSLMYSLTKK;  KVDSLMYSLTKKY;
VDSLMYSLTKKYL;  DSLMYSLTKKYLE;  SLMYSLTKKYLET;  LMYSLTKKYLETG;
MYSLTKKYLETGV;  YSLTKKYLETGVL;  SLTKKYLETGVLD;  LTKKYLETGVLDG;
TKKYLETGVLDGG;  KKYLETGVLDGGK;  KYLETGVLDGGKT;  YLETGVLDGGKTF;
LETGVLDGGKTMF;  ETGVLDGGKTMFL;  TGVLDGGKTMFLG;  GVLDGGKTMFLGL;
VLDGGKTMFLGLK;  LDGGKTMFLGLKR;  DGGKTMFLGLKRD;  GGKTMFLGLKRDG;
GKTMFLGLKRDGL;  KTMFLGLKRDGLG;  TMFLGLKRDGLGL;  MFLGLKRDGLGLV;
FLGLKRDGLGLVL;  LGLKRDGLGLVLN;  GLKRDGLGLVLNF;  LKRDGLGLVLNFN;
KRDGLGLVLNFNL;  RDGLGLVLNFNLK;  DGLGLVLNFNLKS;  GLGLVLNFNLKSN;
LGLVLNFNLKSNY;  GLVLNFNLKSNYS;  LVLNFNLKSNYSF;  VLNFNLKSNYSFT;
LNFNLKSNYSFTY;  NFNLKSNYSFTYN;  FNLKSNYSFTYNK;  NLKSNYSFTYNKS;
LKSNYSFTYNKSL;  KSNYSFTYNKSLK;  SNYSFTYNKSLKT;  NYSFTYNKSLKTQ;
YSFTYNKSLKTQQ;  SFTYNKSLKTQQS;  FTYNKSLKTQQST;  TYNKSLKTQQSTM;
YNKSLKTQQSTMN;  NKSLKTQQSTMNG;  KSLKTQQSTMNGT;  SLKTQQSTMNGTT;
LKTQQSTMNGTTK;  KTQQSTMNGTTKV;  TQQSTMNGTTKVP;  QQSTMNGTTKVPY;
QSTMNGTTKVPYD;  STMNGTTKVPYDK;  TMNGTTKVPYDKV;  MNGTTKVPYDKVS;
NGTTKVPYDKVSY;  GTTKVPYDKVSYF;  TTKVPYDKVSYFV;  TKVPYDKVSYFVL;
KVPYDKVSYFVLQ;  VPYDKVSYFVLQM;  PYDKVSYFVLQMF;  YDKVSYFVLQMFN;

14 mers:
NDNYRLYFLYFFI;  DNYRLYFLYFFIK;  NYRLYFLYFFIKS;
```

Fig. 33 continued

YYLYFLYFFIKSKE; YLYFLYFFIKSKED; LYFLYFFIKSKEDI; YFLYFFIKSKEDIF; FLYFFIKSKEDIFM; LYFFIKSKEDIFML; YFFIKSKEDIFMLK; FFIKSKEDIFMLKK; FIKSKEDIFMLKKV; IKSKEDIFMLKKVY; KSKEDIFMLKKVYY; SKEDIFMLKKVYYF; KEDIFMLKKVYYFL; EDIFMLKKVYYFLI; DIFMLKKVYYFLIF; IFMLKKVYYFLIFL; FMLKKVYYFLIFLF; MLKKVYY

| | | |
|---|---|---|
| GFVGGVRGKVLESF; | FVGGVRGKVLESFM; | VGGVRGKVLESFMY; |
| GGVRGKVLESFMYG; | GVRGKVLESFMYGY; | VRGKVLESFMYGYF; |
| RGKVLESFMYGYFA; | GKVLESFMYGYFAG; | KVLESFMYGYFAGA; |
| VLESFMYGYFAGAK; | LESFMYGYFAGAKY; | ESFMYGYFAGAKYA; |
| SFMYGYFAGAKYAN; | FMYGYFAGAKYANS; | MYGYFAGAKYANSN; |
| YGYFAGAKYANSNT; | GYFAGAKYANSNTK; | YFAGAKYANSNTKV; |
| FAGAKYANSNTKVV; | AGAKYANSNTKVVS; | GAKYANSNTKVVSQ; |
| AKYANSNTKVVSQY; | KYANSNTKVVSQYV; | YANSNTKVVSQYVG; |
| ANSNTKVVSQYVGT; | NSNTKVVSQYVGTF; | SNTKVVSQYVGTFG; |
| NTKVVSQYVGTFGD; | TKVVSQYVGTFGDF; | KVVSQYVGTFGDFG; |
| VVSQYVGTFGDFGL; | VSQYVGTFGDFGLG; | SQYVGTFGDFGLGR; |
| QYVGTFGDFGLGRS; | YVGTFGDFGLGRST; | VGTFGDFGLGRSTA; |
| GTFGDFGLGRSTAS; | TFGDFGLGRSTASN; | FGDFGLGRSTASNM; |
| GDFGLGRSTASNMY; | DFGLGRSTASNMYR; | FGLGRSTASNMYRD; |
| GLGRSTASNMYRDG; | LGRSTASNMYRDGV; | GRSTASNMYRDGVD; |
| RSTASNMYRDGVDT; | STASNMYRDGVDTT; | TASNMYRDGVDTTF; |
| ASNMYRDGVDTTFA; | SNMYRDGVDTTFAA; | NMYRDGVDTTFAAA; |
| MYRDGVDTTFAAAG; | YRDGVDTTFAAAGL; | RDGVDTTFAAAGLS; |
| DGVDTTFAAAGLSG; | GVDTTFAAAGLSGT; | VDTTFAAAGLSGTG; |
| DTTFAAAGLSGTGV; | TTFAAAGLSGTGVT; | TFAAAGLSGTGVTF; |
| FAAAGLSGTGVTFA; | AAAGLSGTGVTFAA; | AAGLSGTGVTFAAK; |
| AGLSGTGVTFAAKE; | GLSGTGVTFAAKEL; | LSGTGVTFAAKELG; |
| SGTGVTFAAKELGP; | GTGVTFAAKELGPD; | TGVTFAAKELGPDH; |
| GVTFAAKELGPDHY; | VTFAAKELGPDHYL; | TFAAKELGPDHYLI; |
| FAAKELGPDHYLIG; | AAKELGPDHYLIGV; | AKELGPDHYLIGVD; |
| KELGPDHYLIGVDQ; | ELGPDHYLIGVDQD; | LGPDHYLIGVDQDQ; |
| GPDHYLIGVDQDQS; | PDHYLIGVDQDQSY; | DHYLIGVDQDQSYL; |
| HYLIGVDQDQSYLA; | YLIGVDQDQSYLAP; | LIGVDQDQSYLAPN; |
| IGVDQDQSYLAPNN; | GVDQDQSYLAPNNV; | VDQDQSYLAPNNVI; |
| DQDQSYLAPNNVIV; | QDQSYLAPNNVIVS; | DQSYLAPNNVIVSA; |
| QSYLAPNNVIVSAV; | SYLAPNNVIVSAVK; | YLAPNNVIVSAVKK; |
| LAPNNVIVSAVKKV; | APNNVIVSAVKKVD; | PNNVIVSAVKKVDS; |
| NNVIVSAVKKVDSL; | NVIVSAVKKVDSLM; | VIVSAVKKVDSLMY; |
| IVSAVKKVDSLMYS; | VSAVKKVDSLMYSL; | SAVKKVDSLMYSLT; |
| AVKKVDSLMYSLTK; | VKKVDSLMYSLTKK; | KKVDSLMYSLTKKY; |
| KVDSLMYSLTKKYL; | VDSLMYSLTKKYLE; | DSLMYSLTKKYLET; |
| SLMYSLTKKYLETG; | LMYSLTKKYLETGV; | MYSLTKKYLETGVL; |
| YSLTKKYLETGVLD; | SLTKKYLETGVLDG; | LTKKYLETGVLDGG; |
| TKKYLETGVLDGGK; | KKYLETGVLDGGKT; | KYLETGVLDGGKTM; |
| YLETGVLDGGKTMF; | LETGVLDGGKTMFL; | ETGVLDGGKTMFLG; |
| TGVLDGGKTMFLGL; | GVLDGGKTMFLGLK; | VLDGGKTMFLGLKF; |
| LDGGKTMFLGLKFD; | DGGKTMFLGLKFDG; | GGKTMFLGLKFDGL; |
| GKTMFLGLKFDGLG; | KTMFLGLKFDGLGL; | TMFLGLKFDGLGLV; |
| MFLGLKFDGLGLVN; | FLGLKFDGLGLVNF; | LGLKFDGLGLVNFN; |
| GLKFDGLGLVNFNL; | LKFDGLGLVNFNLK; | KFDGLGLVNFNLKS; |
| FDGLGLVNFNLKSN; | DGLGLVNFNLKSNY; | GLGLVNFNLKSNYS; |
| LGLVNFNLKSNYSF; | GLVNFNLKSNYSFT; | LVNFNLKSNYSFTY; |
| VNFNLKSNYSFTYN; | NFNLKSNYSFTYNK; | FNLKSNYSFTYNKS; |
| NLKSNYSFTYNKSL; | LKSNYSFTYNKSLK; | KSNYSFTYNKSLKT; |
| SNYSFTYNKSLKTQ; | NYSFTYNKSLKTQQ; | YSFTYNKSLKTQQS; |
| SFTYNKSLKTQQST; | FTYNKSLKTQQSTM; | TYNKSLKTQQSTMN; |
| YNKSLKTQQSTMNG; | NKSLKTQQSTMNGT; | KSLKTQQSTMNGTT; |
| SLKTQQSTMNGTTK; | LKTQQSTMNGTTKV; | KTQQSTMNGTTKVP; |
| TQQSTMNGTTKVPY; | QQSTMNGTTKVPYD; | QSTMNGTTKVPYDK; |
| STMNGTTKVPYDKV; | TMNGTTKVPYDKVS; | MNGTTKVPYDKVSY; |
| NGTTKVPYDKVSYF; | GTTKVPYDKVSYFV; | TTKVPYDKVSYFVL; |
| TKVPYDKVSYFVLQ; | KVPYDKVSYFVLQG; |

Fig. 33 continued

VPYDKVSYFVLQME; PYDKVSYFVLQKEN;

15 mers:
MDNYYRIYFLYFFIK; DNYYRIYFLYFFIKS; NYYRIYFLYFFIKSK;
YYRIYFLYFFIKSKE; YRIYFLYFFIKSKED; IYFLYFFIKSKEDI;
IYFLYFFIKSEDIF; YFLYFFIKSKEDIFM; FLYFFIKSKEDIFML;
LYFFIKSKEDIFMLK; YFFIKSKEDIFMLKK; FFIKSKEDIFMLKKV;
FIKSKEDIFMLKKVY; IKSKEDIFMLKKVYY; KSKEDIFMLKKVYYF;
SKEDIFMLKKVYYFL; KEDIFMLKKVYYFLT; EDIFMLKKVYYFLTF;
DIFMLKKVYYFLTFL; IFMLKKVYYFLTFLF; FMLKKVYYFLTFLFT;
MLKKVYYFLTFLFTV; LKKVYYFLTFLFTVA; KKVYYFLTFLFTVAC;
KVYYFLTFLFTVACS; VYYFLTFLFTVACSS; YYFLTFLFTVACSSS;
YFLTFLFTVACSSSD; FLTFLFTVACSSSDD; LTFLFTVACSSSDDC;
TFLFTVACSSSDDCK; FLFTVACSSSDDCKS; LFTVACSSSDDCKSF;
FTVACSSSDDCKSFA; TVACSSSDDCKSFAK; VACSSSDDCKSFAKT;
ACSSSDDCKSFAKTV; CSSSDDCKSFAKTVS; SSSDDCKSFAKTVSL;
SSDDCKSFAKTVSLT; SDDCKSFAKTVSLTV; DDCKSFAKTVSLTVD;
DCKSFAKTVSLTVDQ; CKSFAKTVSLTVDQA; KSFAKTVSLTVDQAF;
SFAKTVSLTVDQAFD; FAKTVSLTVDQAFDD; AKTVSLTVDQAFDDK;
KTVSLTVDQAFDDKG; TVSLTVDQAFDDKGF; VSLTVDQAFDDKGFN;
SLTVDQAFDDKGFNE; LTVDQAFDDKGFNES; TVDQAFDDKGFNESS;
VDQAFDDKGFNESSS; DQAFDDKGFNESSSK; QAFDDKGFNESSSKA;
AFDDKGFNESSSKAI; FDDKGFNESSSKAIR; DDKGFNESSSKAIRK;
DKGFNESSSKAIRKL; KGFNESSSKAIRKLK; GFNESSSKAIRKLKA;
FNESSSKAIRKLKAD; NESSSKAIRKLKADL; ESSSKAIRKLKADLN;
SSSKAIRKLKADLNI; SSKAIRKLKADLNII; SKAIRKLKADLNIIE;
KAIRKLKADLNIIEI; AIRKLKADLNIIEK; IRKLKADLNIIEKA;
RKLKADLNIIEKAS; KLKADLNIIEKAST; LKADLNIIEKASTG;
KADLNIIEKASTG; ADLNIIEKASTGS; DLNIIEKASTGNS;
LNIIEKASTGNSY; NIIEKASTGNSYL; IIEKASTGNSYLG;
NIEKASTGNSYLGD; IEKASTGNSYLGDI; EKASTGNSYLGDIA;
KASTGNSYLGDIAN; ASTGNSYLGDIANL; STGNSYLGDIANLE;
TGNSYLGDIANLED; GNSYLGDIANLEDG; NSYLGDIANLEDGN;
SYLGDIANLEDGNS; YLGDIANLEDGNSL; LGDIANLEDGNSLI;
GDIANLEDGNSLIW; DIANLEDGNSLIWG;
IANLEDGNSLIWGL; ANLEDGNSLIWGLG; NLEDGNSLIWGLGF;
LEDGNSLIWGLGFR; EDGNSLIWGLGFRL; DGNSLIWGLGFRLS;
GNSLIWGLGFRLSD; NSLIWGLGFRLSDI; SLIWGLGFRLSDIL;
NLIWGLGFRLSDILF; LIWGLGFRLSDILFQ; IWGLGFRLSDILFQR;
WGLGFRLSDILFQRA; GLGFRLSDILFQRAS; LGFRLSDILFQRASE;
GFRLSDILFQRASEN; FRLSDILFQRASENV; RLSDILFQRASENVS;
LSDILFQRASENVSV; SDILFQRASENVSVN; DILFQRASENVSVNY;
ILFQRASENVSVNYA; LFQRASENVSVNYAT; FQRASENVSVNYATT;
QRASENVSVNYATTE; RASENVSVNYATTEC; ASENVSVNYATTECV;
SENVSVNYATTECVY; ENVSVNYATTECVYD; NVSVNYATTECVYDF;
VSVNYATTECVYDFT; SVNYATTECVYDFTQ; VNYATTECVYDFTQT;
NYATTECVYDFTQTP; YATTECVYDFTQTPK; ATTECVYDFTQTPKN;
TTECVYDFTQTPKNL; TECVYDFTQTPKNLL; ECVYDFTQTPKNLLN;
CVYDFTQTPKNLLNT; VYDFTQTPKNLLNTS; YDFTQTPKNLLNTSF;
DFTQTPKNLLNTSFR; FTQTPKNLLNTSFRS; TQTPKNLLNTSFRSE;
QTPKNLLNTSFRSEF; TPKNLLNTSFRSEFV; PKNLLNTSFRSEFVA;
KNLLNTSFRSEFVAF; NLLNTSFRSEFVAFL; LLNTSFRSEFVAFLA;
LNTSFRSEFVAFLAC; NTSFRSEFVAFLACY; TSFRSEFVAFLACYF;
SFRSEFVAFLACYFA; FRSEFVAFLACYFAS; RSEFVAFLACYFASK;
SEFVAFLACYFASKA; EFVAFLACYFASKAS; FVAFLACYFASKASK;
VAFLACYFASKASKT; AFLACYFASKASKTG; FLACYFASKASKTGK;
LACYFASKASKTGKL; ACYFASKASKTGKLG; CYFASKASKTGKLGS;

KIGQSLNNGIIKVPY; IGQSINNGIIKVPYD; GQSINNGIIKVPYDK;
QSINNGIIKVPYDKV; SINNGIIKVPYDKVS; INNGIIKVPYDKVSY;
NNGIIKVPYDKVSYF; NGIIKVPYDKVSYFV; GIIKVPYDKVSYFVL;
IIKVPYDKVSYFVLQ; IKVPYDKVSYFVLQM; KVPYDKVSYFVLQME;
VPYDKVSYFVLQMEN;

16 mers:
MDNYYFLYFLYFFIKS; DNYYFLYFLYFFIKSK; NYYFLYFLYFFIKSKE;
YYFLYFLYFFIKSKED; YFLYFLYFFIKSKEDT; FLYFLYFFIKSKEDTF;
LYFLYFFIKSKEDTFM; YFLYFFIKSKEDTFML; LYFFIKSKEDTFMLK;
LYFFIKSKEDTFMLKK; YFFIKSKEDTFMLKKV; FFIKSKEDTFMLKKVY;
FIKSKEDTFMLKKVYY; IKSKEDTFMLKKVYYF; KSKEDTFMLKKVYYFL;
SKEDTFMLKKVYYFLT; KEDTFMLKKVYYFLTF; EDTFMLKKVYYFLTFL;
DTFMLKKVYYFLTFLF; TFMLKKVYYFLTFLFT; FMLKKVYYFLTFLFTV;
MLKKVYYFLTFLFTVA; LKKVYYFLTFLFTVAC; KKVYYFLTFLFTVACS;
KVYYFLTFLFTVACSS; VYYFLTFLFTVACSSD; YYFLTFLFTVACSSDD;
YFLTFLFTVACSSDDG; FLTFLFTVACSSDDGK; LTFLFTVACSSDDGKS;
TFLFTVACSSDDGKSE; FLFTVACSSDDGKSEA; LFTVACSSDDGKSEAK;
FTVACSSDDGKSEAKT; TVACSSDDGKSEAKTV; VACSSDDGKSEAKTVS;
ACSSDDGKSEAKTVSL; CSSDDGKSEAKTVSLI; SSDDGKSEAKTVSLIV;
SDDGKSEAKTVSLIVD; DDGKSEAKTVSLIVDG; DGKSEAKTVSLIVDGA;
GKSEAKTVSLIVDGAF; KSEAKTVSLIVDGAFD; SEAKTVSLIVDGAFDD;
EAKTVSLIVDGAFDDK; AKTVSLIVDGAFDDKG; KTVSLIVDGAFDDKGF;
TVSLIVDGAFDDKGFN; VSLIVDGAFDDKGFNE; SLIVDGAFDDKGFNES;
LIVDGAFDDKGFNESS; IVDGAFDDKGFNESSS; VDGAFDDKGFNESSSK;
DGAFDDKGFNESSSKA; GAFDDKGFNESSSKAI; AFDDKGFNESSSKAIR;
FDDKGFNESSSKAIRK; DDKGFNESSSKAIRKL; DKGFNESSSKAIRKLK;
KGFNESSSKAIRKLKA; GFNESSSKAIRKLKAD; FNESSSKAIRKLKADL;
NESSSKAIRKLKADLN; ESSSKAIRKLKADLNI; SSSKAIRKLKADLNIN;
SSKAIRKLKADLNINI; SKAIRKLKADLNINII; KAIRKLKADLNINIIE;
AIRKLKADLNINIIEK; IRKLKADLNINIIEKA; RKLKADLNINIIEKAS;
KLKADLNINIIEKAST; LKADLNINIIEKASTG; KADLNINIIEKASTGN;
ADLNINIIEKASTGNS; DLNINIIEKASTGNSY; LNINIIEKASTGNSYL;
NINIIEKASTGNSYLG; INIIEKASTGNSYLGD; NIIEKASTGNSYLGDI;
IIEKASTGNSYLGDIA; IEKASTGNSYLGDIAN; EKASTGNSYLGDIANL;
KASTGNSYLGDIANLE; ASTGNSYLGDIANLED; STGNSYLGDIANLEDG;
TGNSYLGDIANLEDGN; GNSYLGDIANLEDGNS; NSYLGDIANLEDGNSL;
SYLGDIANLEDGNSLI; YLGDIANLEDGNSLIW; LGDIANLEDGNSLIWG;
GDIANLEDGNSLIWGI; DIANLEDGNSLIWGIS; IANLEDGNSLIWGISF;
ANLEDGNSLIWGISFR; NLEDGNSLIWGISFRS; LEDGNSLIWGISFRSD;
EDGNSLIWGISFRSDT; DGNSLIWGISFRSDTL; GNSLIWGISFRSDTLF;
NSLIWGISFRSDTLFQ; SLIWGISFRSDTLFQR; LIWGISFRSDTLFQRA;
IWGISFRSDTLFQRAS; WGISFRSDTLFQRASE; GISFRSDTLFQRASEN;
ISFRSDTLFQRASENV; SFRSDTLFQRASENVS; FRSDTLFQRASENVSV;
RSDTLFQRASENVSVN; SDTLFQRASENVSVNY; DTLFQRASENVSVNYA;
TLFQRASENVSVNYAT; LFQRASENVSVNYATT; FQRASENVSVNYATTE;
QRASENVSVNYATTEG; RASENVSVNYATTEGV; ASENVSVNYATTEGVY;
SENVSVNYATTEGVYD; ENVSVNYATTEGVYDE; NVSVNYATTEGVYDET;
VSVNYATTEGVYDETQ; SVNYATTEGVYDETQT; VNYATTEGVYDETQTP;
NYATTEGVYDETQTPK; YATTEGVYDETQTPKN; ATTEGVYDETQTPKNL;
TTEGVYDETQTPKNLL; TEGVYDETQTPKNLLN; EGVYDETQTPKNLLNT;
GVYDETQTPKNLLNTS; VYDETQTPKNLLNTSF; YDETQTPKNLLNTSFR;
DETQTPKNLLNTSFRS; ETQTPKNLLNTSFRSE; TQTPKNLLNTSFRSEE;
QTPKNLLNTSFRSEEV; TPKNLLNTSFRSEEVA; PKNLLNTSFRSEEVAF;
KNLLNTSFRSEEVAFL; NLLNTSFRSEEVAFLA; LLNTSFRSEEVAFLAG;
LNTSFRSEEVAFLAGY; NTSFRSEEVAFLAGYF; TSFRSEEVAFLAGYFA;

| | |
|---|---|
| | KSNYSEIYNKSLKIGQ; SNYSEIYNKSLKIGQS; NYSEIYNKSLKIGQSI; YSEIYNKSLKIGQSIM; SEIYNKSLKIGQSIMN; EIYNKSLKIGQSIMNG; IYNKSLKIGQSIMNGI; YNKSLKIGQSIMNGII; NKSLKIGQSIMNGIIK; KSLKIGQSIMNGIIKV; SLKIGQSIMNGIIKVP; LKIGQSIMNGIIKVPY; KIGQSIMNGIIKVPYD; IGQSIMNGIIKVPYDK; GQSIMNGIIKVPYDKV; QSIMNGIIKVPYDKVS; SIMNGIIKVPYDKVSY; IMNGIIKVPYDKVSYF; MNGIIKVPYDKVSYFV; NGIIKVPYDKVSYFVL; GIIKVPYDKVSYFVLQ; IIKVPYDKVSYFVLQM; IKVPYDKVSYFVLQME; KVPYDKVSYFVLQMEN; |
| AAC70056.1 Decorin binding protein A; DbpA [Borrelia afzelii, SEQ ID NO: 76932-77557 | 13 mers:<br>MIKYNKIILTLTL; IKYNKIILTLTLL; KYNKIILTLTLLA; YNKIILTLTLLAS; NKIILTLTLLASL; KIILTLTLLASLL; IILTLTLLASLLA; ILTLTLLASLLAA; LTLTLLASLLAAC; TLTLLASLLAACS; LTLLASLLAACSL; TLLASLLAACSLT; LLASLLAACSLTG; LASLLAACSLTGK; ASLLAACSLTGKA; SLLAACSLTGKAR; LLAACSLTGKARL; LAACSLTGKARLE; AACSLTGKARLES; ACSLTGKARLESS; CSLTGKARLESSV; SLTGKARLESSVK; LTGKARLESSVKD; TGKARLESSVKDI; GKARLESSVKDIT; KARLESSVKDITN; ARLESSVKDITNE; RLESSVKDITNEI; LESSVKDITNEIE; ESSVKDITNEIEK; SSVKDITNEIEKA; SVKDITNEIEKAI; VKDITNEIEKAIK; KDITNEIEKAIKE; DITNEIEKAIKEA; ITNEIEKAIKEAE; TNEIEKAIKEAED; NEIEKAIKEAEDA; EIEKAIKEAEDAG; IEKAIKEAEDAGV; EKAIKEAEDAGVK; KAIKEAEDAGVKT; AIKEAEDAGVKTD; IKEAEDAGVKTDA; KEAEDAGVKTDAF; EAEDAGVKTDAFT; AEDAGVKTDAFTE; EDAGVKTDAFTET; DAGVKTDAFTETQ; AGVKTDAFTETQT; GVKTDAFTETQTG; VKTDAFTETQTGG; KTDAFTETQTGGK; TDAFTETQTGGKV; DAFTETQTGGKVG; AFTETQTGGKVGG; FTETQTGGKVGGS; TETQTGGKVGGSQ; ETQTGGKVGGSQI; TQTGGKVGGSQIR; QTGGKVGGSQIRA; TGGKVGGSQIRAA; GGKVGGSQIRAAK; GKVGGSQIRAAKI; KVGGSQIRAAKIR; VGGSQIRAAKIRV; GGSQIRAAKIRVA; GSQIRAAKIRVAD; SQIRAAKIRVADL; QIRAAKIRVADLT; IRAAKIRVADLTI; RAAKIRVADLTIK; AAKIRVADLTIKF; AKIRVADLTIKFL; KIRVADLTIKFLE; IRVADLTIKFLEA; RVADLTIKFLEAT; VADLTIKFLEATE; ADLTIKFLEATEE; DLTIKFLEATEEE; LTIKFLEATEEET; TIKFLEATEEETI; IKFLEATEEETIT; KFLEATEEETITF; FLEATEEETITFK; LEATEEETITFKE; EATEEETITFKEN; ATEEETITFKENG; TEEETITFKENGA; EEETITFKENGAG; EETITFKENGAGE; ETITFKENGAGEE; TITFKENGAGEED; ITFKENGAGEEDF; TFKENGAGEEDFS; FKENGAGEEDFSG; KENGAGEEDFSGI; ENGAGEEDFSGIY; NGAGEEDFSGIYD; GAGEEDFSGIYDL; AGEEDFSGIYDLI; GEEDFSGIYDLIL; EEDFSGIYDLILN; EDFSGIYDLILNA; DFSGIYDLILNAA; FSGIYDLILNAAK; SGIYDLILNAAKA; GIYDLILNAAKAV; IYDLILNAAKAVE; YDLILNAAKAVEK; DLILNAAKAVEKI; LILNAAKAVEKIG; ILNAAKAVEKIGM; LNAAKAVEKIGMQ; NAAKAVEKIGMQG; AAKAVEKIGMQGM; AKAVEKIGMQGMK; KAVEKIGMQGMKQ; AVEKIGMQGMKQA; VEKIGMQGMKQAV; EKIGMQGMKQAVE; KIGMQGMKQAVEE; IGMQGMKQAVEEA; GMQGMKQAVEEAA; MQGMKQAVEEAAK; QGMKQAVEEAAKE; GMKQAVEEAAKEK; MKQAVEEAAKEKP; KQAVEEAAKEKPK; QAVEEAAKEKPKT; AVEEAAKEKPKTT; VEEAAKEKPKTTA; EEAAKEKPKTTAD; EAAKEKPKTTADG; AAKEKPKTTADGI; AKEKPKTTADGII; KEKPKTTADGIIA; EKPKTTADGIIAI; KPKTTADGIIAIV; PKTTADGIIAIVK; KTTADGIIAIVKV; TTADGIIAIVKVM; TADGIIAIVKVMK; ADGIIAIVKVMKA; DGIIAIVKVMKAK; GIIAIVKVMKAKV; IIAIVKVMKAKVE; IAIVKVMKAKVEN; AIVKVMKAKVENI; IVKVMKAKVENIK; VKVMKAKVENIKE; KVMKAKVENIKEK; VMKAKVENIKEKQ; MKAKVENIKEKQT; KAKVENIKEKQTK; AKVENIKEKQTKN; KVENIKEKQTKNQ; VENIKEKQTKNQK;<br><br>14 mers:<br>MIKYNKIILTLTLL; IKYNKIILTLTLLA; KYNKIILTLTLLAS; YNKIILTLTLLASL; NKIILTLTLLASLL; KIILTLTLLASLLA; IILTLTLLASLLAA; ILTLTLLASLLAAC; LTLTLLASLLAACS; TLTLLASLLAACSL; LTLLASLLAACSLT; TLLASLLAACSLTG; |

AACSLTGKARLESSV; ACSLTGKARLESSVK; CSLTGKARLESSVKD;
SLTGKARLESSVKDI; LTGKARLESSVKDIT; TGKARLESSVKDITN;
GKARLESSVKDITNE; KARLESSVKDITNEI; ARLESSVKDITNEIE;
RLESSVKDITNEIEK; LESSVKDITNEIEKA; ESSVKDITNEIEKAI;
SSVKDITNEIEKAIK; SVKDITNEIEKAIKE; VKDITNEIEKAIKEA;
KDITNEIEKAIKEAE; DITNEIEKAIKEAED; ITNEIEKAIKEAEDA;
TNEIEKAIKEAEDAQ; NEIEKAIKEAEDAQV; EIEKAIKEAEDAQVK;
IEKAIKEAEDAQVKT; EKAIKEAEDAQVKTD; KAIKEAEDAQVKTDA;
AIKEAEDAQVKTDAF; IKEAEDAQVKTDAFT; KEAEDAQVKTDAFTE;
EAEDAQVKTDAFTET; AEDAQVKTDAFTETQ; EDAQVKTDAFTETQT;
DAQVKTDAFTETQTG; AQVKTDAFTETQTGG; QVKTDAFTETQTGGK;
VKTDAFTETQTGGKV; KTDAFTETQTGGKVG; TDAFTETQTGGKVGG;
DAFTETQTGGKVGGS; AFTETQTGGKVGGSQ; FTETQTGGKVGGSQT;
TETQTGGKVGGSQTR; ETQTGGKVGGSQTRA; TQTGGKVGGSQTRAA;
QTGGKVGGSQTRAAK; TGGKVGGSQTRAAKT; GGKVGGSQTRAAKTR;
GKVGGSQTRAAKTRV; KVGGSQTRAAKTRVA; VGGSQTRAAKTRVAD;
GGSQTRAAKTRVADL; GSQTRAAKTRVADLT; SQTRAAKTRVADLTT;
QTRAAKTRVADLTTK; TRAAKTRVADLTTKF; RAAKTRVADLTTKFL;
AAKTRVADLTTKFLE; AKTRVADLTTKFLEA; KTRVADLTTKFLEAT;
TRVADLTTKFLEATE; RVADLTTKFLEATEE; VADLTTKFLEATEEE;
ADLTTKFLEATEEET; DLTTKFLEATEEETI; LTTKFLEATEEETII;
TTKFLEATEEETIIE; TKFLEATEEETIIEK; KFLEATEEETIIEKE;
FLEATEEETIIEKEN; LEATEEETIIEKENG; EATEEETIIEKENGA;
ATEEETIIEKENGAG; TEEETIIEKENGAGE; EEETIIEKENGAGEE;
EETIIEKENGAGEED; ETIIEKENGAGEEDF; TIIEKENGAGEEDFS;
IIEKENGAGEEDFSG; IEKENGAGEEDFSGI; EKENGAGEEDFSGIY;
KENGAGEEDFSGIYD; ENGAGEEDFSGIYDL; NGAGEEDFSGIYDLI;
GAGEEDFSGIYDLIL; AGEEDFSGIYDLILN; GEEDFSGIYDLILNA;
EEDFSGIYDLILNAA; EDFSGIYDLILNAAK; DFSGIYDLILNAAKA;
FSGIYDLILNAAKAV; SGIYDLILNAAKAVE; GIYDLILNAAKAVEK;
IYDLILNAAKAVEKI; YDLILNAAKAVEKIG; DLILNAAKAVEKIGM;
LILNAAKAVEKIGMQ; ILNAAKAVEKIGMQG; LNAAKAVEKIGMQGM;
NAAKAVEKIGMQGMK; AAKAVEKIGMQGMKQ; AKAVEKIGMQGMKQA;
KAVEKIGMQGMKQAV; AVEKIGMQGMKQAVE; VEKIGMQGMKQAVEE;
EKIGMQGMKQAVEEA; KIGMQGMKQAVEEAA; IGMQGMKQAVEEAAK;
GMQGMKQAVEEAAKE; MQGMKQAVEEAAKEK; QGMKQAVEEAAKEKP;
GMKQAVEEAAKEKPK; MKQAVEEAAKEKPKT; KQAVEEAAKEKPKTT;
QAVEEAAKEKPKTTA; AVEEAAKEKPKTTAD; VEEAAKEKPKTTADG;
EEAAKEKPKTTADGI; EAAKEKPKTTADGII; AAKEKPKTTADGIIA;
AKEKPKTTADGIIAT; KEKPKTTADGIIATV; EKPKTTADGIIATVK;
KPKTTADGIIATVKV; PKTTADGIIATVKVM; KTTADGIIATVKVMK;
TTADGIIATVKVMKA; TADGIIATVKVMKAK; ADGIIATVKVMKAKV;
DGIIATVKVMKAKVE; GIIATVKVMKAKVEN; IIATVKVMKAKVENI;
IATVKVMKAKVENIK; ATVKVMKAKVENIKE; TVKVMKAKVENIKEK;
VKVMKAKVENIKEKQ; KVMKAKVENIKEKQT; VMKAKVENIKEKQTK;
MKAKVENIKEKQTKN; KAKVENIKEKQTKNQ; AKVENIKEKQTKNQK;

16 mers:
MIKYNKIILTLTLLAS; IKYNKIILTLTLLASL; KYNKIILTLTLLASLL;
YNKIILTLTLLASLLA; NKIILTLTLLASLLAA; KIILTLTLLASLLAAC;
IILTLTLLASLLAACS; ILTLTLLASLLAACSL; LTLTLLASLLAACSLT;
TLTLLASLLAACSLTG; LTLLASLLAACSLTGK; TLLASLLAACSLTGKA;
LLASLLAACSLTGKAR; LASLLAACSLTGKARL; ASLLAACSLTGKARLE;
SLLAACSLTGKARLES; LLAACSLTGKARLESS; LAACSLTGKARLESSV;
AACSLTGKARLESSVK; ACSLTGKARLESSVKD; CSLTGKARLESSVKDI;
SLTGKARLESSVKDIT; LTGKARLESSVKDITN; TGKARLESSVKDITNE;
GKARLESSVKDITNEI; KARLESSVKDITNEIE; ARLESSVKDITNEIEK;

Fig. 33 continued

| | |
|---|---|
| | RLESSVKDITNEIEKA; LESSVKDITNEIEKAI; ESSVKDITNEIEKAIK; SSVKDITNEIEKAIKE; SVKDITNEIEKAIKEA; VKDITNEIEKAIKEAE; KDITNEIEKAIKEAED; DITNEIEKAIKEAEDA; ITNEIEKAIKEAEDAG; TNEIEKAIKEAEDAGV; NEIEKAIKEAEDAGVK; EIEKAIKEAEDAGVKT; IEKAIKEAEDAGVKTD; EKAIKEAEDAGVKTDA; KAIKEAEDAGVKTDAF; AIKEAEDAGVKTDAFT; IKEAEDAGVKTDAFTE; KEAEDAGVKTDAFTET; EAEDAGVKTDAFTETQ; AEDAGVKTDAFTETQT; EDAGVKTDAFTETQTG; DAGVKTDAFTETQTGG; AGVKTDAFTETQTGGK; GVKTDAFTETQTGGKV; VKTDAFTETQTGGKVG; KTDAFTETQTGGKVGG; TDAFTETQTGGKVGGS; DAFTETQTGGKVGGSQ; AFTETQTGGKVGGSQI; FTETQTGGKVGGSQIR; TETQTGGKVGGSQIRA; ETQTGGKVGGSQIRAA; TQTGGKVGGSQIRAAK; QTGGKVGGSQIRAAKI; TGGKVGGSQIRAAKIR; GGKVGGSQIRAAKIRV; GKVGGSQIRAAKIRVA; KVGGSQIRAAKIRVAD; VGGSQIRAAKIRVADL; GGSQIRAAKIRVADLT; GSQIRAAKIRVADLTI; SQIRAAKIRVADLTIK; QIRAAKIRVADLTIKF; IRAAKIRVADLTIKFL; RAAKIRVADLTIKFLE; AAKIRVADLTIKFLEA; AKIRVADLTIKFLEAT; KIRVADLTIKFLEATE; IRVADLTIKFLEATEE; RVADLTIKFLEATEEE; VADLTIKFLEATEEET; ADLTIKFLEATEEETI; DLTIKFLEATEEETIT; LTIKFLEATEEETITF; TIKFLEATEEETITFK; IKFLEATEEETITFKE; KFLEATEEETITFKEN; FLEATEEETITFKENG; LEATEEETITFKENGA; EATEEETITFKENGAG; ATEEETITFKENGAGE; TEEETITFKENGAGEE; EEETITFKENGAGEED; EETITFKENGAGEEDF; ETITFKENGAGEEDFS; TITFKENGAGEEDFSG; ITFKENGAGEEDFSGI; TFKENGAGEEDFSGIY; FKENGAGEEDFSGIYD; KENGAGEEDFSGIYDL; ENGAGEEDFSGIYDLI; NGAGEEDFSGIYDLIL; GAGEEDFSGIYDLILN; AGEEDFSGIYDLILNA; GEEDFSGIYDLILNAA; EEDFSGIYDLILNAAK; EDFSGIYDLILNAAKA; DFSGIYDLILNAAKAV; FSGIYDLILNAAKAVE; SGIYDLILNAAKAVEK; GIYDLILNAAKAVEKI; IYDLILNAAKAVEKIG; YDLILNAAKAVEKIGM; DLILNAAKAVEKIGMQ; LILNAAKAVEKIGMQG; ILNAAKAVEKIGMQGM; LNAAKAVEKIGMQGMK; NAAKAVEKIGMQGMKQ; AAKAVEKIGMQGMKQA; AKAVEKIGMQGMKQAV; KAVEKIGMQGMKQAVE; AVEKIGMQGMKQAVEE; VEKIGMQGMKQAVEEA; EKIGMQGMKQAVEEAA; KIGMQGMKQAVEEAAK; IGMQGMKQAVEEAAKE; GMQGMKQAVEEAAKEK; MQGMKQAVEEAAKEKP; QGMKQAVEEAAKEKPK; GMKQAVEEAAKEKPKT; MKQAVEEAAKEKPKTT; KQAVEEAAKEKPKTTA; QAVEEAAKEKPKTTAD; AVEEAAKEKPKTTADG; VEEAAKEKPKTTADGI; EEAAKEKPKTTADGII; EAAKEKPKTTADGIIA; AAKEKPKTTADGIIAI; AKEKPKTTADGIIAIV; KEKPKTTADGIIAIVK; EKPKTTADGIIAIVKV; KPKTTADGIIAIVKVM; PKTTADGIIAIVKVMK; KTTADGIIAIVKVMKA; TTADGIIAIVKVMKAK; TADGIIAIVKVMKAKV; ADGIIAIVKVMKAKVE; DGIIAIVKVMKAKVEN; GIIAIVKVMKAKVENI; IIAIVKVMKAKVENIK; IAIVKVMKAKVENIKE; AIVKVMKAKVENIKEK; IVKVMKAKVENIKEKQ; VKVMKAKVENIKEKQT; KVMKAKVENIKEKQTK; VMKAKVENIKEKQTKN; MKAKVENIKEKQTKNQ; KAKVENIKEKQTKNQK; |
| AAC70057.1 Decorin binding protein A; DbpA [Borrelia garinii], SEQ ID NO: 77558-78247 | 13 mers: MIKYNKILLKLSL; IKYNKILLKLSLI; KYNKILLKLSLIV; YNKILLKLSLIVS; NKILLKLSLIVSL; KILLKLSLIVSLL; ILLKLSLIVSLLV; LLKLSLIVSLLVA; LKLSLIVSLLVAC; KLSLIVSLLVACG; LSLIVSLLVACGL; SLIVSLLVACGLT; LIVSLLVACGLTG; IVSLLVACGLTGE; VSLLVACGLTGET; SLLVACGLTGETK; LLVACGLTGETKI; LVACGLTGETKIR; VACGLTGETKIRL; ACGLTGETKIRLE; CGLTGETKIRLES; GLTGETKIRLESS; LTGETKIRLESSA; TGETKIRLESSAQ; GETKIRLESSAQE; ETKIRLESSAQEI; TKIRLESSAQEIK; KIRLESSAQEIKD; IRLESSAQEIKDE; RLESSAQEIKDEI; LESSAQEIKDEIN; ESSAQEIKDEINK; SSAQEIKDEINKI; SAQEIKDEINKIK; AQEIKDEINKIKA; QEIKDEINKIKAN; EIKDEINKIKANA; IKDEINKIKANAK; KDEINKIKANAKK; DEINKIKANAKKE; EINKIKANAKKEG; INKIKANAKKEGV; NKIKANAKKEGVK; KIKANAKKEGVKE; |

| | |
|---|---|
| | KISEKPEFILKAKI; ISEKPEFILKAKIK; SEKPEFILKAKIKA; EKPEFILKAKIKAT; KPEFILKAKIKATQ; PEFILKAKIKATQV; EFILKAKIKATQVA; FILKAKIKATQVAE; ILKAKIKATQVAER; LKAKIKATQVAERF; KAKIKATQVAERFV; AKIKATQVAERFVK; KIKATQVAERFVKA; IKATQVAERFVKAI; KATQVAERFVKAIK; ATQVAERFVKAIKE; TQVAERFVKAIKEE; QVAERFVKAIKEEA; VAERFVKAIKEEAE; AERFVKAIKEEAEK; ERFVKAIKEEAEKL; RFVKAIKEEAEKLK; FVKAIKEEAEKLKK; VKAIKEEAEKLKKS; KAIKEEAEKLKKSG; AIKEEAEKLKKSGS; IKEEAEKLKKSGSS; KEEAEKLKKSGSSG; EEAEKLKKSGSSGA; EAEKLKKSGSSGAF; AEKLKKSGSSGAFS; EKLKKSGSSGAFSA; KLKKSGSSGAFSAM; LKKSGSSGAFSAMY; KKSGSSGAFSAMYD; KSGSSGAFSAMYDL; SGSSGAFSAMYDLM; GSSGAFSAMYDLMT; SSGAFSAMYDLMTD; SGAFSAMYDLMTDV; GAFSAMYDLMTDVS; AFSAMYDLMTDVSK; FSAMYDLMTDVSKP; SAMYDLMTDVSKPL; AMYDLMTDVSKPLE; MYDLMTDVSKPLEE; YDLMTDVSKPLEEI; DLMTDVSKPLEEIG; LMTDVSKPLEEIGT; MTDVSKPLEEIGTQ; TDVSKPLEEIGTQK; DVSKPLEEIGTQKM; VSKPLEEIGTQKMT; SKPLEEIGTQKMTG; KPLEEIGTQKMTGT; PLEEIGTQKMTGTV; LEEIGTQKMTGTVT; EEIGTQKMTGTVTK; EIGTQKMTGTVTKE; IGTQKMTGTVTKEA; GTQKMTGTVTKEAE; TQKMTGTVTKEAEK; QKMTGTVTKEAEKT; KMTGTVTKEAEKTP; MTGTVTKEAEKTPP; TGTVTKEAEKTPPT; GTVTKEAEKTPPTT; TVTKEAEKTPPTTA; VTKEAEKTPPTTAD; TKEAEKTPPTTADG; KEAEKTPPTTADGI; EAEKTPPTTADGII; AEKTPPTTADGIIA; EKTPPTTADGIIAI; KTPPTTADGIIAIA; TPPTTADGIIAIAQ; PPTTADGIIAIAQA; PTTADGIIAIAQAM; TTADGIIAIAQAME; TADGIIAIAQAMEE; ADGIIAIAQAMEEK; DGIIAIAQAMEEKL; GIIAIAQAMEEKLN; IIAIAQAMEEKLNN; IAIAQAMEEKLNNV; AIAQAMEEKLNNVN; IAQAMEEKLNNVNK; AQAMEEKLNNVNKK; QAMEEKLNNVNKKQ; AMEEKLNNVNKKQH; MEEKLNNVNKKQHD; EEKLNNVNKKQHDA; EKLNNVNKKQHDAL; KLNNVNKKQHDALK; LNNVNKKQHDALKN; NNVNKKQHDALKNL; NVNKKQHDALKNLE; VNKKQHDALKNLEE; NKKQHDALKNLEEK; KKQHDALKNLEEKA; KQHDALKNLEEKAN; QHDALKNLEEKANT; HDALKNLEEKANTA; DALKNLEEKANTAA; ALKNLEEKANTAAT; LKNLEEKANTAATI; KNLEEKANTAATII;<br><br>15 mers:<br>MTKYNKILLKLSLIV; TKYNKILLKLSLIVS; KYNKILLKLSLIVSL; YNKILLKLSLIVSLL; NKILLKLSLIVSLLV; KILLKLSLIVSLLVA; ILLKLSLIVSLLVAC; LLKLSLIVSLLVACG; LKLSLIVSLLVACGL; KLSLIVSLLVACGLT; LSLIVSLLVACGLTG; SLIVSLLVACGLTGE; LIVSLLVACGLTGET; IVSLLVACGLTGETK; VSLLVACGLTGETKI; SLLVACGLTGETKIR; LLVACGLTGETKIRL; LVACGLTGETKIRLE; VACGLTGETKIRLES; ACGLTGETKIRLESS; CGLTGETKIRLESSA; GLTGETKIRLESSAQ; LTGETKIRLESSAQE; TGETKIRLESSAQEI; GETKIRLESSAQEIK; ETKIRLESSAQEIKD; TKIRLESSAQEIKDE; KIRLESSAQEIKDEI; IRLESSAQEIKDEIN; RLESSAQEIKDEINK; LESSAQEIKDEINKI; ESSAQEIKDEINKIK; SSAQEIKDEINKIKA; SAQEIKDEINKIKAN; AQEIKDEINKIKANA; QEIKDEINKIKANAK; EIKDEINKIKANAKK; IKDEINKIKANAKKE; KDEINKIKANAKKEG; DEINKIKANAKKEGV; EINKIKANAKKEGVK; INKIKANAKKEGVKE; NKIKANAKKEGVKEE; KIKANAKKEGVKEEA; IKANAKKEGVKEEAF; KANAKKEGVKEEAFT; ANAKKEGVKEEAFTN; NAKKEGVKEEAFTNT; AKKEGVKEEAFTNTQ; KKEGVKEEAFTNTQT; KEGVKEEAFTNTQTG; EGVKEEAFTNTQTGS; GVKEEAFTNTQTGSK; VKEEAFTNTQTGSKI; KEEAFTNTQTGSKIS; EEAFTNTQTGSKISE; EAFTNTQTGSKISEK; |

Fig. 33 continued

AFTNQTGSKISEKPF; FNTQTGSKISEKPFT; TNTQTGSKISEKPFT;
NTQTGSKISEKPFT; TQTGSKISEKPFTL; QTGSKISEKPFTLK;
TGSKISEKPFTLKA; GSKISEKPFTLKAK; SKISEKPFTLKAKI;
KISEKPFTLKAKIK; ISEKPFTLKAKIKA; SEKPFTLKAKIKAT;
EKPFTLKAKIKAIQ; KPFTLKAKIKAIQV; PFTLKAKIKAIQVA;
FTLKAKIKAIQVAF; TLKAKIKAIQVAFR; LKAKIKAIQVAFRF;
LKAKIKAIQVAFRFV; KAKIKAIQVAFRFVK; AKIKAIQVAFRFVKA;
KIKAIQVAFRFVKAT; IKAIQVAFRFVKATK; KAIQVAFRFVKATKF;
AIQVAFRFVKATKFF; IQVAFRFVKATKFFA; QVAFRFVKATKFFAF;
VAFRFVKATKFFAFK; AFRFVKATKFFAFKL; FRFVKATKFFAFKLK;
RFVKATKFFAFKLKK; FVKATKFFAFKLKKS; VKATKFFAFKLKKSG;
KATKFFAFKLKKSGG; ATKFFAFKLKKSGGS; TKFFAFKLKKSGGSG;
KFFAFKLKKSGGSGA; FFAFKLKKSGGSGAF; FAFKLKKSGGSGAFS;
AFKLKKSGGSGAFSA; FKLKKSGGSGAFSAM; KLKKSGGSGAFSAMY;
LKKSGGSGAFSAMYD; KKSGGSGAFSAMYDL; KSGGSGAFSAMYDLM;
SGGSGAFSAMYDLMT; GGSGAFSAMYDLMTD; GSGAFSAMYDLMTDV;
SGAFSAMYDLMTDVS; GAFSAMYDLMTDVSK; AFSAMYDLMTDVSKP;
FSAMYDLMTDVSKPL; SAMYDLMTDVSKPLF; AMYDLMTDVSKPLFF;
MYDLMTDVSKPLFFT; YDLMTD

| | |
|---|---|
| | AKKEGVKFEAFTNTQT; KKEGVKFEAFTNTQTG; KEGVKFEAFTNTQTGS; EGVKFEAFTNTQTGSK; GVKFEAFTNTQTGSKI; VKFEAFTNTQTGSKIS; KFEAFTNTQTGSKISE; FEAFTNTQTGSKISEK; EAFTNTQTGSKISEKP; AFTNTQTGSKISEKPE; FTNTQTGSKISEKPEF; TNTQTGSKISEKPEFI; NTQTGSKISEKPEFIL; TQTGSKISEKPEFILK; QTGSKISEKPEFILKA; TGSKISEKPEFILKAK; GSKISEKPEFILKAKI; SKISEKPEFILKAKIK; KISEKPEFILKAKIKA; ISEKPEFILKAKIKAI; SEKPEFILKAKIKAIQ; EKPEFILKAKIKAIQV; KPEFILKAKIKAIQVA; PEFILKAKIKAIQVAE; EFILKAKIKAIQVAER; FILKAKIKAIQVAERF; ILKAKIKAIQVAERFV; LKAKIKAIQVAERFVK; KAKIKAIQVAERFVKA; AKIKAIQVAERFVKAI; KIKAIQVAERFVKAIK; IKAIQVAERFVKAIKE; KAIQVAERFVKAIKEE; AIQVAERFVKAIKEEA; IQVAERFVKAIKEEAE; QVAERFVKAIKEEAEK; VAERFVKAIKEEAEKL; AERFVKAIKEEAEKLK; ERFVKAIKEEAEKLKK; RFVKAIKEEAEKLKKS; FVKAIKEEAEKLKKSG; VKAIKEEAEKLKKSGS; KAIKEEAEKLKKSGSS; AIKEEAEKLKKSGSSG; IKEEAEKLKKSGSSGA; KEEAEKLKKSGSSGAF; EEAEKLKKSGSSGAFS; EAEKLKKSGSSGAFSA; AEKLKKSGSSGAFSAM; EKLKKSGSSGAFSAMY; KLKKSGSSGAFSAMYD; LKKSGSSGAFSAMYDL; KKSGSSGAFSAMYDLM; KSGSSGAFSAMYDLMI; SGSSGAFSAMYDLMID; GSSGAFSAMYDLMIDV; SSGAFSAMYDLMIDVS; SGAFSAMYDLMIDVSK; GAFSAMYDLMIDVSKP; AFSAMYDLMIDVSKPL; FSAMYDLMIDVSKPLE; SAMYDLMIDVSKPLEE; AMYDLMIDVSKPLEEI; MYDLMIDVSKPLEEIG; YDLMIDVSKPLEEIGI; DLMIDVSKPLEEIGIQ; LMIDVSKPLEEIGIQK; MIDVSKPLEEIGIQKM; IDVSKPLEEIGIQKMT; DVSKPLEEIGIQKMTG; VSKPLEEIGIQKMTGT; SKPLEEIGIQKMTGTV; KPLEEIGIQKMTGTVT; PLEEIGIQKMTGTVTK; LEEIGIQKMTGTVTKE; EEIGIQKMTGTVTKEA; EIGIQKMTGTVTKEAE; IGIQKMTGTVTKEAEK; GIQKMTGTVTKEAEKT; IQKMTGTVTKEAEKTP; QKMTGTVTKEAEKTPP; KMTGTVTKEAEKTPPT; MTGTVTKEAEKTPPTT; TGTVTKEAEKTPPTTA; GTVTKEAEKTPPTTAD; TVTKEAEKTPPTTADG; VTKEAEKTPPTTADGI; TKEAEKTPPTTADGII; KEAEKTPPTTADGIIA; EAEKTPPTTADGIIAI; AEKTPPTTADGIIAIA; EKTPPTTADGIIAIAQ; KTPPTTADGIIAIAQA; TPPTTADGIIAIAQAM; PPTTADGIIAIAQAME; PTTADGIIAIAQAMEE; TTADGIIAIAQAMEEK; TADGIIAIAQAMEEKL; ADGIIAIAQAMEEKLN; DGIIAIAQAMEEKLNN; GIIAIAQAMEEKLNNV; IIAIAQAMEEKLNNVN; IAIAQAMEEKLNNVNK; AIAQAMEEKLNNVNKK; IAQAMEEKLNNVNKKQ; AQAMEEKLNNVNKKQH; QAMEEKLNNVNKKQHD; AMEEKLNNVNKKQHDA; MEEKLNNVNKKQHDAL; EEKLNNVNKKQHDALK; EKLNNVNKKQHDALKN; KLNNVNKKQHDALKNL; LNNVNKKQHDALKNLE; NNVNKKQHDALKNLEE; NVNKKQHDALKNLEEK; VNKKQHDALKNLEEKA; NKKQHDALKNLEEKAN; KKQHDALKNLEEKANT; KQHDALKNLEEKANTA; QHDALKNLEEKANTAA; HDALKNLEEKANTAAT; DALKNLEEKANTAATT; ALKNLEEKANTAATTT; |
| AAC70021.1 Decorin binding protein B; DbpB [Borrelia burgdorferi], SEQ ID NO: 78248-78913 | 13 mers: SIVIALFFKLLVA; IVIALFFKLLVAC; VIALFFKLLVACS; IALFFKLLVACSI; ALFFKLLVACSIG; LFFKLLVACSIGL; FFKLLVACSIGLV; FKLLVACSIGLVE; KLLVACSIGLVER; LLVACSIGLVERT; LVACSIGLVERTN; VACSIGLVERTNA; ACSIGLVERTNAA; CSIGLVERTNAAL; SIGLVERTNAALE; IGLVERTNAALES; GLVERTNAALESS; LVERTNAALESSS; VERTNAALESSSK; ERTNAALESSSKD; RTNAALESSSKDL; TNAALESSSKDLK; NAALESSSKDLKN; AALESSSKDLKNK; ALESSSKDLKNKI; LESSSKDLKNKIL; ESSSKDLKNKILK; SSSKDLKNKILKI; SSKDLKNKILKIK; SKDLKNKILKIKK; KDLKNKILKIKKE; DLKNKILKIKKEA; LKNKILKIKKEAT; KNKILKIKKEATG; NKILKIKKEATGK; KILKIKKEATGKG; ILKIKKEATGKGV; LKIKKEATGKGVL; KIKKEATGKGVLF; IKKEATGKGVLFE; KKEATGKGVLFEA; KEATGKGVLFEAF; EATGKGVLFEAFT; ATGKGVLFEAFTG; TGKGVLFEAFTGL; GKGVLFEAFTGLK; KGVLFEAFTGLKT; GVLFEAFTGLKTG; VLFEAFTGLKTGS; LFEAFTGLKTGSK; FEAFTGLKTGSKV; EAFTGLKTGSKVT; |

VETGKFLKIEEEA; EIGKFLKIEEEAL; TGKFLKIEEEALK;
GKFLKIEEEALKL; KFLKIEEEALKLK; FLKIEEEALKLKE;
LKIEEEALKLKET; KIEEEALKLKETG; IEEEALKLKETGN;
IEEEALKLKETGNS; EEALKLKETGNSG; EALKLKETGNSGQ;
ALKLKETGNSGQF; LKLKETGNSGQFL; KLKETGNSGQFLA;
KLKETGNSGQFLAM; LKETGNS

QAIVETGKFLKIIEE; AIVETGKFLKIIEEE; IVETGKFLKIIEEEA;
VETGKFLKIIEEEAL; ETGKFLKIIEEEALK; TGKFLKIIEEEALKL;
GKFLKIIEEEALKLK; KFLKIIEEEALKLKE; FLKIIEEEALKLKET;
LKIIEEEALKLKETG; KIIEEEALKLKETGN; IIEEEALKLKETGNS;
IEEEALKLKETGNSG; EEEALKLKETGNSGQ; EEALKLKETGNSGQF;
EALKLKETGNSGQFL; ALKLKETGNSGQFLA; LKLKETGNSGQFLAM;
KLKETGNSGQFLAMF; LKETGNSGQFLAMFD; KETGNSGQFLAMFDL;
ETGNSGQFLAMFDLM; TGNSGQFLAMFDLML; GNSGQFLAMFDLMLF;
NSGQFLAMFDLMLFV; SGQFLAMFDLMLFVV; GQFLAMFDLMLFVVF;
QFLAMFDLMLFVVFS; FLAMFD

| | |
|---|---|
| | AKVQAIVETGKFLKII; KVQAIVETGKFLKIIE; VQAIVETGKFLKIIEE; QAIVETGKFLKIIEEE; AIVETGKFLKIIEEEA; IVETGKFLKIIEEEAL; VETGKFLKIIEEEALK; ETGKFLKIIEEEALKL; TGKFLKIIEEEALKLK; GKFLKIIEEEALKLKE; KFLKIIEEEALKLKET; FLKIIEEEALKLKETG; LKIIEEEALKLKETGN; KIIEEEALKLKETGNS; IIEEEALKLKETGNSG; IEEEALKLKETGNSGQ; EEEALKLKETGNSGQF; EEALKLKETGNSGQFL; EALKLKETGNSGQFLA; ALKLKETGNSGQFLAM; LKLKETGNSGQFLAMF; KLKETGNSGQFLAMFD; LKETGNSGQFLAMFDL; KETGNSGQFLAMFDLM; ETGNSGQFLAMFDLML; TGNSGQFLAMFDLMLE; GNSGQFLAMFDLMLEV; NSGQFLAMFDLMLEVV; SGQFLAMFDLMLEVVE; GQFLAMFDLMLEVVES; QFLAMFDLMLEVVESL; FLAMFDLMLEVVESLE; LAMFDLMLEVVESLED; AMFDLMLEVVESLEDV; MFDLMLEVVESLEDVG; FDLMLEVVESLEDVGI; DLMLEVVESLEDVGII; LMLEVVESLEDVGIIG; MLEVVESLEDVGIIGL; LEVVESLEDVGIIGLK; EVVESLEDVGIIGLKA; VVESLEDVGIIGLKAR; VESLEDVGIIGLKARV; ESLEDVGIIGLKARVL; SLEDVGIIGLKARVLE; LEDVGIIGLKARVLEE; EDVGIIGLKARVLEES; DVGIIGLKARVLEESK; VGIIGLKARVLEESKN; GIIGLKARVLEESKNN; IIGLKARVLEESKNNP; IGLKARVLEESKNNPI; GLKARVLEESKNNPIN; LKARVLEESKNNPINT; KARVLEESKNNPINTA; ARVLEESKNNPINTAE; RVLEESKNNPINTAEP; VLEESKNNPINTAERL; LEESKNNPINTAERLL; EESKNNPINTAERLLA; ESKNNPINTAERLLAA; SKNNPINTAERLLAAK; KNNPINTAERLLAAKA; NNPINTAERLLAAKAQ; NPINTAERLLAAKAQI; PINTAERLLAAKAQIE; INTAERLLAAKAQIEN; NTAERLLAAKAQIENQ; TAERLLAAKAQIENQL; AERLLAAKAQIENQLK; ERLLAAKAQIENQLKV; RLLAAKAQIENQLKVV; LLAAKAQIENQLKVVK; LAAKAQIENQLKVVKE; AAKAQIENQLKVVKEK; AKAQIENQLKVVKEKQ; KAQIENQLKVVKEKQN; AQIENQLKVVKEKQNI; QIENQLKVVKEKQNIE; IENQLKVVKEKQNIEN; ENQLKVVKEKQNIENG; NQLKVVKEKQNIENGG; QLKVVKEKQNIENGGE; LKVVKEKQNIENGGEK; KVVKEKQNIENGGEKK; VVKEKQNIENGGEKKN; VKEKQNIENGGEKKNN; KEKQNIENGGEKKNNK; EKQNIENGGEKKNNKS; KQNIENGGEKKNNKSK; QNIENGGEKKNNKSKK; NIENGGEKKNNKSKKK; IENGGEKKNNKSKKK; |
| NP_212694.1 Heat shock protein 90 [Borrelia burgdorferi B31], SEQ ID NO: 78914-81459 | 13 mers: MILIFYFKQIALF; ILIFYFKQIALFI; LIFYFKQIALFII; IFYFKQIALFIIF; FYFKQIALFIIFR; YFKQIALFIIFRL; FKQIALFIIFRLC; KQIALFIIFRLCY; QIALFIIFRLCYI; IALFIIFRLCYII; ALFIIFRLCYIIK; LFIIFRLCYIIKK; FIIFRLCYIIKKV; IIFRLCYIIKKVK; IFRLCYIIKKVKI; FRLCYIIKKVKIK; RLCYIIKKVKIKL; LCYIIKKVKIKLK; CYIIKKVKIKLKR; YIIKKVKIKLKRK; IIKKVKIKLKRKS; IKKVKIKLKRKSC; KKVKIKLKRKSCM; KVKIKLKRKSCMK; VKIKLKRKSCMKK; KIKLKRKSCMKKQ; IKLKRKSCMKKQF; KLKRKSCMKKQFD; LKRKSCMKKQFDT; KRKSCMKKQFDTE; RKSCMKKQFDTEV; KSCMKKQFDTEVN; SCMKKQFDTEVND; CMKKQFDTEVNDL; MKKQFDTEVNDLL; KKQFDTEVNDLLY; KQFDTEVNDLLYL; QFDTEVNDLLYLI; FDTEVNDLLYLII; DTEVNDLLYLIIS; TEVNDLLYLIIHS; EVNDLLYLIIHSL; VNDLLYLIIHSLY; NDLLYLIIHSLYS; DLLYLIIHSLYSH; LLYLIIHSLYSHK; LYLIIHSLYSHKE; YLIIHSLYSHKEI; LIIHSLYSHKEIF; IIHSLYSHKEIFL; IHSLYSHKEIFLR; HSLYSHKEIFLRE; SLYSHKEIFLREL; LYSHKEIFLRELI; YSHKEIFLRELIS; SHKEIFLRELISN; HKEIFLRELISNA; KEIFLRELISNAS; EIFLRELISNASD; IFLRELISNASDA; FLRELISNASDAI; LRELISNASDAID; RELISNASDAIDK; ELISNASDAIDKL; LISNASDAIDKLK; ISNASDAIDKLKF; SNASDAIDKLKFL; NASDAIDKLKFLS; ASDAIDKLKFLSL; SDAIDKLKFLSLT; DAIDKLKFLSLTN; AIDKLKFLSLTNE; IDKLKFLSLTNEK; DKLKFLSLTNEKF; KLKFLSLTNEKFK; LKFLSLTNEKFKN; KFLSLTNEKFKNI; FLSLTNEKFKNIA; LSLTNEKFKNIAL; SLTNEKFKNIALE; LTNEKFKNIALEP; TNEKFKNIALEPK; NEKFKNIALEPKI; EKFKNIALEPKIE; KFKNIALEPKIEI; FKNIALEPKIEIS; KNIALEPKIEISF; NIALEPKIEISFD; IALEPKIEISFDD; ALEPKIEISFDDK; LEPKIEISFDDKS; EPKIEISFDDKSL; |

HKSEIKAEEYNEFY; KSEIKAEEYNEFYK; SEIKAEEYNEFYKN;
EIKAEEYNEFYKNT; IKAEEYNEFYKNTT; KAEEYNEFYKNTTF;
AEEYNEFYKNTTFD; EEYNEFYKNTTFDY; EYNEFYKNTTFDYE;
YNEFYKNTTFDYEN; NEFYKNTTFDYENP; EFYKNTTFDYENPL;
FYKNTTFDYENPLM; YKNTTFDYENPLMH; KNTTFDYENPLMHT;
NTTFDYENPLMHTH; TTFDYENPLMHTHT; TFDYENPLMHTHTK;
FDYENPLMHTHTKA

| | |
|---|---|
| | LKDENFKKIEEEFKDT; KDENFKKIEEEFKDTL; DENFKKIEEEFKDTLT; ENFKKIEEEFKDTLTK; NFKKIEEEFKDTLTKV; FKKIEEEFKDTLTKVK; KKIEEEFKDTLTKVKE; KIEEEFKDTLTKVKEI; IEEEFKDTLTKVKEIL; EEEFKDTLTKVKEILK; EEFKDTLTKVKEILKD; EFKDTLTKVKEILKDH; FKDTLTKVKEILKDHI; KDTLTKVKEILKDHIK; DTLTKVKEILKDHIKE; TLTKVKEILKDHIKEV; LTKVKEILKDHIKEVN; TKVKEILKDHIKEVNL; KVKEILKDHIKEVNLS; VKEILKDHIKEVNLSA; KEILKDHIKEVNLSAT; EILKDHIKEVNLSATL; ILKDHIKEVNLSATLI; LKDHIKEVNLSATLIK; KDHIKEVNLSATLIKE; DHIKEVNLSATLIKEP; HIKEVNLSATLIKEPS; IKEVNLSATLIKEPSA; KEVNLSATLIKEPSAI; EVNLSATLIKEPSAII; VNLSATLIKEPSAIII; NLSATLIKEPSAIIID; LSATLIKEPSAIIIDS; SATLIKEPSAIIIDSN; ATLIKEPSAIIIDSND; TLIKEPSAIIIDSNDP; LIKEPSAIIIDSNDPT; IKEPSAIIIDSNDPTY; KEPSAIIIDSNDPTYQ; EPSAIIIDSNDPTYQM; PSAIIIDSNDPTYQMQ; SAIIIDSNDPTYQMQK; AIIIDSNDPTYQMQKI; IIIDSNDPTYQMQKIM; IIDSNDPTYQMQKIML; IDSNDPTYQMQKIMLS; DSNDPTYQMQKIMLSM; SNDPTYQMQKIMLSMG; NDPTYQMQKIMLSMGQ; DPTYQMQKIMLSMGQE; PTYQMQKIMLSMGQEV; TYQMQKIMLSMGQEVK; YQMQKIMLSMGQEVKE; QMQKIMLSMGQEVKEI; MQKIMLSMGQEVKEIK; QKIMLSMGQEVKEIKP; KIMLSMGQEVKEIKPI; IMLSMGQEVKEIKPIL; MLSMGQEVKEIKPILE; LSMGQEVKEIKPILEL; SMGQEVKEIKPILELN; MGQEVKEIKPILELNP; GQEVKEIKPILELNPN; QEVKEIKPILELNPNN; EVKEIKPILELNPNNK; VKEIKPILELNPNNKI; KEIKPILELNPNNKIV; EIKPILELNPNNKIVQ; IKPILELNPNNKIVQN; KPILELNPNNKIVQNL; PILELNPNNKIVQNLK; ILELNPNNKIVQNLKN; LELNPNNKIVQNLKNL; ELNPNNKIVQNLKNLE; LNPNNKIVQNLKNLEP; NPNNKIVQNLKNLEPE; PNNKIVQNLKNLEPEK; NNKIVQNLKNLEPEKL; NKIVQNLKNLEPEKLE; KIVQNLKNLEPEKLEK; IVQNLKNLEPEKLEKI; VQNLKNLEPEKLEKIS; QNLKNLEPEKLEKISI; NLKNLEPEKLEKISII; LKNLEPEKLEKISILL; KNLEPEKLEKISILLF; NLEPEKLEKISILLFE; LEPEKLEKISILLFEE; EPEKLEKISILLFEEA; PEKLEKISILLFEEAM; EKLEKISILLFEEAML; KLEKISILLFEEAMLT; LEKISILLFEEAMLTS; EKISILLFEEAMLTSG; KISILLFEEAMLTSGM; ISILLFEEAMLTSGMP; SILLFEEAMLTSGMPS; ILLFEEAMLTSGMPSK; LLFEEAMLTSGMPSKN; LFEEAMLTSGMPSKNP; FEEAMLTSGMPSKNPG; EEAMLTSGMPSKNPGK; EAMLTSGMPSKNPGKF; AMLTSGMPSKNPGKFI; MLTSGMPSKNPGKFIN; LTSGMPSKNPGKFINI; TSGMPSKNPGKFINII; SGMPSKNPGKFINIIN; GMPSKNPGKFINIINE; MPSKNPGKFINIINEF; PSKNPGKFINIINEFI; SKNPGKFINIINEFIE; KNPGKFINIINEFIEK; NPGKFINIINEFIEKD; PGKFINIINEFIEKDF; GKFINIINEFIEKDFL; |
| CAA44492.1\| Outer surface protein A [Borrelia burgdorferi], SEQ ID NO: 81460-82502 | 13 mers: MKKYLLGIGLILAL; KKYLLGIGLILALI; KYLLGIGLILALIA; YLLGIGLILALIAC; LLGIGLILALIACK; LGIGLILALIACKQ; IGLILALIACKQN; GLILALIACKQNV; LILALIACKQNVS; ILALIACKQNVST; LALIACKQNVSTL; ALIACKQNVSTLD; LIACKQNVSTLDE; IACKQNVSTLDEK; ACKQNVSTLDEKN; CKQNVSTLDEKNS; KQNVSTLDEKNSV; QNVSTLDEKNSVS; NVSTLDEKNSVSV; VSTLDEKNSVSVD; STLDEKNSVSVDL; TLDEKNSVSVDLP; LDEKNSVSVDLPG; DEKNSVSVDLPGG; EKNSVSVDLPGGM; KNSVSVDLPGGMT; NSVSVDLPGGMTE; SVSVDLPGGMTEL; VSVDLPGGMTELV; SVDLPGGMTELVS; VDLPGGMTELVSK; DLPGGMTELVSKE; LPGGMTELVSKEK; PGGMTELVSKEKD; GGMTELVSKEKDK; GMTELVSKEKDKD; MTELVSKEKDKDG; TELVSKEKDKDGK; ELVSKEKDKDGKY; LVSKEKDKDGKYS; VSKEKDKDGKYSL; SKEKDKDGKYSLE; KEKDKDGKYSLEA; EKDKDGKYSLEAT; KDKDGKYSLEATV; DKDGKYSLEATVD; KDGKYSLEATVDK; DGKYSLEATVDKL; GKYSLEATVDKLE; KYSLEATVDKLEL; YSLEATVDKLELK; SLEATVDKLELKG; LEATVDKLELKGT; EATVDKLELKGTS; ATVDKLELKGTSD; TVDKLELKGTSDK; VDKLELKGTSDKN; DKLELKGTSDKNN; KLELKGTSDKNNG; |

Fig. 33 continued

LELKGTSDKNNGS; ELKGTSDKNNGSG; LKGTSDKNNGSGT; KGTSDKNNGSGTL;
GTSDKNNGSGTLF; TSDKNNGSGTLFG; SDKNNGSGTLFGF; DKNNGSGTLFGFK;
KNNGSGTLFGFKT; NNGSGTLEGFKTD; NGSGTLFGFKTDK; GSGTLFGFKTDKS;
SGTLFGFKTDKSK; GTLFGFKTDKSKV; TLFGFKTDKSVK; LFGFKTDKSKVKL;
FGFKTDKSKVKLT; GFKTDKSKVKLTT; FKTDKSKVKLTTA; KTDKSKVKLTTAD;
TDKSKVKLTTADD; DKSKVKLTTADDL; KSKVKLTTADDLS; SKVKLTTADDLSQ;
KVKLTTADDLSQT; VKLTTADDLSQTK; KLTTADDLSQTKF; LTTADDLSQTKFF;
TTADDLSQTKFFT; TADDLSQTKFFTF; ADDLSQTKFFTFK; DDLSQTKFFTFKE;
DLSQTKFFTF

Fig. 33 continued

GTVVLSKNILKSGE; TVVLSKNILKSGEI; VVLSKNILKSGEIT;
VLSKNILKSGEITV; LSKNILKSGEITVA; SKNILKSGEITVAL;
KNILKSGEITVALD; NILKSGEITVALDD; ILKSGEITVALDDS;
LKSGEITVALDDSD; KSGEITVALDDSDT; SGEITVALDDSDTT;
GEITVALDDSDTTQ; EITVALDDSDTTQA; ITVALDDSDTTQAT;
TVALDDSDTTQATK; VALDDSDTTQATKK; ALDDSDTTQATKKT;
LDDSDTTQATKKTO; DDSDTTQATKKTCK; DSDTTQATKKTCKW;
SDTTQATKKTCKWD; DTTQATKKTCKWDS; TTQATKKTCKWDSK;
TQATKKTCKWDSKT; QATKKTCKWDSKTS; ATKKTCKWDSKTST;
TKKTCKWDSKTSTL; KKTCKWDSKTSTLT; KTCKWDSKTSTLTT;
TCKWDSKTSTLTTS; CKWDSKTSTLTTSV; KWDSKTSTLTTSVN;
WDSKTSTLTTSVNS; DSKTSTLTTSVNSQ; SKTSTLTTSVNSQK;
KTSTLTTSVNSQKT; TSTLTTSVNSQKTK; STLTTSVNSQKTKN;
TLTTSVNSQKTKNL; LTTSVNSQKTKNLV; TTSVNSQKTKNLVF;
TSVNSQKTKNLVFT; SVNSQKTKNLVFTK; VNSQKTKNLVFTKE;
NSQKTKNLVFTKEE; SQKTKNLVFTKEDT; QKTKNLVFTKEDTT;
KTKNLVFTKEDTTT; TKNLVFTKEDTTTV; KNLVFTKEDTTTVQ;
NLVFTKEDTTTVQK; LVFTKEDTTTVQKY; VFTKEDTTTVQKYD;
FTKEDTTTVQKYDS; TKEDTTTVQKYDSA; KEDTTTVQKYDSAC;
EDTTTVQKYDSAGT; DTTTVQKYDSACTN; TTTVQKYDSACTNL;
TTVQKYDSACTNLE; TVQKYDSACTNLEG; VQKYDSACTNLEGK;
QKYDSACTNLEGKA; KYDSACTNLEGKAV; YDSACTNLEGKAVE;
DSACTNLEGKAVEI; SACTNLEGKAVEIT; ACTNLEGKAVEITT;
CTNLEGKAVEITTL; TNLEGKAVEITTLK; NLEGKAVEITTLKE;
LEGKAVEITTLKEL; EGKAVEITTLKELK; GKAVEITTLKELKN;
KAVEITTLKELKNA; AVEITTLKELKNAL; VEITTLKELKNALK;

15 mers:
MKKYLLGIGLILALI; KKYLLGIGLILALIA; KYLLGIGLILALIAC;
YLLGIGLILALIACK; LLGIGLILALIACKQ; LGIGLILALIACKQN;
GIGLILALIACKQNV; IGLILALIACKQNVS; GLILALIACKQNVST;
LILALIACKQNVSTL; ILALIACKQNVSTLD; LALIACKQNVSTLDE;
ALIACKQNVSTLDEK; LIACKQNVSTLDEKN; IACKQNVSTLDEKNS;
ACKQNVSTLDEKNSV; CKQNVSTLDEKNSVS; KQNVSTLDEKNSVSV;
QNVSTLDEKNSVSVD; NVSTLDEKNSVSVDL; VSTLDEKNSVSVDLP;
STLDEKNSVSVDLPG; TLDEKNSVSVDLPGG; LDEKNSVSVDLPGGM;
DEKNSVSVDLPGGMT; EKNSVSVDLPGGMTE; KNSVSVDLPGGMTEL;
NSVSVDLPGGMTELV; SVSVDLPGGMTELVS; VSVDLPGGMTELVSK;
SVDLPGGMTELVSKE; VDLPGGMTELVSKEK; DLPGGMTELVSKEKD;
LPGGMTELVSKEKDK; PGGMTELVSKEKDKG; GGMTELVSKEKDKGQ;
GMTELVSKEKDKGQK; MTELVSKEKDKGQKY; TELVSKEKDKGQKYS;
ELVSKEKDKGQKYSL; LVSKEKDKGQKYSLE; VSKEKDKGQKYSLEA;
SKEKDKGQKYSLEAT; KEKDKGQKYSLEATV; EKDKGQKYSLEATVD;
KDKGQKYSLEATVDK; DKGQKYSLEATVDKI; KGQKYSLEATVDKIE;
GQKYSLEATVDKIEL; QKYSLEATVDKIELK; KYSLEATVDKIELKG;
YSLEATVDKIELKGT; SLEATVDKIELKGTS; LEATVDKIELKGTSD;
EATVDKIELKGTSDK; ATVDKIELKGTSDKN; TVDKIELKGTSDKNN;
VDKIELKGTSDKNNG; DKIELKGTSDKNNGS; KIELKGTSDKNNGSC;
IELKGTSDKNNGSCT; ELKGTSDKNNGSCTL; LKGTSDKNNGSCTLE;
KGTSDKNNGSCTLEG; GTSDKNNGSCTLEGE; TSDKNNGSCTLEGEK;
SDKNNGSCTLEGEKT; DKNNGSCTLEGEKTD; KNNGSCTLEGEKTDK;
NNGSCTLEGEKTDKS; NGSCTLEGEKTDKSK; GSCTLEGEKTDKSKV;
SCTLEGEKTDKSKVK; CTLEGEKTDKSKVKL; TLEGEKTDKSKVKLT;
LEGEKTDKSKVKLTT; EGEKTDKSKVKLTTA; GEKTDKSKVKLTTAD;
EKTDKSKVKLTTADD; KTDKSKVKLTTADDL; TDKSKVKLTTADDLS;
DKSKVKLTTADDLSQ; KSKVKLTTADDLSQT; SKVKLTTADDLSQTK;
KVKLTTADDLSQTKE; VKLTTADDLSQTKEL; KLTTADDLSQTKELE;

KAVEITTLRELKNAL; AVEITTLRELKNALK;

16 mers:
MKKYLLGTGLTLAITA; KYLLGTGLTLAITAG; KYLLGTGLTLAITACK;
YLLGTGLTLAITACKQ; LLGTGLTLAITACKQN; LGTGLTLAITACKQNV;
GTGLTLAITACKQNVS; TGLTLAITACKQNVST; GLTLAITACKQNVSTL;
LTLAITACKQNVSTLD; TLAITACKQNVSTLDE; LAITACKQNVSTLDEF;
AITACKQNVSTLDEKN; ITACKQNVSTLDEKNS; TACKQNVSTLDEKNSV;
ACKQNVSTLDEKNSVS; CKQNVSTLDEKNSVSV; KQNVSTLDEKNSVSVD;
QNVSTLDEKNSVSVDL; NVSTLDEKNSVSVDLP; VSTLDEKNSVSVDLPC;
STLDEKNSVSVDLPCQ; TLDEKNSVSVDLPCQM; LDEKNSVSVDLPCQMT;
DEKNSVSVDLPCQMTE; EKNSVSVDLPCQMTEL; KNSVSVDLPCQMTELV;
NSVSVDLPCQMTELVS; SVSVDLPCQMTELVSK; VSVDLPCQMTELVSKE;
SVDLPCQMTELVSKEK; VDLPCQMTELVSKEKD; DLPCQMTELVSKEKDK;
LPCQMTELVSKEKDKD; PCQMTELVSKEKDKDG; CQMTELVSKEKDKDGK;
QMTELVSKEKDKDGKY; MTELVSKEKDKDGKYS; TELVSKEKDKDGKYSL;
ELVSKEKDKDGKYSLF; LVSKEKDKDGKYSLFA; VSKEKDKDGKYSLFAT;
SKEKDKDGKYSLFATV; KEKDKDGKYSLFATVD; EKDKDGKYSLFATVDK;
KDKDGKYSLFATVDKL; DKDGKYSLFATVDKLE; KDGKYSLFATVDKLEL;
DGKYSLFATVDKLELK; GKYSLFATVDKLELKG; KYSLFATVDKLELKGT;
YSLFATVDKLELKGTS; SLFATVDKLELKGTSE; LFATVDKLELKGTSDR;
FATVDKLELKGTSDKN; ATVDKLELKGTSDKNN; TVDKLELKGTSDKNNG;
VDKLELKGTSDKNNGS; DKLELKGTSDKNNGSG; KLELKGTSDKNNGSGT;
LELKGTSDKNNGSGTL; ELKGTSDKNNGSGTLE; LKGTSDKNNGSGTLEG;
KGTSDKNNGSGTLEGE; GTSDKNNGSGTLEGEK; TSDKNNGSGTLEGEKT;
SDKNNGSGTLEGEKTD; DKNNGSGTLEGEKTDK; KNNGSGTLEGEKTDKS;
NNGSGTLEGEKTDKSK; NGSGTLEGEKTDKSKV; GSGTLEGEKTDKSKVK;
SGTLEGEKTDKSKVKL; GTLEGEKTDKSKVKLT; TLEGEKTDKSKVKLTI;
LEGEKTDKSKVKLTIA; EGEKTDKSKVKLTIAD; GEKTDKSKVKLTIADD;
EKTDKSKVKLTIADDL; KTDKSKVKLTIADDLS; TDKSKVKLTIADDLSQ;
DKSKVKLTIADDLSQT; KSKVKLTIADDLSQTK; SKVKLTIADDLSQTKF;
KVKLTIADDLSQTKFE; VKLTIADDLSQTKFEI; KLTIADDLSQTKFEIF;
LTIADDLSQTKFEIFK; TIADDLSQTKFEIFKE; IADDLSQTKFEIFKED;
ADDLSQTKFEIFKEDA; DDLSQTKFEIFKEDAK; DLSQTKFEIFKEDAKT;
LSQTKFEIFKEDAKTL; SQTKFEIFKEDAKTLV; QTKFEIFKEDAKTLVS;
TKFEIFKEDAKTLVSK; KFEIFKEDAKTLVSKK; FEIFKEDAKTLVSKKV;
EIFKEDAKTLVSKKVT; IFKEDAKTLVSKKVTL; FKEDAKTLVSKKVTLK;
KEDAKTLVSKKVTLKD; EDAKTLVSKKVTLKDK; DAKTLVSKKVTLKDKG;
AKTLVSKKVTLKDKSS; KTLVSKKVTLKDKSST; TLVSKKVTLKDKSSTE;
LVSKKVTLKDKSSTEE; VSKKVTLKDKSSTEEK; SKKVTLKDKSSTEEKF;
KKVTLKDKSSTEEKFN; KVTLKDKSSTEEKFNE; VTLKDKSSTEEKFNEK;
TLKDKSSTEEKFNEKG; LKDKSSTEEKFNEKGE; KDKSSTEEKFNEKGET;
DKSSTEEKFNEKGETS; KSSTEEKFNEKGETSE; SSTEEKFNEKGETSEK;
STEEKFNEKGETSEKT; TEEKFNEKGETSEKTV; EEKFNEKGETSEKTIV;
EKFNEKGETSEKTIVR; KFNEKGETSEKTIVRA; FNEKGETSEKTIVRAN;
NEKGETSEKTIVRANG; EKGETSEKTIVRANGT; KGETSEKTIVRANGTR;
GETSEKTIVRANGTRL; ETSEKTIVRANGTRLF; TSEKTIVRANGTRLFY;
SEKTIVRANGTRLFYT; EKTIVRANGTRLFYTD; KTIVRANGTRLFYTDT;
TIVRANGTRLFYTDTK; IVRANGTRLFYTDTKS; VRANGTRLFYTDTKSD;
RANGTRLFYTDTKSDG; ANGTRLFYTDTKSDGS; NGTRLFYTDTKSDGSG;
GTRLFYTDTKSDGSGK; TRLFYTDTKSDGSGKA; RLFYTDTKSDGSGKAK;
LFYTDTKSDGSGKAKE; FYTDTKSDGSGKAKEV; YTDTKSDGSGKAKEVL;
TDTKSDGSGKAKEVLK; DTKSDGSGKAKEVLKD; TKSDGSGKAKEVLKDF;
KSDGSGKAKEVLKDFT; SDGSGKAKEVLKDFTL; DGSGKAKEVLKDFTLE;
GSGKAKEVLKDFTLEG; SGKAKEVLKDFTLEGT; GKAKEVLKDFTLEGTL;
KAKEVLKDFTLEGTLA; AKEVLKDFTLEGTLAA; KEVLKDFTLEGTLAAD;
EVLKDFTLEGTLAADG; VLKDFTLEGTLAADGK; LKDFTLEGTLAADGKT;

Fig. 33 continued

| | KDFTLEGTLAADGKTT; DFTLEGTLAADGKTTL; FTLEGTLAADGKTTLK; TLEGTLAADGKTTLKV; LEGTLAADGKTTLKVT; EGTLAADGKTTLKVTE; GTLAADGKTTLKVTEG; TLAADGKTTLKVTEGT; LAADGKTTLKVTEGTV; AADGKTTLKVTEGTVV; ADGKTTLKVTEGTVVL; DGKTTLKVTEGTVVLS; GKTTLKVTEGTVVLSK; KTTLKVTEGTVVLSKN; TTLKVTEGTVVLSKNI; TLKVTEGTVVLSKNIL; LKVTEGTVVLSKNILK; KVTEGTVVLSKNILKS; VTEGTVVLSKNILKSG; TEGTVVLSKNILKSGE; EGTVVLSKNILKSGEI; GTVVLSKNILKSGEIT; TVVLSKNILKSGEITV; VVLSKNILKSGEITVA; VLSKNILKSGEITVAL; LSKNILKSGEITVALD; SKNILKSGEITVALDD; KNILKSGEITVALDDS; NILKSGEITVALDDSD; ILKSGEITVALDDSDT; LKSGEITVALDDSDTT; KSGEITVALDDSDTTQ; SGEITVALDDSDTTQA; GEITVALDDSDTTQAT; EITVALDDSDTTQATK; ITVALDDSDTTQATKK; TVALDDSDTTQATKKT; VALDDSDTTQATKKTG; ALDDSDTTQATKKTGK; LDDSDTTQATKKTGKW; DDSDTTQATKKTGKWD; DSDTTQATKKTGKWDS; SDTTQATKKTGKWDSK; DTTQATKKTGKWDSKT; TTQATKKTGKWDSKTS; TQATKKTGKWDSKTST; QATKKTGKWDSKTSTL; ATKKTGKWDSKTSTLT; TKKTGKWDSKTSTLTI; KKTGKWDSKTSTLTIS; KTGKWDSKTSTLTISV; TGKWDSKTSTLTISVN; GKWDSKTSTLTISVNS; KWDSKTSTLTISVNSQ; WDSKTSTLTISVNSQK; DSKTSTLTISVNSQKT; SKTSTLTISVNSQKTK; KTSTLTISVNSQKTKN; TSTLTISVNSQKTKNL; STLTISVNSQKTKNLV; TLTISVNSQKTKNLVF; LTISVNSQKTKNLVFT; TISVNSQKTKNLVFTK; ISVNSQKTKNLVFTKE; SVNSQKTKNLVFTKED; VNSQKTKNLVFTKEDT; NSQKTKNLVFTKEDTI; SQKTKNLVFTKEDTIT; QKTKNLVFTKEDTITV; KTKNLVFTKEDTITVQ; TKNLVFTKEDTITVQK; KNLVFTKEDTITVQKY; NLVFTKEDTITVQKYD; LVFTKEDTITVQKYDS; VFTKEDTITVQKYDSA; FTKEDTITVQKYDSAG; TKEDTITVQKYDSAGT; KEDTITVQKYDSAGTN; EDTITVQKYDSAGTNL; DTITVQKYDSAGTNLE; TITVQKYDSAGTNLEG; ITVQKYDSAGTNLEGK; TVQKYDSAGTNLEGKA; VQKYDSAGTNLEGKAV; QKYDSAGTNLEGKAVE; KYDSAGTNLEGKAVEI; YDSAGTNLEGKAVEIT; DSAGTNLEGKAVEITT; SAGTNLEGKAVEITTL; AGTNLEGKAVEITTLK; GTNLEGKAVEITTLKE; TNLEGKAVEITTLKEL; NLEGKAVEITTLKELK; LEGKAVEITTLKELKN; EGKAVEITTLKELKNA; GKAVEITTLKELKNAL; KAVEITTLKELKNALK; AVEITTLKELKNALK ; |
|---|---|
| \|BAA22351.1\| Outer surface protein B [Borrelia garinii], SEQ ID NO: 82503-83640 | 13 mers: MKKYLLGFALVLA; KKYLLGFALVLAL; KYLLGFALVLALI; YLLGFALVLALIA; LLGFALVLALIAC; LGFALVLALIACG; GFALVLALIACGQ; FALVLALIACGQK; ALVLALIACGQKG; LVLALIACGQKGA; VLALIACGQKGAE; LALIACGQKGAEP; ALIACGQKGAEPK; LIACGQKGAEPKN; IACGQKGAEPKND; ACGQKGAEPKHND; CGQKGAEPKHNDQ; GQKGAEPKHNDQE; QKGAEPKHNDQEV; KGAEPKHNDQEVE; GAEPKHNDQEVED; AEPKHNDQEVEDS; EPKHNDQEVEDSK; PKHNDQEVEDSKK; KHNDQEVEDSKKD; HNDQEVEDSKKDQ; NDQEVEDSKKDQK; DQEVEDSKKDQKD; QEVEDSKKDQKDA; EVEDSKKDQKDAS; VEDSKKDQKDASK; EDSKKDQKDASKK; DSKKDQKDASKKD; SKKDQKDASKKDL; KKDQKDASKKDLP; KDQKDASKKDLPL; DQKDASKKDLPLV; QKDASKKDLPLVT; KDASKKDLPLVTE; DASKKDLPLVTED; ASKKDLPLVTEDT; SKKDLPLVTEDTV; KKDLPLVTEDTVK; KDLPLVTEDTVKL; DLPLVTEDTVKLF; LPLVTEDTVKLFN; PLVTEDTVKLFND; LVTEDTVKLFNDT; VTEDTVKLFNDTK; TEDTVKLFNDTKI; EDTVKLFNDTKIF; DTVKLFNDTKIFI; TVKLFNDTKIFIS; VKLFNDTKIFISK; KLFNDTKIFISKE; LFNDTKIFISKEK; FNDTKIFISKEKN; NDTKIFISKEKND; DTKIFISKEKNKD; TKIFISKEKNKDG; KIFISKEKNKDGK; IFISKEKNKDGKY; FISKEKNKDGKYE; ISKEKNKDGKYEL; SKEKNKDGKYELR; KEKNKDGKYELRA; EKNKDGKYELRAT; KNKDGKYELRATV; NKDGKYELRATVD; KDGKYELRATVDT; DGKYELRATVDTV; GKYELRATVDTVE; KYELRATVDTVEL; YELRATVDTVELK; ELRATVDTVELKG; LRATVDTVELKGV; RATVDTVELKGVA; ATVDTVELKGVAD; TVDTVELKGVADK; VDTVELKGVADKN; DTVELKGVADKND; TVELKGVADKNDG; VELKGVADKNDGS; ELKGVADKNDGSG; LKGVADKNDGSGG; KGVADKNDGSGGK; GVADKNDGSGGKL; VADKNDGSGGKLE; |

ACGQKGAEPKHDQG; CGQKGAEPKHDQE; GQKGAEPKHDQEV;
QKGAEPKHDQEVE; KGAEPKHDQEVED; GAEPKHDQEVEDS;
AEPKHDQEVEDSK; EPKHDQEVEDSKK; PKHDQEVEDSKKD;
KHDQEVEDSKKDQ; HDQEVEDSKKDQK; DQEVEDSKKDQKD;
DQEVEDSKKDQKDA; QEVEDSKKDQKDAS; EVEDSKKDQKDASK;
VEDSKKDQKDASKK; EDSKKDQKDASKKD; DSKKDQKDASKKDL;
SKKDQKDASKKDLP; KKDQKDASKKDLPL; KDQKDASKKDLPLV;
DQKDASKKDLPLVT; QKDASKKDLPLVTE; KDASKKDLPLVTED;
DASKKDLPLVTEDT; ASKKD

NTTVETYDSSNTKVA; TTVETYDSSNTKVAS; TVETYDSSNTKVASK;
TVETYDSSNTKVASKV; VETYDSSNTKVASKVF; ETYDSSNTKVASKVFK;
TYDSSNTKVASKVFKK; YDSSNTKVASKVFKKQ; DSSNTKVASKVFKKQS;
SSNTKVASKVFKKQCS; SNTKVASKVFKKQSL; NTKVASKVFKKQSLT;
TKVASKVFKKQSLTF; KVASKVFKKQSLTFE; VASKVFKKQSLTFET;
ASKVFKKQCSLTFETF; SKVFKKQSLTFETFE; KVFFKQCSLTFETFET;
VFKKQSLTFETFETY; FKKQSLTFETFETYF; KKQSLTFETFETYKT;
KQSLTFETFETYKTG; QSLTFETFETYKTGK; SLTFETFETYKTGKL

| | |
|---|---|
| AAM22469.1\| Outer surface protein C [Borrelia afzelii], SEQ ID NO: 83641-84430 | 13 mers:<br>MKKNTLSAILMTL; KKNTLSAILMTLF; KNTLSAILMTLFL; NTLSAILMTLFLF;<br>TLSAILMTLFLFI; LSAILMTLFLFIS; SAILMTLFLFISC; AILMTLFLFISCN;<br>ILMTLFLFISCNN; LMTLFLFISCNNS; MTLFLFISCNNSG; TLFLFISCNNSGK;<br>LFLFISCNNSGKG; FLFISCNNSGKGG; LFISCNNSGKGGD; FISCNNSGKGGDS;<br>ISCNNSGKGGDSA; SCNNSGKGGDSAS; CNNSGKGGDSAST; NNSGKGGDSASTN;<br>NSGKGGDSASTNP; SGKGGDSASTNPA; GKGGDSASTNPAD; KGGDSASTNPADE;<br>GGDSASTNPADES; GDSASTNPADESA; DSASTNPADESAK; SASTNPADESAKG;<br>ASTNPADESAKGP; STNPADESAKGPN; TNPADESAKGPNL; NPADESAKGPNLT;<br>PADESAKGPNLTE; ADESAKGPNLTEI; DESAKGPNLTEIS; ESAKGPNLTEISK;<br>SAKGPNLTEISKK; AKGPNLTEISKKI; KGPNLTEISKKIT; GPNLTEISKKITD;<br>PNLTEISKKITDS; NLTEISKKITDSN; LTEISKKITDSNA; TEISKKITDSNAF;<br>EISKKITDSNAFV; ISKKITDSNAFVL; SKKITDSNAFVLA; KKITDSNAFVLAV;<br>KITDSNAFVLAVK; ITDSNAFVLAVKE; TDSNAFVLAVKEV; DSNAFVLAVKEVE;<br>SNAFVLAVKEVET; NAFVLAVKEVETL; AFVLAVKEVETLV; FVLAVKEVETLVS;<br>VLAVKEVETLVSS; LAVKEVETLVSSI; AVKEVETLVSSID; VKEVETLVSSIDE;<br>KEVETLVSSIDEL; EVETLVSSIDELA; VETLVSSIDELAN; ETLVSSIDELANK;<br>TLVSSIDELANKA; LVSSIDELANKAI; VSSIDELANKAIG; SSIDELANKAIGK;<br>SIDELANKAIGKK; IDELANKAIGKKI; DELANKAIGKKIQ; ELANKAIGKKIQQ;<br>LANKAIGKKIQQN; ANKAIGKKIQQNG; NKAIGKKIQQNGL; KAIGKKIQQNGLG;<br>AIGKKIQQNGLGA; IGKKIQQNGLGAE; GKKIQQNGLGAEA; KKIQQNGLGAEAN;<br>KIQQNGLGAEANR; IQQNGLGAEANRN; QQNGLGAEANRNE; QNGLGAEANRNES;<br>NGLGAEANRNESL; GLGAEANRNESLL; LGAEANRNESLLA; GAEANRNESLLAG;<br>AEANRNESLLAGV; EANRNESLLAGVH; ANRNESLLAGVHE; NRNESLLAGVHEI;<br>RNESLLAGVHEIS; NESLLAGVHEIST; ESLLAGVHEISTL; SLLAGVHEISTLI;<br>LLAGVHEISTLIT; LAGVHEISTLITE; AGVHEISTLITEK; GVHEISTLITEKL;<br>VHEISTLITEKLS; HEISTLITEKLSK; EISTLITEKLSKL; ISTLITEKLSKLK;<br>STLITEKLSKLKN; TLITEKLSKLKNS; LITEKLSKLKNSG; ITEKLSKLKNSGE;<br>TEKLSKLKNSGEL; EKLSKLKNSGELK; KLSKLKNSGELKA; LSKLKNSGELKAK;<br>SKLKNSGELKAKI; KLKNSGELKAKIE; LKNSGELKAKIED; KNSGELKAKIEDA;<br>NSGELKAKIEDAK; SGELKAKIEDAKK; GELKAKIEDAKKC; ELKAKIEDAKKCS;<br>LKAKIEDAKKCSE; KAKIEDAKKCSEE; AKIEDAKKCSEEF; KIEDAKKCSEEFT;<br>IEDAKKCSEEFTN; EDAKKCSEEFTNK; DAKKCSEEFTNKL; AKKCSEEFTNKLR;<br>KKCSEEFTNKLRV; KCSEEFTNKLRVS; CSEEFTNKLRVSH; SEEFTNKLRVSHA;<br>EEFTNKLRVSHAD; EFTNKLRVSHADL; FTNKLRVSHADLG; TNKLRVSHADLGK;<br>NKLRVSHADLGKQ; KLRVSHADLGKQG; LRVSHADLGKQGV; RVSHADLGKQGVN;<br>VSHADLGKQGVND; SHADLGKQGVNDD; HADLGKQGVNDDD; ADLGKQGVNDDDA;<br>DLGKQGVNDDDAK; LGKQGVNDDDAKK; GKQGVNDDDAKKA; KQGVNDDDAKKAI;<br>QGVNDDDAKKAIL; GVNDDDAKKAILK; VNDDDAKKAILKT; NDDDAKKAILKTN;<br>DDDAKKAILKTNA; DDAKKAILKTNAD; DAKKAILKTNADK; AKKAILKTNADKT;<br>KKAILKTNADKTK; KAILKTNADKTKG; AILKTNADKTKGA; ILKTNADKTKGAE;<br>LKTNADKTKGAEE; KTNADKTKGAEEL; TNADKTKGAEELG; NADKTKGAEELGK;<br>ADKTKGAEELGKL; DKTKGAEELGKLF; KTKGAEELGKLFK; TKGAEELGKLFKS;<br>KGAEELGKLFKSV; GAEELGKLFKSVE; AEELGKLFKSVEG; EELGKLFKSVEGL;<br>ELGKLFKSVEGLV; LGKLFKSVEGLVK; GKLFKSVEGLVKA; KLFKSVEGLVKAA;<br>LFKSVEGLVKAAQ; FKSVEGLVKAAQE; KSVEGLVKAAQEA; SVEGLVKAAQEAL;<br>VEGLVKAAQEALT; EGLVKAAQEALTN; GLVKAAQEALTNS; LVKAAQEALTNSV;<br>VKAAQEALTNSVK; KAAQEALTNSVKE; AAQEALTNSVKEL; AQEALTNSVKELT;<br>QEALTNSVKELTS; EALTNSVKELTSP; ALTNSVKELTSPV; LTNSVKELTSPVV;<br>TNSVKELTSPVVA; NSVKELTSPVVAE; SVKELTSPVVAES; VKELTSPVVAESP;<br>KELTSPVVAESPK; ELTSPVVAESPKK; LTSPVVAESPKKP;<br><br>14 mers:<br>MKKNTLSAILMTLF; KKNTLSAILMTLFL; KNTLSAILMTLFLF;<br>NTLSAILMTLFLFI; TLSAILMTLFLFIS; LSAILMTLFLFISC;<br>SAILMTLFLFISCN; AILMTLFLFISCNN; ILMTLFLFISCNNS; |

Fig. 33 continued

| | | |
|---|---|---|
| LKTLFLFISCNNSGG; | NILFLFISCNNSGK; | TLFLFISCNNSGKG; |
| LFLFISCNNSGKGG; | FLFISCNNSGKGGD; | LFISCNNSGKGGDS; |
| FISCNNSGKGGDSA; | ISCNNSGKGGDSAS; | SCNNSGKGGDSAST; |
| CNNSGKGGDSASTN; | NNSGKGGDSASTNP; | NSGKGGDSASTNPA; |
| SGKGGDSASTNPAD; | GKGGDSASTNPADF; | KGGDSASTNPADFS; |
| GGDSASTNPADFSA; | GDSASTNPADFSAK; | DSASTNPADFSAKQ; |
| SASTNPADFSAKQP; | ASTNPADFSAKQPN; | STNPADFSAKQPNL; |
| TNPADFSAKQPNLT; | NPADFSAKQPNLTF; | PADFSAKQPNLTFT; |
| ADFSAKQPNLTFTS; | DFSAKQPNLTFTSK; | FSAKQPNLTFTSKK; |
| SAKQPNLTFTSKKT; | AKQPNLTFTSKKTT; | KQPNLTFTSKKTTD; |
| QPNLTFTSKKTTDS; | PNLTFTSKKTTDSN; | NLTFTSKKTTDSNA; |
| LTFTSKKTTDSNAF; | TFTSKKTTDSNAFV; | FTSKKTTDSNAFVL; |
| TSKKTTDSNAFVLA; | SKKTTDSNAFVLAV; | KKTTDSNAFVLAVK; |
| KTTDSNAFVLAVKF; | TTDSNAFVLAVKFV; | TDSNAFVLAVKFVE; |
| DSNAFVLAVKFVET; | SNAFVLAVKFVETL; | NAFVLAVKFVETLV; |
| AFVLAVKFVETLVS; | FVLAVKFVETLVSS; | VLAVKFVETLVSST; |
| LAVKFVETLVSSTD; | AVKFVETLVSSTDF; | VKFVETLVSSTDFL; |
| KFVETLVSSTDFLA; | FVETLVSSTDFLAN; | VETLVSSTDFLANK; |
| ETLVSSTDFLANKA; | TLVSSTDFLANKAT; | LVSSTDFLANKATG; |
| VSSTDFLANKATGK; | SSTDFLANKATGKK; | STDFLANKATGKKT; |
| TDFLANKATGKKTQ; | DFLANKATGKKTQQ; | FLANKATGKKTQQN; |
| LANKATGKKTQQNG; | ANKATGKKTQQNGL; | NKATGKKTQQNGLG; |
| KATGKKTQQNGLGA; | ATGKKTQQNGLGAF; | TGKKTQQNGLGAFA; |
| GKKTQQNGLGAFANR; | KKTQQNGLGAFANR; | KTQQNGLGAFANRN; |
| TQQNGLGAFANRNF; | QQNGLGAFANRNFS; | QNGLGAFANRNFSL; |
| NGLGAFANRNFSLL; | GLGAFANRNFSLLA; | LGAFANRNFSLLAG; |
| GAFANRNFSLLAGV; | AFANRNFSLLAGVH; | FANRNFSLLAGVHE; |
| ANRNFSLLAGVHEI; | NRNFSLLAGVHEIS; | RNFSLLAGVHEIST; |
| NFSLLAGVHEISTL; | FSLLAGVHEISTLI; | SLLAGVHEISTLIT; |
| LLAGVHEISTLITE; | LAGVHEISTLITEK; | AGVHEISTLITEKL; |
| GVHEISTLITEKLS; | VHEISTLITEKLSK; | HEISTLITEKLSKL; |
| EISTLITEKLSKLK; | ISTLITEKLSKLKN; | STLITEKLSKLKNS; |
| TLITEKLSKLKNSG; | LITEKLSKLKNSGE; | ITEKLSKLKNSGEL; |
| TEKLSKLKNSGELK; | EKLSKLKNSGELKA; | KLSKLKNSGELKAK; |
| LSKLKNSGELKAKI; | SKLKNSGELKAKIE; | KLKNSGELKAKIED; |
| LKNSGELKAKIEDA; | KNSGELKAKIEDAK; | NSGELKAKIEDAKK; |
| SGELKAKIEDAKKQ; | GELKAKIEDAKKQS; | ELKAKIEDAKKQSE; |
| LKAKIEDAKKQSEE; | KAKIEDAKKQSEEF; | AKIEDAKKQSEEFT; |
| KIEDAKKQSEEFTN; | IEDAKKQSEEFTNK; | EDAKKQSEEFTNKL; |
| DAKKQSEEFTNKLR; | AKKQSEEFTNKLRV; | KKQSEEFTNKLRVS; |
| KQSEEFTNKLRVSH; | QSEEFTNKLRVSHA; | SEEFTNKLRVSHAD; |
| EEFTNKLRVSHADL; | EFTNKLRVSHADLQ; | FTNKLRVSHADLQK; |
| TNKLRVSHADLQKQ; | NKLRVSHADLQKQG; | KLRVSHADLQKQV; |
| LRVSHADLQKQVN; | RVSHADLQKQVND; | VSHADLQKQVNDD; |
| SHADLQKQVNDDD; | HADLQKQVNDDDA; | ADLQKQVNDDDAK; |
| DLQKQVNDDDAKK; | LQKQVNDDDAKKA; | QKQVNDDDAKKAT; |
| KQVNDDDAKKATL; | QVNDDDAKKATLK; | VNDDDAKKATLKT; |
| VNDDAKKATLKTN; | NDDAKKATLKTNA; | DDDAKKATLKTNAD; |
| DDAKKATLKTNADK; | DAKKATLKTNADKT; | AKKATLKTNADKTE; |
| KKATLKTNADKTKQ; | KATLKTNADKTKQA; | ATLKTNADKTKQAF; |
| TLKTNADKTKQAFE; | LKTNADKTKQAFEL; | KTNADKTKQAFELQ; |
| TNADKTKQAFELQK; | NADKTKQAFELQKL; | ADKTKQAFELQKLF; |
| DKTKQAFELQKLFK; | KTKQAFELQKLFKS; | TKQAFELQKLFKSV; |
| KQAFELQKLFKSVE; | QAFELQKLFKSVEG; | AFELQKLFKSVEGL; |
| FELQKLFKSVEGLV; | ELQKLFKSVEGLVK; | LQKLFKSVEGLVKA; |
| QKLFKSVEGLVKAA; | KLFKSVEGLVKAAQ; | LFKSVEGLVKAAQE; |
| FKSVEGLVKAAQEA; | KSVEGLVKAAQEAL; | SVEGLVKAAQEALT; |

KGGVNDDAKKAILK; QGVNDDAKKAILKT; GVNDDAKKAILKTN;
VNDDAKKAILKTNA; NDDAKKAILKTNAD; DDAKKAILKTNADK;
DAKKAILKTNADKT; AKKAILKTNADKTK; KKAILKTNADKTKG;
KAILKTNADKTKGA; AILKTNADKTKGAF; ILKTNADKTKGAFF;
LKTNADKTKGAFEL; KTNADKTKGAFELG; TNADKTKGAFELGK;
NADKTKGAFELGKL; ADKTKGAFELGKLF; DKTKGAFELGKLFK;
KTKGAFELGKLFKS; TKGAFELGKLFKSV; KGAFELGKLFKSVE;
GAFELGKLFKSVEQ; AFELGKLFKSVEQL; FELGKLFKSVEQLV;
ELGKLFKSVEQLVK; LGKLFKS

| | |
|---|---|
| | LKNSGELKAKIEDAKK; KNSGELKAKIEDAKKC; NSGELKAKIEDAKKCS; SGELKAKIEDAKKCSE; GELKAKIEDAKKCSEE; ELKAKIEDAKKCSEEF; LKAKIEDAKKCSEEFT; KAKIEDAKKCSEEFTN; AKIEDAKKCSEEFTNK; KIEDAKKCSEEFTNKL; IEDAKKCSEEFTNKLR; EDAKKCSEEFTNKLRV; DAKKCSEEFTNKLRVS; AKKCSEEFTNKLRVSH; KKCSEEFTNKLRVSHA; KCSEEFTNKLRVSHAD; CSEEFTNKLRVSHADL; SEEFTNKLRVSHADLG; EEFTNKLRVSHADLGK; EFTNKLRVSHADLGKQ; FTNKLRVSHADLGKQG; TNKLRVSHADLGKQGV; NKLRVSHADLGKQGVN; KLRVSHADLGKQGVND; LRVSHADLGKQGVNDD; RVSHADLGKQGVNDDD; VSHADLGKQGVNDDDA; SHADLGKQGVNDDDAK; HADLGKQGVNDDDAKK; ADLGKQGVNDDDAKKA; DLGKQGVNDDDAKKAI; LGKQGVNDDDAKKAIL; GKQGVNDDDAKKAILK; KQGVNDDDAKKAILKT; QGVNDDDAKKAILKTN; GVNDDDAKKAILKTNA; VNDDDAKKAILKTNAD; NDDDAKKAILKTNADK; DDDAKKAILKTNADKT; DDAKKAILKTNADKTK; DAKKAILKTNADKTKG; AKKAILKTNADKTKGA; KKAILKTNADKTKGAE; KAILKTNADKTKGAEE; AILKTNADKTKGAEEL; ILKTNADKTKGAEELG; LKTNADKTKGAEELGK; KTNADKTKGAEELGKL; TNADKTKGAEELGKLF; NADKTKGAEELGKLFK; ADKTKGAEELGKLFKS; DKTKGAEELGKLFKSV; KTKGAEELGKLFKSVE; TKGAEELGKLFKSVEG; KGAEELGKLFKSVEGL; GAEELGKLFKSVEGLV; AEELGKLFKSVEGLVK; EELGKLFKSVEGLVKA; ELGKLFKSVEGLVKAA; LGKLFKSVEGLVKAAQ; GKLFKSVEGLVKAAQE; KLFKSVEGLVKAAQEA; LFKSVEGLVKAAQEAL; FKSVEGLVKAAQEALT; KSVEGLVKAAQEALTN; SVEGLVKAAQEALTNS; VEGLVKAAQEALTNSV; EGLVKAAQEALTNSVK; GLVKAAQEALTNSVKE; LVKAAQEALTNSVKEL; VKAAQEALTNSVKELT; KAAQEALTNSVKELTS; AAQEALTNSVKELTSP; AQEALTNSVKELTSPV; QEALTNSVKELTSPVV; EALTNSVKELTSPVVA; ALTNSVKELTSPVVAE; LTNSVKELTSPVVAES; TNSVKELTSPVVAESP; NSVKELTSPVVAESPK; SVKELTSPVVAESPKK; VKELTSPVVAESPKKP; |
| AAC62927.1\| OspE-related lipoprotein [Borrelia garinii], SEQ ID NO: 84431-85092 | 13 mers: MNKKMKMFIICAV; NKKMKMFIICAVF; KKMKMFIICAVFV; KMKMFIICAVFVL; MKMFIICAVFVLI; KMFIICAVFVLIS; MFIICAVFVLISS; FIICAVFVLISSC; IICAVFVLISSCG; ICAVFVLISSCGN; CAVFVLISSCGNF; AVFVLISSCGNFR; VFVLISSCGNFRS; FVLISSCGNFRSS; VLISSCGNFRSSL; LISSCGNFRSSLS; ISSCGNFRSSLSD; SSCGNFRSSLSDQ; SCGNFRSSLSDQG; CGNFRSSLSDQGS; GNFRSSLSDQGSL; NFRSSLSDQGSLS; FRSSLSDQGSLSD; RSSLSDQGSLSDQ; SSLSDQGSLSDQG; SLSDQGSLSDQGS; LSDQGSLSDQGSL; SDQGSLSDQGSLS; DQGSLSDQGSLSD; QGSLSDQGSLSDQ; GSLSDQGSLSDQG; SLSDQGSLSDQGS; LSDQGSLSDQGSL; SDQGSLSDQGSLS; DQGSLSDQGSLSD; QGSLSDQGSLSDQ; GSLSDQGSLSDQG; SLSDQGSLSDQGG; LSDQGSLSDQGGL; SDQGSLSDQGGLS; DQGSLSDQGGLSG; QGSLSDQGGLSGQ; GSLSDQGGLSGQA; SLSDQGGLSGQAS; LSDQGGLSGQASS; SDQGGLSGQASSD; DQGGLSGQASSDT; QGGLSGQASSDTI; GGLSGQASSDTIK; GLSGQASSDTIKF; LSGQASSDTIKFS; SGQASSDTIKFSE; GQASSDTIKFSEF; QASSDTIKFSEFT; ASSDTIKFSEFTV; SSDTIKFSEFTVN; SDTIKFSEFTVNL; DTIKFSEFTVNLK; TIKFSEFTVNIKN; IKFSEFTVNIKNK; KFSEFTVNIKNKK; FSEFTVNIKNKKD; SEFTVNIKNKKDN; EFTVNIKNKKDNN; FTVNIKNKKDNNG; TVNIKNKKDNNGD; VNIKNKKDNNGDW; NIKNKKDNNGDWS; IKNKKDNNGDWSN; KNKKDNNGDWSNL; NKKDNNGDWSNLG; KKDNNGDWSNLGT; KDNNGDWSNLGTL; DNNGDWSNLGTLV; NNGDWSNLGTLVI; NGDWSNLGTLVIP; GDWSNLGTLVIRK; DWSNLGTLVIRKE; WSNLGTLVIRKEQ; SNLGTLVIRKEQD; NLGTLVIRKEQDG; LGTLVIRKEQDGV; GTLVIRKEQDGVE; TLVIRKEQDGVET; LVIRKEQDGVETG; VIRKEQDGVETGL; IRKEQDGVETGLN; RKEQDGVETGLNV; KEQDGVETGLNVI; EQDGVETGLNVIG; QDGVETGLNVIGT; DGVETGLNVIGTI; GVETGLNVIGTIN; VETGLNVIGTING; ETGLNVIGTINGQ; TGLNVIGTINGQL; GLNVIGTINGQLR; LNVIGTINGQLRG; NVIGTINGQLRGH; VIGTINGQLRGHS; IGTINGQLRGHSA; GTINGQLRGHSAT; TINGQLRGHSATF; INGQLRGHSATFF; |

Fig. 33 continued

HGQLRGHSATFFC; GQLRGHSATFFCI; QLRGHSATFFCIE; LRGHSATFFCIEE;
RGHSATFFCIEEA; GHSATFFCIEEAE; HSATFFCIEEAEV; SATFFCIEEAEVN;
ATFFCIEEAEVNN; TFFCIEEAEVNNF; FCIEEAEVNNFV; CIEEAEVNNFVK;
IEEAEVNNFVKA; EEAEVNNFVKAM; EAEVNNFVKAMT; AEVNNFVKAMTN;
EVNNFVKAMTNV; VNNFVKAMTNVG; NNFVKAMTNVQS; NFVKAMTNVQSFK;
FVKAMTNVQSFKT; VKAMTNVQSFKTS; KAMTNVQSFKTSL; AMTNVQSFKTSLY;
MTNVQSFKTSLYY; TNVQSFKTSLYYG; NVQSFKTSLYYGY; VQSFKTSLYYGYK;
QSFKTSLYYGYKF; SFKTSLYYGYKFF; FKTSLYYGYKFFQ; KTSLYYGYKFFQS;
TSLYYGYKFFQSS; SLYYGYKFFQSST; LYYGYKFFQSSTN; YYGYKFFQSSTNG;
YGYKFFQSSTNGT; GYKFFQSSTNGTK; YKFFQSSTNGTKG; KFFQSSTNGTKGK;
FFQSSTNGTKGKF; FQSSTNGTKGKFT; QSSTNGTKGKFTT; SSTNGTKGKFTTK;
STNGTKGKFTTKT; TNGTKGKFTTKTF; NGTKGKFTTKTFT; GTKGKFTTKTFTT;
TKGKFTTKTFTTN; KGKFTTKTFTTNN; GKFTTKTFTTNNS; KFTTKTFTTNNSF;
FTTKTFTTNNSFH; TTKTFTTNNSFHT; TKTFTTNNSFHTT; KTFTTNNSFHTTF;
TFTTNNSFHTTFS; FTTNNSFHTTFSQ; TTNNSFHTTFSQD; TNNSFHTTFSQDK;
NNSFHTTFSQDKI;

14 mers:
MKKMKMFTTCAVF; KKMKMFTTCAVFV; KMKMFTTCAVFVL;
MKMFTTCAVFVLT; KMFTTCAVFVLTS; MFTTCAVFVLTSS;
FTTCAVFVLTSSQ; TTCAVFVLTSSQQ; TCAVFVLTSSQQN;
CAVFVLTSSQQNF; AVFVLTSSQQNFR; VFVLTSSQQNFRS;
FVLTSSQQNFRSS; VLTSSQQNFRSSL; LTSSQQNFRSSLS;
TSSQQNFRSSLSQ; SSQQNFRSSLSQG; SQQNFRSSLSDQG;
QQNFRSSLSDQGS; QNFRSSLSDQGSL; NFRSSLSDQGSLS;
FRSSLSDQGSLSD; RSSLSDQGSLSDQ; SSLSDQGSLSDQG;
SLSDQGSLSDQGS; LSDQGSLSDQGSL; SDQGSLSDQGSLS;
DQGSLSDQGSLSD; QGSLSDQGSLSDQ; GSLSDQGSLSDQG;
SLSDQGSLSDQGS; LSDQGSLSDQGSL; SDQGSLSDQGSLS;
DQGSLSDQGSLSD; QGSLSDQGSLSDQ; GSLSDQGSLSDQG;
SLSDQGSLSDQGG; LSDQGSLSDQGGL; SDQGSLSDQGGLS;
DQGSLSDQGGLSG; QGSLSDQGGLSGQ; GSLSDQGGLSGQA;
SLSDQGGLSGQAS; LSDQGGLSGQASS; SDQGGLSGQASSD;
DQGGLSGQASSDT; QGGLSGQASSDTI; GGLSGQASSDTIK;
GLSGQASSDTIKF; LSGQASSDTIKFS; SGQASSDTIKFSE;
GQASSDTIKFSEF; QASSDTIKFSEFT; ASSDTIKFSEFTV;
SSDTIKFSEFTVN; SDTIKFSEFTVNI; DTIKFSEFTVNIK;
TIKFSEFTVNIKN; IKFSEFTVNIKNK; KFSEFTVNIKNKK;
FSEFTVNIKNKKD; SEFTVNIKNKKDN; EFTVNIKNKKDNN;
FTVNIKNKKDNNG; TVNIKNKKDNNGD; VNIKNKKDNNGDW;
NIKNKKDNNGDWS; IKNKKDNNGDWSN; KNKKDNNGDWSNL;
NKKDNNGDWSNLG; KKDNNGDWSNLGT; KDNNGDWSNLGTL;
DNNGDWSNLGTLV; NNGDWSNLGTLVT; NGDWSNLGTLVTR;
GDWSNLGTLVTRF; DWSNLGTLVTRFQ; WSNLGTLVTRFQD;
SNLGTLVTRFQDQ; NLGTLVTRFQDQV; LGTLVTRFQDQVE;
GTLVTRFQDQVET; TLVTRFQDQVETQ; LVTRFQDQVETQL;
VTRFQDQVETQLN; TRFQDQVETQLNV; RFQDQVETQLNVI;
FQDQVETQLNVIG; QDQVETQLNVIGT; DQVETQLNVIGTT;
QVETQLNVIGTTN; VETQLNVIGTTNQ; ETQLNVIGTTNQL;
TQLNVIGTTNQLR; QLNVIGTTNQLRG; LNVIGTTNQLRGH;
NVIGTTNQLRGHS; VIGTTNQLRGHSA; IGTTNQLRGHSAT;
GTTNQLRGHSATF; TTNQLRGHSATFF; TNQLRGHSATFFC;
NQLRGHSATFFCI; QLRGHSATFFCIE; LRGHSATFFCIEE;
RGHSATFFCIEEA; GHSATFFCIEEAE; HSATFFCIEEAEV;
SATFFCIEEAEVN; ATFFCIEEAEVNN; TFFCIEEAEVNNF;
FFCIEEAEVNNFV; FCIEEAEVNNFVK; CIEEAEVNNFVKA; IEEAEVNNFVKAM;

FFCIEEAEVNNFVKA; FCIEEAEVNNFVKAM; CIEEAEVNNFVKAMT;
IEEAEVNNFVKAMTN; EEAEVNNFVKAMTNV; EAEVNNFVKAMTNVG;
AEVNNFVKAMTNVGS; EVNNFVKAMTNVGSF; VNNFVKAMTNVGSFK;
NNFVKAMTNVGSFKT; NFVKAMTNVGSFKTS; FVKAMTNVGSFKTSL;
VKAMTNVGSFKTSLY; KAMTNVGSFKTSLYY; AMTNVGSFKTSLYYG;
MTNVGSFKTSLYYGY; TNVGSFKTSLYYGYK; NVGSFKTSLYYGYKE;
VGSFKTSLYYGYKEF; GSFKTSLYYGYKEFQ; SFKTSLYYGYKEFQS;
FKTSLYYGYKEFQSS; KTSLYYGYKEFQSST; TSLYYGYKEFQSSTN;
SLYYGYKEFQSSTNG; LYYGYKEFQSSTNGT; YYGYKEFQSSTNGTK;
YGYKEF

| | |
|---|---|
| | FFCIEEAEVNNFVKAM; FCIEEAEVNNFVKAMT; CIEEAEVNNFVKAMTN; IEEAEVNNFVKAMTNV; EEAEVNNFVKAMTNVG; EAEVNNFVKAMTNVGS; AEVNNFVKAMTNVGSF; EVNNFVKAMTNVGSFK; VNNFVKAMTNVGSFKT; NNFVKAMTNVGSFKTS; NFVKAMTNVGSFKTSL; FVKAMTNVGSFKTSLY; VKAMTNVGSFKTSLYY; KAMTNVGSFKTSLYYG; AMTNVGSFKTSLYYGY; MTNVGSFKTSLYYGYK; TNVGSFKTSLYYGYKE; NVGSFKTSLYYGYKEE; VGSFKTSLYYGYKEEQ; GSFKTSLYYGYKEEQS; SFKTSLYYGYKEEQSS; FKTSLYYGYKEEQSST; KTSLYYGYKEEQSSTN; TSLYYGYKEEQSSTNG; SLYYGYKEEQSSTNGI; LYYGYKEEQSSTNGIK; YYGYKEEQSSTNGIKG; YGYKEEQSSTNGIKGK; GYKEEQSSTNGIKGKE; YKEEQSSTNGIKGKEI; KEEQSSTNGIKGKEIT; EEQSSTNGIKGKEITT; EQSSTNGIKGKEITTK; QSSTNGIKGKEITTKI; SSTNGIKGKEITTKIE; STNGIKGKEITTKIET; TNGIKGKEITTKIETI; NGIKGKEITTKIETIN; GIKGKEITTKIETINN; IKGKEITTKIETINNS; KGKEITTKIETINNSE; GKEITTKIETINNSEH; KEITTKIETINNSEHI; EITTKIETINNSEHIT; ITTKIETINNSEHITF; TTKIETINNSEHITFS; TKIETINNSEHITFSG; KIETINNSEHITFSGD; IETINNSEHITFSGDK; ETINNSEHITFSGDKI; |
| CAA57806.1\| Outer surface protein G [Borrelia burgdorferi], SEQ ID NO: 85093-85822 | 13 mers: MNKKMKNLIICAV; NKKMKNLIICAVF; KKMKNLIICAVFV; KMKNLIICAVFVL; MKNLIICAVFVLI; KNLIICAVFVLII; NLIICAVFVLIIS; LIICAVFVLIISC; IICAVFVLIISCK; ICAVFVLIISCKI; CAVFVLIISCKID; AVFVLIISCKIDA; VFVLIISCKIDAS; FVLIISCKIDASS; VLIISCKIDASSE; LIISCKIDASSED; IISCKIDASSEDL; ISCKIDASSEDLK; SCKIDASSEDLKQ; CKIDASSEDLKQN; KIDASSEDLKQNV; IDASSEDLKQNVK; DASSEDLKQNVKE; ASSEDLKQNVKEK; SSEDLKQNVKEKV; SEDLKQNVKEKVE; EDLKQNVKEKVEG; DLKQNVKEKVEGF; LKQNVKEKVEGFL; KQNVKEKVEGFLD; QNVKEKVEGFLDK; NVKEKVEGFLDKE; VKEKVEGFLDKEL; KEKVEGFLDKELM; EKVEGFLDKELMQ; KVEGFLDKELMQG; VEGFLDKELMQGD; EGFLDKELMQGDD; GFLDKELMQGDDP; FLDKELMQGDDPN; LDKELMQGDDPNN; DKELMQGDDPNNS; KELMQGDDPNNSL; ELMQGDDPNNSLF; LMQGDDPNNSLFN; MQGDDPNNSLFNP; QGDDPNNSLFNPP; GDDPNNSLFNPPP; DDPNNSLFNPPPV; DPNNSLFNPPPVL; PNNSLFNPPPVLP; NNSLFNPPPVLPA; NSLFNPPPVLPAS; SLFNPPPVLPASS; LFNPPPVLPASSH; FNPPPVLPASSHD; NPPPVLPASSHDN; PPPVLPASSHDNT; PPVLPASSHDNTP; PVLPASSHDNTPV; VLPASSHDNTPVL; LPASSHDNTPVLK; PASSHDNTPVLKA; ASSHDNTPVLKAV; SSHDNTPVLKAVQ; SHDNTPVLKAVQA; HDNTPVLKAVQAK; DNTPVLKAVQAKD; NTPVLKAVQAKDG; TPVLKAVQAKDGG; PVLKAVQAKDGGQ; VLKAVQAKDGGQQ; LKAVQAKDGGQQE; KAVQAKDGGQQEG; AVQAKDGGQQEGK; VQAKDGGQQEGKE; QAKDGGQQEGKEE; AKDGGQQEGKEEK; KDGGQQEGKEEKE; DGGQQEGKEEKEK; GGQQEGKEEKEKE; GQQEGKEEKEKEI; QQEGKEEKEKEIQ; QEGKEEKEKEIQE; EGKEEKEKEIQEL; GKEEKEKEIQELK; KEEKEKEIQELKD; EEKEKEIQELKDK; EKEKEIQELKDKI; KEKEIQELKDKID; EKEIQELKDKIDK; KEIQELKDKIDKR; EIQELKDKIDKRK; IQELKDKIDKRKK; QELKDKIDKRKKE; ELKDKIDKRKKEL; LKDKIDKRKKELE; KDKIDKRKKELEE; DKIDKRKKELEEA; KIDKRKKELEEAR; IDKRKKELEEARK; DKRKKELEEARKK; KRKKELEEARKKF; RKKELEEARKKFQ; KKELEEARKKFQE; KELEEARKKFQEF; ELEEARKKFQEFK; LEEARKKFQEFKE; EEARKKFQEFKEQ; EARKKFQEFKEQV; ARKKFQEFKEQVE; RKKFQEFKEQVES; KKFQEFKEQVESA; KFQEFKEQVESAT; FQEFKEQVESATG; QEFKEQVESATGE; EFKEQVESATGES; FKEQVESATGEST; KEQVESATGESTE; EQVESATGESTEK; QVESATGESTEKV; VESATGESTEKVK; ESATGESTEKVKK; SATGESTEKVKKQ; ATGESTEKVKKQG; TGESTEKVKKQGN; GESTEKVKKQGNI; ESTEKVKKQGNIG; STEKVKKQGNIGQ; TEKVKKQGNIGQK; EKVKKQGNIGQKA; KVKKQGNIGQKAL; VKKQGNIGQKALK; KKQGNIGQKALKY; KQGNIGQKALKYA; QGNIGQKALKYAK; GNIGQKALKYAKE; NIGQKALKYAKEL; IGQKALKYAKELG; GQKALKYAKELGV; QKALKYAKELGVN; KALKYAKELGVNG; ALKYAKELGVNGS; LKYAKELGVNGSY; KYAKELGVNGSYS; YAKELGVNGSYSV; AKELGVNGSYSVN; KELGVNGSYSVND; |

Fig. 33 continued

ELGVNGSYSVNDG; LGVNGSYSVNDGT; GVNGSYSVNDGTN; VNGSYSVNDGTNT;
NGSYSVNDGTNTN; GSYSVNDGTNTND; SYSVNDGTNTNDF; YSVNDGTNTNDFV;
SVNDGTNTNDFVK; VNDGTNTNDFVKK; DGTNTNDFVKKV; DGTNTNDFVKKVI;
GTNTNDFVKKVID; TNTNDFVKKVIDD; NTNDFVKKVIDDA; TNDFVKKVIDDAL;
NDFVKKVIDDALK; DFVKKVIDDALKN; FVKKVIDDALKNI; VKKVIDDALKNIE;
KKVIDDALKNIEF; KVIDDALKNIEFF; VIDDALKNIEFFL; IDDALKNIEFFLE;
DDALKNIEFFLEK; DALKNIEFFLEKI; ALKNIEFFLEKLA; LKNIEFFLEKLAE;
KNIEFFLEKLAEP; NIEFFLEKLAEPQ; IEFFLEKLAEPQN; EFFLEKLAEPQNT;
FFLEKLAEPQNTE; FLEKLAEPQNTED; LEKLAEPQNT

LGQKALKYAKELGV; GQKALKYAKELGVN; QKALKYAKELGVNG;
KALKYAKELGVNGS; ALKYAKELGVNGSY; LKYAKELGVNGSYS;
KYAKELGVNGSYSV; YAKELGVNGSYSVN; AKELGVNGSYSVND;
KELGVNGSYSVNDG; ELGVNGSYSVNDGT; LGVNGSYSVNDGTN;
GVNGSYSVNDGTNT; VNGSYSVNDGTNTN; NGSYSVNDGTNTND;
GSYSVNDGTNTNDF; SYSVNDGTNTNDFV; YSVNDGTNTNDFVK;
SVNDGTNTNDFVKK; VNDGTNTNDFVKKV; NDGTNTNDFVKKVT;
DGTNTNDFVKKVTD; GTNTNDFVKKVTDD; TNTNDFVKKVTDDA;
NTNDFVKKVTDDAL; TNDFVKKVTDDALK; NDFVKKVTDDALKN;
DFVKKVTDDALKNT; FVKKVTDDALKNTE; VKKVTDDALKNTEE;
KKVTDDALKNTEEF; KVTDDALKNTEEFL; VTDDALKNTEEFLE;
TDDALKNTEEFLEK; DDALKNTEEFLEKI; DALKNTEEFLEKIA;
ALKNTEEFLEKIAF; LKNTEEFLEKIAFP; KNTEEFLEKIAFPQ;
NTEEFLEKIAFPQN; TEEFLEKIAFPQNT; EEFLEKIAFPQNTE;
EFLEKIAFPQNTEG; FLEKIAFPQNTEGK; LEKIAFPQNTEGKF;

15 mers:
MKKKMKNLTTCAVFV; KKKMKNLTTCAVFVL; KKMKNLTTCAVFVLT;
KMKNLTTCAVFVLTT; MKNLTTCAVFVLTTS; KNLTTCAVFVLTTSC;
NLTTCAVFVLTTSCK; LTTCAVFVLTTSCKT; TTCAVFVLTTSCKTD;
TCAVFVLTTSCKTDA; CAVFVLTTSCKTDAS; AVFVLTTSCKTDASS;
VFVLTTSCKTDASSE; FVLTTSCKTDASSED; VLTTSCKTDASSEDL;
LTTSCKTDASSEDLK; TTSCKTDASSEDLKQ; TSCKTDASSEDLKQN;
SCKTDASSEDLKQNV; CKTDASSEDLKQNVK; KTDASSEDLKQNVKE;
TDASSEDLKQNVKEK; DASSEDLKQNVKEKV; ASSEDLKQNVKEKVE;
SSEDLKQNVKEKVEG; SEDLKQNVKEKVEGF; EDLKQNVKEKVEGFL;
DLKQNVKEKVEGFLD; LKQNVKEKVEGFLDK; KQNVKEKVEGFLDKE;
QNVKEKVEGFLDKEL; NVKEKVEGFLDKELM; VKEKVEGFLDKELMQ;
KEKVEGFLDKELMQG; EKVEGFLDKELMQGD; KVEGFLDKELMQGDD;
VEGFLDKELMQGDDP; EGFLDKELMQGDDPN; GFLDKELMQGDDPNN;
FLDKELMQGDDPNNS; LDKELMQGDDPNNSL; DKELMQGDDPNNSLF;
KELMQGDDPNNSLFN; ELMQGDDPNNSLFNP; LMQGDDPNNSLFNPP;
MQGDDPNNSLFNPPV; QGDDPNNSLFNPPVL; GDDPNNSLFNPPVLP;
DDPNNSLFNPPVLP; DPNNSLFNPPVLPA; PNNSLFNPPVLPAS;
NNSLFNPPVLPASS; NSLFNPPVLPASSH; SLFNPPVLPASSHD;
LFNPPVLPASSHDN; FNPPVLPASSHDNT; NPPVLPASSHDNTP;
PPVLPASSHDNTPV; PVLPASSHDNTPVL; VLPASSHDNTPVLK;
VLPASSHDNTPVLKA; LPASSHDNTPVLKAV; PASSHDNTPVLKAVQ;
ASSHDNTPVLKAVQA; SSHDNTPVLKAVQAK; SHDNTPVLKAVQAKD;
HDNTPVLKAVQAKDG; DNTPVLKAVQAKDGG; NTPVLKAVQAKDGGQ;
TPVLKAVQAKDGGQQ; PVLKAVQAKDGGQQF; VLKAVQAKDGGQQFC;
LKAVQAKDGGQQFCK; KAVQAKDGGQQFCKF; AVQAKDGGQQFCKFF;
VQAKDGGQQFCKFFK; QAKDGGQQFCKFFKE; AKDGGQQFCKFFKEF;
KDGGQQFCKFFKEFT; DGGQQFCKFFKEFTQ; GGQQFCKFFKEFTQE;
GQQFCKFFKEFTQEL; QQFCKFFKEFTQELK; QFCKFFKEFTQELKD;
FCKFFKEFTQELKDK; CKFFKEFTQELKDKT; KFFKEFTQELKDKTD;
FFKEFTQELKDKTDK; FKEFTQELKDKTDKR; KEFTQELKDKTDKRK;
EFTQELKDKTDKRKK; FTQELKDKTDKRKKE; TQELKDKTDKRKKEL;
QELKDKTDKRKKELE; ELKDKTDKRKKELEK; LKDKTDKRKKELEEA;
KDKTDKRKKELEEAR; DKTDKRKKELEEARK;
KTDKRKKELEEARKK; TDKRKKELEEARKKF; DKRKKELEEARKKFQ;
KRKKELEEARKKFQF; RKKELEEARKKFQFF; KKELEEARKKFQFFK;
KELEEARKKFQFFKQ; ELEEARKKFQFFKQV; LEEARKKFQFFKQVE;
EEARKKFQFFKQVES; EARKKFQFFKQVESA;
RKKFQFFKQVESAT; KKFQFFKQVESATG; KFQFFKQVESATGE;
FQFFKQVESATGES; QFFKQVESATGEST; FFKQVESATGESTE;
FKQVESATGESTEK; KQVESATGESTEKV; QVESATGESTEKVK;

| | |
|---|---|
| | KRKKELEEARKKFQEF; RKKELEEARKKFQEFK; KKELEEARKKFQEFKE; KELEEARKKFQEFKEQ; ELEEARKKFQEFKEQV; LEEARKKFQEFKEQVE; EEARKKFQEFKEQVES; EARKKFQEFKEQVESA; ARKKFQEFKEQVESAT; RKKFQEFKEQVESATG; KKFQEFKEQVESATGE; KFQEFKEQVESATGES; FQEFKEQVESATGEST; QEFKEQVESATGESTE; EFKEQVESATGESTEK; FKEQVESATGESTEKV; KEQVESATGESTEKVK; EQVESATGESTEKVKK; QVESATGESTEKVKKQ; VESATGESTEKVKKQG; ESATGESTEKVKKQGN; SATGESTEKVKKQGNI; ATGESTEKVKKQGNIG; TGESTEKVKKQGNIGQ; GESTEKVKKQGNIGQK; ESTEKVKKQGNIGQKA; STEKVKKQGNIGQKAL; TEKVKKQGNIGQKALK; EKVKKQGNIGQKALKY; KVKKQGNIGQKALKYA; VKKQGNIGQKALKYAK; KKQGNIGQKALKYAKE; KQGNIGQKALKYAKEL; QGNIGQKALKYAKELG; GNIGQKALKYAKELGV; NIGQKALKYAKELGVN; IGQKALKYAKELGVNG; GQKALKYAKELGVNGS; QKALKYAKELGVNGSY; KALKYAKELGVNGSYS; ALKYAKELGVNGSYSV; LKYAKELGVNGSYSVN; KYAKELGVNGSYSVND; YAKELGVNGSYSVNDG; AKELGVNGSYSVNDGT; KELGVNGSYSVNDGTN; ELGVNGSYSVNDGTNT; LGVNGSYSVNDGTNTN; GVNGSYSVNDGTNTND; VNGSYSVNDGTNTNDF; NGSYSVNDGTNTNDFV; GSYSVNDGTNTNDFVK; SYSVNDGTNTNDFVKK; YSVNDGTNTNDFVKKV; SVNDGTNTNDFVKKVI; VNDGTNTNDFVKKVID; NDGTNTNDFVKKVIDD; DGTNTNDFVKKVIDDA; GTNTNDFVKKVIDDAL; TNTNDFVKKVIDDALK; NTNDFVKKVIDDALKN; TNDFVKKVIDDALKNI; NDFVKKVIDDALKNIE; DFVKKVIDDALKNIEE; FVKKVIDDALKNIEEE; VKKVIDDALKNIEEEL; KKVIDDALKNIEEELE; KVIDDALKNIEEELEK; VIDDALKNIEEELEKL; IDDALKNIEEELEKLA; DDALKNIEEELEKLAE; DALKNIEEELEKLAEP; ALKNIEEELEKLAEPQ; LKNIEEELEKLAEPQN; KNIEEELEKLAEPQNI; NIEEELEKLAEPQNIE; IEEELEKLAEPQNIED; EEELEKLAEPQNIEDK; EELEKLAEPQNIEDKK; |
| AAC44770.1\| FlaA protein (Borrelia burgdorferi), SEQ ID NO: 85823-87132 | 13 mers:<br>MKRKAKSILFFLL; KRKAKSILFFLLS; RKAKSILFFLLST; KAKSILFFLLSTV; AKSILFFLLSTVL; KSILFFLLSTVLF; SILFFLLSTVLFA; ILFFLLSTVLFAQ; LFFLLSTVLFAQE; FFLLSTVLFAQET; FLLSTVLFAQETD; LLSTVLFAQETDG; LSTVLFAQETDGL; STVLFAQETDGLA; TVLFAQETDGLAE; VLFAQETDGLAEG; LFAQETDGLAEGS; FAQETDGLAEGSK; AQETDGLAEGSKR; QETDGLAEGSKRA; ETDGLAEGSKRAE; TDGLAEGSKRAEP; DGLAEGSKRAEPG; GLAEGSKRAEPGE; LAEGSKRAEPGEL; AEGSKRAEPGELV; EGSKRAEPGELVL; GSKRAEPGELVLD; SKRAEPGELVLDF; KRAEPGELVLDFA; RAEPGELVLDFAE; AEPGELVLDFAEL; EPGELVLDFAELA; PGELVLDFAELAR; GELVLDFAELARD; ELVLDFAELARDP; LVLDFAELARDPS; VLDFAELARDPSS; LDFAELARDPSST; DFAELARDPSSTR; FAELARDPSSTRL; AELARDPSSTRLD; ELARDPSSTRLDL; LARDPSSTRLDLT; ARDPSSTRLDLTN; RDPSSTRLDLTNY; DPSSTRLDLTNYV; PSSTRLDLTNYVD; SSTRLDLTNYVDY; STRLDLTNYVDYV; TRLDLTNYVDYVY; RLDLTNYVDYVYS; LDLTNYVDYVYSG; DLTNYVDYVYSGA; LTNYVDYVYSGAS; TNYVDYVYSGASG; NYVDYVYSGASGI; YVDYVYSGASGIV; VDYVYSGASGIVK; DYVYSGASGIVKP; YVYSGASGIVKPE; VYSGASGIVKPED; YSGASGIVKPEDM; SGASGIVKPEDMV; GASGIVKPEDMVV; ASGIVKPEDMVVD; SGIVKPEDMVVDL; GIVKPEDMVVDLG; IVKPEDMVVDLGI; VKPEDMVVDLGIN; KPEDMVVDLGINN; PEDMVVDLGINNW; EDMVVDLGINNWS; DMVVDLGINNWSV; MVVDLGINNWSVL; VVDLGINNWSVLL; VDLGINNWSVLLT; DLGINNWSVLLTP; LGINNWSVLLTPS; GINNWSVLLTPSA; INNWSVLLTPSAR; NNWSVLLTPSARL; NWSVLLTPSARLQ; WSVLLTPSARLQA; SVLLTPSARLQAY; VLLTPSARLQAYV; LLTPSARLQAYVK; LTPSARLQAYVKN; TPSARLQAYVKNS; PSARLQAYVKNSV; SARLQAYVKNSVV; ARLQAYVKNSVVA; RLQAYVKNSVVAP; LQAYVKNSVVAPA; QAYVKNSVVAPAV; AYVKNSVVAPAVV; YVKNSVVAPAVVK; VKNSVVAPAVVKS; KNSVVAPAVVKSE; NSVVAPAVVKSES; SVVAPAVVKSESK; VVAPAVVKSESKR; VAPAVVKSESKRY; APAVVKSESKRYA; PAVVKSESKRYAG; AVVKSESKRYAGD; VVKSESKRYAGDT; VKSESKRYAGDTI; |

Fig. 33 continued

Fig. 33 continued 14 mers:
MKRKAKSTLFFLLS; KRKAKSTLFFLLST; RKAKSTLFFLLSTV;
KAKSTLFFLLSTVL; AKSTLFFLLSTVLF; KSTLFFLLSTVLFA;
STLFFLLSTVLFAQ; TLFFLLSTVLFAQE; LFFLLSTVLFAQET;
FFLLSTVLFAQETD; FLLSTVLFAQETDG; LLSTVLFAQETDGL;
LSTVLFAQETDGLA; STVLFAQETDGLAF; TVLFAQETDGLAFG;
VLFAQETDGLAFGS; LFAQETDGLAFGSK; FAQETDGLAFGSKR;
AQETDGLAFGSKRA; QETDGLAFGSKRAF; ETDGLAFGSKRAFP;
TDGLAFGSKRAFPG; DGLAFGSKRAFPGF; GLAFGSKRAFPGFL;
LAFGSKRAFPGFLV; AFGSKRAFPGFLVL; FGSKRAFPGFLVLF;
GSKRAFPGFLVLDF; SKRAFPGFLVLDFA; KRAFPGFLVLDFAF;
RAFPGFLVLDFAFL; AFPGFLVLDFAFLA; FPGFLVLDFAFLAR;
PGFLVLDFAFLARD; GFLVLDFAFLARDP; FLVLDFAFLARDPS;
LVLDFAFLARDPSS; VLDFAFLARDPSST; LDFAFLARDPSSTR;
DFAFLARDPSSTRL; FAFLARDPSSTRLD; AFLARDPSSTRLDL;
FLARDPSSTRLDLT; LARDPSSTRLDLTN; ARDPSSTRLDLTNY;
RDPSSTRLDLTNYV; DPSSTRLDLTNYVD; PSSTRLDLTNYVDY;
SSTRLDLTNYVDYV; STRLDLTNYVDYVY; TRLDLTNYVDYVYS;
RLDLTNYVDYVYSG; LDLTNYVDYVYSGA; DLTNYVDYVYSGAS;
LTNYVDYVYSGASG; TNYVDYVYSGASGT; NYVDYVYSGASGTV;
YVDYVYSGASGTVK; VDYVYSGASGTVKP; DYVYSGASGTVKPF;
YVYSGASGTVKPFD; VYSGASGTVKPFDM; YSGASGTVKPFDMV;
SGASGTVKPFDMVV; GASGTVKPFDMVVD; ASGTVKPFDMVVDL;
SGTVKPFDMVVDLG; GTVKPFDMVVDLGI; TVKPFDMVVDLGIN;
VKPFDMVVDLGINN; KPFDMVVDLGINNW; PFDMVVDLGINNWS;
FDMVVDLGINNWSV; DMVVDLGINNWSVL; MVVDLGINNWSVLL;
VVDLGINNWSVLLT; VDLGINNWSVLLTP; DLGINNWSVLLTPS;
LGINNWSVLLTPSA; GINNWSVLLTPSAR; INNWSVLLTPSARL;
NNWSVLLTPSARLQ; NWSVLLTPSARLQA; WSVLLTPSARLQAY;
SVLLTPSARLQAYV; VLLTPSARLQAYVK; LLTPSARLQAYVKN;
LTPSARLQAYVKNS; TPSARLQAYVKNSV; PSARLQAYVKNSVV;
SARLQAYVKNSVVA; ARLQAYVKNSVVAP; RLQAYVKNSVVAPA;
LQAYVKNSVVAPAV; QAYVKNSVVAPAVV; AYVKNSVVAPAVVK;
YVKNSVVAPAVVKS; VKNSVVAPAVVKSE; KNSVVAPAVVKSES;
NSVVAPAVVKSESK; SVVAPAVVKSESKR; VVAPAVVKSESKRY;
VAPAVVKSESKRYA; APAVVKSESKRYAG; PAVVKSESKRYAGD;
AVVKSESKRYAGDT; VVKSESKRYAGDTT; VKSESKRYAGDTTL;
KSESKRYAGDTTLG; SESKRYAGDTTLGV; ESKRYAGDTTLGVR;
SKRYAGDTTLGVRV; KRYAGDTTLGVRVL; RYAGDTTLGVRVLF;
YAGDTTLGVRVLFP; AGDTTLGVRVLFPS; GDTTLGVRVLFPSY;
DTTLGVRVLFPSYS; TTLGVRVLFPSYSQ; TLGVRVLFPSYSQS;
LGVRVLFPSYSQSS; GVRVLFPSYSQSSA; VRVLFPSYSQSSAM;
RVLFPSYSQSSAMT; VLFPSYSQSSAMTM; LFPSYSQSSAMTMP;
FPSYSQSSAMTMPP; PSYSQSSAMTMPPF; SYSQSSAMTMPPFK;
YSQSSAMTMPPFKT; SQSSAMTMPPFKTP; QSSAMTMPPFKTPF;
SSAMTMPPFKTPFY; SAMTMPPFKTPFYS; AMTMPPFKTPFYSQ;
MTMPPFKTPFYSQF; TMPPFKTPFYSQFS; MPPFKTPFYSQFSQ;
PPFKTPFYSQFSQN; PFKTPFYSQFSQNQ; FKTPFYSQFSQNQF;
KTPFYSQFSQNQFL; TPFYSQFSQNQFLG; PFYSQFSQNQFLGK;
FYSQFSQNQFLGKG; YSQFSQNQFLGKGL; SQFSQNQFLGKGLT;
QFSQNQFLGKGLTD; FSQNQFLGKGLTDN; SQNQFLGKGLTDNT;
QNQFLGKGLTDNTK; NQFLGKGLTDNTKT; QFLGKGLTDNTKTM;
FLGKGLTDNTKTMK; LGKGLTDNTKTMKF; GKGLTDNTKTMKFI;
KGLTDNTKTMKFIK; GLTDNTKTMKFIKV; LTDNTKTMKFIKVS;
TDNTKTMKFIKVSV; DNTKTMKFIKVSVY; NTKTMKFIKVSVYS;
TKTMKFIKVSVYSL; KTMKFIKVSVYSLG; TMKFIKVSVYSLGY;
MKFIKVSVYSLGYE; KFIKVSVYSLGYEL; FIKVSVYSLGYELD;

Fig. 33 continued

LKVSVYSLGYEIDLE; KVSVYSLGYEIDLEV; VSVYSLGYEIDLEVL;
SVYSLGYEIDLEVL; VYSLGYEIDLEVLF; YSLGYEIDLEVLFE;
SLGYEIDLEVLFED; LGYEIDLEVLFEDM; GYEIDLEVLFEDMN;
YEIDLEVLFEDMNQ; EIDLEVLFEDMNQM; IDLEVLFEDMNQME;
DLEVLFEDMNQMEY; LEVLFEDMNQMEYA; EVLFEDMNQMEYAY;
VLFEDMNQMEYAYS; LFEDMNQMEYAYSM; FEDMNQMEYAYSMQ;
EDMNQMEYAYSMQT; DMNQMEYAYSMQTL; MNQMEYAYSMQTLK;
NQMEYAYSMQTLKF; QMEYAYSMQTLKFK; MEYAYSMQTLKFKQ;
EYAYSMQTLKFKQW; YAYSMQTLKFKQWA; AYSMQTLKFKQWAD;
YSMQTLKFKQWADL; SMQTLKFKQWADLT; MQTLKFKQWADLTW;
QTLKFKQWADLTWS; TLKFKQWADLTWSN; LKFKQWADLTWSNP;
KFKQWADLTWSNPN; FKQWADLTWSNPNY; KQWADLTWSNPNYT;
QWADLTWSNPNYTP; WADLTWSNPNYTPN; ADLTWSNPNYTPNT;
DLTWSNPNYTPNTS; LTWSNPNYTPNTSS; TWSNPNYTPNTSSR;
WSNPNYTPNTSSRT; SNPNYTPNTSSRTT; NPNYTPNTSSRTTK;
PNYTPNTSSRTTKD; NYTPNTSSRTTKDD; YTPNTSSRTTKDDV;
TPNTSSRTTKDDVP; PNTSSRTTKDDVPN; NTSSRTTKDDVPNY;
TSSRTTKDDVPNYP; SSRTTKDDVPNYPL; SRTTKDDVPNYPLA;
RTTKDDVPNYPLAS; TTKDDVPNYPLASS; TKDDVPNYPLASSK;
KDDVPNYPLASSKM; DDVPNYPLASSKMR; DVPNYPLASSKMRF;
VPNYPLASSKMRFK; PNYPLASSKMRFKA; NYPLASSKMRFKAF;
YPLASSKMRFKAFR; PLASSKMRFKAFRV; LASSKMRFKAFRVS;
ASSKMRFKAFRVSK; SSKMRFKAFRVSKS; SKMRFKAFRVSKSH;
KMRFKAFRVSKSHS; MRFKAFRVSKSHSS; RFKAFRVSKSHSSK;
FKAFRVSKSHSSKV; KAFRVSKSHSSKVK; AFRVSKSHSSKVKN;
FRVSKSHSSKVKNF; RVSKSHSSKVKNFI; VSKSHSSKVKNFIF;
SKSHSSKVKNFIFY; KSHSSKVKNFIFYV; SHSSKVKNFIFYVK;
HSSKVKNFIFYVKD; SSKVKNFIFYVKDL; SKVKNFIFYVKDLR;
KVKNFIFYVKDLRV; VKNFIFYVKDLRVL; KNFIFYVKDLRVLY;
NFIFYVKDLRVLYD; FIFYVKDLRVLYDK; IFYVKDLRVLYDKL;
FYVKDLRVLYDKLS; YVKDLRVLYDKLSV; VKDLRVLYDKLSVS;
KDLRVLYDKLSVSI; DLRVLYDKLSVSID; LRVLYDKLSVSIDS;
RVLYDKLSVSIDSD; VLYDKLSVSIDSDI; LYDKLSVSIDSDID;
YDKLSVSIDSDIDS; DKLSVSIDSDIDSE; KLSVSIDSDIDSES;
LSVSIDSDIDSESV; SVSIDSDIDSESVF; VSIDSDIDSESVFK;
SIDSDIDSESVFKV; IDSDIDSESVFKVY; DSDIDSESVFKVYE;
SDIDSESVFKVYET; DIDSESVFKVYETS; IDSESVFKVYETSG;
DSESVFKVYETSGT; SESVFKVYETSGTE; ESVFKVYETSGTES;
SVFKVYETSGTESL; VFKVYETSGTESLR; FKVYETSGTESLRK;
KVYETSGTESLRKL; VYETSGTESLRKLK; YETSGTESLRKLKA;
ETSGTESLRKLKAH; TSGTESLRKLKAHE; SGTESLRKLKAHET;
GTESLRKLKAHETF; TESLRKLKAHETFK; ESLRKLKAHETFKR;
SLRKLKAHETFKRV; LRKLKAHETFKRVL; RKLKAHETFKRVLK;
KLKAHETFKRVLKL; LKAHETFKRVLKLR; KAHETFKRVLKLRF;
AHETFKRVLKLRFK; HETFKRVLKLRFKT; ETFKRVLKLRFKTS;
TFKRVLKLRFKTST; FKRVLKLRFKTSTA; KRVLKLRFKTSTAF;
RVLKLRFKTSTAFG; VLKLRFKTSTAFGS; LKLRFKTSTAFGSF;
KLRFKTSTAFGSFQ; LRFKTSTAFGSFQN; RFKTSTAFGSFQNF;
FKTSTAFGSFQNFV; KTSTAFGSFQNFVE; TSTAFGSFQNFVEK;
STAFGSFQNFVEKT; TAFGSFQNFVEKTE; AFGSFQNFVEKTES;
FGSFQNFVEKTESF; GSFQNFVEKTESFK; SFQNFVEKTESFKP;
FQNFVEKTESFKPE; QNFVEKTESFKPEE; NFVEKTESFKPEES;
FVEKTESFKPEESS; VEKTESFKPEESSP; EKTESFKPEESSPK;
KTESFKPEESSPKN;

15 mers:
NKRKAKSILFFLLST; RKAKSILFFLLSLV; RKAKSILFFLLSLVL;

Fig. 33 continued

| | | |
|---|---|---|
| KAKSILFFLLSTVLF; | AKSILFFLLSTVLFA; | KSILFFLLSTVLFAQ; |
| SILFFLLSTVLFAQE; | ILFFLLSTVLFAQET; | LFFLLSTVLFAQETD; |
| FFLLSTVLFAQETDG; | FLLSTVLFAQETDGL; | LLSTVLFAQETDGLA; |
| LSTVLFAQETDGLAE; | STVLFAQETDGLAEG; | TVLFAQETDGLAEGS; |
| VLFAQETDGLAEGSK; | LFAQETDGLAEGSKR; | FAQETDGLAEGSKRA; |
| AQETDGLAEGSKRAF; | QETDGLAEGSKRAFP; | ETDGLAEGSKRAFPG; |
| TDGLAEGSKRAFPGF; | DGLAEGSKRAFPGFL; | GLAEGSKRAFPGFLV; |
| LAEGSKRAFPGFLVL; | AEGSKRAFPGFLVLD; | EGSKRAFPGFLVLDF; |
| GSKRAFPGFLVLDFA; | SKRAFPGFLVLDFAF; | KRAFPGFLVLDFAFL; |
| RAFPGFLVLDFAFLA; | AFPGFLVLDFAFLAR; | FPGFLVLDFAFLARD; |
| PGFLVLDFAFLARDP; | GFLVLDFAFLARDPS; | FLVLDFAFLARDPSS; |
| LVLDFAFLARDPSST; | VLDFAFLARDPSSTR; | LDFAFLARDPSSTRL; |
| DFAFLARDPSSTRLD; | FAFLARDPSSTRLDL; | AFLARDPSSTRLDLT; |
| FLARDPSSTRLDLTN; | LARDPSSTRLDLTNY; | ARDPSSTRLDLTNYV; |
| RDPSSTRLDLTNYVD; | DPSSTRLDLTNYVDY; | PSSTRLDLTNYVDYV; |
| SSTRLDLTNYVDYVY; | STRLDLTNYVDYVYS; | TRLDLTNYVDYVYSG; |
| RLDLTNYVDYVYSGA; | LDLTNYVDYVYSGAS; | DLTNYVDYVYSGASG; |
| LTNYVDYVYSGASGT; | TNYVDYVYSGASGTV; | NYVDYVYSGASGTVK; |
| YVDYVYSGASGTVKP; | VDYVYSGASGTVKPF; | DYVYSGASGTVKPFD; |
| YVYSGASGTVKPFDM; | VYSGASGTVKPFDMV; | YSGASGTVKPFDMVV; |
| SGASGTVKPFDMVVD; | GASGTVKPFDMVVDL; | ASGTVKPFDMVVDLG; |
| SGTVKPFDMVVDLGI; | GTVKPFDMVVDLGIN; | TVKPFDMVVDLGINN; |
| VKPFDMVVDLGINNW; | KPFDMVVDLGINNWS; | PFDMVVDLGINNWSV; |
| FDMVVDLGINNWSVL; | DMVVDLGINNWSVLL; | MVVDLGINNWSVLLT; |
| VVDLGINNWSVLLTP; | VDLGINNWSVLLTPS; | DLGINNWSVLLTPSA; |
| LGINNWSVLLTPSAR; | GINNWSVLLTPSARL; | INNWSVLLTPSARLQ; |
| NNWSVLLTPSARLQA; | NWSVLLTPSARLQAY; | WSVLLTPSARLQAYV; |
| SVLLTPSARLQAYVK; | VLLTPSARLQAYVKN; | LLTPSARLQAYVKNS; |
| LTPSARLQAYVKNSV; | TPSARLQAYVKNSVV; | PSARLQAYVKNSVVA; |
| SARLQAYVKNSVVAP; | ARLQAYVKNSVVAPA; | RLQAYVKNSVVAPAV; |
| LQAYVKNSVVAPAVV; | QAYVKNSVVAPAVVK; | AYVKNSVVAPAVVKS; |
| YVKNSVVAPAVVKSE; | VKNSVVAPAVVKSES; | KNSVVAPAVVKSESK; |
| NSVVAPAVVKSESKR; | SVVAPAVVKSESKRY; | VVAPAVVKSESKRYA; |
| VAPAVVKSESKRYAG; | APAVVKSESKRYAGD; | PAVVKSESKRYAGDT; |
| AVVKSESKRYAGDTI; | VVKSESKRYAGDTIL; | VKSESKRYAGDTILG; |
| KSESKRYAGDTILGV; | SESKRYAGDTILGVR; | ESKRYAGDTILGVRV; |
| SKRYAGDTILGVRVL; | KRYAGDTILGVRVLF; | RYAGDTILGVRVLFP; |
| YAGDTILGVRVLFPS; | AGDTILGVRVLFPSY; | GDTILGVRVLFPSYS; |
| DTILGVRVLFPSYSQ; | TILGVRVLFPSYSQS; | ILGVRVLFPSYSQSS; |
| LGVRVLFPSYSQSSA; | GVRVLFPSYSQSSAM; | VRVLFPSYSQSSAMT; |
| RVLFPSYSQSSAMTP; | VLFPSYSQSSAMTPP; | LFPSYSQSSAMTPPF; |
| FPSYSQSSAMTPPFK; | PSYSQSSAMTPPFKT; | SYSQSSAMTPPFKTP; |
| YSQSSAMTPPFKTP; | SQSSAMTPPFKTPF; | QSSAMTPPFKTPFY; |
| SSAMTPPFKTPFYS; | SAMTPPFKTPFYSG; | AMTPPFKTPFYSGF; |
| MTPPFKTPFYSGFS; | TPPFKTPFYSGFSG; | PPFKTPFYSGFSGN; |
| PPFKTPFYSGFSGNQ; | PFKTPFYSGFSGNQF; | FKTPFYSGFSGNQFL; |
| KTPFYSGFSGNQFLG; | TPFYSGFSGNQFLGK; | PFYSGFSGNQFLGKG; |
| FYSGFSGNQFLGKGL; | YSGFSGNQFLGKGLT; | SGFSGNQFLGKGLTD; |
| GFSGNQFLGKGLTDN; | FSGNQFLGKGLTDNI; | SGNQFLGKGLTDNIK; |
| GNQFLGKGLTDNIKT; | NQFLGKGLTDNIKTM; | QFLGKGLTDNIKTMK; |
| FLGKGLTDNIKTMKF; | LGKGLTDNIKTMKFI; | GKGLTDNIKTMKFIK; |
| KGLTDNIKTMKFIKV; | GLTDNIKTMKFIKVS; | LTDNIKTMKFIKVSV; |
| TDNIKTMKFIKVSVV; | DNIKTMKFIKVSVVS; | NIKTMKFIKVSVVSL; |
| IKTMKFIKVSVVSLG; | KTMKFIKVSVVSLGY; | TMKFIKVSVVSLGYF; |
| MKFIKVSVVSLGYFT; | KFIKVSVVSLGYFTD; | FIKVSVVSLGYFTDL; |
| IKVSVVSLGYFTDLF; | KVSVVSLGYFTDLFV; | VSVVSLGYFTDLFVL; |
| SVVSLGYFTDLFVLF; | VVSLGYFTDLFVLFF; | VSLGYFTDLFVLFFD; |

Fig. 33 continued

SLGYEIDLEVLFEEK; LGYEIDLEVLFEDKN; GYEIDLEVLFEDKNG;
YEIDLEVLFEDMNGV; EIDLEVLFEDKNGME; IDLEVLFEDKNGMEY;
DLEVLFEDKNGMEYA; LEVLFEDMNGKEYAY; EVLFEDMNGKEYAYS;
VLFEDMNGKEYAYSK; LFFDMNGMEYAYSMG; FFDMNGMEYAYSMGT;
FEDMNGMEYAYSMGTL; DMNGMEYAYSKGTLK; MNGKEYAYSKGTLKF;
NGKEYAYSMGTLKFK; GMEYAYSMGTLKFKQ; MEYAYSMGTLKFKQW;
EYAYSMGTLKFKQWA; YAYSMGTLKFKQWAD; AYSMGTLKFKQWADL;
YSMGTLKFKQWADLT; SMGTLKFKQWADLTW; MGTLKFKQWADLTWS;
GTLKFKQWADLTWSN; TLKFKQWADLTWSNP; LKFKQWADLTWSNPN;
KFKQWADLTWSNPNY; FKQWADLTWSNPNYT; KQWADLTWSNPNYTP;
QWADLTWSNPNYTPN; WADLTWSNPNYTPNT; ADLTWSNPNYTPNTS;
DLTWSNPNYTPNTSS; LTWSNPNYTPNTSSR; TWSNPNYTPNTSSRT;
WSNPNYTPNTSSRTT; SNPNYTPNTSSRTTK; NPNYTPNTSSRTTKD;
PNYTPNTSSRTTKDD; NYTPNTSSRTTKDDV; YTPNTSSRTTKDDVP;
TPNTSSRTTKDDVPN; PNTSSRTTKDDVPNY; NTSSRTTKDDVPNYP;
TSSRTTKDDVPNYPL; SSRTTKDDVPNYPLA; SRTTKDDVPNYPLAS;
RTTKDDVPNYPLASS; TTKDDVPNYPLASSK; TKDDVPNYPLASSKM;
KDDVPNYPLASSKMR; DDVPNYPLASSKMRF; DVPNYPLASSKMRFK;
VPNYPLASSKMRFKA; PNYPLASSKMRFKAF; NYPLASSKMRFKAFR;
YPLASSKMRFKAFRV; PLASSKMRFKAFRVS; LASSKMRFKAFRVSK;
ASSKMRFKAFRVSKS; SSKMRFKAFRVSKSH; SKMRFKAFRVSKSHS;
KMRFKAFRVSKSHSS; MRFKAFRVSKSHSSK; RFKAFRVSKSHSSKV;
FKAFRVSKSHSSKVK; KAFRVSKSHSSKVKN; AFRVSKSHSSKVKNF;
FRVS

Fig. 33 continued

| | |
|---|---|
| | VLFEDMNGMEYAYSMG; LFEDMNGMEYAYSMGT; FEDMNGMEYAYSMGTL; EDMNGMEYAYSMGTLK; DMNGMEYAYSMGTLKF; MNGMEYAYSMGTLKFK; NGMEYAYSMGTLKFKG; GMEYAYSMGTLKFKGW; MEYAYSMGTLKFKGWA; EYAYSMGTLKFKGWAD; YAYSMGTLKFKGWADL; AYSMGTLKFKGWADLI; YSMGTLKFKGWADLIW; SMGTLKFKGWADLIWS; MGTLKFKGWADLIWSN; GTLKFKGWADLIWSNP; TLKFKGWADLIWSNPN; LKFKGWADLIWSNPNY; KFKGWADLIWSNPNYI; FKGWADLIWSNPNYIP; KGWADLIWSNPNYIPN; GWADLIWSNPNYIPNI; WADLIWSNPNYIPNIS; ADLIWSNPNYIPNISS; DLIWSNPNYIPNISSR; LIWSNPNYIPNISSRI; IWSNPNYIPNISSRII; WSNPNYIPNISSRIIK; SNPNYIPNISSRIIKD; NPNYIPNISSRIIKDD; PNYIPNISSRIIKDDV; NYIPNISSRIIKDDVP; YIPNISSRIIKDDVPN; IPNISSRIIKDDVPNY; PNISSRIIKDDVPNYP; NISSRIIKDDVPNYPL; ISSRIIKDDVPNYPLA; SSRIIKDDVPNYPLAS; SRIIKDDVPNYPLASS; RIIKDDVPNYPLASSK; IIKDDVPNYPLASSKM; IKDDVPNYPLASSKMR; KDDVPNYPLASSKMRF; DDVPNYPLASSKMRFK; DVPNYPLASSKMRFKA; VPNYPLASSKMRFKAF; PNYPLASSKMRFKAFR; NYPLASSKMRFKAFRV; YPLASSKMRFKAFRVS; PLASSKMRFKAFRVSK; LASSKMRFKAFRVSKS; ASSKMRFKAFRVSKSH; SSKMRFKAFRVSKSHS; SKMRFKAFRVSKSHSS; KMRFKAFRVSKSHSSK; MRFKAFRVSKSHSSKV; RFKAFRVSKSHSSKVK; FKAFRVSKSHSSKVKN; KAFRVSKSHSSKVKNF; AFRVSKSHSSKVKNFI; FRVSKSHSSKVKNFIF; RVSKSHSSKVKNFIFY; VSKSHSSKVKNFIFYV; SKSHSSKVKNFIFYVK; KSHSSKVKNFIFYVKD; SHSSKVKNFIFYVKDL; HSSKVKNFIFYVKDLR; SSKVKNFIFYVKDLRV; SKVKNFIFYVKDLRVL; KVKNFIFYVKDLRVLY; VKNFIFYVKDLRVLYD; KNFIFYVKDLRVLYDK; NFIFYVKDLRVLYDKL; FIFYVKDLRVLYDKLS; IFYVKDLRVLYDKLSV; FYVKDLRVLYDKLSVS; YVKDLRVLYDKLSVSI; VKDLRVLYDKLSVSID; KDLRVLYDKLSVSIDS; DLRVLYDKLSVSIDSD; LRVLYDKLSVSIDSDI; RVLYDKLSVSIDSDID; VLYDKLSVSIDSDIDS; LYDKLSVSIDSDIDSE; YDKLSVSIDSDIDSES; DKLSVSIDSDIDSESV; KLSVSIDSDIDSESVF; LSVSIDSDIDSESVFK; SVSIDSDIDSESVFKV; VSIDSDIDSESVFKVY; SIDSDIDSESVFKVYE; IDSDIDSESVFKVYET; DSDIDSESVFKVYETS; SDIDSESVFKVYETSG; DIDSESVFKVYETSGT; IDSESVFKVYETSGTE; DSESVFKVYETSGTES; SESVFKVYETSGTESL; ESVFKVYETSGTESLR; SVFKVYETSGTESLRK; VFKVYETSGTESLRKL; FKVYETSGTESLRKLK; KVYETSGTESLRKLKA; VYETSGTESLRKLKAH; YETSGTESLRKLKAHE; ETSGTESLRKLKAHET; TSGTESLRKLKAHETF; SGTESLRKLKAHETFK; GTESLRKLKAHETFKR; TESLRKLKAHETFKRV; ESLRKLKAHETFKRVL; SLRKLKAHETFKRVLK; LRKLKAHETFKRVLKL; RKLKAHETFKRVLKLR; KLKAHETFKRVLKLRE; LKAHETFKRVLKLREK; KAHETFKRVLKLREKI; AHETFKRVLKLREKIS; HETFKRVLKLREKISI; ETFKRVLKLREKISIA; TFKRVLKLREKISIAE; FKRVLKLREKISIAEG; KRVLKLREKISIAEGS; RVLKLREKISIAEGSF; VLKLREKISIAEGSFQ; LKLREKISIAEGSFQN; KLREKISIAEGSFQNF; LREKISIAEGSFQNFV; REKISIAEGSFQNFVE; EKISIAEGSFQNFVEK; KISIAEGSFQNFVEKI; ISIAEGSFQNFVEKIE; SIAEGSFQNFVEKIES; IAEGSFQNFVEKIESE; AEGSFQNFVEKIESEK; EGSFQNFVEKIESEKP; GSFQNFVEKIESEKPE; SFQNFVEKIESEKPEE; FQNFVEKIESEKPEES; QNFVEKIESEKPEESS; NFVEKIESEKPEESSP; FVEKIESEKPEESSPK; VEKIESEKPEESSPKN; |
| AAU07005.1\| flagellar filament 41 kDa core protein [Borrelia garinii PBi], SEQ ID NO: 87133-88422 | 13 mers: MIINHNTSAINAS; IINHNTSAINASR; INHNTSAINASRN; NHNTSAINASRNN; HNTSAINASRNNS; NTSAINASRNNSI; TSAINASRNNSIN; SAINASRNNSINA; AINASRNNSINAA; INASRNNSINAAN; NASRNNSINAANL; ASRNNSINAANLS; SRNNSINAANLSK; RNNSINAANLSKT; NNSINAANLSKTQ; NSINAANLSKTQE; SINAANLSKTQEK; INAANLSKTQEKL; NAANLSKTQEKLS; AANLSKTQEKLSS; ANLSKTQEKLSSG; NLSKTQEKLSSGY; LSKTQEKLSSGYR; SKTQEKLSSGYRI; |

YAIENLKASYAQIKL; AIENLKASYAQIKLD; IENLKASYAQIKDA;
ENLKASYAQIKDAT; NLKASYAQIKDATM; LKASYAQIKDATMT;
KASYAQIKDATMTD; ASYAQIKDATMTDE; SYAQIKDATMTDEV;
YAQIKDATMTDEVV; AQIKDATMTDEVVA; QIKDATMTDEVVAS;
IKDATMTDEVVAST; KDATMTDEVVASTT; DATMTDEVVASTTN;
ATMTDEVVASTTNS; TMTDEVVASTTNST; MTDEVVASTTNSTL;
TDEVVASTTNSTLT; DEVVASTTNSTLTQ; EVVASTTNSTLTQS;
VVASTTNSTLTQSA; VASTTNSTLTQSAM; ASTTNSTLTQSAMA;
STTNSTLTQSAMAM; TTNSTLTQSAMAMT; TNSTLTQSAMAMTA;
NSTLTQSAMAMTAQ; STLTQSAMAMTAQA; TLTQSAMAMTAQAN;
LTQSAMAMTAQANQ; TQSAMAMTAQANQV; QSAMAMTAQANQVP;
SAMAMTAQANQVPQ; AMAMTAQANQVPQY; MAMTAQANQVPQYV;
AMTAQANQVPQYVL; MTAQANQVPQYVLS; TAQANQVPQYVLSL;
AQANQVPQYVLSLL; QANQVPQYVLSLLR;

15 mers:
MTTNHNTSATNASRN; TTNHNTSATNASRNN; TNHNTSATNASRNNS;
NHNTSATNASRNNST; HNTSATNASRNNSTN; NTSATNASRNNSTNA;
TSATNASRNNSTNAA; SATNASRNNSTNAAN; ATNASRNNSTNAANL;
TNASRNNSTNAANLS; NASRNNSTNAANLSK; ASRNNSTNAANLSKT;
SRNNSTNAANLSKTQ; RNNSTNAANLSKTQE; NNSTNAANLSKTQEK;
NSTNAANLSKTQEKL; STNAANLSKTQEKLS; TNAANLSKTQEKLSS;
NAANLSKTQEKLSSG; AANLSKTQEKLSSGY; ANLSKTQEKLSSGYR;
NLSKTQEKLSSGYRI; LSKTQEKLSSGYRIN; SKTQEKLSSGYRINR;
KTQEKLSSGYRINRA; TQEKLSSGYRINRAS; QEKLSSGYRINRASD;
EKLSSGYRINRASDD; KLSSGYRINRASDDA; LSSGYRINRASDDAA;
SSGYRINRASDDAAG; SGYRINRASDDAAGM; GYRINRASDDAAGMG;
YRINRASDDAAGMGV; RINRASDDAAGMGVS; INRASDDAAGMGVSG;
NRASDDAAGMGVSGK; RASDDAAGMGVSGKI; ASDDAAGMGVSGKIN;
SDDAAGMGVSGKINA; DDAAGMGVSGKINAQ; DAAGMGVSGKINAQI;
AAGMGVSGKINAQIR; AGMGVSGKINAQIRG; GMGVSGKINAQIRGL;
MGVSGKINAQIRGLS; GVSGKINAQIRGLSQ; VSGKINAQIRGLSQA;
SGKINAQIRGLSQAS; GKINAQIRGLSQASR; KINAQIRGLSQASRN;
INAQIRGLSQASRNT; NAQIRGLSQASRNTS; AQIRGLSQASRNTSK;
QIRGLSQASRNTSKA; IRGLSQASRNTSKAI; RGLSQASRNTSKAIN;
GLSQASRNTSKAINF; LSQASRNTSKAINFI; SQASRNTSKAINFIQ;
QASRNTSKAINFIQT; ASRNTSKAINFIQTT; SRNTSKAINFIQTTE;
RNTSKAINFIQTTEG; NTSKAINFIQTTEGN; TSKAINFIQTTEGNL;
SKAINFIQTTEGNLN; KAINFIQTTEGNLNE; AINFIQTTEGNLNEV;
INFIQTTEGNLNEVE; NFIQTTEGNLNEVEK; FIQTTEGNLNEVEKV;
IQTTEGNLNEVEKVL; QTTEGNLNEVEKVLV; TTEGNLNEVEKVLVR;
TEGNLNEVEKVLVRM; EGNLNEVEKVLVRMK; GNLNEVEKVLVRMKE;
NLNEVEKVLVRMKEL; LNEVEKVLVRMKELA; NEVEKVLVRMKELAV;
EVEKVLVRMKELAVQ; VEKVLVRMKELAVQS; EKVLVRMKELAVQSG;
KVLVRMKELAVQSGN; VLVRMKELAVQSGNG; LVRMKELAVQSGNGT;
VRMKELAVQSGNGTY; RMKELAVQSGNGTYS; MKELAVQSGNGTYSD;
KELAVQSGNGTYSDA; ELAVQSGNGTYSDAD; LAVQSGNGTYSDADR;
AVQSGNGTYSDADRG; VQSGNGTYSDADRGS; QSGNGTYSDADRGSI;
SGNGTYSDADRGSIQ; GNGTYSDADRGSIQT; NGTYSDADRGSIQTE;
GTYSDADRGSIQTEI; TYSDADRGSIQTEIE; YSDADRGSIQTEIEQ;
SDADRGSIQTEIEQL; DADRGSIQTEIEQLT; ADRGSIQTEIEQLTD;
DRGSIQTEIEQLTDE; RGSIQTEIEQLTDEI; GSIQTEIEQLTDEIN;
SIQTEIEQLTDEINR; IQTEIEQLTDEINRI; QTEIEQLTDEINRIA;
TEIEQLTDEINRIAD; EIEQLTDEINRIADQ; IEQLTDEINRIADQA;
EQLTDEINRIADQAQ; QLTDEINRIADQAQY; LTDEINRIADQAQYN;
TDEINRIADQAQYNQ; DEINRIADQAQYNQM; EINRIADQAQYNQMH;
INRIADQAQYNQMHM; NRIADQAQYNQMHML; RIADQAQYNQMHMLS;

Fig. 33 continued

| | | | |
|---|---|---|---|
| | LADQAQYNQMHHLSNK; | ADQAQYNQMHHLSNKS; | DQAQYNQMHHLSNKSA; |
| | QAQYNQMHHLSNKSAS; | AQYNQMHHLSNKSASQ; | QYNQMHHLSNKSASQN; |
| | YNQMHHLSNKSASQNV; | NQMHHLSNKSASQNVR; | QMHHLSNKSASQNVRT; |
| | MHHLSNKSASQNVRTA; | HHLSNKSASQNVRTAF; | HLSNKSASQNVRTAFF; |
| | LSNKSASQNVRTAFFL; | SNKSASQNVRTAFFLC; | NKSASQNVRTAFFLCM; |
| | KSASQNVRTAFFLCMQ; | SASQNVRTAFFLCMQP; | ASQNVRTAFFLCMQPA; |
| | SQNVRTAFFLCMQPAK; | QNVRTAFFLCMQPAKI; | NVRTAFFLCMQPAKIN; |
| | VRTAFFLCMQPAKINT; | RTAFFLCMQPAKINTP; | TAFFLCMQPAKINTPA; |
| | AFFLCMQPAKINTPAS; | FFLCMQPAKINTPASL; | FLCMQPAKINTPASLS; |
| | LCMQPAKINTPASLSC; | CMQPAKINTPASLSCS; | MQPAKINTPASLSCSQ; |
| | QPAKINTPASLSCSQA; | PAKINTPASLSCSQAS; | AKINTPASLSCSQASW; |
| | KINTPASLSCSQASWT; | INTPASLSCSQASWTL; | NTPASLSCSQASWTLR; |
| | TPASLSCSQASWTLRV; | PASLSCSQASWTLRVH; | ASLSCSQASWTLRVHV; |
| | SLSCSQASWTLRVHVC; | LSCSQASWTLRVHVCA; | SCSQASWTLRVHVCAN; |
| | CSQASWTLRVHVCANQ; | SQASWTLRVHVCANQD; | QASWTLRVHVCANQDF; |
| | ASWTLRVHVCANQDFA; | SWTLRVHVCANQDFAT; | WTLRVHVCANQDFATA; |
| | TLRVHVCANQDFATAV; | LRVHVCANQDFATAVN; | RVHVCANQDFATAVNT; |
| | VHVCANQDFATAVNTY; | HVCANQDFATAVNTYA; | VCANQDFATAVNTYAA; |
| | CANQDFATAVNTYAAN; | ANQDFATAVNTYAANV; | NQDFATAVNTYAANVA; |
| | QDFATAVNTYAANVAN; | DFATAVNTYAANVANL; | FATAVNTYAANVANLF; |
| | ATAVNTYAANVANLFS; | TAVNTYAANVANLFSG; | AVNTYAANVANLFSGE; |
| | VNTYAANVANLFSGEG; | NTYAANVANLFSGEGS; | TYAANVANLFSGEGSQ; |
| | YAANVANLFSGEGSQA; | AANVANLFSGEGSQAA; | ANVANLFSGEGSQAAQ; |
| | NVANLFSGEGSQAAQT; | VANLFSGEGSQAAQTA; | ANLFSGEGSQAAQTAP; |
| | NLFSGEGSQAAQTAPV; | LFSGEGSQAAQTAPVQ; | FSGEGSQAAQTAPVQE; |
| | SGEGSQAAQTAPVQEG; | GEGSQAAQTAPVQEGA; | EGSQAAQTAPVQEGAQ; |
| | GSQAAQTAPVQEGAQQ; | SQAAQTAPVQEGAQQE; | QAAQTAPVQEGAQQEG; |
| | AAQTAPVQEGAQQEGA; | AQTAPVQEGAQQEGAQ; | QTAPVQEGAQQEGAQQ; |
| | TAPVQEGAQQEGAQQE; | APVQEGAQQEGAQQEP; | PVQEGAQQEGAQQEPA; |
| | VQEGAQQEGAQQEPAP; | QEGAQQEGAQQEPAPA; | EGAQQEGAQQEPAPAT; |
| | GAQQEGAQQEPAPATA; | AQQEGAQQEPAPATAP; | QQEGAQQEPAPATAPS; |
| | QEGAQQEPAPATAPSQ; | EGAQQEPAPATAPSQG; | GAQQEPAPATAPSQGG; |
| | AQQEPAPATAPSQGGV; | QQEPAPATAPSQGGVN; | QEPAPATAPSQGGVNS; |
| | EPAPATAPSQGGVNSP; | PAPATAPSQGGVNSPV; | APATAPSQGGVNSPVN; |
| | PATAPSQGGVNSPVNV; | ATAPSQGGVNSPVNVT; | TAPSQGGVNSPVNVTT; |
| | APSQGGVNSPVNVTTT; | PSQGGVNSPVNVTTTV; | SQGGVNSPVNVTTTVD; |
| | QGGVNSPVNVTTTVDA; | GGVNSPVNVTTTVDAN; | GVNSPVNVTTTVDANT; |
| | VNSPVNVTTTVDANTS; | NSPVNVTTTVDANTSL; | SPVNVTTTVDANTSLA; |
| | PVNVTTTVDANTSLAK; | VNVTTTVDANTSLAKI; | NVTTTVDANTSLAKIE; |
| | VTTTVDANTSLAKIEN; | TTTVDANTSLAKIENA; | TTVDANTSLAKIENAI; |
| | TVDANTSLAKIENAIR; | VDANTSLAKIENAIRM; | DANTSLAKIENAIRMI; |
| | ANTSLAKIENAIRMIS; | NTSLAKIENAIRMISD; | TSLAKIENAIRMISDQ; |
| | SLAKIENAIRMISDQR; | LAKIENAIRMISDQRA; | AKIENAIRMISDQRAN; |
| | KIENAIRMISDQRANL; | IENAIRMISDQRANLC; | ENAIRMISDQRANLCA; |
| | NAIRMISDQRANLCAF; | AIRMISDQRANLCAFQ; | IRMISDQRANLCAFQN; |
| | RMISDQRANLCAFQNR; | MISDQRANLCAFQNRL; | ISDQRANLCAFQNRLF; |
| | SDQRANLCAFQNRLFS; | DQRANLCAFQNRLFST; | QRANLCAFQNRLFSTK; |
| | RANLCAFQNRLFSTKD; | ANLCAFQNRLFSTKDS; | NLCAFQNRLFSTKDST; |
| | LCAFQNRLFSTKDSTE; | CAFQNRLFSTKDSTEY; | AFQNRLFSTKDSTEYA; |
| | FQNRLFSTKDSTEYAT; | QNRLFSTKDSTEYATE; | NRLFSTKDSTEYATEN; |
| | RLFSTKDSTEYATENL; | LFSTKDSTEYATENLK; | FSTKDSTEYATENLKA; |
| | STKDSTEYATENLKAS; | TKDSTEYATENLKASY; | KDSTEYATENLKASYA; |
| | DSTEYATENLKASYAQ; | STEYATENLKASYAQT; | TEYATENLKASYAQTK; |
| | EYATENLKASYAQTKD; | YATENLKASYAQTKDA; | ATENLKASYAQTKDAT; |
| | TENLKASYAQTKDATM; | ENLKASYAQTKDATMI; | NLKASYAQTKDATMID; |
| | LKASYAQTKDATMIDE; | KASYAQTKDATMIDEV; | ASYAQTKDATMIDEVV; |
| | SYAQTKDATMIDEVVA; | YAQTKDATMIDEVVAS; | AQTKDATMIDEVVASI; |

Fig. 33 continued

```
LKDATHIDEVVASTT;    KDATMIDEVVASTTN;    DATMIDEVVASTTNS;
ATMIDEVVASTTNSI;    TMIDEVVASTTNSIL;    MIDEVVASTTNSILT;
IDEVVASTTNSILTQ;    DEVVASTTNSILTQS;    EVVASTTNSILTQSA;
VVASTTNSILTQSAM;    VASTTNSILTQSAMA;    ASTTNSILTQSAMAM;
STTNSILTQSAMAMT;    TNSILTQSAMAMTA;     NSILTQSAMAMTAQ;
NSILTQSAMAMTAQA;    SILTQSAMAMTAQAN;    ILTQSAMAMTAQANQ;
LTQSAMAMTAQANQV;    TQSAMAMTAQANQVP;    QSAMAMTAQANQVPQ;
SAMAMTAQANQVPQY;    AMAMTAQANQVPQYV;    MAMTAQANQVPQYVL;
AMTAQANQVPQYVLS;    MTAQANQVPQYVLSL;    TAQANQVPQYVLSLR;
AQANQVPQYVLSLR;

16 mers:
MITNENTSATNASRNN;   ITNHNTSATNASRNNS;   TNHNTSATNASRNNST;
NHNTSATNASRNNSTN;   HNTSATNASRNNSTNA;   NTSATNASRNNSTNAA;
TSATNASRNNSTNAAN;   SATNASRNNSTNAANL;   ATNASRNNSTNAANLS;
TNASRNNSTNAANLSK;   NASRNNSTNAANLSKT;   ASRNNSTNAANLSKTQ;
SRNNSTNAANLSKTQF;   RNNSTNAANLSKTQFK;   NNSTNAANLSKTQFKL;
NSTNAANLSKTQFKLS;   STNAANLSKTQFKLSS;   TNAANLSKTQFKLSSG;
NAANLSKTQFKLSSGY;   AANLSKTQFKLSSGYR;   ANLSKTQFKLSSGYRT;
NLSKTQFKLSSGYRTN;   LSKTQFKLSSGYRTNR;   SKTQFKLSSGYRTNRA;
KTQFKLSSGYRTNRAS;   TQFKLSSGYRTNRASD;   QFKLSSGYRTNRASDD;
FKLSSGYRTNRASDDA;   KLSSGYRTNRASDDAA;   LSSGYRTNRASDDAAG;
SSGYRTNRASDDAAGK;   SGYRTNRASDDAAGKG;   GYRTNRASDDAAGKGV;
YRTNRASDDAAGKGVS;   RTNRASDDAAGKGVSG;   TNRASDDAAGKGVSGK;
NRASDDAAGKGVSGKI;   RASDDAAGKGVSGKIN;   ASDDAAGKGVSGKINA;
SDDAAGKGVSGKINAQ;   DDAAGKGVSGKINAQI;   DAAGKGVSGKINAQIR;
AAGKGVSGKINAQIRG;   AGKGVSGKINAQIRGL;   GKGVSGKINAQIRGLS;
KGVSGKINAQIRGLSQ;   GVSGKINAQIRGLSQA;   VSGKINAQIRGLSQAS;
SGKINAQIRGLSQASR;   GKINAQIRGLSQASRN;   KINAQIRGLSQASRNT;
INAQIRGLSQASRNTS;   NAQIRGLSQASRNTSK;   AQIRGLSQASRNTSKA;
QIRGLSQASRNTSKAI;   IRGLSQASRNTSKAIN;   RGLSQASRNTSKAINF;
GLSQASRNTSKAINFI;   LSQASRNTSKAINFIQ;   SQASRNTSKAINFIQT;
QASRNTSKAINFIQTT;   ASRNTSKAINFIQTTE;   SRNTSKAINFIQTTEG;
RNTSKAINFIQTTEGN;   NTSKAINFIQTTEGNL;   TSKAINFIQTTEGNLN;
SKAINFIQTTEGNLNE;   KAINFIQTTEGNLNEV;   AINFIQTTEGNLNEVE;
INFIQTTEGNLNEVEK;   NFIQTTEGNLNEVEKV;   FIQTTEGNLNEVEKVL;
IQTTEGNLNEVEKVLV;   QTTEGNLNEVEKVLVR;   TTEGNLNEVEKVLVRM;
TEGNLNEVEKVLVRMK;   EGNLNEVEKVLVRMKE;   GNLNEVEKVLVRMKEL;
NLNEVEKVLVRMKELA;   LNEVEKVLVRMKELAV;   NEVEKVLVRMKELAVQ;
EVEKVLVRMKELAVQS;   VEKVLVRMKELAVQSG;   EKVLVRMKELAVQSGN;
KVLVRMKELAVQSGNG;   VLVRMKELAVQSGNGT;   LVRMKELAVQSGNGTY;
VRMKELAVQSGNGTYS;   RMKELAVQSGNGTYSD;   MKELAVQSGNGTYSDA;
KELAVQSGNGTYSDAD;   ELAVQSGNGTYSDADR;   LAVQSGNGTYSDADRG;
AVQSGNGTYSDADRGS;   VQSGNGTYSDADRGST;   QSGNGTYSDADRGSTQ;
SGNGTYSDADRGSTQT;   GNGTYSDADRGSTQTF;   NGTYSDADRGSTQTFT;
GTYSDADRGSTQTFTF;   TYSDADRGSTQTFTFQ;   YSDADRGSTQTFTFQL;
SDADRGSTQTFTFQLT;   DADRGSTQTFTFQLTD;   ADRGSTQTFTFQLTDF;
DRGSTQTFTFQLTDFI;   RGSTQTFTFQLTDFIN;   GSTQTFTFQLTDFINR;
STQTFTFQLTDFINRT;   TQTFTFQLTDFINRTA;   QTFTFQLTDFINRTAD;
TFTFQLTDFINRTADQ;   FTFQLTDFINRTADQA;   TFQLTDFINRTADQAQ;
FQLTDFINRTADQAQY;   QLTDFINRTADQAQYN;   LTDFINRTADQAQYNQ;
TDFINRTADQAQYNQM;   DFINRTADQAQYNQMH;   FINRTADQAQYNQMHM;
INRTADQAQYNQMHML;   NRTADQAQYNQMHMLS;   RTADQAQYNQMHMLSN;
TADQAQYNQMHMLSNK;   ADQAQYNQMHMLSNKS;   DQAQYNQMHMLSNKSA;
QAQYNQMHMLSNKSAS;   AQYNQMHMLSNKSASQ;   QYNQMHMLSNKSASQN;
YNQMHMLSNKSASQNV;   NQMHMLSNKSASQNVR;   QMHMLSNKSASQNVRT;
MHMLSNKSASQNVRTA;   HMLSNKSASQNVRTAE;   MLSNKSASQNVRTAEL;
```

| | |
|---|---|
| | STTNSILTQSAMAMIA; TTNSILTQSAMAMIAQ; TNSILTQSAMAMIAQA; NSILTQSAMAMIAQAN; SILTQSAMAMIAQANQ; ILTQSAMAMIAQANQV; LTQSAMAMIAQANQVP; TQSAMAMIAQANQVPQ; QSAMAMIAQANQVPQY; SAMAMIAQANQVPQYV; AMAMIAQANQVPQYVL; MAMIAQANQVPQYVLS; AMIAQANQVPQYVLSL; MIAQANQVPQYVLSLL; IAQANQVPQYVLSLLR; |
| 1L8W\|A Chain A, Crystal Structure Of Lyme Disease Variable Surface Antigen Vlse Of Borrelia Burgdorferi, SEQ ID NO: 88423-89760 | 13 mers: MRGSHHHHHGSS; RGSHHHHHGSSQ; GSHHHHHGSSQV; SHHHHHGSSQVA; HHHHHGSSQVAD; HHHHGSSQVADK; HHHGSSQVADKD; HHGSSQVADKDD; HGSSQVADKDDP; GSSQVADKDDPT; SSQVADKDDPTN; SQVADKDDPTNK; QVADKDDPTNKF; VADKDDPTNKFY; ADKDDPTNKFYQ; DKDDPTNKFYQS; KDDPTNKFYQSV; DDPTNKFYQSVI; DPTNKFYQSVIQ; PTNKFYQSVIQL; TNKFYQSVIQLG; NKFYQSVIQLGN; KFYQSVIQLGNG; FYQSVIQLGNGF; YQSVIQLGNGFL; QSVIQLGNGFLD; SVIQLGNGFLDV; VIQLGNGFLDVF; IQLGNGFLDVFT; QLGNGFLDVFTS; LGNGFLDVFTSF; GNGFLDVFTSFG; NGFLDVFTSFGG; GFLDVFTSFGGL; FLDVFTSFGGLV; LDVFTSFGGLVA; DVFTSFGGLVAE; VFTSFGGLVAEA; FTSFGGLVAEAF; TSFGGLVAEAFG; SFGGLVAEAFGF; FGGLVAEAFGFK; GGLVAEAFGFKS; GLVAEAFGFKSD; LVAEAFGFKSDP; VAEAFGFKSDPK; AEAFGFKSDPKK; EAFGFKSDPKKS; AFGFKSDPKKSD; FGFKSDPKKSDV; GFKSDPKKSDVK; FKSDPKKSDVKT; KSDPKKSDVKTY; SDPKKSDVKTYF; DPKKSDVKTYFT; PKKSDVKTYFTT; KKSDVKTYFTTV; KSDVKTYFTTVA; SDVKTYFTTVAA; DVKTYFTTVAAK; VKTYFTTVAAKL; KTYFTTVAAKLE; TYFTTVAAKLEK; YFTTVAAKLEKT; FTTVAAKLEKTK; TTVAAKLEKTKT; TVAAKLEKTKTD; VAAKLEKTKTDL; AAKLEKTKTDLN; AKLEKTKTDLNS; KLEKTKTDLNSL; LEKTKTDLNSLP; EKTKTDLNSLPK; KTKTDLNSLPKE; TKTDLNSLPKEK; KTDLNSLPKEKS; TDLNSLPKEKSD; DLNSLPKEKSDI; LNSLPKEKSDIS; NSLPKEKSDISS; SLPKEKSDISST; LPKEKSDISSTT; PKEKSDISSTTG; KEKSDISSTTGK; EKSDISSTTGKP; KSDISSTTGKPD; SDISSTTGKPDS; DISSTTGKPDST; ISSTTGKPDSTG; SSTTGKPDSTGS; STTGKPDSTGSV; TTGKPDSTGSVG; TGKPDSTGSVGT; GKPDSTGSVGTA; KPDSTGSVGTAV; PDSTGSVGTAVE; DSTGSVGTAVEG; STGSVGTAVEGA; TGSVGTAVEGAI; GSVGTAVEGAIK; SVGTAVEGAIKE; VGTAVEGAIKEV; GTAVEGAIKEVS; TAVEGAIKEVSE; AVEGAIKEVSEL; VEGAIKEVSELL; EGAIKEVSELLD; GAIKEVSELLDK; AIKEVSELLDKL; IKEVSELLDKLV; KEVSELLDKLVK; EVSELLDKLVKA; VSELLDKLVKAV; SELLDKLVKAVK; ELLDKLVKAVKT; LLDKLVKAVKTA; LDKLVKAVKTAE; DKLVKAVKTAEG; KLVKAVKTAEGA; LVKAVKTAEGAS; VKAVKTAEGASS; KAVKTAEGASSG; AVKTAEGASSGT; VKTAEGASSGTA; KTAEGASSGTAA; TAEGASSGTAAI; AEGASSGTAAIG; EGASSGTAAIGE; GASSGTAAIGEV; ASSGTAAIGEVV; SSGTAAIGEVVA; SGTAAIGEVVAD; GTAAIGEVVADA; TAAIGEVVADAD; AAIGEVVADADA; AIGEVVADADAA; IGEVVADADAAK; GEVVADADAAKV; EVVADADAAKVA; VVADADAAKVAD; VADADAAKVADK; ADADAAKVADKA; DADAAKVADKAS; ADAAKVADKASV; DAAKVADKASVK; AAKVADKASVKG; AKVADKASVKGI; KVADKASVKGIA; VADKASVKGIAK; ADKASVKGIAKG; DKASVKGIAKGI; KASVKGIAKGIK; ASVKGIAKGIKE; SVKGIAKGIKEI; VKGIAKGIKEIV; KGIAKGIKEIVE; GIAKGIKEIVEA; IAKGIKEIVEAA; AKGIKEIVEAAG; KGIKEIVEAAGG; GIKEIVEAAGGS; IKEIVEAAGGSE; KEIVEAAGGSEK; EIVEAAGGSEKL; IVEAAGGSEKLK; VEAAGGSEKLKA; EAAGGSEKLKAV; AAGGSEKLKAVA; AGGSEKLKAVAA; GGSEKLKAVAAA; GSEKLKAVAAAK; SEKLKAVAAAKG; EKLKAVAAAKGE; KLKAVAAAKGEN; LKAVAAAKGENN; KAVAAAKGENNK; AVAAAKGENNKG; VAAAKGENNKGA; AAAKGENNKGAG; AAKGENNKGAGK; AKGENNKGAGKL; KGENNKGAGKLF; GENNKGAGKLFG; ENNKGAGKLFGK; NNKGAGKLFGKA; NKGAGKLFGKAG; KGAGKLFGKAGA; GAGKLFGKAGAA; AGKLFGKAGAAA; GKLFGKAGAAAH; KLFGKAGAAAHG; LFGKAGAAAHGD; FGKAGAAAHGDS; GKAGAAAHGDSE; KAGAAAHGDSEA; AGAAAHGDSEAA; |

```
DAAEQDGKKPEEAKN;    AAEQDGKKPEEAKNP;    AEQDGKKPEEAKNPT;
EQDGKKPEEAKNPTA;    QDGKKPEEAKNPTAA;    DGKKPEEAKNPTAAA;
GKKPEEAKNPTAAAI;    KKPEEAKNPTAAAIG;    KPEEAKNPTAAAIGD;
PEEAKNPTAAAIGDK;    EEAKNPTAAAIGDKD;    EAKNPTAAAIGDKDG;
AKNPTAAAIGDKDGG;    KNPTAAAIGDKDGGA;    NPTAAAIGDKDGGAE;
PTAAAIGDKDGGAEF;    TAAAIGDKDGGAEFQ;    AAAIGDKDGGAEFQQ;
AAIGDKDGGAEFQQD;    AIGDKDGGAEFQQDE;    IGDKDGGAEFQQDEK;
GDKDGGAEFQQDEKK;    DKDGGAEFQQDEKKD;    KDGGAEFQQDEKKDD;
DGGAEFQQDEKKDDQ;    GGAEFQQDEKKDDQT;    GAEFQQDEKKDDQT;
AEFQQDEKKDDQTA;     EFQQDEKKDDQTAA;     FQQDEKKDDQTAAA;
QQDEKKDDQTAAAT;     QDEKKDDQTAAATA;     DEKKDDQTAAATAL;
EKKDDQTAAATALR;     KKDDQTAAATALRG;     KDDQTAAATALRGK;
DDQTAAATALRGKA;     DQTAAATALRGKAK;     QTAAATALRGKAKD;
TAAATALRGKAKDG;     AAATALRGKAKDGK;     AATALRGKAKDGKF;
ATALRGKAKDGKFA;     TALRGKAKDGKFAV;     ALRGKAKDGKFAVK;
LRGKAKDGKFAVKD;     RGKAKDGKFAVKDG;     GKAKDGKFAVKDGE;
KAKDGKFAVKDGEK;     AKDGKFAVKDGEKE;    KDGKFAVKDGEKEK;
DGKFAVKDGEKEKA;    GKFAVKDGEKEKAE;    KFAVKDGEKEKAEG;
FAVKDGEKEKAEGA;    AVKDGEKEKAEGAT;    VKDGEKEKAEGATK;
KDGEKEKAEGATKG;    DGEKEKAEGATKGA;    GEKEKAEGATKGAE;
EKEKAEGATKGAEF;    KEKAEGATKGAEFS;    EKAEGATKGAEFSA;
EKAEGAIKGAAESAV;   KAEGAIKGAAESAVK;   AEGAIKGAAESAVRK;
EGAIKGAAESAVRKV;   GAIKGAAESAVRKVL;   AIKGAAESAVRKVLG;
IKGAAESAVRKVLGA;   KGAAESAVRKVLGAI;   GAAESAVRKVLGAIT;
AAESAVRKVLGAITG;   AESAVRKVLGAITGL;   ESAVRKVLGAITGLI;
SAVRKVLGAITGLIG;   AVRKVLGAITGLIGD;   VRKVLGAITGLIGDA;
RKVLGAITGLIGDAV;   KVLGAITGLIGDAVS;   VLGAITGLIGDAVSS;
LGAITGLIGDAVSSG;   GAITGLIGDAVSSGL;   AITGLIGDAVSSGLR;
ITGLIGDAVSSGLRK;   TGLIGDAVSSGLRKV;   GLIGDAVSSGLRKVG;
LIGDAVSSGLRKVGD;   IGDAVSSGLRKVGDS;   GDAVSSGLRKVGDSV;
DAVSSGLRKVGDSVK;   AVSSGLRKVGDSVKA;   VSSGLRKVGDSVKAA;
SSGLRKVGDSVKAAS;   SGLRKVGDSVKAASK;   GLRKVGDSVKAASKE;
LRKVGDSVKAASKET;   RKVGDSVKAASKETP;   KVGDSVKAASKETPP;
VGDSVKAASKETPPA;   GDSVKAASKETPPAL;   DSVKAASKETPPALN;
SVKAASKETPPALNK;

16 mers:
MRGSHHHHHHGSSQVA;  RGSHHHHHHGSSQVAD;  GSHHHHHHGSSQVADK;
SHHHHHHGSSQVADKD;  HHHHHHGSSQVADKDD;  HHHHHGSSQVADKDDP;
HHHHGSSQVADKDDPT;  HHHGSSQVADKDDPTN;  HHGSSQVADKDDPTNK;
HGSSQVADKDDPTNKF;  GSSQVADKDDPTNKFY;  SSQVADKDDPTNKFYQ;
SQVADKDDPTNKFYQS;  QVADKDDPTNKFYQSV;  VADKDDPTNKFYQSVT;
ADKDDPTNKFYQSVTQ;  DKDDPTNKFYQSVTQL;  KDDPTNKFYQSVTQLG;
DDPTNKFYQSVTQLGN;  DPTNKFYQSVTQLGNC;  PTNKFYQSVTQLGNCF;
TNKFYQSVTQLGNCFL;  NKFYQSVTQLGNCFLD;  KFYQSVTQLGNCFLDV;
FYQSVTQLGNCFLDVF;  YQSVTQLGNCFLDVFT;  QSVTQLGNCFLDVFTS;
SVTQLGNCFLDVFTSF;  VTQLGNCFLDVFTSFG;  TQLGNCFLDVFTSFGG;
QLGNCFLDVFTSFGGL;  LGNCFLDVFTSFGGLV;  GNCFLDVFTSFGGLVA;
NCFLDVFTSFGGLVAE;  CFLDVFTSFGGLVAEA;  FLDVFTSFGGLVAEAF;
LDVFTSFGGLVAEAFG;  DVFTSFGGLVAEAFGK;  VFTSFGGLVAEAFGKK;
FTSFGGLVAEAFGKKS;  TSFGGLVAEAFGKKSD;  SFGGLVAEAFGKKSDP;
FGGLVAEAFGKKSDPK;  GGLVAEAFGKKSDPKK;  GLVAEAFGKKSDPKKS;
LVAEAFGKKSDPKKSD;  VAEAFGKKSDPKKSDV;  AEAFGKKSDPKKSDVK;
EAFGKKSDPKKSDVKT;  AFGKKSDPKKSDVKTY;  FGKKSDPKKSDVKTYF;
GKKSDPKKSDVKTYFT;  KKSDPKKSDVKTYFTT;  KSDPKKSDVKTYFTTV;
SDPKKSDVKTYFTTVA;  DPKKSDVKTYFTTVAA;  PKKSDVKTYFTTVAAR;
KKSDVKTYFTTVAAKL;  KSDVKTYFTTVAAKLE;  SDVKTYFTTVAAKLEK;
```

Fig. 33 continued

| | | |
|---|---|---|
| DVKTYFPTVAAKLEKT; | VKTYFPTVAAKLEKTK; | KTYFPTVAAKLEKTKT; |
| TYFPTVAAKLEKTKTD; | YFPTVAAKLEKTKTDL; | FPTVAAKLEKTKTDLN; |
| PTVAAKLEKTKTDLNS; | TVAAKLEKTKTDLNSL; | VAAKLEKTKTDLNSLP; |
| AAKLEKTKTDLNSLPK; | AKLEKTKTDLNSLPKK; | KLEKTKTDLNSLPKEK; |
| LEKTKTDLNSLPKKKG; | EKTKTDLNSLPKKKGS; | KTKTDLNSLPKEKSDT; |
| TKTDLNSLPKFPSDTS; | KTDLNSLPKEKSDTSS; | TDLNSLPKEKSDTSST; |
| DLNSLPKEKSDTSSTT; | LNSLPKEKSDTSSTTG; | NSLPKEKSDTSSTTGP; |
| SLPKEKSDTSSTTGKP; | LPKEKSDTSSTTGKPD; | PKEKSDTSSTTGKPDS; |
| KEKSDTSSTTGKPDST; | EKSDTSSTTGKPDSTG; | KSDTSSTTGKPDSTGS; |
| SDTSSTTGKPDSTGSV; | DTSSTTGKPDSTGSVG; | TSSTTGKPDSTGSVGT; |
| SSTTGKPDSTGSVGTA; | STTGKPDSTGSVGTAV; | TTGKPDSTGSVGTAVF; |
| TGKPDSTGSVGTAVFG; | GKPDSTGSVGTAVFGA; | KPDSTGSVGTAVFGAT; |
| PDSTGSVGTAVFGATK; | DSTGSVGTAVFGATKF; | STGSVGTAVFGATKFV; |
| TGSVGTAVFGATKFVS; | GSVGTAVFGATKFVSF; | SVGTAVFGATKFVSFL; |
| VGTAVFGATKFVSFLL; | GTAVFGATKFVSFLLD; | TAVFGATKFVSFLLDK; |
| AVFGATKFVSFLLDKI; | VFGATKFVSFLLDKIV; | FGATKFVSFLLDKIVK; |
| GATKFVSFLLDKIVKA; | ATKFVSFLLDKIVKAV; | TKFVSFLLDKIVKAVK; |
| KFVSFLLDKIVKAVKT; | FVSFLLDKIVKAVKTA; | VSFLLDKIVKAVKTAF; |
| SFLLDKIVKAVKTAFG; | FLLDKIVKAVKTAFGA; | LLDKIVKAVKTAFGAS; |
| LDKIVKAVKTAFGASS; | DKIVKAVKTAFGASSG; | KIVKAVKTAFGASSGT; |
| IVKAVKTAFGASSGTA; | VKAVKTAFGASSGTAA; | KAVKTAFGASSGTAAT; |
| AVKTAFGASSGTAATG; | VKTAFGASSGTAATGF; | KTAFGASSGTAATGFV; |
| TAFGASSGTAATGFVV; | AFGASSGTAATGFVVA; | FGASSGTAATGFVVAD; |
| GASSGTAATGFVVADA; | ASSGTAATGFVVADAD; | SSGTAATGFVVADADA; |
| SGTAATGFVVADADAA; | GTAATGFVVADADAAK; | TAATGFVVADADAAKV; |
| AATGFVVADADAAKVA; | ATGFVVADADAAKVAD; | TGFVVADADAAKVADK; |
| GFVVADADAAKVADKA; | FVVADADAAKVADKAS; | VVADADAAKVADKASV; |
| VADADAAKVADKASVK; | ADADAAKVADKASVKG; | DADAAKVADKASVKGI; |
| ADAAKVADKASVKGIA; | DAAKVADKASVKGIAK; | AAKVADKASVKGIAKG; |
| AKVADKASVKGIAKGI; | KVADKASVKGIAKGIK; | VADKASVKGIAKGIKE; |
| ADKASVKGIAKGIKEI; | DKASVKGIAKGIKEIV; | KASVKGIAKGIKEIVE; |
| ASVKGIAKGIKEIVEA; | SVKGIAKGIKEIVEAA; | VKGIAKGIKEIVEAAG; |
| KGIAKGIKEIVEAAGG; | GIAKGIKEIVEAAGGS; | IAKGIKEIVEAAGGSE; |
| AKGIKEIVEAAGGSEK; | KGIKEIVEAAGGSEKL; | GIKEIVEAAGGSEKLK; |
| IKEIVEAAGGSEKLKA; | KEIVEAAGGSEKLKAV; | EIVEAAGGSEKLKAVA; |
| IVEAAGGSEKLKAVAA; | VEAAGGSEKLKAVAAA; | EAAGGSEKLKAVAAAK; |
| AAGGSEKLKAVAAAKG; | AGGSEKLKAVAAAKGE; | GGSEKLKAVAAAKGEN; |
| GSEKLKAVAAAKGENN; | SEKLKAVAAAKGENNK; | EKLKAVAAAKGENNKG; |
| KLKAVAAAKGENNKGA; | LKAVAAAKGENNKGAG; | KAVAAAKGENNKGAGK; |
| AVAAAKGENNKGAGKL; | VAAAKGENNKGAGKLF; | AAAKGENNKGAGKLFG; |
| AAKGENNKGAGKLFGK; | AKGENNKGAGKLFGKA; | KGENNKGAGKLFGKAG; |
| GENNKGAGKLFGKAGA; | ENNKGAGKLFGKAGAA; | NNKGAGKLFGKAGAAA; |
| NKGAGKLFGKAGAAAH; | KGAGKLFGKAGAAAHG; | GAGKLFGKAGAAAHGD; |
| AGKLFGKAGAAAHGDS; | GKLFGKAGAAAHGDSF; | KLFGKAGAAAHGDSFA; |
| LFGKAGAAAHGDSFAA; | FGKAGAAAHGDSFAAS; | GKAGAAAHGDSFAASK; |
| KAGAAAHGDSFAASKA; | AGAAAHGDSFAASKAA; | GAAAHGDSFAASKAAG; |
| AAAHGDSFAASKAAGA; | AAHGDSFAASKAAGAV; | AHGDSFAASKAAGAVS; |
| HGDSFAASKAAGAVSA; | GDSFAASKAAGAVSAV; | DSFAASKAAGAVSAVS; |
| SFAASKAAGAVSAVSG; | FAASKAAGAVSAVSGF; | AASKAAGAVSAVSGFQ; |
| ASKAAGAVSAVSGFQT; | SKAAGAVSAVSGFQTL; | KAAGAVSAVSGFQTLS; |
| AAGAVSAVSGFQTLSA; | AGAVSAVSGFQTLSAT; | GAVSAVSGFQTLSATV; |
| AVSAVSGFQTLSATVT; | VSAVSGFQTLSATVTA; | SAVSGFQTLSATVTAA; |
| AVSGFQTLSATVTAAD; | VSGFQTLSATVTAADA; | SGFQTLSATVTAADAA; |
| GFQTLSATVTAADAAF; | FQTLSATVTAADAAFG; | QTLSATVTAADAAFGD; |
| TLSATVTAADAAFGDG; | LSATVTAADAAFGDGK; | SATVTAADAAFGDGKK; |
| ATVTAADAAFGDGKKP; | TVTAADAAFGDGKKPF; | VTAADAAFGDGKKPFE; |
| TAADAAFGDGKKPEEA; | AADAAFGDGKKPEEAK; | ADAAFGDGKKPEEAKN; |

Fig. 33 continued

|  | DAAEQDGKKPEEAKNP; AAEQDGKKPEEAKNPI; AEQDGKKPEEAKNPIA; EQDGKKPEEAKNPIAA; QDGKKPEEAKNPIAAA; DGKKPEEAKNPIAAAI; GKKPEEAKNPIAAAIG; KKPEEAKNPIAAAIGD; KPEEAKNPIAAAIGDK; PEEAKNPIAAAIGDKD; EEAKNPIAAAIGDKDG; EAKNPIAAAIGDKDGG; AKNPIAAAIGDKDGGA; KNPIAAAIGDKDGGAE; NPIAAAIGDKDGGAEF; PIAAAIGDKDGGAEFG; IAAAIGDKDGGAEFGQ; AAAIGDKDGGAEFGQD; AAIGDKDGGAEFGQDE; AIGDKDGGAEFGQDEK; IGDKDGGAEFGQDEKK; GDKDGGAEFGQDEKKK; DKDGGAEFGQDEKKKD; KDGGAEFGQDEKKKDD; DGGAEFGQDEKKKDDQ; GGAEFGQDEKKKDD

LDALEAIEYLIKI; DALEAIEYLIKIK; ALEAIEYLIKIKI; LEAIEYLIKIKIS;
EAIEYLIKIKIST; AIEYLIKIKISTD; IEYLIKIKISTDS; EYLIKIKISTDST;
YLIKIKISTDSTF; LIKIKISTDSTFL; IKIKISTDSTFLS; KIKISTDSTFLSE;
IKISTDSTFLSED; KISTDSTFLSEDM; ISTDSTFLSEDMT; STDSTFLSEDMTR;
TDSTFLSEDMTRL; DSTFLSEDMTRLI; STFLSEDMTRLIG; TFLSEDMTRLIGS;
FLSEDMTRLIGSY; LSEDMTRLIGSYP; SEDMTRLIGSYPD; EDMTRLIGSYPDS;
DMTRLIGSYPDST; MTRLIGSYPDSTF; TRLIGS

Fig. 33 continued

DSIFNYLIQLNSDKI; SIFNYLIQLNSDKID; IFNYLIQLNSDKIDY;
FNYLIQLNSDKIDYA; NYLIQLNSDKIDYAE; YLIQLNSDKIDYAEK;
LIQLNSDKIDYAEKY; IQLNSDKIDYAEKYG; QLNSDKIDYAEKYGD;
LNSDKIDYAEKYGDN; NSDKIDYAEKYGDNA; SDKIDYAEKYGDNAR;
DKIDYAEKYGDNARN; KIDYAEKYGDNARNN; IDYAEKYGDNARNNF;
DYAEKYGDNARNNFK; YAEKYGDNARNNFKK; AEKYGDNARNNFKKD;
EKYGDNARNNFKKDY; KYGDNARNNFKKDYS; YGDNARNNFKKDYSE;
GDNARNNFKKDYSED; DNARNNFKKDYSEDK; NARNNFKKDYSEDKA;
ARNNFKKDYSEDKAN; RNNFKKDYSEDKANT; NNFKKDYSEDKANTV;
NFKKDYSEDKANTVK; FKKDYSEDKANTVKQ; KKDYSEDKANTVKQT;
KDYSEDKANTVKQTL; DYSEDKANTVKQTLK; YSEDKANTVKQTLKQ;
SEDKANTVKQTLKQT; EDKANTVKQTLKQTL; DKANTVKQTLKQTLA;
KANTVKQTLKQTLAD; ANTVKQTLKQTLADL; NTVKQTLKQTLADLP;
TVKQTLKQTLADLPK; VKQTLKQTLADLPKE;

16 mers:
MRKTSLLTFLFLVVS; RKTSLLTFLFLVVSL; KTSLLTFLFLVVSLS;
TSLLTFLFLVVSLSA; SLLTFLFLVVSLSAN; LLTFLFLVVSLSANT;
LTFLFLVVSLSANTE; TFLFLVVSLSANTEK; FLFLVVSLSANTEKN;
LFLVVSLSANTEKNY; FLVVSLSANTEKNYT; LVVSLSANTEKNYTE;
VVSLSANTEKNYTET; VSLSANTEKNYTETR; SLSANTEKNYTETKR;
LSANTEKNYTETKRA; SANTEKNYTETKRAF; ANTEKNYTETKRAFS;
NTEKNYTETKRAFSK; TEKNYTETKRAFSKE; EKNYTETKRAFSKED;
KNYTETKRAFSKEDF; NYTETKRAFSKEDFN; YTETKRAFSKEDFNL;
TETKRAFSKEDFNLI; ETKRAFSKEDFNLIN; TKRAFSKEDFNLINK;
KRAFSKEDFNLINKR; RAFSKEDFNLINKRL; AFSKEDFNLINKRLD;
FSKEDFNLINKRLDN; SKEDFNLINKRLDNY; KEDFNLINKRLDNYD;
EDFNLINKRLDNYDF; DFNLINKRLDNYDFK; FNLINKRLDNYDFKN;
NLINKRLDNYDFKNE; LINKRLDNYDFKNEY; INKRLDNYDFKNEYE;
NKRLDNYDFKNEYEK; KRLDNYDFKNEYEKS; RLDNYDFKNEYEKSH;
LDNYDFKNEYEKSHV; DNYDFKNEYEKSHVE; NYDFKNEYEKSHVFS;
YDFKNEYEKSHVFSD; DFKNEYEKSHVFSDA; FKNEYEKSHVFSDAP;
KNEYEKSHVFSDAPR; NEYEKSHVFSDAPRI; EYEKSHVFSDAPRIR;
YEKSHVFSDAPRIRG; EKSHVFSDAPRIRGD; KSHVFSDAPRIRGDL;
SHVFSDAPRIRGDLR; HVFSDAPRIRGDLRK; VFSDAPRIRGDLRKI;
FSDAPRIRGDLRKIG; SDAPRIRGDLRKIGI; DAPRIRGDLRKIGIK;
APRIRGDLRKIGIKE; PRIRGDLRKIGIKEK; RIRGDLRKIGIKEKS;
IRGDLRKIGIKEKSV; RGDLRKIGIKEKSVF; GDLRKIGIKEKSVFL;
DLRKIGIKEKSVFLD; LRKIGIKEKSVFLDA; RKIGIKEKSVFLDAL;
KIGIKEKSVFLDALE; IGIKEKSVFLDALEA; GIKEKSVFLDALEAT;
IKEKSVFLDALEATE; KEKSVFLDALEATEY; EKSVFLDALEATEYL;
KSVFLDALEATEYLT; SVFLDALEATEYLTK; VFLDALEATEYLTKT;
FLDALEATEYLTKTK; LDALEATEYLTKTKT; DALEATEYLTKTKTS;
ALEATEYLTKTKTST; LEATEYLTKTKTSTD; EATEYLTKTKTSTDS;
ATEYLTKTKTSTDST; TEYLTKTKTSTDSTF; EYLTKTKTSTDSTFL;
YLTKTKTSTDSTFLS; LTKTKTSTDSTFLSE; TKTKTSTDSTFLSED;
KTKTSTDSTFLSEDM; TKTSTDSTFLSEDMT; KTSTDSTFLSEDMTR;
TSTDSTFLSEDMTRL; STDSTFLSEDMTRLT; TDSTFLSEDMTRLTQ;
DSTFLSEDMTRLTQS; STFLSEDMTRLTQSY; TFLSEDMTRLTQSYP;
FLSEDMTRLTQSYPD; LSEDMTRLTQSYPDS; SEDMTRLTQSYPDST;
EDMTRLTQSYPDSTF; DMTRLTQSYPDSTFN; MTRLTQSYPDSTFNY;
TRLTQSYPDSTFNYL; RLTQSYPDSTFNYLI; LTQSYPDSTFNYLIQ;
TQSYPDSTFNYLIQL; QSYPDSTFNYLIQLN; SYPDSTFNYLIQLNS;
YPDSTFNYLIQLNSD; PDSTFNYLIQLNSDK; DSTFNYLIQLNSDKI;
STFNYLIQLNSDKID; TFNYLIQLNSDKIDY; FNYLIQLNSDKIDYA;
NYLIQLNSDKIDYAE; YLIQLNSDKIDYAEK; LIQLNSDKIDYAEKY;
IQLNSDKIDYAEKYG; QLNSDKIDYAEKYGD;

Fig. 33 continued

| | |
|---|---|
| | LNSDKIDYAEKYGDNA; NSDKIDYAEKYGDNAR; SDKIDYAEKYGDNARN; DKIDYAEKYGDNARNN; KIDYAEKYGDNARNNF; IDYAEKYGDNARNNFK; DYAEKYGDNARNNFKK; YAEKYGDNARNNFKKD; AEKYGDNARNNFKKDY; EKYGDNARNNFKKDYS; KYGDNARNNFKKDYSE; YGDNARNNFKKDYSED; GDNARNNFKKDYSEDK; DNARNNFKKDYSEDKA; NARNNFKKDYSEDKAN; ARNNFKKDYSEDKANT; RNNFKKDYSEDKANTV; NNFKKDYSEDKANTVK; NFKKDYSEDKANTVKQ; FKKDYSEDKANTVKQI; KKDYSEDKANTVKQIL; KDYSEDKANTVKQILK; DYSEDKANTVKQILKQ; YSEDKANTVKQILKQI; SEDKANTVKQILKQIL; EDKANTVKQILKQILA; DKANTVKQILKQILAD; KANTVKQILKQILADL; ANTVKQILKQILADLP; NTVKQILKQILADLPK; TVKQILKQILADLPKD; |
| SEQ ID NO:19, SEQ ID NO: 90383-91628 | 13 mers: MCAFLLLNLVNCK; CAFLLLNLVNCKF; AFLLLNLVNCKFD; FLLLNLVNCKFDS; LLLNLVNCKFDSL; LLNLVNCKFDSLN; LNLVNCKFDSLNL; NLVNCKFDSLNLS; LVNCKFDSLNLST; VNCKFDSLNLSTK; NCKFDSLNLSTKS; CKFDSLNLSTKSV; KFDSLNLSTKSVD; FDSLNLSTKSVDD; DSLNLSTKSVDDK; SLNLSTKSVDDKN; LNLSTKSVDDKNN; NLSTKSVDDKNNS; LSTKSVDDKNNSI; STKSVDDKNNSIA; TKSVDDKNNSIAK; KSVDDKNNSIAKL; SVDDKNNSIAKLL; VDDKNNSIAKLLQ; DDKNNSIAKLLQH; DKNNSIAKLLQHL; KNNSIAKLLQHLS; NNSIAKLLQHLSK; NSIAKLLQHLSKS; SIAKLLQHLSKSE; IAKLLQHLSKSED; AKLLQHLSKSEDQ; KLLQHLSKSEDQA; LLQHLSKSEDQAN; LQHLSKSEDQANK; QHLSKSEDQANKT; HLSKSEDQANKTS; LSKSEDQANKTST; SKSEDQANKTSTS; KSEDQANKTSTSE; SEDQANKTSTSED; EDQANKTSTSEDQ; DQANKTSTSEDQK; QANKTSTSEDQKE; ANKTSTSEDQKEL; NKTSTSEDQKELE; KTSTSEDQKELEI; TSTSEDQKELEIT; STSEDQKELEITE; TSEDQKELEITEN; SEDQKELEITENK; EDQKELEITENKE; DQKELEITENKEQ; QKELEITENKEQE; KELEITENKEQEH; ELEITENKEQEHE; LEITENKEQEHEK; EITENKEQEHEKL; ITENKEQEHEKLS; TENKEQEHEKLSQ; ENKEQEHEKLSQV; NKEQEHEKLSQVA; KEQEHEKLSQVAQ; EQEHEKLSQVAQH; QEHEKLSQVAQHA; EHEKLSQVAQHAP; HEKLSQVAQHAPN; EKLSQVAQHAPNS; KLSQVAQHAPNSK; LSQVAQHAPNSKI; SQVAQHAPNSKIE; QVAQHAPNSKIEK; VAQHAPNSKIEKV; AQHAPNSKIEKVK; QHAPNSKIEKVKS; HAPNSKIEKVKSD; APNSKIEKVKSDG; PNSKIEKVKSDGK; NSKIEKVKSDGKP; SKIEKVKSDGKPV; KIEKVKSDGKPVP; IEKVKSDGKPVPG; EKVKSDGKPVPGD; KVKSDGKPVPGDK; VKSDGKPVPGDKI; KSDGKPVPGDKIL; SDGKPVPGDKILS; DGKPVPGDKILSS; GKPVPGDKILSSN; KPVPGDKILSSNK; PVPGDKILSSNKD; VPGDKILSSNKDI; PGDKILSSNKDIY; GDKILSSNKDIYN; DKILSSNKDIYNS; KILSSNKDIYNSY; ILSSNKDIYNSYI; LSSNKDIYNSYIP; SSNKDIYNSYIPE; SNKDIYNSYIPEV; NKDIYNSYIPEVK; KDIYNSYIPEVKE; DIYNSYIPEVKEE; IYNSYIPEVKEEI; YNSYIPEVKEEIV; NSYIPEVKEEIVY; SYIPEVKEEIVYE; YIPEVKEEIVYEI; IPEVKEEIVYEIL; PEVKEEIVYEILE; EVKEEIVYEILEE; VKEEIVYEILEEV; KEEIVYEILEEVI; EEIVYEILEEVII; |

Fig. 33 continued

EIVYELEEVLPE; LVYELEEVLPET; VYELEEVLPETK;
YELEEVLPETKL; ELEEVLPETKLP; LEEVLPETKLPE;
EEVLPETKLPEL; EVLPETKLPELT; VLPETKLPELTE;
LPETKLPELTEE; PETKLPELTEEV; ETKLPELTEEVM;
TKLPELTEEVMP; KLPELTEEVMPT; LPELTEEVMPTP;
PELTEEVMPTPQ; ELTEEVMPTPQT; LTEEVMPTPQTT;
TEEVMPTPQTTD; EEVMPTPQTTDF; EVMPTPQTTDFY;
VMPTPQTTDFYT; MPTPQTTDFYTE; PTPQTTDFYTEP;
TPQTTDFYTEPR; PQTTDFYTEPRP; QTTDFYTEPRPT;
TTDFYTEPRPTS; TDFYTEPRPTSS; DFYTEPRPTSSF;
FYTEPRPTSSFL; YTEPRPTSSFLT; TEPRPTSSFLTQ;
EPRPTSSFLTQG; PRPTSSFLTQGT; RPTSSFLTQGTS;
PTSSFLTQGTSP; TSSFLTQGTSPS; SSFLTQGTSPST;
SFLTQGTSPSTS; FLTQGTSPSTST; LTQGTSPSTSTT;
TQGTSPSTSTTK; QGTSPSTSTTKS; GTSPSTSTTKSY;
TSPSTSTTKSYK; SPSTSTTKSYKE; PSTSTTKSYKEL;
STSTTKSYKELA; TSTTKSYKELAK; STTKSYKELAKE;
STTKSYKELAKEK; TTKSYKELAKEKI; TKSYKELAKEKIN;
KSYKELAKEKINN; SYKELAKEKINNG; YKELAKEKINNGL;
KELAKEKINNGLN; ELAKEKINNGLNI; LAKEKINNGLNIV;
AKEKINNGLNIVQ; KEKINNGLNIVQK; EKINNGLNIVQKI;
KINNGLNIVQKIT; INNGLNIVQKITQ; NNGLNIVQKITQN;
NGLNIVQKITQNI; GLNIVQKITQNID; LNIVQKITQNIDN;
NIVQKITQNIDNT; IVQKITQNIDNTE; VQKITQNIDNTEN;
QKITQNIDNTENL; KITQNIDNTENLS; ITQNIDNTENLSK;
TQNIDNTENLSKE; QNIDNTENLSKEP; NIDNTENLSKEPK;
IDNTENLSKEPKT; DNTENLSKEPKP; NTENLSKEPKPT;
TENLSKEPKPKT; ENLSKEPKPKTS; NLSKEPKPKISG;
NLSKEPKEISG; LSKEPKEISGK; NSKEPKEISGKE;
SKEPKEISGKEV; KEPKEISGKEVE; EPKEISGKEVEE;
PKEISGKEVEEK; KEISGKEVEEKI; EISGKEVEEKIT;
ISGKEVEEKITH; SGKEVEEKITHP;
GKEVEEKITHPIF; KEVEEKITHPIFD; EVEEKITHPIFDH;
VEEKITHPIFDHI; EEKITHPIFDHIT; EKITHPIFDHITG;
KITHPIFDHITGS; ITHPIFDHITGSG; THPIFDHITGSGK;
HPIFDHITGSGKN; PIFDHITGSGKNP; IFDHITGSGKNPG;
FDHITGSGKNPGQ; DHITGSGKNPGQD; HITGSGKNPGQDS;
ITGSGKNPGQDST; TGSGKNPGQDSTS; GSGKNPGQDSTSN;
SGKNPGQDSTSNT; GKNPGQDSTSNTW; KNPGQDSTSNTWG;
NPGQDSTSNTWGE; PGQDSTSNTWGEG; GQDSTSNTWGEGL;
QDSTSNTWGEGLE; DSTSNTWGEGLET; STSNTWGEGLETG;
TSNTWGEGLETGG; SNTWGEGLETGGD; NTWGEGLETGGDS;
TWGEGLETGGDSN; WGEGLETGGDSNP; GEGLETGGDSNPP;
EGLETGGDSNPPT; GLETGGDSNPPTN; LETGGDSNPPTNL;
ETGGDSNPPTNLE; TGGDSNPPTNLEE; GGDSNPPTNLEEV;
GDSNPPTNLEEVR; DSNPPTNLEEVRS; SNPPTNLEEVRSS;
NPPTNLEEVRSSI; PPTNLEEVRSSIR; PTNLEEVRSSIRK;
TNLEEVRSSIRKL; NLEEVRSSIRKLK; LEEVRSSIRKLKV;
EEVRSSIRKLKV; EVRSSIRKLKVS; VRSSIRKLKVSD;
RSSIRKLKVSDG; SSIRKLKVSDGT; SIRKLKVSDGTE;

Fig. 33 continued

IRKIKVSDGTEQ; RIKIKVSDGTEQT; IKIKVSDGTEQTK;
RIKVSDGTEQTKD; IKVSDGTEQTKDK; KVSDGTEQTKDKV;
VSDGTEQTKDKVE; SDGTEQTKDKVEI; DGTEQTKDKVEID;
GTEQTKDKVEIDE; TEQTKDKVEIDEI; EQTKDKVEIDEII;
QTKDKVEIDEIIE; TKDKVEIDEIIED; KDKVEIDEIIEDL;
DKVEIDEIIEDLQ; KVEIDEIIEDLQK; VEIDEIIEDLQKL;
EIDEIIEDLQKLK; IDEIIEDLQKLKE; DEIIEDLQKLKEF;
EIIEDLQKLKEFL; IIEDLQKLKEFLE; IEDLQKLKEFLEK;
EDLQKLKEFLEKL; DLQKLKEFLEKLK; LQKLKEFLEKLKK;
QKLKEFLEKLKKY; KLKEFLEKLKKYL; LKEFLEKLKKYLK;
KEFLEKLKKYLKD; EFLEKLKKYLKDT; FLEKLKKYLKDTN;
LEKLKKYLKDTNK; EKLKKYLKDTNKL; KLKKYLKDTNKLS;
LKKYLKDTNKLSA; KKYLKDTNKLSAI; KYLKDTNKLSAIE;
YLKDTNKLSAIEE; LKDTNKLSAIEES; KDTNKLSAIEESV;
DTNKLSAIEESVK; TNKLSAIEESVKG; NKLSAIEESVKGL;
NLSAIEESVKGLS;

14 mers:
MCAFLLLNLVKCKF; CAFLLLNLVKCKFD; AFLLLNLVKCKFDS;
FLLLNLVKCKFDSL; LLLNLVKCKFDSLN; LLNLVKCKFDSLNL;
LNLVKCKFDSLNLS; NLVKCKFDSLNLST; LVKCKFDSLNLSTK;
VKCKFDSLNLSTKS; KCKFDSLNLSTKSV; CKFDSLNLSTKSVD;
KFDSLNLSTKSVDD; FDSLNLSTKSVDDK; DSLNLSTKSVDDKN;
SLNLSTKSVDDKN; LNLSTKSVDDKNKS; NLSTKSVDDKNKSI;
LSTKSVDDKNSIA; STKSVDDKNSIAK; TKSVDDKNSIAKL;
KSVDDKNSIAKLL; SVDDKNSIAKLLQ; VDDKNSIAKLLQH;
DDKNSIAKLLQHL; DKNSIAKLLQHLS; KNSIAKLLQHLSK;
NSIAKLLQHLSKS; NSIAKLLQHLSKSE; SIAKLLQHLSKSED;
IAKLLQHLSKSEDQ; AKLLQHLSKSEDQA; KLLQHLSKSEDQAN;
LLQHLSKSEDQANK; LQHLSKSEDQANKT; QHLSKSEDQANKTS;
HLSKSEDQANKTST; LSKSEDQANKTSTS; SKSEDQANKTSTSE;
KSEDQANKTSTSED; SEDQANKTSTSEDQ; EDQANKTSTSEDQK;
DQANKTSTSEDQKF; QANKTSTSEDQKEL; ANKTSTSEDQKELF;
NKTSTSEDQKELFI; KTSTSEDQKELFII; TSTSEDQKELFIIE;
STSEDQKELETTEN; TSEDQKELETTENK; SEDQKELETTENKF;
EDQKELETTENKFQ; DQKELETTENKFQE; QKELETTENKFQEH;
KELETTENKFQEHF; ELETTENKFQEHEK; LETTENKFQEHEKL;
ETTENKFQEHEKLS; TTENKFQEHEKLSQ; TENKFQEHEKLSQV;
ENKFQEHEKLSQVA; NKFQEHEKLSQVAQ; KFQEHEKLSQVAQH;
FQEHEKLSQVAQHA; QEHEKLSQVAQHAP; EHEKLSQVAQHAPN;
HEKLSQVAQHAPNS; EKLSQVAQHAPNSK; KLSQVAQHAPNSKI;
LSQVAQHAPNSKIE; SQVAQHAPNSKIEK; QVAQHAPNSKIEKV;
VAQHAPNSKIEKVK; AQHAPNSKIEKVKS; QHAPNSKIEKVKSD;
HAPNSKIEKVKSDG; APNSKIEKVKSDGK; PNSKIEKVKSDGKP;
NSKIEKVKSDGKPV; SKIEKVKSDGKPVP; KIEKVKSDGKPVPG;
IEKVKSDGKPVPGD; EKVKSDGKPVPGDK; KVKSDGKPVPGDKI;
VKSDGKPVPGDKIL; KSDGKPVPGDKILS; SDGKPVPGDKILSS;
DGKPVPGDKILSSK; GKPVPGDKILSSKD; KPVPGDKILSSKDI;
PVPGDKILSSKDIY; VPGDKILSSKDIYN; PGDKILSSKDIYNS;
GDKILSSKDIYNSY; DKILSSKDIYNSYI; KILSSKDIYNSYIP;
ILSSKDIYNSYIPE; LSSKDIYNSYIPEE; SSKDIYNSYIPEEV;

Fig. 33 continued

SNKDIYNSYIPEVK; NKDIYNSYIPEVKE; KDIYNSYIPEVKEE;
DIYNSYIPEVKEET; IYNSYIPEVKEETV; YNSYIPEVKEETVY;
NSYIPEVKEETVYE; SYIPEVKEETVYET; YIPEVKEETVYETL;
IPEVKEETVYETLE; PEVKEETVYETLEE; EVKEETVYETLEEV;
VKEETVYETLEEVI; KEETVYETLEEVIL; EETVYETLEEVILP;
ETVYETLEEVILPR; TVYETLEEVILPRT; VYETLEEVILPRTK;
YETLEEVILPRTKT; ETLEEVILPRTKTP; TLEEVILPRTKTPP;
LEEVILPRTKTPPI; EEVILPRTKTPPIT; EVILPRTKTPPIT

Fig. 33 continued

| | | | |
|---|---|---|---|
| | DCKPVPGDKILSSNK; | GKPVPGDKILSSNKD; | KPVPGDKILSSNKDT; |
| | PVPGDKILSSNKDTY; | VPGDKILSSNKDTYK; | PGDKILSSNKDTYKS; |
| | GDKILSSNKDTYKSY; | DKILSSNKDTYKSYI; | KILSSNKDTYKSYIP; |
| | ILSSNKDTYKSYIPE; | LSSNKDTYKSYIPEV; | SSNKDTYKSYIPEVK; |
| | SNKDTYKSYIPEVKE; | NKDTYKSYIPEVKEE; | KDTYKSYIPEVKEEI; |
| | DTYKSYIPEVKEEIV; | TYKSYIPEVKEEIVY; | YKSYIPEVKEEIVYE; |
| | KSYIPEVKEEIVYEI; | SYIPEVKEEIVYEIL; | YIPEVKEEIVYEILE; |
| | IPEVKEEIVYEILEE; | PEVKEEIVYEILEEV; | EVKEEIVYEILEEVI; |
| | VKEEIVYEILEEVII; | KEEIVYEILEEVIIP; | EEIVYEILEEVIIPE; |
| | EIVYEILEEVIIPET; | IVYEILEEVIIPETK; | VYEILEEVIIPETKI; |
| | YEILEEVIIPETKIP; | EILEEVIIPETKIPE; | ILEEVIIPETKIPEI; |
| | LEEVIIPETKIPEIT; | EEVIIPETKIPEITE; | EVIIPETKIPEITEE; |
| | VIIPETKIPEITEEV; | IIPETKIPEITEEVI; | IPETKIPEITEEVIM; |
| | PETKIPEITEEVIMP; | ETKIPEITEEVIMPI; | TKIPEITEEVIMPIP; |
| | KIPEITEEVIMPIPQ; | IPEITEEVIMPIPQT; | PEITEEVIMPIPQTI; |
| | EITEEVIMPIPQTID; | ITEEVIMPIPQTIDF; | TEEVIMPIPQTIDFY; |
| | EEVIMPIPQTIDFYI; | EVIMPIPQTIDFYIE; | VIMPIPQTIDFYIEP; |
| | IMPIPQTIDFYIEPR; | MPIPQTIDFYIEPRP; | PIPQTIDFYIEPRPI; |
| | IPQTIDFYIEPRPIS; | PQTIDFYIEPRPISS; | QTIDFYIEPRPISSF; |
| | TIDFYIEPRPISSFL; | IDFYIEPRPISSFLT; | DFYIEPRPISSFLTQ; |
| | FYIEPRPISSFLTQG; | YIEPRPISSFLTQGT; | IEPRPISSFLTQGTS; |
| | EPRPISSFLTQGTSP; | PRPISSFLTQGTSPS; | RPISSFLTQGTSPSI; |
| | PISSFLTQGTSPSIT; | ISSFLTQGTSPSITS; | SSFLTQGTSPSITST; |
| | SFLTQGTSPSITSTI; | FLTQGTSPSITSTIK; | LTQGTSPSITSTIKS; |
| | TQGTSPSITSTIKSY; | QGTSPSITSTIKSYK; | GTSPSITSTIKSYKE; |
| | TSPSITSTIKSYKEL; | SPSITSTIKSYKELA; | PSITSTIKSYKELAK; |
| | SITSTIKSYKELAKE; | ITSTIKSYKELAKEK; | TSTIKSYKELAKEKI; |
| | STIKSYKELAKEKIN; | TIKSYKELAKEKINE; | IKSYKELAKEKINEG; |
| | KSYKELAKEKINEGL; | SYKELAKEKINEGLN; | YKELAKEKINEGLNI; |
| | KELAKEKINEGLNIV; | ELAKEKINEGLNIVQ; | LAKEKINEGLNIVQK; |
| | AKEKINEGLNIVQKI; | KEKINEGLNIVQKIT; | EKINEGLNIVQKITQ; |
| | KINEGLNIVQKITQN; | INEGLNIVQKITQNI; | NEGLNIVQKITQNID; |
| | EGLNIVQKITQNIDN; | GLNIVQKITQNIDNT; | LNIVQKITQNIDNTI; |
| | NIVQKITQNIDNTIE; | IVQKITQNIDNTIEK; | VQKITQNIDNTIEKL; |
| | QKITQNIDNTIEKLN; | KITQNIDNTIEKLNS; | ITQNIDNTIEKLNSK; |
| | TQNIDNTIEKLNSKE; | QNIDNTIEKLNSKET; | NIDNTIEKLNSKETP; |
| | IDNTIEKLNSKETPK; | DNTIEKLNSKETPKE; | NTIEKLNSKETPKEI; |
| | TIEKLNSKETPKEIS; | IEKLNSKETPKEISG; | EKLNSKETPKEISGK; |
| | KLNSKETPKEISGKE; | LNSKETPKEISGKEV; | NSKETPKEISGKEVE; |
| | SKETPKEISGKEVEE; | KETPKEISGKEVEEK; | ETPKEISGKEVEEKI; |
| | TPKEISGKEVEEKIT; | PKEISGKEVEEKITH; | KEISGKEVEEKITHP; |
| | EISGKEVEEKITHPI; | ISGKEVEEKITHPIF; | SGKEVEEKITHPIFD; |
| | GKEVEEKITHPIFDH; | KEVEEKITHPIFDHT; | EVEEKITHPIFDHTT; |
| | VEEKITHPIFDHTTG; | EEKITHPIFDHTTGS; | EKITHPIFDHTTGSS; |
| | KITHPIFDHITGSGN; | ITHPIFDHITGSGNK; | THPIFDHITGSGNKP; |
| | HPIFDHITGSGNKPG; | PIFDHITGSGNKPGQ; | IFDHITGSGNKPGQD; |
| | FDHTTGSGNKPGQDS; | DHTTGSGNKPGQDST; | HTTGSGNKPGQDSTS; |
| | TTGSGNKPGQDSTSN; | TGSGNKPGQDSTSNT; | GSGNKPGQDSISNTW; |
| | SGNKPGQDSISNTWG; | GNKPGQDSISNTWGE; | NKPGQDSISNTWGEG; |
| | KPGQDSISNTWGEGL; | PGQDSISNTWGEGLE; | GQDSISNTWGEGLET; |
| | QDSISNTWGEGLETG; | DSISNTWGEGLETGG; | SISNTWGEGLETGGD; |

Fig. 33 continued

ISKTKGCLEIGGDS; SKTWGEGLEIGGDSK; KTWGCLEIGGDSKF;
TWGGLETGGDSKFF; WGGLETGGDSKFFT; GFGLETGGDSKFFTN;
FGLETGGDSKFFTNL; GLETGGDSKFFTNLF; LFTGGDSKFFTNLFF;
ETGGDSKFFTNLFFV; TGGDSKFFTNLFFVR; GGDSKFFTNLFFVRS;
GDSKFFTNLFFVRSS; DSKFFTNLFFVRSSL; SKFFTNLFFVRSSLR;
KFFTNLFFVRSSLRT; FFTNLFFVRSSLRTK; FTNLFFVRSSLRTKT;
TNLFFV

HAPNSKIEKVKSDCKP; APKSKIEKVKSDCKPV; PNSKIEKVKSDCKPVP;
NSKIEKVKSDCKPVPG; SKIEKVKSDCKPVPGD; KIEKVKSDCKPVPGDK;
IEKVKSDCKPVPGDKI; EKVKSDCKPVPGDKIL; KVKSDCKPVPGDKILS;
VKSDCKPVPGDKILSS; KSDCKPVPGDKILSSN; SDCKPVPGDKILSSNK;
DCKPVPGDKILSSNKD; CKPVPGDKILSSNKDI; KPVPGDKILSSNKDIY;
PVPGDKILSSNKDIYK; VPGDKILSSNKDIYNS; P

| | |
|---|---|
| | ITGSGNNPGQDSISNT; TGSGNNPGQDSISNTW; GSGNNPGQDSISNTWG; SGNNPGQDSISNTWGE; GNNPGQDSISNTWGEG; NNPGQDSISNTWGEGL; NPGQDSISNTWGEGLE; PGQDSISNTWGEGLEI; GQDSISNTWGEGLEIG; QDSISNTWGEGLEIGG; DSISNTWGEGLEIGGD; SISNTWGEGLEIGGDS; ISNTWGEGLEIGGDSN; SNTWGEGLEIGGDSNF; NTWGEGLEIGGDSNFF; TWGEGLEIGGDSNFFT; WGEGLEIGGDSNFFTN; GEGLEIGGDSNFFTNL; EGLEIGGDSNFFTNLE; GLEIGGDSNFFTNLEE; LEIGGDSNFFTNLEEV; EIGGDSNFFTNLEEVR; IGGDSNFFTNLEEVRS; GGDSNFFTNLEEVRSS; GDSNFFTNLEEVRSSI; DSNFFTNLEEVRSSIR; SNFFTNLEEVRSSIRT; NFFTNLEEVRSSIRTK; FFTNLEEVRSSIRTKI; FTNLEEVRSSIRTKIK; TNLEEVRSSIRTKIKV; NLEEVRSSIRTKIKVS; LEEVRSSIRTKIKVSD; EEVRSSIRTKIKVSDG; EVRSSIRTKIKVSDGT; VRSSIRTKIKVSDGTE; RSSIRTKIKVSDGTEQ; SSIRTKIKVSDGTEQT; SIRTKIKVSDGTEQTK; IRTKIKVSDGTEQTKD; RTKIKVSDGTEQTKDK; TKIKVSDGTEQTKDKV; KIKVSDGTEQTKDKVE; IKVSDGTEQTKDKVEI; KVSDGTEQTKDKVEID; VSDGTEQTKDKVEIDE; SDGTEQTKDKVEIDEI; DGTEQTKDKVEIDEII; GTEQTKDKVEIDEIIE; TEQTKDKVEIDEIIED; EQTKDKVEIDEIIEDL; QTKDKVEIDEIIEDLQ; TKDKVEIDEIIEDLQK; KDKVEIDEIIEDLQKL; DKVEIDEIIEDLQKLK; KVEIDEIIEDLQKLKE; VEIDEIIEDLQKLKEF; EIDEIIEDLQKLKEFL; IDEIIEDLQKLKEFLE; DEIIEDLQKLKEFLEK; EIIEDLQKLKEFLEKL; IIEDLQKLKEFLEKLK; IEDLQKLKEFLEKLKK; EDLQKLKEFLEKLKKY; DLQKLKEFLEKLKKYL; LQKLKEFLEKLKKYLK; QKLKEFLEKLKKYLKD; KLKEFLEKLKKYLKDT; LKEFLEKLKKYLKDTN; KEFLEKLKKYLKDTNN; EFLEKLKKYLKDTNNL; FLEKLKKYLKDTNNLS; LEKLKKYLKDTNNLSA; EKLKKYLKDTNNLSAI; KLKKYLKDTNNLSAIE; LKKYLKDTNNLSAIEE; KKYLKDTNNLSAIEES; KYLKDTNNLSAIEESV; YLKDTNNLSAIEESVK; LKDTNNLSAIEESVKG; KDTNNLSAIEESVKGL; DTNNLSAIEESVKGLS; |
| SEQ ID NO: 20 SEQ ID NO: 91629-93474 | 13 mers: MIKMSLNYTEINT; IKMSLNYTEINTL; KMSLNYTEINTLI; MSLNYTEINTLIK; SLNYTEINTLIKE; LNYTEINTLIKEI; NYTEINTLIKEIP; YTEINTLIKEIPF; TEINTLIKEIPFT; EINTLIKEIPFTN; INTLIKEIPFTNS; NTLIKEIPFTNSL; TLIKEIPFTNSLI; LIKEIPFTNSLIT; IKEIPFTNSLITK; KEIPFTNSLITKI; EIPFTNSLITKII; IPFTNSLITKIIQ; PFTNSLITKIIQP; FTNSLITKIIQPD; TNSLITKIIQPDY; NSLITKIIQPDYK; SLITKIIQPDYKS; LITKIIQPDYKSL; ITKIIQPDYKSLV; TKIIQPDYKSLVL; KIIQPDYKSLVLE; IIQPDYKSLVLEI; IQPDYKSLVLEIY; QPDYKSLVLEIYN; PDYKSLVLEIYNK; DYKSLVLEIYNKI; YKSLVLEIYNKID; KSLVLEIYNKIDN; SLVLEIYNKIDNK; LVLEIYNKIDNKK; VLEIYNKIDNKKF; LEIYNKIDNKKFK; EIYNKIDNKKFKI; IYNKIDNKKFKIL; YNKIDNKKFKILI; NKIDNKKFKILIC; KIDNKKFKILICL; IDNKKFKILICLN; DNKKFKILICLNP; NKKFKILICLNPN; KKFKILICLNPNT; KFKILICLNPNTT; FKILICLNPNTTR; KILICLNPNTTRF; ILICLNPNTTRFH; LICLNPNTTRFHI; ICLNPNTTRFHIT; CLNPNTTRFHITK; LNPNTTRFHITKK; NPNTTRFHITKKN; PNTTRFHITKKNF; NTTRFHITKKNFK; TTRFHITKKNFKK; TRFHITKKNFKKN; |

Fig. 33 continued

KPHIKKKFKKNA; FHIKKNFKKEAD; HIKKNFKKEALK;
IKKKFKKNALKL; KKNFKKNALKLR; KNFKKNALKLRF;
KNFKKNALKLRFS; KFKKNALKLRFSD; FKKNALKLRFSDF;
KKNALKLRFSDFL; KNALKLRFSDFLK; NALKLRFSDFLKS;
ALKLRFSDFLKSK; LKLRFSDFLKSKI; KLRFSDFLKSKIQ;
LRFSDFLKSKIQN; RFSDFLKSKIQNG; FSDFLKSKIQNGK;
SDFLKSKIQNGKT; DFLKSKIQNGKTT; FLKSKIQNGKTTK;
LKSKIQNGKTTKA; KSKIQNGKTTKAF; SKIQNGKTTKAFQ;
KIQNGKTTKAFQM; IQNGKTTKAFQMK; QNGKTTKAFQMKK;
NGKTTKAFQMKKE; GKTTKAFQMKKER; KTTKAFQMKKERT;
TTKAFQMKKERTT; TKAFQMKKERTTS; KAFQMKKERTTSL;
AFQMKKERTTSLE; FQMKKERTTSLET; QMKKERTTSLETL;
MKKERTTSLETLQ; KKERTTSLETLQK; KERTTSLETLQKD;
ERTTSLETLQKDM; RTTSLETLQKDMT; TTSLETLQKDMTT;
TSLETLQKDMTTL; SLETLQKDMTTLF; LETLQKDMTTLFT;
ETLQKDMTTLFTK; TLQKDMTTLFTKL; LQKDMTTLFTKLW;
QKDMTTLFTKLWP; KDMTTLF

KKELIVLEKRIDS; KELIVLEKRIDSL; ELIVLEKRIDSLK;
LIVLEKRIDSLKQ; IVLEKRIDSLKQQ; VLEKRIDSLKQQT;
LEKRIDSLKQQTK; EKRIDSLKQQTKL; KRIDSLKQQTKLL;
RIDSLKQQTKLLE; IDSLKQQTKLLEE; DSLKQQTKLLEEK;
SLKQQTKLLEKIE; LKQQIKLLEDIEN; KQQIKLLENIEEE;
QQTKLLEKTENEK; QTKLLENTENEKE; TKLLENTENEKEK;
KLLENTENEKEKG; LLEKTENEKEKGE; LENTENEKEKGEL;
ENTENEKEKGELL; NTENEKEKGELLL; TENEKEKGELLLE;
ENEKEKGELLLEK; NEKEKGELLLEKT; EKEKGELLLEKTN;
EKEKGELLLEKTNK; KEKGELLLEKTNKT; EKGELLLEKTNKTQ;
KGELLLEKTNKTQK; GELLLEKTNKTQKG; ELLLEKTNKTQKGT;
LLLEKTNKLQKGTK; LLEKTNKLQKGTKE; LEKTNKLQKGTKEL;
EKTNKLQKGTKELN; TNKLQKGTKELNLL; NKLQKGTKELNLLN;
KLQKGTKELNLLNY; LQKGTKELNLLNYK; QKGTKELNLLNYKE;
KGTKELNLLNYKEE; GTKELNLLNYKEEK; TKELNLLNYKEEKI;
KELNLLNYKEEKIK; ELNLLNYKEEKIKI; LNLLNYKEEKIKIS;
NLLNYKEEKTKIS; LLNYKEEKTKISL; LNYKEEKTKISLN;
NYKEEKTKISLNQ; YKEEKTKISLNQS; KEEKTKISLNQSL;
EEKIKISLNQSLS; EKIKISLNQSLSP; KIKISLNQSLSPK;
IKISLNQSLSPKE; KISLNQSLSPKEN; ISLNQSLSPKENA;
SLNQSLSPKENAL; LNQSLSPKENALQ; NQSLSPKENALQY;
QSLSPKENALQYE; SLSPKENALQYEK; LSPKENALQYEKA;
SPKENALQYEKAY; PKENALQYEKAYK; KENALQYEKAYKK;
ENALQYEKAYKKG; NALQYEKAYKKGK; ALQYEKAYKKGKN;
LQYEKAYKKGKNS; QYEKAYKKGKNSE; YEKAYKKGKNSEK;
EKAYKKGKNSEKT; KAYKKGKNSEKTI; AYKKGKNSEKTIQ;
YKKGKNSEKTIQK; KKGKNSEKTIQKL; KGKNSEKTIQKLK;
GKNSEKTIQKLKD; KNSEKTIQKLKDE; NSEKTIQKLKDEK;
SEKTIQKLKDEKF; EKTIQKLKDEKEL; KTIQKLKDEKFKL;
TIQKLKDEKFKEL; IQKLKDEKFKELN; QKLKDEKFKELNL;
KLKDEKFKELNLL; LKDEKFKELNLLQ; KDEKFKELNLLQS;
DEKFKELNLLQSK; EKFKELNLLQSKT; KFKELNLLQSKTT;
FKELNLLQSKTTM; KELNLLQSKTTML; ELNLLQSKTTMLK;
LNLLQSKTTMLKV; NLLQSKTTMLKVE; LLQSKTTMLKVEN;
LQSKTTMLKVENL; QSKTTMLKVENLT; SKTTMLKVENLTP;
KTTMLKVENLTPE; TTMLKVENLTPEE; TMLKVENLTPEEY;
MLKVENLTPEEYN; LKVENLTPEEYNQ; KVENLTPEEYNQE;
VENLTPEEYNQEK; ENLTPEEYNQEKT; NLTPEEYNQEKTA;
LTPEEYNQEKTAI; TPEEYNQEKTAIK; PEEYNQEKTAIKE;
EEYNQEKTAIKEK; EYNQEKTAIKEKE; YNQEKTAIKEKEK;
NQEKTAIKEKEKT; QEKTAIKEKEKTP; EKTAIKEKEKTPK;
KTAIKEKEKTPKI; TAIKEKEKTPKIG; AIKEKEKTPKIGL;
IKEKEKTPKIGLH; KEKEKTPKIGLHF; EKEKTPKIGLHFT;
KEKTPKIGLHFTY; EKTPKIGLHFTYC; KTPKIGLHFTYCG;
TPKIGLHFTYCGE; PKIGLHFTYCGEE; KIGLHFTYCGEEL;
IGLHFTYCGEELL; GLHFTYCGEELLL; LHFTYCGEELLLG;
HFTYCGEELLLGR; FTYCGEELLLGRK; TYCGEELLLGRKA;
YCGEELLLGRKAK; CGEELLLGRKAKE; GEELLLGRKAKEN;
EELLLGRKAKEND; ELLLGRKAKENDK; LLLGRKAKENDKL;
LLGRKAKENDKLL; LGRKAKENDKLLR; GRKAKENDKLLRN;
RKAKENDKLLRNV; KAKENDKLLRNVK;

Fig. 33 continued

AKENEKLLRHCVK; KEKDKLLRHCVKG; EKDKLLRHCVKGK;
DKLLRHCVKGND; DKLLRHCVKGNDY; KLLRHCVKGNDYW;
LLRHCVKGNDYWL; LRHCVKGNDYWLH; RHCVKGNDYWLHT;
HCVKGNDYWLHTR; CVKGNDYWLHTRD; VKGNDYWLHTRDY;
KGNDYWLHTRDYP; GNDYWLHTRDYPG; NDYWLHTRDYPGA;
DYWLHTRDYPGAY; YWLHTRDYPGAYV; WLHTRDYPGAYVF;
LHTRDYPGAYVFT; HTRDYPGAYVFTK; TRDYPGAYVFTKK;
RDYPGAYVFTKKQ; DYPGAYVFTKKQK; YPGAYVFTKKQKN;
PGAYVFTKKQKNK; GAYVFTKKQKNKT; AYVFTKKQKNKTP;
YVFTKKQKNKTPS; VFTKKQKNKTPSL; FTKKQKNKTPSLD;
TKKQKNKTPSLDV; KKQKNKTPSLDVL; KQKNKTPSLDVLL;
QKNKTPSLDVLLG; KNKTPSLDVLLGA; NKTPSLDVLLGAG;
KTPSLDVLLGAGN; TPSLDVLLGAGNL; PSLDVLLGAGNLC;
SLDVLLGAGNLCV; LDVLLGAGNLCVF; DVLLGAGNLCVFY;
VLLGAGNLCVFYT; LLGAGNLCVFYTK; LGAGNLCVFYTKL;
GAGNLCVFYTKLA; AGNLCVFYTKLAK; GNLCVFYTKLAKK;
NLCVFYTKLAKKS; LCVFYTKLAKKSG; CVFYTKLAKKSGK;
VFYTKLAKKSGKA; FYTKLAKKSGKAD; YTKLAKKSGKADL;
TKLAKKSGKADLY; KLAKKSGKADLYY; LAKKSGKADLYYT;
AKKSGKADLYYTQ; KKSGKADLYYTQV; KSGKADLYYTQVK;
SGKADLYYTQVKE; GKADLYYTQVKNL; KADLYYTQVKNLR;
ADLYYTQVKNLRR; DLYYTQVKNLRRV; LYYTQVKNLRRVK;
YYTQVKNLRRVKN; YTQVKNLRRVKNK; TQVKNLRRVKNKK;
QVKNLRRVKNKKL; VKNLRRVKNKKLG; KNLRRVKNKKLGL;
NLRRVKNKKLGLV; LRRVKNKKLGLVT; RRVKNKKLGLVTP;
RVKNKKLGLVTPK; VKNKKLGLVTPKA; KNKKLGLVTPKAE;
NKKLGLVTPKAEK; KKLGLVTPKAEKN; KLGLVTPKAEKNL;
LGLVTPKAEKNLH; GLVTPKAEKNLHT; LVTPKAEKNLHTK;
VTPKAEKNLHTKL; TPKAEKNLHTKLD; PKAEKNLHTKLDE;
KAEKNLHTKLDEK; AEKNLHTKLDENL; EKNLHTKLDENLL;
KNLHTKLDENLLK; NLHTKLDENLLKK; LHTKLDENLLKKL;
HTKLDENLLKKTK; TKLDENLLKKTKN; KLDENLLKKTKNQ;
LDENLLKKTKNQT;

14 mers:
MTKMSLNYTETNTL; TKMSLNYTETNTLT; KMSLNYTETNTLTK;
MSLNYTETNTLTKF; SLNYTETNTLTKFT; LNYTETNTLTKFTP;
NYTETNTLTKFTPS; YTETNTLTKFTPSN; TETNTLTKFTPSNL;
ETNTLTKFTPSNLT; TNTLTKFTPSNLTT; NTLTKFTPSNLTTK;
TLTKFTPSNLTTKT; LTKFTPSNLTTKTL; TKFTPSNLTTKTLQ;
KFTPSNLTTKTLQP; FTPSNLTTKTLQPD; TPSNLTTKTLQPDY;
PSNLTTKTLQPDYK; SNLTTKTLQPDYKS; NLTTKTLQPDYKSL;
LTTKTLQPDYKSLV; TTKTLQPDYKSLVE; TKTLQPDYKSLVEL;
KTLQPDYKSLVELY; TLQPDYKSLVELYK; LQPDYKSLVELYKK;
QPDYKSLVELYKKL; PDYKSLVELYKKLD; DYKSLVELYKKLDN;
YKSLVELYKKLDNK; KSLVELYKKLDNKK; SLVELYKKLDNKKF;
LVELYKKLDNKKFK; VELYKKLDNKKFKL; ELYKKLDNKKFKLL;
LYKKLDNKKFKLLL; YKKLDNKKFKLLLC; KKLDNKKFKLLLCL;
KLDNKKFKLLLCLN; LDNKKFKLLLCLNF; DNKKFKLLLCLNFT;
NKKFKLLLCLNFTT; KKFKLLLCLNFTTT; KFKLLLCLNFTTTR;

TYCCFFLLGRNAK; YCCFFLLGRNAKE; CCFFLLGRNAKEN;
CFFLLGRNAKEND; FFLLGRNAKENDK; FLLGRNAKENDKL;
LLGRNAKENDKLL; LGRNAKENDKLLR; GRNAKENDKLLRH;
RNAKENDKLLRHC; NAKENDKLLRHCV; AKENDKLLRHCVK;
KENDKLLRHCVKG; ENDKLLRHCVKGN; NDKLLRHCVKGND;
DKLLRHCVKGNDY; KLLRHCVKGNDYW;
LLRHCVKGNDYWL; LRHCVKGNDYWLH; RHCVKGNDYWLHT;
HCVKGNDYWLHTR; CVKGNDYWLHTRD; VKGNDYWLHTRDY;
KGNDYWLHTRDYP; GNDYWLHTRDYPG; NDYWLHTRDYPGA;
DYWLHTRDYPGAY; YWLHTRDYPGAYV; WLHTRDYPGAYVF;
LHTRDYPGAYVFT; HTRDYPGAYVFTK; TRDYPGAYVFTKN;
RDYPGAYVFTKNQ; DYPGAYVFTKNQK; YPGAYVFTKNQKK;
PGAYVFTKNQKKT; GAYVFTKNQKKTP; AYVFTKNQKKTPS;
YVFTKNQKKTPSL; VFTKNQKKTPSLD; FTKNQKKTPSLDV;
TKNQKKTPSLDVL; KNQKKTPSLDVLL; NQKKTPSLDVLLG;
QKKTPSLDVLLGA; KKTPSLDVLLGAG; KTPSLDVLLGAGN;
TPSLDVLLGAGNL; PSLDVLLGAGNLC; SLDVLLGAGNLCV;
LDVLLGAGNLCVF; DVLLGAGNLCVFY; VLLGAGNLCVFYT;
LLGAGNLCVFYTK; LGAGNLCVFYTKL; GAGNLCVFYTKLA;
AGNLCVFYTKLAK; GNLCVFYTKLAKK; NLCVFYTKLAKKS;
LCVFYTKLAKKSG; CVFYTKLAKKSGK; VFYTKLAKKSGKA;
FYTKLAKKSGKAD; YTKLAKKSGKADL; TKLAKKSGKADLY;
KLAKKSGKADLYY; LAKKSGKADLYYQ;
AKKSGKADLYYQV; KKSGKADLYYQVK; KSGKADLYYQVKN;
SGKADLYYQVKNL; GKADLYYQVKNLR; KADLYYQVKNLRR;
ADLYYQVKNLRRV; DLYYQVKNLRRVK; LYYQVKNLRRVKN;
YYQVKNLRRVKNK; YQVKNLRRVKNKK; QVKNLRRVKNKKL;
VKNLRRVKNKKLG; KNLRRVKNKKLGL; NLRRVKNKKLGLV;
LRRVKNKKLGLVT; RRVKNKKLGLVTP; RVKNKKLGLVTPK;
VKNKKLGLVTPKA; KNKKLGLVTPKAE; NKKLGLVTPKAEK;
KKLGLVTPKAEKN; KLGLVTPKAEKNL; LGLVTPKAEKNLH;
GLVTPKAEKNLHT; LVTPKAEKNLHTK; VTPKAEKNLHTKL;
TPKAEKNLHTKLD; PKAEKNLHTKLDE;
KAEKNLHTKLDEN; AEKNLHTKLDENL; EKNLHTKLDENLK;
KNLHTKLDENLKK; NLHTKLDENLKKT; LHTKLDENLKKTK;
HTKLDENLKKTKN; TKLDENLKKTKQ; KLDENLKKTKQT;

15 mers:
MTKMSLNYTEINTLT; TKMSLNYTEINTLTK; KMSLNYTEINTLTKE;
MSLNYTEINTLTKEI; SLNYTEINTLTKEIP; LNYTEINTLTKEIPF;
NYTEINTLTKEIPFT; YTEINTLTKEIPFTK; TEINTLTKEIPFTKS;
EINTLTKEIPFTKSL; INTLTKEIPFTKSLT; NTLTKEIPFTKSLTT;
TLTKEIPFTKSLTTK; LTKEIPFTKSLTTKT; TKEIPFTKSLTTKTI;
KEIPFTKSLTTKTIQ; EIPFTKSLTTKTIQP; IPFTKSLTTKTIQPD;
PFTKSLTTKIQPDY; FTKSLTTKIQPDYK; TKSLTTKIQPDYKS;
KSLTTKIQPDYKSL; SLTTKIQPDYKSLV; LTTKIQPDYKSLVL;
TTKIQPDYKSLVLF; TKIQPDYKSLVLFT; KIQPDYKSLVLFTY;
IQPDYKSLVLFTYN; QPDYKSLVLFTYNK; PDYKSLVLFTYNKI;
DYKSLVLFTYNKID; YKSLVLFTYNKIDK; KSLVLFTYNKIDKK;
SLVLFTYNKIDKKF; LVLFTYNKIDKKFK;
VLFTYNKIDKKFKT; LFTYNKIDKKFKTL; FTYNKIDKKFKTLI;

| | YSLKDQIKKTNIKEL; | ESLKDQIKKTNIKEL; | SLKDQIKKTNIKELL; |
|---|---|---|---|
| | LKDQIKKTNIKELLT; | KDQIKKTNIKELLTE; | DQIKKTNIKELLTEK; |
| | QIKKTNIKELLTEKY; | IKKTNIKELLTEKYK; | KKTNIKELLTEKYKK; |
| | KTNIKELLTEKYKKE; | TNIKELLTEKYKKEL; | NIKELLTEKYKKELI; |
| | IKELLTEKYKKELIV; | KELLTEKYKKELIVL; | ELLTEKYKKELIVLE; |
| | LLTEKYKKELIVLEK; | LTEKYKKELIVLEKR; | TEKYKKELIVLEKRT; |
| | EKYKKELIVLEKRTD; | KYKKELIVLEKRTDS; | YKKELIVLEKRTDSL; |
| | KKELIVLEKRTDSLK; | KELIVLEKRTDSLKQ; | ELIVLEKRTDSLKQQ; |
| | LIVLEKRTDSLKQQT; | IVLEKRTDSLKQQTK; | VLEKRTDSLKQQTKL; |
| | LEKRTDSLKQQTKLL; | EKRTDSLKQQTKLLE; | KRTDSLKQQTKLLEN; |
| | RTDSLKQQTKLLENT; | TDSLKQQTKLLENTE; | DSLKQQTKLLENTEN; |
| | SLKQQTKLLENTENE; | LKQQTKLLENTENEK; | KQQTKLLENTENEKE; |
| | QQTKLLENTENEKEK; | QTKLLENTENEKEKG; | TKLLENTENEKEKGE; |
| | KLLENTENEKEKGEL; | LLENTENEKEKGELL; | LENTENEKEKGELLL; |
| | ENTENEKEKGELLLK; | NTENEKEKGELLLKI; | TENEKEKGELLLKIN; |
| | ENEKEKGELLLKINK; | NEKEKGELLLKINKT; | EKEKGELLLKINKTQ; |
| | KEKGELLLKINKTQK; | EKGELLLKINKTQKG; | KGELLLKINKTQKGT; |
| | GELLLKINKTQKGTK; | ELLLKINKTQKGTKE; | LLLKINKTQKGTKEF; |
| | LLKINKTQKGTKEFN; | LKINKTQKGTKEFNL; | KINKTQKGTKEFNLN; |
| | INKTQKGTKEFNLNY; | NKTQKGTKEFNLNYK; | KTQKGTKEFNLNYKE; |
| | TQKGTKEFNLNYKEE; | QKGTKEFNLNYKEEK; | KGTKEFNLNYKEEKI; |
| | GTKEFNLNYKEEKIK; | TKEFNLNYKEEKIKI; | KEFNLNYKEEKIKIS; |
| | EFNLNYKEEKIKISL; | FNLNYKEEKIKISLN; | NLNYKEEKIKISLNQ; |
| | LNYKEEKIKISLNQS; | NYKEEKIKISLNQSL; | YKEEKIKISLNQSLS; |
| | KEEKIKISLNQSLSP; | EEKIKISLNQSLSPK; | EKIKISLNQSLSPKE; |
| | KIKISLNQSLSPKEN; | IKISLNQSLSPKENA; | KISLNQSLSPKENAL; |
| | ISLNQSLSPKENALQ; | SLNQSLSPKENALQY; | LNQSLSPKENALQYF; |
| | NQSLSPKENALQYFK; | QSLSPKENALQYFKA; | SLSPKENALQYFKAY; |
| | LSPKENALQYFKAYK; | SPKENALQYFKAYKK; | PKENALQYFKAYKKG; |
| | KENALQYFKAYKKGK; | ENALQYFKAYKKGKN; | NALQYFKAYKKGKNS; |
| | ALQYFKAYKKGKNSF; | LQYFKAYKKGKNSFK; | QYFKAYKKGKNSFKT; |
| | YFKAYKKGKNSFKTT; | FKAYKKGKNSFKTTQ; | KAYKKGKNSFKTTQN; |
| | AYKKGKNSFKTTQNQ; | YKKGKNSFKTTQNQL; | KKGKNSFKTTQNQLK; |
| | KGKNSFKTTQNQLKD; | GKNSFKTTQNQLKDN; | KNSFKTTQNQLKDNL; |
| | NSFKTTQNQLKDNLD; | SFKTTQNQLKDNLDK; | FKTTQNQLKDNLDKF; |
| | KTTQNQLKDNLDKFN; | TTQNQLKDNLDKFNL; | TQNQLKDNLDKFNLT; |
| | QNQLKDNLDKFNLTQ; | NQLKDNLDKFNLTQS; | QLKDNLDKFNLTQSK; |
| | LKDNLDKFNLTQSKI; | KDNLDKFNLTQSKIT; | DNLDKFNLTQSKITM; |
| | NLDKFNLTQSKITML; | LDKFNLTQSKITMLK; | DKFNLTQSKITMLKV; |
| | KFNLTQSKITMLKVE; | FNLTQSKITMLKVEN; | NLTQSKITMLKVENL; |
| | LTQSKITMLKVENLI; | TQSKITMLKVENLIP; | QSKITMLKVENLIPE; |
| | SKITMLKVENLIPEE; | KITMLKVENLIPEER; | ITMLKVENLIPEERY; |
| | TMLKVENLIPEERYN; | MLKVENLIPEERYNQ; | LKVENLIPEERYNQE; |
| | KVENLIPEERYNQEK; | VENLIPEERYNQEKT; | ENLIPEERYNQEKTA; |
| | NLIPEERYNQEKTAI; | LIPEERYNQEKTAIK; | IPEERYNQEKTAIKE; |
| | PEERYNQEKTAIKEK; | EERYNQEKTAIKEKE; | ERYNQEKTAIKEKEK; |
| | RYNQEKTAIKEKEKT; | YNQEKTAIKEKEKTP; | NQEKTAIKEKEKTPK; |
| | QEKTAIKEKEKTPKI; | EKTAIKEKEKTPKIG; | KTAIKEKEKTPKIGL; |
| | TAIKEKEKTPKIGLF; | AIKEKEKTPKIGLFS; | IKEKEKTPKIGLFST; |
| | KEKEKTPKIGLFSTY; | EKEKTPKIGLFSTYG; | KEKTPKIGLFSTYGF; |
| | EKTPKIGLFSTYGFE; | KTPKIGLFSTYGF; | ETPKIGLFSTYGF; |

Fig. 33 continued

KTPKLGHFTYCGFEI; TPKLGHFTYCGFEIL; PKLGHFTYCGFEIL;
KLGHFTYCGFEILTG; LGHFTYCGFEILTG; GHFTYCGFEILTGR;
HFTYCGFEILTGRN; HFTYCGFEILTGRNA; FTYCGFEILTGRNAK;
TYCGFEILGRNAKE; YCGFEILGRNAKEE; CGFEILGRNAKEED;
GFEILGRNAKEEDK; FEILGRNAKEEDKL; EILGRNAKEEDKLL;
ILGRNAKEEDKLLR; LGRNAKEEDKLLRH; GRNAKEEDKLLRHC;
RNAKEEDKLLRHCV; NAKEEDKLLRHCVK; AKEEDKLLRHCVKG;
KEEDKLLRHCVKGN; EEDKLLRHCVKGND; EDKLLRHCVKGNDY;
DKLLRHCVKGNDYW; KLLRHCVKGNDYWL; LLRHCVKGNDYWLH;
LRHCVKGNDYWLHT; RHCVKGNDYWLHTR; HCVKGNDYWLHTRD;
CVKGNDYWLHTRDY; VKGNDYWLHTRDYP; KGNDYWLHTRDYPG;
GNDYWLHTRDYPGA; NDYWLHTRDYPGAY;

Fig. 33 continued

| | | |
|---|---|---|
| SYSFLEKYYESLNDQ; | YSFLEKYYESLNDQL; | SFLEKYYESLNDQLK; |
| FLEKYYESLNDQLKK; | LEKYYESLNDQLKKT; | EKYYESLNDQLKKTN; |
| KYYESLNDQLKKTNT; | YYESLNDQLKKTNTK; | YESLNDQLKKTNTKE; |
| ESLNDQLKKTNTKEL; | SLNDQLKKTNTKELL; | LNDQLKKTNTKELLI; |
| NDQLKKTNTKELLIE; | DQLKKTNTKELLIEK; | QLKKTNTKELLIEKY; |
| LKKTNTKELLIEKYK; | KKTNTKELLIEKYKK; | KTNTKELLIEKYKKE; |
| TNTKELLIEKYKKEL; | NTKELLIEKYKKELI; | TKELLIEKYKKELIV; |
| KELLIEKYKKELIVL; | ELLIEKYKKELIVLE; | LLIEKYKKELIVLEK; |
| LIEKYKKELIVLEKR; | IEKYKKELIVLEKRT; | EKYKKELIVLEKRTD; |
| KYKKELIVLEKRTDS; | YKKELIVLEKRTDSL; | KKELIVLEKRTDSLK; |
| KELIVLEKRTDSLKQ; | ELIVLEKRTDSLKQQ; | LIVLEKRTDSLKQQT; |
| IVLEKRTDSLKQQTK; | VLEKRTDSLKQQTKL; | LEKRTDSLKQQTKLL; |
| EKRTDSLKQQTKLLE; | KRTDSLKQQTKLLEN; | RTDSLKQQTKLLENT; |
| TDSLKQQTKLLENTE; | DSLKQQTKLLENTEN; | SLKQQTKLLENTENE; |
| LKQQTKLLENTENEK; | KQQTKLLENTENEKE; | QQTKLLENTENEKEK; |
| QTKLLENTENEKEKG; | TKLLENTENEKEKGE; | KLLENTENEKEKGEL; |
| LLENTENEKEKGELI; | LENTENEKEKGELIL; | ENTENEKEKGELILL; |
| NTENEKEKGELILLN; | TENEKEKGELILLNI; | ENEKEKGELILLNIN; |
| NEKEKGELILLNINK; | EKEKGELILLNINKI; | KEKGELILLNINKIQ; |
| EKGELILLNINKIQK; | KGELILLNINKIQKG; | GELILLNINKIQKGI; |
| ELILLNINKIQKGIK; | LILLNINKIQKGIKE; | ILLNINKIQKGIKEI; |
| LLNINKIQKGIKEIK; | LNINKIQKGIKEIKL; | NINKIQKGIKEIKLL; |
| INKIQKGIKEIKLLN; | NKIQKGIKEIKLLNY; | KIQKGIKEIKLLNYK; |
| IQKGIKEIKLLNYKE; | QKGIKEIKLLNYKEE; | KGIKEIKLLNYKEEK; |
| GIKEIKLLNYKEEKT; | IKEIKLLNYKEEKTK; | KEIKLLNYKEEKTKT; |
| EIKLLNYKEEKTKTS; | IKLLNYKEEKTKTSL; | KLLNYKEEKTKTSLN; |
| LLNYKEEKTKTSLNQ; | LNYKEEKTKTSLNQS; | NYKEEKTKTSLNQSL; |
| YKEEKTKTSLNQSLS; | KEEKTKTSLNQSLSP; | EEKTKTSLNQSLSPK; |
| EKTKTSLNQSLSPKE; | KTKTSLNQSLSPKEN; | TKTSLNQSLSPKENA; |
| KTSLNQSLSPKENAL; | TSLNQSLSPKENALQ; | SLNQSLSPKENALQY; |
| LNQSLSPKENALQYF; | NQSLSPKENALQYFK; | QSLSPKENALQYFKA; |
| SLSPKENALQYFKAY; | LSPKENALQYFKAYK; | SPKENALQYFKAYKK; |
| PKENALQYFKAYKKG; | KENALQYFKAYKKGK; | ENALQYFKAYKKGKN; |
| NALQYFKAYKKGKNS; | ALQYFKAYKKGKNSF; | LQYFKAYKKGKNSFK; |
| QYFKAYKKGKNSFKT; | YFKAYKKGKNSFKTT; | FKAYKKGKNSFKTTQ; |
| KAYKKGKNSFKTTQN; | AYKKGKNSFKTTQNQ; | YKKGKNSFKTTQNQL; |
| KKGKNSFKTTQNQLK; | KGKNSFKTTQNQLKD; | GKNSFKTTQNQLKDN; |
| KNSFKTTQNQLKDNL; | NSFKTTQNQLKDNLD; | SFKTTQNQLKDNLDK; |
| FKTTQNQLKDNLDKF; | KTTQNQLKDNLDKFN; | TTQNQLKDNLDKFNL; |
| TQNQLKDNLDKFNLT; | QNQLKDNLDKFNLTQ; | NQLKDNLDKFNLTQS; |
| QLKDNLDKFNLTQSK; | LKDNLDKFNLTQSKI; | KDNLDKFNLTQSKIT; |
| DNLDKFNLTQSKITM; | NLDKFNLTQSKITML; | LDKFNLTQSKITMLK; |
| DKFNLTQSKITMLKV; | KFNLTQSKITMLKVF; | FNLTQSKITMLKVFK; |
| NLTQSKITMLKVFKL; | LTQSKITMLKVFKLT; | TQSKITMLKVFKLTP; |
| QSKITMLKVFKLTPF; | SKITMLKVFKLTPFE; | KITMLKVFKLTPFEE; |
| ITMLKVFKLTPFEEY; | TMLKVFKLTPFEEYN; | MLKVFKLTPFEEYNQ; |
| LKVFKLTPFEEYNQE; | KVFKLTPFEEYNQEK; | VFKLTPFEEYNQEKT; |
| FKLTPFEEYNQEKTA; | KLTPFEEYNQEKTAI; | LTPFEEYNQEKTAIK; |
| TPFEEYNQEKTAIKE; | PFEEYNQEKTAIKEK; | FEEYNQEKTAIKEKE; |
| EEYNQEKTAIKEKEK; | EYNQEKTAIKEKEKT; | YNQEKTAIKEKEKTP; |
| NQEKTAIKEKEKTPK; | QEKTAIKEKEKTPKT; | EKTAIKEKEKTPKTG; |

Fig. 33 continued

| | |
|---|---|
| | EKTAIKEKEKTPKIGL; KTAIKEKEKTPKIGLH; TAIKEKEKTPKIGLHF; AIKEKEKTPKIGLHFT; IKEKEKTPKIGLHFTY; KEKEKTPKIGLHFTYC; EKEKTPKIGLHFTYCG; KEKTPKIGLHFTYCGF; EKTPKIGLHFTYCGFE; KTPKIGLHFTYCGFEI; TPKIGLHFTYCGFEIL; PKIGLHFTYCGFEILI; KIGLHFTYCGFEILIG; IGLHFTYCGFEILIGR; GLHFTYCGFEILIGRN; LHFTYCGFEILIGRNA; HFTYCGFEILIGRNAK; FTYCGFEILIGRNAKE; TYCGFEILIGRNAKEN; YCGFEILIGRNAKEND; CGFEILIGRNAKENDK; GFEILIGRNAKENDKL; FEILIGRNAKENDKLL; EILIGRNAKENDKLLR; ILIGRNAKENDKLLRH; LIGRNAKENDKLLRHC; IGRNAKENDKLLRHCV; GRNAKENDKLLRHCVK; RNAKENDKLLRHCVKG; NAKENDKLLRHCVKGN; AKENDKLLRHCVKGND; KENDKLLRHCVKGNDY; ENDKLLRHCVKGNDYW; NDKLLRHCVKGNDYWL; DKLLRHCVKGNDYWLH; KLLRHCVKGNDYWLHT; LLRHCVKGNDYWLHTR; LRHCVKGNDYWLHTRD; RHCVKGNDYWLHTRDY; HCVKGNDYWLHTRDYP; CVKGNDYWLHTRDYPG; VKGNDYWLHTRDYPGA; KGNDYWLHTRDYPGAY; GNDYWLHTRDYPGAYV; NDYWLHTRDYPGAYVF; DYWLHTRDYPGAYVFI; YWLHTRDYPGAYVFIK; WLHTRDYPGAYVFIKN; LHTRDYPGAYVFIKNQ; HTRDYPGAYVFIKNQK; TRDYPGAYVFIKNQKN; RDYPGAYVFIKNQKNK; DYPGAYVFIKNQKNKT; YPGAYVFIKNQKNKTP; PGAYVFIKNQKNKTPS; GAYVFIKNQKNKTPSL; AYVFIKNQKNKTPSLD; YVFIKNQKNKTPSLDV; VFIKNQKNKTPSLDVL; FIKNQKNKTPSLDVLL; IKNQKNKTPSLDVLLG; KNQKNKTPSLDVLLGA; NQKNKTPSLDVLLGAG; QKNKTPSLDVLLGAGN; KNKTPSLDVLLGAGNL; NKTPSLDVLLGAGNLC; KTPSLDVLLGAGNLCV; TPSLDVLLGAGNLCVF; PSLDVLLGAGNLCVFY; SLDVLLGAGNLCVFYT; LDVLLGAGNLCVFYTK; DVLLGAGNLCVFYTKL; VLLGAGNLCVFYTKLA; LLGAGNLCVFYTKLAK; LGAGNLCVFYTKLAKK; GAGNLCVFYTKLAKKS; AGNLCVFYTKLAKKSG; GNLCVFYTKLAKKSGK; NLCVFYTKLAKKSGKA; LCVFYTKLAKKSGKAD; CVFYTKLAKKSGKADL; VFYTKLAKKSGKADLY; FYTKLAKKSGKADLYY; YTKLAKKSGKADLYYT; TKLAKKSGKADLYYTQ; KLAKKSGKADLYYTQV; LAKKSGKADLYYTQVK; AKKSGKADLYYTQVKN; KKSGKADLYYTQVKNL; KSGKADLYYTQVKNLR; SGKADLYYTQVKNLRR; GKADLYYTQVKNLRRV; KADLYYTQVKNLRRVK; ADLYYTQVKNLRRVKN; DLYYTQVKNLRRVKNK; LYYTQVKNLRRVKNKK; YYTQVKNLRRVKNKKL; YTQVKNLRRVKNKKLG; TQVKNLRRVKNKKLGL; QVKNLRRVKNKKLGLV; VKNLRRVKNKKLGLVI; KNLRRVKNKKLGLVIP; NLRRVKNKKLGLVIPK; LRRVKNKKLGLVIPKA; RRVKNKKLGLVIPKAE; RVKNKKLGLVIPKAEK; VKNKKLGLVIPKAEKN; KNKKLGLVIPKAEKNL; NKKLGLVIPKAEKNLH; KKLGLVIPKAEKNLHI; KLGLVIPKAEKNLHIK; LGLVIPKAEKNLHIKL; GLVIPKAEKNLHIKLD; LVIPKAEKNLHIKLDE; VIPKAEKNLHIKLDEN; IPKAEKNLHIKLDENL; PKAEKNLHIKLDENLI; KAEKNLHIKLDENLIK; AEKNLHIKLDENLIKK; EKNLHIKLDENLIKKI; KNLHIKLDENLIKKIK; NLHIKLDENLIKKIKN; LHIKLDENLIKKIKNQ; HIKLDENLIKKIKNQT; |
| SEQ ID NO:21<br>SEQ ID NO:<br>93475-94488 | 13 mers:<br>MKLQRSLSLIIFS; KLQRSLSLIIFSL; LQRSLSLIIFSLT; QRSLSLIIFSLTV; RSLSLIIFSLTVL; SLSLIIFSLTVLC; LSLIIFSLTVLCC; SLIIFSLTVLCCD; LIIFSLTVLCCDN; IIFSLTVLCCDNK; IFSLTVLCCDNKE; FSLTVLCCDNKER; SLTVLCCDNKERK; LTVLCCDNKERKE; TVLCCDNKERKEG; VLCCDNKERKEGV; LCCDNKERKEGVS; CCDNKERKEGVST; |

Fig. 33 continued

| | | |
|---|---|---|
| CDKKERKEGVSTK; | DKKERKEGVSTKI; | KKERKEGVSTKIS; |
| KERKEGVSTKISL; | ERKEGVSTKISLG; | RKEGVSTKISLGA; |
| KEGVSTKISLGAE; | EGVSTKISLGAEP; | GVSTKISLGAEPR; |
| VSTKISLGAEPRS; | STKISLGAEPRSL; | TKISLGAEPRSLD; |
| KISLGAEPRSLDP; | ISLGAEPRSLDPQ; | SLGAEPRSLDPQL; |
| LGAEPRSLDPQLA; | GAEPRSLDPQLAE; | AEPRSLDPQLAED; |
| EPRSLDPQLAEDN; | PRSLDPQLAEDNV; | RSLDPQLAEDNVA; |
| SLDPQLAEDNVAS; | LDPQLAEDNVASK; | DPQLAEDNVASKM; |
| PQLAEDNVASKMI; | QLAEDNVASKMID; | LAEDNVASKMIDT; |
| AEDNVASKMIDTL; | EDNVASKMIDTLY; | DNVASKMIDTLYR; |
| NVASKMIDTLYRG; | VASKMIDTLYRGT; | ASKMIDTLYRGTV; |
| SKMIDTLYRGTVT; | KMIDTLYRGTVTG; | MIDTLYRGTVTGD; |
| IDTLYRGTVTGDP; | DTLYRGTVTGDPN; | TLYRGTVTGDPNT; |
| LYRGTVTGDPNTG; | YRGTVTGDPNTGG; | RGTVTGDPNTGGH; |
| GTVTGDPNTGGHK; | TVTGDPNTGGHKP; | VTGDPNTGGHKPG; |
| TGDPNTGGHKPGL; | GDPNTGGHKPGLA; | DPNTGGHKPGLAK; |
| PNTGGHKPGLAKG; | NTGGHKPGLAKGW; | TGGHKPGLAKGWE; |
| GGHKPGLAKGWET; | GHKPGLAKGWETS; | HKPGLAKGWETSS; |
| KPGLAKGWETSSD; | PGLAKGWETSSDG; | GLAKGWETSSDGT; |
| LAKGWETSSDGTA; | AKGWETSSDGTAY; | KGWETSSDGTAYP; |
| GWETSSDGTAYPF; | WETSSDGTAYPFY; | ETSSDGTAYPFYL; |
| TSSDGTAYPFYLR; | SSDGTAYPFYLRD; | SDGTAYPFYLRDN; |
| DGTAYPFYLRDNL; | GTAYPFYLRDNLT; | TAYPFYLRDNLTW; |
| AYPFYLRDNLTWS; | YPFYLRDNLTWSD; | PFYLRDNLTWSDG; |
| FYLRDNLTWSDGV; | YLRDNLTWSDGVA; | LRDNLTWSDGVAT; |
| RDNLTWSDGVATT; | DNLTWSDGVATTA; | NLTWSDGVATTAE; |
| LTWSDGVATTAEG; | TWSDGVATTAEGT; | WSDGVATTAEGTR; |
| SDGVATTAEGTRK; | DGVATTAEGTRKS; | GVATTAEGTRKSY; |
| VATTAEGTRKSYL; | ATTAEGTRKSYLR; | TTAEGTRKSYLRI; |
| TAEGTRKSYLRIL; | AEGTRKSYLRILN; | EGTRKSYLRILNK; |
| GTRKSYLRILNKE; | TRKSYLRILNKET; | RKSYLRILNKETG; |
| KSYLRILNKETGS; | SYLRILNKETGST; | YLRILNKETGSTY; |
| LRILNKETGSTYV; | RILNKETGSTYVD; | ILNKETGSTYVDM; |
| LNKETGSTYVDMV; | NKETGSTYVDMVK; | KETGSTYVDMVKS; |
| ETGSTYVDMVKST; | TGSTYVDMVKSTT; | GSTYVDMVKSTTK; |
| STYVDMVKSTTKN; | TYVDMVKSTTKNG; | YVDMVKSTTKNGQ; |
| VDMVKSTTKNGQE; | DMVKSTTKNGQEY; | MVKSTTKNGQEYF; |
| VKSTTKNGQEYFD; | KSTTKNGQEYFDG; | STTKNGQEYFDGQ; |
| TTKNGQEYFDGQV; | TKNGQEYFDGQVT; | KNGQEYFDGQVTD; |
| NGQEYFDGQVTDS; | GQEYFDGQVTDSE; | QEYFDGQVTDSEL; |
| EYFDGQVTDSELG; | YFDGQVTDSELGI; | FDGQVTDSELGIR; |
| DGQVTDSELGIRA; | GQVTDSELGIRAI; | QVTDSELGIRAID; |
| VTDSELGIRAIDS; | TDSELGIRAIDSK; | DSELGIRAIDSKT; |
| SELGIRAIDSKTL; | ELGIRAIDSKTLE; | LGIRAIDSKTLEI; |
| GIRAIDSKTLEIT; | IRAIDSKTLEITL; | RAIDSKTLEITLA; |
| AIDSKTLEITLAS; | IDSKTLEITLASP; | DSKTLEITLASPK; |
| SKTLEITLASPKP; | KTLEITLASPKPY; | TLEITLASPKPYF; |
| LEITLASPKPYFI; | EITLASPKPYFID; | ITLASPKPYFIDL; |
| TLASPKPYFIDLL; | LASPKPYFIDLLV; | ASPKPYFIDLLVH; |
| SPKPYFIDLLVHQ; | PKPYFIDLLVHQS; | KPYFIDLLVHQSF; |
| PYFIDLLVHQSFT; | YFIDLLVHQSFTP; | FIDLLVHQSFTPV; |

Fig. 33 continued

IDLVHQSFIPVP; DLVHQSFIPVPV; LVHQSFIPVPVH;
LVHQSFIPVPVHV; VHQSFIPVPVHVT; HQSFIPVPVHVTD;
QSFIPVPVHVTDK; SFIPVPVHVTDKY; FIPVPVHVTDKYG;
IPVPVHVTDKYGQ; PVPVHVTDKYGQN; VPVHVTDKYGQNW;
PVHVTDKYGQNWT; VHVTDKYGQNWTS; HVTDKYGQNWTSP;
VTDKYGQNWTSPE; TDKYGQNWTSPEN; DKYGQNWTSPENM;
KYGQNWTSPENMV; YGQNWTSPENMVT; GQNWTSPENMVTS;
QNWTSPENMVTSG; NWTSPENMVTSGP; WTSPENMVTSGPF;
TSPENMVTSGPFK; SPENMVTSGPFKL; PENMVTSGPFKLK;
ENMVTSGPFKLKE; NMVTSGPFKLKER; MVTSGPFKLKERT;
VTSGPFKLKERTP; TSGPFKLKERTPS; SGPFKLKERTPSE;
GPFKLKERTPSEK; PFKLKERTPSEKY; FKLKERTPSEKYV;
KLKERTPSEKYVF; LKERTPSEKYVFE; KERTPSEKYVFEK;
ERTPSEKYVFEKD; RTPSEKYVFEKDN; TPSEKYVFEKDNK;
PSEKYVFEKDNKY; SEKYVFEKDNKYY; EKYVFEKDNKYYD;
KYVFEKDNKYYDS; YVFEKDNKYYDSN; VFEKDNKYYDSNE;
FEKDNKYYDSNEV; EKDNKYYDSNEVE; KDNKYYDSNEVEL;
DNKYYDSNEVELE; NKYYDSNEVELEE; KYYDSNEVELEET;
YYDSNEVELEEIT; YDSNEVELEEITY; DSNEVELEEITYY;
SNEVELEEITYYT; NEVELEEITYYTT; EVELEEITYYTTK;
VELEEITYYTTKD; ELEEITYYTTKDS; LEEITYYTTKDSS;
EEITYYTTKDSST; EITYYTTKDSSTA; ITYYTTKDSSTAY;
TYYTTKDSSTAYK; YYTTKDSSTAYKM; YTTKDSSTAYKMY;
TTKDSSTAYKMYV; TKDSSTAYKMYVN; KDSSTAYKMYVNE;
DSSTAYKMYVNEF; SSTAYKMYVNEFL; STAYKMYVNEFLD;
TAYKMYVNEFLDA; AYKMYVNEFLDAI; YKMYVNEFLDAIL;
KMYVNEFLDAILV; MYVNEFLDAILVP; YVNEFLDAILVPY;
VNEFLDAILVPYP; NEFLDAILVPYPQ; EFLDAILVPYPQT;

14 mers:
MKLQRSLSLIFSL; KLQRSLSLIFSLT; LQRSLSLIFSLTV;
QRSLSLIFSLTVL; RSLSLIFSLTVLC; SLSLIFSLTVLCC;
LSLIFSLTVLCCD; SLIFSLTVLCCDN; LIFSLTVLCCDNK;
IFSLTVLCCDNKE; FSLTVLCCDNKER; SLTVLCCDNKERK;
LTVLCCDNKERKE; TVLCCDNKERKEG; VLCCDNKERKEGV;
VLCCDNKERKEGVS; LCCDNKERKEGVST; CCDNKERKEGVSTK;
CDNKERKEGVSTKT; DNKERKEGVSTKTS; NKERKEGVSTKTSL;
KERKEGVSTKTSLG; ERKEGVSTKTSLGA; RKEGVSTKTSLGAE;
KEGVSTKTSLGAEP; EGVSTKTSLGAEPR; GVSTKTSLGAEPRS;
VSTKTSLGAEPRSL; STKTSLGAEPRSLD; TKTSLGAEPRSLDP;
KTSLGAEPRSLDPQ; TSLGAEPRSLDPQL; SLGAEPRSLDPQLA;
LGAEPRSLDPQLAE; GAEPRSLDPQLAED; AEPRSLDPQLAEDN;
EPRSLDPQLAEDNV; PRSLDPQLAEDNVA; RSLDPQLAEDNVAS;
SLDPQLAEDNVASK; LDPQLAEDNVASKM; DPQLAEDNVASKMT;
PQLAEDNVASKMTD; QLAEDNVASKMTDT; LAEDNVASKMTDTL;
AEDNVASKMTDTLY; EDNVASKMTDTLYR; DNVASKMTDTLYRG;
NVASKMTDTLYRGT; VASKMTDTLYRGTV; ASKMTDTLYRGTVT;
SKMTDTLYRGTVTG; KMTDTLYRGTVTGD; MTDTLYRGTVTGDP;
TDTLYRGTVTGDPN; DTLYRGTVTGDPNT; TLYRGTVTGDPNTG;
LYRGTVTGDPNTGG; YRGTVTGDPNTGGH; RGTVTGDPNTGGHK;
GTVTGDPNTGGHKP; TVTGDPNTGGHKPG; VTGDPNTGGHKPGL;

GIRKSYLRILKKETG; IRKSYLRILKKETGS; RKSYLRILKKETGST;
KSYLRILKKETGSTY; SYLRILKKETGSTYV; YLRILKKETGSTYVD;
LRILKKETGSTYVDM; RILKKETGSTYVDMV; ILKKETGSTYVDMVK;
LKKETGSTYVDMVKS; KKETGSTYVDMVKSI; KETGSTYVDMVKSII;
ETGSTYVDMVKSIIK; TGSTYVDMVKSIIKK; GSTYVDMVKSIIKKG;
STYVDMVKSIIKKGQ; TYVDMVKSIIKKGQE; YVDMVKSIIKKGQEY;

MKLQRSLSLIFSLTV; KLQRSLSLIFSLTVL; LQRSLSLIFSLTVLC;
QRSLSLIFSLTVLCC; RSLSLIFSLTVLCCD; SLSLIFSLTVLCCDN;
LSLIFSLTVLCCDNK; SLIFSLTVLCCDNKE; LIFSLTVLCCDNKER;
IFSLTVLCCDNKERK; FSLTVLCCDNKERKE; S

| | |
|---|---|
| | AIDSKTLEITLASPKP; IDSKTLEITLASPKPY; DSKTLEITLASPKPYF; SKTLEITLASPKPYFI; KTLEITLASPKPYFID; TLEITLASPKPYFIDL; LEITLASPKPYFIDLL; EITLASPKPYFIDLLV; ITLASPKPYFIDLLVH; TLASPKPYFIDLLVHQ; LASPKPYFIDLLVHQS; ASPKPYFIDLLVHQSF; SPKPYFIDLLVHQSFI; PKPYFIDLLVHQSFIP; KPYFIDLLVHQSFIPV; PYFIDLLVHQSFIPVP; YFIDLLVHQSFIPVPV; FIDLLVHQSFIPVPVH; IDLLVHQSFIPVPVHV; DLLVHQSFIPVPVHVT; LLVHQSFIPVPVHVTD; LVHQSFIPVPVHVTDK; VHQSFIPVPVHVTDKY; HQSFIPVPVHVTDKYG; QSFIPVPVHVTDKYGQ; SFIPVPVHVTDKYGQN; FIPVPVHVTDKYGQNW; IPVPVHVTDKYGQNWT; PVPVHVTDKYGQNWTS; VPVHVTDKYGQNWTSP; PVHVTDKYGQNWTSPE; VHVTDKYGQNWTSPEN; HVTDKYGQNWTSPENM; VTDKYGQNWTSPENMV; TDKYGQNWTSPENMVT; DKYGQNWTSPENMVTS; KYGQNWTSPENMVTSG; YGQNWTSPENMVTSGP; GQNWTSPENMVTSGPF; QNWTSPENMVTSGPFK; NWTSPENMVTSGPFKL; WTSPENMVTSGPFKLK; TSPENMVTSGPFKLKE; SPENMVTSGPFKLKER; PENMVTSGPFKLKERI; ENMVTSGPFKLKERIP; NMVTSGPFKLKERIPS; MVTSGPFKLKERIPSE; VTSGPFKLKERIPSEK; TSGPFKLKERIPSEKY; SGPFKLKERIPSEKYV; GPFKLKERIPSEKYVF; PFKLKERIPSEKYVFE; FKLKERIPSEKYVFEK; KLKERIPSEKYVFEKD; LKERIPSEKYVFEKDN; KERIPSEKYVFEKDNK; ERIPSEKYVFEKDNKY; RIPSEKYVFEKDNKYY; IPSEKYVFEKDNKYYD; PSEKYVFEKDNKYYDS; SEKYVFEKDNKYYDSN; EKYVFEKDNKYYDSNE; KYVFEKDNKYYDSNEV; YVFEKDNKYYDSNEVE; VFEKDNKYYDSNEVEL; FEKDNKYYDSNEVELE; EKDNKYYDSNEVELEE; KDNKYYDSNEVELEEI; DNKYYDSNEVELEEIT; NKYYDSNEVELEEITF; KYYDSNEVELEEITFY; YYDSNEVELEEITFYT; YDSNEVELEEITFYTT; DSNEVELEEITFYTTN; SNEVELEEITFYTTND; NEVELEEITFYTTNDS; EVELEEITFYTTNDSS; VELEEITFYTTNDSST; ELEEITFYTTNDSSTA; LEEITFYTTNDSSTAY; EEITFYTTNDSSTAYK; EITFYTTNDSSTAYKM; ITFYTTNDSSTAYKMY; TFYTTNDSSTAYKMYV; FYTTNDSSTAYKMYVN; YTTNDSSTAYKMYVNE; TTNDSSTAYKMYVNEE; TNDSSTAYKMYVNEEL; NDSSTAYKMYVNEELD; DSSTAYKMYVNEELDA; SSTAYKMYVNEELDAI; STAYKMYVNEELDAIL; TAYKMYVNEELDAILV; AYKMYVNEELDAILVP; YKMYVNEELDAILVPY; KMYVNEELDAILVPYP; MYVNEELDAILVPYPQ; YVNEELDAILVPYPQI; |
| SEQ ID NO:22 SEQ ID NO: 94489-95586 | 13 mers: MNLINKLFILTIL; NLINKLFILTILF; LINKLFILTILFS; INKLFILTILFSS; NKLFILTILFSSV; KLFILTILFSSVI; LFILTILFSSVIS; FILTILFSSVISC; ILTILFSSVISCK; LTILFSSVISCKL; TILFSSVISCKLY; ILFSSVISCKLYK; LFSSVISCKLYKK; FSSVISCKLYKKI; SSVISCKLYKKIT; SVISCKLYKKITY; VISCKLYKKITYN; ISCKLYKKITYNA; SCKLYKKITYNAD; CKLYKKITYNADQ; KLYKKITYNADQV; LYKKITYNADQVI; YKKITYNADQVID; KKITYNADQVIDK; KITYNADQVIDKL; ITYNADQVIDKLK; TYNADQVIDKLKS; YNADQVIDKLKSN; NADQVIDKLKSNN; ADQVIDKLKSNNG; DQVIDKLKSNNGS; QVIDKLKSNNGSF; VIDKLKSNNGSFN; IDKLKSNNGSFNT; DKLKSNNGSFNTL; KLKSNNGSFNTLK; LKSNNGSFNTLKS; KSNNGSFNTLKSN; SNNGSFNTLKSND; NNGSFNTLKSNDD; NGSFNTLKSNDDS; GSFNTLKSNDDSK; SFNTLKSNDDSKR; FNTLKSNDDSKRS; NTLKSNDDSKRSG; |

Fig. 33 continued

TLKSDDSKRSGK; LKSDDSKRSGKK; KSDDSKRSGKKP;
SDDSKRSGKKPR; DDSKRSGKPRSV; DSKRSGKPRSVD;
DSKRSGKPRSVD; SKRSGKPRSVDK; KRSGKPRSVDKT;
RSGKPRSVDKTY; SGKPRSVDKTYM; GKPRSVDKTYMD;
KPRSVDKTYMDQ; PRSVDKTYMDQD; 
RSVDKTYMDQDT; SVDKTYMDQDTG; VDKTYMDQDTGK;
DKTYMDQDTGKK; KTYMDQDTGKKP; TYMDQDTGKKPL;
YMDQDTGKKPLM; MDQDTGKKPLMA; DQDTGKKPLMAD;
QDTGKKPLMADM; DTGKKPLMADMQ; TGKKPLMADMQP;
GKKPLMADMQPD; KKPLMADMQPDM; KPLMADMQPDMQ;
PLMADMQPDMQN; LMADMQPDMQND; MADMQPDMQNDS;
ADMQPDMQNDSS; DMQPDMQNDSSS; MQPDMQNDSSSH;
QPDMQNDSSSHH; PDMQNDSSSHHT; DMQNDSSSHHTI;
MQNDSSSHHTIQ; QNDSSSHHTIQV; NDSSSHHTIQVK;
DSSSHHTIQVKL; SSSHHTIQVKLQ; SSHHTIQVKLQD;
SHHTIQVKLQDK; HHTIQVKLQDKE; HTIQVKLQDKEA;
TIQVKLQDKEAS; IQVKLQDKEASE; QVKLQDKEASEA;
VKLQDKEASEAR; KLQDKEASEARN; LQDKEASEARNT;
QDKEASEARNTM; DKEASEARNTMT; KEASEARNTMTE;
EASEARNTMTET; ASEARNTMTETS; SEARNTMTETSS;
EARNTMTETSSK; ARNTMTETSSKE; RNTMTETSSKEE;
NTMTETSSKEEY; TMTETSSKEEYK; MTETSSKEEYKR;
TETSSKEEYKRI; ETSSKEEYKRIN; TSSKEEYKRINE;
SSKEEYKRINED; SKEEYKRINEDL; KEEYKRINEDLA;
EEYKRINEDLAK; EYKRINEDLAKV; YKRINEDLAKVK;
KRINEDLAKVKA; RINEDLAKVKAS; INEDLAKVKASL;
NEDLAKVKASLD; EDLAKVKASLDK; DLAKVKASLDKT;
LAKVKASLDKTK; AKVKASLDKTKS; KVKASLDKTKSL;
VKASLDKTKSLL; KASLDKTKSLLS; AS

KNDFEYAQRKADR; KDFEYAQRKADRA; DFEYAQRKADRAL;
FEYAQRKADRALE; EYAQRKADRALEE; YAQRKADRALEEA;
AQRKADRALEEAL; QRKADRALEEALS; RKADRALEEALSK;
KADRALEEALSKS; ADRALEEALSKSN; DRALEEALSKSNA;
RALEEALSKSNAS; ALEEALSKSNASR; LEEALSKSNASRH;
EEALSKSNASRHF; EALSKSNASRHFS; ALSKSNASRHFSY;
LSKSNASRHFSYY; SKSNASRHFSYYY; KSNASRHFSYYYA;
SNASRHFSYYYAG; NASRHFSYYYAGY; ASRHFSYYYAGYH;
SRHFSYYYAGYHQ; RHFSYYYAGYHQF; HFSYYYAGYHQFM;
FSYYYAGYHQFMA; SYYYAGYHQFMAD; YYYAGYHQFMADA;
YYAGYHQFMADAK; YAGYHQFMADAKA; AGYHQFMADAKAS;
GYHQFMADAKASM; YHQFMADAKASMS; HQFMADAKASMSS;
QFMADAKASMSST; FMADAKASMSSTK; MADAKASMSSTKS;
ADAKASMSSTKSL; DAKASMSSTKSLL; AKASMSSTKSLLE;
KASMSSTKSLLEV; ASMSSTKSLLEVA; SMSSTKSLLEVAK;
MSSTKSLLEVAKN; SSTKSLLEVAKNK; STKSLLEVAKNKQ;
TKSLLEVAKNKQK; KSLLEVAKNKQKE; SLLEVAKNKQKEL;
LLEVAKNKQKELN; LEVAKNKQKELNE; EVAKNKQKELNEN;
VAKNKQKELNENK; AKNKQKELNENMT; KNKQKELNENMTK;
NKQKELNENMTKT; KQKELNENMTKTN; QKELNENMTKTNK;
KELNENMTKTNKD; ELNENMTKTNKDF; LNENMTKTNKDFQ;
NENMTKTNKDFQE; ENMTKTNKDFQEL; NMTKTNKDFQELN;
MTKTNKDFQELND; TKTNKDFQELNDI; KTNKDFQELNDIY;
TNKDFQELNDIYK; NKDFQELNDIYKK; KDFQELNDIYKKL;
DFQELNDIYKKLQ; FQELNDIYKKLQD; QELNDIYKKLQDM;
ELNDIYKKLQDMD; LNDIYKKLQDMDS; NDIYKKLQDMDSR;

14 mers:
MNLTKLFTLTTLF; NLTKLFTLTTLFS; LTKLFTLTTLFSS;
TKLFTLTTLFSSV; KLFTLTTLFSSVT; LFTLTTLFSSVTS;
FTLTTLFSSVTSC; TLTTLFSSVTSCK; LTTLFSSVTSCKL;
TTLFSSVTSCKLY; TLFSSVTSCKLYK; LFSSVTSCKLYKK;
FSSVTSCKLYKKT; SSVTSCKLYKKTT; SVTSCKLYKKTTY;
VTSCKLYKKTTYN; TSCKLYKKTTYNA; SCKLYKKTTYNAD;
CKLYKKTTYNADQ; KLYKKTTYNADQV; LYKKTTYNADQVT;
YKKTTYNADQVTD; KKTTYNADQVTDK; KTTYNADQVTDKL;
TTYNADQVTDKLK; TYNADQVTDKLKS; YNADQVTDKLKSN;
NADQVTDKLKSNG; ADQVTDKLKSNGS; DQVTDKLKSNGSF;
QVTDKLKSNGSFN; VTDKLKSNGSFNT; TDKLKSNGSFNTL;
DKLKSNGSFNTLK; KLKSNGSFNTLKS; LKSNGSFNTLKSN;
KSNGSFNTLKSND; SNGSFNTLKSNDD; NGSFNTLKSNDDS;
GSFNTLKSNDDSK; SFNTLKSNDDSKR; FNTLKSNDDSKRS;
NTLKSNDDSKRSG; TLKSNDDSKRSGR; LKSNDDSKRSGRK;
KSNDDSKRSGRKP; SNDDSKRSGRKPR; NDDSKRSGRKPRS;
DDSKRSGRKPRSV; DSKRSGRKPRSVD; SKRSGRKPRSVDN;
KRSGRKPRSVDNT; RSGRKPRSVDNTY; SGRKPRSVDNTYM;
GRKPRSVDNTYMD; RKPRSVDNTYMDQ; KPRSVDNTYMDQD;
PRSVDNTYMDQDT; RSVDNTYMDQDTG; SVDNTYMDQDTGK;
VDNTYMDQDTGKK; DNTYMDQDTGKKP; NTYMDQDTGKKPL;
TYMDQDTGKKPLM; YMDQDTGKKPLMA; MDQDTGKKPLMAD;
DQDTGKKPLMADM; QDTGKKPLMADMQ;

Fig. 33 continued

QDICKKPLMADMQP; DICKKPLMADMQPD; ICKKPLMADMQPDM;
CKKPLMADMQPDMQ; KKPLMADMQPDMQK; KPLMADMQPDMQKD;
PLMADMQPDMQKDN; LMADMQPDMQKDNS; MADMQPDMQKDNSS;
ADMQPDMQKDNSSS; DMQPDMQKDNSSSH; MQPDMQKDNSSSHT;
QPDMQKDNSSSHTL; PDMQKDNSSSHTLQ; DMQKDNSSSHTLQV;
MQKDNSSSHTLQVN; QKDNSSSHTLQVNT; KDNSSSHTLQVNTQ;
DNSSSHTLQVNTQD; NSSSHTLQVNTQDN; SSSHTLQVNTQDNF;
SSHTLQVNTQDNFA; SHTLQVNTQDNFAS; HTLQVNTQDNFASF;
TLQVNTQDNFASFA; LQVNTQDNFASFAR; QVNTQDNFASFARN;
VNTQDNFASFARNT; NTQDNFASFARNTM; TQDNFASFARNTMT;
QDNFASFARNTMTF; DNFASFARNTMTFT; NFASFARNTMTFTS;
FASFARNTMTFTSS; ASFARNTMTFTSSK; SFARNTMTFTSSKF;
FARNTMTFTSSKFY; ARNTMTFTSSKFYN; RNTMTFTSSKFYNR;
NTMTFT

SRHESYYAGYHQF; RHESYYAGYHQFM; HESYYAGYHQFMA;
ESYYAGYHQFMAD; SYYAGYHQFMADA; YYAGYHQFMADAK;
YYAGYHQFMADAKA; YAGYHQFMADAKAS; AGYHQFMADAKASM;
GYHQFMADAKASMS; YHQFMADAKASMSS; HQFMADAKASMSST;
QFMADAKASMSSTK; FMADAKASMSSTKS; MADAKASMSSTKSL;
ADAKASMSSTKSLL; DAKASMSSTKSLLE; AKASMSSTKSLLEV;
KASMSSTKSLLEVA; ASMSSTKSLLEVAK; SMSSTKSLLEVAKN;
MSSTKSLLEVAKNK; SSTKSLLEVAKNKQ; STKSLLEVAKNKQK;
TKSLLEVAKNKQKE; KSLLEVAKNKQKEL; SLLEVAK

| | | |
|---|---|---|
| HTLQVNLQDKEASEA; | TLQVNLQDKEASEAR; | LQVNLQDKEASEARN; |
| QVNLQDKEASEARNT; | VNLQDKEASEARNTM; | NLQDKEASEARNTMT; |
| TQDKEASEARNTMTE; | QDKEASEARNTMTET; | DKEASEARNTMTETE; |
| KEASEARNTMTETES; | EASEARNTMTETESS; | ASEARNTMTETESSK; |
| SEARNTMTETESSKE; | EARNTMTETESSKEE; | ARNTMTETESSKEEY; |
| RNTMTETESSKEEYN; | NTMTETESSKEEYNR; | TMTETESSKEEYNRT; |
| MTETESSKEEYNRTN; | TETESSKEEYNRTNE; | ETESSKEEYNRTNED; |
| TESSKEEYNRTNEDL; | ESSKEEYNRTNEDLA; | SSKEEYNRTNEDLAK; |
| SKEEYNRTNEDLAKV; | KEEYNRTNEDLAKVK; | EEYNRTNEDLAKVKA; |
| EYNRTNEDLAKVKAS; | YNRTNEDLAKVKASL; | NRTNEDLAKVKASLD; |
| RTNEDLAKVKASLDK; | TNEDLAKVKASLDKT; | NEDLAKVKASLDKTK; |
| EDLAKVKASLDKTKS; | DLAKVKASLDKTKSL; | LAKVKASLDKTKSLL; |
| AKVKASLDKTKSLLS; | KVKASLDKTKSLLST; | VKASLDKTKSLLSTA; |
| KASLDKTKSLLSTAK; | ASLDKTKSLLSTAKS; | SLDKTKSLLSTAKSY; |
| LDKTKSLLSTAKSYL; | DKTKSLLSTAKSYLE; | KTKSLLSTAKSYLEQ; |
| TKSLLSTAKSYLEQT; | KSLLSTAKSYLEQTR; | SLLSTAKSYLEQTRR; |
| LLSTAKSYLEQTRRG; | LSTAKSYLEQTRRGV; | STAKSYLEQTRRGVG; |
| TAKSYLEQTRRGVGS; | AKSYLEQTRRGVGSS; | KSYLEQTRRGVGSSK; |
| SYLEQTRRGVGSSKA; | YLEQTRRGVGSSKAK; | LEQTRRGVGSSKAKL; |
| EQTRRGVGSSKAKLA; | QTRRGVGSSKAKLAL; | TRRGVGSSKAKLALL; |
| RRGVGSSKAKLALLP; | RGVGSSKAKLALLPS; | GVGSSKAKLALLPSL; |
| VGSSKAKLALLPSLE; | GSSKAKLALLPSLEE; | SSKAKLALLPSLEEA; |
| SKAKLALLPSLEEAI; | KAKLALLPSLEEAIA; | AKLALLPSLEEAIAK; |
| KLALLPSLEEAIAKV; | LALLPSLEEAIAKVK; | ALLPSLEEAIAKVKS; |
| LLPSLEEAIAKVKSN; | LPSLEEAIAKVKSNH; | PSLEEAIAKVKSNHA; |
| SLEEAIAKVKSNHAS; | LEEAIAKVKSNHASA; | EEAIAKVKSNHASAD; |
| EAIAKVKSNHASADT; | AIAKVKSNHASADTH; | IAKVKSNHASADTHC; |
| AKVKSNHASADTHCN; | KVKSNHASADTHCND; | VKSNHASADTHCNDA; |
| KSNHASADTHCNDAT; | SNHASADTHCNDATA; | NHASADTHCNDATAA; |
| HASADTHCNDATAAL; | ASADTHCNDATAALK; | SADTHCNDATAALKR; |
| ADTHCNDATAALKRA; | DTHCNDATAALKRAK; | THCNDATAALKRAKN; |
| HCNDATAALKRAKND; | CNDATAALKRAKNDF; | NDATAALKRAKNDFF; |
| DATAALKRAKNDFFY; | ATAALKRAKNDFFYA; | TAALKRAKNDFFYAQ; |
| AALKRAKNDFFYAQR; | ALKRAKNDFFYAQRK; | LKRAKNDFFYAQRKA; |
| KRAKNDFFYAQRKAD; | RAKNDFFYAQRKADR; | AKNDFFYAQRKADRA; |
| KNDFFYAQRKADRAL; | NDFFYAQRKADRALE; | DFFYAQRKADRALEE; |
| FFYAQRKADRALEEA; | FYAQRKADRALEEAL; | YAQRKADRALEEALS; |
| AQRKADRALEEALSN; | QRKADRALEEALSNS; | RKADRALEEALSNSN; |
| KADRALEEALSNSNA; | ADRALEEALSNSKAS; | DRALEEALSNSKASR; |
| RALEEALSNSKASRH; | ALEEALSNSKASRHE; | LEEALSNSKASRHES; |
| EEALSNSKASRHESY; | EALSNSKASRHESYY; | ALSNSKASRHESYYY; |
| LSNSKASRHESYYYA; | SNSKASRHESYYYAG; | NSKASRHESYYYAGY; |
| SKASRHESYYYAGYH; | KASRHESYYYAGYHQ; | ASRHESYYYAGYHQF; |
| SRHESYYYAGYHQFM; | RHESYYYAGYHQFMA; | HESYYYAGYHQFMAD; |
| ESYYYAGYHQFMADA; | SYYYAGYHQFMADAK; | YYYAGYHQFMADAKA; |
| YYAGYHQFMADAKAS; | YAGYHQFMADAKASM; | AGYHQFMADAKASMS; |
| GYHQFMADAKASMSS; | YHQFMADAKASMSST; | HQFMADAKASMSSTK; |
| QFMADAKASMSSTKS; | FMADAKASMSSTKSL; | MADAKASMSSTKSLL; |
| ADAKASMSSTKSLLE; | DAKASMSSTKSLLEV; | AKASMSSTKSLLEVA; |
| KASMSSTKSLLEVAK; | ASMSSTKSLLEVAKN; | SMSSTKSLLEVAKKK; |
| MSSTKSLLEVAKKKQ; | SSTKSLLEVAKKKQK; | STKSLLEVAKKKQKR; |

Fig. 33 continued

TKSLLEVAKKKQKEL; KSLLEVAKKKQKELN; SLLEVAKKKQKELNE;
LLEVAKKKQKELNEN; LEVAKKKQKELNENM; EVAKKKQKELNENMT;
VAKKKQKELNENMTK; AKKKQKELNENMTKT; KKKQKELNENMTKTN;
KKQKELNENMTKTNK; KQKELNENMTKTNKD; QKELNENMTKTNKDF;
KELNENMTKTNKDFQ; ELNENMTKTNKDFQE; LNENMTKTNKDFQEL;
NENMTKTNKDFQELN; ENMTKTNKDFQELND; N

SKEEYNRLEDLAKVK; KEEYNRLEDLAKVKA; EEYNRLEDLAKVKAS;
EYNRLEDLAKVKASL; YNRLEDLAKVKASLD; NRLEDLAKVKASLDK;
RLEDLAKVKASLDKI; LEDLAKVKASLDKIK; EDLAKVKASLDKIKS;
DLAKVKASLDKIKSL; LAKVKASLDKIKSLL; AKVKASLDKIKSLLS;
KVKASLDKIKSLLST; VKASLDKIKSLLSTA; KASLDKIKSLLSTAK;
ASLDKIKSLLSTAKS; SLDKIKSLLSTAKSY; LDKIKSLLSTAKSYL;
DKIKSLLSTAKSYLE; KIKSLLSTAKSYLEQ; IKSLLSTAKSYLEQT;
KSLLSTAKSYLEQTR; SLLSTAKSYLEQTRR; LLSTAKSYLEQTRRG;
LSTAKSYLEQTRRGV; STAKSYLEQTRRGVG; TAKSYLEQTRRGVGS;
AKSYLEQTRRGVGSS; KSYLEQTRRGVGSSK; SYLEQTRRGVGSSKA;
YLEQTRRGVGSSKAN; LEQTRRGVGSSKANL; EQTRRGVGSSKANLA;
QTRRGVGSSKANLAL; TRRGVGSSKANLALL; RRGVGSSKANLALLP;
RGVGSSKANLALLPS; GVGSSKANLALLPSL; VGSSKANLALLPSLE;
GSSKANLALLPSLEE; SSKANLALLPSLEEA; SKANLALLPSLEEAI;
KANLALLPSLEEAIA; ANLALLPSLEEAIAK; NLALLPSLEEAIAKV;
LALLPSLEEAIAKVK; ALLPSLEEAIAKVKS; LLPSLEEAIAKVKSN;
LPSLEEAIAKVKSNH; PSLEEAIAKVKSNHA; SLEEAIAKVKSNHAS;
LEEAIAKVKSNHASA; EEAIAKVKSNHASAD; EAIAKVKSNHASADT;
AIAKVKSNHASADTH; IAKVKSNHASADTHC; AKVKSNHASADTHCK;
KVKSNHASADTHCKD; VKSNHASADTHCKDA; KSNHASADTHCKDAT;
SNHASADTHCKDATA; NHASADTHCKDATAA; HASADTHCKDATAAL;
ASADTHCKDATAALK; SADTHCKDATAALKR; ADTHCKDATAALKRA;
DTHCKDATAALKRAK; THCKDATAALKRAKN; HCKDATAALKRAKND;
CKDATAALKRAKNDF; KDATAALKRAKNDFF; DATAALKRAKNDFFY;
ATAALKRAKNDFFYA; TAALKRAKNDFFYAQ; AALKRAKNDFFYAQR;
ALKRAKNDFFYAQRK; LKRAKNDFFYAQRKA; KRAKNDFFYAQRKAD;
RAKNDFFYAQRKADR; AKNDFFYAQRKADRA; KNDFFYAQRKADRAL;
NDFFYAQRKADRALE; DFFYAQRKADRALEE; FFYAQRKADRALEEA;
FYAQRKADRALEEAL; YAQRKADRALEEALS; AQRKADRALEEALSN;
QRKADRALEEALSNS; RKADRALEEALSNSA; KADRALEEALSNSAS;
ADRALEEALSNSASR; DRALEEALSNSASRH;
RALEEALSNSASRHE; ALEEALSNSASRHES; LEEALSNSASRHESY;
EEALSNSASRHESYY; EALSNSASRHESYYY; ALSNSASRHESYYYA;
LSNSASRHESYYYAG; SNSASRHESYYYAGY; NSASRHESYYYAGYH;
SASRHESYYYAGYHQ; ASRHESYYYAGYHQF;
SRHESYYYAGYHQFM; RHESYYYAGYHQFMA; HESYYYAGYHQFMAD;
ESYYYAGYHQFMADA; SYYYAGYHQFMADAK; YYYAGYHQFMADAKA;
YYAGYHQFMADAKAS; YAGYHQFMADAKASM; AGYHQFMADAKASMS;
GYHQFMADAKASMSS; YHQFMADAKASMSST; HQFMADAKASMSSTK;
QFMADAKASMSSTKS; FMADAKASMSSTKSL; MADAKASMSSTKSLL;
ADAKASMSSTKSLLE; DAKASMSSTKSLLEV; AKASMSSTKSLLEVA;
KASMSSTKSLLEVAK; ASMSSTKSLLEVAKN; SMSSTKSLLEVAKNK;
MSSTKSLLEVAKNKQ; SSTKSLLEVAKNKQK; STKSLLEVAKNKQKF;
TKSLLEVAKNKQKFL; KSLLEVAKNKQKFLN; SLLEVAKNKQKFLNE;
LLEVAKNKQKFLNEM; LEVAKNKQKFLNEMT; EVAKNKQKFLNEMTK;
VAKNKQKFLNEMTKT; AKNKQKFLNEMTKTN; KNKQKFLNEMTKTNK;
NKQKFLNEMTKTNKD; KQKFLNEMTKTNKDF; QKFLNEMTKTNKDFQ;
KFLNEMTKTNKDFQE; FLNEMTKTNKDFQEL; LNEMTKTNKDFQELN;
NEMTKTNKDFQELND; EMTKTNKDFQELNDI; MTKTNKDFQELNDIY;
TKTNKDFQELNDIYK; KTNKDFQELNDIYKK; TNKDFQELNDIYKKL;
NKDFQELNDIYKKLQ; KDFQELNDIYKKLQD; DFQELNDIYKKLQDM;

Fig. 33 continued

|  | DFQELNDIYKKLQDMD; FQELNDIYKKLQDMDS; QELNDIYKKLQDMDSR; |
|---|---|
| SEQ ID NO:23 SEQ ID NO: 95587-96876 | 13 mers:<br>MIINHNTSAINAS; IINHNTSAINASR; INHNTSAINASRN;<br>NHNTSAINASRNN; HNTSAINASRNNG; NTSAINASRNNGI;<br>TSAINASRNNGIN; SAINASRNNGINA; AINASRNNGINAA;<br>INASRNNGINAAN; NASRNNGINAANL; ASRNNGINAANLS;<br>SRNNGINAANLSK; RNNGINAANLSKT; NNGINAANLSKTQ;<br>NGINAANLSKTQE; GINAANLSKTQEK; INAANLSKTQEKL;<br>NAANLSKTQEKLS; AANLSKTQEKLSS; ANLSKTQEKLSSG;<br>NLSKTQEKLSSGY; LSKTQEKLSSGYR; SKTQEKLSSGYRI;<br>KTQEKLSSGYRIN; TQEKLSSGYRINR; QEKLSSGYRINRA;<br>EKLSSGYRINRAS; KLSSGYRINRASD; LSSGYRINRASDD;<br>SSGYRINRASDDA; SGYRINRASDDAA; GYRINRASDDAAG;<br>YRINRASDDAAGM; RINRASDDAAGMG; INRASDDAAGMGV;<br>NRASDDAAGMGVS; RASDDAAGMGVSG; ASDDAAGMGVSGK;<br>SDDAAGMGVSGKI; DDAAGMGVSGKIN; DAAGMGVSGKINA;<br>AAGMGVSGKINAQ; AGMGVSGKINAQI; GMGVSGKINAQIR;<br>MGVSGKINAQIRG; GVSGKINAQIRGL; VSGKINAQIRGLS;<br>SGKINAQIRGLSQ; GKINAQIRGLSQA; KINAQIRGLSQAS;<br>INAQIRGLSQASR; NAQIRGLSQASRN; AQIRGLSQASRNT;<br>QIRGLSQASRNTS; IRGLSQASRNTSK; RGLSQASRNTSKA;<br>GLSQASRNTSKAI; LSQASRNTSKAIN; SQASRNTSKAINF;<br>QASRNTSKAINFI; ASRNTSKAINFIQ; SRNTSKAINFIQT;<br>RNTSKAINFIQTT; NTSKAINFIQTTE; TSKAINFIQTTEG;<br>SKAINFIQTTEGN; KAINFIQTTEGNL; AINFIQTTEGNLN;<br>INFIQTTEGNLNE; NFIQTTEGNLNEV; FIQTTEGNLNEVE;<br>IQTTEGNLNEVEK; QTTEGNLNEVEKV; TTEGNLNEVEKVL;<br>TEGNLNEVEKVLV; EGNLNEVEKVLVR; GNLNEVEKVLVRM;<br>NLNEVEKVLVRMK; LNEVEKVLVRMKE; NEVEKVLVRMKEL;<br>EVEKVLVRMKELA; VEKVLVRMKELAV; EKVLVRMKELAVQ;<br>KVLVRMKELAVQS; VLVRMKELAVQSG; LVRMKELAVQSGN;<br>VRMKELAVQSGNG; RMKELAVQSGNGT; MKELAVQSGNGTY;<br>KELAVQSGNGTYS; ELAVQSGNGTYSD; LAVQSGNGTYSDA;<br>AVQSGNGTYSDAD; VQSGNGTYSDADR; QSGNGTYSDADRG;<br>SGNGTYSDADRGS; GNGTYSDADRGSI; NGTYSDADRGSIQ;<br>GTYSDADRGSIQI; TYSDADRGSIQIE; YSDADRGSIQIEI;<br>SDADRGSIQIEIE; DADRGSIQIEIEQ; ADRGSIQIEIEQL;<br>DRGSIQIEIEQLT; RGSIQIEIEQLTD; GSIQIEIEQLTDE;<br>SIQIEIEQLTDEI; IQIEIEQLTDEIN; QIEIEQLTDEINR;<br>IEIEQLTDEINRI; EIEQLTDEINRIA; IEQLTDEINRIAD;<br>EQLTDEINRIADQ; QLTDEINRIADQA; LTDEINRIADQAQ;<br>TDEINRIADQAQY; DEINRIADQAQYN; EINRIADQAQYNQ;<br>INRIADQAQYNQM; NRIADQAQYNQMH; RIADQAQYNQMHM;<br>IADQAQYNQMHML; ADQAQYNQMHMLS; DQAQYNQMHMLSN;<br>QAQYNQMHMLSNK; AQYNQMHMLSNKS; QYNQMHMLSNKSA;<br>YNQMHMLSNKSAS; NQMHMLSNKSASQ; QMHMLSNKSASQN;<br>MHMLSNKSASQNV; HMLSNKSASQNVR; MLSNKSASQNVRT;<br>LSNKSASQNVRTA; SNKSASQNVRTAE; NKSASQNVRTAEE;<br>KSASQNVRTAEEL; SASQNVRTAEELG; ASQNVRTAEELGM; |

Fig. 33 continued

| | | |
|---|---|---|
| SQKVRTAEELGMQ; | QKVRTAEELGMQP; | KVRTAEELGMQPA; |
| VRTAEELGMQPAK; | RTAEELGMQPAKT; | TAEELGMQPAKTN; |
| AEELGMQPAKTNT; | EELGMQPAKTNTP; | ELGMQPAKTNTPA; |
| LGMQPAKTNTPAS; | GMQPAKTNTPASL; | MQPAKTNTPASLS; |
| QPAKTNTPASLSG; | PAKTNTPASLSGS; | AKTNTPASLSGSQ; |
| KTNTPASLSGSQA; | TNTPASLSGSQAS; | NTPASLSGSQASW; |
| TPASLSGSQASWT; | PASLSGSQASWTL; | ASLSGSQASWTLR; |
| SLSGSQASWTLRV; | LSGSQASWTLRVH; | SGSQASWTLRVHV; |
| GSQASWTLRVHVG; | SQASWTLRVHVGA; | QASWTLRVHVGAK; |
| ASWTLRVHVGAKQ; | SWTLRVHVGAKQD; | WTLRVHVGAKQDE; |
| TLRVHVGAKQDEA; | LRVHVGAKQDEAT; | RVHVGAKQDEATA; |
| VHVGAKQDEATAV; | HVGAKQDEATAVN; | VGAKQDEATAVNT; |
| GAKQDEATAVNTY; | AKQDEATAVNTYA; | KQDEATAVNTYAA; |
| QDEATAVNTYAAK; | DEATAVNTYAAKV; | EATAVNTYAAKVA; |
| ATAVNTYAAKVAK; | TAVNTYAAKVAKL; | AVNTYAAKVAKLF; |
| VNTYAAKVAKLFS; | NTYAAKVAKLFSG; | TYAAKVAKLFSGF; |
| YAAKVAKLFSGFG; | AAKVAKLFSGFGA; | AKVAKLFSGFGAQ; |
| KVAKLFSGFGAQT; | VAKLFSGFGAQTA; | AKLFSGFGAQTAQ; |
| KLFSGFGAQTAQA; | LFSGFGAQTAQAA; | FSGFGAQTAQAAP; |
| SGFGAQTAQAAPV; | GFGAQTAQAAPVQ; | FGAQTAQAAPVQE; |
| GAQTAQAAPVQEG; | AQTAQAAPVQEGV; | QTAQAAPVQEGVQ; |
| TAQAAPVQEGVQQ; | AQAAPVQEGVQQE; | QAAPVQEGVQQEG; |
| AAPVQEGVQQEGA; | APVQEGVQQEGAQ; | PVQEGVQQEGAQQ; |
| VQEGVQQEGAQQP; | QEGVQQEGAQQPA; | EGVQQEGAQQPAP; |
| GVQQEGAQQPAPA; | VQQEGAQQPAPAT; | QQEGAQQPAPATA; |
| QEGAQQPAPATAP; | EGAQQPAPATAPS; | GAQQPAPATAPSQ; |
| AQQPAPATAPSQG; | QQPAPATAPSQGG; | QPAPATAPSQGGV; |
| PAPATAPSQGGVN; | APATAPSQGGVNS; | PATAPSQGGVNSP; |
| ATAPSQGGVNSPV; | TAPSQGGVNSPVN; | APSQGGVNSPVNV; |
| PSQGGVNSPVNVT; | SQGGVNSPVNVTT; | QGGVNSPVNVTTV; |
| GGVNSPVNVTTVD; | GVNSPVNVTTVDA; | VNSPVNVTTVDAT; |
| NSPVNVTTVDAK; | SPVNVTTVDANT; | PVNVTTVDANTS; |
| VNVTTVDANTSL; | NVTTVDANTSLA; | VTTVDANTSLAK; |
| TTVDANTSLAKT; | TVDANTSLAKTE; | TVDANTSLAKTEE; |
| VDANTSLAKTENA; | DANTSLAKTENAT; | ANTSLAKTENATR; |
| NTSLAKTENATRM; | TSLAKTENATRMT; | SLAKTENATRMTS; |
| LAKTENATRMTSD; | AKTENATRMTSDQ; | KTENATRMTSDQR; |
| TENATRMTSDQRA; | ENATRMTSDQRAN; | NATRMTSDQRANL; |
| ATRMTSDQRANLG; | TRMTSDQRANLGA; | RMTSDQRANLGAF; |
| MTSDQRANLGAFQ; | TSDQRANLGAFQN; | SDQRANLGAFQNR; |
| DQRANLGAFQNRL; | QRANLGAFQNRLE; | RANLGAFQNRLES; |
| ANLGAFQNRLESI; | NLGAFQNRLESIK; | LGAFQNRLESIKN; |
| GAFQNRLESIKNS; | AFQNRLESIKNST; | FQNRLESIKNSTE; |
| QNRLESIKNSTEY; | NRLESIKNSTEYA; | RLESIKNSTEYAT; |
| LESIKNSTEYALE; | ESIKNSTEYALEN; | SIKNSTEYALENL; |
| IKNSTEYALENLK; | KNSTEYALENLKA; | NSTEYALENLKAS; |
| STEYALENLKASY; | TEYALENLKASYA; | EYALENLKASYAQ; |
| YALENLKASYAQI; | ALENLKASYAQIK; | LENLKASYAQIKD; |
| ENLKASYAQIKDA; | NLKASYAQIKDAT; | LKASYAQIKDATM; |
| KASYAQIKDATMT; | ASYAQIKDATMTD; | SYAQIKDATMTDE; |
| YAQIKDATMTDEV; | AQIKDATMTDEVV; | QIKDATMTDEVVA; |

Fig. 33 continued

IKDATMIDEVVAA; KDATMIDEVVAAT; DATMIDEVVAATT;
ATMTDEVVAATTN; TMTDEVVAATTNS; MTDEVVAATTNST;
TDEVVAATTNSTL; DEVVAATTNSTLT; EVVAATTNSTLTQ;
VVAATTNSTLTQS; VAATTNSILTQSA; AATTNSILTQSAM;
ATTNSILTQSAMA; TTNSILTQSAMAM; TNSILTQSAMAMT;
NSILTQSAMAMTA; SILTQSAMAMTAQ; ILTQSAMAMTAQA;
LTQSAMAMTAQAK; TQSAMAMTAQAKQ; QSAMAMTAQAKQV;
SAMAMTAQAKQVP; AMAMTAQAKQVPQ; MAMTAQAKQVPQY;
AMTAQAKQVPQYV; MTAQAKQVPQYVL; TAQAKQVPQYVLS;
AQAKQVPQYVLSL; QAKQVPQYVLSLL; AKQVPQYVLSLLR;

14 mers:
MTNHNTSATKASR; TNHNTSATKASRK; NHNTSATKASRKN;
HNTSATKASRKNG; NTSATKASRKNGT; TSATKASRKNGTN;
SATKASRKNGTNA; ATKASRKNGTNAA; TKASRKNGTNAAN;
KASRKNGTNAANL; ASRKNGTNAANLS; SRKNGTNAANLSK;
RKNGTNAANLSKT; KNGTNAANLSKTQ; NGTNAANLSKTQE;
GTNAANLSKTQEK; TNAANLSKTQEKL; NAANLSKTQEKLS;
AANLSKTQEKLSS; ANLSKTQEKLSSG; NLSKTQEKLSSGY;
LSKTQEKLSSGYR; SKTQEKLSSGYRI; KTQEKLSSGYRIN;
TQEKLSSGYRINR; QEKLSSGYRINRA; EKLSSGYRINRAS;
KLSSGYRINRASD; LSSGYRINRASDD; SSGYRINRASDDA;
SGYRINRASDDAA; GYRINRASDDAAG; YRINRASDDAAGM;
RINRASDDAAGMG; INRASDDAAGMGV; NRASDDAAGMGVS;
RASDDAAGMGVSG; ASDDAAGMGVSGK; SDDAAGMGVSGKT;
DDAAGMGVSGKTN; DAAGMGVSGKTNA; AAGMGVSGKTNAQ;
AGMGVSGKTNAQT; GMGVSGKTNAQTR; MGVSGKTNAQTRG;
GVSGKTNAQTRGL; VSGKTNAQTRGLS; SGKTNAQTRGLSQ;
GKTNAQTRGLSQA; KTNAQTRGLSQAS; TNAQTRGLSQASR;
NAQTRGLSQASRN; AQTRGLSQASRNT; QTRGLSQASRNTS;
TRGLSQASRNTSK; RGLSQASRNTSKA; GLSQASRNTSKAI;
LSQASRNTSKAIN; SQASRNTSKAINF; QASRNTSKAINFT;
ASRNTSKAINFTQ; SRNTSKAINFTQT; RNTSKAINFTQTT;
NTSKAINFTQTTE; TSKAINFTQTTEG; SKAINFTQTTEGN;
KAINFTQTTEGNL; AINFTQTTEGNLN; INFTQTTEGNLNE;
NFTQTTEGNLNEV; FTQTTEGNLNEVE; TQTTEGNLNEVEK;
QTTEGNLNEVEKV; TTEGNLNEVEKVL; TEGNLNEVEKVLV;
EGNLNEVEKVLVR; GNLNEVEKVLVRM; NLNEVEKVLVRMK;
LNEVEKVLVRMKE; NEVEKVLVRMKEL; EVEKVLVRMKELA;
VEKVLVRMKELAV; EKVLVRMKELAVQ; KVLVRMKELAVQS;
VLVRMKELAVQSG; LVRMKELAVQSGN; VRMKELAVQSGNG;
RMKELAVQSGNGT; MKELAVQSGNGTY; KELAVQSGNGTYS;
ELAVQSGNGTYSD; LAVQSGNGTYSDA; AVQSGNGTYSDAD;
VQSGNGTYSDADR; QSGNGTYSDADRG; SGNGTYSDADRGS;
GNGTYSDADRGSI; NGTYSDADRGSIQ; GTYSDADRGSIQI;
TYSDADRGSIQIE; YSDADRGSIQIEL; SDADRGSIQIELE;
DADRGSIQIELEQ; ADRGSIQIELEQL; DRGSIQIELEQLT;
RGSIQIELEQLTD; GSIQIELEQLTDE; SIQIELEQLTDEL;
IQIELEQLTDELN; QIELEQLTDELNR; IELEQLTDELNRI;
ELEQLTDELNRIA; LEQLTDELNRIAD; EQLTDELNRIADQ;
QLTDELNRIADQA; LTDELNRIADQAG; TDELNRIADQAGY;

Fig. 33 continued

| | | |
|---|---|---|
| TDEIKRLADQAQYN; | DEIKRLADQAQYNQ; | EIKRLADQAQYNQM; |
| EIKRLADQAQYNQMH; | IKRLADQAQYNQMHM; | KRLADQAQYNQMHML; |
| RLADQAQYNQMHMLS; | LADQAQYNQMHMLSN; | ADQAQYNQMHMLSNK; |
| DQAQYNQMHMLSNKS; | QAQYNQMHMLSNKSA; | AQYNQMHMLSNKSAS; |
| QYNQMHMLSNKSASQ; | YNQMHMLSNKSASQK; | NQMHMLSNKSASQKV; |
| QMHMLSNKSASQKVR; | MHMLSNKSASQKVRT; | HMLSNKSASQKVRTA; |
| MLSNKSASQKVRTAF; | LSNKSASQKVRTAFF; | SNKSASQKVRTAFFL; |
| NKSASQKVRTAFFLG; | KSASQKVRTAFFLGM; | SASQKVRTAFFLGMQ; |
| ASQKVRTAFFLGMQP; | SQKVRTAFFLGMQPA; | QKVRTAFFLGMQPAK; |
| KVRTAFFLGMQPAKT; | VRTAFFLGMQPAKTN; | RTAFFLGMQPAKTNT; |
| TAFFLGMQPAKTNTP; | AFFLGMQPAKTNTPA; | FFLGMQPAKTNTPAS; |
| FLGMQPAKTNTPASL; | LGMQPAKTNTPASLS; | GMQPAKTNTPASLSG; |
| MQPAKTNTPASLSGS; | QPAKTNTPASLSGSQ; | PAKTNTPASLSGSQA; |
| AKTNTPASLSGSQAS; | KTNTPASLSGSQASW; | TNTPASLSGSQASWT; |
| NTPASLSGSQASWTL; | TPASLSGSQASWTLR; | PASLSGSQASWTLRV; |
| ASLSGSQASWTLRVH; | SLSGSQASWTLRVHV; | LSGSQASWTLRVHVG; |
| SGSQASWTLRVHVGA; | GSQASWTLRVHVGAN; | SQASWTLRVHVGANQ; |
| QASWTLRVHVGANQD; | ASWTLRVHVGANQDE; | SWTLRVHVGANQDEA; |
| WTLRVHVGANQDEAL; | TLRVHVGANQDEALA; | LRVHVGANQDEALAV; |
| RVHVGANQDEALAVN; | VHVGANQDEALAVNL; | HVGANQDEALAVNLY; |
| VGANQDEALAVNLYA; | GANQDEALAVNLYAA; | ANQDEALAVNLYAAR; |
| NQDEALAVNLYAARV; | QDEALAVNLYAARVA; | DEALAVNLYAARVAN; |
| EALAVNLYAARVANL; | ALAVNLYAARVANLF; | LAVNLYAARVANLFS; |
| AVNLYAARVANLFSG; | VNLYAARVANLFSGF; | NLYAARVANLFSGFG; |
| LYAARVANLFSGFGA; | YAARVANLFSGFGAQ; | AARVANLFSGFGAQT; |
| ARVANLFSGFGAQTA; | RVANLFSGFGAQTAQ; | VANLFSGFGAQTAQA; |
| ANLFSGFGAQTAQAA; | NLFSGFGAQTAQAAP; | LFSGFGAQTAQAAPV; |
| FSGFGAQTAQAAPVQ; | SGFGAQTAQAAPVQE; | GFGAQTAQAAPVQEG; |
| FGAQTAQAAPVQEGV; | GAQTAQAAPVQEGVQ; | AQTAQAAPVQEGVQQ; |
| QTAQAAPVQEGVQQE; | TAQAAPVQEGVQQEG; | AQAAPVQEGVQQEGA; |
| QAAPVQEGVQQEGAQ; | AAPVQEGVQQEGAQQ; | APVQEGVQQEGAQQP; |
| PVQEGVQQEGAQQPA; | VQEGVQQEGAQQPAP; | QEGVQQEGAQQPAPA; |
| EGVQQEGAQQPAPAT; | GVQQEGAQQPAPATA; | VQQEGAQQPAPATAP; |
| QQEGAQQPAPATAPS; | QEGAQQPAPATAPSQ; | EGAQQPAPATAPSQG; |
| GAQQPAPATAPSQGG; | AQQPAPATAPSQGGV; | QQPAPATAPSQGGVN; |
| QPAPATAPSQGGVNS; | PAPATAPSQGGVNSP; | APATAPSQGGVNSPV; |
| PATAPSQGGVNSPVK; | ATAPSQGGVNSPVKV; | TAPSQGGVNSPVKVT; |
| APSQGGVNSPVKVTT; | PSQGGVNSPVKVTTT; | SQGGVNSPVKVTTTV; |
| QGGVNSPVKVTTTVD; | GGVNSPVKVTTTVDA; | GVNSPVKVTTTVDAN; |
| VNSPVKVTTTVDANT; | NSPVKVTTTVDANTS; | SPVKVTTTVDANTSL; |
| PVKVTTTVDANTSLA; | VKVTTTVDANTSLAK; | KVTTTVDANTSLAKI; |
| VTTTVDANTSLAKIE; | TTTVDANTSLAKIEK; | TTVDANTSLAKIEKA; |
| TVDANTSLAKIEKAT; | VDANTSLAKIEKATR; | DANTSLAKIEKATRM; |
| ANTSLAKIEKATRMT; | NTSLAKIEKATRMTS; | TSLAKIEKATRMTSD; |
| SLAKIEKATRMTSDQ; | LAKIEKATRMTSDQR; | AKIEKATRMTSDQRA; |
| KIEKATRMTSDQRAN; | IEKATRMTSDQRANL; | EKATRMTSDQRANLG; |
| KATRMTSDQRANLGA; | ATRMTSDQRANLGAF; | TRMTSDQRANLGAFQ; |
| RMTSDQRANLGAFQN; | MTSDQRANLGAFQNR; | TSDQRANLGAFQNRL; |
| SDQRANLGAFQNRLE; | DQRANLGAFQNRLES; | QRANLGAFQNRLESI; |
| RANLGAFQNRLESIK; | ANLGAFQNRLESIKK; | NLGAFQNRLESIKKS; |
| LGAFQNRLESIKNST; | GAFQNRLESIKNSTE; | AFQNRLESIKNSTEY; |

Fig. 33 continued

QSRLESIKNSTEYA; SRLESIKKSTEYAI; RLESIKNSTEYAIE;
LESIKNSTEYAIEK; ESIKKSTEYAIEKL; SIKNSTEYAIENLK;
IKNSTEYAIENLKA; KNSTEYAIENLKAS; NSTEYAIENLKASY;
STEYAIENLKASYA; TEYAIENLKASYAQ; EYAIENLKASYAQI;
YAIENLKASYAQIK; AIENLKASYAQIKD; IENLKASYAQIKDA;
ENLKASYAQIKDAT; NLKASYAQIKDATM; LKASYAQIKDATMT;
KASYAQIKDATMTD; ASYAQIKDATMTDE; SYAQIKDATMTDEV;
YAQIKDATMTDEVV; AQIKDATMTDEVVA; QIKDATMTDEVVAA;
IKDATMTDEVVAAT; KDATMTDEVVAATT; DATMTDEVVAATTN;
ATMTDEVVAATTNS; TMTDEVVAATTNST; MTDEVVAATTNSIL;
TDEVVAATTNSILT; DEVVAATTNSILTQ; EVVAATTNS

| | | |
|---|---|---|
| AVQSGNGTYSDADRG; | VQSGNGTYSDADRGS; | QSGNGTYSDADRGST; |
| SGNGTYSDADRGSTQ; | GNGTYSDADRGSTQT; | NGTYSDADRGSTQTF; |
| GTYSDADRGSTQTFT; | TYSDADRGSTQTFTF; | YSDADRGSTQTFTFQ; |
| SDADRGSTQTFTFQL; | DADRGSTQTFTFQLT; | ADRGSTQTFTFQLTD; |
| DRGSTQTFTFQLTDF; | RGSTQTFTFQLTDFT; | GSTQTFTFQLTDFTN; |
| STQTFTFQLTDFTNR; | TQTFTFQLTDFTNRT; | QTFTFQLTDFTNRTA; |
| TFTFQLTDFTNRTAD; | FTFQLTDFTNRTADQ; | TFQLTDFTNRTADQA; |
| FQLTDFTNRTADQAQ; | QLTDFTNRTADQAQY; | LTDFTNRTADQAQYN; |
| TDFTNRTADQAQYNQ; | DFTNRTADQAQYNQM; | FTNRTADQAQYNQMH; |
| TNRTADQAQYNQMHM; | NRTADQAQYNQMHML; | RTADQAQYNQMHMLS; |
| TADQAQYNQMHMLSN; | ADQAQYNQMHMLSNK; | DQAQYNQMHMLSNKS; |
| QAQYNQMHMLSNKSA; | AQYNQMHMLSNKSAS; | QYNQMHMLSNKSASQ; |
| YNQMHMLSNKSASQN; | NQMHMLSNKSASQNV; | QMHMLSNKSASQNVR; |
| MHMLSNKSASQNVRT; | HMLSNKSASQNVRTA; | MLSNKSASQNVRTAF; |
| LSNKSASQNVRTAFF; | SNKSASQNVRTAFFL; | NKSASQNVRTAFFLG; |
| KSASQNVRTAFFLGM; | SASQNVRTAFFLGMQ; | ASQNVRTAFFLGMQP; |
| SQNVRTAFFLGMQPA; | QNVRTAFFLGMQPAK; | NVRTAFFLGMQPAKT; |
| VRTAFFLGMQPAKTN; | RTAFFLGMQPAKTNT; | TAFFLGMQPAKTNTP; |
| AFFLGMQPAKTNTPA; | FFLGMQPAKTNTPAS; | FLGMQPAKTNTPASL; |
| LGMQPAKTNTPASLS; | GMQPAKTNTPASLSG; | MQPAKTNTPASLSGS; |
| QPAKTNTPASLSGSQ; | PAKTNTPASLSGSQA; | AKTNTPASLSGSQAS; |
| KTNTPASLSGSQASW; | TNTPASLSGSQASWT; | NTPASLSGSQASWTL; |
| TPASLSGSQASWTLR; | PASLSGSQASWTLRV; | ASLSGSQASWTLRVH; |
| SLSGSQASWTLRVHV; | LSGSQASWTLRVHVG; | SGSQASWTLRVHVGA; |
| GSQASWTLRVHVGAN; | SQASWTLRVHVGANQ; | QASWTLRVHVGANQD; |
| ASWTLRVHVGANQDE; | SWTLRVHVGANQDEA; | WTLRVHVGANQDEAL; |
| TLRVHVGANQDEALA; | LRVHVGANQDEALAV; | RVHVGANQDEALAVN; |
| VHVGANQDEALAVNT; | HVGANQDEALAVNTY; | VGANQDEALAVNTYA; |
| GANQDEALAVNTYAA; | ANQDEALAVNTYAAK; | NQDEALAVNTYAAKV; |
| QDEALAVNTYAAKVA; | DEALAVNTYAAKVAK; | EALAVNTYAAKVAKL; |
| ALAVNTYAAKVAKLF; | LAVNTYAAKVAKLFS; | AVNTYAAKVAKLFSG; |
| VNTYAAKVAKLFSGF; | NTYAAKVAKLFSGFG; | TYAAKVAKLFSGFGA; |
| YAAKVAKLFSGFGAQ; | AAKVAKLFSGFGAQT; | AKVAKLFSGFGAQTA; |
| KVAKLFSGFGAQTAQ; | VAKLFSGFGAQTAQA; | AKLFSGFGAQTAQAA; |
| KLFSGFGAQTAQAAP; | LFSGFGAQTAQAAPV; | FSGFGAQTAQAAPVQ; |
| SGFGAQTAQAAPVQF; | GFGAQTAQAAPVQFG; | FGAQTAQAAPVQFGV; |
| GAQTAQAAPVQFGVQ; | AQTAQAAPVQFGVQQ; | QTAQAAPVQFGVQQF; |
| TAQAAPVQFGVQQFG; | AQAAPVQFGVQQFGA; | QAAPVQFGVQQFGAQ; |
| AAPVQFGVQQFGAQQ; | APVQFGVQQFGAQQP; | PVQFGVQQFGAQQPA; |
| VQFGVQQFGAQQPAP; | QFGVQQFGAQQPAPA; | FGVQQFGAQQPAPAT; |
| GVQQFGAQQPAPATA; | VQQFGAQQPAPATAP; | QQFGAQQPAPATAPS; |
| QFGAQQPAPATAPSG; | FGAQQPAPATAPSGG; | GAQQPAPATAPSGGG; |
| AQQPAPATAPSGGGV; | QQPAPATAPSGGGVK; | QPAPATAPSGGGVKS; |
| PAPATAPSGGGVKSP; | APATAPSGGGVKSPV; | PATAPSGGGVKSPVN; |
| ATAPSGGGVKSPVNV; | TAPSGGGVKSPVNVT; | APSGGGVKSPVNVTT; |
| PSGGGVKSPVNVTTV; | SGGGVKSPVNVTTVD; | GGGVKSPVNVTTVD; |
| GGVKSPVNVTTVDAN; | GVKSPVNVTTVDANT; | VKSPVNVTTVDANTS; |
| KSPVNVTTVDANTSL; | SPVNVTTVDANTSLA; | PVNVTTVDANTSLAK; |
| VNVTTVDANTSLAKI; | NVTTVDANTSLAKIE; | VTTVDANTSLAKIE; |
| TTVDANTSLAKIEDA; | TVDANTSLAKIEDAI; | TVDANTSLAKIEDAI; |
| VDANTSLAKIEDATR; | DANTSLAKIEDATRM; | ANTSLAKIEDATRMI; |

Fig. 33 continued

NTSLAKIENAIRMIS; TSLAKIENAIRMISD; SLAKIENAIRMISDQ;
LAKIENAIRMISDQR; AKIENAIRMISDQRA; KIENAIRMISDQRAN;
IENAIRMISDQRANL; ENAIRMISDQRANLG; NAIRMISDQRANLGA;
AIRMISDQRANLGAF; IRMISDQRANLGAFQ; RMISDQRANLGAFQN;
MISDQRANLGAFQNR; ISDQRANLGAFQNRL; SDQRANLGAFQNRLE;
DQRANLGAFQNRLES; QRANLGAFQNRLEST; RANLGAFQNRLESTK;
ANLGAFQNRLESTKN; NLGAFQNRLESTKNS; LGAFQNRLESTKNST;
GAFQNRLESTKNSTF; AFQNRLESTKNSTFY; FQNRLESTKNSTFYA;
QNRLESTKNSTFYAT; NRLESTKNSTFYATE; RLESTKNSTFYATEN;
LESTKNSTFYATENL; ESTKNSTFYATENLK; STKNSTFYATENLKA;
TKNSTFYATENLKAS; KNSTFYATENLKASY; NSTFYATENLKASYA;
STFYATENLKASYAQ; TFYATENLKASYAQI; FYATENLKASYAQIK;
YATENLKASYAQIKD; ATENLKASYAQIKDA; TENLKASYAQIKDAT;
ENLKASYAQIKDATM; NLKASYAQIKDATMT; LKASYAQIKDATMTD;
KASYAQIKDATMTDE; ASYAQIKDATMTDEV; SYAQIKDATMTDEVV;
YAQIKDATMTDEVVA; AQIKDATMTDEVVAA; QIKDATMTDEVVAAT;
IKDATMTDEVVAATT; KDATMTDEVVAATTN; DATMTDEVVAATTNS;
ATMTDEVVAATTNST; TMTDEVVAATTNSIL; MTDEVVAATTNSILT;
TDEVVAATTNSILTQ; DEVVAATTNSILTQS; EVVAATTNSILTQSA;
VVAATTNSILTQSAM; VAATTNSILTQSAMA; AATTNSILTQSAMAM;
ATTNSILTQSAMAMI; TTNSILTQSAMAMIA; TNSILTQSAMAMIAQ;
NSILTQSAMAMIAQA; SILTQSAMAMIAQAK; ILTQSAMAMIAQAKQ;
LTQSAMAMIAQAKQV; TQSAMAMIAQAKQVP; QSAMAMIAQAKQVPG;
SAMAMIAQAKQVPQY; AMAMIAQAKQVPQYV; MAMIAQAKQVPQYVL;
AMIAQAKQVPQYVLS; MIAQAKQVPQYVLSL; IAQAKQVPQYVLSLL;
AQAKQVPQYVLSLLR;

16 mers:
MTIHHNTSAIKASRNK; IHHNTSAIKASRNKG; HHNTSAIKASRNKGT;
NHNTSAIKASRNKGTN; HNTSAIKASRNKGTNA; NTSAIKASRNKGTNAA;
TSAIKASRNKGTNAAN; SAIKASRNKGTNAANL; AIKASRNKGTNAANLS;
IKASRNKGTNAANLSK; KASRNKGTNAANLSKT; ASRNKGTNAANLSKTQ;
SRNKGTNAANLSKTQF; RNKGTNAANLSKTQFK; NKGTNAANLSKTQFKL;
KGTNAANLSKTQFKLS; GTNAANLSKTQFKLSS; TNAANLSKTQFKLSSG;
NAANLSKTQFKLSSGY; AANLSKTQFKLSSGYR; ANLSKTQFKLSSGYRT;
NLSKTQFKLSSGYRTN; LSKTQFKLSSGYRTNR; SKTQFKLSSGYRTNRA;
KTQFKLSSGYRTNRAS; TQFKLSSGYRTNRASD; QFKLSSGYRTNRASDD;
FKLSSGYRTNRASDDA; KLSSGYRTNRASDDAA; LSSGYRTNRASDDAAG;
SSGYRTNRASDDAAGM; SGYRTNRASDDAAGMG; GYRTNRASDDAAGMGV;
YRTNRASDDAAGMGVS; RTNRASDDAAGMGVSG; TNRASDDAAGMGVSGK;
NRASDDAAGMGVSGKI; RASDDAAGMGVSGKIN; ASDDAAGMGVSGKINA;
SDDAAGMGVSGKINAQ; DDAAGMGVSGKINAQI; DAAGMGVSGKINAQIR;
AAGMGVSGKINAQIRG; AGMGVSGKINAQTRGL; GMGVSGKINAQTRGLS;
MGVSGKINAQTRGLSQ; GVSGKINAQTRGLSQA; VSGKINAQTRGLSQAS;
SGKINAQTRGLSQASR; GKINAQTRGLSQASRN; KINAQTRGLSQASRNT;
INAQTRGLSQASRNTS; NAQTRGLSQASRNTSK; AQTRGLSQASRNTSKA;
QTRGLSQASRNTSKAT; TRGLSQASRNTSKATN; RGLSQASRNTSKATNF;
GLSQASRNTSKATNFI; LSQASRNTSKATNFIQ; SQASRNTSKATNFIQT;
QASRNTSKATNFIQTT; ASRNTSKATNFIQTTE; SRNTSKATNFIQTTEG;
RNTSKATNFIQTTEGK; NTSKATNFIQTTEGKL; TSKATNFIQTTEGKLK;
SKATNFIQTTEGKLKF; KATNFIQTTEGKLKFV; ATNFIQTTEGKLKFVE;

Fig. 33 continued

| | | |
|---|---|---|
| INFIQTTEGNLNEVEK; | KFIQTTEGNLNEVEKV; | FIQTTEGNLNEVEKVL; |
| IQTTEGNLNEVEKVLV; | QTTEGNLNEVEKVLVR; | TTEGNLNEVEKVLVRM; |
| TEGNLNEVEKVLVRMK; | EGNLNEVEKVLVRMKE; | GNLNEVEKVLVRMKEL; |
| NLNEVEKVLVRMKELA; | LNEVEKVLVRMKELAV; | NEVEKVLVRMKELAVQ; |
| EVEKVLVRMKELAVQS; | VEKVLVRMKELAVQSG; | EKVLVRMKELAVQSGN; |
| KVLVRMKELAVQSGNG; | VLVRMKELAVQSGNGT; | LVRMKELAVQSGNGTY; |
| VRMKELAVQSGNGTYS; | RMKELAVQSGNGTYSD; | MKELAVQSGNGTYSDA; |
| KELAVQSGNGTYSDAD; | ELAVQSGNGTYSDADR; | LAVQSGNGTYSDADRG; |
| AVQSGNGTYSDADRGS; | VQSGNGTYSDADRGST; | QSGNGTYSDADRGSTQ; |
| SGNGTYSDADRGSTQT; | GNGTYSDADRGSTQTF; | NGTYSDADRGSTQTFT; |
| GTYSDADRGSTQTFTF; | TYSDADRGSTQTFTFQ; | YSDADRGSTQTFTFQI; |
| SDADRGSTQTFTFQLT; | DADRGSTQTFTFQLTD; | ADRGSTQTFTFQLTDE; |
| DRGSTQTFTFQLTDET; | RGSTQTFTFQLTDETN; | GSTQTFTFQLTDETNR; |
| STQTFTFQLTDETNRT; | TQTFTFQLTDETNRTA; | QTFTFQLTDETNRTAD; |
| TFTFQLTDETNRTADQ; | FTFQLTDETNRTADQA; | TFQLTDETNRTADQAQ; |
| FQLTDETNRTADQAQY; | QLTDETNRTADQAQYN; | LTDETNRTADQAQYNQ; |
| TDETNRTADQAQYNQM; | DETNRTADQAQYNQMH; | ETNRTADQAQYNQMHM; |
| TNRTADQAQYNQMHML; | NRTADQAQYNQMHMLS; | RTADQAQYNQMHMLSN; |
| TADQAQYNQMHMLSNK; | ADQAQYNQMHMLSNKS; | DQAQYNQMHMLSNKSA; |
| QAQYNQMHMLSNKSAS; | AQYNQMHMLSNKSASQ; | QYNQMHMLSNKSASQN; |
| YNQMHMLSNKSASQNV; | NQMHMLSNKSASQNVR; | QMHMLSNKSASQNVRT; |
| MHMLSNKSASQNVRTA; | HMLSNKSASQNVRTAE; | MLSNKSASQNVRTAEE; |
| LSNKSASQNVRTAEEL; | SNKSASQNVRTAEELG; | NKSASQNVRTAEELGM; |
| KSASQNVRTAEELGMQ; | SASQNVRTAEELGMQP; | ASQNVRTAEELGMQPA; |
| SQNVRTAEELGMQPAK; | QNVRTAEELGMQPAKT; | NVRTAEELGMQPAKTK; |
| VRTAEELGMQPAKTKT; | RTAEELGMQPAKTKTP; | TAEELGMQPAKTKTPA; |
| AEELGMQPAKTKTPAS; | EELGMQPAKTKTPASL; | ELGMQPAKTKTPASLG; |
| LGMQPAKTKTPASLGG; | GMQPAKTKTPASLGGS; | MQPAKTKTPASLGGSQ; |
| QPAKTKTPASLGGSQA; | PAKTKTPASLGGSQAS; | AKTKTPASLGGSQASW; |
| KTKTPASLGGSQASWT; | TKTPASLGGSQASWTL; | KTPASLGGSQASWTLR; |
| TPASLGGSQASWTLRV; | PASLGGSQASWTLRVE; | ASLGGSQASWTLRVEV; |
| SLGGSQASWTLRVEVG; | LGGSQASWTLRVEVGA; | GGSQASWTLRVEVGAN; |
| GSQASWTLRVEVGANQ; | SQASWTLRVEVGANQD; | QASWTLRVEVGANQDE; |
| ASWTLRVEVGANQDEA; | SWTLRVEVGANQDEAT; | WTLRVEVGANQDEATA; |
| TLRVEVGANQDEATAV; | LRVEVGANQDEATAVN; | RVEVGANQDEATAVNT; |
| VEVGANQDEATAVNTY; | EVGANQDEATAVNTYA; | VGANQDEATAVNTYAA; |
| GANQDEATAVNTYAAN; | ANQDEATAVNTYAANV; | NQDEATAVNTYAANVA; |
| QDEATAVNTYAANVAK; | DEATAVNTYAANVAKL; | EATAVNTYAANVAKLF; |
| ATAVNTYAANVAKLFS; | TAVNTYAANVAKLFSG; | AVNTYAANVAKLFSGE; |
| VNTYAANVAKLFSGEG; | NTYAANVAKLFSGEGA; | TYAANVAKLFSGEGAQ; |
| YAANVAKLFSGEGAQT; | AANVAKLFSGEGAQTA; | ANVAKLFSGEGAQTAQ; |
| NVAKLFSGEGAQTAQA; | VAKLFSGEGAQTAQAA; | AKLFSGEGAQTAQAAP; |
| KLFSGEGAQTAQAAPV; | LFSGEGAQTAQAAPVQ; | FSGEGAQTAQAAPVQE; |
| SGEGAQTAQAAPVQEG; | GEGAQTAQAAPVQEGV; | EGAQTAQAAPVQEGVQ; |
| GAQTAQAAPVQEGVQQ; | AQTAQAAPVQEGVQQE; | QTAQAAPVQEGVQQEG; |
| TAQAAPVQEGVQQEGA; | AQAAPVQEGVQQEGAQ; | QAAPVQEGVQQEGAQQ; |
| AAPVQEGVQQEGAQQP; | APVQEGVQQEGAQQPA; | PVQEGVQQEGAQQPAP; |
| VQEGVQQEGAQQPAPA; | QEGVQQEGAQQPAPAT; | EGVQQEGAQQPAPATA; |
| GVQQEGAQQPAPATAP; | VQQEGAQQPAPATAPS; | QQEGAQQPAPATAPSQ; |
| QEGAQQPAPATAPSQG; | EGAQQPAPATAPSQGG; | GAQQPAPATAPSQGGV; |
| AQQPAPATAPSQGGVK; | QQPAPATAPSQGGVKS; | QPAPATAPSQGGVKSP; |

Fig. 33 continued

| | |
|---|---|
| | PAPATAPSQGGVNSPV; APATAPSQGGVNSPVN; PATAPSQGGVNSPVNV; ATAPSQGGVNSPVNVT; TAPSQGGVNSPVNVTT; APSQGGVNSPVNVTTT; PSQGGVNSPVNVTTTV; SQGGVNSPVNVTTTVD; QGGVNSPVNVTTTVDA; GGVNSPVNVTTTVDAN; GVNSPVNVTTTVDANT; VNSPVNVTTTVDANTS; NSPVNVTTTVDANTSL; SPVNVTTTVDANTSLA; PVNVTTTVDANTSLAK; VNVTTTVDANTSLAKI; NVTTTVDANTSLAKIE; VTTTVDANTSLAKIEN; TTTVDANTSLAKIENA; TTVDANTSLAKIENAI; TVDANTSLAKIENAIR; VDANTSLAKIENAIRM; DANTSLAKIENAIRMI; ANTSLAKIENAIRMIS; NTSLAKIENAIRMISD; TSLAKIENAIRMISDQ; SLAKIENAIRMISDQR; LAKIENAIRMISDQRA; AKIENAIRMISDQRAN; KIENAIRMISDQRANL; IENAIRMISDQRANLG; ENAIRMISDQRANLGA; NAIRMISDQRANLGAF; AIRMISDQRANLGAFQ; IRMISDQRANLGAFQN; RMISDQRANLGAFQNR; MISDQRANLGAFQNRL; ISDQRANLGAFQNRLE; SDQRANLGAFQNRLES; DQRANLGAFQNRLESI; QRANLGAFQNRLESIK; RANLGAFQNRLESIKN; ANLGAFQNRLESIKNS; NLGAFQNRLESIKNST; LGAFQNRLESIKNSTE; GAFQNRLESIKNSTEY; AFQNRLESIKNSTEYA; FQNRLESIKNSTEYAI; QNRLESIKNSTEYAIE; NRLESIKNSTEYAIEN; RLESIKNSTEYAIENL; LESIKNSTEYAIENLK; ESIKNSTEYAIENLKA; SIKNSTEYAIENLKAS; IKNSTEYAIENLKASY; KNSTEYAIENLKASYA; NSTEYAIENLKASYAQ; STEYAIENLKASYAQI; TEYAIENLKASYAQIK; EYAIENLKASYAQIKD; YAIENLKASYAQIKDA; AIENLKASYAQIKDAT; IENLKASYAQIKDATM; ENLKASYAQIKDATMT; NLKASYAQIKDATMTD; LKASYAQIKDATMTDE; KASYAQIKDATMTDEV; ASYAQIKDATMTDEVV; SYAQIKDATMTDEVVA; YAQIKDATMTDEVVAA; AQIKDATMTDEVVAAT; QIKDATMTDEVVAATT; IKDATMTDEVVAATTN; KDATMTDEVVAATTNS; DATMTDEVVAATTNSI; ATMTDEVVAATTNSIL; TMTDEVVAATTNSILT; MTDEVVAATTNSILTQ; TDEVVAATTNSILTQS; DEVVAATTNSILTQSA; EVVAATTNSILTQSAM; VVAATTNSILTQSAMA; VAATTNSILTQSAMAM; AATTNSILTQSAMAMI; ATTNSILTQSAMAMIA; TTNSILTQSAMAMIAQ; TNSILTQSAMAMIAQA; NSILTQSAMAMIAQAN; SILTQSAMAMIAQANQ; ILTQSAMAMIAQANQV; LTQSAMAMIAQANQVP; TQSAMAMIAQANQVPQ; QSAMAMIAQANQVPQY; SAMAMIAQANQVPQYV; AMAMIAQANQVPQYVL; MAMIAQANQVPQYVLS; AMIAQANQVPQYVLSL; MIAQANQVPQYVLSLL; IAQANQVPQYVLSLLR; |
| SEQ ID NO:24 SEQ ID NO: 96877-98934 | 13 mers: MKLQRSLFLIIFF; KLQRSLFLIIFFL; LQRSLFLIIFFLT; QRSLFLIIFFLTF; RSLFLIIFFLTFL; SLFLIIFFLTFLC; LFLIIFFLTFLCC; FLIIFFLTFLCCN; LIIFFLTFLCCNN; IIFFLTFLCCNNK; IFFLTFLCCNNKE; FFLTFLCCNNKER; FLTFLCCNNKERK; LTFLCCNNKERKE; TFLCCNNKERKEG; FLCCNNKERKEGV; LCCNNKERKEGVS; CCNNKERKEGVSF; CNNKERKEGVSFK; NNKERKEGVSFKI; NKERKEGVSFKIS; KERKEGVSFKISL; ERKEGVSFKISLG; RKEGVSFKISLGA; KEGVSFKISLGAE; EGVSFKISLGAEP; GVSFKISLGAEPS; VSFKISLGAEPSS; SFKISLGAEPSSL; FKISLGAEPSSLD; KISLGAEPSSLDP; ISLGAEPSSLDPQ; SLGAEPSSLDPQL; LGAEPSSLDPQLA; GAEPSSLDPQLAE; AEPSSLDPQLAED; EPSSLDPQLAEDN; PSSLDPQLAEDNV; SSLDPQLAEDNVA; SLDPQLAEDNVAS; LDPQLAEDNVASK; DPQLAEDNVASKM; PQLAEDNVASKMI; QLAEDNVASKMID; LAEDNVASKMIDT; |

Fig. 33 continued

| | | |
|---|---|---|
| AEDNVASKMLDTM; | EDNVASKMLDTMF; | DNVASKMLDTMFR; |
| NVASKMLDTMFRG; | VASKMLDTMFRGT; | ASKMLDTMFRGTV; |
| SKMLDTMFRGTVT; | KMLDTMFRGTVTG; | MLDTMFRGTVTGD; |
| LDTMFRGTVTGDP; | DTMFRGTVTGDPN; | TMFRGTVTGDPNT; |
| MFRGTVTGDPNTG; | FRGTVTGDPNTGG; | RGTVTGDPNTGGN; |
| GTVTGDPNTGGNK; | TVTGDPNTGGNKP; | VTGDPNTGGNKPG; |
| TGDPNTGGNKPGL; | GDPNTGGNKPGLA; | DPNTGGNKPGLAK; |
| PNTGGNKPGLAKG; | NTGGNKPGLAKGW; | TGGNKPGLAKGWD; |
| GGNKPGLAKGWDT; | GNKPGLAKGWDTS; | NKPGLAKGWDTSS; |
| KPGLAKGWDTSSD; | PGLAKGWDTSSDG; | GLAKGWDTSSDGT; |
| LAKGWDTSSDGTV; | AKGWDTSSDGTVY; | KGWDTSSDGTVYT; |
| GWDTSSDGTVYTF; | WDTSSDGTVYTFN; | DTSSDGTVYTFNL; |
| TSSDGTVYTFNLR; | SSDGTVYTFNLRE; | SDGTVYTFNLREK; |
| DGTVYTFNLREKI; | GTVYTFNLREKIT; | TVYTFNLREKITW; |
| VYTFNLREKITWS; | YTFNLREKITWSD; | TFNLREKITWSDG; |
| FNLREKITWSDGV; | NLREKITWSDGVA; | LREKITWSDGVAT; |
| REKITWSDGVATT; | EKITWSDGVATTA; | KITWSDGVATTAE; |
| ITWSDGVATTAEG; | TWSDGVATTAEGT; | WSDGVATTAEGTR; |
| SDGVATTAEGTRK; | DGVATTAEGTRKS; | GVATTAEGTRKSY; |
| VATTAEGTRKSYL; | ATTAEGTRKSYLR; | TTAEGTRKSYLRL; |
| TAEGTRKSYLRTL; | AEGTRKSYLRTLN; | EGTRKSYLRTLNK; |
| GTRKSYLRTLNKE; | TRKSYLRTLNKET; | RKSYLRTLNKETG; |
| KSYLRTLNKETGS; | SYLRTLNKETGSK; | YLRTLNKETGSKY; |
| LRTLNKETGSKYV; | RTLNKETGSKYVE; | TLNKETGSKYVEM; |
| LNKETGSKYVEMV; | NKETGSKYVEMVK; | KETGSKYVEMVKS; |
| ETGSKYVEMVKSV; | TGSKYVEMVKSVL; | GSKYVEMVKSVLK; |
| SKYVEMVKSVLKN; | KYVEMVKSVLKNG; | YVEMVKSVLKNGQ; |
| VEMVKSVLKNGQK; | EMVKSVLKNGQKY; | MVKSVLKNGQKYF; |
| VKSVLKNGQKYFD; | KSVLKNGQKYFDG; | SVLKNGQKYFDGQ; |
| VLKNGQKYFDGQV; | LKNGQKYFDGQVT; | KNGQKYFDGQVTD; |
| NGQKYFDGQVTDS; | GQKYFDGQVTDSE; | QKYFDGQVTDSEL; |
| KYFDGQVTDSELG; | YFDGQVTDSELGT; | FDGQVTDSELGTR; |
| DGQVTDSELGTRA; | GQVTDSELGTRAT; | QVTDSELGTRATD; |
| VTDSELGTRAIDE; | TDSELGTRAIDEK; | DSELGTRAIDEKT; |
| SELGTRAIDEKTL; | ELGTRAIDEKTLE; | LGTRAIDEKTLET; |
| GTRAIDEKTLETT; | TRAIDEKTLETTL; | RAIDEKTLETTLE; |
| AIDEKTLETTLES; | IDEKTLETTLESP; | DEKTLETTLESPK; |
| EKTLETTLESPKP; | KTLETTLESPKPY; | TLETTLESPKPYF; |
| LETTLESPKPYFT; | ETTLESPKPYFTD; | TTLESPKPYFTDM; |
| TLESPKPYFTDML; | LESPKPYFTDMLV; | ESPKPYFTDMLVH; |
| SPKPYFTDMLVHQ; | PKPYFTDMLVHQS; | KPYFTDMLVHQSF; |
| PYFTDMLVHQSFI; | YFTDMLVHQSFIP; | FTDMLVHQSFIPV; |
| TDMLVHQSFIPVP; | DMLVHQSFIPVPV; | MLVHQSFIPVPVH; |
| LVHQSFIPVPVHV; | VHQSFIPVPVHVT; | HQSFIPVPVHVTE; |
| QSFIPVPVHVTEK; | SFIPVPVHVTEKY; | FIPVPVHVTEKYG; |
| IPVPVHVTEKYGQ; | PVPVHVTEKYGQN; | VPVHVTEKYGQNW; |
| PVHVTEKYGQNWT; | VHVTEKYGQNWTS; | HVTEKYGQNWTSP; |
| VTEKYGQNWTSPE; | TEKYGQNWTSPEN; | EKYGQNWTSPENM; |
| KYGQNWTSPENMV; | YGQNWTSPENMVT; | GQNWTSPENMVTS; |
| QNWTSPENMVTSG; | NWTSPENMVTSGP; | WTSPENMVTSGPF; |
| TSPENMVTSGPFK; | SPENMVTSGPFKI; | PENMVTSGPFKIK; |

Fig. 33 continued

ENRVTSQPFKLKE; KMVTSQPFKLKER; MVTSQPFKLKERI;
VTSQPFKLKERIP; TSQPFKLKERIPN; SQPFKLKERIPNE;
QPFKLKERIPNEK; PFKLKERIPNEKY; FKLKERIPNEKYV;
KLKERIPNEKYVF; LKERIPNEKYVFE; KERIPNEKYVFEK;
ERIPNEKYVFEKN; RIPNEKYVFEKNN; IPNEKYVFEKNNK;
PNEKYVFEKNNKY; NEKYVFEKNNKYY; EKYVFEKNNKYYD;
KYVFEKNNKYYDS; YVFEKNNKYYDSN; VFEKNNKYYDSNE;
FEKNNKYYDSNEV; EKNNKYYDSNEVE; KNNKYYDSNEVEL;
NNKYYDSNEVELF; KYYDSNEVELFF; KYYDSNEVELFFI;
YYDSNEVELFFIT; YDSNEVELFFITF; DSNEVELFFITFY;
SNEVELFFITFYT; NEVELFFITFYTT; EVELFFITFYTTN;
VELFFITFYTTND; ELFFITFYTTNDS; LFFITFYTTNDSS;
FFITFYTTNDSST; FITFYTTNDSSTA; ITFYTTNDSSTAY;
TFYTTNDSSTAYK; FYTTNDSSTAYKM; YTTNDSSTAYKMY;
TTNDSSTAYKMYE; TNDSSTAYKMYEN; NDSSTAYKMYENE;
DSSTAYKMYENEE; SSTAYKMYENEEL; STAYKMYENEELD;
TAYKMYENEELDA; AYKMYENEELDAT; YKMYENEELDATF;
KMYENEELDATFG; MYENEELDATFGS; YENEELDATFGST;
ENEELDATFGSTP; NEELDATFGSTPP; EELDATFGSTPPD;
ELDATFGSTPPDL; LDATFGSTPPDLI; DATFGSTPPDLIK;
ATFGSTPPDLIKE; TFGSTPPDLIKNL; FGSTPPDLIKNLK;
GSTPPDLIKNLKL; STPPDLIKNLKLR; TPPDLIKNLKLRS;
PPDLIKNLKLRSD; PDLIKNLKLRSDY; DLIKNLKLRSDYY;
LIKNLKLRSDYYS; IKNLKLRSDYYSS; KNLKLRSDYYSSA;
NLKLRSDYYSSAV; LKLRSDYYSSAVN; KLRSDYYSSAVNA;
LRSDYYSSAVNAI; RSDYYSSAVNAIY; SDYYSSAVNAIYF;
DYYSSAVNAIYFY; YYSSAVNAIYFYA; YSSAVNAIYFYAF;
SSAVNAIYFYAFN; SAVNAIYFYAFNT; AVNAIYFYAFNTH;
VNAIYFYAFNTHI; NAIYFYAFNTHIK; AIYFYAFNTHIKP;
IYFYAFNTHIKPL; YFYAFNTHIKPLD; FYAFNTHIKPLDK;
YAFNTHIKPLDNV; AFNTHIKPLDNVK; FNTHIKPLDNVKI;
NTHIKPLDNVKIR; THIKPLDNVKIRK; HIKPLDNVKIRKA;
IKPLDNVKIRKAL; KPLDNVKIRKALT; PLDNVKIRKALTL;
LDNVKIRKALTLA; DNVKIRKALTLAI; NVKIRKALTLAID;
VKIRKALTLAIDR; KIRKALTLAIDRE; IRKALTLAIDRET;
RKALTLAIDRETL; KALTLAIDRETLY; ALTLAIDRETLYK;
LTLAIDRETLYKV; TLAIDRETLYKVL; LAIDRETLYKVLD;
AIDRETLYKVLDG; IDRETLYKVLDGG; DRETLYKVLDGGT;
RETLYKVLDGTTP; ETLYKVLDGTTPR; TLYKVLDGTTPRR;
LYKVLDGTTPRRA; YKVLDGTTPRRAT; KVLDGTTPRRATP;
VLDGTTPRRATPN; LDGTTPRRATPNF; DGTTPRRATPNFS;
GTTPRRATPNFSS; TTPRRATPNFSSY; TPRRATPNFSSYS;
PRRATPNFSSYSY; RRATPNFSSYSYA; RATPNFSSYSYAK;
ATPNFSSYSYAKS; TPNFSSYSYAKSL; PNFSSYSYAKSLE;
NFSSYSYAKSLEL; FSSYSYAKSLELF; SSYSYAKSLELFN;
SYSYAKSLELFNP; YSYAKSLELFNPE; SYAKSLELFNPEI;
YAKSLELFNPEIA; AKSLELFNPEIAK; KSLELFNPEIAKT;
SLELFNPEIAKTL; LELFNPEIAKTLL; ELFNPEIAKTLLA;
LFNPEIAKTLLAE; FNPEIAKTLLAEA; NPEIAKTLLAEAG;
PEIAKTLLAEAGY; EIAKTLLAEAGYP; IAKTLLAEAGYPE;

DGQKYFDGQVTDSEL; GQKYFDGQVTDSELG; QKYFDGQVTDSELGT;
KYFDGQVTDSELGT; YFDGQVTDSELGTR; FDGQVTDSELGTRA;
DGQVTDSELGTRAT; GQVTDSELGTRATD; QVTDSELGTRATDF;
VTDSELGTRATDEK; TDSELGTRATDEKT; DSELGTRATDEKTL;
SELGTRATDEKTLE; ELGTRATDEKTLEI; LGTRATDEKTLEIT;
GTRATDEKTLEITL; TRATDEKTLEITLF; RATDEKTLEITLFS;
ATDEKTLEITLFSP; TDEKTLEITLFSPK; DEKTLEITLFSPKP;
EKTLEITLFSPKPY; KTLEITLFSPKPYF; TLEITLFSPKPYFI;
LEITLFSPKPYFID; EITLFSPKPYFIDM; ITLFSPKPYFIDML;
TLFSPKPYFIDMLV; LFSPKPYFIDMLVH; FSPKPYFIDMLVHQ;
SPKPYFIDMLVHQS; PKPYFIDMLVHQSF; KPYFIDMLVHQSFI;
PYFIDMLVHQSFIP

YAFNTHIKPLDNVK; AFNTHIKPLDNVKI; FNTHIKPLDNVKIR;
NTHIKPLDNVKIRK; THIKPLDNVKIRKA; HIKPLDNVKIRKAL;
IKPLDNVKIRKALT; KPLDNVKIRKALTL; PLDNVKIRKALTLA;
LDNVKIRKALTLAI; DNVKIRKALTLAID; NVKIRKALTLAIDR;
VKIRKALTLAIDRE; KIRKALTLAIDRET; IRKALTLAIDRETL;
RKALTLAIDRETLT; KALTLAIDRETLTY; ALTLAIDRETLTYK;
LTLAIDRETLTYKV; TLAIDRETLTYKVL; LAIDRETLTYKVLD;
AIDRETLTYKVLDN; IDRETLTYKVLDNG; DRETLTYKVLDNGT;
RETLTYKVLDNGTT; ETLTYKVLDNGTTP; TLTYKVLDNGTTPT;
LTYKVLDNGTTPTR; TYKVLDNGTTPTRR; YKVLDNGTTPTRRA;
KVLDNGTTPTRRAT; VLDNGTTPTRRATP; LDNGTTPTRRATPN;
DNGTTPTRRATPNF; NGTTPTRRATPNFS; GTTPTRRATPNFSS;
TTPTRRATPNFSSY; TPTRRATPNFSSYS; PTRRATPNFSSYSY;
TRRATPNFSSYSYA; RRATPNFSSYSYAK; RATPNFSSYSYAKS;
ATPNFSSYSYAKSL; TPNFSSYSYAKSLE; PNFSSYSYAKSLEL;
NFSSYSYAKSLELF; FSSYSYAKSLELFN; SSYSYAK

GYTQFSSHNYSNPF; YTQFSSHNYSNPEY; TQFSSHNYSNPEYN;
QFSSHNYSNPEYNF; FSSHNYSNPEYNEL; SSHNYSNPEYNELT;
SHNYSNPEYNELTK; HNYSNPEYNELTKK; NYSNPEYNELTKKS;
YSNPEYNELKKSD; SNPEYNELKKSDL; NPEYNELKKSDLE;
PEYNELKKSDLEL; EYNELKKSDLELD; YNELKKSDLELDP;
NELKKSDLELDPT; ELKKSDLELDPTK; LKKSDLELDPTKR;
KKSDLELDPTKRQ; KSDLELDPTKRQD; SDLELDPTKRQDT;
DLELDPTKRQDTL; LELDPTKRQDTLR; ELDPTKRQDTLRQ;
LDPTKRQDTLRQA; DPTKRQDTLRQAE; PTKRQDTLRQAEE;
TKRQDTLRQAEET; KRQDTLRQAEETT; RQDTLRQAEETTF;
QDTLRQAEETTFK; DTLRQAEETTFKD; TLRQAEETTFKDP;
LRQAEETTFKDPP; RQAEETTFKDPPI; QAEETTFKDPPIA;
AEETTFKDPPIAP; EETTFKDPPIAPT; ETTFKDPPIAPTY;
TTFKDPPIAPTYT; TFKDPPIAPTYTY; FKDPPIAPTYTYG;
KDPPIAPTYTYGN; DPPIAPTYTYGNS; PPIAPTYTYGNSY;
PIAPTYTYGNSYL; IAPTYTYGNSYLF; APTYTYGNSYLFR;
PTYTYGNSYLFRN; TYTYGNSYLFRND; YTYGNSYLFRNDK;
TYGNSYLFRNDKW; YGNSYLFRNDKWT; GNSYLFRNDKWTG;
NSYLFRNDKWTGW; SYLFRNDKWTGWN; YLFRNDKWTGWNT;
LFRNDKWTGWNTI; FRNDKWTGWNTIL; RNDKWTGWNTILE;
NDKWTGWNTILER; DKWTGWNTILERF; KWTGWNTILERFD;
WTGWNTILERFDL; TGWNTILERFDLS; GWNTILERFDLSQ;
WNTILERFDLSQL; NTILERFDLSQLK; TILERFDLSQLKL;
ILERFDLSQLKLK; LERFDLSQLKLKN;

15 mers:
MKIQRSLFITFFLTF; KIQRSLFITFFLTFL; IQRSLFITFFLTFL;
QRSLFITFFLTFLC; RSLFITFFLTFLCC; SLFITFFLTFLCCN;
LFITFFLTFLCCNK; FITFFLTFLCCNKE; ITFFLTFLCCNKER;
TFFLTFLCCNKERK; FFLTFLCCNKERKE; FLTFLCCNKERKEG;
LTFLCCNKERKEGV; TFLCCNKERKEGVS; FLCCNKERKEGVSF;
LCCNKERKEGVSFK; CCNKERKEGVSFKT; CNKERKEGVSFKTS;
NKERKEGVSFKTSL; KERKEGVSFKTSLG; ERKEGVSFKTSLGA;
RKEGVSFKTSLGAE; KEGVSFKTSLGAEP; EGVSFKTSLGAEPS;
GVSFKTSLGAEPSS; VSFKTSLGAEPSSL; SFKTSLGAEPSSLD;
FKTSLGAEPSSLDP; KTSLGAEPSSLDPQ; TSLGAEPSSLDPQL;
SLGAEPSSLDPQLA; LGAEPSSLDPQLAE; GAEPSSLDPQLAED;
AEPSSLDPQLAEDK; EPSSLDPQLAEDKV; PSSLDPQLAEDKVA;
SSLDPQLAEDKVAS; SLDPQLAEDKVASK; LDPQLAEDKVASKM;
DPQLAEDKVASKMI; PQLAEDKVASKMID; QLAEDKVASKMIDT;
LAEDKVASKMIDTM; AEDKVASKMIDTMF; EDKVASKMIDTMFR;
DKVASKMIDTMFRG; KVASKMIDTMFRGT; VASKMIDTMFRGTV;
ASKMIDTMFRGTVT; SKMIDTMFRGTVTG; KMIDTMFRGTVTGD;
MIDTMFRGTVTGDP; IDTMFRGTVTGDPN; DTMFRGTVTGDPNT;
TMFRGTVTGDPNTG; MFRGTVTGDPNTGG; FRGTVTGDPNTGGN;
RGTVTGDPNTGGNK; GTVTGDPNTGGNKP; TVTGDPNTGGNKPG;
VTGDPNTGGNKPGL; TGDPNTGGNKPGLA; GDPNTGGNKPGLAK;
DPNTGGNKPGLAKG; PNTGGNKPGLAKGW; NTGGNKPGLAKGWD;
TGGNKPGLAKGWDI; GGNKPGLAKGWDIS; GNKPGLAKGWDISS;
NKPGLAKGWDISSD; KPGLAKGWDISSDG; PGLAKGWDISSDG;

| | | |
|---|---|---|
| YYDSKEVELEEITFY; | YDSKEVELEEITFYD; | DSKEVELEEITFYDT; |
| SKEVELEEITFYDTN; | KEVELEEITFYTTND; | EVELEEITFYTNDS; |
| VELEEITFYTTNDSS; | ELEEITFYTTNDSST; | LEEITFYTTNDSSTA; |
| EEITFYTTNDSSTAY; | EITFYTTNDSSTAYK; | ITFYTTNDSSTAYKM; |
| TFYTTNDSSTAYKMY; | FYTTNDSSTAYKMYE; | YTTNDSSTAYKMYEN; |
| TTNDSSTAYKMYENE; | TNDSSTAYKMYENEE; | NDSSTAYKMYENEEL; |
| DSSTAYKMYENEELD; | SSTAYKMYENEELDA; | STAYKMYENEELDAI; |
| TAYKMYENEELDAIF; | AYKMYENEELDAIFG; | YKMYENEELDAIFGS; |
| KMYENEELDAIFGST; | MYENEELDAIFGSTP; | YENEELDAIFGSTPP; |
| ENEELDAIFGSTPPD; | NEELDAIFGSTPPDL; | EELDAIFGSTPPDLI; |
| ELDAIFGSTPPDLIK; | LDAIFGSTPPDLIKN; | DAIFGSTPPDLIKNL; |
| AIFGSTPPDLIKNLK; | IFGSTPPDLIKNLKL; | FGSTPPDLIKNLKLR; |
| GSTPPDLIKNLKLRS; | STPPDLIKNLKLRSD; | TPPDLIKNLKLRSDY; |
| PPDLIKNLKLRSDYY; | PDLIKNLKLRSDYYS; | DLIKNLKLRSDYYSS; |
| LIKNLKLRSDYYSSA; | IKNLKLRSDYYSSAV; | KNLKLRSDYYSSAVN; |
| NLKLRSDYYSSAVNA; | LKLRSDYYSSAVNAI; | KLRSDYYSSAVNAIY; |
| LRSDYYSSAVNAIYF; | RSDYYSSAVNAIYFY; | SDYYSSAVNAIYFYA; |
| DYYSSAVNAIYFYAF; | YYSSAVNAIYFYAFK; | YSSAVNAIYFYAFKT; |
| SSAVNAIYFYAFKTH; | SAVNAIYFYAFKTHI; | AVNAIYFYAFKTHIK; |
| VNAIYFYAFKTHIKP; | NAIYFYAFKTHIKPL; | AIYFYAFKTHIKPLD; |
| IYFYAFKTHIKPLDN; | YFYAFKTHIKPLDNV; | FYAFKTHIKPLDNVK; |
| YAFKTHIKPLDNVKI; | AFKTHIKPLDNVKIR; | FKTHIKPLDNVKIRK; |
| KTHIKPLDNVKIRKA; | THIKPLDNVKIRKAL; | HIKPLDNVKIRKALT; |
| IKPLDNVKIRKALTL; | KPLDNVKIRKALTLA; | PLDNVKIRKALTLAI; |
| LDNVKIRKALTLAID; | DNVKIRKALTLAIDR; | NVKIRKALTLAIDRE; |
| VKIRKALTLAIDRET; | KIRKALTLAIDRETL; | IRKALTLAIDRETLT; |
| RKALTLAIDRETLTY; | KALTLAIDRETLTYK; | ALTLAIDRETLTYKV; |
| LTLAIDRETLTYKVL; | TLAIDRETLTYKVLD; | LAIDRETLTYKVLDN; |
| AIDRETLTYKVLDNG; | IDRETLTYKVLDNGT; | DRETLTYKVLDNGTT; |
| RETLTYKVLDNGTTP; | ETLTYKVLDNGTTPT; | TLTYKVLDNGTTPTR; |
| LTYKVLDNGTTPTRR; | TYKVLDNGTTPTRRA; | YKVLDNGTTPTRRAT; |
| KVLDNGTTPTRRATP; | VLDNGTTPTRRATPN; | LDNGTTPTRRATPNF; |
| DNGTTPTRRATPNFS; | NGTTPTRRATPNFSS; | GTTPTRRATPNFSSY; |
| TTPTRRATPNFSSYS; | TPTRRATPNFSSYSY; | PTRRATPNFSSYSYA; |
| TRRATPNFSSYSYAK; | RRATPNFSSYSYAKS; | RATPNFSSYSYAKSL; |
| ATPNFSSYSYAKSLE; | TPNFSSYSYAKSLEL; | PNFSSYSYAKSLELF; |
| NFSSYSYAKSLELFN; | FSSYSYAKSLELFNP; | SSYSYAKSLELFNPE; |
| SYSYAKSLELFNPEI; | YSYAKSLELFNPEIA; | SYAKSLELFNPEIAK; |
| YAKSLELFNPEIAKT; | AKSLELFNPEIAKTL; | KSLELFNPEIAKTLL; |
| SLELFNPEIAKTLLA; | LELFNPEIAKTLLAE; | ELFNPEIAKTLLAEA; |
| LFNPEIAKTLLAEAG; | FNPEIAKTLLAEAGY; | NPEIAKTLLAEAGYP; |
| PEIAKTLLAEAGYPN; | EIAKTLLAEAGYPNG; | IAKTLLAEAGYPNGG; |
| AKTLLAEAGYPNGG; | KTLLAEAGYPNGGFP; | TLLAEAGYPNGGFP; |
| LLAEAGYPNGGFPT; | LAEAGYPNGGFPTL; | AEAGYPNGGFPTLK; |
| EAGYPNGGFPTLKL; | AGYPNGGFPTLKLK; | GYPNGGFPTLKLKY; |
| YPNGGFPTLKLKYN; | PNGGFPTLKLKYNT; | NGGFPTLKLKYNTN; |
| GGFPTLKLKYNTNE; | GFPTLKLKYNTNEA; | GFPTLKLKYNTNEAN; |
| FPTLKLKYNTNEANK; | PTLKLKYNTNEANKK; | TLKLKYNTNEANKKI; |
| LKLKYNTNEANKKIC; | KLKYNTNEANKKICE; | LKYNTNEANKKICEF; |
| KYNTNEANKKICEFI; | YNTNEANKKICEFIQ; | NTNEANKKICEFIQN; |
| TNEANKKICEFIQNQ; | NEANKKICEFIQNQN; | EANKKICEFIQNQNK; |

Fig. 33 continued

ANKKICFFIQKQWKK; KKICFFIQKQWKKN; KICFFIQKQWKKNL;
KICFFIQKQWKKNLN; ICFFIQKQWKKNLNT; CFFIQKQWKKNLNTD;
FFIQKQWKKNLNTDV; FIQKQWKKNLNTDVE; IQKQWKKNLNTDVEL;
QKQWKKNLNTDVELE; KQWKKNLNTDVELEE; QWKKNLNTDVELEEE;
WKKNLNTDVELEEEW; KKNLNTDVELEEEWT; KNLNTDVELEEEWTY;
NLNTDVELEEEWTYL; LNTDVELEEEWTYLN; NTDVELEEEWTYLNT;
TDVELEEEWTYLNTK; DVELEEEWTYLNTKA; VELEEEWTYLNTKAK;
ELEEEWTYLNTKAKG; LEEEWTYLNTKAKGN; EEEWTYLNTKAKGNY;
EEWTYLNTKAKGNYE; EWTYLNTKAKGNYET; WTYLNTKAKGNYETA;
TYLNTKAKGNYETAR; YLNTKAKGNYETARA; LNTKAKGNYETARAG;
NTKAKGNYETARAGW; TKAKGNYETARAGWI; KAKGNYETARAGWIC;
AKGNYETARAGWICG; KGNYETARAGWICGD; GNYETARAGWICGDY;
NYETARAGWICGDYA; YETARAGWICGDYAD; ETARAGWICGDYADP;
TARAGWICGDYADPL; ARAGWICGDYADPLT; RAGWICGDYADPLTF;
AGWICGDYADPLTFL; GWICGDYADPLTFLS; WICGDYADPLTFLST;
ICGDYADPLTFLSTF; CGDYADPLTFLSTFT; GDYADPLTFLSTFTQ;
DYADPLTFLSTFTQG; YADPLTFLSTFTQGY; ADPLTFLSTFTQGYT;
DPLTFLSTFTQGYTQ; PLTFLSTFTQGYTQF; LTFLSTFTQGYTQFS;
TFLSTFTQGYTQFSS; FLSTFTQGYTQFSSH; LSTFTQGYTQFSSHN;
STFTQGYTQFSSHNY; TFTQGYTQFSSHNYS; FTQGYTQFSSHNYSN;
TQGYTQFSSHNYSNP; QGYTQFSSHNYSNPE; GYTQFSSHNYSNPEY;
YTQFSSHNYSNPEYK; TQFSSHNYSNPEYKE; QFSSHNYSNPEYKEL;
FSSHNYSNPEYKELL; SSHNYSNPEYKELLK; SHNYSNPEYKELLKK;
HNYSNPEYKELLKKS; NYSNPEYKELLKKSD; YSNPEYKELLKKSDL;
SNPEYKELLKKSDLE; NPEYKELLKKSDLEL; PEYKELLKKSDLELD;
EYKELLKKSDLELDP; YKELLKKSDLELDPI; KELLKKSDLELDPIK;
ELLKKSDLELDPIKR; LLKKSDLELDPIKRQ; LKKSDLELDPIKRQD;
KKSDLELDPIKRQDT; KSDLELDPIKRQDTL; SDLELDPIKRQDTLR;
DLELDPIKRQDTLRQ; LELDPIKRQDTLRQA; ELDPIKRQDTLRQAF;
LDPIKRQDTLRQAFE; DPIKRQDTLRQAFEI; PIKRQDTLRQAFEII;
IKRQDTLRQAFEIII; KRQDTLRQAFEIIIE; RQDTLRQAFEIIIEK;
QDTLRQAFEIIIEKD; DTLRQAFEIIIEKDF; TLRQAFEIIIEKDFP;
LRQAFEIIIEKDFPT; RQAFEIIIEKDFPTA; QAFEIIIEKDFPTAP;
AFEIIIEKDFPTAPT; FEIIIEKDFPTAPTY; EIIIEKDFPTAPTYT;
IIIEKDFPTAPTYTY; IIEKDFPTAPTYTYG; IEKDFPTAPTYTYGN;
EKDFPTAPTYTYGNS; KDFPTAPTYTYGNSY; DFPTAPTYTYGNSYL;
FPTAPTYTYGNSYLF; PTAPTYTYGNSYLFR; TAPTYTYGNSYLFRN;
APTYTYGNSYLFRND; PTYTYGNSYLFRNDK; TYTYGNSYLFRNDKW;
YTYGNSYLFRNDKWT; TYGNSYLFRNDKWTG; YGNSYLFRNDKWTGK;
GNSYLFRNDKWTGKN; NSYLFRNDKWTGKNT; SYLFRNDKWTGKNTI;
YLFRNDKWTGKNTIL; LFRNDKWTGKNTILE; FRNDKWTGKNTILER;
RNDKWTGKNTILERF; NDKWTGKNTILERFD; DKWTGKNTILERFDL;
KWTGKNTILERFDLS; WTGKNTILERFDLSQ; TGKNTILERFDLSQL;
GKNTILERFDLSQLK; KNTILERFDLSQLKL; NTILERFDLSQLKLK;
TILERFDLSQLKLKN; ILERFDLSQLKLKN;

16 mers:
MKLQRSLFLIFFLTF; KLQRSLFLIFFLTFL; LQRSLFLIFFLTFLC;
QRSLFLIFFLTFLCC; RSLFLIFFLTFLCCN; SLFLIFFLTFLCCNK;
LFLIFFLTFLCCNKF; FLIFFLTFLCCNKFK; LIFFLTFLCCNKFKR;

Fig. 33 continued

| | | |
|---|---|---|
| IFFLIFLCCNKERK; | IFFLTFLCCNKERKE; | FFLTFLCCNKERKEG; |
| FLTFLCCNKERKEGV; | LTFLCCNKERKEGVS; | TFLCCNKERKEGVSF; |
| FLCCNKERKEGVSFK; | LCCNKERKEGVSFKT; | CCNKERKEGVSFKTS; |
| CNKERKEGVSFKTSL; | NKERKEGVSFKTSLC; | KERKEGVSFKTSLCA; |
| KERKEGVSFKTSLCAE; | ERKEGVSFKTSLCAEP; | RKEGVSFKTSLCAEPS; |
| KEGVSFKTSLGAEPSS; | EGVSFKTSLGAEPSSL; | GVSFKTSLGAEPSSLD; |
| VSFKTSLGAEPSSLDP; | SFKTSLGAEPSSLDPQ; | FKTSLGAEPSSLDPQL; |
| KTSLGAEPSSLDPQLA; | TSLGAEPSSLDPQLAE; | SLGAEPSSLDPQLAED; |
| LGAEPSSLDPQLAEDK; | GAEPSSLDPQLAEDNV; | AEPSSLDPQLAEDNVA; |
| EPSSLDPQLAEDKVAS; | PSSLDPQLAEDKVASK; | SSLDPQLAEDNVASKM; |
| SLDPQLAEDKVASKMT; | LDPQLAEDNVASKMID; | DPQLAEDNVASKMIDT; |
| PQLAEDNVASKMIDTM; | QLAEDNVASKMIDTMF; | LAEDNVASKMIDTMFR; |
| AEDNVASKMIDTMFRG; | EDKVASKMIDTMFRGT; | DNVASKMIDTMFRGTV; |
| NVASKMIDTMFRGTVT; | VASKMIDTMFRGIVTG; | ASKMIDTMFRGIVTGD; |
| SKMIDTMFRGIVTGDP; | KMIDTMFRGIVTGDPN; | MIDTMFRGIVTGDPNT; |
| IDTMFRGIVTGDPNTG; | DTMFRGIVTGDPNTGG; | TMFRGIVTGDPNTGGN; |
| MFRGIVTGDPNTGGNK; | FRGIVTGDPNTGGNKP; | RGIVTGDPNTGGNKPG; |
| GIVTGDPNTGGNKPGL; | IVTGDPNTGGNKPGLA; | VTGDPNTGGNKPGLAK; |
| TGDPNTGGNKPGLAKG; | GDPNTGGNKPGLAKGW; | DPNTGGNKPGLAKGWD; |
| PNTGGNKPGLAKGWDI; | NTGGNKPGLAKGWDIS; | TGGNKPGLAKGWDISS; |
| GGNKPGLAKGWDISSD; | GNKPGLAKGWDISSDG; | NKPGLAKGWDISSDGT; |
| KPGLAKGWDISSDGTV; | PGLAKGWDISSDGTVY; | GLAKGWDISSDGTVYT; |
| LAKGWDISSDGTVYTF; | AKGWDISSDGTVYTFN; | KGWDISSDGTVYTFEL; |
| GWDISSDGTVYTFNLR; | WDISSDGTVYTFNLRE; | DISSDGTVYTFNLREK; |
| ISSDGTVYTFNLREKT; | SSDGTVYTFNLREKIT; | SDGTVYTFNLREKITP; |
| DGTVYTFNLREKITWS; | GTVYTFNLREKITWSD; | TVYTFNLREKITWSDG; |
| VYTFNLREKITWSDGV; | YTFNLREKITWSDGVA; | TFNLREKITWSDGVAI; |
| FNLREKITWSDGVATT; | NLREKITWSDGVATTA; | LREKITWSDGVATTAE; |
| REKITWSDGVATTAFG; | EKITWSDGVATTAEGT; | KITWSDGVATTAFGTR; |
| ITWSDGVATTAEGIRK; | TWSDGVATTAEGIRKS; | WSDGVATTAEGIRKSY; |
| SDGVATTAEGIRKSYL; | DGVATTAEGIRKSYLR; | GVATTAEGIRKSYLRI; |
| VATTAEGIRKSYLRTI; | ATTAEGTRKSYLRTIN; | TTAEGTRKSYLRTINK; |
| TAEGTRKSYLRTINKE; | AEGTRKSYLRTINKET; | EGTRKSYLRTINKETG; |
| GTRKSYLRTINKETGS; | TRKSYLRTINKETGSK; | RKSYLRTINKETGSKY; |
| KSYLRTINKETGSKYV; | SYLRTINKETGSKYVF; | YLRTINKETGSKYVFM; |
| LRTINKETGSKYVFMV; | RTINKETGSKYVFMVR; | TINKETGSKYVFMVRS; |
| INKETGSKYVFMVKSV; | NKETGSKYVFMVKSVT; | KETGSKYVFMVKSVTK; |
| ETGSKYVFMVKSVIKK; | TGSKYVFMVKSVIKKG; | GSKYVFMVKSVIKKGQ; |
| SKYVFMVKSVIKKGQK; | KYVFMVKSVIKKGQKY; | YVFMVKSVIKKGQKYF; |
| VFMVKSVIKKGQKYFD; | FMVKSVIKKGQKYFDG; | MVKSVIKKGQKYFDGQ; |
| VKSVIKKGQKYFDGQV; | KSVIKKGQKYFDGQVT; | SVIKKGQKYFDGQVTD; |
| VIKKGQKYFDGQVTDS; | IKKGQKYFDGQVTDSE; | KKGQKYFDGQVTDSEL; |
| NGQKYFDGQVTDSELG; | GQKYFDGQVTDSELGT; | QKYFDGQVTDSELGTR; |
| KYFDGQVTDSELGTRA; | YFDGQVTDSELGTRAI; | FDGQVTDSELGTRAID; |
| DGQVTDSELGTRAIDE; | GQVTDSELGTRAIDEK; | QVTDSELGTRAIDEKI; |
| VTDSELGTRAIDEKIL; | TDSELGTRAIDEKILE; | DSELGTRAIDEKILEI; |
| SELGTRAIDEKILETT; | ELGTRAIDEKILETTL; | LGTRAIDEKTLEITLE; |
| GTRAIDEKTLEITLES; | TRAIDEKTLEITLESP; | RAIDEKTLEITLESPK; |
| AIDEKTLEITLESPKF; | IDEKTLEITLESPKFY; | DEKTLEITLESPKFYF; |
| EKTLEITLESPKFYFI; | KTLEITLESPKFYFID; | TLEITLESPKFYFIDM; |
| LEITLESPKFYFIDMI; | EITLESPKFYFIDMIV; | ITLESPKFYFIDMIVH; |

|  | |
|---|---|
|  | PIKRQDILRQAEEIII; IKRQDILRQAEEIIIE; KRQDILRQAEEIIIEK; RQDILRQAEEIIIEKD; QDILRQAEEIIIEKDF; DILRQAEEIIIEKDFP; ILRQAEEIIIEKDFPI; LRQAEEIIIEKDFPIA; RQAEEIIIEKDFPIAP; QAEEIIIEKDFPIAPI; AEEIIIEKDFPIAPIY; EEIIIEKDFPIAPIYI; EIIIEKDFPIAPIYIY; IIIEKDFPIAPIYIYG; IIEKDFPIAPIYIYGN; IEKDFPIAPIYIYGNS; EKDFPIAPIYIYGNSY; KDFPIAPIYIYGNSYL; DFPIAPIYIYGNSYLF; FPIAPIYIYGNSYLFR; PIAPIYIYGNSYLFRN; IAPIYIYGNSYLFRND; APIYIYGNSYLFRNDK; PIYIYGNSYLFRNDKW; IYIYGNSYLFRNDKWT; YIYGNSYLFRNDKWTG; IYGNSYLFRNDKWTGW; YGNSYLFRNDKWTGWN; GNSYLFRNDKWTGWNT; NSYLFRNDKWTGWNTN; SYLFRNDKWTGWNTNI; YLFRNDKWTGWNTNIL; LFRNDKWTGWNTNILE; FRNDKWTGWNTNILER; RNDKWTGWNTNILERF; NDKWTGWNTNILERFD; DKWTGWNTNILERFDL; KWTGWNTNILERFDLS; WTGWNTNILERFDLSQ; TGWNTNILERFDLSQL; GWNTNILERFDLSQLK; WNTNILERFDLSQLKL; NTNILERFDLSQLKLK; TNILERFDLSQLKLKN; NILERFDLSQLKLKNK; |
| SEQ ID NO:25 SEQ ID NO: 98935-99908 | 13 mers: MTKIFSNLIINGL; TKIFSNLIINGLL; KIFSNLIINGLLF; IFSNLIINGLLFG; FSNLIINGLLFGF; SNLIINGLLFGFV; NLIINGLLFGFVS; LIINGLLFGFVSL; IINGLLFGFVSLN; INGLLFGFVSLNV; NGLLFGFVSLNVF; GLLFGFVSLNVFA; LLFGFVSLNVFAD; LFGFVSLNVFADS; FGFVSLNVFADSN; GFVSLNVFADSNN; FVSLNVFADSNNA; VSLNVFADSNNAN; SLNVFADSNNANI; LNVFADSNNANIL; NVFADSNNANILK; VFADSNNANILKP; FADSNNANILKPQ; ADSNNANILKPQS; DSNNANILKPQSN; SNNANILKPQSNV; NNANILKPQSNVL; NANILKPQSNVLE; ANILKPQSNVLEH; NILKPQSNVLEHS; ILKPQSNVLEHSD; LKPQSNVLEHSDQ; KPQSNVLEHSDQK; PQSNVLEHSDQKD; QSNVLEHSDQKDN; SNVLEHSDQKDNK; NVLEHSDQKDNKK; VLEHSDQKDNKKL; LEHSDQKDNKKLD; EHSDQKDNKKLDQ; HSDQKDNKKLDQK; SDQKDNKKLDQKD; DQKDNKKLDQKDQ; QKDNKKLDQKDQV; KDNKKLDQKDQVN; DNKKLDQKDQVNQ; NKKLDQKDQVNQA; KKLDQKDQVNQAL; KLDQKDQVNQALD; LDQKDQVNQALDT; DQKDQVNQALDTI; QKDQVNQALDTIN; KDQVNQALDTINK; DQVNQALDTINKV; QVNQALDTINKVT; VNQALDTINKVTE; NQALDTINKVTED; QALDTINKVTEDV; ALDTINKVTEDVS; LDTINKVTEDVSS; DTINKVTEDVSSK; TINKVTEDVSSKL; INKVTEDVSSKLE; NKVTEDVSSKLEG; KVTEDVSSKLEGV; VTEDVSSKLEGVR; TEDVSSKLEGVRE; EDVSSKLEGVRES; DVSSKLEGVRESS; VSSKLEGVRESSL; SSKLEGVRESSLE; SKLEGVRESSLEL; KLEGVRESSLELV; LEGVRESSLELVE; EGVRESSLELVES; GVRESSLELVESN; VRESSLELVESND; RESSLELVESNDA; ESSLELVESNDAG; SSLELVESNDAGV; SLELVESNDAGVV; LELVESNDAGVVK; ELVESNDAGVVKK; LVESNDAGVVKKF; VESNDAGVVKKFV; ESNDAGVVKKFVG; SNDAGVVKKFVGS; NDAGVVKKFVGSM; DAGVVKKFVGSMS; AGVVKKFVGSMSL; GVVKKFVGSMSLM; VVKKFVGSMSLMS; VKKFVGSMSLMSD; KKFVGSMSLMSDV; KFVGSMSLMSDVA; FVGSMSLMSDVAK; VGSMSLMSDVAKG; GSMSLMSDVAKGT; SMSLMSDVAKGTV; |

Fig. 33 continued

MSLMSDVAKGTVV; SLMSDVAKGTVVA; LMSDVAKGTVVAS;
MSDVAKGTVVASQ; SDVAKGTVVASQF; DVAKGTVVASQFA;
VAKGTVVASQFAT; AKGTVVASQFATT; KGTVVASQFATTV;
GTVVASQFATTVA; TVVASQFATTVAK; VVASQFATTVAKG;
VASQFATTVAKGS; ASQFATTVAKGSG; SQFATTVAKGSGM;
QFATTVAKGSGMV; FATTVAKGSGMVA; ATTVAKGSGMVAF;
TTVAKG

MTKIFSNLIFGLL; TKIFSNLIFGLLF; KIFSNLIFGLLFG;
IFSNLIFGLLFGF; FSNLIFGLLFGFV; SNLIFGLLFGFVS;
NLIFGLLFGFVSL; LIFGLLFGFVSLN; IFGLLFGFVSLNV;
FGLLFGFVSLNVF; GLLFGFVSLNVFA; LLFGFVSLNVFAD;
LFGFVSLNVFADS; FGFVSLNVFADSN; GFVSLNVFADSNN;
FVSLNVFADSNNA; VSLNVFADSNNAN; SLNVFADSNNANT;
LNVFADSNNANTL; NVFADSNNANTLK; VFADSNNANTLKP;
FADSNNANTLKPQ; ADSNNANTLKPQS; DSNNANTLKPQSN;
SNNANTLKPQSNV; NNANTLKPQSNVL; NANTLKPQSNVLE;
ANTLKPQSNVLEH; NTLKPQSNVLEHS; TLKPQSNVLEHSD;
LKPQSNVLEHSDQ; KPQSNVLEHSDQK; PQSNVLEHSDQKD;
QSNVLEHSDQKDK; SNVLEHSDQKDKK

MATFLEKQIMLKK; ATFLEKQIMLKKS; TFLEKQIMLKKSP;
FLEKQIMLKKSPN; LEKQIMLKKSPNK; EKQIMLKKSPNKE;
KQIMLKKSPNKEL; QIMLKKSPNKELE;
IMLKKSPNKELEL; MLKKSPNKELELT; LKKSPNKELELTK;
KKSPNKELELTKE; KSPNKELELTKEE; SPNKELELTKEEF;
PNKELELTKEEFA; NKELELTKEEFAK; KELELTKEEFAKV;
ELELTKEEFAKVD; LELTKEEFAKVDE; ELTKEEFAKVDEV;
LTKEEFAKVDEVK; TKEEFAKVDEVKE; KEEFAKVDEVKET;
EEFAKVDEVKETL; EFAKVDEVKETLM; FAKVDEVKETLMA;
AKVDEVKETLMAS; KVDEVKETLMASE;
VDEVKETLMASERA; DEVKETLMASERAL; EVKETLMASERALD;
VKETLMASERALDE; KETLMASERALDET; ETLMASERALDETV;
TLM

| | | |
|---|---|---|
| QVRQALDTIRKVTED; | VRQALDTIRKVTEDV; | RQALDTIRKVTEDVS; |
| QALDTIRKVTEDVSS; | ALDTIRKVTEDVSSR; | LDTIRKVTEDVSSRL; |
| DTIRKVTEDVSSRLE; | TIRKVTEDVSSRLEG; | IRKVTEDVSSRLEGV; |
| RKVTEDVSSRLEGVR; | KVTEDVSSRLEGVRE; | VTEDVSSRLEGVRES; |
| TEDVSSRLEGVRESS; | EDVSSRLEGVRESSL; | DVSSRLEGVRESSLE; |
| VSSRLEGVRESSLEL; | SSRLEGVRESSLELV; | SRLEGVRESSLELVE; |
| RLEGVRESSLELVES; | LEGVRESSLELVESR; | EGVRESSLELVESRD; |
| GVRESSLELVESRDA; | VRESSLELVESRDAG; | RESSLELVESRDAGV; |
| ESSLELVESRDAGVV; | SSLELVESRDAGVVK; | SLELVESRDAGVVKK; |
| LELVESRDAGVVKKF; | ELVESRDAGVVKKFV; | LVESRDAGVVKKFVG; |
| VESRDAGVVKKFVGS; | ESRDAGVVKKFVGSM; | SRDAGVVKKFVGSMS; |
| RDAGVVKKFVGSMSL; | DAGVVKKFVGSMSLM; | AGVVKKFVGSMSLMS; |
| GVVKKFVGSMSLMSD; | VVKKFVGSMSLMSDV; | VKKFVGSMSLMSDVA; |
| KKFVGSMSLMSDVAK; | KFVGSMSLMSDVAKG; | FVGSMSLMSDVAKGT; |
| VGSMSLMSDVAKGTV; | GSMSLMSDVAKGTVV; | SMSLMSDVAKGTVVA; |
| MSLMSDVAKGTVVAS; | SLMSDVAKGTVVASQ; | LMSDVAKGTVVASQE; |
| MSDVAKGTVVASQEA; | SDVAKGTVVASQEAT; | DVAKGTVVASQEATI; |
| VAKGTVVASQEATIV; | AKGTVVASQEATIVA; | KGTVVASQEATIVAK; |
| GTVVASQEATIVAKG; | TVVASQEATIVAKGS; | VVASQEATIVAKGSG; |
| VASQEATIVAKGSGM; | ASQEATIVAKGSGMV; | SQEATIVAKGSGMVA; |
| QEATIVAKGSGMVAE; | EATIVAKGSGMVAEG; | ATIVAKGSGMVAEGA; |
| TIVAKGSGMVAEGAN; | IVAKGSGMVAEGANK; | VAKGSGMVAEGANKV; |
| AKGSGMVAEGANKVV; | KGSGMVAEGANKVVE; | GSGMVAEGANKVVEM; |
| SGMVAEGANKVVEMS; | GMVAEGANKVVEMSK; | MVAEGANKVVEMSKK; |
| VAEGANKVVEMSKKA; | AEGANKVVEMSKKAV; | EGANKVVEMSKKAVQ; |
| GANKVVEMSKKAVQE; | ANKVVEMSKKAVQET; | NKVVEMSKKAVQETQ; |
| KVVEMSKKAVQETQK; | VVEMSKKAVQETQKA; | VEMSKKAVQETQKAV; |
| EMSKKAVQETQKAVS; | MSKKAVQETQKAVSV; | SKKAVQETQKAVSVA; |
| KKAVQETQKAVSVAG; | KAVQETQKAVSVAGE; | AVQETQKAVSVAGEA; |
| VQETQKAVSVAGEAT; | QETQKAVSVAGEATF; | ETQKAVSVAGEATFL; |
| TQKAVSVAGEATFLI; | QKAVSVAGEATFLIE; | KAVSVAGEATFLIEK; |
| AVSVAGEATFLIEKQ; | VSVAGEATFLIEKQT; | SVAGEATFLIEKQTM; |
| VAGEATFLIEKQTML; | AGEATFLIEKQTMLN; | GEATFLIEKQTMLNK; |
| EATFLIEKQTMLNKS; | ATFLIEKQTMLNKSP; | TFLIEKQTMLNKSPN; |
| FLIEKQTMLNKSPNK; | LIEKQTMLNKSPNKE; | IEKQTMLNKSPNKEL; |
| EKQTMLNKSPNKELE; | KQTMLNKSPNKELEL; | QTMLNKSPNKELELT; |
| TMLNKSPNKELELTK; | MLNKSPNKELELTKE; | LNKSPNKELELTKEE; |
| NKSPNKELELTKEEF; | KSPNKELELTKEEFA; | SPNKELELTKEEFAK; |
| PNKELELTKEEFAKV; | NKELELTKEEFAKVD; | KELELTKEEFAKVDE; |
| ELELTKEEFAKVDEV; | LELTKEEFAKVDEVK; | ELTKEEFAKVDEVKE; |
| LTKEEFAKVDEVKET; | TKEEFAKVDEVKETL; | KEEFAKVDEVKETLM; |
| EEFAKVDEVKETLMA; | EFAKVDEVKETLMAS; | FAKVDEVKETLMASE; |
| AKVDEVKETLMASER; | KVDEVKETLMASERA; | VDEVKETLMASERAL; |
| DEVKETLMASERALD; | EVKETLMASERALDE; | VKETLMASERALDET; |
| KETLMASERALDETV; | ETLMASERALDETVQ; | TLMASERALDETVQE; |
| LMASERALDETVQEA; | MASERALDETVQEAQ; | ASERALDETVQEAQK; |
| SERALDETVQEAQKV; | ERALDETVQEAQKVL; | RALDETVQEAQKVLN; |
| ALDETVQEAQKVLNK; | LDETVQEAQKVLNKV; | DETVQEAQKVLNKVN; |
| ETVQEAQKVLNKVNG; | TVQEAQKVLNKVNGL; | VQEAQKVLNKVNGLN; |
| QEAQKVLNKVNGLNS; | EAQKVLNKVNGLNSS; | AQKVLNKVNGLNSSK; |
| QKVLNKVNGLNSSKD; | KVLNKVNGLNSSKD; | |

Fig. 33 continued

VLKMVNGLNPSNKDQ; LKMVNGLNPSNKDQV; KMVNGLNPSNKDQVL;
MVNGLNPSNKDQVLA; VNGLNPSNKDQVLAK; NGLNPSNKDQVLAKK;
GLNPSNKDQVLAKKD; LNPSNKDQVLAKKDV; NPSNKDQVLAKKDVR;
PSNKDQVLAKKDVRK; SNKDQVLAKKDVRKA; NKDQVLAKKDVRKAI;
KDQVLAKKDVRKAIS; DQVLAKKDVRKAISN; QVLAKKDVRKAISNV;
VLAKKDVRKAISNVV; LAKKDVRKAISNVVK; AKKDVRKAISNVVKV;
KKDVRKAISNVVKVA; KDVRKAISNVVKVAQ; DVRKAISNVVKVAQG;
VRKAISNVVKVAQGA; RKAISNVVKVAQGAR; KAISNVVKVAQGARD;
AISNVVKVAQGARDL; ISNVVKVAQGARDLT; SNVVKVAQGARDLTK;
NVVKVAQGARDLTKV; VVKVAQGARDLTKVM; VKVAQGARDLTKVMA;
KVAQGARDLTKVMAT; VAQGARDLTKVMATS; AQGARDLTKVMATSL;
QGARDLTKVMATSLY; GARDLTKVMATSLYM; ARDLTKVMATSLYMR;

16 mers:
MIKLFSNLIKGLLFG; IKLFSNLIKGLLFGF; KLFSNLIKGLLFGFV;
LFSNLIKGLLFGFVS; FSNLIKGLLFGFVSL; SNLIKGLLFGFVSLN;
NLIKGLLFGFVSLNV; LIKGLLFGFVSLNVF; IKGLLFGFVSLNVFA;
KGLLFGFVSLNVFAD; GLLFGFVSLNVFADS; LLFGFVSLNVFADSN;
LFGFVSLNVFADSNK; FGFVSLNVFADSNKA; GFVSLNVFADSNKAK;
FVSLNVFADSNKAKL; VSLNVFADSNKAKLL; SLNVFADSNKAKLLK;
LNVFADSNKAKLLKP; NVFADSNKAKLLKPQ; VFADSNKAKLLKPQS;
FADSNKAKLLKPQSK; ADSNKAKLLKPQSKV; DSNKAKLLKPQSKVL;
SNKAKLLKPQSKVLE; NKAKLLKPQSKVLES; KAKLLKPQSKVLESD;
AKLLKPQSKVLESDQ; KLLKPQSKVLESDQK; LLKPQSKVLESDQKD;
LKPQSKVLESDQKDN; KPQSKVLESDQKDNK; PQSKVLESDQKDNKK;
QSKVLESDQKDNKKL; SKVLESDQKDNKKLD; KVLESDQKDNKKLDQ;
VLESDQKDNKKLDQK; LESDQKDNKKLDQKD; ESDQKDNKKLDQKDV;
SDQKDNKKLDQKDVN; DQKDNKKLDQKDVNQ; QKDNKKLDQKDVNQA;
KDNKKLDQKDVNQAL; DNKKLDQKDVNQALD; NKKLDQKDVNQALDT;
KKLDQKDVNQALDTI; KLDQKDVNQALDTIN; LDQKDVNQALDTINK;
DQKDVNQALDTINKV; QKDVNQALDTINKVT; KDVNQALDTINKVTE;
DVNQALDTINKVTED; VNQALDTINKVTEDV; NQALDTINKVTEDVS;
QALDTINKVTEDVSS; ALDTINKVTEDVSSK; LDTINKVTEDVSSKL;
DTINKVTEDVSSKLE; TINKVTEDVSSKLEG; INKVTEDVSSKLEGV;
NKVTEDVSSKLEGVR; KVTEDVSSKLEGVRE; VTEDVSSKLEGVRES;
TEDVSSKLEGVRESS; EDVSSKLEGVRESSL; DVSSKLEGVRESSLE;
VSSKLEGVRESSLEV; SSKLEGVRESSLEVE; SKLEGVRESSLEVES;
KLEGVRESSLEVESN; LEGVRESSLEVESND; EGVRESSLEVESNDA;
GVRESSLEVESNDAG; VRESSLEVESNDAGV; RESSLEVESNDAGVV;
ESSLEVESNDAGVVK; SSLEVESNDAGVVKK; SLEVESNDAGVVKKF;
LEVESNDAGVVKKFV; EVESNDAGVVKKFVG; VESNDAGVVKKFVGS;
ESNDAGVVKKFVGSM; SNDAGVVKKFVGSMS; NDAGVVKKFVGSMSL;
DAGVVKKFVGSMSLM; AGVVKKFVGSMSLMS; GVVKKFVGSMSLMSD;
VVKKFVGSMSLMSDV; VKKFVGSMSLMSDVA; KKFVGSMSLMSDVAK;
KFVGSMSLMSDVAKG; FVGSMSLMSDVAKGT; VGSMSLMSDVAKGTV;
GSMSLMSDVAKGTVV; SMSLMSDVAKGTVVA; MSLMSDVAKGTVVAS;
SLMSDVAKGTVVASQ; LMSDVAKGTVVASQE; MSDVAKGTVVASQEA;
SDVAKGTVVASQEAT; DVAKGTVVASQEATL; VAKGTVVASQEATLV;
AKGTVVASQEATLVA; KGTVVASQEATLVAK; GTVVASQEATLVAKC;
TVVASQEATLVAKCS; VVASQEATLVAKCSG; VASQEATLVAKCSGM;

Fig. 33 continued

| | |
|---|---|
| | VASQEATIVAKCSGMV; ASQEATIVAKCSGMVA; SQEATIVAKCSGMVAE; QEATIVAKCSGMVAEG; EATIVAKCSGMVAEGA; ATIVAKCSGMVAEGAN; TIVAKCSGMVAEGANK; IVAKCSGMVAEGANKV; VAKCSGMVAEGANKVV; AKCSGMVAEGANKVVE; KCSGMVAEGANKVVEM; CSGMVAEGANKVVEMS; SGMVAEGANKVVEMSK; GMVAEGANKVVEMSKK; MVAEGANKVVEMSKKA; VAEGANKVVEMSKKAV; AEGANKVVEMSKKAVQ; EGANKVVEMSKKAVQE; GANKVVEMSKKAVQET; ANKVVEMSKKAVQETQ; NKVVEMSKKAVQETQK; KVVEMSKKAVQETQKA; VVEMSKKAVQETQKAV; VEMSKKAVQETQKAVS; EMSKKAVQETQKAVSV; MSKKAVQETQKAVSVA; SKKAVQETQKAVSVAG; KKAVQETQKAVSVAGE; KAVQETQKAVSVAGEA; AVQETQKAVSVAGEAT; VQETQKAVSVAGEATF; QETQKAVSVAGEATFL; ETQKAVSVAGEATFLI; TQKAVSVAGEATFLIE; QKAVSVAGEATFLIEK; KAVSVAGEATFLIEKQ; AVSVAGEATFLIEKQI; VSVAGEATFLIEKQIM; SVAGEATFLIEKQIML; VAGEATFLIEKQIMLN; AGEATFLIEKQIMLNK; GEATFLIEKQIMLNKS; EATFLIEKQIMLNKSP; ATFLIEKQIMLNKSPN; TFLIEKQIMLNKSPNN; FLIEKQIMLNKSPNNK; LIEKQIMLNKSPNNKE; IEKQIMLNKSPNNKEL; EKQIMLNKSPNNKELE; KQIMLNKSPNNKELEL; QIMLNKSPNNKELELT; IMLNKSPNNKELELTK; MLNKSPNNKELELTKE; LNKSPNNKELELTKEE; NKSPNNKELELTKEEF; KSPNNKELELTKEEFA; SPNNKELELTKEEFAK; PNNKELELTKEEFAKV; NNKELELTKEEFAKVD; NKELELTKEEFAKVDE; KELELTKEEFAKVDEV; ELELTKEEFAKVDEVK; LELTKEEFAKVDEVKE; ELTKEEFAKVDEVKET; LTKEEFAKVDEVKETL; TKEEFAKVDEVKETLM; KEEFAKVDEVKETLMA; EEFAKVDEVKETLMAS; EFAKVDEVKETLMASE; FAKVDEVKETLMASER; AKVDEVKETLMASERA; KVDEVKETLMASERAL; VDEVKETLMASERALD; DEVKETLMASERALDE; EVKETLMASERALDET; VKETLMASERALDETV; KETLMASERALDETVQ; ETLMASERALDETVQE; TLMASERALDETVQEA; LMASERALDETVQEAQ; MASERALDETVQEAQK; ASERALDETVQEAQKV; SERALDETVQEAQKVL; ERALDETVQEAQKVLN; RALDETVQEAQKVLNM; ALDETVQEAQKVLNMV; LDETVQEAQKVLNMVN; DETVQEAQKVLNMVNG; ETVQEAQKVLNMVNGL; TVQEAQKVLNMVNGLN; VQEAQKVLNMVNGLNP; QEAQKVLNMVNGLNPS; EAQKVLNMVNGLNPSN; AQKVLNMVNGLNPSNK; QKVLNMVNGLNPSNKD; KVLNMVNGLNPSNKDQ; VLNMVNGLNPSNKDQV; LNMVNGLNPSNKDQVL; NMVNGLNPSNKDQVLA; MVNGLNPSNKDQVLAK; VNGLNPSNKDQVLAKK; NGLNPSNKDQVLAKKD; GLNPSNKDQVLAKKDV; LNPSNKDQVLAKKDVR; NPSNKDQVLAKKDVRK; PSNKDQVLAKKDVRKA; SNKDQVLAKKDVRKAI; NKDQVLAKKDVRKAIS; KDQVLAKKDVRKAISN; DQVLAKKDVRKAISNV; QVLAKKDVRKAISNVV; VLAKKDVRKAISNVVK; LAKKDVRKAISNVVKV; AKKDVRKAISNVVKVA; KKDVRKAISNVVKVAQ; KDVRKAISNVVKVAQG; DVRKAISNVVKVAQGA; VRKAISNVVKVAQGAR; RKAISNVVKVAQGARD; KAISNVVKVAQGARDL; AISNVVKVAQGARDLT; ISNVVKVAQGARDLTK; SNVVKVAQGARDLTKV; NVVKVAQGARDLTKVM; VVKVAQGARDLTKVMA; VKVAQGARDLTKVMAI; KVAQGARDLTKVMAIS; VAQGARDLTKVMAISL; AQGARDLTKVMAISLY; QGARDLTKVMAISLYM; GARDLTKVMAISLYMR; |
| SEQ ID NO:26 SEQ ID NO: 99909-102686 | 13 mers: MKKMLLIFSFFLI; KKMLLIFSFFLIF; KMLLIFSFFLIFL; MLLIFSFFLIFLN; LLIFSFFLIFLNG; LIFSFFLIFLNGF; IFSFFLIFLNGFP; FSFFLIFLNGFPL; SFFLIFLNGFPLN; FFLIFLNGFPLNA; FLIFLNGFPLNAR; LIFLNGFPLNARK; |

Fig. 33 continued

| | IFLNGFPLNARKV; | FLNGFPLNARKVD; | LNGFPLNARKVDK; |
|---|---|---|---|
| | NGFPLNARKVDKE; | GFPLNARKVDKEK; | FPLNARKVDKEKL; |
| | PLNARKVDKEKLK; | LNARKVDKEKLKD; | NARKVDKEKLKDF; |
| | ARKVDKEKLKDFV; | RKVDKEKLKDFVN; | KVDKEKLKDFVNK; |
| | VDKEKLKDFVNKD; | DKEKLKDFVNKDL; | KEKLKDFVNKDLE; |
| | EKLKDFVNKDLEF; | KLKDFVNKDLEFV; | LKDFVNKDLEFVN; |
| | KDFVNKDLEFVNY; | DFVNKDLEFVNYK; | FVNKDLEFVNYKG; |
| | VNKDLEFVNYKGP; | NKDLEFVNYKGPY; | KDLEFVNYKGPYD; |
| | DLEFVNYKGPYDS; | LEFVNYKGPYDST; | EFVNYKGPYDSTK; |
| | FVNYKGPYDSTKT; | VNYKGPYDSTKTY; | NYKGPYDSTKTYF; |
| | YKGPYDSTKTYFQ; | KGPYDSTKTYFQT; | GPYDSTKTYFQTV; |
| | PYDSTKTYFQTVG; | YDSTKTYFQTVGT; | DSTKTYFQTVGTG; |
| | STKTYFQTVGTGE; | TKTYFQTVGTGEF; | KTYFQTVGTGEFL; |
| | TYFQTVGTGEFLA; | YFQTVGTGEFLAR; | FQTVGTGEFLARP; |
| | QTVGTGEFLARPL; | TVGTGEFLARPLT; | VGTGEFLARPLTK; |
| | GTGEFLARPLTKS; | TGEFLARPLTKSN; | GEFLARPLTKSNS; |
| | EFLARPLTKSNSF; | FLARPLTKSNSNS; | LARPLTKSNSNSS; |
| | ARPLTKSNSNSSY; | RPLTKSNSNSSYY; | PLTKSNSNSSYYG; |
| | LTKSNSNSSYYGK; | TKSNSNSSYYGKY; | KSNSNSSYYGKYF; |
| | SNSNSSYYGKYFI; | NSNSSYYGKYFIN; | SNSSYYGKYFINR; |
| | NSSYYGKYFINRF; | SSYYGKYFINRFI; | SYYGKYFINRFID; |
| | YYGKYFINRFIDD; | YGKYFINRFIDDQ; | GKYFINRFIDDQD; |
| | KYFINRFIDDQDK; | YFINRFIDDQDKK; | FINRFIDDQDKKA; |
| | INRFIDDQDKKAS; | NRFIDDQDKKASV; | RFIDDQDKKASVD; |
| | FIDDQDKKASVDV; | IDDQDKKASVDVF; | DDQDKKASVDVFS; |
| | DQDKKASVDVFSI; | QDKKASVDVFSIS; | DKKASVDVFSISS; |
| | KKASVDVFSISSK; | KASVDVFSISSKS; | ASVDVFSISSKSF; |
| | SVDVFSISSKSFL; | VDVFSISSKSFLD; | DVFSISSKSFLDS; |
| | VFSISSKSFLDST; | FSISSKSFLDSTI; | SISSKSFLDSTIN; |
| | ISSKSFLDSTINL; | SSKSFLDSTINLR; | SKSFLDSTINLRR; |
| | KSFLDSTINLRRI; | SFLDSTINLRRIL; | FLDSTINLRRILT; |
| | LDSTINLRRILTG; | DSTINLRRILTGY; | STINLRRILTGYI; |
| | TINLRRILTGYIT; | INLRRILTGYITK; | NLRRILTGYITKS; |
| | LRRILTGYITKSF; | RRILTGYITKSFD; | RILTGYITKSFDY; |
| | ILTGYITKSFDYD; | LTGYITKSFDYDR; | TGYITKSFDYDRS; |
| | GYITKSFDYDRSS; | YITKSFDYDRSSA; | ITKSFDYDRSSAE; |
| | TKSFDYDRSSAEL; | KSFDYDRSSAELT; | SFDYDRSSAELTA; |
| | FDYDRSSAELTAK; | DYDRSSAELTAKV; | YDRSSAELTAKVL; |
| | DRSSAELTAKVLT; | RSSAELTAKVLTT; | SSAELTAKVLTTY; |
| | SAELTAKVLTTYK; | AELTAKVLTTYNA; | ELTAKVLTTYNAV; |
| | LTAKVLTTYNAVY; | TAKVLTTYNAVYR; | AKVLTTYNAVYRG; |
| | KVLTTYNAVYRGD; | VLTTYNAVYRGDL; | LTTYNAVYRGDLD; |
| | TTYNAVYRGDLDY; | TYNAVYRGDLDYY; | YNAVYRGDLDYYK; |
| | NAVYRGDLDYYKG; | AVYRGDLDYYKGF; | VYRGDLDYYKGFY; |
| | YRGDLDYYKGFYI; | RGDLDYYKGFYIE; | GDLDYYKGFYIEP; |
| | DLDYYKGFYIEPA; | LDYYKGFYIEPAL; | DYYKGFYIEPALK; |
| | YYKGFYIEPALKS; | YKGFYIEPALKSL; | KGFYIEPALKSLT; |
| | GFYIEPALKSLTK; | FYIEPALKSLTKE; | YIEPALKSLTKEN; |
| | IEPALKSLTKENA; | EPALKSLTKENAG; | PALKSLTKENAGL; |
| | ALKSLTKENAGLS; | LKSLTKENAGLSR; | KSLTKENAGLSRV; |
| | SLTKENAGLSRVY; | LTKENAGLSRVYS; | TKENAGLSRVYSQ; |

Fig. 33 continued

KEKAGLSRVYSQW; ENAGLSRVYSQWA; NAGLSRVYSQWAG;
AGLSRVYSQWAGK; GLSRVYSQWAGKT; LSRVYSQWAGKTQ;
SRVYSQWAGKTQI; RVYSQWAGKTQIF; VYSQWAGKTQIFI;
YSQWAGKTQIFIP; SQWAGKTQIFIPL; QWAGKTQIFIPLK;
WAGKTQIFIPLKK; AGKTQIFIPLKKD; GKTQIFIPLKKDI;
KTQIFIPLKKDIL; TQIFIPLKKDILS; QIFIPLKKDILSG;
IFIPLKKDILSGN; FIPLKKDILSGNT; IPLKKDILSGNTF;
PLKKDILSGNIFS; LKKDILSGNIFSD; KKDILSGNIFSDI;
KDILSGNIFSDID; DILSGNIFSDIDT; ILSGNIFSDIDTD;
LSGNIFSDIDTDS; SGNIFSDIDTDSL; GNIFSDIDTDSLV;
NIFSDIDTDSLVT; IFSDIDTDSLVTD; FSDIDTDSLVTDK;
SDIDTDSLVTDKV; DIDTDSL

| | | |
|---|---|---|
| QRDTVREKIQEDI; | RDTVREKIQEDIN; | DTVREKIQEDINE; |
| TVREKIQEDINEI; | VREKIQFDINEIN; | REKIQFDTNEINK; |
| EKIQFDTNETNKE; | KIQFDTNETNKEK; | IQFDTNETNKEKI; |
| QEDINETKEKNL; | EDINEINKEKNLP; | DINEINKEKNLPK; |
| INEICKEKNLPKP; | NEIKKEKNLPKPG; | EIKKEKNLPKPGD; |
| TKEKNLPKPGDV; | KEKNLPKPGDVS; | EKNLPKPGDVSS; |
| KNLPKPGDVSSP; | KNLPKPGDVSSPK; | NLPKPGDVSSPKV; |
| LPKPGDVSSPKVD; | PKPGDVSSPKVDK; | KPGDVSSPKVDKQ; |
| PGDVSSPKVDKQL; | GDVSSPKVDKQLQ; | DVSSPKVDKQLQT; |
| VSSPKVDKQLQTK; | SSPKVDKQLQTKE; | SPKVDKQLQTKES; |
| PKVDKQLQTKESL; | KVDKQLQTKESLE; | VDKQLQTKESLED; |
| DKQLQIKESLEDL; | KQLQIKESLEDLQ; | QLQIKESLEDLQE; |
| LQTKESLEDLQEQ; | QTKESLEDIQEQL; | TKESLEDLQEQLK; |
| KESLEDLQEQLKE; | ESLEDLQEQLKEA; | SLEDLQEQLKEAG; |
| LEDLQEQLKEAGD; | EDLQEQLKEAGDE; | DLQEQLKEAGDEK; |
| LQEQLKEAGDENQ; | QEQLKEAGDENQK; | EQLKEAGDENQKR; |
| QLKEAGDENQKRE; | LKEAGDENQKRET; | KEAGDENQKRETE; |
| EAGDENQKRETEK; | AGDENQKRETEKQ; | GDENQKRETEKQI; |
| DENQKRETEKQIE; | ENQKRETEKQIEI; | NQKRETEKQIEIK; |
| QKRETEKQIEIKK; | KRETEKQIEIKKR; | RETEKQIEIKKRD; |
| ETEKQIEIKKRDE; | TEKQIEIKKRDEE; | EKQIEIKKRDEEL; |
| KQIEIKKRDEELL; | QIEIKKRDEELLK; | IEIKKRDEELLKS; |
| EIKKRDEELLKSK; | IKKRDEELLKSKD; | KKRDEELLKSKDG; |
| KRDEELLKSKDGK; | RDEELLKSKDGKV; | DEELLKSKDGKVS; |
| EELLKSKDGKVSK; | ELLKSKDGKVSKD; | LLKSKDGKVSKDY; |
| LKSKDGKVSKDYE; | KSKDGKVSKDYEA; | SKDGKVSKDYEAL; |
| KDGKVSKDYEALD; | DGKVSKDYEALDL; | GKVSKDYEALDLD; |
| KVSKDYEALDLDR; | VSKDYEALDLDRE; | SKDYEALDLDREL; |
| KDYEALDLDRELS; | DYEALDLDRELSK; | YEALDLDRELSKA; |
| EALDLDRELSKAS; | ALDLDRELSKASS; | LDLDRELSKASSK; |
| DLDRELSKASSKE; | LDRELSKASSKEK; | DRELSKASSKEKS; |
| RELSKASSKEKSK; | ELSKASSKEKSKV; | LSKASSKEKSKVK; |
| SKASSKEKSKVKE; | KASSKEKSKVKEE; | ASSKEKSKVKEEL; |
| SSKEKSKVKEELI; | SKEKSKVKEELIT; | KEKSKVKEELITK; |
| EKSKVKEELITKG; | KSKVKEELITKGK; | SKVKEELITKGKS; |
| KVKEELITKGKSR; | VKEELITKGKSRA; | KEELITKGKSRAS; |
| EELITKGKSRASL; | ELITKGKSRASLG; | LITKGKSRASLGD; |
| ITKGKSRASLGDL; | TKGKSRASLGDLN; | KGKSRASLGDLNK; |
| GKSRASLGDLNKD; | KSRASLGDLNKDK; | SRASLGDLNKDKN; |
| RASLGDLNKDKEL; | ASLGDLNKDKELM; | SLGDLNKDKELMP; |
| LGDLNKDKELMLP; | GDLNKDKELMLPE; | DLNKDKELMLPED; |
| LNKDKELMLPEDQ; | NKDKELMLPEDQK; | DKNELMLPEDQKL; |
| DKELMLPEDQKLP; | KELMLPEDQKLPE; | NLMLPEDQKLPED; |
| LMLPEDQKLPEDK; | MLPEDQKLPEDKK; | LPEDQKLPEDKKL; |
| PEDQKLPEDKKLD; | EDQKLPEDKKLDS; | DQKLPEDKKLDSK; |
| QKLPEDKKLDSKL; | KLPEDKKLDSKLD; | LPEDKKLDSKLDG; |
| PEDKKLDSKLDGK; | EDKKLDSKLDGKK; | DKKLDSKLDGKKE; |
| KKLDSKLDGKKEF; | KLDSKLDGKKEFK; | LDSKLDGKKEFKP; |
| DSKLDGKKEFKPV; | SKLDGKKEFKPVS; | KLDGKKEFKPVSE; |
| LDGKKEFKPVSEV; | DGKKEFKPVSEVE; | GKKEFKPVSEVEK; |
| KKEFKPVSEVEKL; | KEFKPVSEVEKLD; | EFKPVSEVEKLDK; |

Fig. 33 continued

PKPVSEVEKLDKI; KPVSEVEKLDKIS; PVSEVEKLDKISK;
VSEVEKLDKISKS; SEVEKLDKISKSN; EVEKLDKISKSNK;
VEKLDKISKSNKE; EKLDKISKSNKEV; KLDKISKSNKEVG;
LDKISKSNKEVGK; DKISKSNKEVGKL; KISKSNKEVGKLS;
ISKSNKEVGKLSP; SKSNKEVGKLSPL; KSNKEVGKLSPLD;
SNKEVGKLSPLDK; NKEVGKLSPLDKP; KEVGKLSPLDKPS;
EVGKLSPLDKPSY; VGKLSPLDKPSYD;
GKLSPLDKPSYDD; KLSPLDKPSYDDI; LSPLDKPSYDDID;
SPLDKPSYDDIDS; PLDKPSYDDIDSK; LDKPSYDDIDSKE;
DKPSYDDIDSKEE; KPSYDDIDSKEEV; PSYDDIDSKEEVD;
SYDDIDSKEEVDK; YDDIDSKEEVDKK; DDIDSKEEVDKKA;
DIDSKEEVDKKAI; IDSKEEVDKKAID; DSKEEVDKKAIKL;
SKEEVDKKAIKLQ; KEEVDKKAIKLQK; EEVDKKAIKLQKI;
EVDKKAIKLQKID; VDKKAIKLQKIDP; DKKAIKLQKIDPK;
KKAIKLQKIDPKV; KAIKLQKIDPKVK; AIKLQKIDPKVKD;
IKLQKIDPKVKDQ; KLQKIDPKVKDQT; LQKIDPKVKDQTT;
QKIDPKVKDQTTS; KIDPKVKDQTTSL; IDPKVKDQTTSLK;
DPKVKDQTTSLKE; PKVKDQTTSLKED; KVKDQTTSLKEDL;
VKDQTTSLKEDLD; KDQTTSLKEDLDK; DQTTSLKEDLDKD;
QTTSLKEDLDKDL; TTSLKEDLDKDLT; TSLKEDLDKDLTT;
SLKEDLDKDLTTM; LKEDLDKDLTTMS; KEDLDKDLTTMST;
EDLDKDLTTMSID; DLDKDLTTMSIDS; LDKDLTTMSIDSS;
DKDLTTMSIDSSS; KDLTTMSIDSSSP; DLTTMSIDSSSPV;
LTTMSIDSSSPVF; TTMSIDSSSPVFL; TMSIDSSSPVFLE;
MSIDSSSPVFLEV; SIDSSSPVFLEVI; IDSSSPVFLEVID;
DSSSPVFLEVIDP; SSSPVFLEVIDPI; SSPVFLEVIDPIT;
SPVFLEVIDPITN; PVFLEVIDPITNL; VFLEVIDPITNLG;
FLEVIDPITNLGT; LEVIDPITNLGTL; EVIDPITNLGTLQ;
VIDPITNLGTLQI; IDPITNLGTLQID; DPITNLGTLQIDL;
PITNLGTLQIDL; ITNLGTLQIDLN; TNLGTLQIDLNT;
NLGTLQIDLNTG; LGTLQIDLNTGV; GTLQIDLNTGVR;
TLQIDLNTGVRL; LQIDLNTGVRLK; QIDLNTGVRLKE;
IDLNTGVRLKES; DLNTGVRLKEST; LNTGVRLKESTQ;
NTGVRLKESTQQ; TGVRLKESTQQG; GVRLKESTQQGT;
VRLKESTQQGTQ; RLKESTQQGTQR; LKESTQQGTQRY;
KESTQQGTQRYG; ESTQQGTQRYGI; STQQGTQRYGIY;
TQQGTQRYGIYE; QQGTQRYGIYER; QGTQRYGIYERE;
GTQRYGIYEREK; TQRYGIYEREKD; QRYGIYEREKDL;
RYGIYEREKDLV; YGIYEREKDLVV; GIYEREKDLVVT;
IYEREKDLVVTK; YEREKDLVVTKM; EREKDLVVTKMD;
REKDLVVTKMDS; EKDLVVTKMDSG; KDLVVTKMDSGK;
DLVVTKMDSGKA; LVVTKMDSGKAK; VVTKMDSGKAKL;
VTKMDSGKAKLQ; TKMDSGKAKLQT; KMDSGKAKLQTI;
MDSGKAKLQTIN; DSGKAKLQTINK; SGKAKLQTINKL;
GKAKLQTINKLE; KAKLQTINKLEN; AKLQTINKLENL;
KLQTINKLENLK; LQTINKLENLKV; QTINKLENLKVV;
TINKLENLKVVS; INKLENLKVVSE; NKLENLKVVSES;
KLENLKVVSESN; LENLKVVSESNF; ENLKVVSESNFE;
NLKVVSESNFEL; LKVVSESNFELK; KVVSESNFELKK;
VVSESNFELKKS; VSESNFELKKSE; SESNFELKKSEI;
ESNFELKKSEIY; SNFELKKSEIYV;

Fig. 33 continued

DFEIKKSSLYVD; FEIKKSSLYVDS; EIKKSSLYVDSK;
IKKSSLYVDSKM; KKSSLYVDSKMT; KSSLYVDSKMTL;
SSLYVDSKMTLA; SSLYVDSKMTLAA; SLYVDSKMTLAAV;
LYVDSKMTLAAVR; YVDSKMTLAAVRD; VDSKMTLAAVRDK;
DSKMTLAAVRDKD; SKMTLAAVRDKDD; KMTLAAVRDKDDS;
MTLAAVRDKDDSN; TLAAVRDKDDSNA; LAAVRDKDDSNAW;
AAVRDKDDSNAWR; AVRDKDDSNAWRL; VRDKDDSNA

YYGKYFIKRFIDDQ; YGKYFIKRFIDDQD; GKYFIKRFIDDQDK;
KYFIKRFIDDQDKK; YFIKRFIDDQDKKA; FIKRFIDDQDKKAS;
IKRFIDDQDKKASV; KRFIDDQDKKASVD; RFIDDQDKKASVDV;
FIDDQDKKASVDVF; IDDQDKKASVDVFS; DDQDKKASVDVFST;
DQDKKASVDVFSTS; QDKKASVDVFSTSS; DKKASVDVFSTSSK;
KKASVDVFSTSSKS; KASVDVFSTSSKSF; ASVDVFSTSSKSFL;
SVDVFSTSSKSFLD; VDVFSTSSKSFLDS; DVFSTSSKSFLDST;
VFSTSSKSFLDSTI; FSTSSKSFLDSTIN; STSSKSFLDSTINL;
TSSKSFLDSTINLR; SSKSFLDSTINLRR; SKSFLDSTINLR

ITDIQGETHKADQD; TDIQGETHKADQDK; DIQGETHKADQDKT;
IQGETHKADQDKTD; QGETHKADQDKTDT; GETHKADQDKTDTF;
ETHKADQDKTDTFL; THKADQDKTDTFLD; HKADQDKTDTFLDN;
KADQDKTDTFLDNI; ADQDKTDTFLDNIH; DQDKTDTFLDNIHE;
QDKTDTFLDNIHES; DKTDTFLDNIHESD; KTDTFLDNIHESDS;
TDTFLDNIHESDSN; DTFLDNIHESDSNT; TFLDNIHESDSNTT;
FLDNIHESDSNTTE; LDNIHESDSNTTET; DNIHESDSNTTETI;
NIHESDSNTTETLE; IHESDSNTTETLEK; HESDSNTTETLEKL;
ESDSNTTETLEKLR; SDSNTTETLEKLRD; DSNTTETLEKLRDQ;
SNTTETLEKLRDQL; NTTETLEKLRDQLE; TTETLEKLRDQLEK;
TETLEKLRDQLEKA; ETLEKLRDQLEKAT; TLEKLRDQLEKATD;
LEKLRDQLEKATDE; EKLRDQLEKATDEE; KLRDQLEKATDEEH;
LRDQLEKATDEEHK; RDQLEKATDEEHKK; DQLEKATDEEHKKE;
QLEKATDEEHKKET; LEKATDEEHKKETE; EKATDEEHKKETES;
KATDEEHKKETESQ; ATDEEHKKETESQV; TDEEHKKETESQVD;
DEEHKKETESQVDA; EEHKKETESQVDAK; EHKKETESQVDAKK;
HKKETESQVDAKKK; KKETESQVDAKKKE; KETESQVDAKKKEK;
ETESQVDAKKKEKE; TESQVDAKKKEKEE; ESQVDAKKKEKEEL;
SQVDAKKKEKEELD; QVDAKKKEKEELDK; VDAKKKEKEELDKK;
DAKKKEKEELDKKA; AKKKEKEELDKKAI; KKKEKEELDKKAIN;
KKEKEELDKKAINL; KEKEELDKKAINLD; EKEELDKKAINLDK;
KEELDKKAINLDKA; EELDKKAINLDKAQ; ELDKKAINLDKAQQ;
LDKKAINLDKAQQK; DKKAINLDKAQQKL; KKAINLDKAQQKLD;
KAINLDKAQQKLDS; AINLDKAQQKLDSA; INLDKAQQKLDSAE;
NLDKAQQKLDSAED; LDKAQQKLDSAEDN; DKAQQKLDSAEDNL;
KAQQKLDSAEDNLD; AQQKLDSAEDNLDV; QQKLDSAEDNLDVQ;
QKLDSAEDNLDVQR; KLDSAEDNLDVQRD; LDSAEDNLDVQRDT;
DSAEDNLDVQRDTV; SAEDNLDVQRDTVR; AEDNLDVQRDTVRE;
EDNLDVQRDTVREK; DNLDVQRDTVREKT; NLDVQRDTVREKIQ;
LDVQRDTVREKIQE; DVQRDTVREKIQED; VQRDTVREKIQEDI;
QRDTVREKIQEDIN; RDTVREKIQEDINE; DTVREKIQEDINET;
TVREKIQEDINETN; VREKIQEDINETNK; REKIQEDINETNKE;
EKIQEDINETNKEK; KIQEDINETNKEKL; IQEDINETNKEKLP;
QEDINETNKEKLPK; EDINETNKEKLPKP; DINETNKEKLPKPG;
INETNKEKLPKPGD; NETNKEKLPKPGDV; ETNKEKLPKPGDVS;
TNKEKLPKPGDVSS; NKEKLPKPGDVSSP; KEKLPKPGDVSSPK;
EKLPKPGDVSSPKV; KLPKPGDVSSPKVD; LPKPGDVSSPKVDK;
PKPGDVSSPKVDKQ; KPGDVSSPKVDKQL; PGDVSSPKVDKQLQ;
GDVSSPKVDKQLQT; DVSSPKVDKQLQTK; VSSPKVDKQLQTKE;
SSPKVDKQLQTKES; SPKVDKQLQTKESL; PKVDKQLQTKESLE;
KVDKQLQTKESLED; VDKQLQTKESLEDL; DKQLQTKESLEDLQ;
KQLQTKESLEDLQE; QLQTKESLEDLQEQ; LQTKESLEDLQEQL;
QTKESLEDLQEQLK; TKESLEDLQEQLKE; KESLEDLQEQLKEA;
ESLEDLQEQLKEAG; SLEDLQEQLKEAGD; LEDLQEQLKEAGDE;
EDLQEQLKEAGDEN; DLQEQLKEAGDENQ; LQEQLKEAGDENQK;
QEQLKEAGDENQKR; EQLKEAGDENQKRE; QLKEAGDENQKRET;
LKEAGDENQKRETE; KEAGDENQKRETEK; EAGDENQKRETEKQ;
AGDENQKRETEKQI; GDENQKRETEKQIE; DENQKRETEKQIEI;
ENQKRETEKQIEIK; NQKRETEKQIEIKK; QKRETEKQIEIKKR;
KRETEKQIEIKKRD; RETEKQIEIKKRDE; ETEKQIEIKKRDEF;
TEKQIEIKKRDEFL; EKQIEIKKRDEFLL;

Fig. 33 continued

KQIEIKKRDEELLK; QIEIKKRDEELLKS; IEIKKRDEELLKSK;
EIKKRDEELLKSKD; IKKRDEELLKSKDG; KKRDEELLKSKDGK;
KRDEELLKSKDGKV; RDEELLKSKDGKVS; DEELLKSKDGKVSK;
EELLKSKDGKVSKD; ELLKSKDGKVSKDY; LLKSKDGKVSKDYE;
LKSKDGKVSKDYEA; KSKDGKVSKDYEAL; SKDGKVSKDYEALD;
KDGKVSKDYEALDL; DGKVSKDYEALDLD; GKVSKDYEALDLDR;
KVSKDYEALDLDRE; VSKDYEALDLDREL; SKDYEALDLDRELS;
KDYEALDLDRELSK; DYEALDLDRELSKA; YEALDLDRELSKAS;
EALDLDRELSKASS; ALDLDRELSKASSK; LD

Fig. 33 continued

YLQDELKKLVLEDV; LQDELKKLVLDVK; QDELKNLVLEDVKT;
DELKLVTLDVNTL; ELKNLVTLDVNTLK; LKNLVTLDVNTLKK;
KNLVTLDVNTLKKV; NLVTLDVNTLKKVK;

15 mers:
MKKMLTFSFFLTFL; KKMLTFSFFLTFLK; KMLTFSFFLTFLKG;
MLTFSFFLTFLKGF; LTFSFFLTFLKGFP; TFSFFLTFLKGFPL;
FSFFLTFLKGFPLN; SFFLTFLKGFPLNA; FFLTFLKGFPLNAR;
FLTFLKGFPLNARK; LTFLKGFPLNARKV; TFLKGFPLNARKVD;
FLKGFPLNARKVDK; LKGFPLNARKVDKE; KGFPLNARKVDKEK;
GFPLNARKVDKEKL; FPLNARKVDKEKLK; PLNARKVDKEKLKD;
LNARKVDKEKLKDF; NARKVDKEKLKDFV; ARKVDKEKLKDFVN;
RKVDKEKLKDFVNM; KVDKEKLKDFVNMD; VDKEKLKDFVNMDL;
DKEKLKDFVNMDLE; KEKLKDFVNMDLEF; EKLKDFVNMDLEFV;
KLKDFVNMDLEFVN; LKDFVNMDLEFVNY; KDFVNMDLEFVNYK;
DFVNMDLEFVNYKG; FVNMDLEFVNYKGP; VNMDLEFVNYKGPY;
NMDLEFVNYKGPYD; MDLEFVNYKGPYDS; DLEFVNYKGPYDST;
LEFVNYKGPYDSTN; EFVNYKGPYDSTNT; FVNYKGPYDSTNTY;
VNYKGPYDSTNTYE; NYKGPYDSTNTYEQ; YKGPYDSTNTYEQL;
KGPYDSTNTYEQLV; GPYDSTNTYEQLVG; PYDSTNTYEQLVGL;
YDSTNTYEQLVGLG; DSTNTYEQLVGLGF; STNTYEQLVGLGFL;
TNTYEQLVGLGFLA; NTYEQLVGLGFLAR; TYEQLVGLGFLARP;
YEQLVGLGFLARPL; EQLVGLGFLARPLT; QLVGLGFLARPLTN;
LVGLGFLARPLTNS; VGLGFLARPLTNSN; GLGFLARPLTNSNS;
LGFLARPLTNSNSK; GFLARPLTNSNSKS; FLARPLTNSNSKSS;
LARPLTNSNSKSSY; ARPLTNSNSKSSYY; RPLTNSNSKSSYYG;
PLTNSNSKSSYYGK; LTNSNSKSSYYGKY; TNSNSKSSYYGKYF;
NSNSKSSYYGKYFT; SNSKSSYYGKYFTN; NSKSSYYGKYFTNR;
SKSSYYGKYFTNRF; KSSYYGKYFTNRFI; SSYYGKYFTNRFID;
SYYGKYFTNRFIDD; YYGKYFTNRFIDDQ; YGKYFTNRFIDDQK;
GKYFTNRFIDDQKK; KYFTNRFIDDQKKA; YFTNRFIDDQKKAS;
FTNRFIDDQKKASV; TNRFIDDQKKASVD; NRFIDDQKKASVDV;
RFIDDQKKASVDVF; FIDDQKKASVDVFS; IDDQKKASVDVFST;
DDQKKASVDVFSTS; DQKKASVDVFSTSS; QKKASVDVFSTSSK;
KKASVDVFSTSSKS; KASVDVFSTSSKSF; ASVDVFSTSSKSFL;
SVDVFSTSSKSFLD; VDVFSTSSKSFLDS; DVFSTSSKSFLDST;
VFSTSSKSFLDSTN; FSTSSKSFLDSTNL; STSSKSFLDSTNLR;
TSSKSFLDSTNLRR; SSKSFLDSTNLRRT; SKSFLDSTNLRRTL;
KSFLDSTNLRRTLT; SFLDSTNLRRTLTG; FLDSTNLRRTLTGY;
LDSTNLRRTLTGYL; DSTNLRRTLTGYLL; STNLRRTLTGYLLK;
TNLRRTLTGYLLKS; NLRRTLTGYLLKSF; LRRTLTGYLLKSFD;
RRTLTGYLLKSFDY; RTLTGYLLKSFDYD; TLTGYLLKSFDYDR;
LTGYLLKSFDYDRS; TGYLLKSFDYDRSS; GYLLKSFDYDRSSA;
YLLKSFDYDRSSAE; LLKSFDYDRSSAEL; LKSFDYDRSSAELL;
KSFDYDRSSAELLA; SFDYDRSSAELLAK; FDYDRSSAELLAKV;
DYDRSSAELLAKVT; YDRSSAELLAKVTT; DRSSAELLAKVTTY;
RSSAELLAKVTTYK; SSAELLAKVTTYKA; SAELLAKVTTYKAV;
AELLAKVTTYKAVY; ELLAKVTTYKAVYR; LLAKVTTYKAVYRG;
LAKVTTYKAVYRGD; AKVTTYKAVYRGDL; KVTTYKAVYRGDLD;
VTTYKAVYRGDLDY; TTYKAVYRGDLDYY;

Fig. 33 continued

| | | |
|---|---|---|
| TLYNAVYRGDLYYK; | LYNAVYRGDLYYKG; | YNAVYRGDLYYKGF; |
| NAVYRGDLYYKGFY; | AVYRGDLYYKGFYT; | VYRGDLYYKGFYTE; |
| YRGDLYYKGFYTEP; | RGDLYYKGFYTEPA; | GDLYYKGFYTEPAL; |
| DLYYKGFYTEPALK; | LYYKGFYTEPALKS; | YYKGFYTEPALKSL; |
| YKGFYTEPALKSLT; | KGFYTEPALKSLTK; | GFYTEPALKSLTKE; |
| FYTEPALKSLTKEN; | YTEPALKSLTKENA; | TEPALKSLTKENAG; |
| EPALKSLTKENAGL; | PALKSLTKENAGLS; | ALKSLTKENAGLSR; |
| LKSLTKENAGLSRV; | KSLTKENAGLSRVY; | SLTKENAGLSRVYS; |
| LTKENAGLSRVYSQ; | TKENAGLSRVYSQW; | KENAGLSRVYSQWA; |
| ENAGLSRVYSQWAG; | NAGLSRVYSQWAGK; | AGLSRVYSQWAGKT; |
| GLSRVYSQWAGKTQ; | LSRVYSQWAGKTQT; | SRVYSQWAGKTQTF; |
| RVYSQWAGKTQTFT; | VYSQWAGKTQTFTP; | YSQWAGKTQTFTPL; |
| SQWAGKTQTFTPLK; | QWAGKTQTFTPLKK; | WAGKTQTFTPLKKD; |
| AGKTQTFTPLKKDI; | GKTQTFTPLKKDIL; | KTQTFTPLKKDILS; |
| TQTFTPLKKDILSG; | QTFTPLKKDILSGK; | TFTPLKKDILSGKI; |
| FTPLKKDILSGKIE; | TPLKKDILSGKIES; | PLKKDILSGKIESD; |
| LKKDILSGKIESDI; | KKDILSGKIESDID; | KDILSGKIESDIDT; |
| DILSGKIESDIDTD; | ILSGKIESDIDTDS; | LSGKIESDIDTDSL; |
| SGKIESDIDLDSLV; | GKIESDIDLDSLVT; | KIESDIDLDSLVTD; |
| IESDIDLDSLVTDK; | ESDIDLDSLVTDKV; | SDIDLDSLVTDKVI; |
| DIDLDSLVTDKVIA; | IDLDSLVTDKVIAA; | DLDSLVTDKVIAAL; |
| LDSLVTDKVIAALL; | DSLVTDKVIAALLS; | SLVTDKVIAALLSE; |
| LVTDKVIAALLSEN; | VTDKVIAALLSENE; | TDKVIAALLSENEA; |
| DKVIAALLSENEAG; | KVIAALLSENEAGV; | VIAALLSENEAGVN; |
| IAALLSENEAGVNF; | AALLSENEAGVNFA; | ALLSENEAGVNFAR; |
| LLSENEAGVNFARD; | LSENEAGVNFARDI; | SENEAGVNFARDIT; |
| ENEAGVNFARDITD; | NEAGVNFARDITDL; | EAGVNFARDITDLQ; |
| AGVNFARDITDLQG; | GVNFARDITDLQGE; | VNFARDITDLQGET; |
| NFARDITDLQGETH; | FARDITDLQGETHK; | ARDITDLQGETHKA; |
| RDITDLQGETHKAD; | DITDLQGETHKADQ; | ITDLQGETHKADQD; |
| TDLQGETHKADQDK; | DLQGETHKADQDKI; | LQGETHKADQDKID; |
| QGETHKADQDKIDT; | GETHKADQDKIDTF; | ETHKADQDKIDTFL; |
| THKADQDKIDTFLD; | HKADQDKIDTFLDN; | KADQDKIDTFLDNT; |
| ADQDKIDTFLDNTH; | DQDKIDTFLDNTHE; | QDKIDTFLDNTHES; |
| DKIDTFLDNTHESD; | KIDTFLDNTHESDS; | IDTFLDNTHESDSN; |
| DTFLDNTHESDSNI; | TFLDNTHESDSNIT; | FLDNTHESDSNITE; |
| LDNTHESDSNITET; | DNTHESDSNITETI; | NTHESDSNITETIE; |
| THESDSNITETIEN; | HESDSNITETIENL; | ESDSNITETIENLR; |
| SDSNITETIENLRD; | DSNITETIENLRDQ; | SNITETIENLRDQL; |
| NITETIENLRDQLE; | ITETIENLRDQLEK; | TETIENLRDQLEKA; |
| ETIENLRDQLEKAT; | TIENLRDQLEKATD; | IENLRDQLEKATDE; |
| ENLRDQLEKATDEF; | NLRDQLEKATDEFK; | LRDQLEKATDEFKK; |
| RDQLEKATDEFKKE; | DQLEKATDEFKKEI; | QLEKATDEFKKEIF; |
| LEKATDEFKKEIFS; | EKATDEFKKEIFSQ; | KATDEFKKEIFSQV; |
| ATDEFKKEIFSQVD; | TDEFKKEIFSQVDA; | DEFKKEIFSQVDAK; |
| EFKKEIFSQVDAKK; | FKKEIFSQVDAKKK; | KKEIFSQVDAKKKE; |
| KEIFSQVDAKKKFK; | EIFSQVDAKKKEKE; | IFSQVDAKKKEKEE; |
| FSQVDAKKKEKEEL; | SQVDAKKKEKEELD; | QVDAKKKEKEELDK; |
| VDAKKKEKEELDKA; | DAKKKEKEELDKAI; | AKKKEKEELDKAIK; |
| KKKEKEELDKAIKL; | KKEKEELDKAIKLD; | KEKEELDKAIKLDK; |

| | | |
|---|---|---|
| DKKLPEDQKLPED; | KLMLPEDQKLPEDK; | KLKLPEDQKLPEDKK; |
| LMLPEDQKLPEDKK; | MLPEDQKLPEDKKL; | LPEDQKLPEDKKLDS; |
| PEDQKLPEDKKLDSK; | EDQKLPEDKKLDSKL; | DQKLPEDKKLDSKLD; |
| QKLPEDKKLDSKLDG; | KLPEDKKLDSKLDGK; | LPEDKKLDSKLDGKK; |
| PEDKKLDSKLDGKKE; | EDKKLDSKLDGKKEF; | DKKLDSKLDGKKEFK; |
| KKLDSKLDGKKEFKP; | KLDSKLDGKKEFKPV; | LDSKLDGKKEFKPVS; |
| DSKLDGKKEFKPVSF; | SKLDGKKEFKPVSFV; | KLDGKKEFKPVSFVE; |
| LDGKKEFKPVSFVEK; | DGKKEFKPVSFVEKL; | GKKEFKPVSFVEKLD; |
| KKEFKPVSFVEKLDK; | KEFKPVSFVEKLDKT; | EFKPVSFVEKLDKTS; |
| FKPVSFVEKLDKTSK; | KPVSFVEKLDKTSKS; | PVSFVEKLDKTSKSN; |
| VSFVEKLDKTSKSN; | SFVEKLDKTSKSNK; | FVEKLDKTSKSNNKE; |
| VEKLDKTSKSNNKEV; | EKLDKTSKSNNKEVG; | KLDKTSKSNNKEVGK; |
| LDKTSKSNNKEVGKL; | DKTSKSNNKEVGKLS; | KTSKSNNKEVGKLSP; |
| TSKSNNKEVGKLSPL; | SKSNNKEVGKLSPLD; | KSNNKEVGKLSPLDK; |
| SNNKEVGKLSPLDKP; | NNKEVGKLSPLDKPS; | NKEVGKLSPLDKPSY; |
| KEVGKLSPLDKPSYD; | EVGKLSPLDKPSYDD; | VGKLSPLDKPSYDDT; |
| GKLSPLDKPSYDDTD; | KLSPLDKPSYDDTDS; | LSPLDKPSYDDTDSK; |
| SPLDKPSYDDTDSKE; | PLDKPSYDDTDSKEE; | LDKPSYDDTDSKEEV; |
| DKPSYDDTDSKEEVD; | KPSYDDTDSKEEVDK; | PSYDDTDSKEEVDKK; |
| SYDDTDSKEEVDKKA; | YDDTDSKEEVDKKAT; | DDTDSKEEVDKKATN; |
| DTDSKEEVDKKATNL; | TDSKEEVDKKATNLQ; | DSKEEVDKKATNLQK; |
| SKEEVDKKATNLQKI; | KEEVDKKATNLQKID; | EEVDKKATNLQKIDP; |
| EVDKKATNLQKIDPK; | VDKKATNLQKIDPKV; | DKKATNLQKIDPKVK; |
| NKATNLQKIDPKVKD; | KATNLQKIDPKVKDQ; | ATNLQKIDPKVKDQT; |
| TNLQKIDPKVKDQTT; | NLQKIDPKVKDQTTS; | LQKIDPKVKDQTTSL; |
| QKIDPKVKDQTTSLN; | KIDPKVKDQTTSLNE; | IDPKVKDQTTSLNED; |
| DPKVKDQTTSLNEDL; | PKVKDQTTSLNEDLD; | KVKDQTTSLNEDLDK; |
| VKDQTTSLNEDLDKD; | KDQTTSLNEDLDKDL; | DQTTSLNEDLDKDLT; |
| QTTSLNEDLDKDLTT; | TTSLNEDLDKDLTTM; | TSLNEDLDKDLTTMS; |
| SLNEDLDKDLTTMSI; | LNEDLDKDLTTMSID; | NEDLDKDLTTMSIDS; |
| EDLDKDLTTMSIDSS; | DLDKDLTTMSIDSSS; | LDKDLTTMSIDSSSP; |
| DKDLTTMSIDSSSPV; | KDLTTMSIDSSSPVF; | DLTTMSIDSSSPVFL; |
| LTTMSIDSSSPVFLE; | TTMSIDSSSPVFLEV; | TMSIDSSSPVFLEVT; |
| MSIDSSSPVFLEVTD; | SIDSSSPVFLEVIDP; | IDSSSPVFLEVIDPT; |
| DSSSPVFLEVTDPTT; | SSSPVFLEVTDPTTK; | SSPVFLEVTDPTTKG; |
| SPVFLEVTDPTTKLG; | PVFLEVTDPTTKLGT; | VFLEVTDPTTKLGTL; |
| FLEVTDPTTKLGTLQ; | LEVTDPTTKLGTLQL; | EVTDPTTKLGTLQLI; |
| VTDPTTKLGTLQLID; | TDPTTKLGTLQLIDL; | DPTTKLGTLQLIDLN; |
| PTTKLGTLQLIDLNT; | TTKLGTLQLIDLNTG; | TKLGTLQLIDLNTGV; |
| NLGTLQLIDLNTGVR; | LGTLQLIDLNTGVRL; | GTLQLIDLNTGVRLK; |
| TLQLIDLNTGVRLKE; | LQLIDLNTGVRLKES; | QLIDLNTGVRLKEST; |
| LIDLNTGVRLKESTQ; | IDLNTGVRLKESTQQ; | DLNTGVRLKESTQQG; |
| LNTGVRLKESTQQGT; | NTGVRLKESTQQGTQ; | TGVRLKESTQQGTQR; |
| GVRLKESTQQGTQRY; | VRLKESTQQGTQRYG; | RLKESTQQGTQRYGT; |
| LKESTQQGTQRYGTY; | KESTQQGTQRYGTYE; | ESTQQGTQRYGTYER; |
| STQQGTQRYGTYERE; | TQQGTQRYGTYEREK; | QQGTQRYGTYEREKD; |
| QGTQRYGTYEREKDL; | GTQRYGTYEREKDLV; | TQRYGTYEREKDLVV; |
| QRYGTYEREKDLVVI; | RYGTYEREKDLVVIK; | YGTYEREKDLVVIKM; |
| GTYEREKDLVVIKMD; | TYEREKDLVVIKMDS; | YEREKDLVVIKMDSG; |
| EREKDLVVIKMDSGK; | REKDLVVIKMDSGKA; | EKDLVVIKMDSGKAK; |
| KDLVVIKMDSGKAKL; | DLVVIKMDSGKAKLQ; | LVVIKMDSGKAKLQT; |

| | | |
|---|---|---|
| STNTYEQLVGLGEFLA; | TNTYEQLVGLGEFLAR; | NTYEQLVGLGEFLARP; |
| TYEQLVGLGEFLARPL; | YEQLVGLGEFLARPLT; | EQLVGLGEFLARPLTN; |
| QLVGLGEFLARPLTNS; | LVGLGEFLARPLTNSN; | VGLGEFLARPLTNSNS; |
| GLGEFLARPLTNSNSK; | LGEFLARPLTNSNSNS; | GEFLARPLTNSNSNSS; |
| EFLARPLTNSNSNSSY; | FLARPLTNSNSNSSYY; | LARPLTNSNSNSSYYG; |
| ARPLTNSNSSYYGK; | RPLTNSNSSYYGKY; | PLTNSNSSYYGKYF; |
| LTNSNSSYYGKYFT; | TNSNSSYYGKYFTN; | NSNSSYYGKYFTNR; |
| SNSJSSYYGKYFLRF; | NSNSSYYGKYFLRFL; | SNSSYYGKYFTNRFTD; |
| NSSYYGKYFTNRFTDD; | SSYYGKYFTNRFTDDQ; | SYYGKYFTNRFTDDQD; |
| YYGKYFTNRFTDDQDK; | YGKYFTNRFTDDQDKK; | GKYFTNRFTDDQDKKA; |
| KYFTNRFTDDQDKKAS; | YFTNRFTDDQDKKASV; | FTNRFTDDQDKKASVD; |
| TNRFTDDQDKKASVDV; | NRFTDDQDKKASVDVF; | RFTDDQDKKASVDVFS; |
| FTDDQDKKASVDVFST; | TDDQDKKASVDVFSTS; | DDQDKKASVDVFSTSS; |
| DQDKKASVDVFSTSSK; | QDKKASVDVFSTSSKS; | DKKASVDVFSTSSKSE; |
| KKASVDVFSTSSKSEL; | KASVDVFSTSSKSELD; | ASVDVFSTSSKSELDS; |
| SVDVFSTSSKSELDSL; | VDVFSTSSKSELDSIL; | DVFSTSSKSELDSILN; |
| VFSTSSKSELDSILNL; | FSTSSKSELDSILNLR; | STSSKSELDSILNLRR; |
| TSSKSELDSILNLRRT; | SSKSELDSILNLRRTL; | SKSELDSILNLRRTLT; |
| KSELDSILNLRRTLTG; | SELDSILNLRRTLTGY; | ELDSILNLRRTLTGYL; |
| LDSILNLRRTLTGYLL; | DSILNLRRTLTGYLLK; | SILNLRRTLTGYLLKS; |
| ILNLRRTLTGYLLKSF; | LNLRRTLTGYLLKSFD; | NLRRTLTGYLLKSFDY; |
| LRRTLTGYLLKSFDYD; | RRTLTGYLLKSFDYDR; | RTLTGYLLKSFDYDRS; |
| TLTGYLLKSFDYDRSS; | LTGYLLKSFDYDRSSA; | TGYLLKSFDYDRSSAE; |
| GYLLKSFDYDRSSAEL; | YLLKSFDYDRSSAELL; | LLKSFDYDRSSAELLA; |
| LKSFDYDRSSAELLAK; | KSFDYDRSSAELLAKV; | SFDYDRSSAELLAKVT; |
| FDYDRSSAELLAKVTL; | DYDRSSAELLAKVTLI; | YDRSSAELLAKVTLIY; |
| DRSSAELLAKVTLIYK; | RSSAELLAKVTLIYKA; | SSAELLAKVTLIYKAV; |
| SAELLAKVTLIYKAVY; | AELLAKVTLIYKAVYR; | ELLAKVTLIYKAVYRG; |
| LLAKVTLIYKAVYRGD; | LAKVTLIYKAVYRGDL; | AKVTLIYKAVYRGDLD; |
| KVTLIYKAVYRGDLDY; | VTLIYKAVYRGDLDYY; | TLIYKAVYRGDLDYYK; |
| LIYKAVYRGDLDYYKG; | IYKAVYRGDLDYYKGF; | YKAVYRGDLDYYKGFY; |
| KAVYRGDLDYYKGFYT; | AVYRGDLDYYKGFYTE; | VYRGDLDYYKGFYTEP; |
| YRGDLDYYKGFYTEPA; | RGDLDYYKGFYTEPAL; | GDLDYYKGFYTEPALK; |
| DLDYYKGFYTEPALKS; | LDYYKGFYTEPALKSL; | DYYKGFYTEPALKSLT; |
| YYKGFYTEPALKSLTK; | YKGFYTEPALKSLTKE; | KGFYTEPALKSLTKEN; |
| GFYTEPALKSLTKENA; | FYTEPALKSLTKENAG; | YTEPALKSLTKENAGL; |
| TEPALKSLTKENAGLS; | EPALKSLTKENAGLSR; | PALKSLTKENAGLSRV; |
| ALKSLTKENAGLSRVY; | LKSLTKENAGLSRVYS; | KSLTKENAGLSRVYSQ; |
| SLTKENAGLSRVYSQW; | LTKENAGLSRVYSQWA; | TKENAGLSRVYSQWAG; |
| KENAGLSRVYSQWAGK; | ENAGLSRVYSQWAGKT; | NAGLSRVYSQWAGKTQ; |
| AGLSRVYSQWAGKTQL; | GLSRVYSQWAGKTQLF; | LSRVYSQWAGKTQLFL; |
| SRVYSQWAGKTQLFLP; | RVYSQWAGKTQLFLPL; | VYSQWAGKTQLFLPLK; |
| YSQWAGKTQLFLPLKK; | SQWAGKTQLFLPLKKD; | QWAGKTQLFLPLKKDT; |
| WAGKTQLFLPLKKDTL; | AGKTQLFLPLKKDTLS; | GKTQLFLPLKKDTLSG; |
| KTQLFLPLKKDTLSGN; | TQLFLPLKKDTLSGNT; | QLFLPLKKDTLSGNTE; |
| LFLPLKKDTLSGNTES; | FLPLKKDTLSGNTESD; | LPLKKDTLSGNTESDT; |
| PLKKDTLSGNTESDTD; | LKKDTLSGNTESDTDT; | KKDTLSGNTESDTDTD; |
| KDTLSGNTESDTDTDS; | DTLSGNTESDTDTDSL; | TLSGNTESDTDTDSLV; |
| LSGNTESDTDTDSLVT; | SGNTESDTDTDSLVTD; | GNTESDTDTDSLVTDK; |
| NTESDTDTDSLVTDKV; | TESDTDTDSLVTDKVL; | ESDTDTDSLVTDKVLA; |
| SDTDTDSLVTDKVLAA; | DTDTDSLVTDKVLAAL; | TDTDSLVTDKVLAALI; |

Fig. 33 continued

DIDSLVTDKVIAALLS; IDSLVTDKVIAALLSE; DSLVTDKVIAALLSEK;
SLVTDKVIAALLSEKE; LVTDKVIAALLSEKEA; VTDKVIAALLSEKEAG;
TDKVIAALLSEKEAGV; DKVIAALLSEKEAGVN; KVIAALLSEKEAGVNF;
VIAALLSEKEAGVNFA; IAALLSEKEAGVNFAR; AALLSEKEAGVNFARD;
ALLSEKEAGVNFARDI; LLSEKEAGVNFARDIT; LSEKEAGVNFARDITD;
SEKEAGVNFARDITDT; EKEAGVNFARDITDTQ; KEAGVNFARDITDTQG;
EAGVNFARDITDTQGE; AGVNFARDITDTQGET; GVNFARDITDTQGETH;
VNFARDITDTQGETHK; NFARDITDTQGETHKA; FARDITDTQGETHKAD;
ARDITDTQGETHKADQ; RDITDTQGETHKADQD; DITDTQGETHKADQDK;
ITDTQGETHKADQDKT; TDTQGETHKADQDKTD; DTQGETHKADQDKTDT;
TQGETHKADQDKTDTE; QGETHKADQDKTDTEL; GETHKADQDKTDTELD;
ETHKADQDKTDTELDK; THKADQDKTDTELDKH; HKADQDKTDTELDKIH;
KADQDKTDTELDKTHE; ADQDKTDTELDKTHES; DQDKTDTELDNHESD;
QDKTDTELDNHESDS; DKTDTELDNHESDSN; KTDTELDNHESDSNT;
TDTELDNHESDSNTT; DTELDNHESDSNTTE; TELDNHESDSNTTET;
ELDNHESDSNTTETL; LDNHESDSNTTETLE; DNHESDSNTTETLEN;
NHESDSNTTETLENL; HESDSNTTETLENLR; ESDSNTTETLENLRD;
SDSNTTETLENLRDQ; DSNTTETLENLRDQL; SNTTETLENLRDQLE;
NTTETLENLRDQLEK; TTETLENLRDQLEKA; TETLENLRDQLEKAT;
ETLENLRDQLEKATD; TLENLRDQLEKATDE; LENLRDQLEKATDEH;
ENLRDQLEKATDEHK; NLRDQLEKATDEHKK; LRDQLEKATDEHKKE;
RDQLEKATDEHKKEL; DQLEKATDEHKKELE; QLEKATDEHKKELES;
LEKATDEHKKELESQ; EKATDEHKKELESQV; KATDEHKKELESQVD;
ATDEHKKELESQVDA; TDEHKKELESQVDAK; DEHKKELESQVDAKK;
EHKKELESQVDAKKK; HKKELESQVDAKKKE; KKELESQVDAKKKEK;
KELESQVDAKKKEKE; ELESQVDAKKKEKEL; LESQVDAKKKEKELD;
ESQVDAKKKEKELDK; SQVDAKKKEKELDKK; QVDAKKKEKELDKKA;
VDAKKKEKELDKKAT; DAKKKEKELDKKATN; AKKKEKELDKKATNL;
KKKEKELDKKATNLD; KKEKELDKKATNLDK; KEKELDKKATNLDKA;
EKELDKKATNLDKAQ; KELDKKATNLDKAQQ; ELDKKATNLDKAQQK;
LDKKATNLDKAQQKL; DKKATNLDKAQQKLD; KKATNLDKAQQKLDS;
KATNLDKAQQKLDSA; ATNLDKAQQKLDSAE; TNLDKAQQKLDSAED;
NLDKAQQKLDSAEDN; LDKAQQKLDSAEDNL; DKAQQKLDSAEDNLD;
KAQQKLDSAEDNLDV; AQQKLDSAEDNLDVQ; QQKLDSAEDNLDVQR;
QKLDSAEDNLDVQRD; KLDSAEDNLDVQRDT; LDSAEDNLDVQRDTV;
DSAEDNLDVQRDTVR; SAEDNLDVQRDTVRE; AEDNLDVQRDTVREK;
EDNLDVQRDTVREKT; DNLDVQRDTVREKTQ; NLDVQRDTVREKTQE;
LDVQRDTVREKTQED; DVQRDTVREKTQEDT; VQRDTVREKTQEDTN;
QRDTVREKTQEDTNE; RDTVREKTQEDTNET; DTVREKTQEDTNETN;
TVREKTQEDTNETNK; VREKTQEDTNETNKE; REKTQEDTNETNKER;
EKTQEDTNETNKERN; KTQEDTNETNKERNL; TQEDTNETNKERNLP;
QEDTNETNKERNLPK; EDTNETNKERNLPKP; DTNETNKERNLPKPG;
TNETNKERNLPKPGD; NETNKERNLPKPGDV; ETNKERNLPKPGDVS;
TNKERNLPKPGDVSS; NKERNLPKPGDVSSP; KERNLPKPGDVSSPK;
ERNLPKPGDVSSPKV; RNLPKPGDVSSPKVD; NLPKPGDVSSPKVDK;
LPKPGDVSSPKVDKQ; PKPGDVSSPKVDKQL; KPGDVSSPKVDKQLQ;
PGDVSSPKVDKQLQT; GDVSSPKVDKQLQIK; DVSSPKVDKQLQIKE;
VSSPKVDKQLQIKES; SSPKVDKQLQIKESL; SPKVDKQLQIKESLE;
PKVDKQLQIKESLED; KVDKQLQIKESLEDL; VDKQLQIKESLEDLQ;
DKQLQIKESLEDLQE; KQLQIKESLEDLQEL; QLQIKESLEDLQELK;

Fig. 33 continued

LQIKESLEDLQEQLKEI; QIKESLEDLQEQLKEA; IKESLEDLQEQLKEAG;
KESLEDLQEQLKEAGD; ESLEDLQEQLKEAGDF; SLEDLQEQLKEAGDFN;
LEDLQEQLKEAGDFNQ; EDLQEQLKEAGDFNQK; DLQEQLKEAGDFNQKR;
LQEQLKEAGDFNQKRE; QEQLKEAGDFNQKREI; EQLKEAGDFNQKREIE;
QLKEAGDFNQKREIEK; LKEAGDFNQKREIEKQ; KEAGDFNQKREIEKQI;
EAGDFNQKREIEKQIE; AGDFNQKREIEKQIET; GDFNQKREIEKQIETK;
DFNQKREIEKQIETKK; FNQKREIEKQIETKKR; NQKREIEKQIETKKRD;
QKREIEKQIETKKRDE; KREIEKQIETKKRDEE; REIEKQIETKKRDEEL;
EIEKQIETKKRDEELL; IEKQIETKKRDEELLR; EKQIETKKRDEELLRS;
KQIETKKRDEELLRSK; QIETKKRDEELLRSKD; IETKKRDEELLRSKDG;
ETKKRDEELLRSKDGK; TKKRDEELLRSKDGKV; KKRDEELLRSKDGKVS;
KRDEELLRSKDGKVSK; RDEELLRSKDGKVSKD; DEELLRSKDGKVSKDY;
EELLRSKDGKVSKDYE; ELLRSKDGKVSKDYEA; LLRSKDGKVSKDYEAL;
LRSKDGKVSKDYEALD; RSKDGKVSKDYEALDL; SKDGKVSKDYEALDLD;
KDGKVSKDYEALDLDR; DGKVSKDYEALDLDRE; GKVSKDYEALDLDREL;
KVSKDYEALDLDRELS; VSKDYEALDLDRELSK; SKDYEALDLDRELSKA;
KDYEALDLDRELSKAS; DYEALDLDRELSKASS; YEALDLDRELSKASSK;
EALDLDRELSKASSKE; ALDLDRELSKASSKEK; LDLDRELSKASSKEKS;
DLDRELSKASSKEKSK; LDRELSKASSKEKSKV; DRELSKASSKEKSKVK;
RELSKASSKEKSKVKE; ELSKASSKEKSKVKEE; LSKASSKEKSKVKEEI;
SKASSKEKSKVKEEIT; KASSKEKSKVKEEITT; ASSKEKSKVKEEITTK;
SSKEKSKVKEEITKG; SKEKSKVKEEITKGK; KEKSKVKEEITKGKS;
EKSKVKEEITKGKSR; KSKVKEEITKGKSRA; SKVKEEITKGKSRAS;
KVKEEITKGKSRASL; VKEEITKGKSRASLG; KEEITKGKSRASLGD;
EEITKGKSRASLGDL; EITKGKSRASLGDLN; ITKGKSRASLGDLNK;
TKGKSRASLGDLNKD; KGKSRASLGDLNKDK; GKSRASLGDLNKDKN;
KSRASLGDLNKDKNL; SRASLGDLNKDKNLM; RASLGDLNKDKNLML;
ASLGDLNKDKNLMLP; SLGDLNKDKNLMLPE; LGDLNKDKNLMLPED;
GDLNKDKNLMLPEDQ; DLNKDKNLMLPEDQK; LNKDKNLMLPEDQKL;
NKDKNLMLPEDQKLP; KDKNLMLPEDQKLPE; DKNLMLPEDQKLPED;
KNLMLPEDQKLPEDK; NLMLPEDQKLPEDKK; LMLPEDQKLPEDKKL;
MLPEDQKLPEDKKLD; LPEDQKLPEDKKLDS; PEDQKLPEDKKLDSK;
EDQKLPEDKKLDSKL; DQKLPEDKKLDSKLD; QKLPEDKKLDSKLDG;
KLPEDKKLDSKLDGK; LPEDKKLDSKLDGKK; PEDKKLDSKLDGKKE;
EDKKLDSKLDGKKEF; DKKLDSKLDGKKEFK; KKLDSKLDGKKEFKP;
KLDSKLDGKKEFKPV; LDSKLDGKKEFKPVS; DSKLDGKKEFKPVSE;
SKLDGKKEFKPVSEV; KLDGKKEFKPVSEVK; LDGKKEFKPVSEVKL;
DGKKEFKPVSEVKLD; GKKEFKPVSEVKLDK; KKEFKPVSEVKLDKT;
KEFKPVSEVKLDKTS; EFKPVSEVKLDKTSK; FKPVSEVKLDKTSKS;
KPVSEVKLDKTSKSN; PVSEVKLDKTSKSNN; VSEVKLDKTSKSNNE;
SEVKLDKTSKSNNEV; EVKLDKTSKSNNEVG; VKLDKTSKSNNEVGK;
KLDKTSKSNNEVGKL; LDKTSKSNNEVGKLS; DKTSKSNNEVGKLSP;
KTSKSNNEVGKLSPL; TSKSNNEVGKLSPLD; SKSNNEVGKLSPLDK;
KSNNEVGKLSPLDKP; SNNEVGKLSPLDKPS; NNEVGKLSPLDKPSY;
NEVGKLSPLDKPSYD; EVGKLSPLDKPSYDD; VGKLSPLDKPSYDDI;
GKLSPLDKPSYDDID; KLSPLDKPSYDDIDS; LSPLDKPSYDDIDSK;
SPLDKPSYDDIDSKE; PLDKPSYDDIDSKEE; LDKPSYDDIDSKEEV;
DKPSYDDIDSKEEVD; KPSYDDIDSKEEVDK; PSYDDIDSKEEVDKA;
SYDDIDSKEEVDKAI; YDDIDSKEEVDKAIN; DDIDSKEEVDKAINL;
DIDSKEEVDKAINLQ; IDSKEEVDKAINLQK; DSKEEVDKAINLQKT;

Fig. 33 continued

| | |
|---|---|
| | PKNLDEFILSENKILP; KNLDEFILSENKILPF; NLDEFILSENKILPFT; LDEFILSENKILPFTS; DEFILSENKILPFTSF; EFILSENKILPFTSFS; FILSENKILPFTSFSV; ILSENKILPFTSFSVR; LSENKILPFTSFSVRK; SENKILPFTSFSVRKN; ENKILPFTSFSVRKNF; NKILPFTSFSVRKNFI; KILPFTSFSVRKNFIY; ILPFTSFSVRKNFIYL; LPFTSFSVRKNFIYLQ; PFTSFSVRKNFIYLQD; FTSFSVRKNFIYLQDE; TSFSVRKNFIYLQDEL; SFSVRKNFIYLQDELK; FSVRKNFIYLQDELKN; SVRKNFIYLQDELKNL; VRKNFIYLQDELKNLV; RKNFIYLQDELKNLVI; KNFIYLQDELKNLVIL; NFIYLQDELKNLVILD; FIYLQDELKNLVILDV; IYLQDELKNLVILDVN; YLQDELKNLVILDVNT; LQDELKNLVILDVNTL; QDELKNLVILDVNTLK; DELKNLVILDVNTLKK; ELKNLVILDVNTLKKV; LKNLVILDVNTLKKVK; |
| SEQ ID NO:27 SEQ ID NO: 102687-104636 | 13 mers: MKYILSIDQGTTS; KYILSIDQGTTSS; YILSIDQGTTSSR; ILSIDQGTTSSRA; LSIDQGTTSSRAM; SIDQGTTSSRAMV; IDQGTTSSRAMVF; DQGTTSSRAMVFD; QGTTSSRAMVFDK; GTTSSRAMVFDKN; TTSSRAMVFDKNA; TSSRAMVFDKNAN; SSRAMVFDKNANI; SRAMVFDKNANIK; RAMVFDKNANIKG; AMVFDKNANIKGF; MVFDKNANIKGFA; VFDKNANIKGFAQ; FDKNANIKGFAQK; DKNANIKGFAQKE; KNANIKGFAQKEF; NANIKGFAQKEFT; ANIKGFAQKEFTQ; NIKGFAQKEFTQI; IKGFAQKEFTQIY; KGFAQKEFTQIYP; GFAQKEFTQIYPQ; FAQKEFTQIYPQP; AQKEFTQIYPQPS; QKEFTQIYPQPSW; KEFTQIYPQPSWV; EFTQIYPQPSWVE; FTQIYPQPSWVEH; TQIYPQPSWVEHD; QIYPQPSWVEHDP; IYPQPSWVEHDPT; YPQPSWVEHDPTE; PQPSWVEHDPTEI; QPSWVEHDPTEIW; PSWVEHDPTEIWG; SWVEHDPTEIWGS; WVEHDPTEIWGSQ; VEHDPTEIWGSQL; EHDPTEIWGSQLG; HDPTEIWGSQLGV; DPTEIWGSQLGVI; PTEIWGSQLGVIT; TEIWGSQLGVITE; EIWGSQLGVITEA; IWGSQLGVITEAM; WGSQLGVITEAMA; GSQLGVITEAMAN; SQLGVITEAMANA; QLGVITEAMANAR; LGVITEAMANARI; GVITEAMANARIL; VITEAMANARILP; ITEAMANARILPN; TEAMANARILPNE; EAMANARILPNEI; AMANARILPNEID; MANARILPNEIDA; ANARILPNEIDAI; NARILPNEIDAIG; ARILPNEIDAIGI; RILPNEIDAIGIT; ILPNEIDAIGITN; LPNEIDAIGITNQ; PNEIDAIGITNQR; NEIDAIGITNQRE; EIDAIGITNQRET; IDAIGITNQRETT; DAIGITNQRETTV; AIGITNQRETTVI; IGITNQRETTVIW; GITNQRETTVIWE; ITNQRETTVIWEK; TNQRETTVIWEKN; NQRETTVIWEKNT; QRETTVIWEKNTG; RETTVIWEKNTGK; ETTVIWEKNTGKP; TTVIWEKNTGKPI; TVIWEKNTGKPIY; VIWEKNTGKPIYN; IWEKNTGKPIYNA; WEKNTGKPIYNAI; EKNTGKPIYNAIV; KNTGKPIYNAIVW; NTGKPIYNAIVWQ; TGKPIYNAIVWQD; GKPIYNAIVWQDR; KPIYNAIVWQDRR; PIYNAIVWQDRRT; IYNAIVWQDRRTA; YNAIVWQDRRTAK; NAIVWQDRRTAKI; AIVWQDRRTAKIC; IVWQDRRTAKICD; VWQDRRTAKICDQ; WQDRRTAKICDQL; QDRRTAKICDQLK; DRRTAKICDQLKK; RRTAKICDQLKKE; RTAKICDQLKKEG; TAKICDQLKKEGK; AKICDQLKKEGKD; KICDQLKKEGKDK; ICDQLKKEGKDKI; CDQLKKEGKDKII; DQLKKEGKDKIIL; |

QFQADLLECKVVR; FQADLLECKVVRP; QADLLECKVVRPK;
ADLLECKVVRPKT; DLLECKVVRPKTT; LLECKVVRPKTTE;
LECKVVRPKTTET; ECKVVRPKTTETT; CKVVRPKTTETTA;
KVVRPKTTETTAL; VVRPKTTETTALG; VRPKTTETTALGA;
RPKTTETTALGAA; PKTTETTALGAAY; KTTETTALGAAYL;
TTETTALGAAYLA; TETTALGAAYLAG; ETTALGAAYLAGL;
TTALGAAYLAGLA; TALGAAYLAGLAT; ALGAAYLAGLATG;
LGAAYLAGLATGY; GAAYLAGLATGYW; AAYLAGLATGYWQ;
AYLAGLATGYWQS; YLAGLATGYWQSA; LAGLATGYWQSAE;
AGLATGYWQSAEE; GLATGYWQSAEET; LATGYWQSAEETV;
ATGYWQSAEETVS; TGYWQSAEETVSL; GYWQSAEETVSLW;
YWQSAEETVSLWQ; WQSAEETVSLWQV; QSAEETVSLWQVD;
SAEETVSLWQVDK; AEETVSLWQVDKT; EETVSLWQVDKTF;
ETVSLWQVDKTFE; TVSLWQVDKTFEP; VSLWQVDKTFEPS;
SLWQVDKTFEPSM; LWQVDKTFEPSMP; WQVDKTFEPSMPK;
QVDKTFEPSMPKN; VDKTFEPSMPKNQ; DKTFEPSMPKNQK;
KTFEPSMPKNQKE; TFEPSMPKNQKEK; FEPSMPKNQKEKL;
EPSMPKNQKEKLL; PSMPKNQKEKLLE; SMPKNQKEKLLEN;
MPKNQKEKLLENW; PKNQKEKLLENWN; KNQKEKLLENWKK;
NQKEKLLENWKKA; QKEKLLENWNKAV; KEKLLENWNKAVG;
EKLLENWNKAVGK; KLLENWNKAVGKA; LLENWNKAVGKAK;
LENWKAVGKAKS; ENWKAVGKAKSW; NWKAVGKAKSWL;
WNKAVGKAKSWLQ; NKAVGKAKSWLQN; KAVGKAKSWLQNS;
AVGKAKSWLQNSH; VGKAKSWLQNSHS; GKAKSWLQNSHSS;

14 mers:
MKYILSIDQGTTSS; KYILSIDQGTTSSR; YILSIDQGTTSSRA;
ILSIDQGTTSSRAM; LSIDQGTTSSRAMV; SIDQGTTSSRAMVE;
IDQGTTSSRAMVED; DQGTTSSRAMVEDK; QGTTSSRAMVEDKN;
GTTSSRAMVEDKNA; TTSSRAMVEDKNAK; TSSRAMVEDKNAKI;
SSRAMVEDKNAKIK; SRAMVEDKNAKIKG; RAMVEDKNAKIKGF;
AMVEDKNAKIKGFA; MVEDKNAKIKGFAQ; VEDKNAKIKGFAQR;
EDKNAKIKGFAQKE; DKNAKIKGFAQKEF; KNAKIKGFAQKEFT;
NAKIKGFAQKEFTQ; AKIKGFAQKEFTQT; KIKGFAQKEFTQTY;
IKGFAQKEFTQTYP; KGFAQKEFTQTYPQ; GFAQKEFTQTYPQP;
FAQKEFTQTYPQPS; AQKEFTQTYPQPSW; QKEFTQTYPQPSWV;
KEFTQTYPQPSWVE; EFTQTYPQPSWVEH; FTQTYPQPSWVEHD;
TQTYPQPSWVEHDP; QTYPQPSWVEHDPT; TYPQPSWVEHDPTE;
YPQPSWVEHDPTET; PQPSWVEHDPTETW; QPSWVEHDPTETWG;
PSWVEHDPTETWGS; SWVEHDPTETWGSQ; WVEHDPTETWGSQL;
VEHDPTETWGSQLG; EHDPTETWGSQLGV; HDPTETWGSQLGVI;
DPTETWGSQLGVIT; PTETWGSQLGVITE; TETWGSQLGVITEA;
ETWGSQLGVITEAM; TWGSQLGVITEAMA; WGSQLGVITEAMAN;
GSQLGVITEAMANA; SQLGVITEAMANAR; QLGVITEAMANARI;
LGVITEAMANARIL; GVITEAMANARILP; VITEAMANARILPN;
ITEAMANARILPNE; TEAMANARILPNEI; EAMANARILPNEID;
AMANARILPNEIDA; MANARILPNEIDAT; ANARILPNEIDATG;
NARILPNEIDATGI; ARILPNEIDATGIT; RILPNEIDATGITN;
ILPNEIDATGITNQ; LPNEIDATGITNQR; PNEIDATGITNQRE;
NEIDATGITNQRET; EIDATGITNQRETT; IDATGITNQRETTV;
DATGITNQRETTVT; ATGITNQRETTVTE; TGITNQRETTVTER;

Fig. 33 continued

GLNQRETTVLWEKK; LLKQRETTVLWEKK; TNQRETTVLWEKKT;
NQRETTVLWEKKTG; QRETTVLWEKKTGK; RETTVLWEKKTGKP;
ETTVLWEKKTGKPI; TTVLWEKKTGKPIY; TVLWEKKTGKPIYN;
VLWEKKTGKPIYNA; LWEKKTGKPIYNAL; WEKKTGKPIYNALV;
EKKTGKPIYNALVW; KKTGKPIYNALVWQ; KTGKPIYNALVWQD;
TGKPIYNALVWQDR; GKPIYNALVWQDRR; KPIYNALVWQDRRT;
PIYNALVWQDRRTA; IYNALVWQDRRTAK; YNALVWQDRRTAKT;
NALVWQDRRTAKTC; ALVWQDRRTAKTCD; LVWQDRRTAKTCDQ;
VWQDRRTAKTCDQL; WQDRRTAKTCDQLK; QDRRTAKTCDQLKK;
DRRTAKTCDQLKKF; RRTAKTCDQLKKFG; RTAKTCDQLKKFGK;
TAKTCDQLKKFGKD; AKTCDQLKKFGKDK; KTCDQLKKFGKDKT;
TCDQLKKFGKDKTI; CDQLKKFGKDK

Fig. 33 continued

APQSFDLLNMKKS; PQSFDLLNMKKSL; QSFDLLNMKKSLP;
SFDLLNMKKSLPF; FDLLNMKKSLPFF; DLLNMKKSLPFFF;
LLNMKKSLPFFFT; LNMKKSLPFFFTQ; NMKKSLPFFFTQF;
MKKSLPFFFTQEL; KKSLPFFFTQELR; KSLPFFFTQELRV;
SLPFFFTQELRVD; LPFFFTQELRVDG; PFFFTQELRVDGG;
FFFTQELRVDGGA; FFTQELRVDGGAS; FTQELRVDGGASQ;
TQELRVDGGASQN; QELRVDGGASQNL; ELRVDGGASQNLL;
LRVDGGASQNLLM; RVDGGASQNLLMQ; VDGGASQNLLMQF;
DGGASQNLLMQFQ; GGASQNL

| | | |
|---|---|---|
| PSWVEHDPTELWCSQ; | SWVEHDPTELWCSQL; | WVEHDPTELWCSQLG; |
| VEHDPTELWCSQLGV; | EHDPTELWCSQLGVT; | HDPTELWCSQLGVTT; |
| DPTELWCSQLGVTTA; | PTELWCSQLGVTTAA; | TELWCSQLGVTTAAM; |
| ELWCSQLGVTTAAMA; | LWCSQLGVTTAAMAA; | WCSQLGVTTAAMAAA; |
| CSQLGVTTAAMAKAR; | SQLGVTTAAMAKARI; | QLGVTTAAMAKARIL; |
| LGVTTAAMAKARILP; | GVTTAAMAKARILPK; | VTTAAMAKARILPKE; |
| TTAAMAKARILPKET; | TAAMAKARILPKETD; | AAMAKARILPKETDA; |
| AMAKARILPKETDAI; | MAKARILPKETDAIG; | AKARILPKETDAIGT; |
| KARILPKETDAIGTT; | ARILPKETDAIGTTN; | RILPKETDAIGTTNQ; |
| ILPKETDAIGTTNQR; | LPKETDAIGTTNQRE; | PKETDAIGTTNQRET; |
| KETDAIGTTNQRETT; | ETDAIGTTNQRETTV; | TDAIGTTNQRETTVI; |
| DAIGTTNQRETTVIW; | AIGTTNQRETTVIWE; | IGTTNQRETTVIWEK; |
| GTTNQRETTVIWEKN; | TTNQRETTVIWEKNT; | TNQRETTVIWEKNTG; |
| NQRETTVIWEKNTGK; | QRETTVIWEKNTGKP; | RETTVIWEKNTGKPI; |
| ETTVIWEKNTGKPIY; | TTVIWEKNTGKPIYK; | TVIWEKNTGKPIYKA; |
| VIWEKNTGKPIYKAI; | IWEKNTGKPIYKAIV; | WEKNTGKPIYKAIVW; |
| EKNTGKPIYKAIVWQ; | KNTGKPIYKAIVWQD; | NTGKPIYKAIVWQDR; |
| TGKPIYKAIVWQDRR; | GKPIYKAIVWQDRRT; | KPIYKAIVWQDRRTA; |
| PIYKAIVWQDRRTAK; | IYKAIVWQDRRTAKI; | YKAIVWQDRRTAKIC; |
| KAIVWQDRRTAKICD; | AIVWQDRRTAKICDQ; | IVWQDRRTAKICDQL; |
| VWQDRRTAKICDQLK; | WQDRRTAKICDQLKK; | QDRRTAKICDQLKKE; |
| DRRTAKICDQLKKEG; | RRTAKICDQLKKEGK; | RTAKICDQLKKEGKD; |
| TAKICDQLKKEGKDK; | AKICDQLKKEGKDKI; | KICDQLKKEGKDKII; |
| ICDQLKKEGKDKIIL; | CDQLKKEGKDKIILE; | DQLKKEGKDKIILEK; |
| QLKKEGKDKIILEKT; | LKKEGKDKIILEKTG; | KKEGKDKIILEKTGL; |
| KEGKDKIILEKTGLV; | EGKDKIILEKTGLVL; | GKDKIILEKTGLVLD; |
| KDKIILEKTGLVLDS; | DKIILEKTGLVLDSY; | KIILEKTGLVLDSYF; |
| IILEKTGLVLDSYFS; | ILEKTGLVLDSYFSG; | LEKTGLVLDSYFSGT; |
| EKTGLVLDSYFSGTK; | KTGLVLDSYFSGTKI; | TGLVLDSYFSGTKIM; |
| GLVLDSYFSGTKIMW; | LVLDSYFSGTKIMWI; | VLDSYFSGTKIMWIL; |
| LDSYFSGTKIMWILD; | DSYFSGTKIMWILDK; | SYFSGTKIMWILDKV; |
| YFSGTKIMWILDKVE; | FSGTKIMWILDKVEG; | SGTKIMWILDKVEGA; |
| GTKIMWILDKVEGAR; | TKIMWILDKVEGARQ; | KIMWILDKVEGARQR; |
| IMWILDKVEGARQRA; | MWILDKVEGARQRAE; | WILDKVEGARQRAEN; |
| ILDKVEGARQRAENG; | LDKVEGARQRAENGE; | DKVEGARQRAENGEL; |
| KVEGARQRAENGELC; | VEGARQRAENGELCF; | EGARQRAENGELCFG; |
| GARQRAENGELCFGT; | ARQRAENGELCFGTT; | RQRAENGELCFGTTD; |
| QRAENGELCFGTTDT; | RAENGELCFGTTDTW; | AENGELCFGTTDTWI; |
| ENGELCFGTTDTWIL; | NGELCFGTTDTWILW; | GELCFGTTDTWILWN; |
| ELCFGTTDTWILWNL; | LCFGTTDTWILWNLT; | CFGTTDTWILWNLTQ; |
| FGTTDTWILWNLTQK; | GTTDTWILWNLTQKK; | TTDTWILWNLTQKKE; |
| TDTWILWNLTQKKEH; | DTWILWNLTQKKEHA; | TWILWNLTQKKEHAT; |
| WILWNLTQKKEHATD; | ILWNLTQKKEHATDY; | LWNLTQKKEHATDYS; |
| WNLTQKKEHATDYSN; | NLTQKKEHATDYSNA; | LTQKKEHATDYSNAS; |
| TQKKEHATDYSNASR; | QKKEHATDYSNASRT; | KKEHATDYSNASRTL; |
| KEHATDYSNASRTLL; | EHATDYSNASRTLLN; | HATDYSNASRTLLNK; |
| ATDYSNASRTLLNKT; | TDYSNASRTLLNKTK; | DYSNASRTLLNKTKT; |
| YSNASRTLLNKTKTL; | SNASRTLLNKTKTLE; | NASRTLLNKTKTLEW; |
| ASRTLLNKTKTLEWD; | SRTLLNKTKTLEWDD; | RTLLNKTKTLEWDDS; |
| TLLNKTKTLEWDDEL; | LLNKTKTLEWDDELL; | LNKTKTLEWDDELLS; |
| NKTKTLEWDDELLST; | KTKTLEWDDELLSTI; | TKTLEWDDELLSTIL; |

Fig. 33 continued

KTLEWDDELLSILNV; TLEWDDELLSILNVP; LEWDDELLSILNVPR;
EWDDELLSILNVPRA; WDDELLSILNVPRAT; DDELLSILNVPRATI;
DELLSILNVPRATIP; ELLSILNVPRATIPF; LLSILNVPRATIPFL;
LSILNVPRATIPFLK; SILNVPRATIPFLKE; ILNVPRATIPFLKES;
LNVPRATIPFLKESS; NVPRATIPFLKESST; VPRATIPFLKESSTT;
PRATIPFLKESSTTY; RATIPFLKESSTTYG; ATIPFLKESSTTYGK;
TIPFLKESSTTYGKT; IPFLKESSTTYGKTD; PFLKESSTTYGKTDK;
FLKESSTTYGKTDKA; LKESSTTYGKTDKAL; KESSTTYGKTDKALF;
ESSTTYGKTDKALFG; SSTTYGKTDKALFGA; STTYGKTDKALFGAF;
TTYGKTDKALFGAFT; TYGKTDKALFGAFTP; YGKTDKALFGAFTPT;
GKTDKALFGAFTPTA; KTDKALFGAFTPTAG; TDKALFGAFTPTAGT;
DKALFGAFTPTAGTA; KALFGAFTPTAGTAG; ALFGAFTPTAGTAGD;
LFGAFTPTAGTAGDQ; FGAFTPTAGTAGDQF; GAFTPTAGTAGDQFA;
AFTPTAGTAGDQFAA; FTPT

| | | |
|---|---|---|
| LQWLRDGLFFRKSSD; | QWLRDGLFFRKSSDA; | WLRDGLFFRKSSDAF; |
| LRDGLFFRKSSDAFA; | RDGLFFRKSSDAFAL; | DGLFFRKSSDAFALA; |
| GLFFRKSSDAFALAS; | LFFRKSSDAFALASS; | FFRKSSDAFALASSV; |
| FRKSSDAFALASSVS; | RKSSDAFALASSVSD; | KSSDAFALASSVSDN; |
| SSDAFALASSVSDNG; | SDAFALASSVSDNGG; | DAFALASSVSDNGGV; |
| AFALASSVSDNGGVY; | FALASSVSDNGGVYF; | ALASSVSDNGGVYFV; |
| LASSVSDNGGVYFVP; | ASSVSDNGGVYFVPA; | SSVSDNGGVYFVPAF; |
| SVSDNGGVYFVPAFV; | VSDNGGVYFVPAFVG; | SDNGGVYFVPAFVGL; |
| DNGGVYFVPAFVGLG; | NGGVYFVPAFVGLGA; | GGVYFVPAFVGLGAP; |
| GVYFVPAFVGLGAPH; | VYFVPAFVGLGAPHW; | YFVPAFVGLGAPHWD; |
| FVPAFVGLGAPHWDS; | VPAFVGLGAPHWDSY; | PAFVGLGAPHWDSYA; |
| AFVGLGAPHWDSYAR; | FVGLGAPHWDSYARG; | VGLGAPHWDSYARGT; |
| GLGAPHWDSYARGTT; | LGAPHWDSYARGTTF; | GAPHWDSYARGTTFG; |
| APHWDSYARGTTFGT; | PHWDSYARGTTFGTF; | HWDSYARGTTFGTFR; |
| WDSYARGTTLGLTRG; | DSYARGTTLGLTRGS; | SYARGTTLGLTRGST; |
| YARGTTLGLTRGSTK; | ARGTTLGLTRGSTKA; | RGTTLGLTRGSTKAH; |
| GTTLGLTRGSTKAHT; | TTLGLTRGSTKAHTT; | TLGLTRGSTKAHTTR; |
| LGLTRGSTKAHTTRA; | GLTRGSTKAHTTRAA; | LTRGSTKAHTTRAAL; |
| TRGSTKAHTTRAALE; | RGSTKAHTTRAALES; | GSTKAHTTRAALESL; |
| STKAHTTRAALESLA; | TKAHTTRAALESLAF; | KAHTTRAALESLAFQ; |
| AHTTRAALESLAFQS; | HTTRAALESLAFQSF; | TTRAALESLAFQSFD; |
| TRAALESLAFQSFDL; | RAALESLAFQSFDLL; | AALESLAFQSFDLLN; |
| ALESLAFQSFDLLNT; | LESLAFQSFDLLNTM; | ESLAFQSFDLLNTMK; |
| SLAFQSFDLLNTMKK; | LAFQSFDLLNTMKKS; | AFQSFDLLNTMKKSL; |
| FQSFDLLNTMKKSLP; | QSFDLLNTMKKSLPN; | SFDLLNTMKKSLPNF; |
| FDLLNTMKKSLPNFE; | DLLNTMKKSLPNFEL; | LLNTMKKSLPNFELQ; |
| LNTMKKSLPNFELQE; | NTMKKSLPNFELQEL; | TMKKSLPNFELQELR; |
| MKKSLPNFELQELRV; | KKSLPNFELQELRVD; | KSLPNFELQELRVDG; |
| SLPNFELQELRVDGG; | LPNFELQELRVDGGA; | PNFELQELRVDGGAS; |
| NFELQELRVDGGASQ; | FELQELRVDGGASQN; | ELQELRVDGGASQNK; |
| LQELRVDGGASQNKL; | QELRVDGGASQNKLL; | ELRVDGGASQNKLLM; |
| LRVDGGASQNKLLMQ; | RVDGGASQNKLLMQF; | VDGGASQNKLLMQFQ; |
| DGGASQNKLLMQFQA; | GGASQNKLLMQFQAD; | GASQNKLLMQFQADL; |
| ASQNKLLMQFQADLL; | SQNKLLMQFQADLLE; | QNKLLMQFQADLLEC; |
| NKLLMQFQADLLECK; | KLLMQFQADLLECKV; | LLMQFQADLLECKVV; |
| LMQFQADLLECKVVR; | MQFQADLLECKVVRP; | QFQADLLECKVVRPK; |
| FQADLLECKVVRPKT; | QADLLECKVVRPKTT; | ADLLECKVVRPKTTE; |
| DLLECKVVRPKTTET; | LLECKVVRPKTTETT; | LECKVVRPKTTETTA; |
| ECKVVRPKTTETTAL; | CKVVRPKTTETTALG; | KVVRPKTTETTALGA; |
| VVRPKTTETTALGAA; | VRPKTTETTALGAAY; | RPKTTETTALGAAYL; |
| PKTTETTALGAAYLA; | KTTETTALGAAYLAG; | TTETTALGAAYLAGL; |
| TETTALGAAYLAGLA; | ETTALGAAYLAGLAT; | TTALGAAYLAGLATG; |
| TALGAAYLAGLATGY; | ALGAAYLAGLATGYW; | LGAAYLAGLATGYWQ; |
| GAAYLAGLATGYWQS; | AAYLAGLATGYWQSA; | AYLAGLATGYWQSAE; |
| YLAGLATGYWQSAEE; | LAGLATGYWQSAEEI; | AGLATGYWQSAEEIV; |
| GLATGYWQSAEEIVS; | LATGYWQSAEEIVSL; | ATGYWQSAEEIVSLW; |
| TGYWQSAEEIVSLWQ; | GYWQSAEEIVSLWQV; | YWQSAEEIVSLWQVD; |
| WQSAEEIVSLWQVDK; | QSAEEIVSLWQVDKI; | SAEEIVSLWQVDKIF; |
| AEEIVSLWQVDKIFP; | EEIVSLWQVDKIFPS; | EIVSLWQVDKIFPSM; |
| IVSLWQVDKIFPSMP; | VSLWQVDKIFPSMPK; | SLWQVDKIFPSMPKQ; |
| LWQVDKIFPSMPKQK; | WQVDKIFPSMPKQKL; | QVDKIFPSMPKQKL; |

Fig. 33 continued

| | |
|---|---|
| | QVDKIFEPSMPKNQKE; VDKIFEPSMPKNQKEK; DKIFEPSMPKNQKEKL; KIFEPSMPKNQKEKLL; IFEPSMPKNQKEKLLE; FEPSMPKNQKEKLLEN; EPSMPKNQKEKLLENW; PSMPKNQKEKLLENWN; SMPKNQKEKLLENWNK; MPKNQKEKLLENWNKA; PKNQKEKLLENWNKAV; KNQKEKLLENWNKAVG; NQKEKLLENWNKAVGK; QKEKLLENWNKAVGKA; KEKLLENWNKAVGKAK; EKLLENWNKAVGKAKS; KLLENWNKAVGKAKSW; LLENWNKAVGKAKSWI; LENWNKAVGKAKSWIQ; ENWNKAVGKAKSWIQN; NWNKAVGKAKSWIQNS; WNKAVGKAKSWIQNSH; NKAVGKAKSWIQNSHS; KAVGKAKSWIQNSHSS; |
| SEQ ID NO:28 SEQ ID NO: 104637-106906 | 13 mers: MKTIKKDSEFYDS; KTIKKDSEFYDSL; TIKKDSEFYDSLA; IKKDSEFYDSLAT; KKDSEFYDSLATL; KDSEFYDSLATLK; DSEFYDSLATLKK; SEFYDSLATLKKH; EFYDSLATLKKHI; FYDSLATLKKHIN; YDSLATLKKHINK; DSLATLKKHINKY; SLATLKKHINKYI; LATLKKHINKYIE; ATLKKHINKYIEE; TLKKHINKYIEEK; LKKHINKYIEEKV; KKHINKYIEEKVL; KHINKYIEEKVLK; HINKYIEEKVLKY; INKYIEEKVLKYS; NKYIEEKVLKYSI; KYIEEKVLKYSIS; YIEEKVLKYSISS; IEEKVLKYSISSQ; EEKVLKYSISSQL; EKVLKYSISSQLY; KVLKYSISSQLYK; VLKYSISSQLYKL; LKYSISSQLYKLE; KYSISSQLYKLEK; YSISSQLYKLEKP; SISSQLYKLEKPE; ISSQLYKLEKPEI; SSQLYKLEKPEII; SQLYKLEKPEIIE; QLYKLEKPEIIEL; LYKLEKPEIIELI; YKLEKPEIIELIK; KLEKPEIIELIKI; LEKPEIIELIKIS; EKPEIIELIKISN; KPEIIELIKISND; PEIIELIKISNDY; EIIELIKISNDYE; IIELIKISNDYEK; IELIKISNDYEKE; ELIKISNDYEKEK; LIKISNDYEKEKN; IKISNDYEKEKNA; KISNDYEKEKNAF; ISNDYEKEKNAFN; SNDYEKEKNAFNT; NDYEKEKNAFNTS; DYEKEKNAFNTSL; YEKEKNAFNTSLE; EKEKNAFNTSLEE; KEKNAFNTSLEEC; EKNAFNTSLEECY; KNAFNTSLEECYY; NAFNTSLEECYYK; AFNTSLEECYYKN; FNTSLEECYYKNT; NTSLEECYYKNTQ; TSLEECYYKNTQN; SLEECYYKNTQNE; LEECYYKNTQNEA; EECYYKNTQNEAI; ECYYKNTQNEAIK; CYYKNTQNEAIKK; YYKNTQNEAIKKW; YKNTQNEAIKKWI; KNTQNEAIKKWIL; NTQNEAIKKWILE; TQNEAIKKWILEI; QNEAIKKWILEIV; NEAIKKWILEIVR; EAIKKWILEIVRN; AIKKWILEIVRNK; IKKWILEIVRNKN; KKWILEIVRNKNF; KWILEIVRNKNFI; WILEIVRNKNFIQ; ILEIVRNKNFIQI; LEIVRNKNFIQIS; EIVRNKNFIQISK; IVRNKNFIQISKE; VRNKNFIQISKEA; RNKNFIQISKEAN; NKNFIQISKEANL; KNFIQISKEANLN; NFIQISKEANLNT; FIQISKEANLNTK; IQISKEANLNTKK; QISKEANLNTKKL; ISKEANLNTKKLG; SKEANLNTKKLGT; KEANLNTKKLGTT; EANLNTKKLGTTY; ANLNTKKLGTTYK; NLNTKKLGTTYKL; LNTKKLGTTYKLK; NTKKLGTTYKLKS; TKKLGTTYKLKSS; KKLGTTYKLKSSN; KLGTTYKLKSSNF; LGTTYKLKSSNFL; GTTYKLKSSNFLK; TTYKLKSSNFLKL; TYKLKSSNFLKLI; YKLKSSNFLKLIE; KLKSSNFLKLIEI; LKSSNFLKLIEIQ; KSSNFLKLIEIQN; SSNFLKLIEIQNS; SNFLKLIEIQNSP; NFLKLIEIQNSPY; FLKLIEIQNSPYY; LKLIEIQNSPYYS; KLIEIQNSPYYSQ; |

YFSDFTQYAPKD; FSDFTQYAPKDF; SDFTQYAPKDFQ;
SDFTQYAPKDFQD; DFTQYAPKDFQDT; FTQYAPKDFQDTL;
TQYAPKDFQDTLK; QYAPKDFQDTLKC; YAPKDFQDTLKCY;
APKDFQDTLKCYL; PKDFQDTLKCYLY; KDFQDTLKCYLYV;
DFQDTLKCYLYVI; FQDTLKCYLYVIE; QDTLKCYLYVIEK;
DTLKCYLYVIEKT; TLKCYLYVIEKTT; LKCYLYV

YFEIQNQIEVYFL; EIQNQIEVYFLS; IQNQIEVYFLSF;
IQKQIFVYFLSFY; QNQIFVYFLSFYP; NQIFVYFLSFYP;
QTFVYFLSFYPN; TFVYFLSFYPNI; FVYFLSFYPNIEY;
VYFLSFYPNIEYK; YFLSFYPNIEYKH; FLSFYPNIEYKHF;
LSFYPNIEYKHFK; SFYPNIEYKHFKF; FYPNIEYKHFKFI;
YPNIEYKHFKFIS; PNIEYKHFKFISD; NIEYKHFKFISDI;
IEYKHFKFISDII; EYKHFKFISDILL; YKHFKFISDILLY;
KHFKFISDILLYL; HFKFISDILLYLD; FKFISDILLYLDE;
KFISDILLYLDEN; FISDILLYLDENK; ISDILLYLDENKI;
SDILLYLDENKII; DILLYLDENKIIP; ILLYLDENKIIPK;
LLYLDENKIIPK; LYLDENKIIPKK; YLDENKIIPKKI;
LDENKIIPKKII; DENKIIPKKIIK; ENKIIPKKIIKI;
NKIIPKKIIKIQ; KIIPKKIIKIQK; IIPKKIIKIQKI;
IPKKIIKIQKIK; PKKIIKIQKIKP; KKIIKIQKIKPN;
KIIKIQKIKPNQ; IIKIQKIKPNQL; IKIQKIKPNQLD;
KIQKIKPNQLDY; IQKIKPNQLDYQ; QKIKPNQLDYQK;
KIKPNQLDYQKS; IKPNQLDYQKSY; KPNQLDYQKSYL;
PNQLDYQKSYLL; NQLDYQKSYLLT; QLDYQKSYLLTK;
LDYQKSYLLKS; DYQKSYLLKSL; YQKSYLLKSLK;
QKSYLLKSLKT; KSYLLKSLKTR; SYLLKSLKTRS;
YLLKSLKTRSR; LLKSLKTRSRI; LKSLKTRSRIL;
LKSLKTRSRILK; KSLKTRSRILKI; SLKTRSRILKII;
SLKTRSRILKII; LKTRSRILKIIK; KTRSRILKIIKN;
TRSRILKIIKNI; RSRILKIIKNIR; SRILKIIKNIRF;
RILKIIKNIRFN; ILKIIKNIRFNL; LKIIKNIRFNLI;
KIIKNIRFNLIE; IIKNIRFNLIEK; IKNIRFNLIEKL;
KNIRFNLIEKLE; NIRFNLIEKLED; IRFNLIEKLEDE;
RFNLIEKLEDEN; FNLIEKLEDENF; NLIEKLEDENFK;
LIEKLEDENFKK; IEKLEDENFKKL; EKLEDENFKKLP;
KLEDENFKKLPA; LEDENFKKLPAC; EDENFKKLPACY;
DENFKKLPACYL; ENFKKLPACYLT; NFKKLPACYLTY;
FKKLPACYLTYC; KKLPACYLTYCF; KLPACYLTYCFN;
LPACYLTYCFNL; PACYLTYCFNLV; ACYLTYCFNLVE;
CYLTYCFNLVEL; YLTYCFNLVELK; LTYCFNLVELKN;
TYCFNLVELKNR; YCFNLVELKNRK; CFNLVELKNRKI;
FNLVELKNRKIK; NLVELKNRKIKS; LVELKNRKIKSN;
VELKNRKIKSNE; ELKNRKIKSNEK; LKNRKIKSNEKN;
KNRKIKSNEKNS; NRKIKSNEKNSL; RKIKSNEKNSLL;
KIKSNEKNSLLE; IKSNEKNSLLEF; KSNEKNSLLEFI;
KSNEKNSLLEFIS; SNEKNSLLEFISF; NEKNSLLEFISFF;
EKNSLLEFISFFK; KNSLLEFISFFKI; NSLLEFISFFKIK;
SLLEFISFFKIKL; LLEFISFFKIKLF; LEFISFFKIKLFQ;
EFISFFKIKLFQK; FISFFKIKLFQKT; ISFFKIKLFQKTK;
SFFKIKLFQKTKL; FFKIKLFQKIKFK; FKIKLFQKIKFKK;
KIKLFQKIKFKKE; IKLFQKIKFKKEL; KLFQKIKFKKELF;
LFQKIKFKKELFK; FQKIKFKKELFKS; QKIKFKKELFKSK;
KIKFKKELFKSKC; IKFKKELFKSKCI;

14 more:
MKIKKDSFYDSL; KIKKDSFYDSLA; IKKDSFYDSLAT;

Fig. 33 continued

| | | | |
|---|---|---|---|
| | IKKDSFYDSLATL; | KKDSFYDSLATLK; | KDSFYDSLATLKK; |
| | DSFYDSLATLKKH; | SFYDSLATLKKHI; | FYDSLATLKKHIN; |
| | YDSLATLKKHINK; | DSLATLKKHINKY; | SLATLKKHINKYI; |
| | LATLKKHINKYIE; | ATLKKHINKYIEE; | TLKKHINKYIEEK; |
| | LKKHINKYIEEKV; | KKHINKYIEEKVL; | KHINKYIEEKVLK; |
| | HINKYIEEKVLKY; | INKYIEEKVLKYS; | NKYIEEKVLKYST; |
| | KYIEEKVLKYSTS; | YIEEKVLKYSTSS; | IEEKVLKYSTSSQ; |
| | EEKVLKYSTSSQL; | EKVLKYSTSSQLY; | KVLKYSTSSQLYK; |
| | VLKYSTSSQLYKL; | LKYSTSSQLYKLE; | KYSTSSQLYKLEK; |
| | YSTSSQLYKLEKP; | STSSQLYKLEKPE; | TSSQLYKLEKPEI; |
| | SSQLYKLEKPEIE; | SQLYKLEKPEIEL; | QLYKLEKPEIELI; |
| | LYKLEKPEIELIK; | YKLEKPEIELIKI; | KLEKPEIELIKIS; |
| | LEKPEIELIKISN; | EKPEIELIKISND; | KPEIELIKISNDY; |
| | PEIELIKISNDYE; | EIELIKISNDYEK; | IELIKISNDYEKE; |
| | ELIKISNDYEKEK; | LIKISNDYEKEKN; | IKISNDYEKEKNA; |
| | KISNDYEKEKNAF; | ISNDYEKEKNAFN; | SNDYEKEKNAFNT; |
| | NDYEKEKNAFNTS; | DYEKEKNAFNTSL; | YEKEKNAFNTSLE; |
| | EKEKNAFNTSLEE; | KEKNAFNTSLEEC; | EKNAFNTSLEECY; |
| | KNAFNTSLEECYY; | NAFNTSLEECYYK; | AFNTSLEECYYKN; |
| | FNTSLEECYYKNT; | NTSLEECYYKNTQ; | TSLEECYYKNTQN; |
| | SLEECYYKNTQNE; | LEECYYKNTQNEA; | EECYYKNTQNEAL; |
| | ECYYKNTQNEALK; | CYYKNTQNEALKK; | YYKNTQNEALKKW; |
| | YKNTQNEALKKWI; | KNTQNEALKKWIL; | NTQNEALKKWILE; |
| | TQNEALKKWILEI; | QNEALKKWILEIV; | NEALKKWILEIVR; |
| | EALKKWILEIVRN; | ALKKWILEIVRNK; | LKKWILEIVRNKF; |
| | KKWILEIVRNKFI; | KWILEIVRNKFIQ; | WILEIVRNKFIQI; |
| | ILEIVRNKFIQIS; | LEIVRNKFIQISK; | EIVRNKFIQISKE; |
| | IVRNKFIQISKEA; | VRNKFIQISKEAN; | RNKFIQISKEANL; |
| | NKFIQISKEANLN; | KFIQISKEANLNT; | FIQISKEANLNTK; |
| | IQISKEANLNTKK; | QISKEANLNTKKL; | ISKEANLNTKKLG; |
| | SKEANLNTKKLGT; | KEANLNTKKLGTT; | EANLNTKKLGTTY; |
| | ANLNTKKLGTTYK; | NLNTKKLGTTYKL; | LNTKKLGTTYKLK; |
| | NTKKLGTTYKLKS; | TKKLGTTYKLKSS; | KKLGTTYKLKSSN; |
| | KLGTTYKLKSSNF; | LGTTYKLKSSNFL; | GTTYKLKSSNFLK; |
| | TTYKLKSSNFLKL; | TYKLKSSNFLKLT; | YKLKSSNFLKLTE; |
| | KLKSSNFLKLTET; | LKSSNFLKLTETQ; | KSSNFLKLTETQK; |
| | SSNFLKLTETQKS; | SNFLKLTETQKSP; | NFLKLTETQKSPY; |
| | FLKLTETQKSPYY; | LKLTETQKSPYYS; | KLTETQKSPYYSQ; |
| | LTETQKSPYYSQE; | TETQKSPYYSQEK; | ETQKSPYYSQEKK; |
| | TQKSPYYSQEKKD; | QKSPYYSQEKKDI; | KSPYYSQEKKDIY; |
| | SPYYSQEKKDIYK; | PYYSQEKKDIYKQ; | YYSQEKKDIYKQI; |
| | YSQEKKDIYKQII; | SQEKKDIYKQIIL; | QEKKDIYKQIILN; |
| | EKKDIYKQIILNF; | KKDIYKQIILNFS; | KDIYKQIILNFSS; |
| | DIYKQIILNFSSN; | IYKQIILNFSSNI; | YKQIILNFSSNIK; |
| | KQIILNFSSNIKL; | QIILNFSSNIKLD; | IILNFSSNIKLDS; |
| | ILNFSSNIKLDSL; | LNFSSNIKLDSLE; | NFSSNIKLDSLEQ; |
| | FSSNIKLDSLEQT; | SSNIKLDSLEQTI; | SNIKLDSLEQTID; |
| | NIKLDSLEQTIDL; | IKLDSLEQTIDLL; | KLDSLEQTIDLLV; |
| | LDSLEQTIDLLVA; | DSLEQTIDLLVAV; | SLEQTIDLLVAVR; |
| | LEQTIDLLVAVRN; | EQTIDLLVAVRNR; | QTIDLLVAVRNRK; |

NKTIPKKIIKIQK; KTIPKKIIKIQKI; TIPKKIIKIQKID;
TIPKKIIKIQKIDP; IPKKIIKIQKIDPK; PKKIIKIQKIDPKQ;
KKIIKIQKIDPKQL; KIIKIQKIDPKQLD; IIKIQKIDPKQLDY;
IKIQKIDPKQLDYQ; KIQKIDPKQLDYQK; IQKIDPKQLDYQKS;
QKIDPKQLDYQKSY; KIDPKQLDYQKSYL; IDPKQLDYQKSYLL;
DPKQLDYQKSYLLT

| | |
|---|---|
| | VELKNNRKIKSNEKNS; ELKNNRKIKSNEKNSL; LKNNRKIKSNEKNSLL; KNNRKIKSNEKNSLLE; NNRKIKSNEKNSLLEF; NRKIKSNEKNSLLEFI; RKIKSNEKNSLLEFIS; KIKSNEKNSLLEFISF; IKSNEKNSLLEFISFF; KSNEKNSLLEFISFFK; SNEKNSLLEFISFFKT; NEKNSLLEFISFFKTK; EKNSLLEFISFFKTKL; KNSLLEFISFFKTKLK; NSLLEFISFFKTKLKQ; SLLEFISFFKTKLKQK; LLEFISFFKTKLKQKI; LEFISFFKTKLKQKIN; EFISFFKTKLKQKINF; FISFFKTKLKQKINFK; ISFFKTKLKQKINFKK; SFFKTKLKQKINFKKE; FFKTKLKQKINFKKEL; FKTKLKQKINFKKELM; KTKLKQKINFKKELMK; TKLKQKINFKKELMKS; KLKQKINFKKELMKSK; LKQKINFKKELMKSKG; KQKINFKKELMKSKGI; |
| SEQ ID NO:29 SEQ ID NO: 106907-107912 | 13 mers: MITQQDYTEIKKK; ITQQDYTEIKKKL; TQQDYTEIKKKLE; QQDYTEIKKKLEN; QDYTEIKKKLENT; DYTEIKKKLENTK; YTEIKKKLENTKT; TEIKKKLENTKTR; EIKKKLENTKTRI; IKKKLENTKTRIQ; KKKLENTKTRIQF; KKLENTKTRIQFR; KLENTKTRIQFRN; LENTKTRIQFRNG; ENTKTRIQFRNGN; NTKTRIQFRNGNK; TKTRIQFRNGNKI; KTRIQFRNGNKID; TRIQFRNGNKIDS; RIQFRNGNKIDSL; IQFRNGNKIDSLG; QFRNGNKIDSLGY; FRNGNKIDSLGYQ; RNGNKIDSLGYQG; NGNKIDSLGYQGS; GNKIDSLGYQGSL; NKIDSLGYQGSLG; KIDSLGYQGSLGE; IDSLGYQGSLGEP; DSLGYQGSLGEPI; SLGYQGSLGEPIL; LGYQGSLGEPILL; GYQGSLGEPILLK; YQGSLGEPILLKD; QGSLGEPILLKDK; GSLGEPILLKDKL; SLGEPILLKDKLT; LGEPILLKDKLTF; GEPILLKDKLTFS; EPILLKDKLTFSI; PILLKDKLTFSIC; ILLKDKLTFSICD; LLKDKLTFSICDG; LKDKLTFSICDGK; KDKLTFSICDGKN; DKLTFSICDGKNI; KLTFSICDGKNID; LTFSICDGKNIDN; TFSICDGKNIDNR; FSICDGKNIDNRK; SICDGKNIDNRKE; ICDGKNIDNRKEY; CDGKNIDNRKEYE; DGKNIDNRKEYEI; GKNIDNRKEYEIT; KNIDNRKEYEITK; NIDNRKEYEITKN; IDNRKEYEITKNA; DNRKEYEITKNAP; NRKEYEITKNAPS; RKEYEITKNAPSL; KEYEITKNAPSLD; EYEITKNAPSLDS; YEITKNAPSLDSL; EITKNAPSLDSLI; ITKNAPSLDSLIE; TKNAPSLDSLIEY; KNAPSLDSLIEYL; NAPSLDSLIEYLE; APSLDSLIEYLEH; PSLDSLIEYLEHM; SLDSLIEYLEHMI; LDSLIEYLEHMIL; DSLIEYLEHMILF; SLIEYLEHMILFF; LIEYLEHMILFFL; IEYLEHMILFFLE; EYLEHMILFFLEK; YLEHMILFFLEKT; LEHMILFFLEKTP; EHMILFFLEKTPV; HMILFFLEKTPVG; MILFFLEKTPVGT; ILFFLEKTPVGTL; LFFLEKTPVGTLT; FFLEKTPVGTLTA; FLEKTPVGTLTAK; LEKTPVGTLTAKF; EKTPVGTLTAKFA; KTPVGTLTAKFAM; TPVGTLTAKFAME; PVGTLTAKFAMEG; VGTLTAKFAMEGS; GTLTAKFAMEGSI; TLTAKFAMEGSIL; LTAKFAMEGSILT; TAKFAMEGSILTR; AKFAMEGSILTRS; KFAMEGSILTRSK; FAMEGSILTRSKL; AMEGSILTRSKLI; MEGSILTRSKLIQ; EGSILTRSKLIQA; GSILTRSKLIQAF; SILTRSKLIQAFT; ILTRSKLIQAFTN; LTRSKLIQAFTNT; TRSKLIQAFTNTN; RSKLIQAFTNTNK; SKLIQAFTNTNKF; KLIQAFTNTNKFC; LIQAFTNTNKFCI; IQAFTNTNKFCIP; QAFTNTNKFCIPD; |

Fig. 33 continued

AFTNKFCIPDQ; FTNKFCIPDQR; TNKFCIPDQRS;
NKFCIPDQRSL; KFCIPDQRSLP; FCIPDQRSLPS;
CIPDQRSLPSN; IPDQRSLPSNC; PDQRSLPSNCY;
DQRSLPSNCYA; QRSLPSNCYAY; RSLPSNCYAYK;
SLPSNCYAYKV; LPSNCYAYKVL; PSNCYAYKVLG;
SNCYAYKVLGT; NCYAYKVLGTS; CYAYKVLGTSS;
YAYKVLGTSSA; AYKVLGTSSAP; YKVLGTSSAPK;
KVLGTSSAPKL; VLGTSSAPKLS; LGTSSAPKLSG;
GTSSAPKLSGR; TSSAPKLSGRF; SSAPKLSGRFL;
SAPKLSGRFLR; APKLSGRFLRH; PKLSGRFLRHY;
KLSGRFLRHYD; LSGRFLRHYDS; SGRFLRHYDSG;
GRFLRHYDSGG; RFLRHYDSGGS; FLRHYDSGGST;
LRHYDSGGSTD; RHYDSGGSTDS; HYDSGGSTDSD;
YDSGGSTDSDG; DSGGSTDSDGT; SGGSTDSDGTR;
GGSTDSDGTRS; GSTDSDGTRSL; STDSDGTRSLG;
TDSDGTRSLGH; DSDGTRSLGHT; SDGTRSLGHTQ;
DGTRSLGHTQE; GTRSLGHTQED; TRSLGHTQEDS;
RSLGHTQEDSY; SLGHTQEDSYK; LGHTQEDSYKN;
GHTQEDSYKNH; HTQEDSYKNHD; TQEDSYKNHDL;
QEDSYKNHDLE; EDSYKNHDLEF; DSYKNHDLEFS;
SYKNHDLEFSR; YKNHDLEFSRI; KNHDLEFSRIN;
NHDLEFSRINF; HDLEFSRINFK; DLEFSRINFKG;
LEFSRINFKGK; EFSRINFKGKL; FSRINFKGKLV;
SRINFKGKLVK; RINFKGKLVKR; INFKGKLVKRM;
NFKGKLVKRMT; FKGKLVKRMTM; KGKLVKRMTML;
GKLVKRMTMLY; KLVKRMTMLYR; LVKRMTMLYRS;
VKRMTMLYRSA; KRMTMLYRSAD; RMTMLYRSADT;
MTMLYRSADTW; TMLYRSADTWY; MLYRSADTWYT;
LYRSADTWYTW; YRSADTWYTWW; RSADTWYTWWA;
SADTWYTWWAE; ADTWYTWWAEE; DTWYTWWAEEL;
TWYTWWAEELM; WYTWWAEELMS; YTWWAEELMSP;
TWWAEELMSPF; WWAEELMSPFI; WAEELMSPFIT;
AEELMSPFITG; EELMSPFITGY; ELMSPFITGYS;
LMSPFITGYSY; MSPFITGYSYE; SPFITGYSYEE;
PFITGYSYEEI; FITGYSYEEID; ITGYSYEEIDP;
TGYSYEEIDPE; GYSYEEIDPEY; YSYEEIDPEYL;
SYEEIDPEYLL; YEEIDPEYLLP; EEIDPEYLLPP;
EIDPEYLLPPT; IDPEYLLPPTS; DPEYLLPPTSQ;
PEYLLPPTSQS; EYLLPPTSQSG; YLLPPTSQSGS;
LLPPTSQSGSK; LPPTSQSGSKE; PPTSQSGSKET;
PTSQSGSKETK; TSQSGSKETKP; SQSGSKETKPK;
QSGSKETKPKN; SGSKETKPKNT; GSKETKPKNTC;
SKETKPKNTCY; KETKPKNTCYI; ETKPKNTCYIS;
TKPKNTCYISF; KPKNTCYISFY; PKNTCYISFYR;
KNTCYISFYRD;

14 mers:
NLTQQDYTFIKKKL; LTQQDYTFIKKKLE; TQQDYTFIKKKLEN;
QQDYTFIKKKLENT; QDYTFIKKKLENTK; DYTFIKKKLENTKT;

GSTDSDGTRSLGHT; STDSDGTRSLGHTQ; TDSDGTRSLGHTQE;
DSDGTRSLGHTQED; SDGTRSLGHTQEDS; DGTRSLGHTQEDSY;
GTRSLGHTQEDSYK; TRSLGHTQEDSYKN; RSLGHTQEDSYKNH;
SLGHTQEDSYKNHD; LGHTQEDSYKNHDH; GHTQEDSYKNHDHD;
HTQEDSYKNHDHDL; TQEDSYKNHDHDLD; QEDSYKNHDHDLDF;
EDSYKNHDHDLDFS; DSYKNHDHDLDFSR; SYKNHDHDLDFSRT;
YKNHDHDLDFSRTN; KNHDHDL

| | | |
|---|---|---|
| CKIDNRKEYEITKN; | KIDNRKEYEITKNA; | IDNRKEYEITKNAP; |
| DNRKEYEITKNAPS; | NRKEYEITKNAPSL; | RKEYEITKNAPSLD; |
| KEYEITKNAPSLDS; | EYEITKNAPSLDSL; | YEITKNAPSLDSLI; |
| EITKNAPSLDSLIE; | ITKNAPSLDSLIEY; | TKNAPSLDSLIEYL; |
| KNAPSLDSLIEYLE; | NAPSLDSLIEYLEH; | APSLDSLIEYLEHM; |
| PSLDSLIEYLEHMI; | SLDSLIEYLEHMII; | LDSLIEYLEHMIIF; |
| DSLIEYLEHMIIFF; | SLIEYLEHMIIFFL; | LIEYLEHMIIFFLE; |
| IEYLEHMIIFFLEK; | EYLEHMIIFFLEKT; | YLEHMIIFFLEKTP; |
| LEHMIIFFLEKTPV; | EHMIIFFLEKTPVG; | HMIIFFLEKTPVGT; |
| MIIFFLEKTPVGTL; | IIFFLEKTPVGTLT; | IFFLEKTPVGTLTA; |
| FFLEKTPVGTLTAK; | FLEKTPVGTLTAKF; | LEKTPVGTLTAKFA; |
| EKTPVGTLTAKFAM; | KTPVGTLTAKFAME; | TPVGTLTAKFAMEG; |
| PVGTLTAKFAMEGS; | VGTLTAKFAMEGST; | GTLTAKFAMEGSTL; |
| TLTAKFAMEGSTLT; | LTAKFAMEGSTLTR; | TAKFAMEGSTLTRS; |
| AKFAMEGSLLTRSK; | KFAMEGSLLTRSKL; | FAMEGSLLTRSKLI; |
| AMEGSLLTRSKLIQ; | MEGSLLTRSKLIQA; | EGSLLTRSKLIQAF; |
| GSLLTRSKLIQAFT; | SLLTRSKLIQAFTN; | LTRSKLIQAFTNT; |
| LTRSKLIQAFTNTK; | TRSKLIQAFTNTKF; | RSKLIQAFTNTKFC; |
| SKLIQAFTNTKFCI; | KLIQAFTNTKFCIP; | LIQAFTNTKFCIPD; |
| IQAFTNTKFCIPDG; | QAFTNTKFCIPDGR; | AFTNTKFCIPDGRS; |
| FTNTKFCIPDGRSL; | TNTKFCIPDGRSLP; | NTKFCIPDGRSLPS; |
| TKFCIPDGRSLPSK; | KFCIPDGRSLPSKC; | FCIPDGRSLPSKCY; |
| CIPDGRSLPSKCYA; | IPDGRSLPSKCYAY; | PDGRSLPSKCYAYK; |
| DGRSLPSKCYAYKV; | GRSLPSKCYAYKVL; | RSLPSKCYAYKVLG; |
| SLPSKCYAYKVLGT; | LPSKCYAYKVLGTS; | PSKCYAYKVLGTSS; |
| SKCYAYKVLGTSSA; | KCYAYKVLGTSSAP; | CYAYKVLGTSSAPK; |
| YAYKVLGTSSAPKL; | AYKVLGTSSAPKLS; | YKVLGTSSAPKLSG; |
| KVLGTSSAPKLSGR; | VLGTSSAPKLSGRF; | LGTSSAPKLSGRFL; |
| GTSSAPKLSGRFLR; | TSSAPKLSGRFLRH; | SSAPKLSGRFLRHY; |
| SAPKLSGRFLRHYD; | APKLSGRFLRHYDS; | PKLSGRFLRHYDSG; |
| KLSGRFLRHYDSGG; | LSGRFLRHYDSGGS; | SGRFLRHYDSGGST; |
| GRFLRHYDSGGSTD; | RFLRHYDSGGSTDS; | FLRHYDSGGSTDSD; |
| LRHYDSGGSTDSDG; | RHYDSGGSTDSDGT; | HYDSGGSTDSDGTR; |
| YDSGGSTDSDGTRS; | DSGGSTDSDGTRSL; | SGGSTDSDGTRSLG; |
| GGSTDSDGTRSLGH; | GSTDSDGTRSLGHT; | STDSDGTRSLGHTQ; |
| TDSDGTRSLGHTQE; | DSDGTRSLGHTQED; | SDGTRSLGHTQEDS; |
| DGTRSLGHTQEDSY; | GTRSLGHTQEDSYK; | TRSLGHTQEDSYKN; |
| RSLGHTQEDSYKNH; | SLGHTQEDSYKNHD; | LGHTQEDSYKNHDD; |
| GHTQEDSYKNHDDL; | HTQEDSYKNHDDLD; | TQEDSYKNHDDLDF; |
| QEDSYKNHDDLDFS; | EDSYKNHDDLDFSR; | DSYKNHDDLDFSRI; |
| SYKNHDDLDFSRIK; | YKNHDDLDFSRIKF; | KNHDDLDFSRIKFK; |
| NHDDLDFSRIKFKG; | HDDLDFSRIKFKGK; | DDLDFSRIKFKGKL; |
| DLDFSRIKFKGKLV; | LDFSRIKFKGKLVK; | DFSRIKFKGKLVKR; |
| FSRIKFKGKLVKRM; | SRIKFKGKLVKRMT; | RIKFKGKLVKRMTM; |
| IKFKGKLVKRMTMI; | KFKGKLVKRMTMIY; | FKGKLVKRMTMIYR; |
| KGKLVKRMTMIYRS; | GKLVKRMTMIYRSA; | KLVKRMTMIYRSAD; |
| LVKRMTMIYRSADT; | VKRMTMIYRSADTW; | KRMTMIYRSADTWY; |
| RMTMIYRSADTWYT; | MTMIYRSADTWYTW; | TMIYRSADTWYTWW; |
| MIYRSADTWYTWWA; | IYRSADTWYTWWAE; | YRSADTWYTWWAEE; |
| RSADTWYTWWAEET; | SADTWYTWWAEETM; | ADTWYTWWAEETMS; |

Fig. 33 continued

DTWYKYWAEEIMSP; TWYKYWAEEIMSPE; WYKYWAEEIMSPEI;
YKYWAEEIMSPEIT; KYWAEEIMSPEITG; YWAEEIMSPEITGY;
WAEEIMSPEITGYS; AEEIMSPEITGYSY; EEIMSPEITGYSYE;
EIMSPEITGYSYEE; IMSPEITGYSYEEI; MSPEITGYSYEEID;
SPEITGYSYEEIDP; PEITGYSYEEIDPE; EITGYSYEEIDPEY;
ITGYSYEEIDPEYL; TGYSYEEIDPEYLL; GYSYEEIDPEYLLP;
YSYEEIDPEYLLPP; SYEEIDPEYLLPPT; YEEIDPEYLLPPTS;
EEIDPEYLLPPTSQ; EIDPEYLLPPTSQS; IDPEYL

Fig. 33 continued

| SEQ ID NO:30 SEQ ID NO: 107913-109286 | 13 mers:<br>MDLLDLLEKEKQI; DLLDLLEKEKQIN; LLDLLEKEKQINK;<br>LDLLEKEKQINKN; DLLEKEKQINKNK; LLEKEKQINKNKG;<br>LEKEKQINKNKGV; EKEKQINKNKGVF; KEKQINKNKGVFM;<br>EKQINKNKGVFMT; KQINKNKGVFMTK; QINKNKGVFMTKP;<br>INKNKGVFMTKPK; NKNKGVFMTKPKI; KNKGVFMTKPKIF;<br>NKGVFMTKPKIFS; KGVFMTKPKIFSI; GVFMTKPKIFSIN;<br>VFMTKPKIFSINK; FMTKPKIFSINKE; MTKPKIFSINKEK;<br>TKPKIFSINKEKI; KPKIFSINKEKIK; PKIFSINKEKIKI;<br>KIFSINKEKIKIL; IFSINKEKIKILI; FSINKEKIKILII;<br>SINKEKIKILIIV; INKEKIKILIIVV; NKEKIKILIIVVL;<br>KEKIKILIIVVLT; EKIKILIIVVLTS; KIKILIIVVLTST;<br>IKILIIVVLTSTF; KILIIVVLTSTFL; ILIIVVLTSTFLL;<br>LIIVVLTSTFLLG; IIVVLTSTFLLGI; IVVLTSTFLLGII;<br>VVLTSTFLLGIIF; VLTSTFLLGIIFS; LTSTFLLGIIFSN;<br>TSTFLLGIIFSNE; STFLLGIIFSNEN; TFLLGIIFSNENK;<br>FLLGIIFSNENKV; LLGIIFSNENKVA; LGIIFSNENKVAR;<br>GIIFSNENKVARI; IIFSNENKVARIL; IFSNENKVARILE;<br>FSNENKVARILEE; SNENKVARILEEK; NENKVARILEEKF;<br>ENKVARILEEKFF; NKVARILEEKFFD; KVARILEEKFFDF;<br>VARILEEKFFDFD; ARILEEKFFDFDF; RILEEKFFDFDFN;<br>ILEEKFFDFDFNL; LEEKFFDFDFNLI; EEKFFDFDFNLIS;<br>EKFFDFDFNLISK; KFFDFDFNLISKI; FFDFDFNLISKIE;<br>FDFDFNLISKIET; DFDFNLISKIETE; FDFNLISKIETEL;<br>DFNLISKIETELE; FNLISKIETELEG; NLISKIETELEGT;<br>LISKIETELEGTL; ISKIETELEGTLT; SKIETELEGTLTK;<br>KIETELEGTLTKL; IETELEGTLTKLG; ETELEGTLTKLGK;<br>TELEGTLTKLGKD; ELEGTLTKLGKDW; LEGTLTKLGKDWI;<br>EGTLTKLGKDWIL; GTLTKLGKDWILT; TLTKLGKDWILTY;<br>LTKLGKDWILTYN; TKLGKDWILTYNK; KLGKDWILTYNKQ;<br>LGKDWILTYNKQN; GKDWILTYNKQNI; KDWILTYNKQNIP;<br>DWILTYNKQNIPV; WILTYNKQNIPVD; ILTYNKQNIPVDN;<br>LTYNKQNIPVDNK; TYNKQNIPVDNKK; YNKQNIPVDNKKV;<br>NKQNIPVDNKKVN; KQNIPVDNKKVNS; QNIPVDNKKVNSL;<br>NIPVDNKKVNSLI; IPVDNKKVNSLIK; PVDNKKVNSLIKA;<br>VDNKKVNSLIKAL; DNKKVNSLIKALD; NKKVNSLIKALDE;<br>KKVNSLIKALDEL; KVNSLIKALDELQ; VNSLIKALDELQK;<br>NSLIKALDELQKN; SLIKALDELQKNK; LIKALDELQKNKL;<br>IKALDELQKNKLV; KALDELQKNKLVS; ALDELQKNKLVSR;<br>LDELQKNKLVSRD; DELQKNKLVSRDQ; ELQKNKLVSRDQK;<br>LQKNKLVSRDQKK; QKNKLVSRDQKKH; KNKLVSRDQKKHK;<br>NKLVSRDQKKHKE; KLVSRDQKKHKEL; LVSRDQKKHKELG;<br>VSRDQKKHKELGI; SRDQKKHKELGIG; RDQKKHKELGIGE;<br>DQKKHKELGIGEN; QKKHKELGIGENP; KKHKELGIGENPS;<br>KHKELGIGENPSF; HKELGIGENPSFK; KELGIGENPSFKL;<br>ELGIGENPSFKLF; LGIGENPSFKLFD; GIGENPSFKLFDN;<br>IGENPSFKLFDNN; GENPSFKLFDNNN; ENPSFKLFDNNNK;<br>NPSFKLFDNNNKL; PSFKLFDNNNKLL; SFKLFDNNNKLLT;<br>FKLFDNNNKLLTE; KLFDNNNKLLTEI; LFDNNNKLLTEIF;<br>FDNNNKLLTEIFV; DNNNKLLTEIFVG; NNNKLLTEIFVGK; |

Fig. 33 continued

| | | |
|---|---|---|
| DKLLTEIFVGKS; | KLLTEIFVGKSG; | LLTEIFVGKSGE; |
| LTEIFVGKSGEG; | TEIFVGKSGEGD; | EIFVGKSGEGDS; |
| IFVGKSGEGDSR; | FVGKSGEGDSRL; | VGKSGEGDSRLA; |
| GKSGEGDSRLAY; | KSGEGDSRLAYI; | SGEGDSRLAYIK; |
| GEGDSRLAYIKG; | EGDSRLAYIKGS; | GDSRLAYIKGSD; |
| DSRLAYIKGSDE; | SRLAYIKGSDEK; | RLAYIKGSDEKV; |
| LAYIKGSDEKVY; | AYIKGSDEKVYL; | YIKGSDEKVYLT; |
| IKGSDEKVYLTK; | KGSDEKVYLTKN; | GSDEKVYLTKNI; |
| SDEKVYLTKNIF; | DEKVYLTKNIFL; | EKVYLTKNIFLS; |
| KVYLTKNIFLSY; | VYLTKNIFLSYK; | YLTKNIFLSYKG; |
| LTKNIFLSYKGN; | TKNIFLSYKGNS; | KNIFLSYKGNSY; |
| NIFLSYKGNSYN; | IFLSYKGNSYNT; | FLSYKGNSYNTF; |
| LSYKGNSYNTFS; | SYKGNSYNTFSD; | YKGNSYNTFSDT; |
| KGNSYNTFSDTL; | GNSYNTFSDTLF; | NSYNTFSDTLFQ; |
| SYNTFSDTLFQE; | YNTFSDTLFQEK; | NTFSDTLFQEKN; |
| TFSDTLFQEKNT; | FSDTLFQEKNTK; | SDTLFQEKNTKL; |
| DTLFQEKNTKLE; | TLFQEKNTKLEN; | LFQEKNTKLENL; |
| FQEKNTKLENLS; | QEKNTKLENLSF; | EKNTKLENLSFK; |
| KNTKLENLSFKI; | NTKLENLSFKII; | TKLENLSFKIIR; |
| KLENLSFKIIRK; | LENLSFKIIRKL; | ENLSFKIIRKLE; |
| NLSFKIIRKLEK; | LSFKIIRKLEKE; | SFKIIRKLEKEN; |
| FKIIRKLEKENK; | KIIRKLEKENKI; | IIRKLEKENKIN; |
| IRKLEKENKINK; | RKLEKENKINKY; | KLEKENKINKYE; |
| LEKENKINKYEL; | EKENKINKYELI; | KENKINKYELIS; |
| ENKINKYELISK; | NKINKYELISKD; | KINKYELISKDG; |
| INKYELISKDGL; | NKYELISKDGLY; | KYELISKDGLYF; |
| YELISKDGLYFL; | ELISKDGLYFLN; | LISKDGLYFLNQ; |
| ISKDGLYFLNQK; | SKDGLYFLNQKM; | KDGLYFLNQKMT; |
| DGLYFLNQKMTK; | GLYFLNQKMTKE; | LYFLNQKMTKER; |
| YFLNQKMTKERP; | FLNQKMTKERPL; | LNQKMTKERPLN; |
| NQKMTKERPLNI; | QKMTKERPLNIA; | KMTKERPLNIAE; |
| MTKERPLNIAEF; | TKERPLNIAEFK; | KERPLNIAEFKA; |
| ERPLNIAEFKAD; | RPLNIAEFKADG; | PLNIAEFKADGL; |
| LNIAEFKADGLE; | NIAEFKADGLET; | IAEFKADGLETD; |
| AEFKADGLETDK; | EFKADGLETDKS; | FKADGLETDKSK; |
| KADGLETDKSKI; | ADGLETDKSKID; | DGLETDKSKIDD; |
| GLETDKSKIDDY; | LETDKSKIDDYN; | ETDKSKIDDYNL; |
| TDKSKIDDYNLQ; | DKSKIDDYNLQY; | KSKIDDYNLQYK; |
| SKIDDYNLQYKI; | KIDDYNLQYKIE; | IDDYNLQYKIEV; |
| DDYNLQYKIEVK; | DYNLQYKIEVKW; | YNLQYKIEVKWS; |
| NLQYKIEVKWSN; | LQYKIEVKWSNK; | QYKIEVKWSNKS; |
| YKIEVKWSNKSV; | KIEVKWSNKSVN; | IEVKWSNKSVNK; |
| EVKWSNKSVNKI; | VKWSNKSVNKIE; | KWSNKSVNKIEV; |
| WSNKSVNKIEVY; | SNKSVNKIEVYF; | NKSVNKIEVYFN; |
| KSVNKIEVYFNK; | SVNKIEVYFNKN; | VNKIEVYFNKNE; |
| NKIEVYFNKNEE; | KIEVYFNKNEED; | IEVYFNKNEEDK; |
| EVYFNKNEEDKD; | VYFNKNEEDKDI; | YFNKNEEDKDIL; |
| FNKNEEDKDILL; | NKNEEDKDILLK; | KNEEDKDILLKD; |
| NEEDKDILLKDK; | EEDKDILLKDKT; | EDKDILLKDKTL; |

Fig. 33 continued

ENDKEILKKDKD; KDKDILKKDKDY; DKDILKKDKDEY;
RDILLKKDKDEYY; DILLKKDKDEYYY; ILLKKDKDEYYYT;
LLKKDKDEYYYT; LKKDKDEYYYTS; KKDKDEYYYTSK;
KDKDEYYYTSKW; DKDEYYYTSKWT; KDEYYYTSKWTE;
DEYYYTSKWTEF; EYYYTSKWTEFD; YYYTSKWTEFDV;
YYTSKWTEFDVF; YTSKWTEFDVFD; TSKWTEFDVFDL;
FSKWTEFDVFDLE; SKWTEFDVFDLEK; KWTEFDVFDLEKK;
WTEFDVFDLEKKL; TEFDVFDLEKKLT; EFDVFDLEKKLTE;
FDVFDLEKKLTEK; DVFDLEKKLTEKD; VFDLEKKLTEKDD;
FDLEKKLTEKDDT; DLEKKLTEKDDTS; LEKKLTEKDDTSS;
EKKLTEKDD

Fig. 33 continued

IAEFKADGLEIDKS; AEFKADGLEIDKSK; FKADGLEIDKSKI;
FKADGLETDKSKTD; KADGLETDKSKTDD; ADGLETDKSKTDDY;
DGLETDKSKTDDYN; GLETDKSKTDDYNL; LETDKSKTDDYNLQ;
ETDKSKTDDYNLQY; TDKSKTDDYNLQYK; DKSKTDDYNLQYKI;
KSKTDDYNLQYKIE; SKTDDYNLQYKIEV; KTDDYNLQYKIEVK;
TDDYNLQYKIEVKW; DDYNLQYKIEVKWS;

| | | |
|---|---|---|
| LNKNKCVFMTKPKIFS; | KKKKCVFMTKPKIFSL; | KNKCVFMTKPKIFSLK; |
| NKGVFMTKPKIFSTNK; | KGVFMTKPKIFSTNKF; | GVFMTKPKIFSTNKFK; |
| VFMTKPKIFSTNKFKI; | FMTKPKIFSTNKFKIK; | MTKPKIFSTNKFKIKI; |
| TKPKIFSTNKFKIKIL; | KPKIFSTNKFKIKILL; | PKIFSTNKFKIKILLI; |
| KIFSTNKFKIKILLIV; | IFSTNKFKIKILLIVV; | FSTNKFKIKILLIVVL; |
| STNKFKIKILLIVVLT; | TNKFKIKILLIVVLTS; | NKFKIKILLIVVLTST; |
| KFKIKILLIVVLTSTF; | FKIKILLIVVLTSTFL; | KIKILLIVVLTSTFLL; |
| IKILLIVVLTSTFLLG; | KILLIVVLTSTFLLGI; | ILLIVVLTSTFLLGII; |
| LIVVLTSTFLLGIIF; | IVVLTSTFLLGIIFS; | VVLTSTFLLGIIFSK; |
| VVLTSTFLLGIIFSNE; | VLTSTFLLGIIFSNEK; | LTSTFLLGIIFSNEKV; |
| TSTFLLGIIFSNEKKV; | STFLLGIIFSNEKVA; | TFLLGIIFSNEKVAR; |
| FLLGIIFSNEKVARI; | LLGIIFSNEKVARIL; | LGIIFSNEKVARILE; |
| GIIFSNEKVARILEE; | IIFSNEKVARILEEK; | IFSNEKVARILEEKF; |
| FSNEKVARILEEKFF; | SNEKVARILEEKFD; | NEKVARILEEKFDF; |
| EKVARILEEKFDFD; | KVARILEEKFDFDF; | KVARILEEKFDFDFN; |
| VARILEEKFDFDFNL; | ARILEEKFDFDFNLI; | RILEEKFDFDFNLIS; |
| ILEEKFDFDFNLISK; | LEEKFDFDFNLISKI; | EEKFDFDFNLISKIE; |
| EKFDFDFNLISKIET; | KFDFDFNLISKIETE; | FDFDFNLISKIETEL; |
| DFDFNLISKIETELG; | FDFNLISKIETELGG; | DFNLISKIETELGGL; |
| FNLISKIETELGTL; | NLISKIETELGTLT; | LISKIETELGTLTK; |
| ISKIETELGTLTKI; | SKIETELGTLTKIG; | KIETELGTLTKIGK; |
| IETELGTLTKIGKD; | ETELGTLTKIGKDW; | TELGTLTKIGKDWI; |
| ELGTLTKIGKDWIL; | LGTLTKIGKDWILT; | GTLTKIGKDWILTY; |
| TLTKIGKDWILTYK; | LTKIGKDWILTYKQ; | TKIGKDWILTYKQN; |
| KIGKDWILTYKQNI; | IGKDWILTYKQNIP; | GKDWILTYKQNIPV; |
| KDWILTYKQNIPVD; | DWILTYKQNIPVDK; | WILTYKQNIPVDKK; |
| ILTYKQNIPVDKKV; | LTYKQNIPVDKKVN; | TYKQNIPVDKKVNS; |
| YKQNIPVDKKVNSL; | KQNIPVDKKVNSLI; | QNIPVDKKVNSLIK; |
| NIPVDKKVNSLIKA; | IPVDKKVNSLIKAL; | PVDKKVNSLIKALD; |
| VDKKVNSLIKALDE; | DKKVNSLIKALDEL; | KKVNSLIKALDELQ; |
| KVNSLIKALDELQK; | VNSLIKALDELQKN; | NSLIKALDELQKNK; |
| SLIKALDELQKNKI; | LIKALDELQKNKIV; | IKALDELQKNKIVS; |
| KALDELQKNKIVSR; | ALDELQKNKIVSRD; | LDELQKNKIVSRDQ; |
| DELQKNKIVSRDQK; | ELQKNKIVSRDQKK; | LQKNKIVSRDQKKH; |
| QKNKIVSRDQKKHK; | KNKIVSRDQKKHKE; | NKIVSRDQKKHKEL; |
| KIVSRDQKKHKELG; | IVSRDQKKHKELGT; | VSRDQKKHKELGTG; |
| SRDQKKHKELGTGE; | RDQKKHKELGTGEN; | DQKKHKELGTGENP; |
| QKKHKELGTGENPS; | KKHKELGTGENPSF; | KHKELGTGENPSFK; |
| HKELGTGENPSFKL; | KELGTGENPSFKLF; | ELGTGENPSFKLFD; |
| LGTGENPSFKLFDN; | GTGENPSFKLFDNK; | TGENPSFKLFDNKK; |
| GENPSFKLFDNKKL; | ENPSFKLFDNKKLI; | NPSFKLFDNKKLIT; |
| PSFKLFDNKKLITE; | SFKLFDNKKLITEF; | FKLFDNKKLITEFV; |
| KLFDNKKLITEFVG; | LFDNKKLITEFVGK; | FDNKKLITEFVGKS; |
| DNKKLITEFVGKSG; | NKKLITEFVGKSGG; | KKLITEFVGKSGGD; |
| KLITEFVGKSGGDS; | LITEFVGKSGGDSR; | ITEFVGKSGGDSRL; |
| TEFVGKSGGDSRLA; | EFVGKSGGDSRLAY; | FVGKSGGDSRLAYI; |
| VGKSGGDSRLAYIK; | GKSGGDSRLAYIKG; | KSGGDSRLAYIKGS; |
| SGGDSRLAYIKGSD; | GGDSRLAYIKGSDE; | GDSRLAYIKGSDEN; |
| DSRLAYIKGSDENV; | SRLAYIKGSDENVY; | RLAYIKGSDENVYI; |

|  | TSKWTFFDVFDLEKKL; SKWTFFDVFDLEKKLT; KWTFFDVFDLEKKLTE; WTFFDVFDLEKKLTEK; TFFDVFDLEKKLTEKD; FFDVFDLEKKLTEKDD; FDVFDLEKKLTEKDDI; DVFDLEKKLTEKDDIS; VFDLEKKLTEKDDISS; FDLEKKLTEKDDISSN; DLEKKLTEKDDISSND; LEKKLTEKDDISSNDN; EKKLTEKDDISSNDNQ; KKLTEKDDISSNDNQE; KLTEKDDISSNDNQED; LTEKDDISSNDNQEDH; TEKDDISSNDNQEDHH; EKDDISSNDNQEDHHE; KDDISSNDNQEDHHEH; DDISSNDNQEDHHEHH; DISSNDNQEDHHEHHN; ISSNDNQEDHHEHHNN; SSNDNQEDHHEHHNNA; SNDNQEDHHEHHNNAD; |
| SEQ ID NO:31 SEQ ID NO: 109287-109852 | 13 mers: MKKLIIFTLFLS; KKLIIFTLFLSQ; KLIIFTLFLSQA; LIIFTLFLSQAC; IIFTLFLSQACN; IFTLFLSQACNL; IFTLFLSQACNLS; FTLFLSQACNLST; TLFLSQACNLSTM; LFLSQACNLSTMH; FLSQACNLSTMHK; LSQACNLSTMHKI; SQACNLSTMHKID; QACNLSTMHKIDT; ACNLSTMHKIDTK; CNLSTMHKIDTKE; NLSTMHKIDTKED; LSTMHKIDTKEDM; STMHKIDTKEDMK; TMHKIDTKEDMKI; MHKIDTKEDMKIL; HKIDTKEDMKILY; KIDTKEDMKILYS; IDTKEDMKILYSE; DTKEDMKILYSEI; TKEDMKILYSEIA; KEDMKILYSEIAE; EDMKILYSEIAEL; DMKILYSEIAELR; MKILYSEIAELRK; KILYSEIAELRKK; ILYSEIAELRKKL; LYSEIAELRKKLN; YSEIAELRKKLNL; SEIAELRKKLNLN; EIAELRKKLNLNH; IAELRKKLNLNHL; AELRKKLNLNHLE; ELRKKLNLNHLEI; LRKKLNLNHLEID; RKKLNLNHLEIDD; KKLNLNHLEIDDT; KLNLNHLEIDDTL; LNLNHLEIDDTLE; NLNHLEIDDTLEK; LNHLEIDDTLEKV; NHLEIDDTLEKVA; HLEIDDTLEKVAK; LEIDDTLEKVAKE; EIDDTLEKVAKEY; IDDTLEKVAKEYA; DDTLEKVAKEYAI; DTLEKVAKEYAIK; TLEKVAKEYAIKL; LEKVAKEYAIKLG; EKVAKEYAIKLGE; KVAKEYAIKLGEN; VAKEYAIKLGENR; AKEYAIKLGENRT; KEYAIKLGENRTI; EYAIKLGENRTIT; YAIKLGENRTITH; AIKLGENRTITHT; IKLGENRTITHTL; KLGENRTITHTLF; LGENRTITHTLFG; GENRTITHTLFGT; ENRTITHTLFGTT; NRTITHTLFGTTP; RTITHTLFGTTPM; TITHTLFGTTPMQ; ITHTLFGTTPMQR; THTLFGTTPMQRI; HTLFGTTPMQRIH; TLFGTTPMQRIHK; LFGTTPMQRIHKY; FGTTPMQRIHKYD; GTTPMQRIHKYDQ; TTPMQRIHKYDQS; TPMQRIHKYDQSF; PMQRIHKYDQSFN; MQRIHKYDQSFNL; QRIHKYDQSFNLT; RIHKYDQSFNLTR; IHKYDQSFNLTRE; HKYDQSFNLTREI; KYDQSFNLTREIL; YDQSFNLTREILA; DQSFNLTREILAS; QSFNLTREILASG; SFNLTREILASGI; FNLTREILASGIE; NLTREILASGIEL; LTREILASGIELN; TREILASGIELNR; REILASGIELNRV; EILASGIELNRVV; ILASGIELNRVVN; LASGIELNRVVNA; ASGIELNRVVNAW; SGIELNRVVNAWL; GIELNRVVNAWLN; IELNRVVNAWLNS; ELNRVVNAWLNSP; LNRVVNAWLNSPS; NRVVNAWLNSPSH; RVVNAWLNSPSHK; VVNAWLNSPSHKE; VNAWLNSPSHKEA; NAWLNSPSHKEAL; AWLNSPSHKEALI; WLNSPSHKEALIN; LNSPSHKEALINT; NSPSHKEALINTD; SPSHKEALINTDT; PSHKEALINTDTD; SHKEALINTDTDK; HKEALINTDTDKI; KEALINTDTDKIG; EALINTDTDKIGG; |

Fig. 33 continued

ALINTDTDKIGGY; LINTDTDKIGGYR; INTDTDKIGGYRL;
NTDTDKIGGYRLK; TDTDKIGGYRLKT; DTDKIGGYRLKTT;
TDKIGGYRLKTTD; DKIGGYRLKTTDN; KIGGYRLKTTDNI;
IGGYRLKTTDNID; GGYRLKTTDNIDI; GYRLKTTDNIDIF;
YRLKTTDNIDIFV; RLKTTDNIDIFVV; LKTTDNIDIFVVL;
KTTDNIDIFVVLF; TTDNIDIFVVLFG; TDNIDIFVVLFGK;
DNIDIFVVLFGKR; NIDIFVVLFGKRK; IDIFVVLFGKRKY;
DIFVVLFGKRKYK; IFVVLFGKRKYKN;

14 mers:
MKKLITFTLFLSQ; KKLITFTLFLSQA; KLITFTLFLSQAC;
LITFTLFLSQACN; ITFTLFLSQACNL; TFTLFLSQACNLS;
FTLFLSQACNLST; TLFLSQACNLSTM; LFLSQACNLSTMK;
FLSQACNLSTMKL; LSQACNLSTMKLD; SQACNLSTMKLDT;
QACNLSTMKLDTK; ACNLSTMKLDTKE; CNLSTMKLDTKED;
NLSTMKLDTKEDM; LSTMKLDTKEDMK; STMKLDTKEDMKI;
TMKLDTKEDMKTI; MKLDTKEDMKTLY; KLDTKEDMKTLYS;
LDTKEDMKTLYSE; DTKEDMKTLYSEI; TKEDMKTLYSEIA;
KEDMKILYSEIAE; EDMKILYSEIAEL; DMKILYSEIAELR;
MKILYSEIAELRK; KILYSEIAELRKK; ILYSEIAELRKKL;
LYSEIAELRKKLN; YSEIAELRKKLNL; SEIAELRKKLNLH;
EIAELRKKLNLHL; IAELRKKLNLHLE; AELRKKLNLHLEI;
ELRKKLNLHLEID; LRKKLNLHLEIDD; RKKLNLHLEIDDT;
KKLNLHLEIDDTL; KLNLHLEIDDTLE; LNLHLEIDDTLEK;
NLHLEIDDTLEKV; LHLEIDDTLEKVA; NHLEIDDTLEKVAK;
LEIDDTLEKVAKE; EIDDTLEKVAKEY; IDDTLEKVAKEYA;
DDTLEKVAKEYAT; DTLEKVAKEYATK; TLEKVAKEYATKL;
LEKVAKEYATKLG; EKVAKEYATKLGE; KVAKEYATKLGER;
VAKEYATKLGENR; AKEYATKLGENRT; KEYATKLGENRTT;
EYATKLGENRTTH; YATKLGENRTTHT; ATKLGENRTTHTL;
TKLGENRTTHTLF; KLGENRTTHTLFG; LGENRTTHTLFGT;
GENRTTHTLFGTT; ENRTTHTLFGTTP; NRTTHTLFGTTPM;
RTTHTLFGTTPMQ; TTHTLFGTTPMQR; THTLFGTTPMQRT;
HTLFGTTPMQRTH; TLFGTTPMQRTHK; LFGTTPMQRTHKY;
FGTTPMQRTHKYD; GTTPMQRTHKYDQ; TTPMQRTHKYDQS;
TPMQRTHKYDQSF; PMQRTHKYDQSFN; MQRTHKYDQSFNL;
QRTHKYDQSFNLT; RTHKYDQSFNLTR; THKYDQSFNLTRE;
HKYDQSFNLTREE; KYDQSFNLTREIL; YDQSFNLTREILA;
DQSFNLTREILAS; QSFNLTREILASG; SFNLTREILASGT;
FNLTREILASGIE; NLTREILASGIEL; LTREILASGIELN;
TREILASGIELNR; REILASGIELNRV; EILASGIELNRVV;
ILASGIELNRVVA; LASGIELNRVVAW; ASGIELNRVVAWL;
SGIELNRVVAWLS; GIELNRVVAWLNS; IELNRVVAWLNSP;
ELNRVVAWLNSPS; LNRVVAWLNSPSH; NRVVAWLNSPSHK;
RVVAWLNSPSHKE; VVAWLNSPSHKEA; VAWLNSPSHKEAL;
AWLNSPSHKEALT; WLNSPSHKEALTN; LNSPSHKEALTND;
NSPSHKEALTNDT; SPSHKEALTNDTK; PSHKEALTNDTKI;
SHKEALTNDTKIG; HKEALTNDTKIGG; KEALTNDTKIGGY;
EALINTDTDKIGG; ALINTDTDKIGGY; LINTDTDKIGGYR;

| | YRLKTTDNIDIFVVLF; RLKTTDNIDIFVVLFG; LKTTDNIDIFVVLFGK; KTTDNIDIFVVLFGKR; TTDNIDIFVVLFGKRK; TDNIDIFVVLFGKRKY; DNIDIFVVLFGKRKYK; NIDIFVVLFGKRKYKN; |
|---|---|
| SEQ ID NO:32<br>SEQ ID NO:<br>109853-110650 | 13 mers:<br>MMQRISILLMLLA; MQRISILLMLLAV; QRISILLMLLAVF; RISILLMLLAVFS; ISILLMLLAVFSC; SILLMLLAVFSCK; ILLMLLAVFSCKQ; LLMLLAVFSCKQF; LMLLAVFSCKQFG; MLLAVFSCKQFGD; LLAVFSCKQFGDV; LAVFSCKQFGDVK; AVFSCKQFGDVKS; VFSCKQFGDVKSL; FSCKQFGDVKSLT; SCKQFGDVKSLTE; CKQFGDVKSLTEI; KQFGDVKSLTEID; QFGDVKSLTEIDS; FGDVKSLTEIDSG; GDVKSLTEIDSGN; DVKSLTEIDSGNG; VKSLTEIDSGNGI; KSLTEIDSGNGIP; SLTEIDSGNGIPL; LTEIDSGNGIPLV; TEIDSGNGIPLVV; EIDSGNGIPLVVS; IDSGNGIPLVVSD; DSGNGIPLVVSDV; SGNGIPLVVSDVV; GNGIPLVVSDVVK; NGIPLVVSDVVKD; GIPLVVSDVVKDL; IPLVVSDVVKDLI; PLVVSDVVKDLIP; LVVSDVVKDLIPK; VVSDVVKDLIPKE; VSDVVKDLIPKEI; SDVVKDLIPKEIS; DVVKDLIPKEISL; VVKDLIPKEISLT; VKDLIPKEISLTP; KDLIPKEISLTPE; DLIPKEISLTPEE; LIPKEISLTPEEA; IPKEISLTPEEAE; PKEISLTPEEAEK; KEISLTPEEAEKL; EISLTPEEAEKLE; ISLTPEEAEKLES; SLTPEEAEKLESL; LTPEEAEKLESLK; TPEEAEKLESLKV; PEEAEKLESLKVF; EEAEKLESLKVFL; EAEKLESLKVFLK; AEKLESLKVFLKD; EKLESLKVFLKDA; KLESLKVFLKDAM; LESLKVFLKDAMS; ESLKVFLKDAMSV; SLKVFLKDAMSVN; LKVFLKDAMSVNG; KVFLKDAMSVNGR; VFLKDAMSVNGRE; FLKDAMSVNGREE; LKDAMSVNGREEA; KDAMSVNGREEAL; DAMSVNGREEALK; AMSVNGREEALKA; MSVNGREEALKAE; SVNGREEALKAEY; VNGREEALKAEYE; NGREEALKAEYEK; GREEALKAEYEKS; REEALKAEYEKSY; EEALKAEYEKSYK; EALKAEYEKSYKE; ALKAEYEKSYKEF; LKAEYEKSYKEFF; KAEYEKSYKEFFD; AEYEKSYKEFFDW; EYEKSYKEFFDWL; YEKSYKEFFDWLS; EKSYKEFFDWLSK; KSYKEFFDWLSKD; SYKEFFDWLSKDV; YKEFFDWLSKDVN; KEFFDWLSKDVNR; EFFDWLSKDVNRQ; FFDWLSKDVNRQK; FDWLSKDVNRQKE; DWLSKDVNRQKEF; WLSKDVNRQKEFI; LSKDVNRQKEFIS; SKDVNRQKEFISS; KDVNRQKEFISSF; DVNRQKEFISSFD; VNRQKEFISSFDN; NRQKEFISSFDNI; RQKEFISSFDNIS; QKEFISSFDNISS; KEFISSFDNISSI; EFISSFDNISSIV; FISSFDNISSIVS; ISSFDNISSIVSK; SSFDNISSIVSKA; SFDNISSIVSKAV; FDNISSIVSKAVD; DNISSIVSKAVDA; NISSIVSKAVDAS; ISSIVSKAVDASK; SSIVSKAVDASKK; SIVSKAVDASKKR; IVSKAVDASKKRR; VSKAVDASKKRRP; SKAVDASKKRRPT; KAVDASKKRRPTE; AVDASKKRRPTEQ; VDASKKRRPTEQQ; DASKKRRPTEQQS; ASKKRRPTEQQSL; SKKRRPTEQQSLG; KKRRPTEQQSLGF; KRRPTEQQSLGFK; RRPTEQQSLGFKE; RPTEQQSLGFKEY; PTEQQSLGFKEYV; TEQQSLGFKEYVC; EQQSLGFKEYVCY; QQSLGFKEYVCYK; QSLGFKEYVCYKI; SLGFKEYVCYKIK; LGFKEYVCYKIKN; |

Fig. 33 continued

CFKEYVCYKIKNS; FKEYVCYKIKKSK; KEYVCYKIKKSKG;
EYVCYKIKNSKGE; YVCYKIKNSKGEA; VCYKIKNSKGEAI;
CYKIKNSKGEALS; YKIKNSKGEALSL; KIKNSKGEALSLF;
IKNSKGEALSLF; KNSKGEALSLFFQ; NSKGEALSLFFQK;
SKGEALSLFFQKV; KGEALSLFFQKVV; GEALSLFFQKVVD;
EALSLFFQKVVDA; ALSLFFQKVVDAF; LSLFFQKVVDAFG;
SLFFQKVVDAFGA; LFFQKVVDAFGAD; FFQKVVDAFGADP;
FQKVVDAFGADPY; QKVVDAFGADPYK; KVVDAFGADPYKK;
VVDAFGADPYKKD; VDAFGADPYKKDN; DAFGADPYKKDNF;
AFGADPYKKDNFS; FGADPYKKDNFSS; GADPYKKDNFSSV;
ADPYKKDNFSSVQ; DPYKKDNFSSVQK; PYKKDNFSSVQKP;
YKKDNFSVQKPV; KKDNFSVQKPVK; KDNFSVQKPVKC;
DNFSVQKPVKCN; NFSVQKPVKCNF; DFSVQKPVKCNFF;
FSVQKPVKCNFFI; SVQKPVKCNFFI; VQKPVKCNFFIPK;
QKPVKCNFFIPKV; KPVKCNFFIPKVI; PVKCNFFIPKVIK;
VKCNFFIPKVIKK; KCNFFIPKVIKKV; CNFFIPKVIKKVL;
NFFIPKVIKKVLT; FFIPKVIKKVLTF; FIPKVIKKVLTFS;
IPKVIKKVLTFSE; PKVIKKVLTFSES; KVIKKVLTFSESN;
VIKKVLTFSESNK; IKKVLTFSESNKE; KKVLTFSESNKEL;
KVLTFSESNKELK; VLTFSESNKELKN; LTFSESNKELKNL;
TFSESNKELKNLK; FSESNKELKNLKN; SESNKELKNLKNY;
ESNKELKNLKNYG; SNKELKNLKNYGK; NKELKNLKNYGKV;

14 mers:
MMQRISILMLLAV; MQRISILMLLAVF; QRISILMLLAVFS;
RISILMLLAVFSC; ISILMLLAVFSCK; SILMLLAVFSCKQ;
ILMLLAVFSCKQF; LMLLAVFSCKQFG; MLLAVFSCKQFGD;
MLLAVFSCKQFGDV; LLAVFSCKQFGDVK; LAVFSCKQFGDVKS;
AVFSCKQFGDVKSL; VFSCKQFGDVKSLT; FSCKQFGDVKSLTF;
SCKQFGDVKSLTFI; CKQFGDVKSLTFID; KQFGDVKSLTFIDS;
QFGDVKSLTFIDSG; FGDVKSLTFIDSGN; GDVKSLTFIDSGNG;
DVKSLTFIDSGNGT; VKSLTFIDSGNGTP; KSLTFIDSGNGTPL;
SLTFIDSGNGTPLV; LTFIDSGNGTPLVV; TFIDSGNGTPLVVS;
FIDSGNGTPLVVSD; IDSGNGTPLVVSDV; DSGNGTPLVVSDVV;
SGNGTPLVVSDVVK; GNGTPLVVSDVVKD; NGTPLVVSDVVKDL;
GTPLVVSDVVKDLT; TPLVVSDVVKDLTP; PLVVSDVVKDLTPK;
LVVSDVVKDLTPKF; VVSDVVKDLTPKFT; VSDVVKDLTPKFTS;
SDVVKDLTPKFTSL; DVVKDLTPKFTSLT; VVKDLTPKFTSLTP;
VKDLTPKFTSLTPF; KDLTPKFTSLTPFE; DLTPKFTSLTPFEA;
LTPKFTSLTPFEAF; TPKFTSLTPFEAFK; PKFTSLTPFEAFKL;
KFTSLTPFEAFKLE; FTSLTPFEAFKLES; TSLTPFEAFKLESL;
SLTPFEAFKLESLK; LTPFEAFKLESLKV; TPFEAFKLESLKVF;
PFEAFKLESLKVFL; FEAFKLESLKVFLK; EAFKLESLKVFLKD;
AFKLESLKVFLKDA; FKLESLKVFLKDAM; KLESLKVFLKDAMS;
LESLKVFLKDAMSV; ESLKVFLKDAMSVK; SLKVFLKDAMSVKG;
LKVFLKDAMSVKGR; KVFLKDAMSVKGRE; VFLKDAMSVKGREE;
FLKDAMSVKGREEA; LKDAMSVKGREEAL; KDAMSVKGREEALK;
DAMSVKGREEALKA; AMSVKGREEALKAE; MSVKGREEALKAEY;
SVKGREEALKAEYE; VKGREEALKAEYEK; KGREEALKAEYEKS;
GREEALKAEYEKSY; REEALKAEYEKSYK; EEALKAEYEKSYKE;
EALKAEYEKSYKEF; ALKAEYEKSYKEFF; LKAEYEKSYKEFFD;

Fig. 33 continued

| | |
|---|---|
| | KAEYEKSYKEFFDW; AEYEKSYKEFFDWL; EYEKSYKEFFDWLS;<br>YEKSYKEFFDWLSK; EKSYKEFFDWLSKD; KSYKEFFDWLSKDV;<br>SYKEFFDWLSKDVN; YKEFFDWLSKDVNR; KEFFDWLSKDVNRQ;<br>EFFDWLSKDVNRQK; FFDWLSKDVNRQKE; FDWLSKDVNRQKEF;<br>DWLSKDVNRQKEFT; WLSKDVNRQKEFTS; LSKDVNRQKEFTSS;<br>SKDVNRQKEFTSSF; KDVNRQKEFTSSFD; DVNRQKEFTSSFDN;<br>VNRQKEFTSSFDNT; NRQKEFTSSFDNTS; RQKEFTSSFDNTSS;<br>QKEFTSSFDNTSST; KEFTSSFDNTSSTV; EFTSSFDNTSSTVS;<br>FTSSFDNTSSTVSK; TSSFDNTSSTVSKA; SSFDNTSSTVSKAV;<br>SFDNTSSTVSKAVD; FDNTSSTVSKAVDA; DNTSSTVSKAVDAS;<br>NTSSTVSKAVDASK; TSSTVSKAVDASKK; SSTVSKAVDASKKR;<br>STVSKAVDASKKRR; TVSKAVDASKKRRP; VSKAVDASKKRRPT;<br>SKAVDASKKRRPTE; KAVDASKKRRPTEQ; AVDASKKRRPTEQQ;<br>VDASKKRRPTEQQS; DASKKRRPTEQQSL; ASKKRRPTEQQSLG;<br>SKKRRPTEQQSLGF; KKRRPTEQQSLGFK; KRRPTEQQSLGFKE;<br>RRPTEQQSLGFKEY; RPTEQQSLGFKEYV; PTEQQSLGFKEYVC;<br>TEQQSLGFKEYVCY; EQQSLGFKEYVCYK; QQSLGFKEYVCYKT;<br>QSLGFKEYVCYKTK; SLGFKEYVCYKTKN; LGFKEYVCYKTKNS;<br>GFKEYVCYKTKNSK; FKEYVCYKTKNSKG; KEYVCYKTKNSKGE;<br>EYVCYKTKNSKGEA; YVCYKTKNSKGEAL; VCYKTKNSKGEALS;<br>CYKTKNSKGEALSL; YKTKNSKGEALSLF; KTKNSKGEALSLFF;<br>TKNSKGEALSLFFQ; KNSKGEALSLFFQK; NSKGEALSLFFQKV;<br>SKGEALSLFFQKVV; KGEALSLFFQKVVD; GEALSLFFQKVVDA;<br>EALSLFFQKVVDAF; ALSLFFQKVVDAFG; LSLFFQKVVDAFGA;<br>SLFFQKVVDAFGAD; LFFQKVVDAFGADP; FFQKVVDAFGADPY;<br>FQKVVDAFGADPYK; QKVVDAFGADPYKK; KVVDAFGADPYKKD;<br>VVDAFGADPYKKDN; VDAFGADPYKKDND; DAFGADPYKKDNDE;<br>AFGADPYKKDNDES; FGADPYKKDNDESV; GADPYKKDNDESVQ;<br>ADPYKKDNDESVQK; DPYKKDNDESVQKP; PYKKDNDESVQKPV;<br>YKKDNDESVQKPVK; KKDNDESVQKPVKC; KDNDESVQKPVKCN;<br>DNDESVQKPVKCNE; NDESVQKPVKCNEE; DESVQKPVKCNEET;<br>ESVQKPVKCNEETF; SVQKPVKCNEETFK; VQKPVKCNEETFKV;<br>QKPVKCNEETFKVT; KPVKCNEETFKVTK; PVKCNEETFKVTKK;<br>VKCNEETFKVTKKV; KCNEETFKVTKKVL; CNEETFKVTKKVLT;<br>NEETFKVTKKVLTE; EETFKVTKKVLTES; ETFKVTKKVLTESE;<br>TFKVTKKVLTESES; FKVTKKVLTESESN; KVTKKVLTESESNN;<br>VTKKVLTESESNNE; TKKVLTESESNNEL; KKVLTESESNNELK;<br>KVLTESESNNELKN; VLTESESNNELKNL; LTESESNNELKNLK;<br>TESESNNELKNLKN; ESESNNELKNLKNY; SESNNELKNLKNYG;<br>ESNNELKNLKNYGK; SNNELKNLKNYGKV;<br><br>15 mers:<br>MMQRTSTLLMLLAVF; MQRTSTLLMLLAVFS; QRTSTLLMLLAVFSC;<br>RTSTLLMLLAVFSCK; TSTLLMLLAVFSCKQ; STLLMLLAVFSCKQF;<br>TLLMLLAVFSCKQFG; LLMLLAVFSCKQFGD; LMLLAVFSCKQFGDV;<br>MLLAVFSCKQFGDVK; LLAVFSCKQFGDVKS; LAVFSCKQFGDVKSL;<br>AVFSCKQFGDVKSLT; VFSCKQFGDVKSLTE; FSCKQFGDVKSLTEI;<br>SCKQFGDVKSLTEID; CKQFGDVKSLTEIDS; KQFGDVKSLTEIDSG;<br>QFGDVKSLTEIDSGN; FGDVKSLTEIDSGNG; GDVKSLTEIDSGNGT;<br>DVKSLTEIDSGNGTP; VKSLTEIDSGNGTPL; KSLTEIDSGNGTPLV;<br>SLTEIDSGNGTPLVV; LTEIDSGNGTPLVVS; TEIDSGNGTPLVVSD; |

Fig. 33 continued

| | | |
|---|---|---|
| FIDSCNGIPLVVSDV; | IDSCNGIPLVVSDVV; | DSCNGIPLVVSDVVK; |
| SGKGTPLVVSDVVKD; | GKGTPLVVSDVVKDL; | KGTPLVVSDVVKDLT; |
| GTPLVVSDVVKDLTP; | TPLVVSDVVKDLTPK; | PLVVSDVVKDLTPKF; |
| LVVSDVVKDLTPKFI; | VVSDVVKDLTPKFIS; | VSDVVKDLTPKFISL; |
| SDVVKDLTPKFISLT; | DVVKDLTPKFISLTP; | VVKDLTPKFISLTPF; |
| VKDLTPKFISLTPFF; | KDLTPKFISLTPFFA; | DLTPKFISLTPFFAF; |
| LTPKFISLTPFFAFK; | TPKFISLTPFFAFKL; | PKFISLTPFFAFKLF; |
| KFISLTPFFAFKLFS; | FISLTPFFAFKLFSL; | ISLTPFFAFKLFSLK; |
| SLTPFFAFKLFSLKV; | LTPFFAFKLFSLKVF; | TPFFAFKLFSLKVFL; |
| PFFAFKLFSLKVFLK; | FFAFKLFSLKVFLKD; | FAFKLFSLKVFLKDA; |
| AFKLFSLKVFLKDAM; | FKLFSLKVFLKDAMS; | KLFSLKVFLKDAMSV; |
| LFSLKVFLKDAMSVN; | FSLKVFLKDAMSVNG; | SLKVFLKDAMSVNGR; |
| LKVFLKDAMSVNGRF; | KVFLKDAMSVNGRFF; | VFLKDAMSVNGRFFA; |
| FLKDAMSVNGRFFAL; | LKDAMSVNGRFFALK; | KDAMSVNGRFFALKA; |
| DAMSVNGRFFALKAF; | AMSVNGRFFALKAFY; | MSVNGRFFALKAFYE; |
| SVNGRFFALKAFYEK; | VNGRFFALKAFYEKS; | NGRFFALKAFYEKSY; |
| GRFFALKAFYEKSYK; | RFFALKAFYEKSYKF; | FFALKAFYEKSYKFF; |
| FALKAFYEKSYKFFD; | ALKAFYEKSYKFFDW; | LKAFYEKSYKFFDWL; |
| KAFYEKSYKFFDWL; | AFYEKSYKFFDWLS; | FYEKSYKFFDWLSK; |
| YEKSYKFFDWLSKD; | EKSYKFFDWLSKDV; | KSYKFFDWLSKDVN; |
| SYKFFDWLSKDVNR; | YKFFDWLSKDVNRQ; | KFFDWLSKDVNRQK; |
| FFDWLSKDVNRQKF; | FDWLSKDVNRQKFF; | DWLSKDVNRQKFFI; |
| DWLSKDVNRQKFFIS; | WLSKDVNRQKFFISS; | LSKDVNRQKFFISSF; |
| SKDVNRQKFFISSFD; | KDVNRQKFFISSFDN; | DVNRQKFFISSFDNT; |
| VNRQKFFISSFDNTS; | NRQKFFISSFDNTSS; | RQKFFISSFDNTSST; |
| QKFFISSFDNTSSTV; | KFFISSFDNTSSTVS; | FFISSFDNTSSTVSK; |
| FISSFDNTSSTVSKA; | ISSFDNTSSTVSKAV; | SSFDNTSSTVSKAVD; |
| SFDNTSSTVSKAVDA; | FDNTSSTVSKAVDAS; | DNTSSTVSKAVDASK; |
| NTSSTVSKAVDASKK; | TSSTVSKAVDASKKR; | SSTVSKAVDASKKRR; |
| STVSKAVDASKKRRP; | TVSKAVDASKKRRPT; | VSKAVDASKKRRPTE; |
| SKAVDASKKRRPTEQ; | KAVDASKKRRPTEQQ; | AVDASKKRRPTEQQS; |
| VDASKKRRPTEQQSL; | DASKKRRPTEQQSLG; | ASKKRRPTEQQSLGF; |
| SKKRRPTEQQSLGFK; | KKRRPTEQQSLGFKF; | KRRPTEQQSLGFKFY; |
| RRPTEQQSLGFKFYV; | RPTEQQSLGFKFYVC; | PTEQQSLGFKFYVCY; |
| TEQQSLGFKFYVCYK; | EQQSLGFKFYVCYKT; | QQSLGFKFYVCYKTK; |
| QSLGFKFYVCYKTKN; | SLGFKFYVCYKTKNS; | LGFKFYVCYKTKNSK; |
| GFKFYVCYKTKNSKG; | FKFYVCYKTKNSKGF; | KFYVCYKTKNSKGFA; |
| FYVCYKTKNSKGFAL; | YVCYKTKNSKGFALS; | VCYKTKNSKGFALSL; |
| CYKTKNSKGFALSLF; | YKTKNSKGFALSLFF; | KTKNSKGFALSLFFQ; |
| TKNSKGFALSLFFQK; | KNSKGFALSLFFQKV; | NSKGFALSLFFQKVV; |
| SKGFALSLFFQKVVD; | KGFALSLFFQKVVDA; | GFALSLFFQKVVDAF; |
| FALSLFFQKVVDAFG; | ALSLFFQKVVDAFGA; | LSLFFQKVVDAFGAD; |
| SLFFQKVVDAFGADP; | LFFQKVVDAFGADPY; | FFQKVVDAFGADPYK; |
| FQKVVDAFGADPYKK; | QKVVDAFGADPYKKD; | KVVDAFGADPYKKDN; |
| VVDAFGADPYKKDND; | VDAFGADPYKKDNDE; | DAFGADPYKKDNDES; |
| AFGADPYKKDNDESV; | FGADPYKKDNDESVQ; | GADPYKKDNDESVQK; |
| ADPYKKDNDESVQKP; | DPYKKDNDESVQKPV; | PYKKDNDESVQKPVK; |
| YKKDNDESVQKPVKC; | KKDNDESVQKPVKCE; | KDNDESVQKPVKCEF; |
| DNDESVQKPVKCEFF; | NDESVQKPVKCEFFF; | DESVQKPVKCEFFFV; |
| ESVQKPVKCEFFFVK; | SVQKPVKCEFFFVKV; | VQKPVKCEFFFVKVI; |
| QKPVKCEFFFVKVTK; | KPVKCEFFFVKVTKV; | PVKCEFFFVKVTKVI; |

Fig. 33 continued

VKDEELFKVIKKVL; KDEELFKVIKKVLG; DEELFKVIKKVLTE;
EELFKVIKKVLTES; ELFKVIKKVLTESE; LFKVIKKVLTESES;
FKVIKKVLTESESN; KVIKKVLTESESNK; VIKKVLTESESNKE;
IKKVLTESESNKEL; KKVLTESESNKELK; KVLTESESNKELKN;
VLTESESNKELKND; LTESESNKELKNDK

| | |
|---|---|
| | RRPTEQQSLGFKEYVC; RPTEQQSLGFKEYVCY; PTEQQSLGFKEYVCYK; TEQQSLGFKEYVCYKI; EQQSLGFKEYVCYKIK; QQSLGFKEYVCYKIKN; QSLGFKEYVCYKIKNS; SLGFKEYVCYKIKNSK; LGFKEYVCYKIKNSKG; GFKEYVCYKIKNSKGE; FKEYVCYKIKNSKGEA; KEYVCYKIKNSKGEAL; EYVCYKIKNSKGEALS; YVCYKIKNSKGEALSL; VCYKIKNSKGEALSLF; CYKIKNSKGEALSLFF; YKIKNSKGEALSLFFQ; KIKNSKGEALSLFFQK; IKNSKGEALSLFFQKV; KNSKGEALSLFFQKVV; NSKGEALSLFFQKVVD; SKGEALSLFFQKVVDA; KGEALSLFFQKVVDAF; GEALSLFFQKVVDAFG; EALSLFFQKVVDAFGA; ALSLFFQKVVDAFGAD; LSLFFQKVVDAFGADP; SLFFQKVVDAFGADPY; LFFQKVVDAFGADPYK; FFQKVVDAFGADPYKK; FQKVVDAFGADPYKKD; QKVVDAFGADPYKKDN; KVVDAFGADPYKKDND; VVDAFGADPYKKDNDE; VDAFGADPYKKDNDES; DAFGADPYKKDNDESV; AFGADPYKKDNDESVQ; FGADPYKKDNDESVQK; GADPYKKDNDESVQKP; ADPYKKDNDESVQKPV; DPYKKDNDESVQKPVK; PYKKDNDESVQKPVKC; YKKDNDESVQKPVKCN; KKDNDESVQKPVKCNE; KDNDESVQKPVKCNEE; DNDESVQKPVKCNEEI; NDESVQKPVKCNEEIF; DESVQKPVKCNEEIFK; ESVQKPVKCNEEIFKV; SVQKPVKCNEEIFKVI; VQKPVKCNEEIFKVIK; QKPVKCNEEIFKVIKK; KPVKCNEEIFKVIKKV; PVKCNEEIFKVIKKVL; VKCNEEIFKVIKKVLT; KCNEEIFKVIKKVLTE; CNEEIFKVIKKVLTES; NEEIFKVIKKVLTESE; EEIFKVIKKVLTESES; EIFKVIKKVLTESESN; IFKVIKKVLTESESNN; FKVIKKVLTESESNNE; KVIKKVLTESESNNEL; VIKKVLTESESNNELK; IKKVLTESESNNELKN; KKVLTESESNNELKNL; KVLTESESNNELKNLK; VLTESESNNELKNLKN; LTESESNNELKNLKNY; TESESNNELKNLKNYG; ESESNNELKNLKNYGN; SESNNELKNLKNYGNV; |
| SEQ ID NO:33 SEQ ID NO: 110651-111504 | 13 mers: MKRISILSILLLL; KRISILSILLLLL; RISILSILLLLLL; ISILSILLLLLLF; SILSILLLLLLFS; ILSILLLLLLFSC; LSILLLLLLFSCK; SILLLLLLFSCKQ; ILLLLLLFSCKQY; LLLLLLFSCKQYG; LLLLLFSCKQYGD; LLLLFSCKQYGDV; LLLFSCKQYGDVK; LLFSCKQYGDVKS; LFSCKQYGDVKSL; FSCKQYGDVKSLT; SCKQYGDVKSLTE; CKQYGDVKSLTEV; KQYGDVKSLTEVA; QYGDVKSLTEVAT; YGDVKSLTEVATD; GDVKSLTEVATDL; DVKSLTEVATDLE; VKSLTEVATDLED; KSLTEVATDLEDD; SLTEVATDLEDDN; LTEVATDLEDDNS; TEVATDLEDDNSF; EVATDLEDDNSFA; VATDLEDDNSFAS; ATDLEDDNSFASG; TDLEDDNSFASGS; DLEDDNSFASGSV; LEDDNSFASGSVE; EDDNSFASGSVES; DDNSFASGSVESK; DNSFASGSVESKD; NSFASGSVESKDQ; SFASGSVESKDQI; FASGSVESKDQII; ASGSVESKDQIIE; SGSVESKDQIIEK; GSVESKDQIIEKG; SVESKDQIIEKGP; VESKDQIIEKGPV; ESKDQIIEKGPVL; SKDQIIEKGPVLT; KDQIIEKGPVLTS; DQIIEKGPVLTSE; QIIEKGPVLTSEE; IIEKGPVLTSEEF; IEKGPVLTSEEFE; EKGPVLTSEEFER; KGPVLTSEEFERL; GPVLTSEEFERLE; PVLTSEEFERLEA; VLTSEEFERLEAL; LTSEEFERLEALK; TSEEFERLEALKT; SEEFERLEALKTF; EEFERLEALKTFL; EFERLEALKTFLK; FERLEALKTFLKD; ERLEALKTFLKDA; RLEALKTFLKDAM; LEALKTFLKDAMG; EALKTFLKDAMGV; ALKTFLKDAMGVN; LKTFLKDAMGVNG; KTFLKDAMGVNGR; TFLKDAMGVNGRE; FLKDAMGVNGREG; |

Fig. 33 continued

LKDAMGVKGREGD; KDAMGVNGREGDT; DAMGVNGREGDTK;
AMGVKGREGDTKA; MGVKGREGDTKAF; GVNGREGDTKAFY;
VNGREGDTKAFYE; NGREGDTKAFYEK; GREGDTKAFYEKS;
REGDTKAFYEKSY; EGDTKAFYEKSYK; GDTKAFYEKSYKE;
DTKAFYEKSYKEF; TKAFYEKSYKEFF; KAFYEKSYKEFFD;
AFYEKSYKEFFDX; FYEKSYKEFFDWL; YEKSYKEFFDWLS;
EKSYKEFFDWLSK; KSYKEFFDWLSKD; SYKEFFDWLSKDV;
YKEFFDWLSKDVK; KEFFDWLSKDVNR; EFFDWLSKDVNRQ;
FFDWLSKDVNRQK; FDWLSKDVNRQKF; DWLSKDVNRQKEF;
WLSKDVNRQKEFV; LSKDVNRQKEFVS; SKDVNRQKEFVSF;
KDVNRQKEFVSFF; DVNRQKEFVSFFN; VNRQKEFVSFFNG;
NRQKEFVSFFNG; RQKEFVS

Fig. 33 continued

DSLFFQKVADAFG; SLFFQKVADAFGT; LFFQKVADAFGTQ;
LFFQKVADAFGTQF; FFQKVADAFGTQFY; FQKVADAFGTQFYK;
QKVADAFGTQFYK; KVADAFGTQFYKN; VADAFGTQFYKNK;
ADAFGTQFYKNKD; DAFGTQFYKNKDE; AFGTQFYKNKDED;
FGTQFYKNKDEDD; GTQFYKNKDEDDE; TQFYKNKDEDDEN;
QFYKNKDEDDENK; FYKNKDEDDENNQ; YKNKDEDDENNQK;
KNKDEDDENNQKP; NKDEDDENNQKPE; KDEDDENNQKPEK;
DEDDENNQKPEKC; EDDENNQKPEKCE; DDENNQKPEKCEE;
DENNQKPEKCEEF; ENNQKPEKCEEFF; NNQKPEKCEEFFK;
NQKPEKCEEFFKV; QKPEKCEE

AEYEKSYKFFDWLS; EYEKSYKFFDWLSK; YEKSYKFFDWLSKD;
EKSYKFFDWLSKDV; KSYKFFDWLSKDVE; SYKFFDWLSKDVER;
YKFFDWLSKDVERQ; KFFDWLSKDVERQK; FFDWLSKDVERQKF;
FDWLSKDVERQKFF; DWLSKDVERQKFFV; WLSKDVERQKFFVS;
LSKDVERQKFFVSF; SKDVERQKFFVSFF; KDVERQKFFVSFFN;
DVERQKFFVSFFNT; VERQKFFVSFFNTC; ERQKFFVSFFNTCG;
RQKFFVSFFNTCGT; QKFFVSFFNTCGTT; KFFVSFFNTCGTTT;
FFVSFFNTCGTTTK; FVSFFNTCGTTTKA; VSFFNTCGTTTKAV;
SFFNTCGTTTKAVD; FFNTCGTTTKAVDA; FNTCGTTTKAVDAS;
NTCGTTTKAVDASK; TCGTTTKAVDASKK; CGTTTKAVDASKKR;
GTTTKAVDASKKRY; TTTKAVDASKKRYN; TTKAVDASKKRYNS;
TKAVDASKKRYNSK; KAVDASKKRYNSKP; AVDASKKRYNSKPK;
VDASKKRYNSKPKS; DASKKRYNSKPKSL; ASKKRYNSKPKSLG;
SKKRYNSKPKSLGF; KKRYNSKPKSLGFN; KRYNSKPKSLGFNE;
RYNSKPKSLGFNEY; YNSKPKSLGFNEYV; NSKPKSLGFNEYVC;
SKPKSLGFNEYVCY; KPKSLGFNEYVCYD; PKSLGFNEYVCYDT;
KSLGFNEYVCYDTK; SLGFNEYVCYDTKT; LGFNEYVCYDTKTR;
GFNEYVCYDTKTRT; FNEYVCYDTKTRTG; NEYVCYDTKTRTGD;
EYVCYDTKTRTGDD; YVCYDTKTRTGDDL; VCYDTKTRTGDDLS;
CYDTKTRTGDDLSF; YDTKTRTGDDLSFF; DTKTRTGDDLSFFQ;
TKTRTGDDLSFFQK; KTRTGDDLSFFQKV; TRTGDDLSFFQKVA;
RTGDDLSFFQKVAD; TGDDLSFFQKVADA; GDDLSFFQKVADAF;
DDLSFFQKVADAFG; DLSFFQKVADAFGT; LSFFQKVADAFGTQ;
SFFQKVADAFGTQE; FFQKVADAFGTQEY; FQKVADAFGTQEYK;
QKVADAFGTQEYKK; KVADAFGTQEYKKD; VADAFGTQEYKKDE;
ADAFGTQEYKKDED; DAFGTQEYKKDEDD; AFGTQEYKKDEDDE;
FGTQEYKKDEDDEN; GTQEYKKDEDDENE; TQEYKKDEDDENEQ;
QEYKKDEDDENEQK; EYKKDEDDENEQKP; YKKDEDDENEQKPF;
KKDEDDENEQKPEK; KDEDDENEQKPEKC; DEDDENEQKPEKCN;
EDDENEQKPEKCNE; DDENEQKPEKCNEE; DENEQKPEKCNEET;
ENEQKPEKCNEETF; NEQKPEKCNEETFK; EQKPEKCNEETFKV;
QKPEKCNEETFKVT; KPEKCNEETFKVTK; PEKCNEETFKVTKR;
EKCNEETFKVTKRV; KCNEETFKVTKRVF; CNEETFKVTKRVFT;
NEETFKVTKRVFTS; EETFKVTKRVFTSF; ETFKVTKRVFTSFN;
TFKVTKRVFTSFNN; FKVTKRVFTSFNNE; KVTKRVFTSFNNEL;
VTKRVFTSFNNELA; TKRVFTSFNNELAN; KRVFTSFNNELANL;
RVFTSFNNELANLK; VFTSFNNELANLKN; FTSFNNELANLKNL;
TSFNNELANLKNLE; SFNNELANLKNLES; FNNELANLKNLESY;
NNELANLKNLESYN; NELANLKNLESYNL; ELANLKNLESYNLK;
LANLKNLESYNLKS; ANLKNLESYNLKSN; NLKNLESYNLKSNK;

16 mers:
MKRISILSILLLLLF; KRISILSILLLLLFS; RISILSILLLLLFSC;
ISILSILLLLLFSCK; SILSILLLLLFSCKQ; ILSILLLLLFSCKQY;
LSILLLLLFSCKQYG; SILLLLLFSCKQYGD; ILLLLLFSCKQYGDV;
LLLLLFSCKQYGDVK; LLLLFSCKQYGDVKS; LLLFSCKQYGDVKSL;
LLFSCKQYGDVKSLT; LFSCKQYGDVKSLTE; FSCKQYGDVKSLTEV;
SCKQYGDVKSLTEVA; CKQYGDVKSLTEVAT; KQYGDVKSLTEVATD;
QYGDVKSLTEVATDI; YGDVKSLTEVATDLE;

| | | |
|---|---|---|
| GDVKSLTEVATDLEDD; | DVKSLTEVATDLEDDN; | VKSLTEVATDLEDDNS; |
| KSLTEVATDLEDDNSF; | SLTEVATDLEDDNSFA; | LTEVATDLEDDNSFAS; |
| TEVATDLEDDNSFASG; | EVATDLEDDNSFASGS; | VATDLEDDNSFASGSV; |
| ATDLEDDNSFASGSVE; | TDLEDDNSFASGSVES; | DLEDDNSFASGSVESK; |
| LEDDNSFASGSVESKD; | EDDNSFASGSVESKDQ; | DDNSFASGSVESKDQI; |
| DNSFASGSVESKDQTT; | NSFASGSVESKDQTTE; | SFASGSVESKDQTTEK; |
| FASGSVESKDQTTEKG; | ASGSVESKDQTTEKGP; | SGSVESKDQTTEKGPV; |
| GSVESKDQTTEKGPVL; | SVESKDQTTEKGPVLT; | VESKDQTTEKGPVLTS; |
| ESKDQTTEKGPVLTSE; | SKDQTTEKGPVLTSEE; | KDQTTEKGPVLTSEEF; |
| DQTTEKGPVLTSEEFF; | QTTEKGPVLTSEEFFR; | TTEKGPVLTSEEFFRL; |
| TEKGPVLTSEEFFRLE; | EKGPVLTSEEFFRLEA; | KGPVLTSEEFFRLEAL; |
| GPVLTSEEFFRLEALK; | PVLTSEEFFRLEALKT; | VLTSEEFFRLEALKTF; |
| LTSEEFFRLEALKTFL; | TSEEFFRLEALKTFLK; | SEEFFRLEALKTFLKD; |
| EEFFRLEALKTFLKDA; | EFFRLEALKTFLKDAM; | FFRLEALKTFLKDAMG; |
| FRLEALKTFLKDAMGV; | RLEALKTFLKDAMGVN; | LEALKTFLKDAMGVNG; |
| EALKTFLKDAMGVNGR; | ALKTFLKDAMGVNGRE; | LKTFLKDAMGVNGREG; |
| KTFLKDAMGVNGREGD; | TFLKDAMGVNGREGDT; | FLKDAMGVNGREGDTK; |
| LKDAMGVNGREGDTKA; | KDAMGVNGREGDTKAF; | DAMGVNGREGDTKAFY; |
| AMGVNGREGDTKAFYE; | MGVNGREGDTKAFYEK; | GVNGREGDTKAFYEKS; |
| VNGREGDTKAFYEKSY; | NGREGDTKAFYEKSYK; | GREGDTKAFYEKSYKE; |
| REGDTKAFYEKSYKEF; | EGDTKAFYEKSYKEFF; | GDTKAFYEKSYKEFFD; |
| DTKAFYEKSYKEFFDW; | TKAFYEKSYKEFFDWL; | KAFYEKSYKEFFDWLS; |
| AFYEKSYKEFFDWLSK; | FYEKSYKEFFDWLSKD; | YEKSYKEFFDWLSKDV; |
| EKSYKEFFDWLSKDVE; | KSYKEFFDWLSKDVER; | SYKEFFDWLSKDVERQ; |
| YKEFFDWLSKDVERQK; | KEFFDWLSKDVERQKE; | EFFDWLSKDVERQKEF; |
| FFDWLSKDVERQKEFV; | FDWLSKDVERQKEFVS; | DWLSKDVERQKEFVSF; |
| WLSKDVERQKEFVSFF; | LSKDVERQKEFVSFFN; | SKDVERQKEFVSFFNK; |
| KDVERQKEFVSFFNT; | DVERQKEFVSFFNTG; | VERQKEFVSFFNTCG; |
| ERQKEFVSFFNTCGT; | RQKEFVSFFNTCGTT; | QKEFVSFFNTCGTTT; |
| KEFVSFFNTCGTTTK; | EFVSFFNTCGTTTKA; | FVSFFNTCGTTTKAV; |
| VSFFNTCGTTTKAVD; | SFFNTCGTTTKAVDA; | FFNTCGTTTKAVDAS; |
| FNTCGTTTKAVDASK; | NTCGTTTKAVDASKK; | TCGTTTKAVDASKKR; |
| CGTTTKAVDASKKRY; | GTTTKAVDASKKRYN; | TTTKAVDASKKRYNS; |
| TTKAVDASKKRYNSN; | TKAVDASKKRYNSNP; | KAVDASKKRYNSNPK; |
| AVDASKKRYNSNPKS; | VDASKKRYNSNPKSL; | DASKKRYNSNPKSLG; |
| ASKKRYNSNPKSLGF; | SKKRYNSNPKSLGFN; | KKRYNSNPKSLGFNE; |
| KRYNSNPKSLGFNEY; | RYNSNPKSLGFNEYV; | YNSNPKSLGFNEYVC; |
| NSNPKSLGFNEYVCY; | SNPKSLGFNEYVCYD; | NPKSLGFNEYVCYDT; |
| PKSLGFNEYVCYDTK; | KSLGFNEYVCYDTKT; | SLGFNEYVCYDTKTR; |
| LGFNEYVCYDTKTRT; | GFNEYVCYDTKTRTG; | FNEYVCYDTKTRTGD; |
| NEYVCYDTKTRTGDD; | EYVCYDTKTRTGDDL; | YVCYDTKTRTGDDLS; |
| VCYDTKTRTGDDLSL; | CYDTKTRTGDDLSLF; | YDTKTRTGDDLSLFF; |
| DTKTRTGDDLSLFFQ; | TKTRTGDDLSLFFQK; | KTRTGDDLSLFFQKV; |
| TRTGDDLSLFFQKVA; | RTGDDLSLFFQKVAD; | TGDDLSLFFQKVADA; |
| GDDLSLFFQKVADAF; | DDLSLFFQKVADAFG; | DLSLFFQKVADAFGT; |
| LSLFFQKVADAFGTQ; | SLFFQKVADAFGTQE; | LFFQKVADAFGTQEY; |
| FFQKVADAFGTQEYK; | FQKVADAFGTQEYKN; | QKVADAFGTQEYKNK; |
| KVADAFGTQEYKNKD; | VADAFGTQEYKNKDE; | ADAFGTQEYKNKDED; |
| DAFGTQEYKNKDEDD; | AFGTQEYKNKDEDDE; | FGTQEYKNKDEDDEN; |
| GTQEYKNKDEDDENQ; | TQEYKNKDEDDENQK; | QEYKNKDEDDENQKP; |
| EYKNKDEDDENQKPF; | YKNKDEDDENQKPFK; |

Fig. 33 continued

|  |  |
|---|---|
|  | KNKDEDDENNQKPEKC; NKDEDDENNQKPEKCN; KDEDDENNQKPEKCNE; DEDDENNQKPEKCNEE; EDDENNQKPEKCNEEI; DDENNQKPEKCNEEIF; DENNQKPEKCNEEIFK; ENNQKPEKCNEEIFKV; NNQKPEKCNEEIFKVI; NQKPEKCNEEIFKVIK; QKPEKCNEEIFKVIKR; KPEKCNEEIFKVIKRV; PEKCNEEIFKVIKRVF; EKCNEEIFKVIKRVFT; KCNEEIFKVIKRVFTE; CNEEIFKVIKRVFTES; NEEIFKVIKRVFTESE; EEIFKVIKRVFTESEN; EIFKVIKRVFTESENN; IFKVIKRVFTESENNN; FKVIKRVFTESENNNE; KVIKRVFTESENNNEL; VIKRVFTESENNNELA; IKRVFTESENNNELAN; KRVFTESENNNELANL; RVFTESENNNELANLK; VFTESENNNELANLKN; FTESENNNELANLKNL; TESENNNELANLKNLN; ESENNNELANLKNLNS; SENNNELANLKNLNSY; ENNNELANLKNLNSYN; NNNELANLKNLNSYNL; NNELANLKNLNSYNLN; NELANLKNLNSYNLNS; ELANLKNLNSYNLNSN; LANLKNLNSYNLNSNN; ANLKNLNSYNLNSNNK; |
| SEQ ID NO:34 SEQ ID NO: 111505-113094 | 13 mers: MKIKPLIQLKLLG; KIKPLIQLKLLGL; IKPLIQLKLLGLF; KPLIQLKLLGLFL; PLIQLKLLGLFLF; LIQLKLLGLFLFS; IQLKLLGLFLFSC; QLKLLGLFLFSCT; LKLLGLFLFSCTI; KLLGLFLFSCTID; LLGLFLFSCTIDA; LGLFLFSCTIDAN; GLFLFSCTIDANL; LFLFSCTIDANLN; FLFSCTIDANLNE; LFSCTIDANLNED; FSCTIDANLNEDY; SCTIDANLNEDYK; CTIDANLNEDYKN; TIDANLNEDYKNK; IDANLNEDYKNKV; DANLNEDYKNKVK; ANLNEDYKNKVKG; NLNEDYKNKVKGI; LNEDYKNKVKGIL; NEDYKNKVKGILN; EDYKNKVKGILNK; DYKNKVKGILNKA; YKNKVKGILNKAA; KNKVKGILNKAAD; NKVKGILNKAADD; KVKGILNKAADDQ; VKGILNKAADDQE; KGILNKAADDQET; GILNKAADDQETT; ILNKAADDQETTS; LNKAADDQETTSA; NKAADDQETTSAD; KAADDQETTSADT; AADDQETTSADTN; ADDQETTSADTNS; DDQETTSADTNSN; DQETTSADTNSNA; QETTSADTNSNAA; ETTSADTNSNAAK; TTSADTNSNAAKN; TSADTNSNAAKNI; SADTNSNAAKNIP; ADTNSNAAKNIPI; DTNSNAAKNIPIA; TNSNAAKNIPIAD; NSNAAKNIPIADN; SNAAKNIPIADND; NAAKNIPIADNDK; AAKNIPIADNDKV; AKNIPIADNDKVA; KNIPIADNDKVAA; NIPIADNDKVAAE; IPIADNDKVAAEL; PIADNDKVAAELK; IADNDKVAAELKK; ADNDKVAAELKKQ; DNDKVAAELKKQS; NDKVAAELKKQSQ; DKVAAELKKQSQA; KVAAELKKQSQAA; VAAELKKQSQAAK; AAELKKQSQAAKT; AELKKQSQAAKTV; ELKKQSQAAKTVA; LKKQSQAAKTVAA; KKQSQAAKTVAAA; KQSQAAKTVAAAP; QSQAAKTVAAAPN; SQAAKTVAAAPNK; QAAKTVAAAPNKG; AAKTVAAAPNKGS; AKTVAAAPNKGSQ; KTVAAAPNKGSQN; TVAAAPNKGSQNQ; VAAAPNKGSQNQP; AAAPNKGSQNQPQ; AAPNKGSQNQPQT; APNKGSQNQPQTT; PNKGSQNQPQTTP; NKGSQNQPQTTPN; KGSQNQPQTTPNK; GSQNQPQTTPNKG; SQNQPQTTPNKGS; QNQPQTTPNKGSQ; NQPQTTPNKGSQN; QPQTTPNKGSQNQ; PQTTPNKGSQNQQ; QTTPNKGSQNQQA; TTPNKGSQNQQAA; TPNKGSQNQQAAP; PNKGSQNQQAAPS; NKGSQNQQAAPSP; KGSQNQQAAPSPQ; GSQNQQAAPSPQL; SQNQQAAPSPQLQ; QNQQAAPSPQLQS; NQQAAPSPQLQSL; QQAAPSPQLQSLS; QAAPSPQLQSLSF; |

Fig. 33 continued

AAPSPQLQSLSFS; APSPQLQSLSFSA; PSPQLQSLSFSAD;
SPQLQSLSFSADL; PQLQSLSFSADLS; QLQSLSFSADLSN;
LQSLSFSADLSNL; QSLSFSADLSNLP; SLSFSADLSNLPK;
LSFSADLSNLPKT; SFSADLSNLPKTT; FSADLSNLPKTTA;
SADLSNLPKTTAA; ADLSNLPKTTAAR; DLSNLPKTTAARA;
LSNLPKTTAARAA; SNLPKTTAARAAS; NLPKTTAARAASL;
LPKTTAARAASLT; PKTTAARAASLTK; KTTAARAASLTKQ;
TTAARAASLTKQR; TAARAASLTKQRT; AARAASLTKQRTP;
ARAASLTKQRTPT; RAASLTKQRTPTQ; AASLTKQRTPTQA;
ASLTKQRTPTQAV; SLTKQRTPTQAVT; LTKQRTPTQAVTT;
TKQRTPTQAVTTV; KQRTPTQAVTTVP; QRTPTQAVTTVPG;
RTPTQAVTTVPGN; TPTQAVTTVPGNT; PTQAVTTVPGNTR;
TQAVTTVPGNTRT; QAVTTVPGNTRTF; AVTTVPGNTRTFN;
VTTVPGNTRTFNS; TTVPGNTRTFNSR; TVPGNTRTFNSRK;
VPGNTRTFNSRNS; PGNTRTFNSRKSG; GNTRTFNSRNSGL;
NTRTFNSRNSGLP; TRTFNSRNSGLPT; RTFNSRNSGLPTF;
TFNSRNSGLPTFA; FNSRNSGLPTFAL; NSRNSGLPTFALK;
SRNSGLPTFALNY; RNSGLPTFALKYS; NSGLPTFALKYSF;
SGLPTFALNYSFS; GLPTFALKYSFSQ; LPTFALKYSFSQP;
PTFALNYSFSQPT; TFALNYSFSQPTR; FALNYSFSQPTRQ;
ALNYSFSQPTRQQ; LNYSFSQPTRQQT; NYSFSQPTRQQTN;
YSFSQPTRQQTNS; SFSQPTRQQTNSS; FSQPTRQQTNSSS;
SQPTRQQTNSSSA; QPTRQQTNSSSAV; PTRQQTNSSSAVQ;
TRQQTNSSSAVQT; RQQTNSSSAVQTT; QQTNSSSAVQTTT;
QTNSSAVQTTTS; TNSSAVQTTTSS; NSSAVQTTTSSG;
SSAVQTTTSSGS; SSAVQTTTSSGSK; SAVQTTTSSGSKL;
AVQTTSSGSKLQ; VQTTSSGSKLQT; QTTSSGSKLQTL;
TTTSSGSKLQTLK; TTSSGSKLQTLKN; TSSGSKLQTLKNE;
SSGSKLQTLKNEL; SGSKLQTLKNELI; GSKLQTLKNELIR;
SKLQTLKNELIRA; KLQTLKNELIRAI; LQTLKNELIRAIS;
QTLKNELIRAISE; TLKNELIRAISEE; LKNELIRAISEEK;
KNELIRAISEEKN; NELIRAISEEKNK; ELIRAISEEKNKT;
LIRAISEEKNKTQ; IRAISEEKNKTQN; RAISEEKNKTQNK;
AISEEKNKTQNKF; ISEEKNKTQNKFG; SEEKNKTQNKFGF;
EEKNKTQNKFGFR; EKNKTQNKFGFRE; KNKTQNKFGFRET;
NKTQNKFGFRETY; KTQNKFGFRETYD; TQNKFGFRETYDQ;
QNKFGFRETYDQF; NKFGFRETYDQFK; KFGFRETYDQFKM;
FGFRETYDQFKMK; GFRETYDQFKMKD; FRETYDQFKMKDS;
RETYDQFKMKDSA; ETYDQFKMKDSAF; TYDQFKMKDSAFE;
YDQFKMKDSAFEL; DQFKMKDSAFELL; QFKMKDSAFELLD;
FKMKDSAFELLDV; KMKDSAFELLDVI; MKDSAFELLDVIS;
KDSAFELLDVISS; DSAFELLDVISSA; SAFELLDVISSAK;
AFELLDVISSAKV; FELLDVISSAKVY; ELLDVISSAKVYD;
LLDVISSAKVYDR; LDVISSAKVYDRS; DVISSAKVYDRSY;
VISSAKVYDRSYA; ISSAKVYDRSYAP; SSAKVYDRSYAPQ;
SAKVYDRSYAPQL; AKVYDRSYAPQLN; KVYDRSYAPQLNS;
VYDRSYAPQLNSN; YDRSYAPQLNSNT; DRSYAPQLNSNTP;
RSYAPQLNSNTPE; SYAPQLNSNTPEA; YAPQLNSNTPEAE;
APQLNSNTPEAEN; PQLNSNTPEAENR; QLNSNTPEAENER;
LNSNTPEAENERE; NSNTPEAENEREK; SNTPEAENEREKE;
NTPEAENERKEY; TPEAENERKEYA; PEAENERNKEYAI;

Fig. 33 continued

MAENERNKFYALM; AENERKKFYALMD; ENERKKFYALMDF;
NERKKFYALMDFD; ERKKFYALMDFDQ; RKKFYALMDFDQY;
NKFYALMDFDQYK; KFYALMDFDQYKI; FYALMDFDQYKIE;
YALMDFDQYKIEQ; ALMDFDQYKIEQF; LMDFDQYKIEQFG;
MDFDQYKIEQFGS; DFDQYKIEQFGSI; FDQYKIEQFGSIM;
DQYKIEQFGSIME; QYKIEQFGSIMEA; YKIEQFGSIMEAL;
KIEQFGSIMEALY; IEQFGSIMEALYN; EQFGSIMEALYNE;
QFGSIMEALYNEK; FGSIMEALYNEKQ; GSIMEALYNEKQH;
SIMEALYNEKQNH; IMEALYNEKQKHS; MEALYNEKQNHSL;
EALYNEKQNHSLT; ALYNEKQNHSLTR; LYNEKQNHSLTRE;
YNEKQNHSLTREL; NEKQNHSLTRELM; EKQNHSLTRELMT;
KQNHSLTRELMTS; QNHSLTRELMTSG; NHSLTRELMTSGL;
HSLTRELMTSGLG; SLTRELMTSGLGT; LTRELMTSGLGTQ;
TRELMTSGLGTQT; RELMTSGLGTQTS; ELMTSGLGTQTSF;
LMTSGLGTQTSFE; MTSGLGTQTSFEL; TSGLGTQTSFELA;
SGLGTQTSFELAL; GLGTQTSFELALE; LGTQTSFELALEE;
GTQTSFELALEET; TQTSFELALEETN; QTSFELALEETNK;
TSFELALEETNKK; SFELALEETNKKI; FELALEETNKKIE;
ELALEETNKKIEL; LALEETNKKIELF; ALEETNKKIELFN;
LEETNKKIELFNQ; EETNKKIELFNQD; ETNKKIELFNQDY;
TNKKIELFNQDYL; NKKIELFNQDYLN; KKIELFNQDYLNA;
KIELFNQDYLNAK; IELFNQDYLNAKI; ELFNQDYLNAKIE;
LFNQDYLNAKIES; FNQDYLNAKIESF; NQDYLNAKIESFD;
QDYLNAKIESFDF; DYLNAKIESFDFT; YLNAKIESFDFTM;
LNAKIESFDFTMK; NAKIESFDFTMKL; AKIESFDFTMKLK;
KIESFDFTMKLKE; IESFDFTMKLKEL; ESFDFTMKLKELK;
SFDFTMKLKELKS; FDFTMKLKELKSK; DFTMKLKELKSKL;
FTMKLKELKSKLN; TMKLKELKSKLNQ; MKLKELKSKLNQT;
KLKELKSKLNQTL; LKELKSKLNQTLD; KELKSKLNQTLDK;
ELKSKLNQTLDKR; LKSKLNQTLDKRK; KSKLNQTLDKRKE;
SKLNQTLDKRKEW; KLNQTLDKRKEWS; LNQTLDKRKEWSR;
NQTLDKRKEWSRQ; QTLDKRKEWSRQA; TLDKRKEWSRQAD;
LDKRKEWSRQADG; DKRKEWSRQADGL; KRKEWSRQADGLT;
RKEWSRQADGLTA; KEWSRQADGLTAN; EWSRQADGLTANA;
WSRQADGLTANAS; SRQADGLTANASS; RQADGLTANASSN;
QADGLTANASSNS; ADGLTANASSNSS; DGLTANASSNSSL;
GLTANASSNSSLS; LTANASSNSSLSD; TANASSNSSLSDS;
ANASSNSSLSDSK; NASSNSSLSDSKS; ASSNSSLSDSKSL;
SSNSSLSDSKSLA; SNSSLSDSKSLAF; NSSLSDSKSLAFY;
SSLSDSKSLAFYT; SLSDSKSLAFYTK; LSDSKSLAFYTKK;
SDSKSLAFYTKKR; DSKSLAFYTKKRY; SKSLAFYTKKRYL;
KSLAFYTKKRYLD; SLAFYTKKRYLDN; LAFYTKKRYLDNM;
AFYTKKRYLDNMQ; FYTKKRYLDNMQN; YTKKRYLDNMQNA;
TKKRYLDNMQNAR; KKRYLDNMQNARQ; KRYLDNMQNARQS;
RYLDNMQNARQSV; YLDNMQNARQSVL; LDNMQNARQSVLE;
DNMQNARQSVLEA; NMQNARQSVLEAY; MQNARQSVLEAYL;
QNARQSVLEAYTS; NARQSVLEAYTST; ARQSVLEAYTSTM;

14 more:
NKIKPLIQLKLLGL; KIKPLIQLKLLGLF; IKPLIQLKLLGLFL;
KPLIQLKLLGLFL; PLIQLKLLGLFLS; LIQLKLLGLFLSQ;

Fig. 33 continued

IQLKLLGLFLFSCT; QLKLLGLFLFSCTI; LKLLGLFLFSCTID;
KLLGLFLFSCTIDA; LLGLFLFSCTTDAK; LGLFLFSCTTDAKL;
GLFLFSCTTDANL; LFLFSCTTDANLN; FLFSCTTDANLNED;
LFSCTTDANLNEDY; FSCTTDANLNEDYK; SCTTDANLNEDYKN;
CTTDANLNEDYKNK; TTDANLNEDYKNKV; TDANLNEDYKNKVK;
DANLNEDYKNKVKG; ANLNEDYKNKVKGT; NLNEDYKNKVKGTL;
LNEDYKNKVKGTLN; NEDYKNKVKGTLNK; EDYKNKVKGTLNKA;
DYKNKVKGTLNKAA; YKNKVKG

SGLPTFALNYSFSQQ; GLPTFALNYSFSQP; LPTFALNYSFSQPT;
PTFALNYSFSQPTR; TFALNYSFSQPTRQ; FALNYSFSQPTRQQ;
ALNYSFSQPTRQQT; LNYSFSQPTRQQTN; NYSFSQPTRQQTNS;
YSFSQPTRQQTNSS; SFSQPTRQQTNSSS; FSQPTRQQTNSSSA;
SQPTRQQTNSSAV; QPTRQQTNSSAVQ; PTRQQTNSSAVQT;
TRQQTNSSAVQTT; RQQTNSSAVQTTT; QQTNSSAVQTTTS;
QTNSSAVQTTTSS; TNSSAVQTTTSSG; NSSAVQTTTSSGS;
SSAVQTTTSSGSK; SAVQTTTSSGSKL; AVQTTTSSGSKLQ;
AVQTTTSSGSKLQT; VQTTTSSGSKLQTT; QTTSSGSKLQTLK;
TTTSSGSKLQTLKN; TTSSGSKLQTLKNE; TSSGSKLQTLKNEL;
SSGSKLQTLKNELT; SGSKLQTLKNELTR; GSKLQTLKNELTRA;
SKLQTLKNELTRAI; KLQTLKNELTRAIS; LQTLKNELTRAISE;
QTLKNELTRAISEF; TLKNELTRAISEEK; LKNELTRAISEEKN;
KNELTRAISEEKK; NELTRAISEEKNKT; ELTRAISEEKKTQ;
LTRAISEEKKTQN; TRAISEEKNKIQKK; RAISEEKNKTQNF;
AISEEKNKTQNFG; ISEEKNKQENFGF; SEEKKKTQNFGFR;
EEKNKTQNFGFRE; EKKTQKKFGFRET; KNKTQNFGFRETY;
NKTQNFGFRETYD; K

ELAEEIKKIEIF; LAEEIKKIEIFK; AEEIKKIEIFKQ;
EEIKKIEIFKQD; EIKKIEIFKQDY; IKKIEIFKQDYL;
KKIEIFKQDYLN; KIEIFKQDYLNA; IEIFKQDYLNAK;
EIFKQDYLNAKI; IFKQDYLNAKIE; FKQDYLNAKIES;
KQDYLNAKIESF; QDYLNAKIESFD; DYLNAKIESFDF;
DYLNAKIESFDF; YLNAKIESFDFT; LNAKIESFDFTM;
NAKIESFDFTMK; AKIESFDFTMKL; KIESFDFTMKLR;
IESFDFTMKLREL; ESFDFTMKLRELK; SFDFTMKLRELKS;
FDFTMKLRELKSK; DFTMKLRELKSKI; FTMKLRELKSKIN;
TMKLRELKSKINQ; MKLRELKSKINQT; KLRELKSKINQTL;
LRELKSKINQTLD; RELKSKINQTLDK; ELKSKINQTLDKR;
LKSKINQTLDKRK; KSKINQTLDKRKE; SKINQTLDKRKEW;
KINQTLDKRKEWS; INQTLDKRKEWSR; NQTLDKRKEWSRQ;
QTLDKRKEWSRQA; TLDKRKEWSRQAD; LDKRKEWSRQADG;
DKRKEWSRQADGL; KRKEWSRQADGLT; RKEWSRQADGLTA;
KEWSRQADGLTAN; EWSRQADGLTANA; WSRQADGLTANAS;
SRQADGLTANASS; RQADGLTANASSN; QADGLTANASSNS;
ADGLTANASSNSL; DGLTANASSNSLS; GLTANASSNSLSD;
LTANASSNSLSDS; TANASSNSLSDSK; ANASSNSLSDSKS;
NASSNSLSDSKSL; ASSNSLSDSKSLA; SSNSLSDSKSLAE;
SNSLSDSKSLAEY; NSLSDSKSLAEYI; SLSDSKSLAEYIK;
LSDSKSLAEYIKK; SDSKSLAEYIKKR; DSKSLAEYIKKRY;
SKSLAEYIKKRYL; KSLAEYIKKRYLD; SLAEYIKKRYLDN;
LAEYIKKRYLDNM; AEYIKKRYLDNMQ; EYIKKRYLDNMQN;
YIKKRYLDNMQNA; IKKRYLDNMQNAR; KKRYLDNMQNARQ;
KRYLDNMQNARQS; RYLDNMQNARQSV; YLDNMQNARQSVL;
LDNMQNARQSVLE; DNMQNARQSVLEA; NMQNARQSVLEAY;
MQNARQSVLEAYT; QNARQSVLEAYTS; NARQSVLEAYTST;
ARQSVLEAYTSTM;

15 mers:
MKIKPITQKILGLF; KIKPITQKILGLFI; IKPITQKILGLFIS;
KPITQKILGLFISC; PITQKILGLFISCT; ITQKILGLFISCTI;
TQKILGLFISCTID; QKILGLFISCTIDA; KILGLFISCTIDAN;
ILGLFISCTIDANL; LGLFISCTIDANLE; GLFISCTIDANLED;
LFISCTIDANLEDY; FISCTIDANLEDYK; ISCTIDANLEDYKK;
SCTIDANLEDYKKV; CTIDANLEDYKKVK; TIDANLEDYKKVKG;
IDANLEDYKKVKGT; DANLEDYKKVKGTL; ANLEDYKKVKGTLN;
NLEDYKKVKGTLNK; LEDYKKVKGTLNKA; EDYKKVKGTLNKAA;
DYKKVKGTLNKAAD; YKKVKGTLNKAADD; KKVKGTLNKAADDQ;
KVKGTLNKAADDQE; VKGTLNKAADDQET; KGTLNKAADDQETT;
GTLNKAADDQETTS; TLNKAADDQETTSA; LNKAADDQETTSAD;
NKAADDQETTSADT; KAADDQETTSADTK; AADDQETTSADTKS;
ADDQETTSADTKSN; DDQETTSADTKSNA; DQETTSADTKSNAA;
QETTSADTKSNAAK; ETTSADTKSNAAKK; TTSADTKSNAAKKI;
TSADTKSNAAKKIP; SADTKSNAAKKIPT; ADTKSNAAKKIPTA;
DTKSNAAKKIPTAD; TKSNAAKKIPTADN; KSNAAKKIPTADNK;
SNAAKKIPTADNKV; NAAKKIPTADNKVA; AAKKIPTADNKVAA;
AKKIPTADNKVAAE; KKIPTADNKVAAEL; KIPTADNKVAAELK;
IPTADNKVAAELKQ; PTADNKVAAELKQ;

Fig. 33 continued

| | | |
|---|---|---|
| IADNKVAAELKKQS; | ADNKVAAELKKQSQ; | DNKVAAELKKQSQA; |
| NKVAAELKKQSQAA; | KVAAELKKQSQAAK; | VAAELKKQSQAAKT; |
| VAAELKKQSQAAKTV; | AAELKKQSQAAKTVA; | AELKKQSQAAKTVAA; |
| ELKKQSQAAKTVAAA; | LKKQSQAAKTVAAAP; | KKQSQAAKTVAAAPK; |
| KQSQAAKTVAAAPKK; | QSQAAKTVAAAPKKG; | SQAAKTVAAAPKKGS; |
| QAAKTVAAAPKKGSQ; | AAKTVAAAPKKGSQK; | AKTVAAAPKKGSQKQ; |
| KTVAAAPKKGSQKQP; | TVAAAPKKGSQKQPQ; | VAAAPKKGSQKQPQT; |
| AAAPKKGSQKQPQTT; | AAPKKGSQKQPQTTP; | APKKGSQKQPQTTPK; |
| PKKGSQKQPQTTPKK; | KKGSQKQPQTTPKKG; | KGSQKQPQTTPKKGS; |
| GSQKQPQTTPKKGSQ; | SQKQPQTTPKKGSQK; | QKQPQTTPKKGSQKQ; |
| KQPQTTPKKGSQKQA; | QPQTTPKKGSQKQAA; | PQTTPKKGSQKQAAP; |
| QTTPKKGSQKQAAPS; | TTPKKGSQKQAAPSP; | TPKKGSQKQAAPSPQ; |
| PKKGSQKQAAPSPQ; | KKGSQKQAAPSPQL; | KGSQKQAAPSPQLQ; |
| GSQKQAAPSPQLQS; | SQKQAAPSPQLQSL; | QKQAAPSPQLQSLS; |
| KQAAPSPQLQSLSF; | QAAPSPQLQSLSFS; | AAPSPQLQSLSFSA; |
| APSPQLQSLSFSAD; | PSPQLQSLSFSADL; | SPQLQSLSFSADLS; |
| PQLQSLSFSADLSN; | QLQSLSFSADLSNL; | LQSLSFSADLSNLP; |
| QSLSFSADLSNLPK; | SLSFSADLSNLPKT; | LSFSADLSNLPKTT; |
| SFSADLSNLPKTTA; | FSADLSNLPKTTAA; | SADLSNLPKTTAAR; |
| ADLSNLPKTTAARA; | DLSNLPKTTAARAA; | LSNLPKTTAARAAS; |
| SNLPKTTAARAASL; | NLPKTTAARAASLT; | LPKTTAARAASLTK; |
| PKTTAARAASLTKQ; | KTTAARAASLTKQR; | TTAARAASLTKQRI; |
| TAARAASLTKQRIP; | AARAASLTKQRIPI; | ARAASLTKQRIPIQ; |
| RAASLTKQRIPIQA; | AASLTKQRIPIQAV; | ASLTKQRIPIQAVT; |
| SLTKQRIPIQAVTT; | LTKQRIPIQAVTTV; | TKQRIPIQAVTTVP; |
| KQRIPIQAVTTVPG; | QRIPIQAVTTVPGK; | RIPIQAVTTVPGKT; |
| IPIQAVTTVPGKTR; | PIQAVTTVPGKTRT; | IQAVTTVPGKTRTF; |
| QAVTTVPGKTRTFN; | AVTTVPGKTRTFNS; | VTTVPGKTRTFNSR; |
| TTVPGKTRTFNSRS; | TVPGKTRTFNSRNS; | VPGKTRTFNSRNSG; |
| PGKTRTFNSRNSGL; | GKTRTFNSRNSGLP; | KTRTFNSRNSGLPT; |
| TRTFNSRNSGLPTF; | RTFNSRNSGLPTFA; | TFNSRNSGLPTFAL; |
| FNSRNSGLPTFALN; | NSRNSGLPTFALNY; | SRNSGLPTFALNYS; |
| RNSGLPTFALNYSF; | NSGLPTFALNYSFS; | SGLPTFALNYSFSQ; |
| GLPTFALNYSFSQP; | LPTFALNYSFSQPT; | PTFALNYSFSQPTR; |
| TFALNYSFSQPTRQ; | FALNYSFSQPTRQQ; | ALNYSFSQPTRQQT; |
| LNYSFSQPTRQQTN; | NYSFSQPTRQQTNS; | YSFSQPTRQQTNSS; |
| SFSQPTRQQTNSSA; | FSQPTRQQTNSSAV; | SQPTRQQTNSSAVQ; |
| QPTRQQTNSSAVQT; | PTRQQTNSSAVQTT; | TRQQTNSSAVQTTS; |
| RQQTNSSAVQTTSS; | QQTNSSAVQTTSSG; | QTNSSAVQTTSSGS; |
| TNSSAVQTTSSGSK; | NSSAVQTTSSGSKL; | SSAVQTTSSGSKLQ; |
| SAVQTTSSGSKLQT; | AVQTTSSGSKLQTT; | VQTTSSGSKLQTTK; |
| QTTSSGSKLQTTKN; | TTSSGSKLQTTKNF; | TSSGSKLQTTKNFL; |
| SSGSKLQTTKNFLT; | SGSKLQTTKNFLTR; | GSKLQTTKNFLTRA; |
| SKLQTTKNFLTRAI; | KLQTTKNFLTRAIS; | LQTTKNFLTRAISE; |
| QTTKNFLTRAISEK; | TTKNFLTRAISEKK; | TKNFLTRAISEKKK; |
| KNFLTRAISEKKKT; | NFLTRAISEKKKTQ; | FLTRAISEKKKTQN; |
| LTRAISEKKKTQND; | TRAISEKKKTQNDF; | RAISEKKKTQNDFG; |
| AISEKKKTQNDFGR; | ISEKKKTQNDFGRE; | SEKKKTQNDFGRET; |
| EKKKTQNDFGRETY; | KKKTQNDFGRETYD; | KKTQNDFGRETYDQ; |
| KTQNDFGRETYDQF; | TQNDFGRETYDQFK; |  |

Fig. 33 continued

| | | |
|---|---|---|
| QRKFGRETYDQFKM; | KFGRETYDQFKMK; | FGRETYDQFKMKD; |
| GRETYDQFKMKDS; | RETYDQFKMKDSA; | ETYDQFKMKDSAF; |
| TYDQFKMKDSAFE; | YDQFKMKDSAFEL; | DQFKMKDSAFELL; |
| QFKMKDSAFELLD; | FKMKDSAFELLDV; | KMKDSAFELLDVI; |
| MKDSAFELLDVIS; | KDSAFELLDVISS; | DSAFELLDVISSA; |
| SAFELLDVISSAK; | AFELLDVISSAKV; | FELLDVISSAKVY; |
| ELLDVISSAKVYD; | LLDVISSAKVYDR; | LDVISSAKVYDRS; |
| DVISSAKVYDRSY; | VISSAKVYDRSYA; | ISSAKVYDRSYAP; |
| SSAKVYDRSYAPQ; | SAKVYDRSYAPQL; | AKVYDRSYAPQLN; |
| KVYDRSYAPQLNS; | VYDRSYAPQLNSK; | YDRSYAPQLNSKT; |
| DRSYAPQLNSKTP; | RSYAPQLNSKTPE; | SYAPQLNSKTPEA; |
| YAPQLNSKTPEAK; | APQLNSKTPEAKE; | PQLNSKTPEAKER; |
| QLNSKTPEAKERK; | LNSKTPEAKERKF; | NSKTPEAKERKFY; |
| SKTPEAKERKFYA; | KTPEAKERKFYAL; | TPEAKERKFYALM; |
| PEAKERKFYALMD; | EAKERKFYALMDF; | AKERKFYALMDFD; |
| KERKFYALMDFDQ; | ERKFYALMDFDQY; | RKFYALMDFDQYK; |
| KFYALMDFDQYKI; | FYALMDFDQYKIE; | YALMDFDQYKIEQ; |
| ALMDFDQYKIEQF; | LMDFDQYKIEQFG; | MDFDQYKIEQFGS; |
| DFDQYKIEQFGSI; | FDQYKIEQFGSIM; | DQYKIEQFGSIME; |
| QYKIEQFGSIMEA; | YKIEQFGSIMEAL; | KIEQFGSIMEALY; |
| IEQFGSIMEALYN; | EQFGSIMEALYNE; | QFGSIMEALYNEK; |
| FGSIMEALYNEKQ; | GSIMEALYNEKQH; | SIMEALYNEKQHS; |
| IMEALYNEKQHSL; | MEALYNEKQHSLL; | EALYNEKQHSLLR; |
| ALYNEKQHSLLRF; | LYNEKQHSLLRFI; | YNEKQHSLLRFIM; |
| NEKQHSLLRFIMS; | EKQHSLLRFIMSG; | KQHSLLRFIMSGI; |
| QHSLLRFIMSGIG; | HSLLRFIMSGIGT; | SLLRFIMSGIGTQ; |
| LLRFIMSGIGTQT; | LRFIMSGIGTQTS; | RFIMSGIGTQTSF; |
| FIMSGIGTQTSFE; | IMSGIGTQTSFEL; | MSGIGTQTSFELA; |
| SGIGTQTSFELAL; | GIGTQTSFELALE; | IGTQTSFELALEE; |
| GTQTSFELALEEI; | TQTSFELALEEIN; | QTSFELALEEINK; |
| TSFELALEEINKK; | SFELALEEINKKT; | FELALEEINKKTE; |
| ELALEEINKKTEF; | LALEEINKKTEFN; | ALEEINKKTEFNQ; |
| LEEINKKTEFNQD; | EEINKKTEFNQDY; | EINKKTEFNQDYL; |
| INKKTEFNQDYLN; | NKKTEFNQDYLNA; | KKTEFNQDYLNAK; |
| KTEFNQDYLNAKT; | TEFNQDYLNAKTN; | EFNQDYLNAKTNS; |
| FNQDYLNAKTNSF; | NQDYLNAKTNSFD; | QDYLNAKTNSFDF; |
| DYLNAKTNSFDFT; | YLNAKTNSFDFTM; | LNAKTNSFDFTMK; |
| NAKTNSFDFTMKL; | AKTNSFDFTMKLK; | KTNSFDFTMKLKE; |
| TNSFDFTMKLKEL; | NSFDFTMKLKELK; | SFDFTMKLKELKS; |
| FDFTMKLKELKSK; | DFTMKLKELKSKL; | FTMKLKELKSKLQ; |
| TMKLKELKSKLQT; | MKLKELKSKLQTL; | KLKELKSKLQTLD; |
| LKELKSKLQTLDK; | KELKSKLQTLDKR; | ELKSKLQTLDKRK; |
| LKSKLQTLDKRKE; | KSKLQTLDKRKEW; | SKLQTLDKRKEWS; |
| KLQTLDKRKEWSR; | LQTLDKRKEWSRQ; | QTLDKRKEWSRQA; |
| TLDKRKEWSRQAD; | LDKRKEWSRQADG; | DKRKEWSRQADGL; |
| KRKEWSRQADGLI; | RKEWSRQADGLIA; | KEWSRQADGLIAN; |
| EWSRQADGLIANA; | WSRQADGLIANAS; | SRQADGLIANASS; |
| RQADGLIANASSN; | QADGLIANASSNS; | ADGLIANASSNSS; |
| DGLIANASSNSSD; | | |

| | | | |
|---|---|---|---|
| | LSFSADLSNLPKTTAA; | SFSADLSNLPKTTAAR; | FSADLSNLPKTTAARA; |
| | SADLSNLPKTTAARAA; | ADLSNLPKTTAARAAS; | DLSNLPKTTAARAASL; |
| | LSNLPKTTAARAASLT; | SNLPKTTAARAASLTK; | NLPKTTAARAASLTKQ; |
| | LPKTTAARAASLTKQR; | PKTTAARAASLTKQRI; | KTTAARAASLTKQRIP; |
| | TTAARAASLTKQRIPI; | TAARAASLTKQRIPIQ; | AARAASLTKQRIPIQA; |
| | ARAASLTKQRIPIQAV; | RAASLTKQRIPIQAVT; | AASLTKQRIPIQAVTT; |
| | ASLTKQRIPIQAVTTV; | SLTKQRIPIQAVTTVP; | LTKQRIPIQAVTTVPG; |
| | TKQRIPIQAVTTVPGN; | KQRIPIQAVTTVPGNT; | QRIPIQAVTTVPGNTR; |
| | RIPIQAVTTVPGNTRT; | IPIQAVTTVPGNTRTF; | PIQAVTTVPGNTRTFN; |
| | IQAVTTVPGNTRTFNS; | QAVTTVPGNTRTFNSR; | AVTTVPGNTRTFNSRN; |
| | VTTVPGNTRTFNSRNS; | TTVPGNTRTFNSRNSG; | TVPGNTRTFNSRNSGL; |
| | VPGNTRTFNSRNSGLP; | PGNTRTFNSRNSGLPT; | GNTRTFNSRNSGLPTF; |
| | NTRTFNSRNSGLPTFA; | TRTFNSRNSGLPTFAL; | RTFNSRNSGLPTFALN; |
| | TFNSRNSGLPTFALNY; | FNSRNSGLPTFALNYS; | NSRNSGLPTFALNYSF; |
| | SRNSGLPTFALNYSFS; | RNSGLPTFALNYSFSQ; | NSGLPTFALNYSFSQP; |
| | SGLPTFALNYSFSQPT; | GLPTFALNYSFSQPTR; | LPTFALNYSFSQPTRQ; |
| | PTFALNYSFSQPTRQQ; | TFALNYSFSQPTRQQT; | FALNYSFSQPTRQQTN; |
| | ALNYSFSQPTRQQTNS; | LNYSFSQPTRQQTNSS; | NYSFSQPTRQQTNSSS; |
| | YSFSQPTRQQTNSSSA; | SFSQPTRQQTNSSSAV; | FSQPTRQQTNSSSAVQ; |
| | SQPTRQQTNSSSAVQT; | QPTRQQTNSSSAVQTT; | PTRQQTNSSSAVQTTT; |
| | TRQQTNSSSAVQTTTS; | RQQTNSSSAVQTTTSS; | QQTNSSSAVQTTTSSG; |
| | QTNSSSAVQTTTSSGS; | TNSSSAVQTTTSSGSK; | NSSSAVQTTTSSGSKL; |
| | SSSAVQTTTSSGSKLQ; | SSAVQTTTSSGSKLQT; | SAVQTTTSSGSKLQTL; |
| | AVQTTTSSGSKLQTLK; | VQTTTSSGSKLQTLKN; | QTTTSSGSKLQTLKNE; |
| | TTTSSGSKLQTLKNEL; | TTSSGSKLQTLKNELI; | TSSGSKLQTLKNELIR; |
| | SSGSKLQTLKNELIRA; | SGSKLQTLKNELIRAI; | GSKLQTLKNELIRAIS; |
| | SKLQTLKNELIRAISE; | KLQTLKNELIRAISEE; | LQTLKNELIRAISEEK; |
| | QTLKNELIRAISEEKN; | TLKNELIRAISEEKNK; | LKNELIRAISEEKNKT; |
| | KNELIRAISEEKNKTQ; | NELIRAISEEKNKTQN; | ELIRAISEEKNKTQNN; |
| | LIRAISEEKNKTQNNF; | IRAISEEKNKTQNNFG; | RAISEEKNKTQNNFGF; |
| | AISEEKNKTQNNFGFR; | ISEEKNKTQNNFGFRE; | SEEKNKTQNNFGFRET; |
| | EEKNKTQNNFGFRETY; | EKNKTQNNFGFRETYD; | KNKTQNNFGFRETYDQ; |
| | NKTQNNFGFRETYDQF; | KTQNNFGFRETYDQFK; | TQNNFGFRETYDQFKM; |
| | QNNFGFRETYDQFKMK; | NNFGFRETYDQFKMKD; | NFGFRETYDQFKMKDS; |
| | FGFRETYDQFKMKDSA; | GFRETYDQFKMKDSAF; | FRETYDQFKMKDSAFE; |
| | RETYDQFKMKDSAFEL; | ETYDQFKMKDSAFELL; | TYDQFKMKDSAFELLD; |
| | YDQFKMKDSAFELLDV; | DQFKMKDSAFELLDVI; | QFKMKDSAFELLDVIS; |
| | FKMKDSAFELLDVISS; | KMKDSAFELLDVISSA; | MKDSAFELLDVISSAK; |
| | KDSAFELLDVISSAKV; | DSAFELLDVISSAKVY; | SAFELLDVISSAKVYD; |
| | AFELLDVISSAKVYDR; | FELLDVISSAKVYDRS; | ELLDVISSAKVYDRSY; |
| | LLDVISSAKVYDRSYA; | LDVISSAKVYDRSYAP; | DVISSAKVYDRSYAPQ; |
| | VISSAKVYDRSYAPQL; | ISSAKVYDRSYAPQLN; | SSAKVYDRSYAPQLNS; |
| | SAKVYDRSYAPQLNSN; | AKVYDRSYAPQLNSNT; | KVYDRSYAPQLNSNTP; |
| | VYDRSYAPQLNSNTPE; | YDRSYAPQLNSNTPEA; | DRSYAPQLNSNTPEAE; |
| | RSYAPQLNSNTPEAEN; | SYAPQLNSNTPEAENE; | YAPQLNSNTPEAENER; |
| | APQLNSNTPEAENERN; | PQLNSNTPEAENERNK; | QLNSNTPEAENERNKF; |
| | LNSNTPEAENERNKFY; | NSNTPEAENERNKFYA; | SNTPEAENERNKFYAL; |
| | NTPEAENERNKFYALM; | TPEAENERNKFYALMD; | PEAENERNKFYALMDF; |
| | EAENERNKFYALMDFD; | AENERNKFYALMDFDQ; | ENERNKFYALMDFDQY; |
| | NERNKFYALMDFDQYK; | ERNKFYALMDFDQYKI; | RNKFYALMDFDQYKIE; |
| | NKFYALMDFDQYKIEQ; | KFYALMDFDQYKIEQF; | FYALMDFDQYKIEQFG; |

Fig. 33 continued

| | YALMDFDQYKIEQFGS; ALMDFDQYKIEQFGSI; LMDFDQYKIEQFGSIM; |
| --- | --- |
| | MDFDQYKIEQFGSIME; DFDQYKIEQFGSIMEA; FDQYKIEQFGSIMEAL; |
| | DQYKIEQFGSIMEALY; QYKIEQFGSIMEALYN; YKIEQFGSIMEALYNE; |
| | KIEQFGSIMEALYNEN; IEQFGSIMEALYNENQ; EQFGSIMEALYNENQN; |
| | QFGSIMEALYNENQNH; FGSIMEALYNENQNHS; GSIMEALYNENQNHSL; |
| | SIMEALYNENQNHSLI; IMEALYNENQNHSLIR; MEALYNENQNHSLIRE; |
| | EALYNENQNHSLIREL; ALYNENQNHSLIRELM; LYNENQNHSLIRELMI; |
| | YNENQNHSLIRELMIS; NENQNHSLIRELMISG; ENQNHSLIRELMISGL; |
| | NQNHSLIRELMISGLG; QNHSLIRELMISGLGT; NHSLIRELMISGLGTQ; |
| | HSLIRELMISGLGTQI; SLIRELMISGLGTQIS; LIRELMISGLGTQISF; |
| | IRELMISGLGTQISFE; RELMISGLGTQISFEL; ELMISGLGTQISFELA; |
| | LMISGLGTQISFELAL; MISGLGTQISFELALE; ISGLGTQISFELALEE; |
| | SGLGTQISFELALEEI; GLGTQISFELALEEIN; LGTQISFELALEEINK; |
| | GTQISFELALEEINKK; TQISFELALEEINKKI; QISFELALEEINKKIE; |
| | ISFELALEEINKKIEI; SFELALEEINKKIEIF; FELALEEINKKIEIFN; |
| | ELALEEINKKIEIFNQ; LALEEINKKIEIFNQD; ALEEINKKIEIFNQDY; |
| | LEEINKKIEIFNQDYL; EEINKKIEIFNQDYLN; EINKKIEIFNQDYLNA; |
| | INKKIEIFNQDYLNAK; NKKIEIFNQDYLNAKI; KKIEIFNQDYLNAKIN; |
| | KIEIFNQDYLNAKINS; IEIFNQDYLNAKINSF; EIFNQDYLNAKINSFD; |
| | IFNQDYLNAKINSFDF; FNQDYLNAKINSFDFT; NQDYLNAKINSFDFTM; |
| | QDYLNAKINSFDFTMK; DYLNAKINSFDFTMKL; YLNAKINSFDFTMKLK; |
| | LNAKINSFDFTMKLKE; NAKINSFDFTMKLKEL; AKINSFDFTMKLKELK; |
| | KINSFDFTMKLKELKS; INSFDFTMKLKELKSK; NSFDFTMKLKELKSKL; |
| | SFDFTMKLKELKSKLN; FDFTMKLKELKSKLNQ; DFTMKLKELKSKLNQI; |
| | FTMKLKELKSKLNQIL; TMKLKELKSKLNQILD; MKLKELKSKLNQILDK; |
| | KLKELKSKLNQILDKR; LKELKSKLNQILDKRK; KELKSKLNQILDKRKE; |
| | ELKSKLNQILDKRKEW; LKSKLNQILDKRKEWS; KSKLNQILDKRKEWSR; |
| | SKLNQILDKRKEWSRQ; KLNQILDKRKEWSRQA; LNQILDKRKEWSRQAD; |
| | NQILDKRKEWSRQADG; QILDKRKEWSRQADGL; ILDKRKEWSRQADGLI; |
| | LDKRKEWSRQADGLIA; DKRKEWSRQADGLIAN; KRKEWSRQADGLIANA; |
| | RKEWSRQADGLIANAS; KEWSRQADGLIANASS; EWSRQADGLIANASSN; |
| | WSRQADGLIANASSNS; SRQADGLIANASSNSS; RQADGLIANASSNSSL; |
| | QADGLIANASSNSSLS; ADGLIANASSNSSLSD; DGLIANASSNSSLSDS; |
| | GLIANASSNSSLSDSK; LIANASSNSSLSDSKS; IANASSNSSLSDSKSL; |
| | ANASSNSSLSDSKSLA; NASSNSSLSDSKSLAE; ASSNSSLSDSKSLAEY; |
| | SSNSSLSDSKSLAEYI; SNSSLSDSKSLAEYIK; NSSLSDSKSLAEYIKK; |
| | SSLSDSKSLAEYIKKR; SLSDSKSLAEYIKKRY; LSDSKSLAEYIKKRYL; |
| | SDSKSLAEYIKKRYLD; DSKSLAEYIKKRYLDN; SKSLAEYIKKRYLDNM; |
| | KSLAEYIKKRYLDNMQ; SLAEYIKKRYLDNMQN; LAEYIKKRYLDNMQNA; |
| | AEYIKKRYLDNMQNAR; EYIKKRYLDNMQNARQ; YIKKRYLDNMQNARQS; |
| | IKKRYLDNMQNARQSV; KKRYLDNMQNARQSVL; KRYLDNMQNARQSVLE; |
| | RYLDNMQNARQSVLEA; YLDNMQNARQSVLEAY; LDNMQNARQSVLEAYI; |
| | DNMQNARQSVLEAYIS; NMQNARQSVLEAYISI; MQNARQSVLEAYISIM; |
| SEQ ID NO:35 SEQ ID NO: 113095-114736 | 13 mers: MSSCTIDANLNKD; SSCTIDANLNKDY; SCTIDANLNKDYK; CTIDANLNKDYKN; TIDANLNKDYKNK; IDANLNKDYKNKV; DANLNKDYKNKVE; ANLNKDYKNKVEE; NLNKDYKNKVEEL; LNKDYKNKVEELL; NKDYKNKVEELLN; KDYKNKVEELLNS; DYKNKVEELLNSS; YKNKVEELLNSST; KNKVEELLNSSTD; |

Fig. 33 continued

| | | | |
|---|---|---|---|
| | NKVEELLNSSTDD; | KVEELLNSSTDDQ; | VEELLNSSTDDQA; |
| | EELLNSSTDDQAK; | ELLNSSTDDQAKT; | LLNSSTDDQAKTS; |
| | LNSSTDDQAKTST; | NSSTDDQAKTSTN; | SSTDDQAKTSTNT; |
| | STDDQAKTSTNTG; | TDDQAKTSTNTGS; | DDQAKTSTNTGSN; |
| | DQAKTSTNTGSNA; | QAKTSTNTGSNAT; | AKTSTNTGSNATK; |
| | KTSTNTGSNATKN; | TSTNTGSNATKNK; | STNTGSNATKNKT; |
| | TNTGSNATKNKTN; | NTGSNATKNKTNT; | TGSNATKNKTNTK; |
| | GSNATKNKTNTKV; | SNATKNKTNTKVA; | NATKNKTNTKVAG; |
| | ATKNKTNTKVAGL; | TKNKTNTKVAGLQ; | KNKTNTKVAGLQK; |
| | NKTNTKVAGLQKN; | KTNTKVAGLQKNT; | TNTKVAGLQKNTQ; |
| | NTKVAGLQKNTQS; | TKVAGLQKNTQSK; | KVAGLQKNTQSKK; |
| | VAGLQKNTQSKKN; | AGLQKNTQSKKNN; | GLQKNTQSKKNNK; |
| | LQKNTQSKKNNKL; | QKNTQSKKNNKLQ; | KNTQSKKNNKLQG; |
| | NTQSKKNNKLQGL; | TQSKKNNKLQGLN; | QSKKNNKLQGLNP; |
| | SKKNNLQGLNPA; | KKKNNLQGLNPAN; | KKNNLQGLNPANQ; |
| | KNNLQGLNPANQV; | NNLQGLNPANQVN; | NLQGLNPANQVNP; |
| | LQGLNPANQVNPG; | QGLNPANQVNPGN; | GLNPANQVNPGNP; |
| | LNPANQVNPGNPM; | NPANQVNPGNPMQ; | PANQVNPGNPMQT; |
| | ANQVNPGNPMQTA; | NQVNPGNPMQTAN; | QVNPGNPMQTANQ; |
| | VNPGNPMQTANQA; | NPGNPMQTANQAN; | PGNPMQTANQANQ; |
| | GNPMQTANQANQA; | NPMQTANQANQAN; | PMQTANQANQANQ; |
| | MQTANQANQANQA; | QTANQANQANQAN; | TANQANQANQANQ; |
| | ANQANQANQANQA; | NQANQANQANQAN; | QANQANQANQANQ; |
| | ANQANQANQANQA; | NQANQANQANQAN; | QANQANQANQANQ; |
| | ANQANQANQANQA; | NQANQANQANQAS; | QANQANQANQASQ; |
| | ANQANQANQASQA; | NQANQANQASQAS; | QANQANQASQASQ; |
| | ANQANQASQASQA; | NQANQASQASQAS; | QANQASQASQASQ; |
| | ANQASQASQASQV; | NQASQASQASQVA; | QASQASQASQVAS; |
| | ASQASQASQVASS; | SQASQASQVASSA; | QASQASQVASSAS; |
| | ASQASQVASSASQ; | SQASQVASSASQA; | QASQVASSASQAS; |
| | ASQVASSASQASP; | SQVASSASQASPV; | QVASSASQASPVA; |
| | VASSASQASPVAS; | ASSASQASPVASP; | SSASQASPVASPA; |
| | SASQASPVASPAT; | ASQASPVASPATN; | SQASPVASPATNV; |
| | QASPVASPATNVQ; | ASPVASPATNVQA; | SPVASPATNVQAT; |
| | PVASPATNVQATP; | VASPATNVQATPP; | ASPATNVQATPPK; |
| | SPATNVQATPPKQ; | PATNVQATPPKQT; | ATNVQATPPKQTA; |
| | TNVQATPPKQTAS; | NVQATPPKQTASA; | VQATPPKQTASAQ; |
| | QATPPKQTASAQA; | ATPPKQTASAQAT; | TPPKQTASAQATQ; |
| | PPKQTASAQATQT; | PKQTASAQATQTV; | KQTASAQATQTVP; |
| | QTASAQATQTVPN; | TASAQATQTVPNN; | ASAQATQTVPNNT; |
| | SAQATQTVPNNTS; | AQATQTVPNNTST; | QATQTVPNNTSTP; |
| | ATQTVPNNTSTPN; | TQTVPNNTSTPNQ; | QTVPNNTSTPNQS; |
| | TVPNNTSTPNQST; | VPNNTSTPNQSTT; | PNNTSTPNQSTTK; |
| | NNTSTPNQSTTKP; | NTSTPNQSTTKPQ; | TSTPNQSTTKPQQ; |
| | STPNQSTTKPQQY; | TPNQSTTKPQQYT; | PNQSTTKPQQYTF; |
| | NQSTTKPQQYTFS; | QSTTKPQQYTFSS; | STTKPQQYTFSSS; |
| | TTKPQQYTFSSSF; | TKPQQYTFSSSFS; | KPQQYTFSSSFSQ; |
| | PQQYTFSSSFSQP; | QQYTFSSSFSQPT; | QYTFSSSFSQPTS; |
| | YTFSSSFSQPTSQ; | TFSSSFSQPTSQT; | FSSSFSQPTSQTK; |
| | SSSFSQPTSQTKN; | SSFSQPTSQTKNN; | SFSQPTSQTKNNK; |
| | FSQPTSQTKNNKS; | SQPTSQTKNNKSQ; | QPTSQTKNNKSQS; |

Fig. 33 continued

PTSQNEKNSQSK; TSQNENKSQSNN; SQTNENKSQSNKV;
QTKENSQSNKVL; TNENSQSNNVLT; NENSQSNNVLTN;
ENSQSNKVLTNY; NSQSNKVLTNYR; NSQSNKVLTNYRH;
SQSNKVLTNYRHQ; QSNKVLTNYRHQT; SNVLTNYRHQTQ;
NVLTNYRHQTQP; VLTNYRHQTQPS; LTNYRHQTQPSF;
TNYRHQTQPSFV; NYRHQTQPSFVV; YRHQTQPSFVVP;
YRHQTQPSFVVPV; RHQTQPSFVVPVY; HQTQPSFVVPVYS;
QTQPSFVVPVYSG; TQPSFVVPVYSGN; QPSFVVPVYSGNS;
PSFVVPVYSGNSP; SFVVPVYSGNSPL; FVVPVYSGNSPLQ;
VVPVYSGNSPLQK; VPVYSGNSPLQKL; PVYSGNSPLQKLK;
VYSGNSPLQKLKN; YSGNSPLQKLKNN; SGNSPLQKLKNN;
GNSPLQKLKNLL; KSPLQKLKNNLLR; SPLQKLKNLLRR;
PLQKLKNLLRR; LQKLKNLLRRTA; QKLKNLLRRTAF;
KLKNLLRRTAFK; LKNLLRRTAFKR; KNLLRRTAFKRK;
NLLRRTAFKRKR; LLRRTAFKRKTH; LRRTAFKRKTHN;
LRRTAFKNKTHN; RRTAFKNKTHNH; RTAFKNKTHNHG;
TAFKNKTHNHGF; AFKNKTHNHGFR; FKNKTHNHGFRE;
KNKTHNHGFRET; NKTHNHGFRETY; KTHNHGFRETYD;
KTHNHGFRETYDQ; THNHGFRETYDQF; HNHGFRETYDQFK;
NHGFRETYDQFKM; HGFRETYDQFKMK; GFRETYDQFKMKD;
FRETYDQFKMKDS; RETYDQFKMKDSA; ETYDQFKMKDSAF;
TYDQFKMKDSAFT; YDQFKMKDSAFTL; DQFKMKDSAFTLL;
QFKMKDSAFTLLD; FKMKDSAFTLLDV; KMKDSAFTLLDVI;
MKDSAFTLLDVIS; KDSAFTLLDVISN; DSAFTLLDVISNI;
SAFTLLDVISNIS; AFTLLDVISNISV; FTLLDVISNISVF;
TLLDVISNISVFD; LLDVISNISVFDR; LDVISNISVFDRG;
DVISNISVFDRGS; VISNISVFDRGSA; ISNISVFDRGSAP;
SNISVFDRGSAPQ; NISVFDRGSAPQL; ISVFDRGSAPQLS;
SVFDRGSAPQLSS; VFDRGSAPQLSSN; FDRGSAPQLSSNT;
DRGSAPQLSSNTP; RGSAPQLSSNTPF; GSAPQLSSNTPFA;
SAPQLSSNTPFAE; APQLSSNTPFAES; PQLSSNTPFAESE;
QLSSNTPFAESER; LSSNTPFAESERN; SSNTPFAESERNR;
SNTPFAESERNRL; NTPFAESERNRLY; TPFAESERNRLYA;
PFAESERNRLYAM; FAESERNRLYAMM; AESERNRLYAMMD;
ESERNRLYAMMDF; SERNRLYAMMDFD; ERNRLYAMMDFDQ;
RNRLYAMMDFDQA; NRLYAMMDFDQAK; RLYAMMDFDQAKT;
LYAMMDFDQAKTT; YAMMDFDQAKTTE; AMMDFDQAKTTEF;
MMDFDQAKTTEFG; MDFDQAKTTEFGS; DFDQAKTTEFGSL;
FDQAKTTEFGSTM; DQAKTTEFGSTMN; QAKTTEFGSTMNT;
AKTTEFGSTMNLL; KTTEFGSTMNLLY; TTEFGSTMNLLYQ;
TEFGSTMNLLYQE; EFGSTMNLLYQEN; FGSTMNLLYQENQ;
GSTMNLLYQENQN; STMNLLYQENQNH; TMNLLYQENQNHS;
MNLLYQENQNHSL; NLLYQENQNHSLT; LLYQENQNHSLTR;
LYQENQNHSLTRS; YQENQNHSLTRSL; QENQNHSLTRSLI;
ENQNHSLTRSLII; NQNHSLIRSLIIS; QNHSLIRSLIISG;
NHSLIRSLIISGL; HSLIRSLIISGLG; SLIRSLIISGLGL;
LIRSLTTSGLGTQ; TRSLTTSGLGTQT; RSLTTSGLGTQTS;
SLIISGLGIQISL; LIISGLGIQISLE; IISGLGIQISLES;
ISGLGIQISLEST; SGLGIQISLESTL; GLGIQISLESTLE;
LGIQISLESTLEF; GIQISLESTLEFI; IQISLESTLEFIE;
QISLESTLEFIEK; ISLESTLEFIEKR; SLESTLEFIEKKT;

LKSTLEELEKKIE; ESTLEELEKKIES; STLEELEKKIESF;
TLEETEKKIESFN; LEELEKKIESFNT; EELEKKIESFNTQ;
ELEKKIESFNTQY; LEKKIESFNTQYL; EKKIESFNTQYLN;
KKIESFNTQYLNT; KIESFNTQYLNTI; IESFNTQYLNTII;
ESFNTQYLNTIIK; SFNTQYLNTIIKS; FNTQYLNTIIKSY;
NTQYLNTIIKSYT; TQYLNTIIKSYTF; QYLNTIIKSYTFK;
YLNTIIKSYTFKD; LNTIIKSYTFKDK; NTIIKSYTFKDKL;
TIIKSYTFKDKLK; IIKSYTFKDKLKE; IKSYTFKDKLKEL;
KSYTFKDKLKELE; SYTFKDKLKELES; YTFKDKLKELESK;
TFKDKLKELESKI; FKDKLKELESKIN; KDKLKELESKINS;
DKLKELESKINST; KLKELESKINSTI; LKELESKINSTIA;
KELESKINSTIAE; ELESKINSTIAEK; LESKINSTIAEKK;
ESKINSTIAEKKE; SKINSTIAEKKEN; KINSTIAEKKENI;
INSTIAEKKENIN; NSTIAEKKENINY; STIAEKKENINYA;
TIAEKKENINYAD; IAEKKENINYADA; AEKKENINYADAI;
EKKENINYADAII; KKENINYADAIIT; KENINYADAIITK;
ENINYADAIITKT; NINYADAIITKTS; INYADAIITKTSS;
NYADAIITKTSSK; YADAIITKTSSNS; ADAIITKTSSNSK;
DAIITKTSSNSKR; AIITKTSSNSKRN; IITKTSSNSKRND;
ITKTSSNSKRNDF; TKTSSNSKRNDFQ; KTSSNSKRNDFQS;
TSSNSKRNDFQSL; SSNSKRNDFQSLG; SNSKRNDFQSLGQ;
NSKRNDFQSLGQY; SKRNDFQSLGQYL; KRNDFQSLGQYLK;
RNDFQSLGQYLKK; NDFQSLGQYLKKK; DFQSLGQYLKNKY;
FQSLGQYLKKKL; QSLGQYLKKKYLD; SLGQYLKNKYLDK;
LGQYLKNKYLDKM; GQYLKNKYLDKMQ; QYLKNKYLDKMQD;
YLKNKYLDKMQDA; LKNKYLDKMQDAR; KNKYLDKMQDARQ;
NKYLDKMQDARQS; KYLDKMQDARQSA; YLDKMQDARQSAL;
LDKMQDARQSALD; DKMQDARQSALDL; KMQDARQSALDLY;
MQDARQSALDLYL; QDARQSALDLYLN; DARQSALDLYLNI;
ARQSALDLYLNIT; RQSALDLYLNITE; QSALDLYLNITEL;
SALDLYLNITELR;

14 mers:
MSSCTIDANLKKDY; SSCTIDANLKKDYK; SCTIDANLKKDYKN;
CTIDANLKKDYKNK; TIDANLKKDYKNKV; IDANLKKDYKNKVE;
DANLKKDYKNKVEE; ANLKKDYKNKVEEI; NLKKDYKNKVEELL;
LKKDYKNKVEELLN; KKDYKNKVEELLNS; KDYKNKVEELLNSS;
DYKNKVEELLNSST; YKNKVEELLNSSTD; KNKVEELLNSSTDD;
NKVEELLNSSTDDQ; KVEELLNSSTDDQA; VEELLNSSTDDQAK;
EELLNSSTDDQAKT; ELLNSSTDDQAKTS; LLNSSTDDQAKTST;
LNSSTDDQAKTSTN; NSSTDDQAKTSTNT; SSTDDQAKTSTNTG;
STDDQAKTSTNTGS; TDDQAKTSTNTGSN; DDQAKTSTNTGSNA;
DQAKTSTNTGSNAT; QAKTSTNTGSNATK; AKTSTNTGSNATKN;
KTSTNTGSNATKNK; TSTNTGSNATKNKT; STNTGSNATKNKTN;
TNTGSNATKNKTNL; NTGSNATKNKTNLK; TGSNATKNKTNLKV;
GSNATKNKTNLKVA; SNATKNKTNLKVAG; NATKNKTNLKVAGL;
ATKNKTNLKVAGLQ; TKNKTNLKVAGLQK; KNKTNLKVAGLQKN;
NKTNLKVAGLQKNT; KTNLKVAGLQKNTQ; TNLKVAGLQKNTQS;
NLKVAGLQKNTQSK; LKVAGLQKNTQSKK; KVAGLQKNTQSKKN;
VAGLQKNTQSKKNL; AGLQKNTQSKKNLQ; GLQKNTQSKKNLQG;
LQKNTQSKKNLQG; QKNTQSKKNLQGI; KNTQSKKNLQGIL;

Fig. 33 continued

NTQSKKNKLQGLN; TQSKKNKLQGLNP; QSKKNKLQGLNPA;
SKKNKLQGLNPAK; KKNKLQGLNPAKQ; KNKLQGLNPAKQV;
NKLQGLNPAKQVN; KLQGLNPAKQVNP; LQGLNPAKQVNPG;
QGLNPAKQVNPGN; GLNPAKQVNPGNP; LNPAKQVNPGNPM;
NPAKQVNPGNPMQ; PAKQVNPGNPMQT; AKQVNPGNPMQTA;
KQVNPGNPMQTAN; QVNPGNPMQTANQ; VNPGNPMQTANQA;
NPGNPMQTANQAN; PGNPMQTANQANQ; GNPMQTANQANQA;
NPMQTANQANQAK; PMQTANQANQAKQ; MQTANQANQAKQA;
QTANQANQAKQAN; TANQANQAKQANQ; ANQANQAKQANQA;
NQANQAKQANQAN; QANQAKQANQANQ; ANQAKQANQANQA;
NQAKQANQANQAK; QAKQANQANQAKQ; AKQANQANQAKQA;
KQANQANQAKQAS; QANQANQAKQASQ; ANQANQAKQASQA;
NQANQAKQASQAS; QANQAKQASQASQ; ANQAKQASQASQA;
NQAKQASQASQAS; QAKQASQASQASQ; AKQASQASQASQV;
KQASQASQASQVA; QASQASQASQVAS; ASQASQASQVASS;
SQASQASQVASSA; QASQASQVASSAS; ASQASQVASSASQ;
SQASQVASSASQA; QASQVASSASQAS; ASQVASSASQASP;
SQVASSASQASPV; QVASSASQASPVA; VASSASQASPVAS;
ASSASQASPVASS; SSASQASPVASSA; SASQASPVASSAT;
ASQASPVASPATN; SQASPVASPATNV; QASPVASPATNVQ;
ASPVASPATNVQA; SPVASPATNVQAT; PVASPATNVQATP;
VASPATNVQATPP; ASPATNVQATPPK; SPATNVQATPPKQ;
PATNVQATPPKQI; ATNVQATPPKQIA; TNVQATPPKQIAS;
NVQATPPKQIASA; VQATPPKQIASAQ; QATPPKQIASAQA;
ATPPKQIASAQAT; TPPKQIASAQATQ; PPKQIASAQATQT;
PKQIASAQATQTV; KQIASAQATQTVP; QIASAQATQTVPN;
IASAQATQTVPNK; ASAQATQTVPNKT; SAQATQTVPNKTS;
AQATQTVPNKTST; QATQTVPNKTSTP; ATQTVPNKTSTPK;
TQTVPNKTSTPKQ; QTVPNKTSTPNQS; TVPNKTSTPNQST;
VPNKTSTPNQSTT; PNKTSTPNQSTTK; NKTSTPNQSTTKP;
KTSTPNQSTTKPQ; TSTPNQSTTKPQQ; STPNQSTTKPQQY;
TPNQSTTKPQQYT; PNQSTTKPQQYTF; NQSTTKPQQYTFS;
QSTTKPQQYTFSS; STTKPQQYTFSSS; TTKPQQYTFSSSF;
TKPQQYTFSSSFS; KPQQYTFSSSFSQ; PQQYTFSSSFSQP;
QQYTFSSSFSQPT; QYTFSSSFSQPTS; YTFSSSFSQPTSQ;
TFSSSFSQPTSQT; FSSSFSQPTSQTN; SSSFSQPTSQTNF;
SSFSQPTSQTNFN; SFSQPTSQTNFNK; FSQPTSQTNFNKS;
SQPTSQTNFNKSQ; QPTSQTNFNKSQS; PTSQTNFNKSQSN;
TSQTNFNKSQSNK; SQTNFNKSQSNKV; QTNFNKSQSNKVL;
TNFNKSQSNKVLT; NFNKSQSNKVLTK; FNKSQSNKVLTKY;
NKSQSNKVLTKYR; KSQSNKVLTKYRH; SQSNKVLTKYRHQ;
QSNKVLTKYRHQT; SNKVLTKYRHQTP; NKVLTKYRHQTPS;
KVLTKYRHQTPSF; VLTKYRHQTPSFV; LTKYRHQTPSFVV;
TKYRHQTPSFVVP; KYRHQTPSFVVPV; YRHQTPSFVVPVY;
RHQTPSFVVPVYS; HQTPSFVVPVYSG; QTPSFVVPVYSGN;
TPSFVVPVYSGNS; PSFVVPVYSGNSP; SFVVPVYSGNSPL;
FVVPVYSGNSPLQ; VVPVYSGNSPLQK; VPVYSGNSPLQKL;
PVYSGNSPLQKLK; VYSGNSPLQKLKN; YSGNSPLQKLKNL;
SGNSPLQKLKNLL; GNSPLQKLKNLLR; NSPLQKLKNLLRR;
SPLQKLKNLLRRI; PLQKLKNLLRRIA; LQKLKNLLRRIAE;
QKLKNLLRRIAEE;

LNSILAEKKEWLKY; NSILAEKKEWLKYA; SILAEKKEWLKYAD;
ILAEKKEWLKYADA; LAEKKEWLKYADAT; AEKKEWLKYADATT;
EKKEWLKYADATTT; KKEWLKYADATTTN; KEWLKYADATTTNT;
EWLNYADATTTNTS; WLKYADATTTNTSS; LNYADATTTNTSSK;
NYADATTNTSSKS; YADATTNTSSNSK; ADATTNTSSKSKR;
DATTNTSSNSKRN; ATTNTSSNSKRND; TTNTSSNSKRNDP;
TNTSSNSKRNDPQ; NTSSNSKRNDPQS; TSSNSKRNDPQSL;
TSSNSKRNDPQSLG; SSNSKRNDPQSLGQ; SNSKRNDPQSLGQY;
NSKRNDPQSLGQYT; SKRNDPQSLGQYTK; KRNDPQSLGQYTKN;
RNDPQSLGQYTKNK; NDPQSLGQYTKNKY; DPQSLGQYTKNKYL;
PQSLGQYTKNKYLD; QSLGQYTKNKYLDK; SLGQYTKNKYLDKM;
LGQYTKNKYLDKMQ; GQYTKNKYLDKMQD; QYTKNKYLDKMQDA;
YTKNKYLDKMQDAR; TKNKYLDKMQDARQ; KNKYLDKMQDARQ

ASQASQASQASQVAS; KQASQASQASQVASS; QASQASQASQVASSA;
ASQASQASQVASSAS; SQASQASQVASSASQ; QASQASQVASSASQA;
ASQASQVASSASQAS; SQASQVASSASQASP; QASQVASSASQASPV;
ASQVASSASQASPVA; SQVASSASQASPVAS; QVASSASQASPVASP;
VASSASQASPVASPA; ASSASQASPVASPAT; SSASQASPVASPATN;
SASQASPVASPATNV; ASQASPVASPATNVQ; SQASPVASPATNVQA;
QASPVASPATNVQAT; ASPVASPATNVQATP; SPVASPATNVQATPP;
PVASPATNVQATPPK; VASPATNVQATPPKQ; ASPATNVQATPPKQT;
SPATNVQATPPKQTA; PATNVQATPPKQTAS; ATNVQATPPKQTASA;
TNVQATPPKQTASAQ; NVQATPPKQTASAQA; VQATPPKQTASAQAT;
QATPPKQTASAQATQ; ATPPKQTASAQATQT; TPPKQTASAQATQTV;
PPKQTASAQATQTVP; PKQ

| | | |
|---|---|---|
| SNLSVFDRGSAPQLS; | KLSVFDRGSAPQLSS; | LSVFDRGSAPQLSSN; |
| SVFDRGSAPQLSSNT; | VFDRGSAPQLSSNTP; | FDRGSAPQLSSNTPP; |
| DRGSAPQLSSNTPPA; | RGSAPQLSSNTPPAF; | GSAPQLSSNTPPAFS; |
| SAPQLSSNTPPAFSF; | APQLSSNTPPAFSFR; | PQLSSNTPPAFSFRN; |
| QLSSNTPPAFSFRNR; | LSSNTPPAFSFRNRL; | SSNTPPAFSFRNRLY; |
| SNTPPAFSFRNRLYA; | NTPPAFSFRNRLYAM; | TPPAFSFRNRLYAMM; |
| PPAFSFRNRLYAMMD; | PAFSFRNRLYAMMDF; | AFSFRNRLYAMMDFD; |
| FSFRNRLYAMMDFDQ; | SFRNRLYAMMDFDQA; | FRNRLYAMMDFDQAK; |
| RNRLYAMMDFDQAKT; | NRLYAMMDFDQAKTT; | RLYAMMDFDQAKTTF; |
| LYAMMDFDQAKTTFF; | YAMMDFDQAKTTFFG; | AMMDFDQAKTTFFGS; |
| MMDFDQAKTTFFGST; | MDFDQAKTTFFGSTM; | DFDQAKTTFFGSTMN; |
| FDQAKTTFFGSTMNL; | DQAKTTFFGSTMNLL; | QAKTTFFGSTMNLLY; |
| AKTTFFGSTMNLLYQ; | KTTFFGSTMNLLYQE; | TTFFGSTMNLLYQER; |
| TFFGSTMNLLYQERQ; | FFGSTMNLLYQERQK; | FGSTMNLLYQERQKH; |
| GSTMNLLYQERQKHS; | STMNLLYQERQKHSL; | TMNLLYQERQKHSLL; |
| MNLLYQERQKHSLLR; | NLLYQERQKHSLLRS; | LLYQERQKHSLLRSL; |
| LYQERQKHSLLRSLI; | YQERQKHSLLRSLIT; | QERQKHSLLRSLITS; |
| ERQKHSLLRSLITSG; | RQKHSLLRSLITSGL; | QKHSLLRSLITSGLG; |
| KHSLLRSLITSGLGI; | HSLLRSLITSGLGIQ; | SLLRSLITSGLGIQL; |
| LLRSLITSGLGIQLS; | LRSLITSGLGIQLSL; | RSLITSGLGIQLSLE; |
| SLITSGLGIQLSLES; | LITSGLGIQLSLEST; | ITSGLGIQLSLESTL; |
| TSGLGIQLSLESTLE; | SGLGIQLSLESTLEE; | GLGIQLSLESTLEEI; |
| LGIQLSLESTLEEIE; | GIQLSLESTLEEIEK; | IQLSLESTLEEIEKK; |
| QLSLESTLEEIEKKI; | LSLESTLEEIEKKIE; | SLESTLEEIEKKIES; |
| LESTLEEIEKKIESF; | ESTLEEIEKKIESFN; | STLEEIEKKIESFNT; |
| TLEEIEKKIESFNTQ; | LEEIEKKIESFNTQY; | EEIEKKIESFNTQYL; |
| EIEKKIESFNTQYLN; | IEKKIESFNTQYLNT; | EKKIESFNTQYLNTI; |
| KKIESFNTQYLNTII; | KIESFNTQYLNTIIK; | IESFNTQYLNTIIKS; |
| ESFNTQYLNTIIKSY; | SFNTQYLNTIIKSYT; | FNTQYLNTIIKSYTF; |
| NTQYLNTIIKSYTFK; | TQYLNTIIKSYTFKD; | QYLNTIIKSYTFKDK; |
| YLNTIIKSYTFKDKL; | LNTIIKSYTFKDKLK; | NTIIKSYTFKDKLKE; |
| TIIKSYTFKDKLKEL; | IIKSYTFKDKLKELE; | IKSYTFKDKLKELES; |
| KSYTFKDKLKELESK; | SYTFKDKLKELESKL; | YTFKDKLKELESKLN; |
| TFKDKLKELESKLNS; | FKDKLKELESKLNSL; | KDKLKELESKLNSLL; |
| DKLKELESKLNSLLA; | KLKELESKLNSLLAE; | LKELESKLNSLLAEK; |
| KELESKLNSLLAEKK; | ELESKLNSLLAEKKE; | LESKLNSLLAEKKEW; |
| ESKLNSLLAEKKEWL; | SKLNSLLAEKKEWLK; | KLNSLLAEKKEWLKY; |
| LNSLLAEKKEWLKYA; | NSLLAEKKEWLKYAD; | SLLAEKKEWLKYADA; |
| LLAEKKEWLKYADAT; | LAEKKEWLKYADATT; | AEKKEWLKYADATTT; |
| EKKEWLKYADATTTS; | KKEWLKYADATTTST; | KEWLKYADATTTSTS; |
| EWLKYADATTTSTSS; | WLKYADATTTSTSSR; | LNYADATTTSTSSRS; |
| NYADATTTSTSSRSK; | YADATTTSTSSRSKR; | ADATTTSTSSRSKRN; |
| DATTTSTSSRSKRND; | ATTTSTSSRSKRNDP; | TTTSTSSRSKRNDPQ; |
| TTSTSSRSKRNDPQS; | TSTSSRSKRNDPQSL; | STSSRSKRNDPQSLG; |
| TSSRSKRNDPQSLGQ; | SSRSKRNDPQSLGQY; | SRSKRNDPQSLGQYL; |
| RSKRNDPQSLGQYLK; | SKRNDPQSLGQYLKK; | KRNDPQSLGQYLKKK; |
| RNDPQSLGQYLKKKY; | NDPQSLGQYLKKKYL; | DPQSLGQYLKKKYLD; |
| PQSLGQYLKKKYLDK; | QSLGQYLKKKYLDKQ; | SLGQYLKKKYLDKQD; |
| LGQYLKKKYLDKQDA; | GQYLKKKYLDKQDAR; | QYLKKKYLDKQDARQ; |
| YLKKKYLDKQDARQS; | LKKKYLDKQDARQSA; | KKKYLDKQDARQSAL; |
| KKYLDKQDARQSALD; | KYLDKQDARQSALDL; | YLDKQDARQSALDL; |

Fig. 33 continued

LDKMQDARQSALDLYL; DKMQDARQSALDLYLN; KMQDARQSALDLYLNT;
MQDARQSALDLYLNTT; QDARQSALDLYLNTTF; DARQSALDLYLNTTF;
ARQSALDLYLNTTFT; RQSALDLYLNTTFTR;

16 mers:
MSSCTTDANLNKDYKK; SSCTTDANLNKDYKNK; SCTTDANLNKDYKNKV;
CTTDANLNKDYKNKVE; TTDANLNKDYKNKVEE; TDANLNKDYKNKVEEL;
DANLNKDYKNKVEELL; ANLNKDYKNKVEELLN; NLNKDYKNKVEELLNS;
LNKDYKNKVEELLNSS; NKDYKNKVEELLNSST; KDYKNKVEELLNSSTD;
DYKNKVEELLNSSTDD; YKNKVEELLNSSTDDQ; KNKVEELLNSSTDDQA;
NKVEELLNSSTDDQAK; KVEELLNSSTDDQAKT; VEELLNSSTDDQAKTS;
EELLNSSTDDQAKTSI; ELLNSSTDDQAKTSIN; LLNSSTDDQAKTSINT;
LNSSTDDQAKTSINTG; NSSTDDQAKTSINTGS; SSTDDQAKTSINTGSN;
STDDQAKTSINTGSNA; TDDQAKTSINTGSNAP; DDQAKTSINTGSNAPK;
DQAKTSINTGSNAPKK; QAKTSINTGSNAPKKK; AKTSINTGSNAPKKKT;
KTSINTGSNAPKKKTI; TSINTGSNAPKKKTIT; SINTGSNAPKKKTITK;
INTGSNAPKKKTITKV; NTGSNAPKKKTITKVA; TGSNAPKKKTITKVAG;
GSNAPKKKTITKVAGL; SNAPKKKTITKVAGLQ; NAPKKKTITKVAGLQK;
APKKKTITKVAGLQKN; PKKKTITKVAGLQKNT; KKKTITKVAGLQKNTQ;
KKTITKVAGLQKNTQS; KTITKVAGLQKNTQSK; TITKVAGLQKNTQSKK;
ITKVAGLQKNTQSKKN; TKVAGLQKNTQSKKNN; KVAGLQKNTQSKKNNL;
VAGLQKNTQSKKNNLQ; AGLQKNTQSKKNNLQG; GLQKNTQSKKNNLQGL;
LQKNTQSKKNNLQGLN; QKNTQSKKNNLQGLNP; KNTQSKKNNLQGLNPA;
NTQSKKNNLQGLNPAN; TQSKKNNLQGLNPANQ; QSKKNNLQGLNPANQV;
SKKNNLQGLNPANQVN; KKNNLQGLNPANQVNP; KNNLQGLNPANQVNPG;
NNLQGLNPANQVNPGN; NLQGLNPANQVNPGNP; LQGLNPANQVNPGNPM;
QGLNPANQVNPGNPMQ; GLNPANQVNPGNPMQT; LNPANQVNPGNPMQTA;
NPANQVNPGNPMQTAN; PANQVNPGNPMQTANQ; ANQVNPGNPMQTANQA;
NQVNPGNPMQTANQAN; QVNPGNPMQTANQANQ; VNPGNPMQTANQANQA;
NPGNPMQTANQANQAN; PGNPMQTANQANQANQ; GNPMQTANQANQANQA;
NPMQTANQANQANQAN; PMQTANQANQANQANQ; MQTANQANQANQANQA;
QTANQANQANQANQAN; TANQANQANQANQANQ; ANQANQANQANQANQA;
NQANQANQANQANQAS; QANQANQANQANQASQ; ANQANQANQANQASQA;
NQANQANQANQASQAS; QANQANQANQASQASQ; ANQANQANQASQASQA;
NQANQANQASQASQAS; QANQANQASQASQASQ; ANQANQASQASQASQA;
NQANQASQASQASQAS; QANQASQASQASQASQ; ANQASQASQASQASQV;
NQASQASQASQASQVA; QASQASQASQASQVAS; ASQASQASQVASSAS;
ANQASQASQASQVASS; NQASQASQASQVASSA; QASQASQASQVASSAS;
ASQASQASQVASSASQ; SQASQASQVASSASQA; QASQASQVASSASQAS;
ASQASQVASSASQASP; SQASQVASSASQASPV; QASQVASSASQASPVA;
ASQVASSASQASPVAS; SQVASSASQASPVASS; QVASSASQASPVASSA;
VASSASQASPVASSAT; ASSASQASPVASSATN; SSASQASPVASSATNV;
SASQASPVASSATNVQ; ASQASPVASSATNVQA; SQASPVASSATNVQAT;
QASPVASSATNVQATP; ASPVASSATNVQATPP; SPVASSATNVQATPPK;
PVASSATNVQATPPKQ; VASSATNVQATPPKQI; ASSATNVQATPPKQIA;
SSATNVQATPPKQIAS; SATNVQATPPKQIASA; ATNVQATPPKQIASAQ;
TNVQATPPKQIASAQA; NVQATPPKQIASAQAT; VQATPPKQIASAQATQ;
QATPPKQIASAQATQI; ATPPKQIASAQATQIV; TPPKQIASAQATQIVP;
PPKQIASAQATQIVPK; PKQIASAQATQIVPKN; KQIASAQATQIVPKNT;
QIASAQATQIVPKNTS; IASAQATQIVPKNTST; ASAQATQIVPKNTSTP;
SAQATQIVPKNTSTPK; AQATQIVPKNTSTPKQ; QATQIVPKNTSTPKQS;

Fig. 33 continued

| | GSIMNILYQENQNHSL; SIMNILYQENQNHSLI; IMNILYQENQNHSLIR; MNILYQENQNHSLIRS; NILYQENQNHSLIRSL; ILYQENQNHSLIRSLI; LYQENQNHSLIRSLII; YQENQNHSLIRSLIIS; QENQNHSLIRSLIISG; ENQNHSLIRSLIISGL; NQNHSLIRSLIISGLG; QNHSLIRSLIISGLGI; NHSLIRSLIISGLGIQ; HSLIRSLIISGLGIQI; SLIRSLIISGLGIQIS; LIRSLIISGLGIQISL; IRSLIISGLGIQISLE; RSLIISGLGIQISLES; SLIISGLGIQISLEST; LIISGLGIQISLESTL; IISGLGIQISLESTLE; ISGLGIQISLESTLEE; SGLGIQISLESTLEEI; GLGIQISLESTLEEIE; LGIQISLESTLEEIEK; GIQISLESTLEEIEKK; IQISLESTLEEIEKKI; QISLESTLEEIEKKIE; ISLESTLEEIEKKIES; SLESTLEEIEKKIESF; LESTLEEIEKKIESFN; ESTLEEIEKKIESFNT; STLEEIEKKIESFNTQ; TLEEIEKKIESFNTQY; LEEIEKKIESFNTQYL; EEIEKKIESFNTQYLN; EIEKKIESFNTQYLNT; IEKKIESFNTQYLNTI; EKKIESFNTQYLNTII; KKIESFNTQYLNTIIN; KIESFNTQYLNTIINS; IESFNTQYLNTIINSY; ESFNTQYLNTIINSYT; SFNTQYLNTIINSYTF; FNTQYLNTIINSYTFK; NTQYLNTIINSYTFKD; TQYLNTIINSYTFKDK; QYLNTIINSYTFKDKL; YLNTIINSYTFKDKLK; LNTIINSYTFKDKLKE; NTIINSYTFKDKLKEL; TIINSYTFKDKLKELE; IINSYTFKDKLKELES; INSYTFKDKLKELESK; NSYTFKDKLKELESKL; SYTFKDKLKELESKLN; YTFKDKLKELESKLNS; TFKDKLKELESKLNSI; FKDKLKELESKLNSIL; KDKLKELESKLNSILA; DKLKELESKLNSILAE; KLKELESKLNSILAEK; LKELESKLNSILAEKK; KELESKLNSILAEKKE; ELESKLNSILAEKKEW; LESKLNSILAEKKEWL; ESKLNSILAEKKEWLN; SKLNSILAEKKEWLNY; KLNSILAEKKEWLNYA; LNSILAEKKEWLNYAD; NSILAEKKEWLNYADA; SILAEKKEWLNYADAI; ILAEKKEWLNYADAII; LAEKKEWLNYADAIIT; AEKKEWLNYADAIITN; EKKEWLNYADAIITNT; KKEWLNYADAIITNTS; KEWLNYADAIITNTSS; EWLNYADAIITNTSSN; WLNYADAIITNTSSNS; LNYADAIITNTSSNSK; NYADAIITNTSSNSKR; YADAIITNTSSNSKRN; ADAIITNTSSNSKRND; DAIITNTSSNSKRNDP; AIITNTSSNSKRNDPQ; IITNTSSNSKRNDPQS; ITNTSSNSKRNDPQSL; TNTSSNSKRNDPQSLG; NTSSNSKRNDPQSLGQ; TSSNSKRNDPQSLGQY; SSNSKRNDPQSLGQYI; SNSKRNDPQSLGQYIK; NSKRNDPQSLGQYIKN; SKRNDPQSLGQYIKNK; KRNDPQSLGQYIKNKY; RNDPQSLGQYIKNKYL; NDPQSLGQYIKNKYLD; DPQSLGQYIKNKYLDK; PQSLGQYIKNKYLDKM; QSLGQYIKNKYLDKMQ; SLGQYIKNKYLDKMQD; LGQYIKNKYLDKMQDA; GQYIKNKYLDKMQDAR; QYIKNKYLDKMQDARQ; YIKNKYLDKMQDARQS; IKNKYLDKMQDARQSA; KNKYLDKMQDARQSAL; NKYLDKMQDARQSALD; KYLDKMQDARQSALDL; YLDKMQDARQSALDLY; LDKMQDARQSALDLYL; DKMQDARQSALDLYLN; KMQDARQSALDLYLNI; MQDARQSALDLYLNIT; QDARQSALDLYLNITE; DARQSALDLYLNITEI; ARQSALDLYLNITEIR; |
|---|---|
| SEQ ID NO:36 SEQ ID NO: 114737-116378 | 13 mers: MSSCTIDANLNKD; SSCTIDANLNKDY; SCTIDANLNKDYK; CTIDANLNKDYKN; TIDANLNKDYKNK; IDANLNKDYKNKV; DANLNKDYKNKVE; ANLNKDYKNKVEE; NLNKDYKNKVEEL; LNKDYKNKVEELL; NKDYKNKVEELLN; KDYKNKVEELLNS; DYKNKVEELLNSS; YKNKVEELLNSST; KNKVEELLNSSTD; NKVEELLNSSTDD; KVEELLNSSTDDQ; VEELLNSSTDDQA; EELLNSSTDDQAK; ELLNSSTDDQAKI; LLNSSTDDQAKIS; LNSSTDDQAKISI; NSSTDDQAKISIN; SSTDDQAKISINT; |

Fig. 33 continued

| | | |
|---|---|---|
| STDQAKISINTG; | TDQAKISINTGS; | DQAKISINTGSK; |
| DQAKTSTNTGSNA; | QAKTSTNTGSNAT; | AKTSTNTGSNATK; |
| KTSTNTGSNATKN; | TSTNTGSNATKNK; | STNTGSNATKNKT; |
| TNTGSNATKNKTN; | NTGSNATKNKTNI; | TGSNATKNKTNIK; |
| GSNATKNKTNIKV; | SNATKNKTNIKVA; | NATKNKTNIKVAG; |
| ATKNKTNIKVAGL; | TKNKTNIKVAGLQ; | KNKTNIKVAGLQK; |
| NKTNIKVAGLQKN; | KTNIKVAGLQKNT; | TNIKVAGLQKNTQ; |
| NIKVAGLQKNTQS; | IKVAGLQKNTQSK; | KVAGLQKNTQSKK; |
| VAGLQKNTQSKKN; | AGLQKNTQSKKNN; | GLQKNTQSKKNNK; |
| LQKNTQSKKNNKL; | QKNTQSKKNNKLQ; | KNTQSKKNNKLQG; |
| NTQSKKNNKLQGL; | TQSKKNNKLQGLN; | QSKKNNKLQGLNP; |
| SKKNNLQGLNPA; | KKNNLQGLNPAK; | KNNLQGLNPAKQ; |
| NNKLQGLNPAKQV; | NLQGLNPAKQVN; | LQGLNPAKQVNP; |
| LQGLNPAKQVNPG; | QGLNPAKQVNPGN; | GLNPAKQVNPGNP; |
| LNPAKQVNPGNPM; | NPAKQVNPGNPMQ; | PAKQVNPGNPMQT; |
| AKQVNPGNPMQTA; | KQVNPGNPMQTAN; | QVNPGNPMQTANQ; |
| VNPGNPMQTANQA; | NPGNPMQTANQAN; | PGNPMQTANQANQ; |
| GNPMQTANQANQA; | NPMQTANQANQAN; | PMQTANQANQANQ; |
| MQTANQANQANQA; | QTANQANQANQAN; | TANQANQANQANQ; |
| ANQANQANQANQA; | NQANQANQANQAN; | QANQANQANQANQ; |
| ANQANQANQANQA; | NQANQANQANQAN; | QANQANQANQANQ; |
| ANQANQANQANQA; | NQANQANQANQAS; | QANQANQANQASQ; |
| ANQANQANQASQA; | NQANQANQASQAS; | QANQANQASQASQ; |
| ANQANQASQASQA; | NQANQASQASQAS; | QANQASQASQASQ; |
| ANQASQASQASQV; | NQASQASQASQVA; | QASQASQASQVAS; |
| ASQASQASQVASS; | SQASQASQVASSA; | QASQASQVASSAS; |
| ASQASQVASSASQ; | SQASQVASSASQA; | QASQVASSASQAS; |
| ASQVASSASQASP; | SQVASSASQASPV; | QVASSASQASPVA; |
| VASSASQASPVAS; | ASSASQASPVASP; | SSASQASPVASPA; |
| SASQASPVASPAT; | ASQASPVASPATN; | SQASPVASPATNV; |
| QASPVASPATNVQ; | ASPVASPATNVQA; | SPVASPATNVQAT; |
| PVASPATNVQATP; | VASPATNVQATPP; | ASPATNVQATPPK; |
| SPATNVQATPPKQ; | PATNVQATPPKQT; | ATNVQATPPKQTA; |
| TNVQATPPKQTAS; | NVQATPPKQTASA; | VQATPPKQTASAQ; |
| QATPPKQTASAQA; | ATPPKQTASAQAT; | TPPKQTASAQATQ; |
| PPKQTASAQATQT; | PKQTASAQATQTV; | KQTASAQATQTVP; |
| QTASAQATQTVPK; | TASAQATQTVPKN; | ASAQATQTVPKNT; |
| SAQATQTVPKNTS; | AQATQTVPKNTST; | QATQTVPKNTSTP; |
| ATQTVPKNTSTPK; | TQTVPKNTSTPKQ; | QTVPKNTSTPKQS; |
| TVPKNTSTPKQST; | VPKNTSTPKQSTI; | PKNTSTPKQSTIK; |
| KNTSTPKQSTIKP; | NTSTPKQSTIKPQ; | TSTPKQSTIKPQQ; |
| STPKQSTIKPQQY; | TPKQSTIKPQQYT; | PKQSTIKPQQYTF; |
| KQSTIKPQQYTFS; | QSTIKPQQYTFSS; | STIKPQQYTFSSS; |
| TIKPQQYTFSSSF; | IKPQQYTFSSSFS; | KPQQYTFSSSFSQ; |
| PQQYTFSSSFSQP; | QQYTFSSSFSQPT; | QYTFSSSFSQPTS; |
| YTFSSSFSQPTSQ; | TFSSSFSQPTSQT; | FSSSFSQPTSQTK; |
| SSSFSQPTSQTNF; | SSFSQPTSQTNFN; | SFSQPTSQTNFNK; |
| FSQPTSQTNFNKS; | SQPTSQTNFNKSQ; | QPTSQTNFNKSQS; |
| PTSQTNFNKSQSK; | TSQTNFNKSQSN; | SQTNFNKSQSNKV; |
| QTNFNKSQSNKVL; | TNFNKSQSNKVLT; | NFNKSQSNKVLTK; |
| FNKSQSNKVLTKY; | NKSQSNKVLTKYR; | KSQSNKVLTKYRN; |

Fig. 33 continued

| | | |
|---|---|---|
| SQSNRVLTNYRHQ; | QSNRVLTNYRHQT; | SNRVLTNYRHQTQ; |
| NRVLTNYRHQTQP; | RVLTNYRHQTQPS; | VLTNYRHQTQPSF; |
| LTNYRHQTQPSFV; | TNYRHQTQPSFVV; | NYRHQTQPSFVVP; |
| YRHQTQPSFVVPV; | RHQTQPSFVVPVY; | HQTQPSFVVPVYS; |
| QTQPSFVVPVYSG; | TQPSFVVPVYSGN; | QPSFVVPVYSGNS; |
| PSFVVPVYSGNSP; | SFVVPVYSGNSPL; | FVVPVYSGNSPLQ; |
| VVPVYSGNSPLQK; | VPVYSGNSPLQKL; | PVYSGNSPLQKLK; |
| VYSGNSPLQKLKN; | YSGNSPLQKLKNN; | SGNSPLQKLKNNL; |
| GNSPLQKLKNNLL; | NSPLQKLKNNLLR; | SPLQKLKNNLLRR; |
| PLQKLKNNLLRRT; | LQKLKNNLLRRTA; | QKLKNNLLRRTAE; |
| KLKNNLLRRTAEE; | LKNNLLRRTAEEK; | KNNLLRRTAEEKN; |
| NNLLRRTAEEKNK; | NLLRRTAEEKNKT; | LLRRTAEEKNKTH; |
| LRRTAEEKNKTHH; | RRTAEEKNKTHHG; | RTAEEKNKTHHGF; |
| TAEEKNKTHHGFR; | AEEKNKTHHGFRE; | EEKNKTHHGFRET; |
| EKNKTHHGFRETY; | KNKTHHGFRETYD; | NKTHHGFRETYDQ; |
| KTHHGFRETYDQF; | THHGFRETYDQFK; | HHGFRETYDQFKM; |
| HGFRETYDQFKMK; | GFRETYDQFKMKD; | FRETYDQFKMKDS; |
| RETYDQFKMKDSA; | ETYDQFKMKDSAF; | TYDQFKMKDSAFT; |
| YDQFKMKDSAFTL; | DQFKMKDSAFTLL; | QFKMKDSAFTLLD; |
| FKMKDSAFTLLDV; | KMKDSAFTLLDVI; | MKDSAFTLLDVIS; |
| KDSAFTLLDVISN; | DSAFTLLDVISNI; | SAFTLLDVISNIS; |
| AFTLLDVISNISV; | FTLLDVISNISVF; | TLLDVISNISVFD; |
| LLDVISNISVFDR; | LDVISNISVFDRG; | DVISNISVFDRGS; |
| VISNISVFDRGSA; | ISNISVFDRGSAP; | SNISVFDRGSAPQ; |
| NISVFDRGSAPQL; | ISVFDRGSAPQLS; | SVFDRGSAPQLSS; |
| VFDRGSAPQLSSN; | FDRGSAPQLSSNT; | DRGSAPQLSSNTP; |
| RGSAPQLSSNTPF; | GSAPQLSSNTPFA; | SAPQLSSNTPFAE; |
| APQLSSNTPFAES; | PQLSSNTPFAESE; | QLSSNTPFAESER; |
| LSSNTPFAESERN; | SSNTPFAESERNR; | SNTPFAESERNRL; |
| NTPFAESERNRLY; | TPFAESERNRLYA; | PFAESERNRLYAM; |
| FAESERNRLYAMM; | AESERNRLYAMMD; | ESERNRLYAMMDF; |
| SERNRLYAMMDFD; | ERNRLYAMMDFDQ; | RNRLYAMMDFDQA; |
| NRLYAMMDFDQAK; | RLYAMMDFDQAKT; | LYAMMDFDQAKTT; |
| YAMMDFDQAKTTF; | AMMDFDQAKTTFG; | MMDFDQAKTTFGG; |
| MDFDQAKTTFGGS; | DFDQAKTTFGGST; | FDQAKTTFGGSTM; |
| DQAKTTFGGSTMN; | QAKTTFGGSTMNL; | AKTTFGGSTMNLL; |
| KTTFGGSTMNLLY; | TTFGGSTMNLLYQ; | TFGGSTMNLLYQE; |
| FGGSTMNLLYQEK; | GGSTMNLLYQEKQ; | GSTMNLLYQEKQN; |
| STMNLLYQEKQNH; | TMNLLYQEKQNHS; | MNLLYQEKQNHSL; |
| NLLYQEKQNHSLT; | LLYQEKQNHSLTR; | LYQEKQNHSLTRS; |
| YQEKQNHSLTRSL; | QEKQNHSLTRSLI; | EKQNHSLTRSLIT; |
| KQNHSLTRSLITS; | QNHSLTRSLITSG; | NHSLTRSLITSGL; |
| HSLTRSLITSGIG; | SLTRSLITSGIGT; | LTRSLITSGIGTQ; |
| TRSLITSGIGTQT; | RSLITSGIGTQTS; | SLITSGIGTQTSL; |
| LITSGIGTQTSLE; | ITSGIGTQTSLES; | TSGIGTQTSLEST; |
| SGIGTQTSLESTL; | GIGTQTSLESTLE; | IGTQTSLESTLEE; |
| GTQTSLESTLEET; | TQTSLESTLEETE; | QTSLESTLEETEK; |
| TSLESTLEETEKK; | SLESTLEETEKKI; | LESTLEETEKKIE; |
| ESTLEETEKKIES; | STLEETEKKIESF; | TLEETEKKIESFN; |
| LEETEKKIESFNT; | EETEKKIESFNTQ; | ETEKKIESFNTQY; |
| TEKKIESFNTQYL; | EKKIESFNTQYLK; |

Fig. 33 continued

KKIESYKTQYLNI; KIESYKTQYLKTI; IESYKTQYLKTII;
ESYKTQYLKTIK; SYKTQYLKTIKS; YKTQYLKTIKSY;
KTQYLKTIKSYT; TQYLKTIKSYTF; QYLKTIKSYTFK;
YLKTIKSYTFKD; LKTIKSYTFKDK; KTIKSYTFKDKL;
TIKSYTFKDKLK; IKSYTFKDKLKE; KSYTFKDKLKEL;
SYTFKDKLKELE; YTFKDKLKELES; TFKDKLKELESK;
FKDKLKELESKI; KDKLKELESKIN; DKLKELESKINS;
KLKELESKINSI; LKELESKINSIL; KELESKINSILA;
ELESKINSILAE; LESKINSILAEK; ESKINSILAEKK;
SKINSILAEKKE; KINSILAEKKEW; INSILAEKKEWL;
NSILAEKKEWLN; SILAEKKEWLNY; ILAEKKEWLNYA;
LAEKKEWLNYAD; AEKKEWLNYADA; EKKEWLNYADAL;
KKEWLNYADALI; KEWLNYADALIT; EWLNYADALITK;
WLNYADALITKT; LNYADALITKTS; NYADALITKTSS;
YADALITKTSSN; ADALITKTSSNS; DALITKTSSNSK;
ALITKTSSNSKR; LITKTSSNSKRN; ITKTSSNSKRND;
TKTSSNSKRNDP; KTSSNSKRNDPQ; TSSNSKRNDPQS;
SSNSKRNDPQSL; SNSKRNDPQSLG; NSKRNDPQSLGQ;
SKRNDPQSLGQY; KRNDPQSLGQYL; RNDPQSLGQYLK;
NDPQSLGQYLKN; DPQSLGQYLKNK; PQSLGQYLKNKY;
QSLGQYLKNKYL; SLGQYLKNKYLD; LGQYLKNKYLDK;
GQYLKNKYLDKM; QYLKNKYLDKMQ; YLKNKYLDKMQD;
LKNKYLDKMQDA; KNKYLDKMQDAR; NKYLDKMQDARQ;
KYLDKMQDARQS; YLDKMQDARQSA; LDKMQDARQSAL;
DKMQDARQSALD; KMQDARQSALDL; MQDARQSALDLY;
QDARQSALDLYL; DARQSALDLYLN; ARQSALDLYLNI;
RQSALDLYLNIT; QSALDLYLNITE;
SALDLYLNITETR;

14 mers:
MSSCTIDANLKKDY; SSCTIDANLKKDYK; SCTIDANLKKDYKN;
CTIDANLKKDYKNK; TIDANLKKDYKNKV; IDANLKKDYKNKVE;
DANLKKDYKNKVEE; ANLKKDYKNKVEEL; NLKKDYKNKVEELL;
LKKDYKNKVEELLN; KKDYKNKVEELLNS; KDYKNKVEELLNSS;
DYKNKVEELLNSST; YKNKVEELLNSSTD; KNKVEELLNSSTDD;
NKVEELLNSSTDDQ; KVEELLNSSTDDQA; VEELLNSSTDDQAK;
EELLNSSTDDQAKT; ELLNSSTDDQAKTS; LLNSSTDDQAKTST;
LNSSTDDQAKTSTN; NSSTDDQAKTSTNT; SSTDDQAKTSTNTG;
STDDQAKTSTNTGS; TDDQAKTSTNTGSN; DDQAKTSTNTGSNA;
DQAKTSTNTGSNAT; QAKTSTNTGSNATK; AKTSTNTGSNATKN;
KTSTNTGSNATKNK; TSTNTGSNATKNKT; STNTGSNATKNKTK;
TNTGSNATKNKTKI; NTGSNATKNKTKIK; TGSNATKNKTKIKV;
GSNATKNKTKIKVA; SNATKNKTKIKVAG; NATKNKTKIKVAGL;
ATKNKTKIKVAGLQ; TKNKTKIKVAGLQK; KNKTKIKVAGLQKN;
NKTKIKVAGLQKNT; KTKIKVAGLQKNTQ; TKIKVAGLQKNTQS;
KIKVAGLQKNTQSK; IKVAGLQKNTQSKK; KVAGLQKNTQSKKN;
VAGLQKNTQSKKNN; AGLQKNTQSKKNNL; GLQKNTQSKKNNLQ;
LQKNTQSKKNNLQG; QKNTQSKKNNLQGL; KNTQSKKNNLQGLN;
NTQSKKNNLQGLNP; TQSKKNNLQGLNPA; QSKKNNLQGLNPAN;
SKKNNLQGLNPAKQ; KKNNLQGLNPAKQV; KNNLQGLNPAKQVN;
NNLQGLNPAKQVN; NLQGLNPAKQVNP; LQGLNPAKQVNPS;

Fig. 33 continued

LQCLKPAKQVFPQN; QCLKPAKQVFPQNP; CLKPAKQVFPQNPM;
LKPAKQVFPQNPMQ; KPAKQVFPQNPMQT; PAKQVFPQNPMQTA;
AKQVFPQNPMQTAN; KQVFPQNPMQTANQ; QVFPQNPMQTANQA;
VFPQNPMQTANQAN; FPQNPMQTANQANQ; PQNPMQTANQANQA;
QNPMQTANQANQAN; NPMQTANQANQANQ; PMQTANQANQANQA;
MQTANQANQANQAN; QTANQANQANQANQ; TANQANQANQANQA;
ANQANQANQANQAN; NQANQANQANQANQ; QANQANQANQANQA;
ANQANQANQANQAN; NQANQANQANQANQ; QANQANQANQANQA;
ANQANQANQANQAS; NQANQANQANQASQ; QANQANQANQASQA;
ANQANQANQASQAS; NQANQANQASQASQ; QANQANQASQASQA;
ANQANQASQASQAS; NQANQASQASQASQ; QANQASQASQASQV;
ANQASQASQASQVA; NQASQASQASQVAS; QASQASQASQVASS;
ASQASQASQVASSA; SQASQASQVASSAS; QASQASQVASSASQ;
ASQASQVASSASQA; SQASQVASSASQAS; QASQVASSASQASP;
ASQVASSASQASPV; SQVASSASQASPVA; QVASSASQASPVAS;
VASSASQASPVASP; ASSASQASPVASPA; SSASQASPVASPAT;
SASQASPVASPATN; ASQASPVASPATNV; SQASPVASPATNVQ;
QASPVASPATNVQA; ASPVASPATNVQAT; SPVASPATNVQATP;
PVASPATNVQATPP; VASPATNVQATPPK; ASPATNVQATPPKQ;
SPATNVQATPPKQL; PATNVQATPPKQLA; ATNVQATPPKQLAS;
TNVQATPPKQLASA; NVQATPPKQLASAQ; VQATPPKQLASAQA;
QATPPKQLASAQAL; ATPPKQLASAQALQ; TPPKQLASAQALQT;
PPKQLASAQALQTV; PKQLASAQALQTVP; KQLASAQALQTVPN;
QLASAQALQTVPNK; LASAQALQTVPNKT; ASAQALQTVPNKTS;
SAQALQTVPNKTST; AQALQTVPNKTSTP; QALQTVPNKTSTPN;
ALQTVPNKTSTPNQ; LQTVPNKTSTPNQS; QTVPNKTSTPNQSL;
TVPNKTSTPNQSLL; VPNKTSTPNQSLLK; PNKTSTPNQSLLKP;
NKTSTPNQSLLKPQ; KTSTPNQSLLKP

Fig. 33 continued

EKNYADAITNTCS; KNYADAITNTSSS; NYADAITNTSSSN;
NYADAITNTSSSN; YADAITNTSSNSK; ADAITNTSSNSKR;
DAITNTSSNSKRN; AITNTSSNSKRND; ITNTSSNSKRNDP;
TNTSSNSKRNDPQ; NTSSNSKRNDPQS; TSSNSKRNDPQSL;
TSSNSKRNDPQSLG; SSNSKRNDPQSLGQ; SNSKRNDPQSLGQY;
NSKRNDPQSLGQYT; SKRNDPQSLGQYTK; KRNDPQSLGQYTKN;
RNDPQSLGQYTKNK; NDPQSLGQYTKNKY; DPQSLGQYTKNKYL;
PQSLGQYTKNKYLD; QSLGQYTKNKYLDK; SLGQYTKNKYLDKM;
LGQYTKNKYLDKMQ; GQYTKNKYLDKMQD; QYTKNKYLDKMQDA;
YTKNKYLDKMQDAR; TKNKYLD

| | | |
|---|---|---|
| ASQVASSASQASPVA; | SQVASSASQASPVAS; | QVASSASQASPVASP; |
| VASSASQASPVASPA; | ASSASQASPVASPAT; | SSASQASPVASPATN; |
| SASQASPVASPATNV; | ASQASPVASPATNVQ; | SQASPVASPATNVQA; |
| QASPVASPATNVQAT; | ASPVASPATNVQATP; | SPVASPATNVQATPP; |
| PVASPATNVQATPPK; | VASPATNVQATPPKQ; | ASPATNVQATPPKQT; |
| SPATNVQATPPKQTA; | PATNVQATPPKQTAS; | ATNVQATPPKQTASA; |
| TNVQATPPKQTASAQ; | NVQATPPKQTASAQA; | VQATPPKQTASAQAT; |
| QATPPKQTASAQATQ; | ATPPKQTASAQATQT; | TPPKQTASAQATQTV; |
| PPKQTASAQATQTVP; | PKQTASAQATQTVPN; | KQTASAQATQTVPNK; |
| QTASAQATQTVPNKT; | TASAQATQTVPNKTS; | ASAQATQTVPNKTST; |
| SAQATQTVPNKTSTP; | AQATQTVPNKTSTPK; | QATQTVPNKTSTPKQ; |
| ATQTVPNKTSTPKQS; | TQTVPNKTSTPKQSI; | QTVPNKTSTPKQSII; |
| TVPNKTSTPKQSIIK; | VPNKTSTPKQSIIKP; | PNKTSTPKQSIIKPQ; |
| NKTSTPKQSIIKPQQ; | KTSTPKQSIIKPQQY; | TSTPKQSIIKPQQYT; |
| STPKQSIIKPQQYTF; | TPKQSIIKPQQYTFS; | PKQSIIKPQQYTFSS; |
| KQSIIKPQQYTFSSS; | QSIIKPQQYTFSSSF; | SIIKPQQYTFSSSFS; |
| IIKPQQYTFSSSFSQ; | IKPQQYTFSSSFSQP; | KPQQYTFSSSFSQPT; |
| PQQYTFSSSFSQPTS; | QQYTFSSSFSQPTSQ; | QYTFSSSFSQPTSQT; |
| YTFSSSFSQPTSQTN; | TFSSSFSQPTSQTNF; | FSSSFSQPTSQTNFN; |
| SSSFSQPTSQTNFNN; | SSFSQPTSQTNFNNS; | SFSQPTSQTNFNNSQ; |
| FSQPTSQTNFNNSQS; | SQPTSQTNFNNSQSK; | QPTSQTNFNNSQSKN; |
| PTSQTNFNNSQSKNV; | TSQTNFNNSQSKNVL; | SQTNFNNSQSKNVLT; |
| QTNFNNSQSKNVLTN; | TNFNNSQSKNVLTNY; | NFNNSQSKNVLTNYR; |
| FNNSQSKNVLTNYRH; | NNSQSKNVLTNYRHQ; | NSQSNKVLTNYRHQT; |
| SQSNKVLTNYRHQTQ; | QSNKVLTNYRHQTQP; | SNKVLTNYRHQTQPS; |
| NKVLTNYRHQTQPSV; | KVLTNYRHQTQPSVV; | VLTNYRHQTQPSVVP; |
| LTNYRHQTQPSVVPV; | TNYRHQTQPSVVPVY; | NYRHQTQPSVVPVYS; |
| YRHQTQPSVVPVYSG; | RHQTQPSVVPVYSGN; | HQTQPSVVPVYSGNS; |
| QTQPSVVPVYSGNSP; | TQPSVVPVYSGNSPL; | QPSVVPVYSGNSPLQ; |
| PSVVPVYSGNSPLQK; | SVVPVYSGNSPLQKL; | VVPVYSGNSPLQKLK; |
| VPVYSGNSPLQKLKN; | PVYSGNSPLQKLKNL; | VYSGNSPLQKLKNLL; |
| YSGNSPLQKLKNLLR; | SGNSPLQKLKNLLRR; | GNSPLQKLKNLLRRT; |
| NSPLQKLKNLLRRTA; | SPLQKLKNLLRRTAF; | PLQKLKNLLRRTAFF; |
| LQKLKNLLRRTAFFK; | QKLKNLLRRTAFFKN; | KLKNLLRRTAFFKNK; |
| LKNLLRRTAFFKNKT; | KNLLRRTAFFKNKTH; | NLLRRTAFFKNKTHH; |
| LLRRTAFFKNKTHHG; | LRRTAFFKNKTHHGF; | RRTAFFKNKTHHGFR; |
| RTAFFKNKTHHGFRE; | TAFFKNKTHHGFRET; | AFFKNKTHHGFRETY; |
| FFKNKTHHGFRETYD; | FKNKTHHGFRETYDQ; | KNKTHHGFRETYDQF; |
| NKTHHGFRETYDQFK; | KTHHGFRETYDQFKM; | THHGFRETYDQFKMK; |
| HHGFRETYDQFKMKD; | HGFRETYDQFKMKDS; | GFRETYDQFKMKDSA; |
| FRETYDQFKMKDSAF; | RETYDQFKMKDSAFT; | ETYDQFKMKDSAFTL; |
| TYDQFKMKDSAFTLL; | YDQFKMKDSAFTLLD; | DQFKMKDSAFTLLDV; |
| QFKMKDSAFTLLDVT; | FKMKDSAFTLLDVTS; | KMKDSAFTLLDVTSN; |
| MKDSAFTLLDVTSNI; | KDSAFTLLDVTSNIS; | DSAFTLLDVTSNISV; |
| SAFTLLDVTSNISVF; | AFTLLDVTSNISVFD; | FTLLDVTSNISVFDR; |
| TLLDVTSNISVFDRG; | LLDVTSNISVFDRGS; | LDVTSNISVFDRGSA; |
| DVTSNISVFDRGSAP; | VTSNISVFDRGSAPQ; | TSNISVFDRGSAPQL; |
| SNISVFDRGSAPQLS; | NISVFDRGSAPQLSS; | ISVFDRGSAPQLSSN; |
| SVFDRGSAPQLSSNT; | VFDRGSAPQLSSNTP; | FDRGSAPQLSSNTPP; |
| DRGSAPQLSSNTPPA; | RGSAPQLSSNTPPAF; | GSAPQLSSNTPPAFS; |

Fig. 33 continued

Fig. 33 continued 16 mers:
MSSCTIDAKLNKDYKN; SSCTIDAKLNKDYKNK; SCTIDAKLNKDYKNKV;
CTIDAKLNKDYKNKVE; TIDAKLNKDYKNKVEE; IDAKLNKDYKNKVEEL;
DAKLNKDYKNKVEELL; AKLNKDYKNKVEELLN; KLNKDYKNKVEELLNS;
LNKDYKNKVEELLNSS; NKDYKNKVEELLNSST; KDYKNKVEELLNSSTD;
DYKNKVEELLNSSTDD; YKNKVEELLNSSTDDQ; KNKVEELLNSSTDDQA;
NKVEELLNSSTDDQAK; KVEELLNSSTDDQAKI; VEELLNSSTDDQAKIS;
EELLNSSTDDQAKIST; ELLNSSTDDQAKISTN; LLNSSTDDQAKISTNT;
LNSSTDDQAKISTNTG; NSSTDDQAKISTNTGS; SSTDDQAKISTNTGSN;
STDDQAKISTNTGSNA; TDDQAKISTNTGSNAT; DDQAKISTNTGSNATK;
DQAKISTNTGSNATKN; QAKISTNTGSNATKNK; AKISTNTGSNATKNKT;
KISTNTGSNATKNKTN; ISTNTGSNATKNKTNT; STNTGSNATKNKTNTK;
TNTGSNATKNKTNTKV; NTGSNATKNKTNTKVA; TGSNATKNKTNTKVAG;
GSNATKNKTNTKVAGL; SNATKNKTNTKVAGLQ; NATKNKTNTKVAGLQK;
ATKNKTNTKVAGLQKN; TKNKTNTKVAGLQKNT; KNKTNTKVAGLQKNTQ;
NKTNTKVAGLQKNTQS; KTNTKVAGLQKNTQSR; TNTKVAGLQKNTQSRK;
NTKVAGLQKNTQSRKN; TKVAGLQKNTQSRKNN; KVAGLQKNTQSRKNNL;
VAGLQKNTQSRKNNLQ; AGLQKNTQSRKNNLQG; GLQKNTQSRKNNLQGL;
LQKNTQSRKNNLQGLN; QKNTQSRKNNLQGLNP; KNTQSRKNNLQGLNPA;
NTQSRKNNLQGLNPAN; TQSRKNNLQGLNPANQ; QSRKNNLQGLNPANQV;
SRKNNLQGLNPANQVN; RKNNLQGLNPANQVNP; KNNLQGLNPANQVNPG;
NNLQGLNPANQVNPGN; NLQGLNPANQVNPGNP; LQGLNPANQVNPGNPM;
QGLNPANQVNPGNPMQ; GLNPANQVNPGNPMQT; LNPANQVNPGNPMQTA;
NPANQVNPGNPMQTAN; PANQVNPGNPMQTANQ; ANQVNPGNPMQTANQA;
NQVNPGNPMQTANQAN; QVNPGNPMQTANQANQ; VNPGNPMQTANQANQA;
NPGNPMQTANQANQAN; PGNPMQTANQANQANQ; GNPMQTANQANQANQA;
NPMQTANQANQANQAN; PMQTANQANQANQANQ; MQTANQANQANQANQA;
QTANQANQANQANQAN; TANQANQANQANQANQ; ANQANQANQANQANQA;
NQANQANQANQANQAN; QANQANQANQANQANQ; ANQANQANQANQANQA;
NQANQANQANQANQAS; QANQANQANQANQASQ; ANQANQANQANQASQA;
NQANQANQANQASQAS; QANQANQANQASQASQ; ANQANQANQASQASQA;
NQANQANQASQASQAS; QANQANQASQASQASQ; ANQANQASQASQASQA;
NQANQASQASQASQAS; QANQASQASQASQASQ; ANQASQASQASQASQV;
NQASQASQASQASQVA; QASQASQASQASQVAS; ASQASQASQASQVASS;
NQASQASQASQVASSA; QASQASQASQVASSAS; ASQASQASQVASSASQ;
SQASQASQVASSASQA; QASQASQVASSASQAS; ASQASQVASSASQASP;
SQASQVASSASQASPV; QASQVASSASQASPVA; ASQVASSASQASPVAS;
SQVASSASQASPVASP; QVASSASQASPVASPA; VASSASQASPVASPAT;
ASSASQASPVASPATN; SSASQASPVASPATNV; SASQASPVASPATNVQ;
ASQASPVASPATNVQA; SQASPVASPATNVQAT; QASPVASPATNVQATP;
ASPVASPATNVQATPP; SPVASPATNVQATPPK; PVASPATNVQATPPKQ;
VASPATNVQATPPKQI; ASPATNVQATPPKQIA; SPATNVQATPPKQTAS;
PATNVQATPPKQTASA; ATNVQATPPKQTASAQ; TNVQATPPKQTASAQA;
NVQATPPKQTASAQAT; VQATPPKQTASAQATQ; QATPPKQTASAQATQT;
ATPPKQTASAQATQTV; TPPKQTASAQATQTVP; PPKQTASAQATQTVPN;
PKQTASAQATQTVPNT; KQTASAQATQTVPNTS; QTASAQATQTVPNTST;
TASAQATQTVPNTSTP; ASAQATQTVPNTSTPN; SAQATQTVPNTSTPNQ;
AQATQTVPNTSTPNQS; QATQTVPNTSTPNQSI; ATQTVPNTSTPNQSII;
TQTVPNTSTPNQSIIK; QTVPNTSTPNQSIIKP; TVPNTSTPNQSIIKPQ;
VPNTSTPNQSIIKPQQ; PNTSTPNQSIIKPQQY; NTSTPNQSIIKPQQYT;
TSTPNQSIIKPQQYTP;

Fig. 33 continued

| | | |
|---|---|---|
| STPNQSLLKPQQYTFS; | TPKQSLLKPQQYTFSS; | PQQSLLKPQQYTFSSS; |
| QSLLKPQQYTFSSSF; | QSLLKPQQYTFSSSFS; | SLLKPQQYTFSSSFSQ; |
| LLKPQQYTFSSSFSQP; | LKPQQYTFSSSFSQPT; | KPQQYTFSSSFSQPTS; |
| PQQYTFSSSFSQPTSQ; | QQYTFSSSFSQPTSQT; | QYTFSSSFSQPTSQTN; |
| YTFSSSFSQPTSQTNF; | TFSSSFSQPTSQTNFN; | FSSSFSQPTSQTNFNN; |
| SSSFSQPTSQTNFNNS; | SSFSQPTSQTNFNNSQ; | SFSQPTSQTNFNNSQS; |
| FSQPTSQTNFNNSQSN; | SQPTSQTNFNNSQSNK; | QPTSQTNFNNSQSNKV; |
| PTSQTNFNNSQSNKVL; | TSQTNFNNSQSNKVLL; | SQTNFNNSQSNKVLLT; |
| QTNFNNSQSNKVLLTY; | TNFNNSQSNKVLLTYR; | NFNNSQSNKVLLTYRH; |
| FNNSQSNKVLLTYRHQ; | NNSQSNKVLLTYRHQT; | NSQSNKVLLTYRHQTQ; |
| SQSNKVLLTYRHQTQP; | QSNKVLLTYRHQTQPS; | SNKVLLTYRHQTQPSF; |
| NKVLLTYRHQTQPSFV; | KVLLTYRHQTQPSFVV; | VLLTYRHQTQPSFVVP; |
| LLTYRHQTQPSFVVPV; | LTYRHQTQPSFVVPVY; | TYRHQTQPSFVVPVYS; |
| YRHQTQPSFVVPVYSG; | RHQTQPSFVVPVYSGN; | HQTQPSFVVPVYSGNS; |
| QTQPSFVVPVYSGNSP; | TQPSFVVPVYSGNSPL; | QPSFVVPVYSGNSPLQ; |
| PSFVVPVYSGNSPLQK; | SFVVPVYSGNSPLQKL; | FVVPVYSGNSPLQKLK; |
| VVPVYSGNSPLQKLKN; | VPVYSGNSPLQKLKNN; | PVYSGNSPLQKLKNNL; |
| VYSGNSPLQKLKNNLL; | YSGNSPLQKLKNNLLR; | SGNSPLQKLKNNLLRR; |
| GNSPLQKLKNNLLRRI; | NSPLQKLKNNLLRRIA; | SPLQKLKNNLLRRIAE; |
| PLQKLKNNLLRRIAEE; | LQKLKNNLLRRIAEEK; | QKLKNNLLRRIAEEKN; |
| KLKNNLLRRIAEEKNK; | LKNNLLRRIAEEKNKT; | KNNLLRRIAEEKNKTH; |
| NNLLRRIAEEKNKTHH; | NLLRRIAEEKNKTHHN; | LLRRIAEEKNKTHHNG; |
| LRRIAEEKNKTHHNGF; | RRIAEEKNKTHHNGFR; | RIAEEKNKTHHNGFRE; |
| IAEEKNKTHHNGFRET; | AEEKNKTHHNGFRETY; | EEKNKTHHNGFRETYD; |
| EKNKTHHNGFRETYDQ; | KNKTHHNGFRETYDQF; | NKTHHNGFRETYDQFK; |
| KTHHNGFRETYDQFKM; | THHNGFRETYDQFKMK; | HHNGFRETYDQFKMKD; |
| HNGFRETYDQFKMKDS; | NGFRETYDQFKMKDSA; | GFRETYDQFKMKDSAF; |
| FRETYDQFKMKDSAFT; | RETYDQFKMKDSAFTL; | ETYDQFKMKDSAFTLL; |
| TYDQFKMKDSAFTLLD; | YDQFKMKDSAFTLLDV; | DQFKMKDSAFTLLDVT; |
| QFKMKDSAFTLLDVIS; | FKMKDSAFTLLDVISN; | KMKDSAFTLLDVISNL; |
| MKDSAFTLLDVISNLS; | KDSAFTLLDVISNLSV; | DSAFTLLDVISNLSVE; |
| SAFTLLDVISNLSVFD; | AFTLLDVISNLSVFDR; | FTLLDVISNLSVFDRG; |
| TLLDVISNLSVFDRGS; | LLDVISNLSVFDRGSA; | LDVISNLSVFDRGSAP; |
| DVISNLSVFDRGSAPQ; | VISNLSVFDRGSAPQL; | ISNLSVFDRGSAPQLS; |
| SNLSVFDRGSAPQLSS; | NLSVFDRGSAPQLSSN; | LSVFDRGSAPQLSSNT; |
| SVFDRGSAPQLSSNTP; | VFDRGSAPQLSSNTPE; | FDRGSAPQLSSNTPEA; |
| DRGSAPQLSSNTPEAE; | RGSAPQLSSNTPEAES; | GSAPQLSSNTPEAESE; |
| SAPQLSSNTPEAESER; | APQLSSNTPEAESERN; | PQLSSNTPEAESERNR; |
| QLSSNTPEAESERNRL; | LSSNTPEAESERNRLY; | SSNTPEAESERNRLYA; |
| SNTPEAESERNRLYAM; | NTPEAESERNRLYAMM; | TPEAESERNRLYAMMD; |
| PEAESERNRLYAMMDF; | EAESERNRLYAMMDFD; | AESERNRLYAMMDFDQ; |
| ESERNRLYAMMDFDQA; | SERNRLYAMMDFDQAK; | ERNRLYAMMDFDQAKT; |
| RNRLYAMMDFDQAKTT; | NRLYAMMDFDQAKTTF; | RLYAMMDFDQAKTTFF; |
| LYAMMDFDQAKTTFFG; | YAMMDFDQAKTTFFGS; | AMMDFDQAKTTFFGST; |
| MMDFDQAKTTFFGSTM; | MDFDQAKTTFFGSTMN; | DFDQAKTTFFGSTMNI; |
| FDQAKTTFFGSTMNIL; | DQAKTTFFGSTMNILY; | QAKTTFFGSTMNILYQ; |
| AKTTFFGSTMNILYQE; | KTTFFGSTMNILYQEN; | TTFFGSTMNILYQENQ; |
| TFFGSTMNILYQENQH; | FFGSTMNILYQENQHS; | FGSTMNILYQENQHSL; |
| GSTMNILYQENQHSLI; | STMNILYQENQHSLIR; | TMNILYQENQHSLIRS; |
| MNILYQENQHSLIRSL; | NILYQENQHSLIRSLL; | ILYQENQHSLIRSLLT; |
| LYQENQHSLIRSLLTT; | YQENQHSLIRSLLTTS; | QENQHSLIRSLLTTSG; |

Fig. 33 continued

| | ENQNHSLIRSLIISGL; NQNHSLIRSLIISGLG; QNHSLIRSLIISGLGI; |
| --- | --- |
| | NHSLIRSLIISGLGIQ; HSLIRSLIISGLGIQI; SLIRSLIISGLGIQIS; |
| | LIRSLIISGLGIQISL; IRSLIISGLGIQISLE; RSLIISGLGIQISLES; |
| | SLIISGLGIQISLEST; LIISGLGIQISLESTL; IISGLGIQISLESTLE; |
| | ISGLGIQISLESTLEE; SGLGIQISLESTLEEI; GLGIQISLESTLEEIE; |
| | LGIQISLESTLEEIEK; GIQISLESTLEEIEKK; IQISLESTLEEIEKKI; |
| | QISLESTLEEIEKKIE; ISLESTLEEIEKKIES; SLESTLEEIEKKIESF; |
| | LESTLEEIEKKIESFN; ESTLEEIEKKIESFNT; STLEEIEKKIESFNTQ; |
| | TLEEIEKKIESFNTQY; LEEIEKKIESFNTQYL; EEIEKKIESFNTQYLN; |
| | EIEKKIESFNTQYLNT; IEKKIESFNTQYLNTI; EKKIESFNTQYLNTII; |
| | KKIESFNTQYLNTIIN; KIESFNTQYLNTIINS; IESFNTQYLNTIINSY; |
| | ESFNTQYLNTIINSYT; SFNTQYLNTIINSYTF; FNTQYLNTIINSYTFK; |
| | NTQYLNTIINSYTFKD; TQYLNTIINSYTFKDK; QYLNTIINSYTFKDKL; |
| | YLNTIINSYTFKDKLK; LNTIINSYTFKDKLKE; NTIINSYTFKDKLKEL; |
| | TIINSYTFKDKLKELE; IINSYTFKDKLKELES; INSYTFKDKLKELESK; |
| | NSYTFKDKLKELESKL; SYTFKDKLKELESKLN; YTFKDKLKELESKLNS; |
| | TFKDKLKELESKLNSI; FKDKLKELESKLNSIL; KDKLKELESKLNSILA; |
| | DKLKELESKLNSILAE; KLKELESKLNSILAEK; LKELESKLNSILAEKK; |
| | KELESKLNSILAEKKE; ELESKLNSILAEKKEW; LESKLNSILAEKKEWL; |
| | ESKLNSILAEKKEWLN; SKLNSILAEKKEWLNY; KLNSILAEKKEWLNYA; |
| | LNSILAEKKEWLNYAD; NSILAEKKEWLNYADA; SILAEKKEWLNYADAI; |
| | ILAEKKEWLNYADAII; LAEKKEWLNYADAIIT; AEKKEWLNYADAIITN; |
| | EKKEWLNYADAIITNT; KKEWLNYADAIITNTS; KEWLNYADAIITNTSS; |
| | EWLNYADAIITNTSSN; WLNYADAIITNTSSNS; LNYADAIITNTSSNSK; |
| | NYADAIITNTSSNSKR; YADAIITNTSSNSKRN; ADAIITNTSSNSKRND; |
| | DAIITNTSSNSKRNDP; AIITNTSSNSKRNDPQ; IITNTSSNSKRNDPQS; |
| | ITNTSSNSKRNDPQSL; TNTSSNSKRNDPQSLG; NTSSNSKRNDPQSLGQ; |
| | TSSNSKRNDPQSLGQY; SSNSKRNDPQSLGQYI; SNSKRNDPQSLGQYIK; |
| | NSKRNDPQSLGQYIKN; SKRNDPQSLGQYIKNK; KRNDPQSLGQYIKNKY; |
| | RNDPQSLGQYIKNKYL; NDPQSLGQYIKNKYLD; DPQSLGQYIKNKYLDK; |
| | PQSLGQYIKNKYLDKM; QSLGQYIKNKYLDKMQ; SLGQYIKNKYLDKMQD; |
| | LGQYIKNKYLDKMQDA; GQYIKNKYLDKMQDAR; QYIKNKYLDKMQDARQ; |
| | YIKNKYLDKMQDARQS; IKNKYLDKMQDARQSA; KNKYLDKMQDARQSAL; |
| | NKYLDKMQDARQSALD; KYLDKMQDARQSALDL; YLDKMQDARQSALDLY; |
| | LDKMQDARQSALDLYL; DKMQDARQSALDLYLN; KMQDARQSALDLYLNI; |
| | MQDARQSALDLYLNIT; QDARQSALDLYLNITE; DARQSALDLYLNITEI; |
| | ARQSALDLYLNITEIR; |
| SEQ ID NO:37 SEQ ID NO: 116379-117364 | 13 mers:<br>MKKTKLNIIKLNI; KKTKLNIIKLNIL; KTKLNIIKLNILT;<br>TKLNIIKLNILTT; KLNIIKLNILTTT; LNIIKLNILTTTL;<br>NIIKLNILTTTLT; IIKLNILTTTLTL; IKLNILTTTLTLI;<br>KLNILTTTLTLIC; LNILTTTLTLICI; NILTTTLTLICIS;<br>ILTTTLTLICISC; LTTTLTLICISCA; TTTLTLICISCAV;<br>TTLTLICISCAVN; TLTLICISCAVNK; LTLICISCAVNKI;<br>TLICISCAVNKID; LICISCAVNKIDP; ICISCAVNKIDPE;<br>CISCAVNKIDPEP; ISCAVNKIDPEPK; SCAVNKIDPEPKS;<br>CAVNKIDPEPKSK; AVNKIDPEPKSKT; VNKIDPEPKSKTN;<br>NKIDPEPKSKTNK; KIDPEPKSKTNKK; IDPEPKSKTNKKE;<br>DPEPKSKTNKKEN; PEPKSKTNKKENI; EPKSKTNKKENIK; |

Fig. 33 continued

PKSKTNKKENIKE; KSKTNKKENIKEV; SKTNKKENIKNFV;
KTNKKENIKNFVNK; TNKKENTKNFVNK; NKKENTKNFVNKF;
KKENTKNFVNKFQ; KENTKNFVNKFQD; ENTKNFVNKFQDL;
NTKNFVNKFQDLE; TKNFVNKFQDLEP; KNFVKFQDLEPS;
NFVKFQDLEPSKK; FVKFQDLEPSKKQ; VKFQDLEPSKKQ;
NKFQDLEPSKKQN; KFQDLEPSKKQNK; FQDLEPSKKQNKD;
QDLEPSKKQNKDL; DLEPSKKQNKDLE; LEPSKKQNKDLEP;
EPSKKQDKDLEPL; PSKKQKDLEPLR; SKKQKDLEPLRE;
KKQNKDLEPTRFK; KQKKDLEPLREKY; QKKDLEPLREKYP;
NKDLEPLREKYPE; KDLEPLREKYPEA; DLEPLREKYPEAT;
LEPLREKYPEATA; EPLREKYPEATAS; PLREKYPEATASK;
LREKYPEATASKL; REKYPEATASKLE; EKYPEATASKLET;
KYPEATASKLETT; YPEATASKLETTI; PEATASKLETTIK;
EATASKLETTIKT; ATASKLETTIKTL; TASKLETTIKILE;
ASKLETTIKILEA; SKLETTIKILEAQ; KLETTIKILEAQK;
LETTIKILEAQKE; ETTIKILEAQKEK; TTIKILEAQKEKE;
TIKILEAQKEKEF; IKILEAQKEKEFT; KILEAQKEKENTE;
ILEAQKEKENTET; LEAQKEKENTETA; EAQKEKENTETAK;
AQKEKENTETAKI; QKEKENTETAKID; KEKENTETAKIDK;
EKENTETAKIDNT; KENTETAKIDNTQ; ENTETAKIDNTQI;
NTETAKIDNTQID; TETAKIDNTQIDF; ETAKIDNTQIDFL;
TAKIDNTQIDFLK; AKIDNTQIDFLKT; KIDNTQIDFLKTE;
IDNTQI

Fig. 33 continued

ILEAQKEKENIEIA; LEAQKEKENIEIAK; EAQKEKENIEIAKI;
AQKEKENIEIAKID; QKEKENIEIAKIDK; KEKENIEIAKIDKT;
EKENIEIAKIDNTQ; KENIEIAKIDNTQT; ENIEIAKIDNTQID;
NIEIAKIDNTQIDF; IEIAKIDNTQIDFL; EIAKIDNTQIDFLK;
IAKIDNTQIDFLKT; AKIDNTQIDFLKTF; KIDNTQIDFLKTFK;
IDNTQIDFLKTFKT; DNTQIDFLKTFKTD; NTQIDFLKTFKTDP;
TQIDFLKTFKTDPH; QIDFLKTFKTDPHD; IDFLKTFKTDPHDS;
DFLKTFKTDPHDSL; FLKTFKTDPHDSLP; LKTFKTD

SAEQLEKHIEENYK; AEQLEKHIEENYKE; EQLEKHIEEKYKEF;
QLEKHIEENYKEFE; LEKHIEENYKEFES; EKHIEENYKEFNSL;
KHIEENYKEFNSLK; IEENYKEFNSLKP; IEENYKEFNSLKPT;
EENYKEFNSLKPTY;

15 mers:
MKKTKINTFKLNILT; KKTKINTFKLNILTT; KTKINTFKLNILTTL;
TKLNILTKLNILTTLL; KLNIKLNILTTLLL; LNIKLNILTTLLLL;
NIFKLNILTTLLLLI; IIKLNILTTLLLIC; IKLNILTTLLLLCT;
KLNILTTLLLICTS; LNILTTLLLCTSC; NILTTLLICTSCA;
ILTTLLLCTSCAV; LTTLLLCTSCAVK; TTLLLCTSCAVKK;
TLLTLLCLSCAVKKI; LLTLLCLSCAVKKID; LTLLCLSCAVKKIDP;
TLLCLSCAVKKIDPP; LLCLSCAVKKIDPPP; LCLSCAVKKIDPPPK;
CLSCAVKKIDPPPKS; LSCAVKKIDPPPKSK; SCAVKKIDPPPKSKT;
CAVKKIDPPPKSKTN; AVKKIDPPPKSKTNK; VKKIDPPPKSKTNKK;
KKIDPPPKSKTNKKE; KIDPPPKSKTNKKEK; IDPPPKSKTNKKEKT;
DPPPKSKTNKKEKTK; PPPKSKTNKKEKTKN; PPKSKTNKKEKTKNF;
PKSKTNKKEKTKNFV; KSKTNKKEKTKNFVK; SKTNKKEKTKNFVKK;
KTKKKENIKNFVKFQ; TKKKENIKEFVKKFQ; KKKENIKEFVKKFQD;
KKENIKNFVKKFQDL; KENIKKFVKKFQDLE; ENIKNFVKKFQDLEP;
NIKNFVNKFQDLEPS; IKNFVNKFQDLEPSK; KNFVNKFQDLEPSKK;
NFVNKFQDLEPSKKQ; FVNKFQDLEPSKKQK; VNKFQDLEPSKKQKK;
NKFQDLEPSKKQKKD; KFQDLEPSKKQKKDL; FQDLEPSKKQKKDLE;
QDLEPSKKQKKDLEP; DLEPSKKQKKDLEPL; LEPSKKQKKDLEPLR;
EPSKKQKKDLEPLRE; PSKKQKKDLEPLREK; SKKQKKDLEPLREKY;
KKQKKDLEPLREKYP; KQKKDLEPLREKYPE; QKKDLEPLREKYPEA;
NKDLEPLREKYPEAT; KDLEPLREKYPEATA; DLEPLREKYPEATAS;
LEPLREKYPEATASK; EPLREKYPEATASKL; PLREKYPEATASKLE;
LREKYPEATASKLET; REKYPEATASKLETT; EKYPEATASKLETTL;
KYPEATASKLETTLK; YPEATASKLETTLKI; PEATASKLETTLKIL;
EATASKLETTLKILE; ATASKLETTLKILEA; TASKLETTLKILEAQ;
ASKLETTLKILEAQK; SKLETTLKILEAQKE; KLETTLKILEAQKEK;
LETTLKILEAQKEKE; ETTLKILEAQKEKEK; TTLKILEAQKEKENT;
TLKILEAQKEKENTE; LKILEAQKEKENTEA; KILEAQKEKENTEIA;
ILEAQKEKENTEIAK; LEAQKEKENTEIAKT; EAQKEKENTEIAKTD;
AQKEKENTEIAKTDN; QKEKENTEIAKTDNT; KEKENTEIAKTDNTQ;
EKENTEIAKTDNTQI; KENTEIAKTDNTQID; ENTEIAKTDNTQIDF;
NTEIAKIDNTQIDFL; TEIAKIDNTQIDFLK; EIAKIDNTQIDFLKT;
IAKIDNTQIDFLKTF; AKIDNTQIDFLKTFK; KIDNTQIDFLKTFKT;
IDNTQIDFLKTFKTD; DNTQIDFLKTFKTDP; NTQIDFLKTFKTDPH;
TQIDFLKTFKTDPHD; QIDFLKTFKTDPHDS; IDFLKTFKTDPHDSL;
DFLKTFKTDPHDSLP; FLKTFKTDPHDSLPE; LKTFKTDPHDSLPED;
KTFKTDPHDSLPEDE; TFKTDPHDSLPEDEK; FKTDPHDSLPEDEKM;
KTDPHDSLPEDEKMQ; TDPHDSLPEDEKMQM; DPHDSLPEDEKMQMK;
PHDSLPEDEKMQKKI; HDSLPEDEKMQKKIL; DSLPEDEKMQKKILY;
SLPEDEKMQKKILYS; LPEDEKMQKKILYSS; PEDEKMQKKILYSSL;
EDEKMQKKIIYSSL; DEKMQKKIIYSSLE; EKMQKKIIYSSLEY;
KMQKKIIYSSLEYE; MQKKIIYSSLEYET; QKKIIYSSLEYETE;
MKKIIYSSLEYETEK; KKIIYSSLEYETEKI; KIIYSSLEYETEKIK;
IIYSSLEYETEKIKI; IYSSLEYETEKIKIL; YSSLEYETEKIKILQ;
SSLEYETEKIKILQE; SLEYETEKIKILQEI; LEYETEKIKILQEIL;

| | |
|---|---|
| | DELQILNQKEIEELLM; ELQILNQKEIEELLMR; LQILNQKEIEELLMRI; QILNQKEIEELLMRIE; ILNQKEIEELLMRIES; LNQKEIEELLMRIESE; NQKEIEELLMRIESEL; QKEIEELLMRIESELK; KEIEELLMRIESELKI; EIEELLMRIESELKIK; IEELLMRIESELKIKE; EELLMRIESELKIKEN; ELLMRIESELKIKENF; LLMRIESELKIKENFK; LMRIESELKIKENFKK; MRIESELKIKENFKKA; RIESELKIKENFKKAL; IESELKIKENFKKALN; ESELKIKENFKKALNK; SELKIKENFKKALNKT; ELKIKENFKKALNKTI; LKIKENFKKALNKTID; KIKENFKKALNKTIDA; IKENFKKALNKTIDAY; KENFKKALNKTIDAYN; ENFKKALNKTIDAYNQ; NFKKALNKTIDAYNQD; FKKALNKTIDAYNQDS; KKALNKTIDAYNQDSE; KALNKTIDAYNQDSEN; ALNKTIDAYNQDSENI; LNKTIDAYNQDSENIK; NKTIDAYNQDSENIKT; KTIDAYNQDSENIKTS; TIDAYNQDSENIKTSA; IDAYNQDSENIKTSAE; DAYNQDSENIKTSAEQ; AYNQDSENIKTSAEQL; YNQDSENIKTSAEQLE; NQDSENIKTSAEQLEK; QDSENIKTSAEQLEKH; DSENIKTSAEQLEKHI; SENIKTSAEQLEKHIN; ENIKTSAEQLEKHINE; NIKTSAEQLEKHINEN; IKTSAEQLEKHINENY; KTSAEQLEKHINENYK; TSAEQLEKHINENYKE; SAEQLEKHINENYKEF; AEQLEKHINENYKEFN; EQLEKHINENYKEFNS; QLEKHINENYKEFNSL; LEKHINENYKEFNSLK; EKHINENYKEFNSLKP; KHINENYKEFNSLKPI; HINENYKEFNSLKPIY; |
| SEQ ID NO:38 SEQ ID NO: 117365-118046 | 13 mers: MRILVGVCIIALA; RILVGVCIIALAL; ILVGVCIIALALL; LVGVCIIALALLG; VGVCIIALALLGC; GVCIIALALLGCY; VCIIALALLGCYL; CIIALALLGCYLP; IIALALLGCYLPD; IALALLGCYLPDN; ALALLGCYLPDNQ; LALLGCYLPDNQE; ALLGCYLPDNQEQ; LLGCYLPDNQEQA; LGCYLPDNQEQAV; GCYLPDNQEQAVQ; CYLPDNQEQAVQT; YLPDNQEQAVQTF; LPDNQEQAVQTFF; PDNQEQAVQTFFE; DNQEQAVQTFFEN; NQEQAVQTFFENS; QEQAVQTFFENSE; EQAVQTFFENSES; QAVQTFFENSESS; AVQTFFENSESSD; VQTFFENSESSDM; QTFFENSESSDMG; TFFENSESSDMGS; FFENSESSDMGSD; FENSESSDMGSDE; ENSESSDMGSDEI; NSESSDMGSDEIV; SESSDMGSDEIVT; ESSDMGSDEIVTE; SSDMGSDEIVTEG; SDMGSDEIVTEGI; DMGSDEIVTEGIF; MGSDEIVTEGIFS; GSDEIVTEGIFSS; SDEIVTEGIFSSL; DEIVTEGIFSSLK; EIVTEGIFSSLKL; IVTEGIFSSLKLY; VTEGIFSSLKLYA; TEGIFSSLKLYAS; EGIFSSLKLYASE; GIFSSLKLYASEH; IFSSLKLYASEHR; FSSLKLYASEHRL; SSLKLYASEHRLL; SLKLYASEHRLLV; LKLYASEHRLLVE; KLYASEHRLLVEI; LYASEHRLLVEIK; YASEHRLLVEIKK; ASEHRLLVEIKKT; SEHRLLVEIKKTL; EHRLLVEIKKTLI; HRLLVEIKKTLIS; RLLVEIKKTLISL; LLVEIKKTLISLK; LVEIKKTLISLKD; VEIKKTLISLKDP; EIKKTLISLKDPN; IKKTLISLKDPNY; KKTLISLKDPNYR; KTLISLKDPNYRG; TLISLKDPNYRGV; LISLKDPNYRGVV; ISLKDPNYRGVVL; SLKDPNYRGVVLP; LKDPNYRGVVLPV; KDPNYRGVVLPVS; DPNYRGVVLPVSD; PNYRGVVLPVSDY; NYRGVVLPVSDYN; YRGVVLPVSDYNE; RGVVLPVSDYNEE; GVVLPVSDYNEEY; VVLPVSDYNEEYF; VLPVSDYNEEYFN; LPVSDYNEEYFNK; PVSDYNEEYFNKF; VSDYNEEYFNKFF; SDYNEEYFNKFFL; DYNEEYFNKFFLD; |

Fig. 33 continued

YREYYNKFFLDL; KEEYFKFFLDLG; EEYFKFFLDLGS;
EYFNKFFLDLGSE; YFNKFFLDLGSEQ; FNKFFLDLGSEQS;
NKFFLDLGSEQSK; KFFLDLGSEQSKD; FFLDLGSEQSKDL;
FLDLGSEQSKDLL; LDLGSEQSKDLLK; DLGSEQSKDLLKF;
LGSEQSKDLLKFF; GSEQSKDLLKFFL; SEQSKDLLKFFLM;
EQSKDLLKFFLMV; QSKDLLKFFLMVK; SKDLLKFFLMVKN;
KDLLKFFL

RLVEIKKTLISLK; LLVEIKKTLISLKD; LVEIKKTLISLKDP;
VEIKKTLISLKDPN; EIKKTLISLKDPNY; IKKTLISLKDPNYR;
KKTLISLKDPNYRG; KTLISLKDPNYRGV; TLISLKDPNYRGVV;
LISLKDPNYRGVVL; ISLKDPNYRGVVLP; SLKDPNYRGVVLPV;
LKDPNYRGVVLPVS; KDPNYRGVVLPVSD; DPNYRGVVLPVSDY;
PNYRGVVLPVSDYN; NYRGVVLPVSDYNE; YRGVVLPVSDYNEF;
RGVVLPVSDYNEFY; GVVLPVSDYNEFYF; VVLPVSDYNEFYFN;
VLPVSDYNEFYFNK; LPVSDYNEFYFNKF; PVSDYNEFYFNKFF;
VSDYNEFYFNKFFL; SDYNEFYFNKFFLD; DYNEFYFNKFFLDL;
YNEFYFNKFFLDLG; NEFYFNKFFLDLGS; EFYFNKFFLDLGSE;
FYFNKFFLDLGSEQ; YFNKFFLDLGSEQS; FNKFFLDLGSEQSK;
NKFFLDLGSEQSKD; KFFLDLGSEQSKDL; FFLDLGSEQSKDLI;
FLDLGSEQSKDLIK; LDLGSEQSKDLIKL; DLGSEQSKDLIKLF;
LGSEQSKDLIKLFI; GSEQSKDLIKLFIM; SEQSKDLIKLFIMV;
EQSKDLIKLFIMVK; QSKDLIKLFIMVKN; SKDLIKLFIMVKNE;
KDLIKLFIMVKNEQ; DLIKLFIMVKNEQN; LIKLFIMVKNEQNN;
IKLFIMVKNEQNNK; KLFIMVKNEQNNKF; LFIMVKNEQNNKFM;
FIMVKNEQNNKFMR; IMVKNEQNNKFMRI; MVKNEQNNKFMRIV;
VKNEQNNKFMRIVR; KNEQNNKFMRIVRW; NEQNNKFMRIVRWL;
EQNNKFMRIVRWLY; QNNKFMRIVRWLYS; NNKFMRIVRWLYSC;
NKFMRIVRWLYSCI; KFMRIVRWLYSCIE; FMRIVRWLYSCIEE;
MRIVRWLYSCIEEL; RIVRWLYSCIEELY; IVRWLYSCIEELYS;
VRWLYSCIEELYSP; RWLYSCIEELYSPD; WLYSCIEELYSPDI;
LYSCIEELYSPDIK; YSCIEELYSPDIKY; SCIEELYSPDIKYS;
CIEELYSPDIKYSG; IEELYSPDIKYSGE; EELYSPDIKYSGEE;
ELYSPDIKYSGEEG; LYSPDIKYSGEEGS; YSPDIKYSGEEGSP;
SPDIKYSGEEGSPE; PDIKYSGEEGSPEY; DIKYSGEEGSPEYY;
IKYSGEEGSPEYYR; KYSGEEGSPEYYRN; YSGEEGSPEYYRNM;
SGEEGSPEYYRNMP; GEEGSPEYYRNMPR; EEGSPEYYRNMPRP;
EGSPEYYRNMPRPT; GSPEYYRNMPRPTA; SPEYYRNMPRPTAY;
PEYYRNMPRPTAYQ; EYYRNMPRPTAYQQ; YYRNMPRPTAYQQY;
YRNMPRPTAYQQYL; RNMPRPTAYQQYLK; NMPRPTAYQQYLKV;
MPRPTAYQQYLKVK; PRPTAYQQYLKVKR; RPTAYQQYLKVKRY;
PTAYQQYLKVKRYD; TAYQQYLKVKRYDY; AYQQYLKVKRYDYN;
YQQYLKVKRYDYNR; QQYLKVKRYDYNRP; QYLKVKRYDYNRPV;
YLKVKRYDYNRPVP; LKVKRYDYNRPVPT; KVKRYDYNRPVPTL;
VKRYDYNRPVPTLP; KRYDYNRPVPTLPT;

15 mers:
MRLLVGVCTIALALLG; RLLVGVCTIALALLGG; LLVGVCTIALALLGGY;
LVGVCTIALALLGGYL; VGVCTIALALLGGYLP; GVCTIALALLGGYLPD;
VCTIALALLGGYLPD; CTIALALLGGYLPDK; TIALALLGGYLPDKQ;
IALALLGGYLPDKQF; ALALLGGYLPDKQFQ; LALLGGYLPDKQFQA;
ALLGGYLPDKQFQAV; LLGGYLPDKQFQAVQ; LGGYLPDKQFQAVQT;
GGYLPDKQFQAVQTF; GYLPDKQFQAVQTFF; YLPDKQFQAVQTFFE;
LPDKQFQAVQTFFEN; PDKQFQAVQTFFENS; DKQFQAVQTFFENSE;
KQFQAVQTFFENSES; QFQAVQTFFENSESS; FQAVQTFFENSESSD;
QAVQTFFENSESSDM; AVQTFFENSESSDMG; VQTFFENSESSDMGS;
QTFFENSESSDMGSD; TFFENSESSDMGSDE; FFENSESSDMGSDEI;
FENSESSDMGSDEIV; ENSESSDMGSDEIVT; NSESSDMGSDEIVTE;
SESSDMGSDEIVTEG; ESSDMGSDEIVTEGT; SSDMGSDEIVTEGTF;

Fig. 33 continued

SDMGSDEVTEGLSS; DMGSDEVTEGLFSS; GSDEVTEGLFSSL;
GSDEVTEGLFSSLK; SDEVTEGLFSSLKL; DEVTEGLFSSLKLY;
EVTEGLFSSLKLYA; VTEGLFSSLKLYAS; TEGLFSSLKLYASE;
EGLFSSLKLYASEE; GLFSSLKLYASEER; LFSSLKLYASEERL;
FSSLKLYASEERLL; SSLKLYASEERLLV; SLKLYASEERLLVE;
LKLYASEERLLVET; KLYASEERLLVETK; LYASEERLLVETKK;
YASEERLLVETKKT; ASEERLLVETKKTL; SEERLLVETKKTLI;
EERLLVETKKTLIS; ERLLVETKKTLISL; RLLVETKKTLISLK;
LLVETKKTLISLKD; LVETKKTL

ALLCCYLPDNQEQAVQ; LCCYLPDNQEQAVQT; CCYLPDNQEQAVQTF;
CCYLPDNQEQAVQTFF; CYLPDNQEQAVQTFFN; YLPDNQEQAVQTFFNS;
LPDNQEQAVQTFFNS; PDNQEQAVQTFFNSE; DNQEQAVQTFFNSES;
NQEQAVQTFFNSESS; QEQAVQTFFNSESSD; EQAVQTFFNSESSDM;
QAVQTFFNSESSDMG; AVQTFFNSESSDMGS; VQTFFNSESSDMGSD;
QTFFNSESSDMGSDE; TFFNSESSDMGSDEI; FFNSESSDMGSDEIV;
FNSESSDMGSDEIVT; NSESSDMGSDEIVTE; SESSDMGSDEIVTEG;
SESSDMGSDEIVTEGI; ESSDMGSDEIVTEGIF; SSDMGSDEIVTEGIFS;
SDMGSDEIVTEGIFSS; DMGSDEIVTEGIFSSL; MGSDEIVTEGIFSSLK;
GSDEIVTEGIFSSLKL; SDEIVTEGIFSSLKLY; DEIVTEGIFSSLKLYA;
EIVTEGIFSSLKLYAS; IVTEGIFSSLK

| | QYLKVKRYDYNRPVPI; YLKVKRYDYNRPVPIL; LKVKRYDYNRPVPILP; KVKRYDYNRPVPILPT; |
|---|---|
| SEQ ID NO:39<br>SEQ ID NO:<br>118047-118632 | 13 mers:<br>MRNKNIFKLFFAS; RNKNIFKLFFASM; NKNIFKLFFASML;<br>KNIFKLFFASMLF; NIFKLFFASMLFV; IFKLFFASMLFVM;<br>FKLFFASMLFVMA; KLFFASMLFVMAC; LFFASMLFVMACK;<br>FFASMLFVMACKA; FASMLFVMACKAY; ASMLFVMACKAYV;<br>SMLFVMACKAYVE; MLFVMACKAYVEE; LFVMACKAYVEEK;<br>FVMACKAYVEEKK; VMACKAYVEEKKE; MACKAYVEEKKEI;<br>ACKAYVEEKKEID; CKAYVEEKKEIDS; KAYVEEKKEIDSL;<br>AYVEEKKEIDSLM; YVEEKKEIDSLME; VEEKKEIDSLMED;<br>EEKKEIDSLMEDV; EKKEIDSLMEDVL; KKEIDSLMEDVLA;<br>KEIDSLMEDVLAL; EIDSLMEDVLALV; IDSLMEDVLALVN;<br>DSLMEDVLALVND; SLMEDVLALVNDS; LMEDVLALVNDSS;<br>MEDVLALVNDSSG; EDVLALVNDSSGG; DVLALVNDSSGGK;<br>VLALVNDSSGGKF; LALVNDSSGGKFK; ALVNDSSGGKFKD;<br>LVNDSSGGKFKDY; VNDSSGGKFKDYK; NDSSGGKFKDYKD;<br>DSSGGKFKDYKDK; SSGGKFKDYKDKI; SGGKFKDYKDKIN;<br>GGKFKDYKDKINE; GKFKDYKDKINEL; KFKDYKDKINELK;<br>FKDYKDKINELKE; KDYKDKINELKEN; DYKDKINELKENL;<br>YKDKINELKENLK; KDKINELKENLKD; DKINELKENLKDI;<br>KINELKENLKDIG; INELKENLKDIGN; NELKENLKDIGNA;<br>ELKENLKDIGNAE; LKENLKDIGNAEL; KENLKDIGNAELK;<br>ENLKDIGNAELKE; NLKDIGNAELKEK; LKDIGNAELKEKL;<br>KDIGNAELKEKLL; DIGNAELKEKLLN; IGNAELKEKLLNL;<br>GNAELKEKLLNLQ; NAELKEKLLNLQN; AELKEKLLNLQNS;<br>ELKEKLLNLQNSF; LKEKLLNLQNSFQ; KEKLLNLQNSFQD;<br>EKLLNLQNSFQDK; KLLNLQNSFQDKL; LLNLQNSFQDKLA;<br>LNLQNSFQDKLAA; NLQNSFQDKLAAK; LQNSFQDKLAAKL;<br>QNSFQDKLAAKLA; NSFQDKLAAKLAA; SFQDKLAAKLAAL;<br>FQDKLAAKLAALK; QDKLAAKLAALKA; DKLAAKLAALKAA;<br>KLAAKLAALKAAK; LAAKLAALKAAKN; AAKLAALKAAKNT;<br>AKLAALKAAKNTI; KLAALKAAKNTIE; LAALKAAKNTIEN;<br>AALKAAKNTIENI; ALKAAKNTIENIT; LKAAKNTIENITD;<br>KAAKNTIENITDK; AAKNTIENITDKD; AKNTIENITDKDQ;<br>KNTIENITDKDQD; NTIENITDKDQDI; TIENITDKDQDIS;<br>IENITDKDQDISK; ENITDKDQDISKR; NITDKDQDISKRK;<br>ITDKDQDISKRKI; TDKDQDISKRKIW; DKDQDISKRKIWS;<br>KDQDISKRKIWSE; DQDISKRKIWSEA; QDISKRKIWSEAK;<br>DISKRKIWSEAKL; ISKRKIWSEAKLV; SKRKIWSEAKLVG;<br>KRKIWSEAKLVGV; RKIWSEAKLVGVT; KIWSEAKLVGVTV;<br>IWSEAKLVGVTVP; WSEAKLVGVTVPL; SEAKLVGVTVPLL;<br>EAKLVGVTVPLLG; AKLVGVTVPLLGS; KLVGVTVPLLGSN;<br>LVGVTVPLLGSNT; VGVTVPLLGSNTS; GVTVPLLGSNTSG;<br>VTVPLLGSNTSGN; TVPLLGSNTSGNG; VPLLGSNTSGNGD;<br>PLLGSNTSGNGDK; LLGSNTSGNGDKM; LGSNTSGNGDKMS;<br>GSNTSGNGDKMSK; SNTSGNGDKMSKN; NTSGNGDKMSKNA;<br>TSGNGDKMSKNAV; SGNGDKMSKNAVE; GNGDKMSKNAVEQ;<br>NGDKMSKNAVEQI; GDKMSKNAVEQID; DKMSKNAVEQIDK; |

Fig. 33 continued

KMSKKAVEQIDKV; MSKKAVEQIDKVI; SKNAVEQIDKVLK;
KNAVEQIDKVIKF; NAVEQIDKVIKFL; AVEQIDKVIKFLE;
VEQIDKVIKFLEE; EQIDKVIKFLEEG; QIDKVIKFLEEGT;
IDKVIKFLEEGTK;

14 mers:
MRKKNIFKLFFASM; RKKNIFKLFFASML; KKNIFKLFFASMLF;
KNIFKLFFASMLFV; NIFKLFFASMLFVM; IFKLFFASMLFVMA;
FKLFFASMLFVMAC; KLFFASMLFVMACK; LFFASMLFVMACKA;
FFASMLFVMACKAY; FASMLFVMACKAYV; ASMLFVMACKAYVE;
SMLFVMACKAYVEE; MLFVMACKAYVEEK; LFVMACKAYVEEKK;
FVMACKAYVEEKKE; VMACKAYVEEKKEI; MACKAYVEEKKEID;
ACKAYVEEKKEIDS; CKAYVEEKKEIDSL; KAYVEEKKEIDSLM;
AYVEEKKEIDSLME; YVEEKKEIDSLMED; VEEKKEIDSLMEDV;
EEKKEIDSLMEDVL; EKKEIDSLMEDVLA; KKEIDSLMEDVLAL;
KEIDSLMEDVLALV; EIDSLMEDVLALVK; IDSLMEDVLALVKD;
DSLMEDVLALVKDS; SLMEDVLALVKDSS; LMEDVLALVKDSSG;
MEDVLALVKDSSGG; EDVLALVKDSSGGK; DVLALVKDSSGGKF;
VLALVKDSSGGKFK; LALVKDSSGGKFKD; ALVKDSSGGKFKDY;
LVKDSSGGKFKDYK; VKDSSGGKFKDYKD; KDSSGGKFKDYKDK;
DSSGGKFKDYKDKT; SSGGKFKDYKDKTK; SGGKFKDYKDKTKF;
GGKFKDYKDKTKEL; GKFKDYKDKTKELK; KFKDYKDKTKELKE;
FKDYKDKTKELKEN; KDYKDKTKELKENL; DYKDKTKELKENLK;
YKDKTKELKENLKD; KDKTKELKENLKDI; DKTKELKENLKDIG;
KTKELKENLKDIGN; TKELKENLKDIGNA; KELKENLKDIGNAE;
ELKENLKDIGNAEL; LKENLKDIGNAELK; KENLKDIGNAELKE;
ENLKDIGNAELKEK; NLKDIGNAELKEKL; LKDIGNAELKEKLL;
KDIGNAELKEKLLN; DIGNAELKEKLLNI; IGNAELKEKLLNIQ;
GNAELKEKLLNIQS; NAELKEKLLNIQSF; AELKEKLLNIQSFQ;
ELKEKLLNIQSFQD; LKEKLLNIQSFQDK; KEKLLNIQSFQDK;
EKLLNLQSFQDKL; KLLNLQSFQDKLA; LLNLQSFQDKLAA;
LNLQSFQDKLAAK; NLQSFQDKLAAKL; LQSFQDKLAAKLA;
QSFQDKLAAKLAA; NSFQDKLAAKLAAL; SFQDKLAAKLAALK;
FQDKLAAKLAALKA; QDKLAAKLAALKAA; DKLAAKLAALKAAK;
KLAAKLAALKAAKN; LAAKLAALKAAKNT; AAKLAALKAAKNTT;
AKLAALKAAKNTTF; KLAALKAAKNTTFK; LAALKAAKNTTFKT;
AALKAAKNTTFKTT; ALKAAKNTTFKTTD; LKAAKNTTFKTTDK;
KAAKNTTFKTTDKD; AAKNTTFKTTDKDQ; AKNTTFKTTDKDQD;
KNTTFKTTDKDQDT; NTTFKTTDKDQDTS; TTFKTTDKDQDTSK;
TFKTTDKDQDTSKR; FKTTDKDQDTSKRK; KTTDKDQDTSKRKI;
TTDKDQDTSKRKIW; TDKDQDTSKRKIWS; DKDQDTSKRKIWSE;
KDQDTSKRKIWSEA; DQDTSKRKIWSEAK; QDTSKRKIWSEAKL;
DTSKRKIWSEAKLV; TSKRKIWSEAKLVG; SKRKIWSEAKLVGV;
KRKIWSEAKLVGVT; RKIWSEAKLVGVTV; KIWSEAKLVGVTVP;
IWSEAKLVGVTVPL; WSEAKLVGVTVPLL; SEAKLVGVTVPLLG;
EAKLVGVTVPLLGS; AKLVGVTVPLLGSN; KLVGVTVPLLGSNT;
LVGVTVPLLGSNTS; VGVTVPLLGSNTSG; GVTVPLLGSNTSGG;
VTVPLLGSNTSGGD; TVPLLGSNTSGGDK; VPLLGSNTSGGDKM;
PLLGSNTSGGDKMS; LLGSNTSGGDKMSK; LGSNTSGGDKMSKK;
GSNTSGGDKMSKKA; SNTSGGDKMSKKAV; NTSGGDKMSKKAVE;
TSGGDKMSKKAVEQ; SGGDKMSKKAVEQI; GGDKMSKKAVEQID;

Fig. 33 continued

NGDKMSKNAVEQID; GDKMSKNAVEQIDK; DKMSKNAVEQIDKV;
KMSKNAVEQIDKVT; MSKNAVEQIDKVTK; SKNAVEQIDKVTKF;
KNAVEQIDKVTKFL; NAVEQIDKVTKFLE; AVEQIDKVTKFLEE;
VEQIDKVTKFLEEG; EQIDKVTKFLEEGI; QIDKVTKFLEEGID;

15 mers:
MRKKNTFKLFFASML; RKKNTFKLFFASMLF; KKNTFKLFFASMLFV;
KNTFKLFFASMLFVM; NTFKLFFASMLFVMA; TFKLFFASMLFVMAC;
FKLFFASMLFVMACK; KLFFASMLFVMACKA; LFFASMLFVMACKAY;
FFASMLFVMACKAYV; FASMLFVMACKAYVE; ASMLFVMACKAYVEE;
SMLFVMACKAYVEEK; MLFVMACKAYVEEKK; LFVMACKAYVEEKKE;
FVMACKAYVEEKKEI; VMACKAYVEEKKEID; MACKAYVEEKKEIDS;
ACKAYVEEKKEIDSL; CKAYVEEKKEIDSLM; KAYVEEKKEIDSLME;
AYVEEKKEIDSLMED; YVEEKKEIDSLMEDV; VEEKKEIDSLMEDVL;
EEKKEIDSLMEDVLA; EKKEIDSLMEDVLAL; KKEIDSLMEDVLALV;
KEIDSLMEDVLALVN; EIDSLMEDVLALVND; IDSLMEDVLALVNDS;
DSLMEDVLALVNDSS; SLMEDVLALVNDSSG; LMEDVLALVNDSSGG;
MEDVLALVNDSSGGK; EDVLALVNDSSGGKF; DVLALVNDSSGGKFK;
VLALVNDSSGGKFKD; LALVNDSSGGKFKDY; ALVNDSSGGKFKDYK;
LVNDSSGGKFKDYKD; VNDSSGGKFKDYKDK; NDSSGGKFKDYKDKI;
DSSGGKFKDYKDKIN; SSGGKFKDYKDKINE; SGGKFKDYKDKINEL;
GGKFKDYKDKINELK; GKFKDYKDKINELKE; KFKDYKDKINELKEN;
FKDYKDKINELKENL; KDYKDKINELKENLK; DYKDKINELKENLKD;
YKDKINELKENLKDI; KDKINELKENLKDIG; DKINELKENLKDIGN;
KINELKENLKDIGNA; INELKENLKDIGNAE; NELKENLKDIGNAEL;
ELKENLKDIGNAELK; LKENLKDIGNAELKE; KENLKDIGNAELKEK;
ENLKDIGNAELKEKL; NLKDIGNAELKEKLL; LKDIGNAELKEKLLN;
KDIGNAELKEKLLNL; DIGNAELKEKLLNLQ; IGNAELKEKLLNLQN;
GNAELKEKLLNLQNS; NAELKEKLLNLQNSF; AELKEKLLNLQNSFQ;
ELKEKLLNLQNSFQD; LKEKLLNLQNSFQDK; KEKLLNLQNSFQDKL;
EKLLNLQNSFQDKLA; KLLNLQNSFQDKLAA; LLNLQNSFQDKLAAK;
LNLQNSFQDKLAAKL; NLQNSFQDKLAAKLA; LQNSFQDKLAAKLAA;
QNSFQDKLAAKLAAL; NSFQDKLAAKLAALK; SFQDKLAAKLAALKA;
FQDKLAAKLAALKAA; QDKLAAKLAALKAAK; DKLAAKLAALKAAKN;
KLAAKLAALKAAKNT; LAAKLAALKAAKNTT; AAKLAALKAAKNTTE;
AKLAALKAAKNTTEN; KLAALKAAKNTTENT; LAALKAAKNTTENTT;
AALKAAKNTTENTTD; ALKAAKNTTENTTDK; LKAAKNTTENTTDKD;
KAAKNTTENTTDKDQ; AAKNTTENTTDKDQD; AKNTTENTTDKDQDI;
KNTTENTTDKDQDIS; NTTENTTDKDQDISK; TTENTTDKDQDISKR;
TENTTDKDQDISKRK; ENTTDKDQDISKRKT; NTTDKDQDISKRKTW;
TTDKDQDISKRKTWS; TDKDQDISKRKTWSE; DKDQDISKRKTWSEA;
KDQDISKRKTWSEAK; DQDISKRKTWSEAKL; QDISKRKTWSEAKLV;
DISKRKTWSEAKLVG; ISKRKTWSEAKLVGV; SKRKTWSEAKLVGVT;
KRKTWSEAKLVGVTV; RKTWSEAKLVGVTVP; KTWSEAKLVGVTVPL;
TWSEAKLVGVTVPLL; WSEAKLVGVTVPLLG; SEAKLVGVTVPLLGS;
EAKLVGVTVPLLGSN; AKLVGVTVPLLGSNT; KLVGVTVPLLGSNTS;
LVGVTVPLLGSNTSG; VGVTVPLLGSNTSGN; GVTVPLLGSNTSGNG;
VTVPLLGSNTSGNGD; TVPLLGSNTSGNGDK; VPLLGSNTSGNGDKM;
PLLGSNTSGNGDKMS; LLGSNTSGNGDKMSK; LGSNTSGNGDKMSKN;
GSNTSGNGDKMSKNA; SNTSGNGDKMSKNAV; NTSGNGDKMSKNAVE;
TSGNGDKMSKNAVEQ; SGNGDKMSKNAVEQI; GNGDKMSKNAVEQID;

| | |
|---|---|
| | NGDKMSKNAVEQIDKV; GDKMSKNAVEQIDKVI; DKMSKNAVEQIDKVIK; KMSKNAVEQIDKVIKF; MSKNAVEQIDKVIKFL; SKNAVEQIDKVIKFLE; KNAVEQIDKVIKFLEE; NAVEQIDKVIKFLEEG; AVEQIDKVIKFLEEGT; VEQIDKVIKFLEEGTN; |
| SEQ ID NO:40<br>SEQ ID NO: 118633-119806 | 13 mers:<br>MKDNILKNNKLIA; KDNILKNNKLIAI; DNILKNNKLIAIF; NILKNNKLIAIFL; ILKNNKLIAIFLL; LKNNKLIAIFLLH; KNNKLIAIFLLHV; NNKLIAIFLLHVL; NKLIAIFLLHVLT; KLIAIFLLHVLTV; LIAIFLLHVLTVL; IAIFLLHVLTVLI; AIFLLHVLTVLIL; IFLLHVLTVLILI; FLLHVLTVLILIS; LLHVLTVLILISC; LHVLTVLILISCS; HVLTVLILISCSL; VLTVLILISCSLE; LTVLILISCSLEV; TVLILISCSLEVK; VLILISCSLEVKD; LILISCSLEVKDS; ILISCSLEVKDSN; LISCSLEVKDSNE; ISCSLEVKDSNES; SCSLEVKDSNESK; CSLEVKDSNESKK; SLEVKDSNESKKH; LEVKDSNESKKHK; EVKDSNESKKHKK; VKDSNESKKHKKE; KDSNESKKHKKEK; DSNESKKHKKEKR; SNESKKHKKEKRK; NESKKHKKEKRKG; ESKKHKKEKRKGK; SKKHKKEKRKGKV; KKHKKEKRKGKVE; KHKKEKRKGKVEN; HKKEKRKGKVENL; KKEKRKGKVENLL; KEKRKGKVENLLV; EKRKGKVENLLVA; KRKGKVENLLVAI; RKGKVENLLVAIN; KGKVENLLVAINN; GKVENLLVAINNL; KVENLLVAINNLK; VENLLVAINNLKN; ENLLVAINNLKNP; NLLVAINNLKNPT; LLVAINNLKNPTK; LVAINNLKNPTKP; VAINNLKNPTKPA; AINNLKNPTKPAA; INNLKNPTKPAAG; NNLKNPTKPAAGK; NLKNPTKPAAGKN; LKNPTKPAAGKNK; KNPTKPAAGKNKA; NPTKPAAGKNKAN; PTKPAAGKNKANS; TKPAAGKNKANSK; KPAAGKNKANSKA; PAAGKNKANSKAS; AAGKNKANSKASK; AGKNKANSKASKQ; GKNKANSKASKQK; KNKANSKASKQKN; NKANSKASKQKNN; KANSKASKQKNNP; ANSKASKQKNNPN; NSKASKQKNNPNA; SKASKQKNNPNAN; KASKQKNNPNANA; ASKQKNNPNANAN; SKQKNNPNANANN; KQKNNPNANANNA; QKNNPNANANNAP; KNNPNANANNAPK; NNPNANANNAPKK; NPNANANNAPKKI; PNANANNAPKKIL; NANANNAPKKILD; ANANNAPKKILDP; NANNAPKKILDPE; ANNAPKKILDPEV; NNAPKKILDPEVA; NAPKKILDPEVAK; APKKILDPEVAKL; PKKILDPEVAKLI; KKILDPEVAKLIQ; KILDPEVAKLIQK; ILDPEVAKLIQKI; LDPEVAKLIQKIL; DPEVAKLIQKILD; PEVAKLIQKILDR; EVAKLIQKILDRS; VAKLIQKILDRSE; AKLIQKILDRSEN; KLIQKILDRSENI; LIQKILDRSENII; IQKILDRSENIIQ; QKILDRSENIIQI; KILDRSENIIQIS; ILDRSENIIQISE; LDRSENIIQISEM; DRSENIIQISEMD; RSENIIQISEMDS; SENIIQISEMDSS; ENIIQISEMDSSR; NIIQISEMDSSRG; IIQISEMDSSRGE; IQISEMDSSRGEP; QISEMDSSRGEPN; ISEMDSSRGEPND; SEMDSSRGEPNDQ; EMDSSRGEPNDQF; MDSSRGEPNDQFG; DSSRGEPNDQFGM; SSRGEPNDQFGMR; SRGEPNDQFGMRA; RGEPNDQFGMRAE; GEPNDQFGMRAEI; EPNDQFGMRAEIF; PNDQFGMRAEIFS; NDQFGMRAEIFSK; DQFGMRAEIFSKI; QFGMRAEIFSKIF; FGMRAEIFSKIFF; GMRAEIFSKIFFN; |

Fig. 33 continued

| | | |
|---|---|---|
| MRAELYSKIFFNA; | RAELYSKIFFNAN; | AELYSKIFFNAKS; |
| ELYSKIFFNAKST; | YSKIFFNAKSTV; | SKIFFNAKSTVH; |
| KIFFNAKSTVHF; | IFFNAKSTVHFD; | FFNAKSTVHFDS; |
| FNAKSTVHFDSH; | NAKSTVHFDSHE; | AKSTVHFDSHEY; |
| KSTVHFDSHEYT; | STVHFDSHEYTF; | TVHFDSHEYTFF; |
| VHFDSHEYTFFR; | HFDSHEYTFFRR; | FDSHEYTFFRRM; |
| DSHEYTFFRRML; | SHEYTFFRRMLY; | HEYTFFRRMLYT; |
| EYTFFRRMLYTS; | YTFFRRMLYTSL; | TFFRRMLYTSLN; |
| FFRRMLYTSLNF; | FRRMLYTSLNFN; | RRMLYTSLNFNE; |
| RMLYTSLNFNEG; | MLYTSLNFNEGK; | LYTSLNFNEGKF; |
| YTSLNFNEGKFN; | TSLNFNEGKFNL; | SLNFNEGKFNLG; |
| LNFNEGKFNLGQ; | NFNEGKFNLGQL; | FNEGKFNLGQIL; |
| NEGKFNLGQILS; | EGKFNLGQILSK; | GKFNLGQILSKL; |
| KFNLGQILSKLS; | FNLGQILSKLSQ; | NLGQILSKLSQD; |
| LGQILSKLSQDS; | GQILSKLSQDSN; | QILSKLSQDSNY; |
| ILSKLSQDSNYR; | LSKLSQDSNYRG; | SKLSQDSNYRGL; |
| KLSQDSNYRGLV; | LSQDSNYRGLVK; | SQDSNYRGLVKE; |
| QDSNYRGLVKET; | DSNYRGLVKETL; | SNYRGLVKETLL; |
| NYRGLVKETLLR; | YRGLVKETLLRG; | RGLVKETLLRGF; |
| GLVKETLLRGFS; | LVKETLLRGFST; | VKETLLRGFSTQ; |
| KETLLRGFSTQL; | ETLLRGFSTQLA; | TLLRGFSTQLAM; |
| LLRGFSTQLAME; | LRGFSTQLAMEE; | RGFSTQLAMEEI; |
| GFSTQLAMEEIS; | FSTQLAMEEISA; | STQLAMEEISAK; |
| TQLAMEEISAKI; | QLAMEEISAKIL; | LAMEEISAKILV; |
| AMEEISAKILVK; | MEEISAKILVKD; | EEISAKILVKDK; |
| EISAKILVKDKL; | ISAKILVKDKLQ; | SAKILVKDKLQQ; |
| AKILVKDKLQQL; | KILVKDKLQQLN; | ILVKDKLQQLNK; |
| LVKDKLQQLNKP; | VKDKLQQLNKPN; | KDKLQQLNKPNL; |
| DKLQQLNKPNLE; | KLQQLNKPNLET; | LQQLNKPNLETL; |
| QQLNKPNLETLY; | QLNKPNLETLYN; | LNKPNLETLYND; |
| NKPNLETLYNDF; | KPNLETLYNDFF; | PNLETLYNDFFK; |
| NLETLYNDFFKL; | LETLYNDFFKLT; | ETLYNDFFKLTS; |
| TLYNDFFKLTSL; | LYNDFFKLTSLK; | YNDFFKLTSLKE; |
| NDFFKLTSLKEK; | DFFKLTSLKEKW; | FFKLTSLKEKWL; |
| FKLTSLKEKWLK; | KLTSLKEKWLKD; | LTSLKEKWLKDT; |
| TSLKEKWLKDTD; | SLKEKWLKDTDD; | LKEKWLKDTDDL; |
| KEKWLKDTDDLI; | EKWLKDTDDLID; | KWLKDTDDLIDE; |
| WLKDTDDLIDEY; | LKDTDDLIDEYN; | KDTDDLIDEYNT; |
| DTDDLIDEYNTP; | TDDLIDEYNTPD; | DDLIDEYNTPDL; |
| DLIDEYNTPDLQ; | LIDEYNTPDLQT; | IDEYNTPDLQTD; |
| DEYNTPDLQTDV; | EYNTPDLQTDVS; | YNTPDLQTDVSK; |
| NTPDLQTDVSKL; | TPDLQTDVSKLN; | PDLQTDVSKLND; |
| DLQTDVSKLNDT; | LQTDVSKLNDTL; | QTDVSKLNDTLR; |
| TDVSKLNDTLRS; | DVSKLNDTLRSK; | VSKLNDTLRSKN; |
| SKLNDTLRSKNS; | KLNDTLRSKNSR; | LNDTLRSKNSRA; |
| NDTLRSKNSRAQ; | DTLRSKNSRAQF; | TLRSKNSRAQFA; |
| LRSKNSRAQFAN; | RSKNSRAQFANI; | SKNSRAQFANIH; |
| KNSRAQFANIHD; | NSRAQFANIHDI; | SRAQFANIHDIL; |
| RAQFANIHDILL; | AQFANIHDILLD; | QFANIHDILLDL; |
| FANIHDILLDLV; |

Fig. 33 continued

ANLHDILLDLVNG; KLHDILLDLVKTT; LHDLLLDLVKTTT;
DLTLDLVNGTTK; DLLDLVKTTNT; LLDLVKTTNTL;
LLDLVKTTNTLA; LDLVKTTNTLAP; DLVKTTNTLAPT;
LVKTTNTLAPTQ;

14 mers:
MKDNIIKNKLIAT; KDKILKNKLIATF; DNILKNKLIATFL;
NIIKNKLIATFLL; IKNKLIATFLLH; KNKLIATFLLHV;
KNKLIATFLLHVL; NKLIATFLLHVLT; KLIATFLLHVLTV;
LIATFLLHVLTVL; IATFLLHVLTVLT; ATFLLHVLTVLTL;
TFLLHVLTVLTLT; FLLHVLTVLTLTS; LLHVLTVLTLTSC;
LHVLTVLTLTSCS; HVLTVLTLTSCSL; VLTVLTLTSCSLE;
VLTVLTLTSCSLEV; LTVLTLTSCSLEVK; TVLTLTSCSLEVKD;
VLTLTSCSLEVKDS; LTLTSCSLEVKDSN; TLTSCSLEVKDSNE;
LTSCSLEVKDSNES; TSCSLEVKDSNESK; SCSLEVKDSNESKK;
CSLEVKDSNESKKH; SLEVKDSNESKKHK; LEVKDSNESKKHKK;
EVKDSNESKKHKKE; VKDSNESKKHKKEK; KDSNESKKHKKEKR;
DSNESKKHKKEKRK; SNESKKHKKEKRKG; NESKKHKKEKRKGK;
ESKKHKKEKRKGKV; SKKHKKEKRKGKVE; KHKKEKRKGKVEN;
KHKKEKRKGKVENL; HKKEKRKGKVENLL; KKEKRKGKVENLLV;
KEKRKGKVENLLVA; EKRKGKVENLLVAI; KRKGKVENLLVAIN;
RKGKVENLLVAINK; KGKVENLLVAINKL; GKVENLLVAINKLK;
KVENLLVAIKKLKN; VENLLVAINKLKKP; ENLLVAIKNLKPT;
NLLVAINKLKKPTK; LLVAINKLKPTKP; LVAINKLKPTKPA;
VAINKLKPTKPAA; AINKLKPTKPAAG; INKLKPTKPAAGK;
NKLKPTKPAAGKN; NLKPTKPAAGKKK; LKPTKPAAGKNKA;
KPTKPAAGKKKAN; PTKPAAGKKKAKS; TKPAAGKKKANSK;
TKPAAGKKANSKA; KPAAGKKAKSKAS; PAAGKKANSKASK;
AAGKKANSKASKQ; AGKKAKSKASKQK; GKKANSKASKQKN;
KNKAKSKASKQKN; NKANSKASKQKNP; KAKSKASKQKKPN;
ANSKASKQKKPNA; NSKASKQKNPNAK; SKASKQKNPKAKA;
KASKQKNPKAKAN; ASKQKNPNANAKK; SKQKNPKANANKA;
KQKNPNANANNAP; QKNPNAKANKAKK; KNKPNANANKAPKK;
NKPNANAKNAPKKI; NPKANANNAPKKIL; PNANANNAPKKILD;
NAKANNAPKKTDP; ANANKAPKKILDP; NANNAPKKILDPEV;
ANKAPKKTLDPEVA; NKAPKKTLDPEVAK; NAPKKTLDPEVAKL;
APKKTLDPEVAKLT; PKKTLDPEVAKLTQ; KKTLDPEVAKLTQK;
KILDPEVAKLTQKI; ILDPEVAKLTQKIL; LDPEVAKLTQKILD;
DPEVAKLTQKTLER; PEVAKLTQKTLDRS; EVAKLTQKTLDRSE;
VAKLTQKTLDRSEN; AKLTQKTLDRSENI; KLTQKTLDRSENTT;
LTQKLDRSENTTQ; TQKLDRSENTTQI; QKLDRSENLLQIS;
KLLDRSENLLQISE; LLDRSENLLQISEK; LDRSENLLQISEND;
DRSENTTQTSEMDS; RSENTTQTSEMDSS; SENTTQTSEMDSSR;
ENTTQTSEMDSSRG; NTTQTSEMDSSRGE; TTQTSEMDSSRGEP;
TQTSEMDSSRGEPN; QTSEMDSSRGEPND; TSEMDSSRGEPNDQ;
SEMDSSRGEPNDQF; EMDSSRGEPNDQFG; MDSSRGEPNDQFGM;
DSSRGEPNDQFGMR; SSRGEPNDQFGMRA; SRGEPNDQFGMRAE;
RGEPNDQFGMRAEI; GEPNDQFGMRAELF; EPNDQFGMRAELFS;
PNDQFGMRAELFSK; NDQFGMRAELFSKI; DQFGMRAELFSKIF;
QFGMRAELFSKIFF; FGMRAELFSKIFFA; GMRAELFSKIFFAN;
MRAELFSKIFFAN; RAELFSKIFFNAKS; AELFSKIFFNAKST;

```
16 mers:
MKDNIKKNKLTATFL;   KDNIKKNKLTATFLL;   DNIKKNKLTATFLLH;
NIKKNKLTATFLLHV;   IKNKKLTATFLLHVL;   KNKKLTATFLLHVLT;
KNKLTATFLLHVLTV;   NKLTATFLLHVLTVL;   KLTATFLLHVLTVLI;
KLTATFLLHVLTVLIT;  LTATFLLHVLTVLIT;   TATFLLHVLTVLITS;
ATFLLHVLTVLITSC;   TFLLHVLTVLITSCS;   FLLHVLTVLITSCSL;
LLHVLTVLITSCSLE;   LHVLTVLITSCSLEV;   HVLTVLITSCSLEVK;
VLTVLITSCSLEVKD;   LTVLITSCSLEVKDS;   TVLITSCSLEVKDSN;
VLITSCSLEVKDSNE;   LITSCSLEVKDSNES;   ITSCSLEVKDSNESK;
TSCSLEVKDSNESKK;   SCSLEVKDSNESKKH;   CSLEVKDSNESKKHK;
SLEVKDSNESKKHKK;   LEVKDSNESKKHKKE;   EVKDSNESKKHKKEK;
VKDSNESKKHKKEKR;   KDSNESKKHKKEKRK;   DSNESKKHKKEKRKG;
SNESKKHKKEKRKGK;   NESKKHKKEKRKGKV;   ESKKHKKEKRKGKVE;
SKKHKKEKRKGKVEN;   KKHKKEKRKGKVENL;   KHKKEKRKGKVENLL;
HKKEKRKGKVENLLV;   KKEKRKGKVENLLVA;   KEKRKGKVENLLVAI;
EKRKGKVENLLVAIN;   KRKGKVENLLVAINN;   RKGKVENLLVAINNL;
KGKVENLLVAINNLK;   GKVENLLVAINNLKS;   KVENLLVAINNLKSP;
VENLLVAINNLKSPT;   ENLLVAINNLKSPTK;   NLLVAINNLKSPTKP;
LLVAINNLKSPTKPA;   LVAINNLKSPTKPAA;   VAINNLKSPTKPAAG;
AINNLKSPTKPAAGK;   INNLKSPTKPAAGKN;   NNLKSPTKPAAGKNK;
NLKSPTKPAAGKNKA;   LKSPTKPAAGKNKAN;   KSPTKPAAGKNKANS;
SPTKPAAGKNKANSK;   PTKPAAGKNKANSKA;   TKPAAGKNKANSKAS;
KPAAGKNKANSKASK;   PAAGKNKANSKASKQ;   AAGKNKANSKASKQK;
AGKNKANSKASKQKN;   GKNKANSKASKQKNP;   KNKANSKASKQKNPN;
NKANSKASKQKNPNA;   KANSKASKQKNPNAN;   ANSKASKQKNPNANA;
NSKASKQKNPNANAN;   SKASKQKNPNANANK;   KASKQKNPNANANKK;
ASKQKNPNANANKAP;   SKQKNPNANANKAPK;   KQKNPNANANKAPKK;
QKNPNANANKAPKKT;   KNPNANANKAPKKTL;   NPNANANKAPKKTLD;
PNANANKAPKKTLDP;   NANANKAPKKTLDPE;   ANANKAPKKTLDPEV;
NANKAPKKTLDPEVA;   ANKAPKKTLDPEVAK;   NKAPKKTLDPEVAKL;
KAPKKTLDPEVAKLT;   APKKTLDPEVAKLTQ;   PKKTLDPEVAKLTQK;
KKTLDPEVAKLTQKT;   KTLDPEVAKLTQKTL;   TLDPEVAKLTQKTLD;
LDPEVAKLTQKTLDR;   DPEVAKLTQKTLDRS;   PEVAKLTQKTLDRSE;
EVAKLTQKTLDRSEN;   VAKLTQKTLDRSENT;   AKLTQKTLDRSENTT;
KLTQKTLDRSENTTQ;   LTQKTLDRSENTTQT;   TQKTLDRSENTTQTS;
QKTLDRSENTTQTSF;   KTLDRSENTTQTSFM;   TLDRSENTTQTSFMD;
LDRSENTTQTSFMDS;   DRSENTTQTSFMDSS;   RSENTTQTSFMDSSR;
SENTTQTSFMDSSRG;   ENTTQTSFMDSSRGE;   NTTQTSFMDSSRGEP;
TTQTSFMDSSRGEPN;   TQTSFMDSSRGEPND;   QTSFMDSSRGEPNDQ;
TSFMDSSRGEPNDQF;   SFMDSSRGEPNDQFG;   FMDSSRGEPNDQFGM;
MDSSRGEPNDQFGMR;   DSSRGEPNDQFGMRA;   SSRGEPNDQFGMRAE;
SRGEPNDQFGMRAEF;   RGEPNDQFGMRAEFS;   GEPNDQFGMRAEFSK;
EPNDQFGMRAEFSKI;   PNDQFGMRAEFSKIF;   NDQFGMRAEFSKIFF;
DQFGMRAEFSKIFFN;   QFGMRAEFSKIFFNA;   FGMRAEFSKIFFNAN;
GMRAEFSKIFFNANS;   MRAEFSKIFFNANST;   RAEFSKIFFNANSTV;
AEFSKIFFNANSTVH;   EFSKIFFNANSTVHF;   FSKIFFNANSTVHFD;
SKIFFNANSTVHFDS;   KIFFNANSTVHFDSH;   IFFNANSTVHFDSHE;
FFNANSTVHFDSHEY;   FNANSTVHFDSHEYT;   NANSTVHFDSHEYTE;
ANSTVHFDSHEYTER;   NSTVHFDSHEYTERR;   STVHFDSHEYTERRM;
```

Fig. 33 continued

| | |
|---|---|
| | TVHFDSHEYTEERRML; VHFDSHEYTEERRMLY; HFDSHEYTEERRMLYT; FDSHEYTEERRMLYTS; DSHEYTEERRMLYTSL; SHEYTEERRMLYTSLN; HEYTEERRMLYTSLNF; EYTEERRMLYTSLNFN; YTEERRMLYTSLNFNE; TEERRMLYTSLNFNEG; EERRMLYTSLNFNEGK; ERRMLYTSLNFNEGKI; RRMLYTSLNFNEGKIF; RMLYTSLNFNEGKIFN; MLYTSLNFNEGKIFNL; LYTSLNFNEGKIFNLG; YTSLNFNEGKIFNLGQ; TSLNFNEGKIFNLGQI; SLNFNEGKIFNLGQIL; LNFNEGKIFNLGQILS; NFNEGKIFNLGQILSK; FNEGKIFNLGQILSKL; NEGKIFNLGQILSKLS; EGKIFNLGQILSKLSQ; GKIFNLGQILSKLSQD; KIFNLGQILSKLSQDS; IFNLGQILSKLSQDSN; FNLGQILSKLSQDSNY; NLGQILSKLSQDSNYR; LGQILSKLSQDSNYRG; GQILSKLSQDSNYRGL; QILSKLSQDSNYRGLV; ILSKLSQDSNYRGLVK; LSKLSQDSNYRGLVKE; SKLSQDSNYRGLVKET; KLSQDSNYRGLVKETL; LSQDSNYRGLVKETLI; SQDSNYRGLVKETLIN; QDSNYRGLVKETLINR; DSNYRGLVKETLINRG; SNYRGLVKETLINRGF; NYRGLVKETLINRGFS; YRGLVKETLINRGFSI; RGLVKETLINRGFSIQ; GLVKETLINRGFSIQL; LVKETLINRGFSIQLA; VKETLINRGFSIQLAM; KETLINRGFSIQLAME; ETLINRGFSIQLAMEE; TLINRGFSIQLAMEEI; LINRGFSIQLAMEEIS; INRGFSIQLAMEEISA; NRGFSIQLAMEEISAK; RGFSIQLAMEEISAKI; GFSIQLAMEEISAKIL; FSIQLAMEEISAKILN; SIQLAMEEISAKILNV; IQLAMEEISAKILNVK; QLAMEEISAKILNVKD; LAMEEISAKILNVKDK; AMEEISAKILNVKDKL; MEEISAKILNVKDKLQ; EEISAKILNVKDKLQQ; EISAKILNVKDKLQQL; ISAKILNVKDKLQQLN; SAKILNVKDKLQQLNK; AKILNVKDKLQQLNKP; KILNVKDKLQQLNKPN; ILNVKDKLQQLNKPNL; LNVKDKLQQLNKPNLE; NVKDKLQQLNKPNLET; VKDKLQQLNKPNLETL; KDKLQQLNKPNLETLY; DKLQQLNKPNLETLYN; KLQQLNKPNLETLYND; LQQLNKPNLETLYNDF; QQLNKPNLETLYNDFE; QLNKPNLETLYNDFEK; LNKPNLETLYNDFEKL; NKPNLETLYNDFEKLT; KPNLETLYNDFEKLTS; PNLETLYNDFEKLTSL; NLETLYNDFEKLTSLK; LETLYNDFEKLTSLKE; ETLYNDFEKLTSLKEK; TLYNDFEKLTSLKEKW; LYNDFEKLTSLKEKWL; YNDFEKLTSLKEKWLK; NDFEKLTSLKEKWLKD; DFEKLTSLKEKWLKDT; FEKLTSLKEKWLKDTD; EKLTSLKEKWLKDTDD; KLTSLKEKWLKDTDDL; LTSLKEKWLKDTDDLI; TSLKEKWLKDTDDLID; SLKEKWLKDTDDLIDE; LKEKWLKDTDDLIDEY; KEKWLKDTDDLIDEYN; EKWLKDTDDLIDEYNT; KWLKDTDDLIDEYNTN; WLKDTDDLIDEYNTNP; LKDTDDLIDEYNTNPD; KDTDDLIDEYNTNPDL; DTDDLIDEYNTNPDLQ; TDDLIDEYNTNPDLQT; DDLIDEYNTNPDLQTD; DLIDEYNTNPDLQTDV; LIDEYNTNPDLQTDVS; IDEYNTNPDLQTDVSK; DEYNTNPDLQTDVSKL; EYNTNPDLQTDVSKLN; YNTNPDLQTDVSKLND; NTNPDLQTDVSKLNDT; TNPDLQTDVSKLNDTL; NPDLQTDVSKLNDTLR; PDLQTDVSKLNDTLRS; DLQTDVSKLNDTLRSK; LQTDVSKLNDTLRSKN; QTDVSKLNDTLRSKNS; TDVSKLNDTLRSKNSR; DVSKLNDTLRSKNSRA; VSKLNDTLRSKNSRAQ; SKLNDTLRSKNSRAQF; KLNDTLRSKNSRAQFA; LNDTLRSKNSRAQFAN; NDTLRSKNSRAQFANI; DTLRSKNSRAQFANIH; TLRSKNSRAQFANIHD; LRSKNSRAQFANIHDI; RSKNSRAQFANIHDII; SKNSRAQFANIHDIIL; KNSRAQFANIHDIILD; NSRAQFANIHDIILDL; SRAQFANIHDIILDLV; RAQFANIHDIILDLVN; AQFANIHDIILDLVNT; QFANIHDIILDLVNTT; FANIHDIILDLVNTTT; ANIHDIILDLVNTTTN; NIHDIILDLVNTTTNI; IHDIILDLVNTTTNIL; HDIILDLVNTTTNILA; DIILDLVNTTTNILAP; IILDLVNTTTNILAPI; ILDLVNTTTNILAPIQ; |
| SEQ ID NO:41 | |

Fig. 33 continued

| SEQ ID NO: | 13 mers: |
|---|---|
| 119807-121024 | MKNNKLIAIFLLH; KNNKLIAIFLLHI; NNKLIAIFLLHIL; NKLIAIFLLHILT; KLIAIFLLHILTG; LIAIFLLHILTGL; IAIFLLHILTGLI; AIFLLHILTGLIL; IFLLHILTGLILL; FLLHILTGLILLS; LLHILTGLILLSC; LHILTGLILLSCS; HILTGLILLSCSL; ILTGLILLSCSLE; LTGLILLSCSLEV; TGLILLSCSLEVN; GLILLSCSLEVNQ; LILLSCSLEVNQD; ILLSCSLEVNQDD; LLSCSLEVNQDDN; LSCSLEVNQDDNQ; SCSLEVNQDDNQE; CSLEVNQDDNQEK; SLEVNQDDNQEKQ; LEVNQDDNQEKQK; EVNQDDNQEKQKK; VNQDDNQEKQKKA; NQDDNQEKQKKAK; QDDNQEKQKKAKT; DDNQEKQKKAKTK; DNQEKQKKAKTKT; NQEKQKKAKTKTS; QEKQKKAKTKTSK; EKQKKAKTKTSKS; KQKKAKTKTSKSE; QKKAKTKTSKSEN; KKAKTKTSKSENN; KAKTKTSKSENNS; AKTKTSKSENNSS; KTKTSKSENNSSK; TKTSKSENNSSKM; KTSKSENNSSKMK; TSKSENNSSKMKK; SKSENNSSKMKKL; KSENNSSKMKKLS; SENNSSKMKKLSK; ENNSSKMKKLSKN; NNSSKMKKLSKNA; NSSKMKKLSKNAK; SSKMKKLSKNAKN; SKMKKLSKNAKNK; KMKKLSKNAKNKK; MKKLSKNAKNKKP; KKLSKNAKNKKPT; KLSKNAKNKKPTV; LSKNAKNKKPTVD; SKNAKNKKPTVDN; KNAKNKKPTVDNL; NAKNKKPTVDNLL; AKNKKPTVDNLLV; KNKKPTVDNLLVA; NKKPTVDNLLVAI; KKPTVDNLLVAIN; KPTVDNLLVAINT; PTVDNLLVAINTL; TVDNLLVAINTLK; VDNLLVAINTLKN; DNLLVAINTLKNP; NLLVAINTLKNPP; LLVAINTLKNPPK; LVAINTLKNPPKT; VAINTLKNPPKTA; AINTLKNPPKTAG; INTLKNPPKTAGK; NTLKNPPKTAGKN; TLKNPPKTAGKNK; LKNPPKTAGKNKS; KNPPKTAGKNKSN; NPPKTAGKNKSNS; PPKTAGKNKSNSA; PKTAGKNKSNSAA; KTAGKNKSNSAAA; TAGKNKSNSAAAL; AGKNKSNSAAALK; GKNKSNSAAALKQ; KNKSNSAAALKQP; NKSNSAAALKQPN; KSNSAAALKQPNN; SNSAAALKQPNNA; NSAAALKQPNNAN; SAAALKQPNNANA; AAALKQPNNANAL; AALKQPNNANALK; ALKQPNNANALKQ; LKQPNNANALKQI; KQPNNANALKQID; QPNNANALKQIDP; PNNANALKQIDPE; NNANALKQIDPEA; NANALKQIDPEAK; ANALKQIDPEAKE; NALKQIDPEAKEL; ALKQIDPEAKELI; LKQIDPEAKELIQ; KQIDPEAKELIQK; QIDPEAKELIQKI; IDPEAKELIQKIL; DPEAKELIQKILE; PEAKELIQKILER; EAKELIQKILERS; AKELIQKILERSE; KELIQKILERSED; ELIQKILERSEDI; LIQKILERSEDIV; IQKILERSEDIVQ; QKILERSEDIVQI; KILERSEDIVQIS; ILERSEDIVQISE; LERSEDIVQISEI; ERSEDIVQISEID; RSEDIVQISEIDA; SEDIVQISEIDAN; EDIVQISEIDANK; DIVQISEIDANKG; IVQISEIDANKGE; VQISEIDANKGEP; QISEIDANKGEPD; ISEIDANKGEPDD; SEIDANKGEPDDQ; EIDANKGEPDDQF; IDANKGEPDDQFE; DANKGEPDDQFEM; ANKGEPDDQFEMK; NKGEPDDQFEMKA; KGEPDDQFEMKAE; GEPDDQFEMKAEI; EPDDQFEMKAEIF; PDDQFEMKAEIFS; DDQFEMKAEIFSK; DQFEMKAEIFSKI; QFEMKAEIFSKIF; FEMKAEIFSKIFF; EMKAEIFSKIFFN; MKAEIFSKIFFNA; KAEIFSKIFFNAG; AEIFSKIFFNAGS; EIFSKIFFNAGST; IFSKIFFNAGSTV; FSKIFFNAGSTVT; SKIFFNAGSTVTF; |

Fig. 33 continued

KLPPKAGSTVTFD; LPPKAGSTVTFDD; PPKAGSTVTFDDK;
PKAGSTVTFDDKE; KAGSTVTFDDKEY; AGSTVTFDDKEYV;
GSTVTFDDKEYVK; STVTFDDKEYVNE; TVTFDDKEYVNER;
VTFDDKEYVNERR; TFDDKEYVNERRI; FDDKEYVNERRIL;
DDKEYVNERRILY; DKEYVNERRILYT; KEYVNERRILYTS;
EYVNERRILYTSL; YVNERRILYTSLN; VNERRILYTSLNF;
NERRILYTSLNFN; ERRILYTSLNFNE; RRILYTSLNFNEK;
RILYTSLNFNEKK; ILYTSLNFNEKKI; LYTSLNFNEKKIL;
YTSLNFNEKKILN; TSLNFNEKKILNL; SLNFNEKKILNLG;
LNFNEKKILNLGK; NFNEKKILNLGKT; FNEKKILNLGKTL;
NEKKILNLGKTLS; EKKILNLGKTLSK; KKILNLGKTLSKL;
KILNLGKTLSKLS; ILNLGKTLSKLSQ; LNLGKTLSKLSQD;
NLGKTLSKLSQDS; LGKTLSKLSQDSN; GKTLSKLSQDSNY;
KTLSKLSQDSNYR; TLSKLSQDSNYRS; LSKLSQDSNYRSL;
SKLSQDSNYRSLV; KLSQDSNYRSLVK; LSQDSNYRSLVKE;
SQDSNYRSLVKEL; QDSNYRSLVKELL; DSNYRSLVKELLI;
SNYRSLVKELLIN; NYRSLVKELLINR; YRSLVKELLINRG;
RSLVKELLINRGF; SLVKELLINRGFS; LVKELLINRGFST;
VKELLINRGFSTQ; KELLINRGFSTQL; ELLINRGFSTQLA;
LLINRGFSTQLAI; LINRGFSTQLAIE; INRGFSTQLAIEE;
NRGFSTQLAIEEI; RGFSTQLAIEEIS; GFSTQLAIEEISL;
FSTQLAIEEISLR; STQLAIEEISLRT; TQLAIEEISLRTL;
QLAIEEISLRTLN; LAIEEISLRTLNV; AIEEISLRTLNVK;
IEEISLRTLNVKD; EEISLRTLNVKDK; EISLRTLNVKDKI;
ISLRTLNVKDKIQ; SLRTLNVKDKIQH; LRTLNVKDKIQHL;
RTLNVKDKIQHLK; TLNVKDKIQHLNK; LNVKDKIQHLNKP;
NVKDKIQHLNKPN; VKDKIQHLNKPNL; KDKIQHLNKPNLK;
DKIQHLNKPNLKT; KIQHLNKPNLKTL; IQHLNKPNLKTLY;
QHLNKPNLKTLYH; HLNKPNLKTLYHD; LNKPNLKTLYHDF;
NKPNLKTLYHDFK; KPNLKTLYHDFNK; PNLKTLYHDFNKL;
NLKTLYHDFNKLI; LKTLYHDFNKLIP; KTLYHDFNKLIPL;
TLYHDFNKLIPLK; LYHDFNKLIPLKE; YHDFNKLIPLKEK;
HDFNKLIPLKEKW; DFNKLIPLKEKWL; FNKLIPLKEKWLK;
NKLIPLKEKWLKD; KLIPLKEKWLKDV; LIPLKEKWLKDVD;
IPLKEKWLKDVDD; PLKEKWLKDVDDT; LKEKWLKDVDDTT;
KEKWLKDVDDTTK; EKWLKDVDDTTKD; KWLKDVDDTTKDY;
WLKDVDDTTKDYN; LKDVDDTTKDYNA; KDVDDTTKDYNAN;
DVDDTTKDYNANP; VDDTTKDYNANPE; DDTTKDYNANPEL;
DTTKDYNANPELR; TTKDYNANPELRT; TKDYNANPELRTD;
KDYNANPELRTDI; DYNANPELRTDIS; YNANPELRTDISK;
NANPELRTDISKL; ANPELRTDISKLN; NPELRTDISKLND;
PELRTDISKLNDY; ELRTDISKLNDYI; LRTDISKLNDYII;
RTDISKLNDYIIS; TDISKLNDYIISK; DISKLNDYIISKN;
ISKLNDYIISKNS; SKLNDYIISKNSK; KLNDYIISKNSKA;
LNDYIISKNSKAQ; NDYIISKNSKAQF; DYIISKNSKAQFT;
YIISKNSKAQFTD; IISKNSKAQFTDI; ISKNSKAQFTDIH;
SKNSKAQFTDIHN; KNSKAQFTDIHNI; NSKAQFTDIHNII;
SKAQFTDIHNIIL; KAQFTDIHNIILN; AQFTDIHNIILNL;
QFTDIHNIILNLI; FTDIHNIILNLIN; TDIHNIILNLINT;
DIHNIILNLINTT; IHNIILNLINTTK; HNIILNLINTTKT;
NIILNLINTTKTI; IILNLINTTKTIA; ILNLINTTKTIAA;

| | YIISKNSKAQFTDIHN; IISKNSKAQFTDIHNI; ISKNSKAQFTDIHNII; SKNSKAQFTDIHNIIL; KNSKAQFTDIHNIILN; NSKAQFTDIHNIILNL; SKAQFTDIHNIILNLI; KAQFTDIHNIILNLIN; AQFTDIHNIILNLINT; QFTDIHNIILNLINTT; FTDIHNIILNLINTTT; TDIHNIILNLINTTTN; DIHNIILNLINTTTNI; IHNIILNLINTTTNIL; HNIILNLINTTTNILA; NIILNLINTTTNILAP; IILNLINTTTNILAPI; ILNLINTTTNILAPIQ; |
|---|---|
| SEQ ID NO:42 SEQ ID NO: 121025-122410 | 13 mers: MKKVKSKYLALGL; KKVKSKYLALGLL; KVKSKYLALGLLF; VKSKYLALGLLFG; KSKYLALGLLFGF; SKYLALGLLFGFI; KYLALGLLFGFIS; YLALGLLFGFISC; LALGLLFGFISCD; ALGLLFGFISCDL; LGLLFGFISCDLF; GLLFGFISCDLFI; LLFGFISCDLFIR; LFGFISCDLFIRY; FGFISCDLFIRYE; GFISCDLFIRYEM; FISCDLFIRYEMK; ISCDLFIRYEMKE; SCDLFIRYEMKEE; CDLFIRYEMKEES; DLFIRYEMKEESP; LFIRYEMKEESPG; FIRYEMKEESPGL; IRYEMKEESPGLF; RYEMKEESPGLFD; YEMKEESPGLFDK; EMKEESPGLFDKG; MKEESPGLFDKGN; KEESPGLFDKGNS; EESPGLFDKGNSI; ESPGLFDKGNSIL; SPGLFDKGNSILE; PGLFDKGNSILET; GLFDKGNSILETS; LFDKGNSILETSE; FDKGNSILETSEE; DKGNSILETSEES; KGNSILETSEESI; GNSILETSEESIK; NSILETSEESIKK; SILETSEESIKKP; ILETSEESIKKPM; LETSEESIKKPMN; ETSEESIKKPMNK; TSEESIKKPMNKK; SEESIKKPMNKKG; EESIKKPMNKKGK; ESIKKPMNKKGKG; SIKKPMNKKGKGK; IKKPMNKKGKGKI; KKPMNKKGKGKIA; KPMNKKGKGKIAR; PMNKKGKGKIARK; MNKKGKGKIARKK; NKKGKGKIARKKG; KKGKGKIARKKGK; KGKGKIARKKGKS; GKGKIARKKGKSK; KGKIARKKGKSKV; GKIARKKGKSKVS; KIARKKGKSKVSR; IARKKGKSKVSRK; ARKKGKSKVSRKE; RKKGKSKVSRKEP; KKGKSKVSRKEPY; KGKSKVSRKEPYI; GKSKVSRKEPYIH; KSKVSRKEPYIHS; SKVSRKEPYIHSL; KVSRKEPYIHSLK; VSRKEPYIHSLKR; SRKEPYIHSLKRD; RKEPYIHSLKRDS; KEPYIHSLKRDSA; EPYIHSLKRDSAN; PYIHSLKRDSANK; YIHSLKRDSANKS; IHSLKRDSANKSN; HSLKRDSANKSNF; SLKRDSANKSNFL; LKRDSANKSNFLQ; KRDSANKSNFLQK; RDSANKSNFLQKN; DSANKSNFLQKNV; SANKSNFLQKNVI; ANKSNFLQKNVIL; NKSNFLQKNVILE; KSNFLQKNVILEE; SNFLQKNVILEEE; NFLQKNVILEEES; FLQKNVILEEESL; LQKNVILEEESLK; QKNVILEEESLKT; KNVILEEESLKTE; NVILEEESLKTEL; VILEEESLKTELL; ILEEESLKTELLK; LEEESLKTELLKE; EEESLKTELLKEQ; EESLKTELLKEQS; ESLKTELLKEQSE; SLKTELLKEQSET; LKTELLKEQSETR; KTELLKEQSETRK; TELLKEQSETRKE; ELLKEQSETRKEK; LLKEQSETRKEKI; LKEQSETRKEKIQ; KEQSETRKEKIQK; EQSETRKEKIQKQ; QSETRKEKIQKQQ; SETRKEKIQKQQD; ETRKEKIQKQQDE; TRKEKIQKQQDEY; RKEKIQKQQDEYK; KEKIQKQQDEYKG; EKIQKQQDEYKGM; KIQKQQDEYKGMT; IQKQQDEYKGMTQ; QKQQDEYKGMTQG; KQQDEYKGMTQGS; QQDEYKGMTQGSL; QDEYKGMTQGSLN; DEYKGMTQGSLNS; EYKGMTQGSLNSL; YKGMTQGSLNSLS; |

KTLKYLQVSVKT; TLLKYLQVSVKTA; LLNYLQVSVKTAA;
LNYLQVSVKTAAN; NYLQVSVKTAANF; YLQVSVKTAANFV;
LQVSVKTAANFVY; QVSVKTAANFVYI; VSVKTAANFVYIN;
SVKTAANFVYIND; VKTAANFVYINDT; KTAANFVYINDTH;
TAANFVYINDTHA; AANFVYINDTHAK; ANFVYINDTHAKR;
NFVYINDTHAKRK; FVYINDTHAKRKL; VYINDTHAKRKLE;
YINDTHAKRKLEN; INDTHAKRKLENT; NDTHAKRKL

ESLKRDSANKSNFL; SLKRDSANKSNFLQ; LKRDSANKSNFLQK;
RDSANKSNFLQKK; RDSANKSNFLQKKV; DSANKSNFLQKNVT;
SANKSNFLQKNVTL; ANKSNFLQKNVTLF; NKSNFLQKNVTLFF;
KSNFLQKNVTLFFS; SNFLQKNVTLFFSS; NFLQKNVTLFFSSL;
FLQKNVTLFFSSLK; LQKNVTLFFSSLKT; QKNVTLFFSSLKTF;
KNVTLFFSSLKTFL; NVTLFFSSLKTFLL; VTLFFSSLKTFLLK;
TLFFSSLKTFLLKF; LFFSSLKTFLLKFQ; FFSSLKTFLLKFQS;
FSSLKTFLLKFQSF; SSLKTFLLKFQSFT; SLKTFLLKFQSFTR;
LKTFLLKFQSFTRK; KTFLLKFQSFTRKE; TFLLKFQSFTRKEK;
FLLKFQSFTRKEKT; LLKFQSFTRKEKTQ; LKFQSFTRKEKTQK;
KFQSFTRKEKTQKQ; FQSFTRKEKTQKQD; QSFTRKEKTQKQDE;
SFTRKEKTQKQDEY; FTRKEKTQKQDEYK; TRKEKTQKQDEYKG;
RKEKTQKQDEYKGM; KEKTQKQDEYKGMT; EKTQKQDEYKGMTQ;
KTQKQDEYKGMTQG; TQKQDEYKGMTQGS; QKQDEYKGMTQGSL;
KQDEYKGMTQGSL; QDEYKGMTQGSLK; DEYKGMTQGSLKS;

TIRKIYDTYTLFST; IRKIYDTYTLFSTKL; RKIYDTYTLFSTKLT;
RIYDTYTLFSTKLT; IYDTYTLFSTKLTQ; YDTYTLFSTKLTQM;
DTYTLFSTKLTQMY; TYTLFSTKLTQMYS; YLFSTKLTQMYST;
LFSTKLTQMYSTR; FSTKLTQMYSTRL; STKLTQMYSTRLD;
STKLTQMYSTRLDN; TKLTQMYSTRLDNL; KLTQMYSTRLDNLA;
LTQMYSTRLDNLAK; TQMYSTRLDNLAKA; QMYSTRLDNLAKAK;
MYSTRLDNLAKAK

Fig. 33 continued

| | | |
|---|---|---|
| EDYARYYLDDDDDD; | EDYARYYLDDDDDD; | DYARYYLDDDDDDE; |
| YARYYLDDDDDDEY; | ARYYLDDDDDDEYY; | RYYLDDDDDDEYYE; |
| YYLDDDDDDEYYED; | YLDDDDDDEYYEDD; | LDDDDDDEYYEDDY; |
| DDDDDDEYYEDDYE; | DDDDDEYYEDDYEE; | DDDDEYYEDDYEEL; |
| DDDEYYEDDYEELR; | DDEYYEDDYEELRL; | DEYYEDDYEELRLS; |
| EYYEDDYEELRLSN; | YYEDDYEELRLSNR; | YEDDYEELRLSNRY; |
| EDDYEELRLSNRYQ; | DDYEELRLSNRYQS; | DYEELRLSNRYQSY; |
| YEELRLSNRYQSYL; | EELRLSNRYQSYLE; | ELRLSNRYQSYLEG; |
| LRLSNRYQSYLEGV; | RLSNRYQSYLEGVK; | LSNRYQSYLEGVKY; |
| SNRYQSYLEGVKYN; | NRYQSYLEGVKYNV; | RYQSYLEGVKYNVD; |
| YQSYLEGVKYNVDS; | QSYLEGVKYNVDSA; | SYLEGVKYNVDSAT; |
| YLEGVKYNVDSATN; | LEGVKYNVDSATNT; | EGVKYNVDSATNTT; |
| GVKYNVDSATNTTN; | VKYNVDSATNTTNK; | KYNVDSATNTTNKT; |
| YNVDSATNTTNKTY; | NVDSATNTTNKTYD; | VDSATNTTNKTYDT; |
| DSATNTTNKTYDTY; | SATNTTNKTYDTYL; | ATNTTNKTYDTYLF; |
| TNTTNKTYDTYLFS; | NTTNKTYDTYLFST; | TTNKTYDTYLFSTK; |
| TNKTYDTYLFSTKL; | NKTYDTYLFSTKLT; | KTYDTYLFSTKLTQ; |
| TYDTYLFSTKLTQM; | YDTYLFSTKLTQMY; | DTYLFSTKLTQMYS; |
| TYLFSTKLTQMYST; | YLFSTKLTQMYSTR; | LFSTKLTQMYSTRL; |
| FSTKLTQMYSTRLD; | STKLTQMYSTRLDK; | TKLTQMYSTRLDKL; |
| KLTQMYSTRLDKLA; | LTQMYSTRLDKLAK; | TQMYSTRLDKLAKA; |
| QMYSTRLDKLAKAK; | MYSTRLDKLAKAKA; | YSTRLDKLAKAKAE; |
| STRLDKLAKAKAEE; | TRLDKLAKAKAEEA; | RLDKLAKAKAEEAA; |
| LDKLAKAKAEEAAK; | DKLAKAKAEEAAKF; | KLAKAKAEEAAKFT; |
| LAKAKAEEAAKFTK; | AKAKAEEAAKFTKE; | KAKAEEAAKFTKED; |
| AKAEEAAKFTKEDL; | KAEEAAKFTKEDLE; | AEEAAKFTKEDLEK; |
| EEAAKFTKEDLEKN; | EAAKFTKEDLEKNF; | AAKFTKEDLEKNFK; |
| AKFTKEDLEKNFKT; | KFTKEDLEKNFKTL; | FTKEDLEKNFKTLL; |
| TKEDLEKNFKTLLN; | KEDLEKNFKTLLNY; | EDLEKNFKTLLNYI; |
| DLEKNFKTLLNYIQ; | LEKNFKTLLNYIQV; | EKNFKTLLNYIQVS; |
| KNFKTLLNYIQVSV; | NFKTLLNYIQVSVK; | FKTLLNYIQVSVKT; |
| KTLLNYIQVSVKTA; | TLLNYIQVSVKTAA; | LLNYIQVSVKTAAN; |
| LNYIQVSVKTAANF; | NYIQVSVKTAANFV; | YIQVSVKTAANFVY; |
| IQVSVKTAANFVYT; | QVSVKTAANFVYTN; | VSVKTAANFVYTND; |
| SVKTAANFVYTNDT; | VKTAANFVYTNDTH; | KTAANFVYTNDTHA; |
| TAANFVYTNDTHAK; | AANFVYTNDTHAKR; | ANFVYTNDTHAKRK; |
| NFVYTNDTHAKRKL; | FVYTNDTHAKRKLE; | VYTNDTHAKRKLEN; |
| YTNDTHAKRKLENT; | TNDTHAKRKLENTA; | NDTHAKRKLENTAF; |
| DTHAKRKLENTAFT; | THAKRKLENTAFTK; | HAKRKLENTAFTKT; |
| AKRKLENTAFTKTL; | KRKLENTAFTKTLL; | RKLENTAFTKTLLA; |
| KLENTAFTKTLLAK; | LENTAFTKTLLAKI; | ENTAFTKTLLAKIK; |
| NTAFTKTLLAKIKE; | TAFTKTLLAKIKEQ; | AFTKTLLAKIKEQS; |
| FTKTLLAKIKEQSN; | TKTLLAKIKEQSNL; | KTLLAKIKEQSNLY; |
| TLLAKIKEQSNLYE; | LLAKIKEQSNLYEA; | LAKIKEQSNLYEAY; |
| AKIKEQSNLYEAYK; | KIKEQSNLYEAYKA; | IKEQSNLYEAYKAL; |
| KEQSNLYEAYKALV; | EQSNLYEAYKALVT; | QSNLYEAYKALVTS; |
| SNLYEAYKALVTSI; | NLYEAYKALVTSIL; | LYEAYKALVTSILM; |
| YEAYKALVTSILMR; | EAYKALVTSILMRD; | AYKALVTSILMRDS; |
| YKALVTSILMRDSL; | KALVTSILMRDSLK; | ALVTSILMRDSLKR; |
| LVTSILMRDSLKRV; | VTSILMRDSLKRVQ; |

Fig. 33 continued

TSILLMRDSLKEVQG; SILLMRDSLKEVQGI; ILLMRDSLKEVQGII;
LLMRDSLKEVQGIID; LMRDSLKEVQGIIDK; MRDSLKEVQGIIDKN;
RDSLKEVQGIIDKNG; DSLKEVQGIIDKNGV; SLKEVQGIIDKNGVW;
LKEVQGIIDKNGVWY;

16 mers:
MKKVKSKYLALGLFG; KKVKSKYLALGLFGF; KVKSKYLALGLFGFT;
VKSKYLALGLFGFTS; KSKYLALGLFGFTSC; SKYLALGLFGFTSCD;
KYLALGLFGFTSCDL; YLALGLFGFTSCDLF; LALGLFGFTSCDLFT;
ALGLFGFTSCDLFTR; LGLFGFTSCDLFTRY; GLFGFTSCDLFTRYE;
LFGFTSCDLFTRYEM; FGFTSCDLFTRYEMK; GFTSCDLFTRYEMKE;
FTSCDLFTRYEMKEE; TSCDLFTRYEMKEES; SCDLFTRYEMKEESP;
CDLFTRYEMKEESPG; DLFTRYEMKEESPGL; LFTRYEMKEESPGLF;
FTRYEMKEESPGLFD; TRYEMKEESPGLFDK; RYEMKEESPGLFDKG;
YEMKEESPGLFDKGN; EMKEESPGLFDKGNS; MKEESPGLFDKGNSI;
KEESPGLFDKGNSIL; EESPGLFDKGNSILE; ESPGLFDKGNSILET;
SPGLFDKGNSILETS; PGLFDKGNSILETSE; GLFDKGNSILETSEE;
LFDKGNSILETSEES; FDKGNSILETSEEST; DKGNSILETSEESTK;
KGNSILETSEESIKK; GNSILETSEESIKKP; NSILETSEESIKKPM;
SILETSEESIKKPMK; ILETSEESIKKPMKK; LETSEESIKKPMKKG;
ETSEESIKKPMKKGK; TSEESIKKPMKKGKG; SEESIKKPMKKGKGK;
EESIKKPMKKGKGKL; ESIKKPMKKGKGKLA; SIKKPMKKGKGKLAR;
IKKPMKKGKGKLARK; KKPMKKGKGKLARKK; KPMKKGKGKLARKKG;
PMKKGKGKLARKKGK; MKKGKGKLARKKGKS; KKGKGKLARKKGKSK;
KGKGKLARKKGKSKV; GKGKLARKKGKSKVS; KGKLARKKGKSKVSR;
GKLARKKGKSKVSRK; KLARKKGKSKVSRKE; LARKKGKSKVSRKEP;
ARKKGKSKVSRKEPY; RKKGKSKVSRKEPYI; KKGKSKVSRKEPYIH;
KGKSKVSRKEPYIHS; GKSKVSRKEPYIHSL; KSKVSRKEPYIHSLK;
SKVSRKEPYIHSLKR; KVSRKEPYIHSLKRD; VSRKEPYIHSLKRDS;
SRKEPYIHSLKRDSA; RKEPYIHSLKRDSAK; KEPYIHSLKRDSAKK;
EPYIHSLKRDSAKKS; PYIHSLKRDSAKKSF; YIHSLKRDSAKKSFL;
IHSLKRDSAKKSFLQ; HSLKRDSAKKSFLQK; SLKRDSAKKSFLQKN;
LKRDSAKKSFLQKNV; KRDSAKKSFLQKNVT; RDSAKKSFLQKNVTL;
DSAKKSFLQKNVTLE; SAKKSFLQKNVTLEE; AKKSFLQKNVTLEES;
KKSFLQKNVTLEESL; KSFLQKNVTLEESLK; SFLQKNVTLEESLKT;
FLQKNVTLEESLKTE; LQKNVTLEESLKTEL; QKNVTLEESLKTELL;
KNVTLEESLKTELLK; NVTLEESLKTELLKE; VTLEESLKTELLKEQ;
TLEESLKTELLKEQS; LEESLKTELLKEQSE; EESLKTELLKEQSET;
ESLKTELLKEQSETR; SLKTELLKEQSETRK; LKTELLKEQSETRKE;
KTELLKEQSETRKEK; TELLKEQSETRKEKI; ELLKEQSETRKEKIQ;
LLKEQSETRKEKIQK; LKEQSETRKEKIQKQ; KEQSETRKEKIQKQD;
EQSETRKEKIQKQDF; QSETRKEKIQKQDFY; SETRKEKIQKQDFYK;
ETRKEKIQKQDFYKG; TRKEKIQKQDFYKGM; RKEKIQKQDFYKGMT;
KEKIQKQDFYKGMTQ; EKIQKQDFYKGMTQG; KIQKQDFYKGMTQGS;
IQKQDFYKGMTQGSL; QKQDFYKGMTQGSLN; KQDFYKGMTQGSLNS;
QDFYKGMTQGSLNSL; DFYKGMTQGSLNSLS; FYKGMTQGSLNSLSG;
YKGMTQGSLNSLSGE; KGMTQGSLNSLSGES; GMTQGSLNSLSGESG;
MTQGSLNSLSGESGE; TQGSLNSLSGESGEL; QGSLNSLSGESGELK;
GSLNSLSGESGELKE; SLNSLSGESGELKET; LNSLSGESGELKETT;
NSLSGESGELKETTF;

Fig. 33 continued

SLSCESCELKETIESK; LSCESCELKETIESNE; SCESCELKETIESKEI;
ESCELKETIESNETD; ESCELKETIESNETDT; SCELKETIESNETDTT;
CELKETIESNETDTT; ELKETIESNETDTTD; LKETIESNETDTTDS;
KETIESNETDTTDSD; ETIESNEIDITIDSDL; TIESNEIDITIDSDLR;
IESNEIDITIDSDLRP; ESNEIDITIDSDLRPK; SNEIDITIDSDLRPKS;
NEIDITIDSDLRPKSS; EIDITIDSDLRPKSSL; IDITIDSDLRPKSSLQ;
DITTDSDLRPKSSLQD; ITTDSDLRPKSSLQDT; TTDSDLRPKSSLQDTA;
TDSDLRPKSSLQDTAG; DSDLRPKSSLQDTAGS; SDLRPKSSLQDTAGSN;
DLRPKSSLQDTAGSNS; LRPKSSLQDTAGSNST; RPKSSLQDTAGSNSTS;
PKSSLQDTAGSNSTSY; KSSLQDTAGSNSTSYT; SSLQDTAGSNSTSYTD;
SLQDTAGSNSTSYTDE; LQDTAGSNSTSYTDEF; QDTAGSNSTSYTDEFE;
DTAGSNSTSYTDEFEE; TAGSNSTSYTDEFEED; AGSNSTSYTDEFEEDY;
GSNSTSYTDEFEEDYA; SNSTSYTDEFEEDYAR; NSTSYTDEFEEDYARY;
STSYTDEFEEDYARYY; TSYTDEFEEDYARYYL; SYTDEFEEDYARYYLD;
YTDEFEEDYARYYLDE; TDEFEEDYARYYLDED; DEFEEDYARYYLDEDD;
EFEEDYARYYLDEDDD; FEEDYARYYLDEDDDE; EEDYARYYLDEDDDED;
EDYARYYLDEDDDEDD; DYARYYLDEDDDEDEE; YARYYLDEDDDEDEEY;
ARYYLDEDDDEDEEYY; RYYLDEDDDEDEEYYE; YYLDEDDDEDEEYYED;
YLDEDDDEDEEYYEDD; LDEDDDEDEEYYEDDY; DEDDDEDEEYYEDDYE;
EDDDEDEEYYEDDYEE; DDDEDEEYYEDDYEEI; DDEDEEYYEDDYEEIR;
DEDEEYYEDDYEEIRL; EDEEYYEDDYEEIRLS; DEEYYEDDYEEIRLSN;
EEYYEDDYEEIRLSNR; EYYEDDYEEIRLSNRY; YYEDDYEEIRLSNRYQ;
YEDDYEEIRLSNRYQS; EDDYEEIRLSNRYQSY; DDYEEIRLSNRYQSYL;
DYEEIRLSNRYQSYLE; YEEIRLSNRYQSYLEG; EEIRLSNRYQSYLEGV;
EIRLSNRYQSYLEGVK; IRLSNRYQSYLEGVKY; RLSNRYQSYLEGVKYN;
LSNRYQSYLEGVKYNV; SNRYQSYLEGVKYNVD; NRYQSYLEGVKYNVDS;
RYQSYLEGVKYNVDSA; YQSYLEGVKYNVDSAI; QSYLEGVKYNVDSALK;
SYLEGVKYNVDSA

| | |
|---|---|
| | SVKTAANFVYINDTHA; VKTAANFVYINDTHAK; KTAANFVYINDTHAKR; TAANFVYINDTHAKRK; AANFVYINDTHAKRKL; ANFVYINDTHAKRKLE; NFVYINDTHAKRKLEN; FVYINDTHAKRKLENI; VYINDTHAKRKLENIE; YINDTHAKRKLENIEA; INDTHAKRKLENIEAE; NDTHAKRKLENIEAEI; DTHAKRKLENIEAEIK; THAKRKLENIEAEIKT; HAKRKLENIEAEIKTL; AKRKLENIEAEIKTLI; KRKLENIEAEIKTLIA; RKLENIEAEIKTLIAK; KLENIEAEIKTLIAKI; LENIEAEIKTLIAKIK; ENIEAEIKTLIAKIKE; NIEAEIKTLIAKIKEQ; IEAEIKTLIAKIKEQS; EAEIKTLIAKIKEQSN; AEIKTLIAKIKEQSNL; EIKTLIAKIKEQSNLY; IKTLIAKIKEQSNLYE; KTLIAKIKEQSNLYEA; TLIAKIKEQSNLYEAY; LIAKIKEQSNLYEAYK; IAKIKEQSNLYEAYKA; AKIKEQSNLYEAYKAI; KIKEQSNLYEAYKAIV; IKEQSNLYEAYKAIVT; KEQSNLYEAYKAIVTS; EQSNLYEAYKAIVTSI; QSNLYEAYKAIVTSIL; SNLYEAYKAIVTSILL; NLYEAYKAIVTSILLM; LYEAYKAIVTSILLMR; YEAYKAIVTSILLMRD; EAYKAIVTSILLMRDS; AYKAIVTSILLMRDSL; YKAIVTSILLMRDSLK; KAIVTSILLMRDSLKE; AIVTSILLMRDSLKEV; IVTSILLMRDSLKEVQ; VTSILLMRDSLKEVQG; TSILLMRDSLKEVQGI; SILLMRDSLKEVQGII; ILLMRDSLKEVQGIID; LLMRDSLKEVQGIIDK; LMRDSLKEVQGIIDKN; MRDSLKEVQGIIDKNG; RDSLKEVQGIIDKNGV; DSLKEVQGIIDKNGVW; SLKEVQGIIDKNGVWY; |
| SEQ ID NO:43 SEQ ID NO: 122411-123764 | 13 mers: MKIKSKCLALGLL; KIKSKCLALGLLF; IKSKCLALGLLFG; KSKCLALGLLFGF; SKCLALGLLFGFI; KCLALGLLFGFIS; CLALGLLFGFISC; LALGLLFGFISCD; ALGLLFGFISCDL; LGLLFGFISCDLF; GLLFGFISCDLFI; LLFGFISCDLFIR; LFGFISCDLFIRD; FGFISCDLFIRDE; GFISCDLFIRDEI; FISCDLFIRDEIK; ISCDLFIRDEIKE; SCDLFIRDEIKEK; CDLFIRDEIKEKS; DLFIRDEIKEKSL; LFIRDEIKEKSLG; FIRDEIKEKSLGL; IRDEIKEKSLGLC; RDEIKEKSLGLCD; DEIKEKSLGLCDE; EIKEKSLGLCDEE; IKEKSLGLCDEES; KEKSLGLCDEESS; EKSLGLCDEESSI; KSLGLCDEESSIL; SLGLCDEESSILE; LGLCDEESSILET; GLCDEESSILETG; LCDEESSILETGD; CDEESSILETGDK; DEESSILETGDKS; EESSILETGDKSV; ESSILETGDKSVK; SSILETGDKSVKK; SILETGDKSVKKS; ILETGDKSVKKSL; LETGDKSVKKSLN; ETGDKSVKKSLNK; TGDKSVKKSLNKK; GDKSVKKSLNKKG; DKSVKKSLNKKGK; KSVKKSLNKKGKD; SVKKSLNKKGKDK; VKKSLNKKGKDKV; KKSLNKKGKDKVA; KSLNKKGKDKVAR; SLNKKGKDKVARK; LNKKGKDKVARKK; NKKGKDKVARKKV; KKGKDKVARKKVE; KGKDKVARKKVEG; GKDKVARKKVEGN; KDKVARKKVEGNA; DKVARKKVEGNAV; KVARKKVEGNAVK; VARKKVEGNAVKK; ARKKVEGNAVKKD; RKKVEGNAVKKDP; KKVEGNAVKKDPF; KVEGNAVKKDPFN; VEGNAVKKDPFNH; EGNAVKKDPFNHH; GNAVKKDPFNHHV; NAVKKDPFNHHVK; AVKKDPFNHHVKR; VKKDPFNHHVKRE; KKDPFNHHVKRES; KDPFNHHVKRESV; DPFNHHVKRESVN; PFNHHVKRESVNN; FNHHVKRESVNNS; NHHVKRESVNNSN; HHVKRESVNNSNL; HVKRESVNNSNLS; VKRESVNNSNLSQ; KRESVNNSNLSQK; RESVNNSNLSQKN; ESVNNSNLSQKNV; SVNNSNLSQKNVI; VNNSNLSQKNVIS; NNSNLSQKNVISE; NSNLSQKNVISEE; |

Fig. 33 continued

SDLSQKNVISEEE; KLSQKKVLSEEEI; LSQKKVLSEEEIL;
SQKNVISEEEILK; QKNVISEEEILKT; KNVISEEEILKTK;
NVISEEEILKTKL; VISEEEILKTKLL; ISEEEILKTKLLR;
SEEEILKTKLLRE; EEEILKTKLLRER; EEILKTKLLRERP;
EILKTKLLRERPE; ILKTKLLRERPET; LKTKLLRERPETR;
KTKLLRERPETRK; TKLLRERPETRKE; KLLRERPETRKEE;
LLRERPETRKEET; LRERPETRKEETQ; RERPETRKEETQK;
ERPETRKEETQKQ; RPETRKEETQKQD; PETRKEETQKQDE;
ETRKEETQKQDEH; TRKEETQK

QMYSTRLDNLAKA; MYSTRLDNLAKAK; YSTRLDNLAKAKA;
STRLDNLAKAKAR; TRLDNLAKAKARE; RLDNLAKAKAREE;
LDNLAKAKAREEA; DNLAKAKAREEAK; NLAKAKAREEAKK;
LAKAKAREEAKKF; AKAKAREEAKKFT; KAKAREEAKKFTK;
AKAREEAKKFTKE; KAREEAKKFTKEE; AREEAKKFTKEEL;
REEAKKFTKEELE; EEAKKFTKEELEK; EAKKFTKEELEKD;
AKKFTKEELEKDL; KFTKEELEKDLK; FTKEELEKDLKT;
FTKEELEKDLKTL; TKEELEKDLKTLL; EELEKDLKTLLR;
EELEKDLKTLLNY; ELEKDLKTLLNYT; LEKDLKTLLNYTQ;
EKDLKTLLNYTQV; KDLKTLLNYTQVS; DLKTLLNYTQVSA;
LKTLLNYTQVSAR; KTLLNYTQVSART; TLLNYTQVSARTA;
LLNYTQVSARTAT; LNYTQVSARTATN; NYTQVSARTATNE;
YTQVSARTATNEV; TQVSARTATNEVY; QVSARTATNEVYA;
VSARTATNEVYAR; SARTATNEVYARE; ARTATNEVYAREL;
RTATNEVYARELY; TATNEVYARELYS; ATNEVYARELYSK;
TNEVYARELYSKR; NEVYARELYSKRK; EVYARELYSKRKL;
VYARELYSKRKLD; YARELYSKRKLDA; ARELYSKRKLDAT;
RELYSKRKLDATE; ELYSKRKLDATET; LYSKRKLDATETE;
YSKRKLDATETEL; SKRKLDATETELK; KRKLDATETELKK;
RKLDATETELKNL; KLDATETELKNLI; LDATETELKNLIL;
DATETELKNLILK; ATETELKNLILKI; TETELKNLILKIK;
ETELKNLILKIKG; TELKNLILKIKGQ; ELKNLILKIKGQS;
LKNLILKIKGQSD; KNLILKIKGQSDL; NLILKIKGQSDLY;
LILKIKGQSDLYE; ILKIKGQSDLYEA; LKIKGQSDLYEAY;
KIKGQSDLYEAYK; IKGQSDLYEAYKA; KGQSDLYEAYKAT;
GQSDLYEAYKATV; QSDLYEAYKATVR; SDLYEAYKATVRS;
DLYEAYKATVRST; LYEAYKATVRSTL; YEAYKATVRSTLL;
EAYKATVRSTLLM; AYKATVRSTLLMK; YKATVRSTLLMKD;
KATVRSTLLMKDS; ATVRSTLLMKDSL; TVRSTLLMKDSLK;
VRSTLLMKDSLKI; RSTLLMKDSLKII; STLLMKDSLKIIE;
TLLMKDSLKIIEI; LLMKDSLKIIEIV; LMKDSLKIIEIVT;
MKDSLKIIEIVTD; KDSLKIIEIVTDK; DSLKIIEIVTDKN;
SLKIIEIVTDKNG; LKIIEIVTDKNGV; KIIEIVTDKNGVW;
IIEIVTDKNGVWY;

14 mers:
MRTKSKCLALGLLF; RTKSKCLALGLLFG; TKSKCLALGLLFGF;
KSKCLALGLLFGFT; SKCLALGLLFGFTS; KCLALGLLFGFTSC;
CLALGLLFGFTSCD; LALGLLFGFTSCDL; ALGLLFGFTSCDLF;
LGLLFGFTSCDLFT; GLLFGFTSCDLFTR; LLFGFTSCDLFTRD;
LFGFTSCDLFTRDE; FGFTSCDLFTRDEI; GFTSCDLFTRDEIK;
FTSCDLFTRDEIKE; TSCDLFTRDEIKEK; SCDLFTRDEIKEKS;
CDLFTRDEIKEKSL; DLFTRDEIKEKSLG; LFTRDEIKEKSLGL;
FTRDEIKEKSLGLC; TRDEIKEKSLGLCD; RDEIKEKSLGLCDE;
DEIKEKSLGLCDEE; EIKEKSLGLCDEES; IKEKSLGLCDEESS;
KEKSLGLCDEESSI; EKSLGLCDEESSIL; KSLGLCDEESSILE;
SLGLCDEESSILET; LGLCDEESSILETG; GLCDEESSILETGD;
LCDEESSILETGDK; CDEESSILETGDKS; DEESSILETGDKSV;
EESSILETGDKSVK; ESSILETGDKSVKK; SSILETGDKSVKKS;
SILETGDKSVKKSL; ILETGDKSVKKSLK; LETGDKSVKKSLKK;
ETGDKSVKKSLKKG; TGDKSVKKSLKKGR; GDKSVKKSLKKGR;

GTRLSNRYESYLE; TRLSNRYESYLEG; RLSNRYESYLEGV;
RLSNRYESYLEGVK; LSNRYESYLEGVKY; SNRYESYLEGVKYN;
NRYESYLEGVKYNV; RYESYLEGVKYNVS; YESYLEGVKYNVSS;
ESYLEGVKYNVSSA; SYLEGVKYNVSSAL; YLEGVKYNVSSALK;
LEGVKYNVSSALKT; EGVKYNVSSALKTL; GVKYNVSSALKTLV;
VKYNVSSALKTLVK; KYNVSSALKTLVKT; YNVSSALK

Fig. 33 continued

| | | |
|---|---|---|
| LRLKSDLQAISGSNS; | RLKSDLQAISGSNSI; | LKSDLQAISGSNSIS; |
| KSDLQAISGSNSISY; | SDLQAISGSNSISYT; | DLQAISGSNSISYTD; |
| LQAISGSNSISYTDE; | QAISGSNSISYTDEI; | AISGSNSISYTDEIE; |
| ISGSNSISYTDEIEE; | SGSNSISYTDEIEED; | GSNSISYTDEIEEDD; |
| SNSISYTDEIEEDYD; | NSISYTDEIEEDYDQ; | SISYTDEIEEDYDQY; |
| ISYTDEIEEDYDQYS; | SYTDEIEEDYDQYSL; | YTDEIEEDYDQYSLE; |
| TDEIEEDYDQYSLEE; | DEIEEDYDQYSLEED; | EIEEDYDQYSLEEDY; |
| IEEDYDQYSLEEDYY; | EEDYDQYSLEEDYYY; | EDYDQYSLEEDYYYD; |
| DYDQYSLEEDYYYDG; | YDQYSLEEDYYYDGE; | DQYSLEEDYYYDGET; |
| QYSLEEDYYYDGETR; | YSLEEDYYYDGETRL; | SLEEDYYYDGETRLS; |
| LEEDYYYDGETRLSK; | EEDYYYDGETRLSKR; | EDYYYDGETRLSKRY; |
| DYYYDGETRLSKRYE; | YYYDGETRLSKRYES; | YYDGETRLSKRYESY; |
| YDGETRLSKRYESYL; | DGETRLSKRYESYLE; | GETRLSKRYESYLEG; |
| ETRLSKRYESYLEGV; | TRLSKRYESYLEGVK; | RLSKRYESYLEGVKY; |
| LSKRYESYLEGVKYN; | SKRYESYLEGVKYNV; | KRYESYLEGVKYNVS; |
| RYESYLEGVKYNVSS; | YESYLEGVKYNVSSA; | ESYLEGVKYNVSSAT; |
| SYLEGVKYNVSSATK; | YLEGVKYNVSSATKT; | LEGVKYNVSSATKTI; |
| EGVKYNVSSATKTIV; | GVKYNVSSATKTIVK; | VKYNVSSATKTIVKI; |
| KYNVSSATKTIVKIY; | YNVSSATKTIVKIYD; | NVSSATKTIVKIYDN; |
| VSSATKTIVKIYDNY; | SSATKTIVKIYDNYT; | SATKTIVKIYDNYTL; |
| ATKTIVKIYDNYTLL; | TKTIVKIYDNYTLLS; | KTIVKIYDNYTLLST; |
| TIVKIYDNYTLLSTK; | IVKIYDNYTLLSTKQ; | VKIYDNYTLLSTKQT; |
| KIYDNYTLLSTKQTQ; | IYDNYTLLSTKQTQM; | YDNYTLLSTKQTQMY; |
| DNYTLLSTKQTQMYS; | NYTLLSTKQTQMYST; | YTLLSTKQTQMYSTR; |
| TLLSTKQTQMYSTRL; | LLSTKQTQMYSTRLD; | LSTKQTQMYSTRLDN; |
| STKQTQMYSTRLDNL; | TKQTQMYSTRLDNLA; | KQTQMYSTRLDNLAK; |
| QTQMYSTRLDNLAKA; | TQMYSTRLDNLAKAK; | QMYSTRLDNLAKAKA; |
| MYSTRLDNLAKAKAR; | YSTRLDNLAKAKARE; | STRLDNLAKAKAREE; |
| TRLDNLAKAKAREEA; | RLDNLAKAKAREEAK; | LDNLAKAKAREEAKK; |
| DNLAKAKAREEAKKE; | NLAKAKAREEAKKET; | LAKAKAREEAKKETK; |
| AKAKAREEAKKETKE; | KAKAREEAKKETKEE; | AKAREEAKKETKEEL; |
| KAREEAKKETKEELE; | AREEAKKETKEELEK; | REEAKKETKEELEKD; |
| EEAKKETKEELEKDL; | EAKKETKEELEKDLK; | AKKETKEELEKDLKT; |
| KKETKEELEKDLKTL; | KETKEELEKDLKTLN; | ETKEELEKDLKTLNY; |
| TKEELEKDLKTLNYT; | KEELEKDLKTLNYTQ; | EELEKDLKTLNYTQV; |
| ELEKDLKTLNYTQVS; | LEKDLKTLNYTQVSA; | EKDLKTLNYTQVSAR; |
| KDLKTLNYTQVSART; | DLKTLNYTQVSARTA; | LKTLNYTQVSARTAT; |
| KTLNYTQVSARTATN; | TLNYTQVSARTATNE; | LNYTQVSARTATNEV; |
| NYTQVSARTATNEVY; | YTQVSARTATNEVYA; | TQVSARTATNEVYAR; |
| QVSARTATNEVYARE; | VSARTATNEVYAREI; | SARTATNEVYAREIY; |
| ARTATNEVYAREIYS; | RTATNEVYAREIYSK; | TATNEVYAREIYSKR; |
| ATNEVYAREIYSKRK; | TNEVYAREIYSKRKL; | NEVYAREIYSKRKLD; |
| EVYAREIYSKRKLDA; | VYAREIYSKRKLDAI; | YAREIYSKRKLDAIE; |
| AREIYSKRKLDAIET; | REIYSKRKLDAIETE; | EIYSKRKLDAIETEI; |
| IYSKRKLDAIETEIK; | YSKRKLDAIETEIKN; | SKRKLDAIETEIKNL; |
| KRKLDAIETEIKNLI; | RKLDAIETEIKNLIL; | KLDAIETEIKNLILK; |
| LDAIETEIKNLILKI; | DAIETEIKNLILKIK; | AIETEIKNLILKIKQ; |
| IETEIKNLILKIKQS; | ETEIKNLILKIKQSD; | TEIKNLILKIKQSDL; |
| EIKNLILKIKQSDLY; | IKNLILKIKQSDLYE; | KNLILKIKQSDLYEA; |
| NLILKIKQSDLYEAY; | LILKIKQSDLYEAYK; | ILKIKQSDLYEAYKA; |

Fig. 33 continued

KIKQSDLYFAYKAI; IKQSDLYFAYKAIV; KQSDLYFAYKAIVR;
QQSDLYFAYKAIVRS; QSDLYFAYKAIVRST; SDLYFAYKAIVRSTL;
DLYFAYKAIVRSTLL; LYFAYKAIVRSTLLM; YFAYKAIVRSTLLMK;
FAYKAIVRSTLLMKD; AYKAIVRSTLLMKDS; YKAIVRSTLLMKDSL;
KAIVRSTLLMKDSLK; AIVRSTLLMKDSLKI; IVRSTLLMKDSLKIT;
VRSTLLMKDSLKITF; RSTLLMKDSLKITFT; STLLMKDSLKITFTV;
TLLMKDSLKITFTVT; LLMKDSLKITFTVTD; LMKDSLKITFTVTDK;
MKDSLKITFTVTDKN; KDSLKITFTVTDKNG; DSLKITFTVTDKNGV;
SLKITFTVTDKNGVW; LKITFTVTDKNGVWY;

16 mers:
MKIKSKCLALGLLFGF; KIKSKCLALGLLFGFT; IKSKCLALGLLFGFTS;
KSKCLALGLLFGFTSC; SKCLALGLLFGFTSCD; KCLALGLLFGFTSCDL;
CLALGLLFGFTSCDLF; LALGLLFGFTSCDLFI; ALGLLFGFTSCDLFIR;
LGLLFGFTSCDLFIRD; GLLFGFTSCDLFIRDE; LLFGFTSCDLFIRDEI;
LFGFTSCDLFIRDEIK; FGFTSCDLFIRDEIKE; GFTSCDLFIRDEIKEK;
FTSCDLFIRDEIKEKS; TSCDLFIRDEIKEKSL; SCDLFIRDEIKEKSLG;
CDLFIRDEIKEKSLGL; DLFIRDEIKEKSLGLC; LFIRDEIKEKSLGLCD;
FIRDEIKEKSLGLCDE; IRDEIKEKSLGLCDEE; RDEIKEKSLGLCDEES;
DEIKEKSLGLCDEESS; EIKEKSLGLCDEESSI; IKEKSLGLCDEESSIL;
KEKSLGLCDEESSILF; EKSLGLCDEESSILFT; KSLGLCDEESSILFTG;
SLGLCDEESSILFTGD; LGLCDEESSILFTGDK; GLCDEESSILFTGDKS;
LCDEESSILFTGDKSV; CDEESSILFTGDKSVK; DEESSILFTGDKSVKK;
EESSILFTGDKSVKKS; ESSILFTGDKSVKKSL; SSILFTGDKSVKKSLN;
SILFTGDKSVKKSLNK; ILFTGDKSVKKSLNKK; LFTGDKSVKKSLNKKG;
FTGDKSVKKSLNKKGK; TGDKSVKKSLNKKGKD; GDKSVKKSLNKKGKDK;
DKSVKKSLNKKGKDKV; KSVKKSLNKKGKDKVA; SVKKSLNKKGKDKVAR;
VKKSLNKKGKDKVARK; KKSLNKKGKDKVARKK; KSLNKKGKDKVARKKV;
SLNKKGKDKVARKKVE; LNKKGKDKVARKKVEG; NKKGKDKVARKKVEGN;
KKGKDKVARKKVEGNA; KGKDKVARKKVEGNAV; GKDKVARKKVEGNAVK;
KDKVARKKVEGNAVKK; DKVARKKVEGNAVKKD; KVARKKVEGNAVKKDP;
VARKKVEGNAVKKDPF; ARKKVEGNAVKKDPFN; RKKVEGNAVKKDPFNH;
KKVEGNAVKKDPFNHH; KVEGNAVKKDPFNHHV; VEGNAVKKDPFNHHVK;
EGNAVKKDPFNHHVKR; GNAVKKDPFNHHVKRE; NAVKKDPFNHHVKRES;
AVKKDPFNHHVKRESV; VKKDPFNHHVKRESVN; KKDPFNHHVKRESVNK;
KDPFNHHVKRESVNKS; DPFNHHVKRESVNKSN; PFNHHVKRESVNKSNL;
FNHHVKRESVNKSNLS; NHHVKRESVNKSNLSQ; HHVKRESVNKSNLSQK;
HVKRESVNKSNLSQKK; VKRESVNKSNLSQKKV; KRESVNKSNLSQKKVT;
RESVNKSNLSQKKVTS; ESVNKSNLSQKKVTSF; SVNKSNLSQKKVTSFF;
VNKSNLSQKKVTSFFE; NKSNLSQKKVTSFFEI; KSNLSQKKVTSFFEIL;
SNLSQKKVTSFFEILK; NLSQKKVTSFFEILKT; LSQKKVTSFFEILKTK;
SQKKVTSFFEILKTKL; QKKVTSFFEILKTKLL; KKVTSFFEILKTKLLR;
KVTSFFEILKTKLLRE; VTSFFEILKTKLLRER; TSFFEILKTKLLRERP;
SFFEILKTKLLRERPE; FFEILKTKLLRERPET; FEILKTKLLRERPETR;
EILKTKLLRERPETRK; ILKTKLLRERPETRKE; LKTKLLRERPETRKEI;
KTKLLRERPETRKEIQ; TKLLRERPETRKEIQK; KLLRERPETRKEIQKQ;
LLRERPETRKEIQKQQ; LRERPETRKEIQKQQD; RERPETRKEIQKQQDE;
ERPETRKEIQKQQDEH; RPETRKEIQKQQDEHK; PETRKEIQKQQDEHKR;
ETRKEIQKQQDEHKRM; TRKEIQKQQDEHKRML; RKEIQKQQDEHKRMLQ;
KEIQKQQDEHKRMLQG; EIQKQQDEHKRMLQGS; IQKQQDEHKRMLQGSL;
QKQQDEHKRMLQGSLS; KQQDEHKRMLQGSLSF;

Fig. 33 continued

| | | |
|---|---|---|
| QQDEHKRMLQGSLSFL; | QDEHKRMLQGSLSFLS; | DEHKRMLQGSLSFLSG; |
| EHKRMLQGSLSFLSGE; | HKRMLQGSLSFLSGES; | KRMLQGSLSFLSGESG; |
| RMLQGSLSFLSGESGE; | MLQGSLSFLSGESGEL; | LQGSLSFLSGESGELK; |
| QGSLSFLSGESGELKD; | GSLSFLSGESGELKDT; | SLSFLSGESGELKDTI; |
| LSFLSGESGELKDTIE; | SFLSGESGELKDTIES; | FLSGESGELKDTIESE; |
| LSGESGELKDTIESNE; | SGESGELKDTIESNEI; | GESGELKDTIESNEID; |
| ESGELKDTIESNEIDF; | SGELKDTIESNEIDFT; | GELKDTIESNEIDFTT; |
| ELKDTIESNEIDFTTD; | LKDTIESNEIDFTTDS; | KDTIESNEIDFTTDSD; |
| DTIESNEIDFTTDSDL; | TIESNEIDFTTDSDLR; | IESNEIDFTTDSDLRL; |
| ESNEIDFTTDSDLRLK; | SNEIDFTTDSDLRLKS; | NEIDFTTDSDLRLKSD; |
| EIDFTTDSDLRLKSDI; | IDFTTDSDLRLKSDIQ; | DFTTDSDLRLKSDIQA; |
| FTTDSDLRLKSDIQAI; | TTDSDLRLKSDIQAIS; | TDSDLRLKSDLQAISG; |
| DSDLRLKSDLQAISGG; | SDLRLKSDIQATSGGN; | DLRLKSDIQATSGGNS; |
| LRLKSDLQATSGGNST; | RLKSDLQATSGGNSTS; | LKSDLQATSGGNSTSY; |
| KSDLQAISGSKSISYT; | SDLQAISGSKSISYTD; | DLQAISGSKSISYTDE; |
| LQAISGSKSISYTDEI; | QAISGSKSISYTDEIE; | AISGSKSISYTDEIEE; |
| ISGGNSTSYTDEIEEE; | SGSNSTSYTDEIEEED; | GSNSTSYTDEIEEEDY; |
| SNSTSYTDEIEEEDYD; | NSTSYTDEIEEEDYDQ; | STSYTDEIEEEDYDQY; |
| ISYTDEIEEEDYDQYS; | SYTDEIEEEDYDQYSL; | YTDEIEEEDYDQYSLE; |
| TDEIEEEDYDQYSLEE; | DEIEEEDYDQYSLEED; | EIEEEDYDQYSLEEDY; |
| IEEEDYDQYSLEEDYY; | EEEDYDQYSLEEDYYY; | EEDYDQYSLEEDYYYD; |
| EDYDQYSLEEDYYYDG; | DYDQYSLEEDYYYDGE; | YDQYSLEEDYYYDGET; |
| DQYSLEEDYYYDGETR; | QYSLEEDYYYDGETRL; | YSLEEDYYYDGETRLS; |
| SLEEDYYYDGETRLSR; | LEEDYYYDGETRLSRY; | EEDYYYDGETRLSRYE; |
| EDYYYDGETRLSRYES; | DYYYDGETRLSRYESY; | YYYDGETRLSRYESY; |
| YYDGETRLSRYESYLE; | YDGETRLSRYESYLE; | DGETRLSRYESYLEG; |
| GETRLSRYESYLEGV; | ETRLSRYESYLEGVK; | TRLSRYESYLEGVKY; |
| RLSRYESYLEGVKYN; | LSRYESYLEGVKYNV; | SRYESYLEGVKYNVS; |
| NRYESYLEGVKYNVSS; | RYESYLEGVKYNVSSA; | YESYLEGVKYNVSSAT; |
| ESYLEGVKYNVSSAIK; | SYLEGVKYNVSSAIKT; | YLEGVKYNVSSAIKTI; |
| LEGVKYNVSSAIKTIV; | EGVKYNVSSAIKTIVK; | GVKYNVSSAIKTIVKT; |
| VKYNVSSAIKTIVKTY; | KYNVSSAIKTIVKTYD; | YNVSSAIKTIVKTYDN; |
| NVSSAIKTIVKTYDNY; | VSSAIKTIVKTYDNYT; | SSAIKTIVKTYDNYTL; |
| SAIKTIVKTYDNYTLL; | AIKTIVKTYDNYTLLS; | IKTIVKTYDNYTLLST; |
| KTIVKTYDNYTLLSTK; | TIVKTYDNYTLLSTKQ; | IVKTYDNYTLLSTKQT; |
| VKTYDNYTLLSTKQTQ; | KTYDNYTLLSTKQTQM; | TYDNYTLLSTKQTQMY; |
| YDNYTLLSTKQTQMYS; | DNYTLLSTKQTQMYST; | NYTLLSTKQTQMYSTR; |
| YTLLSTKQTQMYSTRL; | TLLSTKQTQMYSTRLD; | LLSTKQTQMYSTRLDN; |
| LSTKQTQMYSTRLDNL; | STKQTQMYSTRLDNLA; | TKQTQMYSTRLDNLAK; |
| KQTQMYSTRLDNLAKA; | QTQMYSTRLDNLAKAK; | TQMYSTRLDNLAKAKA; |
| QMYSTRLDNLAKAKAR; | MYSTRLDNLAKAKARE; | YSTRLDNLAKAKAREE; |
| STRLDNLAKAKAREEA; | TRLDNLAKAKAREEAK; | RLDNLAKAKAREEAKK; |
| LDNLAKAKAREEAKKF; | DNLAKAKAREEAKKFT; | NLAKAKAREEAKKFTK; |
| LAKAKAREEAKKFTKE; | AKAKAREEAKKFTKEE; | KAKAREEAKKFTKEEL; |
| AKAREEAKKFTKEELE; | KAREEAKKFTKEELEK; | AREEAKKFTKEELEKD; |
| REEAKKFTKEELEKDL; | EEAKKFTKEELEKDLK; | EAKKFTKEELEKDLKT; |
| AKKFTKEELEKDLKTI; | KKFTKEELEKDLKTIL; | KFTKEELEKDLKTLLN; |
| FTKEELEKDLKTLLNY; | TKEELEKDLKTLLNYI; | KEELEKDLKTLLNYIQ; |
| EELEKDLKTLLNYIQV; | ELEKDLKTLLNYIQVS; | LEKDLKTLLNYIQVSA; |
| EKDLKTLLNYIQVSAR; | KDLKTLLNYIQVSART; | DLKTLLNYIQVSARTA; |
| LKTLLNYIQVSARTAT; | KTLLNYIQVSARTATN; | TLLNYIQVSARTATNF; |

Fig. 33 continued

| | |
|---|---|
| | LLNYIQVSARTATNFV; LNYIQVSARTATNFVY; NYIQVSARTATNFVYA; YIQVSARTATNFVYAR; IQVSARTATNFVYARE; QVSARTATNFVYAREI; VSARTATNFVYAREIY; SARTATNFVYAREIYS; ARTATNFVYAREIYSK; RTATNFVYAREIYSKR; TATNFVYAREIYSKRK; ATNFVYAREIYSKRKL; TNFVYAREIYSKRKLD; NFVYAREIYSKRKLDA; FVYAREIYSKRKLDAI; VYAREIYSKRKLDAIE; YAREIYSKRKLDAIET; AREIYSKRKLDAIETE; REIYSKRKLDAIETEI; EIYSKRKLDAIETEIK; IYSKRKLDAIETEIKN; YSKRKLDAIETEIKNL; SKRKLDAIETEIKNLI; KRKLDAIETEIKNLIL; RKLDAIETEIKNLILK; KLDAIETEIKNLILKI; LDAIETEIKNLILKIK; DAIETEIKNLILKIKG; AIETEIKNLILKIKGQ; IETEIKNLILKIKGQS; ETEIKNLILKIKGQSD; TEIKNLILKIKGQSDL; EIKNLILKIKGQSDLY; IKNLILKIKGQSDLYE; KNLILKIKGQSDLYEA; NLILKIKGQSDLYEAY; LILKIKGQSDLYEAYK; ILKIKGQSDLYEAYKA; LKIKGQSDLYEAYKAI; KIKGQSDLYEAYKAIV; IKGQSDLYEAYKAIVR; KGQSDLYEAYKAIVRS; GQSDLYEAYKAIVRSI; QSDLYEAYKAIVRSIL; SDLYEAYKAIVRSILL; DLYEAYKAIVRSILLM; LYEAYKAIVRSILLMK; YEAYKAIVRSILLMKD; EAYKAIVRSILLMKDS; AYKAIVRSILLMKDSL; YKAIVRSILLMKDSLK; KAIVRSILLMKDSLKI; AIVRSILLMKDSLKII; IVRSILLMKDSLKIIE; VRSILLMKDSLKIIEI; RSILLMKDSLKIIEIV; SILLMKDSLKIIEIVI; ILLMKDSLKIIEIVID; LLMKDSLKIIEIVIDK; LMKDSLKIIEIVIDKN; MKDSLKIIEIVIDKNG; KDSLKIIEIVIDKNGV; DSLKIIEIVIDKNGVW; SLKIIEIVIDKNGVWY; |
| SEQ ID NO:44 SEQ ID NO: 123765-125370 | 13 mers: MKKVKSKYLALGL; KKVKSKYLALGLL; KVKSKYLALGLLF; VKSKYLALGLLFG; KSKYLALGLLFGF; SKYLALGLLFGFI; KYLALGLLFGFIS; YLALGLLFGFISC; LALGLLFGFISCD; ALGLLFGFISCDL; LGLLFGFISCDLF; GLLFGFISCDLFI; LLFGFISCDLFIR; LFGFISCDLFIRY; FGFISCDLFIRYE; GFISCDLFIRYEM; FISCDLFIRYEMK; ISCDLFIRYEMKE; SCDLFIRYEMKEE; CDLFIRYEMKEES; DLFIRYEMKEESP; LFIRYEMKEESPG; FIRYEMKEESPGL; IRYEMKEESPGLF; RYEMKEESPGLFD; YEMKEESPGLFDK; EMKEESPGLFDKG; MKEESPGLFDKGN; KEESPGLFDKGNS; EESPGLFDKGNSI; ESPGLFDKGNSIL; SPGLFDKGNSILE; PGLFDKGNSILET; GLFDKGNSILETS; LFDKGNSILETSE; FDKGNSILETSEE; DKGNSILETSEES; KGNSILETSEESI; GNSILETSEESIK; NSILETSEESIKK; SILETSEESIKKP; ILETSEESIKKPM; LETSEESIKKPMN; ETSEESIKKPMNK; TSEESIKKPMNKK; SEESIKKPMNKKG; EESIKKPMNKKGK; ESIKKPMNKKGKG; SIKKPMNKKGKGK; IKKPMNKKGKGKI; KKPMNKKGKGKIA; KPMNKKGKGKIAR; PMNKKGKGKIARK; MNKKGKGKIARKN; NKKGKGKIARKNG; KKGKGKIARKNGK; KGKGKIARKNGKS; GKGKIARKNGKSK; KGKIARKNGKSKV; GKIARKNGKSKVS; KIARKNGKSKVSG; IARKNGKSKVSGK; ARKNGKSKVSGKE; RKNGKSKVSGKEP; KNGKSKVSGKEPF; NGKSKVSGKEPFI; GKSKVSGKEPFIH; KSKVSGKEPFIHS; SKVSGKEPFIHSF; KVSGKEPFIHSFK; VSGKEPFIHSFKR; SGKEPFIHSFKRD; GKEPFIHSFKRDA; KEPFIHSFKRDAA; EPFIHSFKRDAAN; PFIHSFKRDAANK; FIHSFKRDAANKS; IHSFKRDAANKSN; |

Fig. 33 continued

ESFKRDAANKSNF; SFKRDAAKKSNFL; FKRDAAKKSNFLQ;
RRDAANKSNFLQK; RDAANKSNFLQKN; DAANKSNFLQKNV;
AANKSNFLQKNVM; ANKSNFLQKNVML; NKSNFLQKNVMLE;
KSNFLQKNVMLEE; SNFLQKNVMLEES; NFLQKNVMLEESL;
FLQKNVMLEESL; LQKNVMLEESLK; QKNVMLEESLKT;
KNVMLEESLKTE; KVMLEESLKTEL; VMLEESLKTELL;
MLEESLKTELLK; LEESLKTELLKE; EESLKTELLKEQ;
ESLKTELLKEQS; SLKTELLKEQSE; LKTELLKEQSEL;
LKTELLKEQSEFR; KTELLKEQSEFRK; TELLKEQSEFRKE;
ELLKEQ

| | | |
|---|---|---|
| TIRKIYDTYTLFS; | LRKIYDTYTLFST; | RKIYDTYTLFSTK; |
| KIYDTYTLFSTKL; | IYDTYTLFSTKLT; | YDTYTLFSTKLTQ; |
| DTYTLFSTKLTQM; | TYTLFSTKLTQMY; | YTLFSTKLTQMYS; |
| TLFSTKLTQMYST; | LFSTKLTQMYSTR; | FSTKLTQMYSTRL; |
| STKLTQMYSTRLD; | TKLTQMYSTRLDN; | KLTQMYSTRLDNL; |
| LTQMYSTRLDNLA; | TQMYSTRLDNLAK; | QMYSTRLDNLAKA; |
| MYSTRLDNLAKAK; | YSTRLDNLAKAKA; | STRLDNLAKAKAK; |
| TRLDNLAKAKAKE; | RLDNLAKAKAKEE; | LDNLAKAKAKEEA; |
| DNLAKAKAKEEAA; | NLAKAKAKEEAAK; | LAKAKAKEEAAKF; |
| AKAKAKEEAAKFT; | KAKAKEEAAKFTK; | AKAKEEAAKFTKE; |
| KAKEEAAKFTKED; | AKEEAAKFTKEDL; | KEEAAKFTKEDLE; |
| EEAAKFTKEDLEK; | EAAKFTKEDLEKN; | AAKFTKEDLEKNF; |
| AKFTKEDLEKNFK; | KFTKEDLEKNFKT; | FTKEDLEKNFKTL; |
| TKEDLEKNFKTLL; | KEDLEKNFKTLLN; | EDLEKNFKTLLNY; |
| DLEKNFKTLLNYI; | LEKNFKTLLNYIQ; | EKNFKTLLNYIQV; |
| KNFKTLLNYIQVS; | NFKTLLNYIQVSV; | FKTLLNYIQVSVK; |
| KTLLNYIQVSVKT; | TLLNYIQVSVKTA; | LLNYIQVSVKTAT; |
| LNYIQVSVKTATK; | NYIQVSVKTATKF; | YIQVSVKTATKFV; |
| IQVSVKTATKFVY; | QVSVKTATKFVYL; | VSVKTATKFVYLK; |
| SVKTATKFVYLKE; | VKTATKFVYLKEM; | KTATKFVYLKEMH; |
| TATKFVYLKEMHA; | ATKFVYLKEMHAK; | TKFVYLKEMHAKR; |
| KFVYLKEMHAKRK; | FVYLKEMHAKRKL; | VYLKEMHAKRKLE; |
| YLKEMHAKRKLEN; | LKEMHAKRKLENL; | KEMHAKRKLENLE; |
| EMHAKRKLENLEA; | MHAKRKLENLEAK; | HAKRKLENLEAKI; |
| AKRKLENLEAKIK; | KRKLENLEAKIKT; | RKLENLEAKIKTL; |
| KLENLEAKIKTLL; | LENLEAKIKTLLA; | ENLEAKIKTLLAK; |
| NLEAKIKTLLAKI; | LEAKIKTLLAKIK; | EAKIKTLLAKIKE; |
| AKIKTLLAKIKEK; | KIKTLLAKIKEKS; | IKTLLAKIKEKSN; |
| KTLLAKIKEKSNL; | TLLAKIKEKSNLY; | LLAKIKEKSNLYS; |
| LAKIKEKSNLYSA; | AKIKEKSNLYSAY; | KIKEKSNLYSAYK; |
| IKEKSNLYSAYKA; | KEKSNLYSAYKAI; | EKSNLYSAYKAIV; |
| KSNLYSAYKAIVS; | SNLYSAYKAIVSS; | NLYSAYKAIVSST; |
| LYSAYKAIVSSTL; | YSAYKAIVSSTLL; | SAYKAIVSSTLLM; |
| AYKAIVSSTLLMR; | YKAIVSSTLLMRD; | KAIVSSTLLMRDS; |
| ATVSSTLLMRDSL; | TVSSTLLMRDSLK; | VSSTLLMRDSLKE; |
| SSTLLMRDSLKEV; | STLLMRDSLKEVQ; | TLLMRDSLKEVQY; |
| LLMRDSLKEVQYA; | LMRDSLKEVQYAT; | MRDSLKEVQYATD; |
| RDSLKEVQYATDK; | DSLKEVQYATDKN; | SLKEVQYATDKNG; |
| LKEVQYATDKNGT; | KEVQYATDKNGTW; | EVQYATDKNGTWY; |
| VQYATDKNGTWYR; | QYATDKNGTWYRK; | YATDKNGTWYRKL; |
| ATDKNGTWYRKLD; | TDKNGTWYRKLDA; | DKNGTWYRKLDAI; |
| KNGTWYRKLDAIE; | NGTWYRKLDAIET; | GTWYRKLDAIETE; |
| TWYRKLDAIETET; | WYRKLDAIETETK; | YRKLDAIETETKN; |
| RKLDAIETETKNL; | KLDAIETETKNLI; | LDAIETETKNLIL; |
| DAIETETKNLILK; | AIETETKNLILKI; | IETETKNLILKIK; |
| ETETKNLILKIKG; | TETKNLILKIKGQ; | ETKNLILKIKGQS; |
| TKNLILKIKGQSD; | KNLILKIKGQSDL; | NLILKIKGQSDLY; |
| LILKIKGQSDLYE; | ILKIKGQSDLYEA; | LKIKGQSDLYEAY; |
| KIKGQSDLYEAYK; | IKGQSDLYEAYKA; | KGQSDLYEAYKAI; |
| GQSDLYEAYKAIV; | QSDLYEAYKAIVR; | SDLYEAYKAIVRS; |
| DLYEAYKAIVRST; | LYEAYKAIVRSTL; | YEAYKAIVRSTLL; |

Fig. 33 continued

HAYKAIVRSILLM; AYKAIVRSILLMK; YKAIVRSILLMKD;
KAIVRSILLMKDS; AIVRSILLMKDSL; IVRSILLMKDSLK;
VRSILLMKDSLKT; RSILLMKDSLKTT; SILLMKDSLKTTF;
ILLMKDSLKTTFT; LLMKDSLKTTFTV; LMKDSLKTTFTVT;
MKDSLKTTFTVTD; KDSLKTTFTVTDK; DSLKTTFTVTDKN;
SLKTTFTVTDKNG; LKTTFTVTDKNGV; KTTFTVTDKNGVY;
TTFTVTDKNGVVY;

14 mers:
MRKVKSKYLALGLL; KKVKSKYLALGLLF; KVKSKYLALGLLFG;
VKSKYLALGLLFGF; KSKYLALGLLFGFT; SKYLALGLLFGFTS;
KYLALGLLFGFTSC; YLALGLLFGFTSCD; LALGLLFGFTSCDL;
ALGLLFGFTSCDLF; LGLLFGFTSCDLFT; GLLFGFTSCDLFTR;
LLFGFTSCDLFTRY; LFGFTSCDLFTRYE; FGFTSCDLFTRYEM;
GFTSCDLFTRYEMK; FTSCDLFTRYEMKE; TSCDLFTRYEMKEE;
SCDLFTRYEMKEES; CDLFTRYEMKEESP; DLFTRYEMKEESPG;
LFTRYEMKEESPGL; FTRYEMKEESPGLF; TRYEMKEESPGLFD;
RYEMKEESPGLFDK; YEMKEESPGLFDKG; EMKEESPGLFDKGN;
MKEESPGLFDKGNS; KEESPGLFDKGNSI; EESPGLFDKGNSIL;
ESPGLFDKGNSILE; SPGLFDKGNSILET; PGLFDKGNSILETS;
GLFDKGNSILETSF; LFDKGNSILETSFS; FDKGNSILETSFSS;
DKGNSILETSFSSI; KGNSILETSFSSIK; GNSILETSFSSIKK;
NSILETSFSSIKKP; SILETSFSSIKKPM; ILETSFSSIKKPMK;
LETSFSSIKKPMKK; ETSFSSIKKPMKKG; TSFSSIKKPMKKGK;
SFSSIKKPMKKGKG; FSSIKKPMKKGKGK; SSIKKPMKKGKGKI;
SIKKPMKKGKGKIA; IKKPMKKGKGKIAR; KKPMKKGKGKIARK;
KPMKKGKGKIARKN; PMKKGKGKIARKNG; MKKGKGKIARKNGK;
KKGKGKIARKNGKS; KGKGKIARKNGKSK; GKGKIARKNGKSKV;
KGKIARKNGKSKVS; GKIARKNGKSKVSG; KIARKNGKSKVSGK;
IARKNGKSKVSGKE; ARKNGKSKVSGKEP; RKNGKSKVSGKEPF;
KNGKSKVSGKEPFT; NGKSKVSGKEPFTH; GKSKVSGKEPFTHS;
KSKVSGKEPFTHSF; SKVSGKEPFTHSFK; KVSGKEPFTHSFKR;
VSGKEPFTHSFKRD; SGKEPFTHSFKRDA; GKEPFTHSFKRDAA;
KEPFTHSFKRDAAN; EPFTHSFKRDAANK; PFTHSFKRDAANKS;
FTHSFKRDAANKSN; THSFKRDAANKSNF; HSFKRDAANKSNFL;
SFKRDAANKSNFLQ; FKRDAANKSNFLQK;
KRDAANKSNFLQKN; RDAANKSNFLQKKV; DAANKSNFLQKNVM;
AANKSNFLQKVML; ANKSNFLQKNVMLE; NKSNFLQKNVMLEE;
KSNFLQKVMLEEE; SNFLQKNVMLEEES; NFLQKNVMLEEESL;
FLQKNVMLEEESLK; LQKNVMLEEESLKT; QKNVMLEEESLKTE;
KNVMLEEESLKTEL; NVMLEEESLKTELL; VMLEEESLKTELLK;
MLEEESLKTELLKE; LEEESLKTELLKEQ; EEESLKTELLKEQS;
EESLKTELLKEQSF; ESLKTELLKEQSFT; SLKTELLKEQSFTR;
LKTELLKEQSFTRK; KTELLKEQSFTRKE; TELLKEQSFTRKEK;
ELLKEQSFTRKEKI; LLKEQSFTRKEKIQ; LKEQSFTRKEKIQK;
KEQSFTRKEKIQKQ; EQSFTRKEKIQKQD; QSFTRKEKIQKQDD;
SFTRKEKIQKQDEY; FTRKEKIQKQDEYK; TRKEKIQKQDEYKG;
RKEKIQKQDEYKGM; KEKIQKQDEYKGMT; EKIQKQDEYKGMTK;
KIQKQDEYKGMTK; IQKQDEYKGMTKG; QKQDEYKGMTKGS;
KQDEYKGMTKGSL; QDEYKGMTKGSLK; DEYKGMTKGSLKS;
EYKGMTKGSLNSL; YKGMTKGSLNSLS; KGMTKGSLNSLSG;

KGMTKGSLNSLSGESG; GMTKGSLKSLSGES; MTKGSLNSLSGESGE;
TKGSLNSLSGESGF; KGSLKSLSGESGEL; GSLNSLSGESGELK;
GSLNSLSGESGELKE; LNSLSGESGELKET; NSLSGESGELKETT;
SLSGESGELKETLE; LSGESGELKETLES; SGESGELKETLESN;
GESGELKETLESNE; ESGELKETLESNEL; SGELKETLESNELD;
GELKETLESNELDT; ELKETLESNELDTT; LKETLESNELDTTL;
KETLESNELDTTLD; ETLESNELDTTLDS; TLESNELDTTLDSD;
LESNELDTTLDSDL; ESNELDTTLDSDLR; SNELDTTLDSDLRP;
NELDTTLDSDLRPK; ELDTTLDSDLRPKS; LDTTLDSDLRPKSS;
DTTLDSDLRPKSSL; TTLDSDLRPKSSLQ; TLDSDLRPKSSLQD;
LDSDLRPKSSLQDT; DSDLRPKSSLQDTA; SDLRPKSSLQDTAG;
DLRPKSSLQDTAGS; LRPKSSLQDTAGSK; RPKSSLQDTAGSKS;
PKSSLQDTAGSNST; KSSLQDTAGSNSTS; SSLQDTAGSNSTSY;
SLQDTAGSNSTSYT; LQDTAGSNSTSYTD; QDTAGSNSTSYTDF;
DTAGSNSTSYTDFI; TAGSNSTSYTDFIE; AGSNSTSYTDFIEE;
GSNSTSYTDFIEEE; SNSTSYTDFIEEED; NSTSYTDFIEEEDY;
STSYTDFIEEEDYA; TSYTDFIEEEDYAR; SYTDFIEEEDYARY;
YTDFIEEEDYARYY; TDFIEEEDYARYYL; DFIEEEDYARYYLD;
FIEEEDYARYYLDE; IEEEDYARYYLDED; EEEDYARYYLDEDD;
EEDYARYYLDEDDE; EDYARYYLDEDDED; DYARYYLDEDDEDD;
YARYYLDEDDEDDE; ARYYLDEDDEDDEY; RYYLDEDDEDDEYY;
YYLDEDDEDDEYYE; YLDEDDEDDEYYED; LDEDDEDDEYYEDD;
DEDDEDDEYYEDDY; EDDEDDEYYEDDYE; DDEDDEYYEDDYEE;
DEDDEYYEDDYEEI; EDDEYYEDDYEEIR; DDEYYEDDYEEIRL;
DEYYEDDYEEIRLS; EYYEDDYEEIRLSN; YYEDDYEEIRLSNR;
YEDDYEEIRLSNRY; EDDYEEIRLSNRYQ; DDYEEIRLSNRYQS;
DYEEIRLSNRYQSY; YEEIRLSNRYQSYL; EEIRLSNRYQSYLE;
EIRLSNRYQSYLEG; IRLSNRYQSYLEGV; RLSNRYQSYLEGVK;
LSNRYQSYLEGVKY; SNRYQSYLEGVKYK; NRYQSYLEGVKYKV;
RYQSYLEGVKYKVD; YQSYLEGVKYKVDS; QSYLEGVKYKVDSA;
SYLEGVKYKVDSAI; YLEGVKYKVDSAIK; LEGVKYKVDSAIKT;
EGVKYKVDSAINTT; GVKYKVDSAINTTK; VKYKVDSAINTTKK;
KYKVDSAINTTKKY; YKVDSAINTTKKTY; KVDSAINTTKKTYD;
VDSAINTTKKIYDT; DSAINTTKKIYDTY; SAINTTKKIYDTYI;
AINTTKKIYDTYTL; INTTKKIYDTYTLF; NTTKKIYDTYTLFS;
TTKKIYDTYTLFST; TKKIYDTYTLFSTK; KKIYDTYTLFSTKL;
KIYDTYTLFSTKLT; IYDTYTLFSTKLTQ; YDTYTLFSTKLTQM;
DTYTLFSTKLTQMY; TYTLFSTKLTQMYS; YTLFSTKLTQMYST;
TLFSTKLTQMYSTR; LFSTKLTQMYSTRI; FSTKLTQMYSTRLD;
STKLTQMYSTRLDN; TKLTQMYSTRLDNL; KLTQMYSTRLDNLA;
LTQMYSTRLDNLAK; TQMYSTRLDNLAKA; QMYSTRLDNLAKAK;
MYSTRLDNLAKAKA; YSTRLDNLAKAKAK; STRLDNLAKAKAKE;
TRLDNLAKAKAKEE; RLDNLAKAKAKEEA; LDNLAKAKAKEEAA;
DNLAKAKAKEEAAK; NLAKAKAKEEAAKF; LAKAKAKEEAAKFT;
AKAKAKEEAAKFTK; KAKAKEEAAKFTKE; AKAKEEAAKFTKED;
KAKEEAAKFTKEDL; AKEEAAKFTKEDLE; KEEAAKFTKEDLEK;
EEAAKFTKEDLEKN; EAAKFTKEDLEKNF; AAKFTKEDLEKNFK;
AKFTKEDLEKNFKI; KFTKEDLEKNFKTL; FTKEDLEKNFKTLL;
TKEDLEKNFKTLLN; KEDLEKNFKTLLNY; EDLEKNFKTLLNYI;
DLEKNFKTLLNYIQ; LEKNFKTLLNYIQV; EKNFKTLLNYIQVS;
KNFKTLLNYIQVSV; NFKTLLNYIQVSVK; FKTLLNYIQVSVKT;

Fig. 33 continued

KTLKYIQVSVKTA; TLLKYIQVSVKTAT; LLKYIQVSVKTATN;
LKYIQVSVKTATNF; KYIQVSVKTATNFV; YIQVSVKTATNFVY;
IQVSVKTATNFVYI; QVSVKTATNFVYIN; VSVKTATNFVYINE;
SVKTATNFVYINEM; VKTATNFVYINEMH; KTATNFVYINEMHA;
TATNFVYINEMHAK; ATNFVYINEMHAKR; TNFVYINEMHAKRK;
NFVYINEMHAKRKL; FVYINEMHAKRKLE; VYINEMHAKRKLEN;
YINEMHAKRKLENI; INEMHAKRKLENIE; NEMHAKRKLENIEA;
EMHAKRKLENIEAK; MHAKRKLENIEAKI; HAKRKLENIEAKIK;
AKRKLENIEAKIKT; KRKLENIEAKIKTL; RKLENIEAKIKTLT;
KLENIEAKIKTLTA; LENIEAKIKTLTAK; ENIEAKIKTLTAKT;
NIEAKIKTLTAKTK; IEAKIKTLTAKTKE; EAKIKTLTAKTKEK;
AKIKTLTAKTKEKS; KIKTLTAKTKEKSN; IKTLTAKTKEKSNL;
KTLTA

| | | |
|---|---|---|
| RYMKEESPGLFDKG; | YEMKEESPGLFDKGE; | EMKEESPGLFDKGES; |
| MKEESPGLFDKGEST; | KEESPGLFDKGESTL; | EESPGLFDKGESTLP; |
| ESPGLFDKGESTLPT; | SPGLFDKGESTLPTS; | PGLFDKGESTLPTSF; |
| GLFDKGESTLPTSFF; | LFDKGESTLPTSFFS; | FDKGESTLPTSFFSI; |
| DKGESTLPTSFFSIK; | KGESTLPTSFFSIKK; | GESTLPTSFFSIKKP; |
| ESTLPTSFFSTKKPM; | STLPTSFFSTKKPMK; | TLPTSFFSTKKPMKK; |
| LPTSFFSTKKPMKKG; | PTSFFSTKKPMKKGK; | TSFFSTKKPMKKGK; |
| SFFSTKKPMKKGKG; | FFSTKKPMKKGKGK; | FSTKKPMKKGKGKT; |
| STKKPMKKGKGKTA; | TKKPMKKGKGKTAR; | KKPMKKGKGKTARK; |
| KPMKKGKGKTARKN; | PMKKGKGKTARKNG; | MKKGKGKTARKNGK; |
| NKKGKGKTARKNGKS; | KKGKGKTARKNGKSK; | KGKGKTARKNGKSKV; |
| GKGKTARKNGKSKVS; | KGKTARKNGKSKVSG; | GKTARKNGKSKVSGK; |
| KTARKNGKSKVSGKP; | TARKNGKSKVSGKPP; | ARKNGKSKVSGKPPT; |
| RKNGKSKVSGKPPT; | KNGKSKVSGKPPTHS; | NGKSKVSGKPPTHSF; |
| GKSKVSGKPPTHSF; | KSKVSGKPPTHSFK; | SKVSGKPPTHSFKR; |
| KVSGKPPTHSFKRD; | VSGKPPTHSFKRDA; | SGKPPTHSFKRDAA; |
| GKPPTHSFKRDAAN; | KPPTHSFKRDAANK; | PPTHSFKRDAANKS; |
| PTHSFKRDAANKSN; | THSFKRDAANKSNF; | HSFKRDAANKSNFL; |
| ESFKRDAANKSNFLQ; | SFKRDAANKSNFLQK; | FKRDAANKSNFLQKN; |
| KRDAANKSNFLQKNV; | RDAANKSNFLQKNVM; | DAANKSNFLQKNVML; |
| AANKSNFLQKNVMLE; | ANKSNFLQKNVMLEE; | NKSNFLQKNVMLEES; |
| KSNFLQKNVMLEESS; | SNFLQKNVMLEESSL; | NFLQKNVMLEESSLK; |
| FLQKNVMLEESLKT; | LQKNVMLEESLKTE; | QKNVMLEESLKTEL; |
| KNVMLEESLKTELL; | NVMLEESLKTELLK; | VMLEESLKTELLKE; |
| MLEESLKTELLKEQ; | LEESLKTELLKEQS; | EESLKTELLKEQSF; |
| EESLKTELLKEQSFT; | ESLKTELLKEQSETR; | SLKTELLKEQSETRK; |
| LKTELLKEQSETRKE; | KTELLKEQSETRKEK; | TELLKEQSETRKEKI; |
| ELLKEQSETRKEKT; | LLKEQSETRKEKTQ; | LKEQSETRKEKTQK; |
| EQSETRKEKTQKQ; | QSETRKEKTQKQD; | SETRKEKTQKQDF; |
| SETRKEKIQKQDFY; | ETRKEKIQKQDFYK; | TRKEKIQKQDFYKG; |
| RKEKIQKQDFYKGM; | KEKIQKQDFYKGMT; | EKIQKQDFYKGMTK; |
| KIQKQDFYKGMTKG; | IQKQDFYKGMTKGS; | QKQDFYKGMTKGSL; |
| KQQDFYKGMTKGSLN; | QQDFYKGMTKGSLNS; | QDFYKGMTKGSLNSL; |
| DFYKGMTKGSLNSLS; | FYKGMTKGSLNSLSG; | YKGMTKGSLNSLSGE; |
| KGMTKGSLNSLSGFS; | GMTKGSLNSLSGFSG; | MTKGSLNSLSGFSGF; |
| TKGSLNSLSGFSGFL; | KGSLNSLSGFSGFLK; | GSLNSLSGFSGFLKE; |
| SLNSLSGFSGFLKET; | LNSLSGFSGFLKETT; | NSLSGFSGFLKETTE; |
| SLSGFSGFLKETTES; | LSGFSGFLKETTESK; | SGFSGFLKETTESKE; |
| GFSGFLKETTESKET; | FSGFLKETTESKETD; | SGFLKETTESKETDT; |
| GFLKETTESKETDTT; | FLKETTESKETDTTT; | LKETTESKETDTTTD; |
| KETTESKETDTTTDS; | ETTESKETDTTTDSD; | TTESKETDTTTDSDL; |
| TESKETDTTTDSDLR; | ESKETDTTTDSDLRP; | SKETDTTTDSDLRPK; |
| KETDTTTDSDLRPKS; | ETDTTTDSDLRPKSS; | TDTTTDSDLRPKSSL; |
| DTTTDSDLRPKSSLQ; | TTTDSDLRPKSSLQD; | TTDSDLRPKSSLQDI; |
| TDSDLRPKSSLQDIA; | DSDLRPKSSLQDIAG; | SDLRPKSSLQDIAGS; |
| DLRPKSSLQDIAGSN; | LRPKSSLQDIAGSNS; | RPKSSLQDIAGSNST; |
| PKSSLQDIAGSNSTS; | KSSLQDIAGSNSTSY; | SSLQDIAGSNSTSYT; |
| SLQDIAGSNSTSYTD; | LQDIAGSNSTSYTDE; | QDIAGSNSTSYTDEL; |
| DIAGSNSTSYTDELF; | IAGSNSTSYTDELFE; | AGSNSTSYTDELFEE; |
| GSNSTSYTDELFEED; | SNSTSYTDELFEEDY; | NSTSYTDELFEEDYA; |
| STSYTDELFEEDYAR; | TSYTDELFEEDYARY; | SYTDELFEEDYARYV; |

| Antigen designation | HLA-chain Class 2 | Amino acid sequence 15 mer peptide | 9mer core peptide |
|---|---|---|---|
| NP_212517.1 Basic membrane protein A (bmpA) [Borrelia burgdorferi B31 Seq1 | HLA-DRB1*0101 | GSFADLEAGRSVATR | LEAGRSVAT |
| | | IGSFADLEAGRSVAT | FADLEAGRS |
| | | FADLEAGRSVATRMY | LEAGRSVAT |
| | | SFADLEAGRSVATRM | LEAGRSVAT |
| | | ADLEAGRSVATRMYS | LEAGRSVAT |
| | | AFLTGYIAAKLSKTG | YIAAKLSKT |
| | | FLTGYIAAKLSKTGK | IAAKLSKTG |
| | | LTGYIAAKLSKTGKI | IAAKLSKTG |
| | | TGYIAAKLSKTGKIG | IAAKLSKTG |
| | | DLEAGRSVATRMYSD | LEAGRSVAT |
| | | LEAGRSVATRMYSDE | LEAGRSVAT |
| | | GAFLTGYIAAKLSKT | LTGYIAAKL |
| | | GYIAAKLSKTGKIGF | IAAKLSKTG |
| | | IHHAAGLGGIGAIEV | IHHAAGLGG |
| | | LVGMTFRAQEGAFLT | FRAQEGAFL |
| | | NLVGMTFRAQEGAFL | LVGMTFRAQ |
| | | HHAAGLGGIGAIEVA | LGGIGAIEV |
| | | HAAGLGGIGAIEVAK | LGGIGAIEV |
| | | AAGLGGIGAIEVAKE | LGGIGAIEV |
| | | AGLGGIGAIEVAKEL | LGGIGAIEV |
| | | EGAFLTGYIAAKLSK | LTGYIAAKL |
| | | YIAAKLSKTGKIGFL | IAAKLSKTG |
| | | GMTFRAQEGAFLTGY | FRAQEGAFL |
| | | QEGAFLTGYIAAKLS | LTGYIAAKL |
| | | EKEIDNLSSKIINKE | IDNLSSKII |
| | | LEKEIDNLSSKIINK | IDNLSSKII |
| | | KEIDNLSSKIINKEI | IDNLSSKII |
| | | MTFRAQEGAFLTGYI | FRAQEGAFL |
| | | ELEKEIDNLSSKIIN | IDNLSSKII |
| | | VGMTFRAQEGAFLTG | FRAQEGAFL |
| | | FELEKEIDNLSSKII | FELEKEIDN |
| | | DMKYAIIDPIYSNDP | YAIIDPIYS |
| | | MKYAIIDPIYSNDPI | YAIIDPIYS |
| | | DPIPANLVGMTFRAQ | IPANLVGMT |
| | | TQYIGSFADLEAGRS | IGSFADLEA |
| | | QYIGSFADLEAGRSV | FADLEAGRS |
| | | YIGSFADLEAGRSVA | FADLEAGRS |
| | | IPANLVGMTFRAQEG | LVGMTFRAQ |
| | | PANLVGMTFRAQEGA | LVGMTFRAQ |
| | | PIPANLVGMTFRAQE | LVGMTFRAQ |
| | | AQEGAFLTGYIAAKL | FLTGYIAAK |
| | | SDLIWLIGYRFSDVA | LIWLIGYRF |
| | | ANLVGMTFRAQEGAF | LVGMTFRAQ |
| | | GSDLIWLIGYRFSDV | LIWLIGYRF |
| | | VAKVAALQNPDMKYA | VAALQNPDM |
| | | DAGSDLIWLIGYRFS | LIWLIGYRF |
| | | AGSDLIWLIGYRFSD | LIWLIGYRF |
| | | IDIIHHAAGLGGIGA | IHHAAGLGG |
| | | PDMKYAIIDPIYSND | YAIIDPIYS |
| | | NPDMKYAIIDPIYSN | YAIIDPIYS |
| | | AKVAALQNPDMKYAI | LQNPDMKYA |
| | | QNPDMKYAIIDPIYS | MKYAIIDPI |

| | | | |
|---|---|---|---|
| | | FSDVAKVAALQNPDM | VAKVAALQN |
| | | FTDTTHHAAGLGGTG | THHAAGLGG |
| | | DFTDTTHHAAGLGGT | THHAAGLGG |
| | | SDVAKVAALQNPDMK | VAKVAALQN |
| | | SDTDTTHHAAGLGGT | THHAAGLGG |
| | | YLAPDNVTTSTTKDV | YLAPDNVTT |
| | | DPTYSNDPTPANLVG | NDPTPANLV |
| | | TDPTYSNDPTPANLV | TYSNDPTPA |
| | | LTKTTGYRFSDVAKV | LTKTTGYRF |
| | | VAALQNPDMKYATTD | LQNPDMKYA |
| | | KVAALQNPDMKYATT | LQNPDMKYA |
| | | DTTHHAAGLGGTGAT | THHAAGLGG |
| | | GYRFSDVAKVAALQN | YRFSDVAKV |
| | | YRFSDVAKVAALQNP | VAKVAALQN |
| | | YATTDPTYSNDPTPA | YATTDPTYS |
| | | TFRAQEGAFLTGYTA | FRAQEGAFL |
| | | KDAGSDLTKTTGYRF | GSDLTKTTG |
| | | GLGGTGATFVAKFLG | LGGTGATFV |
| | | TYSNDPTPANLVGMT | NDPTPANLV |
| | | LGGTGATFVAKFLGS | LGGTGATFV |
| | | TAAKLSKTGKTGFLG | TAAKLSKTG |
| | | GSGKGSLGSFIPKVS | KGSLGSFIP |
| | | FRAQEGAFLTGYTAA | FRAQEGAFL |
| | | FTYSNDPTPANLVGS | YSNDPTPAN |
| | | DQAYLAPDNVTTSTT | YLAPDNVTT |
| | | LAPDNVTTSTTKDVG | VTTSTTKDV |
| | | QAYLAPDNVTTSTTK | YLAPDNVTT |
| | | AALQNPDMKYATTDP | LQNPDMKYA |
| | | DLIWLIGYRFSDVAK | LIWLIGYRF |
| | | PDNVTTSTTKDVGRA | VTTSTTKDV |
| | | SGKGSLGSFIPKVSL | LGSFIPKVS |
| | | LSDLEGLRDAGSDLT | LEGLRDAGS |
| | | RFSDVAKVAALQNPD | VAKVAALQN |
| | | KYATTDPTYSNDPTP | YATTDPTYS |
| | | APDNVTTSTTKDVGR | VTTSTTKDV |
| | | ATTDPTYSNDPTPAN | TYSNDPTPA |
| | | SDLEGLRDAGSDLTK | LRDAGSDLT |
| | | KGSLGSFIPKVSLTT | LGSFIPKVS |
| | | F

|  |  | LEGLKDAGSDLIWLL | LKDAGSDLI |
|---|---|---|---|
|  |  | NKTLLTLLESTVFL | LTLLESTVF |
|  |  | ILDPIYONDPIPANL | IYSNDPIPA |
|  |  | EGLKDAGSDIWLTG | LKDAGSDLI |
|  |  | AGARYANRDLKISLQ | YANRDLKIS |
|  |  | THHAAGLGGTGATE | THHAAGLGG |
|  |  | FAGARYANRDIKTST | YANRDIKTS |
|  |  | GARYANRDIKTSTQY | YANRDIKTS |
|  |  | FKLTCYRFSDVAKVA | YRFSDVAKV |
|  |  | LTCYRFSDVAKVAAL | YRFSDVAKV |
|  |  | DLTCYRFSDVAKVAA | YRFSDVAKV |
|  |  | GGKLTNYGLKEGVVG | LTNYGLKEG |
|  |  | GKLTNYGLKEGVVGF | YGLKEGVVG |
|  |  | KTLLTLLESTVFLS | LTLLESTVF |
|  |  | FKLVLKESSNSYLS | LKESSNSY |
|  |  | KTFLVLKESSNSYL | LKESSNSY |
|  |  | VGRALNIFTSNHLKT | LNIFTSNHL |
|  |  | FKTFLVLKESSNSY | LVLKESSN |
|  |  | KLTNYGLKEGVVGFV | YGLKEGVVG |
|  |  | TLLTLLESTVFLSG | LTLLESTVF |
|  |  | GRALNIFTSNHLKTN | LNIFTSNHL |
|  |  | LTNYGLKEGVVGFVR | YGLKEGVVG |
|  |  | DVGRALNIFTSNHLK | LNIFTSNHL |
|  |  | NDPIPANLVGKIFRA | IPANLVGKI |
|  |  | DKSFNESALNGVKKV | FNESALNGV |
|  |  | RALNIFTSNHLKTNT | LNIFTSNHL |
|  |  | GFVRNPKMLSFELEK | VRNPKMLSF |
|  |  | ELVLKESSNSYLSD | LKESSNSY |
|  |  | SNDPIPANLVGKIFR | IPANLVGKI |
|  |  | DDKSFNESALNGVKK | FNESALNGV |
|  |  | LLTLLESIVFLSCS | LLLESIVF |
|  |  | AYLAPDNVITSTTKD | YLAPDNVIT |
|  |  | ALQNPDKKYALIDPI | LQNPDKKYA |
|  |  | FDDKSFNESALNGVK | FNESALNGV |
|  |  | TFDDKSFNESALNGV | SFNESALNG |
|  |  | LQNPDKKYALIDPIS | LQNPDKKYA |
|  |  | TKDVGRALNIFTSNH | VGRALNIFT |
|  |  | TIKDVGRALNIFTSN | VGRALNIFT |
|  |  | KEGVVGFVRNPKMTS | VGFVRNPKM |
|  |  | SIVFLSCSGKGSLGS | FLSCSGKSS |
|  |  | YSDFTDTTHHAAGLG | FTDTTHHAA |
|  |  | TNYGLKEGVVGFVRN | YGLKEGVVG |
|  |  | STTKDVGRALNIFTS | VGRALNIFT |
|  | HLA-DRB1*0301 | None |  |
|  | HLA-DRB1*0401 | FKLELVLKESSNSY | VLKESSNS |
|  |  | LELVLKESSNSYLS | LKESSNSY |
|  |  | ELVLKESSNSYLSD | LKESSNSY |
|  |  | KLELVLKESSNSYL | LKESSNSY |
|  |  | LVLKESSNSYLSDT | LKESSNSY |
|  |  | KLINKEIIVPSKES | INKEIIVPS |
|  |  | SKTINKEIIVPSKE | INKEIIVPS |
|  |  | CCKLINKEIIVPSNK | INKEIIVPS |
|  |  | LSSKTINKEIIVPSN | INKEIIVPS |
|  |  | NLSSKTINKEIIVPS | LSSKTINKE |
|  |  | EGVVGFVRNPKMTSF | FVRNPKMTS |
|  |  | KEGVVGFVRNPKMTS | VVGFVRNPK |

Fig. 34 continued

|  |  | ISYELKKIDNLCSK | LKKIDNLS |
|---|---|---|---|
|  |  | MTSFELKKIDNLSS | LKKIDNLS |
|  |  | GVVGFVRNPKMISFE | FVRNPKMIS |
|  |  | FFIFKKIDNLSSKI | LKKIDNLS |
|  |  | SFELKKIDNLSSKL | LKKIDNLS |
|  |  | AIIDPIYSNDPIPAN | IYSNDPIPA |
|  |  | VVGFVRNPKMTSFEL | FVRNPKMIS |
|  |  | VGFVRNPKMTSFELK | FVRNPKMIS |
|  |  | IIDPIYSNDPIPANL | IYSNDPIPA |
|  |  | IDPIYSNDPIPANLV | IYSNDPIPA |
|  |  | KMTSFELKKIDNLS | MTSFELKK |
|  |  | DPIYSNDPIPANLVG | IYSNDPIPA |
|  |  | VLKESSNSYLSDLK | LKESSNSY |
|  |  | LKESSNSYLSDLG | LKESSNSY |
|  |  | RALNIFTSNLKTNT | LNIFTSNH |
|  |  | GRALNIFTSNHLKTN | LNIFTSNH |
|  |  | VGRALNIFTSNHLKT | LNIFTSNH |
|  |  | INKEIIVPSLKESY | INKEIIVPS |
|  |  | KDVGRALNIFTSNH | VGRALNIFT |
|  |  | INKEIIVPSNKESYE | INKEIIVPS |
|  |  | DVGRALNIFTSNHLK | LNIFTSNH |
|  |  | YALIDPIYSNDPIPA | IDPIYSNDP |
|  | HLA-DRB1*0404 | VGRALNIFTSNHLKT | ALNIFTSNH |
|  |  | GRALNIFTSNHLKTN | ALNIFTSNH |
|  |  | KDVGRALNIFTSNHL | ALNIFTSNH |
|  |  | DVGRALNIFTSNHLK | ALNIFTSNH |
|  |  | TKDVGRALNIFTSNH | VGRALNIFT |
|  |  | RALNIFTSNHLKTNI | ALNIFTSNH |
|  |  | ALNIFTSNHLKTNIS | ALNIFTSNH |
|  |  | FKLELVLKESSNSY | VLKESSNS |
|  |  | KLELVLKESSNSYL | VLKESSNS |
|  |  | LELVLKESSNSYLS | VLKESSNS |
|  |  | ELVLKESSNSYLSD | VLKESSNS |
|  | HLA-DRB1*0405 | AIIDPIYSNDPIPAN | IYSNDPIPA |
|  |  | IIDPIYSNDPIPANL | YSNDPIPAN |
|  |  | IDPIYSNDPIPANLV | YSNDPIPAN |
|  |  | DPIYSNDPIPANLVG | YSNDPIPAN |
|  |  | PIYSNDPIPANLVGM | YSNDPIPAN |
|  |  | KIINKEIIVPSNKES | EIIVPSNKE |
|  |  | KEGVVGFVRNPKMS | VVGFVRNPK |
|  |  | EGVVGFVRNPKMTSF | FVRNPKMIS |
|  |  | IYSNDPIPANLVGMI | YSNDPIPAN |
|  |  | INKEIIVPSNKESYE | EIIVPSNKE |
|  |  | SKIINKEIIVPSNKE | INKEIIVPS |
|  |  | GVVGFVRNPKMTSFE | FVRNPKMIS |
|  |  | IINKEIIVPSNKESY | EIIVPSNKE |
|  | HLA-DRB1*0701 | VGRALNIFTSNHLKT | LNIFTSNH |
|  |  | GRALNIFTSNHLKTN | LNIFTSNH |
|  |  | DVGRALNIFTSNHLK | LNIFTSNH |
|  |  | KDVGRALNIFTSNH | ALNIFTSNH |
|  |  | RALNIFTSNHLKTNI | LNIFTSNH |
|  |  | LAPDNVITSTTKDVG | VITSTTKDV |
|  |  | APDNVITSTTKDVGR | VITSTTKDV |
|  |  | PDNVITSTTKDVGRA | VITSTTKDV |
|  |  | DNVITSTTKDVGRAL | VITSTTKDV |
|  | HLA-DRB1*0802 | None |  |

Fig. 34 continued

| | HLA-DRB1*0901 | WLIGYRFSDVAKVAA | YRFSDVAKV |
| | | LIGYRFSDVAKVAAL | YRFSDVAKV |
| | | IGYRFSDVAKVAALQ | YRFSDVAKV |
| | | LEGLKDAGSDLTWL | LKDAGSDLT |
| | | GASLTGYLAAKLSKI | LTGYLAAKL |
| | | DLEGLKDAGSDLTWL | LKDAGSDLT |
| | | SDLEGLKDAGSDLTW | LKDAGSDLT |
| | | LSDLEGLKDAGSDLT | LEGLKDAGS |
| | | LTWLTGYRFSDVAKV | LTGYRFSDV |
| | | EGLKDAGSDLTWLTG | LKDAGSDLT |
| | | TWLTGYRFSDVAKVA | YRFSDVAKV |
| | | APLTGYLAAKLSKTG | YLAAKLSKT |
| | HLA-DRB1*1101 | GSDLTWLTGYRFSDV | LTWLTGYRF |
| | | SDLTWLTGYRFSDVA | LTWLTGYRF |
| | | AGSDLTWLTGYRFSD | LTWLTGYRF |
| | | DAGSDLTWLTGYRFS | LTWLTGYRF |
| | | PTPANLVGMTFRAQF | LVGMTFRAQ |
| | | PANLVGMTFRAQFGA | LVGMTFRAQ |
| | | TPANLVGMTFRAQFG | LVGMTFRAQ |
| | | DLTWLTGYRFSDVAK | LTWLTGYRF |
| | | ANLVGMTFRAQFGAF | LVGMTFRAQ |
| | | DPTPANLVGMTFRAQ | PANLVGMTF |
| | HLA-DRB1*1302 | KYANKDIKLSTQYIG | YANKDIKLS |
| | | NLSSKITNKETTVPS | TNKETTVP |
| | | LSSKIINKETIVPSN | INKEIIVPS |
| | | YANKDIKLSTQYIGS | IKLSTQYIG |
| | | SSKIINKEIIVPSNK | IINKEIIVP |
| | | SKIINKEIIVPSNKE | IINKEIIVP |
| | | ANKDIKLSTQYIGSS | IKLSTQYIG |
| | | NKDIKLSTQYIGSSA | IKLSTQYIG |
| | | KDIKLSTQYIGSSAD | IKLSTQYIG |
| | | VGRALNIFTSNHLKT | LNIFTSNHL |
| | | KIINKEIIVPSNKES | INKEIIVPS |
| | | EGVVGFVRNPKMTSF | FVRNPKMTS |
| | | MKILLLLLESIVFL | ILLLLLES |
| | | KEVGRALNIFTSNHL | VGRALNIFT |
| | | SNLSSKIINKEIIVP | LSSKIINKE |
| | | RALNIFTSNHLKTNI | LNIFTSNHL |
| | | KEGVVGFVRNPKMTS | VGFVRNPKM |
| | | NKILLLLLESIVFL | ILLLLLES |
| | | GVVGFVRNPKMTSFR | FVRNPKMTS |
| | | GRALNIFTSNHLKTN | LNIFTSNHL |
| | | SSKLTNYGLKEGVVG | LTNYGLKEG |
| | | VVGFVRNPKMTSFRL | FVRNPKMTS |
| | | DVGRALNIFTSNHLK | LNIFTSNHL |
| | | TLLLTLLFSTVPLSG | LFLFSTVF |
| | | FTLLLTLLFSTVPLS | TLLLTLLFS |
| | | ELEKETDNLSSKITN | TDNLSSKIT |
| | | SKLTNYGLKEGVVGF | LTNYGLKEG |
| | | LEKETDNLSSKITNK | TDNLSSKIT |
| | | EKETDNLSSKITNKE | TDNLSSKIT |
| | | KETDNLSSKITNKET | TDNLSSKIT |
| | | FELEKETDNLSSKIT | LEKETDNLS |
| | | TNKETTVPSNKESY | TNKETTVP |
| | | ALNIFTSNGLKTNTF | LNIFTSNHL |
| | | LNIFTSNHLKTNTFF | LNIFTSNHL |
| | | VGFVRNPKMTSFRLF | FVRNPKMTS |

Fig. 34 continued

| | | | |
|---|---|---|---|
| | | TDNLSSKIINKEILV | TDNLSSKII |
| | | DTKTSTQYTGSFADL | TKTSTQYTG |
| | | KLTNYGLKEGVVGFV | YGLKEGVVG |
| | | FTDNLSSKIINKEII | TDNLSSKII |
| | | FGGKLTNYGLKEGV | LTNYGLKEG |
| | | DAGSDLTWLTGYRFS | LTWLTGYRF |
| | | AGSDLTWLTGYRFSD | LTWLTGYRF |
| | | SDLTWLTGYRFSDVA | LTWLTGYRF |
| | | LTNYGLKEGVVGFVR | YGLKEGVVG |
| | | TFTSNHLKTNTFEGG | SNHLKTNTF |
| | | GSDLTWLTGYRFSDV | LTWLTGYRF |
| | | LLILLESIVFLGGS | LILLESIVF |
| | | EGGKLTNYGLKEGVV | LTNYGLKEG |
| | | TFEGGKLTNYGLKEG | GGKLTNYGL |
| | | AKYANKDTKTSTQYT | YANKDTKTS |
| | | TKTSTQYTGSFADLF | TKTSTQYTG |
| | | GSIGSFTPKVGLTID | GSFTPKVS |
| | | AGAKYANKDTKTSTQ | YANKDTKTS |
| | | GAKYANKDTKTSTQY | YANKDTKTS |
| | | EAGAKYANKDTKTST | YANKDTKTS |
| | | PDMKYATTDPTYSND | MKYATTDPT |
| | | QNPDMKYATTDPTYS | MKYATTDPT |
| | | NPDMKYATTDPTYSN | MKYATTDPT |
| | | KDAGSDLTWLTGYRF | AGSDLTWLT |
| | | FTSNHLKTNTFEGGK | SNHLKTNTF |
| | HLA-DRB1*1501 | NKILLLILLESIVFL | ILLLILLES |
| | | MKILLLILLESIVFL | ILLLILLES |
| | | KILLLILLESIVFLS | LILLESIV |
| | | GSDLTWLIGYRFSDV | DLIWLIGYR |
| | | SDLTWLIGYRFSDVA | LIGYRFSDV |
| | | DLTWLIGYRFSDVAK | LIGYRFSDV |
| | | ILLLILLESIVFLGG | LILLESIV |
| | | LTWLIGYRFSDVAKV | LIGYRFSDV |
| | | TWLIGYRFSDVAKVA | LIGYRFSDV |
| | | EGVVGFVRNPKMLS | VVGFVRNPK |
| | | AGSDLTWLIGYRFSD | DLTWLIGYR |
| | | KEGVVGFVRNPKMLS | VVGFVRNPK |
| | | LILLLESIVFLGGS | LILLESIV |
| | | LKEGVVGFVRNPKMT | VVGFVRNPK |
| | | DVGRALNTFTSNHLK | LNTFTSNHL |
| | | KDVGRALNTFTSNHL | GRALNTFTS |
| | | LILLESIVFLGGSGK | LILLESIV |
| | | GLKEGVVGFVRNPKM | VVGFVRNPK |
| | | DAGSDLTWLTGYRFS | DLTWLTGYR |
| | | AFLTGYTAAKLSKTG | FLTGYTAAK |
| | | FLTGYTAAKLSKTGK | TAAKLSKTG |
| | HLA-DRB3*0101 | None | |
| | HLA-DRB4*0101 | SDLTWLIGYRFSDVA | LTWLIGYR |
| | | GSDLTWLIGYRFSDV | LIWLIGYR |
| | | DAGSDLTWLIGYRFS | LIWLIGYR |
| | | AGSDLTWLIGYRFSD | LIWLIGYR |
| | | DLTWLTGYRFSDVAK | LTWLTGYRF |
| | HLA-DRB5*0101 | None | |
| NP_212516.1 Basic membrane protein B | HLA-DRB1*0101 | WLVGYKLTDASLLVS | KLTDASLLV |
| | | TWLVGYKLTDASLLV | YKLTDASLL |

Fig. 34 continued

| | | | |
|---|---|---|---|
| Basic membrane protein B (bmpB) [Borrelia burgdorferi B31]  SEQ ID NO:2, SEQ ID NO:126025-126584 | | LVGYMLTDASLLVSS<br>VGYMLTDASLLVSSE<br>SDLIWLVGYMLTDAS<br>GYMLTDASLLVSSEN<br>GSDLIWLVGYMLTDA<br>LIWLVGYMLTDASLL<br>DLIWLVGYMLTDASL<br>NGSDLIWLVGYMLTD<br>IDVIRFAAGLAGIGV<br>DVIRFAAGLAGIGVI<br>IRFAAGLAGIGVIET<br>RNGSDLIWLVGYMLT<br>YMLTDASLLVSSENP<br>GIDVIRFAAGLAGIG<br>VIRFAAGLAGIGVIE<br>WEGGKVVQMGLRDGV<br>GGKVVQMGLRDGVIG<br>GKVVQMGLRDGVIGL<br>FIFGILLTSCFSRNG<br>RFAAGLAGIGVIETA<br>IVIFIFGILLTSCFS<br>KPNGSDLIWLVGYML<br>RIVIFIFGILLTSCF<br>VWEGGKVVQMGLPDG<br>IFIFGILLTSCFSRN<br>EGGKVVQMGLRDGVI<br>VIFIFGILLTSCFSR<br>FAAGLAGIGVIETAK<br>MLTDASLLVSSENPK<br>AAGLAGIGVIETAKN<br>IGFIGGMKGNIVDAP<br>GFIGGMKGNIVDAPR<br>AGLAGIGVIETAKNL<br>IFGILLTSCFSRNGI<br>SGKIGFIGGMKGNIV<br>GKIGFIGGMKGNIVD<br>KIGFIGGMKGNIVDA<br>SDVDIGRTIASKMYS<br>KGIDVIRFAAGLAGI<br>FSDVDIGRTIASKMY<br>AFLAGYIAAKKSFSG<br>KVVQMGLRDGVIGLP<br>FLAGYIAAKKSFSGK<br>DKSFNSSANEALLRL<br>FGILLTSCFSRNGIE<br>KSFNSSANEALLPLK<br>VVFRVEQGAFLAGYI<br>AVVFPVEQGAFLAGY<br>VVQMGLRDGVIGLPN<br>AGYIAAKKSFSGKIG<br>SKGIDVIRFAAGLAG<br>LAGYIAAKKSFSGKI<br>VDIGRTIASKMYSKG<br>VFSCAISGVYSSYVS<br>SCAISGVYSSYVSDL<br>EVFSCAISGVYSSYV<br>NNNVWEGGKVVQMGL | MLTDASLLV<br>MLTDASLLV<br>LIWLVGYML<br>MLTDASLLV<br>LIWLVGYML<br>LIWLVGYML<br>LIWLVGYML<br>LIWLVGYML<br>FAAGLAGIG<br>FAAGLAGIG<br>FAAGLAGIG<br>LIWLVGYML<br>LTDASLLVS<br>IRFAAGLAG<br>FAAGLAGIG<br>VVQMGLRDG<br>VVQMGLRDG<br>VVQMGLRDG<br>FGILLTSCF<br>LAGIGVIET<br>FGILLTSCF<br>GSDLIWLVG<br>IFGILLTSC<br>WEGGKVVQM<br>FGILLTSCF<br>VVQMGLRDG<br>FGILLTSCF<br>LAGIGVIET<br>MLTDASLLV<br>LAGIGVIET<br>IGGMKGNIV<br>IGGMKGNIV<br>LAGIGVIET<br>FGILLTSCF<br>IGFIGGMKG<br>IGGMKGNIV<br>IGGMKGNIV<br>VDIGRTIAS<br>IRFAAGLAG<br>VDIGRTIAS<br>AGYIAAKKS<br>VVQMGLRDG<br>IAAKKSFSG<br>FNSSANEAL<br>FGILLTSCF<br>FNSSANEAL<br>FRVEQGAFL<br>FRVEQGAFL<br>VVQMGLRDG<br>IAAKKSFSG<br>VIRFAAGLA<br>IAAKKSFSG<br>IGRTIASKM<br>ISGVYSSYV<br>ISGVYSSYV<br>SCAISGVYS<br>WEGGKVVQM |

Fig. 34 continued

| | | FSGAIGVYSGYVSD | IGVYGGYV |
| --- | --- | --- | --- |
| | | GATSGVYSSYVSRD | TSGVYSSYV |
| | | NVWEGGKVVQKGLR | WEGGKVVQ |
| | | NVWFGGKVVQKGLRD | WFGGKVVQ |
| | | KNNNVWEGGKVVQG | WEGGKVVQ |
| | | TKNNVWFGGKVVQK | NVWFGGKVV |
| | | KRDVIFFGTLLTSC | FFGTLLTS |
| | | LDDKSPNSSANEAL | PNSSANEAL |
| | | DDKSPNSSANEALR | PNSSANEAL |
| | | TAVVFRVFQGAFLAG | FRVFQGAFL |
| | | DVDTGRTTASKMYSK | TGRTTASKM |
| | | VLDDKSPNSSANEAL | SPNSSANEA |
| | | LTDASLNVSSENPKT | LTDASLNVS |
| | | GYTAAKKSFSGKTGF | TAAKKSFSG |
| | | SSKKIKTSMLVDGVL | TKTSMLVDG |
| | | SFSDVDTGRTTASKM | VDTGRTTAS |
| | | FRVFQGAFLAGYTAA | VFQGAFLAG |
| | | VFRVFQGAFLAGYTA | VFQGAFLAG |
| | | SSSKKIKTSMLVDGV | IKTSMLVDG |
| | | KSSSKKIKTSMLVDG | KKIKTSMLV |
| | | GAFLAGYTAAKKSFS | LAGYTAAKK |
| | | FLGGMKGNIVDAFRY | IGGMKGNIV |
| | | TGGMKGNIVDAFRYG | TGGMKGNIV |
| | | GLAGIGVIETAKNLG | LAGIGVIET |
| | | LAGTGVIRTAKNLGD | LAGTGVIRT |
| | | KLSYGIIDPLYGEDV | YGIIDPIYG |
| | | ENPKLSYGIIDPLYG | ENPKLSYGI |
| | | LSYGIIDPIYGDVQ | YGIIDPIYG |
| | | SKKIKISMLVDGVLD | IKISMLVDG |
| | | SVIKNIGDALYLITG | IKNIGDALY |
| | | KKIKISMLVDGVLDD | IKISMLVDG |
| | | EQGAFLAGYIAAKKS | LAGYIAAKK |
| | | PKLSYGIIDPIYGDD | YGIIDPIYG |
| | | TSVIKNIGDALYLIT | IKNIGDALY |
| | | SPNSSANEALLRLKK | PNSSANEAL |
| | | PNSSANEALLRLKKD | PNSSANEAL |
| | | NPKLSYGIIDPIYGD | YGIIDPIYG |
| | | NSFSDVDIGRTIASK | VDLGRTIAS |
| | | DIGRTTASKMYSRGT | GRTTASKMY |
| | | QGAFLAGYIAAKKSF | LAGYIAAKK |
| | | SNSFSDVDIGRTTAS | FSDVDIGRT |
| | | GLLTSCFSRNGTFS | LTSCFSRNG |
| | | VFQGAFLAGYTAAKK | FLAGYTAAK |
| | | TLLTSCFSRNGTFSS | LTSCFSRNG |
| | | TGRTTASKMYSRGTD | TGRTTASKM |
| | | LTAVVFRVFQGAFLA | FRVFQGAFL |
| | | VIKNIGDALYLITGF | IGDALYLIT |
| | | DDVQTPENLTAVVF | VQTPENLTA |
| | | RVFQGAFLAGYIAAK | VFQGAFLAG |
| | | DDVQTPENLTAVVF | VQTPENLTA |
| | HLA-DRB1*0301 | None | |
| | HLA-DRB1*0401 | AIKDTFTTSFYSNSF | AIKDTFTTS |
| | | NKDIFITSFYSNSFS | ITSFYSNSF |
| | | KDIFITSFYSNSFSD | ITSFYSNSF |
| | | DIFITSFYSNSFSDV | ITSFYSNSF |
| | | IFITSFYSNSFSDVD | ITSFYSNSF |
| | | FITSFYSNSFSDVDT | ITSFYSNSF |

Fig. 34 continued

| | | | |
|---|---|---|---|
| | | ILSEYCNSSFDVDLG | ILSEYCNS |
| | | WLVGYMLTDASLLVS | MLTDASLLV |
| | | TWLVGYMLTDASLLV | VGYMLTDAS |
| | | VGYMLTDASLLVSSF | MLTDASLLV |
| | | LVGYMLTDASLLVSS | MLTDASLLV |
| | | GYMLTDASLLVSSFN | MLTDASLLV |
| | HLA-DRB1*0404 | LAGIGVIETAKNLGD | VIETAKNLG |
| | | GLAGIGVIETAKNLG | IGVIETAKN |
| | | AGIGVIETAKNLGDG | VIETAKNLG |
| | | IGVIETAKNLGDGYY | VIETAKNLG |
| | | LTWLVGYMLTDASLL | VGYMLTDAS |
| | | TWLVGYMLTDASLLV | YMLTDASLL |
| | | GIGVIETAKNLGDGY | VIETAKNLG |
| | | WLVGYMLTDASLLVS | YMLTDASLL |
| | | LVGYMLTDASLLVSS | YMLTDASLL |
| | | VGYMLTDASLLVSSF | YMLTDASLL |
| | | SDLTWLVGYMLTDAS | WLVGYMLTD |
| | | DLTWLVGYMLTDASL | VGYMLTDAS |
| | HLA-DRB1*0405 | GVYSSYVSDLDKLKR | YSSYVSDLD |
| | | SGVYSSYVSDLDLKR | YSSYVSDLD |
| | | CALSGVYSSYVSDLD | LSGVYSSYV |
| | | ATSGVYSSYVSDLDN | YSSYVSDLD |
| | | LSGVYSSYVSDLDNL | YSSYVSDLD |
| | | VYSSYVSDLDNLKRN | YSSYVSDLD |
| | | YSSYVSDLDNLKRNG | YSSYVSDLD |
| | | LAGIGVIETAKNLGD | IGVIETAKN |
| | | AGIGVIETAKNLGDG | IETAKNLGD |
| | | RGLRDGVIGLPNANE | RDGVIGLPN |
| | | ELISEYCNSSFCVDL | YCNSSFCVD |
| | | GIGVIETAKNLGDGY | IETAKNLGD |
| | | IGVIETAKNLGDGYY | IETAKNLGD |
| | | GLRDGVIGLPNANEF | VIGLPNANE |
| | | IELISEYSSSFSDVD | ISEYSSSFS |
| | | LRDGVIGLPNANEFY | VIGLPNANE |
| | | RDGVIGLPNANEFYY | VIGLPNANE |
| | HLA-DRB1*0701 | EVFSCALSGVYSSYV | FSCALSGVY |
| | | EEVFSCALSGVYSSY | FSCALSGVY |
| | | ENLEEVFSCALSGVY | VFSCALSGV |
| | | NLEEVFSCALSGVYS | FSCALSGVY |
| | | IERVFSCALSGVYSS | FSCALSGVY |
| | | VFSCALSGVYSSYVS | FSCALSGVY |
| | | FSCALSGVYSSYVSD | FSCALSGVY |
| | | VGYMLTDASLLVSSF | YMLTDASLL |
| | | WLVGYMLTDASLLVS | YMLTDASLL |
| | | TWLVGYMLTDASLLV | YMLTDASLL |
| | | LVGYMLTDASLLVSS | YMLTDASLL |
| | HLA-DRB1*0802 | None | |
| | HLA-DRB1*0901 | LDDKSFNSSANEALL | FNSSANEAL |
| | | DKSFNSSANEALLRL | FNSSANEAL |
| | | DDKSFNSSANEALLR | FNSSANEAL |
| | | VLDDKSFNSSANEAL | SFNSSANEA |
| | | KSFNSSANEALLRLK | FNSSANEAL |
| | | GIDVIHFAAGLAGLG | VIHFAAGLA |
| | | TDVIHFAAGLAGLGV | VIHFAAGLA |
| | | YLAPKNFITSVIKNT | YLAPKNFIT |

Fig. 34 continued

| | HLA-DRB1*1101 | None | |
| --- | --- | --- | --- |
| | HLA-DRB1*1302 | VSDLNLKRNGSDLL | LDLKRNGS |
| | | SDLDNLKRNGSDLW | LKRNGSDL |
| | | RIVIFIFGILLTSCF | IFIFGILL |
| | | NFITSVIKNIGDALY | ITSVIKNIG |
| | | IVIFIFGILLTSCFS | FGILLTSCF |
| | | LAPKNFITSVIKNIG | PKNFITSV |
| | | LDNLKRNGSDLWLV | LKRNGSDL |
| | | KNFITSVIKNIGDAL | ITSVIKNIG |
| | | LIGEYIKNNNVWEG | YIKNNNVWE |
| | | DLDNLKRNGSDLWL | LKRNGSDL |
| | | ITGEYIKNNNVWEGG | IKNNNVWEG |
| | | GEYIKNNNVWEGGKV | IKNNNVWEG |
| | | TGEYIKNNNVWEGGK | IKNNNVWEG |
| | | VIFIFGILLTSCFSR | FGILLTSCF |
| | | IFIFGILLTSCFSRN | FGILLTSCF |
| | | EYIKNNNVWEGGKVV | IKNNNVWEG |
| | | FITSVIKNIGDALYL | ITSVIKNIG |
| | | ITSVIKNIGDALYLI | ITSVIKNIG |
| | | APKNFITSVIKNIGD | ITSVIKNIG |
| | | PKNFITSVIKNIGDA | ITSVIKNIG |
| | | SSKKIKISMLVDGVI | IKISMLVDG |
| | | FIFGILLTSCFSRNG | FGILLTSCF |
| | | MRIVIFIFGILLTSC | IFIFGILL |
| | | DNLKRNGSDLWLVG | LKRNGSDL |
| | | SKKIKISMLVDGVID | IKISMLVDG |
| | | VLERKIINKEIIVPG | IINKEIIVP |
| | | LERKIINKEIIVPGN | IINKEIIVP |
| | | KVLERKIINKEIIVP | LERKIINKE |
| | | KKIKISMLVDGVIDD | IKISMLVDG |
| | | SSSKKIKISMLVDGV | IKISMLVDG |
| | | TSVIKNIGDALYLII | IKNIGDALY |
| | | ESSSKKIKISMLVDG | KKIKISMLV |
| | | PEYIKVLERKIINKE | IKVLERKII |
| | | EYIKVLERKIINKEI | IKVLERKII |
| | | SDLWLVGYMLTRAS | LWLVGYML |
| | | YIKNNNVWEGGKVVQ | IKNNNVWEG |
| | | IKNNNVWEGGKVVQM | IKNNNVWEG |
| | | ERKIINKEIIVPGNQ | IINKEIIVP |
| | | IKVLERKIINKEIIV | IKVLERKII |
| | | SSYVSDLDNLKRNGS | YVSDLDNLK |
| | | RKIINKEIIVPGNQE | IINKEIIVP |
| | | YVSDLDNLKRNGSDL | LDNLKRNGS |
| | | GKVVQKGLRDGVIGL | KGLRDGVIG |
| | | SVIKNIGDALYLIIG | IKNIGDALY |
| | | YIKVLERKIINKEII | IKVLERKII |
| | | GGKVVQKGLRDGVIG | VQKGLRDGV |
| | | SYVSDLDNLKRNGSD | LDNLKRNGS |
| | | DLWLVGYMLTRASL | VGYMLTRAS |
| | | KVVQKGLRDGVIGLP | KGLRDGVIG |
| | | IGFIGGMKGNIVDAF | IGGMKGNIV |
| | | SCKIGFIGGMKGNIV | IGFIGGMKG |
| | | VDIGRTTASKMYEG | IGRTTASKM |
| | | GKIGFIGGMKGNIVD | IGGMKGNIV |
| | | IFGILLTSCFSRNGI | FGILLTSCF |
| | | LWLVGYMLTRASII | VGYMLTRAS |
| | | NGSDLWLVGYMLTR | LWLVGYML |

Fig. 34 continued

| | | | |
|---|---|---|---|
| | | RNGSDLIWLVGYMLT | LIWLVGYM |
| | | WLVGYMLTDASLLVS | VGYMLTDAS |
| | | FGLLLTSCFSRGLE | FLSGLLTSC |
| | | GSDLTWLVGYMLTDA | LTWLVGYM |
| | | ANESEYIRVLERKI | ESIKVLER |
| | | KEFRYIKVLERKIN | IKVLERKI |
| | | EFRYIKVLERKINR | IKVLERKI |
| | | TWLVGYMLTDASLV | VGYMLTDAS |
| | | VVQMCLRDCVTGLPN | MCLRDCVTG |
| | | KTKTSWLVDCVLDDK | TKTSWLVDC |
| | | MIKRNGSDLTWLVGY | LKRNGSDL |
| | | TKTSWLVDCVLDDKS | TKTSWLVDC |
| | | LKRNGSDLTWLVGYM | LKRNGSDL |
| | | YLAPKNFITSVTKNT | PKNFITSV |
| | | GFTCCMKCNTVDAFR | TCCMKCNTV |
| | | ENPKTSYCITDPTYG | TSYCITDPT |
| | | VTKNTGDALYLITGF | TKNTGDALY |
| | | SDVDTGRTTASKMYS | TGRTTASKM |
| | | VQMCLRDCVTGLPNA | MCLRDCVTG |
| | | KTGFTCCMKCNTVDA | TCCMKCNTV |
| | | NPKTSYCITDPTYCD | YCITDPTYG |
| | | PKLSYGILDPIYGDD | YGILDPIYG |
| | | DVDTGRTTASKMYSK | TGRTTASKM |
| | | SYLAPKNFTSVIKN | PKNFTSV |
| | | FSDVDTGRTTASKMY | TGRTTASKM |
| | | QSYLAPKNFITSVIK | PKNFITSV |
| | | GFSDVDLGRTIASKM | VDLGRTIAS |
| | | NQFEYEIPIKQILKL | YELPIKQIL |
| | | LVGYMLTDASLLVSS | VGYMLTDAS |
| | | IGRTIASKMSSKGLD | IGRTIASKM |
| | | VGYMLTDASLLVSSE | VGYMLTDAS |
| | | DQSYLAPKNFITSVI | LAPKNFITS |
| | | KLINKEIIVPCNQES | IINKEIIVP |
| | | FLGGKGNIVEAFRY | LGGKGNIV |
| | HLA-DRB1*1501 | PRIVIFIGILLTSC | FLSGLLTS |
| | | VIFIFGILLTSCFSR | FLSGLLTS |
| | | RIVIFIGILLTSCF | FLSGLLTS |
| | | IVIFIGILLTSCFS | FLSGLLTS |
| | | AFLAGYTAAKKSFSC | FLAGYTAAK |
| | | IFIFGILLTSCFSRM | ILLTSCFSR |
| | | FLAGYTAAKKSFSCK | TAAKKSFSC |
| | | SDLTWLVGYMLTDAS | LVGYMLTDA |
| | | DLTWLVGYMLTDASL | LVGYMLTDA |
| | | LTWLVGYMLTDASLL | LVGYMLTDA |
| | | GKVVQMCLRDCVTGL | VVQMCLRDC |
| | | GSDLTWLVGYMLTDA | LTWLVGYM |
| | | GGKVVQMCLRDCVTG | VVQMCLRDC |
| | | TWLVGYMLTDASLLV | LVGYMLTDA |
| | | WEGGKVVQMCLRDCV | VVQMCLRDC |
| | | VWEGGKVVQMCLRDC | GKVVQMCLR |
| | HLA-DRB3*0101 | YCRS | |
| | HLA-DRB4*0101 | SDLTWLVGYMLTDAS | LTWLVGYM |
| | | GSDLTWLVGYMLTDA | LTWLVGYM |
| | | NGSDLTWLVGYMLTD | LTWLVGYM |
| | | RNGSDLTWLVGYMLT | LIWLVGYM |
| | | DLTWLVGYMLTDASL | TWLVGYMLT |

Fig. 34 continued

|  | HLA-DRB5*0101 | None |  |
|---|---|---|---|
| NP_212518.1<br>Basic membrane protein C (bmpC) [Borrelia burgdorferi B31<br><br>SEQ ID NO:3,<br>SEQ ID NO:126585-127288 | HLA-DRB1*0101 | AGIFYANPKLRLVSK | YANPKLRLV |
|  |  | GIFYANPKLRLVSKK | YANPKLRLV |
|  |  | FKAGIFYANPKLRLV | FYANPKLRL |
|  |  | KAGIFYANPKLRLVS | YANPKLRLV |
|  |  | LAIKFRNEEAAFLAG | FRNEEAAFL |
|  |  | AIKFRNEEAAFLAGY | FRNEEAAFL |
|  |  | IFYANPKLRLVSKKA | YANPKLRLV |
|  |  | SLAIKFRNEEAAFLA | FRNEEAAFL |
|  |  | IKFRNEEAAFLAGYI | FRNEEAAFL |
|  |  | NSLAIKFRNEEAAFL | NSLAIKFRN |
|  |  | FPIAGITGLGVYDAA | ITGLGVYDA |
|  |  | IFPIAGITGLGVYDA | IAGITGLGV |
|  |  | EKIGFLTGPMSEHVK | LTGPMSEHV |
|  |  | KEKIGFLTGPMSEHV | FLTGPMSEH |
|  |  | KIGFLTGPMSEHVKD | LTGPMSEHV |
|  |  | IGFLTGPMSEHVKDF | LTGPMSEHV |
|  |  | IKSDKVVVGVLAHGS | VVVGVLAHG |
|  |  | IAGITGLGVYDAAKE | ITGLGVYDA |
|  |  | KSDKVVVGVLAHGSF | VVGVLAHGS |
|  |  | DKVVVGVLAHGSFYD | VVGVLAHGS |
|  |  | PIAGITGLGVYDAAK | ITGLGVYDA |
|  |  | SDKVVVGVLAHGSFY | VVGVLAHGS |
|  |  | GFLTGPMSEHVKDFK | LTGPMSEHV |
|  |  | KVVVGVLAHGSFYDK | VVGVLAHGS |
|  |  | FKRFIFITLSLLVFA | IFITLSLLV |
|  |  | AGITGLGVYDAAKEL | ITGLGVYDA |
|  |  | KRFIFITLSLLVFAC | IFITLSLLV |
|  |  | RFIFITLSLLVFACF | IFITLSLLV |
|  |  | MFKRFIFITLSLLVF | IFITLSLLV |
|  |  | FYANPKLRLVSKKAP | YANPKLRLV |
|  |  | NPKLRLVSKKAPSLF | LVSKKAPSL |
|  |  | ANPKLRLVSKKAPSL | KLRLVSKKA |
|  |  | PKLRLVSKKAPSLFD | LVSKKAPSL |
|  |  | AAFLAGYIAAKMSRK | LAGYIAAKM |
|  |  | KLRLVSKKAPSLFDK | LVSKKAPSL |
|  |  | AFLAGYIAAKMSRKE | LAGYIAAKM |
|  |  | FIFITLSLLVFACFK | FITLSLLVF |
|  |  | EAAFLAGYIAAKMSR | LAGYIAAKM |
|  |  | EEAAFLAGYIAAKMS | LAGYIAAKM |
|  |  | YANPKLRLVSKKAPS | YANPKLRLV |
|  |  | LRLVSKKAPSLFDKE | LVSKKAPSL |
|  |  | KFRNEEAAFLAGYIA | FRNEEAAFL |
|  |  | FRNEEAAFLAGYIAA | FRNEEAAFL |
|  |  | VGIFPIAGITGLGV | FPIAGITGL |
|  |  | GIFPIAGITGLGVY | IAGITGLGV |
|  |  | KNPLNLFWLIGYRFS | LFWLIGYRF |
|  |  | NEEAAFLAGYIAAKM | FLAGYIAAK |
|  |  | PLNLFWLIGYRFSDL | LFWLIGYRF |
|  |  | NPLNLFWLIGYRFSD | LFWLIGYRF |
|  |  | LNLFWLIGYRFSDLS | LFWLIGYRF |
|  |  | VIFPIAGITGLGVYD | IAGITGLGV |
|  |  | QSYIAPQNVITSIIK | YIAPQNVIT |
|  |  | FLTGPMSEHVKDFKF | LTGPMSEHV |
|  |  | DQSYIAPQNVITSII | YIAPQNVIT |

Fig. 34 continued

| | | | |
|---|---|---|---|
| | | VVGVLAHGSFYDKG | VVGVLAHGS |
| | | TFTTLSLVFAQFKS | TFTTLSLV |
| | | NQDQSYIAPQNVITS | YIAPQNVIT |
| | | VVGVLAHGSFYDKGY | VVGVLAHGS |
| | | QDQSYIAPQNVITSL | YIAPQNVIT |
| | | GTTGLGVYDAAKELG | TTGLGVYDA |
| | | PLAGYTAAKMSRKEK | LAGYTAAKM |
| | | TTGLGVYDAAKELGP | TTGLGVYDA |
| | | LNQDQSYIAPQNVIT | LNQDQSYIA |
| | | GYRFSDLSVKLSYRF | FSDLSVKLS |
| | | QFKQTFYANPKLRI | FKAQTFYAN |
| | | LTGPMSFEVKDPKFG | LTGPMSFHV |
| | | YRFSDLSVKLSYRF | FSDLSVKLS |
| | | WLTGYRFSDLSVKLS | RFSDLSVKL |
| | | DKVGVFPTAGTTGL | TFPTAGTTG |
| | | TGYRFSDLSVKLSYF | FSDLSVKLS |
| | | LAGYTAAKMSRKEKT | LAGYTAAKM |
| | | LTGYRFSDLSVKLSY | FSDLSVKLS |
| | | QKVTYSTSSEYTNNR | TYSTSSEYT |
| | | KVGVFPTAGTTGLG | FPTAGTTGL |
| | | DTGKVTYSTSSEYTN | TYSTSSEYT |
| | | IGKVIYSLSSEYINN | IYSLSSEYI |
| | | KDTGKVTYSTSSEYT | VTYSTSSEY |
| | | KVIYSLSSEYINNRV | IYSLSSEYI |
| | | LRPYPIEGKRLLTVD | IEGKRLLTV |
| | | CLRPYPIEGKRLLTV | YPIEGKRLL |
| | | DNFGIKLITKSLRPY | FGIKLITKS |
| | | FGIKLITKSLRPYPI | LITKSLRPY |
| | | RLVGKKAPSLFDKEK | LVGKKAPSL |
| | | RPYPIEGKRLLTVDE | IEGKRLLTV |
| | | EDKVGVLFPLAGITG | VGVLFPLAG |
| | | QKNDLNLFWLIGYRF | PLNLFWLIG |
| | | GYIAPQNVITGIIKD | YIAPQNVIT |
| | | NLFWLIGYRFSDLSV | LFWLIGYRF |
| | | PYPIEGKRLLTVDEA | IEGKRLLTV |
| | | KYYVIGLNQDQSYIA | YVIGLNQDQ |
| | | PGFKQTFYANPKIR | FKAQTFYAN |
| | | YPIEGKRLLTVDEAM | IEGKRLLTV |
| | | LVGKKAPSLFDKEG | LVGKKAPSL |
| | | RDNFGIKLITKSLRP | FGIKLITKS |
| | | LRDNFGIKLITKSLR | FGIKLITKS |
| | | IKLITKSLRPYPIEG | TKSLRPYPI |
| | | KLITKSLRPYPIEGK | TKSLRPYPI |
| | | KDFKFQFKAQTFYAN | QFKAQTFYA |
| | | GIKLITKSLRPYPIE | TKSLRPYPI |
| | | YYVIGLNQDQSYIAP | LNQDQSYIA |
| | | AGYTAAKMSRKEKTG | TAAKMSRKE |
| | | FKFQFKAQTFYANPK | FKAQTFYAN |
| | | LITKSLRPYPIEGKR | TKSLRPYPI |
| | | DFKFQFKAQTFYANP | FKAQTFYAN |
| | | KLRDNFGIKLITKSL | FGIKLITKS |
| | | KFQFKAQTFYANPKL | FKAQTFYAN |
| | | YVIGLNQDQSYIAPQ | LNQDQSYIA |
| | | LFWLIGYRFSDLSVK | LFWLIGYRF |
| | | TGLNQDQSYIAPQNV | LNQDQSYIA |
| | | FTTLSLVFAQFKSN | FTTLSLVF |
| | | YIAPQNVITGIIKDL | YIAPQNVIT |

Fig. 34 continued

| | | | |
|---|---|---|---|
| | | KYSDLSVKLSYEKDG | FSDLSVKLS |
| | | FDYGDIQVPKNSLAT | IQVPKNSLA |
| | | VKLRDFGIKLITKS | LRDFGIKL |
| | | VIGIYQDQSYIAPQN | YQDQSYIA |
| | | FSDLSVKLSYERDG | FSDLSVKLS |
| | | KFGIKLITKSLRPYP | LITKSLRPY |
| | | RKKSTGFITGPMSRE | TGFITGPMS |
| | | SNKKSTKSDKVVVGV | TKSDKVVVG |
| | | KKSTKSDKVVVGVIA | TKSDKVVVG |
| | | KSNKKSTKSDKVVVG | KKSTKSDKV |
| | | YTNNRVFKGGTTTDR | YTNNRVFKG |
| | | RSTKSDKVVVGVLAE | TKSDKVVVG |
| | | KRVFKGGTTTDRGLK | FKGGTTTDR |
| | | SRYTNNRVFKGGTTT | YTNNRVFKG |
| | | RVFKGGTTTDRGLKF | FKGGTTTDR |
| | | SSFYTNNRVFKGGTT | YTNNRVFKG |
| | | TSSFYTNNRVFKGGT | YTNNRVFKG |
| | | NRVFKGGTTTDRGL | FKGGTTTDR |
| | | KKSTKSDKVVVGVL | TKSDKVVVG |
| | | STSSFYTNNRVFKGG | YTNNRVFKG |
| | | TNNRVFKGGTTTDRG | FKGGTTTDR |
| | | YGDIQVPKNSLAIKF | IQVPKNSLA |
| | | DAYFVQKNPLNLFWL | VQKNPLNLF |
| | | SIKSDKVVVGVLAEG | IKSDKVVVG |
| | | FDAYFVQKNPLNLFW | VQKNPLNLF |
| | | DYGDIQVPKNSLAIK | IQVPKNSLA |
| | | TFDAYFVQKNPLNLF | YFVQKNPLN |
| | | GDIQVPKNSLAIKFR | IQVPKNSLA |
| | | GSFYDKGSEQSVHDG | YDKGSEQSV |
| | | GYLAAKESRKEKIGF | LAAKESRKE |
| | | AYFVQKNPLNLFWLL | VQKNPLNLF |
| | | IEGKRLLTVDEAMTF | IEGKRLLTV |
| | | AJDYGDIQVPKNSLA | YGDIQVPKN |
| | | KEDKVGVIPPIAGIT | VGVIPPIAG |
| | | TKSLRPYPIEGKRLL | TKSLRPYPI |
| | | YFVQKNPLNLFWLLG | VQKNPLNLF |
| | | PIEGKRLLTVDEAMT | IEGKRLLTV |
| | | VIYSISSFYTNNRVF | IYSISSFYI |
| HLA-DRB1*0301 | None | | |
| HLA-DRB1*0401 | FKRFIFITLSLLVFA | IFITLSLLV | |
| | KRYIFITLSLLVFAG | IFITLSLLV | |
| | MFKRFIFITLSLLVF | IFITLSLLV | |
| | RFIFITLSLLVFACF | IFITLSLLV | |
| | KDIGKVIYSISSFYI | GKVIYSISS | |
| | DIGKVIYSISSFYIN | GKVIYSISS | |
| | IKDIGKVIYSISSFY | GKVIYSISS | |
| | GKVIYSISSFYTNNR | VIYSISSFY | |
| | FIFITLSLLVFACFK | IFITLSLLV | |
| | IFITLSLLVFACFKS | IFITLSLLV | |
| | IGKVIYSISSFYTNN | VIYSISSFY | |
| HLA-DRB1*0404 | FKRFIFITLSLLVFA | IFITLSLLV | |
| | MFKRFIFITLSLLVF | IFITLSLLV | |
| HLA-DRB1*0405 | EGVIEIVKDPDVLNR | IVKDPDVLN | |
| | KEGVIEIVKDPDVLN | VIEIVKDPD | |
| | GVIEIVKDPDVLNRK | IVKDPDVLN | |
| | IEIVKDPDVLNRLV | IVKDPDVLN | |

Fig. 34 continued

| | | | |
|---|---|---|---|
| | | VIEIVKDPVINNRL | IVKDPVLN |
| | | TEDAYEVQKNPINLF | YEVQKNPLN |
| | | EDAYEVQKNPLNLFW | YEVQKNPLN |
| | | DAYEVQKNPLNLFWL | YEVQKNPLN |
| | | AMIEDAYEVQKNPLN | EDAYEVQKN |
| | | KTEDAYEVQKNPLNL | YEVQKNPLN |
| | | LRIVSKKAPSLFEKE | SKKAPSLFD |
| | | RIVSKKAPSLFDKEK | SKKAPSLFD |
| | | PKIRIVSKKAPSLFD | LRIVSKKAP |
| | | KIRIVSKKAPSLFDK | SKKAPSLFD |
| | | IVSKKAPSLFDKEKG | SKKAPSLFD |
| | | EIVKDPVINRIMDE | IVKDPVLN |
| | | IVKDPVINNRIMDE | IVKDPVLN |
| | | AYEVQKNPLNLFWLT | YEVQKNPLN |
| | | YEVQKNPLNLFWLTG | YEVQKNPLN |
| | HLA-DRB1*0701 | KPKRFTFTTLSLLVF | TFTTLSLLV |
| | | PKRFTFTTLSLLVFA | TFTTLSLLV |
| | | KRFTFTTLSLLVFAG | TFTTLSLLV |
| | | RFTFTTLSLLVFAGF | TFTTLSLLV |
| | | PKIRIVSKKAPSLFD | VSKKAPSLF |
| | HLA-DRB1*0802 | PGIKLITKSLRPYPT | ITKSLRPYP |
| | | TKLITKSLRPYPTEG | TTKSLRPYP |
| | | GIKLITKSLRPYPTE | ITKSLRPYP |
| | | KLITKSLRPYPTEGK | TTKSLRPYP |
| | HLA-DRB1*0901 | None | |
| | HLA-DRB1*1101 | PLNLFWLTGYRFSDL | FWLTGYRFS |
| | | LNLFWLTGYRFSDLS | FWLTGYRFS |
| | | NPLNLFWLTGYRFSD | FWLTGYRFS |
| | | KNPLNLFWLTGYRFS | LFWLTGYRF |
| | | NLFWLTGYRFSDLSV | FWLTGYRFS |
| | | SSEYINNRVFKGGIT | YINNRVFKG |
| | | TSSEYINNRVFKGGI | YINNRVFKG |
| | | STSSEYINNRVFKGG | YINNRVFKG |
| | | YGISSEYINNRVFKG | EYINNRVFK |
| | HLA-DRB1*1302 | RNFGTKLITKSLRPY | TKLITKSLR |
| | | LRDNFGIKLITKSLR | FGIKLITKS |
| | | RDNFGIKLITKSLRP | TKLITKSLR |
| | | NFGIKLITKSLRPYP | IKLITKSLR |
| | | FGIKLITKSLRPYPT | IKLITKSLR |
| | | GIKLITKSLRPYPTE | IKLITKSLR |
| | | IKLITKSLRPYPTEG | IKLITKSLR |
| | | TSIIKDIGKVIYSIS | IKDIGKVIY |
| | | SIIKDIGKVIYSISS | IKDIGKVIY |
| | | IKDIGKVIYSISSEY | IGKVIYSIS |
| | | NVITSIIKDIGKVIY | ITSIIKDIG |
| | | SSEYINNRVFKGGIL | YINNRVFKG |
| | | IIKDIGKVIYSISSE | IGKVIYSIS |
| | | SEYINNRVFKGGIIL | YINNRVFKG |
| | | ISSEYINNRVFKGGI | YINNRVFKG |
| | | VITSIIKDIGKVIYS | IKDIGKVIY |
| | | SISSEYINNRVFKGG | YINNRVFKG |
| | | ITSIIKDIGKVIYSI | IKDIGKVIY |
| | | DAYEVQKNPLNLFWL | VQKNPLNLF |
| | | AYEVQKNPLNLFWLT | VQKNPLNLF |
| | | YEVQKNPLNLFWLTG | VQKNPLNLF |
| | | TEDAYEVQKNPLNLF | YEVQKNPLN |

Fig. 34 continued

|  |  |  |  |
|---|---|---|---|
|  |  | EDAYEVQKNPLNLFW | VQKNPLNLF |
|  |  | FKRFTFTTLSLLVFA | FTTLSLLVF |
|  |  | IAPQNVTSLLKDIGK | PQNVTSLL |
|  |  | MFKRFTFTTLSLLVF | FTTLSLLV |
|  |  | YSISSEYINNRVFKG | EYINNRVFK |
|  |  | RDIGKVIYSISSEYI | IGKVIYSIS |
|  |  | RFTFTTLSLLVFACF | FTTLSLLVF |
|  |  | KRFTFTTLSLLVFAC | FTTLSLLVF |
|  |  | LVFACFKSNKKSTKS | FKSNKKSTK |
|  |  | EVQKNPLNLFWLTGY | VQKNPLNLF |
|  |  | LLVFACFKSNKKSTK | FACFKSNKK |
|  |  | VFACFKSNKKSTKSD | FKSNKKSTK |
|  |  | FACFKSNKKSTKSDK | FKSNKKSTK |
|  |  | VQKNPLNLFWLTGYR | VQKNPLNLF |
|  |  | ACFKSNKKSTKSDKV | FKSNKKSTK |
|  |  | EYINNRVFKGGIIDR | YINNRVFKG |
|  |  | VKIRDFGTKLTTKG | LRDFGTKL |
|  |  | FTFTTLSLLVFACFK | FTTLSLLVF |
|  |  | KNPLNLFWLTGYRFS | LFWLTGYR |
|  |  | YTAPQNVTTSTTKDI | PQNVTTST |
|  |  | QSYTAPQNVTTSTTK | PQNVTTST |
|  |  | KLRDFGIKLITKSL | FGIKLITKS |
|  |  | NPLNLFWLTGYRFSD | LFWLTGYRF |
|  |  | FEAGIFYANPKLRLV | AGIFYANPK |
|  |  | SYTAPQNVTTSTTKD | PQNVTTST |
|  |  | DQSYTAPQNVTTSLL | TAPQNVTTS |
|  |  | QNVTSLLKDIGKVI | ITSLLKDIG |
|  |  | APQNVTSLLKDIGK | PQNVTSLL |
|  |  | LNLFWLGYRFSDLS | LFWLGYRF |
|  |  | DIGRVIYSISSEYIN | IGRVIYSIS |
|  |  | NPKLRLVSKKAPSLF | LRLVSKKAP |
|  |  | PKLRLVSKKAPSLFD | LRLVSKKAP |
|  |  | PQNVTSLLKDIGKV | PQNVTSLL |
|  |  | IGKVIYSISSEYINN | IGKVIYSIS |
|  |  | YINNRVFKGGIIIDR | YINNRVFKG |
|  |  | QRNPLNLFWLLGYRF | LNLFWLLGY |
|  |  | FACTFYANPKLRLVS | YANPKLRLV |
|  |  | FYANPKLRLVCKKAP | YANPKLRLV |
|  |  | ACTFYANPKLRLVSK | YANPKLRLV |
|  |  | PLNLFWLLGYRFSDL | LFWLLGYRF |
|  |  | YANPKLRLVSKKAPS | LRLVSKKAP |
|  |  | TFTTLSLLVFACFKS | FTTLSLLVF |
|  |  | ANPKLRLVSKKAPSL | LRLVSKKAP |
|  |  | EYIDLFNKTTSQFLT | LFNKTTSQF |
|  |  | CTFYANPKLRLVSKK | FYANPKLR |
|  |  | CFKAGTFYANPKLRL | TFYANPKLR |
|  |  | DKVGVFPTAGTTGT | VGVFPTAG |
|  |  | KLRLVSKKAPSLFDK | LRLVSKKAP |
|  |  | CFKSNKKSTKSDKVV | FKSNKKSTK |
|  | HLA-DRB1*1501 | KNPLNLFWLTGYRFS | NLFWLTGYR |
|  |  | QKNPLNLFWLTGYR | NLFWLTGYR |
|  |  | VQKNPLNLFWLTGYR | LNLFWLTGY |
|  |  | LFWLTGYRFSDLSVK | GYRFSDLSV |
|  |  | NPLNLFWLGYRFSD | NLFWLGYR |
|  |  | FWLTGYRFSDLSVKL | YRFSDLSVK |
|  |  | PLNLFWLLGYRFSDL | NLFWLLGYR |
|  |  | WLTGYRFSDLSVKLS | YRFSDLSVK |

Fig. 34 continued

| | | | |
|---|---|---|---|
| | | LIGYRFSDLSVKLSY | YRFSDLSVK |
| | | DNFGTKLTTKSLRPY | TKLTTKSLR |
| | | MFKRIFIFTLSLLVF | IFTTLSLLV |
| | | NFGTKLTTKSLRPYP | TKLTTKSLR |
| | | FRRSIFTTLSLLVFA | IFTTLSLLV |
| | | GYRFSDLSVKLSYRP | YRFSDLSVK |
| | | NLFWLTGYRFSDLS | NLFWLTGYR |
| | | FGTKLTTKSLRPYPT | TKLTTKSLR |
| | | KRFIFTTLSLLVFAC | IFTTLSLLV |
| | | TGYRFSDLSVKLSYR | YRFSDLSVK |
| | | YRFSDLSVKLSYRP | LSVKLSYR |
| | | RDNFGTKLTTKSLRP | TKLTTKSLR |
| | | LRDNFGTKLTTKSLR | NFGTKLTTK |
| | | NLFWLTGYRFSDLSV | NLFWLTGYR |
| | | SLRPYPTEGKRLLTV | LRPYPTEGK |
| | | LRPYPTEGKRLLTVD | TEGKRLLTV |
| | | YTNNRVFKGQTTTDR | NRVFKGQTT |
| | | RFIFTTLSLLVFACF | IFTTLSLLV |
| | | IFTTLSLLVFACFKS | IFTTLSLLV |
| | | LSLLVFACFKSNKKS | LLVFACFKS |
| | | ANPKLRLVSKKAPSL | LRLVSKKAP |
| | | NPKLRLVSKKAPSLF | LVSKKAPSL |
| | | TNNRVFKGQTTTDRG | FKGQTTTDR |
| | | TKLTTKSLRPYPIEG | LTTKSLRPY |
| | | TLSLLVFACFKSNKK | LLVFACFKS |
| | | PYPIEGKRLLTVEEA | IEGKRLLTV |
| | | RPYPIEGKRLLTVEE | IEGKRLLTV |
| | | GTKLTTKSLRPYPIE | LTTKSLRPY |
| | | YPIEGKRLLTVEEA | IEGKRLLTV |
| | | LLVFACFKSNKKSLK | FACFKSNKK |
| | | SLLVFACFKSNKKSL | FACFKSNKK |
| | | PKLRLVSKKAPSLFE | LVSKKAPSL |
| | | KAGIFYANPKLRLVS | IFYANPKLR |
| HLA-DRB3*0101 | None | |
| HLA-DRB4*0101 | RFIFTTLSLLVFACF | FTTLSLLVF |
| | | FIFTTLSLLVFACFK | LSLLVFACF |
| | | FTTLSLLVFACFKSN | LSLLVFACF |
| | | IFTTLSLLVFACFKS | LSLLVFACF |
| | | TTLSLLVFACFKSNK | LSLLVFACF |
| | | NPKLRLVSKKAPSLF | LRLVSKKAP |
| | | PKLRLVSKKAPSLFE | VSKKAPSLF |
| | | KLRLVSKKAPSLFEK | VSKKAPSLF |
| | | LRLVSKKAPSLFEKS | VSKKAPSLF |
| | | LSVKLSYRPDLYYG | LSYRPDLY |
| | | SDLSVKLSYRPDLY | LSVKLSYR |
| | | VKLSYRPDLYYGLL | LSYRPDLY |
| | | SVKLSYRPDLYYGL | LSYRPDLY |
| | | DLSVKLSYRPDLYY | LSYRPDLY |
| | | RLVSKKAPSLFEKS | VSKKAPSLF |
| | | TLSLLVFACFKSNKK | LSLLVFACF |
| | | LSLLVFACFKSNKKS | LSLLVFACF |
| | | TEDAYEVQKNPLNLF | YEVQKNPLN |
| | | EDAYEVQKNPLNLFW | VQKNPLNLF |
| | | DAYEVQKNPLNLFWL | VQKNPLNLF |
| | | AYEVQKNPLNLFWLT | VQKNPLNLF |
| | | FGTKLTTKSLRPYPT | TKLTTKSLR |

Fig. 34 continued

| | | | |
|---|---|---|---|
| | HLA-DRB5*0101 | AGYIAAKMSRKEKIG<br>FLAGYIAAKMSRKEK<br>LAGYIAAKMSRKEKI<br>AAFLAGYIAAKMSRK<br>AFLAGYIAAKMSRKE<br>KAGIFYANPKLRLVS<br>FKAGIFYANPKLRLV<br>AGIFYANPKLRLVSK<br>FGFKAGIFYANPKLR<br>GFKAGIFYANPKLRL<br>GYIAAKMSRKEKIGF<br>YIAAKMSRKEKIGFL<br>GIFYANPKLRLVSKK<br>IFYANPKLRLVSKKA<br>SLFDKEKGKAMALFM<br>KKAPSLFDKEKGKAM<br>PSLFDKEKGKAMALF<br>KAPSLFDKEKGKAMA<br>APSLFDKEKGKAMAL | YIAAKMSRK<br>YIAAKMSRK<br>YIAAKMSRK<br>GYIAAKMSR<br>YIAAKMSRK<br>IFYANPKLR<br>IFYANPKLR<br>IFYANPKLR<br>FKAGIFYAN<br>IFYANPKLR<br>YIAAKMSRK<br>YIAAKMSRK<br>IFYANPKLR<br>IFYANPKLR<br>FDKEKGKAM<br>KKAPSLFDK<br>FDKEKGKAM<br>FDKEKGKAM<br>FDKEKGKAM |
| NP_212519.1B<br>Basic membrane protein D (bmpD) [Borrelia burgdorferi B31<br><br>SEQ ID NO:4,<br>SEQ ID NO:127289-127904 | HLA-DRB1*0101 | AFLAGYFASKASKTG<br>FLAGYFASKASKTGK<br>LAGYFASKASKTGKI<br>AGYFASKASKTGKIG<br>GYFASKASKTGKIGF<br>FGDFGLGRSTASNMY<br>TFGDFGLGRSTASNM<br>GTFGDFGLGRSTASN<br>GDFGLGRSTASNMYR<br>VGTFGDFGLGRSTAS<br>DGVDIIFAAAGLSGI<br>GVDIIFAAAGLSGIG<br>VDIIFAAAGLSGIGV<br>YFASKASKTGKIGFV<br>VAFLAGYFASKASKT<br>DIIFAAAGLSGIGVI<br>RDGVDIIFAAAGLSG<br>SNLIWGIGFRLSDIL<br>NSNLIWGIGFRLSDI<br>GNSNLIWGIGFRLSD<br>DGNSNLIWGIGFRLS<br>DFGLGRSTASNMYRD<br>IIFAAAGLSGIGVIE<br>FGLGRSTASNMYRDG<br>IYNKSLKIGQSIMNG<br>EIYNKSLKIGQSIMN<br>FASKASKTGKIGFVG<br>NLIWGIGFRLSDILF<br>NKSLKIGQSIMNGII<br>YNKSLKIGQSIMNGI<br>TGVLDGGKTMFLGLK<br>KSLKIGQSIMNGIIK<br>GVLDGGKTMFLGLKE<br>LETGVLDGGKTMFLG<br>EEVAFLAGYFASKAS<br>YLETGVLDGGKTMFL<br>SEEVAFLAGYFASKA | YFASKASKT<br>FASKASKTG<br>FASKASKTG<br>FASKASKTG<br>FASKASKTG<br>FGLGRSTAS<br>FGLGRSTAS<br>FGLGRSTAS<br>FGLGRSTAS<br>DFGLGRSTA<br>IFAAAGLSG<br>IFAAAGLSG<br>IFAAAGLSG<br>FASKASKTG<br>LAGYFASKA<br>IFAAAGLSG<br>IIFAAAGLS<br>IWGIGFRLS<br>IWGIGFRLS<br>IWGIGFRLS<br>LIWGIGFRL<br>FGLGRSTAS<br>FAAAGLSGI<br>FGLGRSTAS<br>LKIGQSIMN<br>IYNKSLKIG<br>FASKASKTG<br>IWGIGFRLS<br>LKIGQSIMN<br>LKIGQSIMN<br>LDGGKTMFL<br>LKIGQSIMN<br>LDGGKTMFL<br>LDGGKTMFL<br>VAFLAGYFA<br>TGVLDGGKT<br>VAFLAGYFA |

Fig. 34 continued

| | | | |
|---|---|---|---|
| | | EIGVLEGGKTMFLGL | LDGGKTMF |
| | | TFAAAGLSGIGVTRA | TFAAAGLSG |
| | | LSDTLFQRASENVSV | LFQRASENV |
| | | FVAFLAGYFASKASK | LAGYFASKA |
| | | YRDGVDLLAAAGLS | VDLLAAAG |
| | | SDTLFQRASENVSVN | LFQRASENV |
| | | DKGFNFSSSKATRKL | FNFSSSKAT |
| | | LTNGTGFRLSDTLFQ | TNGTGFRLS |
| | | RLSDTLFQRASENVS | LFQRASENV |
| | | DDKGFNFSSSKATRK | FNFSSSKAT |
| | | FDDKGFNFSSSKATR | FNFSSSKAT |
| | | DTLFQRASENVSVNY | LFQRASENV |
| | | AFDDKGFNFSSSKAT | GFNFSSSKA |
| | | TGFVGGVRGKVLFSF | VGGVRGKVL |
| | | KGFNFSSSKATRKLK | FNFSSSKAT |
| | | GFVGGVRGKVLFSFM | VGGVRGKVL |
| | | FRLSDTLFQRASENV | LSDTLFQRA |
| | | LKTGGSTMNGTTKVP | LKTGGSTMN |
| | | LLNTSFRSEEVAFLA | FRSEEVAFL |
| | | NLLNTSFRSEEVAFL | NTSFRSEEV |
| | | DQQSYLAPNNVTVSA | LAPNNVTVS |
| | | LNLSFRSEEVAFLAG | FRSEEVAFL |
| | | NTSFRSEEVAFLAGY | FRSEEVAFL |
| | | DQDQSYLAPNNVIVS | YLAPNNVIV |
| | | AKYANSNTKVVSQYV | YANSNTKVV |
| | | LSFRSEEVAFLAGYF | FRSEEVAFL |
| | | FRSEEVAFLAGYFAG | VAFLAGYFA |
| | | FAAAGLGGLGVLEAA | FAAAGLGGL |
| | | DQSYLAPNNVIVSAV | LAPNNVIVS |
| | | SFRSEEVAFLAGYFA | FRSEEVAFL |
| | | QSYLAPNNVIVSAVK | LAPNNVIVS |
| | | YSELYNKSLKIGQSI | LYNKSLKIG |
| | | NYSELYNKSLKIGQS | LYNKSLKIG |
| | | SNYSELYNKSLKIGQ | LYNKSLKIG |
| | | YEAGAKYANSNIKVV | AGAKYANSN |
| | | SLKIGQSINGIIKV | LKIGQSIKN |
| | | VSAVKKVDSLMYSLT | VKKVDSLMY |
| | | GAVKKVDSLMYSLTK | VKKVDSLMY |
| | | TLFQRASENVSVNYA | FQRASENVS |
| | | KSNYSELYNKSLKIG | YSELYNKSL |
| | | FVGGVRGKVLFSFMY | VRGKVLFSF |
| | | RSEEVAFLAGYFASK | VAFLAGYFA |
| | | AGAKYANSNTKVVSQ | YANSNTKVV |
| | | VGGVRGKVLFSFMG | VRGKVLFSF |
| | | YLAPNNVTVSAVKKV | LAPNNVTVS |
| | | EAGAKYANSNTKVVS | YANSNTKVV |
| | | VLDGGKTMFLGLKFD | LDGGKTMFL |
| | | LDGGKTMFLGLKFDG | LDGGKTMFL |
| | | VDQDQSYLAPNNVTV | VDQDQSYLA |
| | | SRLYNKSLKTGGSTM | LYNKSLKTG |
| | | VTVSAVKKVDSLMYS | VKKVDSLMY |
| | | GAKYANSNTKVVSQY | YANSNTKVV |
| | | NVIVSAVKKVDSLMY | VIVSAVKKV |
| | | KTGFVGGVRGKVLFS | VGGVRGKVL |
| | | TNGTGFRLSDTLFQR | TNGTGFRLS |
| | | TGTGFVGGVRGKVL | TGFVGGVRG |
| | | LAPNNVIVSAVKKVD | VIVSAVKKV |

Fig. 34 continued

|  |  |  |  |
|---|---|---|---|
|  |  | VKKVDSLMYSLTKKY | VDSLMYSL |
|  |  | QSTMQTTKVPYDK (QTQFVQGVRQKVL?) | VQQVRQKVL |
|  |  | KKVDSLMYSLTKKYL | LMYSLTKKY |
|  |  | DSLMYSLTKKYLETG | LMYSLTKKY |
|  |  | SYLAPNNVIVSAVKK | LAPNNVIVS |
|  |  | LVINENLKSNYSFTV | NENLKSNYS |
|  |  | QQSTMQTTKVPYDK | TMNQTTKVP |
|  |  | LGVINENLKSNYSF | NENLKSNYS |
|  |  | KTQQSTMQTTKVPY | TMNQTTKVP |
|  |  | TQQSTMQTTKVPYD | TMNQTTKVP |
|  |  | QLGVINENLKSNYS | LVINENLKS |
|  |  | VINENLKSNYSFTV | LKSNYSFTV |
|  |  | QSTMQTTKVPYDKV | TMNQTTKVP |
|  |  | INTTEKASTGNSYLG | TTEKASTGN |
|  |  | YFLTFLFTVACSSSD | FLFTVACSS |
|  |  | FLTFLFTVACSSSDD | FLFTVACSS |
|  |  | SKATRKLKADLNTNT | TRKLKADLN |
|  |  | TVSAVKKVDSLMYSL | VKKVDSLMY |
|  |  | QFNRSSSKATRKLKA | FNRSSSKAT |
|  |  | LTFLFTVACSSSDG | FLFTVACSS |
|  |  | KATRKLKADLNTNTT | TRKLKADLN |
|  |  | APNNVIVSAVKKVDS | VIVSAVKKV |
|  |  | PNNVIVSAVKKVDSL | VIVSAVKKV |
|  |  | DLNINTTEKASTGNS | TTEKASTGN |
|  |  | LNTNTTEKASTGNSY | TTEKASTGN |
|  |  | LGVDQDQSYLAPNNV | VDQDQSYLA |
|  |  | NNVIVSAVKKVDSLM | VIVSAVKKV |
|  |  | EDGNSYLIWGIGFRL | NGNLIWGIG |
|  |  | LFQRASENVSVYAL | LFQRASENV |
|  |  | KVDSLMYSLTKKYLE | LMYSLTKKY |
|  |  | NINTTEKASTGNSYL | TTEKASTGN |
|  |  | AVKKVDSLMYSLTKK | VDSLMYSL |
|  |  | VDSLMYSLTKKYLET | LMYSLTKKY |
|  |  | AAGLSSIGVIEAAKE | LGGIGVIEA |
|  |  | DLNIIGVDQDQSYLA | YLIGVDQDQ |
|  |  | LSRMYGTEAGAKYAR | KRGYEAGA |
|  |  | STMNQTTKVPYDKVS | TMNQTTKVP |
|  |  | KYANSNIKVVSQYVG | YANSNIKVV |
|  |  | YANSNIKVVSQYVGT | YANSNIKVV |
|  |  | FNRSSSKATRKLKAD | FNRSSSKAT |
| HLA-DRB1*0301 | None |  |  |
| HLA-DRB1*0401 |  | GDFGLGRSTAGNMYR | GRSTAGNMY |
|  |  | FGDFGLGRSTAGNMY | FGLGRSTAG |
|  |  | LVINENLKSNYSFTV | NENLKSNYS |
|  |  | VINENLKSNYSFTVN | LKSNYSFTV |
| HLA-DRB1*0404 |  | IKVVSQYVGTFGDFG | VVSQYVGTF |
|  |  | VVSQYVGTFGDFGLG | YVGTFGDFG |
|  |  | KVVSQYVGTFGDFGL | YVGTFGDFG |
|  |  | SQYVGTFGDFGLGRS | YVGTFGDFG |
|  |  | VSQYVGTFGDFGLGR | YVGTFGDFG |
|  |  | VAFLAGYFASKASI | LAGYFASKA |
|  |  | EEVAFLAGYFASKAS | LAGYFASKA |
|  |  | SEEVAFLAGYFASKA | FLAGYFASK |
|  |  | EVAFLAGYFASKASK | LAGYFASKA |
|  |  | YVGTFGDFGLGRSTA | YVGTFGDFG |
|  |  | QYVGTFGDFGLGRST | YVGTFGDFG |

Fig. 34 continued

| | | AFLAGYFASKASKTG | LAGYFASKA |
|---|---|---|---|
| | HLA-DRB1*0405 | EGVYDEIQIPKNLLN | YDEIQIPKN |
| | | GVYDEIQIPKNLLNI | IQIPKNLLN |
| | | VYDFIQTPKNLLNTS | IQTPKNLLN |
| | | YDEIQIPKNLLNTSF | IQIPKNLLN |
| | | DEIQTPKNLLNTSFR | IQTPKNLLN |
| | HLA-DRB1*0701 | YEAGAKYANSNIKVV | KYANSNIKV |
| | | EAGAKYANSNIKVVS | YANSNIKVV |
| | | AGAKYANSNIKVVSQ | YANSNIKVV |
| | | GAKYANSNIKVVSQY | YANSNIKVV |
| | | AKYANSNIKVVSQYV | YANSNIKVV |
| | | AGYFASKASKTGKTG | YFASKASKT |
| | | LAGYFASKASKTGKT | YFASKASKT |
| | | AFLAGYFASKASKTG | YFASKASKT |
| | | FLAGYFASKASKTGK | YFASKASKT |
| | | APDDKGFNESSSKAI | GFNESSSKA |
| | | DKGFNESSSKAIRKL | FNESSSKAI |
| | | FDDKGFNESSSKAIR | FNESSSKAI |
| | | DDKGFNESSSKAIRK | FNESSSKAI |
| | | VAFLAGYFASKASKT | VAFLAGYFA |
| | | KGFNESSSKAIRKLK | FNESSSKAI |
| | | GTIKVPYDKVSYFVL | PYDKVSYFV |
| | | KEDIFMLKKVYYFLI | MLKKVYYFL |
| | | EDIFMLKKVYYFLIF | MLKKVYYFL |
| | | ILKVPYDKVSYFVLQ | YDKVSYFVL |
| | | IKVPYDKVSYFVLQE | YDKVSYFVL |
| | | KVPYDKVSYFVLQEE | YDKVSYFVL |
| | | DQSYLAPNNVIVGAV | YLAPNNVIV |
| | | FGDFGLGRSTACNMY | LGRSTACNM |
| | | GDFGLGRSTACNMYR | LGRSTACNM |
| | | KYANSNIKVVSQYVG | YANSNIKVV |
| | | YANSNIKVVSQYVGI | YANSNIKVV |
| | | DIFMLKKVYYFLIFL | MLKKVYYFL |
| | HLA-DRB1*0802 | None | |
| | HLA-DRB1*0901 | GVDIIFAAAGLSGIG | IIFAAAGLS |
| | | DGVDIIFAAAGLSGI | IIFAAAGLS |
| | | VDIIFAAAGLSGIGV | IIFAAAGLS |
| | | DKGFNESSSKAIRKL | FNESSSKAI |
| | | KGFNESSSKAIRKLK | FNESSSKAI |
| | | APDDKGFNESSSKAI | GFNESSSKA |
| | | FDDKGFNESSSKAIR | FNESSSKAI |
| | | DDKGFNESSSKAIRK | FNESSSKAI |
| | | RDGVDIIFAAAGLSG | IIFAAAGLS |
| | | YRDGVDIIFAAAGLS | YRDGVDIIF |
| | | EAGAKYANSNIKVVS | YANSNIKVV |
| | | YEAGAKYANSNIKVV | AKYANSNIK |
| | | AGAKYANSNIKVVSQ | YANSNIKVV |
| | | DIIFAAAGLSGIGVL | IIFAAAGLS |
| | | IIFAAAGLSGIGVLT | IIFAAAGLS |
| | | GAKYANSNIKVVSQY | YANSNIKVV |
| | | LAGYFASKASKTGKI | YFASKASKT |
| | | AKYANSNIKVVSQYV | YANSNIKVV |
| | | AGYFASKASKTGKTG | YFASKASKT |
| | | AFLAGYFASKASKTG | YFASKASKT |
| | | FLAGYFASKASKTGK | YFASKASKT |

Fig. 34 continued

| | | | |
|---|---|---|---|
| | | VAYLAGYFASKACKT | LAGYFASKA |
| | | LSDTLFQRASFNVSV | FQRASFNVS |
| | | SDTLFQRASFNVSVN | FQRASFNVS |
| | | DTLFQRASFNVSVYY | FQRASFNVS |
| | | RLSDTLFQRASFNVS | LFQRASFNV |
| | | LYGTGFRLSDTLFQ | TGFRLSDTL |
| | | YGTGFRLSDTLFQR | FRLSDTLFQ |
| | | WGTGFRLSDTLFQRA | FRLSDTLFQ |
| | | TLFQRASFNVSVYA | FQRASFNVS |
| | | GFNFSSGKATRKLKA | FNFSSGKAT |
| | | GTGFRLSDTLFQRAS | FRLSDTLFQ |
| | | FNFSSGKATRKLKAD | FNFSSGKAT |
| | | TGFRLSDTLFQRASF | FRLSDTLFQ |
| | | GYFASKASKTGKTGF | YFASKASKT |
| HLA-DRB1*1101 | None | | |
| HLA-DRB1*1302 | | KYANSNTKVVSQYVG | ANSNTKVVS |
| | | KTGQSTMNGTTKVPY | TGQSTMNGT |
| | | ISGSLRGLIKVPYD | ISGSLRGL |
| | | LKTGQSTMNGTTKVP | TGQSTMNGT |
| | | YANSNTKVVSQYVGT | TKVVSQYVG |
| | | ANSNTKVVSQYVGTF | TKVVSQYVG |
| | | SLKTGQSTMNGTTKV | TGQSTMNGT |
| | | RSLKTGQSTMNGTTK | TGQSTMNGT |
| | | NSNTKVVSQYVGTFG | TKVVSQYVG |
| | | SNTKVVSQYVGTFGD | TKVVSQYVG |
| | | YKSLKTGQSTMNGTT | TGQSTMNGT |
| | | YDKSLKTGQSTMNGT | LKTGQSTMN |
| | | REDIFMLKKVYYFLT | FMLKKVYY |
| | | EDIFMLKKVYYFLTF | FMLKKVYY |
| | | AKYANSNTKVVSQYV | YANSNTKVV |
| | | GAKYANSNTKVVSQY | YANSNTKVV |
| | | GQSTMNGTTKVPYDK | MNGTTKVPY |
| | | RAGAKYANSNTKVVS | YANSNTKVV |
| | | AGAKYANSNTKVVSQ | YANSNTKVV |
| | | LKADLNINLIEKAST | LNINLIEKA |
| | | QSTMNGTTKVPYDKV | MNGTTKVPY |
| | | EIQIPKNLLNISFRG | IPKNLLNIS |
| | | TQTPKNLINTSFRSF | TPKNLINTS |
| | | SKEDIFMLKKVYYFL | IFMLKKVYY |
| | | KADLNINLIEKASTG | LNINLIEKA |
| | | DEIQIPKNLLNISFR | IPKNLLNIS |
| | | KCKEDIFMLKKVYYF | IFMLKKVYY |
| | | ADLNINLIEKASTGN | LNINLIEKA |
| | | YDEIQIPKNLLNISF | IPKNLLNIS |
| | | VYDEIQIPKNLLNIS | IQIPKNLLN |
| | | RKLRADLNINLIEKA | KADLNINLI |
| | | DIFMLKKVYYFLTFL | IFMLKKVYY |
| | | KLKADLNINLIEKAS | LNINLIEKA |
| | | QIPKNLLNISFRSFV | IPKNLLNIS |
| | | IPKNLINTSFRSFFV | IPKNLINTS |
| | | SLMNGLIKVPYDKVS | MNGLIKVPS |
| | | GLGLVLFNLKSYYS | LFNLKSYY |
| | | GKLGFVGGVRGKVLF | LGFVGGVRG |
| | | NYSRTYNKSLKTGQS | TYNKSLKTG |
| | | TFMLKKVYYFLTFLF | TFMLKKVYY |
| | | YSRTYNKSLKTGQST | TYNKSLKTG |
| | | LGLVLFNLKSYYS | LFNLKSYY |

Fig. 34 continued

| | | | |
|---|---|---|---|
| | | GNYSETYNKSLKTGQ | TYNKSLKTG |
| | | LAPNNVTVSAVKKVD | PNNVTVSAV |
| | | LNINITEKASTGNGY | LNINITEKA |
| | | SETYNKSLKTGQSTM | TYNKSLKTG |
| | | KLKVVSQYVGTFGDF | LKVVSQYVG |
| | | YLAPNNVTVSAVKKV | PNNVTVSAV |
| | | DGLGVLNENLKSNY | LNENLKS |
| | | DLNINITEKASTGNG | LNINITEKA |
| | | SYLAPNNVTVSAVKK | LAPNNVTVS |
| | | ETYNKSLKTGQSTMN | TYNKSLKTG |
| | | TGKTGFVGGVRGKVL | TGFVGGVRG |
| | | DQSYLAPNNVTVSAV | LAPNNVTVS |
| | | TKSKEDTFMLKKVYY | TKSKEDTFM |
| | | QSYLAPNNVTVSAVK | LAPNNVTVS |
| | | KSNYSETYNKSLKTG | SETYNKSLK |
| | | TKVVSQYVGTFGDFG | TKVVSQYVG |
| | | LVLNENLKSNYSETY | LNENLKSNY |
| | | GLVLNENLKSNYSET | LNENLKSNY |
| | | TYNKSLKTGQSTMNG | TYNKSLKTG |
| | | VSAVKKVDSLMYSLT | VKKVDSLMY |
| | | NVTVSAVKKVDSLMY | TVSAVKKVD |
| | | YEAGAKYANSMIKVV | AKYANSMIK |
| | | KTGKTGFVGGVRGKV | TGFVGGVRG |
| | | SAVKKVDSLMYSLTK | VKKVDSLMY |
| | | VTVSAVKKVDSLMYS | VKKVDSLMY |
| | | MNGILKVPYEKVSY | MNGILKVPY |
| | | APNNVIVSAVKKVDS | VIVSAVKKV |
| | | ASKTGKLGFVGGVRG | KLGFVGGVR |
| | | QDQSYLAPNNVIVSA | LAPNNVIVS |
| | | SKTGKLGFVGGVRGK | LGFVGGVRG |
| | | PNNVIVSAVKKVDSL | VIVSAVKKV |
| | | KLGFVGGVRGKVLES | LGFVGGVRG |
| | | LGFVGGVRGKVLES | LGFVGGVRG |
| | | VKKVDSLMYSLTKKY | VDSLMYSLT |
| | | AVKKVDSLMYSLTKK | VDSLMYSLT |
| | HLA-DRB1*1501 | KVYYFLIFLFIVACS | FLIFLFIVA |
| | | KKVYYFLIFLFIVAC | FLIFLFIVA |
| | | VYYFLIFLFIVACSS | FLIFLFIVA |
| | | LKKVYYFLIFLFIVA | YFLIFLFIV |
| | | YYFLIFLFIVACSSD | FLIFLFIVA |
| | | YELYFLYFTKSKED | FLYFFTKSK |
| | | YYRTYFLYFFTKSK | FLYFFTKSK |
| | | AFLAGYFASKASKTG | LAGYFASKA |
| | | MYYRTYFLYFFTKSK | TYFLYFFTK |
| | | FLYFLYFFTKSKEDT | FLYFFTKSK |
| | | FLAGYFASKASKTGK | FASKASKTG |
| | | VAFLAGYFASKASKT | FLAGYFASK |
| | | YFLIFLFIVACSSED | FLIFLFIVA |
| | HLA-DRB3*0101 | None | |
| | HLA-DRB4*0101 | TQTPKNLLNTSFREF | TPKNLLNTS |
| | HLA-DRB5*0101 | None | |
| AAC70056.1 Decorin binding protein A | HLA-DRB1*0101 | FLILTLLASLLAACS | LTLLASLLA |
| | | LILTLLASLLAACSL | LTLLASLLA |

Fig. 34 continued

| Decorin binding protein A DbpA [Borrelia afzelii] SEQ ID NO:5, SEQ ID NO:127905-128186 | | LTLLASLLAACSLTG | LASLLAACS |
|---|---|---|---|
| | | TLTLLASLLAACSLT | LASLLAACS |
| | | TLLASLLAACSLTGK | LASLLAACS |
| | | NKIILTLTLLASLLA | ILTLTLLAS |
| | | KIILTLTLLASLLAA | LTLLASLLA |
| | | IILTLTLLASLLAAC | LTLLASLLA |
| | | LASLLAACSLTGKAR | LLAACSLTG |
| | | LLASLLAACSLTGKA | LASLLAACS |
| | | IKYNKIILTLTLLAS | YNKIILTLT |
| | | ASLLAACSLTGKARL | LLAACSLTG |
| | | YNKIILTLTLLASLL | ILTLTLLAS |
| | | KYNKIILTLTLLASL | ILTLTLLAS |
| | | MIKYNKIILTLTLLA | YNKIILTLT |
| | | VGGSQIRAAKIRVAD | IRAAKIRVA |
| | | KVGGSQIRAAKIRVA | VGGSQIRAA |
| | | GSQIRAAKIRVADLT | IRAAKIRVA |
| | | GGSQIRAAKIRVADL | IRAAKIRVA |
| | | SQIRAAKIRVADLTI | IRAAKIRVA |
| | | IYDLILNAAKAVEKI | LILNAAKAV |
| | | GIYDLILNAAKAVEK | LILNAAKAV |
| | | FSGIYDLILNAAKAV | IYDLILNAA |
| | | SGIYDLILNAAKAVE | LILNAAKAV |
| | | YDLILNAAKAVEKIG | LILNAAKAV |
| | | LLAACSLTGKARLES | LLAACSLTG |
| | | SLLAACSLTGKARLE | LLAACSLTG |
| | | TGGKVGGSQIRAAKI | VGGSQIRAA |
| | | DLILNAAKAVEKIGM | LILNAAKAV |
| | | GGKVGGSQIRAAKIR | VGGSQIRAA |
| | | QIRAAKIRVADLTIK | IRAAKIRVA |
| | | GKVGGSQIRAAKIRV | VGGSQIRAA |
| | | LILNAAKAVEKIGMQ | LILNAAKAV |
| | | IRAAKIRVADLTIKF | IRAAKIRVA |
| | | QTGGKVGGSQIRAAK | VGGSQIRAA |
| | | TQTGGKVGGSQIRAA | GKVGGSQIR |
| | | KAVEKIGMQGMKQAV | IGMQGMKQA |
| | | DGIIAIVKVMKAKVE | IAIVKVMKA |
| | | GIIAIVKVMKAKVEN | VKVMKAKVE |
| | | VEKIGMQGMKQAVEE | IGMQGMKQA |
| | | AVEKIGMQGMKQAVE | IGMQGMKQA |
| | | AKAVEKIGMQGMKQA | VEKIGMQGM |
| | | EKIGMQGMKQAVEEA | IGMQGMKQA |
| | | IAIVKVMKAKVENIK | VKVMKAKVE |
| | | IIAIVKVMKAKVENI | VKVMKAKVE |
| | | ADGIIAIVKVMKAKV | IAIVKVMKA |
| | | AIVKVMKAKVENIKE | VKVMKAKVE |
| | | TTADGIIAIVKVMKA | DGIIAIVKV |
| | | KIRVADLTIKFLEAT | VADLTIKFL |
| | | IRVADLTIKFLEATE | LTIKFLEAT |
| | | TADGIIAIVKVMKAK | IAIVKVMKA |
| | | KIGMQGMKQAVEEAA | IGMQGMKQA |
| | | IGMQGMKQAVEEAAK | IGMQGMKQA |
| | | VADLTIKFLEATEEE | LTIKFLEAT |
| | | KVADLTIKFLEATEE | LTIKFLEAT |
| | | ADLTIKFLEATEEET | LTIKFLEAT |
| | | EDFSGIYDLILNAAK | IYDLILNAA |
| | | DAGVKTDAFTETQTG | VKTDAFTET |
| | | AGVKTDAFTETQTGG | VKTDAFTET |

Fig. 34 continued

|  |  | EDAGVKTDAFTETQT | VKTDAFTET |
|---|---|---|---|
|  |  | ARDAGVKTDAFTETQ | VKTDAFTET |
|  |  | RAAKIRVADLTIKFL | IRVADLTIK |
|  |  | FFDFSCTYDLTLNAA | FSCTYDLTL |
|  |  | LAEDAGVKTDAFTET | AGVKTDAFT |
|  |  | AAKIRVADLTIKFLR | VADLTIKFL |
|  |  | AKIRVADLTIKFLRA | VADLTIKFL |
|  |  | LNAAKAVEKTGKQGM | LNAAKAVEK |
|  | HLA-DRB1*0301 | None | |
|  | HLA-DRB1*0401 | NKIILTLTLLAGLLA | IILTLTLLA |
|  |  | IKYNKIILTLTLLAS | IILTLTLLA |
|  |  | MIKYNKIILTLTLLA | YNKIILTLT |
|  |  | KYNKIILTLTLLASL | IILTLTLLA |
|  |  | KIILTLTLLASLLAA | LTLLASLLA |
|  |  | IILTLTLLASLLAAC | LTLLASLLA |
|  |  | YNKIILTLTLLASLL | IILTLTLLA |
|  |  | TLTLTLLASLLAACS | LTLLASLLA |
|  |  | LTLTLLASLLAACSL | LTLLASLLA |
|  |  | LTLLASLLAACSLTG | LTLLASLLA |
|  |  | TLLASLLAACSLT | LTLLASLLA |
|  | HLA-DRB1*0404 | NKTTLTLTLLASLLA | TTLTLTLLA |
|  |  | IKYNKTTLTLTLLAS | TTLTLTLLA |
|  |  | KYNKTTLTLTLLASL | TTLTLTLLA |
|  |  | YNKTTLTLTLLASLL | TTLTLTLLA |
|  |  | MIKYNKTTLTLTLLA | YNKTTLTLT |
|  |  | KTTLTLTLLASLLAA | TTLTLTLLA |
|  |  | TTLTLTLLASLLAAC | TTLTLTLLA |
|  |  | LTLLASLLAACSLTG | LASLLAACS |
|  |  | LLASLLAACSLTGKA | LLAACSLTG |
|  |  | TLLASLLAACSLTGK | LLAACSLTG |
|  |  | LASLLAACSLTGKAR | LLAACSLTG |
|  |  | ASLLAACSLTGKARL | LLAACSLTG |
|  | HLA-DRB1*0405 | NKTTLTLTLLASLLA | TTLTLTLLA |
|  |  | IKYNKIILTLTLLAS | IILTLTLLA |
|  |  | KYNKTTLTLTLLASL | TTLTLTLLA |
|  |  | MIKYNKIILTLTLLA | YNKIILTLT |
|  |  | YNKTTLTLTLLASLL | TTLTLTLLA |
|  | HLA-DRB1*0701 | KVGGSQIRAAKIRVA | GGQIRAAKI |
|  |  | VGGSQIRAAKIRVAD | IRAAKIRVA |
|  |  | GGSQIRAAKIRVADL | IRAAKIRVA |
|  |  | GSQIRAAKIRVADLT | IRAAKIRVA |
|  |  | SQIRAAKIRVADLTI | IRAAKIRVA |
|  | HLA-DRB1*0802 | None | |
|  | HLA-DRB1*0901 | YDLTLNAAKAVEKTG | LTLNAAKAV |
|  |  | CTYDLTLNAAKAVEK | LTLNAAKAV |
|  |  | TYDLTLNAAKAVEKT | LTLNAAKAV |
|  | HLA-DRB1*1101 | None | |
|  | HLA-DRB1*1302 | IKYNKIILTLTLLAS | YNKIILTLT |
|  |  | MIKYNKIILTLTLLA | YNKIILTLT |
|  |  | KYNKTTLTLTLLASL | YNKTTLTLT |
|  |  | YNKTTLTLTLLASLL | YNKTTLTLT |
|  |  | YNKTTLTLTLLASLLA | TLTLTLLAS |
|  |  | KTTLTLTLLASLLAA | LTLLASLLA |
|  |  | DGTTATVKVMKAKVP | TATVKVMKA |
|  |  | ADGTTATVKVMKAKV | TATVKVMKA |
|  |  | DLTLNAAKAVEKTGM | TLNAAKAVE |

Fig. 34 continued

| | | | |
|---|---|---|---|
| | | IYDLILNAAKAVEKI | ILNAAKAVE |
| | | GIYDLILNAAKAVEK | ILNAAKAVE |
| | | IILTLTLLASLLAAC | LTLLASLLA |
| | | GIIAIVKVMKAKVEN | IAIVKVMKA |
| | | YDLILNAAKAVEKIG | ILNAAKAVE |
| | | TTADGIIAIVKVMKA | IIAIVKVMK |
| | | ILTLTLLASLLAACS | LTLLASLLA |
| | | TADGIIAIVKVMKAK | IAIVKVMKA |
| | | SGIYDLILNAAKAVE | LILNAAKAV |
| | | AKAVEKIGMQGMKQA | VEKIGMQGM |
| | | LILNAAKAVEKIGMQ | ILNAAKAVE |
| | | KAVEKIGMQGMKQAV | IGMQGMKQA |
| | | IAIVKVMKAKVENIK | VKVMKAKVE |
| | | IIAIVKVMKAKVENI | VKVMKAKVE |
| | HLA-DRB1*1501 | KIILTLTLLASLLAA | ILTLTLLAS |
| | | NKIILTLTLLASLLA | ILTLTLLAS |
| | | KYNKIILTLTLLASL | ILTLTLLAS |
| | | IKYNKIILTLTLLAS | KYNKIILTL |
| | | YNKIILTLTLLASLL | ILTLTLLAS |
| | | QIRAAKIRVADLTIK | IRAAKIRVA |
| | | IRAAKIRVADLTIKF | IRVADLTIK |
| | | ILTLTLLASLLAACS | ILTLTLLAS |
| | | IILTLTLLASLLAAC | ILTLTLLAS |
| | | TLLASLLAACSLTGK | LLAACSLTG |
| | | LASLLAACSLTGKAR | LLAACSLTG |
| | | LLASLLAACSLTGKA | LLAACSLTG |
| | HLA-DRB3*0101 | None | |
| | HLA-DRB4*0101 | None | |
| | HLA-DRB5*0101 | GIYDLILNAAKAVEK | YDLILNAAK |
| | | IYDLILNAAKAVEKI | LNAAKAVEK |
| | | YDLILNAAKAVEKIG | LNAAKAVEK |
| AAC70057.1<br>Decorin binding protein A<br>DbpA [Borrelia garinii]<br><br>SEQ ID NO:6,<br>SEQ ID NO:128187-128428 | HLA-DRB1*0101 | EIGIQKMTGTVTKEA | IQKMTGTVT |
| | | IGIQKMTGTVTKEAE | IQKMTGTVT |
| | | LEEIGIQKMTGTVTK | IQKMTGTVT |
| | | EEIGIQKMTGTVTKE | IQKMTGTVT |
| | | PLEEIGIQKMTGTVT | IGIQKMTGT |
| | | LLKLSLIVSLLVACG | LSLIVSLLV |
| | | LKLSLIVSLLVACGL | IVSLLVACG |
| | | LSLIVSLLVACGLTG | IVSLLVACG |
| | | IQKMTGTVTKEAEKT | IQKMTGTVT |
| | | SLIVSLLVACGLTGE | IVSLLVACG |
| | | KLSLIVSLLVACGLT | IVSLLVACG |
| | | GIQKMTGTVTKEAEK | IQKMTGTVT |
| | | NKILLKLSLIVSLLV | LKLSLIVSL |
| | | IKYNKILLKLSLIVS | YNKILLKLS |
| | | KILLKLSLIVSLLVA | LKLSLIVSL |
| | | YNKILLKLSLIVSLL | LKLSLIVSL |
| | | KYNKILLKLSLIVSL | ILLKLSLIV |
| | | MIKYNKILLKLSLIV | YNKILLKLS |
| | | ILLKLSLIVSLLVAC | LKLSLIVSL |
| | | LIVSLLVACGLTGET | IVSLLVACG |
| | | IVSLLVACGLTGETK | IVSLLVACG |
| | | QKMTGTVTKEAEKTP | MTGTVTKEA |
| | | AEKLKKSGSSGAFSA | LKKSGSSGA |
| | | EAEKLKKSGSSGAFS | LKKSGSSGA |

Fig. 34 continued

| | | | |
|---|---|---|---|
| | | EKLKKCSSSGAFSAM | LKKSGSSGA |
| | | EFAFKLKKSGSSGAF | LKKSGSSGA |
| | | KFEAEKLKKSGSSGA | AEKLKKGSS |
| | | LKNLEEKANTAATTT | LEEKANTAA |
| | | FILEAKIRALQVAER | AKIKALQVA |
| | | TLKAKTKATQVAERF | TKATQVAER |
| | | VSLLVACGLTGETKT | LLVACGLTG |
| | | SGSSGAFSAMYDLMT | SSGAFSAMY |
| | | LKAKTKATQVAERFV | TKATQVAER |
| | | ADGTTATAQAMFEKI | TATAQAMEE |
| | | FSAMYDLMTDVSKPI | FSAMYDLMT |
| | | MTGTVTKFAFKTPP | MTGTVTKFA |
| | | MTGTVTKFAFKTPPI | MTGTVTKFA |
| | | ALKNLEEKANTAATT | LEEKANTAA |
| | | SGAFSAMYDLMTDVS | FSAMYDLMT |
| | | TTADGTTATAQAMFE | GTTATAQAM |
| | | GAFSAMYDLMTDVSK | FSAMYDLMT |
| | | TADGTTATAQAMFEK | TATAQAMEE |
| | | LLVACGLTGETKTRI | LLVACGLTG |
| | | KLKKSGSSGAFSAMY | LKKSGSSGA |
| | | GSSGAFSAMYDLMTD | FSAMYDLMT |
| | | LKKSGSSGAFSAMYD | LKKSGSSGA |
| | | KAKTKATQVAERFVK | TKATQVAER |
| | | VKFEAFTNIQTGSKI | FEAFTNIQT |
| | | DGTTATAQAMFEKLN | TATAQAMEE |
| | | GSSGAFSAMYDLMTDV | FSAMYDLMT |
| | | AKIKALQVAERFVKA | IKALQVAER |
| | | GVKFEAFTNIQTGSK | FEAFTNIQT |
| | | GTTATAQAMEEKLNS | TATAQAMEE |
| | | FFFILKAKIKALQVA | ILKAKIKAL |
| HLA-DRB1*0301 | None | | |
| HLA-DRB1*0401 | LLKLSLTVSLLVACG | LSLTVSLLV | |
| | LKLSLTVSLLVACGL | LSLTVSLLV | |
| | IRTLLKLSLTVSLLV | LLKLSLTV | |
| | ILLKLSLTVSLLVAC | LSLTVSLLV | |
| | KTILKLSLTVSLLVA | LSLTVSLLV | |
| HLA-DRB1*0404 | GVKFEAFTNIQTGSK | KFEAFTNIQ | |
| | VKFEAFTNIQTGSKI | KFEAFTNIQ | |
| | EGVKFEAFTNIQTGS | KFEAFTNIQ | |
| | KEGVKFEAFTNIQTG | KFEAFTNIQ | |
| | KFEAFTNIQTGSKIS | KFEAFTNIQ | |
| | KKEGVKFEAFTNIQ | KFEAFTNIQ | |
| | AKKEGVKFEAFTNIQ | VKFEAFTNI | |
| | LIVSLLVACGLTGET | LLVACGLTG | |
| | IVSLLVACGLTGETK | LLVACGLTG | |
| | LSLTVSLLVACGLTG | TVSLLVACG | |
| | SLTVSLLVACGLTGE | LLVACGLTG | |
| | VSLLVACGLTGETKI | LLVACGLTG | |
| HLA-DRB1*0405 | GVKFEAFTNIQTGSK | FEAFTNIQT | |
| | KEGVKFEAFTNIQTG | FEAFTNIQT | |
| | VKFEAFTNIQTGSKI | FEAFTNIQT | |
| | KKEGVKFEAFTNIQ | GVKFEAFTN | |
| | EGVKFEAFTNIQTGS | FEAFTNIQT | |
| HLA-DRB1*0701 | IRTLLKLSLTVSLLV | ILLKLSLIV | |
| | KTLLKLSLTVSLLVA | LSLTVSLLV | |
| | LLKLSLTVSLLVAC | LSLTVSLLV | |

Fig. 34 continued

| | HLA-DRB1*0802 | None | |
| | HLA-DRB1*0901 | None | |
| | HLA-DRB1*1101 | None | |
| | HLA-DRB1*1302 | LEEIGIQKMTGTVTK | IGIQKMTGT |
| | | EEIGIQKMTGTVTKE | IGIQKMTGT |
| | | PLEEIGIQKMTGTVT | IGIQKMTGT |
| | | EIGIQKMTGTVTKEA | IGIQKMTGT |
| | | IGIQKMTGTVTKEAE | IGIQKMTGT |
| | | NKILLKLSLIVSLLV | LLKLSLIVS |
| | | KILLKLSLIVSLLVA | LLKLSLIVS |
| | | IKYNKILLKLSLIVS | IKYNKILLK |
| | | KPLEEIGIQKMTGTV | IGIQKMTGT |
| | | YNKILLKLSLIVSLL | LLKLSLIVS |
| | | SKPLEEIGIQKMTGT | LEEIGIQKM |
| | | KYNKILLKLSLIVSL | LLKLSLIVS |
| | | MIKYNKILLKLSLIV | IKYNKILLK |
| | | ILLKLSLIVSLLVAC | LLKLSLIVS |
| | | LLKLSLIVSLLVACG | LLKLSLIVS |
| | | LKLSLIVSLLVACGL | LSLIVSLLV |
| | | AMEEKLNNVNKKQHD | LNNVNKKQH |
| | | MEEKLNNVNKKQHDA | LNNVNKKQH |
| | | EEKLNNVNKKQHDAL | LNNVNKKQH |
| | | EKLNNVNKKQHDALK | LNNVNKKQH |
| | | KDEINKIKANAKKEG | INKIKANAK |
| | | DEINKIKANAKKEGV | IKANAKKEG |
| | | KLSLIVSLLVACGLT | LSLIVSLLV |
| | | LSLIVSLLVACGLTG | LSLIVSLLV |
| | | EINKIKANAKKEGVK | IKANAKKEG |
| | | PEFILKAKIKAIQVA | FILKAKIKA |
| | | KPEFILKAKIKAIQV | FILKAKIKA |
| | | INKIKANAKKEGVKF | IKANAKKEG |
| | | EKPEFILKAKIKAIQ | FILKAKIKA |
| | | GIQKMTGTVTKEAEK | IQKMTGTVT |
| | HLA-DRB1*1501 | IKYNKILLKLSLIVS | ILLKLSLIV |
| | | NKILLKLSLIVSLLV | LLKLSLIVS |
| | | KYNKILLKLSLIVSL | LLKLSLIVS |
| | | YNKILLKLSLIVSLL | LLKLSLIVS |
| | | KILLKLSLIVSLLVA | LLKLSLIVS |
| | | ILLKLSLIVSLLVAC | LLKLSLIVS |
| | | LLKLSLIVSLLVACG | LLKLSLIVS |
| | | MIKYNKILLKLSLIV | IKYNKILLK |
| | HLA-DRB3*0101 | None | |
| | HLA-DRB4*0101 | None | |
| | HLA-DRB5*0101 | GVKFEAFTNTQTGSK | FEAFTNTQT |
| | | KAKIKAIQVAERFVK | IKAIQVAER |
| | | VKFEAFTNTQTGSKI | FTNTQTGSK |
| | | AKIKAIQVAERFVKA | IQVAERFVK |
| AAC70021.1 Decorin binding protein B DbpB [Borrelia burgdorferi] SEQ ID NO:7, SEQ ID NO:128429- | HLA-DRB1*0101 | LEDVGIIGLKARVLE | IIGLKARVL |
| | | EDVGIIGLKARVLEE | IIGLKARVL |
| | | DVGIIGLKARVLEES | IIGLKARVL |
| | | VGIIGLKARVLEESK | IIGLKARVL |
| | | ALFFKLLVACSIGLV | FKLLVACSI |
| | | IALFFKLLVACSIGL | FKLLVACSI |
| | | GIIGLKARVLEESKN | IIGLKARVL |

Fig. 34 continued

| | | | |
|---|---|---|---|
| | | LLGLKARVLEECKNN | LLGLKARVL |
| | | TVTALFFKLLVACST | FFKLLVACS |
| | | VTALFFKLLVACSTG | FKLLVACST |
| | | LFFKLLVACSTGLVE | FKLLVACST |
| | | SGQFLAMFDLMLEVV | FLAMFDLML |
| | | GQFLAMFDLMLEVVE | FLAMFDLML |
| | | STVTALFFKLLVACS | VTALFFKLL |
| | | FFKLLVACSTGLVER | LLVACSTGL |
| | | GSKVTSGGLALREAK | VTSGGLALR |
| | | TGSKVTSGGLALREA | VTSGGLALR |
| | | SKVTSGGLALREAKV | VTSGGLALR |
| | | FKLLVACSTGLVERT | LLVACSTGL |
| | | FLAMFDLMLEVVESL | FLAMFDLML |
| | | QFLAMFDLMLEVVES | FLAMFDLML |
| | | FEAFTGLKTGSKVTS | FTGLKTGSK |
| | | TSGGLALREAKVQAI | LALREAKVQ |
| | | SGGLALREAKVQAIV | LREAKVQAI |
| | | EAFTGLKTGSKVTSG | LKTGSKVTS |
| | | LKTGSKVTSGGLALR | LKTGSKVTS |
| | | ONSGQFLAMFDLMLE | FLAMFDLML |
| | | NSGQFLAMFDLMLEV | FLAMFDLML |
| | | KTGSKVTSGGLALRE | VTSGGLALR |
| | | AFTGLKTGSKVTSGG | LKTGSKVTS |
| | | FTGLKTGSKVTSGGL | LKTGSKVTS |
| | | KVTSGGLALREAKVQ | VTSGGLALR |
| | | GGLALREAKVQAIVE | LREAKVQAI |
| | | VTSGGLALREAKVQA | VTSGGLALR |
| | | GLALREAKVQAIVET | LREAKVQAI |
| | | LALREAKVQAIVETG | LREAKVQAI |
| | | VLFEAFTGLKTGSKV | FTGLKTGSK |
| | | GVLFEAFTGLKTGSK | FEAFTGLKT |
| | | TGLKTGSKVTSGGLA | LKTGSKVTS |
| | | TGNSGQFLAMFDLML | GQFLAMFDL |
| | | INIAERLLAAKAQIE | AERLLAAKA |
| | | LFEAFTGLKTGSKVT | FTGLKTGSK |
| | | NIAERLLAAKAQIEN | LLAAKAQIE |
| | | TAERLLAAKAQIENG | LLAAKAQIE |
| | | LLKLKKEATGKGVLF | LKKEATGKG |
| | | LAMFDLMLEVVESLR | MFDLMLEVV |
| | | AERLLAAKAQIENGL | LLAAKAQIE |
| | | MKILKKEATGKGV | TKKEATGKG |
| | | LKTKKEATGKGVLF | TKKEATGKG |
| | | FTLKTKKEATGKGVL | TKKEATGKG |
| | | KNTLKTKKEATGKG | TLKTKKEAT |
| | | KLLVACSTGLVERTN | LLVACSTGL |
| | | NPINTAERLLAAKAQ | INTAERLLA |
| | | TGLVERTNAALESS | RTNAALESS |
| | | STGLVERTNAALESS | ERTNAALES |
| | | ERLLAAKAQIENGL | LLAAKAQIE |
| | | NPINTAERLLAAKA | INTAERLLA |
| | | ALREAKVQAIVETGK | LREAKVQAI |
| | | GLVERTNAALESSK | RTNAALESS |
| | | GLKTGSKVTSGGLAL | LKTGSKVTS |
| | | LREAKVQAIVETGKE | LREAKVQAI |
| | | LLVACSTGLVERTNA | LLVACSTGL |
| HLA-DRB1*0301 | None | | |

Fig. 34 continued

| HLA-DRB1*0401 | TVIALFFKLLVACSI | FFKLLVAC |
| | STVTALFFKLLVACS | TALFFKLLV |
| | VIALFFKLLVACSIG | FFKLLVAC |
| | TALFFKLLVACSIGL | FFKLLVAC |
| | ALFFKLLVACSIGLV | FFKLLVAC |
| HLA-DRB1*0404 | GVLFFAFTGLKTSSK | LFFAFTGLK |
| | ARVLFFSKNNPTNTA | VLFFSKNNP |
| | KGVLFFAFTGLKTGS | LFFAFTGLK |
| | GKGVLFFAFTGLKTG | LFFAFTGLK |
| | TGLKARVLFFSKNNP | ARVLFFSKN |
| | LKARVLFFSKNNPTN | VLFFSKNNP |
| | KARVLFFSKNNPTNT | VLFFSKNNP |
| | GLKARVLFFSKNNPT | VLFFSKNNP |
| | TGKGVLFFAFTGLKT | LFFAFTGLK |
| | ATGKGVLFFAFTGLK | KGVLFFAFT |
| | LFFAFTGLKTGSKVT | LFFAFTGLK |
| | VLFFAFTGLKTGSKV | LFFAFTGLK |
| | RVLFFSKNNPTNTAF | VLFFSKNNP |
| | VLFFSKNNPTNTAFR | VLFFSKNNP |
| HLA-DRB1*0405 | TVTALFFKLLVACST | TALFFKLLV |
| | SIVIALFFKLLVACS | IALFFKLLV |
| | AKPLKLFVVESLFP | KLFVVESLF |
| HLA-DRB1*0701 | EDVGIIGLKARVLFF | IGLKARVL |
| | DVGIIGLKARVLFFS | IIGLKARVL |
| | GLEDVGIIGLKARVL | GIIGLKARV |
| | LEDVGIIGLKARVLF | IIGLKARVL |
| | VGIIGLKARVLFFSK | IIGLKARVL |
| HLA-DRB1*0802 | None | |
| HLA-DRB1*0901 | None | |
| HLA-DRB1*1101 | None | |
| HLA-DRB1*1302 | LEDVGIIGLKARVLF | VGIIGLKAR |
| | EDVGIIGLKARVLFF | IGLKARVLF |
| | ESSSKDLKNKILKIK | SSKDLKNKI |
| | SSSKDLKNKILKIKK | LKNKILKIK |
| | SSKDLKNKILKIKKE | LKNKILKIK |
| | KDLKNKILKIKKEAT | LKNKILKIK |
| | SKDLKNKILKIKKEA | LKNKILKIK |
| | DVGIIGLKARVLFFS | IGLKARVLF |
| | VGTTGLKARVLFFSK | TGLKARVLF |
| | DLKNKILKIKKEATG | LKNKILKIK |
| | LKNKILKIKKEATGK | LKNKILKIK |
| | GTTGLKARVLFFSKN | TGLKARVLF |
| | SLEDVGTTGLKARVL | VGTTGLKAR |
| | ESLEDVGTTGLKARV | VGTTGLKAR |
| | VESLEDVGTTGLKAR | LEDVGTTGL |
| | AQTENQLKVVEEKQN | TENQLKVVE |
| | KAQTENQLKVVEEKQ | TENQLKVVE |
| | AAKAQTENQLKVVEE | TENQLKVVE |
| | AKAQTENQLKVVEEK | TENQLKVVE |
| | TTGLKARVLFFSKNN | TGLKARVLF |
| | AFTGLKTGSKVTGGG | LKTGSKVTS |
| | FTGLKTGSKVTGGGI | LKTGSKVTS |

Fig. 34 continued

| | | | |
|---|---|---|---|
| | | TGLKTGSKVTSGGLA | LKTGSKVTS |
| | | IGLKARVLEESKNNP | IGLKARVLE |
| | | FEAFTGLKTGSKVTS | TGLKTGSKV |
| | | EAFTGLKTGSKVTSG | LKTGSKVTS |
| | | LAAKAQIENQLKVVK | AKAQIENQL |
| | HLA-DRB1*1501 | SLEDVGIIGLKARVL | VGIIGLKAR |
| | | LEDVGIIGLKARVLE | VGIIGLKAR |
| | | EDVGIIGLKARVLEE | VGIIGLKAR |
| | | SIVIALFFKLLVACS | ALFFKLLVA |
| | | IVIALFFKLLVACSI | ALFFKLLVA |
| | | GVLFEAFTGLKTGSK | FEAFTGLKT |
| | | DVGIIGLKARVLEES | IIGLKARVL |
| | | VGIIGLKARVLEESK | IIGLKARVL |
| | | VLFEAFTGLKTGSKV | FTGLKTGSK |
| | | VIALFFKLLVACSIG | ALFFKLLVA |
| | | CKGVLFEAFTGLKTG | VLFEAFTGL |
| | | LFEAFTGLKTGSKVT | FTGLKTGSK |
| | HLA-DRB3*0101 | None | |
| | HLA-DRB4*0101 | None | |
| | HLA-DRB5*0101 | None | |
| NP_212694.1<br>Heat shock protein 90<br>[Borrelia burgdorferi B31]<br><br>SEQ ID NO:8,<br>SEQ ID NO:128685-129678 | HLA-DRB1*0101 | NDPTYQMQKIMLSMG | YQMQKIMLS |
| | | DPTYQMQKIMLSMGQ | YQMQKIMLS |
| | | PTYQMQKIMLSMGQE | YQMQKIMLS |
| | | DSNDPTYQMQKIMLS | DPTYQMQKI |
| | | SNDPTYQMQKIMLSM | YQMQKIMLS |
| | | TYQMQKIMLSMGQEV | YQMQKIMLS |
| | | YQMQKIMLSMGQEVK | YQMQKIMLS |
| | | IVQNLKNLEPEKLEK | LKNLEPEKL |
| | | VQNLKNLEPEKLEKI | LKNLEPEKL |
| | | NKIVQNLKNLEPEKL | VQNLKNLEP |
| | | KIVQNLKNLEPEKLE | LKNLEPEKL |
| | | QNLKNLEPEKLEKIS | LKNLEPEKL |
| | | YTNLFYVPSKAPYDL | YTNLFYVPS |
| | | NLEYTNLFYVPSKAP | YTNLFYVPS |
| | | LEYTNLFYVPSKAPY | YTNLFYVPS |
| | | EIFLRELISNASDAI | LRELISNAS |
| | | IFLRELISNASDAID | LRELISNAS |
| | | KEIFLRELISNASDA | LRELISNAS |
| | | SILLFEEAMLTSGMP | LLFEEAMLT |
| | | HKEIFLRELISNASD | LRELISNAS |
| | | SHKEIFLRELISNAS | SHKEIFLRE |
| | | NLKNLEPEKLEKISI | LKNLEPEKL |
| | | LKNLEPEKLEKISIL | LKNLEPEKL |
| | | ISILLFEEAMLTSGM | LLFEEAMLT |
| | | TNLFYVPSKAPYDLY | VPSKAPYDL |
| | | EYTNLFYVPSKAPYD | YTNLFYVPS |
| | | LIFYFKQIALFIIFR | FKQIALFII |
| | | MILIFYFKQIALFII | YFKQIALFI |
| | | DLLYLIIHSLYSHKE | YLIIHSLYS |
| | | KDSIKEVNLSATLIK | EVNLSATLI |
| | | DSIKEVNLSATLIKE | EVNLSATLI |
| | | IFYFKQIALFIIFRL | FKQIALFII |
| | | LLYLIIHSLYSHKEI | YLIIHSLYS |

| | | | |
|---|---|---|---|
| | | YEGLKLKAINKNETS<br>EYEGLKLKAINKNET<br>LTNELGVIAKSGTKF<br>KFVNLSATIIKEPSA<br>SKLKSSVKKILSEL<br>DLTNELGVIAKSGT<br>YLTTHSLYSKETFL<br>MQKTMLSMCQEVKKT<br>FYVPSKAPYDLYPN<br>TKSSVKKTLSELF<br>KTKSSVKKTLSELF<br>KLTSGMPSKNPGKFT<br>FVNLSATLKEPSAT<br>YFKQTALFTFFRLCY<br>LTNEKFKNIALEPKT<br>NFKFKNIALFPKTFT<br>LIKFPSATIDSNDP<br>FKFKNIALFPKTFTS<br>THKFKNIALFPKTS<br>QKTMLSMCQEVKETK<br>ILKFNPTVAAYKFKQ<br>SLTNEKFKNIALEPK<br>LKFNPTVAAYKFKQF<br>QQNKILSKLKSSSVK<br>KKKLNETTALWTKN<br>FYSAFIVSEKVEVTS<br>GFYSAFIVSEKVEVT<br>LQQNKILSKIKSSSV<br>QNKILSKIKSSVKK<br>EEKLNETTALWTKRK<br>EKKKLNETTALWTK<br>IDQDLPLNVSKEIL<br>IDQQDLPLNVSKEIL<br>EEKSEKLNETTALWT<br>SAFIVSEKVEVTSKK<br>LTSGMPSKNPGKFLN<br>YSAFIVSEKVEVTSK<br>TNELGVIAKSGTKEF<br>AFIVSEKVEVTSKKA<br>EKLNETTALWTKKKS<br>FVTSKKALFSDAYTS<br>VTSKKALFSDAYTSS | YEGLKLKAI<br>YEGLKLKAI<br>LTNELGVIA<br>FVNLSATLT<br>IKSSVKKL<br>LTNELGVIA<br>YLTTHSLYS<br>TKLSMCQEV<br>VPSKAPYDL<br>VKKTLSELE<br>TKSSVKKT<br>LTSGMPSKN<br>FVNLSATLT<br>FKQTALFT<br>FKNIALEPK<br>FKNIALEPK<br>LKFPSATI<br>FKNIALEPK<br>FKNIALEPK<br>TKLSMCQEV<br>LKFNPTVAA<br>LTNEKFKNI<br>LKFNPTVAA<br>LSKLKSSSV<br>LNETTALWT<br>IVSEKVEVT<br>SAFIVSEKV<br>NKILSKIKS<br>LSKLKSSSV<br>LNETTALWT<br>LNETTALWT<br>QQDLPLNVS<br>LPLNVSKEI<br>KLNETTALW<br>IVSEKVEVT<br>LTSGMPSKN<br>IVSEKVEVT<br>NLGVIAKSG<br>IVSEKVEVT<br>LNETTALWT<br>VTSKKALFS<br>VTSKKALFS |
| | HLA-DRB1*0301 | None | |
| | HLA-DRB1*0401 | SHKEIFLRELISNAS<br>HKEIFLRELISNASD<br>KEIFLRELISNASDA<br>EIFLRELISNASDAL<br>IFLRELISNASDAID<br>DSNDPTYQKTMLS<br>SDPTYQKTMLSK<br>DPTYQKTMLSMCQ<br>PTYQKTMLSMCQE<br>FLRELISNASDATEK<br>NDPTYQKTMLSMC<br>YKTQFTKKYSNHT<br>YKKTQFTKKYSNHT | FLRELISNA<br>LRELISNAS<br>LRELISNAS<br>LRELISNAS<br>LRELISNAS<br>DSNDPTYQM<br>YQMQKTMLS<br>YQMQKTMLS<br>YQMQKTMLS<br>LRELISNAS<br>YQMQKTMLS<br>TTKKYSNHT<br>SKTQFTTKK |

Fig. 34 continued

|  |  |  |  |
|---|---|---|---|
|  |  | LRELISNASDAIEKL | LRELISNAS |
|  |  | QETIKKYSNHTNYPT | TIKKYSNHT |
|  |  | IQETIKKYSNHTNYP | IKKYSNHT |
|  |  | KTQETIKKYSNHTNY | TIKKYSNHT |
|  |  | YQKQKIMLSNGQEVK | YQKQKIMLS |
|  |  | NDLLYLTTHSLYSHK | YLTTHSLYS |
|  |  | TYQKQKIMLSNGQEV | YQKQKIMLS |
|  |  | DLLYLTTHSLYSHKE | YLTTHSLYS |
|  |  | VNDLLYLTTHSLYSH | YLTTHSLYS |
|  |  | EVNDLLYLTTHSLYS | LYLTTHSLY |
|  |  | EQLKLKATNKNETSN | LKLKATNKN |
|  |  | YEQLKLKATNKNETS | LKLKATNKN |
|  |  | EYEQLKLKATNKNET | LKLKATNKN |
|  |  | LLYLTTHSLYSHKET | YLTTHSLYS |
|  |  | LKLKATNKNETSNEL | LKATNKNET |
|  |  | ETTKKYSNHTNYPTY | TTKKYSNHT |
|  |  | TIKKYSNHTNYPTYT | TIKKYSNHT |
|  |  | EEYNEEYKNTTFDYE | EYKNTTFDY |
|  | HLA-DRB1*0404 | KETFLRELISNASDA | FLRELISNA |
|  |  | ETFLRELISNASDAI | FLRELISNA |
|  |  | SHKETFLRELISNAS | FLRELISNA |
|  |  | HKETFLRELISNASD | FLRELISNA |
|  |  | YSHKETFLRELISNA | TFLRELISN |
|  |  | KEIKPILELNPNNKI | ILELNPNNK |
|  |  | VKEIKPILELNPNNK | IKPILELNP |
|  |  | NDLLYLTTHSLYSHK | YLTTHSLYS |
|  |  | EIKPILELNPNNKIV | ILELNPNNK |
|  |  | IKPILELNPNNKIVQ | ILELNPNNK |
|  |  | DLLYLTTHSLYSHKE | YLTTHSLYS |
|  |  | LLYLTTHSLYSHKET | YLTTHSLYS |
|  |  | TFLRELISNASDAIE | FLRELISNA |
|  |  | VNDLLYLTTHSLYSH | YLTTHSLYS |
|  |  | KPILELNPNNKIVQN | ILELNPNNK |
|  |  | EVNDLLYLTTHSLYS | LLYTTHSL |
|  |  | FLRELISNASDAIEK | FLRELISNA |
|  |  | EEAKLTGMFSKRD | KLTGMFSK |
|  |  | EEAKLTGMFSKNPG | KLTGMFSK |
|  | HLA-DRB1*0405 | DSNDPTYQKQKIMLS | DSNDPTYQM |
|  |  | NPNNKIVQNLKNLEP | NKIVQNLKN |
|  |  | PNNKIVQNLKNLEPE | VQNLKNLEP |
|  |  | PTYQKQKIMLSNGQE | YQKQKIMLS |
|  |  | DPTYQKQKIMLSNGQ | YQKQKIMLS |
|  |  | SNDPTYQKQKIMLSN | YQKQKIMLS |
|  |  | NDPTYQKQKIMLSNG | YQKQKIMLS |
|  |  | LLYLTTHSLYSHKET | YLTTHSLYS |
|  |  | DLLYLTTHSLYSHKE | YLTTHSLYS |
|  |  | NNKIVQNLKNLEPEK | VQNLKNLEP |
|  |  | NKIVQNLKNLEPEKL | VQNLKNLEP |
|  |  | VNDLLYLTTHSLYSH | YLTTHSLYS |
|  |  | EVNDLLYLTTHSLYS | LYLTTHSLY |
|  |  | NDLLYLTTHSLYSHK | YLTTHSLYS |
|  |  | TFLRELISNASDAIE | LRELISNAS |
|  |  | KIVQNLKNLEPEKLE | VQNLKNLEP |
|  |  | EKETFLRELISNASD | LRELISNAS |
|  |  | KETFLRELISNASDA | LRELISNAS |
|  |  | KIFLRELISNASDAI | LRELISNAS |
|  |  | EKLTSLTRFNSSVE | LTRFNSSV |

Fig. 34 continued

| | | |
|---|---|---|
| | | KLISLIRFKSSVDG / IRFKSSVD |
| | | LTSLTRFKSSVDGF / TRFKSSVD |
| | | SKKTIPLRYLIGNAS / LIYLRLLIS |
| | HLA-DRB1*0701 | NKTLSKTKSSVKKT / LSKTKSSV |
| | | KILSKIKSSVKKIL / LSKIKSSV |
| | | IGQNKTLSKTKSSV / IQQNKTLSK |
| | | QQNKILSKIKSSVK / LSKIKSSV |
| | | QNKTLSKTKSSVKK / LSKTKSSV |
| | | LSKTKSSVKKTLSE / LSKTKSSV |
| | | TLSKTKSSVKKTLS / LSKTKSSV |
| | | DLYYPNTKPCVKLFT / YPNTKPCVK |
| | | YDLYYPNTKPCVKLF / YPNTKPCVK |
| | | TSLTRFKSSVDGPV / TRFKSSV |
| | | PYDLYYPNTKPCVKL / YPNTKPCVK |
| | | APYDLYYPNTKPCVK / YYPNTKPCV |
| | | LTSLTRFKSSVDGF / LTRFKSSV |
| | | KLTSLTRFKSSVDG / LTRFKSSV |
| | | FKLTSLTRFKSSVD / LTRFKSSV |
| | | FLYNFFYKNTTFDYE / FYKNTTFDY |
| | | FYNFFYKNTTFDYEN / FYKNTTFDY |
| | | QFLIKKYSKETNYPI / IKKYSNHT |
| | | LYYPNTKPCVKLFIN / YPNTKPCVK |
| | | YNFFYKNTTFDYENP / FYKNTTFDY |
| | | NFFYKNTTFDYENPL / FYKNTTFDY |
| | | IFYFKQIALFIIFRL / YFKQIALFI |
| | | ILIFYFKQIALFIIF / YFKQIALFI |
| | | MILIFYFKQIALFII / YFKQIALFI |
| | | LIFYFKQIALFIIFR / YFKQIALFI |
| | | AEENFFYKNTTFDY / FFYKNTTFD |
| | | REKLISLIRFKSSV / LSLIRFKSS |
| | HLA-DRB1*0802 | CYIIKKVKIKLRRKS / IIKKVKIKL |
| | | IIKKVKIKLRRKCC / VKIKLRRKC |
| | | YIIKKVKIKLRRKCC / VKIKLRRKC |
| | | KKVKIKLRRKCCKKK / VKIKLRRKC |
| | HLA-DRB1*0901 | INYPIYIKYSEPIKK / YIKYSEPIK |
| | | YPIYIKYSEPIKKDG / YIKYSEPIK |
| | | NYPIYIKYSEPIKKD / YIKYSEPIK |
| | | PIYIKYSEPIKKDGK / YIKYSEPIK |
| | | HINYPIYIKYSEPIK / IYIKYSEPI |
| | | KTLSKTKSSVKKTL / TKSSVKKT |
| | | YTNLFYVPSKAPYDL / YVPSKAPYD |
| | | TNLFYVPSKAPYDLY / YVPSKAPYD |
| | | TLSKTKSSVKKTLS / TKSSVKKT |
| | | NKTLSKTKSSVKKT / LSKTKSSV |
| | | LSKTKSSVKKTLSE / TKSSVKKT |
| | | NLFYVPSKAPYDLYY / YVPSKAPYD |
| | | SKTKSSVKKTLSEL / TKSSVKKT |
| | | FYTNLFYVPSKAPYD / FYVPSKAPY |
| | | MTLFYFKQTALFTI / YFKQTALFT |
| | | TLFYFKQTALFTIF / YFKQTALFT |
| | | LIFYFKQTALFTIFR / YFKQTALFT |
| | | IYIKYSEPIKKDGKQ / YIKYSEPIK |
| | | FYFKQTALFTIFRL / YFKQTALFT |
| | | IFYVPSKAPYDLYYP / YVPSKAPYD |
| | | TSLTRFKSSVDGPV / FRKSSVDG |
| | | LTSLTRFKSSVDGF / RFKSSVDG |

Fig. 34 continued

| | HLA-DRB1*1101 | EGNLEYTNLFYVPSK | YTNLFYVPS |
| --- | --- | --- | --- |
| | | AEGNLFYTNLFYVPS | LFYTNLFYV |
| | | GNLEYTNLFYVPSKA | YTNLFYVPS |
| | | LEYTNLFYVPSKAPY | YTNLFYVPS |
| | | NLEYTNLFYVPSKAP | YTNLFYVPS |
| | | FKLTSLTRFKSSVD | LTSLTRFKS |
| | | NRFKLTSLTRFKSS | LTSLTRFKS |
| | | FNRFKLTSLTRFKSS | LTSLTRFKS |
| | | RFKLTSLTRFKSSV | LTSLTRFKS |
| | | FKNRFKLTSLTRFKS | FKLTSLTRF |
| | | YTNLFYVPSKAPYDL | YTNLFYVPS |
| | | RYTNLFYVPSKAPYD | YTNLFYVPS |
| | | KKVKIKLKRKSCMKK | VKIKLKRKS |
| | HLA-DRB1*1302 | RQLKLKATNKNETSN | LKATNKNET |
| | | YEQLKLKATNKNETS | LKATNKNET |
| | | QLKLKATNKNETSNE | LKATNKNET |
| | | LKLKATNKNETSNEL | LKATNKNET |
| | | FYEQLKLKATNKNET | LFLKATNKN |
| | | IKKVKIKLKRKSCM | VKIKLKRKS |
| | | QDLTNHLGVIAKSGT | LTNHLGVIA |
| | | TKPILELNPNNKIVQ | LELNPNNKI |
| | | KPILELNPNNKIVQN | LNPNNKIVQ |
| | | IKKVKIKLKRKSCMK | LKLKRKSCM |
| | | KDHLKEVNLSATLIK | LKEVNLSAT |
| | | DHLKEVNLSATLIKE | VNLSATLIK |
| | | PGVKLFTNRIFITDS | LFTNRIFIT |
| | | PILELNPNNKIVQNL | LNPNNKIVQ |
| | | LTNHLGVIAKSGTKE | LGVIAKSGT |
| | | NKIVQNLKNLEPEKL | IVQNLKNLE |
| | | TNHLGVIAKSGTKEF | LGVIAKSGT |
| | | LNPNNKIVQNLKNLE | LNPNNKIVQ |
| | | KPGVKLFTNRIFITD | LFTNRIFIT |
| | | RELQQNKILSKTKS | LLQQNKILS |
| | | NHLGVIAKSGTKEFI | LGVIAKSGT |
| | | KKVKIKLKRKSCMKK | LKLKRKSCM |
| | | GVKLFTNRIFITDSE | LFTNRIFIT |
| | | DLTNHLGVIAKSGTK | LGVIAKSGT |
| | | VKLFTNRIFITDSEG | LFTNRIFIT |
| | | LKEVNLSATLIKEPG | VNLSATLIK |
| | | HLKEVNLSATLIKEP | VNLSATLIK |
| | | ILELNPNNKIVQNLK | LNPNNKIVQ |
| | | CYIIKKVKIKLKRKS | IKKVKIKLK |
| | | NPNNKIVQNLKNLEP | IVQNLKNLE |
| | | PNNKIVQNLKNLEPE | IVQNLKNLE |
| | | KIVQNLKNLEPPRLE | VQNLKNLEP |
| | | RELQQNKILSKTKSS | NKILSKTKS |
| | | FKNRFKLTSLTRFKS | FKLTSLTRF |
| | | NNKIVQNLKNLEPEK | IVQNLKNLE |
| | | YIIKKVKIKLKRKSC | VKIKLKRKS |
| | | TKPGVKLFTNRIFIT | VKLFTNRIF |
| | | TLQQNKILSKTKSSS | NKILSKTKS |
| | | KVKIKLKRKSCMKKQ | IKLKRKSCM |
| | | FRLCYIIKKVKIKLK | YIIKKVKIK |
| | | PTYQMQKIMLSMQQE | YQMQKIMLS |
| | | RLCYIIKKVKIKLKR | IKKVKIKLK |
| | | VKIKLKRKSCMKKQP | IKLKRKSCM |

Fig. 34 continued

| | | | |
|---|---|---|---|
| | | DPTYQMQKIMLSKGQ | YQMQKIMLS |
| | | NDPTYQMQKIMLSKG | YQMQKIMLS |
| | | LELNPNNKIVQNLKN | LNPNNKIVQ |
| | | VSRFTLQQNKTLSKT | TLQQNKTLS |
| | | EDREKLISLIRFKSS | LISLIRFKS |
| | | LCYIIKKVKIKLKRK | IKKVKIKLK |
| | | NRFKITSLIRFKSSS | ITSLIRFKS |
| | | SRFTLQQNKTLSKTK | TLQQNKTLS |
| | | FKLTSLIRFKSSVD | LTSLIRFKS |
| | | RFKLTSLIRFKSSV | LTSLIRFKS |
| | | TVQNLKNLEPKLEK | TVQNLKNLE |
| | | KLKATNKNFTSNELK | LKATNKNFT |
| | | NKTLSKTKSSVKKT | NKTLSKTKS |
| | | NVSRFTLQQNKTLSK | TLQQNKTLS |
| | | LGVTAKSGTKRFIKI | LGVTAKSGT |
| | | HLGVTAKSGTKRFIK | LGVTAKSGT |
| | | LKATNKNFTSNELKD | LKATNKNFT |
| | | SLLPNYLRFTKGTTD | LPNYLRFTK |
| | | LQQNKTLSKTKSSSV | NKTLSKTKS |
| | | VNDLLYLTTHSLYSE | LYLTTHSLY |
| | | YQMQKIMLSKGQFME | YQMQKIMLS |
| | | KLFINRIFITDSEGS | LFINRIFIT |
| | | LNVSRFTLQQNKTLS | LNVSRFTLQ |
| | | IFYFKQIALFIIFRL | FKQIALFII |
| | | NDLLYLTTHSLYSHK | LYLTTHSLY |
| | | FYFKQIALFIIFRLG | FKQIALFII |
| | | KEVNLSATLIREFSA | VNLSATLIK |
| | | GCLLPNYLRFIKGII | LPNYLRFIK |
| | | EIKPILELNPNNKIV | LELNPNNKI |
| | | QQNKLLSKIKSSSVK | NKILSKIKS |
| | | LKDHIKEVNLSATLI | IKEVNLSAT |
| | | KEIKPILELNPNNKI | ILELNPNNK |
| | | TYQMQKIMLSKGQEV | YQMQKIMLS |
| | | DLLYLTTHSLYSHKE | LYLTTHSLY |
| | | IKKYSNHINYPIYIK | YSNHINYPI |
| | | IFRLCYIIKKVKIKL | YIIKKVKIK |
| | | SNDPTYQMQKIMLSK | YQMQKIMLS |
| | | QELIKKYSNHINYPI | IKKYSNHIN |
| | | TIKKYSNHINYPIYI | YSNHINYPI |
| | | KKYSNHINYPIYIKY | YSNHINYPI |
| | | LLPNYLRFIKGTTDG | YLRFIKGTT |
| | | DSNDPTYQMQKIMLS | TYQMQKIML |
| | | DDKSTLIKDNGTGMD | LIKDNGTGM |
| | | ELIKKYSNHINYPIY | YSNHINYPI |
| | | LPNYLRFIKGTTDGQ | YLRFIKGTT |
| | | DEQDLTNHLGVTAKS | LTNHLGVTA |
| | | MDEQDLTNHLGVTAK | LTNHLGVTA |
| | | PEYFGLKLKATNKNF | LKLKATNKN |
| | | TPFYGLKLKATNKN | YGLKLKAT |
| | | FKQIALFIIFRLGYI | IALFIIFRL |
| | | LFINRIFITDSFGGL | IFINRIFIT |
| | | YFKQIALFIIFRLGY | IALFIIFRL |
| | | EILKDHIKEVNLSAT | LKDHIKEVN |
| | | DKSTLIKDNGTGMDE | IKDNGTGME |
| | | EQDLTNHLGVTAKSG | LTNHLGVTA |
| | | KSTLIKDNGTGMDEQ | LIKDNGTGM |
| | | EVNDLLYLTTHSLYS | LYLTTHSLY |

Fig. 34 continued

| | | | |
|---|---|---|---|
| | | TEVNDLYLITHSLY | LYLITHSL |
| | | LLYLTTHSLYSKKET | LTTHSLYSH |
| | | ILKDELKEVNLSATL | LKEVNLSAT |
| | | LDEATLNLTPRYEGL | TLNLTPRYE |
| | | KILSKLKSSSVKKIL | LKSSVKKI |
| | | RLDEATLNLTPRYEG | TLNLTPRYE |
| | | TLSKTKSSSVKKTLS | TKSSVKKT |
| | | TTFRLCYTTKKVKTK | CYTTKKVKT |
| | | LTSLTRFKSSSVDGF | LTSLTRFKS |
| | | YSHETNYPTYTKYSE | YSHTNYPT |
| | | PQKFINTTNEFTEKD | INTTNEFTE |
| | | TLTFYFKQTALFTTF | FKQTALFTT |
| | | QNKTLSKTKSSSVKK | NKTLSKTKS |
| | | TFLRELTSNASDATD | LRELTSNAS |
| | | SEGSLLPNYLRFIKG | LPNYLRFIK |
| | | QMDEQDLTKELGVTA | DLTKELGVT |
| | | KKPQKFINTTNEFTE | KFINTTNEF |
| | | NPQKFINTTNEFTEK | INTTNEFTE |
| | | NEKFKNTALFPKTET | FKNTALFPK |
| | | KTLTFYFKQTALFTT | TFYFKQTAL |
| | | DSEGSLLPNYLRFTK | EGSLLPNYL |
| | | EVNLSATLIREPSAI | VNLSATLIR |
| | | EKFKNTALFPKTETS | FKNTALFPK |
| | | KQTALFIIFRLCYII | LALFIIFRL |
| | | SGTKFINNLKQDEKK | FINNLKQDE |
| | | EGSLLPNYLRFIKGI | LPNYLRFIK |
| | | LYLITHSLYSKEIF | LIIHSLYSH |
| | | LIFYFKQTALFIIFR | FKQTALFII |
| | | KLTSLTRFKSSSVDG | LTSLTRFKS |
| | | VQLLKNLEPEKLEKI | LKNLEPEKL |
| | | EIFLRELTSNASDAI | LRELTSNAS |
| | | EEYNEFYKNTTFEYE | YNEFYKNTT |
| | | LSKIKSSSVKKILSL | LKSSVKKI |
| | | GKIKSSSVKKILSL | LKSSVKKI |
| | | WKIQELLKKYSNHLN | LQELLKKYS |
| | | GKFINLINEFIEKDF | INLINEFIE |
| | | KYSNETNYPTYTKYS | YSNETNYPT |
| | | GTKFINNLKQDEKK | INNLKQDEK |
| | | STLTKDNGTQMDEQD | LTKDNGTQM |
| | | GELDEATLNLTPEYE | LDEATLNL |
| | | SDFENREKLTSLTRF | FENREKLTS |
| | | TKFINNLKQDEKKS | INNLKQDEK |
| | HLA-DRB1*1501 | KLTSLTRFKSSSVDG | LTRFKSSV |
| | | LTSLTRFKSSSVDGF | LTRFKSSV |
| | | TSLTRFKSSSVDGFV | LTRFKSSV |
| | | REKLTSLTRFKSSSV | TSLTRFKSS |
| | | SLTRFKSSSVDGFVS | LTRFKSSV |
| | | NDLYLITTHSLYSHK | LTTHSLYSH |
| | | LTRFKSSSVDGFVSF | LTRFKSSV |
| | | DLLYLTTHSLYSHKE | LTTHSLYSH |
| | | LLYLTTHSLYSKKET | LTTHSLYSH |
| | | LYLTTHSLYSKETFL | LTTHSLYSH |
| | | VDDLYLITHSLYCH | YLITHSLYC |
| | | YLTTHSLYSKETFL | LTTHSLYSH |
| | | SHKEIFLRELTSNAS | FLRELTSNA |
| | | KETFLRELTSNASDA | LRELTSNAS |

Fig. 34 continued

| | | HRETPERELTSNASD | LRELTSNAS |
| --- | --- | --- | --- |
| | | FTFLRFLTSNASDAT | LRFLTSNAS |
| | | LITHSLYSHKEIFLR | LIHSLYSH |
| | | TALFTTFRLCYTTRK | FTTFRLCYT |
| | | ALFTTFRLCYTLKKV | FTTFRLCYT |
| | | TFLRFLTSNASDATD | LRFLTSNAS |
| | | QTALFTTFRLCYTTK | FTTFRLCYT |
| | | LFTTFRLCYTTKKVK | TFRLCYTT |
| | | CYTTKKVKTKLKRKS | TKKVKTKLK |
| | | FTTFRLCYTTKKVKT | TFRLCYTT |
| | | LCYTTKKVKTKLKRK | TKKVKTKLK |
| | | YTTKKVKTKLKRKSC | TKKVKTKLK |
| | | RLCYTTKKVKTKLKR | TKKVKTKLK |
| | | KKVKTKLKRKSCMKK | TKLKRKSCM |
| | | TKKVKTKLKRKSCMK | VKTKLKRKS |
| | | TTKKVKTKLKRKSCM | KKVKTKLKR |
| | | TTFRLCYTTKKVKTK | FRLCYTTKK |
| | | FRLCYTTKKVKTKLK | YTTKKVKTK |
| | | FKQTALFTTFRLCYT | TFTFRLCY |
| | | KVKTKLKRKSCMKKQ | TKLKRKSCM |
| | | KQTALFTTFRLCYTT | FTTFRLCYT |
| | | TFRLCYTTKKVKTKL | YTTKKVKTK |
| | | VKTKLKRKSCMKKQF | TKLKRKSCM |
| HLA-DRB3*0101 | | None | |
| HLA-DRB4*0101 | | KKTKPTLFINPYYKT | TLFINPYYK |
| | | KTKPTLFINPYYKTV | TLFINPYYK |
| | | TKPTLFINPNKKTVQ | TLFINPNK |
| | | KPTLFINPNNKTVQN | TLFINPNK |
| | | PTLFINPNNKTVQNL | TLFINPNK |
| | | VKKTKPTLFINPYNK | VKKTKPTLF |
| | | TLFINPYNKTVQNLK | TLFINPYNK |
| | | KKVKTKLKRKSCMKK | TKLKRKSCM |
| | | DLLYLTTHSLYSHKK | LTTHSLYSH |
| | | KLVQNLKNLEPEKL | LVQNLKNLE |
| | | VNDLLYLTTHSLYSH | LYLTTHSLY |
| | | NDLLYLIHSLYGHK | LIHSLYSH |
| | | KVKTKLKRKSCMKKQ | TKLKRKSCM |
| | | EYEGLKLKAINKNET | LKLKAINKN |
| | | YEGLKLKAINKNETS | LKLKAINKN |
| | | EGLKLKAINKNETSN | LKLKAINKN |
| | | LLYLIHSLYSHKEL | LIHSLYSH |
| | | VKIKLKRKSCMKKQF | TKLKRKSCM |
| | | LYLIHSLYSHKEIF | LIHSLYSH |
| | | LSELEKLSKKNPEKF | LSELEKLSK |
| | | IPEYEGLKLKAINKN | YEGLKLKAI |
| | | KIVQNLKNLEPEKLE | LKNLEPEKL |
| | | PEYEGLKLKAINKNE | LKLKAINKN |
| | | IVQNLKNLEPEKLEK | LKNLEPEKL |
| | | PTYQMQKTMLSMQQF | YQMQKTMLS |
| | | NDPTYQMQKLKLSMG | YQMQKTKLS |
| | | DPTYQMQKTMLSMQQ | YQMQKTMLS |
| | | VPSKAPYDLYYPNTK | VPSKAPYDL |
| | | SNDPTYQMQKTMLSM | YQMQKTMLS |
| | | SELKLSKKNPEKFS | LSKKNPEKF |

Fig. 34 continued

| | HLA-DRB5*0101 | APYDLYYPNTKPGVK | YDLYPNTK |
| | | PYDLYYPNTKPGVKL | YPNTKPGVK |
| | | YDLYYPNTKPGVKLF | YPNTKPGVK |
| | | DLYYPNTKPGVKLFI | YPNTKPGVK |
| | | LYYPNTKPGVKLFIN | YPNTKPGVK |
| | | LEYANKWKIQEIIKK | YANKWKIQE |
| | | YANKWKIQEIIKKYS | WKIQEIIKK |
| | | EYANKWKIQEIIKKY | WKIQEIIKK |
| | | ANKWKIQEIIKKYSN | WKIQEIIKK |
| | | NKWKIQEIIKKYSNH | WKIQEIIKK |
| | | YYPNTKPGVKLFINR | YPNTKPGVK |
| | | YPNTKPGVKLFINRI | YPNTKPGVK |
| | | KKIEEEFKDTLTKVK | EEFKDTLTK |
| | | KIEEEFKDTLTKVKE | FKDTLTKVK |
| | | IEEEFKDTLTKVKEI | FKDTLTKVK |
| | | EEEFKDTLTKVKEIL | FKDTLTKVK |
| | | EEFKDTLTKVKEILK | FKDTLTKVK |
| CAA44492.1\| Outer surface protein A [Borrelia burgdorferi] SEQ ID NO:9, SEQ ID NO:129679-129984 | HLA-DRB1*0101 | KKYLLGIGLILALIA | LLGIGLILA |
| | | KYLLGIGLILALIAC | LLGIGLILA |
| | | MKKYLLGIGLILALI | LLGIGLILA |
| | | KTGKWDSKTSTLTIS | WDSKTSTLT |
| | | TGKWDSKTSTLTISV | WDSKTSTLT |
| | | TKKTGKWDSKTSTLT | TGKWDSKTS |
| | | KKTGKWDSKTSTLTI | WDSKTSTLT |
| | | GKWDSKTSTLTISVN | WDSKTSTLT |
| | | LKDFTLEGTLAADGK | FTLEGTLAA |
| | | VLKDFTLEGTLAADG | FTLEGTLAA |
| | | KDFTLEGTLAADGKT | FTLEGTLAA |
| | | SVSVDLPGGMTELVS | LPGGMTELV |
| | | YLLGIGLILALIACK | IGLILALIA |
| | | NSVSVDLPGGMTELV | SVDLPGGMT |
| | | SVDLPGGMTELVSKE | LPGGMTELV |
| | | VSVDLPGGMTELVSK | LPGGMTELV |
| | | VDLPGGMTELVSKEK | LPGGMTELV |
| | | LLGIGLILALIACKQ | IGLILALIA |
| | | KEVLKDFTLEGTLAA | LKDFTLEGT |
| | | EVLKDFTLEGTLAAD | FTLEGTLAA |
| | | TSEKTIVRANGTRLE | IVRANGTRL |
| | | SEETIVRANGTRLEY | IVRANGTRL |
| | | TTLKVTEGTVVLSKN | VTEGTVVLS |
| | | KTTLKVTEGTVVLSK | VTEGTVVLS |
| | | EKTIVRANGTRLEYT | IVRANGTRL |
| | | GKTTLKVTEGTVVLS | LKVTEGTVV |
| | | KTIVRANGTRLEYTD | IVRANGTRL |
| | | KNILKSGEITVALDD | LKSGEITVA |
| | | LSKNILKSGEITVAL | LKSGEITVA |
| | | SKNILKSGEITVALD | LKSGEITVA |
| | | NILKSGEITVALDDS | LKSGEITVA |
| | | DFTLEGTLAADGKTT | FTLEGTLAA |
| | | FTLEGTLAADGKTTL | FTLEGTLAA |
| | | TLKVTEGTVVLSKNI | VTEGTVVLS |
| | | LGIGLILALIACKQN | IGLILALIA |
| | | VLSKNILKSGEITVA | KNILKSGEI |
| | | KEDAKTLVSKKVTLK | AKTLVSKKV |
| | | EDAKTLVSKKVTLKD | AKTLVSKKV |

Fig. 34 continued

| | | | |
|---|---|---|---|
| | | LKVFEGTVVLGKNLL | VFEGTVVLS |
| | | TTVRANGTRLFYTDI | VRANGTRLF |
| | | EIFKEDAKTLVGKKV | FKEDAKTLV |
| | | SAGTNLEGKAVEITT | LEGKAVEIT |
| | | DSAGTNLEGKAVEIT | GTNLEGKAV |
| | | KYDSKTSTLTTSVNS | KDSKTSTLT |
| | | KDSKTSTLTTSVNSQ | KDSKTSTLT |
| | | TFKEDAKTLVSKKVT | AKTLVSKKV |
| | | GTNLEGKAVEITTLK | LEGKAVEIT |
| | | AGTNLEGKAVEITTL | LEGKAVEIT |
| | | DLPGGMTELVSKEKD | LPGGMTELV |
| | | FKEDAKTLVSKKVTL | AKTLVSKKV |
| | | DGKTTLKVFEGTVVL | LKVFEGTVV |
| | | LPGGMTELVSKEKDK | LPGGMTELV |
| | | TTVQKYDSAGTNLEG | VQKYDSAGT |
| | | TTTVQKYDSAGTNLE | VQKYDSAGT |
| | | TNLEGKAVEITTLKF | LEGKAVEIT |
| | | NLVFTKEDITTVQKY | FTKEDITTV |
| | | AKTLVSKKVTLKDKS | AKTLVSKKV |
| | | DAKTLVSKKVTLKDK | AKTLVSKKV |
| | | KNLVFTKEDITTVQK | FTKEDITTV |
| | | GLGILALIACKQNVS | ILALIACKQ |
| | | FTSFKTIVRANGTRL | KTIVRANGT |
| | | TKNLVFTKEDITTVQ | FTKEDITTV |
| | | TGLILALIACKQNVS | ILALIACKQ |
| | | KLKNLVFTKEDITTV | VFTKEDITT |
| | | IVRANGTRLFYTDIK | IVRANGTRL |
| | | ADGKTTLKVFEGTVV | ADGKTTLKV |
| | | LVFTKEDITTVQKYD | FTKEDITTV |
| | | LKSGEITVALDDSDT | LKSGEITVA |
| | | ILKSGEITVALDDSD | LKSGEITVA |
| | | DTITVQKYDSAGTNL | VQKYDSAGT |
| | | EDITVQKYDSAGTN | VQKYDSAGT |
| | | KEDITVQKYDSAGT | ITVQKYDSA |
| | | GLILALIACKQNVST | ILALIACKQ |
| | | LEGTLAADGKTTLKV | LEGTLAADG |
| | | TTSVNSQKTKNLVFT | VNSQKTKNL |
| | | LFYTDIKSDGSGKAK | IKSDGSGKA |
| | | RLFYTDIKSDGSGKA | YTDIKSDGS |
| | | TLTTSVNSQKTKNLV | VNSQKTKNL |
| | | STLTTSVNSQKTKNL | TTSVNSQKT |
| | | TSVNSQKTKNLVFTK | VNSQKTKNL |
| | | TVQKYDSAGTNLEGK | VQKYDSAGT |
| | | VQKYDSAGTNLEGKA | VQKYDSAGT |
| | | VFEGTVVLSKNTLKS | VFEGTVVLS |
| | | VALDDSDTTQATKKT | LDDSDTTQA |
| | | YTDIKSDGSGKAKFV | TKSDGSGKA |
| | | QKYDSAGTNLEGKAV | YDSAGTNLE |
| | | TLEGTLAADGKTTLK | LEGTLAADG |
| | | LTTSVNSQKTKNLVF | VNSQKTKNL |
| | | KVFEGTVVLSKNTLK | VFEGTVVLS |
| | | FYTDIKSDGSGKAKF | TKSDGSGKA |
| | | LTIALIACKQNVSTI | IACKQNVST |
| | | FFTFKEDAKTLVGKK | TFKEDAKTL |
| | | FFTFKEDAKTLVGK | TFKEDAKTL |
| | | VRANGTRLFYTDIKS | VRANGTRLF |
| | | NLEGKAVEITTLKEL | LEGKAVEIT |

Fig. 34 continued

| | | | |
|---|---|---|---|
| | HLA-DRB1*0301 | None | |
| | HLA-DRB1*0401 | KEVLKDFTLEGTLAA | VLKDFTLEG |
| | | EVLKDFTLEGTLAAD | FTLEGTLAA |
| | | VLKDFTLEGTLAADG | FTLEGTLAA |
| | | LKDFTLEGTLAADGK | FTLEGTLAA |
| | | KDFTLEGTLAADGKT | FTLEGTLAA |
| | | KNLVFTKEDTIVQK | FTKEDTITV |
| | | NLVFTKEDTITVQKY | FTKEDTITV |
| | | LVFTKEDTITVQKYD | FTKEDTITV |
| | | DFTLEGTLAADGKTT | FTLEGTLAA |
| | | LEYIDIKSDGSGKAK | IKSDGSGKA |
| | | IKNLVFTKEDTITVQ | FTKEDTITV |
| | | FTLEGTLAADGKTTL | FTLEGTLAA |
| | | RLEYIDIKSDGSGKA | YIDIKSDGS |
| | | KTKNLVFTKEDTITV | KTKNLVFTK |
| | | AKEVLKDFTLEGTLA | VLKDFTLEG |
| | HLA-DRB1*0404 | KEVLKDFTLEGTLAA | VLKDFTLEG |
| | | GKAKEVLKDFTLEGT | VLKDFTLEG |
| | | AKEVLKDFTLEGTLA | VLKDFTLEG |
| | | KAKEVLKDFTLEGTL | VLKDFTLEG |
| | | SGKAKEVLKDFTLEG | AKEVLKDFT |
| | HLA-DRB1*0405 | TITVQKYDSAGTNLF | VQKYDSAGT |
| | | ITVQKYDSAGTNLFG | YDSAGTNLF |
| | | TVQKYDSAGTNLFGK | YDSAGTNLF |
| | | VQKYDSAGTNLFGKA | YDSAGTNLF |
| | | QKYDSAGTNLFGKAV | YDSAGTNLF |
| | HLA-DRB1*0701 | DGKTTLKVTEGTVVL | LKVTEGTVV |
| | | GKTTLKVTEGTVVLS | LKVTEGTVV |
| | | KTTLKVTEGTVVLSK | LKVTEGTVV |
| | | ADGKTTLKVTEGTVV | LLKVTEGTV |
| | | TTLKVTEGTVVLSKN | LKVTEGTVV |
| | HLA-DRB1*0802 | None | |
| | HLA-DRB1*0901 | None | |
| | HLA-DRB1*1101 | None | |
| | HLA-DRB1*1302 | TEGTVVLSKNILKSG | TVVLSKNIL |
| | | EGTVVLSKNILKSGE | TVVLSKNIL |
| | | GTVVLSKNILKSGEI | VVLSKNILK |
| | | VTEGTVVLSKNILKS | TVVLSKNIL |
| | | TVVLSKNILKSGEIT | TVVLSKNIL |
| | | SEKTIVRANGTRLEY | IVRANGTRL |
| | | TSEKTIVRANGTRLE | IVRANGTRL |
| | | EKTIVRANGTRLEYT | IVRANGTRL |
| | | KTIVRANGTRLEYTD | IVRANGTRL |
| | | ILTISVNSQKTKNLV | VNSQKTKNL |
| | | STLTISVNSQKTKNL | ISVNSQKTK |
| | | LTISVNSQKTKNLVF | VNSQKTKNL |
| | | KVTEGTVVLSKNILK | TVVLSKNIL |
| | | TISVNSQKTKNLVFT | VNSQKTKNL |
| | | LKVTEGTVVLSKNIL | LKVTEGTVV |
| | | TIVRANGTRLEYTDI | VRANGTRLE |
| | | ISVNSQKTKNLVFTK | VNSQKTKNL |

Fig. 34 continued

| | | | |
|---|---|---|---|
| | | VVLSKNILKSGEITV | VVLSKNILK |
| | | ETSEKTIVRANGTRL | KTIVRANGT |
| | | EDAKTLVSKKVTLKD | LVSKKVTLK |
| | | DAKTLVSKKVTLKDK | LVSKKVTLK |
| | HLA-DRB1*1501 | TEGTVVLSKNILKSG | VLSKNILKS |
| | | EGTVVLSKNILKSGE | VLSKNILKS |
| | HLA-DRB3*0101 | None | |
| | HLA-DRB4*0101 | None | |
| | HLA-DRB5*0101 | KDKDGKYSLEATVDK | KDKDGKYSL |
| | | DKDGKYSLEATVDKL | YSLEATVDK |
| | | KDGKYSLEATVDKLE | YSLEATVDK |
| | | DGKYSLEATVDKLEL | YSLEATVDK |
| | | GKYSLEATVDKLELK | YSLEATVDK |
| \|BAA22351.1\| Outer surface protein B [Borrelia garinii]<br><br>SEQ ID NO:10,<br>SEQ ID NO:129985-130282 | HLA-DRB1*0101 | KKYLLGFALVLALIA | LLGFALVLA |
| | | ITVQNYDTAGTKLAG | YDTAGTKLA |
| | | TITVQNYDTAGTKLA | VQNYDTAGT |
| | | QNYDTAGTKLAGTAT | YDTAGTKLA |
| | | KYLLGFALVLALIAC | LLGFALVLA |
| | | MKKYLLGFALVLALI | LLGFALVLA |
| | | TVQNYDTAGTKLAGT | YDTAGTKLA |
| | | VQNYDTAGTKLAGTA | YDTAGTKLA |
| | | ATEIKDLEALKAALK | IKDLEALKA |
| | | TATEIKDLEALKAAL | IKDLEALKA |
| | | YLLGFALVLALIACG | FALVLALIA |
| | | GTATEIKDLEALKAA | IKDLEALKA |
| | | AGTATEIKDLEALKA | AGTATEIKD |
| | | LLGFALVLALIACGQ | FALVLALIA |
| | | LGFALVLALIACGQK | FALVLALIA |
| | | YDTAGTKLAGTATEI | YDTAGTKLA |
| | | NYDTAGTKLAGTATE | YDTAGTKLA |
| | | EGVKSDQSKVTMSIT | VKSDQSKVT |
| | | LEGVKSDQSKVTMSI | VKSDQSKVT |
| | | GKLEGVKSDQSKVTM | VKSDQSKVT |
| | | GGKLEGVKSDQSKVT | LEGVKSDQS |
| | | KLEGVKSDQSKVTMS | VKSDQSKVT |
| | | DGTITVQNYDTAGTK | VQNYDTAGT |
| | | GTITVQNYDTAGTKL | VQNYDTAGT |
| | | SKKDLPLVTEDTVKL | DLPLVTEDT |
| | | GFALVLALIACGQKG | LVLALIACG |
| | | TDGTITVQNYDTAGT | TITVQNYDT |
| | | KKDLPLVTEDTVKLF | LVTEDTVKL |
| | | FALVLALIACGQKGA | LVLALIACG |
| | | MLEGNLVGGKTSVEI | LVGGKTSVE |
| | | KDLPLVTEDTVKLFN | LVTEDTVKL |
| | | DLPLVTEDTVKLFND | LVTEDTVKL |
| | | LEGNLVGGKTSVEIK | VGGKTSVEI |
| | | EGNLVGGKTSVEIKE | VGGKTSVEI |
| | | GNLVGGKTSVEIKEG | VGGKTSVEI |
| | | LPLVTEDTVKLFNDT | LVTEDTVKL |
| | | NLVGGKTSVEIKEGT | VGGKTSVEI |
| | | ETLKNGIMLEGNLVG | LKNGIMLEG |
| | | YKTGKLSTKKITRTN | LSTKKITRT |

Fig. 34 continued

| | | TYKIGKLSTKKITRI | IGKLSTKKI |
|---|---|---|---|
| | | TGKLSTKKITRTNGT | LSTKKTTRT |
| | | VETLKNGIMLEGNLV | LKNGIMLEG |
| | | KKETEKAGTVKLFLD | TEKAGTVKL |
| | | LKKEIEKAGTVKLFL | IEKAGTVKL |
| | | KETFKAGTVKLFLDD | TEKAGTVKL |
| | | KDFVFLTDGTITVQN | FLTDGTITV |
| | | VTLKKETEKAGTVKL | TKKETEKAG |
| | | TLKKETEKAGTVKLF | TEKAGTVKL |
| | | KTGKLSTKKITRTNG | LSTKKTTRT |
| | | GKLSTKKITRTNGTT | LSTKKTTRT |
| | | GTAGTKLAGTATEIK | GTKLAGTAT |
| | | GVKSDQSKVTMSTTD | VKSDQSKVT |
| | | VKSDQSKVTMSTTDD | VKSDQSKVT |
| | | DFVFLTDGTITVQNY | FLTDGTITV |
| | | TAGTKLAGTATEIKE | LAGTATEIK |
| | | TKDFVFLTDGTITVQ | FLTDGTITV |
| | | DGKYELRATVDTVEL | YELRATVDT |
| | | FVFLTDGTITVQNYD | FLTDGTITV |
| | | GKYELRATVDTVELK | YELRATVDT |
| | | ALVLALTACGQKGAE | LVLALTACG |
| | | NKDGKYELRATVDTV | YELRATVDT |
| | | KNKDGKYELRATVDT | DGKYELRAT |
| | | KDGKYELRATVDTVE | YELRATVDT |
| | | KAVETIKNGIMLEGN | IKNGIMLEG |
| | | AVETLKNGIMLEGNL | LKNGIMLEG |
| | | ASKVEKKQGSLTEET | EKKQGSLTE |
| | | TLKNGIMLEGNLVGG | LKNGIMLEG |
| | | SKVEKKQGSLTEETE | EKKQGSLTE |
| | | KIKDFVFLTDGTITV | FVFLTDGTI |
| | | LKNGIMLEGNLVGGK | LKNGIMLEG |
| | | AGTKLAGTATEIKEL | LAGTATEIK |
| | | GTKLAGTATEIKELL | LAGTATEIK |
| | | TKAVETLKNGIMLEG | VETLKNGIM |
| | | KTAVWSDTSNILTVG | WSDTSNILT |
| | | KVEKKQGSLTEETEE | EKKQGSLTE |
| | | VASKVEKKQGSLTEE | EKKQGSLTE |
| | | KVASKVEKKQGSLTE | VEKKQGSLT |
| | | VGGKTSVETKFGTVT | VGGKTSVET |
| | | TAVWSDTSNILTVSA | VWSDTSNTL |
| | | LVLALTACGQKGAEE | LVLALTACG |
| | | TKKTAVWSDTSNTLT | VWSDTSNTL |
| | | KKTAVWSDTSNTLTV | WSDTSNTLT |
| | | LVGGKTSVETKFGTV | VGGKTSVET |
| | | KNGIMLEGNLVGGKT | IMLEGNLVG |
| | | ETYKIGKLSTKKITR | YKIGKLSTK |
| | | LVTEDTVKLFNDTKT | LVTEDTVKL |
| | | EETYKIGKLSTKKIT | YKIGKLSTK |
| | | TEETYKIGKLSTKKI | YKIGKLSTK |
| | | LSTKKITRTNGTTLE | LSTKKTTRT |
| | | PLVTEDTVKLFNDTK | LVTEDTVKL |
| | | VFLTDGTITVQNYDT | FLTDGTITV |
| | | KLSTKKITRTNGTTL | LSTKKTTRT |
| | | VETYDSSNTKVASKV | YDSSNTKVA |
| | | YELRATVDTVELKGV | YELRATVDT |
| | | TITVETYDSSNTKVA | VETYDSSNT |
| | | ITVETYDSSNTKVAS | YDSSNTKVA |

Fig. 34 continued

| | | AVWSDTSNLTVSAD | WSDTSNLT |
|---|---|---|---|
| | | ETYDSSNTKVASKVF | YDSSNTKVA |
| | | IKLEGNLVGGKTSVE | IKLEGNLVG |
| | | TEKAGTVKLFDDTS | TEKAGTVKL |
| | | KGIKLEGNLVGGKTS | IKLEGNLVG |
| | | TEKAGTVKLFDDTS | TEKAGTVKL |
| | | FLTDGTTTVQNYDTA | FLTDGTTTV |
| | | KLFDDTSSGSTKFT | FLDDTSSGS |
| | | KYELRATVDTYFLEG | YELRATVDT |
| | HLA-DRB1*0301 | DTVKLFNDTKTPTSK | LFNDTKTPT |
| | | EDTVKLFNDTKTPTS | LFNDTKTPT |
| | | TVKLFNDTKTPTSKK | LFNDTKTPT |
| | | TEDTVKLFNDTKTPT | KLFNDTKTP |
| | | VKLFNDTKTPTSKKI | LFNDTKTPT |
| | HLA-DRB1*0401 | SKVFKKQGSLTEFTE | FKKQGSLTE |
| | | VASKVFKKQGSLTEF | FKKQGSLTE |
| | | ASKVFKKQGSLTEFT | FKKQGSLTE |
| | | KVASKVFKKQGSLTE | VFKKQGSLT |
| | | KVFKKQGSLTEETEE | FKKQGSLTE |
| | | TAVWSDTSNLTVSA | VWSDTSNTL |
| | HLA-DRB1*0404 | TAVWSDTSNLTVSA | WSDTSNTLT |
| | | AVWSDTSNLTVSAD | TSNLTVSA |
| | HLA-DRB1*0405 | TLEYSDMTNDENATK | YSDMTNDEN |
| | | GTTLEYSDMTNDENA | YSDMTNDEN |
| | | NGTTLEYSDMTNDEN | EYSDMTNDE |
| | | TTLEYSDMTNDENAT | YSDMTNDEN |
| | | LEYSDMTNDENATKA | YSDMTNDEN |
| | HLA-DRB1*0701 | ETYDSSNTKVASKVF | YDSSNTKVA |
| | | TYDSSNTKVASKVFK | NTKVASKVF |
| | | YDSSNTKVASKVFKK | NTKVASKVF |
| | HLA-DRB1*0802 | None | |
| | HLA-DRB1*0901 | FKKYLLGFALVLALL | LGFALVLAL |
| | | KKYLLGFALVLALLA | LGFALVLAL |
| | HLA-DRB1*1101 | None | |
| | HLA-DRB1*1302 | TKAVETLKNGIMLEG | VETLKNGIM |
| | | KAVETLKNGIMLEGN | LKNGIMLEG |
| | | VETLKNGIMLEGNLV | LKNGIMLEG |
| | | AVETLKNGIMLEGNL | LKNGIMLEG |
| | | ETLKNGIMLEGNLVG | LKNGIMLEG |
| | | LSTKKITRTNGTTLE | KKITRTNGT |
| | | EDTVKLFNDTKIFIS | VKLFNDTKI |
| | | DTVKLFNDTKIFISK | VKLFNDTKI |
| | | LYKGKLSTKKITRTN | GKLSTKKIT |
| | | YKTGKLSTKKITRTN | LSTKKITRT |
| | | TGKLSTKKITRTNGT | LSTKKITRT |
| | | GKLSTKKITRTNGTT | LSTKKITRT |
| | | STKKITRTNGTTLEY | ITRTNGTTL |

Fig. 34 continued

| | | | |
|---|---|---|---|
| | | KTGKLSTKKITRTNG | LSTKKITRT |
| | | KLSTKKITRTNGTTL | KKITRTNGT |
| | | NGIMLEGNLVGGKTS | EGNLVGGKT |
| | | VKLFNDTKIFISKEK | LFNDTKIFI |
| | | IMLEGNLVGGKTSVE | EGNLVGGKT |
| | HLA-DRB1*1501 | MKKYLLGFALVLALI | LLGFALVLA |
| | | KKYLLGFALVLALIA | LLGFALVLA |
| | | KYLLGFALVLALIAC | LLGFALVLA |
| | HLA-DRB3*0101 | None | |
| | HLA-DRB4*0101 | None | |
| | HLA-DRB5*0101 | None | |
| AAM22469.1\| Outer surface protein C [Borrelia afzelii]<br><br>SEQ ID NO:11,<br>SEQ ID NO:130283-130498 | HLA-DRB1*0101 | TNSVKELTSPVVAES | VKELTSPVV |
| | | NSVKELTSPVVAESP | VKELTSPVV |
| | | ALTNSVKELTSPVVA | VKELTSPVV |
| | | LTNSVKELTSPVVAE | VKELTSPVV |
| | | EALTNSVKELTSPVV | LTNSVKELT |
| | | EGLVKAAQEALTNSV | VKAAQEALT |
| | | SVKELTSPVVAESPK | VKELTSPVV |
| | | VKELTSPVVAESPKK | VKELTSPVV |
| | | GLVKAAQEALTNSVK | VKAAQEALT |
| | | VEGLVKAAQEALTNS | VKAAQEALT |
| | | LAGVHEISTLITEKL | VHEISTLIT |
| | | AGVHEISTLITEKLS | VHEISTLIT |
| | | SVEGLVKAAQEALTN | VKAAQEALT |
| | | KSVEGLVKAAQEALT | LVKAAQEAL |
| | | HEISTLITEKLSKLK | ISTLITEKL |
| | | VHEISTLITEKLSKL | ISTLITEKL |
| | | MKKNTLSAILMTLFL | KNTLSAILM |
| | | NTLSAILMTLFLFIS | LSAILMTLF |
| | | GVHEISTLITEKLSK | ISTLITEKL |
| | | ESLLAGVHEISTLIT | LLAGVHEIS |
| | | KNTLSAILMTLFLFI | LSAILMTLF |
| | | SLLAGVHEISTLITE | VHEISTLIT |
| | | LLAGVHEISTLITEK | VHEISTLIT |
| | | TLSAILMTLFLFISC | LMTLFLFIS |
| | | KELTSPVVAESPKKP | LTSPVVAES |
| | | LSAILMTLFLFISCN | LMTLFLFIS |
| | | LVKAAQEALTNSVKE | VKAAQEALT |
| | | SAILMTLFLFISCNN | LMTLFLFIS |
| | | ISTLITEKLSKLKNS | ISTLITEKL |
| | | EISTLITEKLSKLKN | ISTLITEKL |
| | | VKAAQEALTNSVKEL | VKAAQEALT |
| | | KKNTLSAILMTLFLF | LSAILMTLF |
| | | VLAVKEVETLVSSID | VKEVETLVS |
| | | LAVKEVETLVSSIDE | VKEVETLVS |
| | | AFVLAVKEVETLVSS | VKEVETLVS |
| | | AILMTLFLFISCNNS | LMTLFLFIS |
| | | NAFVLAVKEVETLVS | LAVKEVETL |
| | | FVLAVKEVETLVSSI | VKEVETLVS |
| | | FKSVEGLVKAAQEAL | FKSVEGLVK |
| | | EEFTNKLRVSHADLG | FTNKLRVSH |
| | | VKEVETLVSSIDELA | VKEVETLVS |
| | | EFTNKLRVSHADLGK | LRVSHADLG |

Fig. 34 continued

| | | | |
|---|---|---|---|
| | | GKLFKSVEGLVKAAQ | FKSVEGLVK |
| | | NSGKGGDSASTYPA | GKGGDSAST |
| | | KLFKSVEGLVKAAQF | FKSVEGLVK |
| | | MSGKGGDSASTYPAD | GKGGDSAST |
| | HLA-DRB1*0301 | None | |
| | HLA-DRB1*0401 | None | |
| | HLA-DRB1*0404 | MTLFLFTSCNNSGKG | LFTSCNNSG |
| | | TLFLFTSCNNSGKGG | LFTSCNNSG |
| | | TLMTLFLFTSCNNSG | FLFTSCNNS |
| | | KKAILKTNADKTKGA | ILKTNADKT |
| | | LFTLFLFTSCNNSGK | LFTSCNNSG |
| | | AKKAILKTNADKTKG | ILKTNADKT |
| | | KAILKTNADKTKGAE | ILKTNADKT |
| | | LFLFTSCNNSGKGGD | LFTSCNNSG |
| | | DAKKAILKTNADKTK | ILKTNADKT |
| | | DDAKKAILKTNADKT | AILKTNADK |
| | HLA-DRB1*0405 | LAVKEVETLVSSIDE | VKEVETLVS |
| | | VLAVKEVETLVSSID | VKEVETLVS |
| | | VKEVETLVSSIDELA | VKEVETLVS |
| | | AVKEVETLVSSIDEL | VKEVETLVS |
| | | NAFVLAVKEVETLVS | FVLAVKEVE |
| | | TNSVKELTSPVVAES | VKELTSPVV |
| | | LTNSVKELTSPVVAE | VKELTSPVV |
| | | NSVKELTSPVVAESP | VKELTSPVV |
| | | AFVLAVKEVETLVSS | VKEVETLVS |
| | | FVLAVKEVETLVSSI | VKEVETLVS |
| | HLA-DRB1*0701 | ALTNSVKELTSPVVA | VKELTSPVV |
| | | FALTNSVKELTSPVV | SVKELTSPV |
| | | LTNSVKELTSPVVAE | VKELTSPVV |
| | | TNSVKELTSPVVAES | VKELTSPVV |
| | | NSVKELTSPVVAESP | VKELTSPVV |
| | | SVKELTSPVVAESPK | VKELTSPVV |
| | | VKELTSPVVAESPKK | VKELTSPVV |
| | | FTSKKTTDSNAFVLA | TTDSNAFVL |
| | | TFTSKKTTDSNAFVL | SKKTTDSNA |
| | | TSKKTTDSNAFVLAV | TTDSNAFVL |
| | | SKKTTDSNAFVLAVK | TTDSNAFVL |
| | | KKTTDSNAFVLAVKE | TTDSNAFVL |
| | | KTTDSNAFVLAVKEV | TTDSNAFVL |
| | | TTDSNAFVLAVKEVE | TTDSNAFVL |
| | HLA-DRB1*0802 | None | |
| | HLA-DRB1*0901 | FGLVKAAQFALTNSV | LVKAAQFAL |
| | | KSVEGLVKAAQFALT | LVKAAQFAL |
| | | SVEGLVKAAQFALTN | LVKAAQFAL |
| | | VEGLVKAAQFALTNS | LVKAAQFAL |
| | | FKSVEGLVKAAQFAL | VEGLVKAAQ |
| | HLA-DRB1*1101 | KKCSFFFTNKLRVSH | FFTNKLRVS |
| | | KCSFFFTNKLRVSHA | FTNKLRVSH |
| | | CSFFFTNKLRVSHAD | FTNKLRVSH |
| | | SFFFTNKLRVSHADI | FTNKLRVSH |
| | | FFFTNKLRVSHADIQ | FTNKLRVSH |
| | | FFTNKLRVSHADIQK | FTNKLRVSH |

Fig. 34 continued

| | | FTNKLRVSRADLGKQ | FTNKLRVSS |
|---|---|---|---|
| | HLA-DRB1*1302 | EALTNSVKELTSPVV | LTNSVKELT |
| | | QEALTNSVKELTSPV | LTNSVKELT |
| | | AAQEALTNSVKELTS | LTNSVKELT |
| | | AQEALTNSVKELTSP | LTNSVKELT |
| | | ALTNSVKELTSPVVA | LTNSVKELT |
| | | KAAQEALTNSVKELT | ALTNSVKEL |
| | | LTNSVKELTSPVVAE | LTNSVKELT |
| | | MKKNTLSAILMFLFL | MKKNTLSAI |
| | | LAGVHEISTLITEKL | VHEISTLIT |
| | | AGVHEISTLITEKLS | ISTLITEKL |
| | HLA-DRB1*1501 | ALTNSVKELTSPVVA | VKELTSPVV |
| | | EALTNSVKELTSPVV | NSVKELTSP |
| | | LTNSVKELTSPVVAE | VKELTSPVV |
| | | TNSVKELTSPVVAES | VKELTSPVV |
| | | NSVKELTSPVVAESP | VKELTSPVV |
| | | VKELTSPVVAESPKK | VKELTSPVV |
| | HLA-DRB3*0101 | None | |
| | HLA-DRB4*0101 | None | |
| | HLA-DRB5*0101 | None | |
| AAC62927.1\| OspE-related lipoprotein [Borrelia garinii] SEQ ID NO:12, SEQ ID NO:130499-130870 | HLA-DRB1*0101 | NNFVKAMTNVGSFKT | VKAMTNVGS |
| | | NFVKAMTNVGSFKTS | VKAMTNVGS |
| | | AEVNNFVKAMTNVGS | FVKAMTNVG |
| | | VNNFVKAMTNVGSFK | VKAMTNVGS |
| | | EVNNFVKAMTNVGSF | VKAMTNVGS |
| | | FVKAMTNVGSFKTSL | MTNVGSFKT |
| | | VKAMTNVGSFKTSLY | MTNVGSFKT |
| | | NGDWSNLGTLVIRKE | WSNLGTLVI |
| | | GTINGQLRGHSATFF | NGQLRGHSA |
| | | GDWSNLGTLVIRKEQ | WSNLGTLVI |
| | | NNGDWSNLGTLVIRK | WSNLGTLVI |
| | | TINGQLRGHSATFFC | LRGHSATFF |
| | | DNNGDWSNLGTLVIR | WSNLGTLVI |
| | | KDNNGDWSNLGTLVI | DWSNLGTLV |
| | | INGQLRGHSATFFCI | LRGHSATFF |
| | | NGQLRGHSATFFCIE | LRGHSATFF |
| | | LSGQGGLSGQASSDT | QGGLSGQAS |
| | | SDQGGLSGQASSDTI | LSGQASSDT |
| | | GQLRGHSATFFCIEE | LRGHSATFF |
| | | DQGGLSGQASSDTIK | LSGQASSDT |
| | | QGGLSGQASSDTIKF | LSGQASSDT |
| | | GGLSGQASSDTIKFS | LSGQASSDT |
| | | KAMTNVGSFKTSLYY | MTNVGSFKT |
| | | EAEVNNFVKAMTNVG | VNNFVKAMT |
| | | KMKMFIICAVFVLIS | MFIICAVFV |
| | | MKMFIICAVFVLISS | MFIICAVFV |
| | | KKMKMFIICAVFVLI | MFIICAVFV |
| | | NKKMKMFIICAVFVL | MFIICAVFV |
| | | MNKKMKMFIICAVFV | MKMFIICAV |
| | | MFIICAVFVLISSCG | MFIICAVFV |
| | | DWSNLGTLVIRKEQD | WSNLGTLVI |
| | | WSNLGTLVIRKEQDG | WSNLGTLVI |

Fig. 34 continued

| | | | |
|---|---|---|---|
| | | FIICAVFVLSSCGN | VFVLSSCG |
| | | TCAVFVLTSSCGNFR | VFVLTSSCG |
| | | MTNVGSFKTSLYYG | MTNVGSFKT |
| | | CAVFVLTSSCGNFRS | VFVLTSSCG |
| | | KMFIICAVFVLSSC | MFIICAVFV |
| | | IICAVFVLTSSCGNF | VFVLTSSCG |
| | | QLRGHSATPPCTPPA | LRGHSATPP |
| | | LRGHSATPPCTPPAP | LRGHSATPP |
| | | AMTNVGSFKTSLYYG | MTNVGSFKT |
| | | SSCGNFRSSLSDQGS | FRSSLSDQG |
| | | GLSCQASSDTTKFSF | LSCQASSDT |
| | | LSCQASSDTTKFSFF | LSCQASSDT |
| | | TSSCGNFRSSLSDQG | CGNFRSSLS |
| | | CGNFRSSLSDQGSLS | FRSSLSDQG |
| | | SCGNFRSSLSDQGSL | FRSSLSDQG |
| | | GNFRSSLSDQGSLSD | FRSSLSDQG |
| | | AVFVLTSSCGNFRSS | VFVLTSSCG |
| | | DGVETGLNVIGTTNG | VETGLNVIG |
| | | ETGLNVIGTTNGQLR | LNVIGTTNG |
| | | TGLNVIGTTNGQLRG | LNVIGTTNG |
| | | VFVLTSSCGNFRSSL | VFVLTSSCG |
| | | GVETGLNVIGTTNGQ | LNVIGTTNG |
| | | VETGLNVIGTTNGQL | LNVIGTTNG |
| | | LNVIGTTNGQLRGHS | LGTTNGQLR |
| | | NVIGTTNGQLRGHSA | IGTTNGQLR |
| | | GSLSDQGGLSGQASS | LSDQGGLSG |
| | | QGSLSDQGGLSGQAS | LSDQGGLSG |
| | | QDGVETGLNVIGTTN | VETGLNVIG |
| | | GLNVIGTTNGQLRGH | LGTTNGQLR |
| | | DQDGVETGLNVIGTT | VETGLNVIG |
| | | KEQDGVETGLNVIGT | VETGLNVIG |
| | | NFRSSLSDQGSLSDQ | FRSSLSDQG |
| | | FVLTSSCGNFRSSLS | FVLSSCGN |
| HLA-DRB1*0301 | | None | |
| HLA-DRB1*0401 | | AEVNNFVKAMINVGS | FVKAMINVG |
| | | VNNFVKAMTNVGSFK | FVKAMTNVG |
| | | NFVKAMTNVGSFKT | FVKAMTNVG |
| | | EVNNFVKAMTNVGSF | FVKAMTNVG |
| | | EAEVNNFVKAMINVG | VNNFVKAMT |
| | | NFVKAMTNVGSFKTS | FVKAMTNVG |
| | | FVKAMTNVGSFKTSL | FVKAMTNVG |
| | | IKNKKDNNGDWSNLG | IKNKKDNNG |
| | | KNKKDNNGDWSNLGT | NNGDWSNLG |
| | | NKKDNNGDWSNLGTL | NNGDWSNLG |
| | | KKDNNGDWSNLGTLV | NNGDWSNLG |
| | | KDNNGDWSNLGTLVI | NNGDWSNLG |
| HLA-DRB1*0404 | | AEVNNFVKAMINVGS | FVKAMINVG |
| | | NFVKAMTNVGSFKT | FVKAMTNVG |
| | | VNNFVKAMTNVGSFK | FVKAMTNVG |
| | | EVNNFVKAMTNVGSF | FVKAMTNVG |
| | | EAEVNNFVKAMTNVG | VNNFVKAMT |
| | | CAVFVLTSSCGNFRS | VFVLTSSCG |
| | | TCAVFVLTSSCGNFR | VFVLTSSCG |
| | | NFVKAMTNVGSFKTS | FVKAMTNVG |

Fig. 34 continued

| HLA-DRB1*0405 | AEVNNFVKAMTNVGS | FVKAMTNVG |
| | VNNFVKAMTNVGSFK | VKAMTNVG |
| | NFVKAMTNVGSFKT | VKAMTNVG |
| | RVNNFVKAMTNVGSF | VKAMTNVG |
| | NFVKAMTNVGSFKTS | VKAMTNVG |
| | KDNGDWSNLGTLVT | NGDWSNLG |
| | IKFSEFTVNIKNKKD | FSEFTVNIK |
| | VKAMTNVGSFKTSLY | VKAMTNVG |
| | DNGDWSNLGTLVTR | WSNLGTLVT |
| | NGDWSNLGTLVTRK | WSNLGTLVT |
| HLA-DRB1*0701 | KDNGDWSNLGTLVT | DWSNLGTLV |
| | DNGDWSNLGTLVTR | WSNLGTLVT |
| | NGDWSNLGTLVTRK | WSNLGTLVT |
| | GDWSNLGTLVTRKE | WSNLGTLVT |
| | GDWSNLGTLVTRKEQ | WSNLGTLVT |
| | KKMKMFTTCAVFVL | FTTCAVFVL |
| | KMKMFTTCAVFVLS | FTTCAVFVL |
| | MKMFTTCAVFVLSS | FTTCAVFVL |
| | NKKMKMFTTCAVFVL | MFTTCAVFV |
| | KMFTTCAVFVLSSC | FTTCAVFVL |
| | MFTTCAVFVLSSCC | FTTCAVFVL |
| HLA-DRB1*0802 | None | |
| HLA-DRB1*0901 | NNFVKAMTNVGSFKT | FVKAMTNVG |
| | AEVNNFVKAMTNVGS | FVKAMTNVG |
| | FVNNFVKAMTNVGSF | FVKAMTNVG |
| | VNNFVKAMTNVGSFK | FVKAMTNVG |
| | RAEVNNFVKAMTNVG | VNNFVKAMT |
| | NFVKAMTNVGSFKTS | FVKAMTNVG |
| | FVKAMTNVGSFKTSL | FVKAMTNVG |
| HLA-DRB1*1101 | NNFVKAMTNVGSFKT | VKAMTNVG |
| | NFVKAMTNVGSFKTS | KTNVGSFKT |
| HLA-DRB1*1302 | AEVNNFVKAMTNVGS | VNNFVKAMT |
| | RAEVNNFVKAMTNVG | VNNFVKAMT |
| | VKAMTNVGSFKTSLY | MTNVGSFKT |
| | ETGLNVIGTINGQLR | LNVIGTING |
| | TGLNVIGTINGQLRG | LNVIGTING |
| | KAMTNVGSFKTSLYY | VGSFKTSLY |
| | SEFTVNIKNKKDNG | FTVNIKNKK |
| | FVNNFVKAMTNVGSF | FVKAMTNVG |
| | VNNFVKAMTNVGSFK | FVKAMTNVG |
| | NGDWSNLGTLVTRKE | WSNLGTLVT |
| | NNFVKAMTNVGSFKT | FVKAMTNVG |
| | KFSEFTVNIKNKKDN | FTVNIKNKK |
| | FSEFTVNIKNKKDN | FTVNIKNKK |
| | GDWSNLGTLVTRKEQ | WSNLGTLVT |
| | MTNVGSFKTSLYYGV | VGSFKTSLY |
| | DNGDWSNLGTLVTR | WSNLGTLVT |
| | NGDWSNLGTLVTRK | WSNLGTLVT |
| | LNVIGTINGQLRGHC | IGTINGQLR |
| | AMTNVGSFKTSLYYG | VGSFKTSLY |
| | GLNVIGTINGQLRGH | IGTINGQLR |
| | NFVKAMTNVGSFKTS | MTNVGSFKT |

Fig. 34 continued

| | | | |
|---|---|---|---|
| | | KENNGDWSNLGTLVI | DWSNLGTLV |
| | | FTVNIKNKKDNNGD | FTVNIKNKK |
| | | EFTVNIKNKKDNNGD | FTVNIKNKK |
| | | TIKFSEFTVNIKNKK | EFTVNIKNK |
| | | IKFSEFTVNIKNKKD | FTVNIKNKK |
| | | FVKAMTNVGSFKTSL | MTNVGSFKT |
| | | EEAFVNNFVKAMTNV | VNNFVKAMT |
| | | DWSNLGTLVIRKFQD | WSNLGTLVI |
| | | VETGLNVTGTTNGQL | LNVTGTTNG |
| | | DGVETGLNVTGTTNG | TGLNVTGTT |
| | | GTEEAFVNNFVKAMT | FVNNFVKAM |
| | | GVETGLNVTGTTNGQ | LNVTGTTNG |
| | | IKEAFVNNFVKAMTN | VNNFVKAMT |
| | | WSNLGTLVIRKFQDG | WSNLGTLVI |
| | | NVTGTTNGQLRGHSA | TGTTNGQLR |
| | | TNVGSFKTSLYYGYR | VGSFKTSLY |
| | | VTGTTNGQLRGHSAT | TGTTNGQLR |
| | | TGTTNGQLRGHSATE | TGTTNGQLR |
| | | NVGSFKTSLYYGYKE | VGSFKTSLY |
| | | VGSFKTSLYYGYKEE | VGSFKTSLY |
| | | TVNIKNKKDNNGDWS | TKKKDNNG |
| | | VNIKNKKDNNGDWSN | IKNKKDNNG |
| | | TTKITTINSEHITEC | TINSEHIT |
| | | TKIEIINSEHITEC | TINSEHIT |
| | | CAVFVLISSGGNFRS | VFVLISSCG |
| HLA-DRB1*1501 | | ICAVFVLISSGGNFR | VFVLISSCG |
| | | CAVFVLISSGGNFRG | VFVLISSCG |
| | | NFICAVFVLISSGG | CAVFVLSS |
| | | IICAVFVLISSGGN | VFVLISSCG |
| | | FIICAVFVLISSGGN | VFVLISSCG |
| | | AVFVLISSGGNFRSS | VFVLISSCG |
| | | SSTNGIKGKEITTKI | IKGKEITTK |
| | | STNGIKGKEITTKIE | IKGKEITTK |
| | | NGIKGKEITTKIETI | IKGKEITTK |
| | | QSSTNGIKGKEITTK | STNGIKGKE |
| | | TNGIKGKEITTKIET | IKGKEITTK |
| | | VFVLISSGGNFRSSL | VFVLISSCG |
| | | FVNNFVKAMTNVGSF | VKAMTNVGS |
| | | VNNFVKAMTNVGSFK | VKAMTNVGS |
| | | NNFVKAMTNVGSFKT | VKAMTNVGS |
| | | AEVNNFVKAMTNVGS | FVKAMTNVG |
| | | NKKMKMFTTCAVFVL | MKMFTTCAV |
| | | NFVKAMTNVGSFKTS | VKAMTNVGS |
| | | KKMKMFTTCAVFVLI | MKMFTTCAV |
| | | NKKMKMFTTCAVFV | MKMFTTCAV |
| HLA-DRB3*0101 | | None | |
| HLA-DRB4*0101 | | None | |
| HLA-DRB5*0101 | | TSLYYGYKEEQSSTN | YGYKEEQSS |
| | | SLYYGYKEEQSSTNG | YKEEQSSTN |
| | | YGYKEEQSSTNGIKG | YKEEQSSTN |
| | | YYGYKEEQSSTNGIK | YKEEQSSTN |
| | | LYYGYKEEQSSTNGI | YKEEQSSTN |

Fig. 34 continued

| CAA57806.1\| Outer surface protein G [Borrelia burgdorferi]<br><br>SEQ ID NO:13,<br>SEQ ID NO:130871-131040 | HLA-DRB1*0101 | PNNSLFNPPVLPAS<br>NNSLFNPPVLPASS<br>NSLFNPPVLPASSH<br>DPNNSLFNPPVLPA<br>SLFNPPVLPASSHD<br>DDPNNSLFNPPVLP<br>LFNPPVLPASSHDN<br>DNTPVLKAVQAKDG<br>TPVLKAVQAKDGGQQ<br>HDNTPVLKAVQAKDG<br>NTPVLKAVQAKDGGQ<br>PVLKAVQAKDGGQQE<br>FNPPVLPASSHDNT<br>NKKMKNLIICAVFVL<br>MNKKMKNLIICAVFV<br>KKMKNLIICAVFVLI<br>YAKELGVNGSYSVND<br>AKELGVNGSYSVNDG<br>LKYAKELGVNGSYSV<br>KELGVNGSYSVNDGT<br>KYAKELGVNGSYSVN<br>KMKNLIICAVFVLII<br>MKNLIICAVFVLIIS<br>VKKQGNIGQKALKYA<br>VLKAVQAKDGGQQEG<br>LKAVQAKDGGQQEGK<br>PPPVLPASSHDNTPV<br>NPPPVLPASSHDNTP<br>KQGNIGQKALKYAKE<br>KKQGNIGQKALKYAK<br>QGNIGQKALKYAKEL<br>PPVLPASSHDNTPVL<br>GNIGQKALKYAKELG<br>LGVNGSYSVNDGTNT<br>ELGVNGSYSVNDGTN<br>KEQVESATGESTEKV<br>EQVESATGESTEKVK<br>QKALKYAKELGVNGS<br>KALKYAKELGVNGSY<br>FLDKELMQGDDPNNS<br>LIICAVFVLIISCKI<br>ALKYAKELGVNGSYS<br>NIGQKALKYAKELGV<br>KELMQGDDPNNSLFN<br>IGQKALKYAKELGVN<br>QEFKEQVESATGEST<br>LDKELMQGDDPNNSL<br>DKELMQGDDPNNSLF<br>FKEQVESATGESTEK<br>ELMQGDDPNNSLFNP | LFNPPVLP<br>LFNPPVLP<br>LFNPPVLP<br>LFNPPVLP<br>FNPPPVLPA<br>DDPNNSLFN<br>LFNPPVLP<br>LKAVQAKDG<br>LKAVQAKDG<br>TPVLKAVQA<br>LKAVQAKDG<br>LKAVQAKDG<br>FNPPPVLPA<br>MKNLIICAV<br>MKNLIICAV<br>MKNLIICAV<br>LGVNGSYSV<br>LGVNGSYSV<br>YAKELGVNG<br>LGVNGSYSV<br>LGVNGSYSV<br>MKNLIICAV<br>MKNLIICAV<br>KQGNIGQKA<br>LKAVQAKDG<br>LKAVQAKDG<br>VLPASSHDN<br>VLPASSHDN<br>IGQKALKYA<br>IGQKALKYA<br>IGQKALKYA<br>VLPASSHDN<br>IGQKALKYA<br>LGVNGSYSV<br>LGVNGSYSV<br>VESATGEST<br>VESATGEST<br>YAKELGVNG<br>YAKELGVNG<br>FLDKELMQG<br>ICAVFVLII<br>YAKELGVNG<br>IGQKALKYA<br>MQGDDPNNS<br>IGQKALKYA<br>FKEQVESAT<br>MQGDDPNNS<br>MQGDDPNNS<br>VESATGEST<br>MQGDDPNNS |
| | HLA-DRB1*0301 | None | |
| | HLA-DRB1*0401 | FLDKELMQGDDPNNS<br>LDKELMQGDDPNNSL<br>KELMQGDDPNNSLFN<br>DKELMQGDDPNNSLF<br>ELMQGDDPNNSLFNP | FLDKELMQG<br>MQGDDPNNS<br>MQGDDPNNS<br>MQGDDPNNS<br>MQGDDPNNS |

Fig. 34 continued

| | HLA-DRB1*0404 | None | |
|---|---|---|---|
| | HLA-DRB1*0405 | DPNNSLFNPPPVLPA<br>PNNSLFNPPPVLPAS | NNSLFNPPP<br>FNPPPVLPA |
| | HLA-DRB1*0701 | KMKNLIICAVFVLII<br>MKNLIICAVFVLIIS<br>KNLIICAVFVLIISC<br>KKMKNLIICAVFVLI<br>NKKMKNLIICAVFVL | LIICAVFVL<br>LIICAVFVL<br>LIICAVFVL<br>LIICAVFVL<br>MKNLIICAV |
| | HLA-DRB1*0802 | None | |
| | HLA-DRB1*0901 | None | |
| | HLA-DRB1*1101 | None | |
| | HLA-DRB1*1302 | MNKKMKNLIICAVFV<br>KKMKNLIICAVFVLI<br>NKKMKNLIICAVFVL<br>AKELGVNGSYSVND<br>LKYAKELGVNGSYSV<br>YAKELGVNGSYSVND<br>KYAKELGVNGSYSVN<br>KELGVNGSYSVNDGT<br>MKNLIICAVFVLIIS<br>LGVNGSYSVNDGTNT<br>KMKNLIICAVFVLII<br>LIICAVFVLIISCKI<br>ICAVFVLIISCKIDA<br>CAVFVLIISCKIDAS<br>IICAVFVLIISCKID | MNKKMKNLI<br>MKNLIICAV<br>MKNLIICAV<br>LGVNGSYSV<br>AKELGVNGS<br>LGVNGSYSV<br>LGVNGSYSV<br>LGVNGSYSV<br>MKNLIICAV<br>LGVNGSYSV<br>MKNLIICAV<br>VFVLIISCK<br>VFVLIISCK<br>VFVLIISCK<br>VFVLIISCK |
| | HLA-DRB1*1501 | CAVFVLIISCKIDAS<br>IICAVFVLIISCKID<br>ICAVFVLIISCKIDA<br>LIICAVFVLIISCKI<br>NLIICAVFVLIISCK<br>KKMKNLIICAVFVLI<br>NKKMKNLIICAVFVL<br>MNKKMKNLIICAVFV | VFVLIISCK<br>VFVLIISCK<br>VFVLIISCK<br>VFVLIISCK<br>CAVFVLIIS<br>MKNLIICAV<br>MKNLIICAV<br>MKNLIICAV |
| | HLA-DRB3*0101 | None | |
| | HLA-DRB4*0101 | None | |
| | HLA-DRB5*0101 | None | |
| AAC44770.1\| FlaA protein (Borrelia burgdorferi)<br><br>SEQ ID NO:14,<br>SEQ ID NO:131041-131966 | HLA-DRB1*0101 | LFPSYSQSSAMIMPP<br>NWSVLLTPSARLQAY<br>WSVLLTPSARLQAYV<br>SNPNYIPNISSRIIK<br>NPNYIPNISSRIIKD<br>PNYIPNISSRIIKDD<br>WSNPNYIPNISSRII<br>PPSYSQSSAMIMPPF<br>GINNWSVLLTPSARL<br>PSYSQSSAMIMPPFK<br>TESLPKLKAHETFKR<br>AYVKNSVVAPAVVKS<br>ILGVRVLFPSYSQSS<br>LGVRVLFPSYSQSSA | YSQSSAMIM<br>LLTPSARLQ<br>LLTPSARLQ<br>IPNISSRII<br>IPNISSRII<br>IPNISSRII<br>YIPNISSRI<br>YSQSSAMIM<br>WSVLLTPSA<br>YSQSSAMIM<br>LKLKAHET<br>VKNSVVAPA<br>VRVLFPSYS<br>LFPSYSQSS |

Fig. 34 continued

| | |
|---|---|
| ESLRKLKAHETFKRV | LRKLKAHET |
| AKSILFFLLSTVLFA | FFLLSTVLF |
| KSILFFLLSTVLFAQ | FFLLSTVLF |
| SILFFLLSTVLFAQE | FFLLSTVLF |
| EDMNGMEYAYSMGTL | MEYAYSMGT |
| YVKNSVVAPAVVKSE | VVAPAVVKS |
| VKNSVVAPAVVKSES | VVAPAVVKS |
| KNSVVAPAVVKSESK | VVAPAVVKS |
| NSVVAPAVVKSESKR | VVAPAVVKS |
| FEDMNGMEYAYSMGT | MNGMEYAYS |
| GTESLRKLKAHETFK | LRKLKAHET |
| DLGINNWSVLLTPSA | INNWSVLLT |
| MRFKAFRVSKSHSSK | FRVSKSHSS |
| TSGTESLRKLKAHET | TESLRKLKA |
| SGTESLRKLKAHETF | LRKLKAHET |
| LGINNWSVLLTPSAR | INNWSVLLT |
| NYIPNISSRIIKDDV | IPNISSRII |
| KMRFKAFRVSKSHSS | FKAFRVSKS |
| KAKSILFFLLSTVLF | LFFLLSTVL |
| KDDVPNYPLASSKMR | NYPLASSKM |
| DDVPNYPLASSKMRF | YPLASSKMR |
| SVLLTPSARLQAYVK | LLTPSARLQ |
| VRVLFPSYSQSSAMI | LFPSYSQSS |
| GVRVLFPSYSQSSAM | LFPSYSQSS |
| MNGMEYAYSMGTLKF | MEYAYSMGT |
| FKAFRVSKSHSSKVK | FRVSKSHSS |
| ILFFLLSTVLFAQET | FFLLSTVLF |
| VPNYPLASSKMRFKA | YPLASSKMR |
| RFKAFRVSKSHSSKV | FRVSKSHSS |
| DVPNYPLASSKMRFK | YPLASSKMR |
| YSQSSAMIMPPFKIP | YSQSSAMIM |
| DMNGMEYAYSMGTLK | MEYAYSMGT |
| KAFRVSKSHSSKVKN | FRVSKSHSS |
| NGMEYAYSMGTLKFK | MEYAYSMGT |
| SYSQSSAMIMPPFKI | YSQSSAMIM |
| GDTILGVRVLFPSYS | ILGVRVLFP |
| DTILGVRVLFPSYSQ | VRVLFPSYS |
| PNYPLASSKMRFKAF | YPLASSKMR |
| TILGVRVLFPSYSQS | VRVLFPSYS |
| VDLGINNWSVLLTPS | INNWSVLLT |
| MVVDLGINNWSVLLT | VVDLGINNW |
| YIPNISSRIIKDDVP | IPNISSRII |
| VVDLGINNWSVLLTP | INNWSVLLT |
| LFFLLSTVLFAQETD | FFLLSTVLF |
| NYVDYVYSGASGIVK | VYSGASGIV |
| VLLTPSARLQAYVKN | LLTPSARLQ |
| QAYVKNSVVAPAVVK | VKNSVVAPA |
| SLRKLKAHETFKRVL | LRKLKAHET |
| LRKLKAHETFKRVLK | LRKLKAHET |
| IWSNPNYIPNISSRI | IWSNPNYIP |
| YVDYVYSGASGIVKP | VYSGASGIV |
| VDYVYSGASGIVKPS | VYSGASGIV |
| VVAPAVVKSESKRYA | VVAPAVVKS |
| LQAYVKNSVVAPAVV | VKNSVVAPA |
| RLQAYVKNSVVAPAV | V

| | | | |
|---|---|---|---|
| | | ARLQAYVKNSVVAPA | YVKNSVVAP |
| | | SVFKVYFTGGTFSLR | YFTGGTFSL |
| | | LGVFKVYFTSGTESL | FKVYFTSGT |
| | | SSKMRFKAFRVSKSH | FKAFRVSKS |
| | | SKNRFKAFRVSKSHS | FKAFRVSKS |
| | | ASSKMRFKAFRVSKS | MRFKAFRVS |
| | | TNYVDYVYSGASGTV | YVYSGASGT |
| | | TKDDVPNYPIASSKM | VPNYPIASS |
| | | OMFYAYSKGTLXFRG | MFYAYSMGT |
| | | MFYAYSMGTLXFRGN | MFYAYSMGT |
| | | LFFDMNOMFYAYSMG | MNOMFYAYS |
| | | GYVYSGASGTVKPED | VYSGASGTV |
| | | VLFFDMNOMFYAYSM | MNOMFYAYS |
| | | KDLRVLYDKLSVGTD | LYDKLSVGT |
| | | VKDLRVLYDKLSVGT | LRVLYDKLS |
| | | FFLLSTVLPAQRTGG | FFLLSTVLP |
| | | EVLFRDMNOMFYAYS | FRDMNOMFY |
| | | FKVYFTSGTFSLRKL | YFTSGTFSL |
| | | AFRVSKSHSSKVKNF | FRVSKSHSS |
| | | VFKVYFTSGTFSLRF | YFTSGTFSL |
| | | NYPIASSKMRFKAFR | YPIASSKMR |
| | | FRVSKSHSSKVKNFT | FRVSKSHSS |
| | | TFYVKDLRVLYDKLS | VKDLRVLYD |
| | | LRVLYDKLSVSIDSE | LYDKLSVSI |
| | | DLRVLYDKLSVSTDS | LYDKLSVST |
| | | SKRYAGDTILGVRVL | YAGDTILGV |
| | | FAELARDPSSTRLDL | ARDPSSTRL |
| | | LDFAELARDPSSTRL | LARDPSSTR |
| | | FYVKDLRVLYDKLGV | LRVLYDKLS |
| | | DFAELARDPSSTRLD | ARDPSSTRL |
| | | AELARDPSSTRLDLT | ARDPSSTRL |
| | | LLTPSARLQAYVKNS | LLTPSARLQ |
| | | ESKRYAGDTILGVRV | YAGDTILGV |
| | | KLIKDDVPNYPLASS | LKDDVPNYP |
| | | QSSAMIKPPFKIPFY | MIKPPFKIP |
| | | IPFISSRLIKDDVPN | LPNISSRLL |
| | | SQSSAMIKPPFKIPF | MIKPPFKIP |
| | | SSAMIKPPFKIPFYS | MIKPPFKIP |
| | | YVYSGASGTVKPEDK | VYSGASGTV |
| | | LLKDDVPNYPLASSK | VPNYPLASS |
| | | KRYAGDTILGVRVLF | YAGDTILGV |
| | | QLIDNIKTMKFIKVS | IKTMKFIKV |
| | | KVYFTSGTFSLRKLK | YFTSGTFSL |
| | | RVLYDKLSVSTDSDF | LYDKLSVST |
| | | RGLIDNIKTMKFIKV | IDNIKTMKF |
| | | IDNIKTMKFIKVSVY | IKTMKFIKV |
| | | SFSVFKVYFTSGTFS | FKVYFTSGT |
| | | ADLIWSN

| | | | |
|---|---|---|---|
| | | LIDNIKTMKEIKVSV | IKTMKEIKV |
| | | RYAGDTTLGVRVLFP | YAGDTTLGV |
| | | VADLIWSNPNYLPNI | LIWSNPNYL |
| | | DNIKTMKEIKVSVYS | IKTMKEIKV |
| | | YAGDTTLGVRVLFPG | TLGVRVLFP |
| | | FIFYVKDLRVLYDKL | FYVKDLRVL |
| | | ELARDPSSTRLDLTY | ARDPSSTRL |
| | | YVKDLRVLYDKLSVG | LRVLYDKLS |
| | | APAVVKSFSKRYAGD | VVKSFSKRY |
| | | VAPAVVKSFSKRYAG | VVKSFSKRY |
| | | PAVVKSFSKRYAGDT | VVKSFSKRY |
| | | LASSKMRFKAFRVSK | MRFKAFRVS |
| | | FKGWADLIWSNPNYI | FKGWADLIW |
| | | KYAYSMGTLKFKGDA | AYSMGTLKF |
| | | SAKTMPPFRTPFYSG | MTPPFRTP |
| | | PLASSKMRFKAFRVS | KMRFKAFRV |
| | | YPLASSKMRFKAFRV | YPLASSKMR |
| | | LLSTVLFAQETDGLA | STVLFAQET |
| | | FLLSTVLFAQETDGL | STVLFAQET |
| | | LTNYVDVVYSGASGT | VDVVYSGAS |
| | | VKNFIFYVKDLRVLY | FYVKDLRVL |
| | | KVKNFIFYVKDLRVL | IFYVKDLRV |
| | | VYSGASGTVKPEDMV | VYSGASGTV |
| | | DLIWSNPNYLPNISG | LIWSNPNYL |
| | | AGDTTLGVRVLFPSY | TLGVRVLFP |
| | | VLDFAELARDPSSTR | FAELARDPS |
| HLA-DRB1*0301 | VKNFIFYVKDLRVLY | FIFYVKDLR |
| | KNFIFYVKDLRVLYD | YVKDLRVLY |
| | NFIFYVKDLRVLYDK | YVKDLRVLY |
| | IFYVKDLRVLYDKLS | YVKDLRVLY |
| HLA-DRB1*0401 | KNFIFYVKDLRVLYD | YVKDLRVLY |
| | NFIFYVKDLRVLYDK | YVKDLRVLY |
| | VKNFIFYVKDLRVLY | FIFYVKDLR |
| | FIFYVKDLRVLYDKL | YVKDLRVLY |
| | IFYVKDLRVLYDKLS | YVKDLRVLY |
| | ILFFLLSTVLFAQET | FLLSTVLF |
| | KSILFFLLSTVLFAQ | FLLSTVLF |
| | SILFFLLSTVLFAQE | FLLSTVLF |
| | AKSILFFLLSTVLFA | FLLSTVLF |
| | KAKSILFFLLSTVLF | LFFLLSTVL |
| | VLDFAELARDPSSTR | FAELARDPS |
| | IFFLLSTVLFAQETD | FLLSTVLFA |
| | LDFAELARDPSSTRL | LARDPSSTR |
| | ARLQAYVKNSVVAPA | YVKNSVVAP |
| | KMRFKAFRVSKSHSS | FKAFRVSKS |
| | RLQAYVKNSVVAPAV | VKNSVVAPA |
| | MRFKAFRVSKSHSSK | FRVSKSHSS |
| | DFAELARDPSSTRLD | LARDPSSTR |
| | LQAYVKNSVVAPAVV | VKNSVVAPA |
| | FYVKDLRVLYDKLSV | YVKDLRVLY |
| | FAELARDPSSTRLDL | LARDPSSTR |
| | YVKDLRVLYDKLSVG | YVKDLRVLY |
| | QAYVKNSVVAPAVVK | VKNSVVAPA |
| | AELARDPSSTRLDLT | LARDPSSTR |
| | INNSVLLTPSARLQ | NSVLLTPSA |
| | GTKNSVLLTPSARL | NSVLLTPSA |

Fig. 34 continued

| | | | |
|---|---|---|---|
| | | NNWSVLLTPSARLQA | WSVLLTPSA |
| | | AYVKNSVVAPAVVKS | VKYSVVAPA |
| | | DLGINNWSVLLTPSA | GINNWSVLL |
| | | FFLLSTVLFAQETDG | FFLLSTVLF |
| | | LGINNWSVLLTPSAR | WSVLLTPSA |
| | | FKAFRVSKSHSSKVK | FRVSKSHSS |
| | | RFKAFRVSKSHSSKV | FRVSKSHSS |
| | | LGVRVLFPSYSQSSA | LFPSYSQSS |
| | | TLGVRVLFPSYSQSS | VRVLFPSYS |
| | | GVRVLFPSYSQSSAM | LFPSYSQSS |
| | | MQMEYAYSMQTLKFK | MEYAYSMQT |
| | | MNQMEYAYSMQTLKF | MEYAYSMQT |
| | HLA-DRB1*0404 | INNWSVLLTPSARLQ | VLLTPSARL |
| | | NNWSVLLTPSARLQA | VLLTPSARL |
| | | GINNWSVLLTPSARL | WSVLLTPSA |
| | | NWSVLLTPSARLQAY | VLLTPSARL |
| | | WSVLLTPSARLQAYV | VLLTPSARL |
| | | KGWADLIWSNPNYTP | WADLIWSNP |
| | | FKGWADLIWSNPNYT | WADLIWSNP |
| | | TLGVRVLFPSYSQSS | TLGVRVLFP |
| | | KSILFFLLSTVLFAQ | FLLSTVLFA |
| | | LGINNWSVLLTPSAR | WSVLLTPSA |
| | | DLGINNWSVLLTPSA | GINNWSVLL |
| | | AKSILFFLLSTVLFA | ILFFLLSTV |
| | | GWADLIWSNPNYIPN | LIWSNPNYI |
| | | WADLIWSNPNYIPNL | LIWSNPNYI |
| | | ILFFLLSTVLFAQET | FLLSTVLFA |
| | | SILFFLLSTVLFAQE | FLLSTVLFA |
| | | DTILGVRVLFPSYSQ | ILGVRVLFP |
| | | GDTILGVRVLFPSYS | ILGVRVLFP |
| | | AGDTILGVRVLFPSY | ILGVRVLFP |
| | | RYAGDTILGVRVLFP | YAGDTILGV |
| | | YAGDTILGVRVLFPS | ILGVRVLFP |
| | | LFFLLSTVLFAQETD | FLLSTVLFA |
| | | SVLLTPSARLQAYVK | VLLTPSARL |
| | HLA-DRB1*0405 | LFYVKDLRVLYDKLG | VKDLRVLYD |
| | | FYVKDLRVLYDKLGV | VKDLRVLYD |
| | | KNFLFYVKDLRVLYD | YVKDLRVLY |
| | | NFLFYVKDLRVLYDK | VKDLRVLYD |
| | | FLFYVKDLRVLYDKL | VKDLRVLYD |
| | | FKGWADLIWSNPNYT | ADLIWSNPN |
| | | GWADLIWSNPNYIPN | LIWSNPNYI |
| | | DLGINNWSVLLTPSA | INNWSVLLT |
| | | KGWADLIWSNPNYIP | ADLIWSNPN |
| | | LGINNWSVLLTPSAR | INNWSVLLT |
| | | DLIWSNPNYIPNISS | IWSNPNYI |
| | | KMRFKAFRVSKSHSS | FKAFRVSKS |
| | | VVDLGINNWSVLLTP | INNWSVLLT |
| | | VDLGINNWSVLLTPS | INNWSVLLT |
| | | MRFKAFRVSKSHSSK | FKAFRVSKS |
| | | VVDLGINNWSVLLT | GINNWSVLL |
| | | ASKMRFKAFRVSKS | SKMRFKAFR |
| | | SSKMRFKAFRVSKSH | FKAFRVSK |
| | | SKMRFKAFRVSKSHS | FKAFRVSK |
| | | WADLIWSNPNYIPNI | LIWSNPNYI |

Fig. 34 continued

| | | | |
|---|---|---|---|
| | | LIWSNPNYIPNISSR | PNYIPNISS |
| | | GTNWSVLLTPSARL | TNWSVLLT |
| | | ADLIWSNPNYIPNIS | LIWSNPNYI |
| | | TNWSVLLTPSARLQ | TNWSVLLT |
| | | LKFKGWADLIWSNPN | FKGWADLIW |
| | | VVKDLRVLYDKLSVS | VKDLRVLYD |
| | | VLDFAFLARDPSSTR | FAFLARDPS |
| | | VKDLRVLYDKLSVGT | VKDLRVLYD |
| | | LDFAFLARDPSSTRL | LARDPSSTR |
| | | KFKGWADLIWSNPNY | ADLIWSNPN |
| | | DFAFLARDPSSTRLD | LARDPSSTR |
| | | GTILGVRVLFPSYSQ | VRVLFPSYS |
| | | FAFLARDPSSTRLDL | LARDPSSTR |
| | | TLGVRVLFPSYSQSS | RVLFPSYSQ |
| | | TILGVRVLFPSYSQS | RVLFPSYSQ |
| | | AFLARDPSSTRLDLT | LARDPSSTR |
| | | LGVRVLFPSYSQSSA | RVLFPSYSQ |
| | HLA-DRB1*0701 | WSNPNYIPNISSRTT | YIPNISSRT |
| | | SNPNYIPNISSRTTR | IPNISSRTT |
| | | NPNYIPNISSRTTRD | IPNISSRTT |
| | | PNYIPNISSRTTRDD | IPNISSRTT |
| | | NYIPNISSRTTKDDV | IPNISSRTT |
| | | YIPNISSRTTKDDVP | IPNISSRTT |
| | | NWSVLLTPSARLQAY | VLLTPSARL |
| | | GTNWSVLLTPSARL | SVLLTPSAR |
| | | WSVLLTPSARLQAYV | VLLTPSARL |
| | | IWSVLLTPSARLQ | VLLTPSARL |
| | | NWSVLLTPSARLQA | VLLTPSARL |
| | | IWSNPNYIPNISSRL | WSNPNYIPN |
| | | RFKAFRVSKSHSSKV | FRVSKSHSS |
| | | FKAFRVSKSHSSKVK | VSKSHSSKV |
| | | KAFRVSKSHSSVKN | VSKSHSSKV |
| | | LKIDKIMKEIKVSYSLG | MKEIKVSVY |
| | | KIDKEIKVSVYSLGY | MKEIKVSVY |
| | | NIKIDKEIKVSVYSL | MKEIKVSVY |
| | | KSILFFLLSTVLFAQ | LFFLLSTVL |
| | | SILFFLLSTVLFAQE | LFFLLSTVL |
| | | AKSIFFLLSTVLFA | FFLLSTVL |
| | | AFRVSKSHSSKVKNF | VSKSHSSKV |
| | | FRVSKSHSSKVKNFT | VSKSHSSKV |
| | | IDNIKIMKEIKVSVY | IMKEIKVSV |
| | | DNIKIMKEIKVSVYS | MKEIKVSVY |
| | | MVVDLGTNWSVLLT | LGTNWSVL |
| | | MRFKAFRVSKSHSS | FKAFRVSK |
| | | VVDLGTNWSVLLTP | TNWSVLLT |
| | | SVLLTPSARLQAYVK | VLLTPSARL |
| | | VLLTPSARLQAYVKN | VLLTPSARL |
| | | XAKSIFFLLSTVLF | FFLLSTVL |
| | | MRFKAFRVSKSHSSK | FRVSKSHSS |
| | | VDLGTNWSVLLTPS | LGTNWSVL |
| | | RVLFPSYSQSSAKTM | LFPSYSQSS |
| | | VVAPAVVKSESKRYA | VVKSESKRY |
| | | VAPAVVKSESKRYAG | VVKSESKRY |
| | | IPNISSRTTKDDVPN | IPNISSRTT |
| | | APAVVKSESKRYAGS | VVKSESKRY |
| | | DMVVDLGTNWSVLL | LGTNWSVL |

Fig. 34 continued

| | | | |
|---|---|---|---|
| | | SVVAPVVKSESKRY | SVVAPVVK |
| | | RKAKSLFFLLSTVL | AKSLFFLL |
| | | PAVVKSESKRYAGDT | VVKSESKRY |
| | | VLFPSYSQSSAMTMP | YSQSSAMTM |
| | | ILFFLLSTVLFAQET | LFFLLSTVL |
| | HLA-DRB1*0802 | None | |
| | HLA-DRB1*0901 | KDFVKAMINVGSFKL | FVKAMINVG |
| | | AEVNNFVKAMINVGS | FVKAMINVG |
| | | EVNNFVKAMINVGSF | FVKAMINVG |
| | | VNNFVKAMINVGSFK | FVKAMINVG |
| | | EAEVNNFVKAMINVG | VNNFVKAMI |
| | | NFVKAMINVGSFKLS | FVKAMINVG |
| | | FVKAMINVGSFKLSL | FVKAMINVG |
| | HLA-DRB1*1101 | ASSKMRFKAFRVSKS | KRFKAFRVS |
| | | LASSKMRFKAFRVSK | KRFKAFRVS |
| | | SSKMRFKAFRVSKSE | KRFKAFRVS |
| | | SKMRFKAFRVSKSES | KRFKAFRVS |
| | | PLASSKMRFKAFRVS | ASSKMRFKA |
| | HLA-DRB1*1302 | MVVDLGTNNWSVLLT | LGTNNWSVL |
| | | VVDLGTNNWSVLLTP | TNNWSVLLT |
| | | VDLGTNNWSVLLTPS | TNNWSVLLT |
| | | DLGTNNWSVLLTPSA | TNNWSVLLT |
| | | LGTNNWSVLLTPSAR | TNNWSVLLT |
| | | DMVVDLGTNNWSVLL | LGTNNWSVL |
| | | EDMVVDLGTNNWSVL | VVDLGTNNW |
| | | GTNNWSVLLTPSARL | TNNWSVLLT |
| | | TNNWSVLLTPSARLQ | TNNWSVLLT |
| | | SNPNYIPNISSRIKK | IPNISSRII |
| | | NPNYIPNISSRIKKD | IPNISSRII |
| | | AKSLFFLLSTVLFA | FFLLSTVLF |
| | | KSLFFLLSTVLFAQ | FFLLSTVLF |
| | | SLFFLLSTVLFAQE | FFLLSTVLF |
| | | KAKSLFFLLSTVLF | LFFLLSTV |
| | | WSNPNYIPNISSRII | YIPNISSRI |
| | | ILFFLLSTVLFAQET | FFLLSTVLF |
| | | PNYIPNISSRIIKDD | IPNISSRII |
| | | VKNFIFYVKDLRVLY | VKNFIFYVK |
| | | SKVKNFIFYVKDLRV | VKNFIFYVK |
| | | NYIPNISSRIIKDDV | IPNISSRII |
| | | SSKVKNFIFYVKDLR | VKNFIFYVK |
| | | KSHSSKVKNFIFYVK | SKVKNFIFY |
| | | ARLQAYVKNSVVAPA | YVKNSVVAP |
| | | LWSNPNYIPNISSRI | NPNYIPNIS |
| | | HSSKVKNFIFYVKDL | VKNFIFYVK |
| | | SHSSKVKNFIFYVKD | VKNFIFYVK |
| | | LQAYVKNSVVAPAVV | VKNSVVAPA |
| | | RLQAYVKNSVVAPAV | VKNSVVAPA |
| | | QAYVKNSVVAPAVVK | VKNSVVAPA |
| | | GDTILGVRVLFPSYS | LGVRVLFPS |
| | | YIPNISSRIIKDDVF | IPNISSRII |
| | | TKTMRFRVSVYSLG | MRFRVSVY |
| | | ADLWSNPNYIPNIS | IINSNPNYI |
| | | DTILGVRVLFPSYSQ | LGVRVLFPS |

Fig. 34 continued

| | | | |
|---|---|---|---|
| | | LFFLLSTVLFAQETD | FFLLSTVLF |
| | | AYVKNSVVAPAVVKS | VKNSVVAPA |
| | | KGLIDNIKTMKEIKV | LIDNIKTMK |
| | | TTLGVRVLFPSYSQS | LGVRVLFPS |
| | | YAGDILGVRVLFPS | ILGVRVLF |
| | | AQETTLGVRVLFPSY | LGVRVLFPS |
| | | FFLLSTVLFAQETEG | FFLLSTVLF |
| | | LQKGLIDNIKTMKEI | IDNIKTMK |
| | | KTMKEIKVSVYSIGY | IKVSVYSIG |
| | | KVKNFIFYVKDLRVL | VKNFIFYVK |
| | | DLTWSNPNYTPNTSS | NPNYTPNTS |
| | | FLQKGLIDNIKTMKE | LIDNIKTMK |
| | | GKGLIDNIKTMKEIK | LIDNIKTMK |
| | | TMKEIKVSVYSIGYE | IKVSVYSIG |
| | | MKEIKVSVYSIGYET | IKVSVYSIG |
| | | LTWSNPNYTPNTSSR | NPNYTPNTS |
| | | QFLQKGLIDNIKTMK | KGLIDNIKT |
| | | KNFIFYVKDLRVLYD | YVKDLRVLY |
| | | GADILTWSNPNYTPNT | LTWSNPNY |
| | | SARLQAYVKNSVVAP | LQAYVKNSV |
| | | KEIKVSVYSIGYETD | IKVSVYSIG |
| | | GWADLTWSNPNYTPN | LTWSNPNY |
| | | GLIDNIKTMKEIKVS | LIDNIKTMK |
| | | YVKNSVVAPAVVKSE | VKNSVVAPA |
| | | KGAADLTWSNPNYTP | LTWSNPNYT |
| | | LGVRVLFPSYSQSSA | LGVRVLFPS |
| | | NFIFYVKDLRVLYDK | YVKDLRVLY |
| | | IFYVKDLRVLYDKLS | YVKDLRVLY |
| | | ILGVRVLFPSYSQSS | LGVRVLFPS |
| | | LIDNIKTMKEIKVSV | LIDNIKTMK |
| | | FIFYVKDLRVLYDKL | YVKDLRVLY |
| | | SSTRLDLTNYVDVY | TRLDLTNYV |
| | | STRLDLTNYVDVYS | LTNYVDVY |
| | HLA-DRB1*1501 | KSILFFLLSTVLFAQ | LFFLLSTV |
| | | AKSILFFLLSTVLFA | LFFLLSTV |
| | | SKVKNFIFYVKDLRV | VKNFIFYVK |
| | | RKAKSILFFLLSTVL | LFFLLSTV |
| | | KAKSILFFLLSTVLF | ILFFLLSTV |
| | | SSKVKNFIFYVKDLR | VKNFIFYVK |
| | | KVKNFIFYVKDLRVL | VKNFIFYVK |
| | | KSHSSKVKNFIFYVK | KVKNFIFYV |
| | | SHSSKVKNFIFYVKD | VKNFIFYVK |
| | | HSSKVKNFIFYVKDL | VKNFIFYVK |
| | | VKNFIFYVKDLRVLY | VKNFIFYVK |
| | | ASSKMRFKAFRVSKS | MRFKAFRVS |
| | | SSKMRFKAFRVSKSH | MRFKAFRVS |
| | | STLFFLLSTVLFAQE | LFFLLSTVL |
| | | KRKAKSTLFFLLSTV | STLFFLLST |
| | | SKMRFKAFRVSKSHS | MRFKAFRVS |
| | | LASSKMRFKAFRVSK | MRFKAFRVS |
| | | PLASSKMRFKAFRVS | KMRFKAFRV |
| | | KMRFKAFRVSKSHSS | MRFKAFRVS |
| | | ILGVRVLFPSYSQSS | VRVLFPSYS |
| | | DTTLGVRVLFPSYSQ | VRVLFPSYS |
| | | ILFFLLSTVLFAQET | LFFLLSTV |
| | | TTLGVRVLFPSYSQS | VRVLFPSYS |

Fig. 34 continued

| | | | |
|---|---|---|---|
| | | MRFKAFRVSKSESSK | FRVSKSESS |
| | | LGVRVLFPSYSQSQA | VRVLFPSYS |
| | | GDTILGVRVLFPSYS | LGVRVLFPS |
| | | VKDLRVLYDKLSVST | VLYDKLSVS |
| | | KDLFYVKDLRVLYD | LFYVKDLR |
| | | YVKDLRVLYDKLSVS | LRVLYDKLS |
| | | KDLRVLYDKLSVSTD | VLYDKLSVS |
| | | VLDFAFLARDPSSTR | VLDFAFLAR |
| | | DLRVLYDKLSVSTDS | VLYDKLSVS |
| | | LDFAFLARDPSSTRL | LARDPSSTR |
| | | TFKRVLKLRFKTSTA | KRVLKLRFK |
| | | GVRVLFPSYSQSSAM | VRVLFPSYS |
| | | NLFYVKDLRVLYDK | FYVKDLRVL |
| | | KTFKRVLKLRFKTST | KRVLKLRFK |
| | | RFKAFRVSKSESSRV | FRVSKSESS |
| | | LRVLYDKLSVSTDSF | VLYDKLSVS |
| | | LGTNNKSVLLTPSAR | TNNKSVLLT |
| | | AFLARDPSSTRLDLT | LARDPSSTR |
| | | DFAFLARDPSSTRLD | LARDPSSTR |
| | | GTNNKSVLLTPSARL | SVLLTPSAR |
| HLA-DRB3*0101 | None | | |
| HLA-DRB4*0101 | | ADLTYSNPYYTPNTS | LTYSNPNYT |
| | | KQWADLTYSNPNYTP | LTYSNPNYT |
| | | WADLTYSNPNYTPNT | LTYSNPNYT |
| | | QWADLTYSNPNYTPN | LTYSNPNYT |
| | | FKQWADLTYSNPNYT | FKQWADLTY |
| | | DLTYSNPNYTPNTSS | LTYSNPNYT |
| | | LTYSNPNYTPNTSSR | LTYSNPNYT |
| | | TILGVRVLFPSYSQS | VRVLFPSYS |
| | | DTILGVRVLFPSYSQ | VRVLFPSYS |
| | | GDTILGVRVLFPSYS | LGVRVLFPS |
| | | ILGVRVLFPSYSQSS | VRVLFPSYS |
| | | RIIKDDVPNYPLASS | IKDDVPNYP |
| | | LGVRVLFPSYSQSSA | VRVLFPSYS |
| | | PLASSKMRFKAFRVS | LASSKMRFK |
| | | LASSKMRFKAFRVSK | MRFKAFRVS |
| | | ASSKMRFKAFRVSKS | MRFKAFRVS |
| | | SSKMRFKAFRVSKSH | MRFKAFRVS |
| | | SKMRFKAFRVSKSHS | MRFKAFRVS |
| | | ISSRIIKDDVPNYPL | IKDDVPNYP |
| | | HISSRIIKDDVPNYP | SRIIKDDVP |
| | | SSRIIKDDVPNYPLA | IKDDVPNYP |
| | | SRIIKDDVPNYPLAS | IKDDVPNYP |
| | | IIKDDVPNYPLASSK | IKDDVPNYP |
| | | IKDDVPNYPLASSKM | IKDDVPNYP |
| HLA-DRB5*0101 | | DVPNYPLASSKMRFK | YPLASSKMR |
| | | VPNYPLASSKMRFKA | YPLASSKMR |
| | | PNYPLASSKMRFKAF | YPLASSKMR |
| | | KDDVPNYPLASSKMR | NYPLASSKM |
| | | DDVPNYPLASSKMRF | YPLASSKMR |
| | | SLRKLKAHETFKRV | LKAHETFKR |
| | | LRKLKAHETFKRVLK | LKAHETFKR |
| | | SLRKLKAHETFKRVL | LKAHETFKR |
| | | RKLKAHETFKRVLKL | LKAHETFKR |

Fig. 34 continued

| | | | |
|---|---|---|---|
| | | TESLRKLKAHETFKR | LRKLKAHET |
| | | NYPLASSKMRFKAFR | YPLASSKMR |
| | | YPLASSKMRFKAFRV | YPLASSKMR |
| | | WSNPNYIPNISSRII | YIPNISSRI |
| | | IWSNPNYIPNISSRI | NYIPNISSR |
| | | SNPNYIPNISSRIIK | YIPNISSRI |
| | | NPNYIPNISSRIIKD | YIPNISSRI |
| BAD18055.1 FlaB protein [Borrelia garinii] SEQ ID NO:15, SEQ ID NO:131967-132356 | HLA-DRB1*0101 | QPAKINTPASLSGSQ | INTPASLSG |
| | | PAKINTPASLSGSQA | INTPASLSG |
| | | MQPAKINTPASLSGS | INTPASLSG |
| | | AKINTPASLSGSQAS | INTPASLSG |
| | | ANLFSGEGAQAAQTA | FSGEGAQAA |
| | | VANLFSGEGAQAAQT | FSGEGAQAA |
| | | NLFSGEGAQAAQTAP | FSGEGAQAA |
| | | GMQPAKINTPASLSG | KINTPASLS |
| | | ANVANLFSGEGAQAA | VANLFSGEG |
| | | NVANLFSGEGAQAAQ | FSGEGAQAA |
| | | YNQMHMLSNKSASQN | MHMLSNKSA |
| | | RKVLVRMKELAVQGG | VRMKELAVQ |
| | | KVLVRMKELAVQSGN | MKELAVQSG |
| | | QAQYNQMHMLSNKSA | YNQMHMLSN |
| | | AQYNQMHMLSNKSAS | MHMLSNKSA |
| | | LFSGEGAQAAQTAPV | FSGEGAQAA |
| | | VLVRMKELAVQSGNG | MKELAVQSG |
| | | NQMHMLSNKSASQNV | MHMLSNKSA |
| | | AEELGMQPAKINTPA | LGMQPAKIN |
| | | FSGEGAQAAQTAPVQ | FSGEGAQAA |
| | | TAEELGMQPAKINTP | LGMQPAKIN |
| | | LVRMKELAVQGGNGT | MKELAVQSG |
| | | QYNQMHMLSNKSASQ | MHMLSNKSA |
| | | VRMKELAVQSGNGTY | MKELAVQSG |
| | | RTAEELGMQPAKINT | LGMQPAKIN |
| | | EELGMQPAKINTPAS | LGMQPAKIN |
| | | VRTAEELGMQPAKIN | ELGMQPAKI |
| | | INTPASLSGSQASWT | INTPASLSG |
| | | KINTPASLSGSQASW | INTPASLSG |
| | | VQQEGAQQPAPATAP | VQQEGAQQP |
| | | RMKELAVQSGNGTYS | MKELAVQSG |
| | | MKELAVQSGNGTYSD | MKELAVQSG |
| | | EGVQQEGAQQPAPAT | VQQEGAQQP |
| | | QMHMLSNKSASQNVR | MHMLSNKSA |
| | | MHMLSNKSASQNVRT | MHMLSNKSA |
| | | AIAVNIYAANVANLF | VNIYAANVA |
| | | LGMQPAKINTPASLS | LGMQPAKIN |
| | | IAVNIYAANVANLFS | YAANVANLF |
| | | ELGMQPAKINTPASL | LGMQPAKIN |
| | | QEGVQQEGAQQPAPA | VQQEGAQQP |
| | | AVNIYAANVANLFSG | YAANVANLF |
| | | PVQEGVQQEGAQQPA | VQQEGAQQP |
| | | APVQEGVQQEGAQQP | QEGVQQEGA |
| | | VQEGVQQEGAQQPAP | VQQEGAQQP |
| | | NIYAANVANLFSGEG | YAANVANLF |
| | | QEGAQQPAPATAPSQ | QQPAPATAP |
| | | VNIYAANVANLFSGE | YAANVANLF |
| | | QQEGAQQPAPATAPS | QQPAPATAP |

Fig. 34 continued

| | | | |
|---|---|---|---|
| | | GVQEGAQQPAPATA | VQQEGAQQP |
| | | EGAQQPAPATAPSQG | QQPAPATAP |
| | | EATAVNTYAANVANL | VNTYAANVA |
| | | VRKVLVRMKELAVQS | VRMKELAVQ |
| | | GAQQPAPATAPSQGG | QQPAPATAP |
| | | RVRKVLVRMKELAVQ | LVRMKELAV |
| | | AANVANLFSCFGAQA | VANLFSCFG |
| | | RELAVQSCNGTYSDA | VQSCNGTYS |
| | | DEATAVNTYAANVAN | VNTYAANVA |
| | | PSQGGVNSPVNVTTT | VNSPVNVTT |
| | | DQAQYNQKHMLSNKS | YNQMHMLSN |
| | | SQGGVNSPVNVTTTV | VNSPVNVTT |
| | | QGGVNSPVNVTTTVD | VNSPVNVTT |
| | | APSQGGVNSPVNVTT | GVNSPVNVT |
| | | QDEATAVNTYAANVA | AVNTYAANV |
| | | PASLSGSQASWTLRV | LSGSQASWT |
| | | ASLSGSQASWTLRVH | LSGSQASWT |
| | | TYAANVANLFSCFGA | VANLFSCFG |
| | | GGVNSPVNVTTTVDA | VNSPVNVTT |
| | | ELAVQSCNGTYSDAD | VQSCNGTYS |
| | | NTPASLSGSQASWTL | LSGSQASWT |
| | | GEGAQAAQTAPVQEG | AQAAQTAPV |
| | | LAVQSCNGTYSDADR | VQSCNGTYS |
| | | EGAQAAQTAPVQEGV | AQAAQTAPV |
| | | YAANVANLFSCFGAQ | VANLFSCFG |
| | | TPASLSGSQASWTLR | LSGSQASWT |
| | | AQQPAPATAPSQGGV | PATAPSQGG |
| | | ALDQAQYNQKHMLSNK | YNQMHMLSN |
| | | HKLSNKSASQNVRTA | LSNKSASQN |
| | | IADQAQYNQKHMLSN | QYNQMHMLS |
| | | SGEGAQAAQTAPVQE | AQAAQTAPV |
| | | VNVTTTVDANTSLAK | VTTTVDANT |
| | | QQPAPATAPSQGGVN | PATAPSQGG |
| | | GVNSPVNVTTTVDAN | VNVTTTVDA |
| | | AQAAQTAPVQEGVQQ | AQTAPVQEG |
| | | GAQAAQTAPVQEGVQ | AQTAPVQEG |
| | | VNSPVNVTTTVDANT | VNVTTTVDA |
| | | SLSGSQASWTLRVHV | LSGSQASWT |
| | | LSGSQASWTLRVHVG | LSGSQASWT |
| | | SKAINFTQTTEGKLE | INFTQTTEG |
| | | NSPVNVTTTVDANTS | VNVTTTVDA |
| | | SPVNVTTTVDANTSL | VNVTTTVDA |
| | | NVTTTVDANTSLAKI | VDANTSLAK |
| | | KAINFTQTTEGNLEF | INFTQTTEG |
| | | QPAPATAPSQGGVNS | PATAPSQGG |
| | | MLSNKSASQNVRTAE | LSNKSASQN |
| | | PAPATAPSQGGVNSP | PATAPSQGG |
| | | VTTTVDANTSLAKIE | VDANTSLAK |
| | | PVNVTTTVDANTSLA | VNVTTTVDA |
| | | QAAQTAPVQEGVQQE | AQTAPVQEG |
| HLA-DRB1*0301 | None | | |
| HLA-DRB1*0401 | | QYNQKHMLSNKSASQ | QKHMLSNKS |
| | | YKQMHMLSNKSASQN | QMHMLSNKS |
| | | TAVNTYAANVANLFS | YAANVANLF |
| | | QAQYNQKHMLSNKSA | QKHMLSNKS |
| | | NQKHMLSNKSASQNV | KHMLSNKSASQ |

Fig. 34 continued

| | | | |
|---|---|---|---|
| | | ALAVNIYAANVANLF | NIYAANVAN |
| | | NIYAANVANLFSCFG | YAANVANLF |
| | | AVNIYAANVANLFSG | YAANVANLF |
| | | AQYNQMHLSNKSAS | QMHLSNKS |
| | | VNIYAANVANLFSGF | YAANVANLF |
| | | QMHLSNKSASQHVR | MLSNKSASQ |
| | | GVNSPVNTTTVDAN | VNVTTTVDA |
| | | GGVNSPVNVTTTVDA | VNSPVNVTT |
| | | NSPVNVTTTVDANTS | VNVTTTVDA |
| | | VNSPVNVTTTVDANT | VNVTTTVDA |
| | HLA-DRB1*0404 | ANVANLFSCFGAQAA | VANLFSCFG |
| | | AANVANLFSCFGAQA | VANLFSCFG |
| | | NIYAANVANLFSCFG | YAANVANLF |
| | | TYAANVANLFSCFGA | VANLFSCFG |
| | | YAANVANLFSCFGAQ | VANLFSCFG |
| | | YNQMHLSNKSASQN | MLSNKSASQ |
| | | QYNQMHLSNKSASQ | QMHLSNKS |
| | | NVANLFSCFGAQAAQ | VANLFSCFG |
| | | VANLFSCFGAQAAQT | VANLFSCFG |
| | | YQMHLSNKSASQNV | MLSNKSASQ |
| | | QMHLSNKSASQHVR | MLSNKSASQ |
| | | VNVTTTVDANTSLAK | TVDANTSLA |
| | | PVNVTTTVDANTSLA | VNVTTTVDA |
| | | AQYNQMHLSNKSAS | QMHLSNKS |
| | | QAQYNQMHLSNKSA | QMHLSNKS |
| | | DQAQYNQMHLSNKS | YNQMHLSN |
| | HLA-DRB1*0405 | EELGKQPAKINTPAS | LGMQPAKIN |
| | | LGMQPAKINTPASLS | PAKINTPAS |
| | | GGVNSPVNVTTTVDA | PVNVTTVD |
| | | GVNSPVNVTTTVDAN | VNVTTTVDA |
| | | VNSPVNVTTTVDANT | VNVTTTVDA |
| | | ELGMQPAKINTPASL | PAKINTPAS |
| | | NSPVNVTTTVDANTS | VNVTTTVDA |
| | HLA-DRB1*0701 | GGVNSPVNVTTTVDA | PVNVTTVD |
| | | GVNSPVNVTTTVDAN | VNVTTTVDA |
| | HLA-DRB1*0802 | None | |
| | HLA-DRB1*0901 | IAVNIYAANVANLFS | VNIYAANVA |
| | | ALAVNIYAANVANLF | VNIYAANVA |
| | | LAVNIYAANVANL | VNIYAANVA |
| | | AVNIYAANVANLFSG | IYAANVANL |
| | | VNIYAANVANLFSGF | IYAANVANL |
| | HLA-DRB1*1101 | None | |
| | HLA-DRB1*1302 | NTSLAKIENAIRMIS | AKIENAIRM |
| | | TSLAKIENAIRMISD | IENAIRMIS |
| | | SLAKIENAIRMISDQ | IENAIRMIS |
| | | RMKELAVQSGNGTYS | LAVQSGNGT |
| | | ALAVNIYAANVANLF | VNIYAANVA |
| | | LAVNIYAANVANLFS | VNIYAANVA |
| | | KKELAVQSGNGTYSD | LAVQSGNGT |
| | | KELAVQSGNGTYSDA | LAVQSGNGT |
| | | LVRKELAVQSGNGT | KKELAVQSG |
| | | VRMKELAVQSGNGTY | LAVQSGNGT |

Fig. 34 continued

| | | | |
|---|---|---|---|
| | | AVNIYAANVANLFSG | YAANVANLF |
| | | VNIYAANVANLFSGE | YAANVANLF |
| | | SQGGVNSPVNVTTTV | GVNSPVNVT |
| | | QGGVNSPVNVTTTVD | GVNSPVNVT |
| | | GGVNSPVNVTTTVDA | GVNSPVNVT |
| | | EAIAVNIYAANVANL | VNIYAANVA |
| | | PSQGGVNSPVNVTTT | GVNSPVNVT |
| | | APSQGGVNSPVNVTT | GVNSPVNVT |
| | | QDEAIAVNIYAANVA | IAVNIYAAN |
| | | DEAIAVNIYAANVAN | VNIYAANVA |
| | | GVNSPVNVTTTVDAN | GVNSPVNVT |
| | | ELAVQSGNGTYSDAD | LAVQSGNGT |
| | | LAVQSGNGTYSDADR | LAVQSGNGT |
| | | NIYAANVANLFSGEG | YAANVANLF |
| | | SKAINFIQTTEGNLN | INFIQTTEG |
| | HLA-DRB1*1501 | EKVLVRMKELAVQSG | LVRMKELAV |
| | | KVLVRMKELAVQSGN | LVRMKELAV |
| | | VEKVLVRMKELAVQS | LVRMKELAV |
| | | EVEKVLVRMKELAVQ | LVRMKELAV |
| | | VLVRMKELAVQSGNG | VRMKELAVQ |
| | | LVRMKELAVQSGNGT | VRMKELAVQ |
| | | NEVEKVLVRMKELAV | VLVRMKELA |
| | | QYNQMHMLSNKSASQ | MHMLSNKSA |
| | | YNQMHMLSNKSASQN | MHMLSNKSA |
| | | AQYNQMHMLSNKSAS | MHMLSNKSA |
| | | VRMKELAVQSGNGTY | VRMKELAVQ |
| | | QAQYNQMHMLSNKSA | QMHMLSNKS |
| | | NQMHMLSNKSASQNV | MHMLSNKSA |
| | | QASWTLRVHVGANQD | LRVHVGANQ |
| | | SQASWTLRVHVGANQ | QASWTLRVH |
| | HLA-DRB3*0101 | None | |
| | HLA-DRB4*0101 | EVEKVLVRMKELAVQ | VEKVLVRMK |
| | | VEKVLVRMKELAVQS | VRMKELAVQ |
| | | EKVLVRMKELAVQSG | VRMKELAVQ |
| | | KVLVRMKELAVQSGN | VRMKELAVQ |
| | | VLVRMKELAVQSGNG | VRMKELAVQ |
| | | VRMKELAVQSGNGTY | VRMKELAVQ |
| | | LVRMKELAVQSGNGT | VRMKELAVQ |
| | HLA-DRB5*0101 | NTSLAKIENAIRMIS | AKIENAIRM |
| | | TSLAKIENAIRMISD | AKIENAIRM |
| | | DANTSLAKIENAIRM | LAKIENAIR |
| | | ANTSLAKIENAIRMI | AKIENAIRM |
| | | SLAKIENAIRMISDQ | AKIENAIRM |
| AAU07005.1\| flagellar filament 41 kDa core protein [Borrelia garinii PBi] SEQ ID NO:16, SEQ ID NO:132357-132940 | HLA-DRB1*0101 | TTNSILTQSAMAMIA | ILTQSAMAM |
| | | TNSILTQSAMAMIAQ | ILTQSAMAM |
| | | NSILTQSAMAMIAQA | ILTQSAMAM |
| | | STTNSILTQSAMAMI | ILTQSAMAM |
| | | ASTTNSILTQSAMAM | TNSILTQSA |
| | | QPAKINTPASLSGSQ | INTPASLSG |
| | | PAKINTPASLSGSQA | INTPASLSG |
| | | SILTQSAMAMIAQAN | ILTQSAMAM |

Fig. 34 continued

| | | | |
|---|---|---|---|
| | | KQPAKTNTPASLSG | TNTPASLSG |
| | | AKTNTPASLSGSQAS | TNTPASLSG |
| | | ILTQSAMAMLAQANQ | ILTQSAMAM |
| | | CMQPAKTNTPASLSG | KTNTPASLS |
| | | NAIRMISDQRANLGA | IRMISDQRA |
| | | ANVANLFSGFGSQAA | VANLFSGFG |
| | | ANLFSGFGSQAAQTA | FSGFGSQAA |
| | | FNAIRMISDQRANLG | IRMISDQRA |
| | | VANLFSGFGSQAAQT | FSGFGSQAA |
| | | NLFSGFGSQAAQTAP | FSGFGSQAA |
| | | NVANLFSGFGSQAAQ | FSGFGSQAA |
| | | YNQMHMLSNKSASQN | MHMLSNKSA |
| | | EKVLVRMKFLAVQSG | VRMKFLAVQ |
| | | KVLVRMKFLAVQSGN | MKFLAVQSG |
| | | QAQYNQMHMLSNKSA | YNQMHMLSN |
| | | AQYNQMHMLSNKSAS | MHMLSNKSA |
| | | NQMHMLSNKSASQNV | MHMLSNKSA |
| | | ARELGMQPAKTNTPA | LGMQPAKTN |
| | | VLVRMKFLAVQSGNG | MKFLAVQSG |
| | | TARELGMQPAKTNTP | LGMQPAKTN |
| | | QYNQMHMLSNKSASQ | MHMLSNKSA |
| | | AKLENAIRMISQRA | IENAIRMIS |
| | | LVRMKFLAVQSGNGT | MKFLAVQSG |
| | | RIAELGMQPAKINT | LGKQPAKTN |
| | | ERLGMQPAKTNTPAS | LGMQPAKTN |
| | | VRMKFLAVQSGNGTY | MKFLAVQSG |
| | | VRIAELGMQPAKTN | ELGMQPAKT |
| | | IENAIRMISDQRANL | IRMISDQRA |
| | | KIENAIRMISDQRAN | IRMISDQRA |
| | | INTPASLSGSQASQE | INTPASLSG |
| | | EYATENLKASYAQLK | IENLKASYA |
| | | LFSGFGSQAAQTAPV | FSGFGSQAA |
| | | YATENLKASYAQIKD | IENLKASYA |
| | | FSGFGSQAAQTAPVQ | FSGFGSQAA |
| | | KTNTPASLSGSQASQ | TNTPASLSG |
| | | AIRMISDQRANLGAF | IRMISDQRA |
| | | TRMTSDQRANLGAFQ | T

| | | | |
|---|---|---|---|
| | | VNIYAANVANLFGE | YAANVANLF |
| | | QQPGAQQPAPATAPS | QQPAPATAP |
| | | AQQPGAQQPAPATAP | AQQPAPATA |
| | | MTDFVVASTTNSTLT | VVASTTNST |
| | | TMIDFVVASTTNSLL | VVASTTNSL |
| | | TDFVVASTTNSTLTQ | VVASTTNST |
| | | FGAQQPAPATAPSQG | QQPAPATAP |
| | | AMAMTAQANQVPQYV | MTAQANQVP |
| | | EATAVNIYAANVANL | VNIYAANVA |
| | | DFVVASTTNSTLTQS | VVASTTNST |
| | | ETLKASYAQTKDATK | LKASYAQTK |
| | | VEKVLVRKKELAVQS | VRKKELAVQ |
| | | SAMAMTAQANQVPQY | MTAQANQVP |
| | | GAQQPAPATAPSQGG | QQPAPATAP |
| | | EVEKVLVRKKELAVQ | LVRKKELAV |
| | | MAQTRGLSQASRNTS | TRGLSQASR |
| | | KELAVQSGNGTYSDA | VQSGNGTYS |
| | | NLKASYAQTKDATMT | LKASYAQTK |
| | | LKASYAQTKDATMTD | LKASYAQTK |
| | | TMAQTRGLSQASRNT | TRGLSQASR |
| | | AQTRGLSQASRNTSE | TRGLSQASR |
| | | DEATAVNIYAANVAN | VNIYAANVA |
| | | PSQGGVNSPVNVTTT | VNSPVNVTT |
| | | DQAQENQKIHLSKKG | YNQKIHLSN |
| | | SGGGVNSPVNVTTTV | VNSPVNVTT |
| | | QGGVNSPVNVTTTVD | VNSPVNVTT |
| | | APSQGGVNSPVNVTT | GVNSPVNVT |
| | | QEEATAVNIYAANVA | AVNIYAANV |
| | | PASLSGSQASNTLRV | LSGSQASNT |
| | | ASLSGSQASNTLRVH | LSGSQASNT |
| | | AANVANLFSGEGSQA | VANLFSGEG |
| | | MAMTAQANQVPQYVL | MTAQANQVP |
| | | IYAANVANLFSGEGS | VANLFSGEG |
| | | GGVNSPVNVTTTVDA | VNSPVNVTT |
| | | ELAVQSGNGTYSE

| | | | |
|---|---|---|---|
| | | ASYAQIKDATMTEVV | AQIKDATMT |
| | | QQPAPATAPSQGGVN | PATAPSQGG |
| | | AKIAQANQVPQYVLG | MIAQANQVP |
| | | GVNSPVNVTTTVDAN | VNVTTTVDA |
| | | IRGLSQASRNISKAI | IRGLSQASR |
| | | RMISDQRANLCAFQN | ISDQRANLC |
| | | CAQQFCAQQPAPATA | CAQQPAPAT |
| | | MIAQANQVPQYVLGL | QANQVPQYV |
| | | GSQAAQTAPVQFGAQ | AQTAPVQFG |
| | | SQAAQTAPVQFGAQQ | AQTAPVQFG |
| | | DATMTEVVASTTKS | MTEVVAST |
| | | VNSPVNVTTTVDANT | VNVTTTVDA |
| | | SLCGSQASWTIRVHV | ISCGSQASWT |
| | | LSCGSQASWTIRVHVG | ISCGSQASWT |
| | | SKAINFIQTTFCNLF | INFIQTTFC |
| | | KTINHTSAINASRN | IHNTSAIN |
| | | SYAQIKDATMTEVV | AQIKDATMT |
| | | NSPVNVTTTVDANTS | VNVTTTVDA |
| | | SPVNVTTTVDANTSL | VNVTTTVDA |
| | | NVTTTVDANTSLAKI | VDANTSLAK |
| | | KAINFIQTTFCNLFE | INFIQTTFC |
| | | GGLGSQAAQTAPVQL | SQAAQTAPV |
| | | QPAPATAPSQGGVNS | PATAPSQGG |
| | | KLSNKSASQNVRTAE | LSNKSASQN |
| | | IKDATMTEVVASTT | MTEVVAST |
| | | KDATMTEVVASTTN | MTEVVAST |
| | | PAPATAPSQGGVNSP | PATAPSQGG |
| | | VTTTVDANTSLAKIE | VDANTSLAK |
| | | QIKDATMTDEVVAST | DATMTDEVV |
| | | PVNVTTTVDANTSLA | VNVTTTVDA |
| | | QAAQTAPVQFGAQQE | AQTAPVQFG |
| | | EGAQQFGAQQPAPAT | AQQFGAQQP |
| | HLA-DRB1*0301 | None | |
| | HLA-DRB1*0401 | QYNQMHMLSNKSASQ | QMHMLSNKS |
| | | YNQMHMLSNKSASQN | QMHMLSNKS |
| | | IAVNIYAANVANLFG | YAANVANLF |
| | | QAQYNQMHMLSNKSA | QMHMLSNKS |
| | | HQMHMLSNKSASQNV | MLSNKSASQ |
| | | AIAVNIYAANVANLF | NIYAANVAN |
| | | NIYAANVANLFSGEG | YAANVANLF |
| | | AVNIYAANVANLFSG | YAANVANLF |
| | | AQYNQMHMLSNKSAS | QMHMLSNKS |
| | | VNIYAANVANLFSGE | YAANVANLF |
| | | QMHMLSNKSASQNVR | MLSNKSASQ |
| | | GVNSPVNVTTTVDAN | VNVTTTVDA |
| | | GGVNSPVNVTTTVDA | VNSPVNVTT |
| | | NSPVNVTTTVDANTS | VNVTTTVDA |
| | | VNSPVNVTTTVDANT | VNVTTTVDA |
| | HLA-DRB1*0404 | ANVANLFSGEGSQAA | VANLFSGEG |
| | | AANVANLFSGEGSQA | VANLFSGEG |
| | | YAANVANLFSGEGSQ | VANLFSGEG |
| | | NIYAANVANLFSGEG | YAANVANLF |
| | | IYAANVANLFSGEG | VANLFSGEG |
| | | YNQMHMLSNKSASQN | MLSNKSASQ |
| | | QYNQMHMLSNKSASQ | QMHMLSNKS |

Fig. 34 continued

| | | | |
|---|---|---|---|
| | | NVANLFSGEGSQAAQ | VANLFSGEG |
| | | VANLFSGEGSQAAQT | VANLFSGEG |
| | | EKAIRMISDQRANLG | AIRMISDQR |
| | | NQMHMLSNKSASQNV | MLSNKSASQ |
| | | KAIRMISDQRANLGA | ISDQRANLG |
| | | QMHMLSNKSASQNVR | MLSNKSASQ |
| | | AIRMISDQRANLGAF | ISDQRANLG |
| | | VNVTTTVDANTSLAK | TVDANTSLA |
| | | PVNVTTTVDANTSLA | VNVTTVDA |
| | | IRMISDQRANLGAFQ | ISDQRANLG |
| | | AQYNQMHMLSNKSAS | QMHMLSNKS |
| | | QAQYNQMHMLSNKSA | QMHMLSNKS |
| | | DQAQYNQMHMLSNKS | YNQMHMLSN |
| | | RMISDQRANLGAFQY | ISDQRANLG |
| | HLA-DRB1*0405 | RLCMQPAKTNTPAS | LCMQPAKTN |
| | | LCMQPAKTNTPASLS | PAKTNTPAS |
| | | GGVNSPVNVTTTVDA | PVNVTTVD |
| | | GVNSPVNVTTTVDAN | VNVTTVDA |
| | | VNSPVNVTTTVDANT | VNVTTVDA |
| | | RLCMQPAKTNTPASL | PAKTNTPAS |
| | | NSPVNVTTTVDANTS | VNVTTVDA |
| | HLA-DRB1*0701 | TKTDEVVASTTNSIL | VVASTTNSI |
| | | KTDEVVASTTNSILT | VVASTTNSI |
| | | TDEVVASTTNSILTQ | VVASTTNSI |
| | | DEVVASTTNSILTQS | VVASTTNSI |
| | | ATKIDEVVASTTNSI | IDEVVASTT |
| | | EVVASTTNSILTQSA | VASTTNSIL |
| | | HHNTSAINASRNNSI | ISAINASRN |
| | | HNTSAINASRNNSIN | INASRNNSI |
| | | TSAINASRNNSINAA | INASRNNSI |
| | | NTSAINASRNNSINA | INASRNNSI |
| | | SAINASRNNSINAAN | INASRNNSI |
| | | VVASTTNSILTQSAM | VVASTTNSI |
| | | GGVNSPVNVTTTVDA | PVNVTTVD |
| | | GVNSPVNVTTTVDAN | VNVTTVDA |
| | | HHHNTSAINASRN | INHNTSAI |
| | HLA-DRB1*0802 | None | |
| | HLA-DRB1*0901 | LAVNLYAANVANLFS | VNLYAANVA |
| | | ALAVNLYAANVANLF | VNLYAANVA |
| | | TTNSILTQSAMAKIA | LTQSAMAKI |
| | | TNSILTQSAMAKIAQ | LTQSAMAKI |
| | | NSILTQSAMAKIAQA | LTQSAMAKI |
| | | SILTQSAMAKIAQAN | LTQSAMAKI |
| | | STTNSILTQSAMAKI | ILTQSAMAK |
| | | ELAVNLYAANVANL | VNLYAANVA |
| | | AVNLYAANVANLFSG | LYAANVANL |
| | | VNLYAANVANLFSGE | LYAANVANL |
| | HLA-DRB1*1101 | None | |
| | HLA-DRB1*1302 | NTSLAKIENAIRMIS | AKIENAIRM |
| | | TSLAKIENAIRMISD | IENAIRMIS |
| | | SLAKIENAIRMISDQ | IENAIRMIS |
| | | RMKELAVQSGNGTYS | LAVQSGNGT |

Fig. 34 continued

| | | | |
|---|---|---|---|
| | | ATAVNTYAANVANLF | VNTYAANVA |
| | | TAVNTYAANVANLFS | VNTYAANVA |
| | | RKELAVQSGNGTYSD | LAVQSGNGT |
| | | KELAVQSGNGTYSDA | LAVQSGNGT |
| | | LVRMKELAVQSGNGT | MKELAVQSG |
| | | VRMKELAVQSGNGTY | LAVQSGNGT |
| | | AVNTYAANVANLFSQ | YAANVANLF |
| | | VNTYAANVANLFSQE | YAANVANLF |
| | | SQQVNSPVNVTTTV | QVNSPVNVT |
| | | QQVNSPVNVTTTVD | QVNSPVNVT |
| | | QVNSPVNVTTTVDA | QVNSPVNVT |
| | | EATAVNTYAANVANL | VNTYAANVA |
| | | FSQQVNSPVNVTTT | QVNSPVNVT |
| | | APSQQVNSPVNVTT | QVNSPVNVT |
| | | QDEATAVNTYAANVA | TAVNTYAAN |
| | | DEATAVNTYAANVAN | VNTYAANVA |
| | | QVNSPVNVTTTVDAN | QVNSPVNVT |
| | | ELAVQSGNGTYSDAE | LAVQSGNGT |
| | | LAVQSGNGTYSDAER | LAVQSGNGT |
| | | NTYAANVANLFSQFG | YAANVANLF |
| | | SKATNETQTTFQXLT | TNETQTTFQ |
| | HLA-DRB1*1501 | ERVLVRMKELAVQSG | LVRMKELAV |
| | | KVLVRMKELAVQSGN | LVRMKELAV |
| | | VEKVLVRMKELAVQS | LVRMKELAV |
| | | EVEKVLVRMKELAVQ | LVRMKELAV |
| | | VLVRMKELAVQSGNG | VRMKELAVQ |
| | | LVRMKELAVQSGNGT | VRMKELAVQ |
| | | INAQIRGLSQASRNT | IRGLSQASR |
| | | GKINAQIRGLSQASR | QIRGLSQAS |
| | | NAQIRGLSQASRNTS | IRGLSQASR |
| | | KINAQIRGLSQASRN | IRGLSQASR |
| | | AQIRGLSQASRNTSK | IRGLSQASR |
| | | NEVEKVLVRMKELAV | VLVRMKELA |
| | | KIENAIRMISDQRAN | AIRMISDQR |
| | | IENAIRMISDQRANL | AIRMISDQR |
| | | AKIENAIRMISDQRA | AIRMISDQR |
| | | ENAIRMISDQRANLG | AIRMISDQR |
| | | LAKIENAIRMISDQR | LAKIENAIR |
| | | QYNQMHMLSNKSASQ | MHMLSNKSA |
| | | QIRGLSQASRNTSKA | IRGLSQASR |
| | | YNQMHMLSNKSASQN | MHMLSNKSA |
| | | IRGLSQASRNTSKAI | IRGLSQASR |
| | | AQYNQMHMLSNKSAS | MHMLSNKSA |
| | | VRMKELAVQSGNGTY | VRMKELAVQ |
| | | QAQYNQMHMLSNKSA | QMHMLSNKS |
| | | ATRMTSDQRANLQAF | ATRMTSDQR |
| | | KQMHMLSNKSASQNV | MHMLSNKSA |
| | | QASRTLRVEVQANQD | LRVEVQANQ |
| | | NAIRMISDQRANLQA | AIRMISDQR |
| | | SQASRTLRVEVQANQ | QASRTLRVH |
| | HLA-DRB3*0101 | None | |
| | HLA-DRB4*0101 | EVEKVLVRMKELAVQ | VEKVLVRMK |
| | | VEKVLVRMKELAVQS | VRMKELAVQ |
| | | EKVLVRMKELAVQSG | VRMKELAVQ |
| | | KVLVRMKELAVQSGN | VRMKELAVQ |

Fig. 34 continued

| | | | |
|---|---|---|---|
| | | VLVRMKELAVQSGNG | VRMKELAVQ |
| | | ENAIRMISDQRANLG | IRMISDQRA |
| | | NAIRMISDQRANLGA | IRMISDQRA |
| | | VRMKELAVQSGNGTY | VRMKELAVQ |
| | | LVRMKELAVQSGNGT | VRMKELAVQ |
| | | AIRMISDQRANLGAF | ISDQRANLG |
| | | IRMISDQRANLGAFQ | ISDQRANLG |
| | HLA-DRB5*0101 | NTSLAKIENAIRMIS | AKIENAIRM |
| | | TSLAKIENAIRMISD | AKIENAIRM |
| | | DANTSLAKIENAIRM | LAKIENAIR |
| | | ANTSLAKIENAIRMI | AKIENAIRM |
| | | SLAKIENAIRMISDQ | AKIENAIRM |
| 1L8W\|A Chain A, Crystal Structure Of Lyme Disease Variable Surface Antigen VlsE1 Of Borrelia Burgdorferi<br><br>SEQ ID NO:17,<br>SEQ ID NO:132941-133116 | HLA-DRB1*0101 | DVFTSFGGLVAEAFG | FGGLVAEAF |
| | | SDVKTYFTTVAAKLE | YFTTVAAKL |
| | | LDVFTSFGGLVAEAF | FTSFGGLVA |
| | | VKTYFTTVAAKLEKT | YFTTVAAKL |
| | | KTYFTTVAAKLEKTK | FTTVAAKLE |
| | | KSDVKTYFTTVAAKL | VKTYFTTVA |
| | | DVKTYFTTVAAKLEK | YFTTVAAKL |
| | | FTSFGGLVAEAFGFK | FGGLVAEAF |
| | | VKAVKTAEGASSGTA | VKTAEGASS |
| | | VFTSFGGLVAEAFGF | FGGLVAEAF |
| | | KAVKTAEGASSGTAA | VKTAEGASS |
| | | KLVKAVKTAEGASSG | VKTAEGASS |
| | | DKLVKAVKTAEGASS | VKAVKTAEG |
| | | LVKAVKTAEGASSGT | VKTAEGASS |
| | | TYFTTVAAKLEKTKT | FTTVAAKLE |
| | | TSFGGLVAEAFGFKS | FGGLVAEAF |
| | | KKSDVKTYFTTVAAK | VKTYFTTVA |
| | | AAKVADKASVKGIAK | VADKASVKG |
| | | ADAAKVADKASVKGI | VADKASVKG |
| | | PKKSDVKTYFTTVAA | VKTYFTTVA |
| | | DADAAKVADKASVKG | AAKVADKAS |
| | | DAAKVADKASVKGIA | VADKASVKG |
| | | AKVADKASVKGIAKG | VADKASVKG |
| | | DPKKSDVKTYFTTVA | KSDVKTYFT |
| | | AVKTAEGASSGTAAI | VKTAEGASS |
| | | VKTAEGASSGTAAIG | VKTAEGASS |
| | | YFTTVAAKLEKTKTD | FTTVAAKLE |
| | | GEVVADADAAKVADK | VADADAAKV |
| | | EVVADADAAKVADKA | VADADAAKV |
| | | IGEVVADADAAKVAD | VADADAAKV |
| | | AIGEVVADADAAKVA | VADADAAKV |
| | | AAIGEVVADADAAKV | VVADADAAK |
| | | LLDKLVKAVKTAEGA | VKAVKTAEG |
| | | ELLDKLVKAVKTAEG | DKLVKAVKT |
| | | LDKLVKAVKTAEGAS | VKAVKTAEG |
| | | FTTVAAKLEKTKTDL | FTTVAAKLE |
| | | SFGGLVAEAFGFKSD | FGGLVAEAF |
| | | FGGLVAEAFGFKSDP | FGGLVAEAF |
| | | PTNKFYQSVIQLGNG | FYQSVIQLG |
| | | NKFYQSVIQLGNGFL | FYQSVIQLG |
| | | DPTNKFYQSVIQLGN | FYQSVIQLG |
| | | TNKFYQSVIQLGNGF | FYQSVIQLG |
| | | NGELDVFTSFGGLVA | FLDVFTSFG |

Fig. 34 continued

| | | | |
|---|---|---|---|
| | | KVADKASVKG IAKGT | VADKASVKG |
| | | VADKASVKGIAKGTK | VADKASVKG |
| | | DPTNKFYQSVIQLG | NKFYQSVIQ |
| | | GFLDVFTSFGGLVAE | FTSFGGLVA |
| | | FLDVFTSFGGLVAEA | FTSFGGLVA |
| | | VVADADAAKVADKAS | VADADAAKV |
| | | VADADAAKVADKASV | VADADAAKV |
| | | VSELLDKLVKAVKTA | LDKLVKAV |
| | | SELLDKLVKAVKTAE | LDKLVKAV |
| | | EVSELLDKLVKAVKT | LDKLVKAV |
| | | KTDLNSLPKEKSDTS | LNSLPKEKS |
| | | TDLNSLPKEKSDTSS | LNSLPKEKS |
| | HLA-DRB1*0301 | None | |
| | HLA-DRB1*0401 | None | |
| | HLA-DRB1*0404 | NGFLDVFTSFGGLVA | FLDVFTSFG |
| | | QLGNGFLDVFTSFGG | FLDVFTSFG |
| | | GNGFLDVFTSFGGLV | FLDVFTSFG |
| | | IQLGNGFLDVFTSFG | QLGNGFLDV |
| | | LGNGFLDVFTSFGGL | FLDVFTSFG |
| | | GFLDVFTSFGGLVAE | FLDVFTSFG |
| | | FLDVFTSFGGLVAEA | FLDVFTSFG |
| | HLA-DRB1*0405 | VAEAFGFKSDPKKSD | AFGFKSDPK |
| | | AEAFGFKSDPKKSDV | FKSDPKKSD |
| | | EAFGFKSDPKKSDVK | FKSDPKKSD |
| | | AFGFKSDPKKSDVKT | FKSDPKKSD |
| | | FGFKSDPKKSDVKTY | FKSDPKKSD |
| | | DPTNKFYQSVIQLGN | NKFYQSVI |
| | | PTNKFYQSVIQLGNG | YQSVIQLGN |
| | | KFYQSVIQLGNGFLD | YQSVIQLGN |
| | | TNKFYQSVIQLGNGF | YQSVIQLGN |
| | | SDVKTYFTTVAAKLE | VKTYFTTVA |
| | HLA-DRB1*0701 | KSDVKTYFTTVAAKL | DVKTYFTTV |
| | | SDVKTYFTTVAAKLE | YFTTVAAKL |
| | | DVKTYFTTVAAKLEK | YFTTVAAKL |
| | | VKTYFTTVAAKLEKT | YFTTVAAKL |
| | | KTYFTTVAAKLEKTK | YFTTVAAKL |
| | HLA-DRB1*0802 | None | |
| | HLA-DRB1*0901 | VKTYFTTVAAKLEKT | YFTTVAAKL |
| | | SDVKTYFTTVAAKLE | YFTTVAAKL |
| | | DVKTYFTTVAAKLEK | YFTTVAAKL |
| | | KTYFTTVAAKLEKTK | YFTTVAAKL |
| | | NKFYQSVIQLGNGFL | FYQSVIQLG |
| | | PTNKFYQSVIQLGNG | FYQSVIQLG |
| | | DPTNKFYQSVIQLGN | FYQSVIQLG |
| | | DDPTNKFYQSVIQLG | NKFYQSVIQ |
| | HLA-DRB1*1101 | None | |
| | HLA-DRB1*1302 | None | |
| | HLA-DRB1*1501 | GLVAEAFGFKSDPKK | AFGFKSDPK |
| | | LVAEAFGFKSDPKKS | AFGFKSDPK |
| | | VAEAFGFKSDPKKSD | AFGFKSDPK |
| | HLA-DRB3*0101 | None | |
| | HLA-DRB4*0101 | None | |
| | HLA-DRB5*0101 | None | |
| CAA57807.1 Associated protein A | HLA-DRB1*0101 | TFLFLFVVSLSANTE | FVVSLSANT |
| | | FLFLFVVSLSANTEE | VVSLSANTE |

Fig. 34 continued

| | | | |
|---|---|---|---|
| Associated protein A (BapA)[Borrelia burgdorferi]<br><br>SEQ ID NO:18,<br>SEQ ID NO:133117-133398 | | LFLFVVSLSANIEEN<br>FLFVVSLSANIEENY<br>LIFLFLFVVSLSANI<br>EAIEYLIKIKISTDS<br>AIEYLIKIKISTDSI<br>IEYLIKIKISTDSIF<br>EYLIKIKISTDSIFL<br>YLIKIKISTDSIFLS<br>LFVVSLSANIEENYT<br>LLIFLFLFVVSLSAN<br>SLLIFLFLFVVSLSA<br>NTVKQILKQILADLP<br>VKQILKQILADLPKD<br>TVKQILKQILADLPK<br>ISLLIFLFLFVVSLS<br>KISLLIFLFLFVVSL<br>LIKIKISTDSIFLSE<br>IKIKISTDSIFLSED<br>EDMIRLIGSYPDSIF<br>FVVSLSANIEENYTE<br>FLSEDMIRLIGSYPD<br>SEDMIRLIGSYPDSI<br>DMIRLIGSYPDSIFN<br>DSIFLSEDMIRLIGS<br>KSHVFSDAPRIRGDL<br>EKSHVFSDAPRIRGD<br>YEKSHVFSDAPRIRG<br>SIFLSEDMIRLIGSY<br>SHVFSDAPRIRGDLP<br>DSIFNYLIQLNSDKI | FVVSLSANI<br>FVVSLSANI<br>FLFVVSLSA<br>IEYLIKIKI<br>IKIKISTDS<br>IKIKISTDS<br>IKIKISTDS<br>IKIKISTDS<br>VVSLSANIE<br>FLFVVSLSA<br>FLFLFVVSL<br>VKQILKQIL<br>LKQILADLP<br>LKQILADLP<br>FLFLFVVSL<br>LIFLFLFVV<br>IKIKISTDS<br>IKIKISTDS<br>IRLIGSYPD<br>FVVSLSANI<br>FLSEDMIRL<br>IRLIGSYPD<br>IRLIGSYPD<br>FLSEDMIRL<br>VFSDAPRIR<br>VFSDAPRIR<br>VFSDAPRIR<br>FLSEDMIRL<br>VFSDAPRIR<br>IFNYLIQLN |
| | HLA-DRB1*0301 | None | |
| | HLA-DRB1*0401 | LLIFLFLFVVSLSAN<br>SLLIFLFLFVVSLSA<br>LIFLFLFVVSLSANI<br>IFLFLFVVSLSANIE<br>FLFLFVVSLSANIEE<br>LFLFVVSLSANIEEN<br>FLFVVSLSANIEENY<br>DNARNNFKKDYSEDK<br>NNFKKDYSEDKANTV<br>NARNNFKKDYSEDKA<br>RNNFKKDYSEDKANT<br>ARNNFKKDYSEDKAN<br>EAIEYLIKIKISTDS<br>AIEYLIKIKISTDSI<br>IEYLIKIKISTDSIF<br>YLIKIKISTDSIFLS<br>EYLIKIKISTDSIFL | FLFVVSLSA<br>LFLFVVSLS<br>FLFVVSLSA<br>FLFVVSLSA<br>FLFVVSLSA<br>FLFVVSLSA<br>FLFVVSLSA<br>RNNFKKDYS<br>FKKDYSEDK<br>FKKDYSEDK<br>FKKDYSEDK<br>FKKDYSEDK<br>YLIKIKIST<br>IKIKISTDS<br>IKIKISTDS<br>IKIKISTDS<br>IKIKISTDS |
| | HLA-DRB1*0404 | LIFLFLFVVSLSANI<br>IFLFLFVVSLSANIE<br>FLFLFVVSLSANIEE<br>LLIFLFLFVVSLSAN<br>SLLIFLFLFVVSLSA<br>LFLFVVSLSANIEEN<br>ISLLIFLFLFVVSLS<br>FLFVVSLSANIEENY | FLFVVSLSA<br>FVVSLSANI<br>FVVSLSANI<br>LFLFVVSLS<br>LFLFVVSLS<br>FVVSLSANI<br>LLIFLFLFV<br>FVVSLSANI |

Fig. 34 continued

| | | | |
|---|---|---|---|
| | HLA-DRB1*0405 | FLSEDMIRLIGSYPD<br>LSEDMIRLTGSYPDS<br>EDMIRLIGSYPDSIF<br>SEDMIRLTGSYPDST<br>DMIRLIGSYPDSIFN<br>MIRLTGSYPDSIFNY<br>IRLTGSYPDSIFNYL<br>FLPLFVVSLSANIEE | EDMIRLIGS<br>IRLTGSYPD<br>IRLIGSYPD<br>IRLTGSYPD<br>IRLIGSYP<br>IRLTGSYPD<br>IRLTGSYPD<br>VVSLSANIE | |
| | HLA-DRB1*0701 | None | | |
| | HLA-DRB1*0802 | None | | |
| | HLA-DRB1*0901 | LFLFLFVVSLSANIE<br>LFLFLFVVSLSANI<br>FLFVVSLSANIEE<br>LFLFVVSLSANIEEN<br>FLFVVSLSANIEENY<br>LFVVSLSANIEENYT | FVVSLSANI<br>LFVVSLSAN<br>FVVSLSANI<br>FVVSLSANI<br>FVVSLSANI<br>FVVSLSANI | |
| | HLA-DRB1*1101 | None | | |
| | HLA-DRB1*1302 | IEYLIKIKISTDSIF<br>ATEYLIKIKISTDS<br>ATEYLIKIKISTDST<br>YLIKIKISTDSIFLS<br>EYLIKIKISTDSIFL<br>LFLFLFVVSLSANIE<br>LEAIEYLIKIKISTD<br>ALEATEYLIKIKIST<br>FLFLFVVSLSANIEE<br>LIKIKISTDSIFLSE<br>LFLFVVSLSANIEEN<br>FLSEDMIRLIGSYPD<br>EDMIRLIGSYPDSIF<br>IKIKISTDSIFLSED<br>LSEDMIRLIGSYPDS<br>SEDMIRLIGSYPDSI<br>KEDFNLINKRLDNYD<br>IFNYLIQLNSDKIDY<br>SIFNYLIQLNSDKID<br>SKEDFNLINKRLDNY<br>EDFNLINKRLDNYDF<br>DLRKIGIKEKSVFLE<br>LIFLFLFVVSLSANI<br>DSIFNYLIQLNSDKI<br>RKIGIKEKSVFLDAL<br>LLIFLFLFVVSLSAN<br>IRKIGIKEKSVFLDA<br>ISLLIFLFLFVVSLG<br>GDLRKIGIKEKSVFL<br>RGDLRKIGIKEKSVF<br>FNYLIQLNSDKIDYA<br>SLLIFLFLFVVSLGA<br>EKYQDNARNNFKKY<br>DMIRLTGSYPDSIFN<br>NYLIQLNSDKIDYAE<br>NTVKQILKQILADLP<br>YAEKYQDNARNNFKK<br>AEKYQDNARNNFKKD<br>FSKEDFNLINKRLDN | YLIKIKIST<br>YLIKIKIST<br>IKIKISTDS<br>IKIKISTDS<br>IKIKISTDS<br>LFLFVVSLS<br>YLIKIKIST<br>IEYLIKIKI<br>LFLFVVSLS<br>IKISTDSIF<br>LFLFVVSLS<br>MIRLIGSYP<br>MIRLIGSYP<br>IKISTDSIF<br>MIRLIGSYP<br>MIRLIGSYP<br>FNLINKRLD<br>LIQLNSDKI<br>LIQLNSDKI<br>FNLINKRLD<br>FNLINKRLD<br>IGIKEKSVF<br>LFLFVVSLS<br>IFNYLIQLN<br>IGIKEKSVF<br>LFLFVVSLS<br>IGIKEKSVF<br>ISLLIFLFL<br>IGIKEKSVF<br>IRKIGIKEK<br>IIQLNSDKI<br>LFLFVVSLS<br>YQDNARNNF<br>IRLTGSYPD<br>LIQLNSDKI<br>VKQILKQIL<br>YQDNARNNF<br>YQDNARNNF<br>FNLINKRLD | |

Fig. 34 continued

| | | | |
|---|---|---|---|
| | | AFSKEDFNLINKRLD | DFNLINKRL |
| | | DALEAIEYLIKIKIS | IEYLIKIKI |
| | | DFNLINKRLDNYDFK | FNLINKRLD |
| | | DYAEKYGDNARNNF | YGDNARNNF |
| | | IDYAEKYGDNARNN | KYGDNARNN |
| | HLA-DRB1*1501 | ISLLIFLFLVVSLS | LIFLFLFVV |
| | | KISLLIFLFLFVVSL | LIFLFLFVV |
| | | KKISLLIFLFLFVVS | LIFLFLFVV |
| | | SLLIFLFLVVSLSA | LIFLFLFVV |
| | | MKKISLLIFLFLFVV | LLIFLFLFV |
| | | LLIFLFLFVVSLSAN | LIFLFLFVV |
| | | LIFLFLFVVSLSANI | LIFLFLFVV |
| | | IFLFLFVVSLSANIE | FLFVVSLSA |
| | | FLFLFVVSLSANIEE | FLFVVSLSA |
| | | SKEDFNLINKRLDNY | DFNLINKRL |
| | | KEDFNLINKRLDNYD | LINKRLDNY |
| | | EDFNLINKRLDNYDF | LINKRLDNY |
| | | DFNLINKRLDNYDFK | LINKRLDNY |
| | | SEDMIRLIGSYPDSI | IRLIGSYPD |
| | | EDMIRLIGSYPDSIF | IRLIGSYPD |
| | | FNLINKRLDNYDFKN | LINKRLDNY |
| | | LFLFVVSLSANIEEN | FVVSLSANI |
| | HLA-DRB3*0101 | None | |
| | HLA-DRB4*0101 | IRLIGSYPDSIFNYL | LIGSYPDSI |
| | HLA-DRB5*0101 | FNYLIQLNSDKIDYA | YLIQLNSDK |
| | | DSIFNYLIQLNSDKI | YLIQLNSDK |
| | | IFNYLIQLNSDKIDY | YLIQLNSDK |
| | | SIFNYLIQLNSDKID | YLIQLNSDK |
| | | PDSIFNYLIQLNSDK | IFNYLIQLN |
| | | DNYDFKNEYEKSHV | FKNEYEKSH |
| | | RLDNYDFKNEYEKSH | YDFKNEYEK |
| | | LDNYDFKNEYEKSHV | FKNEYEKSH |
| AAL25643.1, P37-47 [Borrelia burgdorferi] SEQ ID NO:19, SEQ ID NO:133399-133708 | HLA-DRB1*0101 | SSFLTQGTSPSITST | LTQGTSPSI |
| | | ISSFLTQGTSPSITS | LTQGTSPSI |
| | | RPISSFLTQGTSPSI | FLTQGTSPS |
| | | PISSFLTQGTSPSIT | LTQGTSPSI |
| | | SFLTQGTSPSITSTI | LTQGTSPSI |
| | | PRPISSFLTQGTSPS | ISSFLTQGT |
| | | FLTQGTSPSITSTIK | LTQGTSPSI |
| | | NFFTNLEEVRSSIRT | FTNLEEVRS |
| | | PEITEEVIMPIPQTI | EVIMPIPQT |
| | | EITEEVIMPIPQTID | VIMPIPQTI |
| | | ITEEVIMPIPQTIDF | VIMPIPQTI |
| | | TEEVIMPIPQTIDFY | VIMPIPQTI |
| | | SNFFTNLEEVRSSIR | FTNLEEVRS |
| | | DSNFFTNLEEVRSSI | FTNLEEVRS |
| | | GDSNFFTNLEEVRSS | FTNLEEVRS |
| | | GGDSNFFTNLEEVRS | GGDSNFFTN |
| | | EEVIMPIPQTIDFYI | VIMPIPQTI |
| | | IDFYIEPRPISSFLT | YIEPRPISS |
| | | LTQGTSPSITSTIKS | LTQGTSPSI |
| | | DFYIEPRPISSFLTQ | YIEPRPISS |
| | | YIEPRPISSFLTQGT | PRPISSFLT |
| | | IEPRPISSFLTQGTS | ISSFLTQGT |
| | | FYIEPRPISSFLTQG | YIEPRPISS |

Fig. 34 continued

| | | | |
|---|---|---|---|
| | | FTNLEEVRSSIRTKI | FTNLEEVRS |
| | | FPRPTSSFLTQGTSP | TSSFLTQGT |
| | | FTTDLEEVRSSIRTK | FTNLEEVRS |
| | | RVIMPTPQTTDFYTE | VIMPTPQTT |
| | | TIDFYIEPRPTSSFL | YIEPRPTSS |
| | | TNNGLNTVQKTTQNT | NNGLNTVQ |
| | | QTIDFYTEPRPTSSF | YTEPRPTSS |
| | | NNGLNTVQKTTQNTD | TVQKTTQNT |
| | | LNTVQKTTQNTDNTT | TVQKTTQNT |
| | | NGLNTVQKTTQNTDN | TVQKTTQNT |
| | | GLNTVQKTTQNTDNT | TVQKTTQNT |
| | | PQTTDFYTEPRPTSS | FYTEPRPTS |
| | | VIMPTPQTTDFYTEP | VIMPTPQTT |
| | | KLSQVAQHAPNSKTE | VAQHAPNSK |
| | | FKLSQVAQHAPNSKT | VAQHAPNSK |
| | | LSQVAQHAPNSKTEK | VAQHAPNSK |
| | | HFKLSQVAQHAPNSK | KLSQVAQHA |
| | | SQVAQHAPNSKTEKV | VAQHAPNSK |
| | | VQKFDSLNLSTKSV | FDSLNLSTK |
| | | CKFDSLNLSTKSVDD | SLNLSTKSV |
| | | NCKFDSLNLSTKSVD | SLNLSTKSV |
| | HLA-DRB1*0301 | None | |
| | HLA-DRB1*0401 | FKLKKYLKDTNNLSA | YLKDTNNLS |
| | | KLKKYLKDTNNLSAT | YLKDTNNLS |
| | | LKKYLKDTNNLSATE | YLKDTNNLS |
| | | KKYLKDTNNLSATEE | YLKDTNNLS |
| | | LFKLKKYLKDTNNLS | LFKLKKYLK |
| | | KYLKDTNNLSATEES | YLKDTNNLS |
| | | YLKDTNNLSATEESV | YLKDTNNLS |
| | | PQTTDFYTEPRPTSS | FYTEPRPTS |
| | | QTIDFYTEPRPTSSF | FYTEPRPTS |
| | | TDFYTEPRPTSSFLT | FYTEPRPTS |
| | | TIDFYTEPRPTSSFL | FYTEPRPTS |
| | | TPQTTDFYTEPRPTS | TIDFYTEPR |
| | | LSSFLTQGTSPSITS | FLTQGTSPS |
| | | SSFLTQGTSPSITST | FLTQGTSPS |
| | | RPTSSFLTQGTSPSI | FLTQGTSPS |
| | | PTSSFLTQGTSPSIT | FLTQGTSPS |
| | | PRPTSSFLTQGTSPS | PRPTSSFLT |
| | | DFYIEPRPTSSFLTQ | FYIEPRPTS |
| | HLA-DRB1*0404 | EKLKKYLKDTNNLSA | YLKDTNNLS |
| | | KLKKYLKDTNNLSAI | LKDTNNLSA |
| | | LKKYLKDTNNLSAIE | LKDTNNLSA |
| | | KKYLKDTNNLSAIEE | LKDTNNLSA |
| | | RKITHPIPDHLGSGG | ITHPIPDHL |
| | | KYLKDTNNLSAIEES | LKDTNNLSA |
| | | KITHPIPDHLGSGN | IPDHLGSG |
| | | ITHPIPDHLGSGNN | IPDHLGSG |
| | HLA-DRB1*0405 | KKYLKDTNNLSAIEE | YLKDTNNLS |
| | | FKLKKYLKDTNNLSA | YLKDTNNLS |
| | | LKKYLKDTNNLSAIE | YLKDTNNLS |
| | | KLKKYLKDTNNLSAI | YLKDTNNLS |
| | | NGLNTVQKTTQNTDN | VQKTTQNTD |
| | | NGLNTVQKTTQNTD | TVQKTTQNT |
| | | GLNTVQKTTQNTDNT | VQKTTQNTD |

Fig. 34 continued

|  |  |  |  |
|---|---|---|---|
|  |  | NIVQKIQNIDNITE | VQKIQNID |
|  |  | LNTVQKTTQNIDNIT | VQKTTQNID |
|  |  | LEKLKKYLKDNNLS | LKKYLKDTN |
|  |  | RITEEVIMPTPQTID | RVIMPTPQT |
|  |  | ITEEVIMPTPQTIDF | IMPTPQTID |
|  |  | TEEVIMPTPQTIDFY | IMPTPQTID |
|  |  | EEVIMPTPQTIDFYT | IMPTPQTID |
|  |  | EVIMPTPQTIDFYTE | IMPTPQTID |
|  |  | QQDSNFFTNLEEVRS | SNFFTNLEE |
|  |  | LETQQDSNFFTNLEE | DSNFFTNLE |
|  |  | TQQDSNFFTNLEEVR | SNFFTNLEE |
|  |  | KYLKDNNLSATEES | YLKDNNLS |
|  |  | ETQQDSNFFTNLEEV | SNFFTNLEE |
|  |  | TVQKTTQNIDNITEK | VQKTTQNID |
|  |  | YLKDNNLSATESV | YLKDNNLS |
|  |  | VQKTTQNIDNITENL | VQKTTQNID |
|  |  | QDSNFFTNLEEVRSS | SNFFTNLEE |
|  |  | IDFYTEPRPTSSFLT | FYTEPRPTS |
|  |  | PQTIDFYTEPRPTSS | FYTEPRPTS |
|  |  | RPTSSFLTQGTSPST | FLTQGTSPS |
|  |  | PRPTSSFLTQGTSPS | TSSFLTQGT |
|  |  | QTIDFYTEPRPTSSF | SYTEPRPTS |
|  |  | TIDFYTEPRPTSSFL | FYTEPRPTS |
|  |  | TSSFLTQGTSPSITS | FLTQGTSPS |
| HLA-DRB1*0701 |  | TNLEEVRSSIRTKLE | LEEVRSSIR |
|  |  | FTNLEEVRSSIRTKL | LEEVRSSIR |
|  |  | SFLTQGTSPSITGTL | LTQGTSPSI |
| HLA-DRB1*0802 |  | None |  |
| HLA-DRB1*0901 |  | KDTYNSYIPFVKEFT | TYNSYIPFV |
|  |  | SSNKDTYNSYIPFVK | TYNSYIPFV |
|  |  | SNKDTYNSYIPFVKE | TYNSYIPFV |
|  |  | NKDTYNSYIPFVKEF | TYNSYIPFV |
| HLA-DRB1*1101 |  | None |  |
| HLA-DRB1*1302 |  | EKTNNGLNTVQKTTQ | KTNNGLNTV |
|  |  | LNTVQKTTQNIDNIT | LNTVQKTTQ |
|  |  | KTNNGLNTVQKTTQN | LNTVQKTTQ |
|  |  | NNGLNTVQKTTQNI | LNTVQKTTQ |
|  |  | NNGLNTVQKTTQNID | LNTVQKTTQ |
|  |  | NGLNTVQKTTQNIDN | LNTVQKTTQ |
|  |  | AKEKTNNGLNTVQKT | KTNNGLNTV |
|  |  | KEKTNNGLNTVQKTT | KTNNGLNTV |
|  |  | ELAKEKTNNGLNTVQ | KTNNGLNTV |
|  |  | LAKEKTNNGLNTVQK | KTNNGLNTV |
|  |  | GLNTVQKTTQNIDNI | LNTVQKTTQ |
|  |  | NTVQKTTQNIDNITE | TTQNIDNIT |
|  |  | KELAKEKTNNGLNTV | EKTNNGLNT |
|  |  | NQAFLILNLVNQKFD | LILNLVNQK |
|  |  | TVQKTTQNIDNITEN | TTQNIDNIT |
|  |  | QAFLILNLVNQKFDS | LILNLVNQK |
|  |  | VQKTTQNIDNITENL | TTQNIDNIT |
|  |  | AFLILNLVNQKFDSL | LILNLVNQK |
|  |  | QKTTQNIDNITENLN | TTQNIDNIT |
|  |  | NSIAKLLQHLSKSED | LAKLLQHLS |
|  |  | NQKFDSLNLSTKSVD | SLNLSTKSV |
|  |  | QKFDSLNLSTKSVDI | LNLSTKSVD |
|  |  | RPTSSFLTQGTSPSI | SLTQGTSPS |

Fig. 34 continued

| | | | |
|---|---|---|---|
| | | KFDSLNLSTKSVDDK | LNLSTKSVD |
| | | FLLLNLVNCKFDSLN | LLLNLVNCK |
| | | PISSFLTQGTSPSIT | FLTQGTSPS |
| | | ISSFLTQGTSPSITS | FLTQGTSPS |
| | | PRPISSFLTQGTSPS | ISSFLTQGT |
| | | FDSLNLSTKSVDDKN | LNLSTKSVD |
| | | FTNLEEVRSSIRTKI | LEEVRSSIR |
| | | SSFLTQGTSPSITST | FLTQGTSPS |
| | | SIAKLLQHLSKSEDQ | LQHLSKSED |
| | | IAKLLQHLSKSEDQA | LQHLSKSED |
| | | KITQNIDNITENLNS | ITQNIDNIT |
| | | ITQNIDNITENLNSK | ITQNIDNIT |
| | | DDKNNSIAKLLQHLS | DKNNSIAKL |
| | | TNLEEVRSSIRTKIK | VRSSIRTKI |
| | HLA-DRB1*1501 | FTNLEEVRSSIRTKI | LEEVRSSIR |
| | | TNLEEVRSSIRTKIK | LEEVRSSIR |
| | | FFTNLEEVRSSIRTK | LEEVRSSIR |
| | HLA-DRB3*0101 | None | |
| | HLA-DRB4*0101 | EKLSQVAQHAPNSKI | VAQHAPNSK |
| | | SEKLSQVAQHAPNSK | EKLSQVAQH |
| | | KLSQVAQHAPNSKIE | VAQHAPNSK |
| | | LSQVAQHAPNSKIEK | VAQHAPNSK |
| | | SQVAQHAPNSKIEKV | VAQHAPNSK |
| | | QVAQHAPNSKIEKVK | VAQHAPNSK |
| | | VAQHAPNSKIEKVKS | VAQHAPNSK |
| | HLA-DRB5*0101 | None | |
| NP_212481.1\| fibronectin/fibrinogen-binding protein, putative [Borrelia burgdorferi B31] SEQ ID NO:20, SEQ ID NO:133709-134764 | HLA-DRB1*0101 | LDKFNLIQSKITMLK | FNLIQSKIT |
| | | DKFNLIQSKITMLKV | FNLIQSKIT |
| | | LCVFYTKLAKKSGKA | FYTKLAKKS |
| | | CVFYTKLAKKSGKAD | FYTKLAKKS |
| | | NSNFKILDAYYRRPK | FKILDAYYR |
| | | SNFKILDAYYRRPKI | FKILDAYYR |
| | | GNLCVFYTKLAKKSG | FYTKLAKKS |
| | | NLCVFYTKLAKKSGK | FYTKLAKKS |
| | | TNSNFKILDAYYRRP | FKILDAYYR |
| | | IATNSNFKILDAYYR | NSNFKILDA |
| | | ATNSNFKILDAYYRR | FKILDAYYR |
| | | KFNLIQSKITMLKVE | IQSKITMLK |
| | | FNLIQSKITMLKVEN | IQSKITMLK |
| | | NLDKFNLIQSKITML | FNLIQSKIT |
| | | AGNLCVFYTKLAKKS | LCVFYTKLA |
| | | NLIQSKITMLKVENL | IQSKITMLK |
| | | DNLDKFNLIQSKITM | FNLIQSKIT |
| | | KDNLDKFNLIQSKIT | LDKFNLIQS |
| | | VFYTKLAKKSGKADL | FYTKLAKKS |
| | | IKEIPFTNSLITKII | FTNSLITKI |
| | | KEIPFTNSLITKIIQ | FTNSLITKI |
| | | LIQSKITMLKVENLI | ITMLKVENL |
| | | LDVLLGAGNLCVFYT | LLGAGNLCV |
| | | DVLLGAGNLCVFYTK | LLGAGNLCV |
| | | ILFIKLNPSSPNIIA | LNPSSPNII |
| | | IQSKITMLKVENLIP | ITMLKVENL |
| | | LIKEIPFTNSLITKI | IPFTNSLIT |
| | | EIPFTNSLITKIIQP | FTNSLITKI |
| | | IPFTNSLITKIIQPD | FTNSLITKI |

Fig. 34 continued

| | | | |
|---|---|---|---|
| | | FYTKLAKKGKADLY | FYTKLAKKG |
| | | NFKTLDAYYRRPKTK | FKTLDAYYR |
| | | FKILDAYYRRPKIKE | FKILDAYYR |
| | | LFTKLWPSSPNTTAT | LWPSSPNTT |
| | | PSLDVLLGAGNLCVF | LLGAGNLCV |
| | | SLDVLLGAGNLCVFY | LLGAGNLCV |
| | | TPSLDVLLGAGNLCV | DVLLGAGNL |
| | | TTKAFQMKNFRTTSL | FQMKNFRTT |
| | | TKAFQMKNFRTTSLF | MKNFRTTSL |
| | | TTLFTKLWPSSPNTT | TKLWPSSPN |
| | | KAFQMKNFRTTSLFT | MKNFRTTSL |
| | | KKNFKKNALKLRFSD | FKKNALKLR |
| | | TKKNFKKNALKLRFS | FKKNALKLR |
| | | FTKLWPSSPNTTATN | LWPSSPNTT |
| | | KNFKKNALKLRFSDF | FKKNALKLR |
| | | AFQMKNFRTTSLFTL | MKNFRTTSL |
| | | FKTLTCLNPNTTRFH | LTCLNPNTT |
| | | KTLTCLNPNTTRFHT | LTCLNPNTT |
| | | TKLWPSSPNTTATKS | LWPSSPNTT |
| | | VKNLRRVKNKKLGLV | LRRVKNKKL |
| | | RKTKTSLNQSLSPKE | TKTSLNQSL |
| | | FQMKNFRTTSLFTLQ | MKNFRTTSL |
| | | LLGAGNLCVFYTKLA | LLGAGNLCV |
| | | EEKTKTSLNQSLSPK | TKTSLNQSL |
| | | KEFKTKTSLNQSLSP | TKTSLNQSL |
| | | KSKIQNGKIIKAFQK | IQNGKIIKA |
| | | SKIQNGKIIKAFQKK | IQNGKIIKA |
| | | ITKKNFKKNALKLRF | FKKNALKLR |
| | | MIKMSLNYIEIEILI | MIKMSLNYI |
| | | ELKSKIQNGKIIKAF | IQNGKIIKA |
| | | LKSKIQNGKIIKAFQ | IQNGKIIKA |
| | | DFLKSKIQNGKIIKA | KSKIQNGKI |
| | | KLLRRVKNKKLGLVI | VKNKKLGLV |
| | | LLTCLNPNTTRFHIT | LNPNTTRFH |
| | | VLLGAGNLCVFYTKL | LLGAGNLCV |
| | | LRRVKNKKLGLVIPK | VKNKKLGLV |
| | | YKEEKTKTSLNQSLS | TKTSLNQSL |
| | | NLRRVKNKKLGLVIP | VKNKKLGLV |
| | | KFKTLTCLNPNTTR | LTCLNPNTT |
| | | KFKTLTCLNPNTTRF | LTCLNPNTT |
| | | NYKFKTKTSLNQSL | KTKTSLNQS |
| | | DLYYTQVKNLRRVKN | YTQVKNLRR |
| | | HTTKKNFKKNALKLR | NFKKNALKL |
| | | LYYTQVKNLRRVKNK | VKNLRRVKN |
| | | RRVKNKKLGLVIPKA | VKNKKLGLV |
| | | LTCLNPNTTRFHTTK | LNPNTTRFH |
| | | KTKTSLNQSLSPKEN | TKTSLNQSL |
| | | QSKITMLKVFNLTPF | TTMLKVFNL |
| | | TKTSLNQSLSPKENA | TKTSLNQSL |
| | | SKITMLKVFNLTPFE | TTMLKVFNL |
| | | MTTLFTKLWPSSPNT | TKLWPSSPN |
| | | KKGKNSFKTTQNQLE | KKGKNSFKT |
| | | PFTNSLTTKTTQPDY | FTNSLTTKT |
| | | NFKKNALKLRFSDFL | FKKNALKLR |
| | | YTQVKNLRRVKNKKL | VKNLRRVKN |
| | | DMTTLFTKLWPSSPN | FTKLWPSSP |
| | | FKKNALKLRFSDFLK | FKKNALKLR |

Fig. 34 continued

| | | | |
|---|---|---|---|
| | | KLWPSSPNIIAINSI | LWPSSPNII |
| | | TQVKNLRRVKNKKLG | VKNLRRVKN |
| | | KIIQPDYKSLVLEIY | IIQPDYKSL |
| | | QPDYKSLVLEIYKI | YKSLVLEIY |
| | | IIQPDYKSLVLEIYN | YKSLVLEIY |
| | | IQPDYKSLVLEIYNK | YKSLVLEIY |
| | | PDYKSLVLEIYNKID | YKSLVLEIY |
| | | FTNSLITKIIQPDYK | FTNSLITKI |
| | | YYTQVKNLRRVKNKK | VKNLRRVKN |
| | | KDMILFIKLPSSP | MILFIKLP |
| | | KNSFKTIQNQLKDNL | FKTIQNQLK |
| | | NSFKTIQNQLKDNLE | FKTIQNQLK |
| | | NTLIKEIPFTNSLIT | IKEIPFTNS |
| | | FTYCGFEILTGRNAE | YCGFEILTG |
| | | KEKTPKIGLHFTYCG | TPKIGLHFT |
| | | HFTYCGFEILTGRNA | YCGFEILTG |
| | | TLIKEIPFTNSLITK | IKEIPFTNS |
| | | QKNSFKTIQNQLKDN | FKTIQNQLK |
| | | EKTPKIGLHFTYCGF | IGLHFTYCG |
| | | KQKNSFKTIQNQLKD | FKTIQNQLK |
| | | TCLNPNTTRFETTFE | LNPNTTRFE |
| | | LWPSSPNIIAINSKF | LWPSSPNII |
| | | EIFLKAKEIHFSNKM | LKAKEIHFS |
| | | IFLKAKEIHFSNKKG | LKAKEIHFS |
| | | ADLYYTQVKNLRRVK | YTQVKNLRR |
| | | MKNERIISLEILQKD | MKNERIISL |
| | | YCGFEILIGRNAKEN | EILIGRNA |
| | | LSAGNLCVFYTRLAK | LCVFYTRLA |
| | | QKKNERIISLEILQK | MKNERIISL |
| | | KADLYYTQVKNLRRV | YTQVKNLRR |
| | | NKKFKILICLNPNTT | FKILICLNP |
| | | RVKNKKLGLVIPKAE | VKNKKLGLV |
| | | TPKIGLHFTYCGFEI | IGLHFTYCG |
| | | KIQNGKIIKAFQKKN | IQNGKIIKA |
| | | GKIIKAFQKKNERII | AFQKKNERI |
| | | KTPKIGLHFTYCGFE | IGLHFTYCG |
| | | VKNKKLGLVIPKAEK | VKNKKLGLV |
| | | IQNGKIIKAFQKKNE | IQNGKIIKA |
| | | TRINIIKEIPFTNS | INILIKEIP |
| | | INILIKEIPFTNSLI | IKEIPFTNS |
| | | EINILIKEIPFTNSL | IKEIPFTNS |
| | | TQEIFLKAKEIHFSN | LKAKEIHFS |
| | | TTQEIFLKAKEIHFS | EIFLKAKEI |
| | | QEIFLKAKEIHFSNK | LKAKEIHFS |
| | | MELKEFYNNTSYTSV | FYNNTSYTS |
| | | KIIKAFQKKNERIIS | FQKKNERII |
| | HLA-DRB1*0301 | None | |
| | HLA-DRB1*0401 | DLYYTQVKNLRRVKN | YYTQVKNLR |
| | | SGKADLYYTQVKNLR | SGKADLYYT |
| | | GKADLYYTQVKNLR | YYTQVKNLR |
| | | KADLYYTQVKNLRRV | YYTQVKNLR |
| | | ADLYYTQVKNLRRVK | YYTQVKNLR |
| | | LYYTQVKNLRRVKN | YYTQVKNLR |
| | | YYTQVKNLRRVKNKK | YYTQVKNLR |
| | | MELKEFYNNTSYTSV | IKEFYNNTS |
| | | MELKEFYNNTSYTS | LKEFYNNTS |
| | | DKKMELKEFYNNTS | MELKEFY |

Fig. 34 continued

| | | | |
|---|---|---|---|
| | | KKIMELKEEYNNTSY | LKEEYNNTS |
| | | KIMELKEEYNNTSYT | LKEEYNNTS |
| | | DMTLFIKLWPSSPN | LFIKLWPSS |
| | | MTTLFTKLWPSSPNT | LFTKLWPSS |
| | | TLFTKLWPSSPNTI | LFIKLWPSS |
| | | TLFTKLWPSSPNTTA | TKLWPSSPN |
| | | FLKEYNNTSYTSYS | LKEEYNNTS |
| | | LKEYNNTSYTSYGF | LKEEYNNTS |
| | | WPSSPNTTATNSNFK | PNTTATNSN |
| | | PSSPNTTATNSNFKI | TTATNSNFK |
| | | LFTKLWPSSPNTTAT | TKLWPSSPN |
| | | SSPNTTATNSNFKIL | TTATNSNFK |
| | | QAYVFTKNQKNKTPS | FTKNQKNKT |
| | | PQAYVFTKNQKNKTP | FTKNQKNKT |
| | | PNTTATNSNFKILDA | TTATNSNFK |
| | | SPNTTATNSNFKILD | TTATNSNFK |
| | | KDMTLFTKLWPSSP | LFTKLWPSS |
| | | YPQAYVFTKNQKNKT | YVFTKNQKN |
| | | YVFTKNQKNKTPSLD | FTKNQKNKT |
| | | AYVFTKNQKNKTPSL | FTKNQKNKT |
| | | LTEKYKELTVLEER | YKELTVLE |
| | HLA-DRB1*0404 | WPSSPNTTATNSNFK | PNTTATNSN |
| | | PSSPNTTATNSNFKI | TTATNSNFK |
| | | FKILICLNPNTTRFH | LICLNPNT |
| | | SSPNTTATNSNFKIL | TTATNSNFK |
| | | KFKILICLNPNTTRF | LICLNPNT |
| | | PNTTATNSNFKILDA | TTATNSNFK |
| | | SPNTTATNSNFKILD | TTATNSNFK |
| | | KKFKILICLNPNTTR | LICLNPNT |
| | | NKKFKILICLNPNTT | LICLNPNT |
| | | MTLFIKLWPSSPN | FIKLWPSSP |
| | | KILICLNPNTTRFHI | LICLNPNT |
| | | TLFIKLWPSSPNTI | KLWPSSPN |
| | | LFIKLWPSSPNTTA | KLWPSSPN |
| | | SNFKILDAYYRPKI | ILDAYYRP |
| | | NSNFKILDAYYRRP | KILDAYYR |
| | | NSNFKILDAYYRPK | ILDAYYRP |
| | | NFKILDAYYRPKTR | ILDAYYRP |
| | | FKILDAYYRPKIKE | ILDAYYRP |
| | | KDMTLFTKLWPSSP | MTLFTKLW |
| | | ILICLNPNTTRFHIT | LICLNPNT |
| | | DNKKFKILICLNPNT | FKILICLNP |
| | | NTTATNSNFKILDAY | TTATNSNFK |
| | | TTATNSNFKILDAYY | TTATNSNFK |
| | | DMTLFTKLWPSSPN | FTKLWPSSP |
| | HLA-DRB1*0405 | DMTLFTKLWPSSPN | FTKLWPSSP |
| | | MTLFTKLWPSSPNT | TKLWPSSPN |
| | | TLFTKLWPSSPNTT | TKLWPSSPN |
| | | LFTKLWPSSPNTTA | TKLWPSSPN |
| | | FTKLWPSSPNTTAT | TKLWPSSPN |
| | | TKLWPSSPNTTATN | TKLWPSSPN |
| | | KLWPSSPNTTATNS | TKLWPSSPN |
| | | DLYYTQVKNLRRVKN | YTQVKNLRR |
| | | LYYTQVKNLRRVKN | YTQVKNLRR |
| | | GKADLYYTQVKNLRR | YYTQVKNLR |
| | | ADLYYTQVKNLRRVK | YTQVKNLRR |

Fig. 34 continued

| | | | |
|---|---|---|---|
| | | KABLYYTQVKNLRRV | YTQVKNLRR |
| | | KKGKNSFKTTQNQLK | KNSFKTTQN |
| | | KGKNSFKTIQNQLKD | KNSFKTIQN |
| | | KDMTLFTKLWPSSP | TLFTKLWPS |
| | | KLWPSSPNTTATNSN | WPSSPNTTA |
| | | VYTQVKNLRRVKNKK | YTQVKNLRR |
| | | QKNSFKTTQNQLKDN | FKTTQNQLK |
| | | KNSFKTTQNQLKDNL | FKTTQNQLK |
| | | DSLKQQTKLLFNTEN | LKQQTKLLF |
| | | TKMSLNYTFTNTLTK | TKMSLNYTF |
| | | SLKQQTKLLFNTENE | TKLLFNTEN |
| | | LKQQTKLLFNTENEK | TKLLFNTEN |
| | | WPSSPNTTATNSNFK | WPSSPNTTA |
| | | KQQTKLLFNTFNEKE | TKLLFNTEN |
| | | KMSLNYTFTNTLTKE | YTFTNTLTK |
| | | MSLNYTFTNTLTKET | YTFTNTLTK |
| | | SLNYTFTNTLTKETP | YTFTNTLTK |
| | | QQTKLLFNTFNEKEK | TKLLFNTEN |
| | | KAYKKGKNSFKTTQN | YKKGKNSFK |
| | | LNYTFTNTLTKFTPP | YTFTNTLTK |
| | | AYKKGKNSFKTTQNQ | KNSFKTTQN |
| | | YTQVKNLRRVKNKKL | YTQVKNLRR |
| | | LQKDMTTLFTKLWPS | TTLFTKLWP |
| | | YKKGKNSFKTIQNQL | KNSFKTIQN |
| | | LSPSSPNTTATNSNF | WPSSPNTTA |
| | | QKDMLLFTKLWPSS | LLFTKLWPS |
| | | NSFKTIQNQLKDNLD | FKTIQNQLK |
| HLA-DRB1*0701 | LLLCLNPTTREHLT | LNPTTRFH |
| | | LLCLNPTTRFHLTK | LNPTTRFH |
| | | KLLCLNPTTRFHL | LNPTTRFH |
| | | LCLNPTTRFHLTKK | LNPTTRFH |
| | | MLKFYNNTSYTSY | FYNNTSYT |
| | | MLKFYNNTSYTSYS | YNNTSYTSY |
| | | KFFYNNTSYTSYSFF | YNNTSYTSY |
| | | LKFYNNTSYTSYSF | YNNTSYTSY |
| | | FEYNNTSYTSYSFFL | YNNTSYTSY |
| | | CLNPNTTRFHLCKKN | NPTTRFHL |
| | | SSPNLIATNSNFKLL | LIATNSNFK |
| | | FKLLCLNPNTTRFH | CLNPNTTRF |
| | | SPLLIATNSNFKLLD | LIATNSNFK |
| | | TKFTPFTNSLTTKFT | TPFTNSLTT |
| | | LIKEIPFTNSLTTKI | IPFTNSLIT |
| | | PNTTATNSNFKTLEA | TTATNSNFK |
| | | KEIPFTNSLTTKTTQ | TPFTNSLTT |
| | | PSSPNTTATNSNFKT | TTATNSNFK |
| | | LNPNTTRFHLTKNP | LNPTTRFH |
| | | WPSSPNTTATNSNFK | NTTATNSNF |
| HLA-DRB1*0802 | DMTTLFTKLWPSPN | FTKLWPSSP |
| | | MTTLFTKLWPSSPNT | FTKLWPSSP |
| | | TTLFTKLWPSSPNTT | FTKLWPSSP |
| | | KDMTLFTKLWPSSP | LFTKLWPSS |
| | | QNLCVFYTKLAKKSG | FYTKLAKKS |
| | | NLCVFYTKLAKKSGK | YTKLAKKSG |
| | | TLFTKLWPSSPNTTA | FTKLWPSSP |
| | | LCVFYTKLAKKSGKA | YTKLAKKSG |
| | | CVFYTKLAKKSGKAD | YTKLAKKSG |
| | | VFYTKLAKKSGKADL | YTKLAKKSG |

Fig. 34 continued

| | | | |
|---|---|---|---|
| | | LFIKLWFSSPNIIAI | FIKLWFSSP |
| | | PGAYVFIKYQKNKTP | FIKYQKNKT |
| | | GAYVFIKYQKNKTPS | FIKYQKNKT |
| | | AYVFIKYQKNKTPSL | FIKYQKNKT |
| | | YVFIKNQKNKIPSLL | FIKNQKNKT |
| | | YPGAYVFIKNQKNKT | YVFIKYQKN |
| | HLA-DRB1*0901 | ILFIKLWFSSPNIIA | LWFSSPNII |
| | | LFIKLWFSSPNIIAT | LWFSSPNII |
| | | FIKLWFSSPNIIATN | LWFSSPNII |
| | | IKLWFSSPNIIATNS | LWFSSPNII |
| | | IILFIKLWFSSPNII | KLWFSSPNI |
| | | KLWFSSPNIIATNSN | LWFSSPNII |
| | | LWFSSPNIIATNSNF | LWFSSPNII |
| | | IKFIPFTNSLITKII | FTNSLITKI |
| | | KFIPFTNSLITKIIQ | FTNSLITKI |
| | | LIKFIPFTNSLITKI | IPFTNSLII |
| | HLA-DRB1*1101 | DLYYTQVKNLRRVKN | QVKNLRRVK |
| | | LYYTQVKNLRRVKNK | VKNLRRVKN |
| | | YYTQVKNLRRVKNKK | VKNLRRVKN |
| | | YTQVKNLRRVKNKKL | VKNLRRVKN |
| | | TQVKNLRRVKNKKLG | VKNLRRVKN |
| | | QVKNLRRVKNKKLGL | VKNLRRVKN |
| | | VKNLRRVKNKKLGLV | VKNLRRVKN |
| | | NLCVFYTKLAKKSGK | YTKLAKKSG |
| | | LCVFYTKLAKKSGKA | YTKLAKKSG |
| | | GNLCVFYTKLAKKSG | FYTKLAKKS |
| | | CVFYTKLAKKSGKAD | YTKLAKKSG |
| | | VFYTKLAKKSGKADL | YTKLAKKSG |
| | | FYTKLAKKSGKADLY | YTKLAKKSG |
| | HLA-DRB1*1302 | KGELILLNINKIQKG | LILLNINKI |
| | | GELILLNINKIQKGI | LILLNINKI |
| | | ELILLNINKIQKGIK | LNINKIQKG |
| | | LILLNINKIQKGIKE | LNINKIQKG |
| | | RKGELILLNINKIQK | LILLNINKI |
| | | KRKGELILLNINKIQ | LILLNINKI |
| | | DLYYTQVKNLRRVKN | YYTQVKNLR |
| | | VKNLRRVKNKKLGLV | VKNLRRVKN |
| | | AYVFIKYQKNKTPSL | FIKYQKNKT |
| | | YVFIKNQKNKIPSLL | FIKYQKNKT |
| | | GAYVFIKYQKNKTPS | FIKYQKNKT |
| | | LYYTQVKNLRRVKNK | VKNLRRVKN |
| | | ILLNINKIQKGIKEI | LNINKIQKG |
| | | RKKGELILLNINKI | KGELILLNI |
| | | YYTQVKNLRRVKNKK | VKNLRRVKN |
| | | TQVKNLRRVKNKKLG | VKNLRRVKN |
| | | YTQVKNLRRVKNKKL | VKNLRRVKN |
| | | PGAYVFIKYQKNKTP | FIKYQKNKT |
| | | TTKNFRKNALKLRF | FRKNALKLR |
| | | ITTKNFRKNALKLR | KNFRKNAL |
| | | VFIKNQKNKIPSLDV | FIKNQKNKT |
| | | LDKFNITQSKTTMLK | FNITQSKTT |
| | | DKFNITQSKTTMLKV | TQSKTTMLK |
| | | KNLRRVKNKKLGLVT | VKNKKLGLV |
| | | NLRRVKNKKLGLVTP | VKNKKLGLV |
| | | TKNFRKNALKLRFS | FRKNALKLR |
| | | LRRVKNKKLGLVTPK | VKNKKLGLV |

Fig. 34 continued

| | | | |
|---|---|---|---|
| | | KKNFKKNALKLRFSD | FKKNALKLR |
| | | FTKNQKNKTPSLDVL | TKNQKNKTP |
| | | KFNLIQSKITMLKVE | IQSKITMLK |
| | | QVKNLRRVKNKKLGL | VKNLRRVKN |
| | | LLLINKIQKGLKEIN | LINKIQKG |
| | | FNLTQSKITMLKVEN | TQSKITMLK |
| | | RRVKNKKLGLVTPKA | VKNKKLGLV |
| | | YPGRYVPTKNQKNKT | VPTKNQKNK |
| | | TSLFTLQKDMTTLFT | LFTLQKDMT |
| | | TTSLFTLQKDMTTLF | LFTLQKDMT |
| | | RVKNKKLGLVTPKAE | VKNKKLGLV |
| | | VKNKKLGLVTPKAEK | LGLVTPKAE |
| | | KNFKKNALKLRFSDF | FKKNALKLR |
| | | TPFTNSLTTKTTQPD | FTNSLTTKT |
| | | NLDKFNLTQSKITML | FNLTQSKIT |
| | | FKTLTCLNPNTTRFH | LTCLNPNTT |
| | | KKFKTLTCLNPNTTR | LTCLNPNTT |
| | | TKETPFTNSLTTKTT | FTNSLTTKT |
| | | KETPFTNSLTTKTTQ | FTNSLTTKT |
| | | NLTQSKITMLKVEN | TQSKITMLK |
| | | KTLTCLNPNTTRFHT | LTCLNPNTT |
| | | KFKTLTCLNPNTTRF | LTCLNPNTT |
| | | LFTLQKDMTTLFTKL | LQKDMTTLF |
| | | EIPFTNSLITKLIQP | FTNSLITKI |
| | | SLFTLQKDMTTLFTK | LQKDMTTLF |
| | | LNINKIQKGLKEINL | LNINKIQKG |
| | | IKLDENLIKKIKNQT | ENLIKKIKN |
| | | LNYTEINTLIKEIPF | INTLIKEIP |
| | | KADLYYTQVKNLRRV | YYTQVKNLR |
| | | ADLYYTQVKNLRRVK | YYTQVKNLR |
| | | SLNYTEINTLIKEIP | TEINTLIKE |
| | | PFTNSLITKIIQPDY | FTNSLITKI |
| | | ENLDKFNLIQSKITE | FNLIQSKIT |
| | | DFLKSKIQNGKIIKA | LKSKIQNGK |
| | | QPDYKSLVLETYNKI | YKSLVLETY |
| | | NYTEINTLIKEIPFT | INTLIKEIP |
| | | PDYKSLVLETYNKID | YKSLVLETY |
| | | YTEINTLIKEIPFTN | INTLIKEIP |
| | | RTTSLFTLQKDMTTL | LFTLQKDMT |
| | | GKADLYYTQVKNLRR | YYTQVKNLR |
| | | TEINTLIKEIPFTNS | INTLIKEIP |
| | | TKKFKTLTCLNPNTT | FKTLTCLNP |
| | | TATNSNFKTIDAYYK | TATNSNFKT |
| | | YKSLVLETYNKIDNK | YKSLVLETY |
| | | RENLDKFNLTQSKIT | KFNLTQSKT |
| | | TLTCLNPNTTRFHTT | LTCLNPNTT |
| | | LTKETPFTNSLTTRI | TPFTNSLTT |
| | | DYKSLVLETYNKIDN | YKSLVLETY |
| | | LKSKIQNGKTTKAFQ | IQNGKTTKA |
| | | FLKSKIQNGKTTKAF | IQNGKTTKA |
| | | TKNQKNKTPSLDVLL | TKNQKNKTP |
| | | MIKMSLNYTEINTLT | MIKMSLNYT |
| | | NFKKNALKLRFSDFL | FKKNALKLR |
| | | FTNSLTTKTTQPDYK | FTNSLTTKT |
| | | LDVLLGAGNLGVFYT | VLLGAGNLG |
| | | DSLKQQIKLLFNIEN | LKQQIKLLF |
| | | LVLETYNKIDNKKFK | LYNKIDNKK |

Fig. 34 continued

| | | | |
|---|---|---|---|
| | | LIQSKIDMLKVENLI | IQSKIDMLK |
| | | SLVLFTYYKIDNKKF | TYYKIDNKK |
| | | GGKADLYYTQVKNLR | LYYTQVKNL |
| | | KTTQPDYKSLVLFTY | TQPDYKSLV |
| | | DKLLFTKLWPSSPN | LLFTKLWP |
| | | LFQLNPNTTRFHTK | LFQLNPNTT |
| | | RTMLKVENLIPEEK | LKVENLIPE |
| | | FKKNAIKLRFSDLR | FKKNAIKLR |
| | | FTLQKDMTTLFTKLW | LQKDMTTLF |
| | | YFRTTSLFTLQKDMT | TTSLFTLQK |
| | | FRTTSLFTLQKDMTT | LFTLQKDMT |
| | | TLFTKLWPSSPNIT | TKLWPSSPN |
| | | KKLGLVTPKAFKNLH | LGLVTPKAF |
| | | KSLVLFTYYKIDNKK | LVLFTYYKI |
| | | DVLLGAGNLCVFYTK | AGNLCVFYT |
| | | TLFTKLWPSSPNTTA | TKLWPSSPN |
| | | LNDQIKKTNIKELLT | DQIKKTNIK |
| | | TTMLKVENLIPEEY | LKVENLIPE |
| | | SPNITATNSNFKTLD | TATNSNFKT |
| | | SSPNTTATNSNFKTL | TATNSNFKT |
| | | LFTYNKIDNKKFKTL | TYYKIDNKK |
| | | KNKKLGLVIPKAEKN | LGLVIPKAE |
| | | SLNDQIKKTNIKELL | DQIKKTNIK |
| | | VLLGAGNLCVFYTKL | AGNLCVFYT |
| | | PNITATNSNFKTLEA | TATNSNFKT |
| | | IQSKIDMLKVENLIP | IQSKIDMLK |
| | | ILQKDMTTLFTKLWP | LQKDMTTLF |
| | | IQKGIKEINLLNYKE | IKEINLLNY |
| | | KTTLFTKLWPSSPNI | TKLWPSSPN |
| | | LFTKLWPSSPNIIAT | TKLWPSSPN |
| | | KIQKGIKEINLLNYK | IKEINLLNY |
| | | NKKLGLVIPKAEKNL | LGLVIPKAE |
| | | NKIQKGIKEINLLNY | KGIKEINLL |
| | | GDFLKSKIQNGKIIK | LKSKIQNGK |
| | | NSFKTIQQLKDNLD | IQQLKDNL |
| | | QSKIDMLKVENLIPE | ITKLKVENL |
| | | KTTATNSNFKTLDAY | TATNSNFKT |
| | | SKIDMLKVENLIPEE | LKVENLIPE |
| | | TTQPDYKSLVLFTYY | YKSLVLFTY |
| | | ATNSNFKTLDAYYRR | FKTLDAYYR |
| | | KNSFKTIQQLKDNL | FKTIQQLK |
| | | EKRTDSLKQQTKLLE | TDSLKQQTK |
| | | TDSLKQQTKLLENTE | LKQQTKLLE |
| | | PSSPNITATNSNFKT | PNITATNSN |
| | | LQKDMTTLFTKLWPS | TTLFTKLWP |
| | | RTDSLKQQTKLLENT | LKQQTKLLE |
| | | QKGIKEINLLNYKEF | IKEINLLNY |
| | | TQPDYKSLVLFTYNK | YKSLVLFTY |
| HLA-DRB1*1501 | DMTTLFTKLWPSSPN | LFTKLWPSS |
| | | KDMTTLFTKLWPSSP | LFTKLWPSS |
| | | MTTLFTKLWPSSPNT | LFTKLWPSS |
| | | QKDMTTLFTKLWPSS | TLFTKLWPS |
| | | TTLFTKLWPSSPNTT | LFTKLWPSS |
| | | VKLRRVKNKKLGLV | LRRVKNKKL |
| | | TLFTKLWPSSPNTTA | LFTKLWPSS |
| | | KNLRRVKNKKLGLVI | VKNKKLGLV |
| | | NLRRVKNKKLGLVTP | VKNKKLGLV |

Fig. 34 continued

|  |  |  |  |
|---|---|---|---|
|  |  | LRRVKNKKLGLVIPK | VKNKKLGLV |
|  |  | LQKDMTLFTKLWPS | TTLFTKLWP |
|  |  | RRVKNKKLGLVIPKA | VKNKKLGLV |
|  |  | LFTKLWPSSPNTTAT | LFTKLWPSS |
|  |  | KENALQYFKAYKKGK | LQYFKAYKK |
|  |  | DLYYTQVKNLRRVKN | YTQVKNLRR |
|  |  | ENALQYFKAYKKGKN | LQYFKAYKK |
|  |  | ADLYYTQVKNLRRVK | YTQVKNLRR |
|  |  | LYYTQVKNLRRVKN | YTQVKNLRR |
|  |  | NALQYFKAYKKGKS | LQYFKAYKK |
|  |  | KADLYYTQVKNLRRV | YTQVKNLRR |
|  |  | YTQVKNLRRVKNKKL | YTQVKNLRR |
|  |  | ATNSNFKTLDAYYRR | FKTLDAYYR |
|  |  | GNLCVFYTKLAKKG | VFYTKLAKK |
|  |  | TNSNFKTLDAYYRRP | FKTLDAYYR |
|  |  | KGELTLLNTNKTQRG | LLNTNKTQK |
|  |  | TATNSNFKTLDAYYR | SNFKTLDAY |
|  |  | NLCVFYTKLAKKSQK | VFYTKLAKK |
|  |  | LCVFYTKLAKKSQKA | VFYTKLAKK |
|  |  | SNFKTLDAYYRRPKT | FKTLDAYYR |
|  |  | NSNFKTLDAYYRRPK | FKTLDAYYR |
|  |  | AGNLCVFYTKLAKKS | VFYTKLAKK |
|  |  | FKGELTLLNTNKTQK | LTLLNTNKT |
|  |  | TQVKNLRRVKNKKLG | LRRVKNKKL |
|  |  | YYTQVKNLRRVKNKK | YTQVKNLRR |
|  |  | GELLLLNINKLQKGI | LLNINKLQK |
|  |  | PKENALQYFKAYKKG | LQYFKAYKK |
|  |  | VKNKKLGLVIPKAE | VKNKKLGLV |
|  |  | RVKNKKLGLVIPKAE | VKNKKLGLV |
| HLA-DRB3*0101 | None |  |  |
| HLA-DRB4*0101 |  | TLFTKLWPSSPNTTA | LWPSSPNTT |
|  |  | TTLFTKLWPSSPNTT | FTKLWPSSP |
|  |  | LFTKLWPSSPNTTAT | LWPSSPNTT |
|  |  | FTKLWPSSPNTTATN | LWPSSPNTT |
|  |  | TKLWPSSPNTTATNS | LWPSSPNTT |
|  |  | NFKTLCLNPNTTR | LTCLNPNTT |
|  |  | FKTLCLNPNTTRFH | LTCLNPNTT |
|  |  | KTLCLNPNTTRFHT | LTCLNPNTT |
|  |  | FKTLCLNPNTTRF | LTCLNPNTT |
|  |  | RIISLEILQKDMIIL | LEILQKDMI |
|  |  | NKKFKTLCLNPNTT | LLCLNPNT |
|  |  | IISLEILQKDMIILF | LEILQKDMI |
|  |  | ISLEILQKDMIILFT | LEILQKDMI |
|  |  | MIILFTKLWPSSPN | TKLWPSSPN |
|  |  | KKLGLVIPKAEKNLH | LGLVIPKAE |
|  |  | DMIILFTKLWPSSPN | FTKLWPSSP |
|  |  | KLGLVIPKAEKNLHI | IPKAEKNLH |
|  |  | LGLVIPKAEKNLHIK | IPKAEKNLH |
|  |  | GLVIPKAEKNLHIKL | IPKAEKNLH |
|  |  | LVIPKAEKNLHIKLD | IPKAEKNLH |
|  |  | ERIISLEILQKDMI | LEILQKDMI |
|  |  | NERTTSLEILQKDM | TSLEILQKD |
|  |  | GKADLYYTQVKNLRR | YYTQVKNLR |
|  |  | KADLYYTQVKNLRRV | YYTQVKNLR |
|  |  | ADLYYTQVKNLRRVK | YYTQVKNLR |
|  |  | KLWPSSPNTTATNSN | LWPSSPNTT |
|  |  | DLYYTQVKNLRRVKN | YYTQVKNLR |

Fig. 34 continued

| | HLA-DRB5*0101 | DLYYTQVKNLRRVKN | YYTQVKNLR |
| --- | --- | --- | --- |
| | | KNSFKTIQNQLKDNL | FKTIQNQLK |
| | | GKADLYYTQVKNLRR | YYTQVKNLR |
| | | NSFKTIQNQLKDNLD | FKTIQNQLK |
| | | ADLYYTQVKNLRRVK | YYTQVKNLR |
| | | KADLYYTQVKNLRRV | YYTQVKNLR |
| | | KKGKNSFKTIQNQLK | KKGKNSFKT |
| | | KGKNSFKTIQNQLKD | FKTIQNQLK |
| | | GKNSFKTIQNQLKDN | FKTIQNQLK |
| | | LYYTQVKNLRRVKNK | YTQVKNLRR |
| | | LQYFKAYKKGKNSFK | YFKAYKKGK |
| | | NSNFKILDAYYRRPK | FKILDAYYR |
| | | SNFKILDAYYRRPKI | FKILDAYYR |
| | | TNSNFKILDAYYRRP | FKILDAYYR |
| | | YYTQVKNLRRVKNKK | YYTQVKNLR |
| | | QYFKAYKKGKNSFKT | YKKGKNSFK |
| | | YFKAYKKGKNSFKTI | YKKGKNSFK |
| | | GAYVFIKNQKNKTPS | IKNQKNKTP |
| | | PGAYVFIKNQKNKTP | YVFIKNQKN |
| | | ENALQYFKAYKKGKN | YFKAYKKGK |
| | | NALQYFKAYKKGKNS | YFKAYKKGK |
| | | SGKADLYYTQVKNLR | ADLYYTQVK |
| | | SFKTIQNQLKDNLDK | FKTIQNQLK |
| | | ATNSNFKILDAYYRR | FKILDAYYR |
| | | FKTIQNQLKDNLDKF | FKTIQNQLK |
| | | LIPEEEYNQEKTAIK | LIPEEEYNQ |
| | | FKAYKKGKNSFKTIQ | YKKGKNSFK |
| | | AYVFIKNQKNKTPSL | IKNQKNKTP |
| | | KAYKKGKNSFKTIQN | YKKGKNSFK |
| | | IATNSNFKILDAYYR | IATNSNFKI |
| | | NTTRFHITKKNFKKN | FHITKKNFK |
| | | KENALQYFKAYKKGK | LQYFKAYKK |
| | | PNTTRFHITKKNFKK | FHITKKNFK |
| | | TTRFHITKKNFKKNA | FHITKKNFK |
| | | YVFIKNQKNKTPSLD | IKNQKNKTP |
| | | YTQVKNLRRVKNKKL | YTQVKNLRR |
| | | ALQYFKAYKKGKNSF | YFKAYKKGK |
| | | NFKILDAYYRRPKIK | FKILDAYYR |
| | | TRFHITKKNFKKNAL | FHITKKNFK |
| | | FKILDAYYRRPKIKE | FKILDAYYR |
| | | PEEEYNQEKTAIKEK | YNQEKTAIK |
| | | NPNTTRFHITKKNFK | RFHITKKNF |
| | | IPEEEYNQEKTAIKE | YNQEKTAIK |
| | | EEEYNQEKTAIKEKE | YNQEKTAIK |
| | | EEYNQEKTAIKEKEK | YNQEKTAIK |
| | | VFIKNQKNKTPSLDV | IKNQKNKTP |
| | | YPGAYVFIKNQKNKT | YVFIKNQKN |
| AAC44656.1 P30 Borrelia burgdorferi SEQ ID NO:21, SEQ ID NO:134765-135226 | HLA-DRB1*0101 | VHQSFIPVPVHVTDK | FIPVPVHVT |
| | | LLVHQSFIPVPVHVT | HQSFIPVPV |
| | | LVHQSFIPVPVHVTD | FIPVPVHVT |
| | | HQSFIPVPVHVTDKY | FIPVPVHVT |
| | | QSFIPVPVHVTDKYG | FIPVPVHVT |
| | | ELGIRAIDSKTLEIT | IRAIDSKTL |
| | | LGIRAIDSKTLEITL | IRAIDSKTL |
| | | DSELGIRAIDSKTLE | IPAIDSKTL |
| | | TDSELGIRAIDSKTL | ELGIRAIDS |

Fig. 34 continued

| | | | |
|---|---|---|---|
| | | SELGIRAIDSKTLEI | IRAIDSKTL |
| | | TLYRGIVTGDPNTG | IVTGDPNTG |
| | | DTLYRGIVTGDPNTG | YRGIVTGDP |
| | | KKLQRSLSLIIFSLT | LQRSLSLII |
| | | YRGIVTGDPNTGGHK | IVTGDPNTG |
| | | LYRGIVTGDPNTGGH | IVTGDPNTG |
| | | ITFYTTNDSSTAYKM | YTTNDSSTA |
| | | FRITFYTTNDSSTAY | YTTNDSSTA |
| | | SFIPVPVHVTDKYGQ | FIPVPVHVT |
| | | RITFYTTNDSSTAYR | YTTNDSSTA |
| | | LRRITFYTTNDSSTA | ITFYTTNDS |
| | | TFYTTNDSSTAYKMY | YTTNDSSTA |
| | | LRDNLTWSDGVATTA | LTWSDGVAT |
| | | FIPVPVHVTDKYGQN | FIPVPVHVT |
| | | RDNLTWSDGVATTAF | LTWSDGVAT |
| | | RGIVTGDPNTGGHRP | IVTGDPNTG |
| | | DNLTWSDGVATTAFG | LTWSDGVAT |
| | | TSPENMVTSGPFKLK | MVTSGPFKL |
| | | GIRAIDSKTIFTTLA | IRAIDSKTI |
| | | NLTWSDGVATTAFGT | LTWSDGVAT |
| | | IRAIDSKTLFTTLAG | IRAIDSKTL |
| | | LTWSDGVATTAFGIR | LTWSDGVAT |
| | | PENMVTSGPFKLKER | MVTSGPFKL |
| | | SPENMVTSGPFKLKE | MVTSGPFKL |
| | | WSDGVATTAFGIRKS | GVATTAFGI |
| | | GQNWISPENMVTSGP | WISPENMVT |
| | | DGVATTAFGIRKSY | TAFGIRKS |
| | | WTSPENMVTSGPFKL | WTSPENMVT |
| | | QNWISPENMVTSGPF | WTSPENMVT |
| | | FYLRDNLTWSDGVAT | LRDNLTWSD |
| | | YLRDNLTWSDGVATT | LTWSDGVAT |
| | | TLRITLASPKPYFID | LASPKPYFI |
| | | KTLRITLASPKPYFI | ITLASPKPY |
| | | ENMVTSGPFKLKERI | MVTSGPFKL |
| | | DKYGQNWTSPENMVT | GQNWTSPEN |
| | | KYGQNWTSPENMVTS | WTSPENMVT |
| | | GVATTAFGIRKSYLR | TAFGIRKS |
| | | LRITLASPKPYFIDL | LASPKPYFI |
| | | DGVATTAFGIRKSYL | TAFGIRKS |
| | | YGQNWTSPENMVTSG | WTSPENMVT |
| | | KSYLRTLNKETGSTY | TLNKETGST |
| | | PYFIDLLVHQSFIPV | FIDLLVHQS |
| | | RKSYLRTLNKETGST | YLRTLNKET |
| | | GIVTGDPNTGGHRPG | IVTGDPNTG |
| | | FITLASPKPYFIDLL | LASPKPYFI |
| | | KPYFIDLLVHQSFIP | FIDLLVHQS |
| | | GAFPRSLDPQLAFRN | PRSLDPQLA |
| | | AFPRSLDPQLAFRNV | PRSLDPQLA |
| | | SPKPYFIDLLVHQSF | FIDLLVHQS |
| | | PKPYFIDLLVHQSFI | FIDLLVHQS |
| | | ASPKPYFIDLLVHQS | YFIDLLVHQ |
| | | FYTTNDSSTAYKMYV | YTTNDSSTA |
| | | RLVSTRTSLGAFPRS | VSTRTSLGA |
| | | VATTAFGIRKSYLRT | TAFGIRKS |
| | | SYLRTLNKETGSTYV | TLNKETGST |
| | | ITLASPKPYFIDLLV | LASPKPYFI |
| | | KLQRSLSLIIFSLTV | LQRSLSLII |

Fig. 34 continued

| | | | |
|---|---|---|---|
| | | LQRSLSLLFSLTVL | LQRSLSLL |
| | | KRRSFGVSTKTSLGA | RRFGVSTKT |
| | | YLRILNKETGSTYVE | ILNKETGST |
| | | MVTSGPFKLKRIP | MVTSGPFKL |
| | | RRFGVSTKLSLGAE | VSTKLSLGA |
| | | YTTNDSSTAYKMYVN | YTTNDSSTA |
| | | RRFGVSTKTSLGAEPR | VSTKTSLGA |
| | | ATTAFGTRKSYLRTL | TTAFGTRKS |
| | | TTAFGTRKSYLRTLN | TTAFGTRKS |
| | | RRFGVSTKTSLGAEP | VSTKTSLGA |
| | | FIDLLVHQSFIPVPV | FIDLLVHQS |
| | | LRILNKETGSTYVEM | ILNKETGST |
| | | TSLGAEPRSLDPQLA | LGAEPRSLD |
| | | TVTGDPNTGGEKPQL | TVTGDPNTG |
| | | NTSPRNMVTSGPFK | NTSPRNMVT |
| | | VSTKTSLGAEPRSLD | VSTKTSLGA |
| | | FGTRKSYLRILNKET | TRKSYLRIL |
| | | GVSTKTSLGAEPRSL | VSTKTSLGA |
| | | RSLSLIIFSLTVLCG | LIIFSLTVL |
| | | DSKTIFITLASPKPY | FITLASPKP |
| | | SKTIFITLASPKPYF | ITLASPKPY |
| | | YFIDLLVHQSFIPVF | FIDLLVHQS |
| | | MIDILYRGIVTGDPN | YRGIVTGDP |
| | | MVTSGPFKLKRIPG | MVTSGPFKL |
| | | KMIDILYRGIVTGDP | MIDILYRGI |
| | | SLSLIIFSLTVLCGD | IFSLTVLCG |
| | | PRSLDPQLAEDNVAS | PRSLDPQLA |
| | | LSLIIFSLTVLCGDN | IFSLTVLCG |
| | | IGILRGIVIGDPNT | YRGIVTGDP |
| | | EPRSLDPQLAEDNVA | PRSLDPQLA |
| | | SLGAEPRSLDPQLAE | PRSLDPQLA |
| | | TRKSYLRILNKETGS | YLRILNKET |
| | | GTRKSYLRILNKETG | TRKSYLRIL |
| | | DLLVHQSFIPVPVHV | LVHQSFIPV |
| | | LGAEPRSLDPQLAED | PRSLDPQLA |
| | | QRSLSLIIFSLTVLC | LIIFSLTVL |
| | | SLIIFSLTVLCGDNK | IFSLTVLCG |
| | | IDLLVHQSFIPVPVH | LVHQSFIPV |
| HLA-DRB1*0301 HLA-DRB1*0401 | None | | |
| | | ASPKPYFIDLLVHQS | YFIDLLVHQ |
| | | SPKPYFIDLLVHQSF | YFIDLLVHQ |
| | | KPYFIDLLVHQSFIP | YFIDLLVHQ |
| | | PKPYFIDLLVHQSFI | YFIDLLVHQ |
| | | LASPKPYFIDLLVHQ | PYFIDLLVH |
| | | PYFIDLLVHQSFIPV | YFIDLLVHQ |
| | | YFIDLLVHQSFIPVP | YFIDLLVHQ |
| | | FFIFYTTNDSSTAY | YTTNDSSTA |
| | | EKYVFEKDNKYYGS | YVFEKDNKY |
| | | SEKYVFEKDNKYYG | YVFEKDNKY |
| | | PSEKYVFEKDNKYY | YVFEKDNKY |
| | | RIPSEKYVFEKDNKY | RIPSEKYVF |
| | | IPSEKYVFEKDNKYY | YVFEKDNKY |
| | | IEEIFYTTNDSSTA | ITFYTTNDS |
| | | FITFYTTNDSSTAYK | YTTNDSSTA |
| | | ITFYTTNDSSTAYKM | YTTNDSSTA |

Fig. 34 continued

| | | | |
|---|---|---|---|
| | HLA-DRB1*0404 | RKSYLRLLNKETGST | YLRLLNKET |
| | | KSYLRLLNKETGSTY | LLNKETGST |
| | | SYLRLLNKETGSTYV | LLNKETGST |
| | | YLRLLNKETGSTYVD | LLNKETGST |
| | | LRLLNKETGSTYVDE | LLNKETGS |
| | HLA-DRB1*0405 | VTDKYCQNWTSPFN | CQNWTSPF |
| | | HVTDKYCQNWTSPF | YCQNWTSPF |
| | | TDKYCQNWTSPFNKV | CQNWTSPF |
| | | DKYCQNWTSPFNKVT | CQNWTSPF |
| | | KYCQNWTSPFNKVTS | CQNWTSPF |
| | | YCQNWTSPFNKVTSC | CQNWTSPF |
| | | CQNWTSPFNKVTSCP | CQNWTSPF |
| | | LVHQSFTPVPVHVT | HQSFTPVPV |
| | | ELFFTFYTTNDSST | TFYTTND |
| | | LFFTFYTTNDSSTA | TFYTTND |
| | | RVLFFTFYTTNDSS | FTFYTTND |
| | | LVHQSFTPVPVHVT | HQSFTPVPV |
| | | VLFFTFYTTNDSS | TFYTTND |
| | | YPFYLRDNLTWSDGV | LRDNLTWSD |
| | | PFYLRDNLTWSDVA | LRDNLTWSD |
| | | TAYPFYLRDNLTWSD | YLRDNLTWS |
| | | FYLRDNLTWSDGVAT | LRDNLTWSD |
| | | FFTFYTTNDSSTAY | TFYTTND |
| | | AYPFYLRDNLTWSDG | LRDNLTWSD |
| | HLA-DRB1*0701 | LLVHQSFIPVPVHVT | SFIPVPVHV |
| | | LVHQSFIPVPVHVTE | FIPVPVHVT |
| | | LGIRAIDSKTLEITL | IRAIDSKTL |
| | | VHQSFIPVPVHVTDK | FIPVPVHVT |
| | | HQSFIPVPVHVTDKY | FIPVPVHVT |
| | | ELGIRAIDSKTLEIT | IRAIDSKTL |
| | | MKLQRSLSLLIYSLT | MKLQRSLSL |
| | | SELGIRAIDSKTLEI | IRAIDSKTL |
| | | IDSELGIRAIDSKTL | ELGIRAIDS |
| | | DSELGIRAIDSKTLE | IRAIDSKTL |
| | | QSFIPVPVHVTDKYG | FIPVPVHVT |
| | HLA-DRB1*0802 | MVTSGPFKLKERIPS | MVTSGPFKL |
| | | VTSGPFKLKERIPSE | FKLKERIPS |
| | | SGPFKLKERIPSEKY | FKLKERIPS |
| | | GPFKLKERIPSEKYV | FKLKERIPS |
| | | TSGPFKLKERIPSEK | FKLKERIPS |
| | | SKTLEITLASPRPY | LTLASPRPY |
| | | KTLEITLASPRPYFT | TTLASPRPY |
| | | DSKTLEITLASPRPY | LEITLASPR |
| | | TLEITLASPRPYFTD | TTLASPRPY |
| | | LEITLASPRPYFTDL | TTLASPRPY |
| | HLA-DRB1*0901 | MKLQRSLSLLIFSLT | LQRSLSLT |
| | | KTLEITLASPRPYFT | TTLASPRPY |
| | HLA-DRB1*1101 | MVTSGPFKLKERTPS | VTSGPFKL |
| | | VTSGPFKLKERTPSE | FKLKERTPS |
| | | TSGPFKLKERTPSEK | FKLKERTPS |
| | | SGPFKLKERTPSEKY | FKLKERTPS |
| | | GPFKLKERTPSEKYV | FKLKERTPS |
| | HLA-DRB1*1302 | QRSLSLTFSLTVLCC | LSLTFSLT |
| | | RSLSLTFSLTVLCC | LSLTFSLT |
| | | LQRSLSLTFSLTVL | LSLTFSLT |
| | | LSLTFSLTVLCCRL | LTFSLTVL |

Fig. 34 continued

| | | | |
|---|---|---|---|
| | | SLSLIIFSLTVLCCD | IIFSLTVL |
| | | STYVDMVKSTTKNQQ | YVDMVKSTT |
| | | TYVDMVKSTIKNGQE | VKSTIKNGQ |
| | | YVDMVKSTIKNGQEY | VKSTIKNGQ |
| | | RKLQRSLSLIIFSLT | LQRSLSLII |
| | | VDMVKSTIKNGQEYF | VKSTIKNGQ |
| | | KSYLRTLNKFTGSTY | LRTLNKFTG |
| | | KLQRSLSLTFSLTV | SLTFSLTV |
| | | SYLRTLNKFTGSTYV | LRTLNKFTG |
| | | DMVKSTIKNGQEYFR | VKSTIKNGQ |
| | | SLTFSLTVLCCDKE | LTFSLTVL |
| | | KTLFTTLASPKPYFT | TTLASPKPY |
| | | GSTYVDMVKSTTKNG | YVDMVKSTT |
| | | DSKTFTTLASPKPY | KTLFTTLAS |
| | | SKTFTTLASPKPYF | TTLASPKPY |
| | | TLFTTLASPKPYFTD | TTLASPKPY |
| | | LFTTLASPKPYFTDL | TTLASPKPY |
| | | RKSYLRTLNKFTGST | LRTLNKFTG |
| | | LTFSLTVLCCDKE | LTFSLTVL |
| | | YLRTLNKFTGSTYVD | LRTLNKFTG |
| | | LRTLNKFTGSTYVDK | LRTLNKFTG |
| | | IRKSYLRILNKETGS | LRILNKETG |
| | | FTGSTYVDMVKSTTK | YVDMVKSTT |
| | | TGSTYVDMVKSTIKN | YVDMVKSTT |
| | | GIRKSYLRTLNKETG | YLRTLNKFT |
| | | MVTSGPFKLKFRIPS | MVTSGPFKL |
| | | WTSGPFKVTSGPFKL | ENVVTSGPF |
| | | TGPENMVTSGPFKLK | MVTSGPFKL |
| | | KVKSIIKNGQEYFGG | VKSIIKNGQ |
| | | SPENMVTSGPFKLKE | MVTSGPFKL |
| | | GPFKLKERIPSEKYV | FKLKERIPS |
| | | VKSIIKNGQEYFGGQ | VKSIIKNGQ |
| | | SGPFKLKERIPSEKY | FKLKERIPS |
| | | TSGPFKLKERIPSEK | FKLKERIPS |
| | HLA-DRB1*1501 | RKSYLRILNKETGST | LRILNKETG |
| | | KSYLRILNKETGSTY | LRILNKETG |
| | | GIRKSYLRILNKETG | YLRILNKET |
| | | IRKSYLRILNKETGS | LRILNKETG |
| | | SYLRTLNKFTGSTYV | LRTLNKFTG |
| | | LQRSLSLIIFSLTVL | SLIIFSLTV |
| | | QRSLSLIIFSLTVLC | LIIFSLTVL |
| | | RSLSLIIFSLTVLCC | LIIFSLTVL |
| | | SLSLIIFSLTVLCCD | LIIFSLTVL |
| | | YPFYLRDNLTWSGQV | YLRDNLTWS |
| | | LSLTFSLTVLCCDT | LTFSLTVL |
| | | PFYLRDNLTWSGQVA | YLRDNLTWS |
| | | YLRTLNKFTGSTYVD | LRTLNKFTG |
| | | AYPFYLRDNLTWSGQ | YLRDNLTWS |
| | | GTAYPFYLRDNLTWS | FYLRDNLTW |
| | | LRTLNKFTGSTYVDK | LRTLNKFTG |
| | | TAYPFYLRDNLTWSG | YLRDNLTWS |
| | HLA-DRB3*0101 | None | |
| | HLA-DRB4*0101 | YFIDLLVHQSFIPVP | IDLLVHQSF |
| | | FIDLLVHQSFIPVPV | LVHQSFIPV |
| | | IDLLVHQSFIPVPVH | LVHQSFIPV |
| | | PYFIDLLVHQSFIPV | IDLLVHQSF |

Fig. 34 continued

| | HLA-DRB5*0101 | None | |
|---|---|---|---|
| NP_045619.1\| immunogenic protein P37, putative [Borrelia burgdorferi B31] SEQ ID NO:22, SEQ ID NO:135227-135614 | HLA-DRB1*0101 | ASLDKIKSLLSTAKS<br>KASLDKIKSLLSTAK<br>LDKIKSLLSTAKSYL<br>SLDKIKSLLSTAKSY<br>DKIKSLLSTAKSYLE<br>QFMADAKASMSSTKS<br>MNLFILTILFSSVLS<br>KIKSLLSTAKSYLEQ<br>LNKLFILTILFSSVI<br>LFILTILFSSVISCK<br>IKSLLSTAKSYLEQT<br>RGVGSSKANLALLPS<br>KLFILTILFSSVISC<br>YHQFMADAKASMSST<br>GYHQFMADAKASMSS<br>QTRRGVGSSKANLAL<br>EQTRRGVGSSKANLA<br>HQFMADAKASMSSTK<br>FILTILFSSVISCKL<br>RRGVGSSKANLALLP<br>AGYHQFMADAKASMS<br>MNLINKLFILTILFS<br>TRRGVGSSKANLALL<br>FMADAKASMSSTKSL<br>MADAKASMSSTKSLL<br>LINKLFILTILFSSV<br>GVGSSKANLALLPSL<br>VGSSKANLALLPSLE<br>GSSKANLALLPSLEE<br>NLINKLFILTILFSS<br>SSKANLALLPSLEEA<br>ILTILFSSVISCKLY<br>ADAKASMSSTKSLLE<br>VKASLDKIKSLLSTA<br>ELNDIYKKLQDMDSR<br>KVKASLDKIKSLLST<br>QELNDIYKKLQDMDS<br>DAKASMSSTKSLLEV<br>SKANLALLPSLEEAI<br>KANLALLPSLEEAIA<br>LTILFSSVISCKLYK<br>EAIAKVKSNHASADT<br>AKVKASLDKIKSLLS<br>YAGYHQFMADAKASM<br>EEAIAKVKSNHASAD<br>NDFEYAQRKADRALE<br>DFEYAQRKADRALEE<br>KNDFEYAQRKADRAL<br>YYAGYHQFMADAKAS<br>FEYAQRKADRALEEA<br>SLEEAIAKVKSNHAS<br>GSFNTLKSNDDSKRS<br>ANLALLPSLEEAIAK<br>LEEAIAKVKSNHASA | IKSLLSTAK<br>LDKIKSLLS<br>IKSLLSTAK<br>IKSLLSTAK<br>IKSLLSTAK<br>MADAKASMS<br>LTILFSSVI<br>IKSLLSTAK<br>LFILTILFS<br>LTILFSSVI<br>IKSLLSTAK<br>VGSSKANLA<br>LTILFSSVI<br>MADAKASMS<br>MADAKASMS<br>VGSSKANLA<br>RRGVGSSKA<br>MADAKASMS<br>LTILFSSVI<br>VGSSKANLA<br>QFMADAKAS<br>LINKLFILT<br>VGSSKANLA<br>MADAKASMS<br>MADAKASMS<br>LFILTILFS<br>VGSSKANLA<br>VGSSKANLA<br>KANLALLPS<br>LINKLFILT<br>LALLPSLEE<br>LTILFSSVI<br>KASMSSTKS<br>LDKIKSLLS<br>YKKLQDMDS<br>LDKIKSLLS<br>LNDIYKKLQ<br>KASMSSTKS<br>LALLPSLEE<br>LALLPSLEE<br>LTILFSSVI<br>IAKVKSNHA<br>VKASLDKIK<br>QFMADAKAS<br>IAKVKSNHA<br>YAQRKADRA<br>YAQRKADRA<br>YAQRKADRA<br>YYAGYHQFM<br>YAQRKADRA<br>IAKVKSNHA<br>FNTLKSNDD<br>LALLPSLEE<br>IAKVKSNHA | |

Fig. 34 continued

| | | | |
|---|---|---|---|
| | | AKNDEEYAQRKADRA | EEYAQRKAD |
| | | ATANVKSNHASADTH | VKSNHASAD |
| | | PGLEEALAKVKSNHA | LEEALAKVK |
| | | NGSFNTLKSNDDSKR | FNTLKSNDD |
| | | LAKVKSNHASADTHC | VKSNHASAD |
| | | KSLLSTAKSYLEQTR | LSTAKSYLE |
| | | CKLYKKTTYNADQVT | LYKKTTYNA |
| | | RALEEALSNSNASRH | LEEALSNSN |
| | | AKASMSSTKSLLEVA | KASMSSTKS |
| | HLA-DRB1*0301 | None | |
| | HLA-DRB1*0401 | PGLEEALAKVKSNHA | PGLEEALAK |
| | | SLEEALAKVKSNHAS | LAKVKSNHA |
| | | LEEALAKVKSNHACA | LAKVKSNHA |
| | | EELAKVKSNHASAD | LAKVKSNHA |
| | | EALAKVKSNHASADT | LAKVKSNHA |
| | | LAKVKSNHASADTHC | LAKVKSNHA |
| | | ATANVKSNHASADTH | LAKVKSNHA |
| | | RALEEALSNSNASRH | EALSNSNAS |
| | | DRALEEALSNSNASR | EALSNSNAS |
| | | ADRALEEALSNSNAS | LEEALSNSN |
| | | KASLDKTKSLLSTAK | LDKTKSLLS |
| | | ASLDKTKSLLSTAKS | LDKTKSLLS |
| | | LEEALSNSNASRHES | EALSNSNAS |
| | | ALEEALSNSNASRHE | EALSNSNAS |
| | | TSCKLYKKTTYNADQ | LYKKTTYNA |
| | | VTSCKLYKKTTYNAD | LYKKTTYNA |
| | | SCKLYKKTTYNADQV | LYKKTTYNA |
| | | CKLYKKTTYNADQVT | LYKKTTYNA |
| | | NLTNKLFTLTTLFSS | LFTLTTLFS |
| | | ADMQPDMQHDNSSSI | MQPDMQHDN |
| | | LTKLFTLTTLFSSVT | LFTLTTLFS |
| | | NKLFTLTTLFSSVTS | LFTLTTLFS |
| | | TKLFTLTTLFSSVT | LFTLTTLFS |
| | HLA-DRB1*0404 | RSVDNTYMDQDTGKK | VDNTYMDQD |
| | | SVDNTYMDQDTGKKP | YMDQDTGKK |
| | | VDNTYMDQDTGKKPL | YMDQDTGKK |
| | | NTYMDQDTGKKPLEA | YMDQDTGKK |
| | | DNTYMDQDTGKKPLM | YMDQDTGKK |
| | | NKLFTLTTLFSSVTS | LLTTLFSSV |
| | | TNKLFTLTTLFSSVT | LLTTLFSSV |
| | | LTKLFTLTTLFSSV | LFTLTTLFS |
| | | LFTLTTLFSSVTCK | LLTTLFSSV |
| | | KLFTLTTLFSSVTCC | LLTTLFSSV |
| | | EELAKVKSNHASAD | LAKVKSNHA |
| | | EALAKVKSNHASADT | LAKVKSNHA |
| | | RALEEALSNSNASRH | LEEALSNSN |
| | HLA-DRB1*0405 | GSSKANLALLPSLEE | KANLALLPS |
| | | SSKANLALLPSLEEA | LALLPSLEE |
| | | KANLALLPSLEEALA | LALLPSLEE |
| | | SKANLALLPSLEEAL | LALLPSLEE |
| | | ANLALLPSLEEALAK | LALLPSLEE |
| | | NLALLPSLEEALAKV | LALLPSLEE |
| | | LALLPSLEEALAKVK | LALLPSLEE |
| | | KSNGSFNTLKSNDD | NGSFNTLKS |
| | | SNGSFNTLKSNDDS | FNTLKSNDD |

Fig. 34 continued

| | | | |
|---|---|---|---|
| | | NNGSFNTLKSNDDSK | FNTLKSNDD |
| | | NGSFNTLKSNDDSKR | FNTLKSNDD |
| | | GSFNTLKSNDDSKRS | FNTLKSNDD |
| | | ADAKASMSSTKSLLF | KASMSSTKS |
| | | DAKASMSSTKSLLFV | MSSTKSLLF |
| | | KASMSSTKSLLFVAK | MSSTKSLLF |
| | | ASMSSTKSLLFVAKY | MSSTKSLLF |
| | | AKASMSSTKSLLFVA | MSSTKSLLF |
| | | KELNENMTKTNKDFQ | ENMTKTNKD |
| | | KQKELNENMTKTNKR | LNENMTKTN |
| | | QKELNENMTKTNKDF | ENMTKTNKD |
| | | ELNENMTKTNKDFQE | ENMTKTNKD |
| | | LNENMTKTNKDFQEL | ENMTKTNKD |
| | | ASLDKTKSLLSTAKS | LDKTKSLLS |
| | | KASLDKTKSLLSTAK | LDKTKSLLS |
| | | SFNTLKSNDDSKRSG | FNTLKSNDD |
| | | FNTLKSNDDSKRSGR | FNTLKSNDD |
| HLA-DRB1*0701 | | RALFFALSNSNASRH | RALFFALSN |
| | | ALFFALSNSNASRHE | LSNSNASRH |
| | | FFALSNSNASRHESY | LSNSNASRH |
| | | FALSNSNASRHESYY | LSNSNASRH |
| | | LFFALSNSNASRHES | LSNSNASRH |
| | | ALSNSNASRHESYYY | LSNSNASRH |
| | | LSNSNASRHESYYYA | LSNSNASRH |
| | | DKTKSLLSTAKSYLL | LLSTAKSYL |
| | | KTKSLLSTAKSYLLQ | LLSTAKSYL |
| | | TKSLLSTAKSYLLQT | LLSTAKSYL |
| | | KSLLSTAKSYLLQTR | LLSTAKSYL |
| | | FTLTTLFSSVTSGKL | LTTLFSSVT |
| | | TNKLFTLTTLFSSVT | LLTTLFSSV |
| | | NKLFTLTTLFSSVTS | LTTLFSSVT |
| | | LFTLTTLFSSVTSGK | LTTLFSSVT |
| | | KLFTLTTLFSSVTSG | LTTLFSSVT |
| | | LDKTKSLLSTAKSYL | SLLSTAKSY |
| | | SLLSTAKSYLLQTRR | LLSTAKSYL |
| HLA-DRB1*0802 | | RALFFALSNSNASRH | RALFFALSN |
| | | ALFFALSNSNASRHE | LSNSNASRH |
| | | FFALSNSNASRHESY | LSNSNASRH |
| | | FALSNSNASRHESYY | LSNSNASRH |
| | | LFFALSNSNASRHES | LSNSNASRH |
| | | ALSNSNASRHESYYY | LSNSNASRH |
| | | LSNSNASRHESYYYA | LSNSNASRH |
| | | DKTKSLLSTAKSYLL | LLSTAKSYL |
| | | KTKSLLSTAKSYLLQ | LLSTAKSYL |
| | | TKSLLSTAKSYLLQT | LLSTAKSYL |
| | | KSLLSTAKSYLLQTR | LLSTAKSYL |
| | | FTLTTLFSSVTSGKL | LTTLFSSVT |
| | | TNKLFTLTTLFSSVT | LLTTLFSSV |
| | | NKLFTLTTLFSSVTS | LTTLFSSVT |
| | | LFTLTTLFSSVTSGK | LTTLFSSVT |
| | | KLFTLTTLFSSVTSG | LTTLFSSVT |
| | | LDKTKSLLSTAKSYL | SLLSTAKSY |
| | | SLLSTAKSYLLQTRR | LLSTAKSYL |
| HLA-DRB1*0901 | | None | |
| HLA-DRB1*1101 | | None | |
| HLA-DRB1*1302 | | MNLTNKLFTLTTLFS | LTNKLFTLT |

Fig. 34 continued

| | | | |
|---|---|---|---|
| | | NLINKLFILTILFSS | LINKLFILT |
| | | LINKLFILTILFSSV | LINKLFILT |
| | | INKLFILTILFSSVI | LFILTILFS |
| | | NKLFILTILFSSVIS | LFILTILFS |
| | | QVIDKLKSNNGSFNT | LKSNNGSFN |
| | | VIDKLKSNNGSFNTL | LKSNNGSFN |
| | | KLFILTILFSSVISC | LTILFSSVI |
| | | IDKLKSNNGSFNTLK | LKSNNGSFN |
| | | DKLKSNNGSFNTLKS | LKSNNGSFN |
| | | LFILTILFSSVISCK | LTILFSSVI |
| | | DQVIDKLKSNNGSFN | IDKLKSNNG |
| | | RGVGSSKANLALLPS | VGSSKANLA |
| | HLA-DRB1*1501 | NKLFILTILFSSVIS | LFILTILFS |
| | | INKLFILTILFSSVI | LFILTILFS |
| | | LINKLFILTILFSSV | LFILTILFS |
| | | NLINKLFILTILFSS | LFILTILFS |
| | | LFILTILFSSVISCK | LTILFSSVI |
| | | KLFILTILFSSVISC | FILTILFSS |
| | | ASLDKIKSLLSTAKS | IKSLLSTAK |
| | | KASLDKIKSLLSTAK | LDKIKSLLS |
| | | LDKIKSLLSTAKSYL | IKSLLSTAK |
| | | MNLINKLFILTILFS | LINKLFILT |
| | | DKIKSLLSTAKSYLE | IKSLLSTAK |
| | | FILTILFSSVISCKL | LTILFSSVI |
| | | SLDKIKSLLSTAKSY | IKSLLSTAK |
| | HLA-DRB3*0101 | None | |
| | HLA-DRB4*0101 | GKKPLMADMQPDMQN | MADMQPDMQ |
| | | KKPLMADMQPDMQND | MADMQPDMQ |
| | | KPLMADMQPDMQNDN | MADMQPDMQ |
| | | PLMADMQPDMQNDNS | MADMQPDMQ |
| | | TGKKPLMADMQPDMQ | LMADMQPDM |
| | | LMADMQPDMQNDNSS | MADMQPDMQ |
| | | MADMQPDMQNDNSSS | MADMQPDMQ |
| | HLA-DRB5*0101 | None | |
| NP_212281.1\| flagellin [Borrelia burgdorferi B31] SEQ ID NO:23, SEQ ID NO:135615-136268 | HLA-DRB1*0101 | TTNSILTQSAMAMIA | ILTQSAMAM |
| | | TNSILTQSAMAMIAQ | ILTQSAMAM |
| | | NSILTQSAMAMIAQA | ILTQSAMAM |
| | | ATTNSILTQSAMAMI | ILTQSAMAM |
| | | AATTNSILTQSAMAM | TNSILTQSA |
| | | QPAKINTPASLGSSQ | INTPASLSG |
| | | PAKINTPASLSGSQA | INTPASLSG |
| | | SILTQSAMAMIAQAN | ILTQSAMAM |
| | | MQPAKINTPASLSGS | INTPASLSG |
| | | AKINTPASLSGSQAS | INTPASLSG |
| | | ILTQSAMAMIAQANQ | ILTQSAMAM |
| | | GMQPAKINTPASLSG | KINTPASLS |
| | | NAIRMISDQRANLGA | IRMISDQRA |
| | | ENAIRMISDQRANLG | IRMISDQRA |
| | | ANLFSGEGAQTAQAA | FSGEGAQTA |
| | | ANVANLFSGEGAQTA | VANLFSGEG |
| | | VANLFSGEGAQTAQA | FSGEGAQTA |
| | | NLFSGEGAQTAQAAP | FSGEGAQTA |
| | | YNQMHMLSNKSASQN | MHMLSNKSA |
| | | NVANLFSGEGAQTAQ | FSGEGAQTA |
| | | EKVLVRMKELAVQSG | VRMKELAVQ |

Fig. 34 continued

| | | | |
|---|---|---|---|
| | | KVLVRMKELAVQSGG | MKELAVQGG |
| | | QAQYNQMHMLSNKSA | YYQMHMLSN |
| | | AQYDQMHMLSNKSAS | MHMLSNKSA |
| | | YQMHMLSNKSASQNV | MHMLSNKSA |
| | | AELGMQPAKTNTPA | LGMQPAKTN |
| | | VLVRMKELAVQSGNG | MKELAVQSG |
| | | TAFFLGMQPAKTNTP | LGMQPAKTN |
| | | QYYQMHMLSNKSASQ | MHMLSNKSA |
| | | AKTNATRMTSDQRA | TNATRMTS |
| | | ATMTDEVVAATTNST | MTDEVVAAT |
| | | LVRMKELAVQSGNGT | MKELAVQSG |
| | | MTDEVVAATTNSTLT | VVAATTNST |
| | | TDEVVAATTNSTLTQ | VVAATTNST |
| | | DEVVAATTNSTLTQS | VVAATTNST |
| | | RTAFFLGMQPAKTNT | LGMQPAKTN |
| | | FFLGMQPAKTNTPAS | LGMQPAKTN |
| | | TMTDEVVAATTNSTL | VVAATTNST |
| | | VRMKELAVQSGNGTY | MKELAVQSG |
| | | VRTAFFLGMQPAKTN | FLGMQPAKT |
| | | TENATRMTSDQRAIL | TRMTSDQRA |
| | | KTENATRMTSDQRAI | TRMTSDQRA |
| | | INTPASLGSQASWT | NTPASLGG |
| | | LYATENLKASYAQTK | TENLKASYA |
| | | YATENLKASYAQTKE | LENLKASYA |
| | | KTNTPASLGSQASW | NTPASLSG |
| | | LFSGEGAQTAQAAPV | FSGEGAQTA |
| | | FSGEGAQTAQAAFVQ | SGEGAQTA |
| | | AIRMISDQRANLGAF | IRMSDQRA |
| | | IRMISDQRANLGAFQ | IRMSDQRA |
| | | VQQEGAQQPAPATAP | VQQEGAQQP |
| | | RKELAVQSGNGTYS | MKELAVQSG |
| | | MKELAVQSGNGTYSE | MKELAVQSG |
| | | LGVQQEGAQQPAPAT | VQQEGAQQP |
| | | STEYAIENLKASYAQ | IENLKASYA |
| | | HSTEYAIENLKASYA | YAIENLKAS |
| | | TEYAIENLKASYAQI | LENLKASYA |
| | | QMHMLSNKSASQNVR | MHMLSNKSA |
| | | MHMLSNKSASQNVRI | MHMLSNKSA |
| | | TQSAMAMTAQANQVP | TQSAMAMTA |
| | | ALAVDLYAANVANLF | VNLYAANVA |
| | | LGMQPAKTNTPASLS | LGMQPAKTN |
| | | TAVNLYAANVANLFS | YAANVANLF |
| | | ATENLKASYAQTKEA | LKASYAQTK |
| | | TENLKASYAQTKEAT | LKASYAQTK |
| | | FLGMQPAKTNTPASL | LGMQPAKTN |
| | | LTQSAMAMTAQANQV | AMAMTAQAN |
| | | QECVQQEGAQQPAPA | VQQEGAQQP |
| | | QSAMAMTAQANQVPQ | MTAQANQVP |
| | | EVVAATTNSTLTQSA | VVAATTNST |
| | | AVNLYAANVANLFSG | YAANVANLF |
| | | PVQECVQQEGAQQPA | VQQEGAQQP |
| | | VVAATTNSTLTQSAM | VVAATTNST |
| | | APVQECVQQEGAQQP | QECVQQEGA |
| | | VQECVQQEGAQQPAP | VQQEGAQQP |
| | | NLYAANVANLFSGEG | YAANVANLF |
| | | QECAQQPAPATAPSG | QQPAPATAP |
| | | VNLYAANVANLFSGE | YAANVANLF |

Fig. 34 continued

| | | | |
|---|---|---|---|
| | | QQEGAQQPAPATAPS | QQPAPATAP |
| | | CVQQEGAQQPAPATA | VQQEGAQQP |
| | | AANVANLFSGEGAQT | VANLFSGEG |
| | | EGAQQPAPATAPSQG | QQPAPATAP |
| | | AMAMIAQANQVPQYV | MIAQANQVP |
| | | RATAVNIYAANVANL | VNIYAANVA |
| | | ENLKASYAQTKDATM | LKASYAQTK |
| | | VEKVLVRMKFIAVQS | VRMKFIAVQ |
| | | SAMAMIAQANQVPQY | MIAQANQVP |
| | | GAQQPAPATAPSQGG | QQPAPATAP |
| | | EVEKVLVRMKFIAVQ | LVRMKFIAV |
| | | HAQTRGLSQASRNTS | TRGLSQASR |
| | | KFIAVQSGNGTYSDA | VQSGNGTYS |
| | | NLKASYAQTKDATMT | LKASYAQTK |
| | | LKASYAQTKDATMTD | LKASYAQTK |
| | | TNAQTRGLSQASRNT | TRGLSQASR |
| | | AQTRGLSQASRNTSK | TRGLSQASR |
| | | DRATAVNIYAANVAN | VNIYAANVA |
| | | GEGAQTAQAAPVQEG | AQTAQAAPV |
| | | PSQGGVNSPVNVTTT | VNSPVNVTT |
| | | EQAQYNQMEMLSNES | YNQMEMLSN |
| | | EGAQTAQAAPVQEGV | AQTAQAAPV |
| | | SQGGVNSPVNVTTTV | VNSPVNVTT |
| | | QGGVNSPVNVTTTVE | VNSPVNVTT |
| | | APSQGGVNSPVNVTT | GVNSPVNVT |
| | | QDRATAVNIYAANVA | AVNIYAANV |
| | | PASLSGSQASWTLRV | LSGSQASWT |
| | | AGLSGSQASWTLRVH | LSGSQASWT |
| | | MAMIAQANQVPQYVL | MIAQANQVP |
| | | IYAANVANLFSGEGA | VANLFSGEG |
| | | GGVNSPVNVTTTVDA | VNSPVNVTT |
| | | SRNNGINAANLSKTQ | INAANLSKT |
| | | RNNGINAANLSKTQE | INAANLSKT |
| | | ASRNNGINAANLSKT | NGINAANLS |
| | | ELAVQSGNGTYSDAR | VQSGNGTYS |
| | | NGINAANLSKTQEK | INAANLSKT |
| | | NT

| | | | |
|---|---|---|---|
| | | DATMTDEVVAATTNS<br>AQTAQAAPVQFCVQQ<br>RMLSDQRANLGAFQN<br>MTAQANQVPQYVLSL<br>VKSPVNVTTTVDANT<br>SLSGSQASYTIRVHV<br>LSGSQASYTIRVHVG<br>SKATNFTQTTFQNLG<br>MTTNRNTSATNASRI<br>SYAQTKDATMTDEVV<br>TSPVNVTTTVDANTS<br>SPVNVTTTVDANTSL<br>NVTTTVDANTSLAKI<br>KATNFTQTTFQNLMF<br>QPAPATAPSQGGVTS<br>TKDATMTDEVVAATT<br>MLSNKSASQNVRTAE<br>KDATMTDEVVAATTN<br>QTKDATMTDEVVAAT<br>PAPATAPSQGGVTSP<br>QTAQAAPVQFCVQQF<br>VTTTVDANTSLAKIE<br>PVNVTTTVDANTSLA<br>VAATTNSLLQSAMA | MTDEVVAAT<br>AQAAPVQFG<br>LSDQRANLG<br>QANQVPQYV<br>VNVTTTVDA<br>LSGSQASYT<br>LSGSQASYT<br>TFTQTTFG<br>TNRNTSATN<br>AQTKDATMT<br>VNVTTTVDA<br>VNVTTTVDA<br>VDANTSLAK<br>TFTQTTFG<br>PATAPSQGG<br>MTDEVVAAT<br>LSNKSASQN<br>MTDEVVAAT<br>DATMTDEVV<br>PATAPSQGG<br>AQAAPVQFG<br>VDANTSLAK<br>VNVTTTVDA<br>TNSLLQSA |
| | HLA-DRB1*0301 | None | |
| | HLA-DRB1*0401 | QYNQMHMLSNKSASQ<br>YNQMHMLSNKSASQN<br>TAVNIYAANVANLFS<br>QAQYNQMHMLSNKSA<br>NQMHMLSNKSASQNV<br>ATAVNIYAANVANLF<br>NIYAANVANLFSGEG<br>AVNIYAANVANLFSG<br>AQYNQMHMLSNKSAS<br>VNIYAANVANLFSGE<br>QMHMLSNKSASQNVR<br>GVNSPVNVTTTVDAN<br>GGVNSPVNVTTTVDA<br>NSPVNVTTTVDANTS<br>VKSPVNVTTTVDANT | QMHMLSNKS<br>QMHMLSNKS<br>YAANVANLF<br>QMHMLSNKS<br>MLSNKSASQ<br>NIYAANVAN<br>YAANVANLF<br>YAANVANLF<br>QMHMLSNKS<br>YAANVANLF<br>MLSNKSASQ<br>VNVTTTVDA<br>VKSPVNVTT<br>VNVTTTVDA<br>VNVTTTVDA |
| | HLA-DRB1*0404 | ANVANLFSGEGAQTA<br>AANVANLFSGEGAQT<br>NIYAANVANLFSGEG<br>IYAANVANLFSGEGA<br>YAANVANLFSGEGAQ<br>YNQMHMLSNKSASQN<br>QYNQMHMLSNKSASQ<br>NVANLFSGEGAQTAQ<br>VANLFSGEGAQTAQA<br>FNAIRMLSDQRANLG<br>NQMHMLSNKSASQNV<br>NAIRMLSDQRANLGA<br>QMHMLSNKSASQNVR<br>AIRMLSDQRANLGAF<br>VNVTTTVDANTSLAK | VANLFSGEG<br>VANLFSGEG<br>YAANVANLF<br>VANLFSGEG<br>VANLFSGEG<br>MLSNKSASQ<br>QMHMLSNKS<br>VANLFSGEG<br>VANLFSGEG<br>AIRMLSDQR<br>MLSNKSASQ<br>LSDQRANLG<br>MLSNKSASQ<br>LSDQRANLG<br>TVDANTSLA |

Fig. 34 continued

| | | |
|---|---|---|
| | | PVNVTTTVDANTSLA<br>TRMTSDQRANLCAFQ<br>AQYDQMHRLSNKSAS<br>QAQYNQMHRLSNKSA<br>DQAQENQKHRLSNKS<br>RMTSDQRANLCAFQN<br>MTDEVVAATTNSTLT | VNVTTTVDA<br>TSDQRANLC<br>QRHRLSNKS<br>QRHRLSNKS<br>YNQKHRLSN<br>TSDQRANLC<br>VVAATTNST |
| | HLA-DRB1*0405 | RFLGMQPAKTNTPAS<br>LGMQPAKTNTPASLS<br>GGVNSPVNVTTTVDA<br>GVNSPVNVTTTVDAN<br>VNSPVNVTTTVDANT<br>FLGMQPAKTNTPASL<br>NSPVNVTTTVDANTS | LGMQPAKTN<br>PAKTNTPAS<br>PVNVTTTVD<br>VNVTTTVDA<br>VNVTTTVDA<br>PAKTNTPAS<br>VNVTTTVDA |
| | HLA-DRB1*0701 | TMTDEVVAATTNSTL<br>MTDEVVAATTNSTLT<br>TDEVVAATTNSTLTQ<br>DEVVAATTNSTLTQS<br>EVVAATTNSTLTQSA<br>ATMTDEVVAATTNST<br>VVAATTNSTLTQSAM<br>QNRLESIKNSTEYAI<br>NRLESIKNSTEYAIE<br>ESIKNSTEYAIENLK<br>RLESIKNSTEYAIEN<br>LESIKNSTEYAIENL<br>GGVNSPVNVTTTVDA<br>GVNSPVNVTTTVDAN<br>KLLNHNTSALNASRN | VVAATTNST<br>VVAATTNST<br>VVAATTNST<br>VVAATTNST<br>VAATTNSTL<br>ATMTDEVVA<br>VVAATTNST<br>IKNSTEYAI<br>IKNSTEYAI<br>IKNSTEYAI<br>IKNSTEYAI<br>IKNSTEYAI<br>PVNVTTTVD<br>VNVTTTVDA<br>LLNHNTSAL |
| | HLA-DRB1*0802 | None | |
| | HLA-DRB1*0901 | TAVNIYAANVANLFS<br>ATAVNIYAANVANLF<br>TTNSTLTQSAMAMTA<br>TNSTLTQSAMAMAQ<br>NSTLTQSAMAMTAQA<br>STLTQSAMAMTAQAN<br>TTNSTLTQSAMAMT<br>FATAVNIYAANVANL<br>AVNIYAANVANLFSG<br>VNIYAANVANLFSGY | VNIYAANVA<br>VNIYAANVA<br>LTQSAMAMT<br>LTQSAMAMT<br>LTQSAMAMT<br>LTQSAMAMT<br>TLTQSAMAM<br>VNIYAANVA<br>IYAANVANL<br>IYAANVANL |
| | HLA-DRB1*1101 | None | |
| | HLA-DRB1*1302 | NTSLAKTENATRMTS<br>TSLAKTENATRMTSD<br>SLAKTENATRMTSDQ<br>ASRNGINAANLSKT<br>SRNGINAANLSKTQ<br>LAKTENATRMISDQR<br>AKTENATRMTSDQRA<br>RNGINAANLSKTQE<br>MGVSGKINAQIRGLS<br>DLLNHNTSALNASRN<br>NGINAANLSKTQEK<br>NGINAANLSKTQEKL<br>LLNHNTSALNASRN<br>GVSGKINAQIRGLSQ<br>VSGKINAQIRGLSQA | AKTENATRM<br>TENATRMTS<br>TENATRMTS<br>NGINAANLS<br>INAANLSKT<br>TENATRMTS<br>TENATRMTS<br>INAANLSKT<br>MGVSGKINA<br>LLNHNTSAL<br>INAANLSKT<br>INAANLSKT<br>LLNHNTSAL<br>INAQIRGLS<br>INAQIRGLS |

Fig. 34 continued

| | | | |
|---|---|---|---|
| | | RKKELAVQSGNGTYS | LAVQSGNGT |
| | | ATAVNTYAANVANLF | VNTYAANVA |
| | | IENAIRKISDQRANL | IENAIRKIS |
| | | TAVNTYAANVANLFS | VNTYAANVA |
| | | KKELAVQSGNGTYSD | LAVQSGNGT |
| | | SQKTNAQTRGLSQAS | TNAQTRGLS |
| | | QKTNAQTRGLSQASR | TNAQTRGLS |
| | | KIENAIRKISDQRAN | IENAIRKIS |
| | | KELAVQSGNGTYSDA | LAVQSGNGT |
| | | LVRMKELAVQSGNGT | MKELAVQSG |
| | | VRMKELAVQSGNGTY | LAVQSGNGT |
| | | AQMGVSGKTNAQTRG | MGVSGKTNA |
| | | AVNTYAANVANLFSG | YAANVANLF |
| | | VNTYAANVANLFSGE | YAANVANLF |
| | | SGGVNSPVNVTTTV | GVNSPVNVT |
| | | QGGVNSPVNVTTTVT | GVNSPVNVT |
| | | GGVNSPVNVTTTVEA | GVNSPVNVT |
| | | INASRNNGTNAANLS | SRNNGTNAA |
| | | EATAVNTYAANVANL | VNTYAANVA |
| | | PSQGGVNSPVNVTTT | GVNSPVNVT |
| | | APSQGGVNSPVNVTT | GVNSPVNVT |
| | | QDLATVNTYAANVA | LAVNTYAAN |
| | | DEATAVNTYAANVAN | VNTYAANVA |
| | | GVNSPVNVTTTVEAN | GVNSPVNVT |
| | | NASRNNGTNAANLSK | NGTNAANLS |
| | | RGLSQASRNTSKAIN | LSQASRNTS |
| | | ELAVQSGNGTYSDAD | LAVQSGNGT |
| | | IRGLSQASRNTSKAI | LSQASRNTS |
| | | LAVQSGNGTYSDAER | LAVQSGNGT |
| | | TSAINASRNNGINAA | AINASRNNG |
| | | QIRGLSQASRNTSKA | LSQASRNTS |
| | | ININGSAINASRNNG | ININGSAIN |
| | | NAQIRGLSQASRNTS | RGLSQASRN |
| | | AQIRGLSQASRNTSK | LSQASRNTS |
| | | QRLESIKNSTEYAL | LESIKNSTE |
| | | IIYAANVANLFSGES | YAANVANLF |
| | | KRLESIKNSTEYATE | IKNSTEYAT |
| | | GMGVSGKINAQIRGL | MGVSGKINA |
| | | SKAIKFIQTTEGNIN | INFIQTTEG |
| HLA-DRB1*1501 | | EKVLVRMKELAVQSG | LVRMKELAV |
| | | KVLVRMKELAVQSGN | LVRMKELAV |
| | | VEKVLVRMKELAVQS | LVRMKELAV |
| | | EVEKVLVRMKELAVQ | LVRMKELAV |
| | | VLVRMKELAVQSGNG | VRMKELAVQ |
| | | LVRMKELAVQSGNGT | VRMKELAVQ |
| | | TNAQTRGLSQASRNT | TRGLSQASR |
| | | QKTNAQTRGLSQASR | QTRGLSQAS |
| | | NAQTRGLSQASRNTS | TRGLSQASR |
| | | KTNAQTRGLSQASRN | TRGLSQASR |
| | | AQTRGLSQASRNTSK | TRGLSQASR |
| | | NEVEKVLVRMKELAV | VLVRMKELA |
| | | KIENAIRKISDQRAN | ATRMSDQR |
| | | IENAIRKISDQRANL | ATRMSDQR |
| | | AKIENAIRKISDQRA | AIRKISDQR |
| | | ENAIRKISDQRANLG | ATRMSDQR |
| | | LAKIENAIRKISDQR | LAKIENAIR |
| | | QYNQMEKLSNKSASQ | MRKLSNKSA |

Fig. 34 continued

| | | | |
|---|---|---|---|
| | | QIRGLSQASRNTSKA | IRGLSQASR |
| | | YNQMHMLSNKSASQN | MHMLSNKSA |
| | | IRGLSQASRNTSKAI | IRGLSQASR |
| | | AQYNQMHMLSNKSAS | MHMLSNKSA |
| | | VRMKELAVQSGNGTY | VRMKELAVQ |
| | | QAQYNQMHMLSNKSA | QMHMLSNKS |
| | | AIRMISDQRANLGAF | AIRMISDQR |
| | | NQMHMLSNKSASQNV | MHMLSNKSA |
| | | QASWTLRVHVGANQD | LRVHVGANQ |
| | | NAIRMISDQRANLGA | AIRMISDQR |
| | | SQASWTLRVHVGANQ | QASWTLRVH |
| | HLA-DRB3*0101 | None | |
| | HLA-DRB4*0101 | EVEKVLVRMKELAVQ | VEKVLVRMK |
| | | VEKVLVRMKELAVQS | VRMKELAVQ |
| | | EKVLVRMKELAVQSG | VRMKELAVQ |
| | | KVLVRMKELAVQSGN | VRMKELAVQ |
| | | VLVRMKELAVQSGNG | VRMKELAVQ |
| | | ENAIRMISDQRANLG | IRMISDQRA |
| | | NAIRMISDQRANLGA | IRMISDQRA |
| | | VRMKELAVQSGNGTY | VRMKELAVQ |
| | | LVRMKELAVQSGNGT | VRMKELAVQ |
| | | AIRMISDQRANLGAF | ISDQRANLG |
| | | IRMISDQRANLGAFQ | ISDQRANLG |
| | HLA-DRB5*0101 | NTSLAKIENAIRMIS | AKIENAIRM |
| | | TSLAKIENAIRMISD | AKIENAIRM |
| | | DANTSLAKIENAIRM | LAKIENAIR |
| | | ANTSLAKIENAIRMI | AKIENAIRM |
| | | SLAKIENAIRMISDQ | AKIENAIRM |
| NP_212463.1 oligopeptide ABC transporter, periplasmic oligopeptide-binding protein (oppA-2) [Borrelia burgdorferi B31] SEQ ID NO:24, SEQ ID NO:136269-137092 | HLA-DRB1*0101 | LTFLSIFTQGYTQFS | FLSIFTQGY |
| | | TFLSIFTQGYTQFSS | FTQGYTQFS |
| | | FLSIFTQGYTQFSSH | FTQGYTQFS |
| | | LSIFTQGYTQFSSHN | FTQGYTQFS |
| | | SIFTQGYTQFSSHNY | FTQGYTQFS |
| | | DNVKIRKALTLAIDR | IRKALTLAI |
| | | LDNVKIRKALTLAID | IRKALTLAI |
| | | PLDNVKIRKALTLAI | VKIRKALTL |
| | | VRQSFIPVPVHVTEK | FIPVPVHVT |
| | | NVKIRKALTLAIDRE | IRKALTLAI |
| | | VKIRKALTLAIDRET | IRKALTLAI |
| | | MLVRQSFIPVPVHVT | RQSFIPVPV |
| | | LVRQSFIPVPVHVTE | FIPVPVHVT |
| | | RQSFIPVPVHVTEKY | FIPVPVHVT |
| | | QSFIPVPVHVTEKYG | FIPVPVHVT |
| | | IFTQGYTQFSSHNYS | FTQGYTQFS |
| | | TMFRGIVTGDPNTGG | IVTGDPNTG |
| | | FTQGYTQFSSHNYSN | FTQGYTQFS |
| | | DTMFRGIVTGDPNTG | FRGIVTGDP |
| | | FRGIVTGDPNTGGNK | IVTGDPNTG |
| | | MFRGIVTGDPNTGGN | IVTGDPNTG |
| | | SLELFNPEIAKTLLA | FNPEIAKTL |
| | | LELFNPEIAKTLLAE | FNPEIAKTL |
| | | KSLELFNPEIAKTLL | FNPEIAKTL |
| | | AKSLELFNPEIAKTL | LFNPEIAKT |
| | | KIRKALTLAIDRETL | IRKALTLAI |
| | | ITFYTTNDSSTAYKM | YTTNDSSTA |

Fig. 34 continued

| | | EKIDENYTTNDSSTAY | YTTNDSSTA |
| | | FTFYTTNDSSTAYK | YTTNDSSTA |
| | | IRKALTLALDRETLT | IRKALTLA |
| | | FLFNPETARTLLAEA | FNPETARTL |
| | | SFIPVPVHVIEKYGQ | FIPVPVHVT |
| | | LEKTTFYTTNDSSTA | TFYTTNDS |
| | | TFYTTNDSSTAYKMY | YTTNDSSTA |
| | | FIPVPVHVTFKYGQN | FIPVPVHVT |
| | | RGTVTGPPTTGGNEP | VTGPPNTG |
| | | TSPENMVTSGPFKLR | MVTSGPFKL |
| | | REKITWSDGVATTAE | TWSDGVAT |
| | | LREITWSDGVATTA | TWSDGVAT |
| | | EKITWSDGVATTAEG | TWSDGVAT |
| | | YKVLDNGTTPTRRAT | LDNGTTPTR |
| | | DAIFGSIPPDLTKNL | FGSIPPDLT |
| | | KITWSDGVATTAEGI | TWSDGVAT |
| | | PYFIDMLVHQSFIPV | FIDMLVHQS |
| | | PENMVTSGPFKLKER | MVTSGPFKL |
| | | LDAIFGSIPPDLTKN | FGSIPPDLT |
| | | TYKVLDNGTTPTRRA | LDNGTTPTR |
| | | TKPLDNVETRKALTL | TKPLDNVKT |
| | | KPYFIDMLVEQSFIP | FIDMLVHQS |
| | | SPENMVTSGPFKLKE | MVTSGPFKL |
| | | ELDAIFGSIPPDLIK | FGSIPPDLT |
| | | EELDAIFGSIPPDLT | IFGSIPPDL |
| | | ITWSDGVATAEGIR | ITWSDGVAT |
| | | WSDGVATTAEGIRKS | GVATTAEGI |
| | | LTYKVLDNGTTPTRR | VLDNGTTPT |
| | | GQNWTSPENMVTSGP | VTSPENMVT |
| | | TLTYKVLDNGTTPTR | YKVLDNGTT |
| | | SDGVATTAEGIRKSY | TTAEGIRKS |
| | | FKPYFIDMLVEQSFI | FIDMLVHQS |
| | | WTSPENMVTSGPFKL | WTSPENMVT |
| | | LFNPETARTLLAEAG | FNPETARTL |
| | | SPKPYFIDMLVEQSF | FIDMLVHQS |
| | | QNWTSPENMVTSGPF | WTSPENMVT |
| | | NTHIKPLDNVKTRKA | IKPLDNVKT |
| | | THIKPLDNVKIRKAL | IKPLDNVKI |
| | | ENMVTSGPFKLKERT | MVTSGPFKL |
| | | AIFGSIPPDLIKNLK | FGSIPPDLT |
| | | FNPETARTLLAFAGY | FNPETARTL |
| | | ESPKPYFIDMLVHQS | YFIDMLVHQ |
| | | PDLTKNLKLRSDYYS | TKNLKLRSD |
| | | KPLDNVKIRKALTLA | VKIRKALTL |
| | | EKYGQNWTSPENMVT | GQNWTSPEN |
| | | KYGQNWTSPENMVTS | WTSPENMVT |
| | | VSFKISLGAFPSSLD | FKISLGAFP |
| | | GVATTAEGTRKSYLR | TTAEGTRKS |
| | | DLTKNLKLRSDYYSS | TKNLKLRSD |
| | | DGVATTAEGIRKSYL | TTAEGIRKS |
| | | PETARTLLAFAGYPY | ARTLLAFAG |
| | | YGQNWTSPENMVTSG | WTSPENMVT |
| | | ETARTLLAFAGYPKG | ARTLLAFAG |
| | | LKLRSDYYSSAVKAT | LKLRSDYYS |
| | | FNTHIKPLDNVKIRK | IKPLDNVKT |
| | | YAFNIHIKPLDNVKT | FNTHIKPLD |
| | | AFNIHIKPLDNVKIR | IKPLDNVKI |

Fig. 34 continued

| | |
|---|---|
| KVLDNGTTPRRATF | LDNGTTPR |
| NLRKITWSDQVAIT | ITWSDQVAT |
| KKLQRSLFLISFLT | MKLQRSLFL |
| SIVTQDPNTGGNKPC | IVTQDPNTG |
| SFKISLGAEPSSLDP | LGAEPSSLD |
| FNLRFKITWSDQVAT | LRFKITWSD |
| NFRKTTYLNTRANGN | RTTYLNTKA |
| FRKTTYLNTKANGN | YLNTKANGN |
| IAPIYTGNSYLFRN | YTYGNSYLF |
| KLRSDYYSSAVNAIY | YYSSAVNAT |
| FIDMLVHQSFTPVPV | FIDMLVHQS |
| FTLTYKVLDNGTTPT | YKVLDNGTT |
| LRSDYYSSAVNAIYF | YYSSAVNAT |
| APIYTGNSYLFRND | YTYGNSYLF |
| YFIDMLVHQSFTPVP | FIDMLVHQS |
| RSDYYSSAVNAIYFY | YYSSAVNAT |
| FKISLGAEPSSLDPG | LGAEPSSLD |
| VATTAEGIRKSYLRF | TTAEGIRKS |
| SDYYSSAVNATYFYA | YYSSAVNAT |
| TGDYADPLTFLSTFT | YADPLTFLS |
| AGWIGDYADPLTFLG | IGDYADPLT |
| PLYTGNSYLFRNDK | YTYGNSYLF |
| FYTTNDSSTAYKMYE | YTTNDSSTA |
| GDYADPLTFLSTFTQ | YADPLTFLS |
| GNIGDYADPLTFLST | YADPLTFLS |
| SLFPDLIKNLKLRSD | LIKNLKLRS |
| YADPLTFLSTFTQGY | YADPLTFLS |
| LFPDLIKNLKLRSDY | IKNLKLRSD |
| IKVTGSFKISLGAFP | IVTGSFKL |
| LPFLAKTLLAEAGYP | AKTLLAEAG |
| LIKNLKLRSDYYSSA | LKLRSDYYS |
| LFPDLIKNLKLRSDYY | IKNLKLRSD |
| VLDNGTTPRRATFN | NGTTPRRA |
| WIGDYADPLTFLSTF | YADPLTFLS |
| ISLGAEPSSLDPQLA | LGAEPSSLD |
| AITAEGIRKSYLRIL | ITAEGIRKS |
| TTAEGIRKSYLRFLN | TTAEGIRKS |
| KISLGAEPSSLDFQL | LGAEPSSLD |
| YTTNDSSTAYKMYFN | YTTNDSSTA |
| GVSFKISLGAEPSSL | FKISLGAEP |
| LAKGWDISSDGTVYT | GWDISSDGT |
| IKNLKLRSDYYSSAV | LKLRSDYYS |
| FKDFPIAPIYTGNS | FPIAPIYTY |
| IVTGDPNTGGNKPGL | IVTGDPNTG |
| PLTFLSTFTQGYTQF | FLSTFTQGY |
| FKDFPIAPIYTGN | FPIAPIYTY |
| AKGWDISSDGTVYTF | ISSDGTVYT |
| GWDISSDGTVYTFNL | ISSDGTVYT |
| RGVSFKISLGAEPSS | FKISLGAEP |
| TAKTTLAEAGYPNGN | AKTLLAEAG |
| KGWDISSDGTVYTFN | ISSDGTVYT |
| FRTTYLNTRANGNYF | YLNTKANGN |
| HIKPLDNVRTRNALT | KPLDNVRT |
| NWTSPRNMVTSGPFK | TSPRNMVT |
| EGIRKSYLRFLNKFT | IRKSYLRFL |
| AKTLLAEAGYPNGNG | AKTLLAEAG |
| WDISSDGTVYTFNLR | ISSDGTVYT |

Fig. 34 continued

| | | | |
|---|---|---|---|
| | | KEGVFKISLGAEPS | FKISLGAEP |
| | | UTTYLNTKANGNYFT | YLNTKANGN |
| | | LDKGITFTRRATPNF | NGTTFIRRA |
| | | KIDTMFRQTVTGDPN | FRQTVTGDP |
| | | ADPLTFLSIFTQGYT | FLSIFTQGY |
| | | FPTAPTYTGNSYLF | TAPTYTGN |
| | | KMIDTMFRQTVTGDP | DTMFRQTVT |
| | | TTEKDFPTAPTYTG | FPTAPTYT |
| | | TTEKDFPTAPTYTY | DFPTAPTYT |
| | | PKFSSYSYAKSLFLF | YSYAKSLFL |
| | | DPLTFLSIFTQGYTQ | FLSIFTQGY |
| | | TPKFSSYSYAKSLFL | FSSYSYAKS |
| | | TFGSTPPDLTKNLKL | FGSTPPDL |
| | | PTAPTYTGNSYLFR | YTGNSYLF |
| | | KDFPTAPTYTGNSY | FPTAPTYT |
| | | TYTGNSYLFRNDKW | GNSYLFRN |
| | | TDTMFRQTVTGDPNT | FRQTVTGDP |
| | | FSSYSYAKSLFLFNP | YSYAKSLFL |
| | | NFSSYSYAKSLFLFN | YSYAKSLFL |
| | | YAKSLFLFNPFTAKT | YAKSLFLFN |
| | | MVTSGPFFLKFRTPV | MVTSGPFFL |
| | | NDKWTGWNTHILERF | WTGWNTHIL |
| | | DKWTGWNTHILERFD | GTGWNTHIL |
| | | DYYSSAVNALSFYAF | YYSSAVNAL |
| | | SSYSYAKSLFLFNPF | YSYAKSLFL |
| | | TTYLNTKANGNYETA | YLNTKANGN |
| | | YTYGNSYLFRNDKWT | GNSYLFRN |
| | | FGSTPPDLTKNLKR | FGSTPPDL |
| | | SKYVEMVKSVIKSG | VEMVKSVIK |
| | | IRKSYLRILNKETGC | YLRILNKET |
| | | TLEITLESPKPYFI | LESPKPYFI |
| | | GSKYVEMVKSVIKNG | VEMVKSVIK |
| | | KTLEITLESPKPYFI | ITLESPKPY |
| | | GIRKSYLRILNKETG | IRKSYLRIL |
| | | EELDALFGSIPPDL | LEALFGSIP |
| | | IDMLVHQSFTPVPVH | LVHQSFTPV |
| | | DMLVHQSFTPVPVHV | LVHQSFTPV |
| | | YYSSAVNALSFYAPY | YSSAVNAL |
| | | TLKLKYNTNFANKKT | YNTNFANKK |
| | | GLGAEPSSLDPQLAE | LGAEPSSLD |
| | | DFPTAPTYTGNSYL | TAPTYTGN |
| | | LKLKYNTNFANKKTG | YNTNFANKK |
| HLA-DRB1*0301 | | None | |
| HLA-DRB1*0401 | | RIPNEKYVFEKNNKY | RIPNEKYVF |
| | | IPNEKYVFEKNNKYY | YVFEKNNKY |
| | | PNEKYVFEKNNKYYD | YVFEKNNKY |
| | | NEKYVFEKNNKYYDS | YVFEKNNKY |
| | | EKYVFEKNNKYYDSN | YVFEKNNKY |
| | | ESPKPYFIDMLVHQS | YFIDMLVHQ |
| | | SPKPYFIDMLVHQSF | YFIDMLVHQ |
| | | KPYFIDMLVHQSFTP | YFIDMLVHQ |
| | | PKPYFIDMLVHQSFT | YFIDMLVHQ |
| | | LESPKPYFIDMLVHQ | PYFIDMLVH |
| | | KYVFEKNNKYYDSNE | YVFEKNNKY |
| | | YVFEKNNKYYDSNEV | YVFEKNNKY |
| | | PYFIDMLVHQSFTPV | YFIDMLVHQ |
| | | YFIDMLVHQSFTPVP | YFIDMLVHQ |

Fig. 34 continued

|  |  |  |  |
|---|---|---|---|
|  |  | LDPIKRQDILRQALL | IKRQDILRQ |
|  |  | DLELDPTKRQDTLRQ | DLELDPTKR |
|  |  | LLDPIKRQDILRQAE | IKRQDILRQ |
|  |  | LELDPTKRQDTLRQA | TKRQDTLRQ |
|  |  | DPIKRQDILRQAEEI | IKRQDILRQ |
|  |  | RKITFYTTNDSSTAY | YTTNDSSTA |
|  |  | LRKITFYTTNDSSTA | ITFYTTNDS |
|  |  | KITFYTTNDSSTAYK | YTTNDSSTA |
|  |  | ITFYTTNDSSTAYKE | YTTNDSSTA |
|  |  | KLRSDYYSSAVNATY | YSSAVNAT |
|  |  | LRSDYYSSAVNATYF | YSSAVNAT |
|  | HLA-DRB1*0404 | ITFLSTFTQGYTQPS | FLSTFTQGY |
|  |  | ADPLTFLSTFTQGYT | FLSTFTQGY |
|  |  | RKSYLRTLNKETCSK | YLRTLNKET |
|  |  | KSYLRTLNKETCSKY | TLNKETCSK |
|  |  | YADPLTFLSTFTQGY | PLTFLSTFT |
|  |  | VNATYFYAFNTHTKP | YFYAFNTHT |
|  |  | DPLTFLSTFTQGYTQ | FLSTFTQGY |
|  |  | ATYFYAFNTHTKPLD | YFYAFNTHT |
|  |  | AVNATYFYAFNTHTK | YFYAFNTHT |
|  |  | NATYFYAFNTHTKPL | YFYAFNTHT |
|  |  | PLTFLSTFTQGYTQP | FLSTFTQGY |
|  |  | SAVNATYFYAFNTHT | YFYAFNTH |
|  |  | CYLRTLNKETCSKYV | TLNKETCSK |
|  | HLA-DRB1*0405 | VTEKYGQNWTSPERK | GQNWTSPE |
|  |  | HVTEKYGQNWTSPER | YGQNWTSPE |
|  |  | TEKYGQNWTSPERKV | GQNWTSPE |
|  |  | EKYGQNWTSPERKVT | GQNWTSPE |
|  |  | KYGQNWTSPERKVTS | GQNWTSPE |
|  |  | RNDKWTGWNTNLLER | WTGWNTNLL |
|  |  | LFRNDKWTGWNTNLL | DKWTGWNTN |
|  |  | FRNDKWTGWNTNLLE | WTGWNTNLL |
|  |  | NDKWTGWNTNLLERF | WTGWNTNLL |
|  |  | DKWTGWNTNLLERFD | WTGWNTNLL |
|  |  | YGQNWTSPERMVTSG | GQNWTSPE |
|  |  | VSFKISLGAEPSSLD | VSFKISLGA |
|  |  | SFKISLGAEPSSLDP | LGAEPSSLD |
|  |  | FKISLGAEPSSLDPQ | LGAEPSSLD |
|  |  | ISLGAEPSSLDPQLA | LGAEPSSLD |
|  |  | KISLGAEPSSLDPQL | LGAEPSSLD |
|  |  | FNLREKITWSDGVAT | LREKITWSD |
|  |  | FLENFFTTYINTKA | NFFTTYIN |
|  |  | DVYFNLREKITWSD | YFNLRE |
|  |  | SLGAEPSSLDPQLAE | LGAEPSSLD |
|  |  | LGAEPSSLDPQLAEE | LGAEPSSLD |
|  |  | YFNLREKITWSDGV | LREKITWSD |
|  |  | LENFFTTYINTKAY | NFFTTYIN |
|  |  | FNLREKITWSDGVA | LREKITWSD |
|  |  | TYFYAFNTHTKPLD | FNTHTKPLD |
|  |  | VYFNLREKITWSDG | LREKITWSD |
|  |  | KWTGWNTNLLERFDL | WTGWNTNLL |
|  |  | ATYFYAFNTHTKPLD | FYAFNTHTK |
|  |  | FELDATFCSTPPELT | DATFCSTPP |
|  |  | FLDATFCSTPPDLTK | FCSTPPDLT |
|  |  | GQNWTSPERMVTSGF | GQNWTSPE |
|  |  | RFTQNQWKRKLNTRV | QQWKRKLN |

Fig. 34 continued

|  |  |  |  |
|---|---|---|---|
|  |  | ELEEITFYTTNDSST | ITFYTTNDS |
|  |  | VELENEEWTTYLNTK | NEEWTTYLN |
|  |  | LEEITFYTTNDSSTA | ITFYTTNDS |
|  |  | TDVELENEEWTTYLN | NEEWTTYL |
|  |  | DVELENEEWTTYLNT | NEEWTTYLN |
|  |  | LVHQSFTPVPVHVTE | HQSFTPVPV |
|  |  | MLVHQSFTPVPVHVT | HQSFTPVPV |
|  |  | EVELFFTTPYTTNDS | FITFYTTND |
|  |  | VELFFTTPYTTNDSS | ITFYTTNDS |
|  |  | FTQNGWKKNLNTDVE | QNGWKKNLN |
|  |  | LDAIFGSTPPDLTKN | FGSTPPDLT |
|  |  | WTGWNTNLLRFDLS | WTGWNTNL |
|  |  | DAIFGSTPPDLTKNL | FGSTPPDLT |
|  |  | YFYAFNHTKPLDYV | FNTHTKPLD |
|  |  | FYAFNHTKPLDYVF | FNTHTKPLD |
|  |  | ELITFYTTNDSSTAY | ITFYTTNDS |
|  |  | ENEEWTTYLNTKANG | NEEWTTYLN |
|  |  | NEEWTTYLNTKANGN | NEEWTTYLN |
|  | HLA-DRB1*0701 | LFRNDKWTGWNTNL | NDKWTGWT |
|  |  | FRNDKWTGWNTNLL | WTGWNTNL |
|  |  | RSDYYSSAVNATYFY | YYSSAVNAT |
|  |  | SDYYSSAVNATYFYA | YYSSAVNAT |
|  |  | KLRSDYYSSAVNATY | YYSSAVNAT |
|  |  | LRSDYYSSAVNATYF | YYSSAVNAT |
|  |  | NDKKIGWTNILLRF | WTGWNTNL |
|  |  | RNDKKIGWTNILLR | WTGWNTNL |
|  |  | PLDNVKIRKALTLAL | VKIRKALTL |
|  |  | DKWTGWTNLLERFD | WTGWNTNL |
|  |  | LDNVKIRKALTLALD | IRKALTLAL |
|  |  | DNVKIRKALTLALDR | IRKALTLAL |
|  |  | MLVHQSFTPVPVHVT | SFTPVPVHV |
|  |  | LVHQSFTPVPVHVTE | SFTPVPVHV |
|  |  | LKLRSDYYSSAVNAT | RSDYYSSAV |
|  |  | VHQSFTPVPVHVTEK | SFTPVPVHV |
|  |  | NVKIRKALTLALDRE | IRKALTLAL |
|  |  | HQSFTPVPVHVTEKY | SFTPVPVHV |
|  |  | VKIRKALTLALDRET | IRKALTLAL |
|  |  | DYYSSAVNATYFYAF | YYSSAVNAT |
|  |  | QSFTPVPVHVTEKYG | SFTPVPVHV |
|  |  | EKLQRSLFLLIFFLI | EKLQRSLFL |
|  | HLA-DRB1*0802 | PLDNVKIRKALTLAL | VKIRKALTL |
|  |  | LDNVKIRKALTLALD | IRKALTLAL |
|  |  | DNVKIRKALTLALDR | IRKALTLAL |
|  |  | NVKIRKALTLALDRE | IRKALTLAL |
|  | HLA-DRB1*0901 | None |  |
|  | HLA-DRB1*1101 | SDGIVYTFNLREKI | YTFNLREKI |
|  |  | GIVYTFNLREKIWG | YTFNLREKI |
|  |  | DGIVYTFNLREKITW | YTFNLREKI |
|  |  | SSDGIVYTFNLREKI | GIVYTFNLR |
|  |  | VYTFNLREKITWGG | YTFNLREKI |
|  |  | SGPFKLKERIPNEKY | FKLKERIPN |
|  |  | MVTSGPFKLKERIPN | VTSGPFKLK |
|  |  | VTSGPFKLKERIPNE | FKLKERIPN |
|  |  | GPFKLKERIPNEKYV | FKLKERIPN |
|  |  | TSGPFKLKERIPNEK | FKLKERIPN |
|  | HLA-DRB1*1302 | SKYVEMVKSVTKYGQ | VEMVKSVTK |

Fig. 34 continued

| | | | |
|---|---|---|---|
| | | KYVEMVKSVIKNGQK | VKSVIKNGQ |
| | | EMVKSVIKNGQKYF | VKSVIKNGQ |
| | | YVEMVKSVIKNGQKY | VKSVIKNGQ |
| | | ETLTYKVLDNGTTPT | YKVLDNGTT |
| | | TLTYKVLDNGTTPTR | VLDNGTTPT |
| | | LTYKVLDNGTTPTRR | VLDNGTTPT |
| | | VEMVKSVIKNGQKYF | VKSVIKNGQ |
| | | PDLIKNIKLRSDYYS | IKNIKLRS |
| | | STPPDLIKNIKLRSD | LIKNIKLRS |
| | | TPPDLIKNIKLRSDY | LIKNIKLRS |
| | | PPDLIKNIKLRSDYY | LIKNIKLRS |
| | | TYKVLDNGTTPTRRA | VLDNGTTPT |
| | | YKVLDNGTTPTRRAT | VLDNGTTPT |
| | | NEKRTQYNTNIERF | NTQYNTNI |
| | | DKWTQYNTNIERFD | YNTNIERF |
| | | KSYLRILNKETGSKY | LRILNKETG |
| | | DLIKNIKLRSDYYSS | IKNIKLRSD |
| | | SYLRILNKETGSKYV | LRILNKETG |
| | | MVKSVIKNGQKYFDG | VKSVIKNGQ |
| | | VKSVIKNGQKYFDGQ | VKSVIKNGQ |
| | | GSKYVEMVKSVIKNG | VEMVKSVIK |
| | | KWTQYNTNIERFDL | YNTNIERF |
| | | WTQYNTNIERFDLS | YNTNIERF |
| | | GSIPPDLIKNIKLRG | PPDLIKNLK |
| | | LIKNIKLRSDYYSSA | IKNIKLRS |
| | | TGSKYVEMVKSVIKN | VEMVKSVIK |
| | | ETGSKYVEMVKSVIK | YVEMVKSVI |
| | | KKLQRSLFLIIFFLT | LQRSLFLII |
| | | EFIQNQWKKNLNIDV | IQNQWKKNL |
| | | LQRSLFLIIFFLTF | LFLIIFFLT |
| | | YLRILNKETGSKYVE | LRILNKETG |
| | | RKSYLRILNKETGSK | LRILNKETG |
| | | IRKSYLRILNKETGS | LRILNKETG |
| | | LRILNKETGSKYVEM | LRILNKETG |
| | | GIRKSYLRILNKETG | YLRILNKET |
| | | WTSPENKVTSQPFKL | ENKVTSQPF |
| | | TSPENMVTSQPFKLK | MVTSQPFKL |
| | | IKPLDNVKIRKALTL | LDNVKIRKA |
| | | QRSLFIIFFIIFLG | IFLIIFFLT |
| | | FIQNQWKKNLNIDVE | IQNQWKKNL |
| | | RSLFLIIFFLTFLGG | LFLIIFFLT |
| | | KLQRSLFLIIFFLTF | LFLIIFFLT |
| | | IQNQWKKNLNIDVEL | IQNQWKKNL |
| | | TAPIYTYQNSYLFRN | IYTYQNSYL |
| | | APIYTYQNSYLFRND | YQNSYLFRN |
| | | PLDNVKIRKALTLAT | VKIRKALTL |
| | | SPENMVTSQPFKLRE | MVTSQPFKL |
| | | LDNVKIRKALTLATD | VKIRKALTL |
| | | PYFIDMLVHQSFIPV | FIDMLVHQS |
| | | TQYNTNIERFDLSQ | YNTNIERF |
| | | YAPNTETKPIDNVKT | PNTETKPID |
| | | KVLDNGTTPTRRATP | VLDNGTTPT |
| | | KPLDNVKIRKALTLA | VKIRKALTL |
| | | IKNIKLRSDYYSSAV | IKNIKLRSDYYS |
| HLA-DRB1*1501 | | RKSYLRILNKETGSK | LRILNKETG |
| | | KSYLRILNKETGSKY | LRILNKETG |
| | | SYLRILNKETGSKYV | LRILNKETG |

Fig. 34 continued

| | | | |
|---|---|---|---|
| | | GIRKSYLRILNKETG | YLRILNKET |
| | | IRKSYLRILNKETGS | LRILNKETG |
| | | YLRILNKETGSKYVE | LRILNKETG |
| | | LRILNKETGSKYVEM | LRILNKETG |
| | | PPDLIKNLKLRSDYY | IKNLKLRSD |
| | | PDLIKNLKLRSDYYS | IKNLKLRSD |
| | | DLIKNLKLRSDYYSS | IKNLKLRSD |
| | | SIPPDLIKNLKLRSD | DLIKNLKLR |
| | | IPPDLIKNLKLRSDY | IKNLKLRSD |
| | | LIKNLKLRSDYYSSA | IKNLKLRSD |
| | | IKNLKLRSDYYSSAV | IKNLKLRSD |
| | | GTVYTFNLREKITWG | VYTFNLREK |
| | | IAPIYIYGNSYLFRN | IYGNSYLFR |
| | | YGNSYLFRNDKWTGW | LFRNDKWTG |
| | | PIAPIYIYGNSYLFR | IYIYGNSYL |
| | HLA-DRB3*0101 | None | |
| | HLA-DRB4*0101 | FKLKERIPNEKYVFE | LKERIPNEK |
| | | PFKLKERIPNEKYVF | LKERIPNEK |
| | | GPFKLKERIPNEKYV | LKERIPNEK |
| | | SGPFKLKERIPNEKY | LKERIPNEK |
| | | TSGPFKLKERIPNEK | TSGPFKLKE |
| | | VNAIYFYAFNTHIKP | IYFYAFNTH |
| | | SAVNAIYFYAFNTHI | IYFYAFNTH |
| | | SSAVNAIYFYAFNTH | VNAIYFYAF |
| | | NAIYFYAFNTHIKPL | IYFYAFNTH |
| | | AVNAIYFYAFNTHIK | IYFYAFNTH |
| | | YFIDMLVHQSFIPVP | IDMLVHQSF |
| | | PYFIDMLVHQSFIPV | IDMLVHQSF |
| | | AIYFYAFNTHIKPLD | IYFYAFNTH |
| | | IYFYAFNTHIKPLDN | IYFYAFNTH |
| | | FIDMLVHQSFIPVPV | LVHQSFIPV |
| | | IDMLVHQSFIPVPVH | LVHQSFIPV |
| | | KLKERIPNEKYVFEK | LKERIPNEK |
| | | LKERIPNEKYVFEKN | LKERIPNEK |
| | | FLIIFFLTFLCCNNK | IFFLTFLCC |
| | | RSLFLIIFFLTFLCC | IIFFLTFLC |
| | | SLFLIIFFLTFLCCN | IFFLTFLCC |
| | HLA-DRB5*0101 | LTYKVLDNGTTPTRR | LDNGTTPTR |
| | | YKVLDNGTTPTRRAT | LDNGTTPTR |
| | | TYKVLDNGTTPTRRA | LDNGTTPTR |
| | | AKSLELFNPEIAKTL | LFNPEIAKT |
| | | KSLELFNPEIAKTLL | FNPEIAKTL |
| | | SLELFNPEIAKTLLA | FNPEIAKTL |
| | | LELFNPEIAKTLLAE | FNPEIAKTL |
| | | ELFNPEIAKTLLAEA | FNPEIAKTL |
| | | TLTYKVLDNGTTPTR | YKVLDNGTT |
| | | KVLDNGTTPTRRATP | LDNGTTPTR |
| | | KSYLRILNKETGSKY | ILNKETGSK |
| AAC44381.1\| outer membrane porin protein Oms28 precursor SEQ ID NO:25, SEQ ID NO:137093- | HLA-DRB1*0101 | VKKFVGSMSLMSDVA | FVGSMSLMS |
| | | GVVKKFVGSMSLMSD | FVGSMSLMS |
| | | VVKKFVGSMSLMSDV | FVGSMSLMS |
| | | KKFVGSMSLMSDVAK | FVGSMSLMS |
| | | AGVVKKFVGSMSLMS | AGVVKKFVG |
| | | FVGSMSLMSDVAKGT | FVGSMSLMS |
| | | KFVGSMSLMSDVAKG | FVGSMSLMS |

Fig. 34 continued

| | | | |
|---|---|---|---|
| | | KKDVRKAISNVVKVA | VRKAISNVV |
| | | AKCSCMVAECANKVV | MVAECANKV |
| | | VLAKKDVRKAISNVV | LAKKDVRKA |
| | | LAKKDVRKAISNVVK | VRKAISNVV |
| | | AKKDVRKAISNVVKV | VRKAISNVV |
| | | KDVRKAISNVVKVAQ | VRKAISNVV |
| | | KCSCMVAECANKVVE | MVAECANKV |
| | | CSCMVAECANKVVEK | MVAECANKV |
| | | VAKCSCMVAECANKV | CSCMVAECA |
| | | AKGTVVASQEATIVA | VASQEATIV |
| | | VAKGTVVASQEATIV | GTVVASQEA |
| | | KGTVVASQEATIVAK | VASQEATIV |
| | | GTVVASQEATIVAKC | VASQEATIV |
| | | SCMVAECANKVVEKC | MVAECANKV |
| | | ARDLTKVMATSLYKR | LTKVMATSL |
| | | TVVASQEATIVAKCS | VASQEATIV |
| | | ATIVAKCSCMVAECA | IVAKCSCKV |
| | | SQEATIVAKCSCMVA | IVAKCSCKV |
| | | EATIVAKCSCMVAEC | IVAKCSCKV |
| | | MSLMSDVAKGTVVAS | LMSDVAKGT |
| | | QEATIVAKCSCMVAE | IVAKCSCKV |
| | | TQKAVSVAGEATF

| | | | |
|---|---|---|---|
| | | EVKETLMASERALDE | ETLMASERA |
| | | FSNLTNGLLFCFVS | TNGLLFCFV |
| | | IFSNLLTNGLLFCFV | LTNGLLFCFV |
| | | ANKVVKMSKKAVQET | VVKMSKKAV |
| | | KILKPQSNVLHSDQ | LKPQSNVLH |
| | | NKVVKMSKKAVQETQ | MSKKAVQET |
| | | NGLLFCFVSLNVFAD | LFCFVSLNV |
| | | GLLFCFVSLNVFADS | LFCFVSLNV |
| | | SVAGEATFLTKKQTK | VAGEATFLT |
| | | SNLTNGLLFCFVSL | TNGLLFCFV |
| | | DSNNANTLKPQSNVL | ANTLKPQSN |
| | | VVKMSKKAVQETQKA | MSKKAVQET |
| | | NLTTNGLLFCFVSLN | TNGLLFCFV |
| | | KVVKMSKKAVQETQK | MSKKAVQET |
| | | VAGEATFLTKKQTKL | VAGEATFLT |
| | | TSNVVKVAQGARDLT | VKVAQGARD |
| | | QETQKAVSVAGEATF | TQKAVSVAG |
| | | DEVKETLMASERALD | ETLMASERA |
| | | SNVVKVAQGARDLTK | VKVAQGARD |
| | | VQETQKAVSVAGEAT | TQKAVSVAG |
| | | NVVKVAQGARDLTKV | VKVAQGARD |
| | | VDLVKETLMASERAL | ETLMASERA |
| | | QKVLHMVNGLNPSKK | MVNGLNPSN |
| | | LTEKQLKLNKSPNNK | LKLNKSPNN |
| | | KAVQETQKAVSVAGE | TQKAVSVAG |
| | | KKAVQETQKAVSVAG | QETQKAVSV |
| | | KVDEVKETLMASERA | VKETLMASE |
| | | VKMSKKAVQETQKAV | MSKKAVQET |
| | | AVQETQKAVSVAGEA | TQKAVSVAG |
| | | KVLHMVNGLNPSNKE | MVNGLNPSN |
| | | SKLEGVRESSLELVE | VRESSLELV |
| | | SSKLEGVRESSLELV | LEGVRESSL |
| | | KETLMASERALDETV | ETLMASERA |
| | | LEGVRESSLELVESX | VRESSLELV |
| | | VLHMVNGLNPSNKEQ | MVNGLNPSN |
| | | KLEGVRESSLELVES | VRESSLELV |
| | | ATSNVVKVAQGARDL | VKVAQGARD |
| | | ETQKAVSVAGEATFL | TQKAVSVAG |
| | | TLKPQSNVLHSDQK | TLKPQSNVL |
| | | ETLMASERALDETVQ | ETLMASERA |
| | | LHMVNGLNPSNKQV | MVNGLNPSN |
| | | AQKVLHMVNGLNPSN | VLHMVNGLN |
| | HLA-DRB1*0301 | None | |
| | HLA-DRB1*0401 | AGVVKKFVGSMSLKS | VKKFVGSMS |
| | | GVVKKFVGSMSLKSD | FVGSMSLKS |
| | | VVKKFVGSMSLKSDV | FVGSMSLKS |
| | | KKFVGSMSLKSDVAK | FVGSMSLKS |
| | | VKKFVGSMSLKSDVA | FVGSMSLKS |
| | | KFVGSMSLKSDVAKG | FVGSMSLKS |
| | | FVGSMSLKSDVAKGT | FVGSMSLMS |
| | | LAKKDVRKATSNVVK | VRKATSNVV |
| | | VLAKKDVRKATSNVV | AKKDVRKAT |
| | | KDVRKATSNVVKVAQ | VRKATSNVV |
| | | AKKDVRKATSNVVKV | VRKATSNVV |
| | | KKDVRKATSNVVKVA | VRKATSNVV |
| | | MTKTFSNLTNGLLF | MTKTFSNLT |
| | | TNGLLFCFVSLNVFA | LFCFVSLNV |

Fig. 34 continued

| | | | |
|---|---|---|---|
| | | NGLLFGFVSLNVFAD | LFGFVSLNV |
| | | GLLFGFVSLNVFADS | LFGFVSLNV |
| | HLA-DRB1*0404 | QKVLNMVNGLNPSNK | VLNMVNGLN |
| | | EAQKVLNMVNGLNPS | VLNMVNGLN |
| | | QEAQKVLNMVNGLNP | VLNMVNGLN |
| | | AQKVLNMVNGLNPSN | VLNMVNGLN |
| | | VQEAQKVLNMVNGLN | QKVLNMVNG |
| | | KVLNMVNGLNPSNKD | VLNMVNGLN |
| | | VLNMVNGLNPSNKDQ | VLNMVNGLN |
| | | LTTNGLLFGFVSLNV | LLFGFVSLN |
| | | TNGLLFGFVSLNVFA | LFGFVSLNV |
| | | NGLLFGFVSLNVFAD | LFGFVSLNV |
| | | TTNGLLFGFVSLNVF | LFGFVSLNV |
| | | TEKQTMLNKSPNNKE | TMLNKSPNN |
| | | LTEKQTMLNKSPNNK | TMLNKSPNN |
| | | EKQTMLNKSPNNKEL | TMLNKSPNN |
| | | KQTMLNKSPNNKELE | TMLNKSPNN |
| | | GLLFGFVSLNVFADS | LFGFVSLNV |
| | HLA-DRB1*0405 | TEKQTMLNKSPNNKE | TMLNKSPNN |
| | | EKQTMLNKSPNNKEL | LNKSPNNKE |
| | | KQTMLNKSPNNKELE | LNKSPNNKE |
| | | QTMLNKSPNNKELEL | LNKSPNNKE |
| | | TMLNKSPNNKELELT | LNKSPNNKE |
| | | LNKSPNNKELELTKE | LNKSPNNKE |
| | | MLNKSPNNKELELTK | LNKSPNNKE |
| | HLA-DRB1*0701 | VLAKKDVRKAISNVV | VLAKKDVRK |
| | | AKKDVRKAISNVVKV | VRKAISNVV |
| | | KKDVRKAISNVVKVA | VRKAISNVV |
| | | LAKKDVRKAISNVVK | VRKAISNVV |
| | | KDVRKAISNVVKVAQ | VRKAISNVV |
| | | DVRKAISNVVKVAQG | VRKAISNVV |
| | | VRKAISNVVKVAQGA | VRKAISNVV |
| | HLA-DRB1*0802 | None | |
| | HLA-DRB1*0901 | KDVRKAISNVVKVAQ | VRKAISNVV |
| | | KKDVRKAISNVVKVA | VRKAISNVV |
| | | AKKDVRKAISNVVKV | VRKAISNVV |
| | | LAKKDVRKAISNVVK | VRKAISNVV |
| | | VLAKKDVRKAISNVV | AKKDVRKAI |
| | | VVKKFVGSMSLKSDV | FVGSMSLKS |
| | | AGVVKKFVGSMSLKS | KKFVGSMSL |
| | | GVVKKFVGSMSLKSD | FVGSMSLKS |
| | HLA-DRB1*1101 | None | |
| | HLA-DRB1*1302 | TKTFSNLTTNGLLFG | FSNLTTNGL |
| | | KTFSNLTTNGLLFGF | FSNLTTNGL |
| | | TFSNLTTNGLLFGFV | FSNLTTNGL |
| | | FSNLTTNGLLFGFVS | FSNLTTNGL |
| | | MTKTFSNLTTNGLLF | FSNLTTNGL |
| | | EAQKVLNMVNGLNPS | LNMVNGLNP |
| | | AQKVLNMVNGLNPSN | LNMVNGLNP |
| | | QEAQKVLNMVNGLNP | KVLNMVNGL |
| | | QKVLNMVNGLNPSNK | LNMVNGLNP |
| | | KVLNMVNGLNPSNKD | LNMVNGLNP |
| | | KDVRKAISNVVKVAQ | VRKAISNVV |
| | | VLNMVNGLNPSNKDQ | LNMVNGLNP |
| | | GLLFGFVSLNVFADS | FGFVSLNVF |

Fig. 34 continued

| | | | |
|---|---|---|---|
| | | IEKQTMLNKSPNNKL | MLNKSPNNK |
| | | EKQTMLNKSPNNKEL | MLNKSPNNK |
| | | DVRKAISNVVKVAQG | ISNVVKVAQ |
| | | VRKAISNVVKVAQGA | ISNVVKVAQ |
| | | LLFGFVSLNVFADSN | FGFVSLNVF |
| | | LTEKQTMLNKSPNNK | QTMLNKSPN |
| | | NGLLFGFVSLNVFAD | FGFVSLNVF |
| | | SNLTTNGLLFGFVSL | TTNGLLFG |
| | | KAISNVVKVAQGARD | ISNVVKVAQ |
| | | VQFAQKVLNMVNGLN | KVLNMVNGL |
| | | TNGLLFGFVSLNVF | TNGLLFGF |
| | | KQTMLNKSPNNKELE | MLNKSPNNK |
| | | QTMLNKSPNNKELEL | MLNKSPNNK |
| | | GVVKKFVGSMSLMSD | VKKFVGSMS |
| | | TNGLLFGFVSLNVFA | FGFVSLNVF |
| | | RKAISNVVKVAQGAR | ISNVVKVAQ |
| | | ARDLTKVMAISLYKR | TKVMAISLY |
| | | LFGFVSLNVFADSN | FGFVSLNVF |
| | | LNMVNGLNPSNKEQV | LNMVNGLNP |
| | | FGFVSLNVFADSNIA | FGFVSLNVF |
| | | AGVVKKFVGSMSLMS | VKKFVGSMS |
| | | ISNVVKVAQGARDLT | ISNVVKVAQ |
| | | DAGVVKKFVGSMSLM | VKKFVGSMS |
| | | DDAGVVKKFVGSMSL | VKKFVGSMS |
| | | SNDAGVVKKFVGSMS | AGVVKKFVG |
| | | VVKKFVGSMSLMSDV | VKKFVGSMS |
| | | VKKFVGSMSLMSDVA | VKKFVGSMS |
| | | AISNVVKVAQGARDL | ISNVVKVAQ |
| | | TTTNGLLFGFVSLN | TTNGLLFG |
| | | GARDLTKVMAISLYK | TKVMAISLY |
| | | KKDVRKAISNVVKVA | VRKAISNVV |
| | | TMLNKSPNNKELELT | MLNKSPNNK |
| | | QGARDLTKVMAISLY | LTKVMAISL |
| HLA-DRB1*1501 | | ARDLTKVMAISLYKR | KVMAISLYK |
| | | TNGLLFGFVSLNVFA | LFGFVSLNV |
| | | TTNGLLFGFVSLNVF | LFGFVSLNV |
| | | NGLLFGFVSLNVFAD | LFGFVSLNV |
| | | GLLFGFVSLNVFADS | LFGFVSLNV |
| | | LTTNGLLFGFVSLNV | TNGLLFGFV |
| | | VLAKKDVRKAISNVV | VLAKKDVRK |
| | | LLFGFVSLNVFADSN | LFGFVSLNV |
| | | LFGFVSLNVFADSNI | LFGFVSLNV |
| | | LAKKDVRKAISNVVK | VRKAISNVV |
| | | KKDVRKAISNVVKVA | VRKAISNVV |
| | | AKKDVRKAISNVVKV | VRKAISNVV |
| | | KDVRKAISNVVKVAQ | VRKAISNVV |
| | | QKVLNMVNGLNPSNK | VLNMVNGLN |
| | | AGVVKKFVGSMSLMS | VKKFVGSMS |
| | | GVVKKFVGSMSLMSD | FVGSMSLMS |
| | | LTEKQTMLNKSPNNK | TMLNKSPNN |
| | | KVLNMVNGLNPSNKE | VNGLNPSNK |
| | | TEKQTMLNKSPNNKE | MLNKSPNNK |
| | | EKQTMLNKSPNNKEL | MLNKSPNNK |
| | | KQTMLNKSPNNKELE | MLNKSPNNK |
| | | VLNMVNGLNPSNKEQ | VNGLNPSNK |
| | | VVKKFVGSMSLMSDV | FVGSMSLMS |
| | | QTMLNKSPNNKELEL | MLNKSPNNK |

Fig. 34 continued

| | | VKKEVGSMSLMSDVA | FVGSMSLMS |
|---|---|---|---|
| | HLA-DRB3*0101 | None | |
| | HLA-DRB4*0101 | LIEKQIMLNKSPNNK | LIEKQIMLN |
| | | EKQIMLNKSPNNKEL | MLNKSPNNK |
| | | IEKQIMLNKSPNNKE | MLNKSPNNK |
| | | KQIMLNKSPNNKELE | MLNKSPNNK |
| | | QIMLNKSPNNKELEL | MLNKSPNNK |
| | | IMLNKSPNNKELELT | MLNKSPNNK |
| | | MLNKSPNNKELELTK | MLNKSPNNK |
| | HLA-DRB5*0101 | IEKQIMLNKSPNNKE | MLNKSPNNK |
| CAA49829.1\| p93 [Borrelia burgdorferi] SEQ ID NO:26, SEQ ID NO:137571-138312 | HLA-DRB1*0101 | IDPITNLGTLQLIDL | ITNLGTLQL |
| | | LEVIDPITNLGTLQL | VIDPITNLG |
| | | EVIDPITNLGTLQLI | ITNLGTLQL |
| | | VIDPITNLGTLQLID | ITNLGTLQL |
| | | DPITNLGTLQLIDLN | ITNLGTLQL |
| | | DYYKGFYIEPALKSL | FYIEPALKS |
| | | YKGFYIEPALKSLTK | FYIEPALKS |
| | | YYKGFYIEPALKSLT | FYIEPALKS |
| | | KGFYIEPALKSLTKE | FYIEPALKS |
| | | LDYYKGFYIEPALKS | YKGFYIEPA |
| | | ITNLGTLQLIDLNTG | ITNLGTLQL |
| | | PITNLGTLQLIDLNT | ITNLGTLQL |
| | | EKLKDFVNMDLEFVN | FVNMDLEFV |
| | | LKDFVNMDLEFVNYK | FVNMDLEFV |
| | | KDFVNMDLEFVNYKG | FVNMDLEFV |
| | | KLKDFVNMDLEFVNY | FVNMDLEFV |
| | | KEKLKDFVNMDLEFV | KEKLKDFVN |
| | | FLIFLNGFPLNARKV | FLNGFPLNA |
| | | LIFLNGFPLNARKVD | FLNGFPLNA |
| | | DELKNLVILDVNTLK | LKNLVILDV |
| | | QDELKNLVILDVNTL | LKNLVILDV |
| | | EEEITKGKSRASLGD | ITKGKSRAS |
| | | LQDELKNLVILDVNT | LKNLVILDV |
| | | KEEEITKGKSRASLG | ITKGKSRAS |
| | | EEITKGKSRASLGD | ITKGKSRAS |
| | | YLQDELKNLVILDVN | LKNLVILDV |
| | | VKEEEITKGKSRASL | ITKGKSRAS |
| | | EFLARPLTNSNSNSS | FLARPLTNS |
| | | IYLQDELKNLVILDV | IYLQDELKN |
| | | KVKEEEITKGKSRAS | EITKGKSRA |
| | | IGEFLARPLTNSNSN | FLARPLTNS |
| | | GEFLARPLTNSNSNS | FLARPLTNS |
| | | FLARPLTNSNSNSSY | LTNSNSNSS |
| | | FFLIFLNGFPLNARK | FLNGFPLNA |
| | | VGIGEFLARPLTNSN | FLARPLTNS |
| | | GIGEFLARPLTNSNS | FLARPLTNS |
| | | SFFLIFLNGFPLNAR | FLNGFPLNA |
| | | GFYIEPALKSLTKEN | FYIEPALKS |
| | | FYIEPALKSLTKENA | FYIEPALKS |
| | | NFEINKNSSLYVDSK | INKNSSLYV |
| | | SNFEINKNSSLYVDS | INKNSSLYV |
| | | IVGIGEFLARPLTNS | IGEFLARPL |
| | | IFLNGFPLNARKVDK | FLNGFPLNA |
| | | ESNFEINKNSSLYVD | INKNSSLYV |
| | | SESNFEINKNSSLYV | EINKNSSLY |

| | | | |
|---|---|---|---|
| | | FEINKNSSLYVDSKM | LNKNSSLYV |
| | | LARPLTNSNSSYY | LTNSNSS |
| | | PGFSLLFLNGFPLNA | FFLLYLNGF |
| | | ARPLTNSNSNSSYYG | LTNSNSNSS |
| | | DFVNKDLEFVNYKGP | FVNKDLEFV |
| | | FVNKDLEFVNYKGPY | FVNKDLEFV |
| | | RPLTNSNSNSSYYGK | LTNSNSNSS |
| | | FLNGFPLNARKVDFE | FLNGFPLNA |
| | | LKNLVTLRVNTLRR | LKNLVTLRV |
| | | ELKNLVTLRVNTLRR | LKNLVTLRV |
| | | LVVTKMDSCKAKLQT | VTKMDSCKA |
| | | GLVVTKMDSCKAKLQ | VTKMDSCKA |
| | | DSTLNLRRTLTGYTT | TLNLRRTLT |
| | | LDSTLNLRRTLTGYT | TLNLRRTLT |
| | | EDLDKDLTTMSIDSS | DKDLTTMSI |
| | | FTTKGSRASLGDLN | TTKGSRAS |
| | | DLDKDLTTMSIDSSS | LTTMSIDSS |
| | | TTKGSRASLGDLNN | TTKGSRAS |
| | | KDLVVTKMDSCKAKL | VTKMDSCKA |
| | | TDSLVTDKVTAALLS | LVTDKVTAA |
| | | EKDLVVTKMDSCKAK | VTKMDSCKA |
| | | DSLVTDKVIAALLSE | DKVIAALLS |
| | | TLNLRRTLTGYTTKS | LRRTLTGYT |
| | | DKDLTTMSIDSSPV | LTTMSIDSS |
| | | MKKMLIFSFFLIFL | MKKMLIFS |
| | | LVTDKVIAALLSENE | DKVIAALLS |
| | | LRKDLTTMSIDSSSP | LTTMSIDSS |
| | | DLTTMSIDSSSPVFL | LTTMSIDSS |
| | | LTTMSIDSSSPVFLE | IDSSSPVFL |
| | | VTDKVIAALLSENEA | DKVIAALLS |
| | | LNLRRLLTGYIIKSF | LRRILTGYI |
| | | SLVTDKVIAALLSEN | DKVIAALLS |
| | | KDLTTMSIDSSSPVF | LTTMSIDSS |
| | | TNLGTLQLIDLNTGV | LGTLQLIDL |
| | | SILNLRRILTGYIIK | LRRILTGYI |
| | | VVIKDSCKAKLQIL | LKDSCKAK |
| | | SFLDSTLNLRRTLTG | TLNLRRTLT |
| | | ENKLLPFTSFSVRKN | LLPFTSFSV |
| | | LGTLQLIDLNTGVRL | LQLIDLNTG |
| | | EINKNSSLYVDSKML | LNKNSSLYV |
| | | NKLLPFTSFSVRKNF | FTSFSVRKN |
| | | FLDSTLNLRRTLTGY | TLNLRRTLT |
| | | SLYVDSKMTLAAVRD | YVDSKMTLA |
| | | INKNSSLYVDSKMTL | LNKNSSLYV |
| | | LYVDSKMTLAAVRDK | SKMTLAAVR |
| | | NLRRTLTGYTTKSFD | TLTGYTTKS |
| | | TDTDSLVTDKVTAAL | LVTDKVTAA |
| | | VTKMDSCKAKLQTLN | VTKMDSCKA |
| | | KSFLDSTLNLRRTLT | LDSTLNLRR |
| | | TDKVTAALLSFNEAG | TAALLSFNE |
| | | DKVTAALLSFNEAGV | TAALLSFNE |
| | | SSLYVDSKMTLAAVR | YVDSKMTLA |
| | | PVFLEVIDPTTNLGT | VIDPTTNLG |
| | | PLTNSNSNSSYYGKY | LTNSNSNSS |
| | | VFLEVIDPTTNLGTL | VIDPTTNLG |
| | | LQTLNKLFNIKVVSF | LNKLFNIKV |
| | | LTNSNSNSSYYGKYF | LTNSNSNSS |

Fig. 34 continued

| | | | |
|---|---|---|---|
| | | LRRLLGYIIKSFDY | ILTGYIIKS |
| | | FFLLNSKDGKVSKDY | IKSKDGKVS |
| | | RDFFLLKSKDGVSK | LKSKDGKVS |
| | | QTLQLTDLNTCVSFS | LXRLFNLRV |
| | | TTKSLDSSSPVFLEV | LDSSPVFL |
| | | KRDFFLLKSKDGKVS | FFLLKSKDG |
| | | FLEVTDPTTNLGTLQ | VTDPTTNLG |
| | | FLLKSKDGKVSKDYF | IKSKDGKVS |
| | | KDLVTLDVTTLKRVR | LVTLDVNTL |
| | | YVDSKMTLAAVRDKR | MTLAAVRDK |
| | | REDLDKDLTTMSTDS | LDKDLTTMS |
| | | LNQFPLNARKVDKEK | QFPLNARKV |
| | | DFFLLKSKDGKVSKD | LKSKDGKVS |
| | | TDLNTGVRLKFSTQQ | TDLNTGVRL |
| | | LNFDLDKDLTTMSTD | DKDLTTMST |
| | | SLXEDLDKDLTTMST | LDKDLTTMS |
| | | TMSTDSSPVFLEVT | TDSSPVFL |
| | | LFFVNYKGPYDSTNT | VNYKGPYDS |
| | | GTLQLTDLNTGVRLK | IQLTDLNTG |
| | | NLGTLQLTDLNTGVR | IQLTDLNTG |
| | | VDSKMTLAAVRDKD | MTLAAVRDK |
| | | LFVNYKGPYDSLNTY | VNYKGPYDS |
| | | DLNTGVRLKFSTQQG | VRLKFSTQQ |
| | | KSLTKENAGLSRVYS | LTKENAGLS |
| | | MSTDSSPVFLFVTD | TDSSPVFL |
| | | DIDSLVTDKVIAALL | LVTDKVIAA |
| | | DFKVKDQTTSLNEDL | VKDQTTSLN |
| | | LKSLTKENAGLSRVY | LTKENAGLS |
| | | NTGVRLKFSTQQGLQ | VRLKFSTQQ |
| | | DIDLSLVTDKVIAA | LDSLVTDKV |
| | | LNTGVRLKFSTQQGI | VRLKFSTQQ |
| | | ILPFTSFSVRKNFIY | FTSFSVRKN |
| | | LSLNKILPFTSFSVR | ILPFTSFSV |
| | | GLNKILPFTSFSVRK | ILPFTSFSV |
| | | TDFKVKDQTTSLNED | VKDQTTSLN |
| | | QKIDPKVKDQTTSLN | KVKDQTTSL |
| | | KTDPKVKDQTTSLNF | VKDQTTSLN |
| | | KILPFTSFSVRKNFI | FTSFSVRKN |
| | | ALKSLTKENAGLSRV | LTKENAGLS |
| | | RRKDLVVLKMDSGKA | LVVLKMDSG |
| | | PKVKDQTTSLNFDLD | VKDQTTSLN |
| | | RRLLTGYITKSFDYD | LLTGYITKS |
| | | SFDYDRSSAFLTAKV | YDRSSAFLT |
| | | TGVRLKFSTQQGLQR | VRLKFSTQQ |
| | | TKSFDYDRSSAFLTA | YDRSSAFLT |
| | | AGLSRVYSQWAGKTQ | LSRVYSQWA |
| | | KSFDYDRSSAFLTAK | YDRSSAFLT |
| | | FDYDRSSAFLTAKVT | YDRSSAFLT |
| | | SRVYSQWAGKTQFFT | VYSQWAGKT |
| | | NSSLYVDSKMTLAAV | YVDSKMTLA |
| | | AKLQTLNKLFNLKVV | LNKLFNLKV |
| | | LKMDSGKARLQTLNF | MDSGKARLQ |
| | | TLSENKTLPFTSFSV | NKTLPFTSF |
| | | FQTVGTGFFLARPLT | TGFFLARPL |
| | | TTKSFDYDRSSAFLT | DYDRSSAFL |
| | | VFQTVGTGFFLARPL | TVGTGFFLA |
| | | LSRVYSQWAGKTQFF | VYSQWAGKT |

Fig. 34 continued

| | | | |
|---|---|---|---|
| | | KLQLLNKLENLKVVS | LNKLENLKV |
| | | NAQLSRVYSQWAQKT | LSRVYSQWA |
| | | KAKLQLLNKLENLKV | LQLLNKLEN |
| | | LQLTDLNTQVRLKFS | TDLNTQVRL |
| | | DLEFVNYKGPYDSTN | VNYKGPYDS |
| | | QLSRVYSQWAQKTQF | VYSQWAQKT |
| | | TLNKLENLKVVSESN | LENLKVVSE |
| | | PALKSLTKENAQLSR | LTKENAQLS |
| | | ELTAKVTTYNAVYR | TAKVTTYN |
| | HLA-DRB1*0301 | None | |
| | HLA-DRB1*0401 | EFLARPLTNSNSNSS | LARPLTNSN |
| | | FLARPLTNSNSNSSY | LTNSNSNSS |
| | | LARPLTNSNSNSSYY | LTNSNSNSS |
| | | ARPLTNSNSNSSYYG | LTNSNSNSS |
| | | RPLTNSNSNSSYYGK | LTNSNSNSS |
| | | LDYYKGFYTEPALKS | YKGFYTEPA |
| | | DYYKGFYTEPALKSL | FYTEPALKS |
| | | VNFARDITDLQGETH | FARDITDLQ |
| | | NEACVNFARDITDTQ | NEACVNFAR |
| | | CVNFARDITDLQGET | FARDITDTQ |
| | | EACVNFARDITDTQG | FARDITDTQ |
| | | ACVNFARDITDLQGF | FARDITDTQ |
| | | YKGFYTEPALKSLTK | FYTEPALKS |
| | | YYKGFYTEPALKSLT | FYTEPALKS |
| | | KGFYTEPALKSLTKE | FYTEPALKS |
| | | LTNSNSSYYGKYF | LTNSNSNSS |
| | | PLTNSNSNSSYYGKY | LTNSNSNSS |
| | | NFARDITDTQGFTHK | FARDITDTQ |
| | | FARDITDTQGFTHKA | FARDITDTQ |
| | | FYTEPALKSLTKENA | FYTEPALKS |
| | | GFYTEPALKSLTKEN | FYTEPALKS |
| | | PSFLIFLNGFPLNA | FFLIFLNGF |
| | | FFLIFLNGFPLNARK | FLNGFPLNA |
| | | SFFLIFLNGFPLNAR | FLNGFPLNA |
| | HLA-DRB1*0404 | SFFLIFLNGFPLNAR | FLIFLNGFP |
| | | PSFLIFLNGFPLNA | FLIFLNGFP |
| | | LEVIDFITNLGTLQL | VIDFITNLG |
| | | SPVLEVIDFITNLGT | VFLEVIDFI |
| | | PVFLEVIDFITNLGT | VIDFITNLG |
| | | VFLEVIDFITNLGTL | VIDFITNLG |
| | | FLEVIDFITNLGTLQ | VIDFITNLG |
| | | FFLIFLNGFPLNARK | FLNGFPLNA |
| | | FFLIFLNGFPLNARKV | FLNGFPLNA |
| | | IFSFFLIFLNGFPLN | FLIFLNGFP |
| | | LLIFSFFLIFLNGFP | SFFLIFLNG |
| | | LIFSFFLIFLNGFPL | FLIFLNGFP |
| | | EVIDFITNLGTLQLI | VIDFITNLG |
| | | VIDFITNLGTLQLID | VIDFITNLG |
| | | LIFLNGFPLNARKVE | FLNGFPLNA |
| | | EFLARPLTNSNSNSS | LARPLTNSN |
| | | FLKNIVILDVNTLKK | VILDVNTLK |
| | | LKNIVILDVNTLKKV | ILDVNTLKK |
| | | EKDLVVIKMDSGKAK | VIKMDSGKA |
| | | RKDLVVIKMDSGKA | LVVIKMDSG |
| | | FLARPLTNSNSNSSY | LTNSNSNSS |
| | | NLVILDVNTLKKVR | ILDVNTLKK |

Fig. 34 continued

| | | | |
|---|---|---|---|
| | | KDLVVLKMDSGKAKL | VLKMDSGKA |
| | | LARPLTNSNSSYY | LTNSNSS |
| | | STLQLIDLNTGVRLK | LIDLNTGVR |
| | | VLSTLQLIDLNTGVR | LQLIDLNTG |
| | | IFLNGFPLNARKVDK | FLNGFPLNA |
| | | LQTLQLIDLNTGVRL | LIDLNTGVR |
| | | TGFFLARPLTNSNSY | LARPLTNSN |
| | | GFFLARPLTNSNSS | LARPLTNSN |
| | | GTGFFLARPLTNSNS | LARPLTNSN |
| | | DLVVLKMDSGKAKLQ | VLKMDSGKA |
| | | LVVLKMDSGKAKLQT | VLKMDSGKA |
| | | TLQLIDLNTGVRLKF | LIDLNTGVR |
| | | VGTGFFLARPLTNSN | FLARPLTNS |
| | | LQLIDLNTGVRLKFS | LIDLNTGVR |
| | HLA-DRB1*0405 | FLTAKVITYNAVYR | TAKVITYN |
| | | AFLTAKVITYNAVY | TAKVITYN |
| | | LDYYKCFYTEPALKS | YKCFYTEPA |
| | | DYYKCFYTEPALKSL | FYTEPALKS |
| | | YYKCFYTEPALKSLT | FYTEPALKS |
| | | YKCFYTEPALKSLTK | FYTEPALKS |
| | | DPKVKDQTTSLNFD | VKDQTTSLN |
| | | PKVKDQTTSLNFDD | VKDQTTSLN |
| | | FNFTNKEKNLPKPGD | TNKEKNLPK |
| | | DPKVKDQTTSLNFDL | VKDQTTSLN |
| | | NFTNKEKNLPKPGDV | TNKEKNLPK |
| | | KGFYTEPALKSLTKE | FYTEPALKS |
| | | GFFLIFLNGFPLNAR | IFLNGFPLN |
| | | FFLIFLNGFPLNARK | LNGFPLNAR |
| | | IAKVITYNAVYRD | IAKVITYN |
| | | FLIFLNGFPLNARKV | LNGFPLNAR |
| | | RSSAELIAKVITYNA | LIAKVITY |
| | | SSAELIAKVITYNA | IAKVITYN |
| | | SAELIAKVITYNAV | IAKVITYN |
| | | LIAKVITYNAVYRG | IAKVITYN |
| | | LIFLNGFPLNARKVD | LNGFPLNAR |
| | | IFLNGFPLNARKVDK | LNGFPLNAR |
| | | QKIDPKVKDQTTSLN | QKIDPKVKD |
| | | KIDPKVKDQTTSLNF | VKDQTTSLN |
| | | FTNKEKNLPKPGDVS | EKNLPKPGD |
| | | TNKEKNLPKPGDVSS | EKNLPKPGD |
| | | SNITFTTNLRDQLF | TFTTNLRD |
| | | KAVRLAKFSPKNLD | AKFSPKNLD |
| | HLA-DRB1*0701 | LSFNKTLPFTSFSVR | TLPFTSFSV |
| | | SFNKTLPFTSFSVRK | LLPFTSFSV |
| | | FNKTLPFTSFSVRKN | TLPFTSFSV |
| | | NKTLPFTSFSVRKNF | TLPFTSFSV |
| | | TLSFNKTLPFTSFSV | TLSFNKTLP |
| | | TLPFTSFSVRKNFTY | TLPFTSFSV |
| | | KTLPFTSFSVRKNFT | TLPFTSFSV |
| | | LARPLTNSNSSYY | LTNSNSS |
| | | ARPLTNSNSSYYG | LTNSNSS |
| | | RPLTNSNSSYYGK | LTNSNSS |
| | | SFSNFFTNKNSSLYV | FTNKNSSLY |
| | | LPFTSFSVRKNFTYL | FSVRKNFTY |
| | | FSNFFTNKNSSLYVD | TNKNSSLYV |
| | HLA-DRB1*0802 | None | |

Fig. 34 continued

| | | | |
|---|---|---|---|
| | HLA-DRB1*0901 | FDYDRSSAELIAKVI | YDRSSAELI |
| | | SFDYDRSSAELIAKV | YDRSSAELI |
| | | KSFDYDRSSAELIAK | YDRSSAELI |
| | | TKSFDYDRSSAELIA | YDRSSAELI |
| | | IIKSFDYDRSSAELI | IIKSFDYDR |
| | | SVDVFSTSSKSFLDS | FSTSSKSFL |
| | | DVFSTSSKSFLDST | FSTSSKSFL |
| | | ASVDVFSTSSKSFLD | FSTSSKSFL |
| | | DVFSTSSKSFLDSTL | FSTSSKSFL |
| | | XASVDVFSTSSKSFL | DVFSTSSKS |
| | | YDRSSAELIAKVTTT | YDRSSAELI |
| | | DYDRSSAELIAKVTT | YDRSSAELI |
| | HLA-DRB1*1101 | None | |
| | HLA-DRB1*1302 | SPVFLEVIDPTTNLG | VFLEVIDPT |
| | | LNKLENLKVVSGNF | LENLKVVSG |
| | | IAKVTTYNAVYRGD | TTYNAVYR |
| | | AKVTTYNAVYRGDL | TTYNAVYR |
| | | LNKLENLKVVSGN | LENLKVVSG |
| | | GDLNNDKNLMLPEQ | LNNDKNLML |
| | | SKEVDKATNLQKT | VDKATNLQ |
| | | TKNSSLYVDSKMT | TKNSSLYV |
| | | KDLVVTKMDSCKAKL | TKMDSCKAK |
| | | KEVDKATNLQKTD | VDKATNLQ |
| | | TKNSSLYVDSKMTL | TKNSSLYV |
| | | VFLEVIDPTTNLGTL | VIDPTTNLG |
| | | KVTTYNAVYRGDL | TTYNAVYR |
| | | PVFLEVIDPTTNLGT | VIDPTTNLG |
| | | NKLENLKVVSGNFF | LKVVSGNF |
| | | TFSFFITPLNGFPLN | TPLNGFPL |
| | | FSFFITPLNGFPLNA | TPLNGFPL |
| | | EFTLSENKTLPFTSF | TLSENKTLP |
| | | ATNLQKTDPKVKDQT | TNLQKTDPK |
| | | DLVVTKMDSCKAKLQ | TKMDSCKAK |
| | | MKKMLTFSFFITPL | LTFSFFIT |
| | | DKDLTTMSIDSSPV | LTTMSIDSS |
| | | SRASIGDLNNDKNLM | IGDLNNDK |
| | | FLIFLNGFPLNARKV | LIFLNGFPL |
| | HLA-DRB1*1501 | SFFLIFLNGFPLNAR | FLIFLNGFP |
| | | FFLIFLNGFPLNARK | LNGFPLNAR |
| | | FLIFLNGFPLNARKV | LNGFPLNAR |
| | | LIFLNGFPLNARKVD | LNGFPLNAR |
| | | SENKILPFTSFSVRK | ILPFTSFSV |
| | | ENKILPFTSFSVRKN | ILPFTSFSV |
| | | LSENKILPFTSFSVR | ILPFTSFSV |
| | | NKILPFTSFSVRKNF | ILPFTSFSV |
| | | LDSLNLRRILTGYI | LNLRRILTG |
| | | DSLNLRRILTGYII | LRRILTGYI |
| | | IFLNGFPLNARKVDK | LNGFPLNAR |
| | | SLNLRRILTGYIIK | LRRILTGYI |
| | | KILPFTSFSVRKNFI | LPFTSFSVR |
| | | LNLRRILTGYIIKS | LRRILTGYI |
| | | SELDSLNLRRILTG | LDSLNLRR |
| | | ELDSLNLRRILTGY | LNLRRILTG |
| | | IGTLQLIDLNTGVRL | LIDLNTGVR |
| | | GTLQLIDLNTGVRLK | LIDLNTGVR |
| | | LNLRRILTGYIIKSF | LRRILTGYI |

Fig. 34 continued

| | | | |
|---|---|---|---|
| | | NLGTLQLIDLNTGVR | LQLIDLNTG |
| | | EKDLVVIKMDSGKAK | LVVIKMDSG |
| | | KDLVVIKMDSGKAKL | LVVIKMDSG |
| | | ILPFTSFSVRENFIY | ILPFTSFSV |
| | | FLNGFPLNARKVDKE | LNGFPLNAR |
| | | QQGIQRYGIYEREKD | IQRYGIYER |
| | | QGIQRYGIYEREKDL | IQRYGIYER |
| | | TQQGIQRYGIYEREK | IQRYGIYER |
| | | TLQLIDLNTGVRLKE | LIDLNTGVR |
| | | ESTQQGIQRYGIYER | QGIQRYGIY |
| | | NSSYYGKYFINRFID | YYGKYFINR |
| | | SSYYGKYFINRFIDD | YYGKYFINR |
| | | LQLIDLNTGVRLKES | LIDLNTGVR |
| | | STQQGIQRYGIYERE | IQRYGIYER |
| | | SNSSYYGKYFINRFI | YYGKYFINR |
| | | DELKNLVILDVNTLK | LKNLVILDV |
| | | LNGFPLNARKVDKEK | LNGFPLNAR |
| | | SNAWRLAKFSPKNLD | WRLAKFSPK |
| | | DSNAWRLAKFSPKNL | WRLAKFSPK |
| | | NAWRLAKFSPKNLDE | WRLAKFSPK |
| | | DLVVIKMDSGKAKLQ | VIKMDSGKA |
| | | FSFFLIFLNGFPLNA | LIFLNGFPL |
| | | IFSFFLIFLNGFPLN | LIFLNGFPL |
| | | QDELKNLVILDVNTL | LKNLVILDV |
| | | LIFSFFLIFLNGFPL | FFLIFLNGF |
| | | REKDLVVIKMDSGKA | LVVIKMDSG |
| | | ILSENKILPFTSFSV | SENKILPFT |
| | | LVVIKMDSGKAKLQI | VIKMDSGKA |
| | | LLIFSFFLIFLNGFP | LLIFSFFLI |
| | | NSNSSYYGKYFINRF | YYGKYFINR |
| | | ELIAKVITIYNAVYR | VITIYNAVY |
| | | LIAKVITIYNAVYRG | ITIYNAVYR |
| | HLA-DRB3*0101 | DLTTMSIDSSSPVFL | MSIDSSSPV |
| | | LTTMSIDSSSPVFLE | MSIDSSSPV |
| | | TTMSIDSSSPVFLEV | MSIDSSSPV |
| | | KDLTTMSIDSSSPVF | MSIDSSSPV |
| | | DKDLTTMSIDSSSPV | TMSIDSSSP |
| | HLA-DRB4*0101 | None | |
| | HLA-DRB5*0101 | AINLQKIDPKVKLQT | LQKIDPKVK |
| | | INLQKIDPKVKDQTT | LQKIDPKVK |
| | | KSELDSILNLRRILT | LDSILNLRR |
| | | SELDSILNLRRILTG | LDSILNLRR |
| | | VNYKGPYDSTNTYEQ | VNYKGPYDS |
| | | KKEFKPVSEVEKLDK | FKPVSEVEK |
| | | LDGKKEFKPVSEVEK | LDGKKEFKP |
| | | KEFKPVSEVEKLDKI | FKPVSEVEK |
| | | DGKKEFKPVSEVEKL | FKPVSEVEK |
| | | GKKEFKPVSEVEKLD | FKPVSEVEK |
| NP_212375.1 glycerol kinase (glpK) [Borrelia burgdorferi B31] SEQ ID NO:27, | HLA-DRB1*0101 | VYFVPAFVGLGAPHW | FVPAFVGLG |
| | | YFVPAFVGLGAPHWD | FVGLGAPHW |
| | | FVPAFVGLGAPHWDS | FVGLGAPHW |
| | | VPAFVGLGAPHWDSY | FVGLGAPHW |
| | | PAFVGLGAPHWDSYA | FVGLGAPHW |
| | | AAYLAGLATGYWQSA | YLAGLATGY |

Fig. 34 continued

| SEQ ID NO:138313-139244 | | | QKEFTQIYPQPSWVE<br>KEFTQIYPQPSWVEH<br>ALGAAYLAGLATGYW<br>LGAAYLAGLATGYWQ<br>GAAYLAGLATGYWQS<br>AYLAGLATGYWQSAE<br>FAQKEFTQIYPQPSW<br>GFAQKEFTQIYPQPS<br>TALGAAYLAGLATGY<br>AQKEFTQIYPQPSWV<br>ACLKKGMAKNTYGTG<br>AFVGLGAPHWDSYAR<br>QACLKKGMAKNTYGT<br>EFTQIYPQPSWVERD<br>FVGLGAPHWDSYARG<br>FGQACLKKGMAKNTY<br>FTQIYPQPSWVERDP<br>KVVRPKITETTALGA<br>YLAGLATGYWQSAEE<br>TFGQACLKKGMAKNT<br>GQACLKKGMAKNTYG<br>EGSVFIGGAVIQWLR<br>GGSVFIGGAVIQWLRD<br>LEGSVFIGGAVIQWL<br>CKVVRPKITETTALG<br>LECKVVRPKITETTA<br>ECKVVRPKITETTAL<br>LLECKVVRPKITETT<br>TETTALGAAYLAGLA<br>ITETTALGAAYLAGL<br>SVFIGGAVIQWLRDG<br>ETTALGAAYLAGLAT<br>TTALGAAYLAGLATG<br>LAGLATGYWQSAEEI<br>KALFGAEIPIAGIAG<br>DKALFGAEIPIAGIA<br>KTDKALFGAEIPIAG<br>TDKALFGAEIPIAGI<br>GVITEAMANARILPN<br>QLGVITEAMANARIL<br>LGVITEAMANARILP<br>NGGVYFVPAFVGLGA<br>GGVYFVPAFVGLGAP<br>SVTYVLEGSVFIGGA<br>PKITETTALGAAYLA<br>TEIWGSQLGVITEAM<br>KSVTYVLEGSVFIGG<br>VTYVLEGSVFIGGAV<br>GSTKAHITRAALESI<br>KKSVTYVLEGSVFIG<br>PTEIWGSQLGVITEA<br>DQFAATFGQACLKKG<br>RKSVTYVLEGSVFI<br>VFIGGAVIQWLRDGL<br>DPTEIWGSQLGVITE<br>VLEGSVFIGGAVIQW<br>LNGGVYFVPAFVGLG | FTQIYPQPS<br>FTQIYPQPS<br>YLAGLATGY<br>YLAGLATGY<br>YLAGLATGY<br>LAGLATGYW<br>FTQIYPQPS<br>FAQKEFTQI<br>LGAAYLAGL<br>FTQIYPQPS<br>LKKGMAKNT<br>FVGLGAPHW<br>LKKGMAKNT<br>FTQIYPQPS<br>FVGLGAPHW<br>LKKGMAKNT<br>FTQIYPQPS<br>VRPKITETT<br>YLAGLATGY<br>FGQACLKKG<br>LKKGMAKNT<br>FIGGAVIQW<br>FIGGAVIQW<br>FIGGAVIQW<br>VRPKITETT<br>VRPKITETT<br>VRPKITETT<br>CKVVRPKIT<br>TTALGAAYL<br>TTALGAAYL<br>FIGGAVIQW<br>LGAAYLAGL<br>LGAAYLAGL<br>LATGYWQSA<br>FGAEIPIAG<br>FGAEIPIAG<br>LFGAEIPIA<br>FGAEIPIAG<br>ITEAMANAR<br>ITEAMANAR<br>ITEAMANAR<br>FVPAFVGLG<br>FVPAFVGLG<br>YVLEGSVFI<br>TTALGAAYL<br>WGSQLGVIT<br>YVLEGSVFI<br>YVLEGSVFI<br>TKAHITRAA<br>YVLEGSVFI<br>WGSQLGVIT<br>FAATFGQAC<br>VTYVLEGSV<br>IGGAVIQWL<br>WGSQLGVIT<br>VFIGGAVIQ<br>YFVPAFVGL |

| | | | |
|---|---|---|---|
| | | TIDTKLLWNLTQKKL | LLWNLTQKK |
| | | TQTTRQSTKAHTTRA | TTRQSTKAH |
| | | FIGGAVIQWLRDGLL | FIGGAVIQW |
| | | TEAMANARTLPNETD | MANARTLPN |
| | | ILSLDQGTTSSRAKV | LDQGTTSSR |
| | | ATVWQDRRTAKTDDQ | WQDRRTAKT |
| | | LFQAFIPTAGTAGEQ | FQAFIPTAG |
| | | GTTRQSTKAHTTRAA | TTRQSTKAH |
| | | KEHATDYSNASRTLL | DYSNASRTL |
| | | LATGYWQSAEEIVSL | LATGYWQSA |
| | | TVWQDRRTAKTDDQL | WQDRRTAKT |
| | | QLATGYWQSAEEIVS | LATGYWQSA |
| | | RATLPFLKESSTIYG | LPFLKESST |
| | | LLTSIAWGRKKSVTV | IAWGRKKSV |
| | | ATLPFLKESSTIYGK | LKESSTIYG |
| | | HTTRAALESTAFQSF | TTRAALEST |
| | | TTRQSTKAHTTRAAL | TKAHTTRAA |
| | | TLPFLKESSTIYGKT | LKESSTIYG |
| | | LPFLKESSTIYGKTD | LKESSTIYG |
| | | IDTNILWNLTQKKEH | ILWNLTQKK |
| | | DTWILWNLTQKKEHA | ILWNLTQKK |
| | | LTSIAWGRKKSVTYV | IAWGRKKSV |
| | | ISHDKLLTSIAWGRK | LLTSIAWGR |
| | | TSIAWGRKKSVTYVL | IAWGRKKSV |
| | | IDGSQIGVTTFAMAN | WGSQIGVTT |
| | | FGTIDTWILWNLTQK | FGTIDTWIL |
| | | LLSHDKLLTSIAWGR | DKLLTSIAW |
| | | TQLYPQFSWVEHDFT | LYPQFSWVE |
| | | GKTDKALFGAELFLA | DKALFGAEL |
| | | TYVLEGSVFLGGAVI | YVLEGSVFL |
| | | ITRAALESIAFQSFD | ITRAALESI |
| | | KFIYNAIVWQDRRTA | YNAIVWQDR |
| | | SHDKLLTSIAWGRKK | LLTSIAWGR |
| | | CFGTIDTWILWNLTQ | FGTIDTWIL |
| | | PFLKESSTIYGKTDK | LKESSTIYG |
| | | KLLTSIAWGRKKSVT | IAWGRKKSV |
| | | TWILWNLTQKKEHAT | ILWNLTQKK |
| | | SDGGVYFVPAFVGL | VYFVPAFVG |
| | | DDELLSTLNVPRATL | LSTLNVPRA |
| | | GGDAEALASSVSDNG | AEALASSVS |
| | | STDQGTTSSRAMVFD | DQGTTSSRA |
| | | EAMANARTLPNETEA | MANARTLPN |
| | | FRKSSDAEALASSVS | FRKSSDAEA |
| | | SDAEALASSVSDNGG | AEALASSVS |
| | | FQAFIPTAGTAGEQF | FQAFIPTAG |
| | | FIYNAIVWQDRRTAK | YNAIVWQDR |
| | | MKYTLSTDQGTTSSR | MKYTLSTDQ |
| | | HDKLLTSIAWGRKKS | LLTSIAWGR |
| | | WDDELLSTLNVPRAT | LSTLNVPRA |
| | | VDGGASQNILQFQ | VDGGASQN |
| | | FDDDELLSTLNVPRA | LLSTLNVPR |
| | | RVDGGASQNLLQF | VDGGASQN |
| | | STAFQSFDTLNTMKK | FQSFDTLNT |
| | | DYSNASRTLLNTKT | YSNASRTLL |
| | | TAFQSFDTLNTMKKS | FQSFDTLNT |
| | | LKESSTIYGKTDKAL | LKESSTIYG |
| | | ALGLLNQRETIVIWE | LLNQRETIV |

Fig. 34 continued

| | | |
|---|---|---|
| | | IDQGTISSRAMVFDK / IDQGTISSR |
| | | FDDNNAVQKAKSDTQ / DDNAVQKAK |
| | | DAIGITNQRETTVTW / ITNQRETTV |
| | | TGITNQRETTVTWER / ITNQRETTV |
| | | ILNVPRAILPFLKES / LNVPRAILP |
| | | IDAIGITNQRETTVT / ITNQRETTV |
| | | STAMQRKKSVTYVLF / QRKKSVTY |
| | | RGSTKAHTTRAALFG / TKAHTTRAA |
| | | WDSYARGTTTGTTRG / YARGTTTGT |
| | | TAMQRKKSVTYVLFG / QRKKSVTY |
| | | FIDAIGITNQRETTV / IDAIGITNQ |
| | | GSYARGTTTGTTRGS / YARGTTTGT |
| | | LNVPRAILPFLKESS / LNVPRAILP |
| | | TYGTGGFLTVNIGKF / GTGGFLTV |
| | | NTGKPIYHATVWQDR / IYHATVWQD |
| | | TYPQPSWVFHDPTEI / TYPQPSWVF |
| HLA-DRB1*0301 | None | |
| HLA-DRB1*0401 | | TQKKEHATDYSNASR / HATDYSNAS |
| | | QKKEHATDYSNASRT / HATDYSNAS |
| | | LTQKKEHATDYSNAS / QKKEHATDY |
| | | KKEHATDYSNASRTL / HATDYSNAS |
| | | KEHATDYSNASRTLL / HATDYSNAS |
| | | EHATDYSNASRTLLI / HATDYSNAS |
| | | HATDYSNASRTLLIG / HATDYSNAS |
| | | FDTLNTMKKSTPNFF / FDTLNTMKK |
| | | MKYTLSTDQGTTSSR / MKYTLSTDQ |
| | | DTLNTMKKSTPNFFT / MKKSTPNFF |
| | | TLNTMKKSTPNFFTQ / MKKSTPNFF |
| | | LNTMKKSTPNFFTQF / MKKSTPNFF |
| HLA-DRB1*0404 | | VYFVPAFVGLGAPHH / FVPAFVGLG |
| | | YFVPAFVGLGAPHHD / FVGLGAPHH |
| | | FVPAFVGLGAPHHDS / FVGLGAPHH |
| | | TIDTWLWNLTQKKE / TLWNLTQKK |
| | | DTWTLWNLTQKKEHA / TLWNLTQKK |
| | | GTIDTWTLWNLTQKE / DTWTLWNLT |
| | | IDTWTLWNLTQKKEH / TLWNLTQKK |
| | | TWTLWNLTQKKEHAT / LLWNLTQKK |
| | | NGGVYFVPAFVGLGA / FVPAFVGLG |
| | | GVYFVPAFVGLGAPH / FVPAFVGLG |
| | | GGVYFVPAFVGLGAP / FVPAFVGLG |
| | | DNGGVYFVPAFVGLG / GVYFVPAFV |
| | | NASRTLLNIKTLEWD / LLNIKTLEW |
| | | ASRTLLNIKTLEWDD / LLNIKTLEW |
| | | SRTLLNIKTLEWDDL / LLNIKTLEW |
| | | RTLLNIKTLEWDDLS / LLNIKTLEW |
| | | EKIMWILDDVEGARQ / IMWILDDVE |
| | | GTKIMWILDDVEGAR / IMWILDDVE |
| | | EWDDLLSILNVPRA / LLSILNVPR |
| | | DDLLSILNVPRAIL / LSILNVPRA |
| | | WDDLLSILNVPRAI / LSILNVPRA |
| | | DDLLSILNVPRAIL / LSILNVPRA |
| | | TLLNIKTLEWDDEL / LLNIKTLEW |
| | | AAYLAGLATGVWQSA / LAGLATGVW |
| | | AYLAGLATGVWQSAF / LAGLATGVW |
| | | GSQLGVITEAMANAR / VITEAMANA |
| | | VPAFVGLGAPHHDSY / FVGLGAPHH |

Fig. 34 continued

| | | | |
|---|---|---|---|
| | | LGVITEAMANARLP | VITEAMANA |
| | | WILWNLTQKKFEATD | ILWNLTQKK |
| | | QGLGVITEAMANARL | VITEAMANA |
| | | ILWNLTQKKFEATDY | ILWNLTQKK |
| | | QLGVITEAMANARIL | VITEAMANA |
| | | ELLSTLNVPRATLPE | LSTLNVPRA |
| | | PAFVGLQAPHRDSYA | FVGLQAPHR |
| | | SEAFAIAGSVSDYGG | IAGSVSDYG |
| | | SGTKIMWILDNVEGA | IKWILDNVE |
| | HLA-DRB1*0405 | QKEFTQIYPQPSWVE | FTQIYPQPS |
| | | KEFTQIYPQPSWVEH | IYPQPSWVE |
| | | FFTQIYPQPSWVEHD | IYPQPSWVE |
| | | FTQIYPQPSWVEHDP | IYPQPSWVE |
| | | TEAMANARILPNETD | MANARILPN |
| | | EAMANARILPNETDA | ARILPNETD |
| | | TQIYPQPSWVEHDPT | IYPQPSWVE |
| | | AMANARILPNETDAT | ARILPNETD |
| | | MANARILPNETDATG | ARILPNETD |
| | | IYPQPSWVEHDPTFT | IYPQPSWVE |
| | | ANARILPNETDATGT | ARILPNETD |
| | | QIYPQPSWVEHDPTF | IYPQPSWVE |
| | | GVITEAMANARILPN | ITEAMANAR |
| | | GTIDTWILWNLTQKK | WILWNLTQK |
| | | ITEAMANARILPNET | MANARILPN |
| | | FGTIDTWILWNLTQK | IWILWNLTQ |
| | | TIDTWILWNLTQKKF | WILWNLTQK |
| | | FAQKEFTQIYPQPSW | FTQIYPQPS |
| | | FIGGAVIQWLRDGLE | GAVIQWLRD |
| | | VITEAMANARILPNE | MANARILPN |
| | | LYNAIVWQERRIAKI | LYNAIVWQE |
| | | SGTKIMWILDNVEGA | IKWILDNVE |
| | | IDTWILWNLTQKKEH | WILWNLTQK |
| | | IGGAVIQWLRDGLEF | IQWLRDGLE |
| | | NARILPNETDAIGIT | ARILPNETD |
| | | FSGIKIMWILDNVEG | IKWILDNVE |
| | | ARILPNETDAIGITY | ARILPNETD |
| | | AQKEFTQIYPQPSWV | FTQIYPQPS |
| | | YPQPSWVEHDPTFTW | WVEHDPTFT |
| | | TKIMWILDNVEGARQ | IKWILDNVE |
| | | RTGKPLYNAIVWQER | LYNAIVWQE |
| | | GTKIMWILDNVEGAR | IKWILDNVE |
| | | GGAVIQWLRDGLEFT | IQWLRDGLE |
| | | PQPSWVEHDPTFTG | WVEHDPTFT |
| | | QFAQKEFTQIYPQPS | QKEFTQIYP |
| | HLA-DRB1*0701 | EHATDYSKASRTLLI | YSKASRTLL |
| | | HATDYSKASRTLLIN | YSKASRTLL |
| | | ATDYSKASRTLLINE | YSKASRTLL |
| | | TDYSKASRTLLINTK | YSKASRTLL |
| | | DATGTTNQREITVWE | TTNQREITV |
| | | LSTDQGTTSSRAMVF | DQGTTSSRA |
| | | TDATGTTNQREITVW | TTNQREITV |
| | | ATGTTNQREITVWEK | TTNQREITV |
| | | TGTTNQREITVWEK | TTNQREITV |
| | | STDQGTTSSRAMVFD | TTSSRAMVF |
| | | TSTAWGRKKSVTYVL | WGRKKSVTY |
| | | STAWGRKKSVTYVLL | RKKSVTYVL |
| | | TAWGRKKSVTYVLEG | RKKSVTYVL |

Fig. 34 continued

| | | | |
|---|---|---|---|
| | | KEHATDYSNASRTLL | DYSNASRTL |
| | | TDQGTTSSRAMVFDK | TTSSRAMVF |
| | | AWGRKKSVTYVLEGS | RKKSVTYVL |
| | | KFTQIYPQPSWVEH | IYPQPSWVE |
| | | QKFTQIYPQPSWVE | QIYPQPSWV |
| | | FTQIYPQPSWVEHD | IYPQPSWVE |
| | | DGRKKSVTYVLEGV | RKKSVTYVL |
| | | TQIYPQPSWVEHDP | IYPQPSWVE |
| | | DQGTTSSRAMVFDK | TTSSRAMVF |
| | | FTQIYPQPSWVEHP | IYPQPSWVE |
| | | FTDACTTNQRETTV | CTTNQRET |
| | | QGTTSSRAMVFDKNA | TTSSRAMVF |
| | HLA-DRB1*0802 | FKLLFNWYKAVCKAK | LFNWKAVC |
| | | KLLFNWYKAVCKAKS | WKAVCKAK |
| | | LLFNWYKAVCKAKSW | WKAVCKAK |
| | | LFNWYKAVCKAKSWT | WKAVCKAK |
| | | FNWYKAVCKAKSWTQ | WKAVCKAK |
| | | DKLLTSTAWGRKKSV | STAWGRKK |
| | | KLLTSTAWGRKKSVT | STAWGRKK |
| | | LLTSTAWGRKKSVTY | STAWGRKK |
| | | LTSTAWGRKKSVTYV | STAWGRKK |
| | | TDTNTLWNLTQKKFH | NTLWNLTQK |
| | HLA-DRB1*0901 | LATGYWQSAEEIVSL | YWQSAEEIV |
| | | GLATGYWQSAEEIVS | YWQSAEEIV |
| | | ATGYWQSAEEIVSLW | YWQSAEEIV |
| | | TGYWQSAEEIVSLWQ | YWQSAEEIV |
| | | AGLATGYWQSAEEIV | GYWQSAEEI |
| | | HATDYSNASRTLLNI | YSNASRTLL |
| | | FHATDYSNASRTLLN | YSNASRTLL |
| | | KQVEKIFFPSMPKNQ | IFFPSMPKN |
| | | ATDYSNASRTLLNIK | YSNASRTLL |
| | | TDYSNASRTLLNIK | YSNASRTLL |
| | | GLFFFRKSSDAEALA | FRKSSDAEA |
| | | LFFFRKSSDAEALAS | FRKSSDAEA |
| | | DGLFFFRKSSDAEAL | FRKSSDAEA |
| | | QVEKIFFPSMPKNQK | IFFPSMPKN |
| | | VEKIFFPSMPKNQKE | IFFPSMPKN |
| | | DKIFFPSMPKNQKEK | IFFPSMPKN |
| | | KEHATDYSNASRTLL | TDYSNASRT |
| | | FFFRKSSDAEALASS | FRKSSDAEA |
| | | RDGLFFFRKSSDAEA | FFRKSSDAE |
| | | GYWQSAEEIVSLWQV | YWQSAEEIV |
| | | KIFFPSMPKNQKEKL | FPSMPKNQ |
| | | PHWDSYARGTTCT | WDSYARGTT |
| | | APHWDSYARGTTTCT | WDSYARGTT |
| | HLA-DRB1*1101 | KLLFNWYKAVCKAKS | LFNWKAVC |
| | | FKLLFNWYKAVCKAK | LFNWKAVC |
| | | TYNAIVQDRRTAKI | IVQDRRTA |
| | HLA-DRB1*1302 | FDTLNTMKKSTPNFF | LNTMKKSTP |
| | | TDYSNASRTLLNIK | YSNASRTLL |
| | | FQSFDTLNTMKKSTP | FDTLNTMKK |
| | | QSFDTLNTMKKSTPN | LNTMKKSTP |
| | | DTLNTMKKSTPNFFT | LNTMKKSTP |
| | | ATDYSNASRTLLLNT | YSNASRTLL |
| | | FHATDYSNASRTLLL | YSNASRTLL |
| | | HATDYSNASRTLLLN | YSNASRTLL |

Fig. 34 continued

| | | | |
|---|---|---|---|
| | | SFDILNIMKKSIPNF | LNTMKKSIP |
| | | ASRTLLNTKTLEWD | LLNTKTLE |
| | | KEHAIDYSNASRTLL | AIDYSNAS |
| | | SRTLLNTKTLEWDD | LLNTKTLE |
| | | RTLLNTKTLEWDDE | LLNTKTLE |
| | | NASRTLLNTKTLEW | LLNTKTLE |
| | | SNASRTLLNTKTLE | SRTLLNTK |
| | | DELLSTLNVPRATLP | LSTLNVPRA |
| | | ELLSTLNVPRATLPE | LSTLNVPRA |
| | | TLNTMKKSIPNFFIQ | LNTMKKSIP |
| | | DDELLSTLNVPRATL | LSTLNVPRA |
| | | DYSNASRTLLNTKT | YSNASRTLL |
| | | YSNASRTLLNTKTL | YSNASRTLL |
| | | LNTMKKSIPNFFIQE | LNTMKKSIP |
| | | LLSTLNVPRATLPEL | TLNVPRATL |
| | | TLLNTKTLEWDDEL | LLNTKTLE |
| | | TQGFLTVNIGKEPII | LTVNIGKEP |
| | | LSTLNVPRATLPELK | TLNVPRATL |
| | | GGFLTVNIGKEPIIS | LTVNIGKEP |
| | | LLNTKTLEWDDELL | LLNTKTLE |
| | | AFQSFDILNTMKKS | FDILNTMKK |
| | | GFLTVNIGKEPIISH | LTVNIGKEP |
| | | GTGGFLTVNIGKEPI | LTVNIGKEP |
| | | WDDELLSTLNVPRAT | LSTLNVPRA |
| | | KTWGSQLGVTFAMA | WGSQLGVT |
| | | TEIWGSQLGVTFAM | WGSQLGVT |
| | | HPTEIWGSQLGVT | EIWGSQLG |
| | | PTEIWGSQLGVTFA | WGSQLGVT |
| | | PTEIWGSQLGVTFA | WGSQLGVT |
| | | EWDDELLSTLNVPRA | ELLSTLNVP |
| | | KLLENWNKAVGKAKS | LENWNKAVG |
| | | YGTGGFLTVNIGKEP | FLTVNIGKE |
| | | FLTVNIGKEPIISHD | LTVNIGKEP |
| | | IDAIGITNQRETVI | IGITNQRET |
| | | DAIGITNQRETTVI | IGITNQRET |
| | | IAFQSFDILNTMKKS | FDILNTMKK |
| | | TAWGRKKSVTYVLG | WGRKKSVTY |
| | | STAWGRKKSVTYVL | WGRKKSVTY |
| | | EKLLENWNKAVGKAK | LENWNKAVG |
| | | TGLAWGRKKSVTYVL | WGRKKSVTY |
| | | LLTSTAWGRKKSVTY | LTSTAWGRK |
| | | YARGTTIGTTRGSTK | RGTTIGTTR |
| | | STAFQSFDILNTMKK | FQSFDILNT |
| | HLA-DRB1*1501 | TDTWTLWNLTQKKEH | WTLWNLTQK |
| | | DTWTLWNLTQKKEHA | WTLWNLTQK |
| | | TTDTWTLWNLTQKKE | WTLWNLTQK |
| | | GTTDTWTLWNLTQKK | WTLWNLTQK |
| | | FGTTDTWTLWNLTQK | TDTWTLWNL |
| | | DKLLTSTAWGRKKSV | LLTSTAWGR |
| | | HDKLLTSTAWGRKKS | LLTSTAWGR |
| | | TSHDKLLTSTAWGR | LLTSTAWGR |
| | | SHDKLLTSTAWGRKK | LLTSTAWGR |
| | | TWTLWNLTQKKEHAT | WTLWNLTQK |
| | | LLTSTAWGRKKSVTY | LTSTAWGRK |
| | | WTLWNLTQKKEHATD | WTLWNLTQK |
| | | KLLTSTAWGRKKSVT | LTSTAWGRK |
| | | LTSTAWGRKKSVTYV | WGRKKSVTY |

Fig. 34 continued

| | | | |
|---|---|---|---|
| | | WDDELLSILNVPRAI | LLSILNVPR |
| | | DELLSILNVPRATL | LLSILNVPR |
| | | EWDDELLSILNVPRA | LLSILNVPR |
| | | DELLSILNVPRATLP | LLSILNVPR |
| | | IISHDKLLTSIAWGR | KLLTSIAWG |
| | | TSIAWGRKKSVTVL | WGRKKSVTY |
| | | EKLIENWNKAVGKAK | IENWNKAVG |
| | | QKKILENWNKAVGK | IENWNKAVG |
| | | NQKKILENWNKAVG | ILENWNKAV |
| | | STAWGRKKSVTVLE | WGRKKSVTY |
| | | KKILENWNKAVGKA | IENWNKAVG |
| | | VYFVPAFVCLCAPHW | VYFVPAFVC |
| | | AFVCLCAPHWDSYAR | FVCLCAPHW |
| | | LRWDDELLSILNVPR | DELLSILNV |
| HLA-DRB3*0101 | None | | |
| HLA-DRB4*0101 | | EETVSLWQVDKIFEF | VSLWQVDKI |
| | | AEETVSLWQVDKIFF | VSLWQVDKI |
| | | EIVSLWQVDKIFFFS | VSLWQVDKI |
| | | SAEETVSLWQVDKIF | VSLWQVDKI |
| | | FSGTKTMWTLDNVEG | KTMWTLDNV |
| | | SGTKTMWTLDNVEGA | KTMWTLDNV |
| | | GTKTMWTLDNVEGAR | KTMWTLDNV |
| | | YFSGTKTMWTLDNVE | KTMWTLDNV |
| | | TDTWTLWNLTQKKEH | WTLWNLTQK |
| | | DTWTLWNLTQKKEHA | WTLWNLTQK |
| | | TVSLWQVDKIFFPSM | VSLWQVDKI |
| | | TDTWTLWNLTQKKE | WTLWNLTQK |
| | | GTDTWTLWNLTQKK | WTLWNLTQK |
| | | VSLWQVDKIFFPSMP | VSLWQVDKI |
| | | QSAFETVSLWQVDKT | AEETVSLWQ |
| | | TKTMWTLDNVEGARQ | TMWTLDNVE |
| | | AALESTAFQSFDTLN | TAFQSFDTL |
| | | RAALESTAFQSFDTL | LESTAFQSF |
| | | DTWTLWNLTQKKEHAT | WTLWNLTQK |
| | | KIMWTLDNVEGARQR | KIMWTLDNV |
| | | LESTAFQSFDTLNTW | TAFQSFDTL |
| | | ALESTAFQSFDTLNT | TAFQSFDTL |
| HLA-DRB5*0101 | | EKLIENWNKAVGKAK | IENWNKAVG |
| | | KLIENWNKAVGKAKS | WNKAVGKAK |
| | | IENWNKAVGKAKSW | WNKAVGKAK |
| | | LIENWNKAVGKAKSW | WNKAVGKAK |
| | | ENWNKAVGKAKSWLQ | WNKAVGKAK |
| | | PLYNAIVWQDRRTAK | YNAIVWQDR |
| | | KPLYNAIVWQDRRTA | YNAIVWQDR |
| | | GKPLYNAIVWQDRRT | YNAIVWQDR |
| | | TGKPLYNAIVWQDRR | YNAIVWQDR |
| | | RTGKPLYNAIVWQDR | GKPLYNAIV |
| | | LYNAIVWQDRRTAKI | YNAIVWQDR |
| | | YNAIVWQDRRTAKLG | YNAIVWQDR |
| | | HDKLLTSIAWGRKKS | LTSIAWGRK |
| | | DKLLTSIAWGRKKSV | LTSIAWGRK |
| | | SHDKLLTSIAWGRKK | ITSIAWGRK |
| | | DKIFFPSMPENQKLK | FFPSMPENQ |
| | | TDTWTLWNLTQKKEH | WTLWNLTQK |
| | | KIFFPSMPENQKEKL | FFPSMPENQ |
| | | DTWTLWNLTQKKEHA | WTLWNLTQK |

Fig. 34 continued

| | | | |
|---|---|---|---|
| | | NWNKAVGKAKSWIQN | WNKAVGKAK |
| | | WNKAVGKAKSWIQNS | WNKAVGKAK |
| | | GTIDTWILWNLTQKK | WILWNLTQK |
| | | ISHDKLLTSIAWGRK | LLTSIAWGR |
| | | KLLTSIAWGRKKSVT | LTSIAWGRK |
| | | TIDTWILWNLTQKKE | WILWNLTQK |
| | | QVDKIFEPSMPKNQK | FEPSMPKNQ |
| | | VDKIFEPSMPKNQKE | FEPSMPKNQ |
| | | KEFTQIYPQPSWVEH | IYPQPSWVE |
| NP_212342.1\| hypothetical protein BB0208 [Borrelia burgdorferi B31] SEQ ID NO:28, SEQ ID NO:139245-139616 | HLA-DRB1*0101 | GTTYKLKSSNFLKLI | YKLKSSNFL |
| | | LGTTYKLKSSNFLKL | YKLKSSNFL |
| | | TTYKLKSSNFLKLIE | YKLKSSNFL |
| | | KLGTTYKLKSSNFLK | YKLKSSNFL |
| | | KKLGTTYKLKSSNFL | LGTTYKLKS |
| | | DIYKQIILNFSSNIN | YKQIILNFS |
| | | KDIYKQIILNFSSNI | YKQIILNFS |
| | | KKDIYKQIILNFSSN | YKQIILNFS |
| | | EKKDIYKQIILNFSS | YKQIILNFS |
| | | QEKKDIYKQIILNFS | IYKQIILNF |
| | | TYKLKSSNFLKLIEI | YKLKSSNFL |
| | | EQTIDILVAVRNRNK | IDILVAVRN |
| | | YKLKSSNFLKLIEIQ | YKLKSSNFL |
| | | QTIDILVAVRNRNKI | IDILVAVRN |
| | | SEFYDSLATLKKHIN | YDSLATLKK |
| | | DSEFYDSLATLKKHI | YDSLATLKK |
| | | DSLEQTIDILVAVRN | LEQTIDILV |
| | | KDSEFYDSLATLKKH | YDSLATLKK |
| | | KKDSEFYDSLATLKK | FYDSLATLK |
| | | SLEQTIDILVAVRNR | IDILVAVRN |
| | | LEQTIDILVAVRNRN | IDILVAVRN |
| | | IYKQIILNFSSNINI | YKQIILNFS |
| | | YKQIILNFSSNINID | YKQIILNFS |
| | | EFYDSLATLKKHINK | YDSLATLKK |
| | | FLKLIEIQNSPYYSQ | LKLIEIQNS |
| | | LKLIEIQNSPYYSQE | IQNSPYYSQ |
| | | KVLKYSISSQLYKLE | LKYSISSQL |
| | | LIEIQNSPYYSQEKK | IQNSPYYSQ |
| | | KLIEIQNSPYYSQEK | IQNSPYYSQ |
| | | KKVLKYSISSQLYK | LKYSISSQL |
| | | EKVLKYSISSQLYKL | LKYSISSQL |
| | | IEEKVLKYSISSQLY | LKYSISSQL |
| | | IDILVAVRNRNKIKI | IDILVAVRN |
| | | IEIQNSPYYSQEKKD | IQNSPYYSQ |
| | | TIDILVAVRNRNKIK | IDILVAVRN |
| | | ECYYKNTQNEAIKKW | YKNTQNEAI |
| | | YIEEKVLKYSISSQL | KVLKYSISS |
| | | CYYKNTQNEAIKKWI | YKNTQNEAI |
| | | YDSLATLKKHINKYI | YDSLATLKK |
| | | KQIILNFSSNINIDS | ILNFSSNIN |
| | | FYDSLATLKKHINKY | YDSLATLKK |
| | | EECYYKNTQNEAIKK | YKNTQNEAI |
| | | LEECYYKNTQNEAIK | YKNTQNEAI |
| | | SLEECYYKNTQNEAI | YYKNTQNEA |
| | | QIILNFSSNINIDSL | ILNFSSNIN |
| | HLA-DRB1*0301 | None | |

Fig. 34 continued

| | | | |
|---|---|---|---|
| | HLA-DRB1*0401 | EECYYKNTQNEAIKK | YYKNTQNEA |
| | | FCYYKNTQNFATKKW | YYKNTQNFA |
| | | LEECYYKNTQNEAIK | YYKNTQNEA |
| | | SLEECYYKNTQNEAI | YYKNTQNEA |
| | | ISLEECYYKNTQNEA | ISLEECYYK |
| | | DIYKQILNFSSNIN | YKQIINFS |
| | | RKDIYKQIINFSSN | YKQIINFS |
| | | QRKDIYKQIINFS | IYKQIINF |
| | | RKDIYKQIINFSS | YKQIINFS |
| | | KDIYKQIINFSSNI | YKQIINFS |
| | | SNFLKITETQNSPYY | LTETQNSPY |
| | | NFLKITETQNSPYYS | TETQNSPYY |
| | | FLKITETQNSPYYSQ | TETQNSPYY |
| | | LKITETQNSPYYSQE | TETQNSPYY |
| | | IYKQIINFSSNINI | YKQIINFS |
| | | CYYKNTQNEAIKKWT | YYKNTQNEA |
| | | KLTETQNSPYYSQEK | TETQNSPYY |
| | | YYKNTQNEAIKKWFL | YYKNTQNEA |
| | | YKQIINFSSNINID | YKQIINFS |
| | | KLGTTYKLKSSNFL | LGTTYKLKS |
| | | LGTTYKLKSSNFLKL | YKLKSSNFL |
| | | KLGTTYKLKSSNFLK | YKLKSSNFL |
| | | TTYKLKSSNFLKLTE | YKLKSSNFL |
| | | GTTYKLKSSNFLKLL | YKLKSSNFL |
| | HLA-DRB1*0404 | DIYKQIILNFSSNIN | IILNFSSNI |
| | | IYKQIILNFSSNINI | ILNFSSNIN |
| | | YKQIILNFSSNINID | ILNFSSNIN |
| | | KQIILNFSSNINIDS | ILNFSSNIN |
| | | QIILNFSSNINIDSL | ILNFSSNIN |
| | | FQTIDILVAVRNRK | ILVAVRNR |
| | | QTIDILVAVRNRKL | ILVAVRNR |
| | | TIDILVAVRNRKIK | ILVAVRNR |
| | | LEQTIDILVAVRN | TIDILVAVR |
| | | IDILVAVRNRKIKL | ILVAVRNR |
| | | KDIYKQIILNFSSNI | YKQIILNFS |
| | | IILNFSSNINIDSL | IILNFSSNIN |
| | HLA-DRB1*0405 | KQIILNFSSNINIDS | ILNFSSNIN |
| | | DIYKQIILNFSSNIN | YKQIILNFS |
| | | QIILNFSSNINIDSL | ILNFSSNIN |
| | | YKQIILNFSSNINID | ILNFSSNIN |
| | | IYKQIILNFSSNINI | IILNFSSNIN |
| | | ILNFSSNINIDSLEQ | ILNFSSNIN |
| | | IILNFSSNINIDSLE | IILNFSSNIN |
| | HLA-DRB1*0701 | GTTYKLKSSNFLKIT | YKLKSSNFL |
| | | LGTTYKLKSSNFLKL | YKLKSSNFL |
| | | KLGTTYKLKSSNFL | TYKLKSSNF |
| | | KLGTTYKLKSSNFLK | YKLKSSNFL |
| | | TTYKLKSSNFLKLTE | YKLKSSNFL |
| | HLA-DRB1*0802 | None | |
| | HLA-DRB1*0901 | GTTYKLKSSNFLKLL | YKLKSSNFL |
| | | TTYKLKSSNFLKLLE | YKLKSSNFL |
| | | LGTTYKLKSSNFLKL | YKLKSSNFL |
| | | EKVLKYSISSQLYKL | LKYSISSQL |
| | | EEKVLKYSISSQLYK | LKYSISSQL |
| | | KVLKYSISSQLYKLE | LKYSISSQL |
| | | KLGTTYKLKSSNFLK | YKLKSSNFL |

Fig. 34 continued

| | | | |
|---|---|---|---|
| | | KKLGTTYKLKSSNFL | LGTTYKLKS |
| | | TKKNLKYSTSSQLY | LKYSTSSQL |
| | | YLKKVLKYSTSSQL | VLKYSTSSQ |
| | | VLKYSTSSQLYKLEK | YSTSSQLYK |
| | | IYKQIILNFSSNINI | ILNFSSNIN |
| | | YKQIILNFSSNINID | ILNFSSNIN |
| | | TYKLKSSNFLKLIEI | YKLKSSNFL |
| | | KQTILNFSSNINIDS | ILNFSSNIN |
| | | QTILNFSSNINIDSL | ILNFSSNIN |
| | | YKLKSSNFLKLIEIQ | YKLKSSNFL |
| | | LKYSTSSQLYKLEKP | YSTSSQLYK |
| | HLA-DRB1*1101 | None | |
| | HLA-DRB1*1302 | RNKIKILNILNKILK | IKILNILNK |
| | | VRNRNKIKILNILNK | VRNRNKIKI |
| | | ILVAVRNRNKIKILN | VRNRNKIKI |
| | | NRNKIKILNILNKIL | IKILNILNK |
| | | DILVAVRNRNKIKIL | VRNRNKIKI |
| | | DIYKQIILNFSSNIN | YKQIILNFS |
| | | IDILVAVRNRNKIKI | VAVRNRNKI |
| | | RNRNKIKILNILNKI | IKILNILNK |
| | | IYKQIILNFSSNINI | ILNFSSNIN |
| | | VAVRNRNKIKILNIL | VRNRNKIKI |
| | | YKQIILNFSSNINID | ILNFSSNIN |
| | | LVAVRNRNKIKILNI | VRNRNKIKI |
| | | KQIILNFSSNINIDS | ILNFSSNIN |
| | | QIILNFSSNINIDSL | ILNFSSNIN |
| | | AVRNRNKIKILNILN | VRNRNKIKI |
| | | KDIYKQIILNFSSNI | YKQIILNFS |
| | | QIIDILVAVRNRNKI | DILVAVRNR |
| | | IIDILVAVRNRNKIK | VAVRNRNKI |
| | | IILNFSSNINIDSLE | ILNFSSNIN |
| | | LGTTYKLKSSNFLKL | YKLKSSNFL |
| | | KKDIYKQIILNFSSN | YKQIILNFS |
| | | QKKDIYKQIILNFS | IYKQIILNF |
| | | KKKDIYKQIILNFSS | YKQIILNFS |
| | | KFANLNTKKLGTTYK | ANLNTKKLG |
| | | LSKFANLNTKKLGTT | ANLNTKKLG |
| | | KKLGTTYKLKSSNFL | LGTTYKLKS |
| | | GTTYKLKSSNFLKLI | YKLKSSNFL |
| | | SKFANLNTKKLGTTY | ANLNTKKLG |
| | | TTYKLKSSNFLKLIE | YKLKSSNFL |
| | | ILNFSSNINIDSLEQ | ILNFSSNIN |
| | | FANLNTKKLGTTYKL | LNTKKLGTT |
| | | KLGTTYKLKSSNFLK | YKLKSSNFL |
| | | ANLNTKKLGTTYKLK | LNTKKLGTT |
| | | KNILEIVRNKNFIQI | IVRNKNFIQ |
| | | ILEIVRNKNFIQISK | VRNKNFIQI |
| | | TYKLKSSNFLKLIEI | YKLKSSNFL |
| | | KILEIVRNKNFIQIS | IVRNKNFIQ |
| | | YKLKSSNFLKLIEIQ | YKLKSSNFL |
| | | LEIVRNKNFIQISKE | VRNKNFIQI |
| | | FLKLIEIQNSPYYSQ | IEIQNSPYY |
| | | LEQIIDILVAVRNRN | IDILVAVRN |
| | | IQTSKFANLNTKKLG | FANLNTKKL |
| | | IKLIEIQNSPYYSQE | IEIQNSPYY |
| | | DSLATLKKETNKYTE | LATLKKETN |
| | | YDSLATLKKETNKYT | LATLKKETN |

Fig. 34 continued

| | | | |
|---|---|---|---|
| | | NLNTKKLGTTYKLKS | LNTKKLGTT |
| | | EQTIDILVAVRNRNK | ILVAVRNRN |
| | | LNTKKLGTTYKLKSS | LNTKKLGTT |
| | HLA-DRB1*1501 | RNKIKILNILNKNLK | IKILNILNK |
| | | NRNKIKILNILNKNL | IKILNILNK |
| | | VRNRNKIKILNILNK | VRNRNKIKI |
| | | RNRNKIKILNILNKN | IKILNILNK |
| | | IDILVAVRNRNKIKI | LVAVRNRNK |
| | | DILVAVRNRNKIKIL | LVAVRNRNK |
| | | NEAIKKWILEIVRNK | IKKWILEIV |
| | | EAIKKWILEIVRNKN | IKKWILEIV |
| | | KWILEIVRNKNFIQI | IVRNKNFIQ |
| | | WILEIVRNKNFIQIS | VRNKNFIQI |
| | | QNEAIKKWILEIVRN | IKKWILEIV |
| | | TIDILVAVRNRNKIK | LVAVRNRNK |
| | | LVAVRNRNKIKILNI | LVAVRNRNK |
| | | ILVAVRNRNKIKILN | LVAVRNRNK |
| | | QTIDILVAVRNRNKI | LVAVRNRNK |
| | | TQNEAIKKWILEIVR | IKKWILEIV |
| | | NTQNEAIKKWILEIV | EAIKKWILE |
| | | ILEIVRNKNFIQISK | VRNKNFIQI |
| | HLA-DRB3*0101 | None | |
| | HLA-DRB4*0101 | SISSQLYKLEKPEII | LYKLEKPEI |
| | | SQLYKLEKPEIIELI | YKLEKPEII |
| | | SSQLYKLEKPEIIEL | YKLEKPEII |
| | | ISSQLYKLEKPEIIE | YKLEKPEII |
| | HLA-DRB5*0101 | EQTIDILVAVRNRNK | ILVAVRNRN |
| | | QTIDILVAVRNRNKI | LVAVRNRNK |
| | | IDILVAVRNRNKIKI | LVAVRNRNK |
| | | TIDILVAVRNRNKIK | LVAVRNRNK |
| | | IKISNDYEKEKNAFN | ISNDYEKEK |
| | | | |
| NP_045482.1\| hypothetical protein BBG22 [Borrelia burgdorferi B31]<br><br>SEQ ID NO:29,<br>SEQ ID NO:139617-140010 | HLA-DRB1*0101 | GTLTAKFAMEGSILT | LTAKFAMEG |
| | | LTAKFAMEGSILTRS | FAMEGSILT |
| | | TAKFAMEGSILTRSK | FAMEGSILT |
| | | AKFAMEGSILTRSKL | FAMEGSILT |
| | | TLTAKFAMEGSILTR | FAMEGSILT |
| | | KRMTMIYRSADTWYT | KRMTMIYRS |
| | | RMTMIYRSADTWYTW | YRSADTWYT |
| | | MTMIYRSADTWYTWY | YRSADTWYT |
| | | TMIYRSADTWYTWYW | YRSADTWYT |
| | | MIYRSADTWYTWYWA | YRSADTWYT |
| | | RINFKGKLVKRMTMI | FKGKLVKRM |
| | | DFSRINFKGKLVKRM | DFSRINFKG |
| | | FSRINFKGKLVKRMT | FKGKLVKRM |
| | | SRINFKGKLVKRMTM | FKGKLVKRM |
| | | INFKGKLVKRMTMIY | FKGKLVKRM |
| | | KFAMEGSILTRSKLI | FAMEGSILT |
| | | FAMEGSILTRSKLIQ | FAMEGSILT |
| | | KTPVGTLTAKFAMEG | VGTLTAKFA |
| | | TPVGTLTAKFAMEGS | VGTLTAKFA |
| | | IYRSADTWYTWYWAE | YRSADTWYT |
| | | YRSADTWYTWYWAEE | YRSADTWYT |
| | | VGTLTAKFAMEGSIL | LTAKFAMEG |
| | | NFKGKLVKRMTMIYR | FKGKLVKRM |
| | | FKGKLVKRMTMIYRS | FKGKLVKRM |

Fig. 34 continued

| | | PVGTLTAKFAMEGSI | LTAKFAMEG |
| --- | --- | --- | --- |
| | | FLEKTPVGTLTAKFA | FLEKTPVGT |
| | | LEKTPVGTLTAKFAM | VGTLTAKFA |
| | | EKTPVGTLTAKFAME | VGTLTAKFA |
| | | YAYKVLGISSAFKLS | YKVLGISSA |
| | HLA-DRB1*0301 | None | |
| | HLA-DRB1*0401 | TAKFAMEGSILTRCK | FAMEGSILT |
| | | AKFAMEGSILTRSKL | FAMEGSILT |
| | | LTAKFAMEGSILTRS | FAMEGSILT |
| | | ILTAKFAMEGSILTR | FAMEGSILT |
| | | GTLTAKFAMEGSILT | GTLTAKFA |
| | | EHMILFFLEKTPVGT | FFLEKTPVG |
| | | LEHMILFFLEKTPVG | LFFLEKTPV |
| | | HMILFFLEKTPVGTL | FFLEKTPVG |
| | | MILFFLEKTPVGTLT | FFLEKTPVG |
| | | ILFFLEKTPVGTLTA | FFLEKTPVG |
| | | KFAMEGSILTRSKLT | FAMEGSILT |
| | | FAMEGSILTRSKLIQ | FAMEGSILT |
| | | RKEYETTKNAPSLDS | YETTKNAPS |
| | | KEYETTKNAPSLDSL | YETTKNAPS |
| | | TRSKLIQAFTNTNKF | LIQAFTNTN |
| | | RSKLIQAFTNTNKFQ | LIQAFTNTN |
| | | FKQKIVKRMTMIYRS | IVKRMTMIY |
| | | NFKQKIVKRMTMIYR | IVKRMTMIY |
| | | KQKIVKRMTMIYRSA | IVKRMTMIY |
| | | SKLIQAFTNTNKFQT | LIQAFTNTN |
| | | QKIVKRMTMIYRSAD | IVKRMTMIY |
| | | TDNRKEYETTKNAPS | EYETTKNAP |
| | | DYRKEYETTKNAPSL | YETTKNAPS |
| | | NRKEYETTKNAPSLD | YETTKNAPS |
| | | LFFLEKTPVGTLTAK | FFLEKTPVG |
| | | TNFKQKIVKRMTMIY | FKQKIVKRM |
| | HLA-DRB1*0404 | LTRSKLIQAFTNTNK | LIQAFTNTN |
| | | TRSKLIQAFTNTNKF | LIQAFTNTN |
| | | RSKLIQAFTNTNKFQ | LIQAFTNTN |
| | | ILTRSKLIQAFTNTN | KLIQAFTNT |
| | | SKLIQAFTNTNKFQT | LIQAFTNTN |
| | | KLIQAFTNTNKFQIP | LIQAFTNTN |
| | | IDPEYLLPPFTSQSG | LLPPFTSQS |
| | | PEYLLPPFTSQSGKE | LLPPFTSQS |
| | | DPEYLLPPFTSQSGS | LLPPFTSQS |
| | | LIQAFTNTNKFQIPD | LIQAFTNTN |
| | | EYLLPPFTSQSGSKE | LLPPFTSQS |
| | | EIDPEYLLPPFTSQS | YLLPPFTSQ |
| | | LEHMILFFLEKTPVG | LFFLEKTP |
| | | EHMILFFLEKTPVGT | FFLEKTPVG |
| | | HMILFFLEKTPVGTL | FFLEKTPVG |
| | | YLLPPFTSQSGSKET | LLPPFTSQS |
| | HLA-DRB1*0405 | YRSADTWYTWYAEET | YRSADTWYT |
| | | KRMIMIYRSADTWYT | MIMIYRSAD |
| | | ADTWYTWYAEETKSS | WYTWYAEE |
| | | RKEYETTKNAPSLDS | YETTKNAPS |
| | | KEYETTKNAPSLDSL | YETTKNAPS |
| | | RSADTWYTWYAEETK | WYTWYAEE |
| | | RMTMIYRSADTWYT | YRSADTWYT |
| | | MTMIYRSADTWYTWY | YRSADTWYT |

Fig. 34 continued

| | | | |
|---|---|---|---|
| | | TMIYRSADTWYTWYW | YRSADTWYT |
| | | DTWYTWYWAFFTMSP | WYWAFFTMS |
| | | KIYRSADTWYTWYWA | YRSADTWYT |
| | | TRSKLIQAFTNTNKF | IQAFTNTNK |
| | | LTRSKLIQAFTNTNK | LIQAFTNTN |
| | | RSKLIQAFTNTNKFC | IQAFTNTNK |
| | | SKLIQAFTNTNKFCI | IQAFTNTNK |
| | | SADTWYTWYWAFFTM | YTWYWAFFT |
| | | TWYTWYWAFFTMSPF | YTWYWAFFT |
| | | FYETTKNAPSLDSLT | TKNAPSLDS |
| | | YETTKNAPSLDSLTE | TKNAPSLDS |
| | | KLIQAFTNTNKFCIP | IQAFTNTNK |
| | | WYTWYWAFFTMSPFI | WYWAFFTMS |
| | | IYRSADTWYTWYWAF | YRSADTWYT |
| | | NKFYETTKNAPSLD | YETTKNAPS |
| | | TDNKEYETTKNAPS | FYETTKNAP |
| | | DNKEYETTKNAPSL | YETTKNAPS |
| | | LIQAFTNTNKFCIPD | IQAFTNTNK |
| | | GKLVKRMTMTYRSAD | VKRMTMTYR |
| | | KLVKRMTMTYRSADT | VKRMTMTYR |
| | | YTWYWAFFTMSPFIT | WYWAFFTMS |
| HLA-DRB1*0701 | | SKLIQAFTNTNKFCI | IQAFTNTNK |
| | | KLIQAFTNTNKFCIP | FTNTNKFCI |
| | | LIQAFTNTNKFCIPD | FTNTNKFCI |
| | | IQAFTNTNKFCIPDG | FTNTNKFCI |
| | | QAFTNTNKFCIPDGR | FTNTNKFCI |
| | | IKKLENTKTRIQFR | LENTKTRIQ |
| | | KKLENTKTRIQFRN | LENTKTRIQ |
| | | KKLENTKTRIQFRNG | LENTKTRIQ |
| | | FIKKKLENTKTRIQF | LENTKTRIQ |
| | | TLIKKKLENTKTRIQ | KLENTKTRI |
| | | RFAMEGSILTRSKLI | GSILTRSKL |
| | | MEGSILTRSKLIQAF | SILTRSKLI |
| | | AMEGSILTRSKLIQA | SILTRSKLI |
| | | FAMEGSILTRSKLIQ | SILTRSKLI |
| | | EGSILTRSKLIQAFT | SILTRSKLI |
| | | RMIMIYRSADTWYIK | YRSADTWYI |
| HLA-DRB1*0802 | | None | |
| HLA-DRB1*0901 | | YAYKVLGISSAPKLS | LGISSAPKL |
| | | AYKVLGISSAPKLSG | LGISSAPKL |
| | | YKVLGISSAPKLSGR | LGISSAPKL |
| | | CYAYKVLGISSAPKL | VLGISSAPK |
| | | KVLGISSAPKLSGRF | LGISSAPKL |
| | | VLGISSAPKLSGRFL | LGISSAPKL |
| | | LGISSAPKLSGRFLR | LGISSAPKL |
| HLA-DRB1*1101 | | None | |
| HLA-DRB1*1302 | | NFKGKLVKRMTMIYR | LVKRMTMTY |
| | | FKGKLVKRMTMTYRS | VKRMTMTYR |
| | | KGKLVKRMTMTYRSA | VKRMTMTYR |
| | | GKLVKRMTMTYRSAD | VKRMTMTYR |
| | | KLVKRMTMIYRSADT | VKRMTMTYR |
| | | INFKGKLVKRMTMIY | GKLVKRMTM |
| | | CYAYKVLGISSAPKL | YKVLGISSA |
| | | YAYKVLGISSAPKLS | LGISSAPKL |
| | | LVKRMTMIYRSADTW | VKRMTMIYR |
| | | IRIQFRNGKIDSLG | IQFRNGKI |

Fig. 34 continued

| | | | |
|---|---|---|---|
| | | SRINFKGKLVKRMTM | INFKGKLVK |
| | | AYKVLGTSSAPKLGG | LGTSSAPKL |
| | | YKVLGTSSAPKLSGR | LGTSSAPKL |
| | | TQFRNGNKTDSLGY | FRNGNKTDS |
| | | RINFKGKLVKRMTKI | GKLVKRMTK |
| | | VKRMTMYRSADTSY | VKRMTMYR |
| | | KTRTQFRNGNKTDSL | TQFRNGNKT |
| | | RTQFRNGNKTDSLGY | TQFRNGNKT |
| | | TKTRTQFRNGNKTDS | TQFRNGNKT |
| | | FSRINFKGKLVKRKT | INFKGKLVK |
| | | SKLTQAFTNTNKFGT | TQAFTNTNK |
| | | KKYFTTKNAPSLDSL | TTKNAPSLD |
| | | RKKYFTTKNAPSLDS | TTKNAPSLD |
| | | KLTQAFTNTNKFGTP | FTNTNKFGT |
| | | FAMFGSTLTRSKLTQ | FAMFGSTLT |
| | | KYFTTKNAPSLDSLT | TTKNAPSLD |
| | | YFTTKNAPSLDSLTK | TTKNAPSLD |
| | | NCYAYKVLGTSSAPK | YKVLGTSSA |
| HLA-DRB1*1501 | FKGKLVKRMTMYRS | VKRMTMYR |
| | | KLVKRMTMYRSADT | VKRMTMYR |
| | | GKLVKRMTMYRSAD | VKRMTMYR |
| | | NFKGKLVKRMTMYR | FKGKLVKRM |
| | | KGKLVKRMTMYRSA | VKRMTMYR |
| | | VKRMTMYRSADTSY | VKRMTMYR |
| | | LVKRMTMYRSADTS | VKRMTMYR |
| | | NCYAYKVLGTSSAPK | YKVLGTSSA |
| | | YAYKVLGTSSAPKLS | VLGTSSAPK |
| | | CYAYKVLGTSSAPKL | VLGTSSAPK |
| | | AYKVLGTSSAPKLGG | VLGTSSAPK |
| | | LHMILFFLEKTPVG | LFFLEKTPV |
| | | YKVLGTSSAPKLSGR | VLGTSSAPK |
| | | HMILFFLEKTPVGT | LFFLEKTPV |
| | | MILFFLEKTPVGTL | LFFLEKTPV |
| | | ILFFLEKTPVGTLT | LFFLEKTPV |
| | | DFSRINFKGKLVKR | INFKGKLVK |
| | | FSRINFKGKLVKRMT | INFKGKLVK |
| | | LDFSRINFKGKLVKR | INFKGKLVK |
| | | YLHMILFFLEKTPV | ILFFLEKTP |
| | | SRINFKGKLVKRMTK | INFKGKLVK |
| | | LSGRFLRHYDSGGST | LRHYDSGG |
| | | KLSGRFLRHYDSGGS | FLRHYDSGG |
| | | SGRFLRHYDSGGSTD | LRHYDSGG |
| | | GRFLRHYDSGGSTDS | LRHYDSGG |
| | | DLFSRINFKGKLVK | RINFKGKLV |
| | | ILFFLEKTPVGTLTA | LFFLEKTPV |
| | | RINFKGKLVKRMTMT | INFKGKLVK |
| | | RFLRHYDSGGSTDSE | LRHYDSGG |
| | | LTRSKLTQAFTNTNK | LTQAFTNTN |
| HLA-DRB3*0101 | None | |
| HLA-DRB4*0101 | None | |
| HLA-DRB5*0101 | FSRINFKGKLVKRT | FKGKLVKRM |
| | | DFSRINFKGKLVKR | INFKGKLVK |
| | | SRINFKGKLVKRMTK | FKGKLVKRM |
| | | RINFKGKLVKRMTKI | FKGKLVKRM |
| | | INFKGKLVKRMTKIY | FKGKLVKRM |
| | | FKGKLVKRMTMYRS | FKGKLVKRM |

Fig. 34 continued

| | | | |
|---|---|---|---|
| | | NFKGKLVKPMTMIYR<br>KRMTMIYRSADTWYT<br>AKFAMEGSILTRSKL<br>TAKFAMEGSILTRSK<br>RMTMIYRSADTWYTW<br>MTMIYRSADTWYTWY<br>TMIYRSADTWYTWYW<br>MIYRSADTWYTWYWA<br>LTAKFAMEGSILTRS<br>TLTAKFAMEGSILTR | PKGKLVKPM<br>MTMIYRSAD<br>FAMEGSILT<br>FAMEGSILT<br>YRSADTWYT<br>YRSADTWYT<br>YRSADTWYT<br>YRSADTWYT<br>FAMEGSILT<br>FAMEGSILT |
| NP_212885.1\| hypothetical protein BB0751 [Borrelia burgdorferi B31]<br><br>SEQ ID NO:30,<br>SEQ ID NO:140011-140476 | HLA-DRB1*0101 | KILIIVVLTSTFLLG<br>IKILIIVVLTSTFLL<br>ILIIVVLTSTFLLGI<br>LIIVVLTSTFLLGII<br>KIKILIIVVLTSTFL<br>IIVVLTSTFLLGIIF<br>IVVLTSTFLLGIIFS<br>KEKIKILIIVVLTST<br>EKIKILIIVVLTSTF<br>NKEKIKILIIVVLTS<br>INKEKIKILIIVVLT<br>SINKEKIKILIIVVL<br>KIETELEGTLTKLGK<br>SKIETELEGTLTKLG<br>IETELEGTLTKLGKD<br>ETELEGTLTKLGKDW<br>TELEGTLTKLGKDWI<br>NKNKGVFMTKPKIFS<br>NKGVFMTKPKIFSIN<br>KGVFMTKPKIFSINK<br>KNKGVFMTKPKIFSI<br>KDEYYYTTSKWTFFD<br>QKDEYYYTTSKWTFF<br>DEYYYTTSKWTFFDV<br>GVFMTKPKIFSINKE<br>LEGTLTKLGKDWILT<br>ELEGTLTKLGKDWIL<br>KQINKNKGVFMTKPK<br>EKQINKNKGVFMTKP<br>KEKQINKNKGVFMTK<br>LNNQKMTKERPLNII<br>EKEKQINKNKGVFMT | IVVLTSTFL<br>IVVLTSTFL<br>IVVLTSTFL<br>IVVLTSTFL<br>IKILIIVVL<br>IVVLTSTFL<br>IVVLTSTFL<br>IKILIIVVL<br>IKILIIVVL<br>IKILIIVVL<br>IKILIIVVL<br>INKEKIKIL<br>LEGTLTKLG<br>ETELEGTLT<br>LEGTLTKLG<br>LEGTLTKLG<br>LEGTLTKLG<br>VFMTKPKIF<br>FMTKPKIFS<br>FMTKPKIFS<br>FMTKPKIFS<br>YYYTTSKWT<br>YYYTTSKWT<br>YYYTTSKWT<br>FMTKPKIFS<br>LEGTLTKLG<br>LEGTLTKLG<br>INKNKGVFM<br>INKNKGVFM<br>INKNKGVFM<br>MTKERPLNI<br>INKNKGVFM |
| | HLA-DRB1*0301 | None | |
| | HLA-DRB1*0401 | YNLQYKIEVKWSNKS<br>LQYKIEVKWSNKSVN<br>QYKIEVKWSNKSVNN<br>NLQYKIEVKWSNKSV<br>YKIEVKWSNKSVNNI<br>KIEVKWSNKSVNNIE<br>IEVKWSNKSVNNIEV<br>QKDEYYYTTSKWTFF<br>FLLGIIFSNENKVAR<br>KDEYYYTTSKWTFFD<br>DEYYYTTSKWTFFDV | YKIEVKWSN<br>IEVKWSNKS<br>IEVKWSNKS<br>IEVKWSNKS<br>IEVKWSNKS<br>IEVKWSNKS<br>IEVKWSNKS<br>YYYTTSKWT<br>LGIIFSNEN<br>YYYTTSKWT<br>YYYTTSKWT |

Fig. 34 continued

| | | | |
|---|---|---|---|
| | | KDKDEYYYTSKWTF | YYYTTSKWT |
| | HLA-DRB1*0404 | KILLVVLTSTFLLG | LVVLTSTF |
| | | LLLVVLTSTFLLGI | VLTSTFLLG |
| | | TFLLGTTFSNFNKVA | LLGTTFSNF |
| | | STFLLGTTFSNFNKV | LLGTTFSNF |
| | | FLLGTTFSNFNKVAR | LLGTTFSNF |
| | | LSTFLLGTTFSNFNK | LLGTTFSNF |
| | | KIKLLLVVLTSTFL | LLLVVLTS |
| | | IKILLVVLTSTFLL | LLVVLTS |
| | | LLVVLTSTFLLGTT | VLTSTFLLG |
| | | VLTSTFLLGTTFSNF | VLTSTFLLG |
| | | LLGTTFSNFNKVART | LLGTTFSNF |
| | HLA-DRB1*0405 | KDWILTYNKQNIPVD | WILTYNKQN |
| | | DWILTYNKQNIPVDN | YNKQNIPVD |
| | | WILTYNKQNIPVDNK | YNKQNIPVD |
| | | LQYKTFVKWSNKSVN | TFVKWSNKS |
| | | QYKTFVKWSNKSVNN | TFVKWSNKS |
| | | YKTFVKWSNKSVNNT | TFVKWSNKS |
| | | TFVKWSNKSVNNTEV | TFVKWSNKS |
| | | LLTYNKQNIPVDNKK | YNKQNIPVD |
| | | KTFVKWSNKSVNNTE | TFVKWSNKS |
| | | LTYNKQNIPVDNKKV | YNKQNIPVD |
| | | NLQYKTFVKWSNKSV | TFVKWSNKS |
| | | YNLQYRIEVRWSNKS | YRIEVRWSN |
| | | IKLGKDWILTYNKQN | KDWILTYNK |
| | | KFPDFPNLISKIET | PDFPNLIS |
| | | KLGKDWILTYNKQNI | WILTYNKQN |
| | | LGKDWILTYNKQNIP | WILTYNKQN |
| | | LSLNPGPKLPDNNNK | LNPGPKLPD |
| | | GKDWILTYNKQNIPV | WILTYNKQN |
| | HLA-DRB1*0701 | LILVVLTSTFLLGII | LVVLTSTFL |
| | | LLLVVLTSTFLLGI | LVVLTSTFL |
| | | IKILLVVLTSTFLL | LVVLTSTFL |
| | | KILLVVLTSTFLLG | LVVLTSTFL |
| | | DEYYYTSKWTFFDV | YYTTSKWTF |
| | | DKDEYYYTSKWTFF | YYTTSKWTF |
| | | KDEEYYTTSKWTFFD | YYTTSKWTF |
| | | KIKILLVVLTSTFL | LLVVLTSTF |
| | | EYYYTTSKWTFFDVF | YYTTSKWTF |
| | | LLVVLTSTFLLGIIF | LVVLTSTFL |
| | | KDKDEYYYTSKWTF | YYYTTSKWT |
| | | LVVLTSTFLLGTTFS | LVVLTSTFL |
| | | YYYTTSKWTFFDVFF | YTTSKWTFF |
| | | YYTTSKWTFFDVFDL | YYTTSKWTF |
| | | XNKQVFMTKPKIFSF | VFMTKPKIF |
| | | NKQVFMTKPKIFSTY | VFMTKPKIF |
| | | KQVFMTKPKIFSTYP | VFMTKPKIF |
| | | TNKNQVFMTKPKIF | TNKNQVFM |
| | | KKDKDYYYTTSKWT | DYYYTTSKW |
| | | TNKQVFMTKPKIFS | VFMTKPKIF |
| | HLA-DRB1*0802 | None | |
| | HLA-DRB1*0901 | DKDEYYYTTSKWTFF | YYTTSKWT |
| | | KDEYYYTTSKWTFFD | YYTTSKWT |
| | | DEYYYTTSKWTFFDV | YYTTSKWT |
| | | KDKDEYYYTTSKWTF | YYYTTSKWT |

Fig. 34 continued

| | | | |
|---|---|---|---|
| | HLA-DRB1*1101 | DENVYLTKNIFLSYK | LTKNIFLSY |
| | | SDENVYLTKNIFLSY | NVYLTKNIF |
| | | ENVYLTKNIFLSYKG | LTKNIFLSY |
| | | NVYLTKNIFLSYKGN | LTKNIFLSY |
| | HLA-DRB1*1302 | FKIKILIVVLTSTF | IKILIVVL |
| | | KFKIKILIVVLTST | IKILIVVL |
| | | SINKFKIKILIVVL | FKIKILIV |
| | | INKFKIKILIVVLT | IKILIVVL |
| | | NKFKIKILIVVLTS | IKILIVVL |
| | | IKILIVVLTSTFLL | IKILIVVL |
| | | KIKILIVVLTSTFL | IKILIVVL |
| | | DGLYFLNNQKMTKR | LNNQKMTKE |
| | | KILIVVLTSTFLLG | LIVVLTST |
| | | SFKIFDNNKLLTET | FDNNKLLT |
| | | FKIFDNNKLLTETF | FDNNKLLT |
| | | KDGLYFLNNQKMTKE | YFLNNQKMT |
| | | PSFKIFDNNKLLTE | FDNNKLLT |
| | | NPSFKIFDNNKLLT | IFDNNKLL |
| | | KIFDNNKLLTETFV | FDNNKLLT |
| | | GLYFLNNQKMTKER | LNNQKMTKE |
| | | RKKQINKNKGVFMT | INKNKGVFM |
| | | KKQINKNKGVFMTK | INKNKGVFM |
| | | KQINKNKGVFMTKP | INKNKGVFM |
| | | FKQINKNKGVFMTKP | INKNKGVFM |
| | | LYFLNNQKMTKERPL | LNNQKMTKE |
| | | ILIVVLTSTFLLGI | LIVVLTST |
| | | LIVVLTSTFLLGIL | VVLTSTFLL |
| | | YFLNNQKMTKERPLN | LNNQKMTKE |
| | | YKIEVKWSNKSVNNI | VKWSNKSVN |
| | | QINKNKGVFMTKPKI | INKNKGVFM |
| | | LKKKQINKNKGVFM | QINKNKGVF |
| | | IEVKWSNKSVNNIEV | WSNKSVNNI |
| | | LFDNNKLLTETFVG | FDNNKLLT |
| | | KIEVKWSNKSVNNIE | WSNKSVNNI |
| | | FDFDNLISKIETEL | FNLISKIET |
| | | KFFDFDNLISKIET | FDFNLISKI |
| | | FFDFDNLISKIETE | FNLISKIET |
| | | FDNNKLLTETFVGK | FDNNKLLT |
| | | KFNNINNYETTSK | NNINNYET |
| | | DFDNLISKIETELE | FNLISKIET |
| | | FDFNLISKIETELG | FNLISKIET |
| | | SKDGLYFLNNQKMTK | YFLNNQKMT |
| | | VKWSNKSVNNIEVYF | WSNKSVNNI |
| | | IVVLTSTFLLGILF | VVLTSTFLL |
| | | FVKSNKSVNNIEVY | WSNKSVNNI |
| | | INKNKGVFMTKPKIF | INKNKGVFM |
| | | RFNNINNYETTSK | INNYETTS |
| | | NFNNINNYETTSKD | INNYETTS |
| | | NNINNYETTSKDGL | INNYETTS |
| | | FNNINNYETTSKDG | INNYETTS |
| | | LFNLSFKITRLNK | FKITRLNK |
| | | KLFNLSFKITRLNR | LFNLSFKIT |
| | | SDENVYLTKNIFLSY | YLTKNIFLS |
| | | FLNNQKMTKERPLN | LNNQKMTKE |
| | | DENVYLTKNIFLSYK | YLTKNIFLS |
| | | FKNIKLFNLSFKIIR | LFNLSFKII |
| | | QFKNTKLFNLSFKII | KNTKLFNLS |

| | | | |
|---|---|---|---|
| | | NLQYKIEVKWSNKSV | YKIEVKWSN |
| | | DKDEYYYTTSKWTFF | YYYTTSKWT |
| | | KDEYYYTTSKWTFFD | YYYTTSKWT |
| | | DEYYYTTSKWTFFDV | YYYTTSKWT |
| | | KDGLYFLNNQKMTKE | LYFLNNQKM |
| | | DGLYFLNNQKMTKER | LYFLNNQKM |
| | | KDKDEYYYTTSKWTF | YYYTTSKWT |
| | | DYNLQYKIEVKWSNK | YKIEVKWSN |
| | | SKDGLYFLNNQKMTK | LYFLNNQKM |
| | | DDYNLQYKIEVKWSN | YNLQYKIEV |
| | | FSNENKVARILEEKF | FSNENKVAR |
| | | IFSNENKVARILEEK | FSNENKVAR |
| | | EYYYTTSKWTFFDVF | YYYTTSKWT |
| | | YKIEVKWSNKSVNNI | YKIEVKWSN |
| | | QYKIEVKWSNKSVNN | YKIEVKWSN |
| | | GLYFLNNQKMTKERP | LYFLNNQKM |
| | | ENLSFKIIRKLNKEN | FKIIRKLNK |
| | | NLSFKIIRKLNKENE | FKIIRKLNK |
| | | LSFKIIRKLNKENEN | FKIIRKLNK |
| | | LYFLNNQKMTKERPL | LYFLNNQKM |
| | | KKDKDEYYYTTSKWT | DEYYYTTSK |
| | | KLENLSFKIIRKLNK | LSFKIIRKL |
| | | LENLSFKIIRKLNKE | FKIIRKLNK |
| AAC67038.1\| predicted coding region BB0689 [Borrelia burgdorferi B31] SEQ ID NO:31, SEQ ID NO:140477-140768 | HLA-DRB1*0101 | THTLFGTTPMQRIHK | FGTTPMQRI |
| | | RTLFGTTPMQRIHKY | FGTTPMQRI |
| | | TITHTLFGTTPMQRI | LFGTTPMQR |
| | | ITHTLFGTTPMQRIH | FGTTPMQRI |
| | | TLFGTTPMQRIHKYD | FGTTPMQRI |
| | | KEDMKILYSEIAELR | MKILYSEIA |
| | | EDMKILYSEIAELRK | MKILYSEIA |
| | | IDTKEDMKILYSEIA | IDTKEDMKI |
| | | TKEDMKILYSEIAEL | MKILYSEIA |
| | | DTKEDMKILYSEIAE | MKILYSEIA |
| | | IIFTLFLSQACNLST | FLSQACNLS |
| | | IFTLFLSQACNLSTM | LSQACNLST |
| | | IIIFTLFLSQACNLS | IFTLFLSQA |
| | | KKLIIFTLFLSQAC | IFTLFLSQA |
| | | LFGTTPMQRIHKYLQ | FGTTPMQRI |
| | | TLFLSQACNLSTMKK | LSQACNLST |
| | | MKKLIIFTLFLSQA | LIIFTLFL |
| | | FTLFLSQACNLSTMK | LSQACNLST |
| | | DMKILYSEIAELRKK | MKILYSEIA |
| | | MKILYSEIAELRKKL | MKILYSEIA |
| | | LIIFTLFLSQACNL | IFTLFLSQA |
| | | KLIIFTLFLSQACN | IFTLFLSQA |
| | | NRVVNAWLNSPSHKE | VVNAWLNSP |
| | | FGTTPMQRIHKYDQS | FGTTPMQRI |
| | | RTITHTLFGTTPMQR | THTLFGTTP |
| | | LFLSQACNLSTMRKI | LSQACNLST |
| | | RVVNAWLNSPSHKEA | WLNSPSHKE |
| | | VVNAWLNSPSHKEAL | WLNSPSHKE |
| | | VNAWLNSPSHKEALI | WLNSPSHKE |
| | | TDKIGGYRLKTTDNI | IGGYRLKTT |
| | | DKIGGYRLKTTDNID | IGGYRLKTT |
| | | VAKEYAIKLGENRTI | VAKEYAIKL |
| | | NAWLNSPSHKEALIN | WLNSPSHKE |

Fig. 34 continued

| | | | |
|---|---|---|---|
| | | FLSQACNLSTMEKID | LSQACNLST |
| | | TDTDKTGGYRLKTT | TGGYRLKTT |
| | | DTDKIGGYRLKTTDN | IGGYRLKTT |
| | | KTDTDKTGGYRLKTT | TDKTGGYRL |
| | | IELNRVVNAWLNSPS | VVNAWLNSP |
| | | LSQACNLSTMEKIDT | LSQACNLST |
| | | KTGGYRLKTTDNIDT | TGGYRLKTT |
| | | FNLTRFTLASGTFLN | LTRFTLASG |
| | | TGGYRLKTTDNIDT | TGGYRLKTT |
| | | LNRVVNAWLNSPSHK | VVNAWLNSP |
| | | ELNRVVNAWLNSPSH | VVNAWLNSP |
| | | EYATKLGENRTTHT | TKLGENRTT |
| | | DQSFNLTRFTLASGT | LTRFTLASG |
| | | REYATKLGENRTTTH | TKLGENRTT |
| | | QSFNLTRFTLASGTF | LTRFTLASG |
| | | EKVAREYATKLGENR | VAREYATKL |
| | | YATKLGENRTTHTL | TKLGENRTT |
| | | GTFLNRVVNAWLNSP | TFLNRVVNA |
| | | LTRFTLASGTFLNRV | TLASGTFLN |
| | | SFNLTRFTLASGTFL | LTRFTLASG |
| | | DTLEKVAREYATKLG | VAREYATKL |
| | | LEKVAREYATKLGEN | VAREYATKL |
| HLA-DRB1*0301 | None | | |
| HLA-DRB1*0401 | | KRDMKTLYSETAELR | MKTLYSETA |
| | | RDMKTLYSETAELRK | MKTLYSETA |
| | | TDTKRDMKTLYSETA | TKRDMKTLY |
| | | DTKRDMKTLYSETAE | MKTLYSETA |
| | | TKRDMKTLYSETAEL | MKTLYSETA |
| | | DMKTLYSETAELREK | MKTLYSETA |
| | | MKTLYSETAELRKRL | MKTLYSETA |
| | | TTFTLFLSQACNLS | TTFTLFLSQ |
| | | TTFTLFLSQACNLST | FLSQACNLS |
| | | TFTLFLSQACNLSTM | FLSQACNLS |
| | | FTLFLSQACNLSTME | FLSQACNLS |
| | | TLFLSQACNLSTMEK | FLSQACNLS |
| HLA-DRB1*0404 | | NRVVNAWLNSPSHKE | VVNAWLNSP |
| | | ELNRVVNAWLNSPSH | VVNAWLNSP |
| | | LNRVVNAWLNSPSHK | VVNAWLNSP |
| | | GIELNRVVNAWLNSP | ELNRVVNAW |
| | | IELNRVVNAWLNSPS | VVNAWLNSP |
| | | RVVNAWLNSPSHKEA | VVNAWLNSP |
| | | VVNAWLNSPSHKEAL | VVNAWLNSP |
| | | LIIFTLFLSQACNLS | LFTLFLSQA |
| | | LIFTLFLSQACNLST | FLSQACNLS |
| | | RTTHTLFGTTPMQR | THTLFGTT |
| | | TLFLSQACNLSTEHK | FLSQACNLS |
| | | MKKLLIFTLFLSQA | LLIFTLFL |
| | | KKLLIFTLFLSQAC | LLIFTLFL |
| | | LFTLFLSQACNLSTM | FLSQACNLS |
| | | HKEALINTDTDKIGG | LINTDTDKI |
| | | FTLFLSQACNLSTMH | FLSQACNLS |
| | | SHKEALINTDTDKIG | LINTDTDKI |
| | | NRTTHTLFGTTPMQ | THTLFGTT |
| | | TTHTLFGTTPMQRL | THTLFGTT |
| | | PSHKEALINTDTDKI | EALINTDTD |

Fig. 34 continued

| | | | |
|---|---|---|---|
| | | KKALINTDTDKIGGY | LINTDTDKI |
| | | EALINTDTDKIGGYR | INTDTDKI |
| | | GENRTITHILFGTIP | ITHILFGTI |
| | HLA-DRB1*0405 | TELNRVVNAWLNSPS | NRVVNAWLN |
| | | ELNRVVNAWLNSPSH | VNAWLNSPS |
| | | NRVVNAWLNSPSHKE | VNAWLNSPS |
| | | LNRVVNAWLNSPSHK | VNAWLNSPS |
| | | RVVNAWLNSPSHKEA | VNAWLNSPS |
| | | VVNAWLNSPSHKEAL | VNAWLNSPS |
| | | VNAWLNSPSHKEALT | VNAWLNSPS |
| | | TTFTLFLSQACNLS | FTLFLSQAC |
| | | KKLTTFTLFLSQAC | TTFTLFLS |
| | | TTFTLFLSQACNLST | FLSQACNLS |
| | | GTELNRVVNAWLNSP | NRVVNAWLN |
| | | KLTTFTLFLSQACN | TTFTLFLS |
| | | EKYDQSFNLTRFLA | YDQSFNLTR |
| | | FTLFLSQACNLSTMH | FLSQACNLS |
| | | TFTLFLSQACNLSTM | FLSQACNLS |
| | HLA-DRB1*0701 | None | |
| | HLA-DRB1*0802 | None | |
| | HLA-DRB1*0901 | VNAWLNSPSHKEALI | WLNSPSHKE |
| | | VVNAWLNSPSHKEAL | WLNSPSHKE |
| | | NAWLNSPSHKEALIN | WLNSPSHKE |
| | | RVVNAWLNSPSHKEA | WLNSPSHKE |
| | | NRVVNAWLNSPSHKE | VNAWLNSPS |
| | HLA-DRB1*1101 | None | |
| | HLA-DRB1*1302 | MKKLLLFTLFLSQA | TTFTLFLS |
| | | KKLLLFTLFLSQAC | LLFTLFLS |
| | | TELNRVVNAWLNSPS | VVNAWLNSP |
| | | KLLLFTLFLSQACN | LLFTLFLS |
| | | ELNRVVNAWLNSPSH | VVNAWLNSP |
| | | LNRVVNAWLNSPSHK | VVNAWLNSP |
| | | NRVVNAWLNSPSHKE | VVNAWLNSP |
| | | GTELNRVVNAWLNSP | LNRVVNAWL |
| | | LLFTLFLSQACNLS | LLFTLFLS |
| | | RVVNAWLNSPSHKEA | VNAWLNSPS |
| | | LLLFTLFLSQACNL | LLFTLFLS |
| | | DNIDIFVVLFGKRKY | IFVVLFGKR |
| | HLA-DRB1*1501 | NIDIFVVLFGKRKYK | IFVVLFGKR |
| | | DNIDIFVVLFGKRKY | IFVVLFGKR |
| | | IDIFVVLFGKRKYN | IFVVLFGKR |
| | | LNRVVNAWLNSPSHK | VNAWLNSPS |
| | | ELNRVVNAWLNSPSH | VNAWLNSPS |
| | | NRVVNAWLNSPSHKE | VNAWLNSPS |
| | | TDNIDIFVVLFGKRK | IFVVLFGKR |
| | | RVVNAWLNSPSHKEA | VNAWLNSPS |
| | | TELNRVVNAWLNSPS | LNRVVNAWL |
| | | KKLTTFTLFLSQAC | TTFTLFLS |
| | | KLTTFTLFLSQACN | TTFTLFLS |
| | | MKKLLLFTLFLSQA | TTFTLFLS |
| | | SKTAFIRKKLNLNHL | IRKKLNLNH |
| | | YSKTAFIRKKLNLNH | FIRKKLNLN |
| | | FIAFIRKKLNLNHLE | IRKKLNLNH |
| | | TAFIRKKLNLNHLET | IRKKLNLNH |
| | | AFIRKKLNLNHLETE | IRKKLNLNH |
| | | TTDNIDIFVVLFGKR | DIFVVLFGK |

Fig. 34 continued

| | | | |
|---|---|---|---|
| | | VVNAWLNSPSHKEAL | VNAWLNSPS |
| | | RTITRTLFGTTPMQR | ITRTLFGTT |
| | | LIIFTLFLSQACNL | IIIFTLFLS |
| | | TITRTLFGTTPMQRI | LFGTTPMQR |
| | HLA-DRB3*0101 | None | |
| | HLA-DRB4*0101 | None | |
| | HLA-DRB5*0101 | RTLFGTTPMQRIRKY | LFGTTPMQR |
| | | TRTLFGTTPMQRLHK | LFGTTPMQR |
| NP_045709.1 lipoprotein BBA36[Borrelia burgdorferi B31]<br><br>SEQ ID NO:32,<br>SEQ ID NO:140769-141052 | HLA-DRB1*0101 | SLTPEEAEKLESLKV<br>MQRISILLMLLAVFS<br>ISILLMLLAVFSCKQ<br>QRISILLMLLAVFSC<br>RISILLMLLAVFSCK<br>SILLMLLAVFSCKQF<br>ILLMLLAVFSCKQFG<br>LLMLLAVFSCKQFGD<br>ISSFDNISSIVSKAV<br>SSFDNISSIVSKAVD<br>KEFISSFDNISSIVS<br>FISSFDNISSIVSKA<br>SLKVFLKDAMSVNGR<br>LKVFLKDAMSVNGRE<br>EFISSFDNISSIVSK<br>ESLKVFLKDAMSVNG<br>KVFLKDAMSVNGREE<br>FDNISSIVSKAVDAS<br>VFLKDAMSVNGREEA<br>SFDNISSIVSKAVDA<br>MMQRISILLMLLAVF<br>DNISSIVSKAVDASK<br>LESLKVFLKDAMSVN<br>KLESLKVFLKDAMSV<br>DVVKDLIPKEISLTP<br>IPKEISLTPEEAEKL<br>SDVVKDLIPKEISLT<br>PKEISLTPEEAEKLE<br>EISLTPEEAEKLESL<br>FLKDAMSVNGREEAL<br>KEISLTPEEAEKLES<br>ISLTPEEAEKLESLK<br>VVKDLIPKEISLTPE<br>VKDLIPKEISLTPEE<br>ISSIVSKAVDASKKR<br>NISSIVSKAVDASKK<br>EEIFKVIKKVLTESE<br>EIFKVIKKVLTESES<br>LKDAMSVNGREEALK<br>VCYKIKNSKGEALSL<br>KDLIPKEISLTPEEA<br>YKIKNSKGEALSLFF<br>CYKIKNSKGEALSLF<br>NEEIFKVIKKVLTES<br>YVCYKIKNSKGEALS<br>EYVCYKIKNSKGEAL<br>IDSGNGIPLVVSDVV | LTPEEAEKL<br>MQRISILLM<br>LLMLLAVFS<br>LLMLLAVFS<br>LLMLLAVFS<br>LLMLLAVFS<br>LLMLLAVFS<br>LLMLLAVFS<br>FDNISSIVS<br>FDNISSIVS<br>FISSFDNIS<br>FDNISSIVS<br>LKDAMSVNG<br>LKDAMSVNG<br>FDNISSIVS<br>VFLKDAMSV<br>LKDAMSVNG<br>ISSIVSKAV<br>LKDAMSVNG<br>ISSIVSKAV<br>MMQRISILL<br>ISSIVSKAV<br>VFLKDAMSV<br>SLKVFLKDA<br>VKDLIPKEI<br>IPKEISLTP<br>VKDLIPKEI<br>LTPEEAEKL<br>LTPEEAEKL<br>LKDAMSVNG<br>LTPEEAEKL<br>LTPEEAEKL<br>LIPKEISLT<br>LIPKEISLT<br>ISSIVSKAV<br>ISSIVSKAV<br>FKVIKKVLT<br>FKVIKKVLT<br>LKDAMSVNG<br>IKNSKGEAL<br>LIPKEISLT<br>IKNSKGEAL<br>IKNSKGEAL<br>FKVIKKVLT<br>IKNSKGEAL<br>YKIKNSKGE<br>GNGIPLVVS |

Fig. 34 continued

| | | | |
|---|---|---|---|
| | | LTEIDSGNGIPLVVS | IDSGNGIPL |
| | | TKIDSGNGIPLVVS | GNGIPLVVS |
| | | VSDVVKDLIPKEISL | VKDLIPKEI |
| | | VVSDVVKDLIPKEIS | VKDLIPKEI |
| | | QKEFTFKVIKKVLTE | FKVIKKVLT |
| | | KQKFFTFKVIKKVLT | TFKVIKKVL |
| | | LVVSDVVKDLIPKEI | LVVSDVVKD |
| | | LTPFFAFKLFSLKVF | LTPFFAFKL |
| | | YKEFFDWLSKDVNRQ | FFDWLSKDV |
| | | TFKVIKKVLTESFSK | FKVIKKVLT |
| | | FKVIKKVLTESFSKY | FKVIKKVLT |
| | | KEFFDWLSKDVNRQK | WLSKDVNRQ |
| | | DSGNGIPLVVSDVVK | GNGIPLVVS |
| | | DLIPKFTSLTPFFAE | LTPKFTSL |
| | | ETDSGNGIPLVVSDV | GNGIPLVVS |
| | | FSTNFLRNLKNYGIV | LKNLKNYGI |
| | HLA-DRB1*0301 | None | |
| | HLA-DRB1*0401 | KEFTSSFDNTSSIVS | FTSSFDNTS |
| | | RTFKVIKKVLTESFS | FKVIKKVLT |
| | | RETFKVIKKVLTESF | FKVIKKVLT |
| | | NRKIFKVIKKVLTES | FKVIKKVLT |
| | | NRQKFFTSSFDNTSS | FTSSFDNTS |
| | | RQKFFTSSFDNTSST | FTSSFDNTS |
| | | QKFTSSFDNTSSIV | FTSSFDNTS |
| | HLA-DRB1*0404 | TSTLMILAVFSCKQ | MILAVFSCK |
| | | SLFFQKVVDAFGADP | FQKVVDAFG |
| | | LFFQKVVDAFGADPY | VVDAFGADP |
| | | FQKVVDAFGADPYKK | VVDAFGADP |
| | | FFQKVVDAFGADPYK | VVDAFGADP |
| | | STLMILAVFSCKQF | LIAVFSCKQ |
| | | TLLMILAVFSCKQFG | LIAVFSCKQ |
| | | QKVVDAFGADPYKKE | VVDAFGADP |
| | | FSLKVFLKDAMSVYG | FLKDAMSVY |
| | | SLKVFLKDAMSVYGR | LKDAMSVYG |
| | | LKVFLKDAMSVYGRF | LKDAMSVYG |
| | HLA-DRB1*0405 | KSYKFFDWLSKDVN | YKFFDWLS |
| | | FKSYKFFDWLSKDV | YKFFDWLS |
| | | YEKSYKFFDWLSKD | YKFFDWLS |
| | | YKFFDWLSKDVNRQ | YKFFDWLS |
| | | EYEKSYKFFDWLGK | YKFFDWLS |
| | | AEYEKSYKFFDWLS | YEKSYKFF |
| | | SYKFFDWLSKDVNR | YKFFDWLS |
| | | KEFTSSFDNTSSIVS | TSSFDNTSS |
| | | FTSSFDNTSSIVSK | FDNTSSIVS |
| | | NRQKFFTSSFDNTSS | FTSSFDNTS |
| | | RQKFFTSSFDNTSSI | TSSFDNTSS |
| | | QKFFTSSFDNTSSIV | TSSFDNTSS |
| | | FTSSFDNTSSIVSKA | FDNTSSIVS |
| | | KEFFDWLSKDVNRQK | FDWLSKDVN |
| | | EFFDWLSKDVNRQKF | FDWLSKDVN |
| | | TSSFDNTSSIVSKAV | FDNTSSIVS |
| | HLA-DRB1*0701 | TSSFDNTSSIVSKAV | SFDNTSSIV |
| | | SSFDNTSSIVSKAVD | TSSIVSKAV |
| | | SFDNTSSIVSKAVDA | TSSIVSKAV |
| | | FDNTSSIVSKAVDAS | TSSIVSKAV |

Fig. 34 continued

| | | DNISSIVSKAVDASK | ISSIVSKAV |
|---|---|---|---|
| | HLA-DRB1*0802 | None | |
| | HLA-DRB1*0901 | None | |
| | HLA-DRB1*1101 | None | |
| | HLA-DRB1*1302 | NEEIFKVIKKVLTES | FKVIKKVLT |
| | | EEIFKVIKKVLTESE | FKVIKKVLT |
| | | KCNEEIFKVIKKVLT | IFKVIKKVL |
| | | CNEEIFKVIKKVLTE | FKVIKKVLT |
| | | EIFKVIKKVLTESES | FKVIKKVLT |
| | | IFKVIKKVLTESESN | FKVIKKVLT |
| | | FKVIKKVLTESESNN | FKVIKKVLT |
| | | MQRISILLMLLAVFS | MQRISILLM |
| | | MMQRISILLMLLAVF | MQRISILLM |
| | | SESNNELKNLKNYGN | SNNELKNLK |
| | | QRISILLMLLAVFSC | ISILLMLLA |
| | | ESNNELKNLKNYGNV | LKNLKNYGN |
| | | RISILLMLLAVFSCK | ISILLMLLA |
| | | ISILLMLLAVFSCKQ | ISILLMLLA |
| | | ESLKVFLKDAMSVNG | LKVFLKDAM |
| | | LESLKVFLKDAMSVN | LKVFLKDAM |
| | | EYVCYKIKNSKGEAL | YKIKNSKGE |
| | | ISSFDNISSIVSKAV | FDNISSIVS |
| | | SSFDNISSIVSKAVD | FDNISSIVS |
| | | AEKLESLKVFLKDAM | LESLKVFLK |
| | | EFISSFDNISSIVSK | FDNISSIVS |
| | | YVCYKIKNSKGEALS | IKNSKGEAL |
| | | FISSFDNISSIVSKA | FDNISSIVS |
| | | VCYKIKNSKGEALSL | IKNSKGEAL |
| | | EKLESLKVFLKDAMS | LKVFLKDAM |
| | | LVVSDVVKDLIFKEI | VSDVVKDLI |
| | | NGIPLVVSDVVKDLI | LVVSDVVKD |
| | | KEFISSFDNISSIVS | SFDNISSIV |
| | HLA-DRB1*1501 | MQRISILLMLLAVFS | ILLMLLAVF |
| | | RISILLMLLAVFSCK | ILLMLLAVF |
| | | MMQRISILLMLLAVF | MMQRISILL |
| | | ISILLMLLAVFSCKQ | ILLMLLAVF |
| | | QRISILLMLLAVFSC | ILLMLLAVF |
| | | SILLMLLAVFSCKQF | LLMLLAVFS |
| | HLA-DRB3*0101 | None | |
| | HLA-DRB4*0101 | RISILLMLLAVFSCK | ILLMLLAVF |
| | | ISILLMLLAVFSCKQ | MLLAVFSCK |
| | | SILLMLLAVFSCKQF | MLLAVFSCK |
| | | ILLMLLAVFSCKQFG | MLLAVFSCK |
| | | YKEFFDWLSKDVNRQ | FDWLSKDVN |
| | | KEFFDWLSKDVNRQK | FDWLSKDVN |
| | HLA-DRB5*0101 | None | |
| AAT93789.1\| lipoprotein BBA36 (homolog 67%)[Borrelia garinii PBi] SEQ ID NO:33, SEQ ID NO:141053-141368 | HLA-DRB1*0101 | VSFFNNICGIITKAV | FNNICGIIT |
| | | SFFNNICGIITKAVD | ICGIITKAV |
| | | NNELANLKNLNSYNL | LANLKNLNS |
| | | NELANLKNLNSYNLN | LKNLNSYNL |
| | | LANLKNLNSYNLNCN | LKNLNSYNL |
| | | ELANLKNLNSYNLNS | LKNLNSYNL |
| | | ANLKNLNSYNLNCNN | LKNLNSYNL |
| | | FNNICGIITKAVDAS | ICGIITKAV |
| | | FFNNICGIITKAVDA | ICGIITKAV |

Fig. 34 continued

| | | | |
|---|---|---|---|
| | | SEFFERLEALKTFLK | FERLEALKT |
| | | FFFERLEALKTFLKD | FERLEALKT |
| | | NICGLITKAVDASK | ICGLITKAV |
| | | TSFFERLEALKTFL | FERLEALKT |
| | | VLTSFFERLEALKT | VLTSFFER |
| | | LTSFFERLEALKTF | FERLEALKT |
| | | KDQIIEKGPVLTSF | IIEKGPVLT |
| | | DQIIEKGPVLTSFF | IIEKGPVLT |
| | | MKRISILSILLLLLF | ISILLLLL |
| | | LKNLNSYLLNSCKR | LKNLNSYL |
| | | SKDQIIEKGPVLTSF | IIEKGPVLT |
| | | FSKDQIIEKGPVLTS | IIEKGPVLT |
| | | KRISISILLLLLF | ISILLLLL |
| | | RISISILLLLLFS | ISILLLLL |
| | | ISISILLLLLFSG | ISILLLLL |
| | | FVSFFNNTGGTTRA | FNNTGGTT |
| | | FFVSFFNNTGGTTK | FNNTGGTT |
| | | YGDVKSLTEVATDLE | VKSLTEVAT |
| | | QYGDVKSLTEVATDL | VKSLTEVAT |
| | | KFVSFFNNTGGTTT | VSFFNNTGG |
| | | GDVKSLTEVATDLED | VKSLTEVAT |
| | | KQYGDVKSLTEVATD | VKSLTEVAT |
| | | CKQYGDVKSLTEVAT | YGDVKSLTE |
| | | EFERLEALKTFLKDA | FERLEALKT |
| | | FERLEALKTFLKDAM | FERLEALKT |
| | | SILSILLLLLFSGK | ISILLLLL |
| | | NICGLITKAVDASKK | ICGLITKAV |
| | | ICGLITKAVDASKKR | ICGLITKAV |
| | | VSKDQIIEKGPVLT | DQIIEKGPV |
| | | QIIEKGPVLTSFFE | IIEKGPVLT |
| | | ILSILLLLLFSGKQ | ILLLLLFS |
| | | LSILLLLLFSGKQY | ILLLLLFS |
| | | IIEKGPVLTSFFER | IIEKGPVLT |
| | | SLFFQKVADAFGTQF | FQKVADAFG |
| | | DLSLFFQKVADAFGT | FQKVADAFG |
| | | LSLFFQKVADAFGTQ | FQKVADAFG |
| | | DVKSLTEVATDLEDD | VKSLTEVAT |
| | | VKSLTEVATDLEDDN | VKSLTEVAT |
| | | ALKTFLKDAMGVYGR | LKDAMGVYG |
| | | LKTFLKDAMGVNGRE | LKDAMGVNG |
| | | LFFQKVADAFGTQFY | FQKVADAFG |
| | | EALKTFLKDAMGVYG | TFLKDAMGV |
| | | KTFLKDAMGVNGREG | LKDAMGVNG |
| | | TFLKDAMGVNGREGD | LKDAMGVNG |
| | | YKFFDWLSKDVNRQ | FFDWLSKDV |
| | | DDLSLFFQKVADAFG | FFQKVADAF |
| | | LEDDNSFASGSVFSK | SFASGSVFS |
| | | EDDNSFASGSVFSKD | FASGSVFSK |
| | | KFFDWLSKDVNRQK | WLSKDVNRQ |
| | | DDNSFASGSVFSKDQ | FASGSVFSK |
| | | DNSFASGSVFSKDQI | FASGSVFSK |
| | | SFNNRLANLKNLLG | NRLANLK |
| HLA-DRB1*0301 | | LGFNEYVGYDIKTRI | LGFNEYVGY |
| | | FYVGYDIKTRTGDDL | VGYDIKTRT |
| | | FNEYVGYDIKTRIGD | VGYDIKTRT |
| | | NEYVGYDIKTRTGDD | VGYDIKTRT |

Fig. 34 continued

|  |  | GFNFYVCYDIKTRTG | VCYDIKTRT |
|---|---|---|---|
|  | HLA-DRB1*0401 | None |  |
|  | HLA-DRB1*0404 | ILSILLLILLFSCKQ | ILLLLLLFS |
|  |  | SILLLLLFSCKQYG | LLLLFSCKQ |
|  |  | ILLLLLFSCKQYGD | LLLLFSCKQ |
|  |  | LSILLLLLFSCKQY | LLLLFSCKQ |
|  |  | LLLLLFSCKQYGDY | LLLLFSCKQ |
|  | HLA-DRB1*0405 | KSYKFFDWLSKDVN | YKFFDWLS |
|  |  | NRQKFVSFFNNICG | FVSFFNNIC |
|  |  | VNRQKFVSFFNNIC | QKFVSFFN |
|  |  | RQKFVSFFNNICGI | FVSFFNNIC |
|  |  | QKFVSFFNNICGII | FVSFFNNIC |
|  |  | KFVSFFNNICGIIT | FVSFFNNIC |
|  |  | EKSYKFFDWLSKDV | YKFFDWLS |
|  |  | YEKSYKFFDWLSKD | YKFFDWLS |
|  |  | YKFFDWLSKDVNRQ | YKFFDWLS |
|  |  | EYEKSYKFFDWLSK | YKFFDWLS |
|  |  | AEYEKSYKFFDWLS | YEKSYKFF |
|  |  | SYKFFDWLSKDVNR | YKFFDWLS |
|  |  | FVSFFNNICGIITK | FVSFFNNIC |
|  |  | FVSFFNNICGIITKA | FVSFFNNIC |
|  |  | KVIKRVFTFSFNNF | TKRVFTFSF |
|  |  | RIFKVIKRVFTFSFN | TKRVFTFSF |
|  |  | KFFDWLSKDVNRQK | FDWLSKDVN |
|  |  | FKVIKRVFTFSFNN | TKRVFTFSF |
|  |  | IFKVIKRVFTFSFN | TKRVFTFSF |
|  |  | FIFKVIKRVFTFSF | FKVIKRVFT |
|  |  | FFDWLSKDVNRQKF | FDWLSKDVN |
|  |  | VIKRVFTFSFNNFL | TKRVFTFSF |
|  | HLA-DRB1*0701 | NNFLANLKNLNSYNL | NLKNLNSYN |
|  |  | ANLKNLNSYNLNSN | LKNLNSYNL |
|  |  | NFLANLKNLNSYNL | LKNLNSYNL |
|  |  | FLANLKNLNSYNLNS | LKNLNSYNL |
|  |  | LANLKNLNSYNLNSN | LKNLNSYNL |
|  |  | QEEIFKVIKRVFTF | IFKVIKRVF |
|  |  | NEEIFKVIKRVFTFS | IFKVIKRVF |
|  |  | KQEEIFKVIKRVFT | IFKVIKRVF |
|  |  | EEIFKVIKRVFTFSF | IFKVIKRVF |
|  | HLA-DRB1*0802 | None |  |
|  | HLA-DRB1*0901 | None |  |
|  | HLA-DRB1*1101 | None |  |
|  | HLA-DRB1*1302 | NNFLANLKNLNSYNL | LANLKNLN |
|  |  | FLANLKNLNSYNLNS | LKNLNSYNL |
|  |  | LANLKNLNSYNLNSN | LKNLNSYNL |
|  |  | ANLKNLNSYNLNSNN | LKNLNSYNL |
|  |  | KFVSFFNNICGIIT | FFNNICGII |
|  |  | VSFFNNICGIITKAV | FNNICGIIT |
|  |  | FVSFFNNICGIITK | FNNICGIIT |
|  |  | FVSFFNNICGIITKA | FNNICGIIT |
|  |  | MKRISILSILLLLL | ISILSILLL |
|  |  | SFFNNICGIITKAV | FNNICGIIT |
|  |  | KRISILSILLLLLF | ISILSILLL |
|  |  | NLKNLNSYNLNSNN | LKNLNSYNL |
|  |  | ISILSILLLLLFSC | ISILSILLL |
|  |  | RISILSILLLLLFS | ISILSILLL |

Fig. 34 continued

| | | | |
|---|---|---|---|
| | | NEEIFKVIKRVFTES | FKVIKRVFT |
| | | EEIFKVIKRVFTESE | FKVIKRVFT |
| | | FNNICGIITKAVDA | FNNICGIIT |
| | | ASKKRYNSNPKSLGF | YNSNPKSLG |
| | | KCNEEIFKVIKRVFT | IFKVIKRVF |
| | | DASKKRYNSNPKSLG | KKRYNSNPK |
| | | CNEEIFKVIKRVFTE | FKVIKRVFT |
| | | SKKRYNSNPKSLGFN | YNSNPKSLG |
| | | FNNICGIITKAVDAS | FNNICGIIT |
| | | EIFKVIKRVFTESEN | FKVIKRVFT |
| | | KKRYNSNPKSLGFNE | YNSNPKSLG |
| | | KRYNSNPKSLGFNEY | YNSNPKSLG |
| | | SILSILLLLLLFSCK | LSILLLLLL |
| | | IFKVIKRVFTESENN | FKVIKRVFT |
| | | FERLEALKTFLKDAM | LEALKTFLK |
| | | ERLEALKTFLKDAMG | LEALKTFLK |
| | | ILSILLLLLLFSCKQ | LSILLLLLL |
| | | ENNNELANLKNLNSY | LANLKNLNS |
| | | NNNELANLKNLNSYN | LANLKNLNS |
| | | LSILLLLLLFSCKQY | LSILLLLLL |
| | | FKVIKRVFTESENNN | FKVIKRVFT |
| | | EALKTFLKDAMGVNG | LKTFLKDAM |
| | | ESKDQIIEKGPVLTS | IIEKGPVLT |
| | | LEALKTFLKDAMGVN | LKTFLKDAM |
| | HLA-DRB1*1501 | NNELANLKNLNSYNL | LANLKNLNS |
| | | NELANLKNLNSYNLN | LANLKNLNS |
| | | ELANLKNLNSYNLNS | LKNLNSYNL |
| | | LANLKNLNSYNLNSN | LKNLNSYNL |
| | | ENNNELANLKNLNSY | LANLKNLNS |
| | | NNNELANLKNLNSYN | LANLKNLNS |
| | | ANLKNLNSYNLNSNN | LKNLNSYNL |
| | | LSILLLLLLFSCKQY | LLLLLFSCK |
| | | SENNNELANLKNLNS | NELANLKNL |
| | | SILLLLLLFSCKQYG | LLLLLFSCK |
| | | ILSILLLLLLFSCKQ | LLLLLFSCK |
| | HLA-DRB3*0101 | None | |
| | HLA-DRB4*0101 | SILSILLLLLLFSCK | LLLLLLFSC |
| | | LSILLLLLLFSCKQY | LLLLLFSCK |
| | | ILSILLLLLLFSCKQ | LLLLLFSCK |
| | | SILLLLLLFSCKQYG | LLLLLFSCK |
| | | ILLLLLLFSCKQYGD | LLLLLFSCK |
| | | YKEFFDWLSKDVNRQ | FDWLSKDVN |
| | | KEFFDWLSKDVNRQK | FDWLSKDVN |
| | HLA-DRB5*0101 | None | |
| NP_045739.1\| BBA66 antigen, P35, putative [Borrelia burgdorferi B31] SEQ ID NO:34, SEQ ID NO:141369-142034 | HLA-DRB1*0101 | DGLIANASSNSSLSD | IANASSNSS |
| | | RQADGLIANASSNSS | LIANASSNS |
| | | QADGLIANASSNSSL | IANASSNSS |
| | | ADGLIANASSNSSLS | IANASSNSS |
| | | GLIANASSNSSLSDS | IANASSNSS |
| | | LIRELMISGLGTQIS | MISGLGTQI |
| | | ELMISGLGTQISFEL | ISGLGTQIS |
| | | IRELMISGLGTQISF | ISGLGTQIS |
| | | RELMISGLGTQISFE | ISGLGTQIS |
| | | LMISGLGTQISFELA | ISGLGTQIS |
| | | KQRIPIQAVTTVPGN | IQAVTTVPG |

Fig. 34 continued

| | | | |
|---|---|---|---|
| | | TKQRIPIQAVTTVPG | IPIQAVTTV |
| | | QRIPIQAVTTVPQNT | IQAVTTVPG |
| | | IPIQAVTTVPGNTRT | IQAVTTVPG |
| | | RIPIQAVTTVPGNTR | IQAVTTVPG |
| | | LTANASSNSSLSDSK | LANASSNSS |
| | | TANASSNSSLSDSKS | TANASSNSS |
| | | MTSGLGTQTSFFLAL | TSGLGTQTS |
| | | TSGLGTQTSFFLALF | TSGLGTQTS |
| | | SNLPKTTAARAASLT | LPKTTAARA |
| | | LSNLPKTTAARAASL | LPKTTAARA |
| | | AKTVAAAPNKGSQNQ | VAAAPNKGS |
| | | SQAAKTVAAAPNKGS | TVAAAPNKG |
| | | AAKTVAAAPNKGSQN | VAAAPNKGS |
| | | QAAKTVAAAPNKGSQ | VAAAPNKGS |
| | | QSKLQTLKNELTRAT | LQTLKNELT |
| | | TQAVTTVPGNTRTFN | TQAVTTVPG |
| | | PIQAVTTVPGNTRTF | IQAVTTVPG |
| | | SKLQTLKNELTRATS | LKNELTRAT |
| | | ADLSNLPKTTAARAA | LPKTTAARA |
| | | SSAVQTTSSGSKLQ | VQTTSSGS |
| | | KNKVKGTLNKAADDQ | VKGTLNKAA |
| | | TNSSAVQTTSSGS | LNSSAVQT |
| | | LLPKTTAARAASLTK | TTAARAASL |
| | | SAVQTTSSGSKLQT | VQTTSSGS |
| | | NKVKGTLNKAADDQE | VKGTLNKAA |
| | | TMKLKELKSKLNQIL | LKELKSKLN |
| | | SSAVQTTSSGSKL | VQTTSSGS |
| | | KKLKELKSKLNQILD | LKELKSKLN |
| | | LSSSAVQTTSSGSK | VQTTSSGS |
| | | KTVAAAPNKGSQNQP | VAAAPNKGS |
| | | LPKTTAARAASLTKQ | TTAARAASL |
| | | SADLSNLPKTTAARA | LSNLPKTTA |
| | | SLTKQRIPIQAVTTV | RIPIQAVTT |
| | | LTKQRIPIQAVTTVP | IPIQAVTTV |
| | | KLQTLKNELTRATSE | LKNELTRAT |
| | | LQTLKNELTRATSEE | LKNELTRAT |
| | | SRQADLTANASSNS | ADLTANAS |
| | | DLSNLPKTTAARAAS | LPKTTAARA |
| | | EDYKNKVKGTLNKAA | KYKVKGTL |
| | | YKNKVKGTLNKAADD | VKGTLNKAA |
| | | DYKNKVKGTLNKAAD | VKGTLNKAA |
| | | FALNYSFSQPTRQQT | LNYSFSQPT |
| | | MKIKPLIQLKLLQLF | MKIKPLIQL |
| | | TFALNYSFSQPTRQQ | LNYSFSQPT |
| | | QTLKNELTRATSEEK | LKNELTRAT |
| | | SLTRFLMTSGLGTQT | TRFLMTSGL |
| | | LKELKSKLNQTLDRR | LKSKLNQTL |
| | | KLKELKSKLNQTLDR | LKSKLNQTL |
| | | PKTTAARAASLTKQR | TTAARAASL |
| | | PTFALNYSFSQPTRQ | LNYSFSQPT |
| | | KVYDRSYAPQINSQT | YDRSYAPQL |
| | | LPTFALNYSFSQPTR | LNYSFSQPT |
| | | KGSQNQQAAPSPQLQ | QQAAPSPQL |
| | | QLPTFALNYSFSQPT | LPTFALNYS |
| | | NKGSQNQQAAPSPQL | SQNQQAAPS |
| | | GSQNQQAAPSPQLQS | QQAAPSPQL |
| | | LSFSADLSNLPKTTA | FSADLSNLP |

Fig. 34 continued

| | | | |
|---|---|---|---|
| | | SQNQQAAPSPQLQSL | QQAAPSPQL |
| | | DSAFELLDVTSSAKV | FELLDVTSS |
| | | YDQFKMKDSAFELLD | FKMKDSAFE |
| | | TYDQFKMKDSAFELL | FKMKDSAFE |
| | | SAFELLDVTSSAKVY | LDVTSSAKV |
| | | QNQQAAPSPQLQSLS | QQAAPSPQL |
| | | DQFKMKDSAFELLDV | FKMKDSAFE |
| | | FDFTMKLKELKSKLN | FTMKLKELN |
| | | KVKQILNKAADDQFT | VKQILNKAA |
| | | VKQILNKAADDQFTT | VKQILNKAA |
| | | DFTMKLKELKSKLNQ | LKELKSKLN |
| | | TVAAAPNKGSQHPQ | VAAAPNKGS |
| | | FTMKLKELKSKLNQT | LKELKSKLN |
| | | ARLKKQSQAAKTVAA | KQSQAAKTV |
| | | FELLDVTSSAKVYDR | LDVTSSAKV |
| | | TKPLTQLKLLGLFLF | LTQLKLLGL |
| | | VYDRSYAPQLNSNTP | YAPQLNSNT |
| | | KPLTQLKLLGLFLFS | LTQLKLLGL |
| | | ALNYSFSQPTRQQTN | LNYSFSQPT |
| | | LNYSFSQPTRQQTNS | LNYSFSQPT |
| | | SSGSKLQTLKNELTR | LQTLKNELT |
| | | FSADLSNLPKTTAAR | LSNLPKTTA |
| | | ETYDQFKMKDSAFEL | FKMKDSAFE |
| | | SGSKLQTLKNELTRA | LQTLKNELT |
| | | TSSGSKLQTLKNELT | GSKLQTLKN |
| | | AFELLDVTSSAKVYD | LDVTSSAKV |
| | | ELKKQSQAAKTVAAA | SQAAKTVAA |
| | | AVQTTSGGSKLQTL | VQTTSGGS |
| | | SFSADLSNLPKTTAA | LSNLPKTTA |
| | | RETYDQFKMKDSAFE | QFKMKDSAF |
| | | YDRSYAPQLNSNTPE | YAPQLNSNT |
| | | KRYLDNMQNARQSVL | LDNMQNARQ |
| | | RYLDNMQNARQSVLF | MQNARQSVL |
| | | VQTTSGGSKLQTLK | VQTTSGGS |
| | | ELLDVTSSAKVYDRS | LDVTSSAKV |
| | | NSRNSGLPTFALNYS | NSGLPTFAL |
| | | KTTAARAASLTKQRT | TAARAASLT |
| | | ASLTKQRLPLQAVTT | LTKQRLPLQ |
| | | LKKQSQAAKTVAAAP | SQAAKTVAA |
| | | KLKPLTQLKLLGLFL | LTQLKLLGL |
| | | TLKNELTRATSFEKN | LKNELTRAT |
| | | LKNELTRATSFEKNX | LKNELTRAT |
| | | FELKSKLNQTLDKRX | LKSKLNQTL |
| | | QAVTTVPQNTRTFNS | VTTVPQNTR |
| | | RTFNSRNSGLPTFAL | FNSRNSGLP |
| | | SRNSGLPTFALNYSF | LPTFALNYS |
| | | YLDNMQNARQSVLFA | MQNARQSVL |
| | | VAAAPNKGSQHPQT | VAAAPNKGS |
| | | QPTRQQTNSSAVQT | QQTNSSAV |
| | | PTRQQTNSSAVQTT | TNSSAVQT |
| | | QSQAAKTVAAAPNKG | SQAAKTVAA |
| | | TRQQTNSSAVQTTT | TNSSAVQT |
| | | RSYAPQLNSNTPEAF | YAPQLNSNT |
| | | FKMKDSAFELLDVTS | FKMKDSAFE |
| | | LTQLKLLGLFLFSQT | LTQLKLLGL |
| | | KKQSQAAKTVAAAPN | SQAAKTVAA |
| | | LDNMQNARQSVLEAY | MQNARQSVL |

Fig. 34 continued

| | | | |
|---|---|---|---|
| | | VAAELKKQSQAAKTV | KKQSQAAKT |
| | | KQSQAAKTVAAAPNK | SQAAKTVAA |
| | | DRSYAPQLNGNTPEA | YAPQLNGNT |
| | | AAFIKKQSQAAKTVA | KQSQAAKTV |
| | | HSLIRELMSGLGLQ | IRELMISGL |
| | | PLTQLKLLGLFLFSQ | LKLLGLFLF |
| | | NSQLPTFALNYSFSQ | LPTFALNYS |
| | | QFKMKDSAFELLDVT | FKMKDSAFE |
| | | RQQTNSSSAVQTTTS | TNSSAVQT |
| | | NRSLTRELMTSGLGT | TRELMTSGL |
| | | DNMQNARQSVLFAVT | MQNARQSVL |
| | | TTAARAASLTKQRIP | TTAARAASL |
| | | QQTNSSAVQTTTSS | TNSSAVQT |
| | | RNSQLPTFALNYSFS | LPTFALNYS |
| | | AKVYDRSYAPQLNSN | YDRSYAPQL |
| | | TFNSRNSQLPTFAIN | FNSRNSQLP |
| | | SLSFSADLSNLPKTT | FSADLSNLP |
| | | FNSRNSQLPTFALNY | FNSRNSQLP |
| | | MKDSAFELLDVTSSA | FELLDVTSS |
| | | QLQSLSFSADLSNLP | LQSLSFSAD |
| | | TQLKLLGLFLFSQTT | LKLLGLFLF |
| | | LQSLSFSADLSNLPK | SADLSNLP |
| | | SSAKVYDRSYAPQLN | YDRSYAPQL |
| | | KKKDSAFELLDVTSS | MKDSAFELL |
| | | AVTTVPGNTRFNSR | VTTVPGNTR |
| | | KKRYLDNMQNARQSV | LDNMQNARQ |
| | | NGQAAPSFQLQSLSF | QQAAPSFQL |
| | | NYSFSQFTRQQTNSS | SQFTRQQT |
| | | IKKRYLDNMQNARQS | LDNMQNARQ |
| | | LKLLGLFLFSQTTEA | LGLFLFSQ |
| | | QSLSFSADLSNLPKT | FSADLSNLP |
| | | NQNRSLIRELMISGL | LIRELMISG |
| | | QNRSLIRELMISGLG | IRELMISGL |
| | | AASLTKQRIPIQAVT | LTKQRIPIQ |
| HLA-DRB1*0301 | None | | |
| HLA-DRB1*0401 | | GSTMFALYNFNQNHS | MFALYNFNQ |
| | | SLMFALYNFNQNHSL | LYNFNQNHS |
| | | MFALYNFNQNHSLTR | LYNFNQNHS |
| | | LMFALYNFNQNHSLI | LYNFNQNHS |
| | | ALYNFNQNHSLIRE | LYNFNQNHS |
| | | RQADGLIANASSNSS | LIANASSNS |
| | | QADGLIANASSNSSL | IANASSNS |
| | | ADGLIANASSNSSLS | LANASSNSS |
| | | DGLIANASSNSSLSP | LANASSNSS |
| | | GLIANASSNSSLSPS | LANASSNSS |
| | | LSFSADLSNLPKTTA | FSADLSNLP |
| | | LQSLSFSADLSNLPK | FSADLSNLP |
| | | QSLSFSADLSNLPKT | FSADLSNLP |
| | | SLSFSADLSNLPKTT | SADLSNLP |
| | | QLQSLSFSADLSNLP | LSFSADLSN |
| | | LYNFNQNHSLIRELK | LYNFNQNHS |
| | | ALYNFNQNHSLIREL | LYNFNQNHS |
| | | LIANASSNSSLSSK | LANASSNS |
| | | IANASSNSSLSDKS | IANASSNS |
| | | FSADLSNLPKTTAAR | FSADLSNLP |
| | | SFSADLSNLPKTTAA | FSADLSNLP |
| | | PTFALNYSFSQFTRQ | FALNYSFSQ |

Fig. 34 continued

| | | | |
|---|---|---|---|
| | | LPTFALNYSFSQPTR | FALNYSFSQ |
| | | FFNQDYLMAKTNSF | FNQDYLMAK |
| | | GLPTFALNYSFSQPT | FALNYSFSQ |
| | | SQLPTFALNYSFSQP | FALNYSFSQ |
| | | KSGLPTFALNYSFSQ | LPTFALNY |
| | | TFNQDYLMAKTNSFD | YLMAKTNSF |
| | | FALNYSFSQPTRQQT | FALNYSFSQ |
| | | TFALNYSFSQPTRQQ | FALNYSFSQ |
| | | FNQDYLMAKTNSFDF | YLMAKTNSF |
| | HLA-DRB1*0404 | RQADQLTANASSNSS | LTANASSNS |
| | | ADQLTANASSNSSLS | TANASSNSS |
| | | DQLTANASSNSSLSD | TANASSNSS |
| | | QADQLTANASSNSSL | TANASSNSS |
| | | QLTANASSNSSLSDS | TANASSNSS |
| | | DRSYAPQLNSNTPFA | YAPQLNSNT |
| | | RSYAPQLNSNTPFAE | QLNSNTPFA |
| | | SYAPQLNSNTPFAEN | QLNSNTPFA |
| | | FSLTRFLMTSGLGTQ | LTRFLMTSG |
| | | LTRFLMTSGLGTQTS | LMTSGLGTQ |
| | | YAPQLNSNTPFAENK | QLNSNTPFA |
| | | LSFSADLSNLPKTTA | FSADLSNLP |
| | | SLTRFLMTSGLGTQT | LMTSGLGTQ |
| | | RFLMTSGLGTQTSFF | LMTSGLGTQ |
| | | LTANASSNSSLSDSK | LANASSNSS |
| | | TANASSNSSLSDSKS | LANASSNSS |
| | | TRFLMTSGLGTQTSF | LMTSGLGTQ |
| | | APQLNSNTPFAENKR | QLNSNTPFA |
| | | LQSLSFSADLSNLPK | FSADLSNLP |
| | HLA-DRB1*0405 | RIPLQAVTTVPGNTR | LQAVTTVPG |
| | | IPLQAVTTVPGNTRF | LQAVTTVPG |
| | | KQRIPLQAVTTVPGN | LQAVTTVPG |
| | | TKQRIPLQAVTTVPG | KQRIPLQAV |
| | | QRIPLQAVTTVPGNT | LQAVTTVPG |
| | | PLQAVTTVPGNTRTF | LQAVTTVPG |
| | | LQAVTTVPGNTRTFY | LQAVTTVPG |
| | | SQAAKTVAAAPNKGS | AKTVAAAPN |
| | | AKTVAAAPNKGSQNQ | VAAAPNKGS |
| | | QAAKTVAAAPNKGSQ | VAAAPNKGS |
| | | AAKTVAAAPNKGSQN | VAAAPNKGS |
| | | KTVAAAPNKGSQNQP | VAAAPNKGS |
| | | LQSLSFSADLSNLPK | FSADLSNLP |
| | HLA-DRB1*0701 | DNKQNARQSVLFAYT | MQNARQSVL |
| | | KRYLDNKQNARQSVL | DNKQNARQS |
| | | YLDNKQNARQSVLFA | MQNARQSVL |
| | | LDNKQNARQSVLFAY | MQNARQSVL |
| | | RYLDNKQNARQSVLF | MQNARQSVL |
| | | SNLPKTTAARAASLT | LPKTTAARA |
| | | LSNLPKTTAARAASL | LPKTTAARA |
| | | NLPKTTAARAASLTK | TTAARAASL |
| | | LPKTTAARAASLTKQ | TTAARAASL |
| | | ADLSNLPKTTAARAA | LPKTTAARA |
| | | DLSNLPKTTAARAAS | LPKTTAARA |
| | | SADLSNLPKTTAARA | LSNLPKTTA |
| | | MQNARQSVLFAYTST | MQNARQSVL |
| | | NKQNARQSVLFAYTS | MQNARQSVL |
| | | PKTTAARAASLTKQR | TTAARAASL |

Fig. 34 continued

| | | |
|---|---|---|
| HLA-DRB1*0802 | None | |
| HLA-DRB1*0901 | DNMQNARQSVLEAYL | MQNARQSVL |
| | LDNMQNARQSVLEAY | MQNARQSVL |
| | YLDNMQNARQSVLEA | MQNARQSVL |
| | RYLDNMQNARQSVLE | MQNARQSVL |
| | KRYLDNMQNARQSVL | LDNMQNARQ |
| HLA-DRB1*1101 | None | |
| HLA-DRB1*1302 | ITQLKLLGLFLFSCT | LKLLGLFLF |
| | TKPLTQLKLLGLFLF | TQLKLLGLF |
| | TQLKLLGLFLFSCTT | LKLLGLFLF |
| | KPLTQLKLLGLFLFS | LKLLGLFLF |
| | PLTQLKLLGLFLFSC | LKLLGLFLF |
| | ADLSNLPKTTAARAA | LSNLPKTTA |
| | QLKLLGLFLFSCTTD | LKLLGLFLF |
| | NLNEDYKNKVKGILN | YKNKVKGIL |
| | LNEDYKNKVKGILNK | YKNKVKGIL |
| | LKLLGLFLFSCTTDA | LKLLGLFLF |
| | RLPLQAVTTVPGNTR | LQAVTTVPG |
| | LPLQAVTTVPGNTRT | LQAVTTVPG |
| | EDYKNKVKGILNKAA | YKNKVKGIL |
| | NEDYKNKVKGILNKA | YKNKVKGIL |
| | TKQRLPLQAVTTVPG | LPLQAVTTV |
| | QRLPLQAVTTVPGNT | LQAVTTVPG |
| | KQRLPLQAVTTVPGN | LQAVTTVPG |
| | QADGLIANASSNSSL | IANASSNSS |
| | ADGLIANASSNSSLS | IANASSNSS |
| | DGLIANASSNSSLSD | IANASSNSS |
| | RQADGLIANASSNSS | LIANASSNS |
| | LQAVTTVPGNTRTEN | LQAVTTVPG |
| | DYKNKVKGILNKAAD | YKNKVKGIL |
| | GLIANASSNSSLSDS | IANASSNSS |
| | PLQAVTTVPGNTRTE | LQAVTTVPG |
| | YKNKVKGILNKAADE | YKNKVKGIL |
| | MKIKPLTQLKLLGLF | LKPLTQLKL |
| | LSFSADLSNLPKTTA | FSADLSNLP |
| | NQDYLNAKTNSFDFT | YLNAKTNSF |
| | SFSADLSNLPKTTAA | LSNLPKTTA |
| | KRYLDNMQNARQSVL | YLDNMQNAR |
| | FSADLSNLPKTTAAR | LSNLPKTTA |
| | FLMTSCLGTQTSFEL | TSCLGTQTS |
| | QDYLNAKTNSFDFTK | YLNAKTNSF |
| | KIKPLTQLKLLGLFL | TQLKLLGLF |
| | LIANASSNSSLSDSK | IANASSNSS |
| | DYLNAKTNSFDFTMK | YLNAKTNSF |
| | LRELMTSCLGTQTS | TRELMTSCL |
| | RYLDNMQNARQSVLE | MQNARQSVL |
| | YLNAKTNSFDFTMKL | YLNAKTNSF |
| | SADLSNLPKTTAARA | LSNLPKTTA |
| | LMTSCLGTQTSFELA | LGTQTSFEL |
| | LRELMTSCLGTQTSF | LSGLGTQTS |
| | ADLSNLPKTTAARAA | LSNLPKTTA |
| | FNQDYLNAKTNSFDF | YLNAKTNSF |
| | LFNQDYLNAKTNSFD | YLNAKTNSF |
| | ELFNQDYLNAKTNSF | NQDYLNAK |
| | YLDNMQNARQSVLEA | MQNARQSVL |
| HLA-DRB1*1501 | IKPLTQLKLLGLFLF | LTQLKLLGL |

Fig. 34 continued

| | | | |
|---|---|---|---|
| | | FTMKLKELKSKLNQI | MKLKELKSK |
| | | FDFTMKLKELKSKLN | MKLKELKSK |
| | | KPLIQLKLLGLFLFS | LIQLKLLGL |
| | | DFTMKLKELKSKLNQ | MKLKELKSK |
| | | LIQLKLLGLFLFSCT | LIQLKLLGL |
| | | PLIQLKLLGLFLFSC | LIQLKLLGL |
| | | SFDFTMKLKELKSKL | MKLKELKSK |
| | | NSFDFTMKLKELKSK | TMKLKELKS |
| | | MFIKPLIQLKLLGLF | LIQLKLLGL |
| | HLA-DRB3*0101 | None | |
| | HLA-DRB4*0101 | LIQLKLLGLFLFSCT | LKLLGLFLF |
| | | KPLIQLKLLGLFLFS | LKLLGLFLF |
| | | IKPLIQLKLLGLFLF | LIQLKLLGL |
| | | IQLKLLGLFLFSCTI | LKLLGLFLF |
| | | PLIQLKLLGLFLFSC | LKLLGLFLF |
| | | LKLLGLFLFSCTIDA | LKLLGLFLF |
| | | QLKLLGLFLFSCTID | LKLLGLFLF |
| | | SGLPTFALNYSFSQP | LPTFALNYS |
| | | FALNYSFSQPTRQQT | YSFSQPTRQ |
| | | LNYSFSQPTRQQTNS | YSFSQPTRQ |
| | | PTFALNYSFSQPTRQ | FALNYSFSQ |
| | | NSGLPTFALNYSFSQ | LPTFALNYS |
| | | ALNYSFSQPTRQQTN | YSFSQPTRQ |
| | | TFALNYSFSQPTRQQ | YSFSQPTRQ |
| | | SRNSGLPTFALNYSF | LPTFALNYS |
| | | RNSGLPTFALNYSFS | LPTFALNYS |
| | | NSPNSGLPTFALNYS | GLPTFALNY |
| | HLA-DRB5*0101 | IKKRYLDNMQNAPQS | LDNMQNARQ |
| | | KRYLDNMQNARQSVL | LDNMQNARQ |
| | | KKRYLDNMQNARQSV | LDNMQNARQ |
| | | YIKKRYLDNMQNARQ | IKKRYLDNM |
| | | RYLDNMQNARQSVLE | LDNMQNARQ |
| | | VYDRSYAPQLNSNTP | YAPQLNSNT |
| | | KVYDRSYAPQLNSNT | YDRSYAPQL |
| | | DRSYAPQLNSNTPEA | YAPQLNSNT |
| | | RSYAPQLNSNTPEAE | YAPQLNSNT |
| | | YDRSYAPQLNSNTPE | YAPQLNSNT |
| | | FALNYSFSQPTRQQT | YSFSQPTRQ |
| | | ALNYSFSQPTRQQTN | YSFSQPTRQ |
| | | LNYSFSQPTRQQTNS | YSFSQPTRQ |
| | | TFALNYSFSQPTRQQ | YSFSQPTRQ |
| | | PTFALNYSFSQPTRQ | NYSFSQPTR |
| | | FDFTMKLKELKSKLN | FTMKLKELK |
| AAT93824.1\|BBA66 antigen, P35, putative [Borrelia garinii PBi] SEQ ID NO:35, SEQ ID NO:142035-142838 | HLA-DRB1*0101 | TYDQFKMKDSAFTLL | FKMKDSAFT |
| | | YDQFKMKDSAFTLLD | FKMKDSAFT |
| | | DQFKMKDSAFTLLDV | FKMKDSAFT |
| | | RETYDQFKMKDSAFT | RETYDQFKM |
| | | ETYDQFKMKDSAFTL | FKMKDSAFT |
| | | ASQASQVASSASQAS | ASQVASSAS |
| | | ASQVASSASQASPVA | VASSASQAS |
| | | SQVASSASQASPVAS | VASSASQAS |
| | | SQASQVASSASQASP | VASSASQAS |
| | | QASQVASSASQASPV | VASSASQAS |
| | | QFKMKDSAFTLLDVI | FKMKDSAFT |
| | | FKMKDSAFTLLDVIS | FKMKDSAFT |

Fig. 34 continued

| | | | |
|---|---|---|---|
| | | ATPPKQTASAQATQT | PKQTASAQA |
| | | TPPKQTASAQATQTV | TASAQATQT |
| | | PKQTASAQATQTVPN | TASAQATQT |
| | | PPKQTASAQATQTVP | TASAQATQT |
| | | KQTASAQATQTVPNN | TASAQATQT |
| | | SPATNVQATPPKQTA | VQATPPKQT |
| | | ASPATNVQATPPKQT | ATNVQATPP |
| | | ATNVQATPPKQTASA | VQATPPKQT |
| | | PATNVQATPPKQTAS | VQATPPKQT |
| | | VASSASQASPVASPA | VASSASQAS |
| | | SPLQKLKNNLLRRTA | LKNNLLRRT |
| | | QVASSASQASPVASP | VASSASQAS |
| | | TNVQATPPKQTASAQ | VQATPPKQT |
| | | NSPLQKLKNNLLRRT | LQKLKNNLL |
| | | TASAQATQTVPNNTS | TASAQATQT |
| | | PLQKLKNNLLRRTAE | LKNNLLRRT |
| | | LQKLKNNLLRRTAEE | LKNNLLRRT |
| | | QKLKNNLLRRTAEEK | LKNNLLRRT |
| | | QTASAQATQTVPNNT | TASAQATQT |
| | | VQATPPKQTASAQAT | VQATPPKQT |
| | | YTFSSSFSQPTSQTN | FSSSFSQPT |
| | | SLTISGLGTQTSLES | LSGLGTQTS |
| | | NVQATPPKQTASAQA | VQATPPKQT |
| | | QYTFSSSFSQPTSQT | FSSSFSQPT |
| | | QTNFNNSQSNNVLTN | FNNSQSNNV |
| | | TNFNNSQSNNVLTNY | FNNSQSNNV |
| | | LTTSGLGTQTSLEST | LSGLGTQTS |
| | | SQTNFNNSQSNNVLT | FNNSQSNNV |
| | | TSQTNFNNSQSNNVL | FNNSQSNNV |
| | | PTSQTNFNNSQSNNV | QTNFNNSQS |
| | | SVFDRGSAPQLSSNT | FDRGSAPQL |
| | | TRSLTTSGLGTQTSL | LSGLGTQTS |
| | | ISVFDRGSAPQLSSN | FDRGSAPQL |
| | | LTRSLTTSGLGTQTS | TTSGLGTQT |
| | | PQQYTFSSSFSQPTS | FSSSFSQPT |
| | | QQYTFSSSFSQPTSQ | FSSSFSQPT |
| | | NISVFDRGSAPQLSS | FDRGSAPQL |
| | | KPQQYTFSSSFSQPT | YTFSSSFSQ |
| | | RSLTTSGLGTQTSLE | TSGLGTQTS |
| | | SNISVFDRGSAPQLS | FDRGSAPQL |
| | | AQATQTVPNNTSTPN | TQTVPNNTS |
| | | QATQTVPNNTSTPNQ | TQTVPNNTS |
| | | KQVNPCNPMQTANQA | VNPCNPMQT |
| | | KFELNYADATTTNTS | LNYADATTT |
| | | ANQVNPCNPMQTANQ | VNPCNPMQT |
| | | FELNYADATTTNTSS | LNYADATTT |
| | | PANQVNPCNPMQTAN | VNPCNPMQT |
| | | TPANQVNPCNPMQTA | VNPCNPMQT |
| | | FSSSFSQPTSQTNFN | FSSSFSQPT |
| | | TFSSSFSQPTSQTNF | FSSSFSQPT |
| | | KKFELNYADATTTNT | LNYADATTT |
| | | ASQASPVASPATNVQ | ASPVASPAT |
| | | TTSGLGTQTSLESTL | LGTQTSLES |
| | | ASAQATQTVPNNTST | TQTVPNNTS |
| | | SQASPVASPATNVQA | VASPATNVQ |
| | | VFDRGSAPQLSSNTP | DRGSAPQLS |
| | | TSGLGTQTSLESTLE | LGTQTSLES |

Fig. 34 continued

| | | | |
|---|---|---|---|
| | | KLKNNLERRIAEEKI | LKNILLRRI |
| | | LNPANQVNPCNPNQT | NQVNPCNPN |
| | | DSAFTLLDVTSNTSV | FTLLDVTSN |
| | | NYREQTQPSFVVPVY | HQTQPSFVV |
| | | FNQSTIKPQQYTFSS | IKPQQYTFS |
| | | PSFVVPVYSQTSPLQ | VVPVYSQTS |
| | | TIKPQQYTFSSSFSQ | IKPQQYTFS |
| | | SAFTLLDVTSNTSVF | FTLLDVTSN |
| | | TPNQSTIKPQQYTFS | QSTIKPQQY |
| | | QTANQANQANQANQA | TANQANQAN |
| | | TANQANQANQANQAN | TANQANQAN |
| | | TKPQQYTFSSSPSQP | TKPQQYTFS |
| | | YSQNSPLQKLKNNLL | YSQNSPLQK |
| | | YREQTQPSFVVPVYS | HQTQPSFVV |
| | | PVYSQNSPLQKLKNN | YSQNSPLQK |
| | | TFSFNTQYLNTTINS | FNTQYLNTT |
| | | TIYQFNQNHSLTRSL | YQFNQNHSL |
| | | RTRSFNTQYLNTTIN | FNTQYLNTT |
| | | SFNTQYLNTTINSYT | FNTQYLNTT |
| | | PVASPATNVQATPPK | VASPATNVQ |
| | | NLQCTNPANQVNPCN | LQCTNPANQ |
| | | NLLYQRNQNHSLIRS | YQRNQNHSL |
| | | FNTQYLNTTINSYTF | LNTTINSYT |
| | | QLVPNTSLPKQSLL | VPNTSLPK |
| | | RDSAFTLLDVTSNTS | FTLLDVTSN |
| | | ESYNTQYLNTTINSY | FNTQYLNTT |
| | | YAMMDFDQAKTTEFG | FDQAKTTEF |
| | | QASQASQASQVASSA | QASQASQVA |
| | | SGBSPLQKLKNNLLR | LQKLKNNLL |
| | | SASQASPVASPATNV | ASPVASPAT |
| | | NQANQASQASQASQV | QASQASQAS |
| | | SQASQASQASQVASS | QASQASQVA |
| | | QALPPKQLASQALQ | KQLASQAL |
| | | LKELESKLNSTLAE | LKELESKLN |
| | | ASQASQASQVASSAS | QASQASQVA |
| | | LKELESKLNSTLAEK | LKELESKLN |
| | | KYLDKMQDARQSALD | DKMQDARQS |
| | | KLSLNTGSNATKNKI | INTGSNATK |
| | | ASSASQASPVASPAT | ASQASPVAS |
| | | NKYLDKMQDARQSAL | DKMQDARQS |
| | | LQCTNPANQVNPCNP | LQCTNPANQ |
| | | SFSQPTSQTNFTMSQ | FSQPTSQTN |
| | | TQYLNTTINSYTFKD | LNTTINSYT |
| | | YLDKMQDARQSALDL | DKMQDARQS |
| | | SRNRLYAMMDFDQA | RNRLYAMMD |
| | | AFTLLDVTSNTSVFD | LLDVTSNTS |
| | | FTLLDVTSNTSVFDR | LLDVTSNTS |
| | | AKTSTNTGSNATKNK | TNTGSNATK |
| | | QNSPLQKLKNLLR | LQKLKNLL |
| | | TKVACLQKNTQSKRN | TKVACLQKN |
| | | QAKTSTNTGSNATKN | TNTGSNATK |
| | | DQAKTSTNTGSNATK | STNTGSNAT |
| | | NTKVACLQKNTQSKK | TKVACLQKN |
| | | NRLYAMMDFDQAKTT | YAMMDFDQA |
| | | LYAMMDFDQAKTTFF | YAMMDFDQA |
| | | RLYAMMDFDQAKTTF | YAMMDFDQA |
| | | NQQKLNTTINSYTFK | LNTTINSYT |

Fig. 34 continued

| | | | |
|---|---|---|---|
| | | CSASQASPVASPATN | ASQASPVAS |
| | | RNRLYAMMDFDQAKT | YAMMDFDQA |
| | | VASPATNVQATPPKQ | VASPATNVQ |
| | | FRNRLYAMMDFDQAK | YAMMDFDQA |
| | | YQENQNHSLLRSLL | YQENQNHSL |
| | | AMMDFDQAKTFPCS | FDQAKTTFF |
| | | VYSGNSPLQKLKNL | YSGNSPLQK |
| | | TTNTSSNSKRNDPQ | TTNTSSNSK |
| | | TKNKYLDKMQDARQS | TKNKYLDKM |
| | | QYLNTTINSYTFKDK | LNTTINSYT |
| | | FNQNHSLLRSLLTSG | MQNHSLTRS |
| | HLA-DRB1*0301 | None | |
| | HLA-DRB1*0401 | ESFMQYLNTILNGY | YNTQYLNTI |
| | | SFMQYLNTILNGYT | YLNTILNGY |
| | | FNTQYLNTILNSYTF | YLNTILNGY |
| | | TQYLNTIINSYFKD | YLNTILNGY |
| | | NTQYLNTTINSYTFK | YLNTTINSY |
| | | GGIDMLLYQENQHS | MLLYQENQ |
| | | STMNLYQFNQNHSL | LYQFNQNHS |
| | | MTLYQFNQNESLTR | LYQFNQNHS |
| | | NTLYQFNQNESLTRS | LYQFNQNHS |
| | | TMNLYQFNQNESLT | LYQFNQNHS |
| | | QYLNTTINSYTFKDK | YLNTTINSY |
| | | YLNTTINSYTFKDFL | YLNTTINSY |
| | | SFVVPVYSGNSPLQR | VYSGNSPLQ |
| | | PSFVVPVYSGNSPLQ | VVPVYSGNS |
| | | VPVYSGNSPLQKLKN | VYSGNSPLQ |
| | | VVPVYSGNSPLQKLK | VYSGNSPLQ |
| | | FVVPVYSGNSPLQKL | VYSGNSPLQ |
| | | SLTSGLGTQTSLES | TSGLGTQTS |
| | | LTSGLGTQTSLEST | LGTQTSLES |
| | | SGLGTQTSLESTLE | LGTQTSLES |
| | | TSGLGTQTSLRSTLE | LGTQTSLES |
| | | RFTYDQFKMKDSAFT | TYDQFKMKD |
| | | LISGLGIQISLESTL | LGIQISLES |
| | | NYADAIITNTSSNSK | ITNTSSNS |
| | | PTSQNFNNSQSNNV | SQTNFNNSQ |
| | | YADAIITNTSSNSKR | TTNTSSNSK |
| | | ADAIITNTSSNSKRN | ITNTSSNSK |
| | | STYDQFKMKDSAFTL | FKMKDSAFT |
| | | ISQTNFNNSQSNNVL | FNNSQSNNV |
| | | TYDQFKMKDSAFTLL | FKMKDSAFT |
| | | SQTNFNNSQSNNVLT | FNNSQSNNV |
| | | QTNFNNSQSNNVLTN | FNNSQSNNV |
| | | DQFKMKDSAFTLLEV | FKMKDSAFT |
| | | NFNNSQSNNVLTNY | FNNSQSNNV |
| | | YDQFKMKDSAFTLLE | FKMKDSAFT |
| | | DAIITNTSSNSKRND | ITNTSSNSK |
| | | AIITNTSSNSKRNDP | ITNTSSNSK |
| | | TLYQFNQNHSLLRSL | LYQFNQNHS |
| | | LYQFNQNHSLLRSLL | LYQFNQNHS |
| | | ANLNKDYKNKVEEL | LNKDYKNKV |
| | | TIDANLNKDYKNKVE | LNKDYKNKV |
| | | CTIDANLNKDYKNKV | DANLNKDYK |
| | | TDANLNKDYKNKVEE | LNKDYKNKV |
| | | DANLNKDYKNKVEEL | LNKDYKNKV |
| | | XPQQYTFSSSFSQPT | YTFSSSFSQ |

Fig. 34 continued

| | | | |
|---|---|---|---|
| | | QQYFPSSPSQPTSQ | YFPSSPSQ |
| | | PQQYFSSSFSQPTS | YFSSSFSQ |
| | | VYSGNSPLQRLNNL | VYSGNSPLQ |
| | | FLLDVTSNISVFDR | LLDVTSNIS |
| | HLA-DRB1*0404 | TQYLNTTINSYTFK | YLNTTINSY |
| | | SFNTQYLNTTINSYT | YLNTTINSY |
| | | FSFNTQYLNTTINSY | SFNTQYLNT |
| | | FNTQYLNTTINSYTF | YLNTTINSY |
| | | NTQYLNTTINSYTFK | YLNTTINSY |
| | | NKVFFLNSSTDDQA | LNSSTDDQ |
| | | KNKVFFLNSSTDDQ | VFFLNSST |
| | | KVFFLNSSTDDQAK | LNSSTDDQ |
| | | VFFLNSSTDDQAKT | LNSSTDDQ |
| | | FFLNSSTDDQAKTS | LNSSTDDQ |
| | | QYLNTTINSYTFKDK | YLNTTINSY |
| | | YLNTTINSYTFKDKL | YLNTTINSY |
| | | NYADAITTNTSSNSK | TTNTSSNS |
| | | YADAITTNTSSNSKR | TTNTSSNSK |
| | | ADAITTNTSSNSKRD | TTNTSSNSK |
| | | DAITTNTSSNSKRDP | TTNTSSNSK |
| | | AITTNTSSNSKRDP | TTNTSSNSK |
| | | QAIQTVPNNTSTPNQ | TVPNNTSTP |
| | | FLLNSSTDDQAKTST | LNSSTDDQ |
| | | GSIMNILYQENQHIS | ILYQENQH |
| | | LNSSTDDQAKTSTN | LNSSTDDQ |
| | | FGSIMNILYQENQH | MNILYQEN |
| | | AIQTVPNNTSTPNQS | TVPNNTSTP |
| | | LNYADAITTNISSKG | YADAITTNT |
| | | IQTVPNNTSTPNQSI | TVPNNTSTP |
| | | AQAIQTVPNNTSTPN | TVPNNTSTP |
| | | SIMNILYQENQHSL | ILYQENQH |
| | | SAQAIQTVPNNTSTP | IQTVPNNTS |
| | | MNILYQENQHSLI | ILYQENQH |
| | | SQASPVASPATNVQA | VASPATNVQ |
| | | ASQASPVASPATNVQ | PVASPATNV |
| | | ASPVASPATNVQATP | VASPATNVQ |
| | HLA-DRB1*0405 | LASAQAIQTVPNNTS | AQAIQTVPN |
| | | ASAQAIQTVPNNTST | IQTVPNNTS |
| | | SAQAIQTVPNNTSTP | IQTVPNNTS |
| | | AQAIQTVPNNTSTPN | IQTVPNNTS |
| | | QAIQTVPNNTSTPNQ | IQTVPNNTS |
| | | AIQTVPNNTSTPNQS | IQTVPNNTS |
| | | IQTVPNNTSTPNQST | IQTVPNNTS |
| | | ASPATNVQATPPKQT | TNVQATPPK |
| | | SCLCTQTSLESTLEE | LCTQTSLES |
| | | SPATNVQATPPKQTA | VQATPPKQT |
| | | PATNVQATPPKQTAS | VQATPPKQT |
| | | KKKDSAFTLLDVTSN | KDSAFTLLD |
| | | TCTQTSLESTLEETE | TSLESTLEE |
| | | LTNYRHQTPSFVVP | RHQTPSFVV |
| | | CTQTSLESTLEETEK | TSLESTLEE |
| | | VLTNYRHQTPSFVV | YRHQTPSF |
| | | GLCTQTSLESTLEE | TSLESTLEE |
| | | ATNVQATPPKQTASA | VQATPPKQT |
| | | FKKTFSFNTQYLNTT | TFSFNTQYL |
| | | LCTQTSLESTLEEEKK | TSLESTLEE |
| | | TNVQATPPKQTASAQ | VQATPPKQT |

Fig. 34 continued

| | | KKIESPNTQYLNTII | IESPNTQYL |
|---|---|---|---|
| | | TNYRHQTQPSFVVPV | HQTQPSFVV |
| | | DQFKMRDSAFTLLD | RDSAFTLLD |
| | | YDQFKMRDSAFTLLD | FKMRDSAFT |
| | | TQYLNTIINSYTFKD | LNTIINSYT |
| | HLA-DRB1*0701 | TQYLNTIINSYTFKD | YLNTIINSY |
| | | HQNHSLIRSLIISGL | HSLIRSLII |
| | | QNHSLIRSLIISGLG | HSLIRSLII |
| | | PTTQYLNTIINSYTF | YLNTIINSY |
| | | NTQYLNTIINSYTFK | YLNTIINSY |
| | | ADAIINTSSNSKRI | IINTSSNSK |
| | | NYADAIINTSSNSK | IINTSSNS |
| | | YADAIINTSSNSKR | IINTSSNSK |
| | | VLTNYRHQTQPSFVV | RHQTQPSFV |
| | | TNYRHQTQPSFVVPV | RQTQPSFVV |
| | | YQFNQNHSLIRSLII | NHSLIRSLI |
| | | QFNQNHSLIRSLIIS | HSLIRSLII |
| | | SQTNFNNSQSNNVLT | FNNSQSNNV |
| | | DAIINTSSNSKRID | IINTSSNSK |
| | | FNQNHSLIRSLIISG | HSLIRSLII |
| | | TSQTNFNNSQSNNVL | FNNSQSNNV |
| | | QTNFNNSQSNNVLTN | FNNSQSNNV |
| | | TNFNNSQSNNVLTNY | FNNSQSNNV |
| | | LTNYRHQTQPSFVVP | HQTQPSFVV |
| | | SPNTQYLNTIINSYT | YLNTIINSY |
| | | PTSQTNFNNSQSNNV | NFNNSQSNN |
| | HLA-DRB1*0802 | None | |
| | HLA-DRB1*0901 | QQYTFSSSFSQPTSQ | YTFSSSFSQ |
| | | KPQQYTFSSSFSQPT | YTFSSSFSQ |
| | | PQQYTFSSSFSQPTS | YTFSSSFSQ |
| | | TTKPQQYTFSSSFSQ | TTKPQQYTF |
| | | TKPQQYTFSSSFSQP | YTFSSSFSQ |
| | | KKKWLNYADAIITYT | WLNYADAII |
| | | AEKKWLNYADAIIT | WLNYADAII |
| | | EKKWLNYADAIITN | WLNYADAII |
| | | KKWLNYADAIINTS | WLNYADAII |
| | | QYTFSSSFSQPTSQT | YTFSSSFSQ |
| | | YTFSSSFSQPTSQTN | YTFSSSFSQ |
| | | IAEKKWLNYADAII | IAEKKWLN |
| | | TPKQIASAQAIQTV | KQIASAQAI |
| | | ATPKQIASAQAIQT | KQIASAQAI |
| | | HSLIRSLIISGLGIQ | LIRSLIISG |
| | | PTKQIASAQAIQTVP | KQIASAQAI |
| | | SLIRSLIISGLGIQI | IISGLGIQ |
| | | LIRSLIISGLGIQIS | IISGLGIQ |
| | | IRSLIISGLGIQISL | IISGLGIQ |
| | | RSLIISGLGIQISLL | IISGLGIQ |
| | | QTNFNNSQSNNVLTN | FNNSQSNNV |
| | | SQTNFNNSQSNNVLT | FNNSQSNNV |
| | | TNFNNSQSNNVLTNY | FNNSQSNNV |
| | HLA-DRB1*1101 | None | |
| | HLA-DRB1*1302 | HSPLQKLKNLLRRI | LQKLKNLL |
| | | SPLQKLKNLLRRIA | LKNLLRRI |
| | | PLQKLKNLLRRIAE | LKNLLRRI |
| | | LQKLKNLLRRIAEE | LKNLLRRI |
| | | QSLGQYIKNKYLEKF | LGQYIKNKY |

Fig. 34 continued

| | | | |
|---|---|---|---|
| | | QKLKNNLLRRIARRK | LKNNLLRRI |
| | | SLGQYIKNKYLDKKQ | LGQYIKNKY |
| | | LGQYIKNKYLDKKQD | LGQYIKNKY |
| | | PQSLGQYIKNKYLDK | LGQYIKNKY |
| | | DPQSLGQYIKNKYLD | LGQYIKNKY |
| | | TQYLNTTINSYTFKD | LNTTINSYT |
| | | NDPQSLGQYIKNKYL | LGQYIKNKY |
| | | FNTQYLNTTINSYTF | YLNTTINSY |
| | | RNDPQSLGQYIKNKY | PQSLGQYIK |
| | | SFNTQYLNTTINSYT | YLNTTINSY |
| | | KLKNNLLRRIARRKN | LKNNLLRRI |
| | | NTQYLNTTINSYTFK | YLNTTINSY |
| | | QYLNTTINSYTFKDK | LNTTINSYT |
| | | AQATQTVPNNTSPN | TQTVPNNTS |
| | | QATQTVPNNTSTPN | VPNNTSTPN |
| | | LKNNLLRRIARRKNR | LKNNLLRRI |
| | | FTLLDVISNISVFDR | LLDVISNIS |
| | | FSPNTQYLNTTINSY | FNTQYLNTT |
| | | HSLTRSLTTSGLGTQ | TRSLTTSGL |
| | | YLNTTINSYTFKDKL | TINSYTFKD |
| | | SLTSGLGTQTSLES | LTTSGLGTQ |
| | | GLIRSLIISGLGIQI | IRSLIISGL |
| | | LTTSGLGTQTSLEST | LGTQTSLES |
| | | IQTVPNNTSTPNQSI | VPNNTSTPN |
| | | ATQTVPNNTSTPNQS | VPNNTSTPN |
| | | TLLDVISNISVFDRG | ISNISVFDR |
| | | IISGLGIQISLESTL | LGIQISLES |
| | | LLDVISNISVFDRGS | ISNISVFDR |
| | | ISGLGIQISLESTLE | LGIQISLES |
| | | GNSPLQKLKNNLLRR | LQKLKNNLL |
| | | LIRSLIISGLGIQIS | IIISGLGIQ |
| | | IRSLIISGLGIQISL | IIISGLGIQ |
| | | YADAIITNTSSNSKR | IITNTSSNS |
| | | NYADAIITNTSSNSK | IITNTSSNS |
| | | RQSAIDLYLNITEIR | ALDLYLNIT |
| | | ADAIITNTSSNSKRN | IITNTSSNS |
| | | SGLGTQTSLESTLEE | LGTQTSLES |
| | | DAIITNTSSNSKRND | IITNTSSNS |
| | | SGNSPLQKLKNNLLR | LQKLKNNLL |
| | | TEFGSIMNILYQEKQ | SGSIMNILY |
| | | LNTTINSYTFKDKLE | LNTTINSYT |
| | | YSGNSPLQKLKNNLL | YSGNSPLQK |
| | | AFTLLDVISNISVFD | LLDVISNIS |
| | | QGLNPANQVNPCNPK | LNPANQVNP |
| | | TTEFGSIMNILYQEK | FGSIMNILY |
| | | LQAKISTNTGSNATK | ISTNTGSNA |
| | | NQHSLTRSLTTSGL | LTRSLTTSG |
| | | LNYADAIITNTSSNS | LNYADAIIT |
| | | KTTEFGSIMNILYQE | FGSIMNILY |
| | | DDQAKISTNTGSNAT | ISTNTGSNA |
| | | AKISTNTGSNATKYK | ISTNTGSNA |
| | | QAKISTNTGSNATKY | ISTNTGSNA |
| | | QTVPNNTSTPNQSTT | VPNNTSTPN |
| | | NHSLTRSLTTSGLGT | TRSLTTSGL |
| | | TNFNNSQSNVLTNY | FNNSQSNNV |
| | | LNPANQVNPCNPKQT | NQVNPCNPK |
| | | LDVISNISVFDRGSA | ISNISVFDR |

Fig. 34 continued

| | | | |
|---|---|---|---|
| | | TKNKNIKVAGLQKN | NKINIKVAG |
| | | NFNNSQSNNVLTNYR | FNNSQSNNV |
| | | QNHSLIRSLIISGLG | LIRSLIISGL |
| | | FNNSQSNNVLTNYR | FNNSQSNNV |
| | | GQYLKNKYLDKNQEA | LKNKYLDKN |
| | | QYLKNKYLDKNQEAR | LKNKYLDKN |
| | | SAFTILDVTSNTSVF | ILDVTSNTS |
| | | GLYPANQVNPGNPKQ | NQVNPGNPM |
| | | RSLTTSGLGTQTSLE | LTTSGLGTQ |
| | | ATTNTSSNSKKDEP | TTNTSSNS |
| | | AKTTEFQSTMNTLYQ | FQSTMNTLY |
| | | KISNTGSNATKNKT | ISNTGSNA |
| | | QTNFNNSQSNNVLTN | FNNSQSNNV |
| | | DSAFTILDVTSNTSV | ILDVTSNTS |
| | | SQTNFNNSQSNNVLT | FNNSQSNNV |
| | | TSQTNFNNSQSNNVL | FNNSQSNNV |
| | | QAKTTEFQSTMNTLY | EFQSTMNTL |
| | | GLGTQTSLESTLEFE | LGTQTSLES |
| | | LGTQTSLESTLEFE | LGTQTSLES |
| | | KDSAFTILDVTSNTS | FTILDVTSN |
| | | EFQSTMNTLYQFNQI | FQSTMNTLY |
| | | NKTNIRVAGLQKNTQ | IRVAGLQKN |
| | | ANLNKDYKNKVEELL | LNKDYKNKV |
| | | FTSQNFNNSQSNNV | NFNNSQSNN |
| | | DVTSNTSVFDRGSAP | TSNTSVFDR |
| | | PANQVNPGNPKQIAN | NQVNPGNPM |
| | | NPANQVNPGNPKQIA | NQVNPGNPM |
| | | TEDQAKISINTGSNA | AKISINTGS |
| | | SQSNNVLTNYRHQTQ | SNNVLTNYR |
| | | ISINTGSNATKNKTN | ISINTGSNA |
| | | SAQAIQTVPNNISTP | IQTVPNNTS |
| | | NSQSNNVLTNYRHQT | SNNVLTNYR |
| | | KLKVAGLQKNTQCKK | IKVAGLQKN |
| | HLA-DRB1*1501 | NSPLQKLKNNLLRRI | QKLKNNLLR |
| | | SPLQKLKNNLLRRIA | QKLKNNLLR |
| | | HSLIRSLIISGLGIQ | LIRSLIISG |
| | | PLQKLKNYLLRRIAE | QKLKNYLLR |
| | | HQNHSLIRSLIISGL | LIRSLIISG |
| | | GNSPLQKLKNNLLRR | LQKLKNNLL |
| | | QNHSLIRSLIISGLG | LIRSLIISG |
| | | NHSLIRSLTTSGLGT | LIRSLTTSG |
| | | TQYLNTLINSYTEKD | YLNTLINSY |
| | HLA-DRB3*0101 | None | |
| | HLA-DRB4*0101 | YSGNSPLQKLKNNLL | SPLQKLKNN |
| | | NSPLQKLKNNLLRRI | LQKLKNNLL |
| | | SPLQKLKNNLLRRIA | LQKLKNNLL |
| | | GNSPLQKLKNNLLRR | LQKLKNNLL |
| | | SGNSPLQKLKNNLLR | LQKLKNNLL |
| | HLA-DRB5*0101 | RETYDQFKMKDSAFT | YDQFKMKDS |
| | | ETYDQFKMKDSAFTL | FKMKDSAFT |
| | | TYDQFKMKDSAFTLL | FKMKDSAFT |
| | | YDQFKMKDSAFTLLD | FKMKDSAFT |
| | | DQFKMKDSAFTLLDV | FKMKDSAFT |
| NP_045742.1\| hypothetical protein BBA69 [Borrelia | HLA-DRB1*0101 | IKINLITRLLLLGI | LITRLLLLL |
| | | LLKNLITRLLLLGIG | LITRLLLLL |

Fig. 34 continued

| protein BBA69 [Borrelia burgdorferi B31] SEQ ID NO:36, SEQ ID NO:142839-143178 | | KINIITMILTLICIS<br>INIITMILTLICISC<br>NIIKINIITMILTLI<br>SDEKFMGTTASELKA<br>ASDEKFMGTTASELK<br>DEKFMGTTASELKAI<br>EKFMGTTASELKAIG<br>AKITNEESNLLDTYI<br>NIITMILTLICISCA<br>QIAKITNEESNLLDT<br>IAKITNEESNLLDTY<br>IQIAKITNEESNLLD<br>DIQIAKITNEESNLL<br>GASDEKFMGTTASEL<br>IITMILTLICISCAP<br>NKYYKDSDSLQSAFY<br>RFNKYYKDSDSLQSA<br>FNKYYKDSDSLQSAF<br>EFNKYYKDSDSLQS<br>LNIIKINIITMILTL<br>KLNIIKINIITMILT<br>KFMGTTASELKAIGK<br>IAANFLYRIALDIQL<br>KITNEESNLLDTYIP<br>FMGTTASELKAIGKE<br>ITNEESNLLDTYIPA<br>PKIAANFLYRIALDI<br>ENDPKIAANFLYRIA<br>YENDPKIAANFLYRI<br>KNQYDIQIAKITNEE<br>NQYDIQIAKITNEES<br>RKNQYDIQIAKITNE<br>NDPKIAANFLYRIAL<br>EDRKNQYDIQIAKIT<br>DRKNQYDIQIAKITN<br>DPKIAANFLYRIALD<br>AKLNIIKINIITMIL<br>ANFLYRIALDIQLKL<br>AANFLYRIALDIQLK<br>NFLYRIALDIQLKLE<br>ITMILTLICISCAPF<br>ENEKMLLKRFLLSSL<br>EKMLLKRFLLSSLDY<br>FLYRIALDIQLKLEK<br>NEKMLLKRFLLSSLD<br>APFNKINPKANENTK<br>CAPFNKINPKANENT<br>TMILTLICISCAPFN<br>FNKINPKANENTKLK<br>KIAANFLYRIALDIQ<br>PFNKINPKANENTKL<br>KMLLKRFLLSSLDYK<br>MLLKRFLLSSLDYKK<br>MILTLICISCAPFNK<br>LQLQEKFKKTLNKTL<br>LQEKFKKTLNKTLED<br>QLQEKFKKTLNKTLE | IITMILTLI<br>IITMILTLI<br>INIITMILT<br>FMGTTASEL<br>FMGTTASEL<br>FMGTTASEL<br>FMGTTASEL<br>ITNEESNLL<br>IITMILTLI<br>ITNEESNLL<br>ITNEESNLL<br>ITNEESNLL<br>IAKITNEES<br>EKFMGTTAS<br>IITMILTLI<br>YKDSDSLQS<br>YKDSDSLQS<br>YKDSDSLQS<br>NKYYKDSDS<br>INIITMILT<br>IKINIITMI<br>FMGTTASEL<br>IAANFLYRI<br>ITNEESNLL<br>FMGTTASEL<br>ITNEESNLL<br>IAANFLYRI<br>IAANFLYRI<br>DPKIAANFL<br>YDIQIAKIT<br>YDIQIAKIT<br>YDIQIAKIT<br>IAANFLYRI<br>RKNQYDIQI<br>YDIQIAKIT<br>IAANFLYRI<br>IKINIITMI<br>YRIALDIQL<br>YRIALDIQL<br>YRIALDIQL<br>ITMILTLIC<br>MLLKRFLLS<br>MLLKRFLLS<br>YRIALDIQL<br>MLLKRFLLS<br>INPKANENT<br>FNKINPKAN<br>LTLICISCA<br>INPKANENT<br>IAANFLYRI<br>INPKANENT<br>LKRFLLSSL<br>LKRFLLSSL<br>ICISCAPFN<br>KFKKTLNKT<br>FKKTLNKTL<br>FKKTLNKTL |

Fig. 34 continued

| | | NENEKMLLKRFLLSS | MLLKRFLLS |
| | | QEKFKKTLNKTLEDY | FKKTLNKTL |
| | HLA-DRB1*0301 | None | |
| | HLA-DRB1*0401 | EDYRKNTNNIQENKV | YRKNTNNIQ |
| | | LEDYRKNTNNIQENK | YRKNTNNIQ |
| | | TLEDYRKNTNNIQEN | YRKNTNNIQ |
| | | KTLEDYRKNTNNIQE | YRKNTNNIQ |
| | | NKTLEDYRKNTNNIQ | LEDYRKNTN |
| | | YRKNTNNIQENKVLA | YRKNTNNIQ |
| | | DYRKNTNNIQENKVL | YRKNTNNIQ |
| | | EHFNKYYKDSDSLQS | YYKDSDSLQ |
| | | HFNKYYKDSDSLQSA | YKDSDSLQS |
| | | FNKYYKDSDSLQSAF | YKDSDSLQS |
| | | NKYYKDSDSLQSAFY | YKDSDSLQS |
| | | EKLTNNYENDPKTAA | LTNNYENDP |
| | | KLTNNYENDPKTAAN | YENDPKTAA |
| | | LTNNYENDPKTAANF | YENDPKTAA |
| | | TNNYENDPKTAANFL | YENDPKTAA |
| | | NNYENDPKTAANFLY | YENDPKTAA |
| | | DIQTAKITNEFSNLL | TAKITNEFS |
| | | IQTAKITNEFSNLLD | ITNEFSNLL |
| | HLA-DRB1*0404 | None | |
| | HLA-DRB1*0405 | IQTAKITNEFSNLLD | TAKITNEFS |
| | | DIQTAKITNEFSNLL | TAKITNEFS |
| | | NQYDIQTAKITNEFS | QIAKITNEF |
| | | QYDIQTAKITNEFSN | TAKITNEFS |
| | | YDIQTAKITNEFSNL | TAKITNEFS |
| | | LIKINIITKILTLIC | INIITNILT |
| | | IKINIITKILTLICT | ITKILTLIC |
| | | QTAKITNEFSNLLDT | TAKITNEFS |
| | | KINIITMILTLICTS | ITMILTLIC |
| | | INIITMILTLICTSC | ITMILTLIC |
| | | TAKITNEFSNLLDTY | TAKITNEFS |
| | | NIITMILTLICTSCA | ITMILTLIC |
| | | LEDYRKNTNNIQENK | YRKNTNNIQ |
| | | EDYRKNTNNIQENKV | YRKNTNNIQ |
| | | TLEDYRKNTNNIQEN | YRKNTNNIQ |
| | | KTLEDYRKNTNNIQE | YRKNTNNIQ |
| | | ETLEKLTNNYENDPK | LEKLTNNYE |
| | | EKLTNNYENDPKTAA | TNNYENDPK |
| | | KELEKLTNNYENDP | LEKLTNNYE |
| | | LKETLEKLTNNYEND | LEKLTNNYE |
| | | TLKETLEKLTNNYEN | LEKLTNNYE |
| | | EHFNKYYKDSDSLQS | FNKYYKDSD |
| | HLA-DRB1*0701 | DEKFMGTTASELKAT | FMGTTASEL |
| | | EKFMGTTASELKATG | FMGTTASEL |
| | | ASDEKFMGTTASEL | KFMGTTASE |
| | | ASDEKFMGTTASELK | FMGTTASEL |
| | | DEKFMGTTASELKA | FMGTTASEL |
| | | KFMGTTASELKAIGK | FMGTTASEL |
| | | FMGTTASELKAIGKE | FMGTTASEL |
| | | LQLQEKFKKTLNKTL | KFKKTLNKT |
| | | QEKFKKTLNKTLEDY | FKKTLNKTL |
| | | QLQEKFKKTLNKTLE | FKKTLNKTL |
| | | LQEKFKKTLNKTLED | FKKTLNKTL |

Fig. 34 continued

| | | | |
|---|---|---|---|
| | | EKYKKTLNKTLEEYR | FKKTLNKTL |
| | HLA-DRB1*0802 | TKLKKNTRLKKPANP | LKKNTRLKK |
| | | ENTRLKKNTRLKKPA | LKKNTRLKK |
| | | NTKLKKNTRLKKPAN | LKKNTRLKK |
| | | ANENIKLKKNTRLKK | ENTKLKKNT |
| | | KENTRLKKNTRLKKP | LKKNTRLKK |
| | HLA-DRB1*0901 | None | |
| | HLA-DRB1*1101 | ENTRLKKNTRLKKPA | LKKNTRLKK |
| | | ANENIKLKKNTRLKK | ANENIKLKK |
| | | NTKLKKNTRLKKPAN | LKKNTRLKK |
| | | NENTRLKKNTRLKKP | LKKNTRLKK |
| | | TKLKKNTRLKKPANP | LKKNTRLKK |
| | | KLKKNTRLKKPANPG | LKKNTRLKK |
| | | LKKNTRLKKPANPGE | LKKNTRLKK |
| | HLA-DRB1*1302 | KLNIIKINIITMILT | IKINIITMI |
| | | INIIKINIITMILTL | IKINIITMI |
| | | NIIKINIITMILTLI | IKINIITMI |
| | | IIKINIITMILTLIC | INIITMILT |
| | | IKINIITMILTLICT | INIITMILT |
| | | AKINIIKINIITMIL | IKINIITMI |
| | | KAKINITKINIITMI | INITKINII |
| | | KINIITMILTLICTS | INIITMILT |
| | | IXIITMILTLICTSC | IXIITMILT |
| | | KKAKINITKINIITM | INITKINII |
| | | MKKAKINITKINIIT | INITKINII |
| | | NIITMILTLICTSCA | IITMILTLI |
| | | IITMILTLICTSCAP | IITMILTLI |
| | | ANENIRLKKNTRLKK | NTRLKKNTR |
| | | NENTRLKKNTRLKKP | LKKNTRLKK |
| | | ENTRLKKNTRLKKPA | LKKNTRLKK |
| | | NTKLKKNTRLKKPAN | LKKNTRLKK |
| | | TKLKKNTRLKKPANP | LKKNTRLKK |
| | | RKNQYDIQTAKTTYF | YDIQTAKTT |
| | | NQYDIQTAKTTYFFS | IQTAKTTYF |
| | | KNQYDIQTAKTTYFF | IQTAKTTYF |
| | HLA-DRB1*1501 | KKLLKRFLLSSLDYK | LKRFLLSSL |
| | | MLLKRFLLSSLDYKK | LKRFLLSSL |
| | | ENEKMLLKRFLLSSL | MLLKRFLLS |
| | | NEKMLLKRFLLSSLD | LKRFLLSSL |
| | | EKMLLKRFLLSSLDY | LKRFLLSSL |
| | | LLKRFLLSSLDYKKE | LKRFLLSSL |
| | | LKRFLLSSLDYKKEN | LKRFLLSSL |
| | | NENEKMLLKRFLLSS | MLLKRFLLS |
| | | INIITMILTLICTSC | IITMILTLI |
| | HLA-DRB3*0101 | None | |
| | HLA-DRB4*0101 | NFLYRIALDIQLKLE | LYRIALDIQ |
| | | ANFLYRIALDIQLKL | LYRIALDIQ |
| | | TAANFLYRIALDIQL | LYRIALDIQ |
| | | AANFLYRIALDIQLK | LYRIALDIQ |
| | | KTAANFLYRIALDIQ | FLYRIALDI |
| | | LYRIALDIQLKLEKH | LYRIALDIQ |
| | | FLYRIALDIQLKLEK | LYRIALDIQ |
| | | NKTLEDYRKNINNIQ | LEDYRKNIN |
| | | KTLEDYRKNINNIQY | YRKNINNIQ |
| | HLA-DRB5*0101 | APFRKINPKANENTK | FRKINPKAN |
| | | CAPFRKINPKANENT | FRKINPKAN |

Fig. 34 continued

| | | | |
|---|---|---|---|
| | | CISCAPFNKINPKAN<br>ISCAPFNKINPKANE<br>SCAPFNKINPKANEN<br>FNKINPKANENTKLK | ISCAPFNKI<br>FNKINPKAN<br>FNKINPKAN<br>FNKINPKAN |
| AAT93826.1\| conserved hypothetical protein BBA69[Borrelia garinii PBi]<br><br>SEQ ID NO:37,<br>SEQ ID NO:143179-143468 | HLA-DRB1*0101 | KLNIIKLNILTTTLT<br>LNIIKLNILTTTLT<br>NIIKLNILTTTLTLI<br>IIKLNILTTTLTLIC<br>IKLNILTTTLTLICI<br>KLNILTTTLTLICIS<br>LNILTTTLTLICISC<br>EPLREKYPEATASKL<br>DEKMQMKKIIYSSLN<br>EDEKMQMKKIIYSSL<br>EKMQMKKIIYSSLNY<br>TKLNIIKLNILTTTL<br>PEDEKMQMKKIIYSS<br>LPEDEKMQMKKIIYS<br>IKENFKKALNKTIDA<br>LREKYPEATASKLET<br>KTKLNIIKLNILTTT<br>KENFKKALNKTIDAY<br>PLREKYPEATASKLE<br>KLETTLKILEAQKEK<br>KIKENFKKALNKTID<br>SKLETTLKILEAQKE<br>LKIKENFKKALNKTI<br>ETTLKILEAQKEKEN<br>LETTLKILEAQKEKE<br>NILTTTLTLICISCA<br>TTLKILEAQKEKENI<br>ENFKKALNKTIDAYN<br>MQMKKIIYSSLNYET<br>ILTTTLTLICISCAV<br>LEPLREKYPEATASK<br>REKYPEATASKLETT<br>EKYPEATASKLETTL<br>KMQMKKIIYSSLNYE<br>DLEPLREKYPEATAS<br>KDLEPLREKYPEATA<br>NKDLEPLREKYPEAT<br>LTTTLTLICISCAVN<br>KKTKLNIIKLNILTT<br>TTTLTLICISCAVNK<br>NFKKALNKTIDAYNQ | KLNILTTTL<br>LNILTTTLT<br>LNILTTTLT<br>LNILTTTLT<br>LNILTTTLT<br>LNILTTTLT<br>LNILTTTLT<br>LREKYPEAT<br>MQMKKIIYS<br>MQMKKIIYS<br>MQMKKIIYS<br>IKLNILTTT<br>MQMKKIIYS<br>DEKMQMKKI<br>FKKALNKTI<br>YPEATASKL<br>IIKLNILTT<br>FKKALNKTI<br>YPEATASKL<br>LKILEAQKE<br>FKKALNKTI<br>ETTLKILEA<br>NFKKALNKT<br>LKILEAQKE<br>LKILEAQKE<br>LTTTLTLIC<br>LKILEAQKE<br>FKKALNKTI<br>MQMKKIIYS<br>LTLICISCA<br>LREKYPEAT<br>YPEATASKL<br>YPEATASKL<br>MQMKKIIYS<br>LREKYPEAT<br>LREKYPEAT<br>LEPLREKYP<br>LTLICISCA<br>LNIIKLNIL<br>LTLICISCA<br>FKKALNKTI |
| | HLA-DRB1*0301 | None | |
| | HLA-DRB1*0401 | QEILEKLDKNLQHKK<br>EILEKLDKNLQHKKI<br>QIDFLKTFKTDPHDS<br>LQEILEKLDKNLQHK<br>IIKLNILTTTLTLIC<br>NTQIDFLKTFKTDPH<br>IDFLKTFKTDPHDSL<br>ILQEILEKLDKNLQH | LEKLDKNLQ<br>LEKLDKNLQ<br>LKTFKTDPH<br>LEKLDKNLQ<br>LNILTTTLT<br>FLKTFKTDP<br>LKTFKTDPH<br>LEKLDKNLQ |

Fig. 34 continued

| | | | |
|---|---|---|---|
| | | TQIDFLKTFKTDPHD | LKTFKTDPH |
| | | TKLNTLTTTLTLQT | LNTLTTTLT |
| | | KILQWILEKLDKNLQ | ILEKLDKN |
| | | KLNTIKLNTLTTTLT | TTKLNTLTT |
| | | LNTIKLNILTTTLTL | LNILTTTLT |
| | | NTTKLNILTTTLTLT | LNTLTTTLT |
| | | DFLKTFKTDPEDSLP | LKTFKTDPH |
| | | TNFNYKFFNSLKPIY | YKFFNSLKP |
| | HLA-DRB1*0404 | TDFLKTFKTDPEDSL | FLKTFKTDP |
| | | NTQIDFLKTFKTDPH | FLKTFKTDP |
| | | TQIDFLKTFKTDPHD | FLKTFKTDP |
| | | QIDFLKTFKTDPHDS | FLKTFKTDP |
| | | DNTQIDFLKTFKTDP | TDFLKTFKT |
| | | DFLKTFKTDPEDSLP | FLKTFKTDP |
| | | TTKLNTLTTTLTLTC | KLNTLTTTL |
| | | FLKTFKTDPEDSLPF | FLKTFKTDP |
| | | NTTKLNILTTTLTLT | KLNTLTTTL |
| | | KLNTTKLNTLTTTLT | KLNTLTTTL |
| | | LNTTKLNILTTTLTL | KLNTLTTTL |
| | HLA-DRB1*0405 | KHTNFNYKFFNSLKP | NYKFFNSLK |
| | | HIKFNYKFFNSLKPL | YKFFNSLKP |
| | | TNFNYKFFNSLKPIY | YKFFNSLKP |
| | | FNIKNFVNKFQDLEP | LKNFVNKFQ |
| | | MQNKKITYSSLNYET | KKITYSSLN |
| | HLA-DRB1*0701 | LIKLNILTTTLTLIC | ILTTTLTLI |
| | | TKLNTLTTTLTLQT | NLTTTLTLT |
| | | NTIKLNILTTTLTLI | LNILTTTLT |
| | | PFLREKYPEATASKL | LREKYPEAT |
| | | PLREKYPEATASKLE | YPEATASKL |
| | | LREKYPEATASKLET | YPEATASKL |
| | | REKYPEATASKLETT | YPEATASKL |
| | | EKYPEATASKLETTL | YPEATASKL |
| | | KLNILTTTLTLICIS | ILTTTLTLI |
| | HLA-DRB1*0802 | None | |
| | HLA-DRB1*0901 | LKTKFNFKKALNKTT | TKFNFKKAL |
| | | KFNFKKALNKTIDAY | FKKALNKTI |
| | | TKFNFKKALNKTIDA | FKKALNKTI |
| | | NIKFNFKKALNKTID | FKKALNKTI |
| | | FNFKKALNKTIDAYN | FKKALNKTI |
| | HLA-DRB1*1101 | None | |
| | HLA-DRB1*1302 | KLNTTKLNTLTTTLT | TKLNTLTT |
| | | LNTTKLNILTTTLTL | LNTLTTTLT |
| | | NTTKLNILTTTLTLT | LNTLTTTLT |
| | | TTKLNTLTTTLTLTC | LNTLTTTLT |
| | | TKLNTLTTTLTLQT | LNTLTTTLT |
| | | KTKLNTTKLNTLTTT | LNTTKLNTL |
| | | TKLNTTKLNTLTTTL | TKLNTLTT |
| | | KLNTLTTTLTLQTS | LNTLTTTLT |
| | | LNILTTTLTLICISC | LNILTTTLT |
| | | KKTKLNTTKLNTLTT | LNTTKLNTL |
| | | NKKIKLNIIKLNILT | LNIIKLNIL |
| | | QSKLDIISKVIKNFI | LDIISKVIK |
| | | SKLDIISKVIKNFIK | ISKVIKNFI |
| | | KLDIISKVIKNFIKD | ISKVIKNFI |
| | | DIISKVIKNFIKDEL | ISKVIKNFI |
| | | LDIISKVIKNFIKDE | ISKVIKNFI |

Fig. 34 continued

| | | | |
|---|---|---|---|
| | | IISKVIKNPIKDELQ | IKNPIKDEL |
| | | ISKVIKNPIKDELQI | IKNPIKDEL |
| | | YDIPIIIQSRLDIIS | IPIIIQSRL |
| | | FIYDIPIIIQSRLDI | IPIIIQSRL |
| | | IYDIPIIIQSRLDII | IPIIIQSRL |
| | | IIIQSRLDIISKVIK | IIIQSRLDI |
| | | IPIIIQSRLDIISKV | IIIQSRLDI |
| | | IQSRLDIISKVIKNP | LDIISKVIK |
| | | EDEKMQMKKIIYSSL | MQMKKIIYS |
| | | DIPIIIQSRLDIISK | IIIQSRLDI |
| | | IIQSRLDIISKVIKN | LDIISKVIK |
| | | EKMQMKKIIYSSLNY | MQMKKIIYS |
| | | KNFIYDIPIIIQSRL | FIYDIPIII |
| | | DEKMQMKKIIYSSLN | MQMKKIIYS |
| | | MQMKKIIYSSLNYET | MQMKKIIYS |
| | | KMQMKKIIYSSLNYE | MQMKKIIYS |
| | | PEDEKMQMKKIIYSS | MQMKKIIYS |
| | | NFIYDIPIIIQSRLD | IPIIIQSRL |
| | | LPEDEKMQMKKIIYS | EKMQMKKII |
| | | NPIKDELQILNQKEI | IKDELQILN |
| | | IKDELQILNQKEIEE | LQILNQKEI |
| | | PIKDELQILNQKEIE | LQILNQKEI |
| | | KDELQILNQKEIEEL | LQILNQKEI |
| | HLA-DRB1*1501 | IEELLMRIESELKIK | LMRIESELK |
| | | EIEELLMRIESELKI | LMRIESELK |
| | | KEIEELLMRIESELK | LLMRIESEL |
| | | EELLMRIESELKIKE | LMRIESELK |
| | | ELLMRIESELKIKEN | LMRIESELK |
| | HLA-DRB3*0101 | None | |
| | HLA-DRB4*0101 | ILQEILEKLDKNLQH | LEKLDKNLQ |
| | | LQEILEKLDKNLQHK | LEKLDKNLQ |
| | | QEILEKLDKNLQHKK | LEKLDKNLQ |
| | | EILEKLDKNLQHKKI | LEKLDKNLQ |
| | | KILQEILEKLDKNLQ | ILQEILEKL |
| | HLA-DRB5*0101 | LKIKENFKKALNKTI | LKIKENFKK |
| | | NKFQDLEPSKKQNKD | FQDLEPSKK |
| | | VNKFQDLEPSKKQNK | FQDLEPSKK |
| | | ESELKIKENFKKALN | LKIKENFKK |
| | | IESELKIKENFKKAL | LKIKENFKK |
| | | SELKIKENFKKALNK | LKIKENFKK |
| | | RIESELKIKENFKKA | LKIKENFKK |
| | | MRIESELKIKENFKK | IESELKIKE |
| | | KFQDLEPSKKQNKDL | LEPSKKQNK |
| NP_045573.1| hypothetical protein BBI42 [Borrelia burgdorferi B31] SEQ ID NO:38, SEQ ID NO:143469-143852 | HLA-DRB1*0101 | PEYYRNMPRPTAYQQ | YRNMPRPTA |
| | | SPEYYRNMPRPTAYQ | YRNMPRPTA |
| | | GSPEYYRNMPRPTAY | YRNMPRPTA |
| | | EGSPEYYRNMPRPTA | YYRNMPRPT |
| | | EYYRNMPRPTAYQQY | YRNMPRPTA |
| | | MRILVGVCIIALALL | MRILVGVCI |
| | | YYRNMPRPTAYQQYL | YRNMPRPTA |
| | | LKDPNYRGVVLPVSD | YRGVVLPVS |
| | | DPNYRGVVLPVSDYN | YRGVVLPVS |
| | | SLKDPNYRGVVLPVS | LKDPNYRGV |
| | | KDPNYRGVVLPVSDY | YRGVVLPVS |
| | | PNYRGVVLPVSDYNE | YRGVVLPVS |

Fig. 34 continued

| | | | |
|---|---|---|---|
| | | YRNMPRPTAYQQYLK | YRNMPRPTA |
| | | NKFFLDLGSFQSKDL | FLDLGSFQS |
| | | KFFLDLGSFQSKDLL | FLDLGSFQS |
| | | LLVGVCTTALALLGC | VCTTALALL |
| | | LVGVCTTALALLGCY | VCTTALALL |
| | | RLLVGVCTTALALLG | VCTTALALL |
| | | VGVCTTALALLGCYL | VCTTALALL |
| | | EQTFSSLKLYASERR | FSSLKLYAS |
| | | QTFSSLKLYASERRL | FSSLKLYAS |
| | | FNKFFLDLGSFQSKD | FLDLGSFQS |
| | | YFNKFFLDLGSFQSK | FLDLGSFQS |
| | | FYFNKFFLDLGSFQS | FNKFFLDLG |
| | | TEQTFSSLKLYASEH | FSSLKLYAS |
| | | GVCTTALALLGCYLP | TTALALLGC |
| | | TVTEQTFSSLKLYAS | TVTEQTFSS |
| | | VTEQTFSSLKLYASE | FSSLKLYAS |
| | | VCTTALALLGCYLPE | TTALALLGC |
| | | VKRYDYNRPVPTLPT | YNRPVPTLP |
| | | NYRGVVLPVSDYNEE | YRGVVLPVS |
| | | FFLDLGSFQSKDLTF | FLDLGSFQS |
| | | FLDLGSFQSKDLTFL | FLDLGSFQS |
| | | YRGVVLPVSDYNEEY | YRGVVLPVS |
| | | FSSLKLYASERRLLV | FSSLKLYAS |
| | | IFSSLKLYASERRLL | FSSLKLYAS |
| | | KVKRYDYNRPVPTLP | YDYNRPVPT |
| | | EEGSPYYRNMPRPT | YYRNMPRP |
| | | NKFMRIVRWLYSCIE | MRIVRWLYS |
| | | KFMRIVRWLYSCIEE | VRWLYSCIE |
| | | CTTALALLGCYLPEN | LLALALLGC |
| | | SSLKLYASERRLLVE | LKLYASERR |
| | | TTALALLGCYLPEQQ | LLALALLGC |
| | | FMRIVRWLYSCIEEL | VRWLYSCIE |
| | | MRIVRWLYSCIEELY | VRWLYSCIE |
| | | QTFENSESSDMGSD | FENSESSDM |
| | | TFENSESSDMGSDE | FENSESSDM |
| | | VQTFENSESSDMGS | FENSESSDM |
| | | AVQTFENSESSDMG | FENSESSDM |
| | | QAVQTFENSESSDM | TFENSESSS |
| | | RNMPRPTAYQQYLKV | MPRPTAYQQ |
| | | LDLGSFQSKDLKLF | LGSFQSKDL |
| HLA-DRB1*0301 | None | | |
| HLA-DRB1*0401 | | DLIKLFIKVENEQNK | LFIKVENEQ |
| | | IKLFIKVENEQNNKK | LFIKVENEQ |
| | | KDLIKLFIKVENEQN | LFIKVENEQ |
| | | LIKLFIKVENEQNN | LFIKVENEQ |
| | | SKDLIKLFIKVENEQ | IKLFIKVEN |
| | | PEYYRNMPRPTAYQQ | YRNMPRPTA |
| | | SPEYYRNMPRPTAYQ | YRNMPRPTA |
| | | GSPEYYRNMPRPTA | YYRNMPRPT |
| | | GSPEYYRNMPRPTAY | YRNMPRPTA |
| | | KLFIKVENEQNNKF | LFIKVENEQ |
| | | EYYRNMPRPTAYQQY | YRNMPRPTA |
| | | LFIKVENEQNNKFM | LFIKVENEQ |
| | | FYFNKFFLDLGSFQS | FFLDLGSFQ |
| | | YYRNMPRPTAYQQYL | YRNMPRPTA |
| | | QNNKFMRIVRWLYS | FMRIVRWLY |

Fig. 34 continued

| | | | |
|---|---|---|---|
| | | NNKFMRIVRWLYSC | FMRIVRWLY |
| | | YYNKFPLDQSFQSK | FFLDQSFQ |
| | HLA-DRB1*0404 | IKLFTMVKNEQNNK | LFTMVKNEQ |
| | | DLTKLFTMVKNEQN | LFTMVKNEQ |
| | | LIKLFTMVKNEQNN | LFTMVKNEQ |
| | | KLFTMVKNEQNNKF | VKNEQNNNK |
| | | LFTMVKNEQNNKFM | VKNEQNNK |
| | | KDLTKLFTMVKNEQ | LFTMVKNEQ |
| | | SKDLTKLFTMVKNEQ | TKLFTMVKN |
| | HLA-DRB1*0405 | NKFMRIVRWLYSCFF | MRIVRWLYS |
| | | KFMRIVRWLYSCFF | MRIVRWLYS |
| | | FMRIVRWLYSCFFL | VRWLYSCFF |
| | | PFYYRNMPRPTAYQQ | YRNMPRPTA |
| | | SPFYYRNMPRPTAYQ | YRNMPRPTA |
| | | KDLTKLFTMVKNEQ | TKLFTMVKN |
| | | GSPFYYRNMPRPTAY | YRNMPRPTA |
| | | FYYRNMPRPTAYQQY | YRNMPRPTA |
| | | FGSPFYYRNMPRPTA | YYRNMPRPT |
| | | MRIVRWLYSCFFLY | VRWLYSCFF |
| | | DLTKLFTMVKNEQN | FTMVKNEQN |
| | | LKLFTMVKNEQNNK | FTMVKNEQN |
| | | LTKLFTMVKNEQNN | FTMVKNEQN |
| | | KLFTMVKNEQNNKF | FTMVKNEQN |
| | | RIVRWLYSCFFLYS | VRWLYSCFF |
| | | NNKFMRIVRWLYSC | MRIVRWLYS |
| | | NNKFMRIVRWLYSC | MRIVRWLYS |
| | | QNNKFMRIVRWLYS | FMRIVRWLY |
| | | YYRNMPRPTAYQQYL | YRNMPRPTA |
| | | YRNMPRPTAYQQYLK | YRNMPRPTA |
| | | LFTMVKNEQNNKFM | FTMVKNEQN |
| | | IVRWLYSCFFLYSP | VRWLYSCFF |
| | HLA-DRB1*0701 | NNKFMRIVRWLYSC | FMRIVRWLY |
| | | NKFMRIVRWLYSCF | FMRIVRWLY |
| | | QNNKFMRIVRWLYS | FMRIVRWLY |
| | | NNKFMRIVRWLYSC | FMRIVRWLY |
| | | KFMRIVRWLYSCFF | MRIVRWLYS |
| | HLA-DRB1*0802 | None | |
| | HLA-DRB1*0901 | None | |
| | HLA-DRB1*1101 | FYYRNMPRPTAYQQ | YRNMPRPTA |
| | | PFYYRNMPRPTAYQQ | YRNMPRPTA |
| | | FGSPFYYRNMPRPTA | YYRNMPRPT |
| | | GSPFYYRNMPRPTAY | YRNMPRPTA |
| | | SPFYYRNMPRPTAYQ | YRNMPRPTA |
| | | YYRNMPRPTAYQQYL | YRNMPRPTA |
| | | YRNMPRPTAYQQYLK | YRNMPRPTA |
| | HLA-DRB1*1302 | SKDLTKLFTMVKNEQ | TKLFTMVKN |
| | | KDLTKLFTMVKNEQN | LKLFTMVKN |
| | | DLTKLFTMVKNEQN | TKLFTMVKN |
| | | LKLFTMVKNEQNNK | LFTMVKNEQ |
| | | RRLVETKKTLSLK | VETKKTLS |
| | | LIKLFTMVKNEQNN | LFTMVKNEQ |
| | | FQSKDLTKLFTMVK | SKDLTKLFT |
| | | RLLVETKKTLSLKD | VETKKTLS |
| | | QSKDLTKLFTMVKN | LKLFTMVKN |
| | | GSPFYYRNMPRPTAY | YYRNMPRPT |
| | | SPFYYRNMPRPTAYQ | YYRNMPRPT |

Fig. 34 continued

| | | | |
|---|---|---|---|
| | | FEYYRNMPRPTAYQQ | YYRNMPRPT |
| | | LLVETKKTLTSLKDP | VETKKTLTS |
| | | EHRLLVETKKTLTSL | VETKKTLTS |
| | | SEHRLLVETKKTLTS | LVETKKTLT |
| | | EGSPFYYRNMPRPTA | YYRNMPRPT |
| | | MRTLVCVCTTALALL | MRTLVCVCT |
| | | FYYRNMPRPTAYQQY | YYRNMPRPT |
| | | TMVKNFQNNKFMRT | FQNNKFMR |
| | | CVCTTALALLCCYLP | TALALLCCY |
| | | VCTTALALLCCYLPD | LALLCCYLP |
| | | VKNFQNNKFMRTVR | FQNNKFMR |
| | | MVKNFQNNKFMRTV | FQNNKFMR |
| | | LVETKKTLTSLKDPN | VETKKTLTS |
| | | FTMVKNFQNNKFMR | VKNFQNNK |
| | | YYRNMPRPTAYQQYL | YYRNMPRPT |
| | | KNFQNNKFMRTVRW | FQNNKFMR |
| | | FQNNKFMRTVRWLY | FQNNKFMR |
| | | LVCVCTTALALLCCY | VCTTALALL |
| | | CTTALALLCCYLPDN | LALLCCYLP |
| | | VCVCTTALALLCCYL | VCTTALALL |
| | | VETKKTLTSLKDPNY | VETKKTLTS |
| | | QNNKFMRTVRWLYS | FMRTVRWLY |
| | HLA-DRB1*1501 | NKFMRTVRWLYSCTE | MRTVRWLYS |
| | | NNKFMRIVRWLYSCT | MRIVRWLYS |
| | | KFMRIVRWLYSCTEE | MRIVRWLYS |
| | | NNKFMRIVRWLYSC | MRIVRWLYS |
| | | QNNKFMRIVRWLYS | FMRIVRWLY |
| | | FMRIVRWLYSCTEEL | MRIVRWLYS |
| | | MRIVRWLYSCTEELV | MRIVRWLYS |
| | | FGIPSSLKLYASEHR | PSSLKLYAS |
| | | GIPSSLKLYASEHRL | LKLYASEHR |
| | | PSSLKLYASEHRLLV | LKLYASEHR |
| | | IPSSLKLYASEHRLL | LKLYASEHR |
| | | SSLKLYASEHRLLVE | LKLYASEHR |
| | | PNYRGVVLPVSDYE | YRGVVLPVS |
| | | LKDPNYRGVVLPVSD | YRGVVLPVS |
| | | KDPNYRGVVLPVSDY | YRGVVLPVS |
| | | SLKDPNYRGVVLPVS | PNYRGVVLP |
| | | DPNYRGVVLPVSDYE | YRGVVLPVS |
| | | SKDLIKLFIMVKEQ | LIKLFIMVK |
| | | KDLIKLFIMVKNEQ | LIKLFIMVK |
| | | EQSKDLIKLFIMVKN | LIKLFIMVK |
| | | QSKDLIKLFIMVKNE | LIKLFIMVK |
| | HLA-DRB3*0101 | None | |
| | HLA-DRB4*0101 | ETKKTLTSLKDPNYR | LTSLKDPNY |
| | | KKTLTSLKDPNYRGV | LSLKDPNYR |
| | | KTLTSLKDPNYRGVV | LSLKDPNYR |
| | | TKKTLTSLKDPNYRG | LSLKDPNYR |
| | | TLTSLKDPNYRGVVL | LSLKDPNYR |
| | | LTSLKDPNYRGVVLP | LSLKDPNYR |
| | | TSLKDPNYRGVVLPV | LSLKDPNYR |
| | | TTALALLCCYLPDNQ | LALLCCYLP |
| | | TALALLCCYLPDNQE | LCCYLPDNQ |
| | | ALALLCCYLPDNQEQ | LCCYLPDNQ |
| | | LALLCCYLPDNQEQA | LCCYLPDNQ |
| | | ALLCCYLPDNQEQAV | LCCYLPDNQ |

Fig. 34 continued

| | | | |
|---|---|---|---|
| | | NKPMRIVRWLYSCIE | IVRWLYSCI |
| | | KPMRIVRWLYSCIEE | IVRWLYSCI |
| | | PMRIVRWLYSCIEEL | IVRWLYSCI |
| | HLA-DRB5*0101 | GSPEYYRNMPRPTAY | YRNMPRPTA |
| | | SPEYYRNMPRPTAYQ | YRNMPRPTA |
| | | PEYYRNMPRPTAYQQ | YRNMPRPTA |
| | | EYYRNMPRPTAYQQY | YRNMPRPTA |
| | | EGSPEYYRNMPRPTA | YRNMPRPT |
| | | IKLFIMVKNEQNNNK | LFIMVKNEQ |
| | | KLFIMVKNEQNNNKF | VKNEQNNNK |
| | | LFIMVKNEQNNNKFM | VKNEQNNNK |
| | | IMVKNEQNNNKFMRI | VKNEQNNNK |
| | | FIMVKNEQNNNKFMR | VKNEQNNNK |
| | | TAYQQYLKVKRYDYN | YQQYLKVKR |
| | | YYRNMPRPTAYQQYL | YRNMPRPTA |
| | | YRNMPRPTAYQQYLK | YRNMPRPTA |
| NP_051318.1\| revA protein[Borrelia burgdorferi B31]<br><br>SEQ ID NO:39,<br>SEQ ID NO:143853-144042 | HLA-DRB1*0101 | NIFKLFFASMLFVMA | FFASMLFVM |
| | | IFKLFFASMLFVMAC | FASMLFVMA |
| | | FKLFFASMLFVMACK | FASMLFVMA |
| | | KLFFASMLFVMACKA | FASMLFVMA |
| | | LFFASMLFVMACKAY | FASMLFVMA |
| | | NSFQDKLAAKLAALK | FQDKLAAKL |
| | | DKLAAKLAALKAAKN | LAAKLAALK |
| | | SFQDKLAAKLAALKA | LAAKLAALK |
| | | FQDKLAAKLAALKAA | LAAKLAALK |
| | | QNSFQDKLAAKLAAL | FQDKLAAKL |
| | | LQNSFQDKLAAKLAA | FQDKLAAKL |
| | | KLAAKLAALKAAKNT | LAALKAAKN |
| | | NLQNSFQDKLAAKLA | FQDKLAAKL |
| | | FFASMLFVMACKAYV | FASMLFVMA |
| | | FASMLFVMACKAYVE | FASMLFVMA |
| | | QDKLAAKLAALKAAK | LAAKLAALK |
| | | LAAKLAALKAAKNTI | LAALKAAKN |
| | | AKLVGVTVPLLGSNT | LVGVTVPLL |
| | | AAKLAALKAAKNTIE | LAALKAAKN |
| | | EAKLVGVTVPLLGSN | LVGVTVPLL |
| | | LNLQNSFQDKLAAKL | LNLQNSFQD |
| | | SEAKLVGVTVPLLGS | LVGVTVPLL |
| | | KLVGVTVPLLGSNTS | LVGVTVPLL |
| | | AKLAALKAAKNTIEN | LAALKAAKN |
| | | WSEAKLVGVTVPLLG | LVGVTVPLL |
| | | LVGVTVPLLGSNTSG | LVGVTVPLL |
| | | IWSEAKLVGVTVPLL | EAKLVGVTV |
| | | GVTVPLLGSNTSGNG | VPLLGSNTS |
| | | VGVTVPLLGSNTSGN | VPLLGSNTS |
| | | VTVPLLGSNTSGNGD | VPLLGSNTS |
| | | SMLFVMACKAYVEEK | FVMACKAYV |
| | | ASMLFVMACKAYVEE | FVMACKAYV |
| | | MLFVMACKAYVEEKK | FVMACKAYV |
| | | KNIFKLFFASMLFVM | FKLFFASML |
| | | NKNIFKLFFASMLFV | FKLFFASML |
| | | KLAALKAAKNTIENI | LAALKAAKN |
| | | LAALKAAKNTIENIT | LAALKAAKN |
| | | MRNKNIFKLFFASML | IFKLFFASM |
| | | RNKNIFKLFFASMLF | FKLFFASML |

Fig. 34 continued

| | | |
|---|---|---|
| | | TVPLLGSNTSGNGDK  VPLLGSNTS |
| | | VPLLGSNTSGNGDKM  VPLLGSNTS |
| | | LFVMACKAYVEEKKE  FVMACKAYV |
| | | FVMACKAYVEEKKFI  FVMACKAYV |
| HLA-DRB1*0301 | None | |
| HLA-DRB1*0401 | None | |
| HLA-DRB1*0404 | AELKEKLLNLQNSFQ | LKEKLLNLQ |
| | LKEKLLNLQNSFQDK | LLNLQNSFQ |
| | ELKEKLLNLQNSFQD | LLNLQNSFQ |
| | KEKLLNLQNSFQDKL | LLNLQNSFQ |
| | EKLLNLQNSFQDKLA | LLNLQNSFQ |
| | KLLNLQNSFQDKLAA | LLNLQNSFQ |
| | LLNLQNSFQDKLAAK | LLNLQNSFQ |
| | GVTVPLLGSNTSGNG | LLGSNTSGN |
| | VTVPLLGSNTSGNGD | LLGSNTSGN |
| | VGVTVPLLGSNTSGN | VPLLGSNTS |
| | TVPLLGSNTSGNGDK | LLGSNTSGN |
| | VPLLGSNTSGNGDKM | LLGSNTSGN |
| HLA-DRB1*0405 | None | |
| HLA-DRB1*0701 | None | |
| HLA-DRB1*0802 | FFASMLFVMACKAYV | LFVMACKAY |
| | FASMLFVMACKAYVE | FVMACKAYV |
| | ASMLFVMACKAYVEE | FVMACKAYV |
| | SMLFVMACKAYVEEK | FVMACKAYV |
| | MLFVMACKAYVEEKK | FVMACKAYV |
| HLA-DRB1*0901 | KNTFKLFFASMLFVM | LFFASMLFV |
| | NTFKLFFASMLFVMA | LFFASMLFV |
| | TFKLFFASMLFVMAC | LFFASMLFV |
| | FKLFFASMLFVMACK | LFFASMLFV |
| | KNTFKLFFASMLFV | FKLFFASML |
| | KLFFASMLFVMACKA | FFASMLFVM |
| HLA-DRB1*1101 | None | |
| HLA-DRB1*1302 | KLVGVTVPLLGSNTS | VGVTVPLLG |
| | GVTVPLLGSNTSGNG | VPLLGSNTS |
| | VTVPLLGSNTSGNGD | VPLLGSNTS |
| | VGVTVPLLGSNTSGN | VPLLGSNTS |
| | LVGVTVPLLGSNTSG | VPLLGSNTS |
| | KSFAKLVGVTVPLLG | AKLVGVTVP |
| | SFAKLVGVTVPLLGS | VGVTVPLLG |
| | VPLLGSNTSGNGDKM | VPLLGSNTS |
| | TVPLLGSNTSGNGDK | VPLLGSNTS |
| | FAKLVGVTVPLLGSN | VGVTVPLLG |
| | AKLVGVTVPLLGSNT | VGVTVPLLG |
| | ELKEKLLNLQNSFQD | LLNLQNSFQ |
| | LKEKLLNLQNSFQDK | LLNLQNSFQ |
| | AELKEKLLNLQNSFQ | LKEKLLNLQ |
| | KEKLLNLQNSFQDKL | LLNLQNSFQ |
| | EKLLNLQNSFQDKLA | LLNLQNSFQ |
| HLA-DRB1*1501 | KEDVLALVNDSGGGK | VLALVNDSS |
| | EDVLALVNDSSGGKF | VLALVNDSS |
| | DVLALVNDSSGGKFK | LVNDSSGGK |
| | KNTFKLFFASMLFVM | TFKLFFASM |
| | VLALVNDSSGGKFKD | LVNDSSGGK |
| HLA-DRB3*0101 | None | |
| HLA-DRB4*0101 | AELKEKLLNLQNSFQ | LKEKLLNLQ |

Fig. 34 continued

| | | | |
|---|---|---|---|
| | | DIGNAELKEKLLNLQ | DIGNAELKE |
| | | IGNAELKEKLLNLQN | LKEKLLNLQ |
| | | GNAELKEKLLNLQNS | LKEKLLNLQ |
| | | NAELKEKLLNLQNSF | LKEKLLNLQ |
| | | ELKEKLLNLQNSFQD | LKEKLLNLQ |
| | | LKEKLLNLQNSFQDK | LKEKLLNLQ |
| | | KLVGVTVPLLGSNTS | VGVTVPLLG |
| | HLA-DRB5*0101 | None | |
| NP_045737.1\| BBA64 antigen, P35 [Borrelia burgdorferi B31]<br><br>SEQ ID NO:40,<br>SEQ ID NO:144043-144728 | HLA-DRB1*0101 | IFNLGQILSKLSQDS | LGQILSKLS |
| | | FNLGQILSKLSQDSN | LGQILSKLS |
| | | GKIFNLGQILSKLSQ | LGQILSKLS |
| | | EGKIFNLGQILSKLS | IFNLGQILS |
| | | KIFNLGQILSKLSQD | LGQILSKLS |
| | | LGQILSKLSQDSNYR | ILSKLSQDS |
| | | SKIFFNANSTVHFDS | FFNANSTVH |
| | | KIFFNANSTVHFDSH | FNANSTVH |
| | | NLGQILSKLSQDSNY | ILSKLSQDS |
| | | FSKIFFNANSTVHFD | FFNANSTVH |
| | | IFSKIFFNANSTVHF | FFNANSTVH |
| | | LIAIFLLHVLTVLIL | LLHVLTVLI |
| | | IFFNANSTVHFDSHE | FNANSTVHF |
| | | DIILDLVNTTTNILA | LVNTTTNIL |
| | | IAIFLLHVLTVLILI | LLHVLTVLI |
| | | NDTLRSKNSRAQFAN | LRSKNSRAQ |
| | | AIFLLHVLTVLILIS | LLHVLTVLI |
| | | LNDTLRSKNSRAQFA | LRSKNSRAQ |
| | | DTLRSKNSRAQFANI | LRSKNSRAQ |
| | | IILDLVNTTTNILAP | LVNTTTNIL |
| | | ILDLVNTTTNILAPI | LVNTTTNIL |
| | | IFLLHVLTVLILISC | LLHVLTVLI |
| | | RDIILDLVNTTTNIL | ILDLVNTTT |
| | | KLIAIFLLHVLTVLI | IFLLHVLTV |
| | | LDLVNTTTNILAPIQ | LVNTTTNIL |
| | | GQILSKLSQDSNYRG | ILSKLSQDS |
| | | EIFSKIFFNANSTVH | IFFNANSTV |
| | | YNTNPDLQTDVSKLN | YNTNPDLQT |
| | | SKLNDTLRSKNSRAQ | NDTLRSKNS |
| | | KETLINRGFSIQLAM | INRGFSIQL |
| | | VKETLINRGFSIQLA | INRGFSIQL |
| | | NKLIAIFLLHVLTVL | LIAIFLLHV |
| | | ETLINRGFSIQLAME | INRGFSIQL |
| | | TLINRGFSIQLAMEE | INRGFSIQL |
| | | KLNDTLRSKNSRAQF | LRSKNSRAQ |
| | | NNKLIAIFLLHVLTV | LIAIFLLHV |
| | | LKNNKLIAIFLLHVL | LIAIFLLHV |
| | | FFNANSTVHFDSHEY | FNANSTVHF |
| | | FLLHVLTVLILISCS | LHVLTVLIL |
| | | TLRSKNSRAQFANIH | LRSKNSRAQ |
| | | LLHVLTVLILISCSL | LLHVLTVLI |
| | | LRSKNSRAQFANIRD | LRSKNSRAQ |
| | | ILKNNKLIAIFLLHV | LKNNKLIAI |
| | | KNNKLIAIFLLHVLT | LIAIFLLHV |
| | | VLTVLILISCSLEVK | ILISCSLEV |
| | | HVLTVLILISCSLEV | VLILISCSL |
| | | LTVLILISCSLEVKD | ILISCSLEV |

Fig. 34 continued

| | | | |
|---|---|---|---|
| | | SNYRGLVKETLINRG | YRGLVKETL |
| | | LVKETLINRGFSTQL | LINRGFSTQ |
| | | IDFYNTNPDLQTDVS | YNTNPDLQT |
| | | DFYNTNPDLQTDVSK | YNTNPDLQT |
| | | LHVLIVLILLSCSLE | VLILLSCSL |
| | | DKILKNNKLTATFLL | LKNNKLTAT |
| | | NTLKNNKLTATFLLH | LKNNKLTAT |
| | | KDNTLKNNKLTATFL | LKNNKLTAT |
| | | LIDFYNTNPDLQTDV | YNTNPDLQT |
| | | DLIDFYNTNPDLQTD | YNTNPDLQT |
| | | PNTTQTSFMDSSRGF | TSFMDSSRG |
| | | DSNYRGLVKETLINR | YRGLVKETL |
| | | SKNTTQTSFMDSSRG | TTQTSFMDS |
| | | DDLIDFYNTNPDLQT | LIDFYNTNP |
| | | TTQTSFMDSSRGFPN | TSFMDSSRG |
| | | LINRGFSTQLAMEET | INRGFSTQL |
| | | NTTQTSFMDSSRGFP | TSFMDSSRG |
| | | TVLILLSCSLEVKDS | LLSCSLEV |
| | | QTLSKISQDSNYRGL | TLSKISQDS |
| | | TLSKISQDSNYRGLV | TLSKISQDS |
| | | LSQDSNYRGLVKETL | ISQDSNYRG |
| | | TQTSFMDSSRGFPND | TSFMDSSRG |
| | | PNDQFGMRAETFSKI | FGMRAETFS |
| | | VLILLSCSLEVKDSN | ILLSCSLEV |
| | | NDQFGMRAETFSKIF | FGMRAETFS |
| | | MKDNLKNNKLTATF | LKNNKLTAT |
| | | NPDLQTDVSKLNDTL | LQTDVSKLN |
| | | YTNPDLQTDVSKLND | LQTDVSKLN |
| | | TNPDLQTDVSKLNDT | LQTDVSKLN |
| | | PDLQTDVSKLNDTLR | LQTDVSKLN |
| | | INRGFSTQLAMEETS | INRGFSTQL |
| | | NAPKKILDPEVAKLI | KKILDPEVA |
| | | APKKILDPEVAKLIQ | LDPEVAKLI |
| | | NLGKIFNLGQILSKI | IFNLGQILS |
| | | QDSNYRGLVKETLIN | YRGLVKETL |
| | | KKILDPEVAKLIQKI | LDPEVAKLI |
| | | FNLGKIFNLGQILSK | IFNLGQILS |
| | | YRGLVKETLINRGFS | YRGLVKETL |
| | | NYRGLVKETLINRGF | YRGLVKETL |
| | | PKKILDPEVAKLIQK | LDPEVAKLI |
| | | SQDSNYRGLVKETLI | YRGLVKETL |
| | | GFPNDQFGMRAETFS | QFGMRAETF |
| | | FPNDQFGMRAETFSK | FGMRAETFS |
| | | DQFGMRAETFSKIFF | FGMRAETFS |
| | | FNANSTVHFDSEYT | FNANSTVHF |
| | | EERRMLYTSLNFNEG | RRMLYTSLN |
| | | KILDPEVAKLIQKIL | LDPEVAKLI |
| | | VATNNLKNPTKPAAG | LKNPTKPAA |
| | | NNLKNPTKPAAGKN | LKNPTKPAA |
| | | NNLKNPTKPAAGKNK | LKNPTKPAA |
| | | NTHDTTLDLVNTTT | TLDLVNTTT |
| | | THDTTLDLVNTTTT | TLDLVNTTT |
| | | ATNNLKNPTKPAAGK | LKNPTKPAA |
| | | GKVENLVATNNLKN | VENLVATN |
| | | LVATNNLKNPTKPAA | NNLKNPTK |
| | | ANTRDTTLDLVNTTT | TLDLVNTT |
| | | LQTDVSKLNDTLRSK | LQTDVSKLN |

Fig. 34 continued

|  |  | DLQIDVSKLNPTLRS | LQIDVSKLN |
|---|---|---|---|
|  | HLA-DRB1*0301 | None |  |
|  | HLA-DRB1*0401 | IFSKIFFNANSTVHF | FFNANSTVH |
|  |  | FSKIFFNANSTVHFD | FFNANSTVH |
|  |  | SKIFFNANSTVHFDS | FFNANSTVH |
|  |  | KIFFNANSTVHFDSH | FFNANSTVH |
|  |  | EIFSKIFFNANSTVH | SCKIFFNAN |
|  |  | IILDLVNTTTNILAP | LVNTTTNIL |
|  |  | DIILDLVNTTTNILA | LVNTTTNIL |
|  |  | LDLVNTTTNILAPIQ | LVNTTTNIL |
|  |  | ILDLVNTTTNILAPI | LVNTTTNIL |
|  |  | RDIILDLVNTTTNIL | IILDLVNTT |
|  |  | IFFNANSTVHFDSHE | FFNANSTVH |
|  |  | FFNANSTVHFDSHEY | FFNANSTVH |
|  |  | STLYNDFEKLTSLKE | YNDFEKLTS |
|  |  | TLYNDFEKLTSLKEK | FEKLTSLKE |
|  |  | FNLLVATNNLKNPTK | LLVATNNLK |
|  |  | LYNDFEKLTSLKEKW | FEKLTSLKE |
|  |  | VENLLVATNNLKNPT | LVATNNLKN |
|  |  | SCSLEVKDSNFSKKH | LEVKDSNFS |
|  |  | CSLEVKDSNFSKKHK | LEVKDSNFS |
|  |  | TSCSLEVKDSNFSKK | LEVKDSNFS |
|  |  | ITSCSLEVKDSNFSK | LEVKDSNFS |
|  |  | KVENLLVATNNLKNP | LLVATNNLK |
|  |  | YNDFEKLTSLKEKWL | FEKLTSLKE |
|  |  | GKVENLLVATNNLKN | LLVATNNLK |
|  |  | TLTSCSLEVKDSNFS | TLTSCSLEV |
|  |  | NDFEKLTSLKEKWLK | FEKLTSLKE |
|  |  | FKRMLYTSLNFNG | MLYTSLNFN |
|  |  | NLLVATNNLKNPTKP | LVATNNLKN |
|  | HLA-DRB1*0404 | FNLLVATNNLKNPTK | LLVATNNLK |
|  |  | RDIILDLVNTTTNIL | IILDLVNTT |
|  |  | DIILDLVNTTTNILA | IILDLVNTT |
|  |  | VENLLVATNNLKNPT | LLVATNNLK |
|  |  | KVENLLVATNNLKNP | LLVATNNLK |
|  |  | GKVENLLVATNNLKN | LLVATNNLK |
|  |  | KGKVENLLVATNNLK | VENLLVATN |
|  |  | AIRDIILDLVNTTT | IILDLVNTT |
|  |  | NIRDIILDLVNTTT | IILDLVNTT |
|  |  | IRDIILDLVNTTTNI | IILDLVNTT |
|  |  | IILDLVNTTTNILAP | LVNTTTNIL |
|  |  | LDLVNTTTNILAPI | LVNTTTNIL |
|  |  | NLLVATNNLKNPTKP | LLVATNNLK |
|  |  | LLVATNNLKNPTKPA | LLVATNNLK |
|  |  | RRMLYTSLNFNGKI | MLYTSLNFN |
|  |  | FKRMLYTSLNFNG | MLYTSLNFN |
|  |  | ERRMLYTSLNFNGK | MLYTSLNFN |
|  |  | DDLIDEYNINPDLQ | LIDEYNINP |
|  |  | EIFSKIFFNANSTVH | SCKIFFNAN |
|  |  | DDLIDEYNINPDLQ | LIDEYNINP |
|  |  | KDTDDLIDEYNINPD | LIDEYNINP |
|  |  | GLVKETLINRGFSTQ | VKETLINRG |
|  |  | DTDDLIDEYNINPDL | LIDEYNINP |
|  |  | KDTDDLIDEYNIN | KDTDDLID |
|  |  | SNYRGLVKETLINRG | LVKETLINR |
|  |  | IFSKIFFNANSTVHF | FFNANSTVH |

Fig. 34 continued

| | | | |
|---|---|---|---|
| | | YRGLVKETLINRGFS | VKETLINRG |
| | | NYRGLVKETLINRGF | VKETLINRG |
| | | KLIAFLLHVLTVLL | LFLLHVLTV |
| | | RGLVKETLINRGFST | VKETLINRG |
| | | HIIQLSEKDSSRGEF | LSEKDSSRG |
| | | FSKIFFNANSTVHFD | FFNANSTVH |
| | | YTERRMLYTSLNFN | RRMLYTSL |
| | | TTQTSFMDSSRGFPV | TSFMDSSRG |
| | | TEERRMLYTSLNFN | MLYTSLNFN |
| | | TQTSFMDSSRGFPV | TSFMDSSRG |
| | | LIAIFLLHVLTVLL | LLHVLTVL |
| | | SFNTTQTSFMDSSRG | TQTSFMDSS |
| | | FNTTQTSFMDSSRGF | TSFMDSSRG |
| | | SKIFFNANSTVHFDS | FFNANSTVH |
| | | IAIFLLHVLTVLLT | LLHVLTVL |
| | | KIFFNANSTVHFDSH | FFNANSTVH |
| | | LDLVNTTTNLLAPIQ | LVNTTTNL |
| | | RMLYTSLNFNRGKIF | MLYTSLNFN |
| | | MLYTSLNFNRGKIFN | MLYTSLNFN |
| HLA-DRB1*0405 | | FNLLVATNNLKNPTK | LVATNNLKN |
| | | DDLIDEYNTNPDLQT | IDEYNTNPD |
| | | DLIDEYNTNPDLQTE | IDEYNTNPD |
| | | NLLVATNNLKNPTKP | LVATNNLKN |
| | | GKVENLLVATNNLKN | VENLLVATN |
| | | KVENLLVATNNLKNP | LVATNNLKN |
| | | VENLLVATNNLKNPT | LVATNNLKN |
| | | ETLYNDFEKLTSLKE | YNDFEKLTS |
| | | TLYNDFEKLTSLKEK | FEKLTSLKE |
| | | IILDLVNTTTNLLAP | VNTTTNLLA |
| | | KDTDLIDEYNTNPD | LIDEYNTNP |
| | | DIILDLVNTTTNLLA | LVNTTTNLL |
| | | TEDLIDEYNTNPDLQ | IDEYNTNPD |
| | | EERRMLYTSLNFNEG | RRMLYTSLN |
| | | DTDDLIDEYNTNPDL | IDEYNTNPD |
| | | LYNDFEKLTSLKEKW | FEKLTSLKE |
| | | LDLVNTTTNLLAPIQ | VNTTTNLLA |
| | | ILDLVNTTTNLLAPI | VNTTTNLLA |
| | | YNDFEKLTSLKEKWL | FEKLTSLKE |
| | | TEERRMLYTSLNFNF | RRMLYTSLN |
| | | HEYTEERRMLYTSLN | YTEERRMLY |
| | | LLVATNNLKNPTKPA | LVATNNLKN |
| | | NDFEKLTSLKEKWLK | FEKLTSLKE |
| | | LIDEYNTNPDLQTEV | IDEYNTNPD |
| | | YTEERRMLYTSLNFN | RRMLYTSLN |
| | | IDEYNTNPDLQTEVS | IDEYNTNPD |
| | | LVATNNLKNPTKPAA | LVATNNLKN |
| | | RYTEERRMLYTSLNF | RRMLYTSLN |
| | | YNTNPDLQTEVSKLN | YNTNPDLQT |
| | | ERRMLYTSLNFNEGR | RRMLYTSLN |
| HLA-DRB1*0701 | | RTFSKIFFNANSTVH | FFNANSTV |
| | | TFSKIFFNANSTVHF | FFNANSTVH |
| | | FSKIFFNANSTVHFD | FFNANSTVH |
| | | SKIFFNANSTVHFDS | FFNANSTVH |
| | | KIFFNANSTVHFDSH | FFNANSTVH |
| | | IFFNANSTVHFDSHY | FFNANSTVH |
| | | FFNANSTVHFDSHLY | FFNANSTVH |
| | | EDILDLVNTTTNLL | DLVNTTTN |

Fig. 34 continued

| | | | |
|---|---|---|---|
| | | DIILDLVNTTNILA | LVNTTNIL |
| | | TLLVNTTTNILAPI | LVNTTNIL |
| | | LDLVNTTTNILAPIQ | LVNTTNIL |
| | | IILDLVNTTTNILAP | LVNTTNIL |
| | | LNDILRSKNSRAQFA | LRSKNSRAQ |
| | | NDTLRSKNSRAQFAN | LRSKNSRAQ |
| | | DTLRSKNSRAQFANT | LRSKNSRAQ |
| | | LIATFLLHVLTVLTL | LHVLTVLT |
| | | TATFLLHVLTVLTLT | LHVLTVLT |
| | | TLRSKNSRAQFANTH | SKNSRAQFA |
| | | LRSKNSRAQFANTHD | SKNSRAQFA |
| HLA-DRB1*0802 | | None | |
| HLA-DRB1*0901 | | None | |
| HLA-DRB1*1101 | | RMLYTSLNFNEGKIF | YTSLNFNEG |
| | | RRMLYTSLNFNEGKI | YTSLNFNEG |
| | | ERRMLYTSLNFNEGK | YTSLNFNEG |
| | | MLYTSLNFNEGKIFN | YTSLNFNEG |
| | | EERRMLYTSLNFNEG | MLYTSLNFN |
| HLA-DRB1*1302 | | MKDNLKNYKLIAIF | LKNYKLIAI |
| | | RDNILKNNKLIAIFL | LKNNKLIAI |
| | | DNILKNNKLIAIFLL | LKNNKLIAI |
| | | NILKNNKLIAIFLLH | LKNNKLIAI |
| | | ENLVAINNLKNPTK | AINNLKNPT |
| | | DIILDLVNTTTNILA | LVNTTNIL |
| | | HDIILDLVNTTTNIL | IILDLVNTT |
| | | IILDLVNTTTNILAP | LVNTTNIL |
| | | NLLVAINNLKNPTKP | AINNLKNPT |
| | | VENLLVAINNLKNPT | VAINNLKNP |
| | | LLDLVNTTTNILAPI | LVNTTNIL |
| | | LIVAINNLKNPTKPA | AINNLKNPT |
| | | LDLVNTTTNILAPIQ | LVNTTNIL |
| | | GKTFNLGQTLSKLSQ | TFNLGQTLS |
| | | FGKTFNLGQTLSKLS | TFNLGQTLS |
| | | TLKNNKLIATFLLHV | LKNNKLIAT |
| | | LVAINNLKNPTKPAA | AINNLKNPT |
| | | LKNNKLIATFLLHVL | LKNNKLIAT |
| | | NEGKTFNLGQTLSKL | TFNLGQTLS |
| | | FNEGKTFNLGQTLSK | TFNLGQTLS |
| | | NFNEGKTFNLGQTLS | GKTFNLGQT |
| | | KVENLLVAINNLKNP | LLVAINNLK |
| | | TFLLHVLTVLTLTSG | LLHVLTVLT |
| | | ATFLLHVLTVLTLTS | LLHVLTVLT |
| | | KTFNLGQTLSKLSQD | TFNLGQTLS |
| | | TFNLGQTLSKLSQDS | TFNLGQTLS |
| | | VAINNLKNPTKPAAG | AINNLKNPT |
| | | TATFLLHVLTVLTLT | LLHVLTVLT |
| | | LIATFLLHVLTVLTL | LLHVLTVLT |
| | | FLLHVLTVLTLSGG | LLHVLTVL |
| | | KLIATFLLHVLTVLT | IATFLLHVL |
| | | IFSKIFFNANSTVHF | FFNANSTVH |
| | | FSKIFFNANSTVHFD | FNANSTVHF |
| | | SKIFFNANSTVHFDS | FNANSTVHF |
| | | LLHVLTVLTLSGGL | LLHVLTVL |
| | | KIFFNANSTVHFDSH | FNANSTVHF |
| | | HDIILDLVNTTTNI | IILDLVNTT |
| | | IFFNANSTVHFDSHE | FNANSTVHF |

Fig. 34 continued

| | | | |
|---|---|---|---|
| | | GKVENLLVAINNLKN | LLVAINNLK |
| | | KGKVENLLVAINNLK | VENLLVAIN |
| | | AINNLKNPTKPAAGK | AINNLKNPT |
| | | GLVKETLINRGFSTQ | VKETLINRG |
| | | KIHDLLLDLVNTTTN | LLDLVNTT |
| | | LHVLTVLTLTSCSLE | VLTVLTLTS |
| | | LVKETLINRGFSTQL | INRGFSTQ |
| | | VKETLINRGFSTQLA | INRGFSTQ |
| | | ANTHDTTLDLVNTT | TLDLVNTT |
| | | HVLTVLTLTSCSLEV | LTVLTLTSC |
| | | KETLINRGFSTQLAK | LINRGFSTQ |
| | | PANTHDTTLDLVNTT | THDTTLDLV |
| | | ETLINRGFSTQLAME | LINRGFSTQ |
| | | NKLTATFLLEVLTVL | TATFLLEVL |
| | | DKLQQLNKPNLETLY | LQQLNKPNL |
| | | VKDKLQQLNKPNLET | LQQLNKPNL |
| | | NVKDKLQQLNKPNLE | LQQLNKPNL |
| | | VLTVLTLTSCSLEVK | LTVLTLTSC |
| | | FFNANSTVHFDSHEY | FNANSTVHF |
| | | KDKLQQLNKPNLETL | LQQLNKPNL |
| | | EEISAKTLNVKDKLQ | ISAKTLNVK |
| | | DFEVAKLIQKILDRS | VAKLIQKIL |
| | | PEVAKLIQKILDRSE | LIQKILDRS |
| | | ISAKTLNVKDKLQQL | ISAKTLNVK |
| | | EISAKTLNVKDKLQQ | ISAKTLNVK |
| | | EVAKLIQKILDRSEN | LIQKILDRS |
| | | LNVKDKLQQLNKPNL | DKLQQLNKP |
| | HLA-DRB1*1501 | ENLLVAINNLKNPTK | LLVAINNLK |
| | | NLLVAINNLKNPTKP | INNLKNPTK |
| | | LVAINNLKNPTKPA | INNLKNPTK |
| | | NKLIAIFLLEVLTVL | LIAIFLLHV |
| | | LIAIFLLHVLTVLIL | IFLLEVLTV |
| | | KIFSKIFFNANSTVH | SKIFFNANS |
| | | IFSKIFFNANSTVHF | FFNANSTVH |
| | | LVAINNLKNPTKPAA | INNLKNPTK |
| | | VAINNLKNPTKPAAG | INNLKNPTK |
| | | IAIFLLHVLTVLILI | IFLLEVLTV |
| | | SNYRGLVKETLINRG | LVKETLINR |
| | | KLTATFLLHVLTVLT | TFLLEVLTV |
| | | FSKIFFNANSTVHFD | FFNANSTVH |
| | | SKIFFNANSTVHFDS | FFNANSTVH |
| | | YRGLVKETLINRGFS | LVKETLINR |
| | | RGLVKETLINRGFST | LVKETLINR |
| | | NYRGLVKETLINRGF | LVKETLINR |
| | | MNKLTATFLLHVLTV | LTATFLLHV |
| | | DSNYRGLVKETLINR | YRGLVKETL |
| | | ATFLLEVLTVLTLTS | LHVLTVLTL |
| | | KIFFNANSTVHFDSH | FFNANSTVH |
| | | TFLLEVLTVLTLTSC | LHVLTVLTL |
| | | LKNKLTATFLLHVL | TATFLLHV |
| | | VLTVLTLTSCSLEVK | VLTLTSCSL |
| | | GLVKETLINRGFSTQ | LVKETLINR |
| | | LTVLTLTSCSLEVKE | VLTLTSCSL |
| | | LVKETLINRGFSTQL | LVKETLINR |
| | | VENLLVAINNLKNPT | LLVAINNLK |
| | | FLLEVLTVLTLTSCS | LHVLTVLIL |
| | | KVENLLVAINNLKNP | LLVAINNLK |

Fig. 34 continued

| | | | |
|---|---|---|---|
| | | HVLTVLILISCSLEV | VLILISCSL |
| | | LLHVLTVLILISCSL | LTVLILISC |
| | | KNNKLIAIFLLHVLT | LIAIFLLHV |
| | | LHVLTVLILISCSLE | VLILISCSL |
| | | AINNLKNPTKPAAGK | INNLKNPTK |
| | | ILKNNKLIAIFLLHV | LKNNKLIAI |
| | | SKLNDTLRSKNSRAQ | TLRSKNSRA |
| | HLA-DRB3*0101 | None | |
| | HLA-DRB4*0101 | AKLIQKILDRSENII | LIQKILDRS |
| | HLA-DRB5*0101 | VAINNLKNPTKPAAG | INNLKNPTK |
| | | ENLLVAINNLKNPTK | LLVAINNLK |
| | | LVAINNLKNPTKPAA | INNLKNPTK |
| | | NLLVAINNLKNPTKP | INNLKNPTK |
| | | SKLNDTLRSKNSRAQ | LNDTLRSKN |
| | | LLVAINNLKNPTKPA | INNLKNPTK |
| | | KLNDTLRSKNSRAQF | LRSKNSRAQ |
| | | LNDTLRSKNSRAQFA | LRSKNSRAQ |
| AAT93822.1\| BBA64 antigen, P35 [Borrelia garinii PBi]<br><br>SEQ ID NO:41,<br>SEQ ID NO:144729-145414 | HLA-DRB1*0101 | IFSKIFFNAGSTVTF | FFNAGSTVT |
| | | FSKIFFNAGSTVTFD | FFNAGSTVT |
| | | SKIFFNAGSTVTFDD | FFNAGSTVT |
| | | KIFFNAGSTVTFDDN | FFNAGSTVT |
| | | EIFSKIFFNAGSTVT | EIFSKIFFN |
| | | IFFNAGSTVTFDDNE | FFNAGSTVT |
| | | FFNAGSTVTFDDNEY | FFNAGSTVT |
| | | ILNLGKILSKLSQDS | LGKILSKLS |
| | | LNLGKILSKLSQDSN | LGKILSKLS |
| | | NKILNLGKILSKLSQ | LGKILSKLS |
| | | ENKILNLGKILSKLS | ILNLGKILS |
| | | FLLHILTGLILLSCS | LTGLILLSC |
| | | IFLLHILTGLILLSC | ILTGLILLS |
| | | LGKILSKLSQDSNYR | ILSKLSQDS |
| | | NIILNLINTTTNILA | ILNLINTTT |
| | | NLGKILSKLSQDSNY | ILSKLSQDS |
| | | LHILTGLILLSCSLE | ILTGLILLS |
| | | ILHILTGLILLSCSL | ILTGLILLS |
| | | HNIILNLINTTTNIL | ILNLINTTT |
| | | KILNLGKILSKLSQD | LGKILSKLS |
| | | TDIRNIILNLINTTT | IRNIILNLI |
| | | IILNLINTTTNILAP | LINTTTNIL |
| | | AIFLLHILTGLILLS | LHILTGLIL |
| | | ILNLINTTTNILAPI | LINTTTNIL |
| | | GKILSKLSQDSNYRS | ILSKLSQDS |
| | | DIRNIILNLINTTTN | ILNLINTTT |
| | | IRNIILNLINTTTNI | ILNLINTTT |
| | | HILTGLILLSCSLEV | LTGLILLSC |
| | | VKEILNRGFSIQLA | INRGFSIQL |
| | | IKDYNANPELRTDIS | YNANPELRT |
| | | LVAINTLKNPPKTAG | LVAINTLKN |
| | | KEILNRGFSIQLAI | INRGFSIQL |
| | | DIIKDYNANPELRTD | YNANPELRT |
| | | IIKDYNANPELRTDI | YNANPELRT |
| | | NDYNANPELRTDISK | YNANPELRT |
| | | DDIIKDYNANPELRT | DYNANPELR |
| | | EILNRGFSIQLAIE | INRGFSIQL |
| | | INTLKNPPKTAGKNK | LKNPPKTAG |

Fig. 34 continued

| | | | |
|---|---|---|---|
| | | YNANPELRTDISKLN | YNANPELRT |
| | | ATNTLKNPPKTAGKN | LKNPPKTAG |
| | | LVLLNGTTNLLAFLQ | LLNTTTNLL |
| | | NTLKNPPKTAGKNKS | LKNPPKTAG |
| | | ILNRGFSIQLAIEE | LNRGFSIQL |
| | | VAINTLKNPPKTAGK | LKNPPKTAG |
| | | LVKFILNRGFSTQL | TLTNRGFST |
| | | LIATFLLHTLTGLTL | LLHTLTGLT |
| | | IATFLLHTLTGLTLL | LHTLTGLTL |
| | | TLTGLTLLSCSLFVN | TLTGLTLLS |
| | | FVNGSTVTFDDNEYV | FVNGSTVTF |
| | | PTVDNLLVAINTLKN | VDNLLVAIN |
| | | TVDNLLVAINTLKN | LVAINTLKN |
| | | NEYITSKNSKAQFTD | SKNSKAQFT |
| | | LNDYITSKNSKAQFT | TTSKNSKAQ |
| | | DNLLVAINTLKNPPK | LVAINTLKN |
| | | VDNLLVAINTLKNPP | LVAINTLKN |
| | | DYITSKNSKAQFTDI | SKNSKAQFT |
| | | FTDIENIILNLINT | IHNTILNLI |
| | | LTGLTLLSCSLFVNG | LTGLTLLSC |
| | | AQFTDIHNTILNLIN | IHNTILNLI |
| | | KILSKLSQDSNYRSL | LLSKLSQDS |
| | | MKNKLIATFLLHTL | LIATFLLHT |
| | | NLLVAINTLKNPPKT | LVAINTLKN |
| | | TLSKLSQDSNYRSLV | TLSKLSQDS |
| | | QFTDIENIILNLINT | IENIILNLI |
| | | KAQFTDIHNTILNLI | FTDIHNIIL |
| | | NKLIAIFLLHILTGL | LIAIFLLHI |
| | | SLVKFLLNRGFSIQ | VKFLLNRG |
| | | NKLIAIFLLHILTG | LIAIFLLHI |
| | | KLIAIFLLHILTGLI | LAIFLLHIL |
| | | SNYRSLVKFLLNRG | YRSLVKFLL |
| | | EYNANPELRTDISKL | YNANPELRT |
| | | LLNRGFSIQLAIEE | LNRGFSIQL |
| | | KKNKLIAIFLLHILT | LIAIFLLHI |
| | | YIISKNSKAQFTDIH | SKNSKAQFT |
| | | TLKNPPKTAGKNKSN | LKNPPKTAG |
| | | NANPELRTDISKLND | LRTDISKLN |
| | | RSLVKFILNRGFST | VKFILNRG |
| | | LKNPPKTAGKNKSN | LKNPPKTAG |
| | | PELRTDISKLNDYII | LRTDISKLN |
| | | NPELRTDISKLNDYI | LRTDISKLN |
| | | ANPELRTDISKLNDY | LRTDISKLN |
| | | TTSKNSKAQFTDIHN | SKNSKAQFT |
| | | RPTVDNLLVAINTLK | VDNLLVAIN |
| | | ATEFTSLRTLNVKDF | FTSLRTLNV |
| | | TEFTSLRTLNVKDFI | LRTLNVKDF |
| | | LFNKTLNLGKTLSKL | TLNLGKTLS |
| | | YRSLVKFILNRGFS | VKFILNRG |
| | | TGLTLLSCSLFVNG | TLLSCSLFV |
| | | NYRSLVKFILNRGF | VKFILNRG |
| | | LNRGFSIQLAIEETS | LNRGFSIQL |
| | | FNNKTLNLGKTLSK | TLNLGKTLS |
| | | LLVAINTLKNPPKTA | LVAINTLKN |
| | | QLTLLSCSLFVNGT | TLLSCSLFV |
| | | IQLAIEETSLRTLNV | IAIEETSLR |
| | | SKLNDYIISKNSKAQ | YIISKNSKA |

Fig. 34 continued

| | | | |
|---|---|---|---|
| | | KLNDYIISKNSKAQF | IISKNSKAQ |
| | | AKELTQKTLFRSEDT | ITQKTLFRS |
| | | EAKELTQKILERSED | LIQKILERS |
| | | PEAKELTQKTLERSE | LTQKTLRS |
| | | KELIQKILERSEDIV | LIQKILERS |
| | HLA-DRB1*0301 | None | |
| | HLA-DRB1*0401 | IILRLINTTTNILAP | LINTTTNIL |
| | | NIILNLINTTTNILA | LINTTTNIL |
| | | INLINTTTNILAPIQ | LINTTTNIL |
| | | INLINTTTNILAPT | LINTTTNIL |
| | | ENTILNLINTTTNIL | LNLINTTTN |
| | | DNLLVAINTLKNPPK | LVAINTLKN |
| | | VDNLLVAINTLKNPP | LVAINTLKN |
| | | NLLVAINTLKNPPKT | LVAINTLKN |
| | | TVDNLLVAINTLKNP | LVAINTLKN |
| | | TFSKIFFNAGSTVTF | FFNAGSTVT |
| | | PTVDNLLVAINTLKN | LLVAINTLK |
| | | FSKIFFNAGSTVTFD | FFNAGSTVT |
| | | SKIFFNAGSTVTFDE | FFNAGSTVT |
| | | KIFFNAGSTVTFDEN | FFNAGSTVT |
| | | FIFSKIFFNAGSTVT | FSKIFFNAG |
| | | NKYVNERRILYTSLN | YVNERRILY |
| | | LVAINTLKNPPKTAQ | LVAINTLKN |
| | | DTHNTINLINTTTN | TINLINTT |
| | | THNTTNLINTTTNI | TTNLINTT |
| | | LLVAINTLKNPPKTA | LVAINTLKN |
| | HLA-DRB1*0404 | ENTILNLINTTTNIL | TILNLNTT |
| | | NIILNLINTTTNILA | TILNLNTT |
| | | TDTHNTTNLINTTT | TTNLINTT |
| | | DTHNTTNLINTTTN | TTNLINTT |
| | | THNTTNLINTTTNT | TTNLINTT |
| | | TTNLINTTTNILAP | TTNLINTT |
| | | KITATFLLHTITGLT | TFLLHTITG |
| | | TLNLINTTTNILAPT | TLNLINTT |
| | | LIATFLLHTITGLTL | LLHTITGL |
| | | LAIFLLHILTGIILL | LLHILTGLI |
| | | IFLLHILTGIILSC | LLHILTGLI |
| | | AIFLLHILTGIILLS | LLHILTGLI |
| | | VDNLLVAINTLKNPP | LLVAINTLK |
| | | DNLLVAINTLKNPPK | LLVAINTLK |
| | | NLLVAINTLKNPPKT | LLVAINTLK |
| | | RRILYTSLNPNEKK | LLYTSLNPN |
| | | ERRILYTSLNPNEKK | LLYTSLNPN |
| | | NERRILYTSLNPNE | LLYTSLNPN |
| | | YVNERRILYTSLNPN | ERRILYTSL |
| | | KIFSKIFFNAGSTVT | FSKIFFNAG |
| | | TVDNLLVAINTLKNP | LLVAINTLK |
| | | VNERRILYTSLNPNE | LLYTSLNPN |
| | | LLVAINTLKNPPKTA | LLVAINTLK |
| | | PTVDNLLVAINTLKN | LLVAINTLK |
| | | FLLHTITGLTTISCS | LLHTITGL |
| | | LLHILTGLILSCSL | LLHILTGLI |
| | | INLINTTTNILAPTQ | LINTTTNIL |
| | | IFSKIFFNAGSTVTF | FFNAGSTVT |
| | | DRIIKDYNANPRLRT | IKDYNANP |

Fig. 34 continued

| | | | |
|---|---|---|---|
| | | KEVDDIIKDYNANPL | IIKDYNANP |
| | | VEETIKDYNANPLLR | IIKDYNANP |
| | | DVDDIIKDYNANPLL | IIKDYNANP |
| | | FSKIFFNAGSTVTFD | FFNAGSTVT |
| | | SLVKEILLNRGYSIQ | VKEILLNRG |
| | | KPTVDNLLVAINTLK | VDNLVAIN |
| | | RRILYTSLNFNENRI | ILYTSLNFN |
| | HLA-DRB1*0405 | DNLLVAINTLKNPPK | LVAINTLKN |
| | | NLLVAINTLKNPPKT | LVAINTLKN |
| | | LLVAINTLKNPPKTA | LVAINTLKN |
| | | LVAINTLKNPPKTAG | LVAINTLKN |
| | | PTVDNLLVAINTLKN | VDNLVAIN |
| | | VDNLLVAINTLKNPP | LVAINTLKN |
| | | TVDNLLVAINTLKNP | LVAINTLKN |
| | | TILNLINTTTNILAP | INTTTNILA |
| | | NILNLINTTTNILA | LNLINTTTN |
| | | LNLINTTTNILAPIQ | INTTTNILA |
| | | ILNLINTTTNILAPI | INTTTNILA |
| | | NERRILYTSLNFNEN | RRILYTSLN |
| | | KTLYEDFNKLTPLKE | LYHDFNKLT |
| | | RRRILYTSLNFNENR | YTSLNFNEN |
| | | TLYEDFNKLTPLKEK | FNKLTPLKE |
| | | RRILYTSLNFNENKT | YTSLNFNEN |
| | | ENIILNLINTTTNIL | LNLINTTT |
| | | VNERRILYTSLNFTE | RRILYTSLN |
| | | VAINTLKNPPKTAGK | INTLKNPPK |
| | | YNANPELRTDISKKN | YNANPELRT |
| | | LYHDFNKLTPLKEKW | FNKLTPLKE |
| | | NLVNERRILYTSLN | VNERRILY |
| | HLA-DRB1*0701 | ENIILNLINTTTNIL | ILNLINTT |
| | | NIILNLINTTTNILA | LINTTTNIL |
| | | LNLINTTTNILAPI | LINTTTNIL |
| | | LNLINTTTNILAPIQ | LINTTTNIL |
| | | LFSKIFFNAGSTVTF | FFNAGSTVT |
| | | FSKIFFNAGSTVTFD | FFNAGSTVT |
| | | IILNLINTTTNILAP | LINTTTNIL |
| | | EIFSKIFFNAGSTVT | IFFNAGSTV |
| | | SKIFFNAGSTVTFDD | FFNAGSTVT |
| | | KIFFNAGSTVTFDDN | FFNAGSTVT |
| | | IFFNAGSTVTFDDNE | FFNAGSTVT |
| | | FFNAGSTVTFDDNEY | FFNAGSTVT |
| | HLA-DRB1*0802 | NNSSKMKKLSKNAKN | MKKLSKNAK |
| | | RNSSKMKKLSKNAK | NSSKMKKLS |
| | | SKMKKLSKNAKNKKP | MKKLSKNAK |
| | | NSSKMKKLSKNAKNK | MKKLSKNAK |
| | | SSKMKKLSKNAKNKK | MKKLSKNAK |
| | | FDFNKLTPLKFKNL | FNKLTPLKF |
| | | YHDFNKLTPLKEKW | FNKLTPLKE |
| | | LYHDFNKLTPLKEKW | FNKLTPLKE |
| | | KTLYEDFNKLTPLKE | YHDFNKLTP |
| | | TLYEDFNKLTPLKEK | FNKLTPLKE |
| | | KMKKLSKNAKNKKPT | MKKLSKNAK |
| | | MKKLSKNAKNKKPTV | MKKLSKNAK |
| | HLA-DRB1*0901 | IFSKIFFNAGSTVTF | FFNAGSTVT |
| | | FSKIFFNAGSTVTFD | FFNAGSTVT |
| | | SKIFFNAGSTVTFDD | FFNAGSTVT |

Fig. 34 continued

| | | | |
|---|---|---|---|
| | | KIFFNAGSTVTFDDN | FFNAGSTVT |
| | | KIFSKIFFNAGSTVT | KIFFNAGST |
| | | IFFNAGSTVTFDDNF | FFNAGSTVT |
| | HLA-DRB1*1101 | SSKMKKLSKNAKNKK | MKKLSKNAK |
| | | SKMKKLSKNAKNKKP | MKKLSKNAK |
| | | FNNSSKMKKLSKNAK | SKMKKLSKN |
| | | NSSKMKKLSKNAKNK | MKKLSKNAK |
| | | NNSSKMKKLSKNAKN | MKKLSKNAK |
| | HLA-DRB1*1302 | NFNFNKILNLGKILS | NKILNLGKI |
| | | FNFNKILNLGKILSK | ILNLGKILS |
| | | NFNKILNLGKILSKL | ILNLGKILS |
| | | FNKILNLGKILSKLS | ILNLGKILS |
| | | NKILNLGKILSKLSQ | ILNLGKILS |
| | | ENTILNLTNTTTNTL | ILNLTNTT |
| | | DIHNTILNLTNTTTN | TILNLTNTT |
| | | IHNTILNLTNTTTNT | TILNLTNTT |
| | | NTILNLTNTTTNILA | TILNLTNTT |
| | | TDIHNTILNLTNTTT | IHNTILNLT |
| | | TILNLTNTTTNILAP | LTNTTNIL |
| | | FTDIHNTILNLTNTT | IHNTILNLT |
| | | LNLTNTTTNILAPL | LTNTTNIL |
| | | KILNLGKILSKLSQE | ILNLGKILS |
| | | ILNLGKILSKLSQES | ILNLGKILS |
| | | LNLTNTTTNILAPTQ | LTNTTNIL |
| | | QFTDIHNTILNLTNT | IHNTILNL |
| | | KAQFTDIHNTILNLT | DIHNTILNL |
| | | AQFTDIHNTILNLTN | IHNTILNL |
| | | NKNKLIAIFLLHIL | NKNKLIAI |
| | | DNLLVAINTLKNPPK | VAINTLKNP |
| | | IFSKIFFNAGSTVTF | FFNAGSTVT |
| | | SKIFFNAGSTVTFD | FFNAGSTVT |
| | | SLVKELLNRGFSIQ | VKELLNRG |
| | | SKIFFNAGSTVTFDD | FFNAGSTVT |
| | | DVDNLLVAINTLKNP | LLVAINTLK |
| | | VDNLLVAINTLKNPP | VAINTLKNP |
| | | NLLVAINTLKNPPKT | VAINTLKNP |
| | | KIFFNAGSTVTFDDN | FFNAGSTVT |
| | | LVKELLNRGFSIQL | LLNRGFSIQ |
| | | VKELLNRGFSIQLA | LNRGFSIQ |
| | | SKMKKLSKNAKNKKP | MKKLSKNAK |
| | | SSKMKKLSKNAKNKK | MKKLSKNAK |
| | | LLVAINTLKNPPKTA | VAINTLKNP |
| | | LVAINTLKNPPKTAG | VAINTLKNP |
| | | KELLNRGFSIQLAL | LLNRGFSIQ |
| | | TATFLLHTLTGLTL | LHTLTGLTL |
| | | MKKLSKNAKNKKPTV | LSKNAKNKK |
| | | KMKKLSKNAKNKKPT | LSKNAKNKK |
| | | ITATFLLHTLTGLT | LHTLTGLT |
| | | ATFLLHTLTGLTLG | LHTLTGLTL |
| | | KIFSKIFFNAGSTVT | IFFNAGSTV |
| | | PTVDNLLVAINTLKN | LLVAINTLK |
| | | FNNSSKMKKLSKNAK | SKMKKLSKN |
| | | NNSSKMKKLSKNAKN | MKKLSKNAK |
| | | NSSKMKKLSKNAKNK | MKKLSKNAK |
| | | TFLLHTLTGLTLGG | LHTLTGLTL |
| | | IFFNAGSTVTFDDN | FFNAGSTVT |
| | | LKFNFNKILNLGKIL | NFNKILNLG |

Fig. 34 continued

| | | | |
|---|---|---|---|
| | | VAINTLKPPKTAGK | LKPPKTAG |
| | | SLNFNFNKTINLQKT | NFNKTINLQ |
| | | KLIATFLLHTLTGLL | TATFLLHTL |
| | | FILTNRGFSTQLATF | LTNRGFSTQ |
| | | FLLHTLTGLILSGG | LHTLTGLIL |
| | | KKLSKNAKNKKPTVD | LSKNAKNKK |
| | | VKDKIQHLNKPNLKT | TQHLNKPNL |
| | | LNVKDKIQHLNKPNL | VKDKIQHL |
| | | DKIQHLNKPNLKTLY | TQHLNKPNL |
| | | NFYVNERRILYTSLN | YVNERRILY |
| | | NVKDKIQHLNKPNLK | TQHLNKPNL |
| | | RSLVKETLNRGFST | VKETLNRG |
| | | KPTVDNLLVAINTLK | VDNLLVAIN |
| | | DNFYVNERRILYTSL | YVNERRILY |
| | | YTSLNFNENKTINLQ | LNFNENKTI |
| | | SNYRSLVKETLTNRG | YRSLVKETL |
| | | DDNFYVNERRILYTS | YVNERRILY |
| | | FDDNFYVNERRILYT | YVNERRILY |
| | | TSLNFNENKTINLQK | NFNKTINLQ |
| | | KDKIQHLNKPNLKTL | TQHLNKPNL |
| | | FFNAGSTVFDDNFY | FFNAGSTVT |
| | | YRSLVKETLTNRGFS | VKETLTNRG |
| | | TFDDNFYVNERRILY | NYVNERRIL |
| | | NKLTATFLLHTLTGL | TATFLLHTL |
| | | KIQHLNKPNLKTLYD | IQHLNKPNL |
| | | LLHTLTGLILSGGL | LHTLTGLIL |
| | | LEEISLRTLNVKDKI | ISLRTLNVK |
| | | NYRSLVKETLINRGF | VKETLINRG |
| | | EEISLRTLNVKDKIQ | ISLRTLNVK |
| | | ILTNRGFSIQLAIEE | LINRGFSIQ |
| | | YVNERRILYTSLNFN | YVNERRILY |
| | | IQHLNKPNLKTLYHD | IQHLNKPNL |
| | | AINTLRNPPKTAGKN | LKPPKTAG |
| | | LLHTLTGLILSGGLE | LHTLTGLIL |
| | | NYVNERRILYTSLNF | YVNERRILY |
| | | KLSKNAKNKKPTVDN | LSKNAKNKK |
| | | LNLGKILSKLSQSSN | LGKILSKLS |
| | | LSKNAKNKKPTVDN | LSKNAKNKK |
| | | ISLRTLNVKDKIQHL | ISLRTLNVK |
| HLA-DRB1*1501 | | TATFLLHTLTGLILL | TFLLHTLTG |
| | | LIAIFLLHTLTGLIL | IFLLHTLTG |
| | | DNLLVAINTLKNPPK | LLVAINTLK |
| | | TFLLHTLTGLILSGG | TFLLHTLTG |
| | | RSLVKETLTNRGFST | LVKETLTNR |
| | | NKTINLQKTLSKLS | TINLQKTLS |
| | | ATFLLHTLTGLILS | TFLLHTLTG |
| | | NKTINLQKTLSKLSQ | TINLQKTLS |
| | | KLTATFLLHTLTGLI | TFLLHTLTG |
| | | NFNKTINLQKTLSKL | TINLQKTLS |
| | | NKLTATFLLHTLTGL | TFLLHTLTG |
| | | FNKTINLQKTLSK | TINLQKTLS |
| | | SLVKETLTNRGFSTQ | LVKETLTNR |
| | | SNYRSLVKETLTNRG | LVKETLTNR |
| | | YRSLVKETLTNRGFS | LVKETLTNR |
| | | NYRSLVKETLTNRGF | LVKETLTNR |
| | | LVKETLTNRGFSTQL | LVKETLTNR |

Fig. 34 continued

| | | | |
|---|---|---|---|
| | | TDINIILNLINTTT | HNIILNLI |
| | | NNKLIAIFLLRILTG | LIAIFLLRI |
| | | NLLVAINTLKNPPKT | INTLKNPPK |
| | | LVAINTLKNPPKTAG | INTLKNPPK |
| | | LLVAINTLKNPPKTA | INTLKNPPK |
| | | ISNIILNLINTTTNI | ILNLINTTT |
| | | DSNYRSLVKEILNR | YRSLVKEIL |
| | | DISNIILNLINTTTN | ILNLINTTT |
| | | KILNLGKILSKLSQD | LNLGKILSK |
| | | VAINTLKNPPKTAGK | INTLKNPPK |
| | | ILNLGKILSKLSQDS | ILNLGKILS |
| | | HNIILNLINTTTNIL | ILNLINTTT |
| | | VDNLLVAINTLKNPP | LLVAINTLK |
| | | NIILNLINTTTNILA | ILNLINTTT |
| | | FLLRILTGLILLSCS | LRILTGLIL |
| | | IQLAIEEISLRTLNV | LAIEEISLR |
| | HLA-DRB3*0101 | None | |
| | HLA-DRB4*0101 | IEEISLRTLNVKDKI | ISLRTLNVK |
| | | QLAIEEISLRTLNVK | IEEISLRTL |
| | | AIEEISLRTLNVKDK | ISLRTLNVK |
| | | LAIEEISLRTLNVKD | ISLRTLNVK |
| | | EEISLRTLNVKDKIQ | ISLRTLNVK |
| | | EISLRTLNVKDKIQS | ISLRTLNVK |
| | | ISLRTLNVKDKIQSL | ISLRTLNVK |
| | | SLVKEILNRGPSIQ | VKEILNRG |
| | HLA-DRB5*0101 | PDNEYVNERRILYT | YVNERRILY |
| AAL84596.1\| BBK32 [Borrelia burgdorferi] SEQ ID NO:42, SEQ ID NO:145415-145890 | HLA-DRB1*0101 | TLFSTKLTQMYSTRL | FSTKLTQMY |
| | | LFSTKLTQMYSTRLD | LTQMYSTRL |
| | | FSTKLTQMYSTRLDN | LTQMYSTRL |
| | | STKLTQMYSTRLDNL | LTQMYSTRL |
| | | TKLTQMYSTRLDNLA | LTQMYSTRL |
| | | KLTQMYSTRLDNLAK | LTQMYSTRL |
| | | LTQMYSTRLDNLAKA | LTQMYSTRL |
| | | YDTYLFSTKLTQMY | YTLFSTKLT |
| | | DTYTLFSTKLTQMYS | YTLFSTKLT |
| | | NLYEAYKAIVTSILL | YKAIVTSIL |
| | | SNLYEAYKAIVTSIL | YEAYKAIVT |
| | | YEAYKAIVTSILLMR | YKAIVTSIL |
| | | EAYKAIVTSILLMRD | YKAIVTSIL |
| | | LYEAYKAIVTSILLM | YKAIVTSIL |
| | | KKVKSKYLALGLLFG | VKSKYLALG |
| | | IYDTYLFSTKLTQM | YTLFSTKLT |
| | | RKIYDTYLFSTKLT | TYTLFSTKL |
| | | KIYDTYLFSTKLTQ | YTLFSTKLT |
| | | TYTLFSTKLTQMYST | YTLFSTKLT |
| | | KVKSKYLALGLLFGF | YLALGLLFG |
| | | VKSKYLALGLLFGFI | YLALGLLFG |
| | | KSKYLALGLLFGFIS | YLALGLLFG |
| | | SKYLALGLLFGFISC | YLALGLLFG |
| | | YTLFSTKLTQMYSTR | YTLFSTKLT |
| | | QDEYKGMTQGSLNSL | YKGMTQGSL |
| | | DEYKGMTQGSLNSLS | MTQGSLNSL |
| | | AYKAIVTSILLMRDS | YKAIVTSIL |
| | | YKAIVTSILLMRDSL | YKAIVTSIL |

Fig. 34 continued

| | | | |
|---|---|---|---|
| | | EYKGMIQRSLNSLSG | MTQGSLNSL |
| | | YKGMTQGSLNSLSGF | MTQGSLNSL |
| | | KKKVKSKYLALGLLF | VKSKYLALG |
| | | GMTQGSLNSLSGFSG | MTQGSLNSL |
| | | KTQGSLNSLSGFSGF | LNSLSGFSG |
| | | KGMTQGSLNSLSGFS | MTQGSLNSL |
| | | YLALGLLFGFISGDL | YLALGLLFG |
| | | AFIKTLIAKIKFQSI | IKTLIAKIK |
| | | FAFIKTLIAKIKFQS | IKTLIAKIK |
| | | FGIFAFIKTLIAKIK | FAFIKTLIA |
| | | GIFAFIKTLIAKIKF | IKTLIAKIK |
| | | IFAFIKTLIAKIKFQ | IKTLIAKIK |
| | | KYLALGLLFGFISGD | YLALGLLFG |
| | | FKTLLNYIQVSVKTA | FKTLLNYIQ |
| | | QGSLNSLSGFSGFLF | LNSLSGFSG |
| | | TQGSLNSLSGFSGFL | LNSLSGFSG |
| | | LNYIQVSVKTAANFV | YIQVSVKTA |
| | | LLNYIQVSVKTAANF | YIQVSVKTA |
| | | QSNLYEAYKAIVTSI | YEAYKAIVT |
| | | EQSNLYEAYKAIVTS | YEAYKAIVT |
| | | GSLNSLSGFSGFLFF | LNSLSGFSG |
| | | EKNFKTLLNYIQVSV | FKTLLNYIQ |
| | | TLLNYIQVSVKTAAN | YIQVSVKTA |
| | | KEQSNLYEAYKAIVT | LYEAYKAIV |
| | | KNFKTLLNYIQVSVK | FKTLLNYIQ |
| | | KTLLNYIQVSVKTAA | YIQVSVKTA |
| | | QGEYKGMTQGSLNS | KGMTQGSL |
| | | NYIQVSVKTAANFVY | YIQVSVKTA |
| | | DLEKNFKTLLNYIQV | FKTLLNYIQ |
| | | EDLEKNFKTLLNYIQ | EKNFKTLLN |
| | | YIQVSVKTAANFVYI | YIQVSVKTA |
| | | INKYDTYTLFSTKL | YDTYTLFST |
| | | KAIVTSILLMRDSLR | VTSILLMRD |
| | | EGVKYNVDSAINTIK | YNVDSAINT |
| | | LEKNFKTLLNYIQVS | FKTLLNYIQ |
| | | EFYTHSLKRDSANKS | THSLKRDSA |
| | | HSLKRDSANKSNFLQ | LKRDSANKS |
| | | IHSLKRDSANKSNFL | LKRDSANKS |
| | | PYTHSLKRDSANKSN | LKRDSANKS |
| | | GVKYNVDSAINTIKK | YNVDSAINT |
| | | LEGVKYNVDSAINTI | YNVDSAINT |
| | | YLEGVKYNVDSAINT | VKYNVDSAI |
| | | YTHSLKRDSANKSNF | LKRDSANKS |
| | HLA-DRB1*0301 | NFIDTTDSDLRPKS | TTDSDLRP |
| | | FIDTTDSDLRPKSS | TTDSDLRP |
| | | IDTTDSDLRPKSSL | TTDSDLRP |
| | | TTDSDLRPKSSLQD | TDSDLRPKS |
| | | DTTDSDLRPKSSLQ | TDSDLRPKS |
| | HLA-DRB1*0401 | PYTHSLKRDSANKS | LKRDSANKS |
| | | RPYTHSLKRDSANKS | THSLKRDSA |
| | | YTHSLKRDSANKSNF | LKRDSANKS |
| | | THSLKRDSANKSNFL | LKRDSANKS |
| | | HSLKRDSANKSNFLQ | LKRDSANKS |
| | | SLKRDSANKSNFLQK | LKRDSANKS |
| | | LKRDSANKSNFLQKN | LKRDSANKS |
| | | NKIYDTYTLFSTKLT | YDTYTLFS |

Fig. 34 continued

| | | | |
|---|---|---|---|
| | | AANFVYTNDTHAKRK | FVYTNDTHA |
| | | ANFVYTNDTHAKRKL | FVYTNDTHA |
| | | FKTLLNYIQVSVKTA | NYIQVSVKT |
| | | TAANFVYTNDTHAKR | FVYTNDTHA |
| | | TINKIYDTYLFSTK | LYDTYLFS |
| | | NTINKIYDTYLFST | IYDTYLFS |
| | | INTINKIYDTYLFS | IYKIYDTYT |
| | | INKIYDTYLFSTKL | IYDTYLFS |
| | | IKTLAKIKEQSNLY | LIAKIKEQS |
| | | KTLIAKIKEQSNLYE | KIKEQSNLY |
| | | FKTLLNYIQVSVKT | FKTLLNYIQ |
| | | TLLNYIQVSVKTAAN | NYIQVSVKT |
| | | LLNYIQVSVKTAANF | NYIQVSVKT |
| | | KTLLNYIQVSVKTAA | NYIQVSVKT |
| | | TLIAKIKEQSNLYEA | KIKEQSNLY |
| | | LIAKIKEQSNLYEAY | KIKEQSNLY |
| | | IAKIKEQSNLYEAYK | KIKEQSNLY |
| | HLA-DRB1*0404 | AANFVYTNDTHAKRK | FVYTNDTHA |
| | | ANFVYTNDTHAKRKL | FVYTNDTHA |
| | HLA-DRB1*0405 | EDLEKNFKTLLNYIQ | EKNFKTLLN |
| | | DLEKNFKTLLNYIQV | EKNFKTLL |
| | | FTKEDLEKNFKTLLN | LEKNFKTLL |
| | | TKEDLEKNFKTLLNY | EKNFKTLL |
| | | NKIYDTYLFSTKLT | IYDTYLFS |
| | | KEDLEKNFKTLLNYI | EKNFKTLL |
| | | KTLIAKIKEQSNLYE | IAKIKEQSN |
| | | TLIAKIKEQSNLYEA | IKEQSNLYE |
| | | IAKIKEQSNLYEAYK | IKEQSNLYE |
| | | AKIKEQSNLYEAYKA | IKEQSNLYE |
| | | LIAKIKEQSNLYEAY | IKEQSNLYE |
| | | LEKNFKTLLNYIQVS | EKNFKTLL |
| | | EKNFKTLLNYIQVSV | EKNFKTLL |
| | | IYDTYLFSTKLTQK | YTLFSTKLT |
| | | KIYDTYLFSTKLTQ | YTLFSTKLT |
| | | NTINKIYDTYLFS | NTINKIYD |
| | | YDTYLFSTKLTQKY | YTLFSTKLT |
| | | ITIDSDLRFKSSLQD | ITIDSDLRF |
| | | DTYLFSTKLTQKYC | YTLFSTKLT |
| | | IKEQSNLYEAYKAIV | IKEQSNLYE |
| | | TIDSDLRFKSSLQDI | LRFKSSLQD |
| | | IDSDLRFKSSLQDIA | LRFKSSLQD |
| | HLA-DRB1*0701 | YIQVSVKTAANFVYT | VKTAANFVY |
| | | LYEAYKATVTSTLMR | YKATVTSTL |
| | | YEAYKATVTSTLMRE | YKATVTSTL |
| | | IQVSVKTAANFVYTN | VKTAANFVY |
| | | NYIQVSVKTAANFVY | SVKTAANFV |
| | | QVSVKTAANFVYTND | VKTAANFVY |
| | | EAYKATVTSTLMRD | YKATVTSTL |
| | | NLYEAYKATVTSTL | YKATVTSTL |
| | | SNLYEAYKATVTST | AYKATVTST |
| | | VSVKTAANFVYTNDT | VKTAANFVY |
| | | AYKATVTSTLMRDS | YKATVTSTL |
| | | YKATVTSTLMRDSL | YKATVTSTL |
| | | SVKTAANFVYTNDTH | VKTAANFVY |
| | | LNYIQVSVKTAANFV | VSVKTAANF |
| | HLA-DRB1*0802 | FSTKKPMNKKQKQKT | STKKPMNKK |

Fig. 34 continued

| | | | |
|---|---|---|---|
| | HLA-DRB1*0901 | SNLYEAYKAIVTSIL | YEAYKAIVT |
| | | NLYEAYKAIVTSILL | YEAYKAIVT |
| | | QSNLYEAYKAIVTSI | YEAYKAIVT |
| | | RQSNLYEAYKAIVTS | YEAYKAIVT |
| | | KRQSNLYEAYKAIVT | LYEAYKAIV |
| | | YDTYTLFSTKLTQMY | YTLFSTKLT |
| | | DTYTLFSTKLTQMYS | YTLFSTKLT |
| | | YEAYKAIVTSILMR | YEAYKAIVT |
| | | TYDTYTLFSTKLTQK | YTLFSTKLT |
| | | KTYDTYLFSTKLTQ | YTLFSTKLT |
| | | LYEAYKAIVTSILLK | YEAYKAIVT |
| | | NKTYDTYLFSTKLT | TYDTYTLFS |
| | HLA-DRB1*1101 | None | |
| | HLA-DRB1*1302 | EAYKAIVTSILLKRE | YKAIVTSIL |
| | | YEAYKAIVTSILLMR | YKAIVTSIL |
| | | YDTYLFSTKLTQMY | YTLFSTKLT |
| | | DTYTLFSTKLTQMYS | YTLFSTKLT |
| | | TYDTYLFSTKLTQK | YTLFSTKLT |
| | | NKTYDTYLFSTKLT | NKTYDTYL |
| | | AYKAIVTSILMRDS | IVTSILMR |
| | | YKAIVTSILMRDSL | IVTSILMR |
| | | KTYDTYLFSTKLTQ | YTLFSTKLT |
| | | NYIQVSVKTAANFVY | IQVSVKTAA |
| | | YTLFSTKLTQMYSTR | YTLFSTKLT |
| | | LYEAYKAIVTSILLK | YKAIVTSIL |
| | | TYTLFSTKLTQMYST | YTLFSTKLT |
| | | KTLLNYIQVSVKTAA | LLNYIQVSV |
| | | KNFKTLLNYIQVSVK | LLNYIQVSV |
| | | FYTRAFTKTLIAKTK | TRAFTKTLI |
| | | NLYEAYKAIVTSILL | YKAIVTSIL |
| | | FKTLLNYIQVSVKTA | LLNYIQVSV |
| | | RKNFKTLLNYIQVSV | FKTLLNYIQ |
| | | SNLYEAYKAIVTSIL | YEAYKAIVT |
| | | NFKTLLNYIQVSVKT | LNYIQVSVK |
| | | LLNYIQVSVKTAAN | IQVSVKTAA |
| | | TRAFTKTLIAKTKQ | TKTLIAKTK |
| | | HLEAMIKTLIAKIKE | IKTLIAKIK |
| | | DYEEIRLSNRYQSYL | IRLSNRYQS |
| | | KSKYLALGLLFGFIG | YLALGLLFG |
| | | KAIVTSILLMRDSLK | IVTSILMR |
| | | YEEIRLSNRYQSYLE | IRLSNRYQS |
| | | YIQVSVKTAANFVYI | VKTAANFVY |
| | | DDYEEIRLSNRYQSY | IRLSNRYQS |
| | | EDDYEEIRLSNRYQS | EEIRLSNRY |
| | | SKYLALGLLFGFIGG | LGLLFGFIG |
| | | EEIRLSNRYQSYLEG | IRLSNRYQS |
| | | LLNYIQVSVKTAANF | IQVSVKTAA |
| | | EALIKLIAKIKEQS | IKTLIAKIK |
| | | ALIKTLIAKIKEQSX | IKTLIAKIK |
| | | RDLKNFKTLLNYIQ | RKNFKTLLN |
| | | IQVSVKTAANFVYIN | VKTAANFVY |
| | | KYLALGLLFGFISQK | LGLLFGFIS |
| | | VDSAINTINKIYDTY | INTINKIYD |
| | | YDVDSAINTINKIYD | SAINTINKI |
| | | DLKNFKTLLNYIQV | FKTLLNYIQ |
| | | LALGLLFGFISQRLP | LGLLFGFIS |
| | | SAINTINKIYDTYTL | INTINKIYD |

Fig. 34 continued

| | | | |
|---|---|---|---|
| | | YLALGLLEGFISCDL | LGLLEGFIS |
| | | NVDSAINTINKIYDT | INTINKIYD |
| | | LSYIQVSVKTAANFV | IQVSVKTAA |
| | | DSAINTINKIYDTYT | INTINKIYD |
| | | ANKSNFLQKNVLEEE | SNFLQKNVI |
| | | NKSNFLQKNVLEEEE | SNFLQKNVI |
| | | LKKNFKTLLNYIQVS | FKTLLNYIQ |
| | | EPYIRSLKRDSANKS | IHSLKRDSA |
| | HLA-DRB1*1501 | KAIVTSILLMRDSLK | IVTSILLMR |
| | | IVTSILLMRDSLKEV | IVTSILLMR |
| | | YEAYKAIVTSILLMR | YEAYKAIVT |
| | | AIVTSILLMRDSLKE | IVTSILLMR |
| | | KGKIARKKGKSKVSR | IARKKGKSK |
| | | GKIARKKGKSKVSRK | IARKKGKSK |
| | | EAYKAIVTSILLMRD | IVTSILLMR |
| | | AYKAIVTSILLMRDS | IVTSILLMR |
| | | YKAIVTSILLMRDSL | IVTSILLMR |
| | | KKGKIARKKGKSK | KKGKGKIAR |
| | | GKGKIARKKGKSKVS | IARKKGKSK |
| | | KGKGKIARKKGKSKV | IARKKGKSK |
| | | TSILLMRDSLKEVQG | ILLMRDSLK |
| | | VTSILLMRDSLKEVQ | ILLMRDSLK |
| | HLA-DRB3*0101 | None | |
| | HLA-DRB4*0101 | GKSKVSRKEPYIHSL | VSRKEPYIH |
| | | KSKVSRKEPYIHSLK | VSRKEPYIH |
| | | KEGKSKVSRKEPYIH | KKGKSKVSR |
| | | KGKSKVSRKEPYIHS | VSRKEPYIH |
| | | SKVSRKEPYIHSLKR | VSRKEPYIH |
| | | VSRKEPYIHSLKRDS | VSRKEPYIH |
| | | KVSRKEPYIHSLKRD | VSRKEPYIH |
| | HLA-DRB5*0101 | KTELLKEQSETRKEK | LLKEQSETR |
| | | TELLKEQSETRKEKI | LLKEQSETR |
| | | TSEESIKKPMNKKGK | IKKPMNKKG |
| | | SEESIKKPMNKKGKG | KKPMNKKGK |
| | | SLKTELLKEQSETRK | LLKEQSETR |
| | | LKTELLKEQSETRKE | LLKEQSETR |
| | | ESIKKPMNKKGKGKI | KKPMNKKGK |
| | | EESIKKPMNKKGKGK | KKPMNKKGK |
| | | AANFVYINDTHAKRK | YINDTHAKR |
| | | ANFVYINDTHAKRKL | INDTHAKRK |
| | | NFVYINDTHAKRKLE | INDTHAKRK |
| | | FVYINDTHAKRKLEN | INDTHAKRK |
| | | ELLKEQSETRKEKIQ | LKEQSETRK |
| AAL84590.1 BBK32 [Borrelia afzelii] SEQ ID NO:43, SEQ ID NO:145891-146426 | HLA-DRB1*0101 | YDNYTLLSTKQTQMY | YTLLSTKQT |
| | | VKIYDNYTLLSTKQT | YDNYTLLST |
| | | KIYDNYTLLSTKQTQ | YTLLSTKQT |
| | | DNYTLLSTKQTQMYS | YTLLSTKQT |
| | | IYDNYTLLSTKQTQM | YTLLSTKQT |
| | | DEHKRMLQGSLSFLS | KRMLQGSLS |
| | | EHKRMLQGSLSFLSG | LQGSLSFLS |
| | | HKRMLQGSLSFLSGE | LQGSLSFLS |
| | | KRMLQGSLSFLSGES | LQGSLSFLS |
| | | RMLQGSLSFLSGESG | LQGSLSFLS |
| | | NYTLLSTKQTQMYST | YTLLSTKQT |
| | | YTLLSTKQTQMYSTR | YTLLSTKQT |

Fig. 34 continued

| | | | | |
|---|---|---|---|---|
| | | LLNYIQVSARTATNF | YIQVSARTA | |
| | | VLEGVKYNVSSAIKT | VKYNVSSAI | |
| | | LEGVKYNVSSAIKTI | YNVSSAIKT | |
| | | EGVKYNVSSAIKTIV | YNVSSAIKT | |
| | | TLLNYIQVSARTATN | YIQVSARTA | |
| | | LNYIQVSARTATNFV | YIQVSARTA | |
| | | KTLLNYIQVSARTAT | YIQVSARTA | |
| | | LKTLLNYIQVSARTA | NYIQVSART | |
| | | GVKYNVSSAIKTIVK | YNVSSAIKT | |
| | | VKYNVSSAIKTIVKI | YNVSSAIKT | |
| | | NYIQVSARTATNFVY | YIQVSARTA | |
| | | KKIKSKCLALGLLFG | IKSKCLALG | |
| | | TLLSTKQTQMYSTRL | LSTKQTQMY | |
| | | IQQSLSFLSCFSQEL | IQQSLSFLS | |
| | | VLQQSLSFLSCFSQF | IQQSLSFLS | |
| | | YIQVSARTATNFVYA | YIQVSARTA | |
| | | EDYYYDGETRLSNRY | YYDGETRLS | |
| | | EEDYYYDGETRLSNR | YYDGETRLS | |
| | | DYYYDGETRLSNRYE | YYDGETRLS | |
| | | EEDYYYDGETRLSN | YYDGETRLS | |
| | | LSTKQTQMYSTRLDN | QTQMYSTRL | |
| | | KTIVKIYDNYTLLST | IYDNYTLLS | |
| | | LLSTKQTQMYSTRLD | QTQMYSTRL | |
| | | AIVRSLLMKDSLKI | VRSLLMKDS | |
| | | VRSLLMKDSLKIIE | LLMKDSLKI | |
| | | TKQTQMYSTRLDNLA | QTQMYSTRL | |
| | | IVRSLLMKDSLKII | LLMKDSLKI | |
| | | RGLLLMKDSLKIIEI | LLMKDSLKI | |
| | | GLEEDYYYDGETRLS | YYDGETRLS | |
| | | KYNVSAIKTIVKIY | YNVSSAIKT | |
| | | TIVKIYDNYTLLSTK | YDNYTLLST | |
| | | GLLMKDSLKIIEIV | LLMKDSLKI | |
| | | YNVSSAIKTIVKIYD | YNVSSAIKT | |
| | | IVKIYDNYTLLSTKQ | YDNYTLLST | |
| | | KIKSKCLALGLLFGF | IKSKCLALG | |
| | | IKSKCLALGLLFGFI | IKSKCLALG | |
| | | STKQTQMYSTRLDNL | QTQMYSTRL | |
| | | KSDLQATSGSNSIGY | LQATSGSNS | |
| | | SDLQATSGSNSIGYT | LQATSGSNS | |
| | | KQTQMYSTRLDNLAK | QTQMYSTRL | |
| | | QTQMYSTRLDNLAKA | QTQMYSTRL | |
| | | YYDGETRLSNRYES | YYDGETRLS | |
| | | QEEKRMLQQSLSFL | KRMLQQSLS | |
| | | LRLKSDLQATSGSNS | KSDLQATSG | |
| | | FLKSDLQATSGSNST | LQATSGSNS | |
| | | LKSDLQATSGSNSTS | LQATSGSNS | |
| | | SEEPILKTKLLRFRP | LKTKLLRFR | |
| | | YYDGETRLSNRYESY | YYDGETRLS | |
| | | EETLKTKLLRFRPFT | LKTKLLRFR | |
| | | EETLKTKLLRFRPE | LKTKLLRFR | |
| | | ISEEPILKTKLLRFR | EETLKTKLL | |
| | | LLLMKDSLKIIEIVT | LLMKDSLKI | |
| | | EDLKTLLNYIQVSAR | LKTLLNYIQ | |
| | | ETLKTKLLRFRPFTE | LKTKLLRFR | |
| | | EKDLKTLLNYIQVSA | LKTLLNYIQ | |
| | | DLKTLLNYIQVSART | LKTLLNYIQ | |
| | | IKTIVKIYDNYTLLS | VKIYDNYTL | |

Fig. 34 continued

| | | | |
|---|---|---|---|
| | | LLKKDSLKILEIVID | LLKKDSLKI |
| | | ELEKDLKTLLNYIQV | LKTLLNYIQ |
| | | ELLEKDLKTLLNYIQ | KDLKTLLN |
| | | RAYKATVRSTLLMKD | YKATVRSTL |
| | | LEKDLKTLLNSIQVS | LKTLLNYIQ |
| | | SYLEQVKYNVSSATK | VKYNVSSAT |
| | | DLYPAYKATVRSTLL | PEAYKATVR |
| | | LQATSGSNSTSYTD | LQATSGSNS |
| | | SELYPAYKATVRSTL | YEAYKATVR |
| | | LQATSGSNSTSYTDF | LQATSGSNS |
| | | QKYSTRLDNLAKAKA | YSTRLDNLA |
| | | ETETKNLTLKTKQQS | TKNLTLKTK |
| | | TETKNLTLKTKQQSG | TKNLTLKTK |
| | | TETETKNLTLKTKQQ | TKNLTLKTK |
| | | ATETETKNLTLNTKQ | TKNLTLKTK |
| | | QGSTSFLSGFSGELK | FLSGFSGEL |
| | | AYKATVRSTLLMKDS | VRSTLLMKD |
| | | DATETPTKNLTLKTK | ETKNLTLKT |
| | | TQVSARTATNFVYAR | VSARTATNF |
| | | YKATVRSTLLMKDSL | VRSTLLMKD |
| | | KATVRSTLLMKDSLK | VRSTLLMKD |
| | | GSLSFLSGFSGELKD | FLSGFSGEL |
| | | ESYLEQVKYNVSSAT | LEQVKYNVS |
| | | STRLDNLAKAKAREE | LDNLAKAKA |
| | | TRLDNLAKAKAREEA | LDNLAKAKA |
| | HLA-DRB1*0301 | NELDFTIDSDLRLKS | FTLDSDLRL |
| | | LDSTIDSDLRLKSDL | FTLDSDLRL |
| | | ELDFTIDSDLRLKSD | FTLDSDLRL |
| | | FTLDSDLRLKSDLQA | LDSDLRLKS |
| | | DFTLDSDLRLKSDLQ | LDSDLRLKS |
| | | DGNELDFTLDSDLRL | NELDFTLDS |
| | | GNELDFTLDSDLRLK | FTLDSDLRL |
| | HLA-DRB1*0401 | DAVKKDPFNHHVKRE | VKKDPFNHH |
| | | GNAVKKDPFNHHVKR | VKKDPFNHH |
| | | KVEGNAVKKDPFNHH | KVEGNAVKK |
| | | EGNAVKKDPFNHHVK | VKKDPFNHH |
| | | VEGNAVKKDPFNHHV | VKKDPFNHH |
| | | NHHVKRESVNNSLLS | VKRESVNNS |
| | | HHVKRESVNNSLLSQ | VKRESVNNS |
| | | DPFNHHVKRESVNNS | FNHHVKRES |
| | | PFNHHVKRESVNNSL | VKRESVNNS |
| | | VKIYDNYTLLSIKQT | IYDNYTLLS |
| | | IVKIYDNYTLLSTKQ | IYDNYTLLS |
| | | FNHHVKRESVNNSLL | VKRESVNNS |
| | | LKTIVKIYDNYTLLS | IVKIYDNYT |
| | | KTIVKIYDNYTLLST | IYDNYTLLS |
| | | TIVKIYDNYTLLSTK | IYDNYTLLS |
| | | VKKDPFNHHVKRESV | VKKDPFNHH |
| | | AVKKDPFNHHVKRES | VKKDPFNHH |
| | | HVKRESVNNSLLSQK | VKRESVNNS |
| | | VKRESVNNSLLSQKN | VKRESVNNS |
| | HLA-DRB1*0404 | None | |
| | HLA-DRB1*0405 | IKTLVKIYDNYTLLS | IKTLVKIYD |
| | | VKIYDNYTLLSTKQT | IYDNYTLLS |
| | | SSALKTIVKIYDNYT | IKTLVKIYD |
| | | KTIVKIYDNYTLLST | IYDNYTLLS |

Fig. 34 continued

| | | SALKTIVKIYDNYTL | IKTIVKIYD |
|---|---|---|---|
| | HLA-DRB1*0701 | NYTQVSARTATNFVY | VSARTATNF |
| | | YTQVSARTATNFVYA | ARTATNFVY |
| | | TQVSARTATNFVYAR | ARTATNFVY |
| | | DLYEAYKAIVRSILL | YKAIVRSIL |
| | | LYEAYKAIVRSILMK | YKAIVRSIL |
| | | YEAYKAIVRSILMKR | YKAIVRSIL |
| | | SDLYEAYKAIVRSIL | YEAYKAIVR |
| | | QVSARTATNFVYARF | ARTATNFVY |
| | | EAYKAIVRSILMKRD | YKAIVRSIL |
| | | VSARTATNFVYARFT | ARTATNFVY |
| | | LNYTQVSARTATNFV | VSARTATNF |
| | | EGVKYNVSSATKTTV | VKYNVSSAT |
| | | LLNYTQVSARTATNF | TQVSARTAT |
| | HLA-DRB1*0802 | None | |
| | HLA-DRB1*0901 | EGVKYNVSSALKTIV | YNVSSALKT |
| | | LEGVKYNVSSATKTT | YNVSSATKT |
| | | GVKYNVSSALKTIVK | YNVSSALKT |
| | | VKYNVSSATKTTVKT | YNVSSATKT |
| | | YLEGVKYNVSSATKT | VKYNVSSAT |
| | | KTLLNYTQVSARTAT | YTQVSARTA |
| | | LNYTQVSARTATNFV | YTQVSARTA |
| | | KYNVSSATKTTVKTY | YNVSSATKT |
| | | TLLNYTQVSARTATN | YTQVSARTA |
| | | LLNYTQVSARTATNF | YTQVSARTA |
| | | YNVSSATKTIVKIYD | YNVSSATKT |
| | HLA-DRB1*1101 | None | |
| | HLA-DRB1*1302 | DAIETDIKNLILKIK | IDTELKNLI |
| | | AIETDIKNLILKIKG | IKNLILKIK |
| | | TETFIKNLILKIKGQ | TKNLILKIK |
| | | ETDIKNLILKIKGQS | IKNLILKIK |
| | | TDIKNLILKIKGQSE | TKNLILKIK |
| | | DIKNLILKIKGQSEL | IKNLILKIK |
| | | TDLLIKTKQSELY | TKLLIKIP |
| | | EGVKYNVSSATKTIV | YNVSSATKT |
| | | LEGVKYNVSSATKTT | YNVSSATKT |
| | | YLEGVKYNVSSATKT | VKYNVSSAT |
| | | GVKYNVSSATKTTVK | YNVSSATKT |
| | | VKYNVSSATKTTVKT | YNVSSATKT |
| | | VKTYDNYTLLSTKQT | TYDNYTLLS |
| | | KTLLNYTQVSARTAT | LLNYTQVSA |
| | | EAYKAIVRSILMKRE | YKAIVRSIL |
| | | TLLNYTQVSARTATN | TQVSARTAT |
| | | YEAYKAIVRSILMKR | YKAIVRSIL |
| | | RVKRFSVNSNLSQKN | RSVNSNLS |
| | | VKRFSVNSNLSQKNV | VNSNLSQK |
| | | LLNYTQVSARTATNF | TQVSARTAT |
| | | LNYTQVSARTATNFV | TQVSARTAT |
| | | NYTQVSARTATNFVY | TQVSARTAT |
| | | KTYDNYTLLSTKQTQ | YTLLSTKQT |
| | | TYDNYTLLSTKQTQK | YTLLSTKQT |
| | | YDNYTLLSTKQTQKY | YTLLSTKQT |
| | | KRFSVNSNLSQKNV | VNSNLSQK |
| | | RSVNSNLSQKNVI | VNSNLSQK |
| | | YKAIVRSILMKRDSL | IVRSILMK |
| | | AYKAIVRSILMKRDS | IVRSILMK |

Fig. 34 continued

| | | | |
|---|---|---|---|
| | | ENYTLLSTKQQMYQ | YTLLSTKQT |
| | | EELKTLLNYTQVSAR | LKTLLNYTQ |
| | | EGVNNSLSQKNVTS | VNNSLSQK |
| | | YYVSSATKTTVKIYD | YYVSSATKT |
| | | KNLLLRKLRGQSDLYE | LKIRGQSDL |
| | | LYEAYKAIVRSTLIM | YKAIVRSTL |
| | | DLKTLLNYTQVSART | LNYTQVSAR |
| | | EELKTLLNYTQVSA | LKTLLNYTQ |
| | | LKTLLNYTQVSARTA | LNYTQVSAR |
| | | LEATETEIRNLILKT | TETEIKNLT |
| | | KYNVSSATKTTVKIY | YNVSSATKT |
| | | KTTVKIYDNYTLLST | VKIYDNYTL |
| | | HHVKRESVNNSLSQ | VKRESVNNS |
| | | TKTTVKIYDNYTLLS | VKIYDNYTL |
| | | SATKTTVKIYDNYTL | TKTTVKIY |
| | | NHHVKRESVNNSLS | VKRESVNNS |
| | | DLYEAYKAIVRSTLL | YKAIVRSTL |
| | | KAIVRSTLMKDSLK | TVRSTLMK |
| | | SYLEGVKYNVSSATK | VKYNVSSAT |
| | | VTQVSARTATNFVYA | TQVSARTAT |
| | | TTVKIYDNYTLLSTK | VKIYDNYTL |
| | | KLDAIETEIKNLILK | IETEIKNLI |
| | | TQVSARTATNFVYAR | TQVSARTAT |
| | | YTLLSTKQTQMYTK | YTLLSTKQT |
| | | LALGLLFGFTSCDLF | LGLLFGFTS |
| | | ESYLEGVKYNVSSAT | LEGVKYNVS |
| | | SDLYEAYKAIVRSTL | EAYKAIVRS |
| | | NYTLLSTKQTQMYT | YTLLSTKQT |
| | | KSKCLALGLLFGFIC | LALGLLFGF |
| | | SKCLALGLLFGFIC | LGLLFGFIC |
| | | EELKRDLKTLLNYTQ | LKRDLKTLL |
| | | KCLALGLLFGFISCD | LGLLFGFIC |
| | | CLALGLLFGFISCDL | LGLLFGFIC |
| | | AIVRSTLMKDSLKT | LLMKDSLK |
| | | LEKRDLKTLLNYTQVS | LKTLLNYTQ |
| | | IVRSTLMKDSLKT | LLMKDSLK |
| | | ELEKRDLKTLLNYTQV | LKTLLNYTQ |
| | | NLILKIKGQSDLYEA | LKIKGQSDL |
| | | TVKIYDNYTLLSTKQ | YDNYTLLS |
| | | LLLRKIRGQSDLYEAY | LKIRGQSDL |
| | | VRSTLMKDSLKTE | TLMKDSLK |
| | | SVNNSLSQKNVTSE | VNNSLSQK |
| | | MKTKSKCLALGLLFG | MKTKSKCLA |
| | | RRLDAIETEIKNLIL | IETEIKNLT |
| | | ATKTTVKIYDNYTLL | VKIYDNYTL |
| | | DPFNEEVKRESVNNS | EVNHVKRES |
| | | KKLDAIETEIKNLI | KLDAIETET |
| HLA-DRB1*1501 | | ETLETKLLRERPETR | LETKLLRER |
| | | TLKTLLRERPETRK | LLRERPETR |
| | | LKTLLRERPETRKE | LLRERPETR |
| | | KTLLRERPETRKEE | LLRERPETR |
| | | TKLLRERPETRKEET | LLRERPETR |
| | | KAIVRSTLMKDSLK | TVRSTLMK |
| | | YEAYKAIVRSTLMK | YEAYKAIVR |
| | | ATVRSTLMKDSLKT | TVRSTLMK |
| | | IVRSTLMKDSLKT | IVRSTLMK |
| | | AYKAIVRSTLMKDS | TVRSTLMK |

Fig. 34 continued

| | | | |
|---|---|---|---|
| | | EAYKAIVRSILLMKD | IVRSILLMK |
| | | YKAIVRSILLMKDSL | IVRSILLMK |
| | | KLLRERPETRKEEIQ | LLRERPETR |
| | | ETEIKNLILKIKGQS | IKNLILKIK |
| | | TEIKNLILKIKGQSD | IKNLILKIK |
| | | LLRERPETRKEEIQK | LLRERPETR |
| | | ISEEEILKTKLLRER | EILKTKLLR |
| | | SEEEILKTKLLRERP | LKTKLLRER |
| | | EEILKTKLLRERPE | LKTKLLRER |
| | | IETEIKNLILKIKGQ | IKNLILKIK |
| | | EEILKTKLLRERPET | LKTKLLRER |
| | | AIETEIKNLILKIKG | IKNLILKIK |
| | | DAIETEIKNLILKIK | TEIKNLILK |
| | | VRSILLMKDSLKIIE | LLMKDSLKI |
| | | RSILLMKDSLKIIEI | LLMKDSLKI |
| | | ATNFVYAREIYSKRK | VYAREIYSK |
| | | TNFVYAREIYSKRKL | VYAREIYSK |
| | | KDLKTLLNYIQVSAR | LLNYIQVSA |
| | | TATNFVYAREIYSKR | VYAREIYSK |
| | | NFVYAREIYSKRKLD | VYAREIYSK |
| | HLA-DRB3*0101 | None | |
| | HLA-DRB4*0101 | ILKTKLLRERPETRK | LLRERPETR |
| | | LKTKLLRERPETRKE | LRERPETRK |
| | HLA-DRB5*0101 | ATNFVYAREIYSKRK | YAREIYSKR |
| | | TNFVYAREIYSKRKL | YAREIYSKR |
| | | NFVYAREIYSKRKLD | YAREIYSKR |
| | | FVYAREIYSKRKLDA | YAREIYSKR |
| | | EILKTKLLRERPETR | LKTKLLRER |
| | | VYAREIYSKRKLDAI | YAREIYSKR |
| | | TATNFVYAREIYSKR | VYAREIYSK |
| | | ILKTKLLRERPETRK | LLRERPETR |
| | | KTKLLRERPETRKEE | LLRERPETR |
| | | LKTKLLRERPETRKE | LLRERPETR |
| | | TKLLRERPETRKEEI | LLRERPETR |
| AAL84595.1\| BBK32 [Borrelia garinii] SEQ ID NO:44, SEQ ID NO:146427-146962 | HLA-DRB1*0101 | TLFSTKLTQMYSTRL | FSTKLTQMY |
| | | LFSTKLTQMYSTRLD | LTQMYSTRL |
| | | FSTKLTQMYSTRLDN | LTQMYSTRL |
| | | STKLTQMYSTRLDNL | LTQMYSTRL |
| | | TKLTQMYSTRLDNLA | LTQMYSTRL |
| | | KLTQMYSTRLDNLAK | LTQMYSTRL |
| | | LTQMYSTRLDNLAKA | LTQMYSTRL |
| | | YSAYKAIVSSILLMR | YKAIVSSIL |
| | | NLYSAYKAIVSSILL | YKAIVSSIL |
| | | LYSAYKAIVSSILLM | YKAIVSSIL |
| | | SAYKAIVSSILLMRD | YKAIVSSIL |
| | | SNLYSAYKAIVSSIL | YSAYKAIVS |
| | | YDTYTLFSTKLTQMY | YTLFSTKLT |
| | | DTYTLFSTKLTQMYS | YTLFSTKLT |
| | | KKVKSKYLALGLLFG | VKSKYLALG |
| | | IYDTYTLFSTKLTQM | YTLFSTKLT |
| | | NKIYDTYTLFSTKLT | TYTLFSTKL |
| | | KIYDTYTLFSTKLTQ | YTLFSTKLT |
| | | TYTLFSTKLTQMYST | YTLFSTKLT |
| | | KVKSKYLALGLLFGF | YLALGLLFG |
| | | VKSKYLALGLLFGFI | YLALGLLFG |

Fig. 34 continued

| | | | |
|---|---|---|---|
| | | KSKYLALGLLFGFIS | YLALGLLFG |
| | | SKYLALGLLFGFISG | YLALGLLFG |
| | | YTLFSTKLTQMYSTR | YTLFSTKLT |
| | | AYKATVSSTLLMRDS | YKATVSSTL |
| | | YKAIVSSILLNRDSL | YKAIVSSIL |
| | | HSFKRDAANKSNFLQ | FKRDAANKS |
| | | THSFKRDAANKSNFL | FKRDAANKS |
| | | DEYKQMTKGSLNSLG | MTKGSLNSL |
| | | PFTHSFKRDAANKSN | FKRDAANKS |
| | | KKKVSKYLALGLLF | VSKYLALG |
| | | QDEYKQMTKGSLNSL | YKQMTKGSL |
| | | EPFTHSFKRDAANKS | FTHSFKRDA |
| | | FTHSFKRDAANKSNF | FKRDAANKS |
| | | QMTKGSLNSLSGFSG | MTKGSLNSL |
| | | EYKQMTKGSLNSLSG | MTKGSLNSL |
| | | YKQMTKGSLNSLSGF | MTKGSLNSL |
| | | MTKGSLNSLSGFSGF | LNSLSGFSG |
| | | YLALGLLFGFISGEL | YLALGLLFG |
| | | ENTFAKTKTLTAKTK | FAKTKTLTA |
| | | NTFAKTKTLTAKTKE | TKTLTAKTK |
| | | FAKTKTLTAKTKEKG | TKTLTAKTK |
| | | AKTKTLTAKTKEKSN | TKTLTAKTK |
| | | TFAKTKTLTAKTKEK | TKTLTAKTK |
| | | KYLALGLLFGFISGE | YLALGLLFG |
| | | FKTLLNYIQVSVKTA | FKTLLNYIQ |
| | | KGSLNSLSGFSGELK | LNSLSGFSG |
| | | LLNYIQVSVKTATNF | YIQVSVKTA |
| | | TKGSLNSLSGFSGEL | LNSLSGFSG |
| | | LNYIQVSVKTATNFV | YIQVSVKTA |
| | | KGNFKGSLNSLSGFS | MTKGSLNSL |
| | | GSLNSLSGFSGELKE | LNSLSGFSG |
| | | EKNFKTLLNYIQVSV | FKTLLNYIQ |
| | | TLLNYIQVSVKTATN | YIQVSVKTA |
| | | KNFKTLLNYIQVSVK | FKTLLNYIQ |
| | | KTLLNYIQVSVKTAT | YIQVSVKTA |
| | | DLEKNFKTLLNYIQV | FKTLLNYIQ |
| | | EDLEKNFKTLLNYIQ | EKNFKTLLN |
| | | SFKRDAANKSNFLQK | FKRDAANKS |
| | | TYKTYDTYTIFSTKL | YDTYTIFST |
| | | QQDEYKQMTKGSLNS | YKQMTKGSL |
| | | FKRDAANKSNFLQKN | FKRDAANKS |
| | | EQVKYNVDSAINTIN | YNVDSAINT |
| | | LEKNFKTLLNYIQVS | FKTLLNYIQ |
| | | QVKYNVDSAINTINK | YNVDSAINT |
| | | LEQVKYNVDSAINTI | YNVDSAINT |
| | | YLEQVKYNVDSAINT | VKYNVDSAI |
| | | NYIQVSVKTATNFVY | YIQVSVKTA |
| | | VKYNVDSAINTINKT | YNVDSAINT |
| | | SSLQDTACSNSTSYT | TACSNSTSY |
| | | KSSLQDTACSNSTSY | LQDTACSNS |
| | | FKSNLYSAYKATVSS | YSAYKATVS |
| | | KSNLYSAYKATVSST | YSAYKATVS |
| | | TTTDSDLRPKSSLQD | DSDLRPKSS |
| | | KFKSNLYSAYKATVS | LYSAYKATV |
| | | TTDSDLRPKSSLQDT | LRPKSSLQD |
| | | DSDLRPKSSLQDTAC | LRPKSSLQD |
| | | NFKTLLNYIQVSVKT | FKTLLNYIQ |

Fig. 34 continued

| | | | |
|---|---|---|---|
| | | IDSDLRPKSSLQDIA<br>NTINKIYDTYILFST<br>YIQVSVKTAINFVYL<br>KQQDFYKQMTKQSLN<br>SDLRPKSSLQDLAGS<br>QKQQDFYKQMTKQSL<br>SLQDTAGSNSTSYTD<br>LRPKSSLQDTAGSNS<br>LQDTAGSNSTSYTDF<br>KIKTLTAKIKEKSNL<br>TKTLTAKIKEKSNLY<br>TINKIYDTYTLFSTK<br>QMYSTRLDNLAKAKA<br>KATVSSTLLMRDSLF<br>TNFVYTNEMHAKRKL<br>ATNFVYTNEMHAKRK<br>SLNSLSCFSCFLKFT<br>LNSLSCFSCFLKFTT<br>FVYTNEMHAKRKLFN<br>NFVYTNEMHAKRKLF<br>ATVSSTLLMRDSLFR<br>QDTAGSNSTSYTDFI | LRPKSSLQD<br>IKIYDTYT<br>YIQVSVKTA<br>YKQMTKQSL<br>LRPKSSLQD<br>QKQQDFYKQ<br>TAGSNSTSY<br>LRPKSSLQD<br>TAGSNSTSY<br>TKTLTAKIK<br>TKTLTAKIK<br>YDTYTLFST<br>YSTRLDNLA<br>TVSSTLLMR<br>TNEMHAKRK<br>FVYTNEMHA<br>LNSLSCFSC<br>LNSLSCFSC<br>TNEMHAKRK<br>TNEMHAKRK<br>VSSTLLMRD<br>TAGSNSTSY |
| | HLA-DRB1*0301 | NLIDITLDSDLRPKS<br>ELDITLDSDLRPKSS<br>LDITLDSDLRPKSSL<br>ITLDSDLRPKSSLQD<br>DITLDSDLRPKSSLQ | ITLDSDLRP<br>ITLDSDLRP<br>ITLDSDLRP<br>IDSDLRPKS<br>IDSDLRPKS |
| | HLA-DRB1*0401 | PFIESFKRDAANKSN<br>EPFIESFKRDAANKS<br>FIESFKRDAANKSNF<br>IESFKRDAANKSNFL<br>IHSFKRDAANKSNFL<br>SFKRDAANKSNFLQK<br>FKRDAANKSNFLQKX<br>LATNFVYTNEMHAKR<br>TNFVYTNEMHAKRKL<br>ATNFVYTNEMHAKRK<br>KTAINFVYTNEMHAK<br>VKTAINFVYTNEMHA<br>KTLTAKIKEKSNLYS<br>TKTLTAKIKEKSNLY<br>TLTAKIKEKSNLYSA<br>LTAKIKEKSNLYSAY<br>TAKIKEKSNLYSAYK<br>NKIYDTYTLFSTKLT<br>FKTLLNYTQVSVKTA<br>TINKIYDTYTLFSTK<br>NTINKIYDTYTLFST<br>INTINKIYDTYTLFS<br>INKIYDTYTLFSTKL<br>FVYTNEMHAKRKLFN<br>NFKTLLNYTQVSVKT<br>NFVYTNEMHAKRKLF<br>LLNYTQVSVKTATNF<br>TLLNYTQVSVKTATN | FKRDAANKS<br>IHSFKRDAA<br>FKRDAANKS<br>FKRDAANKS<br>FKRDAANKS<br>FKRDAANKS<br>FKRDAANKS<br>FVYTNEMHA<br>FVYTNEMHA<br>FVYTNEMHA<br>FVYTNEMHA<br>TNFVYTNEM<br>KIKEKSNLY<br>ITAKIKEKS<br>KIKEKSNLY<br>KIKEKSNLY<br>KIKEKSNLY<br>IYDTYTLFS<br>NYTQVSVKT<br>IYDTYTLFS<br>IYDTYTLFS<br>IYDTYTLFS<br>IYDTYTLFS<br>FVYTNEMHA<br>FKTLLNYTQ<br>FVYTNEMHA<br>NYTQVSVKT<br>NYTQVSVKT |

Fig. 34 continued

| | | | |
|---|---|---|---|
| | | SAYKAIVSSILMRD | YKAIVSSIL |
| | | YSAYKAIVSSILMR | YKAIVSSIL |
| | | KTLNYIQVSVKTAT | NYIQVSVKT |
| | HLA-DRB1*0404 | ATNFVYINEMHAKRK | FVYINEMHA |
| | | TNFVYINEMHAKRKL | FVYINEMHA |
| | | TATNFVYINEMHAKR | FVYINEMHA |
| | HLA-DRB1*0405 | EDLEKNFKTLLNYIQ | FKNFKTLLN |
| | | DLEKNFKTLLNYIQV | FKNFKTLLN |
| | | FTKEDLEKNFKTLLN | LEKNFKTLL |
| | | TKEDLEKNFKTLLNY | FKNFKTLLN |
| | | NKIYDTYLFSTKLT | YDTYLFS |
| | | KEDLEKNFKTLLNYT | FKNFKTLLN |
| | | LEKNFKTLLNYIQVS | FKNFKTLLN |
| | | FKNFKTLLNYIQVSV | FKNFKTLLN |
| | | IYDTYLFSTKLTQM | YTLFSTKLT |
| | | KIYDTYLFSTKLTQ | YTLFSTKLT |
| | | IXTTNKIYDTYLFS | IXTTNKIYD |
| | | YDTYLFSTKLTQMY | YTLFSTKLT |
| | | ITIDSDLRPKSSLQD | ITIDSDLRP |
| | | DTYLFSTKLTQMYS | YTLFSTKLT |
| | | TIDSDLRPKSSLQDT | IRPKSSLQD |
| | | IDSDLRPKSSLQDTA | LRPKSSLQD |
| | HLA-DRB1*0701 | LYSAYKAIVSSTLMR | YKAIVSSTL |
| | | YSAYKAIVSSTLMR | YKAIVSSTL |
| | | SAYKAIVSSILMRD | YKAIVSSIL |
| | | NLYSAYKAIVSSTL | YKAIVSSTL |
| | | SNLYSAYKAIVSSIL | YSAYKAIVS |
| | | YIQVSVKTATNFVYT | VKTATNFVY |
| | | IQVSVKTATNFVYIN | VKTATNFVY |
| | | NYIQVSVKTATNFVY | SVKTATNFV |
| | | QVSVKTATNFVYINE | VKTATNFVY |
| | | VSVKTATNFVYINEM | VKTATNFVY |
| | | AYKAIVSSILMRDS | YKAIVSSIL |
| | | YKAIVSSILMRDSL | YKAIVSSIL |
| | | SVKTATNFVYINEMH | VKTATNFVY |
| | | LNYIQVSVKTATNFV | VSVKTATNF |
| | | VKTATNFVYINEMHA | VKTATNFVY |
| | HLA-DRB1*0802 | ESIKKPNKKGKGKI | SIKKPKNKK |
| | HLA-DRB1*0901 | SNLYSAYKAIVSSIL | YSAYKAIVS |
| | | LYSAYKAIVSSILLM | YKAIVSSIL |
| | | YSAYKAIVSSILMR | AIVSSILMR |
| | | YDTYLFSTKLTQMY | YTLFSTKLT |
| | | DTYLFSTKLTQMYS | YTLFSTKLT |
| | | IYDTYLFSTKLTQM | YTLFSTKLT |
| | | NLYSAYKAIVSSILL | YSAYKAIVS |
| | | KIYDTYLFSTKLTQ | YTLFSTKLT |
| | | NKIYDTYLFSTKLT | IYDTYLFS |
| | HLA-DRB1*1101 | None | |
| | HLA-DRB1*1302 | NYIQVSVKTATNFVY | IQVSVKTAT |
| | | KTLLNYIQVSVKTAT | LLNYIQVSV |
| | | YDTYLFSTKLTQMY | YTLFSTKLT |
| | | DTYLFSTKLTQMYS | YTLFSTKLT |
| | | TLLNYIQVSVKTAT | IQVSVKTAT |
| | | LLNYIQVSVKTATNF | IQVSVKTAT |
| | | LNYIQVSVKTATNFV | IQVSVKTAT |
| | | IYDTYLFSTKLTQM | YTLFSTKLT |

Fig. 34 continued

| | | | |
|---|---|---|---|
| | | YIQVSVKTATNFVYI | IQVSVKTAT |
| | | IQVSVKTATNFVYIN | IQVSVKTAT |
| | | NKIYDIYTLFSIKLT | NKIYDIYTL |
| | | FNIFAKIKTLTAKIK | IFAKIKTLT |
| | | KIYDIYTLFSIKLTQ | YTLFSIKLT |
| | | NIFAKIKTLTAKIKE | IKTLTAKIK |
| | | IFAKIKTLTAKIKEK | IKTLTAKIK |
| | | YTLFSIKLTQMYSTR | YTLFSIKLT |
| | | TYTLFSIKLTQMYST | YTLFSIKLT |
| | | SAYKATVSSILLMRD | TVSSILMR |
| | | KIFKTLLNYTQVSVK | LLNYTQVSV |
| | | YSAYKATVSSILLMR | YKATVSSIL |
| | | FKTLLNYTQVSVKTA | LLNYTQVSV |
| | | EKNFKTLLNYTQVSV | FKTLLNYTQ |
| | | FAKIKTLTAKIKEKS | IKTLTAKIK |
| | | NFKTLLNYTQVSVKT | LLNYTQVSV |
| | | AKIKTLTAKIKEKSN | IKTLTAKIK |
| | | AYKATVSSILLMRDS | TVSSILMR |
| | | DYEEIRLSNRYQSYL | IRLSNRYQS |
| | | KSKYLALGLLFGFTS | YLALGLLFG |
| | | YKATVSSILLMRDSL | TVSSILMR |
| | | YEEIRLSNRYQSYLE | IRLSNRYQS |
| | | DDYEEIRLSNRYQSY | IRLSNRYQS |
| | | EDDYEEIRLSNRYQS | EEIRLSNRY |
| | | SKYLALGLLFGFTSC | LGLLFGFTS |
| | | EEIRLSNRYQSYLEG | IRLSNRYQS |
| | | ANKSNFLQKNVMLEE | SNFLQKNVM |
| | | EDLEKNFKTLLNYIQ | EKNFKTLLN |
| | | IKSNFLQKNVMLEEE | SNFLQKNVM |
| | | KYLALGLLFGFISCD | LGLLFGFIS |
| | | VDSAINTINKIYDTY | INTINKIYD |
| | | YNVDSAINTINKIYD | SAINTINKI |
| | | ELEKNFKTLLNYIQV | FKTLLNYIQ |
| | | LALGLLFGFISCDLF | LGLLFGFIS |
| | | SAINTINKIYDIYTL | INTINKIYD |
| | | KAIVSSILLMRDSLK | IVSSILMR |
| | | YLALGLLFGFISCDL | LGLLFGFTS |
| | | NVDSAINTINKIYDT | INTINKIYD |
| | | DSAINTINKIYDIYT | INTINKIYD |
| | | RKLENIFAKIKTLTA | IFAKIKTLT |
| | | KLENIFAKIKTLTAK | IFAKIKTLT |
| | | KRKLENIFAKIKTLT | ENIFAKIKT |
| | | LEKNFKTLLNYTQVS | FKTLLNYTQ |
| | | LENIFAKIKTLTAKI | IFAKIKTLT |
| | | LYSAYKATVSSILLM | YKATVSSIL |
| | | IKTLTAKIKEKSNLY | IKTLTAKIK |
| | | KSNFLQKNVMLEEES | SNFLQKNVM |
| | HLA-DRB1*1501 | KATVSSILLMRDSLK | TVSSILMR |
| | | TVSSILLMRDSLKEV | TVSSILMR |
| | | ATVSSILLMRDSLKE | TVSSILMR |
| | | YSAYKATVSSILLMR | YKATVSSIL |
| | | SAYKATVSSILLMRD | TVSSILMR |
| | | AYKATVSSILLMRDS | TVSSILMR |
| | | YKATVSSILLMRDSL | IVSSILMR |
| | | KKGKGKIARKNGKSK | KKGKGKIAR |
| | | VSSILLMRDSLKEVQ | ILLMRDSLK |
| | | SSILLMRDSLKEVQY | ILLMRDSLK |

Fig. 34 continued

|  |  |  | GKGKIARKYGKSKV<br>KGKIARKNGKSKVSG | IARKNGKSK<br>IARKNGKSK |
|---|---|---|---|---|
|  | HLA-DRB3*0101 |  | None |  |
|  | HLA-DRB4*0101 |  | GKSKVSGKEPFTHSF<br>KNGKSKVSGKEPFTH<br>NGKSKVSGKEPFTHS<br>KSKVSGKEPFTHSFK<br>SKVSGKEPFTHSFKP<br>VSGKEPFTHSFKRDA | VSGKEPFTH<br>SKVSGKEPF<br>VSGKEPFTH<br>VSGKEPFTH<br>VSGKEPFTH<br>VSGKEPFTH |
|  | HLA-DRB5*0101 |  | ATNFVYINEMHAKRK<br>TNFVYINEMHAKRKL<br>NFVYINEMHAKRKLE<br>FVYINEMHAKRKLEN<br>VYINEMHAKRKLENT<br>YINEMHAKRKLENTE<br>KTFLLKFQSFTRKEK<br>TFLLKFQSFTRKEKT<br>TSFFSTKKPMNKKGK<br>SFFSTKKPMNKKGK<br>SLKTFLLKFQSFTRK<br>LKTFLLKFQSFTRKE<br>FSTKKPMNKKGKGKT<br>FSTKKPMNKKGKGK<br>FLLKFQSFTRKEKTQ | YINEMHAKR<br>INEMHAKRK<br>INEMHAKRK<br>INEMHAKRK<br>INEMHAKRK<br>INEMHAKRK<br>LLKFQSFTR<br>LLKFQSFTR<br>TKKPMNKKG<br>KKPMNKKGK<br>LLKFQSFTR<br>LLKFQSFTR<br>KKPMNKKGK<br>KKPMNKKGK<br>LKFQSFTRK |

Fig. 34 continued

Fig. 35. Summary flow chart ELISPOT

Fig. 36. Prediction of cancer antigen BclX(L) specific MHC class 1, 8-, 9-, 10, 11-mer peptide binders
SEQ ID NO:179553-180345

| pos | peptide | logscore | affinity(nM) | Bind Level | Protein Name | Allele |
|---|---|---|---|---|---|---|
| | 8-mers | | | | | |
| 57 | HLADSPAV | 0.691 | 28 | SB | Sequence | A0201 |
| 213 | FLTGMTVA | 0.687 | 29 | SB | Sequence | A0201 |
| 166 | AAWMATYL | 0.477 | 285 | WB | Sequence | A0201 |
| 160 | VLVSRIAA | 0.463 | 333 | WB | Sequence | A0201 |
| 119 | YQSFEQVV | 0.436 | 448 | WB | Sequence | A0201 |
| 147 | GALCVESV | 0.431 | 472 | WB | Sequence | A0201 |
| 223 | VLLGSLFS | 0.427 | 494 | WB | Sequence | A0201 |
| 213 | FLTGMTVA | 0.777 | 11 | SB | Sequence | A0202 |
| 57 | HLADSPAV | 0.771 | 11 | SB | Sequence | A0202 |
| 119 | YQSFEQVV | 0.590 | 84 | WB | Sequence | A0202 |
| 218 | TVAGVVLL | 0.569 | 110 | WB | Sequence | A0202 |
| 11 | FLSYKLSQ | 0.545 | 137 | WB | Sequence | A0202 |
| 82 | MAAVKQAL | 0.512 | 195 | WB | Sequence | A0202 |
| 73 | SLDAREVI | 0.475 | 294 | WB | Sequence | A0202 |
| 192 | ELYGNNAA | 0.444 | 410 | WB | Sequence | A0202 |
| 217 | MTVAGVVL | 0.440 | 425 | WB | Sequence | A0202 |
| 160 | VLVSRIAA | 0.434 | 454 | WB | Sequence | A0202 |
| 1 | SQSNRELV | 0.434 | 457 | WB | Sequence | A0202 |
| 213 | FLTGMTVA | 0.852 | 4 | SB | Sequence | A0203 |
| 57 | HLADSPAV | 0.831 | 6 | SB | Sequence | A0203 |
| 160 | VLVSRIAA | 0.642 | 48 | SB | Sequence | A0203 |
| 158 | MQVLVSRI | 0.602 | 74 | WB | Sequence | A0203 |
| 11 | FLSYKLSQ | 0.582 | 92 | WB | Sequence | A0203 |
| 133 | GVNWGRIV | 0.581 | 92 | WB | Sequence | A0203 |
| 216 | GMTVAGVV | 0.579 | 94 | WB | Sequence | A0203 |
| 119 | YQSFEQVV | 0.578 | 96 | WB | Sequence | A0203 |
| 164 | RIAAWMAT | 0.573 | 101 | WB | Sequence | A0203 |
| 78 | EVIPMAAV | 0.486 | 261 | WB | Sequence | A0203 |
| 1 | SQSNRELV | 0.481 | 274 | WB | Sequence | A0203 |
| 217 | MTVAGVVL | 0.467 | 318 | WB | Sequence | A0203 |
| 147 | GALCVESV | 0.464 | 328 | WB | Sequence | A0203 |
| 221 | GVVLLGSL | 0.443 | 412 | WB | Sequence | A0203 |
| 218 | TVAGVVLL | 0.440 | 429 | WB | Sequence | A0203 |
| 57 | HLADSPAV | 0.555 | 122 | WB | Sequence | A0204 |
| 153 | SVDKEMQV | 0.431 | 469 | WB | Sequence | A0204 |
| 57 | HLADSPAV | 0.780 | 10 | SB | Sequence | A0206 |
| 158 | MQVLVSRI | 0.733 | 18 | SB | Sequence | A0206 |
| 213 | FLTGMTVA | 0.682 | 31 | SB | Sequence | A0206 |
| 1 | SQSNRELV | 0.677 | 32 | SB | Sequence | A0206 |
| 119 | YQSFEQVV | 0.677 | 33 | SB | Sequence | A0206 |
| 138 | RIVAFFSF | 0.653 | 42 | SB | Sequence | A0206 |
| 164 | RIAAWMAT | 0.575 | 99 | WB | Sequence | A0206 |
| 147 | GALCVESV | 0.568 | 106 | WB | Sequence | A0206 |
| 166 | AAWMATYL | 0.567 | 108 | WB | Sequence | A0206 |
| 217 | MTVAGVVL | 0.563 | 112 | WB | Sequence | A0206 |
| 160 | VLVSRIAA | 0.517 | 185 | WB | Sequence | A0206 |
| 42 | SEMETPSA | 0.514 | 191 | WB | Sequence | A0206 |
| 78 | EVIPMAAV | 0.496 | 233 | WB | Sequence | A0206 |
| 153 | SVDKEMQV | 0.493 | 240 | WB | Sequence | A0206 |
| 57 | HLADSPAV | 0.955 | 1 | SB | Sequence | A0211 |
| 153 | SVDKEMQV | 0.898 | 3 | SB | Sequence | A0211 |
| 213 | FLTGMTVA | 0.893 | 3 | SB | Sequence | A0211 |
| 73 | SLDAREVI | 0.877 | 3 | SB | Sequence | A0211 |
| 192 | ELYGNNAA | 0.834 | 6 | SB | Sequence | A0211 |

| | | | | | | |
|---|---|---|---|---|---|---|
| 218 | TVAGVVLL | 0.797 | 8 | SB | Sequence | A0211 |
| 172 | YLNDHLEP | 0.751 | 14 | SB | Sequence | A0211 |
| 78 | EVIPMAAV | 0.739 | 16 | SB | Sequence | A0211 |
| 216 | GMTVAGVV | 0.718 | 21 | SB | Sequence | A0211 |
| 160 | VLVSRIAA | 0.684 | 30 | SB | Sequence | A0211 |
| 223 | VLLGSLFS | 0.683 | 30 | SB | Sequence | A0211 |
| 133 | GVNWGRIV | 0.668 | 36 | SB | Sequence | A0211 |
| 212 | WFLTGMTV | 0.668 | 36 | SB | Sequence | A0211 |
| 144 | SFGGALCV | 0.591 | 83 | WB | Sequence | A0211 |
| 72 | SSLDAREV | 0.590 | 84 | WB | Sequence | A0211 |
| 106 | DLTSQLHI | 0.564 | 111 | WB | Sequence | A0211 |
| 119 | YQSFEQVV | 0.545 | 136 | WB | Sequence | A0211 |
| 81 | PMAAVKQA | 0.532 | 158 | WB | Sequence | A0211 |
| 11 | FLSYKLSQ | 0.511 | 198 | WB | Sequence | A0211 |
| 166 | AAWMATYL | 0.456 | 360 | WB | Sequence | A0211 |
| 1 | SQSNRELV | 0.439 | 431 | WB | Sequence | A0211 |
| 147 | GALCVESV | 0.439 | 434 | WB | Sequence | A0211 |
| | | | | | | |
| 57 | HLADSPAV | 0.915 | 2 | SB | Sequence | A0212 |
| 192 | ELYGNNAA | 0.813 | 7 | SB | Sequence | A0212 |
| 213 | FLTGMTVA | 0.801 | 8 | SB | Sequence | A0212 |
| 153 | SVDKEMQV | 0.732 | 18 | SB | Sequence | A0212 |
| 73 | SLDAREVI | 0.714 | 22 | SB | Sequence | A0212 |
| 160 | VLVSRIAA | 0.662 | 38 | SB | Sequence | A0212 |
| 172 | YLNDHLEP | 0.662 | 38 | SB | Sequence | A0212 |
| 119 | YQSFEQVV | 0.586 | 88 | WB | Sequence | A0212 |
| 78 | EVIPMAAV | 0.585 | 88 | WB | Sequence | A0212 |
| 223 | VLLGSLFS | 0.582 | 92 | WB | Sequence | A0212 |
| 11 | FLSYKLSQ | 0.573 | 101 | WB | Sequence | A0212 |
| 212 | WFLTGMTV | 0.541 | 142 | WB | Sequence | A0212 |
| 216 | GMTVAGVV | 0.466 | 321 | WB | Sequence | A0212 |
| | | | | | | |
| 57 | HLADSPAV | 0.892 | 3 | SB | Sequence | A0216 |
| 153 | SVDKEMQV | 0.817 | 7 | SB | Sequence | A0216 |
| 213 | FLTGMTVA | 0.761 | 13 | SB | Sequence | A0216 |
| 192 | ELYGNNAA | 0.715 | 21 | SB | Sequence | A0216 |
| 78 | EVIPMAAV | 0.666 | 37 | SB | Sequence | A0216 |
| 218 | TVAGVVLL | 0.657 | 41 | SB | Sequence | A0216 |
| 73 | SLDAREVI | 0.640 | 49 | SB | Sequence | A0216 |
| 144 | SFGGALCV | 0.630 | 54 | WB | Sequence | A0216 |
| 216 | GMTVAGVV | 0.613 | 65 | WB | Sequence | A0216 |
| 166 | AAWMATYL | 0.603 | 73 | WB | Sequence | A0216 |
| 160 | VLVSRIAA | 0.583 | 91 | WB | Sequence | A0216 |
| 212 | WFLTGMTV | 0.565 | 110 | WB | Sequence | A0216 |
| 11 | FLSYKLSQ | 0.488 | 255 | WB | Sequence | A0216 |
| 106 | DLTSQLHI | 0.487 | 256 | WB | Sequence | A0216 |
| 133 | GVNWGRIV | 0.470 | 308 | WB | Sequence | A0216 |
| 81 | PMAAVKQA | 0.469 | 311 | WB | Sequence | A0216 |
| 118 | AYQSFEQV | 0.461 | 342 | WB | Sequence | A0216 |
| 223 | VLLGSLFS | 0.442 | 417 | WB | Sequence | A0216 |
| 147 | GALCVESV | 0.438 | 436 | WB | Sequence | A0216 |
| | | | | | | |
| 57 | HLADSPAV | 0.924 | 2 | SB | Sequence | A0219 |
| 213 | FLTGMTVA | 0.668 | 36 | SB | Sequence | A0219 |
| 153 | SVDKEMQV | 0.597 | 78 | WB | Sequence | A0219 |
| 73 | SLDAREVI | 0.576 | 98 | WB | Sequence | A0219 |
| 218 | TVAGVVLL | 0.517 | 185 | WB | Sequence | A0219 |
| 192 | ELYGNNAA | 0.486 | 259 | WB | Sequence | A0219 |
| 212 | WFLTGMTV | 0.458 | 352 | WB | Sequence | A0219 |
| 166 | AAWMATYL | 0.455 | 362 | WB | Sequence | A0219 |
| 106 | DLTSQLHI | 0.448 | 390 | WB | Sequence | A0219 |
| 223 | VLLGSLFS | 0.431 | 471 | WB | Sequence | A0219 |
| | | | | | | |
| 12 | LSYKLSQK | 0.761 | 13 | SB | Sequence | A0301 |
| 8 | VVDFLSYK | 0.551 | 128 | WB | Sequence | A0301 |
| 224 | LLGSLFSR | 0.487 | 257 | WB | Sequence | A0301 |

Fig. 36 continued

| | | | | | | |
|---|---|---|---|---|---|---|
| 8 | VVDFLSYK | 0.751 | 14 | SB | Sequence | A1101 |
| 12 | LSYKLSQK | 0.721 | 20 | SB | Sequence | A1101 |
| 79 | VIPMAAVK | 0.509 | 203 | WB | Sequence | A1101 |
| 124 | QVVNELFR | 0.472 | 302 | WB | Sequence | A1101 |
| 7 | LVVDFLSY | 0.457 | 355 | WB | Sequence | A1101 |
| 197 | NAAAESRK | 0.455 | 363 | WB | Sequence | A1101 |
| 135 | NWGRIVAF | 0.600 | 75 | WB | Sequence | A2301 |
| 138 | RIVAFFSF | 0.466 | 321 | WB | Sequence | A2301 |
| 222 | VVLLGSLF | 0.461 | 339 | WB | Sequence | A2301 |
| 135 | NWGRIVAF | 0.617 | 62 | WB | Sequence | A2402 |
| 118 | AYQSFEQV | 0.569 | 105 | WB | Sequence | A2403 |
| 78 | EVIPMAAV | 0.598 | 77 | WB | Sequence | A2601 |
| 7 | LVVDFLSY | 0.541 | 144 | WB | Sequence | A2601 |
| 78 | EVIPMAAV | 0.862 | 4 | SB | Sequence | A2602 |
| 7 | LVVDFLSY | 0.797 | 9 | SB | Sequence | A2602 |
| 112 | HITPGTAY | 0.755 | 14 | SB | Sequence | A2602 |
| 97 | ELRYRRAF | 0.589 | 85 | WB | Sequence | A2602 |
| 138 | RIVAFFSF | 0.529 | 164 | WB | Sequence | A2602 |
| 112 | HITPGTAY | 0.597 | 78 | WB | Sequence | A2902 |
| 7 | LVVDFLSY | 0.480 | 276 | WB | Sequence | A2902 |
| 204 | KGQERFNR | 0.743 | 16 | SB | Sequence | A3101 |
| 224 | LLGSLFSR | 0.697 | 26 | SB | Sequence | A3101 |
| 157 | EMQVLVSR | 0.583 | 90 | WB | Sequence | A3101 |
| 70 | HSSSLDAR | 0.577 | 97 | WB | Sequence | A3101 |
| 83 | AAVKQALR | 0.539 | 146 | WB | Sequence | A3101 |
| 95 | EFELRYRR | 0.509 | 201 | WB | Sequence | A3101 |
| 124 | QVVNELFR | 0.453 | 369 | WB | Sequence | A3101 |
| 12 | LSYKLSQK | 0.447 | 397 | WB | Sequence | A3101 |
| 95 | EFELRYRR | 0.823 | 6 | SB | Sequence | A3301 |
| 157 | EMQVLVSR | 0.738 | 16 | SB | Sequence | A3301 |
| 94 | DEFELRYR | 0.650 | 43 | SB | Sequence | A3301 |
| 201 | ESRKGQER | 0.606 | 71 | WB | Sequence | A3301 |
| 224 | LLGSLFSR | 0.538 | 148 | WB | Sequence | A3301 |
| 70 | HSSSLDAR | 0.463 | 332 | WB | Sequence | A3301 |
| 124 | QVVNELFR | 0.803 | 8 | SB | Sequence | A6801 |
| 70 | HSSSLDAR | 0.775 | 11 | SB | Sequence | A6801 |
| 197 | NAAAESRK | 0.681 | 31 | SB | Sequence | A6801 |
| 12 | LSYKLSQK | 0.647 | 45 | SB | Sequence | A6801 |
| 157 | EMQVLVSR | 0.599 | 76 | WB | Sequence | A6801 |
| 196 | NNAAAESR | 0.585 | 88 | WB | Sequence | A6801 |
| 83 | AAVKQALR | 0.535 | 153 | WB | Sequence | A6801 |
| 201 | ESRKGQER | 0.532 | 158 | WB | Sequence | A6801 |
| 165 | IAAWMATY | 0.532 | 158 | WB | Sequence | A6801 |
| 95 | EFELRYRR | 0.511 | 198 | WB | Sequence | A6801 |
| 117 | TAYQSFEQ | 0.507 | 208 | WB | Sequence | A6801 |
| 8 | VVDFLSYK | 0.481 | 273 | WB | Sequence | A6801 |
| 94 | DEFELRYR | 0.457 | 357 | WB | Sequence | A6801 |
| 26 | FSDVEENR | 0.442 | 418 | WB | Sequence | A6801 |
| 224 | LLGSLFSR | 0.430 | 476 | WB | Sequence | A6801 |
| 78 | EVIPMAAV | 0.888 | 3 | SB | Sequence | A6802 |
| 218 | TVAGVVLL | 0.790 | 9 | SB | Sequence | A6802 |
| 215 | TGMTVAGV | 0.742 | 16 | SB | Sequence | A6802 |
| 217 | MTVAGVVL | 0.697 | 26 | SB | Sequence | A6802 |
| 82 | MAAVKQAL | 0.633 | 52 | WB | Sequence | A6802 |
| 57 | HLADSPAV | 0.549 | 131 | WB | Sequence | A6802 |
| 207 | ERFNRWFL | 0.481 | 273 | WB | Sequence | A6802 |
| 60 | DSPAVNGA | 0.473 | 300 | WB | Sequence | A6802 |

Fig. 36 continued

| | | | | | | |
|---|---|---|---|---|---|---|
| 192 | ELYGNNAA | 0.447 | 395 | WB | Sequence | A6802 |
| 91 | EAGDEFEL | 0.436 | 444 | WB | Sequence | A6802 |
| 78 | EVIPMAAV | 0.812 | 7 | SB | Sequence | A6901 |
| 57 | HLADSPAV | 0.740 | 16 | SB | Sequence | A6901 |
| 192 | ELYGNNAA | 0.570 | 104 | WB | Sequence | A6901 |
| 217 | MTVAGVVL | 0.544 | 138 | WB | Sequence | A6901 |
| 218 | TVAGVVLL | 0.507 | 206 | WB | Sequence | A6901 |
| 91 | EAGDEFEL | 0.489 | 252 | WB | Sequence | A6901 |
| 153 | SVDKEMQV | 0.437 | 441 | WB | Sequence | A6901 |
| 212 | WFLTGMTV | 0.436 | 445 | WB | Sequence | A6901 |
| 61 | SPAVNGAT | 0.657 | 41 | SB | Sequence | B0702 |
| 82 | MAAVKQAL | 0.468 | 316 | WB | Sequence | B0702 |
| 166 | AAWMATYL | 0.430 | 477 | WB | Sequence | B0702 |
| 97 | ELRYRRAF | 0.589 | 85 | WB | Sequence | B0801 |
| 7 | LVVDFLSY | 0.511 | 198 | WB | Sequence | B1501 |
| 138 | RIVAFFSF | 0.493 | 240 | WB | Sequence | B1501 |
| 112 | HITPGTAY | 0.492 | 243 | WB | Sequence | B1501 |
| 165 | IAAWMATY | 0.473 | 300 | WB | Sequence | B1501 |
| 97 | ELRYRRAF | 0.439 | 430 | WB | Sequence | B1501 |
| 222 | VVLLGSLF | 0.433 | 461 | WB | Sequence | B1501 |
| 206 | QERFNRWF | 0.528 | 165 | WB | Sequence | B1801 |
| 5 | RELVVDFL | 0.517 | 185 | WB | Sequence | B1801 |
| 122 | FEQVVNEL | 0.508 | 205 | WB | Sequence | B1801 |
| 210 | NRWFLTGM | 0.510 | 200 | WB | Sequence | B2705 |
| 165 | IAAWMATY | 0.806 | 8 | SB | Sequence | B3501 |
| 7 | LVVDFLSY | 0.629 | 55 | WB | Sequence | B3501 |
| 82 | MAAVKQAL | 0.591 | 83 | WB | Sequence | B3501 |
| 112 | HITPGTAY | 0.543 | 140 | WB | Sequence | B3501 |
| 75 | DAREVIPM | 0.516 | 187 | WB | Sequence | B3501 |
| 142 | FFSFGGAL | 0.499 | 226 | WB | Sequence | B3501 |
| 61 | SPAVNGAT | 0.478 | 283 | WB | Sequence | B3501 |
| 166 | AAWMATYL | 0.476 | 289 | WB | Sequence | B3501 |
| 217 | MTVAGVVL | 0.470 | 307 | WB | Sequence | B3501 |
| 5 | RELVVDFL | 0.624 | 58 | WB | Sequence | B4001 |
| 122 | FEQVVNEL | 0.618 | 62 | WB | Sequence | B4001 |
| 5 | RELVVDFL | 0.442 | 420 | WB | Sequence | B4002 |
| 156 | KEMQVLVS | 0.430 | 478 | WB | Sequence | B4403 |
| 77 | REVIPMAA | 0.434 | 456 | WB | Sequence | B4501 |
| 161 | LVSRIAAW | 0.626 | 57 | WB | Sequence | B5801 |
| 165 | IAAWMATY | 0.593 | 81 | WB | Sequence | B5801 |
| 16 | LSQKGYSW | 0.586 | 88 | WB | Sequence | B5801 |
| 19 | KGYSWSQF | 0.543 | 141 | WB | Sequence | B5801 |
| 138 | RIVAFFSF | 0.467 | 320 | WB | Sequence | B5801 |
| 49 | AINGNPSW | 0.447 | 394 | WB | Sequence | B5801 |
| | 9.mers | | | | | |
| 104 | FSDLTSQLH | 0.482 | 270 | WB | Sequence | A0101 |
| 143 | FSFGGALCV | 0.518 | 183 | WB | Sequence | A0201 |
| 217 | MTVAGVVLL | 0.478 | 282 | WB | Sequence | A0201 |
| 172 | YLNDHLEPW | 0.739 | 16 | SB | Sequence | A0202 |
| 217 | MTVAGVVLL | 0.604 | 72 | WB | Sequence | A0202 |
| 165 | IAAWMATYL | 0.568 | 107 | WB | Sequence | A0202 |

Fig. 36 continued

| | | | | | | |
|---|---|---|---|---|---|---|
| 213 | FLTGMTVAG | 0.564 | 111 | WB | Sequence | A0202 |
| 11 | FLSYKLSQK | 0.520 | 179 | WB | Sequence | A0202 |
| 161 | LVSRIAAWM | 0.450 | 362 | WB | Sequence | A0202 |
| 8 | VVDFLSYKL | 0.449 | 387 | WB | Sequence | A0202 |
| 192 | ELYGNNAAA | 0.447 | 394 | WB | Sequence | A0202 |
| 81 | PMAAVKQAL | 0.437 | 441 | WB | Sequence | A0202 |
| 216 | GMTVAGVVL | 0.436 | 448 | WB | Sequence | A0202 |
| | | | | | | |
| 214 | LTGMTVAGV | 0.691 | 28 | SB | Sequence | A0203 |
| 217 | MTVAGVVLL | 0.609 | 69 | WB | Sequence | A0203 |
| 165 | IAAWMATYL | 0.530 | 161 | WB | Sequence | A0203 |
| 84 | AVKQALREA | 0.518 | 183 | WB | Sequence | A0203 |
| 110 | QLHITPGTA | 0.507 | 206 | WB | Sequence | A0203 |
| 172 | YLNDHLEPW | 0.493 | 240 | WB | Sequence | A0203 |
| 117 | TAYQSFEQV | 0.473 | 300 | WB | Sequence | A0203 |
| 11 | FLSYKLSQK | 0.447 | 396 | WB | Sequence | A0203 |
| | | | | | | |
| 214 | LTGMTVAGV | 0.504 | 213 | WB | Sequence | A0204 |
| 217 | MTVAGVVLL | 0.475 | 291 | WB | Sequence | A0204 |
| | | | | | | |
| 109 | SQLHITPGT | 0.712 | 22 | SB | Sequence | A0206 |
| 217 | MTVAGVVLL | 0.675 | 33 | SB | Sequence | A0206 |
| 117 | TAYQSFEQV | 0.650 | 43 | SB | Sequence | A0206 |
| 1 | SQSNRELVV | 0.648 | 45 | SB | Sequence | A0206 |
| 143 | FSFGGALCV | 0.584 | 90 | WB | Sequence | A0206 |
| 77 | REVIPMAAV | 0.572 | 103 | WB | Sequence | A0206 |
| 165 | IAAWMATYL | 0.551 | 128 | WB | Sequence | A0206 |
| 158 | MQVLVSRIA | 0.544 | 138 | WB | Sequence | A0206 |
| 214 | LTGMTVAGV | 0.492 | 244 | WB | Sequence | A0206 |
| 172 | YLNDHLEPW | 0.464 | 331 | WB | Sequence | A0206 |
| 42 | SEMETPSAI | 0.440 | 426 | WB | Sequence | A0206 |
| | | | | | | |
| 192 | ELYGNNAAA | 0.863 | 4 | SB | Sequence | A0211 |
| 143 | FSFGGALCV | 0.797 | 8 | SB | Sequence | A0211 |
| 81 | PMAAVKQAL | 0.794 | 9 | SB | Sequence | A0211 |
| 172 | YLNDHLEPW | 0.715 | 21 | SB | Sequence | A0211 |
| 153 | SVDKEMQVL | 0.703 | 24 | SB | Sequence | A0211 |
| 8 | VVDFLSYKL | 0.696 | 26 | SB | Sequence | A0211 |
| 217 | MTVAGVVLL | 0.634 | 52 | WB | Sequence | A0211 |
| 112 | HITPGTAYQ | 0.618 | 62 | WB | Sequence | A0211 |
| 117 | TAYQSFEQV | 0.617 | 63 | WB | Sequence | A0211 |
| 223 | VLLGSLFSR | 0.581 | 93 | WB | Sequence | A0211 |
| 213 | FLTGMTVAG | 0.581 | 93 | WB | Sequence | A0211 |
| 133 | GVNWGRIVA | 0.575 | 99 | WB | Sequence | A0211 |
| 216 | GMTVAGVVL | 0.553 | 126 | WB | Sequence | A0211 |
| 185 | GGWDTFVEL | 0.550 | 130 | WB | Sequence | A0211 |
| 103 | AFSDLTSQL | 0.472 | 302 | WB | Sequence | A0211 |
| 176 | HLEPWIQEN | 0.427 | 493 | WB | Sequence | A0211 |
| | | | | | | |
| 192 | ELYGNNAAA | 0.845 | 5 | SB | Sequence | A0212 |
| 81 | PMAAVKQAL | 0.789 | 9 | SB | Sequence | A0212 |
| 143 | FSFGGALCV | 0.702 | 25 | SB | Sequence | A0212 |
| 172 | YLNDHLEPW | 0.673 | 34 | SB | Sequence | A0212 |
| 223 | VLLGSLFSR | 0.573 | 101 | WB | Sequence | A0212 |
| 8 | VVDFLSYKL | 0.561 | 115 | WB | Sequence | A0212 |
| 153 | SVDKEMQVL | 0.535 | 153 | WB | Sequence | A0212 |
| 213 | FLTGMTVAG | 0.521 | 178 | WB | Sequence | A0212 |
| 118 | AYQSFEQVV | 0.476 | 290 | WB | Sequence | A0212 |
| | | | | | | |
| 192 | ELYGNNAAA | 0.741 | 16 | SB | Sequence | A0216 |
| 81 | PMAAVKQAL | 0.710 | 22 | SB | Sequence | A0216 |
| 143 | FSFGGALCV | 0.652 | 42 | SB | Sequence | A0216 |
| 117 | TAYQSFEQV | 0.593 | 81 | WB | Sequence | A0216 |
| 112 | HITPGTAYQ | 0.512 | 196 | WB | Sequence | A0216 |
| 216 | GMTVAGVVL | 0.430 | 479 | WB | Sequence | A0216 |
| | | | | | | |
| 81 | PMAAVKQAL | 0.675 | 33 | SB | Sequence | A0219 |

Fig. 36 continued

| | | | | | | |
|---|---|---|---|---|---|---|
| 143 | FSFGGALCV | 0.652 | 43 | SB | Sequence | A0219 |
| 192 | ELYGNNAAA | 0.541 | 142 | WB | Sequence | A0219 |
| 117 | TAYQSFEQV | 0.497 | 232 | WB | Sequence | A0219 |
| 172 | YLNDHLEPW | 0.459 | 348 | WB | Sequence | A0219 |
| 223 | VLLGSLFSR | 0.456 | 361 | WB | Sequence | A0219 |
| 214 | LTGMTVAGV | 0.450 | 384 | WB | Sequence | A0219 |
| 224 | LLGSLFSRK | 0.762 | 13 | SB | Sequence | A0301 |
| 11 | FLSYKLSQK | 0.710 | 23 | SB | Sequence | A0301 |
| 164 | RIAAWMATY | 0.698 | 26 | SB | Sequence | A0301 |
| 223 | VLLGSLFSR | 0.615 | 64 | WB | Sequence | A0301 |
| 7 | LVVDFLSYK | 0.497 | 231 | WB | Sequence | A0301 |
| 7 | LVVDFLSYK | 0.767 | 12 | SB | Sequence | A1101 |
| 224 | LLGSLFSRK | 0.612 | 66 | WB | Sequence | A1101 |
| 223 | VLLGSLFSR | 0.595 | 79 | WB | Sequence | A1101 |
| 164 | RIAAWMATY | 0.575 | 99 | WB | Sequence | A1101 |
| 148 | ALCVESVDK | 0.529 | 163 | WB | Sequence | A1101 |
| 78 | EVIPMAAVK | 0.509 | 201 | WB | Sequence | A1101 |
| 11 | FLSYKLSQK | 0.430 | 477 | WB | Sequence | A1101 |
| 99 | RYRRAFSDL | 0.690 | 28 | SB | Sequence | A2301 |
| 135 | NWGRIVAFF | 0.644 | 47 | SB | Sequence | A2301 |
| 137 | GRIVAFFSF | 0.459 | 346 | WB | Sequence | A2301 |
| 135 | NWGRIVAFF | 0.739 | 16 | SB | Sequence | A2402 |
| 99 | RYRRAFSDL | 0.550 | 129 | WB | Sequence | A2402 |
| 99 | RYRRAFSDL | 0.748 | 15 | SB | Sequence | A2403 |
| 121 | SFEQVVNEL | 0.557 | 120 | WB | Sequence | A2403 |
| 118 | AYQSFEQVV | 0.487 | 256 | WB | Sequence | A2403 |
| 6 | ELVVDFLSY | 0.532 | 158 | WB | Sequence | A2601 |
| 164 | RIAAWMATY | 0.495 | 235 | WB | Sequence | A2601 |
| 164 | RIAAWMATY | 0.923 | 2 | SB | Sequence | A2602 |
| 6 | ELVVDFLSY | 0.873 | 3 | SB | Sequence | A2602 |
| 161 | LVSRIAAWM | 0.677 | 32 | SB | Sequence | A2602 |
| 153 | SVDKEMQVL | 0.639 | 49 | SB | Sequence | A2602 |
| 78 | EVIPMAAVK | 0.496 | 234 | WB | Sequence | A2602 |
| 217 | MTVAGVVLL | 0.481 | 273 | WB | Sequence | A2602 |
| 111 | LHITPGTAY | 0.553 | 125 | WB | Sequence | A2902 |
| 6 | ELVVDFLSY | 0.539 | 146 | WB | Sequence | A2902 |
| 164 | RIAAWMATY | 0.463 | 334 | WB | Sequence | A3002 |
| 82 | MAAVKQALR | 0.766 | 12 | SB | Sequence | A3101 |
| 223 | VLLGSLFSR | 0.686 | 30 | SB | Sequence | A3101 |
| 7 | LVVDFLSYK | 0.573 | 101 | WB | Sequence | A3101 |
| 156 | KEMQVLVSR | 0.474 | 296 | WB | Sequence | A3101 |
| 94 | DEFELRYRR | 0.721 | 20 | SB | Sequence | A3301 |
| 82 | MAAVKQALR | 0.665 | 37 | SB | Sequence | A3301 |
| 97 | ELRYRRAFS | 0.614 | 65 | WB | Sequence | A3301 |
| 223 | VLLGSLFSR | 0.581 | 92 | WB | Sequence | A3301 |
| 91 | EAGDEFELR | 0.532 | 157 | WB | Sequence | A3301 |
| 25 | QFSDVEENR | 0.531 | 159 | WB | Sequence | A3301 |
| 78 | EVIPMAAVK | 0.848 | 5 | SB | Sequence | A6801 |
| 82 | MAAVKQALR | 0.813 | 7 | SB | Sequence | A6801 |
| 7 | LVVDFLSYK | 0.786 | 10 | SB | Sequence | A6801 |
| 91 | EAGDEFELR | 0.710 | 23 | SB | Sequence | A6801 |
| 123 | EQVVNELFR | 0.635 | 51 | WB | Sequence | A6801 |
| 11 | FLSYKLSQK | 0.558 | 119 | WB | Sequence | A6801 |
| 94 | DEFELRYRR | 0.544 | 139 | WB | Sequence | A6801 |
| 25 | QFSDVEENR | 0.540 | 145 | WB | Sequence | A6801 |

Fig. 36 continued

| | | | | | | |
|---|---|---|---|---|---|---|
| 196 | NNAAAESRK | 0.474 | 295 | WB | Sequence | A6801 |
| 223 | VLLGSLFSR | 0.430 | 477 | WB | Sequence | A6801 |
| 217 | MTVAGVVLL | 0.796 | 9 | SB | Sequence | A6802 |
| 117 | TAYQSFEQV | 0.729 | 18 | SB | Sequence | A6802 |
| 215 | TGMTVAGVV | 0.654 | 42 | SB | Sequence | A6802 |
| 0 | MSQSNRELV | 0.587 | 86 | WB | Sequence | A6802 |
| 21 | YSWSQFSDV | 0.549 | 131 | WB | Sequence | A6802 |
| 143 | FSFGGALCV | 0.526 | 169 | WB | Sequence | A6802 |
| 152 | ESVDKEMQV | 0.525 | 171 | WB | Sequence | A6802 |
| 169 | MATYLNDHL | 0.520 | 180 | WB | Sequence | A6802 |
| 192 | ELYGNNAAA | 0.509 | 202 | WB | Sequence | A6802 |
| 140 | VAFFSFGGA | 0.500 | 222 | WB | Sequence | A6802 |
| 214 | LTGMTVAGV | 0.464 | 330 | WB | Sequence | A6802 |
| 165 | IAAWMATYL | 0.451 | 376 | WB | Sequence | A6802 |
| 217 | MTVAGVVLL | 0.705 | 24 | SB | Sequence | A6901 |
| 117 | TAYQSFEQV | 0.623 | 58 | WB | Sequence | A6901 |
| 192 | ELYGNNAAA | 0.604 | 72 | WB | Sequence | A6901 |
| 143 | FSFGGALCV | 0.589 | 85 | WB | Sequence | A6901 |
| 214 | LTGMTVAGV | 0.557 | 120 | WB | Sequence | A6901 |
| 21 | YSWSQFSDV | 0.489 | 252 | WB | Sequence | A6901 |
| 36 | APEGTESEM | 0.519 | 181 | WB | Sequence | B0702 |
| 61 | SPAVNGATG | 0.454 | 369 | WB | Sequence | B0702 |
| 114 | TPGTAYQSF | 0.450 | 382 | WB | Sequence | B0702 |
| 96 | FELRYRRAF | 0.497 | 229 | WB | Sequence | B0801 |
| 164 | RIAAWMATY | 0.586 | 87 | WB | Sequence | B1501 |
| 88 | ALREAGDEF | 0.520 | 180 | WB | Sequence | B1501 |
| 96 | FELRYRRAF | 0.752 | 14 | SB | Sequence | B1801 |
| 206 | QERFNRWFL | 0.592 | 82 | WB | Sequence | B1801 |
| 122 | FEQVVNELF | 0.523 | 174 | WB | Sequence | B1801 |
| 162 | QENGGWDTF | 0.476 | 290 | WB | Sequence | B1801 |
| 137 | GRIVAFFSF | 0.554 | 124 | WB | Sequence | B2705 |
| 101 | RRAFSDLTS | 0.434 | 459 | WB | Sequence | B2705 |
| 114 | TPGTAYQSF | 0.705 | 24 | SB | Sequence | B3501 |
| 165 | IAAWMATYL | 0.649 | 44 | SB | Sequence | B3501 |
| 36 | APEGTESEM | 0.540 | 144 | WB | Sequence | B3501 |
| 6 | ELVVDFLSY | 0.531 | 159 | WB | Sequence | B3501 |
| 111 | LHITPGTAY | 0.437 | 441 | WB | Sequence | B3501 |
| 53 | NPSWHLADS | 0.429 | 480 | WB | Sequence | B3501 |
| 164 | RIAAWMATY | 0.428 | 485 | WB | Sequence | B3501 |
| 90 | REAGDEFEL | 0.788 | 9 | SB | Sequence | B4001 |
| 206 | QERFNRWFL | 0.597 | 78 | WB | Sequence | B4001 |
| 162 | QENGGWDTF | 0.525 | 170 | WB | Sequence | B4001 |
| 122 | FEQVVNELF | 0.453 | 370 | WB | Sequence | B4001 |
| 96 | FELRYRRAF | 0.446 | 399 | WB | Sequence | B4001 |
| 42 | SEMETPSAI | 0.504 | 215 | WB | Sequence | B4002 |
| 96 | FELRYRRAF | 0.473 | 299 | WB | Sequence | B4002 |
| 182 | QENGGWDTF | 0.434 | 455 | WB | Sequence | B4402 |
| 42 | SEMETPSAI | 0.467 | 319 | WB | Sequence | B4403 |
| 5 | RELVVDFLS | 0.444 | 407 | WB | Sequence | B4403 |
| 77 | REVIPMAAV | 0.438 | 438 | WB | Sequence | B4501 |
| 165 | IAAWMATYL | 0.442 | 416 | WB | Sequence | B5301 |
| 80 | IPMAAVKQA | 0.716 | 21 | SB | Sequence | B5401 |

Fig. 36 continued

| | | | | | | |
|---|---|---|---|---|---|---|
| 48 | SAINGNPSW | 0.641 | 48 | SB | Sequence | B5801 |
| 15 | KLSQKGYSW | 0.596 | 79 | WB | Sequence | B5801 |
| 165 | IAAWMATYL | 0.559 | 118 | WB | Sequence | B5801 |
| 172 | YLNDHLEPW | 0.506 | 208 | WB | Sequence | B5801 |
| 10-mers | | | | | | |
| 104 | FSDLTSQLHI | 0.427 | 492 | WB | Sequence | A0101 |
| 172 | YLNDHLEPWI | 0.866 | 4 | SB | Sequence | A0201 |
| 213 | FLTGMTVAGV | 0.841 | 5 | SB | Sequence | A0201 |
| 164 | RIAAWMATYL | 0.651 | 43 | SB | Sequence | A0201 |
| 168 | WMATYLNDHL | 0.573 | 101 | WB | Sequence | A0201 |
| 7 | LVVDFLSYKL | 0.524 | 173 | WB | Sequence | A0201 |
| 73 | SLDAREVIPM | 0.491 | 246 | WB | Sequence | A0201 |
| 160 | VLVSRIAAWM | 0.486 | 259 | WB | Sequence | A0201 |
| 153 | SVDKEMQVLV | 0.473 | 298 | WB | Sequence | A0201 |
| 216 | GMTVAGVVLL | 0.444 | 411 | WB | Sequence | A0201 |
| 213 | FLTGMTVAGV | 0.811 | 7 | SB | Sequence | A0202 |
| 168 | WMATYLNDHL | 0.772 | 11 | SB | Sequence | A0202 |
| 164 | RIAAWMATYL | 0.763 | 13 | SB | Sequence | A0202 |
| 7 | LVVDFLSYKL | 0.651 | 43 | SB | Sequence | A0202 |
| 102 | RAFSDLTSQL | 0.617 | 63 | WB | Sequence | A0202 |
| 73 | SLDAREVIPM | 0.616 | 63 | WB | Sequence | A0202 |
| 172 | YLNDHLEPWI | 0.587 | 87 | WB | Sequence | A0202 |
| 216 | GMTVAGVVLL | 0.496 | 233 | WB | Sequence | A0202 |
| 145 | FGGALCVESV | 0.480 | 276 | WB | Sequence | A0202 |
| 160 | VLVSRIAAWM | 0.430 | 476 | WB | Sequence | A0202 |
| 213 | FLTGMTVAGV | 0.936 | 2 | SB | Sequence | A0203 |
| 172 | YLNDHLEPWI | 0.891 | 3 | SB | Sequence | A0203 |
| 164 | RIAAWMATYL | 0.837 | 5 | SB | Sequence | A0203 |
| 168 | WMATYLNDHL | 0.647 | 45 | SB | Sequence | A0203 |
| 160 | VLVSRIAAWM | 0.613 | 66 | WB | Sequence | A0203 |
| 139 | IVAFFSFGGA | 0.596 | 79 | WB | Sequence | A0203 |
| 7 | LVVDFLSYKL | 0.581 | 92 | WB | Sequence | A0203 |
| 125 | VVNELFRDGV | 0.570 | 105 | WB | Sequence | A0203 |
| 216 | GMTVAGVVLL | 0.476 | 289 | WB | Sequence | A0203 |
| 102 | RAFSDLTSQL | 0.470 | 308 | WB | Sequence | A0203 |
| 214 | LTGMTVAGVV | 0.468 | 315 | WB | Sequence | A0203 |
| 116 | GTAYQSFEQV | 0.463 | 335 | WB | Sequence | A0203 |
| 213 | FLTGMTVAGV | 0.697 | 26 | SB | Sequence | A0204 |
| 172 | YLNDHLEPWI | 0.664 | 37 | SB | Sequence | A0204 |
| 73 | SLDAREVIPM | 0.477 | 287 | WB | Sequence | A0204 |
| 164 | RIAAWMATYL | 0.476 | 290 | WB | Sequence | A0204 |
| 7 | LVVDFLSYKL | 0.468 | 317 | WB | Sequence | A0204 |
| 49 | AINGNPSWHL | 0.452 | 374 | WB | Sequence | A0204 |
| 213 | FLTGMTVAGV | 0.869 | 4 | SB | Sequence | A0206 |
| 164 | RIAAWMATYL | 0.809 | 7 | SB | Sequence | A0206 |
| 172 | YLNDHLEPWI | 0.722 | 20 | SB | Sequence | A0206 |
| 158 | MQVLVSRIAA | 0.689 | 28 | SB | Sequence | A0206 |
| 7 | LVVDFLSYKL | 0.684 | 30 | SB | Sequence | A0206 |
| 168 | WMATYLNDHL | 0.680 | 31 | SB | Sequence | A0206 |
| 109 | SQLHITPGTA | 0.652 | 43 | SB | Sequence | A0206 |
| 116 | GTAYQSFEQV | 0.572 | 102 | WB | Sequence | A0206 |
| 153 | SVDKEMQVLV | 0.558 | 119 | WB | Sequence | A0206 |
| 102 | RAFSDLTSQL | 0.543 | 140 | WB | Sequence | A0206 |
| 156 | KEMQVLVSRI | 0.508 | 204 | WB | Sequence | A0206 |
| 181 | IQENGGWDTF | 0.508 | 205 | WB | Sequence | A0206 |
| 139 | IVAFFSFGGA | 0.495 | 235 | WB | Sequence | A0206 |
| 125 | VVNELFRDGV | 0.483 | 269 | WB | Sequence | A0206 |
| 117 | TAYQSFEQVV | 0.450 | 383 | WB | Sequence | A0206 |

Fig. 36 continued

| | | | | | |
|---|---|---|---|---|---|
| 213 | FLTGMTVAGV | 0.966 | 1 | SB | Sequence A0211 |
| 172 | YLNDHLEPWI | 0.951 | 1 | SB | Sequence A0211 |
| 153 | SVDKEMQVLV | 0.905 | 2 | SB | Sequence A0211 |
| 73 | SLDAREVIPM | 0.826 | 6 | SB | Sequence A0211 |
| 216 | GMTVAGVVLL | 0.737 | 17 | SB | Sequence A0211 |
| 7 | LVVDFLSYKL | 0.730 | 18 | SB | Sequence A0211 |
| 164 | RIAAWMATYL | 0.711 | 22 | SB | Sequence A0211 |
| 125 | VVNELFRDGV | 0.687 | 29 | SB | Sequence A0211 |
| 49 | AINGNPSWHL | 0.686 | 29 | SB | Sequence A0211 |
| 168 | WMATYLNDHL | 0.685 | 30 | SB | Sequence A0211 |
| 117 | TAYQSFEQVV | 0.633 | 52 | WB | Sequence A0211 |
| 160 | VLVSRIAAWM | 0.632 | 53 | WB | Sequence A0211 |
| 142 | FFSFGGALCV | 0.567 | 107 | WB | Sequence A0211 |
| 223 | VLLGSLFSRK | 0.498 | 228 | WB | Sequence A0211 |
| 102 | RAFSDLTSQL | 0.453 | 372 | WB | Sequence A0211 |
| 116 | GTAYQSFEQV | 0.429 | 481 | WB | Sequence A0211 |
| | | | | | |
| 213 | FLTGMTVAGV | 0.932 | 2 | SB | Sequence A0212 |
| 172 | YLNDHLEPWI | 0.916 | 2 | SB | Sequence A0212 |
| 153 | SVDKEMQVLV | 0.742 | 16 | SB | Sequence A0212 |
| 168 | WMATYLNDHL | 0.697 | 26 | SB | Sequence A0212 |
| 125 | VVNELFRDGV | 0.695 | 27 | SB | Sequence A0212 |
| 7 | LVVDFLSYKL | 0.648 | 45 | SB | Sequence A0212 |
| 160 | VLVSRIAAWM | 0.604 | 72 | WB | Sequence A0212 |
| 73 | SLDAREVIPM | 0.594 | 80 | WB | Sequence A0212 |
| 49 | AINGNPSWHL | 0.570 | 104 | WB | Sequence A0212 |
| 164 | RIAAWMATYL | 0.550 | 129 | WB | Sequence A0212 |
| 142 | FFSFGGALCV | 0.494 | 238 | WB | Sequence A0212 |
| 223 | VLLGSLFSRK | 0.487 | 258 | WB | Sequence A0212 |
| 117 | TAYQSFEQVV | 0.482 | 270 | WB | Sequence A0212 |
| 192 | ELYGNNAAAE | 0.475 | 293 | WB | Sequence A0212 |
| 216 | GMTVAGVVLL | 0.440 | 426 | WB | Sequence A0212 |
| | | | | | |
| 213 | FLTGMTVAGV | 0.911 | 2 | SB | Sequence A0216 |
| 172 | YLNDHLEPWI | 0.869 | 4 | SB | Sequence A0216 |
| 153 | SVDKEMQVLV | 0.772 | 11 | SB | Sequence A0216 |
| 168 | WMATYLNDHL | 0.696 | 26 | SB | Sequence A0216 |
| 164 | RIAAWMATYL | 0.695 | 27 | SB | Sequence A0216 |
| 49 | AINGNPSWHL | 0.680 | 31 | SB | Sequence A0216 |
| 160 | VLVSRIAAWM | 0.657 | 41 | SB | Sequence A0216 |
| 7 | LVVDFLSYKL | 0.643 | 47 | SB | Sequence A0216 |
| 73 | SLDAREVIPM | 0.617 | 62 | WB | Sequence A0216 |
| 216 | GMTVAGVVLL | 0.588 | 85 | WB | Sequence A0216 |
| 117 | TAYQSFEQVV | 0.530 | 161 | WB | Sequence A0216 |
| 142 | FFSFGGALCV | 0.487 | 256 | WB | Sequence A0216 |
| 116 | GTAYQSFEQV | 0.444 | 408 | WB | Sequence A0216 |
| | | | | | |
| 213 | FLTGMTVAGV | 0.927 | 2 | SB | Sequence A0219 |
| 172 | YLNDHLEPWI | 0.884 | 3 | SB | Sequence A0219 |
| 168 | WMATYLNDHL | 0.611 | 67 | WB | Sequence A0219 |
| 49 | AINGNPSWHL | 0.543 | 140 | WB | Sequence A0219 |
| 7 | LVVDFLSYKL | 0.539 | 146 | WB | Sequence A0219 |
| 153 | SVDKEMQVLV | 0.533 | 156 | WB | Sequence A0219 |
| 164 | RIAAWMATYL | 0.449 | 387 | WB | Sequence A0219 |
| 73 | SLDAREVIPM | 0.445 | 404 | WB | Sequence A0219 |
| 160 | VLVSRIAAWM | 0.441 | 421 | WB | Sequence A0219 |
| | | | | | |
| 223 | VLLGSLFSRK | 0.767 | 12 | SB | Sequence A0301 |
| 6 | ELVVDFLSYK | 0.504 | 213 | WB | Sequence A0301 |
| 147 | GALCVESVDK | 0.488 | 253 | WB | Sequence A0301 |
| 222 | VVLLGSLFSR | 0.457 | 356 | WB | Sequence A0301 |
| 77 | REVIPMAAVK | 0.453 | 372 | WB | Sequence A0301 |
| | | | | | |
| 223 | VLLGSLFSRK | 0.742 | 16 | SB | Sequence A1101 |
| 222 | VVLLGSLFSR | 0.681 | 31 | SB | Sequence A1101 |
| 147 | GALCVESVDK | 0.515 | 190 | WB | Sequence A1101 |
| 24 | SQFSDVEENR | 0.470 | 310 | WB | Sequence A1101 |

Fig. 36 continued

| | | | | | |
|---|---|---|---|---|---|
| 121 SFEQVVNELF | 0.581 | 92 | WB | Sequence | A2301 |
| 171 TYLNDHLEPW | 0.547 | 134 | WB | Sequence | A2301 |
| 121 SFEQVVNELF | 0.528 | 165 | WB | Sequence | A2402 |
| 171 TYLNDHLEPW | 0.520 | 180 | WB | Sequence | A2402 |
| 113 ITPGTAYQSF | 0.460 | 343 | WB | Sequence | A2402 |
| 171 TYLNDHLEPW | 0.739 | 16 | SB | Sequence | A2403 |
| 121 SFEQVVNELF | 0.546 | 136 | WB | Sequence | A2403 |
| 113 ITPGTAYQSF | 0.508 | 204 | WB | Sequence | A2403 |
| 35 EAPEGTESEM | 0.448 | 390 | WB | Sequence | A2601 |
| 164 RIAAWMATYL | 0.626 | 57 | WB | Sequence | A2602 |
| 113 ITPGTAYQSF | 0.581 | 92 | WB | Sequence | A2602 |
| 160 VLVSRIAAWM | 0.553 | 126 | WB | Sequence | A2602 |
| 35 EAPEGTESEM | 0.507 | 207 | WB | Sequence | A2602 |
| 152 ESVDKEMQVL | 0.490 | 249 | WB | Sequence | A2602 |
| 95 EFELRYRRAF | 0.483 | 268 | WB | Sequence | A2602 |
| 110 QLHITPGTAY | 0.506 | 209 | WB | Sequence | A2902 |
| 222 VVLLGSLFSR | 0.683 | 30 | SB | Sequence | A3101 |
| 129 LFRDGVNWGR | 0.667 | 36 | SB | Sequence | A3101 |
| 202 SRKGQERFNR | 0.608 | 69 | WB | Sequence | A3101 |
| 81 PMAAVKQALR | 0.521 | 177 | WB | Sequence | A3101 |
| 222 VVLLGSLFSR | 0.572 | 103 | WB | Sequence | A3301 |
| 129 LFRDGVNWGR | 0.553 | 126 | WB | Sequence | A3301 |
| 10 DFLSYKLSQK | 0.470 | 306 | WB | Sequence | A3301 |
| 6 ELVVDFLSYK | 0.702 | 25 | SB | Sequence | A6801 |
| 24 SQFSDVEENR | 0.532 | 158 | WB | Sequence | A6801 |
| 222 VVLLGSLFSR | 0.516 | 188 | WB | Sequence | A6801 |
| 194 YGNNAAAESR | 0.493 | 240 | WB | Sequence | A6801 |
| 78 EVIPMAAVKQ | 0.454 | 368 | WB | Sequence | A6801 |
| 169 MATYLNDHLE | 0.448 | 394 | WB | Sequence | A6801 |
| 139 IVAFFSFGGA | 0.742 | 16 | SB | Sequence | A6802 |
| 116 GTAYQSFEQV | 0.673 | 34 | SB | Sequence | A6802 |
| 7 LVVDFLSYKL | 0.659 | 39 | SB | Sequence | A6802 |
| 120 QSFEQVVNEL | 0.618 | 62 | WB | Sequence | A6802 |
| 213 FLTGMTVAGV | 0.577 | 96 | WB | Sequence | A6802 |
| 117 TAYQSFEQVV | 0.561 | 115 | WB | Sequence | A6802 |
| 164 RIAAWMATYL | 0.519 | 182 | WB | Sequence | A6802 |
| 65 NGATGHSSSL | 0.496 | 234 | WB | Sequence | A6802 |
| 218 TVAGVVLLGS | 0.491 | 246 | WB | Sequence | A6802 |
| 145 FGGALCVESV | 0.474 | 294 | WB | Sequence | A6802 |
| 125 VVNELFRDGV | 0.465 | 328 | WB | Sequence | A6802 |
| 161 LVSRIAAWMA | 0.451 | 380 | WB | Sequence | A6802 |
| 215 TGMTVAGVVL | 0.450 | 382 | WB | Sequence | A6802 |
| 153 SVDKEMQVLV | 0.534 | 155 | WB | Sequence | A6901 |
| 213 FLTGMTVAGV | 0.527 | 166 | WB | Sequence | A6901 |
| 117 TAYQSFEQVV | 0.466 | 324 | WB | Sequence | A6901 |
| 7 LVVDFLSYKL | 0.451 | 378 | WB | Sequence | A6901 |
| 164 RIAAWMATYL | 0.443 | 412 | WB | Sequence | A6901 |
| 116 GTAYQSFEQV | 0.427 | 493 | WB | Sequence | A6901 |
| 80 IPMAAVKQAL | 0.704 | 24 | SB | Sequence | B0702 |
| 17 SQKGYSWSQF | 0.572 | 102 | WB | Sequence | B1501 |
| 110 QLHITPGTAY | 0.557 | 121 | WB | Sequence | B1501 |
| 133 GVNWGRIVAF | 0.548 | 132 | WB | Sequence | B1501 |
| 181 IQENGGWDTF | 0.522 | 175 | WB | Sequence | B1501 |
| 12 LSYKLSQKGY | 0.455 | 364 | WB | Sequence | B1501 |

Fig. 36 continued

|     |             |       |     |    |          |       |
| --- | ----------- | ----- | --- | -- | -------- | ----- |
| 5   | RELVVDFLSY  | 0.759 | 13  | SB | Sequence | B1801 |
| 163 | SRIAAWMATY  | 0.588 | 86  | WB | Sequence | B2705 |
| 101 | RRAFSDLTSQ  | 0.461 | 340 | WB | Sequence | B2705 |
| 80  | IPMAAVKQAL  | 0.609 | 69  | WB | Sequence | B3501 |
| 178 | EPWIQENGGW  | 0.604 | 72  | WB | Sequence | B3501 |
| 91  | EAGDEFELRY  | 0.566 | 109 | WB | Sequence | B3501 |
| 35  | EAPEGTESEM  | 0.563 | 112 | WB | Sequence | B3501 |
| 87  | QALREAGDEF  | 0.508 | 206 | WB | Sequence | B3501 |
| 61  | SPAVNGATGH  | 0.490 | 249 | WB | Sequence | B3501 |
| 46  | TPSAINGNPS  | 0.483 | 269 | WB | Sequence | B3501 |
| 133 | GVNWGRIVAF  | 0.455 | 362 | WB | Sequence | B3501 |
| 140 | VAFFSFGGAL  | 0.454 | 367 | WB | Sequence | B3501 |
| 190 | PVELYGNNAA  | 0.439 | 430 | WB | Sequence | B3501 |
| 200 | AESRKGQERF  | 0.453 | 370 | WB | Sequence | B4501 |
| 178 | EPWIQENGGW  | 0.603 | 73  | WB | Sequence | B5301 |
| 2   | QSNRELVVDF  | 0.474 | 295 | WB | Sequence | B5801 |
| 159 | QVLVSRIAAW  | 0.467 | 320 | WB | Sequence | B5801 |
| 47  | PSAINGNPSW  | 0.437 | 444 | WB | Sequence | B5801 |

|     | 11-mers  |       |     |    |          |       |
| --- | ------------ | ----- | --- | -- | -------- | ----- |
| 213 | FLTGMTVAGVV  | 0.627 | 56  | WB | Sequence | A0201 |
| 73  | SLDAREVIPMA  | 0.561 | 115 | WB | Sequence | A0201 |
| 160 | VLVSRIAAWMA  | 0.547 | 135 | WB | Sequence | A0201 |
| 57  | HLADSPAVNGA  | 0.539 | 147 | WB | Sequence | A0201 |
| 172 | YLNDHLEPWIQ  | 0.480 | 278 | WB | Sequence | A0201 |
| 88  | ALREAGDEFEL  | 0.470 | 309 | WB | Sequence | A0201 |
| 119 | YQSFEQVVNEL  | 0.426 | 497 | WB | Sequence | A0201 |
| 57  | HLADSPAVNGA  | 0.763 | 12  | SB | Sequence | A0202 |
| 213 | FLTGMTVAGVV  | 0.754 | 14  | SB | Sequence | A0202 |
| 119 | YQSFEQVVNEL  | 0.734 | 17  | SB | Sequence | A0202 |
| 88  | ALREAGDEFEL  | 0.679 | 32  | SB | Sequence | A0202 |
| 172 | YLNDHLEPWIQ  | 0.611 | 67  | WB | Sequence | A0202 |
| 139 | IVAFFSFGGAL  | 0.558 | 119 | WB | Sequence | A0202 |
| 218 | TVAGVVLLGSL  | 0.537 | 149 | WB | Sequence | A0202 |
| 160 | VLVSRIAAWMA  | 0.525 | 170 | WB | Sequence | A0202 |
| 15  | KLSQKGYSWSQ  | 0.450 | 382 | WB | Sequence | A0202 |
| 6   | ELVVDFLSYKL  | 0.449 | 387 | WB | Sequence | A0202 |
| 73  | SLDAREVIPMA  | 0.446 | 401 | WB | Sequence | A0202 |
| 213 | FLTGMTVAGVV  | 0.864 | 4   | SB | Sequence | A0203 |
| 57  | HLADSPAVNGA  | 0.844 | 5   | SB | Sequence | A0203 |
| 138 | RIVAFFSFGGA  | 0.752 | 14  | SB | Sequence | A0203 |
| 160 | VLVSRIAAWMA  | 0.649 | 44  | SB | Sequence | A0203 |
| 218 | TVAGVVLLGSL  | 0.619 | 61  | WB | Sequence | A0203 |
| 88  | ALREAGDEFEL  | 0.604 | 72  | WB | Sequence | A0203 |
| 119 | YQSFEQVVNEL  | 0.567 | 108 | WB | Sequence | A0203 |
| 172 | YLNDHLEPWIQ  | 0.565 | 110 | WB | Sequence | A0203 |
| 49  | AINGNPSWHLA  | 0.562 | 114 | WB | Sequence | A0203 |
| 209 | FNRWFLTGMTV  | 0.494 | 239 | WB | Sequence | A0203 |
| 139 | IVAFFSFGGAL  | 0.487 | 257 | WB | Sequence | A0203 |
| 73  | SLDAREVIPMA  | 0.480 | 276 | WB | Sequence | A0203 |
| 82  | MAAVKQALREA  | 0.430 | 477 | WB | Sequence | A0203 |
| 124 | QVVNELFRDGV  | 0.426 | 496 | WB | Sequence | A0203 |
| 213 | FLTGMTVAGVV  | 0.584 | 90  | WB | Sequence | A0204 |
| 88  | ALREAGDEFEL  | 0.526 | 168 | WB | Sequence | A0204 |
| 160 | VLVSRIAAWMA  | 0.517 | 185 | WB | Sequence | A0204 |
| 172 | YLNDHLEPWIQ  | 0.517 | 186 | WB | Sequence | A0204 |

Fig. 36 continued

| 73 | SLDAPEVIPMA | 0.485 | 263 | WB | Sequence | A0204 |
|---|---|---|---|---|---|---|
| 213 | FLTGMTVAGVV | 0.746 | 15 | SB | Sequence | A0206 |
| 138 | RIVAFFSFGGA | 0.725 | 19 | SB | Sequence | A0206 |
| 181 | IQENGGWDTFV | 0.704 | 24 | SB | Sequence | A0206 |
| 119 | YQSFEQVVNEL | 0.671 | 35 | SB | Sequence | A0206 |
| 48 | SAINGNPSWHL | 0.664 | 38 | SB | Sequence | A0206 |
| 124 | QVVNELFRDGV | 0.619 | 62 | WB | Sequence | A0206 |
| 160 | VLVSRIAAWMA | 0.584 | 90 | WB | Sequence | A0206 |
| 86 | KQALREAGDEF | 0.547 | 134 | WB | Sequence | A0206 |
| 57 | HLADSPAVNGA | 0.509 | 201 | WB | Sequence | A0206 |
| 218 | TVAGVVLLGSL | 0.456 | 358 | WB | Sequence | A0206 |
| 88 | ALREAGDEFEL | 0.442 | 420 | WB | Sequence | A0206 |
| 109 | SQLHITPGTAY | 0.441 | 422 | WB | Sequence | A0206 |
| 213 | FLTGMTVAGVV | 0.943 | 1 | SB | Sequence | A0211 |
| 73 | SLDAREVIPMA | 0.876 | 3 | SB | Sequence | A0211 |
| 172 | YLNDHLEPWIQ | 0.852 | 4 | SB | Sequence | A0211 |
| 88 | ALREAGDEFEL | 0.799 | 8 | SB | Sequence | A0211 |
| 57 | HLADSPAVNGA | 0.787 | 10 | SB | Sequence | A0211 |
| 160 | VLVSRIAAWMA | 0.759 | 13 | SB | Sequence | A0211 |
| 15 | KLSQKGYSWSQ | 0.743 | 16 | SB | Sequence | A0211 |
| 6 | ELVVDFLSYKL | 0.682 | 31 | SB | Sequence | A0211 |
| 218 | TVAGVVLLGSL | 0.628 | 55 | WB | Sequence | A0211 |
| 49 | AINGNPSWHLA | 0.612 | 66 | WB | Sequence | A0211 |
| 212 | WFLTGMTVAGV | 0.577 | 97 | WB | Sequence | A0211 |
| 141 | AFFSFGGALCV | 0.571 | 103 | WB | Sequence | A0211 |
| 144 | SFGGALCVESV | 0.569 | 105 | WB | Sequence | A0211 |
| 79 | VIPMAAVKQAL | 0.568 | 107 | WB | Sequence | A0211 |
| 124 | QVVNELFRDGV | 0.535 | 152 | WB | Sequence | A0211 |
| 130 | FRDGVNWGRIV | 0.516 | 167 | WB | Sequence | A0211 |
| 48 | SAINGNPSWHL | 0.515 | 189 | WB | Sequence | A0211 |
| 192 | ELYGNNAAAES | 0.504 | 214 | WB | Sequence | A0211 |
| 150 | CVESVDKEMQV | 0.489 | 252 | WB | Sequence | A0211 |
| 116 | GTAYQSFEQVV | 0.452 | 376 | WB | Sequence | A0211 |
| 139 | IVAFFSFGGAL | 0.444 | 411 | WB | Sequence | A0211 |
| 213 | FLTGMTVAGVV | 0.824 | 6 | SB | Sequence | A0212 |
| 172 | YLNDHLEPWIQ | 0.812 | 7 | SB | Sequence | A0212 |
| 88 | ALREAGDEFEL | 0.779 | 10 | SB | Sequence | A0212 |
| 73 | SLDAREVIPMA | 0.745 | 15 | SB | Sequence | A0212 |
| 57 | HLADSPAVNGA | 0.714 | 22 | SB | Sequence | A0212 |
| 160 | VLVSRIAAWMA | 0.681 | 31 | SB | Sequence | A0212 |
| 79 | VIPMAAVKQAL | 0.604 | 72 | WB | Sequence | A0212 |
| 15 | KLSQKGYSWSQ | 0.568 | 107 | WB | Sequence | A0212 |
| 212 | WFLTGMTVAGV | 0.504 | 213 | WB | Sequence | A0212 |
| 6 | ELVVDFLSYKL | 0.451 | 380 | WB | Sequence | A0212 |
| 130 | FRDGVNWGRIV | 0.431 | 473 | WB | Sequence | A0212 |
| 213 | FLTGMTVAGVV | 0.862 | 4 | SB | Sequence | A0216 |
| 88 | ALREAGDEFEL | 0.821 | 6 | SB | Sequence | A0216 |
| 73 | SLDAREVIPMA | 0.744 | 16 | SB | Sequence | A0216 |
| 160 | VLVSRIAAWMA | 0.649 | 44 | SB | Sequence | A0216 |
| 150 | CVESVDKEMQV | 0.641 | 48 | SB | Sequence | A0216 |
| 57 | HLADSPAVNGA | 0.595 | 79 | WB | Sequence | A0216 |
| 144 | SFGGALCVESV | 0.591 | 83 | WB | Sequence | A0216 |
| 172 | YLNDHLEPWIQ | 0.581 | 92 | WB | Sequence | A0216 |
| 15 | KLSQKGYSWSQ | 0.561 | 115 | WB | Sequence | A0216 |
| 6 | ELVVDFLSYKL | 0.544 | 138 | WB | Sequence | A0216 |
| 218 | TVAGVVLLGSL | 0.534 | 154 | WB | Sequence | A0216 |
| 141 | AFFSFGGALCV | 0.526 | 168 | WB | Sequence | A0216 |
| 181 | IQENGGWDTFV | 0.497 | 231 | WB | Sequence | A0216 |
| 124 | QVVNELFRDGV | 0.490 | 249 | WB | Sequence | A0216 |
| 79 | VIPMAAVKQAL | 0.487 | 257 | WB | Sequence | A0216 |
| 192 | ELYGNNAAAES | 0.478 | 283 | WB | Sequence | A0216 |
| 48 | SAINGNPSWHL | 0.468 | 315 | WB | Sequence | A0216 |
| 212 | WFLTGMTVAGV | 0.437 | 441 | WB | Sequence | A0216 |

Fig. 36 continued

| | | | | | |
|---|---|---|---|---|---|
| 49 AINGNPSWHLA | 0.436 | 447 | WB | Sequence | A0216 |
| | | | | | |
| 213 FLTGMTVAGVV | 0.781 | 10 | SB | Sequence | A0219 |
| 57 HLADSPAVNGA | 0.730 | 18 | SB | Sequence | A0219 |
| 172 YLNDHLEPWIQ | 0.695 | 27 | SB | Sequence | A0219 |
| 73 SLDAREVIPMA | 0.609 | 68 | WB | Sequence | A0219 |
| 86 ALREAGDEFEL | 0.549 | 131 | WB | Sequence | A0219 |
| 212 WFLTGMTVAGV | 0.524 | 172 | WB | Sequence | A0219 |
| 160 VLVSRIAAWMA | 0.499 | 225 | WB | Sequence | A0219 |
| | | | | | |
| 222 VVLLGSLFSRK | 0.688 | 29 | SB | Sequence | A0301 |
| | | | | | |
| 222 VVLLGSLFSRK | 0.786 | 10 | SB | Sequence | A1101 |
| 221 GVVLLGSLFSR | 0.596 | 78 | WB | Sequence | A1101 |
| 67 ATGHSSSLDAR | 0.505 | 212 | WB | Sequence | A1101 |
| 5 RELVVDFLSYK | 0.428 | 489 | WB | Sequence | A1101 |
| | | | | | |
| 135 NWGRIVAFFSF | 0.695 | 26 | SB | Sequence | A2301 |
| 171 TYLNDHLEPWI | 0.576 | 98 | WB | Sequence | A2301 |
| 167 AWMATYLNDHL | 0.534 | 154 | WB | Sequence | A2301 |
| 13 SYKLSQKGYSW | 0.531 | 159 | WB | Sequence | A2301 |
| | | | | | |
| 135 NWGRIVAFFSF | 0.746 | 15 | SB | Sequence | A2402 |
| 171 TYLNDHLEPWI | 0.746 | 15 | SB | Sequence | A2402 |
| 167 AWMATYLNDHL | 0.520 | 180 | WB | Sequence | A2402 |
| | | | | | |
| 171 TYLNDHLEPWI | 0.660 | 39 | SB | Sequence | A2403 |
| 167 AWMATYLNDHL | 0.523 | 174 | WB | Sequence | A2403 |
| 13 SYKLSQKGYSW | 0.523 | 174 | WB | Sequence | A2403 |
| 112 HITPGTAYQSF | 0.431 | 473 | WB | Sequence | A2403 |
| | | | | | |
| 159 QVLVSRIAAWM | 0.640 | 49 | SB | Sequence | A2602 |
| 112 HITPGTAYQSF | 0.573 | 101 | WB | Sequence | A2602 |
| 180 WIQENGGWDTF | 0.518 | 183 | WB | Sequence | A2602 |
| 11 FLSYKLSQKGY | 0.516 | 188 | WB | Sequence | A2602 |
| 132 DGVNWGRIVAF | 0.462 | 336 | WB | Sequence | A2602 |
| 218 TVAGVVLLGSL | 0.443 | 415 | WB | Sequence | A2602 |
| | | | | | |
| 109 SQLHITPGTAY | 0.516 | 188 | WB | Sequence | A2902 |
| | | | | | |
| 222 VVLLGSLFSRK | 0.435 | 453 | WB | Sequence | A3001 |
| 99 RYRRAFSDLTS | 0.428 | 486 | WB | Sequence | A3001 |
| | | | | | |
| 221 GVVLLGSLFSR | 0.598 | 77 | WB | Sequence | A3101 |
| 121 SFEQVVNELFR | 0.552 | 127 | WB | Sequence | A3101 |
| 201 ESRKGQERFNR | 0.511 | 198 | WB | Sequence | A3101 |
| 67 ATGHSSSLDAR | 0.475 | 292 | WB | Sequence | A3101 |
| 5 RELVVDFLSYK | 0.442 | 417 | WB | Sequence | A3101 |
| 193 LYGNNAAAESR | 0.435 | 449 | WB | Sequence | A3101 |
| | | | | | |
| 201 ESRKGQERFNR | 0.690 | 28 | SB | Sequence | A3301 |
| 128 ELFRDGVNWGR | 0.634 | 52 | WB | Sequence | A3301 |
| 91 EAGDEFELRYR | 0.538 | 148 | WB | Sequence | A3301 |
| 121 SFEQVVNELFR | 0.472 | 303 | WB | Sequence | A3301 |
| 221 GVVLLGSLFSR | 0.447 | 396 | WB | Sequence | A3301 |
| 95 EFELRYRRAFS | 0.435 | 449 | WB | Sequence | A3301 |
| | | | | | |
| 128 ELFRDGVNWGR | 0.739 | 16 | SB | Sequence | A6801 |
| 23 WSQFSDVEENR | 0.667 | 36 | SB | Sequence | A6801 |
| 201 ESRKGQERFNR | 0.666 | 36 | SB | Sequence | A6801 |
| 91 EAGDEFELRYR | 0.643 | 47 | SB | Sequence | A6801 |
| 221 GVVLLGSLFSR | 0.638 | 49 | SB | Sequence | A6801 |
| 80 IPMAAVKQALR | 0.566 | 109 | WB | Sequence | A6801 |
| 121 SFEQVVNELFR | 0.536 | 151 | WB | Sequence | A6801 |
| | | | | | |
| 218 TVAGVVLLGSL | 0.796 | 9 | SB | Sequence | A6802 |
| 124 QVVNELFRDGV | 0.712 | 22 | SB | Sequence | A6802 |

Fig. 36 continued

| | | | | | |
|---|---|---|---|---|---|
| 139 IVAFFSFGGAL | 0.684 | 30 | SB | Sequence | A6802 |
| 152 ESVDKEMQVLV | 0.613 | 65 | WB | Sequence | A6802 |
| 215 TGMTVAGVVLL | 0.561 | 116 | WB | Sequence | A6802 |
| 6 ELVVDFLSYKL | 0.551 | 129 | WB | Sequence | A6802 |
| 138 RIVAFFSFGGA | 0.548 | 132 | WB | Sequence | A6802 |
| 188 DTFVELYGNNA | 0.530 | 161 | WB | Sequence | A6802 |
| 78 EVIPMAAVKQA | 0.516 | 188 | WB | Sequence | A6802 |
| 116 GTAYQSFEQVV | 0.514 | 191 | WB | Sequence | A6802 |
| 75 DAREVIPMAAV | 0.509 | 203 | WB | Sequence | A6802 |
| 57 HLADSPAVNGA | 0.508 | 206 | WB | Sequence | A6802 |
| 217 MTVAGVVLLGS | 0.480 | 277 | WB | Sequence | A6802 |
| 45 ETPSAINGNPS | 0.479 | 279 | WB | Sequence | A6802 |
| 213 FLTGMTVAGVV | 0.470 | 308 | WB | Sequence | A6802 |
| 70 HSSSLDAREVI | 0.447 | 397 | WB | Sequence | A6802 |
| 48 SAINGNPSWHL | 0.541 | 143 | WB | Sequence | A6901 |
| 75 DAREVIPMAAV | 0.527 | 166 | WB | Sequence | A6901 |
| 152 ESVDKEMQVLV | 0.511 | 199 | WB | Sequence | A6901 |
| 57 HLADSPAVNGA | 0.485 | 263 | WB | Sequence | A6901 |
| 54 PSWHLADSPAV | 0.469 | 312 | WB | Sequence | A6901 |
| 212 WFLTGMTVAGV | 0.453 | 369 | WB | Sequence | A6901 |
| 78 EVIPMAAVKQA | 0.442 | 417 | WB | Sequence | A6901 |
| 6 ELVVDFLSYKL | 0.442 | 417 | WB | Sequence | A6901 |
| 218 TVAGVVLLGSL | 0.430 | 475 | WB | Sequence | A6901 |
| 188 DTFVELYGNNA | 0.427 | 494 | WB | Sequence | A6901 |
| 139 IVAFFSFGGAL | 0.518 | 183 | WB | Sequence | B0702 |
| 53 NPSWHLADSPA | 0.499 | 224 | WB | Sequence | B0702 |
| 61 SPAVNGATGHS | 0.457 | 355 | WB | Sequence | B0702 |
| 109 SQLHITPGTAY | 0.605 | 72 | WB | Sequence | B1501 |
| 86 KQALREAGDEF | 0.567 | 108 | WB | Sequence | B1501 |
| 1 SQSNRELVVDF | 0.540 | 144 | WB | Sequence | B1501 |
| 119 YQSFEQVVNEL | 0.515 | 189 | WB | Sequence | B1501 |
| 158 MQVLVSRIAAW | 0.512 | 196 | WB | Sequence | B1501 |
| 162 VSRIAAWMATY | 0.477 | 285 | WB | Sequence | B1501 |
| 11 FLSYKLSQKGY | 0.474 | 294 | WB | Sequence | B1501 |
| 180 WIQENGGWDTF | 0.473 | 299 | WB | Sequence | B1501 |
| 120 QSFEQVVNELF | 0.450 | 386 | WB | Sequence | B1501 |
| 112 HITPGTAYQSF | 0.447 | 394 | WB | Sequence | B1501 |
| 133 GVNWGRIVAFF | 0.433 | 463 | WB | Sequence | B1501 |
| 94 DEFELRYRRAF | 0.829 | 6 | SB | Sequence | B1801 |
| 90 REAGDEFELRY | 0.560 | 116 | WB | Sequence | B1801 |
| 109 SQLHITPGTAY | 0.539 | 146 | WB | Sequence | B1801 |
| 151 VESVDKEMQVL | 0.476 | 288 | WB | Sequence | B1801 |
| 177 LEPWIQENGGW | 0.466 | 321 | WB | Sequence | B1801 |
| 209 FNRWFLTGMTV | 0.444 | 409 | WB | Sequence | B1801 |
| 101 RRAFSDLTSQL | 0.563 | 113 | WB | Sequence | B2705 |
| 163 SRIAAWMATYL | 0.470 | 310 | WB | Sequence | B2705 |
| 53 NPSWHLADSPA | 0.623 | 59 | WB | Sequence | B3501 |
| 46 TPSAINGNPSW | 0.485 | 263 | WB | Sequence | B3501 |
| 180 WIQENGGWDTF | 0.474 | 297 | WB | Sequence | B3501 |
| 132 DGVNWGRIVAF | 0.442 | 419 | WB | Sequence | B3501 |
| 119 YQSFEQVVNEL | 0.610 | 68 | WB | Sequence | B3901 |
| 151 VESVDKEMQVL | 0.492 | 243 | WB | Sequence | B4001 |
| 40 TESEMETPSAI | 0.446 | 402 | WB | Sequence | B4002 |
| 30 EENRTEAPEGT | 0.498 | 228 | WB | Sequence | B4501 |
| 46 TPSAINGNPSW | 0.772 | 11 | SB | Sequence | B5301 |

Fig. 36 continued

| 53 NPSWHLADSPA | 0.430 | 474 | WB | Sequence | B5401 |
| 170 ATYLNDHLEPW | 0.540 | 145 | WB | Sequence | B5701 |
| 170 ATYLNDHLEPW | 0.537 | 150 | WB | Sequence | B5801 |
| 120 QSFEQVVNELF | 0.495 | 235 | WB | Sequence | B5801 |

Fig. 36 continued

Fig. 37. Prediction of cancer antigen BclX(L) specific MHC class 2, 15-mer peptide binders.

SEQ ID NO:180346-180857

| Allele | pos | peptide | core | 1-log50k(aff) | affinity(nM) | Bind Level | Identity |
|---|---|---|---|---|---|---|---|
| DRB1_0101 | 212 | RWFLTGMTVAGVVLL | LTGMTVAGV | 0.8026 | 8 | SB | BclX(L) |
| DRB1_0101 | 209 | RFNRWFLTGMTVAGV | FLTGMTVAG | 0.7932 | 9 | SB | BclX(L) |
| DRB1_0101 | 210 | FNRWFLTGMTVAGVV | LTGMTVAGV | 0.7940 | 9 | SB | BclX(L) |
| DRB1_0101 | 211 | NRWFLTGMTVAGVVL | LTGMTVAGV | 0.7970 | 9 | SB | BclX(L) |
| DRB1_0101 | 213 | WFLTGMTVAGVVLLG | LTGMTVAGV | 0.7753 | 11 | SB | BclX(L) |
| DRB1_0101 | 76 | DAREVIPMAAVKQAL | VIPMAAVKQ | 0.7755 | 11 | SB | BclX(L) |
| DRB1_0101 | 77 | AREVIPMAAVKQALR | VIPMAAVKQ | 0.7788 | 11 | SB | BclX(L) |
| DRB1_0101 | 78 | REVIPMAAVKQALRE | VIPMAAVKQ | 0.7772 | 11 | SB | BclX(L) |
| DRB1_0101 | 75 | LDAREVIPMAAVKQA | VIPMAAVKQ | 0.7730 | 12 | SB | BclX(L) |
| DRB1_0101 | 157 | KEMQVLVSRIAAWMA | MQVLVSRIA | 0.7458 | 16 | SB | BclX(L) |
| DRB1_0101 | 108 | LTSQLHITPGTAYQS | LHITPGTAY | 0.7338 | 18 | SB | BclX(L) |
| DRB1_0101 | 109 | TSQLHITPGTAYQSF | ITPGTAYQS | 0.7313 | 18 | SB | BclX(L) |
| DRB1_0101 | 74 | SLDAREVIPMAAVKQ | AREVIPMAA | 0.7348 | 18 | SB | BclX(L) |
| DRB1_0101 | 110 | SQLHITPGTAYQSFE | ITPGTAYQS | 0.7287 | 19 | SB | BclX(L) |
| DRB1_0101 | 214 | FLTGMTVAGVVLLGS | LTGMTVAGV | 0.7282 | 19 | SB | BclX(L) |
| DRB1_0101 | 156 | DKEMQVLVSRIAAWM | MQVLVSRIA | 0.7226 | 20 | SB | BclX(L) |
| DRB1_0101 | 111 | QLHITPGTAYQSFEQ | ITPGTAYQS | 0.7202 | 21 | SB | BclX(L) |
| DRB1_0101 | 112 | LHITPGTAYQSFEQV | ITPGTAYQS | 0.7189 | 21 | SB | BclX(L) |
| DRB1_0101 | 154 | SVDKEMQVLVSRIAA | MQVLVSRIA | 0.7165 | 21 | SB | BclX(L) |
| DRB1_0101 | 79 | EVIPMAAVKQALREA | IPMAAVKQA | 0.7208 | 21 | SB | BclX(L) |
| DRB1_0101 | 153 | ESVDKEMQVLVSRIA | VDKEMQVLV | 0.7145 | 22 | SB | BclX(L) |
| DRB1_0101 | 155 | VDKEMQVLVSRIAAW | MQVLVSRIA | 0.7141 | 22 | SB | BclX(L) |
| DRB1_0101 | 215 | LTGMTVAGVVLLGSL | LTGMTVAGV | 0.7090 | 23 | SB | BclX(L) |
| DRB1_0101 | 208 | EPFNRWFLTGMTVAG | FNRWFLTGM | 0.7077 | 24 | SB | BclX(L) |
| DRB1_0101 | 46 | ETPSAINGNPSWHLA | INGNPSWHL | 0.7051 | 24 | SB | BclX(L) |
| DRB1_0101 | 47 | TPSAINGNPSWHLAD | INGNPSWHL | 0.7051 | 24 | SB | BclX(L) |
| DRB1_0101 | 48 | PSAINGNPSWHLADS | INGNPSWHL | 0.7076 | 24 | SB | BclX(L) |
| DRB1_0101 | 49 | SAINGNPSWHLADSP | INGNPSWHL | 0.7072 | 24 | SB | BclX(L) |
| DRB1_0101 | 45 | METPSAINGNPSWHL | PSAINGNPS | 0.7034 | 25 | SB | BclX(L) |
| DRB1_0101 | 158 | EMQVLVSRIAAWMAT | MQVLVSRIA | 0.6845 | 30 | SB | BclX(L) |
| DRB1_0101 | 80 | VIPMAAVKQALREAG | VIPMAAVKQ | 0.6856 | 30 | SB | BclX(L) |
| DRB1_0101 | 159 | MQVLVSRIAAWMATY | MQVLVSRIA | 0.6834 | 31 | SB | BclX(L) |
| DRB1_0101 | 161 | VLVSRIAAWMATYLN | IAAWMATYL | 0.6838 | 31 | SB | BclX(L) |
| DRB1_0101 | 217 | GMTVAGVVLLGSLFS | MTVAGVVLL | 0.6800 | 32 | SB | BclX(L) |
| DRB1_0101 | 218 | MTVAGVVLLGSLFSR | VVLLGSLFS | 0.6800 | 32 | SB | BclX(L) |
| DRB1_0101 | 51 | INGNPSWHLADSPAV | INGNPSWHL | 0.6778 | 33 | SB | BclX(L) |
| DRB1_0101 | 192 | VELYGNNAAAESRKG | YGNNAAAES | 0.6693 | 36 | SB | BclX(L) |
| DRB1_0101 | 219 | TVAGVVLLGSLFSRK | VVLLGSLFS | 0.6677 | 36 | SB | BclX(L) |
| DRB1_0101 | 160 | QVLVSRIAAWMATYL | VSRIAAWMA | 0.6652 | 37 | SB | BclX(L) |
| DRB1_0101 | 191 | PVELYGNNAAAESRK | YGNNAAAES | 0.6658 | 37 | SB | BclX(L) |
| DRB1_0101 | 193 | ELYGNNAAAESRKGQ | YGNNAAAES | 0.6661 | 37 | SB | BclX(L) |
| DRB1_0101 | 99 | LRYRPAFSDLTSQLH | YRPAFSDLT | 0.6657 | 37 | SB | BclX(L) |
| DRB1_0101 | 162 | LVSRIAAWMATYLND | IAAWMATYL | 0.6627 | 38 | SB | BclX(L) |
| DRB1_0101 | 190 | TFVELYGNNAAAESR | YGNNAAAES | 0.6628 | 38 | SB | BclX(L) |
| DRB1_0101 | 189 | DTFVELYGNNAAAES | FVELYGNNA | 0.6613 | 39 | SB | BclX(L) |
| DRB1_0101 | 54 | NPSWHLADSPAVNGA | WHLADSPAV | 0.6617 | 39 | SB | BclX(L) |
| DRB1_0101 | 55 | PSWHLADSPAVNGAT | WHLADSPAV | 0.6611 | 39 | SB | BclX(L) |
| DRB1_0101 | 216 | TGMTVAGVVLLGSLF | MTVAGVVLL | 0.6543 | 42 | SB | BclX(L) |
| DRB1_0101 | 163 | VSRIAAWMATYLNDH | IAAWMATYL | 0.6531 | 43 | SB | BclX(L) |
| DRB1_0101 | 53 | GNPSWHLADSPAVNG | WHLADSPAV | 0.6532 | 43 | SB | BclX(L) |
| DRB1_0101 | 59 | LADSPAVNGATCHSS | LADSPAVNG | 0.6361 | 51 | WB | BclX(L) |
| DRB1_0101 | 98 | ELRYRPAFSDLTSQL | YRPAFSDLT | 0.6357 | 51 | WB | BclX(L) |
| DRB1_0101 | 164 | SRIAAWMATYLNDHL | IAAWMATYL | 0.6357 | 52 | WB | BclX(L) |
| DRB1_0101 | 97 | FELRYRPAFSDLTSQ | YRPAFSDLT | 0.6337 | 53 | WB | BclX(L) |
| DRB1_0101 | 96 | EFELRYRPAFSDLTS | YRPAFSDLT | 0.6321 | 54 | WB | BclX(L) |
| DRB1_0101 | 95 | DEFELRYRPAFSDLT | LRYRPAFSD | 0.6294 | 55 | WB | BclX(L) |
| DRB1_0101 | 140 | IVAFFSFGGALCVES | FSFGGALCV | 0.6203 | 61 | WB | BclX(L) |
| DRB1_0101 | 56 | SWHLADSPAVNGATG | LADSPAVNG | 0.6196 | 61 | WB | BclX(L) |

| | | | | | | | |
|---|---|---|---|---|---|---|---|
| DRB1_0101 | 61 | DSPAVNGATGHSSSL | VNGATGHSS | 0.6197 | 61 | WB | BclX(L) |
| DRB1_0101 | 62 | SPAVNGATGHSSSLD | VNGATGHSS | 0.6205 | 61 | WB | BclX(L) |
| DRB1_0101 | 141 | VAFFSFGGALCVESV | FSFGGALCV | 0.6191 | 62 | WB | BclX(L) |
| DRB1_0101 | 60 | ADSPAVNGATGHSSS | VNGATGHSS | 0.6174 | 63 | WB | BclX(L) |
| DRB1_0101 | 142 | AFFSFGGALCVESVD | FSFGGALCV | 0.6153 | 64 | WB | BclX(L) |
| DRB1_0101 | 57 | WHLADSPAVNGATGH | LADSPAVNG | 0.6162 | 64 | WB | BclX(L) |
| DRB1_0101 | 113 | HITPGTAYQSFEQVV | ITPGTAYQS | 0.6121 | 66 | WB | BclX(L) |
| DRB1_0101 | 114 | ITPGTAYQSFEQVVN | ITPGTAYQS | 0.6131 | 66 | WB | BclX(L) |
| DRB1_0101 | 50 | AINGNPSWHLADSPA | INGNPSWHL | 0.6133 | 66 | WB | BclX(L) |
| DRB1_0101 | 63 | PAVNGATGHSSSLDA | VNGATGHSS | 0.6078 | 70 | WB | BclX(L) |
| DRB1_0101 | 100 | RYRRAFSDLTSQLHI | YRRAFSDLT | 0.6026 | 74 | WB | BclX(L) |
| DRB1_0101 | 101 | YRRAFSDLTSQLHIT | YRRAFSDLT | 0.6021 | 74 | WB | BclX(L) |
| DRB1_0101 | 52 | NGNPSWHLADSPAVN | WHLADSPAV | 0.6004 | 75 | WB | BclX(L) |
| DRB1_0101 | 138 | GRIVAFFSFGGALCV | IVAFFSFGG | 0.5864 | 88 | WB | BclX(L) |
| DRB1_0101 | 194 | LYGNNAAAESRKGQE | YGNNAAAES | 0.5808 | 93 | WB | BclX(L) |
| DRB1_0101 | 165 | RIAAWMATYLNDHLE | AAWMATYLN | 0.5762 | 98 | WB | BclX(L) |
| DRB1_0101 | 195 | YGNNAAAESRKGQER | YGNNAAAES | 0.5731 | 101 | WB | BclX(L) |
| DRB1_0101 | 139 | RIVAFFSFGGALCVE | FSFGGALCV | 0.5729 | 102 | WB | BclX(L) |
| DRB1_0101 | 131 | FRDGVNWGRIVAFFS | VNWGRIVAF | 0.5627 | 114 | WB | BclX(L) |
| DRB1_0101 | 143 | FFSFGGALCVESVDK | FSFGGALCV | 0.5613 | 115 | WB | BclX(L) |
| DRB1_0101 | 144 | FSFGGALCVESVDKE | FSFGGALCV | 0.5583 | 119 | WB | BclX(L) |
| DRB1_0101 | 132 | RDGVNWGRIVAFFSF | VNWGRIVAF | 0.5561 | 122 | WB | BclX(L) |
| DRB1_0101 | 133 | DGVNWGRIVAFFSFG | VNWGRIVAF | 0.5558 | 122 | WB | BclX(L) |
| DRB1_0101 | 81 | IPMAAVKQALREAGD | IPMAAVKQA | 0.5527 | 126 | WB | BclX(L) |
| DRB1_0101 | 102 | RRAFSDLTSQLHITP | FSDLTSQLH | 0.5334 | 156 | WB | BclX(L) |
| DRB1_0101 | 103 | RAFSDLTSQLHITPG | FSDLTSQLH | 0.5314 | 159 | WB | BclX(L) |
| DRB1_0101 | 58 | HLADSPAVNGATGHS | LADSPAVNG | 0.5293 | 163 | WB | BclX(L) |
| DRB1_0101 | 134 | GVNWGRIVAFFSFGG | VNWGRIVAF | 0.5282 | 165 | WB | BclX(L) |
| DRB1_0101 | 166 | IAAWMATYLNDHLEP | IAAWMATYL | 0.5271 | 167 | WB | BclX(L) |
| DRB1_0101 | 64 | AVNGATGHSSSLDAR | VNGATGHSS | 0.5266 | 168 | WB | BclX(L) |
| DRB1_0101 | 135 | VNWGRIVAFFSFGGA | VNWGRIVAF | 0.5248 | 171 | WB | BclX(L) |
| DRB1_0101 | 7 | ELVVDFLSYKLSQKG | VVDFLSYKL | 0.5243 | 172 | WB | BclX(L) |
| DRB1_0101 | 129 | ELFRDGVNWGRIVAF | FRDGVNWGR | 0.5154 | 189 | WB | BclX(L) |
| DRB1_0101 | 65 | VNGATGHSSSLDARE | VNGATGHSS | 0.5156 | 189 | WB | BclX(L) |
| DRB1_0101 | 130 | LFRDGVNWGRIVAFF | VNWGRIVAF | 0.5023 | 218 | WB | BclX(L) |
| DRB1_0101 | 8 | LVVDFLSYKLSQKGY | LSYKLSQKG | 0.4921 | 244 | WB | BclX(L) |
| DRB1_0101 | 9 | VVDFLSYKLSQKGYS | LSYKLSQKG | 0.4892 | 251 | WB | BclX(L) |
| DRB1_0101 | 207 | QERFNRWFLTGMTVA | FNRWFLTGM | 0.4845 | 264 | WB | BclX(L) |
| DRB1_0101 | 42 | ESEMETPSAINGNPS | METPSAING | 0.4626 | 335 | WB | BclX(L) |
| DRB1_0101 | 40 | GTESEMETPSAINGN | METPSAING | 0.4622 | 337 | WB | BclX(L) |
| DRB1_0101 | 107 | DLTSQLHITPGTAYQ | LHITPGTAY | 0.4593 | 347 | WB | BclX(L) |
| DRB1_0101 | 39 | EGTESEMETPSAING | ESEMETPSA | 0.4591 | 348 | WB | BclX(L) |
| DRB1_0101 | 43 | SEMETPSAINGNPSW | METPSAING | 0.4590 | 348 | WB | BclX(L) |
| DRB1_0101 | 106 | SDLTSQLHITPGTAY | SQLHITPGT | 0.4569 | 356 | WB | BclX(L) |
| DRB1_0101 | 10 | VDFLSYKLSQKGYSW | LSYKLSQKG | 0.4565 | 358 | WB | BclX(L) |
| DRB1_0101 | 41 | TESEMETPSAINGNP | METPSAING | 0.4564 | 358 | WB | BclX(L) |
| DRB1_0101 | 167 | AAWMATYLNDHLEPW | AAWMATYLN | 0.4556 | 361 | WB | BclX(L) |
| DRB1_0101 | 11 | DFLSYKLSQKGYSWS | LSYKLSQKG | 0.4515 | 378 | WB | BclX(L) |
| DRB1_0101 | 104 | AFSDLTSQLHITPGT | FSDLTSQLH | 0.4453 | 404 | WB | BclX(L) |
| DRB1_0101 | 105 | FSDLTSQLHITPGTA | FSDLTSQLH | 0.4451 | 405 | WB | BclX(L) |
| DRB1_0101 | 137 | WGRIVAFFSFGGALC | IVAFFSFGG | 0.4311 | 471 | WB | BclX(L) |
| DRB1_0101 | 206 | GQERFNRWFLTGMTV | FNRWFLTGM | 0.4277 | 489 | WB | BclX(L) |
| DRB1_0401 | 99 | LRYRRAFSDLTSQLH | YRRAFSDLT | 0.5618 | 115 | WB | BclX(L) |
| DRB1_0401 | 97 | FELRYRRAFSDLTSQ | YRRAFSDLT | 0.5300 | 162 | WB | BclX(L) |
| DRB1_0401 | 96 | EFELRYRRAFSDLTS | YRRAFSDLT | 0.5284 | 164 | WB | BclX(L) |
| DRB1_0401 | 95 | DEFELRYRRAFSDLT | DEFELRYRR | 0.5275 | 166 | WB | BclX(L) |
| DRB1_0401 | 98 | ELRYRRAFSDLTSQL | YRRAFSDLT | 0.5259 | 169 | WB | BclX(L) |
| DRB1_0401 | 185 | NGGWDTFVELYGNNA | WDTFVELYG | 0.5189 | 182 | WB | BclX(L) |
| DRB1_0401 | 186 | GGWDTFVELYGNNAA | FVELYGNNA | 0.5180 | 184 | WB | BclX(L) |
| DRB1_0401 | 188 | WDTFVELYGNNAAAE | FVELYGNNA | 0.5159 | 188 | WB | BclX(L) |
| DRB1_0401 | 187 | GWDTFVELYGNNAAA | FVELYGNNA | 0.5157 | 189 | WB | BclX(L) |
| DRB1_0401 | 189 | DTFVELYGNNAAAES | FVELYGNNA | 0.5154 | 189 | WB | BclX(L) |
| DRB1_0401 | 100 | RYRRAFSDLTSQLHI | YRRAFSDLT | 0.4844 | 265 | WB | BclX(L) |
| DRB1_0401 | 101 | YRRAFSDLTSQLHIT | YRRAFSDLT | 0.4813 | 274 | WB | BclX(L) |
| DRB1_0401 | 153 | ESVDKEMQVLVSRIA | KEMQVLVSR | 0.4561 | 360 | WB | BclX(L) |
| DRB1_0401 | 155 | VDKEMQVLVSRIAAW | MQVLVSRIA | 0.4519 | 376 | WB | BclX(L) |

Fig. 37 continued

| | | | | | | |
|---|---|---|---|---|---|---|
| DRB1_0401 | 208 | ERFNRWFLTGMTVAG | WFLTGMTVA | 0.4512 | 379 | WB | BclX(L) |
| DRB1_0401 | 154 | SVDKEMQVLVSRIAA | MQVLVSRIA | 0.4495 | 386 | WB | BclX(L) |
| DRB1_0401 | 209 | RFNRWFLTGMTVAGV | FLTGMTVAG | 0.4467 | 398 | WB | BclX(L) |
| DRB1_0401 | 210 | FNRWFLTGMTVAGVV | FLTGMTVAG | 0.4427 | 416 | WB | BclX(L) |
| DRB1_0401 | 157 | KEMQVLVSRIAAWMA | MQVLVSRIA | 0.4419 | 419 | WB | BclX(L) |
| DRB1_0401 | 156 | DKEMQVLVSRIAAWM | MQVLVSRIA | 0.4413 | 422 | WB | BclX(L) |
| DRB1_0401 | 211 | NRWFLTGMTVAGVVL | FLTGMTVAG | 0.4327 | 463 | WB | BclX(L) |
| | | | | | | | |
| DRB1_0404 | 167 | AAWMATYLNDHLEPW | WMATYLNDH | 0.5484 | 132 | WB | BclX(L) |
| DRB1_0404 | 164 | SRIAAWMATYLNDHL | WMATYLNDH | 0.5424 | 141 | WB | BclX(L) |
| DRB1_0404 | 165 | RIAAWMATYLNDHLE | WMATYLNDH | 0.5417 | 142 | WB | BclX(L) |
| DRB1_0404 | 166 | IAAWMATYLNDHLEP | WMATYLNDH | 0.5330 | 156 | WB | BclX(L) |
| DRB1_0404 | 163 | VSRIAAWMATYLNDH | AAWMATYLN | 0.5217 | 177 | WB | BclX(L) |
| DRB1_0404 | 219 | TVAGVVLLGSLFSRK | VVLLGSLFS | 0.5094 | 202 | WB | BclX(L) |
| DRB1_0404 | 209 | RFNRWFLTGMTVAGV | FLTGMTVAG | 0.4902 | 249 | WB | BclX(L) |
| DRB1_0404 | 210 | FNRWFLTGMTVAGVV | FLTGMTVAG | 0.4853 | 262 | WB | BclX(L) |
| DRB1_0404 | 211 | NRWFLTGMTVAGVVL | FLTGMTVAG | 0.4826 | 270 | WB | BclX(L) |
| DRB1_0404 | 208 | ERFNRWFLTGMTVAG | WFLTGMTVA | 0.4761 | 290 | WB | BclX(L) |
| DRB1_0404 | 168 | AWMATYLNDHLEPWI | WMATYLNDH | 0.4694 | 311 | WB | BclX(L) |
| DRB1_0404 | 212 | RWFLTGMTVAGVVLL | FLTGMTVAG | 0.4547 | 365 | WB | BclX(L) |
| DRB1_0404 | 189 | DTFVELYGNNAAAES | FVELYGNNA | 0.4505 | 382 | WB | BclX(L) |
| DRB1_0404 | 187 | GWDTFVELYGNNAAA | FVELYGNNA | 0.4498 | 385 | WB | BclX(L) |
| DRB1_0404 | 169 | WMATYLNDHLEPWIQ | WMATYLNDH | 0.4478 | 393 | WB | BclX(L) |
| DRB1_0404 | 188 | WDTFVELYGNNAAAE | FVELYGNNA | 0.4462 | 400 | WB | BclX(L) |
| DRB1_0404 | 186 | GGWDTFVELYGNNAA | FVELYGNNA | 0.4437 | 411 | WB | BclX(L) |
| DRB1_0404 | 185 | NGGWDTFVELYGNNA | GWDTFVELY | 0.4388 | 434 | WB | BclX(L) |
| | | | | | | | |
| DRB1_0405 | 118 | TAYQSFEQVVNELFR | YQSFEQVVN | 0.5794 | 95 | WB | BclX(L) |
| DRB1_0405 | 117 | GTAYQSFEQVVNELF | YQSFEQVVN | 0.5772 | 97 | WB | BclX(L) |
| DRB1_0405 | 115 | TPGTAYQSFEQVVNE | YQSFEQVVN | 0.5541 | 124 | WB | BclX(L) |
| DRB1_0405 | 116 | PGTAYQSFEQVVNEL | YQSFEQVVN | 0.5538 | 125 | WB | BclX(L) |
| DRB1_0405 | 114 | ITPGTAYQSFEQVVN | AYQSFEQVV | 0.5505 | 129 | WB | BclX(L) |
| DRB1_0405 | 163 | VSRIAAWMATYLNDH | AAWMATYLN | 0.5510 | 129 | WB | BclX(L) |
| DRB1_0405 | 162 | LVSRIAAWMATYLND | AAWMATYLN | 0.5473 | 134 | WB | BclX(L) |
| DRB1_0405 | 161 | VLVSRIAAWMATYLN | IAAWMATYL | 0.5442 | 139 | WB | BclX(L) |
| DRB1_0405 | 164 | SRIAAWMATYLNDHL | AAWMATYLN | 0.5402 | 145 | WB | BclX(L) |
| DRB1_0405 | 99 | LRYRRAFSDLTSQLH | YRRAFSDLT | 0.5100 | 201 | WB | BclX(L) |
| DRB1_0405 | 97 | FELRYRRAFSDLTSQ | YRRAFSDLT | 0.5085 | 204 | WB | BclX(L) |
| DRB1_0405 | 96 | EFELRYRRAFSDLTS | YRRAFSDLT | 0.5069 | 208 | WB | BclX(L) |
| DRB1_0405 | 165 | RIAAWMATYLNDHLE | AAWMATYLN | 0.5055 | 211 | WB | BclX(L) |
| DRB1_0405 | 119 | AYQSFEQVVNELFRD | YQSFEQVVN | 0.4974 | 230 | WB | BclX(L) |
| DRB1_0405 | 120 | YQSFEQVVNELFRDG | YQSFEQVVN | 0.4968 | 231 | WB | BclX(L) |
| DRB1_0405 | 98 | ELRYRRAFSDLTSQL | YRRAFSDLT | 0.4923 | 243 | WB | BclX(L) |
| DRB1_0405 | 18 | SQKGYSWSQFSDVEE | GYSWSQFSD | 0.4575 | 354 | WB | BclX(L) |
| DRB1_0405 | 95 | DEFELRYRRAFSDLT | LRYRRAFSD | 0.4574 | 355 | WB | BclX(L) |
| DRB1_0405 | 19 | QKGYSWSQFSDVEEN | WSQFSDVEE | 0.4562 | 359 | WB | BclX(L) |
| DRB1_0405 | 100 | RYRRAFSDLTSQLHI | YRRAFSDLT | 0.4475 | 395 | WB | BclX(L) |
| DRB1_0405 | 20 | KGYSWSQFSDVEENR | WSQFSDVEE | 0.4430 | 414 | WB | BclX(L) |
| DRB1_0405 | 166 | IAAWMATYLNDHLEP | AAWMATYLN | 0.4423 | 418 | WB | BclX(L) |
| DRB1_0405 | 21 | GYSWSQFSDVEENRT | WSQFSDVEE | 0.4353 | 450 | WB | BclX(L) |
| | | | | | | | |
| DRB1_0701 | 157 | KEMQVLVSRIAAWMA | VLVSRIAAW | 0.5228 | 175 | WB | BclX(L) |
| DRB1_0701 | 159 | MQVLVSRIAAWMATY | VLVSRIAAW | 0.5194 | 181 | WB | BclX(L) |
| DRB1_0701 | 158 | EMQVLVSRIAAWMAT | VLVSRIAAW | 0.5191 | 182 | WB | BclX(L) |
| DRB1_0701 | 156 | DKEMQVLVSRIAAWM | VLVSRIAAW | 0.4971 | 231 | WB | BclX(L) |
| DRB1_0701 | 160 | QVLVSRIAAWMATYL | VLVSRIAAW | 0.4833 | 268 | WB | BclX(L) |
| DRB1_0701 | 46 | ETPSAINGNPSWHLA | INGNPSWHL | 0.4783 | 283 | WB | BclX(L) |
| DRB1_0701 | 45 | METPSAINGNPSWHL | AINGNPSWH | 0.4779 | 284 | WB | BclX(L) |
| DRB1_0701 | 155 | VDKEMQVLVSRIAAW | MQVLVSRIA | 0.4772 | 286 | WB | BclX(L) |
| DRB1_0701 | 47 | TPSAINGNPSWHLAD | INGNPSWHL | 0.4774 | 286 | WB | BclX(L) |
| DRB1_0701 | 48 | PSAINGNPSWHLADS | INGNPSWHL | 0.4764 | 289 | WB | BclX(L) |
| DRB1_0701 | 161 | VLVSRIAAWMATYLN | VLVSRIAAW | 0.4745 | 295 | WB | BclX(L) |
| DRB1_0701 | 49 | SAINGNPSWHLADSP | INGNPSWHL | 0.4718 | 303 | WB | BclX(L) |
| DRB1_0701 | 99 | LRYRRAFSDLTSQLH | YRRAFSDLT | 0.4627 | 335 | WB | BclX(L) |
| DRB1_0701 | 100 | RYRRAFSDLTSQLHI | FSDLTQLH | 0.4416 | 420 | WB | BclX(L) |
| DRB1_0701 | 101 | YRRAFSDLTSQLHIT | FSDLTQLH | 0.4344 | 455 | WB | BclX(L) |
| DRB1_0701 | 51 | INGNPSWHLADSPAV | INGNPSWHL | 0.4291 | 481 | WB | BclX(L) |

Fig. 37 continued

| | | | | | | |
|---|---|---|---|---|---|---|
| DRB1_0901 | 55 | PSWHLADSPAVNGAT | WHLADSPAV | 0.5482 | 133 | WB | BclX(L) |
| DRB1_0901 | 54 | NPSWHLADSPAVNGA | WHLADSPAV | 0.5414 | 143 | WB | BclX(L) |
| DRB1_0901 | 53 | GNPSWHLADSPAVNG | WHLADSPAV | 0.5408 | 144 | WB | BclX(L) |
| DRB1_0901 | 51 | INGNPSWHLADSPAV | SWHLADSPA | 0.5289 | 164 | WB | BclX(L) |
| DRB1_0901 | 52 | NGNPSWHLADSPAVN | WHLADSPAV | 0.5284 | 164 | WB | BclX(L) |
| DRB1_0901 | 56 | SWHLADSPAVNGATG | WHLADSPAV | 0.4678 | 317 | WB | BclX(L) |
| DRB1_0901 | 57 | WHLADSPAVNGATGH | WHLADSPAV | 0.4636 | 331 | WB | BclX(L) |
| DRB1_0901 | 212 | RWFLTGMTVAGVVLL | FLTGMTVAG | 0.4483 | 391 | WB | BclX(L) |
| DRB1_0901 | 213 | WFLTGMTVAGVVLLG | MTVAGVVLL | 0.4445 | 408 | WB | BclX(L) |
| DRB1_0901 | 214 | FLTGMTVAGVVLLGS | MTVAGVVLL | 0.4327 | 463 | WB | BclX(L) |
| DRB1_1101 | 157 | KEMQVLVSRIAAWMA | MQVLVSRIA | 0.4319 | 467 | WB | BclX(L) |
| DRB1_1101 | 131 | FRDGVNWGRIVAFFS | GVNWGRIVA | 0.4310 | 472 | WB | BclX(L) |
| DRB1_1101 | 156 | DKEMQVLVSRIAAWM | MQVLVSRIA | 0.4308 | 473 | WB | BclX(L) |
| DRB1_1101 | 155 | VDKEMQVLVSRIAAW | MQVLVSRIA | 0.4292 | 481 | WB | BclX(L) |
| DRB1_1101 | 132 | RDGVNWGRIVAFFSF | GVNWGRIVA | 0.4283 | 486 | WB | BclX(L) |
| DRB1_1101 | 154 | SVDKEMQVLVSRIAA | MQVLVSRIA | 0.4267 | 494 | WB | BclX(L) |
| DRB1_1302 | 218 | MTVAGVVLLGSLFSR | VVLLGSLFS | 0.4945 | 237 | WB | BclX(L) |
| DRB1_1302 | 216 | TGMTVAGVVLLGSLF | MTVAGVVLL | 0.4855 | 262 | WB | BclX(L) |
| DRB1_1302 | 214 | FLTGMTVAGVVLLGS | MTVAGVVLL | 0.4842 | 265 | WB | BclX(L) |
| DRB1_1302 | 217 | GMTVAGVVLLGSLFS | MTVAGVVLL | 0.4840 | 266 | WB | BclX(L) |
| DRB1_1302 | 212 | RWFLTGMTVAGVVLL | FLTGMTVAG | 0.4832 | 268 | WB | BclX(L) |
| DRB1_1302 | 215 | LTGMTVAGVVLLGSL | MTVAGVVLL | 0.4775 | 285 | WB | BclX(L) |
| DRB1_1302 | 213 | WFLTGMTVAGVVLLG | MTVAGVVLL | 0.4716 | 304 | WB | BclX(L) |
| DRB1_1302 | 189 | DTFVELYGNNAAAES | VELYGNNAA | 0.4688 | 313 | WB | BclX(L) |
| DRB1_1302 | 190 | TFVELYGNNAAAESR | YGNNAAAES | 0.4615 | 339 | WB | BclX(L) |
| DRB1_1302 | 191 | FVELYGNNAAAESRK | YGNNAAAES | 0.4526 | 373 | WB | BclX(L) |
| DRB1_1302 | 192 | VELYGNNAAAESRKG | YGNNAAAES | 0.4415 | 421 | WB | BclX(L) |
| DRB1_1302 | 219 | TVAGVVLLGSLFSRK | VVLLGSLFS | 0.4384 | 436 | WB | BclX(L) |
| DRB1_1302 | 193 | ELYGNNAAAESRKGQ | YGNNAAAES | 0.4275 | 490 | WB | BclX(L) |
| DRB1_1501 | 219 | TVAGVVLLGSLFSRK | VLLGSLFSR | 0.6681 | 36 | SB | BclX(L) |
| DRB1_1501 | 218 | MTVAGVVLLGSLFSR | VVLLGSLFS | 0.6441 | 47 | SB | BclX(L) |
| DRB1_1501 | 6 | RELVVDFLSYKLSQK | LVVDFLSYK | 0.5208 | 179 | WB | BclX(L) |
| DRB1_1501 | 7 | ELVVDFLSYKLSQKG | FLSYKLSQK | 0.5009 | 221 | WB | BclX(L) |
| DRB1_1501 | 157 | KEMQVLVSRIAAWMA | MQVLVSRIA | 0.4968 | 231 | WB | BclX(L) |
| DRB1_1501 | 156 | DKEMQVLVSRIAAWM | MQVLVSRIA | 0.4965 | 232 | WB | BclX(L) |
| DRB1_1501 | 209 | RFNRWFLTGMTVAGV | FNRWFLTGM | 0.4870 | 257 | WB | BclX(L) |
| DRB1_1501 | 164 | SRIAAWMATYLNDHL | WMATYLNDH | 0.4849 | 263 | WB | BclX(L) |
| DRB1_1501 | 210 | FNRWFLTGMTVAGVV | LTGMTVAGV | 0.4836 | 267 | WB | BclX(L) |
| DRB1_1501 | 8 | LVVDFLSYKLSQKGY | FLSYKLSQK | 0.4778 | 284 | WB | BclX(L) |
| DRB1_1501 | 5 | NRELVVDFLSYKLSQ | LVVDFLSYK | 0.4777 | 285 | WB | BclX(L) |
| DRB1_1501 | 135 | VNWGRIVAFFSFGGA | IVAFFSFGG | 0.4756 | 291 | WB | BclX(L) |
| DRB1_1501 | 4 | SNRELVVDFLSYKLS | LVVDFLSYK | 0.4755 | 291 | WB | BclX(L) |
| DRB1_1501 | 159 | MQVLVSRIAAWMATY | LVSRIAAWM | 0.4693 | 312 | WB | BclX(L) |
| DRB1_1501 | 163 | VSRIAAWMATYLNDH | IAAWMATYL | 0.4691 | 312 | WB | BclX(L) |
| DRB1_1501 | 158 | EMQVLVSRIAAWMAT | VLVSRIAAW | 0.4683 | 315 | WB | BclX(L) |
| DRB1_1501 | 165 | RIAAWMATYLNDHLE | WMATYLNDH | 0.4685 | 315 | WB | BclX(L) |
| DRB1_1501 | 128 | NELFRDGVNWGRIVA | LFRDGVNWG | 0.4675 | 318 | WB | BclX(L) |
| DRB1_1501 | 125 | QVVNELFRDGVNWGR | LFRDGVNWG | 0.4668 | 320 | WB | BclX(L) |
| DRB1_1501 | 126 | VVNELFRDGVNWGRI | LFRDGVNWG | 0.4668 | 320 | WB | BclX(L) |
| DRB1_1501 | 166 | IAAWMATYLNDHLEP | WMATYLNDH | 0.4649 | 327 | WB | BclX(L) |
| DRB1_1501 | 137 | WGRIVAFFSFGGALC | IVAFFSFGG | 0.4643 | 329 | WB | BclX(L) |
| DRB1_1501 | 136 | NWGRIVAFFSFGGAL | IVAFFSFGG | 0.4638 | 331 | WB | BclX(L) |
| DRB1_1501 | 207 | QERFNRWFLTGMTVA | FNRWFLTGM | 0.4608 | 342 | WB | BclX(L) |
| DRB1_1501 | 208 | ERFNRWFLTGMTVAG | FNRWFLTGM | 0.4602 | 344 | WB | BclX(L) |
| DRB1_1501 | 138 | GRIVAFFSFGGALCV | IVAFFSFGG | 0.4587 | 350 | WB | BclX(L) |
| DRB1_1501 | 9 | VVDFLSYKLSQKGYS | FLSYKLSQK | 0.4584 | 351 | WB | BclX(L) |
| DRB1_1501 | 155 | VDKEMQVLVSRIAAW | MQVLVSRIA | 0.4570 | 356 | WB | BclX(L) |
| DRB1_1501 | 167 | AAWMATYLNDHLEPW | WMATYLNDH | 0.4551 | 364 | WB | BclX(L) |
| DRB1_1501 | 3 | QSNRELVVDFLSYKL | LVVDFLSYK | 0.4543 | 367 | WB | BclX(L) |
| DRB1_1501 | 127 | VNELFRDGVNWGRIV | LFRDGVNWG | 0.4431 | 414 | WB | BclX(L) |
| DRB1_1501 | 134 | GVNWGRIVAFFSFGG | VNWGRIVAF | 0.4391 | 432 | WB | BclX(L) |
| DRB1_1501 | 129 | ELFRDGVNWGRIVAF | LFRDGVNWG | 0.4390 | 433 | WB | BclX(L) |
| DRB1_1501 | 217 | GMTVAGVVLLGSLFS | VAGVVLLGS | 0.4377 | 439 | WB | BclX(L) |

Fig. 37 continued

| | | | | | | | |
|---|---|---|---|---|---|---|---|
| DRB1_1501 | 124 | EQVVNELFRDGVNWG | VVNELFRDG | 0.4373 | 441 | WB | BclX(L) |
| DRB1_1501 | 139 | RIVAFFSFGGALCVE | IVAFFSFGG | 0.4300 | 477 | WB | BclX(L) |
| DRB1_1501 | 211 | NRWFLTGMTVAGVVL | LTGMTVAGV | 0.4264 | 496 | WB | BclX(L) |
| DRB4_0101 | 99 | LRYRRAFSDLTSQLH | YRRAFSDLT | 0.4654 | 325 | WB | BclX(L) |
| DRB4_0101 | 100 | RYRRAFSDLTSQLHI | FSDLTSQLH | 0.4328 | 463 | WB | BclX(L) |

| Antigen | Sequence |
|---|---|
| <ABX71745 CRASP-2,Borrelia Burgdorferi><br><br>SEQ ID NO: 45, SEQ ID NO:146963 | <ABX71745 CRASP-2;Protein;Borrelia burgdorferi><br>mkksflsiymlisisllscdvsrlnqrnidelkifvekakyysikldaiyseytgayndimtyimtysegts sdkskvnqaisilkkdnkivnkfkelekiieeykpmflskliddfaieldqavdndvsnarhvadsye klrksvalayiesfdvisskfvdskfveaskkfvnkakefveendlialkcivktigdmvndreinsrsry nnfykkeadflgaavelegaykaikqtll |
| <CAH10086 CRASP-1,Borrelia garinii><br><br>SEQ ID NO: 46, SEQ ID NO:146964 | <CAH10086 CRASP-1;Protein;Borrelia garinii><br>mkktklniiklnilttiltlliciscavdkidpesksktntkdfenksqdlepsntknkdleplekinsketiiskl ekmikdledqkdqedteiakitntqidflenfksephdtisediemkikriiysslnyeieklintlkeildkl yknhkykttarnfilnisikiqfqienalelmkeeiedaseilnqeryeillkhvepslnlkqkfekilnetik aynqdldniksnedqlahmdenykefdplnldy |
| <AAU07022 4-alpha-glucanotransferase,Borrelia garinii PBi><br><br>SEQ ID NO: 47, SEQ ID NO:146965 | <AAU07022 4-alpha-glucanotransferase;Protein;Borrelia garinii PBi><br>Mkykkirinlnlkrksgillnisslpskygigdlgkgaykfidflfassqsywqmfayspidftrsppysif safagnvyyidlealdkfidsdlnlikenetrysdlkklsfkdkflkeaalnfinrasvdevrsfekfkkks sywlldfasfvafkeyflkdsrdafnvlfdrgilirnekdlfklrnilskeikvqevlqyfffsqfqalkryand kgielvmnlplfiaydsadvwahqkyfklrfdaskdkvagispdyfleqeqawdspayswnvlknv kyewwakrigilrkyidvikidhfrgfvstwevgvgeayafnglwvkspgrdffnfilneikdlkiwvedf endledvsrlrdffnfpgmrimklafdfdsdnqnlphnyikncivytgigdnstirefvnslddlhkkyif dylntnedfvvwdmirsamssvsdsviipmqdyinlgnefranipkntlnnwifrllesdldatlsknis fitrlygrt |
| <CAA59725 outer surface protein A,Borrelia afzelii><br><br>SEQ ID NO: 48, SEQ ID NO:146966 | <CAA59725 outer surface protein A;Protein;Borrelia afzelii><br>mkkyllgiglilaliackqnvssldeknsasvdlpgemkvlvskekdkdgkyslkatvdkielkgtsdk dngsgvlegtkddkskakltiaddlskttfelfkedgktlvsrkvsskdktstdemfnekgelsaktmtr engtkleytemksdgtgkakevlknftlegkvandkvtlevkegtvtlskeiaksgevtvalndtnttq atkktgawdsktstltisvnskkttqlvftkqdtitvqkydsagtnlegtaveiktldelknalk |
| <CAA59727 outer surface protein A,Borrelia garinii><br><br>SEQ ID NO: 49, SEQ ID NO:146967 | <CAA59727 outer surface protein A;Protein;Borrelia garinii><br>Mkkyllgiglilaliackqnvssldeknsvsvdlpggmkvlvskekdkdgkyslmatveklelkgtsd knngsgtlegektdkskvkltiaedlskttfeifkedgktlvskkvtlkdkssteekfnekgeisektivra ngtrleytdiksdgsgkakevlkdftlegtlaadgkttlkvtegtvvlsknilksgeitvalddsdttqatkkt gkwdsktstltisvnsqktknlvftkedtitvqkydsagtnlegkaveittleklkdalk |
| <YP_853838 outer surface protein B,Borrelia | <YP_853838 outer surface protein B;Protein;Borrelia afzelii PKo><br>Mkqyllvfalvlaliacsqkgtepkstsqdhndqeiinsdntpkdskkdltvlaeensvplfngnkifvs keknsagkyelratvdtvelkgvsdknngsgklegtkadktkvamtiaddlntitvetydasnkktgs evvkkqgsvikesykankldskkitrenettleysemtdssnatkavetlkngiklegslvggkttvklt |

| | |
|---|---|
| afzelii PKo><br><br>SEQ ID NO: 50,

Fig. 39.

<ABX71745 CRASP-2;Protein;Borrelia burgdorferi>
Seq ID No 146974-148805

8 mers:
mkksflsi;kksflsiy;ksflsiym;sflsiyml;flsiymli;lsiymlis;siymlisi;iymlisis;ymlisisl;mlisisll;lisislls;
isisllsc;sisllscd;isllscdv;sllscdvs;llscdvsr;lscdvsrl;scdvsrln;cdvsrlnq;dvsrlnqr;vsrlnqrn;srlnqrni;
rlnqrnid;lnqrnide;nqrnidel;qrnidelk;rnidelki;nidelkif;idelkifv;delkifve;elkifvek;lkifveka;kifvek
ak;ifvekaky;fvekakyy;vekakyys;ekakyysi;kakyysik;akyysikl;kyysikld;yysiklda;ysikldai;siklda
iy;ikldaiys;kldaiyse;ldaiysey;daiyseyt;aiyseytg;iyseytga;yseytgay;seytgayn;eytgaynd;ytgayndi
;tgayndim;gayndimt;ayndimty;yndimtyi;ndimtyim;dimtyimt;imtyimty;mtyimtys;tyimtyse;yim
tyseg;imtysegt;mtysegts;tysegtss;ysegtssd;segtssdk;egtssdks;gtssdksk;tssdkskv;ssdkskvn;sdks
kvnq;dkskvnqa;kskvnqai;skvnqais;kvnqaisi;vnqaisil;nqaisilk;qaisilkk;aisilkkd;isilkkdn;silkkd
nk;ilkkdnki;lkkdnkiv;kkdnkivn;kdnkivnk;dnkivnkf;nkivnkfk;kivnkfke;ivnkfkel;vnkfkele;nkfk
elek;kfkeleki;fkelekii;kelekiie;elekiiee;lekiieey;ekiieeyk;kiieeykp;iieeykpm;ieeykpmf;eeykpm
fl;eykpmfls;ykpmflsk;kpmflskl;pmflskli;mflsklid;flsklidd;lskliddf;skliddfa;kliddfai;liddfaie;id
dfaiel;ddfaield;dfaieldq;faieldqa;aieldqav;ieldqavd;eldqavdn;ldqavdnd;dqavdndv;qavdndvs;av
dndvsn;vdndvsna;dndvsnar;ndvsnarh;dvsnarhv;vsnarhva;snarhvad;narhvads;arhvadsy;rhvads
ye;hvadsyek;vadsyekl;adsyeklr;dsyeklrk;syeklrks;yeklrksv;eklrksva;klrksval;lrksvala;rksvala
y;ksvalayi;svalayie;valayies;alayiesf;layiesfd;ayiesfdv;yiesfdvi;iesfdvis;esfdviss;sfdvissk;fdvi
sskf;dvisskfv;visskfvd;isskfvds;sskfvdsk;skfvdskf;kfvdskfv;fvdskfve;vdskfvea;dskfveas;skfve
ask;kfveaskk;fveaskkf;veaskkfv;easkkfvn;askkfvnk;skkfvnka;kkfvnkak;kfvnkake;fvnkakef;vn
kakefv;nkakefve;kakefvee;akefveen;kefveend;efveendl;fveendli;veendlia;eendlial;endlialk;nd
lialkc;dlialkci;lialkciv;ialkcivk;alkcivkt;lkcivkti;kcivktig;civktigd;ivktigdm;vktigdmv;ktigdm
vn;tigdmvnd;igdmvndr;gdmvndre;dmvndrei;mvndrein;vndreins;ndreinsr;dreinsrs;reinsrsr;eins
rsry;insrsryn;nsrsrynn;srsrynnf;rsrynnfy;srynnfyk;rynnfykk;ynnfykke;nnfykkea;nfykkead;fyk
keadf;ykkeadfl;kkeadflg;keadflga;eadflgaa;adflgaav;dflgaave;flgaavel;lgaavele;gaaveleg;aave
lega;avelegay;velegayk;elegayka;legaykai;egaykaik;gaykaikq;aykaikqt;ykaikqtl;kaikqtll;

9 mers:
mkksflsiy;kksflsiym;ksflsiyml;sflsiymli;flsiymlis;lsiymlisi;siymlisis;iymlisisl;ymlisisll;mlisisl
ls;lisisllsc;isisllscd;sisllscdv;isllscdvs;sllscdvsr;llscdvsrl;lscdvsrln;scdvsrlnq;cdvsrlnqr;dvsrlnq
rn;vsrlnqrni;srlnqrnid;rlnqrnide;lnqrnidel;nqrnidelk;qrnidelki;rnidelkif;nidelkifv;idelkifve;del
kifvek;elkifveka;lkifvekak;kifvekaky;ifvekakyy;fvekakyys;vekakyysi;ekakyysik;kakyysikl;ak
yysikld;kyysiklda;yysikldai;ysikldaiy;sikldaiys;ikldaiyse;kldaiysey;ldaiyseyt;daiyseytg;aiysey
tga;iyseytgay;yseytgayn;seytgaynd;eytgayndi;ytgayndim;tgayndimt;gayndimty;ayndimtyi;ynd
imtyim;ndimtyimt;dimtyimty;imtyimtys;mtyimtyse;tyimtyseg;yimtysegt;imtysegts;mtysegtss;
tysegtssd;ysegtssdk;segtssdks;egtssdksk;gtssdkskv;tssdkskvn;ssdkskvnq;sdkskvnqa;dkskvnqa
i;kskvnqais;skvnqaisi;kvnqaisil;vnqaisilk;nqaisilkk;qaisilkkd;aisilkkdn;isilkkdnk;silkkdnki;ilk
kdnkiv;lkkdnkivn;kkdnkivnk;kdnkivnkf;dnkivnkfk;nkivnkfke;kivnkfkel;ivnkfkele;vnkfkelek;
nkfkeleki;kfkelekii;fkelekiie;kelekiiee;elekiieey;lekiieeyk;ekiieeykp;kiieeykpm;iieeykpmf;iee
ykpmfl;eeykpmfls;eykpmflsk;ykpmflskl;kpmflskli;pmflsklid;mflsklidd;flskliddf;lskliddfa;skli
ddfai;kliddfaie;liddfaiel;iddfaield;ddfaieldq;dfaieldqa;faieldqav;aieldqavd;ieldqavdn;eldqavdn
d;ldqavdndv;dqavdndvs;qavdndvsn;avdndvsna;vdndvsnar;dndvsnarh;ndvsnarhv;dvsnarhva;vs narhvad;snarhvads;narhvadsy;arhvadsye;rhvadsyek;hvadsyekl;vadsyeklr;adsyeklrk;dsyeklrks;syeklrksv;yeklrksva;eklrksval;klrksvala;lrksvalay;rksvalayi;ksvalayie;svalayies;valayiesf;alayiesfd;layiesfdv;ayiesfdvi;yiesfdvis;iesfdviss;esfdvissk;sfdvisskf;fdvisskfv;dvisskfvd;visskfvds;isskfvdsk;sskfvdskf;skfvdskfv;kfvdskfve;fvdskfvea;vdskfveas;dskfveask;skfveaskk;kfveaskkf;fveaskkfv;veaskkfvn;easkkfvnk;askkfvnka;skkfvnkak;kkfvnkake;kfvnkakef;fvnkakefv;vnkakefve;nkakefvee;kakefveen;akefveend;kefveendl;efveendli;fveendlia;veendlial;eendlialk;endlialkc;ndlialkci;dlialkciv;lialkcivk;ialkcivkt;alkcivkti;lkcivktig;kcivktigd;civktigdm;ivktigdmv;vktigdmvn;ktigdmvnd;tigdmvndr;igdmvndre;gdmvndrei;dmvndrein;mvndreins;vndreinsr;ndreinsrs;dreinsrsr;reinsrsry;einsrsryn;insrsrynn;nsrsrynnf;srsrynnfy;rsrynnfyk;srynnfykk;rynnfykke;ynnfykkea;nnfykkead;nfykkeadf;fykkeadfl;ykkeadflg;kkeadflga;keadflgaa;eadflgaav;adflgaave;dflgaavel;flgaavele;lgaaveleg;gaavelega;aavelegay;avelegayk;velegayka;elegaykai;legaykaik;egaykaikq;gaykaikqt;aykaikqtl;ykaikqtll;

10 mers:
mkksflsiym;kksflsiyml;ksflsiymli;sflsiymlis;flsiymlisi;lsiymlisis;siymlisisl;iymlisisll;ymlisislls;mlisisllsc;lisisllscd;isisllscdv;sisllscdvs;isllscdvsr;sllscdvsrl;llscdvsrln;lscdvsrlnq;scdvsrlnqr;cdvsrlnqrn;dvsrlnqrni;vsrlnqrnid;srlnqrnide;rlnqrnidel;lnqrnidelk;nqrnidelki;qrnidelkif;rnidelkifv;nidelkifve;idelkifvek;delkifveka;elkifvekak;lkifvekaky;kifvekakyy;ifvekakyys;fvekakyysi;vekakyysik;ekakyysikl;kakyysikld;akyysiklda;kyysikldai;yysikldaiy;ysikldaiys;sikldaiyse;ikldaiysey;kldaiyseyt;ldaiyseytg;daiyseytga;aiyseytgay;iyseytgayn;yseytgaynd;seytgayndi;eytgayndim;ytgayndimt;tgayndimty;gayndimtyi;ayndimtyim;yndimtyimt;ndimtyimty;dimtyimtys;imtyimtyse;mtyimtyseg;tyimtysegt;yimtysegts;imtysegtss;mtysegtssd;tysegtssdk;ysegtssdks;segtssdksk;egtssdkskv;gtssdkskvn;tssdkskvnq;ssdkskvnqa;sdkskvnqai;dkskvnqais;kskvnqaisi;skvnqaisil;kvnqaisilk;vnqaisilkk;nqaisilkkd;qaisilkkdn;aisilkkdnk;isilkkdnki;silkkdnkiv;ilkkdnkivn;lkkdnkivnk;kkdnkivnkf;kdnkivnkfk;dnkivnkfke;nkivnkfkel;kivnkfkele;ivnkfkelek;vnkfkeleki;nkfkelekii;kfkelekiie;fkelekiiee;kelekiieey;elekiieeyk;lekiieeykp;ekiieeykpm;kiieeykpmf;iieeykpmfl;ieeykpmfls;eeykpmflsk;eykpmflskl;ykpmflskli;kpmflsklid;pmflsklidd;mflskliddf;flskliddfa;lskliddfai;skliddfaie;kliddfaiel;liddfaield;iddfaieldq;ddfaieldqa;dfaieldqav;faieldqavd;aieldqavdn;ieldqavdnd;eldqavdndv;ldqavdndvs;dqavdndvsn;qavdndvsna;avdndvsnar;vdndvsnarh;dndvsnarhv;ndvsnarhva;dvsnarhvad;vsnarhvads;snarhvadsy;narhvadsye;arhvadsyek;rhvadsyekl;hvadsyeklr;vadsyeklrk;adsyeklrks;dsyeklrksv;syeklrksva;yeklrksval;eklrksvala;klrksvalay;lrksvalayi;rksvalayie;ksvalayies;svalayiesf;valayiesfd;alayiesfdv;layiesfdvi;ayiesfdvis;yiesfdviss;iesfdvissk;esfdvisskf;sfdvisskfv;fdvisskfvd;dvisskfvds;visskfvdsk;isskfvdskf;sskfvdskfv;skfvdskfve;kfvdskfvea;fvdskfveas;vdskfveask;dskfveaskk;skfveaskkf;kfveaskkfv;fveaskkfvn;veaskkfvnk;easkkfvnka;askkfvnkak;skkfvnkake;kkfvnkakef;kfvnkakefv;fvnkakefve;vnkakefvee;nkakefveen;kakefveend;akefveendl;kefveendli;efveendlia;fveendlial;veendlialk;eendlialkc;endlialkci;ndlialkciv;dlialkcivk;lialkcivkt;ialkcivkti;alkcivktig;lkcivktigd;kcivktigdm;civktigdmv;ivktigdmvn;vktigdmvnd;ktigdmvndr;tigdmvndre;igdmvndrei;gdmvndrein;dmvndreins;mvndreinsr;vndreinsrs;ndreinsrsr;dreinsrsry;reinsrsryn;einsrsrynn;insrsrynnf;nsrsrynnfy;srsrynnfyk;rsrynnfykk;srynnfykke;rynnfykkea;ynnfykkead;nnfykkeadf;nfykkeadfl;fykkeadflg;ykkeadflga;kkeadflgaa;keadflgaav;eadflgaave;adflgaavel;dflgaavele;flgaaveleg;lgaavelega;gaavelegay;aavelegayk;avelegayka;velegaykai;elegaykaik;legaykaikq;egaykaikqt;gaykaikqtl;aykaikqtll;

11 mers:

Fig. 39 continued mkksflsiyml;kksflsiymli;ksflsiymlis;sflsiymlisi;flsiymlisis;lsiymlisisl;siymlisisll;iymlisislls;y
mlisisllsc;mlisisllscd;lisisllscdv;isisllscdvs;sisllscdvsr;isllscdvsrl;sllscdvsrln;llscdvsrlnq;lscdvs
rlnqr;scdvsrlnqrn;cdvsrlnqrni;dvsrlnqrnid;vsrlnqrnide;srlnqrnidel;rlnqrnidelk;lnqrnidelki;nqrn
idelkif;qrnidelkifv;rnidelkifve;nidelkifvek;idelkifveka;delkifvekak;elkifvekaky;lkifvekakyy;ki
fvekakyys;ifvekakyysi;fvekakyysik;vekakyysikl;ekakyysikld;kakyysiklda;akyysikldai;kyysikl
daiy;yysikldaiys;ysikldaiyse;sikldaiysey;ikldaiyseyt;kldaiyseytg;ldaiyseytga;daiyseytgay;aiys
eytgayn;iyseytgaynd;yseytgayndi;seytgayndim;eytgayndimt;ytgayndimty;tgayndimtyi;gayndi
mtyim;ayndimtyimt;yndimtyimty;ndimtyimtys;dimtyimtyse;imtyimtyseg;mtyimtysegt;tyimty
segts;yimtysegtss;imtysegtssd;mtysegtssdk;tysegtssdks;ysegtssdksk;segtssdkskv;egtssdkskvn;
gtssdkskvnq;tssdkskvnqa;ssdkskvnqai;sdkskvnqais;dkskvnqaisi;kskvnqaisil;skvnqaisilk;kvnq
aisilkk;vnqaisilkkd;nqaisilkkdn;qaisilkkdnk;aisilkkdnki;isilkkdnkiv;silkkdnkivn;ilkkdnkivnk;l
kkdnkivnkf;kkdnkivnkfk;kdnkivnkfke;dnkivnkfkel;nkivnkfkele;kivnkfkelek;ivnkfkeleki;vnkf
kelekii;nkfkelekiie;kfkelekiiee;fkelekiieey;kelekiieeyk;elekiieeykp;lekiieeykpm;ekiieeykpmf;
kiieeykpmfl;iieeykpmfls;ieeykpmflsk;eeykpmflskl;eykpmflskli;ykpmflsklid;kpmflsklidd;pmfl
skliddf;mflskliddfa;flskliddfai;lskliddfaie;skliddfaiel;kliddfaield;liddfaieldq;iddfaieldqa;ddfai
eldqav;dfaieldqavd;faieldqavdn;aieldqavdnd;ieldqavdndv;eldqavdndvs;ldqavdndvsn;dqavdnd
vsna;qavdndvsnar;avdndvsnarh;vdndvsnarhv;dndvsnarhva;ndvsnarhvad;dvsnarhvads;vsnarhv
adsy;snarhvadsye;narhvadsyek;arhvadsyekl;rhvadsyeklr;hvadsyeklrk;vadsyeklrks;adsyeklrksv
;dsyeklrksva;syeklrksval;yeklrksvala;eklrksvalay;klrksvalayi;lrksvalayie;rksvalayies;ksvalayi
esf;svalayiesfd;valayiesfdv;alayiesfdvi;layiesfdvis;ayiesfdviss;yiesfdvissk;iesfdvisskf;esfdviss
kfv;sfdvisskfvd;fdvisskfvds;dvisskfvdsk;visskfvdskf;isskfvdskfv;sskfvdskfve;skfvdskfvea;kfv
dskfveas;fvdskfveask;vdskfveaskk;dskfveaskkf;skfveaskkfv;kfveaskkfvn;fveaskkfvnk;veaskk
fvnka;easkkfvnkak;askkfvnkake;skkfvnkakef;kkfvnkakefv;kfvnkakefve;fvnkakefvee;vnkakef
veen;nkakefveend;kakefveendl;akefveendli;kefveendlia;efveendlial;fveendlialk;veendlialkc;e
endlialkci;endlialkciv;ndlialkcivk;dlialkcivkt;lialkcivkti;ialkcivktig;alkcivktigd;lkcivktigdm;k
civktigdmv;civktigdmvn;ivktigdmvnd;vktigdmvndr;ktigdmvndre;tigdmvndrei;igdmvndrein;g
dmvndreins;dmvndreinsr;mvndreinsrs;vndreinsrsr;ndreinsrsry;dreinsrsryn;reinsrsrynn;einsrsr
ynnf;insrsrynnfy;nsrsrynnfyk;srsrynnfykk;rsrynnfykke;srynnfykkea;rynnfykkead;ynnfykkeadf
;nnfykkeadfl;nfykkeadflg;fykkeadflga;ykkeadflgaa;kkeadflgaav;keadflgaave;eadflgaavel;adfl
gaavele;dflgaaveleg;flgaavelega;lgaavelegay;gaavelegayk;aavelegayka;avelegaykai;velegayk
aik;elegaykaikq;legaykaikqt;egaykaikqtl;gaykaikqtll;

13 mers:
mkksflsiymlis;kksflsiymlisi;ksflsiymlisis;sflsiymlisisl;flsiymlisisll;lsiymlisislls;siymlisisllsc;i
ymlisisllscd;ymlisisllscdv;mlisisllscdvs;lisisllscdvsr;isisllscdvsrl;sisllscdvsrln;isllscdvsrlnq;sll
scdvsrlnqr;llscdvsrlnqrn;lscdvsrlnqrni;scdvsrlnqrnid;cdvsrlnqrnide;dvsrlnqrnidel;vsrlnqrnidel
k;srlnqrnidelki;rlnqrnidelkif;lnqrnidelkifv;nqrnidelkifve;qrnidelkifvek;rnidelkifveka;nidelkifv
ekak;idelkifvekaky;delkifvekakyy;elkifvekakyys;lkifvekakyysi;kifvekakyysik;ifvekakyysikl;f
vekakyysikld;vekakyysiklda;ekakyysikldai;kakyysikldaiy;akyysikldaiys;kyysikldaiyse;yysikl
daiysey;ysikldaiyseyt;sikldaiyseytg;ikldaiyseytga;kldaiyseytgay;ldaiyseytgayn;daiyseytgaynd;
aiyseytgayndi;iyseytgayndim;yseytgayndimt;seytgayndimty;eytgayndimtyi;ytgayndimtyim;tg
ayndimtyimt;gayndimtyimty;ayndimtyimtys;yndimtyimtyse;ndimtyimtyseg;dimtyimtysegt;im
tyimtysegts;mtyimtysegtss;tyimtysegtssd;yimtysegtssdk;imtysegtssdks;mtysegtssdksk;tysegts
sdkskv;ysegtssdkskvn;segtssdkskvnq;egtssdkskvnqa;gtssdkskvnqai;tssdkskvnqais;ssdkskvnqa
isi;sdkskvnqaisil;dkskvnqaisilk;kskvnqaisilkk;skvnqaisilkkd;kvnqaisilkkdn;vnqaisilkkdnk;nqa

Fig. 39 continued isilkkdnki;qaisilkkdnkiv;aisilkkdnkivn;isilkkdnkivnk;silkkdnkivnkf;ilkkdnkivnkfk;lkkdnkivn
kfke;kkdnkivnkfkel;kdnkivnkfkele;dnkivnkfkelek;nkivnkfkeleki;kivnkfkelekii;ivnkfkelekiie;v
nkfkelekiiee;nkfkelekiieey;kfkelekiieeyk;fkelekiieeykp;kelekiieeykpm;elekiieeykpmf;lekiieey
kpmfl;ekiieeykpmfls;kiieeykpmflsk;iieeykpmflskl;ieeykpmflskli;eeykpmflsklid;eykpmflsklid
d;ykpmflskliddf;kpmflskliddfa;pmflskliddfai;mflskliddfaie;flskliddfaiel;lskliddfaield;skliddfai
eldq;kliddfaieldqa;liddfaieldqav;iddfaieldqavd;ddfaieldqavdn;dfaieldqavdnd;faieldqavdndv;ai
eldqavdndvs;ieldqavdndvsn;eldqavdndvsna;ldqavdndvsnar;dqavdndvsnarh;qavdndvsnarhv;av
dndvsnarhva;vdndvsnarhvad;dndvsnarhvads;ndvsnarhvadsy;dvsnarhvadsye;vsnarhvadsyek;sn
arhvadsyekl;narhvadsyeklr;arhvadsyeklrk;rhvadsyeklrks;hvadsyeklrksv;vadsyeklrksva;adsyek
lrksval;dsyeklrksvala;syeklrksvalay;yeklrksvalayi;eklrksvalayie;klrksvalayies;lrksvalayiesf;rk
svalayiesfd;ksvalayiesfdv;svalayiesfdvi;valayiesfdvis;alayiesfdviss;layiesfdvissk;ayiesfdvissk
f;yiesfdvisskfv;iesfdvisskfvd;esfdvisskfvds;sfdvisskfvdsk;fdvisskfvdskf;dvisskfvdskfv;visskf
vdskfve;isskfvdskfvea;sskfvdskfveas;skfvdskfveask;kfvdskfveaskk;fvdskfveaskkf;vdskfveask
kfv;dskfveaskkfvn;skfveaskkfvnk;kfveaskkfvnka;fveaskkfvnkak;veaskkfvnkake;easkkfvnkak
ef;askkfvnkakefv;skkfvnkakefve;kkfvnkakefvee;kfvnkakefveen;fvnkakefveend;vnkakefveend
l;nkakefveendli;kakefveendlia;akefveendlial;kefveendlialk;efveendlialkc;fveendlialkci;veendl
ialkciv;eendlialkcivk;endlialkcivkt;ndlialkcivkti;dlialkcivktig;lialkcivktigd;ialkcivktigdm;alkc
ivktigdmv;lkcivktigdmvn;kcivktigdmvnd;civktigdmvndr;ivktigdmvndre;vktigdmvndrei;ktigd
mvndrein;tigdmvndreins;igdmvndreinsr;gdmvndreinsrs;dmvndreinsrsr;mvndreinsrsry;vndrein
srsryn;ndreinsrsrynn;dreinsrsrynnf;reinsrsrynnfy;einsrsrynnfyk;insrsrynnfykk;nsrsrynnfykke;s
rsrynnfykkea;rsrynnfykkead;srynnfykkeadf;rynnfykkeadfl;ynnfykkeadflg;nnfykkeadflga;nfyk
keadflgaa;fykkeadflgaav;ykkeadflgaave;kkeadflgaavel;keadflgaavele;eadflgaaveleg;adflgaave
lega;dflgaavelegay;flgaavelegayk;lgaavelegayka;gaavelegaykai;aavelegaykaik;avelegaykaikq;
velegaykaikqt;elegaykaikqtl;legaykaikqtll;

14 mers:
mkksflsiymlisi;kksflsiymlisis;ksflsiymlisisl;sflsiymlisisll;flsiymlisislls;lsiymlisisllsc;siymlisisl
lscd;iymlisisllscdv;ymlisisllscdvs;mlisisllscdvsr;lisisllscdvsrl;isisllscdvsrln;sisllscdvsrlnq;islls
cdvsrlnqr;sllscdvsrlnqrn;llscdvsrlnqrni;lscdvsrlnqrnid;scdvsrlnqrnide;cdvsrlnqrnidel;dvsrlnqrn
idelk;vsrlnqrnidelki;srlnqrnidelkif;rlnqrnidelkifv;lnqrnidelkifve;nqrnidelkifvek;qrnidelkifveka
;rnidelkifvekak;nidelkifvekaky;idelkifvekakyy;delkifvekakyys;elkifvekakyysi;lkifvekakyysik;
kifvekakyysikl;ifvekakyysikld;fvekakyysiklda;vekakyysikldai;ekakyysikldaiy;kakyysikldaiys;
akyysikldaiyse;kyysikldaiysey;yysikldaiyseyt;ysikldaiyseytg;sikldaiyseytga;ikldaiyseytgay;kl
daiyseytgayn;ldaiyseytgaynd;daiyseytgayndi;aiyseytgayndim;iyseytgayndimt;yseytgayndimty
;seytgayndimtyi;eytgayndimtyim;ytgayndimtyimt;tgayndimtyimty;gayndimtyimtys;ayndimtyi
mtyse;yndimtyimtyseg;ndimtyimtysegt;dimtyimtysegts;imtyimtysegtss;mtyimtysegtssd;tyimt
ysegtssdk;yimtysegtssdks;imtysegtssdksk;mtysegtssdkskv;tysegtssdkskvn;ysegtssdkskvnq;seg
tssdkskvnqa;egtssdkskvnqai;gtssdkskvnqais;tssdkskvnqaisi;ssdkskvnqaisil;sdkskvnqaisilk;dks
kvnqaisilkk;kskvnqaisilkkd;skvnqaisilkkdn;kvnqaisilkkdnk;vnqaisilkkdnki;nqaisilkkdnkiv;qai
silkkdnkivn;aisilkkdnkivnk;isilkkdnkivnkf;silkkdnkivnkfk;ilkkdnkivnkfke;lkkdnkivnkfkel;kk
dnkivnkfkele;kdnkivnkfkelek;dnkivnkfkeleki;nkivnkfkelekii;kivnkfkelekiie;ivnkfkelekiiee;vn
kfkelekiieey;nkfkelekiieeyk;kfkelekiieeykp;fkelekiieeykpm;kelekiieeykpmf;elekiieeykpmfl;le
kiieeykpmfls;ekiieeykpmflsk;kiieeykpmflskl;iieeykpmflskli;ieeykpmflsklid;eeykpmflsklidd;e
ykpmflskliddf;ykpmflskliddfa;kpmflskliddfai;pmflskliddfaie;mflskliddfaiel;flskliddfaield;lskl
iddfaieldq;skliddfaieldqa;kliddfaieldqav;liddfaieldqavd;iddfaieldqavdn;ddfaieldqavdnd;dfaiel

Fig. 39 continued dqavdndv;faieldqavdndvs;aieldqavdndvsn;ieldqavdndvsna;eldqavdndvsnar;ldqavdndvsnarh;d
qavdndvsnarhv;qavdndvsnarhva;avdndvsnarhvad;vdndvsnarhvads;dndvsnarhvadsy;ndvsnarhv
adsye;dvsnarhvadsyek;vsnarhvadsyekl;snarhvadsyeklr;narhvadsyeklrk;arhvadsyeklrks;rhvads adsyeklrksvalay;dsyeklrksvalayi;syeklrksvalayie;yeklrksvalayies;eklrksvalayiesf;klrksvalayie
sfd;lrksvalayiesfdv;rksvalayiesfdvi;ksvalayiesfdvis;svalayiesfdviss;valayiesfdvissk;alayiesfdv
isskf;layiesfdvisskfv;ayiesfdvisskfvd;yiesfdvisskfvds;iesfdvisskfvdsk;esfdvisskfvdskf;sfdviss
kfvdskfv;fdvisskfvdskfve;dvisskfvdskfvea;visskfvdskfveas;isskfvdskfveask;sskfvdskfveaskk;
skfvdskfveaskkf;kfvdskfveaskkfv;fvdskfveaskkfvn;vdskfveaskkfvnk;dskfveaskkfvnka;skfvea
skkfvnkak;kfveaskkfvnkake;fveaskkfvnkakef;veaskkfvnkakefv;easkkfvnkakefve;askkfvnkake
fvee;skkfvnkakefveen;kkfvnkakefveend;kfvnkakefveendl;fvnkakefveendli;vnkakefveendlia;n
kakefveendlial;kakefveendlialk;akefveendlialkc;kefveendlialkci;efveendlialkciv;fveendlialkci
vk;veendlialkcivkt;eendlialkcivkti;endlialkcivktig;ndlialkcivktigd;dlialkcivktigdm;lialkcivktig
dmv;ialkcivktigdmvn;alkcivktigdmvnd;lkcivktigdmvndr;kcivktigdmvndre;civktigdmvndrei;iv
ktigdmvndrein;vktigdmvndreins;ktigdmvndreinsr;tigdmvndreinsrs;igdmvndreinsrsr;gdmvndre
insrsry;dmvndreinsrsryn;mvndreinsrsrynn;vndreinsrsrynnf;ndreinsrsrynnfy;dreinsrsrynnfyk;re
insrsrynnfykk;einsrsrynnfykke;insrsrynnfykkea;nsrsrynnfykkead;srsrynnfykkeadf;rsrynnfykk
eadfl;srynnfykkeadflg;rynnfykkeadflga;ynnfykkeadflgaa;nnfykkeadflgaav;nfykkeadflgaave;fy
kkeadflgaavel;ykkeadflgaavele;kkeadflgaaveleg;keadflgaavelega;eadflgaavelegay;adflgaavele
gayk;dflgaavelegayka;flgaavelegaykai;lgaavelegaykaik;gaavelegaykaikq;aavelegaykaikqt;ave
legaykaikqtl;velegaykaikqtll;

16 mers:
mkksflsiymlisisl;kksflsiymlisisll;ksflsiymlisislls;sflsiymlisisllsc;flsiymlisisllscd;lsiymlisisllsc
dv;siymlisisllscdvs;iymlisisllscdvsr;ymlisisllscdvsrl;mlisisllscdvsrln;lisisllscdvsrlnq;isisllscdv
srlnqr;sisllscdvsrlnqrn;isllscdvsrlnqrni;sllscdvsrlnqrnid;llscdvsrlnqrnide;lscdvsrlnqrnidel;scdv
srlnqrnidelk;cdvsrlnqrnidelki;dvsrlnqrnidelkif;vsrlnqrnidelkifv;srlnqrnidelkifve;rlnqrnidelkifv
ek;lnqrnidelkifveka;nqrnidelkifvekak;qrnidelkifvekaky;rnidelkifvekakyy;nidelkifvekakyys;id
elkifvekakyysi;delkifvekakyysik;elkifvekakyysikl;lkifvekakyysikld;kifvekakyysiklda;ifvekak
yysikldai;fvekakyysikldaiy;vekakyysikldaiys;ekakyysikldaiyse;kakyysikldaiysey;akyysikldai
yseyt;kyysikldaiyseytg;yysikldaiyseytga;ysikldaiyseytgay;sikldaiyseytgayn;ikldaiyseytgaynd;
kldaiyseytgayndi;ldaiyseytgayndim;daiyseytgayndimt;aiyseytgayndimty;iyseytgayndimtyi;ys
eytgayndimtyim;seytgayndimtyimt;eytgayndimtyimty;ytgayndimtyimtys;tgayndimtyimtyse;g
ayndimtyimtyseg;ayndimtyimtysegt;yndimtyimtysegts;ndimtyimtysegtss;dimtyimtysegtssd;i
mtyimtysegtssdk;mtyimtysegtssdks;tyimtysegtssdksk;yimtysegtssdkskv;imtysegtssdkskvn;mt
ysegtssdkskvnq;tysegtssdkskvnqa;ysegtssdkskvnqai;segtssdkskvnqais;egtssdkskvnqaisi;gtssd
kskvnqaisil;tssdkskvnqaisilk;ssdkskvnqaisilkk;sdkskvnqaisilkkd;dkskvnqaisilkkdn;kskvnqaisi
lkkdnk;skvnqaisilkkdnki;kvnqaisilkkdnkiv;vnqaisilkkdnkivn;nqaisilkkdnkivnk;qaisilkkdnkivn
kf;aisilkkdnkivnkfk;isilkkdnkivnkfke;silkkdnkivnkfkel;ilkkdnkivnkfkele;lkkdnkivnkfkelek;kk
dnkivnkfkeleki;kdnkivnkfkelekii;dnkivnkfkelekiie;nkivnkfkelekiiee;kivnkfkelekiieey;ivnkfke
lekiieeyk;vnkfkelekiieeykp;nkfkelekiieeykpm;kfkelekiieeykpmf;fkelekiieeykpmfl;kelekiieeyk
pmfls;elekiieeykpmflsk;lekiieeykpmflskl;ekiieeykpmflskli;kiieeykpmflsklid;iieeykpmflsklidd
;ieeykpmflskliddf;eeykpmflskliddfa;eykpmflskliddfai;ykpmflskliddfaie;kpmflskliddfaiel;pmfl
skliddfaield;mflskliddfaieldq;flskliddfaieldqa;lskliddfaieldqav;skliddfaieldqavd;kliddfaieldqa
vdn;liddfaieldqavdnd;iddfaieldqavdndv;ddfaieldqavdndvs;dfaieldqavdndvsn;faieldqavdndvsn
a;aieldqavdndvsnar;ieldqavdndvsnarh;eldqavdndvsnarhv;ldqavdndvsnarhva;dqavdndvsnarhva
d;qavdndvsnarhvads;avdndvsnarhvadsy;vdndvsnarhvadsye;dndvsnarhvadsyek;ndvsnarhvadsy
ekl;dvsnarhvadsyeklr;vsnarhvadsyeklrk;snarhvadsyeklrks;narhvadsyeklrksv;arhvadsyeklrksva
;rhvadsyeklrksval;hvadsyeklrksvala;vadsyeklrksvalay;adsyeklrksvalayi;dsyeklrksvalayie;syek

Fig. 39 continued lrksvalayies;yeklrksvalayiesf;eklrksvalayiesfd;klrksvalayiesfdv;lrksvalayiesfdvi;rksvalayiesfd
vis;ksvalayiesfdviss;svalayiesfdvissk;valayiesfdvisskf;alayiesfdvisskfv;layiesfdvisskfvd;ayies
fdvisskfvds;yiesfdvisskfvdsk;iesfdvisskfvdskf;esfdvisskfvdskfv;sfdvisskfvdskfve;fdvisskfvds
kfvea;dvisskfvdskfveas;visskfvdskfveask;isskfvdskfveaskk;sskfvdskfveaskkf;skfvdskfveaskkf
v;kfvdskfveaskkfvn;fvdskfveaskkfvnk;vdskfveaskkfvnka;dskfveaskkfvnkak;skfveaskkfvnkak
e;kfveaskkfvnkakef;fveaskkfvnkakefv;veaskkfvnkakefve;easkkfvnkakefvee;askkfvnkakefvee
n;skkfvnkakefveend;kkfvnkakefveendl;kfvnkakefveendli;fvnkakefveendlia;vnkakefveendlial;
nkakefveendlialk;kakefveendlialkc;akefveendlialkci;kefveendlialkciv;efveendlialkcivk;fveend
lialkcivkt;veendlialkcivkti;eendlialkcivktig;endlialkcivktigd;ndlialkcivktigdm;dlialkcivktigdm
v;lialkcivktigdmvn;ialkcivktigdmvnd;alkcivktigdmvndr;lkcivktigdmvndre;kcivktigdmvndrei;
civktigdmvndrein;ivktigdmvndreins;vktigdmvndreinsr;ktigdmvndreinsrs;tigdmvndreinsrsr;igd
mvndreinsrsry;gdmvndreinsrsryn;dmvndreinsrsrynn;mvndreinsrsrynnf;vndreinsrsrynnfy;ndrei
nsrsrynnfyk;dreinsrsrynnfykk;reinsrsrynnfykke;einsrsrynnfykkea;insrsrynnfykkead;nsrsrynnf
ykkeadf;srsrynnfykkeadfl;rsrynnfykkeadflg;srynnfykkeadflga;rynnfykkeadflgaa;ynnfykkeadfl
gaav;nnfykkeadflgaave;nfykkeadflgaavel;fykkeadflgaavele;ykkeadflgaaveleg;kkeadflgaavele
ga;keadflgaavelegay;eadflgaavelegayk;adflgaavelegayka;dflgaavelegaykai;flgaavelegaykaik;l
gaavelegaykaikq;gaavelegaykaikqt;aavelegaykaikqtl;avelegaykaikqtll;

<CAH10086 CRASP-1;Protein;Borrelia garinii>
Seq ID No 148806-150757

8 mers:
mkktklni;kktklnii;ktklniik;tklniikl;klniikln;lniiklni;niiklnil;iiklnilt;iklnilft;klniltt;klniltti;lnilttil;nilttilt
;ilttiltl;lttiltli;ttiltlic;tiltlici;iltlicis;ltlicisc;tlicisca;liciscav;iciscavd;ciscavdk;iscavdki;scavdkid;
cavdkidp;avdkidpe;vdkidpes;dkidpesk;kidpesks;idpesksk;dpeskskt;peskkstn;eskskktnt;sksktntk
;ksktntkd;sktntkdf;ktntkdfe;tntkdfen;ntkdfenk;tkdfenks;kdfenksq;dfenksqd;fenksqdl;enksqdle;
nksqdlep;ksqdleps;sqdlepsn;qdlepsnt;dlepsntk;lepsntkn;epsntknk;psntknkd;sntknkdl;ntknkdle;
tknkdlep;knkdlepl;nkdleple;kdleplek;dleplekn;leplekns;epleknsk;pleknske;leknsket;eknsketi;k
nsketii;nsketiis;sketiisk;ketiiskl;etiiskle;tiisklek;iisklekm;isklekmi;sklekmik;klekmikd;lekmik
dl;ekmikdle;kmikdled;mikdledq;ikdledqk;kdledqkd;dledqkdq;ledqkdqe;edqkdqed;dqkdqedt;q
kdqedte;kdqedtei;dqedteia;qedteiak;edteiaki;dteiakit;teiakitn;eiakitnt;iakitntq;akitntqi;kitntqid
;itntqidf;tntqidfl;ntqidfle;tqidflen;qidflenf;idflenfk;dflenfks;flenfkse;lenfksep;enfkseph;nfksep
hd;fksephdt;ksephdti;sephdtis;ephdtise;phdtised;hdtisedi;dtisedie;tisediem;isediemk;sediemki;
ediemkik;diemkikr;iemkikri;emkikrii;mkikriiy;kikriiys;ikriiyss;kriiyssl;riiyssln;iiysslny;iyssln
ye;ysslnyei;sslnyeie;slnyeiek;lnyeieki;nyeiekin;yeiekint;eiekintl;iekintlk;ekintlke;kintlkei;intl
keil;ntlkeild;tlkeildk;lkeildkl;keildkly;eildklyk;ildklykn;ldklyknh;dklyknhk;klyknhky;lyknhky
k;yknhkykt;knhkyktt;nhkyktta;hkykttar;kykttarn;ykttarnf;kttarnfi;ttarnfil;tarnfiln;arnfilni;rnfil
nis;nfilnisi;filnisik;ilnisiki;lnisikiq;nisikiqf;isikiqfq;sikiqfqi;ikiqfqie;kiqfqien;iqfqiena;qfqiena
l;fqienale;qienalel;ienalelm;enalelmk;nalelmke;alelmkee;lelmkeei;elmkeeie;lmkeeied;mkeeie
da;keeiedas;eeiedase;eiedasei;iedaseil;edaseiln;daseilnq;aseilnqe;seilnqer;eilnqery;ilnqerye;ln
qeryei;nqeryeil;qeryeill;eryeillk;ryeillkh;yeillkhv;eillkhve;illkhvep;llkhveps;lkhvepsl;khvepsl
n;hvepslnl;vepslnlk;epslnlkq;pslnlkqk;slnlkqkf;lnlkqkfe;nlkqkfek;lkqkfeki;kqkfekil;qkfekiln;
kfekilne;fekilnet;ekilneti;kilnetik;ilnetika;lnetikay;netikayn;etikaynq;tikaynqd;ikaynqdl;kaynq
dld;aynqdldn;ynqdldni;nqdldnik;qdldniks;dldniksn;ldniksne;dniksned;niksnedq;iksnedql;ksne dqla;snedqlah;nedqlahm;edqlahmd;dqlahmde;qlahmden;lahmdeny;ahmdenyk;hmdenyke;mde
nykef;denykefd;enykefdp;nykefdpl;ykefdpln;kefdplnl;efdplnld;fdplnldy;

9 mers:
mkktklnii;kktklniik;ktklniikl;tklniikln;klniiklni;lniiklnil;niiklnilt;iiklniltt;iklniltti;klnilttil;lniltti
lt;nilttiltl;ilttiltli;lttiltlic;ttiltlici;tiltlicis;iltlicisc;ltliciscа;tliciscav;liciscavd;iciscavdk;ciscavdki;
iscavdkid;scavdkidp;cavdkidpe;avdkidpes;vdkidpesk;dkidpesks;kidpesksk;idpeskskt;dpeskskt
n;pesksktnt;esksktntk;sksktntkd;ksktntkdf;sktntkdfe;ktntkdfen;tntkdfenk;ntkdfenks;tkdfenksq;
kdfenksqd;dfenksqdl;fenksqdle;enksqdlep;nksqdleps;ksqdlepsn;sqdlepsnt;qdlepsntk;dlepsntk
n;lepsntknk;epsntknkd;psntknkdl;sntknkdle;ntknkdlep;tknkdlepl;knkdleple;nkdleplek;kdleple
kn;dleplekns;lepleknsk;epleknske;pleknsket;leknsketi;eknsketii;knsketiis;nsketiisk;sketiiskl;k
etiiskle;etiisklek;tiisklekm;iisklekmi;isklekmik;sklekmikd;klekmikdl;lekmikdle;ekmikdled;k
mikdledq;mikdledqk;ikdledqkd;kdledqkdq;dledqkdqe;ledqkdqed;edqkdqedt;dqkdqedte;qkdqe
dtei;kdqedteia;dqedteiak;qedteiaki;edteiakit;dteiakitn;teiakitnt;eiakitntq;iakitntqi;akitntqid;kit
ntqidf;itntqidfl;tntqidfle;ntqidflen;tqidflenf;qidflenfk;idflenfks;dflenfkse;flenfksep;lenfkseph;
enfksephd;nfksephdt;fksephdti;ksephdtis;sephdtise;ephdtised;phdtisedi;hdtisedie;dtisediem;tis
ediemk;isediemki;sediemkik;ediemkikr;diemkikri;iemkikrii;emkikriiy;mkikriiys;kikriiyss;ikri
iyssl;kriiyssln;riiyssIny;iiyssInye;iyssInyei;yssInyeie;ssInyeiek;sInyeieki;Inyeiekin;nyeiekint;y
eiekintl;eiekintlk;iekintlke;ekintlkei;kintlkeil;intlkeild;ntlkeildk;tlkeildkl;lkeildkly;keildklyk;e ildklykn;ildklyknh;ldklyknhk;dklyknhky;klyknhkyk;lyknhkykt;yknhkyktt;knhkyktta;nhkyktta r;hkykttarn;kykttarnf;ykttarnfi;kttarnfil;ttarnfiln;tarnfilni;arnfilnis;rnfilnisi;nfilnisik;filnisiki;il nisikiq;lnisikiqf;nisikiqfq;isikiqfqi;sikiqfqie;ikiqfqien;kiqfqiena;iqfqienal;qfqienale;fqienalel; qienalelm;ienalelmk;enalelmke;nalelmkee;alelmkeei;lelmkeeie;elmkeeied;lmkeeieda;mkeeied as;keeiedase;eeiedasei;eiedaseil;iedaseiln;edaseilnq;daseilnqe;aseilnqer;seilnqery;eilnqerye;il nqeryei;lnqeryeil;nqeryeill;qeryeillk;eryeillkh;ryeillkhv;yeillkhve;eillkhvep;illkhveps;llkhvep sl;lkhvepsln;khvepslnl;hvepslnlk;vepslnlkq;epslnlkqk;pslnlkqkf;slnlkqkfe;lnlkqkfek;nlkqkfeki ;lkqkfekil;kqkfekiln;qkfekilne;kfekilnet;fekilneti;ekilnetik;kilnetika;ilnetikay;lnetikayn;netika ynq;etikaynqd;tikaynqdl;ikaynqdld;kaynqdldn;aynqdldni;ynqdldnik;nqdldniks;qdldniksn;dldn iksne;ldniksned;dniksnedq;niksnedql;iksnedqla;ksnedqlah;snedqlahm;nedqlahmd;edqlahmde; dqlahmden;qlahmdeny;lahmdenyk;ahmdenyke;hmdenykef;mdenykefd;denykefdp;enykefdpl; nykefdpln;ykefdplnl;kefdplnld;efdplnldy;

10 mers:
mkktklniik;kktklniikl;ktklniikln;tklniiklni;klniiklnil;lniiklnilt;niiklniltt;iiklniltti;iklnilttil;klniltt ilt;lnilttiltl;nilttiltli;ilttiltlic;lttiltlici;ttiltlicis;tiltlicisc;iltlicisca;ltliciscav;tliciscavd;liciscavdk;ic iscavdki;ciscavdkid;iscavdkidp;scavdkidpe;cavdkidpes;avdkidpesk;vdkidpesks;dkidpesksk;ki dpeskskt;idpesksktn;dpesksktnt;pesksktntk;esksktntkd;sksktntkdf;ksktntkdfe;sktntkdfen;ktntk dfenk;tntkdfenks;ntkdfenksq;tkdfenksqd;kdfenksqdl;dfenksqdle;fenksqdlep;enksqdleps;nksqd lepsn;ksqdlepsnt;sqdlepsntk;qdlepsntkn;dlepsntknk;lepsntknkd;epsntknkdl;psntknkdle;sntknk dlep;ntknkdlepl;tknkdleple;knkdleplek;nkdleplekn;kdleplekns;dlepleknsk;lepleknske;eplekns ket;pleknsketi;leknsketii;eknsketiis;knsketiisk;nsketiiskl;sketiiskle;ketiisklek;etiisklekm;tiiskl ekmi;iisklekmik;isklekmikd;sklekmikdl;klekmikdle;lekmikdled;ekmikdledq;kmikdledqk;mik dledqkd;ikdledqkdq;kdledqkdqe;dledqkdqed;ledqkdqedt;edqkdqedte;dqkdqedtei;qkdqedteia;k dqedteiak;dqedteiaki;qedteiakit;edteiakitn;dteiakitnt;teiakitntq;eiakitntqi;iakitntqid;akitntqidf; kitntqidfl;itntqidfle;tntqidflen;ntqidflenf;tqidflenfk;qidflenfks;idflenfkse;dflenfksep;flenfksep

Fig. 39 continued h;lenfksephd;enfksephdt;nfksephdti;fksephdtis;ksephdtise;sephdtised;ephdtisedi;phdtisedie;hdtisediem;dtisediemk;tisediemki;isediemkik;sediemkikr;ediemkikri;diemkikrii;iemkikriiy;emkikriiys;mkikriiyss;kikriiyssl;ikriiyssln;kriiysslny;riiysslnye;iiysslnyei;iysslnyeie;ysslnyeiek;sslnyeieki;slnyeiekin;lnyeiekint;nyeiekintl;yeiekintlk;eiekintlke;iekintlkei;ekintlkeil;kintlkeild;intlkeildk;ntlkeildkl;tlkeildkly;lkeildklyk;keildklykn;eildklyknh;ildklyknhk;ldklyknhky;dklyknhkyk;klyknhkykt;lyknhkyktt;yknhkyktta;knhkykttar;nhkykttarn;hkykttarnf;kykttarnfi;ykttarnfil;kttarnfiln;ttarnfilni;tarnfilnis;arnfilnisi;rnfilnisik;nfilnisiki;filnisikiq;ilnisikiqf;lnisikiqfq;nisikiqfqi;isikiqfqie;sikiqfqien;ikiqfqiena;kiqfqienal;iqfqienale;qfqienalel;fqienalelm;qienalelmk;ienalelmke;enalelmkee;nalelmkeei;alelmkeeie;lelmkeeied;elmkeeieda;lmkeeiedas;mkeeiedase;keeiedasei;eeiedaseil;eiedaseiln;iedaseilnq;edaseilnqe;daseilnqer;aseilnqery;seilnqerye;eilnqeryei;ilnqeryeil;lnqeryeill;nqeryeillk;qeryeillkh;eryeillkhv;ryeillkhve;yeillkhvep;eillkhveps;illkhvepsl;llkhvepsln;lkhvepslnl;khvepslnlk;hvepslnlkq;vepslnlkqk;epslnlkqkf;pslnlkqkfe;slnlkqkfek;lnlkqkfeki;nlkqkfekil;lkqkfekiln;kqkfekilne;qkfekilnet;kfekilneti;fekilnetik;ekilnetika;kilnetikay;ilnetikayn;lnetikaynq;netikaynqd;etikaynqdl;tikaynqdld;ikaynqdldn;kaynqdldni;aynqdldnik;ynqdldniks;nqdldniksn;qdldniksne;dldniksned;ldniksnedq;dniksnedql;niksnedqla;iksnedqlah;ksnedqlahm;snedqlahmd;nedqlahmde;edqlahmden;dqlahmdeny;qlahmdenyk;lahmdenyke;ahmdenykef;hmdenykefd;mdenykefdp;denykefdpl;enykefdpln;nykefdplnl;ykefdplnld;kefdplnldy;

11 mers:

mkktklniikl;kktklniikln;ktklniiklni;tklniiklnil;klniiklnilt;lniiklniltt;niiklniltti;iiklnilttil;iklnilttilt;klnilttiltl;lnilttiltli;nilttiltlic;ilttiltlici;lttiltlicis;ttiltlicisc;tiltlicisca;iltliciscav;ltliciscavd;tliciscavdk;liciscavdki;iciscavdkid;ciscavdkidp;iscavdkidpe;scavdkidpes;cavdkidpesk;avdkidpesks;vdkidpesksk;dkidpeskskt;kidpesksktn;idpesksktnt;dpesksktntk;pesksktntkd;esksktntkdf;sksktntkdfe;ksktntkdfen;sktntkdfenk;ktntkdfenks;tntkdfenksq;ntkdfenksqd;tkdfenksqdl;kdfenksqdle;dfenksqdlep;fenksqdleps;enksqdlepsn;nksqdlepsnt;ksqdlepsntk;sqdlepsntkn;qdlepsntknk;dlepsntknkd;lepsntknkdl;epsntknkdle;psntknkdlep;sntknkdlepl;ntknkdleple;tknkdleplek;knkdleplekn;nkdlepleknsk;kdlepleknsk;dlepleknske;lepleknsket;epleknsketi;pleknsketii;leknsketiis;eknsketiisk;knsketiiskl;nsketiiskle;sketiisklek;ketiisklekm;etiisklekmi;tiisklekmik;iisklekmikd;isklekmikdl;sklekmikdle;klekmikdled;lekmikdledq;ekmikdledqk;kmikdledqkd;mikdledqkdq;ikdledqkdqe;kdledqkdqed;dledqkdqedt;ledqkdqedte;edqkdqedtei;dqkdqedteia;qkdqedteiak;kdqedteiaki;dqedteiakit;qedteiakitn;edteiakitnt;dteiakitntq;teiakitntqi;eiakitntqid;iakitntqidf;akitntqidfl;kitntqidfle;itntqidflen;tntqidflenf;ntqidflenfk;tqidflenfks;qidflenfkse;idflenfksep;dflenfkseph;flenfksephd;lenfksephdt;enfksephdti;nfksephdtis;fksephdtise;ksephdtised;sephdtisedi;ephdtisedie;phdtisediem;hdtisediemk;dtisediemki;tisediemkik;isediemkikr;sediemkikri;ediemkikrii;diemkikriiy;iemkikriiys;emkikriiyss;mkikriiyssl;kikriiyssln;ikriiysslny;kriiysslnye;riiysslnyei;iiysslnyeie;iysslnyeiek;ysslnyeieki;sslnyeiekin;slnyeiekint;lnyeiekintl;nyeiekintlk;yeiekintlke;eiekintlkei;iekintlkeil;ekintlkeild;kintlkeildk;intlkeildkl;ntlkeildkly;tlkeildklyk;lkeildklykn;keildklyknh;eildklyknhk;ildklyknhky;ldklyknhkyk;dklyknhkykt;klyknhkyktt;lyknhkyktta;yknhkykttar;knhkykttarn;nhkykttarnf;hkykttarnfi;kykttarnfil;ykttarnfiln;kttarnfilni;ttarnfilnis;tarnfilnisi;arnfilnisik;rnfilnisiki;nfilnisikiq;filnisikiqf;ilnisikiqfq;lnisikiqfqi;nisikiqfqie;isikiqfqien;sikiqfqiena;ikiqfqienal;kiqfqienale;iqfqienalel;qfqienalelm;fqienalelmk;qienalelmke;ienalelmkee;enalelmkeei;nalelmkeeie;alelmkeeied;lelmkeeieda;elmkeeiedas;lmkeeiedase;mkeeiedasei;keeiedaseil;eeiedaseiln;eiedaseilnq;iedaseilnqe;edaseilnqer;daseilnqery;aseilnqerye;seilnqeryei;eilnqeryeil;ilnqeryeill;lnqeryeillk;nqeryeillkh;qeryeillkhv;eryeillkhve;ryeillkhvep;yeillkhveps;eillk

Fig. 39 continued hvepsl;illkhvepsln;llkhvepslnl;lkhvepslnlk;khvepslnlkq;hvepslnlkqk;vepslnlkqkf;epslnlkqkfe;pslnlkqkfek;slnlkqkfeki;lnlkqkfekil;nlkqkfekiln;lkqkfekilne;kqkfekilnet;qkfekilneti;kfekilnetik;fekilnetika;ekilnetikay;kilnetikayn;ilnetikaynq;lnetikaynqd;netikaynqdl;etikaynqdld;tikaynqdldn;ikaynqdldni;kaynqdldnik;aynqdldniks;ynqdldniksn;nqdldniksne;qdldniksned;dldniksnedq;ldniksnedql;dniksnedqla;niksnedqlah;iksnedqlahm;ksnedqlahmd;snedqlahmde;nedqlahmden;edqlahmdeny;dqlahmdenyk;qlahmdenyke;lahmdenykef;ahmdenykefd;hmdenykefdp;mdenykefdpl;denykefdpln;enykefdplnl;nykefdplnld;ykefdplnldy;

13 mers:
mkktklniiklni;kktklniiklnil;ktklniiklnilt;tklniiklniltt;klniiklniltti;lniiklnilttil;niiklnilttilt;iiklniltttiltl;iklnilttiltli;klnilttiltlic;lnilttiltlici;nilttiltlicis;ilttiltlicisc;lttiltlicisca;ttiltliciscav;tiltliciscavd;iltliciscavdk;ltliciscavdki;tliciscavdkid;liciscavdkidp;iciscavdkidpe;ciscavdkidpes;iscavdkidpesk;scavdkidpesks;cavdkidpesksk;avdkidpeskskt;vdkidpeskskt n;dkidpesksktnt;kidpesksktntk;idpesksktntkd;dpesksktntkdf;pesksktntkdfe;esksktntkdfen;sksktntkdfenk;ksktntkdfenks;sktntkdfenksq;ktntkdfenksqd;tntkdfenksqdl;ntkdfenksqdle;tkdfenksqdlep;kdfenksqdleps;dfenksqdlepsn;fenksqdlepsnt;enksqdlepsntk;nksqdlepsntkn;ksqdlepsntknk;sqdlepsntknkd;qdlepsntknkdl;dlepsntknkdle;lepsntknkdlep;epsntknkdlepl;psntknkdleple;sntknkdleplek;ntknkdleplekn;tknkdleplekns;knkdlepleknsk;nkdlepleknske;kdlepleknsket;dlepleknsketi;lepleknsketii;epleknsketiis;pleknsketiisk;leknsketiiskl;eknsketiiskle;knsketiisklek;nsketiisklekm;sketiisklekmi;ketiisklekmik;etiisklekmikd;tiisklekmikdl;iisklekmikdle;isklekmikdled;sklekmikdledq;klekmikdledqk;lekmikdledqkd;ekmikdledqkdq;kmikdledqkdqe;mikdledqkdqed;ikdledqkdqedt;kdledqkdqedte;dledqkdqedtei;ledqkdqedteia;edqkdqedteiak;dqkdqedteiaki;qkdqedteiakit;kdqedteiakitn;dqedteiakitnt;qedteiakitntq;edteiakitntqi;dteiakitntqid;teiakitntqidf;eiakitntqidfl;iakitntqidfle;akitntqidflen;kitntqidflenf;itntqidflenfk;tntqidflenfks;ntqidflenfkse;tqidflenfksep;qidflenfkseph;idflenfksephd;dflenfksephdt;flenfksephdti;lenfksephdtis;enfksephdtise;nfksephdtised;fksephdtisedi;ksephdtisedie;sephdtisediem;ephdtisediemk;phdtisediemki;hdtisediemkik;dtisediemkikr;tisediemkikri;isediemkikrii;sediemkikriiy;ediemkikriiys;diemkikriiyss;iemkikriiyssl;emkikriiyssln;mkikriiysslny;kikriiysslnye;ikriiysslnyei;kriiysslnyeie;riiysslnyeiek;iiysslnyeieki;iysslnyeiekin;ysslnyeiekint;sslnyeiekintl;slnyeiekintlk;lnyeiekintlke;nyeiekintlkei;yeiekintlkeil;eiekintlkeild;iekintlkeildk;ekintlkeildkl;kintlkeildkly;intlkeildklyk;ntlkeildklykn;tlkeildklyknh;lkeildklyknhk;keildklyknhky;eildklyknhkyk;ildklyknhkykt;ldklyknhkyktt;dklyknhkyktta;klyknhkykttar;lyknhkykttarn;yknhkykttarnf;knhkykttarnfi;nhkykttarnfil;hkykttarnfiln;kykttarnfilni;ykttarnfilnis;kttarnfilnisi;ttarnfilnisik;tarnfilnisiki;arnfilnisikiq;rnfilnisikiqf;nfilnisikiqfq;filnisikiqfqi;ilnisikiqfqie;lnisikiqfqien;nisikiqfqiena;isikiqfqienal;sikiqfqienale;ikiqfqienalel;kiqfqienalelm;iqfqienalelmk;qfqienalelmke;fqienalelmkee;qienalelmkeei;ienalelmkeeie;enalelmkeeied;nalelmkeeieda;alelmkeeiedas;lelmkeeiedase;elmkeeiedasei;lmkeeiedaseil;mkeeiedaseiln;keeiedaseilnq;eeiedaseilnqe;eiedaseilnqer;iedaseilnqery;edaseilnqerye;daseilnqeryei;aseilnqeryeil;seilnqeryeill;eilnqeryeillk;ilnqeryeillkh;lnqeryeillkhv;nqeryeillkhve;qeryeillkhvep;eryeillkhveps;ryeillkhvepsl;yeillkhvepsln;eillkhvepslnl;illkhvepslnlk;llkhvepslnlkq;lkhvepslnlkqk;khvepslnlkqkf;hvepslnlkqkfe;vepslnlkqkfek;epslnlkqkfeki;pslnlkqkfekil;slnlkqkfekiln;lnlkqkfekilne;nlkqkfekilnet;lkqkfekilneti;kqkfekilnetik;qkfekilnetika;kfekilnetikay;fekilnetikayn;ekilnetikaynq;kilnetikaynqd;ilnetikaynqdl;lnetikaynqdld;netikaynqdldn;etikaynqdldni;tikaynqdldnik;ikaynqdldniks;kaynqdldniksn;aynqdldniksne;ynqdldniksned;nqdldniksnedq;qdldniksnedql;dldniksnedqla;ldniksnedqlah;dniksnedqlahm;niksnedqlahmd;iksnedqlahmde;ksnedqlahmden;snedqlahm

Fig. 39 continued deny;nedqlahmdenyk;edqlahmdenyke;dqlahmdenykef;qlahmdenykefd;lahmdenykefdp;ahmde
nykefdpl;hmdenykefdpln;mdenykefdplnl;denykefdplnld;enykefdplnldy;

14 mers:
mkktklniiklnil;kktklniiklnilt;ktklniiklniltt;tklniiklniltti;klniiklnilttil;lniiklnilttilt;niiklniltti 15 mers:

mkktklniiklnilt;kktklniiklniltt;ktklniiklniltti;tklniiklnilttil;klniiklnilttilt;lniiklnilttiltl;niiklnilttilt
li;iiklnilttiltlic;iklnilttiltlici;klnilttiltlicis;lnilttiltlicisc;nilttiltlicisca;ilttiltliciscav;lttiltliciscavd;t
tiltliciscavdk;tiltliciscavdki;iltliciscavdkid;ltliciscavdkidp;tliciscavdkidpe;liciscavdkidpes;icis
cavdkidpesk;ciscavdkidpesks;iscavdkidpesksk;scavdkidpeskskt;cavdkidpesksktn;avdkidpesks
ktnt;vdkidpesksktntk;dkidpesksktntkd;kidpesksktntkdf;idpesksktntkdfe;dpesksktntkdfen;pesk
sktntkdfenk;esksktntkdfenks;sksktntkdfenksq;ksktntkdfenksqd;sktntkdfenksqdl;ktntkdfenksqd
le;tntkdfenksqdlep;ntkdfenksqdleps;tkdfenksqdlepsn;kdfenksqdlepsnt;dfenksqdlepsntk;fenksq
dlepsntkn;enksqdlepsntknk;nksqdlepsntknkd;ksqdlepsntknkdl;sqdlepsntknkdle;qdlepsntknkdl
ep;dlepsntknkdlepl;lepsntknkdleple;epsntknkdleplek;psntknkdleplekn;sntknkdlelplekns;ntknkd
lepleknsk;tknkdlepleknske;knkdlepleknsket;nkdlepleknsketi;kdlepleknsketii;dlepleknsketiis;le
pleknsketiisk;epleknsketiiskl;pleknsketiiskle;leknsketiisklek;eknsketiisklekm;knsketiisklekmi;
nsketiisklekmik;sketiisklekmikd;ketiisklekmikdl;etiisklekmikdle;tiisklekmikdled;iisklekmikdl
edq;isklekmikdledqk;sklekmikdledqkd;klekmikdledqkdq;lekmikdledqkdqe;ekmikdledqkdqed;
kmikdledqkdqedt;mikdledqkdqedte;ikdledqkdqedtei;kdledqkdqedteia;dledqkdqedteiak;ledqkd
qedteiaki;edqkdqedteiakit;dqkdqedteiakitn;qkdqedteiakitnt;kdqedteiakitntq;dqedteiakitntqi;qe
dteiakitntqid;edteiakitntqidf;dteiakitntqidfl;teiakitntqidfle;eiakitntqidflen;iakitntqidflenf;akitnt
qidflenfk;kitntqidflenfks;itntqidflenfkse;tntqidflenfksep;ntqidflenfkseph;tqidflenfksephd;qidfl
enfksephdt;idflenfksephdti;dflenfksephdtis;flenfksephdtise;lenfksephdtised;enfksephdtisedi;nf
ksephdtisedie;fksephdtisediem;ksephdtisediemk;sephdtisediemki;ephdtisediemkik;phdtisedie
mkikr;hdtisediemkikri;dtisediemkikrii;tisediemkikriiy;isediemkikriiys;sediemkikriiyss;ediem
kikriiyssl;diemkikriiyssln;iemkikriiysslny;emkikriiysslnye;mkikriiysslnyei;kikriiysslnyeie;ikri
iysslnyeiek;kriiysslnyeieki;riiysslnyeiekin;iiysslnyeiekint;iysslnyeiekintl;ysslnyeiekintlk;sslny
eiekintlke;slnyeiekintlkei;lnyeiekintlkeil;nyeiekintlkeild;yeiekintlkeildk;eiekintlkeildkl;iekintl
keildkly;ekintlkeildklyk;kintlkeildklykn;intlkeildklyknh;ntlkeildklyknhk;tlkeildklyknhky;lkeil
dklyknhkyk;keildklyknhkykt;eildklyknhkyktt;ildklyknhkyktta;ldklyknhkykttar;dklyknhkyktta
rn;klyknhkykttarnf;lyknhkykttarnfi;yknhkykttarnfil;knhkykttarnfiln;nhkykttarnfilni;hkykttarnf
ilnis;kykttarnfilnisi;ykttarnfilnisik;kttarnfilnisiki;ttarnfilnisikiq;tarnfilnisikiqf;arnfilnisikiqfq;r
nfilnisikiqfqi;nfilnisikiqfqie;filnisikiqfqien;ilnisikiqfqiena;lnisikiqfqienal;nisikiqfqienale;isiki
qfqienalel;sikiqfqienalelm;ikiqfqienalelmk;kiqfqienalelmke;iqfqienalelmkee;qfqienalelmkeei;
fqienalelmkeeie;qienalelmkeeied;ienalelmkeeieda;enalelmkeeiedas;nalelmkeeiedase;alelmkee
iedasei;lelmkeeiedaseil;elmkeeiedaseiln;lmkeeiedaseilnq;mkeeiedaseilnqe;keeiedaseilnqer;eei
edaseilnqery;eiedaseilnqerye;iedaseilnqeryei;edaseilnqeryeil;daseilnqeryeill;aseilnqeryeillk;se
ilnqeryeillkh;eilnqeryeillkhv;ilnqeryeillkhve;lnqeryeillkhvep;nqeryeillkhveps;qeryeillkhvepsl;
eryeillkhvepsln;ryeillkhvepslnl;yeillkhvepslnlk;eillkhvepslnlkq;illkhvepslnlkqk;llkhvepslnlkq
kf;lkhvepslnlkqkfe;khvepslnlkqkfek;hvepslnlkqkfeki;vepslnlkqkfekil;epslnlkqkfekiln;pslnlkq
kfekilne;slnlkqkfekilnet;lnlkqkfekilneti;nlkqkfekilnetik;lkqkfekilnetika;kqkfekilnetikay;qkfek
ilnetikayn;kfekilnetikaynq;fekilnetikaynqd;ekilnetikaynqdl;kilnetikaynqdld;ilnetikaynqdldn;ln
etikaynqdldni;netikaynqdldnik;etikaynqdldniks;tikaynqdldniksn;ikaynqdldniksne;kaynqdldni
ksned;aynqdldniksnedq;ynqdldniksnedql;nqdldniksnedqla;qdldniksnedqlah;dldniksnedqlahm;
ldniksnedqlahmd;dniksnedqlahmde;niksnedqlahmden;iksnedqlahmdeny;ksnedqlahmdenyk;sn
edqlahmdenyke;nedqlahmdenykef;edqlahmdenykefd;dqlahmdenykefdp;qlahmdenykefdpl;lah
mdenykefdpln;ahmdenykefdplnl;hmdenykefdplnld;mdenykefdplnldy;

16 mers:

Fig. 39 continued mkktklniiklniltt;kktklniiklniltti;ktklniiklniltti;tklniiklniltti;klniiklniltti;lniiklniltti;niiklni
lttiltlic;iiklniltti;iklniltti;klniltti;lniltti;nilttiltliciscav;ilttiltliciscavd;ltti
ltliciscavdk;ttiltliciscavdki;tiltliciscavdkid;iltliciscavdkidp;ltliciscavdkidpe;tliciscavdkidpes;li
ciscavdkidpesk;iciscavdkidpesks;ciscavdkidpesksk;iscavdkidpeskskt;scavdkidpesksktn;cavdk
idpesksktnt;avdkidpesksktnt <AAU07022 4-alpha-glucanotransferase;Protein;Borrelia garinii PBi>
Seq ID No 150758-154717

8 mers:
mkykkiri;kykkirin;ykkirinl;kkirinln;kirinlnl;irinlnlk;rinlnlkr;inlnlkrk;nlnlkrks;lnlkrksg;nlkrksg
i;lkrksgil;krksgill;rksgilln;ksgillni;sgillnis;gillniss;illnissl;llnisslp;lnisslps;nisslpsk;isslpsky;ssl
pskyg;slpskygi;lpskygig;pskygigd;skygigdl;kygigdlg;ygigdlgk;gigdlgkg;igdlgkga;gdlgkgay;dl
gkgayk;lgkgaykf;gkgaykfi;kgaykfid;gaykfidf;aykfidfl;ykfidflf;kfidflfa;fidflfas;idflfass;dflfass
q;flfassqs;lfassqsy;fassqsyw;assqsywq;ssqsywqm;sqsywqmf;qsywqmfa;sywqmfay;ywqmfays
;wqmfaysp;qmfayspi;mfayspid;fayspidf;ayspidft;yspidftr;spidftrs;pidftrsp;idftrspp;dftrsppy;ftr
sppys;trsppysi;rsppysif;sppysifs;ppysifsa;pysifsaf;ysifsafa;sifsafag;ifsafagn;fsafagnv;safagnvy
;afagnvyy;fagnvyyi;agnvyyid;gnvyyidl;nvyyidle;vyyidlea;yyidleal;yidleald;idlealdk;dlealdkf;l
ealdkfi;ealdkfid;aldkfids;ldkfidsd;dkfidsdl;kfidsdln;fidsdlnl;idsdlnll;dsdlnllk;sdlnllke;dlnllken
;lnllkene;nllkenet;llkenetr;lkenetry;kenetrys;enetrysd;netrysdl;etrysdlk;trysdlkk;rysdlkkl;ysdlk
kls;sdlkklsf;dlkklsfk;lkklsfkd;kklsfkdk;klsfkdkf;lsfkdkfl;sfkdkflk;fkdkflke;kdkflkea;dkflkeaa;
kflkeaal;flkeaaln;lkeaalnf;keaalnfi;eaalnfin;aalnfinr;alnfinra;lnfinras;nfinrasv;finrasvd;inrasvd
e;nrasvdev;rasvdevr;asvdevrs;svdevrsf;vdevrsfe;devrsfek;evrsfekf;vrsfekfk;rsfekfkk;sfekfkkk;
fekfkkks;ekfkkkss;kfkkkssy;fkkkssyw;kkkssywl;kksswywll;kssywlld;ssywlldf;sywlldfa;ywlldfa
s;wlldfasf;lldfasfv;ldfasfva;dfasfvaf;fasfvafk;asfvafke;sfvafkey;fvafkeyf;vafkeyfl;afkeyflk;fke
yflkd;keyflkds;eyflkdsr;yflkdsrd;flkdsrda;lkdsrdaf;kdsrdafn;dsrdafnv;srdafnvl;rdafnvlf;dafnvl
fd;afnvlfdr;fnvlfdrg;nvlfdrgi;vlfdrgil;lfdrgili;fdrgilir;drgilirn;rgilirne;gilirnek;ilirnekd;lirnekdl;
irnekdlf;rnekdlfk;nekdlfkl;ekdlfklr;kdlfklrn;dlfklrni;lfklrnil;fklrnils;klrnilsk;lrnilske;rnilskei;n
ilskeik;ilskeikv;lskeikvq;skeikvqe;keikvqev;eikvqevl;ikvqevlq;kvqevlqy;vqevlqyf;qevlqyff;ev
lqyfff;vlqyfffs;lqyfffsq;qyfffsqf;yfffsqfq;fffsqfqa;ffsqfqal;fsqfqalk;sqfqalkr;qfqalkry;fqalkrya;
qalkryan;alkryand;lkryandk;kryandkg;ryandkgi;yandkgie;andkgiel;ndkgielv;dkgielvm;kgielv
mn;gielvmnl;ielvmnlp;elvmnlpl;lvmnlplf;vmnlplfi;mnlplfia;nlplfiay;lplfiayd;plfiayds;lfiaydsa
;fiaydsad;iaydsadv;aydsadvw;ydsadvwa;dsadvwah;sadvwahq;advwahqk;dvwahqky;vwahqkyf
;wahqkyfk;ahqkyfkl;hqkyfklr;qkyfklrf;kyfklrfd;yfklrfda;fklrfdas;klrfdask;lrfdaskd;rfdaskdk;f
daskdkv;daskdkva;askdkvag;skdkvagi;kdkvagis;dkvagisp;kvagispd;vagispdy;agispdyf;gispdy
fl;ispdyfle;spdyfleq;pdyfleqe;dyfleqeq;yfleqeqa;fleqeqaw;leqeqawd;eqeqawds;qeqawdsp;eqa
wdspa;qawdspay;awdspays;wdspaysw;dspayswn;spayswnv;payswnvl;ayswnvlk;yswnvlkn;sw
nvlknv;wnvlknvk;nvlknvky;vlknvkye;lknvkyew;knvkyeww;nvkyewwa;vkyewwak;kyewwakr
;yewwakri;ewwakrig;wwakrigi;wakrigil;akrigilr;krigilrk;rigilrky;igilrkyi;gilrkyid;ilrkyidv;lrk
yidvi;rkyidvik;kyidviki;yidvikid;idvikidh;dvikidhf;vikidhfr;ikidhfrg;kidhfrgf;idhfrgfv;dhfrgfv
s;hfrgfvst;frgfvstw;rgfvstwe;gfvstwev;fvstwevg;vstwevgv;stwevgvg;twevgvge;wevgvgea;evg
vgeay;vgvgeaya;gvgeayaf;vgeayafn;geayafng;eayafngl;ayafnglw;yafnglwv;afnglwvk;fnglwvk
s;nglwvksp;glwvkspg;lwvkspgr;wvkspgrd;vkspgrdf;kspgrdff;spgrdffn;pgrdffnf;grdffnfi;rdffnf
il;dffnfiln;ffnfilne;fnfilnei;nfilneik;filneikd;ilneikdl;lneikdlk;neikdlki;eikdlkiw;ikdlkiwv;kdlki
wve;dlkiwved;lkiwvedf;kiwvedfe;iwvedfen;wvedfend;vedfendl;edfendle;dfendled;fendledv;e
ndledvs;ndledvsr;dledvsrl;ledvsrlr;edvsrlrd;dvsrlrdf;vsrlrdff;srlrdffn;rlrdffnf;lrdffnfp;rdffnfpg;
dffnfpgm;ffnfpgmr;fnfpgmri;nfpgmrim;fpgmrimk;pgmrimkl;gmrimkla;mrimklaf;rimklafd;im
klafdf;mklafdfd;klafdfds;lafdfdsd;afdfdsdn;fdfdsdnq;dfdsdnqn;fdsdnqnl;dsdnqnlp;sdnqnlph;d
nqnlphn;nqnlphny;qnlphnyi;nlphnyik;lphnyikn;phnyiknc;hnyiknci;nyikncivy;iyikncivy;ikncivyt
;kncivytg;ncivytgi;civytgig;ivytgigd;vytgigdn;ytgigdns;tgigdnst;gigdnsti;igdnstir;gdnstire;dns tiref;nstirefv;stirefvn;tirefvns;irefvnsl;refvnsld;efvnsldd;fvnslddl;vnslddlh;nslddlhk;slddlhkk;l
ddlhkky;ddlhkkyi;dlhkkyif;lhkkyifd;hkkyifdy;kkyifdyl;kyifdyln;yifdylnt;ifdylntn;fdylntne;dyl
ntned;ylntnedf;lntnedfv;ntnedfvv;tnedfvvw;nedfvvwd;edfvvwdm;dfvvwdmi;fvvwdmir;vvwd
mirs;vwdmirsa;wdmirsam;dmirsams;mirsamss;irsamssv;rsamssvs;samssvsd;amssvsds;mssvsd
sv;ssvsdsvi;sv fr;vikidhfrg;ikidhfrgf;kidhfrgfv;idhfrgfvs;dhfrgfvst;hfrgfvstw;frgfvstwe;rgfvstwev;gfvstwevg;
fvstwevgv;vstwevgvg;stwevgvge;twevgvgea;wevgvgeay;evgvgeaya;vgvgeayaf;gvgeayafn;vgeayafng;geayafngl;eayafnglw;ayafnglwv;yafnglwvk;afnglwvks;fnglwvksp;nglwvkspg;glwvkspgr;lwvkspgrd;wvkspgrdf;vkspgrdff;kspgrdffn;spgrdffnf;pgrdffnfi;grdffnfil;rdffnfiln;dffnfilne;ffnfilnei;fnfilneik;nfilneikd;filneikdl;ilneikdlk;lneikdlki;neikdlkiw;eikdlkiwv;ikdlkiwve;kdlkiwved;dlkiwvedf;lkiwvedfe;kiwvedfen;iwvedfend;wvedfendl;vedfendle;edfendled;dfendledv;fendledvs;endledvsr;ndledvsrl;dledvsrlr;ledvsrlrd;edvsrlrdf;dvsrlrdff;vsrlrdffn;srlrdffnf;rlrdffnfp;lrdffnfpg;rdffnfpgm;dffnfpgmr;ffnfpgmri;fnfpgmrim;nfpgmrimk;fpgmrimkl;pgmrimkla;gmrimklaf;mrimklafd;rimklafdf;imklafdfd;mklafdfds;klafdfdsd;lafdfdsdn;afdfdsdnq;fdfdsdnqn;dfdsdnqnl;fdsdnqnlp;dsdnqnlph;sdnqnlphn;dnqnlphny;nqnlphnyi;qnlphnyik;nlphnyikn;lphnyiknc;phnyiknci;hnyikncív;nyikncivy;yikncivyt;ikncivytg;kncivytgi;ncivytgig;civytgigd;ivytgigdn;vytgigdns;ytgigdnst;tgigdnsti;gigdnstir;igdnstire;gdnstiref;dnstirefv;nstirefvn;stirefvns;tirefvnsl;irefvnsld;refvnsldd;efvnslddl;fvnslddlh;vnslddlhk;nslddlhkk;slddlhkky;lddlhkkyi;ddlhkkyif;dlhkkyifd;lhkkyifdy;hkkyifdyl;kkyifdyln;kyifdylnt;yifdylntn;ifdylntne;fdylntned;dylntnedf;ylntnedfv;lntnedfvv;ntnedfvvw;tnedfvvwd;nedfvvwdm;edfvvwdmi;dfvvwdmir;fvvwdmirs;vvwdmirsa;vwdmirsam;wdmirsams;dmirsamss;mirsamssv;irsamssvs;rsamssvsd;samssvsds;amssvsdsv;mssvsdsvi;ssvsdsvii;svsdsviip;vsdsviipm;sdsviipmq;dsviipmqd;sviipmqdy;viipmqdyi;iipmqdyin;ipmqdyinl;pmqdyinlg;mqdyinlgn;qdyinlgne;dyinlgnef;yinlgnefr;inlgnefra;nlgnefran;lgnefrani;gnefranip;nefranipk;efranipkn;franipknt;ranipkntl;anipkntln;nipkntlnn;ipkntlnnw;pkntlnnwi;kntlnnwif;ntlnnwifr;tlnnwifrl;lnnwifrll;nnwifrlle;nwifrlles;wifrllesd;ifrllesdl;frllesdld;rllesdlda;llesdldat;lesdldatl;esdldatls;sdldatlsk;dldatlskn;ldatlskni;datlsknis;atlsknisf;tlsknisfi;lsknisfit;sknisfitr;knisfitrl;nisfitrly;isfitrlyg;sfitrlygr;fitrlygrt;

10 mers:
mkykkirinl;kykkirinln;ykkirinlnl;kkirinlnlk;kirinlnlkr;irinlnlkrk;rinlnlkrks;inlnlkrksg;nlnlkrksgi;lnlkrksgil;nlkrksgill;lkrksgilln;krksgillni;rksgillnis;ksgillniss;sgillnissl;gillnisslp;illnisslps;llnisslpsk;lnisslpsky;nisslpskyg;isslpskygi;sslpskygig;slpskygigd;lpskygigdl;pskygigdlg;skygigdlgk;kygigdlgkg;ygigdlgkga;gigdlgkgay;igdlgkgayk;gdlgkgaykf;dlgkgaykfi;lgkgaykfid;gkgaykfidf;kgaykfidfl;gaykfidflf;aykfidflfa;ykfidflfas;kfidflfass;fidflfassq;idflfassqs;dflfassqsy;flfassqsyw;lfassqsywq;fassqsywqm;assqsywqmf;ssqsywqmfa;sqsywqmfay;qsywqmfays;sywqmfaysp;ywqmfayspi;wqmfayspid;qmfayspidf;mfayspidft;fayspidftr;ayspidftrs;yspidftrsp;spidftrspp;pidftrsppy;idftrsppys;dftrsppysi;ftrsppysif;trsppysifs;rsppysifsa;sppysifsaf;ppysifsafa;pysifsafag;ysifsafagn;sifsafagnv;ifsafagnvy;fsafagnvyy;safagnvyyi;afagnvyyid;fagnvyyidl;agnvyyidle;gnvyyidlea;nvyyidleal;vyyidleald;yyidlealdk;yidlealdkf;idlealdkfi;dlealdkfid;lealdkfids;ealdkfidsd;aldkfidsdl;ldkfidsdln;dkfidsdlnl;kfidsdlnll;fidsdlnllk;idsdlnllke;dsdlnllken;sdlnllkene;dlnllkenet;lnllkenetr;nllkenetry;llkenetrys;lkenetrysd;kenetrysdl;enetrysdlk;netrysdlkk;etrysdlkkl;trysdlkkls;rysdlkklsf;ysdlkklsfk;sdlkklsfkd;dlkklsfkdk;lkklsfkdkf;kklsfkdkfl;klsfkdkflk;lsfkdkflke;sfkdkflkea;fkdkflkeaa;kdkflkeaal;dkflkeaaln;kflkeaalnf;flkeaalnfi;lkeaalnfin;keaalnfinr;eaalnfinra;aalnfinras;alnfinrasv;lnfinrasvd;nfinrasvde;finrasvdev;inrasvdevr;nrasvdevrs;rasvdevrsf;asvdevrsfe;svdevrsfek;vdevrsfekf;devrsfekfk;evrsfekfkk;vrsfekfkkk;rsfekfkkks;sfekfkkkss;fekfkkkssy;ekfkkkssyw;kfkkkssywl;fkkkssywll;kkkssywlld;kkssywlldf;kssywlldfa;ssywlldfas;sywlldfasf;ywlldfasfv;wlldfasfva;lldfasfvaf;ldfasfvafk;dfasfvafke;fasfvafkey;asfvafkeyf;sfvafkeyfl;fvafkeyflk;vafkeyflkd;afkeyflkds;fkeyflkdsr;keyflkdsrd;eyflkdsrda;yflkdsrdaf;flkdsrdafn;lkdsrdafnv;kdsrdafnvl;dsrdafnvlf;srdafnvlfd;rdafnvlfdr;dafnvlfdrg;afnvlfdrgi;fnvlfdrgil;nvlfdrgili;vlfdrgilir;lfdrgilirn;fdrgilirne;drgilirnek;rgilirnekd;gilirnekdl;ilirnekdlf;lirnekdlfk;ir

Fig. 39 continued nekdlfkl;rnekdlfklr;nekdlfklrn;ekdlfklrni;kdlfklrnil;dlfklrnils;lfklrnilsk;fklrnilske;klrnilskei;lrn
ilskeik;rnilskeikv;nilskeikvq;ilskeikvqe;lskeikvqev;skeikvqevl;keikvqevlq;eikvqevlqy;ikvqevl
qyf;kvqevlqyff;vqevlqyfff;qevlqyfffs;evlqyfffsq;vlqyfffsqf;lqyfffsqfq;qyfffsqfqa;yfffsqfqal;fff
sqfqalk;ffsqfqalkr;fsqfqalkry;sqfqalkrya;qfqalkryan;fqalkryand;qalkryandk;alkryandkg;lkryan
dkgi;kryandkgie;ryandkgiel;yandkgielv;andkgielvm;ndkgielvmn;dkgielvmnl;kgielvmnlp;giel
vmnlpl;ielvmnlplf;elvmnlplfi;lvmnlplfia;vmnlplfiay;mnlplfiayd;nlplfiayds;lplfiaydsa;plfiayds
ad;lfiaydsadv;fiaydsadvw;iaydsadvwa;aydsadvwah;ydsadvwahq;dsadvwahqk;sadvwahqky;ad
vwahqkyf;dvwahqkyfk;vwahqkyfkl;wahqkyfklr;ahqkyfklrf;hqkyfklrfd;qkyfklrfda;kyfklrfdas;
yfklrfdask;fklrfdaskd;klrfdaskdk;lrfdaskdkv;rfdaskdkva;fdaskdkvag;daskdkvagi;askdkvagis;s
kdkvagisp;kdkvagispd;dkvagispdy;kvagispdyf;vagispdyfl;agispdyfle;gispdyfleq;ispdyfleqe;sp
dyfleqeq;pdyfleqeqa;dyfleqeqaw;yfleqeqawd;fleqeqawds;leqeqawdsp;eqeqawdspa;qeqawdsp
ay;eqawdspays;qawdspaysw;awdspayswn;wdspayswnv;dspayswnvl;spayswnvlk;payswnvlkn;
ayswnvlknv;yswnvlknvk;swnvlknvky;wnvlknvkye;nvlknvkyew;vlknvkyeww;lknvkyewwa;kn
vkyewwak;nvkyewwakr;vkyewwakri;kyewwakrig;yewwakrigi;ewwakrigil;wwakrigilr;wakrig
ilrk;akrigilrky;krigilrkyi;rigilrkyid;igilrkyidv;gilrkyidvi;ilrkyidvik;lrkyidviki;rkyidvikid;kyidv
ikidh;yidvikidhf;idvikidhfr;dvikidhfrg;vikidhfrgf;ikidhfrgfv;kidhfrgfvs;idhfrgfvst;dhfrgfvstw;
hfrgfvstwe;frgfvstwev;rgfvstwevg;gfvstwevgv;fvstwevgvg;vstwevgvge;stwevgvgea;twevgvg
eay;wevgvgeaya;evgvgeayaf;vgvgeayafn;gvgeayafng;vgeayafngl;geayafnglw;eayafnglwv;aya
fnglwvk;yafnglwvks;afnglwvksp;fnglwvkspg;nglwvkspgr;glwvkspgrd;lwvkspgrdf;wvkspgrdf
f;vkspgrdffn;kspgrdffnf;spgrdffnfi;pgrdffnfil;grdffnfiln;rdffnfilne;dffnfilnei;ffnfilneik;fnfilnei
kd;nfilneikdl;filneikdlk;ilneikdlki;lneikdlkiw;neikdlkiwv;eikdlkiwve;ikdlkiwved;kdlkiwvedf;
dlkiwvedfe;lkiwvedfen;kiwvedfend;iwvedfendl;wvedfendle;vedfendled;edfendledv;dfendledv
s;fendledvsr;endledvsrl;ndledvsrlr;dledvsrlrd;ledvsrlrdf;edvsrlrdff;dvsrlrdffn;vsrlrdffnf;srlrdff
nfp;rlrdffnfpg;lrdffnfpgm;rdffnfpgmr;dffnfpgmri;ffnfpgmrim;fnfpgmrimk;nfpgmrimkl;fpgmri
mkla;pgmrimklaf;gmrimklafd;mrimklafdf;rimklafdfd;imklafdfds;mklafdfdsd;klafdfdsdn;lafdf
dsdnq;afdfdsdnqn;fdfdsdnqnl;dfdsdnqnlp;fdsdnqnlph;dsdnqnlphn;sdnqnlphny;dnqnlphnyi;nq
nlphnyik;qnlphnyikn;nlphnyiknc;lphnyiknci;phnyiknciv;hnyikncivy;nyikncivyt;yikncivytg;ik
ncivytgi;kncivytgig;ncivytgigd;civytgigdn;ivytgigdns;vytgigdnst;ytgigdnsti;tgigdnstir;gigdnst
ire;igdnstiref;gdnstirefv;dnstirefvn;nstirefvns;stirefvnsl;tirefvnsld;irefvnsldd;refvnslddl;efvnsl
ddlh;fvnslddlhk;vnslddlhkk;nslddlhkky;slddlhkkyi;lddlhkkyif;ddlhkkyifd;dlhkkyifdy;lhkkyifd
yl;hkkyifdyln;kkyifdylnt;kyifdylntn;yifdylntne;ifdylntned;fdylntnedf;dylntnedfv;ylntnedfvv;l
ntnedfvvw;ntnedfvvwd;tnedfvvwdm;nedfvvwdmi;edfvvwdmir;dfvvwdmirs;fvvwdmirsa;vvw
dmirsam;vwdmirsams;wdmirsamss;dmirsamssv;mirsamssvs;irsamssvsd;rsamssvsds;samssvsd
sv;amssvsdsvi;mssvsdsvii;ssvsdsviip;svsdsviipm;vsdsviipmq;sdsviipmqd;dsviipmqdy;sviipm
qdyi;viipmqdyin;iipmqdyinl;ipmqdyinlg;pmqdyinlgn;mqdyinlgne;qdyinlgnef;dyinlgnefr;yinlg
nefra;inlgnefran;nlgnefrani;lgnefranip;gnefranipk;nefranipkn;efranipknt;franipkntl;ranipkntln;
anipkntlnn;nipkntlnnw;ipkntlnnwi;pkntlnnwif;kntlnnwifr;ntlnnwifrl;tlnnwifrll;lnnwifrlle;nnwi
frlles;nwifrllesd;wifrllesdl;ifrllesdld;frllesdlda;rllesdldat;llesdldatl;lesdldatls;esdldatlsk;sdldatl
skn;dldatlskni;ldatlsknis;datlsknisf;atlsknisfi;tlsknisfit;lsknisfitr;sknisfitrl;knisfitrly;nisfitrlyg;i
sfitrlygr;sfitrlygrt;

11 mers:
mkykkirinlnln;kykkirinlnl;ykkirinlnlk;kkirinlnlkr;kirinlnlkrk;irinlnlkrks;rinlnlkrksg;inlnlkrksgi;
nlnlkrksgil;lnlkrksgill;nlkrksgilln;lkrksgillni;krksgillnis;rksgillniss;ksgillnissl;sgillnisslp;gillni
sslps;illnisslpsk;llnisslpsky;lnisslpskyg;nisslpskygi;isslpskygig;sslpskygigd;slpskygigdl;lpsky gigdlg;pskygigdlgk;skygigdlgkg;kygigdlgkga;ygigdlgkgay;gigdlgkgayk;igdlgkgaykf;gdlgkga ykfi;dlgkgaykfid;lgkgaykfidf;gkgaykfidfl;kgaykfidflf;gaykfidflfa;aykfidflfas;ykfidflfass;kfidfl fassq;fidflfassqs;idflfassqsy;dflfassqsyw;flfassqsywq;lfassqsywqm;fassqsywqmf;assqsywqmf a;ssqsywqmfay;sqsywqmfays;qsywqmfaysp;sywqmfayspi;ywqmfayspid;wqmfayspidf;qmfay spidft;mfayspidftr;fayspidftrs;ayspidftrsp;yspidftrspp;spidftrsppy;pidftrsppys;idftrsppysi;dftrs ppysif;ftrsppysifs;trsppysifsa;rsppysifsaf;sppysifsafa;ppysifsafag;pysifsafagn;ysifsafagnv;sifs afagnvy;ifsafagnvyy;fsafagnvyyi;safagnvyyid;afagnvyyidl;fagnvyyidle;agnvyyidlea;gnvyyidl eal;nvyyidleald;vyyidlealdk;yyidlealdkf;yidlealdkfi;idlealdkfid;dlealdkfids;lealdkfidsd;ealdkfi dsdl;aldkfidsdln;ldkfidsdlnl;dkfidsdlnll;kfidsdlnllk;fidsdlnllke;idsdlnllken;dsdlnllkene;sdlnllk enet;dlnllkenetr;lnllkenetry;nllkenetrys;llkenetrysd;lkenetrysdl;kenetrysdlk;enetrysdlkk;netrys dlkkl;etrysdlkkls;trysdlkklsf;rysdlkklsfk;ysdlkklsfkd;sdlkklsfkdk;dlkklsfkdkf;lkklsfkdkfl;kklsf kdkflk;klsfkdkflke;lsfkdkflkea;sfkdkflkeaa;fkdkflkeaal;kdkflkeaaln;dkflkeaalnf;kflkeaalnfi;fl keaalnfin;lkeaalnfinr;keaalnfinra;eaalnfinras;aalnfinrasv;alnfinrasvd;lnfinrasvde;nfinrasvdev;f inrasvdevr;inrasvdevrs;nrasvdevrsf;rasvdevrsfe;asvdevrsfek;svdevrsfekf;vdevrsfekfk;devrsfek fkk;evrsfekfkkk;vrsfekfkkks;rsfekfkkkss;sfekfkkkssy;fekfkkkssyw;ekfkkkssywl;kfkkkssywll; fkkkssywlld;kkkssywlldf;kkssywlldfa;kssywlldfas;ssywlldfasf;sywlldfasfv;ywlldfasfva;wlldfa sfvaf;lldfasfvafk;ldfasfvafke;dfasfvafkey;fasfvafkeyf;asfvafkeyfl;sfvafkeyflk;fvafkeyflkd;vaf keyflkds;afkeyflkdsr;fkeyflkdsrd;keyflkdsrda;eyflkdsrdaf;yflkdsrdafn;flkdsrdafnv;lkdsrdafnvl ;kdsrdafnvlf;dsrdafnvlfd;srdafnvlfdr;rdafnvlfdrg;dafnvlfdrgi;afnvlfdrgil;fnvlfdrgili;nvlfdrgilir; vlfdrgilirn;lfdrgilirne;fdrgilirnek;drgilirnekd;rgilirnekdl;gilirnekdlf;ilirnekdlfk;lirnekdlfkl;irne kdlfklr;rnekdlfklrn;nekdlfklrni;ekdlfklrnil;kdlfklrnils;dlfklrnilsk;lfklrnilske;fklrnilskei;klrnilsk eik;lrnilskeikv;rnilskeikvq;nilskeikvqe;ilskeikvqev;lskeikvqevl;skeikvqevlq;keikvqevlqy;eikv qevlqyf;ikvqevlqyff;kvqevlqyfff;vqevlqyfffs;qevlqyfffsq;evlqyfffsqf;vlqyfffsqfq;lqyfffsqfqa;q yfffsqfqal;yfffsqfqalk;fffsqfqalkr;ffsqfqalkry;fsqfqalkrya;sqfqalkryan;qfqalkryand;fqalkryand k;qalkryandkg;alkryandkgi;lkryandkgie;kryandkgiel;ryandkgielv;yandkgielvm;andkgielvmn;n dkgielvmnl;dkgielvmnlp;kgielvmnlpl;gielvmnlplf;ielvmnlplfi;elvmnlplfia;lvmnlplfiay;vmnlpl fiayd;mnlplfiayds;nlplfiaydsa;lplfiaydsad;plfiaydsadv;lfiaydsadvw;fiaydsadvwa;iaydsadvwah; aydsadvwahq;ydsadvwahqk;dsadvwahqky;sadvwahqkyf;advwahqkyfk;dvwahqkyfkl;vwahqk yfklr;wahqkyfklrf;ahqkyfklrfd;hqkyfklrfda;qkyfklrfdas;kyfklrfdask;yfklrfdaskd;fklrfdaskdk;kl rfdaskdkv;lrfdaskdkva;rfdaskdkvag;fdaskdkvagi;daskdkvagis;askdkvagisp;skdkvagispd;kdkv agispdy;dkvagispdyf;kvagispdyfl;vagispdyfle;agispdyfleq;gispdyfleqe;ispdyfleqeq;spdyfleqeq a;pdyfleqeqaw;dyfleqeqawd;yfleqeqawds;fleqeqawdsp;leqeqawdspa;eqeqawdspay;qeqawdsp ays;eqawdspaysw;qawdspayswn;awdspayswnv;wdspayswnvl;dspayswnvlk;spayswnvlkn;pays wnvlknv;ayswnvlknvk;yswnvlknvky;swnvlknvkye;wnvlknvkyew;nvlknvkyeww;vlknvkyeww a;lknvkyewwak;knvkyewwakr;nvkyewwakri;vkyewwakrig;kyewwakrigi;yewwakrigil;ewwak rigilr;wwakrigilrk;wakrigilrky;akrigilrkyi;krigilrkyid;rigilrkyidv;igilrkyidvi;gilrkyidvik;ilrkyi dviki;lrkyidvikid;rkyidvikidh;kyidvikidhf;yidvikidhfr;idvikidhfrg;dvikidhfrgf;vikidhfrgfv;ikid hfrgfvs;kidhfrgfvst;idhfrgfvstw;dhfrgfvstwe;hfrgfvstwev;frgfvstwevg;rgfvstwevgv;gfvstwevg vg;fvstwevgvge;vstwevgvgea;stwevgvgeay;twevgvgeaya;wevgvgeayaf;evgvgeayafn;vgvgeay afng;gvgeayafngl;vgeayafnglw;geayafnglwv;eayafnglwvk;ayafnglwvks;yafnglwvksp;afnglwv kspg;fnglwvkspgr;nglwvkspgrd;glwvkspgrdf;lwvkspgrdff;wvkspgrdffn;vkspgrdffnf;kspgrdffn fi;spgrdffnfil;pgrdffnfiln;grdffnfilne;rdffnfilnei;dffnfilneik;ffnfilneikd;fnfilneikdl;nfilneikdlk;f ilneikdlki;ilneikdlkiw;lneikdlkiwv;neikdlkiwve;eikdlkiwved;ikdlkiwvedf;kdlkiwvedfe;dlkiwv edfen;lkiwvedfend;kiwvedfendl;iwvedfendle;wvedfendled;vedfendledv;edfendledvs;dfendled vsr;fendledvsrl;endledvsrlr;ndledvsrlrd;dledvsrlrdf;ledvsrlrdff;edvsrlrdffn;dvsrlrdffnf;vsrlrdff

Fig. 39 continued nfp;srlrdffnfpg;rlrdffnfpgm;lrdffnfpgmr;rdffnfpgmri;dffnfpgmrim;ffnfpgmrimk;fnfpgmrimkl;nfpgmrimkla;fpgmrimklaf;pgmrimklafd;gmrimklafdf;mrimklafdfd;rimklafdfds;imklafdfdsd;mklafdfdsdn;klafdfdsdnq;lafdfdsdnqn;afdfdsdnqnl;fdfdsdnqnlp;dfdsdnqnlph;fdsdnqnlphn;dsdnqnlphny;sdnqnlphnyi;dnqnlphnyik;nqnlphnyikn;qnlphnyiknc;nlphnyiknci;lphnyikncív;phnyiknciyy;hnyikncivyt;nyikncivytg;yikncivytgi;ikncivytgig;kncivytgigd;ncivytgigdn;civytgigdns;ivytgigdnst;vytgigdnsti;ytgigdnstir;tgigdnstire;gigdnstiref;igdnstirefv;gdnstirefvn;dnstirefvns;nstirefvnsl;stirefvnsld;tirefvnsldd;irefvnsldd l;refvnslddlh;efvnslddlhk;fvnslddlhkk;vnslddlhkky;nslddlhkkyi;slddlhkkyif;lddlhkkyifd;ddlhkkyifdy;dlhkkyifdyl;lhkkyifdyln;hkkyifdylnt;kkyifdylntn;kyifdylntne;yifdylntned;ifdylntnedf;fdylntnedfv;dylntnedfvv;ylntnedfvvw;lntnedfvvwd;ntnedfvvwdm;tnedfvvwdmi;nedfvvwdmir;edfvvwdmirs;dfvvwdmirsa;fvvwdmirsam;vvwdmirsams;vwdmirsamss;wdmirsamssv;dmirsamssvs;mirsamssvsd;irsamssvsds;rsamssvsdsv;samssvsdsvi;amssvsdsvii;mssvsdsviip;ssvsdsviipm;svsdsviipmq;vsdsviipmqd;sdsviipmqdy;dsviipmqdyi;sviipmqdyin;viipmqdyinl;iipmqdyinlg;ipmqdyinlgn;pmqdyinlgne;mqdyinlgnef;qdyinlgnefr;dyinlgnefra;yinlgnefran;inlgnefrani;nlgnefranip;lgnefranipk;gnefranipkn;nefranipknt;efranipkntl;franipkntln;ranipkntlnn;anipkntlnnw;nipkntlnnwi;ipkntlnnwif;pkntlnnwifr;kntlnnwifrl;ntlnnwifrll;tlnnwifrlle;lnnwifrlles;nnwifrllesd;nwifrllesdl;wifrllesdld;ifrllesdlda;frllesdldat;rllesdldatl;llesdldatls;lesdldatlsk;esdldatlskn;sdldatlskni;dldatlsknis;ldatlsknisf;datlsknisfi;atlsknisfit;tlsknisfitr;lsknisfitrl;sknisfitrly;knisfitrlyg;nisfitrlygr;isfitrlygrt;

13 mers:
mkykkirinlnlk;kykkirinlnlkr;ykkirinlnlkrk;kkirinlnlkrks;kirinlnlkrksg;irinlnlkrksgi;rinlnlkrksgil;inlnlkrksgill;nlnlkrksgilln;lnlkrksgillni;nlkrksgillnis;lkrksgillniss;krksgillnissl;rksgillnisslp;ksgillnisslps;sgillnisslpsk;gillnisslpsky;illnisslpskyg;llnisslpskygi;lnisslpskygig;nisslpskygigd;isslpskygigdl;sslpskygigdlg;slpskygigdlgk;lpskygigdlgkg;pskygigdlgkga;skygigdlgkgay;kygigdlgkgayk;ygigdlgkgaykf;gigdlgkgaykfi;igdlgkgaykfid;gdlgkgaykfidf;dlgkgaykfidfl;lgkgaykfidflf;gkgaykfidflfa;kgaykfidflfas;gaykfidflfass;aykfidflfassq;ykfidflfassqs;kfidflfassqsy;fidflfassqsyw;idflfassqsywq;dflfassqsywqm;flfassqsywqmf;lfassqsywqmfa;fassqsywqmfay;assqsywqmfays;ssqsywqmfaysp;sqsywqmfayspi;qsywqmfayspid;sywqmfayspidf;ywqmfayspidft;wqmfayspidftr;qmfayspidftrs;mfayspidftrsp;fayspidftrspp;ayspidftrsppy;yspidftrsppys;spidftrsppysi;pidftrsppysif;idftrsppysifs;dftrsppysifsa;ftrsppysifsaf;trsppysifsafa;rsppysifsafag;sppysifsafagn;ppysifsafagnv;pysifsafagnvy;ysifsafagnvyy;sifsafagnvyyi;ifsafagnvyyid;fsafagnvyyidl;safagnvyyidle;afagnvyyidlea;fagnvyyidleal;agnvyyidleald;gnvyyidlealdk;nvyyidlealdkf;vyyidlealdkfi;yyidlealdkfid;yidlealdkfids;idlealdkfidsd;dlealdkfidsdl;lealdkfidsdln;ealdkfidsdlnl;aldkfidsdlnll;ldkfidsdlnllk;dkfidsdlnllke;kfidsdlnllken;fidsdlnllkene;idsdlnllkenet;dsdlnllkenetr;sdlnllkenetry;dlnllkenetrys;lnllkenetrysd;nllkenetrysdl;llkenetrysdlk;lkenetrysdlkk;kenetrysdlkkl;enetrysdlkkls;netrysdlkklsf;etrysdlkklsfk;trysdlkklsfkd;rysdlkklsfkdk;ysdlkklsfkdkf;sdlkklsfkdkfl;dlkklsfkdkflk;lkklsfkdkflke;kklsfkdkflkea;klsfkdkflkeaa;lsfkdkflkeaal;sfkdkflkeaaln;fkdkflkeaalnf;kdkflkeaalnfi;dkflkeaalnfin;kflkeaalnfinr;flkeaalnfinra;lkeaalnfinras;keaalnfinrasv;eaalnfinrasvd;aalnfinrasvde;alnfinrasvdev;lnfinrasvdevr;nfinrasvdevrs;finrasvdevrsf;inrasvdevrsfe;nrasvdevrsfek;rasvdevrsfekf;asvdevrsfekfk;svdevrsfekfkk;vdevrsfekfkkk;devrsfekfkkks;evrsfekfkkkss;vrsfekfkkkssy;rsfekfkkkssyw;sfekfkkkssywl;fekfkkkssywll;ekfkkkssywlld;kfkkkssywlldf;fkkkssywlldfa;kkkssywlldfas;kkssywlldfasf;kssywlldfasfv;ssywlldfasfva;sywlldfasfvaf;ywlldfasfvafk;wlldfasfvafke;lldfasfvafkey;ldfasfvafkeyf;dfasfvafkeyfl;fasfvafkeyflk;asfvafkeyflkd;sfvafkeyflkds;fvafkeyflkdsr;vafkeyflkdsrd;afkeyflkdsrda;fkeyflkdsrdaf;keyflkdsrdafn;eyflkdsrdafnv;yflkdsrdafnvl;flkdsrdafnvlf;lkdsrdafnvlfd;kdsrdafnvlfdr;dsrdafnvlfdrg;srdafnvlfd

Fig. 39 continued rgi;rdafnvlfdrgil;dafnvlfdrgili;afnvlfdrgilir;fnvlfdrgilirn;nvlfdrgilirne;vlfdrgilirnek;lfdrgilirnek
d;fdrgilirnekdl;drgilirnekdlf;rgilirnekdlfk;gilirnekdlfkl;ilirnekdlfklr;lirnekdlfklrn;irnekdlfklrni
;rnekdlfklrnil;nekdlfklrnils;ekdlfklrnilsk;kdlfklrnilske;dlfklrnilskei;lfklrnilskeik;fklrnilskeikv;
klrnilskeikvq;lrnilskeikvqe;rnilskeikvqev;nilskeikvqevl;ilskeikvqevlq;lskeikvqevlqy;skeikvqe
vlqyf;keikvqevlqyff;eikvqevlqyfff;ikvqevlqyfffs;kvqevlqyfffsq;vqevlqyfffsqf;qevlqyfffsqfq;e
vlqyfffsqfqa;vlqyfffsqfqal;lqyfffsqfqalk;qyfffsqfqalkr;yfffsqfqalkry;fffsqfqalkrya;ffsqfqalkrya
n;fsqfqalkryand;sqfqalkryandk;qfqalkryandkg;fqalkryandkgi;qalkryandkgie;alkryandkgiel;lkr
yandkgielv;kryandkgielvm;ryandkgielvmn;yandkgielvmnl;andkgielvmnlp;ndkgielvmnlpl;dkg
ielvmnlplf;kgielvmnlplfi;gielvmnlplfia;ielvmnlplfiay;elvmnlplfiayd;lvmnlplfiayds;vmnlplfiay
dsa;mnlplfiaydsad;nlplfiaydsadv;lplfiaydsadvw;plfiaydsadvwa;lfiaydsadvwah;fiaydsadvwahq
;iaydsadvwahqk;aydsadvwahqky;ydsadvwahqkyf;dsadvwahqkyfk;sadvwahqkyfkl;advwahqky
fklr;dvwahqkyfklrf;vwahqkyfklrfd;wahqkyfklrfda;ahqkyfklrfdas;hqkyfklrfdask;qkyfklrfdaskd
;kyfklrfdaskdk;yfklrfdaskdkv;fklrfdaskdkva;klrfdaskdkvag;lrfdaskdkvagi;rfdaskdkvagis;fdask
dkvagisp;daskdkvagispd;askdkvagispdy;skdkvagispdyf;kdkvagispdyfl;dkvagispdyfle;kvagisp
dyfleq;vagispdyfleqe;agispdyfleqeq;gispdyfleqeqa;ispdyfleqeqaw;spdyfleqeqawd;pdyfleqeqa
wds;dyfleqeqawdsp;yfleqeqawdspa;fleqeqawdspay;leqeqawdspays;eqeqawdspaysw;qeqawds
payswn;eqawdspayswnv;qawdspayswnvl;awdspayswnvlk;wdspayswnvlkn;dspayswnvlknv;sp
ayswnvlknvk;payswnvlknvky;ayswnvlknvkye;yswnvlknvkyew;swnvlknvkyeww;wnvlknvkye
wwa;nvlknvkyewwak;vlknvkyewwakr;lknvkyewwakri;knvkyewwakrig;nvkyewwakrigi;vkye
wwakrigil;kyewwakrigilr;yewwakrigilrk;ewwakrigilrky;wwakrigilrkyi;wakrigilrkyid;akrigilrk
yidv;krigilrkyidvi;rigilrkyidvik;igilrkyidviki;gilrkyidvikid;ilrkyidvikidh;lrkyidvikidhf;rkyidvi
kidhfr;kyidvikidhfrg;yidvikidhfrgf;idvikidhfrgfv;dvikidhfrgfvs;vikidhfrgfvst;ikidhfrgfvstw;ki
dhfrgfvstwe;idhfrgfvstwev;dhfrgfvstwevg;hfrgfvstwevgv;frgfvstwevgvg;rgfvstwevgvge;gfvst
wevgvgea;fvstwevgvgeay;vstwevgvgeaya;stwevgvgeayaf;twevgvgeayafn;wevgvgeayafng;ev
gvgeayafngl;vgvgeayafnglw;gvgeayafnglwv;vgeayafnglwvk;geayafnglwvks;eayafnglwvksp;a
yafnglwvkspg;yafnglwvkspgr;afnglwvkspgrd;fnglwvkspgrdf;nglwvkspgrdff;glwvkspgrdffn;l
wvkspgrdffnf;wvkspgrdffnfi;vkspgrdffnfil;kspgrdffnfiln;spgrdffnfilne;pgrdffnfilnei;grdffnfiln
eik;rdffnfilneikd;dffnfilneikdl;ffnfilneikdlk;fnfilneikdlki;nfilneikdlkiw;filneikdlkiwv;ilneikdlk
iwve;lneikdlkiwved;neikdlkiwvedf;eikdlkiwvedfe;ikdlkiwvedfen;kdlkiwvedfend;dlkiwvedfen
dl;lkiwvedfendle;kiwvedfendled;iwvedfendledv;wvedfendledvs;vedfendledvsr;edfendledvsrl;
dfendledvsrlr;fendledvsrlrd;endledvsrlrdf;ndledvsrlrdff;dledvsrlrdffn;ledvsrlrdffnf;edvsrlrdffn
fp;dvsrlrdffnfpg;vsrlrdffnfpgm;srlrdffnfpgmr;rlrdffnfpgmri;lrdffnfpgmrim;rdffnfpgmrimk;dff
nfpgmrimkl;ffnfpgmrimkla;fnfpgmrimklaf;nfpgmrimklafd;fpgmrimklafdf;pgmrimklafdfd;gm
rimklafdfds;mrimklafdfdsd;rimklafdfdsdn;imklafdfdsdnq;mklafdfdsdnqn;klafdfdsdnqnl;lafdfd
sdnqnlp;afdfdsdnqnlph;fdfdsdnqnlphn;dfdsdnqnlphny;fdsdnqnlphnyi;dsdnqnlphnyik;sdnqnlp
hnyikn;dnqnlphnyiknc;nqnlphnyiknci;qnlphnyikncıv;nlphnyiknciyy;lphnyiknciyyt;phnyiknci
vytg;hnyiknciyytgi;nyiknciyytgig;yiknciyytgigd;ikncivytgigdn;kncivytgigdns;ncivytgigdnst;ci
vytgigdnsti;ivytgigdnstir;vytgigdnstire;ytgigdnstiref;tgigdnstirefv;gigdnstirefvn;igdnstirefvns;
gdnstirefvnsl;dnstirefvnsld;nstirefvnsldd;stirefvnslddl;tirefvnslddlh;irefvnslddlhk;refvnslddlh
kk;efvnslddlhkky;fvnslddlhkkyi;vnslddlhkkyif;nslddlhkkyifd;slddlhkkyifdy;lddlhkkyifdyl;ddl
hkkyifdyln;dlhkkyifdylnt;lhkkyifdylntn;hkkyifdylntne;kkyifdylntned;kyifdylntnedf;yifdylntne
dfv;ifdylntnedfvv;fdylntnedfvvw;dylntnedfvvwd;ylntnedfvvwdm;lntnedfvvwdmi;ntnedfvvwd
mir;tnedfvvwdmirs;nedfvvwdmirsa;edfvvwdmirsam;dfvvwdmirsams;fvvwdmirsamss;vvwdm
irsamssv;vwdmirsamssvs;wdmirsamssvsd;dmirsamssvsds;mirsamssvsdsv;irsamssvsdsvi;rsam
ssvsdsvii;samssvsdsviip;amssvsdsviipm;mssvsdsviipmq;ssvsdsviipmqd;svsdsviipmqdy;vsdsvi

Fig. 39 continued ipmqdyi;sdsviipmqdyin;dsviipmqdyinl;sviipmqdyinlg;viipmqdyinlgn;iipmqdyinlgne;ipmqdyi
nlgnef;pmqdyinlgnefr;mqdyinlgnefra;qdyinlgnefran;dyinlgnefrani;yinlgnefranip;inlgnefranip
k;nlgnefranipkn;lgnefranipknt;gnefranipkntl;nefranipkntln;efranipkntlnn;franipkntlnnw;ranip
kntlnnwi;anipkntlnnwif;nipkntlnnwifr;ipkntlnnwifrl;pkntlnnwifrll;kntlnnwifrlle;ntlnnwifrlles;t
lnnwifrllesd;lnnwifrllesdl;nnwifrllesdld;nwifrllesdlda;wifrllesdldat;ifrllesdldatl;frllesdldatls;rll
esdldatlsk;llesdldatlskn;lesdldatlskni;esdldatlsknis;sdldatlsknisf;dldatlsknisfi;ldatlsknisfit;datl
sknisfitr;atlsknisfitrl;tlsknisfitrly;lsknisfitrlyg;sknisfitrlygr;knisfitrlygrt;

14 mers:
mkykkirinlnlkr;kykkirinlnlkrk;ykkirinlnlkrks;kkirinlnlkrksg;kirinlnlkrksgi;irinlnlkrksgil;rinlnl
krksgill;inlnlkrksgilln;nlnlkrksgillni;lnlkrksgillnis;nlkrksgillniss;lkrksgillnissl;krksgillnisslp;r
ksgillnisslps;ksgillnisslpsk;sgillnisslpsky;gillnisslpskyg;illnisslpskygi;llnisslpskygig;lnisslpsk
ygigd;nisslpskygigdl;isslpskygigdlg;sslpskygigdlgk;slpskygigdlgkg;lpskygigdlgka;pskygigdl
gkgay;skygigdlgkayk;kygigdlgkaykf;ygigdlgkaykfi;gigdlgkaykfid;igdlgkaykfidf;gdlgkg
aykfidfl;dlgkgaykfidflf;lgkgaykfidflfa;gkgaykfidflfas;kgaykfidflfass;gaykfidflfassq;aykfidflfa
ssqs;ykfidflfassqsy;kfidflfassqsyw;fidflfassqsywq;idflfassqsywqm;dflfassqsywqmf;flfassqsyw
qmfa;lfassqsywqmfay;fassqsywqmfays;assqsywqmfaysp;ssqsywqmfayspi;sqsywqmfayspid;q
sywqmfayspidf;sywqmfayspidft;ywqmfayspidftr;wqmfayspidftrs;qmfayspidftrsp;mfayspidftrs
pp;fayspidftrsppy;ayspidftrsppys;yspidftrsppysi;spidftrsppysif;pidftrsppysifs;idftrsppysifsa;dft
rsppysifsaf;ftrsppysifsafa;trsppysifsafag;rsppysifsafagn;sppysifsafagnv;ppysifsafagnvy;pysifs
afagnvyy;ysifsafagnvyyi;sifsafagnvyyid;ifsafagnvyyidl;fsafagnvyyidle;safagnvyyidlea;afagnv
yyidleal;fagnvyyidleald;agnvyyidlealdk;gnvyyidlealdkf;nvyyidlealdkfi;vyyidlealdkfid;yyidlea
ldkfids;yidlealdkfidsd;idlealdkfidsdl;dlealdkfidsdln;lealdkfidsdlnl;ealdkfidsdlnll;aldkfidsdlnll
k;ldkfidsdlnllke;dkfidsdlnllken;kfidsdlnllkene;fidsdlnllkenet;idsdlnllkenetr;dsdlnllkenetry;sdl
nllkenetrys;dlnllkenetrysd;lnllkenetrysdl;nllkenetrysdlk;llkenetrysdlkk;lkenetrysdlkkl;kenetry
sdlkkls;enetrysdlkklsf;netrysdlkklsfk;etrysdlkklsfkd;trysdlkklsfkdk;rysdlkklsfkdkf;ysdlkklsfk
dkfl;sdlkklsfkdkflk;dlkklsfkdkflke;lkklsfkdkflkea;kklsfkdkflkeaa;klsfkdkflkeaal;lsfkdkflkeaal
n;sfkdkflkeaalnf;fkdkflkeaalnfi;kdkflkeaalnfin;dkflkeaalnfinr;kflkeaalnfinra;flkeaalnfinras;lke
aalnfinrasv;keaalnfinrasvd;eaalnfinrasvde;aalnfinrasvdev;alnfinrasvdevr;lnfinrasvdevrs;nfinra
svdevrsf;finrasvdevrsfe;inrasvdevrsfek;nrasvdevrsfekf;rasvdevrsfekfk;asvdevrsfekfkk;svdevrs
fekfkkk;vdevrsfekfkkks;devrsfekfkkkss;evrsfekfkkkssy;vrsfekfkkkssyw;rsfekfkkkssywl;sfekf
kkkssywll;fekfkkkssywlld;ekfkkkssywlldf;kfkkkssywlldfa;fkkkssywlldfas;kkkssywlldfasf;kks
sywlldfasfv;kssywlldfasfva;ssywlldfasfvaf;sywlldfasfvafk;ywlldfasfvafke;wlldfasfvafkey;lldf
asfvafkeyf;ldfasfvafkeyfl;dfasfvafkeyflk;fasfvafkeyflkd;asfvafkeyflkds;sfvafkeyflkdsr;fvafke
yflkdsrd;vafkeyflkdsrda;afkeyflkdsrdaf;fkeyflkdsrdafn;keyflkdsrdafnv;eyflkdsrdafnvl;yflkdsr
dafnvlf;flkdsrdafnvlfd;lkdsrdafnvlfdr;kdsrdafnvlfdrg;dsrdafnvlfdrgi;srdafnvlfdrgil;rdafnvlfdrg
ili;dafnvlfdrgilir;afnvlfdrgilirn;fnvlfdrgilirne;nvlfdrgilirnek;vlfdrgilirnekd;lfdrgilirnekdl;fdrgil
irnekdlf;drgilirnekdlfk;rgilirnekdlfkl;gilirnekdlfklr;ilirnekdlfklrn;lirnekdlfklrni;irnekdlfklrnil;r
nekdlfklrnils;nekdlfklrnilsk;ekdlfklrnilske;kdlfklrnilskei;dlfklrnilskeik;lfklrnilskeikv;fklrnilsk
eikvq;klrnilskeikvqe;lrnilskeikvqev;rnilskeikvqevl;nilskeikvqevlq;ilskeikvqevlqy;lskeikvqevl
qyf;skeikvqevlqyff;keikvqevlqyfff;eikvqevlqyfffs;ikvqevlqyfffsq;kvqevlqyfffsqf;vqevlqyfffsq
fq;qevlqyfffsqfqa;evlqyfffsqfqal;vlqyfffsqfqalk;lqyfffsqfqalkr;qyfffsqfqalkry;yfffsqfqalkrya;ff
fsqfqalkryan;ffsqfqalkryand;fsqfqalkryandk;sqfqalkryandkg;qfqalkryandkgi;fqalkryandkgie;q
alkryandkgiel;alkryandkgielv;lkryandkgielvm;kryandkgielvmn;ryandkgielvmnl;yandkgielvm
nlp;andkgielvmnlpl;ndkgielvmnlplf;dkgielvmnlplfi;kgielvmnlplfia;gielvmnlplfiay;ielvmnlplfi

Fig. 39 continued ayd;elvmnlplfiayds;lvmnlplfiaydsa;vmnlplfiaydsad;mnlplfiaydsadv;nlplfiaydsadvw;lplfiaydsa
dvwa;plfiaydsadvwah;lfiaydsadvwahq;fiaydsadvwahqk;iaydsadvwahqky;aydsadvwahqkyf;yd
sadvwahqkyfk;dsadvwahqkyfkl;sadvwahqkyfklr;advwahqkyfklrf;dvwahqkyfklrfd;vwahqkyfk
lrfda;wahqkyfklrfdas;ahqkyfklrfdask;hqkyfklrfdaskd;qkyfklrfdaskdk;kyfklrfdaskdkv;yfklrfda
skdkva;fklrfdaskdkvag;klrfdaskdkvagi;lrfdaskdkvagis;rfdaskdkvagisp;fdaskdkvagispd;daskdk
vagispdy;askdkvagispdyf;skdkvagispdyfl;kdkvagispdyfle;dkvagispdyfleq;kvagispdyfleqe;vag
ispdyfleqeq;agispdyfleqeqa;gispdyfleqeqaw;ispdyfleqeqawd;spdyfleqeqawds;pdyfleqeqawdsp
;dyfleqeqawdspa;yfleqeqawdspay;fleqeqawdspays;leqeqawdspaysw;eqeqawdspayswn;qeqaw
dspayswnv;eqawdspayswnvl;qawdspayswnvlk;awdspayswnvlkn;wdspayswnvlknv;dspayswn
vlknvk;spayswnvlknvky;payswnvlknvkye;ayswnvlknvkyew;yswnvlknvkyeww;swnvlknvkye
wwa;wnvlknvkyewwak;nvlknvkyewwakr;vlknvkyewwakri;lknvkyewwakrig;knvkyewwakrigi
;nvkyewwakrigil;vkyewwakrigilr;kyewwakrigilrk;yewwakrigilrky;ewwakrigilrkyi;wwakrigilr
kyid;wakrigilrkyidv;akrigilrkyidvi;krigilrkyidvik;rigilrkyidviki;igilrkyidvikid;gilrkyidvikidh;i
lrkyidvikidhf;lrkyidvikidhfr;rkyidvikidhfrg;kyidvikidhfrgf;yidvikidhfrgfv;idvikidhfrgfvs;dvik
idhfrgfvst;vikidhfrgfvstw;ikidhfrgfvstwe;kidhfrgfvstwev;idhfrgfvstwevg;dhfrgfvstwevgv;hfrg
fvstwevgvg;frgfvstwevgvge;rgfvstwevgvgea;gfvstwevgvgeay;fvstwevgvgeaya;vstwevgvgeay
af;stwevgvgeayaf n;twevgvgeayafng;wevgvgeayafngl;evgvgeayafnglw;vgvgeayafnglwv;gvge
ayafnglwvk;vgeayafnglwvks;geayafnglwvksp;eayafnglwvkspg;ayafnglwvkspgr;yafnglwvksp
grd;afnglwvkspgrdf;fnglwvkspgrdff;nglwvkspgrdffn;glwvkspgrdffnf;lwvkspgrdffnfi;wvkspgr
dffnfil;vkspgrdffnfiln;kspgrdffnfilne;spgrdffnfilnei;pgrdffnfilneik;grdffnfilneikd;rdffnfilneikd
l;dffnfilneikdlk;ffnfilneikdlki;fnfilneikdlkiw;nfilneikdlkiwv;filneikdlkiwve;ilneikdlkiwved;lne
ikdlkiwvedf;neikdlkiwvedfe;eikdlkiwvedfen;ikdlkiwvedfend;kdlkiwvedfendl;dlkiwvedfendle;
lkiwvedfendled;kiwvedfendledv;iwvedfendledvs;wvedfendledvsr;vedfendledvsrl;edfendledvs
rlr;dfendledvsrlrd;fendledvsrlrdf;endledvsrlrdff;ndledvsrlrdffn;dledvsrlrdffnf;ledvsrlrdffnfp;e
dvsrlrdffnfpg;dvsrlrdffnfpgm;vsrlrdffnfpgmr;srlrdffnfpgmri;rlrdffnfpgmrim;lrdffnfpgmrimk;r
dffnfpgmrimkl;dffnfpgmrimkla;ffnfpgmrimklaf;fnfpgmrimklafd;nfpgmrimklafdf;fpgmrimklaf
dfd;pgmrimklafdfds;gmrimklafdfdsd;mrimklafdfdsdn;rimklafdfdsdnq;imklafdfdsdnqn;mklafd
fdsdnqnl;klafdfdsdnqnlp;lafdfdsdnqnlph;afdfdsdnqnlphn;fdfdsdnqnlphny;dfdsdnqnlphnyi;fds
dnqnlphnyik;dsdnqnlphnyikn;sdnqnlphnyiknc;dnqnlphnyiknci;nqnlphnyikn civ;qnlphnyikn civ
y;nlphnyikncivyt;lphnyikncivytg;phnyikncivytgi;hnyikncivytgig;nyikncivytgigd;yikncivytgig
dn;ikncivytgigdns;kncivytgigdnst;ncivytgigdnsti;civytgigdnstir;ivytgigdnstire;vytgigdnstiref;y
tgigdnstirefv;tgigdnstirefvn;gigdnstirefvns;igdnstirefvnsl;gdnstirefvnsld;dnstirefvnsldd;nstiref
vnslddl;stirefvnslddlh;tirefvnslddlhk;irefvnslddlhkk;refvnslddlhkky;efvnslddlhkkyi;fvnslddlh
kkyif;vnslddlhkkyifd;nslddlhkkyifdy;slddlhkkyifdyl;lddlhkkyifdyln;ddlhkkyifdylnt;dlhkkyifd
ylntn;lhkkyifdylntne;hkkyifdylntned;kkyifdylntnedf;kyifdylntnedfv;yifdylntnedfvv;ifdylntned
fvvw;fdylntnedfvvwd;dylntnedfvvwdm;ylntnedfvvwdmi;lntnedfvvwdmir;ntnedfvvwdmirs;tne
dfvvwdmirsa;nedfvvwdmirsam;edfvvwdmirsams;dfvvwdmirsamss;fvvwdmirsamssv;vvwdmi
rsamssvs;vwdmirsamssvsd;wdmirsamssvsds;dmirsamssvsdsv;mirsamssvsdsvi;irsamssvsdsvii;
rsamssvsdsviip;samssvsdsviipm;amssvsdsviipmq;mssvsdsviipmqd;ssvsdsviipmqdy;svsdsviip
mqdyi;vsdsviipmqdyin;sdsviipmqdyinl;dsviipmqdyinlg;sviipmqdyinlgn;viipmqdyinlgne;iipm
qdyinlgnef;ipmqdyinlgnefr;pmqdyinlgnefra;mqdyinlgnefran;qdyinlgnefrani;dyinlgnefranip;yi
nlgnefranipk;inlgnefranipkn;nlgnefranipknt;lgnefranipkntl;gnefranipkntln;nefranipkntlnn;efra
nipkntlnnw;franipkntlnnwi;ranipkntlnnwif;anipkntlnnwifr;nipkntlnnwifrl;ipkntlnnwifrll;pkntl
nnwifrlle;kntlnnwifrlles;ntlnnwifrllesd;tlnnwifrllesdl;lnnwifrllesdld;nnwifrllesdlda;nwifrllesdl
dat;wifrllesdldatl;ifrllesdldatls;frllesdldatlsk;rllesdldatlskn;llesdldatlskni;lesdldatlsknis;esdldat

Fig. 39 continued lsknisf;sdldatlsknisfi;dldatlsknisfit;ldatlsknisfitr;datlsknisfitrl;atlsknisfitrly;tlsknisfitrlyg;lsknis
fitrlygr;sknisfitrlygrt;

15 mers:
mkykkirinlnlkrk;kykkirinlnlkrks;ykkirinlnlkrksg;kkirinlnlkrksgi;kirinlnlkrksgil;irinlnlkrksgill;
rinlnlkrksgilln;inlnlkrksgillni;nlnlkrksgillnis;lnlkrksgillniss;nlkrksgillnissl;lkrksgillnisslp;krks
gillnisslps;rksgillnisslpsk;ksgillnisslpsky;sgillnisslpskyg;gillnisslpskygi;illnisslpskygig;llnissl
pskygigd;lnisslpskygigdl;nisslpskygigdlg;isslpskygigdlgk;sslpskygigdlgkg;slpskygigdlgkga;lp
skygigdlgkgay;pskygigdlgkgayk;skygigdlgkgaykf;kygigdlgkgaykfi;ygigdlgkgaykfid;gigdlgkg
aykfidf;igdlgkgaykfidfl;gdlgkgaykfidflf;dlgkgaykfidflfa;lgkgaykfidflfas;gkgaykfidflfass;kgay
kfidflfassq;gaykfidflfassqs;aykfidflfassqsy;ykfidflfassqsyw;kfidflfassqsywq;fidflfassqsywqm;
idflfassqsywqmf;dflfassqsywqmfa;flfassqsywqmfay;lfassqsywqmfays;fassqsywqmfaysp;assq
sywqmfayspi;ssqsywqmfayspid;sqsywqmfayspidf;qsywqmfayspidft;sywqmfayspidftr;ywqmf
ayspidftrs;wqmfayspidftrsp;qmfayspidftrspp;mfayspidftrsppy;fayspidftrsppys;ayspidftrsppysi;
yspidftrsppysif;spidftrsppysifs;pidftrsppysifsa;idftrsppysifsaf;dftrsppysifsafa;ftrsppysifsafag;tr
sppysifsafagn;rsppysifsafagnv;sppysifsafagnvy;ppysifsafagnvyy;pysifsafagnvyyi;ysifsafagnv
yyid;sifsafagnvyyidl;ifsafagnvyyidle;fsafagnvyyidlea;safagnvyyidleal;afagnvyyidleald;fagnvy
yidlealdk;agnvyyidlealdkf;gnvyyidlealdkfi;nvyyidlealdkfid;vyyidlealdkfids;yyidlealdkfidsd;yi
dlealdkfidsdl;idlealdkfidsdln;dlealdkfidsdlnl;lealdkfidsdlnll;ealdkfidsdlnllk;aldkfidsdlnllke;ld
kfidsdlnllken;dkfidsdlnllkene;kfidsdlnllkenet;fidsdlnllkenetr;idsdlnllkenetry;dsdlnllkenetrys;s
dlnllkenetrysd;dlnllkenetrysdl;lnllkenetrysdlk;nllkenetrysdlkk;llkenetrysdlkkl;lkenetrysdlkkls;
kenetrysdlkklsf;enetrysdlkklsfk;netrysdlkklsfkd;etrysdlkklsfkdk;trysdlkklsfkdkf;rysdlkklsfkdk
fl;ysdlkklsfkdkflk;sdlkklsfkdkflke;dlkklsfkdkflkea;lkklsfkdkflkeaa;kklsfkdkflkeaal;klsfkdkflk
eaaln;lsfkdkflkeaalnf;sfkdkflkeaalnfi;fkdkflkeaalnfin;kdkflkeaalnfinr;dkflkeaalnfinra;kflkeaal
nfinras;flkeaalnfinrasv;lkeaalnfinrasvd;keaalnfinrasvde;eaalnfinrasvdev;aalnfinrasvdevr;alnfi
nrasvdevrs;lnfinrasvdevrsf;nfinrasvdevrsfe;finrasvdevrsfek;inrasvdevrsfekf;nrasvdevrsfekfk;r
asvdevrsfekfkk;asvdevrsfekfkkk;svdevrsfekfkkks;vdevrsfekfkkkss;devrsfekfkkkssy;evrsfekfk
kkssyw;vrsfekfkkkssywl;rsfekfkkkssywll;sfekfkkkssywlld;fekfkkkssywlldf;ekfkkkssywlldfa;
kfkkkssywlldfas;fkkkssywlldfasf;kkkssywlldfasfv;kkssywlldfasfva;kssywlldfasfvaf;ssywlldfa
sfvafk;sywlldfasfvafke;ywlldfasfvafkey;wlldfasfvafkeyf;lldfasfvafkeyfl;ldfasfvafkeyflk;dfasf
vafkeyflkd;fasfvafkeyflkds;asfvafkeyflkdsr;sfvafkeyflkdsrd;fvafkeyflkdsrda;vafkeyflkdsrdaf;
afkeyflkdsrdafn;fkeyflkdsrdafnv;keyflkdsrdafnvl;eyflkdsrdafnvlf;yflkdsrdafnvlfd;flkdsrdafnvl
fdr;lkdsrdafnvlfdrg;kdsrdafnvlfdrgi;dsrdafnvlfdrgil;srdafnvlfdrgili;rdafnvlfdrgilir;dafnvlfdrgil
irn;afnvlfdrgilirne;fnvlfdrgilirnek;nvlfdrgilirnekd;vlfdrgilirnekdl;lfdrgilirnekdlf;fdrgilirnekdlf
k;drgilirnekdlfkl;rgilirnekdlfklr;gilirnekdlfklrn;ilirnekdlfklrni;lirnekdlfklrnil;irnekdlfklrnils;rn
ekdlfklrnilsk;nekdlfklrnilske;ekdlfklrnilskei;kdlfklrnilskeik;dlfklrnilskeikv;lfklrnilskeikvq;fklr
nilskeikvqe;klrnilskeikvqev;lrnilskeikvqevl;rnilskeikvqevlq;nilskeikvqevlqy;ilskeikvqevlqyf;l
skeikvqevlqyff;skeikvqevlqyfff;keikvqevlqyfffs;eikvqevlqyfffsq;ikvqevlqyfffsqf;kvqevlqyfffs
qfq;vqevlqyfffsqfqa;qevlqyfffsqfqal;evlqyfffsqfqalk;vlqyfffsqfqalkr;lqyfffsqfqalkry;qyfffsqfq
alkrya;yfffsqfqalkryan;fffsqfqalkryand;ffsqfqalkryandk;fsqfqalkryandkg;sqfqalkryandkgi;qfq
alkryandkgie;fqalkryandkgiel;qalkryandkgielv;alkryandkgielvm;lkryandkgielvmn;kryandkgie
lvmnl;ryandkgielvmnlp;yandkgielvmnlpl;andkgielvmnlplf;ndkgielvmnlplfi;dkgielvmnlplfia;k
gielvmnlplfiay;gielvmnlplfiayd;ielvmnlplfiayds;elvmnlplfiaydsa;lvmnlplfiaydsad;vmnlplfiayd
sadv;mnlplfiaydsadvw;nlplfiaydsadvwa;lplfiaydsadvwah;plfiaydsadvwahq;lfiaydsadvwahqk;f
iaydsadvwahqky;iaydsadvwahqkyf;aydsadvwahqkyfk;ydsadvwahqkyfkl;dsadvwahqkyfklr;sa

Fig. 39 continued dvwahqkyfklrf;advwahqkyfklrfd;dvwahqkyfklrfda;vwahqkyfklrfdas;wahqkyfklrfdask;ahqkyf klrfdaskd;hqkyfklrfdaskdk;qkyfklrfdaskdkv;kyfklrfdaskdkva;yfklrfdaskdkvag;fklrfdaskdkvag i;klrfdaskdkvagis;lrfdaskdkvagisp;rfdaskdkvagispd;fdaskdkvagispdy;daskdkvagispdyf;askdkv agispdyfl;skdkvagispdyfle;kdkvagispdyfleq;dkvagispdyfleqe;kvagispdyfleqeq;vagispdyfleqeq a;agispdyfleqeqaw;gispdyfleqeqawd;ispdyfleqeqawds;spdyfleqeqawdsp;pdyfleqeqawdspa;dyf leqeqawdspay;yfleqeqawdspays;fleqeqawdspaysw;leqeqawdspayswn;eqeqawdspayswnv;qeqa wdspayswnvl;eqawdspayswnvlk;qawdspayswnvlkn;awdspayswnvlknv;wdspayswnvlknvk;dsp ayswnvlknvky;spayswnvlknvkye;payswnvlknvkyew;ayswnvlknvkyeww;yswnvlknvkyewwa;s wnvlknvkyewwak;wnvlknvkyewwakr;nvlknvkyewwakri;vlknvkyewwakrig;lknvkyewwakrigi ;knvkyewwakrigil;nvkyewwakrigilr;vkyewwakrigilrk;kyewwakrigilrky;yewwakrigilrkyi;eww akrigilrkyid;wwakrigilrkyidv;wakrigilrkyidvi;akrigilrkyidvik;krigilrkyidviki;rigilrkyidvikid;ig ilrkyidvikidh;gilrkyidvikidhf;ilrkyidvikidhfr;lrkyidvikidhfrg;rkyidvikidhfrgf;kyidvikidhfrgfv; yidvikidhfrgfvs;idvikidhfrgfvst;dvikidhfrgfvstw;vikidhfrgfvstwe;ikidhfrgfvstwev;kidhfrgfvst wevg;idhfrgfvstwevgv;dhfrgfvstwevgvg;hfrgfvstwevgvge;frgfvstwevgvgea;rgfvstwevgvgeay; gfvstwevgvgeaya;fvstwevgvgeayaf;vstwevgvgeayafn;stwevgvgeayafng;twevgvgeayafngl;wev gvgeayafnglw;evgvgeayafnglwv;vgvgeayafnglwvk;gvgeayafnglwvks;vgeayafnglwvksp;geaya fnglwvkspg;eayafnglwvkspgr;ayafnglwvkspgrd;yafnglwvkspgrdf;afnglwvkspgrdff;fnglwvksp grdffn;nglwvkspgrdffnf;glwvkspgrdffnfi;lwvkspgrdffnfil;wvkspgrdffnfiln;vkspgrdffnfilne;ksp grdffnfilnei;spgrdffnfilneik;pgrdffnfilneikd;grdffnfilneikdl;rdffnfilneikdlk;dffnfilneikdlki;ffnfi lneikdlkiw;fnfilneikdlkiwv;nfilneikdlkiwve;filneikdlkiwved;ilneikdlkiwvedf;lneikdlkiwvedfe; neikdlkiwvedfen;eikdlkiwvedfend;ikdlkiwvedfendl;kdlkiwvedfendle;dlkiwvedfendled;lkiwve dfendledv;kiwvedfendledvs;iwvedfendledvsr;wvedfendledvsrl;vedfendledvsrlr;edfendledvsrlr d;dfendledvsrlrdf;fendledvsrlrdff;endledvsrlrdffn;ndledvsrlrdffnf;dledvsrlrdffnfp;ledvsrlrdffnf pg;edvsrlrdffnfpgm;dvsrlrdffnfpgmr;vsrlrdffnfpgmri;srlrdffnfpgmrim;rlrdffnfpgmrimk;lrdffnf pgmrimkl;rdffnfpgmrimkla;dffnfpgmrimklaf;ffnfpgmrimklafd;fnfpgmrimklafdf;nfpgmrimklaf dfd;fpgmrimklafdfds;pgmrimklafdfdsd;gmrimklafdfdsdn;mrimklafdfdsdnq;rimklafdfdsdnqn;i mklafdfdsdnqnl;mklafdfdsdnqnlp;klafdfdsdnqnlph;lafdfdsdnqnlphn;afdfdsdnqnlphny;fdfdsdn qnlphnyi;dfdsdnqnlphnyik;fdsdnqnlphnyikn;dsdnqnlphnyiknc;sdnqnlphnyiknci;dnqnlphnyikn civ;nqnlphnyikncivy;qnlphnyikncivyt;nlphnyikncivytg;lphnyikncivytgi;phnyikncivytgig;hnyi kncivytgigd;nyikncivytgigdn;yikncivytgigdns;ikncivytgigdnst;kncivytgigdnsti;ncivytgigdnstir ;civytgigdnstire;ivytgigdnstiref;vytgigdnstirefv;ytgigdnstirefvn;tgigdnstirefvns;gigdnstirefvnsl ;igdnstirefvnsld;gdnstirefvnsldd;dnstirefvnslddl;nstirefvnslddlh;stirefvnslddlhk;tirefvnslddlhk k;irefvnslddlhkky;refvnslddlhkkyi;efvnslddlhkkyif;fvnslddlhkkyifd;vnslddlhkkyifdy;nslddlhk kyifdyl;slddlhkkyifdyln;lddlhkkyifdylnt;ddlhkkyifdylntn;dlhkkyifdylntne;lhkkyifdylntned;hk kyifdylntnedf;kkyifdylntnedfv;kyifdylntnedfvv;yifdylntnedfvvw;ifdylntnedfvvwd;fdylntnedfv vwdm;dylntnedfvvwdmi;ylntnedfvvwdmir;lntnedfvvwdmirs;ntnedfvvwdmirsa;tnedfvvwdmir sam;nedfvvwdmirsams;edfvvwdmirsamss;dfvvwdmirsamssv;fvvwdmirsamssvs;vvwdmirsam ssvsd;vwdmirsamssvsds;wdmirsamssvsdsv;dmirsamssvsdsvi;mirsamssvsdsvii;irsamssvsdsvii p;rsamssvsdsviipm;samssvsdsviipmq;amssvsdsviipmqd;mssvsdsviipmqdy;ssvsdsviipmqdyi;s vsdsviipmqdyin;vsdsviipmqdyinl;sdsviipmqdyinlg;dsviipmqdyinlgn;sviipmqdyinlgne;viipmq dyinlgnef;iipmqdyinlgnefr;ipmqdyinlgnefra;pmqdyinlgnefran;mqdyinlgnefrani;qdyinlgnefran ip;dyinlgnefranipk;yinlgnefranipkn;inlgnefranipknt;nlgnefranipkntl;lgnefranipkntln;gnefranip kntlnn;nefranipkntlnnw;efranipkntlnnwi;franipkntlnnwif;ranipkntlnnwifr;anipkntlnnwifrl;nipk ntlnnwifrll;ipkntlnnwifrlle;pkntlnnwifrlles;kntlnnwifrllesd;ntlnnwifrllesdl;tlnnwifrllesdld;lnn wifrllesdlda;nnwifrllesdldat;nwifrllesdldatl;wifrllesdldatls;ifrllesdldatlsk;frllesdldatlskn;rllesdl

Fig. 39 continued datlskni;llesdldatlsknis;lesdldatlsknisf;esdldatlsknisfi;sdldatlsknisfit;dldatlsknisfitr;ldatlsknisfitrl;datlsknisfitrly;atlsknisfitrlyg;tlsknisfitrlygr;lsknisfitrlygrt;

16 mers:
mkykkirinlnlkrks;kykkirinlnlkrksg;ykkirinlnlkrksgi;kkirinlnlkrksgil;kirinlnlkrksgill;irinlnlkrksgilln;rinlnlkrksgillni;inlnlkrksgillnis;nlnlkrksgillniss;lnlkrksgillnissl;nlkrksgillnisslp;lkrksgillnisslps;krksgillnisslpsk;rksgillnisslpsky;ksgillnisslpskyg;sgillnisslpskygi;gillnisslpskygig;illnisslpskygigd;llnisslpskygigdl;lnisslpskygigdlg;nisslpskygigdlgk;isslpskygigdlgkg;sslpskygigdlgkga;slpskygigdlgkgay;lpskygigdlgkgayk;pskygigdlgkgaykf;skygigdlgkgaykfi;kygigdlgkgaykfid;ygigdlgkgaykfidf;gigdlgkgaykfidfl;igdlgkgaykfidflf;gdlgkgaykfidflfa;dlgkgaykfidflfas;lgkgaykfidflfass;gkgaykfidflfassq;kgaykfidflfassqs;gaykfidflfassqsy;aykfidflfassqsyw;ykfidflfassqsywq;kfidflfassqsywqm;fidflfassqsywqmf;idflfassqsywqmfa;dflfassqsywqmfay;flfassqsywqmfays;lfassqsywqmfaysp;fassqsywqmfayspi;assqsywqmfayspid;ssqsywqmfayspidf;sqsywqmfayspidft;qsywqmfayspidftr;sywqmfayspidftrs;ywqmfayspidftrsp;wqmfayspidftrspp;qmfayspidftrsppy;mfayspidftrsppys;fayspidftrsppysi;ayspidftrsppysif;yspidftrsppysifs;spidftrsppysifsa;pidftrsppysifsaf;idftrsppysifsafa;dftrsppysifsafag;ftrsppysifsafagn;trsppysifsafagnv;rsppysifsafagnvy;sppysifsafagnvyy;ppysifsafagnvyyi;pysifsafagnvyyid;ysifsafagnvyyidl;sifsafagnvyyidle;ifsafagnvyyidlea;fsafagnvyyidleal;safagnvyyidleald;afagnvyyidlealdk;fagnvyyidlealdkf;agnvyyidlealdkfi;gnvyyidlealdkfid;nvyyidlealdkfids;vyyidlealdkfidsd;yyidlealdkfidsdl;yidlealdkfidsdln;idlealdkfidsdlnl;dlealdkfidsdlnll;lealdkfidsdlnllk;ealdkfidsdlnllke;aldkfidsdlnllken;ldkfidsdlnllkene;dkfidsdlnllkenet;kfidsdlnllkenetr;fidsdlnllkenetry;idsdlnllkenetrys;dsdlnllkenetrysd;sdlnllkenetrysdl;dlnllkenetrysdlk;lnllkenetrysdlkk;nllkenetrysdlkkl;llkenetrysdlkkls;lkenetrysdlkklsf;kenetrysdlkklsfk;enetrysdlkklsfkd;netrysdlkklsfkdk;etrysdlkklsfkdkf;trysdlkklsfkdkfl;rysdlkklsfkdkflk;ysdlkklsfkdkflke;sdlkklsfkdkflkea;dlkklsfkdkflkeaa;lkklsfkdkflkeaal;kklsfkdkflkeaaln;klsfkdkflkeaalnf;lsfkdkflkeaalnfi;sfkdkflkeaalnfin;fkdkflkeaalnfinr;kdkflkeaalnfinra;dkflkeaalnfinras;kflkeaalnfinrasv;flkeaalnfinrasvd;lkeaalnfinrasvde;keaalnfinrasvdev;eaalnfinrasvdevr;aalnfinrasvdevrs;alnfinrasvdevrsf;lnfinrasvdevrsfe;nfinrasvdevrsfek;finrasvdevrsfekf;inrasvdevrsfekfk;nrasvdevrsfekfkk;rasvdevrsfekfkkk;asvdevrsfekfkkks;svdevrsfekfkkkss;vdevrsfekfkkkssy;devrsfekfkkkssyw;evrsfekfkkkssywl;vrsfekfkkkssywll;rsfekfkkkssywlld;sfekfkkkssywlldf;fekfkkkssywlldfa;ekfkkkssywlldfas;kfkkkssywlldfasf;fkkkssywlldfasfv;kkkssywlldfasfva;kkssywlldfasfvaf;kssywlldfasfvafk;ssywlldfasfvafke;sywlldfasfvafkey;ywlldfasfvafkeyf;wlldfasfvafkeyfl;lldfasfvafkeyflk;ldfasfvafkeyflkd;dfasfvafkeyflkds;fasfvafkeyflkdsr;asfvafkeyflkdsrd;sfvafkeyflkdsrda;fvafkeyflkdsrdaf;vafkeyflkdsrdafn;afkeyflkdsrdafnv;fkeyflkdsrdafnvl;keyflkdsrdafnvlf;eyflkdsrdafnvlfd;yflkdsrdafnvlfdr;flkdsrdafnvlfdrg;lkdsrdafnvlfdrgi;kdsrdafnvlfdrgil;dsrdafnvlfdrgili;srdafnvlfdrgilir;rdafnvlfdrgilirn;dafnvlfdrgilirne;afnvlfdrgilirnek;fnvlfdrgilirnekd;nvlfdrgilirnekdl;vlfdrgilirnekdlf;lfdrgilirnekdlfk;fdrgilirnekdlfkl;drgilirnekdlfklr;rgilirnekdlfklrn;gilirnekdlfklrni;ilirnekdlfklrnil;lirnekdlfklrnils;irnekdlfklrnilsk;rnekdlfklrnilske;nekdlfklrnilskei;ekdlfklrnilskeik;kdlfklrnilskeikv;dlfklrnilskeikvq;lfklrnilskeikvqe;fklrnilskeikvqev;klrnilskeikvqevl;lrnilskeikvqevlq;rnilskeikvqevlqy;nilskeikvqevlqyf;ilskeikvqevlqyff;lskeikvqevlqyfff;skeikvqevlqyfffs;keikvqevlqyfffsq;eikvqevlqyfffsqf;ikvqevlqyfffsqfq;kvqevlqyfffsqfqa;vqevlqyfffsqfqal;qevlqyfffsqfqalk;evlqyfffsqfqalkr;vlqyfffsqfqalkry;lqyfffsqfqalkrya;qyfffsqfqalkryan;yfffsqfqalkryand;fffsqfqalkryandk;ffsqfqalkryandkg;fsqfqalkryandkgi;sqfqalkryandkgie;qfqalkryandkgiel;fqalkryandkgielv;qalkryandkgielvm;alkryandkgielvmn;lkryandkgielvmnl;kryandkgielvmnlp;ryandkgielvmnlpl;yandkgielvmnlplf;andkgielvmnlplfi;ndkgielvmnlplfia;dkgielvmnlplfiay;kgielvmnlplfiayd;gielvmnlplfiayds;ielvmnlplfiaydsa;elv

Fig. 39 continued mnlplfiaydsad;lvmnlplfiaydsadv;vmnlplfiaydsadvw;mnlplfiaydsadvwa;nlplfiaydsadvwah;lplfi
aydsadvwahq;plfiaydsadvwahqk;lfiaydsadvwahqky;fiaydsadvwahqkyf;iaydsadvwahqkyfk;ay
dsadvwahqkyfkl;ydsadvwahqkyfklr;dsadvwahqkyfklrf;sadvwahqkyfklrfd;advwahqkyfklrfda;
dvwahqkyfklrfdas;vwahqkyfklrfdask;wahqkyfklrfdaskd;ahqkyfklrfdaskdk;hqkyfklrfdaskdkv;
qkyfklrfdaskdkva;kyfklrfdaskdkvag;yfklrfdaskdkvagi;fklrfdaskdkvagis;klrfdaskdkvagisp;lrfd
askdkvagispd;rfdaskdkvagispdy;fdaskdkvagispdyf;daskdkvagispdyfl;askdkvagispdyfle;skdkv
agispdyfleq;kdkvagispdyfleqe;dkvagispdyfleqeq;kvagispdyfleqeqa;vagispdyfleqeqaw;agispdy
fleqeqawd;gispdyfleqeqawds;ispdyfleqeqawdsp;spdyfleqeqawdspa;pdyfleqeqawdspay;dyfleq
eqawdspays;yfleqeqawdspaysw;fleqeqawdspayswn;leqeqawdspayswnv;eqeqawdspayswnvl;q
eqawdspayswnvlk;eqawdspayswnvlkn;qawdspayswnvlknv;awdspayswnvlknvk;wdspayswnvl
knvky;dspayswnvlknvkye;spayswnvlknvkyew;payswnvlknvkyeww;ayswnvlknvkyewwa;ysw
nvlknvkyewwak;swnvlknvkyewwakr;wnvlknvkyewwakri;nvlknvkyewwakrig;vlknvkyewwak
rigi;lknvkyewwakrigil;knvkyewwakrigilr;nvkyewwakrigilrk;vkyewwakrigilrky;kyewwakrigil
rkyi;yewwakrigilrkyid;ewwakrigilrkyidv;wwakrigilrkyidvi;wakrigilrkyidvik;akrigilrkyidviki;
krigilrkyidvikid;rigilrkyidvikidh;igilrkyidvikidhf;gilrkyidvikidhfr;ilrkyidvikidhfrg;lrkyidvikid
hfrgf;rkyidvikidhfrgfv;kyidvikidhfrgfvs;yidvikidhfrgfvst;idvikidhfrgfvstw;dvikidhfrgfvstwe;v
ikidhfrgfvstwev;ikidhfrgfvstwevg;kidhfrgfvstwevgv;idhfrgfvstwevgvg;dhfrgfvstwevgvge;hfr
gfvstwevgvgea;frgfvstwevgvgeay;rgfvstwevgvgeaya;gfvstwevgvgeayaf;fvstwevgvgeayafn;vs
twevgvgeayafng;stwevgvgeayafngl;twevgvgeayafnglw;wevgvgeayafnglwv;evgvgeayafnglwv
k;vgvgeayafnglwvks;gvgeayafnglwvksp;vgeayafnglwvkspg;geayafnglwvkspgr;eayafnglwvks
pgrd;ayafnglwvkspgrdf;yafnglwvkspgrdff;afnglwvkspgrdffn;fnglwvkspgrdffnf;nglwvkspgrdff
nfi;glwvkspgrdffnfil;lwvkspgrdffnfiln;wvkspgrdffnfilne;vkspgrdffnfilnei;kspgrdffnfilneik;spg
rdffnfilneikd;pgrdffnfilneikdl;grdffnfilneikdlk;rdffnfilneikdlki;dffnfilneikdlkiw;ffnfilneikdlki
wv;fnfilneikdlkiwve;nfilneikdlkiwved;filneikdlkiwvedf;ilneikdlkiwvedfe;lneikdlkiwvedfen;ne
ikdlkiwvedfend;eikdlkiwvedfendl;ikdlkiwvedfendle;kdlkiwvedfendled;dlkiwvedfendledv;lki
wvedfendledvs;kiwvedfendledvsr;iwvedfendledvsrl;wvedfendledvsrlr;vedfendledvsrlrd;edfen
dledvsrlrdf;dfendledvsrlrdff;fendledvsrlrdffn;endledvsrlrdffnf;ndledvsrlrdffnfp;dledvsrlrdffnf
pg;ledvsrlrdffnfpgm;edvsrlrdffnfpgmr;dvsrlrdffnfpgmri;vsrlrdffnfpgmrim;srlrdffnfpgmrimk;rl
rdffnfpgmrimkl;lrdffnfpgmrimkla;rdffnfpgmrimklaf;dffnfpgmrimklafd;ffnfpgmrimklafdf;fnfp
gmrimklafdfd;nfpgmrimklafdfds;fpgmrimklafdfdsd;pgmrimklafdfdsdn;gmrimklafdfdsdnq;mri
mklafdfdsdnqn;rimklafdfdsdnqnl;imklafdfdsdnqnlp;mklafdfdsdnqnlph;klafdfdsdnqnlphn;lafdf
dsdnqnlphny;afdfdsdnqnlphnyi;fdfdsdnqnlphnyik;dfdsdnqnlphnyikn;fdsdnqnlphnyiknc;dsdnq
nlphnyiknci;sdnqnlphnyiknciv;dnqnlphnyikncivy;nqnlphnyikncivyt;qnlphnyikncivytg;nlphnyi
kncivytgi;lphnyikncivytgig;phnyikncivytgigd;hnyikncivytgigdn;nyikncivytgigdns;yikncivytgi
gdnst;ikncivytgigdnsti;knciv ytgigdnstir;nciv ytgigdnstire;civytgigdnstiref;ivytgigdnstirefv;vyt
gigdnstirefvn;ytgigdnstirefvns;tgigdnstirefvnsl;gigdnstirefvnsld;igdnstirefvnsldd;gdnstirefvnsl
ddl;dnstirefvnslddlh;nstirefvnslddlhk;stirefvnslddlhkk;tirefvnslddlhkky;irefvnslddlhkkyi;refvn
slddlhkkyif;efvnslddlhkkyifd;fvnslddlhkkyifdy;vnslddlhkkyifdyl;nslddlhkkyifdyln;slddlhkkyi
fdylnt;lddlhkkyifdylntn;ddlhkkyifdylntne;dlhkkyifdylntned;lhkkyifdylntnedf;hkkyifdylntnedf
v;kkyifdylntnedfvv;kyifdylntnedfvvw;yifdylntnedfvvwd;ifdylntnedfvvwdm;fdylntnedfvvwdm
i;dylntnedfvvwdmir;ylntnedfvvwdmirs;lntnedfvvwdmirsa;ntnedfvvwdmirsam;tnedfvvwdmirs
ams;nedfvvwdmirsamss;edfvvwdmirsamssv;dfvvwdmirsamssvs;fvvwdmirsamssvsd;vvwdmir
samssvsds;vwdmirsamssvsdsv;wdmirsamssvsdsvi;dmirsamssvsdsvii;mirsamssvsdsviip;irsams
svsdsviipm;rsamssvsdsviipmq;samssvsdsviipmqd;amssvsdsviipmqdy;mssvsdsviipmqdyi;ssvs
dsviipmqdyin;svsdsviipmqdyinl;vsdsviipmqdyinlg;sdsviipmqdyinlgn;dsviipmqdyinlgne;sviip

Fig. 39 continued mqdyinlgnef;viipmqdyinlgnefr;iipmqdyinlgnefra;ipmqdyinlgnefran;pmqdyinlgnefrani;mqdyi
nlgnefranip;qdyinlgnefranipk;dyinlgnefranipkn;yinlgnefranipknt;inlgnefranipkntl;nlgnefranip
kntln;lgnefranipkntlnn;gnefranipkntlnnw;nefranipkntlnnwi;efranipkntlnnwif;franipkntlnnwifr;
ranipkntlnnwifrl;anipkntlnnwifrll;n dlpge;asvdlpgem;svdlpgemk;vdlpgemkv;dlpgemkvl;lpgemkvlv;pgemkvlvs;gemkvlvsk;emkvl
vske;mkvlvskek;kvlvskekd;vlvskekdk;lvskekdkd;vskekdkdg;skekdkdgk;kekdkdgky;ekdkdgk
ys;kdkdgkysl;dkdgkyslk;kdgkyslka;dgkyslkat;gkyslkatv;kyslkatvd;yslkatvdk;slkatvdki;lkatvd kie;katvdkiel;atvdkielk;tvdkielkg;vdkielkgt;dkielkgts;kielkgtsd;ielkgtsdk;elkgtsdkd;lkgtsdkdn ;kgtsdkdng;gtsdkdngs;tsdkdngsg;sdkdngsgv;dkdngsgvl;kdngsgvle;dngsgvleg;ngsgvlegt;gsgvl egtk;sgvlegtkd;gvlegtkdd;vlegtkddk;legtkddks;egtkddksk;gtkddkska;tkddkskak;kddkskakl;dd kskaklt;dkskaklti;kskakltia;skakltiad;kakltiadd;akltiaddl;kltiaddls;ltiaddlsk;tiaddlskt;iaddlsktt; addlskttf;ddlskttfe;dlskttfel;lskttfelf;skttfelfk;kttfelfke;ttfelfked;tfelfkedg;felfkedgk;elfkedgkt;l fkedgktl;fkedgktlv;kedgktlvs;edgktlvsr;dgktlvsrk;gktlvsrkv;ktlvsrkvs;tlvsrkvss;lvsrkvssk;vsrk vsskd;srkvsskdk;rkvsskdkt;kvsskdkts;vsskdktst;sskdktstd;skdktstde;kdktstdem;dktstdemf;ktst demfn;tstdemfne;stdemfnek;tdemfnekg;demfnekge;emfnekgel;mfnekgels;fnekgelsa;nekgelsa k;ekgelsakt;kgelsaktm;gelsaktmt;elsaktmtr;lsaktmtre;saktmtren;aktmtreng;ktmtrengt;tmtrengt k;mtrengtkl;trengtkle;rengtkley;engtkleyt;ngtkleyte;gtkleytem;tkleytemk;kleytemks;leytemks d;eytemksdg;ytemksdgt;temksdgtg;emksdgtgk;mksdgtgka;ksdgtgkak;sdgtgkake;dgtgkakev;gt gkakevl;tgkakevlk;gkakevlkn;kakevlknf;akevlknft;kevlknftl;evlknftle;vlknftleg;lknftlegk;knft legkv;nftlegkva;ftlegkvan;tlegkvand;legkvandk;egkvandkv;gkvandkvt;kvandkvtl;vandkvtle;a ndkvtlev;ndkvtlevk;dkvtlevke;kvtlevkeg;vtlevkegt;tlevkegtv;levkegtvt;evkegtvtl;vkegtvtls;ke gtvtlsk;egtvtlske;gtvtlskei;tvtlskeia;vtlskeiak;tlskeiaks;lskeiaksg;skeiaksge;keiaksgev;eiaksge vt;iaksgevtv;aksgevtva;ksgevtval;sgevtvaln;gevtvalnd;evtvalndt;vtvalndtn;tvalndtnt;valndtntt; alndtnttq;lndtnttqa;ndtnttqat;dtnttqatk;tnttqatkk;nttqatkkt;ttqatkktg;tqatkktga;qatkktgaw;atkktg awd;tkktgawds;kktgawdsk;ktgawdskt;tgawdskts;gawdsktst;awdsktstl;wdsktstlt;dsktstlti;sktstlt is;ktstltisv;tstltisvn;stltisvns;tltisvnsk;ltisvnskk;tisvnskkt;isvnskktt;svnskkttq;vnskkttql;nskkttq lv;skkttqlvf;kkttqlvft;kttqlvftk;ttqlvftkq;tqlvftkqd;qlvftkqdt;lvftkqdti;vftkqdtit;ftkqdtitv;tkqdtit vq;kqdtitvqk;qdtitvqky;dtitvqkyd;titvqkyds;itvqkydsa;tvqkydsag;vqkydsagt;qkydsagtn;kydsag tnl;ydsagtnle;dsagtnleg;sagtnlegt;agtnlegta;gtnlegtav;tnlegtave;nlegtavei;legtaveik;egtaveikt;g taveiktl;taveiktld;aveiktlde;veiktldel;eiktldelk;iktldelkn;ktldelkna;tldelknal;ldelknalk;

10 mers:
mkkyllgigl;kkyllgigli;kyllgiglil;yllgiglila;llgiglilal;lgiglilali;giglilalia;iglilaliac;glilaliack;lilali ackq;ilaliackqn;laliackqnv;aliackqnvs;liackqnvss;iackqnvssl;ackqnvssld;ckqnvsslde;kqnvssld ek;qnvssldekn;nvssldekns;vssldeknsa;ssldeknsas;sldeknsasv;ldeknsasvd;deknsasvdl;eknsasvdl p;knsasvdlpg;nsasvdlpge;sasvdlpgem;asvdlpgemk;svdlpgemkv;vdlpgemkvl;dlpgemkvlv;lpge mkvlvs;pgemkvlvsk;gemkvlvske;emkvlvskek;mkvlvskekd;kvlvskekdk;vlvskekdkd;lvskekdkd g;vskekdkdgk;skekdkdgky;kekdkdgkys;ekdkdgkysl;kdkdgkyslk;dkdgkyslka;kdgkyslkat;dgky slkatv;gkyslkatvd;kyslkatvdk;yslkatvdki;slkatvdkie;lkatvdkiel;katvdkielk;atvdkielkg;tvdkielk gt;vdkielkgts;dkielkgtsd;kielkgtsdk;ielkgtsdkd;elkgtsdkdn;lkgtsdkdng;kgtsdkdngs;gtsdkdngsg ;tsdkdngsgv;sdkdngsgvl;dkdngsgvle;kdngsgvleg;dngsgvlegt;ngsgvlegtk;gsgvlegtkd;sgvlegtkd d;gvlegtkddk;vlegtkddks;legtkddksk;egtkddkska;gtkddkskak;tkddkskakl;kddkskaklt;ddkskakl ti;dkskakltia;kskakltiad;skakltiadd;kakltiaddl;akltiaddls;kltiaddlsk;ltiaddlskt;tiaddlsktt;iaddlsk ttf;addlskttfe;ddlskttfel;dlskttfelf;lskttfelfk;skttfelfke;kttfelfked;ttfelfkedg;tfelfkedgk;felfkedg kt;elfkedgktl;lfkedgktlv;fkedgktlvs;kedgktlvsr;edgktlvsrk;dgktlvsrkv;gktlvsrkvs;ktlvsrkvss;tlv srkvssk;lvsrkvsskd;vsrkvsskdk;srkvsskdkt;rkvsskdkts;kvsskdktst;vsskdktstd;sskdktstde;skdkts tdem;kdktstdemf;dktstdemfn;ktstdemfne;tstdemfnek;stdemfnekg;tdemfnekge;demfnekgel;emf nekgels;mfnekgelsa;fnekgelsak;nekgelsakt;ekgelsaktm;kgelsaktmt;gelsaktmtr;elsaktmtre;lsakt mtren;saktmtreng;aktmtrengt;ktmtrengtk;tmtrengtkl;mtrengtkle;trengtkley;rengtkleyt;engtkley

Fig. 39 continued te;ngtkleytem;gtkleytemk;tkleytemks;kleytemksd;leytemksdg;eytemksdgt;ytemksdgtg;temksdgtgk;emksdgtgka;mksdgtgkak;ksdgtgkake;sdgtgkakev;dgtgkakevl;gtgkakevlk;tgkakevlkn;gkakevlknf;kakevlknft;akevlknftl;kevlknftle;evlknftleg;vlknftlegk;lknftlegkv;knftlegkva;nftlegkvan;ftlegkvand;tlegkvandk;legkvandkv;egkvandkvt;gkvandkvtl;kvandkvtle;vandkvtlev;andkvtlevk;ndkvtlevke;dkvtlevkeg;kvtlevkegt;vtlevkegtv;tlevkegtvt;levkegtvtl;evkegtvtls;vkegtvtlsk;kegtvtlske;egtvtlskei;gtvtlskeia;tvtlskeiak;vtlskeiaks;tlskeiaksg;lskeiaksge;skeiaksgev;keiaksgevt;eiaksgevtv;iaksgevtva;aksgevtval;ksgevtvaln;sgevtvalnd;gevtvalndt;evtvalndtn;vtvalndtnt;tvalndtntt;valndtnttq;alndtnttqa;lndtnttqat;ndtnttqatk;dtnttqatkk;tnttqatkkt;nttqatkktg;ttqatkktga;tqatkktgaw;qatkktgawd;atkktgawds;tkktgawdsk;kktgawdskt;ktgawdskts;tgawdsktst;gawdsktstl;awdsktstlt;wdsktstlti;dsktstltis;sktstltisv;ktstltisvn;tstltisvns;stltisvnsk;tltisvnskk;ltisvnskkt;tisvnskktt;isvnskkttq;svnskkttql;vnskkttqlv;nskkttqlvf;skkttqlvft;kkttqlvftk;kttqlvftkq;ttqlvftkqd;tqlvftkqdt;qlvftkqdti;lvftkqdtit;vftkqdtitv;ftkqdtitvq;tkqdtitvqk;kqdtitvqky;qdtitvqkyd;dtitvqkyds;titvqkydsa;itvqkydsag;tvqkydsagt;vqkydsagtn;qkydsagtnl;kydsagtnle;ydsagtnleg;dsagtnlegt;sagtnlegta;agtnlegtav;gtnlegtave;tnlegtavei;nlegtaveik;legtaveikt;egtaveiktl;gtaveiktld;taveiktlde;aveiktldel;veiktldelk;eiktldelkn;iktldelkna;ktldelknal;tldelknalk;

11 mers:
mkkyllgigli;kkyllgiglil;kyllgiglila;yllgiglilal;llgiglilali;lgiglilalia;giglilaliac;iglilaliack;glilaliackq;lilaliackqn;ilaliackqnv;laliackqnvs;aliackqnvss;liackqnvssl;iackqnvssld;ackqnvsslde;ckqnvssldek;kqnvssldekn;qnvssldekns;nvssldeknsa;vssldeknsas;ssldeknsasv;sldeknsasvd;ldeknsasvdl;deknsasvdlp;eknsasvdlpg;knsasvdlpge;nsasvdlpgem;sasvdlpgemk;asvdlpgemkv;svdlpgemkvl;vdlpgemkvlv;dlpgemkvlvs;lpgemkvlvsk;pgemkvlvske;gemkvlvskek;emkvlvskekd;mkvlvskekdk;kvlvskekdkd;vlvskekdkdg;lvskekdkdgk;vskekdkdgky;skekdkdgkys;kekdkdgkysl;ekdkdgkyslk;kdkdgkyslka;dkdgkyslkat;kdgkyslkatv;dgkyslkatvd;gkyslkatvdk;kyslkatvdki;yslkatvdkie;slkatvdkiel;lkatvdkielk;katvdkielkg;atvdkielkgt;tvdkielkgts;vdkielkgtsd;dkielkgtsdk;kielkgtsdkd;ielkgtsdkdn;elkgtsdkdng;lkgtsdkdngs;kgtsdkdngsg;gtsdkdngsgv;tsdkdngsgvl;sdkdngsgvle;dkdngsgvleg;kdngsgvlegt;dngsgvlegtk;ngsgvlegtkd;gsgvlegtkdd;sgvlegtkddk;gvlegtkddks;vlegtkddksk;legtkddkska;egtkddkskak;gtkddkskakl;tkddkskaklt;kddkskaklti;ddkskakltia;dkskakltiad;kskakltiadd;skakltiaddl;kakltiaddls;akltiaddlsk;kltiaddlskt;ltiaddlsktt;tiaddlskttf;iaddlskttfe;addlskttfel;ddlskttfelf;dlskttfelfk;lskttfelfke;skttfelfked;kttfelfkedg;ttfelfkedgk;tfelfkedgkt;felfkedgktl;elfkedgktlv;lfkedgktlvs;fkedgktlvsr;kedgktlvsrk;edgktlvsrkv;dgktlvsrkvs;gktlvsrkvss;ktlvsrkvssk;tlvsrkvsskd;lvsrkvsskdk;vsrkvsskdkt;srkvsskdkts;rkvsskdktst;kvsskdktstd;vsskdktstde;sskdktstdem;skdktstdemf;kdktstdemfn;dktstdemfne;ktstdemfnek;tstdemfnekg;stdemfnekge;tdemfnekgel;demfnekgels;emfnekgelsa;mfnekgelsak;fnekgelsakt;nekgelsaktm;ekgelsaktmt;kgelsaktmtr;gelsaktmtre;elsaktmtren;lsaktmtreng;saktmtrengt;aktmtrengtk;ktmtrengtkl;tmtrengtkle;mtrengtkley;trengtkleyt;rengtkleyte;engtkleytem;ngtkleytemk;gtkleytemks;tkleytemksd;kleytemksdg;leytemksdgt;eytemksdgtg;ytemksdgtgk;temksdgtgka;emksdgtgkak;mksdgtgkake;ksdgtgkakev;sdgtgkakevl;dgtgkakevlk;gtgkakevlkn;tgkakevlknf;gkakevlknft;kakevlknftl;akevlknftle;kevlknftleg;evlknftlegk;vlknftlegkv;lknftlegkva;knftlegkvan;nftlegkvand;ftlegkvandk;tlegkvandkv;legkvandkvt;egkvandkvtl;gkvandkvtle;kvandkvtlev;vandkvtlevk;andkvtlevke;ndkvtlevkeg;dkvtlevkegt;kvtlevkegtv;vtlevkegtvt;tlevkegtvtl;levkegtvtls;evkegtvtlsk;vkegtvtlske;kegtvtlskei;egtvtlskeia;gtvtlskeiak;tvtlskeiaks;vtlskeiaksg;tlskeiaksge;lskeiaksgev;skeiaksgevt;keiaksgevtv;eiaksgevtva;iaksgevtval;aksgevtvaln;ksgevtvalnd;sgevtvalndt;gevtvalndtn;evtvalndtnt;vtvalndtntt;tvalndtnttq;valndtnttqa;alndtnttqat;lndtnttqatk;ndtnttqatkk;dtnttqatkkt;tnttqatkktg;nttqatkktga;ttqatkktgaw;tqatkktgawd;qatkktgawds;atkktgawdsk;tkktgawdskt;kktg

Fig. 39 continued awdskts;ktgawdsktst;tgawdsktstl;gawdsktstlt;awdsktstlti;wdsktstltis;dsktstltisv;sktstltisvn;ktstl
tisvns;tstltisvnsk;stltisvnskk;tltisvnskkt;ltisvnskktt;tisvnskkttq;isvnskkttql;svnskkttqlv;vnskktt
qlvf;nskkttqlvft;skkttqlvftk;kkttqlvftkq;kttqlvftkqd;ttqlvftkqdt;tqlvftkqdti;qlvftkqdtit;lvftkqdtit
v;vftkqdtitvq;ftkqdtitvqk;t kqdtitv;qlvftkqdtitvq;lvftkqdtitvqk;vftkqdtitvqky;ftkqdtitvqkyd;tkqdtitvqkyds;kqdtitvqkydsa;qdtitvqkydsag;dtitvqkydsagt;titvqkydsagtn;itvqkydsagtnl;tvqkydsagtnle;vqkydsagtnleg;qkydsagtnlegt;kydsagtnlegta;ydsagtnlegtav;dsagtnlegtave;sagtnlegtavei;agtnlegtaveik;gtnlegtaveikt;tnlegtaveiktl;nlegtaveiktld;legtaveiktlde;egtaveiktldel;gtaveiktldelk;taveiktldelkn;aveiktldelkna;veiktldelknal;eiktldelknalk;

14 mers:
mkkyllgiglilal;kkyllgiglilali;kyllgiglilalia;yllgiglilaliac;llgiglilaliack;lgiglilaliackq;giglilaliackqn;iglilaliackqnv;glilaliackqnvs;lilaliackqnvss;ilaliackqnvssl;laliackqnvssld;aliackqnvsslde;liackqnvssldek;iackqnvssldekn;ackqnvssldekns;ckqnvssldeknsa;kqnvssldeknsas;qnvssldeknsasv;nvssldeknsasvd;vssldeknsasvdl;ssldeknsasvdlp;sldeknsasvdlpg;ldeknsasvdlpge;deknsasvdlpgem;eknsasvdlpgemk;knsasvdlpgemkv;nsasvdlpgemkvl;sasvdlpgemkvlv;asvdlpgemkvlvs;svdlpgemkvlvsk;vdlpgemkvlvske;dlpgemkvlvskek;lpgemkvlvskekd;pgemkvlvskekdk;gemkvlvskekdkd;emkvlvskekdkdg;mkvlvskekdkdgk;kvlvskekdkdgky;vlvskekdkdgkys;lvskekdkdgkysl;vskekdkdgkyslk;skekdkdgkyslka;kekdkdgkyslkat;ekdkdgkyslkatv;kdkdgkyslkatvd;dkdgkyslkatvdk;kdgkyslkatvdki;dgkyslkatvdkie;gkyslkatvdkiel;kyslkatvdkielk;yslkatvdkielkg;slkatvdkielkgt;lkatvdkielkgts;katvdkielkgtsd;atvdkielkgtsdk;tvdkielkgtsdkd;vdkielkgtsdkdn;dkielkgtsdkdng;kielkgtsdkdngs;ielkgtsdkdngsg;elkgtsdkdngsgv;lkgtsdkdngsgvl;kgtsdkdngsgvle;gtsdkdngsgvleg;tsdkdngsgvlegt;sdkdngsgvlegtk;dkdngsgvlegtkd;kdngsgvlegtkdd;dngsgvlegtkddk;ngsgvlegtkddks;gsgvlegtkddksk;sgvlegtkddkska;gvlegtkddkskak;vlegtkddkskakl;legtkddkskaklt;egtkddkskaklti;gtkddkskakltia;tkddkskakltiad;kddkskakltiadd;ddkskakltiaddl;dkskakltiaddls;kskakltiaddlsk;skakltiaddlskt;kakltiaddlsktt;akltiaddlskttf;kltiaddlskttfe;ltiaddlskttfel;tiaddlskttfelf;iaddlskttfelfk;addlskttfelfke;ddlskttfelfked;dlskttfelfkedg;lskttfelfkedgk;skttfelfkedgkt;kttfelfkedgktl;ttfelfkedgktlv;tfelfkedgktlvs;felfkedgktlvsr;elfkedgktlvsrk;lfkedgktlvsrkv;fkedgktlvsrkvs;kedgktlvsrkvss;edgktlvsrkvssk;dgktlvsrkvsskd;gktlvsrkvsskdk;ktlvsrkvsskdkt;tlvsrkvsskdkts;lvsrkvsskdktst;vsrkvsskdktstd;srkvsskdktstde;rkvsskdktstdem;kvsskdktstdemf;vsskdktstdemfn;sskdktstdemfne;skdktstdemfnek;kdktstdemfnekg;dktstdemfnekge;ktstdemfnekgel;tstdemfnekgels;stdemfnekgelsa;tdemfnekgelsak;demfnekgelsakt;emfnekgelsaktm;mfnekgelsaktmt;fnekgelsaktmtr;nekgelsaktmtre;ekgelsaktmtren;kgelsaktmtreng;gelsaktmtrengt;elsaktmtrengtk;lsaktmtrengtkl;saktmtrengtkle;aktmtrengtkley;ktmtrengtkleyt;tmtrengtkleyte;mtrengtkleytem;trengtkleytemk;rengtkleytemks;engtkleytemksd;ngtkleytemksdg;gtkleytemksdgt;tkleytemksdgtg;kleytemksdgtgk;leytemksdgtgka;eytemksdgtgkak;ytemksdgtgkake;temksdgtgkakev;emksdgtgkakevl;mksdgtgkakevlk;ksdgtgkakevlkn;sdgtgkakevlknf;dgtgkakevlknft;gtgkakevlknftl;tgkakevlknftle;gkakevlknftleg;kakevlknftlegk;akevlknftlegkv;kevlknftlegkva;evlknftlegkvan;vlknftlegkvand;lknftlegkvandk;knftlegkvandkv;nftlegkvandkvt;ftlegkvandkvtl;tlegkvandkvtle;legkvandkvtlev;egkvandkvtlevk;gkvandkvtlevke;kvandkvtlevkeg;vandkvtlevkegt;andkvtlevkegtv;ndkvtlevkegtvt;dkvtlevkegtvtl;kvtlevkegtvtls;vtlevkegtvtlsk;tlevkegtvtlske;levkegtvtlskei;evkegtvtlskeia;vkegtvtlskeiak;kegtvtlskeiaks;egtvtlskeiaksg;gtvtlskeiaksge;tvtlskeiaksgev;vtlskeiaksgevt;tlskeiaksgevtv;lskeiaksgevtva;skeiaksgevtval;keiaksgevtvaln;eiaksgevtvalnd;iaksgevtvalndt;aksgevtvalndtn;ksgevtvalndtnt;sgevtvalndtntt;gevtvalndtnttq;evtvalndtnttqa;vtvalndtnttqat;tvalndtnttqatk;valndtnttqatkk;alndtnttqatkkt;lndtnttqatkktg;ndtnttqatkktga;dtnttqatkktgaw;tnttqatkktgawd;nttqatkktgawds;ttqatkktgawdsk;tqatkktgawdskt;qatkktgawdskts;atkktgawdsktst;tkktgawdsktstl;kktgawdsktstlt;ktgawdsktstlti;tgawdsktstltis;gawdsktstltisv;awdsktstltisvn;wdsktstltisvns;dsktstltisvnsk;sktstltisvnskk;ktstltisvnskkt;tstltisvnskktt;stltisvnskkttq;tltisvnskkttql;ltisvnskkttqlv;tisvnskkttqlvf;isvnskkttqlvft;svnskkttqlvftk;vnskkttqlvftkq;nskkttqlvftkqd;

Fig. 39 continued skkttqlvftkqdt;kkttqlvftkqdti;kttqlvftkqdtit;ttqlvftkqdtitv;tqlvftkqdtitvq;qlvftkqdtitvqk;lvftkqdt
itvqky;vftkqdtitvqkyd;ftkqdtitvqkyds;tkqdtitvqkydsa;kqdtitvqkydsag;qdtitvqkydsagt;dtitvqky
dsagtn;titvqkydsagtnl;itvqkydsagtnle;tvqkydsagtnleg;vqkydsagtnlegt;qkydsagtnlegta;kydsagtn
legtav;ydsagtnlegtave;dsagtnlegtavei;sagtnlegtaveik;agtnlegtaveikt;gtnlegtaveiktl;tnlegtaveikt
ld;nlegtaveiktlde;legtaveiktldel;egtaveiktldelk;gtaveiktldelkn;taveiktldelkna;aveiktldelknal;vei
ktldelknalk;

15 mers:
mkkyllgiglilali;kkyllgiglilalia;kyllgiglilaliac;yllgiglilaliack;llgiglilaliackq;lgiglilaliackqn;giglil
aliackqnv;iglilaliackqnvs;glilaliackqnvss;lilaliackqnvssl;ilaliackqnvssld;laliackqnvsslde;aliack
qnvssldek;liackqnvssldekn;iackqnvssldekns;ackqnvssldeknsa;ckqnvssldeknsas;kqnvssldeknsa
sv;qnvssldeknsasvd;nvssldeknsasvdl;vssldeknsasvdlp;ssldeknsasvdlpg;sldeknsasvdlpge;ldekn
sasvdlpgem;deknsasvdlpgemk;eknsasvdlpgemkv;knsasvdlpgemkvl;nsasvdlpgemkvlv;sasvdlp
gemkvlvs;asvdlpgemkvlvsk;svdlpgemkvlvske;vdlpgemkvlvskek;dlpgemkvlvskekd;lpgemkvlv
skekdk;pgemkvlvskekdkd;gemkvlvskekdkdg;emkvlvskekdkdgk;mkvlvskekdkdgky;kvlvskekd
kdgkys;vlvskekdkdgkysl;lvskekdkdgkyslk;vskekdkdgkyslka;skekdkdgkyslkat;kekdkdgkyslka
tv;ekdkdgkyslkatvd;kdkdgkyslkatvdk;dkdgkyslkatvdki;kdgkyslkatvdkie;dgkyslkatvdkiel;gkys
lkatvdkielk;kyslkatvdkielkg;yslkatvdkielkgt;slkatvdkielkgts;lkatvdkielkgtsd;katvdkielkgtsdk;a
tvdkielkgtsdkd;tvdkielkgtsdkdn;vdkielkgtsdkdng;dkielkgtsdkdngs;kielkgtsdkdngsg;ielkgtsdkd
ngsgv;elkgtsdkdngsgvl;lkgtsdkdngsgvle;kgtsdkdngsgvleg;gtsdkdngsgvlegt;tsdkdngsgvlegtk;s
dkdngsgvlegtkd;dkdngsgvlegtkdd;kdngsgvlegtkddk;dngsgvlegtkddks;ngsgvlegtkddksk;gsgvle
gtkddkska;sgvlegtkddkskak;gvlegtkddkskakl;vlegtkddkskaklt;legtkddkskaklti;egtkddkskakltia
;gtkddkskakltiad;tkddkskakltiadd;kddkskakltiaddl;ddkskakltiaddls;dkskakltiaddlsk;kskakltiad
dlskt;skakltiaddlsktt;kakltiaddlskttf;akltiaddlskttfe;kltiaddlskttfel;ltiaddlskttfelf;tiaddlskttfelfk;
iaddlskttfelfke;addlskttfelfked;ddlskttfelfkedg;dlskttfelfkedgk;lskttfelfkedgkt;skttfelfkedgktl;k
ttfelfkedgktlv;ttfelfkedgktlvs;tfelfkedgktlvsr;felfkedgktlvsrk;elfkedgktlvsrkv;lfkedgktlvsrkvs;f
kedgktlvsrkvss;kedgktlvsrkvssk;edgktlvsrkvsskd;dgktlvsrkvsskdk;gktlvsrkvsskdkt;ktlvsrkvss
kdkts;tlvsrkvsskdktst;lvsrkvsskdktstd;vsrkvsskdktstde;srkvsskdktstdem;rkvsskdktstdemf;kvss
kdktstdemfn;vsskdktstdemfne;sskdktstdemfnek;skdktstdemfnekg;kdktstdemfnekge;dktstdemf
nekgel;ktstdemfnekgels;tstdemfnekgelsa;stdemfnekgelsak;tdemfnekgelsakt;demfnekgelsaktm
;emfnekgelsaktmt;mfnekgelsaktmtr;fnekgelsaktmtre;nekgelsaktmtren;ekgelsaktmtreng;kgelsa
ktmtrengt;gelsaktmtrengtk;elsaktmtrengtkl;lsaktmtrengtkle;saktmtrengtkley;aktmtrengtkleyt;k
tmtrengtkleyte;tmtrengtkleytem;mtrengtkleytemk;trengtkleytemks;rengtkleytemksd;engtkleyt
emksdg;ngtkleytemksdgt;gtkleytemksdgtg;tkleytemksdgtgk;kleytemksdgtgka;leytemksdgtgka
k;eytemksdgtgkake;ytemksdgtgkakev;temksdgtgkakevl;emksdgtgkakevlk;mksdgtgkakevlkn;k
sdgtgkakevlknf;sdgtgkakevlknft;dgtgkakevlknftl;gtgkakevlknftle;tgkakevlknftleg;gkakevlknft
legk;kakevlknftlegkv;akevlknftlegkva;kevlknftlegkvan;evlknftlegkvand;vlknftlegkvandk;lknft
legkvandkv;knftlegkvandkvt;nftlegkvandkvtl;ftlegkvandkvtle;tlegkvandkvtlev;legkvandkvtle
vk;egkvandkvtlevke;gkvandkvtlevkeg;kvandkvtlevkegt;vandkvtlevkegtv;andkvtlevkegtvt;ndk
vtlevkegtvtl;dkvtlevkegtvtls;kvtlevkegtvtlsk;vtlevkegtvtlske;tlevkegtvtlskei;levkegtvtlskeia;ev
kegtvtlskeiak;vkegtvtlskeiaks;kegtvtlskeiaksg;egtvtlskeiaksge;gtvtlskeiaksgev;tvtlskeiaksgevt
;vtlskeiaksgevtv;tlskeiaksgevtva;lskeiaksgevtval;skeiaksgevtvaln;keiaksgevtvalnd;eiaksgevtv
alndt;iaksgevtvalndtn;aksgevtvalndtnt;ksgevtvalndtntt;sgevtvalndtnttq;gevtvalndtnttqa;evtval
ndtnttqat;vtvalndtnttqatk;tvalndtnttqatkk;valndtnttqatkkt;alndtnttqatkktg;lndtnttqatkktga;ndtnt
tqatkktgaw;dtnttqatkktgawd;tnttqatkktgawds;nttqatkktgawdsk;ttqatkktgawdskt;tqatkktgawdsk

Fig. 39 continued ts;qatkktgawdsktst;atkktgawdsktstl;tkktgawdsktstlt;kktgawdsktstlti;ktgawdsktstltis;tgawdsktst
ltisv;gawdsktstltisvn;awdsktstltisvns;wdsktstltisvnsk;dsktstltisvnskk;sktstltisvnskkt;ktstltisvns
kktt;tstltisvnskkttq;stltisvnskkttql;tltisvnskkttqlv;ltisvnskkttqlvf;tisvnskkttqlvft;isvnskkttqlvftk ;svnskkttqlvftkq;vnskkttqlvftkqd;nskkttqlvftkqdt;skkttqlvftkqdti;kkttqlvftkqdtit;kttqlvftkqdtitv ;ttqlvftkqdtitvq;tqlvftkqdtitvqk;qlvftkqdtitvqky;lvftkqdtitvqkyd;vftkqdtitvqkyds;ftkqdtitvqkyd sa;tkqdtitvqkydsag;kqdtitvqkydsagt;qdtitvqkydsagtn;dtitvqkydsagtnl;titvqkydsagtnle;itvqkyds agtnleg;tvqkydsagtnlegt;vqkydsagtnlegta;qkydsagtnlegtav;kydsagtnlegtave;ydsagtnlegtavei;ds agtnlegtaveik;sagtnlegtaveikt;agtnlegtaveiktl;gtnlegtaveiktld;tnlegtaveiktlde;nlegtaveiktldel;le gtaveiktldelk;egtaveiktldelkn;gtaveiktldelkna;taveiktldelknal;aveiktldelknalk;

16 mers:
mkkyllgiglilalia;kkyllgiglilaliac;kyllgiglilaliack;yllgiglilaliackq;llgiglilaliackqn;lgiglilaliackqn v;giglilaliackqnvs;iglilaliackqnvss;glilaliackqnvssl;lilaliackqnvssld;ilaliackqnvsslde;laliackqn vssldek;aliackqnvssldekn;liackqnvssldekns;iackqnvssldeknsa;ackqnvssldeknsas;ckqnvssldekn sasv;kqnvssldeknsasvd;qnvssldeknsasvdl;nvssldeknsasvdlp;vssldeknsasvdlpg;ssldeknsasvdlp ge;sldeknsasvdlpgem;ldeknsasvdlpgemk;deknsasvdlpgemkv;eknsasvdlpgemkvl;knsasvdlpge mkvlv;nsasvdlpgemkvlvs;sasvdlpgemkvlvsk;asvdlpgemkvlvske;svdlpgemkvlvskek;vdlpgemk vlvskekd;dlpgemkvlvskekdk;lpgemkvlvskekdkd;pgemkvlvskekdkdg;gemkvlvskekdkdgk;emk vlvskekdkdgky;mkvlvskekdkdgkys;kvlvskekdkdgkysl;vlvskekdkdgkyslk;lvskekdkdgkyslka;v skekdkdgkyslkat;skekdkdgkyslkatv;kekdkdgkyslkatvd;ekdkdgkyslkatvdk;kdkdgkyslkatvdki;d kdgkyslkatvdkie;kdgkyslkatvdkiel;dgkyslkatvdkielk;gkyslkatvdkielkg;kyslkatvdkielkgt;yslkat vdkielkgts;slkatvdkielkgtsd;lkatvdkielkgtsdk;katvdkielkgtsdkd;atvdkielkgtsdkdn;tvdkielkgtsd kdng;vdkielkgtsdkdngs;dkielkgtsdkdngsg;kielkgtsdkdngsgv;ielkgtsdkdngsgvl;elkgtsdkdngsgv le;lkgtsdkdngsgvleg;kgtsdkdngsgvlegt;gtsdkdngsgvlegtk;tsdkdngsgvlegtkd;sdkdngsgvlegtkdd ;dkdngsgvlegtkddk;kdngsgvlegtkddks;dngsgvlegtkddksk;ngsgvlegtkddkska;gsgvlegtkddkskak ;sgvlegtkddkskakl;gvlegtkddkskaklt;vlegtkddkskaklti;legtkddkskakltia;egtkddkskakltiad;gtkd dkskakltiadd;tkddkskakltiaddl;kddkskakltiaddls;ddkskakltiaddlsk;dkskakltiaddlskt;kskakltiad dlsktt;skakltiaddlskttf;kakltiaddlskttfe;akltiaddlskttfel;kltiaddlskttfelf;ltiaddlskttfelfk;tiaddlsktt felfke;iaddlskttfelfked;addlskttfelfkedg;ddlskttfelfkedgk;dlskttfelfkedgkt;lskttfelfkedgktl;skttf elfkedgktlv;kttfelfkedgktlvs;ttfelfkedgktlvsr;tfelfkedgktlvsrk;felfkedgktlvsrkv;elfkedgktlvsrkv s;lfkedgktlvsrkvss;fkedgktlvsrkvssk;kedgktlvsrkvsskd;edgktlvsrkvsskdk;dgktlvsrkvsskdkt;gkt lvsrkvsskdkts;ktlvsrkvsskdktst;tlvsrkvsskdktstd;lvsrkvsskdktstde;vsrkvsskdktstdem;srkvsskdk tstdemf;rkvsskdktstdemfn;kvsskdktstdemfne;vsskdktstdemfnek;sskdktstdemfnekg;skdktstdem fnekge;kdktstdemfnekgel;dktstdemfnekgels;ktstdemfnekgelsa;tstdemfnekgelsak;stdemfnekgel sakt;tdemfnekgelsaktm;demfnekgelsaktmt;emfnekgelsaktmtr;mfnekgelsaktmtre;fnekgelsaktm tren;nekgelsaktmtreng;ekgelsaktmtrengt;kgelsaktmtrengtk;gelsaktmtrengtkl;elsaktmtrengtkle; lsaktmtrengtkley;saktmtrengtkleyt;aktmtrengtkleyte;ktmtrengtkleytem;tmtrengtkleytemk;mtre ngtkleytemks;trengtkleytemksd;rengtkleytemksdg;engtkleytemksdgt;ngtkleytemksdgtg;gtkley temksdgtgk;tkleytemksdgtgka;kleytemksdgtgkak;leytemksdgtgkake;eytemksdgtgkakev;ytemk sdgtgkakevl;temksdgtgkakevlk;emksdgtgkakevlkn;mksdgtgkakevlknf;ksdgtgkakevlknft;sdgtg kakevlknftl;dgtgkakevlknftle;gtgkakevlknftleg;tgkakevlknftlegk;gkakevlknftlegkv;kakevlknft legkva;akevlknftlegkvan;kevlknftlegkvand;evlknftlegkvandk;vlknftlegkvandkv;lknftlegkvand kvt;knftlegkvandkvtl;nftlegkvandkvtle;ftlegkvandkvtlev;tlegkvandkvtlevk;legkvandkvtlevke; egkvandkvtlevkeg;gkvandkvtlevkegt;kvandkvtlevkegtv;vandkvtlevkegtvt;andkvtlevkegtvtl;nd kvtlevkegtvtls;dkvtlevkegtvtlsk;kvtlevkegtvtlske;vtlevkegtvtlskei;tlevkegtvtlskeia;levkegtvtls

Fig. 39 continued keiak;evkegtvtlskeiaks;vkegtvtlskeiaksg;kegtvtlskeiaksge;egtvtlskeiaksgev;gtvtlskeiaksgevt;t
vtlskeiaksgevtv;vtlskeiaksgevtva;tlskeiaksgevtval;lskeiaksgevtvaln;skeiaksgevtvalnd;keiaksge
vtvalndt;eiaksgevtvalndtn;iaksgevtvalndtnt;aksgevtvalndtntt;ksgevtvalndtnttq;sgevtvalndtnttq
a;gevtvalndtnttqa;evtvalndtnttqat;vtvalndtnttqatk;tvalndtnttqatkk;valndtnttqatkkt;alndtnttqatkktg;alndtntt
qatkktga;lndtnttqatkktgaw;ndtnttqatkktgawd;dtnttqatkktgawds;tnttqatkktgawdsk;nttqatkktgaw
dskt;ttqatkktgawdskts;tqatkktgawdsktst;qatkktgawdsktstl;atkktgawdsktstlt;tkktgawdsktstlti;kk
tgawdsktstltis;ktgawdsktstltisv;tgawdsktstltisvn;gawdsktstltisvns;awdsktstltisvnsk;wdsktstltis
vnskk;dsktstltisvnskkt;sktstltisvnskktt;ktstltisvnskkttq;tstltisvnskkttql;stltisvnskkttqlv;tltisvnsk
kttqlvf;ltisvnskkttqlvft;tisvnskkttqlvftk;isvnskkttqlvftkq;svnskkttqlvftkqd;vnskkttqlvftkqdt;ns
kkttqlvftkqdti;skkttqlvftkqdtit;kkttqlvftkqdtitv;kttqlvftkqdtitvq;ttqlvftkqdtitvqk;tqlvftkqdtitvq
ky;qlvftkqdtitvqkyd;lvftkqdtitvqkyds;vftkqdtitvqkydsa;ftkqdtitvqkydsag;tkqdtitvqkydsagt;kqd
titvqkydsagtn;qdtitvqkydsagtnl;dtitvqkydsagtnle;titvqkydsagtnleg;itvqkydsagtnlegt;tvqkydsag
tnlegta;vqkydsagtnlegtav;qkydsagtnlegtave;kydsagtnlegtavei;ydsagtnlegtaveik;dsagtnlegtavei
kt;sagtnlegtaveiktl;agtnlegtaveiktld;gtnlegtaveiktlde;tnlegtaveiktldel;nlegtaveiktldelk;legtavei
ktldelkn;egtaveiktldelkna;gtaveiktldelknal;taveiktldelknalk;

<CAA59727 outer surface protein A;Protein;Borrelia garinii>
Seq ID No 156822-158917

8 mers:
mkkyllgi;kkyllgig;kyllgigl;yllgigli;llgiglil;lgiglila;giglilal;iglilali;glilalia;lilaliac;ilaliack;laliac
kq;aliackqn;liackqnv;iackqnvs;ackqnvss;ckqnvssl;kqnvssld;qnvsslde;nvssldek;vssldekn;sslde
kns;sldeknsv;ldeknsvs;deknsvsv;eknsvsvd;knsvsvdl;nsvsvdlp;svsvdlpg;vsvdlpgg;svdlpggm;v
dlpggmk;dlpggmkv;lpggmkvl;pggmkvlv;ggmkvlvs;gmkvlvsk;mkvlvske;kvlvskek;vlvskekd;lv
skekdk;vskekdkd;skekdkdg;kekdkdgk;ekdkdgky;kdkdgkys;dkdgkysl;kdgkyslm;dgkyslma;gky
slmat;kyslmatv;yslmatve;slmatvek;lmatvekl;matvekle;atveklel;tveklelk;veklelkg;eklelkgt;klel
kgts;lelkgtsd;elkgtsdk;lkgtsdkn;kgtsdknn;gtsdknng;tsdknngs;sdknngsg;dknngsgt;knngsgtl;nng
sgtle;ngsgtleg;gsgtlege;sgtlegek;gtlegekt;tlegektd;legektdk;egektdks;gektdksk;ektdkskv;ktdks
kvk;tdkskvkl;dkskvklt;kskvklti;skvkltia;kvkltiae;vkltiaed;kltiaedl;ltiaedls;tiaedlsk;iaedlskt;aed
lsktt;edlskttf;dlskttfe;lskttfei;skttfeif;kttfeifk;ttfeifke;tfeifked;feifkedg;eifkedgk;ifkedgkt;fkedg
ktl;kedgktlv;edgktlvs;dgktlvsk;gktlvskk;ktlvskkv;tlvskkvt;lvskkvtl;vskkvtlk;skkvtlkd;kkvtlkd
k;kvtlkdks;vtlkdkss;tlkdksst;lkdksste;kdkssteе;dkssteek;kssteekf;ssteekfn;steekfne;teekfnek;e
ekfnekg;ekfnekge;kfnekgei;fnekgeis;nekgeise;ekgeisek;kgeisekt;geisekti;eisektiv;isektivr;sekt
ivra;ektivran;ktivrang;tivrangt;ivrangtr;vrangtrl;rangtrle;angtrley;ngtrleyt;gtrleytd;trleytdi;rley
tdik;leytdiks;eytdiksd;ytdiksdg;tdiksdgs;diksdgsg;iksdgsgk;ksdgsgka;sdgsgkak;dgsgkake;gsg
kakev;sgkakevl;gkakevlk;kakevlkd;akevlkdf;kevlkdft;evlkdftl;vlkdftle;lkdftleg;kdftlegt;dftleg
tl;ftlegtla;tlegtlaa;legtlaad;egtlaadg;gtlaadgk;tlaadgkt;laadgktt;aadgkttl;adgkttlk;dgkttlkv;gkttl
kvt;kttlkvte;ttlkvteg;tlkvtegt;lkvtegtv;kvtegtvv;vtegtvvl;tegtvvls;egtvvlsk;gtvvlskn;tvvlskni;vv
lsknil;vlsknilk;lskniIks;sknilksg;knilksge;nilksgei;ilksgeit;lksgeitv;ksgeitva;sgeitval;geitvald;e
itvaldd;itvaldds;tvalddsd;valddsdt;alddsdtt;lddsdttq;ddsdttqa;dsdttqat;sdttqatk;dttqatkk;ttqatkk
t;tqatkktg;qatkktgk;atkktgkw;tkktgkwd;kktgkwds;ktgkwdsk;tgkwdskt;gkwdskts;kwdsktst;wds
ktstl;dsktstlt;sktstlti;ktstltis;tstltisv;stltisvn;tltisvns;ltisvnsq;tisvnsqk;isvnsqkt;svnsqktk;vnsqkt
kn;nsqktknl;sqktknlv;qktknlvf;ktknlvft;tknlvftk;knlvftke;nlvftked;lvftkedt;vftkedti;ftkedtit;tke
dtitv;kedtitvq;edtitvqk;dtitvqky;titvqkyd;itvqkyds;tvqkydsa;vqkydsag;qkydsagt;kydsagtn;ydsa

Fig. 39 continued gtnl;dsagtnle;sagtnleg;agtnlegk;gtnlegka;tnlegkav;nlegkave;legkavei;egkaveit;gkaveitt;kaveitt
l;aveittle;veittlek;eittlekl;ittleklk;ttleklkd;tleklkda;leklkdal;eklkdalk;

9 mers:
mkkyllgig;kkyllgigl;kyllgigli;yllgiglil;llgiglila;lgiglilal;giglilali;iglilalia;glilaliac;lilaliack;ilali
ackq;laliackqn;aliackqnv;liackqnvs;iackqnvss;ackqnvssl;ckqnvssld;kqnvsslde;qnvssldek;nvssl
dekn;vssldekns;ssldeknsv;sldeknsvs;ldeknsvsv;deknsvsvd;eknsvsvdl;knsvsvdlp;nsvsvdlpg;svs
vdlpgg;vsvdlpggm;svdlpggmk;vdlpggmkv;dlpggmkvl;lpggmkvlv;pggmkvlvs;ggmkvlvsk;gmk
vlvske;mkvlvskek;kvlvskekd;vlvskekdk;lvskekdkd;vskekdkdg;skekdkdgk;kekdkdgky;ekdkdg
kys;kdkdgkysl;dkdgkyslm;kdgkyslma;dgkyslmat;gkyslmatv;kyslmatve;yslmatvek;slmatvekl;l
matvekle;matveklel;atveklelk;tveklelkg;veklelkgt;eklelkgts;klelkgtsd;lelkgtsdk;elkgtsdkn;lkgt
sdknn;kgtsdknng;gtsdknngs;tsdknngsg;sdknngsgt;dknngsgtl;knngsgtle;nngsgtleg;ngsgtlege;gs
gtlegek;sgtlegekt;gtlegektd;tlegektdk;legektdks;egektdksk;gektdkskv;ektdkskvk;ktdkskvkl;td
kskvklt;dkskvklti;kskvkltia;skvkltiae;kvkltiaed;vkltiaedl;kltiaedls;ltiaedlsk;tiaedlskt;iaedlsktt;
aedlskttf;edlskttfe;dlskttfei;lskttfeif;skttfeifk;kttfeifke;ttfeifked;tfeifkedg;feifkedgk;eifkedgkt;i
fkedgktl;fkedgktlv;kedgktlvs;edgktlvsk;dgktlvskk;gktlvskkv;ktlvskkvt;tlvskkvtl;lvskkvtlk;vsk
kvtlkd;skkvtlkdk;kkvtlkdks;kvtlkdkss;vtlkdksst;tlkdksste;lkdksstee;kdkssteek;dkssteekf;ksste
ekfn;ssteekfne;steekfnek;teekfnekg;eekfnekge;ekfnekgei;kfnekgeis;fnekgeise;nekgeisek;ekgei
sekt;kgeisekti;geisektiv;eisektivr;isektivra;sektivran;ektivrang;ktivrangt;tivrangtr;ivrangtrl;vra
ngtrle;rangtrley;angtrleyt;ngtrleytd;gtrleytdi;trleytdik;rleytdiks;leytdiksd;eytdiksdg;ytdiksdgs;
tdiksdgsg;diksdgsgk;iksdgsgka;ksdgsgkak;sdgsgkake;dgsgkakev;gsgkakevl;sgkakevlk;gkakev
lkd;kakevlkdf;akevlkdft;kevlkdftl;evlkdftle;vlkdftleg;lkdftlegt;kdftlegtl;dftlegtla;ftlegtlaa;tlegt
laad;legtlaadg;egtlaadgk;gtlaadgkt;tlaadgktt;laadgkttl;aadgkttlk;adgkttlkv;dgkttlkvt;gkttlkvte;
kttlkvteg;ttlkvtegt;tlkvtegtv;lkvtegtvv;kvtegtvvl;vtegtvvls;tegtvvlsk;egtvvlskn;gtvvlskni;tvvls
knil;vvlsknilk;vlsknilks;lsknilksg;sknilksge;knilksgei;nilksgeit;ilksgeitv;lksgeitva;ksgeitval;sg
eitvald;geitvaldd;eitvaldds;itvalddsd;tvalddsdt;valddsdtt;alddsdttq;lddsdttqa;ddsdttqat;dsdttqat
k;sdttqatkk;dttqatkkt;ttqatkktg;tqatkktgk;qatkktgkw;atkktgkwd;tkktgkwds;kktgkwdsk;ktgkwd
skt;tgkwdskts;gkwdsktst;kwdsktstl;wdsktstlt;dsktstlti;sktstltis;ktstltisv;tstltisvn;stltisvns;tltisv
nsq;ltisvnsqk;tisvnsqkt;isvnsqktk;svnsqktkn;vnsqktknl;nsqktknlv;sqktknlvf;qktknlvft;ktknlvft
k;tknlvftke;knlvftked;nlvftkedt;lvftkedti;vftkedtit;ftkedtitv;tkedtitvq;kedtitvqk;edtitvqky;dtitv
qkyd;titvqkyds;itvqkydsa;tvqkydsag;vqkydsagt;qkydsagtn;kydsagtnl;ydsagtnle;dsagtnleg;sagt
nlegk;agtnlegka;gtnlegkav;tnlegkave;nlegkavei;legkaveit;egkaveitt;gkaveittl;kaveittle;aveittle
k;veittlekl;eittleklk;ittleklkd;ttleklkda;tleklkdal;leklkdalk;

10 mers:
mkkyllgigl;kkyllgigli;kyllgiglil;yllgiglila;llgiglilal;lgiglilali;giglilalia;iglilaliac;glilaliack;lilali
ackq;ilaliackqn;laliackqnv;aliackqnvs;liackqnvss;iackqnvssl;ackqnvssld;ckqnvsslde;kqnvssld
ek;qnvssldekn;nvssldekns;vssldeknsv;ssldeknsvs;sldeknsvsv;ldeknsvsvd;deknsvsvdl;eknsvsv
dlp;knsvsvdlpg;nsvsvdlpgg;svsvdlpggm;vsvdlpggmk;svdlpggmkv;vdlpggmkvl;dlpggmkvlv;lp
ggmkvlvs;pggmkvlvsk;ggmkvlvske;gmkvlvskek;mkvlvskekd;kvlvskekdk;vlvskekdkd;lvskek
dkdg;vskekdkdgk;skekdkdgky;kekdkdgkys;ekdkdgkysl;kdkdgkyslm;dkdgkyslma;kdgkyslmat
;dgkyslmatv;gkyslmatve;kyslmatvek;yslmatvekl;slmatvekle;lmatveklel;matveklelk;atveklelkg
;tveklelkgt;veklelkgts;eklelkgtsd;klelkgtsdk;lelkgtsdkn;elkgtsdknn;lkgtsdknng;kgtsdknngs;gts
dknngsg;tsdknngsgt;sdknngsgtl;dknngsgtle;knngsgtleg;nngsgtlege;ngsgtlegek;gsgtlegekt;sgtle
gektd;gtlegektdk;tlegektdks;legektdksk;egektdkskv;gektdkskvk;ektdkskvkl;ktdkskvklt;tdkskv klti;dkskvkltia;kskvkltiae;skvkltiaed;kvkltiaedl;vkltiaedls;kltiaedlsk;ltiaedlskt;tiaedlsktt;iaedls
kttf;aedlskttfe;edlskttfei;dlskttfeif;lskttfeifk;skttfeifke;kttfeifked;ttfeifkedg;tfeifkedgk;feifkedg
kt;eifkedgktl;ifkedgktlv;fkedgktlvs;kedgktlvsk;edgktlvskk;dgktlvskkv;gktlvskkvt;ktlvskkvtl;tl
vskkvtlk;lvskkvtlkd;vskkvtlkdk;skkvtlkdks;kkvtlkdkss;kvtlkdksst;vtlkdksste;tlkdksstee;lkdkss teek;kdkssteekf;dkssteekfn;kssteekfne;ssteekfnek;steekfnekg;teekfnekge;eekfnekgei;ekfnekge is;kfnekgeise;fnekgeisek;nekgeisekt;ekgeisekti;kgeisektiv;geisektivr;eisektivra;isektivran;sekt ivrang;ektivrangt;ktivrangtr;tivrangtrl;ivrangtrle;vrangtrley;rangtrleyt;angtrleytd;ngtrleytdi;gtr leytdik;trleytdiks;rleytdiksd;leytdiksdg;eytdiksdgs;ytdiksdgsg;tdiksdgsgk;diksdgsgka;iksdgsg kak;ksdgsgkake;sdgsgkakev;dgsgkakevl;gsgkakevlk;sgkakevlkd;gkakevlkdf;kakevlkdft;akevl kdftl;kevlkdftle;evlkdftleg;vlkdftlegt;lkdftlegtl;kdftlegtla;dftlegtlaa;ftlegtlaad;tlegtlaadg;legtla adgk;egtlaadgkt;gtlaadgktt;tlaadgkttl;laadgkttlk;aadgkttlkv;adgkttlkvt;dgkttlkvte;gkttlkvteg;kt tlkvtegt;ttlkvtegtv;tlkvtegtvv;lkvtegtvvl;kvtegtvvls;vtegtvvlsk;tegtvvlskn;egtvvlskni;gtvvlskni l;tvvlsknilk;vvlsknilks;vlsknilksg;lsknilksge;sknilksgei;knilksgeit;nilksgeitv;ilksgeitva;lksgeit val;ksgeitvald;sgeitvaldd;geitvaldds;eitvalddsd;itvalddsdt;tvalddsdtt;valddsdttq;alddsdttqa;ldd sdttqat;ddsdttqatk;dsdttqatkk;sdttqatkkt;dttqatkktg;ttqatkktgk;tqatkktgkw;qatkktgkwd;atkktgk wds;tkktgkwdsk;kktgkwdskt;ktgkwdskts;tgkwdsktst;gkwdsktstl;kwdsktstlt;wdsktstlti;dsktstlti s;sktstltisv;ktstltisvn;tstltisvns;stltisvnsq;tltisvnsqk;ltisvnsqkt;tisvnsqktk;isvnsqktkn;svnsqktkn l;vnsqktknlv;nsqktknlvf;sqktknlvft;qktknlvftk;ktknlvftke;tknlvftked;knlvftkedt;nlvftkedti;lvft kedtit;vftkedtitv;ftkedtitvq;tkedtitvqk;kedtitvqky;edtitvqkyd;dtitvqkyds;titvqkydsa;itvqkydsag ;tvqkydsagt;vqkydsagtn;qkydsagtnl;kydsagtnle;ydsagtnleg;dsagtnlegk;sagtnlegka;agtnlegkav; gtnlegkave;tnlegkavei;nlegkaveit;legkaveitt;egkaveittl;gkaveittle;kaveittlek;aveittlekl;veittlekl k;eittleklkd;ittleklkda;ttleklkdal;tleklkdalk;

11 mers:
mkkyllgigli;kkyllgiglil;kyllgiglila;yllgiglilal;llgiglilali;lgiglilalia;giglilaliac;iglilaliack;glilaliac kq;lilaliackqn;ilaliackqnv;laliackqnvs;aliackqnvss;liackqnvssl;iackqnvssld;ackqnvsslde;ckqnv ssldek;kqnvssldekn;qnvssldekns;nvssldeknsv;vssldeknsvs;ssldeknsvsv;sldeknsvsvd;ldeknsvsv dl;deknsvsvdlp;eknsvsvdlpg;knsvsvdlpgg;nsvsvdlpggm;svsvdlpggmk;vsvdlpggmkv;svdlpgg mkvl;vdlpggmkvlv;dlpggmkvlvs;lpggmkvlvsk;pggmkvlvske;ggmkvlvskek;gmkvlvskekd;mkv lvskekdk;kvlvskekdkd;vlvskekdkdg;lvskekdkdgk;vskekdkdgky;skekdkdgkys;kekdkdgkysl;ek dkdgkyslm;kdkdgkyslma;dkdgkyslmat;kdgkyslmatv;dgkyslmatve;gkyslmatvek;kyslmatvekl;y slmatvekle;slmatveklel;lmatveklelk;matveklelkg;atveklelkgt;tveklelkgts;veklelkgtsd;eklelkgts dk;klelkgtsdkn;lelkgtsdknn;elkgtsdknng;lkgtsdknngs;kgtsdknngsg;gtsdknngsgt;tsdknngsgtl;sd knngsgtle;dknngsgtleg;knngsgtlege;nngsgtlegek;ngsgtlegekt;gsgtlegektd;sgtlegektdk;gtlegekt dks;tlegektdksk;legektdkskv;egektdkskvk;gektdkskvkl;ektdkskvklt;ktdkskvklti;tdkskvkltia;dk skvkltiae;kskvkltiaed;skvkltiaedl;kvkltiaedls;vkltiaedlsk;kltiaedlskt;ltiaedlsktt;tiaedlskttf;iaedl skttfe;aedlskttfei;edlskttfeif;dlskttfeifk;lskttfeifke;skttfeifked;kttfeifkedg;ttfeifkedgk;tfeifkedg kt;feifkedgktl;eifkedgktlv;ifkedgktlvs;fkedgktlvsk;kedgktlvskk;edgktlvskkv;dgktlvskkvt;gktlv skkvtl;ktlvskkvtlk;tlvskkvtlkd;lvskkvtlkdk;vskkvtlkdks;skkvtlkdkss;kkvtlkdksst;kvtlkdksste;v tlkdksstee;tlkdkssteek;lkdkssteekf;kdkssteekfn;dkssteekfne;kssteekfnek;ssteekfnekg;steekfnek ge;teekfnekgei;eekfnekgeis;ekfnekgeise;kfnekgeisek;fnekgeisekt;nekgeisekti;ekgeisektiv;kgei sektivr;geisektivra;eisektivran;isektivrang;sektivrangt;ektivrangtr;ktivrangtrl;tivrangtrle;ivran gtrley;vrangtrleyt;rangtrleytd;angtrleytdi;ngtrleytdik;gtrleytdiks;trleytdiksd;rleytdiksdg;leytdi ksdgs;eytdiksdgsg;ytdiksdgsgk;tdiksdgsgka;diksdgsgkak;iksdgsgkake;ksdgsgkakev;sdgsgkak evl;dgsgkakevlk;gsgkakevlkd;sgkakevlkdf;gkakevlkdft;kakevlkdftl;akevlkdftle;kevlkdftleg;ev

Fig. 39 continued lkdftlegt;vlkdftlegtl;lkdftlegtla;kdftlegtlaa;dftlegtlaad;ftlegtlaadg;tlegtlaadgk;legtlaadgkt;egtla adgktt;gtlaadgkttl;tlaadgkttlk;laadgkttlkv;aadgkttlkvt;adgkttlkvte;dgkttlkvteg;gkttlkvtegt;kttlk vtegtv;ttlkvtegtvv;tlkvtegtvvl;lkvtegtvvls;kvtegtvvlsk;vtegtvvlskn;tegtvvlskni;egtvvlsknil;gtv vlsknilk;tvvlsknilks;vvlsknilksg;vlsknilksge;lsknilksgei;sknilksgeit;knilksgeitv;nilksgeitva;ilk sgeitval;lksgeitvald;ksgeitvaldd;sgeitvaldds;geitvalddsd;eitvalddsdt;itvalddsdtt;tvalddsdttq;val ddsdttqa;alddsdttqat;lddsdttqatk;ddsdttqatkk;dsdttqatkkt;sdttqatkktg;dttqatkktgk;ttqatkktgkw;t qatkktgkwd;qatkktgkwds;atkktgkwdsk;tkktgkwdskt;kktgkwdskts;ktgkwdsktst;tgkwdsktstl;gk wdsktstlt;kwdsktstlti;wdsktstltis;dsktstltisv;sktstltisvn;ktstltisvns;tstltisvnsq;stltisvnsqk;tltisvn sqkt;ltisvnsqktk;tisvnsqktkn;isvnsqktknl;svnsqktknlv;vnsqktknlvf;nsqktknlvft;sqktknlvftk;qkt knlvftke;ktknlvftked;tknlvftkedt;knlvftkedti;nlvftkedtit;lvftkedtitv;vftkedtitvq;ftkedtitvqk;tked titvqky;kedtitvqkyd;edtitvqkyds;dtitvqkydsa;titvqkydsag;itvqkydsagt;tvqkydsagtn;vqkydsagtn l;qkydsagtnle;kydsagtnleg;ydsagtnlegk;dsagtnlegka;sagtnlegkav;agtnlegkave;gtnlegkavei;tnle gkaveit;nlegkaveitt;legkaveittl;egkaveittle;gkaveittlek;kaveittlekl;aveittleklk;veittleklkd;eittle klkda;ittleklkdal;ttleklkdalk;

13 mers:
mkkyllgiglila;kkyllgiglilal;kyllgiglilali;yllgiglilalia;llgiglilaliac;lgiglilaliack;giglilaliackq;iglil aliackqn;glilaliackqnv;lilaliackqnvs;ilaliackqnvss;laliackqnvssl;aliackqnvssld;liackqnvsslde;ia ckqnvssldek;ackqnvssldekn;ckqnvssldekns;kqnvssldeknsv;qnvssldeknsvs;nvssldeknsvsv;vssl deknsvsvd;ssldeknsvsvdl;sldeknsvsvdlp;ldeknsvsvdlpg;deknsvsvdlpgg;eknsvsvdlpggm;knsvs vdlpggmk;nsvsvdlpggmkv;svsvdlpggmkvl;vsvdlpggmkvlv;svdlpggmkvlvs;vdlpggmkvlvsk;dl pggmkvlvske;lpggmkvlvskek;pggmkvlvskekd;ggmkvlvskekdk;gmkvlvskekdkd;mkvlvskekdk dg;kvlvskekdkdgk;vlvskekdkdgky;lvskekdkdgkys;vskekdkdgkysl;skekdkdgkyslm;kekdkdgky slma;ekdkdgkyslmat;kdkdgkyslmatv;dkdgkyslmatve;kdgkyslmatvek;dgkyslmatvekl;gkyslmat vekle;kyslmatveklel;yslmatveklelk;slmatveklelkg;lmatveklelkgt;matveklelkgts;atveklelkgtsd;t veklelkgtsdk;veklelkgtsdkn;eklelkgtsdknn;klelkgtsdknng;lelkgtsdknngs;elkgtsdknngsg;lkgtsd knngsgt;kgtsdknngsgtl;gtsdknngsgtle;tsdknngsgtleg;sdknngsgtlege;dknngsgtlegek;knngsgtleg ekt;nngsgtlegektd;ngsgtlegektdk;gsgtlegektdks;sgtlegektdksk;gtlegektdkskv;tlegektdkskvk;le gektdkskvkl;egektdkskvklt;gektdkskvklti;ektdkskvkltia;ktdkskvkltiae;tdkskvkltiaed;dkskvklti aedl;kskvkltiaedls;skvkltiaedlsk;kvkltiaedlskt;vkltiaedlsktt;kltiaedlskttf;ltiaedlskttfe;tiaedlskttf ei;iaedlskttfeif;aedlskttfeifk;edlskttfeifke;dlskttfeifked;lskttfeifkedg;skttfeifkedgk;kttfeifkedgk t;ttfeifkedgktl;tfeifkedgktlv;feifkedgktlvs;eifkedgktlvsk;ifkedgktlvskk;fkedgktlvskkv;kedgktlv skkvt;edgktlvskkvtl;dgktlvskkvtlk;gktlvskkvtlkd;ktlvskkvtlkdk;tlvskkvtlkdks;lvskkvtlkdkss;v skkvtlkdksst;skkvtlkdksste;kkvtlkdksstee;kvtlkdkssteek;vtlkdkssteekf;tlkdkssteekfn;lkdksstee kfne;kdkssteekfnek;dkssteekfnekg;kssteekfnekge;ssteekfnekgei;steekfnekgeis;teekfnekgeise;e ekfnekgeisek;ekfnekgeisekt;kfnekgeisekti;fnekgeisektiv;nekgeisektivr;ekgeisektivra;kgeisekti vran;geisektivrang;eisektivrangt;isektivrangtr;sektivrangtrl;ektivrangtrle;ktivrangtrley;tivrangt rleyt;ivrangtrleytd;vrangtrleytdi;rangtrleytdik;angtrleytdiks;ngtrleytdiksd;gtrleytdiksdg;trleytd iksdgs;rleytdiksdgsg;leytdiksdgsgk;eytdiksdgsgka;ytdiksdgsgkak;tdiksdgsgkake;diksdgsgkak ev;iksdgsgkakevl;ksdgsgkakevlk;sdgsgkakevlkd;dgsgkakevlkdf;gsgkakevlkdft;sgkakevlkdftl; gkakevlkdftle;kakevlkdftleg;akevlkdftlegt;kevlkdftlegtl;evlkdftlegtla;vlkdftlegtlaa;lkdftlegtlaa d;kdftlegtlaadg;dftlegtlaadgk;ftlegtlaadgkt;tlegtlaadgktt;legtlaadgkttl;egtlaadgkttlk;gtlaadgkttl kv;tlaadgkttlkvt;laadgkttlkvte;aadgkttlkvteg;adgkttlkvtegt;dgkttlkvtegtv;gkttlkvtegtvv;kttlkvte gtvvl;ttlkvtegtvvls;tlkvtegtvvlsk;lkvtegtvvlskn;kvtegtvvlskni;vtegtvvlsknil;tegtvvlsknilk;egtvv lsknilks;gtvvlsknilksg;tvvlsknilksge;vvlsknilksgei;vlsknilksgeit;lsknilksgeitv;sknilksgeitva;kn

Fig. 39 continued ilksgeitval;nilksgeitvald;ilksgeitvaldd;lksgeitvaldds;ksgeitvalddsd;sgeitvalddsdt;geitvalddsdtt; eitvalddsdttq;itvalddsdttqa;tvalddsdttqat;valddsdttqatk;alddsdttqatkk;lddsdttqatkkt;ddsdttqatk ktg;dsdttqatkktgk;sdttqatkktgkw;dttqatkktgkwd;ttqatkktgkwds;tqatkktgkwdsk;qatkktgkwdskt; atkktgkwdskts;tkktgkwdsktst;kktgkwdsktstl;ktgkwdsktstlt;tgkwdsktstlti;gkwdsktstltis;kwdskts tltisv;wdsktstltisvn;dsktstltisvns;sktstltisvnsq;ktstltisvnsqk;tstltisvnsqkt;stltisvnsqktk;tltisvnsq ktkn;ltisvnsqktknl;tisvnsqktknlv;is geitvalddsdttq;eitvalddsdttqa;itvalddsdttqat;tvalddsdttqatk;valddsdttqatkk;alddsdttqatkkt;lddsd ttqatkktg;ddsdttqatkktgk;dsdttqatkktgkw;sdttqatkktgkwd;dttqatkktgkwds;ttqatkktgkwdsk;tqat kktgkwdskt;qatkktgkwdskts;atkktgkwdsktst;tkktgkwdsktstl;kktgkwdsktstlt;ktgkwdsktstlti;tgk wdsktstltis;gkwdsktstltisv;kwdsktstltisvn;wdsktstltisvns;dsktstltisvnsq;sktstltisvnsqk;ktstltisvn sqkt;tstltisvnsqktk;stltisvnsqktkn;tltisvnsqktknl;ltisvnsqktknlv;tisvnsqktknlvf;isvnsqktknlvft;s vnsqktknlvftk;vnsqktknlvftke;nsqktknlvftked;sqktknlvftkedt;qktknlvftkedti;ktknlvftkedtit;tknl vftkedtitv;knlvftkedtitvq;nlvftkedtitvqk;lvftkedtitvqky;v g;egtvvlsknilksge;gtvvlsknilksgei;tvvlsknilksgeit;vvlsknilksgeitv;vlsknilksgeitva;lsknilksgeitv
al;sknilksgeitvald;knilksgeitvaldd;nilksgeitvaldds;ilksgeitvalddsd;lksgeitvalddsdt;ksgeitvaldds
dtt;sgeitvalddsdttq;geitvalddsdttqa;eitvalddsdttqat;itvalddsdttqatk;tvalddsdttqatkk;valddsdttqat lkdftleg;sgkakevlkdftlegt;gkakevlkdftlegtl;kakevlkdftlegtla;akevlkdftlegtlaa;kevlkdftlegtlaad;
evlkdftlegtlaadg;vlkdftlegtlaadgk;lkdftlegtlaadgkt;kdftlegtlaadgktt;dftlegtlaadgkttl;ftlegtlaadg
kttlk;tlegtlaadgkttlkv;legtlaadgkttlkvt;egtlaadgkttlkvte;gtlaadgkttlkvteg;tlaadgkttlkvtegt;laadg
kttlkvtegtv;aadgkttlkvtegtvv;adgkttlkvtegtvvl;dgkttlkvtegtvvls;gkttlkvtegtvvlsk;kttlkvtegtvvls
kn;ttlkvtegtvvlskni;tlkvtegtvvlsknil;lkvtegtvvlsknilk;kvtegtvvlsknilks;vtegtvvlsknilksg;tegtvvl
sknilksge;egtvvlsknilksgei;gtvvlsknilksgeit;tvvlsknilksgeitv;vvlsknilksgeitva;vlsknilksgeitval;
lsknilksgeitvald;sknilksgeitvaldd;knilksgeitvaldds;nilksgeitvalddsd;ilksgeitvalddsdt;lksgeitval
ddsdtt;ksgeitvalddsdttq;sgeitvalddsdttqa;geitvalddsdttqat;eitvalddsdttqatk;itvalddsdttqatkk;tva
lddsdttqatkkt;valddsdttqatkktg;alddsdttqatkktgk;lddsdttqatkktgkw;ddsdttqatkktgkwd;dsdttqatk
ktgkwds;sdttqatkktgkwdsk;dttqatkktgkwdskt;ttqatkktgkwdskts;tqatkktgkwdsktst;qatkktgkwds
ktstl;atkktgkwdsktstlt;tkktgkwdsktstlti;kktgkwdsktstltis;ktgkwdsktstltisv;tgkwdsktstltisvn;gk
wdsktstltisvns;kwdsktstltisvnsq;wdsktstltisvnsqk;dsktstltisvnsqkt;sktstltisvnsqktk;ktstltisvnsq
ktkn;tstltisvnsqktknl;stltisvnsqktknlv;tltisvnsqktknlvf;ltisvnsqktknlvft;tisvnsqktknlvftk;isvnsq
ktknlvftke;svnsqktknlvftked;vnsqktknlvftkedt;nsqktknlvftkedti;sqktknlvftkedtit;qktknlvftkedti
tv;ktknlvftkedtitv;tknlvftkedtitvq;knlvftkedtitvqk;nlvftkedtitvqky;lvftkedtitvqkyd;vftked
titvqkydsa;ftkedtitvqkydsag;tkedtitvqkydsagt;kedtitvqkydsagtn;edtitvqkydsagtnl;dtitvqkydsag
tnle;titvqkydsagtnleg;itvqkydsagtnlegk;tvqkydsagtnlegka;vqkydsagtnlegkav;qkydsagtnlegkav
e;kydsagtnlegkavei;ydsagtnlegkaveit;dsagtnlegkaveitt;sagtnlegkaveittl;agtnlegkaveittle;gtnleg
kaveittlek;tnlegkaveittlekl;nlegkaveittleklk;legkaveittleklkd;egkaveittleklkda;gkaveittleklkdal;
kaveittleklkdalk;

<YP_853838 outer surface protein B;Protein;Borrelia afzelii PKo>
Seq ID No 158918-161221

8 mers:
mkqyllvf;kqyllvfa;qyllvfal;yllvfalv;llvfalvl;lvfalvla;vfalvlal;falvlali;alv
lalia;lvlaliac;vlaliacs;laliacsq;aliacsqk;liacsqkg;iacsqkgt;acsqkgte;csqkgt
ep;sqkgtepk;qkgtepks;kgtepkst;gtepksts;tepkstsq;epkstsqd;pkstsqdh;kstsqdhn;
stsqdhnd;tsqdhndq;sqdhndqe;qdhndqei;dhndqeii;hndqeiin;ndqeiins;dqeiinsd;qei
insdn;eiinsdnt;iinsdntp;insdntpk;nsdntpkd;sdntpkds;dntpkdsk;ntpkdskk;tpkdsk
kd;pkdskkdl;kdskkdlt;dskkdltv;skkdltvl;kkdltvla;kdltvlae;dltvlaee;ltvlaeen;
tvlaeens;vlaeensv;laeensvp;aeensvpl;eensvplf;ensvplfn;nsvplfng;svplfngn;vpl
fngnk;plfngnki;lfngnkif;fngnkifv;ngnkifvs;gnkifvsk;nkifvske;kifvskek;ifvske
kn;fvskekns;vskeknsa;skeknsag;keknsagk;eknsagky;knsagkye;nsagkyel;sagkyelr;
agkyelra;gkyelrat;kyelratv;yelratvd;elratvdt;lratvdtv;ratvdtve;atvdtvel;tvd
tvelk;vdtvelkg;dtvelkgv;tvelkgvs;velkgvsd;elkgvsdk;lkgvsdkn;kgvsdknn;gvsdkn
ng;vsdknngs;sdknngsg;dknngsgk;knngsgkl;nngsgkle;ngsgkleg;gsgklegt;sgklegtk;
gklegtka;klegtkad;legtkadk;egtkadkt;gtkadktk;tkadktkv;kadktkva;adktkvam;dkt
kvamt;ktkvamti;tkvamtia;kvamtiad;vamtiadd;amtiaddl;mtiaddln;tiaddlnt;iaddln
ti;addlntit;ddlntitv;dlntitve;lntitvet;ntitvety;titvetyd;itvetyda;tvetydas;
vetydasn;etydasnk;tydasnkk;ydasnkkt;dasnkktg;asnkktgs;snkktgse;nkktgsev;kkt
gsevv;ktgsevvk;tgsevvkk;gsevvkkq;sevvkkqg;evvkkqgs;vvkkqgsv;vkkqgsvi;kkqgsv
ik;kqgsvike;qgsvikes;gsvikesy;svikesyk;vikesyka;ikesykan;kesykank;esykankl;
sykankld;ykankldk;kankldsk;ankldskk;nkldskki;kldskkit;ldskkitr;dskkitre;skk
itren;kkitrene;kitrenet;itrenett;trenettl;renettle;enettley;nettleys;ettley
se;ttleysem;tleysemt;leysemtd;eysemtds;ysemtdss;semtdssn;emtdssna;mtdssnat;
tdssnatk;dssnatka;ssnatkav;snatkave;natkavet;atkavetl;tkavetlk;kavetlkn;ave
tlkng;vetlkngi;etlkngik;tlkngikl;lkngikle;kngikleg;ngiklegs;giklegsl;iklegs
lv;klegslvg;legslvgg;egslvggk;gslvggkt;slvggktt;lvggkttv;vggkttvk;ggkttvkl;
gkttvklt;kttvklte;ttvklteg;tvkltegt;vkltegti;kltegtit;ltegtitl;tegtitlt;egt
itltr;gtitltre;titltrei;itltreie;tltreieq;ltreieqd;treieqdg;reieqdgk;eieqdg kv;ieqdgkvk;eqdgkvki;qdgkvkiy;dgkvkiyl;gkvkiyln;kvkiylnd;vkiylndt;kiylndtt;iylndtts;ylndttsg;lndttsgs;ndttsgst;dttsgstk;ttsgstkk;tsgstkkt;sgstkkta;gstkktat;stkktatw;tkktatwn;kktatwne;ktatwnet;tatwnett;atwnettn;twnettnt;wnettntl;nettntlt;ettntlti;ttntltis;tntltisa;ntltisad;tltisads;ltisadsk;tisadskk;isadskkt;sadskktk;adskktkd;dskktkdf;skktkdfv;kktkdfvf;ktkdfvfl;tkdfvflt;kdfvfltd;dfvfltdg;fvfltdgt;vfltdgti;fltdgtit;ltdgtitv;tdgtitvq;dgtitvqa;gtitvqay;titvqayd;itvqaydt;tvqaydta;vqaydtag;qaydtagt;aydtagtk;ydtagtkl;dtagtkle;tagtkleg;agtklegn;gtklegns;tklegnss;klegnsse;legnssei;egnsseik;gnsseikd;nsseikdl;sseikdla;seikdlaa;eikdlaal;ikdlaalk;kdlaalka;dlaalkaa;laalkaal;aalkaalk;

9 mers:
mkqyllvfa;kqyllvfal;qyllvfalv;yllvfalvl;llvfalvla;lvfalvlal;vfalvlali;falvlalia;alvlaliac;lvlaliacs;vlaliacsq;laliacsqk;aliacsqkg;liacsqkgt;iacsqkgte;acsqkgtep;csqkgtepk;sqkgtepks;qkgtepkst;kgtepksts;gtepkstsq;tepkstsqd;epkstsqdh;pkstsqdhn;kstsqdhnd;stsqdhndq;tsqdhndqe;sqdhndqei;qdhndqeii;dhndqeiin;hndqeiins;ndqeiinsd;dqeiinsdn;qeiinsdnt;eiinsdntp;iinsdntpk;insdntpkd;nsdntpkds;sdntpkdsk;dntpkdskk;ntpkdskkd;tpkdskkdl;pkdskkdlt;kdskkdltv;dskkdltvl;skkdltvla;kkdltvlae;kdltvlaee;dltvlaeen;ltvlaeens;tvlaeensv;vlaeensvp;laeensvpl;aeensvplf;eensvplfn;ensvplfng;nsvplfngn;svplfngnk;vplfngnki;plfngnkif;lfngnkifv;fngnkifvs;ngnkifvsk;gnkifvske;nkifvskek;kifvskekn;ifvskekns;fvskeknsa;vskeknsag;skeknsagk;keknsagky;eknsagkye;knsagkyel;nsagkyelr;sagkyelra;agkyelrat;gkyelratv;kyelratvd;yelratvdt;elratvdtv;lratvdtve;ratvdtvel;atvdtvelk;tvdtvelkg;vdtvelkgv;dtvelkgvs;tvelkgvsd;velkgvsdk;elkgvsdkn;lkgvsdknn;kgvsdknng;gvsdknngs;vsdknngsg;sdknngsgk;dknngsgkl;knngsgkle;nngsgkleg;ngsgklegt;gsgklegtk;sgklegtka;gklegtkad;klegtkadk;legtkadkt;egtkadktk;gtkadktkv;tkadktkva;kadktkvam;adktkvamt;dktkvamti;ktkvamtia;tkvamtiad;kvamtiadd;vamtiaddl;amtiaddln;mtiaddlnt;tiaddlnti;iaddlntit;addlntitv;ddlntitve;dlntitvet;lntitvety;ntitvetyd;titvetyda;itvetydas;tvetydasn;vetydasnk;etydasnkk;tydasnkkt;ydasnkktg;dasnkktgs;asnkktgse;snkktgsev;nkktgsevv;kktgsevvk;ktgsevvkk;tgsevvkkq;gsevvkkqg;sevvkkqgs;evvkkqgsv;vvkkqgsvi;vkkqgsvik;kkqgsvike;kqgsvikes;qgsvikesy;gsvikesyk;svikesyka;vikesykan;ikesykank;kesykankl;esykankld;sykanklds;ykankldsk;kankldskk;ankldskki;nkldskkit;kldskkitr;ldskkitre;dskkitren;skkitrene;kkitrenet;kitrenett;itrenettl;trenettle;renettley;enettleys;nettleyse;ettleysem;ttleysemt;tleysemtd;leysemtds;eysemtdss;ysemtdssn;semtdssna;emtdssnat;mtdssnatk;tdssnatka;dssnatkav;ssnatkave;snatkavet;natkavetl;atkavetlk;tkavetlkn;kavetlkng;avetlkngi;vetlkngik;etlkngikl;tlkngikle;lkngikleg;kngiklegs;ngiklegsl;giklegslv;iklegslvg;klegslvgg;legslvggk;egslvggkt;gslvggktt;slvggkttv;lvggkttvk;vggkttvkl;ggkttvklt;gkttvklte;kttvklteg;ttvkltegt;tvkltegti;vkltegtit;kltegtitl;ltegtitlt;tegtitltr;egtitltre;gtitltrei;titltreie;itltreieq;tltreieqd;ltreieqdg;treieqdgk;reieqdgkv;eieqdgkvk;ieqdgkvki;eqdgkvkiy;qdgkvkiyl;dgkvkiyln;gkvkiylnd;kvkiylndt;vkiylndtt;kiylndtts;iylndttsg;ylndttsgs;lndttsgst;ndttsgstk;dttsgstkk;ttsgstkkt;tsgstkkta;sgstkktat;gstkktatw;stkktatwn;tkktatwne;kktatwnet;ktatwnett;tatwnettn;atwnettnt;twnettntl;wnettntlt;nettntlti;ettntltis;ttntltisa;tntltisad;ntltisads;tltisadsk;ltisadskk;tisadskkt;isadskktk;sadskktkd;adskktkdf;dskktkdfv;skktkdfvf;kktkdfvfl;ktkdfvflt;tkdfvfltd;kdfvfltdg;dfvfltdgt;fvfltdgti;vfltdgtit;fltdgtitv;ltdgtitvq;tdgtitvqa;dgtitvqay;gtitvqayd;titvqaydt;itvqaydta;tvqaydtag;vqaydtagt;qaydtagtk;aydtagtkl;ydtagtkle;dtagtkleg;tagtklegn;agtklegns;gtklegnss;tklegnsse;klegnssei;legnsseik;egnsseikd;gnsseikdl;nsseikdla;sseikdlaa;seikdlaal;eikdlaalk;ikdlaalka;kdlaalkaa;dlaalkaal;laalkaalk;

10 mers:
mkqyllvfal;kqyllvfalv;qyllvfalvl;yllvfalvla;llvfalvlal;lvfalvlali;vfalvlalia;falvlaliac;alvlaliacs;lvlaliacsq;vlaliacsqk;laliacsqkg;aliacsqkgt;liacsqk

Fig. 39 continued gte;iacsqkgtep;acsqkgtepk;csqkgtepks;sqkgtepkst;qkgtepksts;kgtepkstsq;gtepk
stsqd;tepkstsqdh;epkstsqdhn;pkstsqdhnd;kstsqdhndq;stsqdhndqe;tsqdhndqei;sqd
hndqeii;qdhndqeiin;dhndqeiins;hndqeiinsd;ndqeiinsdn;dqeiinsdnt;qeiinsdntp;e
iinsdntpk;iinsdntpkd;insdntpkds;nsdntpkdsk;sdntpkdskk;dntpkdskkd;ntpkdskkdl
;tpkdskkdlt;pkdskkdltv;kdskkdltvl;dskkdltvla;skkdltvlae;kkdltvlaee;kdltvlae
en;dltvlaeens;ltvlaeensv;tvlaeensvp;vlaeensvpl;laeensvplf;aeensvplfn;eensvp
lfng;ensvplfngn;nsvplfngnk;svplfngnki;vplfngnkif;plfngnkifv;lfngnkifvs;fngn
kifvsk;ngnkifvske;gnkifvskek;nkifvskekn;kifvskekns;ifvskeknsa;fvskeknsag;vs keknsagk;skeknsagky;keknsagkye;eknsagkyel;knsagkyelr;nsagkyelra;sagkyelrat; agkyelratv;gkyelratvd;kyelratvdt;yelratvdtv;elratvdtve;lratvdtvel;ratvdtvel k;atvdtvelkg;tvdtvelkgv;vdtvelkgvs;dtvelkgvsd;tvelkgvsdk;velkgvsdkn;elkgvsd knn;lkgvsdknng;kgvsdknngs;gvsdknngsg;vsdknngsgk;sdknngsgkl;dknngsgkle;knngs gkleg;nngsgklegt;ngsgklegtk;gsgklegtka;sgklegtkad;gklegtkadk;klegtkadkt;leg tkadktk;egtkadktkv;gtkadktkva;tkadktkvam;kadktkvamt;adktkvamti;dktkvamtia;k tkvamtiad;tkvamtiadd;kvamtiaddl;vamtiaddln;amtiaddlnt;mtiaddlnti;tiaddlntit ;iaddlntitv;addlntitve;ddlntitvet;dlntitvety;lntitvetyd;ntitvetyda;titvetyd as;itvetydasn;tvetydasnk;vetydasnkk;etydasnkkt;tydasnkktg;ydasnkktgs;dasnkk tgse;asnkktgsev;snkktgsevv;nkktgsevvk;kktgsevvkk;ktgsevvkkq;tgsevvkkqg;gsev vkkqgs;sevvkkqgsv;evvkkqgsvi;vvkkqgsvik;vkkqgsvike;kkqgsvikes;kqgsvikesy;qg svikesyk;gsvikesyka;svikesykan;vikesykank;ikesykankl;kesykankld;esykanklds; sykankldsk;ykankldskk;kankldskki;ankldskkit;nkldskkitr;kldskkitre;ldskkitre n;dskkitrene;skkitrenet;kkitrenett;kitrenettl;itrenettle;trenettley;renettl eys;enettleyse;nettleysem;ettleysemt;ttleysemtd;tleysemtds;leysemtdss;eysem tdssn;ysemtdssna;semtdssnat;emtdssnatk;mtdssnatka;tdssnatkav;dssnatkave;ssn atkavet;snatkavetl;natkavetlk;atkavetlkn;tkavetlkng;kavetlkngi;avetlkngik;v etlkngikl;etlkngikle;tlkngikleg;lkngiklegs;kngiklegsl;ngiklegslv;giklegslvg ;iklegslvgg;klegslvggk;legslvggkt;egslvggktt;gslvggkttv;slvggkttvk;lvggkttv kl;vggkttvklt;ggkttvklte;gkttvklteg;kttvkltegt;ttvkltegti;tvkltegtit;vklteg titl;kltegtitlt;ltegtitltr;tegtitltre;egtitltrei;gtitltreie;titltreieq;itlt reieqd;tltreieqdg;ltreieqdgk;treieqdgkv;reieqdgkvk;eieqdgkvki;ieqdgkvkiy;eq dgkvkiyl;qdgkvkiyln;dgkvkiylnd;gkvkiylndt;kvkiylndtt;vkiylndtts;kiylndttsg; iylndttsgs;ylndttsgst;lndttsgstk;ndttsgstkk;dttsgstkkt;ttsgstkkta;tsgstkkta t;sgstkktatw;gstkktatwn;stkktatwne;tkktatwnet;kktatwnett;ktatwnettn;tatwnet tnt;atwnettntl;twnettntlt;wnettntlti;nettntltis;ettntltisa;ttntltisad;tntlt isads;ntltisadsk;tltisadskk;ltisadskkt;tisadskktk;isadskktkd;sadskktkdf;ads kktkdfv;dskktkdfvf;skktkdfvfl;kktkdfvflt;ktkdfvfltd;tkdfvfltdg;kdfvfltdgt;d fvfltdgti;fvfltdgtit;vfltdgtitv;fltdgtitvq;ltdgtitvqa;tdgtitvqay;dgtitvqayd ;gtitvqaydt;titvqaydta;itvqaydtag;tvqaydtagt;vqaydtagtk;qaydtagtkl;aydtagtk le;ydtagtkleg;dtagtklegn;tagtklegns;agtklegnss;gtklegnsse;tklegnssei;klegns seik;legnsseikd;egnsseikdl;gnsseikdla;nsseikdlaa;sseikdlaal;seikdlaalk;eikd laalka;ikdlaalkaa;kdlaalkaal;dlaalkaalk;

11 mers:
mkqyllvfalv;kqyllvfalvl;qyllvfalvla;yllvfalvlal;llvfalvlali;lvfalvlalia;vfa lvlaliac;falvlaliacs;alvlaliacsq;lvlaliacsqk;vlaliacsqkg;laliacsqkgt;aliacs qkgte;liacsqkgtep;iacsqkgtepk;acsqkgtepks;csqkgtepkst;sqkgtepksts;qkgtepkst sq;kgtepkstsqd;gtepkstsqdh;tepkstsqdhn;epkstsqdhnd;pkstsqdhndq;kstsqdhndqe; stsqdhndqei;tsqdhndqeii;sqdhndqeiin;qdhndqeiins;dhndqeiinsd;hndqeiinsdn;ndq eiinsdnt;dqeiinsdntp;qeiinsdntpk;eiinsdntpkd;iinsdntpkds;insdntpkdsk;nsdntp kdskk;sdntpkdskkd;dntpkdskkdl;ntpkdskkdlt;tpkdskkdltv;pkdskkdltvl;kdskkdltv la;dskkdltvlae;skkdltvlaee;kkdltvlaeen;kdltvlaeens;dltvlaeensv;ltvlaeensvp; tvlaeensvpl;vlaeensvplf;laeensvplfn;aeensvplfng;eensvplfngn;ensvplfngnk;nsv plfngnki;svplfngnkif;vplfngnkifv;plfngnkifvs;lfngnkifvsk;fngnkifvske;ngnkif vskek;gnkifvskekn;nkifvskekns;kifvskeknsa;ifvskeknsag;fvskeknsagk;vskeknsag ky;skeknsagkye;keknsagkyel;eknsagkyelr;knsagkyelra;nsagkyelrat;sagkyelratv;

Fig. 39 continued agkyelratvd;gkyelratvdt;kyelratvdtv;yelratvdtve;elratvdtvel;lratvdtvelk;rat vdtvelkg;atvdtvelkgv;tvdtvelkgvs;vdtvelkgvsd;dtvelkgvsdk;tvelkgvsdkn;velkgv sdknn;elkgvsdknng;lkgvsdknngs;kgvsdknngsg;gvsdknngsgk;vsdknngsgkl;sdknngsgk le;dknngsgkleg;knngsgklegt;nngsgklegtk;ngsgklegtka;gsgklegtkad;sgklegtkadk; gklegtkadkt;klegtkadktk;legtkadktkv;egtkadktkva;gtkadktkvam;tkadktkvamt;kad ktkvamti;adktkvamtia;dktkvamtiad;ktkvamtiadd;tkvamtiaddl;kvamtiaddln;vamtia ddlnt;amtiaddlnti;mtiaddlntit;tiaddlntitv;iaddlntitve;addlntitvet;ddlntitve ty;dlntitvetyd;lntitvetyda;ntitvetydas;titvetydasn;itvetydasnk;tvetydasnkk; vetydasnkkt;etydasnkktg;tydasnkktgs;ydasnkktgse;dasnkktgsev;asnkktgsevv;snk ktgsevvk;nkktgsevvkk;kktgsevvkkq;ktgsevvkkqg;tgsevvkkqgs;gsevvkkqgsv;sevvkk qgsvi;evvkkqgsvik;vvkkqgsvike;vkkqgsvikes;kkqgsvikesy;kqgsvikesyk;qgsvikesy ka;gsvikesykan;svikesykank;vikesykankl;ikesykankld;kesykanklds;esykankldsk; sykankldskk;ykankldskki;kankldskkit;ankldskkitr;nkldskkitre;kldskkitren;lds kkitrene;dskkitrenet;skkitrenett;kkitrenettl;kitrenettle;itrenettley;trenet tleys;renettleyse;enettleysem;nettleysemt;ettleysemtd;ttleysemtds;tleysemtd ss;leysemtdssn;eysemtdssna;ysemtdssnat;semtdssnatk;emtdssnatka;mtdssnatkav; tdssnatkave;dssnatkavet;ssnatkavetl;snatkavetlk;natkavetlkn;atkavetlkng;tka vetlkngi;kavetlkngik;avetlkngikl;vetlkngikle;etlkngikleg;tlkngiklegs;lkngik legsl;kngiklegslv;ngiklegslvg;giklegslvgg;iklegslvggk;klegslvggkt;legslvggk tt;egslvggkttv;gslvggkttvk;slvggkttvkl;lvggkttvklt;vggkttvklte;ggkttvklteg; gkttvkltegt;kttvkltegti;ttvkltegtit;tvkltegtitl;vkltegtitlt;kltegtitltr;lte gtitltre;tegtitltrei;egtitltreie;gtitltreieq;titltreieqd;itltreieqdg;tltrei eqdgk;ltreieqdgkv;treieqdgkvk;reieqdgkvki;eieqdgkvkiy;ieqdgkvkiyl;eqdgkvkiy ln;qdgkvkiylnd;dgkvkiylndt;gkvkiylndtt;kvkiylndtts;vkiylndttsg;kiylndttsgs; iylndttsgst;ylndttsgstk;lndttsgstkk;ndttsgstkkt;dttsgstkkta;ttsgstkktat;tsg stkktatw;sgstkktatwn;gstkktatwne;stkktatwnet;tkktatwnett;kktatwnettn;ktatwn ettnt;tatwnettntl;atwnettntlt;twnettntlti;wnettntltis;nettntltisa;ettntltis ad;ttntltisads;tntltisadsk;ntltisadskk;tltisadskkt;ltisadskktk;tisadskktkd; isadskktkdf;sadskktkdfv;adskktkdfvf;dskktkdfvfl;skktkdfvflt;kktkdfvfltd;ktk dfvfltdg;tkdfvfltdgt;kdfvfltdgti;dfvfltdgtit;fvfltdgtitv;vfltdgtitvq;fltdgt itvqa;ltdgtitvqay;tdgtitvqayd;dgtitvqaydt;gtitvqaydta;titvqaydtag;itvqaydta gt;tvqaydtagtk;vqaydtagtkl;qaydtagtkle;aydtagtkleg;ydtagtklegn;dtagtklegns; tagtklegnss;agtklegnsse;gtklegnssei;tklegnsseik;klegnsseikd;legnsseikdl;egn sseikdla;gnsseikdlaa;nsseikdlaal;sseikdlaalk;seikdlaalka;eikdlaalkaa;ikdlaa lkaal;kdlaalkaalk;

13 mers:
mkqyllvfalvla;kqyllvfalvlal;qyllvfalvlali;yllvfalvlalia;llvfalvlaliac;lvfal vlaliacs;vfalvlaliacsq;falvlaliacsqk;alvlaliacsqkg;lvlaliacsqkgt;vlaliacsqk gte;laliacsqkgtep;aliacsqkgtepk;liacsqkgtepks;iacsqkgtepkst;acsqkgtepksts;c sqkgtepkstsq;sqkgtepkstsqd;qkgtepkstsqdh;kgtepkstsqdhn;gtepkstsqdhnd;tepkst sqdhndq;epkstsqdhndqe;pkstsqdhndqei;kstsqdhndqeii;stsqdhndqeiin;tsqdhndqeii ns;sqdhndqeiinsd;qdhndqeiinsdn;dhndqeiinsdnt;hndqeiinsdntp;ndqeiinsdntpk;dq eiinsdntpkd;qeiinsdntpkds;eiinsdntpkdsk;iinsdntpkdskk;insdntpkdskkd;nsdntpk dskkdl;sdntpkdskkdlt;dntpkdskkdltv;ntpkdskkdltvl;tpkdskkdltvla;pkdskkdltvla e;kdskkdltvlaee;dskkdltvlaeen;skkdltvlaeens;kkdltvlaeensv;kdltvlaeensvp;dlt vlaeensvpl;ltvlaeensvplf;tvlaeensvplfn;vlaeensvplfng;laeensvplfngn;aeensvpl fngnk;eensvplfngnki;ensvplfngnkif;nsvplfngnkifv;svplfngnkifvs;vplfngnkifvsk ;plfngnkifvske;lfngnkifvskek;fngnkifvskekn;ngnkifvskekns;gnkifvskeknsa;nkif vskeknsag;kifvskeknsagk;ifvskeknsagky;fvskeknsagkye;vskeknsagkyel;skeknsagk yelr;keknsagkyelra;eknsagkyelrat;knsagkyelratv;nsagkyelratvd;sagkyelratvdt; agkyelratvdtv;gkyelratvdtve;kyelratvdtvel;yelratvdtvelk;elratvdtvelkg;lratv dtvelkgv;ratvdtvelkgvs;atvdtvelkgvsd;tvdtvelkgvsdk;vdtvelkgvsdkn;dtvelkgvsd knn;tvelkgvsdknng;velkgvsdknngs;elkgvsdknngsg;lkgvsdknngsgk;kgvsdknngsgkl;g vsdknngsgkle;vsdknngsgkleg;sdknngsgklegt;dknngsgklegtk;knngsgklegtka;nngsgk

Fig. 39 continued legtkad;ngsgklegtkadk;gsgklegtkadkt;sgklegtkadktk;gklegtkadktkv;klegtkadktk
va;legtkadktkvam;egtkadktkvamt;gtkadktkvamti;tkadktkvamtia;kadktkvamtiad;ad
ktkvamtiadd;dktkvamtiaddl;ktkvamtiaddln;tkvamtiaddlnt;kvamtiaddlnti;vamtiad dlntit;amtiaddlntitv;mtiaddlntitve;tiaddlntitvet;iaddlntitvety;addlntitvety d;ddlntitvetyda;dlntitvetydas;lntitvetydasn;ntitvetydasnk;titvetydasnkk;itv etydasnkkt;tvetydasnkktg;vetydasnkktgs;etydasnkktgse;tydasnkktgsev;ydasnkkt gsevv;dasnkktgsevvk;asnkktgsevvkk;snkktgsevvkkq;nkktgsevvkkqg;kktgsevvkkqgs ;ktgsevvkkqgsv;tgsevvkkqgsvi;gsevvkkqgsvik;sevvkkqgsvike;evvkkqgsvikes;vvkk qgsvikesy;vkkqgsvikesyk;kkqgsvikesyka;kqgsvikesykan;qgsvikesykank;gsvikesyk ankl;svikesykankld;vikesykanklds;ikesykankldsk;kesykankldskk;esykankldskki; sykankldskkit;ykankldskkitr;kankldskkitre;ankldskkitren;nkldskkitrene;kldsk kitrenet;ldskkitrenett;dskkitrenettl;skkitrenettle;kkitrenettley;kitrenettl eys;itrenettleyse;trenettleysem;renettleysemt;enettleysemtd;nettleysemtds;e ttleysemtdss;ttleysemtdssn;tleysemtdssna;leysemtdssnat;eysemtdssnatk;ysemtd ssnatka;semtdssnatkav;emtdssnatkave;mtdssnatkavet;tdssnatkavetl;dssnatkavet lk;ssnatkavetlkn;snatkavetlkng;natkavetlkngi;atkavetlkngik;tkavetlkngikl;ka vetlkngikle;avetlkngikleg;vetlkngiklegs;etlkngiklegsl;tlkngiklegslv;lkngikl egslvg;kngiklegslvgg;ngiklegslvggk;giklegslvggkt;iklegslvggktt;klegslvggktt v;legslvggkttvk;egslvggkttvkl;gslvggkttvklt;slvggkttvklte;lvggkttvklteg;vgg kttvkltegt;ggkttvkltegti;gkttvkltegtit;kttvkltegtitl;ttvkltegtitlt;tvkltegt itltr;vkltegtitltre;kltegtitltrei;ltegtitltreie;tegtitltreieq;egtitltreieqd ;gtitltreieqdg;titltreieqdgk;itltreieqdgkv;tltreieqdgkvk;ltreieqdgkvki;trei eqdgkvkiy;reieqdgkvkiyl;eieqdgkvkiyln;ieqdgkvkiylnd;eqdgkvkiylndt;qdgkvkiyl ndtt;dgkvkiylndtts;gkvkiylndttsg;kvkiylndttsgs;vkiylndttsgst;kiylndttsgstk; iylndttsgstkk;ylndttsgstkkt;lndttsgstkkta;ndttsgstkktat;dttsgstkktatw;ttsgs tkktatwn;tsgstkktatwne;sgstkktatwnet;gstkktatwnett;stkktatwnettn;tkktatwnet tnt;kktatwnettntl;ktatwnettntlt;tatwnettntlti;atwnettntltis;twnettntltisa;w nettntltisad;nettntltisads;ettntltisadsk;ttntltisadskk;tntltisadskkt;ntltis adskktk;tltisadskktkd;ltisadskktkdf;tisadskktkdfv;isadskktkdfvf;sadskktkdfv fl;adskktkdfvflt;dskktkdfvfltd;skktkdfvfltdg;kktkdfvfltdgt;ktkdfvfltdgti;tk dfvfltdgtit;kdfvfltdgtitv;dfvfltdgtitvq;fvfltdgtitvqa;vfltdgtitvqay;fltdgti tvqayd;ltdgtitvqaydt;tdgtitvqaydta;dgtitvqaydtag;gtitvqaydtagt;titvqaydtagt k;itvqaydtagtkl;tvqaydtagtkle;vqaydtagtkleg;qaydtagtklegn;aydtagtklegns;ydt agtklegnss;dtagtklegnsse;tagtklegnssei;agtklegnsseik;gtklegnsseikd;tklegnss eikdl;klegnsseikdla;legnsseikdlaa;egnsseikdlaal;gnsseikdlaalk;nsseikdlaalka ;sseikdlaalkaa;seikdlaalkaal;eikdlaalkaalk;

14 mers:
mkqyllvfalvlal;kqyllvfalvlali;qyllvfalvlalia;yllvfalvlaliac;llvfalvlaliacs; lvfalvlaliacsq;vfalvlaliacsqk;falvlaliacsqkg;alvlaliacsqkgt;lvlaliacsqkgte; vlaliacsqkgtep;laliacsqkgtepk;aliacsqkgtepks;liacsqkgtepkst;iacsqkgtepksts; acsqkgtepkstsq;csqkgtepkstsqd;sqkgtepkstsqdh;qkgtepkstsqdhn;kgtepkstsqdhnd; gtepkstsqdhndq;tepkstsqdhndqe;epkstsqdhndqei;pkstsqdhndqeii;kstsqdhndqeiin; stsqdhndqeiins;tsqdhndqeiinsd;sqdhndqeiinsdn;qdhndqeiinsdnt;dhndqeiinsdntp; hndqeiinsdntpk;ndqeiinsdntpkd;dqeiinsdntpkds;qeiinsdntpkdsk;eiinsdntpkdskk; iinsdntpkdskkd;insdntpkdskkdl;nsdntpkdskkdlt;sdntpkdskkdltv;dntpkdskkdltvl; ntpkdskkdltvla;tpkdskkdltvlae;pkdskkdltvlaee;kdskkdltvlaeen;dskkdltvlaeens; skkdltvlaeensv;kkdltvlaeensvp;kdltvlaeensvpl;dltvlaeensvplf;ltvlaeensvplfn; tvlaeensvplfng;vlaeensvplfngn;laeensvplfngnk;aeensvplfngnki;eensvplfngnkif; ensvplfngnkifv;nsvplfngnkifvs;svplfngnkifvsk;vplfngnkifvske;plfngnkifvskek; lfngnkifvskekn;fngnkifvskekns;ngnkifvskeknsa;gnkifvskeknsag;nkifvskeknsagk; kifvskeknsagky;ifvskeknsagkye;fvskeknsagkyel;vskeknsagkyelr;skeknsagkyelra; keknsagkyelrat;eknsagkyelratv;knsagkyelratvd;nsagkyelratvdt;sagkyelratvdtv; agkyelratvdtve;gkyelratvdtvel;kyelratvdtvelk;yelratvdtvelkg;elratvdtvelkgv; lratvdtvelkgvs;ratvdtvelkgvsd;atvdtvelkgvsdk;tvdtvelkgvsdkn;vdtvelkgvsdknn;

Fig. 39 continued dtvelkgvsdknng;tvelkgvsdknngs;velkgvsdknngsg;elkgvsdknngsgk;lkgvsdknngsgkl;
kgvsdknngsgkle;gvsdknngsgkleg;vsdknngsgklegt;sdknngsgklegtk;dknngsgklegtka;
knngsgklegtkad;nngsgklegtkadk;ngsgklegtkadkt;gsgklegtkadktk;sgklegtkadktkv;
gklegtkadktkva;klegtkadktkvam;legtkadktkvamt;egtkadktkvamti;gtkadktkvamtia;
tkadktkvamtiad;kadktkvamtiadd;adktkvamtiaddl;dktkvamtiaddln;ktkvamtiaddlnt;
tkvamtiaddlnti;kvamtiaddlntit;vamtiaddlntitv;amtiaddlntitve;mtiaddlntitvet;
tiaddlntitvety;iaddlntitvetyd;addlntitvetyda;ddlntitvetydas;dlntitvetydasn;
lntitvetydasnk;ntitvetydasnkk;titvetydasnkkt;itvetydasnkktg;tvetydasnkktgs;
vetydasnkktgse;etydasnkktgsev;tydasnkktgsevv;ydasnkktgsevvk;dasnkktgsevvkk;
asnkktgsevvkkq;snkktgsevvkkqg;nkktgsevvkkqgs;kktgsevvkkqgsv;ktgsevvkkqgsvi;
tgsevvkkqgsvik;gsevvkkqgsvike;sevvkkqgsvikes;evvkkqgsvikesy;vvkkqgsvikesyk;
vkkqgsvikesyka;kkqgsvikesykan;kqgsvikesykank;qgsvikesykankl;gsvikesykankld;
svikesykanklds;vikesykankldsk;ikesykankldskk;kesykankldskki;esykankldskkit;
sykankldskkitr;ykankldskkitre;kankldskkitren;ankldskkitrene;nkldskkitrenet;
kldskkitrenett;ldskkitrenettl;dskkitrenettle;skkitrenettley;kkitrenettleys;
kitrenettleyse;itrenettleysem;trenettleysemt;renettleysemtd;enettleysemtds;
nettleysemtdss;ettleysemtdssn;ttleysemtdssna;tleysemtdssnat;leysemtdssnatk;
eysemtdssnatka;ysemtdssnatkav;semtdssnatkave;emtdssnatkavet;mtdssnatkavetl;
tdssnatkavetlk;dssnatkavetlkn;ssnatkavetlkng;snatkavetlkngi;natkavetlkngik;
atkavetlkngikl;tkavetlkngikle;kavetlkngikleg;avetlkngiklegs;vetlkngiklegsl;
etlkngiklegslv;tlkngiklegslvg;lkngiklegslvgg;kngiklegslvggk;ngiklegslvggkt;
giklegslvggktt;iklegslvggkttv;klegslvggkttvk;legslvggkttvkl;egslvggkttvklt;
gslvggkttvklte;slvggkttvklteg;lvggkttvkltegt;vggkttvkltegti;ggkttvkltegtit;
gkttvkltegtitl;kttvkltegtitlt;ttvkltegtitltr;tvkltegtitltre;vkltegtitltrei;
kltegtitltreie;ltegtitltreieq;tegtitltreieqd;egtitltreieqdg;gtitltreieqdgk;
titltreieqdgkv;itltreieqdgkvk;tltreieqdgkvki;ltreieqdgkvkiy;treieqdgkvkiyl;
reieqdgkvkiyln;eieqdgkvkiylnd;ieqdgkvkiylndt;eqdgkvkiylndtt;qdgkvkiylndtts;
dgkvkiylndttsg;gkvkiylndttsgs;kvkiylndttsgst;vkiylndttsgstk;kiylndttsgstkk;
iylndttsgstkkt;ylndttsgstkkta;lndttsgstkktat;ndttsgstkktatw;dttsgstkktatwn;
ttsgstkktatwne;tsgstkktatwnet;sgstkktatwnett;gstkktatwnettn;stkktatwnettnt;
tkktatwnettntl;kktatwnettntlt;ktatwnettntlti;tatwnettntltis;atwnettntltisa;
twnettntltisad;wnettntltisads;nettntltisadsk;ettntltisadskk;ttntltisadskkt;
tntltisadskktk;ntltisadskktkd;tltisadskktkdf;ltisadskktkdfv;tisadskktkdfvf;
isadskktkdfvfl;sadskktkdfvflt;adskktkdfvfltd;dskktkdfvfltdg;skktkdfvfltdgt;
kktkdfvfltdgti;ktkdfvfltdgtit;tkdfvfltdgtitv;kdfvfltdgtitvq;dfvfltdgtitvqa;
fvfltdgtitvqay;vfltdgtitvqayd;fltdgtitvqaydt;ltdgtitvqaydta;tdgtitvqaydtag;
dgtitvqaydtagt;gtitvqaydtagtk;titvqaydtagtkl;itvqaydtagtkle;tvqaydtagtkleg;
vqaydtagtklegn;qaydtagtklegns;aydtagtklegnss;ydtagtklegnsse;dtagtklegnssei;
tagtklegnsseik;agtklegnsseikd;gtklegnsseikdl;tklegnsseikdla;klegnsseikdlaa;
legnsseikdlaal;egnsseikdlaalk;gnsseikdlaalka;nsseikdlaalkaa;sseikdlaalkaal;
seikdlaalkaalk;

15 mers:
mkqyllvfalvlali;kqyllvfalvlalia;qyllvfalvlaliac;yllvfalvlaliacs;llvfalvlali
acsq;lvfalvlaliacsqk;vfalvlaliacsqkg;falvlaliacsqkgt;alvlaliacsqkgte;lvlali
acsqkgtep;vlaliacsqkgtepk;laliacsqkgtepks;aliacsqkgtepkst;liacsqkgtepksts;i
acsqkgtepkstsq;acsqkgtepkstsqd;csqkgtepkstsqdh;sqkgtepkstsqdhn;qkgtepkstsqd
hnd;kgtepkstsqdhndq;gtepkstsqdhndqe;tepkstsqdhndqei;epkstsqdhndqeii;pkstsqd
hndqeiin;kstsqdhndqeiins;stsqdhndqeiinsd;tsqdhndqeiinsdn;sqdhndqeiinsdnt;qd
hndqeiinsdntp;dhndqeiinsdntpk;hndqeiinsdntpkd;ndqeiinsdntpkds;dqeiinsdntpkd
sk;qeiinsdntpkdskk;eiinsdntpkdskkd;iinsdntpkdskkdl;insdntpkdskkdlt;nsdntpkd
skkdltv;sdntpkdskkdltvl;dntpkdskkdltvla;ntpkdskkdltvlae;tpkdskkdltvlaee;pkd
skkdltvlaeen;kdskkdltvlaeens;dskkdltvlaeensv;skkdltvlaeensvp;kkdltvlaeensvp
l;kdltvlaeensvplf;dltvlaeensvplfn;ltvlaeensvplfng;tvlaeensvplfngn;vlaeensvp
lfngnk;laeensvplfngnki;aeensvplfngnkif;eensvplfngnkifv;ensvplfngnkifvs;nsvp

Fig. 39 continued lfngnkifvsk;svplfngnkifvske;vplfngnkifvskek;plfngnkifvskekn;lfngnkifvskekns
;fngnkifvskeknsa;ngnkifvskeknsag;gnkifvskeknsagk;nkifvskeknsagky;kifvskekns
agkye;ifvskeknsagkyel;fvskeknsagkyelr;vskeknsagkyelra;skeknsagkyelrat;kekns
agkyelratv;eknsagkyelratvd;knsagkyelratvdt;nsagkyelratvdtv;sagkyelratvdtve;
agkyelratvdtvel;gkyelratvdtvelk;kyelratvdtvelkg;yelratvdtvelkgv;elratvdtvel
kgvs;lratvdtvelkgvs qdhnd; qkgtepkstsqdhndq; kgtepkstsqdhndqe; gtepkstsqdhndqei; tepkstsqdhndqeii; e
pkstsqdhndqeiin; pkstsqdhndqeiins; kstsqdhndqeiinsd; stsqdhndqeiinsdn; tsqdhndq
eiinsdnt; sqdhndqeiinsdntp; qdhndqeiinsdntpk; dhndqeiinsdntpkd; hndqeiinsdntpkd
s; ndqeiinsdntpkdsk; dqeiinsdntpkdskk; qeiinsdntpkdskkd; eiinsdntpkdskkdl; iinsd
ntpkdskkdlt;insdntpkdskkdltv;nsdntpkdskkdltvl;sdntpkdskkdltvla;dntpkdskkdlt
vlae;ntpkdskkdltvlaee;tpkdskkdltvlaeen;pkdskkdltvlaeens;kdskkdltvlaeensv;ds
kkdltvlaeensvp;skkdltvlaeensvpl;kkdltvlaeensvplf;kdltvlaeensvplfn;dltvlaeen
svplfng;ltvlaeensvplfngn;tvlaeensvplfngnk;vlaeensvplfngnki;laeensvplfngnkif
;aeensvplfngnkifv;eensvplfngnkifvs;ensvplfngnkifvsk;nsvplfngnkifvske;svplfn
gnkifvskek;vplfngnkifvskekn;plfngnkifvskekns;lfngnkifvskeknsa;fngnkifvskekn
sag;ngnkifvskeknsagk;gnkifvskeknsagky;nkifvskeknsagkye;kifvskeknsagkyel;ifv
skeknsagkyelr;fvskeknsagkyelra;vskeknsagkyelrat;skeknsagkyelratv;keknsagkye
lratvd;eknsagkyelratvdt;knsagkyelratvdtv;nsagkyelratvdtve;sagkyelratvdtvel;
agkyelratvdtvelk;gkyelratvdtvelkg;kyelratvdtvelkgv;yelratvdtvelkgvs;elratvd
tvelkgvsd;lratvdtvelkgvsdk;ratvdtvelkgvsdkn;atvdtvelkgvsdknn;tvdtvelkgvsdkn
ng;vdtvelkgvsdknngs;dtvelkgvsdknngsg;tvelkgvsdknngsgk;velkgvsdknngsgkl;elkg
vsdknngsgkle;lkgvsdknngsgkleg;kgvsdknngsgklegt;gvsdknngsgklegtk;vsdknngsgkl
egtka;sdknngsgklegtkad;dknngsgklegtkadk;knngsgklegtkadkt;nngsgklegtkadktk;n
gsgklegtkadktkv;gsgklegtkadktkva;sgklegtkadktkvam;gklegtkadktkvamt;klegtkad
ktkvamti;legtkadktkvamtia;egtkadktkvamtiad;gtkadktkvamtiadd;tkadktkvamtiadd
l;kadktkvamtiaddln;adktkvamtiaddlnt;dktkvamtiaddlnti;ktkvamtiaddlntit;tkvam
tiaddlntitv;kvamtiaddlntitve;vamtiaddlntitvet;amtiaddlntitvety;mtiaddlntitv
etyd;tiaddlntitvetyda;iaddlntitvetydas;addlntitvetydasn;ddlntitvetydasnk;dl
ntitvetydasnkk;lntitvetydasnkkt;ntitvetydasnkktg;titvetydasnkktgs;itvetydas
nkktgse;tvetydasnkktgsev;vetydasnkktgsevv;etydasnkktgsevvk;tydasnkktgsevvkk
;ydasnkktgsevvkkq;dasnkktgsevvkkqg;asnkktgsevvkkqgs;snkktgsevvkkqgsv;nkktgs
evvkkqgsvi;kktgsevvkkqgsvik;ktgsevvkkqgsvike;tgsevvkkqgsvikes;gsevvkkqgsvik
esy;sevvkkqgsvikesyk;evvkkqgsvikesyka;vvkkqgsvikesykan;vkkqgsvikesykank;kkq
gsvikesykankl;kqgsvikesykankld;qgsvikesykanklds;gsvikesykankldsk;svikesykan
kldskk;vikesykankldskki;ikesykankldskkit;kesykankldskkitr;esykankldskkitre;
sykankldskkitren;ykankldskkitrene;kankldskkitrenet;ankldskkitrenett;nkldskk
itrenettl;kldskkitrenettle;ldskkitrenettley;dskkitrenettleys;skkitrenettley
se;kkitrenettleysem;kitrenettleysemt;itrenettleysemtd;trenettleysemtds;rene
ttleysemtdss;enettleysemtdssn;nettleysemtdssna;ettleysemtdssnat;ttleysemtds
snatk;tleysemtdssnatka;leysemtdssnatkav;eysemtdssnatkave;ysemtdssnatkavet;s
emtdssnatkavetl;emtdssnatkavetlk;mtdssnatkavetlkn;tdssnatkavetlkng;dssnatka
vetlkngi;ssnatkavetlkngik;snatkavetlkngikl;natkavetlkngikle;atkavetlkngikle
g;tkavetlkngiklegs;kavetlkngiklegsl;avetlkngiklegslv;vetlkngiklegslvg;etlkn
giklegslvgg;tlkngiklegslvggk;lkngiklegslvggkt;kngiklegslvggktt;ngiklegslvgg
kttv;giklegslvggkttvk;iklegslvggkttvkl;klegslvggkttvklt;legslvggkttvklte;eg
slvggkttvklteg;gslvggkttvkltegt;slvggkttvkltegti;lvggkttvkltegtit;vggkttvkl
tegtitl;ggkttvkltegtitlt;gkttvkltegtitltr;kttvkltegtitltre;ttvkltegtitltrei
;tvkltegtitltreie;vkltegtitltreieq;kltegtitltreieqd;ltegtitltreieqdg;tegtit
ltreieqdgk;egtitltreieqdgkv;gtitltreieqdgkvk;titltreieqdgkvki;itltreieqdgkv
kiy;tltreieqdgkvkiyl;ltreieqdgkvkiyln;treieqdgkvkiylnd;reieqdgkvkiylndt;eie
qdgkvkiylndtt;ieqdgkvkiylndtts;eqdgkvkiylndttsg;qdgkvkiylndttsgs;dgkvkiylnd
ttsgst;gkvkiylndttsgstk;kvkiylndttsgstkk;vkiylndttsgstkkt;kiylndttsgstkkta;
iylndttsgstkktat;ylndttsgstkktatw;lndttsgstkktatwn;ndttsgstkktatwne;dttsgst
kktatwnet;ttsgstkktatwnett;tsgstkktatwnettn;sgstkktatwnettnt;gstkktatwnettn
tl;stkktatwnettntlt;tkktatwnettntlti;kktatwnettntltis;ktatwnettntltisa;tatw
nettntltisad;atwnettntltisads;twnettntltisadsk;wnettntltisadskk;nettntltisa
dskkt;ettntltisadskktk;ttntltisadskktkd;tntltisadskktkdf;ntltisadskktkdfv;t
ltisadskktkdfvf;ltisadskktkdfvfl;tisadskktkdfvflt;isadskktkdfvfltd;sadskktk
dfvfltdg;adskktkdfvfltdgt;dskktkdfvfltdgti;skktkdfvfltdgtit;kktkdfvfltdgtit
v;ktkdfvfltdgtitvq;tkdfvfltdgtitvqa;kdfvfltdgtitvqay;dfvfltdgtitvqayd;fvflt

Fig. 39 continued dgtitvqaydt;vfltdgtitvqaydta;fltdgtitvqaydtag;ltdgtitvqaydtagt;tdgtitvqaydt
agtk;dgtitvqaydtagtkl;gtitvqaydtagtkle;titvqaydtagtkleg;itvqaydtagtklegn;tv
qaydtagtklegns;vqaydtagtklegnss;qaydtagtklegnsse;aydtagtklegnssei;ydtagtkle
gnsseik;dtagtklegnsseikd;tagtklegnsseikdl;agtklegnsseikdla;gtklegnsseikdlaa
;tklegnsseikdlaal;klegnsseikdlaalk;legnsseikdlaalka;egnsseikdlaalkaa;gnssei
kdlaalkaal;nsseikdlaalkaalk;

<NP_045689 outer surface protein B;Protein;Borrelia burgdorferi B31>
Seq ID No 161222-163501

8 mers:
mrlligfa;rlligfal;lligfala;ligfalal;igfalala;gfalalal;falalali;alalalig;lal
aligc;alaligca;laligcaq;aligcaqk;ligcaqkg;igcaqkga;gcaqkgae;caqkgaes;aqkgae
si;qkgaesig;kgaesigs;gaesigsq;aesigsqk;esigsqke;sigsqken;igsqkend;gsqkendl;
sqkendln;qkendlnl;kendlnle;endlnled;ndlnleds;dlnledss;lnledssk;nledsskk;led
sskks;edsskksh;dsskkshq;sskkshqn;skkshqna;kkshqnak;kshqnakq;shqnakqd;hqnakq
dl;qnakqdlp;nakqdlpa;akqdlpav;kqdlpavt;qdlpavte;dlpavted;lpavteds;pavtedsv;
avtedsvs;vtedsvsl;tedsvslf;edsvslfn;dsvslfng;svslfngn;vslfngnk;slfngnki;lfn
gnkif;fngnkifv;ngnkifvs;gnkifvsk;nkifvske;kifvskek;ifvskekn;fvskekns;vskekn
ss;skeknssg;keknssgk;eknssgky;knssgkyd;nssgkydl;ssgkydlr;sgkydlra;gkydlrat;
kydlrati;ydlratid;dlratidq;lratidqv;ratidqve;atidqvel;tidqvelk;idqvelkg;dqv
elkgt;qvelkgts;velkgtsd;elkgtsdk;lkgtsdkn;kgtsdknn;gtsdknng;tsdknngs;sdknng
sg;dknngsgt;knngsgtl;nngsgtle;ngsgtleg;gsgtlegs;sgtlegsk;gtlegskp;tlegskpd;
legskpdk;egskpdks;gskpdksk;skpdkskv;kpdkskvk;pdkskvkl;dkskvklt;kskvkltv;skv
kltvs;kvkltvsa;vkltvsad;kltvsadl;ltvsadln;tvsadlnt;vsadlntv;sadlntvt;adlntv
tl;dlntvtle;lntvtlea;ntvtleaf;tvtleafd;vtleafda;tleafdas;leafdasn;eafdasnq;
afdasnqk;fdasnqki;dasnqkis;asnqkiss;snqkissk;nqkisskv;qkisskvt;kisskvtk;iss
kvtkk;sskvtkkq;skvtkkqg;kvtkkqgs;vtkkqgsi;tkkqgsit;kkqgsitx;kqgsitxe;qgsitx
et;gsitxetl;sitxetlk;itxetlka;txetlkan;xetlkank;etlkankl;tlkankld;lkanklds;
kanklds k;ankldskk;nkldskkl;kldskklt;ldskkltr;dskkltrs;skkltrsn;kkltrsng;klt
rsngt;ltrsngtt;trsngttl;rsngttle;sngttley;ngttleys;gttleysq;ttleysqi;tleysq
it;leysqitd;eysqitda;ysqitdad;sqitdadn;qitdadna;itdadnat;tdadnatk;dadnatka;
adnatkav;dnatkave;natkavet;atkavetl;tkavetlk;kavetlkn;avetlkns;vetlknsi;etl
knsik;tlknsikl;lknsikle;knsikleg;nsiklegs;siklegsl;iklegslv;klegslvg;legslv
gg;egslvggk;gslvggkt;slvggktt;lvggkttv;vggkttve;ggkttvei;gkttveik;kttveike;
ttveikeg;tveikegt;veikegtv;eikegtvt;ikegtvtl;kegtvtlk;egtvtlkr;gtvtlkre;tvt
lkrei;vtlkreie;tlkreiek;lkreiekd;kreiekdg;reiekdgk;eiekdgkv;iekdgkvk;ekdgkv
kv;kdgkvkvf;dgkvkvfl;gkvkvfln;kvkvflnd;vkvflndt;kvflndta;vflndtag;flndtags;
lndtagsn;ndtagsnk;dtagsnkk;tagsnkkt;agsnkktg;gsnkktgk;snkktgkw;nkktgkwe;kkt
gkwed;ktgkweds;tgkwedst;gkwedsts;kwedstst;wedststl;edststlt;dststlti;ststlt
is;tstltisa;stltisad;tltisads;ltisadsk;tisadskk;isadskkt;sadskktk;adskktkd;
dskktkdl;skktkdlv;kktkdlvf;ktkdlvfl;tkdlvflt;kdlvfltd;dlvfltdg;lvfltdgt;vfl
tdgti;fltdgtit;ltdgtitv;tdgtitvq;dgtitvqq;gtitvqqy;titvqqyn;itvqqynt;tvqqyn
ta;vqqyntag;qqyntagt;qyntagts;yntagtsl;ntagtsle;tagtsleg;agtslegs;gtslegsa;
tslegsas;slegsase;legsasei;egsaseik;gsaseikn;saseiknl;aseiknls;seiknlse;eik
nlsei;iknlselk;knlselkn;nlselkna;lselknal;selknalk;

9 mers:
mrlligfal;rlligfala;lligfalal;ligfalala;igfalalal;gfalalali;falalalig;alala
ligc;lalaligca;alaligcaq;laligcaqk;aligcaqkg;ligcaqkga;igcaqkgae;gcaqkgaes;
caqkgaesi;aqkgaesig;qkgaesigs;kgaesigsq;gaesigsqk;aesigsqke;esigsqken;sigsq
kend;igsqkendl;gsqkendln;sqkendlnl;qkendlnle;kendlnled;endlnleds;ndlnledss;
dlnledssk;lnledsskk;nledsskks;ledsskksh;edsskkshq;dsskkshqn;sskkshqna;skksh
qnak;kkshqnakq;kshqnakqd;shqnakqdl;hqnakqdlp;qnakqdlpa;nakqdlpav;akqdlpavt;

kqdlpavte; qdlpavted; dlpavteds; lpavtedsv; pavtedsvs; avtedsvsl; vtedsvslf; tedsv
slfn; edsvslfng; dsvslfngn; svslfngnk; vslfngnki; slfngnkif; lfngnkifv; fngnkifvs;
ngnkifvsk; gnkifvske; nkifvskek; kifvskekn; ifvskekns; fvskeknss; vskeknssg; skekn
ssgk; keknssgky; eknssgkyd; knssgkydl; nssgkydlr; ssgkydlra; sgkydlrat; gkydlrati;
kydlratid; ydlratidq; dlratidqv; lratidqve; ratidqvel; atidqvelk; tidqvelkg; idqve
lkgt; dqvelkgts; qvelkgtsd; velkgtsdk; elkgtsdkn; lkgtsdknn;kgtsdknng;gtsdknngs;
tsdknngsg;sdknngsgt;dknngsgtl;knngsgtle;nngsgtleg;ngsgtlegs;gsgtlegsk;sgtle
gskp;gtlegskpd;tlegskpdk;legskpdks;egskpdksk;gskpdkskv;skpdkskvk;kpdkskvkl;
pdkskvklt;dkskvkltv;kskvkltvs;skvkltvsa;kvkltvsad;vkltvsadl;kltvsadln;ltvsa
dlnt;tvsadlntv;vsadlntvt;sadlntvtl;adlntvtle;dlntvtlea;lntvtleaf;ntvtleafd;
tvtleafda;vtleafdas;tleafdasn;leafdasnq;eafdasnqk;afdasnqki;fdasnqkis;dasnq
kiss;asnqkissk;snqkisskv;nqkisskvt;qkisskvtk;kisskvtkk;isskvtkkq;sskvtkkqg;
skvtkkqgs;kvtkkqgsi;vtkkqgsit;tkkqgsitx;kkqgsitxe;kqgsitxet;qgsitxetl;gsitx
etlk;sitxetlka;itxetlkan;txetlkank;xetlkankl;etlkankld;tlkanklds;lkankldsk;
kankldskk;ankldskkl;nkldskklt;kldskkltr;ldskkltrs;dskkltrsn;skkltrsng;kkltr
sngt;kltrsngtt;ltrsngttl;trsngttle;rsngttley;sngttleys;ngttleysq;gttleysqi;
ttleysqit;tleysqitd;leysqitda;eysqitdad;ysqitdadn;sqitdadna;qitdadnat;itdad
natk;tdadnatka;dadnatkav;adnatkave;dnatkavet;natkavetl;atkavetlk;tkavetlkn;
kavetlkns;avetlknsi;vetlknsik;etlknsikl;tlknsikle;lknsikleg;knsiklegs;nsikl
egsl;siklegslv;iklegslvg;klegslvgg;legslvggk;egslvggkt;gslvggktt;slvggkttv;
lvggkttve;vggkttvei;ggkttveik;gkttveike;kttveikeg;ttveikegt;tveikegtv;veike
gtvt;eikegtvtl;ikegtvtlk;kegtvtlkr;egtvtlkre;gtvtlkrei;tvtlkreie;vtlkreiek;
tlkreiekd;lkreiekdg;kreiekdgk;reiekdgkv;eiekdgkvk;iekdgkvkv;ekdgkvkvf;kdgkv
kvfl;dgkvkvfln;gkvkvflnd;kvkvflndt;vkvflndta;kvflndtag;vflndtags;flndtagsn;
lndtagsnk;ndtagsnkk;dtagsnkkt;tagsnkktg;agsnkktgk;gsnkktgkw;snkktgkwe;nkktg
kwed;kktgkweds;ktgkwedst;tgkwedsts;gkwedstst;kwedststl;wedststlt;edststlti;
dststltis;ststltisa;tstltisad;stltisads;tltisadsk;ltisadskk;tisadskkt;isads
kktk;sadskktkd;adskktkdl;dskktkdlv;skktkdlvf;kktkdlvfl;ktkdlvflt;tkdlvfltd;
kdlvfltdg;dlvfltdgt;lvfltdgti;vfltdgtit;fltdgtitv;ltdgtitvq;tdgtitvqq;dgtit
vqqy;gtitvqqyn;titvqqynt;itvqqynta;tvqqyntag;vqqyntagt;qqyntagts;qyntagtsl;
yntagtsle;ntagtsleg;tagtslegs;agtslegsa;gtslegsas;tslegsase;slegsasei;legsa
seik;egsaseikn;gsaseiknl;saseiknls;aseiknlse;seiknlsel;eiknlselk;iknlselkn;
knlselkna;nlselknal;lselknalk;

10 mers:
mrlligfala;rlligfalal;lligfalala;ligfalalal;igfalalali;gfalalalig;falalalig
c;alalaligca;lalaligcaq;alaligcaqk;laligcaqkg;aligcaqkga;ligcaqkgae;igcaqkg
aes;gcaqkgaesi;caqkgaesig;aqkgaesigs;qkgaesigsq;kgaesigsqk;gaesigsqke;aesig
sqken;esigsqkend;sigsqkendl;igsqkendln;gsqkendlnl;sqkendlnle;qkendlnled;ken
dlnleds;endlnledss;ndlnledssk;dlnledsskk;lnledsskks;nledsskksh;ledsskkshq;e
dsskkshqn;dsskkshqna;sskkshqnak;skkshqnakq;kkshqnakqd;kshqnakqdl;shqnakqdlp
;hqnakqdlpa;qnakqdlpav;nakqdlpavt;akqdlpavte;kqdlpavted;qdlpavteds;dlpavted
sv;lpavtedsvs;pavtedsvsl;avtedsvslf;vtedsvslfn;tedsvslfng;edsvslfngn;dsvslf
ngnk;svslfngnki;vslfngnkif;slfngnkifv;lfngnkifvs;fngnkifvsk;ngnkifvske;gnki
fvskek;nkifvskekn;kifvskekns;ifvskeknss;fvskeknssg;vskeknssgk;skeknssgky;ke
knssgkyd;eknssgkydl;knssgkydlr;nssgkydlra;ssgkydlrat;sgkydlrati;gkydlratid;
kydlratidq;ydlratidqv;dlratidqve;lratidqvel;ratidqvelk;atidqvelkg;tidqvelkg
t;idqvelkgts;dqvelkgtsd;qvelkgtsdk;velkgtsdkn;elkgtsdknn;lkgtsdknng;kgtsdkn
ngs;gtsdknngsg;tsdknngsgt;sdknngsgtl;dknngsgtle;knngsgtleg;nngsgtlegs;ngsgt
legsk;gsgtlegskp;sgtlegskpd;gtlegskpdk;tlegskpdks;legskpdksk;egskpdkskv;gsk
pdkskvk;skpdkskvkl;kpdkskvklt;pdkskvkltv;dkskvkltvs;kskvkltvsa;skvkltvsad;k
vkltvsadl;vkltvsadln;kltvsadlnt;ltvsadlntv;tvsadlntvt;vsadlntvtl;sadlntvtle
;adlntvtlea;dlntvtleaf;lntvtleafd;ntvtleafda;tvtleafdas;vtleafdasn;tleafdas
nq;leafdasnqk;eafdasnqki;afdasnqkis;fdasnqkiss;dasnqkissk;asnqkisskv;snqkis
skvt;nqkisskvtk;qkisskvtkk;kisskvtkkq;isskvtkkqg;sskvtkkqgs;skvtkkqgsi;kvtk

Fig. 39 continued kqgsit;vtkkqgsitx;tkkqgsitxe;kkqgsitxet;kqgsitxetl;qgsitxetlk;gsitxetlka;si
txetlkan;itxetlkank;txetlkankl;xetlkankld;etlkanklds;tlkankldsk;lkankldskk; kankldskkl;ankldskklt;nkldskkltr;kldskkltrs;ldskkltrsn;dskkltrsng;skkltrsng t;kkltrsngtt;kltrsngttl;ltrsngttle;trsngttley;rsngttleys;sngttleysq;ngttley sqi;gttleysqit;ttleysqitd;tleysqitda;leysqitdad;eysqitdadn;ysqitdadna;sqitd adnat;qitdadnatk;itdadnatka;tdadnatkav;dadnatkave;adnatkavet;dnatkavetl;nat kavetlk;atkavetlkn;tkavetlkns;kavetlknsi;avetlknsik;vetlknsikl;etlknsikle;t lknsikleg;lknsiklegs;knsiklegsl;nsiklegslv;siklegslvg;iklegslvgg;klegslvggk ;legslvggkt;egslvggktt;gslvggkttv;slvggkttve;lvggkttvei;vggkttveik;ggkttvei ke;gkttveikeg;kttveikegt;ttveikegtv;tveikegtvt;veikegtvtl;eikegtvtlk;ikegtv tlkr;kegtvtlkre;egtvtlkrei;gtvtlkreie;tvtlkreiek;vtlkreiekd;tlkreiekdg;lkre iekdgk;kreiekdgkv;reiekdgkvk;eiekdgkvkv;iekdgkvkvf;ekdgkvkvfl;kdgkvkvfln;dg kvkvflnd;gkvkvflndt;kvkvflndta;vkvflndtag;kvflndtags;vflndtagsn;flndtagsnk; lndtagsnkk;ndtagsnkkt;dtagsnkktg;tagsnkktgk;agsnkktgkw;gsnkktgkwe;snkktgkwe d;nkktgkweds;kktgkwedst;ktgkwedsts;tgkwedstst;gkwedststl;kwedststlt;wedstst lti;edststltis;dststltisa;ststltisad;tstltisads;stltisadsk;tltisadskk;ltisa dskkt;tisadskktk;isadskktkd;sadskktkdl;adskktkdlv;dskktkdlvf;skktkdlvfl;kkt kdlvflt;ktkdlvfltd;tkdlvfltdg;kdlvfltdgt;dlvfltdgti;lvfltdgtit;vfltdgtitv;f ltdgtitvq;ltdgtitvqq;tdgtitvqqy;dgtitvqqyn;gtitvqqynt;titvqqynta;itvqqyntag ;tvqqyntagt;vqqyntagts;qqyntagtsl;qyntagtsle;yntagtsleg;ntagtslegs;tagtsleg sa;agtslegsas;gtslegsase;tslegsasei;slegsaseik;legsaseikn;egsaseiknl;gsasei knls;saseiknlse;aseiknlsel;seiknlselk;eiknlselkn;iknlselkna;knlselknal;nlse lknalk;

11 mers:
mrlligfalal;rlligfalala;lligfalalal;ligfalalali;igfalalalig;gfalalaligc;fal alaligca;alalaligcaq;lalaligcaqk;alaligcaqkg;laligcaqkga;aligcaqkgae;ligcaq kgaes;igcaqkgaesi;gcaqkgaesig;caqkgaesigs;aqkgaesigsq;qkgaesigsqk;kgaesigsq ke;gaesigsqken;aesigsqkend;esigsqkendl;sigsqkendln;igsqkendlnl;gsqkendlnle; sqkendlnled;qkendlnleds;kendlnledss;endlnledssk;ndlnledsskk;dlnledsskks;lnl edsskksh;nledsskkshq;ledsskkshqn;edsskkshqna;dsskkshqnak;sskkshqnakq;skkshq nakqd;kkshqnakqdl;kshqnakqdlp;shqnakqdlpa;hqnakqdlpav;qnakqdlpavt;nakqdlpav te;akqdlpavted;kqdlpavteds;qdlpavtedsv;dlpavtedsvs;lpavtedsvsl;pavtedsvslf; avtedsvslfn;vtedsvslfng;tedsvslfngn;edsvslfngnk;dsvslfngnki;svslfngnkif;vsl fngnkifv;slfngnkifvs;lfngnkifvsk;fngnkifvske;ngnkifvskek;gnkifvskekn;nkifvs kekns;kifvskeknss;ifvskeknssg;fvskeknssgk;vskeknssgky;skeknssgkyd;keknssgky dl;eknssgkydlr;knssgkydlra;nssgkydlrat;ssgkydlrati;sgkydlratid;gkydlratidq; kydlratidqv;ydlratidqve;dlratidqvel;lratidqvelk;ratidqvelkg;atidqvelkgt;tid qvelkgts;idqvelkgtsd;dqvelkgtsdk;qvelkgtsdkn;velkgtsdknn;elkgtsdknng;lkgtsd knngs;kgtsdknngsg;gtsdknngsgt;tsdknngsgtl;sdknngsgtle;dknngsgtleg;knngsgtle gs;nngsgtlegsk;ngsgtlegskp;gsgtlegskpd;sgtlegskpdk;gtlegskpdks;tlegskpdksk; legskpdkskv;egskpdkskvk;gskpdkskvkl;skpdkskvklt;kpdkskvkltv;pdkskvkltvs;dks kvkltvsa;kskvkltvsad;skvkltvsadl;kvkltvsadln;vkltvsadlnt;kltvsadlntv;ltvsad lntvt;tvsadlntvtl;vsadlntvtle;sadlntvtlea;adlntvtleaf;dlntvtleafd;lntvtleaf da;ntvtleafdas;tvtleafdasn;vtleafdasnq;tleafdasnqk;leafdasnqki;eafdasnqkis; afdasnqkiss;fdasnqkissk;dasnqkisskv;asnqkisskvt;snqkisskvtk;nqkisskvtkk;qki sskvtkkq;kisskvtkkqg;isskvtkkqgs;sskvtkkqgsi;skvtkkqgsit;kvtkkqgsitx;vtkkqg sitxe;tkkqgsitxet;kkqgsitxetl;kqgsitxetlk;qgsitxetlka;gsitxetlkan;sitxetlka nk;itxetlkankl;txetlkankld;xetlkanklds;etlkankldsk;tlkankldskk;lkankldskkl; kankldskklt;ankldskkltr;nkldskkltrs;kldskkltrsn;ldskkltrsng;dskkltrsngt;skk ltrsngtt;kkltrsngttl;kltrsngttle;ltrsngttley;trsngttleys;rsngttleysq;sngttl eysqi;ngttleysqit;gttleysqitd;ttleysqitda;tleysqitdad;leysqitdadn;eysqitdad na;ysqitdadnat;sqitdadnatk;qitdadnatka;itdadnatkav;tdadnatkave;dadnatkavet; adnatkavetl;dnatkavetlk;natkavetlkn;atkavetlkns;tkavetlknsi;kavetlknsik;ave tlknsikl;vetlknsikle;etlknsikleg;tlknsiklegs;lknsiklegsl;knsiklegslv;nsikle

Fig. 39 continued gslvg;siklegslvgg;iklegslvggk;klegslvggkt;legslvggktt;egslvggkttv;gslvggktt
ve;slvggkttvei;lvggkttveik;vggkttveike;ggkttveikeg;gkttveikegt;kttveikegtv;
ttveikegtvt;tveikegtvtl;veikegtvtlk;eikegtvtlkr;ikegtvtlkre;kegtvtlkrei;egt
vtlkreie;gtvtlkreiek;tvtlkreiekd;vtlkreiekdg;tlkreiekdgk;lkreiekdgkv;kreiek dgkvk;reiekdgkvkv;eiekdgkvkvf;iekdgkvkvfl;ekdgkvkvfln;kdgkvkvflnd;dgkvkvfln dt;gkvkvflndta;kvkvflndtag;vkvflndtags;kvflndtagsn;vflndtagsnk;flndtagsnkk; lndtagsnkkt;ndtagsnkktg;dtagsnkktgk;tagsnkktgkw;agsnkktgkwe;gsnkktgkwed;snk ktgkweds;nkktgkwedst;kktgkwedsts;ktgkwedstst;tgkwedststl;gkwedststlt;kwedst stlti;wedststltis;edststltisa;dststltisad;ststltisads;tstltisadsk;stltisads kk;tltisadskkt;ltisadskktk;tisadskktkd;isadskktkdl;sadskktkdlv;adskktkdlvf; dskktkdlvfl;skktkdlvflt;kktkdlvfltd;ktkdlvfltdg;tkdlvfltdgt;kdlvfltdgti;dlv fltdgtit;lvfltdgtitv;vfltdgtitvq;fltdgtitvqq;ltdgtitvqqy;tdgtitvqqyn;dgtitv qqynt;gtitvqqynta;titvqqyntag;itvqqyntagt;tvqqyntagts;vqqyntagtsl;qqyntagts le;qyntagtsleg;yntagtslegs;ntagtslegsa;tagtslegsas;agtslegsase;gtslegsasei; tslegsaseik;slegsaseikn;legsaseiknl;egsaseiknls;gsaseiknlse;saseiknlsel;ase iknlselk;seiknlselkn;eiknlselkna;iknlselknal;knlselknalk;

13 mers:
mrlligfalalal;rlligfalalali;lligfalalalig;ligfalalaligc;igfalalaligca;gfala laligcaq;falalaligcaqk;alalaligcaqkg;lalaligcaqkga;alaligcaqkgae;laligcaqkg aes;aligcaqkgaesi;ligcaqkgaesig;igcaqkgaesigs;gcaqkgaesigsq;caqkgaesigsqk;a qkgaesigsqke;qkgaesigsqken;kgaesigsqkend;gaesigsqkendl;aesigsqkendln;esigsq kendlnl;sigsqkendlnle;igsqkendlnled;gsqkendlnleds;sqkendlnledss;qkendlnleds sk;kendlnledsskk;endlnledsskks;ndlnledsskksh;dlnledsskkshq;lnledsskkshqn;nl edsskkshqna;ledsskkshqnak;edsskkshqnakq;dsskkshqnakqd;sskkshqnakqdl;skkshqn akqdlp;kkshqnakqdlpa;kshqnakqdlpav;shqnakqdlpavt;hqnakqdlpavte;qnakqdlpavte d;nakqdlpavteds;akqdlpavtedsv;kqdlpavtedsvs;qdlpavtedsvsl;dlpavtedsvslf;lpa vtedsvslfn;pavtedsvslfng;avtedsvslfngn;vtedsvslfngnk;tedsvslfngnki;edsvslfn gnkif;dsvslfngnkifv;svslfngnkifvs;vslfngnkifvsk;slfngnkifvske;lfngnkifvskek ;fngnkifvskekn;ngnkifvskekns;gnkifvskeknss;nkifvskeknssg;kifvskeknssgk;ifvs keknssgky;fvskeknssgkyd;vskeknssgkydl;skeknssgkydlr;keknssgkydlra;eknssgkyd lrat;knssgkydlrati;nssgkydlratid;ssgkydlratidq;sgkydlratidqv;gkydlratidqve; kydlratidqvel;ydlratidqvelk;dlratidqvelkg;lratidqvelkgt;ratidqvelkgts;atidq velkgtsd;tidqvelkgtsdk;idqvelkgtsdkn;dqvelkgtsdknn;qvelkgtsdknng;velkgtsdkn ngs;elkgtsdknngsg;lkgtsdknngsgt;kgtsdknngsgtl;gtsdknngsgtle;tsdknngsgtleg;s dknngsgtlegs;dknngsgtlegsk;knngsgtlegskp;nngsgtlegskpd;ngsgtlegskpdk;gsgtle gskpdks;sgtlegskpdksk;gtlegskpdkskv;tlegskpdkskvk;legskpdkskvkl;egskpdkskvk lt;gskpdkskvkltv;skpdkskvkltvs;kpdkskvkltvsa;pdkskvkltvsad;dkskvkltvsadl;ks kvkltvsadln;skvkltvsadlnt;kvkltvsadlntv;vkltvsadlntvt;kltvsadlntvtl;ltvsadl ntvtle;tvsadlntvtlea;vsadlntvtleaf;sadlntvtleafd;adlntvtleafda;dlntvtleafda s;lntvtleafdasn;ntvtleafdasnq;tvtleafdasnqk;vtleafdasnqki;tleafdasnqkis;lea fdasnqkiss;eafdasnqkissk;afdasnqkisskv;fdasnqkisskvt;dasnqkisskvtk;asnqkiss kvtkk;snqkisskvtkkq;nqkisskvtkkqg;qkisskvtkkqgs;kisskvtkkqgsi;isskvtkkqgsit ;sskvtkkqgsitx;skvtkkqgsitxe;kvtkkqgsitxet;vtkkqgsitxetl;tkkqgsitxetlk;kkqg sitxetlka;kqgsitxetlkan;qgsitxetlkank;gsitxetlkankl;sitxetlkankld;itxetlkan klds;txetlkankldsk;xetlkankldskk;etlkankldskkl;tlkankldskklt;lkankldskkltr; kankldskkltrs;ankldskkltrsn;nkldskkltrsng;kldskkltrsngt;ldskkltrsngtt;dskkl trsngttl;skkltrsngttle;kkltrsngttley;kltrsngttleys;ltrsngttleysq;trsngttley sqi;rsngttleysqit;sngttleysqitd;ngttleysqitda;gttleysqitdad;ttleysqitdadn;t leysqitdadna;leysqitdadnat;eysqitdadnatk;ysqitdadnatka;sqitdadnatkav;qitdad natkave;itdadnatkavet;tdadnatkavetl;dadnatkavetlk;adnatkavetlkn;dnatkavetlk ns;natkavetlknsi;atkavetlknsik;tkavetlknsikl;kavetlknsikle;avetlknsikleg;ve tlknsiklegs;etlknsiklegsl;tlknsiklegslv;lknsiklegslvg;knsiklegslvgg;nsikleg slvggk;siklegslvggkt;iklegslvggktt;klegslvggkttv;legslvggkttve;egslvggkttve i;gslvggkttveik;slvggkttveike;lvggkttveikeg;vggkttveikegt;ggkttveikegtv;gkt

Fig. 39 continued tveikegtvt;kttveikegtvtl;ttveikegtvtlk;tveikegtvtlkr;veikegtvtlkre;eikegtvt
lkrei;ikegtvtlkreie;kegtvtlkreiek;egtvtlkreiekd;gtvtlkreiekdg;tvtlkreiekdgk
;vtlkreiekdgkv;tlkreiekdgkvk;lkreiekdgkvkv;kreiekdgkvkvf;reiekdgkvkvfl;eiek
dgkvkvfln;iekdgkvkvflnd;ekdgkvkvflndt;kdgkvkvflndta;dgkvkvflndtag;gkvkvflnd tags;kvkvflndtagsn;vkvflndtagsnk;kvflndtagsnkk;vflndtagsnkkt;flndtagsnkktg; lndtagsnkktgk;ndtagsnkktgkw;dtagsnkktgkwe;tagsnkktgkwed;agsnkktgkweds;gsnkk tgkwedst;snkktgkwedsts;nkktgkwedstst;kktgkwedststl;ktgkwedststlt;tgkwedstst lti;gkwedststltis;kwedststltisa;wedststltisad;edststltisads;dststltisadsk;s tstltisadskk;tstltisadskkt;stltisadskktk;tltisadskktkd;ltisadskktkdl;tisads kktkdlv;isadskktkdlvf;sadskktkdlvfl;adskktkdlvflt;dskktkdlvfltd;skktkdlvflt dg;kktkdlvfltdgt;ktkdlvfltdgti;tkdlvfltdgtit;kdlvfltdgtitv;dlvfltdgtitvq;lv fltdgtitvqq;vfltdgtitvqqy;fltdgtitvqqyn;ltdgtitvqqynt;tdgtitvqqynta;dgtitvq qyntag;gtitvqqyntagt;titvqqyntagts;itvqqyntagtsl;tvqqyntagtsle;vqqyntagtsle g;qqyntagtslegs;qyntagtslegsa;yntagtslegsas;ntagtslegsase;tagtslegsasei;agt slegsaseik;gtslegsaseikn;tslegsaseiknl;slegsaseiknls;legsaseiknlse;egsaseik nlsel;gsaseiknlselk;saseiknlselkn;aseiknlselkna;seiknlselknal;eiknlselknalk ;

14 mers:
mrlligfalalali;rlligfalalalig;lligfalalaligc;ligfalalaligca;igfalalaligcaq; gfalalaligcaqk;falalaligcaqkg;alalaligcaqkga;lalaligcaqkgae;alaligcaqkgaes; laligcaqkgaesi;aligcaqkgaesig;ligcaqkgaesigs;igcaqkgaesigsq;gcaqkgaesigsqk; caqkgaesigsqke;aqkgaesigsqken;qkgaesigsqkend;kgaesigsqkendl;gaesigsqkendln; aesigsqkendlnl;esigsqkendlnle;sigsqkendlnled;igsqkendlnleds;gsqkendlnledss; sqkendlnledssk;qkendlnledsskk;kendlnledsskks;endlnledsskksh;ndlnledsskkshq; dlnledsskkshqn;lnledsskkshqna;nledsskkshqnak;ledsskkshqnakq;edsskkshqnakqd; dsskkshqnakqdl;sskkshqnakqdlp;skkshqnakqdlpa;kkshqnakqdlpav;kshqnakqdlpavt; shqnakqdlpavte;hqnakqdlpavted;qnakqdlpavteds;nakqdlpavtedsv;akqdlpavtedsvs; kqdlpavtedsvsl;qdlpavtedsvslf;dlpavtedsvslfn;lpavtedsvslfng;pavtedsvslfngn; avtedsvslfngnk;vtedsvslfngnki;tedsvslfngnkif;edsvslfngnkifv;dsvslfngnkifvs; svslfngnkifvsk;vslfngnkifvske;slfngnkifvskek;lfngnkifvskekn;fngnkifvskekns; ngnkifvskeknss;gnkifvskeknssg;nkifvskeknssgk;kifvskeknssgky;ifvskeknssgkyd; fvskeknssgkydl;vskeknssgkydlr;skeknssgkydlra;keknssgkydlrat;eknssgkydlrati; knssgkydlratid;nssgkydlratidq;ssgkydlratidqv;sgkydlratidqve;gkydlratidqvel; kydlratidqvelk;ydlratidqvelkg;dlratidqvelkgt;lratidqvelkgts;ratidqvelkgtsd; atidqvelkgtsdk;tidqvelkgtsdkn;idqvelkgtsdknn;dqvelkgtsdknng;qvelkgtsdknngs; velkgtsdknngsg;elkgtsdknngsgt;lkgtsdknngsgtl;kgtsdknngsgtle;gtsdknngsgtleg; tsdknngsgtlegs;sdknngsgtlegsk;dknngsgtlegskp;knngsgtlegskpd;nngsgtlegskpdk; ngsgtlegskpdks;gsgtlegskpdksk;sgtlegskpdkskv;gtlegskpdkskvk;tlegskpdkskvkl; legskpdkskvklt;egskpdkskvkltv;gskpdkskvkltvs;skpdkskvkltvsa;kpdkskvkltvsad; pdkskvkltvsadl;dkskvkltvsadln;kskvkltvsadlnt;skvkltvsadlntv;kvkltvsadlntvt; vkltvsadlntvtl;kltvsadlntvtle;ltvsadlntvtlea;tvsadlntvtleaf;vsadlntvtleafd; sadlntvtleafda;adlntvtleafdas;dlntvtleafdasn;lntvtleafdasnq;ntvtleafdasnqk; tvtleafdasnqki;vtleafdasnqkis;tleafdasnqkiss;leafdasnqkissk;eafdasnqkisskv; afdasnqkisskvt;fdasnqkisskvtk;dasnqkisskvtkk;asnqkisskvtkkq;snqkisskvtkkqg; nqkisskvtkkqgs;qkisskvtkkqgsi;kisskvtkkqgsit;isskvtkkqgsitx;sskvtkkqgsitxe; skvtkkqgsitxet;kvtkkqgsitxetl;vtkkqgsitxetlk;tkkqgsitxetlka;kkqgsitxetlkan; kqgsitxetlkank;qgsitxetlkankl;gsitxetlkankld;sitxetlkanklds;itxetlkankldsk; txetlkankldskk;xetlkankldskkl;etlkankldskklt;tlkankldskkltr;lkankldskkltrs; kankldskkltrsn;ankldskkltrsng;nkldskkltrsngt;kldskkltrsngtt;ldskkltrsngttl; dskkltrsngttle;skkltrsngttley;kkltrsngttleys;kltrsngttleysq;ltrsngttleysqi; trsngttleysqit;rsngttleysqitd;sngttleysqitda;ngttleysqitdad;gttleysqitdadn; ttleysqitdadna;tleysqitdadnat;leysqitdadnatk;eysqitdadnatka;ysqitdadnatkav; sqitdadnatkave;qitdadnatkavet;itdadnatkavetl;tdadnatkavetlk;dadnatkavetlkn; adnatkavetlkns;dnatkavetlknsi;natkavetlknsik;atkavetlknsikl;tkavetlknsikle;

Fig. 39 continued kavetlknsikleg;avetlknsiklegs;vetlknsiklegsl;etlknsiklegslv;tlknsiklegslvg;
lknsiklegslvgg;knsiklegslvggk;nsiklegslvggkt;siklegslvggktt;iklegslvggkttv;
klegslvggkttve;legslvggkttvei;egslvggkttveik;gslvggkttveike;slvggkttveikeg;
lvggkttveikegt;vggkttveikegtv;ggkttveikegtvt;gkttveikegtvtl;kttveikegtvtlk;
ttveikegtvtlkr;tveikegtvtlkre;veikegtvtlkrei;eikegtvtlkreie;ikegtvtlkreiek;
kegtvtlkreiekd;egtvtlkreiekdg;gtvtlkreiekdgk;tvtlkreiekdgkv;vtlkreiekdgkvk;
tlkreiekdgkvkv;lkreiekdgkvkvf;kreiekdgkvkvfl;reiekdgkvkvfln;eiekdgkvkvflnd;
iekdgkvkvflndt;ekdgkvkvflndta;kdgkvkvflndtag;dgkvkvflndtags;gkvkvflndtagsn;
kvkvflndtagsnk;vkvflndtagsnkk;kvflndtagsnkkt;vflndtagsnkktg;flndtagsnkktgk;
lndtagsnkktgkw;ndtagsnkktgkwe;dtagsnkktgkwed;tagsnkktgkweds;agsnkktgkwedst;
gsnkktgkwedsts;snkktgkwedstst;nkktgkwedststl;kktgkwedststlt;ktgkwedststlti;
tgkwedststltis;gkwedststltisa;kwedststltisad;wedststltisads;edststltisadsk;
dststltisadskk;ststltisadskkt;tstltisadskktk;stltisadskktkd;tltisadskktkdl;
ltisadskktkdlv;tisadskktkdlvf;isadskktkdlvfl;sadskktkdlvflt;adskktkdlvfltd;
dskktkdlvfltdg;skktkdlvfltdgt;kktkdlvfltdgti;ktkdlvfltdgtit;tkdlvfltdgtitv;
kdlvfltdgtitvq;dlvfltdgtitvqq;lvfltdgtitvqqy;vfltdgtitvqqyn;fltdgtitvqqynt;
ltdgtitvqqynta;tdgtitvqqyntag;dgtitvqqyntagt;gtitvqqyntagts;titvqqyntagtsl;
itvqqyntagtsle;tvqqyntagtsleg;vqqyntagtslegs;qqyntagtslegsa;qyntagtslegsas;
yntagtslegsase;ntagtslegsasei;tagtslegsaseik;agtslegsaseikn;gtslegsaseiknl;
tslegsaseiknls;slegsaseiknlse;legsaseiknlsel;egsaseiknlselk;gsaseiknlselkn;
saseiknlselkna;aseiknlselknal;seiknlselknaik;

15 mers:
mrlligfalalalig;rlligfalalaligc;lligfalalaligca;ligfalalaligcaq;igfalalalig
caqk;gfalalaligcaqkg;falalaligcaqkga;alalaligcaqkgae;lalaligcaqkgaes;alalig
caqkgaesi;laligcaqkgaesig;aligcaqkgaesigs;ligcaqkgaesigsq;igcaqkgaesigsqk;g
caqkgaesigsqke;caqkgaesigsqken;aqkgaesigsqkend;qkgaesigsqkendl;kgaesigsqken
dln;gaesigsqkendlnl;aesigsqkendlnle;esigsqkendlnled;sigsqkendlnleds;igsqken
dlnledss;gsqkendlnledssk;sqkendlnledsskk;qkendlnledsskks;kendlnledsskksh;en
dlnledsskkshq;ndlnledsskkshqn;dlnledsskkshqna;lnledsskkshqnak;nledsskkshqna
kq;ledsskkshqnakqd;edsskkshqnakqdl;dsskkshqnakqdlp;sskkshqnakqdlpa;skkshqna
kqdlpav;kkshqnakqdlpavt;kshqnakqdlpavte;shqnakqdlpavted;hqnakqdlpavteds;qna
kqdlpavtedsv;nakqdlpavtedsvs;akqdlpavtedsvsl;kqdlpavtedsvslf;qdlpavtedsvslf
n;dlpavtedsvslfng;lpavtedsvslfngn;pavtedsvslfngnk;avtedsvslfngnki;vtedsvslf
ngnkif;tedsvslfngnkifv;edsvslfngnkifvs;dsvslfngnkifvsk;svslfngnkifvske;vslf
ngnkifvskek;slfngnkifvskekn;lfngnkifvskekns;fngnkifvskeknss;ngnkifvskeknssg
;gnkifvskeknssgk;nkifvskeknssgky;kifvskeknssgkyd;ifvskeknssgkydl;fvskeknssg
kydlr;vskeknssgkydlra;skeknssgkydlrat;keknssgkydlrati;eknssgkydlratid;knssg
kydlratidq;nssgkydlratidqv;ssgkydlratidqve;sgkydlratidqvel;gkydlratidqvelk;
kydlratidqvelkg;ydlratidqvelkgt;dlratidqvelkgts;lratidqvelkgtsd;ratidqvelkg
tsdk;atidqvelkgtsdkn;tidqvelkgtsdknn;idqvelkgtsdknng;dqvelkgtsdknngs;qvelkg
tsdknngsg;velkgtsdknngsgt;elkgtsdknngsgtl;lkgtsdknngsgtle;kgtsdknngsgtleg;g
tsdknngsgtlegs;tsdknngsgtlegsk;sdknngsgtlegskp;dknngsgtlegskpd;knngsgtlegsk
pdk;nngsgtlegskpdks;ngsgtlegskpdksk;gsgtlegskpdkskv;sgtlegskpdkskvk;gtlegsk
pdkskvkl;tlegskpdkskvklt;legskpdkskvkltv;egskpdkskvkltvs;gskpdkskvkltvsa;sk
pdkskvkltvsad;kpdkskvkltvsadl;pdkskvkltvsadln;dkskvkltvsadlnt;kskvkltvsadln
tv;skvkltvsadlntvt;kvkltvsadlntvtl;vkltvsadlntvtle;kltvsadlntvtlea;ltvsadln
tvtleaf;tvsadlntvtleafd;vsadlntvtleafda;sadlntvtleafdas;adlntvtleafdasn;dln
tvtleafdasnq;lntvtleafdasnqk;ntvtleafdasnqki;tvtleafdasnqkis;vtleafdasnqkis
s;tleafdasnqkissk;leafdasnqkisskv;eafdasnqkisskvt;afdasnqkisskvtk;fdasnqkis
skvtkk;dasnqkisskvtkkq;asnqkisskvtkkqg;snqkisskvtkkqgs;nqkisskvtkkqgsi;qkis
skvtkkqgsit;kisskvtkkqgsitx;isskvtkkqgsitxe;sskvtkkqgsitxet;skvtkkqgsitxetl
;kvtkkqgsitxetlk;vtkkqgsitxetlka;tkkqgsitxetlkan;kkqgsitxetlkank;kqgsitxetl
kankl;qgsitxetlkankld;gsitxetlkanklds;sitxetlkankldsk;itxetlkankldskk;txetl
kankldskkl;xetlkankldskklt;etlkankldskkltr;tlkankldskkltrs;lkankldskkltrsn;

Fig. 39 continued kankldskkltrsng;ankldskkltrsngt;nkldskkltrsngtt;kldskkltrsngttl;ldskkltrsng
ttle;dskkltrsngttley;skkltrsngttleys;kkltrsngttleysq;kltrsngttleysqi;ltrsng
ttleysqit;trsngttleysqitd;rsngttleysqitda;sngttleysqitdad;ngttleysqitdadn;g
ttleysqitdadna;ttleysqitdadnat;tleysqitdadnatk;leysqitdadnatka;eysqitdadnat kav;ysqitdadnatkave;sqitdadnatkavet;qitdadnatkavetl;itdadnatkavetlk;tdadnat kavetlkn;dadnatkavetlkns;adnatkavetlknsi;dnatkavetlknsik;natkavetlknsikl;at kavetlknsikle;tkavetlknsikleg;kavetlknsiklegs;avetlknsiklegsl;vetlknsiklegs lv;etlknsiklegslvg;tlknsiklegslvgg;lknsiklegslvggk;knsiklegslvggkt;nsiklegs lvggktt;siklegslvggkttv;iklegslvggkttve;klegslvggkttvei;legslvggkttveik;egs lvggkttveike;gslvggkttveikeg;slvggkttveikegt;lvggkttveikegtv;vggkttveikegtv t;ggkttveikegtvtl;gkttveikegtvtlk;kttveikegtvtlkr;ttveikegtvtlkre;tveikegtv tlkrei;veikegtvtlkreie;eikegtvtlkreiek;ikegtvtlkreiekd;kegtvtlkreiekdg;egtv tlkreiekdgk;gtvtlkreiekdgkv;tvtlkreiekdgkvk;vtlkreiekdgkvkv;tlkreiekdgkvkvf ;lkreiekdgkvkvfl;kreiekdgkvkvfln;reiekdgkvkvflnd;eiekdgkvkvflndt;iekdgkvkvf lndta;ekdgkvkvflndtag;kdgkvkvflndtags;dgkvkvflndtagsn;gkvkvflndtagsnk;kvkvf lndtagsnkk;vkvflndtagsnkkt;kvflndtagsnkktg;vflndtagsnkktgk;flndtagsnkktgkw; lndtagsnkktgkwe;ndtagsnkktgkwed;dtagsnkktgkweds;tagsnkktgkwedst;agsnkktgkwe dsts;gsnkktgkwedstst;snkktgkwedststl;nkktgkwedststlt;kktgkwedststlti;ktgkwe dststltis;tgkwedststltisa;gkwedststltisad;kwedststltisads;wedststltisadsk;e dststltisadskk;dststltisadskkt;ststltisadskktk;tstltisadskktkd;stltisadskkt kdl;tltisadskktkdlv;ltisadskktkdlvf;tisadskktkdlvfl;isadskktkdlvflt;sadskkt kdlvfltd;adskktkdlvfltdg;dskktkdlvfltdgt;skktkdlvfltdgti;kktkdlvfltdgtit;kt kdlvfltdgtitv;tkdlvfltdgtitvq;kdlvfltdgtitvqq;dlvfltdgtitvqqy;lvfltdgtitvqq yn;vfltdgtitvqqynt;fltdgtitvqqynta;ltdgtitvqqyntag;tdgtitvqqyntagt;dgtitvqq yntagts;gtitvqqyntagtsl;titvqqyntagtsle;itvqqyntagtsleg;tvqqyntagtslegs;vqq yntagtslegsa;qqyntagtslegsas;qyntagtslegsase;yntagtslegsasei;ntagtslegsasei k;tagtslegsaseikn;agtslegsaseiknl;gtslegsaseiknls;tslegsaseiknlse;slegsasei knlsel;legsaseiknlselk;egsaseiknlselkn;gsaseiknlselkna;saseiknlselknal;asei knlselknalk;

16 mers:
mrlligfalalaligc;rlligfalalaligca;lligfalalaligcaq;ligfalalaligcaqk;igfalal aligcaqkg;gfalalaligcaqkga;falalaligcaqkgae;alalaligcaqkgaes;lalaligcaqkgae si;alaligcaqkgaesig;laligcaqkgaesigs;aligcaqkgaesigsq;ligcaqkgaesigsqk;igca qkgaesigsqke;gcaqkgaesigsqken;caqkgaesigsqkend;aqkgaesigsqkendl;qkgaesigsqk endln;kgaesigsqkendlnl;gaesigsqkendlnle;aesigsqkendlnled;esigsqkendlnleds;s igsqkendlnledss;igsqkendlnledssk;gsqkendlnledsskk;sqkendlnledsskks;qkendlnl edsskksh;kendlnledsskkshq;endlnledsskkshqn;ndlnledsskkshqna;dlnledsskkshqna k;lnledsskkshqnakq;nledsskkshqnakqd;ledsskkshqnakqdl;edsskkshqnakqdlp;dsskk shqnakqdlpa;sskkshqnakqdlpav;skkshqnakqdlpavt;kkshqnakqdlpavte;kshqnakqdlpa vted;shqnakqdlpavteds;hqnakqdlpavtedsv;qnakqdlpavtedsvs;nakqdlpavtedsvsl;ak qdlpavtedsvslf;kqdlpavtedsvslfn;qdlpavtedsvslfng;dlpavtedsvslfngn;lpavtedsv slfngnk;pavtedsvslfngnki;avtedsvslfngnkif;vtedsvslfngnkifv;tedsvslfngnkifvs ;edsvslfngnkifvsk;dsvslfngnkifvske;svslfngnkifvskek;vslfngnkifvskekn;slfngn kifvskekns;lfngnkifvskeknss;fngnkifvskeknssg;ngnkifvskeknssgk;gnkifvskeknss gky;nkifvskeknssgkyd;kifvskeknssgkydl;ifvskeknssgkydlr;fvskeknssgkydlra;vsk eknssgkydlrat;skeknssgkydlrati;keknssgkydlratid;eknssgkydlratidq;knssgkydlr atidqv;nssgkydlratidqve;ssgkydlratidqvel;sgkydlratidqvelk;gkydlratidqvelkg; kydlratidqvelkgt;ydlratidqvelkgts;dlratidqvelkgtsd;lratidqvelkgtsdk;ratidqv elkgtsdkn;atidqvelkgtsdknn;tidqvelkgtsdknng;idqvelkgtsdknngs;dqvelkgtsdknng sg;qvelkgtsdknngsgt;velkgtsdknngsgtl;elkgtsdknngsgtle;lkgtsdknngsgtleg;kgts dknngsgtlegs;gtsdknngsgtlegsk;tsdknngsgtlegskp;sdknngsgtlegskpd;dknngsgtleg skpdk;knngsgtlegskpdks;nngsgtlegskpdksk;ngsgtlegskpdkskv;gsgtlegskpdkskvk;s gtlegskpdkskvkl;gtlegskpdkskvklt;tlegskpdkskvkltv;legskpdkskvkltvs;egskpdks kvkltvsa;gskpdkskvkltvsad;skpdkskvkltvsadl;kpdkskvkltvsadln;pdkskvkltvsadln

Fig. 39 continued t;dkskvkltvsadlntv;kskvkltvsadlntvt;skvkltvsadlntvtl;kvkltvsadlntvtle;vkltv
sadlntvtlea;kltvsadlntvtleaf;ltvsadlntvtleafd;tvsadlntvtleafda;vsadlntvtlea
fdas;sadlntvtleafdasn;adlntvtleafdasnq;dlntvtleafdasnqk;lntvtleafdasnqki;nt
vtleafdasnqkis;tvtleafdasnqkiss;vtleafdasnqkissk;tleafdasnqkisskv;leafdasnq kisskvt;eafdasnqkisskvtk;afdasnqkisskvtkk;fdasnqkisskvtkkq;dasnqkisskvtkkqg ;asnqkisskvtkkqgs;snqkisskvtkkqgsi;nqkisskvtkkqgsit;qkisskvtkkqgsitx;kisskv tkkqgsitxe;isskvtkkqgsitxet;sskvtkkqgsitxetl;skvtkkqgsitxetlk;kvtkkqgsitxet lka;vtkkqgsitxetlkan;tkkqgsitxetlkank;kkqgsitxetlkankl;kqgsitxetlkankld;qgs itxetlkanklds;gsitxetlkankldsk;sitxetlkankldskk;itxetlkankldskkl;txetlkankl dskklt;xetlkankldskkltr;etlkankldskkltrs;tlkankldskkltrsn;lkankldskkltrsng; kankldskkltrsngt;ankldskkltrsngtt;nkldskkltrsngttl;kldskkltrsngttle;ldskklt rsngttley;dskkltrsngttleys;skkltrsngttleysq;kkltrsngttleysqi;kltrsngttleysq it;ltrsngttleysqitd;trsngttleysqitda;rsngttleysqitdad;sngttleysqitdadn;ngtt leysqitdadna;gttleysqitdadnat;ttleysqitdadnatk;tleysqitdadnatka;leysqitdadn atkav;eysqitdadnatkave;ysqitdadnatkavet;sqitdadnatkavetl;qitdadnatkavetlk;i tdadnatkavetlkn;tdadnatkavetlkns;dadnatkavetlknsi;adnatkavetlknsik;dnatkave tlknsikl;natkavetlknsikle;atkavetlknsikleg;tkavetlknsiklegs;kavetlknsiklegs l;avetlknsiklegslv;vetlknsiklegslvg;etlknsiklegslvgg;tlknsiklegslvggk;lknsi klegslvggkt;knsiklegslvggktt;nsiklegslvggkttv;siklegslvggkttve;iklegslvggkt tvei;klegslvggkttveik;legslvggkttveike;egslvggkttveikeg;gslvggkttveikegt;sl vggkttveikegtv;lvggkttveikegtvt;vggkttveikegtvtl;ggkttveikegtvtlk;gkttveike gtvtlkr;kttveikegtvtlkre;ttveikegtvtlkrei;tveikegtvtlkreie;veikegtvtlkreiek ;eikegtvtlkreiekd;ikegtvtlkreiekdg;kegtvtlkreiekdgk;egtvtlkreiekdgkv;gtvtlk reiekdgkvk;tvtlkreiekdgkvkv;vtlkreiekdgkvkvf;tlkreiekdgkvkvfl;lkreiekdgkvkv fln;kreiekdgkvkvflnd;reiekdgkvkvflndt;eiekdgkvkvflndta;iekdgkvkvflndtag;ekd gkvkvflndtags;kdgkvkvflndtagsn;dgkvkvflndtagsnk;gkvkvflndtagsnkk;kvkvflndta gsnkkt;vkvflndtagsnkktg;kvflndtagsnkktgk;vflndtagsnkktgkw;flndtagsnkktgkwe; lndtagsnkktgkwed;ndtagsnkktgkweds;dtagsnkktgkwedst;tagsnkktgkwedsts;agsnkkt gkwedstst;gsnkktgkwedststl;snkktgkwedststlt;nkktgkwedststlti;kktgkwedststlt is;ktgkwedststltisa;tgkwedststltisad;gkwedststltisads;kwedststltisadsk;weds tstltisadskk;edststltisadskkt;dststltisadskktk;ststltisadskktkd;tstltisadsk ktkdl;stltisadskktkdlv;tltisadskktkdlvf;ltisadskktkdlvfl;tisadskktkdlvflt;i sadskktkdlvfltd;sadskktkdlvfltdg;adskktkdlvfltdgt;dskktkdlvfltdgti;skktkdlv fltdgtit;kktkdlvfltdgtitv;ktkdlvfltdgtitvq;tkdlvfltdgtitvqq;kdlvfltdgtitvqq y;dlvfltdgtitvqqyn;lvfltdgtitvqqynt;vfltdgtitvqqynta;fltdgtitvqqyntag;ltdgt itvqqyntagt;tdgtitvqqyntagts;dgtitvqqyntagtsl;gtitvqqyntagtsle;titvqqyntagt sleg;itvqqyntagtslegs;tvqqyntagtslegsa;vqqyntagtslegsas;qqyntagtslegsase;qy ntagtslegsasei;yntagtslegsaseik;ntagtslegsaseikn;tagtslegsaseiknl;agtslegsa seiknls;gtslegsaseiknlse;tslegsaseiknlsel;slegsaseiknlselk;legsaseiknlselkn ;egsaseiknlselkna;gsaseiknlselknal;saseiknlselknalk;

Fig. 39 continued

<AAN87995 Outer Surface Protein C;Protein;Borrelia garinii>
Seq ID No 163502-165005

8 mers:
ilmtlflf;lmtlflfi;mtlflfis;tlflfisc;lflfiscn;flfiscnn;lfiscnns;fiscnnsg;isc
nnsgg;scnnsggd;cnnsggdt;nnsggdta;nsggdtas;sggdtast;ggdtastn;gdtastnp;dtastn
pd;tastnpde;astnpdes;stnpdesa;tnpdesak;npdesakg;pdesakgp;desakgpn;esakgpnl;
sakgpnlt;akgpnltv;kgpnltvi;gpnltvis;pnltvisk;nltviskk;ltviskki;tviskkit;vis
kkitd;iskkitds;skkitdsn;kkitdsna;kitdsnaf;itdsnafv;tdsnafvl;dsnafvla;snafvl
av;nafvlavk;afvlavke;fvlavkev;vlavkeve;lavkevea;avkeveal;vkeveali;kevealis;
evealiss;vealissi;ealissid;alisside;lissidel;issidela;ssidelan;sidelank;ide
lanka;delankai;elankaig;lankaigk;ankaigkv;nkaigkvi;kaigkvih;aigkvihq;igkvih
qn;gkvihqnn;kvihqnng;vihqnngl;ihqnngln;hqnnglna;qnnglnan;nnglnana;nglnanag;
glnanagq;lnanagqn;nanagqng;anagqngs;nagqngsl;agqngsll;gqngslla;qngsllag;ngs
llaga;gsllagay;sllagaya;llagayai;lagayais;agayaist;gayaistl;ayaistli;yaistl
it;aistlite;istlitek;stlitekl;tliteklsliteklsk;iteklskl;teklsklk;eklsklkn;
klsklkns;lsklknse;sklknsee;klknseel;lknseeln;knseelnk;nseelnkk;seelnkki;eel
nkkie;elnkkiee;lnkkieea;nkkieeak;kkieeakn;kieeaknh;ieeaknhs;eeaknhse;eaknhs
ea;aknhseaf;knhseaft;nhseaftn;hseaftnr;seaftnrl;eaftnrlk;aftnrlkg;ftnrlkgs;
tnrlkgsh;nrlkgsha;rlkgshaq;lkgshaql;kgshaqlg;gshaqlgv;shaqlgva;haqlgvaa;aql
gvaaa;qlgvaaat;lgvaaatd;gvaaatdd;vaaatddh;aaatddha;aatddhak;atddhake;tddhak
ea;ddhakeai;dhakeail;hakeailk;akeailks;keailksn;eailksnp;ailksnpt;ilksnptk;
lksnptkd;ksnptkdk;snptkdkg;nptkdkga;ptkdkgak;tkdkgake;kdkgakel;dkgakelk;kga
kelkd;gakelkdl;akelkdls;kelkdlse;elkdlses;lkdlsesv;kdlsesve;dlsesves;lsesve
sl;sesvesla;esveslak;sveslaka;veslakaa;eslakaaq;slakaaqe;lakaaqea;akaaqeal;
kaaqeala;aaqealan;aqealans;qealansv;ealansvk;alansvke;lansvkel;ansvkelt;nsv
keltn;svkeltnp;vkeltnpv;keltnpvv;eltnpvva;ltnpvvae;tnpvvaes;npvvaesp;pvvaes
pk;

9 mers:
ilmtlflfi;lmtlflfis;mtlflfisc;tlflfiscn;lflfiscnn;flfiscnns;lfiscnnsg;fiscn
nsgg;iscnnsggd;scnnsggdt;cnnsggdta;nnsggdtas;nsggdtast;sggdtastn;ggdtastnp;
gdtastnpd;dtastnpde;tastnpdes;astnpdesa;stnpdesak;tnpdesakg;npdesakgp;pdesa
kgpn;desakgpnl;esakgpnlt;sakgpnltv;akgpnltvi;kgpnltvis;gpnltvisk;pnltviskk;
nltviskki;ltviskkit;tviskkitd;viskkitds;iskkitdsn;skkitdsna;kkitdsnaf;kitds
nafv;itdsnafvl;tdsnafvla;dsnafvlav;snafvlavk;nafvlavke;afvlavkev;fvlavkeve;
vlavkevea;lavkeveal;avkeveali;vkevealis;kevealiss;evealissi;vealissid;ealis
side;alissidel;lissidela;issidelan;ssidelank;sidelanka;idelankai;delankaig;
elankaigk;lankaigkv;ankaigkvi;nkaigkvih;kaigkvihq;aigkvihqn;igkvihqnn;gkvih
qnng;kvihqnngl;vihqnngln;ihqnnglna;hqnnglnan;qnnglnana;nnglnanag;nglnanagq;
glnanagqn;lnanagqng;nanagqngs;anagqngsl;nagqngsll;agqngslla;gqngsllag;qngsl
laga;ngsllagay;gsllagaya;sllagayai;llagayais;lagayaist;agayaistl;gayaistli;
ayaistlit;yaistlite;aistlitek;istlitekl;stlitekls;tliteklsk;liteklskl;itekl
sklk;teklsklkn;eklsklkns;lsklknse;lsklknsee;sklknseel;klknseeln;knseelnk;
knseelnkk;nseelnkki;seelnkkie;eelnkkiee;elnkkieea;lnkkieeak;nkkieeakn;kkiee
aknh;kieeaknhs;ieeaknhse;eeaknhsea;eaknhseaf;aknhseaft;knhseaftn;nhseaftnr;
hseaftnrl;seaftnrlk;eaftnrlkg;aftnrlkgs;ftnrlkgsh;tnrlkgsha;nrlkgshaq;rlkgs
haql;lkgshaqlg;kgshaqlgv;gshaqlgva;shaqlgvaa;haqlgvaaa;aqlgvaaat;qlgvaaatd;
lgvaaatdd;gvaaatddh;vaaatddha;aaatddhak;aatddhake;atddhakea;tddhakeai;ddhak
eail;dhakeailk;hakeailks;akeailksn;keailksnp;eailksnpt;ailksnptk;ilksnptkd;
lksnptkdk;ksnptkdkg;snptkdkga;nptkdkgak;ptkdkgake;tkdkgakel;kdkgakelk;dkgak
elkd;kgakelkdl;gakelkdls;akelkdlse;kelkdlses;elkdlsesv;lkdlsesve;kdlsesves;
dlsesvesl;lsesvesla;sesveslak;esveslaka;sveslakaa;veslakaaq;eslakaaqe;slaka
aqea;lakaaqeal;akaaqeala;kaaqealan;aaqealans;aqealansv;qealansvk;ealansvke;

Fig. 39 continued alansvkel;lansvkelt;ansvkeltn;nsvkeltnp;svkeltnpv;vkeltnpvv;keltnpvva;eltnp
vvae;ltnpvvaes;tnpvvaesp;npvvaespk;

10 mers:
ilmtlflfis;lmtlflfisc;mtlflfiscn;tlflfiscnn;lflfiscnns;flfiscnnsg;lfiscnnsg
g;fiscnnsggd;iscnnsggdt;scnnsggdta;cnnsggdtas;nnsggdtast;nsggdtastn;sggdtas
tnp;ggdtastnpd;gdtastnpde;dtastnpdes;tastnpdesa;astnpdesak;stnpdesakg;tnpde
sakgp;npdesakgpn;pdesakgpnl;desakgpnlt;esakgpnltv;sakgpnltvi;akgpnltvis;kgp
nltvisk;gpnltviskk;pnltviskki;nltviskkit;ltviskkitd;tviskkitds;viskkitdsn;i
skkitdsna;skkitdsnaf;kkitdsnafv;kitdsnafvl;itdsnafvla;tdsnafvlav;dsnafvlavk
;snafvlavke;nafvlavkev;afvlavkeve;fvlavkevea;vlavkeveal;lavkeveali;avkeveal
is;vkevealiss;kevealissi;evealissid;vealisside;ealissidel;alissidela;lissid
elan;issidelank;ssidelanka;sidelankai;idelankaig;delankaigk;elankaigkv;lank
aigkvi;ankaigkvih;nkaigkvihq;kaigkvihqn;aigkvihqnn;igkvihqnng;gkvihqnngl;kv
ihqnngln;vihqnnglna;ihqnnglnan;hqnnglnana;qnnglnanag;nnglnanagq;nglnanagqn;
glnanagqng;lnanagqngs;nanagqngsl;anagqngsll;nagqngslla;agqngsllag;gqngsllag
a;qngsllagay;ngsllagaya;gsllagayai;sllagayais;llagayaist;lagayaistl;agayais
tli;gayaistlit;ayaistlite;yaistlitek;aistlitekl;istlitekls;stliteklsk;tlite
klskl;liteklsklk;iteklsklkn;teklsklkns;eklsklknse;klsklknsee;lsklknseel;skl
knseeln;klknseelnk;lknseelnkk;knseelnkki;nseelnkkie;seelnkkiee;eelnkkieea;e
lnkkieeak;lnkkieeakn;nkkieeaknh;kkieeaknhs;kieeaknhse;ieeaknhsea;eeaknhseaf
;eaknhseaft;aknhseaftn;knhseaftnr;nhseaftnrl;hseaftnrlk;seaftnrlkg;eaftnrlk
gs;aftnrlkgsh;ftnrlkgsha;tnrlkgshaq;nrlkgshaql;rlkgshaqlg;lkgshaqlgv;kgshaq
lgva;gshaqlgvaa;shaqlgvaaa;haqlgvaaat;aqlgvaaatd;qlgvaaatdd;lgvaaatddh;gvaa
atddha;vaaatddhak;aaatddhake;aatddhakea;atddhakeai;tddhakeail;ddhakeailk;dh
akeailks;hakeailksn;akeailksnp;keailksnpt;eailksnptk;ailksnptkd;ilksnptkdk;
lksnptkdkg;ksnptkdkga;snptkdkgak;nptkdkgake;ptkdkgakel;tkdkgakelk;kdkgakelk
d;dkgakelkdl;kgakelkdls;gakelkdlse;akelkdlses;kelkdlsesv;elkdlsesve;lkdlses
ves;kdlsesvesl;dlsesvesla;lsesveslak;sesveslaka;esveslakaa;sveslakaaq;vesla
kaaqe;eslakaaqea;slakaaqeal;lakaaqeala;akaaqealan;kaaqealans;aaqealansv;aqe
alansvk;qealansvke;ealansvkel;alansvkelt;lansvkeltn;ansvkeltnp;nsvkeltnpv;s
vkeltnpvv;vkeltnpvva;keltnpvvae;eltnpvvaes;ltnpvvaesp;tnpvvaespk;

11 mers:
ilmtlflfisc;lmtlflfiscn;mtlflfiscnn;tlflfiscnns;lflfiscnnsg;flfiscnnsgg;lfi
scnnsggd;fiscnnsggdt;iscnnsggdta;scnnsggdtas;cnnsggdtast;nnsggdtastn;nsggdt
astnp;sggdtastnpd;ggdtastnpde;gdtastnpdes;dtastnpdesa;tastnpdesak;astnpdesa
kg;stnpdesakgp;tnpdesakgpn;npdesakgpnl;pdesakgpnlt;desakgpnltv;esakgpnltvi;
sakgpnltvis;akgpnltvisk;kgpnltviskk;gpnltviskki;pnltviskkit;nltviskkitd;ltv
iskkitds;tviskkitdsn;viskkitdsna;iskkitdsnaf;skkitdsnafv;kkitdsnafvl;kitdsn
afvla;itdsnafvlav;tdsnafvlavk;dsnafvlavke;snafvlavkev;nafvlavkeve;afvlavkev
ea;fvlavkeveal;vlavkeveali;lavkevealis;avkevealiss;vkevealissi;kevealissid;
evealisside;vealissidel;ealissidela;alissidelan;lissidelank;issidelanka;ssi
delankai;sidelankaig;idelankaigk;delankaigkv;elankaigkvi;lankaigkvih;ankaig
kvihq;nkaigkvihqn;kaigkvihqnn;aigkvihqnng;igkvihqnngl;gkvihqnngln;kvihqnngl
na;vihqnnglnan;ihqnnglnana;hqnnglnanag;qnnglnanagq;nnglnanagqn;nglnanagqng;
glnanagqngs;lnanagqngsl;nanagqngsll;anagqngslla;nagqngsllag;agqngsllaga;gqn
gsllagay;qngsllagaya;ngsllagayai;gsllagayais;sllagayaist;llagayaistl;lagaya
istli;agayaistlit;gayaistlite;ayaistlitek;yaistlitekl;aistlitekls;istlitekl
sk;stliteklskl;tliteklsklk;liteklsklkn;iteklsklkns;teklsklknse;eklsklknsee;
klsklknseel;lsklknseeln;sklknseelnk;klknseelnkk;lknseelnkki;knseelnkkie;nse
elnkkiee;seelnkkieea;eelnkkieeak;elnkkieeakn;lnkkieeaknh;nkkieeaknhs;kkieea
knhse;kieeaknhsea;ieeaknhseaf;eeaknhseaft;eaknhseaftn;aknhseaftnr;knhseaftn
rl;nhseaftnrlk;hseaftnrlkg;seaftnrlkgs;eaftnrlkgsh;aftnrlkgsha;ftnrlkgshaq;
tnrlkgshaql;nrlkgshaqlg;rlkgshaqlgv;lkgshaqlgva;kgshaqlgvaa;gshaqlgvaaa;sha qlgvaaat;haqlgvaaatd;aqlgvaaatdd;qlgvaaatddh;lgvaaatddha;gvaaatddhak;vaaatd
dhake;aaatddhakea;aatddhakeai;atddhakeail;tddhakeailk;ddhakeailks;dhakeailk
sn;hakeailksnp;akeailksnpt;keailksnptk;eailksnptkd;ailksnptkdk;ilksnptkdkg;
lksnptkdkga;ksnptkdkgak;snptkdkgake;nptkdkgakel;ptkdkgakelk;tkdkgakelkd;kdk gakelkdl;dkgakelkdls;kgakelkdlse;gakelkdlses;akelkdlsesv;kelkdlsesve;elkdls esves;lkdlsesvesl;kdlsesvesla;dlsesveslak;lsesveslaka;sesveslakaa;esveslaka aq;sveslakaaqe;veslakaaqea;eslakaaqeal;slakaaqeala;lakaaqealan;akaaqealans; kaaqealansv;aaqealansvk;aqealansvke;qealansvkel;ealansvkelt;alansvkeltn;lan svkeltnp;ansvkeltnpv;nsvkeltnpvv;svkeltnpvva;vkeltnpvvae;keltnpvvaes;eltnpv vaesp;ltnpvvaespk;

13 mers:
ilmtlflfiscnn;lmtlflfiscnns;mtlflfiscnnsg;tlflfiscnnsgg;lflfiscnnsggd;flfis cnnsggdt;lfiscnnsggdta;fiscnnsggdtas;iscnnsggdtast;scnnsggdtastn;cnnsggdtas tnp;nnsggdtastnpd;nsggdtastnpde;sggdtastnpdes;ggdtastnpdesa;gdtastnpdesak;d tastnpdesakg;tastnpdesakgp;astnpdesakgpn;stnpdesakgpnl;tnpdesakgpnlt;npdesa kgpnltv;pdesakgpnltvi;desakgpnltvis;esakgpnltvisk;sakgpnltviskk;akgpnltvisk ki;kgpnltviskkit;gpnltviskkitd;pnltviskkitds;nltviskkitdsn;ltviskkitdsna;tv iskkitdsnaf;viskkitdsnafv;iskkitdsnafvl;skkitdsnafvla;kkitdsnafvlav;kitdsna fvlavk;itdsnafvlavke;tdsnafvlavkev;dsnafvlavkeve;snafvlavkevea;nafvlavkevea l;afvlavkeveali;fvlavkevealis;vlavkevealiss;lavkevealissi;avkevealissid;vke vealisside;kevealissidel;evealissidela;vealissidelan;ealissidelank;alisside lanka;lissidelankai;issidelankaig;ssidelankaigk;sidelankaigkv;idelankaigkvi ;delankaigkvih;elankaigkvihq;lankaigkvihqn;ankaigkvihqnn;nkaigkvihqnng;kaig kvihqnngl;aigkvihqnngln;igkvihqnnglna;gkvihqnnglnan;kvihqnnglnana;vihqnngln anag;ihqnnglnanagq;hqnnglnanagqn;qnnglnanagqng;nnglnanagqngs;nglnanagqngsl; glnanagqngsll;lnanagqngslla;nanagqngsllag;anagqngsllaga;nagqngsllagay;agqng sllagaya;gqngsllagayai;qngsllagayais;ngsllagayaist;gsllagayaistl;sllagayais tli;llagayaistlit;lagayaistlite;agayaistlitek;gayaistlitekl;ayaistlitekls;y aistliteklsk;aistlitekIskl;istliteklsklk;stliteklsklkn;tliteklsklkns;litekl sklknse;iteklsklknsee;teklsklknseel;eklsklknseeln;klsklknseelnk;lsklknseeln kk;sklknseelnkki;klknseelnkkie;lknseelnkkiee;knseelnkkieea;nseelnkkieeak;se elnkkieeakn;eelnkkieeaknh;elnkkieeaknhs;lnkkieeaknhse;nkkieeaknhsea;kkieeak nhseaf;kieeaknhseaft;ieeaknhseaftn;eeaknhseaftnr;eaknhseaftnrl;aknhseaftnrl k;knhseaftnrlkg;nhseaftnrlkgs;hseaftnrlkgsh;seaftnrlkgsha;eaftnrlkgshaq;aft nrlkgshaql;ftnrlkgshaqlg;tnrlkgshaqlgv;nrlkgshaqlgva;rlkgshaqlgvaa;lkgshaql gvaaa;kgshaqlgvaaat;gshaqlgvaaatd;shaqlgvaaatdd;haqlgvaaatddh;aqlgvaaatddha ;qlgvaaatddhak;lgvaaatddhake;gvaaatddhakea;vaaatddhakeai;aaatddhakeail;aatd dhakeailk;atddhakeailks;tddhakeailksn;ddhakeailksnp;dhakeailksnpt;hakeailks nptk;akeailksnptkd;keailksnptkdk;eailksnptkdkg;ailksnptkdkga;ilksnptkdkgak; lksnptkdkgake;ksnptkdkgakel;snptkdkgakelk;nptkdkgakelkd;ptkdkgakelkdl;tkdkg akelkdls;kdkgakelkdlse;dkgakelkdlses;kgakelkdlsesv;gakelkdlsesve;akelkdlses ves;kelkdlsesvesl;elkdlsesvesla;lkdlsesveslak;kdlsesveslaka;dlsesveslakaa;l sesveslakaaq;sesveslakaaqe;esveslakaaqea;sveslakaaqeal;veslakaaqeala;eslaka aqealan;slakaaqealans;lakaaqealansv;akaaqealansvk;kaaqealansvke;aaqealansvk el;aqealansvkelt;qealansvkeltn;ealansvkeltnp;alansvkeltnpv;lansvkeltnpvv;an svkeltnpvva;nsvkeltnpvvae;svkeltnpvvaes;vkeltnpvvaesp;keltnpvvaespk;

14 mers:
ilmtlflfiscnns;lmtlflfiscnnsg;mtlflfiscnnsgg;tlflfiscnnsggd;lflfiscnnsggdt; flfiscnnsggdta;lfiscnnsggdtas;fiscnnsggdtast;iscnnsggdtastn;scnnsggdtastnp; cnnsggdtastnpd;nnsggdtastnpde;nsggdtastnpdes;sggdtastnpdesa;ggdtastnpdesak; gdtastnpdesakg;dtastnpdesakgp;tastnpdesakgpn;astnpdesakgpnl;stnpdesakgpnlt; tnpdesakgpnltv;npdesakgpnltvi;pdesakgpnltvis;desakgpnltvisk;esakgpnltviskk; sakgpnltviskki;akgpnltviskkit;kgpnltviskkitd;gpnltviskkitds;pnltviskkitdsn;

Fig. 39 continued nltviskkitdsna;ltviskkitdsnaf;tviskkitdsnafv;viskkitdsnafvl;iskkitdsnafvla;
skkitdsnafvlav;kkitdsnafvlavk;kitdsnafvlavke;itdsnafvlavkev;tdsnafvlavkeve;
dsnafvlavkevea;snafvlavkeveal;nafvlavkeveali;afvlavkevealis;fvlavkevealiss;
vlavkevealissi;lavkevealissid;avkevealisside;vkevealissidel;kevealissidela;
evealissidelan;vealissidelank;ealissidelanka;alissidelankai;lissidelankaig;
issidelankaigk;ssidelankaigkv;sidelankaigkvi;idelankaigkvih;delankaigkvihq;
elankaigkvihqn;lankaigkvihqnn;ankaigkvihqnng;nkaigkvihqnngl;kaigkvihqnngln;
aigkvihqnnglna;igkvihqnnglnan;gkvihqnnglnana;kvihqnnglnanag;vihqnnglnanagq;
ihqnnglnanagqn;hqnnglnanagqng;qnnglnanagqngs;nnglnanagqngsl;nglnanagqngsll;
glnanagqngslla;lnanagqngsllag;nanagqngsllaga;anagqngsllagay;nagqngsllagaya;
agqngsllagayai;gqngsllagayais;qngsllagayaist;ngsllagayaistl;gsllagayaistli;
sllagayaistlit;llagayaistlite;lagayaistlitek;agayaistlitekl;gayaistlitekls;
ayaistliteklsk;yaistliteklskl;aistliteklsklk;istliteklsklkn;stliteklsklkns;
tliteklsklknse;liteklsklknsee;iteklsklknseel;teklsklknseeln;eklsklknseelnk;
klsklknseelnkk;lsklknseelnkki;sklknseelnkkie;klknseelnkkiee;lknseelnkkieea;
knseelnkkieeak;nseelnkkieeakn;seelnkkieeaknh;eelnkkieeaknhs;elnkkieeaknhse;
lnkkieeaknhsea;nkkieeaknhseaf;kkieeaknhseaft;kieeaknhseaftn;ieeaknhseaftnr;
eeaknhseaftnrl;eaknhseaftnrlk;aknhseaftnrlkg;knhseaftnrlkgs;nhseaftnrlkgsh;
hseaftnrlkgsha;seaftnrlkgshaq;eaftnrlkgshaql;aftnrlkgshaqlg;ftnrlkgshaqlgv;
tnrlkgshaqlgva;nrlkgshaqlgvaa;rlkgshaqlgvaaa;lkgshaqlgvaaat;kgshaqlgvaaatd;
gshaqlgvaaatdd;shaqlgvaaatddh;haqlgvaaatddha;aqlgvaaatddhak;qlgvaaatddhake;
lgvaaatddhakea;gvaaatddhakeai;vaaatddhakeail;aaatddhakeailk;aatddhakeailks;
atddhakeailksn;tddhakeailksnp;ddhakeailksnpt;dhakeailksnptk;hakeailksnptkd;
akeailksnptkdk;keailksnptkdkg;eailksnptkdkga;ailksnptkdkgak;ilksnptkdkgake;
lksnptkdkgakel;ksnptkdkgakelk;snptkdkgakelkd;nptkdkgakelkdl;ptkdkgakelkdls;
tkdkgakelkdlse;kdkgakelkdlses;dkgakelkdlsesv;kgakelkdlsesve;gakelkdlsesves;
akelkdlsesvesl;kelkdlsesvesla;elkdlsesveslak;lkdlsesveslaka;kdlsesveslakaa;
dlsesveslakaaq;lsesveslakaaqe;sesveslakaaqea;esveslakaaqeal;sveslakaaqeala;
veslakaaqealan;eslakaaqealans;slakaaqealansv;lakaaqealansvk;akaaqealansvke;
kaaqealansvkel;aaqealansvkelt;aqealansvkeltn;qealansvkeltnp;ealansvkeltnpv;
alansvkeltnpvv;lansvkeltnpvva;ansvkeltnpvvae;nsvkeltnpvvaes;svkeltnpvvaesp;
vkeltnpvvaespk;

15 mers:
ilmtlflfiscnnsg;lmtlflfiscnnsgg;mtlflfiscnnsggd;tlflfiscnnsggdt;lflfiscnnsg
gdta;flfiscnnsggdtas;lfiscnnsggdtast;fiscnnsggdtastn;iscnnsggdtastnp;scnnsg
gdtastnpd;cnnsggdtastnpde;nnsggdtastnpdes;nsggdtastnpdesa;sggdtastnpdesak;g
gdtastnpdesakg;gdtastnpdesakgp;dtastnpdesakgpn;tastnpdesakgpnl;astnpdesakgp
nlt;stnpdesakgpnltv;tnpdesakgpnltvi;npdesakgpnltvis;pdesakgpnltvisk;desakgp
nltviskk;esakgpnltviskki;sakgpnltviskkit;akgpnltviskkitd;kgpnltviskkitds;gp
nltviskkitdsn;pnltviskkitdsna;nltviskkitdsnaf;ltviskkitdsnafv;tviskkitdsnaf
vl;viskkitdsnafvla;iskkitdsnafvlav;skkitdsnafvlavk;kkitdsnafvlavke;kitdsnaf
vlavkev;itdsnafvlavkeve;tdsnafvlavkevea;dsnafvlavkeveal;snafvlavkeveali;naf
vlavkevealis;afvlavkevealiss;fvlavkevealissi;vlavkevealissid;lavkevealissid
e;avkevealissidel;vkevealissidela;kevealissidelan;evealissidelank;vealissid
elanka;ealissidelankai;alissidelankaig;lissidelankaigk;issidelankaigkv;ssid
elankaigkvi;sidelankaigkvih;idelankaigkvihq;delankaigkvihqn;elankaigkvihqnn
;lankaigkvihqnng;ankaigkvihqnngl;nkaigkvihqnngln;kaigkvihqnnglna;aigkvihqnn
glnan;igkvihqnnglnana;gkvihqnnglnanag;kvihqnnglnanagq;vihqnnglnanagqn;ihqnn
glnanagqng;hqnnglnanagqngs;qnnglnanagqngsl;nnglnanagqngsll;nglnanagqngslla;
glnanagqngsllag;lnanagqngsllaga;nanagqngsllagay;anagqngsllagaya;nagqngsllag
ayai;agqngsllagayais;gqngsllagayaist;qngsllagayaistl;ngsllagayaistli;gsllag
ayaistlit;sllagayaistlite;llagayaistlitek;lagayaistlitekl;agayaistlitekls;g
ayaistliteklsk;ayaistliteklskl;yaistliteklsklk;aistliteklsklkn;istliteklskl
kns;stliteklsklknse;tliteklsklknsee;liteklsklknseel;iteklsklknseeln;teklskl

Fig. 39 continued knseelnk;eklsklknseelnkk;klsklknseelnkki;lsklknseelnkkie;sklknseelnkkiee;kl
knseelnkkieea;lknseelnkkieeak;knseelnkkieeakn;nseelnkkieeaknh;seelnkkieeakn
hs;eelnkkieeaknhse;elnkkieeaknhsea;lnkkieeaknhseaf;nkkieeaknhseaft;kkieeakn hseaftn;kieeaknhseaftnr;ieeaknhseaftnrl;eeaknhseaftnrlk;eaknhseaftnrlkg;akn hseaftnrlkgs;knhseaftnrlkgsh;nhseaftnrlkgsha;hseaftnrlkgshaq;seaftnrlkgshaq l;eaftnrlkgshaqlg;aftnrlkgshaqlgv;ftnrlkgshaqlgva;tnrlkgshaqlgvaa;nrlkgshaq lgvaaa;rlkgshaqlgvaaat;lkgshaqlgvaaatd;kgshaqlgvaaatdd;gshaqlgvaaatddh;shaq lgvaaatddha;haqlgvaaatddhak;aqlgvaaatddhake;qlgvaaatddhakea;lgvaaatddhakeai ;gvaaatddhakeail;vaaatddhakeailk;aaatddhakeailks;aatddhakeailksn;atddhakeai lksnp;tddhakeailksnpt;ddhakeailksnptk;dhakeailksnptkd;hakeailksnptkdk;akeai lksnptkdkg;keailksnptkdkga;eailksnptkdkgak;ailksnptkdkgake;ilksnptkdkgakel; lksnptkdkgakelk;ksnptkdkgakelkd;snptkdkgakelkdl;nptkdkgakelkdls;ptkdkgakelk dlse;tkdkgakelkdlses;kdkgakelkdlsesv;dkgakelkdlsesve;kgakelkdlsesves;gakelk dlsesvesl;akelkdlsesvesla;kelkdlsesveslak;elkdlsesveslaka;lkdlsesveslakaa;k dlsesveslakaaq;dlsesveslakaaqe;lsesveslakaaqea;sesveslakaaqeal;esveslakaaqe ala;sveslakaaqealan;veslakaaqealans;eslakaaqealansv;slakaaqealansvk;lakaaqe alansvke;akaaqealansvkel;kaaqealansvkelt;aaqealansvkeltn;aqealansvkeltnp;qe alansvkeltnpv;ealansvkeltnpvv;alansvkeltnpvva;lansvkeltnpvvae;ansvkeltnpvva es;nsvkeltnpvvaesp;svkeltnpvvaespk;

16 mers:
ilmtlflfiscnnsgg;lmtlflfiscnnsggd;mtlflfiscnnsggdt;tlflfiscnnsggdta;lflfisc nnsggdtas;flfiscnnsggdtast;lfiscnnsggdtastn;fiscnnsggdtastnp;iscnnsggdtastn pd;scnnsggdtastnpde;cnnsggdtastnpdes;nnsggdtastnpdesa;nsggdtastnpdesak;sggd tastnpdesakg;ggdtastnpdesakgp;gdtastnpdesakgpn;dtastnpdesakgpnl;tastnpdesak gpnlt;astnpdesakgpnltv;stnpdesakgpnltvi;tnpdesakgpnltvis;npdesakgpnltvisk;p desakgpnltviskk;desakgpnltviskki;esakgpnltviskkit;sakgpnltviskkitd;akgpnltv iskkitds;kgpnltviskkitdsn;gpnltviskkitdsna;pnltviskkitdsnaf;nltviskkitdsnaf v;ltviskkitdsnafvl;tviskkitdsnafvla;viskkitdsnafvlav;iskkitdsnafvlavk;skkit dsnafvlavke;kkitdsnafvlavkev;kitdsnafvlavkeve;itdsnafvlavkevea;tdsnafvlavke veal;dsnafvlavkeveali;snafvlavkevealis;nafvlavkevealiss;afvlavkevealissi;fv lavkevealissid;vlavkevealisside;lavkevealissidel;avkevealissidela;vkevealis sidelan;kevealissidelank;evealissidelanka;vealissidelankai;ealissidelankaig ;alissidelankaigk;lissidelankaigkv;issidelankaigkvi;ssidelankaigkvih;sidela nkaigkvihq;idelankaigkvihqn;delankaigkvihqnn;elankaigkvihqnng;lankaigkvihqn ngl;ankaigkvihqnngln;nkaigkvihqnnglna;kaigkvihqnnglnan;aigkvihqnnglnana;igk vihqnnglnanag;gkvihqnnglnanagq;kvihqnnglnanagqn;vihqnnglnanagqng;ihqnnglnan agqngs;hqnnglnanagqngsl;qnnglnanagqngsll;nnglnanagqngslla;nglnanagqngsllag; glnanagqngsllaga;lnanagqngsllagay;nanagqngsllagaya;anagqngsllagayai;nagqngs llagayais;agqngsllagayaist;gqngsllagayaistl;qngsllagayaistli;ngsllagayaistl it;gsllagayaistlite;sllagayaistlitek;llagayaistlitekl;lagayaistlitekls;agay aistliteklsk;gayaistliteklskl;ayaistliteklsklk;yaistliteklsklkn;aistlitekls klkns;istliteklsklknse;stliteklsklknsee;tliteklsklknseel;liteklsklknseeln;i teklsklknseelnk;teklsklknseelnkk;eklsklknseelnkki;klsklknseelnkkie;lsklknse elnkkiee;sklknseelnkkieea;klknseelnkkieeak;lknseelnkkieeakn;knseelnkkieeakn h;nseelnkkieeaknhs;seelnkkieeaknhse;eelnkkieeaknhsea;elnkkieeaknhseaf;lnkki eeaknhseaft;nkkieeaknhseaftn;kkieeaknhseaftnr;kieeaknhseaftnrl;ieeaknhseaft nrlk;eeaknhseaftnrlkg;eaknhseaftnrlkgs;aknhseaftnrlkgsh;knhseaftnrlkgsha;nh seaftnrlkgshaq;hseaftnrlkgshaql;seaftnrlkgshaqlg;eaftnrlkgshaqlgv;aftnrlkgs haqlgva;ftnrlkgshaqlgvaa;tnrlkgshaqlgvaaa;nrlkgshaqlgvaaat;rlkgshaqlgvaaatd ;lkgshaqlgvaaatdd;kgshaqlgvaaatddh;gshaqlgvaaatddha;shaqlgvaaatddhak;haqlgv aaatddhake;aqlgvaaatddhakea;qlgvaaatddhakeai;lgvaaatddhakeail;gvaaatddhakea ilk;vaaatddhakeailks;aaatddhakeailksn;aatddhakeailksnp;atddhakeailksnpt;tdd hakeailksnptk;ddhakeailksnptkd;dhakeailksnptkdk;hakeailksnptkdkg;akeailksnp tkdkga;keailksnptkdkgak;eailksnptkdkgake;ailksnptkdkgakel;ilksnptkdkgakelk;

Fig. 39 continued lksnptkdkgakelkd;ksnptkdkgakelkdl;snptkdkgakelkdls;nptkdkgakelkdlse;ptkdkga
kelkdlses;tkdkgakelkdlsesv;kdkgakelkdlsesve;dkgakelkdlsesves;kgakelkdlsesve
sl;gakelkdlsesvesla;akelkdlsesveslak;kelkdlsesveslaka;elkdlsesveslakaa;lkdl
sesveslakaaq;kdlsesveslakaaqe;dlsesveslakaaqea;lsesveslakaaqeal;sesveslakaa
qeala;esveslakaaqealan;sveslakaaqealans;veslakaaqealansv;eslakaaqealansvk;s
lakaaqealansvke;lakaaqealansvkel;akaaqealansvkelt;kaaqealansvkeltn;aaqealan
svkeltnp;aqealansvkeltnpv;qealansvkeltnpvv;ealansvkeltnpvva;alansvkeltnpvva
e;lansvkeltnpvvaes;ansvkeltnpvvaesp;nsvkeltnpvvaespk;

<NP_047005 outer surface protein C;Protein;Borrelia burgdorferi B31>
Seq ID No 165006-166597

8 mers:
mkkntlsa;kkntlsai;kntlsail;ntlsailm;tlsailmt;lsailmtl;sailmtlf;ailmtlfl;ilm
tlflf;lmtlflfi;mtlflfis;tlflfisc;lflfiscn;flfiscnn;lfiscnns;fiscnnsg;iscnns
gk;scnnsgkd;cnnsgkdg;nnsgkdgn;nsgkdgnt;sgkdgnts;gkdgntsa;kdgntsan;dgntsans;
gntsansa;ntsansad;tsansade;sansades;ansadesv;nsadesvk;sadesvkg;adesvkgp;des
vkgpn;esvkgpnl;svkgpnlt;vkgpnlte;kgpnltei;gpnlteis;pnlteisk;nlteiskk;lteisk
ki;teiskkit;eiskkitd;iskkitds;skkitdsn;kkitdsna;kitdsnav;itdsnavl;tdsnavll;
dsnavlla;snavllav;navllavk;avllavke;vllavkev;llavkeve;lavkevea;avkeveal;vke
veall;kevealls;eveallss;veallssi;eallssid;allsside;llssidei;lssideia;ssidei
aa;sideiaak;ideiaaka;deiaakai;eiaakaig;iaakaigk;aakaigkk;akaigkki;kaigkkih;
aigkkihq;igkkihqn;gkkihqnn;kkihqnng;kihqnngl;ihqnngld;hqnngldt;qnngldte;nng
ldten;ngldtenn;gldtennh;ldtennhn;dtennhng;tennhngs;ennhngsl;nnhngsll;nhngsl
la;hngsllag;ngsllaga;gsllagay;sllagaya;llagayai;lagayais;agayaist;gayaistl;
ayaistli;yaistlik;aistlikq;istlikqk;stlikqkl;tlikqkld;likqkldg;ikqkldgl;kqk
ldglk;qkldglkn;kldglkne;ldglkneg;dglknegl;glkneglk;lkneglke;kneglkek;neglke
ki;eglkekid;glkekida;lkekidaa;kekidaak;ekidaakk;kidaakkc;idaakkcs;daakkcse;
aakkcset;akkcsetf;kkcsetft;kcsetftn;csetftnk;setftnkl;etftnklk;tftnklke;ftn
klkek;tnklkekh;nklkekht;klkekhtd;lkekhtdl;kekhtdlg;ekhtdlgk;khtdlgke;htdlgk
eg;tdlgkegv;dlgkegvt;lgkegvtd;gkegvtda;kegvtdad;egvtdada;gvtdadak;vtdadake;
tdadakea;dadakeai;adakeail;dakeailk;akeailkt;keailktn;eailktng;ailktngt;ilk
tngtk;lktngtkt;ktngtktk;tngtktkg;ngtktkga;gtktkgae;tktkgaee;ktkgaeel;tkgaee
lg;kgaeelgk;gaeelgkl;aeelgklf;eelgklfe;elgklfes;lgklfesv;gklfesve;klfesvev;
lfesvevl;fesvevls;esvevlsk;svevlska;vevlskaa;evlskaak;vlskaake;lskaakem;ska
akeml;kaakemla;aakemlan;akemlans;kemlansv;emlansvk;mlansvke;lansvkel;ansvke
lt;nsvkelts;svkeltsp;vkeltspv;keltspvv;eltspvva;ltspvvae;tspvvaes;spvvaesp;
pvvaespk;vvaespkk;vaespkkp;

9 mers:
mkkntlsai;kkntlsail;kntlsailm;ntlsailmt;tlsailmtl;lsailmtlf;sailmtlfl;ailmt
lflf;ilmtlflfi;lmtlflfis;mtlflfisc;tlflfiscn;lflfiscnn;flfiscnns;lfiscnnsg;
fiscnnsgk;iscnnsgkd;scnnsgkdg;cnnsgkdgn;nnsgkdgnt;nsgkdgnts;sgkdgntsa;gkdgn
tsan;kdgntsans;dgntsansa;gntsansad;ntsansade;tsansades;sansadesv;ansadesvk;
nsadesvkg;sadesvkgp;adesvkgpn;desvkgpnl;esvkgpnlt;svkgpnlte;vkgpnltei;kgpnl
teis;gpnlteisk;pnlteiskk;nlteiskki;lteiskkit;teiskkitd;eiskkitds;iskkitdsn;
skkitdsna;kkitdsnav;kitdsnavl;itdsnavll;tdsnavlla;dsnavllav;snavllavk;navll
avke;avllavkev;vllavkeve;llavkevea;lavkeveal;avkeveall;vkevealls;keveallss;
eveallssi;veallssid;eallsside;allssidei;llssideia;lssideiaa;ssideiaak;sidei
aaka;ideiaakai;deiaakaig;eiaakaigk;iaakaigkk;aakaigkki;akaigkkih;kaigkkihq;
aigkkihqn;igkkihqnn;gkkihqnng;kkihqnngl;kihqnngld;ihqnngldt;hqnngldte;qnngl
dten;nngldtenn;ngldtennh;gldtennhn;ldtennhng;dtennhngs;tennhngsl;ennhngsll;
nnhngslla;nhngsllag;hngsllaga;ngsllagay;gsllagaya;sllagayai;llagayais;lagay
aist;agayaistl;gayaistli;ayaistlik;yaistlikq;aistlikqk;istlikqkl;stlikqkld;
tlikqkldg;likqkldgl;ikqkldglk;kqkldglkn;qkldglkne;kldglkneg;ldglknegl;dglkn

Fig. 39 continued eglk;glkneglke;lkneglkek;kneglkeki;neglkekid;eglkekida;glkekidaa;lkekidaak;
kekidaakk;ekidaakkc;kidaakkcs;idaakkcse;daakkcset;aakkcsetf;akkcsetft;kkcsetftn;kcsetftnk;csetftnkl;setftnklk;etftnklke;tftnklkek;ftnklkekh;tnklkekht;nklkekhtd;klkekhtdl;lkekhtdlg;kekhtdlgk;ekhtdlgke;khtdlgkeg;htdlgkegv;tdlgkegvt;dlgkegvtd;lgkegvtda;gkegvtdad;kegvtdada;egvtdadak;gvtdadake;vtdadakea;tdadakeai;dadakeail;adakeailk;dakeailkt;akeailktn;keailktng;eailktngt;ailktngtk;ilktngtkt;lktngtktk;ktngtktkg;tngtktkga;ngtktkgae;gtktkgaee;tktkgaeel;ktkgaeelg;tkgaeelgk;kgaeelgkl;gaeelgklf;aeelgklfe;eelgklfes;elgklfesv;lgklfesve;gklfesvev;klfesvevl;lfesvevls;fesvevlsk;esvevlska;svevlskaa;vevlskaak;evlskaake;vlskaakem;lskaakeml;skaakemla;kaakemlan;aakemlans;akemlansv;kemlansvk;emlansvke;mlansvkel;lansvkelt;ansvkelts;nsvkeltsp;svkeltspv;vkeltspvv;keltspvva;eltspvvae;ltspvvaes;tspvvaesp;spvvaespk;pvvaespkk;vvaespkkp;

10 mers:
mkkntlsail;kkntlsailm;kntlsailmt;ntlsailmtl;tlsailmtlf;lsailmtlfl;sailmtlflf;ailmtlflfi;ilmtlflfis;lmtlflfisc;mtlflfiscn;tlflfiscnn;lflfiscnns;flfiscnnsg;lfiscnnsgk;fiscnnsgkd;iscnnsgkdg;scnnsgkdgn;cnnsgkdgnt;nnsgkdgnts;nsgkdgntsa;sgkdgntsan;gkdgntsans;kdgntsansa;dgntsansad;gntsansade;ntsansades;tsansadesv;sansadesvk;ansadesvkg;nsadesvkgp;sadesvkgpn;adesvkgpnl;desvkgpnlt;esvkgpnlte;svkgpnltei;vkgpnlteis;kgpnlteisk;gpnlteiskk;pnlteiskki;nlteiskkit;lteiskkitd;teiskkitds;eiskkitdsn;iskkitdsna;skkitdsnav;kkitdsnavl;kitdsnavll;itdsnavlla;tdsnavllav;dsnavllavk;snavllavke;navllavkev;avllavkeve;vllavkevea;llavkeveal;lavkeveall;avkevealls;vkeveallss;keveallssi;eveallssid;veallsside;eallssidei;allssideia;llssideiaa;lssideiaak;ssideiaaka;sideiaakai;ideiaakaig;deiaakaigk;eiaakaigkk;iaakaigkki;aakaigkkih;akaigkkihq;kaigkkihqn;aigkkihqnn;igkkihqnng;gkkihqnngl;kkihqnngld;kihqnngldt;ihqnngldte;hqnngldten;qnngldtenn;nngldtennh;ngldtennhn;gldtennhng;ldtennhngs;dtennhngsl;tennhngsll;ennhngslla;nnhngsllag;nhngsllaga;hngsllagay;ngsllagaya;gsllagayai;sllagayais;llagayaist;lagayaistl;agayaistli;gayaistlik;ayaistlikq;yaistlikqk;aistlikqkl;istlikqkld;stlikqkldg;tlikqkldgl;likqkldglk;ikqkldglkn;kqkldglkne;qkldglkneg;kldglknegl;ldglkneglk;dglkneglke;glkneglkek;lkneglkeki;kneglkekid;neglkekida;eglkekidaa;glkekidaak;lkekidaakk;kekidaakkc;ekidaakkcs;kidaakkcse;idaakkcset;daakkcsetf;aakkcsetft;akkcsetftn;kkcsetftnk;kcsetftnkl;csetftnklk;setftnklke;etftnklkek;tftnklkekh;ftnklkekht;tnklkekhtd;nklkekhtdl;klkekhtdlg;lkekhtdlgk;kekhtdlgke;ekhtdlgkeg;khtdlgkegv;htdlgkegvt;tdlgkegvtd;dlgkegvtda;lgkegvtdad;gkegvtdada;kegvtdadak;egvtdadake;gvtdadakea;vtdadakeai;tdadakeail;dadakeailk;adakeailkt;dakeailktn;akeailktng;keailktngt;eailktngtk;ailktngtkt;ilktngtktk;lktngtktkg;ktngtktkga;tngtktkgae;ngtktkgaee;gtktkgaeel;tktkgaeelg;ktkgaeelgk;tkgaeelgkl;kgaeelgklf;gaeelgklfe;aeelgklfes;eelgklfesv;elgklfesve;lgklfesvev;gklfesvevl;klfesvevls;lfesvevlsk;fesvevlska;esvevlskaa;svevlskaak;vevlskaake;evlskaakem;vlskaakeml;lskaakemla;skaakemlan;kaakemlans;aakemlansv;akemlansvk;kemlansvke;emlansvkel;mlansvkelt;lansvkelts;ansvkeltsp;nsvkeltspv;svkeltspvv;vkeltspvva;keltspvvae;eltspvvaes;ltspvvaesp;tspvvaespk;spvvaespkk;pvvaespkkp;

11 mers:
mkkntlsailm;kkntlsailmt;kntlsailmtl;ntlsailmtlf;tlsailmtlfl;lsailmtlflf;sailmtlflfi;ailmtlflfis;ilmtlflfisc;lmtlflfiscn;mtlflfiscnn;tlflfiscnns;lflfiscnnsg;flfiscnnsgk;lfiscnnsgkd;fiscnnsgkdg;iscnnsgkdgn;scnnsgkdgnt;cnnsgkdgnts;nnsgkdgntsa;nsgkdgntsan;sgkdgntsans;gkdgntsansa;kdgntsansad;dgntsansade;gntsansades;ntsansadesv;tsansadesvk;sansadesvkg;ansadesvkgp;nsadesvkgpn;sadesvkgpnl;adesvkgpnlt;desvkgpnlte;esvkgpnltei;svkgpnlteis;vkgpnlteisk;kgpnlteiskk;gpnlteiskki;pnlteiskkit;nlteiskkitd;lteiskkitds;teiskkitdsn;eiskkitdsna;iskkitdsnav;skkitdsnavl;kkitdsnavll;kitdsnavlla;itdsnavllav;tdsnavllavk;dsnavllavke;snavllavkev;navllavkeve;avllavkevea;vllavkeveal;llavkeveall;lav

Fig. 39 continued kevealls;avkevealiss;vkeveallssi;keveallssid;eveallsside;veallssidei;eallss
ideia;allssideiaa;llssideiaak;lssideiaaka;ssideiaakai;sideiaakaig;ideiaakai
gk;deiaakaigkk;eiaakaigkki;iaakaigkkih;aakaigkkihq;akaigkkihqn;kaigkkihqnn;
aigkkihqnng;igkkihqnngl;gkkihqnngld;kkihqnngldt;kihqnngldte;ihqnngldten;hqn ngldtenn;qnngldtennh;nngldtennhn;ngldtennhng;gldtennhngs;ldtennhngsl;dtennh ngsll;tennhngslla;ennhngsllag;nnhngsllaga;nhngsllagay;hngsllagaya;ngsllagay ai;gsllagayais;sllagayaist;llagayaistl;lagayaistli;agayaistlik;gayaistlikq; ayaistlikqk;yaistlikqkl;aistlikqkld;istlikqkldg;stlikqkldgl;tlikqkldglk;lik qkldglkn;ikqkldglkne;kqkldglkneg;qkldglknegl;kldglkneglk;ldglkneglke;dglkne glkek;glkneglkeki;lkneglkekid;kneglkekida;neglkekidaa;eglkekidaak;glkekidaa kk;lkekidaakkc;kekidaakkcs;ekidaakkcse;kidaakkcset;idaakkcsetf;daakkcsetft; aakkcsetftn;akkcsetftnk;kkcsetftnkl;kcsetftnklk;csetftnklke;setftnklkek;etf tnklkekh;tftnklkekht;ftnklkekhtd;tnklkekhtdl;nklkekhtdlg;klkekhtdlgk;lkekht dlgke;kekhtdlgkeg;ekhtdlgkegv;khtdlgkegvt;htdlgkegvtd;tdlgkegvtda;dlgkegvtd ad;lgkegvtdada;gkegvtdadak;kegvtdadake;egvtdadakea;gvtdadakeai;vtdadakeail; tdadakeailk;dadakeailkt;adakeailktn;dakeailktng;akeailktngt;keailktngtk;eai lktngtkt;ailktngtktk;ilktngtktkg;lktngtktkga;ktngtktkgae;tngtktkgaee;ngtktk gaeel;gtktkgaeelg;tktkgaeelgk;ktkgaeelgkl;tkgaeelgklf;kgaeelgklfe;gaeelgklf es;aeelgklfesv;eelgklfesve;elgklfesvev;lgklfesvevl;gklfesvevls;klfesvevlsk; lfesvevlska;fesvevlskaa;esvevlskaak;svevlskaake;vevlskaakem;evlskaakeml;vls kaakemla;lskaakemlan;skaakemlans;kaakemlansv;aakemlansvk;akemlansvke;kemlan svkel;emlansvkelt;mlansvkelts;lansvkeltsp;ansvkeltspv;nsvkeltspvv;svkeltspv va;vkeltspvvae;keltspvvaes;eltspvvaesp;ltspvvaespk;tspvvaespkk;spvvaespkkp;

13 mers:
mkkntlsailmtl;kkntlsailmtlf;kntlsailmtlfl;ntlsailmtlflf;tlsailmtlflfi;lsail mtlflfis;sailmtlflfisc;ailmtlflfiscn;ilmtlflfiscnn;lmtlflfiscnns;mtlflfiscn nsg;tlflfiscnnsgk;lflfiscnnsgkd;flfiscnnsgkdg;lfiscnnsgkdgn;fiscnnsgkdgnt;i scnnsgkdgnts;scnnsgkdgntsa;cnnsgkdgntsan;nnsgkdgntsans;nsgkdgntsansa;sgkdgn tsansad;gkdgntsansade;kdgntsansades;dgntsansadesv;gntsansadesvk;ntsansadesv kg;tsansadesvkgp;sansadesvkgpn;ansadesvkgpnl;nsadesvkgpnlt;sadesvkgpnlte;ad esvkgpnltei;desvkgpnlteis;esvkgpnlteisk;svkgpnlteiskk;vkgpnlteiskki;kgpnlte iskkit;gpnlteiskkitd;pnlteiskkitds;nlteiskkitdsn;lteiskkitdsna;teiskkitdsna v;eiskkitdsnavl;iskkitdsnavll;skkitdsnavlla;kkitdsnavllav;kitdsnavllavk;itd snavllavke;tdsnavllavkev;dsnavllavkeve;snavllavkevea;navllavkeveal;avllavke veall;vllavkevealls;llavkeveallss;lavkeveallssi;avkeveallssid;vkeveallsside ;keveallssidei;eveallssideia;veallssideiaa;eallssideiaak;allssideiaaka;llss ideiaakai;lssideiaakaig;ssideiaakaigk;sideiaakaigkk;ideiaakaigkki;deiaakaig kkih;eiaakaigkkihq;iaakaigkkihqn;aakaigkkihqnn;akaigkkihqnng;kaigkkihqnngl; aigkkihqnngld;igkkihqnngldt;gkkihqnngldte;kkihqnngldten;kihqnngldtenn;ihqnn gldtennh;hqnngldtennhn;qnngldtennhng;nngldtennhngs;ngldtennhngsl;gldtennhng sll;ldtennhngslla;dtennhngsllag;tennhngsllaga;ennhngsllagay;nnhngsllagaya;n hngsllagayai;hngsllagayais;ngsllagayaist;gsllagayaistl;sllagayaistli;llagay aistlik;lagayaistlikq;agayaistlikqk;gayaistlikqkl;ayaistlikqkld;yaistlikqkl dg;aistlikqkldgl;istlikqkldglk;stlikqkldglkn;tlikqkldglkne;likqkldglkneg;ik qkldglknegl;kqkldglkneglk;qkldglkneglke;kldglkneglkek;ldglkneglkeki;dglkneg lkekid;glkneglkekida;lkneglkekidaa;kneglkekidaak;neglkekidaakk;eglkekidaakk c;glkekidaakkcs;lkekidaakkcse;kekidaakkcset;ekidaakkcsetf;kidaakkcsetft;ida akkcsetftn;daakkcsetftnk;aakkcsetftnkl;akkcsetftnklk;kkcsetftnklke;kcsetftn klkek;csetftnklkekh;setftnklkekht;etftnklkekhtd;tftnklkekhtdl;ftnklkekhtdlg ;tnklkekhtdlgk;nklkekhtdlgke;klkekhtdlgkeg;lkekhtdlgkegv;kekhtdlgkegvt;ekht dlgkegvtd;khtdlgkegvtda;htdlgkegvtdad;tdlgkegvtdada;dlgkegvtdadak;lgkegvtda dake;gkegvtdadakea;kegvtdadakeai;egvtdadakeail;gvtdadakeailk;vtdadakeailkt; tdadakeailktn;dadakeailktng;adakeailktngt;dakeailktngtk;akeailktngtkt;keail ktngtktk;eailktngtktkg;ailktngtktkga;ilktngtktkgae;lktngtktkgaee;ktngtktkga

Fig. 39 continued eel;tngtktkgaeelg;ngtktkgaeelgk;gtktkgaeelgkl;tktkgaeelgklf;ktkgaeelgklfe;t
kgaeelgklfes;kgaeelgklfesv;gaeelgklfesve;aeelgklfesvev;eelgklfesvevl;elgklf
esvevls;lgklfesvevlsk;gklfesvevlska;klfesvevlskaa;lfesvevlskaak;fesvevlskaa
ke;esvevlskaakem;svevlskaakeml;vevlskaakemla;evlskaakemlan;vlskaakemlans;ls
kaakemlansv;skaakemlansvk;kaakemlansvke;aakemlansvkel;akemlansvkelt;kemlans
vkelts;em nsa;nnsgkdgntsansad;nsgkdgntsansade;sgkdgntsansades;gkdgntsansadesv;kdgntsa
nsadesvk;dgntsansadesvkg;gntsansadesvkgp;ntsansadesvkgpn;tsansadesvkgpnl;sa
nsadesvkgpnlt;ansadesvkgpnlte;nsadesvkgpnltei;sadesvkgpnlteis;adesvkgpnltei
sk;desvkgpnlteiskk;esvkgpnlteiskki;svkgpnlteiskkit;vkgpnlteiskkitd;kgpnltei skkitds;gpnlteiskkitdsn;pnlteiskkitdsna;nlteiskkitdsnav;lteiskkitdsnavl;tei skkitdsnavll;eiskkitdsnavlla;iskkitdsnavllav;skkitdsnavllavk;kkitdsnavllavk e;kitdsnavllavkev;itdsnavllavkeve;tdsnavllavkevea;dsnavllavkeveal;snavllavk eveall;navllavkevealls;avllavkeveallss;vllavkeveallssi;llavkeveallssid;lavk eveallsside;avkeveallssidei;vkeveallssideia;keveallssideiaa;eveallssideiaak ;veallssideiaaka;eallssideiaakai;allssideiaakaig;llssideiaakaigk;lssideiaak aigkk;ssideiaakaigkki;sideiaakaigkkih;ideiaakaigkkihq;deiaakaigkkihqn;eiaak aigkkihqnn;iaakaigkkihqnng;aakaigkkihqnngl;akaigkkihqnngld;kaigkkihqnngldt; aigkkihqnngldte;igkkihqnngldten;gkkihqnngldtenn;kkihqnngldtennh;kihqnngldte nnhn;ihqnngldtennhng;hqnngldtennhngs;qnngldtennhngsl;nngldtennhngsll;ngldte nnhngslla;gldtennhngsllag;ldtennhngsllaga;dtennhngsllagay;tennhngsllagaya;e nnhngsllagayai;nnhngsllagayais;nhngsllagayaist;hngsllagayaistl;ngsllagayais tli;gsllagayaistlik;sllagayaistlikq;llagayaistlikqk;lagayaistlikqkl;agayais tlikqkld;gayaistlikqkldg;ayaistlikqkldgl;yaistlikqkldglk;aistlikqkldglkn;is tlikqkldglkne;stlikqkldglkneg;tlikqkldglknegl;likqkldglkneglk;ikqkldglknegl ke;kqkldglkneglkek;qkldglkneglkeki;kldglkneglkekid;ldglkneglkekida;dglknegl kekidaa;glkneglkekidaak;lkneglkekidaakk;kneglkekidaakkc;neglkekidaakkcs;egl kekidaakkcse;glkekidaakkcset;lkekidaakkcsetf;kekidaakkcsetft;ekidaakkcsetft n;kidaakkcsetftnk;idaakkcsetftnkl;daakkcsetftnklk;aakkcsetftnklke;akkcsetft nklkek;kkcsetftnklkekh;kcsetftnklkekht;csetftnklkekhtd;setftnklkekhtdl;etft nklkekhtdlg;tftnklkekhtdlgk;ftnklkekhtdlgke;tnklkekhtdlgkeg;nklkekhtdlgkegv ;klkekhtdlgkegvt;lkekhtdlgkegvtd;kekhtdlgkegvtda;ekhtdlgkegvtdad;khtdlgkegv tdada;htdlgkegvtdadak;tdlgkegvtdadake;dlgkegvtdadakea;lgkegvtdadakeai;gkegv tdadakeail;kegvtdadakeailk;egvtdadakeailkt;gvtdadakeailktn;vtdadakeailktng; tdadakeailktngt;dadakeailktngtk;adakeailktngtkt;dakeailktngtktk;akeailktngt ktkg;keailktngtktkga;eailktngtktkgae;ailktngtktkgaee;ilktngtktkgaeel;lktngt ktkgaeelg;ktngtktkgaeelgk;tngtktkgaeelgkl;ngtktkgaeelgklf;gtktkgaeelgklfe;t ktkgaeelgklfes;ktkgaeelgklfesv;tkgaeelgklfesve;kgaeelgklfesvev;gaeelgklfesv evl;aeelgklfesvevls;eelgklfesvevlsk;elgklfesvevlska;lgklfesvevlskaa;gklfesv evlskaak;klfesvevlskaake;lfesvevlskaakem;fesvevlskaakeml;esvevlskaakemla;sv evlskaakemlan;vevlskaakemlans;evlskaakemlansv;vlskaakemlansvk;lskaakemlansv ke;skaakemlansvkel;kaakemlansvkelt;aakemlansvkelts;akemlansvkeltsp;kemlansv keltspv;emlansvkeltspvv;mlansvkeltspvva;lansvkeltspvvae;ansvkeltspvvaes;nsv keltspvvaesp;svkeltspvvaespk;vkeltspvvaespkk;keltspvvaespkkp;

16 mers:
mkkntlsailmtlflf;kkntlsailmtlflfi;kntlsailmtlflfis;ntlsailmtlflfisc;tlsailm tlflfiscn;lsailmtlflfiscnn;sailmtlflfiscnns;ailmtlflfiscnnsg;ilmtlflfiscnns gk;lmtlflfiscnnsgkd;mtlflfiscnnsgkdg;tlflfiscnnsgkdgn;lflfiscnnsgkdgnt;flfi scnnsgkdgnts;lfiscnnsgkdgntsa;fiscnnsgkdgntsan;iscnnsgkdgntsans;scnnsgkdgnt sansa;cnnsgkdgntsansad;nnsgkdgntsansade;nsgkdgntsansades;sgkdgntsansadesv;g kdgntsansadesvk;kdgntsansadesvkg;dgntsansadesvkgp;gntsansadesvkgpn;ntsansad esvkgpnl;tsansadesvkgpnlt;sansadesvkgpnlte;ansadesvkgpnltei;nsadesvkgpnltei s;sadesvkgpnlteisk;adesvkgpnlteiskk;desvkgpnlteiskki;esvkgpnlteiskkit;svkgp nlteiskkitd;vkgpnlteiskkitds;kgpnlteiskkitdsn;gpnlteiskkitdsna;pnlteiskkitd snav;nlteiskkitdsnavl;lteiskkitdsnavll;teiskkitdsnavlla;eiskkitdsnavllav;is kkitdsnavllavk;skkitdsnavllavke;kkitdsnavllavkev;kitdsnavllavkeve;itdsnavll avkevea;tdsnavllavkeveal;dsnavllavkeveall;snavllavkevealls;navllavkeveallss ;avllavkeveallssi;vllavkeveallssid;llavkeveallsside;lavkeveallssidei;avkeve allssideia;vkeveallssideiaa;keveallssideiaak;eveallssideiaaka;veallssideiaa kai;eallssideiaakaig;allssideiaakaigk;llssideiaakaigkk;lssideiaakaigkki;ssi

Fig. 39 continued deiaakaigkkih;sideiaakaigkkihq;ideiaakaigkkihqn;deiaakaigkkihqnn;eiaakaigkk
ihqnng;iaakaigkkihqnngl;aakaigkkihqnngld;akaigkkihqnngldt;kaigkkihqnngldte;
aigkkihqnngldten;igkkihqnngldtenn;gkkihqnngldtennh;kkihqnngldtennhn;kihqnng
ldtennhng;ihqnngldtennhngs;hqnngldtennhngsl;qnngldtennhngsll;nngldtennhngsl
la;ngldtennhngsllag;gldtennhngsllaga;ldtennhngsllagay;dtennhngsllagaya;tenn
hngsllagayai;ennhngsllagayais;nnhngsllagayaist;nhngsllagayaistl;hngsllagaya
istli;ngsllagayaistlik;gsllagayaistlikq;sllagayaistlikqk;llagayaistlikqkl;l
agayaistlikqkld;agayaistlikqkldg;gayaistlikqkldgl;ayaistlikqkldglk;yaistlik
qkldglkn;aistlikqkldglkne;istlikqkldglkneg;stlikqkldglknegl;tlikqkldglknegl
k;likqkldglkneglke;ikqkldglkneglkek;kqkldglkneglkeki;qkldglkneglkekid;kldgl
kneglkekida;ldglkneglkekidaa;dglkneglkekidaak;glkneglkekidaakk;lkneglkekida
akkc;kneglkekidaakkcs;neglkekidaakkcse;eglkekidaakkcset;glkekidaakkcsetf;lk
ekidaakkcsetft;kekidaakkcsetftn;ekidaakkcsetftnk;kidaakkcsetftnkl;idaakkcse
tftnklk;daakkcsetftnklke;aakkcsetftnklkek;akkcsetftnklkekh;kkcsetftnklkekht
;kcsetftnklkekhtd;csetftnklkekhtdl;setftnklkekhtdlg;etftnklkekhtdlgk;tftnkl
kekhtdlgke;ftnklkekhtdlgkeg;tnklkekhtdlgkegv;nklkekhtdlgkegvt;klkekhtdlgkeg
vtd;lkekhtdlgkegvtda;kekhtdlgkegvtdad;ekhtdlgkegvtdada;khtdlgkegvtdadak;htd
lgkegvtdadake;tdlgkegvtdadakea;dlgkegvtdadakeai;lgkegvtdadakeail;gkegvtdada
keailk;kegvtdadakeailkt;egvtdadakeailktn;gvtdadakeailktng;vtdadakeailktngt;
tdadakeailktngtk;dadakeailktngtkt;adakeailktngtktk;dakeailktngtktkg;akeailk
tngtktkga;keailktngtktkgae;eailktngtktkgaee;ailktngtktkgaeel;ilktngtktkgaee
lg;lktngtktkgaeelgk;ktngtktkgaeelgkl;tngtktkgaeelgklf;ngtktkgaeelgklfe;gtkt
kgaeelgklfes;tktkgaeelgklfesv;ktkgaeelgklfesve;tkgaeelgklfesvev;kgaeelgklfe
svevl;gaeelgklfesvevls;aeelgklfesvevlsk;eelgklfesvevlska;elgklfesvevlskaa;l
gklfesvevlskaak;gklfesvevlskaake;klfesvevlskaakem;lfesvevlskaakeml;fesvevls
kaakemla;esvevlskaakemlan;svevlskaakemlans;vevlskaakemlansv;evlskaakemlansv
k;vlskaakemlansvke;lskaakemlansvkel;skaakemlansvkelt;kaakemlansvkelts;aakem
lansvkeltsp;akemlansvkeltspv;kemlansvkeltspvv;emlansvkeltspvva;mlansvkeltsp
vvae;lansvkeltspvvaes;ansvkeltspvvaesp;nsvkeltspvvaespk;svkeltspvvaespkk;vk
eltspvvaespkkp;

<CAF34024 outer surface protein VlsE;Protein;Borrelia garinii>
Seq ID No 166598-168853

8 mers:
mkkissai;kkissaif;kissaifi;issaifiv;ssaifiva;saifivaf;aifivafl;ifivafla;fiv
aflal;ivaflali;vaflalig;aflaligc;flaligck;laligckn;aligcknn;ligcknnv;igcknn
vg;gcknnvgg;cknnvggd;knnvggdd;nnvggddk;nvggddkk;vggddkkd;ggddkkdt;gddkkdta;
ddkkdtaa;dkkdtaas;kkdtaasi;kdtaasif;dtaasify;taasifyq;aasifyqs;asifyqsi;sif
yqsii;ifyqsiin;fyqsiinl;yqsiinlg;qsiinlgn;siinlgng;iinlgngf;inlgngfi;nlgngf
ie;lgngfiev;gngfievf;ngfievfn;gfievfna;fievfnaf;ievfnafs;evfnafsg;vfnafsgl;
fnafsglv;nafsglva;afsglvad;fsglvada;sglvadaf;glvadafs;lvadafsk;vadafska;ada
fskad;dafskadp;afskadpk;fskadpkk;skadpkks;kadpkksd;adpkksdv;dpkksdvk;pkksdv
kt;kksdvkty;ksdvktyf;sdvktyfd;dvktyfds;vktyfdsi;ktyfdsit;tyfdsitk;yfdsitkt;
fdsitktl;dsitktlk;sitktlkd;itktlkdt;tktlkdtk;ktlkdtkt;tlkdtktl;lkdtktkl;kdt
ktkle;dtktkled;tktkledi;ktkledis;tkledisk;klediske;lediskek;ediskekt;diskek
tg;iskektgg;skektgge;kektggek;ektggekt;ktggektp;tggektpa;ggektpav;gektpave;
ektpaveg;ktpavegi;tpavegia;pavegiae;avegiaev;vegiaevv;egiaevvk;giaevvkt;iae
vvktv;aevvktvg;evvktvge;vvktvgew;vktvgewl;ktvgewld;tvgewldg;vgewldgl;gewldg
li;ewldglik;wldglika;ldglikaa;dglikaae;glikaaeg;likaaegg;ikaaeggg;kaaegggk;
aaeggka;aegggkaa;egggkaad;gggkaadg;ggkaadgg;gkaadggg;kaadgggs;aadgggsd;adg
ggsdk;dgggsdki;gggsdkig;ggsdkign;gsdkignv;sdkignva;dkignvaa;kignvaag;ignvaa
gg;gnvaaggg;nvaaggga;vaagggag;aagggaga;agggagad;gggagadk;ggagadke;gagadkes;
agadkesv;gadkesvn;adkesvng;dkesvngi;kesvngia;esvngiag;svngiaga;vngiagai;ngi

Fig. 39 continued agaik; giagaikg; iagaikgi; agaikgiv; gaikgive; aikgivea; ikgiveaa; kgiveaak; giveaa
kk; iveaakkv; veaakkve; eaakkveg; aakkvegv; akkvegvk; kkvegvkf; kvegvkfa; vegvkfap;
egvkfapk; gvkfapka; vkfapkaa; kfapkaaa; fapkaaad; apkaaada; pkaaadaa; kaaadaaa; aaa
daaaa; aadaaaad; adaaaadg; daaaadgn; aaaadgnk; aaadgnkk; aadgnkka; adgnkkag; dgnkka
gk; gnkkagkl; nkkagklf; kkagklfg; kagklfgt; agklfgta; gklfgtaa; klfgtaag; lfgtaaga;
fgtaagad; gtaagada; taagadag; aagadagd;agadagdv;gadagdvk;adagdvkd;dagdvkda;agd vkdaa;gdvkdaaa;dvkdaaaa;vkdaaaav;kdaaaavg;daaaavga;aaaavgav;aaavgavs;aavgav sg;avgavsge;vgavsgeq;gavsgeqi;avsgeqil;vsgeqiln;sgeqilna;geqilnai;eqilnaiv; qilnaivt;ilnaivta;lnaivtaa;naivtaag;aivtaagq;ivtaagqa;vtaagqag;taagqagq;aag qagqa;agqagqag;gqagqagk;qagqagkk;agqagkka;gqagkkad;qagkkade;agkkadea;gkkade ak;kkadeakn;kadeakna;adeaknai;deaknaie;eaknaiea;aknaieaa;knaieaai;naieaaig; aieaaiga;ieaaigaa;eaaigaag;aaigaagd;aigaagda;igaagdad;gaagdadf;aagdadfg;agd adfgd;gdadfgdd;dadfgddi;adfgddik;dfgddikk;fgddikkk;gddikkkn;ddikkknd;dikkkn dq;ikkkndqi;kkkndqia;kkndqiaa;kndqiaaa;ndqiaaal;dqiaaalv;qiaaalvl;iaaalvlr; aaalvlrg;aalvlrgv;alvlrgva;lvlrgvak;vlrgvakd;lrgvakdg;rgvakdgk;gvakdgkf;vak dgkfa;akdgkfag;kdgkfaga;

9 mers:
mkkissaif;kkissaifi;kissaifiv;issaifiva;ssaifivaf;saifivafl;aifivafla;ifiva flal;fivaflali;ivaflalig;vaflaligc;aflaligck;flaligckn;laligcknn;aligcknnv; ligcknnvg;igcknnvgg;gcknnvggd;cknnvggdd;knnvggddk;nnvggddkk;nvggddkkd;vggdd kkdt;ggddkkdta;gddkkdtaa;ddkkdtaas;dkkdtaasi;kkdtaasif;kdtaasify;dtaasifyq; taasifyqs;aasifyqsi;asifyqsii;sifyqsiin;ifyqsiinl;fyqsiinlg;yqsiinlgn;qsiin lgng;siinlgngf;iinlgngfi;inlgngfie;nlgngfiev;lgngfievf;gngfievfn;ngfievfna; gfievfnaf;fievfnafs;ievfnafsg;evfnafsgl;vfnafsglv;fnafsglva;nafsglvad;afsgl vada;fsglvadaf;sglvadafs;glvadafsk;lvadafska;vadafskad;adafskadp;dafskadpk; afskadpkk;fskadpkks;skadpkksd;kadpkksdv;adpkksdvk;dpkksdvkt;pkksdvkty;kksdv ktyf;ksdvktyfd;sdvktyfds;dvktyfdsi;vktyfdsit;ktyfdsitk;tyfdsitkt;yfdsitktl; fdsitktlk;dsitktlkd;sitktlkdt;itktlkdtk;tktlkdtkt;ktlkdtktk;tlkdtktkl;lkdtk tkle;kdtktkled;dtktkledi;tktkledis;ktkledisk;tklediske;klediskek;lediskekt; ediskektg;diskektgg;iskektgge;skektggek;kektggekt;ektggektp;ktggektpa;tggek tpav;ggektpave;gektpaveg;ektpavegi;ktpavegia;tpavegiae;pavegiaev;avegiaevv; vegiaevvk;egiaevvkt;giaevvktv;iaevvktvg;aevvktvge;evvktvgew;vvktvgewl;vktvg ewld;ktvgewldg;tvgewldgl;vgewldgli;gewldglik;ewldglika;wldglikaa;ldglikaae; dglikaaeg;glikaaegg;likaaeggg;ikaaegggk;kaaegggka;aaegggkaa;aegggkaad;egggk aadg;gggkaadgg;ggkaadggg;gkaadgggs;kaadgggsd;aadgggsdk;adgggsdki;dgggsdkig; gggsdkign;ggsdkignv;gsdkignva;sdkignvaa;dkignvaag;kignvaagg;ignvaaggg;gnvaa ggga;nvaagggag;vaagggaga;aagggagad;agggagadk;gggagadke;ggagadkes;gagadkesv; agadkesvn;gadkesvng;adkesvngi;dkesvngia;kesvngiag;esvngiaga;svngiagai;vngia gaik;ngiagaikg;giagaikgi;iagaikgiv;agaikgive;gaikgivea;aikgiveaa;ikgiveaak; kgiveaakk;giveaakkv;iveaakkve;veaakkveg;eaakkvegv;aakkvegvk;akkvegvkf;kkveg vkfa;kvegvkfap;vegvkfapk;egvkfapka;gvkfapkaa;vkfapkaaa;kfapkaaad;fapkaaada; apkaaadaa;pkaaadaaa;kaaadaaaa;aaadaaaad;aadaaaadg;adaaaadgn;daaaadgnk;aaaad gnkk;aaadgnkka;aadgnkkag;adgnkkagk;dgnkkagkl;gnkkagklf;nkkagklfg;kkagklfgt; kagklfgta;agklfgtaa;gklfgtaag;klfgtaaga;lfgtaagad;fgtaagada;gtaagadag;taaga dagd;aagadagdv;agadagdvk;gadagdvkd;adagdvkda;dagdvkdaa;agdvkdaaa;gdvkdaaaa; dvkdaaaav;vkdaaaavg;kdaaaavga;daaaavgav;aaaavgavs;aaavgavsg;aavgavsge;avgav sgeq;vgavsgeqi;gavsgeqil;avsgeqiln;vsgeqilna;sgeqilnai;geqilnaiv;eqilnaivt; qilnaivta;ilnaivtaa;lnaivtaag;naivtaagq;aivtaagqa;ivtaagqag;vtaagqagq;taagq agqa;aagqagqag;agqagqagk;gqagqagkk;qagqagkka;agqagkkad;gqagkkade;qagkkadea; agkkadeak;gkkadeakn;kkadeakna;kadeaknai;adeaknaie;deaknaiea;eaknaieaa;aknai eaai;knaieaaig;naieaaiga;aieaaigaa;ieaaigaag;eaaigaagd;aaigaagda;aigaagdad; igaagdadf;gaagdadfg;aagdadfgd;agdadfgdd;gdadfgddi;dadfgddik;adfgddikk;dfgdd ikkk;fgddikkkn;gddikkknd;ddikkkndq;dikkkndqi;ikkkndqia;kkkndqiaa;kkndqiaaa;

Fig. 39 continued kndqiaaal;ndqiaaalv;dqiaaalvl;qiaaalvlr;iaaalvlrg;aaalvlrgv;aalvlrgva;alvlr
gvak;lvlrgvakd;vlrgvakdg;lrgvakdgk;rgvakdgkf;gvakdgkfa;vakdgkfag;akdgkfaga;

10 mers:
mkkissaifi;kkissaifiv;kissaifiva;issaifivaf;ssaifivafl;saifivafla;aifivafla
l;ifivaflali;fivaflalig;ivaflaligc;vaflaligck;aflaligckn;flaligcknn;laligck
nnv;aligcknnvg;ligcknnvgg;igcknnvggd;gcknnvggdd;cknnvggddk;knnvggddkk;nnvgg
ddkkd;nvggddkkdt;vggddkkdta;ggddkkdtaa;gddkkdtaas;ddkkdtaasi;dkkdtaasif;kkd
taasify;kdtaasifyq;dtaasifyqs;taasifyqsi;aasifyqsii;asifyqsiin;sifyqsiinl;i
fyqsiinlg;fyqsiinlgn;yqsiinlgng;qsiinlngnf;siinlgngfi;iinlgngfie;inlgngfiev
;nlgngfievf;lgngfievfn;gngfievfna;ngfievfnaf;gfievfnafs;fievfnafsg;ievfnafs
gl;evfnafsglv;vfnafsglva;fnafsglvad;nafsglvada;afsglvadaf;fsglvadafs;sglvad
afsk;glvadafska;lvadafskad;vadafskadp;adafskadpk;dafskadpkk;afskadpkks;fska
dpkksd;skadpkksdv;kadpkksdvk;adpkksdvkt;dpkksdvkty;pkksdvktyf;kksdvktyfd;ks
dvktyfds;sdvktyfdsi;dvktyfdsit;vktyfdsitk;ktyfdsitkt;tyfdsitktl;yfdsitktlk;
fdsitktlkd;dsitktlkdt;sitktlkdtk;itktlkdtkt;tktlkdtktk;ktlkdtktkl;tlkdtktkl
e;lkdtktkled;kdtktkledi;dtktkledis;tktkledisk;ktkledisk;tklediskek;kledisk
ekt;lediskektg;ediskektgg;diskektgge;iskektggek;skektggekt;kektggektp;ektgg
ektpa;ktggektpav;tggektpave;ggektpaveg;gektpavegi;ektpavegia;ktpavegiae;tpa
vegiaev;paveglaevv;avegiaevvk;vegiaevvkt;egiaevvktv;giaevvktvg;iaevvktvge;a
evvktvgew;evvktvgewl;vvktvgewld;vktvgewldg;ktvgewldgl;tvgewldgli;vgewldglik
;gewldglika;ewldglikaa;wldglikaae;ldglikaaeg;dglikaaegg;glikaaeggg;likaaegg
gk;ikaaegggka;kaaegggkaa;aaegggkaad;aegggkaadg;egggkaadgg;gggkaadggg;ggkaad
gggs;gkaadgggsd;kaadgggsdk;aadgggsdki;adgggsdkig;dgggsdkign;gggsdkignv;ggsd
kignva;gsdkignvaa;sdkignvaag;dkignvaagg;kignvaaggg;ignvaaggga;gnvaagggag;nv
aagggaga;vaagggagad;aagggagadk;agggagadke;gggagadkes;ggagadkesv;gagadkesvn;
agadkesvng;gadkesvngi;adkesvngia;dkesvngiag;kesvngiaga;esvngiagai;svngiagai
k;vngiagaikg;ngiagaikgi;giagaikgiv;iagaikgive;agaikgivea;gaikgiveaa;aikgive
aak;ikgiveaakk;kgiveaakkv;giveaakkve;iveaakkveg;veaakkvegv;eaakkvegvk;aakkv
egvkf;akkvegvkfa;kkvegvkfap;kvegvkfapk;vegvkfapka;egvkfapkaa;gvkfapkaaa;vkf
apkaaad;kfapkaaada;fapkaaadaa;apkaaadaaa;pkaaadaaaa;kaaadaaaad;aaadaaaadg;a
adaaaadgn;adaaaadgnk;daaaadgnkk;aaaadgnkka;aaadgnkkag;aadgnkkagk;adgnkkagkl
;dgnkkagklf;gnkkagklfg;nkkagklfgt;kkagklfgta;kagklfgtaa;agklfgtaag;gklfgtaa
ga;klfgtaagad;lfgtaagada;fgtaagadag;gtaagadagd;taagadagdv;aagadagdvk;agadag
dvkd;gadagdvkda;adagdvkdaa;dagdvkdaaa;agdvkdaaaa;gdvkdaaaav;dvkdaaaavg;vkda
aaavga;kdaaaavgav;daaaavgavs;aaaavgavsg;aaavgavsge;aavgavsgeq;avgavsgeqi;vg
avsgeqil;gavsgeqiln;avsgeqilna;vsgeqilnai;sgeqilnaiv;geqilnaivt;eqilnaivta;
qilnaivtaa;ilnaivtaag;lnaivtaagq;naivtaagqa;aivtaagqag;ivtaagqagq;vtaagqagq
a;taagqagqag;aagqagqagk;agqagqagkk;gqagqagkka;qagqagkkad;agqagkkade;gqagkka
dea;qagkkadeak;agkkadeakn;gkkadeakna;kkadeaknai;kadeaknaie;adeaknaiea;deakn
aieaa;eaknaieaai;aknaieaaig;knaieaaiga;naieaaigaa;aieaaigaag;ieaaigaagd;eaa
igaagda;aaigaagdad;aigaagdadf;igaagdadfg;gaagdadfgd;aagdadfgdd;agdadfgddi;g
dadfgddik;dadfgddikk;adfgddikkk;dfgddikkkn;fgddikkknd;gddikkkndq;ddikkkndqi
;dikkkndqia;ikkkndqiaa;kkkndqiaaa;kkndqiaaal;kndqiaaalv;ndqiaaalvl;dqiaaalv
lr;qiaaalvlrg;iaaalvlrgv;aaalvlrgva;aalvlrgvak;alvlrgvakd;lvlrgvakdg;vlrgva
kdgk;lrgvakdgkf;rgvakdgkfa;gvakdgkfag;vakdgkfaga;

11 mers:
mkkissaifiv;kkissaifiva;kissaifivaf;issaifivafl;ssaifivafla;saifivaflal;aif
ivaflali;ifivaflalig;fivaflaligc;ivaflaligck;vaflaligckn;aflaligcknn;flalig
cknnv;laligcknnvg;aligcknnvgg;ligcknnvggd;igcknnvggdd;gcknnvggddk;cknnvggdd
kk;knnvggddkkd;nnvggddkkdt;nvggddkkdta;vggddkkdtaa;ggddkkdtaas;gddkkdtaasi;
ddkkdtaasif;dkkdtaasify;kkdtaasifyq;kdtaasifyqs;dtaasifyqsi;taasifyqsii;aas
ifyqsiin;asifyqsiinl;sifyqsiinlg;ifyqsiinlgn;fyqsiinlgng;yqsiinlgngf;qsiinl
gngfi;siinlgngfie;iinlgngfiev;inlgngfievf;nlgngfievfn;lgngfievfna;gngfievfn

Fig. 39 continued af;ngfievfnafs;gfievfnafsg;fievfnafsgl;ievfnafsglv;evfnafsglva;vfnafsglvad;
fnafsglvada;nafsglvadaf;afsglvadafs;fsglvadafsk;sglvadafska;glvadafskad;lva
dafskadp;vadafskadpk;adafskadpkk;dafskadpkks;afskadpkksd;fskadpkksdv;skadpk
ksdvk;kadpkksdvkt;adpkksdvkty;dpkksdvktyf;pkksdvktyfd;kksdvktyfds;ksdvktyfd
si;sdvktyfdsit;dvktyfdsitk;vktyfdsitkt;ktyfdsitktl;tyfdsitktlk;yfdsitktlkd;
fdsitktlkdt;dsitktlkdtk;sitktlkdtkt;itktlkdtktk;tktlkdtktkl;ktlkdtktkle;tlk
dtktkled;lkdtktkledi;kdtktkledis;dtktkledisk;tktklediske;ktklediskek;tkledi
skekt;klediskektg;lediskektgg;ediskektgge;diskektggek;iskektggekt;skektggek
tp;kektggektpa;ektggektpav;ktggektpave;tggektpaveg;ggektpavegi;gektpavegia;
ektpavegiae;ktpavegiaev;tpavegiaevv;pavegiaevvk;avegiaevvkt;vegiaevvktv;egi
aevvktvg;giaevvktvge;iaevvktvgew;aevvktvgewl;evvktvgewld;vvktvgewldg;vktvge
wldgl;ktvgewldgli;tvgewldglik;vgewldglika;gewldglikaa;ewldglikaae;wldglikaa
eg;ldglikaaegg;dglikaaeggg;glikaaegggk;likaaegggka;ikaaegggkaa;kaaegggkaad;
aaegggkaadg;aegggkaadgg;egggkaadggg;gggkaadgggs;ggkaadgggsd;gkaadgggsdk;kaa
dgggsdki;aadgggsdkig;adgggsdkign;dgggsdkignv;gggsdkignva;ggsdkignvaa;gsdkig
nvaag;sdkignvaagg;dkignvaaggg;kignvaaggga;ignvaagggag;gnvaagggaga;nvaagggag
ad;vaagggagadk;aagggagadke;agggagadkes;gggagadkesv;ggagadkesvn;gagadkesvng;
agadkesvngi;gadkesvngia;adkesvngiag;dkesvngiaga;kesvngiagai;esvngiagaik;svn
giagaikg;vngiagaikgi;ngiagaikgiv;giagaikgive;iagaikgivea;agaikgiveaa;gaikgi
veaak;aikgiveaakk;ikgiveaakkv;kgiveaakkve;giveaakkveg;iveaakkvegv;veaakkveg
vk;eaakkvegvkf;aakkvegvkfa;akkvegvkfap;kkvegvkfapk;kvegvkfapka;vegvkfapkaa;
egvkfapkaaa;gvkfapkaaad;vkfapkaaada;kfapkaaadaa;fapkaaadaaa;apkaaadaaaa;pka
aadaaaad;kaaadaaaadg;aaadaaaadgn;aadaaaadgnk;adaaaadgnkk;daaaadgnkka;aaaadg
nkkag;aaadgnkkagk;aadgnkkagkl;adgnkkagklf;dgnkkagklfg;gnkkagklfgt;nkkagklfg
ta;kkagklfgtaa;kagklfgtaag;agklfgtaaga;gklfgtaagad;klfgtaagada;lfgtaagadag;
fgtaagadagd;gtaagadagdv;taagadagdvk;aagadagdvkd;agadagdvkda;gadagdvkdaa;ada
gdvkdaaa;dagdvkdaaaa;agdvkdaaaav;gdvkdaaaavg;dvkdaaaavga;vkdaaaavgav;kdaaaa
vgavs;daaaavgavsg;aaaavgavsge;aaavgavsgeq;aavgavsgeqi;avgavsgeqil;vgavsgeqi
ln;gavsgeqilna;avsgeqilnai;vsgeqilnaiv;sgeqilnaivt;geqilnaivta;eqilnaivtaa;
qilnaivtaag;ilnaivtaagq;lnaivtaagqa;naivtaagqag;aivtaagqagq;ivtaagqagqa;vta
agqagqag;taagqagqagk;aagqagqagkk;agqagqagkka;gqagqagkkad;qagqagkkade;agqagk
kadea;gqagkkadeak;qagkkadeakn;agkkadeakna;gkkadeaknai;kkadeaknaie;kadeaknai
ea;adeaknaieaa;deaknaieaai;eaknaieaaig;aknaieaaiga;knaieaaigaa;naieaaigaag;
aieaaigaagd;ieaaigaagda;eaaigaagdad;aaigaagdadf;aigaagdadfg;igaagdadfgd;gaa
gdadfgdd;aagdadfgddi;agdadfgddik;gdadfgddikk;dadfgddikkk;adfgddikkkn;dfgddi
kkknd;fgddikkkndq;gddikkkndqi;ddikkkndqia;dikkkndqiaa;ikkkndqiaaa;kkkndqiaa
al;kkndqiaaalv;kndqiaaalvl;ndqiaaalvlr;dqiaaalvlrg;qiaaalvlrgv;iaaalvlrgva;
aaalvlrgvak;aalvlrgvakd;alvlrgvakdg;lvlrgvakdgk;vlrgvakdgkf;lrgvakdgkfa;rgv
akdgkfag;gvakdgkfaga;

13 mers:
mkkissaifivaf;kkissaifivafl;kissaifivafla;issaifivaflal;ssaifivaflali;saifi
vaflalig;aifivaflaligc;ifivaflaligck;fivaflaligckn;ivaflaligcknn;vaflaligck
nnv;aflaligcknnvg;flaligcknnvgg;laligcknnvggd;aligcknnvggdd;ligcknnvggddk;i
gcknnvggddkk;gcknnvggddkkd;cknnvggddkkdt;knnvggddkkdta;nnvggddkkdtaa;nvggdd
kkdtaas;vggddkkdtaasi;ggddkkdtaasif;gddkkdtaasify;ddkkdtaasifyq;dkkdtaasify
qs;kkdtaasifyqsi;kdtaasifyqsii;dtaasifyqsiin;taasifyqsiinl;aasifyqsiinlg;as
ifyqsiinlgn;sifyqsiinlgng;ifyqsiinlgngf;fyqsiinlgngfi;yqsiinlgngfie;qsiinlg
ngfiev;siinlgngfievf;iinlgngfievfn;inlgngfievfna;nlgngfievfnaf;lgngfievfnaf
s;gngfievfnafsg;ngfievfnafsgl;gfievfnafsglv;fievfnafsglva;ievfnafsglvad;evf
nafsglvada;vfnafsglvadaf;fnafsglvadafs;nafsglvadafsk;afsglvadafska;fsglvada
fskad;sglvadafskadp;glvadafskadpk;lvadafskadpkk;vadafskadpkks;adafskadpkksd
;dafskadpkksdv;afskadpkksdvk;fskadpkksdvkt;skadpkksdvkty;kadpkksdvktyf;adpk
ksdvktyfd;dpkksdvktyfds;pkksdvktyfdsi;kksdvktyfdsit;ksdvktyfdsitk;sdvktyfds
itkt;dvktyfdsitktl;vktyfdsitktlk;ktyfdsitktlkd;tyfdsitktlkdt;yfdsitktlkdtk;

Fig. 39 continued fdsitktlkdtkt;dsitktlkdtktk;sitktlkdtktkl;itktlkdtktkle;tktlkdtktkled;ktlkd
tktkledi;tlkdtktkledis;lkdtktkledisk;kdtktklediske;dtktklediskek;tktkledisk
ekt;ktklediskektg;tklediskektgg;klediskektgge;lediskektggek;ediskektggekt;d
iskektggektp;iskektggektpa;skektggektpav;kektggektpave;ektggektpaveg;ktggek
tpavegi;tggektpavegia;ggektpavegiae;gektpavegiaev;ektpavegiaevv;ktpavegiaev
vk;tpavegiaevvkt;pavegiaevvktv;avegiaevvktvg;vegiaevvktvge;egiaevvktvgew;gi
aevvktvgewl;iaevvktvgewld;aevvktvgewldg;evvktvgewldgl;vvktvgewldgli;vktvgew
ldglik;ktvgewldglika;tvgewldglikaa;vgewldglikaae;gewldglikaaeg;ewldglikaaeg
g;wldglikaaeggg;ldglikaaegggk;dglikaaegggka;glikaaegggkaa;likaaegggkaad;ika
aegggkaadg;kaaegggkaadgg;aaegggkaadggg;aegggkaadgggs;egggkaadgggsd;gggkaadg
ggsdk;ggkaadgggsdki;gkaadgggsdkig;kaadgggsdkign;aadgggsdkignv;adgggsdkignva
;dgggsdkignvaa;gggsdkignvaag;ggsdkignvaagg;gsdkignvaaggg;sdkignvaaggga;dkig
nvaagggag;kignvaagggaga;ignvaagggagad;gnvaagggagadk;nvaagggagadke;vaagggaga
dkes;aagggagadkesv;agggagadkesvn;gggagadkesvng;ggagadkesvngi;gagadkesvngia;
agadkesvngiag;gadkesvngiaga;adkesvngiagai;dkesvngiagaik;kesvngiagaikg;esvng
iagaikgi;svngiagaikgiv;vngiagaikgive;ngiagaikgivea;giagaikgiveaa;iagaikgive
aak;agaikgiveaakk;gaikgiveaakkv;aikgiveaakkve;ikgiveaakkveg;kgiveaakkvegv;g
iveaakkvegvk;iveaakkvegvkf;veaakkvegvkfa;eaakkvegvkfap;aakkvegvkfapk;akkveg
vkfapka;kkvegvkfapkaa;kvegvkfapkaaa;vegvkfapkaaad;egvkfapkaaada;gvkfapkaaad
aa;vkfapkaaadaaa;kfapkaaadaaaa;fapkaaadaaaad;apkaaadaaaadg;pkaaadaaaadgn;ka
aadaaaadgnk;aaadaaaadgnkk;aadaaaadgnkka;adaaaadgnkkag;daaaadgnkkagk;aaaadgn
kkagkl;aaadgnkkagklf;aadgnkkagklfg;adgnkkagklfgt;dgnkkagklfgta;gnkkagklfgta
a;nkkagklfgtaag;kkagklfgtaaga;kagklfgtaagad;agklfgtaagada;gklfgtaagadag;klf
gtaagadagd;lfgtaagadagdv;fgtaagadagdvk;gtaagadagdvkd;taagadagdvkda;aagadagd
vkdaa;agadagdvkdaaa;gadagdvkdaaaa;adagdvkdaaaav;dagdvkdaaaavg;agdvkdaaaavga
;gdvkdaaaavgav;dvkdaaaavgavs;vkdaaaavgavsg;kdaaaavgavsge;daaaavgavsgeq;aaaa
vgavsgeqi;aaavgavsgeqil;aavgavsgeqiln;avgavsgeqilna;vgavsgeqilnai;gavsgeqil
naiv;avsgeqilnaivt;vsgeqilnaivta;sgeqilnaivtaa;geqilnaivtaag;eqilnaivtaagq;
qilnaivtaagqa;ilnaivtaagqag;lnaivtaagqagq;naivtaagqagqa;aivtaagqagqag;ivtaa
gqagqagk;vtaagqagqagkk;taagqagqagkka;aagqagqagkkad;agqagqagkkade;gqagqagkka
dea;qagqagkkadeak;agqagkkadeakn;gqagkkadeakna;qagkkadeaknai;agkkadeaknaie;g
kkadeaknaiea;kkadeaknaieaa;kadeaknaieaai;adeaknaieaaig;deaknaieaaiga;eaknai
eaaigaa;aknaieaaigaag;knaieaaigaagd;naieaaigaagda;aieaaigaagdad;ieaaigaagda
df;eaaigaagdadfg;aaigaagdadfgd;aigaagdadfgdd;igaagdadfgddi;gaagdadfgddik;aa
gdadfgddikk;agdadfgddikkk;gdadfgddikkkn;dadfgddikkknd;adfgddikkkndq;dfgddik
kkndqi;fgddikkkndqia;gddikkkndqiaa;ddikkkndqiaaa;dikkkndqiaaal;ikkkndqiaaal
v;kkkndqiaaalvl;kkndqiaaalvlr;kndqiaaalvlrg;ndqiaaalvlrgv;dqiaaalvlrgva;qia
aalvlrgvak;iaaalvlrgvakd;aaalvlrgvakdg;aalvlrgvakdgk;alvlrgvakdgkf;lvlrgvak
dgkfa;vlrgvakdgkfag;lrgvakdgkfaga;

14 mers:
mkkissaifivafl;kkissaifivafla;kissaifivaflal;issaifivaflali;ssaifivaflalig;
saifivaflaligc;aifivaflaligck;ifivaflaligckn;fivaflaligcknn;ivaflaligcknnv;
vaflaligcknnvg;aflaligcknnvgg;flaligcknnvggd;laligcknnvggdd;aligcknnvggddk;
ligcknnvggddkk;igcknnvggddkkd;gcknnvggddkkdt;cknnvggddkkdta;knnvggddkkdtaa;
nnvggddkkdtaas;nvggddkkdtaasi;vggddkkdtaasif;ggddkkdtaasify;gddkkdtaasifyq;
ddkkdtaasifyqs;dkkdtaasifyqsi;kkdtaasifyqsii;kdtaasifyqsiin;dtaasifyqsiinl;
taasifyqsiinlg;aasifyqsiinlgn;asifyqsiinlgng;sifyqsiinlgngf;ifyqsiinlgngfi;
fyqsiinlgngfie;yqsiinlgngfiev;qsiinlgngfievf;siinlgngfievfn;iinlgngfievfna;
inlgngfievfnaf;nlgngfievfnafs;lgngfievfnafsg;gngfievfnafsgl;ngfievfnafsglv;
gfievfnafsglva;fievfnafsglvad;ievfnafsglvada;evfnafsglvadaf;vfnafsglvadafs;
fnafsglvadafsk;nafsglvadafska;afsglvadafskad;fsglvadafskadp;sglvadafskadpk;
glvadafskadpkk;lvadafskadpkks;vadafskadpkksd;adafskadpkksdv;dafskadpkksdvk;
afskadpkksdvkt;fskadpkksdvkty;skadpkksdvktyf;kadpkksdvktyfd;adpkksdvktyfds;
dpkksdvktyfdsi;pkksdvktyfdsit;kksdvktyfdsitk;ksdvktyfdsitkt;sdvktyfdsitktl;

Fig. 39 continued dvktyfdsitktlk;vktyfdsitktlkd;ktyfdsitktlkdt;tyfdsitktlkdtk;yfdsitktlkdtkt;
fdsitktlkdtktk;dsitktlkdtktkl;sitktlkdtktkle;itktlkdtktkled;tktlkdtktkledi;
ktlkdtktkledis;tlkdtktkledisk;lkdtktklediske;kdtktklediskek;dtktklediskekt;
tktklediskektg;ktklediskektgg;tklediskektgge;klediskektggek;lediskektggekt;
ediskektggektp;diskektggektpa;iskektggektpav;skektggektpave;kektggektpaveg;
ektggektpavegi;ktggektpavegia;tggektpavegiae;ggektpavegiaev;gektpavegiaevv;
ektpavegiaevvk;ktpavegiaevvkt;tpavegiaevvktv;pavegiaevvktvg;avegiaevvktvge;
vegiaevvktvgew;egiaevvktvgewl;giaevvktvgewld;iaevvktvgewldg;aevvktvgewldgl;
evvktvgewldgli;vvktvgewldglik;vktvgewldglika;ktvgewldglikaa;tvgewldglikaae;
vgewldglikaaeg;gewldglikaaegg;ewldglikaaeggg;wldglikaaegggk;ldglikaaegggka;
dglikaaegggkaa;glikaaegggkaad;likaaegggkaadg;ikaaegggkaadgg;kaaegggkaadggg;
aaegggkaadgggs;aegggkaadgggsd;egggkaadgggsdk;gggkaadgggsdki;ggkaadgggsdkig;
gkaadgggsdkign;kaadgggsdkignv;aadgggsdkignva;adgggsdkignvaa;dgggsdkignvaag;
gggsdkignvaagg;ggsdkignvaaggg;gsdkignvaaggga;sdkignvaagggag;dkignvaagggaga;
kignvaagggagad;ignvaagggagadk;gnvaagggagadke;nvaagggagadkes;vaagggagadkesv;
aagggagadkesvn;agggagadkesvng;gggagadkesvngi;ggagadkesvngia;gagadkesvngiag;
agadkesvngiaga;gadkesvngiagai;adkesvngiagaik;dkesvngiagaikg;kesvngiagaikgi;
esvngiagaikgiv;svngiagaikgive;vngiagaikgivea;ngiagaikgiveaa;giagaikgiveaak;
iagaikgiveaakk;agaikgiveaakkv;gaikgiveaakkve;aikgiveaakkveg;ikgiveaakkvegv;
kgiveaakkvegvk;giveaakkvegvkf;iveaakkvegvkfa;veaakkvegvkfap;eaakkvegvkfapk;
aakkvegvkfapka;akkvegvkfapkaa;kkvegvkfapkaaa;kvegvkfapkaaad;vegvkfapkaaada;
egvkfapkaaadaa;gvkfapkaaadaaa;vkfapkaaadaaaa;kfapkaaadaaaad;fapkaaadaaaadg;
apkaaadaaaadgn;pkaaadaaaadgnk;kaaadaaaadgnkk;aaadaaaadgnkka;aadaaaadgnkkag;
adaaaadgnkkagk;daaaadgnkkagkl;aaaadgnkkagklf;aaadgnkkagklfg;aadgnkkagklfgt;
adgnkkagklfgta;dgnkkagklfgtaa;gnkkagklfgtaag;nkkagklfgtaaga;kkagklfgtaagad;
kagklfgtaagada;agklfgtaagadag;gklfgtaagadagd;klfgtaagadagdv;lfgtaagadagdvk;
fgtaagadagdvkd;gtaagadagdvkda;taagadagdvkdaa;aagadagdvkdaaa;agadagdvkdaaaa;
gadagdvkdaaaav;adagdvkdaaaavg;dagdvkdaaaavga;agdvkdaaaavgav;gdvkdaaaavgavs;
dvkdaaaavgavsg;vkdaaaavgavsge;kdaaaavgavsgeq;daaaavgavsgeqi;aaaavgavsgeqil;
aaavgavsgeqiln;aavgavsgeqilna;avgavsgeqilnai;vgavsgeqilnaiv;gavsgeqilnaivt;
avsgeqilnaivta;vsgeqilnaivtaa;sgeqilnaivtaag;geqilnaivtaagq;eqilnaivtaagqa;
qilnaivtaagqag;ilnaivtaagqagq;lnaivtaagqagqa;naivtaagqagqag;aivtaagqagqagk;
ivtaagqagqagkk;vtaagqagqagkka;taagqagqagkkad;aagqagqagkkade;agqagqagkkadea;
gqagqagkkadeak;qagqagkkadeakn;agqagkkadeakna;gqagkkadeaknai;qagkkadeaknaie;
agkkadeaknaiea;gkkadeaknaieaa;kkadeaknaieaai;kadeaknaieaaig;adeaknaieaaiga;
deaknaieaaigaa;eaknaieaaigaag;aknaieaaigaagd;knaieaaigaagda;naieaaigaagdad;
aieaaigaagdadf;ieaaigaagdadfg;eaaigaagdadfgd;aaigaagdadfgdd;aigaagdadfgddi;
igaagdadfgddik;gaagdadfgddikk;aagdadfgddikkk;agdadfgddikkkn;gdadfgddikkknd;
dadfgddikkkndq;adfgddikkkndqi;dfgddikkkndqia;fgddikkkndqiaa;gddikkkndqiaaa;
ddikkkndqiaaal;dikkkndqiaaalv;ikkkndqiaaalvl;kkkndqiaaalvlr;kkndqiaaalvlrg;
kndqiaaalvlrgv;ndqiaaalvlrgva;dqiaaalvlrgvak;qiaaalvlrgvakd;iaaalvlrgvakdg;
aaalvlrgvakdgk;aalvlrgvakdgkf;alvlrgvakdgkfa;lvlrgvakdgkfag;vlrgvakdgkfaga;

15 mers:
mkkissaifivafla;kkissaifivaflal;kissaifivaflali;issaifivaflalig;ssaifivafla
ligc;saifivaflaligck;aifivaflaligckn;ifivaflaligcknn;fivaflaligcknnv;ivafla
ligcknnvg;vaflaligcknnvgg;aflaligcknnvggd;flaligcknnvggdd;laligcknnvggddk;a
ligcknnvggddkk;ligcknnvggddkkd;igcknnvggddkkdt;gcknnvggddkkdta;cknnvggddkkd
taa;knnvggddkkdtaas;nnvggddkkdtaasi;nvggddkkdtaasif;vggddkkdtaasify;ggddkkd
taasifyq;gddkkdtaasifyqs;ddkkdtaasifyqsi;dkkdtaasifyqsii;kkdtaasifyqsiin;kd
taasifyqsiinl;dtaasifyqsiinlg;taasifyqsiinlgn;aasifyqsiinlgng;asifyqsiinlgn
gf;sifyqsiinlgngfi;ifyqsiinlgngfie;fyqsiinlgngfiev;yqsiinlgngfievf;qsiinlgn
gfievfn;siinlgngfievfna;iinlgngfievfnaf;inlgngfievfnafs;nlgngfievfnafsg;lgn
gfievfnafsgl;gngfievfnafsglv;ngfievfnafsglva;gfievfnafsglvad;fievfnafsglvad
a;ievfnafsglvadaf;evfnafsglvadafs;vfnafsglvadafsk;fnafsglvadafska;nafsglvad

Fig. 39 continued afskad;afsglvadafskadp;fsglvadafskadpk;sglvadafskadpkk;glvadafskadpkks;lvad
afskadpkksd;vadafskadpkksdv;adafskadpkksdvk;dafskadpkksdvkt;afskadpkksdvkty
;fskadpkksdvktyf;skadpkksdvktyfd;kadpkksdvktyfds;adpkksdvktyfdsi;dpkksdvkty
fdsit;pkksdvktyfdsitk;kksdvktyfdsitkt;ksdvktyfdsitktl;sdvktyfdsitktlk;dvkty fdsitktlkd;vktyfdsitktlkdt;ktyfdsitktlkdtk;tyfdsitktlkdtkt;yfdsitktlkdtktk; fdsitktlkdtktkl;dsitktlkdtktkle;sitktlkdtktkled;itktlkdtktkledi;tktlkdtktkl edis;ktlkdtktkledisk;tlkdtktklediske;lkdtktklediskek;kdtktklediskekt;dtktkl ediskektg;tktklediskektgg;ktklediskektgge;tklediskektggek;klediskektggekt;l ediskektggektp;ediskektggektpa;diskektggektpav;iskektggektpave;skektggektpa veg;kektggektpavegi;ektggektpavegia;ktggektpavegiae;tggektpavegiaev;ggektpa vegiaevv;gektpavegiaevvk;ektpavegiaevvkt;ktpavegiaevvktv;tpavegiaevvktvg;pa vegiaevvktvge;avegiaevvktvgew;vegiaevvktvgewl;egiaevvktvgewld;giaevvktvgewl dg;iaevvktvgewldgl;aevvktvgewldgli;evvktvgewldglik;vvktvgewldglika;vktvgewl dglikaa;ktvgewldglikaae;tvgewldglikaaeg;vgewldglikaaegg;gewldglikaaeggg;ewl dglikaaegggk;wldglikaaegggka;ldglikaaegggkaa;dglikaaegggkaad;glikaaegggkaad g;likaaegggkaadgg;ikaaegggkaadggg;kaaegggkaadgggs;aaegggkaadgggsd;aegggkaad gggsdk;egggkaadgggsdki;gggkaadgggsdkig;ggkaadgggsdkign;gkaadgggsdkignv;kaad gggsdkignva;aadgggsdkignvaa;adgggsdkignvaag;dgggsdkignvaagg;gggsdkignvaaggg ;ggsdkignvaaggga;gsdkignvaagggag;sdkignvaagggaga;dkignvaagggagad;kignvaaggg agadk;ignvaagggagadke;gnvaagggagadkes;nvaagggagadkesv;vaagggagadkesvn;aaggg agadkesvng;agggagadkesvngi;gggagadkesvngia;ggagadkesvngiag;gagadkesvngiaga; agadkesvngiagai;gadkesvngiagaik;adkesvngiagaikg;dkesvngiagaikgi;kesvngiagai kgiv;esvngiagaikgive;svngiagaikgivea;vngiagaikgiveaa;ngiagaikgiveaak;giagai kgiveaakk;iagaikgiveaakkv;agaikgiveaakkve;gaikgiveaakkveg;aikgiveaakkvegv;i kgiveaakkvegvk;kgiveaakkvegvkf;giveaakkvegvkfa;iveaakkvegvkfap;veaakkvegvkf apk;eaakkvegvkfapka;aakkvegvkfapkaa;akkvegvkfapkaaa;kkvegvkfapkaaad;kvegvkf apkaaada;vegvkfapkaaadaa;egvkfapkaaadaaa;gvkfapkaaadaaaa;vkfapkaaadaaaad;kf apkaaadaaaadg;fapkaaadaaaadgn;apkaaadaaaadgnk;pkaaadaaaadgnkk;kaaadaaaadgnk ka;aaadaaaadgnkkag;aadaaaadgnkkagk;adaaaadgnkkagkl;daaaadgnkkagklf;aaaadgnk kagklfg;aaadgnkkagklfgt;aadgnkkagklfgta;adgnkkagklfgtaa;dgnkkagklfgtaag;gnk kagklfgtaaga;nkkagklfgtaagad;kkagklfgtaagada;kagklfgtaagadag;agklfgtaagadag d;gklfgtaagadagdv;klfgtaagadagdvk;lfgtaagadagdvkd;fgtaagadagdvkda;gtaagadag dvkdaa;taagadagdvkdaaa;aagadagdvkdaaaa;agadagdvkdaaaav;gadagdvkdaaaavg;adag dvkdaaaavga;dagdvkdaaaavgav;agdvkdaaaavgavs;gdvkdaaaavgavsg;dvkdaaaavgavsge ;vkdaaaavgavsgeq;kdaaaavgavsgeqi;daaaavgavsgeqil;aaaavgavsgeqiln;aaavgavsge qilna;aavgavsgeqilnai;avgavsgeqilnaiv;vgavsgeqilnaivt;gavsgeqilnaivta;avsge qilnaivtaa;vsgeqilnaivtaag;sgeqilnaivtaagq;geqilnaivtaagqa;eqilnaivtaagqag; qilnaivtaagqagq;ilnaivtaagqagqa;lnaivtaagqagqag;naivtaagqagqagk;aivtaagqagq agkk;ivtaagqagqagkka;vtaagqagqagkkad;taagqagqagkkade;aagqagqagkkadea;agqagq agkkadeak;gqagqagkkadeakn;qagqagkkadeakna;agqagkkadeaknai;gqagkkadeaknaie;q agkkadeaknaiea;agkkadeaknaieaa;gkkadeaknaieaai;kkadeaknaieaaig;kadeaknaieaa iga;adeaknaieaaigaa;deaknaieaaigaag;eaknaieaaigaagd;aknaieaaigaagda;knaieaa igaagdad;naieaaigaagdadf;aieaaigaagdadfg;ieaaigaagdadfgd;eaaigaagdadfgdd;aa igaagdadfgddi;aigaagdadfgddik;igaagdadfgddikk;gaagdadfgddikkk;aagdadfgddikk kn;agdadfgddikkknd;gdadfgddikkkndq;dadfgddikkkndqi;adfgddikkkndqia;dfgddikk kndqiaa;fgddikkkndqiaaa;gddikkkndqiaaal;ddikkkndqiaaalv;dikkkndqiaaalvl;ikk kndqiaaalvlr;kkkndqiaaalvlrg;kkndqiaaalvlrgv;kndqiaaalvlrgva;ndqiaaalvlrgva k;dqiaaalvlrgvakd;qiaaalvlrgvakdg;iaaalvlrgvakdgk;aaalvlrgvakdgkf;aalvlrgva kdgkfa;alvlrgvakdgkfag;lvlrgvakdgkfaga;

16 mers:
mkkissaifivaflal;kkissaifivaflali;kissaifivaflalig;issaifivaflaligc;ssaifiv aflaligck;saifivaflaligckn;aifivaflaligcknn;ifivaflaligcknnv;fivaflaligcknn vg;ivaflaligcknnvgg;vaflaligcknnvggd;aflaligcknnvggdd;flaligcknnvggddk;lali gcknnvggddkk;aligcknnvggddkkd;ligcknnvggddkkdt;igcknnvggddkkdta;gcknnvggddk

Fig. 39 continued kdtaa;cknnvggddkkdtaas;knnvggddkkdtaasi;nnvggddkkdtaasif;nvggddkkdtaasify;v
ggddkkdtaasifyq;ggddkkdtaasifyqs;gddkkdtaasifyqsi;ddkkdtaasifyqsii;dkkdtaas
ifyqsiin;kkdtaasifyqsiinl;kdtaasifyqsiinlg;dtaasifyqsiinlgn;taasifyqsiinlgn
g;aasifyqsiinlgngf;asifyqsiinlgngfi;sifyqsiinlgngfie;ifyqsiinlgngfiev;fyqsi
inlgngfievf;yqsiinlgngfievfn;qsiinlgngfievfna;siinlgngfievfnaf;iinlgngfievf
nafs;inlgngfievfnafsg;nlgngfievfnafsgl;lgngfievfnafsglv;gngfievfnafsglva;ng
fievfnafsglvad;gfievfnafsglvada;fievfnafsglvadaf;ievfnafsglvadafs;evfnafsgl
vadafsk;vfnafsglvadafska;fnafsglvadafskad;nafsglvadafskadp;afsglvadafskadpk
;fsglvadafskadpkk;sglvadafskadpkks;glvadafskadpkksd;lvadafskadpkksdv;vadafs
kadpkksdvk;adafskadpkksdvkt;dafskadpkksdvkty;afskadpkksdvktyf;fskadpkksdvkt
yfd;skadpkksdvktyfds;kadpkksdvktyfdsi;adpkksdvktyfdsit;dpkksdvktyfdsitk;pkk
sdvktyfdsitkt;kksdvktyfdsitktl;ksdvktyfdsitktlk;sdvktyfdsitktlkd;dvktyfdsit
ktlkdt;vktyfdsitktlkdtk;ktyfdsitktlkdtkt;tyfdsitktlkdtktk;yfdsitktlkdtktkl;
fdsitktlkdtktkle;dsitktlkdtktkled;sitktlkdtktkledi;itktlkdtktkledis;tktlkdt
ktkledisk;ktlkdtktklediske;tlkdtktklediskek;lkdtktklediskekt;kdtktklediskek
tg;dtktklediskektgg;tktklediskektgge;ktklediskektggek;tklediskektggekt;kled
iskektggektp;lediskektggektpa;ediskektggektpav;diskektggektpave;iskektggekt
paveg;skektggektpavegi;kektggektpavegia;ektggektpavegiae;ktggektpavegiaev;t
ggektpavegiaevv;ggektpavegiaevvk;gektpavegiaevvkt;ektpavegiaevvktv;ktpavegi
aevvktvg;tpavegiaevvktvge;pavegiaevvktvgew;avegiaevvktvgewl;vegiaevvktvgewl
d;egiaevvktvgewldg;giaevvktvgewldgl;iaevvktvgewldgli;aevvktvgewldglik;evvkt
vgewldglika;vvktvgewldglikaa;vktvgewldglikaae;ktvgewldglikaaeg;tvgewldglika
aegg;vgewldglikaaeggg;gewldglikaaegggk;ewldglikaaegggka;wldglikaaegggkaa;ld
glikaaegggkaad;dglikaaegggkaadg;glikaaegggkaadgg;likaaegggkaadggg;ikaaegggk
aadgggs;kaaegggkaadgggsd;aaegggkaadgggsdk;aegggkaadgggsdki;egggkaadgggsdkig
;gggkaadgggsdkign;ggkaadgggsdkignv;gkaadgggsdkignva;kaadgggsdkignvaa;aadggg
sdkignvaag;adgggsdkignvaagg;dgggsdkignvaaggg;gggsdkignvaaggga;ggsdkignvaagg
gag;gsdkignvaagggaga;sdkignvaagggagad;dkignvaagggagadk;kignvaagggagadke;ign
vaagggagadkes;gnvaagggagadkesv;nvaagggagadkesvn;vaagggagadkesvng;aagggagadk
esvngi;agggagadkesvngia;gggagadkesvngiag;ggagadkesvngiaga;gagadkesvngiagai;
agadkesvngiagaik;gadkesvngiagaikg;adkesvngiagaikgi;dkesvngiagaikgiv;kesvngi
agaikgive;esvngiagaikgivea;svngiagaikgiveaa;vngiagaikgiveaak;ngiagaikgiveaa
kk;giagaikgiveaakkv;iagaikgiveaakkve;agaikgiveaakkveg;gaikgiveaakkvegv;aikg
iveaakkvegvk;ikgiveaakkvegvkf;kgiveaakkvegvkfa;giveaakkvegvkfap;iveaakkvegv
kfapk;veaakkvegvkfapka;eaakkvegvkfapkaa;aakkvegvkfapkaaa;akkvegvkfapkaaad;k
kvegvkfapkaaada;kvegvkfapkaaadaa;vegvkfapkaaadaaa;egvkfapkaaadaaaa;gvkfapka
aadaaaad;vkfapkaaadaaaadg;kfapkaaadaaaadgn;fapkaaadaaaadgnk;apkaaadaaaadgnk
k;pkaaadaaaadgnkka;kaaadaaaadgnkkag;aaadaaaadgnkkagk;aadaaaadgnkkagkl;adaaa
adgnkkagklf;daaaadgnkkagklfg;aaaadgnkkagklfgt;aaadgnkkagklfgta;aadgnkkagklf
gtaa;adgnkkagklfgtaag;dgnkkagklfgtaaga;gnkkagklfgtaagad;nkkagklfgtaagada;kk
agklfgtaagadag;kagklfgtaagadagd;agklfgtaagadagdv;gklfgtaagadagdvk;klfgtaaga
dagdvkd;lfgtaagadagdvkda;fgtaagadagdvkdaa;gtaagadagdvkdaaa;taagadagdvkdaaaa
;aagadagdvkdaaaav;agadagdvkdaaaavg;gadagdvkdaaaavga;adagdvkdaaaavgav;dagdvk
daaaavgavs;agdvkdaaaavgavsg;gdvkdaaaavgavsge;dvkdaaaavgavsgeq;vkdaaaavgavsg
eqi;kdaaaavgavsgeqil;daaaavgavsgeqiln;aaaavgavsgeqilna;aaavgavsgeqilnai;aav
gavsgeqilnaiv;avgavsgeqilnaivt;vgavsgeqilnaivta;gavsgeqilnaivtaa;avsgeqilna
ivtaag;vsgeqilnaivtaagq;sgeqilnaivtaagqa;geqilnaivtaagqag;eqilnaivtaagqagq;
qilnaivtaagqagqa;ilnaivtaagqagqag;lnaivtaagqagqagk;naivtaagqagqagkk;aivtaag
qagqagkka;ivtaagqagqagkkad;vtaagqagqagkkade;taagqagqagkkadea;aagqagqagkkade
ak;agqagqagkkadeakn;gqagqagkkadeakna;qagqagkkadeaknai;agqagkkadeaknaie;gqag
kkadeaknaiea;qagkkadeaknaieaa;agkkadeaknaieaai;gkkadeaknaieaaig;kkadeaknaie
aaiga;kadeaknaieaaigaa;adeaknaieaaigaag;deaknaieaaigaagd;eaknaieaaigaagda;a
knaieaaigaagdad;knaieaaigaagdadf;naieaaigaagdadfg;aieaaigaagdadfgd;ieaaigaa
gdadfgdd;eaaigaagdadfgddi;aaigaagdadfgddik;aigaagdadfgddikk;igaagdadfgddikk
k;gaagdadfgddikkkn;aagdadfgddikkknd;agdadfgddikkkndq;gdadfgddikkkndqi;dadfg

Fig. 39 continued ddikkkndqia;adfgddikkkndqiaa;dfgddikkkndqiaaa;fgddikkkndqiaaal;gddikkkndqia
aalv;ddikkkndqiaaalvl;dikkkndqiaaalvlr;ikkkndqiaaalvlrg;kkkndqiaaalvlrgv;kk
ndqiaaalvlrgva;kndqiaaalvlrgvak;ndqiaaalvlrgvakd;dqiaaalvlrgvakdg;qiaaalvlr
gvakdgk;iaaalvlrgvakdgkf;aaalvlrgvakdgkfa;aalvlrgvakdgkfag;alvlrgvakdgkfaga
;

<CAF34027 outer surface protein VlsE;Protein;Borrelia afzelii PKo>
Seq ID No 168854-171149

8 mers:
mkkissai;kkissaif;kissaifl;issaiflt;ssaiflta;saifltal;aifltall;ifltallv;flt
allvf;ltallvfi;tallvfin;allvfinc;llvfinck;lvfinckn;vfincknn;fincknna;incknn
av;ncknnavg;cknnavgk;knnavgkg;nnavgkgn;navgkgnd;avgkgndd;vgkgnddk;gkgnddkd;
kgnddkds;gnddkdsv;nddkdsvk;ddkdsvkt;dkdsvktf;kdsvktfy;dsvktfye;svktfyes;vkt
fyesi;ktfyesii;tfyesiin;fyesiinl;yesiinlg;esiinlgn;siinlgng;iinlgngf;inlgng
fi;nlgngfid;lgngfidv;gngfidvf;ngfidvfn;gfidvfna;fidvfnaf;idvfnafs;dvfnafsg;
vfnafsgl;fnafsglv;nafsglva;afsglvad;fsglvadt;sglvadtf;glvadtff;lvadtffk;vad
tffks;adtffksd;dtffksdp;tffksdpk;ffksdpkk;fksdpkks;ksdpkksd;sdpkksdv;dpkksd
vk;pkksdvkt;kksdvkty;ksdvktyf;sdvktyfe;dvktyfes;vktyfesi;ktyfesis;tyfesiss;
yfesisst;fesisstl;esisstlk;sisstlka;isstlkat;sstlkatk;stlkatkg;tlkatkgk;lka
tkgkl;katkgkld;atkgklde;tkgkldel;kgkldelv;gkldelvs;kldelvsa;ldelvsak;delvsa
kk;elvsakkg;lvsakkge;vsakkgeg;sakkgegg;akkgeggs;kkgeggsv;kgeggsvk;geggsvka;
eggsvkas;ggsvkasv;gsvkasve;svkasves;vkasvesa;kasvesav;asvesavd;svesavde;ves
avdev;esavdevs;savdevsk;avdevskw;vdevskwl;devskwle;evskwlee;vskwleem;skwlee
mi;kwleemik;wleemika;leemikaa;eemikaae;emikaaee;mikaaeea;ikaaeeaa;kaaeeaak;
aaeeaakv;aeeaakvg;eeaakvgg;eaakvggt;aakvggtg;akvggtgg;kvggtggd;vggtggdg;ggt
ggdgk;gtggdgki;tggdgkig;ggdgkigd;gdgkigds;dgkigdsa;gkigdsaa;kigdsaan;igdsaa
nh;gdsaanhg;dsaanhga;saanhgak;aanhgaka;anhgakad;nhgakadk;hgakadkd;gakadkds;
akadkdsv;kadkdsvk;adkdsvkg;dkdsvkgi;kdsvkgia;dsvkgiak;svkgiakg;vkgiakgi;kgi
akgik;giakgikg;iakgikgi;akgikgiv;kgikgivd;gikgivda;ikgivdaa;kgivdaag;givdaa
gk;ivdaagka;vdaagkal;daagkalg;aagkalge;agkalgek;gkalgekg;kalgekga;algekgal;
lgekgalk;gekgalkd;ekgalkdv;kgalkdvk;galkdvka;alkdvkaa;lkdvkaaa;kdvkaaad;dvk
aaaadd;vkaaadde;kaaaddea;aaaddean;aaddeana;addeanad;ddeanada;deanadag;eanada
gk;anadagkl;nadagklf;adagklfa;dagklfag;agklfagn;gklfagna;klfagnan;lfagnana;
fagnanaa;agnanaav;gnanaavg;nanaavga;anaavgaa;naavgaaa;aavgaaad;avgaaadi;vga
aadia;gaaadiak;aaadiaka;aadiakaa;adiakaag;diakaaga;iakaagav;akaagavt;kaagav
ta;aagavtav;agavtavs;gavtavsg;avtavsge;vtavsgeq;tavsgeqi;avsgeqil;vsgeqilk;
sgeqilka;geqilkai;eqilkaiv;qilkaive;ilkaivea;lkaiveaa;kaiveaag;aiveaagd;ive
aagdp;veaagdpa;eaagdpan;aagdpanq;agdpanqa;gdpanqag;dpanqagk;panqagkk;anqagk
ka;nqagkkae;qagkkaee;agkkaeea;gkkaeeak;kkaeeakn;kaeeaknp;aeeaknpi;eeaknpia;
eaknpiaa;aknpiaaa;knpiaaai;npiaaaig;piaaaigt;iaaaigtd;aaaigtdd;aaigtddd;aig
tdddn;igtdddng;gtdddnga;tdddngaa;dddngaaf;ddngaafk;dngaafkd;ngaafkde;gaafkd
em;aafkdemk;afkdemkk;fkdemkks;kdemkksd;demkksdk;emkksdki;mkksdkia;kksdkiaa;
ksdkiaaa;sdkiaaai;dkiaaaiv;kiaaaivl;iaaaivlr;aaaivlrg;aaivlrgv;aivlrgva;ivl
rgvak;vlrgvakd;lrgvakdg;rgvakdgk;gvakdgkf;vakdgkfa;akdgkfav;kdgkfavk;

9 mers:
mkkissaif;kkissaifl;kissaiflt;issaiflta;ssaifltal;saifltall;aifltallv;iflta
llvf;fltallvfi;ltallvfin;tallvfinc;allvfinck;llvfinckn;lvfincknn;vfincknna;
fincknnav;incknnavg;ncknnavgk;cknnavgkg;knnavgkgn;nnavgkgnd;navgkgndd;avgkg
nddk;vgkgnddkd;gkgnddkds;kgnddkdsv;gnddkdsvk;nddkdsvkt;ddkdsvktf;dkdsvktfy;
kdsvktfye;dsvktfyes;svktfyesi;vktfyesii;ktfyesiin;tfyesiinl;fyesiinlg;yesii
nlgn;esiinlgng;siinlgngf;iinlgngfi;inlgngfid;nlgngfidv;lgngfidvf;gngfidvfn;
ngfidvfna;gfidvfnaf;fidvfnafs;idvfnafsg;dvfnafsgl;vfnafsglv;fnafsglva;nafsg lvad;afsglvadt;fsglvadtf;sglvadtff;glvadtffk;lvadtffks;vadtffksd;adtffksdp;
dtffksdpk;tffksdpkk;ffksdpkks;fksdpkksd;ksdpkksdv;sdpkksdvk;dpkksdvkt;pkksd
vkty;kksdvktyf;ksdvktyfe;sdvktyfes;dvktyfesi;vktyfesis;ktyfesiss;tyfesisst;
yfesisstl;fesisstlk;esisstlka;sisstlkat;isstlkatk;sstlkatkg;stlkatkgk;tlkat
kgkl;lkatkgkld;katkgklde;atkgkldel;tkgkldelv;kgkldelvs;gkldelvsa;kldelvsak;
ldelvsakk;delvsakkg;elvsakkge;lvsakkgeg;vsakkgegg;sakkgeggs;akkgeggsv;kkgeg
gsvk;kgeggsvka;geggsvkas;eggsvkasv;ggsvkasve;gsvkasves;svkasvesa;vkasvesav;
kasvesavd;asvesavde;svesavdev;vesavdevs;esavdevsk;savdevskw;avdevskwl;vdevs
kwle;devskwlee;evskwleem;vskwleemi;skwleemik;kwleemika;wleemikaa;leemikaae;
eemikaaee;emikaaeea;mikaaeeaa;ikaaeeaak;kaaeeaakv;aaeeaakvg;aeeaakvgg;eeaak
vggt;eaakvggtg;aakvggtgg;akvggtggd;kvggtggdg;vggtggdgk;ggtggdgki;gtggdgkig;
tggdgkigd;ggdgkigds;gdgkigdsa;dgkigdsaa;gkigdsaan;kigdsaanh;igdsaanhg;gdsaa
nhga;dsaanhgak;saanhgaka;aanhgakad;anhgakadk;nhgakadkd;hgakadkds;gakadkdsv;
akadkdsvk;kadkdsvkg;adkdsvkgi;dkdsvkgia;kdsvkgiak;dsvkgiakg;svkgiakgi;vkgia
kgik;kgiakgikg;giakgikgi;iakgikgiv;akgikgivd;kgikgivda;gikgivdaa;ikgivdaag;
kgivdaagk;givdaagka;ivdaagkal;vdaagkalg;daagkalge;aagkalgek;agkalgekg;gkalg
ekga;kalgekgal;algekgalk;lgekgalkd;gekgalkdv;ekgalkdvk;kgalkdvka;galkdvkaa;
alkdvkaaa;lkdvkaaad;kdvkaaadd;dvkaaadde;vkaaaddea;kaaaddean;aaaddeana;aadde
anad;addeanada;ddeanadag;deanadagk;eanadagkl;anadagklf;nadagklfa;adagklfag;
dagklfagn;agklfagna;gklfagnan;klfagnana;lfagnanaa;fagnanaav;agnanaavg;gnana
avga;nanaavgaa;anaavgaaa;naavgaaad;aavgaaadi;avgaaadia;vgaaadiak;gaaadiaka;
aaadiakaa;aadiakaag;adiakaaga;diakaagav;iakaagavt;akaagavta;kaagavtav;aagav
tavs;agavtavsg;gavtavsge;avtavsgeq;vtavsgeqi;tavsgeqil;avsgeqilk;vsgeqilka;
sgeqilkai;geqilkaiv;eqilkaive;qilkaivea;ilkaiveaa;lkaiveaag;kaiveaagd;aivea
agdp;iveaagdpa;veaagdpan;eaagdpanq;aagdpanqa;agdpanqag;gdpanqagk;dpanqagkk;
panqagkka;anqagkkae;nqagkkaee;qagkkaeea;agkkaeeak;gkkaeeakn;kkaeeaknp;kaeea
knpi;aeeaknpia;eeaknpiaa;eaknpiaaa;aknpiaaai;knpiaaaig;npiaaaigt;piaaaigtd;
iaaaigtdd;aaaigtddd;aaigtdddn;aigtdddng;igtdddnga;gtdddngaa;tdddngaaf;dddng
aafk;ddngaafkd;dngaafkde;ngaafkdem;gaafkdemk;aafkdemkk;afkdemkks;fkdemkksd;
kdemkksdk;demkksdki;emkksdkia;mkksdkiaa;kksdkiaaa;ksdkiaaai;sdkiaaaiv;dkiaa
aivl;kiaaaivlr;iaaaivlrg;aaaivlrgv;aaivlrgva;aivlrgvak;ivlrgvakd;vlrgvakdg;
lrgvakdgk;rgvakdgkf;gvakdgkfa;vakdgkfav;akdgkfavk;

10 mers:
mkkissaifl;kkissaiflt;kissaiflta;issaifltal;ssaifltall;saifltallv;aifltallv
f;ifltallvfi;fltallvfin;ltallvfinc;tallvfinck;allvfinckn;llvfincknn;lvfinck
nna;vfincknnav;fincknnavg;incknnavgk;ncknnavgkg;cknnavgkgn;knnavgkgnd;nnavg
kgndd;navgkgnddk;avgkgnddkd;vgkgnddkds;gkgnddkdsv;kgnddkdsvk;gnddkdsvkt;ndd
kdsvktf;ddkdsvktfy;dkdsvktfye;kdsvktfyes;dsvktfyesi;svktfyesii;vktfyesiin;k
tfyesiinl;tfyesiinlg;fyesiinlgn;yesiinlgng;esiinlgngf;siinlgngfi;iinlgngfid
;inlgngfidv;nlgngfidvf;lgngfidvfn;gngfidvfna;ngfidvfnaf;gfidvfnafs;fidvfnaf
sg;idvfnafsgl;dvfnafsglv;vfnafsglva;fnafsglvad;nafsglvadt;afsglvadtf;fsglva
dtff;sglvadtffk;glvadtffks;lvadtffksd;vadtffksdp;adtffksdpk;dtffksdpkk;tffk
sdpkks;ffksdpkksd;fksdpkksdv;ksdpkksdvk;sdpkksdvkt;dpkksdvkty;pkksdvktyf;kk
sdvktyfe;ksdvktyfes;sdvktyfesi;dvktyfesis;vktyfesiss;ktyfesisst;tyfesisstl;
yfesisstlk;fesisstlka;esisstlkat;sisstlkatk;isstlkatkg;sstlkatkgk;stlkatkgk
l;tlkatkgkld;lkatkgklde;katkgkldel;atkgkldelv;tkgkldelvs;kgkldelvsa;gkldelv
sak;kldelvsakk;ldelvsakkg;delvsakkge;elvsakkgeg;lvsakkgegg;vsakkgeggs;sakkg
eggsv;akkgeggsvk;kkgeggsvka;kgeggsvkas;geggsvkasv;eggsvkasve;ggsvkasves;gsv
kasvesa;svkasvesav;vkasvesavd;kasvesavde;asvesavdev;svesavdevs;vesavdevsk;e
savdevskw;savdevskwl;avdevskwle;vdevskwlee;devskwleem;evskwleemi;vskwleemik
;skwleemika;kwleemikaa;wleemikaae;leemikaaee;eemikaaeea;emikaaeeaa;mikaaeea
ak;ikaaeeaakv;kaaeeaakvg;aaeeaakvgg;aeeaakvggt;eeaakvggtg;eaakvggtgg;aakvgg
tggd;akvggtggdg;kvggtggdgk;vggtggdgki;ggtggdgkig;gtggdgkigd;tggdgkigds;ggdg
kigdsa;gdgkigdsaa;dgkigdsaan;gkigdsaanh;kigdsaanhg;igdsaanhga;gdsaanhgak;ds

Fig. 39 continued aanhgaka; saanhgakad; aanhgakadk; anhgakadkd; nhgakadkds; hgakadkdsv; gakadkdsvk; akadkdsvkg; kadkdsvkgi; adkdsvkgia; dkdsvkgiak; kdsvkgiakg; dsvkgiakgi; svkgiakgi k; vkgiakgikg; kgiakgikgi; giakgikgiv; iakgikgivd; akgikgivda; kgikgivdaa; gikgivd aag; ikgivdaagk; kgivdaagka; givdaagkal; ivdaagkalg; vdaagkalge; daagkalgek; aagka lgekg; agkalgekga; gkalgekgal; kalgekgalk; algekgalkd; lgekgalkdv; gekgalkdvk; ekg alkdvka; kgalkdvkaa; galkdvkaaa; alkdvkaaad; lkdvkaaadd; kdvkaaadde; dvkaaaddea; v kaaaddean; kaaaddeana; aaaddeanad; aaddeanada; addeanadag; ddeanadagk; deanadagkl ; eanadagklf; anadagklfa; nadagklfag; adagklfagn; dagklfagna; agklfagnan; gklfagna na; klfagnanaa; lfagnanaav; fagnanaavg; agnanaavga; gnanaavgaa; nanaavgaaa; anaavg aaad; naavgaaadi; aavgaaadia; avgaaadiak; vgaaadiaka; gaaadiakaa; aaadiakaag; aadi akaaga; adiakaagav; diakaagavt; iakaagavta; akaagavtav; kaagavtavs; aagavtavsg; ag avtavsge; gavtavsgeq; avtavsgeqi; vtavsgeqil; tavsgeqilk; avsgeqilka; vsgeqilkai; sgeqilkaiv; geqilkaive; eqilkaivea; qilkaiveaa; ilkaiveaag; lkaiveaagd; kaiveaagd p; aiveaagdpa; iveaagdpan; veaagdpanq; eaagdpanqa; aagdpanqag; agdpanqagk; gdpanqa gkk; dpanqagkka; panqagkkae; anqagkkaee; nqagkkaeea; qagkkaeeak; agkkaeeakn; gkkae eaknp; kkaeeaknpi; kaeeaknpia; aeeaknpiaa; eeaknpiaaa; eaknpiaaai; aknpiaaaig; knp iaaaigt; npiaaaigtd; piaaaigtdd; iaaaigtddd; aaaigtdddn; aaigtdddng; aigtdddnga; i gtdddngaa; gtdddngaaf; tdddngaafk; dddngaafkd; ddngaafkde; dngaafkdem; ngaafkdemk ; gaafkdemkk; aafkdemkks; afkdemkksd; fkdemkksdk; kdemkksdki; demkksdkia; emkksdki aa; mkksdkiaaa; kksdkiaaai; ksdkiaaaiv; sdkiaaaivl; dkiaaaivlr; kiaaaivlrg; iaaaiv lrgv; aaaivlrgva; aaivlrgvak; aivlrgvakd; ivlrgvakdg; vlrgvakdgk; lrgvakdgkf; rgva kdgkfa; gvakdgkfav; vakdgkfavk;

11 mers:
mkkissaiflt; kkissaiflta; kissaifltal; issaifltall; ssaifltallv; saifltallvf; aif ltallvfi; ifltallvfin; fltallvfinc; ltallvfinck; tallvfinckn; allvfincknn; llvfin cknna; lvfincknnav; vfincknnavg; fincknnavgk; incknnavgkg; ncknnavgkgn; cknnavgkg nd; knnavgkgndd; nnavgkgnddk; navgkgnddkd; avgkgnddkds; vgkgnddkdsv; gkgnddkdsvk; kgnddkdsvkt; gnddkdsvktf; nddkdsvktfy; ddkdsvktfye; dkdsvktfyes; kdsvktfyesi; dsv ktfyesii; svktfyesiin; vktfyesiinl; ktfyesiinlg; tfyesiinlgn; fyesiinlgng; yesiin lgngf; esiinlgngfi; siinlgngfid; iinlgngfidv; inlgngfidvf; nlgngfidvfn; lgngfidvf na; qngfidvfnaf; ngfidvfnafs; gfidvfnafsg; fidvfnafsgl; idvfnafsglv; dvfnafsglva; vfnafsglvad; fnafsglvadt; nafsglvadtf; afsglvadtff; fsglvadtffk; sglvadtffks; glv adtffksd; lvadtffksdp; vadtffksdpk; adtffksdpkk; dtffksdpkks; tffksdpkksd; ffksdp kksdv; fksdpkksdvk; ksdpkksdvkt; sdpkksdvkty; dpkksdvktyf; pkksdvktyfe; kksdvktyf es; ksdvktyfesi; sdvktyfesis; dvktyfesiss; vktyfesisst; ktyfesisstl; tyfesisstlk; yfesisstlka; fesisstlkat; esisstlkatk; sisstlkatkg; isstlkatkgk; sstlkatkgkl; stl katgkld; tlkatkgklde; lkatkgkldel; katkgkldelv; atkgkldelvs; tkgkldelvsa; kgklde lvsak; gkldelvsakk; kldelvsakkg; ldelvsakkge; delvsakkgeg; elvsakkgegg; lvsakkgeg gs; vsakkgeggsv; sakkgeggsvk; akkgeggsvka; kkgeggsvkas; kgeggsvkasv; geggsvkasve; eggsvkasves; ggsvkasvesa; gsvkasvesav; svkasvesavd; vkasvesavde; kasvesavdev; asv esavdevs; svesavdevsk; vesavdevskw; esavdevskwl; savdevskwle; avdevskwlee; vdevsk wleem; devskwleemi; evskwleemik; vskwleemika; skwleemikaa; kwleemikaae; wleemikaa ee; leemikaaeea; eemikaaeeaa; emikaaeeaak; mikaaeeaakv; ikaaeeaakvg; kaaeeaakvgg; aaeeaakvggt; aeeaakvggtg; eeaakvggtgg; eaakvggtggd; aakvggtggdg; akvggtggdgk; kvg gtggdgki; vggtggdgkig; ggtggdgkigd; gtggdgkigds; tggdgkigdsa; ggdgkigdsaa; gdgkig dsaan; dgkigdsaanh; gkigdsaanhg; kigdsaanhga; igdsaanhgak; gdsaanhgaka; dsaanhgak ad; saanhgakadk; aanhgakadkd; anhgakadkds; nhgakadkdsv; hgakadkdsvk; gakadkdsvkg; akadkdsvkgi; kadkdsvkgia; adkdsvkgiak; dkdsvkgiakg; kdsvkgiakgi; dsvkgiakgik; svk giakgikg; vkgiakgikgi; kgiakgikgiv; giakgikgivd; iakgikgivda; akgikgivdaa; kgikgi vdaag; gikgivdaagk; ikgivdaagka; kgivdaagkal; givdaagkalg; ivdaagkalge; vdaagkalg ek; daagkalgekg; aagkalgekga; agkalgekgal; gkalgekgalk; kalgekgalkd; algekgalkdv; lgekgalkdvk; gekgalkdvka; ekgalkdvkaa; kgalkdvkaaa; galkdvkaaad; alkdvkaaadd; lkd vkaaadde; kdvkaaaddea; dvkaaaddean; vkaaaddeana; kaaaddeanad; aaaddeanada; aaddea nadag; addeanadagk; ddeanadagkl; deanadagklf; eanadagklfa; anadagklfag; nadagklfa gn;adagklfagna;dagklfagnan;agklfagnana;gklfagnanaaa;klfagnanaav;lfagnanaavg;
fagnanaavga;agnanaavgaa;gnanaavgaaa;nanaavgaaad;anaavgaaadi;naavgaaadia;aav
gaaadiak;avgaaadiaka;vgaaadiakaa;gaaadiakaag;aaadiakaaga;aadiakaagav;adiaka
agavt;diakaagavta;iakaagavtav;akaagavtavs;kaagavtavsg;aagavtavsge;agavtavsg
eq;gavtavsgeqi;avtavsgeqil;vtavsgeqilk;tavsgeqilka;avsgeqilkai;vsgeqilkaiv;
sgeqilkaive;geqilkaivea;eqilkaiveaa;qilkaiveaag;ilkaiveaagd;lkaiveaagdp;kai
veaagdpa;aiveaagdpan;iveaagdpanq;veaagdpanqa;eaagdpanqag;aagdpanqagk;agdpan
qagkk;gdpanqagkka;dpanqagkkae;panqagkkaee;anqagkkaeea;nqagkkaeeak;qagkkaeea
kn;agkkaeeaknp;gkkaeeaknpi;kkaeeaknpia;kaeeaknpiaa;aeeaknpiaaa;eeaknpiaaai;
eaknpiaaaig;aknpiaaaigt;knpiaaaigtd;npiaaaigtdd;piaaaigtddd;iaaaigtdddn;aaa
igtdddng;aaigtdddnga;aigtdddngaa;igtdddngaaf;gtdddngaafk;tdddngaafkd;dddnga
afkde;ddngaafkdem;dngaafkdemk;ngaafkdemkk;gaafkdemkks;aafkdemkksd;afkdemkks
dk;fkdemkksdki;kdemkksdkia;demkksdkiaa;emkksdkiaaa;mkksdkiaaai;kksdkiaaaiv;
ksdkiaaaivl;sdkiaaaivlr;dkiaaaivlrg;kiaaaivlrgv;iaaaivlrgva;aaaivlrgvak;aai
vlrgvakd;aivlrgvakdg;ivlrgvakdgk;vlrgvakdgkf;lrgvakdgkfa;rgvakdgkfav;gvakdg
kfavk;

13 mers:
mkkissaifltal;kkissaifltall;kissaifltallv;issaifltallvf;ssaifltallvfi;saifl
tallvfin;aifltallvfinc;ifltallvfinck;fltallvfinckn;ltallvfincknn;tallvfinck
nna;allvfincknnav;llvfincknnavg;lvfincknnavgk;vfincknnavgkg;fincknnavgkgn;i
ncknnavgkgnd;ncknnavgkgndd;cknnavgkgnddk;knnavgkgnddkd;nnavgkgnddkds;navgkg
nddkdsv;avgkgnddkdsvk;vgkgnddkdsvkt;gkgnddkdsvktf;kgnddkdsvktfy;gnddkdsvktf
ye;nddkdsvktfyes;ddkdsvktfyesi;dkdsvktfyesii;kdsvktfyesiin;dsvktfyesiinl;sv
ktfyesiinlg;vktfyesiinlgn;ktfyesiinlgng;tfyesiinlgngf;fyesiinlgngfi;yesiinl
gngfid;esiinlgngfidv;siinlgngfidvf;iinlgngfidvfn;inlgngfidvfna;nlgngfidvfna
f;lgngfidvfnafs;gngfidvfnafsg;ngfidvfnafsgl;gfidvfnafsglv;fidvfnafsglva;idv
fnafsglvad;dvfnafsglvadt;vfnafsglvadtf;fnafsglvadtff;nafsglvadtffk;afsglvad
tffks;fsglvadtffksd;sglvadtffksdp;glvadtffksdpk;lvadtffksdpkk;vadtffksdpkks
;adtffksdpkksd;dtffksdpkksdv;tffksdpkksdvk;ffksdpkksdvkt;fksdpkksdvkty;ksdp
kksdvktyf;sdpkksdvktyfe;dpkksdvktyfes;pkksdvktyfesi;kksdvktyfesis;ksdvktyfe
siss;sdvktyfesisst;dvktyfesisstl;vktyfesisstlk;ktyfesisstlka;tyfesisstlkat;
yfesisstlkatk;fesisstlkatkg;esisstlkatkgk;sisstlkatkgkl;isstlkatkgkld;sstlk
atkgklde;stlkatkgkldel;tlkatkgkldelv;lkatkgkldelvs;katkgkldelvsa;atkgkldelv
sak;tkgkldelvsakk;kgkldelvsakkg;gkldelvsakkge;kldelvsakkgeg;ldelvsakkgegg;d
elvsakkgeggs;elvsakkgeggsv;lvsakkgeggsvk;vsakkgeggsvka;sakkgeggsvkas;akkgeg
gsvkasv;kkgeggsvkasve;kgeggsvkasves;geggsvkasvesa;eggsvkasvesav;ggsvkasvesa
vd;gsvkasvesavde;svkasvesavdev;vkasvesavdevs;kasvesavdevsk;asvesavdevskw;sv
esavdevskwl;vesavdevskwle;esavdevskwlee;savdevskwleem;avdevskwleemi;vdevskw
leemik;devskwleemika;evskwleemikaa;vskwleemikaae;skwleemikaaee;kwleemikaaee
a;wleemikaaeeaa;leemikaaeeaak;eemikaaeeaakv;emikaaeeaakvg;mikaaeeaakvgg;ika
aeeaakvggt;kaaeeaakvggtg;aaeeaakvggtgg;aeeaakvggtggd;eeaakvggtggdg;eaakvggt
ggdgk;aakvggtggdgki;akvggtggdgkig;kvggtggdgkigd;vggtggdgkigds;ggtggdgkigdsa
;gtggdgkigdsaa;tggdgkigdsaan;ggdgkigdsaanh;gdgkigdsaanhg;dgkigdsaanhga;gkig
dsaanhgak;kigdsaanhgaka;igdsaanhgakad;gdsaanhgakadk;dsaanhgakadkd;saanhgaka
dkds;aanhgakadkdsv;anhgakadkdsvk;nhgakadkdsvkg;hgakadkdsvkgi;gakadkdsvkgia;
akadkdsvkgiak;kadkdsvkgiakg;adkdsvkgiakgi;dkdsvkgiakgik;kdsvkgiakgikg;dsvkg
iakgikgi;svkgiakgikgiv;vkgiakgikgivd;kgiakgikgivda;giakgikgivdaa;iakgikgivd
aag;akgikgivdaagk;kgikgivdaagka;gikgivdaagkal;ikgivdaagkalg;kgivdaagkalge;g
ivdaagkalgek;ivdaagkalgekg;vdaagkalgekga;daagkalgekgal;aagkalgekgalk;agkalg
ekgalkd;gkalgekgalkdv;kalgekgalkdvk;algekgalkdvka;lgekgalkdvkaa;gekgalkdvka
aa;ekgalkdvkaaad;kgalkdvkaaadd;galkdvkaaadde;alkdvkaaaddea;lkdvkaaaddean;kd
vkaaaddeana;dvkaaaddeanad;vkaaaddeanada;kaaaddeanadag;aaaddeanadagk;aaddean
adagkl;addeanadagklf;ddeanadagklfa;deanadagklfag;eanadagklfagn;anadagklfagn
a;nadagklfagnan;adagklfagnana;dagklfagnanaa;agklfagnanaav;gklfagnanaavg;klf

Fig. 39 continued agnanaavga;lfagnanaavgaa;fagnanaavgaaa;agnanaavgaaad;gnanaavgaaadi;nanaavga
aadia;anaavgaaadiak;naavgaaadiaka;aavgaaadiakaa;avgaaadiakaag;vgaaadiakaaga
;gaaadiakaagav;aaadiakaagavt;aadiakaagavta;adiakaagavtav;diakaagavtavs;iaka
agavtavsg;akaagavtavsge;kaagavtavsgeq;aagavtavsgeqi;agavtavsgeqil;gavtavsge
qilk;avtavsgeqilka;vtavsgeqilkai;tavsgeqilkaiv;avsgeqilkaive;vsgeqilkaivea;
sgeqilkaiveaa;geqilkaiveaag;eqilkaiveaagd;qilkaiveaagdp;ilkaiveaagdpa;lkaiv eaagdpan;kaiveaagdpanq;aiveaagdpanqa;iveaagdpanqag;veaagdpanqagk;eaagdpanqa gkk;aagdpanqagkka;agdpanqagkkae;gdpanqagkkaee;dpanqagkkaeea;panqagkkaeeak;a nqagkkaeeakn;nqagkkaeeaknp;qagkkaeeaknpi;agkkaeeaknpia;gkkaeeaknpiaa;kkaeea knpiaaa;kaeeaknpiaaai;aeeaknpiaaaig;eeaknpiaaaigt;eaknpiaaaigtd;aknpiaaaigt dd;knpiaaaigtddd;npiaaaigtdddn;piaaaigtdddng;iaaaigtdddnga;aaaigtdddngaa;aa igtdddngaaf;aigtdddngaafk;igtdddngaafkd;gtdddngaafkde;tdddngaafkdem;dddngaa fkdemk;ddngaafkdemkk;dngaafkdemkks;ngaafkdemkksd;gaafkdemkksdk;aafkdemkksdk i;afkdemkksdkia;fkdemkksdkiaa;kdemkksdkiaaa;demkksdkiaaai;emkksdkiaaaiv;mkk sdkiaaaivl;kksdkiaaaivlr;ksdkiaaaivlrg;sdkiaaaivlrgv;dkiaaaivlrgva;kiaaaivl rgvak;iaaaivlrgvakd;aaaivlrgvakdg;aaivlrgvakdgk;aivlrgvakdgkf;ivlrgvakdgkfa ;vlrgvakdgkfav;lrgvakdgkfavk;

14 mers:
mkkissaifltall;kkissaifltallv;kissaifltallvf;issaifltallvfi;ssaifltallvfin; saifltallvfinc;aifltallvfinck;ifltallvfinckn;fltallvfincknn;ltallvfincknna; tallvfincknnav;allvfincknnavg;llvfincknnavgk;lvfincknnavgkg;vfincknnavgkgn; fincknnavgkgnd;incknnavgkgndd;ncknnavgkgnddk;cknnavgkgnddkd;knnavgkgnddkds; nnavgkgnddkdsv;navgkgnddkdsvk;avgkgnddkdsvkt;vgkgnddkdsvktf;gkgnddkdsvktfy; kgnddkdsvktfye;gnddkdsvktfyes;nddkdsvktfyesi;ddkdsvktfyesii;dkdsvktfyesiin; kdsvktfyesiinl;dsvktfyesiinlg;svktfyesiinlgn;vktfyesiinlgng;ktfyesiinlgngf; tfyesiinlgngfi;fyesiinlgngfid;yesiinlgngfidv;esiinlgngfidvf;siinlgngfidvfn; iinlgngfidvfna;inlgngfidvfnaf;nlgngfidvfnafs;lgngfidvfnafsg;gngfidvfnafsgl; ngfidvfnafsglv;gfidvfnafsglva;fidvfnafsglvad;idvfnafsglvadt;dvfnafsglvadtf; vfnafsglvadtff;fnafsglvadtffk;nafsglvadtffks;afsglvadtffksd;fsglvadtffksdp; sglvadtffksdpk;glvadtffksdpkk;lvadtffksdpkks;vadtffksdpkksd;adtffksdpkksdv; dtffksdpkksdvk;tffksdpkksdvkt;ffksdpkksdvkty;fksdpkksdvktyf;ksdpkksdvktyfe; sdpkksdvktyfes;dpkksdvktyfesi;pkksdvktyfesis;kksdvktyfesiss;ksdvktyfesisst; sdvktyfesisstl;dvktyfesisstlk;vktyfesisstlka;ktyfesisstlkat;tyfesisstlkatk; yfesisstlkatkg;fesisstlkatkgk;esisstlkatkgkl;sisstlkatkgkld;isstlkatkgklde; sstlkatkgkldel;stlkatkgkldelv;tlkatkgkldelvs;lkatkgkldelvsa;katkgkldelvsak; atkgkldelvsakk;tkgkldelvsakkg;kgkldelvsakkge;gkldelvsakkgeg;kldelvsakkgegg; ldelvsakkgeggs;delvsakkgeggsv;elvsakkgeggsvk;lvsakkgeggsvka;vsakkgeggsvkas; sakkgeggsvkasv;akkgeggsvkasve;kkgeggsvkasves;kgeggsvkasvesa;geggsvkasvesav; eggsvkasvesavd;ggsvkasvesavde;gsvkasvesavdev;svkasvesavdevs;vkasvesavdevsk; kasvesavdevskw;asvesavdevskwl;svesavdevskwle;vesavdevskwlee;esavdevskwleem; savdevskwleemi;avdevskwleemik;vdevskwleemika;devskwleemikaa;evskwleemikaae; vskwleemikaaee;skwleemikaaeea;kwleemikaaeeaa;wleemikaaeeaak;leemikaaeeaakv; eemikaaeeaakvg;emikaaeeaakvgg;mikaaeeaakvggt;ikaaeeaakvggtg;kaaeeaakvggtgg; aaeeaakvggtggd;aeeaakvggtggdg;eeaakvggtggdgk;eaakvggtggdgki;aakvggtggdgkig; akvggtggdgkigd;kvggtggdgkigds;vggtggdgkigdsa;ggtggdgkigdsaa;gtggdgkigdsaan; tggdgkigdsaanh;ggdgkigdsaanhg;gdgkigdsaanhga;dgkigdsaanhgak;gkigdsaanhgaka; kigdsaanhgakad;igdsaanhgakadk;gdsaanhgakadkd;dsaanhgakadkds;saanhgakadkdsv; aanhgakadkdsvk;anhgakadkdsvkg;nhgakadkdsvkgi;hgakadkdsvkgia;gakadkdsvkgiak; akadkdsvkgiakg;kadkdsvkgiakgi;adkdsvkgiakgik;dkdsvkgiakgikg;kdsvkgiakgikgi; dsvkgiakgikgiv;svkgiakgikgivd;vkgiakgikgivda;kgiakgikgivdaa;giakgikgivdaag; iakgikgivdaagk;akgikgivdaagka;kgikgivdaagkal;gikgivdaagkalg;ikgivdaagkalge; kgivdaagkalgek;givdaagkalgekg;ivdaagkalgekga;vdaagkalgekgal;daagkalgekgalk; aagkalgekgalkd;agkalgekgalkdv;gkalgekgalkdvk;kalgekgalkdvka;algekgalkdvkaa; lgekgalkdvkaaa;gekgalkdvkaaad;ekgalkdvkaaadd;kgalkdvkaaadde;galkdvkaaaddea;

Fig. 39 continued alkdvkaaaddean; lkdvkaaaddeana; kdvkaaaddeanad; dvkaaaddeanada; vkaaaddeanadag;
kaaaddeanadagk; aaaddeanadagkl; aaddeanadagklf; addeanadagklfa; ddeanadagklfag;
deanadagklfagn; eanadagklfagna; anadagklfagnan; nadagklfagnana; adagklfagnanaa;
dagklfagnanaav; agklfagnanaavg; gklfagnanaavga; klfagnanaavgaa; lfagnanaavgaaa;
fagnanaavgaaad; agnanaavgaaadi; gnanaavgaaadia; nanaavgaaadiak; anaavgaaadiaka;
naavgaaadiakaa; aavgaaadiakaag; avgaaadiakaaga; vgaaadiakaagav; gaaadiakaagavt;
aaadiakaagavta;aadiakaagavtav;adiakaagavtavs;diakaagavtavsg;iakaagavtavsge;
akaagavtavsgeq;kaagavtavsgeqi;aagavtavsgeqil;agavtavsgeqilk;gavtavsgeqilka;
avtavsgeqilkai;vtavsgeqilkaiv;tavsgeqilkaive;avsgeqilkaivea;vsgeqilkaiveaa;
sgeqilkaiveaag;geqilkaiveaagd;eqilkaiveaagdp;qilkaiveaagdpa;ilkaiveaagdpan;
lkaiveaagdpanq;kaiveaagdpanqa;aiveaagdpanqag;iveaagdpanqagk;veaagdpanqagkk;
eaagdpanqagkka;aagdpanqagkkae;agdpanqagkkaee;gdpanqagkkaeea;dpanqagkkaeeak;
panqagkkaeeakn;anqagkkaeeaknp;nqagkkaeeaknpi;qagkkaeeaknpia;agkkaeeaknpiaa;
gkkaeeaknpiaaa;kkaeeaknpiaaai;kaeeaknpiaaaig;aeeaknpiaaaigt;eeaknpiaaaigtd;
eaknpiaaaigtdd;aknpiaaaigtddd;knpiaaaigtdddn;npiaaaigtdddng;piaaaigtdddnga;
iaaaigtdddngaa;aaaigtdddngaaf;aaigtdddngaafk;aigtdddngaafkd;igtdddngaafkde;
gtdddngaafkdem;tdddngaafkdemk;dddngaafkdemkk;ddngaafkdemkks;dngaafkdemkksd;
ngaafkdemkksdk;gaafkdemkksdki;aafkdemkksdkia;afkdemkksdkiaa;fkdemkksdkiaaa;
kdemkksdkiaaai;demkksdkiaaaiv;emkksdkiaaaivl;mkksdkiaaaivlr;kksdkiaaaivlrg;
ksdkiaaaivlrgv;sdkiaaaivlrgva;dkiaaaivlrgvak;kiaaaivlrgvakd;iaaaivlrgvakdg;
aaaivlrgvakdgk;aaivlrgvakdgkf;aivlrgvakdgkfa;ivlrgvakdgkfav;vlrgvakdgkfavk;

15 mers:
mkkissaifltallv;kkissaifltallvf;kissaifltallvfi;issaifltallvfin;ssaifltallv
finc;saifltallvfinck;aifltallvfinckn;ifltallvfincknn;fltallvfincknna;ltallv
fincknnav;tallvfincknnavg;allvfincknnavgk;llvfincknnavgkg;lvfincknnavgkgn;v
fincknnavgkgnd;fincknnavgkgndd;incknnavgkgnddk;ncknnavgkgnddkd;cknnavgkgndd
kds;knnavgkgnddkdsv;nnavgkgnddkdsvk;navgkgnddkdsvkt;avgkgnddkdsvktf;vgkgndd
kdsvktfy;gkgnddkdsvktfye;kgnddkdsvktfyes;gnddkdsvktfyesi;nddkdsvktfyesii;dd
kdsvktfyesiin;dkdsvktfyesiinl;kdsvktfyesiinlg;dsvktfyesiinlgn;svktfyesiinlg
ng;vktfyesiinlgngf;ktfyesiinlgngfi;tfyesiinlgngfid;fyesiinlgngfidv;yesiinlg
ngfidvf;esiinlgngfidvfn;siinlgngfidvfna;iinlgngfidvfnaf;inlgngfidvfnafs;nlg
ngfidvfnafsg;lgngfidvfnafsgl;gngfidvfnafsglv;ngfidvfnafsglva;gfidvfnafsglva
d;fidvfnafsglvadt;idvfnafsglvadtf;dvfnafsglvadtff;vfnafsglvadtffk;fnafsglva
dtffks;nafsglvadtffksd;afsglvadtffksdp;fsglvadtffksdpk;sglvadtffksdpkk;glva
dtffksdpkks;lvadtffksdpkksd;vadtffksdpkksdv;adtffksdpkksdvk;dtffksdpkksdvkt
;tffksdpkksdvkty;ffksdpkksdvktyf;fksdpkksdvktyfe;ksdpkksdvktyfes;sdpkksdvkt
yfesi;dpkksdvktyfesis;pkksdvktyfesiss;kksdvktyfesisst;ksdvktyfesisstl;sdvkt
yfesisstlk;dvktyfesisstlka;vktyfesisstlkat;ktyfesisstlkatk;tyfesisstlkatkg;
yfesisstlkatkgk;fesisstlkatkgkl;esisstlkatkgkld;sisstlkatkgklde;isstlkatkgk
ldel;sstlkatkgkldelv;stlkatkgkldelvs;tlkatkgkldelvsa;lkatkgkldelvsak;katkgk
ldelvsakk;atkgkldelvsakkg;tkgkldelvsakkge;kgkldelvsakkgeg;gkldelvsakkgegg;k
ldelvsakkgeggs;ldelvsakkgeggsv;delvsakkgeggsvk;elvsakkgeggsvka;lvsakkgeggsv
kas;vsakkgeggsvkasv;sakkgeggsvkasve;akkgeggsvkasves;kkgeggsvkasvesa;kgeggsv
kasvesav;geggsvkasvesavd;eggsvkasvesavde;ggsvkasvesavdev;gsvkasvesavdevs;sv
kasvesavdevsk;vkasvesavdevskw;kasvesavdevskwl;asvesavdevskwle;svesavdevskwl
ee;vesavdevskwleem;esavdevskwleemi;savdevskwleemik;avdevskwleemika;vdevskwl
eemikaa;devskwleemikaae;evskwleemikaaee;vskwleemikaaeea;skwleemikaaeeaa;kwl
eemikaaeeaak;wleemikaaeeaakv;leemikaaeeaakvg;eemikaaeeaakvgg;emikaaeeaakvgg
t;mikaaeeaakvggtg;ikaaeeaakvggtgg;kaaeeaakvggtggd;aaeeaakvggtggdg;aeeaakvgg
tggdgk;eeaakvggtggdgki;eaakvggtggdgkig;aakvggtggdgkigd;akvggtggdgkigds;kvgg
tggdgkigdsa;vggtggdgkigdsaa;ggtggdgkigdsaan;gtggdgkigdsaanh;tggdgkigdsaanhg
;ggdgkigdsaanhga;gdgkigdsaanhgak;dgkigdsaanhgaka;gkigdsaanhgakad;kigdsaanhg
akadk;igdsaanhgakadkd;gdsaanhgakadkds;dsaanhgakadkdsv;saanhgakadkdsvk;aanhg
akadkdsvkg;anhgakadkdsvkgi;nhgakadkdsvkgia;hgakadkdsvkgiak;gakadkdsvkgiakg;

Fig. 39 continued akadkdsvkgiakgi; kadkdsvkgiakgik; adkdsvkgiakgikg; dkdsvkgiakgikgi; kdsvkgiakgi
kgiv; dsvkgiakgikgivd; svkgiakgikgivda; vkgiakgikgivdaa; kgiakgikgivdaag; giakgi
kgivdaagk; iakgikgivdaagka; akgikgivdaagkal; kgikgivdaagkalg; gikgivdaagkalge; i
kgivdaagkalgek; kgivdaagkalgekg; givdaagkalgekga; ivdaagkalgekgal; vdaagkalgekg
alk; daagkalgekgalkd; aagkalgekgalkdv; agkalgekgalkdvk; gkalgekgalkdvka;kalgekg
alkdvkaa;algekgalkdvkaaa;lgekgalkdvkaaad;gekgalkdvkaaadd;ekgalkdvkaaadde;kg
alkdvkaaaddea;galkdvkaaaddean;alkdvkaaaddeana;lkdvkaaaddeanad;kdvkaaaddeana
da;dvkaaaddeanadag;vkaaaddeanadagk;kaaaddeanadagkl;aaaddeanadagklf;aaddeana
dagklfa;addeanadagklfag;ddeanadagklfagn;deanadagklfagna;eanadagklfagnan;ana
dagklfagnana;nadagklfagnanaa;adagklfagnanaav;dagklfagnanaavg;agklfagnanaavg
a;gklfagnanaavgaa;klfagnanaavgaaa;lfagnanaavgaaad;fagnanaavgaaadi;agnanaavg
aaadia;gnanaavgaaadiak;nanaavgaaadiaka;anaavgaaadiakaa;naavgaaadiakaag;aavg
aaadiakaaga;avgaaadiakaagav;vgaaadiakaagavt;gaaadiakaagavta;aaadiakaagavtav
;aadiakaagavtavs;adiakaagavtavsg;diakaagavtavsge;iakaagavtavsgeq;akaagavtav
sgeqi;kaagavtavsgeqil;aagavtavsgeqilk;agavtavsgeqilka;gavtavsgeqilkai;avtav
sgeqilkaiv;vtavsgeqilkaive;tavsgeqilkaivea;avsgeqilkaiveaa;vsgeqilkaiveaag;
sgeqilkaiveaagd;geqilkaiveaagdp;eqilkaiveaagdpa;qilkaiveaagdpan;ilkaiveaagd
panq;lkaiveaagdpanqa;kaiveaagdpanqag;aiveaagdpanqagk;iveaagdpanqagkk;veaagd
panqagkka;eaagdpanqagkkae;aagdpanqagkkaee;agdpanqagkkaeea;gdpanqagkkaeeak;d
panqagkkaeeakn;panqagkkaeeaknp;anqagkkaeeaknpi;nqagkkaeeaknpia;qagkkaeeaknp
iaa;agkkaeeaknpiaaa;gkkaeeaknpiaaai;kkaeeaknpiaaaig;kaeeaknpiaaaigt;aeeaknp
iaaaigtd;eeaknpiaaaigtdd;eaknpiaaaigtddd;aknpiaaaigtdddn;knpiaaaigtdddng;np
iaaaigtdddnga;piaaaigtdddngaa;iaaaigtdddngaaf;aaaigtdddngaafk;aaigtdddngaaf
kd;aigtdddngaafkde;igtdddngaafkdem;gtdddngaafkdemk;tdddngaafkdemkk;dddngaaf
kdemkks;ddngaafkdemkksd;dngaafkdemkksdk;ngaafkdemkksdki;gaafkdemkksdkia;aaf
kdemkksdkiaa;afkdemkksdkiaaa;fkdemkksdkiaaai;kdemkksdkiaaaiv;demkksdkiaaaiv
l;emkksdkiaaaivlr;mkksdkiaaaivlrg;kksdkiaaaivlrgv;ksdkiaaaivlrgva;sdkiaaaiv
lrgvak;dkiaaaivlrgvakd;kiaaaivlrgvakdg;iaaaivlrgvakdgk;aaaivlrgvakdgkf;aaiv
lrgvakdgkfa;aivlrgvakdgkfav;ivlrgvakdgkfavk;

Fig. 39 continued 16 mers:
mkkissaifltallvf;kkissaifltallvfi;kissaifltallvfin;issaifltallvfinc;ssaiflt
allvfinck;saifltallvfinckn;aifltallvfincknn;ifltallvfincknna;fltallvfincknn
av;ltallvfincknnavg;tallvfincknnavgk;allvfincknnavgkg;llvfincknnavgkgn;lvfi
ncknnavgkgnd;vfincknnavgkgndd;fincknnavgkgnddk;incknnavgkgnddkd;ncknnavgkgn
ddkds;cknnavgkgnddkdsv;knnavgkgnddkdsvk;nnavgkgnddkdsvkt;navgkgnddkdsvktf;a
vgkgnddkdsvktfy;vgkgnddkdsvktfye;gkgnddkdsvktfyes;kgnddkdsvktfyesi;gnddkdsv
ktfyesii;nddkdsvktfyesiin;ddkdsvktfyesiinl;dkdsvktfyesiinlg;kdsvktfyesiinlg
n;dsvktfyesiinlgng;svktfyesiinlgngf;vktfyesiinlgngfi;ktfyesiinlgngfid;tfyes
iinlgngfidv;fyesiinlgngfidvf;yesiinlgngfidvfn;esiinlgngfidvfna;siinlgngfidv
fnaf;iinlgngfidvfnafs;inlgngfidvfnafsg;nlgngfidvfnafsgl;lgngfidvfnafsglv;gn
gfidvfnafsglva;ngfidvfnafsglvad;gfidvfnafsglvadt;fidvfnafsglvadtf;idvfnafsg
lvadtff;dvfnafsglvadtffk;vfnafsglvadtffks;fnafsglvadtffksd;nafsglvadtffksdp
;afsglvadtffksdpk;fsglvadtffksdpkk;sglvadtffksdpkks;glvadtffksdpkksd;lvadtf
fksdpkksdv;vadtffksdpkksdvk;adtffksdpkksdvkt;dtffksdpkksdvkty;tffksdpkksdvk
tyf;ffksdpkksdvktyfe;fksdpkksdvktyfes;ksdpkksdvktyfesi;sdpkksdvktyfesis;dpk
ksdvktyfesiss;pkksdvktyfesisst;kksdvktyfesisstl;ksdvktyfesisstlk;sdvktyfesi
sstlka;dvktyfesisstlkat;vktyfesisstlkatk;ktyfesisstlkatkg;tyfesisstlkatkgk;
yfesisstlkatkgkl;fesisstlkatkgkld;esisstlkatkgklde;sisstlkatkgkldel;isstlka
tkgkldelv;sstlkatkgkldelvs;stlkatkgkldelvsa;tlkatkgkldelvsak;lkatkgkldelvsa
kk;katkgkldelvsakkg;atkgkldelvsakkge;tkgkldelvsakkgeg;kgkldelvsakkgegg;gkld
elvsakkgeggs;kldelvsakkgeggsv;ldelvsakkgeggsvk;delvsakkgeggsvka;elvsakkgegg
svkas;lvsakkgeggsvkasv;vsakkgeggsvkasve;sakkgeggsvkasves;akkgeggsvkasvesa;k
kgeggsvkasvesav;kgeggsvkasvesavd;geggsvkasvesavde;eggsvkasvesavdev;ggsvkasv
esavdevs;gsvkasvesavdevsk;svkasvesavdevskw;vkasvesavdevskwl;kasvesavdevskwl
e;asvesavdevskwlee;svesavdevskwleem;vesavdevskwleemi;esavdevskwleemik;savde
vskwleemika;avdevskwleemikaa;vdevskwleemikaae;devskwleemikaaee;evskwleemika
aeea;vskwleemikaaeea;skwleemikaaeeaak;kwleemikaaeeaakv;wleemikaaeeaakvg;le
emikaaeeaakvgg;eemikaaeeaakvggt;emikaaeeaakvggtg;mikaaeeaakvggtgg;ikaaeeaak
vggtggd;kaaeeaakvggtggdg;aaeeaakvggtggdgk;aeeaakvggtggdgki;eeaakvggtggdgkig
;eaakvggtggdgkigd;aakvggtggdgkigds;akvggtggdgkigdsa;kvggtggdgkigdsaa;vggtgg
dgkigdsaan;ggtggdgkigdsaanh;gtggdgkigdsaanhg;tggdgkigdsaanhga;ggdgkigdsaanh
gak;gdgkigdsaanhgaka;dgkigdsaanhgakad;gkigdsaanhgakadk;kigdsaanhgakadkd;igd
saanhgakadkds;gdsaanhgakadkdsv;dsaanhgakadkdsvk;saanhgakadkdsvkg;aanhgakadk
dsvkgi;anhgakadksvkgia;nhgakadksvkgiak;hgakadksvkgiakg;gakadksvkgiakgi;
akadksvkgiakgik;kadksvkgiakgikg;adksvkgiakgikgi;dksvkgiakgikgiv;kdsvkgi
akgikgivd;dsvkgiakgikgivda;svkgiakgikgivdaa;vkgiakgikgivdaag;kgiakgikgivdaa
gk;giakgikgivdaagka;iakgikgivdaagkal;akgikgivdaagkalg;kgikgivdaagkalge;gikg
ivdaagkalgek;ikgivdaagkalgekg;kgivdaagkalgekga;givdaagkalgekgal;ivdaagkalge
kgalk;vdaagkalgekgalkd;daagkalgekgalkdv;aagkalgekgalkdvk;agkalgekgalkdvka;g
kalgekgalkdvkaa;kalgekgalkdvkaaa;algekgalkdvkaaad;lgekgalkdvkaaadd;gekgalkd
vkaaadde;ekgalkdvkaaaddea;kgalkdvkaaaddean;galkdvkaaaddeana;alkdvkaaaddeana
d;lkdvkaaaddeanada;kdvkaaaddeanadag;dvkaaaddeanadagk;vkaaaddeanadagkl;kaaad
deanadagklf;aaaddeanadagklfa;aaddeanadagklfag;addeanadagklfagn;ddeanadagklf
agna;deanadagklfagnan;eanadagklfagnana;anadagklfagnanaa;nadagklfagnanaav;ad
agklfagnanaavg;dagklfagnanaavga;agklfagnanaavgaa;gklfagnanaavgaaa;klfagnana
avgaaad;lfagnanaavgaaadi;fagnanaavgaaadia;agnanaavgaaadiak;gnanaavgaaadiaka
;nanaavgaaadiakaa;anaavgaaadiakaag;naavgaaadiakaaga;aavgaaadiakaagav;avgaaa
diakaagavt;vgaaadiakaagavta;gaaadiakaagavtav;aaadiakaagavtavs;aadiakaagavta
vsg;adiakaagavtavsge;diakaagavtavsgeq;iakaagavtavsgeqi;akaagavtavsgeqil;kaa
gavtavsgeqilk;aagavtavsgeqilka;agavtavsgeqilkai;gavtavsgeqilkaiv;avtavsgeqi
lkaive;vtavsgeqilkaivea;tavsgeqilkaiveaa;avsgeqilkaiveaag;vsgeqilkaiveaagd;
sgeqilkaiveaagdp;geqilkaiveaagdpa;eqilkaiveaagdpan;qilkaiveaagdpanq;ilkaive
aagdpanqa;lkaiveaagdpanqag;kaiveaagdpanqagk;aiveaagdpanqagkk;iveaagdpanqagk
ka;veaagdpanqagkkae;eaagdpanqagkkaee;aagdpanqagkkaeea;agdpanqagkkaeeak;gdpa

Fig. 39 continued nqagkkaeeakn;dpanqagkkaeeaknp;panqagkkaeeaknpi;anqagkkaeeaknpia;nqagkkaeeak
npiaa;qagkkaeeaknpiaaa;agkkaeeaknpiaaai;gkkaeeaknpiaaaig;kkaeeaknpiaaaigt;k
aeeaknpiaaaigtd;aeeaknpiaaaigtdd;eeaknpiaaaigtddd;eaknpiaaaigtdddn;aknpiaaa
igtdddng;knpiaaaigtdddnga;npiaaaigtdddngaa;piaaaigtdddngaaf;iaaaigtdddngaaf
k;aaaigtdddngaafkd;aaigtdddngaafkde;aigtdddngaafkdem;igtdddngaafkdemk;gtddd
ngaafkdemkk;tdddngaafkdemkks;dddngaafkdemkksd;ddngaafkdemkksdk;dngaafkdemkk
sdki;ngaafkdemkksdkia;gaafkdemkksdkiaa;aafkdemkksdkiaaa;afkdemkksdkiaaai;fk
demkksdkiaaaiv;kdemkksdkiaaaivl;demkksdkiaaaivlr;emkksdkiaaaivlrg;mkksdkiaa
aivlrgv;kksdkiaaaivlrgva;ksdkiaaaivlrgvak;sdkiaaaivlrgvakd;dkiaaaivlrgvakdg
;kiaaaivlrgvakdgk;iaaaivlrgvakdgkf;aaaivlrgvakdgkfa;aaivlrgvakdgkfav;aivlrg
vakdgkfavk;

Fig. 39 continued

Fig. 40.

A) Borrelia burgdorferi MHC class1 & 2 epitopes

<ABX71745 CRASP-2;Protein;Borrelia burgdorferi>
SEQ ID NO:171150-171695

Class 1
MKKSFLSI;KSFLSIYM;SFLSIYML;FLSIYMLI;SIYMLISI;YMLISISL;MLISISLL;LLSCDVSR;DVSRL
NQR;NIDELKIF;ELKIFVEK;KIFVEKAK;IFVEKAKY;FVEKAKYY;EKAKYYSI;KAKYYSIK;YSIKLDAI
;SIKLDAIY;KLDAIYSE;YSEYTGAY;AYNDIMTY;IMTYIMTY;MTYIMTYS;GTSSDKSK;TSSDKSKV;
KSKVNQAI;KVNQAISI;NQAISILK;QAISILKK;SILKKDNK;EEYKPMFL;KPMFLSKL;PMFLSKLI;KLI
DDFAI;FAIELDQA;AIELDQAV;DVSNARHV;HVADSYEK;DSYEKLRK;KLRKSVAL;KSVALAYI;AL
AYIESF;AYIESFDV;YIESFDVI;ESFDVISS;DVISSKFV;SSKFVDSK;KFVDSKFV;KFVEASKK;ASK
KFVNK;KKFVNKAK;FVNKAKEF;FVEENDLI;EENDLIAL;DLIALKCI;LIALKCIV;IALKCIVK;ALKCIV
KT;REINSRSR;EINSRSRY;RSRYNNFY;SRYNNFYK;RYNNFYKK;FYKKEADF;KEADFLGA;EAD
FLGAA;FLGAAVEL;AAVELEGA;AVELEGAY;ELEGAYKA;EGAYKAIK;YKAIKQTL;KAIKQTLL KSFLSIYML;SFLSIYMLI;FLSIYMLIS;LSIYMLISI;IYMLISISL;YMLISISLL;MLISISLLS;SISLLSCDV;
SLLSCDVSR;LLSCDVSRL;NIDELKIFV;KIFVEKAKY;EKAKYYSIK;YYSIKLDAI;YSIKLDAIY;KLDA
IYSEY;AIYSEYTGA;IYSEYTGAY;EYTGAYNDI;YTGAYNDIM;GAYNDIMTY;AYNDIMTYI;YNDIMT
YIM;DIMTYIMTY;IMTYIMTYS;MTYIMTYSE;YIMTYSEGT;YSEGTSSDK;KVNQAISIL;VNQAISILK
;NQAISILKK;ISILKKDNK;ILKKDNKIV;KIVNKFKEL;ELEKIIEEY;KIIEEYKPM;IEEYKPMFL;EYKPM
FLSK;KPMFLSKLI;FLSKLIDDF;KLIDDFAIE;LIDDFAIEL;FAIELDQAV;DVSNARHVA;NARHVADS
Y;HVADSYEKL;YEKLRKSVA;KLRKSVALA;VALAYIESF;LAYIESFDV;AYIESFDVI;ESFDVISSK;S
FDVISSKF;ISSKFVDSK;FVDSKFVEA;DSKFVEASK;KFVEASKKF;FVEASKKFV;EASKKFVNK;K
FVNKAKEF;FVNKAKEFV;KEFVEENDL;VEENDLIAL;EENDLIALK;DLIALKCIV;LIALKCIVK;ALKCI
VKTI;IVKTIGDMV;TIGDMVNDR;REINSRSRY;RSRYNNFYK;SRYNNFYKK;NFYKKEADF;FYKKE
ADFL;KEADFLGAA;EADFLGAAV;DFLGAAVEL;FLGAAVELE;AAVELEGAY;AVELEGAYK;VELE
GAYKA;ELEGAYKAI;AYKAIKQTL;YKAIKQTLL KSFLSIYMLI;FLSIYMLISI;SIYMLISISL;IYMLISISLL;YMLISISLLS;MLISISLLSC;ISLLSCDVSR;SL
LSCDVSRL;RLNQRNIDEL;ELKIFVEKAK;KIFVEKAKYY;FVEKAKYYSI;KYYSIKLDAI;YYSIKLDAI
Y;KLDAIYSEYT;AIYSEYTGAY;SEYTGAYNDI;TGAYNDIMTY;GAYNDIMTYI;AYNDIMTYIM;DIMT
YIMTYS;TYSEGTSSDK;KVNQAISILK;VNQAISILKK;AISILKKDNK;SILKKDNKIV;KDNKIVNKFK;I
VNKFKELEK;KELEKIIEEY;ELEKIIEEYK;KIIEEYKPMF;IEEYKPMFL;EEYKPMFLSK;EYKPMFLS
KL;MFLSKLIDDF;FLSKLIDDFA;KLIDDFAIEL;ELDQAVDNDV;AVDNDVSNAR;ARHVADSYEK;H
VADSYEKLR;VADSYEKLRK;YEKLRKSVAL;KLRKSVALAY;SVALAYIESF;ALAYIESFDV;LAYIES
FDVI;ESFDVISSKF;SFDVISSKFV;VISSKFVDSK;ISSKFVDSKF;DSKFVEASKK;EASKKFVNKA;A
SKKFVNKAK;KEFVEENDLI;FVEENDLIAL;EENDLIALKC;DLIALKCIVK;CIVKTIGDMV;KTIGDMV
NDR;MVNDREINSR;NSRSRYNNFY;RSRYNNFYKK;KEADFLGAAV;FLGAAVELEG;GAAVELEG
AY;AAVELEGAYK;VELEGAYKAI;ELEGAYKAIK;GAYKAIKQTL;AYKAIKQTLL SFLSIYMLISI;FLSIYMLISIS;LSIYMLISISL;SIYMLISISLL;IYMLISISLLS;YMLISISLLSC;LISISLLSC
DV;SISLLSCDVSR;LSCDVSRLNQR;RLNQRNIDELK;NQRNIDELKIF;NIDELKIFVEK;ELKIFVEK
AKY;FVEKAKYYSIK;VEKAKYYSIKL;KYYSIKLDAIY;SIKLDAIYSEY;KLDAIYSEYTG;DAIYSEYTG
AY;SEYTGAYNDIM;YTGAYNDIMTY;TGAYNDIMTYI;GAYNDIMTYIM;YNDIMTYIMTY;MTYIMTY
SEGT;YIMTYSEGTSS;MTYSEGTSSDK;KVNQAISILKK;QAISILKKDNK;ILKKDNKIVNK;KIVNKF
KELEK;KIIEEYKPMFL;EEYKPMFLSKL;EYKPMFLSKLI;PMFLSKLIDDF;FLSKLIDDFAI;LIDDFAI
ELDQ;QAVDNDVSNAR;VSNARHVADSY;NARHVADSYEK;HVADSYEKLRK;SYEKLRKSVAL;KL
RKSVALAYI;KSVALAYIESF;VALAYIESFDV;ALAYIESFDVI;YIESFDVISSK;IESFDVISSKF;ESFD
VISSKFV;DVISSKFVDSK;FVDSKFVEASK;FVEASKKFVNK;EASKKFVNKAK;KEFVEENDLIA;EF
VEENDLIAL;FVEENDLIALK;EENDLIALKCI;LIALKCIVKTI;TIGDMVNDREI;DMVNDREINSR;EINS
RSRYNNF;NSRSRYNNFYK;EADFLGAAVEL;FLGAAVELEGA;LGAAVELEGAY;GAAVELEGAYK
;EGAYKAIKQTL;GAYKAIKQTLL

Class 2
ADFLGAAVELEGAYK;FLGAAVELE;ADSYEKLRKSVALAY;EKLRKSVAL;ADSYEKLRKSVALAY;
YEKLRKSVA;AISILKKDNKIVNKF;LKKDNKIVN;AYIESFDVISSKFVD;FDVISSKFV;AYNDIMTYIM
TYSEG;YNDIMTYIM;DAIYSEYTGAYNDIM;IYSEYTGAY;DDFAIELDQAVDNDV;FAIELDQAV;DF
LGAAVELEGAYKA;FLGAAVELE;DIMTYIMTYSEGTSS;IMTYSEGTS;DIMTYIMTYSEGTSS;YIMT
YSEGT;DKSKVNQAISILKKD;VNQAISILK;DLIALKCIVKTIGDM;IALKCIVKT;DQAVDNDVSNARH
VA;VDNDVSNAR;DSKFVEASKKFVNKA;FVEASKKFV;DSYEKLRKSVALAYI;LRKSVALAY;DSY
EKLRKSVALAYI;YEKLRKSVA;EADFLGAAVELEGAY;FLGAAVELE;EENDLIALKCIVKTI;IALKCIV
KT;EEYKPMFL TTLEYSQI;ATKAVETL;ETLKNSIK;TLKNSIKL;SIKLEGSL;IKLEGSLV;SLVGGKTT;LVGGKTTV;IK
EGTVTL;EGTVTLKR;TLKREIEK;FLNDTAGS;DTAGSNKK;GSNKKTGK;WEDSTSTL;TSTLTISA;
LTISADSK;TISADSKK;SADSKKTK;KTKDLVFL;VFLTDGTI;FLTDGTIT;LTDGTITV;GTITVQQY;Q
QYNTAGT;NTAGTSLE;EIKNLSEL;NLSELKNA MRLLIGFAL;RLLIGFALA;LLIGFALAL;LIGFALALA;ALALALIGC;LALALIGCA;LALIGCAQK;GAESI
GSQK;SQKENDLNL;SKKSHQNAK;LPAVTEDSV;AVTEDSVSL;VTEDSVSLF;SVSLFNGNK;SLF
NGNKIF;LFNGNKIFV;NSSGKYDLR;DLRATIDQV;ATIDQVELK;GSGTLEGSK;KPDKSKVKL;TVS
ADLNTV;SADLNTVTL;DLNTVTLEA;VTLEAFDAS;EAFDASNQK;ASNQKISSK;KISSKVTKK;KQG
SITXET;GSITXETLK;SITXETLKA;KANKLDSKK;KLDSKKLTR;LTRSNGTTL;RSNGTTLEY;TTLEY
SQIT;SQITDADNA;ITDADNATK;DADNATKAV;ATKAVETLK;ETLKNSIKL;SIKLEGSLV;SLVGGK
TTV;TTVEIKEGT;EIKEGTVTL;VTLKREIEK;GSNKKTGKW;STSTLTISA;TLTISADSK;LTISADSKK
;ISADSKKTK;KTKDLVFLT;FLTDGTITV;VQQYNTAGT;QYNTAGTSL;SLEGSASEI;SEIKNLSEL;E
IKNLSELK;NLSELKNAL;LSELKNALK

RLLIGFALAL;LLIGFALALA;LIGFALALAL;IGFALALALI;FALALALIGC;ALALALIGCA;ALALIGCAQ
K;ALIGCAQKGA;DLNLEDSSKK;SSKKSHQNAK;DLPAVTEDSV;LPAVTEDSVS;AVTEDSVSLF;D
SVSLFNGNK;SVSLFNGNKI;VSLFNGNKIF;SLFNGNKIFV;VSKEKNSSGK;RATIDQVELK;GTLEG
SKPDK;GSKPDKSKVK;LTVSADLNTV;DLNTVTLEAF;EAFDASNQKI;DASNQKISSK;KQGSITXE
TL;ITXETLKANK;TLKANKLDSK;KLDSKKLTRS;KLTRSNGTTL;SQITDADNAT;QITDADNATK;NA
TKAVETLK;KAVETLKNSI;AVETLKNSIK;VETLKNSIKL;NSIKLEGSLV;KLEGSLVGGK;SLVGGKT
TVE;LVGGKTTVEI;TTVEIKEGTV;VEIKEGTVTL;EIKEGTVTLK;TVTLKREIEK;EIEKDGKVKV;IEK
DGKVKVF;FLNDTAGSNK;TAGSNKKTGK;WEDSTSTLTI;STLTISADSK;TLTISADSKK;TISADSK
KTK;VFLTDGTITV;FLTDGTITVQ;QQYNTAGTSL;NTAGTSLEGS;SLEGSASEIK;NLSELKNALK

MRLLIGFALAL;RLLIGFALALA;LLIGFALALAL;LIGFALALALI;FALALALIGCA;ALALALIGCAQ;LAL
ALIGCAQK;DSSKKSHQNAK;HQNAKQDLPAV;LPAVTEDSVSL;DSVSLFNGNKI;SVSLFNGNKIF;
SLFNGNKIFVS;LFNGNKIFVSK;FVSKEKNSSGK;VSKEKNSSGKY;KEKNSSGKYDL;DLRATIDQ
VEL;KPDKSKVKLTV;KLTVSADLNTV;TVSADLNTVTL;TLEAFDASNQK;DASNQKISSKV;KQGSI
TXETLK;SITXETLKANK;ETLKANKLDSK;TLKANKLDSKK;LTRSNGTTLEY;TTLEYSQITDA;SQIT
DADNATK;ITDADNATKAV;DNATKAVETLK;KAVETLKNSIK;EGSLVGGKTTV;SLVGGKTTVEI;LV
GGKTTVEIK;EIKEGTVTLKR;GTVTLKREIEK;EIEKDGKVKVF;IEKDGKVKVFL;VFLNDTAGSNK;F
LNDTAGSNKK;DTAGSNKKTGK;KWEDSTSTLTI;TSTLTISADSK;STLTISADSKK;LTISADSKKTK
;SADSKKTKDLV;LVFLTDGTITV;FLTDGTITVQQ;LTDGTITVQQY;VQQYNTAGTSL;NTAGTSLE
GSA;TSLEGSASEIK;LEGSASEIKNL;SASEIKNLSEL;ASEIKNLSELK

Class 2

ALIGCAQKGAESIGS;LIGCAQKGA;ANKLDSKKLTRSNGT;LDSKKLTRS;ASEIKNLSELKNALK;IK
NLSELKN;ASNQKISSKVTKKQG;ISSKVTKKQ;AVETLKNSIKLEGSL;LKNSIKLEG;DASNQKISSK
VTKKQ;NQKISSKVT;DGKVKVFLNDTAGSN;VKVFLNDTA;DGTITVQQYNTAGTS;VQQYNTAGT;
DKSKVKLTVSADLNT;VKLTVSADL;DLVFLTDGTITVQQY;FLTDGTITV;DSVSLFNGNKIFVSK;VS
LFNGNKI;EDSVSLFNGNKIFVS;VSLFNGNKI;EGSASEIKNLSELKN;SASEIKNLS;EGSLVGGKTT
VEIKE;VGGKTTVEI;ETLKNSIKLEGSLVG;KNSIKLEGS;ETLKNSIKLEGSLVG;LKNSIKLEG;FALA
LALIGCAQKGA;FALALALIG;FLTDGTITVQQYNTA;FLTDGTITV;FNGNKIFVSKEKNSS;FNGNKIF
VS;GFALALALIGCAQKG;FALALALIG;GKVKVFLNDTAGSNK;VKVFLNDTA;GKWEDSTSTLTISA
D;WEDSTSTLT;GNKIFVSKEKNSSGK;FVSKEKNSS;GSASEIKNLSELKNA;IKNLSELKN;GSITXE
TLKANKLDS;XETLKANKL;GSLVGGKTTVEIKEG;VGGKTTVEI;GTITVQQYNTAGTSL;VQQYNT
AGT;IGFALALALIGCAQK;FALALALIG;IKLEGSLVGGKTTVE;IKLEGSLVG;ITVQQYNTAGTSLEG
;VQQYNTAGT;ITVQQYNTAGTSLEG;YNTAGTSLE;KANKLDSKKLTRSNG;LDSKKLTRS;KAVET
LKNSIKLEGS;LKNSIKLEG;KDGKVKVFLNDTAGS;VKVFLNDTA;KDLVFLTDGTITVQQ;FLTDGTI
TV;KIFVSKEKNSSGKYD;FVSKEKNSS;KKTGKWEDSTSTLTI;WEDSTSTLT;KLEGSLVGGKTTV
EI;LVGGKTTVE;KLTVSADLNTVTLEA;VSADLNTVT;KNSIKLEGSLVGGKT;IKLEGSLVG;KPDKS
KVKLTVSADL;SKVKLTVSA;KQGSITXETLKANKL;ITXETLKAN;KSKVKLTVSADLNTV;VKLTVSA
DL;KTGKWEDSTSTLTIS;WEDSTSTLT;KTKDLVFLTDGTITV;VFLTDGTIT;KVKLTVSADLNTVTL;
LTVSADLNT;KVKVFLNDTAGSNKK;FLNDTAGSN;KWEDSTSTLTISADS;WEDSTSTLT;LDSKKL

Fig. 40 continued

TRSNGTTLE;LTRSNGTTL;LEGSLVGGKTTVEIK;VGGKTTVEI;LIGFALALALIGCAQ;FALALALIG
;LKANKLDSKKLTRSN;LDSKKLTRS;LKNSIKLEGSLVGGK;IKLEGSLVG;LKNSIKLEGSLVGGK;L
KNSIKLEG;LLIGFALALALIGCA;FALALALIG;LLIGFALALALIGCA;IGFALALAL;LTVSADLNTVTLE
AF;VSADLNTVT;LVFLTDGTITVQQYN;FLTDGTITV;LVGGKTTVEIKEGTV;VGGKTTVEI;MRLLIG
FALALALIG;IGFALALAL;MRLLIGFALALALIG;LIGFALALA;NGNKIFVSKEKNSSG;FVSKEKNSS;
NKIFVSKEKNSSGKY;FVSKEKNSS;NKKTGKWEDSTSTLT;GKWEDSTST;NKLDSKKLTRSNGT
T;LDSKKLTRS;NSIKLEGSLVGGKTT;IKLEGSLVG;NTAGTSLEGSASEIK;GTSLEGSAS;PDKSKV
KLTVSADLN;VKLTVSADL;QGSITXETLKANKLD;XETLKANKL;QQYNTAGTSLEGSAS;YNTAGT
SLE;QYNTAGTSLEGSASE;YNTAGTSLE;RLLIGFALALALIGC;FALALALIG;RLLIGFALALALIGC;I
GFALALAL;RLLIGFALALALIGC;LIGFALALA;SASEIKNLSELKNAL;IKNLSELKN;SIKLEGSLVGG
KTTV;IKLEGSLVG;SKVKLTVSADLNTVT;VKLTVSADL;SKVTKKQGSITXETL;VTKKQGSIT;SLV
GGKTTVEIKEGT;VGGKTTVEI;SSKVTKKQGSITXET;VTKKQGSIT;SVSLFNGNKIFVSKE;VSLFN
GNKI;TAGTSLEGSASEIKN;LEGSASEIK;TDGTITVQQYNTAGT;ITVQQYNTA;TEDSVSLFNGNKI
FV;VSLFNGNKI;TGKWEDSTSTLTISA;WEDSTSTLT;TITVQQYNTAGTSLE;VQQYNTAGT;TKAV
ETLKNSIKLEG;VETLKNSIK;TKDLVFLTDGTITVQ;FLTDGTITV;TLKANKLDSKKLTRS;ANKLDSK
KL;TLKNSIKLEGSLVGG;IKLEGSLVG;TLKNSIKLEGSLVGG;LKNSIKLEG;TVQQYNTAGTSLEG
S;YNTAGTSLE;VETLKNSIKLEGSLV;LKNSIKLEG;VFLTDGTITVQQYNT;FLTDGTITV;VGGKTTV
EIKEGTVT;VGGKTTVEI;VKLTVSADLNTVTLE;LTVSADLNT;VKVFLNDTAGSNKKT;FLNDTAGS
N;VQQYNTAGTSLEGSA;YNTAGTSLE;VSLFNGNKIFVSKEK;VSLFNGNKI;VTEDSVSLFNGNKI
F;VSLFNGNKI;WEDSTSTLTISADSK;WEDSTSTLT;YNTAGTSLEGSASEI;YNTAGTSLE <NP_047005 outer surface protein C;Protein;Borrelia burgdorferi B31>
SEQ ID NO:172135-172552
Class 1
NTLSAILM;TLSAILMT;LSAILMTL;SAILMTLF;AILMTLFL;ILMTLFLF;LMTLFLFI;TLFLFISC;ISCNN
SGK;NSADESVK;NLTEISKK;KITDSNAV;NAVLLAVK;VLLAVKEV;AVKEVEAL;KEVEALLS;LLSSI
DEI;SIDEIAAK;IAAKAIGK;AAKAIGKK;KIHQNNGL;GSLLAGAY;SLLAGAYA;LLAGAYAI;GAYAIST
L;AYAISTLI;YAISTLIK;ISTLIKQK;KQKLDGLK;KLDGLKNE;GLKNEGLK;GLKEKIDA;EKIDAAKK;C
SETFTNK;SETFTNKL;ETFTNKLK;FTNKLKEK;GVTDADAK;DAKEAILK;ILKTNGTK;KTNGTKTK;
AEELGKLF;KLFESVEV;ESVEVLSK;EVLSKAAK;KEMLANSV;EMLANSVK;KELTSPVV;ELTSPV
VA;PVVAESPK;VVAESPKK MKKNTLSAI;NTLSAILMT;TLSAILMTL;LSAILMTLF;SAILMTLFL;AILMTLFLF;ILMTLFLFI;FLFISC
NNS;FISCNNSGK;SANSADESV;DESVKGPNL;NLTEISKKI;KKITDSNAV;KITDSNAVL;ITDSNAV
LL;DSNAVLLAV;AVLLAVKEV;LLAVKEVEA;LAVKEVEAL;AVKEVEALL;EVEALLSSI;ALLSSIDEI;
LLSSIDEIA;SSIDEIAAK;SIDEIAAKA;EIAAKAIGK;IAAKAIGKK;HQNNGLDTE;TENNHNGSL;NGS
LLAGAY;SLLAGAYAI;LLAGAYAIS;GAYAISTLI;AYAISTLIK;AISTLIKQK;LIKQKLDGL;KLDGLKNE
G;GLKEKIDAA;ETFTNKLKE;KLKEKHTDL;KEKHTDLGK;HTDLGKEGV;AILKTNGTK;ELGKLFES
V;KLFESVEVL;ESVEVLSKA;VLSKAAKEM;MLANSVKEL;SVKELTSPV;LTSPVVAES;PVVAESP
KK NTLSAILMTL;TLSAILMTLF;LSAILMTLFL;SAILMTLFLF;AILMTLFLFI;ILMTLFLFIS;LMTLFLFISC;
FLFISCNNSG;LFISCNNSGK;TSANSADESV;SANSADESVK;SVKGPNLTEI;KGPNLTEISK;KITD
SNAVLL;DSNAVLLAVK;NAVLLAVKEV;VLLAVKEVEA;LLAVKEVEAL;KEVEALLSSI;EALLSSIDEI
;ALLSSIDEIA;LLSSIDEIAA;LSSIDEIAAK;SSIDEIAAKA;SIDEIAAKAI;EIAAKAIGKK;DTENNHNGS
L;TENNHNGSLL;SLLAGAYAIS;LLAGAYAIST;LAGAYAISTL;AGAYAISTLI;GAYAISTLIK;YAISTLI
KQK;AISTLIKQKL;TLIKQKLDGL;KLDGLKNEGL;GLKNEGLKEK;CSETFTNKLK;ETFTNKLKEK;E
AILKTNGTK;ILKTNGTKTK;KTKGAEELGK;KLFESVEVLS;ESVEVLSKAA;SVEVLSKAAK;EVLSK
AAKEM;VLSKAAKEML;AAKEMLANSV;EMLANSVKEL;MLANSVKELT;NSVKELTSPV;SVKELTS
PVV;TSPVVAESPK NTLSAILMTLF;TLSAILMTLFL;LSAILMTLFLF;SAILMTLFLFI;ILMTLFLFISC;FLFISCNNSGK;NTS
ANSADESV;TSANSADESVK;ESVKGPNLTEI;KITDSNAVLLA;ITDSNAVLLAV;VLLAVKEVEAL;LL
AVKEVEALL;ALLSSIDEIAA;LLSSIDEIAAK;EIAAKAIGKKI;DTENNHNGSLL;NHNGSLLAGAY;NG
SLLAGAYAI;SLLAGAYAIST;LLAGAYAISTL;LAGAYAISTLI;AYAISTLIKQK;YAISTLIKQKL;TLIKQ KLDGLK;KLDGLKNEGLK;GLKEKIDAAKK;KCSETFTNKLK;ETFTNKLKEKH;KLKEKHTDLGK;GVTDADAKEAI;AILKTNGTKTK;AEELGKLFESV;ELGKLFESVEV;KLFESVEVLSK;ESVEVLSKAAK;VEVLSKAAKEM;EVLSKAAKEML;VLSKAAKEMLA;KAAKEMLANSV;AAKEMLANSVK;KEMLANSVKEL;MLANSVKELTS;SVKELTSPVVA;LTSPVVAESPK;TSPVVAESPKK

Class 2

ADAKEAILKTNGTKT;EAILKTNGT;ADESVKGPNLTEISK;VKGPNLTEI;AGAYAISTLIKQKLD;ISTLIKQKL;AGAYAISTLIKQKLD;YAISTLIKQ;AILKTNGTKTKGAEE;LKTNGTKTK;AILMTLFLFISCNNS;LMTLFLFIS;AKEAILKTNGTKTKG;ILKTNGTKT;AKEAILKTNGTKTKG;LKTNGTKTK;AKEMLANSVKELTSP;LANSVKELT;AKEMLANSVKELTSP;MLANSVKEL;ANSVKELTSPVVAES;VKELTSPVV;AVKEVEALLSSIDEI;VKEVEALLS;AVLLAVKEVEALLSS;VKEVEALLS;AYAISTLIKQKLDGL;ISTLIKQKL;CSETFTNKLKEKHTD;FTNKLKEKH;DAKEAILKTNGTKTK;EAILKTNGT;DESVKGPNLTEISKK;VKGPNLTEI;DGLKNEGLKEKIDAA;LKNEGLKEK;DLGKEGVTDADAKEA;LGKEGVTDA;EAILKTNGTKTKGAE;ILKTNGTKT;EAILKTNGTKTKGAE;LKTNGTKTK;EGVTDADAKEAILKT;VTDADAKEA;EISKKITDSNAVLLA;ITDSNAVLL;EMLANSVKELTSPVV;LANSVKELT;EMLANSVKELTSPVV;MLANSVKEL;EMLANSVKELTSPVV;NSVKELTSP;EMLANSVKELTSPVV;SVKELTSPV;ESVEVLSKAAKEMLA;LSKAAKEML;ESVEVLSKAAKEMLA;VLSKAAKEM;ESVKGPNLTEISKKI;VKGPNLTEI;ETFTNKLKEKHTDLG;FTNKLKEKH;EVLSKAAKEMLANSV;VLSKAAKEM;FESVEVLSKAAKEML;EVLSKAAKE;FESVEVLSKAAKEML;VLSKAAKEM;GAYAISTLIKQKLDG;ISTLIKQKL;GKEGVTDADAKEAIL;VTDADAKEA;GSLLAGAYAISTLIK;LAGAYAIST;HNGSLLAGAYAISTL;LAGAYAIST;ILKTNGTKTKGAEEL;LKTNGTKTK;ILMTLFLFISCNNSG;FLFISCNNS;ISKKITDSNAVLLAV;ITDSNAVLL;ITDSNAVLLAVKEVE;ITDSNAVLL;KCSETFTNKLKEKHT;FTNKLKEKH;KEAILKTNGTKTKGA;ILKTNGTKT;KEAILKTNGTKTKGA;LKTNGTKTK;KEGVTDADAKEAILK;VTDADAKEA;KELTSPVVAESPKKP;LTSPVVAES;KEMLANSVKELTSPV;LANSVKELT;KEMLANSVKELTSPV;MLANSVKEL;KITDSNAVLLAVKEV;ITDSNAVLL;KKCSETFTNKLKEKH;KKCSETFTN;KKITDSNAVLLAVKE;ITDSNAVLL;KKNTLSAILMTLFLF;LSAILMTLF;KLDGLKNEGLKEKID;LKNEGLKEK;KNTLSAILMTLFLFI;LSAILMTLF;KQKLDGLKNEGLKEK;KQKLDGLKN;KAAKEMLANSVKELT;AKEMLANSV;KAAKEMLANSVKELT;MLANSVKEL;LAGAYAISTLIKQKL;LAGAYAIST;LAGAYAISTLIKQKL;YAISTLIKQ;LANSVKELTSPVVAE;LANSVKELT;LANSVKELTSPVVAE;VKELTSPVV;LAVKEVEALLSSIDE;VKEVEALLS;LDGLKNEGLKEKIDA;LKNEGLKEK;LFESVEVLSKAAKEM;SVEVLSKAA;LFLFISCNNSGKDGN;LFISCNNSG;LGKEGVTDADAKEAI;VTDADAKEA;LKTNGTKTKGAEELG;LKTNGTKTK;LLAGAYAISTLIKQK;LAGAYAIST;LLAVKEVEALLSSID;VKEVEALLS;LMTLFLFISCNNSGK;LFISCNNSG;LSAILMTLFLFISCN;LMTLFLFIS;LSKAAKEMLANSVKE;AKEMLANSV;LSSIDEIAAKAIGKK;IDEIAAKAI;MKKNTLSAILMTLFL;KNTLSAILM;MKKNTLSAILMTLFL;MKKNTLSAI;MLANSVKELTSPVVA;LANSVKELT;MLANSVKELTSPVVA;VKELTSPVV;MTLFLFISCNNSGKD;LFISCNNSG;NAVLLAVKEVEALLS;LAVKEVEAL;NGSLLAGAYAISTLI;LAGAYAIST;NHNGSLLAGAYAIST;LLAGAYAIS;NNHNGSLLAGAYAIS;SLLAGAYAI;NSADESVKGPNLTEI;ESVKGPNLT;NSVKELTSPVVAESP;VKELTSPVV;NTLSAILMTLFLFIS;LSAILMTLF;QKLDGLKNEGLKEKI;LKNEGLKEK;SADESVKGPNLTEIS;VKGPNLTEI;SAILMTLFLFISCNN;LMTLFLFIS;SETFTNKLKEKHTDL;FTNKLKEKH;SKKITDSNAVLLAVK;ITDSNAVLL;SKAAKEMLANSVKEL;AKEMLANSV;SLLAGAYAISTLIKQ;LAGAYAIST;SSIDEIAAKAIGKKI;IDEIAAKAI;SVEVLSKAAKEMLAN;LSKAAKEML;SVEVLSKAAKEMLAN;VLSKAAKEM;SVKELTSPVVAESPK;VKELTSPVV;TEISKKITDSNAVLL;KKITDSNAV;TLFLFISCNNSGKDG;LFISCNNSG;TLSAILMTLFLFISC;LMTLFLFIS;VEVLSKAAKEMLANS;VLSKAAKEM;VKELTSPVVAESPKK;VKELTSPVV;VKEVEALLSSIDEIA;VKEVEALLS;VLLAVKEVEALLSSI;VKEVEALLS;VLSKAAKEMLANSVK;VLSKAAKEM;YAISTLIKQKLDGLK;ISTLIKQKL;AAKEMLANSVKELTS;LANSVKELT;AAKEMLANSVKELTS;MLANSVKEL

B) Borrelia afzelii MHC class1 & 2 epitopes

<CAA59725 outer surface protein A;Protein;Borrelia afzelii>

SEQ ID NO:172553-172996

Class 1

KYLLGIGL;YLLGIGLI;LLGIGLIL;GIGLILAL;GLILALIA;ILALIACK;LIACKQNV;NVSSLDEK;SLDEKNSA;SVDLPGEM;DLPGEMKV;LPGEMKVL;EMKVLVSK;KVLVSKEK;SLKATVDK;ATVDKIEL;TVDKIELK;ELKGTSDK;GTKDDKSK;KLTIADDL;TIADDLSK;KTTFELFK;TTFELFKE;ELFKEDGK;FK

Fig. 40 continued

EDGKTL;KEDGKTLV;VSRKVSSK;KTSTDEMF;GELSAKTM;LSAKTMTR;MTRENGTK;TRENGT
KL;KLEYTEMK;GTGKAKEV;EVLKNFTL;FTLEGKVA;VANDKVTL;VKEGTVTL;TLSKEIAK;EIAKS
GEV;ALNDTNTT;NTTQATKK;ATKKTGAW;KTGAWDSK;TSTLTISV;LTISVNSK;TISVNSKK;TTQ
LVFTK;TKQDTITV;DTITVQKY;EGTAVEIK;TAVEIKTL;EIKTLDEL;TLDELKNA

KYLLGIGLI;YLLGIGLIL;LLGIGLILA;GIGLILALI;LILALIACK;ALIACKQNV;SLDEKNSAS;SVDLPGE
MK;VDLPGEMKV;DLPGEMKVL;LPGEMKVLV;GKYSLKATV;YSLKATVDK;SLKATVDKI;ATVDKI
ELK;GSGVLEGTK;LTIADDLSK;TIADDLSKT;DLSKTTFEL;SKTTFELFK;FKEDGKTLV;LVSRKVS
SK;SRKVSSKDK;STDEMFNEK;EMFNEKGEL;ELSAKTMTR;TMTRENGTK;MTRENGTKL;RENG
TKLEY;KSDGTGKAK;TGKAKEVLK;KEVLKNFTL;KVANDKVTL;ANDKVTLEV;TLEVKEGTV;EVK
EGTVTL;VTLSKEIAK;KEIAKSGEV;IAKSGEVTV;KSGEVTVAL;TVALNDTNT;ALNDTNTTQ;DTNT
TQATK;KKTGAWDSK;KTSTLTISV;TLTISVNSK;LTISVNSKK;KTTQLVFTK;FTKQDTITV;KQDTIT
VQK;KYDSAGTNL;GTNLEGTAV;NLEGTAVEI;VEIKTLDEL;EIKTLDELK;TLDELKNAL

KYLLGIGLIL;YLLGIGLILA;LLGIGLILAL;LGIGLILALI;GLILALIACK;KQNVSSLDEK;SLDEKNSASV
;SASVDLPGEM;ASVDLPGEMK;SVDLPGEMKV;DLPGEMKVLV;LPGEMKVLVS;EMKVLVSKEK;
KVLVSKEKDK;KDKDGKYSLK;KYSLKATVDK;KATVDKIELK;KIELKGTSDK;GVLEGTKDDK;GTK
DDKSKAK;KLTIADDLSK;TIADDLSKTT;IADDLSKTTF;DLSKTTFELF;LSKTTFELFK;ELFKEDGK
TL;TLVSRKVSSK;VSRKVSSKDK;TSTDEMFNEK;DEMFNEKGEL;KTMTRENGTK;TMTRENGTK
L;GTKLEYTEMK;GTGKAKEVLK;VLKNFTLEGK;VANDKVTLEV;VTLEVKEGTV;LEVKEGTVTL;T
VTLSKEIAK;EIAKSGEVTV;AKSGEVTVAL;TVALNDTNTT;ALNDTNTTQA;DTNTTQATKK;GAWD
SKTSTL;SKTSTLTISV;STLTISVNSK;TLTISVNSKK;SVNSKKTTQL;KKTTQLVFTK;QLVFTKQDTI
;KTLDELKNAL;TLDELKNALK

YLLGIGLILAL;LLGIGLILALI;ILALIACKQNV;LIACKQNVSSL;NVSSLDEKNSA;SSLDEKNSASV;S
ASVDLPGEMK;SVDLPGEMKVL;VDLPGEMKVLV;LPGEMKVLVSK;LVSKEKDKDGK;KYSLKATV
DKI;SLKATVDKIEL;GTSDKDNGSGV;TIADDLSKTTF;DLSKTTFELFK;TTFELFKEDGK;FELFKED
GKTL;ELFKEDGKTLV;KTLVSRKVSSK;LVSRKVSSKDK;KTSTDEMFNEK;EMFNEKGELSA;MFN
EKGELSAK;KTMTRENGTKL;MTRENGTKLEY;YTEMKSDGTGK;EVLKNFTLEGK;VLKNFTLEGK
V;FTLEGKVANDK;TLEGKVANDKV;KVANDKVTLEV;VANDKVTLEVK;KVTLEVKEGTV;TLEVKE
GTVTL;EVKEGTVTLSK;GTVTLSKEIAK;KEIAKSGEVTV;EIAKSGEVTVA;IAKSGEVTVAL;ALNDT
NTTQAT;TTQATKKTGAW;ATKKTGAWDSK;AWDSKTSTLTI;TSTLTISVNSK;STLTISVNSKK;SV
NSKKTTQLV;SKKTTQLVFTK;TQLVFTKQDTI;LVFTKQDTITV;FTKQDTITVQK;DTITVQKYDSA;V
QKYDSAGTNL;SAGTNLEGTAV;NLEGTAVEIKT;LEGTAVEIKTL;TAVEIKTLDEL;AVEIKTLDELK;
KTLDELKNALK

Class 2
AKEVLKNFTLEGKVA;LKNFTLEGK;AKEVLKNFTLEGKVA;VLKNFTLEG;ALNDTNTTQATKKTG;
NTTQATKKT;AWDSKTSTLTISVNS;WDSKTSTLT;DEMFNEKGELSAKTM;MFNEKGELS;DGKTL
VSRKVSSKDK;GKTLVSRKV;DKVTLEVKEGTVTLS;LEVKEGTVT;DLPGEMKVLVSKEKD;MKVL
VSKEK;DTITVQKYDSAGTNL;VQKYDSAGT;EDGKTLVSRKVSSKD;GKTLVSRKV;ELFKEDGKT
LVSRKV;FKEDGKTLV;EMFNEKGELSAKTMT;EKGELSAKT;EVKEGTVTLSKEIAK;VKEGTVTLS;
EVLKNFTLEGKVAND;LKNFTLEGK;EVTVALNDTNTTQAT;LNDTNTTQA;EVTVALNDTNTTQAT;
VALNDTNTT;EYTEMKSDGTGKAKE;MKSDGTGKA;EYTEMKSDGTGKAKE;YTEMKSDGT;FKE
DGKTLVSRKVSS;GKTLVSRKV;FNEKGELSAKTMTRE;EKGELSAKT;FTKQDTITVQKYDSA;FTK
QDTITV;GAWDSKTSTLTISVN;WDSKTSTLT;GEMKVLVSKEKDKDG;MKVLVSKEK;GEVTVALN
DTNTTQA;VALNDTNTT;GIGLILALIACKQNV;ILALIACKQ;GKAKEVLKNFTLEGK;VLKNFTLEG;G
KTLVSRKVSSKDKT;GKTLVSRKV;GLILALIACKQNVSS;ILALIACKQ;GTKLEYTEMKSDGTG;YT
EMKSDGT;IGLILALIACKQNVS;ILALIACKQ;ISVNSKKTTQLVFTK;ISVNSKKTT;ISVNSKKTTQLV
FTK;VNSKKTTQL;ITVQKYDSAGTNLEG;VQKYDSAGT;ITVQKYDSAGTNLEG;YDSAGTNLE;KA
KEVLKNFTLEGKV;LKNFTLEGK;KAKEVLKNFTLEGKV;VLKNFTLEG;KEDGKTLVSRKVSSK;GK
TLVSRKV;KEVLKNFTLEGKVAN;LKNFTLEGK;KEVLKNFTLEGKVAN;VLKNFTLEG;KKTGAWDS
KTSTLTI;WDSKTSTLT;KKYLLGIGLILALIA;LLGIGLILA;KLEYTEMKSDGTGKA;YTEMKSDGT;KQ
DTITVQKYDSAGT;ITVQKYDSA;KSGEVTVALNDTNTT;EVTVALNDT;KTGAWDSKTSTLTIS;WD
SKTSTLT;KTSTLTISVNSKKTT;LTISVNSKK;KTTQLVFTKQDTITV;KTTQLVFTK;KTTQLVFTKQD

Fig. 40 continued

TITV;VFTKQDTIT;KVTLEVKEGTVTLSK;VKEGTVTLS;KYLLGIGLILALIAC;LLGIGLILA;LEVKEGT
VTLSKEIA;VKEGTVTLS;LEYTEMKSDGTGKAK;MKSDGTGKA;LEYTEMKSDGTGKAK;YTEMKS
DGT;LFKEDGKTLVSRKVS;GKTLVSRKV;LGIGLILALIACKQN;IGLILALIA;LKNFTLEGKVANDKV;
LKNFTLEGK;LLGIGLILALIACKQ;IGLILALIA;LNDTNTTQATKKTGA;NTTQATKKT;LPGEMKVLVS
KEKDK;MKVLVSKEK;LTISVNSKKTTQLVF;ISVNSKKTT;LTISVNSKKTTQLVF;VNSKKTTQL;LVF
TKQDTITVQKYD;FTKQDTITV;MKKYLLGIGLILALI;LLGIGLILA;NGTKLEYTEMKSDGT;TKLEYTE
MK;NVSSLDEKNSASVDL;LDEKNSASV;PGEMKVLVSKEKDKD;MKVLVSKEK;QDTITVQKYDSA
GTN;VQKYDSAGT;QKYDSAGTNLEGTAV;YDSAGTNLE;QLVFTKQDTITVQKY;FTKQDTITV;SG
EVTVALNDTNTTQ;VALNDTNTT;SSLDEKNSASVDLPG;EKNSASVDL;STLTISVNSKKTTQL;ISV
NSKKTT;STLTISVNSKKTTQL;TISVNSKKT;SVNSKKTTQLVFTKQ;VNSKKTTQL;TDEMFNEKGE
LSAKT;MFNEKGELS;TEMKSDGTGKAKEVL;MKSDGTGKA;TGAWDSKTSTLTISV;WDSKTSTLT
;TGKAKEVLKNFTLEG;AKEVLKNFT;TISVNSKKTTQLVFT;ISVNSKKTT;TISVNSKKTTQLVFT;VN
SKKTTQL;TITVQKYDSAGTNLE;VQKYDSAGT;TKKTGAWDSKTSTLT;KTGAWDSKT;TKLEYTE
MKSDGTGK;YTEMKSDGT;TLEVKEGTVTLSKEI;VKEGTVTLS;TLTISVNSKKTTQLV;ISVNSKKT
T;TLTISVNSKKTTQLV;VNSKKTTQL;TQLVFTKQDTITVQK;FTKQDTITV;TSTLTISVNSKKTTQ;IS
VNSKKTT;TTQLVFTKQDTITVQ;FTKQDTITV;TVALNDTNTTQATKK;LNDTNTTQA;TVALNDTNT
TQATKK;VALNDTNTT;TVQKYDSAGTNLEGT;VQKYDSAGT;TVQKYDSAGTNLEGT;YDSAGTN
LE;VALNDTNTTQATKKT;LNDTNTTQA;VALNDTNTTQATKKT;VALNDTNTT;VDLPGEMKVLVSK
EK;LPGEMKVLV;VDLPGEMKVLVSKEK;VDLPGEMKV;VFTKQDTITVQKYDS;FTKQDTITV;VKE
GTVTLSKEIAKS;VKEGTVTLS;VLKNFTLEGKVANDK;LKNFTLEGK;VNSKKTTQLVFTKQD;VNS
KKTTQL;VQKYDSAGTNLEGTA;VQKYDSAGT;VQKYDSAGTNLEGTA;YDSAGTNLE;VSSLDEK
NSASVDLP;EKNSASVDL;VTLEVKEGTVTLSKE;VKEGTVTLS;VTVALNDTNTTQATK;LNDTNTT
QA;VTVALNDTNTTQATK;VALNDTNTT;WDSKTSTLTISVNSK;WDSKTSTLT;YLLGIGLILALIACK
;IGLILALIA;YTEMKSDGTGKAKEV;MKSDGTGKA;YTEMKSDGTGKAKEV;YTEMKSDGT <YP_853838 outer surface protein B;Protein;Borrelia afzelii PKo>
SEQ ID NO:172997-173522
Class 1
KQYLLVFA;QYLLVFAL;YLLVFALV;LLVFALVL;LVFALVLA;VFALVLAL;FALVLALI;ALVLALIA;ALI
ACSQK;SQKGTEPK;NTPKDSKK;VLAEENSV;AEENSVPL;EENSVPLF;PLFNGNKI;LFNGNKIF;K
IFVSKEK;KEKNSAGK;NSAGKYEL;SAGKYELR;ATVDTVEL;TVDTVELK;DTVELKGV;ELKGVSD
K;SGKLEGTK;GTKADKTK;KTKVAMTI;AMTIADDL;IADDLNTI;NTITVETY;ETYDASNK;TYDASN
KK;KTGSEVVK;VVKKQGSV;KKQGSVIK;SVIKESYK;KANKLDSK;KLDSKKIT;TRENETTL;TTLEY
SEM;EMTDSSNA;ATKAVETL;ETLKNGIK;TLKNGIKL;IKLEGSLV;SLVGGKTT;LVGGKTTV;KLTE
GTIT;EGTITLTR;TLTREIEQ;YLNDTTSG;DTTSGSTK;TTSGSTKK;STKKTATW;ETTNTLTI;LTISA
DSK;TISADSKK;SADSKKTK;KTKDFVFL;FVFLTDGT;VFLTDGTI;FLTDGTIT;LTDGTITV;GTITVQ
AY;AYDTAGTK;SEIKDLAA;EIKDLAAL;DLAALKAA;LAALKAAL;AALKAALK KQYLLVFAL;QYLLVFALV;YLLVFALVL;LLVFALVLA;LVFALVLAL;VFALVLALI;FALVLALIA;VLALI
ACSQ;LALIACSQK;CSQKGTEPK;SQDHNDQEI;IINSDNTPK;TPKDSKKDL;TVLAEENSV;LAEEN
SVPL;AEENSVPLF;EENSVPLFN;SVPLFNGNK;VPLFNGNKI;LFNGNKIFV;FVSKEKNSA;NSAGK
YELR;GKYELRATV;ELRATVDTV;RATVDTVEL;ATVDTVELK;KADKTKVAM;KTKVAMTIA;TIADD
LNTI;ETYDASNKK;KTGSEVVKK;EVVKKQGSV;GSVIKESYK;SVIKESYKA;KANKLDSKK;KLDSK
KITR;ITRENETTL;RENETTLEY;ETTLEYSEM;TTLEYSEMT;EMTDSSNAT;MTDSSNATK;ATKAV
ETLK;ETLKNGIKL;GIKLEGSLV;SLVGGKTTV;LVGGKTTVK;TTVKLTEGT;KLTEGTITL;REIEQD
GKV;IEQDGKVKI;YLNDTTSGS;DTTSGSTKK;GSTKKTATW;TWNETTNTL;NETTNTLTI;TTNTLT
ISA;TLTISADSK;LTISADSKK;ISADSKKTK;KTKDFVFLT;FVFLTDGTI;FLTDGTITV;ITVQAYDTA;
VQAYDTAGT;QAYDTAGTK;AYDTAGTKL;KLEGNSSEI;NSSEIKDLA;SEIKDLAAL;EIKDLAALK;D
LAALKAAL;LAALKAALK KQYLLVFALV;QYLLVFALVL;YLLVFALVLA;LLVFALVLAL;LVFALVLALI;VLALIACSQK;ACSQKG
TEPK;SQDHNDQEII;EIINSDNTPK;LTVLAEENSV;VLAEENSVPL;LAEENSVPLF;NSVPLFNGNK;
SVPLFNGNKI;VPLFNGNKIF;PLFNGNKIFV;VSKEKNSAGK;KNSAGKYELR;YELRATVDTV;RAT
VDTVELK;TVDTVELKGV;TVELKGVSDK;VSDKNNGSGK;MTIADDLNTI;IADDLNTITV;DLNTITV
ETY;NTITVETYDA;TVETYDASNK;ETYDASNKKT;EVVKKQGSVI;VVKKQGSVIK;KQGSVIKESY;

VIKESYKANK;SYKANKLDSK;KITRENETTL;ETTLEYSEMT;EMTDSSNATK;MTDSSNATKA,NAT
KAVETLK;KAVETLKNGI;AVETLKNGIK;VETLKNGIKL;KLEGSLVGGK;SLVGGKTTVK;LVGGKTT
VKL;TTVKLTEGTI;VKLTEGTITL;KLTEGTITLT;LTEGTITLTR;LTREIEQDGK;IEQDGKVKIY;YLND
TTSGST;SGSTKKTATW;ATWNETTNTL;ETTNTLTISA;NTLTISADSK;TLTISADSKK;TISADSKKT
K;VFLTDGTITV;FLTDGTITVQ;LTDGTITVQA;VQAYDTAGTK;QAYDTAGTKL;KLEGNSSEIK;DLA
ALKAALK

MKQYLLVFALV;KQYLLVFALVL;YLLVFALVLAL;LLVFALVLALI;ALVLALIACSQ;LVLALIACSQK;I
ACSQKGTEPK;STSQDHNDQEI;DLTVLAEENSV;TVLAEENSVPL;VLAEENSVPLF;NSVPLFNGN
KI;SVPLFNGNKIF;VPLFNGNKIFV;LFNGNKIFVSK;FVSKEKNSAGK;VSKEKNSAGKY;KEKNSA
GKYEL;EKNSAGKYELR;SAGKYELRATV;ELRATVDTVEL;ATVDTVELKGV;DTVELKGVSDK;GV
SDKN

ESY;VKKQGSVIK;SKKDLTVLAEENSVP;SKKDLTVLA;SLVGGKTTVKLTEGT;VGGKTTVKL;SSE
IKDLAALKAALK;IKDLAALKA;SVPLFNGNKIFVSKE;VPLFNGNKI;TATWNETTNTLTISA;WNETT
NTLT;TDGTITVQAYDTAGT;TITVQAYDT;TGSEVVKKQGSVIKE;VKKQGSVIK;TITVQAYDTAGT
KLE;VQAYDTAGT;TKAVETLKNGIKLEG;VETLKNGIK;TKDFVFLTDGTITVQ;FLTDGTITV;TKKTA
TWNETTNTLT;ATWNETTNT;TKKTATWNETTNTLT;TKKTATWNE;TLKNGIKLEGSLVGG;IKLEG
SLVG;TLKNGIKLEGSLVGG;LKNGIKLEG;TPKDSKKDLTVLAEE;SKKDLTVLA;TTVKLTEGTITLT
RE;LTEGTITLT;TVKLTEGTITLTREI;LTEGTITLT;TVQAYDTAGTKLEGN;VQAYDTAGT;TYDASN
KKTGSEVVK;NKKTGSEVV;VETLKNGIKLEGSLV;LKNGIKLEG;VFALVLALIACSQKG;LVLALIAC
S;VFLTDGTITVQAYDT;FLTDGTITV;VGGKTTVKLTEGTIT;VGGKTTVKL;VKIYLNDTTSGSTKK;Y
LNDTTSGS;VKLTEGTITLTREIE;LTEGTITLT;VLALIACSQKGTEPK;VLALIACSQ;VPLFNGNKIFV
SKEK;VPLFNGNKI;VQAYDTAGTKLEGNS;VQAYDTAGT;YDASNKKTGSEVVKK;NKKTGSEVV;
YELRATVDTVELKGV;YELRATVDT;YLLVFALVLALIACS;FALVLALIA;YLLVFALVLALIACS;LLVF
ALVLA;YLLVFALVLALIACS;LVFALVLAL;YLNDTTSGSTKKTAT;TTSGSTKKT

<CAF34027 outer surface protein VlsE;Protein;Borrelia afzelii PKo>
SEQ ID NO:173523-174053
Class 1
KISSAIFL;SAIFLTAL;AIFLTALL;IFLTALLV;FLTALLVF;LTALLVFI;ALLVFINC;LLVFINCK;FINCKN
NA;FYESIINL;IINLGNGF;FIDVFNAF;FNAFSGLV;GLVADTFF;LVADTFFK;TFFKSDPK;KSDVKTY
F;FESISSTL;ESISSTLK;SISSTLKA;SSTLKATK;TLKATKGK;KLDELVSA;KASVESAV;SAVDEVS
K;KWLEEMIK;WLEEMIKA;MIKAAEEA;KAAEEAAK;DSAANHGA;SAANHGAK;DSVKGIAK;KGIA
KGIK;GIKGIVDA;GIVDAAGK;AGKALGEK;ALGEKGAL;ALKDVKAA;EANADAGK;FAGNANAA;NA
AVGAAA;GAAADIAK;IAKAAGAV;KAAGAVTA;AAGAVTAV;AVSGEQIL;VSGEQILK;ILKAIVEA;D
PANQAGK;AEEAKNPI;DDNGAAFK;AAFKDEMK;AFKDEMKK;KIAAAIVL;IAAAIVLR;AAIVLRGV;I
VLRGVAK;AKDGKFAV KISSAIFLT;ISSAIFLTA;SSAIFLTAL;SAIFLTALL;AIFLTALLV;IFLTALLVF;FLTALLVFI;ALLVFINC
K;FINCKNNAV;AVGKGNDDK;SVKTFYESI;TFYESIINL;SIINLGNGF;IINLGNGFI;NLGNGFIDV;G
FIDVFNAF;DVFNAFSGL;FSGLVADTF;GLVADTFFK;LVADTFFKS;DTFFKSDPK;TFFKSDPKK;D
VKTYFESI;YFESISSTL;ISSTLKATK;STLKATKGK;TLKATKGKL;ATKGKLDEL;KLDELVSAK;EGG
SVKASV;SVKASVESA;SVESAVDEV;ESAVDEVSK;SAVDEVSKW;AVDEVSKWL;EVSKWLEEM;
WLEEMIKAA;EMIKAAEEA;MIKAAEEAA;KAAEEAAKV;DSAANHGAK;ANHGAKADK;SVKGIAKGI
;GIAKGIKGI;GIKGIVDAA;IVDAAGKAL;AAGKALGEK;ALGEKGALK;ALKDVKAAA;NADAGKLFA;
KLFAGNANA;FAGNANAAV;NANAAVGAA;DIAKAAGAV;KAAGAVTAV;TAVSGEQIL;AVSGEQIL
K;QILKAIVEA;ILKAIVEAA;AGKKAEEEAK;AEEAKNPIA;EEAKNPIAA;NPIAAAIGT;TDDDNGAAF;G
AAFKDEMK;AAFKDEMKK;KIAAAIVLR;AAAIVLRGV;AIVLRGVAK;VAKDGKFAV KISSAIFLTA;ISSAIFLTAL;SSAIFLTALL;SAIFLTALLV;AIFLTALLVF;IFLTALLVFI;FLTALLVFIN;TA
LLVFINCK;DSVKTFYESI;SVKTFYESII;KTFYESIINL;ESIINLGNGF;SIINLGNGFI;NGFIDVFNAF;
DVFNAFSGLV;AFSGLVADTF;FSGLVADTFF;SGLVADTFFK;GLVADTFFKS;ADTFFKSDPK;DTF
FKSDPKK;DPKKSDVKTY;KTYFESISST;TYFESISSTL;YFESISSTLK;SISSTLKATK;SSTLKATKG
K;ATKGKLDELV;KLDELVSAKK;SAKKGEGGSV;SVKASVESAV;ASVESAVDEV;ESAVDEVSKW;
SAVDEVSKWL;EVSKWLEEMI;VSKWLEEMIK;EEMIKAAEEA;MIKAAEEAAK;AEEAAKVGGT;KV
GGTGGDGK;AANHGAKADK;HGAKADKDSV;SVKGIAKGIK;GIAKGIKGIV;GIVDAAGKAL;DAAG
KALGEK;KALGEKGALK;EANADAGKLF;KLFAGNANAA;LFAGNANAAV;NANAAVGAAA;AVGAA
ADIAK;AKAAGAVTAV;TAVSGEQILK;AVSGEQILKA;QILKAIVEAA;AIVEAAGDPA;EAAGDPANQ
A;AEEAKNPIAA;EEAKNPIAAA;EAKNPIAAAI;GTDDDNGAAF;NGAAFKDEMK;GAAFKDEMKK;D
KIAAAIVLR;IAAAIVLRGV;AAIVLRGVAK;VLRGVAKDGK;GVAKDGKFAV;VAKDGKFAVK KKISSAIFLTA;KISSAIFLTAL;ISSAIFLTALL;SSAIFLTALLV;SAIFLTALLVF;AIFLTALLVFI;FLTALL
VFINC;LTALLVFINCK;LLVFINCKNNA;LVFINCKNNAV;FINCKNNAVGK;YESIINLGNGF;ESIINLG
NGFI;IINLGNGFIDV;FIDVFNAFSGL;DVFNAFSGLVA;NAFSGLVADTF;AFSGLVADTFF;FSGLVA
DTFFK;VADTFFKSDPK;DPKKSDVKTYF;KTYFESISSTL;TYFESISSTLK;ESISSTLKATK;ISSTLK
ATKGK;KATKGKLDELV;KGKLDELVSAK;SAKKGEGGSVK;KASVESAVDEV;SVESAVDEVSK;E
SAVDEVSKWL;EVSKWLEEMIK;EEMIKAAEEAA;EMIKAAEEAAK;MIKAAEEAAKV;KIGDSAANH GA;SAANHGAKADK;DSVKGIAKGIK;GIKGIVDAAGK;ALGEKGALKDV;DEANADAGKLF;KLFAGNANAAV;FAGNANAAVGA;AAVGAAADIAK;AAADIAKAAGA;IAKAAGAVTAV;AVTAVSGEQIL;VTAVSGEQILK;AVSGEQILKAI;AAGDPANQAGK;AEEAKNPIAAA;EEAKNPIAAAI;IGTDDDNGAAF;GTDDDNGAAFK;NGAAFKDEMKK;AFKDEMKKSDK;KSDKIAAAIVL;KIAAAIVLRGV;IAAAIVLRGVA;AAAIVLRGVAK;IVLRGVAKDGK;VLRGVAKDGKF;GVAKDGKFAVK

Class 2

ADAGKLFAGNANAAV;LFAGNANAA;ADIAKAAGAVTAVSG;IAKAAGAVT;ADTFFKSDPKKSDVK;FFKSDPKKS;ADTFFKSDPKKSDVK;FKSDPKKSD;AEEAKNPIAAAIGTD;AKNPIAAAI;AGAVTAVSGEQILKA;VTAVSGEQI;AGKLFAGNANAAVGA;FAGNANAAV;AGNANAAVGAAADIA;ANAAVGAAA;AIFLTALLVFINCKN;FLTALLVFI;AIVLRGVAKDGKFAV;LRGVAKDGK;AKGIKGIVDAAGKAL;IKGIVDAAG;AKAAGAVTAVSGEQI;AKAAGAVTA;ALLVFINCKNNAVGK;FINCKNNAV;ALLVFINCKNNAVGK;VFINCKNNA;ANAAVGAAADIAKAA;AVGAAADIA;DAGKLFAGNANAAVG;FAGNANAAV;DGKIGDSAANHGAKA;IGDSAANHG;DIAKAAGAVTAVSGE;AKAAGAVTA;DKIAAAIVLRGVAKD;IAAAIVLRG;DSVKTFYESIINLGN;FYESIINLG;DSVKTFYESIINLGN;VKTFYESII;DTFFKSDPKKSDVKT;FFKSDPKKS;DTFFKSDPKKSDVKT;FKSDPKKSD;DVFNAFSGLVADTFF;FNAFSGLVA;DVFNAFSGLVADTFF;VFNAFSGLV;DVKTYFESISSTLKA;FESISSTLK;DVKTYFESISSTLKA;YFESISSTL;EAKNPIAAAIGTDDD;IAAAIGTDD;EEAKNPIAAAIGTDD;AKNPIAAAI;EQILKAIVEAAGDPA;LKAIVEAAG;ESIINLGNGFIDVFN;IINLGNGFI;FAGNANAAVGAAADI;FAGNANAAV;FESISSTLKATKGKL;FESISSTLK;FIDVFNAFSGLVADT;FNAFSGLVA;FIDVFNAFSGLVADT;VFNAFSGLV;FKSDPKKSDVKTYFE;FKSDPKKSD;FLTALLVFINCKNNA;FLTALLVFI;FNAFSGLVADTFFKS;FNAFSGLVA;FYESIINLGNGFIDV;FYESIINLG;FYESIINLGNGFIDV;IINLGNGFI;GAVTAVSGEQILKAI;VTAVSGEQI;GDGKIGDSAANHGAK;IGDSAANHG;GEQILKAIVEAAGDP;LKAIVEAAG;GFIDVFNAFSGLVAD;FNAFSGLVA;GFIDVFNAFSGLVAD;VFNAFSGLV;GGDGKIGDSAANHGA;IGDSAANHG;GIAKGIKGIVDAAGK;IKGIVDAAG;GIKGIVDAAGKALGE;IVDAAGKAL;GIVDAAGKALGEKGA;IVDAAGKAL;GKIGDSAANHGAKAD;IGDSAANHG;GKLFAGNANAAVGAA;FAGNANAAV;GLVADTFFKSDPKKS;DTFFKSDPK;GNANAAVGAAADIAK;AVGAAADIA;GNGFIDVFNAFSGLV;FIDVFNAFS;GAAADIAKAAGAVTA;IAKAAGAVT;IAKGIKGIVDAAGKA;IKGIVDAAG;IAKAAGAVTAVSGEQ;IAKAAGAVT;IDVFNAFSGLVADTF;FNAFSGLVA;IDVFNAFSGLVADTF;VFNAFSGLV;IFLTALLVFINCKNN;FLTALLVFI;IKGIVDAAGKALGEK;IVDAAGKAL;ISSAIFLTALLVFIN;FLTALLVFI;IVDAAGKALGEKGAL;IVDAAGKAL;IAAAIVLRGVAKDGK;AIVLRGVAK;IAAAIVLRGVAKDGK;IAAAIVLRG;KAEEAKNPIAAAIGT;AKNPIAAAI;KAIVEAAGDPANQAG;AAGDPANQA;KDSVKTFYESIINLG;KTFYESIIN;KGIAKGIKGIVDAAG;IAKGIKGIV;KGIKGIVDAAGKALG;IVDAAGKAL;KGIVDAAGKALGEKG;IVDAAGKAL;KISSAIFLTALLVFI;AIFLTALLV;KIAAAIVLRGVAKDG;IAAAIVLRG;KKISSAIFLTALLVF;ISSAIFLTA;KKSDKIAAAIVLRGV;IAAAIVLRG;KLFAGNANAAVGAAA;FAGNANAAV;KSDKIAAAIVLRGVA;IAAAIVLRG;KSDVKTYFESISSTL;KSDVKTYFE;KTFYESIINLGNGFI;FYESIINLG;KTFYESIINLGNGFI;YESIINLGN;KTYFESISSTLKATK;FESISSTLK;KTYFESISSTLKATK;YFESISSTL;KAAGAVTAVSGEQIL;VTAVSGEQI;LFAGNANAAVGAAAD;FAGNANAAV;LKAIVEAAGDPANQA;LKAIVEAAG;LLVFINCKNNAVGKG;FINCKNNAV;LLVFINCKNNAVGKG;VFINCKNNA;LTALLVFINCKNNAV;VFINCKNNA;LVADTFFKSDPKKSD;DTFFKSDPK;LVADTFFKSDPKKSD;FFKSDPKKS;LVFINCKNNAVGKGN;CKNNAVGKG;LVFINCKNNAVGKGN;FINCKNNAV;MKKISSAIFLTALLV;MKKISSAIF;MKKSDKIAAAIVLRG;DKIAAAIVL;NADAGKLFAGNANAA;AGKLFAGNA;NANAAVGAAADIAKA;AVGAAADIA;NGFIDVFNAFSGLVA;FIDVFNAFS;NGFIDVFNAFSGLVA;VFNAFSGLV;NAAVGAAADIAKAAG;AVGAAADIA;SAIFLTALLVFINCK;FLTALLVFI;SDKIAAAIVLRGVAK;IAAAIVLRG;SDVKTYFESISSTLK;YFESISSTL;SGEQILKAIVEAAGD;LKAIVEAAG;SIINLGNGFIDVFNA;IINLGNGFI;SSAIFLTALLVFINC;FLTALLVFI;SVKTFYESIINLGNG;FYESIINLG;SVKTFYESIINLGNG;YESIINLGN;TALLVFINCKNNAVG;FINCKNNAV;TALLVFINCKNNAVG;VFINCKNNA;TFFKSDPKKSDVKTY;FKSDPKKSD;TFYESIINLGNGFID;FYESIINLG;TFYESIINLGNGFID;IINLGNGFI;TFYESIINLGNGFID;YESIINLGN;TGGDGKIGDSAANHG;GKIGDSAAN;TYFESISSTLKATKG;FESISSTLK;TYFESISSTLKATKG;YFESISSTL;VADTFFKSDPKKSDV;FFKSDPKKS;VADTFFKSDPKKSDV;FKSDPKKSD;VFINCKNNAVGKGND;CKNNAVGKG;VFNAFSGLVADTFFK;VFNAFSGLV;VGAAADIAKAAGAVT;DIAKAAGAV;VKTFYESIINLGNGF;FYESIINLG;VKTFYESIINLGNGF;YESIINLGN;VKTYFESISSTLKAT;FESISSTLK;VKTYFESISSTLKAT;YFESISSTL;VSGEQILKAIVEAAG;ILKAIVEAA;YESIINLGNGFIDVF;IINLGNGFI;YFESISSTLKATKGK;FESISSTLK;AAADIAKAAGAVTAV;IAKAAGAVT;AAAIVLRGVAKDGKF;LRGVAKDGK;AAAIVLRGVAKDGK

Fig. 40 continued

F;VLRGVAKDG;AADIAKAAGAVTAVS;IAKAAGAVT;AAGAVTAVSGEQILK;VTAVSGEQI;AAIVLR
GVAKDGKFA;LRGVAKDGK;AAIVLRGVAKDGKFA;VLRGVAKDG

C) Borrelia garinii MHC class 1 & 2 epitopes

<CAH10086 CRASP-1;Protein;Borrelia garinii>
SEQ ID NO:174054-174491
Class 1
KTKLNIIK;NIIKLNIL;KLNILTTI;ILTTILTL;LTTILTLI;TILTLICI;TLICISCA;LICISCAV;CISCAVDK;NT
KDFENK;FENKSQDL;EPSNTKNK;KETIISKL;TIISKLEK;LEKMIKDL;EIAKITNT;ITNTQIDF;QIDFL
ENF;TISEDIEM;ISEDIEMK;DIEMKIKR;KIKRIIYS;KRIIYSSL;IIYSSLNY;YSSLNYEI;SLNYEIEK;EI
EKINTL;KINTLKEI;TLKEILDK;KEILDKLY;EILDKLYK;KLYKNHKY;LYKNHKYK;HKYKTTAR;TTAR
NFIL;NFILNISI;FILNISIK;ILNISIKI;SIKIQFQI;IQFQIENA;QFQIENAL;FQIENALE;QIENALEL;ENAL
ELMK;IEDASEIL;EILNQERY;NQERYEIL;QERYEILL;ERYEILLK;YEILLKHV;NLKQKFEK;KILNETI
K;ILNETIKA;ETIKAYNQ;LAHMDENY;HMDENYKE;NYKEFDPL;KEFDPLNL KLNIIKLNI;IKLNILTTI;KLNILTTIL;NILTTILTL;ILTTILTLI;TTILTLICI;ILTLICISC;TLICISCAV;CISCA
VDKI;ESKSKTNTK;NSKETIISK;ETIISKLEK;TIISKLEKM;ISKLEKMIK;MIKDLEDQK;EIAKITNTQ;K
ITNTQIDF;ITNTQIDFL;TQIDFLENF;QIDFLENFK;DTISEDIEM;TISEDIEMK;EDIEMKIKR;EMKIKR
IIY;KIKRIIYSS;RIIYSSLNY;IYSSLNYEI;SSLNYEIEK;SLNYEIEKI;YEIEKINTL;EIEKINTLK;NTLKEI
LDK;TLKEILDKL;LDKLYKNHK;KLYKNHKYK;NHKYKTTAR;KYKTTARNF;KTTARNFIL;NFILNISI
K;FILNISIKI;ISIKIQFQI;KIQFQIENA;IQFQIENAL;FQIENALEL;QIENALELM;ALELMKEEI;LMKEEI
EDA;EEIEDASEI;EIEDASEIL;ASEILNQER;SEILNQERY;ILNQERYEI;LLKHVEPSL;KHVEPSLNL;
HVEPSLNLK;EPSLNLKQK;NLKQKFEKI;KILNETIKA;ILNETIKAY;AYNQDLDNI;QLAHMDENY;LA
HMDENYK;HMDENYKEF;YKEFDPLNL;EFDPLNLDY KLNIIKLNIL;IIKLNILTTI;KLNILTTILT;NILTTILTLI;ILTTILTLIC;ILTLICISCA;LTLICISCAV;LICISCA
VDK;AVDKIDPESK;KTNTKDFENK;SQDLEPSNTK;KNKDLEPLEK;PLEKNSKETI;ETIISKLEKM;T
IISKLEKMI;IISKLEKMIK;KMIKDLEDQK;EIAKITNTQI;KITNTQIDFL;NTQIDFLENF;TQIDFLENFK;
DTISEDIEMK;TISEDIEMKI;IEMKIKRIIY;KIKRIIYSSL;KRIIYSSLNY;IIYSSLNYEI;YSSLNYEIEK;N
YEIEKINTL;ILDKLYKNHK;KLYKNHKYKT;KNHKYKTTAR;KYKTTARNFI;YKTTARNFIL;TTARNFI
LNI;NFILNISIKI;NISIKIQFQI;QFQIENALEL;FQIENALELM;QIENALELMK;NALELMKEEI;EEIEDA
SEIL;DASEILNQER;ASEILNQERY;EILNQERYEI;ILNQERYEIL;NQERYEILLK;ILLKHVEPSL;EPS
LNLKQKF;SLNLKQKFEK;NLKQKFEKIL;KILNETIKAY;ETIKAYNQDL;KAYNQDLDNI;AYNQDLDN
IK;KSNEDQLAHM;QLAHMDENYK;AHMDENYKEF;NYKEFDPLNL;KEFDPLNLDY KLNIIKLNILT;NIIKLNILTTI;IIKLNILTTIL;KLNILTTILTL;ILTTILTLICI;ILTLICISCAV;TLICISCAVDK;
CAVDKIDPESK;KSQDLEPSNTK;EPLEKNSKETI;ETIISKLEKMI;TIISKLEKMIK;NTQIDFLENFK;T
QIDFLENFKS;DTISEDIEMKI;TISEDIEMKIK;ISEDIEMKIKR;DIEMKIKRIIY;MKIKRIIYSSL;RIIYSS
LNYEI;IYSSLNYEIEK;NYEIEKINTLK;IEKINTLKEIL;KINTLKEILDK;NTLKEILDKLY;TLKEILDKLYK
;EILDKLYKNHK;ILDKLYKNHKY;KLYKNHKYTT;KYKTTARNFIL;TTARNFILNIS;FILNISIKIQF;IL
NISIKIQFQ;SIKIQFQIENA;IQFQIENALEL;FQIENALELMK;KEEIEDASEIL;EEIEDASEILN;EDASE
ILNQER;DASEILNQERY;SEILNQERYEI;EILNQERYEIL;ILNQERYEILL;EILLKHVEPSL;LLKHVE
PSLNL;HVEPSLNLKQK;VEPSLNLKQKF;PSLNLKQKFEK;SLNLKQKFEKI;KFEKILNETIK;EKILN
ETIKAY;ILNETIKAYNQ;NETIKAYNQDL;KAYNQDLDNIK;LAHMDENYKEF Class 2
ARNFILNISIKIQFQ;FILNISIKI;AYNQDLDNIKSNEDQ;LDNIKSNED;DFLENFKSEPHDTIS;LENFK
SEPH;DIEMKIKRIIYSSLN;MKIKRIIYS;DKLYKNHKYKTTARN;YKNHKYKTT;DLDNIKSNEDQLAH
M;IKSNEDQLA;EDIEMKIKRIIYSSL;MKIKRIIYS;EIEKINTLKEILDKL;INTLKEILD;EILDKLYKNHKY
KTT;LDKLYKNHK;EILDKLYKNHKYKTT;LYKNHKYKT;EILLKHVEPSLNLKQ;LKHVEPSLN;EMKI
KRIIYSSLNYE;MKIKRIIYS;ENKSQDLEPSNTKNK;QDLEPSNTK;ERYEILLKHVEPSLN;YEILLKH
VE;ETIKAYNQDLDNIKS;IKAYNQDLD;FILNISIKIQFQIEN;LNISIKIQF;HKYKTTARNFILNIS;YKTT
ARNFI;HMDENYKEFDPLNLD;YKEFDPLNL;IDFLENFKSEPHDTI;LENFKSEPH;IEKINTLKEILDK
LY;INTLKEILD;IEMKIKRIIYSSLNY;MKIKRIIYS;IIKLNILTTILTLIC;ILTTILTLI;IIKLNILTTILTLIC;LNI LTTILT;IKIQFQIENALELMK;FQIENALEL;IKLNILTTILTLICI;LNILTTILT;ILDKLYKNHKYKTTA;YK
NHKYKTT;ILLKHVEPSLNLKQK;LKHVEPSLN;ILNISIKIQFQIENA;LNISIKIQF;ILTTILTLICISCAV;I
LTTILTLI;ILTTILTLICISCAV;LTLICISCA;IQFQIENALELMKEE;FQIENALEL;ISEDIEMKIKRIIYS;IE
MKIKRII;ISIKIQFQIENALEL;IKIQFQIEN;ISIKIQFQIENALEL;IQFQIENAL;KAYNQDLDNIKSNED;
YNQDLDNIK;KEILDKLYKNHKYKT;LDKLYKNHK;KIQFQIENALELMKE;FQIENALEL;KKTKLNIIK
LNILTT;LNIIKLNIL;KLNIIKLNILTTILT;IIKLNILTT;KLNIIKLNILTTILT;IKLNILTTI;KLNIIKLNILTTILT;
KLNILTTIL;KLNILTTILTLICIS;LNILTTILT;KLYKNHKYKTTARNF;YKNHKYKTT;KNHKYKTTARNF
ILN;YKTTARNFI;KSQDLEPSNTKNKDL;LEPSNTKNK;KTKLNIIKLNILTTI;IIKLNILTT;KTKLNIIKLN
ILTTI;LNIIKLNIL;KTTARNFILNISIKI;ARNFILNIS;KYKTTARNFILNISI;ARNFILNIS;KYKTTARNFIL
NISI;YKTTARNFI;LDKLYKNHKYKTTAR;YKNHKYKTT;LDNIKSNEDQLAHMD;IKSNEDQLA;LNII
KLNILTTILTL;LNILTTILT;LNILTTILTLICISC;LNILTTILT;LNISIKIQFQIENAL;LNISIKIQF;LNYEIEKI
NTLKEIL;IEKINTLKE;LNYEIEKINTLKEIL;YEIEKINTL;LTTILTLICISCAVD;LTLICISCA;LYKNHKY
KTTARNFI;KYKTTARNF;LYKNHKYKTTARNFI;NHKYKTTAR;LYKNHKYKTTARNFI;YKNHKYKT
T;MDENYKEFDPLNLDY;KEFDPLNLD;MKIKRIIYSSLNYEI;KRIIYSSLN;MKIKRIIYSSLNYEI;MKI
KRIIYS;MKKTKLNIIKLNILT;LNIIKLNIL;NFILNISIKIQFQIE;LNISIKIQF;NHKYKTTARNFILNI;YKTT
ARNFI;NIIKLNILTTILTLI;LNILTTILT;NILTTILTLICISCA;ILTTILTLI;NILTTILTLICISCA;LTTILTLIC;
NKSQDLEPSNTKNKD;LEPSNTKNK;NQDLDNIKSNEDQLA;LDNIKSNED;NTQIDFLENFKSEPH;
FLENFKSEP;NTQIDFLENFKSEPH;IDFLENFKS;NYEIEKINTLKEILD;EKINTLKEI;NYEIEKINTLK
EILD;IEKINTLKE;QDLDNIKSNEDQLAH;IKSNEDQLA;QDLEPSNTKNKDLEP;LEPSNTKNK;QIDF
LENFKSEPHDT;LENFKSEPH;RNFILNISIKIQFQI;FILNISIKI;RYEILLKHVEPSLNL;LKHVEPSLN;
SEDIEMKIKRIIYSS;MKIKRIIYS;SIKIQFQIENALELM;FQIENALEL;SLNYEIEKINTLKEI;IEKINTLK
E;SLNYEIEKINTLKEI;YEIEKINTL;SQDLEPSNTKNKDLE;LEPSNTKNK;SSLNYEIEKINTLKE;YEI
EKINTL;TARNFILNISIKIQF;FILNISIKI;TKLNIIKLNILTTIL;IIKLNILTT;TKLNIIKLNILTTIL;IKLNILTTI
;TQIDFLENFKSEPHD;LENFKSEPH;TTARNFILNISIKIQ;FILNISIKI;TTILTLICISCAVDK;LTLICISC
A;YEIEKINTLKEILDK;IEKINTLKE;YEIEKINTLKEILDK;INTLKEILD;YEILLKHVEPSLNLK;LKHVEP
SLN;YKNHKYKTTARNFIL;YKNHKYKTT;YKNHKYKTTARNFIL;YKTTARNFI;YKTTARNFILNISIK;
ARNFILNIS;YNQDLDNIKSNEDQL;LDNIKSNED <AAU07022 4-alpha-glucanotransferase;Protein;Borrelia garinii PBi>
SEQ ID NO:174492-176082
Class 1
KIRINLNL;RINLNLKR;NLKRKSGI;ILLNISSL;NISSLPSK;SLPSKYGI;GAYKFIDF;AYKFIDFL;KFID
FLFA;FIDFLFAS;FLFASSQS;LFASSQSY;FASSQSYW;SQSYWQMF;QSYWQMFA;SYWQMFAY
;WQMFAYSP;QMFAYSPI;FAYSPIDF;YSPIDFTR;TRSPPYSI;RSPPYSIF;PPYSIFSA;PYSIFSAF;
YSIFSAFA;FSAFAGNV;SAFAGNVY;AFAGNVYY;FAGNVYYI;NVYYIDLE;YYIDLEAL;FIDSDLNL;
LLKENETR;NETRYSDL;ETRYSDLK;RYSDLKKL;DLKKLSFK;SFKDFLK;KFLKEAAL;KEAALNFI
;AALNFINR;ALNFINRA;NRASVDEV;RASVDEVR;SVDEVRSF;EVRSFEKF;RSFEKFKK;KKSSY
WLL;SSYWLLDF;WLLDFASF;LLDFASFV;DFASFVAF;FASFVAFK;FVAFKEYF;VAFKEYFL;AFK
EYFLK;EYFLKDSR;FLKDSRDA;DSRDAFNV;SRDAFNVL;AFNVLFDR;VLFDRGIL;GILIRNEK;NE
KDLFKL;DLFKLRNI;KLRNILSK;ILSKEIKV;KEIKVQEV;EIKVQEVL;KVQEVLQY;VQEVLQYF;QEV
LQYFF;EVLQYFFF;LQYFFFSQ;QYFFFSQF;FFSQFQAL;FSQFQALK;SQFQALKR;FQALKRYA;
RYANDKGI;ELVMNLPL;LVMNLPLF;VMNLPLFI;NLPLFIAY;LPLFIAYD;IAYDSADV;AYDSADVW;
DVWAHQKY;VWAHQKYF;WAHQKYFK;HQKYFKLR;KLRFDASK;GISPDYFL;QAWDSPAY;SPA
YSWNV;AYSWNVLK;NVLKNVKY;KYEWWAKR;YEWWAKRI;WWAKRIGI;WAKRIGIL;KRIGILRK;
ILRKYIDV;KYIDVIKI;DVIKIDHF;VIKIDHFR;GFVSTWEV;WEVGVGEA;EVGVGEAY;EAYAFNGL;
AYAFNGLW;YAFNGLWV;AFNGLWVK;RDFFNFIL;NFILNEIK;ILNEIKDL;EIKDLKIW;IKDLKIWV;V
EDFENDL;FENDLEDV;DLEDVSRL;DVSRLRDF;RLRDFFNF;FFNFPGMR;GMRIMKLA;MRIMKL
AF;IMKLAFDF;FDSDNQNL;NQNLPHNY;YIKNCIVY;NCIVYTGI;GIGDNSTI;NSTIREFV;IREFVNS
L;FVNSLDDL;NSLDDLHK;SLDDLHKK;YIFDYLNT;YLNTNEDF;NTNEDFVV;FVVWDMIR;MSSVS
DSV;SVSDSVII;VIIPMQDY;PMQDYINL;YINLGNEF;NLGNEFRA;EFRANIPK;NTLNNWIF;TLNNW
IFR;TLSKNISF;KNISFITR;NISFITRL;ISFITRLY;FITRLYGR KYKKIRINL;KIRINLNLK;IRINLNLKR;RINLNLKRK;NLKRKSGIL;GILLNISSL;NISSLPSKY;KYGIG
DLGK;DLGKGAYKF;GAYKFIDFL;AYKFIDFLF;YKFIDFLFA;FIDFLFASS;FLFASSQSY;LFASSQS
YW;FASSQSYWQ;ASSQSYWQM;SQSYWQMFA;QSYWQMFAY;SYWQMFAYS;WQMFAYSPI;

Fig. 40 continued

MFAYSPIDF;FAYSPIDFT;AYSPIDFTR;FTRSPPYSI;SPPYSIFSA;PPYSIFSAF;FSAFAGNVY;SA
FAGNVYY;AFAGNVYYI;NVYYIDLEA;VYYIDLEAL;KFIDSDLNL;FIDSDLNLL;LLKENETRY;ETRY
SDLKK;YSDLKKLSF;KLSFKDKFL;LSFKDKFLK;FLKEAALNF;EAALNFINR;AALNFINRA;ASVDE
VRSF;DEVRSFEKF;EVRSFEKFK;RSFEKFKKK;KFKKKSSYW

KYKKIRINLNL;KIRINLNLKRK;NLNLKRKSGIL;ILLNISSLPSK;LLNISSLPSKY;NISSLPSKYGI;SLP
SKYGIGDL;YGIGDLGKGAY;GIGDLGKGAYK;KGAYKFIDFLF;IDFLFASSQSY;DFLFASSQSYW;
FLFASSQSYWQ;FASSQSYWQMF;SSQSYWQMFAY;SQSYWQMFAYS;SYWQMFAYSPI;WQM
FAYSPIDF;QMFAYSPIDFT;MFAYSPIDFTR;SPIDFTRSPPY;D

LEDVS;EDFVVWDMIRSAMSS,FVVWDMIRS;EDFVVWDMIRSAMSS;WDMIRSAMS,EFRANIPK
NTLNNWI,FRANIPKNT;EKDLFKLRNILSKEI;LFKLRNILS;EKFKKKSSYWLLDFA;FKKKSSYWL;E
LVMNLPLFIAYDSA;VMNLPLFIA;ENETRYSDLKKLSFK;RYSDLKKLS;ETRYSDLKKLSFKDK;RY
SDLKKLS;EVLQYFFFSQFQALK;YFFFSQFQA;EVRSFEKFKKKSSYW;FEKFKKKSS;EWWAKRI
GILRKYID,WAKRIGILR;EYFLKDSRDAFNVLF;FLKDSRDAF;EAALNFINRASVDEV;ALNFINRAS;
EAALNFINRASVDEV;FINRASVDE;FASSQSYWQMFAYSP;FASSQSYWQ;FAYSPIDFTRSPPYS
;YSPIDFTRS;FDASKDKVAGISPDY;FDASKDKVA;FDFDSDNQNLPHNYI;FDSDNQNLP;FDRGILI
RNEKDLFK;RGILIRNEK;FDYLNTNEDFVVWDM;FDYLNTNED;FDYLNTNEDFVVWDM;YLNTNE
DFV;FEKFKKKSSYWLLDF;FKKKSSYWL;FENDLEDVSRLRDFF;DLEDVSRLR;FENDLEDVSRL
RDFF;FENDLEDVS;FFFSQFQALKRYAND;FQALKRYAN;FFFSQFQALKRYAND;FSQFQALKR;F
FNFILNEIKDLKIW;ILNEIKDLK;FFNFPGMRIMKLAFD;FPGMRIMKL;FFNFPGMRIMKLAFD;GMRI
MKLAF;FFSQFQALKRYANDK;FQALKRYAN;FIAYDSADVWAHQKY;FIAYDSADV;FIDFLFASSQ
SYWQM;FASSQSYWQ;FIDFLFASSQSYWQM;FLFASSQSY;FIDSDLNLLKENETR;IDSDLNLLK;
FIDSDLNLLKENETR;LNLLKENET;FKDKFLKEAALNFIN;FLKEAALNF;FKDKFLKEAALNFIN;LKE
AALNFI;FKEYFLKDSRDAFNV;FLKDSRDAF;FKEYFLKDSRDAFNV;YFLKDSRDA;FKKKSSYWL
LDFASF;FKKKSSYWL;FKLRFDASKDKVAGI;LRFDASKDK;FKLRNILSKEIKVQE;FKLRNILSK;FK
LRNILSKEIKVQE;LRNILSKEI;FLEQEQAWDSPAYSW;QAWDSPAYS;FLFASSQSYWQMFAY;FA
SSQSYWQ;FLFASSQSYWQMFAY;FLFASSQSY;FLKEAALNFINRASV;ALNFINRAS;FLKEAALN
FINRASV;LKEAALNFI;FNFILNEIKDLKIWV;ILNEIKDLK;FNFPGMRIMKLAFDF;FPGMRIMKL;FN
GLWVKSPGRDFFN;FNGLWVKSP;FNVLFDRGILIRNEK;FDRGILIRN;FNVLFDRGILIRNEK;VLF
DRGILI;FPGMRIMKLAFDFDS;FPGMRIMKL;FRANIPKNTLNNWIF;FRANIPKNT;FRGFVSTWEV
GVGEA;FRGFVSTWE;FRLLESDLDATLSKN;FRLLESDLD;FSQFQALKRYANDKG;FQALKRYAN
;FTRSPPYSIFSAFAG;FTRSPPYSI;FVAFKEYFLKDSRDA;FKEYFLKDS;FVVWDMIRSAMSSVS;
MIRSAMSSV;FVVWDMIRSAMSSVS;VWDMIRSAM;FVVWDMIRSAMSSVS;WDMIRSAMS;GDL
GKGAYKFIDFLF;LGKGAYKFI;GDNSTIREFVNSLDD;IREFVNSLD;GEAYAFNGLWVKSPG;AYA
FNGLWV;GEAYAFNGLWVKSPG;FNGLWVKSP;GIELVMNLPLFIAYD;LVMNLPLFI;GIELVMNLP
LFIAYD;VMNLPLFIA;GILLNISSLPSKYGI;ILLNISSLP;GILLNISSLPSKYGI;ISSLPSKYG;GILLNIS
SLPSKYGI;LLNISSLPS;GNEFRANIPKNTLNN;FRANIPKNT;GRDFFNFILNEIKDL;FFNFILNEI;HF
RGFVSTWEVGVGE;FRGFVSTWE;HKKYIFDYLNTNEDF;FDYLNTNED;HKKYIFDYLNTNEDF;YI
FDYLNTN;HNYIKNCIVYTGIGD;IKNCIVYTG;HNYIKNCIVYTGIGD;YIKNCIVYT;IAYDSADVWAH
QKYF;YDSADVWAH;IDFLFASSQSYWQMF;FASSQSYWQ;IDFLFASSQSYWQMF;FLFASSQSY
;IDFTRSPPYSIFSAF;FTRSPPYSI;IDHFRGFVSTWEVGV;FRGFVSTWE;IDLEALDKFIDSDLN;EA
LDKFIDS;IDSDLNLLKENETRY;LNLLKENET;IELVMNLPLFIAYDS;LVMNLPLFI;IELVMNLPLFIAY
DS;VMNLPLFIA;IFDYLNTNEDFVVWD;FDYLNTNED;IFDYLNTNEDFVVWD;YLNTNEDFV;IFRLL
ESDLDATLSK;FRLLESDLD;IFSAFAGNVYYIDLE;FSAFAGNVY;IGDNSTIREFVNSLD;NSTIREF
VN;IGILRKYIDVIKIDH;IGILRKYID;IGILRKYIDVIKIDH;ILRKYIDVI;IIPMQDYINLGNEFR;PMQDYI
NLG;IKIDHFRGFVSTWEV;FRGFVSTWE;IKNCIVYTGIGDNST;IKNCIVYTG;ILLNISSLPSKYGIG;
ILLNISSLP;ILLNISSLPSKYGIG;ISSLPSKYG;ILLNISSLPSKYGIG;LLNISSLPS;ILNEIKDLKIWVE
DF;EIKDLKIWV;ILNEIKDLKIWVEDF;ILNEIKDLK;INLGNEFRANIPKNT;LGNEFRANI;INLNLKRK
SGILLNI;LKRKSGILL;IPKNTLNNWIFRLLE;LNNWIFRLL;IPKNTLNNWIFRLLE;PKNTLNNWI;IPM
QDYINLGNEFRA;YINLGNEFR;IREFVNSLDDLHKKY;FVNSLDDLH;IREFVNSLDDLHKKY;IREFV
NSLD;IRINLNLKRKSGILL;INLNLKRKS;IRINLNLKRKSGILL;IRINLNLKR;IRSAMSSVSDSVIIP;IR
SAMSSVS;ISSLPSKYGIGDLGK;ISSLPSKYG;IVYTGIGDNSTIREF;IGDNSTIRE;IVYTGIGDNSTI
REF;IVYTGIGDN;IVYTGIGDNSTIREF;YTGIGDNST;KDKFLKEAALNFINR;LKEAALNFI;KDKVAG
ISPDYFLEQ;VAGISPDYF;KDLFKLRNILSKEIK;LFKLRNILS;KDLFKLRNILSKEIK;LRNILSKEI;KE
YFLKDSRDAFNVL;FLKDSRDAF;KEYFLKDSRDAFNVL;YFLKDSRDA;KEAALNFINRASVDE;AL
NFINRAS;KEAALNFINRASVDE;AALNFINRA;KFIDFLFASSQSYWQ;FLFASSQSY;KFIDSDLNLL
KENET;FIDSDLNLL;KFKKKSSYWLLDFAS;FKKKSSYWL;KFLKEAALNFINRAS;FLKEAALNF;KF
LKEAALNFINRAS;LKEAALNFI;KGIELVMNLPLFIAY;VMNLPLFIA;KIDHFRGFVSTWEVG;FRGFV
STWE;KIRINLNLKRKSGIL;INLNLKRKS;KIRINLNLKRKSGIL;IRINLNLKR;KKIRINLNLKRKSGI;IN
LNLKRKS;KKIRINLNLKRKSGI;IRINLNLKR;KKSSYWLLDFASFVA;WLLDFASFV;KKSSYWLLDF
ASFVA;YWLLDFASF;KKYIFDYLNTNEDFV;FDYLNTNED;KKYIFDYLNTNEDFV;YIFDYLNTN;KL
RNILSKEIKVQEV;LRNILSKEI;KNCIVYTGIGDNSTI;YTGIGDNST;KNTLNNWIFRLLESD;LNNWIF
RLL;KNVKYEWWAKRIGIL;VKYEWWAKR;KNVKYEWWAKRIGIL;YEWWAKRIG;KRIGILRKYIDV
IKI;IGILRKYID;KRIGILRKYIDVIKI;ILRKYIDVI;KRKSGILLNISSLPS;GILLNISSL;KRKSGILLNISSL

Fig. 40 continued

PS;ILLNISSLP;KSGILLNISSLPSKY;ILLNISSLP;KSGILLNISSLPSKY;LLNISSLPS;KSSYWLLDFA
SFVAF;LLDFASFVA;KSSYWLLDFASFVAF;WLLDFASFV;KYEWWAKRIGILRKY;WAKRIGILR;K
YEWWAKRIGILRKY;YEWWAKRIG;KYGIGDLGKGAYKFI;IGDLGKGAY;KYIFDYLNTNEDFVV;F
DYLNTNED;KYIFDYLNTNEDFVV;YIFDYLNTN;KYIFDYLNTNEDFVV;YLNTNEDFV;KYKKIRINL
NLKRKS;IRINLNLKR;KYKKIRINLNLKRKS;YKKIRINLN;LDATLSKNISFITRL;LSKNISFIT;LDDLH
KKYIFDYLNT;HKKYIFDYL;LEDVSRLRDFFNFPG;LEDVSRLRD;LEDVSRLRDFFNFPG;RLRDFF
NFP;LEQEQAWDSPAYSWN;EQAWDSPAY;LESDLDATLSKNISF;LESDLDATL;LFDRGILIRNEK
DLF;ILIRNEKDL;LFDRGILIRNEKDLF;RGILIRNEK;LFIAYDSADVWAHQK;FIAYDSADV;LFKLRNI
LSKEIKVQ;FKLRNILSK;LFKLRNILSKEIKVQ;LRNILSKEI;LGNEFRANIPKNTLN;FRANIPKNT;LH
KKYIFDYLNTNED;YIFDYLNTN;LKDSRDAFNVLFDRG;DSRDAFNVL;LKEAALNFINRASVD;ALN
FINRAS;LKNVKYEWWAKRIGI;VKYEWWAKR;LKNVKYEWWAKRIGI;YEWWAKRIG;LKRKSGIL
LNISSLP;GILLNISSL;LKRKSGILLNISSLP;LKRKSGILL;LLDFASFVAFKEYFL;LLDFASFVA;LLES
DLDATLSKNIS;LDATLSKNI;LLNISSLPSKYGIGD;ISSLPSKYG;LLNISSLPSKYGIGD;LLNISSLPS
;LNFINRASVDEVRSF;FINRASVDE;LNISSLPSKYGIGDL;ISSLPSKYG;LNLKRKSGILLNISS;LKR
KSGILL;LNLLKENETRYSDLK;LKENETRYS;LNNWIFRLLESDLDA;FRLLESDLD;LNTNEDFVVW
DMIRS;TNEDFVVWD;LPHNYIKNCIVYTGI;IKNCIVYTG;LPHNYIKNCIVYTGI;LPHNYIKNC;LPHN
YIKNCIVYTGI;YIKNCIVYT;LPLFIAYDSADVWAH;FIAYDSADV;LQYFFFSQFQALKRY;FFSQFQA
LK;LQYFFFSQFQALKRY;FSQFQALKR;LRDFFNFPGMRIMKL;FFNFPGMRI;LRNILSKEIKVQEV
L;LRNILSKEI;LRNILSKEIKVQEVL;LSKEIKVQE;LSFKDKFLKEAALNF;FKDKFLKEA;LSKEIKVQE
VLQYFF;IKVQEVLQY;LSKNISFITRLYGRT;LSKNISFIT;LSKNISFITRLYGRT;SFITRLYGR;LVMN
LPLFIAYDSAD;LVMNLPLFI;LVMNLPLFIAYDSAD;VMNLPLFIA;LWVKSPGRDFFNFIL;LWVKSP
GRD;LWVKSPGRDFFNFIL;PGRDFFNFI;MFAYSPIDFTRSPPY;YSPIDFTRS;MIRSAMSSVSDSV
II;IRSAMSSVS;MKYKKIRINLNLKRK;IRINLNLKR;MKYKKIRINLNLKRK;YKKIRINLN;MNLPLFIAY
DSADVW;FIAYDSADV;MQDYINLGNEFRANI;YINLGNEFR;NCIVYTGIGDNSTIR;YTGIGDNST;N
DKGIELVMNLPLFI;DKGIELVMN;NDKGIELVMNLPLFI;ELVMNLPLF;NDKGIELVMNLPLFI;IELV
MNLPL;NDLEDVSRLRDFFNF;VSRLRDFFN;NEDFVVWDMIRSAMS;FVVWDMIRS;NEDFVVWD
MIRSAMS;VVWDMIRSA;NEFRANIPKNTLNNW;FRANIPKNT;NEKDLFKLRNILSKE;LFKLRNILS;
NETRYSDLKKLSFKD;RYSDLKKLS;NFILNEIKDLKIWVE;FILNEIKDL;NFILNEIKDLKIWVE;ILNEI
KDLK;NFPGMRIMKLAFDFD;FPGMRIMKL;NILSKEIKVQEVLQY;EIKVQEVLQ;NIPKNTLNNWIFR
LL;IPKNTLNNW;NISSLPSKYGIGDLG;ISSLPSKYG;NLGNEFRANIPKNTL;FRANIPKNT;NLKRKS
GILLNISSL;LKRKSGILL;NLLKENETRYSDLKK;LKENETRYS;NLNLKRKSGILLNIS;LKRKSGILL;
NLPHNYIKNCIVYTG;YIKNCIVYT;NLPLFIAYDSADVWA;FIAYDSADV;NNWIFRLLESDLDAT;FRL
LESDLD;NQNLPHNYIKNCIVY;LPHNYIKNC;NSLDDLHKKYIFDYL;LDDLHKKYI;NSTIREFVNSL
DDLH;IREFVNSLD;NTLNNWIFRLLESDL;LNNWIFRLL;NTNEDFVVWDMIRSA;FVVWDMIRS;NV
KYEWWAKRIGILR;VKYEWWAKR;NVKYEWWAKRIGILR;WWAKRIGIL;NVKYEWWAKRIGILR;Y
EWWAKRIG;NVLFDRGILIRNEKD;RGILIRNEK;NVLKNVKYEWWAKRI;VKYEWWAKR;NVYYIDL
EALDKFID;YIDLEALDK;NWIFRLLESDLDATL;FRLLESDLD;NYIKNCIVYTGIGDN;IKNCIVYTG;P
AYSWNVLKNVKYEW;WNVLKNVKY;PAYSWNVLKNVKYEW;YSWNVLKNV;PHNYIKNCIVYTGI
G;IKNCIVYTG;PHNYIKNCIVYTGIG;YIKNCIVYT;PIDFTRSPPYSIFSA;FTRSPPYSI;PKNTLNNWI
FRLLES;LNNWIFRLL;PLFIAYDSADVWAHQ;FIAYDSADV;PMQDYINLGNEFRAN;YINLGNEFR;
PPYSIFSAFAGNVYY;IFSAFAGNV;PYSIFSAFAGNVYYI;IFSAFAGNV;QALKRYANDKGIELV;LK
RYANDKG;QAWDSPAYSWNVLKN;QAWDSPAYS;QDYINLGNEFRANIP;LGNEFRANI;QDYINL
GNEFRANIP;YINLGNEFR;QMFAYSPIDFTRSPP;YSPIDFTRS;QNLPHNYIKNCIVYT;LPHNYIKN
C;QNLPHNYIKNCIVYT;PHNYIKNCI;QSYWQMFAYSPIDFT;MFAYSPIDF;QSYWQMFAYSPIDFT
;WQMFAYSPI;QSYWQMFAYSPIDFT;YWQMFAYSP;QYFFFSQFQALKRYA;FFSQFQALK;RDFF
NFILNEIKDLK;FFNFILNEI;RDFFNFPGMRIMKLA;FPGMRIMKL;RGILIRNEKDLFKLR;LIRNEKDL
F;RIGILRKYIDVIKID;IGILRKYID;RIGILRKYIDVIKID;ILRKYIDVI;RIGILRKYIDVIKID;LRKYIDVIK;R
INLNLKRKSGILLN;LKRKSGILL;RKSGILLNISSLPSK;ILLNISSLP;RKSGILLNISSLPSK;LLNISSLP
S;RLRDFFNFPGMRIMK;FFNFPGMRI;RNEKDLFKLRNILSK;LFKLRNILS;RNILSKEIKVQEVLQ;L
SKEIKVQE;RSFEKFKKKSSYWLL;FKKKSSYWL;RSPPYSIFSAFAGNV;YSIFSAFAG;SDLDATLS
KNISFIT;DATLSKNIS;SDLNLLKENETRYSD;LKENETRYS;SDLNLLKENETRYSD;LNLLKENET;S
FEKFKKKSSYWLLD;FKKKSSYWL;SFKDKFLKEAALNFI;FLKEAALNF;SGILLNISSLPSKYG;ILLN
ISSLP;SGILLNISSLPSKYG;LLNISSLPS;SLPSKYGIGDLGKGA;PSKYGIGDL;SPAYSWNVLKNV
KYE;AYSWNVLKN;SPAYSWNVLKNVKYE;WNVLKNVKY;SPAYSWNVLKNVKYE;YSWNVLKNV;
SPIDFTRSPPYSIFS;FTRSPPYSI;SPPYSIFSAFAGNVY;IFSAFAGNV;SQFQALKRYANDKGI;FQ

Fig. 40 continued

ALKRYAN;SQSYWQMFAYSPIDF;WQMFAYSPI;SQSYWQMFAYSPIDF;YWQMFAYSP;SRDAFNVLFDRGILI;FNVLFDRGI;SRLRDFFNFPGMRIM;FFNFPGMRI;SSQSYWQMFAYSPID;WQMFAYSPI;SSQSYWQMFAYSPID;YWQMFAYSP;SSYWLLDFASFVAFK;LLDFASFVA;SSYWLLDFASFVAFK;WLLDFASFV;STIREFVNSLDDLHK;IREFVNSLD;STWEVGVGEAYAFNG;VGVGEAYAF;SWNVLKNVKYEWWAK;WNVLKNVKY;SYWLLDFASFVAFKE;WLLDFASFV;SYWQMFAYSPIDFTR;MFAYSPIDF;SYWQMFAYSPIDFTR;WQMFAYSPI;SYWQMFAYSPIDFTR;YWQMFAYSP;TGIGDNSTIREFVNS;IGDNSTIRE;TIREFVNSLDDLHKK;IREFVNSLD;TLNNWIFRLLESDLD;IFRLLESDL;TLNNWIFRLLESDLD;NNWIFRLLE;TLSKNISFITRLYGR;LSKNISFIT;TLSKNISFITRLYGR;SKNISFITR;TNEDFVVWDMIRSAM;FVVWDMIRS;TNEDFVVWDMIRSAM;VVWDMIRSA;TWEVGVGEAYAFNGL;VGVGEAYAF;VAFKEYFLKDSRDAF;FKEYFLKDS;VAFKEYFLKDSRDAF;YFLKDSRDA;VGEAYAFNGLWVKSP;AFNGLWVKS;VGEAYAFNGLWVKSP;AYAFNGLWV;VGVGEAYAFNGLWVK;GEAYAFNGL;VIKIDHFRGFVSTWE;IDHFRGFVS;VKSPGRDFFNFILNE;PGRDFFNFI;VKYEWWAKRIGILRK;VKYEWWAKR;VKYEWWAKRIGILRK;WAKRIGILR;VKYEWWAKRIGILRK;YEWWAKRIG;VLFDRGILIRNEKDL;RGILIRNEK;VLKNVKYEWWAKRIG;VKYEWWAKR;VLQYFFFSQFQALKR;FFSQFQALK;VMNLPLFIAYDSADV;VMNLPLFIA;VRSFEKFKKKSSYWL;FEKFKKKSS;VRSFEKFKKKSSYWL;KFKKKSSYW;VRSFEKFKKKSSYWL;VRSFEKFKK;VSRLRDFFNFPGMRI;LRDFFNFPG;VSRLRDFFNFPGMRI;RLRDFFNFP;VSRLRDFFNFPGMRI;VSRLRDFFN;VVWDMIRSAMSSVSD;IRSAMSSVS;VVWDMIRSAMSSVSD;MIRSAMSSV;VVWDMIRSAMSSVSD;WDMIRSAMS;VWAHQKYFKLRFDAS;QKYFKLRFD;VWAHQKYFKLRFDAS;WAHQKYFKL;VWDMIRSAMSSVSDS;IRSAMSSVS;VWDMIRSAMSSVSDS;MIRSAMSSV;VWDMIRSAMSSVSDS;WDMIRSAMS;VYTGIGDNSTIREFV;IGDNSTIRE;VYTGIGDNSTIREFV;YTGIGDNST;VYYIDLEALDKFIDS;YIDLEALDK;WAKRIGILRKYIDVI;IGILRKYID;WAKRIGILRKYIDVI;WAKRIGILR;WDMIRSAMSSVSDSV;IRSAMSSVS;WDMIRSAMSSVSDSV;WDMIRSAMS;WEVGVGEAYAFNGLW;VGVGEAYAF;WIFRLLESDLDATLS;FRLLESDLD;WNVLKNVKYEWWAKR;NVKYEWWAK;WNVLKNVKYEWWAKR;WNVLKNVKY;WQMFAYSPIDFTRSP;MFAYSPIDF;WQMFAYSPIDFTRSP;YSPIDFTRS;WWAKRIGILRKYIDV;IGILRKYID;YAFNGLWVKSPGRDF;FNGLWVKSP;YDSADVWAHQKYFKL;VWAHQKYFK;YEWWAKRIGILRKYI;WAKRIGILR;YEWWAKRIGILRKYI;YEWWAKRIG;YFFFSQFQALKRYAN;FFSQFQALK;YFFFSQFQALKRYAN;FSQFQALKR;YFLEQEQAWDSPAYS;EQAWDSPAY;YGIGDLGKGAYKFID;LGKGAYKFI;YIFDYLNTNEDFVVW;FDYLNTNED;YIFDYLNTNEDFVVW;YIFDYLNTN;YIFDYLNTNEDFVVW;YLNTNEDFV;YIKNCIVYTGIGDNS;IKNCIVYTG;YINLGNEFRANIPKN;YINLGNEFR;YKFIDFLFASSQSYW;FIDFLFASS;YKFIDFLFASSQSYW;FLFASSQSY;YKKIRINLNLKRKSG;INLNLKRKS;YKKIRINLNLKRKSG;IRINLNLKR;YKKIRINLNLKRKSG;YKKIRINLN;YSIFSAFAGNVYYID;IFSAFAGNV;YSPIDFTRSPPYSIF;FTRSPPYSI;YSWNVLKNVKYEWWA;WNVLKNVKY;YTGIGDNSTIREFVN;IGDNSTIRE;YTGIGDNSTIREFVN;YTGIGDNST;YWQMFAYSPIDFTRS;MFAYSPIDF;YWQMFAYSPIDFTRS;WQMFAYSPI;YWQMFAYSPIDFTRS;YWQMFAYSP;AALNFINRASVDEVR;FINRASVDE;AALNFINRASVDEVR;INRASVDEV

<CAA59727 outer surface protein A;Protein;Borrelia garinii>
SEQ ID NO:176083-176568
Class 1
KYLLGIGL;YLLGIGLI;LLGIGLIL;GIGLILAL;GLILALIA;ILALIACK;LIACKQNV;NVSSLDEK;SLDEKNSV;SVDLPGGM;DLPGGMKV;LPGGMKVL;GMKVLVSK;KVLVSKEK;KYSLMATV;SLMATVEK;LMATVEKL;ATVEKLEL;TVEKLELK;ELKGTSDK;KTDKSKVK;KLTIAEDL;TIAEDLSK;AEDLSKTT;KTTFEIFK;TTFEIFKE;EIFKEDGK;FKEDGKTL;KEDGKTLV;LVSKKVTL;VSKKVTLK;TLKDKSST;KSSTEEKF;GEISEKTI;EISEKTIV;ISEKTIVR;IVRANGTR;RLEYTDIK;EVLKDFTL;FTLEGTLA;TLEGTLAA;GTLAADGK;AADGKTTL;KVTEGTVV;EGTVVLSK;TVVLSKNI;VLSKNILK;ALDDSDTT;DTTQATKK;KTGKWDSK;TSTLTISV;TISVNSQK;SVNSQKTK;SQKTKNLV;TKNLVFTK;EDTITVQK;DTITVQKY;KAVEITTL;EITTLEKL;ITTLEKLK KYLLGIGLI;YLLGIGLIL;LLGIGLILA;GIGLILALI;LILALIACK;ALIACKQNV;SSLDEKNSV;SLDEKNSVS;SVDLPGGMK;VDLPGGMKV;DLPGGMKVL;LPGGMKVLV;GGMKVLVSK;GKYSLMATV;YSLMATVEK;SLMATVEKL;ATVEKLELK;GSGTLEGEK;LTIAEDLSK;AEDLSKTTF;DLSKTTFEI;FKEDGKTLV;TLVSKKVTL;LVSKKVTLK;KDKSSTEEK;STEEKFNEK;GEISEKTIV;EISEKTIVR;TIVRANGTR;IVRANGTRL;RANGTRLEY;KSDGSGKAK;SGKAKEVLK;KEVLKDFTL;VLKDFTLEG;FTLEG

Fig. 40 continued

TLAA;LAADGKTTL;AADGKTTLK;TTLKVTEGT;TLKVTEGTV;KVTEGTVVL;VVLSKNILK;VLSKNI
LKS;ILKSGEITV;KSGEITVAL;ALDDSDTTQ;TQATKKTGK;KTSTLTISV;LTISVNSQK;ISVNSQKT
K;SQKTKNLVF;KTKNLVFTK;FTKEDTITV;KYDSAGTNL;SAGTNLEGK;NLEGKAVEI;AVEITTLEK
;VEITTLEKL;EITTLEKLK;TLEKLKDAL

KYLLGIGLIL;YLLGIGLILA;LLGIGLILAL;LGIGLILALI;GLILALIACK;KQNVSSLDEK;SLDEKNSVSV
;SVSVDLPGGM;VSVDLPGGMK;SVDLPGGMKV;VDLPGGMKVL;DLPGGMKVLV;LPGGMKVLV
S;GMKVLVSKEK;KVLVSKEKDK;KYSLMATVEK;YSLMATVEKL;LMATVEKLEL;MATVEKLELK;K
LELKGTSDK;GTLEGEKTDK;KLTIAEDLSK;IAEDLSKTTF;DLSKTTFEIF;LSKTTFEIFK;EIFKEDG
KTL;TLVSKKVTLK;VSKKVTLKDK;SSTEEKFNEK;EEKFNEKGEI;EISEKTIVRA;KTIVRANGTR;TI
VRANGTRL;GTRLEYTDIK;GSGKAKEVLK;VLKDFTLEGT;FTLEGTLAAD;TLAADGKTTL;LAADG
KTTLK;AADGKTTLKV;TTLKVTEGTV;TLKVTEGTVV;VTEGTVVLSK;TVVLSKNILK;NILKSGEITV;
ILKSGEITVA;ALDDSDTTQA;TTQATKKTGK;SKTSTLTISV;TLTISVNSQK;TISVNSQKTK;NSQKT
KNLVF;NLVFTKEDTI;VFTKEDTITV;DSAGTNLEGK;KAVEITTLEK;TTLEKLKDAL;TLEKLKDALK

YLLGIGLILAL;LLGIGLILALI;ILALIACKQNV;LIACKQNVSSL;NVSSLDEKNSV;SSLDEKNSVSV;S
VSVDLPGGMK;SVDLPGGMKVL;VDLPGGMKVLV;LPGGMKVLVSK;LVSKEKDKDGK;KYSLMAT
VEKL;SLMATVEKLEL;LMATVEKLELK;GEKTDKSKVKL;KTDKSKVKLTI;TIAEDLSKTTF;AEDLSK
TTFEI;DLSKTTFEIFK;TTFEIFKEDGK;FEIFKEDGKTL;EIFKEDGKTLV;KTLVSKKVTLK;LVSKKV
TLKDK;TLKDKSSTEEK;KSSTEEKFNEK;KFNEKGEISEK;EKTIVRANGTR;KTIVRANGTRL;IVRA
NGTRLEY;YTDIKSDGSGK;VLKDFTLEGTL;TLEGTLAADGK;TLAADGKTTLK;LAADGKTTLKV;K
TTLKVTEGTV;TTLKVTEGTVV;TLKVTEGTVVL;KVTEGTVVLSK;GTVVLSKNILK;ILKSGEITVAL;
ALDDSDTTQAT;DTTQATKKTGK;ATKKTGKWDSK;KWDSKTSTLTI;STLTISVNSQK;LTISVNSQ
KTK;SVNSQKTKNLV;SQKTKNLVFTK;LVFTKEDTITV;FTKEDTITVQK;DTITVQKYDSA;VQKYDS
AGTNL;NLEGKAVEITT;LEGKAVEITTL;KAVEITTLEKL;AVEITTLEKLK;TTLEKLKDALK

Class 2
ADGKTTLKVTEGTVV;ADGKTTLKV;ADGKTTLKVTEGTVV;TLKVTEGTV;AGTNLEGKAVEITTL;L
EGKAVEIT;AKEVLKDFTLEGTLA;VLKDFTLEG;DFTLEGTLAADGKTT;FTLEGTLAA;DGKTLVSK
KVTLKDK;LVSKKVTLK;DGKTTLKVTEGTVVL;LKVTEGTVV;DGKYSLMATVEKLEL;YSLMATVE
K;DKDGKYSLMATVEKL;YSLMATVEK;DLPGGMKVLVSKEKD;MKVLVSKEK;DSAGTNLEGKAV
EIT;GTNLEGKAV;DTITVQKYDSAGTNL;VQKYDSAGT;EDGKTLVSKKVTLKD;GKTLVSKKV;ED
GKTLVSKKVTLKD;LVSKKVTLK;EDTITVQKYDSAGTN;VQKYDSAGT;EGTVVLSKNILKSGE;TV
VLSKNIL;EGTVVLSKNILKSGE;VLSKNILKS;EIFKEDGKTLVSKKV;FKEDGKTLV;EISEKTIVRAN
GTRL;KTIVRANGT;EKTIVRANGTRLEYT;IVRANGTRL;EVLKDFTLEGTLAAD;FTLEGTLAA;EYT
DIKSDGSGKAKE;IKSDGSGKA;FKEDGKTLVSKKVTL;GKTLVSKKV;FTLEGTLAADGKTTL;FTLE
GTLAA;GGMKVLVSKEKDKDG;MKVLVSKEK;GIGLILALIACKQNV;ILALIACKQ;GKAKEVLKDFTL
EGT;VLKDFTLEG;GKTLVSKKVTLKDKS;LVSKKVTLK;GKTTLKVTEGTVVLS;LKVTEGTVV;GKW
DSKTSTLTISVN;WDSKTSTLT;GKYSLMATVEKLELK;YSLMATVEK;GLILALIACKQNVSS;ILALIA
CKQ;GTNLEGKAVEITTLE;LEGKAVEIT;GTVVLSKNILKSGEI;VVLSKNILK;IFKEDGKTLVSKKVT;
GKTLVSKKV;IGLILALIACKQNVS;ILALIACKQ;ILKSGEITVALDDSD;LKSGEITVA;ISEKTIVRANG
TRLE;IVRANGTRL;ISVNSQKTKNLVFTK;VNSQKTKNL;ITVQKYDSAGTNLEG;VQKYDSAGT;ITV
QKYDSAGTNLEG;YDSAGTNLE;IVRANGTRLEYTDIK;IVRANGTRL;KAKEVLKDFTLEGTL;VLKD
FTLEG;KDFTLEGTLAADGKT;FTLEGTLAA;KDGKYSLMATVEKLE;YSLMATVEK;KDKDGKYSL
MATVEK;KDGKYSLMA;KEDGKTLVSKKVTLK;GKTLVSKKV;KEDTITVQKYDSAGT;ITVQKYDSA
;KEVLKDFTLEGTLAA;LKDFTLEGT;KEVLKDFTLEGTLAA;VLKDFTLEG;KKTGKWDSKTSTLTI;
WDSKTSTLT;KKYLLGIGLILALIA;LLGIGLILA;KNILKSGEITVALDD;LKSGEITVA;KNLVFTKEDTIT
VQK;FTKEDTITV;KTGKWDSKTSTLTIS;WDSKTSTLT;KTIVRANGTRLEYTD;IVRANGTRL;KTKN
LVFTKEDTITV;KTKNLVFTK;KTKNLVFTKEDTITV;VFTKEDTIT;KTTLKVTEGTVVLSK;LKVTEGT
VV;KTTLKVTEGTVVLSK;VTEGTVVLS;KVTEGTVVLSKNILK;TVVLSKNIL;KVTEGTVVLSKNILK;
VTEGTVVLS;KWDSKTSTLTISVNS;WDSKTSTLT;KYLLGIGLILALIAC;LLGIGLILA;LEGTLAADG
KTTLKV;LEGTLAADG;LEYTDIKSDGSGKAK;IKSDGSGKA;LGIGLILALIACKQN;IGLILALIA;LKDF
TLEGTLAADGK;FTLEGTLAA;LKSGEITVALDDSDT;LKSGEITVA;LKVTEGTVVLSKNIL;LKVTEG
TVV;LKVTEGTVVLSKNIL;VTEGTVVLS;LLGIGLILALIACKQ;IGLILALIA;LPGGMKVLVSKEKDK;M
KVLVSKEK;LSKNILKSGEITVAL;LKSGEITVA;LTISVNSQKTKNLVF;VNSQKTKNL;LVFTKEDTIT

Fig. 40 continued

VQKYD;FTKEDTITV;MKKYLLGIGLILALI;LLGIGLILA;NILKSGEITVALDDS;LKSGEITVA;NLVFTK EDTITVQKY;FTKEDTITV;NSVSVDLPGGMKVLV;VDLPGGMKV;PGGMKVLVSKEKDKD;MKVLV SKEK;QKYDSAGTNLEGKAV;YDSAGTNLE;RLEYTDIKSDGSGKA;YTDIKSDGS;SAGTNLEGKA VEITT;LEGKAVEIT;SEKTIVRANGTRLEY;IVRANGTRL;SGKAKEVLKDFTLEG;AKEVLKDFT;SK NILKSGEITVALD;LKSGEITVA;SKVKLTIAEDLSKTT;VKLTIAEDL;STLTISVNSQKTKNL;ISVNSQ KTK;STLTISVNSQKTKNL;TISVNSQKT;SVDLPGGMKVLVSKE;LPGGMKVLV;SVSVDLPGGMKV LVS;LPGGMKVLV;TEGTVVLSKNILKSG;TVVLSKNIL;TEGTVVLSKNILKSG;VLSKNILKS;TGKW DSKTSTLTISV;WDSKTSTLT;TISVNSQKTKNLVFT;VNSQKTKNL;TITVQKYDSAGTNLE;VQKYD SAGT;TIVRANGTRLEYTDI;VRANGTRLE;TKKTGKWDSKTSTLT;TGKWDSKTS;TKNLVFTKEDT ITVQ;FTKEDTITV;TLEGTLAADGKTTLK;LEGTLAADG;TLKVTEGTVVLSKNI;VTEGTVVLS;TLTIS VNSQKTKNLV;VNSQKTKNL;TNLEGKAVEITTLEK;LEGKAVEIT;TTLKVTEGTVVLSKN;LKVTEG TVV;TTLKVTEGTVVLSKN;VTEGTVVLS;TVQKYDSAGTNLEGK;VQKYDSAGT;TVQKYDSAGTN LEGK;YDSAGTNLE;TVVLSKNILKSGEIT;TVVLSKNIL;VALDDSDTTQATKKT;LDDSDTTQA;VDL PGGMKVLVSKEK;LPGGMKVLV;VDLPGGMKVLVSKEK;VDLPGGMKV;VLKDFTLEGTLAADG;F TLEGTLAA;VLSKNILKSGEITVA;KNILKSGEI;VQKYDSAGTNLEGKA;VQKYDSAGT;VQKYDSAG TNLEGKA;YDSAGTNLE;VRANGTRLEYTDIKS;VRANGTRLE;VSVDLPGGMKVLVSK;LPGGMKV LV;VTEGTVVLSKNILKS;TVVLSKNIL;VTEGTVVLSKNILKS;VTEGTVVLS;VVLSKNILKSGEITV;V VLSKNILK;WDSKTSTLTISVNSQ;WDSKTSTLT;YLLGIGLILALIACK;IGLILALIA;YSLMATVEKLEL KGT;YSLMATVEK;YTDIKSDGSGKAKEV;IKSDGSGKA

<AAN87995 Outer Surface Protein C;Protein;Borrelia garinii>
SEQ ID NO:176569-176943

Class 1
ILMTLFLF;LMTLFLFI;TLFLFISC;STNPDESA;ESAKGPNL;AKGPNLTV;NLTVISKK;KITDSNAF;IT DSNAFV;SNAFVLAV;NAFVLAVK;FVLAVKEV;AVKEVEAL;KEVEALIS;LISSIDEL;SIDELANK;DE LANKAI;LANKAIGK;VIHQNNGL;HQNNGLNA;GQNGSLLA;GSLLAGAY;SLLAGAYA;LLAGAYAI; GAYAISTL;AYAISTLI;ISTLITEK;LITEKLSK;TEKLSKLK;KLKNSEEL;HSEAFTNR;SEAFTNRL;EA FTNRLK;RLKGSHAQ;AQLGVAAA;AATDDHAK;DHAKEAIL;HAKEAILK;ILKSNPTK;KSNPTKDK; PTKDKGAK;ESVESLAK;EALANSVK;KELTNPVV;ELTNPVVA;PVVAESPK ILMTLFLFI;FLFISCNNS;STNPDESAK;SAKGPNLTV;NLTVISKKI;KITDSNAFV;ITDSNAFVL;DSN AFVLAV;SNAFVLAVK;VLAVKEVEA;LAVKEVEAL;AVKEVEALI;EVEALISSI;ALISSIDEL;LISSIDE LA;SSIDELANK;SIDELANKA;ELANKAIGK;LANKAIGKV;KVIHQNNGL;NGSLLAGAY;SLLAGAYAI ;LLAGAYAIS;GAYAISTLI;AISTLITEK;ISTLITEKL;TLITEKLSK;LITEKLSKL;ITEKLSKLK;ELNKKIE EA;EEAKNHSEA;EAKNHSEAF;HSEAFTNRL;RLKGSHAQL;AQLGVAAAT;AAATDDHAK;ATDDH AKEA;AILKSNPTK;KDKGAKELK;ELKDLSESV;DLSESVESL;ESVESLAKA;SLAKAAQEA;AQEAL ANSV;ALANSVKEL;SVKELTNPV ILMTLFLFIS;LMTLFLFISC;FLFISCNNSG;TASTNPDESA;ASTNPDESAK;ESAKGPNLTV;KGPNL TVISK;KKITDSNAFV;KITDSNAFVL;DSNAFVLAVK;NAFVLAVKEV;FVLAVKEVEA;VLAVKEVEAL ;LAVKEVEALI;KEVEALISSI;EALISSIDEL;ALISSIDELA;ISSIDELANK;SIDELANKAI;ELANKAIGK V;HQNNGLNANA;NANAGQNGSL;GQNGSLLAGA;SLLAGAYAIS;LLAGAYAIST;LAGAYAISTL;A GAYAISTLI;YAISTLITEK;AISTLITEKL;STLITEKLSK;TLITEKLSKL;LITEKLSKLK;KLKNSEELNK; ELNKKIEEAK;EEAKNHSEAF;NHSEAFTNRL;HSEAFTNRLK;VAAATDDHAK;ATDDHAKEAI;EAI LKSNPTK;ILKSNPTKDK;KELKDLSESV;DLSESVESLA;LSESVESLAK;SLAKAAQEAL;AAQEALA NSV;AQEALANSVK;EALANSVKEL;ALANSVKELT;NSVKELTNPV;SVKELTNPVV ILMTLFLFISC;FLFISCNNSGG;DTASTNPDESA;TASTNPDESAK;ESAKGPNLTVI;ISKKITDSNAF ;KITDSNAFVLA;ITDSNAFVLAV;SNAFVLAVKEV;FVLAVKEVEAL;VLAVKEVEALI;VEALISSIDEL; EALISSIDELA;LISSIDELANK;ELANKAIGKVI;GQNGSLLAGAY;NGSLLAGAYAI;SLLAGAYAIST;L LAGAYAISTL;LAGAYAISTLI;AYAISTLITEK;YAISTLITEKL;ISTLITEKLSK;TLITEKLSKLK;KLSKL KNSEEL;KLKNSEELNKK;EEAKNHSEAFT;RLKGSHAQLGV;GVAAATDDHAK;ATDDHAKEAIL;AI LKSNPTKDK;KSNPTKDKGAK;NPTKDKGAKEL;PTKDKGAKELK;SLAKAAQEALA;KAAQEALAN SV;AAQEALANSVK;QEALANSVKEL;SVKELTNPVVA;LTNPVVAESPK

Fig. 40 continued

Class 2
AFTNRLKGSHAQLGV;LKGSHAQLG;AFVLAVKEVEALISS;VKEVEALIS;AGAYAISTLITEKLS;IST
LITEKL;AGQNGSLLAGAYAIS;GQNGSLLAG;AIGKVIHQNNGLNAN;IHQNNGLNA;AILKSNPTKD
KGAKE;LKSNPTKDK;AISTLITEKLSKLKN;ISTLITEKL;AKEAILKSNPTKDKG;EAILKSNPT;AKEAI
LKSNPTKDKG;LKSNPTKDK;AKGPNLTVISKKITD;LTVISKKIT;ALANSVKELTNPVVA;LANSVKE
LT;ALANSVKELTNPVVA;SVKELTNPV;ALANSVKELTNPVVA;VKELTNPVV;ANSVKELTNPVVA
ES;SVKELTNPV;ANSVKELTNPVVAES;VKELTNPVV;AQEALANSVKELTNP;LANSVKELT;AQL
GVAAATDDHAKE;LGVAAATDD;AYAISTLITEKLSKL;ISTLITEKL;DELANKAIGKVIHQN;LANKAI
GKV;EAFTNRLKGSHAQLG;TNRLKGSHA;EAILKSNPTKDGAK;LKSNPTKDK;EALANSVKELT
NPVV;LANSVKELT;EALANSVKELTNPVV;SVKELTNPV;ESLAKAAQEALANSV;LAKAAQEAL;ES
VESLAKAAQEALA;SLAKAAQEA;FTNRLKGSHAQLGVA;LKGSHAQLG;FVLAVKEVEALISSI;VK
EVEALIS;GAYAISTLITEKLSK;ISTLITEKL;GKVIHQNNGLNANAG;HQNNGLNAN;GLNANAGQN
GSLLAG;LNANAGQNG;GPNLTVISKKITDSN;LTVISKKIT;GQNGSLLAGAYAIST;LLAGAYAIS;GS
HAQLGVAAATDDH;LGVAAATDD;GSLLAGAYAISTLIT;LAGAYAIST;HAKEAILKSNPTKDK;EAIL
KSNPT;HAQLGVAAATDDHAK;LGVAAATDD;HQNNGLNANAGQNGS;LNANAGQNG;IDELANKA
IGKVIHQ;LANKAIGKV;IGKVIHQNNGLNANA;HQNNGLNAN;IHQNNGLNANAGQNG;NNGLNAN
AG;ILMTLFLFISCNNSG;FLFISCNNS;ISKKITDSNAFVLAV;ITDSNAFVL;ISSIDELANKAIGKV;IDE
LANKAI;ISTLITEKLSKLKNS;ISTLITEKL;ITDSNAFVLAVKEVE;ITDSNAFVL;KEAILKSNPTKDKG
A;LKSNPTKDK;KGPNLTVISKKITDS;LTVISKKIT;KGSHAQLGVAAATDD;AQLGVAAAT;KITDSN
AFVLAVKEV;ITDSNAFVL;KKITDSNAFVLAVKE;ITDSNAFVL;KVIHQNNGLNANAGQ;HQNNGLN
AN;KAAQEALANSVKELT;EALANSVKE;LAGAYAISTLITEKL;LAGAYAIST;LAGAYAISTLITEKL;Y
AISTLITE;LANSVKELTNPVVAE;LANSVKELT;LANSVKELTNPVVAE;SVKELTNPV;LANSVKELT
NPVVAE;VKELTNPVV;LAVKEVEALISSIDE;VKEVEALIS;LFLFISCNNSGGDTA;LFISCNNSG;LK
GSHAQLGVAAATD;LKGSHAQLG;LLAGAYAISTLITEK;LAGAYAIST;LMTLFLFISCNNSGG;LFIS
CNNSG;LNANAGQNGSLLAGA;LNANAGQNG;LTVISKKITDSNAFV;LTVISKKIT;MTLFLFISCNN
SGGD;LFISCNNSG;NAFVLAVKEVEALIS;LAVKEVEAL;NGLNANAGQNGSLLA;LNANAGQNG;N
GSLLAGAYAISTLI;LAGAYAIST;NLTVISKKITDSNAF;LTVISKKIT;NNGLNANAGQNGSLL;LNANA
GQNG;NRLKGSHAQLGVAAA;LKGSHAQLG;NSVKELTNPVVAESP;LTNPVVAES;NSVKELTNP
VVAESP;VKELTNPVV;PNLTVISKKITDSNA;LTVISKKIT;QEALANSVKELTNPV;LANSVKELT;QN
GSLLAGAYAISTL;LAGAYAIST;QNNGLNANAGQNGSL;LNANAGQNG;RLKGSHAQLGVAAAT;L
KGSHAQLG;SAKGPNLTVISKKIT;KGPNLTVIS;SESVESLAKAAQEAL;SLAKAAQEA;SHAQLGVA
AATDDHA;LGVAAATDD;SIDELANKAIGKVIH;LANKAIGKV;SKKITDSNAFVLAVK;ITDSNAFVL;S
LAKAAQEALANSVK;AQEALANSV;SLLAGAYAISTLITE;LAGAYAIST;SSIDELANKAIGKVI;LANK
AIGKV;SVESLAKAAQEALAN;LAKAAQEAL;SVKELTNPVVAESPK;LTNPVVAES;TLFLFISCNNS
GGDT;LFISCNNSG;TNRLKGSHAQLGVAA;LKGSHAQLG;TVISKKITDSNAFVL;SKKITDSNA;VE
SLAKAAQEALANS;LAKAAQEAL;VISKKITDSNAFVLA;ITDSNAFVL;VLAVKEVEALISSID;VKEVE
ALIS;YAISTLITEKLSKLK;ISTLITEKL;AAQEALANSVKELTN;LANSVKELT <CAF34024 outer surface protein VlsE;Protein;Borrelia garinii>
SEQ ID NO:176944-177458
Class 1
KISSAIFL;SAIFLTAL;AIFLTALL;IFLTALLV;FLTALLVF;LTALLVFI;ALLVFINC;LLVFINCK;FINCKN
NA;FYESIINL;IINLGNGF;FIDVFNAF;FNAFSGLV;GLVADTFF;LVADTFFK;TFFKSDPK;KSDVKTY
F;FESISSTL;ESISSTLK;SISSTLKA;SSTLKATK;TLKATKGK;KLDELVSA;KASVESAV;SAVDEVS
K;KWLEEMIK;WLEEMIKA;MIKAAEEA;KAAEEAAK;DSAANHGA;SAANHGAK;DSVKGIAK;KGIA
KGIK;GIKGIVDA;GIVDAAGK;AGKALGEK;ALGEKGAL;ALKDVKAA;EANADAGK;FAGNANAA;NA
AVGAAA;GAAADIAK;IAKAAGAV;KAAGAVTA;AAGAVTAV;AVSGEQIL;VSGEQILK;ILKAIVEA;D
PANQAGK;AEEAKNPI;DDNGAAFK;AAFKDEMK;AFKDEMKK;KIAAAIVL;IAAAIVLR;AAIVLRGV;I
VLRGVAK;AKDGKFAV KISSAIFLT;ISSAIFLTA;SSAIFLTAL;SAIFLTALL;AIFLTALLV;IFLTALLVF;FLTALLVFI;ALLVFINC
K;FINCKNNAV;AVGKGNDDK;SVKTFYESI;TFYESIINL;SIINLGNGF;IINLGNGFI;NLGNGFIDV;G
FIDVFNAF;DVFNAFSGL;FSGLVADTF;GLVADTFFK;LVADTFFKS;DTFFKSDPK;TFFKSDPKK;D
VKTYFESI;YFESISSTL;ISSTLKATK;STLKATKGK;TLKATKGKL;ATKGKLDEL;KLDELVSAK;EGG
SVKASV;SVKASVESA;SVESAVDEV;ESAVDEVSK;SAVDEVSKW;AVDEVSKWL;EVSKWLEEM;

Fig. 40 continued

WLEEMIKAA;EMIKAAEEA;MIKAAEEEAA;KAAEEAAKV;DSAANHGAK;ANHGAKADK;SVKGIAKGI
;GIAKGIKGI;GIKGIVDAA;IVDAAGKAL;AAGKALGEK;ALGEKGALK;ALKDVKAAA;NADAGKLFA;
KLFAGNANA;FAGNANAAV;NANAAVGAA;DIAKAAGAV;KAAGAVTAV;TAVSGEQIL;AVSGEQIL
K;QILKAIVEA;ILKAIVEAA;AGKKAEEEAK;AEEEAKNPIA;EEAKNPIAA;NPIAAAIGT;TDDDNGAAF;G
AAFKDEMK;AAFKDEMKK;KIAAAIVLR;AAAIVLRGV;AIVLRGVAK;VAKDGKFAV

KISSAIFLTA;ISSAIFLTAL;SSAIFLTALL;SAIFLTALLV;AIFLTALLVF;IFLTALLVFI;FLTALLVFIN;TA
LLVFINCK;DSVKTFYESI;SVKTFYESII;KTFYESIINL;ESIINLGNGF;SIINLGNGFI;NGFIDVFNAF;
DVFNAFSGLV;AFSGLVADTF;FSGLVADTFF;SGLVADTFFK;GLVADTFFKS;ADTFFKSDPK;DTF
FKSDPKK;DPKKSDVKTY;KTYFESISST;TYFESISSTL;YFESISSTLK;SISSTLKATK;SSTLKATKG
K;ATKGKLDELV;KLDELVSAKK;SAKKGEGGSV;SVKASVESAV;ASVESAVDEV;ESAVDEVSKW;
SAVDEVSKWL;EVSKWLEEMI;VSKWLEEMIK;EEMIKAAEEA;MIKAAEEEAAK;AEEEAAKVGGT;KV
GGTGGDGK;AANHGAKADK;HGAKADKDSV;SVKGIAKGIK;GIAKGIKGIV;GIVDAAGKAL;DAAG
KALGEK;KALGEKGALK;EANADAGKLF;KLFAGNANAA;LFAGNANAAV;NANAAVGAAA;AVGAA
ADIAK;AKAAGAVTAV;TAVSGEQILK;AVSGEQILKA;QILKAIVEAA;AIVEAAGDPA;EAAGDPANQ
A;AEEEAKNPIAA;EEAKNPIAAA;EAKNPIAAAI;GTDDDNGAAF;NGAAFKDEMK;GAAFKDEMKK;D
KIAAAIVLR;IAAAIVLRGV;AAIVLRGVAK;VLRGVAKDGK;GVAKDGKFAV;VAKDGKFAVK

KKISSAIFLTA;KISSAIFLTAL;ISSAIFLTALL;SSAIFLTALLV;SAIFLTALLVF;AIFLTALLVFI;FLTALL
VFINC;LTALLVFINCK;LLVFINCKNNA;LVFINCKNNAV;FINCKNNAVGK;YESIINLGNGF;ESIINLG
NGFI;IINLGNGFIDV;FIDVFNAFSGL;DVFNAFSGLVA;NAFSGLVADTF;AFSGLVADTFF;FSGLVA
DTFFK;VADTFFKSDPK;DPKKSDVKTYF;KTYFESISSTL;TYFESISSTLK;ESISSTLKATK;ISSTLK
ATKGK;KATKGKLDELV;KGKLDELVSAK;SAKKGEGGSVK;KASVESAVDEV;SVESAVDEVSK;E
SAVDEVSKWL;EVSKWLEEMIK;EEMIKAAEEAA;EMIKAAEEAAK;MIKAAEEAAKV;KIGDSAANH
GA;SAANHGAKADK;DSVKGIAKGIK;GIKGIVDAAGK;ALGEKGALKDV;DEANADAGKLF;KLFAG
NANAAV;FAGNANAAVGA;AAVGAAADIAK;AAADIAKAAGA;IAKAAGAVTAV;AVTAVSGEQIL;VT
AVSGEQILK;AVSGEQILKAI;AAGDPANQAGK;AEEEAKNPIAAA;EEAKNPIAAAI;GTDDDNGAAF;
GTDDDNGAAFK;NGAAFKDEMKK;AFKDEMKKSDK;KSDKIAAAIVL;KIAAAIVLRGV;IAAAIVLRG
VA;AAAIVLRGVAK;IVLRGVAKDGK;VLRGVAKDGKF;GVAKDGKFAVK

Class 2
ADAFSKADPKKSDVK;FSKADPKKS;ADAGDVKDAAAAVGA;VKDAAAAVG;ADKESVNGIAGAIK
G;VNGIAGAIK;AFSGLVADAFSKADP;LVADAFSKA;AFSKADPKKSDVKTY;FSKADPKKS;AGDV
KDAAAAVGAVS;VKDAAAAVG;AGKLFGTAAGADAGD;FGTAAGADA;AIFIVAFLALIGCKN;IVAFL
ALIG;AIVTAAGQAGQAGKK;IVTAAGQAG;AKNAIEAAIGAAGDA;IEAAIGAAG;ALVLRGVAKDGK
FAG;LRGVAKDGK;ASIFYQSIINLGNGF;FYQSIINLG;ASIFYQSIINLGNGF;YQSIINLGN;AVSGEQ
ILNAIVTAA;EQILNAIVT;AVSGEQILNAIVTAA;VSGEQILNA;DAFSKADPKKSDVKT;FSKADPKKS;
DAGDVKDAAAAVGAV;VKDAAAAVG;DEAKNAIEAAIGAAG;KNAIEAAIG;DIKKKNDQIAAALVL;IK
KKNDQIA;DKESVNGIAGAIKGI;VNGIAGAIK;DKIGNVAAGGGAGAD;IGNVAAGGG;DQIAAALVL
RGVAKD;IAAALVLRG;DTAASIFYQSIINLG;IFYQSIINL;DTAASIFYQSIINLG;SIFYQSIIN;DVKDA
AAAVGAVSGE;VKDAAAAVG;DAAAAVGAVSGEQIL;VGAVSGEQI;EAKNAIEAAIGAAGD;IEAAIG
AAG;EGVKFAPKAAADAAA;FAPKAAADA;EQILNAIVTAAGQAG;ILNAIVTAA;EQILNAIVTAAGQA
G;LNAIVTAAG;ESVNGIAGAIKGIVE;VNGIAGAIK;EVFNAFSGLVADAFS;FNAFSGLVA;EVFNAF
SGLVADAFS;VFNAFSGLV;FAPKAAADAAAADGN;FAPKAAADA;FGTAAGADAGDVKDA;FGTA
AGADA;FIEVFNAFSGLVADA;FNAFSGLVA;FIEVFNAFSGLVADA;VFNAFSGLV;FIVAFLALIGCK
NNV;IVAFLALIG;FNAFSGLVADAFSKA;FSGLVADAF;FSGLVADAFSKADPK;LVADAFSKA;FSK
ADPKKSDVKTYF;FSKADPKKS;FYQSIINLGNGFIEV;FYQSIINLG;FYQSIINLGNGFIEV;IINLGNG
FI;FYQSIINLGNGFIEV;YQSIINLGN;GADAGDVKDAAAAVG;AGDVKDAAA;GDVKDAAAAVGAVS
G;VKDAAAAVG;GEQILNAIVTAAGQA;ILNAIVTAA;GEQILNAIVTAAGQA;LNAIVTAAG;GFIEVFN
AFSGLVAD;FNAFSGLVA;GFIEVFNAFSGLVAD;VFNAFSGLV;GGGSDKIGNVAAGGG;KIGNVA
AGG;GGSDKIGNVAAGGGA;IGNVAAGGG;GKLFGTAAGADAGDV;FGTAAGADA;GLVADAFSK
ADPKKS;AFSKADPKK;GLVADAFSKADPKKS;VADAFSKAD;GNGFIEVFNAFSGLV;FIEVFNAFS;
GNVAAGGGAGADKES;VAAGGGAGA;GSDKIGNVAAGGGAG;IGNVAAGGG;GVKFAPKAAADA
AAA;FAPKAAADA;IEVFNAFSGLVADAF;FNAFSGLVA;IEVFNAFSGLVADAF;VFNAFSGLV;IFIVA
FLALIGCKNN;IVAFLALIG;IFYQSIINLGNGFIE;FYQSIINLG;IFYQSIINLGNGFIE;IINLGNGFI;IFYQ

Fig. 40 continued

SIINLGNGFIE;YQSIINLGN;IGNVAAGGGAGADKE;VAAGGGAGA;IKKKNDQIAAALVLR;DQIAAA
LVL;ILNAIVTAAGQAGQA;ILNAIVTAA;ILNAIVTAAGQAGQA;IVTAAGQAG;ISSAIFIVAFLALIG;FI
VAFLALI;IVAFLALIGCKNNVG;IVAFLALIG;IVTAAGQAGQAGKKA;IVTAAGQAG;IAAALVLRGVA
KDGK;ALVLRGVAK;IAAALVLRGVAKDGK;IAAALV

Fig. 41.
[Sequences from figure 40 but listed differently]
<CAA59725 outer surface protein A;Protein;Borrelia afzelii>
SEQ ID NO:172553-172996
MHC Type 8-mer
A0101
A0201 YLLGIGLI;SLDEKNSA
A0202 YLLGIGLI;LIACKQNV;LLGIGLIL;KLTIADDL;SLDEKNSA;GIGLILAL;ALNDTNTT
A0203 YLLGIGLI;LIACKQNV;ALNDTNTT;LLGIGLIL;GLILALIA;SLDEKNSA
A0204 LLGIGLIL;ATVDKIEL;LIACKQNV
A0206 YLLGIGLI;ATVDKIEL;FTLEGKVA;LIACKQNV
A0211
YLLGIGLI;DLPGEMKV;SLDEKNSA;TLDELKNA;LLGIGLIL;ALNDTNTT;LIACKQNV;EIAKSGEV;KEDGKTLV;EVLKNFTL;GLILALIA;GIGLILAL;TKQDTITV;ATVDKIEL;KLTIADDL;VANDKVTL
A0212
    YLLGIGLI;DLPGEMKV;SLDEKNSA;LLGIGLIL;TLDELKNA;LIACKQNV;ALNDTNTT;FTLEGKVA
A0216
DLPGEMKV;YLLGIGLI;LLGIGLIL;SLDEKNSA;EIAKSGEV;ALNDTNTT;LIACKQNV;GTGKAKEV;TLDELKNA;EVLKNFTL;GIGLILAL;ATVDKIEL;GLILALIA
A0219 YLLGIGLI;DLPGEMKV;LLGIGLIL;SLDEKNSA;LIACKQNV;ALNDTNTT;TKQDTITV
A0301
ILALIACK;KTTFELFK;VSRKVSSK;LTISVNSK;TTQLVFTK;TLSKEIAK;KTGAWDSK;KVLVSKEK;TISVNSKK;MTRENGTK;SLKATVDK;TIADDLSK;KLEYTEMK
A1101
TTQLVFTK;KTTFELFK;LTISVNSK;TIADDLSK;KTGAWDSK;TISVNSKK;TVDKIELK;KVLVSKEK;TLSKEIAK;ILALIACK;NVSSLDEK;SLKATVDK;NTTQATKK;VSRKVSSK;MTRENGTK;KLEYTEMK;GTKDDKSK
A2301 KYLLGIGL;KTSTDEMF
A2402
A2403 KYLLGIGL
A2601 DTITVQKY
A2602 DTITVQKY;EIKTLDEL;EVLKNFTL;KTSTDEMF;SVDLPGEM;EIAKSGEV
A2902 DTITVQKY
A3001
MTRENGTK;KVLVSKEK;VSRKVSSK;KTTFELFK;TTQLVFTK;SLKATVDK;KTGAWDSK;GTKDDKSK;KLEYTEMK;LTISVNSK
A3002
A3101 TTQLVFTK;LSAKTMTR;KTTFELFK;MTRENGTK;KVLVSKEK
A3301 EMKVLVSK;TTQLVFTK
A6801
LTISVNSK;NTTQATKK;TTQLVFTK;NVSSLDEK;LSAKTMTR;KTTFELFK;TISVNSKK;MTRENGTK;ILALIACK;TIADDLSK;TVDKIELK;DTITVQKY;ELFKEDGK;EMKVLVSK;ELKGTSDK;EGTAVEIK;TTFELFKE;TLSKEIA
A6802 EIAKSGEV;TSTLTISV;LIACKQNV;EVLKNFTL
A6901 EVLKNFTL;EIAKSGEV;FTLEGKVA;YLLGIGLI;LIACKQNV
B0702 LPGEMKVL
B0801
B0802
B1501
B1801
B2705
B3501 LPGEMKVL;TAVEIKTL
B3901 FKEDGKTL;TRENGTKL;VKEGTVTL
B4001 GELSAKTM B4002
B4402
B4403
B4501
B5101 LPGEMKVL
B5301 LPGEMKVL
B5401
B5701 ATKKTGAE
B5801 KTSTDEMF

Allele 9-mer
A0101
A0201 YLLGIGLLT;KTSTLTTSV;ALLACKQNV;LLGIGLLLA;FTKQDTTTV
A0202
LLACKQNV;TLDELKNAL;YLLGIGLLL;KTSTLTTSV;GIGLTLALT;LLGIGLLLA;KSGFVTVAL;SL
KATVDKI;FTKQDTITV;DLSKTTFEL;ALNDTNTTQ
A0203
FTKQDTITV;ALLACKQNV;SLKATVDKI;YLLGIGLLL;KTSTLTTSV;LLGIGLLLA;GIGLTLALT;G
TNLEGTAV;TIADDLSKT
A0204 ALLACKQNV;YLLGIGLLL;FTKQDTITV
A0206
FTKQDTITV;KTSTLTTSV;YLLGIGLLL;ALLACKQNV;LLGIGLLLA;KEVLKGFTL;KVANDKVTL;F
KEDGKTLV
A0211
YLLGIGLLL;TLDELKNAL;ALLACKQNV;LLGIGLLLA;DLSKTTFEL;NLEGTAVEI;ALNDTNTTQ;K
TSTLTTSV;FTKQDTITV;KVANDKVTL;EVKEGTVTL;EMFNEKGEL;FKEDGKTLV;DLPGEMKVL;SL
DEKNSAS;TLEVKEGTV;SLKATVDKI;VDLPGEMKV;LAKSGEVTV;ANDKVTLEV;GKYSLKATV
A0212
YLLGIGLLL;TLDELKNAL;ALLACKQNV;ALNDTNTTQ;VDLPGEMKV;LLGIGLLLA;SLDEKNSAS;F
KEDGKTLV;DLSKTTFEL;FTKQDTITV;LAKSGEVTV;NLEGTAVEI;EVKEGTVTL;TLEVKEGTV
A0216
YLLGIGLLT;DLSKTTFEL;TLDELKNAL;ALLACKQNV;NLEGTAVEI;LLGIGLLLA;ALNDTNTTQ;T
LEVKEGTV;EMFNEKGEL;FTKQDTITV;FKEDGKTLV;LAKSGEVTV;GKYSLKATV;EVKEGTVTL;KV
ANDKVTL;KTSTLTTSV;SLKATVDKI;DLPGEMKVL
A0219
YLLGIGLLT;DLSKTTFEL;TLDELKNAL;ALLACKQNV;ALNDTNTTQ;NLEGTAVEI;FKEDGKTLV;L
LGIGLLLA
A0301
      LVSRKVGSK;KTTQLVFTK;LTTSVNSKK;LLLALTACK;TLTTSVNSK;KQDTITVQK;VTLSK
ETAK
A1101
KTTQLVFTK;STREMFNEK;LTTSVNSKK;ATVDKTELK;LTTADDLSK;LLLALTACK;VTLSKETAK;L
VSRKVGSK;SVDLPGFMK;TLTTSVNSK;KQDTITVQK;TMTRFNGTK;YSLKATVDK;SKTTFELFK;GS
SVTFGTR;DTNTTQATK
A2301 KYDSAGTNL;KYLLGIGLL
A2402 KYLLGIGLL
A2403 KYLLGIGLL;KYDSAGTNL
A2601 EVKEGTVTL
A2602 EVKEGTVTL;DLPGEMKVL
A2902
A3001
      KTTQLVFTK;YSLKATVDK;ATVDKIELK;GRKVGSKSK;TGKAKEVLK;KSDGTGKAK;KKIGA
WDSK
A3002
A3101 KTTQLVFTK;LTTSVNSKK;LLLALTACK;KQDTITVQK;VTLSKETAK
A3301 ELSAKTKLR;DTNTTQATK

Fig. 41 continued

```
A6801
LTTSVNSKK;DTNTTQATK;ELSAKTMTR;KTTQLNFTK;ETKTLDELK;TTTADDLSK;TLTTSVNSK;S
TDRMFNEK;ATVDKIFLK;LVSRKVSSK;YSLKATVDK
A6802 KTSTLTISV;FTKQDTITV;DLSKTTFEL;TVALNDTNT
A6901 FTKQDTITV;EVKEGTVTL;LPGEMKVLV;DLSKTTFEL
B0702 MTRENGTKL;KVANDKVTL
B0801
B0802
B1501 YLLGIGLIL
B1801 RENGTKLEY
B2705
B3501
B3901
B4001 KEVLKNFTL;VEIKGLDEL
B4002 KETAKSGEV;KEVLKNFTL
B4102 RENGTKLEY
B4403
B4501
B5101 LPGEMKVLV
B5301 LPGEMKVLV
B5401 LPGEMKVLV
B5701
B5801

Allele 10-mer
A0101
A0201 YLLGIGLILA;SLDEKNSASV;ALNDTNTTQA;LLGIGLILAL
A0202 YLLGIGLILA;LLGIGLILAL;SLDEKNSASV;ALNDTNTTQA
A0203 ALNDTNTTQA;SLDEKNSASV;YLLGIGLILA;LLGIGLILAL;VANDKVTLEV;SVNSKKTTQL
A0204 SLDEKNSASV;ALNDTNTTQA;VTLEVKEGTV;VANDKVTLEV;LLGIGLILAL;SVDLPGEMKV
A0206
SLDEKNSASV;YLLGIGLILA;LLGIGLILAL;KTLDELKNAL;GAWDSKTSTL;VANDKVTLEV;ALNDT
NTTQA
A0211
SLDEKNSASV;YLLGIGLILA;DLPGEMKVLV;LLGIGLILAL;ALNDTNTTQA;SVDLPGEMKV;VANDK
VTLEV;ETAKSGEVTV;ELFKEDGKTL;VTLEVKEGTV;TMTRENGTKL;TLDELKNAL;GAWDSKTSTL
;KTLDELKNAL;TTADDLSKTT;SKTSTLTISV;QLNFTKQDTT;SVNSKKTTQL
A0212
SLDEKNSASV;YLLGIGLILA;LLGIGLILAL;DLPGEMKVLV;ALNDTNTTQA;VTLEVKEGTV;VANDK
VTLEV;SVDLPGEMKV;ETAKSGEVTV;ELFKEDGKTL;TMTRENGTKL;KTLDELKNAL;GAWDSKTSTL
;QLVFTKQDTT
A0216
SLDEKNSASV;YLLGIGLILA;LLGIGLILAL;ALNDTNTTQA;DLPGEMKVLV;ETAKSGEVTV;SVDLP
GEMKV;VANDKVTLEV;GAWDSKTSTL;TMTRENGTKL;ELFKEDGKTL;SVNSKKTTQL;VTLEVKEGTV
;QLVFTKQDTT
A0219
SLDEKNSASV;LLGIGLILAL;YLLGIGLILA;ALNDTNTTQA;VANDKVTLEV;GAWDSKTSTL;DLPGE
MKVLV;SVDLPGEMKV;ETAKSGEVTV
A0301
KTMTRENGTK;VLKNFTLEGK;TLVSRKVSSK;STLTISVNSK;TTTISVNSKK;GLILALIACK;LSKTT
FELFK;KYSLKATVDK;TLDELKNALK;KLTIADDLSK;KIELKGISEK;ASVDLPGEMK;GTGKAKEVLK
A1101
STLTISVNSK;KTMTRENGTK;TSTDRMFNEK;TVTLSKETAK;GLILALIACK;KQNVSSLDEK;LSKTT
FELFK;ASVDLPGEMK;TLVSRKVSSK;TLTISVNSKK;GTGKAKEVLK;KATVDKIFLK;TLDELKNALK
;GIRLEYTENK;KLTIADDLSK;KVLVSKEKDK;VLKNFTLEGK;GVLEGIKDDK;KIELKGISEK;GTKD
EKSKAK
```

A2301 KYLLGTGLTT;KYSLKATVDK;DLSKTTFELF
A2402 KYLLGTGLTL
A2403 KYLLGTGLTL
A2601
A2602 ELAKSGEVTV
A2902
A3001
KTMTRFNQTK;VSRKVSSKDK;LSKITFELFK;GTRLFYTEMK;KQNVSSLDFK;GTSDKDKSKAK;KVLVS
KFKDK;KDKDGKYSLK;VLKNFTLFCK;STLTTSVNSK;KATVDKTFLK;KYSLKATVDK;EMKVLVSKFK
A3002
A3101 KYSLKATVDK;KKTTQLVFTK
A3301
A6801
DINTTQALLK;TSIDEKFNEK;TVTLSKELAK;STLTTSVNSK;LLTTSVNSKK;TLVSRKVSSK;LSKIT
FELFK;EMKVLVSKFK;GTRLFYTEMK;KTMTRFNQTK
A6802 ELAKSGEVTV;TVALNDTNTT;LGIGLILALI
A6901 ELAKSGEVTV;SVDLPGEMKV;VTLEVKEGTV;YLLGIGLILA;SIDEKNGSGV
B0702 GAKDSKTSTL;SVNSKKTTQL
B0801
B0802
B1501
B1801 LEVKEGTVIL
B2705
B3501 IADDLSKILG;SASVDLPGEM
B3901 AKSGEVTVAL
B4001 LEVKEGTVIL;DEKFNEKGEL
B4002
B4102
B4403
B4501
B5101
B5301
B5401 LPGEMKVLVS
B5701
B5801

Allele 11-mer
A0101 MTRFNQTKLFY
A0201 YLLGTGLTLAL;LVFTKQDTTTV;KVANDKVTLEV;LLGTGLTLALT;ILALIACKQNV
A0202
ILALIACKQNV;YLLGTGLTLAL;LIACKQNVSSL;LLGTGLTLALT;ALNDTNTTQAT;GTSDKDKGSGV
;SLKATVDKTEL;SVNSKKTTQLV;LVFTKQDTTTV;TLFCKVANDKV;KVANDKVTLEV;ELFKRDCKTL
V;KTMTRFNQTKL;VLKNFTLFCKV
A0203
VLKNFTLFCKV;LIACKQNVSSL;YLLGTGLTLAL;ILALIACKQNV;LLGTGLTLALT;SVNSKKTTQLV
;ALNDTNTTQAT;LVFTKQDTTTV;SLKATVDKTEL;GTSDKDKGSGV;KVANDKVTLEV;TLFCKVANDK
V
A0204
KVANDKVTLEV;KTMTRFNQTKL;LVFTKQDTTTV;YLLGIGLILAL;ILALIACKQNV;SVNSKKTTQLV
;SLKATVDKTEL;VLKNFTLFCKV
A0206
YLLGIGLILAL;KVANDKVTLEV;LVFTKQDTTTV;TQLVFTKQDTT;KELAKSGEVTV;TAVELKTLDEL
;SAGTKLEGTAV;LLGIGLILALI;ILALIACKQNV;LIACKQNVSSL
A0211
YLLGIGLILAL;ILALIACKQNV;ELSKELGKILV;KVANDKVTLEV;LLGIGLILALI;LVFTKQDTTTV
;TLFCKVANDKV;SVNSKKTTQLV;VLKNFTLFCKV;SLKATVDKTEL;ALNDTNTTQAT;EMFNEKGELS

Fig. 41 continued

A;SSLDEKNSASV;TLEVKFGTVTL;GTSDKDNGSGV;VDLPGFMKVLV;SVDLPGFMKVL;KVTLEVKFG
TV
A0212
YLLGTGLTIAL;FLFKEDGKTLV;VLKNFTLFGKV;LIALTACKQNV;LVFTKQDTTTV;ALNDTNTTQAT
;TLFGKVANDKV;LLGTGLTIALT;FMFNEKGRLSA;GTSDKDNGSGV;KVANDKVTLEV;SLKATVDKTE
L;SVNSKKTTQLV;SSLDEKNSASV;VDLPGFMKVLV;TLEVKFGTVTL
A0216
YLLGTGLTIAL;FLFKEDGKTLV;TLFGKVANDKV;LIALTACKQNV;VLKNFTLFGKV;LVFTKQDTTTV
;KVANDKVTLEV;SLKATVDKTEL;SVNSKKTTQLV;LLGTGLTIALT;TLEVKFGTVTL;ALNDTNTTQA
T;FMFNEKGRLSA;GTSDKDNGSGV;SSLDEKNSASV;NLFGTAVEIKT;LTACKQNVSSL
A0219
YLLGIGLILAL;LIALTACKQNV;TLFGKVANDKV;ALNDTNTTQAT;LLGIGLILALI;LVFTKQDTTTV
;FLFKEDGKTLV;SVNSKKTTQLV;LTACKQNVSSL
A0301 KLLVSRKVSSK;STLTISVNSKK;KILDELKNALK;KTSTDEMFNEK;FTKQDTTTVQK
A1101
STLTISVNSKK;TLFFLFKEDGK;KTSTDEMFNEK;KILDELKNALK;KLLVSRKVSSK;TSLTISVNSK
;GTVTLSKETAK;SASVDLPGFMK;ATKKTGAVDSK;AVEIKTIDELK;VANDKVTLEVK;DLSKTTFELF
K;FTKQDTTTVQK;LVSRKVSSKDK;EVLKGTTLEGK;YTFMKSDGTGK;TLEGKVANDK
A2301 KYSLKATVDKT
A2402 KYSLKATVDKT;AWDSKTSLTT
A2403 KYSLKATVDKT
A2601
A2602 TLADDLSKTTF;MLRENGTKLEY
A2902 MLRENGTKLEY
A3001
ATKKTGAVDSK;KLLVSRKVSSK;KILDELKNALK;MLRENGTKLEY;EVKFGTVTLSK;KTSTDEMFNEK
;FTKQDTTTVQK;STLTISVNSKK;SKKTTQLVFTK
A3002
A3101 KLLVSRKVSSK;KILDELKNALK;FMFNEKGRLSA;STLTISVNSKK;KTSTDEMFNEK
A3301 EVKFGTVTLSK;DLSKTTFELFK
A6801
TLFFLFKEDGK;STLTISVNSKK;FTKQDTTTVQK;TSLLTTSVNSK;EVKFGTVTLSK;EVLKNFTLFGK
;DLSKTTFELFK;FTLFGKVANDK;KTSTDEMFNEK;YTFMKSDGTGK;LVSKFKDKDGK;SASVDLPGFM
K;GTVTLSKETAK
A6802
TAVEIKTIDEL;DTTTVQKYDSA;LVFTKQDTTTV;FLFKEDGKTLV;SVNSKKTTQLV;LIALTACKQNV
;LTACKQNVSSL;ETAKSGFVTVA;NVSSLDEKNSA
A6901 LVFTKQDTTTV;YLLGTGLTIAL;FLFKEDGKTLV
B0702 TAKSGFVTVAL
B0801
B0802
B1501 MLRENGTKLEY;YLLGTGLTIAL;VQKYDSAGTNL
B1801 FFLFKEDGKTL;MLRENGTKLEY
B2705
B3501 TAVEIKTIDEL;TAKSGFVTVAL;TLADDLSKTTF;MLRENGTKLEY
B3901
B4001 FELFKEDGKTL;LEGTAVEIKTL
B4002 KFTAKSGFVTV
B4402
B4403
B4501 KELAKSGFVTV
B5101
B5301
B5401 LPGFMKVLVSK
B5701 TTQATKKTGAV

Allele 15-mer plus 9-mer core
DRB1_0101
KKVLGTGLTLALTA-LLGTGLTLA;KVLLGTGLTLALTAC-LLGTGLTLA;MKKVLLGTGLTLALT-
LLGTGLTLA;KTQAWDSKTSTLTS-KDSKTSTLT;TQAWDSKTSTLTISV-
KDSKTSTLT;TKKTQAWDSKTSTLT-KTQAWDSKT;QAWDSKTSTLTISVN-
KDSKTSTLT;KKTQAWDSKTSTLT-KDSKTSTLT;VLLGTGLTLALTACK-
TGLTLALTA;LLGTGLTLALTACKQ-TGLTLALTA;LGTGLTLALTACKQN-
TGLTLALTA;QLVFTKQDTTIVQKY-FTKQDTTIV;TQLVFTKQDTTIVQK-
FTKQDTTIV;TTQLVFTKQDTTIVQ-FTKQDTTIV;KTQLVFTKQDTTIV-
VFTKQDTTI;LVFTKQDTTIVQKYD-FTKQDTTIV;VLEVKEGTVTLSKE-
VKEGTVTLS;KVTLEVKEGTVTLSK-VKEGTVTLS;KIFYTEMKSDGTGKA-
YTEMKSDGT;EKVLLEVKEGTVTLS-LEVKEGTVT;LEVKEGTVTLSKEIA-
VKEGTVTLS;LEYTEMKSDGTGKAK-YTEMKSDGT;TISVNSKKTTQLVFT-
VNSKKTTQL;ISVNSKKTTQLVFTK-VNSKKTTQL;TLTISVNSKKTTQLV-
VNSKKTTQL;TLEVKEGTVTLSKEI-VKEGTVTLS;GTLTISVNSKKTTQL-
TISVNSKKT;AWDSKTSTLTISVNS-KDSKTSTLT;LTISVNSKKTTQLVF-
VNSKKTTQL;WDSKTSTLTISVNSK-KDSKTSTLT;LIVQKYDSAGTNLEG-
VQKYDSAGT;TITVQKYDSAGTNLE-VQKYDSAGT;LLFKEDGKTLVSRKV-
FKEDGKTLV;EDGKTLVSRKVSGKD-GKTLVSRKV;GLGLTLALTACKQNV-
LLALTACKQ;KEDGKTLVSRKVSGK-GKTLVSRKV;VALNDTNTTQATKKT-
LNDTNTTQA;LGLTLALTACKQNVS-LLALTACKQ;YTEMKSDGTGKAKEV-
YTEMKSDGT;LFKEDGKTLVSRKVS-GKTLVSRKV;DTTIVQKYDSAGTNL-
VQKYDSAGT;EYTEMKSDGTGKAKE-YTEMKSDGT;QDTTIVQKYDSAGTN-
VQKYDSAGT;TKLEYTEMKSDGTGK-YTEMKSDGT;FKEDGKTLVSRKVSG-
GKTLVSRKV;KQDTTIVQKYDSAGT-IIVQKYDSA;EVTVALNDTNTTQAT-
VALNDTNTT;GTKLEYTEMKSDGTG-YTEMKSDGT;GEVTVALNDTNTTQA-
VALNDTNTT;NGTKLEYTEMKSDGT-TKLEYTEMK;VTVALNDTNTTQATK-
VALNDTNTT;VFTKQDTTIVQKYDS-FTKQDTTIV;SVNSKKTTQLVFTKQ-
VNSKKTTQL;QKYDSAGTNLEGTAV-YDSAGTNLE;VNSKKTTQLVFTKQD-
VNSKKTTQL;GLTLALTACKQNVSS-TLALTACKQ;FTKQDTTIVQKYDSA-
FTKQDTTIV;VKEGTVTLSKETAKS-VKEGTVTLS;EVKEGTVTLSKETAK-
VKEGTVTLS;KSGEVTVALNDTNTT-EVTVALNDT;DEMFNEKCRLSAKTM-
KFNEKCRLS;SGEVTVALNDTNTTQ-VALNDTNTT;TEMFNEKCRLSAKT-
MFNEKCRLS;TVQKYDSAGTNLEGT-VQKYDSAGT;VQKYDSAGTNLEGTA-
VQKYDSAGT;ALNDTNTTQATKKTG-NTTQATKKT;VDLPEEKVLVSRKEK-
LPEEKVLV;DGKTLVSRKVSGKDK-GKTLVSRKV;GKTLVSRKVSGKDKI-
GKTLVSRKV;FNEKCRLSAKTMTRE-FKCRLSAKT;SSLDEKNSASVDLPE-
EKNSASVDL;LNDTNTTQATKKTGA-NTTQATKKT;VSSLDEKNSASVDLP-
EKNSASVDL;NVSSLDEKNSASVDL-LDEKNSASV;TVALNDTNTTQATKK-
LNDTNTTQA;EMFNEKCRLSAKTKT-FKCRLSAKT
DRB1_0301
DRB1_0401
QLVFTKQDTTIVQKY-FTKQDTTIV;TQLVFTKQDTTIVQK-FTKQDTTIV;LVFTKQDTTIVQKYD-
FTKQDTTIV;TTQLVFTKQDTTIVQ-FTKQDTTIV;KTQLVFTKQDTTIV-
KTQLVFTK;LEYTEMKSDGTGKAK-MKSDGTGKA;KLEYTEMKSDGTGKA-
YTEMKSDGT;EYTEMKSDGTGKAKE-MKSDGTGKA;YTEMKSDGTGKAKEV-
MKSDGTGKA;TEMKSDGTGKAKEVL-MKSDGTGKA
DRB1_0404
GEVTVALNDTNTTQA-VALNDTNTT;EVTVALNDTNTTQAT-LNDTNTTQA;VTVALNDTNTTQATK-
LNDTNTTQA;TVALNDTNTTQATKK-LNDTNTTQA;GKAKEVLKNFTLEGK-
VLKNFTLEG;VALNDTNTTQATKKT-LNDTNTTQA;AKEVLKNFTLEGKVA-
VLKNFTLEG;KAKEVLKNFTLEGKV-VLKNFTLEG;TGKAKEVLKNFTLEG-
AKEVLKNFT;KEVLKNFTLEGKVAN-VLKNFTLEG
DRB1_0405

Fig. 41 continued

TITVQKYDSAGTNLE-VQKYDSAGT;ITVQKYDSAGTNLEG-YDSAGTNLE;TVQKYDSAGTNLEGT-YDSAGTNLE;VQKYDSAGTNLEGTA-YDSAGTNLE;QKYDSAGTNLEGTAV-YDSAGTNLE
DRB1_0701
DRB1_0802
DRB1_0901
DRB1_1101
DRB1_1302
STLTISVNSKKTTQL-ISVNSKKTT;TLTISVNSKKTTQLV-ISVNSKKTT;LTISVNSKKTTQLVF-ISVNSKKTT;EVTVALNDTNTTQAT-VALNDTNTT;GEVTVALNDTNTTQA-VALNDTNTT;KTSTLTISVNSKKTT-LTISVNSKK;VTVALNDTNTTQATK-VALNDTNTT;TSTLTISVNSKKTTQ-ISVNSKKTT;KSGEVTVALNDTNTT-EVTVALNDT;SGEVTVALNDTNTTQ-VALNDTNTT;TISVNSKKTTQLVFT-ISVNSKKTT;ISVNSKKTTQLVFTK-ISVNSKKTT;VALNDTNTTQATKKT-VALNDTNTT;TVALNDTNTTQATKK-VALNDTNTT
DRB1_1501
AKEVLKNFTLEGKVA-LKNFTLEGK;KEVLKNFTLEGKVAN-LKNFTLEGK;GKAKEVLKNFTLEGK-VLKNFTLEG;KAKEVLKNFTLEGKV-LKNFTLEGK;EVLKNFTLEGKVAND-LKNFTLEGK;VLKNFTLEGKVANDK-LKNFTLEGK;LKNFTLEGKVANDKV-LKNFTLEGK
DRB3_0101
DRB4_0101
DRB5_0101
LPGEMKVLVSKEKDK-MKVLVSKEK;GEMKVLVSKEKDKDG-MKVLVSKEK;VDLPGEMKVLVSKEK-VDLPGEMKV;PGEMKVLVSKEKDKD-MKVLVSKEK;DLPGEMKVLVSKEKD-MKVLVSKEK

<YP_853838 outer surface protein B;Protein;Borrelia afzelii PKo
SEQ ID NO:172997-173522
Allele 8-mer
A0101
A0201
YLLVFALV;VLAEENSV;FLTDGTIT;KQYLLVFA;LTDGTITV;LLVFALVL;LVFALVLA;FALVLALI
A0202
VLAEENSV;YLLVFALV;LLVFALVL;FLTDGTIT;LVFALVLA;KTKDFVFL;YLNDTTSG;KQYLLVFA;ATVDTVEL;AMTIADDL;FVFLTDGT;LVGGKTTV
A0203
VLAEENSV;YLLVFALV;LVGGKTTV;FLTDGTIT;KQYLLVFA;LLVFALVL;KTKDFVFL;TLKNGIKL;VVKKQGSV;ALVLALIA;YLNDTTSG;KTKVAMTI;KLTEGTIT;LTDGTITV;LVFALVLA;ATKAVETL;ATVDTVEL;
A0204
VLAEENSV;YLLVFALV;LVGGKTTV;ATVDTVEL;LTDGTITV
A0206
YLLVFALV;KQYLLVFA;VLAEENSV;LTDGTITV;ATVDTVEL;FLTDGTIT;FALVLALI;LVGGKTTV;LLVFALVL;IADDLNTI;FVFLTDGT;KTKDFVFL;LVFALVLA
A0211
YLLVFALV;VLAEENSV;LTDGTITV;LVGGKTTV;FLTDGTIT;LLVFALVL;TLKNGIKL;SLVGGKTT;PLFNGNKI;YLNDTTSG;KLTEGTIT;EMTDSSNA;LVFALVLA;ATVDTVEL;IADDLNTI;KTKDFVFL;ALVLALIA;TLTREIEQ;DLAALKAA;EIKDLAAL;IKLEGSLV;KLDSKKIT
A0212
YLLVFALV;VLAEENSV;LTDGTITV;LVGGKTTV;FLTDGTIT;LLVFALVL;YLNDTTSG;TLKNGIKL;PLFNGNKI;SLVGGKTT;EIKDLAAL
A0216
YLLVFALV;VLAEENSV;LVGGKTTV;LTDGTITV;TLKNGIKL;FLTDGTIT;LLVFALVL;PLFNGNKI;SLVGGKTT;ALVLALIA;ATVDTVEL;TLTREIEQ;KLTEGTIT;VVKKQGSV
A0219
YLLVFALV;VLAEENSV;LTDGTITV;LVGGKTTV;FLTDGTIT;LLVFALVL;YLNDTTSG;IADDLNTI
A0301
ALIACSQK;KIFVSKEK;TTSGSTKK;KTGSEVVK;SVIKESYK;AALKAALK;ETYDASNK;TISADSKK

Fig. 41 continued

```
A1101
SVIKESYK;TTSGSTKK;AILACSQK;TVRTVFLK;AALKAALK;TTSADSKK;KTFVSKEK;LTTSADSK
;FIYDASNK;RTGSFVVK;KANKLDSK;SQKGTEPK;GTTTVQAY;QTKADKTK;SADSKKTK
A2301
QYILVFAL;IYDASNKK;AYDTAGTK;LFNQNKTF
A2402 QYILVFAL;VFLTDGTT;VFALVLAL
A2403 QYILVFAL
A2601 NTITVETY;FIKDLAAL;GTTTVQAY;DTVELKGV
A2602 FIKDLAAL;NTITVETY;GTTTVQAY;TTLEYSEM;KTKDFVFL;FIINTITI
A2902 GTTTVQAY
A3001
KIFVSKEK;SQKGTEPK;KIKVAKTI;AALKAALK;GIKADKTK;KTKDFVFL;TTSGSTKK;KEKNSAGK
;KANKLDSK;RTGSFVVK;SGKLEGTK;KKQGSVIK;SVIKESYK
A3002
A3101 KTKDFVFL;SAGKYFLR;KIFVSKEK;KANKLDSK
A3301 DITSGSTK
A6801
FIYDASYK;TTSGSTKK;LTLSADSK;DTTSGSTK;SVIKESYK;NTITVETY;TISADSKK;TVRTVFLK
;ETLKNGIK;NTPKDSKK;SAGKYFLR;EGTITLTR;ELEGVCGK
A6802 NSAGKYFL;DTVELKGV;EIINTLTI;LVFALVLA;FVFLTDGI;ATVDTVEL
A6901
LLDGTITV;YLLVFALV;EIINTLTI;TTLEYSEM;DTVELKGV;FALVLALL;ATVDTVEL;LVFALVLA
B0702 LAALKAAL
B0801
B0802
B1501 GTTTVQAY
B1801
B2705
B3501 LAALKAAL;NTITVETY
B3901 TRENLTTLD4G01 AFFNSVPL
B4002 FFNSVPLF;AFFNSVPL
B4402 FFNSVPLF
B4403 FFNSVPLF;SKIKDLAA
B4501 AFFNSVPL;FFNSVPLF
B5101 FALVLALT
B5301 FALVLALT
B5401 FALVLALT
B5701 STKKTATK
B5801 STKKTATK
```

Allele 9-mer
```
A0101 MTDSGNATK
A0201
FLTDGTITV;KLTEGTITL;YLLVFALVL;KQYLLVFAL;LVFALVLAL;LLVFALVLA;YLNDTTSGS;T
IADDINTT;SLVGGKTTV
A0202
FLTDGTITV;LLVFALVLA;YLNDTTSGS;KLTEGTITL;TIADDLNTI;KQYLLVFAL;LVFALVLAL;K
LEGNSSET;FVSKFKNSA;SLVGGKTTV;YLLVFALVL
A0203
FLTDGTITV;TIADDLNTI;SLVGGKTTV;KLTEGTITL;LLVFALVLA;YLNDTTSGS;KQYLLVFAL;G
IKLEGSLV;ELRAIVDTV;KIKVAKTIA;LVFALVLAL;YLLVFALVL;TTNLITISA
A0204 FLTDGTITV;SLVGGKTTV;KLTEGTITL;KLEGNSSEI;TVLAEENSV;YLLVFALVL
A0206
FLTDGTITV;KLTEGTITL;KQYLLVFAL;TIADDLNTI;SLVGGKTTV;VQAYDTAGT;SKIKDLAAL;L
LVFALVLA;SQDHNQEI;TVLAEENSV;YLLVFALVL;LVFALVLAL;LVQAYDTA;FVFLTDGTI;YL
NDTTSGS
```

Fig. 41 continued

A0201
FLTDGTTTV;KLTEGTTTL;SLVGGKTTV;YLLVFAIVL;KLEGNSSEI;TIADDLNTI;DLAALKAAL;E
LRATVDTV;YLNDTTSGS;LVFAIVLAL;LLVFAIVLA;QKYELRATV;LFNGNKTFV;TVLAFENSV;VL
AITACSQ;KQYLLVFAI;EMIDSSNAT;KLDSKKTTR
A0212
FLTDGTTTV;SLVGGKTTV;YLLVFAIVL;KLTEGTTTL;YLNDTTSGS;ELRATVDTV;DLAALKAAL;L
VFAIVLAL;TVLAFENSV;KLEGNSSEI;TIADDLNTI;QKYELRATV;TTRFNETTI;LFNGNKTFV;LL
VFAIVLA
A0216
FLTDGTTTV;SLVGGKTTV;KLTEGTTTL;ELRATVDTV;YLLVFAIVL;KLEGNSSEI;DLAALKAAL;L
FNGNKTFV;TVLAFENSV;QKYELRATV;TIADDLNTI;LLVFAIVLA;EVVKKQGSV;VLAITACSQ;LV
FAIVLAL;YLNDTTSGS
A0219
FLTDGTTTV;SLVGGKTTV;KLTEGTTTL;ELRATVDTV;YLNDTTSGS;YLLVFAIVL;TIADDLNTI;T
VLAFENSV;KLEGNSSEI;DLAALKAAL
A0301
LVGGKTTVK;IINSDNTPK;KIGSEVVKK;LAALKAALK;MIDSSNATK;ATKAVETLK;KANKLDSKK;
A1101
ATVDTVELK;ATKAVETLK;SVPLFNGNK;MIDSSNATK;IINSDNTPK;KIGSEVVKK;QAYDTAGTK;L
TISADSKK;ETYDASNKK;KANKLDSKK;TLTISADSK;LAALKAALK;CSQKGTEPK;GSVIKESYK;LV
GGKTTVK;ISADSKKLK;LALIACSQK;
A2301 AYDTAGTKL;TVKETTNIL;ETYDASNKK
A2402 VFAIVLALL;QYLLVFALV;TVKETTNIL
A2403 AYDTAGTKL
A2601 EILLEYSEM;ETLKNGIKL
A2602 EILLEYSEM;EVVKKQGSV;ETLKNGIKL
A2902
A3001
ATKAVETLK;ATVDTVELK;KTKDFVFLT;CSQKGTEPK;QAYDTAGTK;ETYDASNKK;KIGSEVVKK;K
TKVARTIA;KANKLDSKK;MIDSSNATK;IINSDNTPK;SVPLFNGNK
A3002
A3101 KLDSKKTTR;ATKAVETLK;MIDSSNATK;KANKLDSKK;RTKDFVFLT
A3301 FIKDLAALK;DTTSGSTKK;NSACKYELR
A6801
ETYDASNKK;FIKDLAALK;LTTSADSKK;DTTSGSTKK;NSACKYELR;MIDSSNATK;QAYDTAGTK;A
TVDTVELK;LAALKAALK;SVPLFNGNK;TLTISADSK;ATKAVETLK;LALIACSQK;IINSDNTPK
A6802
TTNILTTSA;EVVKKQGSV;TTVKLTEGT;LVFAIVLAL;TIADDLNTI;DLAALKAAL;FVFLTEGTT;E
TILEYSEM;TVLAFENSV;NSSEIKDIA;FLTDGTTTV;SVIKESYKA
A6901
FLTDGTTTV;ETLKNGIKL;ETLEYSEMT;TIADDLNTI;EVVKKQGSV;LVFAIVLAL;TVLAFENSV;T
TNILTTSA
B0702 VPLFNGNKI;TPKDSKKDI;KADKTKVAM;RATVDTVEL;LAFENSVPL
B0801
B0802
B1501 KQYLLVFAI;LVFAIVLAL;RENETTLEY
B1801 RENETTLEY;SEIKDLAAL;NETTNLLTI;IEQDGKVKL
B2705 KQYLLVFAI;
B3501 LAFENSVPL;
B3901
B4001 SEIKDLAAL;AENSVPLF
B4002 AENSVPLF;REIEQDGKV;RENETTLEY
B4402 RENETTLEY
B4403 RENETTLEY;EENSVPLFN;AENSVPLF;REIEQDGKV;
B4501 RENETTLEY;AENSVPLF;REIEQDGKV
B5101 VPLFNGNKI

Fig. 41 continued

B5301 VPLFNGKTF
B5401 FALVLALLA;VPLFNGKTF
B5701
B5801 GSTKKTNIV

Allele 10-mer
A0101
A0201
YLLVFALVLA;KQYLLVFALV;VLAFENSVPL;LLVFALVLAL;KLTEGTITLT;YLNDTTSGST;LVFAL
VLALI;FLTDGTITVQ;IADDLNTITV;
A0202
YLLVFALVLA;VLAFENSVPL;LVFALVLALI;KQYLLVFALV;LLVFALVLAL;PLFNGKIFV;FLTDG
TITVQ;KTIADDLNTI;KLTEGTITLT;IADDLNTITV
A0203
VLAFENSVPL;YLNDTTSGST;LLVFALVLAL;KQYLLVFALV;KLTEGTITLT;KTIADDLNTI;YLLVF
ALVLA;FLTDGTITVQ;LVFALVLALI;
A0204 VLAFENSVPL;LLVFALVLAL
A0206
KQYLLVFALV;KTIADDLNTI;VLAFENSVPL;LLVFALVLAL;ATWNETTNIL;KLTEGTITLT;IADDL
NTITV;YLLVFALVLA;YELRATVDTV;FLTDGIITVQ;KAVETLKNGI;YLNDTTSGST;LVFALVLALI
;GQDHKQELL;LLVLAFENSV
A0211
PLFNGKIFV;VLAFENSVPL;YLLVFALVLA;IADDLNTITV;FLTDGIITVQ;KLTEGTITLT;LLVFA
LVLAL;YLNDTTSGST;TVDIVELKGV;LVFALVLALI;KQYLLVFALV;KITRENETTL;VFLTDGTITV
;LTDGTITVQA;SLVGGKTTVK;ATWNETTNIL;YELRATVDTV
A0212
PLFNGKIFV;VLAFENSVPL;FLTDGIITVQ;YLLVFALVLA;LLVFALVLAL;YLNDTTSGST;IADDL
NTITV;TVDIVELKGV;KLTEGTITLT;VFLTDGTITV;KITRENETTL;YELRATVDTV
A0216
PLFNGKIFV;VLAFENSVPL;FLTDGIITVQ;IADDLNTITV;YLLVFALVLA;LLVFALVLAL;KLTEG
TITLT;YLNDTTSGST;KITRENETTL;LVGGKTTVKL;ATWNETTNIL;TVDIVELKGV;VFLTDGTITV
A0219
FLTDGTITVQ;IADDLNTITV;PLFNGKIFV;VLAFENSVPL;YLNDTTSGST;LLVFALVLAL;TVDIV
ELKGV;YLLVFALVLA;ATWNETTNIL;KLTEGTITLT;YELRATVDTV;
A0301
SLVGGKTTVK;VLALTACSQK;DLAALKAALK;KLEGSIVGGK;NTLTTSADSK;VVKKQGSVTK;KIFGN
SSFTK;VQAYDTAGTK
A1101
TVFTYDASNK;NTLTTSADSK;TTSADSKKTK;RATVDIVELK;VLALTACSQK;AVFTLKNGTK;TVELK
GVSDK;NSVPLFNGNK;TLTTSADSKK;SLVGGKTTVK;VQAYDTAGTK;KLEGSIVGGK;VTKFSYKANK
;FTTNSDNTPK;VVKKQGSVTK;VSKEKNSAGK;VSDKNNGSGK
A2301 QYLLVFALVL;SYKANKLDSK
A2402 QYLLVFALVL
A2403 QYLLVFALVL
A2601
A2602 FVVKKQGSVT
A2902
A3001
RATVDTVELK;KLEGNSSFIK;LTRYIFQDGK;VVKKQGSVTK;SYKANKLDSK;VSKEKNSAGK;VTKFS
YKANK;ACSQKGTFPK;KLEGSIVGGK
A3002
A3101 KNSAGKYELR
A3301
A6801
NAIRAVETLK;NTLTTSADSK;TVFTYDASNK;LTEGTITLTR;FTINSDNTPK;DLAALKAALK;NSVPL

Fig. 41 continued

FNGNK;FMIDSSNATK;TLTTSADSKK;VLAITACSQK;TTSADSKKTR;LTRFTFQDSK;RATVDTVELK
;TVELKGVSDK
A6802
MTTADDLNTT;LVFALVLALT;KTTNTLTTSA;TTVKLTFCTT;NTTTVETYDA;LTVLAFFNSV;FWVKK
QGSVT;SVPLFNGNKT;KTTLEYSEMT
A6901
KTTNTLTTSA;MTTADDLNTT;ATWNFTTNTL;FTYGASNKKT;LVFALVLALT;TADDLNTTTV;MIDSS
NATKA;QAYDTAGTKL
B0702 VPLFNGNKIF
B0801
B0802
B1501 KQGSVIKESY;VLAFFNSVPL
B1801 TFQDSKVKTY;YELRATVDTV;VKLTFCTTTL;
B2705
B3501 VPLFNGNKIF;LAFFNSVPLF;DLNTTTVETY;
B3901
B4001 VETLKNGLKL
B4002
B4102
B4402
B4403
B4501
B5101
B5301 VPLFNGNKIF
B5401
B5701
B5801 SGSLKKTAIW

Allele 11-mer
A0101 FLIDGTITVQAY;MIDSSNATKAV
A0201
FLIDGTITVQA;YLLVFALVLAL;TIADDLNTTTV;FVFLTCGTTTV;LLVFALVLALI;SLVGGKTTVKL
;KQYLLVFALVL;AMTTADDLNTT;
A0202
FLIDGTITVQA;LLVFALVLALT;TIADDLNTTTV;SLVGGKTTVKL;YLLVFALVLAL;FVFLTCGTTTV
;AMTTADDLNTT;MIDSSNATKAV;VQAYDTAGTKL;NSSETKDLAAL;KQYLLVFALVL
A0203
FLIDGTITVQA;TIADDLNTTTV;LLVFALVLALT;ATVDTVELKGV;SLVGGKTTVKL;FVFLTCGTTTV
;AMTTADDLNTT;YLLVFALVLAL;MIDSSNATKAV;VQAYDTAGTKL;TLKNGTKLPGS;VTKFSYKANK
L;MKQYLLVFALV;
A0204
SLVGGKTTVKL;TIADDLNTTTV;FLIDGTITVQA;FVFLTCGTTTV;YLLVFALVLAL;ATVDTVELKGV
A0205
FLIDGTITVQA;TIADDLNTTTV;FVFLTCGTTTV;ATVDTVELKGV;KQYLLVFALVL;YLLVFALVLAL
;VQAYDTAGTKL;LLVFALVLALT;MKQYLLVFALV;MIDSSNATKAV;SLVGGKTTVKL;TVLAFFNSVP
L;AMTTADDLNTT;
A0211
FLIDGTITVQA;YLLVFALVLAL;TIADDLNTTTV;SLVGGKTTVKL;FVFLTCGTTTV;DLLVLAFFNSV
;LLVFALVLALT;MIDSSNATKAV;SAGKYELRATV;YLNDTTSGSTK;KLTFCTTTLTR;FMIDSSNATK
A;ELRATVDTVEL;SADSKKTKEFV;ATVDTVELKGV;AMTTADDLNTT;VLAFFNSVPLF;DVLAFFNSV
PL;KADKTKVAKTT
A0212
YLLVFALVLAL;FLIDGTITVQA;SLVGGKTTVKL;TIADDLNTTTV;FVFLTCGTTTV;YLNDTTSGSTK
;SAGKYELRATV;MIDSSNATKAV;DLLVLAFFNSV;LLVFALVLALI;ELRATVDTVEL;ATVDTVELKG
V
A0216
SLVGGKTTVKL;FLIDGTITVQA;TIADDLNTTTV;FVFLTCGTTTV;SAGKYELRATV;YLLVFALVLAL

Fig. 41 continued

;SADSKKTKDFV;DLTVLAFFNSV;FLRATVDTVFL;LLVFALVLAI;AMTIADDLNTT;MTDSSNATKA
V;YLNDTTSGSTK;FMTDSSNATKA;ALVLALTACSQ;ATVDTVFLKGV
A0219
FLTDGTTTVQA;TIADDLNTTTV;YLLVFALVLAL;SLVGGKTTVKL;MTDSSNATKAV;FVFLTDGTTTV
;SADSKKTKDFV;YLNDTTSGSTK;ATVDTVFLKGV;DLTVLAFFNSV;FLRATVDTVFL;LLVFALVLAL
T;FMTDSSNATKA;
A0301
LVLALTACSQK;YLNDTTSGSTK;KLTEGTILLTR;KQGSVTKFSYK;SVIKESYKANK;LFNGKFIFVSK
;GSLVGGKTTVK
A1101
SVIKESYKANK;TVQAYRTAGTK;LVLALTACSQK;SSFIKDLAAIK;ITVETYDASNK;GVSDRKKCSCK
;IVETYDASNKK;IACSQKGIEPK;NILTISADSKK;KQGSVIKESYK;LTISADSKKTK;YLNDTTSGST
K;GSLVGGKTTVK;KAVETLKNGTK;ESYKANKLDSK;FVSKEKNSAGK
A2301  SYKANKLDSKK
A2402  TYNETTNTLIT
A2403
A2601  ELEQDGKVKLY
A2602  ELEQDGKVKLY;LTDGTITVQAY;SVPLFNGNKIF;ITRENETILEY
A2902  ITRENETILEY
A3001
ITRENETILEY;TVQAYRTAGTK;SYKANKLDSKK;YLNDTTSGSTK;KLEGTKADKTK;IACSQKGIEPK
;LTISADSKKTK;LFNGNKIFVSK;SVIKESYKANK;GSLVGGKTTVK;KAVETLKNGTK
A3002
A3101
KLTEGTILLTR;KQGSVIKESYK;LFNGNKIFVSK;SVIKESYKANK;SYKANKLDSKK;LVLALTACSQK
A3301
A6801
NILTISADSKK;ITVETYDASNK;ESYKANKLDSK;DTVFLKGVSDK;TVQAYRTAGTK;SVIKESYKANK
;IVETYDASNKK;LTISADSKKTK;FVSKEKNSAGK;EVVKKQGSVIK;LVLALTACSQK;YLNDTTSGST
K;IACSQKGIEPK;TLTRLEQDGK;INTLTISADSK;EKNSAGKYELR
A6802
FVFLTDGTTTV;TIADDLNTTTV;MKQYLLVFALV;NSVPLFNGNKI;NSSFIKDLAAL;MTDSSNATKAV
;TVLAFFNSVPL;STSQDRNDQFT;RGSLVGGKTTV;MTIADDLNTIT;ATVDTVFLKGV
A6901
TIADDLNTTTV;MTDSSNATKAV;FVFLTDGTTTV;TVLAFFNSVPL;ATVDTVFLKGV;VPLFNGNKIFV
B0702 VPLFNGNKIFV
B0801 YLLVFALVLAL
B0802
B1501 ITRENETILEY;KQYLLVFALVL;VLAFFNSVPLF;VSKEKNSAGKY;YLLVFALVLAL
B1801 TRQDGKVKTYL
B2705 KQYLLVFALVL
B3501 TATENETINTL;LTDGTITVQAY;TVLAFFNSVPL
B3901 KQYLLVFALVL
B4001 TRQDGKVKTYL;RFTRQDGKVKT;EKNSAGKYEL;LFGNSSFIKDL
B4002 RFTRQDGKVKT;EKNSAGKYEL
B4402
B4403
B4501
B5101 VPLFNGNKIFV
B5301
B5401 VPLFNGNKIFV
B5701 TSGSTKKTATW
B5801 TSGSTKKTATW

Allele 15-mer plus 9-mer core
DRB1 0101

Fig. 41 continued

ETYDASNKKTGSEVV-SNKKTGSEV;TYDASNKKTGSEVVK-NKKTGSEVV;YDASNKKTGSEVVKK-NKKTGSEVV;DASNKKTGSEVVKKQ-NKKTGSEVV
DRB1_0802
DRB1_0901 KQYLLVFALVLALIA-LVFALVLAL;YLLVFALVLALIACS-LVFALVLAL;MKQYLLVFALVLALI-LVFALVLAL;QYLLVFALVLALIAC-LVFALVLAL
DRB1_1101
DRB1_1302
NSVPLFNGNKIFVSK-VPLFNGNKI;ENSVPLFNGNKIFVS-VPLFNGNKI;DGKVKIYLNDTTSGS-VKIYLNDTT;GKVKIYLNDTTSGST-YLNDTTSGS;ETLKNGIKLEGSLVG-LKNGIKLEG;VPLFNGNKIFVSKEK-VPLFNGNKI;SVPLFNGNKIFVSKE-VPLFNGNKI;KAVETLKNGIKLEGS-LKNGIKLEG;TKAVETLKNGIKLEG-VETLKNGIK;KVKIYLNDTTSGSTK-YLNDTTSGS;VKIYLNDTTSGSTKK-YLNDTTSGS;EENSVPLFNGNKIFV-VPLFNGNKI;AVETLKNGIKLEGSL-LKNGIKLEG;VETLKNGIKLEGSLV-LKNGIKLEG;YLLVFALVLALIACS-LLVFALVLA;LLVFALVLALIACSQ-LLVFALVLA;QDGKVKIYLNDTTSG-VKIYLNDTT;KQYLLVFALVLALIA-LLVFALVLA;QYLLVFALVLALIAC-LLVFALVLA;SEVVKKQGSVIKESY-VKKQGSVIK;TGSEVVKKQGSVIKE-VKKQGSVIK;MKQYLLVFALVLALI-LLVFALVLA;TLKNGIKLEGSLVGG-LKNGIKLEG;KTGSEVVKKQGSVIK-VVKKQGSVI;LAEENSVPLFNGNKI-ENSVPLFNG;GSEVVKKQGSVIKES-VKKQGSVIK;AEENSVPLFNGNKIF-VPLFNGNKI;LKNGIKLEGSLVGGK-LKNGIKLEG;NGIKLEGSLVGGKTT-IKLEGSLVG;EVVKKQGSVIKESYK-VKKQGSVIK;KNGIKLEGSLVGGKT-IKLEGSLVG
DRB1_1501 IKLEGSLVGGKTTVK-IKLEGSLVG;KQYLLVFALVLALIA-LLVFALVLA;MKQYLLVFALVLALI-LLVFALVLA;QYLLVFALVLALIAC-LLVFALVLA;YLLVFALVLALIACS-LLVFALVLA;LLVFALVLALIACSQ-LLVFALVLA;
DRB3_0101
DRB4_0101
DRB5_0101

<CAF34027 outer surface protein VlsE;Protein;Borrelia afzelii PKo>
SEQ ID NO:173523-174053
Allele 8-mer
A0101
A0201 KLDELVSA;KISSAIFL;KIAAAIVL;ILKAIVEA;
A0202
KISSAIFL;KLDELVSA;KIAAAIVL;ILKAIVEA;LTALLVFI;ALGEKGAL;FINCKNNA;SAIFLTAL;FLTALLVF;AIFLTALL;AAGAVTAV;AVSGEQIL;GLVADTFF
A0203
ILKAIVEA;KLDELVSA;ALKDVKAA;FINCKNNA;ALGEKGAL;KISSAIFL;AAGAVTAV;KIAAAIVL;SISSTLKA;MIKAAEEA;SAIFLTAL;LTALLVFI;AAIVLRGV;GIKGIVDA;IAKAAGAV
A0204 ALGEKGAL;AAGAVTAV;KIAAAIVL;KLDELVSA;
A0206
KLDELVSA;KISSAIFL;SAIFLTAL;AAGAVTAV;KIAAAIVL;FIDVFNAF;FAGNANAA;AAIVLRGV;KAAGAVTA;FLTALLVF;FESISSTL;WLEEMIKA;KASVESAV;AIFLTALL;
A0211
KLDELVSA;KISSAIFL;WLEEMIKA;ALGEKGAL;KIAAAIVL;AIFLTALL;ALKDVKAA;ILKAIVEA;FLTALLVF;AKDGKFAV;AVSGEQIL;ALLVFINC;IFLTALLV;SISSTLKA;AAGAVTAV
A0212 KLDELVSA;ALGEKGAL;ALKDVKAA;WLEEMIKA;FLTALLVF;AKDGKFAV;AVSGEQIL
A0216
ALGEKGAL;KLDELVSA;KISSAIFL;AAGAVTAV;AIFLTALL;ILKAIVEA;WLEEMIKA;ALKDVKAA;KIAAAIVL;AVSGEQIL
A0219 KLDELVSA;KISSAIFL;AKDGKFAV
A0301 LVADTFFK;IVLRGVAK;LLVFINCK;VSGEQILK;ESISSTLK;TLKATKGK
A1101
LVADTFFK;SAANHGAK;SSTLKATK;IVLRGVAK;VSGEQILK;ESISSTLK;GAAADIAK;AAFKDEMK;SAVDEVSK;TFFKSDPK;GIVDAAGK;KAAEEAAK;IAAAIVLR;LLVFINCK;TLKATKGK

Fig. 41 continued

A2301 FYRSTINI;KWLEEMIK;GLVADTFF
A2402 FYRSTINI;TFLTALLV;
A2403 FYRSTINI
A2601
A2602 FIDVEKAF
A2902
A3001
TLKATKGK;AGKATGFK;TFFKSDPK;AFKDFMKK;KGTAKGTK;TVLRGVAK;LVADTFFK;KWLEEMIK
A3002
A3101 TAAATVLR;LVADTFFK
A3301 TAAATVLR
A6801
FSISSTLK;TAAATVLR;LVADTFFK;FANADAGK;LLVFINGK;SAVDFVSK;SAANHGAK;SSTLKATK
;TFFKSDPK;EGVKGLAK;AAFKELMK;DDKGAAFK;DFANGAGK
A6802 LTALLVFT;SATFLTAL;DSAANHGA;FKAFSGLV;NAAVGAAA
A6901 LTALLVFT
B0702 SATFLTAL
B0801
B0802
B1501 FLTALLVF;LIKLGNGF
B1801 FSISSTL
B2705
B3501 FIDVEKAF;SATFLTAL;FAGNANAA;NAAVGAAA
B3901 FSISSTL
B4001 FSISSTL
B4002
B4402
B4403
B4501 AEEAKNPL
B5101
B5301
B5401 FAGNANAA
B5701
B5801 KSDVKTYF

Allele 9-mer
A0101
A0201
FLTALLVFT;KLFAGNANA;KTSSATFLT;FINGKNNAV;ATFLTALLV;QTLKATVEA;FAGNANAAV;K
AAGAVTAV
A0202
FLTALLVFT;FINGKNNAV;TLKATVEAA;KAAGAVTAV;KLFAGNANA;FAGNANAAV;SSATFLTAL;S
ATFLTALL;KTSSATFLT;SVESAVDFV;KAAFFAAKV;GTKGTVEAA;ALKDVKAAA;GLVADTFFK;
A0203
FINGKNNAV;FLTALLVFT;TLKATVEAA;KAAGAVTAV;KLFAGNANA;ALKDVKAAA;GTAKGTKGT;N
LGNGFIDV;SVKTFYFST;SVKASVFSA;AAATVLRGV;TTKLGNGFT;FAGNANAAV;GTKGTVEAA;SA
TFLTALL;MTKAAFFAA;ATKGKLEFI;SVKGTAKGT;ATFLTALLV;KAAFFAAKV
A0204
FLTALLVFT;KAAGAVTAV;KAAFFAAKV;FINGKNNAV;FAGNANAAV;SVESAVDFV;KLFAGNANA
A0205
FAGNANAAV;FINGKNNAV;FLTALLVFT;KAAGAVTAV;NLGNGFIDV;ATFLTALLV;KAAFFAAKV;K
LFAGNANA;SVESAVDFV;SATFLTALL;AAATVLRGV;QILKATVEA;LVADTFFKS;KTSSATFLT;SS
ATFLTAL
A0211
FLTALLVFT;NLGNGFIDV;ATFLTALLV;KLFAGNANA;AVDFVSKWL;VAKDGKFAV;ALKDVKAAA;K
LDELVSAK;WLLEMIKAA;KAAGAVTAV;KAAFFAAKV;SVESAVDFV;FINGKNNAV;FAGNANAAV;IL
KATVEAA;QILKATVEA;GTAKGTKGT;GLVADTFFK;HALGKLSA;

Fig. 41 continued

A0212
FLTALLVFT;NLGNGFTDV;VAKDQKFAV;ALKDVKAAA;KLFAGNANA;FTNCKNNAV;FAGNANAAV;A
VDFVSKWL;ATFLTALLV;WLFFMTKAA;KLDELVSAK;GTAKGTKGT;KAAGAVTAV
A0216
NLGNGFTDV;FLTALLVFT;ATFLTALLV;ALKDVKAAA;KLFAGNANA;SVFSAVDFV;FAGNANAAV;V
AKDQKFAV;AVDFVSKWL;FTNCKNNAV;KAAGAVTAV;FMTKAAFFA;TLKATKGKL;QTLKATVFA;DT
AKAAGAV;WLFFMTKAA
A0219
FLTALLVFT;NLGNGFTDV;VAKDQKFAV;KAAGAVTAV;FAGNANAAV;FTNCKNNAV;SVFSAVDFV;A
TFLTALLV
A0301
GLVADTFFK;KLDELVSAK;KLAAAIVLR;ALGEKGALK;AVSGEQILK;ISSTLKATK;AAFKDEMKK;A
LLVFINCK
A1101
GLVADTFFK;AVSGEQILK;AAFKDEMKK;ALLVFINCK;STLKATKGK;ATVLRGVAF;KLAAAIVLR;D
TFFKSDPK;ISSTLKATK;KLDELVSAK;AAGKALGEK;ALGEKGALK;TFFKSDPKK;AVGKGNDDK;
A2301 IFLTALLVF;GFIDVFNAF;YFFSTSSTL;TFFKSDPKK;
A2402 IFLTALLVF;GFIDVFNAF;YFFSTSSTL
A2403 IFLTALLVF;GFIDVFNAF;YFFSTSSTL
A2601 CLLNLGNGF;EVSKWLEEM;DVFNAFSGL
A2602 EVSKWLEEM;DVFNAFSGL;CLLNLGNGF
A2902
A3001
STLKATKGK;AGKKAELAK;TFFKSDPKK;GLVADTFFK;ALLVFINCK;ANEGAKADK;AAFKDEMKK;D
TFFKSDPK;AAGKALGEK;AVSGEQILK
A3002
A3101 KLAAAIVLR;ISSTLKATK
A3301 DTFFKSDPK
A6801
DTFFKSDPK;ESAVDEVSK;DSAANEGAK;KLAAAIVLR;TFFKSDPKK;GLVADTFFK;ISSTLKATK;S
TLKATKGK;AAFKDEMKK;GAAFKDEMK
A6802
DVFNAFSGL;SATFLTALL;FTNCKNNAV;SSATFLTAL;DTAKAAGAV;DVKTYFFST;FLTALLVFT;L
VADTFFKS;FAGNANAAV;SVKTFYFST;FGGSVKASV;KAAGAVTAV;NANAAVGAA;AAATVLRGV;TS
SATFLTA
A6901
FAGNANAAV;FTNCKNNAV;FVSKWLFFM;DTAKAAGAV;DVFNAFSGL;NLGNGFTDV;QTLKATVFA
B0702 KAAGAVTAV;TVDAAGKAL
B0801
B0802
B1501 STLNLGNGF;GFTDVFNAF
B1801
B2705
B3501 FAGNANAAV;TAVSGEQIL;IFLTALLVF;TDDNGAAF;FSGLVADTF;GFIDVFNAF
B3901 YFFSTSSTL
B4001
B4002 EEAKNPIAA
B4402
B4403 EEAKNPIAA
B4501 EFAKNPIAA;AEFAKNPIA
B5101
B5301
B5401 KPIAAALGU
B5701
B5801 SAVDEVSKW

Fig. 41 continued

Allele 10-mer
A0101
A0201 KISSATFLTA;KLFAGNANAA;KTFYFSTINI
A0202 KLFAGNANAA;KTFYFSTINI;KISSATFLTA;SSATFLTALL;STINLGNGFT;TAAATVLRGV
A0203
SVKASVESAV;KISSATFLTA;KLFAGNANAA;TAAATVLRGV;GIAKGIKGIV;STINLGNGFT;ATKGK
LDFIV;SVKTFYFSTI;SATFLTALLV;KTYFSTSST;SAKKGRGGSV
A0204 KLFAGNANAA
A0206
KISSATFLTA;SATFLTALLV;KLFAGNANAA;ATVFAAGDPA;GVAKDGKFAV;AKAAGAVTAV;ASVES
AVDEV;QTLKATVFAA;STINLGNGFT;KTFYFSTINI;TAAATVLRGV;GLVARTFFKS
A0211
KLFAGNANAA;GVAKDGKFAV;GIAKGIKGIV;KLDFLVGAKK;KISSATFLTA;SATFLTALLV;DVFNA
FSGLV;SVKASVESAV;SAVDEVSKKL;TAAATVLRGV;LFAGNANAAV;STINLGNGFT;AVSGEQLLEA
;GIVDAAGKAL;FLTALLVFIN
A0212 KLFAGNANAA;GVAKDGKFAV;GIAKGIKGIV;LFAGNANAAV;KLDELVGAKK
A0216
KLFAGNANAA;GVAKDGKFAV;GIAKGIKGIV;SVKASVECAV;DVFNAFSGLV;LFAGNANAAV;
A0219 IAAAIVLRGV;LFAGNANAAV
A0301
KALGEKGALK;KLDELVGAKK;AAIVLRGVAK;VLRGVAKDGK;SISSTLKATK;KVGGTGGDGK;SVKGI
AKGIK;ADIFFKSDPK;TAVSGEQILK;VAKDGKFAVK;SSTLKATKGK;
A1101
TALLVFINGK;SISSTLKATK;AAIVLRGVAK;AVGAAADIAK;TAVSGEQILK;KALGEKGALK;SSTLK
ATKGK;SGLVADTFFK;SVKGIAKGIK;DTFFKSDPKK;VSKWLEEMK;KVGGTGGDGK;KLDELVGAKK
;GAAFKDFMKK;MLKAAFEAAK;AANEGAKADK;VAKDGKFAVK
A2301 TYFESISSTL;IFLTALLVFI;AFSGLVADTF;ALFLTALLVF;FSGLVADTFF
A2402 IFLTALLVFI;TYFESISSTL;AFSGLVADTF
A2403 TYFESISSTL;AFSGLVADTF;IFLTALLVFI
A2601 ESTINLGNGF;STINLGNGFT
A2602 ESTINLGNGF;GTDDDNGAAF;ALFLTALLVF;EVSKWLEEMI
A2902
A3001
SGLVADTFFK;SVKGIAKGIK;KALGEKGALK;MLKAAFEAAK;AATVLRGVAK;VAKDGKFAVK;VLRGV
AKDGK;AVGAAADIAK;AANEGAKADK;SSTLKATKGK;KVGGTGGDGK;
A3002
A3101 AATVLRGVAK;
A3301
A6601
DTFFKSDPKK;TAVSGEQILK;MLKAAFEAAK;DAAGKAIGER;TALLVFINGK;DKTAAATVLR;YFFST
SSTLK;SISSTLKATK;SVKGIAKGIK;NGAAFKDFMK;GAAFKDFMKK;SSTLKATKGK;
A6802
DVFNAFSGLV;TAAATVLRGV;SSATFLTALL;SATFLTALLV;FAAGDPANQA;DSVKTFYFST;EVSKW
LEEMI;EAKNPTAAAT;SVKASVESAV;TSSATFLTAL;NANAAVGAAA;EGAKADKDSV;STINLGNGFT
A6901 DVFNAFSGLV;EVSKWLEEMI;FAAGDPANQA;SATFLTALLV
B0702
B0801
B0802
B1501 ALFLTALLVF
B1801
B2705
B3501 EANADAGKLF;DFKKSDVKIY;NGFLDVFNAF;FSGLVADTFF;NANAAVGAAA
B3901
B4001
B4002
B4402

Fig. 41 continued

```
B4403
B4501 AFFAKNPTAA;FFMIKAAFFA;AFFAAKVGGT;FFAKNPTAAA
B5101
B5301
B5401
B5701 FSAVDFVSKW
B5801 FSAVDFVSKW;TSSATFLTAL
```

Allele 11-mer
```
A0101
A0201 KIFAGNANAAV;FIDVFNAFSGL;KTSSATFLTAL;KTAAATVLRGV;ATFLTALLVFI;
A0202
KTSSATFLTAL;KIFAGNANAAV;FIDVFNAFSGL;KTAAATVLRGV;LLVFINCKNNA;FLTALLVFINC
;ISSAIFLTALL;MIKAAEEAAKV;KTYFESISSTL;LVFINCKNNAV;AIFLTALLVFI;KIGDSAANEG
A;XASVESAVDEV;ALGEKGALKDV;AVSGEQTLKAT
A0203
KLAAAIVLRGV;KLFAGNANAAV;MIKAAEEAAKV;ALGEKGALKDV;KISSAIFLTAL;FIDVFNAFSGL
;LAKAAGAVIAV;LLVFINCKNNA;LINLGNGFIDV;KTYFESISSTL;LVFINCKNNAV;FLTALLVFIN
C;KIGDSAANHGA;AAALIAKAAGA
A0204 KLFAGNANAAV;KLAAAIVLRGV;ALGEKGALKDV
A0206
KLFAGNANAAV;FIDVFNAFSGL;KISSAIFLTAL;KLAAAIVLRGV;FAGNANAAVGA;KIGDSAANEGA
;KTYFESISSTL;FLTALLVFINC;XASVESAVDEV;LVFINCKNNAV;KKISSAIFLTA;AIFLTALLVF
I;SSAIFLTALLV;ALGEKGALKDV
A0211
KLFAGNANAAV;ALGEKGALKDV;KLAAAIVLRGV;FIDVFNAFSGL;KISSAIFLTAL;AIFLTALLVFI
;FLTALLVFINC;LINLGNGFIDV;KIGDSAANEGA;KATKGKLDELV;LVFINCKNNAV;MIKAAEEAAK
V;SSAIFLTALLV;AVSGEQILKAI;AVTAVSGEQIL;KTYFESISSTL
A0212
KLFAGNANAAV;ALGEKGALKDV;FIDVFNAFSGL;KLAAAIVLRGV;FLTALLVFINC;MIKAAEEAAKV
;LVFINCKNNAV;KISSAIFLTAL;LINLGNGFIDV
A0216
KLFAGNANAAV;ALGEKGALKDV;MIKAAEEAAKV;FIDVFNAFSGL;KTSSATFLTAL;KTAAATVLRGV
;ATFLTALLVFI;LVFINCKNNAV;LINLGNGFIDV;KIGDSAANEGA;KATKGKLDELV;LLVFINCKNN
A
A0219 KIFAGNANAAV;FIDVFNAFSGL;KTAAATVLRGV;KTSSATFLTAL;ALGEKGALKDV
A0301
FSGLVADTFFK;VTAVSGEQTLK;GVAKDGKFAVK;FINCKNNAVGK;TYFESISSTLK;LTALLVFINCK
A1101
LTALLVFINCK;VTAVSGEQTLK;SVFSAVDFVSK;GTDDRKGAAFK;FSGLVADTFFK;TYFESISSTLK
;AAATVLRGVAK;GVAKDGKFAVK;SAANHGAKADK;VADTFFKSDFK;AAVGAAADTAK;TVLRGVAKDG
K;AAGDPANQAGK;ESTSSTLKATK;TSSTLKATKGK;FINCKNNAVGK;FVSKWLFFMTK;GTKGTVDAA
GK
A2301 TYFESISSTLK;AFSGLVADTFF;SATFLTALLVF
A2402 AFSGLVADTFF
A2403 AFSGLVADTFF
A2601
A2602 KTSSATFLTAL;FIDVFNAFSGL
A2902
A3001 KGKLDELVSAK;TYFESISSTLK;SAKKGFGGSVK;AFKDFMKKSDK;TVLRGVAKDGK
A3002 AFSGLVADTFF
A3101 TYFESISSTLK
A3301
A6801
ESISSTLKATK;LTALLVFINCK;FVSKWLFFMTK;TYFESISSTLK;FSGLVADTFFK;EMIKAAEEAAK
```

Fig. 41 continued

;FTNCKNNAVGK;VTAVSGEQILK;SVRSAVDFVSK;DSVKGTAKGTK;SAANHGAKADK;NGAAFKDFMK
K;TSSTLKATKGK
A6802
RSTTNLGNGFT;TSSATFLTALL;SSATFLTALLV;LVFTNCKNNAV;FTDVFNAFSGL;KTAAATVLRGV
;RSAVDFVSKWL;RRAKNPTAAAT;TAAATVLRGVA;DVFNAFSGLVA;NTKAAFRAAKV
A6901 LVFTNCKNNAV;FTDVFNAFSGL;
B0702
B0801
B0802
B1501 VLRGVAKDGKF;KLFAGNANAAV
B1801 YFSTTNLGNGF;RRANADAGKLF
B2705
B3501 NAFSGLVADTF;SATFLTALLVF;FGTDRDNGAAF;DFKKSDVKTYF
B3901
B4001 YFSTTNLGNGF
B4002 RRAKNPTAAAT
B4402
B4403 RRAKNPTAAAT
B4501 REMIKAAFEAA;ALEAKNPIAAA;EEAKNPIAAAI
B5101
B5301
B5401
B5701
B5801 SAIFLTALLVF;KTFFLSISSTL;KSDKTAAAIVL;ISSAIFLTALL

Allele 15-mer plus 9-mer core
DRB1_0101
GKLFAGNANAAVGAA FAGNANAAV;AGKLFAGNANAAVGA FAGNANAAV;ADTAKAAGAVTAVSG
LAKAAGAVT;AADLAKAAGAVTAVS LAKAAGAVT;GAAADLAKAAGAVTA
LAKAAGAVT;AAADLAKAAGAVTAV LAKAAGAVT;DAGKLFAGNANAAVG
FAGNANAAV;ADAGKLFAGNANAAV LFAGNANAA;KLFAGNANAAVGAAA
FAGNANAAV;KSDKTAAATVLRGVA-TAAATVLRG;SDKTAAATVLRGVAK-
TAAATVLRG;RKSDKTAAATVLRGV-TAAATVLRG;DKTAAATVLRGVAKD-
TAAATVLRG;KKKSDKTAAATVLRG-DKTAAATVL;TDVFNAFSGLVADTF-
VFNAFSGLV;DTAKAAGAVTAVSGE-AKAAGAVTA;FTDVFNAFSGLVADT-
VFNAFSGLV;NGFTDVFNAFSGLVA-VFNAFSGLV;GFTDVFNAFSGLVAD-
VFNAFSGLV;LFAGNANAAVGAAAD-FAGNANAAV;TSSATFLTALLVFTN-
FLTALLVFT;SSATFLTALLVFTNC-FLTALLVFT;KTSSATFLTALLVFT-
ATFLTALLV;SATFLTALLVFTNCK-FLTALLVFT;ATFLTALLVFTNCKN-
FLTALLVFT;TAKAAGAVTAVSGEQ-TAKAAGAVT;VGAAADTAKAAGAVT-
DTAKAAGAV;DVFNAFSGLVADTFF-FNAFSGLVA;GNGFTDVFNAFSGLV-
FTDVFNAFS;FAGNANAAVGAAADT-FAGNANAAV;KTAAATVLRGVAKDG-
TAAATVLRG;TAAATVLRGVAKDGK-TAAATVLRG;VFNAFSGLVADTFFK-
VFNAFSGLV;AKAAGAVTAVSGEQT-AKAAGAVTA;NADAGKLFAGNANAA-
AGKLFAGNA;TYFFSTSSTLKATKG-FFSTSSTLK;KTYFFSTSSTLKATK-
FFSTSSTLK;VKTYFFSTSSTLKAT-FFSTSSTLK;DVKTYFFSTSSTLKA-
FFSISSTLK;SDVKTYFFSISSTLK YFFSISSTL;KGTVDAAGKALGEKG
TVDAAGKAL;KGTKGTVDAAGKALG-TVDAAGKAL;TFLTALLVFTNCKNN-
FLTALLVFT;IKGTVDAAGKALGEK IVDAAGKAL;GTKGTVDAAGKALGE
TVDAAGKAL;AKGTKGTVDAAGKAL-TKGTVDAAG;FLTALLVFTNCKNNA-
FLTALLVFT;KKKISSAIFLTALLV KKKISSAIF;FNAFSGLVADTFFKS
FNAFSGLVA;GKIGDSAANHGAKAD IGDSAANHG;DGKIGDSAANHGAKA
IGDSAANHG;GDGKIGDSAANHGAK IGDSAANHG;KAAGAVTAVSGEQIL
VTAVSGEQI;GGDGKIGDSAANHGA IGDSAANHG;GNANAAVGAAADLAK
AVGAAADLA;YFFSISSTLKATKGK FFSISSTLK;AGAVTAVSGEQILKA
VTAVSGEQI;ANAAVGAAADLAKAA AVGAAADLA;AAGAVTAVSGEQILK VTAVSGFQT;TGGDGKTGFSAANHG-GKTGFSAAN;FFAKNPTAAATGTDD-
AKNPTAAAT;FFSTSSTLKATKGKL-FFSTSSTLK;NANAAVGAAADTAKA-
AVGAAADTA;GTVDAAGKALGFKQA-TVDAAGKAL;GAVTAVSGFQTLKAT-
VTAVSGFQT;NAAVGAAADTAKAAG-AVGAAADTA;FQTLKATVFAAGDPA-
LKATVFAAG;VSGFQTLKATVFAAG-TLKATVFAA;KKTSSATFLTALLVF-
TSSATFLTA;TVDAAGKALGFKQAL-TVDAAGKAL;SGFQTLKATVFAAGD-
LKATVFAAG;TAKGTKGTVDAAGKA-TKGTVDAAG;GFQTLKATVFAAGDP-
LKATVFAAG;AAAIVLRGVAKDGKF-VLRGVAKDG;LKATVFAAGDPANQA-
LKATVFAAG;KGTAKGTKGTVDAAG-TAKGTKGTV;GTAKGTKGTVDAAGK-
TKGTVDAAG;FAKNPTAAATGTDDD-TAAATGTDD;AFFAKNPTAAATGTD-
AKNPTAAAT;KAFFAKNPTAAATGT-AKNPTAAAT;AATVLRGVAKDGKFA-
VLRGVAKDG;AGKAHAAVGAAADTA ANAAVGAAA;KATVFAAGDPANQAG AAGDPANQA DRB1_0301
DRB1_0401 DSVKIFYESIINLGN FYESIINLG;SVKIFYESIINLGNG
FYESIINLG;KTFYESIINLGNGFI-FYESIINLG;VKIFYESIINLGNGF-
FYESIINLG;KDSVKIFYESIINLG KIFYESIIN;TFYESIINLGNGFID
FYESIINLG;FYESIINLGNGFIDV FYESIINLG;KIFFESISSTLKAIK
FESISSTLK;DVKIFFESISSTLKA FESISSTLK;VKIFFESISSTLKAT
FESISSTLK;SDVKIFFESISSTLK FFESISSTL;TVFFESISSTLKATKG FESISSTLK DRB1_0404
NGFIDVFNAFSGLVA VFNAFSGLV;GNGFIDVFNAFSGLV FIDVFNAFS;GFIDVFNAFSGLVAD
VFNAFSGLV;FIDVFNAFSGLVADT VFNAFSGLV;IDVFNAFSGLVADTF
VFNAFSGLV;DVFNAFSGLVADTFF VFNAFSGLV;VFNAFSGLVADTFFK VFNAFSGLV DRB1_0405
LVADTFFKSDPKKSD DTFFKSDPK;VADTFFKSDPKKSDV FKSDPKKSD;DSVKIFYESIINLGN
VKIFYESII;ADTFFKSDPKKSDVK FKSDPKKSD;DTFFKSDPKKSDVKI
FKSDPKKSD;NGFIDVFNAFSGLVA FIDVFNAFS;SVKIFYESIINLGNG
YESIINLGN;VKIFYESIINLGNGF YESIINLGN;TFFKSDPKKSDVKIY
FKSDPKKSD;KTFYESIINLGNGFI YESIINLGN;TFYESIINLGNGFID
YESIINLGN;GFIDVFNAFSGLVAD FNAFSGLVA;FIDVFNAFSGLVADT
FNAFSGLVA;IDVFNAFSGLVADTF FNAFSGLVA;FKSDPKKSDVKIYFE FKSDPKKSD DRB1_0701
KTYFFSTSSTLKATK-YFFSTSSTL;VKTYFFSTSSTLKAT-YFFSTSSTL;DVKTYFFSTSSTLKA-
YFFSTSSTL;KSDVKTYFFSTSSTL-KSDVKTYF;SDVKTYFFSTSSTLK-
YFFSTSSTL;IDVFNAFSGLVADTF-VFNAFSGLV;TYFFSTSSTLKATKG-
YFFSTSSTL;LVFTNGKNNAVGKGN-FTNGKNNAV;TALLVFTNGKNNAVG-
FTNGKNNAV;NGFIDVFNAFSGLVA-VFNAFSGLV;ALLVFTNGKNNAVGK-
FTNGKNNAV;LLVFTNGKNNAVGKG-FTNGKNNAV;GFIDVFNAFSGLVAD-VFNAFSGLV DRB1_0802
LVADTFFKSDPKKSD-FFKSDPKKS;VADTFFKSDPKKSDV-FFKSDPKKS;DTFFKSDPKKSDVKT-
FFKSDPKKS;ADTFFKSDPKKSDVK-FFKSDPKKS;GLVADTFFKSDPKKS-DTFFKSDPK DRB1_0901
KTYFFSTSSTLKATK-YFFSTSSTL;AAADTAKAAGAVTAV-TAKAAGAVT;GAAADTAKAAGAVTA-
TAKAAGAVT;VKTYFFSTSSTLKAT-YFFSTSSTL;AADTAKAAGAVTAVS-
TAKAAGAVT;DVKTYFFSTSSTLKA-YFFSTSSTL;KTFYESIINLGNGFT-
FYESIINLG DRB1_1101 DRB1_1302
TFYESIINLGNGFID-IINLGNGFI;FYESIINLGNGFIDV-IINLGNGFI;LLVFTNGKNNAVGKG-
VFTNGKNNA;YESIINLGNGFIDVF IINLGNGFI;ESIINLGNGFIDVFN
IINLGNGFI;KTFYESIINLGNGFI-FYESIINLG;LVFTNGKNNAVGKGN-
GKNNAVGKG;VFTNGKNNAVGKGNG GKNNAVGKG;ALLVFTNGKNNAVGK
VFTNGKNNA;SIINLGNGFIDVFNA-IINLGNGFI;TALLVFTNGKNNAVG-
VFTNGKNNA;LTALLVFTNGKNNAV VFTNGKNNA DRB1_1501
IAAAIVLRGVAKDGK AIVLRGVAK;AAAIVLRGVAKDGKF LRGVAKDGK;GFIDVFNAFSGLVAD
VFNAFSGLV;NGFIDVFNAFSGLVA VFNAFSGLV;AIVLRGVAKDGKFAV
LRGVAKDGK;AAIVLRGVAKDGKFA LRGVAKDGK;IDVFNAFSGLVADTF
VFNAFSGLV;FIDVFNAFSGLVADT VFNAFSGLV

Fig. 41 continued

DRB3_0101
DRB4_0101
DRB5_0101

<ABX71745;CRASP-2;Protein;Borrelia burgdorferi>
SEQ ID NO:171150-171695
Allele 8-mer
A0101 YSEYTGAY
A0201 YMLISISL;KLIDDFAI;FLSIYMLI;MLISISLL;FLGAAVEL;SIYMLISI
A0202
FLSIYMLI;MLISISLL;FLGAAVEL;KLIDDFAI;YMLISISL;KLRKSVAL;FVEENDLI;ALAYIESF
;SIYMLISI;FAIELDQA;KAIKQTLL;LIALKCIV;KVNQAISI
A0203
FLSIYMLI;MLISISLL;FLGAAVEL;YMLISISL;KLIDDFAI;SIYMLISI;KLRKSVAL;LIALKCIV
;KVNQAISI;ALKCIVKT;MKKSFLSI
A0204 FLGAAVEL;KLIDDFAI;YMLISISL;FLSIYMLI;MLISISLL
A0206
KLIDDFAI;YMLISISL;FLGAAVEL;MLISISLL;FAIELDQA;FLSIYMLI;KVNQAISI;FVEENDLI
;AAVELGA;KAIKQTLL;KSVALAYI;SIYMLISI;KEADFLGA;YSIKLDAI;YIESFDVI
A0211
KLIDDFAI;YMLISISL;FLGAAVEL;MLISISLL;FLSIYMLI;SIYMLISI;KLRKSVAL;ELEGAYKA
;LIALKCIV;KLDAIYSE;AIELDQAV;KFVDSKFV;PMFLSKLI;KVNQAISI;SFLSIYML;DLIALKC
I;YIESFDVI;DVISSKFV
A0212
YMLISISL;FLGAAVEL;KLIDDFAI;FLSIYMLI;MLISISLL;SIYMLISI;KLRKSVAL;AIELDQAV
;LIALKCIV
A0216
FLGAAVEL;MLISISLL;YMLISISL;FLSIYMLI;KLIDDFAI;LIALKCIV;KLRKSVAL;SIYMLISI
;ELEGAYKA;AIELDQAV;DVISSKFV;KFVDSKFV;DVSNARSV
A0219 FLGAAVEL;YMLISISL;MLISISLL;FLSIYMLI;KLIDDFAI
A0301 KIFVEKAK;IMTYIMTY;KAKYYSIK;HVADSYEK;IALKCIVK;RSRYNNFY;ASKKFVNK;
A1101
HVADSYEK;ASKKFVNK;SSKFVDSK;SILKKDNK;QAISILKK;GTSSDKSK;KIFVEKAK;NQAISILK
;IALKCIVK;SRYNNFYK;KAKYYSIK;RYNNFYKK;DSYEKLRK
A2301 FYKKEADF;RYNNFYKK;SFLSIYML;KFVEASKK
A2402 SFLSIYML;FYKKEADF;AYIESFDV
A2403 FYKKEADF;SFLSIYML;AYIESFDV;FVNKAKEF
A2601 EINSRSRY;
A2602 EINSRSRY;SIKLDAIY;FVEKAKYY;AVELEGAY;DVISSKFV;YSEYTGAY;NIDELKIF
A2902 IMTYIMTY;AYNDIMTY;IFVEKAKY;YSEYTGAY;FVEKAKYY
A3001
KAKYYSIK;RYNNFYKK;RSRYNNFY;ASKKFVNK;KIFVEKAK;SSKFVDSK;KFVEASKK;KKFVNKAK
;KLRKSVAL;KSKVNQAI
A3002 AYNDIMTY;IMTYIMTY;RSRYNNFY
A3101 RYNNFYKK;KAKYYSIK;ASKKFVNK;MTYIMTYS;REINSRSR
A3301 DVSRLNQR
A6801
HVADSYEK;DVSRLNQR;QAISILKK;ELKIFVEK;SSKFVDSK;DSYEKLRK;MTYIMTYS;LLSCDVSR
;EGAYKAIK;NQAISILK;EINSRSRY;SRYNNFYK
A6802
DVISSKFV;MLISISLL;EKAKYYSI;MTYIMTYS;ESFDVISS;TSSDKSKV;FLSIYMLI;YSIKLDAI
A6901 DVISSKFV;YMLISISL;EADFLGAA
B0702 KPMFLSKL;KLRKSVAL
B0801 KLRKSVAL
B0802
B1501 YSEYTGAY;IMTYIMTY;RSRYNNFY;YMLISISL;ALAYIESF

```
B1801  FFYRPMFI;FENDLTAI
B2702  SRYNNFYK
B3501  YSRYTGAY;FVNKAKEF;AVELEQAY;FVEKAKYY;
B3901  YKAIKQTL;YMLTSTSL
B4001  FFYRPMFI;FENDLTAI
B4002  FFYRPMFI;FENDLTAI
B4402
B4403  FENDLTAI
B4501  FENDLTAI
B5101
B5301
B5401  FAIELEQA
B5701
B5801  KSFLSIYM;RSVALAYI;KAIKQTLL
```

Allele 9-mer
A0101  KLDAIYSEY;YSIKLDAIY
A0201
YMLTSTSLL;LIDDFAIEL;YLKTYSEGT;LLSCDVSRL;FVDSKFVEA;NIDELKIFV;FVNKAKEFV;FLSIYMLIS;FAIELDQAV;MLISISLLS;AIYSEYTGA
A0202
LLSCDVSRL;YMLISISLL;FVNKAKEFV;HVADSYEKL;FAIELDQAV;MLISISLLS;AIYSEYTGA;FLSIYMLIS;FLSKLIDDF;FVDSKFVEA;IMTYLKTYS;LIDDFAIEL;YIMTYSEGI;KVNQAISIL;AYNDIMTYI;FLGAAVELE;KLRKSVALA;KSFLSIYM;YKAIKQTLL
A0203
LLSCDVSRL;KLRKSVALA;ALKCIVKII;AIYSEYTGA;YMLISISLL;FVNKAKEFV;KVNQAISIL;SISLLSCDV;FLSIYMLIS;YIMTYSEGI;AYNDIMTYI;FAIELDQAV;IMTYLKTYS;MLISISLLS;FVDSKFVEA;LVKTIGDMV;ILKKDNKIV
A0204  FAIELEQAV;LIDDFAIEL;YMLISISLL
A0205
FAIELDQAV;FVDSKFVEA;FVNKAKEFV;YIMTYSEGI;LIDDFAIEL;YMLISISLL;AIYSEYTGA;NIDELKIFV;KLIDDFATE;KFADFLGAA;LSIYMLTST;KTVYKFEEL
A0211
LIDDFATEL;NIDELKIFV;YMLTSTSLL;DLTALKCTV;FVNKAKEFV;FAIELDQAV;LLSCDVSRL;KLDAIYSEY;STSLLSCDV;FVDSKFVEA;TLKKDNKIV;HVADSYEKL;FVEASKKFV;MLISISLLS;KLRKSVALA;FLRQAYKAT;FLSIYMLTS;ALKCIVKTI;FADFLQAAV;SFLSIYMLT
A0212
LIDDFATEL;NIDELKIFV;FAIELDQAV;YMLTSTSLL;FVNKAKEFV;DLTALKCTV;STSLLSCDV;YIMTYSEGI;AIYSEYTGA;FVDSKFVEA;TLKKDNKIV;FLSIYMLTS;LLSCDVSRL;LAYTESFDV
A0216
NIDELKIFV;LIDDFATEL;FVNKAKEFV;DLTALKCTV;YMLTSTSLL;LLSCDVSRL;FVEASKKFV;TLKKDNKIV;FAIELDQAV;STSLLSCDV;HVADSYEKL;KLRKSVALA;FVDSKFVEA
A0219  LIDDFATEL;YMLTSTSLL;NIDELKIFV;FVNKAKEFV;LLSCDVSRL;HVADSYEKL
A0301  RSRYNNFYK;ESFDVTSSK;TTALKCTVK;NQATSTLKK;KLDAIYSEY
A1101
ESFDVTSSK;RSRYNNFYK;TSSKFVDSK;AVELEQAYK;TSTLKKDNK;VNQATSTLK;NQATSTLKK;LTALKCIVK;GAYNDIMTY;SRYNNFYKK;EASKKFVNK;SLLSCDVSR
A2301
IYMLISISL;KFVEASKKF;FYKKEADFL;LKPMFLSE;NFYKKEADF;SFDVISSKF;AYLESFDVL;YTGAYNDI;KFVNKAKEF;AYNDIMTYI;AYKAIKQTL;SFLSIYMLT;DFLGAAVEL;KSFLSIYMI;FLSKLIDDF
A2402
IYMLISISL;SFLSIYMLI;AYLESFDVI;YYSIKLDAI;EYTGAYNDI;AYNDIMTYI;SFDVISSKF;FYKKEADFL;AYKAIKQTL;
```

Fig. 41 continued

A2403
FYKKEADFL;YYSIKLDAT;KFVNKAKFF;AYTFSFDVT;AYKAIKQTL;TYMLTSTSL;KFVEASKKF;A
YNDIMTYI;SFLSTYMLT;NFYKKEADF;SFDVTSSKF;FYTGAYNDI
A2601 YSIKLDATY;DIMTYIMTY;ELEKIIFEY
A2602
DIMTYIMTY;RIIFFYKPM;YSIKLDATY;YTGAYNDIM;ELEKIIFEY;KIFVEKAKY;HVADSYEKI;K
VNQAISIL;KFVNKFKEL
A2902 YSIKLDATY;IYSFYTGAY;KIFVEKAKY
A3001 RSRYNNFYK;KLRKSVALA;FYKPMFLSK
A3002 KIFVEKAKY;AYNDIMTYI
A3101 RSRYNNFYK;SLLSCDVSR;MIYIMTYSF;KSFLSTYML
A3301 DSKFVEASK;LSFDVISSK;FYKPMFLSK
A6801
LSFDVISSK;DSKFVEASK;MIYIMTYSF;EASKKFVNR;ISCKFVESK;TLGDKVNDR;DIMTYIKIY;R
SRYNNFYK;FKKELIALK;YSFCTSSDK;SLLSCDVSR;TSTLKKDNK;EKAKYYSIK;FYKPMFLSK
A6802
HVADSYEKI;FAIELDQAV;FVNKAKEFV;EADFLGAAV;LSIYMLISI;DVSNABHVA;YIMIYSEGT
A6901
EADFLGAAV;NIDELKIFV;FAIELDQAV;FVNKAKEFV;HVADSYEKL;LIDDFAIEL;FVDSKFVEA
B0702 KPMFLSKII;KVNQAISIL
B0801 YEKLRKSVA
B0802
B1501 YSIKLDAIY;AAVELEGAY;YMLISISLL;GAYNDIMTY
B1801 VEENDLIAL;REINSRSRY;VELEGAYKA
B2705 SRYNFYKK
B3501
AAVELEGAY;FAIELDQAV;YSIKLDAIY;DIMIYIMTY;IYSFYTGAY;NARHVADSY;GAYNDIMTY;Y
TGAYNDIM;VALAYIESF
B3901 YNDIMTYIM
B4001 KEFVEENDI;VEENDLIAL;IEEYKPMEL
B4002 KEFVEENDL
B4402
B4403
B4501 REINSRSRY
B5101 KPMFLSKII
B5301
B5401 FAIELDQAV
B5701
B5801 VALAYIESF;YSIKLDATY

Allele 10-mer
A0101
A0201
FLSIYMLIST;KLIDDFATEL;FLSKIIDDFA;ALAYIESFDV;SLLSCDVSRL;KLDAIYSFYT;SIYML
ISISL;YMLISISLLS;RLNQRNIDEL;MLISISLLSC;GAYNDIMTYI
A0202
FLSIYMLISI;SLLSCDVSRL;FLSKLIDDFA;KLIDDFAIEL;KLDAIYSFYT;GAYNDIMTYI;SIYML
ISISL;ALAYIESFDV;MLISISLLSC;RLNQRNIDEL;KSFLSTYMLT;FVEENDLIAL;TYMLTSTSLL
;FLGAAVELEG;YMLISISLLS;KYYSIKLDAI
A0203
FLSIYMLISI;KLIDDFAIEL;FLSKLIDDFA;ALAYIESFDV;RLNQRNIDEL;SIYMLISISL;GAYND
IMTYI;MLISISLLSC;SLLSCDVSRL;CIVKTIGDMV;
A0204 KLIDDFAIEL;SLLSCDVSRL;ALAYIESFDV;RLNQRNIDEL;FLSIYMLISI
A0205
KLIDDFAIEL;FLSIYMLISI;FVEENDLIAL;ALAYIESFDV;MLISISLLSC;FLSKLIDDFA;GAYND
IMTYI;FVEKAKYISI;KEADFLGAAV;SIYMLISISL;KLDAIYSFYT;CIVKTIGDMV;RLNQRNIDEL

Fig. 41 continued

A0201
KLTDDFATEL;FLSTYMLTST;SLLSCDVSRL;STYMLTSTSL;ALAYTESFDV;ELDQAVDNDV;RLNQR
NIDEL;KLDATYSFYT;FLSKLTDDFA;MLTSTSLLSC;FVEENDLTAL;STLKKDNKIV;TTFEYKPMFL
;YMLTSTSLLS;SFDVTSSKFV;KEADFLGAAV;GAYNDIRTYI
A0212
KLTDDFATEL;FLSTYMLTST;ALAYTESFDV;ELDQAVDNDV;STYMLTSTSL;FLSKLTDDFA;RLNQR
NIDEL;FVEENDLTAL;SLLSCDVSRL;MLTSTSLLSC;STLKKDNKIV;KLDATYSFYT;TTFEYKPMFL
A0215
KLTDDFATEL;SLLSCDVSRL;FLSTYMLTST;ALAYTESFDV;RLNQRNIDEL;STYMLTSTSL;ELDQA
VDNDV;FLSKLTDDFA;TTFEYKPMFL;KLDATYSFYT;STLKKDNKIV;CIVNTTGDMV;FVEKAKYYST
;GAYKAIKQTL;MLTSTSLLSC;FVEENDLTAL;
A0219
ELDQAVDNDV;KLTDDFATEL;SLLSCDVSRL;FLSTYMLTST;RLNQRNIDEL;FLSKLTDDFA;ALAYT
ESFDV
A0301
KVNQAISLLK;RSRYNNFYKK;IVNKFKELEK;KLRKSVALAY;DLTALKCIVK;ALYSFYTGAY;AAVEL
EGAYK;VISSKFVDSK;AISILKKDNK
A1101
KVNQAISLLK;IVNKFKELEK;VISSKFVDSK;RSRYNNFYKK;AAVELEGAYK;KVNDREINSR;AISLL
KKDNK;ALYSFYTGAY;ASKKFVNKAK;KTIGDMVNDR;VADSYEKLRK;VNQAISLLKK;AVDKDVSNAR
A2301
IYMLISISLL;KFLSKLIDDF;TYSRGTSSDK;EYKPMFLSKL;KYYSIKLDAL;AYKAIKQTLL;ESFDV
ISSKF;ISSKFVDSKF;AYNDIRTYIM;SVALAYIESF
A2402 IYMLISISLL;KYYSIKLDAL;EYKPMFLSKL;AYKAIKQTLL
A2403
KFLSKLIDDF;KYYSIKLDAL;IYMLISISLL;AYKAIKQTLL;EYKPMFLSKL;AYNDIRTYIM;YYSIK
LDAIY
A2601 ESFDVISSKF;
A2602 KLEEYKPMF;ALYSFYTGAY;KIFVEKAKYY;SVALAYIESF;FVEENDLTAL
A2902 YYSIKLDAIY;ALYSFYTGAY;KIFVEKAKYY
A3001
RSRYNNFYKK;KVNQAISLLK;ASKKFVNKAK;KLRKSVALAY;IVNKFKELEK;ARHVADSYEK;KDNKI
VNKFK;KSFLSTYMLT
A3002 KIFVEKAKYY;NSRSRYNNFY
A3101
KTIGDMVNDR;RSRYNNFYKK;TSLLSCDVSR;MVNDREINSR;KVNQAISLLK;ASKKFVNKAK;AVDND
VSNAR
A3301
A6801
HVADSYEKLR;MVNDREINSR;DSKFVEASKK;ELEKTIEFYK;KTIGDMVNDR;IVNKFKELEK;KVNQA
ISLLK;TSLLSCDVSR;DLTALKCTVK;ELKTFVEKAK;EEYKPMFLSK;TYSRGTSSDK;FSFDVTSSKF
;RLFGAYKAIK
A6802 FVEKAKYYST;STYMLTSTSL;EASKKFVNKA;DIMTYINTYS
A6901
B0702
B0801 YEKLRKSVAL
B0802
B1501 KLRKSVALAY;SVALAYIESF;ALYSFYTGAY;KIIEEYKPMF;KIFVEKAKYY
B1801 VELEGAYKAI;KELEKIIEEY
B2705
B3501 FVEENDLTAL;TGAYNDIRTY;GAAVELEGAY;YYSIKLDAIY;SVALAYIESF
B3901 FVEENDLTAL
B4001 SFYTGAYNDI;KEFVEENDLT;VELEGAYKAI;YEKLRKSVAL
B4002 KEFVEENDLT
B4402 KELEKIIEEY
B4403

Fig. 41 continued

B4501 FFNDLTALKC
B5101 LAYIESFDVT
B5301
B5401
B5701
B5801 TSSKFVDSKF;KIIEEYKPMF;

Allele 11-mer
A0101 YTCAYNDIMTY;YNDIMTYIMTY;VSNARHVADSY
A0201
FLSKLIDDFAI;FLGAAVLEGA;KLRKSVALAYI;ALAYIESFDVT;KIIEEYKPMFL;VALAYIESFDV
;SIYMLISISLL;YMLISISLLSC;FLSIYMLISIS
A0202
FLSKLIDDFAI;FLGAAVLEGA;ALAYIESFDVI;FLSIYMLISIS;SIYMLISISLL;KLRKSVALAYI
;KIIEEYKPMFL;QAYKATKQTLL
A0203
FLGAAVLEGA;KLRKSVALAYI;FLSKLIDDFAI;SIYMLISISLL;ALAYIESFDVI;KIIEEYKPMFL
;LISISLLSCDV;FLSIYMLISIS;LLALKCIVATI;MTYIRTYSEGT;YMLISISLLSC
A0204 FLGAAVLEGA;KIIEEYKPMFL;VALAYIESFDV
A0206
FLSKLIDDFAI;FLGAAVLEGA;KIIEEYKPMFL;ALAYIESFDVI;VALAYIESFDV;YIMTYSEGUSS
;LSIYMLISISL;YMLISISLLSC;LISISLLSCDV
A0211
FLSKLIDDFAI;SIYMLISISLL;FLGAAVLEGA;YMLISISLLSC;KLRKSVALAYI;KIIEEYKPMFL
;ALAYIESFDVI;ESFDVTSSKFV;LIDDFAIELDQ;LISISLLSCDV;VALAYIESFDV;KLDAIYSFYT
G;LLGDKVNDREI
A0212
FLSKLIDDFAI;FLGAAVLEGA;VALAYIESFDV;YMLISISLLSC;SIYMLISISLL;LISISLLSCDV
;LIDDFAIELDQ;KIIEEYKPMFL
A0216
FLSKLIDDFAI;SIYMLISISLL;KLRKSVALAYI;FLGAAVLEGA;ALAYIESFDVI;KIIEEYKPMFL
;FSFDVTSSKFV;LISISLLSCDV
A0219 FLGAAVLEGA;FLSKLIDDFAI;VALAYIESFDV;YMLISISLLSC;
A0301
MTYSFGTSSDK;KVNQATSTLKK;RLNQRNTDELK;TLKKDKFTVNK;HVADSYEKLRK;KTVNKFKELRK
;NSRSRYNNFYK;FVDSKFVRASK
A1101
MTYSFGTSSDK;KVNQATSTLKK;HVADSYEKLRK;KTVNKFKELRK;RLNQRNTDELK;FVFASKFVNK
;GAAVLEGAYK;STSLLSCDVSR;DVTSSRFVDSK;NSRSRYNNFYK;FVDSKFVRASK;YTESFDVTSS
K;QATSTLKKDK;NTDELKTFVEK;FVEENDLTALK;VSNARHVADSY
A2301 FYKPKFLSKLT;SYEKLRKSVAL;PMFLSKLIDDF
A2402 FYKPMFLSKLT;SFLSIYMLIST;IYMLISTSLLS
A2403 SYEKLRKSVAL;SFLSIYMLIST
A2601 FLKTFVEKAKY;YTCAYNDIMTY;DAIYSEYTCAY;ESFDVTSSKFV;
A2602
FTNSRSRYNNF;YTCAYNDIMTY;KIIEEYKPMFL;STKLDAIYSEY;DAIYSEYTCAY;FLKTFVEKAKY
;EFVEENDLIAL;SIYMLISISLL
A2902 KYYSIKLDAIY;YTCAYNDIMTY
A3001
KVNQATSTLKK;NSRSRYNNFYK;KLRKSVALAYI;RLNQRNTDELK;NARHVADSYEK;MTYSFGTSSDK
;KIVNKFKELEK
A3002 KYYSIKLDAIY
A3101
NSRSRYNNFYK;LSCDVSRLNQR;KVNQATSTLKK;RLNQRNTDELK;SISLLSCDVSR;KYYSIKLDAIY
A3301 LLVNDRELNSR;NSRSRYNNFYK;LSCDVSRLNQR

Fig. 41 continued

```
A6801
MTYSFGTSSDK;DVTSSKFVDSK;HVADSYFKLRK;LSCDVSRLNQR;SLSLLSCDVSR;QAYNDVSNAR
;YTRSFDVTSSK;NSRSRYNNFYK;FVFENDLIALK;DMYKDRETNSR;NARHVADSYEK;FASRKFVNKA
K;QATSTLKKDNK;FVEKAKYYSIK;FVEASKKFVEK;DATYSFYTGAY;FVDSKFVEASK;MTYTMTYSE
GT;NIDELKIPVEK;YTGAYNDIMTY
A6802
ESFDVTSSKFV;TGAYNDIMTYI;MTYIMTYSEGT;LSTYMLTSTSL;FGAYKATKQTL;FLSKLTDDFAT
A6901  ESFDVTSSKFV;EADFLGAAVEL
B0702
B0801
B0802
B1501
VSNARHVADSY;KSVALAYIESF;YTGAYNDIMTY;NQRNIDELKIF;SIKLDATYSFY;LGAAVELFGAY
B1801  EEYKPMFLSKL;IESFDVICSKF;SEYTGAYNDIM
B2705
B3501
DATYSFYTGAY;YTGAYNDIMTY;EADFLGAAVEL;EFVEENDLIAL;YNDIMTYIMTY;GAYNDIMTYIM
B3901
B4001  SEYTGAYNDIM;EEYKPMFLSKL;VEKAKYYSIKL
B4002  KFVEENDLIA;ENDLIALKCI
B4102
B4403  ENDLIALKCI;SEYTGAYNDIM;KFVEENDLIA
B4501  ENDLIALKCI
B5101
B5301
B5401
B5701
B5801  KSVALAYIESF;VSNARHVADSY

Allele 15-mer plus 9-mer core
DRB1_0101
SFLSTYMLTSTSLLS-TYMLTSTSL;FLSTYMLTSTSLLSC-TYMLTSTSL;KSFLSTYMLTSTSLL-
TYMLTSTSL;LSTYMLTSTSLLSCD-TYMLTSTSL;KKSFLSTYMLTSTSL-
FLSTYMLTS;EEYKPMFLSKLTDDF-YKPMFLSKL;FKITEEYKPMFLSKL-
TEEYKPMFL;TEEYKPMFLSKLTDD-YKPMFLSKL;ITEEYKPMFLSKLTD-
YKPMFLSKL;KITEEYKPMFLSKLT-YKPMFLSKL;YNDIMTYIMTYSEGT-
IMTYIMTYS;NDIMTYIMTYSEGTS-YIMTYSEGT;IMTYIMTYSEGTSSD-
YIMTYSEGT;STYMLTSTSLLSCDV-TYMLTSTSL;DIMTYIMTYSEGTSS-
YIMTYSEGT;MTYIMTYSEGTSSDK-YIMTYSEGT;TYMLTSTSLLSCDVS-
TYMLTSTSL;EYKPMFLSKLTDDFA-YKPMFLSKL;YKPMFLSKLTDDFAT-
YKPMFLSKL;GAYNDIMTYIMTYSE-YNDIMTYIM;TGAYNDIMTYIMTYS-
YNDIMTYIM;TYIMTYSEGTSSDKS-YIMTYSEGT;YIMTYSEGTSSDKSK-
YIMTYSEGT;SEYTGAYNDIMTYIM-YTGAYNDIM;EYTGAYNDIMTYIMT-
YNDIMTYIM;YTGAYNDIMTYIMTY-YNDIMTYIM;KYYSIKLDATYSFYT-
YSIKLDATY;TRSFDVTSSKFVDSK-FDVTSSKFV;ESFDVTSSKFVDSKF-
FDVTSSKFV;YTRSFDVTSSKFVDS-FDVTSSKFV;YYSIKLDATYSFYTG-
LDATYSFYT;IKLDATYSFYTGAYK LDATYSFYT;SIKLDATYSFYTGAY
LDATYSFYT;VELFGAYKATKQTLL-VELFGAYKA;AYNDIMTYIMTYSEG-
YNDIMTYIM;YSIKLDATYSFYTGA LDATYSFYT;LAYIESFDVISSKFV
YTRSFDVTS;AYTESFDVTSSKFVD-FDVTSSKFV;DSYFKLRKSVALAYI-
LRKSVALAY;YFKLRKSVALAYIES LRKSVALAY;SYEKLRKSVALAYIE
LRKSVALAY;EKLRKSVALAYIESF LRKSVALAY;LKSKVNQAISILKKD
VNQAISILK;SDKSKVNQAISILKK VNQAISILK;SSDKSKVNQAISILK
KVNQAISIL;KSKVNQAISILKKDN VNQAISILK;ADSYEKLRKSVALAY
EKLRKSVAL;YKLLSLSLLSCDVSR MLLSLSLLS;KEADFLGAAVELEGA
FLGAAVELE;EADFLGAAVELEGAY LGAAVELE;SRVNQAISILKKUNK
```

Fig. 41 continued

VNQATSIIK;ADFLQAAVLFQAYK-FLQAAVLF;KKFADFLQAAVLFQ-
FLQAAVLF;DFLQAAVLFQAYKA-FLQAAVLF;YKKFADFLQAAVLF-
YKKFADFLQ;FLQAAVLFQAYKAT-VLFQAYKA;MLTSTSLLS QDVSRL-
MLTSTSLLS;VFFNDLTALKCTVKT-FNDLTALKC;NDLTALKCTVKTTGD-
TALKCTVKT;FNDLTALKCTVKTTG-TALKCTVKT;LT

VNQAISILK;QAISILKKDNKIVNK-ISILKKDNK;IALKCIVKTIGDMVN-
LKCIVKTIG;NQAISILKKDNKIVN-ISILKKDNK;ENDLIALKCIVKTIG-
IALKCIVKT;DLIALKCIVKTIGDM-IALKCIVKT;LIALKCIVKTIGDMV-
LKCIVKTIG;AISILKKDNKIVNKF-LKKDNKIVN;ISILKKDNKIVNKFK-
LKKDNKIVN;VNQAISILKKDNKIV-ISILKKDNK;MVNDREINSRSRYNN-
REINSRSRY;MLISISLLSCDVSRL-MLISISLLS;VNDREINSRSRYNNF-
REINSRSRY;NDREINSRSRYNNFY-REINSRSRY
DRB1_1501 FLSIYMLISISLLSC-MLISISLLS;LSIYMLISISLLSCD-
MLISISLLS;SFLSIYMLISISLLS-IYMLISISL;SIYMLISISLLSCDV-
MLISISLLS;IYMLISISLLSCDVS-MLISISLLS
DRB3_0101
DRB4_0101 EKIIEEYKPMFLSKL-IEEYKPMFL;KELEKIIEEYKPMFL-
IEEYKPMF;LEKIIEEYKPMFLSK-IEEYKPMFL;ELEKIIEEYKPMFLS-
IEEYKPMFL;IYMLISISLLSCDVS-LISISLLSC;KIIEEYKPMFLSKLI-
IEEYKPMFL;YMLISISLLSCDVSR-ISLLSCDVS;MLISISLLSCDVSRL-ISLLSCDVS
DRB5_0101

<NP_048689 outer surface protein B;Protein;Borrelia burgdorferi B31>
SEQ ID NO:171696-172134

Allele 8-mer
A0101
A0201 FLTDGTIT;LLIGFALA;RLLIGFAL;FALALALI;LTDGTITV;SLFNGNKI;FLNDTAGS
A0202
FLNDTAGS;FLTDGTIT;ALALIGCA;LLIGFALA;SLFNGNKI;KTKDLVFL;RLLIGFAL;ATIDQVEL
;LIGFALAL;KLTVSADL;VSADLNTV;NLSELKNA;FALALALI;LVGGKTTV;
A0203
LLIGFALA;ALALIGCA;LVGGKTTV;FLTDGTIT;SLFNGNKI;KTKDLVFL;FLNDTAGS;RLLIGFAL
;NLSELKNA;TLKNSIKL;KVKLTVSA;LIGFALAL;FALALALI;SIKLEGSL;KLTVSADL;LTDGTIT
V;NQKISSKV;ATKAVETL;VSADLNTV;AQKGAESI
A0204 SLFNGNKI;ATIDQVEL;LVGGKTTV;RLLIGFAL;LTDGTITV
A0206
RLLIGFAL;FALALALI;LTDGTITV;LLIGFALA;FLTDGTIT;ATIDQVEL;LVGGKTTV;QQYNTAGT
;FLNDTAGS;LIGFALAL;AQKGAESI;KTKDLVFL
A0211
RLLIGFAL;LTDGTITV;LLIGFALA;SLFNGNKI;LVGGKTTV;FLTDGTIT;SLVGGKTT;TLKNSIKL
;NLSELKNA;KLDSKKLT;FLNDTAGS;KLTVSADL;VSADLNTV;ALALIGCA;KTKDLVFL;ATIDQVE
L;IKLEGSLV;TTLEYSQI;LIGFALAL;ALIGCAQK
A0212
RLLIGFAL;LTDGTITV;SLFNGNKI;LLIGFALA;LVGGKTTV;FLTDGTIT;FLNDTAGS;SLVGGKTT
;VSADLNTV;LIGFALAL;NLSELKNA
A0216
LVGGKTTV;RLLIGFAL;LTDGTITV;SLFNGNKI;LLIGFALA;TLKNSIKL;FLTDGTIT;SLVGGKTT
;LIGFALAL;ALALIGCA;ATIDQVEL
A0219 LTDGTITV;LVGGKTTV;FLTDGTIT;RLLIGFAL;LLIGFALA;FLNDTAGS
A0301
KISSKVTK;ISSKVTKK;KIFVSKEK;ALIGCAQK;GSNKKTGK;VSLFNGNK;SITXETLK;TISADSKK
A1101
SITXETLK;VSLFNGNK;TISADSKK;KIFVSKEK;LTISADSK;KISSKVTK;ALIGCAQK;TIDQVELK
;KANKLDSK;ISSKVTKK;GSNKKTGK;TLKPEIEK;ETLKNSIK;SADSKKTK
A2301 LFNGNKIF;KYDLRATI
A2402 KYDLRATI;VFLTDGTI
A2403 KYDLRATI
A2601 GTITVQQY;EIKNLSEL
A2602 NTVTLEAF;EIKNLSEL;ATIDQVEL;KTKDLVFL;GTITVQQY;ETLKANKL
A2902

Fig. 41 continued

A3001
KTFVSKEK;KANKLDSK;KFKNSSCK;TLKRETFK;QSKPDKSK;KTSSKVTK;SSNKKTSK;KVKLTVSA
;
A3002
A3101 KTSSKVTK;SSGKYDLR;KTKDLVFL;KTFVSKEK;KANKLDSK
A3301
A6801
DTAGSNKK;LTTSADSK;ETLKNSTK;TTSADSKK;STTKETLK;TIDQVELK;SSGKYDLR;TSSKVTKK
;FIKGTSDK;EGTVTLKR;NTAGTSLF;FAFDASNQ
A6802 TTLRYSQT;ATIDQVEL;VSADLNTV;TSTLTTSA
A6901 LTDGTTTV;FALALALT;TTLRYSQT;ETLKANKL
B0702
B0801
B0802
B1501
B1801 WEDSTSTL;
B2705
B3501 NTVTLEAF;
B3901 TRSNGTTL;LKEGTVTL
B4001 WEDSTSTL;
B4002
B4402
B4403
B4501
B5101
B5301 FALALALL;
B5401 FALALALL;LFAVEEDS
B5701
B5801

Allele 9-mer
A0101 RSNGTTLEY;VTEDSVSLF
A0201 FLTDGTTTV;LLTGFALAL;RLLTGFALA;SLVCGKTTV
A0202
FLTDGTTTV;NLSELKNAL;LLTGFALAL;TVSADLNTV;LTGFALALA;SLVCGKTTV;AVTEDSVSL;A
LALALTGC;SLEGSASET
A0203
FLTDGTTTV;SLVCGKTTV;TVSADLNTV;LLTGFALAL;LTGFALALA;RLLTGFALA;STKLEGSTV;S
TSTLTTSA;NLSELKNAL;ALALALTGC
A0204 FLTDGTTTV;SLVCGKTTV;LLTGFALAL
A0206
FLTDGTTTV;TVSADLNTV;SLVCGKTTV;LLTGFALAL;RLLTGFALA;AVTEDSVSL;SQTTDAPNA;K
QGSTTKET;VQQYNTAQT;ALALALTGC;SEIKNLSEL;VTLEAFDAS
A0211
FLTDGTTTV;SLVCGKTTV;LLTGFALAL;NLSELKNAL;RLLTGFALA;AVTEDSVSL;SLFGSASET;K
TKEGTVTL;TVSADLNTV;DLRATIDQV;DLNVTLEA;LFNGNKTFV;SADLNTVTL;SLFNGNKTF;ST
TKETLKA;ALALALTGC
A0212
FLTDGTTTV;SLVCGKTTV;LLTGFALAL;NLSELKNAL;RLLTGFALA;FLKEGTVTL;DLRATIDQV;A
VTEDSVSL;TVSADLNTV;SLFGSASET;LFNGNKTFV
A0216
FLTDGTTTV;SLVCGKTTV;LLTGFALAL;DLRATIDQV;SLEGSASET;NLSELKNAL;LFNGNKTFV;R
LLTGFALA;FLKEGTVTL;TVSADLNTV;DLNVTLEA;AVTEDSVSL
A0219 FLTDGTTTV;SLVCGKTTV;LLTGFALAL;DLRATIDQV;TVSADLNTV;NLSELKNAL

Fig. 41 continued

A0301
KTSSKVTKK;ASNQKTSSK;RSNGTTLFY;ATKAVETLK;VTLKRETEK;KANKLDSKK;GSTTKETLK;S
VSLFNGNK;KLDSKKLTR
A1101
SVSLFNGNK;ATIDQVELK;ATKAVETLK;ASNQKTSSK;VTLKRETEK;GSTTKETLK;KTSSKVTKK;L
TTSADSKK;ITRADNATK;KANKLDSKK;TLTTSADSK;RSNGTTLFY;GSGTIRGSK;LSFIKNALK;GA
ESIGSQR;FAFDASNQK;TSADSKKTK;LALTCCAQK
A2301 QYNTAGTSL
A2402 QYNTAGTSL
A2403 QYNTAGTSL
A2601
A2602 EIKEGTVTL;VTEDSVSLF;ETLKNSIKL
A2902
A3001
ATKAVETLK;RSNGTTLFY;ATIDQVELK;KANKLDSKK;KTRDIVFLT;SKKSHQNAK;SVSLFNGNK
A3002
A3101 KLDSKKLTR;ATKAVETLK;KTSSKVTKK;KANKLDSKK;ASNQKTSSK
A3301
A6801
FAFDASNQK;LTTSADSKK;SVSLFNGNK;ELKNLSEIK;KGGGKYDLR;ATIDQVELK;TLTTSADSK;A
TKAVETLK;GSTTKETLK;ITRADNATK
A6802 TVSADLNTV;STSGLTISA;TTVELKEGT;FLTDGTITV;ETLKNSIKL
A6901 ETLKNSIKL;FLTDGTITV;TVSADLNTV;DADNATKAV;EIKEGTVTL;TILEYSQLT
B0702 KPDKSKVKL;LTRSNGTTL;LPAVTEDSV;AVTEDSVSL
B0801
B0802
B1501 RSNGTTLFY;SLFNGNKIF;LLIGFALAL;SQKENDLNL
B1801
B2705 KRLLIGFAL
B3501
B3901 SADLNTVLL
B4001 SFTKNLSFI
B4002 SFTKNLSFI
B4402
B4403
B4501
B5101 LPAVTEDSV
B5301 LPAVTEDSV
B5401 LPAVTEDSV;LALALTCCA
B5701
B5801 RSNGTTLFY;QSNKKTSKV

Allele 10-mer
A0101
A0201 SLFNGNKIFV;LLIGFALALA;RLLIGFALAL;FLTDGTITVQ;ALALALTCCA
A0202
LLIGFALALA;SLFNGNKIFV;RLLIGFALAL;KGGSTTKETL;ALTCCAQKGA;ALALALTCCA;LTVSA
DLNTV;FLTDGTITVQ;QQYNTAGTSL;FALALALTCC;KLTRSNGTTL;TGFALALALT;DLPAVTEDSV
A0203
LLIGFALALA;ALALALTCCA;SLFNGNKIFV;ALTCCAQKGA;LTVSADLNTV;RLLIGFALAL;KLTRS
NGTTL;FLTDGTITVQ;LIGFALALAL;QQYNTAGTSL;LVGGKIVEL
A0204 SLFNGNKIFV;LTVSADLNTV;KLTRSNGTTL
A0206
RLLIGFALAL;KGGSTTKETL;LTVSADLNTV;QQYNTAGTSL;LLIGFALALA;SLFNGNKIFV;SQLTE
ADNAT;FLTDGTITVQ;KAVETLKNSI;LIGFALALAL;TTVELKEGTV;ALTCCAQKGA;FALALALTGC

Fig. 41 continued

```
A0201
SLFNGNKIFV;RLLIGFALAI;FLTDGTITVQ;LLIGFALALA;DLPAVTEDSV;KITRSNGTTI;ALIGC
AQKCA;ALALALIGCA;VFLTDGTITV;ETEKDGKVKV;TTVFIKFGTV;LIGFALALAL;SLVGGKTTVF
;KIDSKKITRS
A0212
SLFNGNKIFV;RLLIGFALAI;FLTDGTITVQ;DLPAVTEDSV;LLIGFALALA;KITRSNGTTI;VFLID
GTTTV;LIGFALALAL
A0215
SLFNGNKIFV;RLLIGFALAI;DLPAVTEDSV;FLTDGTITVQ;KITRSNGTTI;LLIGFALALA;ETEKD
GKVKV;ALIGCAQKCA;LTVSADINTV;LVGGKTTVFI;TTVFIKFGTV;ALALALIGCA;LIGFALALAL
;VFLTDGTTTV
A0219 FLTDGTITVQ;SLFNGNKIFV;DLPAVTEDSV;RLLIGFALAL;LLIGFALALA;LTVSADINTV
A0301
ALALIGCAQK;FLNDIAGSNK;STLTISADSR;NLSELRNALK;ILKANKLDSK;KLEGSLVGGK;TVILK
RFIFK;ITKFTLRANK
A1101
STLTISADSK;TVILKRFIFK;ITKFTLRANK;TISADSKKTK;SSKKSHQNAK;GTLEGSKPDK;ALALI
GCAQK;AVEILKNSIK;RATIDQVELK;TLKANKLDSK;ILTISADSKK;KLEGSLVGGK;FLNDIAGSNK
;SLEGSASEIK;NLSELKNALK;VSKEKNSSGK;TAGSNKKTGK;QITDADNATK
A2301 VSLFKGKIF
A2402
A2403
A2601
A2602 AVIEDSVSLF
A2902
A3001
CSKKSHQNAK;GTLEGSKPDK;GCKPDKSKVK;ILKANKLDSK;VSKEKNSSGK;KLEGSLVGGK;RATID
QVELK
A3002
A3101
A3301
A6801
NATKAVETIK;TVTLKRFIFK;DSVSLFNGNK;STLTISADSR;FIKFGTVTLK;TLTISADSKK;DASNQ
KTSSK;NLSELKNALK;ITKFTLRANK;QITDADNATK;TISADSKKTK;FLNDIAGSNK;RATIDQVFLK
;DLNLFDSSKK
A6802
KAFDASNQKT;TTVFIKFGTV;LTVSADINTV;SVGLFNGNKT;NTAGTSIFGS;DLPAVTEDSV;NSIKL
FGSLV
A6901 KAFDASNQKT;TTVFIKFGTV;LTVSADINTV;SLFNGNKIFV
B0702
B0801
B0802
B1501 QQYNTAGTSI
B1801 VFIKFGTVTL;TEKDGKVKVF;DFDSTSTLTI
B2705
B3501 LPAVTEDSVS;DLNTVTLFAF
B3901
B4001 VFIKFGTVTL;DFDSTSTLTI;VFTIKNSIKL
B4002 VFIKFGTVTL
B4402
B4403
B4501
B5101
B5301
B5401 LPAVTEDSVS
B5701
```

Allele 11-mer
A0101 LTDCTITVQQY;LTRSNGTTLFY
A0201
LLIGFALALAL;FLTDGTITVQQ;KLTVSADLNTV;RLLIGFALALA;SLVGGKTTVEI;LVFLTDGTITV
A0202
FLTDGTITVQQ;LLIGFALALAL;KLTVSADLNTV;SASFIKNLSEL;LIGFALALAL;SLVGGKTTVEI
;TVSADLNTVTL;RLLIGFALALA;FLNDTAGSNKK;HQNAKQDLPAV;LVFLTDGTITV;ALALALIGCA
Q
A0203
LLIGFALALAL;SLVGGKTTVEI;RLLIGFALALA;LIGFALALAL;KLTVSADLNTV;LVFLTDGTITV
;HQNAKQDLPAV;FLTDGTITVQQ;TVSADLNTVTL
A0204 SLVGGKTTVEI;LLIGFALALAL;KLTVSADLNTV;LVFLTDGTITV
A0206
LLIGFALALAL;HQNAKQDLPAV;KLTVSADLNTV;RLLIGFALALA;VQQENLAGISL;LVFLTDGTITV
;SLVGGKTTVEI;FLTDGTITVQQ;TVSADLNTVTL;FALALALIGCA;LIGFALALAL
A0211
LLIGFALALAL;SLVGGKTTVEI;FLTDGTITVQQ;KLTVSADLNTV;RLLIGFALALA;LVFLTDGTITV
;SLFNGNKIFVS;LTDADKATKAV;SADGKKIKDLV;TVSADLNTVTL;DLRATIDQVEL;FLNDTAGSNK
K;SASFIKNLSEL;ALALALIGCAQ
A0212
LLIGFALALAL;SLVGGKTTVEI;FLTDGTITVQQ;LVFLTDGTITV;KLTVSADLNTV;RLLIGFALALA
;FLNDTAGSNKK;SLFNGNKIFVS;DLRATIDQVEL;LTDADKATKAV
A0216
SLVGGKTTVEI;LLIGFALALAL;FLTDGTITVQQ;KLTVSADLNTV;LVFLTDGTITV;RLLIGFALALA
;DLRATIDQVEL;SADGKKIKDLV;SLFNGNKIFVS
A0219
FLTDGTITVQQ;LLIGFALALAL;SLVGGKTTVEI;KLTVSADLNTV;LVFLTDGTITV;LTDADKATKAV
;DLRATIDQVEL
A0301
FLNDTAGSNKK;KQGSTTXFTLK;TLKANKLDSKK;STLTTSADSKK;LFNGNKIFVSK;STTXFTLKANK
A1101
STLTTSADSKK;STTXFTLKANK;TSLTTTSADSK;TSLFGSASFIK;SQTTDADKATK;ASFIKNLSELK
;GIVTLKREIEK;LALALIGCAQK;KQGSTTXFTLK;TLFAFDASNQK;LTTSADSKKTK;KAVETLKNST
K;TLKANKLDSKK;FVSKFKNSSGK;LVGGKTTVEIK;FLNDTAGSNKK
A2301 VFLNDTAGSNK
A2402 KYFDSTSTTTT
A2403
A2601
A2602 ETEKDGKVKVF;LTDCTITVQQY
A2902
A3001
LTRSNGTTLFY;TLKANKLDSKK;TSLFGSASFIK;LTTSADSKKTK;LFNGNKIFVSK;STLTTSADSKK
;KQGSTTXFTLK
A3002
A3101 LFNGNKIFVSK;KQGSTTXFTLK;STLTTSADSKK
A3301 ETKFGTVTLKR
A6801
TSLTTTSADSK;ETKFGTVTLKR;DTAGSNKKTGK;STLTTSADSKK;LTTSADSKKTK;FVSKFKNSSGK
;ETLKANKLDSK;TLFAFDASNQK;STTXFTLKANK;GIVTLKREIEK;DSKKSHQNAK;FLNDTAGSNK
K;TSLFGSASFIK;TLKANKLDSKK;DNATKAVETLK;LALALIGCAQK
A6802
NTAGTSLFGSA;TVSADLNTVTL;LVFLTDGTITV;SASFIKNLSEL;DASNQKIGSKV;EGSLVGGKTTV
;DSVSLFNGNKI
A6901 LTDADKATKAV;FALALALIGCA;TTLEYSQITDA;LVFLTDGTITV;NTAGTSLFGSA

Fig. 41 continued

```
B0702  LPAVTDRSVSL;KPDKSKVKITV
B0801
B0802
B1501  LTRSNGTTLEY;LLIGFALALAL;VQQYNTAGTSL;VSKEKDSGKY;SVSLFNGNKIF
B1801  TEKDGKVKVFL;MRLLIGFALAL
B2705  MRLLIGFALAL
B3501  LPAVTDRSVSL;TVSADLNTVTL
B3901
B4001  LEGSASEIKNL;TEKDGKVKVFL;KEKNSSCKYDL
B4002
B4402
B4403
B4501
B5101  LPAVTDRSVSL
B5301  LPAVTDRSVSL
B5401  FALALALIGCA
B5701
B5801
```

Allele 15-mer plus 9-mer core

```
DRB1_0101  MRLLIGFALALALIG  IGFALALAL;RLLIGFALALALIGC
           FALALALIG;LLIGFALALALIGCA  FALALALIG;LIGFALALALIGCAQ
           FALALALIG;IGFALALALIGCAQK  FALALALIG;GFALALALIGCAQKG
           FALALALIG;KNSIKLEGSLVGGKT  IKLEGSLVG;NSIKLEGSLVGGKTT
           IKLEGSLVG;LKNSIKLEGSLVGGK  IKLEGSLVG;EILKNSIKLEGSLVG
           KNSIKLEGS;TLKNSIKLEGSLVGG  IKLEGSLVG;ITVQQYNTAGTSLEG
           VQQYNTAGT;TITVQQYNTAGTSLE  VQQYNTAGT;FALALALIGCAQKGA
           FALALALIG;KTGKWEDSTSTLTIG  WEDSTSLT;KKIGKWEDSTSTLT
           WEDSTSLT;KKKIGKWEDSTSTLT  GKWEDSTST;KLEGSLVGGKTTVEI
           LVGGKTTVE;LEGSLVGGKTTVEIK  VGGKTTVEI;EGSLVGGKTTVEIKE
           VGGKTTVEI;GSLVGGKTTVEIKEG  VGGKTTVEI;IKLEGSLVGGKTTVE
           IKLEGSLVG;TGKWEDSTSTLTSA-  WEDSTSLT;VQQYNTAGTSLEGSA-
           YNTAGTSLE;GKWEDSTSTLTSAD-  WEDSTSLT;TVQQYNTAGTSLEGS-
           YNTAGTSLE;QQYNTAGTSLEGSAS-  YNTAGTSLE;SLVGGKTTVEIKEGT-
           VGGKTTVEI;GTITVQQYNTAGTSL-  VQQYNTAGT;DGTITVQQYNTAGTS-
           VQQYNTAGT;KDLVFLTDGTITVQQ-  FLTDGTITV;DLVFLTDGTITVQQY-
           FLTDGTITV;TDGTITVQQYNTAGT-  TTVQQYNTA;TKDLVFLTDGTITVQ-
           FLTDGTITV;LVFLTDGTITVQQYN-  FLTDGTITV;STKLEGSLVGGKTTV-
           IKLEGSLVG;SKVKLTVSADLNTVT-  VKLTVSADL;KSKVKLTVSADLNTV-
           VKLTVSADL;KTKDLVFLTDGTITV-  VFLTDGTIT;DKSKVKLTVSADLNT-
           VKLTVSADL;QYNTAGTSLEGSASE-  YNTAGTSLE;KVKLTVSADLNTVTL-
           LTVSADLNT;VKLTVSADLNTVTLE-  LTVSADLNT;YNTAGTSLEGSASEI-
           YNTAGTSLE;VGGKTTVEIKEGTVT-  VGGKTTVEI;PDKSKVKLTVSADLN-
           VKLTVSADL;ANKLDSKKLTRSNGT-  LDSKKLTRS;LVGGKTTVEIKEGTV-
           VGGKTTVEI;KPDKSKVKLTVSADL-  SKVKLTVSA;LKANKLDSKKLTRSN-
           LDSKKLTRS;QGSITKETLKANKLD-  KETLKANKL;KQGSITKETLKANKL-
           ITKETLKAN;GSITKETLKANKLDS  KETLKANKL;TLKANKLDSKKLTRS
           ANKLDSKKL;NKLDSKKLTRSNGTT-  LDSKKLTRS;KWEDSTSTLTSADS-
           WEDSTSLT;VFLTDGTITVQQYNT  FLTDGTITV;KANKLDSKKLTRSNG
           LDSKKLTRS;NTAGTSLEGSASEIK-  GTSLEGSAS;WEDSTSTLTSADSK-
           WEDSTSLT;EASNQKISSKVTKKQ  NQKISSKVT;FLTDGTITVQQYNTA
           FLTDGTITV;LDSKKLTRSNGTTLE  LTRSNGTTL;ASNQKISSKVTKKQG
           ISSKVTKKQ;TAGTSLEGSASEIKN  LEGSASEIK;SKVTKKQGSITKETL
           VTKKQGSIT;LTVSADLNTVTLEAF  VSADLNTVT;SSKVTKKQGSITKET
           VTKKQGSIT;KLTVSADLNTVTLEA  VSADLNTVT;ALIGCAQKGAESIGS  LIGCAQKGA
DRB1_0301
```

DRB1_0401 FNGNKIFVSKEKNSS-FNGNKIFVS;NKIFVSKEKNSSGKY-
FVSKEKNSS;GNKIFVSKEKNSSGK-FVSKEKNSS;KIFVSKEKNSSGKYD-
FVSKEKNSS;NGNKIFVSKEKNSSG-FVSKEKNSS;ETLKNSIKLEGSLVG-LKNSIKLEG
DRB1_0404 GKVKVFLNDTAGSNK-VKVFLNDTA;DGKVKVFLNDTAGSN-
VKVFLNDTA;KVKVFLNDTAGSNKK-FLNDTAGSN;VKVFLNDTAGSNKKT-FLNDTAGSN;
DRB1_0405 TITVQQYNTAGTSLE-VQQYNTAGT;ITVQQYNTAGTSLEG-
YNTAGTSLE;TVQQYNTAGTSLEGS-YNTAGTSLE;VQQYNTAGTSLEGSA-
YNTAGTSLE;QQYNTAGTSLEGSAS-YNTAGTSLE
DRB1_0701
DRB1_0802
DRB1_0901 MRLLIGFALALALIG-IGFALALAL;RLLIGFALALALIGC-
IGFALALAL;LLIGFALALALIGCA-IGFALALAL;ITVQQYNTAGTSLEG-
VQQYNTAGT;TITVQQYNTAGTSLE-VQQYNTAGT;LIGFALALALIGCAQ-
FALALALIG;TGKWEDSTSTLTISA-WEDSTSTLT;KTGKWEDSTSTLTIS-
WEDSTSTLT;KKTGKWEDSTSTLTI-WEDSTSTLT;
DRB1_1101
DRB1_1302 ETLKNSIKLEGSLVG-LKNSIKLEG;KAVETLKNSIKLEGS-
LKNSIKLEG;TKAVETLKNSIKLEG-VETLKNSIK;AVETLKNSIKLEGSL-
LKNSIKLEG;VETLKNSIKLEGSLV-LKNSIKLEG;TLKNSIKLEGSLVGG-
LKNSIKLEG;LKNSIKLEGSLVGGK-LKNSIKLEG;DSVSLFNGNKIFVSK-
VSLFNGNKI;EDSVSLFNGNKIFVS-VSLFNGNKI;TITVQQYNTAGTSLE-
VQQYNTAGT;ITVQQYNTAGTSLEG-YNTAGTSLE;VSLFNGNKIFVSKEK-
VSLFNGNKI;SVSLFNGNKIFVSKE-VSLFNGNKI;TEDSVSLFNGNKIFV-
VSLFNGNKI;VQQYNTAGTSLEGSA-YNTAGTSLE;TVQQYNTAGTSLEGS-
YNTAGTSLE;EGSASEIKNLSELKN-SASEIKNLS;ASEIKNLSELKNALK-
IKNLSELKN;SASEIKNLSELKNAL-IKNLSELKN;GSASEIKNLSELKNA-IKNLSELKN;QQYNTAGTSLEGSAS-YNTAGTSLE;LDGKKLTRSNGTTLE-LTRSNGTTL;NSIKLEGSLVGGKTT-IKLEGSLVG;VTEDSVSLFNGNKIF-VSLFNGNKI;KNSIKLEGSLVGGKT-IKLEGSLVG
DRB1_1501 MRLLIGFALALALIG-LIGFALALA;RLLIGFALALALIGC-LIGFALALA;LKNSIKLEGSLVGGK-IKLEGSLVG;KDGKVKVFLNDTAGS-VKVFLNDTA;DGKVKVFLNDTAGSN-VKVFLNDTA;KNSIKLEGSLVGGKT-IKLEGSLVG
DRB3_0101
DRB4_0101
DRB5_0101

<NP_047005 outer surface protein C;Protein;Borrelia burgdorferi B31>
SEQ ID NO:172135-172552
Allele 8-mer
A0101
A0201
KLFESVEV;LLSSIDEI;LMTLFLFI;LLAGAYAI;VLLAVKEV;SLLAGAYA;AILMTLFL;KITDSNAV;TLSAILMT
A0202
KLFESVEV;LLSSIDEI;LLAGAYAI;LMTLFLFI;KITDSNAV;KIHQNNGL;TLSAILMT;GAYAISTL;ILMTLFLF;SLLAGAYA;VLLAVKEV;LSAILMTL
A0203
KLFESVEV;LLAGAYAI;LLSSIDEI;LMTLFLFI;VLLAVKEV;KITDSNAV;SLLAGAYA;TLSAILMT;GAYAISTL;GLKEKIDA;AVKEVEAL;KIHQNNGL;AILMTLFL
A0204 KLFESVEV;VLLAVKEV;SLLAGAYA;LLAGAYAI;
A0206
KLFESVEV;KITDSNAV;LLAGAYAI;AILMTLFL;KEMLANSV;VLLAVKEV;LMTLFLFI;SLLAGAYA;ILMTLFLF;LLSSIDEI;GAYAISTL
A0211
KLFESVEV;VLLAVKEV;LLAGAYAI;SLLAGAYA;KITDSNAV;LMTLFLFI;AILMTLFL;LLSSIDEI;TLFLFISC;TLSAILMT;ELTSPVVA;ILMTLFLF;KIHQNNGL;SIDEIAAK;KLDGLKNE

Fig. 41 continued

A0213
KIFFSVEV;VLLAVKEV;LLAGAYAI;SLLAGAYA;KITDSNAV;LMTLFLF1;LLSSIDEI;ATLMTLFL
;TLFLFTSC
A0216
KIFFSVEV;VLLAVKEV;SLLAGAYA;LLAGAYAI;ATLMTLFL;KITDSNAV;LLSSIDEI;LMTLFLFI
;TLFLFTSC;TLSAILMT;GAYAISTL
A0219
LLAGAYAI;VLLAVKEV;KIFFSVEV;LLSSIDEI;SLLAGAYA;KITDSNAV;LMTLFLFI;ATLMTLFL
A0301 KINGTKTK;ILKTNGIK;VVAFSPKK;GLKKFGLK;IAAKAIGK;NLTETSKK
A1101
KINGTKTK;VVAFSPKK;ISCNISGK;YAISTLIR;SIDFTAAK;GVTDADAK;FTFTNKLK;CSFTFTNK
;LAAKAIGK;AAKAIGKK;FTNKLKEK;ISTLIKQK;PVVAFSPK;EVLSKAAK;NSADESVK;ESVEVLS
K;KQKLDGLK;FKLANSVK;NAVLLAVK
A2301 ILMTLFLF;AYAISTLI
A2402 AYAISTLI;TLMTLFLF
A2403 AYAISTLI
A2601
A2602
A2902 ILMTLFLF
A3001 KINGTKTK;KQKLDGLK;AAKAIGKK;ILKTNGIK
A3002
A3101 KINGTKTK
A3301 DAKEAILK;EVLSKAAK
A6801
EFTFNKLK;ESVEVLSK;YAISTLIR;NAVLLAVK;EVLSKAAK;FTNKLREK;NSADESVK;NLTETSKK
;ISCNSGK;DAKEAILK;LAAKAIGK;ISTLIKQK;FKLANSVK;CSFTFTNK;VVAFSPKK;GVTDADA
K;EKIDAAKK
A6802 LLAGAYAI
A6901 NLSAILM
B0702
B0801
B0802
B1501 TLMTLFLF;GSLLAGAY;
B1801
B2702
B3501 SAILKTLF
B3901
B4001 SFTFTNKL;AEELGKLF;FKLANSV
B4002 KELTSPVV;FKLANSV;
B4402
B4403 AEELGKLF;KEVEALLS;
B4501 AEELGKLF
B5101
B5301 SAILKTLF
B5401
B5701
B5801

Allele 9-mer
A0101
A0201
ILMTLFLFI;ALLSSIDEI;KIFFSVEVL;TLSAILMTL;SLLAGAYAI;FKLANSVKEL;LLSSIDEIA;K
ITDSNAVL
A0202
TLSAILMTL;ILMTLFLFI;KIFFSVEVL;LLSSIDEIA;FKLANSVKEL;ALLSSIDEI;GVKELTSPV;F
LFTSCKKS;LLAVKEVLA;GLKKFIDAA;GAYAISTLI;SLLAGAYAI;LLKQKLDGL;ELGKIFFSV;LL

Fig. 41 continued

ACAYATS;KITDSNAVL;KLFKHTDL;SANSADESV;NLTETSKKT;SATLMTLFL;LAVKEVEAL;AVK
EVEALL
A0203
SVKELTSPV;MLANSVKEL;TLSATLMTL;GLKEKIDAA;LTRQXLDGL;TLMTLFLFT;KLFESVEVL;K
LKEKHTDL;ALLSSIDEL;SLLAGAYAT;LLAVKEVEA;LLSSIDELA;FLGKLFESV;QAYATSTLT;MK
KNTLSAT;AVKEVEAL;AVLLAVKEV;LLAGAYATS;FLFTSCNNS
A0204
SLLAGAYAT;TLSATLMTL;KLFESVEVL;MLANSVKEL;ALLSSIDEL;LLAVKEVEA;KLKEKHTDL;T
LMTLFLFT
A0206
SLLAGAYAT;TLMTLFLFT;ALLSSIDEL;KLFESVEVL;TLSATLMTL;SVKELTSPV;SATLMTLFL;G
AYATSTLT;KITDSNAVL;EQNKGLDTE;AVLLAVKEV;EKITDSNAV;ALLNLFLF;SIDELAAKA;EL
GKLFESV
A0211
SLLAGAYAT;KLFESVEVL;TLSATLMTL;ELGKLFESV;MLANSVKEL;TLMTLFLFT;SIDETAAKA;A
LLSSIDEL;KITDSNAVL;SVKELTSPV;NLTELSKKL;HTDLGKEGV;AVLLAVKEV;LLAVKEVEA;IT
DSNAVLL;ELDGLKNEG;LLSSIDELA;GLKEKIDAA;KLKEKHTDL;VLSKAAKEM;AVKEVEALL;SAN
SADESV
A0212
SLLAGAYAT;ELGKLFESV;TLSATLMTL;KLFESVEVL;TLMTLFLFT;KLKEKHTDL;ALLSSIDEL;K
LANSVKEL;GLKEKIDAA;HTDLGKEGV;LLAVKEVEA;SVKELTSPV;SIDELAAKA
A0216
ELGKLFESV;TLSATLMTL;SLLAGAYAT;ALLSSIDEL;MLANSVKEL;KLFESVEVL;TLMTLFLFT;S
VKELTSPV;LLAVKEVEA;AVLLAVKEV;SIDELAAKA;AVKEVEALL;KITDSNAVL;VLSKAAKEM;SA
NSADESV;LLSSIDELA;NLTELSKKL;HTDLGKEGV
A0219
SLLAGAYAT;TLSATLMTL;ALLSSIDEL;TLMTLFLFT;ELGKLFESV;HTDLGKEGV;MLANSVKEL;K
LFESVEVL;SANSADESV;ITDSNAVLL
A0301 IAAKAIGKK;AILKINGTK;AISTLIRQK;FLSCNNSGK
A1101
SSIDELAAK;AILKINGTK;AISTLIRQK;AYATSTLIK;IAAKAIGKK;ELAAKAIGK;FLSCNNSGK;F
VVAFSPKK
A2301 ATLMTLFLF;AYATSTLFK
A2402 ATLMTLFLF;
A2403
A2601
A2602 EVEALLSSI
A2902
A3001 ATLKINGTK;AYATSTLTK;KEKHTDLGK
A3002
A3101
A3301
A6801 FLSCNNSGK;ELAAKAIGK;SSIDELAAK;IAAKAIGKK;ETFINKLKE;
A6802
SVKELTSPV;ELGKLFESV;TLSATLMTL;EVEALLSSI;DSNAVLLAV;ESVEVLSKA;SANSADESV;S
ATLMTLFL;TLMTLFLFT;HTDLGKEGV;LTSPVVAFS
A6901 ELGKLFESV;HTDLGKEGV;SLLAGAYAT;NLSATLMT;DSNAVLLAV;
B0702
B0801
B0802
B1501 KLFESVEVL
B1801 DESVKGPNL
B2705
B3501 LAVKEVEAL;NGSLLAGAY
B3901
B4001 TENNKGSL

Fig. 41 continued

B4002 TFNNRKQSL
B4402
B4403
B4501
B5101
B5301
B5401
B5701
B5801 LSAILMTLF

Allele 10-mer
A0101
A0201
ALLSSIDELA;ALLMTLFLFL;LLAGAYAIST;LLSSIDELAA;NTLSAILMTL;KITDSNAVLL;ILMTL
FLFLS;VLLAVKEVEA;LLAVKEVEAL;KLDGLKNEGL;KLFESVEVLS
A0202
LLAVKEVEAL;LLSSIDELAA;KLDGLKNEGL;ALLSSIDELA;LLAGAYAIST;NTLSAILMTL;FLFLS
CNNSG;LAGAYAISTL;ILMTLFLFLS;MLANSVKELT;LSAILMTLFL;VLSKAAKEML;KITDSNAVLL
;KLFESVEVLS;ALLMTLFLFL;TSANSADESV;TLIKQKLDGL;VLLAVKEVEA;LMTLFLFLSC
A0203
AAKEMLANSV;LLAVKEVEAL;LLAGAYAIST;SVKELTSPVV;TLIKQKLDGL;MLANSVKELT;LLSSI
DELAA;SVKGPNLTEI;VLSKAAKEML;ALLSSIDELA;NTLSAILKTL;NSVKELTSPV
A0204 VLLAVKEVEA;LLAVKEVEAL;EMLANSVKEL
A0206
KEVEALLSSI;ALLMTLFLFL;NTLSAILKTL;KITDSNAVLL;LLAGAYAIST;TLIKQKLDGL;SVKEL
TSPVV;AAKEMLANSV;ALLSSIDELA;KLDGLKNEGL;NSVKELTSPV
A0211
KLDGLKNEGL;KITDSNAVLL;VLLAVKEVEA;EMLANSVKEL;SIDELAAKAI;LLAGAYAIST;VLSKA
AKEML;SVKELTSPVV;ALLMTLFLFL;LLAVKEVEAL;LLSSIDELAA;KLFESVEVLS;TLIKQKLDGL
;ALLSSIDELA;LLAGAYAIS;MLANSVKELT;LKTLFLFLSC;AISTLIKQKL;LSAILMTLFL;NTLS
AILMTL;SVKGPNLTEI
A0212
KLDGLKNEGL;VLLAVKEVEA;LLAVKEVEAL;TLIKQKLDGL;VLSKAAKEML;LLSSIDELAA;LLAGA
YAIST;EMLANSVKEL;SVKELTSPVV;SIDELAAKAI;ALLSSIDELA;LLAGAYAIS;AILMTLFLFL
A0216
KLDGLKNEGL;VLSKAAKEML;VLLAVKEVEA;LLAGAYAIST;TLIKQKLDGL;LLAVKEVEAL;EMLAN
SVKEL;SVKELTSPVV;KITDSNAVLL;ALLSSIDELA;LLSSIDELAA;ALLMTLFLFL;MLANSVKELT
;AISTLIKQKL;SVKGPNLTEI;
A0219
KLDGLKNEGL;VLSKAAKEML;LLAGAYAIST;LLAVKEVEAL;EMLANSVKEL;NTLSAILMTL;TLIKQ
KLDGL;VLLAVKEVEA
A0301 GAYATSTLIK;TLKTNGTKLK;KTKGAFELGK;GLKMFGLKEK
A1101
GAYATSTLIK;SANSADESVK;SVEVLSKAAK;TSPVVAESPK;KTKGAFELGK;DSNAVLLAVK;YATST
LTKQK;LSSIDELAAK;RTFTNKLKEK;QSETFTNKLK;FTAAKATGKK
A2301 SAILKTLFLF;LFTSGNNSGK
A2402 SAILMTLFLF
A2403
A2601
A2602 EVLSKAAKEM;RTFNNHKQSL
A2902
A3001
KTKGAFELGK;ILKTNGTKLK;GAYATSTLIK;SVEVLSKAAK;TSPVVAESPK;KGPNLTEISK;
A3002 TLSAILMTLF;
A3101
A3301

Fig. 41 continued

A6801
FTFTNKLKEK;KTAAKATGKK;YATSTLTKQK;FATLKTNGTK;DSNAVLLAVK;TSPVVARSPK;SANSA
DESVK;GAYATSTLTK;CSETFTNKLK;LFTSCNNSCK;LSSTDETAAK;SVEVLSKAAK
A6802
TSANSADESV;NSVKELTSPV;LSATLMTLFL;NTLSATLMTL;NAVLLAVKEV;ESVEVLSKAA;AGAYA
TSTLT;SSTDETAAKA
A6901 NTLSATLMTL;EMLANSVKET;EALLSSTDET;EVLSKAAKEM
B0702
B0801
B0802
B1501
B1801 KEVEALLSSI;
B2705
B3501 SATLMTLFLF;
B3901
B4001 KEVEALLSSI;TENNHNGSLL
B4002 TENNHNGSLL
B4102
B4403
B4501
B5101
B5301 SATLMTLFLF
B5701
B5701B5801 SATLMTLFLF

Allele 11-mer
A0101
A0201
TLSATLMTLFL;LLAGAYATSTL;ALLSSTDETAA;VLLAVKEVEAL;KITDSNAVLLA;LLAVKEVEALL
;SLLAGAYATST;ITDSNAVLLAV
A0202
TLSATLMTLFL;LLAGAYATSTL;LLAVKEVEALL;VLLAVKEVEAL;FLFTSCNNSCK;KAAKEMLANSV
;ELGKLFESVEV;LSSTDETAAK;ALLSSTDETAA;VLSKAAKEMLA;LAGAYATSTLT;NTSANSADESV
;TIMTLFLFTSC
A0203
LLAGAYATSTL;TLSATLMTLFL;LLAVKEVEALL;KAAKEMLANSV;VLSKAAKEMLA;SVKELTSPVVA
;ALLSSTDETAA;VLLAVKEVEAL;MLANSVKETS;ELGKLFESVEV;TIMTLFLFTSCA0204
LLAGAYATSTL;VLLAVKEVEAL;LLAVKEVEALL;TLSATLMTLFL;SLLAGAYATSTA0206
KAAKEMLANSV;TLSATLMTLFL;LLAGAYATSTL;ALLSSTDETAA;SATLMTLFLFT;ITDSNAVLLAV
;SLLAGAYATST;TIMTLFLFTSC;YATSTLTKQKL;KITDSNAVLLA;VLLAVKEVEAL
A0211
TLSATLMTLFL;LLAGAYATSTL;SLLAGAYATST;ELGKLFESVEV;VLLAVKEVEAL;ITDSNAVLLAV
;ALLSSTDETAA;LLAVKEVEALL;KITDSNAVLLA;VLSKAAKEMLA;KLFESVEVLSK;TIMTLFLFTS
C;KIDGLKNEGLK;KAAKEMLANSV;GVTRADAKEAT;YATSTLTKQKL
A0212
VLLAVKEVEAL;LLAGAYATSTL;ELGKLFESVEV;TLSATLMTLFL;SLLAGAYATST;ITDSNAVLLAV
;LLAVKEVEALL;ALLSSTDETAA;VLSKAAKEMLA;LLMTLFLFTSC
A0216
LLAGAYATSTL;ELGKLFESVEV;TLSATLMTLFL;SLLAGAYATST;LLAVKEVEALL;VLLAVKEVEAL
;ALLSSTDETAA;VLSKAAKEMLA;ITDSNAVLLAV
A0219
LLAGAYATSTL;TLSATLMTLFL;VLLAVKEVEAL;ITDSNAVLLAV;ELGKLFESVEV;SLLAGAYATST
;NTSANSADESV;ALLSSTDETAA;LLAVKEVEALL
A0301
KLFESVEVLSK;FLFTSCNNSCK;TLTEQKLDGLK;KIDGLKNEGLK;KLREKHTDLGK;ALLKTNGTKTK
;GLKEKIDAAKK;LTSPVVARSPK;LLSSTDETAAK

Fig. 41 continued

```
A1101
KLFESVEVLSK;TSANSADFSVK;LTSPVVAESPK;TLIKQKLDGLK;TSPVVAESPKK;ATLKTYQIKIK
;AAKEMLANSVK;KLDGLKNFGLK;FLFTSGNNSGK;LLSSTDFTAAK
A2301 AYATSTLIKQK;NILSATLMTLF
A2402
A2403
A2601
A2602 EVLSKAAKEML;STFNNHNGSLL;NILSATLMTLF
A2902
A3001
KLFESVEVLSK;KLKFKHTDLGK;LTSPVVAESPK;ATLKTYQIKIK;AAKEMLANSVK;TSPVVAESPKK
;KGSETFINKLK
A3002
A3101
A3301
A6801
ESVEVLSKAAK;LTSPVVAESPK;TSANSADFSVK;FLFTSGNNSGK;TSPVVAESPKK;TLIKQKLDGLK
;ELFTNKLKEKH;LLSSTDFTAAK
A6802
NTSANSADFSV;TLSATLMTLFL;SATLMTLFLFT;ELAAKAIGKKL;ESVKGPKLIEI;ELGKLFESVEV
;NGSLLAGAYAL;
A6901 LLDSNAVLLAV;EVLSKAAKEML;ELGKLFESVEV;NTSANSADFSV;ELAAKAIGKKL
B0702
B0801
B0802
B1501
B1801 VEVLSKAAKEM
B2705
B3501 KHNGSLLAGAY
B3901
B4001 KEMLANSVKEL;AEELGKLFESV;
B4002 KEMLANSVKEL
B4402
B4403
B4501 AEELGKLFESV
B5101
B5301 SATLMTLFLFT
B5401
B5701
B5801 LSATLMTLFLF

Allele 15-mer plus 9-mer core
DRB1_0101
GSLLAGAYATSTLIK-LAGAYATST;FNGSLLAGAYATSTL-LAGAYATST;NGSLLAGAYATSTLI-
LAGAYATST;HNGSLLAGAYATST-LLAGAYATS;SLLAGAYATSTLIKQ-
LLAGAYATST;LLAGAYATSTLIKQK-LAGAYATST;LAGAYATSTLIKQKL-
LAGAYATST;ANSVKELTSPVVAES-VKELTSPVV;NSVKELTSPVVAESP-
VKELTSPVV;LANSVKELTSPVVAE-VKELTSPVV;MLANSVKELTSPVVA-
VKELTSPVV;EMLANSVKELTSPVV-MLANSVKEL;SVKELTSPVVAESPK-
VKELTSPVV;VKELTSPVVAESPKK-VKELTSPVV;SVEVLSKAAKEMLAN-
VLSKAAKEM;ESVEVLSKAAKEMLA-VLSKAAKEM;VEVLSKAAKEMLANS-
VLSKAAKEM;FESVEVLSKAAKEML-VLSKAAKEM;EVLSKAAKEMLANSV-
VLSKAAKEM;LFESVEVLSKAAKEM-SVEVLSKAA;VLSKAAKEMLANSVK-
VLSKAAKEM;LAVKEVEALLSSIDE-VKEVEALLS;LLAVKEVEALLSSID-
VKEVEALLS;AVLLAVKEVEALLSS-VKEVEALLS;VLLAVKEVEALLSSI-
VKEVEALLS;NAVLLAVKEVEALLS-LAVKEVEAL;SRRITGNAVLLAVK
```

Fig. 41 continued

```
TTDSNAVLL;TSKKTTDSNAVLLAV-TTDSNAVLL;KKTTDSNAVLLAVK-
TTDSNAVLL;MKKNTLSATLMTLFL-KNTLSATLK;NTLSATLMTLFLFTS-
LSATLMTLF;AKEATLKTNGTKTKG-LKTNGTKTK;DAKEATLKTNGTKTK-
EATLKTNGT;ETSKKTTDSNAVLLA-TTDSNAVLL;KNTLSATLMTLFLFT-
LSATLMTLF;KAAKEMLANSVKELT-AKEMLANSV;TLSATLMTLFLFTSC-
LMTLFLFTS;TETSKKTTDSNAVLL-KKTTDSNAV;EATLKTNGTKTKGAE-
LKTNGTKTK;KEATLKTNGTKTKGA-LKTNGTKTK;KELTSPVVAESPKK-
LTSPVVAES;LSATLMTLFLFTSCN-LMTLFLFTS;SKAAKEMLANSVKEL-
AKEMLANSV;SATLMTLFLFTSCNN-LMTLFLFTS;KKNTLSATLMTLFLF-
LSATLMTLF;CCHNGSLLAGAYATS-SLLAGAYAT;ATLKTNGTKTKGAEE-
LKTNGTKTK;AAKEMLANSVKELTS-MLANSVKEL;VKEVEALLSSTDET-
VKEVEALLS;AKEMLANSVKELTSP MLANSVKEL;ALLMTLFLFTSCNNS
LMTLFLFTS;AVKEVEALLSSTDET-VKEVEALLS;KTTDSNAVLLAVKEV-
TTDSNAVLL;TTDSNAVLLAVKEVE TTDSNAVLL;EGVTDADAKEAILKT
VTDADAKEA;KEGVTDADAKEAILK-VTDADAKEA;ADESVKGPNLTETSK-
VKGPNLTEI;LGKEGVTDADAKEAI VTDADAKEA;DLGKEGVTDADAKEA
LGKEGVTDA;GKEGVTDADAKEAIL VTDADAKEA;SADESVKGPNLTETS
VKGPNLTEI;DESVKGPNLTEISKK VKGPNLTEI;ESVKGPNLTEISKKL
VKGPNLTEI;ILKTNGTKTKGAEEL LKTNGTKTK;NSADESVKGPNLTEI
ESVKGPNLT;LKTNGTKTKGAEELG LKTNGTKTK;GGIDELAAKAIGKKL
IDELAAKAI;LSKAAKEMLANSVKE AKEMLANSV;KEMLANSVKELTSPV
MLANSVKEL;LGGIDELAAKAIGKK IDELAAKAI;AGAYAISTLLKQKLD YAISTLLKQ
DRB1_0301
DRB1_0401
DRB1_0404 ILMTLFLFTSCNNSG FLFTSCNNS;LMTLFLFTSCNNSGK
LFTSCNNSG;MTLFLFTSCNNSGKD LFTSCNNSG;TLFLFTSCNNSGKDG
LFTSCNNSG;LFLFTSCNNSGKDGN LFTSCNNSG;KEALLKTNGTKTGA
ILKTNGTKT;AKEALLKTNGTKTKG LLKTNGTKT;EALLKTNGTKTGAE ILKTNGTKT
DRB1_0405 LAVKEVEALLSSIDE VKEVEALLS;ANSVKELTSPVVAES
VKELTSPVV;LANSVKELTSPVVAE VKELTSPVV;NSVKELTSPVVAESP
VKELTSPVV;LLAVKEVEALLSSID VKEVEALLS;
DRB1_0701 MLANSVKELTSPVVA-VKELTSPVV;ANSVKELTSPVVAES-
VKELTSPVV;LANSVKELTSPVVAE-VKELTSPVV;EMLANSVKELTSPVV-
SVKELTSPV;NSVKELTSPVVAESP-VKELTSPVV;SVKELTSPVVAESPK-
VKELTSPV

DRB4_0101
DRB5_0101 KQKLDGLKNEGLKEK-KQKLDGLKN;DGLKNEGLKEKIDAA-
LKNEGLKEK;QKLDGLKNEGLKEKI-LKNEGLKEK;KLDGLKNEGLKEKID-
LKNEGLKEK;LDGLKNEGLKEKIDA-LKNEGLKEK

<CAH10086 CRASP-1;Protein;Borrelia garinii>
SEQ ID NO:174054-174491
Allele 8-mer
A0101
A0201 ILTTILTL;KLNILTTI;ILNETIKA;TILTLICI;TLICISCA;ILNISIKI
A0202 KLNILTTI;ILTTILTL;ILNETIKA;TLICISCA;ILNISIKI
A0203
KLNILTTI;ILNETIKA;TLICISCA;ILTTILTL;ILNISIKI;LICISCAV;KINTLKEI;SIKIQFQI
;NIIKLNIL
A0204 KLNILTTI;ILTTILTL
A0206 FQIENALE;IQFQIENA;ILTTILTL;KLNILTTI;TLICISCA;LICISCAV
A0211
ILTTILTL;ILNETIKA;KLNILTTI;ILNISIKI;KLYKNHKY;TILTLICI;LICISCAV;TLICISCA
;TISEDIEM;KINTLKEI
A0212 ILTTILTL;ILNETIKA;KLNILTTI;KLYKNHKY;LICISCAV;HMDENYKE
A0216
ILTTILTL;KLNILTTI;ILNETIKA;LICISCAV;TLICISCA;QIENALEL;KLYKNHKY;ILNISIKI
;EIEKINTL
A0219 ILTTILTL;ILNETIKA
A0301
IIYSSLNY;KLYKNHKY;FILNISIK;KILNETIK;KTKLNIIK;TIISKLEK;SLNYEIEK;TLKEILDK
;
A1101
TIISKLEK;SLNYEIEK;KTKLNIIK;IIYSSLNY;KILNETIK;EILDKLYK;FILNISIK;NTKDFENK
;ISEDIEMK;CISCAVDK;TLKEILDK
A2301 LYKNHKYK;NYKEFQPL
A2402 NFILNISI
A2403 QFQIENAL
A2601 EILNQERY
A2602 EILNQERY;IIYSSLNY;TTARNFIL;EIEKINTL;NIIKLNIL;TISEDIEM;QIDFLENF
A2902 KLYKNHKY;IIYSSLNY
A3001 KTKLNIIK;LYKNHKYK;KILNETIK;
A3002 IIYSSLNY
A3101 LYKNHKYK;KTKLNIIK;KIKRIIYS;
A3301 DIEMKIKR
A6801
NTKDFENK;TIISKLEK;FILNISIK;EILDKLYK;CISCAVDK;ETIKAYNQ;DIEMKIKR;SLNYEIEK
;ISEDIEMK;ENALELMK;RKYKTTAR;ERYEILLK;NLKQKFEK;EPSNTKNK
A6802 TTARNFIL;YSSLNYEI;EIAKITNT;TLICISCA;LTTILTLI
A6901 TILTLICI;TTARNFIL
B0702
B0801
B0802
B1501 KLYKNHKY;IIYSSLNY
B1801 QERYEILL;KEFDPLNL;YEILLKHV
B2705 KRIIYSSL;ERYEILLK
B3501 LAHMDENY;TISEDIEM
B3901 TTARNFIL;NQERYEIL
B4001 KEFDPLNL;QERYEILL;IEDASEIL;FENKSQDL;KETIISKL;YEILLKHV;LEKMIKDL
B4002 KEFDPLNL;QERYEILL;FENKSQDL
B4402 KEILDKLY;

Fig. 41 continued

B4403 KFILEKLY;KFPPPLNL
B4501
B5101
B5301
B5401
B5701
B5801 TTNTQIDF

Allele 9-mer
A0101
A0201 FLLNISIKI;ILTTILTLI;TLICISCAV;FQIENALEL;SLNYEIEKI;KLNILTTIL;NILTTILTL;KILNETIKA;KLNITKINI
A0202 ILTTILTLI;KLNILTTIL;TLKEILDKL;SLNYEIEKI;TLICTSCAV;IQFQIENAL;ILNQERYEI;FQIENALEL;ITNTQIDFL;FLLNISIKI;KLNIIKLNI;CISCAVDKI;LLKHVEPSL
A0203 ILTTILTLI;TLICISCAV;KLNILTTIL;TLKEILDKL;SLNYEIEKI;LMKEIEDA;LLKHVEPSL;ILNQERYEI;NLKQEIEKI;KLNIIKLNI;FLLNISIKI;FQIENALEL;CISCAVDKI;KIQFQIENA
A0204 FQIENALEL;ILNQERYEI
A0206 FQIENALEL;TLICISCAV;IQIDFLENF;FLLNISIKI;YEIEKINTL;ILTTILTLI;IQFQIENAL;NILTTILTL;KILNETIKA;IKLNILTTI
A0211 TLICISCAV;ILNQERYEI;ILTTILTLI;FLLNISIKI;TLKEILDKL;KLNILTTIL;NILTTILTL;KLNIIKLNI;LLKHVEPSL;SLNYEIEKI;HFDENYKEF;KILNETIKA;FQIENALEL;ILNETIKAY;ILTLICISC;ALELMKEEI
A0212 LLKHVEPSL;TLICISCAV;TLKEILDKL;FLLNISIKI;NILTTILTL;FQIENALEL;ILNQERYEI;LMKEIEDA;ILTTILTLI;KLNILTTIL;SLNYEIEKI;HFDENYKEF;KLNIIKLNI
A0216 TLICTSCAV;LLKHVEPSL;ILNQERYEI;TLKEILDKL;ILTTILTLI;NILTTILTL;FLLNTQIKI;KLNILTTI;ALELMKEEI;KLNITKINI
A0219 NILTTILTL;TLICTSCAV;ILTTILTLI;ILNQERYEI;LLKHVEPSL
A0301 KLYKNHKYK;RTIYSSLNY;HVEPSLNLK
A1101 SSLNYEIEK;RTIYSSLNY;KLYKNHKYK;TISEDIEMK;HVEPSLNLK;QIDFLENFK;EILISKLEK;NTLKEILDK;NSKETIISK;MIKDLEDQK;LAHMDENYK;ISKLEKMIK
A2301 KYKTTARNF;IYSSLNYEI;NFTLNTSTK;TQIDFLENF
A2402 IYSSLNYFI;KYKTTARNF
A2403 KYKTTARNF;AYNQDLENI;HMDENYKEF;IYSSLNYEI
A2601 TTSKLEKM;DTISEDIEM
A2602 TISKLEKM;QIENALEM;DTISEDIEM;RTIYSSLNY;ETEDASETL;ITNTQIDFL;EMKTKRITY;TTTLTLTGT
A2902 EFDPLNLDY;RTIYSSLNY;QLAHMDENY
A3001 KLYKNHKYK;ISKLEKMIK;ESKSKINIK;SSLNYEIEK;LAHMDENYK;LDKLYKNHK
A3002 IYSSLNYFI;RTIYSSLNY;EFDPLNLDY;QLAHMDENY;KTTNTQIDF;KYKTTARNF
A3101 KLYKNHKYK;ASEILNQER;KIKRLIYSS;KTTARNFLL
A3301 NHKYKTTAR
A6801 ETISKLEK;LIEKINTLK;TISEDIEMK;HVEPSLNLK;MIKDLEDQK;LAHMDENYK;QIDFLENFK;ESKSKINIK;NFLLNISIK;SSLNYEIEK;EDIEMKIKR;EIAKITNIQ;NSKETIISK;NTLKEILDK;EPSLNLKQK
A6802 TLICISCAV;TTILLLICI;LSIKIQFQI;ITNTQIDFL;CISCAVDKI;FLLNISIKI;EIAKITNIQ

Fig. 41 continued

A6901 FLLNTSTKT;TLTCTSCAV;NILTTILTL;TTLLTLTCT;
B0702
B0801
B0802
B1501
TLNFTTKAY;FQTFNALEL;TQFQTENAL;RITYSSLNY;TQIDFLFNF;EMKTKRITY;QLAHMDENY
B1801 YETFKINTL;FQTFNALEL
B2705
B3501 TLNFTTKAY;TTSEDIEMK
B3901 FQTFNALEL;YKFDPLNL;YETFKINTL;KEVEPSLNL
B4001 YETFKINTL;FQTFNALEL;TQFQTENAL;
B4002 EEIEDASEI;YETFKINTL
B4402 SEILNQERY
B4403 SEILNQERY;EEIEDASEI
B4501 ETIEDASEI
B5101
B5301
B5401
B5701
B5801 ISLRIQFQI;RIIYSSLNY

Allele 10-mer
A0101 ASEILNQERY
A0201
ILLRHVEPSL;IIYSSLNYEI;FQTENALELM;NILTTILTLI;LTLICISCAV;ILTLICISCA;KINIL
TTILT
A0202
IIYSSLNYEI;FQTENALELM;LTLICISCAV;ILNQERYEIL;ILLRHVEPSL;TISEDIEMKI;KINII
KINIL;NILTTILTLI;KINIQIDFL;ILTLICISCA;KIKRIIYSSL;KAYNQIDNI;KINILTTILT
A0203
KIKRIIYSSL;IIYSSLNYEI;KLNIIKLNIL;IIKLNILTTI;ILNQERYEIL;KINILTTILT;ILLRH
VFPSL;TLTTICTSCA;NILTTILTIT;LTLICTSCAV;TTSRLRKMT
A0204 TLLRHVEPSL
A0206 FQTFNALELM;IIYSSLNYEI;TLLRHVEPSL;LTLICISCAV;NILTTILTLI;KTINTQIDFL
A0211
TLLRHVEPSL;TLNQERYEIL;IIYSSLNYEI;TTSEDIEMKT;KLYKNHKYKT;KINIIKINTL;KTINT
QIDFL;TLTTICTSCA;NILTTILTIT;KLNIITTTLT;LTLICTSCAV;FILNQERYET;NTSTKTQFQT
;KIKRIYSSL;TITTTLTICT
A0212 TLLRHVEPSL;KLYKNHKYKT;TLNQERYEIL;IIYSSLNYEI;TTSEDIEMKT;KINIIKINTL
A0216
TLLRHVEPSL;KLYKNHKYKT;TLNQERYEIL;IIYSSLNYEI;KTINTQIDFL;KINIIKINTL;KIKRT
IYSSL;PLRKNSKETI;RIAKTTNTQT;NLRQKFEKTL;ILTLICTSCA
A0219 TLLRHVEPSL;TLNQERYEIL;IIYSSLNYEI
A0301 SLNIKQKFEK;TISKLRKMTK;LICTSCAVRK;TLDKIYKNHK;TQIDFLFNFK
A1101
TQIDFLFNFK;KTNIKFENK;SLNIKQKFEK;AVDKIDPESK;EMTKDIRDQK;YSSLNYETFK;TISKL
RKMTK;LICISCAVDK;SQDLEPSNIK;QIENALELMK;QLAHMDENYK;NQERYEILLK
A2301
KYKITARNFI;NYKFDPLNL;NYEIFKINTL;AYNQIDNIK;NFILNISIRI;AHMDENYKEF;NIQID
FLFNF
A2402 KYKITARNFI;NFILNISIKI
A2403 AHMDENYKEF;QFQTENALEL;KYKITARNFI
A2601 ETISKLEKM;ETIKAYNQDI
A2602 ETISKLEKM;ETIKAYNQDL;KILNFTIKAY;NTQIDFLFNF;KIKRIIYSSL
A2902
A3001 KNKDLEPLEK;SLNLRQKFEK;KTNTKDFENK;KNHKYKITAR;KYKITARNFI

Fig. 41 continued

A3002
A3101 KNHKYKTTAR
A3301
A6801 QASFHNQER;FTISFDIFMK;YSSLNYFIFX;TQTDFLFNFK;QLAFHDFNYK;LICTSCAVDK
A6802 TTARNFTLNI;FIAKTINTQT;FTIKAYNQDL;LTLICTSCAV;TTSFDIFMKI;NTSIKIQFQT
A6901
LTLICTSCAV;TTARNFTLNI;FIAKTINTQT;NALFLMKFFI;NILTTILTL;FIINQFRYFI;FTIKA
YNQDL;FTTISKLFKM;TIYSSLNYFI
B0702
B0801
B0802
B1501 FQIFNALFLM;KLNFTIKAY
B1801 TFMKIKRTTY;KFFDPLNLDY;FFIFDASFII;
B2705 KRIIYSSLNY
B3501 FPSLNLKQKF
B3901 YKTTARNFII
B4001 FFIFDASFII
B4002 FFIFDASFII;KFFDPLNLDY;
B4402 KFFDPLNLDY
B4403 KFFDPLNLDY;FFIFDASFII;
B4501 FFIFDASFII
B5101
B5301 FPSLNLKQKF
B5401
B5701
B5801 KSHFDQLAHH

Allele 11-mer
A0101 ILDKLYKNFKY
A0201
ILTTILTLICT;KLNILTTILTL;ILTLICTSCAV;RIIYSSLNYFI;ILNQFRYFILL;NIIKLNILTTI
A0202
TLNQFRYFIL;ILTLICTSCAV;KLNILTTILTL;ILTTILTLICT;SLNLKQKFFKI;TQFQTFNALFL
;KLNITIKLNTLT;LLKHVEPSLNL
A0203
KLNILTTILTL;ILTLICTSCAV;LLKHVEPSLNL;ILTTILTLICT;SLNLKQKFFKI;NITKLNILTTI
;ILNQFRYFILL;STKTQFQTFNA;RIIYSSLNYFI;TTKLNTLTTIL;MKTKRTTYSSL;ILNFTIKIQF
Q;KLYKNHKYKTT
A0204 KLNILTTILTL;ILNQFRYFIL
A0205
RIIYSSLNYFI;TQFQTFNALFL;NTTKLNILTTI;ILTLICTSCAV;TQIDFLFNFKS;FIINTSIKIQF
;ILTTILTLICT;MKTKRTTYSSL
A0211
ILTLICTSCAV;ILNQFRYFIL;KLNILTTILTL;ILTTILTLICT;LLKHVEPSLNL;SLNLKQKFFKI
;KLNITIKLNLT;KLYKNHKYKTT;ILDKLYKNFKY;ILNFTIKAYNQ;NITKLNILTTI;FIINTSIKIQ
F;FILLKHVEPSL
A0212
ILTLICTSCAV;ILNQFRYFIL;LLKHVEPSLNL;KLNILTTILTL;ILTTILTLICT;KLYKNHKYKTT
;ILNFTIKAYNQ
A0216
ILTLICTSCAV;ILNQFRYFIL;KLNILTTILTL;LLKHVEPSLNL;ILTTILTLICT;KLYKNHKYKTT
;NIIKLNILTTI;FILLKHVEPSL
A0219 ILTLICTSCAV;ILTTILTLICT;ILNQFRYFIL;KLNILTTILTL
A0301 KLNILKLILDK;TLICTSCAVDK;TLKFILDKLYK;TLLSKLFKMIK;KAYNQDLDWIK
A1101
TLLSKLFKMIK;KSQDLFPSNIK;NTQIDFLFNFK;TLICTSCAVDK;KLNILKLILDK;KAYNQDLDWIK

Fig. 41 continued

; TLKETLDKLYK;TTSEDTEMKTK;FQTENALELMK;HVFPSLNLKQK;PSLNLKQKFEK;TYSSLNYFTK
K;ELLDKLYKNHK
A2301 TYSSLNYFTEK;KYKTTARNFIL;NYFTEKINTLK;FTLNISIKIQF;KFFKTILNETIK
A2402 KYKTTARNFIL
A2403 KYKTTARNFIL;FTLNISIKIQF
A2601 EKTLNETIKAY;NTLKETLDKLY
A2602 DTEMKIKRTTY;ETLNQERYFTL;EKTLNETIKAY;ETTTSKLFKMI;ETILKHVFPSL
A2902 TLDKLYKNHKY
A3001 KSQDLEPSNTK;TLKFTLEKLYK;KTNTLKETLDK
A3002
A3101 TYSSLNYFTFK;TSEDTEMKTKR
A3301 ELLDKLYKNHK
A6801
NTQLDFLENFK;TLLCISCAVDK;TLISKLEKMIK;ELLDKLYKNHK;ISEDIEMKIKR;HVEPSLNLKQK
;FDASETLNQER;CAVDKIDPESK;TYSSLNYFTEK;TLKFTLDKLYK;TTSEDTEMKTK
A6802
DTISEDIEMKI;TIARNFILNIS;NIIKLNILTTI;RILYSSLNYFI;ILTLLCISCAV;MKIKRIIYSSL
A6901 EPLEKNSKETI;ETIISKLEKMI;ELLKHVFPSL;NIIKLNILTTI
B0702
B0801
B0802
B1501 IQFQIENALEL
B1801 VFPSLNLKQKF
B2705
B3501 DASETLNQERY;LAHMDENYKEF
B3901
B4001 KEELEDASEIL;GELLNQERYEI;LEKINTLKEIL;NETLKAYNQDL
B4002 GELLNQERYEI
B4402
B4403 GELLNQERYEI;LEIEDASEILN
B4501
B5101 EPLEKNSKETT
B5301 EPLEKNSKETT
B5401
B5701
B5801

Allele 15-mer plus 9-mer core
DRB1_0101 LNTIKLNTLTTILTL-LNTLTTTLT;NIIKLNTLTTILTLI-
LNTLTTILT;TIKLNTLTTILTLIC-LNTLTTLT;IKLNTLTTILTLIC-
LNTLTTTLT;KLNTIKLNTLTTLT-KLNTLTTL;KLNTLTTLTLTCIS-
LNTLTTILT;LNTLTTLTLTCISC-LNTLTTLT;NTLTTTLTLTCISCA-
LTTLTLTC;DKLYKNHKYKTTARN-YKNHKYKTT;KLYKNHKYKTTARNF-
YKNHKYKTT;LDKLYKNHKYKTTAR-YKNHKYKTT;TLDKLYKNHKYKTTA-
YKNHKYKTT;ETLDKLYKNHKYKTT-LYKNHKYKT;TKLNTLKNTLTTLI-
TKLNTLTT;DTEMKTKRTTYSSLN-MKTKRTTYS;TEMKTKRTTYSSLNY-
MKIKRIIYS;EDIEMKIKRIIYSSL MKIKRIIYS;ILTLLTLLCISCAV
LTLTCTSCA;KIQFQTENALELMKE-FQTENALEL;KTKINTTKLNILTTI-
IIKLNILTT;IQFQIENALELMKEE FQTENALEL;NQDLENIKSNEEQLA
LDNIKSNED;QDLENIKSNEDQLAH-IKSNEDQLA;IKIQFQTENALELMK-
FQTENALEL;CIKIQFQTENALELM FQTENALEL;ISIKIQFQIENALEL
IQFQIENAL;TTARNFILNISIKIQ FILNISIKI;SEDIEMKIKRIIYSS
MKIKRIIYS;ISEDIEMKIKRIIYS IEMKIKRII;YKNEKYKTTARNFIL
YKNHKYKTT;LTTILTLLCISCAVD LTLLCISCA;ARNFILNISIKIQFQ
FILNISIKI;LYKNHKYKTTARNFI YKNHKYKTT;TARNFILNISIKIQF
FILNISIKI;LDNIKSNEDQLAHMF IKSNEDQLA;DLDNIKSNEDQLAHM

Fig. 41 continued

```
TKSNEDQIA;RNFILNTSTKTQFQT-FILNTSTKT;YFTILKHVEPSLNLK-
LKHVEPSLN;FTLLKHVEPSLNLKQ-LKHVEPSLN;MKTKRTTYSSLNYFT-
MKTKRTTYS;RYFTLLKHVEPSLNL-LKHVEPSLN;TLLKHVEPSLNLKQK-
LKHVEPSLN;KKTKLNTTKLNTLTT-LNTTKLNTL;TTTLTLTCTSCAVDK-
LTLTCTSCA;KTTARNFILNTSTKT-ARNFILNTS
DRB1_0301
DRB1_0401 TTKLNTLTTLLTLTC-LNTLTTLLT;KLNTTKLNTLTTLLT-
TLKLNTLTT;TKLNTTTTLLTLTCT-LNTLTTLLT;LNTTKLNTLLTTLTL-
LNTLTTLLT;NTTKLNTLTTLTLT-LNTLTTLLT
DRB1_0404 TTKLNTLTTLLTLTC-LLTTLLLT;NTQTDFLENFKSEPH-FLENFKSEP
DRB1_0405 YFTFKTNTLKFTLDK-TFKTNTLKF;NYFTEKTNTLKFTLD-
TEKTNTLKF;IFKTNTLKFTLDKLY-TNTLKFTLD;FLFKTNTLKFTLDKL-
TNTLKFTLD;SSLNYFTEKTNTLKF-YFTEKTNTL;TTKTNTLTTTLTLTC-
LNTLTTLLT;IKLNLTTTLTLTCT-LNTLTTLLT;CLNYFIEKTNTLKFT-
TEKTNTLKF;LNYFTEKTNTLKFTL-TFKTNTLKF;KAYNQDLDNTKSNFD-
YNQDLDNIK;AYNQDLDNIKSNFDQ-LDNIKSNFD;HFDENYKFFDFLNLD-
YKFFDFLNL;MKIKRLLYSSLNYFT-KRLLYSSLN;KDENYKFFDFLNLDY-
KFFDFLNLD;YNQDLDNIKSNFDQL-LDNIKSNFD;ISLKIQFQLENALEL-
LKIQFQLEN;ETLKAYNQDLDNIKS-LKAYNQDLD
DRB1_0701 YKNHKYKTTARNFIL-YKTTARNFI;NHKYKTTARNFILNI-
YKTTARNFI;KNHKYKTTARNFILN-YKTTARNFI;LYKNHKYKTTARNFI-
KYKTTARNF;HKYKTTARNFILNIS-YKTTARNFI;KYKTTARNFILNISI-
YKTTARNFI;KLYKNHKYKTTARNF-YKNHKYKTT
DRB1_0802
DRB1_0901 YKNHKYKTTARNFIL-YKTTARNFI;LYKNHKYKTTARNFI-
NHKYKTTAR;NHKYKTTARNFILNI-YKTTARNFI;KNHKYKTTARNFILN-
YKTTARNFI;HKYKTTARNFILNIS-YKTTARNFI
DRB1_1101
DRB1_1202 LNLLKLNLTTTLTL-LNLTTTLLT;NLLKLNLTTTLTLL-
LNLTTTLLT;LKLNLTTTLTLC-LNLTTTLLT;KLNLLKLNLTTTLLL-
LKLNLTLT;IKLNLTTTLTLTCT-LNLTTTLLT;KLNLLTTLLTLCLS-
LNLTTTLLT;LNTLTTLLTL-TCTSC-LNLTTTLLT;KTKLNTTKLNTLTTT-
LNTTKLNTL;TKLNTTKLNTLTTTL-TKLNTTTTT;RNFILNTSTKTQFQT-
FLLNTSTKT;TARNFILNTSTKTQF-FLLNTSTKT;KKTKLNTTKLNTLTT-
LNTTKLNTL;ARNFILNTSTKTQFQ-FLLNTSTKT;NFILNTSTKTQFQTF-
LNTSTKTQF;TTARNFILNTSTKTQ-FLLNTSTKT;MKTKLNTTKLNTLTT-
LNTTKLNTL;FTLNTSTKTQFQTFK-LNTSTKTQF;KTTARNFILNTSTKT-
ARNFILNTS;FTLDKLYKNHKYKTT-LYKNHKYKT;TLDKLYKNHKYKTTA-
YKNHKYKTT;LYKNHKYKTTARNFI-YKNHKYKTT;LDKLYKNHKYKTTAR-
YKNHKYKTT;FDIFMKTKRTTYSSL-MKTKRTTYS;DKLYKNHKYKTTARN-
YKNHKYKTT;TLNTSTKTQFQTFMK-LNTSTKTQF;TFMKTKRTTYSSLNY-
MKTKRTTYS;DTFMKTKRTTYSSLN-MKTKRTTYS;HKYKTTARNFILNTS-
YKTTARNFI;SFDTFMKTKRTTYSS-MKTKRTTYS;TSFDTFMKTKRTTYS-
TFMKTKRTT;KLYKNHKYKTTARNF-YKNHKYKTT;YKTTARNFILNTSTK-
ARNFILNTS;YKNHKYKTTARNFTL-YKNHKYKTT;KYKTTARNFILNTSI-
ARNFILNTS;FMKTKRTTYSSLNYF-MKTKRTTYS;MKTKRTTYSSLNYFT-
MKTKRTTYS;LNISLKIQFQLENAL-LNISLKIQF;ERYFTLLKHVEPSLN-
YFTLLKHVE;NYFTEKTNTLKFTLD-FKTNTLKFT;YFTFKTNTLKFTLDK-
INTLKFTLD;NLLTTLLTLCLSCA-LLTTLLLT;LNYFIEKTNTLKFIL-
YFTEKTNTL;RYFTLLKHVEPSLNL-LKHVEPSLN;SLNYFTEKTNTLKFT-
YFTEKTNTL;YFLLKHVEPSLNLK-LKHVEPSLN;LLTTLLTLCLSCAV-
LLTTLLLT;KFLDKLYKNHKYKT-LDKLYKNHK
DRB1_1501 NTQIDFLENFKSEPH-IDFLENFKS;TQIDFLENFKSEPHD-
LENFKSEPH;IDFLENFKSEPHDTI-LENFKSEPH;QIDFLENFKSEPHDT-
LENFKSEPH;DFLENFKSEPHDTIC-LENFKSEPH;IFMKIKRLLYGLNY-
MKIKRLLYS;FDTFMKIKRLLYGGL-MKIKRLLYS;DTFMKIKRLLYGGLN-MKIKRLLYS
```

Fig. 41 continued

DRB3_0101
DRB4_0101
DRB5_0101 YKNHKYKTTARNFIL-YKTTARNFI;LYKNHKYKTTARNFI-
YKNHKYKTT;DKLYKNHKYKTTARN-YKNHKYKTT;KLYKNHKYKTTARNF-
YKNHKYKTT;EILDKLYKNHKYKTT-LDKLYKNHK;LDKLYKNHKYKTTAR-
YKNHKYKTT;ENKSQDLEPSNTKNK-QDLEPSNTK;NKSQDLEPSNTKNKD-
LEPSNTKNK;KSQDLEPSNTKNKDL-LEPSNTKNK;ILDKLYKNHKYKTTA-
YKNHKYKTT;SQDLEPSNTKNKDLE-LEPSNTKNK;QDLEPSNTKNKDLEP-LEPSNTKNK

<AAU07022 4-alpha-glucanotransferase;Protein;Borrelia garinii PBi>
SEQ ID NO:174492-176082
Allele 8-mer
A0101
A0201
QMFAYSPI;LLDFASFV;ILLNISSL;FIDSDLNL;YIFDYLNT;YAFNGLWV;ILSKEIKV;VMNLPLFI
;FAGNVYYI;VLFDRGIL;GISPDYFL;ILRKYIDV;SLPSKYGI
A0202
LLDFASFV;GISPDYFL;ILSKEIKV;QMFAYSPI;FVNSLDDL;FIDSDLNL;ILLNISSL;ALNFINRA
;FLFASSQS;SLPSKYGI;NISFITRL;FAGNVYYI;ILNEIKDL;VLFDRGIL;FDSDNQNL;FSAFAGN
V;YIFDYLNT;VAFKEYFL;FFSQFQAL;ILRKYIDV;SVSDSVII;VMNLPLFI;YAFNGLWV;FIDFLF
AS;MSSVSDSV;KKSSYWLL;YYIDLEAL
A0203
ALNFINRA;LLDFASFV;ILRKYIDV;QMFAYSPI;ILLNISSL;ILSKEIKV;VMNLPLFI;SLPSKYGI
;VLFDRGIL;YAFNGLWV;FLKDSRDA;ILNEIKDL;NLKRESGI;GMRIMKLA;YIFDYLNT;NISFITR
L;FAGNVYYI;FQALKRYA;GISPDYFL;SVSDSVII;FIDSDLNL;FVNSLDDL;IAYDSADV;KIRINL
NL;GIGDNSTI;FLFASSQS;ELVMNLPL
A0204
LLDFASFV;YAFNGLWV;ILSKEIKV;VMNLPLFI;ILLNISSL;VLFDRGIL;FAGNVYYI;QMFAYSPI
A0206
YAFNGLWV;LLDFASFV;WLLDFASF;FIDSDLNL;FQALKRYA;QMFAYSPI;FAGNVYYI;ILLNISSL
;WQMFAYSP;YIFDYLNT;LQYFFFSQ;SQSYWQMF;GISPDYFL;NTNEDFVV;KEIKVQEV;KEAALNF
I;KFIDFLFA;ILSKEIKV;YYIDLEAL;YSIFSAFA;FIDFLEAS;FVNSLDDL;SVSDSVII
A0211
LLDFASFV;YAFNGLWV;ILLNISSL;ILSKEIKV;VLFDRGIL;SLDDLHKK;GISPDYFL;SLPSKYGI
;FIDSDLNL;PMQDYINL;WLLDFASF;QMFAYSPI;YIFDYLNT;ELVMNLPL;ILRKYIDV;VMNLPLF
I;DLEDVSRL;ILNEIKDL;SVSDSVII;GIGDNSTI;NLGNEFRA;ALNFINRA;NTNEDFVV;YYIDLE
AL;IAYDSADV;FLFASSQS;GFVSTWEV;DLFKLRNI;FLKDSRDA;RLRDFFNF;NLPLFIAY;KFIDF
LFA;NISFITRL;IKDLKIWV;FAGNVYYI
A0212
LLDFASFV;YAFNGLWV;ILSKEIKV;ILRKYIDV;ILLNISSL;VLFDRGIL;PMQDYINL;FIDSDLNL
;YIFDYLNT;SLPSKYGI;SLDDLHKK;QMFAYSPI;ILNEIKDL;WLLDFASF;YYIDLEAL;GISPDYF
L;VMNLPLFI;FLKDSRDA;ELVMNLPL;GIGDNSTI;IAYDSADV;DLEDVSRL;FFSQFQAL;FLFASS
QS;RLRDFFNF;FENDLEDV;VAFKEYFL
A0216
LLDFASFV;ILSKEIKV;ILLNISSL;YAFNGLWV;ILRKYIDV;VLFDRGIL;GISPDYFL;PMQDYINL
;DLEDVSRL;ELVMNLPL;QMFAYSPI;SLPSKYGI;NLGNEFRA;GIGDNSTI;FIDSDLNL;ALNFINR
A;VMNLPLFI;YIFDYLNT;SLDDLHKK;GFVSTWEV;FAGNVYYI;WLLDFASF;FLFASSQS;ILNEIK
DL;IAYDSADV;VAFKEYFL;NISFITRL
A0219
LLDFASFV;ILLNISSL;YAFNGLWV;ILSKEIKV;FIDSDLNL;PMQDYINL;DLEDVSRL;VMNLPLFI
;WLLDFASF;VLFDRGIL;SLPSKYGI;GISPDYFL;SLDDLHKK;ILRKYIDV;IAYDSADV;ELVMNLP
L
A0301
KLRNILSK;RSFEKFKK;KLRFDASK;TLNNWIFR;FSQFQALK;FASFVAFK;NISSLPSK;RINLNLKR
;KVQEVLQY;ISFITRLY

Fig. 41 continued

A1101
RSFKFKK;TLNKWIFR;FASFVAFK;NISSLPSK;FSQFQALK;AALNFINR;STLTRNK;SLDDLKK
;AYSWNVLK;KVQEVLQY;NSLDDLKK;AFNGLRVR;SQFQALKR;SFKDKFLK;AFKEYFLK;KLRNILS
K;WAHQKYFK;SAFAGNVY;RTNLNLKR;TSFITRLY
A2301
QYFFFSQF;PYSTFSAF;KYIDVIKI;AYKFIDFL;AYSWNVLK;NTLNNYIF;VWAHQKYF;YYIDLFAL
;EVLQYFF;AYAFNGLW;RYSDLKKI;DVIKIDHF;RLRDFFNF;IMKIAFDF;RYANDKGT;DFASFVA
F;GAYKFIDF;AYDSADVW;WLLDFASF;TLSKNISF;NFTLNRTK;AFKEYFLK;SFKDKFLK;FAYSPT
DF
A2402
KYIDVIKI;PYSTFSAF;QYFFFSQF;YYIDLFAL;DFASFVAF;VWAHQKYF;AYAFNGLW;AYKFIDFL
;RYANDKGT;AYSWNVLK;EVLQYFF;WWAKRIGI;LVKNLPLF
A2403
QYFFFSQF;YYIDLFAL;AYDSADVW;AYKFIDFL;AYAFNGLW;RSFFYSLF;KYIDVIKI;RFLKEAAL
;RYANDKGT;VWAHQKYF;PYSTFSAF;RYSDLKKL;EVLQYFF;SYWQMFAY;FVAFKEYF;DFASFVA
F;FSQFQAL
A2601 YIKNGIVY;DVIKIDHF;EVLQYFF;DVWAHQKY;EVGVGEAY;NVLKNVKY
A2602
EVLQYFF;DVIKIDHF;EVGVGEAY;VIIFMQDY;YIKNGIVY;DVWAHQKY;EVRSFEKS;EVAFKEYF
;ELKVQEVL;DVSRLRDF;EIKDLKIW;ELVKNLPL;KVQEVLQY;DFASFVAF;NLPLFIAY;YINLGNF
F;NTLNNWIF;FLDSDLNL;NVLKNVKY;SVDFVRGF;LVKNLPLF
A2902
SYWQMFAY;VIIFMQDY;AFAGNVYT;YIKNGIVY;KVQEVLQY;SAFAGNVY;LFASSQSY;EVGVGEAY
;NVLKNVKY;QYFFFSQF;NLPLFIAY
A3001
KLRFDASK;KLRTLLSK;AYKEYFLK;RSFEKFKK;EFRANIFK;SFKDKFLK;LTRYSDLK;WAHQKYFK
;AFNGLWVK
A3002 RYSDLKKL;VIIFMQDY
A3101
TLNNWIFR;HQKYFKLR;VIKIDHFR;AFNVLFDR;AALNFINR;KYEWWAKR;SFKDKFLK;AFKEYFLK
;RSFEKFKK;RINLNLKR;KNLSFITR;FFNFPCMR;KLRNILSK;FITRLYGR;AFNGLWVR;SQFQALK
R;LLKENRTR;RASVDFVR;YSPTDFTR;WAHQKYFK;RLRDFFNF
A3301
RYFLKDSR;TLNNWIFR;DLKKLSFK;VIKIDFFR;HQKYFKLR;FFNFPCMR;EFRANIFK;FITRLYGR
;AFNVLFDR;KYEWWAKR;SFKDKFLK
A6801
FASFVAFK;FWWDMIR;LTRYSDLK;TLNNWIFR;FITRLYGR;FSQFQALK;YSPTDFTR;RYFLKDSR
;NISSLPSK;WAHQKYFK;VIKIDHFR;FFNFPCMR;DLKKLSFK;RSFKKFKK;NVYYIDLF;NFTLNFT
K;SQFQALKR;HQKYFKLR;TSFITRLY;RTNLNLKR;RASVDFVR;AALNFINR;NSLDDLKK
A6802
FAYAFNGL;FSAFAGNV;NTNRDFVV;MSSVSDSV;NISFITRL;QMFAYSPT;YSTFSAPA;NRASVDFV
;NSTTRFFV;WTVYTST;FAGNVYYT;SPAYSWNV;QSYWQMFA;TRSPPYST;YAFNGLWV;SVDSSVT
T;DSRDAFNV
A6901
YAFNGLWV;FAYAFNGL;NTNRDFVV;FSAFAGNV;SPAYSWNV;QMFAYSPT;FAGNVYYT;QSYWQMFA
;FLVKNLPL
B0702 SPAYSWNV
B0801 WAKRIGI
B0802
B1501
SAFAGNVY;SQSYWQMF;YINLGNEF;YIKNGIVY;WLLDFASF;LFKLAFDF;RLRDFFNF;NQNLPFNY
;LSFITRLY;KVQEVLQY;VQEVLQYF;YLNERDF;QMFAYSPT;TLSKNISF;QAWRSPAY;LFASSQS
Y;LVKNLPLF
B1801 QEVLQYFF;YEWWAKRI;WEVGVGEA
B2705 KRIGILRK;DRIKKLAF

Fig. 41 continued

B3501
QARDSPAY;SAFAGNVY;FVGVGFAY;SYWQMFAY;YINLCNEF;DFASFVAF;EVLQYFF;FFSQFQAL
;DWAHQKY;WLLDFASF;LVMNLPLF;FAYSPTDF;LFASSQSY;FVAFKFYF;YIKNCLVY;FASSQSY
W;
B3901   SRDAFKVL;TREFVNSL
B4001   VEDFEKDL;QFVLQYFF;NETRYSDL;RDFFNFTL;KEKDLFKL
B4002   QFVLQYFF;KFTKVQFV
B4402   QFVLQYFF
B4403   QFVLQYFF
B4501
B5101
B5301   FASSQSYW;FAGNVYYL
B5401   PPYSTFSA;LPLFTAYD
B5701
B5801   FASSQSYW;SSYWLLDF;FAYSPTDF

Allele 9-mer
A0101 FCAFAGNVY;YSDLKKLSF;SLDDLEKKY
A0201
TLNNWIFRL;WLLDFASFV;YLNTNEDFV;VLFDRGILL;FVSTKEVGV;FIDSDLNLL;AMSSVSDSV;F
IAYDSADV;LVKDLPLFI;TLSKNISFL;LLDFASFVA;FVAFKFYFL;RLLESDLDA;SQSYKQMFA;NI
LSKEIKV;VLLPMQDYI;FLLNEIKDL;YIKNCIVYT;VVWDMIRSA;VMNLPLFIA;WQMFAYSPI
A0202
YLNTNEDFV;FIDSDLNLL;FVAFKFYFL;AMSSVSDSV;TLSKNISFL;FVSTWEVGV;KIRSAMSSV;W
LLDFASFV;TLNNWIFRL;KLSFKDKFL;FIAYDSADV;VLFDRGILL;GAYKFIDFL;VLLPMQDYI;FF
NFLLNEI;ILRKYIDVI;WQMFAYSPI;LLDFASFVA;FFSQFQAL;LVMNLPLFI;FLFASSQSY;TLR
EFVNSL;LLESDLDA;FLKDSRDAF;FIDFLFASS;SSYWLLDFA;YANDKGIEL;FASSQSYWQ
A0203
KIRSAMSSV;AMSSVSDSV;YLNTNEDFV;TLNNWIFRL;FVSTKEVGV;WLLDFASFV;TLSKNISFL;F
IAYDSADV;TLREFVNSL;FIDSDLNLL;WQMFAYSPI;FVAFKFYFL;VLFDRGILL;ILRKYIDVI;FT
RSPPYST;SQSYWQMFA;VMNLPLFIA;LVMNLPLFI;YIKNCIVYT;VVWDMIRSA;FFNFLLNEI;VLL
PMQDYI;GTLLNTSSL;KTDEFRGFV;KLSFKDKFL;LLDFASFVA;RLRDFFNFP;SSYWLLDFA;ASKD
KVAGT;NIKRESCTT
A0204
WLLDFASFV;TLNNWIFRL;FVSTWEVGV;YLNTNEDFV;VLFDRGILL;AMSSVSDSV;LVMNLPLFI;F
TRSPPYST;FVAFKFYFL;VMNLPLFIA;YANDKGIEL
A0205
WLLDFASFV;WQMFAYSPI;FIDSDLNLL;SQSYWQMFA;FVSTWEVGV;AMSSVSDSV;FIAYDSADV;M
IRSAMSSV;TLNNWIFRL;YLNTNEDFV;VLLPMQDYI;FVAFKFYFL;VLFDRGILL;IQYFFSQF;LL
DFASFVA;VVWDMIRSA;KTDEFRGFV;RGFVSTWFV;LVMNLPLFI;RLLFSDLDA;FVVKDMTRS;KVQ
FVLQYF;YKFIDFLFA;CFAYAFKGL;FFFSQFQAL;AALNFTNRA;SSYWLLDFA;FAYSPTDFT;GTLL
NTSSL;YTFDYLNTN;FIDFLFASS;GAYKFIDFL;
A0211
WLLDFASFV;YLNTNEDFV;VLFDRGILL;AMSSVSDSV;TLNNWIFRL;KTDEFRGFV;FLKDLKTKV;L
LDFASFVA;SLDDLEKKY;FIDSDLNLL;FVSTKEVGV;TLSKNISFL;VVWDMIRSA;FLFASSQSY;NI
LSKEIKV;YANDKGIEL;RLLFSDLDA;MIRSAMSSV;YTFDYLNTN;FVAFKFYFL;VLLPMQDYI;TLR
EFVNSL;VMNLPLFIA;DLFKLRNIL;GILRKYIDV;YSWNVLKNV;KLSFKDKFL;FIAYDSADV;VLQY
FFSQ;RGFVSTWFV;GTLLNTSSL;TLRKYIDVI;PIFTAYDSA;ANDKGIELV;AFAGNVYYI;YAFNG
LWVK;GAYKFIDFL;LVKDLPLFI
A0212
WLLDFASFV;YLNTNEDFV;VLFDRGILL;AMSSVSDSV;FVSTKEVGV;TLNNWIFRL;FLFASSQSY;M
IRSAMSSV;FIDSDLNLL;FLKDLKTKV;LLDFASFVA;VVWDMIRSA;GILRKYIDV;VLQFFFSQ;SL
DDLEKKY;YTFDYLNTN;RLLESDLDA;NILSKEIKV;ILRKEKDL;FVAFKFYFL;ILRKYIDVI;FIA
YDSADV;VLLPMQDYI;FFFSQFQAL;TLSKNISFL;TLREFVNSL;FLLNEIKDL;KIDHFRGFV;KVED
FENDL;YANDKGIEL;VMNLPLFIA;GILLNISSL;YSWNVLKNV;LLKEHETRY;DLFKLRNIL;FLKDS
RDAF

Fig. 41 continued

A0216
WLDPASFV;YLNTNEDFV;AMSSVSDSV;TLNNWIFRL;ETKDLKTWV;TLSKNTSFT;VLFDRQTLT;K
TDFFRQFV;MTRSAMSSV;NTLSKETKV;FVSTKEVGV;FVAFKFYFL;DLFKLRNTL;SAYKTDFL;FT
DSDLNLL;LLDFASFVA;VLTPMQDYT;TLRKYTDVT;GTLRKYTDV;TTRFFVTSL;KLSFKDKFL;GTL
LNTSSL;PLFTAYDSA;YANDKGTEL;VVRDMTRSA;YSKNVLKNV;FLFASSQSY;
A0219
WLLDFASFV;YLNTNEDFV;AMSSVSDSV;TLNNWIFRL;FTDSDLNLL;FVSTKEVGV;TLSKNTSFT;M
TRSAKSSV;LLDFASFVA;VLFDRQTLT;VVRDMTRSA;FLFASSQSY;NTLSKETKV;YANDKGTEL;FV
AFKFYFL;YSNNVLKNV
A0301
RSFFKFKKK;LSFKDKFLK;VAFKFYFLK;FLFASSQSY;RTNLNLKRK;KTRTNLNLK;QSYWQMFAY;T
LNEIKDLK;KVAGTSPDY;PAYSWNVLK;ALKRYANDK
A1101
VAFKFYFLK;LSFKDKFLK;SADVWAHQK;RSFFKFKKK;QSYWQMFAY;NTLNWIFR;PAYSWNVLK;S
AFAGNVYY;YAFKGLWK;RTNLNLKRK;NSLDDLHKK;TLSETKDLK;KTRTNLNLK;SVTTPMQDY;NV
KYEWWAK;ASFVAFKFY;KVAGTSPDY;
A2301
AYKFIDFLF;DYLNTNEDF;DYINLGNEF;KYKKIRINL;YWLLDFASF;SSVAFKFYF;KFAYSPIDF;V
YYIDLEAL;VWAHQKYFK;KYGIGDLGK;KFLDSULNL;RLKKLAFDF;SRLRDFFNF;AYSPIDFTR;LL
KEAALNF;KVQEVLQYF;NYIKNGIVS;AFAGNVYYI;LQYFTFSQF;ELVMNLPLF;DLGKGAYKF;FFN
FILNEI;FFVNGLDDI
A2402
AYKFIDFLF;DYLNTNEDF;YWLLDFASF;AFAGNVYYI;DYLNTNEDF;AYAFNGLWV;KFAYSPIDF;K
YEWWAKRI;VYYIDLEAL;KYKKIRINL;WWAKRIGLL
A2403
YWLLDFASF;AYKFIDFLF;VYYIDLEAL;YFLEQEQAW;KVQEVLQYF;DYLNLGNEF;DYLNTNEDF;S
FVAFKFYF;KYKKIRINL;RLMKLAFDF;KFKKKSSYW;FFFSQFQAL;AFAGNVYYI;MFAYSPIDF;AT
LSKNTSF;KYEWWAKRI;AYAFNGLWV;FFNFILNEI;AWDSPAYSW
A2601  ELVMNLPLF;SVTTPMQDY
A2602
SVTTPMQDY;DVWAHQKYF;ELVMNLPLF;DVSRLRDFF;QSYWQMFAY;KVQEVLQYF;FLDSULNLL;F
VAFKFYFL;KVAGTSPDY;FFVNSLDDI;NTSFTTRLY;NTSSLPSKY
A2902
SAFAGNVYY;NYTKNGIVY;FLFASSQSY;QSYWQMFAY;SVTTPMQDY;MNLPLFTAY;AYKFIDFLF;F
SAFAGNVY;DYINLGNEF;NTSSLPSKY
A3001
KTRTNLNLK;RSFFKFKKK;FVRSFKFK;RGTLTRNEK;ALKRYANDK;FTRYSDLKK;RLRDFFNFP;R
TNLNLKRK;NVKYEWWAK;LSFKDKFLK;VAFKFYFLK;SDLDATLSK;AKRTGTLRK;SWNVLKNVK;RN
TLSKETK;RGFVSTKEV
A3002
KVAGTSPDY;NTSSLPSKY;DVSRLRDFF;KSSYWLLDF;AYKFIDFLF;KYKKIRINL;VQEVLQYFF
A3101
SFTTRLYGR;AYSPIDFTR;NTLDNWIFR;YINLGNEFR;DAKRTGTLR;RSFFKFKKK;DVTKTDHFR;K
YKKTRINL;GLFVKSPQR;LSFKDKFLK;DFFNFPGKR;KTRTNLNLK;VWAHQKYFK;DAFNVLFDR;KF
YFLKDSR;VAFKFYFLK;YAFNGLWVK;SYWQMFAYS
A3301
DVTKTDHFR;DFFNFPGKR;DAFNVLFDR;DFVVWDMLR;DFASFVAFK;SFTTRLYGR;YINLGNEFR;N
TLNNWIFR;DLEDVSRLR;FVRSFKFK;NVKYEWWAK;AYSPIDFTR;FAALNFTNR;FFSQFQALK
A6801
DVTKTDHFR;DAFNVLFDR;DFASFVAFK;FAALNFTNR;YINLGNEFR;NTLNNWIFR;LSFKDKFLK;Y
AFNGLWVK;EVRSFKFK;FTRYSDLKK;DFFNFPGKR;VAFKFYFLK;FSQFQALKR;QSYWQMFAY;FF
SQFQALK;NTSFTTRLY;NVKYEWWAK;SAFAGNVYY;DFVVWDMLR;DLEDVSRLR;ILNEIKDLK;NAK
RIGLLR;PAYSWNVLK;AYSPIDFTR;SFTTRLYGR;FASFVAFKF;SADVWAHQK;NFPGSRIMK;NSLD
DLHKK;EAYAFNGLK;FNFILNEIK
A6802
FVAFKFYFL;FTRSPPYGI;DSFAYSWNV;FLAYGGADY;WQKFAYSFI;NVYYIDLEA;MLRSAKSSV;F

VSTPEVGV;DXSTTREFV;EVLQYFFS;WLLDFASFV;LVMNLPLFT;RGFVSTPFV;TLSKNISFT;TL
XNWIFRL;FDFVVWDMT;KSSVSDSVT;HKKYTFDYL;RTKDLKTWV;TGTGDNSTT
A6901
FVSTPEVGV;YSWNWIKNV;WLLDFASFV;LVMNLPLFT;FTAYDSADV;TLNNWTFRL;FTRSPPYST;F
SPAYSWNV;FTDSDLNLL;FVLQYFFS;QANDSPAYS;NTLQKFTKV;FAYSPTDFT;FVGVGFAYA;RT
KDLKTWV;
B0702
SPAYSWNVL;FPGMRIMKL;PPYSTFSAF;KTRSAMSSV;SPPYSTFSA;TPMQDYINL;RANTFKNTL;T
TREFVNGL
B0801 NLKPKSGTL
B0802
B1501
FLFASSQSY;EQANDSPAY;FSAFAGNVY;SAFAGNVYY;FLKFAALNF;FLKDSRDAF;SQFQALKRY;Q
MKIMKLAF;KVAGTSPEY;KVKSFGRDF;LQYFFFGQF;QSYWQMFAY;HQKYSKLRF;KVQEVLQYF;WQ
MFAYSPT;SVTTPMQDY;ASVDEVRSF;ASFVAFKFY;LLKFMFTRY;WFVGVGFAY
B1801
WEVGVGFAY;IELVMNLPL;MNLPLFTAY;QEVLQYFFF;IKVQEVLQY;DEVRSFKKF;LESDLDATL;Q
SYWQMFAY
B2705 KRIGILRKY;IRINLNLKR
B3501
EQANDSPAY;FSAFAGNVY;PPYSTFSAF;QSYWQMFAY;SPAYSWNVL;FFFSQFQAL;WEVGVGFAY;M
NLPLFTAY;SAFAGNVYY;YANDKGIEL;YFLEQEQAV;FLFASSQSY;TAYDSADVW;TPMQDYINL;LD
FASFVAF;FLKDSRDAF;VGVGFAYAF;SPGRDFFNF
B3901 GRDFFNFLL
B4001 GFAYAFNGL;IELVMNLPL;KEIKVQEVL;QEVLQYFFF;LESDLDATL
B4002 QEVLQYFFF;KEIKVQEVL
B4402 QEVLQYFFF
B4403 QEVLQYFFF
B4501
B5101 TPMQDYINL
B5301 SPGRDFFNF;IFKNDLNNW;FPGMRIMKL;PPYSTFSAF;TPMQDYINL
B5401 LPLFTAYDS;SPPYSTFSA
B5701 NTNEDFVVW;TAYDSADVW
B5801
TAYDSADVW;KSSYWLLDF;LFASSQSYW;FAYAFNGLM;NTNEDFVVW;QSYWQMFAY;RIMKLAFDF;F
SAFAGNVY;KVAGTSPFY;ASSQSYWQM;VAGTSPDYF

Allele 10-mer
A0101 SADVWAHQKY;FSAFAGNVYY
A0201
YLNTNEDFVV;FLKFAALNFT;WLLDFASFVA;FTNRASVDFV;TLNNWTFRLL;ALNFTNRASV;STFSA
FAGNV;YANDKGTELV;ALDKFTDSDL;SAMSSVSDSV;TLNKTKDLKT;SAFAGNVYYI;LVMNLPLFTA
;FVWDKTRSA;AMSSVSDSVT;SLDDLHKKYT;RLLFSDLDAT;TLESDLDATL;SVSDSVTTPK;ATTS
KNTSFT
A0202
FLKFAALNFT;WLLDFASFVA;YLNTNEDFVV;SAFAGNVYYT;LLESDLDATL;AMSSVSDSVT;LVMNL
PLFTA;FLASSQSYW;TLNNWTFRLL;FAGNVYYIDL;SAMSSVSDSV;ALDKFTDSDL;NVYYIDLEAL
;SLDDLHKKYT;SVSDSVTTPM;WTFRLLFSDL;ALNFTNRASV;NLGNEFRANT;FTNRASVDFV;TLNK
IKDLKI;RLLFSDLDAT;SLFSAFAGNV;YANDKGIELV;SVTTPMQDYL;ILLNTGSLPS;ATLDKNLSF
T;FASSQSYWQM;RLRDFFNFPG;NTLNNTFRL
A0203
FLKFAALNFT;ALNFTNRASV;FTNRASVDFV;YLNTNEDFVV;FVWDKTRSA;TLNNWTFRLL;SLFSA
FAGNV;YANDKGIELV;KLRNILSKET;SAMSSVSDSV;AMSSVSDSVT;DMTRGAMSSV;LLNELKDLKI
;NLNLKRFSGI;STTREFVNGL;NLGNEFRANT;YINLGNFFRA;WLLDFASFVA;NLKRKSGILL;NVYY
IDLEAL;LLESDLDATL;LVMNLPLFTA;SLDDLHKKYT;SAFAGNVYYI

Fig. 41 continued

A0204
YLNTNEDFVV;FTNRASVDEV;FLKEAALNFT;STPEVGVGEA;ALNFTNRASV;STFSAFAGNV;YANDK
GIELV;TLNNWTFRIL;LVMNLPLFTA;SAFAGNVYYT
A0206
WLLDFASFVA;FVVWDMIRSA;FTNRASVDEV;FLKEAALNFT;SAMSSVSDSV;YLNTNEDFVV;STFSA
FAGNV;YANDKGIELV;SQFQALKRYA;SAFAGNVYYT;STTREFVNSL;RLLESDLDAT;YWLLDFASFV
;NTLNNWTFRL;YTNLGNEFRA;LLDFASFVAF;NVYYTDLEAT;SQSYWQMFAY;STPEVGVGEA;LVMN
LPLFTA;FASSQSYWQM;ATLSKNTSFT;TLNNWTFRIL;KSSYWLLDFA;YTFDYLNTNE;SVTTPMQDY
T;ALNFTNRASV;YTGTGDNSTT;RSPP

ALDKF;WVKSPGRDFF;KVQEVLQYFF;YIDVIKIDHF;KVAGISPDYF;PIDFTRSPPY;SVITPMQDY
;VVWDMIRSAM;VIKIDHFRGF;DLKKYIPDY;DSVITPMQDY
A2902
VMNLPLFTAY;SWNMIKNVKY;FSAFAGNVYY;SQSYWQMFAY;TFSAFAGNVY;FASFVAFKFY;SYWILDFASF;HNYIKKCIVY
A3001
RIRFDASKDK;LLNTSSLPCK;TLRKYIDVIK;LFKIRNILSK;FVRSFFKFRK;LTRNFKDLFK;KLSFK
DKFLK;RIRDFFNFPG;KIRINLNLKR;YFKIRFDASK;SVDEVRSFFK;KNVKYEWWAK;WAKRIGTLRK
A3002 RYSDLKKISF;SQSYWQMFAY;KVQFVLQYFF;SWNVIKNVKY
A3101
KIRINLNLKR;TSFTTRLYGR;LGKNTSFTTR;FAYSPIDFTR;KLSFKDKFLK;DYINLGNFFR;FFSQF
QALKR;KNILNNWLFR;WWAKRIGILR;RDABNVLFDR;FFFSQFQALK;FVAFKEYFLK;AYAFNGLWVR
;KYKRIRINLN
A3301
DYINLGNFFR;FFSQFQALKR;FAYSPIDFTR;LGKNTSFTTR;FFFSQFQALK;TSFTTRLYGR;DFASF
VAFKF;VLFDRGLLLR
A6801
FAYSPIDYTR;FVAFKEYFLK;DSADVWAHQK;LSFITRLYGR;EVRSFERBKK;NVKYEWWAKR;DVSAH
QKYFK;DYINLGNFFR;FVNSLDDLKK;FFFSQFQALK;FFSQFQALKR;SVDEVRSFEK;LSKNIGFLLR
;SPAYSWNVLK;FSAFAGNVYY;EDFVVWDMIR;FFNELLNEIK;WAHQKYFKLR;FASFVAFKEY;LDFA
SFVAFK;IGIGDNSTLR;FLLNEIKDLK;FNFPGKRIEK;EDLDATLGK;EVLQYFFSQ;YYIDLEAID
K;VLFDRGLLLR
A6802
BAALNEIBRA;SAFAGNVYYI;KVYYIDLEAL;SIFSAFAGNV;SIIRFFVNSL;BAYAFNGLWV;CAMSS
VSDSV;SVLLPFQDYI;NTLNNWIFRL;FINRASVDEV;DKIRSAMSSV;SVSDSVLLPK;FVVWDMIRSA
;FRGFVSIWEV;YANDKGIELV;LVMNLPLFIA;STWEVGVGEA;WDSPAYSWNV;SGLLLNISSL
A6901
BAYAFNGLWV;STWEVGVGEA;NTLNNWIFRL;YANDKGIELV;SIFSAFAGNV;SAFAGNVYYI;FINRA
SVDEV;ELVMNLPLFI;SVSDSVLLPM;NVLE DRGILL;WLLDFASFVA;DKIRSAMSSV;SAMSSVSDSV
;LVMNLPLFIA;FVVWDKIRSA;KVYYIDLEAL;FASSQSYWQM;EVLQSFFFSQ
B0702 SPPYSIFSAF;LPSKYGIGDL;VVWDMIRSAM;SVCDSVLLPM
B0801
B0802
B1501
VMNLPLFTAY;SQSYWQMFAY;QMFAYSPIDF;FSAFAGNVYY;TFSAFAGNVY;QRQAWDSPAY;WVKSP
GRDFF;KVAGISPDYF;FLFASSQSYW;FTRSPPYSTF
B1801
TFLVKNLPLF;YEWWAKRIGT;WEVGVGEAYA;TRVQFVLQYF;NFTKDLKIWV;QFQAWDSPAY;
B2705 KRTGTLRKYT
B3501
FASFVAFKFY;SPPYSTFSAF;FASSQSYWQM;VVWDMIRSAM;FSAFAGNVYY;EVGVSFAYAF;LLDFA
SFVAF;SVSDSVTIPM;TFSAFAGNVY;DFLFASSQSY;YFLKDSRDAF;YFFSQFQAL;SADVWAHQKY
;NVYYIDLEAL;VMNLPLFTAY;QAWDSPAYSW;QFQAWDSPAY;SYWLDFASF;FIAYDSADVW
B3901 FRANTPKNTL
B4001 RFFVNSLDDL;YEWWAKRIGT;KENFTRYSDL;NFTKDLKIWV;TFLVKNLPLF
B4002 RFFVNSLDDL;KENFTRYSDL;QFVLQYFFS
B4402 GEAYAFNGLW
B4403 QFVLQYFFS;GEAYAFNGLW
B4501
B5101 LPLFTAYDSA;TPKNTLNNWI;LPHNYIKKCI;
B5301 SPGRDFFNFL;SPPYSIFSAF;LPHNYIKKCL;LPKNTLNNWI;LPSKYGIGDL
B5401 LDLFIAYDSA;FPGMRIKKLA;LPHNYIKKCL;PPYSIFSAFA;LPKNTLNNWI
B5701
B5801
QAWDSPAYSW;FLFASSQSYW;KVAGLSPDYF;RASVDEVRSF;GAYKFLDFLF;FLAYDSADVW;ASSQS
YWQMF;ASFVAFKEY;FSAFAGNVYY;KSFGRDFFR;FASSQSYWQM

Fig. 41 continued

Allele 11-mer

A0101 DSDNQNLPHNY;SSQSYWQMFAY;DSADVWAHQKY

A0201
RLRFSDLDATL;FLKDSRDAFNV;QMFAYSPIDFT;FTLNETKDLKT;AMSSVSDSVIT;TLSKEIKVQFV
;FLFASSQSYWQ;KVAGISPDYFL;FTAYDSADVWA;RLRDFFNFPCM;YTKNGIVYTGT;VITPKQDYIN
L;TLRKYTDVTKT;KTWVEDFFNDL

A0202
FLKDSRDAFNV;FLFASSQSYWQ;TLSKEIKVQFV;AMSSVSDSVIT;FTAYDSADVWA;KVAGISPDYFL
;FSAFAGNVYYT;GVGEAYAFNGL;YTKNGIVYTGT;FDYLNTNEDFV;VITPKQDYINL;RLLFSDLDAT
L;RLRDFFNFPCM;KLAFDFSDKQ;KLRFDASKDKV;NISSLPSKYGT;QMFAYSPIDFT;TLRKYTDVT
KT;NLPLFIAYDSA;FENDLEDVSRL;SLPSKYGIGDL;LQYFFFSQFQA;FVVKDMIRSAM;YLNTNEDF
VVS

A0203
FLKDSRDAFNV;YTKNGIVYTGT;TLSKEIKVQFV;RLRDFFNFPCM;AMSSVSDSVIT;TLRKYTDVTKT
;FTAYDSADVWA;SLPSKYGIGDL;VIKIDHFRGFV;NLPLFIAYDSA;KLRFDASKDKV;ALKRYANDKG
I;GVGEAYAFNGL;VLKNVKYEWWA;RLLFSDLDATL;FLFASSQSYWQ;AALNFINRASV;VITPKQDYI
NL;LQYFFFSQFQA;FVVKDMIRSAM;NISSLPSKYGI;HLNLKRKSGIL;PLFIAYDSADV

A0204 ILSKEIKVQFV;RLLFSDLDATL;FLKDSRDAFNV;KVAGISPDYFL

A0206
FLKDSRDAFNV;WLLDFASFVAF;RLLFSDLDATL;LQYFFFSQFQA;FVVKDMIRSAM;AALNFINRASV
;FLAYDSADVWA;MQDYINLENF;KVAGISPDYFL;GVGEAYAFNGL;SQSYWQMFAYS;FILNEIKDLK
T;RLRDFFNFPCM;YTKNGIVYTGT;VITPKQDYINL;MQKFAYSPIDF;ILSKEIKVQFV;KVQEVLQYF
FF;GEAYAFNGLWV;FLFASSQSYWQ;FCAFAGNVYYL;RSAFSSVSDSV;AMSSVSDSVII

A0211
FLKDSRDAFNV;RLLFSDLDATL;ILSKEIKVQFV;FLFASSQSYWQ;VLKNVKYEWWA;SLDDLHKKYLF
;WLLDFASFVAF;SYWLLDFASFV;KVAGISPDYFL;PLFIAYDSADV;AMSSVSDSVIT;RLRDFFNFPG
M;AALNFINRASV;YIDLEALDKFI;KLRFDASKDKV;VITPKQDYINL;NLPLFIAYDSA;ELVMNLPLF
IA;TLRKYTDVTKT;SLPSKYGIGDL;NLPHNYIKNGI;VLFDRGILRN;LLDFASFVAFK;VIKIDHFR
GFV;VLQYFFFSQFQ;QMFAYSPIDFT;DLHKKYIFDYL;KIDHFRGFVST;HFRGFVSTWEV;RIGLLRK
YIDV;DVWAHQKYFKL;AWDSPAYGWNV;YIKNGIVYTGI;RYANDKGIELV;TLSKWIFRGLF;FILNEI
KDLKT;KTWVEDFFNDL;TGDNSTIRRFV;FTAYDSADVWA;SVSDSVTTPKQ;ILLNISSLPSK;YTFDY
LNTNED

A0212
FLKDSRDAFNV;RLLFSDLDATL;TLSKEIKVQFV;FLFASSQSYWQ;VLKNVKYEWWA;RLRDFFNFPCM
;PLFIAYDSADV;WLLDFASFVAF;VITPKQDYINL;AMSSVSDSVIT;VLQYFFFSQFQ;SLDDLHKKYI
F;KLRFDASKDKV;FILNEIKDLKT;AALNFINRASV;TLRKYTDVTKT;SYWLLDFASFV;SLPSKYGTG
DL;VLFDRGILRN;QMFAYSPIDFT;KVAGISPDYFL;KTWVEDFFNDL;ALKRYANDKGT;YIDLEALD
KFT;NLPHNYIKNGI

A0216
FLKDSRDAFNV;TLSKEIKVQFV;RLLFSDLDATL;VLKNVKYEWWA;FLFASSQSYWQ;SYWLLDFASFV
;DLHKKYIFDYL;AALNFINRASV;KVAGISPDYFL;PLFIAYDSADV;KLRFDASKDKV;TLRKYTDVTK
T;AMSSVSDSVIT;VIKIDHFRGFV;NLPLFIAYDSA;QMFAYSPIDFT;VITPKQDYINL;NLPHNYIKN
GI;DVWAHQKYFKL;HFRGFVSTWKV;RLRDFFNFPCM;SLPSKYGTGDL;RTGTLRKYTDV;VLQYFFFS
QFQ;ELVMNLPLFTA;GVGEAYAFNGL

A0219
FLKDSRDAFNV;ILSKEIKVQFV;FLFASSQSYWQ;RLLFSDLDATL;AMSSVSDSVIT;KVAGISPDYFL
;WLLDFASFVAF

A0301
TLLNISSLPSK;LLDFASFVAFK;KLRNTLSKETK;TLIRNEKDLFK;YFFFSQFQATK;FFNFPCMRIMK
;KIRINLNLRRK;DLFKLRNILSK;LVMNLPLFIAY;TLSKNISFITR;KYFKLRFDASK;LLNISSLPSK
Y;GLLRKYIDVIK;FVNSLDDLHKK;GIGDLGKGAYK

A1101
ILLNISSLPSK;SSQSYWQMFAY;ASVDEVRSFEK;LVMNLPLFIAY;SFVAFKEYSLK;FVNSLDDLHKK
;KFLDSDLNLLK;LLDFASFVAFK;FAYAFNGLKVK;SLFCAFAGNVY;ILLRNEKDLFK;YFFFSQFQAL

Fig. 41 continued

K;GTLRKYIDVTR;GIGDLGKGAYK;KYFKLRFDASK;RYSDLKKLSFK;TLSKNTSFTTR;DSPAYSWNV
LK;AYSWNVLKNVK
A2301
KYIDVTKIDEF;YYIDLEALDKF;KYFLKDSRDAF;KYFKLRFDASK;VYIDLEALDK;KYKKTRINLNL
;AYSWNVLKNVK;LWKSPGRDFF;RYSDLKKLSFK;TFDYLNTNEDF;KVQFVLQYFF;QYFFSQFQA
L;SFVAFKEYFLK;FFVNSLDDLHK;KFIDSDLNLLK;VYTGTGDNSTT;SYQMFAYSPIDF;YFFFSQFQA
LK;DFTRSPPYSIF;FVLQYFFSQF;DYLNTNEDFVV;NFTLNFIRDLK;KLLDFASFVAF;KFLKFAAL
NFT;SYWQMFAYSPT;FFNFPCKRIMK;DFFNFTLNFTK;WWAKRTGTLRK;DVTKIDHFRGF;KFKKKSS
YWLL;DVSRLRDFFNF;DFLFASGQSYW;NNTFRLLESDI
A2402
YYIDLEALDKF;KYIDVTKIDEF;SYWQMFAYSPT;VYTGTGDNSTT;QYFFSQFQAL;KFLKFAALNFT
;KFKKKSSYWLL;LWKSPGRDFF;KYKKIRINLNL;DFTRSPPYSIF;KVQFVLQYFF;KFFLKDSRDA
F;DYLNTNEDFVV;KYEWWAKRTGT
A2403
YYIDLEALDKF;KYIDVTKIDEF;KVQFVLQYFF;RSPPYSIFSAF;QYFFSQFQAL;KFLKFAALNFT
;KYKKIRINLNL;KYEWWAKRIGT;KFKKKSSYWLL;KYFLKDSRDAF;AFAGNVYYIDL;SYWQMFAYSP
T;LFDYLNTNEDF
A2601
DVTKIDHFRGF;SIWEVGVGEAY;DSADVWAHQKY;YGIGDLGKGAY;SLFSAFAGNVY;EVLQYFFSQF
;FVVWDMIRSAM;YSWNVLKNVKY
A2602
ELKVQFVLQYF;DVTKIDHFRGF;EVLQYFFSQF;FVVWDMIRSAM;YGIGDLGKGAY;KVQFVLQYFF
;DVSRLRDFFNF;SLFSAFAGNVY;LVMNLPLFLAY;DVWAHQKYFKL;VLLPKQDYINL;NLNEDFVVWD
M;SIWEVGVGEAY;SSQSYWQMFAY;DFTRSPPYSIF;SVDEVRSFEKF;DFFNFPGMRIK;DFASFVAFK
EY;KVAGLSPDYFL;DSADVWAHQKY
A2902
LVMNLPLFLAY;LFSAFAGNVYY;YSWNVLKNVKY;YYIDLEALDKF;FFSQFQALKRY;SLFSAFAGNVY
;SIWEVGVGEAY;SSQSYWQMFAY
A3001
KLRNILGKELK;KYFKLRFDASK;KIRINLNLKRK;LGNEFRANLPK;KFIDSDLNLLK;YFFSQFQALK
;RYSDLKKLSFK;EVRSFEKFKKK;SFVAFKEYFLK;RLRDFFNFPGM;KENEDRYSDLK;ASVDEVRSFE
K;TTKNTSSLPSK;LLDFASFVAFK;KKLSFKDKFLK;TLTRNFKDLFK
A3002
RYSDLKKLSFK;KYIDVTKIDEF;DVSRLRDFFNF;KVQFVLQYFF;TFSAFAGNVYY;KYKKTRINLNL
A3101
KYFKLRFDASK;MFAYSPTDFTR;AFKEYFLKDSR;RYSDLKKLSFK;YFFSQFQALK;FFSQFQALKR
;TLSKNTSFTTR;SFVAFKEYFLK;KNVKYFWWAKR;YIDVTKIDEFR;NTSFTTRLYGR;KLRNTLSKRT
K;FWWAKRTGTLR;VWAHQKYFKLR;KFIDSDLNLLK;KFKKKSSYWLL;KYKKTRINLNL;KVQFVLQYF
FF;YTGTGDNSTTR
A3301
MFAYSPTDFTR;YFFSQFQALK;FWWAKRTGTLR;DLNLLKENETR;NTSFTTRLYGR;DFFNDLEDVSR
;YIDVTKIDHFR;DFFNFTLNFTK;AFKEYFLKDSR;FFSQFQALKR;NVLFDRGTTTR;RAYAFNGLKV
K;DLFKLRNTLSK
A6801
NTSFTTRLYGR;RAYAFNGLKVK;YFFSQFQALK;MFAYSPTDFTR;YIDVTKIDHFR;FINRASVDEVR
;DSPAYSWNVLK;FVNSLDDLHKK;TLSKNTSFTTR;FFSQFQALKR;SFVAFKEYFLK;NVLFDRGTTT
R;DFFNFTLNFTK;DLFKLRNTLSK;YTGTGDNSTTR;DLNLLKENETR;NFILNFIKDLK;EVRSFEKFK
KK;LLDFASFVAFK;FFVNSLDDLHK;FFNFPCKRTMK;DSADVWAHQKY;QDYTNLGNEFR;FWWAKRTG
TLR;FASFVAFKEYF;SLFSAFAGNVY;ILIRNFKDLFK
A6802
FSAFAGNVYYI;YSLFSAFAGNV;KVAGLSPDYFL;FLAYDSADVWA;DSVLLPKQDYI;FVVWDMIRSAM
;RSAMGGVSDGV;NLSSLPGKYGL;DAFNVLFDRGI;EAALYFINRAS;SAMGGVSDGVL;NLLDPWLFRL
L;WDMIRSAMGGV;TRSPPYSIFSA;DATLGKNLGFL;QYFFSQFQAL;NLPKNTLNKWL;DVWAHQKYFK
L

```
A6901
DVWAHQKYFIL;NTLNYYFRIL;PAYSWNVLKNV;YSTFSAFAGNV;NTNFDFVVEDM;AALNFTNRASV
;FVVEDMTRSAK;FSAFAGNVYY
B0702 FPGMRIKKLAF;TPKNTLNNWIF;FVVEDMTRSAK;SPGRDFNFIL;SPIDFTRSPPY
B0801
B0802
B1501
YQMFAYSPIDF;WILDFASFVAF;STFEVGVGFAY;LVMNLPLFTAY;MQDYINLGNEF;YGTGDLGKGAY
;STFSAFAGNVY;TFSAFAGNVYY;CMRTMKLAFDF;EQEGAWDSPAY;LLNTSSLPSKY;YSDNVLKNVK
Y
B1801
WEVGVGFAYAF;IFLVMNLPLFI;YFWWAKRIGIL;KELKVQEVLQY;FENDLEDVSRL;IDLFASSQSY
;WLLDFASFVAF
B2705 KRYANDKGIEL;TRYSDLKKLSF
B3501
SPIDFTRSPPY;FPGMRIKKLAF;FVVEDMTRSAK;FASSQSYWQMF;YANDKGIELVK;LVMNLPLFIAY
;STFEVGVGFAY;IPKNTLNNWIF;EQEGAWDSPAY;FASFVAFKEYF;WLIDFASFVAF;SIFSAFAGNV
Y;WEVGVGFAYAF;EVLQYFFSQF;YSWNVLKNVKY;LAYDSADWAH;YGIGDLGKGAY;FFSQFQALK
RY;WAHQKYFKLRF;SGVGDSVILFF;DFASFVAFKEY;MQDYLNLGNEF;SSQSYWQMFAY
B3901 FKDFFLKEAAL;LKDLFKLRNIL
B4001
WEVGVGFAYAF;GFAYAFNGLWV;YFWWAKRIGIL;FENDLEDVSRL;IELVMNLPLFI;NEIRYSDLKKL
B4002 WEVGVGFAYAF
B4402 KELKVQEVLQY
B4403 KELKVQEVLQY
B4501
B5101 LPFNYIKNCLV
B5301 FPGMRIKKLAF;IPKNTLNNWIF;SPGRDFNFIL;FASFVAFKEYF;SPIDFTRSPPY
B5401 LPFNYIKNCLV;FPGMRIKKLAF;LPLFTAYDSAD
B5701
B5801
FASFVAFKEYF;LFTAYDSADVW;FASSQSYWQMF;YLNTNEDFVVW;TINFIRDLKTS;RGAYKFIDFLF
;SSYWLIDFASF

Allele 15-mer plus 9-mer core
DRB1_0101 GTLLNTSSLPSKYGT-TSSLPSKYG;LRDFFNFPQMRIMKL-
FNFPQMRT;RDFFNFPQMRTMKLA-FPQMRIMKI;SGTLLNTSSLPSKYG-
LLNTSSLPS;FVVEDMTRSAMSSVS-EDMTRSAMS;VVEDMTRSAMSSVSD-
TRSAMSSVS;DFFNFPQMRTMKLAF-FPQMRIMKI;FFNFPQMRIMRLAFD-
FPQMRIMKI;TLLNTSSLPSKYGTG-TSSLPSKYG;LLNTSSLPSKYGTGD-
TSSLPSKYG;VWDMTRSAMSSVSDS-TRSAMSSVS;WDMTRSAMSSVSDSV-
TRSAMSSVS;DKGTLVMNLPLFTA-LVMNLPLFT;GTRLVMNLPLFTAYD-
VMNLPLFTA;TELVMNLPLFTAYDS-VMNLPLFTA;KGTLVMNLPLFTAY-
VMNLPLFTA;DMTRSAMSSVSDSVT-TRSAMSSVS;FNFPQMRTMKLAFDF-
FPQMRIMKI;LNTSSLPSKYGTGDL-TSSLPSKYG;ELVMNLPLFTAYDSA-
VMNLPLFTA;ASSQSYWQMFAYSPT-YWQMFAYSP;QSYWQMFAYSPIDFT-
YWQMFAYSP;SQSYWQMFAYSPIDF-YWQMFAYSP;SSQSYWQMFAYSPID-
YWQMFAYSP;DFVVEDMTRSAMSSV-EDMTRSAMS;RKSGTLLNTSSLPSK-
LLNTSSLPS;FASSQSYWQMFAYSP-FASSQSYWQ;KSGTLLNTSSLPSKY-
LLNTSSLPS;RDFVVEDMTRSAMSS-EDMTRSAMS;KRSGTLLNTSSLPS-
LLNTSSLP;AYSPIDFTRSPPYSI-YSPIDFTRS;IDFTRSPPYSIFSAF-
FTRSPPYSI;NEFVVEDMTRSAKS-VVEDMTRSA;PIDFTRSPPYSIFSA-
FTRSPPYSI;YSPIDFTRSPPYSIF-STRSPPYSI;SPIDFTRSPPYSIFS-
FTRSPPYSI;KDLFKLRNILSKEIK-LRNILSKEI;DLFKLRNILSKEIKV-
LRNILSKEI;LKDLFKLRNILSKEI-LFKLRNILS;LFKLRNILSKEIKVQ-
LRNILSKEI;FKLRNILSKEIKVQL-LRNILSKEI;YWQMFAYSPIDFTRS
```

FRGFVSTWE;VWDMIRSAMSSVSDS-MIRSAMSSV;LLESDLDATLSKNIS-
LDATLSKNI;VGEAYAFNGLWVKSP-AYAFNGLWV;GEAYAFNGLWVKSPG-
AYAFNGLWV;IIPMQDYINLGNEFR-PMQDYINLG;EWWAKRIGILRKYID-
WAKRIGILR;ALDKFIDSDLNLLKE-FIDSDLNLL;NEDFVVWDMIRSAMS-
FVVWDMIRS;EDFVVWDMIRSAMSS-FVVWDMIRS;RSFEKFKKKSSYWLL-
FKKKSSYWL;TLNNWIFRLLESDLD-IFRLLESDL;IPMQDYINLGNEFRA-
YINLGNEFR;GNEFRANIPKNTLNN-FRANIPKNT;PMQDYINLGNEFRAN-
YINLGNEFR;VIKIDHFRGFVSTWE-IDHFRGFVS;LNNWIFRLLESDLDA-FRLLESDLD
DRB3_0101 LESDLDATLSKNISF-LESDLDATL;VKSPGRDFFNFILNE-
PGRDFFNFI;LFDRGILIRNEKDLF-ILIRNEKDL;IDLEALDKFIDSDLN-
EALDKFIDS;FDFDSDNQNLPHNYI-FDSDNQNLP;RKSGILLNISSLPSK-
LLNISSLPS;KEYFLKDSRDAFNVL-FLKDSRDAF;AFDFDSDNQNLPHNY-
FDSDNQNLP;EYFLKDSRDAFNVLF-FLKDSRDAF;FKDKFLKEAALNFIN-
FLKEAALNF;FENDLEDVSRLRDFF-FENDLEDVS;VAFKEYFLKDSRDAF-
FKEYFLKDS;FIDSDLNLLKENETR-IDSDLNLLK;AFKEYFLKDSRDAFN-
FLKDSRDAF;FKEYFLKDSRDAFNV-FLKDSRDAF;QDYINLGNEFRANIP-
LGNEFRANI;AFNVLFDRGILIRNE-VLFDRGILI
DRB4_0101 FFNFILNEIKDLKIW-ILNEIKDLK;VGVGEAYAFNGLWVK-
GEAYAFNGL;NVKYEWWAKRIGILR-YEWWAKRIG;VKYEWWAKRIGILRK-
YEWWAKRIG;SDLDATLSKNISFIT-DATLSKNIS;QNLPHNYIKNCIVYT-
LPHNYIKNC;KNVKYEWWAKRIGIL-YEWWAKRIG;LLDFASFVAFKEYFL-
LLDFASFVA;NVLKNVKYEWWAKRI-VKYEWWAKR;VLKNVKYEWWAKRIG-
VKYEWWAKR;LKNVKYEWWAKRIGI-YEWWAKRIG;NQNLPHNYIKNCIVY-
LPHNYIKNC;LPHNYIKNCIVYTGI-LPHNYIKNC;KYEWWAKRIGILRKY-
YEWWAKRIG;YEWWAKRIGILRKYI-YEWWAKRIG
DRB5_0101 KNVKYEWWAKRIGIL-VKYEWWAKR;VLKNVKYEWWAKRIG-
VKYEWWAKR;LKNVKYEWWAKRIGI-VKYEWWAKR;NVLKNVKYEWWAKRI-
VKYEWWAKR;WNVLKNVKYEWWAKR-WNVLKNVKY;AHQKYFKLRFDASKD-
FKLRFDASK;NVKYEWWAKRIGILR-VKYEWWAKR;VKYEWWAKRIGILRK-
VKYEWWAKR;LSKEIKVQEVLQYFF-IKVQEVLQY;NDKGIELVMNLPLFI-
ELVMNLPLF;LPHNYIKNCIVYTGI-YIKNCIVYT;IFDYLNTNEDFVVWD-
YLNTNEDFV;WIFRLLESDLDATLS-FRLLESDLD;AKRIGILRKYIDVIK-
AKRIGILRK;KFLKEAALNFINRAS-FLKEAALNF;IDHFRGFVSTWEVGV-
FRGFVSTWE;FENDLEDVSRLRDFF-DLEDVSRLR

<CAA59727 outer surface protein A;Protein;Borrelia garinii>
SEQ ID NO:176083-176568

Allele 8-mer
A0101
A0201 YLLGIGLI;SLDEKNSV;FTLEGTLA;LMATVEKL
A0202
LMATVEKL;SLDEKNSV;YLLGIGLI;LIACKQNV;LLGIGLIL;KAVEITTL;KLTIAEDL;GIGLILAL
;LVSKKVTL;SLMATVEK
A0203
YLLGIGLI;LMATVEKL;SLDEKNSV;LIACKQNV;LLGIGLIL;GLILALIA;SQKTKNLV;KVTEGTVV
;FTLEGTLA;TLKDKSST;KAVEITTL;LVSKKVTL
A0204 SLDEKNSV;LMATVEKL;KVTEGTVV;LLGIGLIL;FTLEGTLA;LIACKQNV;
A0206 KAVEITTL;FTLEGTLA;KVTEGTVV;YLLGIGLI;SLDEKNSV;ATVEKLEL;LIACKQNV
A0211
YLLGIGLI;SLDEKNSV;DLPGGMKV;KVTEGTVV;ALDDSDTT;TLEGTLAA;LLGIGLIL;LMATVEKL
;EISEKTIV;LIACKQNV;KEDGKTLV;FTLEGTLA;KLTIAEDL;GLILALIA;AADGKTTL;GIGLILA
L;EVLKDPTL;SLMATVEK
A0212
SLDEKNSV;YLLGIGLI;DLPGGMKV;LMATVEKL;LLGIGLIL;ALDDSDTT;TLEGTLAA;KVTEGTVV
;LIACKQNV;EISEKTIV;FTLEGTLA

Fig. 41 continued

A0216
SLDFKNSV;DLPGGMKV;YLLGIGLT;LLGIGLIL;LMATVEKL;TLEGTLAA;KVTFGTVV;ALDDSDTT;FTSEKTTV;LTACKQNV;AADQKTTL;GTGLTLAL;IVSKKVTL;TLKDXSST;EVLKDFTL;GLTIALT A
A0219
SLDFKNSV;YLLGIGLT;DLPGGMKV;LMATVEKL;ALDDSDTT;LLGIGLIL;TLEGTLAA;LTACKQNV;AADQKTTL
A0301
VLSKNTLK;TLALTACK;KTTFEIFK;SLMATVEK;VSKKVTLK;GMKVLVSK;SVNSQKTK;KTGKKDSK;TTSVNSQK;KVLVSKEK;TTAEDLSK;KTDKSKVK
A1101
KTTFEIFK;SLMATVEK;SVNSQKTK;TTAEDLSK;TTSVNSQK;GTLAADGK;TVEKLELK;KTGKKDSK;KVLVSKEK;VLSKNTLK;VSKKVTLK;TTTFEKLK;TTALTACK;NVSSLDFK;GMKVLVSK;KTDKSKVK;TKNLVSTK
A2301 KYLLGTGL
A2402 KYSLKATV
A2403 KYLLGIGL
A2601 DTLTVQKY
A2602 DTLTVQKY;EVLKDFTL;LTTLEKL;SVDLPGGM;ETSEKTTV
A2902 DTLTVQKY
A3001
KVLVSKEK;KTTFEIFK;SLMATVEK;VSKKVTLK;KTGKWDGK;KTDKSKVK;SVNSQKTK;GMKVLVSK;LVRANGTR;RLEYDDIK
A3002
A3101 IVRANGTR;KTTFEIFK;GMKVLVSK;LSEKTIVR;VSKKVTLK;KVLVSKEK
A3301 IVRANGTR
A6801
DTTQATKK;NVSSLDFK;TTSVNSQK;KTTFEIFK;EIFKEDGK;TLALTACK;TVEKLELK;TTAEDLSK;LTTLEKLK;SLMATVEK;DTLTVQKY;TTFEIFKE;SVNSQKTK;IVRANGTR;ELKGTSDK;EDTIVQ K;EGTVVLSK
A6802 TSLLTISV;LTACKQNV;LSEKTIV;EVLKDFTL;TVVLSKYL
A6901 FTLEGTLA;RVLKDFTL;ETSEKTTV;YLLGTGLT;LTACKQNV
B0702 LPGGMKVT;KAVFTTTL
B0801
B0802
B1501
B1801
B2705
B3501 LPGGMKVT
B3901 FKEDGKTT
B4001 GETSEKTT
B4002
B4402
B4403
B4501 AEDLSKTT
B5101
B5301 LPGGMKVL
B5401
B5701
B5801 KSSTEKKF;KAVFTTTL

Allele 9-mer
A0101
A0201
YLLGIGLIL;FTLEGTLAA;SLMATVEKL;KLSTLTISV;FTKEDLITV;ALTACKQNV;LLGIGLILA

Fig. 41 continued

A0202
SLMATVEKL;ALIACKQNV;KSGEITVAL;YLLGIGLIL;KTSTLTISV;FTKEDTTV;GIGLILAIT;L
LGIGLILA;KVTEGTVVL;ILKSGEITV;TLFKIKDAL;FTLFGTLAA;TLVSKKVTL
A0203
FTKEDTTV;ILKSGEITV;SLMATVEKL;ALIACKQNV;YLLGIGLIL;KTSTLTISV;LLGIGLIIA;F
TLFGTLAA;GKYSLMATV;GIGLILAIT;TLKVTEGTV;TLVSKKVTL
A0204 SLMATVEKL;ALIACKQNV;ILKSGEITV;FTKEDTTV;YLLGIGLIL;FTLFGTLAA
A0205
FTLFGTLAA;FTKEDTTV;KTSTLTISV;KVTEGTVVL;YLLGIGLIL;ALIACKQNV;LLGIGLILA;L
AADGKTTL;GKYSLMATV;FKEDGKTLV;SLMATVEKL
A0211
YLLGIGLIL;ILKSGEITV;ALIACKQNV;LLGIGLILA;SLMATVEKL;KVTEGTVVL;TLVSKKVIL;A
LDDSDTTQ;DLPGGMKVL;FTKEDTTTV;DLSKITFFI;FTLFGTLAA;KTSTLTTSV;LAADGKTTL;NL
EGKAVEI;TLKVTEGIV;FKEDGKTLV;SSLDEKNSV;ILEKLKDAL;SLDEKNSVS;VLKDFTLEG;GKY
SLMATV;VDLPGGMKV
A0212
YLLGIGLIL;ILKSGEITV;FTLEGTLAA;SLMATVEKL;ALIACKQNV;TLVSKKVIL;FTKEDTITV;L
AADGKTTL;ALDDSDTTQ;DLPGGMKVL;LLGIGLILA;ILEKLKDAL;FKEDGKTLV;KVTEGTVVL;VD
LPGGMKV;TLKVTEGIV;SSLDEKNSV;VLSRNILKS;VLKDFTLEG
A0216
ILKSGEITV;YLLGIGLIL;TLVSKKVIL;ALIACKQNV;SLMATVEKL;DLSKITFFI;LLGIGLILA;A
LDDSDTTQ;TLKVTEGIV;NLEGKAVEI;TLEKLKDAL;LAADGKTTL;DLPGGMKVL;FTKEDTITV;FK
EDGKTLV;KVTEGTVVL;GKYSLMATV;KTSTLTISV
A0219
ILKSGEITV;YLLGIGLIL;SLMATVEKL;LAADGKTTL;ALIACKQNV;DLSKITFFI;ALDDSDTTQ;T
LVSKKVTL;FKEDGKTLV;YTLEGTLAA;LLGIGLILA;DLPGGMKVL
A0301 VVLSKNILK;KTKNLVFTK;LVSKKVIL;LLLALIACK;LTISVNSQK
A1101
VVLSKNILK;KTKNLVFTK;LTISVNSQK;AVEITTLEK;LTIAEDLSK;LLLALIACK;SIEEKFNEK;A
TVEKLELK;SVDLPGGMK;YSLMATVEK;LVSKKVTLK;AADGKTTLK;SAGINLEGK;GSGTLEGEK;TQ
AIKKTGK;GGMKVLVSK;RANGTRLEY;ISVNSQKTK;KSDGSGKAK
A2301 KYDSAGTNL;KYLLGIGLT
A2402 KYLLGIGLT
A2403 KYLLGIGLT;KYDSAGTNL
A2601
A2602 DLPGGMKVL
A2902
A3001
KTKNLVFTK;YSLMATVEK;AVEITTLEK;RANGTRLEY;KDKSSTEEK;SGKAKEVLK;KSDGSGKAK;T
SVNSQKTK;
A3002 RANGTRLEY
A3101 KTKNLVFTK;LTTSVNSQK;VVLSKNILK;LTLALIACK
A3301 ETSEKTIVR
A6801
LTTSVNSQK;TIVRANGTR;YSLMATVEK;ETSEKTIVR;KITTLEKLK;LTIAEDLSK;KTKNLVFTK;S
IEEKFNEK;LVSKKVTLK;ATVEKLELK
A6802 KTSGLTTSV;FTKEDTITV;TLKVTEGT;DLSKITFFI
A6901 FTLFGTLAA;FTKEDTTTV;DLSKITFFI
B0702 IVRANGTRL;KVTEGTVVL;LAADGKTTL
B0801
B0802
B1501 GQKTKNLVF;RANGTRLEY;YLLGIGLIL
B1801 VEITTLEKL
B2705
B3501 LAADGKTTL;RANGTRLEY;
B3901

Fig. 41 continued

R4001 KFVLRDFTL;AEDLSKTTF;GRTSEKTTV
R4002 GRTSEKTTV;AEDLSKTTF;KFVLRDFTL
R4402 AEDLSKTTF
R4403 KFVLRDFTL
R4501 AEDLSKTTF
R5101 LPGGMKVLV
R5301 LPGGMKVLV
R5401 LPGGMKVLV
R5701
R5801 RANGTRLEY

Allele 10-mer
A0101
A0201 YLLGIGLILA;SLDEKNSVSV;ALDDSDTTQA;LMATVEKLEL;LLGIGLILAL
A0202
YLLGIGLILA;LLGIGLILAL;LMATVEKLEL;TLAADGKTTL;SLDEKNSVSV;ALDDSDTTQA;VLKDF
TLEGT;ILKSGELTVA;YSLMATVEKL
A0203
SLDEKNSVSV;YLLGIGLILA;LLGIGLILAL;VLKDFTLEGT;ILKSGELTVA;TLAADGKTTL;LMATV
EKLEL;TLKVTEGTVV;ALDDSDTTQA;NILKSGELTV
A0204 SLDEKNSVSV;LMATVEKLEL;TLAADGKTTL;LLGIGLILAL;SVDLPGGMKV
A0206
SLDEKNSVSV;YLLGIGLILA;NILKSGELTV;ALDDSDTTQA;LLGIGLILAL;FTLEGTLAAD;AADGK
TTLKV;TLKVTEGTV
A0211
SLDEKNSVSV;YLLGIGLILA;DLPGGMKVLV;ALDDSDTTQA;LLGIGLILAL;TLAADGKTTL;LMATV
EKLEL;SVDLPGGMKV;NILKSGELTV;AADGKTTLKV;VLKDFTLEGT;TLKVTEGTVV;ILKSGELTVA
;TTLKVTEGTV;SKISTLTISV;EISEKTIVRA;VFTKEDTITV
A0212
SLDEKNSVSV;YLLGIGLILA;LLGIGLILAL;DLPGGMKVLV;LMATVEKLEL;ALDDSDTTQA;TLAAD
GKTTL;VLKDFTLEGT;NILKSGELTV;SVDLPGGMKV;ILKSGELTVA;AADGKTTLKV;TLKVTEGTVV
A0216
SLDEKNSVSV;DLPGGMKVLV;YLLGIGLILA;LLGIGLILAL;ALDDSDTTQA;NILKSGELTV;TLAAD
GKTTL;LMATVEKLEL;AADGKTTLKV;SVDLPGGMKV;TLKVTEGTVV;TTLKVTEGTV;TTVRANGTRL
;ILKSGELTVA;NLVFTKEDTT
A0219
SLDEKNSVSV;ALDDSDTTQA;LLGIGLILAL;YLLGIGLILA;DLPGGMKVLV;TLAADGKTTL;AADGK
TTLKV;LMATVEKLEL;NILKSGELTV
A0301
TLVSKKVTLK;TLTISVNSQK;KYSLMATVEK;TVVLSKNTLK;KLTTAEDLSK;QLLALTACK;LAADG
KTTLK;VTEGTVVLSK;KLELKGTSDK;GMKVLVSKEK;KAVEITTLEK;LSKTTFEIFK;VSVDLPGGMK
;TTQATKKTGK
A1101
TVVLSKNTLK;TTQATKKTGK;VTEGTVVLSK;SSTEKKFNEK;KAVEITTLEK;QLLALTACK;KQNVS
SLDEK;TLTISVNSQK;TLVSKKVTLK;VSVDLPGGMK;LSKTTFEIFK;TISVNSQKTK;MATVEKLEK
;LAADGKTTLK;KTTVRANGTR;KLTTAEDLSK;KVLVSKEKDK;GSGKAKFVLK;GTLRGEKTEK;KYSL
MATVEK;LEKLKDALK;GMKVLVSKEK
A2301 KYSLMATVEK;KYLLGIGLIL;DLSKTTFELF;NSGKTKNLVF
A2402 KYLLGIGLIL;
A2403 KYLLGIGLIL;
A2601
A2602 CVSVDLPGGM;EIFKEDGKIL
A2902
A3001
KAVEITTLEK;GTLREYTELK;LSKTTFEIFK;KQNVSSLDEK;KYSLMATVEK;GMKVLVSKEK;KVLVS
KEKDK;TTQATKKTGK;VSKKVTLKDK;TVVLSKNTLK;RTIVRANGTR;KLELKGTSDK

Fig. 41 continued

A3002
A3101 KYSLMATVEK;KTTVRANGTR;LSKTTFETFK
A3301
A6801
TVVLSKNTLK;MATVEKLEL;TLTISVNSQK;DSAGTNLEGK;TTQATKKTGK;LAADGKTTLK;KTTVR
ANGTR;TISVNSQKTK;TLVSKKVTLK;SSTFEKFKEK;KAVETTLEK;LSKTTFETFK
A6802 TTLKVTEGTV;FTSEKTTVRA;LGTGLTLALT
A6901
TTLKVTEGTV;NLLKSGETTV;SVDLPGGMKV;FTSEKTTVRA;YLLGTGLTLA;TTLEKLKDAL;
B0702
B0801
B0802
B1501
B1801 VDLPGGMKVL;
B2705
B3501 LAEDLSKTTF
B3901
B4001
B4002
B4402
B4403
B4501 EEKSTEKGET
B5101
B5301
B5401 LPGGMKVLVS
B5701
B5801

Allele 11-mer
A0101
A0201
YLLGTGLTLAL;SLMATVEKLEL;LVFTKEDTTTV;LLGTGLTLALT;TLALTACKQNV;ALDDSETTQAT
A0202
TLALTACKQNV;SLMATVEKLEL;YLLGTGLTLAL;LTACKQNVSSL;TLKSGETTVAL;LLGTGLTLALT
;KAVETTLEKL;VLKDFTLEGTL;LVFTKEDTTTV;SVNSQKTKNLV;NVSSLDEKNSV;ALDDSETTQA
T;LAADGKTTLKV
A0203
LTACKQNVSSL;VLKDFTLEGTL;YLLGTGLTLAL;TLALTACKQNV;LLGTGLTLALT;TLKSGETTVAL
;SLMATVEKLEL;LVFTKEDTTTV;LAADGKTTLKV;SVNSQKTKNLV;TLKVTEGTVVL;KTTLKVTEGT
V
A0204
SLMATVEKLEL;YLLGTGLTLAL;LVFTKEDTTTV;LAADGKTTLKV;TLALTACKQNV;SVNSQKTKNLV
A0206
YLLGTGLTLAL;KAVETTLEKL;LVFTKEDTTTV;LAADGKTTLKV;LLGTGLTLALT;ALDDSETTQAT
;TLALTACKQNV;LTACKQNVSSL;SLMATVEKLEL;KTTVRANGTRL;TTLKVTEGTVV
A0211
YLLGLGLILAL;TLALTACKQNV;SLMATVEKLEL;ALDDSETTQAT;LLGLGLILALI;TLKSGETTVAL
;VLKDFTLEGTL;LAADGKTTLKV;LVFTKEDTTTV;FTFKEDGKTLV;SVNSQKTKNLV;SSLDEKNSVS
V;NVSSLDEKNSV;TLKVTEGTVVL;SVDLPGGMKVL;VDLPGGMKVLV;TTLKVTEGTVV;NLEGKAVET
TI;KTDKSKVELTT
A0212
YLLGLGLILAL;VLKDFTLEGTL;TLKSGETTVAL;SLMATVEKLEL;ALDDSETTQAT;TLALTACKQNV
;LVFTKEDTTTV;LAADGKTTLKV;LLGLGLILALI;FIFKEDGKTLV;SSLDEKNSVSV;SVNSQKTKNL
V;NVSSLDEKNSV;TLKVTEGTVVL
A0216
YLLGLGLILAL;SLMATVEKLEL;TLALTACKQNV;TLKSGETTVAL;VLKDFTLEGTL;LVFTKEDTTTV

Fig. 41 continued

;LAADGKTTLKV;TIGTGLTIALT;EIFKEDGKTLV;SVNSQKTKNLV;ALDDSDTTQAT;NVSSLDFKNS
V;TLKVTEGTVVL;NLEGKAVEITT;TTLKVTEGTVV;LIAGKQNVSSL
A0219
YLLGTGLTIAL;LAADGKTTLKV;SLMATVEKLEL;TIALIAGKQNV;ALDDSDTTQAT;TLKSGETTVAL
;TLGTGLTIALT;NVSSLDFKNSV;LVFTKEDTTTV;VLKDFTLEGTL;LIAGKQNVSSL
A0301
TLAADGKTTLK;STLTTSVNSQK;KTIVSKKVILK;KVTEGTVVLSK;LMATVEKLELK;LTTSVNSQKTK
;GTVVLSKNILK;FTKEDTITVQK;TVRANGTRLEY;TTLEKLKDALK
A1101
STLTTSVNSQK;TTFEIFKEDGK;SVSVDLPGGMK;KVTEGTVVLSK;KTIVSKKVILK;TTLEKLKDALK
;GTVVLSKNILK;TLAADGKTTLK;LTTSVNSQKTK;SQKTKNLVFTK;KSSTFEKFNEK;AVEITTIFKL
K;AIKKTGKVDSK;LMATVEKLELK;TLKDKSSTEEK;FTKEDTITVQK;DLSKTTFEIFK;TLEGTLAAD
GK;LVSKKVILKDK
A2301 KYSLKATVEKL
A2402 KYSLMATVEKL;KSDSKTSTLTT
A2103 KYSLKATVEKL
A2601
A2602 TIAEDLSKTTF;KTIVRANGTRL;SVDLPGGMKVL;
A2902 IVRANGTRLEY
A3001
KTLVSKKVILK;AIKKTGKVDSK;TLKDKSSTEEK;KVTEGTVVLSK;IVRANGTRLEY;SQKTKNLVFTK
;KFNEKGEISEK;FTKEDTITVQK;GTVVLSKNILK;AVEITTIFKLK;TTLSVNSQKTK
A3002
A3101 KTLVSKKVILK;SQKTKNLVFTK;KFNEKGEISEK;STLTSVNSQK
A3301 DLSKTTFEIFK;LKTIVRANGTR
A6801
TTFEIFKEDGK;STLTSVNSQK;LTTSVNSQKTK;DTTQATKKTGK;FTKEDTITVQK;DLSKTTFEIFK
;TTLEKLKDALK;TLAADGKTTLK;LMATVEKLELK;EKTIVRANGTR;GTVVLSKNILK;SVSVDLPGGM
K;LVSKEDKDGK;TLKDKSSTEEK;YTDIKSDGSGK
A6802
NVSSLDFKNSV;EIFKEDGKTLV;TTLKVTEGTVV;DTLLVQKYDSA;SVNSQKTKNLV;TIALIAGKQNV
;LIAGKQNVSSL;LVFTKEDTTTV;LAADGKTTLKV;
A6901
LAADGKTTLKV;TTLKVTEGTVV;EIFKEDGKTLV;YLLGTGLTIAL;LVFTKEDTTTV;SVNSQKTKNLV
B0702
B0801
B0802
B1501 TVRANGTRLEY;YLLGTGLTIAL;VQKYDSAGTNL
B1801
B2705
B3501 TIAEDLSKTTF
B3901
B4001 FFIFKEDGKTL;LEGKAVEITTL;AEDLSKTTFEI;GEKTDKSKVKI
B4002
B4402
B4403
B4501 AEDLSKTTFEI
B5101
B5301
B5401 LPGGMKVLVSK
B5701
B5801

Allele 15-mer plus 9-mer core
DRB1 0101 KKYLLGIGLLALIA LLGIGLLLA;KYLLGIGLLALIAG LLGIGLLLA;KIGKWDSKISTLTIS

DRB1_0404 KEVLKDFTLEGTLAA-VLKDFTLEG;GKAKEVLKDFTLEGT-
VLKDFTLEG;AKEVLKDFTLEGTLA-VLKDFTLEG;KAKEVLKDFTLEGTL-
VLKDFTLEG;SGKAKEVLKDFTLEG-AKEVLKDFT
DRB1_0405 TITVQKYDSAGTNLE-VQKYDSAGT;ITVQKYDSAGTNLEG-
YDSAGTNLE;TVQKYDSAGTNLEGK-YDSAGTNLE;VQKYDSAGTNLEGKA-
YDSAGTNLE;QKYDSAGTNLEGKAV-YDSAGTNLE
DRB1_0701 DGKTTLKVTEGTVVL-LKVTEGTVV;GKTTLKVTEGTVVLS-
LKVTEGTVV;KTTLKVTEGTVVLSK-LKVTEGTVV;ADGKTTLKVTEGTVV-
TLKVTEGTV;TTLKVTEGTVVLSKN-LKVTEGTVV
DRB1_0802
DRB1_0901
DRB1_1101
DRB1_1302 TEGTVVLSKNILKSG-TVVLSKNIL;EGTVVLSKNILKSGE-
TVVLSKNIL;GTVVLSKNILKSGEI-VVLSKNILK;VTEGTVVLSKNILKS-
TVVLSKNIL;TVVLSKNILKSGEIT-TVVLSKNIL;ISEKTIVRANGTRLE-
IVRANGTRL;SEKTIVRANGTRLEY-IVRANGTRL;EKTIVRANGTRLEYT-
IVRANGTRL;KTIVRANGTRLEYTD-IVRANGTRL;TLTISVNSQKTKNLV-
VNSQKTKNL;STLTISVNSQKTKNL-ISVNSQKTK;LTISVNSQKTKNLVF-
VNSQKTKNL;KVTEGTVVLSKNILK-TVVLSKNIL;TISVNSQKTKNLVFT-
VNSQKTKNL;LKVTEGTVVLSKNIL-LKVTEGTVV;TIVRANGTRLEYTDI-
VRANGTRLE;ISVNSQKTKNLVFTK-VNSQKTKNL;VVLSKNILKSGEITV-
VVLSKNILK;EISEKTIVRANGTRL-KTIVRANGT;EDGKTLVSKKVTLKD-
LVSKKVTLK;DGKTLVSKKVTLKDK-LVSKKVTLK
DRB1_1501 TEGTVVLSKNILKSG-VLSKNILKS;EGTVVLSKNILKSGE-VLSKNILKS
DRB3_0101
DRB4_0101
DRB5_0101 LPGGMKVLVSKEKDK-MKVLVSKEK;GGMKVLVSKEKDKDG-
MKVLVSKEK;VDLPGGMKVLVSKEK-VDLPGGMKV;PGGMKVLVSKEKDKD-
MKVLVSKEK;DLPGGMKVLVSKEKD-MKVLVSKEK;

<AAN87995 Outer Surface Protein C;Protein;Borrelia garinii>
SEQ ID NO:176569-176943
Allele 8-mer
A0101 ITDSNAFV
A0201 LMTLFLFI;LLAGAYAI;FVLAVKEV;SLLAGAYA;ITDSNAFV;LISSIDEL
A0202
LLAGAYAI;LISSIDEL;LMTLFLFI;KLKNSEEL;GAYAISTL;ILMTLFLF;SLLAGAYA;FVLAVKEV
;ITDSNAFV;VIHQNNGL
A0203
LLAGAYAI;LMTLFLFI;FVLAVKEV;SLLAGAYA;GAYAISTL;KLKNSEEL;LISSIDEL;AVKEVEAL
;GQNGSLLA;VIHQNNGL;HQNNGLNA
A0204 FVLAVKEV;SLLAGAYA;LLAGAYAI
A0206
AQLGVAAA;FVLAVKEV;LLAGAYAI;GQNGSLLA;ITDSNAFV;LMTLFLFI;SLLAGAYA;ILMTLFLF
;HQNNGLNA;GAYAISTL;
A0211
LLAGAYAI;SLLAGAYA;FVLAVKEV;LMTLFLFI;ITDSNAFV;TLFLFISC;KLKNSEEL;ELTNPVVA
;RLKGSHAQ;LISSIDEL;ILMTLFLF;AKGPNLTV
A0212
LLAGAYAI;FVLAVKEV;SLLAGAYA;LMTLFLFI;VIHQNNGL;ITDSNAFV;TLFLFISC;KLKNSEEL
;RLKGSHAQ
A0216
SLLAGAYA;LLAGAYAI;FVLAVKEV;ITDSNAFV;KLKNSEEL;LMTLFLFI;LISSIDEL;TLFLFISC
;GAYAISTL;AKGPNLTV;ELTNPVVA
A0219 LLAGAYAI;ITDSNAFV;FVLAVKEV;SLLAGAYA;LMTLFLFI;LISSIDEL
A0301 ILKSNPTK;LITEKLSK;ISTLITEK;NLTVISKK;KSNPTKDK A0101
STDFLANK;TSTLTTEK;NAFVLAVK;AATDDEAK;LTTEKLSK;KSNPTKDK;LANKAIGK;EAKEATLK
;PVVAESPK;EAFTNRLK;ESVESLAK
A2301 TLMTLFLF;AYATSTLT
A2402 AYATSTLT;TLMTLFLF
A2403 AYATSTLT
A2601
A2602 KTTDSNAF;
A2902 TLMTLFLF;
A3001 KSNPTKDK;TLKSNPTK;PTKDKQAK;EAKEATLK;LANKAIGK;RLKGSHAQ;TEKLSKL
A3002
A3101 HSEAFTNR;
A3301 HSEAFTNR;
A6801
EAFTNRLK;HSEAFTNR;NAFVLAVK;ESVESLAK;TSTLTTEK;EALANSVK;NLTVTSKK;EAKEATLK
;LANKAIGK
A6802 FVLAVKEV;LLAGAYAT;SNAFVLAV;STDFDESA
A6901 FVLAVKEV;TTDSNAFV;ESAKGPIL
B0702
B0801
B0802
B1501 KTTDSNAF;TLMTLFLF;SLLAGAY
B1801 DELANKAI
B2705
B3501
B3901 DEAKEAIL
B4001 SEAFTNRL
B4002 KELTNPVV
B4402
B4403 KEVEALIS
B4501
B5101
B5301
B5401
B5701
B5801

Allele 9-mer
A0101
A0201 TLMTLFLFT;ALTSSTDEL;KTTDSNAFV;SLLAGAYAT;ALANSVKEL
A0202
ALTSSTDEL;TLMTLFLFT;KTTDSNAFV;SVKELTNPV;LTSSTDELA;SLAKAAQEA;ALANSVKEL;F
LFTSCNNS;LTTEKLSKL;RLKGSHAQL;KVIHQNNGL;GAYATSTLT;SLLAGAYAT;LLAGAYATS;FL
KDLSESV;VLAVKEVEA;DLSESVEST;LAVKEVEAL
A0203
SVKELTNPV;ALTSSTDEL;ALANSVKEL;TLMTLFLFT;LTTEKLSKL;KTTDSNAFV;RLKGSHAQL;F
LKDLSESV;SLAKAAQEA;SLLAGAYAT;LANKAIGKV;GAYATSTLT;VLAVKEVEA;AVKEVEALI;LL
AGAYATS;FLNKKIFFA;FLFTSCNNS;
A0204
SLLAGAYAT;SLAKAAQEA;ALANSVKEL;ALTSSTDEL;KTTDSNAFV;TLMTLFLFT;VLAVKEVEA
A0206
KTTDSNAFV;SLLAGAYAT;ALTSSTDEL;TLMTLFLFT;AQEALANSV;AQLGVAAAT;SVKELTNPV;G
AYATSTLT;KVIHQNNGL;LTTEKLSKL
A0211
KTTDSNAFV;SLLAGAYAT;FLKDLSESV;SLAKAAQEA;RLKGSHAQL;TLMTLFLFT;ALANSVKEL;D

Fig. 41 continued

LSESVESL;ALTSSIDEL;SVKELTNPV;STDELANKA;SAKQPNLTV;VLAVKEVEA;TTDSNAFVI;FL
NKKIFEA;LTTEKLSKL;ATDDHAKEA;NLTVTSKKI
A0212
SLLAGAYAT;ELKDLSESV;TIMTLFLFI;KTTDSNAFV;SLAKAAQEA;ALTSSIDEL;RIKQSHAQI;V
LAVKEVEA;DLSESVESL;SVKELTNPV;STDELANKA;LTTEKLSKL;SAKQPNLTV;ALANSVKEL
A0216
ELKDLSESV;KTTDSNAFV;SLLAGAYAT;SLAKAAQEA;ALTSSIDEL;RIKQSHAQL;ALANSVKEL;T
IMTLFLFI;SVKELTNPV;DLSESVESL;SAKQPNLTV;FLNKKIFEA;VLAVKEVEA;LTTEKLSKL
A0219
SLLAGAYAT;ELKDLSESV;KTTDSNAFV;ALTSSIDEL;DLGESVESL;TIMTLFLFI;TTDSNAFVI;S
LAKAAQEA;ALANSVKEL
A0301 ALLKSNPIK;TLITEKLSK;ALSTLITEK;ELANKAIGK;ITEKLSKLK
A1101
SSIDELANK;ALSTLITEK;SLNPEESAK;ALLKSNPIK;TLITEKLSK;AAAIDEHAK;ITEKLSKLK;S
NAFVLAVK;
A2301
A2402
A2403
A2601
A2602 EAKNHSEAF;KVIEQNKGL;EVEALISSI
A2902
A3001 ALLKSNPIK;ITEKLSKLK;KDKGAKELK;SVKELTNPV;STNPDESAK
A3002
A3101
A3301
A6801 SLNPDESAK;ELANKAIGK;SSIDELANK;SNAFVLAVK;ITEKLSKLK
A6802
SVKELTNPV;EVEALISSI;DSNAFVLAV;ELKDLSESV;ILMTLFLFI;HSEAFTNRL;ISTLITEKL;L
SSIDELA;ESVESLAKA
A6901 SLLAGAYAT;SVKELTNPV;ESVESLAKA;DSNAFVLAV
B0702
B0801
B0802
B1501
B1801
B2705
B3501 EAKNHSEAF;LAVKEVEAL;NGSLLAGAY
B3901 HSEAFTNRL
B4001
B4002
B4402
B4403
B4501 EFAKNHSFA
B5101
B5301
B5401
B5701
B5801 TTDSNAFVI

Allele 10-mer
A0101
A0201
ALSSIDELA;LLAGAYATST;KTTDSNAFVL;SLAKAAQEAL;ILMTLFLFIS;FVLAVKEVEA;VLAVK
EVEAL;TLITEKLSKL;ALSTLITEKL

Fig. 41 continued

A0202
ALTSSTDELA;SLAKAAQEAI;LLAGAYATST;VLAVKEVEAL;TLITEKLSKL;AISTLITEKL;FLFTS
CNNSG;LAGAYATST;TLMTLFLFTS;KITDSNAFVL;ELANKATGKV;FVLAVKEVEA;TMTLFLFTSC
A0203
CQNGSLLAGA;LLAGAYATST;ALTSSTDELA;TLITEKLSKL;SLAKAAQFAI;VLAVKEVEAL;ELANK
ATGKV;AISTLITEKL;SVKELTNPVV;AAQEALANSV;HQNNGLNANA
A0204 SLAKAAQEAI;ELANKATGKV;VLAVKEVEAL;FVLAVKEVEA;AAQEALANSV
A0205
CQNGSLLAGA;KEVEALTSST;AAQEALANSV;KITDSNAFVL;HQNNGLNANA;FVLAVKEVEA;ALTSS
TDELA;KEIKDLSFSV;KKITDSNAFV;LLAGAYATST;SLAKAAQEAL;SVKELTNPVV
A0211
SLAKAAQEAL;KITDSNAFVL;ELANKATGKV;LLAGAYATST;SIDELANKAI;VLAVKEVEAL;SVKEL
TNPVV;TLITEKLSKL;ALTSSTDELA;DLSFSVESLA;SLLAGAYATS;LMTLFLFTSC;ATDDHAKFAT
;AISTLITEKL;FVLAVKEVEA;AAQEALANSV;ALANSVKELT
A0212
SLAKAAQEAL;VLAVKEVEAL;LLAGAYATST;TLITEKLSKL;ELANKATGKV;SIDELANKAI;FVLAV
KEVEA;SVKELTNPVV;KITDSNAFVL;AAQEALANSV;SLLAGAYATS
A0216
SLAKAAQEAL;ELANKATGKV;TLITEKLSKL;LLAGAYATST;VLAVKEVEAL;KITDSNAFVL;ALTSS
TDELA;SVKELTNPVV;AAQEALANSV;AISTLITEKL;FVLAVKEVEA;ALANSVKELT;DLSFSVESLA
A0219
SLAKAAQEAL;LLAGAYATST;ELANKATGKV;KITDSNAFVL;VLAVKEVEAL;TLITEKLSKL;AAQEA
LANSV
A0301 STLITEKLSK;KLKNSEELNK;LITEKLSKLK;ILKSNPTKDK;HSFAFTNRLK;LSFSVESLAK
A1101
STLITEKLSK;YATSTLITEK;ISSIDELAKK;HSFAFTNRLK;ASTNPDFSAK;DSNAFVLAVK;VAAAT
DDHAK;LSFSVESLAK;AQEALANSVK;LITEKLSKLK;KLKNSEELNK
A2301
A2402
A2403
A2601
A2602
A2902
A3001 KLKNSEELNK;KCPNLTVTSK;STLITEKLSK;TLKSNPTKDK;HSFAFTNRLK
A3002
A3101
A3301
A6801
YATSTLITEK;DSNAFVLAVK;EATLKSNPTK;HSFAFTNRLK;ELNKKTFFAK;VAAATDDHAK;STLIT
EKLSK;LSFSVESLAK
A6802
NSVKELTNPV;ESAKCPNLTV;ELANKATGKV;NAFVLAVKEV;TASTNPDFSA;AGAYATSTLT;NANAG
QNGSL;
A6901 ESAKCPNLTV;EALANSVKEL;ELANKATGKV;EALTSSTDEL;NAFVLAVKEV;FVLAVKEVEA
B0702
B0801
B0802
B1501
B1801 KEVEALTSST
B2705
B3501
B3901 NSHAFTNRL
B4001 KEVEALTSST
B4002 EEAKNGSAF
B4402
B4403 EEAKNGSAF

Fig. 41 continued

B4501 FFAKNHSFAF
B5101
B5301 LAVKEVEAL
B5401
B5701
B5801

Allele 11-mer
A0101 TTDSNAFVLAV
A0201
LLAGAYAISTL;FVLAVKEVEAL;KTTDSNAFVLA;SLLAGAYAIST;TTDSNAFVLAV;VLAVKEVEAL
;YAISTLITEKL;KLSKLKNSEEL
A0202
LLAGAYAISTL;KLSKLKNSEEL;SLAKAAQEALA;VLAVKEVEALL;RLKGSHAQLGV;FVLAVKEVEAL
;YAISTLITEKL;KTTDSNAFVLA;FLFTSCNNSCG;KAAQEALANSV;LAGAYAISLT;LLMTLFLFTSC
A0203
LLAGAYAISTL;RLKGSHAQLGV;SLAKAAQEALA;VLAVKEVEALL;YAISTLITEKL;KAAQEALANSV
;SVKELTREVVA;KLSKLKNSEEL;KTTDSNAFVLA;LLMTLFLFLSC;FVLAVKEVEAL
A0204 LLAGAYAISTL;SLAKAAQEALA;SLLAGAYAIST;FVLAVKEVEAL;VLAVKEVEALL
A0206
FVLAVKEVEAL;KAAQEALANSV;YAISTLITEKL;KTTDSNAFVLA;LLAGAYAISTL;SLLAGAYAIST
;LLMTLFLFLSC;TTDSNAFVLAV;RLKGSHAQLGV
A0211
RLKGSHAQLGV;LLAGAYAISTL;SLLAGAYAIST;KLSKLKNSEEL;TTDSNAFVLAV;SLAKAAQEALA
;KTTDSNAFVLA;VLAVKEVEALL;FVLAVKEVEAL;LLMTLFLFLSC;ATDDHAKEALL;KAAQEALANS
V;ELANKALGKVI
A0212
RLKGSHAQLGV;LLAGAYAISTL;KLSKLKNSEEL;SLLAGAYAIST;FVLAVKEVEAL;TTDSNAFVLAV
;VLAVKEVEALL;SLAKAAQEALA;LLMTLFLFLSC;ATDDHAKEALL
A0216
LLAGAYAISTL;RLKGSHAQLGV;KLSKLKNSEEL;SLAKAAQEALA;SLLAGAYAIST;VLAVKEVEALL
;TTDSNAFVLAV;FVLAVKEVEAL
A0219
LLAGAYAISTL;TTDSNAFVLAV;RLKGSHAQLGV;FVLAVKEVEAL;SLLAGAYAIST;KLSKLKNSEEL
;YAISTLITEKL;
A0301 TLITEKLSKLK;KLKNSEELNKK;LTNPVVAESPK;TSTLITEKLSK;ATLKSNPTKDK
A1101
LTNPVVAESPK;GVAAATDDHAK;AAQEALANSVK;TLITEKLSKLK;TSTLITEKLSK;TASTNPDESAK
;LTSSTDELANK;KSNPTKDKQAK;ATLKSNPTKDK;AYAISTLITEK
A2301 AYAISTLITEK
A2402
A2403
A2601
A2602 ATDDHAKEALL
A2902
A3001
KSNPTKDKQAK;LTNPVVAESPK;KLKNSEELNKK;PTKDKQAKELK;ATLKSNPTKDK;RLKGSHAQLGV
A3002
A3101 LTNPVVAESPK;KSNPTKDKQAK
A3301
A6801
LTNPVVAESPK;TASTNPDESAK;LSSTDELANK;TSTLITEKLSK;GVAAATDDHAK;TLITEKLSKLK
A6802
DIASTNPDESA;FVLAVKEVEAL;ESAEGPDLIVL;YAISTLITEKL;KGSLLAGAYAI;SNAFVLAVKEV
A6901 TTDSNAFVLAV;FVLAVKEVEAL;YAISTLITEKL;DIASTNPDESA;EALLSSTDELA

Fig. 41 continued

```
B0702  NPTKDKQAKFL
B0801
B0802
B1501  QNGSLLAGAY;ISKKITDSNAF
B1601
B2705
B3501  YAISTLITEKL;FVLAVKEVEAL
B3901
B4001  VEALTSSTDEL;QEALANSVKEL
B4002
B4402
B4403
B4501  EFAKNHSFAFT
B5101
B5301
B5401
B5701
B5801
```

Allele 15-mer plus 9-mer core

```
DRB1_0101  GSLLAGAYAISTLIT  LAGAYAIST;KGSLLAGAYAISTLL
LAGAYAIST;QNGSLLAGAYAISTL  LAGAYAIST;SLLAGAYAISTLIT
LAGAYAIST;GQNGSLLAGAYAIST  LLAGAYALS;NRLKGSHAQLGVAAA
LKGSHAQLG;TNRLKGSHAQLGVAA  LKGSHAQLG;AFTNRLKGSHAQLGV
LKGSHAQLG;EAFTNRLKGSHAQLG  TNRLKGSHA;FTNRLKGSHAQLGVA
LKGSHAQLG;LAGAYAISTLITEKL  LAGAYAIST;LLAGAYAISTLITEK
LAGAYAIST;LKGSHAQLGVAATD   LKGSHAQLG;RLKGSHAQLGVAAAT
LKGSHAQLG;AGAYAISTLITEKLS  ISTLITEKL;HQNNGLNANAGQNGS
LNANAGQNG;IHQNNGLNANAGQNG  NNGLNANAG;YAISTLITEKLSKLK
ISTLITEKL;AYAISTLITEKLSKL  ISTLITEKL;GAYAISTLITEKLSK
ISTLITEKL;NNGLNANAGQNGSLL  LNANAGQNG;QNNGLNANAGQNGSL
LNANAGQNG;NGLNANAGQNGSLLA  LNANAGQNG;LNANAGQNGSLLAGA
LNANAGQNG;AKEATLKSNPTKDKQ  LKSNPTKDK;GLNANAGQNGSLLAG
LNANAGQNG;ANSVKELTNPVVAES  VKELTNPVV;HAKEATLKSNPTKDK
EATLKSNPT;NSVKELTNPVVAESP  LTNPVVAES;KGSHAQLGVAAATDD
AQLGVAAAT;GSHAQLGVAAATDDH  LGVAAATDD;AGQNGSLLAGAYATS
QNGSLLAG;EATLKSNPTKDKQAK   LKSNPTKDK;KEATLKSNPTKDKQA
LKSNPTKDK;SHAQLGVAAATDDHA  LGVAAATDD;AISTLITEKLSKLKN
ISTLITEKL;ISTLITEKLSKLKNS  ISTLITEKL;SVKELTNPVVAESPK
LTNPVVAES;VLAVKEVEALTSSTD  VKEVEALTS;AFVLAVKEVEALTSS
VKEVEALTS;FVLAVKEVEALTSST  VKEVEALTS;LAVKEVEALTSSTDE
VKEVEALTS;MAFVLAVKEVEALTS  LAVKEVEAL;HAQLGVAAATDDHAK
LGVAAATDD;SSTDELANKATGKVT  LANKATGKV;ESLAKAAQEALANSV
LAKAAQEAL;TSSTDELANKATGKV  TDELANKAT;EALANSVKELTNPVV
LANSVKELT;AQLGVAAATDDHAKE  LGVAAATDD;TDELANKATGKVTEQ
LANKATGKV;STDELANKATGKVTE  LANKATGKV;LANSVKELTNPVVAE
VKELTNPVV;ALANSVKELTNPVVA  VKELTNPVV;VESLAKAAQEALANS
LAKAAQEAL;ESVESLAKAAQEALA  SLAKAAQEA;ATLKSNPTKDKQAKE
LKSNPTKDK;DELANKATGKVTEQN  LANKATGKV;SVESLAKAAQEALAN
LAKAAQEAL;SLAKAAQEALANSVK  AQEALANSV;SESVESLAKAAQEAL  SLAKAAQEA
DRB1_0301
DRB1_0401  EALANSVKELTNPVV  SVKELTNPV;QEALANSVKELTNPV
LANSVKELT;LANSVKELTNPVVAE  SVKELTNPV;ALANSVKELTNPVVA
SVKELTNPV;ANSVKELTNPVVAES  SVKELTNPV
```

DRB1_0404 LMTLFLFISCNNSGG-LFISCNNSG;MTLFLFISCNNSGGD-
LFISCNNSG;ILMTLFLFISCNNSG-FLFISCNNS;TLFLFISCNNSGGDT-
LFISCNNSG;LFLFISCNNSGGDTA-LFISCNNSG
DRB1_0405 ANSVKELTNPVVAES-VKELTNPVV;LANSVKELTNPVVAE-
VKELTNPVV;EALANSVKELTNPVV-SVKELTNPV;NSVKELTNPVVAESP-
VKELTNPVV;ALANSVKELTNPVVA-VKELTNPVV
DRB1_0701 VISKKITDSNAFVLA-ITDSNAFVL;ISKKITDSNAFVLAV-
ITDSNAFVL;TVISKKITDSNAFVL-SKKITDSNA;SKKITDSNAFVLAVK-
ITDSNAFVL;KKITDSNAFVLAVKE-ITDSNAFVL;ALANSVKELTNPVVA-
VKELTNPVV;LANSVKELTNPVVAE-VKELTNPVV;ANSVKELTNPVVAES-
VKELTNPVV;NSVKELTNPVVAESP-VKELTNPVV;EALANSVKELTNPVV-
SVKELTNPV;KITDSNAFVLAVKEV-ITDSNAFVL;ITDSNAFVLAVKEVE-ITDSNAFVL
DRB1_0802
DRB1_0901
DRB1_1101
DRB1_1302 EALANSVKELTNPVV-LANSVKELT;SAKGPNLTVISKKIT-
KGPNLTVIS;KGPNLTVISKKITDS-LTVISKKIT;AKGPNLTVISKKITD-
LTVISKKIT;QEALANSVKELTNPV-LANSVKELT;GPNLTVISKKITDSN-
LTVISKKIT;PNLTVISKKITDSNA-LTVISKKIT;AAQEALANSVKELTN-
LANSVKELT;KAAQEALANSVKELT-EALANSVKE;AQEALANSVKELTNP-
LANSVKELT;ALANSVKELTNPVVA-LANSVKELT;LANSVKELTNPVVAE-
LANSVKELT;AKEAILKSNPTKDKG-EAILKSNPT;KAKEAILKSNPTKDK-
EAILKSNPT;NLTVISKKITDSNAF-LTVISKKIT;LTVISKKITDSNAFV-
LTVISKKIT;AIGKVIHQNNGLNAN-IHQNNGLNA;IGKVIHQNNGLNANA-
HQNNGLNAN;KEAILKSNPTKDKGA-LKSNPTKDK;EAILKSNPTKDGKAK-
LKSNPTKDK;GKVIHQNNGLNANAG-HQNNGLNAN;LAGAYAISTLITEKL-
YAISTLITE;KVIHQNNGLNANAGQ-HQNNGLNAN;AGAYAISTLITEKLS-
ISTLITEKL;HQNNGLNANAGQNGS-LNANAGQNG;YAISTLITEKLSKLK-
ISTLITEKL;AYAISTLITEKLSKL-ISTLITEKL;NGLNANAGQNGSLLA-LNANAGQNG
DRB1_1501 ALANSVKELTNPVVA-VKELTNPVV;ANSVKELTNPVVAES-
VKELTNPVV;LANSVKELTNPVVAE-VKELTNPVV;EALANSVKELTNPVV-
SVKELTNPV;NSVKELTNPVVAESP-VKELTNPVV
DRB3_0101
DRB4_0101
DRB5_0101

<CAF34024 outer surface protein VlsE;Protein;Borrelia garinii>
SEQ ID NO:176944-177458

Allele 8-mer
A0101
A0201 KLDELVSA;KISSAIFL;KIAAAIVL;ILKAIVEA
A0202
KISSAIFL;KLDELVSA;KIAAAIVL;ILKAIVEA;LTALLVFI;ALGEKGAL;FINCKNNA;SAIFLTAL
;FLTALLVF;AIFLTALL;AAGAVTAV;AVSGEQIL;GLVADTFF
A0203
ILKAIVEA;KLDELVSA;ALKDVKAA;FINCKNNA;ALGEKGAL;KISSAIFL;AAGAVTAV;KIAAAIVL
;SISSTLKA;MIKAAEEA;SAIFLTAL;LTALLVFI;AAIVLRGV;GIKGIVDA;IAKAAGAV
A0204 ALGEKGAL;AAGAVTAV;KIAAAIVL;KLDELVSA
A0206
KLDELVSA;KISSAIFL;SAIFLTAL;AAGAVTAV;KIAAAIVL;FIDVFNAF;FAGNANAA;AAIVLRGV
;KAAGAVTA;FLTALLVF;FESISSTL;WLEEMIKA;KASVESAV;AIFLTALL;
A0211
KLDELVSA;KISSAIFL;WLEEMIKA;ALGEKGAL;KIAAAIVL;AIFLTALL;ALKDVKAA;ILKAIVEA
;FLTALLVF;AKDGKFAV;AVSGEQIL;ALLVFINC;IFLTALLV;SISSTLKA;AAGAVTAV
A0212 KLDELVSA;ALGEKGAL;ALKDVKAA;WLEEMIKA;FLTALLVF;AKDGKFAV;AVSGEQIL

Fig. 41 continued

A0216
ALGFKQAL;KLDELVSA;KTSSATFL;AAGAVTAV;ATFLTALL;TLKAIVEA;WLFFMTKA;ALKDVKAA
;KTAAATVL;AVSGFQTL
A0219 KLDELVSA;KTSSATFL;AKDGKFAV
A0301 LVADTFFK;IVLRGVAK;LLVFTNCK;VSGFQTLK;FSTSSTLK;TLKATKGK
A1101
LVADTFFK;SAANHGAK;SSTLKATK;IVLRGVAK;VSGFQTLK;FSTSSTLK;SAAADIAK;AAFKDEMK
;SAVDEVSK;TFFKSDPK;GIVDAAGK;KAAFEAAK;IAAATVLR;LLVFTNCK;TLKATKGK
A2301 FYFSTINL;KWLEFMTK;GLVADTFF
A2402 FYFSTINL;IFLTALLV
A2403 FYFSTINL
A2601
A2602 FIDVFKAF
A2902
A3001
TLKATKGK;AGKALGEK;TFFKSDPK;AFKDEMKK;KGIAKGLK;IVLRGVAK;LVADTFFK;KWLEFMTK
A3002
A3101 IAAAIVLR;LVADTFFK
A3301 IAAAIVLR
A6801
ECLSSTLK;IAAAIVLR;LVADTFFK;EAKADAGK;LLVFTNCK;SAVDEVSK;SAANHGAK;SCTLKAIK
;TFFKSDPK;GSVKGLAK;AAFKDEMK;DENGAAFK;DPANQAGK
A6802 LIALLVFI;SAIFLTAL;DSAANHGA;FKAFSGLV;NAAVGAAA
A6901 LIALLVFI
B0702 SAIFLTAL
B0801
B0802
B1501 FLTALLVF;LINLGNGF
B1801 FESTSSTL
B2705
B3501 FIDVFKAF;SAIFLTAL;FAGNAKAA;NAAVGAAA
B3901 FRSTSSTL
B4001 FFSTSSTL
B4002
B4402
B4403
B4501 AFFAKYFT
B5101
B5301
B5401 FAGNAKAA
B5701
B5801 KSDVKTYF

Allele 9-mer
A0101
A0201
FLTALLVFI;KLFAGNAKA;KISSAIFLT;FINCKNNAV;AIFLTALLV;QLLKAIVEA;FAGNAKAAV;K
AAGAVTAV
A0202
FLTALLVFI;FINCKNNAV;TLKAIVEAA;KAAGAVTAV;KLFAGNAKA;FAGNAKAAV;SSATFLTAL;S
AIFLTALL;KISSAIFLT;SVESAVDEV;KAAEEAAKV;GIKGIVDAA;ALKDVKAAA;GLVADTFFK
A0203
FINCKNNAV;FLTALLVFI;LLKAIVEAA;KAAGAVTAV;KLFAGNAKA;ALKDVKAAA;GIAKGLKGI;N
LGNGFIEV;SVKTFYEGI;SVKASVESA;AAAIVLRGV;LINLGNGFI;FAGNAKAAV;GIKGIVDAA;SA
IFLTALL;NLKAAEEAA;AIKGKLDEL;SVKGIAKGI;AIFLTALLV;KAAEEAAKV A0204
FLTALLVFT;KAAGAVTAV;KAAFFAAKV;FLNGKNNAV;FAGNANAAV;SVESAVDFV;KLFAGNANA
A0206
FAGNANAAV;FLNGKNNAV;FLTALLVFT;KAAGAVTAV;NLGNGFIDV;ATFLTALLV;KAAFFAAKV;K
LFAGNANA;SVESAVDFV;SATFLTALL;AAATVLRGV;QTLKATVEA;LVADTFFKS;KTSSATFLT;SS
ATFLTAL
A0211
FLTALLVFT;NLGNGFIDV;ATFLTALLV;KLFAGNANA;AVDFVSKWL;VAKDGKFAV;ALKDVKAAA;K
LDFLVSAK;WLEEMIKAA;KAAGAVTAV;KAAFFAAKV;SVESAVDFV;FLNGKNNAV;FAGNANAAV;TL
KATVEAA;QTLKATVEA;GTAKGTKGT;GLVADTFFK;NADAGKLFA
A0212
FLTALLVFT;NLGNGFIDV;VAKDGKFAV;ALKDVKAAA;KLFAGNANA;FLNGKNNAV;FAGNANAAV;A
VDFVSKWL;ATFLTALLV;WLEEMIKAA;KLDFLVSAK;GTAKGTKGT;KAAGAVTAV
A0216
NLGNGFIDV;FLTALLVFT;ATFLTALLV;ALKDVKAAA;KLFAGNANA;SVESAVDFV;FAGNANAAV;V
AKDGKFAV;AVDFVSKWL;FLNGKNNAV;KAAGAVTAV;EMIKAAELA;TLKATKGKL;QTLKATVEA;DL
AKAAGAV;WLEEMIKAA
A0219
FLTALLVFT;NLGNGFIDV;VAKDGKFAV;KAAGAVTAV;FAGNANAAV;FLNGKNNAV;SVESAVDFV;A
TFLTALLV
A0301
GLVADTFFK;KLDELVSAK;KLAAATVLR;ALGEKGALK;AVSGEQILK;TSSTLKATK;AAFKDEMKK;A
LLVFINCK
A1101
GLVADTFFK;AVSGEQILK;AAFKDEMKK;ALLVFINCK;STLKATKGK;ALVLRGVAK;KLAAATVLR;D
TFFKSDPK;TSSTLKATK;KLDELVSAK;AAGKALGEK;ALGEKGALK;TFFKSDPKK;AVGKGNDEK
A2301  IFLTALLVF;GFIDVFNAF;LFYEGLLNL;TFFKSDPKK
A2402  IFLTALLVF;GFIDVFNAF;YFESISSTL
A2403  IFLTALLVF;GFIDVFNAF;YFESISSTL
A2601  SLLNLGNGF;EVSKWLEEM;DVFNAFSGL
A2602  EVSKWLEEM;DVFNAFSGL;SLLNLGNGF
A2902
A3001
STLKATKGK;AGKKAFFAK;TFFKSDPKK;GLVADTFFK;ALLVFINCK;ANEGAKADK;AAFKDEMKK;D
TFFKSDPK;AAGKALGEK;AVSGEQILK
A3002
A3101  KTAAATVLR;TSSTLKATK
A3301  DTFFKSDPK
A6801
DTFFKSDPK;ESAVDFVSK;DSAANEGAK;KTAAATVLR;TFFKSDPKK;GLVADTFFK;TSSTLKATK;S
TLKATKGK;AAFKDEMKK;CAAFKDEMK
A6802
DVFNAFSGL;SATFLTALL;FLNGKNNAV;SSATFLTAL;DLAKAAGAV;DVKTYFEST;FLTALLVFT;L
VADTFFKS;FAGNANAAV;SVKTYFEST;FGGSVKASV;KAAGAVTAV;NANAAVGAA;AAATVLRGV;TS
SATFLTA
A6901
FAGNANAAV;FLNGKNNAV;EVSKWLEEM;DLAKAAGAV;DVFNAFSGL;NLGNGFIDV;QTLKATVEA
B0702  KAAGAVTAV;TVDAAGKAL
B0801
B0802
B1501  SLLNLGNGF;GFIDVFNAF
B1801
B2705
B3501  FAGNANAAV;TAVSGEQIL;IFLTALLVF;TDDYGAAF;FSGLVADTF;GFIDVFNAF
B3901  YFESISSTL
B4001

Fig. 41 continued

B4002 EFAKNPIAA
B4402
B4403 EFAKNPIAA
B4501 EFAKNPIAA;AEFAKNPIA
B5101
B5301
B5401 NPIAAATGT
B5701
B5801 SAVDEVSKW;

Allele 10-mer
A0101
A0201 KISSAIFLTA;KLFAGNANAA;KTFYESIINI
A0202 KLFAGNANAA;KTFYESIINL;KISSAIFLTA;SGAIFLTALL;SLINLGNGFI;IAAAIVLRGV
A0203
SVKASVESAV;KISSAIFLTA;KLFAGNANAA;IAAAIVLRGV;GIAKGIKGIV;SLINLGNGFI;AIKGK
LDELV;SVKTFYESII;GAIFLTALLV;KTFYESISST;SAKKGEGGSV
A0204 KLFAGNANAA;
A0206
KISSAIFLTA;SAIFLTALLV;KLFAGNANAA;AIVEAAGDPA;GVAKDGKFAV;AKAAGAVDAV;ASVES
AVDEV;QILKAIVEAA;SLINLGNGFI;KTFYESIINI;IAAAIVLRGV;GIVEADTFFKS
A0211
KLFAGNANAA;GVAKDGKFAV;GIAKGIKGIV;KLDELVSAKK;KISSAIFLTA;SAIFLTALLV;DVFNA
FSGLV;SVKASVESAV;SAVDEVSKWI;IAAAIVLRGV;LFAGNANAAV;SLINLGNGFI;AVSGEQILKA
;GIVEAAGKAL;FLTALLVFIN
A0212 KLFAGNANAA;GVAKDGKFAV;GIAKGIKGIV;LFAGNANAAV;KLDELVSAKK
A0216 KLFAGNANAA;GVAKDGKFAV;GIAKGIKGIV;SVKASVESAV;DVFNAFSGLV;LFAGNANAAV
A0219 IAAAIVLRGV;LFAGNANAAV
A0301
KALGEKGALK;KLDELVSAKK;AAIVLRGVAK;VLRGVAKDGK;SISSTLKATK;KVGGTGGDGK;SVKGI
AKGIK;ADIFFKSDPK;TAVSGEQILK;VAKDGKFAVK;SSTLKATKGK
A1101
TALLVFINCK;SISSTLKATK;AATVLRGVAK;AVGAAADTAK;TAVSGEQILK;KALGEKGALK;SSTLK
ATKGK;SGIVADTFFK;SVKGTAKGIK;DIFFKSDPKK;VSKWLEEMIK;KVGGTGGDGK;KLDELVSAKK
;GAAFKDFMKK;MIKAAFEAAK;AANEGAKADK;VAKDGKFAVK
A2301 TYFESTSSTI;TFLTALLVFI;AFSGIVADTF;ATFLTALLVF;FSGIVADTFF
A2402 TFLTALLVFI;TYFESTSSTI;AFSGIVADTF
A2403 TYFESTSSTI;AFSGIVADTF;TFLTALLVFI
A2601 ESIINLGNGF;SIINLGNGFI;
A2602 ESIINLGNGF;GIDDNQAAF;ATFLTALLVF;EVSKNIFEMI
A2902
A3001
SGIVADTFFK;SVKGTAKGIK;KALGEKGALK;MIKAAFEAAK;AATVLRGVAK;VAKDGKFAVK;VLRGV
AKDGK;AVGAAADTAK;AANEGAKADK;SSTLKATKGK;KVGGTGGDGK
A3002
A3101 AATVLRGVAK
A3301
A6801
DIFFKSDPKK;TAVSGEQILK;MIKAAFEAAK;DAAGEALGEK;TALLVFINCK;DKIAAAIVLR;YFESI
SSTLK;SISSTLKATK;SVKGTAKGIK;NGAAFKDFMK;GAAFKDFMKK;SSTLKATKGK
A6802
DVFNAFSGLV;IAAAIVLRGV;SGAIFLTALL;SAIFLTALLV;EAAGDPANQA;DSVKTFYESI;EVSKW
LEEMI;EAKNPIAAAI;SVKASVESAV;ISSAIFLTAL;NANAAVGAAA;EGAKADKGSV;SLINLGNGFI
A6901 DVFNAFSGLV;EVSKWLEEMI;EAAGDPANQA;SAIFLTALLV
B0702
B0801

Fig. 41 continued

B0802
B1501 ATFLTALLVF
B1801
B2705
B3501 FANAEAGKLF;DPKKSDVKIY;NGFTDVFNAF;FSGLVADTFF;NANAAVGAAA
B3901
B4001
B4002
B4402
B4403
B4501 AFFAKNPTAA;FFMTKAAFFA;AFFAAKVGGT;FFAKNPTAAA
B5101
B5301
B5301
B5701 ESAVDEVSKW
B5801 ESAVDEVSKW;ISSAIFLTAL

Allele 11-mer
A0101
A0201 KLFAGNANAAV;FTDVFNAFSGL;KISSAIFLTAL;KIAAAIVLRGV;AIFLTALLVFT
A0202
KISSAIFLTAL;KLFAGNANAAV;FTDVFNAFSGL;KIAAAIVLRGV;LLVFTNCKNNA;FLTALLVFTNC
;ISSAIFLTALL;MIKAAEEAAKV;KTYFESISSTL;LVFTNCKNNAV;AIFLTALLVFT;KIGDSAANHG
A;KASVESAVDEV;ALGEKGALKDV;AVSGEQLLKAI
A0203
KIAAAIVLRGV;KLFAGNANAAV;MIKAAEEAAKV;ALGEKGALKDV;KISSAIFLTAL;FTDVFNAFSGL
;LAKAAGAVTAV;LLVFTNCKNNA;TINLGNGFTDV;KTYFESISSTL;LVFTNCKNNAV;FLTALLVFTN
C;KIGDSAANHGA;AAAEIAKAAGA
A0204 KLFAGNANAAV;KIAAAIVLRGV;ALGEKGALKDV
A0206
KLFAGNANAAV;FTDVFNAFSGL;KISSAIFLTAL;KIAAAIVLRGV;FAGNANAAVGA;KIGDSAANHGA
;KTYFESISSTL;FLTALLVFTNC;KASVESAVDEV;LVFTNCKNNAV;KKISSAIFLTA;ATFLTALLVF
T;SSAIFLTALLV;ALGEKGALKDV
A0211
KLFAGNANAAV;ALGEKGALKDV;KIAAATVLRGV;FTDVFNAFSGL;KISSAIFLTAL;ATFLTALLVFT
;FLTALLVFTNC;TINLGNGFTDV;KTGDSAANHGA;KATKGKLDFLV;LVFTNCKNNAV;MIKAAEFAAK
V;SSAIFLTALLV;AVSGEQLLKAI;AVTAVSGFQTL;KTYFESISSTL
A0212
KLFAGNANAAV;ALGEKGALKDV;FTDVFNAFSGL;KTAAATVLRGV;FLTALLVFTNC;MIKAAEEAAKV
;LVFTNCKNNAV;KISSAIFLTAL;TINLGNGFTDV
A0216
KLFAGNANAAV;ALGEKGALKDV;MIKAAEEAAKV;FTDVFNAFSGL;KISSAIFLTAL;KIAAATVLRGV
;ATFLTALLVFT;LVFTNCKNNAV;TINLGNGFTDV;KTGDSAANHGA;KATKGKLDFLV;LLVFTNCKNN
A
A0219 KLFAGNANAAV;FTDVFNAFSGL;KTAAATVLRGV;KISSAIFLTAL;ALGEKGALKDV
A0301
FSGLVADTFFK;VTAVSGEQLLK;GVAKDGKFAVK;FTNCKNNAVGK;TYFESISSTLK;LTALLVFTNCK
A1101
LTALLVFTNCK;VTAVSGEQLLK;SVESAVDEVSK;GIDDENGAAEK;FSGLVADTFFK;TYFESISSTLK
;AAATVLRGVAK;GVAKDGKFAVK;SAANHGAKADK;VADTFFKSDPK;AAVGAAADTAK;TVLRGVAKDG
K;AAGDPANGAGK;ESIGGTLKATK;ISSTLKATKGK;FTNCKNNAVGK;EVSKWLEENIK;GIKGIVDAA
GK
A2301 TYFESISSTLK;AFSGLVADTFF;SAIFLTALLVF
A2402 AFSGLVADTFF
A2403 AFSGLVADTFF
A2601

Fig. 41 continued

```
A2602  KISSAIFLTAL;FIDVFNAFSGL
A2902
A3001  KGKLDELVSAK;TYFFSTSSTLK;SAKKGFGGSVK;AFKDFMKKSDK;TVLRGVAKDGK
A3002  AFSGLVADTFF
A3101  TYFFSTSSTLK
A3301
A6801
FSTSSTLKATK;LTALLVFINCK;EVSKWLFKMIK;TYFFSTSSTLK;FSGLVADTFFK;FMIKAAFFAAK
;FINCKKNAVQK;VTAVSGFQTLK;SVFSAVDFVSK;DSVKGTAKGTK;SAANEGAKADK;NGAAFKDFMK
K;TSSTLKATKGK
A6802
EGILNLGNGFI;ISSAIFLIALL;SSALFLTALLV;LVFINCKNNAV;FLDVFNAFSGL;KLAAALVLRGV
;FSAVDFVSKWL;FFAKNPIAAAI;IAAAIVLRGVA;DVFNAFSGLVA;MIKAAFFAAKV
A6901  LVFINCKNNAV;FLDVFNAFSGL
B0702
B0801
B0802
B1501  VLRGVAKDGKF;KLFAGNANAAV
B1801  YFSLINLGNGF;DEANAEAGKLF
B2705
B3501  NAFSGLVADIF;SALFLTALLVF;LGTDDDKGAAF;DPKKSDVKIFF
B3901
B4001  YESLINLGNGF
B4002  FFAKNPIAAAI
B4402
B4403  FFAKNPIAAAI
B4501  EEDLKAAEEAA;AEEAKNPIAAA;FFAKNPIAAAI
B5101
B5301
B5401
B5701
B5801  SALFLTALLVF;KTYFFSTSSTL;KSDKTAAATVL;ISSAIFLTAL

Allele 15-mer plus 9-mer core
DRB1_0101  FQTLNATVTAAGQAG-LNATVTAAG;AGDVKDAAAAVGAVS-
VKDAAAAVG;GDVKDAAAAVGAVSG-VKDAAAAVG;QTLNATVTAAGQACQ-
TVTAAGQAG;ADAGDVKDAAAAVGA-VKDAAAAVG;DAGDVKDAAAAVGAV-
VKDAAAAVG;TLNATVTAAGQAGQA-TVTAAGQAG;LNATVTAAGQAGQAG-
TVTAAGQAG;FGVKFAPKAAADAAA-FAPKAAADA;GADAGDVKDAAAAVG--
AGDVKDAAA;GVKFAPKAAADAAAA-FAPKAAADA;VFGVKFAPKAAADAA-
FAPKAAADA;VKFAPKAAADAAAAD-FAPKAAADA;NATVTAAGQAGQAGK-
TVTAAGQAG;DQTAAALVLRGVAKD-TAAALVLRG;KKNDQTAAALVLRGV-
TAAALVLRG;KNDQTAAALVLRGVA-TAAALVLRG;KVFGVKFAPKAAADA-
VKFAPKAAA;NDQTAAALVLRGVAK-TAAALVLRG;KKKNDQTAAALVLRG--
DQTAAALVL;SGFQTLNATVTAAGQ-LNATVTAAG;GFQTLNATVTAAGQA-
LNATVTAAG;VSGFQTLNATVTAAG-TLNATVTAA;DVKDAAAAVGAVSGF-
VKDAAAAVG;VKDAAAAVGAVSGFQ  VKDAAAAVG;IEVFNAFSGLVADAF
VFNAFSGLV;FIEVFNAFSGLVADA-VFNAFSGLV;GFIEVFNAFSGLVAD-
VFNAFSGLV;NGFIEVFNAFSGLVA  VFNAFSGLV;AIVTAAGQAGQAGKK
TVTAAGQAG;KFAPKAAADAAADG-FAPKAAADA;TVTAAGQAGQAGKKA-
IVTAAGQAG;FAPKAAADAAADGN  FAPKAAADA;QTAAALVLRGVAKDG
TAAALVLRG;AVGFQILNALVTAA  FQILNALVT;GKLFGTAAGADAGDV
FGTAAGADA;KAGKLFGTAAGADAG  FGTAAGADA;KLFGTAAGADAGDVK
FGTAAGADA;AGKLFGTAAGADAGD  FGTAAGADA;EVFNAFSGLVADAFS
FNAFSGLVA;IAAALVLRGVAKDGK  IAAALVLRG;KKAGKLFGTAAGADA
LFGTAAGAD;AIFIVAFLALLGCKY  IVAFLALLG;ISSAIFIVAFLALLG
```

Fig. 41 continued

FTVAFLALT;SATFTVAFLALTGCK-TVAFLALTG;SSATFTVAFLALTGC-
TVAFLALTG;SDKTGNVAAGGGAGA-TGNVAAGGG;DKTGNVAAGGGAGAD-
TGNVAAGGG;GNGFTEVFNAFSGLV-FTEVFNAFS;TFTVAFLALTGCKNN-
TVAFLALTG;VFNAFSGLVADAFSK-VFNAFSGLV;KTGNVAAGGGAGADK-
VAAGGGAGA;TGNVAAGGGAGADKF-VAAGGGAGA;LFGTAAGADAGDVKD-
FGTAAGADA;FNAFSGLVADAFSKA-FSGLVADAF;FGTAAGADAGDVKDA-
FGTAAGADA;FTVAFLALTGCKNNV-TVAFLALTG;NAFSGLVADAFSKAD-
FSGLVADAF;KTSSATFTVAFLALT-TFTVAFLAL;GLVADAFSKADPKKS-
VADAFSKAD;LVADAFSKADPKKSD-FSKADPKKS;ADAFSKADPKKSDVK-
FSKADPKKS;GSDKTGNVAAGGGAG-TGNVAAGGG;VADAFSKADPKKSDV-
FSKADPKKS;DAFSKADPKKSDVKT-FSKADPKKS;GNVAAGGGAGADKFS-
VAAGGGAGA;GGSDKTGNVAAGGGA TGNVAAGGG;KDAAAAVGAVSGEQI
AAAVGAVSG;TKKANDQTAAALVLR-DQTAAALVL;GGGSDKTGNVAAGGG-
KTGNVAAGG;TVAFLALTGCKNNVG TVAFLALTG;EAKNATEAATGAAGD
TEAATGAAG;DEAKNATEAATGAAG-KNATEAATG;STFYQSTTNLGNGFT-
YQSTTNLGN;AKNATEAATGAAGDA TEAATGAAG;DAAAAVGAVSGEQIL
VGAVSGEQI;KNATEAATGAAGDAD TEAATGAAG;DTKKKNDQTAAALVL
TKKKNDQTA;AAALVLRGVAKDGKF VLRGVAKDG;AFSGLVADAFSKADP
LVADAFSKA;FSGLVADAFSKADPK LVADAFSKA;NATEAATGAAGDADF
TEAATGAAG;AAAVGAVSGEQILNA VGAVSGEQI;KESVNGIAGAIKGIV
VNGIAGAIK;AASTFYQSTTNLGNG FYQSTTNLG;ASTFYQSTTNLGNGF
FYQSTTNLG;TAASTFYQSTTNLGN FYQSTTNLG;ESVNGIAGAIKGIVE
VNGIAGAIK;DKESVNGIAGAIKGI VNGIAGAIK;KKKTSSATFTVAFLA
KKKTSSATF;TFYQSTTNLGNGFTE YQSTTNLGN;VGAVSGEQILNATVT
VSGEQILNA;AAAAVGAVSGEQILN VGAVSGEQI;AALVLRGVAKDGKFA
VLRGVAKDG;ADKESVNGIAGAIKG VNGIAGAIK
DRB1_0301
DRB1_0401 TAASTFYQSTTNLGN FYQSTTNLG;AASTFYQSTTNLGNG
FYQSTTNLG;STFYQSTTNLGNGFT FYQSTTNLG;ASTFYQSTTNLGNGF
FYQSTTNLG;DTAASTFYQSTTNLG STFYQSTTN;TFYQSTTNLGNGFTE
FYQSTTNLG;FYQSTTNLGNGFTEV FYQSTTNLG;SGEQILNATVTAAGQ
LNATVTAAG;VSGEQILNATVTAAG-ILNATVTAA;GEQILNATVTAAGQA-
LNATVTAAG;EQILNATVTAAGQAG-LNATVTAAG
DRB1_0404 NGFTEVFNAFSGLVA-VFNAFSGLV;GNGFTEVFNAFSGLV-
FTEVFNAFS;GFTEVFNAFSGLVAD-VFNAFSGLV;FTEVFNAFSGLVADA-
VFNAFSGLV;TEVFNAFSGLVADAF-VFNAFSGLV;EQILNATVTAAGQAG-
ILNATVTAA;VSGEQILNATVTAAG-ILNATVTAA;GEQILNATVTAAGQA-
ILNATVTAA;SGEQILNATVTAAGQ-ILNATVTAA;AVSGEQILNATVTAA-
VSGEQILNA;EVFNAFSGLVADAFS-VFNAFSGLV;VFNAFSGLVADAFSK-
VFNAFSGLV;QILNATVTAAGQAGQ-ILNATVTAA;ILNATVTAAGQAGQA-ILNATVTAA
DRB1_0405 TAASTFYQSTTNLGN-FYQSTTNLG;AASTFYQSTTNLGNG-
YQSTTNLGN;ASTFYQSTTNLGNGF-YQSTTNLGN;STFYQSTTNLGNGFT-
YQSTTNLGN;TFYQSTTNLGNGFTE-YQSTTNLGN;NGFTEVFNAFSGLVA-
FTEVFNAFS;GFTEVFNAFSGLVAD-FNAFSGLVA;FTEVFNAFSGLVADA-
FNAFSGLVA;FYQSTTNLGNGFTEV-YQSTTNLGN;YQSTTNLGNGFTEVF-
YQSTTNLGN;TEVFNAFSGLVADAF-FNAFSGLVA;EVFNAFSGLVADAFS-FNAFSGLVA
DRB1_0701 TEVFNAFSGLVADAF VFNAFSGLV;NGFTEVFNAFSGLVA
VFNAFSGLV;GFTEVFNAFSGLVAD-VFNAFSGLV;FTEVFNAFSGLVADA-VFNAFSGLV
DRB1_0802 GLVADAFSKADPKKS AFSKADPKK;LVADAFSKADPKKSD
FSKADPKKS;VADAFSKADPKKSDV-FSKADPKKS;ADAFSKADPKKSDVK-
FSKADPKKS;DAFSKADPKKSDVKT FSKADPKKS;AFSKADPKKSDVKTY
FSKADPKKS;FSKADPKKSDVKTYF FSKADPKKS
DRB1_0901 STFYQSTTNLGNGFT FYQSTTNLG;DTAASTFYQSTTNLG
TFYQSTTNL;ASTFYQSTTNLGNGF FYQSTTNLG;AASTFYQSTTNLGNG
FYQSTTNLG;TAASTFYQSTTNLGN FYQSTTNLG
DRB1_1101

Fig. 41 continued

```
DRB1_1302  STFYQSTTNLGNGFT-FYQSTTNLG;VSGFQTLNATVTAAG-
TLNATVTAA;SGFQTLNATVTAAGQ-TLNATVTAA;FFYQSTTNLGNGFTF-
TTNLGNGFT;FYQSTTNLGNGFTEV-TTNLGNGFT;GFQTLNATVTAAGQA-
TLNATVTAA;FQTLNATVTAAGQAG-TLNATVTAA;AVSGFQTLNATVTAA-
FQTLNATVT;YQSTTNLGNGFTEVF-TTNLGNGFT;QSTTNLGNGFTEVFN-
TTNLGNGFT;ASTFYQSTTNLGNGF-FYQSTTNLG;AASTFYQSTTNLGNG-
FYQSTTNLG;TAASTFYQSTTNLGN-FYQSTTNLG;QTLNATVTAAGQAGQ-
TLNATVTAA;STTNLGNGFTEVFNA-TTNLGNGFT;RTAASTFYQSTTNLG-TFYQSTTNL
DRB1_1501  GFTEVFNAFSGLVAD-VFNAFSGLV;NGFTEVFNAFSGLVA-
VFNAFSGLV;SATFTVAFLALTGGK-TVAFLALTG;SSATFTVAFLALTGG-
TVAFLALTG;TAAALVLRGVAKDGK-ALVLRGVAK;TEVFNAFSGLVADAF-
VFNAFSGLV;AAALVLRGVAKDGKF-LRGVAKDGK;FTEVFNAFSGLVADA-
VFNAFSGLV;ATFTVAFLALTGGKN-TVAFLALTG;TVAFLALTGGKNNVG-
TVAFLALTG;ALVLRGVAKDGKFAG-LRGVAKDGK;AALVLRGVAKDGKFA-
LRGVAKDGK;TFTVAFLALTGGKNN-TVAFLALTG;STFYQSTTNLGNGFT-FYQSTTNLG
DRB3_0101
DRB4_0101
DRB5_0101
```

A) Special selected HLA-A*0201 binding peptides from Borrelia proteins

<OspA7;Protein;Borrelia species>FTLEGTLAA (SEQ ID NO:177459)
<OspA 8;Protein;Borrelia species>TLVSKKVTL(SEQ ID NO:177460)
<OspB 8;Protein;Borrelia species>IMLEGNLV (SEQ ID NO:177461)
<OspB 9;Protein;Borrelia species>TMSITDDL (SEQ ID NO:177462)
<OspC 7;Protein;Borrelia species>LMTLFLFI (SEQ ID NO:177463)
<OspC 8;Protein;Borrelia species>LLAGAYAI (SEQ ID NO:177464)
<FlaB 6;Protein;Borrelia species>QASWTLRV (SEQ ID NO:177465)
<FlaB 7;Protein;Borrelia species>IAVNIYAA (SEQ ID NO:177466)
<VlsE 8;Protein;Borrelia species>LSAIVTAA (SEQ ID NO:177467)
<VlsE 9;Protein;Borrelia species>ILSAIVTA (SEQ ID NO:177468)
<OspG 6;Protein;Borrelia species>IICAVFVL (SEQ ID NO:177469)
<FlaA 6;Protein;Borrelia species>IWSNPNYI (SEQ ID NO:177470)
<OspE 4;Protein;Borrelia species>IICAVFVL (SEQ ID NO:177471)
<OspE 5;Protein;Borrelia species>FSEFTVNI (SEQ ID NO:177472)
<BmpA 3;Protein;Borrelia species>MYSDGIDI (SEQ ID NO:177473)
<BmpA 4;Protein;Borrelia species>LAPNNVIT (SEQ ID NO:177474)
<BmpB 3;Protein;Borrelia species>LIGVVFRI (SEQ ID NO:177475)
<BmpB 4;Protein;Borrelia species>VGDALYLI (SEQ ID NO:177476)
<BmpC 3;Protein;Borrelia species>MTEDAYEV (SEQ ID NO:177477)
<BmpC 4;Protein;Borrelia species>LNQDQSYI (SEQ ID NO:177478)
<BmpD 2;Protein;Borrelia species>MYGYEAGA (SEQ ID NO:177479)
<BmpD 3;Protein;Borrelia species>LAPNNVLV (SEQ ID NO:177480)
<DbpA 3;Protein;Borrelia species>ILKAKIKA (SEQ ID NO:177481)
<DbpA 4;Protein;Borrelia species>TADGIIAI (SEQ ID NO:177482)
<DbpB 2;Protein;Borrelia species>LAACNFGL (SEQ ID NO:177483)
<DbpB 3;Protein;Borrelia species>LVACSIGL (SEQ ID NO:177484)
<BapA 4;Protein;Borrelia species>LFILSLSA (SEQ ID NO:177485)
<CRASP-1a;Protein;Borrelia species>KLNIIKLNI (SEQ ID NO:177486)
<CRASP-1b;Protein;Borrelia species>LNYEIEKI (SEQ ID NO:177487)
<CRASP-1c;Protein;Borrelia species>KLNILTTIL (SEQ ID NO:177488)
<CRASP-2a;Protein;Borrelia species>MLISISLL (SEQ ID NO:177489)
<CRASP-2b;Protein;Borrelia species>LIDDFAIEL (SEQ ID NO:177490)
<CRASP-2c;Protein;Borrelia species>LSCDVSRL (SEQ ID NO:177491)
<MalQ 4;Protein;Borrelia species>LLDFASFV (SEQ ID NO:177492)
<MalQ 5;Protein;Borrelia species>LNTNEDFV (SEQ ID NO:177493)
<MalQ 6;Protein;Borrelia species>IAYDSADV (SEQ ID NO:177494)

B) Special selected HLA-A*0301 binding peptides from Borrelia proteins

<BmpA 5;Protein;Borrelia species>IVFLSCSGK (SEQ ID NO:177495)
<BmpA 6;Protein;Borrelia species>FLTGYIAAK (SEQ ID NO:177496)
<BmpB 5;Protein;Borrelia species>EIFIKQILK (SEQ ID NO:177497)
<BmpB 6;Protein;Borrelia species>ALYLITGEY (SEQ ID NO:177498)
<BmpC 5;Protein;Borrelia species>KEMARFMYK (SEQ ID NO:177499)
<BmpC 6;Protein;Borrelia species>YIAAKMSRK (SEQ ID NO:177500)
<BmpD 5;Protein;Borrelia species>SLMYSLTKK (SEQ ID NO:177501)

<BmpD 6;Protein;Borrelia species>RSTASNMYR (SEQ ID NO:177502)
<DbpA 5;Protein;Borrelia species>IIAIVKVMK (SEQ ID NO:177503)
<DbpA 6;Protein;Borrelia species>FTNTQTGSK (SEQ ID NO:177504)
<DbpB 5;Protein;Borrelia species>FTGLKTGSK (SEQ ID NO:177505)
<DbpB 6;Protein;Borrelia species>LFEAFTGLK (SEQ ID NO:177506)
<HSP90 6;Protein;Borrelia species>LLTSGMPSK (SEQ ID NO:177507)
<OspA 7;Protein;Borrelia species>LILALIACK (SEQ ID NO:177508)
<OspA 8;Protein;Borrelia species>KTKNLVFTK (SEQ ID NO:177509)
<Osp A 9;Protein;Borrelia species>ISVNSQKTK (SEQ ID NO:177510)
<OspB 9;Protein;Borrelia species>VTLKKEIEK (SEQ ID NO:177511)
<OspB 10;Protein;Borrelia species>RTNGTTLEY (SEQ ID NO:177512)
<OspB 11;Protein;Borrelia species>MTDADNATK (SEQ ID NO:177513)
<OspC 9;Protein;Borrelia species>LANKAIGKK (SEQ ID NO:177514)
<OspC 10;Protein;Borrelia species>ILMTLFLFI (SEQ ID NO:177515)
<OspC 11;Protein;Borrelia species>AISTLITEK (SEQ ID NO:177516)
<OspE 6;Protein;Borrelia species>GSFKTSLYY (SEQ ID NO:177517)
<OspE 7;Protein;Borrelia species>NLGTLVIRK (SEQ ID NO:177518)
<OspG 7;Protein;Borrelia species>VFVLIISCK (SEQ ID NO:177519)
<FlaA 7;Protein;Borrelia species>RVSKSHSSK (SEQ ID NO:177520)
<FlaB 8;Protein;Borrelia species>SINAANLSK (SEQ ID NO:177521)
<FlaB 9;Protein;Borrelia species>KINTPASLS (SEQ ID NO:177522)
<FlaB 10;Protein;Borrelia species>SQASRNTSK (SEQ ID NO: 177523)
<FlaB 11;Protein;Borrelia species>FQNRLESIK (SEQ ID NO:177524)
<VlsE 10;Protein;Borrelia species>AVSGEQILK (SEQ ID NO:177525)
<VlsE 11;Protein;Borrelia species>AIVLRGLAK (SEQ ID NO:177526)
<BapA 5;Protein;Borrelia species>KQILADLPK (SEQ ID NO:177527)
<BapA 6;Protein;Borrelia species>QLNSDKIDY (SEQ ID NO:177528)
<CRASP-1d;Protein;Borrelia species> RIIYSSLNY (SEQ ID NO:177529)
<CRASP-1e;Protein;Borrelia species>SSLNYEIEK (SEQ ID NO:177530)
<CRASP-2d;Protein;Borrelia species>RSRYNNFYK (SEQ ID NO:177531)
<CRASP-2e;Protein;Borrelia species> ESFDVISSK (SEQ ID NO:177532)
<CRASP-2f;Protein;Borrelia species>LIALKCIVK (SEQ ID NO:177533)
<MalQ 1;Protein;Borrelia species>RSFEKFKKK (SEQ ID NO:177534)
<MalQ 2;Protein;Borrelia species>FLFASSQSY (SEQ ID NO:177535)
<MalQ 3;Protein;Borrelia species>RINLNLKRK (SEQ ID NO:177536)

<Nonsense 3;Protein;artificial>GLFGAGAFK (SEQ ID NO:177537)
<Nonsense 4;Protein;artificial>GVYAGAVMK (SEQ ID NO:177538)

| Protein and peptide sequences | SEQ ID NO |
|---|---|
| <ABK60019.1 VlsE;Borrelia burgdorferi<br>EGAIKEVSELLDKLVKAVKTAEGASSGTDAIGEVVANAGAAKVADKASVTGIAKGIKEIVEAA<br>GGSEKLKVAAATGESNKGAGKLFGKAGAGANAGDSEAASKAAGAVSAVSGEQILSAIVTAADA<br>AEQEGKKPEEAKNPIAAAIGKGNADDGAEFGQEGMKKDDQIAAAIALRGMAKDGKFAVKSGEK<br>EKA<br><br>8 mers:<br>EGAIKEVS;GAIKEVSE;AIKEVSEL;IKEVSELL;KEVSELLD;EVSELLDK;VSELLDKL;<br>SELLDKLV;ELLDKLVK;LLDKLVKA;LDKLVKAV;DKLVKAVK;KLVKAVKT;LVKAVKTA;<br>VKAVKTAE;KAVKTAEG;AVKTAEGA;VKTAEGAS;KTAEGASS;TAEGASSG;AEGASSGT;<br>EGASSGTD;GASSGTDA;ASSGTDAI;SSGTDAIG;SGTDAIGE;GTDAIGEV;TDAIGEVV;<br>DAIGEVVA;AIGEVVAN;IGEVVANA;GEVVANAG;EVVANAGA;VVANAGAA;VANAGAAK;<br>ANAGAAKV;NAGAAKVA;AGAAKVAD;GAAKVADK;AAKVADKA;AKVADKAS;KVADKASV;<br>VADKASVT;ADKASVTG;DKASVTGI;KASVTGIA;ASVTGIAK;SVTGIAKG;VTGIAKGI;<br>TGIAKGIK;GIAKGIKE;IAKGIKEI;AKGIKEIV;KGIKEIVE;GIKEIVEA;IKEIVEAA;<br>KEIVEAAG;EIVEAAGG;IVEAAGGS;VEAAGGSE;EAAGGSEK;AAGGSEKL;AGGSEKLK;<br>GGSEKLKV;GSEKLKVA;SEKLKVAA;EKLKVAAA;KLKVAAAT;LKVAAATG;KVAAATGE;<br>VAAATGES;AAATGESN;AATGESNK;ATGESNKG;TGESNKGA;GESNKGAG;ESNKGAGK;<br>SNKGAGKL;NKGAGKLF;KGAGKLFG;GAGKLFGK;AGKLFGKA;GKLFGKAG;KLFGKAGA;<br>LFGKAGAG;FGKAGAGA;GKAGAGAN;KAGAGANA;AGAGANAG;GAGANAGD;AGANAGDS;<br>GANAGDSE;ANAGDSEA;NAGDSEAA;AGDSEAAS;GDSEAASK;DSEAASKA;SEAASKAA;<br>EAASKAAG;AASKAAGA;ASKAAGAV;SKAAGAVS;KAAGAVSA;AAGAVSAV;AGAVSAVS;<br>GAVSAVSG;AVSAVSGE;VSAVSGEQ;SAVSGEQI;AVSGEQIL;VSGEQILS;SGEQILSA;<br>GEQILSAI;EQILSAIV;QILSAIVT;ILSAIVTA;LSAIVTAA;SAIVTAAD;AIVTAADA;<br>IVTAADAA;VTAADAAE;TAADAAEQ;AADAAEQE;ADAAEQEG;DAAEQEGK;AAEQEGKK;<br>AEQEGKKP;EQEGKKPE;QEGKKPEE;EGKKPEEA;GKKPEEAK;KKPEEAKN;KPEEAKNP;<br>PEEAKNPI;EEAKNPIA;EAKNPIAA;AKNPIAAA;KNPIAAAI;NPIAAAIG;PIAAAIGK;<br>IAAAIGKG;AAAIGKGN;AAIGKGNA;AIGKGNAD;IGKGNADD;GKGNADDG;KGNADDGA;<br>GNADDGAE;NADDGAEF;ADDGAEFG;DDGAEFGQ;DGAEFGQE;GAEFGQEG;AEFGQEGM;<br>EFGQEGMK;FGQEGMKK;GQEGMKKD;QEGMKKDD;EGMKKDDQ;GMKKDDQI;MKKDDQIA;<br>KKDDQIAA;KDDQIAAA;DDQIAAAI;DQIAAAIA;QIAAAIAL;IAAAIALR;AAAIALRG;<br>AAIALRGM;AIALRGMA;IALRGMAK;ALRGMAKD;LRGMAKDG;RGMAKDGK;GMAKDGKF;<br>MAKDGKFA;AKDGKFAV;KDGKFAVK;DGKFAVKS;GKFAVKSG;KFAVKSGE;FAVKSGEK;<br>AVKSGEKE;VKSGEKEK;KSGEKEKA;<br><br>9 mers:<br>EGAIKEVSE;GAIKEVSEL;AIKEVSELL;IKEVSELLD;KEVSELLDK;EVSELLDKL;VSE<br>LLDKLV;SELLDKLVK;ELLDKLVKA;LLDKLVKAV;LDKLVKAVK;DKLVKAVKT;KLVKAV<br>KTA;LVKAVKTAE;VKAVKTAEG;KAVKTAEGA;AVKTAEGAS;VKTAEGASS;KTAEGASSG<br>;TAEGASSGT;AEGASSGTD;EGASSGTDA;GASSGTDAI;ASSGTDAIG;SSGTDAIGE;SG<br>TDAIGEV;GTDAIGEVV;TDAIGEVVA;DAIGEVVAN;AIGEVVANA;IGEVVANAG;GEVVA<br>NAGA;EVVANAGAA;VVANAGAAK;VANAGAAKV;ANAGAAKVA;NAGAAKVAD;AGAAKVAD<br>K;GAAKVADKA;AAKVADKAS;AKVADKASV;KVADKASVT;VADKASVTG;ADKASVTGI;D<br>KASVTGIA;KASVTGIAK;ASVTGIAKG;SVTGIAKGI;VTGIAKGIK;TGIAKGIKE;GIAK<br>GIKEI;IAKGIKEIV;AKGIKEIVE;KGIKEIVEA;GIKEIVEAA;IKEIVEAAG;KEIVEAA<br>GG;EIVEAAGGS;IVEAAGGSE;VEAAGGSEK;EAAGGSEKL;AAGGSEKLK;AGGSEKLKV;<br>GGSEKLKVA;GSEKLKVAA;SEKLKVAAA;EKLKVAAAT;KLKVAAATG;LKVAAATGE;KVA<br>AATGES;VAAATGESN;AAATGESNK;AATGESNKG;ATGESNKGA;TGESNKGAG;GESNKG<br>AGK;ESNKGAGKL;SNKGAGKLF;NKGAGKLFG;KGAGKLFGK;GAGKLFGKA;AGKLFGKAG<br>;GKLFGKAGA;KLFGKAGAG;LFGKAGAGA;FGKAGAGAN;GKAGAGANA;KAGAGANAG;AG<br>AGANAGD;GAGANAGDS;AGANAGDSE;GANAGDSEA;ANAGDSEAA;NAGDSEAAS;AGDSE | 180858-<br>182306 |

AASK;GDSEAASKA;DSEAASKAA;SEAASKAAG;EAASKAAGA;AASKAAGAV;ASKAAGAV
S;SKAAGAVSA;KAAGAVSAV;AAGAVSAVS;AGAVSAVSG;GAVSAVSGE;AVSAVSGEQ;V
SAVSGEQI;SAVSGEQIL;AVSGEQILS;VSGEQILSA;SGEQILSAI;GEQILSAIV;EQIL
SAIVT;QILSAIVTA;ILSAIVTAA;LSAIVTAAD;SAIVTAADA;AIVTAADAA;IVTAADA
AE;VTAADAAEQ;TAADAAEQE;AADAAEQEG;ADAAEQEGK;DAAEQEGKK;AAEQEGKKP;
AEQEGKKPE;EQEGKKPEE;QEGKKPEEA;EGKKPEEAK;GKKPEEAKN;KKPEEAKNP;KPE
EAKNPI;PEEAKNPIA;EEAKNPIAA;EAKNPIAAA

AGAAK; EVVANAGAAKV; VVANAGAAKVA; VANAGAAKVAD; ANAGAAKVADK; NAGAAKVAD
KA; AGAAKVADKAS; GAAKVADKASV; AAKVADKASVT; AKVADKASVTG; KVADKASVTGI;
VADKASVTGIA; ADKASVTGIAK; DKASVTGIAKG; KASVTGIAKGI; ASVTGIAKGIK; SVT
GIAKGIKE; VTGIAKGIKEI; TGIAKGIKEIV; GIAKGIKEIVE; IAKGIKEIVEA; AKGIKE
IVEAA; KGIKEIVEAAG; GIKEIVEAAGG; IKEIVEAAGGS; KEIVEAAGGSE; EIVEAAGGS
EK; IVEAAGGSEKL; VEAAGGSEKLK; EAAGGSEKLKV; AAGGSEKLKVA; AGGSEKLKVAA;
GGSEKLKVAAA; GSEKLKVAAAT; SEKLKVAAATG; EKLKVAAATGE; KLKVAAATGES; LKV
AAATGESN; KVAAATGESNK; VAAATGESNKG; AAATGESNKGA; AATGESNKGAG; ATGESN
KGAGK; TGESNKGAGKL; GESNKGAGKLF; ESNKGAGKLFG; SNKGAGKLFGK; NKGAGKL

IVTAAD;EQILSAIVTAADA;QILSAIVTAADAA;ILSAIVTAADAAE;LSAIVTAADAAEQ;
SAIVTAADAAEQE;AIVTAADAAEQEG;IVTAADAAEQEGK;VTAADAAEQEGKK;TAADAAE
QEGKKP;AADAAEQEGKKPE;ADAAEQEGKKPEE;DAAEQEGKKPEEA;AAEQEGKKPEEAK;
AEQEGKKPEEAKN;EQEGKKPEEAKNP;QEGKKPEEAKNPI;EGKKPEEAKNPIA;GKKPEEA
KNPIAA;KKPEEAKNPIAAA;KPEEAKNPIAAAI;PEEAKNPIAAAIG;EEAKNPIAAAIGK;
EAKNPIAAAIGKG;AKNPIAAAIGKGN;KNPIAAAIGKGNA;NPIAAAIGKGNAD;PIAAAIG
KGNADD;IAAAIGKGNADDG;AAAIGKGNADDGA;AAIGKGNADDGAE;AIGKGNADDGAEF;
IGKGNADDGAEFG;GKGNADDGAEFGQ;KGNADDGAEFGQE;GNADDGAEFGQEG;NADDGAE
FGQEGM;ADDGAEFGQEGMK;DDGAEFGQEGMKK;DGAEFGQEGMKKD;GAEFGQEGMKKDD;
AEFGQEGMKKDDQ;EFGQEGMKKDDQI;FGQEGMKKDDQIA;GQEGMKKDDQIAA;QEGMKKD
DQIAAA;EGMKKDDQIAAAI;GMKKDDQIAAAIA;MKKDDQIAAAIAL;KKDDQIAAAIALR;
KDDQIAAAIALRG;DDQIAAAIALRGM;DQIAAAIALRGMA;QIAAAIALRGMAK;IAAAIAL
RGMAKD;AAAIALRGMAKDG;AAIALRGMAKDGK;AIALRGMAKDGKF;IALRGMAKDGKFA;
ALRGMAKDGKFAV;LRGMAKDGKFAVK;RGMAKDGKFAVKS;GMAKDGKFAVKSG;MAKDGKF
AVKSGE;AKDGKFAVKSGEK;KDGKFAVKSGEKE;DGKFAVKSGEKEK;GKFAVKSGEKEKA;

14 mers:
EGAIKEVSELLDKL;GAIKEVSELLDKLV;AIKEVSELLDKLVK;IKEVSELLDKLVKA;KEV
SELLDKLVKAV;EVSELLDKLVKAVK;VSELLDKLVKAVKT;SELLDKLVKAVKTA;ELLDKL
VKAVKTAE;LLDKLVKAVKTAEG;LDKLVKAVKTAEGA;DKLVKAVKTAEGAS;KLVKAVKTA
EGASS;LVKAVKTAEGASSG;VKAVKTAEGASSGT;KAVKTAEGASSGTD;AVKTAEGASSGT
DA;VKTAEGASSGTDAI;KTAEGASSGTDAIG;TAEGASSGTDAIGE;AEGASSGTDAIGEV;
EGASSGTDAIGEVV;GASSGTDAIGEVVA;ASSGTDAIGEVVAN;SSGTDAIGEVVANA;SGT
DAIGEVVANAG;GTDAIGEVVANAGA;TDAIGEVVANAGAA;DAIGEVVANAGAAK;AIGEVV
ANAGAAKV;IGEVVANAGAAKVA;GEVVANAGAAKVAD;EVVANAGAAKVADK;VVANAGAAK
VADKA;VANAGAAKVADKAS;ANAGAAKVADKASV;NAGAAKVADKASVT;AGAAKVADKASV
TG;GAAKVADKASVTGI;AAKVADKASVTGIA;AKVADKASVTGIAK;KVADKASVTGIAKG;
VADKASVTGIAKGI;ADKASVTGIAKGIK;DKASVTGIAKGIKE;KASVTGIAKGIKEI;ASV
TGIAKGIKEIV;SVTGIAKGIKEIVE;VTGIAKGIKEIVEA;TGIAKGIKEIVEAA;GIAKGI
KEIVEAAG;IAKGIKEIVEAAGG;AKGIKEIVEAAGGS;KGIKEIVEAAGGSE;GIKEIVEAA
GGSEK;IKEIVEAAGGSEKL;KEIVEAAGGSEKLK;EIVEAAGGSEKLKV;IVEAAGGSEKLK
VA;VEAAGGSEKLKVAA;EAAGGSEKLKVAAA;AAGGSEKLKVAAAT;AGGSEKLKVAAATG;
GGSEKLKVAAATGE;GSEKLKVAAATGES;SEKLKVAAATGESN;EKLKVAAATGESNK;KLK
VAAATGESNKG;LKVAAATGESNKGA;KVAAATGESNKGAG;VAAATGESNKGAGK;AAATGE
SNKGAGKL;AATGESNKGAGKLF;ATGESNKGAGKLFG;TGESNKGAGKLFGK;GESNKGAGK
LFGKA;ESNKGAGKLFGKAG;SNKGAGKLFGKAGA;NKGAGKLFGKAGAG;KGAGKLFGKAGA
GA;GAGKLFGKAGAGAN;AGKLFGKAGAGANA;GKLFGKAGAGANAG;KLFGKAGAGANAGD;
LFGKAGAGANAGDS;FGKAGAGANAGDSE;GKAGAGANAGDSEA;KAGAGANAGDSEAA;AGA
GANAGDSEAAS;GAGANAGDSEAASK;AGANAGDSEAASKA;GANAGDSEAASKAA;ANAGDS
EAASKAAG;NAGDSEAASKAAGA;AGDSEAASKAAGAV;GDSEAASKAAGAVS;DSEAASKAA
GAVSA;SEAASKAAGAVSAV;EAASKAAGAVSAVS;AASKAAGAVSAVSG;ASKAAGAVSAVS
GE;SKAAGAVSAVSGEQ;KAAGAVSAVSGEQI;AAGAVSAVSGEQIL;AGAVSAVSGEQILS;
GAVSAVSGEQILSA;AVSAVSGEQILSAI;VSAVSGEQILSAIV;SAVSGEQILSAIVT;AVS
GEQILSAIVTA;VSGEQILSAIVTAA;SGEQILSAIVTAAD;GEQILSAIVTAADA;EQILSA
IVTAADAA;QILSAIVTAADAAE;ILSAIVTAADAAEQ;LSAIVTAADAAEQE;SAIVTAADA
AEQEG;AIVTAADAAEQEGK;IVTAADAAEQEGKK;VTAADAAEQEGKKP;TAADAAEQEGKK
PE;AADAAEQEGKKPEE;ADAAEQEGKKPEEA;DAAEQEGKKPEEAK;AAEQEGKKPEEAKN;
AEQEGKKPEEAKNP;EQEGKKPEEAKNPI;QEGKKPEEAKNPIA;EGKKPEEAKNPIAA;GKK
PEEAKNPIAAA;KKPEEAKNPIAAAI;KPEEAKNPIAAAIG;PEEAKNPIAAAIGK;EEAKNP
IAAAIGKG;EAKNPIAAAIGKGN;AKNPIAAAIGKGNA;KNPIAAAIGKGNAD;NPIAAAIGK
GNADD;PIAAAIGKGNADDG;IAAAIGKGNADDGA;AAAIGKGNADDGAE;AAIGKGNADDGA
EF;AIGKGNADDGAEFG;IGKGNADDGAEFGQ;GKGNADDGAEFGQE;KGNADDGAEFGQEG;
GNADDGAEFGQEGM;NADDGAEFGQEGMK;ADDGAEFGQEGMKK;DDGAEFGQEGMKKD;DGA
EFGQEGMKKDD;GAEFGQEGMKKDDQ;AEFGQEGMKKDDQI;EFGQEGMKKDDQIA;FGQEGM
KKDDQIAA;GQEGMKKDDQIAAA;QEGMKKDDQIAAAI;EGMKKDDQIAAAIA;GMKKDDQIA
AAIAL;MKKDDQIAAAIALR;KKDDQIAAAIALRG;KDDQIAAAIALRGM;DDQIAAAIALRG
MA;DQIAAAIALRGMAK;QIAAAIALRGMAKD;IAAAIALRGMAKDG;AAAIALRGMAKDGK;

Fig. 43 continued

AAIALRGMAKDGKF; AIALRGMAKDGKFA; IALRGMAKDGKFAV; ALRGMAKDGKFAVK; LRG
MAKDGKFAVKS; RGMAKDGKFAVKSG; GMAKDGKFAVKSGE; MAKDGKFAVKSGEK; AKDGKF
AVKSGEKE; KDGKFAVKSGEKEK; DGKFAVKSGEKEKA;

15 mers:
EGAIKEVSELLDKLV; GAIKEVSELLDKLVK; AIKEVSELLDKLVKA; IKEVSELLDKLVKAV
; KEVSELLDKLVKAVK; EVSELLDKLVKAVKT; VSELLDKLVKAVKTA; SELLDKLVKAVKTA
E; ELLDKLVKAVKTAEG; LLDKLVKAVKTAEGA; LDKLVKAVKTAEGAS; DKLVKAVKTAEGA
SS; KLVKAVKTAEGASSG; LVKAVKTAEGASSGT; VKAVKTAEGASSGTD; KAVKTAEGASSG
TDA; AVKTAEGASSGTDAI; VKTAEGASSGTDAIG; KTAEGASSGTDAIGE; TAEGASSGTDA
IGEV; AEGASSGTDAIGEVV; EGASSGTDAIGEVVA; GASSGTDAIGEVVAN; ASSGTDAIGE
VVANA; SSGTDAIGEVVANAG; SGTDAIGEVVANAGA; GTDAIGEVVANAGAA; TDAIGEVVA
NAGAAK; DAIGEVVANAGAAKV; AIGEVVANAGAAKVA; IGEVVANAGAAKVAD; GEVVANAG
AAKVADK; EVVANAGAAKVADKA; VVANAGAAKVADKAS; VANAGAAKVADKASV; ANAGAAK
VADKASVT; NAGAAKVADKASVTG; AGAAKVADKASVTGI; GAAKVADKASVTGIA; AAKVAD
KASVTGIAK; AKVADKASVTGIAKG; KVADKASVTGIAKGI; VADKASVTGIAKGIK; ADKAS
VTGIAKGIKE; DKASVTGIAKGIKEI; KASVTGIAKGIKEIV; ASVTGIAKGIKEIVE; SVTG
IAKGIKEIVEA; VTGIAKGIKEIVEAA; TGIAKGIKEIVEAAG; GIAKGIKEIVEAAGG; IAK
GIKEIVEAAGGS; AKGIKEIVEAAGGSE; KGIKEIVEAAGGSEK; GIKEIVEAAGGSEKL; IK
EIVEAAGGSEKLK; KEIVEAAGGSEKLKV; EIVEAAGGSEKLKVA; IVEAAGGSEKLKVAA; V
EAAGGSEKLKVAAA; EAAGGSEKLKVAAAT; AAGGSEKLKVAAATG; AGGSEKLKVAAATGE;
GGSEKLKVAAATGES; GSEKLKVAAATGESN; SEKLKVAAATGESNK; EKLKVAAATGESNKG
; KLKVAAATGESNKGA; LKVAAATGESNKGAG; KVAAATGESNKGAGK; VAAATGESNKGAGK
L; AAATGESNKGAGKLF; AATGESNKGAGKLFG; ATGESNKGAGKLFGK; TGESNKGAGKLFG
KA; GESNKGAGKLFGKAG; ESNKGAGKLFGKAGA; SNKGAGKLFGKAGAG; NKGAGKLFGKAG
AGA; KGAGKLFGKAGAGAN; GAGKLFGKAGAGANA; AGKLFGKAGAGANAG; GKLFGKAGAGA
NAGD; KLFGKAGAGANAGDS; LFGKAGAGANAGDSE; FGKAGAGANAGDSEA; GKAGAGANAG
DSEAA; KAGAGANAGDSEAAS; AGAGANAGDSEAASK; GAGANAGDSEAASKA; AGANAGDSE
AASKAA; GANAGDSEAASKAAG; ANAGDSEAASKAAGA; NAGDSEAASKAAGAV; AGDSEAAS
KAAGAVS; GDSEAASKAAGAVSA; DSEAASKAAGAVSAV; SEAASKAAGAVSAVS; EAASKAA
GAVSAVSG; AASKAAGAVSAVSGE; ASKAAGAVSAVSGEQ; SKAAGAVSAVSGEQI; KAAGAV
SAVSGEQIL; AAGAVSAVSGEQILS; AGAVSAVSGEQILSA; GAVSAVSGEQILSAI; AVSAV
SGEQILSAIV; VSAVSGEQILSAIVT; SAVSGEQILSAIVTA; AVSGEQILSAIVTAA; VSGE
QILSAIVTAAD; SGEQILSAIVTAADA; GEQILSAIVTAADAA; EQILSAIVTAADAAE; QIL
SAIVTAADAAEQ; ILSAIVTAADAAEQE; LSAIVTAADAAEQEG; SAIVTAADAAEQEGK; AI
VTAADAAEQEGKK; IVTAADAAEQEGKKP; VTAADAAEQEGKKPE; TAADAAEQEGKKPEE; A
ADAAEQEGKKPEEA; ADAAEQEGKKPEEAK; DAAEQEGKKPEEAKN; AAEQEGKKPEEAKNP;
AEQEGKKPEEAKNPI; EQEGKKPEEAKNPIA; QEGKKPEEAKNPIAA; EGKKPEEAKNPIAAA
; GKKPEEAKNPIAAAI; KKPEEAKNPIAAAIG; KPEEAKNPIAAAIGK; PEEAKNPIAAAIGK
G; EEAKNPIAAAIGKGN; EAKNPIAAAIGKGNA; AKNPIAAAIGKGNAD; KNPIAAAIGKGNA
DD; NPIAAAIGKGNADDG; PIAAAIGKGNADDGA; IAAAIGKGNADDGAE; AAAIGKGNADDG
AEF; AAIGKGNADDGAEFG; AIGKGNADDGAEFGQ; IGKGNADDGAEFGQE; GKGNADDGAEF
GQEG; KGNADDGAEFGQEGM; GNADDGAEFGQEGMK; NADDGAEFGQEGMKK; ADDGAEFGQE
GMKKD; DDGAEFGQEGMKKDD; DGAEFGQEGMKKDDQ; GAEFGQEGMKKDDQI; AEFGQEGMK
KDDQIA; EFGQEGMKKDDQIAA; FGQEGMKKDDQIAAA; GQEGMKKDDQIAAAI; QEGMKKDD
QIAAAIA; EGMKKDDQIAAAIAL; GMKKDDQIAAAIALR; MKKDDQIAAAIALRG; KKDDQIA
AAIALRGM; KDDQIAAAIALRGMA; DDQIAAAIALRGMAK; DQIAAAIALRGMAKD; QIAAAI
ALRGMAKDG; IAAAIALRGMAKDGK; AAAIALRGMAKDGKF; AAIALRGMAKDGKFA; AIALR
GMAKDGKFAV; IALRGMAKDGKFAVK; ALRGMAKDGKFAVKS; LRGMAKDGKFAVKSG; RGMA
KDGKFAVKSGE; GMAKDGKFAVKSGEK; MAKDGKFAVKSGEKE; AKDGKFAVKSGEKEK; KDG
KFAVKSGEKEKA;

16 mers:
EGAIKEVSELLDKLVK; GAIKEVSELLDKLVKA; AIKEVSELLDKLVKAV; IKEVSELLDKLV
KAVK; KEVSELLDKLVKAVKT; EVSELLDKLVKAVKTA; VSELLDKLVKAVKTAE; SELLDKL
VKAVKTAEG; ELLDKLVKAVKTAEGA; LLDKLVKAVKTAEGAS; LDKLVKAVKTAEGASS; DK
LVKAVKTAEGASSG; KLVKAVKTAEGASSGT; LVKAVKTAEGASSGTD; VKAVKTAEGASSGT

Fig. 43 continued

| | |
|---|---|
| DA;KAVKTAEGASSGTDAI;AVKTAEGASSGTDAIG;VKTAEGASSGTDAIGE;KTAEGASSG TDAIGEV;TAEGASSGTDAIGEVV;AEGASSGTDAIGEVVA;EGASSGTDAIGEVVAN;GASS GTDAIGEVVANA;ASSGTDAIGEVVANAG;SSGTDAIGEVVANAGA;SGTDAIGEVVANAGAA ;GTDAIGEVVANAGAAK;TDAIGEVVANAGAAKV;DAIGEVVANAGAAKVA;AIGEVVANAGA AKVAD;IGEVVANAGAAKVADK;GEVVANAGAAKVADKA;EVVANAGAAKVADKAS;VVANAG AAKVADKASV;VANAGAAKVADKASVT;ANAGAAKVAD

| | |
|---|---|
| KDFYHAII;DFYHAIIK;FYHAIIKL;YHAIIKLG;HAIIKLGY;AIIKLGYG;IIKLGYGF;IKLGYGFV;KLGYGFVD;LGYGFVDV;GYGFVDVF;YGFVDVFN;GFVDVFNA;FVDVFNAI;VDVFNAIG;DVFNAIGG;VFNAIGGL;FNAIGGLV;NAIGGLVS;AIGGLVSD;IGGLVSDV;GGLVSDVF;GLVSDVFY;LVSDVFYK;VSDVFYKA;SDVFYKAD;DVFYKADP;VFYKADPK;FYKADPKK;YKADPKKS;KADPKKSD;ADPKKSDV;DPKKSDVK;PKKSDVKN;KKSDVKNY;KSDVKNYF;SDVKNYFD;DVKNYFDS;VKNYFDSI;KNYFDSIA;NYFDSIAS;YFDSIASI;FDSIASIL;DSIASILK;SIASILKE;IASILKET;ASILKETQ;SILKETQT;ILKETQTK;LKETQTKL;KETQTKLD;ETQTKLDA;TQTKLDAL;QTKLDALS;TKLDALSK;KLDALSKE;LDALSKEQ;DALSKEQG;ALSKEQGG;LSKEQGGG;SKEQGGGD;KEQGGGDG;EQGGGDGG;QGGGDGGT;GGGDGGTQ;GGDGGTQV;GDGGTQVV;DGGTQVVD;GGTQVVDA;GTQVVDAA;TQVVDAAK;QVVDAAKK;VVDAAKKA;VDAAKKAG;DAAKKAGE;AAKKAGEW;AKKAGEWI;KKAGEWIK;KAGEWIKE;AGEWIKEM;GEWIKEMH;EWIKEMHK;WIKEMHKA;IKEMHKAV;KEMHKAVE;EMHKAVED;MHKAVEDT;HKAVEDTA;KAVEDTAK;AVEDTAKA;VEDTAKAG;EDTAKAGG;DTAKAGGE;TAKAGGEG;AKAGGEGG;KAGGEGGS;AGGEGGSE;GGEGGSES;GEGGSESI;EGGSESIA;GGSESIAN;GSESIANV;SESIANVA;ESIANVAA;SIANVAAG;IANVAAGG;ANVAAGGG;NVAAGGGG;VAAGGGGN;AAGGGGND;AGGGGNDG;GGGGNDGA;GGGNDGAG;GGNDGAGA;GNDGAGAK;NDGAGAKA;DGAGAKAD;GAGAKADV;AGAKADVN;GAKADVNS;AKADVNSV;KADVNSVT;ADVNSVTG;DVNSVTGI;VNSVTGIA;NSVTGIAK;SVTGIAKG;VTGIAKGM;TGIAKGMK;GIAKGMKA;IAKGMKAI;AKGMKAIV;KGMKAIVD;GMKAIVDA;MKAIVDAA;KAIVDAAG;AIVDAAGK;IVDAAGKA;VDAAGKAG;DAAGKAGV;AAGKAGVE;AGKAGVEL;GKAGVELK;KAGVELKP;AGVELKPA;GVELKPAA;VELKPAAA;ELKPAAAG;LKPAAAGG;KPAAAGGA;PAAAGGAA;AAAGGAAA;AAGGAAAN;AGGAAAND;GGAAANDA;GAAANDAG;AAANDAGK;AANDAGKL;ANDAGKLF;NDAGKLFA;DAGKLFAS;AGKLFASG;GKLFASGA;KLFASGAN;LFASGANA;FASGANAN;ASGANANA;SGANANAA;GANANAAA;ANANAAAN;NANAAANA;ANAAANAD;NAAANADD;AAANADDA;AANADDAE;ANADDAEG;NADDAEGA;ADDAEGAA;DDAEGAAE;DAEGAAEA;AEGAAEAA;EGAAEAAG;GAAEAAGK;AAEAAGKA;AEAAGKAV;EAAGKAVS;AAGKAVSA;AGKAVSAV;GKAVSAVS;KAVSAVSG;AVSAVSGD;VSAVSGDQ;SAVSGDQI;AVSGDQIL;VSGDQILK;SGDQILKA;GDQILKAI;DQILKAIV;QILKAIVD;ILKAIVDA;LKAIVDAA;KAIVDAAG;AIVDAAGA;IVDAAGAT;VDAAGATA;DAAGATAG;AAGATAGK;AGATAGKK;GATAGKKA;ATAGKKAN;TAGKKANE;AGKKANEA;GKKANEAT;KKANEATN;KANEATNA;ANEATNAV;NEATNAVE;EATNAVEA;ATNAVEAA;TNAVEAAI;NAVEAAIG;AVEAAIGD;VEAAIGDD;EAAIGDDN;AAIGDDNA;AIGDDNAG;IGDDNAGQ;GDDNAGQA;DDNAGQAG;DNAGQAGA;NAGQAGAA;AGQAGAAF;GQAGAAFA;QAGAAFAA;AGAAFAAG;GAAFAAGM;AAFAAGMQ;AFAAGMQN;FAAGMQNK;AAGMQNKN;AGMQNKND;GMQNKNDQ;MQNKNDQI;QNKNDQIA;NKNDQIAA;KNDQIAAA;NDQIAAAI;DQIAAAIV;QIAAAIVL;IAAAIVLR;AAAIVLRG;AAIVLRGL;AIVLRGLA;IVLRGLAK;VLRGLAKS;LRGLAKSG;RGLAKSGK;GLAKSGKF;LAKSGKFA;AKSGKFAN;KSGKFANE;<br><br>9 mers:<br>MKKISSAIF;KKISSAIFL;KISSAIFLL;ISSAIFLLA;SSAIFLLAF;SAIFLLAFF;AIFLLAFFV;IFLLAFFVF;FLLAFFVFT;LLAFFVFTN;LAFFVFTNC;AFFVFTNCK;FFVFTNCKN;FVFTNCKNN;VFTNCKNNA;FTNCKNNAE;TNCKNNAEL;NCKNNAELA;CKNNAELAE;KNNAELAEA;NNAELAEAE;NAELAEAEA;AELAEAEAK;ELAEAEAKN;LAEAEAKNQ;AEAEAKNQS;EAEAKNQSA;AEAKNQSAK;EAKNQSAKD;AKNQSAKDF;KNQSAKDFY;NQSAKDFYH;QSAKDFYHA;SAKDFYHAI;AKDFYHAII;KDFYHAIIK;DFYHAIIKL;FYHAIIKLG;YHAIIKLGY;HAIIKLGYG;AIIKLGYGF;IIKLGYGFV;IKLGYGFVD;KLGYGFVDV;LGYGFVDVF;GYGFVDVFN;YGFVDVFNA;GFVDVFNAI;FVDVFNAIG;VDVFNAIGG;DVFNAIGGL;VFNAIGGLV;FNAIGGLVS;NAIGGLVSD;AIGGLVSDV;IGGLVSDVF;GGLVSDVFY;GLVSDVFYK;LVSDVFYKA;VSDVFYKAD;SDVFYKADP;DVFYKADPK;VFYKADPKK;FYKADPKKS;YKADPKKSD;KADPKKSDV;ADPKKSDVK;DPKKSDVKN;PKKSDVKNY;KKSDVKNYF;KSDVKNYFD;SDVKNYFDS;DVKNYFDSI;VKNYFDSIA;KNYFDSIAS;NYFDSIASI;YFDSIASIL;FDSIASILK;DSIASILKE;SIASILKET;IASILKETQ;ASILKETQT;SILKETQTK;ILKETQTKL;LKETQTKLD;KETQTKLDA;ETQTKLDAL;TQTKLDALS;QTKLDALSK;TKLDALSKE;KLDALSKEQ;LDALSKEQG;DALSKEQGG;ALSKEQGGG;LSKEQGGGD;SKEQGGGDG;KEQGGGDGG;EQGGGDGGT;QGGGDGGTQ;GGGDGGTQV;GGDGGTQVV;GDGGTQVVD;DGGTQVVDA;GGTQVVDAA;GTQVVDAAK;TQVVDAAKK;QVVDAAKKA;V | |

Fig. 43 continued

VDAAKKAG;VDAAKKAGE;DAAKKAGEW;AAKKAGEWI;AKKAGEWIK;KKAGEWIKE;KAGE
WIKEM;AGEWIKEMH;GEWIKEMHK;EWIKEMHKA;WIKEMHKAV;IKEMHKAVE;KEMHKAV
ED;EMHKAVEDT;MHKAVEDTA;HKAVEDTAK;KAVEDTAKA;AVEDTAKAG;VEDTAKAGG;
EDTAKAGGE;DTAKAGGEG;TAKAGGEGG;AKAGGEGGS;KAGGEGGSE;AGGEGGSES;GGE
GGSESI;GEGGSESIA;EGGSESIAN;GGSESIANV;GSESIANVA;SESIANVAA;ESIANV
AAG;SIANVAAGG;IANVAAGGG;ANVAAGGGG;NVAAGGGGN;VAAGGGGND;AAGGGGNDG
;AGGGGNDGA;GGGGNDGAG;GGGNDGAGA;GGNDGAGAK;GNDGAGAKA;NDGAGAKAD;DG
AGAKADV;GAGAKADVN;AGAKADVNS;GAKADVNSV;AKADVNSVT;KADVNSVTG;ADVNS
VTGI;DVNSVTGIA;VNSVTGIAK;NSVTGIAKG;SVTGIAKGM;VTGIAKGMK;TGIAKGMK
A;GIAKGMKAI;IAKGMKAIV;AKGMKAIVD;KGMKAIVDA;GMKAIVDAA;MKAIVDAAG;K
AIVDAAGK;AIVDAAGKA;IVDAAGKAG;VDAAGKAGV;DAAGKAGVE;AAGKAGVEL;AGKA
GVELK;GKAGVELKP;KAGVELKPA;AGVELKPAA;GVELKPAAA;VELKPAAAG;ELKPAAA
GG;LKPAAAGGA;KPAAAGGAA;PAAAGGAAA;AAAGGAAAN;AAGGAAAND;AGGAAANDA;
GGAAANDAG;GAAANDAGK;AAANDAGKL;AANDAGKLF;ANDAGKLFA;NDAGKLFAS;DAG
KLFASG;AGKLFASGA;GKLFASGAN;KLFASGANA;LFASGANAN;FASGANANA;ASGANA
NAA;SGANANAAA;GANANAAAN;ANANAAANA;NANAAANAD;ANAAANADD;NAAANADDA
;AAANADDAE;AANADDAEG;ANADDAEGA;NADDAEGAA;ADDAEGAAE;DDAEGAAEA;DA
EGAAEAA;AEGAAEAAG;EGAAEAAGK;GAAEAAGKA;AAEAAGKAV;AEAAGKAVS;EAAGK
AVSA;AAGKAVSAV;AGKAVSAVS;GKAVSAVSG;KAVSAVSGD;AVSAVSGDQ;VSAVSGDQ
I;SAVSGDQIL;AVSGDQILK;VSGDQILKA;SGDQILKAI;GDQILKAIV;DQILKAIVD;Q
ILKAIVDA;ILKAIVDAA;LKAIVDAAG;KAIVDAAGA;AIVDAAGAT;IVDAAGATA;VDAA
GATAG;DAAGATAGK;AAGATAGKK;AGATAGKKA;GATAGKKAN;ATAGKKANE;TAGKKAN
EA;AGKKANEAT;GKKANEATN;KKANEATNA;KANEATNAV;ANEATNAVE;NEATNAVEA;
EATNAVEAA;ATNAVEAAI;TNAVEAAIG;NAVEAAIGD;AVEAAIGDD;VEAAIGDDN;EAA
IGDDNA;AAIGDDNAG;AIGDDNAGQ;IGDDNAGQA;GDDNAGQAG;DDNAGQAGA;DNAGQA
GAA;NAGQAGAAF;AGQAGAAFA;GQAGAAFAA;QAGAAFAAG;AGAAFAAGM;GAAFAAGMQ
;AAFAAGMQN;AFAAGMQNK;FAAGMQNKN;AAGMQNKND;AGMQNKNDQ;GMQNKNDQI;MQ
NKNDQIA;QNKNDQIAA;NKNDQIAAA;KNDQIAAAI;NDQIAAAIV;DQIAAAIVL;QIAAA
IVLR;IAAAIVLRG;AAAIVLRGL;AAIVLRGLA;AIVLRGLAK;IVLRGLAKS;VLRGLAKS
G;LRGLAKSGK;RGLAKSGKF;GLAKSGKFA;LAKSGKFAN;AKSGKFANE;

10 mers:
MKKISSAIFL;KKISSAIFLL;KISSAIFLLA;ISSAIFLLAF;SSAIFLLAFF;SAIFLLAF
FV;AIFLLAFFVF;IFLLAFFVFT;FLLAFFVFTN;LLAFFVFTNC;LAFFVFTNCK;AFFVF
TNCKN;FFVFTNCKNN;FVFTNCKNNA;VFTNCKNNAE;FTNCKNNAEL;TNCKNNAELA;NC
KNNAELAE;CKNNAELAEA;KNNAELAEAE;NNAELAEAEA;NAELAEAEAK;AELAEAEAKN
;ELAEAEAKNQ;LAEAEAKNQS;AEAEAKNQSA;EAEAKNQSAK;AEAKNQSAKD;EAKNQSA
KDF;AKNQSAKDFY;KNQSAKDFYH;NQSAKDFYHA;QSAKDFYHAI;SAKDFYHAII;AKDF
YHAIIK;KDFYHAIIKL;DFYHAIIKLG;FYHAIIKLGY;YHAIIKLGYG;HAIIKLGYGF;A
IIKLGYGFV;IIKLGYGFVD;IKLGYGFVDV;KLGYGFVDVF;LGYGFVDVFN;GYGFVDVFN
A;YGFVDVFNAI;GFVDVFNAIG;FVDVFNAIGG;VDVFNAIGGL;DVFNAIGGLV;VFNAIG
GLVS;FNAIGGLVSD;NAIGGLVSDV;AIGGLVSDVF;IGGLVSDVFY;GGLVSDVFYK;GLV
SDVFYKA;LVSDVFYKAD;VSDVFYKADP;SDVFYKADPK;DVFYKADPKK;VFYKADPKKS;
FYKADPKKSD;YKADPKKSDV;KADPKKSDVK;ADPKKSDVKN;DPKKSDVKNY;PKKSDVKN
YF;KKSDVKNYFD;KSDVKNYFDS;SDVKNYFDSI;DVKNYFDSIA;VKNYFDSIAS;KNYFD
SIASI;NYFDSIASIL;YFDSIASILK;FDSIASILKE;DSIASILKET;SIASILKETQ;IA
SILKETQT;ASILKETQTK;SILKETQTKL;ILKETQTKLD;LKETQTKLDA;KETQTKLDAL
;ETQTKLDALS;TQTKLDALSK;QTKLDALSKE;TKLDALSKEQ;KLDALSKEQG;LDALSKE
QGG;DALSKEQGGG;ALSKEQGGGD;LSKEQGGGDG;SKEQGGGDGG;KEQGGGDGGT;EQGG
GDGGTQ;QGGGDGGTQV;GGGDGGTQVV;GGDGGTQVVD;GDGGTQVVDA;DGGTQVVDAA;G
GTQVVDAAK;GTQVVDAAKK;TQVVDAAKKA;QVVDAAKKAG;VVDAAKKAGE;VDAAKKAGE
W;DAAKKAGEWI;AAKKAGEWIK;AKKAGEWIKE;KKAGEWIKEM;KAGEWIKEMH;AGEWIK
EMHK;GEWIKEMHKA;EWIKEMHKAV;WIKEMHKAVE;IKEMHKAVED;KEMHKAVEDT;EMH
KAVEDTA;MHKAVEDTAK;HKAVEDTAKA;KAVEDTAKAG;AVEDTAKAGG;VEDTAKAGGE;
EDTAKAGGEG;DTAKAGGEGG;TAKAGGEGGS;AKAGGEGGSE;KAGGEGGSES;AGGEGGSE
SI;GGEGGSESIA;GEGGSESIAN;EGGSESIANV;GGSESIANVA;GSESIANVAA;SESIA
NVAAG;ESIANVAAGG;SIANVAAGGG;IANVAAGGGG;ANVAAGGGGN;NVAAGGGGND;VA

Fig. 43 continued

AGGGGNDG; AAGGGGNDGA; AGGGGNDGAG; GGGGNDGAGA; GGGNDGAGAK; GGNDGAGAKA
; GNDGAGAKAD; NDGAGAKADV; DGAGAKADVN; GAGAKADVNS; AGAKADVNSV; GAKADVN
SVT; AKADVNSVTG; KADVNSVTGI; ADVNSVTGIA; DVNSVTGIAK; VNSVTGIAKG; NSVT
GIAKGM; SVTGIAKGMK; VTGIAKGMKA; TGIAKGMKAI; GIAKGMKAIV; IAKGMKAIVD; A
KGMKAIVDA; KGMKAIVDAA; GMKAIVDAAG; MKAIVDAAGK; KAIVDAAGKA; AIVDAAGKA
G; IVDAAGKAGV; VDAAGKAGVE; DAAGKAGVEL; AAGKAGVELK; AGKAGVELKP; GKAGVE
LKPA; KAGVELKPAA; AGVELKPAAA; GVELKPAAAG; VELKPAAAGG; ELKPAAAGGA; LKP

| | |
|---|---|
| GGGNDGAGAKA;GGNDGAGAKAD;GNDGAGAKADV;NDGAGAKADVN;DGAGAKADVNS;GAG<br>AKADVNSV;AGAKADVNSVT;GAKADVNSVTG;AKADVNSVTGI;KADVNSVTGIA;ADVNSV<br>TGIAK;DVNSVTGIAKG;VNSVTGIAKGM;NSVTGIAKGMK;SVTGIAKGMKA;VTGIAKGMK<br>AI;TGIAKGMKAIV;GIAKGMKAIVD;IAKGMKAIVDA;AKGMKAIVDAA;KGMKAIVDAAG;<br>GMKAIVDAAGK;MKAIVDAAGKA;KAIVDAAGKAG;AIVDAAGKAGV;IVDAAGKAGVE;VDA<br>AGKAGVEL;DAAGKAGVELK;AAGKAGVELKP;AGKAGVELKPA;GKAGVELKPAA;KAGVEL<br>KPAAA;AGVELKPAAAG;GVELKPAAAGG;VELKPAAAGGA;ELKPAAAGGAA;LKPAAAGGA<br>AA;KPAAAGGAAAN;PAAAGGAAAND;AAAGGAAANDA;AAGGAAANDAG;AGGAAANDAGK;<br>GGAAANDAGKL;GAAANDAGKLF;AAANDAGKLFA;AANDAGKLFAS;ANDAGKLFASG;NDA<br>GKLFASGA;DAGKLFASGAN;AGKLFASGANA;GKLFASGANAN;KLFASGANANA;LFASGA<br>NANAA;FASGANANAAA;ASGANANAAAN;SGANANAAANA;GANANAAANAD;ANANAAANA<br>DD;NANAAANADDA;ANAAANADDAE;NAAANADDAEG;AAANADDAEGA;AANADDAEGAA;<br>ANADDAEGAAE;NADDAEGAAEA;ADDAEGAAEAA;DDAEGAAEAAG;DAEGAAEAAGK;AEG<br>AAEAAGKA;EGAAEAAGKAV;GAAEAAGKAVS;AAEAAGKAVSA;AEAAGKAVSAV;EAAGKA<br>VSAVS;AAGKAVSAVSG;AGKAVSAVSGD;GKAVSAVSGDQ;KAVSAVSGDQI;AVSAVSGDQ<br>IL;VSAVSGDQILK;SAVSGDQILKA;AVSGDQILKAI;VSGDQILKAIV;SGDQILKAIVD;<br>GDQILKAIVDA;DQILKAIVDAA;QILKAIVDAAG;ILKAIVDAAGA;LKAIVDAAGAT;KAI<br>VDAAGATA;AIVDAAGATAG;IVDAAGATAGK;VDAAGATAGKK;DAAGATAGKKA;AAGATA<br>GKKAN;AGATAGKKANE;GATAGKKANEA;ATAGKKANEAT;TAGKKANEATN;AGKKANEAT<br>NA;GKKANEATNAV;KKANEATNAVE;KANEATNAVEA;ANEATNAVEAA;NEATNAVEAAI;<br>EATNAVEAAIG;ATNAVEAAIGD;TNAVEAAIGDD;NAVEAAIGDDN;AVEAAIGDDNA;VEA<br>AIGDDNAG;EAAIGDDNAGQ;AAIGDDNAGQA;AIGDDNAGQAG;IGDDNAGQAGA;GDDNAG<br>QAGAA;DDNAGQAGAAF;DNAGQAGAAFA;NAGQAGAAFAA;AGQAGAAFAAG;GQAGAAFAA<br>GM;QAGAAFAAGMQ;AGAAFAAGMQN;GAAFAAGMQNK;AAFAAGMQNKN;AFAAGMQNKND;<br>FAAGMQNKNDQ;AAGMQNKNDQI;AGMQNKNDQIA;GMQNKNDQIAA;MQNKNDQIAAA;QNK<br>NDQIAAAI;NKNDQIAAAIV;KNDQIAAAIVL;NDQIAAAIVLR;DQIAAAIVLRG;QIAAAI<br>VLRGL;IAAAIVLRGLA;AAAIVLRGLAK;AAIVLRGLAKS;AIVLRGLAKSG;IVLRGLAKS<br>GK;VLRGLAKSGKF;LRGLAKSGKFA;RGLAKSGKFAN;GLAKSGKFANE;<br><br>13 mers:<br>MKKISSAIFLLAF;KKISSAIFLLAFF;KISSAIFLLAFFV;ISSAIFLLAFFVF;SSAIFLL<br>AFFVFT;SAIFLLAFFVFTN;AIFLLAFFVFTNC;IFLLAFFVFTNCK;FLLAFFVFTNCKN;<br>LLAFFVFTNCKNN;LAFFVFTNCKNNA;AFFVFTNCKNNAE;FFVFTNCKNNAEL;FVFTNCK<br>NNAELA;VFTNCKNNAELAE;FTNCKNNAELAEA;TNCKNNAELAEAE;NCKNNAELAEAEA;<br>CKNNAELAEAEAK;KNNAELAEAEAKN;NNAELAEAEAKNQ;NAELAEAEAKNQS;AELAEAE<br>AKNQSA;ELAEAEAKNQSAK;LAEAEAKNQSAKD;AEAEAKNQSAKDF;EAEAKNQSAKDFY;<br>AEAKNQSAKDFYH;EAKNQSAKDFYHA;AKNQSAKDFYHAI;KNQSAKDFYHAII;NQSAKDF<br>YHAIIK;QSAKDFYHAIIKL;SAKDFYHAIIKLG;AKDFYHAIIKLGY;KDFYHAIIKLGYG;<br>DFYHAIIKLGYGF;FYHAIIKLGYGFV;YHAIIKLGYGFVD;HAIIKLGYGFVDV;AIIKLGY<br>GFVDVF;IIKLGYGFVDVFN;IKLGYGFVDVFNA;KLGYGFVDVFNAI;LGYGFVDVFNAIG;<br>GYGFVDVFNAIGG;YGFVDVFNAIGGL;GFVDVFNAIGGLV;FVDVFNAIGGLVS;VDVFNAI<br>GGLVSD;DVFNAIGGLVSDV;VFNAIGGLVSDVF;FNAIGGLVSDVFY;NAIGGLVSDVFYK;<br>AIGGLVSDVFYKA;IGGLVSDVFYKAD;GGLVSDVFYKADP;GLVSDVFYKADPK;LVSDVFY<br>KADPKK;VSDVFYKADPKKS;SDVFYKADPKKSD;DVFYKADPKKSDV;VFYKADPKKSDVK;<br>FYKADPKKSDVKN;YKADPKKSDVKNY;KADPKKSDVKNYF;ADPKKSDVKNYFD;DPKKSDV<br>KNYFDS;PKKSDVKNYFDSI;KKSDVKNYFDSIA;KSDVKNYFDSIAS;SDVKNYFDSIASI;<br>DVKNYFDSIASIL;VKNYFDSIASILK;KNYFDSIASILKE;NYFDSIASILKET;YFDSIAS<br>ILKETQ;FDSIASILKETQT;DSIASILKETQTK;SIASILKETQTKL;IASILKETQTKLD;<br>ASILKETQTKLDA;SILKETQTKLDAL;ILKETQTKLDALS;LKETQTKLDALSK;KETQTKL<br>DALSKE;ETQTKLDALSKEQ;TQTKLDALSKEQG;QTKLDALSKEQGG;TKLDALSKEQGGG;<br>KLDALSKEQGGGD;LDALSKEQGGGDG;DALSKEQGGGDGG;ALSKEQGGGDGGT;LSKEQGG<br>GDGGTQ;SKEQGGGDGGTQV;KEQGGGDGGTQVV;EQGGGDGGTQVVD;QGGGDGGTQVVDA;<br>GGGDGGTQVVDAA;GGDGGTQVVDAAK;GDGGTQVVDAAKK;DGGTQVVDAAKKA;GGTQVVD<br>AAKKAG;GTQVVDAAKKAGE;TQVVDAAKKAGEW;QVVDAAKKAGEWI;VVDAAKKAGEWIK;<br>VDAAKKAGEWIKE;DAAKKAGEWIKEM;AAKKAGEWIKEMH;AKKAGEWIKEMHK;KKAGEWI<br>KEMHKA;KAGEWIKEMHKAV;AGEWIKEMHKAVE;GEWIKEMHKAVED;EWIKEMHKAVEDT;<br>WIKEMHKAVEDTA;IKEMHKAVEDTAK;KEMHKAVEDTAKA;EMHKAVEDTAKAG;MHKAVED | |

Fig. 43 continued

TAKAGG;HKAVEDTAKAGGE;KAVEDTAKAGGEG;AVEDTAKAGGEGG;VEDTAKAGGEGGS;
EDTAKAGGEGGSE;DTAKAGGEGGSES;TAKAGGEGGSESI;AKAGGEGGSESIA;KAGGEGG
SESIAN;AGGEGGSESIANV;GGEGGSESIANVA;GEGGSESIANVAA;EGGSESIANVAAG;
GGSESIANVAAGG;GSESIANVAAGGG;SESIANVAAGGGG;ESIANVAAGGGGN;SIANVAA
GGGGND;IANVAAGGGGNDG;ANVAAGGGGNDGA;NVAAGGGGNDGAG;VAAGGGGNDGAGA;
AAGGGGNDGAGAK;AGGGGNDGAGAKA;GGGGNDGAGAKAD;GGGNDGAGAKADV;GGNDGAG
AKADVN;GNDGAGAKADVNS;NDGAGAKADVNSV;DGAGAKADVNSVT;GAGAKADVNSVTG;
AGAKADVNSVTGI;GAKADVNSVTGIA;AKADVNSVTGIAK;KADVNSVTGIAKG;ADVNSVT
GIAKGM;DVNSVTGIAKGMK;VNSVTGIAKGMKA;NSVTGIAKGMKAI;SVTGIAKGMKAIV;
VTGIAKGMKAIVD;TGIAKGMKAIVDA;GIAKGMKAIVDAA;IAKGMKAIVDAAG;AKGMKAI
VDAAGK;KGMKAIVDAAGKA;GMKAIVDAAGKAG;MKAIVDAAGKAGV;KAIVDAAGKAGVE;
AIVDAAGKAGVEL;IVDAAGKAGVELK;VDAAGKAGVELKP;DAAGKAGVELKPA;AAGKAGV
ELKPAA;AGKAGVELKPAAA;GKAGVELKPAAAG;KAGVELKPAAAGG;AGVELKPAAAGGA;
GVELKPAAAGGAA;VELKPAAAGGAAA;ELKPAAAGGAAAN;LKPAAAGGAAAND;KPAAAGG
AAANDA;PAAAGGAAANDAG;AAAGGAAANDAGK;AAGGAAANDAGKL;AGGAAANDAGKLF;
GGAAANDAGKLFA;GAAANDAGKLFAS;AAANDAGKLFASG;AANDAGKLFASGA;ANDAGKL
FASGAN;NDAGKLFASGANA;DAGKLFASGANAN;AGKLFASGANANA;GKLFASGANANAA;
KLFASGANANAAA;LFASGANANAAAN;FASGANANAAANA;ASGANANAAANAD;SGANANA
AANADD;GANANAAANADDA;ANANAAANADDAE;NANAAANADDAEG;ANAAANADDAEGA;
NAAANADDAEGAA;AAANADDAEGAAE;AANADDAEGAAEA;ANADDAEGAAEAA;NADDAEG
AAEAAG;ADDAEGAAEAAGK;DDAEGAAEAAGKA;DAEGAAEAAGKAV;AEGAAEAAGKAVS;
EGAAEAAGKAVSA;GAAEAAGKAVSAV;AAEAAGKAVSAVS;AEAAGKAVSAVSG;EAAGKAV
SAVSGD;AAGKAVSAVSGDQ;AGKAVSAVSGDQI;GKAVSAVSGDQIL;KAVSAVSGDQILK;
AVSAVSGDQILKA;VSAVSGDQILKAI;SAVSGDQILKAIV;AVSGDQILKAIVD;VSGDQIL
KAIVDA;SGDQILKAIVDAA;GDQILKAIVDAAG;DQILKAIVDAAGA;QILKAIVDAAGAT;
ILKAIVDAAGATA;LKAIVDAAGATAG;KAIVDAAGATAGK;AIVDAAGATAGKK;IVDAAGA
TAGKKA;VDAAGATAGKKAN;DAAGATAGKKANE;AAGATAGKKANEA;AGATAGKKANEAT;
GATAGKKANEATN;ATAGKKANEATNA;TAGKKANEATNAV;AGKKANEATNAVE;GKKANEA
TNAVEA;KKANEATNAVEAA;KANEATNAVEAAI;ANEATNAVEAAIG;NEATNAVEAAIGD;
EATNAVEAAIGDD;ATNAVEAAIGDDN;TNAVEAAIGDDNA;NAVEAAIGDDNAG;AVEAAIG
DDNAGQ;VEAAIGDDNAGQA;EAAIGDDNAGQAG;AAIGDDNAGQAGA;AIGDDNAGQAGAA;
IGDDNAGQAGAAF;GDDNAGQAGAAFA;DDNAGQAGAAFAA;DNAGQAGAAFAAG;NAGQAGA
AFAAGM;AGQAGAAFAAGMQ;GQAGAAFAAGMQN;QAGAAFAAGMQNK;AGAAFAAGMQNKN;
GAAFAAGMQNKND;AAFAAGMQNKNDQ;AFAAGMQNKNDQI;FAAGMQNKNDQIA;AAGMQNK
NDQIAA;AGMQNKNDQIAAA;GMQNKNDQIAAAI;MQNKNDQIAAAIV;QNKNDQIAAAIVL;
NKNDQIAAAIVLR;KNDQIAAAIVLRG;NDQIAAAIVLRGL;DQIAAAIVLRGLA;QIAAAIV
LRGLAK;IAAAIVLRGLAKS;AAAIVLRGLAKSG;AAIVLRGLAKSGK;AIVLRGLAKSGKF;
IVLRGLAKSGKFA;VLRGLAKSGKFAN;LRGLAKSGKFANE;

14 mers:
MKKISSAIFLLAFF;KKISSAIFLLAFFV;KISSAIFLLAFFVF;ISSAIFLLAFFVFT;SSA
IFLLAFFVFTN;SAIFLLAFFVFTNC;AIFLLAFFVFTNCK;IFLLAFFVFTNCKN;FLLAFF
VFTNCKNN;LLAFFVFTNCKNNA;LAFFVFTNCKNNAE;AFFVFTNCKNNAEL;FFVFTNCKN
NAELA;FVFTNCKNNAELAE;VFTNCKNNAELAEA;FTNCKNNAELAEAE;TNCKNNAELAEA
EA;NCKNNAELAEAEAK;CKNNAELAEAEAKN;KNNAELAEAEAKNQ;NNAELAEAEAKNQS;
NAELAEAEAKNQSA;AELAEAEAKNQSAK;ELAEAEAKNQSAKD;LAEAEAKNQSAKDF;AEA
EAKNQSAKDFY;EAEAKNQSAKDFYH;AEAKNQSAKDFYHA;EAKNQSAKDFYHAI;AKNQSA
KDFYHAII;KNQSAKDFYHAIIK;NQSAKDFYHAIIKL;QSAKDFYHAIIKLG;SAKDFYHAI
IKLGY;AKDFYHAIIKLGYG;KDFYHAIIKLGYGF;DFYHAIIKLGYGFV;FYHAIIKLGYGF
VD;YHAIIKLGYGFVDV;HAIIKLGYGFVDVF;AIIKLGYGFVDVFN;IIKLGYGFVDVFNA;
IKLGYGFVDVFNAI;KLGYGFVDVFNAIG;LGYGFVDVFNAIGG;GYGFVDVFNAIGGL;YGF
VDVFNAIGGLV;GFVDVFNAIGGLVS;FVDVFNAIGGLVSD;VDVFNAIGGLVSDV;DVFNAI
GGLVSDVF;VFNAIGGLVSDVFY;FNAIGGLVSDVFYK;NAIGGLVSDVFYKA;AIGGLVSDV
FYKAD;IGGLVSDVFYKADP;GGLVSDVFYKADPK;GLVSDVFYKADPKK;LVSDVFYKADPK
KS;VSDVFYKADPKKSD;SDVFYKADPKKSDV;DVFYKADPKKSDVK;VFYKADPKKSDVKN;
FYKADPKKSDVKNY;YKADPKKSDVKNYF;KADPKKSDVKNYFD;ADPKKSDVKNYFDS;DPK
KSDVKNYFDSI;PKKSDVKNYFDSIA;KKSDVKNYFDSIAS;KSDVKNYFDSIASI;SDVKNY

Fig. 43 continued

FDSIASIL; DVKNYFDSIASILK; VKNYFDSIASILKE; KNYFDSIASILKET; NYFDSIASI
LKETQ; YFDSIASILKETQT; FDSIASILKETQTK; DSIASILKETQTKL; SIASILKETQTK
LD; IASILKETQTKLDA; ASILKETQTKLDAL; SILKETQTKLDALS; ILKETQTKLDALSK;
LKETQTKLDALSKE; KETQTKLDALSKEQ; ETQTKLDALSKEQG; TQTKLDALSKEQGG; QTK
LDALSKEQGGGT; TKLDALSKEQGGGD; KLDALSKEQGGGDG; LDALSKEQGGGDGG; DALSKE
QGGGDGGT; ALSKEQGGGDGGTQ; LSKEQGGGDGGTQV; SKEQGGGDGGTQVV; KEQGGGDGG
TQVVD; EQGGGDGGTQVVDA; QGGGDGGTQVVDAA; GGGDGGTQVVDAAK; GGDGGTQVVDAA
KK; GDGGTQVVDAAKKA; DGGTQVVDAAKKAG; GGTQVVDAAKKAG

N;FLLAFFVFTNCKNNA;LLAFFVFTNCKNNAE;LAFFVFTNCKNNAEL;AFFVFTNCKNNAE
LA;FFVFTNCKNNAELAE;FVFTNCKNNAELAEA;VFTNCKNNAELAEAE;FTNCKNNAELAE
AEA;TNCKNNAELAEAEAK;NCKNNAELAEAEAKN;CKNNAELAEAEAKNQ;KNNAELAEAEA
KNQS;NNAELAEAEAKNQSA;NAELAEAEAKNQSAK;AELAEAEAKNQSAKD;ELAEAEAKNQ
SAKDF;LAEAEAKNQSAKDFY;AEAEAKNQSAKDFYH;EAEAKNQSAKDFYHA;AEAKNQSAK
DFYHAI;EAKNQSAKDFYHAII;AKNQSAKDFYHAIIK;KNQSAKDFYHAIIKL;NQSAKDFY
HAIIKLG;QSAKDFYHAIIKLGY;SAKDFYHAIIKLGYG;AKDFYHAIIKLGYGF;KDFYHAI
IKLGYGFV;DFYHAIIKLGYGFVD;FYHAIIKLGYGFVDV;YHAIIKLGYGFVDVF;HAIIKL
GYGFVDVFN;AIIKLGYGFVDVFNA;IIKLGYGFVDVFNAI;IKLGYGFVDVFNAIG;KLGYG
FVDVFNAIGG;LGYGFVDVFNAIGGL;GYGFVDVFNAIGGLV;YGFVDVFNAIGGLVS;GFVD
VFNAIGGLVSD;FVDVFNAIGGLVSDV;VDVFNAIGGLVSDVF;DVFNAIGGLVSDVFY;VFN
AIGGLVSDVFYK;FNAIGGLVSDVFYKA;NAIGGLVSDVFYKAD;AIGGLVSDVFYKADP;IG
GLVSDVFYKADPK;GGLVSDVFYKADPKK;GLVSDVFYKADPKKS;LVSDVFYKADPKKSD;V
SDVFYKADPKKSDV;SDVFYKADPKKSDVK;DVFYKADPKKSDVKN;VFYKADPKKSDVKNY;
FYKADPKKSDVKNYF;YKADPKKSDVKNYFD;KADPKKSDVKNYFDS;ADPKKSDVKNYFDSI
;DPKKSDVKNYFDSIA;PKKSDVKNYFDSIAS;KKSDVKNYFDSIASI;KSDVKNYFDSIASI
L;SDVKNYFDSIASILK;DVKNYFDSIASILKE;VKNYFDSIASILKET;KNYFDSIASILKE
TQ;NYFDSIASILKETQT;YFDSIASILKETQTK;FDSIASILKETQTKL;DSIASILKETQT
KLD;SIASILKETQTKLDA;IASILKETQTKLDAL;ASILKETQTKLDALS;SILKETQTKLD
ALSK;ILKETQTKLDALSKE;LKETQTKLDALSKEQ;KETQTKLDALSKEQG;ETQTKLDALS
KEQGG;TQTKLDALSKEQGGG;QTKLDALSKEQGGGD;TKLDALSKEQGGGDG;KLDALSKEQ
GGGDGG;LDALSKEQGGGDGGT;DALSKEQGGGDGGTQ;ALSKEQGGGDGGTQV;LSKEQGGG
DGGTQVV;SKEQGGGDGGTQVVD;KEQGGGDGGTQVVDA;EQGGGDGGTQVVDAA;QGGGDGG
TQVVDAAK;GGGDGGTQVVDAAKK;GGDGGTQVVDAAKKA;GDGGTQVVDAAKKAG;DGGTQV
VDAAKKAGE;GGTQVVDAAKKAGEW;GTQVVDAAKKAGEWI;TQVVDAAKKAGEWIK;QVVDA
AKKAGEWIKE;VVDAAKKAGEWIKEM;VDAAKKAGEWIKEMH;DAAKKAGEWIKEMHK;AAKK
AGEWIKEMHKA;AKKAGEWIKEMHKAV;KKAGEWIKEMHKAVE;KAGEWIKEMHKAVED;AGE
WIKEMHKAVEDT;GEWIKEMHKAVEDTA;EWIKEMHKAVEDTAK;WIKEMHKAVEDTAKA;IK
EMHKAVEDTAKAG;KEMHKAVEDTAKAGG;EMHKAVEDTAKAGGE;MHKAVEDTAKAGGEG;H
KAVEDTAKAGGEGG;KAVEDTAKAGGEGGS;AVEDTAKAGGEGGSE;VEDTAKAGGEGGSES;
EDTAKAGGEGGSESI;DTAKAGGEGGSESIA;TAKAGGEGGSESIAN;AKAGGEGGSESIANV
;KAGGEGGSESIANVA;AGGEGGSESIANVAA;GGEGGSESIANVAAG;GEGGSESIANVAAG
G;EGGSESIANVAAGGG;GGSESIANVAAGGGG;GSESIANVAAGGGGN;SESIANVAAGGGG
ND;ESIANVAAGGGGNDG;SIANVAAGGGGNDGA;IANVAAGGGGNDGAG;ANVAAGGGGNDG
AGA;NVAAGGGGNDGAGAK;VAAGGGGNDGAGAKA;AAGGGGNDGAGAKAD;AGGGGNDGAGA
KADV;GGGGNDGAGAKADVN;GGGNDGAGAKADVNS;GGNDGAGAKADVNSV;GNDGAGAKAD
VNSVT;NDGAGAKADVNSVTG;DGAGAKADVNSVTGI;GAGAKADVNSVTGIA;AGAKADVNS
VTGIAK;GAKADVNSVTGIAKG;AKADVNSVTGIAKGM;KADVNSVTGIAKGMK;ADVNSVTG
IAKGMKA;DVNSVTGIAKGMKAI;VNSVTGIAKGMKAIV;NSVTGIAKGMKAIVD;SVTGIAK
GMKAIVDA;VTGIAKGMKAIVDAA;TGIAKGMKAIVDAAG;GIAKGMKAIVDAAGK;IAKGMK
AIVDAAGKA;AKGMKAIVDAAGKAG;KGMKAIVDAAGKAGV;GMKAIVDAAGKAGVE;MKAIV
DAAGKAGVEL;KAIVDAAGKAGVELK;AIVDAAGKAGVELKP;IVDAAGKAGVELKPA;VDAA
GKAGVELKPAA;DAAGKAGVELKPAAA;AAGKAGVELKPAAAG;AGKAGVELKPAAAGG;GKA
GVELKPAAAGGA;KAGVELKPAAAGGAA;AGVELKPAAAGGAAA;GVELKPAAAGGAAAN;VE
LKPAAAGGAAAND;ELKPAAAGGAAANDA;LKPAAAGGAAANDAG;KPAAAGGAAANDAGK;P
AAAGGAAANDAGKL;AAAGGAAANDAGKLF;AAGGAAANDAGKLFA;AGGAAANDAGKLFAS;
GGAAANDAGKLFASG;GAAANDAGKLFASGA;AAANDAGKLFASGAN;AANDAGKLFASGANA
;ANDAGKLFASGANAN;NDAGKLFASGANANA;DAGKLFASGANANAA;AGKLFASGANANAA
A;GKLFASGANANAAAN;KLFASGANANAAANA;LFASGANANAAANAD;FASGANANAAANA
DD;ASGANANAAANADDA;SGANANAAANADDAE;GANANAAANADDAEG;ANANAAANADDA
EGA;NANAAANADDAEGAA;ANAAANADDAEGAAE;NAAANADDAEGAAEA;AAANADDAEGA
AEAA;AANADDAEGAAEAAG;ANADDAEGAAEAAGK;NADDAEGAAEAAGKA;ADDAEGAAEA
AGKAV;DDAEGAAEAAGKAVS;DAEGAAEAAGKAVSA;AEGAAEAAGKAVSAV;EGAAEAAGK
AVSAVS;GAAEAAGKAVSAVSG;AAEAAGKAVSAVSGD;AEAAGKAVSAVSGDQ;EAAGKAVS
AVSGDQI;AAGKAVSAVSGDQIL;AGKAVSAVSGDQILK;GKAVSAVSGDQILKA;KAVSAVS
GDQILKAI;AVSAVSGDQILKAIV;VSAVSGDQILKAIVD;SAVSGDQILKAIVDA;AVSGDQ
ILKAIVDAA;VSGDQILKAIVDAAG;SGDQILKAIVDAAGA;GDQILKAIVDAAGAT;DQILK

Fig. 43 continued

AIVDAAGATA;QILKAIVDAAGATAG;ILKAIVDAAGATAGK;LKAIVDAAGATAGKK;KAIV
DAAGATAGKKA;AIVDAAGATAGKKAN;IVDAAGATAGKKANE;VDAAGATAGKKANEA;DAA
GATAGKKANEAT;AAGATAGKKANEATN;AGATAGKKANEATNA;GATAGKKANEATNAV;AT
AGKKANEATNAVE;TAGKKANEATNAVEA;AGKKANEATNAVEAA;GKKANEATNAVEAAI;K
KANEATNAVEAAIG;KANEATNAVEAAIGD;ANEATNAVEAAIGDD;NEATNAVEAAIGDDN;
EATNAVEAAIGDDNA;ATNAVEAAIGDDNAG;TNAVEAAIGDDNAGQ;NAVEAAIGDDNAGQA
;AVEAAIGDDNAGQAG;VEAAIGDDNAGQAGA;EAAIGDDNAGQAGAA;AAIGDDNAGQAGAA
F;AIGDDNAGQAGAAFA;IGDDNAGQAGAAFAA;GDDNAGQAGAAFAAG;DDNAGQAGAAFAA
GM;DNAGQAGAAFAAGMQ;NAGQAGAAFAAGMQN;AGQAGAAFAAGMQNK;GQAGAAFAAGMQ
NKN;QAGAAFAAGMQNKND;AGAAFAAGMQNKNDQ;GAAFAAGMQNKNDQI;AAFAAGMQNKN
DQIA;AFAAGMQNKNDQIAA;FAAGMQNKNDQIAAA;AAGMQNKNDQIAAAI;AGMQNKNDQI
AAAIV;GMQNKNDQIAAAIVL;MQNKNDQIAAAIVLR;QNKNDQIAAAIVLRG;NKNDQIAAA
IVLRGL;KNDQIAAAIVLRGLA;NDQIAAAIVLRGLAK;DQIAAAIVLRGLAKS;QIAAAIVL
RGLAKSG;IAAAIVLRGLAKSGK;AAAIVLRGLAKSGKF;AAIVLRGLAKSGKFA;AIVLRGL
AKSGKFAN;IVLRGLAKSGKFANE;

16 mers:
MKKISSAIFLLAFFVF;KKISSAIFLLAFFVFT;KISSAIFLLAFFVFTN;ISSAIFLLAFFV
FTNC;SSAIFLLAFFVFTNCK;SAIFLLAFFVFTNCKN;AIFLLAFFVFTNCKNN;IFLLAFF
VFTNCKNNA;FLLAFFVFTNCKNNAE;LLAFFVFTNCKNNAEL;LAFFVFTNCKNNAELA;AF
FVFTNCKNNAELAE;FFVFTNCKNNAELAEA;FVFTNCKNNAELAEAE;VFTNCKNNAELAEA
EA;FTNCKNNAELAEAEAK;TNCKNNAELAEAEAKN;NCKNNAELAEAEAKNQ;CKNNAELAE
AEAKNQS;KNNAELAEAEAKNQSA;NNAELAEAEAKNQSAK;NAELAEAEAKNQSAKD;AELA
EAEAKNQSAKDF;ELAEAEAKNQSAKDFY;LAEAEAKNQSAKDFYH;AEAEAKNQSAKDFYHA
;EAEAKNQSAKDFYHAI;AEAKNQSAKDFYHAII;EAKNQSAKDFYHAIIK;AKNQSAKDFYH
AIIKL;KNQSAKDFYHAIIKLG;NQSAKDFYHAIIKLGY;QSAKDFYHAIIKLGYG;SAKDFY
HAIIKLGYGF;AKDFYHAIIKLGYGFV;KDFYHAIIKLGYGFVD;DFYHAIIKLGYGFVDV;F
YHAIIKLGYGFVDVF;YHAIIKLGYGFVDVFN;HAIIKLGYGFVDVFNA;AIIKLGYGFVDVF
NAI;IIKLGYGFVDVFNAIG;IKLGYGFVDVFNAIGG;KLGYGFVDVFNAIGGL;LGYGFVDV
FNAIGGLV;GYGFVDVFNAIGGLVS;YGFVDVFNAIGGLVSD;GFVDVFNAIGGLVSDV;FVD
VFNAIGGLVSDVF;VDVFNAIGGLVSDVFY;DVFNAIGGLVSDVFYK;VFNAIGGLVSDVFYK
A;FNAIGGLVSDVFYKAD;NAIGGLVSDVFYKADP;AIGGLVSDVFYKADPK;IGGLVSDVFY
KADPKK;GGLVSDVFYKADPKKS;GLVSDVFYKADPKKSD;LVSDVFYKADPKKSDV;VSDVF
YKADPKKSDVK;SDVFYKADPKKSDVKN;DVFYKADPKKSDVKNY;VFYKADPKKSDVKNYF;
FYKADPKKSDVKNYFD;YKADPKKSDVKNYFDS;KADPKKSDVKNYFDSI;ADPKKSDVKNYF
DSIA;DPKKSDVKNYFDSIAS;PKKSDVKNYFDSIASI;KKSDVKNYFDSIASIL;KSDVKNY
FDSIASILK;SDVKNYFDSIASILKE;DVKNYFDSIASILKET;VKNYFDSIASILKETQ;KN
YFDSIASILKETQT;NYFDSIASILKETQTK;YFDSIASILKETQTKL;FDSIASILKETQTK
LD;DSIASILKETQTKLDA;SIASILKETQTKLDAL;IASILKETQTKLDALS;ASILKETQT
KLDALSK;SILKETQTKLDALSKE;ILKETQTKLDALSKEQ;LKETQTKLDALSKEQG;KETQ
TKLDALSKEQGG;ETQTKLDALSKEQGGG;TQTKLDALSKEQGGGD;QTKLDALSKEQGGGDG
;TKLDALSKEQGGGDGG;KLDALSKEQGGGDGGT;LDALSKEQGGGDGGTQ;DALSKEQGGGD
GGTQV;ALSKEQGGGDGGTQVV;LSKEQGGGDGGTQVVD;SKEQGGGDGGTQVVDA;KEQGGG
DGGTQVVDAA;EQGGGDGGTQVVDAAK;QGGGDGGTQVVDAAKK;GGGDGGTQVVDAAKKA;G
GDGGTQVVDAAKKAG;GDGGTQVVDAAKKAGE;DGGTQVVDAAKKAGEW;GGTQVVDAAKKAG
EWI;GTQVVDAAKKAGEWIK;TQVVDAAKKAGEWIKE;QVVDAAKKAGEWIKEM;VVDAAKKA
GEWIKEMH;VDAAKKAGEWIKEMHK;DAAKKAGEWIKEMHKA;AAKKAGEWIKEMHKAV;AKK
AGEWIKEMHKAVE;KKAGEWIKEMHKAVED;KAGEWIKEMHKAVEDT;AGEWIKEMHKAVEDT
A;GEWIKEMHKAVEDTAK;EWIKEMHKAVEDTAKA;WIKEMHKAVEDTAKAG;IKEMHKAVED
TAKAGG;KEMHKAVEDTAKAGGE;EMHKAVEDTAKAGGEG;MHKAVEDTAKAGGEGG;HKAVE
DTAKAGGEGGS;KAVEDTAKAGGEGGSE;AVEDTAKAGGEGGSES;VEDTAKAGGEGGSESI;
EDTAKAGGEGGSESIA;DTAKAGGEGGSESIAN;TAKAGGEGGSESIANV;AKAGGEGGSESI
ANVA;KAGGEGGSESIANVAA;AGGEGGSESIANVAAG;GGEGGSESIANVAAGG;GEGGSES
IANVAAGGG;EGGSESIANVAAGGGG;GGSESIANVAAGGGGN;GSESIANVAAGGGGND;SE
SIANVAAGGGGNDG;ESIANVAAGGGGNDGA;SIANVAAGGGGNDGAG;IANVAAGGGGNDGA
GA;ANVAAGGGGNDGAGAK;NVAAGGGGNDGAGAKA;VAAGGGGNDGAGAKAD;AAGGGGNDG
AGAKADV;AGGGGNDGAGAKADVN;GGGGNDGAGAKADVNS;GGGNDGAGAKADVNSV;GGND

Fig. 43 continued

| | |
|---|---|
| GAGAKADVNSVT; GNDGAGAKADVNSVTG; NDGAGAKADVNSVTGI; DGAGAKADVNSVTGIA; GAGAKADVNSVTGIAK; AGAKADVNSVTGIAKG; GAKADVNSVTGIAKGM; AKADVNSVTGIAKGMK; KADVNSVTGIAKGMKA; ADVNSVTGIAKGMKAI; DVNSVTGIAKGMKAIV; VNSVTGIAKGMKAIVD; NSVTGIAKGMKAIVDA; SVTGIAKGMKAIVDAA; VTGIAKGMKAIVDAAG; TGIAKGMKAIVDAAGK; GIAKGMKAIVDAAGKA; IAKGMKAIVDAAGKAG; AKGMKAIVDAAGKAGV; KGMKAIVDAAGKAGVE; GMKAIVDAAGKAGVEL; MKAIVDAAGKAGVELK; KAIVDAAGKAGVELKP; AIVDAAGKAGVELKPA; IVDAAGKAGVELKPAA; VDAAGKAGVELKPAAA; DAAGKAGVELKPAAAG; AAGKAGVELKPAAAGG; AGKAGVELKPAAAGGA; GKAGVELKPAAAGGAA; KAGVELKPAAAGGAAA; AGVELKPAAAGGAAAN; GVELKPAAAGGAAAND; VELKPAAAGGAAANDA;

KVFSSAVS; VFSSAVSG; FSSAVSGV; SSAVSGVY; SAVSGVYS; AVSGVYSS; VSGVYSSY;
SGVYSSYV; GVYSSYVS; VYSSYVSD; YSSYVSDL; SSYVSDLD; SYVSDLDN; YVSDLDNL;
VSDLDNLK; SDLDNLKM; DLDNLKMN; LDNLKMNG; DNLKMNGS; NLKMNGSG; LKMNGSGL;
KMNGSGLI; MNGSGLIW; NGSGLIWL; GSGLIWLV; SGLIWLVG; GLIWLVGY; LIWLVGYM;
IWLVGYML; WLVGYMLA; LVGYMLAD; VGYMLADV; GYMLADVS; YMLADVSL; MLADVSLS;
LADVSLSV; ADVSLSVS; DVSLSVSL; VSLSVSLE; SLSVSLEN; LSVSLENP; SVSLENPE;
VSLENPEI; SLENPEIN; LENPEINY; ENPEINYG; NPEINYGI; PEINYGII; EINYGIID;
INYGIIDP; NYGIIDPI; YGIIDPIY; GIIDPIYG; IIDPIYGD; IDPIYGDD; DPIYGDDV;
PIYGDDVQ; IYGDDVQI; YGDDVQIP; GDDVQIPK; DDVQIPKN; DVQIPKNL; VQIPKNLI;
QIPKNLIG; IPKNLIGV; PKNLIGVV; KNLIGVVF; NLIGVVFR; LIGVVFRI; IGVVFRIE;
GVVFRIEQ; VVFRIEQG; VFRIEQGA; FRIEQGAF; RIEQGAFL; IEQGAFLA; EQGAFLAG;
QGAFLAGY; GAFLAGYI;AFLAGYIA;FLAGYIAA;LAGYIAAK;AGYIAAKK;GYIAAKKS;
YIAAKKSV;IAAKKSVS;AAKKSVSS;AKKSVSSK;KKSVSSKI;KSVSSKIG;SVSSKIGF;
VSSKIGFI;SSKIGFIG;SKIGFIGG;KIGFIGGV;IGFIGGVK;GFIGGVKG;FIGGVKGD;
IGGVKGDI;GGVKGDIV;GVKGDIVD;VKGDIVDA;KGDIVDAF;GDIVDAFR;DIVDAFRY;
IVDAFRYG;VDAFRYGY;DAFRYGYE;AFRYGYEA;FRYGYEAG;RYGYEAGA;YGYEAGAK;
GYEAGAKY;YEAGAKYA;EAGAKYAN;AGAKYANK;GAKYANKG;AKYANKGI;KYANKGIE;
YANKGIEI;ANKGIEIV;NKGIEIVS;KGIEIVSE;GIEIVSEY;IEIVSEYS;EIVSEYSN;
IVSEYSNS;VSEYSNSF;SEYSNSFS;EYSNSFSD;YSNSFSDI;SNSFSDID;NSFSDIDI;
SFSDIDIA;FSDIDIAR;SDIDIARV;DIDIARVM;IDIARVMA;DIARVMAN;IARVMANK;
ARVMANKM;RVMANKMY;VMANKMYS;MANKMYSK;ANKMYSKG;NKMYSKGI;KMYSKGID;
MYSKGIDI;YSKGIDII;SKGIDIIH;KGIDIIHF;GIDIIHFA;IDIIHFAA;DIIHFAAG;
IIHFAAGL;IHFAAGLA;HFAAGLAG;FAAGLAGV;AAGLAGVG;AGLAGVGV;GLAGVGVI;
LAGVGVIE;AGVGVIEA;GVGVIEAA;VGVIEAAK;GVIEAAKE;VIEAAKEL;IEAAKELG;
EAAKELGD;AAKELGDG;AKELGDGY;KELGDGYY;ELGDGYYV;LGDGYYVI;GDGYYVIG;
DGYYVIGA;GYYVIGAD;YYVIGADQ;YVIGADQD;VIGADQDQ;IGADQDQS;GADQDQSH;
ADQDQSHL;DQDQSHLA;QDQSHLAP;DQSHLAPK;QSHLAPKN;SHLAPKNF;HLAPKNFI;
LAPKNFIT;APKNFITS;PKNFITSV;KNFITSVI;NFITSVIK;FITSVIKN;ITSVIKNV;
TSVIKNVG;SVIKNVGD;VIKNVGDA;IKNVGDAL;KNVGDALY;NVGDALYL;VGDALYLI;
GDALYLIT;DALYLITS;ALYLITSE;LYLITSES;YLITSESL;LITSESLK;ITSESLKN;
TSESLKND;SESLKNDN;ESLKNDNV;SLKNDNVW;LKNDNVWE;KNDNVWEG;NDNVWEGG;
DNVWEGGK;NVWEGGKI;VWEGGKIV;WEGGKIVQ;EGGKIVQM;GGKIVQMG;GKIVQMGL;
KIVQMGLR;IVQMGLRD;VQMGLRDG;QMGLRDGV;MGLRDGVV;GLRDGVVG;LRDGVVGL;
RDGVVGLS;DGVVGLSN;GVVGLSNA;VVGLSNAN;VGLSNANE;GLSNANEF;LSNANEFE;
SNANEFEY;NANEFEYI;ANEFEYIK;NEFEYIKD;EFEYIKDL;FEYIKDLE;EYIKDLER;
YIKDLERK;IKDLERKI;KDLERKII;DLERKIIN;LERKIINK;ERKIINKE;RKIINKEI;
KIINKEII;IINKEIIV;INKEIIVP;NKEIIVPC;KEIIVPCN;EIIVPCNQ;IIVPCNQE;
IVPCNQEG;VPCNQEGY;PCNQEGYE;CNQEGYEI;NQEGYEIF;QEGYEIFI;EGYEIFIK;
GYEIFIKQ;YEIFIKQI;EIFIKQIL;IFIKQILK;FIKQILKL;

9 mers:
MRIAIFIFG;RIAIFIFGI;IAIFIFGIL;AIFIFGILL;IFIFGILLT;FIFGILLTS;IFG
ILLTSC;FGILLTSCF;GILLTSCFS;ILLTSCFSK;LLTSCFSKN;LTSCFSKNG;TSCFSK
NGI;SCFSKNGIE;CFSKNGIES;FSKNGIESG;SKNGIESGS;KNGIESGSS;NGIESGSSK
;GIESGSSKI;IESGSSKIK;ESGSSKIKI;SGSSKIKIS;GSSKIKISM;SSKIKISML;SK
IKISMLV;KIKISMLVD;IKISMLVDG;KISMLVDGV;ISMLVDGVL;SMLVDGVLD;MLVDG
VLDD;LVDGVLDDK;VDGVLDDKS;DGVLDDKSF;GVLDDKSFN;VLDDKSFNS;LDDKSFNS
S;DDKSFNSSA;DKSFNSSAN;KSFNSSANE;SFNSSANEA;FNSSANEAL;NSSANEALL;S
SANEALLR;SANEALLRL;ANEALLRLK;NEALLRLKK;EALLRLKKD;ALLRLKKDF;LLRL
KKDFP;LRLKKDFPE;RLKKDFPEN;LKKDFPENI;KKDFPENIE;KDFPENIEK;DFPENIE
KV;FPENIEKVF;PENIEKVFS;ENIEKVFSS;NIEKVFSSA;IEKVFSSAV;EKVFSSAVS;
KVFSSAVSG;VFSSAVSGV;FSSAVSGVY;SSAVSGVYS;SAVSGVYSS;AVSGVYSSY;VSG
VYSSYV;SGVYSSYVS;GVYSSYVSD;VYSSYVSDL;YSSYVSDLD;SSYVSDLDN;SYVSDL
DNL;YVSDLDNLK;VSDLDNLKM;SDLDNLKMN;DLDNLKMNG;LDNLKMNGS;DNLKMNGSG
;NLKMNGSGL;LKMNGSGLI;KMNGSGLIW;MNGSGLIWL;NGSGLIWLV;GSGLIWLVG;SG
LIWLVGY;GLIWLVGYM;LIWLVGYML;IWLVGYMLA;WLVGYMLAD;LVGYMLADV;VGYML
ADVS;GYMLADVSL;YMLADVSLS;MLADVSLSV;LADVSLSVS;ADVSLSVSL;DVSLSVSL

Fig. 43 continued

E;VSLSVSLEN;SLSVSLENP;LSVSLENPE;SVSLENPEI;VSLENPEIN;SLENPEINY;L
ENPEINYG;ENPEINYGI;NPEINYGII;PEINYGIID;EINYGIIDP;INYGIIDPI;NYGI
IDPIY;YGIIDPIYG;GIIDPIYGD;IIDPIYGDD;IDPIYGDDV;DPIYGDDVQ;PIYGDDV
QI;IYGDDVQIP;YGDDVQIPK;GDDVQIPKN;DDVQIPKNL;DVQIPKNLI;VQIPKNLIG;
QIPKNLIGV;IPKNLIGVV;PKNLIGVVF;KNLIGVVFR;NLIGVVFRI;LIGVVFRIE;IGV
VFRIEQ;GVVFRIEQG;VVFRIEQGA;VFRIEQGAF;FRIEQGAFL;RIEQGAFLA;IEQGAF
LAG;EQGAFLAGY;QGAFLAGYI;GAFLAGYIA;AFLAGYIAA;FLAGYIAAK;LAGYIAAKK
;AGYIAAKKS;GYIAAKKSV;YIAAKKSVS;IAAKKSVSS;AAKKSVSSK;AKKSVSSKI;KK
SVSSKIG;KSVSSKIGF;SVSSKIGFI;VSSKIGFIG;SSKIGFIGG;SKIGFIGGV;KIGFI
GGVK;IGFIGGVKG;GFIGGVKGD;FIGGVKGDI;IGGVKGDIV;GGVKGDIVD;GVKGDIVD
A;VKGDIVDAF;KGDIVDAFR;GDIVDAFRY;DIVDAFRYG;IVDAFRYGY;VDAFRYGYE;D
AFRYGYEA;AFRYGYEAG;FRYGYEAGA;RYGYEAGAK;YGYEAGAKY;GYEAGAKYA;YEAG
AKYAN;EAGAKYANK;AGAKYANKG;GAKYANKGI;AKYANKGIE;KYANKGIEI;YANKGIE
IV;ANKGIEIVS;NKGIEIVSE;KGIEIVSEY;GIEIVSEYS;IEIVSEYSN;EIVSEYSNS;
IVSEYSNSF;VSEYSNSFS;SEYSNSFSD;EYSNSFSDI;YSNSFSDID;SNSFSDIDI;NSF
SDIDIA;SFSDIDIAR;FSDIDIARV;SDIDIARVM;DIDIARVMA;IDIARVMAN;DIARVM
ANK;IARVMANKM;ARVMANKMY;RVMANKMYS;VMANKMYSK;MANKMYSKG;ANKMYSKGI
;NKMYSKGID;KMYSKGIDI;MYSKGIDII;YSKGIDIIH;SKGIDIIHF;KGIDIIHFA;GI
DIIHFAA;IDIIHFAAG;DIIHFAAGL;IIHFAAGLA;IHFAAGLAG;HFAAGLAGV;FAAGL
AGVG;AAGLAGVGV;AGLAGVGVI;GLAGVGVIE;LAGVGVIEA;AGVGVIEAA;GVGVIEAA
K;VGVIEAAKE;GVIEAAKEL;VIEAAKELG;IEAAKELGD;EAAKELGDG;AAKELGDGY;A
KELGDGYY;KELGDGYYV;ELGDGYYVI;LGDGYYVIG;GDGYYVIGA;DGYYVIGAD;GYYV
IGADQ;YYVIGADQD;YVIGADQDQ;VIGADQDQS;IGADQDQSH;GADQDQSHL;ADQDQSH
LA;DQDQSHLAP;QDQSHLAPK;DQSHLAPKN;QSHLAPKNF;SHLAPKNFI;HLAPKNFIT;
LAPKNFITS;APKNFITSV;PKNFITSVI;KNFITSVIK;NFITSVIKN;FITSVIKNV;ITS
VIKNVG;TSVIKNVGD;SVIKNVGDA;VIKNVGDAL;IKNVGDALY;KNVGDALYL;NVGDAL
YLI;VGDALYLIT;GDALYLITS;DALYLITSE;ALYLITSES;LYLITSESL;YLITSESLK
;LITSESLKN;ITSESLKND;TSESLKNDN;SESLKNDNV;ESLKNDNVW;SLKNDNVWE;LK
NDNVWEG;KNDNVWEGG;NDNVWEGGK;DNVWEGGKI;NVWEGGKIV;VWEGGKIVQ;WEGGK
IVQM;EGGKIVQMG;GGKIVQMGL;GKIVQMGLR;KIVQMGLRD;IVQMGLRDG;VQMGLRDG
V;QMGLRDGVV;MGLRDGVVG;GLRDGVVGL;LRDGVVGLS;RDGVVGLSN;DGVVGLSNA;G
VVGLSNAN;VVGLSNANE;VGLSNANEF;GLSNANEFE;LSNANEFEY;SNANEFEYI;NANE
FEYIK;ANEFEYIKD;NEFEYIKDL;EFEYIKDLE;FEYIKDLER;EYIKDLERK;YIKDLER
KI;IKDLERKII;KDLERKIIN;DLERKIINK;LERKIINKE;ERKIINKEI;RKIINKEII;
KIINKEIIV;IINKEIIVP;INKEIIVPC;NKEIIVPCN;KEIIVPCNQ;EIIVPCNQE;IIV
PCNQEG;IVPCNQEGY;VPCNQEGYE;PCNQEGYEI;CNQEGYEIF;NQEGYEIFI;QEGYEI
FIK;EGYEIFIKQ;GYEIFIKQI;YEIFIKQIL;EIFIKQILK;IFIKQILKL;

10 mers:
MRIAIFIFGI;RIAIFIFGIL;IAIFIFGILL;AIFIFGILLT;IFIFGILLTS;FIFGILLT
SC;IFGILLTSCF;FGILLTSCFS;GILLTSCFSK;ILLTSCFSKN;LLTSCFSKNG;LTSCF
SKNGI;TSCFSKNGIE;SCFSKNGIES;CFSKNGIESG;FSKNGIESGS;SKNGIESGSS;KN
GIESGSSK;NGIESGSSKI;GIESGSSKIK;IESGSSKIKI;ESGSSKIKIS;SGSSKIKISM
;GSSKIKISML;SSKIKISMLV;SKIKISMLVD;KIKISMLVDG;IKISMLVDGV;KISMLVD
GVL;ISMLVDGVLD;SMLVDGVLDD;MLVDGVLDDK;LVDGVLDDKS;VDGVLDDKSF;DGVL
DDKSFN;GVLDDKSFNS;VLDDKSFNSS;LDDKSFNSSA;DDKSFNSSAN;DKSFNSSANE;K
SFNSSANEA;SFNSSANEAL;FNSSANEALL;NSSANEALLR;SSANEALLRL;SANEALLRL
K;ANEALLRLKK;NEALLRLKKD;EALLRLKKDF;ALLRLKKDFP;LLRLKKDFPE;LRLKKD
FPEN;RLKKDFPENI;LKKDFPENIE;KKDFPENIEK;KDFPENIEKV;DFPENIEKVF;FPE
NIEKVFS;PENIEKVFSS;ENIEKVFSSA;NIEKVFSSAV;IEKVFSSAVS;EKVFSSAVSG;
KVFSSAVSGV;VFSSAVSGVY;FSSAVSGVYS;SSAVSGVYSS;SAVSGVYSSY;AVSGVYSS
YV;VSGVYSSYVS;SGVYSSYVSD;GVYSSYVSDL;VYSSYVSDLD;YSSYVSDLDN;SSYVS
DLDNL;SYVSDLDNLK;YVSDLDNLKM;VSDLDNLKMN;SDLDNLKMNG;DLDNLKMNGS;LD
NLKMNGSG;DNLKMNGSGL;NLKMNGSGLI;LKMNGSGLIW;KMNGSGLIWL;MNGSGLIWLV
;NGSGLIWLVG;GSGLIWLVGY;SGLIWLVGYM;GLIWLVGYML;LIWLVGYMLA;IWLVGYM
LAD;WLVGYMLADV;LVGYMLADVS;VGYMLADVSL;GYMLADVSLS;YMLADVSLSV;MLAD
VSLSVS;LADVSLSVSL;ADVSLSVSLE;DVSLSVSLEN;VSLSVSLENP;SLSVSLENPE;L

Fig. 43 continued

| | |
|---|---|
| SVSLENPEI;SVSLENPEIN;VSLENPEINY;SLENPEINYG;LENPEINYGI;ENPEINYGI I;NPEINYGIID;PEINYGIIDP;EINYGIIDPI;INYGIIDPIY;NYGIIDPIYG;YGIIDP IYGD;GIIDPIYGDD;IIDPIYGDDV;IDPIYGDDVQ;DPIYGDDVQI;PIYGDDVQIP;IYG DDVQIPK;YGDDVQIPKN;GDDVQIPKNL;DDVQIPKNLI;DVQIPKNLIG;VQIPKNLIGV; QIPKNLIGVV;IPKNLIGVVF;PKNLIGVVFR;KNLIGVVFRI;NLIGVVFRIE;LIGVVFRI EQ;IGVVFRIEQG;GVVFRIEQGA;VVFRIEQGAF;VFRIEQGAFL;FRIEQGAFLA;RIEQG AFLAG;IEQGAFLAGY;EQGAFLAGYI;QGAFLAGYIA;GAFLAGYIAA;AFLAGYIAAK;FL AGYIAAKK;LAGYIAAKKS;AGYIAAKKSV;GYIAAKKSVS;YIAAKKSVSS;IAAKKSVSSK ;AAKKSVSSKI;AKKSVSSKIG;KKSVSSKIGF;KSVSSKIGFI;SVSSKIGFIG;VSSKIGF IGG;SSKIGFIGGV;SKIGFIGGVK;KIGFIGGVKG;IGFIGGVKGD;GFIGGVKGDI;FIGG VKGDIV;IGGVKGDIVD;GGVKGDIVDA;GVKGDIVDAF;VKGDIVDAFR;KGDIVDAFRY;G DIVDAFRYG;DIVDAFRYGY;IVDAFRYGYE;VDAFRYGYEA;DAFRYGYEAG;AFRYGYEAG A;FRYGYEAGAK;RYGYEAGAKY;YGYEAGAKYA;GYEAGAKYAN;YEAGAKYANK;EAGAKY ANKG;AGAKYANKGI;GAKYANKGIE;AKYANKGIEI;KYANKGIEIV;YANKGIEIVS;ANK GIEIVSE;NKGIEIVSEY;KGIEIVSEYS;GIEIVSEYSN;IEIVSEYSNS;EIVSEYSNSF; IVSEYSNSFS;VSEYSNSFSD;SEYSNSFSDI;EYSNSFSDID;YSNSFSDIDI;SNSFSDID IA;NSFSDIDIAR;SFSDIDIARV;FSDIDIARVM;SDIDIARVMA;DIDIARVMAN;IDIAR VMANK;DIARVMANKM;IARVMANKMY;ARVMANKMYS;RVMANKMYSK;VMANKMYSKG;MA NKMYSKGI;ANKMYSKGID;NKMYSKGIDI;KMYSKGIDII;MYSKGIDIIH;YSKGIDIIHF ;SKGIDIIHFA;KGIDIIHFAA;GIDIIHFAAG;IDIIHFAAGL;DIIHFAAGLA;IIHFAAG LAG;IHFAAGLAGV;HFAAGLAGVG;FAAGLAGVGV;AAGLAGVGVI;AGLAGVGVIE;GLAG VGVIEA;LAGVGVIEAA;AGVGVIEAAK;GVGVIEAAKE;VGVIEAAKEL;GVIEAAKELG;V IEAAKELGD;IEAAKELGDG;EAAKELGDGY;AAKELGDGYY;AKELGDGYYV;KELGDGYYV I;ELGDGYYVIG;LGDGYYVIGA;GDGYYVIGAD;DGYYVIGADQ;GYYVIGADQD;YYVIGA DQDQ;YVIGADQDQS;VIGADQDQSH;IGADQDQSHL;GADQDQSHLA;ADQDQSHLAP;DQD QSHLAPK;QDQSHLAPKN;DQSHLAPKNF;QSHLAPKNFI;SHLAPKNFIT;HLAPKNFITS; LAPKNFITSV;APKNFITSVI;PKNFITSVIK;KNFITSVIKN;NFITSVIKNV;FITSVIKN VG;ITSVIKNVGD;TSVIKNVGDA;SVIKNVGDAL;VIKNVGDALY;IKNVGDALYL;KNVGD ALYLI;NVGDALYLIT;VGDALYLITS;GDALYLITSE;DALYLITSES;ALYLITSESL;LY LITSESLK;YLITSESLKN;LITSESLKND;ITSESLKNDN;TSESLKNDNV;SESLKNDNVW ;ESLKNDNVWE;SLKNDNVWEG;LKNDNVWEGG;KNDNVWEGGK;NDNVWEGGKI;DNVWEGG KIV;NVWEGGKIVQ;VWEGGKIVQM;WEGGKIVQMG;EGGKIVQMGL;GGKIVQMGLR;GKIV QMGLRD;KIVQMGLRDG;IVQMGLRDGV;VQMGLRDGVV;QMGLRDGVVG;MGLRDGVVGL;G LRDGVVGLS;LRDGVVGLSN;RDGVVGLSNA;DGVVGLSNAN;GVVGLSNANE;VVGLSNANE F;VGLSNANEFE;GLSNANEFEY;LSNANEFEYI;SNANEFEYIK;NANEFEYIKD;ANEFEY IKDL;NEFEYIKDLE;EFEYIKDLER;FEYIKDLERK;EYIKDLERKI;YIKDLERKII;IKD LERKIIN;KDLERKIINK;DLERKIINKE;LERKIINKEI;ERKIINKEII;RKIINKEIIV; KIINKEIIVP;IINKEIIVPC;INKEIIVPCN;NKEIIVPCNQ;KEIIVPCNQE;EIIVPCNQ EG;IIVPCNQEGY;IVPCNQEGYE;VPCNQEGYEI;PCNQEGYEIF;CNQEGYEIFI;NQEGY EIFIK;QEGYEIFIKQ;EGYEIFIKQI;GYEIFIKQIL;YEIFIKQILK;EIFIKQILKL;<br><br>11 mers:<br>MRIAIFIFGIL;RIAIFIFGILL;IAIFIFGILLT;AIFIFGILLTS;IFIFGILLTSC;FIF GILLTSCF;IFGILLTSCFS;FGILLTSCFSK;GILLTSCFSKN;ILLTSCFSKNG;LLTSCF SKNGI;LTSCFSKNGIE;TSCFSKNGIES;SCFSKNGIESG;CFSKNGIESGS;FSKNGIESG SS;SKNGIESGSSK;KNGIESGSSKI;NGIESGSSKIK;GIESGSSKIKI;IESGSSKIKIS; ESGSSKIKISM;SGSSKIKISML;GSSKIKISMLV;SSKIKISMLVD;SKIKISMLVDG;KIK ISMLVDGV;IKISMLVDGVL;KISMLVDGVLD;ISMLVDGVLDD;SMLVDGVLDDK;MLVDGV LDDKS;LVDGVLDDKSF;VDGVLDDKSFN;DGVLDDKSFNS;GVLDDKSFNSS;VLDDKSFNS SA;LDDKSFNSSAN;DDKSFNSSANE;DKSFNSSANEA;KSFNSSANEAL;SFNSSANEALL; FNSSANEALLR;NSSANEALLRL;SSANEALLRLK;SANEALLRLKK;ANEALLRLKKD;NEA LLRLKKDF;EALLRLKKDFP;ALLRLKKDFPE;LLRLKKDFPEN;LRLKKDFPENI;RLKKDF PENIE;LKKDFPENIEK;KKDFPENIEKV;KDFPENIEKVF;DFPENIEKVFS;FPENIEKVF SS;PENIEKVFSSA;ENIEKVFSSAV;NIEKVFSSAVS;IEKVFSSAVSG;EKVFSSAVSGV; KVFSSAVSGVY;VFSSAVSGVYS;FSSAVSGVYSS;SSAVSGVYSSY;SAVSGVYSSYV;AVS GVYSSYVS;VSGVYSSYVSD;SGVYSSYVSDL;GVYSSYVSDLD;VYSSYVSDLDN;YSSYVS DLDNL;SSYVSDLDNLK;SYVSDLDNLKM;YVSDLDNLKMN;VSDLDNLKMNG;SDLDNLKMN | |

Fig. 43 continued

GS; DLDNLKMNGSG; LDNLKMNGSGL; DNLKMNGSGLI; NLKMNGSGLIW; LKMNGSGLIWL; KMNGSGLIWLV; MNGSGLIWLVG; NGSGLIWLVGY; GSGLIWLVGYM; SGLIWLVGYML; GLI WLVGYMLA; LIWLVGYMLAD; IWLVGYMLADV; WLVGYMLADVS; LVGYMLADVSL; VGYMLA DVSLS; GYMLADVSLSV; YMLADVSLSVS; MLADVSLSVSL; LADVSLSVSLE; ADVSLSVSL EN; DVSLSVSLENP; VSLSVSLENPE; SLSVSLENPEI; LSVSLENPEIN; SVSLENPEINY; VSLENPEINYG; SLENPEINY

IKISMLVDGVLDD;KISMLVDGVLDDK;ISMLVDGVLDDKS;SMLVDGVLDDKSF;MLVDGVL
DDKSFN;LVDGVLDDKSFNS;VDGVLDDKSFNSS;DGVLDDKSFNSSA;GVLDDKSFNSSAN;
VLDDKSFNSSANE;LDDKSFNSSANEA;DDKSFNSSANEAL;DKSFNSSANEALL;KSFNSSA
NEALLR;SFNSSANEALLRL;FNSSANEALLRLK;NSSANEALLRLKK;SSANEALLRLKKD;
SANEALLRLKKDF;ANEALLRLKKDFP;NEALLRLKKDFPE;EALLRLKKDFPEN;ALLRLKK
DFPENI;LLRLKKDFPENIE;LRLKKDFPENIEK;RLKKDFPENIEKV;LKKDFPENIEKVF;
KKDFPENIEKVFS;KDFPENIEKVFSS;DFPENIEKVFSSA;FPENIEKVFSSAV;PENIEKV
FSSAVS;ENIEKVFSSAVSG;NIEKVFSSAVSGV;IEKVFSSAVSGVY;EKVFSSAVSGVYS;
KVFSSAVSGVYSS;VFSSAVSGVYSSY;FSSAVSGVYSSYV;SSAVSGVYSSYVS;SAVSGVY
SSYVSD;AVSGVYSSYVSDL;VSGVYSSYVSDLD;SGVYSSYVSDLDN;GVYSSYVSDLDNL;
VYSSYVSDLDNLK;YSSYVSDLDNLKM;SSYVSDLDNLKMN;SYVSDLDNLKMNG;YVSDLDN
LKMNGS;VSDLDNLKMNGSG;SDLDNLKMNGSGL;DLDNLKMNGSGLI;LDNLKMNGSGLIW;
DNLKMNGSGLIWL;NLKMNGSGLIWLV;LKMNGSGLIWLVG;KMNGSGLIWLVGY;MNGSGLI
WLVGYM;NGSGLIWLVGYML;GSGLIWLVGYMLA;SGLIWLVGYMLAD;GLIWLVGYMLADV;
LIWLVGYMLADVS;IWLVGYMLADVSL;WLVGYMLADVSLS;LVGYMLADVSLSV;VGYMLAD
VSLSVS;GYMLADVSLSVSL;YMLADVSLSVSLE;MLADVSLSVSLEN;LADVSLSVSLENP;
ADVSLSVSLENPE;DVSLSVSLENPEI;VSLSVSLENPEIN;SLSVSLENPEINY;LSVSLEN
PEINYG;SVSLENPEINYGI;VSLENPEINYGII;SLENPEINYGIID;LENPEINYGIIDP;
ENPEINYGIIDPI;NPEINYGIIDPIY;PEINYGIIDPIYG;EINYGIIDPIYGD;INYGIID
PIYGDD;NYGIIDPIYGDDV;YGIIDPIYGDDVQ;GIIDPIYGDDVQI;IIDPIYGDDVQIP;
IDPIYGDDVQIPK;DPIYGDDVQIPKN;PIYGDDVQIPKNL;IYGDDVQIPKNLI;YGDDVQI
PKNLIG;GDDVQIPKNLIGV;DDVQIPKNLIGVV;DVQIPKNLIGVVF;VQIPKNLIGVVFR;
QIPKNLIGVVFRI;IPKNLIGVVFRIE;PKNLIGVVFRIEQ;KNLIGVVFRIEQG;NLIGVVF
RIEQGA;LIGVVFRIEQGAF;IGVVFRIEQGAFL;GVVFRIEQGAFLA;VVFRIEQGAFLAG;
VFRIEQGAFLAGY;FRIEQGAFLAGYI;RIEQGAFLAGYIA;IEQGAFLAGYIAA;EQGAFLA
GYIAAK;QGAFLAGYIAAKK;GAFLAGYIAAKKS;AFLAGYIAAKKSV;FLAGYIAAKKSVS;
LAGYIAAKKSVSS;AGYIAAKKSVSSK;GYIAAKKSVSSKI;YIAAKKSVSSKIG;IAAKKSV
SSKIGF;AAKKSVSSKIGFI;AKKSVSSKIGFIG;KKSVSSKIGFIGG;KSVSSKIGFIGGV;
SVSSKIGFIGGVK;VSSKIGFIGGVKG;SSKIGFIGGVKGD;SKIGFIGGVKGDI;KIGFIGG
VKGDIV;IGFIGGVKGDIVD;GFIGGVKGDIVDA;FIGGVKGDIVDAF;IGGVKGDIVDAFR;
GGVKGDIVDAFRY;GVKGDIVDAFRYG;VKGDIVDAFRYGY;KGDIVDAFRYGYE;GDIVDAF
RYGYEA;DIVDAFRYGYEAG;IVDAFRYGYEAGA;VDAFRYGYEAGAK;DAFRYGYEAGAKY;
AFRYGYEAGAKYA;FRYGYEAGAKYAN;RYGYEAGAKYANK;YGYEAGAKYANKG;GYEAGAK
YANKGI;YEAGAKYANKGIE;EAGAKYANKGIEI;AGAKYANKGIEIV;GAKYANKGIEIVS;
AKYANKGIEIVSE;KYANKGIEIVSEY;YANKGIEIVSEYS;ANKGIEIVSEYSN;NKGIEIV
SEYSNS;KGIEIVSEYSNSF;GIEIVSEYSNSFS;IEIVSEYSNSFSD;EIVSEYSNSFSDI;
IVSEYSNSFSDID;VSEYSNSFSDIDI;SEYSNSFSDIDIA;EYSNSFSDIDIAR;YSNSFSD
IDIARV;SNSFSDIDIARVM;NSFSDIDIARVMA;SFSDIDIARVMAN;FSDIDIARVMANK;
SDIDIARVMANKM;DIDIARVMANKMY;IDIARVMANKMYS;DIARVMANKMYSK;IARVMAN
KMYSKG;ARVMANKMYSKGI;RVMANKMYSKGID;VMANKMYSKGIDI;MANKMYSKGIDII;
ANKMYSKGIDIIH;NKMYSKGIDIIHF;KMYSKGIDIIHFA;MYSKGIDIIHFAA;YSKGIDI
IHFAAG;SKGIDIIHFAAGL;KGIDIIHFAAGLA;GIDIIHFAAGLAG;IDIIHFAAGLAGV;
DIIHFAAGLAGVG;IIHFAAGLAGVGV;IHFAAGLAGVGVI;HFAAGLAGVGVIE;FAAGLAG
VGVIEA;AAGLAGVGVIEAA;AGLAGVGVIEAAK;GLAGVGVIEAAKE;LAGVGVIEAAKEL;
AGVGVIEAAKELG;GVGVIEAAKELGD;VGVIEAAKELGDG;GVIEAAKELGDGY;VIEAAKE
LGDGYY;IEAAKELGDGYYV;EAAKELGDGYYVI;AAKELGDGYYVIG;AKELGDGYYVIGA;
KELGDGYYVIGAD;ELGDGYYVIGADQ;LGDGYYVIGADQD;GDGYYVIGADQDQ;DGYYVIG
ADQDQS;GYYVIGADQDQSH;YYVIGADQDQSHL;YVIGADQDQSHLA;VIGADQDQSHLAP;
IGADQDQSHLAPK;GADQDQSHLAPKN;ADQDQSHLAPKNF;DQDQSHLAPKNFI;QDQSHLA
PKNFIT;DQSHLAPKNFITS;QSHLAPKNFITSV;SHLAPKNFITSVI;HLAPKNFITSVIK;
LAPKNFITSVIKN;APKNFITSVIKNV;PKNFITSVIKNVG;KNFITSVIKNVGD;NFITSVI
KNVGDA;FITSVIKNVGDAL;ITSVIKNVGDALY;TSVIKNVGDALYL;SVIKNVGDALYLI;
VIKNVGDALYLIT;IKNVGDALYLITS;KNVGDALYLITSE;NVGDALYLITSES;VGDALYL
ITSESL;GDALYLITSESLK;DALYLITSESLKN;ALYLITSESLKND;LYLITSESLKNDN;
YLITSESLKNDNV;LITSESLKNDNVW;ITSESLKNDNVWE;TSESLKNDNVWEG;SESLKND
NVWEGG;ESLKNDNVWEGGK;SLKNDNVWEGGKI;LKNDNVWEGGKIV;KNDNVWEGGKIVQ;
NDNVWEGGKIVQM;DNVWEGGKIVQMG;NVWEGGKIVQMGL;VWEGGKIVQMGLR;WEGGKIV

Fig. 43 continued

QMGLRD;EGGKIVQMGLRDG;GGKIVQMGLRDGV;GKIVQMGLRDGVV;KIVQMGLRDGVVG;
IVQMGLRDGVVGL;VQMGLRDGVVGLS;QMGLRDGVVGLSN;MGLRDGVVGLSNA;GLRDGVV
GLSNAN;LRDGVVGLSNANE;RDGVVGLSNANEF;DGVVGLSNANEFE;GVVGLSNANEFEY;
VVGLSNANEFEYI;VGLSNANEFEYIK;GLSNANEFEYIKD;LSNANEFEYIKDL;SNANEFE
YIKDLE;NANEFEYIKDLER;ANEFEYIKDLERK;NEFEYIKDLERKI;EFEYIKDLERKII;
FEYIKDLERKIIN;EYIKDLERKIINK;YIKDLERKIINKE;IKDLERKIINKEI;KDLERKI
INKEII;DLERKIINKEIIV;LERKIINKEIIVP;ERKIINKEIIVPC;RKIINKEIIVPCN;
KIINKEIIVPCNQ;IINKEIIVPCNQE;INKEIIVPCNQEG;NKEIIVPCNQEGY;KEIIVPC
NQEGYE;EIIVPCNQEGYEI;IIVPCNQEGYEIF;IVPCNQEGYEIFI;VPCNQEGYEIFIK;
PCNQEGYEIFIKQ;CNQEGYEIFIKQI;NQEGYEIFIKQIL;QEGYEIFIKQILK;EGYEIFI
KQILKL;

14 mers:
MRIAIFIFGILLTS;RIAIFIFGILLTSC;IAIFIFGILLTSCF;AIFIFGILLTSCFS;IFI
FGILLTSCFSK;FIFGILLTSCFSKN;IFGILLTSCFSKNG;FGILLTSCFSKNGI;GILLTS
CFSKNGIE;ILLTSCFSKNGIES;LLTSCFSKNGIESG;LTSCFSKNGIESGS;TSCFSKNGI
ESGSS;SCFSKNGIESGSSK;CFSKNGIESGSSKI;FSKNGIESGSSKIK;SKNGIESGSSKI
KI;KNGIESGSSKIKIS;NGIESGSSKIKISM;GIESGSSKIKISML;IESGSSKIKISMLV;
ESGSSKIKISMLVD;SGSSKIKISMLVDG;GSSKIKISMLVDGV;SSKIKISMLVDGVL;SKI
KISMLVDGVLD;KIKISMLVDGVLDD;IKISMLVDGVLDDK;KISMLVDGVLDDKS;ISMLVD
GVLDDKSF;SMLVDGVLDDKSFN;MLVDGVLDDKSFNS;LVDGVLDDKSFNSS;VDGVLDDKS
FNSSA;DGVLDDKSFNSSAN;GVLDDKSFNSSANE;VLDDKSFNSSANEA;LDDKSFNSSANE
AL;DDKSFNSSANEALL;DKSFNSSANEALLR;KSFNSSANEALLRL;SFNSSANEALLRLK;
FNSSANEALLRLKK;NSSANEALLRLKKD;SSANEALLRLKKDF;SANEALLRLKKDFP;ANE
ALLRLKKDFPE;NEALLRLKKDFPEN;EALLRLKKDFPENI;ALLRLKKDFPENIE;LLRLKK
DFPENIEK;LRLKKDFPENIEKV;RLKKDFPENIEKVF;LKKDFPENIEKVFS;KKDFPENIE
KVFSS;KDFPENIEKVFSSA;DFPENIEKVFSSAV;FPENIEKVFSSAVS;PENIEKVFSSAV
SG;ENIEKVFSSAVSGV;NIEKVFSSAVSGVY;IEKVFSSAVSGVYS;EKVFSSAVSGVYSS;
KVFSSAVSGVYSSY;VFSSAVSGVYSSYV;FSSAVSGVYSSYVS;SSAVSGVYSSYVSD;SAV
SGVYSSYVSDL;AVSGVYSSYVSDLD;VSGVYSSYVSDLDN;SGVYSSYVSDLDNL;GVYSSY
VSDLDNLK;VYSSYVSDLDNLKM;YSSYVSDLDNLKMN;SSYVSDLDNLKMNG;SYVSDLDNL
KMNGS;YVSDLDNLKMNGSG;VSDLDNLKMNGSGL;SDLDNLKMNGSGLI;DLDNLKMNGSGL
IW;LDNLKMNGSGLIWL;DNLKMNGSGLIWLV;NLKMNGSGLIWLVG;LKMNGSGLIWLVGY;
KMNGSGLIWLVGYM;MNGSGLIWLVGYML;NGSGLIWLVGYMLA;GSGLIWLVGYMLAD;SGL
IWLVGYMLADV;GLIWLVGYMLADVS;LIWLVGYMLADVSL;IWLVGYMLADVSLS;WLVGYM
LADVSLSV;LVGYMLADVSLSVS;VGYMLADVSLSVSL;GYMLADVSLSVSLE;YMLADVSLS
VSLEN;MLADVSLSVSLENP;LADVSLSVSLENPE;ADVSLSVSLENPEI;DVSLSVSLENPE
IN;VSLSVSLENPEINY;SLSVSLENPEINYG;LSVSLENPEINYGI;SVSLENPEINYGII;
VSLENPEINYGIID;SLENPEINYGIIDP;LENPEINYGIIDPI;ENPEINYGIIDPIY;NPE
INYGIIDPIYG;PEINYGIIDPIYGD;EINYGIIDPIYGDD;INYGIIDPIYGDDV;NYGIID
PIYGDDVQ;YGIIDPIYGDDVQI;GIIDPIYGDDVQIP;IIDPIYGDDVQIPK;IDPIYGDDV
QIPKN;DPIYGDDVQIPKNL;PIYGDDVQIPKNLI;IYGDDVQIPKNLIG;YGDDVQIPKNLI
GV;GDDVQIPKNLIGVV;DDVQIPKNLIGVVF;DVQIPKNLIGVVFR;VQIPKNLIGVVFRI;
QIPKNLIGVVFRIE;IPKNLIGVVFRIEQ;PKNLIGVVFRIEQG;KNLIGVVFRIEQGA;NLI
GVVFRIEQGAF;LIGVVFRIEQGAFL;IGVVFRIEQGAFLA;GVVFRIEQGAFLAG;VVFRIE
QGAFLAGY;VFRIEQGAFLAGYI;FRIEQGAFLAGYIA;RIEQGAFLAGYIAA;IEQGAFLAG
YIAAK;EQGAFLAGYIAAKK;QGAFLAGYIAAKKS;GAFLAGYIAAKKSV;AFLAGYIAAKKS
VS;FLAGYIAAKKSVSS;LAGYIAAKKSVSSK;AGYIAAKKSVSSKI;GYIAAKKSVSSKIG;
YIAAKKSVSSKIGF;IAAKKSVSSKIGFI;AAKKSVSSKIGFIG;AKKSVSSKIGFIGG;KKS
VSSKIGFIGGV;KSVSSKIGFIGGVK;SVSSKIGFIGGVKG;VSSKIGFIGGVKGD;SSKIGF
IGGVKGDI;SKIGFIGGVKGDIV;KIGFIGGVKGDIVD;IGFIGGVKGDIVDA;GFIGGVKGD
IVDAF;FIGGVKGDIVDAFR;IGGVKGDIVDAFRY;GGVKGDIVDAFRYG;GVKGDIVDAFRY
GY;VKGDIVDAFRYGYE;KGDIVDAFRYGYEA;GDIVDAFRYGYEAG;DIVDAFRYGYEAGA;
IVDAFRYGYEAGAK;VDAFRYGYEAGAKY;DAFRYGYEAGAKYA;AFRYGYEAGAKYAN;FRY
GYEAGAKYANK;RYGYEAGAKYANKG;YGYEAGAKYANKGI;GYEAGAKYANKGIE;YEAGAK
YANKGIEI;EAGAKYANKGIEIV;AGAKYANKGIEIVS;GAKYANKGIEIVSE;AKYANKGIE
IVSEY;KYANKGIEIVSEYS;YANKGIEIVSEYSN;ANKGIEIVSEYSNS;NKGIEIVSEYSN

Fig. 43 continued

SF;KGIEIVSEYSNSFS;GIEIVSEYSNSFSD;IEIVSEYSNSFSDI;EIVSEYSNSFSDID;
IVSEYSNSFSDIDI;VSEYSNSFSDIDIA;SEYSNSFSDIDIAR;EYSNSFSDIDIARV;YSN
SFSDIDIARVM;SNSFSDIDIARVMA;NSFSDIDIARVMAN;SFSDIDIARVMANK;FSDIDI
ARVMANKM;SDIDIARVMANKMY;DIDIARVMANKMYS;IDIARVMANKMYSK

| | |
|---|---|
| LIW;DLDNLKMNGSGLIWL;LDNLKMNGSGLIWLV;DNLKMNGSGLIWLVG;NLKMNGSGLIW LVGY;LKMNGSGLIWLVGYM;KMNGSGLIWLVGYML;MNGSGLIWLVGYMLA;NGSGLIWLVG YMLAD;GSGLIWLVGYMLADV;SGLIWLVGYMLADVS;GLIWLVGYMLADVSL;LIWLVGYML ADVSLS;IWLVGYMLADVSLSV;WLVGYMLADVSLSVS;LVGYMLADVSLSVSL;VGYMLADV SLSVSLE;GYMLADVSLSVSLEN;YMLADVSLSVSLENP;MLADVSLSVSLENPE;LADVSLS VSLENPEI;ADVSLSVSLENPEIN;DVSLSVSLENPEINY;VSLSVSLENPEINYG;SLSVSL ENPEINYGI;LSVSLENPEINYGII;SVSLENPEINYGIID;VSLENPEINYGIIDP;SLENP EINYGIIDPI;LENPEINYGIIDPIY;ENPEINYGIIDPIYG;NPEINYGIIDPIYGD;PEIN YGIIDPIYGDD;EINYGIIDPIYGDDV;INYGIIDPIYGDDVQ;NYGIIDPIYGDDVQI;YGI IDPIYGDDVQIP;GIIDPIYGDDVQIPK;IIDPIYGDDVQIPKN;IDPIYGDDVQIPKNL;DP IYGDDVQIPKNLI;PIYGDDVQIPKNLIG;IYGDDVQIPKNLIGV;YGDDVQIPKNLIGVV;G DDVQIPKNLIGVVF;DDVQIPKNLIGVVFR;DVQIPKNLIGVVFRI;VQIPKNLIGVVFRIE; QIPKNLIGVVFRIEQ;IPKNLIGVVFRIEQG;PKNLIGVVFRIEQGA;KNLIGVVFRIEQGAF ;NLIGVVFRIEQGAFL;LIGVVFRIEQGAFLA;IGVVFRIEQGAFLAG;GVVFRIEQGAFLAG Y;VVFRIEQGAFLAGYI;VFRIEQGAFLAGYIA;FRIEQGAFLAGYIAA;RIEQGAFLAGYIA AK;IEQGAFLAGYIAAKK;EQGAFLAGYIAAKKS;QGAFLAGYIAAKKSV;GAFLAGYIAAKK SVS;AFLAGYIAAKKSVSS;FLAGYIAAKKSVSSK;LAGYIAAKKSVSSKI;AGYIAAKKSVS SKIG;GYIAAKKSVSSKIGF;YIAAKKSVSSKIGFI;IAAKKSVSSKIGFIG;AAKKSVSSKI GFIGG;AKKSVSSKIGFIGGV;KKSVSSKIGFIGGVK;KSVSSKIGFIGGVKG;SVSSKIGFI GGVKGD;VSSKIGFIGGVKGDI;SSKIGFIGGVKGDIV;SKIGFIGGVKGDIVD;KIGFIGGV KGDIVDA;IGFIGGVKGDIVDAF;GFIGGVKGDIVDAFR;FIGGVKGDIVDAFRY;IGGVKGD IVDAFRYG;GGVKGDIVDAFRYGY;GVKGDIVDAFRYGYE;VKGDIVDAFRYGYEA;KGDIVD AFRYGYEAG;GDIVDAFRYGYEAGA;DIVDAFRYGYEAGAK;IVDAFRYGYEAGAKY;VDAFR YGYEAGAKYA;DAFRYGYEAGAKYAN;AFRYGYEAGAKYANK;FRYGYEAGAKYANKG;RYGY EAGAKYANKGI;YGYEAGAKYANKGIE;GYEAGAKYANKGIEI;YEAGAKYANKGIEIV;EAG AKYANKGIEIVS;AGAKYANKGIEIVSE;GAKYANKGIEIVSEY;AKYANKGIEIVSEYS;KY ANKGIEIVSEYSN;YANKGIEIVSEYSNS;ANKGIEIVSEYSNSF;NKGIEIVSEYSNSFS;K GIEIVSEYSNSFSD;GIEIVSEYSNSFSDI;IEIVSEYSNSFSDID;EIVSEYSNSFSDIDI; IVSEYSNSFSDIDIA;VSEYSNSFSDIDIAR;SEYSNSFSDIDIARV;EYSNSFSDIDIARVM ;YSNSFSDIDIARVMA;SNSFSDIDIARVMAN;NSFSDIDIARVMANK;SFSDIDIARVMANK M;FSDIDIARVMANKMY;SDIDIARVMANKMYS;DIDIARVMANKMYSK;IDIARVMANKMYS KG;DIARVMANKMYSKGI;IARVMANKMYSKGID;ARVMANKMYSKGIDI;RVMANKMYSKGI DII;VMANKMYSKGIDIIH;MANKMYSKGIDIIHF;ANKMYSKGIDIIHFA;NKMYSKGIDII HFAA;KMYSKGIDIIHFAAG;MYSKGIDIIHFAAGL;YSKGIDIIHFAAGLA;SKGIDIIHFA AGLAG;KGIDIIHFAAGLAGV;GIDIIHFAAGLAGVG;IDIIHFAAGLAGVGV;DIIHFAAGL AGVGVI;IIHFAAGLAGVGVIE;IHFAAGLAGVGVIEA;HFAAGLAGVGVIEAA;FAAGLAGV GVIEAAK;AAGLAGVGVIEAAKE;AGLAGVGVIEAAKEL;GLAGVGVIEAAKELG;LAGVGVI EAAKELGD;AGVGVIEAAKELGDG;GVGVIEAAKELGDGY;VGVIEAAKELGDGYY;GVIEAA KELGDGYYV;VIEAAKELGDGYYVI;IEAAKELGDGYYVIG;EAAKELGDGYYVIGA;AAKEL GDGYYVIGAD;AKELGDGYYVIGADQ;KELGDGYYVIGADQD;ELGDGYYVIGADQDQ;LGDG YYVIGADQDQS;GDGYYVIGADQDQSH;DGYYVIGADQDQSHL;GYYVIGADQDQSHLA;YYV IGADQDQSHLAP;YVIGADQDQSHLAPK;VIGADQDQSHLAPKN;IGADQDQSHLAPKNF;GA DQDQSHLAPKNFI;ADQDQSHLAPKNFIT;DQDQSHLAPKNFITS;QDQSHLAPKNFITSV;D QSHLAPKNFITSVI;QSHLAPKNFITSVIK;SHLAPKNFITSVIKN;HLAPKNFITSVIKNV; LAPKNFITSVIKNVG;APKNFITSVIKNVGD;PKNFITSVIKNVGDA;KNFITSVIKNVGDAL ;NFITSVIKNVGDALY;FITSVIKNVGDALYL;ITSVIKNVGDALYLI;TSVIKNVGDALYLI T;SVIKNVGDALYLITS;VIKNVGDALYLITSE;IKNVGDALYLITSES;KNVGDALYLITSE SL;NVGDALYLITSESLK;VGDALYLITSESLKN;GDALYLITSESLKND;DALYLITSESLK NDN;ALYLITSESLKNDNV;LYLITSESLKNDNVW;YLITSESLKNDNVWE;LITSESLKNDN VWEG;ITSESLKNDNVWEGG;TSESLKNDNVWEGGK;SESLKNDNVWEGGKI;ESLKNDNVWE GGKIV;SLKNDNVWEGGKIVQ;LKNDNVWEGGKIVQM;KNDNVWEGGKIVQMG;NDNVWEGGK IVQMGL;DNVWEGGKIVQMGLR;NVWEGGKIVQMGLRD;VWEGGKIVQMGLRDG;WEGGKIVQ MGLRDGV;EGGKIVQMGLRDGVV;GGKIVQMGLRDGVVG;GKIVQMGLRDGVVGL;KIVQMGL RDGVVGLS;IVQMGLRDGVVGLSN;VQMGLRDGVVGLSNA;QMGLRDGVVGLSNAN;MGLRDG VVGLSNANE;GLRDGVVGLSNANEF;LRDGVVGLSNANEFE;RDGVVGLSNANEFEY;DGVVG LSNANEFEYI;GVVGLSNANEFEYIK;VVGLSNANEFEYIKD;VGLSNANEFEYIKDL;GLSN ANEFEYIKDLE;LSNANEFEYIKDLER;SNANEFEYIKDLERK;NANEFEYIKDLERKI;ANE | |

Fig. 43 continued

FEYIKDLERKII;NEFEYIKDLERKIIN;EFEYIKDLERKIINK;FEYIKDLERKIINKE;EY
IKDLERKIINKEI;YIKDLERKIINKEII;IKDLERKIINKEIIV;KDLERKIINKEIIVP;D
LERKIINKEIIVPC;LERKIINKEIIVPCN;ERKIINKEIIVPCNQ;RKIINKEIIVPCNQE;
KIINKEIIVPCNQEG;IINKEIIVPCNQEGY;INKEIIVPCNQEGYE;NKEIIVPCNQEGYEI
;KEIIVPCNQEGYEIF;EIIVPCNQEGYEIFI;IIVPCNQEGYEIFIK;IVPCNQEGYEIFIK
Q;VPCNQEGYEIFIKQI;PCNQEGYEIFIKQIL;CNQEGYEIFIKQILK;NQEGYEIFIKQIL
KL;

16 mers:
MRIAIFIFGILLTSCF;RIAIFIFGILLTSCFS;IAIFIFGILLTSCFSK;AIFIFGILLTSC
FSKN;IFIFGILLTSCFSKNG;FIFGILLTSCFSKNGI;IFGILLTSCFSKNGIE;FGILLTS
CFSKNGIES;GILLTSCFSKNGIESG;ILLTSCFSKNGIESGS;LLTSCFSKNGIESGSS;LT
SCFSKNGIESGSSK;TSCFSKNGIESGSSKI;SCFSKNGIESGSSKIK;CFSKNGIESGSSKI
KI;FSKNGIESGSSKIKIS;SKNGIESGSSKIKISM;KNGIESGSSKIKISML;NGIESGSSK
IKISMLV;GIESGSSKIKISMLVD;IESGSSKIKISMLVDG;ESGSSKIKISMLVDGV;SGSS
KIKISMLVDGVL;GSSKIKISMLVDGVLD;SSKIKISMLVDGVLDD;SKIKISMLVDGVLDDK
;KIKISMLVDGVLDDKS;IKISMLVDGVLDDKSF;KISMLVDGVLDDKSFN;ISMLVDGVLDD
KSFNS;SMLVDGVLDDKSFNSS;MLVDGVLDDKSFNSSA;LVDGVLDDKSFNSSAN;VDGVLD
DKSFNSSANE;DGVLDDKSFNSSANEA;GVLDDKSFNSSANEAL;VLDDKSFNSSANEALL;L
DDKSFNSSANEALLR;DDKSFNSSANEALLRL;DKSFNSSANEALLRLK;KSFNSSANEALLR
LKK;SFNSSANEALLRLKKD;FNSSANEALLRLKKDF;NSSANEALLRLKKDFP;SSANEALL
RLKKDFPE;SANEALLRLKKDFPEN;ANEALLRLKKDFPENI;NEALLRLKKDFPENIE;EAL
LRLKKDFPENIEK;ALLRLKKDFPENIEKV;LLRLKKDFPENIEKVF;LRLKKDFPENIEKVF
S;RLKKDFPENIEKVFSS;LKKDFPENIEKVFSSA;KKDFPENIEKVFSSAV;KDFPENIEKV
FSSAVS;DFPENIEKVFSSAVSG;FPENIEKVFSSAVSGV;PENIEKVFSSAVSGVY;ENIEK
VFSSAVSGVYS;NIEKVFSSAVSGVYSS;IEKVFSSAVSGVYSSY;EKVFSSAVSGVYSSYV;
KVFSSAVSGVYSSYVS;VFSSAVSGVYSSYVSD;FSSAVSGVYSSYVSDL;SSAVSGVYSSYV
SDLD;SAVSGVYSSYVSDLDN;AVSGVYSSYVSDLDNL;VSGVYSSYVSDLDNLK;SGVYSSY
VSDLDNLKM;GVYSSYVSDLDNLKMN;VYSSYVSDLDNLKMNG;YSSYVSDLDNLKMNGS;SS
YVSDLDNLKMNGSG;SYVSDLDNLKMNGSGL;YVSDLDNLKMNGSGLI;VSDLDNLKMNGSGL
IW;SDLDNLKMNGSGLIWL;DLDNLKMNGSGLIWLV;LDNLKMNGSGLIWLVG;DNLKMNGSG
LIWLVGY;NLKMNGSGLIWLVGYM;LKMNGSGLIWLVGYML;KMNGSGLIWLVGYMLA;MNGS
GLIWLVGYMLAD;NGSGLIWLVGYMLADV;GSGLIWLVGYMLADVS;SGLIWLVGYMLADVSL
;GLIWLVGYMLADVSLS;LIWLVGYMLADVSLSV;IWLVGYMLADVSLSVS;WLVGYMLADVS
LSVSL;LVGYMLADVSLSVSLE;VGYMLADVSLSVSLEN;GYMLADVSLSVSLENP;YMLADV
SLSVSLENPE;MLADVSLSVSLENPEI;LADVSLSVSLENPEIN;ADVSLSVSLENPEINY;D
VSLSVSLENPEINYG;VSLSVSLENPEINYGI;SLSVSLENPEINYGII;LSVSLENPEINYG
IID;SVSLENPEINYGIIDP;VSLENPEINYGIIDPI;SLENPEINYGIIDPIY;LENPEINY
GIIDPIYG;ENPEINYGIIDPIYGD;NPEINYGIIDPIYGDD;PEINYGIIDPIYGDDV;EIN
YGIIDPIYGDDVQ;INYGIIDPIYGDDVQI;NYGIIDPIYGDDVQIP;YGIIDPIYGDDVQIP
K;GIIDPIYGDDVQIPKN;IIDPIYGDDVQIPKNL;IDPIYGDDVQIPKNLI;DPIYGDDVQI
PKNLIG;PIYGDDVQIPKNLIGV;IYGDDVQIPKNLIGVV;YGDDVQIPKNLIGVVF;GDDVQ
IPKNLIGVVFR;DDVQIPKNLIGVVFRI;DVQIPKNLIGVVFRIE;VQIPKNLIGVVFRIEQ;
QIPKNLIGVVFRIEQG;IPKNLIGVVFRIEQGA;PKNLIGVVFRIEQGAF;KNLIGVVFRIEQ
GAFL;NLIGVVFRIEQGAFLA;LIGVVFRIEQGAFLAG;IGVVFRIEQGAFLAGY;GVVFRIE
QGAFLAGYI;VVFRIEQGAFLAGYIA;VFRIEQGAFLAGYIAA;FRIEQGAFLAGYIAAK;RI
EQGAFLAGYIAAKK;IEQGAFLAGYIAAKKS;EQGAFLAGYIAAKKSV;QGAFLAGYIAAKKS
VS;GAFLAGYIAAKKSVSS;AFLAGYIAAKKSVSSK;FLAGYIAAKKSVSSKI;LAGYIAAKK
SVSSKIG;AGYIAAKKSVSSKIGF;GYIAAKKSVSSKIGFI;YIAAKKSVSSKIGFIG;IAAK
KSVSSKIGFIGG;AAKKSVSSKIGFIGGV;AKKSVSSKIGFIGGVK;KKSVSSKIGFIGGVKG
;KSVSSKIGFIGGVKGD;SVSSKIGFIGGVKGDI;VSSKIGFIGGVKGDIV;SSKIGFIGGVK
GDIVD;SKIGFIGGVKGDIVDA;KIGFIGGVKGDIVDAF;IGFIGGVKGDIVDAFR;GFIGGV
KGDIVDAFRY;FIGGVKGDIVDAFRYG;IGGVKGDIVDAFRYGY;GGVKGDIVDAFRYGYE;G
VKGDIVDAFRYGYEA;VKGDIVDAFRYGYEAG;KGDIVDAFRYGYEAGA;GDIVDAFRYGYEA
GAK;DIVDAFRYGYEAGAKY;IVDAFRYGYEAGAKYA;VDAFRYGYEAGAKYAN;DAFRYGYE
AGAKYANK;AFRYGYEAGAKYANKG;FRYGYEAGAKYANKGI;RYGYEAGAKYANKGIE;YGY
EAGAKYANKGIEI;GYEAGAKYANKGIEIV;YEAGAKYANKGIEIVS;EAGAKYANKGIEIVS

Fig. 43 continued

| | |
|---|---|
| E;AGAKYANKGIEIVSEY;GAKYANKGIEIVSEYS;AKYANKGIEIVSEYSN;KYANKGIEIV SEYSNS;YANKGIEIVSEYSNSF;ANKGIEIVSEYSNSFS;NKGIEIVSEYSNSFSD;KGIEI VSEYSNSFSDI;GIEIVSEYSNSFSDID;IEIVSEYSNSFSDIDI;EIVSEYSNSFSDIDIA; IVSEYSNSFSDIDIAR;VSEYSNSFSDIDIARV;SEYSNSFSDIDIARVM;EYSNSFSDIDIA RVMA;YSNSFSDIDIARVMAN;SNSFSDIDIARVMANK;NSFSDIDIARVMANKM;SFSDIDI ARVMANKMY;FSDIDIARVMANKMYS;SDIDIARVMANKMYSK;DIDIARVMANKMYSKG;ID IARVMANKMYSKGI;DIARVMANKMYSKGID;IARVMANKMYSKGIDI;ARVMANKMYSKGID II;RVMANKMYSKGIDIIH;VMANKMYSKGIDIIHF;MANKMYSKGIDIIHFA;ANKMYSKGI DIIHFAA;NKMYSKGIDIIHFAAG;KMYSKGIDIIHFAAGL;MYSKGIDIIHFAAGLA;YSKG IDIIHFAAGLAG;SKGIDIIHFAAGLAGV;KGIDIIHFAAGLAGVG;GIDIIHFAAGLAGVGV ;IDIIHFAAGLAGVGVI;DIIHFAAGLAGVGVIE;IIHFAAGLAGVGVIEA;IHFAAGLAGVG VIEAA;HFAAGLAGVGVIEAAK;FAAGLAGVGVIEAAKE;AAGLAGVGVIEAAKEL;AGLAGV GVIEAAKELG;GLAGVGVIEAAKELGD;LAGVGVIEAAKELGDG;AGVGVIEAAKELGDGY;G VGVIEAAKELGDGYY;VGVIEAAKELGDGYYV;GVIEAAKELGDGYYVI;VIEAAKELGDGYY VIG;IEAAKELGDGYYVIGA;EAAKELGDGYYVIGAD;AAKELGDGYYVIGADQ;AKELGDGY YVIGADQD;KELGDGYYVIGADQDQ;ELGDGYYVIGADQDQS;LGDGYYVIGADQDQSH;GDG YYVIGADQDQSHL;DGYYVIGADQDQSHLA;GYYVIGADQDQSHLAP;YYVIGADQDQSHLAP K;YVIGADQDQSHLAPKN;VIGADQDQSHLAPKNF;IGADQDQSHLAPKNFI;GADQDQSHLA PKNFIT;ADQDQSHLAPKNFITS;DQDQSHLAPKNFITSV;QDQSHLAPKNFITSVI;DQSHL APKNFITSVIK;QSHLAPKNFITSVIKN;SHLAPKNFITSVIKNV;HLAPKNFITSVIKNVG; LAPKNFITSVIKNVGD;APKNFITSVIKNVGDA;PKNFITSVIKNVGDAL;KNFITSVIKNVG DALY;NFITSVIKNVGDALYL;FITSVIKNVGDALYLI;ITSVIKNVGDALYLIT;TSVIKNV GDALYLITS;SVIKNVGDALYLITSE;VIKNVGDALYLITSES;IKNVGDALYLITSESL;KN VGDALYLITSESLK;NVGDALYLITSESLKN;VGDALYLITSESLKND;GDALYLITSESLKN DN;DALYLITSESLKNDNV;ALYLITSESLKNDNVW;LYLITSESLKNDNVWE;YLITSESLK NDNVWEG;LITSESLKNDNVWEGG;ITSESLKNDNVWEGGK;TSESLKNDNVWEGGKI;SESL KNDNVWEGGKIV;ESLKNDNVWEGGKIVQ;SLKNDNVWEGGKIVQM;LKNDNVWEGGKIVQMG ;KNDNVWEGGKIVQMGL;NDNVWEGGKIVQMGLR;DNVWEGGKIVQMGLRD;NVWEGGKIVQM GLRDG;VWEGGKIVQMGLRDGV;WEGGKIVQMGLRDGVV;EGGKIVQMGLRDGVVG;GGKIVQ MGLRDGVVGL;GKIVQMGLRDGVVGLS;KIVQMGLRDGVVGLSN;IVQMGLRDGVVGLSNA;V QMGLRDGVVGLSNAN;QMGLRDGVVGLSNANE;MGLRDGVVGLSNANEF;GLRDGVVGLSNAN EFE;LRDGVVGLSNANEFEY;RDGVVGLSNANEFEYI;DGVVGLSNANEFEYIK;GVVGLSNA NEFEYIKD;VVGLSNANEFEYIKDL;VGLSNANEFEYIKDLE;GLSNANEFEYIKDLER;LSN ANEFEYIKDLERK;SNANEFEYIKDLERKI;NANEFEYIKDLERKII;ANEFEYIKDLERKII N;NEFEYIKDLERKIINK;EFEYIKDLERKIINKE;FEYIKDLERKIINKEI;EYIKDLERKI INKEII;YIKDLERKIINKEIIV;IKDLERKIINKEIIVP;KDLERKIINKEIIVPC;DLERK IINKEIIVPCN;LERKIINKEIIVPCNQ;ERKIINKEIIVPCNQE;RKIINKEIIVPCNQEG; KIINKEIIVPCNQEGY;IINKEIIVPCNQEGYE;INKEIIVPCNQEGYEI;NKEIIVPCNQEG YEIF;KEIIVPCNQEGYEIFI;EIIVPCNQEGYEIFIK;IIVPCNQEGYEIFIKQ;IVPCNQE GYEIFIKQI;VPCNQEGYEIFIKQIL;PCNQEGYEIFIKQILK;CNQEGYEIFIKQILKL | |
| <YP_072830.1 basic membrane protein D;Borrelia garinii PBi MLNKVYCFIVFLFIIACSGSDDVKLESKTVSLIVDGAFDDKGFNESSSKAIRKLKTDFNINII EKASTGNSHLGDIATLEDGNSNLIWGIGFRLSDVLLQPRASENISINYAIMEGVYNEIQMPKNL LNISFRSEEVAFLAGYFASKTSKTGKIGFIGGVKGKVLESFMYGYEAGAKYANSTIKVISQYV GTFGDFGLGRSTASNMYRDGVDIVFAAAGLSGIGVIEAAKELGPDHYIIGVDQDQSYLAPNNV LVSAVKKVDSLMYSLTKKYLETGIWDGGKNIFFGLKEDGLGLVLNENLKSNYSEIYNKSLEIG QSIMEGIIKVPYDKASYDNFVLQIAN<br><br>8 mers:<br>MLNKVYCF;LNKVYCFI;NKVYCFIV;KVYCFIVF;VYCFIVFL;YCFIVFLF;CFIVFLFI; FIVFLFII;IVFLFIIA;VFLFIIAC;FLFIIACS;LFIIACSG;FIIACSGS;IIACSGSD; IACSGSDD;ACSGSDDV;CSGSDDVK;SGSDDVKL;GSDDVKLE;SDDVKLES;DDVKLESK; DVKLESKT;VKLESKTV;KLESKTVS;LESKTVSL;ESKTVSLI;SKTVSLIV;KTVSLIVD; TVSLIVDG;VSLIVDGA;SLIVDGAF;LIVDGAFD;IVDGAFDD;VDGAFDDK;DGAFDDKG; GAFDDKGF;AFDDKGFN;FDDKGFNE;DDKGFNES;DKGFNESS;KGFNESSS;GFNESSSK; FNESSSKA;NESSSKAI;ESSSKAIR;SSSKAIRK;SSKAIRKL;SKAIRKLK;KAIRKLKT; | 187285-189925 |

Fig. 43 continued

| | |
|---|---|
| AIRKLKTD;IRKLKTDF;RKLKTDFN;KLKTDFNI;LKTDFNIN;KTDFNINI;TDFNINII;DFNINIIE;FNINIIEK;NINIIEKA;INIIEKAS;NIIEKAST;IIEKASTG;IEKASTGN;EKASTGNS;KASTGNSH;ASTGNSHL;STGNSHLG;TGNSHLGD;GNSHLGDI;NSHLGDIA;SHLGDIAT;HLGDIATL;LGDIATLE;GDIATLED;DIATLEDG;IATLEDGN;ATLEDGNS;TLEDGNSN;LEDGNSNL;EDGNSNLI;DGNSNLIW;GNSNLIWG;NSNLIWGI;SNLIWGIG;NLIWGIGF;LIWGIGFR;IWGIGFRL;WGIGFRLS;GIGFRLSD;IGFRLSDV;GFRLSDVL;FRLSDVLL;RLSDVLLQ;LSDVLLQR;SDVLLQRA;DVLLQRAS;VLLQRASE;LLQRASEN;LQRASENI;QRASENIS;RASENISI;ASENISIN;SENISINY;ENISINYA;NISINYAI;ISINYAIM;SINYAIME;INYAIMEG;NYAIMEGV;YAIMEGVY;AIMEGVYN;IMEGVYNE;MEGVYNEI;EGVYNEIQ;GVYNEIQM;VYNEIQMP;YNEIQMPK;NEIQMPKN;EIQMPKNL;IQMPKNLL;QMPKNLLN;MPKNLLNI;PKNLLNIS;KNLLNISF;NLLNISFR;LLNISFRS;LNISFRSE;NISFRSEE;ISFRSEEV;SFRSEEVA;FRSEEVAF;RSEEVAFL;SEEVAFLA;EEVAFLAG;EVAFLAGY;VAFLAGYF;AFLAGYFA;FLAGYFAS;LAGYFASK;AGYFASKT;GYFASKTS;YFASKTSK;FASKTSKT;ASKTSKTG;SKTSKTGK;KTSKTGKI;TSKTGKIG;SKTGKIGF;KTGKIGFI;TGKIGFIG;GKIGFIGG;KIGFIGGV;IGFIGGVK;GFIGGVKG;FIGGVKGK;IGGVKGKV;GGVKGKVL;GVKGKVLE;VKGKVLES;KGKVLESF;GKVLESFM;KVLESFMY;VLESFMYG;LESFMYGY;ESFMYGYE;SFMYGYEA;FMYGYEAG;MYGYEAGA;YGYEAGAK;GYEAGAKY;YEAGAKYA;EAGAKYAN;AGAKYANS;GAKYANST;AKYANSTI;KYANSTIK;YANSTIKV;ANSTIKVI;NSTIKVIS;STIKVISQ;TIKVISQY;IKVISQYV;KVISQYVG;VISQYVGT;ISQYVGTF;SQYVGTFG;QYVGTFGD;YVGTFGDF;VGTFGDFG;GTFGDFGL;TFGDFGLG;FGDFGLGR;GDFGLGRS;DFGLGRST;FGLGRSTA;GLGRSTAS;LGRSTASN;GRSTASNM;RSTASNMY;STASNMYR;TASNMYRD;ASNMYRDG;SNMYRDGV;NMYRDGVD;MYRDGVDI;YRDGVDIV;RDGVDIVF;DGVDIVFA;GVDIVFAA;VDIVFAAA;DIVFAAAG;IVFAAAGL;VFAAAGLS;FAAAGLSG;AAAGLSGI;AAGLSGIG;AGLSGIGV;GLSGIGVI;LSGIGVIE;SGIGVIEA;GIGVIEAA;IGVIEAAK;GVIEAAKE;VIEAAKEL;IEAAKELG;EAAKELGP;AAKELGPD;AKELGPDH;KELGPDHY;ELGPDHYI;LGPDHYII;GPDHYIIG;PDHYIIGV;DHYIIGVD;HYIIGVDQ;YIIGVDQD;IIGVDQDQ;IGVDQDQS;GVDQDQSY;VDQDQSYL;DQDQSYLA;QDQSYLAP;DQSYLAPN;QSYLAPNN;SYLAPNNV;YLAPNNVL;LAPNNVLV;APNNVLVS;PNNVLVSA;NNVLVSAV;NVLVSAVK;VLVSAVKK;LVSAVKKV;VSAVKKVD;SAVKKVDS;AVKKVDSL;VKKVDSLM;KKVDSLMY;KVDSLMYS;VDSLMYSL;DSLMYSLT;SLMYSLTK;LMYSLTKK;MYSLTKKY;YSLTKKYL;SLTKKYLE;LTKKYLET;TKKYLETG;KKYLETGI;KYLETGIW;YLETGIWD;LETGIWDG;ETGIWDGG;TGIWDGGK;GIWDGGKN;IWDGGKNI;WDGGKNIF;DGGKNIFF;GGKNIFFG;GKNIFFGL;KNIFFGLK;NIFFGLKE;IFFGLKED;FFGLKEDG;FGLKEDGL;GLKEDGLG;LKEDGLGL;KEDGLGLV;EDGLGLVL;DGLGLVLN;GLGLVLNE;LGLVLNEN;GLVLNENL;LVLNENLK;VLNENLKS;LNENLKSN;NENLKSNY;ENLKSNYS;NLKSNYSE;LKSNYSEI;KSNYSEIY;SNYSEIYN;NYSEIYNK;YSEIYNKS;SEIYNKSL;EIYNKSLE;IYNKSLEI;YNKSLEIG;NKSLEIGQ;KSLEIGQS;SLEIGQSI;LEIGQSIM;EIGQSIME;IGQSIMEG;GQSIMEGI;QSIMEGII;SIMEGIIK;IMEGIIKV;MEGIIKVP;EGIIKVPY;GIIKVPYD;IIKVPYDK;IKVPYDKA;KVPYDKAS;VPYDKASY;PYDKASYD;YDKASYDN;DKASYDNF;KASYDNFV;ASYDNFVL;SYDNFVLQ;YDNFVLQI;DNFVLQIA;NFVLQIAN;<br><br>9 mers:<br>MLNKVYCFI;LNKVYCFIV;NKVYCFIVF;KVYCFIVFL;VYCFIVFLF;YCFIVFLFI;CFIVFLFII;FIVFLFIIA;IVFLFIIAC;VFLFIIACS;FLFIIACSG;LFIIACSGS;FIIACSGSD;IIACSGSDD;IACSGSDDV;ACSGSDDVK;CSGSDDVKL;SGSDDVKLE;GSDDVKLES;SDDVKLESK;DDVKLESKT;DVKLESKTV;VKLESKTVS;KLESKTVSL;LESKTVSLI;ESKTVSLIV;SKTVSLIVD;KTVSLIVDG;TVSLIVDGA;VSLIVDGAF;SLIVDGAFD;LIVDGAFDD;IVDGAFDDK;VDGAFDDKG;DGAFDDKGF;GAFDDKGFN;AFDDKGFNE;FDDKGFNES;DDKGFNESS;DKGFNESSS;KGFNESSSK;GFNESSSKA;FNESSSKAI;NESSSKAIR;ESSSKAIRK;SSSKAIRKL;SSKAIRKLK;SKAIRKLKT;KAIRKLKTD;AIRKLKTDF;IRKLKTDFN;RKLKTDFNI;KLKTDFNIN;LKTDFNINI;KTDFNINII;TDFNINIIE;DFNINIIEK;FNINIIEKA;NINIIEKAS;INIIEKAST;NIIEKASTG;IIEKASTGN;IEKASTGNS;EKASTGNSH;KASTGNSHL;ASTGNSHLG;STGNSHLGD;TGNSHLGDI;GNSHLGDIA;NSHLGDIAT;SHLGDIATL;HLGDIATLE;LGDIATLED;GDIATLEDG;DIATLEDGN;IATLEDGNS;ATLEDGNSN;TLEDGNSNL;LEDGNSNLI;EDGNSNLIW;DGNSNLIWG;GNSNLIWGI;NSNLIWGIG;SNLIWGIGF;NLIWGIGFR;LIWGIGFRL;IWGIGFRLS;WGIGFRLSD;GI | |

Fig. 43 continued

GFRLSDV;IGFRLSDVL;GFRLSDVLL;FRLSDVLLQ;RLSDVLLQR;LSDVLLQRA;SDVLL
QRAS;DVLLQRASE;VLLQRASEN;LLQRASENI;LQRASENIS;QRASENISI;RASENISI
N;ASENISINY;SENISINYA;ENISINYAI;NISINYAIM;ISINYAIME;SINYAIMEG;I
NYAIMEGV;NYAIMEGVY;YAIMEGVYN;AIMEGVYNE;IMEGVYNEI;MEGVYNEIQ;EGVY
NEIQM;GVYNEIQMP;VYNEIQMPK;YNEIQMPKN;NEIQMPKNL;EIQMPKNLL;IQMPKNL
LN;QMPKNLLNI;MPKNLLNIS;PKNLLNISF;KNLLNISFR;NLLNISFRS;LLNISFRSE;
LNISFRSEE;NISFRSEEV;ISFRSEEVA;SFRSEEVAF;FRSEEVAFL;RSEEVAFLA;SEE
VAFLAG;EEVAFLAGY;EVAFLAGYF;VAFLAGYFA;AFLAGYFAS;FLAGYFASK;LAGYFA
SKT;AGYFASKTS;GYFASKTSK;YFASKTSKT;FASKTSKTG;ASKTSKTGK;SKTSKTGKI
;KTSKTGKIG;TSKTGKIGF;SKTGKIGFI;KTGKIGFIG;TGKIGFIGG;GKIGFIGGV;KI
GFIGGVK;IGFIGGVKG;GFIGGVKGK;FIGGVKGKV;IGGVKGKVL;GGVKGKVLE;GVKGK
VLES;VKGKVLESF;KGKVLESFM;GKVLESFMY;KVLESFMYG;VLESFMYGY;LESFMYGY
E;ESFMYGYEA;SFMYGYEAG;FMYGYEAGA;MYGYEAGAK;YGYEAGAKY;GYEAGAKYA;Y
EAGAKYAN;EAGAKYANS;AGAKYANST;GAKYANSTI;AKYANSTIK;KYANSTIKV;YANS
TIKVI;ANSTIKVIS;NSTIKVISQ;STIKVISQY;TIKVISQYV;IKVISQYVG;KVISQYV
GT;VISQYVGTF;ISQYVGTFG;SQYVGTFGD;QYVGTFGDF;YVGTFGDFG;VGTFGDFGL;
GTFGDFGLG;TFGDFGLGR;FGDFGLGRS;GDFGLGRST;DFGLGRSTA;FGLGRSTAS;GLG
RSTASN;LGRSTASNM;GRSTASNMY;RSTASNMYR;STASNMYRD;TASNMYRDG;ASNMYR
DGV;SNMYRDGVD;NMYRDGVDI;MYRDGVDIV;YRDGVDIVF;RDGVDIVFA;DGVDIVFAA
;GVDIVFAAA;VDIVFAAAG;DIVFAAAGL;IVFAAAGLS;VFAAAGLSG;FAAAGLSGI;AA
AGLSGIG;AAGLSGIGV;AGLSGIGVI;GLSGIGVIE;LSGIGVIEA;SGIGVIEAA;GIGVI
EAAK;IGVIEAAKE;GVIEAAKEL;VIEAAKELG;IEAAKELGP;EAAKELGPD;AAKELGPD
H;AKELGPDHY;KELGPDHYI;ELGPDHYII;LGPDHYIIG;GPDHYIIGV;PDHYIIGVD;D
HYIIGVDQ;HYIIGVDQD;YIIGVDQDQ;IIGVDQDQS;IGVDQDQSY;GVDQDQSYL;VDQD
QSYLA;DQDQSYLAP;QDQSYLAPN;DQSYLAPNN;QSYLAPNNV;SYLAPNNVL;YLAPNNV
LV;LAPNNVLVS;APNNVLVSA;PNNVLVSAV;NNVLVSAVK;NVLVSAVKK;VLVSAVKKV;
LVSAVKKVD;VSAVKKVDS;SAVKKVDSL;AVKKVDSLM;VKKVDSLMY;KKVDSLMYS;KVD
SLMYSL;VDSLMYSLT;DSLMYSLTK;SLMYSLTKK;LMYSLTKKY;MYSLTKKYL;YSLTKK
YLE;SLTKKYLET;LTKKYLETG;TKKYLETGI;KKYLETGIW;KYLETGIWD;YLETGIWDG
;LETGIWDGG;ETGIWDGGK;TGIWDGGKN;GIWDGGKNI;IWDGGKNIF;WDGGKNIFF;DG
GKNIFFG;GGKNIFFGL;GKNIFFGLK;KNIFFGLKE;NIFFGLKED;IFFGLKEDG;FFGLK
EDGL;FGLKEDGLG;GLKEDGLGL;LKEDGLGLV;KEDGLGLVL;EDGLGLVLN;DGLGLVLN
E;GLGLVLNEN;LGLVLNENL;GLVLNENLK;LVLNENLKS;VLNENLKSN;LNENLKSNY;N
ENLKSNYS;ENLKSNYSE;NLKSNYSEI;LKSNYSEIY;KSNYSEIYN;SNYSEIYNK;NYSE
IYNKS;YSEIYNKSL;SEIYNKSLE;EIYNKSLEI;IYNKSLEIG;YNKSLEIGQ;NKSLEIG
QS;KSLEIGQSI;SLEIGQSIM;LEIGQSIME;EIGQSIMEG;IGQSIMEGI;GQSIMEGII;
QSIMEGIIK;SIMEGIIKV;IMEGIIKVP;MEGIIKVPY;EGIIKVPYD;GIIKVPYDK;IIK
VPYDKA;IKVPYDKAS;KVPYDKASY;VPYDKASYD;PYDKASYDN;YDKASYDNF;DKASYD
NFV;KASYDNFVL;ASYDNFVLQ;SYDNFVLQI;YDNFVLQIA;DNFVLQIAN;

10 mers:
MLNKVYCFIV;LNKVYCFIVF;NKVYCFIVFL;KVYCFIVFLF;VYCFIVFLFI;YCFIVFLF
II;CFIVFLFIIA;FIVFLFIIAC;IVFLFIIACS;VFLFIIACSG;FLFIIACSGS;LFIIA
CSGSD;FIIACSGSDD;IIACSGSDDV;IACSGSDDVK;ACSGSDDVKL;CSGSDDVKLE;SG
SDDVKLES;GSDDVKLESK;SDDVKLESKT;DDVKLESKTV;DVKLESKTVS;VKLESKTVSL
;KLESKTVSLI;LESKTVSLIV;ESKTVSLIVD;SKTVSLIVDG;KTVSLIVDGA;TVSLIVD
GAF;VSLIVDGAFD;SLIVDGAFDD;LIVDGAFDDK;IVDGAFDDKG;VDGAFDDKGF;DGAF
DDKGFN;GAFDDKGFNE;AFDDKGFNES;FDDKGFNESS;DDKGFNESSS;DKGFNESSSK;K
GFNESSSKA;GFNESSSKAI;FNESSSKAIR;NESSSKAIRK;ESSSKAIRKL;SSSKAIRKL
K;SSKAIRKLKT;SKAIRKLKTD;KAIRKLKTDF;AIRKLKTDFN;IRKLKTDFNI;RKLKTD
FNIN;KLKTDFNINI;LKTDFNINII;KTDFNINIIE;TDFNINIIEK;DFNINIIEKA;FNI
NIIEKAS;NINIIEKAST;INIIEKASTG;NIIEKASTGN;IIEKASTGNS;IEKASTGNSH;
EKASTGNSHL;KASTGNSHLG;ASTGNSHLGD;STGNSHLGDI;TGNSHLGDIA;GNSHLGDI
AT;NSHLGDIATL;SHLGDIATLE;HLGDIATLED;LGDIATLEDG;GDIATLEDGN;DIATL
EDGNS;IATLEDGNSN;ATLEDGNSNL;TLEDGNSNLI;LEDGNSNLIW;EDGNSNLIWG;DG
NSNLIWGI;GNSNLIWGIG;NSNLIWGIGF;SNLIWGIGFR;NLIWGIGFRL;LIWGIGFRLS
;IWGIGFRLSD;WGIGFRLSDV;GIGFRLSDVL;IGFRLSDVLL;GFRLSDVLLQ;FRLSDVL

Fig. 43 continued

LQR;RLSDVLLQRA;LSDVLLQRAS;SDVLLQRASE;DVLLQRASEN;VLLQRASENI;LLQR
ASENIS;LQRASENISI;QRASENISIN;RASENISINY;ASENISINYA;SENISINYAI;E
NISINYAIM;NISINYAIME;ISINYAIMEG;SINYAIMEGV;INYAIMEGVY;NYAIMEGVY
N;YAIMEGVYNE;AIMEGVYNEI;IMEGVYNEIQ;MEGVYNEIQM;EGVYNEIQMP;GVYNEI
QMPK;VYNEIQMPKN;YNEIQMPKNL;NEIQMPKNLL;EIQMPKNLLN;IQMPKNLLNI;QMP
KNLLNIS;MPKNLLNISF;PKNLLNISFR;KNLLNISFRS;NLLNISFRSE;LLNISFRSEE;
LNISFRSEEV;NISFRSEEVA;ISFRSEEVAF;SFRSEEVAFL;FRSEEVAFLA;RSEEVAFL
AG;SEEVAFLAGY;EEVAFLAGYF;EVAFLAGYFA;VAFLAGYFAS;AFLAGYFASK;FLAGY
FASKT;LAGYFASKTS;AGYFASKTSK;GYFASKTSKT;YFASKTSKTG;FASKTSKTGK;AS
KTSKTGKI;SKTSKTGKIG;KTSKTGKIGF;TSKTGKIGFI;SKTGKIGFIG;KTGKIGFIGG
;TGKIGFIGGV;GKIGFIGGVK;KIGFIGGVKG;IGFIGGVKGK;GFIGGVKGKV;FIGGVKG
KVL;IGGVKGKVLE;GGVKGKVLES;GVKGKVLESF;VKGKVLESFM;KGKVLESFMY;GKVL
ESFMYG;KVLESFMYGY;VLESFMYGYE;LESFMYGYEA;ESFMYGYEAG;SFMYGYEAGA;F
MYGYEAGAK;MYGYEAGAKY;YGYEAGAKYA;GYEAGAKYAN;YEAGAKYANS;EAGAKYANS
T;AGAKYANSTI;GAKYANSTIK;AKYANSTIKV;KYANSTIKVI;YANSTIKVIS;ANSTIK
VISQ;NSTIKVISQY;STIKVISQYV;TIKVISQYVG;IKVISQYVGT;KVISQYVGTF;VIS
QYVGTFG;ISQYVGTFGD;SQYVGTFGDF;QYVGTFGDFG;YVGTFGDFGL;VGTFGDFGLG;
GTFGDFGLGR;TFGDFGLGRS;FGDFGLGRST;GDFGLGRSTA;DFGLGRSTAS;FGLGRSTA
SN;GLGRSTASNM;LGRSTASNMY;GRSTASNMYR;RSTASNMYRD;STASNMYRDG;TASNM
YRDGV;ASNMYRDGVD;SNMYRDGVDI;NMYRDGVDIV;MYRDGVDIVF;YRDGVDIVFA;RD
GVDIVFAA;DGVDIVFAAA;GVDIVFAAAG;VDIVFAAAGL;DIVFAAAGLS;IVFAAAGLSG
;VFAAAGLSGI;FAAAGLSGIG;AAAGLSGIGV;AAGLSGIGVI;AGLSGIGVIE;GLSGIGV
IEA;LSGIGVIEAA;SGIGVIEAAK;GIGVIEAAKE;IGVIEAAKEL;GVIEAAKELG;VIEA
AKELGP;IEAAKELGPD;EAAKELGPDH;AAKELGPDHY;AKELGPDHYI;KELGPDHYII;E
LGPDHYIIG;LGPDHYIIGV;GPDHYIIGVD;PDHYIIGVDQ;DHYIIGVDQD;HYIIGVDQD
Q;YIIGVDQDQS;IIGVDQDQSY;IGVDQDQSYL;GVDQDQSYLA;VDQDQSYLAP;DQDQSY
LAPN;QDQSYLAPNN;DQSYLAPNNV;QSYLAPNNVL;SYLAPNNVLV;YLAPNNVLVS;LAP
NNVLVSA;APNNVLVSAV;PNNVLVSAVK;NNVLVSAVKK;NVLVSAVKKV;VLVSAVKKVD;
LVSAVKKVDS;VSAVKKVDSL;SAVKKVDSLM;AVKKVDSLMY;VKKVDSLMYS;KKVDSLMY
SL;KVDSLMYSLT;VDSLMYSLTK;DSLMYSLTKK;SLMYSLTKKY;LMYSLTKKYL;MYSLT
KKYLE;YSLTKKYLET;SLTKKYLETG;LTKKYLETGI;TKKYLETGIW;KKYLETGIWD;KY
LETGIWDG;YLETGIWDGG;LETGIWDGGK;ETGIWDGGKN;TGIWDGGKNI;GIWDGGKNIF
;IWDGGKNIFF;WDGGKNIFFG;DGGKNIFFGL;GGKNIFFGLK;GKNIFFGLKE;KNIFFGL
KED;NIFFGLKEDG;IFFGLKEDGL;FFGLKEDGLG;FGLKEDGLGL;GLKEDGLGLV;LKED
GLGLVL;KEDGLGLVLN;EDGLGLVLNE;DGLGLVLNEN;GLGLVLNENL;LGLVLNENLK;G
LVLNENLKS;LVLNENLKSN;VLNENLKSNY;LNENLKSNYS;NENLKSNYSE;ENLKSNYSE
I;NLKSNYSEIY;LKSNYSEIYN;KSNYSEIYNK;SNYSEIYNKS;NYSEIYNKSL;YSEIYN
KSLE;SEIYNKSLEI;EIYNKSLEIG;IYNKSLEIGQ;YNKSLEIGQS;NKSLEIGQSI;KSL
EIGQSIM;SLEIGQSIME;LEIGQSIMEG;EIGQSIMEGI;IGQSIMEGII;GQSIMEGIIK;
QSIMEGIIKV;SIMEGIIKVP;IMEGIIKVPY;MEGIIKVPYD;EGIIKVPYDK;GIIKVPYD
KA;IIKVPYDKAS;IKVPYDKASY;KVPYDKASYD;VPYDKASYDN;PYDKASYDNF;YDKAS
YDNFV;DKASYDNFVL;KASYDNFVLQ;ASYDNFVLQI;SYDNFVLQIA;YDNFVLQIAN;

11 mers:
MLNKVYCFIVF;LNKVYCFIVFL;NKVYCFIVFLF;KVYCFIVFLFI;VYCFIVFLFII;YCF
IVFLFIIA;CFIVFLFIIAC;FIVFLFIIACS;IVFLFIIACSG;VFLFIIACSGS;FLFIIA
CSGSD;LFIIACSGSDD;FIIACSGSDDV;IIACSGSDDVK;IACSGSDDVKL;ACSGSDDVK
LE;CSGSDDVKLES;SGSDDVKLESK;GSDDVKLESKT;SDDVKLESKTV;DDVKLESKTVS;
DVKLESKTVSL;VKLESKTVSLI;KLESKTVSLIV;LESKTVSLIVD;ESKTVSLIVDG;SKT
VSLIVDGA;KTVSLIVDGAF;TVSLIVDGAFD;VSLIVDGAFDD;SLIVDGAFDDK;LIVDGA
FDDKG;IVDGAFDDKGF;VDGAFDDKGFN;DGAFDDKGFNE;GAFDDKGFNES;AFDDKGFNE
SS;FDDKGFNESSS;DDKGFNESSSK;DKGFNESSSKA;KGFNESSSKAI;GFNESSSKAIR;
FNESSSKAIRK;NESSSKAIRKL;ESSSKAIRKLK;SSSKAIRKLKT;SSKAIRKLKTD;SKA
IRKLKTDF;KAIRKLKTDFN;AIRKLKTDFNI;IRKLKTDFNIN;RKLKTDFNINI;KLKTDF
NINII;LKTDFNINIIE;KTDFNINIIEK;TDFNINIIEKA;DFNINIIEKAS;FNINIIEKA
ST;NINIIEKASTG;INIIEKASTGN;NIIEKASTGNS;IIEKASTGNSH;IEKASTGNSHL;
EKASTGNSHLG;KASTGNSHLGD;ASTGNSHLGDI;STGNSHLGDIA;TGNSHLGDIAT;GNS

Fig. 43 continued

HLGDIATL;NSHLGDIATLE;SHLGDIATLED;HLGDIATLEDG;LGDIATLEDGN;GDIATL
EDGNS;DIATLEDGNSN;IATLEDGNSNL;ATLEDGNSNLI;TLEDGNSNLIW;LEDGNSNLI
WG;EDGNSNLIWGI;DGNSNLIWGIG;GNSNLIWGIGF;NSNLIWGIGFR;SNLIWGIGFRL;
NLIWGIGFRLS;LIWGIGFRLSD;IWGIGFRLSDV;WGIGFRLSDVL;GIGFRLSDVLL;IGF
RLSDVLLQ;GFRLSDVLLQR;FRLSDVLLQRA;RLSDVLLQRAS;LSDVLLQRASE;SDVLLQ
RASEN;DVLLQRASENI;VLLQRASENIS;LLQRASENISI;LQRASENISIN;QRASENISI
NY;RASENISINYA;ASENISINYAI;SENISINYAIM;ENISINYAIME;NISINYAIMEG;
ISINYAIMEGV;SINYAIMEGVY;INYAIMEGVYN;NYAIMEGVYNE;YAIMEGVYNEI;AIM
EGVYNEIQ;IMEGVYNEIQM;MEGVYNEIQMP;EGVYNEIQMPK;GVYNEIQMPKN;VYNEIQ
MPKNL;YNEIQMPKNLL;NEIQMPKNLLN;EIQMPKNLLNI;IQMPKNLLNIS;QMPKNLLNI
SF;MPKNLLNISFR;PKNLLNISFRS;KNLLNISFRSE;NLLNISFRSEE;LLNISFRSEEV;
LNISFRSEEVA;NISFRSEEVAF;ISFRSEEVAFL;SFRSEEVAFLA;FRSEEVAFLAG;RSE
EVAFLAGY;SEEVAFLAGYF;EEVAFLAGYFA;EVAFLAGYFAS;VAFLAGYFASK;AFLAGY
FASKT;FLAGYFASKTS;LAGYFASKTSK;AGYFASKTSKT;GYFASKTSKTG;YFASKTSKT
GK;FASKTSKTGKI;ASKTSKTGKIG;SKTSKTGKIGF;KTSKTGKIGFI;TSKTGKIGFIG;
SKTGKIGFIGG;KTGKIGFIGGV;TGKIGFIGGVK;GKIGFIGGVKG;KIGFIGGVKGK;IGF
IGGVKGKV;GFIGGVKGKVL;FIGGVKGKVLE;IGGVKGKVLES;GGVKGKVLESF;GVKGKV
LESFM;VKGKVLESFMY;KGKVLESFMYG;GKVLESFMYGY;KVLESFMYGYE;VLESFMYGY
EA;LESFMYGYEAG;ESFMYGYEAGA;SFMYGYEAGAK;FMYGYEAGAKY;MYGYEAGAKYA;
YGYEAGAKYAN;GYEAGAKYANS;YEAGAKYANST;EAGAKYANSTI;AGAKYANSTIK;GAK
YANSTIKV;AKYANSTIKVI;KYANSTIKVIS;YANSTIKVISQ;ANSTIKVISQY;NSTIKV
ISQYV;STIKVISQYVG;TIKVISQYVGT;IKVISQYVGTF;KVISQYVGTFG;VISQYVGTF
GD;ISQYVGTFGDF;SQYVGTFGDFG;QYVGTFGDFGL;YVGTFGDFGLG;VGTFGDFGLGR;
GTFGDFGLGRS;TFGDFGLGRST;FGDFGLGRSTA;GDFGLGRSTAS;DFGLGRSTASN;FGL
GRSTASNM;GLGRSTASNMY;LGRSTASNMYR;GRSTASNMYRD;RSTASNMYRDG;STASNM
YRDGV;TASNMYRDGVD;ASNMYRDGVDI;SNMYRDGVDIV;NMYRDGVDIVF;MYRDGVDIV
FA;YRDGVDIVFAA;RDGVDIVFAAA;DGVDIVFAAAG;GVDIVFAAAGL;VDIVFAAAGLS;
DIVFAAAGLSG;IVFAAAGLSGI;VFAAAGLSGIG;FAAAGLSGIGV;AAAGLSGIGVI;AAG
LSGIGVIE;AGLSGIGVIEA;GLSGIGVIEAA;LSGIGVIEAAK;SGIGVIEAAKE;GIGVIE
AAKEL;IGVIEAAKELG;GVIEAAKELGP;VIEAAKELGPD;IEAAKELGPDH;EAAKELGPD
HY;AAKELGPDHYI;AKELGPDHYII;KELGPDHYIIG;ELGPDHYIIGV;LGPDHYIIGVD;
GPDHYIIGVDQ;PDHYIIGVDQD;DHYIIGVDQDQ;HYIIGVDQDQS;YIIGVDQDQSY;IIG
VDQDQSYL;IGVDQDQSYLA;GVDQDQSYLAP;VDQDQSYLAPN;DQDQSYLAPNN;QDQSYL
APNNV;DQSYLAPNNVL;QSYLAPNNVLV;SYLAPNNVLVS;YLAPNNVLVSA;LAPNNVLVS
AV;APNNVLVSAVK;PNNVLVSAVKK;NNVLVSAVKKV;NVLVSAVKKVD;VLVSAVKKVDS;
LVSAVKKVDSL;VSAVKKVDSLM;SAVKKVDSLMY;AVKKVDSLMYS;VKKVDSLMYSL;KKV
DSLMYSLT;KVDSLMYSLTK;VDSLMYSLTKK;DSLMYSLTKKY;SLMYSLTKKYL;LMYSLT
KKYLE;MYSLTKKYLET;YSLTKKYLETG;SLTKKYLETGI;LTKKYLETGIW;TKKYLETGI
WD;KKYLETGIWDG;KYLETGIWDGG;YLETGIWDGGK;LETGIWDGGKN;ETGIWDGGKNI;
TGIWDGGKNIF;GIWDGGKNIFF;IWDGGKNIFFG;WDGGKNIFFGL;DGGKNIFFGLK;GGK
NIFFGLKE;GKNIFFGLKED;KNIFFGLKEDG;NIFFGLKEDGL;IFFGLKEDGLG;FFGLKE
DGLGL;FGLKEDGLGLV;GLKEDGLGLVL;LKEDGLGLVLN;KEDGLGLVLNE;EDGLGLVLN
EN;DGLGLVLNENL;GLGLVLNENLK;LGLVLNENLKS;GLVLNENLKSN;LVLNENLKSNY;
VLNENLKSNYS;LNENLKSNYSE;NENLKSNYSEI;ENLKSNYSEIY;NLKSNYSEIYN;LKS
NYSEIYNK;KSNYSEIYNKS;SNYSEIYNKSL;NYSEIYNKSLE;YSEIYNKSLEI;SEIYNK
SLEIG;EIYNKSLEIGQ;IYNKSLEIGQS;YNKSLEIGQSI;NKSLEIGQSIM;KSLEIGQSI
ME;SLEIGQSIMEG;LEIGQSIMEGI;EIGQSIMEGII;IGQSIMEGIIK;GQSIMEGIIKV;
QSIMEGIIKVP;SIMEGIIKVPY;IMEGIIKVPYD;MEGIIKVPYDK;EGIIKVPYDKA;GII
KVPYDKAS;IIKVPYDKASY;IKVPYDKASYD;KVPYDKASYDN;VPYDKASYDNF;PYDKAS
YDNFV;YDKASYDNFVL;DKASYDNFVLQ;KASYDNFVLQI;ASYDNFVLQIA;SYDNFVLQI
AN;

13 mers:
MLNKVYCFIVFLF;LNKVYCFIVFLFI;NKVYCFIVFLFII;KVYCFIVFLFIIA;VYCFIVF
LFIIAC;YCFIVFLFIIACS;CFIVFLFIIACSG;FIVFLFIIACSGS;IVFLFIIACSGSD;
VFLFIIACSGSDD;FLFIIACSGSDDV;LFIIACSGSDDVK;FIIACSGSDDVKL;IIACSGS
DDVKLE;IACSGSDDVKLES;ACSGSDDVKLESK;CSGSDDVKLESKT;SGSDDVKLESKTV;

Fig. 43 continued

GSDDVKLESKTVS;SDDVKLESKTVSL;DDVKLESKTVSLI;DVKLESKTVSLIV;VKLESKT
VSLIVD;KLESKTVSLIVDG;LESKTVSLIVDGA;ESKTVSLIVDGAF;SKTVSLIVDGAFD;
KTVSLIVDGAFDD;TVSLIVDGAFDDK;VSLIVDGAFDDKG;SLIVDGAFDDKGF;LIVDGAF
DDKGFN;IVDGAFDDKGFNE;VDGAFDDKGFNES;DGAFDDKGFNESS;GAFDDKGFNESSS;
AFDDKGFNESSSK;FDDKGFNESSSKA;DDKGFNESSSKAI;DKGFNESSSKAIR;KGFNESS
SKAIRK;GFNESSSKAIRKL;FNESSSKAIRKLK;NESSSKAIRKLKT;ESSSKAIRKLKTD;
SSSKAIRKLKTDF;SSKAIRKLKTDFN;SKAIRKLKTDFNI;KAIRKLKTDFNIN;AIRKLKT
DFNINI;IRKLKTDFNINII;RKLKTDFNINIIE;KLKTDFNINIIEK;LKTDFNINIIEKA;
KTDFNINIIEKAS;TDFNINIIEKAST;DFNINIIEKASTG;FNINIIEKASTGN;NINIIEK
ASTGNS;INIIEKASTGNSH;NIIEKASTGNSHL;IIEKASTGNSHLG;IEKASTGNSHLGD;
EKASTGNSHLGDI;KASTGNSHLGDIA;ASTGNSHLGDIAT;STGNSHLGDIATL;TGNSHLG
DIATLE;GNSHLGDIATLED;NSHLGDIATLEDG;SHLGDIATLEDGN;HLGDIATLEDGNS;
LGDIATLEDGNSN;GDIATLEDGNSNL;DIATLEDGNSNLI;IATLEDGNSNLIW;ATLEDGN
SNLIWG;TLEDGNSNLIWGI;LEDGNSNLIWGIG;EDGNSNLIWGIGF;DGNSNLIWGIGFR;
GNSNLIWGIGFRL;NSNLIWGIGFRLS;SNLIWGIGFRLSD;NLIWGIGFRLSDV;LIWGIGF
RLSDVL;IWGIGFRLSDVLL;WGIGFRLSDVLLQ;GIGFRLSDVLLQR;IGFRLSDVLLQRA;
GFRLSDVLLQRAS;FRLSDVLLQRASE;RLSDVLLQRASEN;LSDVLLQRASENI;SDVLLQR
ASENIS;DVLLQRASENISI;VLLQRASENISIN;LLQRASENISINY;LQRASENISINYA;
QRASENISINYAI;RASENISINYAIM;ASENISINYAIME;SENISINYAIMEG;ENISINY
AIMEGV;NISINYAIMEGVY;ISINYAIMEGVYN;SINYAIMEGVYNE;INYAIMEGVYNEI;
NYAIMEGVYNEIQ;YAIMEGVYNEIQM;AIMEGVYNEIQMP;IMEGVYNEIQMPK;MEGVYNE
IQMPKN;EGVYNEIQMPKNL;GVYNEIQMPKNLL;VYNEIQMPKNLLN;YNEIQMPKNLLNI;
NEIQMPKNLLNIS;EIQMPKNLLNISF;IQMPKNLLNISFR;QMPKNLLNISFRS;MPKNLLN
ISFRSE;PKNLLNISFRSEE;KNLLNISFRSEEV;NLLNISFRSEEVA;LLNISFRSEEVAF;
LNISFRSEEVAFL;NISFRSEEVAFLA;ISFRSEEVAFLAG;SFRSEEVAFLAGY;FRSEEVA
FLAGYF;RSEEVAFLAGYFA;SEEVAFLAGYFAS;EEVAFLAGYFASK;EVAFLAGYFASKT;
VAFLAGYFASKTS;AFLAGYFASKTSK;FLAGYFASKTSKT;LAGYFASKTSKTG;AGYFASK
TSKTGK;GYFASKTSKTGKI;YFASKTSKTGKIG;FASKTSKTGKIGF;ASKTSKTGKIGFI;
SKTSKTGKIGFIG;KTSKTGKIGFIGG;TSKTGKIGFIGGV;SKTGKIGFIGGVK;KTGKIGF
IGGVKG;TGKIGFIGGVKGK;GKIGFIGGVKGKV;KIGFIGGVKGKVL;IGFIGGVKGKVLE;
GFIGGVKGKVLES;FIGGVKGKVLESF;IGGVKGKVLESFM;GGVKGKVLESFMY;GVKGKVL
ESFMYG;VKGKVLESFMYGY;KGKVLESFMYGYE;GKVLESFMYGYEA;KVLESFMYGYEAG;
VLESFMYGYEAGA;LESFMYGYEAGAK;ESFMYGYEAGAKY;SFMYGYEAGAKYA;FMYGYEA
GAKYAN;MYGYEAGAKYANS;YGYEAGAKYANST;GYEAGAKYANSTI;YEAGAKYANSTIK;
EAGAKYANSTIKV;AGAKYANSTIKVI;GAKYANSTIKVIS;AKYANSTIKVISQ;KYANSTI
KVISQY;YANSTIKVISQYV;ANSTIKVISQYVG;NSTIKVISQYVGT;STIKVISQYVGTF;
TIKVISQYVGTFG;IKVISQYVGTFGD;KVISQYVGTFGDF;VISQYVGTFGDFG;ISQYVGT
FGDFGL;SQYVGTFGDFGLG;QYVGTFGDFGLGR;YVGTFGDFGLGRS;VGTFGDFGLGRST;
GTFGDFGLGRSTA;TFGDFGLGRSTAS;FGDFGLGRSTASN;GDFGLGRSTASNM;DFGLGRS
TASNMY;FGLGRSTASNMYR;GLGRSTASNMYRD;LGRSTASNMYRDG;GRSTASNMYRDGV;
RSTASNMYRDGVD;STASNMYRDGVDI;TASNMYRDGVDIV;ASNMYRDGVDIVF;SNMYRDG
VDIVFA;NMYRDGVDIVFAA;MYRDGVDIVFAAA;YRDGVDIVFAAAG;RDGVDIVFAAAGL;
DGVDIVFAAAGLS;GVDIVFAAAGLSG;VDIVFAAAGLSGI;DIVFAAAGLSGIG;IVFAAAG
LSGIGV;VFAAAGLSGIGVI;FAAAGLSGIGVIE;AAAGLSGIGVIEA;AAGLSGIGVIEAA;
AGLSGIGVIEAAK;GLSGIGVIEAAKE;LSGIGVIEAAKEL;SGIGVIEAAKELG;GIGVIEA
AKELGP;IGVIEAAKELGPD;GVIEAAKELGPDH;VIEAAKELGPDHY;IEAAKELGPDHYI;
EAAKELGPDHYII;AAKELGPDHYIIG;AKELGPDHYIIGV;KELGPDHYIIGVD;ELGPDHY
IIGVDQ;LGPDHYIIGVDQD;GPDHYIIGVDQDQ;PDHYIIGVDQDQS;DHYIIGVDQDQSY;
HYIIGVDQDQSYL;YIIGVDQDQSYLA;IIGVDQDQSYLAP;IGVDQDQSYLAPN;GVDQDQS
YLAPNN;VDQDQSYLAPNNV;DQDQSYLAPNNVL;QDQSYLAPNNVLV;DQSYLAPNNVLVS;
QSYLAPNNVLVSA;SYLAPNNVLVSAV;YLAPNNVLVSAVK;LAPNNVLVSAVKK;APNNVLV
SAVKKV;PNNVLVSAVKKVD;NNVLVSAVKKVDS;NVLVSAVKKVDSL;VLVSAVKKVDSLM;
LVSAVKKVDSLMY;VSAVKKVDSLMYS;SAVKKVDSLMYSL;AVKKVDSLMYSLT;VKKVDSL
MYSLTK;KKVDSLMYSLTKK;KVDSLMYSLTKKY;VDSLMYSLTKKYL;DSLMYSLTKKYLE;
SLMYSLTKKYLET;LMYSLTKKYLETG;MYSLTKKYLETGI;YSLTKKYLETGIW;SLTKKYL
ETGIWD;LTKKYLETGIWDG;TKKYLETGIWDGG;KKYLETGIWDGGK;KYLETGIWDGGKN;
YLETGIWDGGKNI;LETGIWDGGKNIF;ETGIWDGGKNIFF;TGIWDGGKNIFFG;GIWDGGK

Fig. 43 continued

NIFFGL;IWDGGKNIFFGLK;WDGGKNIFFGLKE;DGGKNIFFGLKED;GGKNIFFGLKEDG;
GKNIFFGLKEDGL;KNIFFGLKEDGLG;NIFFGLKEDGLGL;IFFGLKEDGLGLV;FFGLKED
GLGLVL;FGLKEDGLGLVLN;GLKEDGLGLVLNE;LKEDGLGLVLNEN;KEDGLGLVLNENL;
EDGLGLVLNENLK;DGLGLVLNENLKS;GLGLVLNENLKSN;LGLVLNENLKSNY;GLVLNEN
LKSNYS;LVLNENLKSNYSE;VLNENLKSNYSEI

KVISQYVG;ANSTIKVISQYVGT;NSTIKVISQYVGTF;STIKVISQYVGTFG;TIKVISQYV
GTFGD;IKVISQYVGTFGDF;KVISQYVGTFGDFG;VISQYVGTFGDFGL;ISQYVGTFGDFG
LG;SQYVGTFGDFGLGR;QYVGTFGDFGLGRS;YVGTFGDFGLGRST;VGTFGDFGLGRSTA;
GTFGDFGLGRSTAS;TFGDFGLGRSTASN;FGDFGLGRSTASNM;GDFGLGRSTASNMY;DFG
LGRSTASNMYR;FGLGRSTASNMYRD;GLGRSTASNMYRDG;LGRSTASNMYRDGV;GRSTAS
NMYRDGVD;RSTASNMYRDGVDI;STASNMYRDGVDIV;TASNMYRDGVDIVF;ASNMYRDGV
DIVFA;SNMYRDGVDIVFAA;NMYRDGVDIVFAAA;MYRDGVDIVFAAAG;YRDGVDIVFAAA
GL;RDGVDIVFAAAGLS;DGVDIVFAAAGLSG;GVDIVFAAAGLSGI;VDIVFAAAGLSGIG;
DIVFAAAGLSGIGV;IVFAAAGLSGIGVI;VFAAAGLSGIGVIE;FAAAGLSGIGVIEA;AAA
GLSGIGVIEAA;AAGLSGIGVIEAAK;AGLSGIGVIEAAKE;GLSGIGVIEAAKEL;LSGIGV
IEAAKELG;SGIGVIEAAKELGP;GIGVIEAAKELGPD;IGVIEAAKELGPDH;GVIEAAKEL
GPDHY;VIEAAKELGPDHYI;IEAAKELGPDHYII;EAAKELGPDHYIIG;AAKELGPDHYII
GV;AKELGPDHYIIGVD;KELGPDHYIIGVDQ;ELGPDHYIIGVDQD;LGPDHYIIGVDQDQ;
GPDHYIIGVDQDQS;PDHYIIGVDQDQSY;DHYIIGVDQDQSYL;HYIIGVDQDQSYLA;YII
GVDQDQSYLAP;IIGVDQDQSYLAPN;IGVDQDQSYLAPNN;GVDQDQSYLAPNNV;VDQDQS
YLAPNNVL;DQDQSYLAPNNVLV;QDQSYLAPNNVLVS;DQSYLAPNNVLVSA;QSYLAPNNV
LVSAV;SYLAPNNVLVSAVK;YLAPNNVLVSAVKK;LAPNNVLVSAVKKV;APNNVLVSAVKK
VD;PNNVLVSAVKKVDS;NNVLVSAVKKVDSL;NVLVSAVKKVDSLM;VLVSAVKKVDSLMY;
LVSAVKKVDSLMYS;VSAVKKVDSLMYSL;SAVKKVDSLMYSLT;AVKKVDSLMYSLTK;VKK
VDSLMYSLTKK;KKVDSLMYSLTKKY;KVDSLMYSLTKKYL;VDSLMYSLTKKYLE;DSLMYS
LTKKYLET;SLMYSLTKKYLETG;LMYSLTKKYLETGI;MYSLTKKYLETGIW;YSLTKKYLE
TGIWD;SLTKKYLETGIWDG;LTKKYLETGIWDGG;TKKYLETGIWDGGK;KKYLETGIWDGG
KN;KYLETGIWDGGKNI;YLETGIWDGGKNIF;LETGIWDGGKNIFF;ETGIWDGGKNIFFG;
TGIWDGGKNIFFGL;GIWDGGKNIFFGLK;IWDGGKNIFFGLKE;WDGGKNIFFGLKED;DGG
KNIFFGLKEDG;GGKNIFFGLKEDGL;GKNIFFGLKEDGLG;KNIFFGLKEDGLGL;NIFFGL
KEDGLGLV;IFFGLKEDGLGLVL;FFGLKEDGLGLVLN;FGLKEDGLGLVLNE;GLKEDGLGL
VLNEN;LKEDGLGLVLNENL;KEDGLGLVLNENLK;EDGLGLVLNENLKS;DGLGLVLNENLK
SN;GLGLVLNENLKSNY;LGLVLNENLKSNYS;GLVLNENLKSNYSE;LVLNENLKSNYSEI;
VLNENLKSNYSEIY;LNENLKSNYSEIYN;NENLKSNYSEIYNK;ENLKSNYSEIYNKS;NLK
SNYSEIYNKSL;LKSNYSEIYNKSLE;KSNYSEIYNKSLEI;SNYSEIYNKSLEIG;NYSEIY
NKSLEIGQ;YSEIYNKSLEIGQS;SEIYNKSLEIGQSI;EIYNKSLEIGQSIM;IYNKSLEIG
QSIME;YNKSLEIGQSIMEG;NKSLEIGQSIMEGI;KSLEIGQSIMEGII;SLEIGQSIMEGI
IK;LEIGQSIMEGIIKV;EIGQSIMEGIIKVP;IGQSIMEGIIKVPY;GQSIMEGIIKVPYD;
QSIMEGIIKVPYDK;SIMEGIIKVPYDKA;IMEGIIKVPYDKAS;MEGIIKVPYDKASY;EGI
IKVPYDKASYD;GIIKVPYDKASYDN;IIKVPYDKASYDNF;IKVPYDKASYDNFV;KVPYDK
ASYDNFVL;VPYDKASYDNFVLQ;PYDKASYDNFVLQI;YDKASYDNFVLQIA;DKASYDNFV
LQIAN;

15 mers:
MLNKVYCFIVFLFII;LNKVYCFIVFLFIIA;NKVYCFIVFLFIIAC;KVYCFIVFLFIIACS
;VYCFIVFLFIIACSG;YCFIVFLFIIACSGS;CFIVFLFIIACSGSD;FIVFLFIIACSGSD
D;IVFLFIIACSGSDDV;VFLFIIACSGSDDVK;FLFIIACSGSDDVKL;LFIIACSGSDDVK
LE;FIIACSGSDDVKLES;IIACSGSDDVKLESK;IACSGSDDVKLESKT;ACSGSDDVKLES
KTV;CSGSDDVKLESKTVS;SGSDDVKLESKTVSL;GSDDVKLESKTVSLI;SDDVKLESKTV
SLIV;DDVKLESKTVSLIVD;DVKLESKTVSLIVDG;VKLESKTVSLIVDGA;KLESKTVSLI
VDGAF;LESKTVSLIVDGAFD;ESKTVSLIVDGAFDD;SKTVSLIVDGAFDDK;KTVSLIVDG
AFDDKG;TVSLIVDGAFDDKGF;VSLIVDGAFDDKGFN;SLIVDGAFDDKGFNE;LIVDGAFD
DKGFNES;IVDGAFDDKGFNESS;VDGAFDDKGFNESSS;DGAFDDKGFNESSSK;GAFDDKG
FNESSSKA;AFDDKGFNESSSKAI;FDDKGFNESSSKAIR;DDKGFNESSSKAIRK;DKGFNE
SSSKAIRKL;KGFNESSSKAIRKLK;GFNESSSKAIRKLKT;FNESSSKAIRKLKTD;NESSS
KAIRKLKTDF;ESSSKAIRKLKTDFN;SSSKAIRKLKTDFNI;SSKAIRKLKTDFNIN;SKAI
RKLKTDFNINI;KAIRKLKTDFNINII;AIRKLKTDFNINIIE;IRKLKTDFNINIIEK;RKL
KTDFNINIIEKA;KLKTDFNINIIEKAS;LKTDFNINIIEKAST;KTDFNINIIEKASTG;TD
FNINIIEKASTGN;DFNINIIEKASTGNS;FNINIIEKASTGNSH;NINIIEKASTGNSHL;I
NIIEKASTGNSHLG;NIIEKASTGNSHLGD;IIEKASTGNSHLGDI;IEKASTGNSHLGDIA;
EKASTGNSHLGDIAT;KASTGNSHLGDIATL;ASTGNSHLGDIATLE;STGNSHLGDIATLED
;TGNSHLGDIATLEDG;GNSHLGDIATLEDGN;NSHLGDIATLEDGNS;SHLGDIATLEDGNS

Fig. 43 continued

N;HLGDIATLEDGNSNL;LGDIATLEDGNSNLI;GDIATLEDGNSNLIW;DIATLEDGNSNLI
WG;IATLEDGNSNLIWGI;ATLEDGNSNLIWGIG;TLEDGNSNLIWGIGF;LEDGNSNLIWGI
GFR;EDGNSNLIWGIGFRL;DGNSNLIWGIGFRLS;GNSNLIW

KSNYSEIYNK;NENLKSNYSEIYNKS;ENLKSNYSEIYNKSL;NLKSNYSEIYNKSLE;LKSN
YSEIYNKSLEI;KSNYSEIYNKSLEIG;SNYSEIYNKSLEIGQ;NYSEIYNKSLEIGQS;YSE
IYNKSLEIGQSI;SEIYNKSLEIGQSIM;EIYNKSLEIGQSIME;IYNKSLEIGQSIMEG;YN
KSLEIGQSIMEGI;NKSLEIGQSIMEGII;KSLEIGQSIMEGIIK;SLEIGQSIMEGIIKV;L
EIGQSIMEGIIKVP;EIGQSIMEGIIKVPY;IGQSIMEGIIKVPYD;GQSIMEGIIKVPYDK;
QSIMEGIIKVPYDKA;SIMEGIIKVPYDKAS;IMEGIIKVPYDKASY;MEGIIKVPYDKASYD
;EGIIKVPYDKASYDN;GIIKVPYDKASYDNF;IIKVPYDKASYDNFV;IKVPYDKASYDNFV
L;KVPYDKASYDNFVLQ;VPYDKASYDNFVLQI;PYDKASYDNFVLQIA;YDKASYDNFVLQI
AN;

16 mers:
MLNKVYCFIVFLFIIA;LNKVYCFIVFLFIIAC;NKVYCFIVFLFIIACS;KVYCFIVFLFII
ACSG;VYCFIVFLFIIACSGS;YCFIVFLFIIACSGSD;CFIVFLFIIACSGSDD;FIVFLFI
IACSGSDDV;IVFLFIIACSGSDDVK;VFLFIIACSGSDDVKL;FLFIIACSGSDDVKLE;LF
IIACSGSDDVKLES;FIIACSGSDDVKLESK;IIACSGSDDVKLESKT;IACSGSDDVKLESK
TV;ACSGSDDVKLESKTVS;CSGSDDVKLESKTVSL;SGSDDVKLESKTVSLI;GSDDVKLES
KTVSLIV;SDDVKLESKTVSLIVD;DDVKLESKTVSLIVDG;DVKLESKTVSLIVDGA;VKLE
SKTVSLIVDGAF;KLESKTVSLIVDGAFD;LESKTVSLIVDGAFDD;ESKTVSLIVDGAFDDK
;SKTVSLIVDGAFDDKG;KTVSLIVDGAFDDKGF;TVSLIVDGAFDDKGFN;VSLIVDGAFDD
KGFNE;SLIVDGAFDDKGFNES;LIVDGAFDDKGFNESS;IVDGAFDDKGFNESSS;VDGAFD
DKGFNESSSK;DGAFDDKGFNESSSKA;GAFDDKGFNESSSKAI;AFDDKGFNESSSKAIR;F
DDKGFNESSSKAIRK;DDKGFNESSSKAIRKL;DKGFNESSSKAIRKLK;KGFNESSSKAIRK
LKT;GFNESSSKAIRKLKTD;FNESSSKAIRKLKTDF;NESSSKAIRKLKTDFN;ESSSKAIR
KLKTDFNI;SSSKAIRKLKTDFNIN;SSKAIRKLKTDFNINI;SKAIRKLKTDFNINII;KAI
RKLKTDFNINIIE;AIRKLKTDFNINIIEK;IRKLKTDFNINIIEKA;RKLKTDFNINIIEKA
S;KLKTDFNINIIEKAST;LKTDFNINIIEKASTG;KTDFNINIIEKASTGN;TDFNINIIEK
ASTGNS;DFNINIIEKASTGNSH;FNINIIEKASTGNSHL;NINIIEKASTGNSHLG;INIIE
KASTGNSHLGD;NIIEKASTGNSHLGDI;IIEKASTGNSHLGDIA;IEKASTGNSHLGDIAT;
EKASTGNSHLGDIATL;KASTGNSHLGDIATLE;ASTGNSHLGDIATLED;STGNSHLGDIAT
LEDG;TGNSHLGDIATLEDGN;GNSHLGDIATLEDGNS;NSHLGDIATLEDGNSN;SHLGDIA
TLEDGNSNL;HLGDIATLEDGNSNLI;LGDIATLEDGNSNLIW;GDIATLEDGNSNLIWG;DI
ATLEDGNSNLIWGI;IATLEDGNSNLIWGIG;ATLEDGNSNLIWGIGF;TLEDGNSNLIWGIG
FR;LEDGNSNLIWGIGFRL;EDGNSNLIWGIGFRLS;DGNSNLIWGIGFRLSD;GNSNLIWGI
GFRLSDV;NSNLIWGIGFRLSDVL;SNLIWGIGFRLSDVLL;NLIWGIGFRLSDVLLQ;LIWG
IGFRLSDVLLQR;IWGIGFRLSDVLLQRA;WGIGFRLSDVLLQRAS;GIGFRLSDVLLQRASE
;IGFRLSDVLLQRASEN;GFRLSDVLLQRASENI;FRLSDVLLQRASENIS;RLSDVLLQRAS
ENISI;LSDVLLQRASENISIN;SDVLLQRASENISINY;DVLLQRASENISINYA;VLLQRA
SENISINYAI;LLQRASENISINYAIM;LQRASENISINYAIME;QRASENISINYAIMEG;R
ASENISINYAIMEGV;ASENISINYAIMEGVY;SENISINYAIMEGVYN;ENISINYAIMEGV
YNE;NISINYAIMEGVYNEI;ISINYAIMEGVYNEIQ;SINYAIMEGVYNEIQM;INYAIMEG
VYNEIQMP;NYAIMEGVYNEIQMPK;YAIMEGVYNEIQMPKN;AIMEGVYNEIQMPKNL;IME
GVYNEIQMPKNLL;MEGVYNEIQMPKNLLN;EGVYNEIQMPKNLLNI;GVYNEIQMPKNLLNI
S;VYNEIQMPKNLLNISF;YNEIQMPKNLLNISFR;NEIQMPKNLLNISFRS;EIQMPKNLLN
ISFRSE;IQMPKNLLNISFRSEE;QMPKNLLNISFRSEEV;MPKNLLNISFRSEEVA;PKNLL
NISFRSEEVAF;KNLLNISFRSEEVAFL;NLLNISFRSEEVAFLA;LLNISFRSEEVAFLAG;
LNISFRSEEVAFLAGY;NISFRSEEVAFLAGYF;ISFRSEEVAFLAGYFA;SFRSEEVAFLAG
YFAS;FRSEEVAFLAGYFASK;RSEEVAFLAGYFASKT;SEEVAFLAGYFASKTS;EEVAFLA
GYFASKTSK;EVAFLAGYFASKTSKT;VAFLAGYFASKTSKTG;AFLAGYFASKTSKTGK;FL
AGYFASKTSKTGKI;LAGYFASKTSKTGKIG;AGYFASKTSKTGKIGF;GYFASKTSKTGKIG
FI;YFASKTSKTGKIGFIG;FASKTSKTGKIGFIGG;ASKTSKTGKIGFIGGV;SKTSKTGKI
GFIGGVK;KTSKTGKIGFIGGVKG;TSKTGKIGFIGGVKGK;SKTGKIGFIGGVKGKV;KTGK
IGFIGGVKGKVL;TGKIGFIGGVKGKVLE;GKIGFIGGVKGKVLES;KIGFIGGVKGKVLESF
;IGFIGGVKGKVLESFM;GFIGGVKGKVLESFMY;FIGGVKGKVLESFMYG;IGGVKGKVLES
FMYGY;GGVKGKVLESFMYGYE;GVKGKVLESFMYGYEA;VKGKVLESFMYGYEAG;KGKVLE
SFMYGYEAGA;GKVLESFMYGYEAGAK;KVLESFMYGYEAGAKY;VLESFMYGYEAGAKYA;L
ESFMYGYEAGAKYAN;ESFMYGYEAGAKYANS;SFMYGYEAGAKYANST;FMYGYEAGAKYAN
STI;MYGYEAGAKYANSTIK;YGYEAGAKYANSTIKV;GYEAGAKYANSTIKVI;YEAGAKYA

Fig. 43 continued

| | |
|---|---|
| NSTIKVIS;EAGAKYANSTIKVISQ;AGAKYANSTIKVISQY;GAKYANSTIKVISQYV;AKY<br>ANSTIKVISQYVG;KYANSTIKVISQYVGT;YANSTIKVISQYVGTF;ANSTIKVISQYVGTF<br>G;NSTIKVISQYVGTFGD;STIKVISQYVGTFGDF;TIKVISQYVGTFGDFG;IKVISQYVGT<br>FGDFGL;KVISQYVGTFGDFGLG;VISQYVGTFGDFGLGR;ISQYVGTFGDFGLGRS;SQYVG<br>TFGDFGLGRST;QYVGTFGDFGLGRSTA;YVGTFGDFGLGRSTAS;VGTFGDFGLGRSTASN;<br>GTFGDFGLGRSTASNM;TFGDFGLGRSTASNMY;FGDFGLGRSTASNMYR;GDFGLGRSTASN<br>MYRD;DFGLGRSTASNMYRDG;FGLGRSTASNMYRDGV;GLGRSTASNMYRDGVD;LGRSTAS<br>NMYRDGVDI;GRSTASNMYRDGVDIV;RSTASNMYRDGVDIVF;STASNMYRDGVDIVFA;TA<br>SNMYRDGVDIVFAA;ASNMYRDGVDIVFAAA;SNMYRDGVDIVFAAAG;NMYRDGVDIVFAAA<br>GL;MYRDGVDIVFAAAGLS;YRDGVDIVFAAAGLSG;RDGVDIVFAAAGLSGI;DGVDIVFAA<br>AGLSGIG;GVDIVFAAAGLSGIGV;VDIVFAAAGLSGIGVI;DIVFAAAGLSGIGVIE;IVFA<br>AAGLSGIGVIEA;VFAAAGLSGIGVIEAA;FAAAGLSGIGVIEAAK;AAAGLSGIGVIEAAKE<br>;AAGLSGIGVIEAAKEL;AGLSGIGVIEAAKELG;GLSGIGVIEAAKELGP;LSGIGVIEAAK<br>ELGPD;SGIGVIEAAKELGPDH;GIGVIEAAKELGPDHY;IGVIEAAKELGPDHYI;GVIEAA<br>KELGPDHYII;VIEAAKELGPDHYIIG;IEAAKELGPDHYIIGV;EAAKELGPDHYIIGVD;A<br>AKELGPDHYIIGVDQ;AKELGPDHYIIGVDQD;KELGPDHYIIGVDQDQ;ELGPDHYIIGVDQ<br>DQS;LGPDHYIIGVDQDQSY;GPDHYIIGVDQDQSYL;PDHYIIGVDQDQSYLA;DHYIIGVD<br>QDQSYLAP;HYIIGVDQDQSYLAPN;YIIGVDQDQSYLAPNN;IIGVDQDQSYLAPNNV;IGV<br>DQDQSYLAPNNVL;GVDQDQSYLAPNNVLV;VDQDQSYLAPNNVLVS;DQDQSYLAPNNVLVS<br>A;QDQSYLAPNNVLVSAV;DQSYLAPNNVLVSAVK;QSYLAPNNVLVSAVKK;SYLAPNNVLV<br>SAVKKV;YLAPNNVLVSAVKKVD;LAPNNVLVSAVKKVDS;APNNVLVSAVKKVDSL;PNNVL<br>VSAVKKVDSLM;NNVLVSAVKKVDSLMY;NVLVSAVKKVDSLMYS;VLVSAVKKVDSLMYSL;<br>LVSAVKKVDSLMYSLT;VSAVKKVDSLMYSLTK;SAVKKVDSLMYSLTKK;AVKKVDSLMYSL<br>TKKY;VKKVDSLMYSLTKKYL;KKVDSLMYSLTKKYLE;KVDSLMYSLTKKYLET;VDSLMYS<br>LTKKYLETG;DSLMYSLTKKYLETGI;SLMYSLTKKYLETGIW;LMYSLTKKYLETGIWD;MY<br>SLTKKYLETGIWDG;YSLTKKYLETGIWDGG;SLTKKYLETGIWDGGK;LTKKYLETGIWDGG<br>KN;TKKYLETGIWDGGKNI;KKYLETGIWDGGKNIF;KYLETGIWDGGKNIFF;YLETGIWDG<br>GKNIFFG;LETGIWDGGKNIFFGL;ETGIWDGGKNIFFGLK;TGIWDGGKNIFFGLKE;GIWD<br>GGKNIFFGLKED;IWDGGKNIFFGLKEDG;WDGGKNIFFGLKEDGL;DGGKNIFFGLKEDGLG<br>;GGKNIFFGLKEDGLGL;GKNIFFGLKEDGLGLV;KNIFFGLKEDGLGLVL;NIFFGLKEDGL<br>GLVLN;IFFGLKEDGLGLVLNE;FFGLKEDGLGLVLNEN;FGLKEDGLGLVLNENL;GLKEDG<br>LGLVLNENLK;LKEDGLGLVLNENLKS;KEDGLGLVLNENLKSN;EDGLGLVLNENLKSNY;D<br>GLGLVLNENLKSNYS;GLGLVLNENLKSNYSE;LGLVLNENLKSNYSEI;GLVLNENLKSNYS<br>EIY;LVLNENLKSNYSEIYN;VLNENLKSNYSEIYNK;LNENLKSNYSEIYNKS;NENLKSNY<br>SEIYNKSL;ENLKSNYSEIYNKSLE;NLKSNYSEIYNKSLEI;LKSNYSEIYNKSLEIG;KSN<br>YSEIYNKSLEIGQ;SNYSEIYNKSLEIGQS;NYSEIYNKSLEIGQSI;YSEIYNKSLEIGQSI<br>M;SEIYNKSLEIGQSIME;EIYNKSLEIGQSIMEG;IYNKSLEIGQSIMEGI;YNKSLEIGQS<br>IMEGII;NKSLEIGQSIMEGIIK;KSLEIGQSIMEGIIKV;SLEIGQSIMEGIIKVP;LEIGQ<br>SIMEGIIKVPY;EIGQSIMEGIIKVPYD;IGQSIMEGIIKVPYDK;GQSIMEGIIKVPYDKA;<br>QSIMEGIIKVPYDKAS;SIMEGIIKVPYDKASY;IMEGIIKVPYDKASYD;MEGIIKVPYDKA<br>SYDN;EGIIKVPYDKASYDNF;GIIKVPYDKASYDNFV;IIKVPYDKASYDNFVL;IKVPYDK<br>ASYDNFVLQ;KVPYDKASYDNFVLQI;VPYDKASYDNFVLQIA;PYDKASYDNFVLQIAN | |
| <YP_709236.1 hypothetical protein BAPKO_4032;Borrelia afzelii<br>PKo><br>MKKINLLIFLFLFILSLSANIEENYTETKRAFSEEDFNLINKRLDNYDFKNEYEKSHVFSDAP<br>RIRRDLRKIGIKEKSVFLDALDIIEYLIKIKISADSIFLSEDMIRLIGGYPDLIFNYLIQLNS<br>DKIDYAEKYGDNARNNFKEDYSKDKTNTVKQILKQILADLPKD<br><br>8 mers:<br>MKKINLLI;KKINLLIF;KINLLIFL;INLLIFLF;NLLIFLFL;LLIFLFLF;LIFLFLFI;<br>IFLFLFIL;FLFLFILS;LFLFILSL;FLFILSLS;LFILSLSA;FILSLSAN;ILSLSANI;<br>LSLSANIE;SLSANIEE;LSANIEEN;SANIEENY;ANIEENYT;NIEENYTE;IEENYTET;<br>EENYTETK;ENYTETKR;NYTETKRA;YTETKRAF;TETKRAFS;ETKRAFSE;TKRAFSEE;<br>KRAFSEED;RAFSEEDF;AFSEEDFN;FSEEDFNL;SEEDFNLI;EEDFNLIN;EDFNLINK;<br>DFNLINKR;FNLINKRL;NLINKRLD;LINKRLDN;INKRLDNY;NKRLDNYD;KRLDNYDF;<br>RLDNYDFK;LDNYDFKN;DNYDFKNE;NYDFKNEY;YDFKNEYE;DFKNEYEK;FKNEYEKS;<br>KNEYEKSH;NEYEKSHV;EYEKSHVF;YEKSHVFS;EKSHVFSD;KSHVFSDA;SHVFSDAP; | 189926-<br>191812 |

Fig. 43 continued

| | |
|---|---|
| HVFSDAPR;VFSDAPRI;FSDAPRIR;SDAPRIRR;DAPRIRRD;APRIRRDL;PRIRRDLR;<br>RIRRDLRK;IRRDLRKI;RRDLRKIG;RDLRKIGI;DLRKIGIK;LRKIGIKE;RKIGIKEK;<br>KIGIKEKS;IGIKEKSV;GIKEKSVF;IKEKSVFL;KEKSVFLD;EKSVFLDA;KSVFLDAL;<br>SVFLDALD;VFLDALDI;FLDALDII;LDALDIIE;DALDIIEY;ALDIIEYL;LDIIEYLI;<br>DIIEYLIK;IIEYLIKI;IEYLIKIK;EYLIKIKI;YLIKIKIS;LIKIKISA;IKIKISAD;<br>KIKISADS;IKISADSI;KISADSIF;ISADSIFL;SADSIFLS;ADSIFLSE;DSIFLSED;<br>SIFLSEDM;IFLSEDMI;FLSEDMIR;LSEDMIRL;SEDMIRLI;EDMIRLIG;DMIRLIGG;<br>MIRLIGGY;IRLIGGYP;RLIGGYPD;LIGGYPDL;IGGYPDLI;GGYPDLIF;GYPDLIFN;<br>YPDLIFNY;PDLIFNYL;DLIFNYLI;LIFNYLIQ;IFNYLIQL;FNYLIQLN;NYLIQLNS;<br>YLIQLNSD;LIQLNSDK;IQLNSDKI;QLNSDKID;LNSDKIDY;NSDKIDYA;SDKIDYAE;<br>DKIDYAEK;KIDYAEKY;IDYAEKYG;DYAEKYGD;YAEKYGDN;AEKYGDNA;EKYGDNAR;<br>KYGDNARN;YGDNARNN;GDNARNNF;DNARNNFK;NARNNFKE;ARNNFKED;RNNFKEDY;<br>NNFKEDYS;NFKEDYSK;FKEDYSKD;KEDYSKDK;EDYSKDKT;DYSKDKTN;YSKDKTNT;<br>SKDKTNTV;KDKTNTVK;DKTNTVKQ;KTNTVKQI;TNTVKQIL;NTVKQILK;TVKQILKQ;<br>VKQILKQI;KQILKQIL;QILKQILA;ILKQILAD;LKQILADL;KQILADLP;QILADLPK;<br>ILADLPKD;<br><br>9 mers:<br>MKKINLLIF;KKINLLIFL;KINLLIFLF;INLLIFLFL;NLLIFLFLF;LLIFLFLFI;LIF<br>LFLFIL;IFLFLFILS;FLFLFILSL;LFLFILSLS;FLFILSLSA;LFILSLSAN;FILSLS<br>ANI;ILSLSANIE;LSLSANIEE;SLSANIEEN;LSANIEENY;SANIEENYT;ANIEENYTE<br>;NIEENYTET;IEENYTETK;EENYTETKR;ENYTETKRA;NYTETKRAF;YTETKRAFS;TE<br>TKRAFSE;ETKRAFSEE;TKRAFSEED;KRAFSEEDF;RAFSEEDFN;AFSEEDFNL;FSEED<br>FNLI;SEEDFNLIN;EEDFNLINK;EDFNLINKR;DFNLINKRL;FNLINKRLD;NLINKRLD<br>N;LINKRLDNY;INKRLDNYD;NKRLDNYDF;KRLDNYDFK;RLDNYDFKN;LDNYDFKNE;D<br>NYDFKNEY;NYDFKNEYE;YDFKNEYEK;DFKNEYEKS;FKNEYEKSH;KNEYEKSHV;NEYE<br>KSHVF;EYEKSHVFS;YEKSHVFSD;EKSHVFSDA;KSHVFSDAP;SHVFSDAPR;HVFSDAP<br>RI;VFSDAPRIR;FSDAPRIRR;SDAPRIRRD;DAPRIRRDL;APRIRRDLR;PRIRRDLRK;<br>RIRRDLRKI;IRRDLRKIG;RRDLRKIGI;RDLRKIGIK;DLRKIGIKE;LRKIGIKEK;RKI<br>GIKEKS;KIGIKEKSV;IGIKEKSVF;GIKEKSVFL;IKEKSVFLD;KEKSVFLDA;EKSVFL<br>DAL;KSVFLDALD;SVFLDALDI;VFLDALDII;FLDALDIIE;LDALDIIEY;DALDIIEYL<br>;ALDIIEYLI;LDIIEYLIK;DIIEYLIKI;IIEYLIKIK;IEYLIKIKI;EYLIKIKIS;YL<br>IKIKISA;LIKIKISAD;IKIKISADS;KIKISADSI;IKISADSIF;KISADSIFL;ISADS<br>IFLS;SADSIFLSE;ADSIFLSED;DSIFLSEDM;SIFLSEDMI;IFLSEDMIR;FLSEDMIR<br>L;LSEDMIRLI;SEDMIRLIG;EDMIRLIGG;DMIRLIGGY;MIRLIGGYP;IRLIGGYPD;R<br>LIGGYPDL;LIGGYPDLI;IGGYPDLIF;GGYPDLIFN;GYPDLIFNY;YPDLIFNYL;PDLI<br>FNYLI;DLIFNYLIQ;LIFNYLIQL;IFNYLIQLN;FNYLIQLNS;NYLIQLNSD;YLIQLNS<br>DK;LIQLNSDKI;IQLNSDKID;QLNSDKIDY;LNSDKIDYA;NSDKIDYAE;SDKIDYAEK;<br>DKIDYAEKY;KIDYAEKYG;IDYAEKYGD;DYAEKYGDN;YAEKYGDNA;AEKYGDNAR;EKY<br>GDNARN;KYGDNARNN;YGDNARNNF;GDNARNNFK;DNARNNFKE;NARNNFKED;ARNNFK<br>EDY;RNNFKEDYS;NNFKEDYSK;NFKEDYSKD;FKEDYSKDK;KEDYSKDKT;EDYSKDKTN<br>;DYSKDKTNT;YSKDKTNTV;SKDKTNTVK;KDKTNTVKQ;DKTNTVKQI;KTNTVKQIL;TN<br>TVKQILK;NTVKQILKQ;TVKQILKQI;VKQILKQIL;KQILKQILA;QILKQILAD;ILKQI<br>LADL;LKQILADLP;KQILADLPK;QILADLPKD;<br><br>10 mers:<br>MKKINLLIFL;KKINLLIFLF;KINLLIFLFL;INLLIFLFLF;NLLIFLFLFI;LLIFLFLF<br>IL;LIFLFLFILS;IFLFLFILSL;FLFLFILSLS;LFLFILSLSA;FLFILSLSAN;LFILS<br>LSANI;FILSLSANIE;ILSLSANIEE;LSLSANIEEN;SLSANIEENY;LSANIEENYT;SA<br>NIEENYTE;ANIEENYTET;NIEENYTETK;IEENYTETKR;EENYTETKRA;ENYTETKRAF<br>;NYTETKRAFS;YTETKRAFSE;TETKRAFSEE;ETKRAFSEED;TKRAFSEEDF;KRAFSEE<br>DFN;RAFSEEDFNL;AFSEEDFNLI;FSEEDFNLIN;SEEDFNLINK;EEDFNLINKR;EDFN<br>LINKRL;DFNLINKRLD;FNLINKRLDN;NLINKRLDNY;LINKRLDNYD;INKRLDNYDF;N<br>KRLDNYDFK;KRLDNYDFKN;RLDNYDFKNE;LDNYDFKNEY;DNYDFKNEYE;NYDFKNEYE<br>K;YDFKNEYEKS;DFKNEYEKSH;FKNEYEKSHV;KNEYEKSHVF;NEYEKSHVFS;EYEKSH<br>VFSD;YEKSHVFSDA;EKSHVFSDAP;KSHVFSDAPR;SHVFSDAPRI;HVFSDAPRIR;VFS<br>DAPRIRR;FSDAPRIRRD;SDAPRIRRDL;DAPRIRRDLR;APRIRRDLRK;PRIRRDLRKI; | |

Fig. 43 continued

RIRRDLRKIG;IRRDLRKIGI;RRDLRKIGIK;RDLRKIGIKE;DLRKIGIKEK;LRKIGIKE
KS;RKIGIKEKSV;KIGIKEKSVF;IGIKEKSVFL;GIKEKSVFLD;IKEKSVFLDA;KEKSV
FLDAL;EKSVFLDALD;KSVFLDALDI;SVFLDALDII;VFLDALDIIE;FLDALDIIEY;LD
ALDIIEYL;DALDIIEYLI;ALDIIEYLIK;LDIIEYLIKI;DIIEYLIKIK;IIEYLIKIKI
;IEYLIKIKIS;EYLIKIKISA;YLIKIKISAD;LIKIKISADS;IKIKISADSI;KIKISAD
SIF;IKISADSIFL;KISADSIFLS;ISADSIFLSE;SADSIFLSED;ADSIFLSEDM;DSIF
LSEDMI;SIFLSEDMIR;IFLSEDMIRL;FLSEDMIRLI;LSEDMIRLIG;SEDMIRLIGG;E
DMIRLIGGY;DMIRLIGGYP;MIRLIGGYPD;IRLIGGYPDL;RLIGGYPDLI;LIGGYPDLI
F;IGGYPDLIFN;GGYPDLIFNY;GYPDLIFNYL;YPDLIFNYLI;PDLIFNYLIQ;DLIFNY
LIQL;LIFNYLIQLN;IFNYLIQLNS;FNYLIQLNSD;NYLIQLNSDK;YLIQLNSDKI;LIQ
LNSDKID;IQLNSDKIDY;QLNSDKIDYA;LNSDKIDYAE;NSDKIDYAEK;SDKIDYAEKY;
DKIDYAEKYG;KIDYAEKYGD;IDYAEKYGDN;DYAEKYGDNA;YAEKYGDNAR;AEKYGDNA
RN;EKYGDNARNN;KYGDNARNNF;YGDNARNNFK;GDNARNNFKE;DNARNNFKED;NARNN
FKEDY;ARNNFKEDYS;RNNFKEDYSK;NNFKEDYSKD;NFKEDYSKDK;FKEDYSKDKT;KE
DYSKDKTN;EDYSKDKTNT;DYSKDKTNTV;YSKDKTNTVK;SKDKTNTVKQ;KDKTNTVKQI
;DKTNTVKQIL;KTNTVKQILK;TNTVKQILKQ;NTVKQILKQI;TVKQILKQIL;VKQILKQ
ILA;KQILKQILAD;QILKQILADL;ILKQILADLP;LKQILADLPK;KQILADLPKD;

11 mers:
MKKINLLIFLF;KKINLLIFLFL;KINLLIFLFLF;INLLIFLFLFI;NLLIFLFLFIL;LLI
FLFLFILS;LIFLFLFILSL;IFLFLFILSLS;FLFLFILSLSA;LFLFILSLSAN;FLFILS
LSANI;LFILSLSANIE;FILSLSANIEE;ILSLSANIEEN;LSLSANIEENY;SLSANIEEN
YT;LSANIEENYTE;SANIEENYTET;ANIEENYTETK;NIEENYTETKR;IEENYTETKRA;
EENYTETKRAF;ENYTETKRAFS;NYTETKRAFSE;YTETKRAFSEE;TETKRAFSEED;ETK
RAFSEEDF;TKRAFSEEDFN;KRAFSEEDFNL;RAFSEEDFNLI;AFSEEDFNLIN;FSEEDF
NLINK;SEEDFNLINKR;EEDFNLINKRL;EDFNLINKRLD;DFNLINKRLDN;FNLINKRLD
NY;NLINKRLDNYD;LINKRLDNYDF;INKRLDNYDFK;NKRLDNYDFKN;KRLDNYDFKNE;
RLDNYDFKNEY;LDNYDFKNEYE;DNYDFKNEYEK;NYDFKNEYEKS;YDFKNEYEKSH;DFK
NEYEKSHV;FKNEYEKSHVF;KNEYEKSHVFS;NEYEKSHVFSD;EYEKSHVFSDA;YEKSHV
FSDAP;EKSHVFSDAPR;KSHVFSDAPRI;SHVFSDAPRIR;HVFSDAPRIRR;VFSDAPRIR
RD;FSDAPRIRRDL;SDAPRIRRDLR;DAPRIRRDLRK;APRIRRDLRKI;PRIRRDLRKIG;
RIRRDLRKIGI;IRRDLRKIGIK;RRDLRKIGIKE;RDLRKIGIKEK;DLRKIGIKEKS;LRK
IGIKEKSV;RKIGIKEKSVF;KIGIKEKSVFL;IGIKEKSVFLD;GIKEKSVFLDA;IKEKSV
FLDAL;KEKSVFLDALD;EKSVFLDALDI;KSVFLDALDII;SVFLDALDIIE;VFLDALDII
EY;FLDALDIIEYL;LDALDIIEYLI;DALDIIEYLIK;ALDIIEYLIKI;LDIIEYLIKIK;
DIIEYLIKIKI;IIEYLIKIKIS;IEYLIKIKISA;EYLIKIKISAD;YLIKIKISADS;LIK
IKISADSI;IKIKISADSIF;KIKISADSIFL;IKISADSIFLS;KISADSIFLSE;ISADSI
FLSED;SADSIFLSEDM;ADSIFLSEDMI;DSIFLSEDMIR;SIFLSEDMIRL;IFLSEDMIR
LI;FLSEDMIRLIG;LSEDMIRLIGG;SEDMIRLIGGY;EDMIRLIGGYP;DMIRLIGGYPD;
MIRLIGGYPDL;IRLIGGYPDLI;RLIGGYPDLIF;LIGGYPDLIFN;IGGYPDLIFNY;GGY
PDLIFNYL;GYPDLIFNYLI;YPDLIFNYLIQ;PDLIFNYLIQL;DLIFNYLIQLN;LIFNYL
IQLNS;IFNYLIQLNSD;FNYLIQLNSDK;NYLIQLNSDKI;YLIQLNSDKID;LIQLNSDKI
DY;IQLNSDKIDYA;QLNSDKIDYAE;LNSDKIDYAEK;NSDKIDYAEKY;SDKIDYAEKYG;
DKIDYAEKYGD;KIDYAEKYGDN;IDYAEKYGDNA;DYAEKYGDNAR;YAEKYGDNARN;AEK
YGDNARNN;EKYGDNARNNF;KYGDNARNNFK;YGDNARNNFKE;GDNARNNFKED;DNARNN
FKEDY;NARNNFKEDYS;ARNNFKEDYSK;RNNFKEDYSKD;NNFKEDYSKDK;NFKEDYSKD
KT;FKEDYSKDKTN;KEDYSKDKTNT;EDYSKDKTNTV;DYSKDKTNTVK;YSKDKTNTVKQ;
SKDKTNTVKQI;KDKTNTVKQIL;DKTNTVKQILK;KTNTVKQILKQ;TNTVKQILKQI;NTV
KQILKQIL;TVKQILKQILA;VKQILKQILAD;KQILKQILADL;QILKQILADLP;ILKQIL
ADLPK;LKQILADLPKD;

13 mers:
MKKINLLIFLFLF;KKINLLIFLFLFI;KINLLIFLFLFIL;INLLIFLFLFILS;NLLIFLF
LFILSL;LLIFLFLFILSLS;LIFLFLFILSLSA;IFLFLFILSLSAN;FLFLFILSLSANI;
LFLFILSLSANIE;FLFILSLSANIEE;LFILSLSANIEEN;FILSLSANIEENY;ILSLSAN
IEENYT;LSLSANIEENYTE;SLSANIEENYTET;LSANIEENYTETK;SANIEENYTETKR;
ANIEENYTETKRA;NIEENYTETKRAF;IEENYTETKRAFS;EENYTETKRAFSE;ENYTETK

Fig. 43 continued

RAFSEE;NYTETKRAFSEED;YTETKRAFSEEDF;TETKRAFSEEDFN;ETKRAFSEEDFNL;
TKRAFSEEDFNLI;KRAFSEEDFNLIN;RAFSEEDFNLINK;AFSEEDFNLINKR;FSEEDFN
LINKRL;SEEDFNLINKRLD;EEDFNLINKRLDN;EDFNLINKRLDNY;DFNLINKRLDNYD;
FNLINKRLDNYDF;NLINKRLDNYDFK;LINKRLDNYDFKN;INKRLDNYDFKNE;NKRLDNY
DFKNEY;KRLDNYDFKNEYE;RLDNYDFKNEYEK;LDNYDFKNEYEKS;DNYDFKNEYEKSH;
NYDFKNEYEKSHV;YDFKNEYEKSHVF;DFKNEYEKSHVFS;FKNEYEKSHVFSD;KNEYEKS
HVFSDA;NEYEKSHVFSDAP;EYEKSHVFSDAPR;YEKSHVFSDAPRI;EKSHVFSDAPRIR;
KSHVFSDAPRIRR;SHVFSDAPRIRRD;HVFSDAPRIRRDL;VFSDAPRIRRDLR;FSDAPRI
RRDLRK;SDAPRIRRDLRKI;DAPRIRRDLRKIG;APRIRRDLRKIGI;PRIRRDLRKIGIK;
RIRRDLRKIGIKE;IRRDLRKIGIKEK;RRDLRKIGIKEKS;RDLRKIGIKEKSV;DLRKIGI
KEKSVF;LRKIGIKEKSVFL;RKIGIKEKSVFLD;KIGIKEKSVFLDA;IGIKEKSVFLDAL;
GIKEKSVFLDALD;IKEKSVFLDALDI;KEKSVFLDALDII;EKSVFLDALDIIE;KSVFLDA
LDIIEY;SVFLDALDIIEYL;VFLDALDIIEYLI;FLDALDIIEYLIK;LDALDIIEYLIKI;
DALDIIEYLIKIK;ALDIIEYLIKIKI;LDIIEYLIKIKIS;DIIEYLIKIKISA;IIEYLIK
IKISAD;IEYLIKIKISADS;EYLIKIKISADSI;YLIKIKISADSIF;LIKIKISADSIFL;
IKIKISADSIFLS;KIKISADSIFLSE;IKISADSIFLSED;KISADSIFLSEDM;ISADSIF
LSEDMI;SADSIFLSEDMIR;ADSIFLSEDMIRL;DSIFLSEDMIRLI;SIFLSEDMIRLIG;
IFLSEDMIRLIGG;FLSEDMIRLIGGY;LSEDMIRLIGGYP;SEDMIRLIGGYPD;EDMIRLI
GGYPDL;DMIRLIGGYPDLI;MIRLIGGYPDLIF;IRLIGGYPDLIFN;RLIGGYPDLIFNY;
LIGGYPDLIFNYL;IGGYPDLIFNYLI;GGYPDLIFNYLIQ;GYPDLIFNYLIQL;YPDLIFN
YLIQLN;PDLIFNYLIQLNS;DLIFNYLIQLNSD;LIFNYLIQLNSDK;IFNYLIQLNSDKI;
FNYLIQLNSDKID;NYLIQLNSDKIDY;YLIQLNSDKIDYA;LIQLNSDKIDYAE;IQLNSDK
IDYAEK;QLNSDKIDYAEKY;LNSDKIDYAEKYG;NSDKIDYAEKYGD;SDKIDYAEKYGDN;
DKIDYAEKYGDNA;KIDYAEKYGDNAR;IDYAEKYGDNARN;DYAEKYGDNARNN;YAEKYGD
NARNNF;AEKYGDNARNNFK;EKYGDNARNNFKE;KYGDNARNNFKED;YGDNARNNFKEDY;
GDNARNNFKEDYS;DNARNNFKEDYSK;NARNNFKEDYSKD;ARNNFKEDYSKDK;RNNFKED
YSKDKT;NNFKEDYSKDKTN;NFKEDYSKDKTNT;FKEDYSKDKTNTV;KEDYSKDKTNTVK;
EDYSKDKTNTVKQ;DYSKDKTNTVKQI;YSKDKTNTVKQIL;SKDKTNTVKQILK;KDKTNTV
KQILKQ;DKTNTVKQILKQI;KTNTVKQILKQIL;TNTVKQILKQILA;NTVKQILKQILAD;
TVKQILKQILADL;VKQILKQILADLP;KQILKQILADLPK;QILKQILADLPKD;

14 mers:
MKKINLLIFLFLFI;KKINLLIFLFLFIL;KINLLIFLFLFILS;INLLIFLFLFILSL;NLL
IFLFLFILSLS;LLIFLFLFILSLSA;LIFLFLFILSLSAN;IFLFLFILSLSANI;FLFLFI
LSLSANIE;LFLFILSLSANIEE;FLFILSLSANIEEN;LFILSLSANIEENY;FILSLSANI
EENYT;ILSLSANIEENYTE;LSLSANIEENYTET;SLSANIEENYTETK;LSANIEENYTET
KR;SANIEENYTETKRA;ANIEENYTETKRAF;NIEENYTETKRAFS;IEENYTETKRAFSE;
EENYTETKRAFSEE;ENYTETKRAFSEED;NYTETKRAFSEEDF;YTETKRAFSEEDFN;TET
KRAFSEEDFNL;ETKRAFSEEDFNLI;TKRAFSEEDFNLIN;KRAFSEEDFNLINK;RAFSEE
DFNLINKR;AFSEEDFNLINKRL;FSEEDFNLINKRLD;SEEDFNLINKRLDN;EEDFNLINK
RLDNY;EDFNLINKRLDNYD;DFNLINKRLDNYDF;FNLINKRLDNYDFK;NLINKRLDNYDF
KN;LINKRLDNYDFKNE;INKRLDNYDFKNEY;NKRLDNYDFKNEYE;KRLDNYDFKNEYEK;
RLDNYDFKNEYEKS;LDNYDFKNEYEKSH;DNYDFKNEYEKSHV;NYDFKNEYEKSHVF;YDF
KNEYEKSHVFS;DFKNEYEKSHVFSD;FKNEYEKSHVFSDA;KNEYEKSHVFSDAP;NEYEKS
HVFSDAPR;EYEKSHVFSDAPRI;YEKSHVFSDAPRIR;EKSHVFSDAPRIRR;KSHVFSDAP
RIRRD;SHVFSDAPRIRRDL;HVFSDAPRIRRDLR;VFSDAPRIRRDLRK;FSDAPRIRRDLR
KI;SDAPRIRRDLRKIG;DAPRIRRDLRKIGI;APRIRRDLRKIGIK;PRIRRDLRKIGIKE;
RIRRDLRKIGIKEK;IRRDLRKIGIKEKS;RRDLRKIGIKEKSV;RDLRKIGIKEKSVF;DLR
KIGIKEKSVFL;LRKIGIKEKSVFLD;RKIGIKEKSVFLDA;KIGIKEKSVFLDAL;IGIKEK
SVFLDALD;GIKEKSVFLDALDI;IKEKSVFLDALDII;KEKSVFLDALDIIE;EKSVFLDAL
DIIEY;KSVFLDALDIIEYL;SVFLDALDIIEYLI;VFLDALDIIEYLIK;FLDALDIIEYLI
KI;LDALDIIEYLIKIK;DALDIIEYLIKIKI;ALDIIEYLIKIKIS;LDIIEYLIKIKISA;
DIIEYLIKIKISAD;IIEYLIKIKISADS;IEYLIKIKISADSI;EYLIKIKISADSIF;YLI
KIKISADSIFL;LIKIKISADSIFLS;IKIKISADSIFLSE;KIKISADSIFLSED;IKISAD
SIFLSEDM;KISADSIFLSEDMI;ISADSIFLSEDMIR;SADSIFLSEDMIRL;ADSIFLSED
MIRLI;DSIFLSEDMIRLIG;SIFLSEDMIRLIGG;IFLSEDMIRLIGGY;FLSEDMIRLIGG
YP;LSEDMIRLIGGYPD;SEDMIRLIGGYPDL;EDMIRLIGGYPDLI;DMIRLIGGYPDLIF;

Fig. 43 continued

MIRLIGGYPDLIFN; IRLIGGYPDLIFNY; RLIGGYPDLIFNYL; LIGGYPDLIFNYLI; IGG
YPDLIFNYLIQ; GGYPDLIFNYLIQL; GYPDLIFNYLIQLN; YPDLIFNYLIQLNS; PDLIFN
YLIQLNSD; DLIFNYLIQLNSDK; LIFNYLIQLNSDKI; IFNYLIQLNSDKID; FNYLIQLNS
DKIDY; NYLIQLNSDKIDYA; YLIQLNSDKIDYAE; LIQLNSDKIDYAEK; IQLNSDKIDYAE
KY; QLNSDKIDYAEKYG; LNSDKIDYAEKYGD; NSDKIDYAEKYGDN; SDKIDYAEKYGDNA;
DKIDYAEKYGDNAR; KIDYAEKYGDNARN; IDYAEKYGDNARNN; DYAEKYGDNARNNF; YAE
KYGDNARNNFK; AEKYGDNARNNFKE; EKYGDNARNNFKED; KYGDNARNNFKEDY; YGDNAR
NNFKEDYS; GDNARNNFKEDYSK; DNARNNFKEDYSKD; NARNNFKEDYSKDK; ARNNFKEDY
SKDKT; RNNFKEDYSKDKTN; NNFKEDYSKDKTNT; NFKEDYSKDKTNTV; FKEDYSKDKTNT
VK;KEDYSKDKTNTVKQ;EDYSKDKTNTVKQI;DYSKDKTNTVKQIL;YSKDKTNTVKQILK;
SKDKTNTVKQILKQ;KDKTNTVKQILKQI;DKTNTVKQILKQIL;KTNTVKQILKQILA;TNT
VKQILKQILAD;NTVKQILKQILADL;TVKQILKQILADLP;VKQILKQILADLPK;KQILKQ
ILADLPKD;

15 mers:
MKKINLLIFLFLFIL;KKINLLIFLFLFILS;KINLLIFLFLFILSL;INLLIFLFLFILSLS
;NLLIFLFLFILSLSA;LLIFLFLFILSLSAN;LIFLFLFILSLSANI;IFLFLFILSLSANI
E;FLFLFILSLSANIEE;LFLFILSLSANIEEN;FLFILSLSANIEENY;LFILSLSANIEEN
YT;FILSLSANIEENYTE;ILSLSANIEENYTET;LSLSANIEENYTETK;SLSANIEENYTE
TKR;LSANIEENYTETKRA;SANIEENYTETKRAF;ANIEENYTETKRAFS;NIEENYTETKR
AFSE;IEENYTETKRAFSEE;EENYTETKRAFSEED;ENYTETKRAFSEEDF;NYTETKRAFS
EEDFN;YTETKRAFSEEDFNL;TETKRAFSEEDFNLI;ETKRAFSEEDFNLIN;TKRAFSEED
FNLINK;KRAFSEEDFNLINKR;RAFSEEDFNLINKRL;AFSEEDFNLINKRLD;FSEEDFNL
INKRLDN;SEEDFNLINKRLDNY;EEDFNLINKRLDNYD;EDFNLINKRLDNYDF;DFNLINK
RLDNYDFK;FNLINKRLDNYDFKN;NLINKRLDNYDFKNE;LINKRLDNYDFKNEY;INKRLD
NYDFKNEYE;NKRLDNYDFKNEYEK;KRLDNYDFKNEYEKS;RLDNYDFKNEYEKSH;LDNYD
FKNEYEKSHV;DNYDFKNEYEKSHVF;NYDFKNEYEKSHVFS;YDFKNEYEKSHVFSD;DFKN
EYEKSHVFSDA;FKNEYEKSHVFSDAP;KNEYEKSHVFSDAPR;NEYEKSHVFSDAPRI;EYE
KSHVFSDAPRIR;YEKSHVFSDAPRIRR;EKSHVFSDAPRIRRD;KSHVFSDAPRIRRDL;SH
VFSDAPRIRRDLR;HVFSDAPRIRRDLRK;VFSDAPRIRRDLRKI;FSDAPRIRRDLRKIG;S
DAPRIRRDLRKIGI;DAPRIRRDLRKIGIK;APRIRRDLRKIGIKE;PRIRRDLRKIGIKEK;
RIRRDLRKIGIKEKS;IRRDLRKIGIKEKSV;RRDLRKIGIKEKSVF;RDLRKIGIKEKSVFL
;DLRKIGIKEKSVFLD;LRKIGIKEKSVFLDA;RKIGIKEKSVFLDAL;KIGIKEKSVFLDAL
D;IGIKEKSVFLDALDI;GIKEKSVFLDALDII;IKEKSVFLDALDIIE;KEKSVFLDALDII
EY;EKSVFLDALDIIEYL;KSVFLDALDIIEYLI;SVFLDALDIIEYLIK;VFLDALDIIEYL
IKI;FLDALDIIEYLIKIK;LDALDIIEYLIKIKI;DALDIIEYLIKIKIS;ALDIIEYLIKI
KISA;LDIIEYLIKIKISAD;DIIEYLIKIKISADS;IIEYLIKIKISADSI;IEYLIKIKIS
ADSIF;EYLIKIKISADSIFL;YLIKIKISADSIFLS;LIKIKISADSIFLSE;IKIKISADS
IFLSED;KIKISADSIFLSEDM;IKISADSIFLSEDMI;KISADSIFLSEDMIR;ISADSIFL
SEDMIRL;SADSIFLSEDMIRLI;ADSIFLSEDMIRLIG;DSIFLSEDMIRLIGG;SIFLSED
MIRLIGGY;IFLSEDMIRLIGGYP;FLSEDMIRLIGGYPD;LSEDMIRLIGGYPDL;SEDMIR
LIGGYPDLI;EDMIRLIGGYPDLIF;DMIRLIGGYPDLIFN;MIRLIGGYPDLIFNY;IRLIG
GYPDLIFNYL;RLIGGYPDLIFNYLI;LIGGYPDLIFNYLIQ;IGGYPDLIFNYLIQL;GGYP
DLIFNYLIQLN;GYPDLIFNYLIQLNS;YPDLIFNYLIQLNSD;PDLIFNYLIQLNSDK;DLI
FNYLIQLNSDKI;LIFNYLIQLNSDKID;IFNYLIQLNSDKIDY;FNYLIQLNSDKIDYA;NY
LIQLNSDKIDYAE;YLIQLNSDKIDYAEK;LIQLNSDKIDYAEKY;IQLNSDKIDYAEKYG;Q
LNSDKIDYAEKYGD;LNSDKIDYAEKYGDN;NSDKIDYAEKYGDNA;SDKIDYAEKYGDNAR;
DKIDYAEKYGDNARN;KIDYAEKYGDNARNN;IDYAEKYGDNARNNF;DYAEKYGDNARNNFK
;YAEKYGDNARNNFKE;AEKYGDNARNNFKED;EKYGDNARNNFKEDY;KYGDNARNNFKEDY
S;YGDNARNNFKEDYSK;GDNARNNFKEDYSKD;DNARNNFKEDYSKDK;NARNNFKEDYSKD
KT;ARNNFKEDYSKDKTN;RNNFKEDYSKDKTNT;NNFKEDYSKDKTNTV;NFKEDYSKDKTN
TVK;FKEDYSKDKTNTVKQ;KEDYSKDKTNTVKQI;EDYSKDKTNTVKQIL;DYSKDKTNTVK
QILK;YSKDKTNTVKQILKQ;SKDKTNTVKQILKQI;KDKTNTVKQILKQIL;DKTNTVKQIL
KQILA;KTNTVKQILKQILAD;TNTVKQILKQILADL;NTVKQILKQILADLP;TVKQILKQI
LADLPK;VKQILKQILADLPKD;

16 mers:

Fig. 43 continued

MKKINLLIFLFLFILS;KKINLLIFLFLFILSL;KINLLIFLFLFILSLS;INLLIFLFLFIL
SLSA;NLLIFLFLFILSLSAN;LLIFLFLFILSLSANI;LIFLFLFILSLSANIE;IFLFLFI
LSLSANIEE;FLFLFILSLSANIEEN;LFLFILSLSANIEENY;FLFILSLSANIEENYT;LF
ILSLSANIEENYTE;FILSLSANIEENYTET;ILSLSANIEENYTETK;LSLSANIEENYTET
KR;SLSANIEENYTETKRA;LSANIEENYTETKRAF;SANIEENYTETKRAFS;ANIEENYTE
TKRAFSE;NIEENYTETKRAFSEE;IEENYTETKRAFSEED;EENYTETKRAFSEEDF;ENYT
ETKRAFSEEDFN;NYTETKRAFSEEDFNL;YTETKRAFSEEDFNLI;TETKRAFSEEDFNLIN
;ETKRAFSEEDFNLINK;TKRAFSEEDFNLINKR;KRAFSEEDFNLINKRL;RAFSEEDFNLI
NKRLD;AFSEEDFNLINKRLDN;FSEEDFNLINKRLDNY;SEEDFNLINKRLDNYD;EEDFNL
INKRLDNYDF;EDFNLINKRLDNYDFK;DFNLINKRLDNYDFKN;FNLINKRLDNYDFKNE;N
LINKRLDNYDFKNEY;LINKRLDNYDFKNEYE;INKRLDNYDFKNEYEK;NKRLDNYDFKNEY
EKS;KRLDNYDFKNEYEKSH;RLDNYDFKNEYEKSHV;LDNYDFKNEYEKSHVF;DNYDFKNE
YEKSHVFS;NYDFKNEYEKSHVFSD;YDFKNEYEKSHVFSDA;DFKNEYEKSHVFSDAP;FKN
EYEKSHVFSDAPR;KNEYEKSHVFSDAPRI;NEYEKSHVFSDAPRIR;EYEKSHVFSDAPRIR
R;YEKSHVFSDAPRIRRD;EKSHVFSDAPRIRRDL;KSHVFSDAPRIRRDLR;SHVFSDAPRI
RRDLRK;HVFSDAPRIRRDLRKI;VFSDAPRIRRDLRKIG;FSDAPRIRRDLRKIGI;SDAPR
IRRDLRKIGIK;DAPRIRRDLRKIGIKE;APRIRRDLRKIGIKEK;PRIRRDLRKIGIKEKS;
RIRRDLRKIGIKEKSV;IRRDLRKIGIKEKSVF;RRDLRKIGIKEKSVFL;RDLRKIGIKEKS
VFLD;DLRKIGIKEKSVFLDA;LRKIGIKEKSVFLDAL;RKIGIKEKSVFLDALD;KIGIKEK
SVFLDALDI;IGIKEKSVFLDALDII;GIKEKSVFLDALDIIE;IKEKSVFLDALDIIEY;KE
KSVFLDALDIIEYL;EKSVFLDALDIIEYLI;KSVFLDALDIIEYLIK;SVFLDALDIIEYLI
KI;VFLDALDIIEYLIKIK;FLDALDIIEYLIKIKI;LDALDIIEYLIKIKIS;DALDIIEYL
IKIKISA;ALDIIEYLIKIKISAD;LDIIEYLIKIKISADS;DIIEYLIKIKISADSI;IIEY
LIKIKISADSIF;IEYLIKIKISADSIFL;EYLIKIKISADSIFLS;YLIKIKISADSIFLSE
;LIKIKISADSIFLSED;IKIKISADSIFLSEDM;KIKISADSIFLSEDMI;IKISADSIFLS
EDMIR;KISADSIFLSEDMIRL;ISADSIFLSEDMIRLI;SADSIFLSEDMIRLIG;ADSIFL
SEDMIRLIGG;DSIFLSEDMIRLIGGY;SIFLSEDMIRLIGGYP;IFLSEDMIRLIGGYPD;F
LSEDMIRLIGGYPDL;LSEDMIRLIGGYPDLI;SEDMIRLIGGYPDLIF;EDMIRLIGGYPDL
IFN;DMIRLIGGYPDLIFNY;MIRLIGGYPDLIFNYL;IRLIGGYPDLIFNYLI;RLIGGYPD
LIFNYLIQ;LIGGYPDLIFNYLIQL;IGGYPDLIFNYLIQLN;GGYPDLIFNYLIQLNS;GYP
DLIFNYLIQLNSD;YPDLIFNYLIQLNSDK;PDLIFNYLIQLNSDKI;DLIFNYLIQLNSDKI
D;LIFNYLIQLNSDKIDY;IFNYLIQLNSDKIDYA;FNYLIQLNSDKIDYAE;NYLIQLNSDK
IDYAEK;YLIQLNSDKIDYAEKY;LIQLNSDKIDYAEKYG;IQLNSDKIDYAEKYGD;QLNSD
KIDYAEKYGDN;LNSDKIDYAEKYGDNA;NSDKIDYAEKYGDNAR;SDKIDYAEKYGDNARN;
DKIDYAEKYGDNARNN;KIDYAEKYGDNARNNF;IDYAEKYGDNARNNFK;DYAEKYGDNARN
NFKE;YAEKYGDNARNNFKED;AEKYGDNARNNFKEDY;EKYGDNARNNFKEDYS;KYGDNAR
NNFKEDYSK;YGDNARNNFKEDYSKD;GDNARNNFKEDYSKDK;DNARNNFKEDYSKDKT;NA
RNNFKEDYSKDKTN;ARNNFKEDYSKDKTNT;RNNFKEDYSKDKTNTV;NNFKEDYSKDKTNT
VK;NFKEDYSKDKTNTVKQ;FKEDYSKDKTNTVKQI;KEDYSKDKTNTVKQIL;EDYSKDKTN
TVKQILK;DYSKDKTNTVKQILKQ;YSKDKTNTVKQILKQI;SKDKTNTVKQILKQIL;KDKT
NTVKQILKQILA;DKTNTVKQILKQILAD;KTNTVKQILKQILADL;TNTVKQILKQILADLP
;NTVKQILKQILADLPK;TVKQILKQILADLPKD;

13 mers:
MKKINLLIFLFLF;KKINLLIFLFLFI;KINLLIFLFLFIL;INLLIFLFLFILS;NLLIFLF
LFILSL;LLIFLFLFILSLS;LIFLFLFILSLSA;IFLFLFILSLSAN;FLFLFILSLSANI;
LFLFILSLSANIE;FLFILSLSANIEE;LFILSLSANIEEN;FILSLSANIEENY;ILSLSAN
IEENYT;LSLSANIEENYTE;SLSANIEENYTET;LSANIEENYTETK;SANIEENYTETKR;
ANIEENYTETKRA;NIEENYTETKRAF;IEENYTETKRAFS;EENYTETKRAFSE;ENYTETK
RAFSEE;NYTETKRAFSEED;YTETKRAFSEEDF;TETKRAFSEEDFN;ETKRAFSEEDFNL;
TKRAFSEEDFNLI;KRAFSEEDFNLIN;RAFSEEDFNLINK;AFSEEDFNLINKR;FSEEDFN
LINKRL;SEEDFNLINKRLD;EEDFNLINKRLDN;EDFNLINKRLDNY;DFNLINKRLDNYD;
FNLINKRLDNYDF;NLINKRLDNYDFK;LINKRLDNYDFKN;INKRLDNYDFKNE;NKRLDNY
DFKNEY;KRLDNYDFKNEYE;RLDNYDFKNEYEK;LDNYDFKNEYEKS;DNYDFKNEYEKSH;
NYDFKNEYEKSHV;YDFKNEYEKSHVF;DFKNEYEKSHVFS;FKNEYEKSHVFSD;KNEYEKS
HVFSDA;NEYEKSHVFSDAP;EYEKSHVFSDAPR;YEKSHVFSDAPRI;EKSHVFSDAPRIR;
KSHVFSDAPRIRR;SHVFSDAPRIRRD;HVFSDAPRIRRDL;VFSDAPRIRRDLR;FSDAPRI

Fig. 43 continued

RRDLRK;SDAPRIRRDLRKI;DAPRIRRDLRKIG;APRIRRDLRKIGI;PRIRRDLRKIGIK;
RIRRDLRKIGIKE;IRRDLRKIGIKEK;RRDLRKIGIKEKS;RDLRKIGIKEKSV;DLRKIGI
KEKSVF;LRKIGIKEKSVFL;RKIGIKEKSVFLD;KIGIKEKSVFLDA;IGIKEKSVFLDAL;
GIKEKSVFLDALD;IKEKSVFLDALDI;KEKSVFLDALDII;EKSVFLDALDIIE;KSVFLDA
LDIIEY;SVFLDALDIIEYL;VFLDALDIIEYLI;FLDALDIIEYLIK;LDALDIIEYLIKI;
DALDIIEYLIKIK;ALDIIEYLIKIKI;LDIIEYLIKIKIS;DIIEYLIKIKISA;IIEYLIK
IKISAD;IEYLIKIKISADS;EYLIKIKISADSI;YLIKIKISADSIF;LIKIKISADSIFL;
IKIKISADSIFLS;KIKISADSIFLSE;IKISADSIFLSED;KISADSIFLSEDM;ISADSIF
LSEDMI;SADSIFLSEDMIR;ADSIFLSEDMIRL;DSIFLSEDMIRLI;SIFLSEDMIRLIG;
IFLSEDMIRLIGG;FLSEDMIRLIGGY;LSEDMIRLIGGYP;SEDMIRLIGGYPD;EDMIRLI
GGYPDL;DMIRLIGGYPDLI;MIRLIGGYPDLIF;IRLIGGYPDLIFN;RLIGGYPDLIFNY;
LIGGYPDLIFNYL;IGGYPDLIFNYLI;GGYPDLIFNYLIQ;GYPDLIFNYLIQL;YPDLIFN
YLIQLN;PDLIFNYLIQLNS;DLIFNYLIQLNSD;LIFNYLIQLNSDK;IFNYLIQLNSDKI;
FNYLIQLNSDKID;NYLIQLNSDKIDY;YLIQLNSDKIDYA;LIQLNSDKIDYAE;IQLNSDK
IDYAEK;QLNSDKIDYAEKY;LNSDKIDYAEKYG;NSDKIDYAEKYGD;SDKIDYAEKYGDN;
DKIDYAEKYGDNA;KIDYAEKYGDNAR;IDYAEKYGDNARN;DYAEKYGDNARNN;YAEKYGD
NARNNF;AEKYGDNARNNFK;EKYGDNARNNFKE;KYGDNARNNFKED;YGDNARNNFKEDY;
GDNARNNFKEDYS;DNARNNFKEDYSK;NARNNFKEDYSKD;ARNNFKEDYSKDK;RNNFKED
YSKDKT;NNFKEDYSKDKTN;NFKEDYSKDKTNT;FKEDYSKDKTNTV;KEDYSKDKTNTVK;
EDYSKDKTNTVKQ;DYSKDKTNTVKQI;YSKDKTNTVKQIL;SKDKTNTVKQILK;KDKTNTV
KQILKQ;DKTNTVKQILKQI;KTNTVKQILKQIL;TNTVKQILKQILA;NTVKQILKQILAD;
TVKQILKQILADL;VKQILKQILADLP;KQILKQILADLPK;QILKQILADLPKD;

14 mers:
MKKINLLIFLFLFI;KKINLLIFLFLFIL;KINLLIFLFLFILS;INLLIFLFLFILSL;NLL
IFLFLFILSLS;LLIFLFLFILSLSA;LIFLFLFILSLSAN;IFLFLFILSLSANI;FLFLFI
LSLSANIE;LFLFILSLSANIEE;FLFILSLSANIEEN;LFILSLSANIEENY;FILSLSANI
EENYT;ILSLSANIEENYTE;LSLSANIEENYTET;SLSANIEENYTETK;LSANIEENYTET
KR;SANIEENYTETKRA;ANIEENYTETKRAF;NIEENYTETKRAFS;IEENYTETKRAFSE;
EENYTETKRAFSEE;ENYTETKRAFSEED;NYTETKRAFSEEDF;YTETKRAFSEEDFN;TET
KRAFSEEDFNL;ETKRAFSEEDFNLI;TKRAFSEEDFNLIN;KRAFSEEDFNLINK;RAFSEE
DFNLINKR;AFSEEDFNLINKRL;FSEEDFNLINKRLD;SEEDFNLINKRLDN;EEDFNLINK
RLDNY;EDFNLINKRLDNYD;DFNLINKRLDNYDF;FNLINKRLDNYDFK;NLINKRLDNYDF
KN;LINKRLDNYDFKNE;INKRLDNYDFKNEY;NKRLDNYDFKNEYE;KRLDNYDFKNEYEK;
RLDNYDFKNEYEKS;LDNYDFKNEYEKSH;DNYDFKNEYEKSHV;NYDFKNEYEKSHVF;YDF
KNEYEKSHVFS;DFKNEYEKSHVFSD;FKNEYEKSHVFSDA;KNEYEKSHVFSDAP;NEYEKS
HVFSDAPR;EYEKSHVFSDAPRI;YEKSHVFSDAPRIR;EKSHVFSDAPRIRR;KSHVFSDAP
RIRRD;SHVFSDAPRIRRDL;HVFSDAPRIRRDLR;VFSDAPRIRRDLRK;FSDAPRIRRDLR
KI;SDAPRIRRDLRKIG;DAPRIRRDLRKIGI;APRIRRDLRKIGIK;PRIRRDLRKIGIKE;
RIRRDLRKIGIKEK;IRRDLRKIGIKEKS;RRDLRKIGIKEKSV;RDLRKIGIKEKSVF;DLR
KIGIKEKSVFL;LRKIGIKEKSVFLD;RKIGIKEKSVFLDA;KIGIKEKSVFLDAL;IGIKEK
SVFLDALD;GIKEKSVFLDALDI;IKEKSVFLDALDII;KEKSVFLDALDIIE;EKSVFLDAL
DIIEY;KSVFLDALDIIEYL;SVFLDALDIIEYLI;VFLDALDIIEYLIK;FLDALDIIEYLI
KI;LDALDIIEYLIKIK;DALDIIEYLIKIKI;ALDIIEYLIKIKIS;LDIIEYLIKIKISA;
DIIEYLIKIKISAD;IIEYLIKIKISADS;IEYLIKIKISADSI;EYLIKIKISADSIF;YLI
KIKISADSIFL;LIKIKISADSIFLS;IKIKISADSIFLSE;KIKISADSIFLSED;IKISAD
SIFLSEDM;KISADSIFLSEDMI;ISADSIFLSEDMIR;SADSIFLSEDMIRL;ADSIFLSED
MIRLI;DSIFLSEDMIRLIG;SIFLSEDMIRLIGG;IFLSEDMIRLIGGY;FLSEDMIRLIGG
YP;LSEDMIRLIGGYPD;SEDMIRLIGGYPDL;EDMIRLIGGYPDLI;DMIRLIGGYPDLIF;
MIRLIGGYPDLIFN;IRLIGGYPDLIFNY;RLIGGYPDLIFNYL;LIGGYPDLIFNYLI;IGG
YPDLIFNYLIQ;GGYPDLIFNYLIQL;GYPDLIFNYLIQLN;YPDLIFNYLIQLNS;PDLIFN
YLIQLNSD;DLIFNYLIQLNSDK;LIFNYLIQLNSDKI;IFNYLIQLNSDKID;FNYLIQLNS
DKIDY;NYLIQLNSDKIDYA;YLIQLNSDKIDYAE;LIQLNSDKIDYAEK;IQLNSDKIDYAE
KY;QLNSDKIDYAEKYG;LNSDKIDYAEKYGD;NSDKIDYAEKYGDN;SDKIDYAEKYGDNA;
DKIDYAEKYGDNAR;KIDYAEKYGDNARN;IDYAEKYGDNARNN;DYAEKYGDNARNNF;YAE
KYGDNARNNFK;AEKYGDNARNNFKE;EKYGDNARNNFKED;KYGDNARNNFKEDY;YGDNAR
NNFKEDYS;GDNARNNFKEDYSK;DNARNNFKEDYSKD;NARNNFKEDYSKDK;ARNNFKEDY

Fig. 43 continued

SKDKT; RNNFKEDYSKDKTN; NNFKEDYSKDKTNT; NFKEDYSKDKTNTV; FKEDYSKDKTNT
VK; KEDYSKDKTNTVKQ; EDYSKDKTNTVKQI; DYSKDKTNTVKQIL; YSKDKTNTVKQILK;
SKDKTNTVKQILKQ; KDKTNTVKQILKQI; DKTNTVKQILKQIL; KTNTVKQILKQILA; TNT
VKQILKQILAD; NTVKQILKQILADL; TVKQILKQILADLP; VKQILKQILADLPK; KQILKQ
ILADLPKD;

15 mers:
MKKINLLIFLFLFIL; KKINLLIFLFLFILS; KINLLIFLFLFILSL; INLLIFLFLFILSLS
; NLLIFLFLFILSLSA; LLIFLFLFILSLSAN; LIFLFLFILSLSANI; IFLFLFILSLSANI
E; FLFLFILSLSANIEE; LFLFILSLSANIEEN; FLFILSLSANIEENY; LFILSLSANIEEN
YT; FILSLSANIEENYTE; ILSLSANIEENYTET; LSLSANIEENYTETK; SLSANIEENYTE
TKR; LSANIEENYTETKRA; SANIEENYTETKRAF; ANIEENYTETKRAFS; NIEENYTETKR
AFSE; IEENYTETKRAFSEE; EENYTETKRAFSEED; ENYTETKRAFSEEDF; NYTETKRAFS
EEDFN; YTETKRAFSEEDFNL; TETKRAFSEEDFNLI; ETKRAFSEEDFNLIN; TKRAFSEED
FNLINK; KRAFSEEDFNLINKR; RAFSEEDFNLINKRL; AFSEEDFNLINKRLD; FSEEDFNL
INKRLDN; SEEDFNLINKRLDNY; EEDFNLINKRLDNYD; EDFNLINKRLDNYDF; DFNLINK
RLDNYDFK; FNLINKRLDNYDFKN; NLINKRLDNYDFKNE; LINKRLDNYDFKNEY; INKRLD
NYDFKNEYE; NKRLDNYDFKNEYEK; KRLDNYDFKNEYEKS; RLDNYDFKNEYEKSH; LDNYD
FKNEYEKSHV; DNYDFKNEYEKSHVF; NYDFKNEYEKSHVFS; YDFKNEYEKSHVFSD; DFKN
EYEKSHVFSDA; FKNEYEKSHVFSDAP; KNEYEKSHVFSDAPR; NEYEKSHVFSDAPRI; EYE
KSHVFSDAPRIR; YEKSHVFSDAPRIRR; EKSHVFSDAPRIRRD; KSHVFSDAPRIRRDL; SH
VFSDAPRIRRDLR; HVFSDAPRIRRDLRK; VFSDAPRIRRDLRKI; FSDAPRIRRDLRKIG; S
DAPRIRRDLRKIGI; DAPRIRRDLRKIGIK; APRIRRDLRKIGIKE; PRIRRDLRKIGIKEK;
RIRRDLRKIGIKEKS; IRRDLRKIGIKEKSV; RRDLRKIGIKEKSVF; RDLRKIGIKEKSVFL
; DLRKIGIKEKSVFLD; LRKIGIKEKSVFLDA; RKIGIKEKSVFLDAL; KIGIKEKSVFLDAL
D; IGIKEKSVFLDALDI; GIKEKSVFLDALDII; IKEKSVFLDALDIIE; KEKSVFLDALDII
EY; EKSVFLDALDIIEYL; KSVFLDALDIIEYLI; SVFLDALDIIEYLIK; VFLDALDIIEYL
IKI; FLDALDIIEYLIKIK; LDALDIIEYLIKIKI; DALDIIEYLIKIKIS; ALDIIEYLIKI
KISA; LDIIEYLIKIKISAD; DIIEYLIKIKISADS; IIEYLIKIKISADST; IEYLIKIKIS
ADSIF; EYLIKIKISADSIFL; YLIKIKISADSIFLS; LIKIKISADSIFLSE; IKIKISADS
IFLSED; KIKISADSIFLSEDM; IKISADSIFLSEDMI; KISADSIFLSEDMIR; ISADSIFL
SEDMIRL; SADSIFLSEDMIRLI; ADSIFLSEDMIRLIG; DSIFLSEDMIRLIGG; SIFLSED
MIRLIGGY; IFLSEDMIRLIGGYP; FLSEDMIRLIGGYPD; LSEDMIRLIGGYPDL; SEDMIR
LIGGYPDLI; EDMIRLIGGYPDLIF; DMIRLIGGYPDLIFN; MIRLIGGYPDLIFNY; IRLIG
GYPDLIFNYL; RLIGGYPDLIFNYLI; LIGGYPDLIFNYLIQ; IGGYPDLIFNYLIQL; GGYP
DLIFNYLIQLN; GYPDLIFNYLIQLNS; YPDLIFNYLIQLNSD; PDLIFNYLIQLNSDK; DLI
FNYLIQLNSDKI; LIFNYLIQLNSDKID; IFNYLIQLNSDKIDY; FNYLIQLNSDKIDYA; NY
LIQLNSDKIDYAE; YLIQLNSDKIDYAEK; LIQLNSDKIDYAEKY; IQLNSDKIDYAEKYG; Q
LNSDKIDYAEKYGD; LNSDKIDYAEKYGDN; NSDKIDYAEKYGDNA; SDKIDYAEKYGDNAR;
DKIDYAEKYGDNARN; KIDYAEKYGDNARNN; IDYAEKYGDNARNNF; DYAEKYGDNARNNFK
; YAEKYGDNARNNFKE; AEKYGDNARNNFKED; EKYGDNARNNFKEDY; KYGDNARNNFKEDY
S; YGDNARNNFKEDYSK; GDNARNNFKEDYSKD; DNARNNFKEDYSKDK; NARNNFKEDYSKD
KT; ARNNFKEDYSKDKTN; RNNFKEDYSKDKTNT; NNFKEDYSKDKTNTV; NFKEDYSKDKTN
TVK; FKEDYSKDKTNTVKQ; KEDYSKDKTNTVKQI; EDYSKDKTNTVKQIL; DYSKDKTNTVK
QILK; YSKDKTNTVKQILKQ; SKDKTNTVKQILKQI; KDKTNTVKQILKQIL; DKTNTVKQIL
KQILA; KTNTVKQILKQILAD; TNTVKQILKQILADL; NTVKQILKQILADLP; TVKQILKQI
LADLPK; VKQILKQILADLPKD;

16 mers:
MKKINLLIFLFLFILS; KKINLLIFLFLFILSL; KINLLIFLFLFILSLS; INLLIFLFLFIL
SLSA; NLLIFLFLFILSLSAN; LLIFLFLFILSLSANI; LIFLFLFILSLSANIE; IFLFLFI
LSLSANIEE; FLFLFILSLSANIEEN; LFLFILSLSANIEENY; FLFILSLSANIEENYT; LF
ILSLSANIEENYTE; FILSLSANIEENYTET; ILSLSANIEENYTETK; LSLSANIEENYTET
KR; SLSANIEENYTETKRA; LSANIEENYTETKRAF; SANIEENYTETKRAFS; ANIEENYTE
TKRAFSE; NIEENYTETKRAFSEE; IEENYTETKRAFSEED; EENYTETKRAFSEEDF; ENYT
ETKRAFSEEDFN; NYTETKRAFSEEDFNL; YTETKRAFSEEDFNLI; TETKRAFSEEDFNLIN
; ETKRAFSEEDFNLINK; TKRAFSEEDFNLINKR; KRAFSEEDFNLINKRL; RAFSEEDFNLI

Fig. 43 continued

| | |
|---|---|
| NKRLD;AFSEEDFNLINKRLDN;FSEEDFNLINKRLDNY;SEEDFNLINKRLDNYD;EEDFNL INKRLDNYDF;EDFNLINKRLDNYDFK;DFNLINKRLDNYDFKN;FNLINKRLDNYDFKNE;N LINKRLDNYDFKNEY;LINKRLDNYDFKNEYE;INKRLDNYDFKNEYEK;NKRLDNYDFKNEY EKS;KRLDNYDFKNEYEKSH;RLDNYDFKNEYEKSHV;LDNYDFKNEYEKSHVF;DNYDFKNE YEKSHVFS;NYDFKNEYEKSHVFSD;YDFKNEYEKSHVFSDA;DFKNEYEKSHVFSDAP;FKN EYEKSHVFSDAPR;KNEYEKSHVFSDAPRI;NEYEKSHVFSDAPRIR;EYEKSHVFSDAPRI

| | |
|---|---|
| FEIFKEDG;EIFKEDGK;IFKEDGKT;FKEDGKTL;KEDGKTLV;EDGKTLVS;DGKTLVSR;GKTLVSRK;KTLVSRKV;TLVSRKVN;LVSRKVNS;VSRKVNSK;SRKVNSKD;RKVNSKDK;KVNSKDKS;VNSKDKSS;NSKDKSST;SKDKSSTE;KDKSSTEE;DKSSTEEK;KSSTEEKF;SSTEEKFN;STEEKFND;TEEKFNDK;EEKFNDKG;EKFNDKGK;KFNDKGKL;FNDKGKLS;NDKGKLSE;DKGKLSEK;KGKLSEKV;GKLSEKVV;KLSEKVVT;LSEKVVTR;SEKVVTRA;EKVVTRAN;KVVTRANG;VVTRANGT;VTRANGTR;TRANGTRL;RANGTRLE;ANGTRLEY;NGTRLEYT;GTRLEYTE;TRLEYTEI;RLEYTEIK;LEYTEIKN;EYTEIKND;YTEIKNDG;TEIKNDGS;EIKNDGSG;IKNDGSGK;KNDGSGKA;NDGSGKAK;DGSGKAKE;GSGKAKEV;SGKAKEVL;GKAKEVLK;KAKEVLKG;AKEVLKGF;KEVLKGFA;EVLKGFAL;VLKGFALE;LKGFALEG;KGFALEGT;GFALEGTL;FALEGTLT;ALEGTLTD;LEGTLTDG;EGTLTDGG;GTLTDGGE;TLTDGGET;LTDGGETK;TDGGETKL;DGGETKLT;GGETKLTV;GETKLTVT;ETKLTVTE;TKLTVTEG;KLTVTEGT;LTVTEGTV;TVTEGTVT;VTEGTVTL;TEGTVTLS;EGTVTLSK;GTVTLSKN;TVTLSKNI;VTLSKNIS;TLSKNISK;LSKNISKS;SKNISKSG;KNISKSGE;NISKSGEI;ISKSGEIT;SKSGEITV;KSGEITVA;SGEITVAL;GEITVALN;EITVALND;ITVALNDT;TVALNDTE;VALNDTET;ALNDTETT;LNDTETTP;NDTETTPA;DTETTPAD;TETTPADK;ETTPADKK;TTPADKKT;TPADKKTG;PADKKTGE;ADKKTGEW;DKKTGEWK;KKTGEWKS;KTGEWKSD;TGEWKSDT;GEWKSDTS;EWKSDTST;WKSDTSTL;KSDTSTLT;SDTSTLTI;DTSTLTIS;TSTLTISK;STLTISKN;TLTISKNS;LTISKNSQ;TISKNSQK;ISKNSQKP;SKNSQKPK;KNSQKPKQ;NSQKPKQL;SQKPKQLV;QKPKQLVF;KPKQLVFT;PKQLVFTK;KQLVFTKE;QLVFTKEN;LVFTKENT;VFTKENTI;FTKENTIT;TKENTITV;KENTITVQ;ENTITVQN;NTITVQNY;TITVQNYN;ITVQNYNR;TVQNYNRA;VQNYNRAG;QNYNRAGN;NYNRAGNA;YNRAGNAL;NRAGNALE;RAGNALEG;AGNALEGS;GNALEGSP;NALEGSPA;ALEGSPAE;LEGSPAEI;EGSPAEIK;GSPAEIKD;SPAEIKDL;PAEIKDLA;AEIKDLAE;EIKDLAEL;IKDLAELK;KDLAELKA;DLAELKAA;LAELKAAL;AELKAALK;<br><br>9 mers:<br>MKKYLLGIG;KKYLLGIGL;KYLLGIGLI;YLLGIGLIL;LLGIGLILA;LGIGLILAL;GIGLILALI;IGLILALIA;GLILALIAC;LILALIACK;ILALIACKQ;LALIACKQN;ALIACKQNV;LIACKQNVS;IACKQNVSS;ACKQNVSSL;CKQNVSSLD;KQNVSSLDE;QNVSSLDEK;NVSSLDEKN;VSSLDEKNS;SSLDEKNSV;SLDEKNSVS;LDEKNSVSV;DEKNSVSVD;EKNSVSVDL;KNSVSVDLP;NSVSVDLPG;SVSVDLPGG;VSVDLPGGM;SVDLPGGMK;VDLPGGMKV;DLPGGMKVL;LPGGMKVLV;PGGMKVLVS;GGMKVLVSK;GMKVLVSKE;MKVLVSKEK;KVLVSKEKD;VLVSKEKDK;LVSKEKDKD;VSKEKDKDG;SKEKDKDGK;KEKDKDGKY;EKDKDGKYS;KDKDGKYSL;DKDGKYSLM;KDGKYSLMA;DGKYSLMAT;GKYSLMATV;KYSLMATVE;YSLMATVEK;SLMATVEKL;LMATVEKLE;MATVEKLEL;ATVEKLELK;TVEKLELKG;VEKLELKGT;EKLELKGTS;KLELKGTSD;LELKGTSDK;ELKGTSDKS;LKGTSDKSN;KGTSDKSNG;GTSDKSNGS;TSDKSNGSG;SDKSNGSGV;DKSNGSGVL;KSNGSGVLE;SNGSGVLEG;NGSGVLEGE;GSGVLEGEK;SGVLEGEKA;GVLEGEKAD;VLEGEKADK;LEGEKADKS;EGEKADKSK;GEKADKSKA;EKADKSKAK;KADKSKAKL;ADKSKAKLT;DKSKAKLTI;KSKAKLTIS;SKAKLTISQ;KAKLTISQD;AKLTISQDL;KLTISQDLN;LTISQDLNQ;TISQDLNQT;ISQDLNQTT;SQDLNQTTF;QDLNQTTFE;DLNQTTFEI;LNQTTFEIF;NQTTFEIFK;QTTFEIFKE;TTFEIFKED;TFEIFKEDG;FEIFKEDGK;EIFKEDGKT;IFKEDGKTL;FKEDGKTLV;KEDGKTLVS;EDGKTLVSR;DGKTLVSRK;GKTLVSRKV;KTLVSRKVN;TLVSRKVNS;LVSRKVNSK;VSRKVNSKD;SRKVNSKDK;RKVNSKDKS;KVNSKDKSS;VNSKDKSST;NSKDKSSTE;SKDKSSTEE;KDKSSTEEK;DKSSTEEKF;KSSTEEKFN;SSTEEKFND;STEEKFNDK;TEEKFNDKG;EEKFNDKGK;EKFNDKGKL;KFNDKGKLS;FNDKGKLSE;NDKGKLSEK;DKGKLSEKV;KGKLSEKVV;GKLSEKVVT;KLSEKVVTR;LSEKVVTRA;SEKVVTRAN;EKVVTRANG;KVVTRANGT;VVTRANGTR;VTRANGTRL;TRANGTRLE;RANGTRLEY;ANGTRLEYT;NGTRLEYTE;GTRLEYTEI;TRLEYTEIK;RLEYTEIKN;LEYTEIKND;EYTEIKNDG;YTEIKNDGS;TEIKNDGSG;EIKNDGSGK;IKNDGSGKA;KNDGSGKAK;NDGSGKAKE;DGSGKAKEV;GSGKAKEVL;SGKAKEVLK;GKAKEVLKG;KAKEVLKGF;AKEVLKGFA;KEVLKGFAL;EVLKGFALE;VLKGFALEG;LKGFALEGT;KGFALEGTL;GFALEGTLT;FALEGTLTD;ALEGTLTDG;LEGTLTDGG;EGTLTDGGE;GTLTDGGET;TLTDGGETK;LTDGGETKL;TDGGETKLT;DGGETKLTV;GGETKLTVT;GETKLTVTE;ETKLTVTEG;TKLTVTEGT;KLTVTEGTV;LTVTEGTVT;TVTEGTVTL;VTEGTVTLS;TEGTVTLSK;EGTVTLSKN;GTVTLSKNI;TVTLSKNIS;VTLSKNISK;TLSKNISKS;LSKNISKSG;SKNISKSGE; | |

Fig. 43 continued

KNISKSGEI;NISKSGEIT;ISKSGEITV;SKSGEITVA;KSGEITVAL;SGEITVALN;GEI
TVALND;EITVALNDT;ITVALNDTE;TVALNDTET;VALNDTETT;ALNDTETTP;LNDTET
TPA;NDTETTPAD;DTETTPADK;TETTPADKK;ETTPADKKT;TTPADKKTG;TPADKKTGE
;PADKKTGEW;ADKKTGEWK;DKKTGEWKS;KKTGEWKSD;KTGEWKSDT;TGEWKSDTS;GE
WKSDTST;EWKSDTSTL;WKSDTSTLT;KSDTSTLTI;SDTSTLTIS;DTSTLTISK;TSTLT
ISKN;STLTISKNS;TLTISKNSQ;LTISKNSQK;TISKNSQKP;ISKNSQKPK;SKNSQKPK
Q;KNSQKPKQL;NSQKPKQLV;SQKPKQLVF;QKPKQLVFT;KPKQLVFTK;PKQLVFTKE;K
QLVFTKEN;QLVFTKENT;LVFTKENTI;VFTKENTIT;FTKENTITV;TKENTITVQ;KENT
ITVQN;ENTITVQNY;NTITVQNYN;TITVQNYNR;ITVQNYNRA;TVQNYNRAG;VQNYNRA
GN;QNYNRAGNA;NYNRAGNAL;YNRAGNALE;NRAGNALEG;RAGNALEGS;AGNALEGSP;
GNALEGSPA;NALEGSPAE;ALEGSPAEI;LEGSPAEIK;EGSPAEIKD;GSPAEIKDL;SPA
EIKDLA;PAEIKDLAE;AEIKDLAEL;EIKDLAELK;IKDLAELKA;KDLAELKAA;DLAELK
AAL;LAELKAALK;

10 mers:
MKKYLLGIGL;KKYLLGIGLI;KYLLGIGLIL;YLLGIGLILA;LLGIGLILAL;LGIGLILA
LI;GIGLILALIA;IGLILALIAC;GLILALIACK;LILALIACKQ;ILALIACKQN;LALIA
CKQNV;ALIACKQNVS;LIACKQNVSS;IACKQNVSSL;ACKQNVSSLD;CKQNVSSLDE;KQ
NVSSLDEK;QNVSSLDEKN;NVSSLDEKNS;VSSLDEKNSV;SSLDEKNSVS;SLDEKNSVSV
;LDEKNSVSVD;DEKNSVSVDL;EKNSVSVDLP;KNSVSVDLPG;NSVSVDLPGG;SVSVDLP
GGM;VSVDLPGGMK;SVDLPGGMKV;VDLPGGMKVL;DLPGGMKVLV;LPGGMKVLVS;PGGM
KVLVSK;GGMKVLVSKE;GMKVLVSKEK;MKVLVSKEKD;KVLVSKEKDK;VLVSKEKDKD;L
VSKEKDKDG;VSKEKDKDGK;SKEKDKDGKY;KEKDKDGKYS;EKDKDGKYSL;KDKDGKYSL
M;DKDGKYSLMA;KDGKYSLMAT;DGKYSLMATV;GKYSLMATVE;KYSLMATVEK;YSLMAT
VEKL;SLMATVEKLE;LMATVEKLEL;MATVEKLELK;ATVEKLELKG;TVEKLELKGT;VEK
LELKGTS;EKLELKGTSD;KLELKGTSDK;LELKGTSDKS;ELKGTSDKSN;LKGTSDKSNG;
KGTSDKSNGS;GTSDKSNGSG;TSDKSNGSGV;SDKSNGSGVL;DKSNGSGVLE;KSNGSGVL
EG;SNGSGVLEGE;NGSGVLEGEK;GSGVLEGEKA;SGVLEGEKAD;GVLEGEKADK;VLEGE
KADKS;LEGEKADKSK;EGEKADKSKA;GEKADKSKAK;EKADKSKAKL;KADKSKAKLT;AD
KSKAKLTI;DKSKAKLTIS;KSKAKLTISQ;SKAKLTISQD;KAKLTISQDL;AKLTISQDLN
;KLTISQDLNQ;LTISQDLNQT;TISQDLNQTT;ISQDLNQTTF;SQDLNQTTFE;QDLNQTT
FEI;DLNQTTFEIF;LNQTTFEIFK;NQTTFEIFKE;QTTFEIFKED;TTFEIFKEDG;TFEI
FKEDGK;FEIFKEDGKT;EIFKEDGKTL;IFKEDGKTLV;FKEDGKTLVS;KEDGKTLVSR;E
DGKTLVSRK;DGKTLVSRKV;GKTLVSRKVN;KTLVSRKVNS;TLVSRKVNSK;LVSRKVNSK
D;VSRKVNSKDK;SRKVNSKDKS;RKVNSKDKSS;KVNSKDKSST;VNSKDKSSTE;NSKDKS
STEE;SKDKSSTEEK;KDKSSTEEKF;DKSSTEEKFN;KSSTEEKFND;SSTEEKFNDK;STE
EKFNDKG;TEEKFNDKGK;EEKFNDKGKL;EKFNDKGKLS;KFNDKGKLSE;FNDKGKLSEK;
NDKGKLSEKV;DKGKLSEKVV;KGKLSEKVVT;GKLSEKVVTR;KLSEKVVTRA;LSEKVVTR
AN;SEKVVTRANG;EKVVTRANGT;KVVTRANGTR;VVTRANGTRL;VTRANGTRLE;TRANG
TRLEY;RANGTRLEYT;ANGTRLEYTE;NGTRLEYTEI;GTRLEYTEIK;TRLEYTEIKN;RL
EYTEIKND;LEYTEIKNDG;EYTEIKNDGS;YTEIKNDGSG;TEIKNDGSGK;EIKNDGSGKA
;IKNDGSGKAK;KNDGSGKAKE;NDGSGKAKEV;DGSGKAKEVL;GSGKAKEVLK;SGKAKEV
LKG;GKAKEVLKGF;KAKEVLKGFA;AKEVLKGFAL;KEVLKGFALE;EVLKGFALEG;VLKG
FALEGT;LKGFALEGTL;KGFALEGTLT;GFALEGTLTD;FALEGTLTDG;ALEGTLTDGG;L
EGTLTDGGE;EGTLTDGGET;GTLTDGGETK;TLTDGGETKL;LTDGGETKLT;TDGGETKLT
V;DGGETKLTVT;GGETKLTVTE;GETKLTVTEG;ETKLTVTEGT;TKLTVTEGTV;KLTVTE
GTVT;LTVTEGTVTL;TVTEGTVTLS;VTEGTVTLSK;TEGTVTLSKN;EGTVTLSKNI;GTV
TLSKNIS;TVTLSKNISK;VTLSKNISKS;TLSKNISKSG;LSKNISKSGE;SKNISKSGEI;
KNISKSGEIT;NISKSGEITV;ISKSGEITVA;SKSGEITVAL;KSGEITVALN;SGEITVAL
ND;GEITVALNDT;EITVALNDTE;ITVALNDTET;TVALNDTETT;VALNDTETTP;ALNDT
ETTPA;LNDTETTPAD;NDTETTPADK;DTETTPADKK;TETTPADKKT;ETTPADKKTG;TT
PADKKTGE;TPADKKTGEW;PADKKTGEWK;ADKKTGEWKS;DKKTGEWKSD;KKTGEWKSDT
;KTGEWKSDTS;TGEWKSDTST;GEWKSDTSTL;EWKSDTSTLT;WKSDTSTLTI;KSDTSTL
TIS;SDTSTLTISK;DTSTLTISKN;TSTLTISKNS;STLTISKNSQ;TLTISKNSQK;LTIS
KNSQKP;TISKNSQKPK;ISKNSQKPKQ;SKNSQKPKQL;KNSQKPKQLV;NSQKPKQLVF;S
QKPKQLVFT;QKPKQLVFTK;KPKQLVFTKE;PKQLVFTKEN;KQLVFTKENT;QLVFTKENT
I;LVFTKENTIT;VFTKENTITV;FTKENTITVQ;TKENTITVQN;KENTITVQNY;ENTITV

Fig. 43 continued

QNYN;NTITVQNYNR;TITVQNYNRA;ITVQNYNRAG;TVQNYNRAGN;VQNYNRAGNA;QNY
NRAGNAL;NYNRAGNALE;YNRAGNALEG;NRAGNALEGS;RAGNALEGSP;AGNALEGSPA;
GNALEGSPAE;NALEGSPAEI;ALEGSPAEIK;LEGSPAEIKD;EGSPAEIKDL;GSPAEIKD
LA;SPAEIKDLAE;PAEIKDLAEL;AEIKDLAELK;EIKDLAELKA;IKDLAELKAA;KDLAE
LKAAL;DLAELKAALK;

11 mers:
MKKYLLGIGLI;KKYLLGIGLIL;KYLLGIGLILA;YLLGIGLILAL;LLGIGLILALI;LGI
GLILALIA;GIGLILALIAC;IGLILALIACK;GLILALIACKQ;LILALIACKQN;ILALIA
CKQNV;LALIACKQNVS;ALIACKQNVSS;LIACKQNVSSL;IACKQNVSSLD;ACKQNVSSL
DE;CKQNVSSLDEK;KQNVSSLDEKN;QNVSSLDEKNS;NVSSLDEKNSV;VSSLDEKNSVS;
SSLDEKNSVSV;SLDEKNSVSVD;LDEKNSVSVDL;DEKNSVSVDLP;EKNSVSVDLPG;KNS
VSVDLPGG;NSVSVDLPGGM;SVSVDLPGGMK;VSVDLPGGMKV;SVDLPGGMKVL;VDLPGG
MKVLV;DLPGGMKVLVS;LPGGMKVLVSK;PGGMKVLVSKE;GGMKVLVSKEK;GMKVLVSKE
KD;MKVLVSKEKDK;KVLVSKEKDKD;VLVSKEKDKDG;LVSKEKDKDGK;VSKEKDKDGKY;
SKEKDKDGKYS;KEKDKDGKYSL;EKDKDGKYSLM;KDKDGKYSLMA;DKDGKYSLMAT;KDG
KYSLMATV;DGKYSLMATVE;GKYSLMATVEK;KYSLMATVEKL;YSLMATVEKLE;SLMATV
EKLEL;LMATVEKLELK;MATVEKLELKG;ATVEKLELKGT;TVEKLELKGTS;VEKLELKGT
SD;EKLELKGTSDK;KLELKGTSDKS;LELKGTSDKSN;ELKGTSDKSNG;LKGTSDKSNGS;
KGTSDKSNGSG;GTSDKSNGSGV;TSDKSNGSGVL;SDKSNGSGVLE;DKSNGSGVLEG;KSN
GSGVLEGE;SNGSGVLEGEK;NGSGVLEGEKA;GSGVLEGEKAD;SGVLEGEKADK;GVLEGE
KADKS;VLEGEKADKSK;LEGEKADKSKA;EGEKADKSKAK;GEKADKSKAKL;EKADKSKAK
LT;KADKSKAKLTI;ADKSKAKLTIS;DKSKAKLTISQ;KSKAKLTISQD;SKAKLTISQDL;
KAKLTISQDLN;AKLTISQDLNQ;KLTISQDLNQT;LTISQDLNQTT;TISQDLNQTTF;ISQ
DLNQTTFE;SQDLNQTTFEI;QDLNQTTFEIF;DLNQTTFEIFK;LNQTTFEIFKE;NQTTFE
IFKED;QTTFEIFKEDG;TTFEIFKEDGK;TFEIFKEDGKT;FEIFKEDGKTL;EIFKEDGKT
LV;IFKEDGKTLVS;FKEDGKTLVSR;KEDGKTLVSRK;EDGKTLVSRKV;DGKTLVSRKVN;
GKTLVSRKVNS;KTLVSRKVNSK;TLVSRKVNSKD;LVSRKVNSKDK;VSRKVNSKDKS;SRK
VNSKDKSS;RKVNSKDKSST;KVNSKDKSSTE;VNSKDKSSTEE;NSKDKSSTEEK;SKDKSS
TEEKF;KDKSSTEEKFN;DKSSTEEKFND;KSSTEEKFNDK;SSTEEKFNDKG;STEEKFNDK
GK;TEEKFNDKGKL;EEKFNDKGKLS;EKFNDKGKLSE;KFNDKGKLSEK;FNDKGKLSEKV;
NDKGKLSEKVV;DKGKLSEKVVT;KGKLSEKVVTR;GKLSEKVVTRA;KLSEKVVTRAN;LSE
KVVTRANG;SEKVVTRANGT;EKVVTRANGTR;KVVTRANGTRL;VVTRANGTRLE;VTRANG
TRLEY;TRANGTRLEYT;RANGTRLEYTE;ANGTRLEYTEI;NGTRLEYTEIK;GTRLEYTEI
KN;TRLEYTEIKND;RLEYTEIKNDG;LEYTEIKNDGS;EYTEIKNDGSG;YTEIKNDGSGK;
TEIKNDGSGKA;EIKNDGSGKAK;IKNDGSGKAKE;KNDGSGKAKEV;NDGSGKAKEVL;DGS
GKAKEVLK;GSGKAKEVLKG;SGKAKEVLKGF;GKAKEVLKGFA;KAKEVLKGFAL;AKEVLK
GFALE;KEVLKGFALEG;EVLKGFALEGT;VLKGFALEGTL;LKGFALEGTLT;KGFALEGTL
TD;GFALEGTLTDG;FALEGTLTDGG;ALEGTLTDGGE;LEGTLTDGGET;EGTLTDGGETK;
GTLTDGGETKL;TLTDGGETKLT;LTDGGETKLTV;TDGGETKLTVT;DGGETKLTVTE;GGE
TKLTVTEG;GETKLTVTEGT;ETKLTVTEGTV;TKLTVTEGTVT;KLTVTEGTVTL;LTVTEG
TVTLS;TVTEGTVTLSK;VTEGTVTLSKN;TEGTVTLSKNI;EGTVTLSKNIS;GTVTLSKNI
SK;TVTLSKNISKS;VTLSKNISKSG;TLSKNISKSGE;LSKNISKSGEI;SKNISKSGEIT;
KNISKSGEITV;NISKSGEITVA;ISKSGEITVAL;SKSGEITVALN;KSGEITVALND;SGE
ITVALNDT;GEITVALNDTE;EITVALNDTET;ITVALNDTETT;TVALNDTETTP;VALNDT
ETTPA;ALNDTETTPAD;LNDTETTPADK;NDTETTPADKK;DTETTPADKKT;TETTPADKK
TG;ETTPADKKTGE;TTPADKKTGEW;TPADKKTGEWK;PADKKTGEWKS;ADKKTGEWKSD;
DKKTGEWKSDT;KKTGEWKSDTS;KTGEWKSDTST;TGEWKSDTSTL;GEWKSDTSTLT;EWK
SDTSTLTI;WKSDTSTLTIS;KSDTSTLTISK;SDTSTLTISKN;DTSTLTISKNS;TSTLTI
SKNSQ;STLTISKNSQK;TLTISKNSQKP;LTISKNSQKPK;TISKNSQKPKQ;ISKNSQKPK
QL;SKNSQKPKQLV;KNSQKPKQLVF;NSQKPKQLVFT;SQKPKQLVFTK;QKPKQLVFTKE;
KPKQLVFTKEN;PKQLVFTKENT;KQLVFTKENTI;QLVFTKENTIT;LVFTKENTITV;VFT
KENTITVQ;FTKENTITVQN;TKENTITVQNY;KENTITVQNYN;ENTITVQNYNR;NTITVQ
NYNRA;TITVQNYNRAG;ITVQNYNRAGN;TVQNYNRAGNA;VQNYNRAGNAL;QNYNRAGNA
LE;NYNRAGNALEG;YNRAGNALEGS;NRAGNALEGSP;RAGNALEGSPA;AGNALEGSPAE;
GNALEGSPAEI;NALEGSPAEIK;ALEGSPAEIKD;LEGSPAEIKDL;EGSPAEIKDLA;GSP
AEIKDLAE;SPAEIKDLAEL;PAEIKDLAELK;AEIKDLAELKA;EIKDLAELKAA;IKDLAE

Fig. 43 continued

LKAAL;KDLAELKAALK;

13 mers:
MKKYLLGIGLILA;KKYLLGIGLILAL;KYLLGIGLILALI;YLLGIGLILALIA;LLGIGLI
LALIAC;LGIGLILALIACK;GIGLILALIACKQ;IGLILALIACKQN;GLILALIACKQNV;
LILALIACKQNVS;ILALIACKQNVSS;LALIACKQNVSSL;ALIACKQNVSSLD;LIACKQN
VSSLDE;IACKQNVSSLDEK;ACKQNVSSLDEKN;CKQNVSSLDEKNS;KQNVSSLDEKNSV;
QNVSSLDEKNSVS;NVSSLDEKNSVSV;VSSLDEKNSVSVD;SSLDEKNSVSVDL;SLDEKNS
VSVDLP;LDEKNSVSVDLPG;DEKNSVSVDLPGG;EKNSVSVDLPGGM;KNSVSVDLPGGMK;
NSVSVDLPGGMKV;SVSVDLPGGMKVL;VSVDLPGGMKVLV;SVDLPGGMKVLVS;VDLPGGM
KVLVSK;DLPGGMKVLVSKE;LPGGMKVLVSKEK;PGGMKVLVSKEKD;GGMKVLVSKEKDK;
GMKVLVSKEKDKD;MKVLVSKEKDKDG;KVLVSKEKDKDGK;VLVSKEKDKDGKY;LVSKEKD
KDGKYS;VSKEKDKDGKYSL;SKEKDKDGKYSLM;KEKDKDGKYSLMA;EKDKDGKYSLMAT;
KDKDGKYSLMATV;DKDGKYSLMATVE;KDGKYSLMATVEK;DGKYSLMATVEKL;GKYSLMA
TVEKLE;KYSLMATVEKLEL;YSLMATVEKLELK;SLMATVEKLELKG;LMATVEKLELKGT;
MATVEKLELKGTS;ATVEKLELKGTSD;TVEKLELKGTSDK;VEKLELKGTSDKS;EKLELKG
TSDKSN;KLELKGTSDKSNG;LELKGTSDKSNGS;ELKGTSDKSNGSG;LKGTSDKSNGSGV;
KGTSDKSNGSGVL;GTSDKSNGSGVLE;TSDKSNGSGVLEG;SDKSNGSGVLEGE;DKSNGSG
VLEGEK;KSNGSGVLEGEKA;SNGSGVLEGEKAD;NGSGVLEGEKADK;GSGVLEGEKADKS;
SGVLEGEKADKSK;GVLEGEKADKSKA;VLEGEKADKSKAK;LEGEKADKSKAKL;EGEKADK
SKAKLT;GEKADKSKAKLTI;EKADKSKAKLTIS;KADKSKAKLTISQ;ADKSKAKLTISQD;
DKSKAKLTISQDL;KSKAKLTISQDLN;SKAKLTISQDLNQ;KAKLTISQDLNQT;AKLTISQ
DLNQTT;KLTISQDLNQTTF;LTISQDLNQTTFE;TISQDLNQTTFEI;ISQDLNQTTFEIF;
SQDLNQTTFEIFK;QDLNQTTFEIFKE;DLNQTTFEIFKED;LNQTTFEIFKEDG;NQTTFEI
FKEDGK;QTTFEIFKEDGKT;TTFEIFKEDGKTL;TFEIFKEDGKTLV;FEIFKEDGKTLVS;
EIFKEDGKTLVSR;IFKEDGKTLVSRK;FKEDGKTLVSRKV;KEDGKTLVSRKVN;EDGKTLV
SRKVNS;DGKTLVSRKVNSK;GKTLVSRKVNSKD;KTLVSRKVNSKDK;TLVSRKVNSKDKS;
LVSRKVNSKDKSS;VSRKVNSKDKSST;SRKVNSKDKSSTE;RKVNSKDKSSTEE;KVNSKDK
SSTEEK;VNSKDKSSTEEKF;NSKDKSSTEEKFN;SKDKSSTEEKFND;KDKSSTEEKFNDK;
DKSSTEEKFNDKG;KSSTEEKFNDKGK;SSTEEKFNDKGKL;STEEKFNDKGKLS;TEEKFND
KGKLSE;EEKFNDKGKLSEK;EKFNDKGKLSEKV;KFNDKGKLSEKVV;FNDKGKLSEKVVT;
NDKGKLSEKVVTR;DKGKLSEKVVTRA;KGKLSEKVVTRAN;GKLSEKVVTRANG;KLSEKVV
TRANGT;LSEKVVTRANGTR;SEKVVTRANGTRL;EKVVTRANGTRLE;KVVTRANGTRLEY;
VVTRANGTRLEYT;VTRANGTRLEYTE;TRANGTRLEYTEI;RANGTRLEYTEIK;ANGTRLE
YTEIKN;NGTRLEYTEIKND;GTRLEYTEIKNDG;TRLEYTEIKNDGS;RLEYTEIKNDGSG;
LEYTEIKNDGSGK;EYTEIKNDGSGKA;YTEIKNDGSGKAK;TEIKNDGSGKAKE;EIKNDGS
GKAKEV;IKNDGSGKAKEVL;KNDGSGKAKEVLK;NDGSGKAKEVLKG;DGSGKAKEVLKGF;
GSGKAKEVLKGFA;SGKAKEVLKGFAL;GKAKEVLKGFALE;KAKEVLKGFALEG;AKEVLKG
FALEGT;KEVLKGFALEGTL;EVLKGFALEGTLT;VLKGFALEGTLTD;LKGFALEGTLTDG;
KGFALEGTLTDGG;GFALEGTLTDGGE;FALEGTLTDGGET;ALEGTLTDGGETK;LEGTLTD
GGETKL;EGTLTDGGETKLT;GTLTDGGETKLTV;TLTDGGETKLTVT;LTDGGETKLTVTE;
TDGGETKLTVTEG;DGGETKLTVTEGT;GGETKLTVTEGTV;GETKLTVTEGTVT;ETKLTVT
EGTVTL;TKLTVTEGTVTLS;KLTVTEGTVTLSK;LTVTEGTVTLSKN;TVTEGTVTLSKNI;
VTEGTVTLSKNIS;TEGTVTLSKNISK;EGTVTLSKNISKS;GTVTLSKNISKSG;TVTLSKN
ISKSGE;VTLSKNISKSGEI;TLSKNISKSGEIT;LSKNISKSGEITV;SKNISKSGEITVA;
KNISKSGEITVAL;NISKSGEITVALN;ISKSGEITVALND;SKSGEITVALNDT;KSGEITV
ALNDTE;SGEITVALNDTET;GEITVALNDTETT;EITVALNDTETTP;ITVALNDTETTPA;
TVALNDTETTPAD;VALNDTETTPADK;ALNDTETTPADKK;LNDTETTPADKKT;NDTETTP
ADKKTG;DTETTPADKKTGE;TETTPADKKTGEW;ETTPADKKTGEWK;TTPADKKTGEWKS;
TPADKKTGEWKSD;PADKKTGEWKSDT;ADKKTGEWKSDTS;DKKTGEWKSDTST;KKTGEWK
SDTSTL;KTGEWKSDTSTLT;TGEWKSDTSTLTI;GEWKSDTSTLTIS;EWKSDTSTLTISK;
WKSDTSTLTISKN;KSDTSTLTISKNS;SDTSTLTISKNSQ;DTSTLTISKNSQK;TSTLTIS
KNSQKP;STLTISKNSQKPK;TLTISKNSQKPKQ;LTISKNSQKPKQL;TISKNSQKPKQLV;
ISKNSQKPKQLVF;SKNSQKPKQLVFT;KNSQKPKQLVFTK;NSQKPKQLVFTKE;SQKPKQL
VFTKEN;QKPKQLVFTKENT;KPKQLVFTKENTI;PKQLVFTKENTIT;KQLVFTKENTITV;
QLVFTKENTITVQ;LVFTKENTITVQN;VFTKENTITVQNY;FTKENTITVQNYN;TKENTIT
VQNYNR;KENTITVQNYNRA;ENTITVQNYNRAG;NTITVQNYNRAGN;TITVQNYNRAGNA;

Fig. 43 continued

ITVQNYNRAGNAL;TVQNYNRAGNALE;VQNYNRAGNALEG;QNYNRAGNALEGS;NYNRAGN
ALEGSP;YNRAGNALEGSPA;NRAGNALEGSPAE;RAGNALEGSPAEI;AGNALEGSPAEIK;
GNALEGSPAEIKD;NALEGSPAEIKDL;ALEGSPAEIKDLA;LEGSPAEIKDLAE;EGSPAEI
KDLAEL;GSPAEIKDLAELK;SPAEIKDLAELKA;PAEIKDLAELKAA;AEIKDLAELKAAL;
EIKDLAELKAALK;

14 mers:
MKKYLLGIGLILAL;KKYLLGIGLILALI;KYLLGIGLILALIA;YLLGIGLILALIAC;LLG
IGLILALIACK;LGIGLILALIACKQ;GIGLILALIACKQN;IGLILALIACKQNV;GLILAL
IACKQNVS;LILALIACKQNVSS;ILALIACKQNVSSL;LALIACKQNVSSLD;ALIACKQNV
SSLDE;LIACKQNVSSLDEK;IACKQNVSSLDEKN;ACKQNVSSLDEKNS;CKQNVSSLDEKN
SV;KQNVSSLDEKNSVS;QNVSSLDEKNSVSV;NVSSLDEKNSVSVD;VSSLDEKNSVSVDL;
SSLDEKNSVSVDLP;SLDEKNSVSVDLPG;LDEKNSVSVDLPGG;DEKNSVSVDLPGGM;EKN
SVSVDLPGGMK;KNSVSVDLPGGMKV;NSVSVDLPGGMKVL;SVSVDLPGGMKVLV;VSVDLP
GGMKVLVS;SVDLPGGMKVLVSK;VDLPGGMKVLVSKE;DLPGGMKVLVSKEK;LPGGMKVLV
SKEKD;PGGMKVLVSKEKDK;GGMKVLVSKEKDKD;GMKVLVSKEKDKDG;MKVLVSKEKDKD
GK;KVLVSKEKDKDGKY;VLVSKEKDKDGKYS;LVSKEKDKDGKYSL;VSKEKDKDGKYSLM;
SKEKDKDGKYSLMA;KEKDKDGKYSLMAT;EKDKDGKYSLMATV;KDKDGKYSLMATVE;DKD
GKYSLMATVEK;KDGKYSLMATVEKL;DGKYSLMATVEKLE;GKYSLMATVEKLEL;KYSLMA
TVEKLELK;YSLMATVEKLELKG;SLMATVEKLELKGT;LMATVEKLELKGTS;MATVEKLEL
KGTSD;ATVEKLELKGTSDK;TVEKLELKGTSDKS;VEKLELKGTSDKSN;EKLELKGTSDKS
NG;KLELKGTSDKSNGS;LELKGTSDKSNGSG;ELKGTSDKSNGSGV;LKGTSDKSNGSGVL;
KGTSDKSNGSGVLE;GTSDKSNGSGVLEG;TSDKSNGSGVLEGE;SDKSNGSGVLEGEK;DKS
NGSGVLEGEKA;KSNGSGVLEGEKAD;SNGSGVLEGEKADK;NGSGVLEGEKADKS;GSGVLE
GEKADKSK;SGVLEGEKADKSKA;GVLEGEKADKSKAK;VLEGEKADKSKAKL;LEGEKADKS
KAKLT;EGEKADKSKAKLTI;GEKADKSKAKLTIS;EKADKSKAKLTISQ;KADKSKAKLTIS
QD;ADKSKAKLTISQDL;DKSKAKLTISQDLN;KSKAKLTISQDLNQ;SKAKLTISQDLNQT;
KAKLTISQDLNQTT;AKLTISQDLNQTTF;KLTISQDLNQTTFE;LTISQDLNQTTFEI;TIS
QDLNQTTFEIF;ISQDLNQTTFEIFK;SQDLNQTTFEIFKE;QDLNQTTFEIFKED;DLNQTT
FEIFKEDG;LNQTTFEIFKEDGK;NQTTFEIFKEDGKT;QTTFEIFKEDGKTL;TTFEIFKED
GKTLV;TFEIFKEDGKTLVS;FEIFKEDGKTLVSR;EIFKEDGKTLVSRK;IFKEDGKTLVSR
KV;FKEDGKTLVSRKVN;KEDGKTLVSRKVNS;EDGKTLVSRKVNSK;DGKTLVSRKVNSKD;
GKTLVSRKVNSKDK;KTLVSRKVNSKDKS;TLVSRKVNSKDKSS;LVSRKVNSKDKSST;VSR
KVNSKDKSSTE;SRKVNSKDKSSTEE;RKVNSKDKSSTEEK;KVNSKDKSSTEEKF;VNSKDK
SSTEEKFN;NSKDKSSTEEKFND;SKDKSSTEEKFNDK;KDKSSTEEKFNDKG;DKSSTEEKF
NDKGK;KSSTEEKFNDKGKL;SSTEEKFNDKGKLS;STEEKFNDKGKLSE;TEEKFNDKGKLS
EK;EEKFNDKGKLSEKV;EKFNDKGKLSEKVV;KFNDKGKLSEKVVT;FNDKGKLSEKVVTR;
NDKGKLSEKVVTRA;DKGKLSEKVVTRAN;KGKLSEKVVTRANG;GKLSEKVVTRANGT;KLS
EKVVTRANGTR;LSEKVVTRANGTRL;SEKVVTRANGTRLE;EKVVTRANGTRLEY;KVVTRA
NGTRLEYT;VVTRANGTRLEYTE;VTRANGTRLEYTEI;TRANGTRLEYTEIK;RANGTRLEY
TEIKN;ANGTRLEYTEIKND;NGTRLEYTEIKNDG;GTRLEYTEIKNDGS;TRLEYTEIKNDG
SG;RLEYTEIKNDGSGK;LEYTEIKNDGSGKA;EYTEIKNDGSGKAK;YTEIKNDGSGKAKE;
TEIKNDGSGKAKEV;EIKNDGSGKAKEVL;IKNDGSGKAKEVLK;KNDGSGKAKEVLKG;NDG
SGKAKEVLKGF;DGSGKAKEVLKGFA;GSGKAKEVLKGFAL;SGKAKEVLKGFALE;GKAKEV
LKGFALEG;KAKEVLKGFALEGT;AKEVLKGFALEGTL;KEVLKGFALEGTLT;EVLKGFALE
GTLTD;VLKGFALEGTLTDG;LKGFALEGTLTDGG;KGFALEGTLTDGGE;GFALEGTLTDGG
ET;FALEGTLTDGGETK;ALEGTLTDGGETKL;LEGTLTDGGETKLT;EGTLTDGGETKLTV;
GTLTDGGETKLTVT;TLTDGGETKLTVTE;LTDGGETKLTVTEG;TDGGETKLTVTEGT;DGG
ETKLTVTEGTV;GGETKLTVTEGTVT;GETKLTVTEGTVTL;ETKLTVTEGTVTLS;TKLTVT
EGTVTLSK;KLTVTEGTVTLSKN;LTVTEGTVTLSKNI;TVTEGTVTLSKNIS;VTEGTVTLS
KNISK;TEGTVTLSKNISKS;EGTVTLSKNISKSG;GTVTLSKNISKSGE;TVTLSKNISKSG
EI;VTLSKNISKSGEIT;TLSKNISKSGEITV;LSKNISKSGEITVA;SKNISKSGEITVAL;
KNISKSGEITVALN;NISKSGEITVALND;ISKSGEITVALNDT;SKSGEITVALNDTE;KSG
EITVALNDTET;SGEITVALNDTETT;GEITVALNDTETTP;EITVALNDTETTPA;ITVALN
DTETTPAD;TVALNDTETTPADK;VALNDTETTPADKK;ALNDTETTPADKKT;LNDTETTPA
DKKTG;NDTETTPADKKTGE;DTETTPADKKTGEW;TETTPADKKTGEWK;ETTPADKKTGEW
KS;TTPADKKTGEWKSD;TPADKKTGEWKSDT;PADKKTGEWKSDTS;ADKKTGEWKSDTST;

Fig. 43 continued

DKKTGEWKSDTSTL;KKTGEWKSDTSTLT;KTGEWKSDTSTLTI;TGEWKSDTSTLTIS;GEW
KSDTSTLTISK;EWKSDTSTLTISKN;WKSDTSTLTISKNS;KSDTSTLTISKNSQ;SDTSTL
TISKNSQK;DTSTLTISKNSQKP;TSTLTISKNSQKPK;STLTISKNSQKPKQ;TLTISKNSQ
KPKQL;LTISKNSQKPKQLV;TISKNSQKPKQLVF;ISKNSQKPKQLVFT;SKNSQKPKQLVF
TK;KNSQKPKQLVFTKE;NSQKPKQLVFTKEN;SQKPKQLVFTKENT;QKPKQLVFTKENTI;
KPKQLVFTKENTIT;PKQLVFTKENTITV;KQLVFTKENTITVQ;QLVFTKENTITVQN;LVF
TKENTITVQNY;VFTKENTITVQNYN;FTKENTITVQNYNR;TKENTITVQNYNRA;KENTIT
VQNYNRAG;ENTITVQNYNRAGN;NTITVQNYNRAGNA;TITVQNYNRAGNAL;ITVQNYNRA
GNALE;TVQNYNRAGNALEG;VQNYNRAGNALEGS;QNYNRAGNALEGSP;NYNRAGNALEGS
PA;YNRAGNALEGSPAE;NRAGNALEGSPAEI;RAGNALEGSPAEIK;AGNALEGSPAEIKD;
GNALEGSPAEIKDL;NALEGSPAEIKDLA;ALEGSPAEIKDLAE;LEGSPAEIKDLAEL;EGS
PAEIKDLAELK;GSPAEIKDLAELKA;SPAEIKDLAELKAA;PAEIKDLAELKAAL;AEIKDL
AELKAALK;

15 mers:
MKKYLLGIGLILALI;KKYLLGIGLILALIA;KYLLGIGLILALIAC;YLLGIGLILALIACK
;LLGIGLILALIACKQ;LGIGLILALIACKQN;GIGLILALIACKQNV;IGLILALIACKQNV
S;GLILALIACKQNVSS;LILALIACKQNVSSL;ILALIACKQNVSSLD;LALIACKQNVSSL
DE;ALIACKQNVSSLDEK;LIACKQNVSSLDEKN;IACKQNVSSLDEKNS;ACKQNVSSLDEK
NSV;CKQNVSSLDEKNSVS;KQNVSSLDEKNSVSV;QNVSSLDEKNSVSVD;NVSSLDEKNSV
SVDL;VSSLDEKNSVSVDLP;SSLDEKNSVSVDLPG;SLDEKNSVSVDLPGG;LDEKNSVSVD
LPGGM;DEKNSVSVDLPGGMK;EKNSVSVDLPGGMKV;KNSVSVDLPGGMKVL;NSVSVDLPG
GMKVLV;SVSVDLPGGMKVLVS;VSVDLPGGMKVLVSK;SVDLPGGMKVLVSKE;VDLPGGMK
VLVSKEK;DLPGGMKVLVSKEKD;LPGGMKVLVSKEKDK;PGGMKVLVSKEKDKD;GGMKVLV
SKEKDKDG;GMKVLVSKEKDKDGK;MKVLVSKEKDKDGKY;KVLVSKEKDKDGKYS;VLVSKE
KDKDGKYSL;LVSKEKDKDGKYSLM;VSKEKDKDGKYSLMA;SKEKDKDGKYSLMAT;KEKDK
DGKYSLMATV;EKDKDGKYSLMATVE;KDKDGKYSLMATVEK;DKDGKYSLMATVEKL;KDGK
YSLMATVEKLE;DGKYSLMATVEKLEL;GKYSLMATVEKLELK;KYSLMATVEKLELKG;YSL
MATVEKLELKGT;SLMATVEKLELKGTS;LMATVEKLELKGTSD;MATVEKLELKGTSDK;AT
VEKLELKGTSDKS;TVEKLELKGTSDKSN;VEKLELKGTSDKSNG;EKLELKGTSDKSNGS;K
LELKGTSDKSNGSG;LELKGTSDKSNGSGV;ELKGTSDKSNGSGVL;LKGTSDKSNGSGVLE;
KGTSDKSNGSGVLEG;GTSDKSNGSGVLEGE;TSDKSNGSGVLEGEK;SDKSNGSGVLEGEKA
;DKSNGSGVLEGEKAD;KSNGSGVLEGEKADK;SNGSGVLEGEKADKS;NGSGVLEGEKADKS
K;GSGVLEGEKADKSKA;SGVLEGEKADKSKAK;GVLEGEKADKSKAKL;VLEGEKADKSKAK
LT;LEGEKADKSKAKLTI;EGEKADKSKAKLTIS;GEKADKSKAKLTISQ;EKADKSKAKLTI
SQD;KADKSKAKLTISQDL;ADKSKAKLTISQDLN;DKSKAKLTISQDLNQ;KSKAKLTISQD
LNQT;SKAKLTISQDLNQTT;KAKLTISQDLNQTTF;AKLTISQDLNQTTFE;KLTISQDLNQ
TTFEI;LTISQDLNQTTFEIF;TISQDLNQTTFEIFK;ISQDLNQTTFEIFKE;SQDLNQTTF
EIFKED;QDLNQTTFEIFKEDG;DLNQTTFEIFKEDGK;LNQTTFEIFKEDGKT;NQTTFEIF
KEDGKTL;QTTFEIFKEDGKTLV;TTFEIFKEDGKTLVS;TFEIFKEDGKTLVSR;FEIFKED
GKTLVSRK;EIFKEDGKTLVSRKV;IFKEDGKTLVSRKVN;FKEDGKTLVSRKVNS;KEDGKT
LVSRKVNSK;EDGKTLVSRKVNSKD;DGKTLVSRKVNSKDK;GKTLVSRKVNSKDKS;KTLVS
RKVNSKDKSS;TLVSRKVNSKDKSST;LVSRKVNSKDKSSTE;VSRKVNSKDKSSTEE;SRKV
NSKDKSSTEEK;RKVNSKDKSSTEEKF;KVNSKDKSSTEEKFN;VNSKDKSSTEEKFND;NSK
DKSSTEEKFNDK;SKDKSSTEEKFNDKG;KDKSSTEEKFNDKGK;DKSSTEEKFNDKGKL;KS
STEEKFNDKGKLS;SSTEEKFNDKGKLSE;STEEKFNDKGKLSEK;TEEKFNDKGKLSEKV;E
EKFNDKGKLSEKVV;EKFNDKGKLSEKVVT;KFNDKGKLSEKVVTR;FNDKGKLSEKVVTRA;
NDKGKLSEKVVTRAN;DKGKLSEKVVTRANG;KGKLSEKVVTRANGT;GKLSEKVVTRANGTR
;KLSEKVVTRANGTRL;LSEKVVTRANGTRLE;SEKVVTRANGTRLEY;EKVVTRANGTRLEY
T;KVVTRANGTRLEYTE;VVTRANGTRLEYTEI;VTRANGTRLEYTEIK;TRANGTRLEYTEI
KN;RANGTRLEYTEIKND;ANGTRLEYTEIKNDG;NGTRLEYTEIKNDGS;GTRLEYTEIKND
GSG;TRLEYTEIKNDGSGK;RLEYTEIKNDGSGKA;LEYTEIKNDGSGKAK;EYTEIKNDGSG
KAKE;YTEIKNDGSGKAKEV;TEIKNDGSGKAKEVL;EIKNDGSGKAKEVLK;IKNDGSGKAK
EVLKG;KNDGSGKAKEVLKGF;NDGSGKAKEVLKGFA;DGSGKAKEVLKGFAL;GSGKAKEVL
KGFALE;SGKAKEVLKGFALEG;GKAKEVLKGFALEGT;KAKEVLKGFALEGTL;AKEVLKGF
ALEGTLT;KEVLKGFALEGTLTD;EVLKGFALEGTLTDG;VLKGFALEGTLTDGG;LKGFALE
GTLTDGGE;KGFALEGTLTDGGET;GFALEGTLTDGGETK;FALEGTLTDGGETKL;ALEGTL

Fig. 43 continued

TDGGETKLT;LEGTLTDGGETKLTV;EGTLTDGGETKLTVT;GTLTDGGETKLTVTE;TLTDG
GETKLTVTEG;LTDGGETKLTVTEGT;TDGGETKLTVTEGTV;DGGETKLTVTEGTVT;GGET
KLTVTEGTVTL;GETKLTVTEGTVTLS;ETKLTVTEGTVTLSK;TKLTVTEGTVTLSKN;KLT
VTEGTVTLSKNI;LTVTEGTVTLSKNIS;TVTEGTVTLSKNISK;VTEGTVTLSKNISKS;TE
GTVTLSKNISKSG;EGTVTLSKNISKSGE;GTVTLSKNISKSGEI;TVTLSKNISKSGEIT;V
TLSKNISKSGEITV;TLSKNISKSGEITVA;LSKNISKSGEITVAL;SKNISKSGEITVALN;
KNISKSGEITVALND;NISKSGEITVALNDT;ISKSGEITVALNDTE;SKSGEITVALNDTET
;KSGEITVALNDTETT;SGEITVALNDTETTP;GEITVALNDTETTPA;EITVALNDTETTPA
D;ITVALNDTETTPADK;TVALNDTETTPADKK;VALNDTETTPADKKT;ALNDTETTPADKK
TG;LNDTETTPADKKTGE;NDTETTPADKKTGEW;DTETTPADKKTGEWK;TETTPADKKTGE
WKS;ETTPADKKTGEWKSD;TTPADKKTGEWKSDT;TPADKKTGEWKSDTS;PADKKTGEWKS
DTST;ADKKTGEWKSDTSTL;DKKTGEWKSDTSTLT;KKTGEWKSDTSTLTI;KTGEWKSDTS
TLTIS;TGEWKSDTSTLTISK;GEWKSDTSTLTISKN;EWKSDTSTLTISKNS;WKSDTSTLT
ISKNSQ;KSDTSTLTISKNSQK;SDTSTLTISKNSQKP;DTSTLTISKNSQKPK;TSTLTISK
NSQKPKQ;STLTISKNSQKPKQL;TLTISKNSQKPKQLV;LTISKNSQKPKQLVF;TISKNSQ
KPKQLVFT;ISKNSQKPKQLVFTK;SKNSQKPKQLVFTKE;KNSQKPKQLVFTKEN;NSQKPK
QLVFTKENT;SQKPKQLVFTKENTI;QKPKQLVFTKENTIT;KPKQLVFTKENTITV;PKQLV
FTKENTITVQ;KQLVFTKENTITVQN;QLVFTKENTITVQNY;LVFTKENTITVQNYN;VFTK
ENTITVQNYNR;FTKENTITVQNYNRA;TKENTITVQNYNRAG;KENTITVQNYNRAGN;ENT
ITVQNYNRAGNA;NTITVQNYNRAGNAL;TITVQNYNRAGNALE;ITVQNYNRAGNALEG;TV
QNYNRAGNALEGS;VQNYNRAGNALEGSP;QNYNRAGNALEGSPA;NYNRAGNALEGSPAE;Y
NRAGNALEGSPAEI;NRAGNALEGSPAEIK;RAGNALEGSPAEIKD;AGNALEGSPAEIKDL;
GNALEGSPAEIKDLA;NALEGSPAEIKDLAE;ALEGSPAEIKDLAEL;LEGSPAEIKDLAELK
;EGSPAEIKDLAELKA;GSPAEIKDLAELKAA;SPAEIKDLAELKAAL;PAEIKDLAELKAAL
K;

16 mers:
MKKYLLGIGLILALIA;KKYLLGIGLILALIAC;KYLLGIGLILALIACK;YLLGIGLILALI
ACKQ;LLGIGLILALIACKQN;LGIGLILALIACKQNV;GIGLILALIACKQNVS;IGLILAL
IACKQNVSS;GLILALIACKQNVSSL;LILALIACKQNVSSLD;ILALIACKQNVSSLDE;LA
LIACKQNVSSLDEK;ALIACKQNVSSLDEKN;LIACKQNVSSLDEKNS;IACKQNVSSLDEKN
SV;ACKQNVSSLDEKNSVS;CKQNVSSLDEKNSVSV;KQNVSSLDEKNSVSVD;QNVSSLDEK
NSVSVDL;NVSSLDEKNSVSVDLP;VSSLDEKNSVSVDLPG;SSLDEKNSVSVDLPGG;SLDE
KNSVSVDLPGGM;LDEKNSVSVDLPGGMK;DEKNSVSVDLPGGMKV;EKNSVSVDLPGGMKVL
;KNSVSVDLPGGMKVLV;NSVSVDLPGGMKVLVS;SVSVDLPGGMKVLVSK;VSVDLPGGMKV
LVSKE;SVDLPGGMKVLVSKEK;VDLPGGMKVLVSKEKD;DLPGGMKVLVSKEKDK;LPGGMK
VLVSKEKDKD;PGGMKVLVSKEKDKDG;GGMKVLVSKEKDKDGK;GMKVLVSKEKDKDGKY;M
KVLVSKEKDKDGKYS;KVLVSKEKDKDGKYSL;VLVSKEKDKDGKYSLM;LVSKEKDKDGKYS
LMA;VSKEKDKDGKYSLMAT;SKEKDKDGKYSLMATV;KEKDKDGKYSLMATVE;EKDKDGKY
SLMATVEK;KDKDGKYSLMATVEKL;DKDGKYSLMATVEKLE;KDGKYSLMATVEKLEL;DGK
YSLMATVEKLELK;GKYSLMATVEKLELKG;KYSLMATVEKLELKGT;YSLMATVEKLELKGT
S;SLMATVEKLELKGTSD;LMATVEKLELKGTSDK;MATVEKLELKGTSDKS;ATVEKLELKG
TSDKSN;TVEKLELKGTSDKSNG;VEKLELKGTSDKSNGS;EKLELKGTSDKSNGSG;KLELK
GTSDKSNGSGV;LELKGTSDKSNGSGVL;ELKGTSDKSNGSGVLE;LKGTSDKSNGSGVLEG;
KGTSDKSNGSGVLEGE;GTSDKSNGSGVLEGEK;TSDKSNGSGVLEGEKA;SDKSNGSGVLEG
EKAD;DKSNGSGVLEGEKADK;KSNGSGVLEGEKADKS;SNGSGVLEGEKADKSK;NGSGVLE
GEKADKSKA;GSGVLEGEKADKSKAK;SGVLEGEKADKSKAKL;GVLEGEKADKSKAKLT;VL
EGEKADKSKAKLTI;LEGEKADKSKAKLTIS;EGEKADKSKAKLTISQ;GEKADKSKAKLTIS
QD;EKADKSKAKLTISQDL;KADKSKAKLTISQDLN;ADKSKAKLTISQDLNQ;DKSKAKLTI
SQDLNQT;KSKAKLTISQDLNQTT;SKAKLTISQDLNQTTF;KAKLTISQDLNQTTFE;AKLT
ISQDLNQTTFEI;KLTISQDLNQTTFEIF;LTISQDLNQTTFEIFK;TISQDLNQTTFEIFKE
;ISQDLNQTTFEIFKED;SQDLNQTTFEIFKEDG;QDLNQTTFEIFKEDGK;DLNQTTFEIFK
EDGKT;LNQTTFEIFKEDGKTL;NQTTFEIFKEDGKTLV;QTTFEIFKEDGKTLVS;TTFEIF
KEDGKTLVSR;TFEIFKEDGKTLVSRK;FEIFKEDGKTLVSRKV;EIFKEDGKTLVSRKVN;I
FKEDGKTLVSRKVNS;FKEDGKTLVSRKVNSK;KEDGKTLVSRKVNSKD;EDGKTLVSRKVNS
KDK;DGKTLVSRKVNSKDKS;GKTLVSRKVNSKDKSS;KTLVSRKVNSKDKSST;TLVSRKVN
SKDKSSTE;LVSRKVNSKDKSSTEE;VSRKVNSKDKSSTEEK;SRKVNSKDKSSTEEKF;RKV

Fig. 43 continued

| | |
|---|---|
| NSKDKSSTEEKFN;KVNSKDKSSTEEKFND;VNSKDKSSTEEKFNDK;NSKDKSSTEEKFNDK G;SKDKSSTEEKFNDKGK;KDKSSTEEKFNDKGKL;DKSSTEEKFNDKGKLS;KSSTEEKFND KGKLSE;SSTEEKFNDKGKLSEK;STEEKFNDKGKLSEKV;TEEKFNDKGKLSEKVV;EEKFN DKGKLSEKVVT;EKFNDKGKLSEKVVTR;KFNDKGKLSEKVVTRA;FNDKGKLSEKVVTRAN; NDKGKLSEKVVTRANG;DKGKLSEKVVTRANGT;KGKLSEKVVTRANGTR;GKLSEKVVTRAN GTRL;KLSEKVVTRANGTRLE;LSEKVVTRANGTRLEY;SEKVVTRANGTRLEYT;EKVVTRA NGTRLEYTE;KVVTRANGTRLEYTEI;VVTRANGTRLEYTEIK;VTRANGTRLEYTEIKN;TR ANGTRLEYTEIKND;RANGTRLEYTEIKNDG;ANGTRLEYTEIKNDGS;NGTRLEYTEIKNDG SG;GTRLEYTEIKNDGSGK;TRLEYTEIKNDGSGKA;RLEYTEIKNDGSGKAK;LEYTEIKND GSGKAKE;EYTEIKNDGSGKAKEV;YTEIKNDGSGKAKEVL;TEIKNDGSGKAKEVLK;EIKN DGSGKAKEVLKG;IKNDGSGKAKEVLKGF;KNDGSGKAKEVLKGFA;NDGSGKAKEVLKGFAL ;DGSGKAKEVLKGFALE;GSGKAKEVLKGFALEG;SGKAKEVLKGFALEGT;GKAKEVLKGFA LEGTL;KAKEVLKGFALEGTLT;AKEVLKGFALEGTLTD;KEVLKGFALEGTLTDG;EVLKGF ALEGTLTDGG;VLKGFALEGTLTDGGE;LKGFALEGTLTDGGET;KGFALEGTLTDGGETK;G FALEGTLTDGGETKL;FALEGTLTDGGETKLT;ALEGTLTDGGETKLTV;LEGTLTDGGETKL TVT;EGTLTDGGETKLTVTE;GTLTDGGETKLTVTEG;TLTDGGETKLTVTEGT;LTDGGETK LTVTEGTV;TDGGETKLTVTEGTVT;DGGETKLTVTEGTVTL;GGETKLTVTEGTVTLS;GET KLTVTEGTVTLSK;ETKLTVTEGTVTLSKN;TKLTVTEGTVTLSKNI;KLTVTEGTVTLSKNI S;LTVTEGTVTLSKNIS;TVTEGTVTLSKNISK;VTEGTVTLSKNISKS;VTEGTVTLSKNISKSG;TEGTVTLSKN ISKSGE;EGTVTLSKNISKSGEI;GTVTLSKNISKSGEIT;TVTLSKNISKSGEITV;VTLSK NISKSGEITVA;TLSKNISKSGEITVAL;LSKNISKSGEITVALN;SKNISKSGEITVALND; KNISKSGEITVALNDT;NISKSGEITVALNDTE;ISKSGEITVALNDTET;SKSGEITVALND TETT;KSGEITVALNDTETTP;SGEITVALNDTETTPA;GEITVALNDTETTPAD;EITVALN DTETTPADK;ITVALNDTETTPADKK;TVALNDTETTPADKKT;VALNDTETTPADKKTG;AL NDTETTPADKKTGE;LNDTETTPADKKTGEW;NDTETTPADKKTGEWK;DTETTPADKKTGEW KS;TETTPADKKTGEWKSD;ETTPADKKTGEWKSDT;TTPADKKTGEWKSDTS;TPADKKTGE WKSDTST;PADKKTGEWKSDTSTL;ADKKTGEWKSDTSTLT;DKKTGEWKSDTSTLTI;KKTG EWKSDTSTLTIS;KTGEWKSDTSTLTISK;TGEWKSDTSTLTISKN;GEWKSDTSTLTISKNS ;EWKSDTSTLTISKNSQ;WKSDTSTLTISKNSQK;KSDTSTLTISKNSQKP;SDTSTLTISKN SQKPK;DTSTLTISKNSQKPKQ;TSTLTISKNSQKPKQL;STLTISKNSQKPKQLV;TLTISK NSQKPKQLVF;LTISKNSQKPKQLVFT;TISKNSQKPKQLVFTK;ISKNSQKPKQLVFTKE;S KNSQKPKQLVFTKEN;KNSQKPKQLVFTKENT;NSQKPKQLVFTKENTI;SQKPKQLVFTKEN TIT;QKPKQLVFTKENTITV;KPKQLVFTKENTITVQ;PKQLVFTKENTITVQN;KQLVFTKE NTITVQNY;QLVFTKENTITVQNYN;LVFTKENTITVQNYNR;VFTKENTITVQNYNRA;FTK ENTITVQNYNRAG;TKENTITVQNYNRAGN;KENTITVQNYNRAGNA;ENTITVQNYNRAGNA L;NTITVQNYNRAGNALE;TITVQNYNRAGNALEG;ITVQNYNRAGNALEGS;TVQNYNRAGN ALEGSP;VQNYNRAGNALEGSPA;QNYNRAGNALEGSPAE;NYNRAGNALEGSPAEI;YNRAG NALEGSPAEIK;NRAGNALEGSPAEIKD;RAGNALEGSPAEIKDL;AGNALEGSPAEIKDLA; GNALEGSPAEIKDLAE;NALEGSPAEIKDLAEL;ALEGSPAEIKDLAELK;LEGSPAEIKDLA ELKA;EGSPAEIKDLAELKAA;GSPAEIKDLAELKAAL;SPAEIKDLAELKAALK | |
| <YP_072829.1 basic membrane protein C;Borrelia garinii PBi> MFKRFVFIALSLLVLACFKSNKKSVKSDKVIIGVLANGSFYDKGYNQSVYDGVVKLKDDFGIK LITKSLRPYPIEGKRLLTVNEAMAEDAYEVQKNPLNLFWLAGYQFSSLSVKLSYERPDIYYGI IDAFDYGDIQVPKNSLATKFRNEEAAFLAGYIAAKMSRKEKIGFLTGPESEYLNDFKFGFKAG IFYANPKLRLVSKKAPSLFDKEKGKEMARFMYKEDKVGVIFPIAGITGLVYDAAKELGPKYY VIGLNQDQSYIAPQNVITSVLKDIGKVIYSVSSDYIKNGVFKGGVVIDRGLKEGVIEIVKDPD VLNNRLVNEVVELENKIISGEIIVPDSEYAFDLFKSKL<br><br>8 mers:<br>MFKRFVFI;FKRFVFIA;KRFVFIAL;RFVFIALS;FVFIALSL;VFIALSLL;FIALSLLV; IALSLLVL;ALSLLVLA;LSLLVLAC;SLLVLACF;LLVLACFK;LVLACFKS;VLACFKSN; LACFKSNK;ACFKSNKK;CFKSNKKS;FKSNKKSV;KSNKKSVK;SNKKSVKS;NKKSVKSD; KKSVKSDK;KSVKSDKV;SVKSDKVI;VKSDKVII;KSDKVIIG;SDKVIIGV;DKVIIGVL; KVIIGVLA;VIIGVLAN;IIGVLANG;IGVLANGS;GVLANGSF;VLANGSFY;LANGSFYD; ANGSFYDK;NGSFYDKG;GSFYDKGY;SFYDKGYN;FYDKGYNQ;YDKGYNQS;DKGYNQSV; KGYNQSVY;GYNQSVYD;YNQSVYDG;NQSVYDGV;QSVYDGVV;SVYDGVVK;VYDGVVKL; | 193918-196654 |

Fig. 43 continued

YDGVVKLK;DGVVKLKD;GVVKLKDD;VVKLKDDF;VKLKDDFG;KLKDDFGI;LKDDFGIK;
KDDFGIKL;DDFGIKLI;DFGIKLIT;FGIKLITK;GIKLITKS;IKLITKSL;KLITKSLR;
LITKSLRP;ITKSLRPY;TKSLRPYP;KSLRPYPI;SLRPYPIE;LRPYPIEG;RPYPIEGK;
PYPIEGKR;YPIEGKRL;PIEGKRLL;IEGKRLLT;EGKRLLTV;GKRLLTVN;KRLLTVNE;
RLLTVNEA;LLTVNEAM;LTVNEAMA;TVNEAMAE;VNEAMAED;NEAMAEDA;EAMAEDAY;
AMAEDAYE;MAEDAYEV;AEDAYEVQ;EDAYEVQK;DAYEVQKN;AYEVQKNP;YEVQKNPL;
EVQKNPLN;VQKNPLNL;QKNPLNLF;KNPLNLFW;NPLNLFWL;PLNLFWLA;LNLFWLAG;
NLFWLAGY;LFWLAGYQ;FWLAGYQF;WLAGYQFS;LAGYQFSS;AGYQFSSL;GYQFSSLS;
YQFSSLSV;QFSSLSVK;FSSLSVKL;SSLSVKLS;SLSVKLSY;LSVKLSYE;SVKLSYER;
VKLSYERP;KLSYERPD;LSYERPDI;SYERPDIY;YERPDIYY;ERPDIYYG;RPDIYYGI;
PDIYYGII;DIYYGIID;IYYGIIDA;YYGIIDAF;YGIIDAFD;GIIDAFDY;IIDAFDYG;
IDAFDYGD;DAFDYGDI;AFDYGDIQ;FDYGDIQV;DYGDIQVP;YGDIQVPK;GDIQVPKN;
DIQVPKNS;IQVPKNSL;QVPKNSLA;VPKNSLAI;PKNSLAIK;KNSLAIKF;NSLAIKFR;
SLAIKFRN;LAIKFRNE;AIKFRNEE;IKFRNEEA;KFRNEEAA;FRNEEAAF;RNEEAAFL;
NEEAAFLA;EEAAFLAG;EAAFLAGY;AAFLAGYI;AFLAGYIA;FLAGYIAA;LAGYIAAK;
AGYIAAKM;GYIAAKMS;YIAAKMSR;IAAKMSRK;AAKMSRKE;AKMSRKEK;KMSRKEKI;
MSRKEKIG;SRKEKIGF;RKEKIGFL;KEKIGFLT;EKIGFLTG;KIGFLTGP;IGFLTGPE;
GFLTGPES;FLTGPESE;LTGPESEY;TGPESEYL;GPESEYLN;PESEYLND;ESEYLNDF;
SEYLNDFK;EYLNDFKF;YLNDFKFG;LNDFKFGF;NDFKFGFK;DFKFGFKA;FKFGFKAG;
KFGFKAGI;FGFKAGIF;GFKAGIFY;FKAGIFYA;KAGIFYAN;AGIFYANP;GIFYANPK;
IFYANPKL;FYANPKLR;YANPKLRL;ANPKLRLV;NPKLRLVS;PKLRLVSK;KLRLVSKK;
LRLVSKKA;RLVSKKAP;LVSKKAPS;VSKKAPSL;SKKAPSLF;KKAPSLFD;KAPSLFDK;
APSLFDKE;PSLFDKEK;SLFDKEKG;LFDKEKGK;FDKEKGKE;DKEKGKEM;KEKGKEMA;
EKGKEMAR;KGKEMARF;GKEMARFM;KEMARFMY;EMARFMYK;MARFMYKE;ARFMYKED;
RFMYKEDK;FMYKEDKV;MYKEDKVG;YKEDKVGV;KEDKVGVI;EDKVGVIF;DKVGVIFP;
KVGVIFPI;VGVIFPIA;GVIFPIAG;VIFPIAGI;IFPIAGIT;FPIAGITG;PIAGITGL;
IAGITGLG;AGITGLGV;GITGLGVY;ITGLGVYD;TGLGVYDA;GLGVYDAA;LGVYDAAK;
GVYDAAKE;VYDAAKEL;YDAAKELG;DAAKELGP;AAKELGPK;AKELGPKY;KELGPKYY;
ELGPKYYV;LGPKYYVI;GPKYYVIG;PKYYVIGL;KYYVIGLN;YYVIGLNQ;YVIGLNQD;
VIGLNQDQ;IGLNQDQS;GLNQDQSY;LNQDQSYI;NQDQSYIA;QDQSYIAP;DQSYIAPQ;
QSYIAPQN;SYIAPQNV;YIAPQNVI;IAPQNVIT;APQNVITS;PQNVITSV;QNVITSVL;
NVITSVLK;VITSVLKD;ITSVLKDI;TSVLKDIG;SVLKDIGK;VLKDIGKV;LKDIGKVI;
KDIGKVIY;DIGKVIYS;IGKVIYSV;GKVIYSVS;KVIYSVSS;VIYSVSSD;IYSVSSDY;
YSVSSDYI;SVSSDYIK;VSSDYIKN;SSDYIKNG;SDYIKNGV;DYIKNGVF;YIKNGVFK;
IKNGVFKG;KNGVFKGG;NGVFKGGV;GVFKGGVV;VFKGGVVI;FKGGVVID;KGGVVIDR;
GGVVIDRG;GVVIDRGL;VVIDRGLK;VIDRGLKE;IDRGLKEG;DRGLKEGV;RGLKEGVI;
GLKEGVIE;LKEGVIEI;KEGVIEIV;EGVIEIVK;GVIEIVKD;VIEIVKDP;IEIVKDPD;
EIVKDPDV;IVKDPDVL;VKDPDVLN;KDPDVLNN;DPDVLNNR;PDVLNNRL;DVLNNRLV;
VLNNRLVN;LNNRLVNE;NNRLVNEV;NRLVNEVV;RLVNEVVE;LVNEVVEL;VNEVVELE;
NEVVELEN;EVVELENK;VVELENKI;VELENKII;ELENKIIS;LENKIISG;ENKIISGE;
NKIISGEI;KIISGEII;IISGEIIV;ISGEIIVP;SGEIIVPD;GEIIVPDS;EIIVPDSE;
IIVPDSEY;IVPDSEYA;VPDSEYAF;PDSEYAFD;DSEYAFDL;SEYAFDLF;EYAFDLFK;
YAFDLFKS;AFDLFKSK;FDLFKSKL;

9 mers:
MFKRFVFIA;FKRFVFIAL;KRFVFIALS;RFVFIALSL;FVFIALSLL;VFIALSLLV;FIA
LSLLVL;IALSLLVLA;ALSLLVLAC;LSLLVLACF;SLLVLACFK;LLVLACFKS;LVLACF
KSN;VLACFKSNK;LACFKSNKK;ACFKSNKKS;CFKSNKKSV;FKSNKKSVK;KSNKKSVKS
;SNKKSVKSD;NKKSVKSDK;KKSVKSDKV;KSVKSDKVI;SVKSDKVII;VKSDKVIIG;KS
DKVIIGV;SDKVIIGVL;DKVIIGVLA;KVIIGVLAN;VIIGVLANG;IIGVLANGS;IGVLA
NGSF;GVLANGSFY;VLANGSFYD;LANGSFYDK;ANGSFYDKG;NGSFYDKGY;GSFYDKGY
N;SFYDKGYNQ;FYDKGYNQS;YDKGYNQSV;DKGYNQSVY;KGYNQSVYD;GYNQSVYDG;Y
NQSVYDGV;NQSVYDGVV;QSVYDGVVK;SVYDGVVKL;VYDGVVKLK;YDGVVKLKD;DGVV
KLKDD;GVVKLKDDF;VVKLKDDFG;VKLKDDFGI;KLKDDFGIK;LKDDFGIKL;KDDFGIK
LI;DDFGIKLIT;DFGIKLITK;FGIKLITKS;GIKLITKSL;IKLITKSLR;KLITKSLRP;
LITKSLRPY;ITKSLRPYP;TKSLRPYPI;KSLRPYPIE;SLRPYPIEG;LRPYPIEGK;RPY
PIEGKR;PYPIEGKRL;YPIEGKRLL;PIEGKRLLT;IEGKRLLTV;EGKRLLTVN;GKRLLT

Fig. 43 continued

VNE;KRLLTVNEA;RLLTVNEAM;LLTVNEAMA;LTVNEAMAE;TVNEAMAED;VNEAMAEDA
;NEAMAEDAY;EAMAEDAYE;AMAEDAYEV;MAEDAYEVQ;AEDAYEVQK;EDAYEVQKN;DA
YEVQKNP;AYEVQKNPL;YEVQKNPLN;EVQKNPLNL;VQKNPLNLF;QKNPLNLFW;KNPLN
LFWL;NPLNLFWLA;PLNLFWLAG;LNLFWLAGY;NLFWLAGYQ;LFWLAGYQF;FWLAGYQF
S;WLAGYQFSS;LAGYQFSSL;AGYQFSSLS;GYQFSSLSV;YQFSSLSVK;QFSSLSVKL;F
SSLSVKLS;SSLSVKLSY;SLSVKLSYE;LSVKLSYER;SVKLSYERP;VKLSYERPD;KLSY
ERPDI;LSYERPDIY;SYERPDIYY;YERPDIYYG;ERPDIYYGI;RPDIYYGII;PDIYYGI
ID;DIYYGIIDA;IYYGIIDAF;YYGIIDAFD;YGIIDAFDY;GIIDAFDYG;IIDAFDYGD;
IDAFDYGDI;DAFDYGDIQ;AFDYGDIQV;FDYGDIQVP;DYGDIQVPK;YGDIQVPKN;GDI
QVPKNS;DIQVPKNSL;IQVPKNSLA;QVPKNSLAI;VPKNSLAIK;PKNSLAIKF;KNSLAI
KFR;NSLAIKFRN;SLAIKFRNE;LAIKFRNEE;AIKFRNEEA;IKFRNEEAA;KFRNEEAAF
;FRNEEAAFL;RNEEAAFLA;NEEAAFLAG;EEAAFLAGY;EAAFLAGYI;AAFLAGYIA;AF
LAGYIAA;FLAGYIAAK;LAGYIAAKM;AGYIAAKMS;GYIAAKMSR;YIAAKMSRK;IAAKM
SRKE;AAKMSRKEK;AKMSRKEKI;KMSRKEKIG;MSRKEKIGF;SRKEKIGFL;RKEKIGFL
T;KEKIGFLTG;EKIGFLTGP;KIGFLTGPE;IGFLTGPES;GFLTGPESE;FLTGPESEY;L
TGPESEYL;TGPESEYLN;GPESEYLND;PESEYLNDF;ESEYLNDFK;SEYLNDFKF;EYLN
DFKFG;YLNDFKFGF;LNDFKFGFK;NDFKFGFKA;DFKFGFKAG;FKFGFKAGI;KFGFKAG
IF;FGFKAGIFY;GFKAGIFYA;FKAGIFYAN;KAGIFYANP;AGIFYANPK;GIFYANPKL;
IFYANPKLR;FYANPKLRL;YANPKLRLV;ANPKLRLVS;NPKLRLVSK;PKLRLVSKK;KLR
LVSKKA;LRLVSKKAP;RLVSKKAPS;LVSKKAPSL;VSKKAPSLF;SKKAPSLFD;KKAPSL
FDK;KAPSLFDKE;APSLFDKEK;PSLFDKEKG;SLFDKEKGK;LFDKEKGKE;FDKEKGKEM
;DKEKGKEMA;KEKGKEMAR;EKGKEMARF;KGKEMARFM;GKEMARFMY;KEMARFMYK;EM
ARFMYKE;MARFMYKED;ARFMYKEDK;RFMYKEDKV;FMYKEDKVG;MYKEDKVGV;YKEDK
VGVI;KEDKVGVIF;EDKVGVIFP;DKVGVIFPI;KVGVIFPIA;VGVIFPIAG;GVIFPIAG
I;VIFPIAGIT;IFPIAGITG;FPIAGITGL;PIAGITGLG;IAGITGLGV;AGITGLGVY;G
ITGLGVYD;ITGLGVYDA;TGLGVYDAA;GLGVYDAAK;LGVYDAAKE;GVYDAAKEL;VYDA
AKELG;YDAAKELGP;DAAKELGPK;AAKELGPKY;AKELGPKYY;KELGPKYYV;ELGPKYY
VI;LGPKYYVIG;GPKYYVIGL;PKYYVIGLN;KYYVIGLNQ;YYVIGLNQD;YVIGLNQDQ;
VIGLNQDQS;IGLNQDQSY;GLNQDQSYI;LNQDQSYIA;NQDQSYIAP;QDQSYIAPQ;DQS
YIAPQN;QSYIAPQNV;SYIAPQNVI;YIAPQNVIT;IAPQNVITS;APQNVITSV;PQNVIT
SVL;QNVITSVLK;NVITSVLKD;VITSVLKDI;ITSVLKDIG;TSVLKDIGK;SVLKDIGKV
;VLKDIGKVI;LKDIGKVIY;KDIGKVIYS;DIGKVIYSV;IGKVIYSVS;GKVIYSVSS;KV
IYSVSSD;VIYSVSSDY;IYSVSSDYI;YSVSSDYIK;SVSSDYIKN;VSSDYIKNG;SSDYI
KNGV;SDYIKNGVF;DYIKNGVFK;YIKNGVFKG;IKNGVFKGG;KNGVFKGGV;NGVFKGGV
V;GVFKGGVVI;VFKGGVVID;FKGGVVIDR;KGGVVIDRG;GGVVIDRGL;GVVIDRGLK;V
VIDRGLKE;VIDRGLKEG;IDRGLKEGV;DRGLKEGVI;RGLKEGVIE;GLKEGVIEI;LKEG
VIEIV;KEGVIEIVK;EGVIEIVKD;GVIEIVKDP;VIEIVKDPD;IEIVKDPDV;EIVKDPD
VL;IVKDPDVLN;VKDPDVLNN;KDPDVLNNR;DPDVLNNRL;PDVLNNRLV;DVLNNRLVN;
VLNNRLVNE;LNNRLVNEV;NNRLVNEVV;NRLVNEVVE;RLVNEVVEL;LVNEVVELE;VNE
VVELEN;NEVVELENK;EVVELENKI;VVELENKII;VELENKIIS;ELENKIISG;LENKII
SGE;ENKIISGEI;NKIISGEII;KIISGEIIV;IISGEIIVP;ISGEIIVPD;SGEIIVPDS
;GEIIVPDSE;EIIVPDSEY;IIVPDSEYA;IVPDSEYAF;VPDSEYAFD;PDSEYAFDL;DS
EYAFDLF;SEYAFDLFK;EYAFDLFKS;YAFDLFKSK;AFDLFKSKL;

10 mers:
MFKRFVFIAL;FKRFVFIALS;KRFVFIALSL;RFVFIALSLL;FVFIALSLLV;VFIALSLL
VL;FIALSLLVLA;IALSLLVLAC;ALSLLVLACF;LSLLVLACFK;SLLVLACFKS;LLVLA
CFKSN;LVLACFKSNK;VLACFKSNKK;LACFKSNKKS;ACFKSNKKSV;CFKSNKKSVK;FK
SNKKSVKS;KSNKKSVKSD;SNKKSVKSDK;NKKSVKSDKV;KKSVKSDKVI;KSVKSDKVII
;SVKSDKVIIG;VKSDKVIIGV;KSDKVIIGVL;SDKVIIGVLA;DKVIIGVLAN;KVIIGVL
ANG;VIIGVLANGS;IIGVLANGSF;IGVLANGSFY;GVLANGSFYD;VLANGSFYDK;LANG
SFYDKG;ANGSFYDKGY;NGSFYDKGYN;GSFYDKGYNQ;SFYDKGYNQS;FYDKGYNQSV;Y
DKGYNQSVY;DKGYNQSVYD;KGYNQSVYDG;GYNQSVYDGV;YNQSVYDGVV;NQSVYDGVV
K;QSVYDGVVKL;SVYDGVVKLK;VYDGVVKLKD;YDGVVKLKDD;DGVVKLKDDF;GVVKLK
DDFG;VVKLKDDFGI;VKLKDDFGIK;KLKDDFGIKL;LKDDFGIKLI;KDDFGIKLIT;DDF
GIKLITK;DFGIKLITKS;FGIKLITKSL;GIKLITKSLR;IKLITKSLRP;KLITKSLRPY;
LITKSLRPYP;ITKSLRPYPI;TKSLRPYPIE;KSLRPYPIEG;SLRPYPIEGK;LRPYPIEG

Fig. 43 continued

KR;RPYPIEGKRL;PYPIEGKRLL;YPIEGKRLLT;PIEGKRLLTV;IEGKRLLTVN;EGKRL
LTVNE;GKRLLTVNEA;KRLLTVNEAM;RLLTVNEAMA;LLTVNEAMAE;LTVNEAMAED;TV
NEAMAEDA;VNEAMAEDAY;NEAMAEDAYE;EAMAEDAYEV;AM

GSFYD; GVLANGSFYDK; VLANGSFYDKG; LANGSFYDKGY; ANGSFYDKGYN; NGSFYDKGY
NQ; GSFYDKGYNQS; SFYDKGYNQSV; FYDKGYNQSVY; YDKGYNQSVYD; DKGYNQSVYDG;
KGYNQSVYDGV; GYNQSVYDGVV; YNQSVYDGVVK; NQSVYDGVVKL; QSVYDGVVKLK; SVY
DGVVKLKD; VYDGVVKLKDD; YDGVVKLKDDF; DGVVKLKDDFG; GVVKLKDDFGI; VVKLKD
DFGIK; VKLKDDFGIKL; KLKDDFGIKLI; LKDDFGIKLIT; KDDFGIKLITK; DDFGIKLIT
KS; DFGIKLITKSL; FGIKLITKSLR; GIKLITKSLRP; IKLITKSLRPY; KLITKSLRPYP;
LITKSLRPYPI; ITKSLRPYPIE; TKSLRPYPIEG; KSLRPYPIEGK; SLRPYPIEGKR; LRP

PD;IISGEIIVPDS;ISGEIIVPDSE;SGEIIVPDSEY;GEIIVPDSEYA;EIIVPDSEYAF;
IIVPDSEYAFD;IVPDSEYAFDL;VPDSEYAFDLF;PDSEYAFDLFK;DSEYAFDLFKS;SEY
AFDLFKSK;EYAFDLFKSKL;

13 mers:
MFKRFVFIALSLL;FKRFVFIALSLLV;KRFVFIALSLLVL;RFVFIALSLLVLA;FVFIALS
LLVLAC;VFIALSLLVLACF;FIALSLLVLACFK;IALSLLVLACFKS;ALSLLVLACFKSN;
LSLLVLACFKSNK;SLLVLACFKSNKK;LLVLACFKSNKKS;LVLACFKSNKKSV;VLACFKS
NKKSVK;LACFKSNKKSVKS;ACFKSNKKSVKSD;CFKSNKKSVKSDK;FKSNKKSVKSDKV;
KSNKKSVKSDKVI;SNKKSVKSDKVII;NKKSVKSDKVIIG;KKSVKSDKVIIGV;KSVKSDK
VIIGVL;SVKSDKVIIGVLA;VKSDKVIIGVLAN;KSDKVIIGVLANG;SDKVIIGVLANGS;
DKVIIGVLANGSF;KVIIGVLANGSFY;VIIGVLANGSFYD;IIGVLANGSFYDK;IGVLANG
SFYDKG;GVLANGSFYDKGY;VLANGSFYDKGYN;LANGSFYDKGYNQ;ANGSFYDKGYNQS;
NGSFYDKGYNQSV;GSFYDKGYNQSVY;SFYDKGYNQSVYD;FYDKGYNQSVYDG;YDKGYNQ
SVYDGV;DKGYNQSVYDGVV;KGYNQSVYDGVVK;GYNQSVYDGVVKL;YNQSVYDGVVKLK;
NQSVYDGVVKLKD;QSVYDGVVKLKDD;SVYDGVVKLKDDF;VYDGVVKLKDDFG;YDGVVKL
KDDFGI;DGVVKLKDDFGIK;GVVKLKDDFGIKL;VVKLKDDFGIKLI;VKLKDDFGIKLIT;
KLKDDFGIKLITK;LKDDFGIKLITKS;KDDFGIKLITKSL;DDFGIKLITKSLR;DFGIKLI
TKSLRP;FGIKLITKSLRPY;GIKLITKSLRPYP;IKLITKSLRPYPI;KLITKSLRPYPIE;
LITKSLRPYPIEG;ITKSLRPYPIEGK;TKSLRPYPIEGKR;KSLRPYPIEGKRL;SLRPYPI
EGKRLL;LRPYPIEGKRLLT;RPYPIEGKRLLTV;PYPIEGKRLLTVN;YPIEGKRLLTVNE;
PIEGKRLLTVNEA;IEGKRLLTVNEAM;EGKRLLTVNEAMA;GKRLLTVNEAMAE;KRLLTVN
EAMAED;RLLTVNEAMAEDA;LLTVNEAMAEDAY;LTVNEAMAEDAYE;TVNEAMAEDAYEV;
VNEAMAEDAYEVQ;NEAMAEDAYEVQK;EAMAEDAYEVQKN;AMAEDAYEVQKNP;MAEDAYE
VQKNPL;AEDAYEVQKNPLN;EDAYEVQKNPLNL;DAYEVQKNPLNLF;AYEVQKNPLNLFW;
YEVQKNPLNLFWL;EVQKNPLNLFWLA;VQKNPLNLFWLAG;QKNPLNLFWLAGY;KNPLNLF
WLAGYQ;NPLNLFWLAGYQF;PLNLFWLAGYQFS;LNLFWLAGYQFSS;NLFWLAGYQFSSL;
LFWLAGYQFSSLS;FWLAGYQFSSLSV;WLAGYQFSSLSVK;LAGYQFSSLSVKL;AGYQFSS
LSVKLS;GYQFSSLSVKLSY;YQFSSLSVKLSYE;QFSSLSVKLSYER;FSSLSVKLSYERP;
SSLSVKLSYERPD;SLSVKLSYERPDI;LSVKLSYERPDIY;SVKLSYERPDIYY;VKLSYER
PDIYYG;KLSYERPDIYYGI;LSYERPDIYYGII;SYERPDIYYGIID;YERPDIYYGIIDA;
ERPDIYYGIIDAF;RPDIYYGIIDAFD;PDIYYGIIDAFDY;DIYYGIIDAFDYG;IYYGIID
AFDYGD;YYGIIDAFDYGDI;YGIIDAFDYGDIQ;GIIDAFDYGDIQV;IIDAFDYGDIQVP;
IDAFDYGDIQVPK;DAFDYGDIQVPKN;AFDYGDIQVPKNS;FDYGDIQVPKNSL;DYGDIQV
PKNSLA;YGDIQVPKNSLAI;GDIQVPKNSLAIK;DIQVPKNSLAIKF;IQVPKNSLAIKFR;
QVPKNSLAIKFRN;VPKNSLAIKFRNE;PKNSLAIKFRNEE;KNSLAIKFRNEEA;NSLAIKF
RNEEAA;SLAIKFRNEEAAF;LAIKFRNEEAAFL;AIKFRNEEAAFLA;IKFRNEEAAFLAG;
KFRNEEAAFLAGY;FRNEEAAFLAGYI;RNEEAAFLAGYIA;NEEAAFLAGYIAA;EEAAFLA
GYIAAK;EAAFLAGYIAAKM;AAFLAGYIAAKMS;AFLAGYIAAKMSR;FLAGYIAAKMSRK;
LAGYIAAKMSRKE;AGYIAAKMSRKEK;GYIAAKMSRKEKI;YIAAKMSRKEKIG;IAAKMSR
KEKIGF;AAKMSRKEKIGFL;AKMSRKEKIGFLT;KMSRKEKIGFLTG;MSRKEKIGFLTGP;
SRKEKIGFLTGPE;RKEKIGFLTGPES;KEKIGFLTGPESE;EKIGFLTGPESEY;KIGFLTG
PESEYL;IGFLTGPESEYLN;GFLTGPESEYLND;FLTGPESEYLNDF;LTGPESEYLNDFK;
TGPESEYLNDFKF;GPESEYLNDFKFG;PESEYLNDFKFGF;ESEYLNDFKFGFK;SEYLNDF
KFGFKA;EYLNDFKFGFKAG;YLNDFKFGFKAGI;LNDFKFGFKAGIF;NDFKFGFKAGIFY;
DFKFGFKAGIFYA;FKFGFKAGIFYAN;KFGFKAGIFYANP;FGFKAGIFYANPK;GFKAGIF
YANPKL;FKAGIFYANPKLR;KAGIFYANPKLRL;AGIFYANPKLRLV;GIFYANPKLRLVS;
IFYANPKLRLVSK;FYANPKLRLVSKK;YANPKLRLVSKKA;ANPKLRLVSKKAP;NPKLRLV
SKKAPS;PKLRLVSKKAPSL;KLRLVSKKAPSLF;LRLVSKKAPSLFD;RLVSKKAPSLFDK;
LVSKKAPSLFDKE;VSKKAPSLFDKEK;SKKAPSLFDKEKG;KKAPSLFDKEKGK;KAPSLFD
KEKGKE;APSLFDKEKGKEM;PSLFDKEKGKEMA;SLFDKEKGKEMAR;LFDKEKGKEMARF;
FDKEKGKEMARFM;DKEKGKEMARFMY;KEKGKEMARFMYK;EKGKEMARFMYKE;KGKEMAR
FMYKED;GKEMARFMYKEDK;KEMARFMYKEDKV;EMARFMYKEDKVG;MARFMYKEDKVGV;
ARFMYKEDKVGVI;RFMYKEDKVGVIF;FMYKEDKVGVIFP;MYKEDKVGVIFPI;YKEDKVG
VIFPIA;KEDKVGVIFPIAG;EDKVGVIFPIAGI;DKVGVIFPIAGIT;KVGVIFPIAGITG;
VGVIFPIAGITGL;GVIFPIAGITGLG;VIFPIAGITGLGV;IFPIAGITGLGVY;FPIAGIT
GLGVYD;PIAGITGLGVYDA;IAGITGLGVYDAA;AGITGLGVYDAAK;GITGLGVYDAAKE;

Fig. 43 continued

ITGLGVYDAAKEL;TGLGVYDAAKELG;GLGVYDAAKELGP;LGVYDAAKELGPK;GVYDAAK
ELGPKY;VYDAAKELGPKYY;YDAAKELGPKYYV;DAAKELGPKYYVI;AAKELGPKYYVIG;
AKELGPKYYVIGL;KELGPKYYVIGLN;ELGPKYYVIGLNQ;LGPKYYVIGLNQD;GPKYYVI
GLNQDQ;PKYYVIGLNQDQS;KYYVIGLNQDQSY;YYVIGLNQDQSYI;YVIGLNQDQSYIA;
VIGLNQDQSYIAP;IGLNQDQSYIAPQ;GLNQDQSYIAPQN;LNQDQSYIAPQNV;NQDQSYI
APQNVI;QDQSYIAPQNVIT;DQSYIAPQNVITS;QSYIAPQNVITSV;SYIAPQNVITSVL;
YIAPQNVITSVLK;IAPQNVITSVLKD;APQNVITSVLKDI;PQNVITSVLKDIG;QNVITSV
LKDIGK;NVITSVLKDIGKV;VITSVLKDIGKVI;ITSVLKDIGKVIY;TSVLKDIGKVIYS;
SVLKDIGKVIYSV;VLKDIGKVIYSVS;LKDIGKVIYSVSS;KDIGKVIYSVSSD;DIGKVIY
SVSSDY;IGKVIYSVSSDYI;GKVIYSVSSDYIK;KVIYSVSSDYIKN;VIYSVSSDYIKNG;
IYSVSSDYIKNGV;YSVSSDYIKNGVF;SVSSDYIKNGVFK;VSSDYIKNGVFKG;SSDYIKN
GVFKGG;SDYIKNGVFKGGV;DYIKNGVFKGGVV;YIKNGVFKGGVVI;IKNGVFKGGVVID;
KNGVFKGGVVIDR;NGVFKGGVVIDRG;GVFKGGVVIDRGL;VFKGGVVIDRGLK;FKGGVVI
DRGLKE;KGGVVIDRGLKEG;GGVVIDRGLKEGV;GVVIDRGLKEGVI;VVIDRGLKEGVIE;
VIDRGLKEGVIEI;IDRGLKEGVIEIV;DRGLKEGVIEIVK;RGLKEGVIEIVKD;GLKEGVI
EIVKDP;LKEGVIEIVKDPD;KEGVIEIVKDPDV;EGVIEIVKDPDVL;GVIEIVKDPDVLN;
VIEIVKDPDVLNN;IEIVKDPDVLNNR;EIVKDPDVLNNRL;IVKDPDVLNNRLV;VKDPDVL
NNRLVN;KDPDVLNNRLVNE;DPDVLNNRLVNEV;PDVLNNRLVNEVV;DVLNNRLVNEVVE;
VLNNRLVNEVVEL;LNNRLVNEVVELE;NNRLVNEVVELEN;NRLVNEVVELENK;RLVNEVV
ELENKI;LVNEVVELENKII;VNEVVELENKIIS;NEVVELENKIISG;EVVELENKIISGE;
VVELENKIISGEI;VELENKIISGEII;ELENKIISGEIIV;LENKIISGEIIVP;ENKIISG
EIIVPD;NKIISGEIIVPDS;KIISGEIIVPDSE;IISGEIIVPDSEY;ISGEIIVPDSEYA;
SGEIIVPDSEYAF;GEIIVPDSEYAFD;EIIVPDSEYAFDL;IIVPDSEYAFDLF;IVPDSEY
AFDLFK;VPDSEYAFDLFKS;PDSEYAFDLFKSK;DSEYAFDLFKSKL;

14 mers:
MFKRFVFIALSLLV;FKRFVFIALSLLVL;KRFVFIALSLLVLA;RFVFIALSLLVLAC;FVF
IALSLLVLACF;VFIALSLLVLACFK;FIALSLLVLACFKS;IALSLLVLACFKSN;ALSLLV
LACFKSNK;LSLLVLACFKSNKK;SLLVLACFKSNKKS;LLVLACFKSNKKSV;LVLACFKSN
KKSVK;VLACFKSNKKSVKS;LACFKSNKKSVKSD;ACFKSNKKSVKSDK;CFKSNKKSVKSD
KV;FKSNKKSVKSDKVI;KSNKKSVKSDKVII;SNKKSVKSDKVIIG;NKKSVKSDKVIIGV;
KKSVKSDKVIIGVL;KSVKSDKVIIGVLA;SVKSDKVIIGVLAN;VKSDKVIIGVLANG;KSD
KVIIGVLANGS;SDKVIIGVLANGSF;DKVIIGVLANGSFY;KVIIGVLANGSFYD;VIIGVL
ANGSFYDK;IIGVLANGSFYDKG;IGVLANGSFYDKGY;GVLANGSFYDKGYN;VLANGSFYD
KGYNQ;LANGSFYDKGYNQS;ANGSFYDKGYNQSV;NGSFYDKGYNQSVY;GSFYDKGYNQSV
YD;SFYDKGYNQSVYDG;FYDKGYNQSVYDGV;YDKGYNQSVYDGVV;DKGYNQSVYDGVVK;
KGYNQSVYDGVVKL;GYNQSVYDGVVKLK;YNQSVYDGVVKLKD;NQSVYDGVVKLKDD;QSV
YDGVVKLKDDF;SVYDGVVKLKDDFG;VYDGVVKLKDDFGI;YDGVVKLKDDFGIK;DGVVKL
KDDFGIKL;GVVKLKDDFGIKLI;VVKLKDDFGIKLIT;VKLKDDFGIKLITK;KLKDDFGIK
LITKS;LKDDFGIKLITKSL;KDDFGIKLITKSLR;DDFGIKLITKSLRP;DFGIKLITKSLR
PY;FGIKLITKSLRPYP;GIKLITKSLRPYPI;IKLITKSLRPYPIE;KLITKSLRPYPIEG;
LITKSLRPYPIEGK;ITKSLRPYPIEGKR;TKSLRPYPIEGKRL;KSLRPYPIEGKRLL;SLR
PYPIEGKRLLT;LRPYPIEGKRLLTV;RPYPIEGKRLLTVN;PYPIEGKRLLTVNE;YPIEGK
RLLTVNEA;PIEGKRLLTVNEAM;IEGKRLLTVNEAMA;EGKRLLTVNEAMAE;GKRLLTVNE
AMAED;KRLLTVNEAMAEDA;RLLTVNEAMAEDAY;LLTVNEAMAEDAYE;LTVNEAMAEDAY
EV;TVNEAMAEDAYEVQ;VNEAMAEDAYEVQK;NEAMAEDAYEVQKN;EAMAEDAYEVQKNP;
AMAEDAYEVQKNPL;MAEDAYEVQKNPLN;AEDAYEVQKNPLNL;EDAYEVQKNPLNLF;DAY
EVQKNPLNLFW;AYEVQKNPLNLFWL;YEVQKNPLNLFWLA;EVQKNPLNLFWLAG;VQKNPL
NLFWLAGY;QKNPLNLFWLAGYQ;KNPLNLFWLAGYQF;NPLNLFWLAGYQFS;PLNLFWLAG
YQFSS;LNLFWLAGYQFSSL;NLFWLAGYQFSSLS;LFWLAGYQFSSLSV;FWLAGYQFSSLS
VK;WLAGYQFSSLSVKL;LAGYQFSSLSVKLS;AGYQFSSLSVKLSY;GYQFSSLSVKLSYE;
YQFSSLSVKLSYER;QFSSLSVKLSYERP;FSSLSVKLSYERPD;SSLSVKLSYERPDI;SLS
VKLSYERPDIY;LSVKLSYERPDIYY;SVKLSYERPDIYYG;VKLSYERPDIYYGI;KLSYER
PDIYYGII;LSYERPDIYYGIID;SYERPDIYYGIIDA;YERPDIYYGIIDAF;ERPDIYYGI
IDAFD;RPDIYYGIIDAFDY;PDIYYGIIDAFDYG;DIYYGIIDAFDYGD;IYYGIIDAFDYG
DI;YYGIIDAFDYGDIQ;YGIIDAFDYGDIQV;GIIDAFDYGDIQVP;IIDAFDYGDIQVPK;
IDAFDYGDIQVPKN;DAFDYGDIQVPKNS;AFDYGDIQVPKNSL;FDYGDIQVPKNSLA;DYG

Fig. 43 continued

DIQVPKNSLAI; YGDIQVPKNSLAIK; GDIQVPKNSLAIKF; DIQVPKNSLAIKFR; IQVPKN
SLAIKFRN; QVPKNSLAIKFRNE; VPKNSLAIKFRNEE; PKNSLAIKFRNEEA; KNSLAIKFR
NEEAA; NSLAIKFRNEEAAF; SLAIKFRNEEAAFL; LAIKFRNEEAAFLA; AIKFRNEEAAFL
AG; IKFRNEEAAFLAGY; KFRNEEAAFLAGYI; FRNEEAAFLAGYIA; RNEEAAFLAGYIAA;
NEEAAFLAGYIAAK; EEAAFLAGYIAAKM; EAAFLAGYIAAKMS; AAFLAGYIAAKMSR; AFL
AGYIAAKMSRK; FLAGYIAAKMSRKE; LAGYIAAKMSRKEK; AGYIAAKMSRKEKI; GYIAAK
MSRKEKIG; YIAAKMSRKEKIGF; IAAKMSRKEKIGFL; AAKMSRKEKIGFLT; AKMSRKEKI
GFLTG; KMSRKEKIGFLTGP; MSRKEKIGFLTGPE; SRKEKIGFLTGPES; RKEKIGFLTGPE
SE; KEKIGFLTGPESEY; EKIGFLTGPESEYL; KIGFLTGPESEYLN; IGFLTGPESEYLND;
GFLTGPESEYLNDF; FLTGPESEYLNDFK; LTGPESEYLNDFKF;TGPESEYLNDFKFG;GPE
SEYLNDFKFGF;PESEYLNDFKFGFK;ESEYLNDFKFGFKA;SEYLNDFKFGFKAG;EYLNDF
KFGFKAGI;YLNDFKFGFKAGIF;LNDFKFGFKAGIFY;NDFKFGFKAGIFYA;DFKFGFKAG
IFYAN;FKFGFKAGIFYANP;KFGFKAGIFYANPK;FGFKAGIFYANPKL;GFKAGIFYANPK
LR;FKAGIFYANPKLRL;KAGIFYANPKLRLV;AGIFYANPKLRLVS;GIFYANPKLRLVSK;
IFYANPKLRLVSKK;FYANPKLRLVSKKA;YANPKLRLVSKKAP;ANPKLRLVSKKAPS;NPK
LRLVSKKAPSL;PKLRLVSKKAPSLF;KLRLVSKKAPSLFD;LRLVSKKAPSLFDK;RLVSKK
APSLFDKE;LVSKKAPSLFDKEK;VSKKAPSLFDKEKG;SKKAPSLFDKEKGK;KKAPSLFDK
EKGKE;KAPSLFDKEKGKEM;APSLFDKEKGKEMA;PSLFDKEKGKEMAR;SLFDKEKGKEMA
RF;LFDKEKGKEMARFM;FDKEKGKEMARFMY;DKEKGKEMARFMYK;KEKGKEMARFMYKE;
EKGKEMARFMYKED;KGKEMARFMYKEDK;GKEMARFMYKEDKV;KEMARFMYKEDKVG;EMA
RFMYKEDKVGV;MARFMYKEDKVGVI;ARFMYKEDKVGVIF;RFMYKEDKVGVIFP;FMYKED
KVGVIFPI;MYKEDKVGVIFPIA;YKEDKVGVIFPIAG;KEDKVGVIFPIAGI;EDKVGVIFP
IAGIT;DKVGVIFPIAGITG;KVGVIFPIAGITGL;VGVIFPIAGITGLG;GVIFPIAGITGL
GV;VIFPIAGITGLGVY;IFPIAGITGLGVYD;FPIAGITGLGVYDA;PIAGITGLGVYDAA;
IAGITGLGVYDAAK;AGITGLGVYDAAKE;GITGLGVYDAAKEL;ITGLGVYDAAKELG;TGL
GVYDAAKELGP;GLGVYDAAKELGPK;LGVYDAAKELGPKY;GVYDAAKELGPKYY;VYDAAK
ELGPKYYV;YDAAKELGPKYYVI;DAAKELGPKYYVIG;AAKELGPKYYVIGL;AKELGPKYY
VIGLN;KELGPKYYVIGLNQ;ELGPKYYVIGLNQD;LGPKYYVIGLNQDQ;GPKYYVIGLNQD
QS;PKYYVIGLNQDQSY;KYYVIGLNQDQSYI;YYVIGLNQDQSYIA;YVIGLNQDQSYIAP;
VIGLNQDQSYIAPQ;IGLNQDQSYIAPQN;GLNQDQSYIAPQNV;LNQDQSYIAPQNVI;NQD
QSYIAPQNVIT;QDQSYIAPQNVITS;DQSYIAPQNVITSV;QSYIAPQNVITSVL;SYIAPQ
NVITSVLK;YIAPQNVITSVLKD;IAPQNVITSVLKDI;APQNVITSVLKDIG;PQNVITSVL
KDIGK;QNVITSVLKDIGKV;NVITSVLKDIGKVI;VITSVLKDIGKVIY;ITSVLKDIGKVI
YS;TSVLKDIGKVIYSV;SVLKDIGKVIYSVS;VLKDIGKVIYSVSS;LKDIGKVIYSVSSD;
KDIGKVIYSVSSDY;DIGKVIYSVSSDYI;IGKVIYSVSSDYIK;GKVIYSVSSDYIKN;KVI
YSVSSDYIKNG;VIYSVSSDYIKNGV;IYSVSSDYIKNGVF;YSVSSDYIKNGVFK;SVSSDY
IKNGVFKG;VSSDYIKNGVFKGG;SSDYIKNGVFKGGV;SDYIKNGVFKGGVV;DYIKNGVFK
GGVVI;YIKNGVFKGGVVID;IKNGVFKGGVVIDR;KNGVFKGGVVIDRG;NGVFKGGVVIDR
GL;GVFKGGVVIDRGLK;VFKGGVVIDRGLKE;FKGGVVIDRGLKEG;KGGVVIDRGLKEGV;
GGVVIDRGLKEGVI;GVVIDRGLKEGVIE;VVIDRGLKEGVIEI;VIDRGLKEGVIEIV;IDR
GLKEGVIEIVK;DRGLKEGVIEIVKD;RGLKEGVIEIVKDP;GLKEGVIEIVKDPD;LKEGVI
EIVKDPDV;KEGVIEIVKDPDVL;EGVIEIVKDPDVLN;GVIEIVKDPDVLNN;VIEIVKDPD
VLNNR;IEIVKDPDVLNNRL;EIVKDPDVLNNRLV;IVKDPDVLNNRLVN;VKDPDVLNNRLV
NE;KDPDVLNNRLVNEV;DPDVLNNRLVNEVV;PDVLNNRLVNEVVE;DVLNNRLVNEVVEL;
VLNNRLVNEVVELE;LNNRLVNEVVELEN;NNRLVNEVVELENK;NRLVNEVVELENKI;RLV
NEVVELENKII;LVNEVVELENKIIS;VNEVVELENKIISG;NEVVELENKIISGE;EVVELE
NKIISGEI;VVELENKIISGEII;VELENKIISGEIIV;ELENKIISGEIIVP;LENKIISGE
IIVPD;ENKIISGEIIVPDS;NKIISGEIIVPDSE;KIISGEIIVPDSEY;IISGEIIVPDSE
YA;ISGEIIVPDSEYAF;SGEIIVPDSEYAFD;GEIIVPDSEYAFDL;EIIVPDSEYAFDLF;
IIVPDSEYAFDLFK;IVPDSEYAFDLFKS;VPDSEYAFDLFKSK;PDSEYAFDLFKSKL;

15 mers:
MFKRFVFIALSLLVL;FKRFVFIALSLLVLA;KRFVFIALSLLVLAC;RFVFIALSLLVLACF
;FVFIALSLLVLACFK;VFIALSLLVLACFKS;FIALSLLVLACFKSN;IALSLLVLACFKSN
K;ALSLLVLACFKSNKK;LSLLVLACFKSNKKS;SLLVLACFKSNKKSV;LLVLACFKSNKKS
VK;LVLACFKSNKKSVKS;VLACFKSNKKSVKSD;LACFKSNKKSVKSDK;ACFKSNKKSVKS
DKV;CFKSNKKSVKSDKVI;FKSNKKSVKSDKVII;KSNKKSVKSDKVIIG;SNKKSVKSDKV

Fig. 43 continued

IIGV; NKKSVKSDKVIIGVL; KKSVKSDKVIIGVLA; KSVKSDKVIIGVLAN; SVKSDKVIIG
VLANG; VKSDKVIIGVLANGS; KSDKVIIGVLANGSF; SDKVIIGVLANGSFY; DKVIIGVLA
NGSFYD; KVIIGVLANGSFYDK; VIIGVLANGSFYDKG; IIGVLANGSFYDKGY; IGVLANGS
FYDKGYN; GVLANGSFYDKGYNQ; VLANGSFYDKGYNQS; LANGSFYDKGYNQSV; ANGSFYD

LGPKYYVIGLNQD;ELGPKYYVIGLNQDQ;LGPKYYVIGLNQDQS;GPKYYVIGLNQDQSY;P
KYYVIGLNQDQSYI;KYYVIGLNQDQSYIA;YYVIGLNQDQSYIAP;YVIGLNQDQSYIAPQ;
VIGLNQDQSYIAPQN;IGLNQDQSYIAPQNV;GLNQDQSYIAPQNVI;LNQDQSYIAPQNVIT
;NQDQSYIAPQNVITS;QDQSYIAPQNVITSV;DQSYIAPQNVITSVL;QSYIAPQNVITSVL
K;SYIAPQNVITSVLKD;YIAPQNVITSVLKDI;IAPQNVITSVLKDIG;APQNVITSVLKDI
GK;PQNVITSVLKDIGKV;QNVITSVLKDIGKVI;NVITSVLKDIGKVIY;VITSVLKDIGKV
IYS;ITSVLKDIGKVIYSV;TSVLKDIGKVIYSVS;SVLKDIGKVIYSVSS;VLKDIGKVIYS
VSSD;LKDIGKVIYSVSSDY;KDIGKVIYSVSSDYI;DIGKVIYSVSSDYIK;IGKVIYSVSS
DYIKN;GKVIYSVSSDYIKNG;KVIYSVSSDYIKNGV;VIYSVSSDYIKNGVF;IYSVSSDYI
KNGVFK;YSVSSDYIKNGVFKG;SVSSDYIKNGVFKGG;VSSDYIKNGVFKGGV;SSDYIKNG
VFKGGVV;SDYIKNGVFKGGVVI;DYIKNGVFKGGVVID;YIKNGVFKGGVVIDR;IKNGVFK
GGVVIDRG;KNGVFKGGVVIDRGL;NGVFKGGVVIDRGLK;GVFKGGVVIDRGLKE;VFKGGV
VIDRGLKEG;FKGGVVIDRGLKEGV;KGGVVIDRGLKEGVI;GGVVIDRGLKEGVIE;GVVID
RGLKEGVIEI;VVIDRGLKEGVIEIV;VIDRGLKEGVIEIVK;IDRGLKEGVIEIVKD;DRGL
KEGVIEIVKDP;RGLKEGVIEIVKDPD;GLKEGVIEIVKDPDV;LKEGVIEIVKDPDVL;KEG
VIEIVKDPDVLN;EGVIEIVKDPDVLNN;GVIEIVKDPDVLNNR;VIEIVKDPDVLNNRL;IE
IVKDPDVLNNRLV;EIVKDPDVLNNRLVN;IVKDPDVLNNRLVNE;VKDPDVLNNRLVNEV;K
DPDVLNNRLVNEVV;DPDVLNNRLVNEVVE;PDVLNNRLVNEVVEL;DVLNNRLVNEVVELE;
VLNNRLVNEVVELEN;LNNRLVNEVVELENK;NNRLVNEVVELENKI;NRLVNEVVELENKII
;RLVNEVVELENKIIS;LVNEVVELENKIISG;VNEVVELENKIISGE;NEVVELENKIISGE
I;EVVELENKIISGEII;VVELENKIISGEIIV;VELENKIISGEIIVP;ELENKIISGEIIV
PD;LENKIISGEIIVPDS;ENKIISGEIIVPDSE;NKIISGEIIVPDSEY;KIISGEIIVPDS
EYA;IISGEIIVPDSEYAF;ISGEIIVPDSEYAFD;SGEIIVPDSEYAFDL;GEIIVPDSEYA
FDLF;EIIVPDSEYAFDLFK;IIVPDSEYAFDLFKS;IVPDSEYAFDLFKSK;VPDSEYAFDL
FKSKL;

16 mers:
MFKRFVFIALSLLVLA;FKRFVFIALSLLVLAC;KRFVFIALSLLVLACF;RFVFIALSLLVL
ACFK;FVFIALSLLVLACFKS;VFIALSLLVLACFKSN;FIALSLLVLACFKSNK;IALSLLV
LACFKSNKK;ALSLLVLACFKSNKKS;LSLLVLACFKSNKKSV;SLLVLACFKSNKKSVK;LL
VLACFKSNKKSVKS;LVLACFKSNKKSVKSD;VLACFKSNKKSVKSDK;LACFKSNKKSVKSD
KV;ACFKSNKKSVKSDKVI;CFKSNKKSVKSDKVII;FKSNKKSVKSDKVIIG;KSNKKSVKS
DKVIIGV;SNKKSVKSDKVIIGVL;NKKSVKSDKVIIGVLA;KKSVKSDKVIIGVLAN;KSVK
SDKVIIGVLANG;SVKSDKVIIGVLANGS;VKSDKVIIGVLANGSF;KSDKVIIGVLANGSFY
;SDKVIIGVLANGSFYD;DKVIIGVLANGSFYDK;KVIIGVLANGSFYDKG;VIIGVLANGSF
YDKGY;IIGVLANGSFYDKGYN;IGVLANGSFYDKGYNQ;GVLANGSFYDKGYNQS;VLANGS
FYDKGYNQSV;LANGSFYDKGYNQSVY;ANGSFYDKGYNQSVYD;NGSFYDKGYNQSVYDG;G
SFYDKGYNQSVYDGV;SFYDKGYNQSVYDGVV;FYDKGYNQSVYDGVVK;YDKGYNQSVYDGV
VKL;DKGYNQSVYDGVVKLK;KGYNQSVYDGVVKLKD;GYNQSVYDGVVKLKDD;YNQSVYDG
VVKLKDDF;NQSVYDGVVKLKDDFG;QSVYDGVVKLKDDFGI;SVYDGVVKLKDDFGIK;VYD
GVVKLKDDFGIKL;YDGVVKLKDDFGIKLI;DGVVKLKDDFGIKLIT;GVVKLKDDFGIKLIT
K;VVKLKDDFGIKLITKS;VKLKDDFGIKLITKSL;KLKDDFGIKLITKSLR;LKDDFGIKLI
TKSLRP;KDDFGIKLITKSLRPY;DDFGIKLITKSLRPYP;DFGIKLITKSLRPYPI;FGIKL
ITKSLRPYPIE;GIKLITKSLRPYPIEG;IKLITKSLRPYPIEGK;KLITKSLRPYPIEGKR;
LITKSLRPYPIEGKRL;ITKSLRPYPIEGKRLL;TKSLRPYPIEGKRLLT;KSLRPYPIEGKR
LLTV;SLRPYPIEGKRLLTVN;LRPYPIEGKRLLTVNE;RPYPIEGKRLLTVNEA;PYPIEGK
RLLTVNEAM;YPIEGKRLLTVNEAMA;PIEGKRLLTVNEAMAE;IEGKRLLTVNEAMAED;EG
KRLLTVNEAMAEDA;GKRLLTVNEAMAEDAY;KRLLTVNEAMAEDAYE;RLLTVNEAMAEDAY
EV;LLTVNEAMAEDAYEVQ;LTVNEAMAEDAYEVQK;TVNEAMAEDAYEVQKN;VNEAMAEDA
YEVQKNP;NEAMAEDAYEVQKNPL;EAMAEDAYEVQKNPLN;AMAEDAYEVQKNPLNL;MAED
AYEVQKNPLNLF;AEDAYEVQKNPLNLFW;EDAYEVQKNPLNLFWL;DAYEVQKNPLNLFWLA
;AYEVQKNPLNLFWLAG;YEVQKNPLNLFWLAGY;EVQKNPLNLFWLAGYQ;VQKNPLNLFWL
AGYQF;QKNPLNLFWLAGYQFS;KNPLNLFWLAGYQFSS;NPLNLFWLAGYQFSSL;PLNLFW
LAGYQFSSLS;LNLFWLAGYQFSSLSV;NLFWLAGYQFSSLSVK;LFWLAGYQFSSLSVKL;F
WLAGYQFSSLSVKLS;WLAGYQFSSLSVKLSY;LAGYQFSSLSVKLSYE;AGYQFSSLSVKLS
YER;GYQFSSLSVKLSYERP;YQFSSLSVKLSYERPD;QFSSLSVKLSYERPDI;FSSLSVKL
SYERPDIY;SSLSVKLSYERPDIYY;SLSVKLSYERPDIYYG;LSVKLSYERPDIYYGI;SVK

Fig. 43 continued

LSYERPDIYYGII;VKLSYERPDIYYGIID;KLSYERPDIYYGIIDA;LSYERPDIYYGIIDA
F;SYERPDIYYGIIDAFD;YERPDIYYGIIDAFDY;ERPDIYYGIIDAFDYG;RPDIYYGIID
AFDYGD;PDIYYGIIDAFDYGDI;DIYYGIIDAFDYGDIQ;IYYGIIDAFDYGDIQV;YYGII
DAFDYGDIQVP;YGIIDAFDYGDIQVPK;GIIDAFDYGDIQVPKN;IIDAFDYGDIQVPKNS

| | |
|---|---|
| NKIISGEII;EVVELENKIISGEIIV;VVELENKIISGEIIVP;VELENKIISGEIIVPD;EL ENKIISGEIIVPDS;LENKIISGEIIVPDSE;ENKIISGEIIVPDSEY;NKIISGEIIVPDSE YA;KIISGEIIVPDSEYAF;IISGEIIVPDSEYAFD;ISGEIIVPDSEYAFDL;SGEIIVPDS EYAFDLF;GEIIVPDSEYAFDLFK;EIIVPDSEYAFDLFKS;IIVPDSEYAFDLFKSK;IVPD SEYAFDLFKSKL | |
| <YP_710005.1 heat shock protein 90;Borrelia afzelii PKo<br>MKKQFDTEVNDLLYLIIHSLYSHKEIFLRELISNASDAIDKLKFLSLTNEKFKNIALEPKIEI TFDDKSILIKDNGIGMNEQELTNHLGVIAKSGTKEFINNLKQDEKKSANLIGQFGVGFYSAFI VSEKVEVTSKKALESDAYIWSSDGKTGYEIEKAKKEDPGTEIKLYLNKEGLEYANKWKIQEIV KKYSNHINYPIYIKYNEPIMKDGKQEGIEEKEEKLNETTALWTKNKSEIKTEEYNEFYKNTTF DYENPLMYIHTKAEGNLEYTNLFYIPSKAPYDLYYPNTKPGVKLFINRIFITDSEGSLLPNYL RFIKGIIDCQDLPLNVSREILQQNKILSKIKSSSVKKILSELEKLSKKNPEKFSEFSKEFGRC IKEGVYSDFENREKLISLIRFKSSSVDGFVSFKEYKERMNEGQKSIYYITGGKENILKENPIV TAYKEKGFEILIMDDELDEAILNLIPEYEGLKLKAINKNETSNELKDENFKKIEEEFKDTLTR VKEILKDQIKEVNLSATLIKEPSAIIVDSNDPTYQMQKIMLSMGQEVKEIKPILELNPNNKIV QNLKNLEPEKLEKISILLFEEALLTSGMPSKNPRKFINIINEFLEKDLL<br><br>8 mers:<br>MKKQFDTE;KKQFDTEV;KQFDTEVN;QFDTEVND;FDTEVNDL;DTEVNDLL;TEVNDLLY; EVNDLLYL;VNDLLYLI;NDLLYLII;DLLYLIIH;LLYLIIHS;LYLIIHSL;YLIIHSLY; LIIHSLYS;IIHSLYSH;IHSLYSHK;HSLYSHKE;SLYSHKEI;LYSHKEIF;YSHKEIFL; SHKEIFLR;HKEIFLRE;KEIFLREL;EIFLRELI;IFLRELIS;FLRELISN;LRELISNA; RELISNAS;ELISNASD;LISNASDA;ISNASDAI;SNASDAID;NASDAIDK;ASDAIDKL; SDAIDKLK;DAIDKLKF;AIDKLKFL;IDKLKFLS;DKLKFLSL;KLKFLSLT;LKFLSLTN; KFLSLTNE;FLSLTNEK;LSLTNEKF;SLTNEKFK;LTNEKFKN;TNEKFKNI;NEKFKNIA; EKFKNIAL;KFKNIALE;FKNIALEP;KNIALEPK;NIALEPKI;IALEPKIE;ALEPKIEI; LEPKIEIT;EPKIEITF;PKIEITFD;KIEITFDD;IEITFDDK;EITFDDKS;ITFDDKSI; TFDDKSIL;FDDKSILI;DDKSILIK;DKSILIKD;KSILIKDN;SILIKDNG;ILIKDNGI; LIKDNGIG;IKDNGIGM;KDNGIGMN;DNGIGMNE;NGIGMNEQ;GIGMNEQE;IGMNEQEL; GMNEQELT;MNEQELTN;NEQELTNH;EQELTNHL;QELTNHLG;ELTNHLGV;LTNHLGVI; TNHLGVIA;NHLGVIAK;HLGVIAKS;LGVIAKSG;GVIAKSGT;VIAKSGTK;IAKSGTKE; AKSGTKEF;KSGTKEFI;SGTKEFIN;GTKEFINN;TKEFINNL;KEFINNLK;EFINNLKQ; FINNLKQD;INNLKQDE;NNLKQDEK;NLKQDEKK;LKQDEKKS;KQDEKKSA;QDEKKSAN; DEKKSANL;EKKSANLI;KKSANLIG;KSANLIGQ;SANLIGQF;ANLIGQFG;NLIGQFGV; LIGQFGVG;IGQFGVGF;GQFGVGFY;QFGVGFYS;FGVGFYSA;GVGFYSAF;VGFYSAFI; GFYSAFIV;FYSAFIVS;YSAFIVSE;SAFIVSEK;AFIVSEKV;FIVSEKVE;IVSEKVEV; VSEKVEVT;SEKVEVTS;EKVEVTSK;KVEVTSKK;VEVTSKKA;EVTSKKAL;VTSKKALE; TSKKALES;SKKALESD;KKALESDA;KALESDAY;ALESDAYI;LESDAYIW;ESDAYIWS; SDAYIWSS;DAYIWSSD;AYIWSSDG;YIWSSDGK;IWSSDGKT;WSSDGKTG;SSDGKTGY; SDGKTGYE;DGKTGYEI;GKTGYEIE;KTGYEIEK;TGYEIEKA;GYEIEKAK;YEIEKAKK; EIEKAKKE;IEKAKKED;EKAKKEDP;KAKKEDPG;AKKEDPGT;KKEDPGTE;KEDPGTEI; EDPGTEIK;DPGTEIKL;PGTEIKLY;GTEIKLYL;TEIKLYLN;EIKLYLNK;IKLYLNKE; KLYLNKEG;LYLNKEGL;YLNKEGLE;LNKEGLEY;NKEGLEYA;KEGLEYAN;EGLEYANK; GLEYANKW;LEYANKWK;EYANKWKI;YANKWKIQ;ANKWKIQE;NKWKIQEI;KWKIQEIV; WKIQEIVK;KIQEIVKK;IQEIVKKY;QEIVKKYS;EIVKKYSN;IVKKYSNH;VKKYSNHI; KKYSNHIN;KYSNHINY;YSNHINYP;SNHINYPI;NHINYPIY;HINYPIYI;INYPIYIK; NYPIYIKY;YPIYIKYN;PIYIKYNE;IYIKYNEP;YIKYNEPI;IKYNEPIM;KYNEPIMK; YNEPIMKD;NEPIMKDG;EPIMKDGK;PIMKDGKQ;IMKDGKQE;MKDGKQEG;KDGKQEGI; DGKQEGIE;GKQEGIEE;KQEGIEEK;QEGIEEKE;EGIEEKEE;GIEEKEEK;IEEKEEKL; EEKEEKLN;EKEEKLNE;KEEKLNET;EEKLNETT;EKLNETTA;KLNETTAL;LNETTALW; NETTALWT;ETTALWTK;TTALWTKN;TALWTKNK;ALWTKNKS;LWTKNKSE;WTKNKSEI; TKNKSEIK;KNKSEIKT;NKSEIKTE;KSEIKTEE;SEIKTEEY;EIKTEEYN;IKTEEYNE; KTEEYNEF;TEEYNEFY;EEYNEFYK;EYNEFYKN;YNEFYKNT;NEFYKNTT;EFYKNTTF; FYKNTTFD;YKNTTFDY;KNTTFDYE;NTTFDYEN;TTFDYENP;TFDYENPL;FDYENPLM; DYENPLMY;YENPLMYI;ENPLMYIH;NPLMYIHT;PLMYIHTK;LMYIHTKA;MYIHTKAE; YIHTKAEG;IHTKAEGN;HTKAEGNL;TKAEGNLE;KAEGNLEY;AEGNLEYT;EGNLEYTN; GNLEYTNL;NLEYTNLF;LEYTNLFY;EYTNLFYI;YTNLFYIP;TNLFYIPS;NLFYIPSK; | 196655-201495 |

Fig. 43 continued

LFYIPSKA;FYIPSKAP;YIPSKAPY;IPSKAPYD;PSKAPYDL;SKAPYDLY;KAPYDLYY;
APYDLYYP;PYDLYYPN;YDLYYPNT;DLYYPNTK;LYYPNTKP;YYPNTKPG;YPNTKPGV;
PNTKPGVK;NTKPGVKL;TKPGVKLF;KPGVKLFI;PGVKLFIN;GVKLFINR;VKLFINRI;
KLFINRIF;LFINRIFI;FINRIFIT;INRIFITD;NRIFITDS;RIFITDSE;IFITDSEG;
FITDSEGS;ITDSEGSL;TDSEGSLL;DSEGSLLP;SEGSLLPN;EGSLLPNY;GSLLPNYL;
SLLPNYLR;LLPNYLRF;LPNYLRFI;PNYLRFIK;NYLRFIKG;YLRFIKGI;LRFIKGII;
RFIKGIID;FIKGIIDC;IKGIIDCQ;KGIIDCQD;GIIDCQDL;IIDCQDLP;IDCQDLPL;
DCQDLPLN;CQDLPLNV;QDLPLNVS;DLPLNVSR;LPLNVSRE;PLNVSREI;LNVSREIL;
NVSREILQ;VSREILQQ;SREILQQN;REILQQNK;EILQQNKI;ILQQNKIL;LQQNKILS;
QQNKILSK;QNKILSKI;NKILSKIK;KILSKIKS;ILSKIKSS;LSKIKSSS;SKIKSSSV;
KIKSSSVK;IKSSSVKK;KSSSVKKI;SSSVKKIL;SSVKKILS;SVKKILSE;VKKILSEL;
KKILSELE;KILSELEK;ILSELEKL;LSELEKLS;SELEKLSK;ELEKLSKK;LEKLSKKN;
EKLSKKNP;KLSKKNPE;LSKKNPEK;SKKNPEKF;KKNPEKFS;KNPEKFSE;NPEKFSEF;
PEKFSEFS;EKFSEFSK;KFSEFSKE;FSEFSKEF;SEFSKEFG;EFSKEFGR;FSKEFGRC;
SKEFGRCI;KEFGRCIK;EFGRCIKE;FGRCIKEG;GRCIKEGV;RCIKEGVY;CIKEGVYS;
IKEGVYSD;KEGVYSDF;EGVYSDFE;GVYSDFEN;VYSDFENR;YSDFENRE;SDFENREK;
DFENREKL;FENREKLI;ENREKLIS;NREKLISL;REKLISLI;EKLISLIR;KLISLIRF;
LISLIRFK;ISLIRFKS;SLIRFKSS;LIRFKSSS;IRFKSSSV;RFKSSSVD;FKSSSVDG;
KSSSVDGF;SSSVDGFV;SSVDGFVS;SVDGFVSF;VDGFVSFK;DGFVSFKE;GFVSFKEY;
FVSFKEYK;VSFKEYKE;SFKEYKER;FKEYKERM;KEYKERMN;EYKERMNE;YKERMNEG;
KERMNEGQ;ERMNEGQK;RMNEGQKS;MNEGQKSI;NEGQKSIY;EGQKSIYY;GQKSIYYI;
QKSIYYIT;KSIYYITG;SIYYITGG;IYYITGGK;YYITGGKE;YITGGKEN;ITGGKENI;
TGGKENIL;GGKENILK;GKENILKE;KENILKEN;ENILKENP;NILKENPI;ILKENPIV;
LKENPIVT;KENPIVTA;ENPIVTAY;NPIVTAYK;PIVTAYKE;IVTAYKEK;VTAYKEKG;
TAYKEKGF;AYKEKGFE;YKEKGFEI;KEKGFEIL;EKGFEILI;KGFEILIM;GFEILIMD;
FEILIMDD;EILIMDDE;ILIMDDEL;LIMDDELD;IMDDELDE;MDDELDEA;DDELDEAI;
DELDEAIL;ELDEAILN;LDEAILNL;DEAILNLI;EAILNLIP;AILNLIPE;ILNLIPEY;
LNLIPEYE;NLIPEYEG;LIPEYEGL;IPEYEGLK;PEYEGLKL;EYEGLKLK;YEGLKLKA;
EGLKLKAI;GLKLKAIN;LKLKAINK;KLKAINKN;LKAINKNE;KAINKNET;AINKNETS;
INKNETSN;NKNETSNE;KNETSNEL;NETSNELK;ETSNELKD;TSNELKDE;SNELKDEN;
NELKDENF;ELKDENFK;LKDENFKK;KDENFKKI;DENFKKIE;ENFKKIEE;NFKKIEEE;
FKKIEEEF;KKIEEEFK;KIEEEFKD;IEEEFKDT;EEEFKDTL;EEFKDTLT;EFKDTLTR;
FKDTLTRV;KDTLTRVK;DTLTRVKE;TLTRVKEI;LTRVKEIL;TRVKEILK;RVKEILKD;
VKEILKDQ;KEILKDQI;EILKDQIK;ILKDQIKE;LKDQIKEV;KDQIKEVN;DQIKEVNL;
QIKEVNLS;IKEVNLSA;KEVNLSAT;EVNLSATL;VNLSATLI;NLSATLIK;LSATLIKE;
SATLIKEP;ATLIKEPS;TLIKEPSA;LIKEPSAI;IKEPSAII;KEPSAIIV;EPSAIIVD;
PSAIIVDS;SAIIVDSN;AIIVDSND;IIVDSNDP;IVDSNDPT;VDSNDPTY;DSNDPTYQ;
SNDPTYQM;NDPTYQMQ;DPTYQMQK;PTYQMQKI;TYQMQKIM;YQMQKIML;QMQKIMLS;
MQKIMLSM;QKIMLSMG;KIMLSMGQ;IMLSMGQE;MLSMGQEV;LSMGQEVK;SMGQEVKE;
MGQEVKEI;GQEVKEIK;QEVKEIKP;EVKEIKPI;VKEIKPIL;KEIKPILE;EIKPILEL;
IKPILELN;KPILELNP;PILELNPN;ILELNPNN;LELNPNNK;ELNPNNKI;LNPNNKIV;
NPNNKIVQ;PNNKIVQN;NNKIVQNL;NKIVQNLK;KIVQNLKN;IVQNLKNL;VQNLKNLE;
QNLKNLEP;NLKNLEPE;LKNLEPEK;KNLEPEKL;NLEPEKLE;LEPEKLEK;EPEKLEKI;
PEKLEKIS;EKLEKISI;KLEKISIL;LEKISILL;EKISILLF;KISILLFE;ISILLFEE;
SILLFEEA;ILLFEEAL;LLFEEALL;LFEEALLT;FEEALLTS;EEALLTSG;EALLTSGM;
ALLTSGMP;LLTSGMPS;LTSGMPSK;TSGMPSKN;SGMPSKNP;GMPSKNPR;MPSKNPRK;
PSKNPRKF;SKNPRKFI;KNPRKFIN;NPRKFINI;PRKFINII;RKFINIIN;KFINIINE;
FINIINEF;INIINEFL;NIINEFLE;IINEFLEK;INEFLEKD;NEFLEKDL;EFLEKDLL;

9 mers:
MKKQFDTEV;KKQFDTEVN;KQFDTEVND;QFDTEVNDL;FDTEVNDLL;DTEVNDLLY;TEV
NDLLYL;EVNDLLYLI;VNDLLYLII;NDLLYLIIH;DLLYLIIHS;LLYLIIHSL;LYLIIH
SLY;YLIIHSLYS;LIIHSLYSH;IIHSLYSHK;IHSLYSHKE;HSLYSHKEI;SLYSHKEIF
;LYSHKEIFL;YSHKEIFLR;SHKEIFLRE;HKEIFLREL;KEIFLRELI;EIFLRELIS;IF
LRELISN;FLRELISNA;LRELISNAS;RELISNASD;ELISNASDA;LISNASDAI;ISNAS
DAID;SNASDAIDK;NASDAIDKL;ASDAIDKLK;SDAIDKLKF;DAIDKLKFL;AIDKLKFL
S;IDKLKFLSL;DKLKFLSLT;KLKFLSLTN;LKFLSLTNE;KFLSLTNEK;FLSLTNEKF;L

Fig. 43 continued

| | |
|---|---|
| SLTNEKFK;SLTNEKFKN;LTNEKFKNI;TNEKFKNIA;NEKFKNIAL;EKFKNIALE;KFKN<br>IALEP;FKNIALEPK;KNIALEPKI;NIALEPKIE;IALEPKIEI;ALEPKIEIT;LEPKIEI<br>TF;EPKIEITFD;PKIEITFDD;KIEITFDDK;IEITFDDKS;EITFDDKSI;ITFDDKSIL;<br>TFDDKSILI;FDDKSILIK;DDKSILIKD;DKSILIKDN;KSILIKDNG;SILIKDNGI;ILI<br>KDNGIG;LIKDNGIGM;IKDNGIGMN;KDNGIGMNE;DNGIGMNEQ;NGIGMNEQE;GIGMNE<br>QEL;IGMNEQELT;GMNEQELTN;MNEQELTNH;NEQELTNHL;EQELTNHLG;QELTNHLGV<br>;ELTNHLGVI;LTNHLGVIA;TNHLGVIAK;NHLGVIAKS;HLGVIAKSG;LGVIAKSGT;GV<br>IAKSGTK;VIAKSGTKE;IAKSGTKEF;AKSGTKEFI;KSGTKEFIN;SGTKEFINN;GTKEF<br>INNL;TKEFINNLK;KEFINNLKQ;EFINNLKQD;FINNLKQDE;INNLKQDEK;NNLKQDEK<br>K;NLKQDEKKS;LKQDEKKSA;KQDEKKSAN;QDEKKSANL;DEKKSANLI;EKKSANLIG;K<br>KSANLIGQ;KSANLIGQF;SANLIGQFG;ANLIGQFGV;NLIGQFGVG;LIGQFGVGF;IGQF<br>GVGFY;GQFGVGFYS;QFGVGFYSA;FGVGFYSAF;GVGFYSAFI;VGFYSAFIV;GFYSAFI<br>VS;FYSAFIVSE;YSAFIVSEK;SAFIVSEKV;AFIVSEKVE;FIVSEKVEV;IVSEKVEVT;<br>VSEKVEVTS;SEKVEVTSK;EKVEVTSKK;KVEVTSKKA;VEVTSKKAL;EVTSKKALE;VTS<br>KKALES;TSKKALESD;SKKALESDA;KKALESDAY;KALESDAYI;ALESDAYIW;LESDAY<br>IWS;ESDAYIWSS;SDAYIWSSD;DAYIWSSDG;AYIWSSDGK;YIWSSDGKT;IWSSDGKTG<br>;WSSDGKTGY;SSDGKTGYE;SDGKTGYEI;DGKTGYEIE;GKTGYEIEK;KTGYEIEKA;TG<br>YEIEKAK;GYEIEKAKK;YEIEKAKKE;EIEKAKKED;IEKAKKEDP;EKAKKEDPG;KAKKE<br>DPGT;AKKEDPGTE;KKEDPGTEI;KEDPGTEIK;EDPGTEIKL;DPGTEIKLY;PGTEIKLY<br>L;GTEIKLYLN;TEIKLYLNK;EIKLYLNKE;IKLYLNKEG;KLYLNKEGL;LYLNKEGLE;Y<br>LNKEGLEY;LNKEGLEYA;NKEGLEYAN;KEGLEYANK;EGLEYANKW;GLEYANKWK;LEYA<br>NKWKI;EYANKWKIQ;YANKWKIQE;ANKWKIQEI;NKWKIQEIV;KWKIQEIVK;WKIQEIV<br>KK;KIQEIVKKY;IQEIVKKYS;QEIVKKYSN;EIVKKYSNH;IVKKYSNHI;VKKYSNHIN;<br>KKYSNHINY;KYSNHINYP;YSNHINYPI;SNHINYPIY;NHINYPIYI;HINYPIYIK;INY<br>PIYIKY;NYPIYIKYN;YPIYIKYNE;PIYIKYNEP;IYIKYNEPI;YIKYNEPIM;IKYNEP<br>IMK;KYNEPIMKD;YNEPIMKDG;NEPIMKDGK;EPIMKDGKQ;PIMKDGKQE;IMKDGKQEG<br>;MKDGKQEGI;KDGKQEGIE;DGKQEGIEE;GKQEGIEEK;KQEGIEEKE;QEGIEEKEE;EG<br>IEEKEEK;GIEEKEEKL;IEEKEEKLN;EEKEEKLNE;EKEEKLNET;KEEKLNETT;EEKLN<br>ETTA;EKLNETTAL;KLNETTALW;LNETTALWT;NETTALWTK;ETTALWTKN;TTALWTKN<br>K;TALWTKNKS;ALWTKNKSE;LWTKNKSEI;WTKNKSEIK;TKNKSEIKT;KNKSEIKTE;N<br>KSEIKTEE;KSEIKTEEY;SEIKTEEYN;EIKTEEYNE;IKTEEYNEF;KTEEYNEFY;TEEY<br>NEFYK;EEYNEFYKN;EYNEFYKNT;YNEFYKNTT;NEFYKNTTF;EFYKNTTFD;FYKNTTF<br>DY;YKNTTFDYE;KNTTFDYEN;NTTFDYENP;TTFDYENPL;TFDYENPLM;FDYENPLMY;<br>DYENPLMYI;YENPLMYIH;ENPLMYIHT;NPLMYIHTK;PLMYIHTKA;LMYIHTKAE;MYI<br>HTKAEG;YIHTKAEGN;IHTKAEGNL;HTKAEGNLE;TKAEGNLEY;KAEGNLEYT;AEGNLE<br>YTN;EGNLEYTNL;GNLEYTNLF;NLEYTNLFY;LEYTNLFYI;EYTNLFYIP;YTNLFYIPS<br>;TNLFYIPSK;NLFYIPSKA;LFYIPSKAP;FYIPSKAPY;YIPSKAPYD;IPSKAPYDL;PS<br>KAPYDLY;SKAPYDLYY;KAPYDLYYP;APYDLYYPN;PYDLYYPNT;YDLYYPNTK;DLYYP<br>NTKP;LYYPNTKPG;YYPNTKPGV;YPNTKPGVK;PNTKPGVKL;NTKPGVKLF;TKPGVKLF<br>I;KPGVKLFIN;PGVKLFINR;GVKLFINRI;VKLFINRIF;KLFINRIFI;LFINRIFIT;F<br>INRIFITD;INRIFITDS;NRIFITDSE;RIFITDSEG;IFITDSEGS;FITDSEGSL;ITDS<br>EGSLL;TDSEGSLLP;DSEGSLLPN;SEGSLLPNY;EGSLLPNYL;GSLLPNYLR;SLLPNYL<br>RF;LLPNYLRFI;LPNYLRFIK;PNYLRFIKG;NYLRFIKGI;YLRFIKGII;LRFIKGIID;<br>RFIKGIIDC;FIKGIIDCQ;IKGIIDCQD;KGIIDCQDL;GIIDCQDLP;IIDCQDLPL;IDC<br>QDLPLN;DCQDLPLNV;CQDLPLNVS;QDLPLNVSR;DLPLNVSRE;LPLNVSREI;PLNVSR<br>EIL;LNVSREILQ;NVSREILQQ;VSREILQQN;SREILQQNK;REILQQNKI;EILQQNKIL<br>;ILQQNKILS;LQQNKILSK;QQNKILSKI;QNKILSKIK;NKILSKIKS;KILSKIKSS;IL<br>SKIKSSS;LSKIKSSSV;SKIKSSSVK;KIKSSSVKK;IKSSSVKKI;KSSSVKKIL;SSSVK<br>KILS;SSVKKILSE;SVKKILSEL;VKKILSELE;KKILSELEK;KILSELEKL;ILSELEKL<br>S;LSELEKLSK;SELEKLSKK;ELEKLSKKN;LEKLSKKNP;EKLSKKNPE;KLSKKNPEK;L<br>SKKNPEKF;SKKNPEKFS;KKNPEKFSE;KNPEKFSEF;NPEKFSEFS;PEKFSEFSK;EKFS<br>EFSKE;KFSEFSKEF;FSEFSKEFG;SEFSKEFGR;EFSKEFGRC;FSKEFGRCI;SKEFGRC<br>IK;KEFGRCIKE;EFGRCIKEG;FGRCIKEGV;GRCIKEGVY;RCIKEGVYS;CIKEGVYSD;<br>IKEGVYSDF;KEGVYSDFE;EGVYSDFEN;GVYSDFENR;VYSDFENRE;YSDFENREK;SDF<br>ENREKL;DFENREKLI;FENREKLIS;ENREKLISL;NREKLISLI;REKLISLIR;EKLISL<br>IRF;KLISLIRFK;LISLIRFKS;ISLIRFKSS;SLIRFKSSS;LIRFKSSSV;IRFKSSSVD<br>;RFKSSSVDG;FKSSSVDGF;KSSSVDGFV;SSSVDGFVS;SSVDGFVSF;SVDGFVSFK;VD | |

Fig. 43 continued

GFVSFKE;DGFVSFKEY;GFVSFKEYK;FVSFKEYKE;VSFKEYKER;SFKEYKERM;FKEYK
ERMN;KEYKERMNE;EYKERMNEG;YKERMNEGQ;KERMNEGQK;ERMNEGQKS;RMNEGQKS
I;MNEGQKSIY;NEGQKSIYY;EGQKSIYYI;GQKSIYYIT;QKSIYYITG;KSIYYITGG;S
IYYITGGK;IYYITGGKE;YYITGGKEN;YITGGKENI;ITGGKENIL;T

VSEKVEVTSK;SEKVEVTSKK;EKVEVTSKKA;KVEVTSKKAL;VEVTSKKALE;EVTSKKAL
ES;VTSKKALESD;TSKKALESDA;SKKALESDAY;KKALESDAYI;KALESDAYIW;ALESD
AYIWS;LESDAYIWSS;ESDAYIWSSD;SDAYIWSSDG;DAYIWSSDGK;AYIWSSDGKT;YI
WSSDGKTG;IWSSDGKTGY;WSSDGKTGYE;SSDGKTGYEI;SDGKTGYEIE;DGKTGY

LDEAI;MDDELDEAIL;DDELDEAILN;DELDEAILNL;ELDEAILNLI;LDEAILNLIP;DE
AILNLIPE;EAILNLIPEY;AILNLIPEYE;ILNLIPEYEG;LNLIPEYEGL;NLIPEYEGLK
;LIPEYEGLKL;IPEYEGLKLK;PEYEGLKLKA;EYEGLKLKAI;YEGLKLKAIN;EGLKLKA
INK;GLKLKAINKN;LKLKAINKNE;KLKAINKNET;LKAINKNETS;KAINKNETSN;AINK
NETSNE;INKNETSNEL;NKNETSNELK;KNETSNELKD;NETSNELKDE;ETSNELKDEN;T
SNELKDENF;SNELKDENFK;NELKDENFKK;ELKDENFKKI;LKDENFKKIE;KDENFKKIE
E;DENFKKIEEE;ENFKKIEEEF;NFKKIEEEFK;FKKIEEEFKD;KKIEEEFKDT;KIEEEF
KDTL;IEEEFKDTLT;EEEFKDTLTR;EEFKDTLTRV;EFKDTLTRVK;FKDTLTRVKE;KDT
LTRVKEI;DTLTRVKEIL;TLTRVKEILK;LTRVKEILKD;TRVKEILKDQ;RVKEILKDQI;
VKEILKDQIK;KEILKDQIKE;EILKDQIKEV;ILKDQIKEVN;LKDQIKEVNL;KDQIKEVN
LS;DQIKEVNLSA;QIKEVNLSAT;IKEVNLSATL;KEVNLSATLI;EVNLSATLIK;VNLSA
TLIKE;NLSATLIKEP;LSATLIKEPS;SATLIKEPSA;ATLIKEPSAI;TLIKEPSAII;LI
KEPSAIIV;IKEPSAIIVD;KEPSAIIVDS;EPSAIIVDSN;PSAIIVDSND;SAIIVDSNDP
;AIIVDSNDPT;IIVDSNDPTY;IVDSNDPTYQ;VDSNDPTYQM;DSNDPTYQMQ;SNDPTYQ
MQK;NDPTYQMQKI;DPTYQMQKIM;PTYQMQKIML;TYQMQKIMLS;YQMQKIMLSM;QMQK
IMLSMG;MQKIMLSMGQ;QKIMLSMGQE;KIMLSMGQEV;IMLSMGQEVK;MLSMGQEVKE;L
SMGQEVKEI;SMGQEVKEIK;MGQEVKEIKP;GQEVKEIKPI;QEVKEIKPIL;EVKEIKPIL
E;VKEIKPILEL;KEIKPILELN;EIKPILELNP;IKPILELNPN;KPILELNPNN;PILELN
PNNK;ILELNPNNKI;LELNPNNKIV;ELNPNNKIVQ;LNPNNKIVQN;NPNNKIVQNL;PNN
KIVQNLK;NNKIVQNLKN;NKIVQNLKNL;KIVQNLKNLE;IVQNLKNLEP;VQNLKNLEPE;
QNLKNLEPEK;NLKNLEPEKL;LKNLEPEKLE;KNLEPEKLEK;NLEPEKLEKI;LEPEKLEK
IS;EPEKLEKISI;PEKLEKISIL;EKLEKISILL;KLEKISILLF;LEKISILLFE;EKISI
LLFEE;KISILLFEEA;ISILLFEEAL;SILLFEEALL;ILLFEEALLT;LLFEEALLTS;LF
EEALLTSG;FEEALLTSGM;EEALLTSGMP;EALLTSGMPS;ALLTSGMPSK;LLTSGMPSKN
;LTSGMPSKNP;TSGMPSKNPR;SGMPSKNPRK;GMPSKNPRKF;MPSKNPRKFI;PSKNPRK
FIN;SKNPRKFINI;KNPRKFINII;NPRKFINIIN;PRKFINIINE;RKFINIINEF;KFIN
IINEFL;FINIINEFLE;INIINEFLEK;NIINEFLEKD;IINEFLEKDL;INEFLEKDLL;

11 mers:
MKKQFDTEVND;KKQFDTEVNDL;KQFDTEVNDLL;QFDTEVNDLLY;FDTEVNDLLYL;DTE
VNDLLYLI;TEVNDLLYLII;EVNDLLYLIIH;VNDLLYLIIHS;NDLLYLIIHSL;DLLYLI
IHSLY;LLYLIIHSLYS;LYLIIHSLYSH;YLIIHSLYSHK;LIIHSLYSHKE;IIHSLYSHK
EI;IHSLYSHKEIF;HSLYSHKEIFL;SLYSHKEIFLR;LYSHKEIFLRE;YSHKEIFLREL;
SHKEIFLRELI;HKEIFLRELIS;KEIFLRELISN;EIFLRELISNA;IFLRELISNAS;FLR
ELISNASD;LRELISNASDA;RELISNASDAI;ELISNASDAID;LISNASDAIDK;ISNASD
AIDKL;SNASDAIDKLK;NASDAIDKLKF;ASDAIDKLKFL;SDAIDKLKFLS;DAIDKLKFL
SL;AIDKLKFLSLT;IDKLKFLSLTN;DKLKFLSLTNE;KLKFLSLTNEK;LKFLSLTNEKF;
KFLSLTNEKFK;FLSLTNEKFKN;LSLTNEKFKNI;SLTNEKFKNIA;LTNEKFKNIAL;TNE
KFKNIALE;NEKFKNIALEP;EKFKNIALEPK;KFKNIALEPKI;FKNIALEPKIE;KNIALE
PKIEI;NIALEPKIEIT;IALEPKIEITF;ALEPKIEITFD;LEPKIEITFDD;EPKIEITFD
DK;PKIEITFDDKS;KIEITFDDKSI;IEITFDDKSIL;EITFDDKSILI;ITFDDKSILIK;
TFDDKSILIKD;FDDKSILIKDN;DDKSILIKDNG;DKSILIKDNGI;KSILIKDNGIG;SIL
IKDNGIGM;ILIKDNGIGMN;LIKDNGIGMNE;IKDNGIGMNEQ;KDNGIGMNEQE;DNGIGM
NEQEL;NGIGMNEQELT;GIGMNEQELTN;IGMNEQELTNH;GMNEQELTNHL;MNEQELTNH
LG;NEQELTNHLGV;EQELTNHLGVI;QELTNHLGVIA;ELTNHLGVIAK;LTNHLGVIAKS;
TNHLGVIAKSG;NHLGVIAKSGT;HLGVIAKSGTK;LGVIAKSGTKE;GVIAKSGTKEF;VIA
KSGTKEFI;IAKSGTKEFIN;AKSGTKEFINN;KSGTKEFINNL;SGTKEFINNLK;GTKEFI
NNLKQ;TKEFINNLKQD;KEFINNLKQDE;EFINNLKQDEK;FINNLKQDEKK;INNLKQDEK
KS;NNLKQDEKKSA;NLKQDEKKSAN;LKQDEKKSANL;KQDEKKSANLI;QDEKKSANLIG;
DEKKSANLIGQ;EKKSANLIGQF;KKSANLIGQFG;KSANLIGQFGV;SANLIGQFGVG;ANL
IGQFGVGF;NLIGQFGVGFY;LIGQFGVGFYS;IGQFGVGFYSA;GQFGVGFYSAF;QFGVGF
YSAFI;FGVGFYSAFIV;GVGFYSAFIVS;VGFYSAFIVSE;GFYSAFIVSEK;FYSAFIVSE
KV;YSAFIVSEKVE;SAFIVSEKVEV;AFIVSEKVEVT;FIVSEKVEVTS;IVSEKVEVTSK;
VSEKVEVTSKK;SEKVEVTSKKA;EKVEVTSKKAL;KVEVTSKKALE;VEVTSKKALES;EVT
SKKALESD;VTSKKALESDA;TSKKALESDAY;SKKALESDAYI;KKALESDAYIW;KALESD
AYIWS;ALESDAYIWSS;LESDAYIWSSD;ESDAYIWSSDG;SDAYIWSSDGK;DAYIWSSDG
KT;AYIWSSDGKTG;YIWSSDGKTGY;IWSSDGKTGYE;WSSDGKTGYEI;SSDGKTGYEIE;

Fig. 43 continued

| | |
|---|---|
| SDGKTGYEIEK; DGKTGYEIEKA; GKTGYEIEKAK; KTGYEIEKAKK; TGYEIEKAKKE; GYE<br>IEKAKKED; YEIEKAKKEDP; EIEKAKKEDPG; IEKAKKEDPGT; EKAKKEDPGTE; KAKKED<br>PGTEI; AKKEDPGTEIK; KKEDPGTEIKL; KEDPGTEIKLY; EDPGTEIKLYL; DPGTEIKLY<br>LN; PGTEIKLYLNK; GTEIKLYLNKE; TEIKLYLNKEG; EIKLYLNKEGL; IKLYLNKEGLE;<br>KLYLNKEGLEY; LYLNKEGLEYA; YLNKEGLEYAN; LNKEGLEYANK; NKEGLEYANKW; KEG<br>LEYANKWK; EGLEYANKWKI; GLEYANKWKIQ; LEYANKWKIQE; EYANKWKIQEI; YANKWK<br>IQEIV; ANKWKIQEIVK; NKWKIQEIVKK; KWKIQEIVKKY; WKIQEIVKKYS; KIQEIVKKY<br>SN; IQEIVKKYSNH; QEIVKKYSNHI; EIVKKYSNHIN; IVKKYSNHINY; VKKYSNHINYP;<br>KKYSNHINYPI; KYSNHINYPIY; YSNHINYPIYI; SNHINYPIYIK; NHINYPIYIKY; HIN<br>YPIYIKYN; INYPIYIKYNE; NYPIYIKYNEP; YPIYIKYNEPI; PIYIKYNEPIM; IYIKYN<br>EPIMK; YIKYNEPIMKD; IKYNEPIMKDG; KYNEPIMKDGK; YNEPIMKDGKQ; NEPIMKDGK<br>QE; EPIMKDGKQEG; PIMKDGKQEGI; IMKDGKQEGIE; MKDGKQEGIEE; KDGKQEGIEEK;<br>DGKQEGIEEKE; GKQEGIEEKEE; KQEGIEEKEEK; QEGIEEKEEKL; EGIEEKEEKLN; GIE<br>EKEEKLNE; IEEKEEKLNET; EEKEEKLNETT; EKEEKLNETTA; KEEKLNETTAL; EEKLNE<br>TTALW; EKLNETTALWT; KLNETTALWTK; LNETTALWTKN; NETTALWTKNK; ETTALWTKN<br>KS; TTALWTKNKSE; TALWTKNKSEI; ALWTKNKSEIK; LWTKNKSEIKT; WTKNKSEIKTE;<br>TKNKSEIKTEE; KNKSEIKTEEY; NKSEIKTEEYN; KSEIKTEEYNE; SEIKTEEYNEF; EIK<br>TEEYNEFY; IKTEEYNEFYK; KTEEYNEFYKN; TEEYNEFYKNT; EEYNEFYKNTT; EYNEFY<br>KNTTF; YNEFYKNTTFD; NEFYKNTTFDY; EFYKNTTFDYE; FYKNTTFDYEN; YKNTTFDYE<br>NP; KNTTFDYENPL; NTTFDYENPLM; TTFDYENPLMY; TFDYENPLMYI; FDYENPLMYIH;<br>DYENPLMYIHT; YENPLMYIHTK; ENPLMYIHTKA; NPLMYIHTKAE; PLMYIHTKAEG; LMY<br>IHTKAEGN; MYIHTKAEGNL; YIHTKAEGNLE; IHTKAEGNLEY; HTKAEGNLEYT; TKAEGN<br>LEYTN; KAEGNLEYTNL; AEGNLEYTNLF; EGNLEYTNLFY; GNLEYTNLFYI; NLEYTNLFY<br>IP; LEYTNLFYIPS; EYTNLFYIPSK; YTNLFYIPSKA; TNLFYIPSKAP; NLFYIPSKAPY;<br>LFYIPSKAPYD; FYIPSKAPYDL; YIPSKAPYDLY; IPSKAPYDLYY; PSKAPYDLYYP; SKA<br>PYDLYYPN; KAPYDLYYPNT; APYDLYYPNTK; PYDLYYPNTKP; YDLYYPNTKPG; DLYYPN<br>TKPGV; LYYPNTKPGVK; YYPNTKPGVKL; YPNTKPGVKLF; PNTKPGVKLFI; NTKPGVKLF<br>IN; TKPGVKLFINR; KPGVKLFINRI; PGVKLFINRIF; GVKLFINRIFI; VKLFINRIFIT;<br>KLFINRIFITD; LFINRIFITDS; FINRIFITDSE; INRIFITDSEG; NRIFITDSEGS; RIF<br>ITDSEGSL; IFITDSEGSLL; FITDSEGSLLP; ITDSEGSLLPN; TDSEGSLLPNY; DSEGSL<br>LPNYL; SEGSLLPNYLR; EGSLLPNYLRF; GSLLPNYLRFI; SLLPNYLRFIK; LLPNYLRFI<br>KG; LPNYLRFIKGI; PNYLRFIKGII; NYLRFIKGIID; YLRFIKGIIDC; LRFIKGIIDCQ;<br>RFIKGIIDCQD; FIKGIIDCQDL; IKGIIDCQDLP; KGIIDCQDLPL; GIIDCQDLPLN; IID<br>CQDLPLNV; IDCQDLPLNVS; DCQDLPLNVSR; CQDLPLNVSRE; QDLPLNVSREI; DLPLNV<br>SREIL; LPLNVSREILQ; PLNVSREILQQ; LNVSREILQQN; NVSREILQQNK; VSREILQQN<br>KI; SREILQQNKIL; REILQQNKILS; EILQQNKILSK; ILQQNKILSKI; LQQNKILSKIK;<br>QQNKILSKIKS; QNKILSKIKSS; NKILSKIKSSS; KILSKIKSSSV; ILSKIKSSSVK; LSK<br>IKSSSVKK; SKIKSSSVKKI; KIKSSSVKKIL; IKSSSVKKILS; KSSSVKKILSE; SSSVKK<br>ILSEL; SSVKKILSELE; SVKKILSELEK; VKKILSELEKL; KKILSELEKLS; KILSELEKL<br>SK; ILSELEKLSKK; LSELEKLSKKN; SELEKLSKKNP; ELEKLSKKNPE; LEKLSKKNPEK;<br>EKLSKKNPEKF; KLSKKNPEKFS; LSKKNPEKFSE; SKKNPEKFSEF; KKNPEKFSEFS; KNP<br>EKFSEFSK; NPEKFSEFSKE; PEKFSEFSKEF; EKFSEFSKEFG; KFSEFSKEFGR; FSEFSK<br>EFGRC; SEFSKEFGRCI; EFSKEFGRCIK; FSKEFGRCIKE; SKEFGRCIKEG; KEFGRCIKE<br>GV; EFGRCIKEGVY; FGRCIKEGVYS; GRCIKEGVYSD; RCIKEGVYSDF; CIKEGVYSDFE;<br>IKEGVYSDFEN; KEGVYSDFENR; EGVYSDFENRE; GVYSDFENREK; VYSDFENREKL; YSD<br>FENREKLI; SDFENREKLIS; DFENREKLISL; FENREKLISLI; ENREKLISLIR; NREKLI<br>SLIRF; REKLISLIRFK; EKLISLIRFKS; KLISLIRFKSS; LISLIRFKSSS; ISLIRFKSS<br>SV; SLIRFKSSSVD; LIRFKSSSVDG; IRFKSSSVDGF; RFKSSSVDGFV; FKSSSVDGFVS;<br>KSSSVDGFVSF; SSSVDGFVSFK; SSVDGFVSFKE; SVDGFVSFKEY; VDGFVSFKEYK; DGF<br>VSFKEYKE; GFVSFKEYKER; FVSFKEYKERM; VSFKEYKERMN; SFKEYKERMNE; FKEYKE<br>RMNEG; KEYKERMNEGQ; EYKERMNEGQK; YKERMNEGQKS; KERMNEGQKSI; ERMNEGQKS<br>IY; RMNEGQKSIYY; MNEGQKSIYYI; NEGQKSIYYIT; EGQKSIYYITG; GQKSIYYITGG;<br>QKSIYYITGGK; KSIYYITGGKE; SIYYITGGKEN; IYYITGGKENI; YYITGGKENIL; YIT<br>GGKENILK; ITGGKENILKE; TGGKENILKEN; GGKENILKENP; GKENILKENPI; KENILK<br>ENPIV; ENILKENPIVT; NILKENPIVTA; ILKENPIVTAY; LKENPIVTAYK; KENPIVTAY<br>KE; ENPIVTAYKEK; NPIVTAYKEKG; PIVTAYKEKGF; IVTAYKEKGFE; VTAYKEKGFEI;<br>TAYKEKGFEIL; AYKEKGFEILI; YKEKGFEILIM; KEKGFEILIMD; EKGFEILIMDD; KGF | |

Fig. 43 continued

| | |
|---|---|
| EILIMDDE;GFEILIMDDEL;FEILIMDDELD;EILIMDDELDE;ILIMDDELDEA;LIMDDE LDEAI;IMDDELDEAIL;MDDELDEAILN;DDELDEAILNL;DELDEAILNLI;ELDEAILNL IP;LDEAILNLIPE;DEAILNLIPEY;EAILNLIPEYE;AILNLIPEYEG;ILNLIPEYEGL; LNLIPEYEGLK;NLIPEYEGLKL;LIPEYEGLKLK;IPEYEGLKLKA;PEYEGLKLKAI;EYE GLKLKAIN;YEGLKLKAINK;EGLKLKAINKN;GLKLKAINKNE;LKLKAINKNET;KLKAIN KNETS;LKAINKNETSN;KAINKNETSNE;AINKNETSNEL;INKNETSNELK;NKNETSNEL KD;KNETSNELKDE;NETSNELKDEN;ETSNELKDENF;TSNELKDENFK;SNELKDENFKK; NELKDENFKKI;ELKDENFKKIE;LKDENFKKIEE;KDENFKKIEEE;DENFKKIEEEF;ENF KKIEEEFK;NFKKIEEEFKD;FKKIEEEFKDT;KKIEEEFKDTL;KIEEEFKDTLT;IEEEFK DTLTR;EEEFKDTLTRV;EEFKDTLTRVK;EFKDTLTRVKE;FKDTLTRVKEI;KDTLTRVKE IL;DTLTRVKEILK;TLTRVKEILKD;LTRVKEILKDQ;TRVKEILKDQI;RVKEILKDQIK; VKEILKDQIKE;KEILKDQIKEV;EILKDQIKEVN;ILKDQIKEVNL;LKDQIKEVNLS;KDQ IKEVNLSA;DQIKEVNLSAT;QIKEVNLSATL;IKEVNLSATLI;KEVNLSATLIK;EVNLSA TLIKE;VNLSATLIKEP;NLSATLIKEPS;LSATLIKEPSA;SATLIKEPSAI;ATLIKEPSA II;TLIKEPSAIIV;LIKEPSAIIVD;IKEPSAIIVDS;KEPSAIIVDSN;EPSAIIVDSND; PSAIIVDSNDP;SAIIVDSNDPT;AIIVDSNDPTY;IIVDSNDPTYQ;IVDSNDPTYQM;VDS NDPTYQMQ;DSNDPTYQMQK;SNDPTYQMQKI;NDPTYQMQKIM;DPTYQMQKIML;PTYQMQ KIMLS;TYQMQKIMLSM;YQMQKIMLSMG;QMQKIMLSMGQ;MQKIMLSMGQE;QKIMLSMGQ EV;KIMLSMGQEVK;IMLSMGQEVKE;MLSMGQEVKEI;LSMGQEVKEIK;SMGQEVKEIKP; MGQEVKEIKPI;GQEVKEIKPIL;QEVKEIKPILE;EVKEIKPILEL;VKEIKPILELN;KEI KPILELNP;EIKPILELNPN;IKPILELNPNN;KPILELNPNNK;PILELNPNNKI;ILELNP NNKIV;LELNPNNKIVQ;ELNPNNKIVQN;LNPNNKIVQNL;NPNNKIVQNLK;PNNKIVQNL KN;NNKIVQNLKNL;NKIVQNLKNLE;KIVQNLKNLEP;IVQNLKNLEPE;VQNLKNLEPEK; QNLKNLEPEKL;NLKNLEPEKLE;LKNLEPEKLEK;KNLEPEKLEKI;NLEPEKLEKIS;LEP EKLEKISI;EPEKLEKISIL;PEKLEKISILL;EKLEKISILLF;KLEKISILLFE;LEKISI LLFEE;EKISILLFEEA;KISILLFEEAL;ISILLFEEALL;SILLFEEALLT;ILLFEEALL TS;LLFEEALLTSG;LFEEALLTSGM;FEEALLTSGMP;EEALLTSGMPS;EALLTSGMPSK; ALLTSGMPSKN;LLTSGMPSKNP;LTSGMPSKNPR;TSGMPSKNPRK;SGMPSKNPRKF;GMP SKNPRKFI;MPSKNPRKFIN;PSKNPRKFINI;SKNPRKFINII;KNPRKFINIIN;NPRKFI NIINE;PRKFINIINEF;RKFINIINEFL;KFINIINEFLE;FINIINEFLEK;INIINEFLE KD;NIINEFLEKDL;IINEFLEKDLL;<br><br>13 mers:<br>MKKQFDTEVNDLL;KKQFDTEVNDLLY;KQFDTEVNDLLYL;QFDTEVNDLLYLI;FDTEVND LLYLII;DTEVNDLLYLIIH;TEVNDLLYLIIHS;EVNDLLYLIIHSL;VNDLLYLIIHSLY; NDLLYLIIHSLYS;DLLYLIIHSLYSH;LLYLIIHSLYSHK;LYLIIHSLYSHKE;YLIIHSL YSHKEI;LIIHSLYSHKEIF;IIHSLYSHKEIFL;IHSLYSHKEIFLR;HSLYSHKEIFLRE; SLYSHKEIFLREL;LYSHKEIFLRELI;YSHKEIFLRELIS;SHKEIFLRELISN;HKEIFLR ELISNA;KEIFLRELISNAS;EIFLRELISNASD;IFLRELISNASDA;FLRELISNASDAI; LRELISNASDAID;RELISNASDAIDK;ELISNASDAIDKL;LISNASDAIDKLK;ISNASDA IDKLKF;SNASDAIDKLKFL;NASDAIDKLKFLS;ASDAIDKLKFLSL;SDAIDKLKFLSLT; DAIDKLKFLSLTN;AIDKLKFLSLTNE;IDKLKFLSLTNEK;DKLKFLSLTNEKF;KLKFLSL TNEKFK;LKFLSLTNEKFKN;KFLSLTNEKFKNI;FLSLTNEKFKNIA;LSLTNEKFKNIAL; SLTNEKFKNIALE;LTNEKFKNIALEP;TNEKFKNIALEPK;NEKFKNIALEPKI;EKFKNIA LEPKIE;KFKNIALEPKIEI;FKNIALEPKIEIT;KNIALEPKIEITF;NIALEPKIEITFD; IALEPKIEITFDD;ALEPKIEITFDDK;LEPKIEITFDDKS;EPKIEITFDDKSI;PKIEITF DDKSIL;KIEITFDDKSILI;IEITFDDKSILIK;EITFDDKSILIKD;ITFDDKSILIKDN; TFDDKSILIKDNG;FDDKSILIKDNGI;DDKSILIKDNGIG;DKSILIKDNGIGM;KSILIKD NGIGMN;SILIKDNGIGMNE;ILIKDNGIGMNEQ;LIKDNGIGMNEQE;IKDNGIGMNEQEL; KDNGIGMNEQELT;DNGIGMNEQELTN;NGIGMNEQELTNH;GIGMNEQELTNHL;IGMNEQE LTNHLG;GMNEQELTNHLGV;MNEQELTNHLGVI;NEQELTNHLGVIA;EQELTNHLGVIAK; QELTNHLGVIAKS;ELTNHLGVIAKSG;LTNHLGVIAKSGT;TNHLGVIAKSGTK;NHLGVIA KSGTKE;HLGVIAKSGTKEF;LGVIAKSGTKEFI;GVIAKSGTKEFIN;VIAKSGTKEFINN; IAKSGTKEFINNL;AKSGTKEFINNLK;KSGTKEFINNLKQ;SGTKEFINNLKQD;GTKEFIN NLKQDE;TKEFINNLKQDEK;KEFINNLKQDEKK;EFINNLKQDEKKS;FINNLKQDEKKSA; INNLKQDEKKSAN;NNLKQDEKKSANL;NLKQDEKKSANLI;LKQDEKKSANLIG;KQDEKKS ANLIGQ;QDEKKSANLIGQF;DEKKSANLIGQFG;EKKSANLIGQFGV;KKSANLIGQFGVG; | |

Fig. 43 continued

| | |
|---|---|
| KSANLIGQFGVGF;SANLIGQFGVGFY;ANLIGQFGVGFYS;NLIGQFGVGFYSA;LIGQFGV<br>GFYSAF;IGQFGVGFYSAFI;GQFGVGFYSAFIV;QFGVGFYSAFIVS;FGVGFYSAFIVSE;<br>GVGFYSAFIVSEK;VGFYSAFIVSEKV;GFYSAFIVSEKVE;FYSAFIVSEKVEV;YSAFIVS<br>EKVEVT;SAFIVSEKVEVTS;AFIVSEKVEVTSK;FIVSEKVEVTSKK;IVSEKVEVTSKKA;<br>VSEKVEVTSKKAL;SEKVEVTSKKALE;EKVEVTSKKALES;KVEVTSKKALESD;VEVTSKK<br>ALESDA;EVTSKKALESDAY;VTSKKALESDAYI;TSKKALESDAYIW;SKKALESDAYIWS;<br>KKALESDAYIWSS;KALESDAYIWSSD;ALESDAYIWSSDG;LESDAYIWSSDGK;ESDAYIW<br>SSDGKT;SDAYIWSSDGKTG;DAYIWSSDGKTGY;AYIWSSDGKTGYE;YIWSSDGKTGYEI;<br>IWSSDGKTGYEIE;WSSDGKTGYEIEK;SSDGKTGYEIEKA;SDGKTGYEIEKAK;DGKTGYE<br>IEKAKK;GKTGYEIEKAKKE;KTGYEIEKAKKED;TGYEIEKAKKEDP;GYEIEKAKKEDPG;<br>YEIEKAKKEDPGT;EIEKAKKEDPGTE;IEKAKKEDPGTEI;EKAKKEDPGTEIK;KAKKEDP<br>GTEIKL;AKKEDPGTEIKLY;KKEDPGTEIKLYL;KEDPGTEIKLYLN;EDPGTEIKLYLNK;<br>DPGTEIKLYLNKE;PGTEIKLYLNKEG;GTEIKLYLNKEGL;TEIKLYLNKEGLE;EIKLYLN<br>KEGLEY;IKLYLNKEGLEYA;KLYLNKEGLEYAN;LYLNKEGLEYANK;YLNKEGLEYANKW;<br>LNKEGLEYANKWK;NKEGLEYANKWKI;KEGLEYANKWKIQ;EGLEYANKWKIQE;GLEYANK<br>WKIQEI;LEYANKWKIQEIV;EYANKWKIQEIVK;YANKWKIQEIVKK;ANKWKIQEIVKKY;<br>NKWKIQEIVKKYS;KWKIQEIVKKYSN;WKIQEIVKKYSNH;KIQEIVKKYSNHI;IQEIVKK<br>YSNHIN;QEIVKKYSNHINY;EIVKKYSNHINYP;IVKKYSNHINYPI;VKKYSNHINYPIY;<br>KKYSNHINYPIYI;KYSNHINYPIYIK;YSNHINYPIYIKY;SNHINYPIYIKYN;NHINYPI<br>YIKYNE;HINYPIYIKYNEP;INYPIYIKYNEPI;NYPIYIKYNEPIM;YPIYIKYNEPIMK;<br>PIYIKYNEPIMKD;IYIKYNEPIMKDG;YIKYNEPIMKDGK;IKYNEPIMKDGKQ;KYNEPIM<br>KDGKQE;YNEPIMKDGKQEG;NEPIMKDGKQEGI;EPIMKDGKQEGIE;PIMKDGKQEGIEE;<br>IMKDGKQEGIEEK;MKDGKQEGIEEKE;KDGKQEGIEEKEE;DGKQEGIEEKEEK;GKQEGIE<br>EKEEKL;KQEGIEEKEEKLN;QEGIEEKEEKLNE;EGIEEKEEKLNET;GIEEKEEKLNETT;<br>IEEKEEKLNETTA;EEKEEKLNETTAL;EKEEKLNETTALW;KEEKLNETTALWT;EEKLNET<br>TALWTK;EKLNETTALWTKN;KLNETTALWTKNK;LNETTALWTKNKS;NETTALWTKNKSE;<br>ETTALWTKNKSEI;TTALWTKNKSEIK;TALWTKNKSEIKT;ALWTKNKSEIKTE;LWTKNKS<br>EIKTEE;WTKNKSEIKTEEY;TKNKSEIKTEEYN;KNKSEIKTEEYNE;NKSEIKTEEYNEF;<br>KSEIKTEEYNEFY;SEIKTEEYNEFYK;EIKTEEYNEFYKN;IKTEEYNEFYKNT;KTEEYNE<br>FYKNTT;TEEYNEFYKNTTF;EEYNEFYKNTTFD;EYNEFYKNTTFDY;YNEFYKNTTFDYE;<br>NEFYKNTTFDYEN;EFYKNTTFDYENP;FYKNTTFDYENPL;YKNTTFDYENPLM;KNTTFDY<br>ENPLMY;NTTFDYENPLMYI;TTFDYENPLMYIH;TFDYENPLMYIHT;FDYENPLMYIHTK;<br>DYENPLMYIHTKA;YENPLMYIHTKAE;ENPLMYIHTKAEG;NPLMYIHTKAEGN;PLMYIHT<br>KAEGNL;LMYIHTKAEGNLE;MYIHTKAEGNLEY;YIHTKAEGNLEYT;IHTKAEGNLEYTN;<br>HTKAEGNLEYTNL;TKAEGNLEYTNLF;KAEGNLEYTNLFY;AEGNLEYTNLFYI;EGNLEYT<br>NLFYIP;GNLEYTNLFYIPS;NLEYTNLFYIPSK;LEYTNLFYIPSKA;EYTNLFYIPSKAP;<br>YTNLFYIPSKAPY;TNLFYIPSKAPYD;NLFYIPSKAPYDL;LFYIPSKAPYDLY;FYIPSKA<br>PYDLYY;YIPSKAPYDLYYP;IPSKAPYDLYYPN;PSKAPYDLYYPNT;SKAPYDLYYPNTK;<br>KAPYDLYYPNTKP;APYDLYYPNTKPG;PYDLYYPNTKPGV;YDLYYPNTKPGVK;DLYYPNT<br>KPGVKL;LYYPNTKPGVKLF;YYPNTKPGVKLFI;YPNTKPGVKLFIN;PNTKPGVKLFINR;<br>NTKPGVKLFINRI;TKPGVKLFINRIF;KPGVKLFINRIFI;PGVKLFINRIFIT;GVKLFIN<br>RIFITD;VKLFINRIFITDS;KLFINRIFITDSE;LFINRIFITDSEG;FINRIFITDSEGS;<br>INRIFITDSEGSL;NRIFITDSEGSLL;RIFITDSEGSLLP;IFITDSEGSLLPN;FITDSEG<br>SLLPNY;ITDSEGSLLPNYL;TDSEGSLLPNYLR;DSEGSLLPNYLRF;SEGSLLPNYLRFI;<br>EGSLLPNYLRFIK;GSLLPNYLRFIKG;SLLPNYLRFIKGI;LLPNYLRFIKGII;LPNYLRF<br>IKGIID;PNYLRFIKGIIDC;NYLRFIKGIIDCQ;YLRFIKGIIDCQD;LRFIKGIIDCQDL;<br>RFIKGIIDCQDLP;FIKGIIDCQDLPL;IKGIIDCQDLPLN;KGIIDCQDLPLNV;GIIDCQD<br>LPLNVS;IIDCQDLPLNVSR;IDCQDLPLNVSRE;DCQDLPLNVSREI;CQDLPLNVSREIL;<br>QDLPLNVSREILQ;DLPLNVSREILQQ;LPLNVSREILQQN;PLNVSREILQQNK;LNVSREI<br>LQQNKI;NVSREILQQNKIL;VSREILQQNKILS;SREILQQNKILSK;REILQQNKILSKI;<br>EILQQNKILSKIK;ILQQNKILSKIKS;LQQNKILSKIKSS;QQNKILSKIKSSS;QNKILSK<br>IKSSSV;NKILSKIKSSSVK;KILSKIKSSSVKK;ILSKIKSSSVKKI;LSKIKSSSVKKIL;<br>SKIKSSSVKKILS;KIKSSSVKKILSE;IKSSSVKKILSEL;KSSSVKKILSELE;SSSVKKI<br>LSELEK;SSVKKILSELEKL;SVKKILSELEKLS;VKKILSELEKLSK;KKILSELEKLSKK;<br>KILSELEKLSKKN;ILSELEKLSKKNP;LSELEKLSKKNPE;SELEKLSKKNPEK;ELEKLSK<br>KNPEKF;LEKLSKKNPEKFS;EKLSKKNPEKFSE;KLSKKNPEKFSEF;LSKKNPEKFSEFS;<br>SKKNPEKFSEFSK;KKNPEKFSEFSKE;KNPEKFSEFSKEF;NPEKFSEFSKEFG;PEKFSEF | |

Fig. 43 continued

SKEFGR;EKFSEFSKEFGRC;KFSEFSKEFGRCI;FSEFSKEFGRCIK;SEFSKEFGRCIKE;
EFSKEFGRCIKEG;FSKEFGRCIKEGV;SKEFGRCIKEGVY;KEFGRCIKEGVYS;EFGRCIK
EGVYSD;FGRCIKEGVYSDF;GRCIKEGVYSDFE;RCIKEGVYSDFEN;CIKEGVYSDFENR;
IKEGVYSDFENRE;KEGVYSDFENREK;EGVYSDFENREKL;GVYSDFENREKLI;VYSDFEN
REKLIS;YSDFENREKLISL;SDFENREKLISLI;DFENREKLISLIR;FENREKLISLIRF;
ENREKLISLIRFK;NREKLISLIRFKS;REKLISLIRFKSS;EKLISLIRFKSSS;KLISLIR
FKSSSV;LISLIRFKSSSVD;ISLIRFKSSSVDG;SLIRFKSSSVDGF;LIRFKSSSVDGFV;
IRFKSSSVDGFVS;RFKSSSVDGFVSF;FKSSSVDGFVSFK;KSSSVDGFVSFKE;SSSVDGF
VSFKEY;SSVDGFVSFKEYK;SVDGFVSFKEYKE;VDGFVSFKEYKER;DGFVSFKEYKERM;
GFVSFKEYKERMN;FVSFKEYKERMNE;VSFKEYKERMNEG;SFKEYKERMNEGQ;FKEYKER
MNEGQK;KEYKERMNEGQKS;EYKERMNEGQKSI;YKERMNEGQKSIY;KERMNEGQKSIYY;
ERMNEGQKSIYYI;RMNEGQKSIYYIT;MNEGQKSIYYITG;NEGQKSIYYITGG;EGQKSIY
YITGGK;GQKSIYYITGGKE;QKSIYYITGGKEN;KSIYYITGGKENI;SIYYITGGKENIL;
IYYITGGKENILK;YYITGGKENILKE;YITGGKENILKEN;ITGGKENILKENP;TGGKENI
LKENPI;GGKENILKENPIV;GKENILKENPIVT;KENILKENPIVTA;ENILKENPIVTAY;
NILKENPIVTAYK;ILKENPIVTAYKE;LKENPIVTAYKEK;KENPIVTAYKEKG;ENPIVTA
YKEKGF;NPIVTAYKEKGFE;PIVTAYKEKGFEI;IVTAYKEKGFEIL;VTAYKEKGFEILI;
TAYKEKGFEILIM;AYKEKGFEILIMD;YKEKGFEILIMDD;KEKGFEILIMDDE;EKGFEIL
IMDDEL;KGFEILIMDDELD;GFEILIMDDELDE;FEILIMDDELDEA;EILIMDDELDEAI;
ILIMDDELDEAIL;LIMDDELDEAILN;IMDDELDEAILNL;MDDELDEAILNLI;DDELDEA
ILNLIP;DELDEAILNLIPE;ELDEAILNLIPEY;LDEAILNLIPEYE;DEAILNLIPEYEG;
EAILNLIPEYEGL;AILNLIPEYEGLK;ILNLIPEYEGLKL;LNLIPEYEGLKLK;NLIPEYE
GLKLKA;LIPEYEGLKLKAI;IPEYEGLKLKAIN;PEYEGLKLKAINK;EYEGLKLKAINKN;
YEGLKLKAINKNE;EGLKLKAINKNET;GLKLKAINKNETS;LKLKAINKNETSN;KLKAINK
NETSNE;LKAINKNETSNEL;KAINKNETSNELK;AINKNETSNELKD;INKNETSNELKDE;
NKNETSNELKDEN;KNETSNELKDENF;NETSNELKDENFK;ETSNELKDENFKK;TSNELKD
ENFKKI;SNELKDENFKKIE;NELKDENFKKIEE;ELKDENFKKIEEE;LKDENFKKIEEEF;
KDENFKKIEEEFK;DENFKKIEEEFKD;ENFKKIEEEFKDT;NFKKIEEEFKDTL;FKKIEEE
FKDTLT;KKIEEEFKDTLTR;KIEEEFKDTLTRV;IEEEFKDTLTRVK;EEEFKDTLTRVKE;
EEFKDTLTRVKEI;EFKDTLTRVKEIL;FKDTLTRVKEILK;KDTLTRVKEILKD;DTLTRVK
EILKDQ;TLTRVKEILKDQI;LTRVKEILKDQIK;TRVKEILKDQIKE;RVKEILKDQIKEV;
VKEILKDQIKEVN;KEILKDQIKEVNL;EILKDQIKEVNLS;ILKDQIKEVNLSA;LKDQIKE
VNLSAT;KDQIKEVNLSATL;DQIKEVNLSATLI;QIKEVNLSATLIK;IKEVNLSATLIKE;
KEVNLSATLIKEP;EVNLSATLIKEPS;VNLSATLIKEPSA;NLSATLIKEPSAI;LSATLIK
EPSAII;SATLIKEPSAIIV;ATLIKEPSAIIVD;TLIKEPSAIIVDS;LIKEPSAIIVDSN;
IKEPSAIIVDSND;KEPSAIIVDSNDP;EPSAIIVDSNDPT;PSAIIVDSNDPTY;SAIIVDS
NDPTYQ;AIIVDSNDPTYQM;IIVDSNDPTYQMQ;IVDSNDPTYQMQK;VDSNDPTYQMQKI;
DSNDPTYQMQKIM;SNDPTYQMQKIML;NDPTYQMQKIMLS;DPTYQMQKIMLSM;PTYQMQK
IMLSMG;TYQMQKIMLSMGQ;YQMQKIMLSMGQE;QMQKIMLSMGQEV;MQKIMLSMGQEVK;
QKIMLSMGQEVKE;KIMLSMGQEVKEI;IMLSMGQEVKEIK;MLSMGQEVKEIKP;LSMGQEV
KEIKPI;SMGQEVKEIKPIL;MGQEVKEIKPILE;GQEVKEIKPILEL;QEVKEIKPILELN;
EVKEIKPILELNP;VKEIKPILELNPN;KEIKPILELNPNN;EIKPILELNPNNK;IKPILEL
NPNNKI;KPILELNPNNKIV;PILELNPNNKIVQ;ILELNPNNKIVQN;LELNPNNKIVQNL;
ELNPNNKIVQNLK;LNPNNKIVQNLKN;NPNNKIVQNLKNL;PNNKIVQNLKNLE;NNKIVQN
LKNLEP;NKIVQNLKNLEPE;KIVQNLKNLEPEK;IVQNLKNLEPEKL;VQNLKNLEPEKLE;
QNLKNLEPEKLEK;NLKNLEPEKLEKI;LKNLEPEKLEKIS;KNLEPEKLEKISI;NLEPEKL
EKISIL;LEPEKLEKISILL;EPEKLEKISILLF;PEKLEKISILLFE;EKLEKISILLFEE;
KLEKISILLFEEA;LEKISILLFEEAL;EKISILLFEEALL;KISILLFEEALLT;ISILLFE
EALLTS;SILLFEEALLTSG;ILLFEEALLTSGM;LLFEEALLTSGMP;LFEEALLTSGMPS;
FEEALLTSGMPSK;EEALLTSGMPSKN;EALLTSGMPSKNP;ALLTSGMPSKNPR;LLTSGMP
SKNPRK;LTSGMPSKNPRKF;TSGMPSKNPRKFI;SGMPSKNPRKFIN;GMPSKNPRKFINI;
MPSKNPRKFINII;PSKNPRKFINIIN;SKNPRKFINIINE;KNPRKFINIINEF;NPRKFIN
IINEFL;PRKFINIINEFLE;RKFINIINEFLEK;KFINIINEFLEKD;FINIINEFLEKDL;
INIINEFLEKDLL;

14 mers:
MKKQFDTEVNDLLY;KKQFDTEVNDLLYL;KQFDTEVNDLLYLI;QFDTEVNDLLYLII;FDT

Fig. 43 continued

EVNDLLYLIIH;DTEVNDLLYLIIHS;TEVNDLLYLIIHSL;EVNDLLYLIIHSLY;VNDLLY
LIIHSLYS;NDLLYLIIHSLYSH;DLLYLIIHSLYSHK;LLYLIIHSLYSHKE;LYLIIHSLY
SHKEI;YLIIHSLYSHKEIF;LIIHSLYSHKEIFL;IIHSLYSHKEIFLR;IHSLYSHKEIFL
RE;HSLYSHKEIFLREL;SLYSHKEIFLRELI;LYSHKEIFLRELIS;YSHKEIFLRELISN;
SHKEIFLRELISNA;HKEIFLRELISNAS;KEIFLRELISNASD;EIFLRELISNASDA;IFL
RELISNASDAI;FLRELISNASDAID;LRELISNASDAIDK;RELISNASDAIDKL;ELISNA
SDAIDKLK;LISNASDAIDKLKF;ISNASDAIDKLKFL;SNASDAIDKLKFLS;NASDAIDKL
KFLSL;ASDAIDKLKFLSLT;SDAIDKLKFLSLTN;DAIDKLKFLSLTNE;AIDKLKFLSLTN
EK;IDKLKFLSLTNEKF;DKLKFLSLTNEKFK;KLKFLSLTNEKFKN;LKFLSLTNEKFKNI;
KFLSLTNEKFKNIA;FLSLTNEKFKNIAL;LSLTNEKFKNIALE;SLTNEKFKNIALEP;LTN
EKFKNIALEPK;TNEKFKNIALEPKI;NEKFKNIALEPKIE;EKFKNIALEPKIEI;KFKNIA
LEPKIEIT;FKNIALEPKIEITF;KNIALEPKIEITFD;NIALEPKIEITFDD;IALEPKIEI
TFDDK;ALEPKIEITFDDKS;LEPKIEITFDDKSI;EPKIEITFDDKSIL;PKIEITFDDKSI
LI;KIEITFDDKSILIK;IEITFDDKSILIKD;EITFDDKSILIKDN;ITFDDKSILIKDNG;
TFDDKSILIKDNGI;FDDKSILIKDNGIG;DDKSILIKDNGIGM;DKSILIKDNGIGMN;KSI
LIKDNGIGMNE;SILIKDNGIGMNEQ;ILIKDNGIGMNEQE;LIKDNGIGMNEQEL;IKDNGI
GMNEQELT;KDNGIGMNEQELTN;DNGIGMNEQELTNH;NGIGMNEQELTNHL;GIGMNEQEL
TNHLG;IGMNEQELTNHLGV;GMNEQELTNHLGVI;MNEQELTNHLGVIA;NEQELTNHLGVI
AK;EQELTNHLGVIAKS;QELTNHLGVIAKSG;ELTNHLGVIAKSGT;LTNHLGVIAKSGTK;
TNHLGVIAKSGTKE;NHLGVIAKSGTKEF;HLGVIAKSGTKEFI;LGVIAKSGTKEFIN;GVI
AKSGTKEFINN;VIAKSGTKEFINNL;IAKSGTKEFINNLK;AKSGTKEFINNLKQ;KSGTKE
FINNLKQD;SGTKEFINNLKQDE;GTKEFINNLKQDEK;TKEFINNLKQDEKK;KEFINNLKQ
DEKKS;EFINNLKQDEKKSA;FINNLKQDEKKSAN;INNLKQDEKKSANL;NNLKQDEKKSAN
LI;NLKQDEKKSANLIG;LKQDEKKSANLIGQ;KQDEKKSANLIGQF;QDEKKSANLIGQFG;
DEKKSANLIGQFGV;EKKSANLIGQFGVG;KKSANLIGQFGVGF;KSANLIGQFGVGFY;SAN
LIGQFGVGFYS;ANLIGQFGVGFYSA;NLIGQFGVGFYSAF;LIGQFGVGFYSAFI;IGQFGV
GFYSAFIV;GQFGVGFYSAFIVS;QFGVGFYSAFIVSE;FGVGFYSAFIVSEK;GVGFYSAFI
VSEKV;VGFYSAFIVSEKVE;GFYSAFIVSEKVEV;FYSAFIVSEKVEVT;YSAFIVSEKVEV
TS;SAFIVSEKVEVTSK;AFIVSEKVEVTSKK;FIVSEKVEVTSKKA;IVSEKVEVTSKKAL;
VSEKVEVTSKKALE;SEKVEVTSKKALES;EKVEVTSKKALESD;KVEVTSKKALESDA;VEV
TSKKALESDAY;EVTSKKALESDAYI;VTSKKALESDAYIW;TSKKALESDAYIWS;SKKALE
SDAYIWSS;KKALESDAYIWSSD;KALESDAYIWSSDG;ALESDAYIWSSDGK;LESDAYIWS
SDGKT;ESDAYIWSSDGKTG;SDAYIWSSDGKTGY;DAYIWSSDGKTGYE;AYIWSSDGKTGY
EI;YIWSSDGKTGYEIE;IWSSDGKTGYEIEK;WSSDGKTGYEIEKA;SSDGKTGYEIEKAK;
SDGKTGYEIEKAKK;DGKTGYEIEKAKKE;GKTGYEIEKAKKED;KTGYEIEKAKKEDP;TGY
EIEKAKKEDPG;GYEIEKAKKEDPGT;YEIEKAKKEDPGTE;EIEKAKKEDPGTEI;IEKAKK
EDPGTEIK;EKAKKEDPGTEIKL;KAKKEDPGTEIKLY;AKKEDPGTEIKLYL;KKEDPGTEI
KLYLN;KEDPGTEIKLYLNK;EDPGTEIKLYLNKE;DPGTEIKLYLNKEG;PGTEIKLYLNKE
GL;GTEIKLYLNKEGLE;TEIKLYLNKEGLEY;EIKLYLNKEGLEYA;IKLYLNKEGLEYAN;
KLYLNKEGLEYANK;LYLNKEGLEYANKW;YLNKEGLEYANKWK;LNKEGLEYANKWKI;NKE
GLEYANKWKIQ;KEGLEYANKWKIQE;EGLEYANKWKIQEI;GLEYANKWKIQEIV;LEYANK
WKIQEIVK;EYANKWKIQEIVKK;YANKWKIQEIVKKY;ANKWKIQEIVKKYS;NKWKIQEIV
KKYSN;KWKIQEIVKKYSNH;WKIQEIVKKYSNHI;KIQEIVKKYSNHIN;IQEIVKKYSNHI
NY;QEIVKKYSNHINYP;EIVKKYSNHINYPI;IVKKYSNHINYPIY;VKKYSNHINYPIYI;
KKYSNHINYPIYIK;KYSNHINYPIYIKY;YSNHINYPIYIKYN;SNHINYPIYIKYNE;NHI
NYPIYIKYNEP;HINYPIYIKYNEPI;INYPIYIKYNEPIM;NYPIYIKYNEPIMK;YPIYIK
YNEPIMKD;PIYIKYNEPIMKDG;IYIKYNEPIMKDGK;YIKYNEPIMKDGKQ;IKYNEPIMK
DGKQE;KYNEPIMKDGKQEG;YNEPIMKDGKQEGI;NEPIMKDGKQEGIE;EPIMKDGKQEGI
EE;PIMKDGKQEGIEEK;IMKDGKQEGIEEKE;MKDGKQEGIEEKEE;KDGKQEGIEEKEEK;
DGKQEGIEEKEEKL;GKQEGIEEKEEKLN;KQEGIEEKEEKLNE;QEGIEEKEEKLNET;EGI
EEKEEKLNETT;GIEEKEEKLNETTA;IEEKEEKLNETTAL;EEKEEKLNETTALW;EKEEKL
NETTALWT;KEEKLNETTALWTK;EEKLNETTALWTKN;EKLNETTALWTKNK;KLNETTALW
TKNKS;LNETTALWTKNKSE;NETTALWTKNKSEI;ETTALWTKNKSEIK;TTALWTKNKSEI
KT;TALWTKNKSEIKTE;ALWTKNKSEIKTEE;LWTKNKSEIKTEEY;WTKNKSEIKTEEYN;
TKNKSEIKTEEYNE;KNKSEIKTEEYNEF;NKSEIKTEEYNEFY;KSEIKTEEYNEFYK;SEI
KTEEYNEFYKN;EIKTEEYNEFYKNT;IKTEEYNEFYKNTT;KTEEYNEFYKNTTF;TEEYNE
FYKNTTFD;EEYNEFYKNTTFDY;EYNEFYKNTTFDYE;YNEFYKNTTFDYEN;NEFYKNTTF

Fig. 43 continued

DYENP; EFYKNTTFDYENPL; FYKNTTFDYENPLM; YKNTTFDYENPLMY; KNTTFDYENPLM
YI; NTTFDYENPLMYIH; TTFDYENPLMYIHT; TFDYENPLMYIHTK; FDYENPLMYIHTKA;
DYENPLMYIHTKAE; YENPLMYIHTKAEG; ENPLMYIHTKAEGN; NPLMYIHTKAEGNL; PLM
YIHTKAEGNLE; LMYIHTKAEGNLEY; MYIHTKAEGNLEYT; YIHTKAEGNLEYTN; IHTKAE
GNLEYTNL; HTKAEGNLEYTNLF; TKAEGNLEYTNLFY; KAEGNLEYTNLFYI; AEGNLEYTN
LFYIP; EGNLEYTNLFYIPS; GNLEYTNLFYIPSK; NLEYTNLFYIPSKA; LEYTNLFYIPSK
AP; EYTNLFYIPSKAPY; YTNLFYIPSKAPYD; TNLFYIPSKAPYDL; NLFYIPSKAPYDLY;
LFYIPSKAPYDLYY; FYIPSKAPYDLYYP; YIPSKAPYDLYYPN; IPSKAPYDLYYPNT; PSK
APYDLYYPNTK; SKAPYDLYYPNTKP; KAPYDLYYPNTKPG; APYDLYYPNTKPGV; PYDLYY
PNTKPGVK; YDLYYPNTKPGVKL; DLYYPNTKPGVKLF; LYYPNTKPGVKLFI; YYPNTKPGV
KLFIN; YPNTKPGVKLFINR; PNTKPGVKLFINRI; NTKPGVKLFINRIF; TKPGVKLFINRI
FI; KPGVKLFINRIFIT; PGVKLFINRIFITD; GVKLFINRIFITDS; VKLFINRIFITDSE;
KLFINRIFITDSEG; LFINRIFITDS

NELKDENFKKIEEE;ELKDENFKKIEEEF;LKDENFKKIEEEFK;KDENFKKIEEEFKD;DEN
FKKIEEEFKDT;ENFKKIEEEFKDTL;NFKKIEEEFKDTLT;FKKIEEEFKDTLTR;KKIEEE
FKDTLTRV;KIEEEFKDTLTRVK;IEEEFKDTLTRVKE;EEEFKDTLTRVKEI;EEFKDTLTR
VKEIL;EFKDTLTRVKEILK;FKDTLTRVKEILKD;KDTLTRV

KSANLIGQF;KQDEKKSANLIGQFG;QDEKKSANLIGQFGV;DEKKSANLIGQFGVG;EKKSA
NLIGQFGVGF;KKSANLIGQFGVGFY;KSANLIGQFGVGFYS;SANLIGQFGVGFYSA;ANLI
GQFGVGFYSAF;NLIGQFGVGFYSAFI;LIGQFGVGFYSAFIV;IGQFGVGFYSAFIVS;GQF
GVGFYSAFIVSE;QFGVGFYSAFIVSEK;FGVGFYSAFIVSEKV;GVGFYSAFIVSEKVE;VG
FYSAFIVSEKVEV;GFYSAFIVSEKVEVT;FYSAFIVSEKVEVTS;YSAFIVSEKVEVTSK;S
AFIVSEKVEVTSKK;AFIVSEKVEVTSKKA;FIVSEKVEVTSKKAL;IVSEKVEVTSKKALE;
VSEKVEVTSKKALES;SEKVEVTSKKALESD;EKVEVTSKKALESDA;KVEVTSKKALESDAY
;VEVTSKKALESDAYI;EVTSKKALESDAYIW;VTSKKALESDAYIWS;TSKKALESDAYIWS
S;SKKALESDAYIWSSD;KKALESDAYIWSSDG;KALESDAYIWSSDGK;ALESDAYIWSSDG
KT;LESDAYIWSSDGKTG;ESDAYIWSSDGKTGY;SDAYIWSSDGKTGYE;DAYIWSSDGKTG
YEI;AYIWSSDGKTGYEIE;YIWSSDGKTGYEIEK;IWSSDGKTGYEIEKA;WSSDGKTGYEI
EKAK;SSDGKTGYEIEKAKK;SDGKTGYEIEKAKKE;DGKTGYEIEKAKKED;GKTGYEIEKA
KKEDP;KTGYEIEKAKKEDPG;TGYEIEKAKKEDPGT;GYEIEKAKKEDPGTE;YEIEKAKKE
DPGTEI;EIEKAKKEDPGTEIK;IEKAKKEDPGTEIKL;EKAKKEDPGTEIKLY;KAKKEDPG
TEIKLYL;AKKEDPGTEIKLYLN;KKEDPGTEIKLYLNK;KEDPGTEIKLYLNKE;EDPGTEI
KLYLNKEG;DPGTEIKLYLNKEGL;PGTEIKLYLNKEGLE;GTEIKLYLNKEGLEY;TEIKLY
LNKEGLEYA;EIKLYLNKEGLEYAN;IKLYLNKEGLEYANK;KLYLNKEGLEYANKW;LYLNK
EGLEYANKWK;YLNKEGLEYANKWKI;LNKEGLEYANKWKIQ;NKEGLEYANKWKIQE;KEGL
EYANKWKIQEI;EGLEYANKWKIQEIV;GLEYANKWKIQEIVK;LEYANKWKIQEIVKK;EYA
NKWKIQEIVKKY;YANKWKIQEIVKKYS;ANKWKIQEIVKKYSN;NKWKIQEIVKKYSNH;KW
KIQEIVKKYSNHI;WKIQEIVKKYSNHIN;KIQEIVKKYSNHINY;IQEIVKKYSNHINYP;Q
EIVKKYSNHINYPI;EIVKKYSNHINYPIY;IVKKYSNHINYPIYI;VKKYSNHINYPIYIK;
KKYSNHINYPIYIKY;KYSNHINYPIYIKYN;YSNHINYPIYIKYNE;SNHINYPIYIKYNEP
;NHINYPIYIKYNEPI;HINYPIYIKYNEPIM;INYPIYIKYNEPIMK;NYPIYIKYNEPIMK
D;YPIYIKYNEPIMKDG;PIYIKYNEPIMKDGK;IYIKYNEPIMKDGKQ;YIKYNEPIMKDGK
QE;IKYNEPIMKDGKQEG;KYNEPIMKDGKQEGI;YNEPIMKDGKQEGIE;NEPIMKDGKQEG
IEE;EPIMKDGKQEGIEEK;PIMKDGKQEGIEEKE;IMKDGKQEGIEEKEE;MKDGKQEGIEE
KEEK;KDGKQEGIEEKEEKL;DGKQEGIEEKEEKLN;GKQEGIEEKEEKLNE;KQEGIEEKEE
KLNET;QEGIEEKEEKLNETT;EGIEEKEEKLNETTA;GIEEKEEKLNETTAL;IEEKEEKLN
ETTALW;EEKEEKLNETTALWT;EKEEKLNETTALWTK;KEEKLNETTALWTKN;EEKLNETT
ALWTKNK;EKLNETTALWTKNKS;KLNETTALWTKNKSE;LNETTALWTKNKSEI;NETTALW
TKNKSEIK;ETTALWTKNKSEIKT;TTALWTKNKSEIKTE;TALWTKNKSEIKTEE;ALWTKN
KSEIKTEEY;LWTKNKSEIKTEEYN;WTKNKSEIKTEEYNE;TKNKSEIKTEEYNEF;KNKSE
IKTEEYNEFY;NKSEIKTEEYNEFYK;KSEIKTEEYNEFYKN;SEIKTEEYNEFYKNT;EIKT
EEYNEFYKNTT;IKTEEYNEFYKNTTF;KTEEYNEFYKNTTFD;TEEYNEFYKNTTFDY;EEY
NEFYKNTTFDYE;EYNEFYKNTTFDYEN;YNEFYKNTTFDYENP;NEFYKNTTFDYENPL;EF
YKNTTFDYENPLM;FYKNTTFDYENPLMY;YKNTTFDYENPLMYI;KNTTFDYENPLMYIH;N
TTFDYENPLMYIHT;TTFDYENPLMYIHTK;TFDYENPLMYIHTKA;FDYENPLMYIHTKAE;
DYENPLMYIHTKAEG;YENPLMYIHTKAEGN;ENPLMYIHTKAEGNL;NPLMYIHTKAEGNLE
;PLMYIHTKAEGNLEY;LMYIHTKAEGNLEYT;MYIHTKAEGNLEYTN;YIHTKAEGNLEYTN
L;IHTKAEGNLEYTNLF;HTKAEGNLEYTNLFY;TKAEGNLEYTNLFYI;KAEGNLEYTNLFY
IP;AEGNLEYTNLFYIPS;EGNLEYTNLFYIPSK;GNLEYTNLFYIPSKA;NLEYTNLFYIPS
KAP;LEYTNLFYIPSKAPY;EYTNLFYIPSKAPYD;YTNLFYIPSKAPYDL;TNLFYIPSKAP
YDLY;NLFYIPSKAPYDLYY;LFYIPSKAPYDLYYP;FYIPSKAPYDLYYPN;YIPSKAPYDL
YYPNT;IPSKAPYDLYYPNTK;PSKAPYDLYYPNTKP;SKAPYDLYYPNTKPG;KAPYDLYYP
NTKPGV;APYDLYYPNTKPGVK;PYDLYYPNTKPGVKL;YDLYYPNTKPGVKLF;DLYYPNTK
PGVKLFI;LYYPNTKPGVKLFIN;YYPNTKPGVKLFINR;YPNTKPGVKLFINRI;PNTKPGV
KLFINRIF;NTKPGVKLFINRIFI;TKPGVKLFINRIFIT;KPGVKLFINRIFITD;PGVKLF
INRIFITDS;GVKLFINRIFITDSE;VKLFINRIFITDSEG;KLFINRIFITDSEGS;LFINR
IFITDSEGSL;FINRIFITDSEGSLL;INRIFITDSEGSLLP;NRIFITDSEGSLLPN;RIFI
TDSEGSLLPNY;IFITDSEGSLLPNYL;FITDSEGSLLPNYLR;ITDSEGSLLPNYLRF;TDS
EGSLLPNYLRFI;DSEGSLLPNYLRFIK;SEGSLLPNYLRFIKG;EGSLLPNYLRFIKGI;GS
LLPNYLRFIKGII;SLLPNYLRFIKGIID;LLPNYLRFIKGIIDC;LPNYLRFIKGIIDCQ;P
NYLRFIKGIIDCQD;NYLRFIKGIIDCQDL;YLRFIKGIIDCQDLP;LRFIKGIIDCQDLPL;
RFIKGIIDCQDLPLN;FIKGIIDCQDLPLNV;IKGIIDCQDLPLNVS;KGIIDCQDLPLNVSR
;GIIDCQDLPLNVSRE;IIDCQDLPLNVSREI;IDCQDLPLNVSREIL;DCQDLPLNVSREIL
Q;CQDLPLNVSREILQQ;QDLPLNVSREILQQN;DLPLNVSREILQQNK;LPLNVSREILQQN

Fig. 43 continued

KI;PLNVSREILQQNKIL;LNVSREILQQNKILS;NVSREILQQNKILSK;VSREILQQNKIL
SKI;SREILQQNKILSKI;REILQQNKILSKIK;REILQQNKILSKIKS;EILQQNKILSKIKSS;ILQQNKILSKI
KSSS;LQQNKILSKIKSSSV;QQNKILSKIKSSSVK;QNKILSKIKSSSVKK;NKILSKIKSS
SVKKI;KILSKIKSSSVKKIL;ILSKIKSSSVKKILS;LSKIKSSSVKKILSE;SKIKSSSVK
KILSEL;KIKSSSVKKILSELE;IKSSSVKKILSELEK;KSSSVKKILSELEKL;SSSVKKIL
SELEKLS;SSVKKILSELEKLSK;SVKKILSELEKLSKK;VKKILSELEKLSKKN;KKILSEL
EKLSKKNP;KILSELEKLSKKNPE;ILSELEKLSKKNPEK;LSELEKLSKKNPEKF;SELEKL
SKKNPEKFS;ELEKLSKKNPEKFSE;LEKLSKKNPEKFSEF;EKLSKKNPEKFSEFS;KLSKK
NPEKFSEFSK;LSKKNPEKFSEFSKE;SKKNPEKFSEFSKEF;KKNPEKFSEFSKEFG;KNPE
KFSEFSKEFGR;NPEKFSEFSKEFGRC;PEKFSEFSKEFGRCI;EKFSEFSKEFGRCIK;KFS
EFSKEFGRCIKE;FSEFSKEFGRCIKEG;SEFSKEFGRCIKEGV;EFSKEFGRCIKEGVY;FS
KEFGRCIKEGVYS;SKEFGRCIKEGVYSD;KEFGRCIKEGVYSDF;EFGRCIKEGVYSDFE;F
GRCIKEGVYSDFEN;GRCIKEGVYSDFENR;RCIKEGVYSDFENRE;CIKEGVYSDFENREK;
IKEGVYSDFENREKL;KEGVYSDFENREKLI;EGVYSDFENREKLIS;GVYSDFENREKLISL
;VYSDFENREKLISLI;YSDFENREKLISLIR;SDFENREKLISLIRF;DFENREKLISLIRF
K;FENREKLISLIRFKS;ENREKLISLIRFKSS;NREKLISLIRFKSSS;REKLISLIRFKSS
SV;EKLISLIRFKSSSVD;KLISLIRFKSSSVDG;LISLIRFKSSSVDGF;ISLIRFKSSSVD
GFV;SLIRFKSSSVDGFVS;LIRFKSSSVDGFVSF;IRFKSSSVDGFVSFK;RFKSSSVDGFV
SFKE;FKSSSVDGFVSFKEY;KSSSVDGFVSFKEYK;SSSVDGFVSFKEYKE;SSVDGFVSFK
EYKER;SVDGFVSFKEYKERM;VDGFVSFKEYKERMN;DGFVSFKEYKERMNE;GFVSFKEYK
ERMNEG;FVSFKEYKERMNEGQ;VSFKEYKERMNEGQK;SFKEYKERMNEGQKS;FKEYKERM
NEGQKSI;KEYKERMNEGQKSIY;EYKERMNEGQKSIYY;YKERMNEGQKSIYYI;KERMNEG
QKSIYYIT;ERMNEGQKSIYYITG;RMNEGQKSIYYITGG;MNEGQKSIYYITGGK;NEGQKS
IYYITGGKE;EGQKSIYYITGGKEN;GQKSIYYITGGKENI;QKSIYYITGGKENIL;KSIYY
ITGGKENILK;SIYYITGGKENILKE;IYYITGGKENILKEN;YYITGGKENILKENP;YITG
GKENILKENPI;ITGGKENILKENPIV;TGGKENILKENPIVT;GGKENILKENPIVTA;GKE
NILKENPIVTAY;KENILKENPIVTAYK;ENILKENPIVTAYKE;NILKENPIVTAYKEK;IL
KENPIVTAYKEKG;LKENPIVTAYKEKGF;KENPIVTAYKEKGFE;ENPIVTAYKEKGFEI;N
PIVTAYKEKGFEIL;PIVTAYKEKGFEILI;IVTAYKEKGFEILIM;VTAYKEKGFEILIMD;
TAYKEKGFEILIMDD;AYKEKGFEILIMDDE;YKEKGFEILIMDDEL;KEKGFEILIMDDELD
;EKGFEILIMDDELDE;KGFEILIMDDELDEA;GFEILIMDDELDEAI;FEILIMDDELDEAI
L;EILIMDDELDEAILN;ILIMDDELDEAILNL;LIMDDELDEAILNLI;IMDDELDEAILNL
IP;MDDELDEAILNLIPE;DDELDEAILNLIPEY;DELDEAILNLIPEYE;ELDEAILNLIPE
YEG;LDEAILNLIPEYEGL;DEAILNLIPEYEGLK;EAILNLIPEYEGLKL;AILNLIPEYEG
LKLK;ILNLIPEYEGLKLKA;LNLIPEYEGLKLKAI;NLIPEYEGLKLKAIN;LIPEYEGLKL
KAINK;IPEYEGLKLKAINKN;PEYEGLKLKAINKNE;EYEGLKLKAINKNET;YEGLKLKAI
NKNETS;EGLKLKAINKNETSN;GLKLKAINKNETSNE;LKLKAINKNETSNEL;KLKAINKN
ETSNELK;LKAINKNETSNELKD;KAINKNETSNELKDE;AINKNETSNELKDEN;INKNETS
NELKDENF;NKNETSNELKDENFK;KNETSNELKDENFKK;NETSNELKDENFKKI;ETSNEL
KDENFKKIE;TSNELKDENFKKIEE;SNELKDENFKKIEEE;NELKDENFKKIEEEF;ELKDE
NFKKIEEEFK;LKDENFKKIEEEFKD;KDENFKKIEEEFKDT;DENFKKIEEEFKDTL;ENFK
KIEEEFKDTLT;NFKKIEEEFKDTLTR;FKKIEEEFKDTLTRV;KKIEEEFKDTLTRVK;KIE
EEFKDTLTRVKE;IEEEFKDTLTRVKEI;EEEFKDTLTRVKEIL;EEFKDTLTRVKEILK;EF
KDTLTRVKEILKD;FKDTLTRVKEILKDQ;KDTLTRVKEILKDQI;DTLTRVKEILKDQIK;T
LTRVKEILKDQIKE;LTRVKEILKDQIKEV;TRVKEILKDQIKEVN;RVKEILKDQIKEVNL;
VKEILKDQIKEVNLS;KEILKDQIKEVNLSA;EILKDQIKEVNLSAT;ILKDQIKEVNLSATL
;LKDQIKEVNLSATLI;KDQIKEVNLSATLIK;DQIKEVNLSATLIKE;QIKEVNLSATLIKE
P;IKEVNLSATLIKEPS;KEVNLSATLIKEPSA;EVNLSATLIKEPSAI;VNLSATLIKEPSA
II;NLSATLIKEPSAIIV;LSATLIKEPSAIIVD;SATLIKEPSAIIVDS;ATLIKEPSAIIV
DSN;TLIKEPSAIIVDSND;LIKEPSAIIVDSNDP;IKEPSAIIVDSNDPT;KEPSAIIVDSN
DPTY;EPSAIIVDSNDPTYQ;PSAIIVDSNDPTYQM;SAIIVDSNDPTYQMQ;AIIVDSNDPT
YQMQK;IIVDSNDPTYQMQKI;IVDSNDPTYQMQKIM;VDSNDPTYQMQKIML;DSNDPTYQM
QKIMLS;SNDPTYQMQKIMLSM;NDPTYQMQKIMLSMG;DPTYQMQKIMLSMGQ;PTYQMQKI
MLSMGQE;TYQMQKIMLSMGQEV;YQMQKIMLSMGQEVK;QMQKIMLSMGQEVKE;MQKIMLS
MGQEVKEI;QKIMLSMGQEVKEIK;KIMLSMGQEVKEIKP;IMLSMGQEVKEIKPI;MLSMGQ
EVKEIKPIL;LSMGQEVKEIKPILE;SMGQEVKEIKPILEL;MGQEVKEIKPILELN;GQEVK
EIKPILELNP;QEVKEIKPILELNPN;EVKEIKPILELNPNN;VKEIKPILELNPNNK;KEIK

Fig. 43 continued

PILELNPNNKI;EIKPILELNPNNKIV;IKPILELNPNNKIVQ;KPILELNPNNKIVQN;PIL
ELNPNNKIVQNL;ILELNPNNKIVQNLK;LELNPNNKIVQNLKN;ELNPNNKIVQNLKNL;LN
PNNKIVQNLKNLE;NPNNKIVQNLKNLEP;PNNKIVQNLKNL

EIKLY;EKAKKEDPGTEIKLYL;KAKKEDPGTEIKLYLN;AKKEDPGTEIKLYLNK;KKEDPG
TEIKLYLNKE;KEDPGTEIKLYLNKEG;EDPGTEIKLYLNKEGL;DPGTEIKLYLNKEGLE;P
GTEIKLYLNKEGLEY;GTEIKLYLNKEGLEYA;TEIKLYLNKEGLEYAN;EIKLYLNKEGLEY
ANK;IKLYLNKEGLEYANKW;KLYLNKEGLEYANKWK;LYLNKEGLEYANKWKI;YLNKEGLE
YANKWKIQ;LNKEGLEYANKWKIQE

G;FSEFSKEFGRCIKEGV;SEFSKEFGRCIKEGVY;EFSKEFGRCIKEGVYS;FSKEFGRCIK
EGVYSD;SKEFGRCIKEGVYSDF;KEFGRCIKEGVYSDFE;EFGRCIKEGVYSDFEN;FGRCI
KEGVYSDFENR;GRCIKEGVYSDFENRE;RCIKEGVYSDFENREK;CIKEGVYSDFENREKL;
IKEGVYSDFENREKLI;KEGVYSDFENREKLIS;EGVYSDFENREKLISL;GVYSDFENREKL
ISLI;VYSDFENREKLISLIR;YSDFENREKLISLIRF;SDFENREKLISLIRFK;DFENREK
LISLIRFKS;FENREKLISLIRFKSS;ENREKLISLIRFKSSS;NREKLISLIRFKSSSV;RE
KLISLIRFKSSSVD;EKLISLIRFKSSSVDG;KLISLIRFKSSSVDGF;LISLIRFKSSSVDG
FV;ISLIRFKSSSVDGFVS;SLIRFKSSSVDGFVSF;LIRFKSSSVDGFVSFK;IRFKSSSVD
GFVSFKE;RFKSSSVDGFVSFKEY;FKSSSVDGFVSFKEYK;KSSSVDGFVSFKEYKE;SSSV
DGFVSFKEYKER;SSVDGFVSFKEYKERM;SVDGFVSFKEYKERMN;VD

| | |
|---|---|
| ISILLFEEALLTSG;KISILLFEEALLTSGM;ISILLFEEALLTSGMP;SILLFEEALLTSGMPS;ILLFEEALLTSGMPSK;LLFEEALLTSGMPSKN;LFEEALLTSGMPSKNP;FEEALLTSGMPSKNPR;EEALLTSGMPSKNPRK;EALLTSGMPSKNPRKF;ALLTSGMPSKNPRKFI;LLTSGMPSKNPRKFIN;LTSGMPSKNPRKFINI;TSGMPSKNPRKFINII;SGMPSKNPRKFINIIN;GMPSKNPRKFINIINE;MPSKNPRKFINIINEF;PSKNPRKFINIINEFL;SKNPRKFINIINEFLE;KNPRKFINIINEFLEK;NPRKFINIINEFLEKD;PRKFINIINEFLEKDL;RKFINIINEFLEKDLL; | |
| <gi\|46451445\|gb\|AAS97967.1\| outer surface protein B [Borrelia burgdorferi]><br>MRLYLTGFALALALIGCAQKGAEPKNTSQKYDDQEVINSNKAPKDAKQTPPAAAEDSVTLFSGNEIFVSKEKNSSGKYDLRTTINQVELKGTSDKNNGSGSLEGVKADKSKVKLIVSDDLNTVTVETFDSSGKKDSSKVTVKHGSITEDTFKANKLDSKKLTRSNGTMLEYSQMTDADNATKAVETLKN<br><br>8 mers:<br>MRLYLTGF;RLYLTGFA;LYLTGFAL;YLTGFALA;LTGFALAL;TGFALALA;GFALALAL;FALALALI;ALALALIG;LALALIGC;ALALIGCA;LALIGCAQ;ALIGCAQK;LIGCAQKG;IGCAQKGA;GCAQKGAE;CAQKGAEP;AQKGAEPK;QKGAEPKN;KGAEPKNT;GAEPKNTS;AEPKNTSQ;EPKNTSQK;PKNTSQKY;KNTSQKYD;NTSQKYDD;TSQKYDDQ;SQKYDDQE;QKYDDQEV;KYDDQEVI;YDDQEVIN;DDQEVINS;DQEVINSN;QEVINSNK;EVINSNKA;VINSNKAP;INSNKAPK;NSNKAPKD;SNKAPKDA;NKAPKDAK;KAPKDAKQ;APKDAKQT;PKDAKQTP;KDAKQTPP;DAKQTPPA;AKQTPPAA;KQTPPAAA;QTPPAAAE;TPPAAAED;PPAAAEDS;PAAAEDSV;AAAEDSVT;AAEDSVTL;AEDSVTLF;EDSVTLFS;DSVTLFSG;SVTLFSGN;VTLFSGNE;TLFSGNEI;LFSGNEIF;FSGNEIFV;SGNEIFVS;GNEIFVSK;NEIFVSKE;EIFVSKEK;IFVSKEKN;FVSKEKNS;VSKEKNSS;SKEKNSSG;KEKNSSGK;EKNSSGKY;KNSSGKYD;NSSGKYDL;SSGKYDLR;SGKYDLRT;GKYDLRTT;KYDLRTTI;YDLRTTIN;DLRTTINQ;LRTTINQV;RTTINQVE;TTINQVEL;TINQVELK;INQVELKG;NQVELKGT;QVELKGTS;VELKGTSD;ELKGTSDK;LKGTSDKN;KGTSDKNN;GTSDKNNG;TSDKNNGS;SDKNNGSG;DKNNGSGS;KNNGSGSL;NNGSGSLE;NGSGSLEG;GSGSLEGV;SGSLEGVK;GSLEGVKA;SLEGVKAD;LEGVKADK;EGVKADKS;GVKADKSK;VKADKSKV;KADKSKVK;ADKSKVKL;DKSKVKLI;KSKVKLIV;SKVKLIVS;KVKLIVSD;VKLIVSDD;KLIVSDDL;LIVSDDLN;IVSDDLNT;VSDDLNTV;SDDLNTVT;DDLNTVTV;DLNTVTVE;LNTVTVET;NTVTVETF;TVTVETFD;VTVETFDS;TVETFDSS;VETFDSSG;ETFDSSGK;TFDSSGKK;FDSSGKKD;DSSGKKDS;SSGKKDSS;SGKKDSSK;GKKDSSKV;KKDSSKVT;KDSSKVTV;DSSKVTVK;SSKVTVKH;SKVTVKHG;KVTVKHGS;VTVKHGSI;TVKHGSIT;VKHGSITE;KHGSITED;HGSITEDT;GSITEDTF;SITEDTFK;ITEDTFKA;TEDTFKAN;EDTFKANK;DTFKANKL;TFKANKLD;FKANKLDS;KANKLDSK;ANKLDSKK;NKLDSKKL;KLDSKKLT;LDSKKLTR;DSKKLTRS;SKKLTRSN;KKLTRSNG;KLTRSNGT;LTRSNGTM;TRSNGTML;RSNGTMLE;SNGTMLEY;NGTMLEYS;GTMLEYSQ;TMLEYSQM;MLEYSQMT;LEYSQMTD;EYSQMTDA;YSQMTDAD;SQMTDADN;QMTDADNA;MTDADNAT;TDADNATK;DADNATKA;ADNATKAV;DNATKAVE;NATKAVET;ATKAVETL;TKAVETLK;KAVETLKN;<br><br>9 mers:<br>MRLYLTGFA;RLYLTGFAL;LYLTGFALA;YLTGFALAL;LTGFALALA;TGFALALAL;GFALALALI;FALALALIG;ALALALIGC;LALALIGCA;ALALIGCAQ;LALIGCAQK;ALIGCAQKG;LIGCAQKGA;IGCAQKGAE;GCAQKGAEP;CAQKGAEPK;AQKGAEPKN;QKGAEPKNT;KGAEPKNTS;GAEPKNTSQ;AEPKNTSQK;EPKNTSQKY;PKNTSQKYD;KNTSQKYDD;NTSQKYDDQ;TSQKYDDQE;SQKYDDQEV;QKYDDQEVI;KYDDQEVIN;YDDQEVINS;DDQEVINSN;DQEVINSNK;QEVINSNKA;EVINSNKAP;VINSNKAPK;INSNKAPKD;NSNKAPKDA;SNKAPKDAK;NKAPKDAKQ;KAPKDAKQT;APKDAKQTP;PKDAKQTPP;KDAKQTPPA;DAKQTPPAA;AKQTPPAAA;KQTPPAAAE;QTPPAAAED;TPPAAAEDS;PPAAAEDSV;PAAAEDSVT;AAAEDSVTL;AAEDSVTLF;AEDSVTLFS;EDSVTLFSG;DSVTLFSGN;SVTLFSGNE;VTLFSGNEI;TLFSGNEIF;LFSGNEIFV;FSGNEIFVS;SGNEIFVSK;GNEIFVSKE;NEIFVSKEK;EIFVSKEKN;IFVSKEKNS;FVSKEKNSS;VSKEKNSSG;SKEKNSSGK;KEKNSSGKY;EKNSSGKYD;KNSSGKYDL;NSSGKYDLR;SSGKYDLRT;SGKYDLRTT;GKYDLRTTI;KYDLRTTIN;YDLRTTINQ;DLRTTINQV;LRTTINQVE;RTTINQVEL;TTINQVELK;TINQVELKG;INQVELKGT;NQVELKGTS;QVELKGTSD;VELKGTSDK;ELKGTSDKN;LKGTSDKNN;KGTSDKNNG;GTSDKNNGS;TSDKNNGSG;SDKNNGSGS;DKNNGSGSL;KNNGS | 201496-202920 |

Fig. 43 continued

GSLE;NNGSGSLEG;NGSGSLEGV;GSGSLEGVK;SGSLEGVKA;GSLEGVKAD;SLEGVKAD
K;LEGVKADKS;EGVKADKSK;GVKADKSKV;VKADKSKVK;KADKSKVKL;ADKSKVKLI;D
KSKVKLIV;KSKVKLIVS;SKVKLIVSD;KVKLIVSDD;VKLIVSDDL;KLIVSDDLN;LIVS
DDLNT;IVSDDLNTV;VSDDLNTVT;SDDLNTVTV;DDLNTVTVE;DLNTVTVET;LNTVTVE
TF;NTVTVETFD;TVTVETFDS;VTVETFDSS;TVETFDSSG;VETFDSSGK;ETFDSSGKK;
TFDSSGKKD;FDSSGKKDS

AK;NSNKAPKDAKQ;SNKAPKDAKQT;NKAPKDAKQTP;KAPKDAKQTPP;APKDAKQTPPA;PKDAKQTPPAA;KDAKQTPPAAA;DAKQTPPAAAE;AKQTPPAAAED;KQTPPAAAEDS;QTPPAAAEDSV;TPPAAAEDSVT;PPAAAEDSVTL;PAAAEDSVTLF;AAAEDSVTLFS;AAEDSVTLFSG;AEDSVTLFSGN;EDSVTLFSGNE;DSVTLFSGNEI;SVTLFSGNEIF;VTLFSGNEIFV;TLFSGNEIFVS;LFSGNEIFVSK;FSGNEIFVSKE;SGNEIFVSKEK;GNEIFVSKEKN;NEIFVSKEKNS;EIFVSKEKNSS;IFVSKEKNSSG;FVSKEKNSSGK;VSKEKNSSGKY;SKEKNSSGKYD;KEKNSSGKYDL;EKNSSGKYDLR;KNSSGKYDLRT;NSSGKYDLRTT;SSGKYDLRTTI;SGKYDLRTTIN;GKYDLRTTINQ;KYDLRTTINQV;YDLRTTINQVE;DLRTTINQVEL;LRTTINQVELK;RTTINQVELKG;TTINQVELKGT;TINQVELKGTS;INQVELKGTSD;NQVELKGTSDK;QVELKGTSDKN;VELKGTSDKNN;ELKGTSDKNNG;LKGTSDKNNGS;KGTSDKNNGSG;GTSDKNNGSGS;TSDKNNGSGSL;SDKNNGSGSLE;DKNNGSGSLEG;KNNGSGSLEGV;NNGSGSLEGVK;NGSGSLEGVKA;GSGSLEGVKAD;SGSLEGVKADK;GSLEGVKADKS;SLEGVKADKSK;LEGVKADKSKV;EGVKADKSKVK;GVKADKSKVKL;VKADKSKVKLI;KADKSKVKLIV;ADKSKVKLIVS;DKSKVKLIVSD;KSKVKLIVSDD;SKVKLIVSDDL;KVKLIVSDDLN;VKLIVSDDLNT;KLIVSDDLNTV;LIVSDDLNTVT;IVSDDLNTVTV;VSDDLNTVTVE;SDDLNTVTVET;DDLNTVTVETF;DLNTVTVETFD;LNTVTVETFDS;NTVTVETFDSS;TVTVETFDSSG;VTVETFDSSGK;TVETFDSSGKK;VETFDSSGKKD;ETFDSSGKKDS;TFDSSGKKDSS;FDSSGKKDSSK;DSSGKKDSSKV;SSGKKDSSKVT;SGKKDSSKVTV;GKKDSSKVTVK;KKDSSKVTVKH;KDSSKVTVKHG;DSSKVTVKHGS;SSKVTVKHGSI;SKVTVKHGSIT;KVTVKHGSITE;VTVKHGSITED;TVKHGSITEDT;VKHGSITEDTF;KHGSITEDTFK;HGSITEDTFKA;GSITEDTFKAN;SITEDTFKANK;ITEDTFKANKL;TEDTFKANKLD;EDTFKANKLDS;DTFKANKLDSK;TFKANKLDSKK;FKANKLDSKKL;KANKLDSKKLT;ANKLDSKKLTR;NKLDSKKLTRS;KLDSKKLTRSN;LDSKKLTRSNG;DSKKLTRSNGT;SKKLTRSNGTM;KKLTRSNGTML;KLTRSNGTMLE;LTRSNGTMLEY;TRSNGTMLEYS;RSNGTMLEYSQ;SNGTMLEYSQM;NGTMLEYSQMT;GTMLEYSQMTD;TMLEYSQMTDA;MLEYSQMTDAD;LEYSQMTDADN;EYSQMTDADNA;YSQMTDADNAT;SQMTDADNATK;QMTDADNATKA;MTDADNATKAV;TDADNATKAVE;DADNATKAVET;ADNATKAVETL;DNATKAVETLK;NATKAVETLKN;

13 mers:

MRLYLTGFALALA;RLYLTGFALALAL;LYLTGFALALALI;YLTGFALALALIG;LTGFALALALIGC;TGFALALALIGCA;GFALALALIGCAQ;FALALALIGCAQK;ALALALIGCAQKG;LALALIGCAQKGA;ALALIGCAQKGAE;LALIGCAQKGAEP;ALIGCAQKGAEPK;LIGCAQKGAEPKN;IGCAQKGAEPKNT;GCAQKGAEPKNTS;CAQKGAEPKNTSQ;AQKGAEPKNTSQK;QKGAEPKNTSQKY;KGAEPKNTSQKYD;GAEPKNTSQKYDD;AEPKNTSQKYDDQ;EPKNTSQKYDDQE;PKNTSQKYDDQEV;KNTSQKYDDQEVI;NTSQKYDDQEVIN;TSQKYDDQEVINS;SQKYDDQEVINSN;QKYDDQEVINSNK;KYDDQEVINSNKA;YDDQEVINSNKAP;DDQEVINSNKAPK;DQEVINSNKAPKD;QEVINSNKAPKDA;EVINSNKAPKDAK;VINSNKAPKDAKQ;INSNKAPKDAKQT;NSNKAPKDAKQTP;SNKAPKDAKQTPP;NKAPKDAKQTPPA;KAPKDAKQTPPAA;APKDAKQTPPAAA;PKDAKQTPPAAAE;KDAKQTPPAAAED;DAKQTPPAAAEDS;AKQTPPAAAEDSV;KQTPPAAAEDSVT;QTPPAAAEDSVTL;TPPAAAEDSVTLF;PPAAAEDSVTLFS;PAAAEDSVTLFSG;AAAEDSVTLFSGN;AAEDSVTLFSGNE;AEDSVTLFSGNEI;EDSVTLFSGNEIF;DSVTLFSGNEIFV;SVTLFSGNEIFVS;VTLFSGNEIFVSK;TLFSGNEIFVSKE;LFSGNEIFVSKEK;FSGNEIFVSKEKN;SGNEIFVSKEKNS;GNEIFVSKEKNSS;NEIFVSKEKNSSG;EIFVSKEKNSSGK;IFVSKEKNSSGKY;FVSKEKNSSGKYD;VSKEKNSSGKYDL;SKEKNSSGKYDLR;KEKNSSGKYDLRT;EKNSSGKYDLRTT;KNSSGKYDLRTTI;NSSGKYDLRTTIN;SSGKYDLRTTINQ;SGKYDLRTTINQV;GKYDLRTTINQVE;KYDLRTTINQVEL;YDLRTTINQVELK;DLRTTINQVELKG;LRTTINQVELKGT;RTTINQVELKGTS;TTINQVELKGTSD;TINQVELKGTSDK;INQVELKGTSDKN;NQVELKGTSDKNN;QVELKGTSDKNNG;VELKGTSDKNNGS;ELKGTSDKNNGSG;LKGTSDKNNGSGS;KGTSDKNNGSGSL;GTSDKNNGSGSLE;TSDKNNGSGSLEG;SDKNNGSGSLEGV;DKNNGSGSLEGVK;KNNGSGSLEGVKA;NNGSGSLEGVKAD;NGSGSLEGVKADK;GSGSLEGVKADKS;SGSLEGVKADKSK;GSLEGVKADKSKV;SLEGVKADKSKVK;LEGVKADKSKVKL;EGVKADKSKVKLI;GVKADKSKVKLIV;VKADKSKVKLIVS;KADKSKVKLIVSD;ADKSKVKLIVSDD;DKSKVKLIVSDDL;KSKVKLIVSDDLN;SKVKLIVSDDLNT;KVKLIVSDDLNTV;VKLIVSDDLNTVT;KLIVSDDLNTVTV;LIVSDDLNTVTVE;IVSDDLNTVTVET;VSDDLNTVTVETF;SDDLNTVTVETFD;DDLNTVTVETFDS;DLNTVTVETFDSS;LNTVTVETFDSSG;NTVTVETFDSSGK;TVTVETF

Fig. 43 continued

DSSGKK;VTVETFDSSGKKD;TVETFDSSGKKDS;VETFDSSGKKDSS;ETFDSSGKKDSSK;
TFDSSGKKDSSKV;FDSSGKKDSSKVT;DSSGKKDSSKVTV;SSGKKDSSKVTVK;SGKKDSS
KVTVKH;GKKDSSKVTVKHG;KKDSSKVTVKHGS;KDSSKVTVKHGSI;DSSKVTVKHGSIT;
SSKVTVKHGSITE;SKVTVKHGSITED;KVTVKHGSITEDT;VTVKHGSITEDTF;TVKHGSI
TEDTFK;VKHGSITEDTFKA;KHGSITEDTFKAN;HGSITEDTFKANK;GSITEDTFKANKL;
SITEDTFKANKLD;ITEDTFKANKLDS;TEDTFKANKLDSK;EDTFKANKLDSKK;DTFKANK
LDSKKL;TFKANKLDSKKLT;FKANKLDSKKLTR;KANKLDSKKLTRS;ANKLDSKKLTRSN;
NKLDSKKLTRSNG;KLDSKKLTRSNGT;LDSKKLTRSNGTM;DSKKLTRSNGTML;SKKLTRS
NGTMLE;KKLTRSNGTMLEY;KLTRSNGTMLEYS;LTRSNGTMLEYSQ;TRSNGTMLEYSQM;
RSNGTMLEYSQMT;SNGTMLEYSQMTD;NGTMLEYSQMTDA;GTMLEYSQMTDAD;TMLEYSQ
MTDADN;MLEYSQMTDADNA;LEYSQMTDADNAT;EYSQMTDADNATK;YSQMTDADNATKA;
SQMTDADNATKAV;QMTDADNATKAVE;MTDADNATKAVET;TDADNATKAVETL;DADNATK
AVETLK;ADNATKAVETLKN;

14 mers:

MRLYLTGFALALAL;RLYLTGFALALALI;LYLTGFALALALIG;YLTGFALALALIGC;LTG
FALALALIGCA;TGFALALALIGCAQ;GFALALALIGCAQK;FALALALIGCAQKG;ALALAL
IGCAQKGA;LALALIGCAQKGAE;ALALIGCAQKGAEP;LALIGCAQKGAEPK;ALIGCAQKG
AEPKN;LIGCAQKGAEPKNT;IGCAQKGAEPKNTS;GCAQKGAEPKNTSQ;CAQKGAEPKNTS
QK;AQKGAEPKNTSQKY;QKGAEPKNTSQKYD;KGAEPKNTSQKYDD;GAEPKNTSQKYDDQ;
AEPKNTSQKYDDQE;EPKNTSQKYDDQEV;PKNTSQKYDDQEVI;KNTSQKYDDQEVIN;NTS
QKYDDQEVINS;TSQKYDDQEVINSN;SQKYDDQEVINSNK;QKYDDQEVINSNKA;KYDDQE
VINSNKAP;YDDQEVINSNKAPK;DDQEVINSNKAPKD;DQEVINSNKAPKDA;QEVINSNKA
PKDAK;EVINSNKAPKDAKQ;VINSNKAPKDAKQT;INSNKAPKDAKQTP;NSNKAPKDAKQT
PP;SNKAPKDAKQTPPA;NKAPKDAKQTPPAA;KAPKDAKQTPPAAA;APKDAKQTPPAAAE;
PKDAKQTPPAAAED;KDAKQTPPAAAEDS;DAKQTPPAAAEDSV;AKQTPPAAAEDSVT;KQT
PPAAAEDSVTL;QTPPAAAEDSVTLF;TPPAAAEDSVTLFS;PPAAAEDSVTLFSG;PAAAED
SVTLFSGN;AAAEDSVTLFSGNE;AAEDSVTLFSGNEI;AEDSVTLFSGNEIF;EDSVTLFSG
NEIFV;DSVTLFSGNEIFVS;SVTLFSGNEIFVSK;VTLFSGNEIFVSKE;TLFSGNEIFVSK
EK;LFSGNEIFVSKEKN;FSGNEIFVSKEKNS;SGNEIFVSKEKNSS;GNEIFVSKEKNSSG;
NEIFVSKEKNSSGK;EIFVSKEKNSSGKY;IFVSKEKNSSGKYD;FVSKEKNSSGKYDL;VSK
EKNSSGKYDLR;SKEKNSSGKYDLRT;KEKNSSGKYDLRTT;EKNSSGKYDLRTTI;KNSSGK
YDLRTTIN;NSSGKYDLRTTINQ;SSGKYDLRTTINQV;SGKYDLRTTINQVE;GKYDLRTTI
NQVEL;KYDLRTTINQVELK;YDLRTTINQVELKG;DLRTTINQVELKGT;LRTTINQVELKG
TS;RTTINQVELKGTSD;TTINQVELKGTSDK;TINQVELKGTSDKN;INQVELKGTSDKNN;
NQVELKGTSDKNNG;QVELKGTSDKNNGS;VELKGTSDKNNGSG;ELKGTSDKNNGSGS;LKG
TSDKNNGSGSL;KGTSDKNNGSGSLE;GTSDKNNGSGSLEG;TSDKNNGSGSLEGV;SDKNNG
SGSLEGVK;DKNNGSGSLEGVKA;KNNGSGSLEGVKAD;NNGSGSLEGVKADK;NGSGSLEGV
KADKS;GSGSLEGVKADKSK;SGSLEGVKADKSKV;GSLEGVKADKSKVK;SLEGVKADKSKV
KL;LEGVKADKSKVKLI;EGVKADKSKVKLIV;GVKADKSKVKLIVS;VKADKSKVKLIVSD;
KADKSKVKLIVSDD;ADKSKVKLIVSDDL;DKSKVKLIVSDDLN;KSKVKLIVSDDLNT;SKV
KLIVSDDLNTV;KVKLIVSDDLNTVT;VKLIVSDDLNTVTV;KLIVSDDLNTVTVE;LIVSDD
LNTVTVET;IVSDDLNTVTVETF;VSDDLNTVTVETFD;SDDLNTVTVETFDS;DDLNTVTVE
TFDSS;DLNTVTVETFDSSG;LNTVTVETFDSSGK;NTVTVETFDSSGKK;TVTVETFDSSGK
KD;VTVETFDSSGKKDS;TVETFDSSGKKDSS;VETFDSSGKKDSSK;ETFDSSGKKDSSKV;
TFDSSGKKDSSKVT;FDSSGKKDSSKVTV;DSSGKKDSSKVTVK;SSGKKDSSKVTVKH;SGK
KDSSKVTVKHG;GKKDSSKVTVKHGS;KKDSSKVTVKHGSI;KDSSKVTVKHGSIT;DSSKVT
VKHGSITE;SSKVTVKHGSITED;SKVTVKHGSITEDT;KVTVKHGSITEDTF;VTVKHGSIT
EDTFK;TVKHGSITEDTFKA;VKHGSITEDTFKAN;KHGSITEDTFKANK;HGSITEDTFKAN
KL;GSITEDTFKANKLD;SITEDTFKANKLDS;ITEDTFKANKLDSK;TEDTFKANKLDSKK;
EDTFKANKLDSKKL;DTFKANKLDSKKLT;TFKANKLDSKKLTR;FKANKLDSKKLTRS;KAN
KLDSKKLTRSN;ANKLDSKKLTRSNG;NKLDSKKLTRSNGT;KLDSKKLTRSNGTM;LDSKKL
TRSNGTML;DSKKLTRSNGTMLE;SKKLTRSNGTMLEY;KKLTRSNGTMLEYS;KLTRSNGTM
LEYSQ;LTRSNGTMLEYSQM;TRSNGTMLEYSQMT;RSNGTMLEYSQMTD;SNGTMLEYSQMT
DA;NGTMLEYSQMTDAD;GTMLEYSQMTDADN;TMLEYSQMTDADNA;MLEYSQMTDADNAT;
LEYSQMTDADNATK;EYSQMTDADNATKA;YSQMTDADNATKAV;SQMTDADNATKAVE;QMT
DADNATKAVET;MTDADNATKAVETL;TDADNATKAVETLK;DADNATKAVETLKN;

Fig. 43 continued 15 mers:
MRLYLTGFALALALI;RLYLTGFALALALIG;LYLTGFALALALIGC;YLTGFALALALIGCA
;LTGFALALALIGCAQ;TGFALALALIGCAQK;GFALALALIGCAQKG;FALALALIGCAQKG
A;ALALALIGCAQKGAE;LALALIGCAQKGAEP;ALALIGCAQKGAEPK;LALIGCAQKGAEP
KN;ALIGCAQKGAEPKNT;LIGCAQKGAEPKNTS;IGCAQKGAEPKNTSQ;GCAQKGAEPKNT
SQK;CAQKGAEPKNTSQKY;AQKGAEPKNTSQKYD;QKGAEPKNTSQKYDD;KGAEPKNTSQK
YDDQ;GAEPKNTSQKYDDQE;AEPKNTSQKYDDQEV;EPKNTSQKYDDQEVI;PKNTSQKYDD
QEVIN;KNTSQKYDDQEVINS;NTSQKYDDQEVINSN;TSQKYDDQEVINSNK;SQKYDDQEV
INSNKA;QKYDDQEVINSNKAP;KYDDQEVINSNKAPK;YDDQEVINSNKAPKD;DDQEVINS
NKAPKDA;DQEVINSNKAPKDAK;QEVINSNKAPKDAKQ;EVINSNKAPKDAKQT;VINSNKA
PKDAKQTP;INSNKAPKDAKQTPP;NSNKAPKDAKQTPPA;SNKAPKDAKQTPPAA;NKAPKD
AKQTPPAAA;KAPKDAKQTPPAAAE;APKDAKQTPPAAAED;PKDAKQTPPAAAEDS;KDAKQ
TPPAAAEDSV;DAKQTPPAAAEDSVT;AKQTPPAAAEDSVTL;KQTPPAAAEDSVTLF;QTPP
AAAEDSVTLFS;TPPAAAEDSVTLFSG;PPAAAEDSVTLFSGN;PAAAEDSVTLFSGNE;AAA
EDSVTLFSGNEI;AAEDSVTLFSGNEIF;AEDSVTLFSGNEIFV;EDSVTLFSGNEIFVS;DS
VTLFSGNEIFVSK;SVTLFSGNEIFVSKE;VTLFSGNEIFVSKEK;TLFSGNEIFVSKEKN;L
FSGNEIFVSKEKNS;FSGNEIFVSKEKNSS;SGNEIFVSKEKNSSG;GNEIFVSKEKNSSGK;
NEIFVSKEKNSSGKY;EIFVSKEKNSSGKYD;IFVSKEKNSSGKYDL;FVSKEKNSSGKYDLR
;VSKEKNSSGKYDLRT;SKEKNSSGKYDLRTT;KEKNSSGKYDLRTTI;EKNSSGKYDLRTTI
N;KNSSGKYDLRTTINQ;NSSGKYDLRTTINQV;SSGKYDLRTTINQVE;SGKYDLRTTINQV
EL;GKYDLRTTINQVELK;KYDLRTTINQVELKG;YDLRTTINQVELKGT;DLRTTINQVELK
GTS;LRTTINQVELKGTSD;RTTINQVELKGTSDK;TTINQVELKGTSDKN;TINQVELKGTS
DKNN;INQVELKGTSDKNNG;NQVELKGTSDKNNGS;QVELKGTSDKNNGSG;VELKGTSDKN
NGSGS;ELKGTSDKNNGSGSL;LKGTSDKNNGSGSLE;KGTSDKNNGSGSLEG;GTSDKNNGS
GSLEGV;TSDKNNGSGSLEGVK;SDKNNGSGSLEGVKA;DKNNGSGSLEGVKAD;KNNGSGSL
EGVKADK;NNGSGSLEGVKADKS;NGSGSLEGVKADKSK;GSGSLEGVKADKSKV;SGSLEGV
KADKSKVK;GSLEGVKADKSKVKL;SLEGVKADKSKVKLI;LEGVKADKSKVKLIV;EGVKAD
KSKVKLIVS;GVKADKSKVKLIVSD;VKADKSKVKLIVSDD;KADKSKVKLIVSDDL;ADKSK
VKLIVSDDLN;DKSKVKLIVSDDLNT;KSKVKLIVSDDLNTV;SKVKLIVSDDLNTVT;KVKL
IVSDDLNTVTV;VKLIVSDDLNTVTVE;KLIVSDDLNTVTVET;LIVSDDLNTVTVETF;IVS
DDLNTVTVETFD;VSDDLNTVTVETFDS;SDDLNTVTVETFDSS;DDLNTVTVETFDSSG;DL
NTVTVETFDSSGK;LNTVTVETFDSSGKK;NTVTVETFDSSGKKD;TVTVETFDSSGKKDS;V
TVETFDSSGKKDSS;TVETFDSSGKKDSSK;VETFDSSGKKDSSKV;ETFDSSGKKDSSKVT;
TFDSSGKKDSSKVTV;FDSSGKKDSSKVTVK;DSSGKKDSSKVTVKH;SSGKKDSSKVTVKHG
;SGKKDSSKVTVKHGS;GKKDSSKVTVKHGSI;KKDSSKVTVKHGSIT;KDSSKVTVKHGSIT
E;DSSKVTVKHGSITED;SSKVTVKHGSITEDT;SKVTVKHGSITEDTF;KVTVKHGSITEDT
FK;VTVKHGSITEDTFKA;TVKHGSITEDTFKAN;VKHGSITEDTFKANK;KHGSITEDTFKA
NKL;HGSITEDTFKANKLD;GSITEDTFKANKLDS;SITEDTFKANKLDSK;ITEDTFKANKL
DSKK;TEDTFKANKLDSKKL;EDTFKANKLDSKKLT;DTFKANKLDSKKLTR;TFKANKLDSK
KLTRS;FKANKLDSKKLTRSN;KANKLDSKKLTRSNG;ANKLDSKKLTRSNGT;NKLDSKKLT
RSNGTM;KLDSKKLTRSNGTML;LDSKKLTRSNGTMLE;DSKKLTRSNGTMLEY;SKKLTRSN
GTMLEYS;KKLTRSNGTMLEYSQ;KLTRSNGTMLEYSQM;LTRSNGTMLEYSQMT;TRSNGTM
LEYSQMTD;RSNGTMLEYSQMTDA;SNGTMLEYSQMTDAD;NGTMLEYSQMTDADN;GTMLEY
SQMTDADNA;TMLEYSQMTDADNAT;MLEYSQMTDADNATK;LEYSQMTDADNATKA;EYSQM
TDADNATKAV;YSQMTDADNATKAVE;SQMTDADNATKAVET;QMTDADNATKAVETL;MTDA
DNATKAVETLK;TDADNATKAVETLKN;

16 mers:
MRLYLTGFALALALIG;RLYLTGFALALALIGC;LYLTGFALALALIGCA;YLTGFALALALI
GCAQ;LTGFALALALIGCAQK;TGFALALALIGCAQKG;GFALALALIGCAQKGA;FALALAL
IGCAQKGAE;ALALALIGCAQKGAEP;LALALIGCAQKGAEPK;ALALIGCAQKGAEPKN;LA
LIGCAQKGAEPKNT;ALIGCAQKGAEPKNTS;LIGCAQKGAEPKNTSQ;IGCAQKGAEPKNTS
QK;GCAQKGAEPKNTSQKY;CAQKGAEPKNTSQKYD;AQKGAEPKNTSQKYDD;QKGAEPKNT
SQKYDDQ;KGAEPKNTSQKYDDQE;GAEPKNTSQKYDDQEV;AEPKNTSQKYDDQEVI;EPKN
TSQKYDDQEVIN;PKNTSQKYDDQEVINS;KNTSQKYDDQEVINSN;NTSQKYDDQEVINSNK
;TSQKYDDQEVINSNKA;SQKYDDQEVINSNKAP;QKYDDQEVINSNKAPK;KYDDQEVINSN

Fig. 43 continued

| | |
|---|---|
| KAPKD; YDDQEVINSNKAPKDA; DDQEVINSNKAPKDAK; DQEVINSNKAPKDAKQ; QEVINS NKAPKDAKQT; EVINSNKAPKDAKQTP; VINSNKAPKDAKQTPP; INSNKAPKDAKQTPPA; N SNKAPKDAKQTPPAA; NKAPKDAKQTPPAAA; KAPKDAKQTPPAAAE; APKDAKQTPPAA AED; PKDAKQTPPAAAEDS; KDAKQTPPAAAEDSV; DAKQTPPAAAEDSVT; AKQTPPA AAEDSVTL; KQTPPAAAEDSVTLF; QTPPAAAEDSVTLFS; TPPAAAEDSVTLFSG; TPP AAAEDSVTLFSGN; PPAAAEDSVTLFSGNE; PAAAEDSVTLFSGNEI; AAAEDSVTLFSGNEI F; AAEDSVTLFSGNEIFV; AEDSVTLFSGNEIFVS; EDSVTLFSGNEIFVSK; DSVTLFSGNE IFVSKE; SVTLFSGNEIFVSKEK; VTLFSGNEIFVSKEKN; TLFSGNEIFVSKEKNS; LFSGN EIFVSKEKNSS; FSGNEIFVSKEKNSSG; SGNEIFVSKEKNSSGK; GNEIFVSKEKNSSGKY; NEIFVSKEKNSSGKYD; EIFVSKEKNSSGKYDL; IFVSKEKNSSGKYDLR; FVSKEKNSSGKY DLRT; VSKEKNSSGKYDLRTT; SKEKNSSGKYDLRTTI; KEKNSSGKYDLRTTIN; EKNSSGK YDLRTTINQ; KNSSGKYDLRTTINQV; NSSGKYDLRTTINQVE; SSGKYDLRTTINQVEL; SG KYDLRTTINQVELK; GKYDLRTTINQVELKG; KYDLRTTINQVELKGT; YDLRTTINQVELKG TS; DLRTTINQVELKGTSD; LRTTINQVELKGTSDK; RTTINQVELKGTSDKN; TTINQVELK GTSDKNN; TINQVELKGTSDKNNG; INQVELKGTSDKNNGS; NQVELKGTSDKNNGSG; QVEL KGTSDKNNGSGS; VELKGTSDKNNGSGSL; ELKGTSDKNNGSGSLE; LKGTSDKNNGSGSLEG ; KGTSDKNNGSGSLEGV; GTSDKNNGSGSLEGVK; TSDKNNGSGSLEGVKA; SDKNNGSGSLE GVKAD; DKNNGSGSLEGVKADK; KNNGSGSLEGVKADKS; NNGSGSLEGVKADKSK; NGSGSL EGVKADKSKV; GSGSLEGVKADKSKVK; SGSLEGVKADKSKVKL; GSLEGVKADKSKVKLI; S LEGVKADKSKVKLIV; LEGVKADKSKVKLIVS; EGVKADKSKVKLIVSD; GVKADKSKVKLIV SDD; VKADKSKVKLIVSDDL; KADKSKVKLIVSDDLN; ADKSKVKLIVSDDLNT; DKSKVKLI VSDDLNTV; KSKVKLIVSDDLNTVT; SKVKLIVSDDLNTVTV; KVKLIVSDDLNTVTVE; VKL IVSDDLNTVTVET; KLIVSDDLNTVTVETF; LIVSDDLNTVTVETFD; IVSDDLNTVTVETFD S; VSDDLNTVTVETFDSS; SDDLNTVTVETFDSSG; DDLNTVTVETFDSSGK; DLNTVTVETF DSSGKK; LNTVTVETFDSSGKKD; NTVTVETFDSSGKKDS; TVTVETFDSSGKKDSS; VTVET FDSSGKKDSSK; TVETFDSSGKKDSSKV; VETFDSSGKKDSSKVT; ETFDSSGKKDSSKVTV; TFDSSGKKDSSKVTVK; FDSSGKKDSSKVTVKH; DSSGKKDSSKVTVKHG; SSGKKDSSKVTV KHGS; SGKKDSSKVTVKHGSI; GKKDSSKVTVKHGSIT; KKDSSKVTVKHGSITE; KDSSKVT VKHGSITED; DSSKVTVKHGSITEDT; SSKVTVKHGSITEDTF; SKVTVKHGSITEDTFK; KV TVKHGSITEDTFKA; VTVKHGSITEDTFKAN; TVKHGSITEDTFKANK; VKHGSITEDTFKAN KL; KHGSITEDTFKANKLD; HGSITEDTFKANKLDS; GSITEDTFKANKLDSK; SITEDTFKA NKLDSKK; ITEDTFKANKLDSKKL; TEDTFKANKLDSKKLT; EDTFKANKLDSKKLTR; DTFK ANKLDSKKLTRS; TFKANKLDSKKLTRSN; FKANKLDSKKLTRSNG; KANKLDSKKLTRSNGT ; ANKLDSKKLTRSNGTM; NKLDSKKLTRSNGTML; KLDSKKLTRSNGTMLE; LDSKKLTRSNG TMLEY; DSKKLTRSNGTMLEYS; SKKLTRSNGTMLEYSQ; KKLTRSNGTMLEYSQM; KLTRSN GTMLEYSQMT; LTRSNGTMLEYSQMTD; TRSNGTMLEYSQMTDA; RSNGTMLEYSQMTDAD; S NGTMLEYSQMTDADN; NGTMLEYSQMTDADNA; GTMLEYSQMTDADNAT; TMLEYSQMTDADN ATK; MLEYSQMTDADNATKA; LEYSQMTDADNATKAV; EYSQMTDADNATKAVE; YSQMTDAD NATKAVET; SQMTDADNATKAVETL; QMTDADNATKAVETLK; MTDADNATKAVETLKN | |
| <CAA65880.1 membrane protein A;Borrelia afzelii> FLSCSGKSGLESGIPKVSLVIDGTFDDKSFNESALNGVKKLKEEFEIELVLKESSTNSYLSDL EGLKDAGSNLIWLIGYKFSDVAKAVSLQNSEMKYAIIDPVYSNEPIPANLVGMTFRAQEGAFL TGYIAAKVSKTGKIGFLGGIEGDIVDAFRYGYEAGAKYANKDIKIFSQYIGSFSDLEAGRSVA TKMYSDGIDIIHHAAGLGGIGAIEVAKELGSGHYIIGVDEDQSYLAPNNVITSTTKDVGRSLN LLTSNYLKTNTFEGGKLINYGLKEGVVGFVRNPKMIPFEVEKEIDSLSSKIINKEVIVPYNKE SYEKFLKEFI 8 mers:
FLSCSGKS; LSCSGKSG; SCSGKSGL; CSGKSGLE; SGKSGLES; GKSGLESG; KSGLESGI; SGLESGIP; GLESGIPK; LESGIPKV; ESGIPKVS; SGIPKVSL; GIPKVSLV; IPKVSLVI; PKVSLVID; KVSLVIDG; VSLVIDGT; SLVIDGTF; LVIDGTFD; VIDGTFDD; IDGTFDDK; DGTFDDKS; GTFDDKSF; TFDDKSFN; FDDKSFNE; DDKSFNES; DKSFNESA; KSFNESAL; SFNESALN; FNESALNG; NESALNGV; ESALNGVK; SALNGVKK; ALNGVKKL; LNGVKKLK; NGVKKLKE; GVKKLKEE; VKKLKEEF; KKLKEEFE; KLKEEFEI; LKEEFEIE; KEEFEIEL; EEFEIELV; EFEIELVL; FEIELVLK; EIELVLKE; IELVLKES; ELVLKESS; LVLKESST; VLKESSTN; LKESSTNS; KESSTNSY; ESSTNSYL; SSTNSYLS; STNSYLSD; TNSYLSDL; NSYLSDLE; SYLSDLEG; YLSDLEGL; LSDLEGLK; SDLEGLKD; DLEGLKDA; LEGLKDAG; | 202921-205433 |

Fig. 43 continued

EGLKDAGS;GLKDAGSN;LKDAGSNL;KDAGSNLI;DAGSNLIW;AGSNLIWL;GSNLIWLI;
SNLIWLIG;NLIWLIGY;LIWLIGYK;IWLIGYKF;WLIGYKFS;LIGYKFSD;IGYKFSDV;
GYKFSDVA;YKFSDVAK;KFSDVAKA;FSDVAKAV;SDVAKAVS;DVAKAVSL;VAKAVSLQ;
AKAVSLQN;KAVSLQNS;AVSLQNSE;VSLQNSEM;SLQNSEMK;LQNSEMKY;QNSEMKYA;
NSEMKYAI;SEMKYAII;EMKYAIID;MKYAIIDP;KYAIIDPV;YAIIDPVY;AIIDPVYS;
IIDPVYSN;IDPVYSNE;DPVYSNEP;PVYSNEPI;VYSNEPIP;YSNEPIPA;SNEPIPAN;
NEPIPANL;EPIPANLV;PIPANLVG;IPANLVGM;PANLVGMT;ANLVGMTF;NLVGMTFR;
LVGMTFRA;VGMTFRAQ;GMTFRAQE;MTFRAQEG;TFRAQEGA;FRAQEGAF;RAQEGAFL;
AQEGAFLT;QEGAFLTG;EGAFLTGY;GAFLTGYI;AFLTGYIA;FLTGYIAA;LTGYIAAK;
TGYIAAKV;GYIAAKVS;YIAAKVSK;IAAKVSKT;AAKVSKTG;AKVSKTGK;KVSKTGKI;
VSKTGKIG;SKTGKIGF;KTGKIGFL;TGKIGFLG;GKIGFLGG;KIGFLGGI;IGFLGGIE;
GFLGGIEG;FLGGIEGD;LGGIEGDI;GGIEGDIV;GIEGDIVD;IEGDIVDA;EGDIVDAF;
GDIVDAFR;DIVDAFRY;IVDAFRYG;VDAFRYGY;DAFRYGYE;AFRYGYEA;FRYGYEAG;
RYGYEAGA;YGYEAGAK;GYEAGAKY;YEAGAKYA;EAGAKYAN;AGAKYANK;GAKYANKD;
AKYANKDI;KYANKDIK;YANKDIKI;ANKDIKIF;NKDIKIFS;KDIKIFSQ;DIKIFSQY;
IKIFSQYI;KIFSQYIG;IFSQYIGS;FSQYIGSF;SQYIGSFS;QYIGSFSD;YIGSFSDL;
IGSFSDLE;GSFSDLEA;SFSDLEAG;FSDLEAGR;SDLEAGRS;DLEAGRSV;LEAGRSVA;
EAGRSVAT;AGRSVATK;GRSVATKM;RSVATKMY;SVATKMYS;VATKMYSD;ATKMYSDG;
TKMYSDGI;KMYSDGID;MYSDGIDI;YSDGIDII;SDGIDIIH;DGIDIIHH;GIDIIHHA;
IDIIHHAA;DIIHHAAG;IIHHAAGL;IHHAAGLG;HHAAGLGG;HAAGLGGI;AAGLGGIG;
AGLGGIGA;GLGGIGAI;LGGIGAIE;GGIGAIEV;GIGAIEVA;IGAIEVAK;GAIEVAKE;
AIEVAKEL;IEVAKELG;EVAKELGS;VAKELGSG;AKELGSGH;KELGSGHY;ELGSGHYI;
LGSGHYII;GSGHYIIG;SGHYIIGV;GHYIIGVD;HYIIGVDE;YIIGVDED;IIGVDEDQ;
IGVDEDQS;GVDEDQSY;VDEDQSYL;DEDQSYLA;EDQSYLAP;DQSYLAPN;QSYLAPNN;
SYLAPNNV;YLAPNNVI;LAPNNVIT;APNNVITS;PNNVITST;NNVITSTT;NVITSTTK;
VITSTTKD;ITSTTKDV;TSTTKDVG;STTKDVGR;TTKDVGRS;TKDVGRSL;KDVGRSLN;
DVGRSLNL;VGRSLNLL;GRSLNLLT;RSLNLLTS;SLNLLTSN;LNLLTSNY;NLLTSNYL;
LLTSNYLK;LTSNYLKT;TSNYLKTN;SNYLKTNT;NYLKTNTF;YLKTNTFE;LKTNTFEG;
KTNTFEGG;TNTFEGGK;NTFEGGKL;TFEGGKLI;FEGGKLIN;EGGKLINY;GGKLINYG;
GKLINYGL;KLINYGLK;LINYGLKE;INYGLKEG;NYGLKEGV;YGLKEGVV;GLKEGVVG;
LKEGVVGF;KEGVVGFV;EGVVGFVR;GVVGFVRN;VVGFVRNP;VGFVRNPK;GFVRNPKM;
FVRNPKMI;VRNPKMIP;RNPKMIPF;NPKMIPFE;PKMIPFEV;KMIPFEVE;MIPFEVEK;
IPFEVEKE;PFEVEKEI;FEVEKEID;EVEKEIDS;VEKEIDSL;EKEIDSLS;KEIDSLSS;
EIDSLSSK;IDSLSSKI;DSLSSKII;SLSSKIIN;LSSKIINK;SSKIINKE;SKIINKEV;
KIINKEVI;IINKEVIV;INKEVIVP;NKEVIVPY;KEVIVPYN;EVIVPYNK;VIVPYNKE;
IVPYNKES;VPYNKESY;PYNKESYE;YNKESYEK;NKESYEKF;KESYEKFL;ESYEKFLK;
SYEKFLKE;YEKFLKEF;EKFLKEFI;

9 mers:
FLSCSGKSG;LSCSGKSGL;SCSGKSGLE;CSGKSGLES;SGKSGLESG;GKSGLESGI;KSG
LESGIP;SGLESGIPK;GLESGIPKV;LESGIPKVS;ESGIPKVSL;SGIPKVSLV;GIPKVS
LVI;IPKVSLVID;PKVSLVIDG;KVSLVIDGT;VSLVIDGTF;SLVIDGTFD;LVIDGTFDD
;VIDGTFDDK;IDGTFDDKS;DGTFDDKSF;GTFDDKSFN;TFDDKSFNE;FDDKSFNES;DD
KSFNESA;DKSFNESAL;KSFNESALN;SFNESALNG;FNESALNGV;NESALNGVK;ESALN
GVKK;SALNGVKKL;ALNGVKKLK;LNGVKKLKE;NGVKKLKEE;GVKKLKEEF;VKKLKEEF
E;KKLKEEFEI;KLKEEFEIE;LKEEFEIEL;KEEFEIELV;EEFEIELVL;EFEIELVLK;F
EIELVLKE;EIELVLKES;IELVLKESS;ELVLKESST;LVLKESSTN;VLKESSTNS;LKES
STNSY;KESSTNSYL;ESSTNSYLS;SSTNSYLSD;STNSYLSDL;TNSYLSDLE;NSYLSDL
EG;SYLSDLEGL;YLSDLEGLK;LSDLEGLKD;SDLEGLKDA;DLEGLKDAG;LEGLKDAGS;
EGLKDAGSN;GLKDAGSNL;LKDAGSNLI;KDAGSNLIW;DAGSNLIWL;AGSNLIWLI;GSN
LIWLIG;SNLIWLIGY;NLIWLIGYK;LIWLIGYKF;IWLIGYKFS;WLIGYKFSD;LIGYKF
SDV;IGYKFSDVA;GYKFSDVAK;YKFSDVAKA;KFSDVAKAV;FSDVAKAVS;SDVAKAVSL
;DVAKAVSLQ;VAKAVSLQN;AKAVSLQNS;KAVSLQNSE;AVSLQNSEM;VSLQNSEMK;SL
QNSEMKY;LQNSEMKYA;QNSEMKYAI;NSEMKYAII;SEMKYAIID;EMKYAIIDP;MKYAI
IDPV;KYAIIDPVY;YAIIDPVYS;AIIDPVYSN;IIDPVYSNE;IDPVYSNEP;DPVYSNEP
I;PVYSNEPIP;VYSNEPIPA;YSNEPIPAN;SNEPIPANL;NEPIPANLV;EPIPANLVG;P
IPANLVGM;IPANLVGMT;PANLVGMTF;ANLVGMTFR;NLVGMTFRA;LVGMTFRAQ;VGMT

Fig. 43 continued

FRAQE;GMTFRAQEG;MTFRAQEGA;TFRAQEGAF;FRAQEGAFL;RAQEGAFLT;AQEGAFL
TG;QEGAFLTGY;EGAFLTGYI;GAFLTGYIA;AFLTGYIAA;FLTGYIAAK;LTGYIAAKV;
TGYIAAKVS;GYIAAKVSK;YIAAKVSKT;IAAKVSKTG;AAKVSKTGK;AKVSKTGKI;KVS
KTGKIG;VSKTGKIGF;SKTGKIGFL;KTGKIGFLG;TGKIGFLGG;GKIGFLGGI;KIGFLG
GIE;IGFLGGIEG;GFLGGIEGD;FLGGIEGDI;LGGIEGDIV;GGIEGDIVD;GIEGDIVDA
;IEGDIVDAF;EGDIVDAFR;GDIVDAFRY;DIVDAFRYG;IVDAFRYGY;VDAFRYGYE;DA
FRYGYEA;AFRYGYEAG;FRYGYEAGA;RYGYEAGAK;YGYEAGAKY;GYEAGAKYA;YEAGA
KYAN;EAGAKYANK;AGAKYANKD;GAKYANKDI;AKYANKDIK;KYANKDIKI;YANKDIKI
F;ANKDIKIFS;NKDIKIFSQ;KDIKIFSQY;DIKIFSQYI;IKIFSQYIG;KIFSQYIGS;I
FSQYIGSF;FSQYIGSFS;SQYIGSFSD;QYIGSFSDL;YIGSFSDLE;IGSFSDLEA;GSFS
DLEAG;SFSDLEAGR;FSDLEAGRS;SDLEAGRSV;DLEAGRSVA;LEAGRSVAT;EAGRSVA
TK;AGRSVATKM;GRSVATKMY;RSVATKMYS;SVATKMYSD;VATKMYSDG;ATKMYSDGI;
TKMYSDGID;KMYSDGIDI;MYSDGIDII;YSDGIDIIH;SDGIDIIHH;DGIDIIHHA;GID
IIHHAA;IDIIHHAAG;DIIHHAAGL;IIHHAAGLG;IHHAAGLGG;HHAAGLGGI;HAAGLG
GIG;AAGLGGIGA;AGLGGIGAI;GLGGIGAIE;LGGIGAIEV;GGIGAIEVA;GIGAIEVAK
;IGAIEVAKE;GAIEVAKEL;AIEVAKELG;IEVAKELGS;EVAKELGSG;VAKELGSGH;AK
ELGSGHY;KELGSGHYI;ELGSGHYII;LGSGHYIIG;GSGHYIIGV;SGHYIIGVD;GHYII
GVDE;HYIIGVDED;YIIGVDEDQ;IIGVDEDQS;IGVDEDQSY;GVDEDQSYL;VDEDQSYL
A;DEDQSYLAP;EDQSYLAPN;DQSYLAPNN;QSYLAPNNV;SYLAPNNVI;YLAPNNVIT;L
APNNVITS;APNNVITST;PNNVITSTT;NNVITSTTK;NVITSTTKD;VITSTTKDV;ITST
TKDVG;TSTTKDVGR;STTKDVGRS;TTKDVGRSL;TKDVGRSLN;KDVGRSLNL;DVGRSLN
LL;VGRSLNLLT;GRSLNLLTS;RSLNLLTSN;SLNLLTSNY;LNLLTSNYL;NLLTSNYLK;
LLTSNYLKT;LTSNYLKTN;TSNYLKTNT;SNYLKTNTF;NYLKTNTFE;YLKTNTFEG;LKT
NTFEGG;KTNTFEGGK;TNTFEGGKL;NTFEGGKLI;TFEGGKLIN;FEGGKLINY;EGGKLI
NYG;GGKLINYGL;GKLINYGLK;KLINYGLKE;LINYGLKEG;INYGLKEGV;NYGLKEGVV
;YGLKEGVVG;GLKEGVVGF;LKEGVVGFV;KEGVVGFVR;EGVVGFVRN;GVVGFVRNP;VV
GFVRNPK;VGFVRNPKM;GFVRNPKMI;FVRNPKMIP;VRNPKMIPF;RNPKMIPFE;NPKMI
PFEV;PKMIPFEVE;KMIPFEVEK;MIPFEVEKE;IPFEVEKEI;PFEVEKEID;FEVEKEID
S;EVEKEIDSL;VEKEIDSLS;EKEIDSLSS;KEIDSLSSK;EIDSLSSKI;IDSLSSKII;D
SLSSKIIN;SLSSKIINK;LSSKIINKE;SSKIINKEV;SKIINKEVI;KIINKEVIV;IINK
EVIVP;INKEVIVPY;NKEVIVPYN;KEVIVPYNK;EVIVPYNKE;VIVPYNKES;IVPYNKE
SY;VPYNKESYE;PYNKESYEK;YNKESYEKF;NKESYEKFL;KESYEKFLK;ESYEKFLKE;
SYEKFLKEF;YEKFLKEFI;

10 mers:
FLSCSGKSGL;LSCSGKSGLE;SCSGKSGLES;CSGKSGLESG;SGKSGLESGI;GKSGLESG
IP;KSGLESGIPK;SGLESGIPKV;GLESGIPKVS;LESGIPKVSL;ESGIPKVSLV;SGIPK
VSLVI;GIPKVSLVID;IPKVSLVIDG;PKVSLVIDGT;KVSLVIDGTF;VSLVIDGTFD;SL
VIDGTFDD;LVIDGTFDDK;VIDGTFDDKS;IDGTFDDKSF;DGTFDDKSFN;GTFDDKSFNE
;TFDDKSFNES;FDDKSFNESA;DDKSFNESAL;DKSFNESALN;KSFNESALNG;SFNESAL
NGV;FNESALNGVK;NESALNGVKK;ESALNGVKKL;SALNGVKKLK;ALNGVKKLKE;LNGV
KKLKEE;NGVKKLKEEF;GVKKLKEEFE;VKKLKEEFEI;KKLKEEFEIE;KLKEEFEIEL;L
KEEFEIELV;KEEFEIELVL;EEFEIELVLK;EFEIELVLKE;FEIELVLKES;EIELVLKES
S;IELVLKESST;ELVLKESSTN;LVLKESSTNS;VLKESSTNSY;LKESSTNSYL;KESSTN
SYLS;ESSTNSYLSD;SSTNSYLSDL;STNSYLSDLE;TNSYLSDLEG;NSYLSDLEGL;SYL
SDLEGLK;YLSDLEGLKD;LSDLEGLKDA;SDLEGLKDAG;DLEGLKDAGS;LEGLKDAGSN;
EGLKDAGSNL;GLKDAGSNLI;LKDAGSNLIW;KDAGSNLIWL;DAGSNLIWLI;AGSNLIWL
IG;GSNLIWLIGY;SNLIWLIGYK;NLIWLIGYKF;LIWLIGYKFS;IWLIGYKFSD;WLIGY
KFSDV;LIGYKFSDVA;IGYKFSDVAK;GYKFSDVAKA;YKFSDVAKAV;KFSDVAKAVS;FS
DVAKAVSL;SDVAKAVSLQ;DVAKAVSLQN;VAKAVSLQNS;AKAVSLQNSE;KAVSLQNSEM
;AVSLQNSEMK;VSLQNSEMKY;SLQNSEMKYA;LQNSEMKYAI;QNSEMKYAII;NSEMKYA
IID;SEMKYAIIDP;EMKYAIIDPV;MKYAIIDPVY;KYAIIDPVYS;YAIIDPVYSN;AIID
PVYSNE;IIDPVYSNEP;IDPVYSNEPI;DPVYSNEPIP;PVYSNEPIPA;VYSNEPIPAN;Y
SNEPIPANL;SNEPIPANLV;NEPIPANLVG;EPIPANLVGM;PIPANLVGMT;IPANLVGMT
F;PANLVGMTFR;ANLVGMTFRA;NLVGMTFRAQ;LVGMTFRAQE;VGMTFRAQEG;GMTFRA
QEGA;MTFRAQEGAF;TFRAQEGAFL;FRAQEGAFLT;RAQEGAFLTG;AQEGAFLTGY;QEG
AFLTGYI;EGAFLTGYIA;GAFLTGYIAA;AFLTGYIAAK;FLTGYIAAKV;LTGYIAAKVS;

Fig. 43 continued

TGYIAAKVSK;GYIAAKVSKT;YIAAKVSKTG;IAAKVSKTGK;AAKVSKTGKI;AKVSKTGK
IG;KVSKTGKIGF;VSKTGKIGFL;SKTGKIGFLG;KTGKIGFLGG;TGKIGFLGGI;GKIGF
LGGIE;KIGFLGGIEG;IGFLGGIEGD;GFLGGIEGDI;FLGGIEGDIV;LGGIEGDIVD;GG
IEGDIVDA;GIEGDIVDAF;IEGDIVDAFR;EGDIVDAFRY;GDIVDAFRYG;DIVDAFRYGY
;IVDAFRYGYE;VDAFRYGYEA;DAFRYGYEAG;AFRYGYEAGA;FRYGYEAGAK;RYGYEAG
AKY;YGYEAGAKYA;GYEAGAKYAN;YEAGAKYANK;EAGAKYANKD;AGAKYANKDI;GAKY
ANKDIK;AKYANKDIKI;KYANKDIKIF;YANKDIKIFS;ANKDIKIFSQ;NKDIKIFSQY;K
DIKIFSQYI;DIKIFSQYIG;IKIFSQYIGS;KIFSQYIGSF;IFSQYIGSFS;FSQYIGSFS
D;SQYIGSFSDL;QYIGSFSDLE;YIGSFSDLEA;IGSFSDLEAG;GSFSDLEAGR;SFSDLE
AGRS;FSDLEAGRSV;SDLEAGRSVA;DLEAGRSVAT;LEAGRSVATK;EAGRSVATKM;AGR
SVATKMY;GRSVATKMYS;RSVATKMYSD;SVATKMYSDG;VATKMYSDGI;ATKMYSDGID;
TKMYSDGIDI;KMYSDGIDII;MYSDGIDIIH;YSDGIDIIHH;SDGIDIIHHA;DGIDIIHH
AA;GIDIIHHAAG;IDIIHHAAGL;DIIHHAAGLG;IIHHAAGLGG;IHHAAGLGGI;HHAAG
LGGIG;HAAGLGGIGA;AAGLGGIGAI;AGLGGIGAIE;GLGGIGAIEV;LGGIGAIEVA;GG
IGAIEVAK;GIGAIEVAKE;IGAIEVAKEL;GAIEVAKELG;AIEVAKELGS;IEVAKELGSG
;EVAKELGSGH;VAKELGSGHY;AKELGSGHYI;KELGSGHYII;ELGSGHYIIG;LGSGHYI
IGV;GSGHYIIGVD;SGHYIIGVDE;GHYIIGVDED;HYIIGVDEDQ;YIIGVDEDQS;IIGV
DEDQSY;IGVDEDQSYL;GVDEDQSYLA;VDEDQSYLAP;DEDQSYLAPN;EDQSYLAPNN;D
QSYLAPNNV;QSYLAPNNVI;SYLAPNNVIT;YLAPNNVITS;LAPNNVITST;APNNVITST
T;PNNVITSTTK;NNVITSTTKD;NVITSTTKDV;VITSTTKDVG;ITSTTKDVGR;TSTTKD
VGRS;STTKDVGRSL;TTKDVGRSLN;TKDVGRSLNL;KDVGRSLNLL;DVGRSLNLLT;VGR
SLNLLTS;GRSLNLLTSN;RSLNLLTSNY;SLNLLTSNYL;LNLLTSNYLK;NLLTSNYLKT;
LLTSNYLKTN;LTSNYLKTNT;TSNYLKTNTF;SNYLKTNTFE;NYLKTNTFEG;YLKTNTFE
GG;LKTNTFEGGK;KTNTFEGGKL;TNTFEGGKLI;NTFEGGKLIN;TFEGGKLINY;FEGGK
LINYG;EGGKLINYGL;GGKLINYGLK;GKLINYGLKE;KLINYGLKEG;LINYGLKEGV;IN
YGLKEGVV;NYGLKEGVVG;YGLKEGVVGF;GLKEGVVGFV;LKEGVVGFVR;KEGVVGFVRN
;EGVVGFVRNP;GVVGFVRNPK;VVGFVRNPKM;VGFVRNPKMI;GFVRNPKMIP;FVRNPKM
IPF;VRNPKMIPFE;RNPKMIPFEV;NPKMIPFEVE;PKMIPFEVEK;KMIPFEVEKE;MIPF
EVEKEI;IPFEVEKEID;PFEVEKEIDS;FEVEKEIDSL;EVEKEIDSLS;VEKEIDSLSS;E
KEIDSLSSK;KEIDSLSSKI;EIDSLSSKII;IDSLSSKIIN;DSLSSKIINK;SLSSKIINK
E;LSSKIINKEV;SSKIINKEVI;SKIINKEVIV;KIINKEVIVP;IINKEVIVPY;INKEVI
VPYN;NKEVIVPYNK;KEVIVPYNKE;EVIVPYNKES;VIVPYNKESY;IVPYNKESYE;VPY
NKESYEK;PYNKESYEKF;YNKESYEKFL;NKESYEKFLK;KESYEKFLKE;ESYEKFLKEF;
SYEKFLKEFI;

11 mers:
FLSCSGKSGLE;LSCSGKSGLES;SCSGKSGLESG;CSGKSGLESGI;SGKSGLESGIP;GKS
GLESGIPK;KSGLESGIPKV;SGLESGIPKVS;GLESGIPKVSL;LESGIPKVSLV;ESGIPK
VSLVI;SGIPKVSLVID;GIPKVSLVIDG;IPKVSLVIDGT;PKVSLVIDGTF;KVSLVIDGT
FD;VSLVIDGTFDD;SLVIDGTFDDK;LVIDGTFDDKS;VIDGTFDDKSF;IDGTFDDKSFN;
DGTFDDKSFNE;GTFDDKSFNES;TFDDKSFNESA;FDDKSFNESAL;DDKSFNESALN;DKS
FNESALNG;KSFNESALNGV;SFNESALNGVK;FNESALNGVKK;NESALNGVKKL;ESALNG
VKKLK;SALNGVKKLKE;ALNGVKKLKEE;LNGVKKLKEEF;NGVKKLKEEFE;GVKKLKEEF
EI;VKKLKEEFEIE;KKLKEEFEIEL;KLKEEFEIELV;LKEEFEIELVL;KEEFEIELVLK;
EEFEIELVLKE;EFEIELVLKES;FEIELVLKESS;EIELVLKESST;IELVLKESSTN;ELV
LKESSTNS;LVLKESSTNSY;VLKESSTNSYL;LKESSTNSYLS;KESSTNSYLSD;ESSTNS
YLSDL;SSTNSYLSDLE;STNSYLSDLEG;TNSYLSDLEGL;NSYLSDLEGLK;SYLSDLEGL
KD;YLSDLEGLKDA;LSDLEGLKDAG;SDLEGLKDAGS;DLEGLKDAGSN;LEGLKDAGSNL;
EGLKDAGSNLI;GLKDAGSNLIW;LKDAGSNLIWL;KDAGSNLIWLI;DAGSNLIWLIG;AGS
NLIWLIGY;GSNLIWLIGYK;SNLIWLIGYKF;NLIWLIGYKFS;LIWLIGYKFSD;IWLIGY
KFSDV;WLIGYKFSDVA;LIGYKFSDVAK;IGYKFSDVAKA;GYKFSDVAKAV;YKFSDVAKA
VS;KFSDVAKAVSL;FSDVAKAVSLQ;SDVAKAVSLQN;DVAKAVSLQNS;VAKAVSLQNSE;
AKAVSLQNSEM;KAVSLQNSEMK;AVSLQNSEMKY;VSLQNSEMKYA;SLQNSEMKYAI;LQN
SEMKYAII;QNSEMKYAIID;NSEMKYAIIDP;SEMKYAIIDPV;EMKYAIIDPVY;MKYAII
DPVYS;KYAIIDPVYSN;YAIIDPVYSNE;AIIDPVYSNEP;IIDPVYSNEPI;IDPVYSNEP
IP;DPVYSNEPIPA;PVYSNEPIPAN;VYSNEPIPANL;YSNEPIPANLV;SNEPIPANLVG;
NEPIPANLVGM;EPIPANLVGMT;PIPANLVGMTF;IPANLVGMTFR;PANLVGMTFRA;ANL

Fig. 43 continued

VGMTFRAQ;NLVGMTFRAQE;LVGMTFRAQEG;VGMTFRAQEGA;GMTFRAQEGAF;MTFRAQ
EGAFL;TFRAQEGAFLT;FRAQEGAFLTG;RAQEGAFLTGY;AQEGAFLTGYI;QEGAFLTGY
IA;EGAFLTGYIAA;GAFLTGYIAAK;AFLTGYIAAKV;FLTGYIAAKVS;LTGYIAAKVSK;
TGYIAAKVSKT;GYIAAKVSKTG;YIAAKVSKTGK;IAAKVSKTGKI;AAKVSKTGKIG;AKV
SKTGKIGF;KVSKTGKIGFL;VSKTGKIGFLG;SKTGKIGFLGG;KTGKIGFLGGI;TGKIGF
LGGIE;GKIGFLGGIEG;KIGFLGGIEGD;IGFLGGIEGDI;GFLGGIEGDIV;FLGGIEGDI
VD;LGGIEGDIVDA;GGIEGDIVDAF;GIEGDIVDAFR;IEGDIVDAFRY;EGDIVDAFRYG;
GDIVDAFRYGY;DIVDAFRYGYE;IVDAFRYGYEA;VDAFRYGYEAG;DAFRYGYEAGA;AFR
YGYEAGAK;FRYGYEAGAKY;RYGYEAGAKYA;YGYEAGAKYAN;GYEAGAKYANK;YEAGAK
YANKD;EAGAKYANKDI;AGAKYANKDIK;GAKYANKDIKI;AKYANKDIKIF;KYANKDIKI
FS;YANKDIKIFSQ;ANKDIKIFSQY;NKDIKIFSQYI;KDIKIFSQYIG;DIKIFSQYIGS;
IKIFSQYIGSF;KIFSQYIGSFS;IFSQYIGSFSD;FSQYIGSFSDL;SQYIGSFSDLE;QYI
GSFSDLEA;YIGSFSDLEAG;IGSFSDLEAGR;GSFSDLEAGRS;SFSDLEAGRSV;FSDLEA
GRSVA;SDLEAGRSVAT;DLEAGRSVATK;LEAGRSVATKM;EAGRSVATKMY;AGRSVATKM
YS;GRSVATKMYSD;RSVATKMYSDG;SVATKMYSDGI;VATKMYSDGID;ATKMYSDGIDI;
TKMYSDGIDII;KMYSDGIDIIH;MYSDGIDIIHH;YSDGIDIIHHA;SDGIDIIHHAA;DGI
DIIHHAAG;GIDIIHHAAGL;IDIIHHAAGLG;DIIHHAAGLGG;IIHHAAGLGGI;IHHAAG
LGGIG;HHAAGLGGIGA;HAAGLGGIGAI;AAGLGGIGAIE;AGLGGIGAIEV;GLGGIGAIE
VA;LGGIGAIEVAK;GGIGAIEVAKE;GIGAIEVAKEL;IGAIEVAKELG;GAIEVAKELGS;
AIEVAKELGSG;IEVAKELGSGH;EVAKELGSGHY;VAKELGSGHYI;AKELGSGHYII;KEL
GSGHYIIG;ELGSGHYIIGV;LGSGHYIIGVD;GSGHYIIGVDE;SGHYIIGVDED;GHYIIG
VDEDQ;HYIIGVDEDQS;YIIGVDEDQSY;IIGVDEDQSYL;IGVDEDQSYLA;GVDEDQSYL
AP;VDEDQSYLAPN;DEDQSYLAPNN;EDQSYLAPNNV;DQSYLAPNNVI;QSYLAPNNVIT;
SYLAPNNVITS;YLAPNNVITST;LAPNNVITSTT;APNNVITSTTK;PNNVITSTTKD;NNV
ITSTTKDV;NVITSTTKDVG;VITSTTKDVGR;ITSTTKDVGRS;TSTTKDVGRSL;STTKDV
GRSLN;TTKDVGRSLNL;TKDVGRSLNLL;KDVGRSLNLLT;DVGRSLNLLTS;VGRSLNLLT
SN;GRSLNLLTSNY;RSLNLLTSNYL;SLNLLTSNYLK;LNLLTSNYLKT;NLLTSNYLKTN;
LLTSNYLKTNT;LTSNYLKTNTF;TSNYLKTNTFE;SNYLKTNTFEG;NYLKTNTFEGG;YLK
TNTFEGGK;LKTNTFEGGKL;KTNTFEGGKLI;TNTFEGGKLIN;NTFEGGKLINY;TFEGGK
LINYG;FEGGKLINYGL;EGGKLINYGLK;GGKLINYGLKE;GKLINYGLKEG;KLINYGLKE
GV;LINYGLKEGVV;INYGLKEGVVG;NYGLKEGVVGF;YGLKEGVVGFV;GLKEGVVGFVR;
LKEGVVGFVRN;KEGVVGFVRNP;EGVVGFVRNPK;GVVGFVRNPKM;VVGFVRNPKMI;VGF
VRNPKMIP;GFVRNPKMIPF;FVRNPKMIPFE;VRNPKMIPFEV;RNPKMIPFEVE;NPKMIP
FEVEK;PKMIPFEVEKE;KMIPFEVEKEI;MIPFEVEKEID;IPFEVEKEIDS;PFEVEKEID
SL;FEVEKEIDSLS;EVEKEIDSLSS;VEKEIDSLSSK;EKEIDSLSSKI;KEIDSLSSKII;
EIDSLSSKIIN;IDSLSSKIINK;DSLSSKIINKE;SLSSKIINKEV;LSSKIINKEVI;SSK
IINKEVIV;SKIINKEVIVP;KIINKEVIVPY;IINKEVIVPYN;INKEVIVPYNK;NKEVIV
PYNKE;KEVIVPYNKES;EVIVPYNKESY;VIVPYNKESYE;IVPYNKESYEK;VPYNKESYE
KF;PYNKESYEKFL;YNKESYEKFLK;NKESYEKFLKE;KESYEKFLKEF;ESYEKFLKEFI;

13 mers:
FLSCSGKSGLESG;LSCSGKSGLESGI;SCSGKSGLESGIP;CSGKSGLESGIPK;SGKSGLE
SGIPKV;GKSGLESGIPKVS;KSGLESGIPKVSL;SGLESGIPKVSLV;GLESGIPKVSLVI;
LESGIPKVSLVID;ESGIPKVSLVIDG;SGIPKVSLVIDGT;GIPKVSLVIDGTF;IPKVSLV
IDGTFD;PKVSLVIDGTFDD;KVSLVIDGTFDDK;VSLVIDGTFDDKS;SLVIDGTFDDKSF;
LVIDGTFDDKSFN;VIDGTFDDKSFNE;IDGTFDDKSFNES;DGTFDDKSFNESA;GTFDDKS
FNESAL;TFDDKSFNESALN;FDDKSFNESALNG;DDKSFNESALNGV;DKSFNESALNGVK;
KSFNESALNGVKK;SFNESALNGVKKL;FNESALNGVKKLK;NESALNGVKKLKE;ESALNGV
KKLKEE;SALNGVKKLKEEF;ALNGVKKLKEEFE;LNGVKKLKEEFEI;NGVKKLKEEFEIE;
GVKKLKEEFEIEL;VKKLKEEFEIELV;KKLKEEFEIELVL;KLKEEFEIELVLK;LKEEFEI
ELVLKE;KEEFEIELVLKES;EEFEIELVLKESS;EFEIELVLKESST;FEIELVLKESSTN;
EIELVLKESSTNS;IELVLKESSTNSY;ELVLKESSTNSYL;LVLKESSTNSYLS;VLKESST
NSYLSD;LKESSTNSYLSDL;KESSTNSYLSDLE;ESSTNSYLSDLEG;SSTNSYLSDLEGL;
STNSYLSDLEGLK;TNSYLSDLEGLKD;NSYLSDLEGLKDA;SYLSDLEGLKDAG;YLSDLEG
LKDAGS;LSDLEGLKDAGSN;SDLEGLKDAGSNL;DLEGLKDAGSNLI;LEGLKDAGSNLIW;
EGLKDAGSNLIWL;GLKDAGSNLIWLI;LKDAGSNLIWLIG;KDAGSNLIWLIGY;DAGSNLI
WLIGYK;AGSNLIWLIGYKF;GSNLIWLIGYKFS;SNLIWLIGYKFSD;NLIWLIGYKFSDV;

Fig. 43 continued

LIWLIGYKFSDVA; IWLIGYKFSDVAK; WLIGYKFSDVAKA; LIGYKFSDVAKAV; IGYKFSD
VAKAVS; GYKFSDVAKAVSL; YKFSDVAKAVSLQ; KFSDVAKAVSLQN; FSDVAKAVSLQNS;
SDVAKAVSLQNSE; DVAKAVSLQNSEM; VAKAVSLQNSEMK; AKAVSLQNSEMKY; KAVSLQN
SEMKYA; AVSLQNSEMKYAI; VSLQNSEMKYAII; SLQNSEMKYAIID; LQNSEMKYAIIDP;
QNSEMKYAIIDPV; NSEMKYAIIDPVY; SEMKYAIIDPVYS; EMKYAIIDPVYSN; MKYAIID
PVYSNE; KYAIIDPVYSNEP; YAIIDPVYSNEPI; AIIDPVYSNEPIP; IIDPVYSNEPIPA;
IDPVYSNEPIPAN; DPVYSNEPIPANL; PVYSNEPIPANLV; VYSNEPIPANLVG; YSNEPIP
ANLVGM; SNEPIPANLVGMT; NEPIPANLVGMTF; EPIPANLVGMTFR; PIPANLVGMTFRA;
IPANLVGMTFRAQ; PANLVGMTFRAQE; ANLVGMTFRAQEG; NLVGMTFRAQEGA; LVGMTFR
AQEGAF; VGMTFRAQEGAFL; GMTFRAQEGAFLT; MTFRAQEGAFLTG

SGLESGIPKVS; GKSGLESGIPKVSL; KSGLESGIPKVSLV; SGLESGIPKVSLVI; GLESGI
PKVSLVID; LESGIPKVSLVIDG; ESGIPKVSLVIDGT; SGIPKVSLVIDGTF; GIPKVSLVI
DGTFD; IPKVSLVIDGTFDD; PKVSLVIDGTFDDK; KVSLVIDGTFDDKS; VSLVIDGTFDDK
SF; SLVIDGTFDDKSFN; LVIDGTFDDKSFNE; VIDGTFDDKSFNES; IDGTFDDKSFNESA;
DGTFDDKSFNESAL

LLTSN; KDVGRSLNLLTSNY; DVGRSLNLLTSNYL; VGRSLNLLTSNYLK; GRSLNLLTSNYL
KT; RSLNLLTSNYLKTN; SLNLLTSNYLKTNT; LNLLTSNYLKTNTF; NLLTSNYLKTNTFE;
LLTSNYLKTNTFEG; LTSNYLKTNTFEGG; TSNYLKTNTFEGGK; SNYLKTNTFEGGKL; NYL
KTNTFEGGKLI; YLKTNTFEGGKLIN; LKTNTFEGGKLINY; KTNTFEGGKLINYG; TNTFEG
GKLINYGL; NTFEGGKLINYGLK; TFEGGKLINYGLKE; FEGGKLINYGLKEG; EGGKLINYG
LKEGV; GGKLINYGLKEGVV; GKLINYGLKEGVVG; KLINYGLKEGVVGF; LINYGLKEGVVG
FV; INYGLKEGVVGFVR; NYGLKEGVVGFVRN; YGLKEGVVGFVRNP; GLKEGVVGFVRNPK;
LKEGVVGFVRNPKM; KEGVVGFVRNPKMI; EGVVGFVRNPKMIP; GVVGFVRNPKMIPF; VVG
FVRNPKMIPFE; VGFVRNPKMIPFEV; GFVRNPKMIPFEVE; FVRNPKMIPFEVEK; VRNPKM

AGAKY; VDAFRYGYEAGAKYA; DAFRYGYEAGAKYAN; AFRYGYEAGAKYANK; FRYGYEAGA
KYANKD; RYGYEAGAKYANKDI; YGYEAGAKYANKDIK; GYEAGAKYANKDIKI; YEAGAKYA
NKDIKIF; EAGAKYANKDIKIFS; AGAKYANKDIKIFSQ; GAKYANKDIKIFSQY; AKYANKD
IKIFSQYI; KYANKDIKIFSQYIG; YANKDIKIFSQYIGS; ANKDIKIFSQYIGSF; NKDIKI
FSQYIGSFS; KDIKIFSQYIGSFSD; DIKIFSQYIGSFSDL; IKIFSQYIGSFSDLE; KIFSQ
YIGSFSDLEA; IFSQYIGSFSDLEAG; FSQYIGSFSDLEAGR;SQYIGSFSDLEAGRS;QYIG
SFSDLEAGRSV;YIGSFSDLEAGRSVA;IGSFSDLEAGRSVAT;GSFSDLEAGRSVATK;SFS
DLEAGRSVATKM;FSDLEAGRSVATKMY;SDLEAGRSVATKMYS;DLEAGRSVATKMYSD;LE
AGRSVATKMYSDG;EAGRSVATKMYSDGI;AGRSVATKMYSDGID;GRSVATKMYSDGIDI;R
SVATKMYSDGIDII;SVATKMYSDGIDIIH;VATKMYSDGIDIIHH;ATKMYSDGIDIIHHA;
TKMYSDGIDIIHHAA;KMYSDGIDIIHHAAG;MYSDGIDIIHHAAGL;YSDGIDIIHHAAGLG
;SDGIDIIHHAAGLGG;DGIDIIHHAAGLGGI;GIDIIHHAAGLGGIG;IDIIHHAAGLGGIG
A;DIIHHAAGLGGIGAI;IIHHAAGLGGIGAIE;IHHAAGLGGIGAIEV;HHAAGLGGIGAIE
VA;HAAGLGGIGAIEVAK;AAGLGGIGAIEVAKE;AGLGGIGAIEVAKEL;GLGGIGAIEVAK
ELG;LGGIGAIEVAKELGS;GGIGAIEVAKELGSG;GIGAIEVAKELGSGH;IGAIEVAKELG
SGHY;GAIEVAKELGSGHYI;AIEVAKELGSGHYII;IEVAKELGSGHYIIG;EVAKELGSGH
YIIGV;VAKELGSGHYIIGVD;AKELGSGHYIIGVDE;KELGSGHYIIGVDED;ELGSGHYII
GVDEDQ;LGSGHYIIGVDEDQS;GSGHYIIGVDEDQSY;SGHYIIGVDEDQSYL;GHYIIGVD
EDQSYLA;HYIIGVDEDQSYLAP;YIIGVDEDQSYLAPN;IIGVDEDQSYLAPNN;IGVDEDQ
SYLAPNNV;GVDEDQSYLAPNNVI;VDEDQSYLAPNNVIT;DEDQSYLAPNNVITS;EDQSYL
APNNVITST;DQSYLAPNNVITSTT;QSYLAPNNVITSTTK;SYLAPNNVITSTTKD;YLAPN
NVITSTTKDV;LAPNNVITSTTKDVG;APNNVITSTTKDVGR;PNNVITSTTKDVGRS;NNVI
TSTTKDVGRSL;NVITSTTKDVGRSLN;VITSTTKDVGRSLNL;ITSTTKDVGRSLNLL;TST
TKDVGRSLNLLT;STTKDVGRSLNLLTS;TTKDVGRSLNLLTSN;TKDVGRSLNLLTSNY;KD
VGRSLNLLTSNYL;DVGRSLNLLTSNYLK;VGRSLNLLTSNYLKT;GRSLNLLTSNYLKTN;R
SLNLLTSNYLKTNT;SLNLLTSNYLKTNTF;LNLLTSNYLKTNTFE;NLLTSNYLKTNTFEG;
LLTSNYLKTNTFEGG;LTSNYLKTNTFEGGK;TSNYLKTNTFEGGKL;SNYLKTNTFEGGKLI
;NYLKTNTFEGGKLIN;YLKTNTFEGGKLINY;LKTNTFEGGKLINYG;KTNTFEGGKLINYG
L;TNTFEGGKLINYGLK;NTFEGGKLINYGLKE;TFEGGKLINYGLKEG;FEGGKLINYGLKE
GV;EGGKLINYGLKEGVV;GGKLINYGLKEGVVG;GKLINYGLKEGVVGF;KLINYGLKEGVV
GFV;LINYGLKEGVVGFVR;INYGLKEGVVGFVRN;NYGLKEGVVGFVRNP;YGLKEGVVGFV
RNPK;GLKEGVVGFVRNPKM;LKEGVVGFVRNPKMI;KEGVVGFVRNPKMIP;EGVVGFVRNP
KMIPF;GVVGFVRNPKMIPFE;VVGFVRNPKMIPFEV;VGFVRNPKMIPFEVE;GFVRNPKMI
PFEVEK;FVRNPKMIPFEVEKE;VRNPKMIPFEVEKEI;RNPKMIPFEVEKEID;NPKMIPFE
VEKEIDS;PKMIPFEVEKEIDSL;KMIPFEVEKEIDSLS;MIPFEVEKEIDSLSS;IPFEVEK
EIDSLSSK;PFEVEKEIDSLSSKI;FEVEKEIDSLSSKII;EVEKEIDSLSSKIIN;VEKEID
SLSSKIINK;EKEIDSLSSKIINKE;KEIDSLSSKIINKEV;EIDSLSSKIINKEVI;IDSLS
SKIINKEVIV;DSLSSKIINKEVIVP;SLSSKIINKEVIVPY;LSSKIINKEVIVPYN;SSKI
INKEVIVPYNK;SKIINKEVIVPYNKE;KIINKEVIVPYNKES;IINKEVIVPYNKESY;INK
EVIVPYNKESYE;NKEVIVPYNKESYEK;KEVIVPYNKESYEKF;EVIVPYNKESYEKFL;VI
VPYNKESYEKFLK;IVPYNKESYEKFLKE;VPYNKESYEKFLKEF;PYNKESYEKFLKEFI;

16 mers:
FLSCSGKSGLESGIPK;LSCSGKSGLESGIPKV;SCSGKSGLESGIPKVS;CSGKSGLESGIP
KVSL;SGKSGLESGIPKVSLV;GKSGLESGIPKVSLVI;KSGLESGIPKVSLVID;SGLESGI
PKVSLVIDG;GLESGIPKVSLVIDGT;LESGIPKVSLVIDGTF;ESGIPKVSLVIDGTFD;SG
IPKVSLVIDGTFDD;GIPKVSLVIDGTFDDK;IPKVSLVIDGTFDDKS;PKVSLVIDGTFDDK
SF;KVSLVIDGTFDDKSFN;VSLVIDGTFDDKSFNE;SLVIDGTFDDKSFNES;LVIDGTFDD
KSFNESA;VIDGTFDDKSFNESAL;IDGTFDDKSFNESALN;DGTFDDKSFNESALNG;GTFD
DKSFNESALNGV;TFDDKSFNESALNGVK;FDDKSFNESALNGVKK;DDKSFNESALNGVKKL
;DKSFNESALNGVKKLK;KSFNESALNGVKKLKE;SFNESALNGVKKLKEE;FNESALNGVKK
LKEEF;NESALNGVKKLKEEFE;ESALNGVKKLKEEFEI;SALNGVKKLKEEFEIE;ALNGVK
KLKEEFEIEL;LNGVKKLKEEFEIELV;NGVKKLKEEFEIELVL;GVKKLKEEFEIELVLK;V
KKLKEEFEIELVLKE;KKLKEEFEIELVLKES;KLKEEFEIELVLKESS;LKEEFEIELVLKE
SST;KEEFEIELVLKESSTN;EEFEIELVLKESSTNS;EFEIELVLKESSTNSY;FEIELVLK
ESSTNSYL;EIELVLKESSTNSYLS;IELVLKESSTNSYLSD;ELVLKESSTNSYLSDL;LVL
KESSTNSYLSDLE;VLKESSTNSYLSDLEG;LKESSTNSYLSDLEGL;KESSTNSYLSDLEGL

Fig. 43 continued

K;ESSTNSYLSDLEGLKD;SSTNSYLSDLEGLKDA;STNSYLSDLEGLKDAG;TNSYLSDLEG
LKDAGS;NSYLSDLEGLKDAGSN;SYLSDLEGLKDAGSNL;YLSDLEGLKDAGSNLI;LSDLE
GLKDAGSNLIW;SDLEGLKDAGSNLIWL;DLEGLKDAGSNLIWLI;LEGLKDAGSNLIWLIG;
EGLKDAGSNLIWLIGY;GLKDAGSNLIWLIGYK;LKDAGSNLIWLIGYKF;KDAGSNLIWLIG
YKFS;DAGSNLIWLIGYKFSD;AGSNLIWLIGYKFSDV;GSNLIWLIGYKFSDVA;SNLIWLI
GYKFSDVAK;NLIWLIGYKFSDVAKA;LIWLIGYKFSDVAKAV;IWLIGYKFSDVAKAVS;WL
IGYKFSDVAKAVSL;LIGYKFSDVAKAVSLQ;IGYKFSDVAKAVSLQN;GYKFSDVAKAVSLQ
NS;YKFSDVAKAVSLQNSE;KFSDVAKAVSLQNSEM;FSDVAKAVSLQNSEMK;SDVAKAVSL
QNSEMKY;DVAKAVSLQNSEMKYA;VAKAVSLQNSEMKYAI;AKAVSLQNSEMKYAII;KAVS
LQNSEMKYAIID;AVSLQNSEMKYAIIDP;VSLQNSEMKYAIIDPV;SLQNSEMKYAIIDPVY
;LQNSEMKYAIIDPVYS;QNSEMKYAIIDPVYSN;NSEMKYAIIDPVYSNE;SEMKYAIIDPV
YSNEP;EMKYAIIDPVYSNEPI;MKYAIIDPVYSNEPIP;KYAIIDPVYSNEPIPA;YAIIDP
VYSNEPIPAN;AIIDPVYSNEPIPANL;IIDPVYSNEPIPANLV;IDPVYSNEPIPANLVG;D
PVYSNEPIPANLVGM;PVYSNEPIPANLVGMT;VYSNEPIPANLVGMTF;YSNEPIPANLVGM
TFR;SNEPIPANLVGMTFRA;NEPIPANLVGMTFRAQ;EPIPANLVGMTFRAQE;PIPANLVG
MTFRAQEG;IPANLVGMTFRAQEGA;PANLVGMTFRAQEGAF;ANLVGMTFRAQEGAFL;NLV
GMTFRAQEGAFLT;LVGMTFRAQEGAFLTG;VGMTFRAQEGAFLTGY;GMTFRAQEGAFLTGY
I;MTFRAQEGAFLTGYIA;TFRAQEGAFLTGYIAA;FRAQEGAFLTGYIAAK;RAQEGAFLTG
YIAAKV;AQEGAFLTGYIAAKVS;QEGAFLTGYIAAKVSK;EGAFLTGYIAAKVSKT;GAFLT
GYIAAKVSKTG;AFLTGYIAAKVSKTGK;FLTGYIAAKVSKTGKI;LTGYIAAKVSKTGKIG;
TGYIAAKVSKTGKIGF;GYIAAKVSKTGKIGFL;YIAAKVSKTGKIGFLG;IAAKVSKTGKIG
FLGG;AAKVSKTGKIGFLGGI;AKVSKTGKIGFLGGIE;KVSKTGKIGFLGGIEG;VSKTGKI
GFLGGIEGD;SKTGKIGFLGGIEGDI;KTGKIGFLGGIEGDIV;TGKIGFLGGIEGDIVD;GK
IGFLGGIEGDIVDA;KIGFLGGIEGDIVDAF;IGFLGGIEGDIVDAFR;GFLGGIEGDIVDAF
RY;FLGGIEGDIVDAFRYG;LGGIEGDIVDAFRYGY;GGIEGDIVDAFRYGYE;GIEGDIVDA
FRYGYEA;IEGDIVDAFRYGYEAG;EGDIVDAFRYGYEAGA;GDIVDAFRYGYEAGAK;DIVD
AFRYGYEAGAKY;IVDAFRYGYEAGAKYA;VDAFRYGYEAGAKYAN;DAFRYGYEAGAKYANK
;AFRYGYEAGAKYANKD;FRYGYEAGAKYANKDI;RYGYEAGAKYANKDIK;YGYEAGAKYAN
KDIKI;GYEAGAKYANKDIKIF;YEAGAKYANKDIKIFS;EAGAKYANKDIKIFSQ;AGAKYA
NKDIKIFSQY;GAKYANKDIKIFSQYI;AKYANKDIKIFSQYIG;KYANKDIKIFSQYIGS;Y
ANKDIKIFSQYIGSF;ANKDIKIFSQYIGSFS;NKDIKIFSQYIGSFSD;KDIKIFSQYIGSF
SDL;DIKIFSQYIGSFSDLE;IKIFSQYIGSFSDLEA;KIFSQYIGSFSDLEAG;IFSQYIGS
FSDLEAGR;FSQYIGSFSDLEAGRS;SQYIGSFSDLEAGRSV;QYIGSFSDLEAGRSVA;YIG
SFSDLEAGRSVAT;IGSFSDLEAGRSVATK;GSFSDLEAGRSVATKM;SFSDLEAGRSVATKM
Y;FSDLEAGRSVATKMYS;SDLEAGRSVATKMYSD;DLEAGRSVATKMYSDG;LEAGRSVATK
MYSDGI;EAGRSVATKMYSDGID;AGRSVATKMYSDGIDI;GRSVATKMYSDGIDII;RSVAT
KMYSDGIDIIH;SVATKMYSDGIDIIHH;VATKMYSDGIDIIHHA;ATKMYSDGIDIIHHAA;
TKMYSDGIDIIHHAAG;KMYSDGIDIIHHAAGL;MYSDGIDIIHHAAGLG;YSDGIDIIHHAA
GLGG;SDGIDIIHHAAGLGGI;DGIDIIHHAAGLGGIG;GIDIIHHAAGLGGIGA;IDIIHHA
AGLGGIGAI;DIIHHAAGLGGIGAIE;IIHHAAGLGGIGAIEV;IHHAAGLGGIGAIEVA;HH
AAGLGGIGAIEVAK;HAAGLGGIGAIEVAKE;AAGLGGIGAIEVAKEL;AGLGGIGAIEVAKE
LG;GLGGIGAIEVAKELGS;LGGIGAIEVAKELGSG;GGIGAIEVAKELGSGH;GIGAIEVAK
ELGSGHY;IGAIEVAKELGSGHYI;GAIEVAKELGSGHYII;AIEVAKELGSGHYIIG;IEVA
KELGSGHYIIGV;EVAKELGSGHYIIGVD;VAKELGSGHYIIGVDE;AKELGSGHYIIGVDED
;KELGSGHYIIGVDEDQ;ELGSGHYIIGVDEDQS;LGSGHYIIGVDEDQSY;GSGHYIIGVDE
DQSYL;SGHYIIGVDEDQSYLA;GHYIIGVDEDQSYLAP;HYIIGVDEDQSYLAPN;YIIGVD
EDQSYLAPNN;IIGVDEDQSYLAPNNV;IGVDEDQSYLAPNNVI;GVDEDQSYLAPNNVIT;V
DEDQSYLAPNNVITS;DEDQSYLAPNNVITST;EDQSYLAPNNVITSTT;DQSYLAPNNVITS
TTK;QSYLAPNNVITSTTKD;SYLAPNNVITSTTKDV;YLAPNNVITSTTKDVG;LAPNNVIT
STTKDVGR;APNNVITSTTKDVGRS;PNNVITSTTKDVGRSL;NNVITSTTKDVGRSLN;NVI
TSTTKDVGRSLNL;VITSTTKDVGRSLNLL;ITSTTKDVGRSLNLLT;TSTTKDVGRSLNLLT
S;STTKDVGRSLNLLTSN;TTKDVGRSLNLLTSNY;TKDVGRSLNLLTSNYL;KDVGRSLNLL
TSNYLK;DVGRSLNLLTSNYLKT;VGRSLNLLTSNYLKTN;GRSLNLLTSNYLKTNT;RSLNL
LTSNYLKTNTF;SLNLLTSNYLKTNTFE;LNLLTSNYLKTNTFEG;NLLTSNYLKTNTFEGG;
LLTSNYLKTNTFEGGK;LTSNYLKTNTFEGGKL;TSNYLKTNTFEGGKLI;SNYLKTNTFEGG
KLIN;NYLKTNTFEGGKLINY;YLKTNTFEGGKLINYG;LKTNTFEGGKLINYGL;KTNTFEG
GKLINYGLK;TNTFEGGKLINYGLKE;NTFEGGKLINYGLKEG;TFEGGKLINYGLKEGV;FE

Fig. 43 continued

| | |
|---|---|
| GGKLINYGLKEGVV;EGGKLINYGLKEGVVG;GGKLINYGLKEGVVGF;GKLINYGLKEGVVG FV;KLINYGLKEGVVGFVR;LINYGLKEGVVGFVRN;INYGLKEGVVGFVRNP;NYGLKEGVV GFVRNPK;YGLKEGVVGFVRNPKM;GLKEGVVGFVRNPKMI;LKEGVVGFVRNPKMIP;KEGV VGFVRNPKMIPF;EGVVGFVRNPKMIPFE;GVVGFVRNPKMIPFEV;VVGFVRNPKMIPFEVE ;VGFVRNPKMIPFEVEK;GFVRNPKMIPFEVEKE;FVRNPKMIPFEVEKEI;VRNPKMIPFEV EKEID;RNPKMIPFEVEKEIDS;NPKMIPFEVEKEIDSL;PKMIPFEVEKEIDSLS;KMIPFE VEKEIDSLSS;MIPFEVEKEIDSLSSK;IPFEVEKEIDSLSSKI;PFEVEKEIDSLSSKII;F EVEKEIDSLSSKIIN;EVEKEIDSLSSKIINK;VEKEIDSLSSKIINKE;EKEIDSLSSKIIN KEV;KEIDSLSSKIINKEVI;EIDSLSSKIINKEVIV;IDSLSSKIINKEVIVP;DSLSSKII NKEVIVPY;SLSSKIINKEVIVPYN;LSSKIINKEVIVPYNK;SSKIINKEVIVPYNKE;SKI INKEVIVPYNKES;KIINKEVIVPYNKES

NVTTTVDA; VTTTVDAN; TTTVDANT; TTVDANTS; TVDANTSL; VDANTSLA; DANTSLAK; ANTSLAKI; NTSLAKIE; TSLAKIEN; SLAKIENA; LAKIENAI; AKIENAIR; KIENAIRM; IENAIRMI; ENAIRMIS; NAIRMISD; AIRMISDQ; IRMISDQR; RMISDQRA; MISDQRAN; ISDQRANL; SDQRANLG; DQRANLGA; QRANLGAF; RANLGAFQ; ANLGAFQN; NLGAFQNR; LGAFQNRL; GAFQNRLE; AFQNRLES; FQNRLESI; QNRLESIK; NRLESIKN; RLESIKNS; LESIKNST; ESIKNSTE; SIKNSTEY; IKNSTEYA; KNSTEYAI; NSTEYAIE; STEYAIEN; TEYAIENL; EYAIENLK; YAIENLKA; AIENLKAS; IENLKASY; ENLKASYA; NLKASYAQ; LKASYAQI; KASYAQIK; ASYAQIKD; SYAQIKDA; YAQIKDAT; AQIKDATM; QIKDATMT; IKDATMTD; KDATMTDE; DATMTDEV; ATMTDEVV; TMTDEVVA; MTDEVVAA; TDEVVAAT; DEVVAATT; EVVAATTN; VVAATTNS; VAATTNSI; AATTNSIL; ATTNSILT; TTNSILTQ; TNSILTQS; NSILTQSA; SILTQSAM; ILTQSAMA; LTQSAMAM; TQSAMAMI; QSAMAMIA; SAMAMIAQ; AMAMIAQA; MAMIAQAN; AMIAQANQ;MIAQANQV;IAQANQVP;AQANQVPQ;
QANQVPQY;ANQVPQYV;NQVPQYVL;QVPQYVLS;VPQYVLSL;PQYVLSLL;QYVLSLLR;

9 mers:
MIINHNTSA;IINHNTSAI;INHNTSAIN;NHNTSAINA;HNTSAINAS;NTSAINASR;TSA
INASRN;SAINASRNN;AINASRNNG;INASRNNGI;NASRNNGIN;ASRNNGINA;SRNNGI
NAA;RNNGINAAN;NNGINAANL;NGINAANLS;GINAANLSK;INAANLSKT;NAANLSKTQ
;AANLSKTQE;ANLSKTQEK;NLSKTQEKL;LSKTQEKLS;SKTQEKLSS;KTQEKLSSG;TQ
EKLSSGY;QEKLSSGYR;EKLSSGYRI;KLSSGYRIN;LSSGYRINR;SSGYRINRA;SGYRI
NRAS;GYRINRASD;YRINRASDD;RINRASDDA;INRASDDAA;NRASDDAAG;RASDDAAG
M;ASDDAAGMG;SDDAAGMGV;DDAAGMGVS;DAAGMGVSG;AAGMGVSGK;AGMGVSGKI;G
MGVSGKIN;MGVSGKINA;GVSGKINAQ;VSGKINAQI;SGKINAQIR;GKINAQIRG;KINA
QIRGL;INAQIRGLS;NAQIRGLSQ;AQIRGLSQA;QIRGLSQAS;IRGLSQASR;RGLSQAS
RN;GLSQASRNT;LSQASRNTS;SQASRNTSK;QASRNTSKA;ASRNTSKAI;SRNTSKAIN;
RNTSKAINF;NTSKAINFI;TSKAINFIQ;SKAINFIQT;KAINFIQTT;AINFIQTTE;INF
IQTTEG;NFIQTTEGN;FIQTTEGNL;IQTTEGNLN;QTTEGNLNE;TTEGNLNEV;TEGNLN
EVE;EGNLNEVEK;GNLNEVEKV;NLNEVEKVL;LNEVEKVLV;NEVEKVLVR;EVEKVLVRM
;VEKVLVRMK;EKVLVRMKE;KVLVRMKEL;VLVRMKELA;LVRMKELAV;VRMKELAVQ;RM
KELAVQS;MKELAVQSG;KELAVQSGN;ELAVQSGNG;LAVQSGNGT;AVQSGNGTY;VQSGN
GTYS;QSGNGTYSD;SGNGTYSDA;GNGTYSDAD;NGTYSDADR;GTYSDADRG;TYSDADRG
S;YSDADRGSI;SDADRGSIQ;DADRGSIQI;ADRGSIQIE;DRGSIQIEI;RGSIQIEIE;G
SIQIEIEQ;SIQIEIEQL;IQIEIEQLT;QIEIEQLTD;IEIEQLTDE;EIEQLTDEI;IEQL
TDEIN;EQLTDEINR;QLTDEINRI;LTDEINRIA;TDEINRIAD;DEINRIADQ;EINRIAD
QA;INRIADQAQ;NRIADQAQY;RIADQAQYN;IADQAQYNQ;ADQAQYNQM;DQAQYNQMH;
QAQYNQMHM;AQYNQMHML;QYNQMHMLS;YNQMHMLSN;NQMHMLSNK;QMHMLSNKS;MHM
LSNKSA;HMLSNKSAS;MLSNKSASQ;LSNKSASQN;SNKSASQNV;NKSASQNVR;KSASQN
VRT;SASQNVRTA;ASQNVRTAE;SQNVRTAEE;QNVRTAEEL;NVRTAEELG;VRTAEELGM
;RTAEELGMQ;TAEELGMQP;AEELGMQPA;EELGMQPAK;ELGMQPAKI;LGMQPAKIN;GM
QPAKINT;MQPAKINTP;QPAKINTPA;PAKINTPAS;AKINTPASL;KINTPASLS;INTPA
SLSG;NTPASLSGS;TPASLSGSQ;PASLSGSQA;ASLSGSQAS;SLSGSQASW;LSGSQASW
T;SGSQASWTL;GSQASWTLR;SQASWTLRV;QASWTLRVH;ASWTLRVHV;SWTLRVHVG;W
TLRVHVGA;TLRVHVGAN;LRVHVGANQ;RVHVGANQD;VHVGANQDE;HVGANQDEA;VGAN
QDEAI;GANQDEAIA;ANQDEAIAV;NQDEAIAVN;QDEAIAVNI;DEAIAVNIY;EAIAVNI
YA;AIAVNIYAA;IAVNIYAAN;AVNIYAANV;VNIYAANVA;NIYAANVAN;IYAANVANL;
YAANVANLF;AANVANLFS;ANVANLFSG;NVANLFSGE;VANLFSGEG;ANLFSGEGA;NLF
SGEGAQ;LFSGEGAQT;FSGEGAQTA;SGEGAQTAQ;GEGAQTAQA;EGAQTAQAA;GAQTAQ
AAP;AQTAQAAPV;QTAQAAPVQ;TAQAAPVQE;AQAAPVQEG;QAAPVQEGV;AAPVQEGVQ
;APVQEGVQQ;PVQEGVQQE;VQEGVQQEG;QEGVQQEGA;EGVQQEGAQ;GVQQEGAQQ;VQ
QEGAQQP;QQEGAQQPA;QEGAQQPAP;EGAQQPAPA;GAQQPAPAT;AQQPAPATA;QQPAP
ATAP;QPAPATAPS;PAPATAPSQ;APATAPSQG;PATAPSQGG;ATAPSQGGV;TAPSQGGV
N;APSQGGVNS;PSQGGVNSP;SQGGVNSPV;QGGVNSPVN;GGVNSPVNV;GVNSPVNVT;V
NSPVNVTT;NSPVNVTTT;SPVNVTTTV;PVNVTTTVD;VNVTTTVDA;NVTTTVDAN;VTTT
VDANT;TTTVDANTS;TTVDANTSL;TVDANTSLA;VDANTSLAK;DANTSLAKI;ANTSLAK
IE;NTSLAKIEN;TSLAKIENA;SLAKIENAI;LAKIENAIR;AKIENAIRM;KIENAIRMI;
IENAIRMIS;ENAIRMISD;NAIRMISDQ;AIRMISDQR;IRMISDQRA;RMISDQRAN;MIS
DQRANL;ISDQRANLG;SDQRANLGA;DQRANLGAF;QRANLGAFQ;RANLGAFQN;ANLGAF

Fig. 43 continued

QNR;NLGAFQNRL;LGAFQNRLE;GAFQNRLES;AFQNRLESI;FQNRLESIK;QNRLESIKN
;NRLESIKNS;RLESIKNST;LESIKNSTE;ESIKNSTEY;SIKNSTEYA;IKNSTEYAI;KN
STEYAIE;NSTEYAIEN;STEYAIENL;TEYAIENLK;EYAIENLKA;YAIENLKAS;AIENL
KASY;IENLKASYA;ENLKASYAQ;NLKASYAQI;LKASYAQIK;KASYAQIKD;ASYAQIKD
A;SYAQIKDAT;YAQIKDATM;AQIKDATMT;QIKDATMTD;IKDATMTDE;KDATMTDEV;D
ATMTDEVV;ATMTDEVVA;TMTDEVVAA;MTDEVVAAT;TDEVVAATT;DEVVAATTN;EVVA
ATTNS;VVAATTNSI;VAATTNSIL;AATTNSILT;ATTNSILTQ;TTNSILTQS;TNSILTQ
SA;NSILTQSAM;SILTQSAMA;ILTQSAMAM;LTQSAMAMI;TQSAMAMIA;QSAMAMIAQ;
SAMAMIAQA;AMAMIAQAN;MAMIAQANQ;AMIAQANQV;MIAQANQVP;IAQANQVPQ;AQA
NQVPQY;QANQVPQYV;ANQVPQYVL;NQVPQYVLS;QVPQYVLSL;VPQYVLSLL;PQYVLS
LLR;

10 mers:
MIINHNTSAI;IINHNTSAIN;INHNTSAINA;NHNTSAINAS;HNTSAINASR;NTSAINAS
RN;TSAINASRNN;SAINASRNNG;AINASRNNGI;INASRNNGIN;NASRNNGINA;ASRNN
GINAA;SRNNGINAAN;RNNGINAANL;NNGINAANLS;NGINAANLSK;GINAANLSKT;IN
AANLSKTQ;NAANLSKTQE;AANLSKTQEK;ANLSKTQEKL;NLSKTQEKLS;LSKTQEKLSS
;SKTQEKLSSG;KTQEKLSSGY;TQEKLSSGYR;QEKLSSGYRI;EKLSSGYRIN;KLSSGYR
INR;LSSGYRINRA;SSGYRINRAS;SGYRINRASD;GYRINRASDD;YRINRASDDA;RINR
ASDDAA;INRASDDAAG;NRASDDAAGM;RASDDAAGMG;ASDDAAGMGV;SDDAAGMGVS;D
DAAGMGVSG;DAAGMGVSGK;AAGMGVSGKI;AGMGVSGKIN;GMGVSGKINA;MGVSGKINA
Q;GVSGKINAQI;VSGKINAQIR;SGKINAQIRG;GKINAQIRGL;KINAQIRGLS;INAQIR
GLSQ;NAQIRGLSQA;AQIRGLSQAS;QIRGLSQASR;IRGLSQASRN;RGLSQASRNT;GLS
QASRNTS;LSQASRNTSK;SQASRNTSKA;QASRNTSKAI;ASRNTSKAIN;SRNTSKAINF;
RNTSKAINFI;NTSKAINFIQ;TSKAINFIQT;SKAINFIQTT;KAINFIQTTE;AINFIQTT
EG;INFIQTTEGN;NFIQTTEGNL;FIQTTEGNLN;IQTTEGNLNE;QTTEGNLNEV;TTEGN
LNEVE;TEGNLNEVEK;EGNLNEVEKV;GNLNEVEKVL;NLNEVEKVLV;LNEVEKVLVR;NE
VEKVLVRM;EVEKVLVRMK;VEKVLVRMKE;EKVLVRMKEL;KVLVRMKELA;VLVRMKELAV
;LVRMKELAVQ;VRMKELAVQS;RMKELAVQSG;MKELAVQSGN;KELAVQSGNG;ELAVQSG
NGT;LAVQSGNGTY;AVQSGNGTYS;VQSGNGTYSD;QSGNGTYSDA;SGNGTYSDAD;GNGT
YSDADR;NGTYSDADRG;GTYSDADRGS;TYSDADRGSI;YSDADRGSIQ;SDADRGSIQI;D
ADRGSIQIE;ADRGSIQIEI;DRGSIQIEIE;RGSIQIEIEQ;GSIQIEIEQL;SIQIEIEQL
T;IQIEIEQLTD;QIEIEQLTDE;IEIEQLTDEI;EIEQLTDEIN;IEQLTDEINR;EQLTDE
INRI;QLTDEINRIA;LTDEINRIAD;TDEINRIADQ;DEINRIADQA;EINRIADQAQ;INR
IADQAQY;NRIADQAQYN;RIADQAQYNQ;IADQAQYNQM;ADQAQYNQMH;DQAQYNQMHM;
QAQYNQMHML;AQYNQMHMLS;QYNQMHMLSN;YNQMHMLSNK;NQMHMLSNKS;QMHMLSNK
SA;MHMLSNKSAS;HMLSNKSASQ;MLSNKSASQN;LSNKSASQNV;SNKSASQNVR;NKSAS
QNVRT;KSASQNVRTA;SASQNVRTAE;ASQNVRTAEE;SQNVRTAEEL;QNVRTAEELG;NV
RTAEELGM;VRTAEELGMQ;RTAEELGMQP;TAEELGMQPA;AEELGMQPAK;EELGMQPAKI
;ELGMQPAKIN;LGMQPAKINT;GMQPAKINTP;MQPAKINTPA;QPAKINTPAS;PAKINTP
ASL;AKINTPASLS;KINTPASLSG;INTPASLSGS;NTPASLSGSQ;TPASLSGSQA;PASL
SGSQAS;ASLSGSQASW;SLSGSQASWT;LSGSQASWTL;SGSQASWTLR;GSQASWTLRV;S
QASWTLRVH;QASWTLRVHV;ASWTLRVHVG;SWTLRVHVGA;WTLRVHVGAN;TLRVHVGAN
Q;LRVHVGANQD;RVHVGANQDE;VHVGANQDEA;HVGANQDEAI;VGANQDEAIA;GANQDE
AIAV;ANQDEAIAVN;NQDEAIAVNI;QDEAIAVNIY;DEAIAVNIYA;EAIAVNIYAA;AIA
VNIYAAN;IAVNIYAANV;AVNIYAANVA;VNIYAANVAN;NIYAANVANL;IYAANVANLF;
YAANVANLFS;AANVANLFSG;ANVANLFSGE;NVANLFSGEG;VANLFSGEGA;ANLFSGEG
AQ;NLFSGEGAQT;LFSGEGAQTA;FSGEGAQTAQ;SGEGAQTAQA;GEGAQTAQAA;EGAQT
AQAAP;GAQTAQAAPV;AQTAQAAPVQ;QTAQAAPVQE;TAQAAPVQEG;AQAAPVQEGV;QA
APVQEGVQ;AAPVQEGVQQ;APVQEGVQQE;PVQEGVQQEG;VQEGVQQEGA;QEGVQQEGAQ
;EGVQQEGAQQ;GVQQEGAQQP;VQQEGAQQPA;QQEGAQQPAP;QEGAQQPAPA;EGAQQPA
PAT;GAQQPAPATA;AQQPAPATAP;QQPAPATAPS;QPAPATAPSQ;PAPATAPSQG;APAT
APSQGG;PATAPSQGGV;ATAPSQGGVN;TAPSQGGVNS;APSQGGVNSP;PSQGGVNSPV;S
QGGVNSPVN;QGGVNSPVNV;GGVNSPVNVT;GVNSPVNVTT;VNSPVNVTTT;NSPVNVTTT
V;SPVNVTTTVD;PVNVTTTVDA;VNVTTTVDAN;NVTTTVDANT;VTTTVDANTS;TTTVDA
NTSL;TTVDANTSLA;TVDANTSLAK;VDANTSLAKI;DANTSLAKIE;ANTSLAKIEN;NTS
LAKIENA;TSLAKIENAI;SLAKIENAIR;LAKIENAIRM;AKIENAIRMI;KIENAIRMIS;

Fig. 43 continued

IENAIRMISD;ENAIRMISDQ;NAIRMISDQR;AIRMISDQRA;IRMISDQRAN;RMISDQRA
NL;MISDQRANLG;ISDQRANLGA;SDQRANLGAF;DQRANLGAFQ;QRANLGAFQN;RANLG
AFQNR;ANLGAFQNRL;NLGAFQNRLE;LGAFQNRLES;GAFQNRLESI;AFQNRLESIK;FQ
NRLESIKN;QNRLESIKNS;NRLESIKNST;RLESIKNSTE;LESIKNSTEY;ESIKNSTEYA
;SIKNSTEYAI;IKNSTEYAIE;KNSTEYAIEN;NSTEYAIENL;STEYAIENLK;TEYAIEN
LKA;EYAIENLKAS;YAIENLKASY;AIENLKASYA;IENLKASYAQ;ENLKASYAQI;NLKA
SYAQIK;LKASYAQIKD;KASYAQIKDA;ASYAQIKDAT;SYAQIKDATM;YAQIKDATMT;A
QIKDATMTD;QIKDATMTDE;IKDATMTDEV;KDATMTDEVV;DATMTDEVVA;ATMTDEVVA
A;TMTDEVVAAT;MTDEVVAATT;TDEVVAATTN;DEVVAATTNS;EVVAATTNSI;VVAATT
NSIL;VAATTNSILT;AATTNSILTQ;ATTNSILTQS;TTNSILTQSA;TNSILTQSAM;NSI
LTQSAMA;SILTQSAMAM;ILTQSAMAMI;LTQSAMAMIA;TQSAMAMIAQ;QSAMAMIAQA;
SAMAMIAQAN;AMAMIAQANQ;MAMIAQANQV;AMIAQANQVP;MIAQANQVPQ;IAQANQVP
QY;AQANQVPQYV;QANQVPQYVL;ANQVPQYVLS;NQVPQYVLSL;QVPQYVLSLL;VPQYV
LSLLR;

11 mers:
MIINHNTSAIN;IINHNTSAINA;INHNTSAINAS;NHNTSAINASR;HNTSAINASRN;NTS
AINASRNN;TSAINASRNNG;SAINASRNNGI;AINASRNNGIN;INASRNNGINA;NASRNN
GINAA;ASRNNGINAAN;SRNNGINAANL;RNNGINAANLS;NNGINAANLSK;NGINAANLS
KT;GINAANLSKTQ;INAANLSKTQE;NAANLSKTQEK;AANLSKTQEKL;ANLSKTQEKLS;
NLSKTQEKLSS;LSKTQEKLSSG;SKTQEKLSSGY;KTQEKLSSGYR;TQEKLSSGYRI;QEK
LSSGYRIN;EKLSSGYRINR;KLSSGYRINRA;LSSGYRINRAS;SSGYRINRASD;SGYRIN
RASDD;GYRINRASDDA;YRINRASDDAA;RINRASDDAAG;INRASDDAAGM;NRASDDAAG
MG;RASDDAAGMGV;ASDDAAGMGVS;SDDAAGMGVSG;DDAAGMGVSGK;DAAGMGVSGKI;
AAGMGVSGKIN;AGMGVSGKINA;GMGVSGKINAQ;MGVSGKINAQI;GVSGKINAQIR;VSG
KINAQIRG;SGKINAQIRGL;GKINAQIRGLS;KINAQIRGLSQ;INAQIRGLSQA;NAQIRG
LSQAS;AQIRGLSQASR;QIRGLSQASRN;IRGLSQASRNT;RGLSQASRNTS;GLSQASRNT
SK;LSQASRNTSKA;SQASRNTSKAI;QASRNTSKAIN;ASRNTSKAINF;SRNTSKAINFI;
RNTSKAINFIQ;NTSKAINFIQT;TSKAINFIQTT;SKAINFIQTTE;KAINFIQTTEG;AIN
FIQTTEGN;INFIQTTEGNL;NFIQTTEGNLN;FIQTTEGNLNE;IQTTEGNLNEV;QTTEGN
LNEVE;TTEGNLNEVEK;TEGNLNEVEKV;EGNLNEVEKVL;GNLNEVEKVLV;NLNEVEKVL
VR;LNEVEKVLVRM;NEVEKVLVRMK;EVEKVLVRMKE;VEKVLVRMKEL;EKVLVRMKELA;
KVLVRMKELAV;VLVRMKELAVQ;LVRMKELAVQS;VRMKELAVQSG;RMKELAVQSGN;MKE
LAVQSGNG;KELAVQSGNGT;ELAVQSGNGTY;LAVQSGNGTYS;AVQSGNGTYSD;VQSGNG
TYSDA;QSGNGTYSDAD;SGNGTYSDADR;GNGTYSDADRG;NGTYSDADRGS;GTYSDADRG
SI;TYSDADRGSIQ;YSDADRGSIQI;SDADRGSIQIE;DADRGSIQIEI;ADRGSIQIEIE;
DRGSIQIEIEQ;RGSIQIEIEQL;GSIQIEIEQLT;SIQIEIEQLTD;IQIEIEQLTDE;QIE
IEQLTDEI;IEIEQLTDEIN;EIEQLTDEINR;IEQLTDEINRI;EQLTDEINRIA;QLTDEI
NRIAD;LTDEINRIADQ;TDEINRIADQA;DEINRIADQAQ;EINRIADQAQY;INRIADQAQ
YN;NRIADQAQYNQ;RIADQAQYNQM;IADQAQYNQMH;ADQAQYNQMHM;DQAQYNQMHML;
QAQYNQMHMLS;AQYNQMHMLSN;QYNQMHMLSNK;YNQMHMLSNKS;NQMHMLSNKSA;QMH
MLSNKSAS;MHMLSNKSASQ;HMLSNKSASQN;MLSNKSASQNV;LSNKSASQNVR;SNKSAS
QNVRT;NKSASQNVRTA;KSASQNVRTAE;SASQNVRTAEE;ASQNVRTAEEL;SQNVRTAEE
LG;QNVRTAEELGM;NVRTAEELGMQ;VRTAEELGMQP;RTAEELGMQPA;TAEELGMQPAK;
AEELGMQPAKI;EELGMQPAKIN;ELGMQPAKINT;LGMQPAKINTP;GMQPAKINTPA;MQP
AKINTPAS;QPAKINTPASL;PAKINTPASLS;AKINTPASLSG;KINTPASLSGS;INTPAS
LSGSQ;NTPASLSGSQA;TPASLSGSQAS;PASLSGSQASW;ASLSGSQASWT;SLSGSQASW
TL;LSGSQASWTLR;SGSQASWTLRV;GSQASWTLRVH;SQASWTLRVHV;QASWTLRVHVG;
ASWTLRVHVGA;SWTLRVHVGAN;WTLRVHVGANQ;TLRVHVGANQD;LRVHVGANQDE;RVH
VGANQDEA;VHVGANQDEAI;HVGANQDEAIA;VGANQDEAIAV;GANQDEAIAVN;ANQDEA
IAVNI;NQDEAIAVNIY;QDEAIAVNIYA;DEAIAVNIYAA;EAIAVNIYAAN;AIAVNIYAA
NV;IAVNIYAANVA;AVNIYAANVAN;VNIYAANVANL;NIYAANVANLF;IYAANVANLFS;
YAANVANLFSG;AANVANLFSGE;ANVANLFSGEG;NVANLFSGEGA;VANLFSGEGAQ;ANL
FSGEGAQT;NLFSGEGAQTA;LFSGEGAQTAQ;FSGEGAQTAQA;SGEGAQTAQAA;GEGAQT
AQAAP;EGAQTAQAAPV;GAQTAQAAPVQ;AQTAQAAPVQE;QTAQAAPVQEG;TAQAAPVQE
GV;AQAAPVQEGVQ;QAAPVQEGVQQ;AAPVQEGVQQE;APVQEGVQQEG;PVQEGVQQEGA;
VQEGVQQEGAQ;QEGVQQEGAQQ;EGVQQEGAQQP;GVQQEGAQQPA;VQQEGAQQPAP;QQE

Fig. 43 continued

GAQQPAPA; QEGAQQPAPAT; EGAQQPAPATA; GAQQPAPATAP; AQQPAPATAPS; QQPAPA
TAPSQ; QPAPATAPSQG; PAPATAPSQGG; APATAPSQGGV; PATAPSQGGVN; ATAPSQGGV
NS; TAPSQGGVNSP; APSQGGVNSPV; PSQGGVNSPVN; SQGGVNSPVNV; QGGVNSPVNVT;
GGVNSPVNVTT; GVNSPVNVTTT; VNSPVNVTTTV; NSPVNVTTTVD; SPVNVTTTVDA; PVN
VTTTVDAN; VNVTTTVDANT; NVTTTVDANTS; VTTTVDANTSL; TTTVDANTSLA; TTVDAN
TSLAK; TVDANTSLAKI; VDANTSLAKIE; DANTSLAKIEN; ANTSLAKIENA; NTSLAKIEN
AI; TSLAKIENAIR; SLAKIENAIRM; LAKIENAIRMI; AKIENAIRMIS; KIENAIRMISD;
IENAIRMISDQ; ENAIRMISDQR; NAIRMISDQRA; AIRMISDQRAN; IRMISDQRANL; RMI
SDQRANLG; MISDQRANLGA; ISDQRANLGAF; SDQRANLGAFQ; DQRANLGAFQN; QRANLG
AFQNR;RANLGAFQNRL;ANLGAFQNRLE;NLGAFQNRLES;LGAFQNRLESI;GAFQNRLES
IK;AFQNRLESIKN;FQNRLESIKNS;QNRLESIKNST;NRLESIKNSTE;RLESIKNSTEY;
LESIKNSTEYA;ESIKNSTEYAI;SIKNSTEYAIE;IKNSTEYAIEN;KNSTEYAIENL;NST
EYAIENLK;STEYAIENLKA;TEYAIENLKAS;EYAIENLKASY;YAIENLKASYA;AIENLK
ASYAQ;IENLKASYAQI;ENLKASYAQIK;NLKASYAQIKD;LKASYAQIKDA;KASYAQIKD
AT;ASYAQIKDATM;SYAQIKDATMT;YAQIKDATMTD;AQIKDATMTDE;QIKDATMTDEV;
IKDATMTDEVV;KDATMTDEVVA;DATMTDEVVAA;ATMTDEVVAAT;TMTDEVVAATT;MTD
EVVAATTN;TDEVVAATTNS;DEVVAATTNSI;EVVAATTNSIL;VVAATTNSILT;VAATTN
SILTQ;AATTNSILTQS;ATTNSILTQSA;TTNSILTQSAM;TNSILTQSAMA;NSILTQSAM
AM;SILTQSAMAMI;ILTQSAMAMIA;LTQSAMAMIAQ;TQSAMAMIAQA;QSAMAMIAQAN;
SAMAMIAQANQ;AMAMIAQANQV;MAMIAQANQVP;AMIAQANQVPQ;MIAQANQVPQY;IAQ
ANQVPQYV;AQANQVPQYVL;QANQVPQYVLS;ANQVPQYVLSL;NQVPQYVLSLL;QVPQYV
LSLLR;
13 mers:
MIINHNTSAINAS;IINHNTSAINASR;INHNTSAINASRN;NHNTSAINASRNN;HNTSAIN
ASRNNG;NTSAINASRNNGI;TSAINASRNNGIN;SAINASRNNGINA;AINASRNNGINAA;
INASRNNGINAAN;NASRNNGINAANL;ASRNNGINAANLS;SRNNGINAANLSK;RNNGINA
ANLSKT;NNGINAANLSKTQ;NGINAANLSKTQE;GINAANLSKTQEK;INAANLSKTQEKL;
NAANLSKTQEKLS;AANLSKTQEKLSS;ANLSKTQEKLSSG;NLSKTQEKLSSGY;LSKTQEK
LSSGYR;SKTQEKLSSGYRI;KTQEKLSSGYRIN;TQEKLSSGYRINR;QEKLSSGYRINRA;
EKLSSGYRINRAS;KLSSGYRINRASD;LSSGYRINRASDD;SSGYRINRASDDA;SGYRINR
ASDDAA;GYRINRASDDAAG;YRINRASDDAAGM;RINRASDDAAGMG;INRASDDAAGMGV;
NRASDDAAGMGVS;RASDDAAGMGVSG;ASDDAAGMGVSGK;SDDAAGMGVSGKI;DDAAGMG
VSGKIN;DAAGMGVSGKINA;AAGMGVSGKINAQ;AGMGVSGKINAQI;GMGVSGKINAQIR;
MGVSGKINAQIRG;GVSGKINAQIRGL;VSGKINAQIRGLS;SGKINAQIRGLSQ;GKINAQI
RGLSQA;KINAQIRGLSQAS;INAQIRGLSQASR;NAQIRGLSQASRN;AQIRGLSQASRNT;
QIRGLSQASRNTS;IRGLSQASRNTSK;RGLSQASRNTSKA;GLSQASRNTSKAI;LSQASRN
TSKAIN;SQASRNTSKAINF;QASRNTSKAINFI;ASRNTSKAINFIQ;SRNTSKAINFIQT;
RNTSKAINFIQTT;NTSKAINFIQTTE;TSKAINFIQTTEG;SKAINFIQTTEGN;KAINFIQ
TTEGNL;AINFIQTTEGNLN;INFIQTTEGNLNE;NFIQTTEGNLNEV;FIQTTEGNLNEVE;
IQTTEGNLNEVEK;QTTEGNLNEVEKV;TTEGNLNEVEKVL;TEGNLNEVEKVLV;EGNLNEV
EKVLVR;GNLNEVEKVLVRM;NLNEVEKVLVRMK;LNEVEKVLVRMKE;NEVEKVLVRMKEL;
EVEKVLVRMKELA;VEKVLVRMKELAV;EKVLVRMKELAVQ;KVLVRMKELAVQS;VLVRMKE
LAVQSG;LVRMKELAVQSGN;VRMKELAVQSGNG;RMKELAVQSGNGT;MKELAVQSGNGTY;
KELAVQSGNGTYS;ELAVQSGNGTYSD;LAVQSGNGTYSDA;AVQSGNGTYSDAD;VQSGNGT
YSDADR;QSGNGTYSDADRG;SGNGTYSDADRGS;GNGTYSDADRGSI;NGTYSDADRGSIQ;
GTYSDADRGSIQI;TYSDADRGSIQIE;YSDADRGSIQIEI;SDADRGSIQIEIE;DADRGSI
QIEIEQ;ADRGSIQIEIEQL;DRGSIQIEIEQLT;RGSIQIEIEQLTD;GSIQIEIEQLTDE;
SIQIEIEQLTDEI;IQIEIEQLTDEIN;QIEIEQLTDEINR;IEIEQLTDEINRI;EIEQLTD
EINRIA;IEQLTDEINRIAD;EQLTDEINRIADQ;QLTDEINRIADQA;LTDEINRIADQAQ;
TDEINRIADQAQY;DEINRIADQAQYN;EINRIADQAQYNQ;INRIADQAQYNQM;NRIADQA
QYNQMH;RIADQAQYNQMHM;IADQAQYNQMHML;ADQAQYNQMHMLS;DQAQYNQMHMLSN;
QAQYNQMHMLSNK;AQYNQMHMLSNKS;QYNQMHMLSNKSA;YNQMHMLSNKSAS;NQMHMLS
NKSASQ;QMHMLSNKSASQN;MHMLSNKSASQNV;HMLSNKSASQNVR;MLSNKSASQNVRT;
LSNKSASQNVRTA;SNKSASQNVRTAE;NKSASQNVRTAEE;KSASQNVRTAEEL;SASQNVR
TAEELG;ASQNVRTAEELGM;SQNVRTAEELGMQ;QNVRTAEELGMQP;NVRTAEELGMQPA;
VRTAEELGMQPAK;RTAEELGMQPAKI;TAEELGMQPAKIN;AEELGMQPAKINT;EELGMQP
AKINTP;ELGMQPAKINTPA;LGMQPAKINTPAS;GMQPAKINTPASL;MQPAKINTPASLS;

Fig. 43 continued

QPAKINTPASLSG; PAKINTPASLSGS; AKINTPASLSGSQ; KINTPASLSGSQA; INTPASL
SGSQAS; NTPASLSGSQASW; TPASLSGSQASWT; PASLSGSQASWTL; ASLSGSQASWTLR;
SLSGSQASWTLRV; LSGSQASWTLRVH; SGSQASWTLRVHV; GSQASWTLRVHVG; SQASWTL
RVHVGA; QASWTLRVHVGAN; ASWTLRVHVGANQ; SWTLRVHVGANQD; WTLRVHVGANQDE;
TLRVHVGANQDEA; LRVHVGANQDEAI; RVHVGANQDEAIA; VHVGANQDEAIAV; HVGANQD
EAIAVN; VGANQDEAIAVNI; GANQDEAIAVNIY; ANQDEAIAVNIYA; NQDEAIAVNIYAA;
QDEAIAVNIYAAN; DEAIAVNIYAANV; EAIAVNIYAANVA; AIAVNIYAANVAN; IAVNIYA
ANVANL; AVNIYAANVANLF; VNIYAANVANLFS; NIYAANVANLFSG; IYAANVANLFSGE;
YAANVANLFSGEG; AANVANLFSGEGA; ANVANLFSGEGAQ; NVANLFSGEGAQT; VANLFSG
EGAQTA; ANLFSGEGAQTAQ; NLFSGEGAQTAQA; LFSGEGAQTAQAA;FSGEGAQTAQAAP;
SGEGAQTAQAAPV;GEGAQTAQAAPVQ;EGAQTAQAAPVQE;GAQTAQAAPVQEG;AQTAQAA
PVQEGV;QTAQAAPVQEGVQ;TAQAAPVQEGVQQ;AQAAPVQEGVQQE;QAAPVQEGVQQEG;
AAPVQEGVQQEGA;APVQEGVQQEGAQ;PVQEGVQQEGAQQ;VQEGVQQEGAQQP;QEGVQQE
GAQQPA;EGVQQEGAQQPAP;GVQQEGAQQPAPA;VQQEGAQQPAPAT;QQEGAQQPAPATA;
QEGAQQPAPATAP;EGAQQPAPATAPS;GAQQPAPATAPSQ;AQQPAPATAPSQG;QQPAPAT
APSQGG;QPAPATAPSQGGV;PAPATAPSQGGVN;APATAPSQGGVNS;PATAPSQGGVNSP;
ATAPSQGGVNSPV;TAPSQGGVNSPVN;APSQGGVNSPVNV;PSQGGVNSPVNVT;SQGGVNS
PVNVTT;QGGVNSPVNVTTT;GGVNSPVNVTTTV;GVNSPVNVTTTVD;VNSPVNVTTTVDA;
NSPVNVTTTVDAN;SPVNVTTTVDANT;PVNVTTTVDANTS;VNVTTTVDANTSL;NVTTTVD
ANTSLA;VTTTVDANTSLAK;TTTVDANTSLAKI;TTVDANTSLAKIE;TVDANTSLAKIEN;
VDANTSLAKIENA;DANTSLAKIENAI;ANTSLAKIENAIR;NTSLAKIENAIRM;TSLAKIE
NAIRMI;SLAKIENAIRMIS;LAKIENAIRMISD;AKIENAIRMISDQ;KIENAIRMISDQR;
IENAIRMISDQRA;ENAIRMISDQRAN;NAIRMISDQRANL;AIRMISDQRANLG;IRMISDQ
RANLGA;RMISDQRANLGAF;MISDQRANLGAFQ;ISDQRANLGAFQN;SDQRANLGAFQNR;
DQRANLGAFQNRL;QRANLGAFQNRLE;RANLGAFQNRLES;ANLGAFQNRLESI;NLGAFQN
RLESIK;LGAFQNRLESIKN;GAFQNRLESIKNS;AFQNRLESIKNST;FQNRLESIKNSTE;
QNRLESIKNSTEY;NRLESIKNSTEYA;RLESIKNSTEYAI;LESIKNSTEYAIE;ESIKNST
EYAIEN;SIKNSTEYAIENL;IKNSTEYAIENLK;KNSTEYAIENLKA;NSTEYAIENLKAS;
STEYAIENLKASY;TEYAIENLKASYA;EYAIENLKASYAQ;YAIENLKASYAQI;AIENLKA
SYAQIK;IENLKASYAQIKD;ENLKASYAQIKDA;NLKASYAQIKDAT;LKASYAQIKDATM;
KASYAQIKDATMT;ASYAQIKDATMTD;SYAQIKDATMTDE;YAQIKDATMTDEV;AQIKDAT
MTDEVV;QIKDATMTDEVVA;IKDATMTDEVVAA;KDATMTDEVVAAT;DATMTDEVVAATT;
ATMTDEVVAATTN;TMTDEVVAATTNS;MTDEVVAATTNSI;TDEVVAATTNSIL;DEVVAAT
TNSILT;EVVAATTNSILTQ;VVAATTNSILTQS;VAATTNSILTQSA;AATTNSILTQSAM;
ATTNSILTQSAMA;TTNSILTQSAMAM;TNSILTQSAMAMI;NSILTQSAMAMIA;SILTQSA
MAMIAQ;ILTQSAMAMIAQA;LTQSAMAMIAQAN;TQSAMAMIAQANQ;QSAMAMIAQANQV;
SAMAMIAQANQVP;AMAMIAQANQVPQ;MAMIAQANQVPQY;AMIAQANQVPQYV;MIAQANQ
VPQYVL;IAQANQVPQYVLS;AQANQVPQYVLSL;QANQVPQYVLSLL;ANQVPQYVLSLLR;

14 mers:
MIINHNTSAINASR;IINHNTSAINASRN;INHNTSAINASRNN;NHNTSAINASRNNG;HNT
SAINASRNNGI;NTSAINASRNNGIN;TSAINASRNNGINA;SAINASRNNGINAA;AINASR
NNGINAAN;INASRNNGINAANL;NASRNNGINAANLS;ASRNNGINAANLSK;SRNNGINAA
NLSKT;RNNGINAANLSKTQ;NNGINAANLSKTQE;NGINAANLSKTQEK;GINAANLSKTQE
KL;INAANLSKTQEKLS;NAANLSKTQEKLSS;AANLSKTQEKLSSG;ANLSKTQEKLSSGY;
NLSKTQEKLSSGYR;LSKTQEKLSSGYRI;SKTQEKLSSGYRIN;KTQEKLSSGYRINR;TQE
KLSSGYRINRA;QEKLSSGYRINRAS;EKLSSGYRINRASD;KLSSGYRINRASDD;LSSGYR
INRASDDA;SSGYRINRASDDAA;SGYRINRASDDAAG;GYRINRASDDAAGM;YRINRASDD
AAGMG;RINRASDDAAGMGV;INRASDDAAGMGVS;NRASDDAAGMGVSG;RASDDAAGMGVS
GK;ASDDAAGMGVSGKI;SDDAAGMGVSGKIN;DDAAGMGVSGKINA;DAAGMGVSGKINAQ;
AAGMGVSGKINAQI;AGMGVSGKINAQIR;GMGVSGKINAQIRG;MGVSGKINAQIRGL;GVS
GKINAQIRGLS;VSGKINAQIRGLSQ;SGKINAQIRGLSQA;GKINAQIRGLSQAS;KINAQI
RGLSQASR;INAQIRGLSQASRN;NAQIRGLSQASRNT;AQIRGLSQASRNTS;QIRGLSQAS
RNTSK;IRGLSQASRNTSKA;RGLSQASRNTSKAI;GLSQASRNTSKAIN;LSQASRNTSKAI
NF;SQASRNTSKAINFI;QASRNTSKAINFIQ;ASRNTSKAINFIQT;SRNTSKAINFIQTT;
RNTSKAINFIQTTE;NTSKAINFIQTTEG;TSKAINFIQTTEGN;SKAINFIQTTEGNL;KAI
NFIQTTEGNLN;AINFIQTTEGNLNE;INFIQTTEGNLNEV;NFIQTTEGNLNEVE;FIQTTE

Fig. 43 continued

GNLNEVEK; IQTTEGNLNEVEKV; QTTEGNLNEVEKVL; TTEGNLNEVEKVLV; TEGNLNEVE
KVLVR; EGNLNEVEKVLVRM; GNLNEVEKVLVRMK; NLNEVEKVLVRMKE; LNEVEKVLVRMK
EL; NEVEKVLVRMKELA; EVEKVLVRMKELAV; VEKVLVRMKELAVQ; EKVLVRMKELAVQS;
KVLVRMKELAVQSG; VLVRMKELAVQSGN; LVRMKELAVQSGNG; VRMKELAVQSGNGT; RMK
ELAVQSGNGTY; MKELAVQSGNGTYS; KELAVQSGNGTYSD; ELAVQSGNGTYSDA; LAVQSG
NGTYSDAD; AVQSGNGTYSDAD

QA;ILTQSAMAMIAQAN;LTQSAMAMIAQANQ;TQSAMAMIAQANQV;QSAMAMIAQANQVP;
SAMAMIAQANQVPQ;AMAMIAQANQVPQY;MAMIAQANQVPQYV;AMIAQANQVPQYVL;MIA
QANQVPQYVLS;IAQANQVPQYVLSL;AQANQVPQYVLSLL;QANQVPQYVLSLLR;

15 mers:
MIINHNTSAINASRN;IINHNTSAINASRNN;INHNTSAINASRNNG;NHNTSAINASRNNGI
;HNTSAINASRNNGIN;NTSAINASRNNGINA;TSAINASRNNGINAA;SAINASRNNGINAA
N;AINASRNNGINAANL;INASRNNGINAANLS;NASRNNGINAANLSK;ASRNNGINAANLS
KT;SRNNGINAANLSKTQ;RNNGINAANLSKTQE;NNGINAANLSKTQEK;NGINAANLSKTQ
EKL;GINAANLSKTQEKLS;INAANLSKTQEKLSS;NAANLSKTQEKLSSG;AANLSKTQEKL
SSGY;ANLSKTQEKLSSGYR;NLSKTQEKLSSGYRI;LSKTQEKLSSGYRIN;SKTQEKLSSG
YRINR;KTQEKLSSGYRINRA;TQEKLSSGYRINRAS;QEKLSSGYRINRASD;EKLSSGYRI
NRASDD;KLSSGYRINRASDDA;LSSGYRINRASDDAA;SSGYRINRASDDAAG;SGYRINRA
SDDAAGM;GYRINRASDDAAGMG;YRINRASDDAAGMGV;RINRASDDAAGMGVS;INRASDD
AAGMGVSG;NRASDDAAGMGVSGK;RASDDAAGMGVSGKI;ASDDAAGMGVSGKIN;SDDAAG
MGVSGKINA;DDAAGMGVSGKINAQ;DAAGMGVSGKINAQI;AAGMGVSGKINAQIR;AGMGV
SGKINAQIRG;GMGVSGKINAQIRGL;MGVSGKINAQIRGLS;GVSGKINAQIRGLSQ;VSGK
INAQIRGLSQA;SGKINAQIRGLSQAS;GKINAQIRGLSQASR;KINAQIRGLSQASRN;INA
QIRGLSQASRNT;NAQIRGLSQASRNTS;AQIRGLSQASRNTSK;QIRGLSQASRNTSKA;IR
GLSQASRNTSKAI;RGLSQASRNTSKAIN;GLSQASRNTSKAINF;LSQASRNTSKAINFI;S
QASRNTSKAINFIQ;QASRNTSKAINFIQT;ASRNTSKAINFIQTT;SRNTSKAINFIQTTE;
RNTSKAINFIQTTEG;NTSKAINFIQTTEGN;TSKAINFIQTTEGNL;SKAINFIQTTEGNLN
;KAINFIQTTEGNLNE;AINFIQTTEGNLNEV;INFIQTTEGNLNEVE;NFIQTTEGNLNEVE
K;FIQTTEGNLNEVEKV;IQTTEGNLNEVEKVL;QTTEGNLNEVEKVLV;TTEGNLNEVEKVL
VR;TEGNLNEVEKVLVRM;EGNLNEVEKVLVRMK;GNLNEVEKVLVRMKE;NLNEVEKVLVRM
KEL;LNEVEKVLVRMKELA;NEVEKVLVRMKELAV;EVEKVLVRMKELAVQ;VEKVLVRMKEL
AVQS;EKVLVRMKELAVQSG;KVLVRMKELAVQSGN;VLVRMKELAVQSGNG;LVRMKELAVQ
SGNGT;VRMKELAVQSGNGTY;RMKELAVQSGNGTYS;MKELAVQSGNGTYSD;KELAVQSGN
GTYSDA;ELAVQSGNGTYSDAD;LAVQSGNGTYSDADR;AVQSGNGTYSDADRG;VQSGNGTY
SDADRGS;QSGNGTYSDADRGSI;SGNGTYSDADRGSIQ;GNGTYSDADRGSIQI;NGTYSDA
DRGSIQIE;GTYSDADRGSIQIEI;TYSDADRGSIQIEIE;YSDADRGSIQIEIEQ;SDADRG
SIQIEIEQL;DADRGSIQIEIEQLT;ADRGSIQIEIEQLTD;DRGSIQIEIEQLTDE;RGSIQ
IEIEQLTDEI;GSIQIEIEQLTDEIN;SIQIEIEQLTDEINR;IQIEIEQLTDEINRI;QIEI
EQLTDEINRIA;IEIEQLTDEINRIAD;EIEQLTDEINRIADQ;IEQLTDEINRIADQA;EQL
TDEINRIADQAQ;QLTDEINRIADQAQY;LTDEINRIADQAQYN;TDEINRIADQAQYNQ;DE
INRIADQAQYNQM;EINRIADQAQYNQMH;INRIADQAQYNQMHM;NRIADQAQYNQMHML;R
IADQAQYNQMHMLS;IADQAQYNQMHMLSN;ADQAQYNQMHMLSNK;DQAQYNQMHMLSNKS;
QAQYNQMHMLSNKSA;AQYNQMHMLSNKSAS;QYNQMHMLSNKSASQ;YNQMHMLSNKSASQN
;NQMHMLSNKSASQNV;QMHMLSNKSASQNVR;MHMLSNKSASQNVRT;HMLSNKSASQNVRT
A;MLSNKSASQNVRTAE;LSNKSASQNVRTAEE;SNKSASQNVRTAEEL;NKSASQNVRTAEE
LG;KSASQNVRTAEELGM;SASQNVRTAEELGMQ;ASQNVRTAEELGMQP;SQNVRTAEELGM
QPA;QNVRTAEELGMQPAK;NVRTAEELGMQPAKI;VRTAEELGMQPAKIN;RTAEELGMQPA
KINT;TAEELGMQPAKINTP;AEELGMQPAKINTPA;EELGMQPAKINTPAS;ELGMQPAKIN
TPASL;LGMQPAKINTPASLS;GMQPAKINTPASLSG;MQPAKINTPASLSGS;QPAKINTPA
SLSGSQ;PAKINTPASLSGSQA;AKINTPASLSGSQAS;KINTPASLSGSQASW;INTPASLS
GSQASWT;NTPASLSGSQASWTL;TPASLSGSQASWTLR;PASLSGSQASWTLRV;ASLSGSQ
ASWTLRVH;SLSGSQASWTLRVHV;LSGSQASWTLRVHVG;SGSQASWTLRVHVGA;GSQASW
TLRVHVGAN;SQASWTLRVHVGANQ;QASWTLRVHVGANQD;ASWTLRVHVGANQDE;SWTLR
VHVGANQDEA;WTLRVHVGANQDEAI;TLRVHVGANQDEAIA;LRVHVGANQDEAIAV;RVHV
GANQDEAIAVN;VHVGANQDEAIAVNI;HVGANQDEAIAVNIY;VGANQDEAIAVNIYA;GAN
QDEAIAVNIYAA;ANQDEAIAVNIYAAN;NQDEAIAVNIYAANV;QDEAIAVNIYAANVA;DE
AIAVNIYAANVAN;EAIAVNIYAANVANL;AIAVNIYAANVANLF;IAVNIYAANVANLFS;A
VNIYAANVANLFSG;VNIYAANVANLFSGE;NIYAANVANLFSGEG;IYAANVANLFSGEGA;
YAANVANLFSGEGAQ;AANVANLFSGEGAQT;ANVANLFSGEGAQTA;NVANLFSGEGAQTAQ
;VANLFSGEGAQTAQA;ANLFSGEGAQTAQAA;NLFSGEGAQTAQAAP;LFSGEGAQTAQAAP
V;FSGEGAQTAQAAPVQ;SGEGAQTAQAAPVQE;GEGAQTAQAAPVQEG;EGAQTAQAAPVQE
GV;GAQTAQAAPVQEGVQ;AQTAQAAPVQEGVQQ;QTAQAAPVQEGVQQE;TAQAAPVQEGVQ

Fig. 43 continued

QEG;AQAAPVQEGVQQEGA;QAAPVQEGVQQEGAQ;AAPVQEGVQQEGAQQ;APVQEGVQQEG
AQQP;PVQEGVQQEGAQQPA;VQEGVQQEGAQQPAP;QEGVQQEGAQQPAPA;EGVQQEGAQQ
PAPAT;GVQQEGAQQPAPATA;VQQEGAQQPAPATAP;QQEGAQQPAPATAPS;QEGAQQPAP
ATAPSQ;EGAQQPAPATAPSQG;GAQQPAPATAPSQGG;AQQPAPATAPSQGGV;QQPAPATA
PSQGGVN;QPAPATAPSQGGVNS;PAPATAPSQGGVNSP;APATAPSQGGVNSPV;PATAPSQ
GGVNSPVN;ATAPSQGGVNSPVNV;TAPSQGGVNSPVNVT;APSQGGVNSPVNVTT;PSQGGV
NSPVNVTTT;SQGGVNSPVNVTTTV;QGGVNSPVNVTTTVD;GGVNSPVNVTTTVDA;GVNSP
VNVTTTVDAN;VNSPVNVTTTVDANT;NSPVNVTTTVDANTS;SPVNVTTTVDANTSL;PVNV
TTTVDANTSLA;VNVTTTVDANTSLAK;NVTTTVDANTSLAKI;VTTTVDANTSLAKIE;TTT
VDANTSLAKIEN;TTVDANTSLAKIENA;TVDANTSLAKIENAI;VDANTSLAKIENAIR;DA
NTSLAKIENAIRM;ANTSLAKIENAIRMI;NTSLAKIENAIRMIS;TSLAKIENAIRMISD;S
LAKIENAIRMISDQ;LAKIENAIRMISDQR;AKIENAIRMISDQRA;KIENAIRMISDQRAN;
IENAIRMISDQRANL;ENAIRMISDQRANLG;NAIRMISDQRANLGA;AIRMISDQRANLGAF
;IRMISDQRANLGAFQ;RMISDQRANLGAFQN;MISDQRANLGAFQNR;ISDQRANLGAFQNR
L;SDQRANLGAFQNRLE;DQRANLGAFQNRLES;QRANLGAFQNRLESI;RANLGAFQNRLES
IK;ANLGAFQNRLESIKN;NLGAFQNRLESIKNS;LGAFQNRLESIKNST;GAFQNRLESIKN
STE;AFQNRLESIKNSTEY;FQNRLESIKNSTEYA;QNRLESIKNSTEYAI;NRLESIKNSTE
YAIE;RLESIKNSTEYAIEN;LESIKNSTEYAIENL;ESIKNSTEYAIENLK;SIKNSTEYAI
ENLKA;IKNSTEYAIENLKAS;KNSTEYAIENLKASY;NSTEYAIENLKASYA;STEYAIENL
KASYAQ;TEYAIENLKASYAQI;EYAIENLKASYAQIK;YAIENLKASYAQIKD;AIENLKAS
YAQIKDA;IENLKASYAQIKDAT;ENLKASYAQIKDATM;NLKASYAQIKDATMT;LKASYAQ
IKDATMTD;KASYAQIKDATMTDE;ASYAQIKDATMTDEV;SYAQIKDATMTDEVV;YAQIKD
ATMTDEVVA;AQIKDATMTDEVVAA;QIKDATMTDEVVAAT;IKDATMTDEVVAATT;KDATM
TDEVVAATTN;DATMTDEVVAATTNS;ATMTDEVVAATTNSI;TMTDEVVAATTNSIL;MTDE
VVAATTNSILT;TDEVVAATTNSILTQ;DEVVAATTNSILTQS;EVVAATTNSILTQSA;VVA
ATTNSILTQSAM;VAATTNSILTQSAMA;AATTNSILTQSAMAM;ATTNSILTQSAMAMI;TT
NSILTQSAMAMIA;TNSILTQSAMAMIAQ;NSILTQSAMAMIAQA;SILTQSAMAMIAQAN;I
LTQSAMAMIAQANQ;LTQSAMAMIAQANQV;TQSAMAMIAQANQVP;QSAMAMIAQANQVPQ;
SAMAMIAQANQVPQY;AMAMIAQANQVPQYV;MAMIAQANQVPQYVL;AMIAQANQVPQYVLS
;MIAQANQVPQYVLSL;IAQANQVPQYVLSLL;AQANQVPQYVLSLLR;

16 mers:
MIINHNTSAINASRNN;IINHNTSAINASRNNG;INHNTSAINASRNNGI;NHNTSAINASRN
NGIN;HNTSAINASRNNGINA;NTSAINASRNNGINAA;TSAINASRNNGINAAN;SAINASR
NNGINAANL;AINASRNNGINAANLS;INASRNNGINAANLSK;NASRNNGINAANLSKT;AS
RNNGINAANLSKTQ;SRNNGINAANLSKTQE;RNNGINAANLSKTQEK;NNGINAANLSKTQE
KL;NGINAANLSKTQEKLS;GINAANLSKTQEKLSS;INAANLSKTQEKLSSG;NAANLSKTQ
EKLSSGY;AANLSKTQEKLSSGYR;ANLSKTQEKLSSGYRI;NLSKTQEKLSSGYRIN;LSKT
QEKLSSGYRINR;SKTQEKLSSGYRINRA;KTQEKLSSGYRINRAS;TQEKLSSGYRINRASD
;QEKLSSGYRINRASDD;EKLSSGYRINRASDDA;KLSSGYRINRASDDAA;LSSGYRINRAS
DDAAG;SSGYRINRASDDAAGM;SGYRINRASDDAAGMG;GYRINRASDDAAGMGV;YRINRA
SDDAAGMGVS;RINRASDDAAGMGVSG;INRASDDAAGMGVSGK;NRASDDAAGMGVSGKI;R
ASDDAAGMGVSGKIN;ASDDAAGMGVSGKINA;SDDAAGMGVSGKINAQ;DDAAGMGVSGKIN
AQI;DAAGMGVSGKINAQIR;AAGMGVSGKINAQIRG;AGMGVSGKINAQIRGL;GMGVSGKI
NAQIRGLS;MGVSGKINAQIRGLSQ;GVSGKINAQIRGLSQA;VSGKINAQIRGLSQAS;SGK
INAQIRGLSQASR;GKINAQIRGLSQASRN;KINAQIRGLSQASRNT;INAQIRGLSQASRNT
S;NAQIRGLSQASRNTSK;AQIRGLSQASRNTSKA;QIRGLSQASRNTSKAI;IRGLSQASRN
TSKAIN;RGLSQASRNTSKAINF;GLSQASRNTSKAINFI;LSQASRNTSKAINFIQ;SQASR
NTSKAINFIQT;QASRNTSKAINFIQTT;ASRNTSKAINFIQTTE;SRNTSKAINFIQTTEG;
RNTSKAINFIQTTEGN;NTSKAINFIQTTEGNL;TSKAINFIQTTEGNLN;SKAINFIQTTEG
NLNE;KAINFIQTTEGNLNEV;AINFIQTTEGNLNEVE;INFIQTTEGNLNEVEK;NFIQTTE
GNLNEVEKV;FIQTTEGNLNEVEKVL;IQTTEGNLNEVEKVLV;QTTEGNLNEVEKVLVR;TT
EGNLNEVEKVLVRM;TEGNLNEVEKVLVRMK;EGNLNEVEKVLVRMKE;GNLNEVEKVLVRMK
EL;NLNEVEKVLVRMKELA;LNEVEKVLVRMKELAV;NEVEKVLVRMKELAVQ;EVEKVLVRM
KELAVQS;VEKVLVRMKELAVQSG;EKVLVRMKELAVQSGN;KVLVRMKELAVQSGNG;VLVR
MKELAVQSGNGT;LVRMKELAVQSGNGTY;VRMKELAVQSGNGTYS;RMKELAVQSGNGTYSD
;MKELAVQSGNGTYSDA;KELAVQSGNGTYSDAD;ELAVQSGNGTYSDADR;LAVQSGNGTYS

Fig. 43 continued

DADRG;AVQSGNGTYSDADRGS;VQSGNGTYSDADRGSI;QSGNGTYSDADRGSIQ;SGNGTY
SDADRGSIQI;GNGTYSDADRGSIQIE;NGTYSDADRGSIQIEI;GTYSDADRGSIQIEIE;T
YSDADRGSIQIEIEQ;YSDADRGSIQIEIEQL;SDADRGSIQIEIEQLT;DADRGSIQIEIEQ
LTD;ADRGSIQIEIEQLTDE;DRGSIQIEIEQLTDEI;RGSIQIEIEQLTDEIN;GSIQIEIE
QLTDEINR;SIQIEIEQLTDEINRI

| | |
|---|---|
| A;VAATTNSILTQSAMAM;AATTNSILTQSAMAMI;ATTNSILTQSAMAMIA;TTNSILTQSA<br>MAMIAQ;TNSILTQSAMAMIAQA;NSILTQSAMAMIAQAN;SILTQSAMAMIAQANQ;ILTQS<br>AMAMIAQANQV;LTQSAMAMIAQANQVP;TQSAMAMIAQANQVPQ;QSAMAMIAQANQVPQY;<br>SAMAMIAQANQVPQYV;AMAMIAQANQVPQYVL;MAMIAQANQVPQYVLS;AMIAQANQVPQY<br>VLSL;MIAQANQVPQYVLSLL;IAQANQVPQYVLSLLR | |
| <AAL23583.1 flagellin A;Borrelia afzelii><br>MKRKAKSILFFLLSTALFAQETDGLTEGSKRAEPGELVLDFAELARDPSSTKLDLTNYVDYVY<br>SGASGIVKPEDMVVDLGISNWSVLLTPSARLQAYVKNSVVAPALVKSESKRYAGDTILGVRVL<br>FPSYSQSSAMIMPPFKIPFYSGESGNQFLGKGLIDNIKTMKEIKVSVYSLGYEVDLEVLFEDM<br>NGMEYAYSLGTLKFKGWADLIWSNPNYIPNISARIIKDDVPNYPLASSKMRFKAFRVSKSHSS<br>KEQNFIFYVKDLRVLYDKLSVSIDSDIDSESVFKVYETSGAESLRKLKAHETFKRVLKLREKI<br>SMPEGSFQNFIEKVESDKPEESSSEN<br><br>13 mers:<br>MKRKAKSILFFLL;KRKAKSILFFLLS;RKAKSILFFLLST;KAKSILFFLLSTA;AKSILFF<br>LLSTAL;KSILFFLLSTALF;SILFFLLSTALFA;ILFFLLSTALFAQ;LFFLLSTALFAQE;<br>FFLLSTALFAQET;FLLSTALFAQETD;LLSTALFAQETDG;LSTALFAQETDGL;STALFAQ<br>ETDGLT;TALFAQETDGLTE;ALFAQETDGLTEG;LFAQETDGLTEGS;FAQETDGLTEGSK;<br>AQETDGLTEGSKR;QETDGLTEGSKRA;ETDGLTEGSKRAE;TDGLTEGSKRAEP;DGLTEGS<br>KRAEPG;GLTEGSKRAEPGE;LTEGSKRAEPGEL;TEGSKRAEPGELV;EGSKRAEPGELVL;<br>GSKRAEPGELVLD;SKRAEPGELVLDF;KRAEPGELVLDFA;RAEPGELVLDFAE;AEPGELV<br>LDFAEL;EPGELVLDFAELA;PGELVLDFAELAR;GELVLDFAELARD;ELVLDFAELARDP;<br>LVLDFAELARDPS;VLDFAELARDPSS;LDFAELARDPSST;DFAELARDPSSTK;FAELARD<br>PSSTKL;AELARDPSSTKLD;ELARDPSSTKLDL;LARDPSSTKLDLT;ARDPSSTKLDLTN;<br>RDPSSTKLDLTNY;DPSSTKLDLTNYV;PSSTKLDLTNYVD;SSTKLDLTNYVDY;STKLDLT<br>NYVDYV;TKLDLTNYVDYVY;KLDLTNYVDYVYS;LDLTNYVDYVYSG;DLTNYVDYVYSGA;<br>LTNYVDYVYSGAS;TNYVDYVYSGASG;NYVDYVYSGASGI;YVDYVYSGASGIV;VDYVYSG<br>ASGIVK;DYVYSGASGIVKP;YVYSGASGIVKPE;VYSGASGIVKPED;YSGASGIVKPEDM;<br>SGASGIVKPEDMV;GASGIVKPEDMVV;ASGIVKPEDMVVD;SGIVKPEDMVVDL;GIVKPED<br>MVVDLG;IVKPEDMVVDLGI;VKPEDMVVDLGIS;KPEDMVVDLGISN;PEDMVVDLGISNW;<br>EDMVVDLGISNWS;DMVVDLGISNWSV;MVVDLGISNWSVL;VVDLGISNWSVLL;VDLGISN<br>WSVLLT;DLGISNWSVLLTP;LGISNWSVLLTPS;GISNWSVLLTPSA;ISNWSVLLTPSAR;<br>SNWSVLLTPSARL;NWSVLLTPSARLQ;WSVLLTPSARLQA;SVLLTPSARLQAY;VLLTPSA<br>RLQAYV;LLTPSARLQAYVK;LTPSARLQAYVKN;TPSARLQAYVKNS;PSARLQAYVKNSV;<br>SARLQAYVKNSVV;ARLQAYVKNSVVA;RLQAYVKNSVVAP;LQAYVKNSVVAPA;QAYVKNS<br>VVAPAL;AYVKNSVVAPALV;YVKNSVVAPALVK;VKNSVVAPALVKS;KNSVVAPALVKSE;<br>NSVVAPALVKSES;SVVAPALVKSESK;VVAPALVKSESKR;VAPALVKSESKRY;APALVKS<br>ESKRYA;PALVKSESKRYAG;ALVKSESKRYAGD;LVKSESKRYAGDT;VKSESKRYAGDTI;<br>KSESKRYAGDTIL;SESKRYAGDTILG;ESKRYAGDTILGV;SKRYAGDTILGVR;KRYAGDT<br>ILGVRV;RYAGDTILGVRVL;YAGDTILGVRVLF;AGDTILGVRVLFP;GDTILGVRVLFPS;<br>DTILGVRVLFPSY;TILGVRVLFPSYS;ILGVRVLFPSYSQ;LGVRVLFPSYSQS;GVRVLFP<br>SYSQSS;VRVLFPSYSQSSA;RVLFPSYSQSSAM;VLFPSYSQSSAMI;LFPSYSQSSAMIM;<br>FPSYSQSSAMIMP;PSYSQSSAMIMPP;SYSQSSAMIMPPF;YSQSSAMIMPPFK;SQSSAMI<br>MPPFKI;QSSAMIMPPFKIP;SSAMIMPPFKIPF;SAMIMPPFKIPFY;AMIMPPFKIPFYS;<br>MIMPPFKIPFYSG;IMPPFKIPFYSGE;MPPFKIPFYSGES;PPFKIPFYSGESG;PFKIPFY<br>SGESGN;FKIPFYSGESGNQ;KIPFYSGESGNQF;IPFYSGESGNQFL;PFYSGESGNQFLG;<br>FYSGESGNQFLGK;YSGESGNQFLGKG;SGESGNQFLGKGL;GESGNQFLGKGLI;ESGNQFL<br>GKGLID;SGNQFLGKGLIDN;GNQFLGKGLIDNI;NQFLGKGLIDNIK;QFLGKGLIDNIKT;<br>FLGKGLIDNIKTM;LGKGLIDNIKTMK;GKGLIDNIKTMKE;KGLIDNIKTMKEI;GLIDNIK<br>TMKEIK;LIDNIKTMKEIKV;IDNIKTMKEIKVS;DNIKTMKEIKVSV;NIKTMKEIKVSVY;<br>IKTMKEIKVSVYS;KTMKEIKVSVYSL;TMKEIKVSVYSLG;MKEIKVSVYSLGY;KEIKVSV<br>YSLGYE;EIKVSVYSLGYEV;IKVSVYSLGYEVD;KVSVYSLGYEVDL;VSVYSLGYEVDLE;<br>SVYSLGYEVDLEV;VYSLGYEVDLEVL;YSLGYEVDLEVLF;SLGYEVDLEVLFE;LGYEVDL<br>EVLFED;GYEVDLEVLFEDM;YEVDLEVLFEDMN;EVDLEVLFEDMNG;VDLEVLFEDMNGM;<br>DLEVLFEDMNGME;LEVLFEDMNGMEY;EVLFEDMNGMEYA;VLFEDMNGMEYAY;LFEDMNG<br>MEYAYS;FEDMNGMEYAYSL;EDMNGMEYAYSLG;DMNGMEYAYSLGT;MNGMEYAYSLGTL;<br>NGMEYAYSLGTLK;GMEYAYSLGTLKF;MEYAYSLGTLKFK;EYAYSLGTLKFKG;YAYSLGT | 208035-<br>210675 |

Fig. 43 continued

| | |
|---|---|
| LKFKGW;AYSLGTLKFKGWA;YSLGTLKFKGWAD;SLGTLKFKGWADL;LGTLKFKGWADLI;GTLKFKGWADLIW;TLKFKGWADLIWS;LKFKGWADLIWSN;KFKGWADLIWSNP;FKGWADLIWSNPN;KGWADLIWSNPNY;GWADLIWSNPNYI;WADLIWSNPNYIP;ADLIWSNPNYIPN;DLIWSNPNYIPNI;LIWSNPNYIPNIS;IWSNPNYIPNISA;WSNPNYIPNISAR;SNPNYIPNISARI;NPNYIPNISARII;PNYIPNISARIIK;NYIPNISARIIKD;YIPNISARIIKDD;IPNISARIIKDDV;PNISARIIKDDVP;NISARIIKDDVPN;ISARIIKDDVPNY;SARIIKDDVPNYP;ARIIKDDVPNYPL;RIIKDDVPNYPLA;IIKDDVPNYPLAS;IKDDVPNYPLASS;KDDVPNYPLASSK;DDVPNYPLASSKM;DVPNYPLASSKMR;VPNYPLASSKMRF;PNYPLASSKMRFK;NYPLASSKMRFKA;YPLASSKMRFKAF;PLASSKMRFKAFR;LASSKMRFKAFRV;ASSKMRFKAFRVS;SSKMRFKAFRVSK;SKMRFKAFRVSKS;KMRFKAFRVSKSH;MRFKAFRVSKSHS;RFKAFRVSKSHSS;FKAFRVSKSHSSK;KAFRVSKSHSSKE;AFRVSKSHSSKEQ;FRVSKSHSSKEQN;RVSKSHSSKEQNF;VSKSHSSKEQNFI;SKSHSSKEQNFIF;KSHSSKEQNFIFY;SHSSKEQNFIFYV;HSSKEQNFIFYVK;SSKEQNFIFYVKD;SKEQNFIFYVKDL;KEQNFIFYVKDLR;EQNFIFYVKDLRV;QNFIFYVKDLRVL;NFIFYVKDLRVLY;FIFYVKDLRVLYD;IFYVKDLRVLYDK;FYVKDLRVLYDKL;YVKDLRVLYDKLS;VKDLRVLYDKLSV;KDLRVLYDKLSVS;DLRVLYDKLSVSI;LRVLYDKLSVSID;RVLYDKLSVSIDS;VLYDKLSVSIDSD;LYDKLSVSIDSDI;YDKLSVSIDSDID;DKLSVSIDSDIDS;KLSVSIDSDIDSE;LSVSIDSDIDSES;SVSIDSDIDSESV;VSIDSDIDSESVF;SIDSDIDSESVFK;IDSDIDSESVFKV;DSDIDSESVFKVY;SDIDSESVFKVYE;DIDSESVFKVYET;IDSESVFKVYETS;DSESVFKVYETSG;SESVFKVYETSGA;ESVFKVYETSGAE;SVFKVYETSGAES;VFKVYETSGAESL;FKVYETSGAESLR;KVYETSGAESLRK;VYETSGAESLRKL;YETSGAESLRKLK;ETSGAESLRKLKA;TSGAESLRKLKAH;SGAESLRKLKAHE;GAESLRKLKAHET;AESLRKLKAHETF;ESLRKLKAHETFK;SLRKLKAHETFKR;LRKLKAHETFKRV;RKLKAHETFKRVL;KLKAHETFKRVLK;LKAHETFKRVLKL;KAHETFKRVLKLR;AHETFKRVLKLRE;HETFKRVLKLREK;ETFKRVLKLREKI;TFKRVLKLREKIS;FKRVLKLREKISM;KRVLKLREKISMP;RVLKLREKISMPE;VLKLREKISMPEG;LKLREKISMPEGS;KLREKISMPEGSF;LREKISMPEGSFQ;REKISMPEGSFQN;EKISMPEGSFQNF;KISMPEGSFQNFI;ISMPEGSFQNFIE;SMPEGSFQNFIEK;MPEGSFQNFIEKV;PEGSFQNFIEKVE;EGSFQNFIEKVES;GSFQNFIEKVESD;SFQNFIEKVESDK;FQNFIEKVESDKP;QNFIEKVESDKPE;NFIEKVESDKPEE;FIEKVESDKPEES;IEKVESDKPEESS;EKVESDKPEESSS;KVESDKPEESSSE;VESDKPEESSSEN;<br><br>14 mers:<br>MKRKAKSILFFLLS;KRKAKSILFFLLST;RKAKSILFFLLSTA;KAKSILFFLLSTAL;AKSILFFLLSTALF;KSILFFLLSTALFA;SILFFLLSTALFAQ;ILFFLLSTALFAQE;LFFLLSTALFAQET;FFLLSTALFAQETD;FLLSTALFAQETDG;LLSTALFAQETDGL;LSTALFAQETDGLT;STALFAQETDGLTE;TALFAQETDGLTEG;ALFAQETDGLTEGS;LFAQETDGLTEGSK;FAQETDGLTEGSKR;AQETDGLTEGSKRA;QETDGLTEGSKRAE;ETDGLTEGSKRAEP;TDGLTEGSKRAEPG;DGLTEGSKRAEPGE;GLTEGSKRAEPGEL;LTEGSKRAEPGELV;TEGSKRAEPGELVL;EGSKRAEPGELVLD;GSKRAEPGELVLDF;SKRAEPGELVLDFA;KRAEPGELVLDFAE;RAEPGELVLDFAEL;AEPGELVLDFAELA;EPGELVLDFAELAR;PGELVLDFAELARD;GELVLDFAELARDP;ELVLDFAELARDPS;LVLDFAELARDPSS;VLDFAELARDPSST;LDFAELARDPSSTK;DFAELARDPSSTKL;FAELARDPSSTKLD;AELARDPSSTKLDL;ELARDPSSTKLDLT;LARDPSSTKLDLTN;ARDPSSTKLDLTNY;RDPSSTKLDLTNYV;DPSSTKLDLTNYVD;PSSTKLDLTNYVDY;SSTKLDLTNYVDYV;STKLDLTNYVDYVY;TKLDLTNYVDYVYS;KLDLTNYVDYVYSG;LDLTNYVDYVYSGA;DLTNYVDYVYSGAS;LTNYVDYVYSGASG;TNYVDYVYSGASGI;NYVDYVYSGASGIV;YVDYVYSGASGIVK;VDYVYSGASGIVKP;DYVYSGASGIVKPE;YVYSGASGIVKPED;VYSGASGIVKPEDM;YSGASGIVKPEDMV;SGASGIVKPEDMVV;GASGIVKPEDMVVD;ASGIVKPEDMVVDL;SGIVKPEDMVVDLG;GIVKPEDMVVDLGI;IVKPEDMVVDLGIS;VKPEDMVVDLGISN;KPEDMVVDLGISNW;PEDMVVDLGISNWS;EDMVVDLGISNWSV;DMVVDLGISNWSVL;MVVDLGISNWSVLL;VVDLGISNWSVLLT;VDLGISNWSVLLTP;DLGISNWSVLLTPS;LGISNWSVLLTPSA;GISNWSVLLTPSAR;ISNWSVLLTPSARL;SNWSVLLTPSARLQ;NWSVLLTPSARLQA;WSVLLTPSARLQAY;SVLLTPSARLQAYV;VLLTPSARLQAYVK;LLTPSARLQAYVKN;LTPSARLQAYVKNS;TPSARLQAYVKNSV;PSARLQAYVKNSVV;SARLQAYVKNSVVA;ARLQAYVKNSVVAP;RLQAYVKNSVVAPA;LQAYVKNSVVAPAL;QAYVKNSVVAPALV;AYVKNSVVAPALVK;YVKNSVVAPALVKS;VKNSVVAPALVKSE;KNSVVAPALVKSES;NSVVAPALVKSESK;SVVAPALVKSES | |

Fig. 43 continued

KR;VVAPALVKSESKRY;VAPALVKSESKRYA;APALVKSESKRYAG;PALVKSESKRYAGD;
ALVKSESKRYAGDT;LVKSESKRYAGDTI;VKSESKRYAGDTIL;KSESKRYAGDTILG;SES
KRYAGDTILGV;ESKRYAGDTILGVR;SKRYAGDTILGVRV;KRYAGDTILGVRVL;RYAGDT
ILGVRVLF;YAGDTILGVRVLFP;AGDTILGVRVLFPS;GDTILGVRVLFPSY;DTILGVRVL
FPSYS;TILGVRVLFPSYSQ;ILGVRVLFPSYSQS;LGVRVLFPSYSQSS;GVRVLFPSYSQS
SA;VRVLFPSYSQSSAM;RVLFPSYSQSSAMI;VLFPSYSQSSAMIM;LFPSYSQSSAMIMP;
FPSYSQSSAMIMPP;PSYSQSSAMIMPPF;SYSQSSAMIMPPFK;YSQSSAMIMPPFKI;SQS
SAMIMPPFKIP;QSSAMIMPPFKIPF;SSAMIMPPFKIPFY;SAMIMPPFKIPFYS;AMIMPP
FKIPFYSG;MIMPPFKIPFYSGE;IMPPFKIPFYSGES;MPPFKIPFYSGESG;PPFKIPFYS
GESGN;PFKIPFYSGESGNQ;FKIPFYSGESGNQF;KIPFYSGESGNQFL;IPFYSGESGNQF
LG;PFYSGESGNQFLGK;FYSGESGNQFLGKG;YSGESGNQFLGKGL;SGESGNQFLGKGLI;
GESGNQFLGKGLID;ESGNQFLGKGLIDN;SGNQFLGKGLIDNI;GNQFLGKGLIDNIK;NQF
LGKGLIDNIKT;QFLGKGLIDNIKTM;FLGKGLIDNIKTMK;LGKGLIDNIKTMKE;GKGLID
NIKTMKEI;KGLIDNIKTMKEIK;GLIDNIKTMKEIKV;LIDNIKTMKEIKVS;IDNIKTMKE
IKVSV;DNIKTMKEIKVSVY;NIKTMKEIKVSVYS;IKTMKEIKVSVYSL;KTMKEIKVSVYS
LG;TMKEIKVSVYSLGY;MKEIKVSVYSLGYE;KEIKVSVYSLGYEV;EIKVSVYSLGYEVD;
IKVSVYSLGYEVDL;KVSVYSLGYEVDLE;VSVYSLGYEVDLEV;SVYSLGYEVDLEVL;VYS
LGYEVDLEVLF;YSLGYEVDLEVLFE;SLGYEVDLEVLFED;LGYEVDLEVLFEDM;GYEVDL
EVLFEDMN;YEVDLEVLFEDMNG;EVDLEVLFEDMNGM;VDLEVLFEDMNGME;DLEVLFEDM
NGMEY;LEVLFEDMNGMEYA;EVLFEDMNGMEYAY;VLFEDMNGMEYAYS;LFEDMNGMEYAY
SL;FEDMNGMEYAYSLG;EDMNGMEYAYSLGT;DMNGMEYAYSLGTL;MNGMEYAYSLGTLK;
NGMEYAYSLGTLKF;GMEYAYSLGTLKFK;MEYAYSLGTLKFKG;EYAYSLGTLKFKGW;YAY
SLGTLKFKGWA;AYSLGTLKFKGWAD;YSLGTLKFKGWADL;SLGTLKFKGWADLI;LGTLKF
KGWADLIW;GTLKFKGWADLIWS;TLKFKGWADLIWSN;LKFKGWADLIWSNP;KFKGWADLI
WSNPN;FKGWADLIWSNPNY;KGWADLIWSNPNYI;GWADLIWSNPNYIP;WADLIWSNPNYI
PN;ADLIWSNPNYIPNI;DLIWSNPNYIPNIS;LIWSNPNYIPNISA;IWSNPNYIPNISAR;
WSNPNYIPNISARI;SNPNYIPNISARII;NPNYIPNISARIIK;PNYIPNISARIIKD;NYI
PNISARIIKDD;YIPNISARIIKDDV;IPNISARIIKDDVP;PNISARIIKDDVPN;NISARI
IKDDVPNY;ISARIIKDDVPNYP;SARIIKDDVPNYPL;ARIIKDDVPNYPLA;RIIKDDVPN
YPLAS;IIKDDVPNYPLASS;IKDDVPNYPLASSK;KDDVPNYPLASSKM;DDVPNYPLASSK
MR;DVPNYPLASSKMRF;VPNYPLASSKMRFK;PNYPLASSKMRFKA;NYPLASSKMRFKAF;
YPLASSKMRFKAFR;PLASSKMRFKAFRV;LASSKMRFKAFRVS;ASSKMRFKAFRVSK;SSK
MRFKAFRVSKS;SKMRFKAFRVSKSH;KMRFKAFRVSKSHS;MRFKAFRVSKSHSS;RFKAFR
VSKSHSSK;FKAFRVSKSHSSKE;KAFRVSKSHSSKEQ;AFRVSKSHSSKEQN;FRVSKSHSS
KEQNF;RVSKSHSSKEQNFI;VSKSHSSKEQNFIF;SKSHSSKEQNFIFY;KSHSSKEQNFIF
YV;SHSSKEQNFIFYVK;HSSKEQNFIFYVKD;SSKEQNFIFYVKDL;SKEQNFIFYVKDLR;
KEQNFIFYVKDLRV;EQNFIFYVKDLRVL;QNFIFYVKDLRVLY;NFIFYVKDLRVLYD;FIF
YVKDLRVLYDK;IFYVKDLRVLYDKL;FYVKDLRVLYDKLS;YVKDLRVLYDKLSV;VKDLRV
LYDKLSVS;KDLRVLYDKLSVSI;DLRVLYDKLSVSID;LRVLYDKLSVSIDS;RVLYDKLSV
SIDSD;VLYDKLSVSIDSDI;LYDKLSVSIDSDID;YDKLSVSIDSDIDS;DKLSVSIDSDID
SE;KLSVSIDSDIDSES;LSVSIDSDIDSESV;SVSIDSDIDSESVF;VSIDSDIDSESVFK;
SIDSDIDSESVFKV;IDSDIDSESVFKVY;DSDIDSESVFKVYE;SDIDSESVFKVYET;DID
SESVFKVYETS;IDSESVFKVYETSG;DSESVFKVYETSGA;SESVFKVYETSGAE;ESVFKV
YETSGAES;SVFKVYETSGAESL;VFKVYETSGAESLR;FKVYETSGAESLRK;KVYETSGAE
SLRKL;VYETSGAESLRKLK;YETSGAESLRKLKA;ETSGAESLRKLKAH;TSGAESLRKLKA
HE;SGAESLRKLKAHET;GAESLRKLKAHETF;AESLRKLKAHETFK;ESLRKLKAHETFKR;
SLRKLKAHETFKRV;LRKLKAHETFKRVL;RKLKAHETFKRVLK;KLKAHETFKRVLKL;LKA
HETFKRVLKLR;KAHETFKRVLKLRE;AHETFKRVLKLREK;HETFKRVLKLREKI;ETFKRV
LKLREKIS;TFKRVLKLREKISM;FKRVLKLREKISMP;KRVLKLREKISMPE;RVLKLREKI
SMPEG;VLKLREKISMPEGS;LKLREKISMPEGSF;KLREKISMPEGSFQ;LREKISMPEGSF
QN;REKISMPEGSFQNF;EKISMPEGSFQNFI;KISMPEGSFQNFIE;ISMPEGSFQNFIEK;
SMPEGSFQNFIEKV;MPEGSFQNFIEKVE;PEGSFQNFIEKVES;EGSFQNFIEKVESD;GSF
QNFIEKVESDK;SFQNFIEKVESDKP;FQNFIEKVESDKPE;QNFIEKVESDKPEE;NFIEKV
ESDKPEES;FIEKVESDKPEESS;IEKVESDKPEESSS;EKVESDKPEESSSE;KVESDKPEE
SSSEN;

15 mers:

Fig. 43 continued

MKRRAKSILFFLLST;KRKAKSILFFLLSTA;RKAKSILFFLLSTAL;KAKSILFFLLSTALF
;AKSILFFLLSTALFA;KSILFFLLSTALFAQ;SILFFLLSTALFAQE;ILFFLLSTALFAQE
T;LFFLLSTALFAQETD;FFLLSTALFAQETDG;FLLSTALFAQETDGL;LLSTALFAQETDG
LT;LSTALFAQETDGLTE;STALFAQETDGLTEG;TALFAQETDGLTEGS;ALFAQETDGLTE
GSK;LFAQETDGLTEGSKR;FAQETDGLTEGSKRA;AQET YPLASSKM; KDDVPNYPLASSKMR; DDVPNYPLASSKMRF; DVPNYPLASSKMRFK; VPNYPL
ASSKMRFKA; PNYPLASSKMRFKAF; NYPLASSKMRFKAFR; YPLASSKMRFKAFRV; PLASS
KMRFKAFRVS; LASSKMRFKAFRVSK; ASSKMRFKAFRVSKS; SSKMRFKAFRVSKSH; SKMR
FKAFRVSKSHS; KMRFKAFRVSKSHSS; MRFKAFRVSKSHSSK; RFKAFRVSKSHSSKE; FKA
FRVSKSHSSKEQ; KAFRVSKSHSSKEQN; AFRVSKSHSSKEQNF; FRVSKSHSSKEQNFI; RV
SKSHSSKEQNFIF; VSKSHSSKEQNFIFY; SKSHSSKEQNFIFYV; KSHSSKEQNFIFYVK; S
HSSKEQNFIFYVKD; HSSKEQNFIFYVKDL; SSKEQNFIFYVKDLR; SKEQNFIFYVKDLRV;
KEQNFIFYVKDLRVL; EQNFIFYVKDLRVLY;QNFIFYVKDLRVLYD;NFIFYVKDLRVLYDK
;FIFYVKDLRVLYDKL;IFYVKDLRVLYDKLS;FYVKDLRVLYDKLSV;YVKDLRVLYDKLSV
S;VKDLRVLYDKLSVSI;KDLRVLYDKLSVSID;DLRVLYDKLSVSIDS;LRVLYDKLSVSID
SD;RVLYDKLSVSIDSDI;VLYDKLSVSIDSDID;LYDKLSVSIDSDIDS;YDKLSVSIDSDI
DSE;DKLSVSIDSDIDSES;KLSVSIDSDIDSESV;LSVSIDSDIDSESVF;SVSIDSDIDSE
SVFK;VSIDSDIDSESVFKV;SIDSDIDSESVFKVY;IDSDIDSESVFKVYE;DSDIDSESVF
KVYET;SDIDSESVFKVYETS;DIDSESVFKVYETSG;IDSESVFKVYETSGA;DSESVFKVY
ETSGAE;SESVFKVYETSGAES;ESVFKVYETSGAESL;SVFKVYETSGAESLR;VFKVYETS
GAESLRK;FKVYETSGAESLRKL;KVYETSGAESLRKLK;VYETSGAESLRKLKA;YETSGAE
SLRKLKAH;ETSGAESLRKLKAHE;TSGAESLRKLKAHET;SGAESLRKLKAHETF;GAESLR
KLKAHETFK;AESLRKLKAHETFKR;ESLRKLKAHETFKRV;SLRKLKAHETFKRVL;LRKLK
AHETFKRVLK;RKLKAHETFKRVLKL;KLKAHETFKRVLKLR;LKAHETFKRVLKLRE;KAHE
TFKRVLKLREK;AHETFKRVLKLREKI;HETFKRVLKLREKIS;ETFKRVLKLREKISM;TFK
RVLKLREKISMP;FKRVLKLREKISMPE;KRVLKLREKISMPEG;RVLKLREKISMPEGS;VL
KLREKISMPEGSF;LKLREKISMPEGSFQ;KLREKISMPEGSFQN;LREKISMPEGSFQNF;R
EKISMPEGSFQNFI;EKISMPEGSFQNFIE;KISMPEGSFQNFIEK;ISMPEGSFQNFIEKV;
SMPEGSFQNFIEKVE;MPEGSFQNFIEKVES;PEGSFQNFIEKVESD;EGSFQNFIEKVESDK
;GSFQNFIEKVESDKP;SFQNFIEKVESDKPE;FQNFIEKVESDKPEE;QNFIEKVESDKPEE
S;NFIEKVESDKPEESS;FIEKVESDKPEESSS;IEKVESDKPEESSSE;EKVESDKPEESSS
EN;

16 mers:
MKRKAKSILFFLLSTA;KRKAKSILFFLLSTAL;RKAKSILFFLLSTALF;KAKSILFFLLST
ALFA;AKSILFFLLSTALFAQ;KSILFFLLSTALFAQE;SILFFLLSTALFAQET;ILFFLLS
TALFAQETD;LFFLLSTALFAQETDG;FFLLSTALFAQETDGL;FLLSTALFAQETDGLT;LL
STALFAQETDGLTE;LSTALFAQETDGLTEG;STALFAQETDGLTEGS;TALFAQETDGLTEG
SK;ALFAQETDGLTEGSKR;LFAQETDGLTEGSKRA;FAQETDGLTEGSKRAE;AQETDGLTE
GSKRAEP;QETDGLTEGSKRAEPG;ETDGLTEGSKRAEPGE;TDGLTEGSKRAEPGEL;DGLT
EGSKRAEPGELV;GLTEGSKRAEPGELVL;LTEGSKRAEPGELVLD;TEGSKRAEPGELVLDF
;EGSKRAEPGELVLDFA;GSKRAEPGELVLDFAE;SKRAEPGELVLDFAEL;KRAEPGELVLD
FAELA;RAEPGELVLDFAELAR;AEPGELVLDFAELARD;EPGELVLDFAELARDP;PGELVL
DFAELARDPS;GELVLDFAELARDPSS;ELVLDFAELARDPSST;LVLDFAELARDPSSTK;V
LDFAELARDPSSTKL;LDFAELARDPSSTKLD;DFAELARDPSSTKLDL;FAELARDPSSTKL
DLT;AELARDPSSTKLDLTN;ELARDPSSTKLDLTNY;LARDPSSTKLDLTNYV;ARDPSSTK
LDLTNYVD;RDPSSTKLDLTNYVDY;DPSSTKLDLTNYVDYV;PSSTKLDLTNYVDYVY;SST
KLDLTNYVDYVYS;STKLDLTNYVDYVYSG;TKLDLTNYVDYVYSGA;KLDLTNYVDYVYSGA
S;LDLTNYVDYVYSGASG;DLTNYVDYVYSGASGI;LTNYVDYVYSGASGIV;TNYVDYVYSG
ASGIVK;NYVDYVYSGASGIVKP;YVDYVYSGASGIVKPE;VDYVYSGASGIVKPED;DYVYS
GASGIVKPEDM;YVYSGASGIVKPEDMV;VYSGASGIVKPEDMVV;YSGASGIVKPEDMVVD;
SGASGIVKPEDMVVDL;GASGIVKPEDMVVDLG;ASGIVKPEDMVVDLGI;SGIVKPEDMVVD
LGIS;GIVKPEDMVVDLGISN;IVKPEDMVVDLGISNW;VKPEDMVVDLGISNWS;KPEDMVV
DLGISNWSV;PEDMVVDLGISNWSVL;EDMVVDLGISNWSVLL;DMVVDLGISNWSVLLT;MV
VDLGISNWSVLLTP;VVDLGISNWSVLLTPS;VDLGISNWSVLLTPSA;DLGISNWSVLLTPS
AR;LGISNWSVLLTPSARL;GISNWSVLLTPSARLQ;ISNWSVLLTPSARLQA;SNWSVLLTP
SARLQAY;NWSVLLTPSARLQAYV;WSVLLTPSARLQAYVK;SVLLTPSARLQAYVKN;VLLT
PSARLQAYVKNS;LLTPSARLQAYVKNSV;LTPSARLQAYVKNSVV;TPSARLQAYVKNSVVA
;PSARLQAYVKNSVVAP;SARLQAYVKNSVVAPA;ARLQAYVKNSVVAPAL;RLQAYVKNSVV
APALV;LQAYVKNSVVAPALVK;QAYVKNSVVAPALVKS;AYVKNSVVAPALVKSE;YVKNSV
VAPALVKSES;VKNSVVAPALVKSESK;KNSVVAPALVKSESKR;NSVVAPALVKSESKRY;S
VVAPALVKSESKRYA;VVAPALVKSESKRYAG;VAPALVKSESKRYAGD;APALVKSESKRYA

Fig. 43 continued

GDT;PALVKSESKRYAGDTI;ALVKSESKRYAGDTIL;LVKSESKRYAGDTILG;VKSESKRY
AGDTILGV;KSESKRYAGDTILGVR;SESKRYAGDTILGVRV;ESKRYAGDTILGVRVL;SKR
YAGDTILGVRVLF;KRYAGDTILGVRVLFP;RYAGDTILGVRVLFPS;YAGDTILGVRVLFPS
Y;AGDTILGVRVLFPSYS;GDTILGVRVLFPSYSQ;DTILGVRVLFPSYSQS;TILGVRVLFP
SYSQSS;ILGVRVLFPSYSQSSA;LGVRVLFPSYSQSSAM;GVRVLFPSYSQSSAMI;VRVLF
PSYSQSSAMIM;RVLFPSYSQSSAMIMP;VLFPSY SMPEGSFQNFIEKVES;MPEGSFQNFIEKVESD;PEGSFQNFIEKVESDK;EGSFQNFIEKVE
SDKP;GSFQNFIEKVESDKPE;SFQNFIEKVESDKPEE;FQNFIEKVESDKPEES;QNFIEKV
ESDKPEESS;NFIEKVESDKPEESSS;FIEKVESDKPEESSSE;IEKVESDKPEESSSEN;

8 mers:
MKRKAKSI;KRKAKSIL;RKAKSILF;KAKSILFF;AKSILFFL;KSILFFLL;SILFFLLS;
ILFFLLST;LFFLLSTA;FFLLSTAL;FLLSTALF;LLSTALFA;LSTALFAQ;STALFAQE;
TALFAQET;ALFAQETD;LFAQETDG;FAQETDGL;AQETDGLT;QETDGLTE;ETDGLTEG;
TDGLTEGS;DGLTEGSK;GLTEGSKR;LTEGSKRA;TEGSKRAE;EGSKRAEP;GSKRAEPG;
SKRAEPGE;KRAEPGEL;RAEPGELV;AEPGELVL;EPGELVLD;PGELVLDF;GELVLDFA;
ELVLDFAE;LVLDFAEL;VLDFAELA;LDFAELAR;DFAELARD;FAELARDP;AELARDPS;
ELARDPSS;LARDPSST;ARDPSSTK;RDPSSTKL;DPSSTKLD;PSSTKLDL;SSTKLDLT;
STKLDLTN;TKLDLTNY;KLDLTNYV;LDLTNYVD;DLTNYVDY;LTNYVDYV;TNYVDYVY;
NYVDYVYS;YVDYVYSG;VDYVYSGA;DYVYSGAS;YVYSGASG;VYSGASGI;YSGASGIV;
SGASGIVK;GASGIVKP;ASGIVKPE;SGIVKPED;GIVKPEDM;IVKPEDMV;VKPEDMVV;
KPEDMVVD;PEDMVVDL;EDMVVDLG;DMVVDLGI;MVVDLGIS;VVDLGISN;VDLGISNW;
DLGISNWS;LGISNWSV;GISNWSVL;ISNWSVLL;SNWSVLLT;NWSVLLTP;WSVLLTPS;
SVLLTPSA;VLLTPSAR;LLTPSARL;LTPSARLQ;TPSARLQA;PSARLQAY;SARLQAYV;
ARLQAYVK;RLQAYVKN;LQAYVKNS;QAYVKNSV;AYVKNSVV;YVKNSVVA;VKNSVVAP;
KNSVVAPA;NSVVAPAL;SVVAPALV;VVAPALVK;VAPALVKS;APALVKSE;PALVKSES;
ALVKSESK;LVKSESKR;VKSESKRY;KSESKRYA;SESKRYAG;ESKRYAGD;SKRYAGDT;
KRYAGDTI;RYAGDTIL;YAGDTILG;AGDTILGV;GDTILGVR;DTILGVRV;TILGVRVL;
ILGVRVLF;LGVRVLFP;GVRVLFPS;VRVLFPSY;RVLFPSYS;VLFPSYSQ;LFPSYSQS;
FPSYSQSS;PSYSQSSA;SYSQSSAM;YSQSSAMI;SQSSAMIM;QSSAMIMP;SSAMIMPP;
SAMIMPPF;AMIMPPFK;MIMPPFKI;IMPPFKIP;MPPFKIPF;PPFKIPFY;PFKIPFYS;
FKIPFYSG;KIPFYSGE;IPFYSGES;PFYSGESG;FYSGESGN;YSGESGNQ;SGESGNQF;
GESGNQFL;ESGNQFLG;SGNQFLGK;GNQFLGKG;NQFLGKGL;QFLGKGLI;FLGKGLID;
LGKGLIDN;GKGLIDNI;KGLIDNIK;GLIDNIKT;LIDNIKTM;IDNIKTMK;DNIKTMKE;
NIKTMKEI;IKTMKEIK;KTMKEIKV;TMKEIKVS;MKEIKVSV;KEIKVSVY;EIKVSVYS;
IKVSVYSL;KVSVYSLG;VSVYSLGY;SVYSLGYE;VYSLGYEV;YSLGYEVD;SLGYEVDL;
LGYEVDLE;GYEVDLEV;YEVDLEVL;EVDLEVLF;VDLEVLFE;DLEVLFED;LEVLFEDM;
EVLFEDMN;VLFEDMNG;LFEDMNGM;FEDMNGME;EDMNGMEY;DMNGMEYA;MNGMEYAY;
NGMEYAYS;GMEYAYSL;MEYAYSLG;EYAYSLGT;YAYSLGTL;AYSLGTLK;YSLGTLKF;
SLGTLKFK;LGTLKFKG;GTLKFKGW;TLKFKGWA;LKFKGWAD;KFKGWADL;FKGWADLI;
KGWADLIW;GWADLIWS;WADLIWSN;ADLIWSNP;DLIWSNPN;LIWSNPNY;IWSNPNYI;
WSNPNYIP;SNPNYIPN;NPNYIPNI;PNYIPNIS;NYIPNISA;YIPNISAR;IPNISARI;
PNISARII;NISARIIK;ISARIIKD;SARIIKDD;ARIIKDDV;RIIKDDVP;IIKDDVPN;
IKDDVPNY;KDDVPNYP;DDVPNYPL;DVPNYPLA;VPNYPLAS;PNYPLASS;NYPLASSK;
YPLASSKM;PLASSKMR;LASSKMRF;ASSKMRFK;SSKMRFKA;SKMRFKAF;KMRFKAFR;
MRFKAFRV;RFKAFRVS;FKAFRVSK;KAFRVSKS;AFRVSKSH;FRVSKSHS;RVSKSHSS;
VSKSHSSK;SKSHSSKE;KSHSSKEQ;SHSSKEQN;HSSKEQNF;SSKEQNFI;SKEQNFIF;
KEQNFIFY;EQNFIFYV;QNFIFYVK;NFIFYVKD;FIFYVKDL;IFYVKDLR;FYVKDLRV;
YVKDLRVL;VKDLRVLY;KDLRVLYD;DLRVLYDK;LRVLYDKL;RVLYDKLS;VLYDKLSV;
LYDKLSVS;YDKLSVSI;DKLSVSID;KLSVSIDS;LSVSIDSD;SVSIDSDI;VSIDSDID;
SIDSDIDS;IDSDIDSE;DSDIDSES;SDIDSESV;DIDSESVF;IDSESVFK;DSESVFKV;
SESVFKVY;ESVFKVYE;SVFKVYET;VFKVYETS;FKVYETSG;KVYETSGA;VYETSGAE;
YETSGAES;ETSGAESL;TSGAESLR;SGAESLRK;GAESLRKL;AESLRKLK;ESLRKLKA;
SLRKLKAH;LRKLKAHE;RKLKAHET;KLKAHETF;LKAHETFK;KAHETFKR;AHETFKRV;
HETFKRVL;ETFKRVLK;TFKRVLKL;FKRVLKLR;KRVLKLRE;RVLKLREK;VLKLREKI;
LKLREKIS;KLREKISM;LREKISMP;REKISMPE;EKISMPEG;KISMPEGS;ISMPEGSF;
SMPEGSFQ;MPEGSFQN;PEGSFQNF;EGSFQNFI;GSFQNFIE;SFQNFIEK;FQNFIEKV;
QNFIEKVE;NFIEKVES;FIEKVESD;IEKVESDK;EKVESDKP;KVESDKPE;VESDKPEE;
ESDKPEES;SDKPEESS;DKPEESSS;KPEESSSE;PEESSSEN;

9 mers:
MKRKAKSIL;KRKAKSILF;RKAKSILFF;KAKSILFFL;AKSILFFLL;KSILFFLLS;SIL

Fig. 43 continued

FFLLST;ILFFLLSTA;LFFLLSTAL;FFLLSTALF;FLLSTALFA;LLSTALFAQ;LSTALF
AQE;STALFAQET;TALFAQETD;ALFAQETDG;LFAQETDGL;FAQETDGLT;AQETDGLTE
;QETDGLTEG;ETDGLTEGS;TDGLTEGSK;DGLTEGSKR;GLTEGSKRA;LTEGSKRAE;TE
GSKRAEP;EGSKRAEPG;GSKRAEPGE;SKRAEPGEL;KRAEPGELV;RAEPGELVL;AEPGE
LVLD;EPGELVLDF;PGELVLDFA;GELVLDFAE;ELVLDFAEL;LVLDFAELA;VLDFAELA
R;LDFAELARD;DFAELARDP;FAELARDPS;AELARDPSS;ELARDPSST;LARDPSSTK;A
RDPSSTKL;RDPSSTKLD;DPSSTKLDL;PSSTKLDLT;SSTKLDLTN;STKLDLTNY;TKLD
LTNYV;KLDLTNYVD;LDLTNYVDY;DLTNYVDYV;LTNYVDYVY;TNYVDYVYS;NYVDYVY
SG;YVDYVYSGA;VDYVYSGAS;DYVYSGASG;YVYSGASGI;VYSGASGIV;YSGASGIVK;
SGASGIVKP;GASGIVKPE;ASGIVKPED;SGIVKPEDM;GIVKPEDMV;IVKPEDMVV;VKP
EDMVVD;KPEDMVVDL;PEDMVVDLG;EDMVVDLGI

QETDGLTE;AQETDGLTEG;QETDGLTEGS;ETDGLTEGSK;TDGLTEGSKR;DGLTEGSKRA
;GLTEGSKRAE;LTEGSKRAEP;TEGSKRAEPG;EGSKRAEPGE;GSKRAEPGEL;SKRAEPG
ELV;KRAEPGELVL;RAEPGELVLD;AEPGELVLDF;EPGELVLDFA;PGELVLDFAE;GELV
LDFAEL;ELVLDFAELA;LVLDFAELAR;VLDFAELARD;LDFAELARDP;DFAELARDPS;F
AELARDPSS;AELARDPSST;ELARDPSSTK;LARDPSSTKL;ARDPSSTKLD;RDPSSTKLD
L;DPSSTKLDLT;PSSTKLDLTN;SSTKLDLTNY

MKRKAKSILFF; KRKAKSILFFL; RKAKSILFFLL; KAKSILFFLLS; AKSILFFLLST; KSI
LFFLLSTA; SILFFLLSTAL; ILFFLLSTALF; LFFLLSTALFA; FFLLSTALFAQ; FLLSTA
LFAQE; LLSTALFAQET; LSTALFAQETD; STALFAQETDG; TALFAQETDGL; ALFAQETDG
LT; LFAQETDGLTE; FAQETDGLTEG; AQETDGLTEGS; QETDGLTEGSK; ETDGLTEGSKR;
TDGLTEGSKRA; DGLTEGSKRAE; GLTEGSKRAEP; LTEGSKRAEPG; TEGSKRAEPGE; EGS
KRAEPGEL; GSKRAEPGELV; SKRAEPGELVL; KRAEPGELVLD; RAEPGELVLDF; AEPGEL
VLDFA; EPGELVLDFAE; PGELVLDFAEL; GELVLDFAELA; ELVLDFAELAR; LVLDFAELA
RD; VLDFAELARDP; LDFAELARDPS; DFAELARDPSS; FAELARDPSST; AELARDPSSTK;
ELARDPSSTKL; LARDPSSTKLD; ARDPSSTKLDL; RDPSSTKLDLT; DPSSTKLDLTN; PSS
TKLDLTNY; SSTKLDLTNYV; STKLDLTNYVD; TKL

| | |
|---|---|
| ETFKRVLK;AHETFKRVLKL;HETFKRVLKLR;ETFKRVLKLRE;TFKRVLKLREK;FKRVLK<br>LREKI;KRVLKLREKIS;RVLKLREKISM;VLKLREKISMP;LKLREKISMPE;KLREKISMP<br>EG;LREKISMPEGS;REKISMPEGSF;EKISMPEGSFQ;KISMPEGSFQN;ISMPEGSFQNF;<br>SMPEGSFQNFI;MPEGSFQNFIE;PEGSFQNFIEK;EGSFQNFIEKV;GSFQNFIEKVE;SFQ<br>NFIEKVES;FQNFIEKVESD;QNFIEKVESDK;NFIEKVESDKP;FIEKVESDKPE;IEKVES<br>DKPEE;EKVESDKPEES;KVESDKPEESS;VESDKPEESSS;ESDKPEESSSE;SDKPEESSS<br>EN | |
| <AAL23584.1 flagellin A;Borrelia garinii><br>MKRKAKSILLFLLSTALFAQETDGLPEGSKRSEPGELVLDFAELARDPSSTKLDLTNYVDYVY<br>SGASGIVKPEDMVVDLGINNWSVLLTPSARLQAYVKNSVVAPAVVKSESKRYAGDTILGVRVL<br>FPSYSQSSAMIMPPFKIPFYSGENGNQFLGKGLINNIKTMKEIKVSVYSLGYEIDLEVLFEDM<br>NGMEYAYSLGTLKFKGWADLIWSNPNYIPNISSRIIKDDVPNYPLASSKMRFKAFRVSKSHSS<br>KEQNFIFYVKDLRVLYDKLSVSIDSDIDSESVFKVYETSGTESLRKLKAHETFKRVLKLREKI<br>SMPEGSFQNFIEKVESEKKPEESSLKK<br><br><br>8 mers:<br>MKRKAKSI;KRKAKSIL;RKAKSILL;KAKSILLF;AKSILLFL;KSILLFLL;SILLFLLS;<br>ILLFLLST;LLFLLSTA;LFLLSTAL;FLLSTALF;LLSTALFA;LSTALFAQ;STALFAQE;<br>TALFAQET;ALFAQETD;LFAQETDG;FAQETDGL;AQETDGLP;QETDGLPE;ETDGLPEG;<br>TDGLPEGS;DGLPEGSK;GLPEGSKR;LPEGSKRS;PEGSKRSE;EGSKRSEP;GSKRSEPG;<br>SKRSEPGE;KRSEPGEL;RSEPGELV;SEPGELVL;EPGELVLD;PGELVLDF;GELVLDFA;<br>ELVLDFAE;LVLDFAEL;VLDFAELA;LDFAELAR;DFAELARD;FAELARDP;AELARDPS;<br>ELARDPSS;LARDPSST;ARDPSSTK;RDPSSTKL;DPSSTKLD;PSSTKLDL;SSTKLDLT;<br>STKLDLTN;TKLDLTNY;KLDLTNYV;LDLTNYVD;DLTNYVDY;LTNYVDYV;TNYVDYVY;<br>NYVDYVYS;YVDYVYSG;VDYVYSGA;DYVYSGAS;YVYSGASG;VYSGASGI;YSGASGIV;<br>SGASGIVK;GASGIVKP;ASGIVKPE;SGIVKPED;GIVKPEDM;IVKPEDMV;VKPEDMVV;<br>KPEDMVVD;PEDMVVDL;EDMVVDLG;DMVVDLGI;MVVDLGIN;VVDLGINN;VDLGINNW;<br>DLGINNWS;LGINNWSV;GINNWSVL;INNWSVLL;NNWSVLLT;NWSVLLTP;WSVLLTPS;<br>SVLLTPSA;VLLTPSAR;LLTPSARL;LTPSARLQ;TPSARLQA;PSARLQAY;SARLQAYV;<br>ARLQAYVK;RLQAYVKN;LQAYVKNS;QAYVKNSV;AYVKNSVV;YVKNSVVA;VKNSVVAP;<br>KNSVVAPA;NSVVAPAV;SVVAPAVV;VVAPAVVK;VAPAVVKS;APAVVKSE;PAVVKSES;<br>AVVKSESK;VVKSESKR;VKSESKRY;KSESKRYA;SESKRYAG;ESKRYAGD;SKRYAGDT;<br>KRYAGDTI;RYAGDTIL;YAGDTILG;AGDTILGV;GDTILGVR;DTILGVRV;TILGVRVL;<br>ILGVRVLF;LGVRVLFP;GVRVLFPS;VRVLFPSY;RVLFPSYS;VLFPSYSQ;LFPSYSQS;<br>FPSYSQSS;PSYSQSSA;SYSQSSAM;YSQSSAMI;SQSSAMIM;QSSAMIMP;SSAMIMPP;<br>SAMIMPPF;AMIMPPFK;MIMPPFKI;IMPPFKIP;MPPFKIPF;PPFKIPFY;PFKIPFYS;<br>FKIPFYSG;KIPFYSGE;IPFYSGEN;PFYSGENG;FYSGENGN;YSGENGNQ;SGENGNQF;<br>GENGNQFL;ENGNQFLG;NGNQFLGK;GNQFLGKG;NQFLGKGL;QFLGKGLI;FLGKGLIN;<br>LGKGLINN;GKGLINNI;KGLINNIK;GLINNIKT;LINNIKTM;INNIKTMK;NNIKTMKE;<br>NIKTMKEI;IKTMKEIK;KTMKEIKV;TMKEIKVS;MKEIKVSV;KEIKVSVY;EIKVSVYS;<br>IKVSVYSL;KVSVYSLG;VSVYSLGY;SVYSLGYE;VYSLGYEI;YSLGYEID;SLGYEIDL;<br>LGYEIDLE;GYEIDLEV;YEIDLEVL;EIDLEVLF;IDLEVLFE;DLEVLFED;LEVLFEDM;<br>EVLFEDMN;VLFEDMNG;LFEDMNGM;FEDMNGME;EDMNGMEY;DMNGMEYA;MNGMEYAY;<br>NGMEYAYS;GMEYAYSL;MEYAYSLG;EYAYSLGT;YAYSLGTL;AYSLGTLK;YSLGTLKF;<br>SLGTLKFK;LGTLKFKG;GTLKFKGW;TLKFKGWA;LKFKGWAD;KFKGWADL;FKGWADLI;<br>KGWADLIW;GWADLIWS;WADLIWSN;ADLIWSNP;DLIWSNPN;LIWSNPNY;IWSNPNYI;<br>WSNPNYIP;SNPNYIPN;NPNYIPNI;PNYIPNIS;NYIPNISS;YIPNISSR;IPNISSRI;<br>PNISSRII;NISSRIIK;ISSRIIKD;SSRIIKDD;SRIIKDDV;RIIKDDVP;IIKDDVPN;<br>IKDDVPNY;KDDVPNYP;DDVPNYPL;DVPNYPLA;VPNYPLAS;PNYPLASS;NYPLASSK;<br>YPLASSKM;PLASSKMR;LASSKMRF;ASSKMRFK;SSKMRFKA;SKMRFKAF;KMRFKAFR;<br>MRFKAFRV;RFKAFRVS;FKAFRVSK;KAFRVSKS;AFRVSKSH;FRVSKSHS;RVSKSHSS;<br>VSKSHSSK;SKSHSSKE;KSHSSKEQ;SHSSKEQN;HSSKEQNF;SSKEQNFI;SKEQNFIF;<br>KEQNFIFY;EQNFIFYV;QNFIFYVK;NFIFYVKD;FIFYVKDL;IFYVKDLR;FYVKDLRV;<br>YVKDLRVL;VKDLRVLY;KDLRVLYD;DLRVLYDK;LRVLYDKL;RVLYDKLS;VLYDKLSV;<br>LYDKLSVS;YDKLSVSI;DKLSVSID;KLSVSIDS;LSVSIDSD;SVSIDSDI;VSIDSDID;<br>SIDSDIDS;IDSDIDSE;DSDIDSES;SDIDSESV;DIDSESVF;IDSESVFK;DSESVFKV; | 210676-<br>213324 |

Fig. 43 continued

SESVFKVY; ESVFKVYE; SVFKVYET; VFKVYETS; FKVYETSG; KVYETSGT; VYETSGTE; YETSGTES; ETSGTESL; TSGTESLR; SGTESLRK; GTESLRKL; TESLRKLK; ESLRKLKA; SLRKLKAH; LRKLKAHE; RKLKAHET; KLKAHETF; LKAHETFK; KAHETFKR; AHETFKRV; HETFKRVL; ETFKRVLK; TFKRVLKL; FKRVLKLR; KRVLKLRE; RVLKLREK; VLKLREKI; LKLREKIS; KLREKISM; LREKISMP; REKISMPE; EKISMPEG; KISMPEGS;ISMPEGSF;
SMPEGSFQ;MPEGSFQN;PEGSFQNF;EGSFQNFI;GSFQNFIE;SFQNFIEK;FQNFIEKV;
QNFIEKVE;NFIEKVES;FIEKVESE;IEKVESEK;EKVESEKK;KVESEKKP;VESEKKPE;
ESEKKPEE;SEKKPEES;EKKPEESS;KKPEESSL;KPEESSLK;PEESSLKK;

9 mers:
MKRKAKSIL;KRKAKSILL;RKAKSILLF;KAKSILLFL;AKSILLFLL;KSILLFLLS;SIL
LFLLST;ILLFLLSTA;LLFLLSTAL;LFLLSTALF;FLLSTALFA;LLSTALFAQ;LSTALF
AQE;STALFAQET;TALFAQETD;ALFAQETDG;LFAQETDGL;FAQETDGLP;AQETDGLPE
;QETDGLPEG;ETDGLPEGS;TDGLPEGSK;DGLPEGSKR;GLPEGSKRS;LPEGSKRSE;PE
GSKRSEP;EGSKRSEPG;GSKRSEPGE;SKRSEPGEL;KRSEPGELV;RSEPGELVL;SEPGE
LVLD;EPGELVLDF;PGELVLDFA;GELVLDFAE;ELVLDFAEL;LVLDFAELA;VLDFAELA
R;LDFAELARD;DFAELARDP;FAELARDPS;AELARDPSS;ELARDPSST;LARDPSSTK;A
RDPSSTKL;RDPSSTKLD;DPSSTKLDL;PSSTKLDLT;SSTKLDLTN;STKLDLTNY;TKLD
LTNYV;KLDLTNYVD;LDLTNYVDY;DLTNYVDYV;LTNYVDYVY;TNYVDYVYS;NYVDYVY
SG;YVDYVYSGA;VDYVYSGAS;DYVYSGASG;YVYSGASGI;VYSGASGIV;YSGASGIVK;
SGASGIVKP;GASGIVKPE;ASGIVKPED;SGIVKPEDM;GIVKPEDMV;IVKPEDMVV;VKP
EDMVVD;KPEDMVVDL;PEDMVVDLG;EDMVVDLGI;DMVVDLGIN;MVVDLGINN;VVDLGI
NNW;VDLGINNWS;DLGINNWSV;LGINNWSVL;GINNWSVLL;INNWSVLLT;NNWSVLLTP
;NWSVLLTPS;WSVLLTPSA;SVLLTPSAR;VLLTPSARL;LLTPSARLQ;LTPSARLQA;TP
SARLQAY;PSARLQAYV;SARLQAYVK;ARLQAYVKN;RLQAYVKNS;LQAYVKNSV;QAYVK
NSVV;AYVKNSVVA;YVKNSVVAP;VKNSVVAPA;KNSVVAPAV;NSVVAPAVV;SVVAPAVV
K;VVAPAVVKS;VAPAVVKSE;APAVVKSES;PAVVKSESK;AVVKSESKR;VVKSESKRY;V
KSESKRYA;KSESKRYAG;SESKRYAGD;ESKRYAGDT;SKRYAGDTI;KRYAGDTIL;RYAG
DTILG;YAGDTILGV;AGDTILGVR;GDTILGVRV;DTILGVRVL;TILGVRVLF;ILGVRVL
FP;LGVRVLFPS;GVRVLFPSY;VRVLFPSYS;RVLFPSYSQ;VLFPSYSQS;LFPSYSQSS;
FPSYSQSSA;PSYSQSSAM;SYSQSSAMI;YSQSSAMIM;SQSSAMIMP;QSSAMIMPP;SSA
MIMPPF;SAMIMPPFK;AMIMPPFKI;MIMPPFKIP;IMPPFKIPF;MPPFKIPFY;PPFKIP
FYS;PFKIPFYSG;FKIPFYSGE;KIPFYSGEN;IPFYSGENG;PFYSGENGN;FYSGENGNQ
;YSGENGNQF;SGENGNQFL;GENGNQFLG;ENGNQFLGK;NGNQFLGKG;GNQFLGKGL;NQ
FLGKGLI;QFLGKGLIN;FLGKGLINN;LGKGLINNI;GKGLINNIK;KGLINNIKT;GLINN
IKTM;LINNIKTMK;INNIKTMKE;NNIKTMKEI;NIKTMKEIK;IKTMKEIKV;KTMKEIKV
S;TMKEIKVSV;MKEIKVSVY;KEIKVSVYS;EIKVSVYSL;IKV3VYSLG;KVSVYSLGY;V
SVYSLGYE;SVYSLGYEI;VYSLGYEID;YSLGYEIDL;SLGYEIDLE;LGYEIDLEV;GYEI
DLEVL;YEIDLEVLF;EIDLEVLFE;IDLEVLFED;DLEVLFEDM;LEVLFEDMN;EVLFEDM
NG;VLFEDMNGM;LFEDMNGME;FEDMNGMEY;EDMNGMEYA;DMNGMEYAY;MNGMEYAYS;
NGMEYAYSL;GMEYAYSLG;MEYAYSLGT;EYAYSLGTL;YAYSLGTLK;AYSLGTLKF;YSL
GTLKFK;SLGTLKFKG;LGTLKFKGW;GTLKFKGWA;TLKFKGWAD;LKFKGWADL;KFKGWA
DLI;FKGWADLIW;KGWADLIWS;GWADLIWSN;WADLIWSNP;ADLIWSNPN;DLIWSNPNY
;LIWSNPNYI;IWSNPNYIP;WSNPNYIPN;SNPNYIPNI;NPNYIPNIS;PNYIPNISS;NY
IPNISSR;YIPNISSRI;IPNISSRII;PNISSRIIK;NISSRIIKD;ISSRIIKDD;SSRII
KDDV;SRIIKDDVP;RIIKDDVPN;IIKDDVPNY;IKDDVPNYP;KDDVPNYPL;DDVPNYPL
A;DVPNYPLAS;VPNYPLASS;PNYPLASSK;NYPLASSKM;YPLASSKMR;PLASSKMRF;L
ASSKMRFK;ASSKMRFKA;SSKMRFKAF;SKMRFKAFR;KMRFKAFRV;MRFKAFRVS;RFKA
FRVSK;FKAFRVSKS;KAFRVSKSH;AFRVSKSHS;FRVSKSHSS;RVSKSHSSK;VSKSHSS
KE;SKSHSSKEQ;KSHSSKEQN;SHSSKEQNF;HSSKEQNFI;SSKEQNFIF;SKEQNFIFY;
KEQNFIFYV;EQNFIFYVK;QNFIFYVKD;NFIFYVKDL;FIFYVKDLR;IFYVKDLRV;FYV
KDLRVL;YVKDLRVLY;VKDLRVLYD;KDLRVLYDK;DLRVLYDKL;LRVLYDKLS;RVLYDK
LSV;VLYDKLSVS;LYDKLSVSI;YDKLSVSID;DKLSVSIDS;KLSVSIDSD;LSVSIDSDI
;SVSIDSDID;VSIDSDIDS;SIDSDIDSE;IDSDIDSES;DSDIDSESV;SDIDSESVF;DI
DSESVFK;IDSESVFKV;DSESVFKVY;SESVFKVYE;ESVFKVYET;SVFKVYETS;VFKVY
ETSG;FKVYETSGT;KVYETSGTE;VYETSGTES;YETSGTESL;ETSGTESLR;TSGTESLR
K;SGTESLRKL;GTESLRKLK;TESLRKLKA;ESLRKLKAH;SLRKLKAHE;LRKLKAHET;R

Fig. 43 continued

KLKAHETF;KLKAHETFK;LKAHETFKR;KAHETFKRV;AHETFKRVL;HETFKRVLK;ETFK
RVLKL;TFKRVLKLR;FKRVLKLRE;KRVLKLREK;RVLKLREKI;VLKLREKIS;LKLREKI
SM;KLREKISMP;LREKISMPE;REKISMPEG;EKISMPEGS;KISMPEGSF;ISMPEGSFQ;
SMPEGSFQN;MPEGSFQNF;PEGSFQNFI;EGSFQNFIE;GSFQNFIEK;SFQNFIEKV;FQN
FIEKVE;QNFIEKVES;NFIEKVESE;FIEKVESEK;IEKVESEKK;EKVESEKKP;KVESEK
KPE;VESEKKPEE;ESEKKPEES;SEKKPEESS;EKKPEESSL;KKPEESSLK;KPEESSLKK
;

10 mers:
MKRKAKSILL;KRKAKSILLF;RKAKSILLFL;KAKSILLFLL;AKSILLFLLS;KSILLFLL
ST;SILLFLLSTA;ILLFLLSTAL;LLFLLSTALF;LFLLSTALFA;FLLSTALFAQ;LLSTA
LFAQE;LSTALFAQET;STALFAQETD;TALFAQETDG;ALFAQETDGL;LFAQETDGLP;FA
QETDGLPE;AQETDGLPEG;QETDGLPEGS;ETDGLPEGSK;TDGLPEGSKR;DGLPEGSKRS
;GLPEGSKRSE;LPEGSKRSEP;PEGSKRSEPG;EGSKRSEPGE;GSKRSEPGEL;SKRSEPG
ELV;KRSEPGELVL;RSEPGELVLD;SEPGELVLDF;EPGELVLDFA;PGELVLDFAE;GELV
LDFAEL;ELVLDFAELA;LVLDFAELAR;VLDFAELARD;LDFAELARDP;DFAELARDPS;F
AELARDPSS;AELARDPSST;ELARDPSSTK;LARDPSSTKL;ARDPSSTKLD;RDPSSTKLD
L;DPSSTKLDLT;PSSTKLDLTN;SSTKLDLTNY;STKLDLTNYV;TKLDLTNYVD;KLDLTN
YVDY;LDLTNYVDYV;DLTNYVDYVY;LTNYVDYVYS;TNYVDYVYSG;NYVDYVYSGA;YVD
YVYSGAS;VDYVYSGASG;DYVYSGASGI;YVYSGASGIV;VYSGASGIVK;YSGASGIVKP;
SGASGIVKPE;GASGIVKPED;ASGIVKPEDM;SGIVKPEDMV;GIVKPEDMVV;IVKPEDMV
VD;VKPEDMVVDL;KPEDMVVDLG;PEDMVVDLGI;EDMVVDLGIN;DMVVDLGINN;MVVDL
GINNW;VVDLGINNWS;VDLGINNWSV;DLGINNWSVL;LGINNWSVLL;GINNWSVLLT;IN
NWSVLLTP;NNWSVLLTPS;NWSVLLTPSA;WSVLLTPSAR;SVLLTPSARL;VLLTPSARLQ
;LLTPSARLQA;LTPSARLQAY;TPSARLQAYV;PSARLQAYVK;SARLQAYVKN;ARLQAYV
KNS;RLQAYVKNSV;LQAYVKNSVV;QAYVKNSVVA;AYVKNSVVAP;YVKNSVVAPA;VKNS
VVAPAV;KNSVVAPAVV;NSVVAPAVVK;SVVAPAVVKS;VVAPAVVKSE;VAPAVVKSES;A
PAVVKSESK;PAVVKSESKR;AVVKSESKRY;VVKSESKRYA;VKSESKRYAG;KSESKRYAG
D;SESKRYAGDT;ESKRYAGDTI;SKRYAGDTIL;KRYAGDTILG;RYAGDTILGV;YAGDTI
LGVR;AGDTILGVRV;GDTILGVRVL;DTILGVRVLF;TILGVRVLFP;ILGVRVLFPS;LGV
RVLFPSY;GVRVLFPSYS;VRVLFPSYSQ;RVLFPSYSQS;VLFPSYSQSS;LFPSYSQSSA;
FPSYSQSSAM;PSYSQSSAMI;SYSQSSAMIM;YSQSSAMIMP;SQSSAMIMPP;QSSAMIMP
PF;SSAMIMPPFK;SAMIMPPFKI;AMIMPPFKIP;MIMPPFKIPF;IMPPFKIPFY;MPPFK
IPFYS;PPFKIPFYSG;PFKIPFYSGE;FKIPFYSGEN;KIPFYSGENG;IPFYSGENGN;PF
YSGENGNQ;FYSGENGNQF;YSGENGNQFL;SGENGNQFLG;GENGNQFLGK;ENGNQFLGKG
;NGNQFLGKGL;GNQFLGKGLI;NQFLGKGLIN;QFLGKGLINN;FLGKGLINNI;LGKGLIN
NIK;GKGLINNIKT;KGLINNIKTM;GLINNIKTMK;LINNIKTMKE;INNIKTMKEI;NNIK
TMKEIK;NIKTMKEIKV;IKTMKEIKVS;KTMKEIKVSV;TMKEIKVSVY;MKEIKVSVYS;K
EIKVSVYSL;EIKVSVYSLG;IKVSVYSLGY;KVSVYSLGYE;VSVYSLGYEI;SVYSLGYEI
D;VYSLGYEIDL;YSLGYEIDLE;SLGYEIDLEV;LGYEIDLEVL;GYEIDLEVLF;YEIDLE
VLFE;EIDLEVLFED;IDLEVLFEDM;DLEVLFEDMN;LEVLFEDMNG;EVLFEDMNGM;VLF
EDMNGME;LFEDMNGMEY;FEDMNGMEYA;EDMNGMEYAY;DMNGMEYAYS;MNGMEYAYSL;
NGMEYAYSLG;GMEYAYSLGT;MEYAYSLGTL;EYAYSLGTLK;YAYSLGTLKF;AYSLGTLK
FK;YSLGTLKFKG;SLGTLKFKGW;LGTLKFKGWA;GTLKFKGWAD;TLKFKGWADL;LKFKG
WADLI;KFKGWADLIW;FKGWADLIWS;KGWADLIWSN;GWADLIWSNP;WADLIWSNPN;AD
LIWSNPNY;DLIWSNPNYI;LIWSNPNYIP;IWSNPNYIPN;WSNPNYIPNI;SNPNYIPNIS
;NPNYIPNISS;PNYIPNISSR;NYIPNISSRI;YIPNISSRII;IPNISSRIIK;PNISSRI
IKD;NISSRIIKDD;ISSRIIKDDV;SSRIIKDDVP;SRIIKDDVPN;RIIKDDVPNY;IIKD
DVPNYP;IKDDVPNYPL;KDDVPNYPLA;DDVPNYPLAS;DVPNYPLASS;VPNYPLASSK;P
NYPLASSKM;NYPLASSKMR;YPLASSKMRF;PLASSKMRFK;LASSKMRFKA;ASSKMRFKA
F;SSKMRFKAFR;SKMRFKAFRV;KMRFKAFRVS;MRFKAFRVSK;RFKAFRVSKS;FKAFRV
SKSH;KAFRVSKSHS;AFRVSKSHSS;FRVSKSHSSK;RVSKSHSSKE;VSKSHSSKEQ;SKS
HSSKEQN;KSHSSKEQNF;SHSSKEQNFI;HSSKEQNFIF;SSKEQNFIFY;SKEQNFIFYV;
KEQNFIFYVK;EQNFIFYVKD;QNFIFYVKDL;NFIFYVKDLR;FIFYVKDLRV;IFYVKDLR
VL;FYVKDLRVLY;YVKDLRVLYD;VKDLRVLYDK;KDLRVLYDKL;DLRVLYDKLS;LRVLY
DKLSV;RVLYDKLSVS;VLYDKLSVSI;LYDKLSVSID;YDKLSVSIDS;DKLSVSIDSD;KL
SVSIDSDI;LSVSIDSDID;SVSIDSDIDS;VSIDSDIDSE;SIDSDIDSES;IDSDIDSESV

Fig. 43 continued

;DSDIDSESVF;SDIDSESVFK;DIDSESVFKV;IDSESVFKVY;DSESVFKVYE;SESVFKV
YET;ESVFKVYETS;SVFKVYETSG;VFKVYETSGT;FKVYETSGTE;KVYETSGTES;VYET
SGTESL;YETSGTESLR;ETSGTESLRK;TSGTESLRKL;SGTESLRKLK;GTESLRKLKA;T
ESLRKLKAH;ESLRKLKAHE;SLRKLKAHET;LRKLKAHETF;RKLKAHETFK;KLKAHETFK
R;LKAHETFKRV;KAHETFKRVL;AHETFKRVLK;HETFKRVLKL;ETFKRVLKLR;TFKRVL
KLRE;FKRVLKLREK;KRVLKLREKI;RVLKLREKIS;VLKLREKISM;LKLREKISMP;KLR
EKISMPE;LREKISMPEG;REKISMPEGS;EKISMPEGSF;KISMPEGSFQ;ISMPEGSFQN;
SMPEGSFQNF;MPEGSFQNFI;PEGSFQNFIE;EGSFQNFIEK;GSFQNFIEKV;SFQNFIEK
VE;FQNFIEKVES;QNFIEKVESE;NFIEKVESEK;FIEKVESEKK;IEKVESEKKP;EKVES
EKKPE;KVESEKKPEE;VESEKKPEES;ESEKKPEESS;SEKKPEESSL;EKKPEESSLK;KK
PEESSLKK;

11 mers:
MKRKAKSILLF;KRKAKSILLFL;RKAKSILLFLL;KAKSILLFLLS;AKSILLFLLST;KSI
LLFLLSTA;SILLFLLSTAL;ILLFLLSTALF;LLFLLSTALFA;LFLLSTALFAQ;FLLSTA
LFAQE;LLSTALFAQET;LSTALFAQETD;STALFAQETDG;TALFAQETDGL;ALFAQETDG
LP;LFAQETDGLPE;FAQETDGLPEG;AQETDGLPEGS;QETDGLPEGSK;ETDGLPEGSKR;
TDGLPEGSKRS;DGLPEGSKRSE;GLPEGSKRSEP;LPEGSKRSEPG;PEGSKRSEPGE;EGS
KRSEPGEL;GSKRSEPGELV;SKRSEPGELVL;KRSEPGELVLD;RSEPGELVLDF;SEPGEL
VLDFA;EPGELVLDFAE;PGELVLDFAEL;GELVLDFAELA;ELVLDFAELAR;LVLDFAELA
RD;VLDFAELARDP;LDFAELARDPS;DFAELARDPSS;FAELARDPSST;AELARDPSSTK;
ELARDPSSTKL;LARDPSSTKLD;ARDPSSTKLDL;RDPSSTKLDLT;DPSSTKLDLTN;PSS
TKLDLTNY;SSTKLDLTNYV;STKLDLTNYVD;TKLDLTNYVDY;KLDLTNYVDYV;LDLTNY
VDYVY;DLTNYVDYVYS;LTNYVDYVYSG;TNYVDYVYSGA;NYVDYVYSGAS;YVDYVYSGA
SG;VDYVYSGASGI;DYVYSGASGIV;YVYSGASGIVK;VYSGASGIVKP;YSGASGIVKPE;
SGASGIVKPED;GASGIVKPEDM;ASGIVKPEDMV;SGIVKPEDMVV;GIVKPEDMVVD;IVK
PEDMVVDL;VKPEDMVVDLG;KPEDMVVDLGI;PEDMVVDLGIN;EDMVVDLGINN;DMVVDL
GINNW;MVVDLGINNWS;VVDLGINNWSV;VDLGINNWSVL;DLGINNWSVLL;LGINNWSVL
LT;GINNWSVLLTP;INNWSVLLTPS;NNWSVLLTPSA;NWSVLLTPSAR;WSVLLTPSARL;
SVLLTPSARLQ;VLLTPSARLQA;LLTPSARLQAY;LTPSARLQAYV;TPSARLQAYVK;PSA
RLQAYVKN;SARLQAYVKNS;ARLQAYVKNSV;RLQAYVKNSVV;LQAYVKNSVVA;QAYVKN
SVVAP;AYVKNSVVAPA;YVKNSVVAPAV;VKNSVVAPAVV;KNSVVAPAVVK;NSVVAPAVV
KS;SVVAPAVVKSE;VVAPAVVKSES;VAPAVVKSESK;APAVVKSESKR;PAVVKSESKRY;
AVVKSESKRYA;VVKSESKRYAG;VKSESKRYAGD;KSESKRYAGDT;SESKRYAGDTI;ESK
RYAGDTIL;SKRYAGDTILG;KRYAGDTILGV;RYAGDTILGVR;YAGDTILGVRV;AGDTIL
GVRVL;GDTILGVRVLF;DTILGVRVLFP;TILGVRVLFPS;ILGVRVLFPSY;LGVRVLFPS
YS;GVRVLFPSYSQ;VRVLFPSYSQS;RVLFPSYSQSS;VLFPSYSQSSA;LFPSYSQSSAM;
FPSYSQSSAMI;PSYSQSSAMIM;SYSQSSAMIMP;YSQSSAMIMPP;SQSSAMIMPPF;QSS
AMIMPPFK;SSAMIMPPFKI;SAMIMPPFKIP;AMIMPPFKIPF;MIMPPFKIPFY;IMPPFK
IPFYS;MPPFKIPFYSG;PPFKIPFYSGE;PFKIPFYSGEN;FKIPFYSGENG;KIPFYSGEN
GN;IPFYSGENGNQ;PFYSGENGNQF;FYSGENGNQFL;YSGENGNQFLG;SGENGNQFLGK;
GENGNQFLGKG;ENGNQFLGKGL;NGNQFLGKGLI;GNQFLGKGLIN;NQFLGKGLINN;QFL
GKGLINNI;FLGKGLINNIK;LGKGLINNIKT;GKGLINNIKTM;KGLINNIKTMK;GLINNI
KTMKE;LINNIKTMKEI;INNIKTMKEIK;NNIKTMKEIKV;NIKTMKEIKVS;IKTMKEIKV
SV;KTMKEIKVSVY;TMKEIKVSVYS;MKEIKVSVYSL;KEIKVSVYSLG;EIKVSVYSLGY;
IKVSVYSLGYE;KVSVYSLGYEI;VSVYSLGYEID;SVYSLGYEIDL;VYSLGYEIDLE;YSL
GYEIDLEV;SLGYEIDLEVL;LGYEIDLEVLF;GYEIDLEVLFE;YEIDLEVLFED;EIDLEV
LFEDM;IDLEVLFEDMN;DLEVLFEDMNG;LEVLFEDMNGM;EVLFEDMNGME;VLFEDMNGM
EY;LFEDMNGMEYA;FEDMNGMEYAY;EDMNGMEYAYS;DMNGMEYAYSL;MNGMEYAYSLG;
NGMEYAYSLGT;GMEYAYSLGTL;MEYAYSLGTLK;EYAYSLGTLKF;YAYSLGTLKFK;AYS
LGTLKFKG;YSLGTLKFKGW;SLGTLKFKGWA;LGTLKFKGWAD;GTLKFKGWADL;TLKFKG
WADLI;LKFKGWADLIW;KFKGWADLIWS;FKGWADLIWSN;KGWADLIWSNP;GWADLIWSN
PN;WADLIWSNPNY;ADLIWSNPNYI;DLIWSNPNYIP;LIWSNPNYIPN;IWSNPNYIPNI;
WSNPNYIPNIS;SNPNYIPNISS;NPNYIPNISSR;PNYIPNISSRI;NYIPNISSRII;YIP
NISSRIIK;IPNISSRIIKD;PNISSRIIKDD;NISSRIIKDDV;ISSRIIKDDVP;SSRIIK
DDVPN;SRIIKDDVPNY;RIIKDDVPNYP;IIKDDVPNYPL;IKDDVPNYPLA;KDDVPNYPL
AS;DDVPNYPLASS;DVPNYPLASSK;VPNYPLASSKM;PNYPLASSKMR;NYPLASSKMRF;

Fig. 43 continued

YPLASSKMRFK;PLASSKMRFKA;LASSKMRFKAF;ASSKMRFKAFR;SSKMRFKAFRV;SKM
RFKAFRVS;KMRFKAFRVSK;MRFKAFRVSKS;RFKAFRVSKSH;FKAFRVSKSHS;KAFRVS
KSHSS;AFRVSKSHSSK;FRVSKSHSSKE;RVSKSHSSKEQ;VSKSHSSKEQN;SKSHSSKEQ
NF;KSHSSKEQNFI;SHSSKEQNFIF;HSSKEQ

FLGKGLINNIKTM;LGKGLINNIKTMK;GKGLINNIKTMKE;KGLINNIKTMKEI;GLINNIK
TMKEIK;LINNIKTMKEIKV;INNIKTMKEIKVS;NNIKTMKEIKVSV;NIKTMKEIKVSVY;
IKTMKEIKVSVYS;KTMKEIKVSVYSL;TMKEIKVSVYSLG;MKEIKVSVYSLGY;KEIKVSV
YSLGYE;EIKVSVYSLGYEI;IKVSVYSLGYEID;KVSVYSLGYEIDL;VSVYSLGYEIDLE;
SVYSLGYEIDLEV;VYSLGYEIDLEVL;YSLGYEIDLEVLF;SLGYEIDLEVLFE;LGYEIDL
EVLFED;GYEIDLEVLFEDM;YEIDLEVLFEDMN;EIDLEVLFEDMNG;IDLEVLFEDMNGM;
DLEVLFEDMNGME;LEVLFEDMNGMEY;EVLFEDMNGMEYA;VLFEDMNGMEYAY;LFEDMNG
MEYAYS;FEDMNGMEYAYSL;EDMNGMEYAYSLG;DMNGMEYAYSLGT;MNGMEYAYSLGTL;
NGMEYAYSLGTLK;GMEYAYSLGTLKF;MEYAYSLGTLKFK;EYAYSLGTLKFKG;YAYSLGT
LKFKGW;AYSLGTLKFKGWA;YSLGTLKFKGWAD;SLGTLKFKGWADL;LGTLKFKGWADLI;
GTLKFKGWADLIW;TLKFKGWADLIWS;LKFKGWADLIWSN;KFKGWADLIWSNP;FKGWADL
IWSNPN;KGWADLIWSNPNY;GWADLIWSNPNYI;WADLIWSNPNYIP;ADLIWSNPNYIPN;
DLIWSNPNYIPNI;LIWSNPNYIPNIS;IWSNPNYIPNISS;WSNPNYIPNISSR;SNPNYIP
NISSRI;NPNYIPNISSRII;PNYIPNISSRIIK;NYIPNISSRIIKD;YIPNISSRIIKDD;
IPNISSRIIKDDV;PNISSRIIKDDVP;NISSRIIKDDVPN;ISSRIIKDDVPNY;SSRIIKD
DVPNYP;SRIIKDDVPNYPL;RIIKDDVPNYPLA;IIKDDVPNYPLAS;IKDDVPNYPLASS;
KDDVPNYPLASSK;DDVPNYPLASSKM;DVPNYPLASSKMR;VPNYPLASSKMRF;PNYPLAS
SKMRFK;NYPLASSKMRFKA;YPLASSKMRFKAF;PLASSKMRFKAFR;LASSKMRFKAFRV;
ASSKMRFKAFRVS;SSKMRFKAFRVSK;SKMRFKAFRVSKS;KMRFKAFRVSKSH;MRFKAFR
VSKSHS;RFKAFRVSKSHSS;FKAFRVSKSHSSK;KAFRVSKSHSSKE;AFRVSKSHSSKEQ;
FRVSKSHSSKEQN;RVSKSHSSKEQNF;VSKSHSSKEQNFI;SKSHSSKEQNFIF;KSHSSKE
QNFIFY;SHSSKEQNFIFYV;HSSKEQNFIFYVK;SSKEQNFIFYVKD;SKEQNFIFYVKDL;
KEQNFIFYVKDLR;EQNFIFYVKDLRV;QNFIFYVKDLRVL;NFIFYVKDLRVLY;FIFYVKD
LRVLYD;IFYVKDLRVLYDK;FYVKDLRVLYDKL;YVKDLRVLYDKLS;VKDLRVLYDKLSV;
KDLRVLYDKLSVS;DLRVLYDKLSVSI;LRVLYDKLSVSID;RVLYDKLSVSIDS;VLYDKLS
VSIDSD;LYDKLSVSIDSDI;YDKLSVSIDSDID;DKLSVSIDSDIDS;KLSVSIDSDIDSE;
LSVSIDSDIDSES;SVSIDSDIDSESV;VSIDSDIDSESVF;SIDSDIDSESVFK;IDSDIDS
ESVFKV;DSDIDSESVFKVY;SDIDSESVFKVYE;DIDSESVFKVYET;IDSESVFKVYETS;
DSESVFKVYETSG;SESVFKVYETSGT;ESVFKVYETSGTE;SVFKVYETSGTES;VFKVYET
SGTESL;FKVYETSGTESLR;KVYETSGTESLRK;VYETSGTESLRKL;YETSGTESLRKLK;
ETSGTESLRKLKA;TSGTESLRKLKAH;SGTESLRKLKAHE;GTESLRKLKAHET;TESLRKL
KAHETF;ESLRKLKAHETFK;SLRKLKAHETFKR;LRKLKAHETFKRV;RKLKAHETFKRVL;
KLKAHETFKRVLK;LKAHETFKRVLKL;KAHETFKRVLKLR;AHETFKRVLKLRE;HETFKRV
LKLREK;ETFKRVLKLREKI;TFKRVLKLREKIS;FKRVLKLREKISM;KRVLKLREKISMP;
RVLKLREKISMPE;VLKLREKISMPEG;LKLREKISMPEGS;KLREKISMPEGSF;LREKISM
PEGSFQ;REKISMPEGSFQN;EKISMPEGSFQNF;KISMPEGSFQNFI;ISMPEGSFQNFIE;
SMPEGSFQNFIEK;MPEGSFQNFIEKV;PEGSFQNFIEKVE;EGSFQNFIEKVES;GSFQNFI
EKVESE;SFQNFIEKVESEK;FQNFIEKVESEKK;QNFIEKVESEKKP;NFIEKVESEKKPE;
FIEKVESEKKPEE;IEKVESEKKPEES;EKVESEKKPEESS;KVESEKKPEESSL;VESEKKP
EESSLK;ESEKKPEESSLKK;

14 mers:
MKRKAKSILLFLLS;KRKAKSILLFLLST;RKAKSILLFLLSTA;KAKSILLFLLSTAL;AKS
ILLFLLSTALF;KSILLFLLSTALFA;SILLFLLSTALFAQ;ILLFLLSTALFAQE;LLFLLS
TALFAQET;LFLLSTALFAQETD;FLLSTALFAQETDG;LLSTALFAQETDGL;LSTALFAQE
TDGLP;STALFAQETDGLPE;TALFAQETDGLPEG;ALFAQETDGLPEGS;LFAQETDGLPEG
SK;FAQETDGLPEGSKR;AQETDGLPEGSKRS;QETDGLPEGSKRSE;ETDGLPEGSKRSEP;
TDGLPEGSKRSEPG;DGLPEGSKRSEPGE;GLPEGSKRSEPGEL;LPEGSKRSEPGELV;PEG
SKRSEPGELVL;EGSKRSEPGELVLD;GSKRSEPGELVLDF;SKRSEPGELVLDFA;KRSEPG
ELVLDFAE;RSEPGELVLDFAEL;SEPGELVLDFAELA;EPGELVLDFAELAR;PGELVLDFA
ELARD;GELVLDFAELARDP;ELVLDFAELARDPS;LVLDFAELARDPSS;VLDFAELARDPS
ST;LDFAELARDPSSTK;DFAELARDPSSTKL;FAELARDPSSTKLD;AELARDPSSTKLDL;
ELARDPSSTKLDLT;LARDPSSTKLDLTN;ARDPSSTKLDLTNY;RDPSSTKLDLTNYV;DPS
STKLDLTNYVD;PSSTKLDLTNYVDY;SSTKLDLTNYVDYV;STKLDLTNYVDYVY;TKLDLT
NYVDYVYS;KLDLTNYVDYVYSG;LDLTNYVDYVYSGA;DLTNYVDYVYSGAS;LTNYVDYVY
SGASG;TNYVDYVYSGASGI;NYVDYVYSGASGIV;YVDYVYSGASGIVK;VDYVYSGASGIV
KP;DYVYSGASGIVKPE;YVYSGASGIVKPED;VYSGASGIVKPEDM;YSGASGIVKPEDMV;

Fig. 43 continued

SGASGIVKPEDMVV; GASGIVKPEDMVVD; ASGIVKPEDMVVDL; SGIVKPEDMVVDLG; GIV
KPEDMVVDLGI; IVKPEDMVVDLGIN; VKPEDMVVDLGINN; KPEDMVVDLGINNW; PEDMVV
DLGINNWS; EDMVVDLGINNWSV; DMVVDLGINNWSVL; MVVDLGINNWSVLL; VVDLGINNW
SVLLT; VDLGINNWSVLLTP; DLGINNWSVLLTPS; LGINNWSVLLTPSA; GINNWSVLLTPS
AR; INNWSVLLTPSARL; NNWSVLLTPSARLQ; NWSVLLTPSARLQA; WSVLLTPSARLQAY;
SVLLTPSARLQAYV; VLLTPSARLQAYVK; LLTPSARLQAYVKN; LTPSARLQAYVKNS; TPS
ARLQAYVKNSV; PSARLQAYVKNSVV; SARLQAYVKNSVVA; ARLQAYVKNSVVAP; RLQAYV

LKLREKIS;TFKRVLKLREKISM;FKRVLKLREKISMP;KRVLKLREKISMPE;RVLKLREKI
SMPEG;VLKLREKISMPEGS;LKLREKISMPEGSF;KLREKISMPEGSFQ;LREKISMPEGSF
QN;REKISMPEGSFQNF;EKISMPEGSFQNFI;KISMPEGSFQNFIE;ISMPEGSFQNFIEK;
SMPEGSFQNFIEKV;MPEGSFQNFIEKVE;PEGSFQNFIEKVES;EGSFQNFIEKVESE;GSF
QNFIEKVESEK;SFQNFIEKVESEKK;FQNFIEKVESEKKP;QNFIEKVESEKKPE;NFIEKV
ESEKKPEE;FIEKVESEKKPEES;IEKVESEKKPEESS;EKVESEKKPEESSL;KVESEKKPE
ESSLK;VESEKKPEESSLKK;

15 mers:
MKRKAKSILLFLLST;KRKAKSILLFLLSTA;RKAKSILLFLLSTAL;KAKSILLFLLSTALF
;AKSILLFLLSTALFA;KSILLFLLSTALFAQ;SILLFLLSTALFAQE;ILLFLLSTALFAQE
T;LLFLLSTALFAQETD;LFLLSTALFAQETDG;FLLSTALFAQETDGL;LLSTALFAQETDG
LP;LSTALFAQETDGLPE;STALFAQETDGLPEG;TALFAQETDGLPEGS;ALFAQETDGLPE
GSK;LFAQETDGLPEGSKR;FAQETDGLPEGSKRS;AQETDGLPEGSKRSE;QETDGLPEGSK
RSEP;ETDGLPEGSKRSEPG;TDGLPEGSKRSEPGE;DGLPEGSKRSEPGEL;GLPEGSKRSE
PGELV;LPEGSKRSEPGELVL;PEGSKRSEPGELVLD;EGSKRSEPGELVLDF;GSKRSEPGE
LVLDFA;SKRSEPGELVLDFAE;KRSEPGELVLDFAEL;RSEPGELVLDFAELA;SEPGELVL
DFAELAR;EPGELVLDFAELARD;PGELVLDFAELARDP;GELVLDFAELARDPS;ELVLDFA
ELARDPSS;LVLDFAELARDPSST;VLDFAELARDPSSTK;LDFAELARDPSSTKL;DFAELA
RDPSSTKLD;FAELARDPSSTKLDL;AELARDPSSTKLDLT;ELARDPSSTKLDLTN;LARDP
SSTKLDLTNY;ARDPSSTKLDLTNYV;RDPSSTKLDLTNYVD;DPSSTKLDLTNYVDY;PSST
KLDLTNYVDYV;SSTKLDLTNYVDYVY;STKLDLTNYVDYVYS;TKLDLTNYVDYVYSG;KLD
LTNYVDYVYSGA;LDLTNYVDYVYSGAS;DLTNYVDYVYSGASG;LTNYVDYVYSGASGI;TN
YVDYVYSGASGIV;NYVDYVYSGASGIVK;YVDYVYSGASGIVKP;VDYVYSGASGIVKPE;D
YVYSGASGIVKPED;YVYSGASGIVKPEDM;VYSGASGIVKPEDMV;YSGASGIVKPEDMVV;
SGASGIVKPEDMVVD;GASGIVKPEDMVVDL;ASGIVKPEDMVVDLG;SGIVKPEDMVVDLGI
;GIVKPEDMVVDLGIN;IVKPEDMVVDLGINN;VKPEDMVVDLGINNW;KPEDMVVDLGINNW
S;PEDMVVDLGINNWSV;EDMVVDLGINNWSVL;DMVVDLGINNWSVLL;MVVDLGINNWSVL
LT;VVDLGINNWSVLLTP;VDLGINNWSVLLTPS;DLGINNWSVLLTPSA;LGINNWSVLLTP
SAR;GINNWSVLLTPSARL;INNWSVLLTPSARLQ;NNWSVLLTPSARLQA;NWSVLLTPSAR
LQAY;WSVLLTPSARLQAYV;SVLLTPSARLQAYVK;VLLTPSARLQAYVKN;LLTPSARLQA
YVKNS;LTPSARLQAYVKNSV;TPSARLQAYVKNSVV;PSARLQAYVKNSVVA;SARLQAYVK
NSVVAP;ARLQAYVKNSVVAPA;RLQAYVKNSVVAPAV;LQAYVKNSVVAPAVV;QAYVKNSV
VAPAVVK;AYVKNSVVAPAVVKS;YVKNSVVAPAVVKSE;VKNSVVAPAVVKSES;KNSVVAP
AVVKSESK;NSVVAPAVVKSESKR;SVVAPAVVKSESKRY;VVAPAVVKSESKRYA;VAPAVV
KSESKRYAG;APAVVKSESKRYAGD;PAVVKSESKRYAGDT;AVVKSESKRYAGDTI;VVKSE
SKRYAGDTIL;VKSESKRYAGDTILG;KSESKRYAGDTILGV;SESKRYAGDTILGVR;ESKR
YAGDTILGVRV;SKRYAGDTILGVRVL;KRYAGDTILGVRVLF;RYAGDTILGVRVLFP;YAG
DTILGVRVLFPS;AGDTILGVRVLFPSY;GDTILGVRVLFPSYS;DTILGVRVLFPSYSQ;TI
LGVRVLFPSYSQS;ILGVRVLFPSYSQSS;LGVRVLFPSYSQSSA;GVRVLFPSYSQSSAM;V
RVLFPSYSQSSAMI;RVLFPSYSQSSAMIM;VLFPSYSQSSAMIMP;LFPSYSQSSAMIMPP;
FPSYSQSSAMIMPPF;PSYSQSSAMIMPPFK;SYSQSSAMIMPPFKI;YSQSSAMIMPPFKIP
;SQSSAMIMPPFKIPF;QSSAMIMPPFKIPFY;SSAMIMPPFKIPFYS;SAMIMPPFKIPFYS
G;AMIMPPFKIPFYSGE;MIMPPFKIPFYSGEN;IMPPFKIPFYSGENG;MPPFKIPFYSGEN
GN;PPFKIPFYSGENGNQ;PFKIPFYSGENGNQF;FKIPFYSGENGNQFL;KIPFYSGENGNQ
FLG;IPFYSGENGNQFLGK;PFYSGENGNQFLGKG;FYSGENGNQFLGKGL;YSGENGNQFLG
KGLI;SGENGNQFLGKGLIN;GENGNQFLGKGLINN;ENGNQFLGKGLINNI;NGNQFLGKGL
INNIK;GNQFLGKGLINNIKT;NQFLGKGLINNIKTM;QFLGKGLINNIKTMK;FLGKGLINN
IKTMKE;LGKGLINNIKTMKEI;GKGLINNIKTMKEIK;KGLINNIKTMKEIKV;GLINNIKT
MKEIKVS;LINNIKTMKEIKVSV;INNIKTMKEIKVSVY;NNIKTMKEIKVSVYS;NIKTMKE
IKVSVYSL;IKTMKEIKVSVYSLG;KTMKEIKVSVYSLGY;TMKEIKVSVYSLGYE;MKEIKV
SVYSLGYEI;KEIKVSVYSLGYEID;EIKVSVYSLGYEIDL;IKVSVYSLGYEIDLE;KVSVY
SLGYEIDLEV;VSVYSLGYEIDLEVL;SVYSLGYEIDLEVLF;VYSLGYEIDLEVLFE;YSLG
YEIDLEVLFED;SLGYEIDLEVLFEDM;LGYEIDLEVLFEDMN;GYEIDLEVLFEDMNG;YEI
DLEVLFEDMNGM;EIDLEVLFEDMNGME;IDLEVLFEDMNGMEY;DLEVLFEDMNGMEYA;LE
VLFEDMNGMEYAY;EVLFEDMNGMEYAYS;VLFEDMNGMEYAYSL;LFEDMNGMEYAYSLG;F
EDMNGMEYAYSLGT;EDMNGMEYAYSLGTL;DMNGMEYAYSLGTLK;MNGMEYAYSLGTLKF;

Fig. 43 continued

NGMEYAYSLGTLKFK; GMEYAYSLGTLKFKG; MEYAYSLGTLKFKGW; EYAYSLGTLKFKGWA
; YAYSLGTLKFKGWAD; AYSLGTLKFKGWADL; YSLGTLKFKGWADLI; SLGTLKFKGWADLI
W; LGTLKFKGWADLIWS; GTLKFKGWADLIWSN; TLKFKGWADLIWSNP; LKFKGWADLIWSN
PN; KFKGWADLIWSNPNY; FKGWADLIWSNPNYI; KGWADLIWSNPNYIP; GWADLIWSNPNY
IPN; WADLIWSNPNYIPNI; ADLIWSNPNYIPNIS;DLIWSNPNYIPNISS;LIWSNPNYIPN
ISSR;IWSNPNYIPNISSRI;WSNPNYIPNISSRII;SNPNYIPNISSRIIK;NPNYIPNISS
RIIKD;PNYIPNISSRIIKDD;NYIPNISSRIIKDDV;YIPNISSRIIKDDVP;IPNISSRII
KDDVPN;PNISSRIIKDDVPNY;NISSRIIKDDVPNYP;ISSRIIKDDVPNYPL;SSRIIKDD
VPNYPLA;SRIIKDDVPNYPLAS;RIIKDDVPNYPLASS;IIKDDVPNYPLASSK;IKDDVPN
YPLASSKM;KDDVPNYPLASSKMR;DDVPNYPLASSKMRF;DVPNYPLASSKMRFK;VPNYPL
ASSKMRFKA;PNYPLASSKMRFKAF;NYPLASSKMRFKAFR;YPLASSKMRFKAFRV;PLASS
KMRFKAFRVS;LASSKMRFKAFRVSK;ASSKMRFKAFRVSKS;SSKMRFKAFRVSKSH;SKMR
FKAFRVSKSHS;KMRFKAFRVSKSHSS;MRFKAFRVSKSHSSK;RFKAFRVSKSHSSKE;FKA
FRVSKSHSSKEQ;KAFRVSKSHSSKEQN;AFRVSKSHSSKEQNF;FRVSKSHSSKEQNFI;RV
SKSHSSKEQNFIF;VSKSHSSKEQNFIFY;SKSHSSKEQNFIFYV;KSHSSKEQNFIFYVK;S
HSSKEQNFIFYVKD;HSSKEQNFIFYVKDL;SSKEQNFIFYVKDLR;SKEQNFIFYVKDLRV;
KEQNFIFYVKDLRVL;EQNFIFYVKDLRVLY;QNFIFYVKDLRVLYD;NFIFYVKDLRVLYDK
;FIFYVKDLRVLYDKL;IFYVKDLRVLYDKLS;FYVKDLRVLYDKLSV;YVKDLRVLYDKLSV
S;VKDLRVLYDKLSVSI;KDLRVLYDKLSVSID;DLRVLYDKLSVSIDS;LRVLYDKLSVSID
SD;RVLYDKLSVSIDSDI;VLYDKLSVSIDSDID;LYDKLSVSIDSDIDS;YDKLSVSIDSDI
DSE;DKLSVSIDSDIDSES;KLSVSIDSDIDSESV;LSVSIDSDIDSESVF;SVSIDSDIDSE
SVFK;VSIDSDIDSESVFKV;SIDSDIDSESVFKVY;IDSDIDSESVFKVYE;DSDIDSESVF
KVYET;SDIDSESVFKVYETS;DIDSESVFKVYETSG;IDSESVFKVYETSGT;DSESVFKVY
ETSGTE;SESVFKVYETSGTES;ESVFKVYETSGTESL;SVFKVYETSGTESLR;VFKVYETS
GTESLRK;FKVYETSGTESLRKL;KVYETSGTESLRKLK;VYETSGTESLRKLKA;YETSGTE
SLRKLKAH;ETSGTESLRKLKAHE;TSGTESLRKLKAHET;SGTESLRKLKAHETF;GTESLR
KLKAHETFK;TESLRKLKAHETFKR;ESLRKLKAHETFKRV;SLRKLKAHETFKRVL;LRKLK
AHETFKRVLK;RKLKAHETFKRVLKL;KLKAHETFKRVLKLR;LKAHETFKRVLKLRE;KAHE
TFKRVLKLREK;AHETFKRVLKLREKI;HETFKRVLKLREKIS;ETFKRVLKLREKISM;TFK
RVLKLREKISMP;FKRVLKLREKISMPE;KRVLKLREKISMPEG;RVLKLREKISMPEGS;VL
KLREKISMPEGSF;LKLREKISMPEGSFQ;KLREKISMPEGSFQN;LREKISMPEGSFQNF;R
EKISMPEGSFQNFI;EKISMPEGSFQNFIE;KISMPEGSFQNFIEK;ISMPEGSFQNFIEKV;
SMPEGSFQNFIEKVE;MPEGSFQNFIEKVES;PEGSFQNFIEKVESE;EGSFQNFIEKVESEK
;GSFQNFIEKVESEKK;SFQNFIEKVESEKKP;FQNFIEKVESEKKPE;QNFIEKVESEKKPE
E;NFIEKVESEKKPEES;FIEKVESEKKPEESS;IEKVESEKKPEESSL;EKVESEKKPEESS
LK;KVESEKKPEESSLKK;

16 mers:
MKRKAKSILLFLLSTA;KRKAKSILLFLLSTAL;RKAKSILLFLLSTALF;KAKSILLFLLST
ALFA;AKSILLFLLSTALFAQ;KSILLFLLSTALFAQE;SILLFLLSTALFAQET;ILLFLLS
TALFAQETD;LLFLLSTALFAQETDG;LFLLSTALFAQETDGL;FLLSTALFAQETDGLP;LL
STALFAQETDGLPE;LSTALFAQETDGLPEG;STALFAQETDGLPEGS;TALFAQETDGLPEG
SK;ALFAQETDGLPEGSKR;LFAQETDGLPEGSKRS;FAQETDGLPEGSKRSE;AQETDGLPE
GSKRSEP;QETDGLPEGSKRSEPG;ETDGLPEGSKRSEPGE;TDGLPEGSKRSEPGEL;DGLP
EGSKRSEPGELV;GLPEGSKRSEPGELVL;LPEGSKRSEPGELVLD;PEGSKRSEPGELVLDF
;EGSKRSEPGELVLDFA;GSKRSEPGELVLDFAE;SKRSEPGELVLDFAEL;KRSEPGELVLD
FAELA;RSEPGELVLDFAELAR;SEPGELVLDFAELARD;EPGELVLDFAELARDP;PGELVL
DFAELARDPS;GELVLDFAELARDPSS;ELVLDFAELARDPSST;LVLDFAELARDPSSTK;V
LDFAELARDPSSTKL;LDFAELARDPSSTKLD;DFAELARDPSSTKLDL;FAELARDPSSTKL
DLT;AELARDPSSTKLDLTN;ELARDPSSTKLDLTNY;LARDPSSTKLDLTNYV;ARDPSSTK
LDLTNYVD;RDPSSTKLDLTNYVDY;DPSSTKLDLTNYVDYV;PSSTKLDLTNYVDYVY;SST
KLDLTNYVDYVYS;STKLDLTNYVDYVYSG;TKLDLTNYVDYVYSGA;KLDLTNYVDYVYSGA
S;LDLTNYVDYVYSGASG;DLTNYVDYVYSGASGI;LTNYVDYVYSGASGIV;TNYVDYVYSG
ASGIVK;NYVDYVYSGASGIVKP;YVDYVYSGASGIVKPE;VDYVYSGASGIVKPED;DYVYS
GASGIVKPEDM;YVYSGASGIVKPEDMV;VYSGASGIVKPEDMVV;YSGASGIVKPEDMVVD;
SGASGIVKPEDMVVDL;GASGIVKPEDMVVDLG;ASGIVKPEDMVVDLGI;SGIVKPEDMVVD
LGIN;GIVKPEDMVVDLGINN;IVKPEDMVVDLGINNW;VKPEDMVVDLGINNWS;KPEDMVV

Fig. 43 continued

| | |
|---|---|
| DLGINNWSV;PEDMVVDLGINNWSVL;EDMVVDLGINNWSVLL;DMVVDLGINNWSVLLT;MV<br>VDLGINNWSVLLTP;VVDLGINNWSVLLTPS;VDLGINNWSVLLTPSA;DLGINNWSVLLTPS<br>AR;LGINNWSVLLTPSARL;GINNWSVLLTPSARLQ;INNWSVLLTPSARLQA;NNWSVLLTP<br>SARLQAY;NWSVLLTPSARLQAYV;WSVLLTPSARLQAYVK;SVLLTPSARLQAYVKN;VLLT<br>PSARLQAYVKNS;LLTPSARLQAYVKNSV;LTPSARLQAYVKNSVV;TPSARLQAYVKNSVVA<br>;PSARLQAYVKNSVVAP;SARLQAYVKNSVVAPA;ARLQAYVKNSVVAPAV;RLQAYVKNSVV<br>APAVV;LQAYVKNSVVAPAVVK;QAYVKNSVVAPAVVKS;AYVKNSVVAPAVVKSE;YVKNSV<br>VAPAVVKSES;VKNSVVAPAVVKSESK;KNSVVAPAVVKSESKR;NSVVAPAVVKSESKRY;S<br>VVAPAVVKSESKRYA;VVAPAVVKSESKRYAG;VAPAVVKSESKRYAGD;APAVVKSESKRYA<br>GDT;PAVVKSESKRYAGDTI;AVVKSESKRYAGDTIL;VVKSESKRYAGDTILG;VKSESKRY<br>AGDTILGV;KSESKRYAGDTILGVR;SESKRYAGDTILGVRV;ESKRYAGDTILGVRVL;SKR<br>YAGDTILGVRVLF;KRYAGDTILGVRVLFP;RYAGDTILGVRVLFPS;YAGDTILGVRVLFPS<br>Y;AGDTILGVRVLFPSYS;GDTILGVRVLFPSYSQ;DTILGVRVLFPSYSQS;TILGVRVLFP<br>SYSQSS;ILGVRVLFPSYSQSSA;LGVRVLFPSYSQSSAM;GVRVLFPSYSQSSAMI;VRVLF<br>PSYSQSSAMIM;RVLFPSYSQSSAMIMP;VLFPSYSQSSAMIMPP;LFPSYSQSSAMIMPPF;<br>FPSYSQSSAMIMPPFK;PSYSQSSAMIMPPFKI;SYSQSSAMIMPPFKIP;YSQSSAMIMPPF<br>KIPF;SQSSAMIMPPFKIPFY;QSSAMIMPPFKIPFYS;SSAMIMPPFKIPFYSG;SAMIMPP<br>FKIPFYSGE;AMIMPPFKIPFYSGEN;MIMPPFKIPFYSGENG;IMPPFKIPFYSGENGN;MP<br>PFKIPFYSGENGNQ;PPFKIPFYSGENGNQF;PFKIPFYSGENGNQFL;FKIPFYSGENGNQF<br>LG;KIPFYSGENGNQFLGK;IPFYSGENGNQFLGKG;PFYSGENGNQFLGKGL;FYSGENGNQ<br>FLGKGLI;YSGENGNQFLGKGLIN;SGENGNQFLGKGLINN;GENGNQFLGKGLINNI;ENGN<br>QFLGKGLINNIK;NGNQFLGKGLINNIKT;GNQFLGKGLINNIKTM;NQFLGKGLINNIKTMK<br>;QFLGKGLINNIKTMKE;FLGKGLINNIKTMKEI;LGKGLINNIKTMKEIK;GKGLINNIKTM<br>KEIKV;KGLINNIKTMKEIKVS;GLINNIKTMKEIKVSV;LINNIKTMKEIKVSVY;INNIKT<br>MKEIKVSVYS;NNIKTMKEIKVSVYSL;NIKTMKEIKVSVYSLG;IKTMKEIKVSVYSLGY;K<br>TMKEIKVSVYSLGYE;TMKEIKVSVYSLGYEI;MKEIKVSVYSLGYEID;KEIKVSVYSLGYE<br>IDL;EIKVSVYSLGYEIDLE;IKVSVYSLGYEIDLEV;KVSVYSLGYEIDLEVL;VSVYSLGY<br>EIDLEVLF;SVYSLGYEIDLEVLFE;VYSLGYEIDLEVLFED;YSLGYEIDLEVLFEDM;SLG<br>YEIDLEVLFEDMN;LGYEIDLEVLFEDMNG;GYEIDLEVLFEDMNGM;YEIDLEVLFEDMNGM<br>E;EIDLEVLFEDMNGMEY;IDLEVLFEDMNGMEYA;DLEVLFEDMNGMEYAY;LEVLFEDMNG<br>MEYAYS;EVLFEDMNGMEYAYSL;VLFEDMNGMEYAYSLG;LFEDMNGMEYAYSLGT;FEDMN<br>GMEYAYSLGTL;EDMNGMEYAYSLGTLK;DMNGMEYAYSLGTLKF;MNGMEYAYSLGTLKFK;<br>NGMEYAYSLGTLKFKG;GMEYAYSLGTLKFKGW;MEYAYSLGTLKFKGWA;EYAYSLGTLKFK<br>GWAD;YAYSLGTLKFKGWADL;AYSLGTLKFKGWADLI;YSLGTLKFKGWADLIW;SLGTLKF<br>KGWADLIWS;LGTLKFKGWADLIWSN;GTLKFKGWADLIWSNP;TLKFKGWADLIWSNPN;LK<br>FKGWADLIWSNPNY;KFKGWADLIWSNPNYI;FKGWADLIWSNPNYIP;KGWADLIWSNPNYI<br>PN;GWADLIWSNPNYIPNI;WADLIWSNPNYIPNIS;ADLIWSNPNYIPNISS;DLIWSNPNY<br>IPNISSR;LIWSNPNYIPNISSRI;IWSNPNYIPNISSRII;WSNPNYIPNISSRIIK;SNPN<br>YIPNISSRIIKD;NPNYIPNISSRIIKDD;PNYIPNISSRIIKDDV;NYIPNISSRIIKDDVP<br>;YIPNISSRIIKDDVPN;IPNISSRIIKDDVPNY;PNISSRIIKDDVPNYP;NISSRIIKDDV<br>PNYPL;ISSRIIKDDVPNYPLA;SSRIIKDDVPNYPLAS;SRIIKDDVPNYPLASS;RIIKDD<br>VPNYPLASSK;IIKDDVPNYPLASSKM;IKDDVPNYPLASSKMR;KDDVPNYPLASSKMRF;D<br>DVPNYPLASSKMRFK;DVPNYPLASSKMRFKA;VPNYPLASSKMRFKAF;PNYPLASSKMRFK<br>AFR;NYPLASSKMRFKAFRV;YPLASSKMRFKAFRVS;PLASSKMRFKAFRVSK;LASSKMRF<br>KAFRVSKS;ASSKMRFKAFRVSKSH;SSKMRFKAFRVSKSHS;SKMRFKAFRVSKSHSS;KMR<br>FKAFRVSKSHSSK;MRFKAFRVSKSHSSKE;RFKAFRVSKSHSSKEQ;FKAFRVSKSHSSKEQ<br>N;KAFRVSKSHSSKEQNF;AFRVSKSHSSKEQNFI;FRVSKSHSSKEQNFIF;RVSKSHSSKE<br>QNFIFY;VSKSHSSKEQNFIFYV;SKSHSSKEQNFIFYVK;KSHSSKEQNFIFYVKD;SHSSK<br>EQNFIFYVKDL;HSSKEQNFIFYVKDLR;SSKEQNFIFYVKDLRV;SKEQNFIFYVKDLRVL;<br>KEQNFIFYVKDLRVLY;EQNFIFYVKDLRVLYD;QNFIFYVKDLRVLYDK;NFIFYVKDLRVL<br>YDKL;FIFYVKDLRVLYDKLS;IFYVKDLRVLYDKLSV;FYVKDLRVLYDKLSVS;YVKDLRV<br>LYDKLSVSI;VKDLRVLYDKLSVSID;KDLRVLYDKLSVSIDS;DLRVLYDKLSVSIDSD;LR<br>VLYDKLSVSIDSDI;RVLYDKLSVSIDSDID;VLYDKLSVSIDSDIDS;LYDKLSVSIDSDID<br>SE;YDKLSVSIDSDIDSES;DKLSVSIDSDIDSESV;KLSVSIDSDIDSESVF;LSVSIDSDI<br>DSESVFK;SVSIDSDIDSESVFKV;VSIDSDIDSESVFKVY;SIDSDIDSESVFKVYE;IDSD<br>IDSESVFKVYET;DSDIDSESVFKVYETS;SDIDSESVFKVYETSG;DIDSESVFKVYETSGT<br>;IDSESVFKVYETSGTE;DSESVFKVYETSGTES;SESVFKVYETSGTESL;ESVFKVYETSG | |

Fig. 43 continued

| | |
|---|---|
| TESLR;SVFKVYETSGTESLRK;VFKVYETSGTESLRKL;FKVYETSGTESLRKLK;KVYETS<br>GTESLRKLKA;VYETSGTESLRKLKAH;YETSGTESLRKLKAHE;ETSGTESLRKLKAHET;T<br>SGTESLRKLKAHETF;SGTESLRKLKAHETFK;GTESLRKLKAHETFKR;TESLRKLKAHETF<br>KRV;ESLRKLKAHETFKRVL;SLRKLKAHETFKRVLK;LRKLKAHETFKRVLKL;RKLKAHET<br>FKRVLKLR;KLKAHETFKRVLKLRE;LKAHETFKRVLKLREK;KAHETFKRVLKLREKI;AHE<br>TFKRVLKLREKIS;HETFKRVLKLREKISM;ETFKRVLKLREKISMP;TFKRVLKLREKISMP<br>E;FKRVLKLREKISMPEG;KRVLKLREKISMPEGS;RVLKLREKISMPEGSF;VLKLREKISM<br>PEGSFQ;LKLREKISMPEGSFQN;KLREKISMPEGSFQNF;LREKISMPEGSFQNFI;REKIS<br>MPEGSFQNFIE;EKISMPEGSFQNFIEK;KISMPEGSFQNFIEKV;ISMPEGSFQNFIEKVE;<br>SMPEGSFQNFIEKVES;MPEGSFQNFIEKVESE;PEGSFQNFIEKVESEK;EGSFQNFIEKVE<br>SEKK;GSFQNFIEKVESEKKP;SFQNFIEKVESEKKPE;FQNFIEKVESEKKPEE;QNFIEKV<br>ESEKKPEES;NFIEKVESEKKPEESS;FIEKVESEKKPEESSL;IEKVESEKKPEESSLK;EK<br>VESEKKPEESSLKK | |
| <YP_709588.1 flagellin;Borrelia afzelii PKo><br>MIINHNTSAINASRNNAINAANLSKTQEKLSSGYRINRASDDAAGMGVSGKINAQIRGLSQAS<br>RNTSKAINFIQTTEGNLNEVEKVLVRMKELAVQSGNGTYSDSDRGSIQIEIEQLTDEINRIAD<br>QAQYNQMHMLSNKSASQNVKTAEELGMQPAKINTPASLSGSQASWTLRVHVGANQDEAIAVNI<br>YSANVANLFAGEGAQAAQAAPVQEGAQEEGAQQPTPATAPTQGGVNSPVNVTTTVDANTSLAK<br>IENAIRMISDQRANLGAFQNRLESIKNSTEYAIENLKASYAQIKDATMTDEVVAATTNSILTQ<br>SAMAMIAQANQVPQYVLSLLR<br><br><br>8 mers:<br>MIINHNTS;IINHNTSA;INHNTSAI;NHNTSAIN;HNTSAINA;NTSAINAS;TSAINASR;<br>SAINASRN;AINASRNN;INASRNNA;NASRNNAI;ASRNNAIN;SRNNAINA;RNNAINAA;<br>NNAINAAN;NAINAANL;AINAANLS;INAANLSK;NAANLSKT;AANLSKTQ;ANLSKTQE;<br>NLSKTQEK;LSKTQEKL;SKTQEKLS;KTQEKLSS;TQEKLSSG;QEKLSSGY;EKLSSGYR;<br>KLSSGYRI;LSSGYRIN;SSGYRINR;SGYRINRA;GYRINRAS;YRINRASD;RINRASDD;<br>INRASDDA;NRASDDAA;RASDDAAG;ASDDAAGM;SDDAAGMG;DDAAGMGV;DAAGMGVS;<br>AAGMGVSG;AGMGVSGK;GMGVSGKI;MGVSGKIN;GVSGKINA;VSGKINAQ;SGKINAQI;<br>GKINAQIR;KINAQIRG;INAQIRGL;NAQIRGLS;AQIRGLSQ;QIRGLSQA;IRGLSQAS;<br>RGLSQASR;GLSQASRN;LSQASRNT;SQASRNTS;QASRNTSK;ASRNTSKA;SRNTSKAI;<br>RNTSKAIN;NTSKAINF;TSKAINFI;SKAINFIQ;KAINFIQT;AINFIQTT;INFIQTTE;<br>NFIQTTEG;FIQTTEGN;IQTTEGNL;QTTEGNLN;TTEGNLNE;TEGNLNEV;EGNLNEVE;<br>GNLNEVEK;NLNEVEKV;LNEVEKVL;NEVEKVLV;EVEKVLVR;VEKVLVRM;EKVLVRMK;<br>KVLVRMKE;VLVRMKEL;LVRMKELA;VRMKELAV;RMKELAVQ;MKELAVQS;KELAVQSG;<br>ELAVQSGN;LAVQSGNG;AVQSGNGT;VQSGNGTY;QSGNGTYS;SGNGTYSD;GNGTYSDS;<br>NGTYSDSD;GTYSDSDR;TYSDSDRG;YSDSDRGS;SDSDRGSI;DSDRGSIQ;SDRGSIQI;<br>DRGSIQIE;RGSIQIEI;GSIQIEIE;SIQIEIEQ;IQIEIEQL;QIEIEQLT;IEIEQLTD;<br>EIEQLTDE;IEQLTDEI;EQLTDEIN;QLTDEINR;LTDEINRI;TDEINRIA;DEINRIAD;<br>EINRIADQ;INRIADQA;NRIADQAQ;RIADQAQY;IADQAQYN;ADQAQYNQ;DQAQYNQM;<br>QAQYNQMH;AQYNQMHM;QYNQMHML;YNQMHMLS;NQMHMLSN;QMHMLSNK;MHMLSNKS;<br>HMLSNKSA;MLSNKSAS;LSNKSASQ;SNKSASQN;NKSASQNV;KSASQNVK;SASQNVKT;<br>ASQNVKTA;SQNVKTAE;QNVKTAEE;NVKTAEEL;VKTAEELG;KTAEELGM;TAEELGMQ;<br>AEELGMQP;EELGMQPA;ELGMQPAK;LGMQPAKI;GMQPAKIN;MQPAKINT;QPAKINTP;<br>PAKINTPA;AKINTPAS;KINTPASL;INTPASLS;NTPASLSG;TPASLSGS;PASLSGSQ;<br>ASLSGSQA;SLSGSQAS;LSGSQASW;SGSQASWT;GSQASWTL;SQASWTLR;QASWTLRV;<br>ASWTLRVH;SWTLRVHV;WTLRVHVG;TLRVHVGA;LRVHVGAN;RVHVGANQ;VHVGANQD;<br>HVGANQDE;VGANQDEA;GANQDEAI;ANQDEAIA;NQDEAIAV;QDEAIAVN;DEAIAVNI;<br>EAIAVNIY;AIAVNIYS;IAVNIYSA;AVNIYSAN;VNIYSANV;NIYSANVA;IYSANVAN;<br>YSANVANL;SANVANLF;ANVANLFA;NVANLFAG;VANLFAGE;ANLFAGEG;NLFAGEGA;<br>LFAGEGAQ;FAGEGAQA;AGEGAQAA;GEGAQAAQ;EGAQAAQA;GAQAAQAA;AQAAQAAP;<br>QAAQAAPV;AAQAAPVQ;AQAAPVQE;QAAPVQEG;AAPVQEGA;APVQEGAQ;PVQEGAQE;<br>VQEGAQEE;QEGAQEEG;EGAQEEGA;GAQEEGAQ;AQEEGAQQ;QEEGAQQP;EEGAQQPT;<br>EGAQQPTP;GAQQPTPA;AQQPTPAT;QQPTPATA;QPTPATAP;PTPATAPT;TPATAPTQ;<br>PATAPTQG;ATAPTQGG;TAPTQGGV;APTQGGVN;PTQGGVNS;TQGGVNSP;QGGVNSPV;<br>GGVNSPVN;GVNSPVNV;VNSPVNVT;NSPVNVTT;SPVNVTTT;PVNVTTTV;VNVTTTVD; | 213325-<br>215925 |

Fig. 43 continued

NVTTTVDA;VTTTVDAN;TTTVDANT;TTVDANTS;TVDANTSL;VDANTSLA;DANTSLAK;
ANTSLAKI;NTSLAKIE;TSLAKIEN;SLAKIENA;LAKIENAI;AKIENAIR;KIENAIRM;
IENAIRMI;ENAIRMIS;NAIRMISD;AIRMISDQ;IRMISDQR;RMISDQRA;MISDQRAN;
ISDQRANL;SDQRANLG;DQRANLGA;QRANLGAF;RANLGAFQ;ANLGAFQN;NLGAFQNR;
LGAFQNRL;GAFQNRLE;AFQNRLES;FQNRLESI;QNRLESIK;NRLESIKN;RLESIKNS;
LESIKNST;ESIKNSTE;SIKNSTEY;IKNSTEYA;KNSTEYAI;NSTEYAIE;STEYAIEN;
TEYAIENL;EYAIENLK;YAIENLKA;AIENLKAS;IENLKASY;ENLKASYA;NLKASYAQ;
LKASYAQI;KASYAQIK;ASYAQIKD;SYAQIKDA;YAQIKDAT;AQIKDATM;QIKDATMT;
IKDATMTD;KDATMTDE;DATMTDEV;ATMTDEVV;TMTDEVVA;MTDEVVAA;TDEVVAAT;
DEVVAATT;EVVAATTN;VVAATTNS;VAATTNSI;AATTNSIL;ATTNSILT;TTNSILTQ;
TNSILTQS;NSILTQSA;SILTQSAM;ILTQSAMA;LTQSAMAM;TQSAMAMI;QSAMAMIA;
SAMAMIAQ;AMAMIAQA;MAMIAQAN;AMIAQANQ;MIAQANQV;IAQANQVP;AQANQVPQ;
QANQVPQY;ANQVPQYV;NQVPQYVL;QVPQYVLS;VPQYVLSL;PQYVLSLL;QYVLSLLR;

9 mers:
MIINHNTSA;IINHNTSAI;INHNTSAIN;NHNTSAINA;HNTSAINAS;NTSAINASR;TSA
INASRN;SAINASRNN;AINASRNNA;INASRNNAI;NASRNNAIN;ASRNNAINA;SRNNAI
NAA;RNNAINAAN;NNAINAANL;NAINAANLS;AINAANLSK;INAANLSKT;NAANLSKTQ
;AANLSKTQE;ANLSKTQEK;NLSKTQEKL;LSKTQEKLS;SKTQEKLSS;KTQEKLSSG;TQ
EKLSSGY;QEKLSSGYR;EKLSSGYRI;KLSSGYRIN;LSSGYRINR;SSGYRINRA;SGYRI
NRAS;GYRINRASD;YRINRASDD;RINRASDDA;INRASDDAA;NRASDDAAG;RASDDAAG
M;ASDDAAGMG;SDDAAGMGV;DDAAGMGVS;DAAGMGVSG;AAGMGVSGK;AGMGVSGKI;G
MGVSGKIN;MGVSGKINA;GVSGKINAQ;VSGKINAQI;SGKINAQIR;GKINAQIRG;KINA
QIRGL;INAQIRGLS;NAQIRGLSQ;AQIRGLSQA;QIRGLSQAS;IRGLSQASR;RGLSQAS
RN;GLSQASRNT;LSQASRNTS;SQASRNTSK;QASRNTSKA;ASRNTSKAI;SRNTSKAIN;
RNTSKAINF;NTSKAINFI;TSKAINFIQ;SKAINFIQT;KAINFIQTT;AINFIQTTE;INF
IQTTEG;NFIQTTEGN;FIQTTEGNL;IQTTEGNLN;QTTEGNLNE;TTEGNLNEV;TEGNLN
EVE;EGNLNEVEK;GNLNEVEKV;NLNEVEKVL;LNEVEKVLV;NEVEKVLVR;EVEKVLVRM
;VEKVLVRMK;EKVLVRMKE;KVLVRMKEL;VLVRMKELA;LVRMKELAV;VRMKELAVQ;RM
KELAVQS;MKELAVQSG;KELAVQSGN;ELAVQSGNG;LAVQSGNGT;AVQSGNGTY;VQSGN
GTYS;QSGNGTYSD;SGNGTYSDS;GNGTYSDSD;NGTYSDSDR;GTYSDSDRG;TYSDSDRG
S;YSDSDRGSI;SDSDRGSIQ;DSDRGSIQI;SDRGSIQIE;DRGSIQIEI;RGSIQIEIE;G
SIQIEIEQ;SIQIEIEQL;IQIEIEQLT;QIEIEQLTD;IEIEQLTDE;EIEQLTDEI;IEQL
TDEIN;EQLTDEINR;QLTDEINRI;LTDEINRIA;TDEINRIAD;DEINRIADQ;EINRIAD
QA;INRIADQAQ;NRIADQAQY;RIADQAQYN;IADQAQYNQ;ADQAQYNQM;DQAQYNQMH;
QAQYNQMHM;AQYNQMHML;QYNQMHMLS;YNQMHMLSN;NQMHMLSNK;QMHMLSNKS;MHM
LSNKSA;HMLSNKSAS;MLSNKSASQ;LSNKSASQN;SNKSASQNV;NKSASQNVK;KSASQN
VKT;SASQNVKTA;ASQNVKTAE;SQNVKTAEE;QNVKTAEEL;NVKTAEELG;VKTAEELGM
;KTAEELGMQ;TAEELGMQP;AEELGMQPA;EELGMQPAK;ELGMQPAKI;LGMQPAKIN;GM
QPAKINT;MQPAKINTP;QPAKINTPA;PAKINTPAS;AKINTPASL;KINTPASLS;INTPA
SLSG;NTPASLSGS;TPASLSGSQ;PASLSGSQA;ASLSGSQAS;SLSGSQASW;LSGSQASW
T;SGSQASWTL;GSQASWTLR;SQASWTLRV;QASWTLRVH;ASWTLRVHV;SWTLRVHVG;W
TLRVHVGA;TLRVHVGAN;LRVHVGANQ;RVHVGANQD;VHVGANQDE;HVGANQDEA;VGAN
QDEAI;GANQDEAIA;ANQDEAIAV;NQDEAIAVN;QDEAIAVNI;DEAIAVNIY;EAIAVNI
YS;AIAVNIYSA;IAVNIYSAN;AVNIYSANV;VNIYSANVA;NIYSANVAN;IYSANVANL;
YSANVANLF;SANVANLFA;ANVANLFAG;NVANLFAGE;VANLFAGEG;ANLFAGEGA;NLF
AGEGAQ;LFAGEGAQA;FAGEGAQAA;AGEGAQAAQ;GEGAQAAQA;EGAQAAQAA;GAQAAQ
AAP;AQAAQAAPV;QAAQAAPVQ;AAQAAPVQE;AQAAPVQEG;QAAPVQEGA;AAPVQEGAQ
;APVQEGAQE;PVQEGAQEE;VQEGAQEEG;QEGAQEEGA;EGAQEEGAQ;GAQEEGAQQ;AQ
EEGAQQP;QEEGAQQPT;EEGAQQPTP;EGAQQPTPA;GAQQPTPAT;AQQPTPATA;QQPTP
ATAP;QPTPATAPT;PTPATAPTQ;TPATAPTQG;PATAPTQGG;ATAPTQGGV;TAPTQGGV
N;APTQGGVNS;PTQGGVNSP;TQGGVNSPV;QGGVNSPVN;GGVNSPVNV;GVNSPVNVT;V
NSPVNVTT;NSPVNVTTT;SPVNVTTTV;PVNVTTTVD;VNVTTTVDA;NVTTTVDAN;VTTT
VDANT;TTTVDANTS;TTVDANTSL;TVDANTSLA;VDANTSLAK;DANTSLAKI;ANTSLAK
IE;NTSLAKIEN;TSLAKIENA;SLAKIENAI;LAKIENAIR;AKIENAIRM;KIENAIRMI;
IENAIRMIS;ENAIRMISD;NAIRMISDQ;AIRMISDQR;IRMISDQRA;RMISDQRAN;MIS
DQRANL;ISDQRANLG;SDQRANLGA;DQRANLGAF;QRANLGAFQ;RANLGAFQN;ANLGAF

Fig. 43 continued

QNR;NLGAFQNRL;LGAFQNRLE;GAFQNRLES;AFQNRLESI;FQNRLESIK;QNRLESIKN
;NRLESIKNS;RLESIKNST;LESIKNSTE;ESIKNSTEY;SIKNSTEYA;IKNSTEYAI;KN
STEYAIE;NSTEYAIEN;STEYAIENL;TEYAIENLK;EYAIENLKA;YAIENLKAS;AIENL
KASY;IENLKASYA;ENLKASYAQ;NLKASYAQI;LKASYAQIK;KASYAQIKD;ASYAQIKD
A;SYAQIKDAT;YAQIKDATM;AQIKDATMT;QIKDATMTD;IKDATMTDE;KDATMTDEV;D
ATMTDEVV;ATMTDEVVA;TMTDEVVAA;MTDEVVAAT;TDEVVAATT;DEVVAATTN;EVVA
ATTNS;VVAATTNSI;VAATTNSIL;AATTNSILT;ATTNSILTQ;TTNSILTQS;TNSILTQ
SA;NSILTQSAM;SILTQSAMA;ILTQSAMAM;LTQSAMAMI;TQSAMAMIA;QSAMAMIAQ;
SAMAMIAQA;AMAMIAQAN;MAMIAQANQ;AMIAQANQV;MIAQANQVP;IAQANQVPQ;AQA
NQVPQY;QANQVPQYV;ANQVPQYVL;NQVPQYVLS;QVPQYVLSL;VPQYVLSLL;PQYVLS
LLR;

10 mers:
MIINHNTSAI;IINHNTSAIN;INHNTSAINA;NHNTSAINAS;HNTSAINASR;NTSAINAS
RN;TSAINASRNN;SAINASRNNA;AINASRNNAI;INASRNNAIN;NASRNNAINA;ASRNN
AINAA;SRNNAINAAN;RNNAINAANL;NNAINAANLS;NAINAANLSK;AINAANLSKT;IN
AANLSKTQ;NAANLSKTQE;AANLSKTQEK;ANLSKTQEKL;NLSKTQEKLS;LSKTQEKLSS
;SKTQEKLSSG;KTQEKLSSGY;TQEKLSSGYR;QEKLSSGYRI;EKLSSGYRIN;KLSSGYR
INR;LSSGYRINRA;SSGYRINRAS;SGYRINRASD;GYRINRASDD;YRINRASDDA;RINR
ASDDAA;INRASDDAAG;NRASDDAAGM;RASDDAAGMG;ASDDAAGMGV;SDDAAGMGVS;D
DAAGMGVSG;DAAGMGVSGK;AAGMGVSGKI;AGMGVSGKIN;GMGVSGKINA;MGVSGKINA
Q;GVSGKINAQI;VSGKINAQIR;SGKINAQIRG;GKINAQIRGL;KINAQIRGLS;INAQIR
GLSQ;NAQIRGLSQA;AQIRGLSQAS;QIRGLSQASR;IRGLSQASRN;RGLSQASRNT;GLS
QASRNTS;LSQASRNTSK;SQASRNTSKA;QASRNTSKAI;ASRNTSKAIN;SRNTSKAINF;
RNTSKAINFI;NTSKAINFIQ;TSKAINFIQT;SKAINFIQTT;KAINFIQTTE;AINFIQTT
EG;INFIQTTEGN;NFIQTTEGNL;FIQTTEGNLN;IQTTEGNLNE;QTTEGNLNEV;TTEGN
LNEVE;TEGNLNEVEK;EGNLNEVEKV;GNLNEVEKVL;NLNEVEKVLV;LNEVEKVLVR;NE
VEKVLVRM;EVEKVLVRMK;VEKVLVRMKE;EKVLVRMKEL;KVLVRMKELA;VLVRMKELAV
;LVRMKELAVQ;VRMKELAVQS;RMKELAVQSG;MKELAVQSGN;KELAVQSGNG;ELAVQSG
NGT;LAVQSGNGTY;AVQSGNGTYS;VQSGNGTYSD;QSGNGTYSDS;SGNGTYSDSD;GNGT
YSDSDR;NGTYSDSDRG;GTYSDSDRGS;TYSDSDRGSI;YSDSDRGSIQ;SDSDRGSIQI;D
SDRGSIQIE;SDRGSIQIEI;DRGSIQIEIE;RGSIQIEIEQ;GSIQIEIEQL;SIQIEIEQL
T;IQIEIEQLTD;QIEIEQLTDE;IEIEQLTDEI;EIEQLTDEIN;IEQLTDEINR;EQLTDE
INRI;QLTDEINRIA;LTDEINRIAD;TDEINRIADQ;DEINRIADQA;EINRIADQAQ;INR
IADQAQY;NRIADQAQYN;RIADQAQYNQ;IADQAQYNQM;ADQAQYNQMH;DQAQYNQMHM;
QAQYNQMHML;AQYNQMHMLS;QYNQMHMLSN;YNQMHMLSNK;NQMHMLSNKS;QMHMLSNK
SA;MHMLSNKSAS;HMLSNKSASQ;MLSNKSASQN;LSNKSASQNV;SNKSASQNVK;NKSAS
QNVKT;KSASQNVKTA;SASQNVKTAE;ASQNVKTAEE;SQNVKTAEEL;QNVKTAEELG;NV
KTAEELGM;VKTAEELGMQ;KTAEELGMQP;TAEELGMQPA;AEELGMQPAK;EELGMQPAKI
;ELGMQPAKIN;LGMQPAKINT;GMQPAKINTP;MQPAKINTPA;QPAKINTPAS;PAKINTP
ASL;AKINTPASLS;KINTPASLSG;INTPASLSGS;NTPASLSGSQ;TPASLSGSQA;PASL
SGSQAS;ASLSGSQASW;SLSGSQASWT;LSGSQASWTL;SGSQASWTLR;GSQASWTLRV;S
QASWTLRVH;QASWTLRVHV;ASWTLRVHVG;SWTLRVHVGA;WTLRVHVGAN;TLRVHVGAN
Q;LRVHVGANQD;RVHVGANQDE;VHVGANQDEA;HVGANQDEAI;VGANQDEAIA;GANQDE
AIAV;ANQDEAIAVN;NQDEAIAVNI;QDEAIAVNIY;DEAIAVNIYS;EAIAVNIYSA;AIA
VNIYSAN;IAVNIYSANV;AVNIYSANVA;VNIYSANVAN;NIYSANVANL;IYSANVANLF;
YSANVANLFA;SANVANLFAG;ANVANLFAGE;NVANLFAGEG;VANLFAGEGA;ANLFAGEG
AQ;NLFAGEGAQA;LFAGEGAQAA;FAGEGAQAAQ;AGEGAQAAQA;GEGAQAAQAA;EGAQA
AQAAP;GAQAAQAAPV;AQAAQAAPVQ;QAAQAAPVQE;AAQAAPVQEG;AQAAPVQEGA;QA
APVQEGAQ;AAPVQEGAQE;APVQEGAQEE;PVQEGAQEEG;VQEGAQEEGA;QEGAQEEGAQ
;EGAQEEGAQQ;GAQEEGAQQP;AQEEGAQQPT;QEEGAQQPTP;EEGAQQPTPA;EGAQQPT
PAT;GAQQPTPATA;AQQPTPATAP;QQPTPATAPT;QPTPATAPTQ;PTPATAPTQG;TPAT
APTQGG;PATAPTQGGV;ATAPTQGGVN;TAPTQGGVNS;APTQGGVNSP;PTQGGVNSPV;T
QGGVNSPVN;QGGVNSPVNV;GGVNSPVNVT;GVNSPVNVTT;VNSPVNVTTT;NSPVNVTTT
V;SPVNVTTTVD;PVNVTTTVDA;VNVTTTVDAN;NVTTTVDANT;VTTTVDANTS;TTTVDA
NTSL;TTVDANTSLA;TVDANTSLAK;VDANTSLAKI;DANTSLAKIE;ANTSLAKIEN;NTS
LAKIENA;TSLAKIENAI;SLAKIENAIR;LAKIENAIRM;AKIENAIRMI;KIENAIRMIS;

Fig. 43 continued

IENAIRMISD;ENAIRMISDQ;NAIRMISDQR;AIRMISDQRA;IRMISDQRAN;RMISDQRA
NL;MISDQRANLG;ISDQRANLGA;SDQRANLGAF;DQRANLGAFQ;QRANLGAFQN;RANLG
AFQNR;ANLGAFQNRL;NLGAFQNRLE;LGAFQNRLES;GAFQNRLESI;AFQNRLESIK;FQ
NRLESIKN;QNRLESIKNS;NRLESIKNST;RLESIKNSTE;LESIKNSTEY;ESIKNSTEYA
;SIKNSTEYAI;IKNSTEYAIE;KNSTEYAIEN;NSTEYAIENL;STEYAIENLK;TEYAIEN
LKA;EYAIENLKAS;YAIENLKASY;AIENLKASYA;IENLKASYAQ;ENLKASYAQI;NLKA
SYAQIK;LKASYAQIKD;KASYAQIKDA;ASYAQIKDAT;SYAQIKDATM;YAQIKDATMT;A
QIKDATMTD;QIKDATMTDE;IKDATMTDEV;KDATMTDEVV;DATMTDEVVA;ATMTDEVVA
A;TMTDEVVAAT;MTDEVVAATT;TDEVVAATTN;DEVVAATTNS;EVVAATTNSI;VVAATT
NSIL;VAATTNSILT;AATTNSILTQ;ATTNSILTQS;TTNSILTQSA;TNSILTQSAM;NSI
LTQSAMA;SILTQSAMAM;ILTQSAMAMI;LTQSAMAMIA;TQSAMAMIAQ;QSAMAMIAQA;
SAMAMIAQAN;AMAMIAQANQ;MAMIAQANQV;AMIAQANQVP;MIAQANQVPQ;IAQANQVP
QY;AQANQVPQYV;QANQVPQYVL;ANQVPQYVLS;NQVPQYVLSL;QVPQYVLSLL;VPQYV
LSLLR;

11 mers:
MIINHNTSAIN;IINHNTSAINA;INHNTSAINAS;NHNTSAINASR;HNTSAINASRN;NTS
AINASRNN;TSAINASRNNA;SAINASRNNAI;AINASRNNAIN;INASRNNAINA;NASRNN
AINAA;ASRNNAINAAN;SRNNAINAANL;RNNAINAANLS;NNAINAANLSK;NAINAANLS
KT;AINAANLSKTQ;INAANLSKTQE;NAANLSKTQEK;AANLSKTQEKL;ANLSKTQEKLS;
NLSKTQEKLSS;LSKTQEKLSSG;SKTQEKLSSGY;KTQEKLSSGYR;TQEKLSSGYRI;QEK
LSSGYRIN;EKLSSGYRINR;KLSSGYRINRA;LSSGYRINRAS;SSGYRINRASD;SGYRIN
RASDD;GYRINRASDDA;YRINRASDDAA;RINRASDDAAG;INRASDDAAGM;NRASDDAAG
MG;RASDDAAGMGV;ASDDAAGMGVS;SDDAAGMGVSG;DDAAGMGVSGK;DAAGMGVSGKI;
AAGMGVSGKIN;AGMGVSGKINA;GMGVSGKINAQ;MGVSGKINAQI;GVSGKINAQIR;VSG
KINAQIRG;SGKINAQIRGL;GKINAQIRGLS;KINAQIRGLSQ;INAQIRGLSQA;NAQIRG
LSQAS;AQIRGLSQASR;QIRGLSQASRN;IRGLSQASRNT;RGLSQASRNTS;GLSQASRNT
SK;LSQASRNTSKA;SQASRNTSKAI;QASRNTSKAIN;ASRNTSKAINF;SRNTSKAINFI;
RNTSKAINFIQ;NTSKAINFIQT;TSKAINFIQTT;SKAINFIQTTE;KAINFIQTTEG;AIN
FIQTTEGN;INFIQTTEGNL;NFIQTTEGNLN;FIQTTEGNLNE;IQTTEGNLNEV;QTTEGN
LNEVE;TTEGNLNEVEK;TEGNLNEVEKV;EGNLNEVEKVL;GNLNEVEKVLV;NLNEVEKVL
VR;LNEVEKVLVRM;NEVEKVLVRMK;EVEKVLVRMKE;VEKVLVRMKEL;EKVLVRMKELA;
KVLVRMKELAV;VLVRMKELAVQ;LVRMKELAVQS;VRMKELAVQSG;RMKELAVQSGN;MKE
LAVQSGNG;KELAVQSGNGT;ELAVQSGNGTY;LAVQSGNGTYS;AVQSGNGTYSD;VQSGNG
TYSDS;QSGNGTYSDSD;SGNGTYSDSDR;GNGTYSDSDRG;NGTYSDSDRGS;GTYSDSDRG
SI;TYSDSDRGSIQ;YSDSDRGSIQI;SDSDRGSIQIE;DSDRGSIQIEI;SDRGSIQIEIE;
DRGSIQIEIEQ;RGSIQIEIEQL;GSIQIEIEQLT;SIQIEIEQLTD;IQIEIEQLTDE;QIE
IEQLTDEI;IEIEQLTDEIN;EIEQLTDEINR;IEQLTDEINRI;EQLTDEINRIA;QLTDEI
NRIAD;LTDEINRIADQ;TDEINRIADQA;DEINRIADQAQ;EINRIADQAQY;INRIADQAQ
YN;NRIADQAQYNQ;RIADQAQYNQM;IADQAQYNQMH;ADQAQYNQMHM;DQAQYNQMHML;
QAQYNQMHMLS;AQYNQMHMLSN;QYNQMHMLSNK;YNQMHMLSNKS;NQMHMLSNKSA;QMH
MLSNKSAS;MHMLSNKSASQ;HMLSNKSASQN;MLSNKSASQNV;LSNKSASQNVK;SNKSAS
QNVKT;NKSASQNVKTA;KSASQNVKTAE;SASQNVKTAEE;ASQNVKTAEEL;SQNVKTAEE
LG;QNVKTAEELGM;NVKTAEELGMQ;VKTAEELGMQP;KTAEELGMQPA;TAEELGMQPAK;
AEELGMQPAKI;EELGMQPAKIN;ELGMQPAKINT;LGMQPAKINTP;GMQPAKINTPA;MQP
AKINTPAS;QPAKINTPASL;PAKINTPASLS;AKINTPASLSG;KINTPASLSGS;INTPAS
LSGSQ;NTPASLSGSQA;TPASLSGSQAS;PASLSGSQASW;ASLSGSQASWT;SLSGSQASW
TL;LSGSQASWTLR;SGSQASWTLRV;GSQASWTLRVH;SQASWTLRVHV;QASWTLRVHVG;
ASWTLRVHVGA;SWTLRVHVGAN;WTLRVHVGANQ;TLRVHVGANQD;LRVHVGANQDE;RVH
VGANQDEA;VHVGANQDEAI;HVGANQDEAIA;VGANQDEAIAV;GANQDEAIAVN;ANQDEA
IAVNI;NQDEAIAVNIY;QDEAIAVNIYS;DEAIAVNIYSA;EAIAVNIYSAN;AIAVNIYSA
NV;IAVNIYSANVA;AVNIYSANVAN;VNIYSANVANL;NIYSANVANLF;IYSANVANLFA;
YSANVANLFAG;SANVANLFAGE;ANVANLFAGEG;NVANLFAGEGA;VANLFAGEGAQ;ANL
FAGEGAQA;NLFAGEGAQAA;LFAGEGAQAAQ;FAGEGAQAAQA;AGEGAQAAQAA;GEGAQA
AQAAP;EGAQAAQAAPV;GAQAAQAAPVQ;AQAAQAAPVQE;QAAQAAPVQEG;AAQAAPVQE
GA;AQAAPVQEGAQ;QAAPVQEGAQE;AAPVQEGAQEE;APVQEGAQEEG;PVQEGAQEEGA;
VQEGAQEEGAQ;QEGAQEEGAQQ;EGAQEEGAQQP;GAQEEGAQQPT;AQEEGAQQPTP;QEE

Fig. 43 continued

GAQQPTPA;EEGAQQPTPAT;EGAQQPTPATA;GAQQPTPATAP;AQQPTPATAPT;QQPTPA
TAPTQ;QPTPATAPTQG;PTPATAPTQGG;TPATAPTQGGV;PATAPTQGGVN;ATAPTQGGV
NS;TAPTQGGVNSP;APTQGGVNSPV;PTQGGVNSPVN;TQGGVNSPVNV;QGGVNSPVNVT;
GGVNSPVNVTT;GVNSPVNVTTT;VNSPVNVTTTV;NSPVNVTTTVD;SPVNVTTTVDA;PVN
VTTTVDAN;VNVTTTVDANT;NVTTTVDANTS;VTTTVDANTSL;TTTVDANTSLA;TTVDAN
TSLAK;TVDANTSLAKI;VDANTSLAKIE;DANTSLAKIEN;ANTSLAKIENA;NTSLAKIEN
AI;TSLAKIENAIR;SLAKIENAIRM;LAKIENAIRMI;AKIENAIRMIS;KIENAIRMISD;
IENAIRMISDQ;ENAIRMISDQR;NAIRMISDQRA;AIRMISDQRAN;IRMISDQRANL;RMI
SDQRANLG;MISDQRANLGA;ISDQRANLGAF;SDQRANLGAFQ;DQRANLGAFQN;QRANLG
AFQNR;RANLGAFQNRL;ANLGAFQNRLE;NLGAFQNRLES;LGAFQNRLESI;GAFQNRLES
IK;AFQNRLESIKN;FQNRLESIKNS;QNRLESIKNST;NRLESIKNSTE;RLESIKNSTEY;
LESIKNSTEYA;ESIKNSTEYAI;SIKNSTEYAIE;IKNSTEYAIEN;KNSTEYAIENL;NST
EYAIENLK;STEYAIENLKA;TEYAIENLKAS;EYAIENLKASY;YAIENLKASYA;AIENLK
ASYAQ;IENLKASYAQI;ENLKASYAQIK;NLKASYAQIKD;LKASYAQIKDA;KASYAQIKD
AT;ASYAQIKDATM;SYAQIKDATMT;YAQIKDATMTD;AQIKDATMTDE;QIKDATMTDEV;
IKDATMTDEVV;KDATMTDEVVA;DATMTDEVVAA;ATMTDEVVAAT;TMTDEVVAATT;MTD
EVVAATTN;TDEVVAATTNS;DEVVAATTNSI;EVVAATTNSIL;VVAATTNSILT;VAATTN
SILTQ;AATTNSILTQS;ATTNSILTQSA;TTNSILTQSAM;TNSILTQSAMA;NSILTQSAM
AM;SILTQSAMAMI;ILTQSAMAMIA;LTQSAMAMIAQ;TQSAMAMIAQA;QSAMAMIAQAN;
SAMAMIAQANQ;AMAMIAQANQV;MAMIAQANQVP;AMIAQANQVPQ;MIAQANQVPQY;IAQ
ANQVPQYV;AQANQVPQYVL;QANQVPQYVLS;ANQVPQYVLSL;NQVPQYVLSLL;QVPQYV
LSLLR;

13 mers:
MIINHNTSAINAS;IINHNTSAINASR;INHNTSAINASRN;NHNTSAINASRNN;HNTSAIN
ASRNNA;NTSAINASRNNAI;TSAINASRNNAIN;SAINASRNNAINA;AINASRNNAINAA;
INASRNNAINAAN;NASRNNAINAANL;ASRNNAINAANLS;SRNNAINAANLSK;RNNAINA
ANLSKT;NNAINAANLSKTQ;NAINAANLSKTQE;AINAANLSKTQEK;INAANLSKTQEKL;
NAANLSKTQEKLS;AANLSKTQEKLSS;ANLSKTQEKLSSG;NLSKTQEKLSSGY;LSKTQEK
LSSGYR;SKTQEKLSSGYRI;KTQEKLSSGYRIN;TQEKLSSGYRINR;QEKLSSGYRINRA;
EKLSSGYRINRAS;KLSSGYRINRASD;LSSGYRINRASDD;SSGYRINRASDDA;SGYRINR
ASDDAA;GYRINRASDDAAG;YRINRASDDAAGM;RINRASDDAAGMG;INRASDDAAGMGV;
NRASDDAAGMGVS;RASDDAAGMGVSG;ASDDAAGMGVSGK;SDDAAGMGVSGKI;DDAAGMG
VSGKIN;DAAGMGVSGKINA;AAGMGVSGKINAQ;AGMGVSGKINAQI;GMGVSGKINAQIR;
MGVSGKINAQIRG;GVSGKINAQIRGL;VSGKINAQIRGLS;SGKINAQIRGLSQ;GKINAQI
RGLSQA;KINAQIRGLSQAS;INAQIRGLSQASR;NAQIRGLSQASRN;AQIRGLSQASRNT;
QIRGLSQASRNTS;IRGLSQASRNTSK;RGLSQASRNTSKA;GLSQASRNTSKAI;LSQASRN
TSKAIN;SQASRNTSKAINF;QASRNTSKAINFI;ASRNTSKAINFIQ;SRNTSKAINFIQT;
RNTSKAINFIQTT;NTSKAINFIQTTE;TSKAINFIQTTEG;SKAINFIQTTEGN;KAINFIQ
TTEGNL;AINFIQTTEGNLN;INFIQTTEGNLNE;NFIQTTEGNLNEV;FIQTTEGNLNEVE;
IQTTEGNLNEVEK;QTTEGNLNEVEKV;TTEGNLNEVEKVL;TEGNLNEVEKVLV;EGNLNEV
EKVLVR;GNLNEVEKVLVRM;NLNEVEKVLVRMK;LNEVEKVLVRMKE;NEVEKVLVRMKEL;
EVEKVLVRMKELA;VEKVLVRMKELAV;EKVLVRMKELAVQ;KVLVRMKELAVQS;VLVRMKE
LAVQSG;LVRMKELAVQSGN;VRMKELAVQSGNG;RMKELAVQSGNGT;MKELAVQSGNGTY;
KELAVQSGNGTYS;ELAVQSGNGTYSD;LAVQSGNGTYSDS;AVQSGNGTYSDSD;VQSGNGT
YSDSDR;QSGNGTYSDSDRG;SGNGTYSDSDRGS;GNGTYSDSDRGSI;NGTYSDSDRGSIQ;
GTYSDSDRGSIQI;TYSDSDRGSIQIE;YSDSDRGSIQIEI;SDSDRGSIQIEIE;DSDRGSI
QIEIEQ;SDRGSIQIEIEQL;DRGSIQIEIEQLT;RGSIQIEIEQLTD;GSIQIEIEQLTDE;
SIQIEIEQLTDEI;IQIEIEQLTDEIN;QIEIEQLTDEINR;IEIEQLTDEINRI;EIEQLTD
EINRIA;IEQLTDEINRIAD;EQLTDEINRIADQ;QLTDEINRIADQA;LTDEINRIADQAQ;
TDEINRIADQAQY;DEINRIADQAQYN;EINRIADQAQYNQ;INRIADQAQYNQM;NRIADQA
QYNQMH;RIADQAQYNQMHM;IADQAQYNQMHML;ADQAQYNQMHMLS;DQAQYNQMHMLSN;
QAQYNQMHMLSNK;AQYNQMHMLSNKS;QYNQMHMLSNKSA;YNQMHMLSNKSAS;NQMHMLS
NKSASQ;QMHMLSNKSASQN;MHMLSNKSASQNV;HMLSNKSASQNVK;MLSNKSASQNVKT;
LSNKSASQNVKTA;SNKSASQNVKTAE;NKSASQNVKTAEE;KSASQNVKTAEEL;SASQNVK
TAEELG;ASQNVKTAEELGM;SQNVKTAEELGMQ;QNVKTAEELGMQP;NVKTAEELGMQPA;
VKTAEELGMQPAK;KTAEELGMQPAKI;TAEELGMQPAKIN;AEELGMQPAKINT;EELGMQP

Fig. 43 continued

AKINTP;ELGMQPAKINTPA;LGMQPAKINTPAS;GMQPAKINTPASL;MQPAKINTPASLS;
QPAKINTPASLSG;PAKINTPASLSGS;AKINTPASLSGSQ;KINTPASLSGSQA;INTPASL
SGSQAS;NTPASLSGSQASW;TPASLSGSQASWT;PASLSGSQASWTL;ASLSGSQASWTLR;
SLSGSQASWTLRV;LSGSQASWTLRVH;SGSQASWTLRVHV;GSQASWTLRVHVG;SQASWTL
RVHVGA;QASWTLRVHVGAN;ASWTLRVHVGANQ;SWTLRVHVGANQD;WTLRVHVGANQDE;
TLRVHVGANQDEA;LRVHVGANQDEAI;RVHVGANQDEAIA;VHVGANQDEAIAV;HVGANQD
EAIAVN;VGANQDEAIAVNI;GANQDEAIAVNIY;ANQDEAIAVNIYS;NQDEAIAVNIYSA;
QDEAIAVNIYSAN;DEAIAVNIYSANV;EAIAVNIYSANVA;AIAVNIYSANVAN;IAVNIYS
ANVANL;AVNIYSANVANLF;VNIYSANVANLFA;NIYSANVANLFAG;IYSANVANLFAGE;
YSANVANLFAGEG;SANVANLFAGEGA;ANVANLFAGEGAQ;NVANLFAGEGAQA;VANLFAG
EGAQAA;ANLFAGEGAQAAQ;NLFAGEGAQAAQA;LFAGEGAQAAQAA;FAGEGAQAAQAAP;
AGEGAQAAQAAPV;GEGAQAAQAAPVQ;EGAQAAQAAPVQE;GAQAAQAAPVQEG;AQAAQAA
PVQEGA;QAAQAAPVQEGAQ;AAQAAPVQEGAQE;AQAAPVQEGAQEE;QAAPVQEGAQEEG;
AAPVQEGAQEEGA;APVQEGAQEEGAQ;PVQEGAQEEGAQQ;VQEGAQEEGAQQP;QEGAQEE
GAQQPT;EGAQEEGAQQPTP;GAQEEGAQQPTPA;AQEEGAQQPTPAT;QEEGAQQPTPATA;
EEGAQQPTPATAP;EGAQQPTPATAPT;GAQQPTPATAPTQ;AQQPTPATAPTQG;QQPTPAT
APTQGG;QPTPATAPTQGGV;PTPATAPTQGGVN;TPATAPTQGGVNS;PATAPTQGGVNSP;
ATAPTQGGVNSPV;TAPTQGGVNSPVN;APTQGGVNSPVNV;PTQGGVNSPVNVT;TQGGVNS
PVNVTT;QGGVNSPVNVTTT;GGVNSPVNVTTTV;GVNSPVNVTTTVD;VNSPVNVTTTVDA;
NSPVNVTTTVDAN;SPVNVTTTVDANT;PVNVTTTVDANTS;VNVTTTVDANTSL;NVTTTVD
ANTSLA;VTTTVDANTSLAK;TTTVDANTSLAKI;TTVDANTSLAKIE;TVDANTSLAKIEN;
VDANTSLAKIENA;DANTSLAKIENAI;ANTSLAKIENAIR;NTSLAKIENAIRM;TSLAKIE
NAIRMI;SLAKIENAIRMIS;LAKIENAIRMISD;AKIENAIRMISDQ;KIENAIRMISDQR;
IENAIRMISDQRA;ENAIRMISDQRAN;NAIRMISDQRANL;AIRMISDQRANLG;IRMISDQ
RANLGA;RMISDQRANLGAF;MISDQRANLGAFQ;ISDQRANLGAFQN;SDQRANLGAFQNR;
DQRANLGAFQNRL;QRANLGAFQNRLE;RANLGAFQNRLES;ANLGAFQNRLESI;NLGAFQN
RLESIK;LGAFQNRLESIKN;GAFQNRLESIKNS;AFQNRLESIKNST;FQNRLESIKNSTE;
QNRLESIKNSTEY;NRLESIKNSTEYA;RLESIKNSTEYAI;LESIKNSTEYAIE;ESIKNST
EYAIEN;SIKNSTEYAIENL;IKNSTEYAIENLK;KNSTEYAIENLKA;NSTEYAIENLKAS;
STEYAIENLKASY;TEYAIENLKASYA;EYAIENLKASYAQ;YAIENLKASYAQI;AIENLKA
SYAQIK;IENLKASYAQIKD;ENLKASYAQIKDA;NLKASYAQIKDAT;LKASYAQIKDATM;
KASYAQIKDATMT;ASYAQIKDATMTD;SYAQIKDATMTDE;YAQIKDATMTDEV;AQIKDAT
MTDEVV;QIKDATMTDEVVA;IKDATMTDEVVAA;KDATMTDEVVAAT;DATMTDEVVAATT;
ATMTDEVVAATTN;TMTDEVVAATTNS;MTDEVVAATTNSI;TDEVVAATTNSIL;DEVVAAT
TNSILT;EVVAATTNSILTQ;VVAATTNSILTQS;VAATTNSILTQSA;AATTNSILTQSAM;
ATTNSILTQSAMA;TTNSILTQSAMAM;TNSILTQSAMAMI;NSILTQSAMAMIA;SILTQSA
MAMIAQ;ILTQSAMAMIAQA;LTQSAMAMIAQAN;TQSAMAMIAQANQ;QSAMAMIAQANQV;
SAMAMIAQANQVP;AMAMIAQANQVPQ;MAMIAQANQVPQY;AMIAQANQVPQYV;MIAQANQ
VPQYVL;IAQANQVPQYVLS;AQANQVPQYVLSL;QANQVPQYVLSLL;ANQVPQYVLSLLR;

14 mers:
MIINHNTSAINASR;IINHNTSAINASRN;INHNTSAINASRNN;NHNTSAINASRNNA;HNT
SAINASRNNAI;NTSAINASRNNAIN;TSAINASRNNAINA;SAINASRNNAINAA;AINASR
NNAINAAN;INASRNNAINAANL;NASRNNAINAANLS;ASRNNAINAANLSK;SRNNAINAA
NLSKT;RNNAINAANLSKTQ;NNAINAANLSKTQE;NAINAANLSKTQEK;AINAANLSKTQE
KL;INAANLSKTQEKLS;NAANLSKTQEKLSS;AANLSKTQEKLSSG;ANLSKTQEKLSSGY;
NLSKTQEKLSSGYR;LSKTQEKLSSGYRI;SKTQEKLSSGYRIN;KTQEKLSSGYRINR;TQE
KLSSGYRINRA;QEKLSSGYRINRAS;EKLSSGYRINRASD;KLSSGYRINRASDD;LSSGYR
INRASDDA;SSGYRINRASDDAA;SGYRINRASDDAAG;GYRINRASDDAAGM;YRINRASDD
AAGMG;RINRASDDAAGMGV;INRASDDAAGMGVS;NRASDDAAGMGVSG;RASDDAAGMGVS
GK;ASDDAAGMGVSGKI;SDDAAGMGVSGKIN;DDAAGMGVSGKINA;DAAGMGVSGKINAQ;
AAGMGVSGKINAQI;AGMGVSGKINAQIR;GMGVSGKINAQIRG;MGVSGKINAQIRGL;GVS
GKINAQIRGLS;VSGKINAQIRGLSQ;SGKINAQIRGLSQA;GKINAQIRGLSQAS;KINAQI
RGLSQASR;INAQIRGLSQASRN;NAQIRGLSQASRNT;AQIRGLSQASRNTS;QIRGLSQAS
RNTSK;IRGLSQASRNTSKA;RGLSQASRNTSKAI;GLSQASRNTSKAIN;LSQASRNTSKAI
NF;SQASRNTSKAINFI;QASRNTSKAINFIQ;ASRNTSKAINFIQT;SRNTSKAINFIQTT;
RNTSKAINFIQTTE;NTSKAINFIQTTEG;TSKAINFIQTTEGN;SKAINFIQTTEGNL;KAI

Fig. 43 continued

NFIQTTEGNLN; AINFIQTTEGNLNE; INFIQTTEGNLNEV; NFIQTTEGNLNEVE; FIQTTE
GNLNEVEK; IQTTEGNLNEVEKV; QTTEGNLNEVEKVL; TTEGNLNEVEKVLV; TEGNLNEVE
KVLVR; EGNLNEVEKVLVRM; GNLNEVEKVLVRMK; NLNEVEKVLVRMKE; LNEVEKVLVRMK
EL; NEVEKVLVRMKELA; EVEKVLVRMKELAV; VEKVLVRMKELAVQ; EKVLVRMKELAVQS;
KVLVRMKELAVQSG; VLVRMKELAVQSGN; LVRMKELAVQSGNG;VRMKELAVQSGNGT;RMK
ELAVQSGNGTY;MKELAVQSGNGTYS;KELAVQSGNGTYSD;ELAVQSGNGTYSDS;LAVQSG
NGTYSDSD;AVQSGNGTYSDSDR;VQSGNGTYSDSDRG;QSGNGTYSDSDRGS;SGNGTYSDS
DRGSI;GNGTYSDSDRGSIQ;NGTYSDSDRGSIQI;GTYSDSDRGSIQIE;TYSDSDRGSIQI
EI;YSDSDRGSIQIEIE;SDSDRGSIQIEIEQ;DSDRGSIQIEIEQL;SDRGSIQIEIEQLT;
DRGSIQIEIEQLTD;RGSIQIEIEQLTDE;GSIQIEIEQLTDEI;SIQIEIEQLTDEIN;IQI
EIEQLTDEINR;QIEIEQLTDEINRI;IEIEQLTDEINRIA;EIEQLTDEINRIAD;IEQLTD
EINRIADQ;EQLTDEINRIADQA;QLTDEINRIADQAQ;LTDEINRIADQAQY;TDEINRIAD
QAQYN;DEINRIADQAQYNQ;EINRIADQAQYNQM;INRIADQAQYNQMH;NRIADQAQYNQM
HM;RIADQAQYNQMHML;IADQAQYNQMHMLS;ADQAQYNQMHMLSN;DQAQYNQMHMLSNK;
QAQYNQMHMLSNKS;AQYNQMHMLSNKSA;QYNQMHMLSNKSAS;YNQMHMLSNKSASQ;NQM
HMLSNKSASQN;QMHMLSNKSASQNV;MHMLSNKSASQNVK;HMLSNKSASQNVKT;MLSNKS
ASQNVKTA;LSNKSASQNVKTAE;SNKSASQNVKTAEE;NKSASQNVKTAEEL;KSASQNVKT
AEELG;SASQNVKTAEELGM;ASQNVKTAEELGMQ;SQNVKTAEELGMQP;QNVKTAEELGMQ
PA;NVKTAEELGMQPAK;VKTAEELGMQPAKI;KTAEELGMQPAKIN;TAEELGMQPAKINT;
AEELGMQPAKINTP;EELGMQPAKINTPA;ELGMQPAKINTPAS;LGMQPAKINTPASL;GMQ
PAKINTPASLS;MQPAKINTPASLSG;QPAKINTPASLSGS;PAKINTPASLSGSQ;AKINTP
ASLSGSQA;KINTPASLSGSQAS;INTPASLSGSQASW;NTPASLSGSQASWT;TPASLSGSQ
ASWTL;PASLSGSQASWTLR;ASLSGSQASWTLRV;SLSGSQASWTLRVH;LSGSQASWTLRV
HV;SGSQASWTLRVHVG;GSQASWTLRVHVGA;SQASWTLRVHVGAN;QASWTLRVHVGANQ;
ASWTLRVHVGANQD;SWTLRVHVGANQDE;WTLRVHVGANQDEA;TLRVHVGANQDEAI;LRV
HVGANQDEAIA;RVHVGANQDEAIAV;VHVGANQDEAIAVN;HVGANQDEAIAVNI;VGANQD
EAIAVNIY;GANQDEAIAVNIYS;ANQDEAIAVNIYSA;NQDEAIAVNIYSAN;QDEAIAVNI
YSANV;DEAIAVNIYSANVA;EAIAVNIYSANVAN;AIAVNIYSANVANL;IAVNIYSANVAN
LF;AVNIYSANVANLFA;VNIYSANVANLFAG;NIYSANVANLFAGE;IYSANVANLFAGEG;
YSANVANLFAGEGA;SANVANLFAGEGAQ;ANVANLFAGEGAQA;NVANLFAGEGAQAA;VAN
LFAGEGAQAAQ;ANLFAGEGAQAAQA;NLFAGEGAQAAQAA;LFAGEGAQAAQAAP;FAGEGA
QAAQAAPV;AGEGAQAAQAAPVQ;GEGAQAAQAAPVQE;EGAQAAQAAPVQEG;GAQAAQAAP
VQEGA;AQAAQAAPVQEGAQ;QAAQAAPVQEGAQE;AAQAAPVQEGAQEE;AQAAPVQEGAQE
EG;QAAPVQEGAQEEGA;AAPVQEGAQEEGAQ;APVQEGAQEEGAQQ;PVQEGAQEEGAQQP;
VQEGAQEEGAQQPT;QEGAQEEGAQQPTP;EGAQEEGAQQPTPA;GAQEEGAQQPTPAT;AQE
EGAQQPTPATA;QEEGAQQPTPATAP;EEGAQQPTPATAPT;EGAQQPTPATAPTQ;GAQQPT
PATAPTQG;AQQPTPATAPTQGG;QQPTPATAPTQGGV;QPTPATAPTQGGVN;PTPATAPTQ
GGVNS;TPATAPTQGGVNSP;PATAPTQGGVNSPV;ATAPTQGGVNSPVN;TAPTQGGVNSPV
NV;APTQGGVNSPVNVT;PTQGGVNSPVNVTT;TQGGVNSPVNVTTT;QGGVNSPVNVTTTV;
GGVNSPVNVTTTVD;GVNSPVNVTTTVDA;VNSPVNVTTTVDAN;NSPVNVTTTVDANT;SPV
NVTTTVDANTS;PVNVTTTVDANTSL;VNVTTTVDANTSLA;NVTTTVDANTSLAK;VTTTVD
ANTSLAKI;TTTVDANTSLAKIE;TTVDANTSLAKIEN;TVDANTSLAKIENA;VDANTSLAK
IENAI;DANTSLAKIENAIR;ANTSLAKIENAIRM;NTSLAKIENAIRMI;TSLAKIENAIRM
IS;SLAKIENAIRMISD;LAKIENAIRMISDQ;AKIENAIRMISDQR;KIENAIRMISDQRA;
IENAIRMISDQRAN;ENAIRMISDQRANL;NAIRMISDQRANLG;AIRMISDQRANLGA;IRM
ISDQRANLGAF;RMISDQRANLGAFQ;MISDQRANLGAFQN;ISDQRANLGAFQNR;SDQRAN
LGAFQNRL;DQRANLGAFQNRLE;QRANLGAFQNRLES;RANLGAFQNRLESI;ANLGAFQNR
LESIK;NLGAFQNRLESIKN;LGAFQNRLESIKNS;GAFQNRLESIKNST;AFQNRLESIKNS
TE;FQNRLESIKNSTEY;QNRLESIKNSTEYA;NRLESIKNSTEYAI;RLESIKNSTEYAIE;
LESIKNSTEYAIEN;ESIKNSTEYAIENL;SIKNSTEYAIENLK;IKNSTEYAIENLKA;KNS
TEYAIENLKAS;NSTEYAIENLKASY;STEYAIENLKASYA;TEYAIENLKASYAQ;EYAIEN
LKASYAQI;YAIENLKASYAQIK;AIENLKASYAQIKD;IENLKASYAQIKDA;ENLKASYAQ
IKDAT;NLKASYAQIKDATM;LKASYAQIKDATMT;KASYAQIKDATMTD;ASYAQIKDATMT
DE;SYAQIKDATMTDEV;YAQIKDATMTDEVV;AQIKDATMTDEVVA;QIKDATMTDEVVAA;
IKDATMTDEVVAAT;KDATMTDEVVAATT;DATMTDEVVAATTN;ATMTDEVVAATTNS;TMT
DEVVAATTNSI;MTDEVVAATTNSIL;TDEVVAATTNSILT;DEVVAATTNSILTQ;EVVAAT
TNSILTQS;VVAATTNSILTQSA;VAATTNSILTQSAM;AATTNSILTQSAMA;ATTNSILTQ

Fig. 43 continued

SAMAM;TTNSILTQSAMAMI;TNSILTQSAMAMIA;NSILTQSAMAMIAQ;SILTQSAMAMIA
QA;ILTQSAMAMIAQAN;LTQSAMAMIAQANQ;TQSAMAMIAQANQV;QSAMAMIAQANQVP;
SAMAMIAQANQVPQ;AMAMIAQANQVPQY;MAMIAQANQVPQYV;AMIAQANQVPQYVL;MIA
QANQVPQYVLS;IAQANQVPQYVLSL;AQANQVPQYVLSLL;QANQVPQYVLSLLR;

15 mers:
MIINHNTSAINASRN;IINHNTSAINASRNN;INHNTSAINASRNNA;NHNTSAINASRNNAI
;HNTSAINASRNNAIN;NTSAINASRNNAINA;TSAINASRNNAINAA;SAINASRNNAINAA
N;AINASRNNAINAANL;INASRNNAINAANLS;NASRNNAINAANLSK;ASRNNAINAANLS
KT;SRNNAINAANLSKTQ;RNNAINAANLSKTQE;NNAINAANLSKTQEK;NAINAANLSKTQ
EKL;AINAANLSKTQEKLS;INAANLSKTQEKLSS;NAANLSKTQEKLSSG;AANLSKTQEKL
SSGY;ANLSKTQEKLSSGYR;NLSKTQEKLSSGYRI;LSKTQEKLSSGYRIN;SKTQEKLSSG
YRINR;KTQEKLSSGYRINRA;TQEKLSSGYRINRAS;QEKLSSGYRINRASD;EKLSSGYRI
NRASDD;KLSSGYRINRASDDA;LSSGYRINRASDDAA;SSGYRINRASDDAAG;SGYRINRA
SDDAAGM;GYRINRASDDAAGMG;YRINRASDDAAGMGV;RINRASDDAAGMGVS;INRASDD
AAGMGVSG;NRASDDAAGMGVSGK;RASDDAAGMGVSGKI;ASDDAAGMGVSGKIN;SDDAAG
MGVSGKINA;DDAAGMGVSGKINAQ;DAAGMGVSGKINAQI;AAGMGVSGKINAQIR;AGMGV
SGKINAQIRG;GMGVSGKINAQIRGL;MGVSGKINAQIRGLS;GVSGKINAQIRGLSQ;VSGK
INAQIRGLSQA;SGKINAQIRGLSQAS;GKINAQIRGLSQASR;KINAQIRGLSQASRN;INA
QIRGLSQASRNT;NAQIRGLSQASRNTS;AQIRGLSQASRNTSK;QIRGLSQASRNTSKA;IR
GLSQASRNTSKAI;RGLSQASRNTSKAIN;GLSQASRNTSKAINF;LSQASRNTSKAINFI;S
QASRNTSKAINFIQ;QASRNTSKAINFIQT;ASRNTSKAINFIQTT;SRNTSKAINFIQTTE;
RNTSKAINFIQTTEG;NTSKAINFIQTTEGN;TSKAINFIQTTEGNL;SKAINFIQTTEGNLN
;KAINFIQTTEGNLNE;AINFIQTTEGNLNEV;INFIQTTEGNLNEVE;NFIQTTEGNLNEVE
K;FIQTTEGNLNEVEKV;IQTTEGNLNEVEKVL;QTTEGNLNEVEKVLV;TTEGNLNEVEKVL
VR;TEGNLNEVEKVLVRM;EGNLNEVEKVLVRMK;GNLNEVEKVLVRMKE;NLNEVEKVLVRM
KEL;LNEVEKVLVRMKELA;NEVEKVLVRMKELAV;EVEKVLVRMKELAVQ;VEKVLVRMKEL
AVQS;EKVLVRMKELAVQSG;KVLVRMKELAVQSGN;VLVRMKELAVQSGNG;LVRMKELAVQ
SGNGT;VRMKELAVQSGNGTY;RMKELAVQSGNGTYS;MKELAVQSGNGTYSD;KELAVQSGN
GTYSDS;ELAVQSGNGTYSDSD;LAVQSGNGTYSDSDR;AVQSGNGTYSDSDRG;VQSGNGTY
SDSDRGS;QSGNGTYSDSDRGSI;SGNGTYSDSDRGSIQ;GNGTYSDSDRGSIQI;NGTYSDS
DRGSIQIE;GTYSDSDRGSIQIEI;TYSDSDRGSIQIEIE;YSDSDRGSIQIEIEQ;SDSDRG
SIQIEIEQL;DSDRGSIQIEIEQLT;SDRGSIQIEIEQLTD;DRGSIQIEIEQLTDE;RGSIQ
IEIEQLTDEI;GSIQIEIEQLTDEIN;SIQIEIEQLTDEINR;IQIEIEQLTDEINRI;QIEI
EQLTDEINRIA;IEIEQLTDEINRIAD;EIEQLTDEINRIADQ;IEQLTDEINRIADQA;EQL
TDEINRIADQAQ;QLTDEINRIADQAQY;LTDEINRIADQAQYN;TDEINRIADQAQYNQ;DE
INRIADQAQYNQM;EINRIADQAQYNQMH;INRIADQAQYNQMHM;NRIADQAQYNQMHML;R
IADQAQYNQMHMLS;IADQAQYNQMHMLSN;ADQAQYNQMHMLSNK;DQAQYNQMHMLSNKS;
QAQYNQMHMLSNKSA;AQYNQMHMLSNKSAS;QYNQMHMLSNKSASQ;YNQMHMLSNKSASQN
;NQMHMLSNKSASQNV;QMHMLSNKSASQNVK;MHMLSNKSASQNVKT;HMLSNKSASQNVKT
A;MLSNKSASQNVKTAE;LSNKSASQNVKTAEE;SNKSASQNVKTAEEL;NKSASQNVKTAEE
LG;KSASQNVKTAEELGM;SASQNVKTAEELGMQ;ASQNVKTAEELGMQP;SQNVKTAEELGM
QPA;QNVKTAEELGMQPAK;NVKTAEELGMQPAKI;VKTAEELGMQPAKIN;KTAEELGMQPA
KINT;TAEELGMQPAKINTP;AEELGMQPAKINTPA;EELGMQPAKINTPAS;ELGMQPAKIN
TPASL;LGMQPAKINTPASLS;GMQPAKINTPASLSG;MQPAKINTPASLSGS;QPAKINTPA
SLSGSQ;PAKINTPASLSGSQA;AKINTPASLSGSQAS;KINTPASLSGSQASW;INTPASLS
GSQASWT;NTPASLSGSQASWTL;TPASLSGSQASWTLR;PASLSGSQASWTLRV;ASLSGSQ
ASWTLRVH;SLSGSQASWTLRVHV;LSGSQASWTLRVHVG;SGSQASWTLRVHVGA;GSQASW
TLRVHVGAN;SQASWTLRVHVGANQ;QASWTLRVHVGANQD;ASWTLRVHVGANQDE;SWTLR
VHVGANQDEA;WTLRVHVGANQDEAI;TLRVHVGANQDEAIA;LRVHVGANQDEAIAV;RVHV
GANQDEAIAVN;VHVGANQDEAIAVNI;HVGANQDEAIAVNIY;VGANQDEAIAVNIYS;GAN
QDEAIAVNIYSA;ANQDEAIAVNIYSAN;NQDEAIAVNIYSANV;QDEAIAVNIYSANVA;DE
AIAVNIYSANVAN;EAIAVNIYSANVANL;AIAVNIYSANVANLF;IAVNIYSANVANLFA;A
VNIYSANVANLFAG;VNIYSANVANLFAGE;NIYSANVANLFAGEG;IYSANVANLFAGEGA;
YSANVANLFAGEGAQ;SANVANLFAGEGAQA;ANVANLFAGEGAQAA;NVANLFAGEGAQAAQ
;VANLFAGEGAQAAQA;ANLFAGEGAQAAQAA;NLFAGEGAQAAQAAP;LFAGEGAQAAQAAP
V;FAGEGAQAAQAAPVQ;AGEGAQAAQAAPVQE;GEGAQAAQAAPVQEG;EGAQAAQAAPVQE

Fig. 43 continued

GA;GAQAAQAAPVQEGAQ;AQAAQAAPVQEGAQE;QAAQAAPVQEGAQEE;AAQAAPVQEGAQ
EEG;AQAAPVQEGAQEEGA;QAAPVQEGAQEEGAQ;AAPVQEGAQEEGAQQ;APVQEGAQEEG
AQQP;PVQEGAQEEGAQQPT;VQEGAQEEGAQQPTP;QEGAQEEGAQQPTPA;EGAQEEGAQQ
PTPAT;GAQEEGAQQPTPATA;AQEEGAQQPTPATAP;QEEGAQQPTPATAPT;EEGAQQPTP
ATAPTQ;EGAQQPTPATAPTQG;GAQQPTPATAPTQGG;AQQPTPATAPTQGGV;QQPTPATA
PTQGGVN;QPTPATAPTQGGVNS;PTPATAPTQGGVNSP;TPATAPTQGGVNSPV;PATAPTQ
GGVNSPVN;ATAPTQGGVNSPVNV;TAPTQGGVNSPVNVT;APTQGGVNSPVNVTT;PTQGGV
NSPVNVTTT;TQGGVNSPVNVTTTV;QGGVNSPVNVTTTVD;GGVNSPVNVTTTVDA;GVNSP
VNVTTTVDAN;VNSPVNVTTTVDANT;NSPVNVTTTVDANTS;SPVNVTTTVDANTSL;PVNV
TTTVDANTSLA;VNVTTTVDANTSLAK;NVTTTVDANTSLAKI;VTTTVDANTSLAKIE;TTT
VDANTSLAKIEN;TTVDANTSLAKIENA;TVDANTSLAKIENAI;VDANTSLAKIENAIR;DA
NTSLAKIENAIRM;ANTSLAKIENAIRMI;NTSLAKIENAIRMIS;TSLAKIENAIRMISD;S
LAKIENAIRMISDQ;LAKIENAIRMISDQR;AKIENAIRMISDQRA;KIENAIRMISDQRAN;
IENAIRMISDQRANL;ENAIRMISDQRANLG;NAIRMISDQRANLGA;AIRMISDQRANLGAF
;IRMISDQRANLGAFQ;RMISDQRANLGAFQN;MISDQRANLGAFQNR;ISDQRANLGAFQNR
L;SDQRANLGAFQNRLE;DQRANLGAFQNRLES;QRANLGAFQNRLESI;RANLGAFQNRLES
IK;ANLGAFQNRLESIKN;NLGAFQNRLESIKNS;LGAFQNRLESIKNST;GAFQNRLESIKN
STE;AFQNRLESIKNSTEY;FQNRLESIKNSTEYA;QNRLESIKNSTEYAI;NRLESIKNSTE
YAIE;RLESIKNSTEYAIEN;LESIKNSTEYAIENL;ESIKNSTEYAIENLK;SIKNSTEYAI
ENLKA;IKNSTEYAIENLKAS;KNSTEYAIENLKASY;NSTEYAIENLKASYA;STEYAIENL
KASYAQ;TEYAIENLKASYAQI;EYAIENLKASYAQIK;YAIENLKASYAQIKD;AIENLKAS
YAQIKDA;IENLKASYAQIKDAT;ENLKASYAQIKDATM;NLKASYAQIKDATMT;LKASYAQ
IKDATMTD;KASYAQIKDATMTDE;ASYAQIKDATMTDEV;SYAQIKDATMTDEVV;YAQIKD
ATMTDEVVA;AQIKDATMTDEVVAA;QIKDATMTDEVVAAT;IKDATMTDEVVAATT;KDATM
TDEVVAATTN;DATMTDEVVAATTNS;ATMTDEVVAATTNSI;TMTDEVVAATTNSIL;MTDE
VVAATTNSILT;TDEVVAATTNSILTQ;DEVVAATTNSILTQS;EVVAATTNSILTQSA;VVA
ATTNSILTQSAM;VAATTNSILTQSAMA;AATTNSILTQSAMAM;ATTNSILTQSAMAMI;TT
NSILTQSAMAMIA;TNSILTQSAMAMIAQ;NSILTQSAMAMIAQA;SILTQSAMAMIAQAN;I
LTQSAMAMIAQANQ;LTQSAMAMIAQANQV;TQSAMAMIAQANQVP;QSAMAMIAQANQVPQ;
SAMAMIAQANQVPQY;AMAMIAQANQVPQYV;MAMIAQANQVPQYVL;AMIAQANQVPQYVLS
;MIAQANQVPQYVLSL;IAQANQVPQYVLSLL;AQANQVPQYVLSLLR;

16 mers:
MIINHNTSAINASRNN;IINHNTSAINASRNNA;INHNTSAINASRNNAI;NHNTSAINASRN
NAIN;HNTSAINASRNNAINA;NTSAINASRNNAINAA;TSAINASRNNAINAAN;SAINASR
NNAINAANL;AINASRNNAINAANLS;INASRNNAINAANLSK;NASRNNAINAANLSKT;AS
RNNAINAANLSKTQ;SRNNAINAANLSKTQE;RNNAINAANLSKTQEK;NNAINAANLSKTQE
KL;NAINAANLSKTQEKLS;AINAANLSKTQEKLSS;INAANLSKTQEKLSSG;NAANLSKTQ
EKLSSGY;AANLSKTQEKLSSGYR;ANLSKTQEKLSSGYRI;NLSKTQEKLSSGYRIN;LSKT
QEKLSSGYRINR;SKTQEKLSSGYRINRA;KTQEKLSSGYRINRAS;TQEKLSSGYRINRASD
;QEKLSSGYRINRASDD;EKLSSGYRINRASDDA;KLSSGYRINRASDDAA;LSSGYRINRAS
DDAAG;SSGYRINRASDDAAGM;SGYRINRASDDAAGMG;GYRINRASDDAAGMGV;YRINRA
SDDAAGMGVS;RINRASDDAAGMGVSG;INRASDDAAGMGVSGK;NRASDDAAGMGVSGKI;R
ASDDAAGMGVSGKIN;ASDDAAGMGVSGKINA;SDDAAGMGVSGKINAQ;DDAAGMGVSGKIN
AQI;DAAGMGVSGKINAQIR;AAGMGVSGKINAQIRG;AGMGVSGKINAQIRGL;GMGVSGKI
NAQIRGLS;MGVSGKINAQIRGLSQ;GVSGKINAQIRGLSQA;VSGKINAQIRGLSQAS;SGK
INAQIRGLSQASR;GKINAQIRGLSQASRN;KINAQIRGLSQASRNT;INAQIRGLSQASRNT
S;NAQIRGLSQASRNTSK;AQIRGLSQASRNTSKA;QIRGLSQASRNTSKAI;IRGLSQASRN
TSKAIN;RGLSQASRNTSKAINF;GLSQASRNTSKAINFI;LSQASRNTSKAINFIQ;SQASR
NTSKAINFIQT;QASRNTSKAINFIQTT;ASRNTSKAINFIQTTE;SRNTSKAINFIQTTEG;
RNTSKAINFIQTTEGN;NTSKAINFIQTTEGNL;TSKAINFIQTTEGNLN;SKAINFIQTTEG
NLNE;KAINFIQTTEGNLNEV;AINFIQTTEGNLNEVE;INFIQTTEGNLNEVEK;NFIQTTE
GNLNEVEKV;FIQTTEGNLNEVEKVL;IQTTEGNLNEVEKVLV;QTTEGNLNEVEKVLVR;TT
EGNLNEVEKVLVRM;TEGNLNEVEKVLVRMK;EGNLNEVEKVLVRMKE;GNLNEVEKVLVRMK
EL;NLNEVEKVLVRMKELA;LNEVEKVLVRMKELAV;NEVEKVLVRMKELAVQ;EVEKVLVRM
KELAVQS;VEKVLVRMKELAVQSG;EKVLVRMKELAVQSGN;KVLVRMKELAVQSGNG;VLVR
MKELAVQSGNGT;LVRMKELAVQSGNGTY;VRMKELAVQSGNGTYS;RMKELAVQSGNGTYSD

Fig. 43 continued

;MKELAVQSGNGTYSDS;KELAVQSGNGTYSDSD;ELAVQSGNGTYSDSDR;LAVQSGNGTYS
DSDRG;AVQSGNGTYSDSDRGS;VQSGNGTYSDSDRGSI;QSGNGTYSDSDRGSIQ;SGNGTY
SDSDRGSIQI;GNGTYSDSDRGSIQIE;NGTYSDSDRGSIQIEI;GTYSDSDRGSIQIEIE;T
YSDSDRGSIQIEIEQ;YSDSDRGSIQIEIEQL;SDSDRGSIQIEIEQLT;DSDRGSIQIEIEQ
LTD;SDRGSIQIEIEQLTDE;DRGSIQIEIEQLTDEI;RGSIQIEIEQLTDEIN;GSIQIEIE
QLTDEINR;SIQIEIEQLTDEINRI;IQIEIEQLTDEINRIA;QIEIEQLTDEINRIAD;IEI
EQLTDEINRIADQ;EIEQLTDEINRIADQA;IEQLTDEINRIADQAQ;EQLTDEINRIADQAQ
Y;QLTDEINRIADQAQYN;LTDEINRIADQAQYNQ;TDEINRIADQAQYNQM;DEINRIADQA
QYNQMH;EINRIADQAQYNQMHM;INRIADQAQYNQMHML;NRIADQAQYNQMHMLS;RIADQ
AQYNQMHMLSN;IADQAQYNQMHMLSNK;ADQAQYNQMHMLSNKS;DQAQYNQMHMLSNKSA;
QAQYNQMHMLSNKSAS;AQYNQMHMLSNKSASQ;QYNQMHMLSNKSASQN;YNQMHMLSNKSA
SQNV;NQMHMLSNKSASQNVK;QMHMLSNKSASQNVKT;MHMLSNKSASQNVKTA;HMLSNKS
ASQNVKTAE;MLSNKSASQNVKTAEE;LSNKSASQNVKTAEEL;SNKSASQNVKTAEELG;NK
SASQNVKTAEELGM;KSASQNVKTAEELGMQ;SASQNVKTAEELGMQP;ASQNVKTAEELGMQ
PA;SQNVKTAEELGMQPAK;QNVKTAEELGMQPAKI;NVKTAEELGMQPAKIN;VKTAEELGM
QPAKINT;KTAEELGMQPAKINTP;TAEELGMQPAKINTPA;AEELGMQPAKINTPAS;EELG
MQPAKINTPASL;ELGMQPAKINTPASLS;LGMQPAKINTPASLSG;GMQPAKINTPASLSGS
;MQPAKINTPASLSGSQ;QPAKINTPASLSGSQA;PAKINTPASLSGSQAS;AKINTPASLSG
SQASW;KINTPASLSGSQASWT;INTPASLSGSQASWTL;NTPASLSGSQASWTLR;TPASLS
GSQASWTLRV;PASLSGSQASWTLRVH;ASLSGSQASWTLRVHV;SLSGSQASWTLRVHVG;L
SGSQASWTLRVHVGA;SGSQASWTLRVHVGAN;GSQASWTLRVHVGANQ;SQASWTLRVHVGA
NQD;QASWTLRVHVGANQDE;ASWTLRVHVGANQDEA;SWTLRVHVGANQDEAI;WTLRVHVG
ANQDEAIA;TLRVHVGANQDEAIAV;LRVHVGANQDEAIAVN;RVHVGANQDEAIAVNI;VHV
GANQDEAIAVNIY;HVGANQDEAIAVNIYS;VGANQDEAIAVNIYSA;GANQDEAIAVNIYSA
N;ANQDEAIAVNIYSANV;NQDEAIAVNIYSANVA;QDEAIAVNIYSANVAN;DEAIAVNIYS
ANVANL;EAIAVNIYSANVANLF;AIAVNIYSANVANLFA;IAVNIYSANVANLFAG;AVNIY
SANVANLFAGE;VNIYSANVANLFAGEG;NIYSANVANLFAGEGA;IYSANVANLFAGEGAQ;
YSANVANLFAGEGAQA;SANVANLFAGEGAQAA;ANVANLFAGEGAQAAQ;NVANLFAGEGAQ
AAQA;VANLFAGEGAQAAQAA;ANLFAGEGAQAAQAAP;NLFAGEGAQAAQAAPV;LFAGEGA
QAAQAAPVQ;FAGEGAQAAQAAPVQE;AGEGAQAAQAAPVQEG;GEGAQAAQAAPVQEGA;EG
AQAAQAAPVQEGAQ;GAQAAQAAPVQEGAQE;AQAAQAAPVQEGAQEE;QAAQAAPVQEGAQE
EG;AAQAAPVQEGAQEEGA;AQAAPVQEGAQEEGAQ;QAAPVQEGAQEEGAQQ;AAPVQEGAQ
EEGAQQP;APVQEGAQEEGAQQPT;PVQEGAQEEGAQQPTP;VQEGAQEEGAQQPTPA;QEGA
QEEGAQQPTPAT;EGAQEEGAQQPTPATA;GAQEEGAQQPTPATAP;AQEEGAQQPTPATAPT
;QEEGAQQPTPATAPTQ;EEGAQQPTPATAPTQG;EGAQQPTPATAPTQGG;GAQQPTPATAP
TQGGV;AQQPTPATAPTQGGVN;QQPTPATAPTQGGVNS;QPTPATAPTQGGVNSP;PTPATA
PTQGGVNSPV;TPATAPTQGGVNSPVN;PATAPTQGGVNSPVNV;ATAPTQGGVNSPVNVT;T
APTQGGVNSPVNVTT;APTQGGVNSPVNVTTT;PTQGGVNSPVNVTTTV;TQGGVNSPVNVTT
TVD;QGGVNSPVNVTTTVDA;GGVNSPVNVTTTVDAN;GVNSPVNVTTTVDANT;VNSPVNVT
TTVDANTS;NSPVNVTTTVDANTSL;SPVNVTTTVDANTSLA;PVNVTTTVDANTSLAK;VNV
TTTVDANTSLAKI;NVTTTVDANTSLAKIE;VTTTVDANTSLAKIEN;TTTVDANTSLAKIEN
A;TTVDANTSLAKIENAI;TVDANTSLAKIENAIR;VDANTSLAKIENAIRM;DANTSLAKIE
NAIRMI;ANTSLAKIENAIRMIS;NTSLAKIENAIRMISD;TSLAKIENAIRMISDQ;SLAKI
ENAIRMISDQR;LAKIENAIRMISDQRA;AKIENAIRMISDQRAN;KIENAIRMISDQRANL;
IENAIRMISDQRANLG;ENAIRMISDQRANLGA;NAIRMISDQRANLGAF;AIRMISDQRANL
GAFQ;IRMISDQRANLGAFQN;RMISDQRANLGAFQNR;MISDQRANLGAFQNRL;ISDQRAN
LGAFQNRLE;SDQRANLGAFQNRLES;DQRANLGAFQNRLESI;QRANLGAFQNRLESIK;RA
NLGAFQNRLESIKN;ANLGAFQNRLESIKNS;NLGAFQNRLESIKNST;LGAFQNRLESIKNS
TE;GAFQNRLESIKNSTEY;AFQNRLESIKNSTEYA;FQNRLESIKNSTEYAI;QNRLESIKN
STEYAIE;NRLESIKNSTEYAIEN;RLESIKNSTEYAIENL;LESIKNSTEYAIENLK;ESIK
NSTEYAIENLKA;SIKNSTEYAIENLKAS;IKNSTEYAIENLKASY;KNSTEYAIENLKASYA
;NSTEYAIENLKASYAQ;STEYAIENLKASYAQI;TEYAIENLKASYAQIK;EYAIENLKASY
AQIKD;YAIENLKASYAQIKDA;AIENLKASYAQIKDAT;IENLKASYAQIKDATM;ENLKAS
YAQIKDATMT;NLKASYAQIKDATMTD;LKASYAQIKDATMTDE;KASYAQIKDATMTDEV;A
SYAQIKDATMTDEVV;SYAQIKDATMTDEVVA;YAQIKDATMTDEVVAA;AQIKDATMTDEVV
AAT;QIKDATMTDEVVAATT;IKDATMTDEVVAATTN;KDATMTDEVVAATTNS;DATMTDEV
VAATTNSI;ATMTDEVVAATTNSIL;TMTDEVVAATTNSILT;MTDEVVAATTNSILTQ;TDE

Fig. 43 continued

| | |
|---|---|
| VVAATTNSILTQS;DEVVAATTNSILTQSA;EVVAATTNSILTQSAM;VVAATTNSILTQSAM A;VAATTNSILTQSAMAM;AATTNSILTQSAMAMI;ATTNSILTQSAMAMIA;TTNSILTQSA MAMIAQ;TNSILTQSAMAMIAQA;NSILTQSAMAMIAQAN;SILTQSAMAMIAQANQ;ILTQS AMAMIAQANQV;LTQSAMAMIAQANQVP;TQSAMAMIAQANQVPQ;QSAMAMIAQANQVPQY; SAMAMIAQANQVPQYV;AMAMIAQANQVPQYVL;MAMIAQANQVPQYVLS;AMIAQANQVPQY VLSL;MIAQANQVPQYVLSLL;IAQANQVPQYVLSLLR | |
| <CAA57807.1 associated protein A;Borrelia burgdorferi<br>MKKISLLIFLFLFVVSLSANIEENYTETKRAFSKEDFNLINKRLDNYDFKNEYEKSHVFSDAP RIRGDLRKIGIKEKSVFLDALEAIEYLIKIKISTDSIFLSEDMIRLIGSYPDSIFNYLIQLNS DKIDYAEKYGDNARNNFKKDYSEDKANTVKQILKQILADLPKD<br><br>8-mer<br>KISLLIFL;ISLLIFLF;SLLIFLFL;LLIFLFLF;LIFLFLFV;IFLFLFVV;FLFLFVVS; LFLFVVSL;FLFVVSLS;SLSANIEE;SANIEENY;EENYTETK;ENYTETKR;YTETKRAF; ETKRAFSK;RAFSKEDF;FSKEDFNL;EDFNLINK;DFNLINKR;KRLDNYDF;RLDNYDFK; DFKNEYEK;EYEKSHVF;HVFSDAPR;APRIRGDL;RIRGDLRK;FLDALEAI;DALEAIEY; ALEAIEYL;LEAIEYLI;EAIEYLIK;EYLIKIKI;KISTDSIF;IFLSEDMI;FLSEDMIR; SEDMIRLI;MIRLIGSY;GSYPDSIF;YPDSIFNY;DSIFNYLI;SIFNYLIQ;LIQLNSDK; IQLNSDKI;KIDYAEKY;AEKYGDNA;EKYGDNAR;DNARNNFK;NARNNFKK;SEDKANTV; NTVKQILK;KQILKQIL;QILKQILA;QILADLPK<br><br>9-mer<br>KKISLLIFL;KISLLIFLF;SLLIFLFLF;LLIFLFLFV;LIFLFLFVV;FLFLFVVSL;FLF VVSLSA;FVVSLSANI;LSANIEENY;EENYTETKR;NYTETKRAF;ETKRAFSKE;AFSKED FNL;FSKEDFNLI;EDFNLINKR;LINKRLDNY;KRLDNYDFK;RLDNYDFKN;YDFKNEYEK ;NEYEKSHVF;HVFSDAPRI;VFSDAPRIR;RIRGDLRKI;KIGIKEKSV;GIKEKSVFL;SV FLDALEA;FLDALEAIE;DALEAIEYL;ALEAIEYLI;EAIEYLIKI;AIEYLIKIK;IEYLI KIKI;YLIKIKIST;KIKISTDSI;KISTDSIFL;IFLSEDMIR;FLSEDMIRL;DMIRLIGS Y;LIGSYPDSI;SYPDSIFNY;YPDSIFNYL;SIFNYLIQL;YLIQLNSDK;QLNSDKIDY;D NARNNFKK;KQILKQILA;ILKQILADL;KQILADLPK<br><br>10mer<br>KISLLIFLFL;ISLLIFLFLF;SLLIFLFLFV;LLIFLFLFVV;IFLFLFVVSL;FLFLFVVS LS;FLFVVSLSAN;SLSANIEENY;NIEENYTETK;EENYTETKRA;YTETKRAFSK;RAFSK EDFNL;AFSKEDFNLI;NLINKRLDNY;NYDFKNEYEK;FKNEYEKSHV;KSHVFSDAPR;HV FSDAPRIR;DAPRIRGDLR;KEKSVFLDAL;SVFLDALEAI;FLDALEAIEY;LDALEAIEYL ;DALEAIEYLI;ALEAIEYLIK;LEAIEYLIKI;EAIEYLIKIK;KIKISTDSIF;SIFLSED MIR;IFLSEDMIRL;FLSEDMIRLI;RLIGSYPDSI;GSYPDSIFNY;SYPDSIFNYL;YPDS IFNYLI;NYLIQLNSDK;YLIQLNSDKI;IQLNSDKIDY;QLNSDKIDYA;NSDKIDYAEK;Y AEKYGDNAR;KYGDNARNNF;KANTVKQILK;NTVKQILKQI;QILKQILADL<br><br>11-mer<br>KKISLLIFLFL;KISLLIFLFLF;ISLLIFLFLFV;SLLIFLFLFVV;LIFLFLFVVSL;FLF LFVVSLSA;FLFVVSLSANI;SLSANIEENYT;NIEENYTETKR;EENYTETKRAF;NYTETK RAFSK;ETKRAFSKEDF;RAFSKEDFNLI;FSKEDFNLINK;KEDFNLINKRL;INKRLDNYD FK;RLDNYDFKNEY;DNYDFKNEYEK;FKNEYEKSHVF;EKSHVFSDAPR;KSHVFSDAPRI; DAPRIRGDLRK;APRIRGDLRKI;RIRGDLRKIGI;RKIGIKEKSVF;KIGIKEKSVFL;VFL DALEAIEY;FLDALEAIEYL;ALEAIEYLIKI;EAIEYLIKIKI;IEYLIKIKIST;LIKIKI STDSI;KIKISTDSIFL;STDSIFLSEDM;DSIFLSEDMIR;SIFLSEDMIRL;IFLSEDMIR LI;FLSEDMIRLIG;SEDMIRLIGSY;RLIGSYPDSIF;GSYPDSIFNYL;SYPDSIFNYLI; YPDSIFNYLIQ;FNYLIQLNSDK;NYLIQLNSDKI;IQLNSDKIDYA;NSDKIDYAEKY;DYA EKYGDNAR;KYGDNARNNFK;DYSEDKANTVK;NTVKQILKQIL;KQILKQILADL;ILKQIL ADLPK<br><br>15-mer plus 9-mer core motif | 215926-216339 |

Fig. 43 continued

AEKYGDNARNNFKKD;YGDNARNNF;AFSKEDFNLINKRLD;DFNLINKRL;AIEYLIKIKIS
TDSI;IKIKISTDS;ALEAIEYLIKIKIST;IEYLIKIKI;ARNNFKKDYSEDKAN;FKKDYS
EDK;DALEAIEYLIKIKIS;IEYLIKIKI;DFNLINKRLDNYDFK;FNLINKRLD

Figure 44: Special selected HLA-A*0201 epitopes from Borrelia

| Protein | Peptide | SEQ ID NO |
|---|---|---|
| BapA 1 | FLSEDMIRL | 216340 |
| BapA 2 | KISTDSIFL | 216341 |
| BapA 4 | FLFILSLSA | 216342 |
| Bmp D 1 | FLAGYFASK | 216343 |
| BmpA 2 | NLVGMTFRA | 216344 |
| BmpA 3 | KMYSDGIDI | 216345 |
| BmpA 4 | YLAPNNVIT | 216346 |
| BmpB 1 | KISMLVDGV | 216347 |
| BmpB 3 | NLIGVVFRI | 216348 |
| BmpB 4 | NVGDALYLI | 216349 |
| BmpC 1 | YANPKLRLV | 216350 |
| BmpC 3 | AMTEDAYEV | 216351 |
| BmpC 4 | GLNQDQSYI | 216352 |
| BmpD 2 | FMYGYEAGA | 216353 |
| BmpD 3 | YLAPNNVLV | 216354 |
| CRASP-1 a | KLNIIKLNI | 216355 |
| CRASP-1 b | SLNYEIEKI | 216356 |
| CRASP-1 c | KLNILTTIL | 216357 |
| CRASP-2 a | YMLISISLL | 216358 |
| CRASP-2 b | LIDDFAIEL | 216359 |

| | | |
|---|---|---|
| CRASP-2 c | LLSCDVSRL | 216360 |
| DbpA 1 | RLESSAQEI | 216361 |
| DbpA 3 | FILKAKIKA | 216362 |
| DbpA 4 | TTADGIIAI | 216363 |
| DbpB 1 | LMLEVVESL | 216364 |
| DbpB 2 | LLAACNFGL | 216365 |
| DbpB 3 | LLVACSIGL | 216366 |
| FlaA 1 | YAGDTILGV | 216367 |
| FlaA 3 | VLFEDMNGM | 216368 |
| FlaA 6 | LIWSNPNYI | 216369 |
| FlaB 1 | SIQIEIEQL | 216370 |
| FlaB 2 | NLNEVEKVL | 216371 |
| FlaB 3 | SLAKIENAI | 216372 |
| FlaB 6 | SQASWTLRV | 216373 |
| FlaB 7 | AIAVNIYAA | 216374 |
| HSP90 1 | ILKDHIKEV | 216375 |
| HSP90 2 | NLIPEYEGL | 216376 |
| HSP90 3 | SMGQEVKEI | 216377 |
| MalQ 4 | WLLDFASFV | 216378 |
| MalQ 5 | YLNTNEDFV | 216379 |

Fig. 44 continued

| | | |
|---|---|---|
| MalQ 6 | FIAYDSADV | 216380 |
| OspA 1 | ALIACKQNV | 216381 |
| OspA 3 | FTKEDTIT | 216382 |
| OspA 4 | KTSTLTISV | 216383 |
| OspA 7 | FTLEGTLAA | 216384 |
| OspA 8 | TLVSKKVTL | 216385 |
| OspB 1 | FLTDGTITV | 216386 |
| OspB 2 | SITDDLNTI | 216387 |
| OspB 5 | KIKDFVFLT | 216388 |
| OspC 1 | KITDSNAFV | 216389 |
| OspC 2 | SVKELTSPV | 216390 |
| OspC 4 | ALTNSVKEL | 216391 |
| OspC 7 | ILMTLFLFI | 216392 |
| OspC 8 | SLLAGAYAI | 216393 |
| OspE 2 | MKMFIICAV | 216394 |
| OspE 4 | FIICAVFVL | 216395 |
| OspE 5 | KFSEFTVNI | 216396 |
| OspG 1 | VIDDALKNI | 216397 |
| OspG 3 | KMKNLIICA | 216398 |
| OspG 6 | LIICAVFVL | 216399 |
| VlsE 3 | GMAKDGKFAV | 216400 |

Fig. 44 continued

| VlsE 5 | KVLGAITGL | 216401 |
| --- | --- | --- |
| VlsE 6 | GLRKVGDSV | 216402 |
| VlsE 8 | ILSAIVTAA | 216403 |
| VlsE 9 | QILSAIVTA | 216404 |

Fig. 44 continued

FIGURE 45: Special selected HLA-A*03 epitopes from Borrelia

| Protein | Peptide | SEQ ID NO |
|---|---|---|
| BapA 3 | YLIQLNSDK | 216405 |
| BapA 5 | KQILADLPK | 216406 |
| BapA 6 | QLNSDKIDY | 216407 |
| BmpA 2 | YLSDLEGLK | 216408 |
| BmpA 5 | IVFLSCSGK | 216409 |
| BmpA 6 | FLTGYIAAK | 216410 |
| BmpB 5 | EIFIKQILK | 216411 |
| BmpB 6 | ALYLITGEY | 216412 |
| BmpB/C 2 | FLAGYIAAK | 216413 |
| BmpC 5 | KEMARFMYK | 216414 |
| BmpC 6 | YIAAKMSRK | 216415 |
| BmpD 1 | FLAGYFASK | 216416 |
| BmpD 5 | SLMYSLTKK | 216417 |
| BmpD 6 | RSTASNMYR | 216418 |
| CRASP-1d | RIIYSSLNY | 216419 |
| CRASP-1e | SSLNYEIEK | 216420 |
| CRASP-2d | RSRYNNFYK | 216421 |
| CRASP-2e | ESFDVISSK | 216422 |
| CRASP-2f | LIALKCIVK | 216423 |
| DbpA 2/3 | KARLESSVK | 216424 |
| DbpA 5 | IIAIVKVMK | 216425 |
| DbpA 6 | FTNTQTGSK | 216426 |
| DbpB 2 | VTSGGLALR | 216427 |
| DbpB 5 | FTGLKTGSK | 216428 |
| DbpB 6 | LFEAFTGLK | 216429 |
| FlaA 4 | KLKAHETFK | 216430 |
| FlaA 5 | RFKAFRVSK | 216431 |
| FlaA 7 | RVSKSHSSK | 216432 |
| FlaB 8 | SINAANLSK | 216433 |
| FlaB 10 | SQASRNTSK | 216434 |
| FlaB 11 | FQNRLESIK | 216435 |
| FlaB 4 | NQMHMLSNK | 216436 |
| FlaB 5 | GSQASWTLR | 216437 |
| FlaB 9 | KINTPASLS | 216438 |
| HSP90 4 | KLISLIRFK | 216439 |
| HSP90 5 | HINYPIYIK | 216440 |
| HSP90 6 | LLTSGMPSK | 216441 |
| MalQ 1 | RSFEKFKKK | 216442 |

| | | |
|---|---|---|
| MalQ 2 | FLFASSQSY | 216443 |
| MalQ 3 | RINLNLKRK | 216444 |
| Osp A 9 | ISVNSQKTK | 216445 |
| Osp G 5 | NIGQKALKY | 216446 |
| OspA 5 | LTISVNSKK | 216447 |
| OspA 6 | VTLSKNISK | 216448 |
| OspA 7 | LILALIACK | 216449 |
| OspA 8 | KTKNLVFTK | 216450 |
| OspB 10 | RTNGTTLEY | 216451 |
| OspB 11 | MTDADNATK | 216452 |
| OspB 6 | ATKAVETLK | 216453 |
| OspB 7 | TLTISADSK | 216454 |
| OspB 9 | VTLKKEIEK | 216455 |
| OspC 10 | ILMTLFLFI | 216456 |
| OspC 11 | AISTLITEK | 216457 |
| OspC 5 | TLITEKLSK | 216458 |
| OspC 6 | ELANKAIGK | 216459 |
| OspC 9 | LANKAIGKK | 216460 |
| OspE 3 | KTSLYYGYK | 216461 |
| OspE 6 | GSFKTSLYY | 216462 |
| OspE 7 | NLGTLVIRK | 216463 |
| OspG 4 | GTNTNDFVK | 216464 |
| OspG 7 | VFVLIISCK | 216465 |
| VlsE 10 | AVSGEQILK | 216466 |
| VlsE 11 | AIVLRGLAK | 216467 |
| VlsE 2 | AIALRGMAK | 216468 |
| VlsE 7 | QIAAAIALR | 216469 |

Fig. 45 continued

MHC MULTIMERS IN BORRELIA DIAGNOSTICS AND DISEASE

All patent and non-patent references cited in PA 2008 00295, PA 2008 01011 as well as in this application are hereby incorporated by reference in their entirety. PA 2008 00295 and PA 2008 01011 are hereby also incorporated herein by reference in its entirety.

FIELD OF INVENTION

The present invention relates to MHC-peptide complexes and uses thereof in the diagnosis, treatment and monitoring of treatment of a disease in an individual.

BACKGROUND OF INVENTION

Biochemical interactions between peptide epitope specific membrane molecules encoded by the Major Histocompatibility Complex (MHC, in humans HLA) and T-cell receptors (TCR) are required to elicit specific immune responses. This requires activation of T-cells by presentation to the T-cells of peptides against which a T-cell response should be raised. The peptides are presented to the T-cells by the MHC complexes.

The Immune Response

The immune response is divided into two parts termed the innate immune response and the adaptive immune response. Both responses work together to eliminate pathogens (antigens). Innate immunity is present at all times and is the first line of defense against invading pathogens. The immediate response by means of pre-existing elements, i.e. various proteins and phagocytic cells that recognize conserved features on the pathogens, is important in clearing and control of spreading of pathogens. If a pathogen is persistent in the body and thus only partially cleared by the actions of the innate immune system, the adaptive immune system initiate a response against the pathogen. The adaptive immune system is capable of eliciting a response against virtually any type of pathogen and is unlike the innate immune system capable of establishing immunological memory.

The adaptive response is highly specific to the particular pathogen that activated it but it is not so quickly launched as the innate when first encountering a pathogen.

However, due to the generation of memory cells, a fast and more efficient response is generated upon repeated exposure to the same pathogen. The adaptive response is carried out by two distinct sets of lymphocytes, the B cells producing antibodies leading to the humoral or antibody mediated immune response, and the T cells leading to the cell mediated immune response.

T cells express a clonotypic T cell receptor (TCR) on the surface. This receptor enable the T cell to recognize peptide antigens bound to major histocompatibility complex (MHC) molecules, called human leukocyte antigens (HLA) in man. Depending on the type of pathogen, being intracellular or extracellular, the antigenic peptides are bound to MHC class I or MHC class II, respectively. The two classes of MHC complexes are recognized by different subsets of T cells; Cytotoxic CD8+ T cells recognizing MHC class I and CD4+ helper cells recognizing MHC class II. In general, TCR recognition of MHC-peptide complexes result in T cell activation, clonal expansion and differentiation of the T cells into effector, memory and regulatory T cells.

B cells express a membrane bound form of immunoglobulin (Ig) called the B cell receptor (BCR). The BCR recognizes an epitope that is part of an intact three dimensional antigenic molecule. Upon BCR recognition of an antigen the BCR:antigen complex is internalized and fragments from the internalized antigen is presented in the context of MHC class II on the surface of the B cell to CD4+ helper T-cells (Th). The specific Th cell will then activate the B cell leading to differentiation into an antibody producing plasma cell.

A very important feature of the adaptive immune system is its ability to distinguish between self and non-self antigens, and preferably respond against non-self. If the immune system fails to discriminate between the two, specific immune responses against self-antigens are generated. These autoimmune reactions can lead to damage of self-tissue.

The adaptive immune response is initiated when antigens are taken up by professional antigen presenting cells such as dendritic cells, Macrophages, Langerhans cells and B-cells. These cells present peptide fragments, resulting from the degradation of proteins, in the context of MHC class II proteins (Major Histocompatibility Complex) to helper T cells. The T helper cells then mediate help to B-cells and antigen-specific cytotoxic T cells, both of which have received primary activation signals via their BCR respective TCR. The help from the Th-cell is mediated by means of soluble mediators e.g. cytokines.

In general the interactions between the various cells of the cellular immune response is governed by receptor-ligand interactions directly between the cells and by production of various soluble reporter substances e.g. cytokines by activated cells.

MHC-Peptide Complexes

MHC complexes function as antigenic peptide receptors, collecting peptides inside the cell and transporting them to the cell surface, where the MHC-peptide complex can be recognized by T-lymphocytes. Two classes of classical MHC complexes exist, MHC class I and II. The most important difference between these two molecules lies in the protein source from which they obtain their associated peptides. MHC class I molecules present peptides derived from endogenous antigens degraded in the cytosol and are thus able to display fragments of viral proteins and unique proteins derived from cancerous cells. Almost all nucleated cells express MHC class I on their surface even though the expression level varies among different cell types. MHC class II molecules bind peptides derived from exogenous antigens. Exogenous proteins enter the cells by endocytosis or phagocytosis, and these proteins are degraded by proteases in acidified intracellular vesicles before presentation by MHC class II molecules. MHC class II molecules are only expressed on professional antigen presenting cells like B cells and macrophages.

The three-dimensional structure of MHC class I and II molecules are very similar but important differences exist. MHC class I molecules consist of two polypeptide chains, a heavy chain, α, spanning the membrane and a light chain, β2-microglobulin (β2m). The heavy chain is encoded in the gene complex termed the major histocompatibility complex (MHC), and its extracellular portion comprises three domains, α1, α2 and α3. The β2m chain is not encoded in the MHC gene and consists of a single domain, which together with the α3 domain of the heavy chain make up a folded structure that closely resembles that of the immunoglobulin. The α1 and α2 domains pair to form the peptide binding cleft, consisting of two segmented a helices lying on a sheet of eight β-strands. In humans as well as in mice three different types of MHC class I molecule exist. HLA-A, B, C are found in humans while MHC class I molecules in mice are designated H-2K, H-2D and H-2L.

The MHC class II molecule is composed of two membrane spanning polypeptide chains, α and β, of similar size (about 30000 Da). Genes located in the major histocompatibility complex encode both chains. Each chain consists of two domains, where α1 and β1 forms a 9-pocket peptide-binding cleft, where pocket 1, 4, 6 and 9 are considered as major peptide binding pockets. The α2 and β2, like the α2 and β2m in the MHC class I molecules, have amino acid sequence and structural similarities to immunoglobulin constant domains. In contrast to MHC class I complexes, where the ends of the antigenic peptide is buried, peptide-ends in MHC class II complexes are not. HLA-DR, DQ and DP are the human class II molecules, H-2A, M and E are those of the mice.

A remarkable feature of MHC genes is their polymorphism accomplished by multiple alleles at each gene. The polygenic and polymorphic nature of MHC genes is reflected in the peptide-binding cleft so that different MHC complexes bind different sets of peptides. The variable amino acids in the peptide binding cleft form pockets where the amino acid side chains of the bound peptide can be buried. This permits a specific variant of MHC to bind some peptides better than others.

MHC Multimers

Due to the short half-life of the peptide-MHC-T cell receptor ternary complex (typically between 10 and 25 seconds) it is difficult to label specific T cells with labelled MHC-peptide complexes, and like-wise, it is difficult to employ such monomers of MHC-peptide for therapeutic and vaccine purposes because of their weak binding. In order to circumvent this problem, MHC multimers have been developed. These are complexes that include multiple copies of MHC-peptide complexes, providing these complexes with an increased affinity and half-life of interaction, compared to that of the monomer MHC-peptide complex. The multiple copies of MHC-peptide complexes are attached, covalently or non-covalently, to a multimerization domain. Known examples of such MHC multimers include the following:

- MHC-dimers: Each MHC dimer contains two copies of MHC-peptide. IgG is used as multimerization domain, and one of the domains of the MHC protein is covalently linked to IgG.
- MHC-tetramers: Each MHC-tetramer contains four copies of MHC-peptide, each of which is biotinylated. The MHC complexes are held together in a complex by the streptavidin tetramer protein, providing a non-covalent linkage between a streptavidin monomer and the MHC protein. Tetramers are described in U.S. Pat. No. 5,635,363.
- MHC pentamers: Five copies of MHC-peptide complexes are multimerised by a self-assembling coiled-coil domain, to form a MHC pentamer. MHC pentamers are described in the US patent 2004209295
- MHC dextramers: A large number of MHC-peptide complexes, typically more than ten, are attached to a dextran polymer. MHC-dextramers are described in the patent application WO 02/072631 A2.
- MHC streptamers: 8-12 MHC-peptide complexes attached to Streptactin. MHC streptamers are described in Knabel M et al. Reversibel MHC multimer staining for functional isolation of T-cell populations and effective adoptive transfer. Nature medicine 6. 631-637 (2002).

Use of MHC Multimers in Flow Cytometry and Related Techniques

The concentration of antigen-specific T-cells in samples from e.g. peripheral blood can be very low. Flow cytometry and related methods offer the ability to analyze a large number of cells and simultaneously identify the few of interest. MHC multimers have turned out to be very valuable reagents for detection and characterization of antigen-specific T-cells in flow cytometer experiments. The relative amount of antigen-specific T cells in a sample can be determined and also the affinity of the binding of MHC multimer to the T-cell receptor can be determined.

The basic function of a flow cytometer is its ability to analyse and identify fluorochrome labelled entities in a liquid sample, by means of its excitation, using a light source such as a laser beam and the light emission from the bound fluorochrome.

MHC multimers is used as detections molecule for identification of antigen-specific T-cells in flow cytometry, by labelling the MHC multimer with a specific fluorochrome, which is detectable, by the flow cytometer used.

In order to facilitate the identification of a small amount of cells, the cells can be sub-categorized using antibodies or other fluorochrome labelled detections molecules directed against surface markers other than the TCR on the specific T-cells population. Antibodies or other fluorochrome labelled detections molecules can also be used to identify cells known not to be antigen-specific T-cells. Both kinds of detections molecules are in the following referred to as gating reagents. Gating reagents, helps identify the "true" antigen-specific T cells bound by MHC multimers by identifying specific subpopulations in a sample, e.g. T cells and by excluding cells that for some reason bind MHC mulimers without being antigen-specific T-cells.

Other cytometry methods, e.g. fluorescence microscopy and IHC can like flow cytometry be employed in identification of antigen-specific T cells in a cell sample using MHC multimers.

Application of MHC Multimers in Immune Monitoring, Diagnostics, Prognostics, Therapy and Vaccines T cells are pivotal for mounting an adaptive immune response. It is therefore of importance to be able to measure the number of specific T cells when performing a monitoring of a given immune response, for example in connection with vaccine development, autologous cancer therapy, transplantation, infectious diseases, toxicity studies etc.

Accordingly, the present invention further provides powerful tools in the fields of vaccines, therapy and diagnosis. One objective of the present invention is to provide methods for anti-bacterial and anti-virus immunotherapy by generating antigen-specific T-cells capable of inactivating or eliminating undesirable target cells. Another objective is to isolate antigen-specific T-cells and culture these in the presence of co-stimulatory molecules. Ex vivo priming and expansion of T-cell populations allows the T-cells to be used in immunotherapy of various types of infectious diseases. A third objective of the present invention is to identify and label specific subsets of cells with relevance for the development or treatment of diseases.

SUMMARY OF INVENTION

Measurement of antigen-specific T cells during an immune response are important parameters in vaccine development, therapy and infectious diseases, inflammation, autoimmunity, toxicity studies etc. MHC multimers are crucial reagents in monitoring of antigen-specific T cells. The present invention describes novel methods to generate MHC multimers and methods to improve existing and new MHC multimers. The invention also describes improved methods for the use of MHC multimers in analysis of T cells in samples including diagnostic and prognostic methods. Furthermore the use of MHC multimers in therapy are described, e.g. anti-bacteria therapy. The present invention also relates to MHC multimers comprising one or more *Borrelia* peptides. In one preferred embodiment the present invention relates to a *Borrelia* vaccine. In a *Borrelia* vaccine the peptides bound in the peptide binding cleft of MHC are derived from antigenic *borrelia* proteins. In another preferred embodiment the present invention relates to diagnosis and monitoring of *Borrelia* infection using MHC multimers with *Borrelia* derived peptides bound in the peptide binding cleft of the MHC molecules.

DEFINITIONS

As used everywhere herein, the term"a", "an" or "the" is meant to be one or more, i. e. at least one.

"8 mers" are peptides consisting of 8 amino acids.
"9 mers" are peptides consisting of 9 amino acids.
"10 mers" are peptides consisting of 10 amino acids.
"11 mers" are peptides consisting of 11 amino acids.
"13 mers" are peptides consisting of 13 amino acids.
"14 mers" are peptides consisting of 14 amino acids.
"15 mers" are peptides consisting of 15 amino acids.
"16 mers" are peptides consisting of 16 amino acids.

As used everywhere herein, the term *"Borrelia garini"* also relates to *"Borrelia garinii"*.

An "amino acid residue" can be a natural or non-natural amino acid residue linked peptide bonds or bonds different from peptide bonds. The amino acid residues can be in D-configuration or L-configuration. An amino acid residue comprises an amino terminal part (NH$_2$) and a carboxy terminal part (COOH) separated by a central part comprising a carbon atom, or a chain of carbon atoms, at least one of which comprises at least one side chain or functional group. NH$_2$ refers to the amino group present at the amino terminal end of an amino acid or peptide, and COOH refers to the carboxy group present at the carboxy terminal end of an amino acid or peptide. The generic term amino acid comprises both natural and non-natural amino acids. Natural amino acids of standard nomenclature as listed in J. Biol. Chem., 243:3552-59 (1969) and adopted in 37 C.F.R., section 1.822(b)(2) belong to the group of amino acids listed in the table herein below. Non-natural amino acids are those not listed in the Table below. Examples of non-natural amino acids are those listed e.g. in 37 C.F.R. section 1.822(b)(4), all of which are incorporated herein by reference. Also, non-natural amino acid residues include, but are not limited to, modified amino acid residues, L-amino acid residues, and stereoisomers of D-amino acid residues.

Natural amino acids and their respective codes.

| Symbols | | |
|---|---|---|
| 1-Letter | 3-Letter | Amino acid |
| Y | Tyr | tyrosine |
| G | Gly | glycine |
| F | Phe | phenylalanine |
| M | Met | methionine |
| A | Ala | alanine |
| S | Ser | serine |
| I | Ile | isoleucine |
| L | Leu | leucine |
| T | Thr | threonine |
| V | Val | valine |
| P | Pro | proline |
| K | Lys | lysine |
| H | His | histidine |
| Q | Gln | glutamine |
| E | Glu | glutamic acid |
| W | Trp | tryptophan |
| R | Arg | arginine |
| D | Asp | aspartic acid |
| N | Asn | asparagine |
| C | Cys | cysteine |

The terms "amino-terminal" and "carboxyl-terminal" are used herein to denote positions within polypeptides. Where the context allows, these terms are used with reference to a particular sequence or portion of a polypeptide to denote proximity or relative position. For example, a certain sequence positioned carboxyl-terminal to a reference sequence within a polypeptide is located proximal to the carboxyl terminus of the reference sequence, but is not necessarily at the carboxyl terminus of the complete polypeptide.

Adjuvant: adjuvants are drugs that have few or no pharmacological effects by themselves, but can increase the efficacy or potency of other drugs when given at the same time. In another embodiment, an adjuvant is an agent which, while not having any specific antigenic effect in itself, can stimulate the immune system, increasing the response to a vaccine.

Agonist: agonist as used herein is a substance that binds to a specific receptor and triggers a response in the cell. It mimics the action of an endogenous ligand that binds to the same receptor.

Anchor amino acid: Anchor amino acid is used interchangeably herein with anchor residue and is an amino acid of antigenic peptide having amino acid sidechains that bind into pockets lining the peptide-binding groove of MHC molecules thereby anchoring the peptide to the MHC molecule. Anchor residues being responsible for the main anchoring of peptide to MHC molecule are called primary anchor amino acids. Amino acids contributing to the binding of antigenic peptide to MHC molecule but in a lesser extend than primary anchor amino acids are called secondary anchor amino acids.

Anchor motif: The pattern of anchor residues in an antigenic peptide binding a certain MHC molecule. Peptides binding different MHC molecules have different anchor motifs defined by the patterns of anchor residues in the peptide sequence.

Anchor residue: Anchor residue is used interchangeably herein with anchor amino acid Anchor position: The position of an anchor amino acid in antigenic peptide sequence. For MHC II the anchor positions is defined in the 9-mer core motif.

Antagonist: antagonist as used herein is a substance that binds to a specific receptor and blocks the response in the cell. It blocks the action of an endogenous ligand that binds to the same receptor.

Antibodies: As used herein, the term "antibody" means an isolated or recombinant binding agent that comprises the necessary variable region sequences to specifically bind an antigenic epitope. Therefore, an antibody is any form of antibody or fragment thereof that exhibits the desired biological activity, e.g., binding the specific target antigen. Antibodies can derive from multiple species. For example, antibodies include rodent (such as mouse and rat), rabbit, sheep, camel, and human antibodies. Antibodies can also include chimeric antibodies, which join variable regions from one species to constant regions from another species. Likewise, antibodies can be humanized, that is constructed by recombinant DNA technology to produce immunoglobulins which have human framework regions from one species combined with complementarity determining regions (CDR's) from a another species' immunoglobulin. The antibody can be monoclonal or polyclonal. Antibodies can be divided into isotypes (IgA, IgG, IgM, IgD, IgE, IgG1, IgG2, IgG3, IgG4, IgA1, IgA2, IgM1, IgM2)

Antibodies: In another embodiment the term "antibody" refers to an intact antibody, or a fragment of an antibody that competes with the intact antibody for antigen binding. In certain embodiments, antibody fragments are produced by recombinant DNA techniques. In certain embodiments, antibody fragments are produced by enzymatic or chemical cleavage of intact antibodies. Exemplary antibody fragments include, but are not limited to, Fab, Fab', F(ab')2, Fv, and scFv. Exemplary antibody fragments also include, but are not limited to, domain antibodies, nanobodies, minibodies ((scFv-C.sub.H3).sub.2), maxibodies ((scFv-C.sub.H2-C.sub.H3).sub.2), diabodies (noncovalent dimer of scFv).

Antigen presenting cell: An antigen-presenting cell (APC) as used herein is a cell that displays foreign antigen complexed with MHC on its surface.

Antigenic peptide: Used interchangeably with binding peptide. Any peptide molecule that is bound or able to bind into the binding groove of either MHC class 1 or MHC class 2 molecules.

Antigenic polypeptide: Polypeptide that contains one or more antigenic peptide sequences.

APC: Antigen presenting cell

Aptamer: the term aptamer as used herein is defined as oligonucleic acid or peptide molecules that bind a specific target molecule. Aptamers are usually created by selecting them from a large random sequence pool, but natural aptamers also exist. Aptamers can be divided into DNA aptamers, RNA aptamers and peptide aptamers.

Avidin: Avidin as used herein is a glycoprotein found in the egg white and tissues of birds, reptiles and amphibians. It contains four identical subunits having a combined mass of 67,000-68,000 daltons. Each subunit consists of 128 amino acids and binds one molecule of biotin.

Biologically active molecule: A biologically active molecule is a molecule having itself a biological activity/effect or is able to induce a biological activity/effect when administered to a biological system. Biologically active molecules include adjuvants, immune targets (e.g. antigens), enzymes, regulators of receptor activity, receptor ligands, immune potentiators, drugs, toxins, cytotoxic molecules, co-receptors, proteins and peptides in general, sugar moieties, lipid groups, nucleic acids including siRNA, nanoparticles, small molecules.

Bioluminescent: Bioluminescence, as used herein, is the production and emission of light by a living organism as the result of a chemical reaction during which chemical energy is converted to light energy.

Biotin: Biotin, as used herein, is also known as vitamin H or B$_7$. Niotin has the chemical formula $C_{10}H_{16}N_2O_3S$.

Bispecific antibodies: The term bispecific antibodies as used herein is defined as antibodies that have binding specificities for at least two different antigens. The antibody can also be trispecific or multispecific.

Bispecific capture molecule: Molecule that have binding specificities for at least two different antigens. The molecule can also be trispecific or multispecific.

Carrier: A carrier as used herein can be any type of molecule that is directly or indirectly associated with the MHC peptide complex. In this invention, a carrier will typically refer to a functionalized polymer (e.g. dextran) that is capable of reacting with MHC-peptide complexes, thus covalently attaching the MHC-peptide complex to the carrier, or that is capable of reacting with scaffold molecules (e.g. streptavidin), thus covalently attaching streptavidin to the carrier; the streptavidin then may bind MHC-peptide complexes. Carrier and scaffold are used interchangeably herein where scaffold typically refers to smaller molecules of a multimerization domain and carrier typically refers to larger molecule and/or cell like structures.

Chelating chemical compound: Chelating chemical compound, as used herein, is the process of reversible binding of a ligand to a metal ion, forming a metal complex.

Chemiluminescent: Chemiluminescence, as used herein, is the emission of light (luminescence) without emission of heat as the result of a chemical reaction.

Chromophore: A chromophore, as used herein, is the part of a visibly coloured molecule responsible for light absorption over a range of wavelengths thus giving rise to the colour. By extension the term can be applied to uv or it absorbing parts of molecules.

Coiled-coil polypeptide: Used interchangeably with coiled-coil peptide and coiled-coil structure. The term coiled-coil polypeptide as used herein is a structural motif in proteins, in which 2-7 alpha-helices are coiled together like the strands of a rope Complement protein: Protein of the complement system.

Counting beads: Beads countable in a flow cytometry experiment.

Covalent binding: The term covalent binding is used herein to describe a form of chemical bonding that is characterized by the sharing of pairs of electrons between atoms. Attraction-to-repulsion stability that forms between atoms when they share electrons is known as covalent bonding.

Crosslinking is the process of chemically joining two or more molecules by a covalent bond. Crosslinking reagents contain reactive ends to specific functional groups (primary amines, sulfhydryls, etc.) on proteins or other molecules.

CSF: Cerebrospinal fluid.

Diagnosis: The act or process of identifying or determining the nature and cause of a disease or injury through evaluation Diabodies: The term "diabodies" refers to small antibody fragments with two antigen-binding sites, which fragments comprise a heavy-chain variable domain (VH) connected to a light-chain variable domain (VL) in the same polypeptide chain (VH-VL). By using a linker that is too short to allow pairing between the two domains on the same chain, the domains are forced to pair with the complementary domains of another chain and create two antigen-binding sites.

Dendritic cell: The term dendritic cell as used herein is a type of immune cells. Their main function is to process antigen material and present it on the surface to other cells of the immune system, thus functioning as antigen-presenting cells.

Detection: In this invention detection means any method capable of measuring one molecule bound to another molecule. The molecules are typically proteins but can be any type of molecule Dextran: the term dextran as used herein is is a complex, branched polysaccharide made of many glucose molecules joined into chains of varying lengths. The straight chain consists of α1→6 glycosidic linkages between glucose molecules, while branches begin from α1→3 linkages (and in some cases, α1→2 and α1→4 linkages as well).

Direct detection of T cells: Direct detection of T cells is used herein interchangeably with direct detection of TCR and direct detection of T cell receptor. As used herein direct detection of T cells is detection directly of the binding interaction between a specific T cell receptor and a MHC multimer.

DNA: The term DNA (Deoxyribonucleic acid) duplex as used herein is a polymer of simple units called nucleotides, with a backbone made of sugars and phosphate atoms joined by ester bonds. Attached to each sugar is one of four types of molecules called bases.

DNA duplex: In living organisms, DNA does not usually exist as a single molecule, but instead as a tightly-associated pair of molecules. These two long strands entwine like vines, in the shape of a double helix.

Electrophilic: electrophile, as used herein, is a reagent attracted to electrons that participates in a chemical reaction by accepting an electron pair in order to bond to a nucleophile.

Enzyme label: enzyme labelling, as used herein, involves a detection method comprising a reaction catalysed by an enzyme.

Epitope-focused antibody: Antibodies also include epitope-focused antibodies, which have at least one minimal essential binding specificity determinant from a heavy chain or light chain CDR3 from a reference antibody, methods for making such epitope-focused antibodies are described in U.S. patent application Ser. No. 11/040,159, which is incorporated herein by reference in its entirety.

Flow cytometry: The analysis of single cells using a flow cytometer.

Flow cytometer: Instrument that measures cell size, granularity and fluorescence due to bound fluorescent marker molecules as single cells pass in a stream past photodetectors. A flow cytometer carry out the measurements and/or sorting of individual cells.

Fluorescent: the term fluorescent as used herein is to have the ability to emit light of a certain wavelength when activated by light of another wavelength.

Fluorochromes: fluorochrome, as used herein, is any fluorescent compound used as a dye to mark e.g. protein with a fluorescent label.

Fluorophore: A fluorophore, as used herein, is a component of a molecule which causes a molecule to be fluorescent.

Folding: In this invention folding means in vitro or in vivo folding of proteins in a tertiary structure.

Fusion antibody: As used herein, the term "fusion antibody" refers to a molecule in which an antibody is fused to a non-antibody polypeptide at the N- or C-terminus of the antibody polypeptide.

Glycosylated: Glycosylation, as used herein, is the process or result of addition of saccharides to proteins and lipids.

Hapten: A residue on a molecule for which there is a specific molecule that can bind, e.g. an antibody.

Heteroconjugate antibodies are composed of two covalently joined antibodies. Such antibodies have, for example, been proposed to target immune system cells to unwanted cells.

IgG: IgG as used herein is a monomeric immunoglobulin, built of two heavy chains and two light chains. Each molecule has two antigen binding sites.

Isolated antibody: The term "isolated" antibody as used herein is an antibody which has been identified and separated and/or recovered from a component of its natural environment.

Immunoconjugates: The invention also pertains to immunoconjugates comprising an antibody conjugated to a cytotoxic agent such as a chemotherapeutic agent, toxin (e.g., an enzymatically active toxin of bacterial, fungal, plant, or animal origin, or fragments thereof), or a radioactive isotope (i.e., a radioconjugate). Enzymatically active toxins and fragments thereof that can be used include diphtheria A chain, nonbinding active fragments of diphtheria toxin, exotoxin A chain (from *Pseudomonas aeruginosa*), ricin A chain, abrin A chain, modeccin A chain, alpha-sarcin, *Aleurites fordii* proteins, dianthin proteins, *Phytolaca americana* proteins (PAPI, PAPII, and PAP-S), *Momordica charantia* inhibitor, curcin, crotin, *Sapaonaria officinalis* inhibitor, gelonin, mitogellin, restrictocin, phenomycin, enomycin, and the tricothecenes. A variety of radionuclides are available for the production of radioconjugated antibodies. Conjugates of the antibody and cytotoxic agent are made using a variety of bifunctional protein-coupling agents such as N-succinimidyl-3-(2-pyridyldithiol) propionate (SPDP), iminothiolane (IT), bifunctional derivatives of imidoesters (such as dimethyl adipimidate HCL), active esters (such as disuccinimidyl suberate), aldehydes (such as glutaraldehyde), bis-azido compounds (such as bis(p-azidobenzoyl) hexanediamine), bis-diazonium derivatives (such as bis-(p-diazoniumbenzoyl)-ethylenediamine), diisocyanates (such as tolyene 2,6-diisocyanate), and bis-active fluorine compounds (such as 1,5-difluoro-2,4-dinitrobenzene).

Immune monitoring: Immune monitoring of the present invention refers to testing of immune status in the diagnosis and therapy of diseases like but not limited to cancer, immunoproliferative and immunodeficiency disorders, autoimmune abnormalities, and infectious disease. It also refers to testing of immune status before, during and after vaccination and transplantation procedures.

Immune monitoring process: a series of one or more immune monitoring analysis

Indirect detection of T cells: Indirect detection of T cells is used interchangeably herein with Indirect detection of TCR and indirect detection of T cell receptor. As used herein indirect detection of T cells is detection of the binding interaction between a specific T cell receptor and a MHC multimer by measurement of the effect of the binding interaction.

Ionophore: ionophore, as used herein, is a lipid-soluble molecule usually synthesized by microorganisms capable of transporting ions.

Label: Label herein is used interchangeable with labeling molecule. Label as described herein is an identifiable substance that is detectable in an assay and that can be attached to a molecule creating a labeled molecule. The behavior of the labeled molecule can then be studied.

Labelling: Labelling herein means attachment of a label to a molecule.

Lanthanide: lanthanide, as used herein, series comprises the 15 elements with atomic numbers 57 through 71, from lanthanum to lutetium.

Linker molecule: Linker molecule and linker is used interchangeable herein. A linker molecule is a molecule that covalently or non-covalently connects two or more molecules, thereby creating a larger complex consisting of all molecules including the linker molecule.

LDA: limiting dilution assay

Liposomes: The term liposomes as used herein is defined as a spherical vesicle with a membrane composed of a phospholipid and cholesterol bilayer. Liposomes, usually but not by definition, contain a core of aqueous solution; lipid spheres that contain no aqueous material are called micelles.

Immunoliposomes: The antibodies disclosed herein can also be formulated as immunoliposomes. Liposomes comprising the antibody are prepared by methods known in the art, such as described in Epstein et al., Proc. Natl. Acad. Sci. USA 82: 3688 (1985); Hwang et al., Proc. Natl. Acad. Sci. USA 77: 4030 (1980); and U.S. Pat. Nos. 4,485,045 and 4,544,545. Particularly useful liposomes can be generated by the reverse-phase evaporation method with a lipid composition comprising phosphatidylcholine, cholesterol, and PEG-derivatized phosphatidylethanolamine (PEG-PE).

Immuno profiling: Immuno profiling as used herein defines the profiling of an individual's antigen-specific T-cell repertoire Marker: Marker is used interchangeably with marker molecule herein. A marker is molecule that specifically associates covalently or non-covalently with a molecule belonging to or associated with an entity.

MHC: Denotes the major histocompatibility complex.

MHC I is used interchangeably herein with MHC class I and denotes the major histocompatibility complex class I.

MHC II is used interchangeably herein with MHC class II and denotes the major histocompatibility complex class I.

MHC molecule: a MHC molecule as used everywhere herein is defined as any MHC class I molecule or MHC class II molecule as defined herein.

A "MHC Class I molecule" as used everywhere herein is used interchangeably with MHC I molecule and is defined as a molecule which comprises 1-3 subunits, including a MHC I heavy chain, a MHC I heavy chain combined with a MHC I beta2microglobulin chain, a MHC I heavy chain combined with MHC I beta2microglobulin chain through a flexible linker, a MHC I heavy chain combined with an antigenic peptide, a MHC I heavy chain combined with an antigenic peptide through a linker, a MHC I heavy chain/MHC I beta2microglobulin dimer combined with an antigenic peptide, and a MHC I heavy chain/MHC I beta2microglobulin dimer combined with an antigenic peptide through a flexible linker to the heavy chain or beta2microglobulin. The MHC I molecule chains can be changed by substitution of single or by cohorts of native amino acids, or by inserts, or deletions to enhance or impair the functions attributed to said molecule. MHC complex: MHC complex is herein used interchangeably with MHC-peptide complex, and defines any MHC I and/or MHC II molecule combined with antigenic peptide unless it is specified that the MHC complex is empty, i.e. is not complexed with antigenic peptide MHC Class I like molecules (including non-classical MHC Class I molecules) include CD1d, HLA E, HLA G, HLA F, HLA H, MICA, MIC B, ULBP-1, ULBP-2, and ULBP-3.

A "MHC Class II molecule" as used everywhere herein is used interchangeably with MHC II molecule and is defined as a molecule which comprises 2-3 subunits including a MHC II alpha-chain and a MHC II beta-chain (i.e. a MHC II alpha/beta-dimer), an MHC II alpha/beta dimer with an antigenic peptide, and an MHC II alpha/beta dimer combined with an antigenic peptide through a flexible linker to the MHC II alpha or MHC II beta chain, a MHC II alpha/beta dimer combined through an interaction by affinity tags e.g. jun-fos, a MHC II alpha/beta dimer combined through an interaction by affinity tags e.g. jun-fos and further combined with an antigenic peptide through a flexible linker to the MHC II alpha or MHC II beta chain. The MHC II molecule chains can be changed by substitution of single or by cohorts of native amino acids, or by inserts, or deletions to enhance or impair the functions attributed to said molecule. Under circumstances where the MHC II alpha-chain and MHC II beta-chain have been fused, to form one subunit, the "MHC Class II molecule" can comprise only 1 subunit or 2 subunits if antigenic peptide is also included.

MHC Class II like molecules (including non-classical MHC Class II molecules) include HLA DM, HLA DO, I-A beta2, and I-E beta2.

A "peptide free MHC Class I molecule" is used interchangeably herein with "peptide free MHC I molecule" and as used everywhere herein is meant to be a MHC Class I molecule as defined above with no peptide.

A "peptide free MHC Class II molecule" is used interchangeably herein with "peptide free MHC II molecule" and as used everywhere herein is meant to be a MHC Class II molecule as defined above with no peptide.

Such peptide free MHC Class I and II molecules are also called "empty" MHC Class I and II molecules.

The MHC molecule may suitably be a vertebrate MHC molecule such as a human, a mouse, a rat, a porcine, a bovine or an avian MHC molecule. Such MHC complexes from different species have different names. E.g. in humans, MHC complexes are denoted HLA. The person skilled in the art will readily know the name of the MHC complexes from various species.

In general, the term "MHC molecule" is intended to include all alleles. By way of example, in humans e.g. HLA A, HLA B, HLA C, HLA D, HLA E, HLA F, HLA G, HLA H, HLA DR, HLA DQ and HLA DP alleles are of interest shall be included, and in the mouse system, H-2 alleles are of interest shall be included. Likewise, in the rat system RT1-alleles, in the porcine system SLA-alleles, in the bovine system BoLA, in the avian system e.g. chicken-B alleles, are of interest shall be included.

"MHC complexes" and "MHC constructs" are used interchangeably herein.

By the terms "MHC complexes" and "MHC multimers" as used herein are meant such complexes and multimers thereof, which are capable of performing at least one of the functions attributed to said complex or multimer. The terms include both classical and non-classical MHC complexes. The meaning of "classical" and "non-classical" in connection with MHC complexes is well known to the person skilled in the art. Non-classical MHC complexes are subgroups of MHC-like complexes. The term "MHC complex" includes MHC Class I molecules, MHC Class II molecules, as well as MHC-like molecules (both Class I and Class II), including the subgroup non-classical MHC Class I and Class II molecules.

MHC multimer: The terms MHC multimer, MHC-multimer, MHCmer and MHC'mer herein are used interchangeably, to denote a complex comprising more than one MHC-peptide complexes, held together by covalent or non-covalent bonds.

Monoclonal antibodies: Monoclonal antibodies, as used herein, are antibodies that are identical because they were produced by one type of immune cell and are all clones of a single parent cell.

Monovalent antibodies: The antibodies in the present invention can be monovalent antibodies. Methods for preparing monovalent antibodies are well known in the art. For example, one method involves recombinant expression of immunoglobulin light chain and modified heavy chain. The heavy chain is truncated generally at any point in the Fc region so as to prevent heavy chain crosslinking. Alternatively, the relevant cysteine residues are substituted with another amino acid residue or are deleted so as to prevent crosslinking. In vitro methods are also suitable for preparing monovalent antibodies. Digestion of antibodies to produce fragments thereof, particularly, Fab fragments, can be accomplished using routine techniques known in the art.

Multimerization domain: A multimerization domain is a molecule, a complex of molecules, or a solid support, to which one or more MHC or MHC-peptide complexes can be attached. A multimerization domain consist of one or more carriers and/or one or more scaffolds and may also contain one or more linkers connecting carrier to scaffold, carrier to carrier, scaffold to scaffold. The multimerization domain may also contain one or more linkers that can be used for attachment of MHC complexes and/or other molecules to the multimerization domain.

Multimerization domains thus include IgG, streptavidin, streptactin, micelles, cells, polymers, beads and other types of solid support, and small organic molecules carrying reactive groups or carrying chemical motifs that can bind MHC complexes and other molecules.

Nanobodies: Nanobodies as used herein is a type of antibodies derived from camels, and are much smaller than traditional antibodies.

Neutralizing antibodies: neutralizing antibodies as used herein is an antibody which, on mixture with the homologous infectious agent, reduces the infectious titer.

NMR: NMR (Nuclear magnetic resonance), as used herein, is a physical phenomenon based upon the quantum mechanical magnetic properties of an atom's nucleus. NMR refers to a family of scientific methods that exploit nuclear magnetic resonance to study molecules.

Non-covalent: The term noncovalent bond as used herein is a type of chemical bond that does not involve the sharing of pairs of electrons, but rather involves more dispersed variations of electromagnetic interactions.

Nucleic acid duplex: A nucleic acid is a complex, high-molecular-weight biochemical macromolecule composed of nucleotide chains that convey genetic information. The most common nucleic acids are deoxyribonucleic acid (DNA) and ribonucleic acid (RNA).

Nucleophilic: a nucleophile, as used herein, is a reagent that forms a chemical bond to its reaction partner (the electrophile) by donating both bonding electrons.

"One or more" as used everywhere herein is intended to include one and a plurality.

A "peptide free MHC Class I molecule" as used everywhere herein is meant to be a MHC Class I molecule as defined above with no peptide.

A "peptide free MHC Class II molecule" as used everywhere herein is meant to be a MHC Class II molecule as defined above with no peptide.

Such peptide free MHC Class I and II molecules are also called "empty" MHC Class I and II molecules.

Pegylated: pegylated, as used herein, is conjugation of Polyethylene glycol (PEG) to proteins.

Peptide or protein: Any molecule composed of at least two amino acids. Peptide normally refers to smaller molecules of up to around 30 amino acids and protein to larger molecules containing more amino acids.

Phosphorylated; phosphorylated, as used herein, is is the addition of a phosphate ($PO_4$) group to a protein molecule or a small molecule.

PNA: PNA (Peptide nucleic acid) as used herein is a chemical similar to DNA or RNA. PNA is not known to occur naturally in existing life on Earth but is artificially synthesized and used in some biological research and medical treatments. DNA and RNA have a deoxyribose and ribose sugar backbone, respectively, whereas PNA's backbone is composed of repeating N-(2-aminoethyl)-glycine units linked by peptide bonds. The various purine and pyrimidine bases are linked to the backbone by methylene carbonyl bonds. PNAs are depicted like peptides, with the N-terminus at the first (left) position and the C-terminus at the right.

"A plurality" as used everywhere herein should be interpreted as two or more.

This applies i.a. to the MHC peptide complex and the binding entity. When a plurality of MHC peptide complexes is attached to the multimerization domain, such as a scaffold or a carrier molecule, the number of MHC peptide complexes need only be limited by the capacity of the multimerization domain.

Polyclonal antibodies: a polyclonal antibody as used herein is an antibody that is derived from different B-cell lines. They are a mixture of immunoglobulin molecules secreted against a specific antigen, each recognising a different epitope.

Polymer: the term polymer as used herein is defined as a compound composed of repeating structural units, or monomers, connected by covalent chemical bonds.

Polypeptide: Peptides are the family of short molecules formed from the linking, in a defined order, of various a-amino acids. The link between one amino acid residue and the next is an amide bond and is sometimes referred to as a peptide bond. Longer peptides are referred to as proteins or polypeptide.

Polysaccharide: The term polysaccharide as used herein is defined as polymers made up of many monosaccharides joined together by glycosidic linkages.

Radicals: radicals, as used herein, are atomic or molecular species with unpaired electrons on an otherwise open shell configuration. These unpaired electrons are usually highly reactive, so radicals are likely to take part in chemical reactions.

Radioactivity: Radioactive decay is the process in which an unstable atomic nucleus loses energy by emitting radiation in the form of particles or electromagnetic waves. RNA:RNA (Ribonucleic acid) as used herein is a nucleic acid polymer consisting of nucleotide monomers that plays several important roles in the processes that translate genetic information from deoxyribonucleic acid (DNA) into protein products.

RNA:RNA (Ribonucleic acid) as used herein is a nucleic acid polymer consisting of nucleotide monomers that plays several important roles in the processes that translate genetic information from deoxyribonucleic acid (DNA) into protein products Scaffold: A scaffold is typically an organic molecule carrying reactive groups, capable of reacting with reactive groups on a MHC-peptide complex. Particularly small organic molecules of cyclic structure (e.g. functionalized cycloalkanes or functionalized aromatic ring structures) are termed scaffolds. Scaffold and carrier are used interchangeably herein where scaffold typically refers to smaller molecules of a multimerization domain and carrier typically refers to larger molecule and/or cell like structures.

Staining: In this invention staining means specific or unspecific labelling of cells by binding labeled molecules to defined proteins or other structures on the surface of cells or inside cells. The cells are either in suspension or part of a tissue. The labeled molecules can be MHC multimers, antibodies or similar molecules capable of binding specific structures on the surface of cells.

Streptavidin: Streptavidin as used herein is a tetrameric protein purified from the bacterium *Streptomyces avidinii*. Streptavidin is widely use in molecular biology through its extraordinarily strong affinity for biotin.

Sugar: Sugars as used herein include monosaccharides, disaccharides, trisaccharides and the oligosaccharides—comprising 1, 2, 3, and 4 or more monosaccharide units respectively.

Therapy: Treatment of illness or disability

Vaccine: A vaccine is an antigenic preparation used to establish immunity to a disease or illness and thereby protect or cure the body from a specific disease or illness. Vaccines are either prophylactic and prevent disease or therapeutic and treat disease. Vaccines may contain more than one type of antigen and is then called a combined vaccine.

Vaccination: The introduction of vaccine into the body of human or animals for the purpose of inducing immunity.

'B.L.' is an abbreviation for Bind level.

'Aff.' is an abbreviation for affinity.

BRIEF DESCRIPTION OF THE DRAWINGS

FIG. 1. Schematic representation of MHC multimer. A MHC multimer consist of a multimerization domain whereto one or more MHC-peptide complexes are attached through one or more linkers. The multimerization domain comprice one or more carriers and/or one or more scaffolds. The MHC-peptide complexes comprise a peptide and a MHC molecule FIG. 2. Program for peptide sequence motifs prediction inhere called random prediction software.

FIG. 3. Full List of HLA Class I alleles assigned as of January 2007 from www.anthonynolan.org.uk/HIG/lists/class1list.html FIG. 4. List of top 30 HLA class 1 alleles in different human ethnic groups FIG. 5. Reactive groups and the bonds formed upon their reaction FIG. 6. Cleavable linkers, conditions for cleaving them and the resulting products of the cleavage. Shown are cleavable linkers relevant for the present invention, as well as the conditions that lead to their cleavage, and the products of the cleavage reaction.

FIG. 7. Size exclusion chromatography of folded HLA-A*0201-β2m-QLFEELQEL (SEQ ID NO 217775) peptide-complex. Purification of HLA-A*0201-β2m-QLFEELQEL (SEQ ID NO 217775) peptide-complex by size exclusion chromatography on a HiLoad 16/60 Superdex 75 column. Eluted protein was followed by measurement of the absorbance at 280 nm. The elution profile consisted of 4 peaks, corresponding to aggregated Heavy Chain, correctly folded MHC-complex, β2m and excess biotin and peptide.

FIG. 8. MHC-SHIFT Assay. The SHIFT Assay shows that heavy chain is efficiently biotinylated, since the band corresponding to biotinylated heavy chain (lane 2) is shifted up-wards upon incubation with streptavidin.

Lane 1: Benchmark protein-ladder

Figure 31:
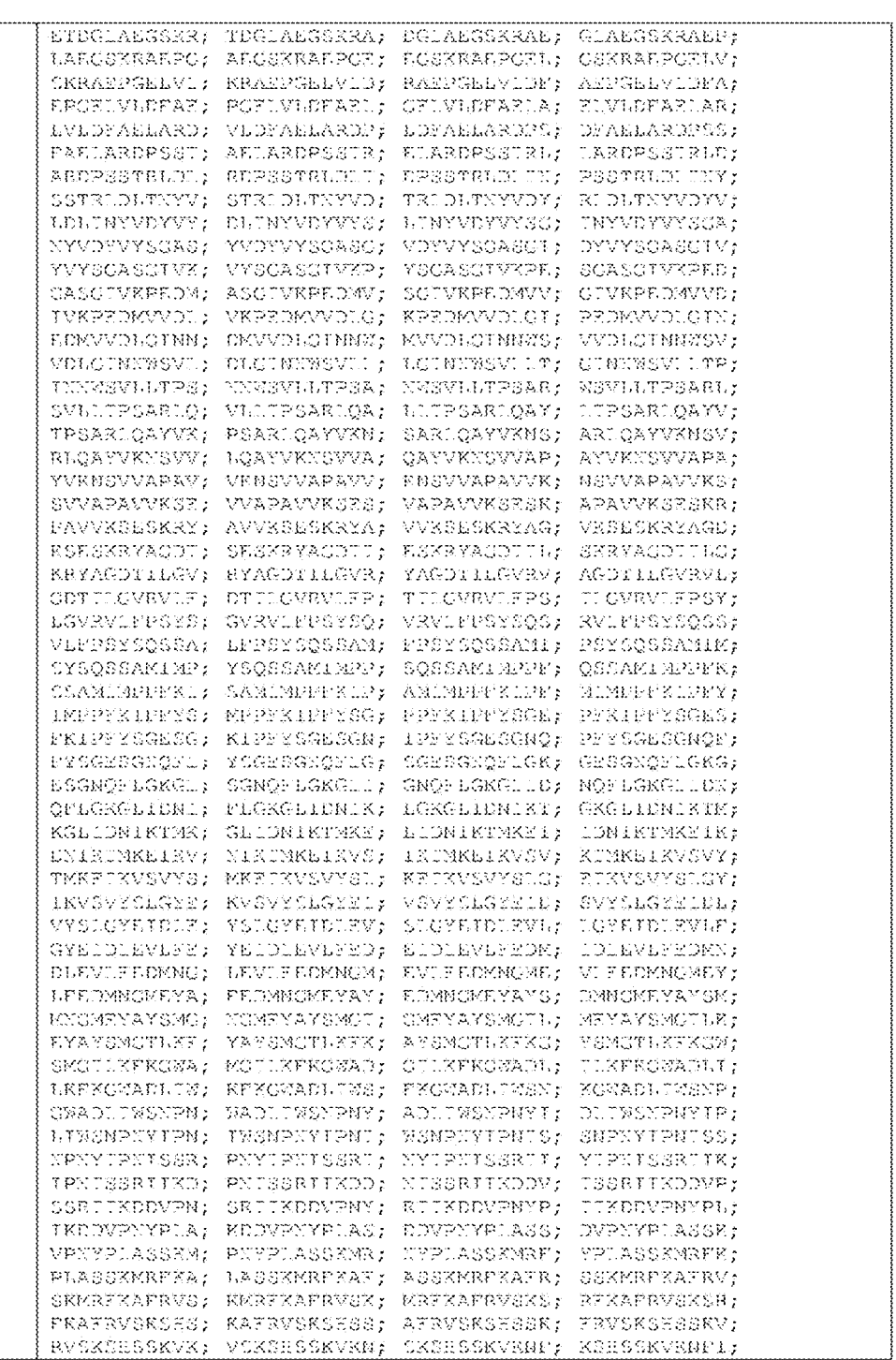
Figure 31:
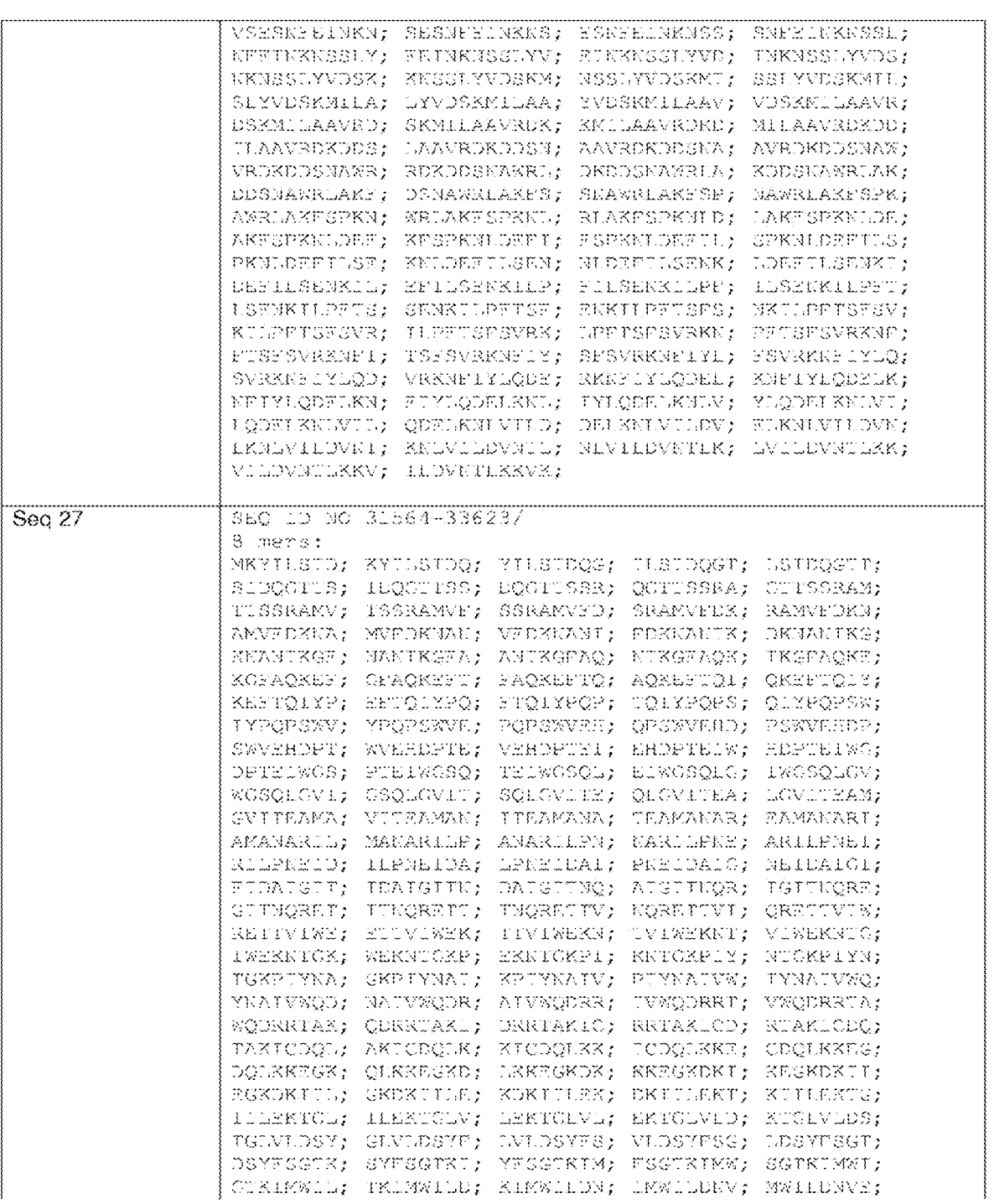
Figure 31:
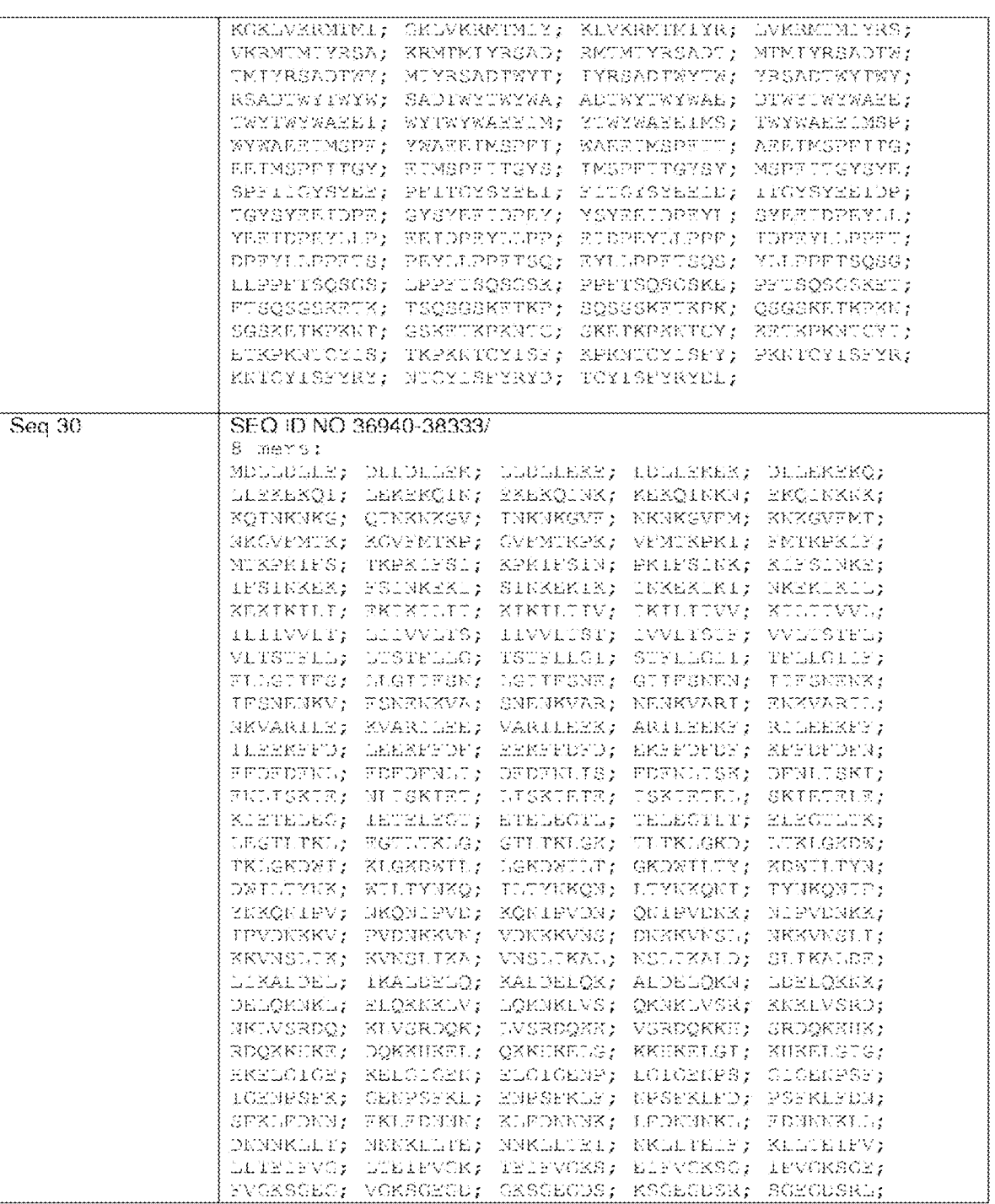
Figure 31:
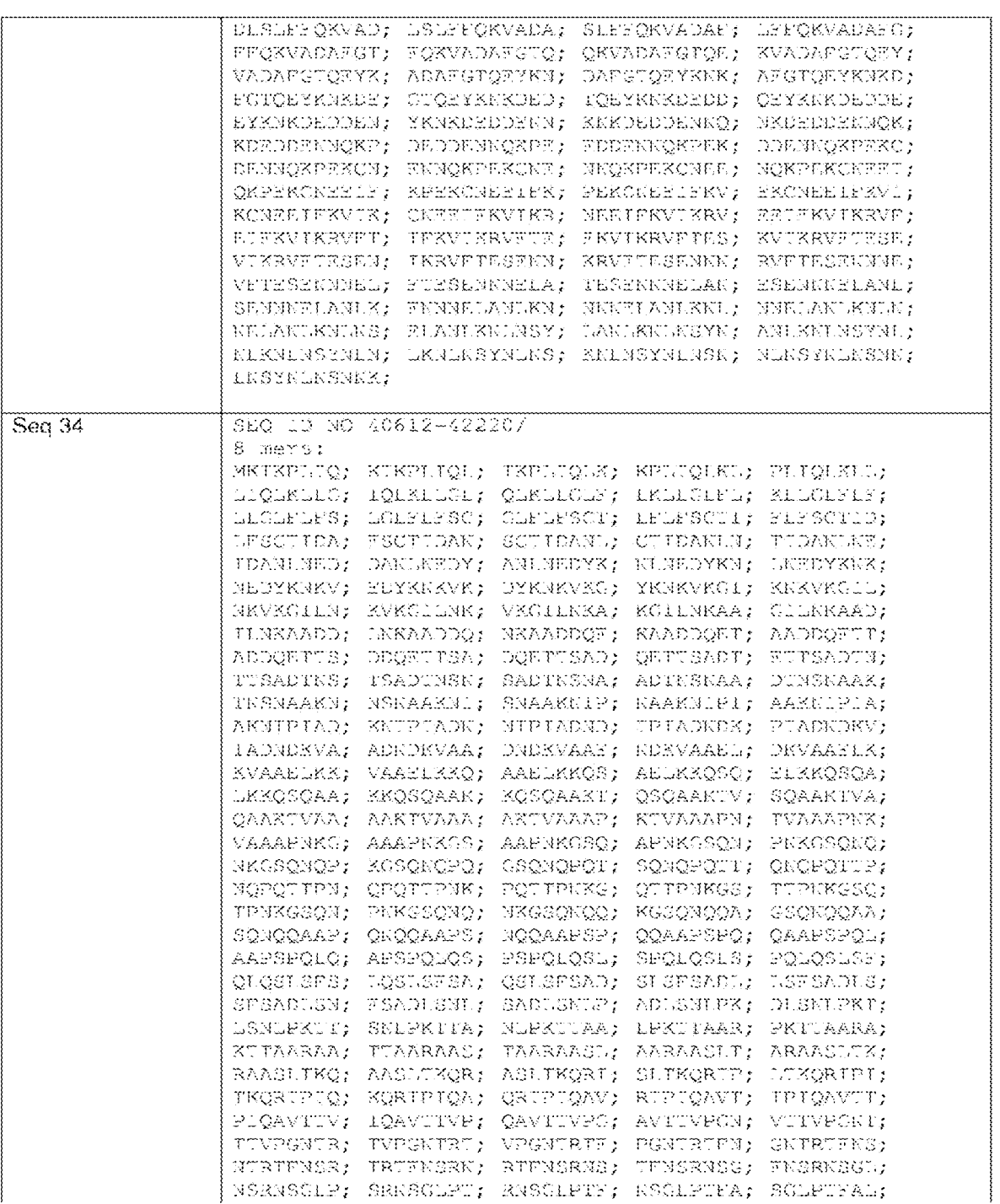

Lane 2: Folded HLA-A*0201-β2m-QLFEELQEL (SEQ ID NO 217775) peptide-complex

Lane 3: Folded HLA-A*0201-β2m-QLFEELQEL (SEQ ID NO 217775) peptide-complex incubated with molar excess Streptavidin.

FIG. 9. Composition of Fluorescein-linker molecule. (A) Schematic representation of an example of a Fluorescein-linker molecule. (B) Composition of a L15 linker.

FIG. 10. List of the 24 MHC class 1 alleles used for peptide prediction by the database www.cbs.dtu.dk/services/NetMHC/ and the 14 MHC class 2 alleles used for peptide prediction by the database www.cbs.dtu.dk/services/NetMHCIII/

FIG. 11. Ex vivo ELISPOT analysis of BclX(L)-specific. CD8 positive T cells in PBL from a breast cancer patient either with or without the BclX(L) YLNDHLEPWI peptide (SEQ ID NO 217776). Analysis were performed in doublets and number of IFN-gamma producing T-cells are presented. (Reference: Sorensen R B, Hadrup S R, Kollgaard T, Svane I M, Thor Straten P, Andersen M H (2006) Efficient tumor cell lysis mediated by a Bcl-X(L) specific T cell clone isolated from a breast cancer patient. Cancer Immunol Immunother April; 56(4)527-33)

FIG. 12. PBL from a breast cancer patient analyzed by flow cytometry. PBL from a breast cancer patient was analyzed by flow cytometry to identify Bcl-X(L)173-182 (peptide YLNDHLEPWI (SEQ ID NO 217776)) specific CD8 T cells using the dextramer complex HLA-A2/Bcl-X(L)173-182-APC, 7-AAD-PerCP, CD3-FITC, and CD8-APC-Cy7. The dextramer complex HLA-A2/HIV-1 pol476-484-APC was used as negative control.

(Reference: Sorensen R B, Hadrup S R, Kollgaard T, Svane I M, Thor Straten P, Andersen M H (2006) Efficient tumor cell lysis mediated by a Bcl-X(L) specific T cell clone isolated from a breast cancer patient. Cancer Immunol Immunother April; 56(4)527-33)

FIG. 13. 51-Cr release assay of isolated T cell clones. Ten expanded T cell clones isolated by Flow sorting and then expanded were tested for their specificity by analysis in a standard 51-Cr release assay. For this purpose, T2 cells loaded with either Bcl-X(L)173-182, YLNDHLEPWI (SEQ ID NO 217776) peptide or an irrelevant peptide (BA4697-105, GLQHWVPEL (SEQ ID NO 217777)) were used as target cells. (Reference: Sorensen R B, Hadrup S R, Kollgaard T, Svane I M, Thor Straten P, Andersen M H (2006) Efficient tumor cell lysis mediated by a Bcl-X(L) specific T cell clone isolated from a breast cancer patient. Cancer Immunol Immunother April; 56(4)527-33)

FIG. 14. Bcl-X(L)173-182 specific clone tested for its cytotoxic potential in 51Cr-release assays. A) Bcl-X(L)173-182 specific clone was tested for its cytotoxic potential in 51Cr-release assays. Two assays were performed a Cell lysis of T2 cells pulsed with Bcl-X(L)173-182 peptide or an irrelevant peptide (BA4697-105, GLQHWVPEL (SEQ ID NO 217777)) in three E:T ratios. B) Cell lysis of T2 cells pulsed with different concentrations of Bcl-X(L)173-182 peptide at the E:T ratio 1:1. (Reference: Sorensen R B, Hadrup S R, Kollgaard T, Svane I M, Thor Straten P, Andersen M H (2006) Efficient tumor cell lysis mediated by a Bcl-X(L) specific T cell clone isolated from a breast cancer patient. Cancer Immunol Immunother April; 56(4)527-33).

FIG. 15. Detection of *Borrelia* specific T cells using MHC dextramers. Dot plots showing live gated CD3+/CD4− lymphocytes from *Borrelia* patient stained with (A) Negative Control MHC Dextramer (HLA-A*0201(GLAGDVSAV) (SEQ ID NO 217778) or (B) pool of MHC Dextramers containing peptides from *Borrelia* antigen Osp A and Fla B. pool of MHC Dextramers containing peptides from *Borrelia* antigen. 0.05% of the live gated CD3+/CD4− lymphocytes are positive for one or more of the MHC Dextramers in the pool.

FIG. 16. Detection of CMV specific T cells using MHC dextramers Dot plots showing live gated CD3+/CD4− lymphocytes from CMV infected patient stained with (A) Negative Control MHC Dextramers (HLA-A*0201 (GLAGDVSAV)) (SEQ ID NO 217778) or (B) MHC Dextramers containing peptides from CMV pp65 antigen (HLA-A*0201(NLVPMVATV)) (SEQ ID NO 217779).

FIG. 17. Conformational ELISA. The ELISA is carried out as a sandwich-ELISA. The ELISA-plate was coated with W6/32 mouse-anti-hHLA-ABC (DAKO M0736) antibody, which recognizes a conformational epitope on correctly folded MHC-complex. Then MHC complex in various concentrations was added (peptide QLFEELQEL is SEQ ID NO:217775). β2m in various concentrations was used as negative control. HRP-conjugated rabbit anti-β2m (DAKO PO174) was used for detection of bound MHC complex. TMB One-step substrate system (Dako) was used as a substrate for HRP, and color formation was followed by measurement of absorbance at 450 nm.

FIG. 18. Carboxylate-modified beads coupled to TCR and stained with HLA-A*0201(NLVPMVATV)/RPE (SEQ ID NO 217779) or HLA-A*0201(ILKEPVHGV)/RPE (SEQ ID NO 217780) dextramers. TCR in various concentrations were coupled to carboxylate- modified beads and then stained with HLA-A*0201(NLVPMVATV)/RPE (SEQ ID NO 217779) or HLA-A*0201(ILKEPVHGV)/RPE (SEQ ID NO 217780) dextramers in a flow cytometry experiment.

A) Histogram showing x-axis: Fluorescence intensity measured in the RPE channel (FL2), y-axis: events counted. Events measured in the Region R9 are regarded as negative, and events measured in Region R10 are regarded as positive.

B) Percentage of positively stained beads is shown for each preparation of beads. Negative control samples:

1) Beads coupled with 10 μg TCR stained with HLA-A*0201(ILKEPVHGV)/RPE (SEQ ID NO 217780)
2) Beads coupled with 0 μg TCR stained with HLA-A*0201(NLVPMVATV)/RPE (SEQ ID NO 217779)

Positive control samples:

3) Beads coupled with 2 μg TCR stained with HLA-A*0201(NLVPMVATV)/RPE (SEQ ID NO 217779)
4) Beads coupled with 5 μg TCR stained with HLA-A*0201(NLVPMVATV)/RPE (SEQ ID NO 217779)
5) Beads coupled with 10 μg TCR stained with HLA-A*0201(NLVPMVATV)/RPE (SEQ ID NO 217779)
6) Beads coupled with 20 μg TCR stained with HLA-A*0201(NLVPMVATV)/RPE (SEQ ID NO 217779)

FIG. 19. Flow cytometry analysis of human cell samples added TCR-coated beads.

TCR-beads were added into human peripheral whole blood (A) or HPBMC (B) and then the samples were analysed by flow cytometry. Region R1 represents TCR-beads; region R2 represents lymphocyte cell population of interest.

FIG. 20. Flow cytometry analysis of MHC multimer constructs carrying nonsense peptides. Human Peripheral Blood Lymphocytes were ficoll purified from blood from a human donor and stained with mouse anti-human CD3/PE antibody and mouse anti-human CD8/PB antibody together with either of the MHC Dextramer molecule constructs A) HLA-A*0201(NLVPMVATV)/APC (SEQ ID NO 217779), B) HLA-A*0201(ILKEPVHGV)/APC (SEQ ID NO 217780), C) HLA-A*0201(nonsense peptide 1)/APC or D) HLA-A*0201(nonsense peptide 2)/APC. The staining was analysed on a CyAn ADP flow cytometer. Live-gated and CD3 positive lymphocytes are shown.

FIG. 21. Summary of flow cytometry analysis of the binding of different MHC multimer constructs to specific T cells in purified Human Peripheral Blood.

Mononuclear Cell samples. Purified HPBMC were stained with different MHC(peptide) molecules attached to APC labeled dextran270 multimerization domain and analyzed by flow cytometry. See example 58 for details on experimental procedures. 5 different MHC(peptide) molecules were investigated. Construct 1: HLA-A*0201 (GLAGDVSAV) (SEQ ID NO 217778), construct 2: HLA-A*0201(ALIAPVHAV) (SEQ ID NO 217781), construct 3: HLA-A*0201(NLVPMVATV) (SEQ ID NO 217779), construct 4: HLA-A*0201(GLCTLVAML) (SEQ ID NO 217782) and construct 5: HLA-A*0201(ILKEPVHGV) (SEQ ID NO 217780). A positive staining is symbolized with a (+) and is here defined as the identification of a distinct CD8 positive and MHC (peptide) positive population when visualized in a dot plot (se FIG. 20). Negative staining is symbolized with a (−) and is defined as absence of a distinct CD8 positive and MHC (peptide) positive population when visualized in a dot plot. Nt means not determined. All samples have previously been analyzed for the presence of T-cells restricted by HLA-A*0201(NLVPMVATV) (SEQ ID NO 217779), HLA-A*0201(GLCTLVAML) (SEQ ID NO 217782) and HLA-A*0201 (ILKEPVHGV) (SEQ ID NO 217780) and these results are shown in italics in the figure (column 2 and 3).

FIG. 22. Gating strategy for no-lyse no-wash procedure. Whole blood was stained with MHC multimer, anti-CD8/APC, anti-CD3/PB and CD45/CY antibody in a no-lyse no-wash procedure. For further details see text in example 65. During analysis of data the following gating strategy was used: CD45/PB antibody was used to set a trigger discriminator to allow the flow cytometer to distinguish between red blood cells and stained white blood cells. This was done during data collection by gating on CD45/PB positive cells in a CD45/PB vs. side scatter dot plot as shown in A. After data collection and during data analysis CD3 positive cells were selected by gating CD3/FITC positive cells in a CD3/FITC vs side scatter plot as shown in B. The final data was illustrated in a MHC multimer/PE vs CD8/APC plot (see FIG. 23).

FIG. 23. Identification of CMV-specific T cells in a blood sample using no-lyse no-wash procedure. Whole blood from three different donors were analysed for the presence of CMV-specific T cells by flow cytometry using a no-lyse no-wash procedure. Donor 1 was stained with a MHC multimer consisting of PE-conjugated 270 kDa dextran coupled with HLA-A*0201 in complex with beta2microglobulin and the peptide NLVPMVATV (SEQ ID NO 217779) derived from Human Cytomegalo Virus (HCMV) (left panel) and with a negative control MHC multimer consisting of PE conjugated 270 kDa dextran coupled with HLA-A*0201 in complex with beta2microglobulin and the peptide ILKEPVHGV (SEQ ID NO 217780) derived from Human Immunodeficiency Virus (HIV) (right panel). Donor 2 was stained with a MHC multimer consisting of PE-conjugated 270 kDa dextran coupled with HLA-A*0101 in complex with beta2microglobulin and the peptide VTEHDTLLY (SEQ ID NO 217783) derived from Human Cytomegalo Virus (HCMV) (left panel) and a negative control MHC multimer consisting of PE-conjugated 270 kDa dextran coupled with HLA-A*0101 in complex with beta2microglobulin and the peptide IVDCLTEMY (SEQ ID NO 217784) derived from ubiquitin specific peptidase 9 (USP9) (right panel). Donor 3 was stained with two MHC multimers consisting of PE conjugated 270 kDa dextran coupled with HLA-B*0207 in complex with beta2microglobulin and either of the peptides TPRVTGGGAM (SEQ ID NO 217785) (left panel) or RPHERNGFTVL (SEQ ID NO 217786) (center panel) both derived from Human Cytomegalo Virus (HCMV) and with a negative control MHC multimer consisting of PE-conjugated 270 kDa dextran coupled with HLA-B*0207 in complex with beta2microglobulin and the peptide TPGPGVRYPL (SEQ ID NO 217787) derived from Human Immunodeficiency Virus (HIV) (right panel). All samples were also added Anti-CD45/PB, anti-CD3/FITC and anti-CD8/APC antibodies. The samples were gated as shown in FIG. 22.

FIG. 24. Enumeration of specific T cells using Cyto-Count™ beads. Whole blood from a human donor were analysed for the presence of CMV-specific T cells with MHC multimers by flow cytometry using a no-lyse no-wash procedure. 2×100 µl donor blood was analysed with two different MHC multimers: A) PE-conjugated 270 kDa dextran coupled with HLA-A*0101 in complex with beta2microglobulin and the peptide VTEHDTLLY (SEQ ID NO 217783) derived from Human Cytomegalo Virus (HCMV) and a negative control construct B) consisting of PE-conjugated 270 kDa dextran coupled with HLA-A*0101 in complex with beta2microglobulin and the peptide IVDCLTEMY (SEQ ID NO 217784) derived from ubiquitin specific peptidase 9 (USP9). To each sample Anti-CD45/CY, anti-CD3/APC and anti-CD8/PB antibody was added together with 50 µl CytoCount beads (1028 beads/µl). Following staining for 15 minutes PBS was added to 1 ml and the samples analysed on a CyAn flow cytometer. During analysis CD45/CY antibody was used to set a trigger discriminator to allow the flow cytometer to distinguish between red blood cells and stained white blood cells and CD3/APC antibody was used to gate for CD3 positive T lymphocytes. Amount of counted beads in sample A are shown in the histogram C and amount of beads counted in the negative control sample B are show in histogram D.

Concentration of HLA-A*0101(VTEHDTLLY) (SEQ ID NO 217783) specific T cells in the blood sample were determined as follows:

((count of MHC multimer+CD8+ cells in A×concentration of beads×dilution factor of beads)/counted beads C))−((counted MHC multimer+CD8+ cells in B×concentration of beads×dilution factor of beads)/counted beads D)=((1300 cells×1028 beads/µl×0.05)/67225 beads)−((2 cells×1028 beads/µl×0.05)/72623 beads)=0,9926 cells/µl=992.6 celler/ml FIG. 25. MHC dextramers can be embedded in a sugar matrix together with antibodies and used for detection of specific T cells in a blood sample. MHC dextramer constructs was embedded in a sugar matrix together with relevant gating reagents (anti-CD3/Pacific Blue, anti-CD8/Alexa700 and anti-CD45/Cascade Yellow antibodies) and the matrix dried. Then EDTA stabilized blood from a human donor were added and the samples analyzed by flow cytometry. Two different MHC construct were used HLA-A*0101 (VTEHDTLLY)/PE dextramer (SEQ ID NO 217783) (A) and the negative control construct HLA-A*0101(IVDCLTEMY)/PE (SEQ ID NO 217784) (B). As a control antibodies and MHC dextramer constructs were used to stain blood from the same donor following a general staining procedure without embedding the antibodies and MHC dextramers in a sugar matrix as described elsewhere herein. (C) Staining with HLA-A*0101(VTEHDTLLY)/PE (SEQ ID NO 217783) dextramer following a normal staining procedure and (D) Staining with HLA-A*0101(IVDCLTEMY)/PE (SEQ ID NO 217784) dextramer following a normal staining procedure.

FIG. 26. Borrelia genome survey for the three Borrelia species, B. burgdorferi, B. afzelii and B. garinii. Listed are the database accession numbers for the individual genomes and the known plasmids or variable plasmid segments of the three species. The specific strains of the individual species are denoted.

FIG. 27. Complete list of all known and putative proteins encoded by the genome and plasmids of Borrelia burgdorferi (strain B31). The proteins are identified by their names or designations. Position of start and end of the gene, coding strand, amino acid length of the encoded protein, and the accession numbers and gene ID's are given.

FIG. 28. Complete list of all known and putative proteins encoded by the genome and plasmids of Borrelia afzelii (strain PKo). The proteins are identified by their names or designations. Position of start and end of the gene, coding strand, amino acid length of the encoded protein, and the accession numbers and gene ID's are given.

FIG. 29. Complete list of all known and putative proteins encoded by the genome, plasmids and known variable plasmid segments of Borrelia garinii (strain PBi). The proteins are identified by their names or designations. Position of start and end of the gene, coding strand, amino acid length of the encoded protein, and the accession numbers and gene ID's are given.

FIG. 30. The amino acid sequences of Borrelia antigens of specific interest as sources for MHC binding peptides. Name and protein bank accession numbers are shown.

FIG. 31. Borrelia MHC class 1 antigen peptides of 8-, 9-, 10- and 11 amino acids in length generated from the chosen protein sequences by random prediction software (see FIG. 2). Name and protein bank accession numbers are shown.

FIG. 32. Borrelia MHC class 1 antigen peptides of 8-, 9-, 10- and 11 amino acids in length generated from the chosen protein sequences by use of software based on neural prediction of MHC binding peptides. Peptide sequences are grouped according to HLA binding alleles and sub-grouped according to peptide length.

Figure 33:
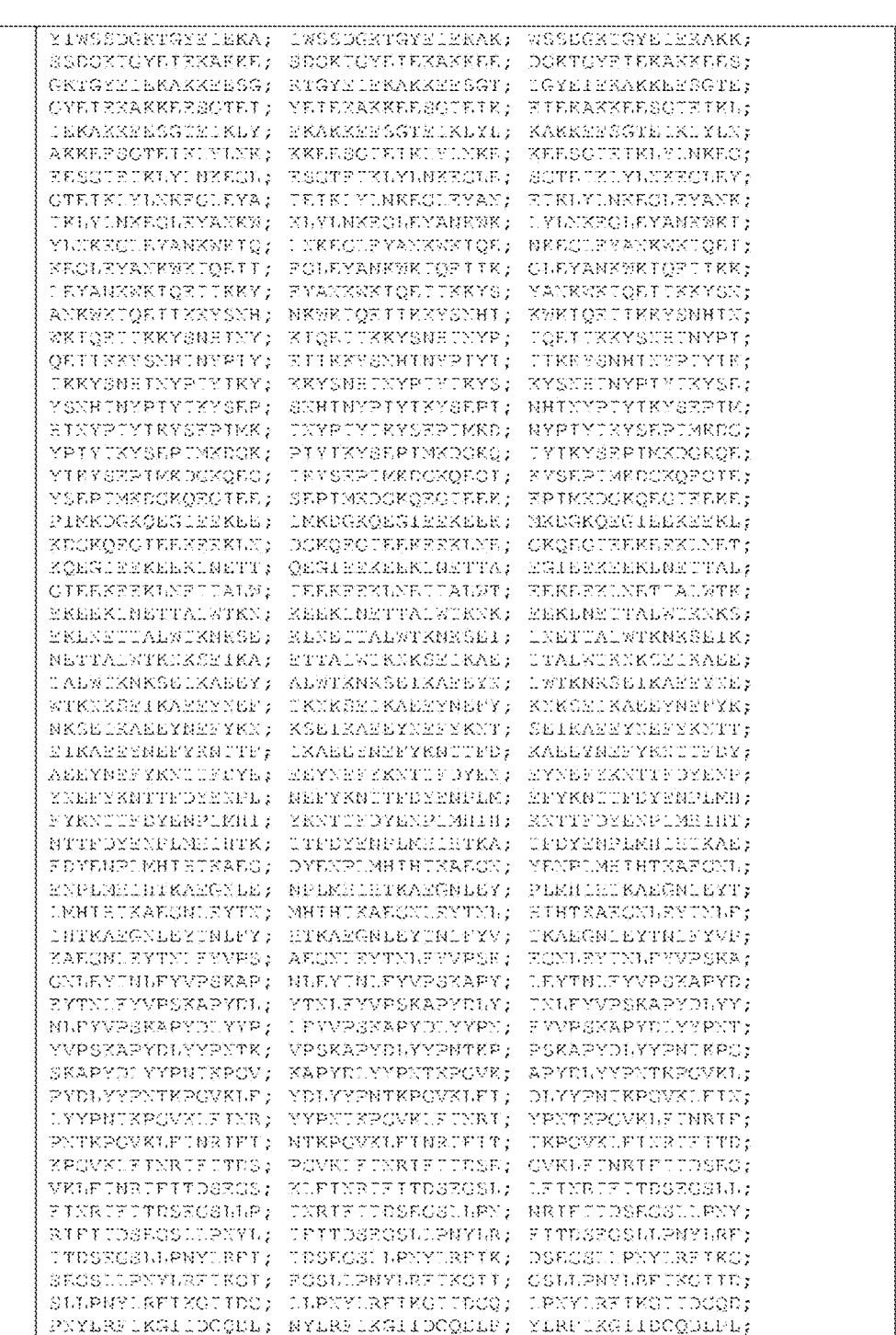
Figure 33:
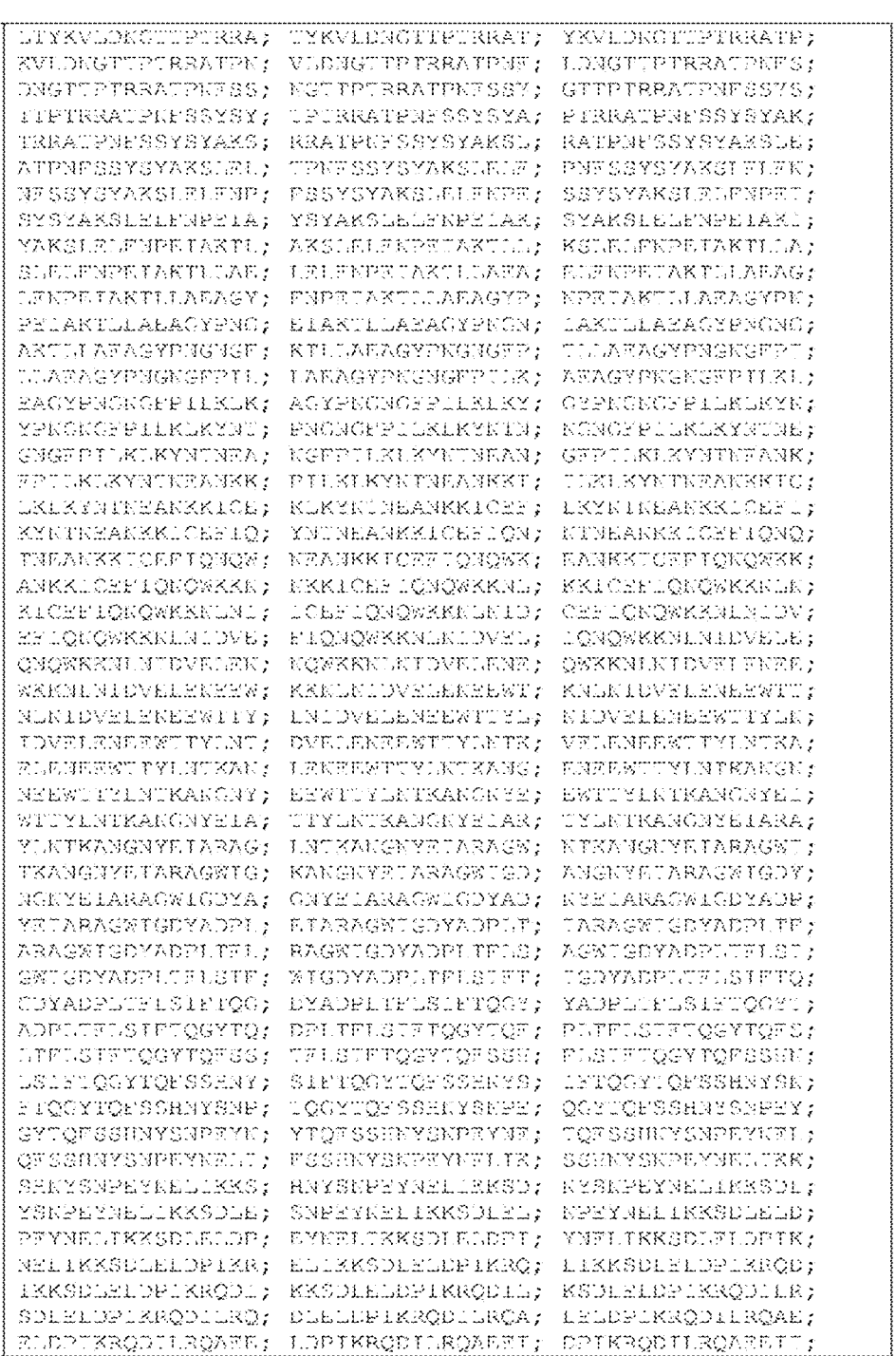
Figure 33:
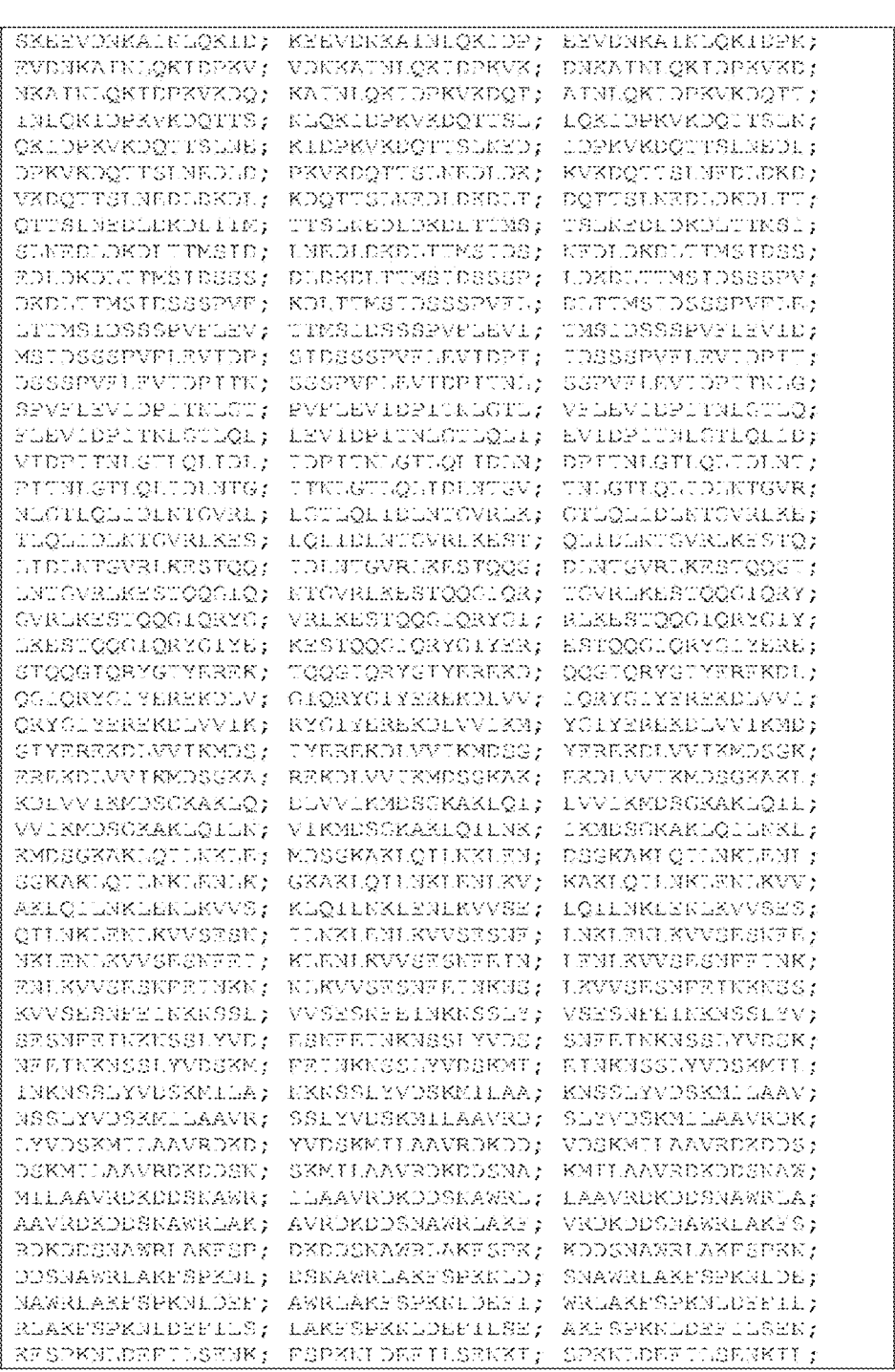
Figure 33:
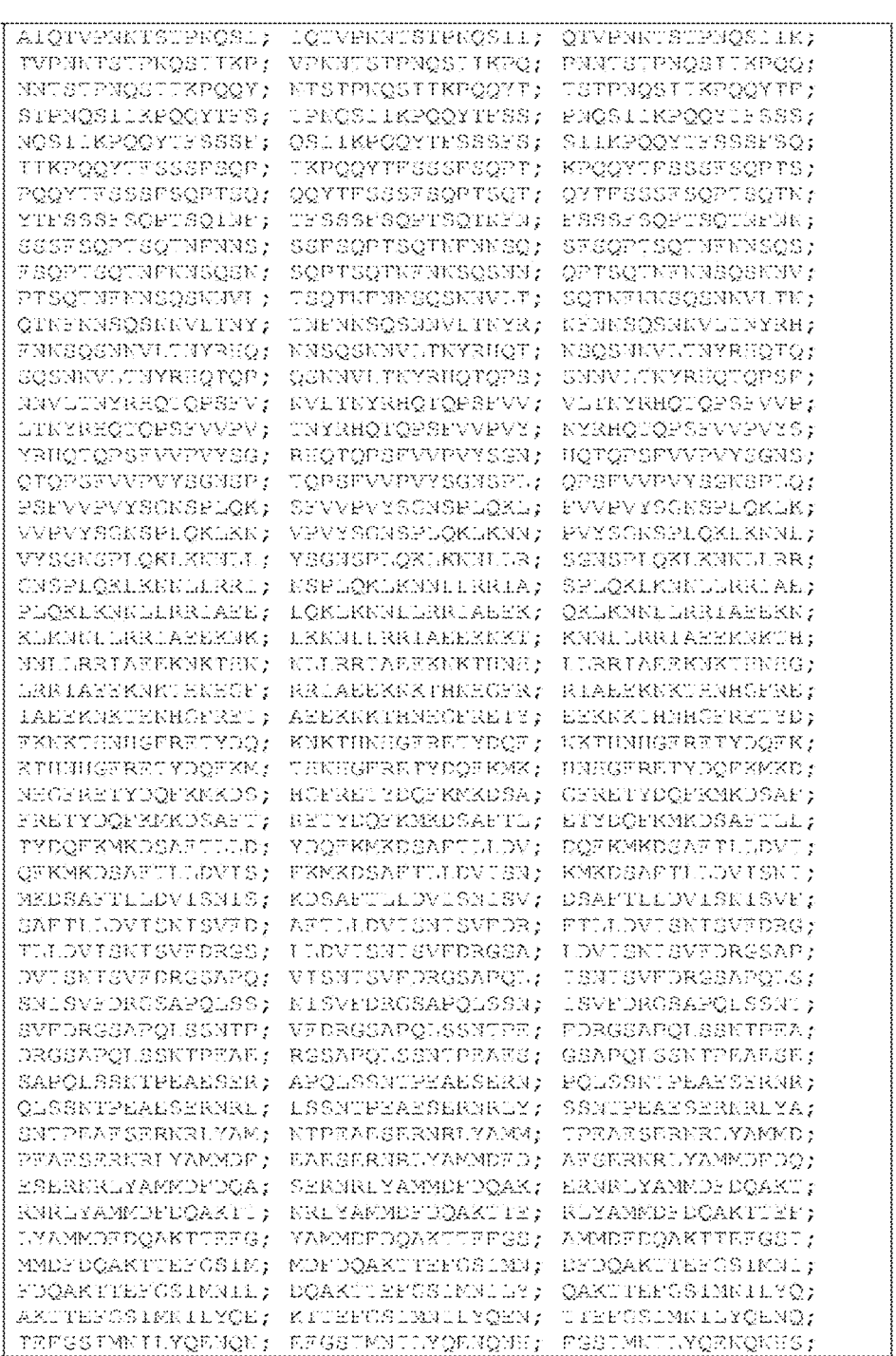
Figure 33:
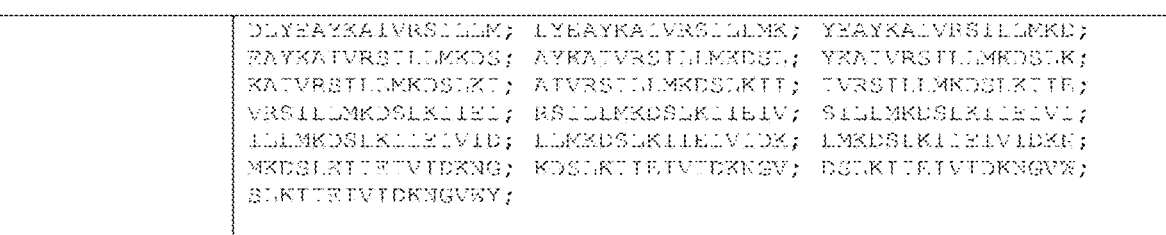

FIG. 33. Borrelia MHC class 2 antigen peptides of 13-, 14-, 15-, and 16 amino acids in length generated from the chosen protein sequences by random prediction software (see FIG. 2).

FIG. 34. Borrelia MHC class 2 antigen peptides of 15 amino acids in length generated from the chosen protein sequences by use of software based on neural prediction of MHC binding peptides. Peptide sequences are grouped according to HLA binding alleles and sub-grouped according to peptide length. For each 15-mer binding peptide the essential 9-mer core sequence is given.

Figure 35:
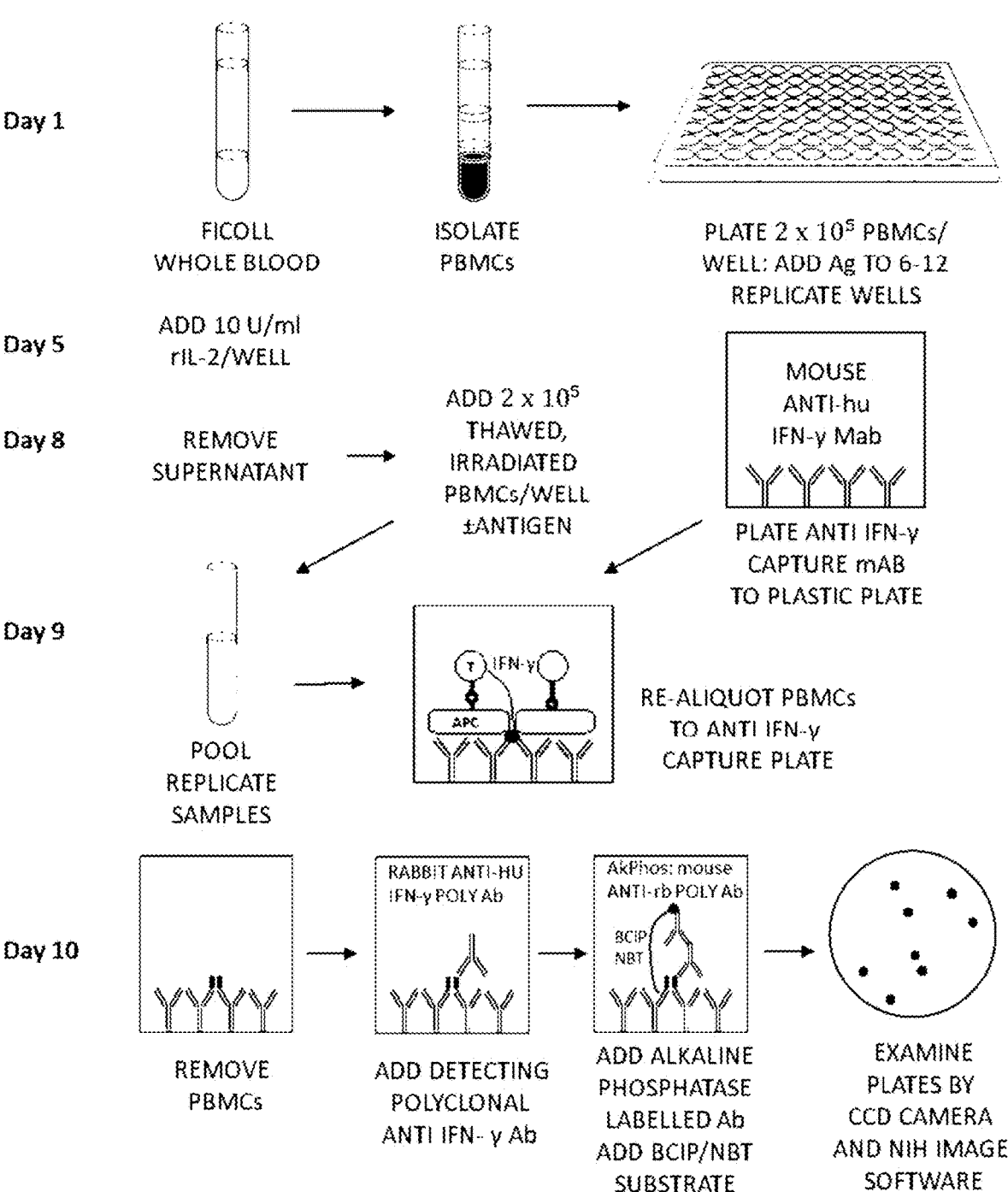

FIG. 35. Summary flow chart ELISPOT. Summary flow chart showing measurement of antigen reactive T-Cells by IFN-γ capture in blood samples by ELISPOT. See example 31 for more detailed information.

FIG. 36. Prediction of cancer antigen BclX(L) specific MHC class 1, 8-, 9-, 10-, 11-mer peptide binders. Prediction of cancer antigen BclX(L) specific MHC class 1, 8-, 9, 10-,11-mer peptide binders for 24 MHC class 1 alleles (see FIG. 10) using the www.cbs.dtu.dk/services/NetMHC/ database. The MHC class 1 molecules for which no binders were found are not listed. The peptides listed in FIG. 36 correspond to SEQ ID NO 216470-217262 in the sequence listing.

FIG. 37. Prediction of cancer antigen BclX(L) specific MHC class 2, 15-mer peptide binders. Prediction of cancer antigen BclX(L) specific MHC class 2, 15-mer peptide binders for 14 MHC class 2 alleles (see FIG. 10) using the www.cbs.dtu.dk/services/NetMHCII/ database. The MHC class 2 molecules for which no binders were found are not listed. The peptides listed in FIG. 37 correspond to SEQ ID NO 217263-217774 in the sequence listing.

FIG. 38. The amino acid sequences of *Borrelia* antigens of specific interest as sources for MHC binding peptides. Name and protein bank accession numbers are shown.

FIG. 39: *Borrelia* MHC class 1 and 2 antigen peptides of 8-, 9-, 10- and 11 amino acids and 13-, 14-, 15- and 16 amino acids in length generated from the chosen protein sequences by random prediction software. Name and protein bank accession numbers are shown.

FIG. 40: NetMHC peptides. A) *Borrelia burgdorferi* MHC class 1 & 2 epitopes, B) *Borrelia afzelii* MHC class 1 & 2 epitopes, C) *Borrelia garinii* MHC class 1 & 2 epitopes. The NetMHC peptides are predicted by the www.cbs.dtu.dk/services/NetMHC/database.

FIG. 41: NetMHC peptide sequences from FIG. 40 are grouped according to HLA binding alleles and sub-grouped according to peptide length.

FIG. 42: Selected peptides. The amino acid sequence from one or more *Borrelia* strains were aligned using the protein alignment programs Vector NTI from Invitrogen, and a homologous sequence for all analyzed strains were be identified. This homologous sequence were run through the "intelligent" peptide epitope prediction program NetMHC as described elsewhere herein to identify epitopes able to bind HLA-A*02 or HLA-A*03. The identified epitopes are shown in this figure. A) Special selected HLA-A*0201 binding peptides from *Borrelia* proteins; B) Special selected HLA-A*0301 binding peptides from *Borrelia* proteins.

FIG. 43: *Borrelia* MHC class 1 and 2 antigen peptides of 8-, 9-, 10- and 11 amino acids and 13-, 14-, 15- and 16 amino acids in length generated from the chosen protein sequences by random prediction software (SEQ ID NO 180858 to SEQ ID NO 215925). NetMHC peptides predicted by the www.cbs.dtu.dk/services/NetMHC/database (SEQ ID NO 215926 to SEQ ID NO216339). Name and protein bank accession numbers are shown.

FIG. 44: Special selected HLA-A*0201 epitopes from *Borrelia* species. Some peptides may be identical to sequences in either *Borrelia afzelii. B. garinii* or *B. burgdorferi* but some will be optimized to show possible fit to more than one species ie. some amino acid position have been altered compared to the individual parent sequences.

FIG. 45: Special selected HLA-A*03 epitopes from *Borrelia* species. Some peptides may be identical to sequences in either *Borrelia afzelii. B. garinii* or *B. burgdorferi* but some will be optimized to show possible fit to more than one species ie. some amino acid position have been altered compared to the individual parent sequences.

DETAILED DESCRIPTION OF THE INVENTION

The present invention in one aspect refers to a MHC monomer comprising a-b-P, or a MHC multimer comprising $(a-b-P)_n$, wherein n>1, wherein a and b together form a functional MHC protein capable of binding the antigenic peptide P, wherein (a-b-P) is the MHC-peptide complex formed when the antigenic peptide P binds to the functional MHC protein, and wherein each MHC peptide complex of a MHC multimer is associated with one or more multimerization domains.

Another aspect of the present invention refers to an antigenic peptide P or an antigenic polypeptide featuring one or more antigenic peptides P.

The antigenic peptide P is in one embodiment a *Borrelia* peptide such as e.g. a *Borrelia burgdorferi* B31 peptide, a *Borreila afzelii* PKo peptide or a *Borrelia garinii* PBi peptide.

MHC monomers and MHC multimers comprising one or more MHC peptide complexes of class 1 or class 2 MHC are covered by the present invention. Accordingly, the antigenic peptide P can have a length of e.g. 8, 9, 10, 11, 12, 13, 14, 15, 16, 16-20, or 20-30 amino acid residues.

Examples of the antigenic peptide P is provided herein below. In one embodiment, the antigenic peptide P can be selected from the group consisting of sequences disclosed in the "Sequence Listing" and annotated consecutively (using integers) starting with SEQ ID NO:1 and ending with SEQ ID NO:217791 or any fragment thereof.

In another aspect the present invention is directed to a composition comprising a plurality of MHC monomers and/or MHC multimers according to the present invention, wherein the MHC multimers are identical or different, and a carrier.

The present invention further relates to a method for detection of antigen-specific T cells, said method comprising the steps of 1) providing the MHC multimer described above, 2) providing a population of antigen-specific T cells, and 3) detecting antigen-specific T cells specific for the peptide P of the MHC multimer.

The present invention also relates to a method for detection of antigen-specific T cells, said method comprising the steps of 1) providing the antigenic peptid or antigenic polypeptide described above, 2) providing a population of antigen-specific T cells, and 3) detecting antigen-specific T cells specific for the antigenic peptide P in complex with MHC molecules.

In a further embodiment the present invention relates to a method for counting of antigen-specific T cells, said method comprising the steps of 1) providing the MHC multimer described above, 2) providing a population of antigen-specific T cells, and 3) counting antigen-specific T cells specific for the peptide P of the MHC multimer.

The present invention also relates to a method for sorting of antigen-specific T cells, said method comprising the steps of 1) providing the MHC multimer described above, 2) providing a population of antigen-specific T cells, and 3) sorting antigen-specific T cells specific for the peptide P of the MHC multimer.

In yet another embodiment the present invention relates to a method for isolation of antigen-specific T cells, said method comprising the steps of 1) providing the MHC multimer described above, 2) providing a population of antigen-specific T cells, and 3) isolating antigen-specific T cells specific for the peptide P of the MHC multimer.

In yet another aspect there is provided a kit comprising an antigenic peptide, an antigenic polypeptide, a MHC monomer or a MHC multimer according to the present invention, or a composition according to the present invention, and at least one additional component, such as a positive control and/or instructions for use.

In a still further aspect there is provided a method for immune monitoring one or more diseases comprising monitoring of antigen-specific T cells, said method comprising the steps of i) providing the MHC monomer or MHC multimer or individual components thereof according to the present invention,
ii) providing a population of antigen-specific T cells or individual antigen-specific T cells, and
iii) measuring the number, activity or state and/or presence of antigen-specific of T cells specific for the peptide P of the said MHC monomer or MHC multimer, thereby immune monitoring said one or more diseases.

Or i) providing the antigenic peptide or antigenic polypeptide according to the present invention,
ii) providing a population of antigen-specific T cells or individual antigen-specific T cells, and providing antigen presenting cells expressing MHC molecules on their surface
iii) measuring the number, activity or state and/or presence of antigen-specific of T cells specific for the antigenic peptide P in complex with one or more MHC molecules displayed on the surface of the antigen presenting cell, thereby immune monitoring said one or more diseases.

In yet another aspect there is provided a method for diagnosing one or more diseases comprising immune monitoring of antigen-specific T cells, said method comprising the following steps: of
i) providing the MHC monomer or MHC multimer or individual components thereof according to the present invention, or individual components thereof,
ii) providing a population of antigen-specific T cells or individual antigen-specific T cells, and
iii) measuring the number, activity or state and/or presence of T cells specific for said MHC monomer or the peptide P of the MHC multimer, thereby diagnosing said one or more diseases.

Or
i) providing the antigenic peptide or antigenic polypeptide according to the present invention,
ii) providing a population of antigen-specific T cells or individual antigen-specific T cells, and providing antigen presenting cells expressing MHC molecules on their surface
iii) measuring the number, activity or state and/or presence of T cells specific for said antigenic peptide P in complex with one or more MHC molecules displayed on the surface of the antigen presenting cell, thereby diagnosing said one or more diseases.

There is also provided a method for isolation of one or more antigen-specific T cells, said method comprising the steps of
i) providing the MHC monomer or MHC multimer or individual components thereof according to the present invention, or individual components thereof, and
ii) providing a population of antigen-specific T cells or individual antigen-specific T cells, and
iii) thereby isolating said T cells specific for the peptide P of the said MHC monomer or MHC multimer.

The present invention makes it possible to pursue different immune monitoring methods using the MHC monomers, MHC multimers, antigenic peptides or antigenic polypeptides according to the present invention. The immune monitoring methods include e.g. flow cytometry, ELISPOT, LDA, Quantiferon and Quantiferon-like methods. Using the above-cited methods, the MHC monomers and/or the MHC multimers can be provided as a MHC peptide complex, or the antigenic peptide and the MHC monomer and/or multimer can be provided separately.

Accordingly, recognition of TCR's can be achieved by direct or indirect detection, e.g. by using one or more of the following methods:

ELISPOT technique using indirect detection, e.g. by adding the antigenic peptide optionally associated with a MHC monomer or MHC multimer, followed by measurement of INF-gamma secretion from a population of cells or from individual cells.

Another technique involves a Quantiferon-like detection assay, e.g. by using indirect detection, e.g. by adding the antigenic peptide optionally associated with a MHC monomer or MHC multimer, followed by measurement of INF-gamma secretion from a population of cells or from individual cells.

Flow cytometry offers another alternative for performing detection assays, e.g. by using direct detection (e.g. of MHC tetramers), e.g. by adding the antigenic peptide optionally associated with a MHC monomer or MHC multimer, followed by detection of a fluorescein label, thereby measuring the number of TCRs on specific T-cells.

Flow cytometry can also be used for indirect detection, e.g. by adding the antigenic peptide optionally associated with a MHC monomer or MHC multimer, followed by addition of a "cell-permeabilizing factor," and subsequent measurement of an intracellular component (e.g. INF-gamma mRNA), from individual cells or populations of cells.

By using the above-mentioned and other techniques, one can diagnose and/or monitor e.g. infectious diseases caused e.g. by mycobacetrium, Gram positive bacteria, Gram negative bacteria, Spirochetes, intracellular bacterium, extracellular bacterium, *Borrelia*, TB, CMV, HPV, Hepatitis, BK, fungal organisms and microorganisms. The diagnosis and/or monitoring of a particular disease can greatly aid in directing an optimal treatment of said disease in an individual.

In still further aspects of the present invention there is provided a method for performing a vaccination of an individual in need thereof, said method comprising the steps of
providing an antigenic peptide, an antigenic polypeptide, a MHC monomer or a MHC multimer, according to the present invention, or the individual components thereof, and
administering said antigenic peptide, antigenic polypeptide, MHC monomer or MHC multimer to said individual and obtaining a protective immune response, thereby performing a vaccination of the said individual.

In yet another embodiment there is provided a method for performing therapeutic treatment of an individual comprising the steps of
Providing the MHC multimer according to the present invention, or individual components thereof, and
Isolating or obtaining T-cells from a source, such as an individual or an ex-vivo library or cell bank, wherein said isolated or obtained T-cells are specific for said provided MHC multimer,
Optionally manipulating said T-cells, and
Introducing said isolated or obtained T-cells into an individual to be subjected to a therapeutic treatment, wherein the individual can be the same individual or a different individual from the source individual.

There is also provided a method comprising one or more steps for minimizing undesired binding of the MHC multimer according to the present invention. This method is disclosed herein below in more detail.

In further aspects the present invention provides:

A method for performing a control experiment comprising the step of counting of particles comprising the MHC multimer according to the present invention.

A method for performing a control experiment comprising the step of sorting of particles comprising the MHC multimer according to the present invention.

A method for performing a control experiment comprising the step of performing flow cytometry analysis of particles comprising the MHC multimer according to the present invention.

A method for performing a control experiment comprising the step of performing a immunohistochemistry analysis comprising the MHC multimer according to the present invention.

A method for performing a control experiment comprising the step of performing a immunocytochemistry analysis comprising the MHC multimer according to the present invention.

A method for performing a control experiment comprising the step of performing an ELISA analysis comprising the MHC multimer according to the present invention.

In a still further aspect of the present invention there is provided a method for generating MHC multimers according to the present invention, said method comprising the steps of i) providing one or more antigenic peptides P; and/or ii) providing one or more functional MHC proteins, iii) optionally providing one or more multimerization domains, and iv) contacting the one or more peptides P and the one or more functional MHC proteins and the one or more multimerization domains simultaneously or sequentially in any order, thereby obtaining MHC multimers according to the present invention.

The method can also be performed by initially providing one or more antigenic peptide(s) P and optionally one or more functional MHC proteins to generate a MHC-peptide complex (a-b-P); subsequently or simultaneously providing one or more multimerisation domain(s); and reacting the one or more MHC-peptide complexes and the one or more multimerization domain(s) to generate a MHC multimer according to the present invention.

In one aspect, the present invention is directed to novel MHC complexes optionally comprising a multimerization domain preferably comprising a carrier molecule and/or a scaffold.

There is also provided a MHC multimer comprising 2 or more MHC-peptide complexes and a multimerization domain to which the 2 or more MHC-peptide complexes are associated. The MHC multimer can generally be formed by association of the 2 or more MHC-peptide complexes with the multimerization domain to which the 2 or more MHC-peptide complexes are capable of associating.

The multimerization domain can be a scaffold associated with one or more MHC-peptide complexes, or a carrier associated with one or more, preferably more than one, MHC-peptide complex(es), or a carrier associated with a plurality of scaffolds each associated with one or more MHC-peptide complexes, such as 2 MHC-peptide complexes, 3 MHC-peptide complexes, 4 MHC-peptide complexes, 5 MHC-peptide complexes or more than 5 MHC-peptide complexes. Accordingly, multimerization domain collectively refers to each and every of the above. It will be clear from the detailed description of the invention provided herein below when the multimerization domain refers to a scaffold or a carrier or a carrier comprising one or more scaffolds.

Generally, when a multimerization domain comprising a carrier and/or a scaffold is present, the MHC complexes can be associated with this domain either directly or via one or more binding entities. The association can be covalent or non-covalent.

Accordingly, there is provided in one embodiment a MHC complex comprising one or more entities $(a\text{-}b\text{-}P)_n$, wherein a and b together form a functional MHC protein capable of binding a peptide P, and wherein (a-b-P) is the MHC-peptide complex formed when the peptide P binds to the functional MHC protein, said MHC complex optionally further comprising a multimerization domain comprising a carrier molecule and/or a scaffold. "MHC complex" refers to any MHC complex, including MHC monomers in the form of a single MHC-peptide complex and MHC multimers comprising a multimerization domain to which more than one MHC peptide complex is associated.

When the invention is directed to complexes comprising a MHC multimer, i.e. a plurality of MHC peptide complexes of the general composition $(a\text{-}b\text{-}P)_n$ associated with a multimerization domain, n is by definition more than 1, i.e. at least 2 or more. Accordingly, the term "MHC multimer" is used herein specifically to indicate that more than one MHC-peptide complex is associated with a multimerization domain, such as a scaffold or carrier or carrier comprising one or more scaffolds. Accordingly, a single MHC-peptide complex can be associated with a scaffold or a carrier or a carrier comprising a scaffold and a MHC-multimer comprising 2 or more MHC-peptide complexes can be formed by association of the individual MHC-peptide complexes with a scaffold or a carrier or a carrier comprising one or more scaffolds each associated with one or more MHC-peptide complexes.

When the MHC complex comprises a multimerization domain to which the n MHC-peptide complexes are associated, the association can be a covalent linkage so that each or at least some of the n MHC-peptide complexes is covalently linked to the multimerization domain, or the association can be a non-covalent association so that each or at least some of the n MHC-peptide complexes are non-covalently associated with the multimerization domain.

The MHC complexes of the invention may be provided in non-soluble or soluble form, depending on the intended application.

Effective methods to produce a variety of MHC complexes comprising highly polymorphic human HLA encoded proteins makes it possible to perform advanced analyses of complex immune responses, which may comprise a variety of peptide epitope specific T-cell clones.

One of the benefits of the MHC complexes of the present invention is that the MHC complexes overcome low intrinsic affinities of monomer ligands and counter receptors. The MHC complexes have a large variety of applications that include targeting of high affinity receptors (e.g. hormone peptide receptors for insulin) on target cells. Taken together poly-ligand binding to target cells has numerous practical, clinical and scientifically uses.

Thus, the present invention provides MHC complexes which present mono-valent or multi-valent binding sites for MHC-peptide recognising cells, such as MHC complexes optionally comprising a multimerization domain, such as a scaffold or a carrier molecule, which multimerization domain have attached thereto, directly or indirectly via one or more linkers, covalently or non-covalently, one or more MHC peptide complexes. "One or more" as used herein is intended to include one as well as a plurality, such as at least 2. This applies i.a. to the MHC peptide complexes and to the binding entities of the multimerization domain. The scaffold or carrier molecule may thus have attached thereto a MHC peptide complex or a plurality of such MHC peptide complexes, and/or a linker or a plurality of linkers.

Product

In one embodiment of the present invention the product is a MHC monomer or a MHC multimer as described above. As used in the description of this invention, the term "MHC multimers" will be used interchangeably with the terms MHC'mers and MHCmers, and will include any number, (larger than one) of MHC-peptide complexes, held together in a large complex by covalent or non-covalent interactions between a multimerization domain and one or more MHC-peptide complexes, and will also include the monomeric form of the MHC-peptide complex, i.e. a MHC-peptide complex that is not attached to a multimerization domain. The multimerization domain consists of one or more carriers and/or one or more scaffolds while the MHC-peptide complex consists of MHC molecule and antigenic peptide. MHC-peptide complexes may be attached to the multimerization domain through one or more linkers. A schematic representation of a MHC multimer is presented in FIG. 1.

In another embodiment of the present invention the product is antigenic peptide or antigenic polypeptide containing one or more antigenic peptide sequences. As used in the description of this invention the term antigenic peptide will be used interchangeably with the term binding peptide and refers to any peptide molecule that is bound or able to bind into the binding groove of either MHC class 1 or MHC class 2.

In the following the design and generation of antigenic peptides, antigenic polypeptides and the different components of MHC monomers and/or MHC multimers are described.

Design and Generation of Antigenic Peptides

Antigenic peptides of the present invention may be used in processes of the present invention either as part of MHC monomers, MHC multimers or antigenic polypeptides or used themselves as a product. Antigenic polypeptide and antigenic peptide products will later in the process they are used for, bind MHC molecules and thereby generate MHC monomers and/or MHC multimers, e.g. when used as a vaccine the antigenic peptides may bind MHC molecules on cells inside the body or when used for an immune monitoring process antigenic peptides binds MHC molecules present in the sample they are applied to.

Therefore the features of and principles for design and generation of antigenic peptides used themselves as a product or used in MHC monomers, MHC multimers or in antigenic polypeptides are identical and will be described in more detail in the following.

MHC class 1 protein typically binds octa-, nona-, deca- or ondecamer (8-, 9-, 10,- 11-mer) peptides in their peptide binding groove. The individual MHC class 1 alleles have individual preferences for the peptide length within the given range. MHC class 2 proteins typically bind peptides with a total length of 13-18 amino acids, comprising a 9'-mer core motif containing the important amino acid anchor residues. However the total length is not strictly defined, as opposed to most MHC class 1 molecules.

For some of the MHC alleles the optimal peptide length and the preferences for specific amino acid residues in the so called anchor positions are known.

To identify high-affinity binding peptides derived from a specific protein for a given MHC allele it is necessary to systematically work through the amino acid sequence of the protein to identify the putative high-affinity binding peptides. Although a given peptide is a binder it is not necessarily a functional T-cell epitope. Functionality needs to be confirmed by a functional analysis e.g. ELISPOT, CTL killing assay or flow cytometry assay as described elsewhere herein.

The binding affinity of the peptide for the MHC molecules can for some MHC molecules be predicted in databases such as www.syfpeithi.de; www-bimas.cit.nih.gov/molbio/hla-_bind/; www.cbs.dtu.dk/services/NetMHC/; www.cbs.dtu.dk/services/NetMHCII/

Design of Binding Peptides

The first step in the design of binding peptides is obtaining the protein's amino acid sequence. In many cases the amino acid sequence of the protein from which antigenic peptides have to be identified from are known. However, when only the genomic DNA sequences are known, i.e. the reading frame and direction of transcription of the genes is unknown, the DNA sequence needs to be translated in all three reading frames in both directions leading to a total of six amino acid sequences for a given genome. From these amino acid sequences binding peptides can then be identified as described below. In organisms having intron/exon gene structure the present approach must be modified accordingly, to identify peptide sequence motifs that are derived by combination of amino acid sequences derived partly from two separate introns. cDNA sequences can be translated into the actual amino acid sequences to allow peptide identification. In cases where the protein sequence is known, these can directly be used to predict peptide epitopes.

Binding peptide sequences can be predicted from any protein sequence by either a total approach, generating binding peptide sequences for potentially any MHC allele, or by a directed approach, identifying a subset of binding peptides with certain preferred characteristics such as affinity for MHC protein, specificity for MHC protein, likelihood of being formed by proteolysis in the cell, and other important characteristics.

Design of MHC Class 1 Binding Peptide Sequence

Many parameters influence the design of the individual binding peptide, as well as the choice of the set of binding peptides to be used in a particular application. Important characteristics of the MHC-peptide complex are physical and chemical (e.g. proteolytic) stability. The relevance of these parameters must be considered for the production of the antigenic peptides, the antigenic polypeptides, the MHC-peptide complexes and the MHC multimers, as well as for their use in a given application. As an example, the stability of the MHC-peptide complex in assay buffer (e.g. PBS), in blood, or in the body can be very important for a particular application.

In the interaction of the MHC-peptide complex with the TCR, a number of additional characteristics must be considered, including binding affinity and specificity for the TCR, degree of cross-talk, undesired binding or interaction with other TCRs. Finally, a number of parameters must be considered for the interaction of MHC-peptide complexes, MHC multimers, antigenic peptides or antigenic polypeptides with the sample or individual it is being applied to. These include immunogenicity, allergenicity, as well as side effects resulting from un-desired interaction with "wrong" T cells, including cross-talk with e.g. autoimmune diseases and un-desired interaction with other cells than antigen-specific T cells.

For some applications, e.g. immuno profiling of an individual's immune response focused on one antigen, it is preferred that all possible binding peptides of that antigen are included in the application (i.e. the "total approach" for the design of binding peptides described below). For other applications, e.g vaccines it may be adequate to include a few or just one binding peptide for each of the HLA-alleles included in the application (i.e. the "directed approach" whereby only the most potent binding peptides can be included). Personalized diagnostics, therapeutics and vaccines will often fall in-between these two extremes, as it will only be necessary to include a few or just one binding peptide in e.g. a vaccine targeting a given individual, but the specific binding peptide may have to be picked from binding peptides designed by the total approach, and identified through the use of immuno profiling studies involving all possible binding peptides. The principles of immuno profiling is described elsewhere herein.

a) Total Approach

The MHC class 1 binding peptide prediction is done as follows using the total approach. The actual protein sequence is split up into 8-, 9-, 10-, and 11-mer peptide sequences. This is performed by starting at amino acid position 1 identifying the first 8-mer; then move the start position by one amino acid identifying the second 8-mer; then move the start position by one amino acid, identifying the third 8-mer. This procedure continues by moving start position by one amino acid for each round of peptide identification. Generated peptides will be amino acid position 1-8, 2-9, 3-10 etc. This procedure can be carried out manually or by means of a software program (FIG. 2). This procedure is then repeated in an identical fashion for 9-, 10 and 11-mers, respectively.

b) Directed Approach

The directed approach identifies a preferred subset of binding peptides from the binding peptides generated in the total approach. This preferred subset is of particularly value in a given context.

One way to select subsets of antigenic peptides is to use consensus sequences to choose a set of relevant binding peptides able to bind the individual MHC allele and that will suit the "average" individual. Such consensus sequences often solely consider the affinity of the binding peptide for the MHC protein; in other words, a subset of binding peptides is identified where the designed binding peptides have a high probability of forming stable MHC-peptide complexes, but where it is uncertain whether this MHC-peptide complex is of high relevance in a population, and more uncertain whether this MHC-peptide complex is of high relevance in a given individual. For class I MHC-alleles, the consensus sequence for a binding peptide is generally given by the formula $X_1$-$X_2$-$X_3$-$X_4$- . . . —$X_n$, where n equals 8, 9, 10, or 11, and where X represents one of the twenty naturally occurring amino acids, optionally modified as described elsewhere in this application. $X_1$-$X_n$ can be further defined. Thus certain positions in the consensus sequence are more likely to contribute to binding to a given MHC molecule than others.

Antigenic peptide-binding by MHC I is accomplished by interaction of specific amino acid side chains of the antigenic peptide with discrete pockets within the peptide-binding groove of the MHC molecule. The peptide-binding groove is formed by the α1 and α2 domains of the MHC I heavy chain and contains six pockets denoted A, B, C, D, E, F. For human HLA molecules the main binding energy associating antigenic peptide to MHC I is provided by interaction of amino acids in position 2 and at the c-terminus of the antigenic peptide with the B and F binding pockets of the MHC I molecule. The amino acids of the antigenic peptide being responsible for the main anchoring of the peptide to the MHC molecule are in the following called primary anchor amino acids and the motif they form for primary anchor motif. Other amino acid side chains of an antigenic peptide may also contribute to the anchoring of the antigenic peptide to the MHC molecule but to a lesser extent. Such amino acids are often referred to as secondary anchor amino acids and form a secondary anchor motif.

Different HLA alleles have different amino acids lining the various pockets of the peptide-binding groove enabling the various alleles to bind unique repertoires of antigenic peptides with specific anchor amino acid motifs. Thus for a selected consensus sequence certain positions are the socalled anchor positions and the selection of useful amino acids for these positions is limited to those able to fit into the corresponding binding pockets in the HLA molecule. For example for peptides binding HLA-A*02, X2 and X9 are primary anchor positions docking into the B and F pocket of the HLA molecule respectively, and useful amino acids at these two positions in the binding peptide are preferable limited to leucine or methionine for X2 and to valine or leucine at position X9. In contrast the primary anchor positions of peptides binding HLA-B*08 are X3, X5 and X9 and the corresponding preferred amino acids at these positions are lysine at position X3, lysine or arginine at position X5 and leucine at position X9.

However, the different HLA alleles can be grouped into clusters or supertypes where the alleles of the supertype share peptide-binding pocket similarities in that they are able to recognize the same type of antigenic peptide primary anchor motif. Therefore antigenic peptides can be selected on their ability to bind a given HLA molecule or a given HLA supertype on the basis of their amino acid sequence, e.g. the identity of the primary anchor motif.

Antigenic peptide primary anchor motifs of special interest of the present invention are listed in table 6.

TABLE 6

HLA I supertype familie's and their antigenic peptide anchor motifs. Examples of usefull amino acids binding in pocket B and pocket F are shown as one letter code.

| | | Anchor motif | | | |
|---|---|---|---|---|---|
| Supertype | B pocket specificity | Example aa B pocket | F pocket specificity | Example aa F pocket | Example of HLA allele's |
| A01 | Small and aliphatic | A,T, S, V, L, I, M, Q | Aromatic and large hydrophobic | F, W, Y, L, I, M | A*0101, A*2601, A*2602, A*2603, A*3002, A*3003, A*3004, A*3201 |

TABLE 6-continued

HLA I supertype familie's and their antigenic peptide anchor motifs. Examples of
usefull amino acids binding in pocket B and pocket F are shown as one letter code.

| | | Anchor motif | | | |
|---|---|---|---|---|---|
| Supertype | B pocket specificity | Example aa B pocket | F pocket specificity | Example aa F pocket | Example of HLA allele's |
| A01/A03 | Small and aliphatic | A, T, S, V, L, I, M, Q | Aromatic and basic | Y, R, K | A*3001, A*3201, A*7401 |
| A01/A24 | Small, aliphatic and aromatic | A, S, T, V, L, I, M, Q, F, W, Y | Aromatic and large hydrophobic | F, W, Y, L, I, M | A*2902 |
| A02 | Small and aliphatic | A, T, S, V, L, I, M, Q | Aliphatic and small hydrophobic | L, I, V, M, Q, A | A*0201, A*0202, A*0203, A*0204, A*0205, A*0206, A*0207, A*0214, A*0217, A*6802, A*6901 |
| A03 | Small and aliphatic | A, T, S, V, L, I, M, Q | Basic | R, H, K | A*0301, A*1101, A*3101, A*3301, A*3303, A*6601, A*6801, A*7401 |
| A24 | Aromatic and aliphatic | F, W, Y, L, I, V, M, Q | Aromatic, aliphatic and hydrophbic | F, W, Y, L, I, V, M, Q, A | A*2301, A*2402 |
| B07 | Proline | P | Aromatic, aliphatic and hydrophbic | F, W, Y, L, I, V, M, Q, A | B*0702, B*0703, B*0705, B*1508, B*3501, B*3503, B*4201, B*5101, B*5102, B*5103, B*5301, B*5401, B*5501, B*5502, B*5601, B*6701, B*7801 |
| B08 | Undefined | | Aromatic, aliphatic and hydrophbic | F, W, Y, L, I, V, M, Q, A | B*0801, B*0802 |
| B27 | Basic | R, H, K | Aromatic, aliphatic, basic and hydrophbic | F, W, Y, L, I, V, M, Q, A, R, H, K | B*1402, B*1503, B*1509, B*1510, B*1518, B*2702, B*2703, B*2704, B*2705, B*2706, B*2707, B*2709, B*3801, B*3901, B*3902, B*3909, B*4801, B*7301 |
| B44 | Acidic | D, E | Aromatic, aliphatic and hydrophbic | F, W, Y, L, I, V, M, Q, A | B*1801, B*3701, B*4001, B*4002, B*4006, B*4402, B*4403, B*4501 |
| B58 | Small | A, S, T | Aromatic, aliphatic and hydrophbic | F, W, Y, L, I, V, M, Q, A | B*1516, B*1517, B*5701, B*5702, B*5801, B*5802 |
| B62 | Aliphatic | L, I, V, M, Q | Aromatic, aliphatic and hydrophbic | F, W, Y, L, I, V, M, Q, A | B*1501, B*1502, B*1512, B*1513, B*4501, B*4601, B*5201 |

Antigenic peptides able to bind a given MHC molecule do not necessarily have primary anchor amino acid residues compatible with both main anchoring pockets of the MHC molecule but may have one or no primary anchor amino acids suitable for binding the MHC molecule in question. However, having the preferred primary anchor motif for a given MHC allele increases the affinity of the antigenic peptide for that given allele and thereby the likelihood of making a stable and useful MHC-peptide molecule.

Therefore in one embodiment of the present invention antigenic peptides can be identified and selected on their ability to bind a given HLA or other MHC molecule based on what amino acids they have at primary anchor positions and/or secondary anchor positions.

Software programs are available that use neural networks or established binding preferences to predict the interaction of specific binding peptides with specific MHC class I alleles. Examples of such programs are www.syfpeithi.de; www.imtech.res.in/raghava/propred1/index.html; www.cbs.dtu.dk/services/NetMHC/.

Another usefull parameter for prediction and selection of usefull antigenic peptides are the probability of the binding peptide in question to be generated in vivo by the proteolytic machinery inside cells. For example for a given antigen the combined action of endosolic, cytosolic and membrane bound protease activities as well as the TAP1 and TAP2 transporter specificities can be taken into consideration. However, the proteolytic activity varies a lot among individuals, and for personalized diagnostics, treatment or vaccination it may be desirable to disregard these general proteolytic data. An example of a program predicting the ability of antigenic peptides to be processed is www.cbs.dtu.dk/services/NetCTL/.

Using the above described principles individual peptides or a subset of peptides able to bind one or more types of MHC molecules and make stable MHC-peptide complexes can be identified. The identified peptides can then be tested for biological relevance in functional assays such as interferon gamma release assays (e.g. ELISPOT), cytotoxicity assays (e.g. CTL killing assays) or using other methods as described in the section "Detection" elsewhere herein. Alternatively or complementary hereto the ability of the identified antigenic peptides to bind selected MHC molecules may be determined in binding assays like Biacore measurement, competition assays or other assays usefull for measurement of binding of peptide to MHC molecules, known by persons skilled in the art.

Design of MHC Class 2 Binding Peptide Sequence.

a) Total Approach and b) Directed Approach

The approach to predict antigenic peptide binders for MHC class 2 can be done in a similar way as described for MHC class 1 binding peptide prediction above. The change is the different size of the antigenic peptides binding MHC II compared to MHC I. MHC II molecules bind antigenic peptides with a size of 12-24 amino acids or even longer peptides. From a given antigenic protein, MHC II molecules typically can bind sets of overlapping peptides that shares a common core sequence but differs in the overall peptide size and in positioning of the core sequence in the peptide. The core peptide sequence is typically 9 amino acids long but may also be shorter or longer. Usefull antigenic peptide sequences binding MHC II of the present invention are described by the central part of the peptide mainly the 9-mer core peptide. The core peptide sequence may be flanked with a few or several important amino acids, generating antigenic peptides with a length of 13-16 amino acids. In some cases the peptide may contain even more flanking residues resulting in binding peptides longer than 13-16 amino acids. Thus, antigenic peptides of special interest of the present invention are peptides consisting of or containing 9-mer core peptide sequences The antigenic peptide sequences may be selected using the total approach as described for MHC I antigenic peptides elsewhere herein, e.g. using the software program shown in FIG. 2.

Alternatively a directed approach identifying a preferred subset of binding peptides from the binding peptides generated in the total approach can be used. As for MHC I one way to select subsets of antigenic peptides is to use consensus sequences to choose a set of relevant binding peptides able to bind the individual MHC allele and that will suit the "average" individual. Such consensus sequences often solely consider the affinity of the binding peptide for the MHC protein; in other words, a subset of binding peptides is identified where the designed binding peptides have a high probability of forming stable MHC-peptide complexes, but where it is uncertain whether this MHC-peptide complex is of high relevance in a population, and more uncertain whether this MHC-peptide complex is of high relevance in a given individual.

For class II MHC-alleles, the consensus sequence for the interacting core of a binding peptide is generally given by the formula $$X1\text{-}X2\text{-}X3\text{-}X4\text{-}\ldots\text{-}Xn,$$

where n equals 9, and where X represents one of the twenty naturally occurring amino acids, optionally modified as described elsewhere in this application.

X1-Xn can be further defined. Thus, certain positions in the consensus sequence are the socalled anchor positions and the selection of useful amino acids for these positions is limited to those able to fit into the corresponding binding pockets in the HLA molecule. For example HLA-DRB1*1501 have X1, X4 and X7 as primary anchor positions where preferred amino acids at the three positions are as follows, X1: leucine, valine and isoleucine, X4: phenylalanine, tyrosine or isoleucine, X7: isoleucine, leucine, valine, methionine or phenylalanine.

Therefore in one embodiment of the present invention antigenic peptides can be identified and selected on their ability to bind a given HLA or other MHC molecule based on what amino acids they have at various anchor positions.

In general, MHC II binding peptides have much more varied anchor positions than MHC I binding peptides and the number of usefull amino acids at each anchor position is much higher. For some MHC II alleles no really consensus sequence has been identified. In general position 1, 4, 6 and 9 of the 9-mer core motif of MHC II antigenic peptides are important for anchoring of the antigenic peptide to the MHC II molecule.

Table 7 shows examples of primary anchor positions and corresponding usefull amino acids for antigenic peptides binding various MHC II molecules.

TABLE 7

Examples of primary anchor positions and corresponding usefull amino acids shown as one letter code.

| MHC II | 1 | 2 | 3 | 4 | 5 | 6 | 7 | 8 | 9 |
|---|---|---|---|---|---|---|---|---|---|
| DQ2 | F, W, Y, I, L, V | | | D, E, L, V, I, H | | P, D, E, H, P, A | D, E | | F, W, Y, I, L, V, M |
| DQA1*0101/DQB1*0501 | L | | | | Y, F, W | | | | |
| DQA1*0102/DQB1*0602 | | | | | | L, I, V | | | A, G, S, T |
| DR17 (DRB1*0301) | L, I, F, M, V | | | D | | K, R, E, Q, N | | | Y, L, F |
| DR4 (DRB1*0401) | F, Y, W, I, L, V, M | | | P, W, I, L, V, A, D, E | | N, S, T, Q, H, R | D, E, H, K, N, Q, R, S, T, Y | | E, H, K, N, Q, R, S, T, Y, A, |

TABLE 7-continued

Examples of primary anchor positions and corresponding usefull amino acids shown as one letter code.

| MHC II | 1 | 2 | 3 | 4 | 5 | 6 | 7 | 8 | 9 |
|---|---|---|---|---|---|---|---|---|---|
| | | | | | | | A, C, I, L, M, V | | C, I, L, M, V |
| DRB1*1101 | W, Y, F | | | L, V, M, A, F, Y | | R, K, H | | | A, G, S, P |
| DRB1*1301 | I, V, F, L | | | Y, W, L, V, A, M | | R, K | | | Y, F, A, S, T |
| DRB1*1302 | Y, F, V, A, I | | | Y, W, L, V, A, M | | R, K | | | Y, F, A, S, T |

Another usefull parameter for prediction and selection of usefull antigenic peptides are the probability of the binding peptide in question to be generated in vivo or processed by the proteolytic machinery inside cells. However, like for MHC I, the proteolytic activity varies a lot among individuals, and for personalized diagnostics, treatment or vaccination it may be desirable to disregard these general proteolytic data.

Using the above described principles individual peptides or one or more subsets of peptides able to bind one or more types of MHC molecules and make stable MHC-peptide complexes can be identified. The identified peptides can then be tested for biological relevance in functional assays such as interferon gamma release assays, ELISPOT, CTL killing assays or using other methods as described in the section "Detection" elsewhere herein. Alternatively or complementary hereto the ability of the identified antigenic peptides to bind selected MHC molecules may be determined in binding assays like Biacore measurement, competition assays or other assays usefull for measurement of binding of peptide to MHC molecules, known by persons skilled in the art.

Peptide Modifications

In addition to the binding peptides designed by the total approach and/or directed approach, homologous peptides and peptides that have been modified in the amino acid side chains or in the backbone can be used as binding peptides.

Homologous Peptides

Homologues MHC peptide sequences may arise from the existence of multiple strongly homologous alleles, from small insertions, deletions, inversions or substitutions. If they are sufficiently homologous to peptides derived by the total approach, i.e. have an amino acid sequence identity greater than e.g. more than 90%, more than 80%, or more than 70%, or more than 60%, to one or two binding peptides derived by the total approach, they may be good candidates. Identity is often most important for the anchor residues.

A MHC binding peptide may be of split- or combinatorial epitope origin i.e. formed by linkage of peptide fragments derived from two different peptide fragments and/or proteins. Such peptides can be the result of either genetic recombination on the DNA level or due to peptide fragment association during the complex break down of proteins during protein turnover. Possibly it could also be the result of faulty reactions during protein synthesis i.e. caused by some kind of mixed RNA handling. A kind of combinatorial peptide epitope can also be seen if a portion of a longer peptide make a loop out leaving only the terminal parts of the peptide bound in the groove.

Uncommon, Artificial and Chemically Modified Amino Acids.

Peptides having un-common amino acids, such as selenocysteine and pyrrolysine, may be bound in the MHC groove as well. Artificial amino acids e.g. having the isomeric D-form may also make up isomeric D-peptides that can bind in the binding groove of the MHC molecules. Bound peptides may also contain amino acids that are chemically modified or being linked to reactive groups that can be activated to induce changes in or disrupt the peptide. Example post-translational modifications are shown below. However, chemical modifications of amino acid side chains or the peptide backbone can also be performed.

Any of the modifications can be found individually or in combination at any position of the peptide, e.g. position 1, 2, 3, 4, 5, 6, etc. up to n.

TABLE 1

Post translational modification of peptides
Protein primary structure and posttranslational modifications

| | |
|---|---|
| N-terminus | Acetylation, Formylation, Pyroglutamate, Methylation, Glycation, Myristoylation (Gly), carbamylation |
| C-terminus | Am idation, Glycosyl phosphatidylinositol (GPI), O-methylation, Glypiation, Ubiquitination, Sumoylation |
| Lysine | Methylation, Acetylation, Acylation, Hydroxylation, Ubiquitination, SUMOylation, Desmosine formation, ADP-ribosylation, Deamination and Oxidation to aldehyde |
| Cysteine | Disulfide bond, Prenylation, Palmitoylation |
| Serine/Threonine | Phosphorylation, Glycosylation |
| Tyrosine | Phosphorylation, Sulfation, Porphyrin ring linkage, Flavin linkage GFP prosthetic group (Thr-Tyr-Gly sequence) formation, Lysine tyrosine quinone (LTQ) formation, Topaquinone (TPQ) formation |
| Asparagine | Deamidation, Glycosylation |
| Aspartate | Succinimide formation |
| Glutamine | Transglutamination |
| Glutamate | Carboxylation, Methylation, Polyglutamylation, Polyglycylation |
| Arginine | Citrullination, Methylation |
| Proline | Hydroxylation |

Post Translationally Modified Peptides

The amino acids of the antigenic peptides can also be modified in various ways dependent on the amino acid in question, or the modification can affect the amino- or carboxy-terminal end of the peptide. See table 1. Such peptide modifications are occurring naturally as the result of post translational processing of the parental protein. A non-exhaustive description of the major post translational modifications is given below, divided into three main types.

a) Modification that Adds a Chemical Moiety to the Binding Peptide.
- acetylation, the addition of an acetyl group, usually at the N-terminus of the protein
- alkylation, the addition of an alkyl group (e.g. methyl, ethyl). Methylation, the addition of a methyl group, usually at lysine or arginine residues is a type of alkylation. Demethylation involves the removal of a methyl-group.
- amidation at C-terminus
- biotinylation, acylation of conserved lysine residues with a biotin appendage
- formylation
- gamma-carboxylation dependent on Vitamin K
- glutamylation, covalent linkage of glutamic acid residues to tubulin and some other proteins by means of tubulin polyglutamylase
- glycosylation, the addition of a glycosyl group to either asparagine, hydroxylysine, serine, or threonine, resulting in a glycoprotein. Distinct from glycation, which is regarded as a nonenzymatic attachment of sugars.
- glycylation, covalent linkage of one to more than 40 glycine residues to the tubulin C-terminal tail
- heme moiety may be covalently attached
- hydroxylation, is any chemical process that introduces one or more hydroxyl groups (—OH) into a compound (or radical) thereby oxidizing it. The principal residue to be hydroxylated is Proline. The hydroxilation occurs at the CY atom, forming hydroxyproline (Hyp). In some cases, proline may be hydroxylated instead on its $C^β$ atom. Lysine may also be hydroxylated on its $C^δ$ atom, forming hydroxylysine (Hyl).
- iodination
- isoprenylation, the addition of an isoprenoid group (e.g. farnesol and geranylgeraniol)
- lipoylation, attachment of a lipoate functionality, as in prenylation, GPI anchor formation, myristoylation, farnesylation, geranylation
- nucleotides or derivatives thereof may be covalently attached, as in ADP-ribosylation and flavin attachment
- oxidation, lysine can be oxidized to aldehyde
- pegylation, addition of poly-ethylen-glycol groups to a protein. Typical reactive amino acids include lysine, cysteine, histidine, arginine, aspartic acid, glutamic acid, serine, threonine, tyrosine. The N-terminal amino group and the C-terminal carboxylic acid can also be used
- phosphatidylinositol may be covalently attached
- phosphopantetheinylation, the addition of a 4'-phosphopantetheinyl moiety from coenzyme A, as in fatty acid, polyketide, non-ribosomal peptide and leucine biosynthesis
- phosphorylation, the addition of a phosphate group, usually to serine, tyrosine, threonine or histidine
- pyroglutamate formation as a result of N-terminal glutamine self-attack, resulting in formation of a cyclic pyroglutamate group.
- racemization of proline by prolyl isomerase
- tRNA-mediated addition of amino acids such as arginylation
- sulfation, the addition of a sulfate group to a tyrosine.
- Selenoylation (co-translational incorporation of selenium in selenoproteins)

b) Modification that Adds Protein or Peptide.
- ISGylation, the covalent linkage to the ISG15 protein (Interferon-Stimulated Gene 15)
- SUMOylation, the covalent linkage to the SUMO protein (Small Ubiquitin-related MOdifier)
- ubiquitination, the covalent linkage to the protein ubiquitin.

c) Modification that Converts One or More Amino Acids to Different Amino Acids.
- citrullination, or deimination the conversion of arginine to citrulline
- deamidation, the conversion of glutamine to glutamic acid or asparagine to aspartic acid The peptide modifications can occur as modification of a single amino acid or more than one i.e. in combinations. Modifications can be present on any position within the peptide i.e. on position 1, 2, 3, 4, 5, etc. for the entire length of the peptide.

Sources of Binding Peptides a) From Natural Sources

The binding peptides can be obtained from natural sources by enzymatic digestion or proteolysis of natural proteins or proteins derived by in vitro translation of mRNA. Binding peptides may also be eluted from the MHC binding groove.

b) From Recombinant Sources

1) As Monomeric or Multimeric Peptide

Alternatively peptides can be produced recombinantly by transfected cells either as monomeric antigenic peptides or as multimeric (concatemeric) antigenic peptides. Optionally, the Multimeric antigenic peptides are cleaved to form monomeric antigenic peptides before binding to MHC protein.

2) As Part of a Bigger Recombinant Protein

Binding peptides may also constitute a part of a bigger recombinant protein e.g. consisting of, 2a) for MHC Class 1 Binding Peptides, Peptide-linker-β2m, β2m being full length or truncated;

Peptide-linker-MHC class 1 heavy chain, the heavy chain being full length or truncated. Most importantly the truncated class I heavy chain will consist of the extracellular part i.e the α1, ☐ α2, and α domains. The heavy chain fragment may also only contain the α1 and α2 domains, or α1 domain alone, or any fragment or full length β2m or heavy chain attached to a designer domain(s) or protein fragment(s).

2b) for MHC Class 2 Binding Peptides the Recombinant Construction can Consist of, Peptide-linker-MHC class 2 α-chain, full length or truncated;

Peptide-linker-MHC class 2, β-chain, full length or truncated;

Peptide-linker-MHC class 2 α-chain-linker-MHC class 2, β-chain, both chains can be full length or truncated, truncation may involve, omission of α- and/or β-chain intermembrane domain, or omission of α- and/or β-chain intermembrane plus cytoplasmic domains. MHC class 2 part of the construction may consist of fused domains from NH2-terminal, MHC class 2 β1domain-MHC class 2 α1domain-constant α3 of MHC class 1, or alternatively of fused domains from NH2-terminal, MHC class 2 α1domain-MHC class 2 β1domain-constant α3 of MHC class 1. In both cases β2m will be associated non-covalently in the folded MHC complex. β2m can also be covalently associated in the folded MHC class 2 complex if the following constructs are used from NH2 terminal, MHC class 2 β1domain-MHC class 2 α1domain-constant α3 of MHC class 1-linker-β2m, or alternatively of fused domains from NH2-terminal, MHC class 2 α1domain-MHC class 2 β1domain-constant α3 of MHC class 1-linker-β2m; the construct may also consist of any of the above MHC class 2 constructs with added designer domain(s) or sequence(s).

c) From Chemical Synthesis

MHC binding peptide may also be chemically synthesized by solid phase or fluid phase synthesis, according to standard protocols.

Comprehensive collections of antigenic peptides, derived from one antigen, may be prepared by a modification of the solid phase synthesis protocol, as described in the following and exemplified in Example 24.

The protocol for the synthesis of the full-length antigen on solid support is modified by adding a partial cleavage step after each coupling of an amino acid. Thus, the starting point for the synthesis is a solid support to which has been attached a cleavable linker. Then the first amino acid X1 (corresponding to the C-terminal end of the antigen) is added and a coupling reaction performed. The solid support now carries the molecule "linker-X1". After washing, a fraction (e.g. 10%) of the cleavable linkers are now cleaved, to release into solution X1. The supernatant is transferred to a collection container. Additional solid support carrying a cleavable linker is added, e.g. corresponding to 10% of the initial amount of solid support.

Then the second amino acid X2 is added and coupled to X1 or the cleavable linker, to form on solid support the molecules "linker-X2" and "linker-X1-X2". After washing, a fraction (e.g. 10%) of the cleavable linker is cleaved, to release into solution X2 and X1-X2. The supernatant is collected into the collection container, which therefore now contains X1, X2, and X1-X2. Additional solid support carrying a cleavable linker is added, e.g. corresponding to 10% of the initial amount of solid support.

Then the third amino acid X3 is added and coupled to X2 or the cleavable linker, to form on solid support the molecules "linker-X3", "linker-X2-X3" and "linker-X1-X2-X3". After washing, a fraction (e.g. 10%) of the cleavable linker is cleaved, to release into solution X3, X2-X3 and X1-X2-X3. The supernatant is collected into the collection container, which therefore now contains X1, X2, X3, X1-X2, X2-X3 and X1-X2-X3. Additional solid support carrying a cleavable linker is added, e.g. corresponding to 10% of the initial amount of solid support.

This step-wise coupling and partial cleavage of the linker is continued until the N-terminal end of the antigen is reached. The collection container will now contain a large number of peptides of different length and sequence. In the present example where a 10% partial cleavage was employed, a large fraction of the peptides will be 8'-mers, 9'-mers, 10'-mers and 11'-mers, corresponding to class I antigenic peptides. As an example, for a 100 amino acid antigen the 8'-mers will consist of the sequences X1-X2-X3-X4-X5-X6-X7-X8, X2-X3-X4-X5-X6-X7-X8-X9, . . . , X93-X94-X95-X96-X97-X98-X99-X100.

Optionally, after a number of coupling and cleavage steps or after each coupling and cleavage step, the used (inactivated) linkers on solid support can be regenerated, in order to maintain a high fraction of linkers available for synthesis. The collection of antigenic peptides can be used as a pool for e.g. the display by APCs to stimulate CTLs in ELISPOT assays, or the antigenic peptides may be mixed with one or more MHC alleles, to form a large number of different MHC-peptide complexes which can e.g. be used to form a large number of different MHC multimers which can e.g. be used in flow cytometry experiments.

Sequences for Use in MHC Monomers, MHC Multimers, Antigenic Polypeptides and Antigenic Peptides MHC Class I and MHC Class II molecules have different structures, as described above, and therefore have different restrictions on the size of the peptide which may be accommodated. In general, MHC Class I molecules will accommodate peptides of from about 8 amino acids in length to about 11 amino acids. MHC Class II molecules will in general accommodate peptides of from about 13 amino acids in length to about 16 amino acids.

Of special interest of the present invention is antigenic peptide sequences derived from proteins of *Borrelia* bacteria. In the following *Borrelia* bacteria and their genes and proteins are described in more detail.

*Borrelia* Bacteria

The various species of *Borrelia* are known to humans in the form of Lyme disease and recurring fever, transmitted through tick or flea bite. The cycle of *Borrelia* through animals is related to the tick's life cycle. The tick has four stages in its two-year life cycle, egg, larva, nymph and adult. Between each stage the tick needs a blood meal in order to mature. The tick usually acquires the spirochaete during its larval stage, when it feeds on small animals such as rodents or birds. Usually the tick picks up *Borrelia* from the white-footed mouse, which is commonly infected. The tick then becomes the host for the spirochaete. The bacteria resides in the digestive tract of the host for its next nymph and adult stages during which it is passed on to other animals, and sometimes humans.

*Borrelia* Species

*Borrelia* is a genus of bacteria of the spirochete class. It is a zoonotic, vector-borne disease transmitted primarily by ticks and some by lice, depending on the species. There are at least 37 known species of *Borrelia*. Different species of *Borrelia* results in different clinical symptoms. Of the 37 known species of *Borrelia*, 12 of these species are known to cause Lyme disease or borreliosis and are transmitted by ticks. The major *Borrelia* species causing Lyme disease are *Borrelia burgdorferi*, *Borrelia afzelii*, *Borrelia garinii* and *Borrelia valaisiana*.

Other *Borrelia* species cause relapsing fever such as *Borrelia recurrentis*, caused by the human body louse. No animal reservoir of *B. recurrentis* exists. Lice that feed on infected humans acquire the *Borrelia* organisms that then multiply in the gut of the louse. When an infected louse feeds on an uninfected human, the organism gains access when the victim crushes the louse or scratches the area where the louse is feeding. *B. recurrentis* infects the person via mucous membranes and then invades the bloodstream.

Other tick-borne relapsing infections are acquired from other species, such as *Borrelia hermsii* or *Borrelia parkeri*, which can be spread from rodents, and serve as a reservoir for the infection, via a tick vector. *Borrelia hermsii* and *Borrelia recurrentis* cause very similar diseases although the disease associated with *Borrelia hermsii* has more relapses and is responsible for more fatalities, while the disease caused by *B. recurrentis* has longer febrile and afebrile intervals and a longer incubation period. The present invention relates in one embodiment to one or more antigenic peptides or one or more antigenic polypeptides or to MHC-peptide complexes or MHC multimers comprising one or more antigenic peptides comprising one or more sequences from one or more *Borrelia* species including the ones mentioned above.

*Borrelia burgdorferi*

In one preferred embodiment the invention relates to one or more antigenic peptides or antigenic polypeptides comprising one or more sequences from *Borrelia burgdorferi* such as *Borrelia burgdorferi* B31 or to one or more MHC-peptide complexes or MHC multimers comprising one or more such antigenic peptides.

*Borrelia burgdorferi* is species of bacteria of the spirochete class of the genus *Borrelia*. *B. burgdorferi* is predominant in North America, but also exists in Europe, and is the agent of Lyme disease.

It is a zoonotic, vector-borne disease transmitted by ticks and is named after the researcher Willy Burgdorfer who first isolated the bacterium in 1982. *B. burgdorferi* is one of the few pathogenic bacteria that can survive without iron, having replaced all of its iron-sulphur cluster enzymes with enzymes that use manganese, thus avoiding the problem many pathogenic bacteria face in acquiring iron. *B. burgdorferi* infections have been linked to non-Hodgkin lymphomas. The *B. burgdorferi* genome (B31 strain) contains 910,725 base pairs and 853 genes.

*Borrelia afzelii*

In one preferred embodiment the invention relates to one or more antigenic peptides or one or more antigenic polypeptides comprising one or more sequences from *Borrelia afzelii* such as *Borrelia afzelii* Pko or one or more MHC-peptide complexes or one or more MHC multimers comprising one or more such antigenic peptides.

*Borrelia afzelii* is considered a new species of the Genus *Borrelia* and considered homologous to *Borrelia burgdorferi* with regard to phenotypic, genetic, and immunological characteristics. Diseases linked to this species of *Borrelia* are Lyme disease and Acrodermatitis chronica atrophicans (ACA). Better understanding of the structure and function of this pathogen will create better methods of treatment to people with the diseases it causes.

*Borrelia garini*

In one preferred embodiment the invention relates to one or more antigenic peptides or one or more antigenic polypeptides comprising one or more sequences from *Borrelia garinii* such as *garinii* PBi or to one or more MHC-peptide complexes or MHC multimers comprising one or more such antigenic peptides.

*Borrelia garinii* is one of two major strains found in Europe. It usually causes Lyme Disease symptoms of the neurological kind—such as extreme back- and leg-pains, meningitis and partial facial paralysis, Lyme arthritis due to *B. garinii* may be associated in susceptible hosts with amoxicillin resistance or treatment resistance.

Other *Borrelia* Species

In one preferred embodiment the present invention relates to or to one or more antigenic peptides or antigenic polypeptides, wherein the sequence of one or more antigenic peptides is from *Borrelia* anserine, or to one or more MHC-peptide complexes or MHC multimers, comprising such antigenic peptides.

In one preferred embodiment the present invention relates to one or more antigenic peptides or antigenic polypeptides, wherein the sequence of one or more antigenic peptides or antigenic polypeptides is from *Borrelia barbouri*, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from the *Borrelia burgdorferi* group such as *burgdorferi* B31, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia afzelii* such as *Borrelia afzelii* ACA-1, *Borrelia afzelii* K78 and/or *Borrelia afzelii* PKo, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *afzelii* PKo, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia andersonii*, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia bissettii*, or to one or more MHC-peptide complexes or MHC multimers, comprising one or more such antigenic peptides.

In one preferred embodiment the present invention relates to one or more Antigenic peptides or antigenic polypeptides, wherein the sequence of one or more antigenic peptides or antigenic polypeptides is from *Borrelia burgdorferi* (Lyme disease spirochete), or to one or more MHC-peptide complexes or MHC multimers, comprising one or more such antigenic peptides.

In one preferred embodiment the present invention relates to one or more Antigenic peptides or antigenic polypeptides, wherein the sequence of one or more antigenic peptides or antigenic polypeptides is from *Borrelia burgdorferi* 118a, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia burgdorferi* 156a, or to one or more MHC-peptide complexes or MHC multimers, comprising one or more such antigenic peptides.

In one preferred embodiment the present invention relates to one or more Antigenic peptides or antigenic polypeptides, wherein the sequence of one or more antigenic peptides or antigenic polypeptides is from *Borrelia burgdorferi* 29805, or to one or more MHC-peptide complexes or MHC multimers, comprising one or more such antigenic peptides.

In one preferred embodiment the present invention relates to one or more Antigenic peptides or antigenic polypeptides, wherein the sequence of one or more antigenic peptides or antigenic polypeptides is from *Borrelia burgdorferi* 64b, or to one or more MHC-peptide complexes or MHC multimers, comprising one or more such antigenic peptides.

In one preferred embodiment the present invention relates to one or more Antigenic peptides or antigenic polypeptides, wherein the sequence of one or more antigenic peptides or antigenic polypeptides is from *Borrelia burgdorferi* 72a, or to one or more MHC-peptide complexes or MHC multimers, comprising one or more such antigenic peptides.

In one preferred embodiment the present invention relates to one or more Antigenic peptides or antigenic polypeptides, wherein the sequence of one or more antigenic peptides or antigenic polypeptides is from *Borrelia burgdorferi* 80a, or to one or more MHC-peptide complexes or MHC multimers, comprising one or more such antigenic In one preferred embodiment the present invention relates to one or more Antigenic peptides or antigenic polypeptides, wherein the sequence of one or more antigenic peptides or antigenic polypeptides is from *Borrelia burgdorferi* 94a, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia burgdorferi* B31, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia burgdorferi* Bol26, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia burgdorferi* CA-11.2a, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia burgdorferi* WI91-23, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia burgdorferi* ZS7, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia californiensis*, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia garinii* such as garinii PBi, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia garinii* PBr, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* genomosp. 1, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* genomosp. 2, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia japonica*, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia lusitaniae*, or to one or more MHC-peptide complexes of MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia spielmanii*, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia spielmanii* A14S, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia tanukii*, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia turdi*, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia valaisiana*, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia valaisiana* VS116, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from Candidatus *Borrelia texasensis*, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. AA4Pool, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. AI-1, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. B31, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. BC-1, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. CA1133, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. CA1176, or to one or more MHC-peptide complexes of MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. CA128, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. CA13, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. CA134, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. CA142, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. CA20, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. CA22, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. CA27, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. CA28, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. CA29, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. CA31, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. CA33, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. CA370, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. CA372, or to one or more MHC-peptide complexes of MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. CA378, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. CA388, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. CA393, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. CA394, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. CA395, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. CA399, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. CA400, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. CA401, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. CA402, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. CA404, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. CA411, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. CA426, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. CA443, or to one or more MHC-peptide complexes of MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. CA446, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. CA448, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. CA462, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. CA468, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. CA502, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. CA504, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. CA507, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. CA547, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. CA552, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. CA8, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. D22, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. D35, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. FD-1, or to one or more MHC-peptide complexes of MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. FL18, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. FL27, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. FL35, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. FL42, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. HN6, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. HN7, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. HN8, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. HNM13, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. HNM14, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. HNM19, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. IA1, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. Ir-3519, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. Ir-4721, or to one or more MHC-peptide complexes of MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. Ir-4812, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. Ir-5215, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. LV5, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. MI-2, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. MI-5, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. MI-6, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. MI-8, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. MI-9, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. MOD-1, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. MOD-5, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. MOK-3a, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. MOS-1b, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. NE49, or to one or more MHC-peptide complexes of MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. NE581, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. PHaP, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. PSigII, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. SCGT-10, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. SCGT-8a, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. SCI-2, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. SCW-30h, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. SI-1, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. SI-10, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. SM-1, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. SV1, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. W97F51, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. Z41293, or to one or more MHC-peptide complexes of MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. Z41493, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia coriaceae*, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia crocidurae*, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia duttonii*, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia duttonii* Ly, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia hermsii*, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia hermsii* DAH, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia hispanica*, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia lonestari*, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia miyamotoi*, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia parkeri*, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia persica*, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia recurrentis*, or to one or more MHC-peptide complexes of MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia recurrentis* A1, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia sinica*, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia theileri*, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia turcica*, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia turicatae*, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia turicatae* 91E135, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. 'Lake Gaillard', or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. 000133, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. 010298, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. 10MT, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. 5145, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. 57Nsk, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. 5MT, or to one or more MHC-peptide complexes of MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. 6T04-2, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. BR, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. BR 2007, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. C5-N52, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. CB-A1, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. CB-A11, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. CB-A3, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. EFL-S0100110, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. IK/23, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. IM/16, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. IM/19, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. KR1, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. KR3, or to one or more MHC-peptide complexes of MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. LB-2001, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. LB-M56, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. LB-W100, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. MK-N61, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. NR-N8, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. OkME1, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. PAnz, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. PJes, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. PMai, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. PMew, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. R57, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. strain Spain, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. TA1, or to one or more MHC-peptide complexes of MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. TM, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. TM1, or to one or more MHC-peptide complexes or MHC multimers, comprising one or more such antigenic peptides.

In one preferred embodiment the present invention relates to one or more antigenic peptides or antigenic polypeptides, wherein the sequence of one or more antigenic peptides or antigenic polypeptides is from *Borrelia* sp. TM2, or to one or more MHC-peptide complexes or MHC multimers, comprising one or more such antigenic peptides.

*Borrelia* Genome

All species of *Borrelia* have linear chromosomes ranging in size from 900,000 to 920,000 base pairs, with an accompaniment of circular and linear plasmids (some species contain up to 20 different plasmids). Between the linear chromosome and array of plasmids there is a high degree of redundancy in the genetic sequence. Although it has not been determined yet, it seems likely that the origin of replication of the main chromosome in species of *Borrelia* is almost exactly centered on the linear chromosome.

Some of the protein sequences from *Borrelia burgdorferi*, *Borrelia garinii* and *Borrelia afzelii* are homolog protein sequences. This means that the present invention in one embodiment relates to one or more antigenic peptides or antigenic polypeptides, wherein the one or more antigenic peptides or antigenic polypeptides are encoded by one or more of the *Borrelia* species *Borrelia burgdorferi*, *Borrelia garinii* and *Borrelia afzelii*, or to one or more MHC-peptide complexes or MHC multimers, comprising one or more such antigenic peptides.

In another embodiment the invention relates to one or more antigenic peptides or antigenic polypeptides, wherein the one or more antigenic peptides or antigenic polypeptides are encoded by *Borrelia burgdorferi* and not by *Borrelia garinii* or *Borrelia afzelii*, or to one or more MHC-peptide complexes or MHC multimers, comprising one or more such antigenic peptides.

In another embodiment the invention relates to one or more antigenic peptides or antigenic polypeptides, wherein the one or more antigenic peptides or antigenic polypeptides are encoded by *Borrelia garinii* and not by *Borrelia burgdorferi* or *Borrelia afzelii*, or to one or more MHC-peptide complexes or MHC multimers, comprising one or more such antigenic peptides.

In another embodiment the invention relates to one or more antigenic peptides or antigenic polypeptides, wherein the one or more antigenic peptides or antigenic polypeptides are encoded by *Borrelia afzelii* and not by *Borrelia garinii* or *Borrelia burgdorferi*, or to one or more MHC-peptide complexes or MHC multimers, comprising one or more such antigenic peptides.

The present invention relates in one embodiment to one or more antigenic peptides or antigenic polypeptides comprising a sequence encoded by a *Borrelia* genome and/or plasmid, or to one or more MHC-peptide complexes or MHC multimers, comprising one or more such antigenic peptides. The genomes and plasmids of *Borrelia burgdoferi* B31, *Borrelia afzelii* Pko and *Borrelia garinii* PBi are listed in FIG. 26-29. The peptides can e.g. be 8 mers, 9 mers, 10 mers, 11 mers, 12 mers, 13 mers, 14 mers, 15 mers or 16 mers.

In one preferred embodiment the present invention relates to one or more antigenic peptides or antigenic polypeptides comprising a sequence encoded by the genome (NC_001318) of *Borrelia burgdorferi* B31, or to one or more MHC-peptide complexes or MHC multimers, comprising one or more such antigenic peptides.

In one preferred embodiment the present invention relates to one or more antigenic peptides or antigenic polypeptides comprising a sequence encoded by the plasmid Ip5 (NC_000957) of *Borrelia burgdorferi* B31, or to one or more MHC-peptide complexes or MHC multimers, comprising one or more such antigenic peptides.

In one preferred embodiment the present invention relates to one or more antigenic peptides or antigenic polypeptides comprising a sequence encoded by the plasmid Ip 17 (NC_001849) of *Borrelia burgdorferi* B31, or to one or more MHC-peptide complexes or MHC multimers, comprising one or more such antigenic peptides.

In one preferred embodiment the present invention relates to one or more antigenic peptides or antigenic polypeptides comprising a sequence encoded by the plasmid Ip21 (NC_000955) of *Borrelia burgdorferi* B31, or to one or more MHC-peptide complexes or MHC multimers, comprising one or more such antigenic peptides.

In one preferred embodiment the present invention relates to one or more antigenic peptides or antigenic polypeptides comprising a sequence encoded by the plasmid Ip25 (NC_001850) of *Borrelia burgdorferi* B31, or to one or more MHC-peptide complexes or MHC multimers, comprising one or more such antigenic peptides.

In one preferred embodiment the present invention relates to one or more antigenic peptides or antigenic polypeptides comprising a sequence encoded by the plasmid Ip28-1 (NC_001851) of *Borrelia burgdorferi* B31, or to one or more MHC-peptide complexes or MHC multimers, comprising one or more such antigenic peptides.

In one preferred embodiment the present invention relates to one or more antigenic peptides or antigenic polypeptides comprising a sequence encoded by the plasmid Ip28-2 (NC_001852) of *Borrelia burgdorferi* B31, or to one or more MHC-peptide complexes or MHC multimers, comprising one or more such antigenic peptides.

In one preferred embodiment the present invention relates to one or more antigenic peptides or antigenic polypeptides comprising a sequence encoded by the plasmid Ip28-3 (NC_001853) of *Borrelia burgdorferi* B31, or to one or more MHC-peptide complexes or MHC multimers, comprising one or more such antigenic peptides.

In one preferred embodiment the present invention relates to one or more antigenic peptides or antigenic polypeptides comprising a sequence encoded by the plasmid lp28-4 (NC_001854) of *Borrelia burgdorferi* B31, or to one or more MHC-peptide complexes or MHC multimers, comprising one or more such antigenic peptides.

In one preferred embodiment the present invention relates to one or more antigenic peptides or antigenic polypeptides comprising a sequence encoded by the plasmid lp36 (NC_001855) of *Borrelia burgdorferi* B31, or to one or more MHC-peptide complexes or MHC multimers, comprising one or more such antigenic peptides.

In one preferred embodiment the present invention relates to one or more antigenic peptides or antigenic polypeptides comprising a sequence encoded by the plasmid lp38 (NC_001856) of *Borrelia burgdorferi* B31, or to one or more MHC-peptide complexes or MHC multimers, comprising one or more such antigenic peptides.

In one preferred embodiment the present invention relates to one or more antigenic peptides or antigenic polypeptides comprising a sequence encoded by the plasmid lp56 (NC_000956) of *Borrelia burgdorferi* B31, or to one or more MHC-peptide complexes or MHC multimers, comprising one or more such antigenic peptides.

In one preferred embodiment the present invention relates to one or more antigenic peptides or antigenic polypeptides comprising a sequence encoded by the plasmid cp9 (NC_001904) of *Borrelia burgdorferi* B31, or to one or more MHC-peptide complexes or MHC multimers, comprising one or more such antigenic peptides.

In one preferred embodiment the present invention relates to one or more antigenic peptides or antigenic polypeptides comprising a sequence encoded by the plasmid lp28-4 (NC_001854) of *Borrelia burgdorferi* B31, or to one or more MHC-peptide complexes or MHC multimers, comprising one or more such antigenic peptides.

In one preferred embodiment the present invention relates to one or more antigenic peptides or antigenic polypeptides comprising a sequence encoded by the plasmid cp26 (NC_001903) of *Borrelia burgdorferi* B31, or to one or more MHC-peptide complexes or MHC multimers, comprising one or more such antigenic peptides.

In one preferred embodiment the present invention relates to one or more antigenic peptides or antigenic polypeptides comprising a sequence encoded by the plasmid cp32-1 (NC_000948) of *Borrelia burgdorferi* B31, or to one or more MHC-peptide complexes or MHC multimers, comprising one or more such antigenic peptides.

In one preferred embodiment the present invention relates to one or more antigenic peptides or antigenic polypeptides comprising a sequence encoded by the plasmid cp32-3 (NC_000949) of *Borrelia burgdorferi* B31, or to one or more MHC-peptide complexes or MHC multimers, comprising one or more such antigenic peptides.

In one preferred embodiment the present invention relates to one or more antigenic peptides or antigenic polypeptides comprising a sequence encoded by the plasmid cp32-4 (NC_000950) of *Borrelia burgdorferi* B31, or to one or more MHC-peptide complexes or MHC multimers, comprising one or more such antigenic peptides.

In one preferred embodiment the present invention relates to one or more antigenic peptides or antigenic polypeptides comprising a sequence encoded by the plasmid cp32-6 (NC_000951) of *Borrelia burgdorferi* B31, or to one or more MHC-peptide complexes or MHC multimers, comprising one or more such antigenic peptides.

In one preferred embodiment the present invention relates to one or more antigenic peptides or antigenic polypeptides comprising a sequence encoded by the plasmid cp32-7 (NC_000952) of *Borrelia burgdorferi* B31, or to one or more MHC-peptide complexes or MHC multimers, comprising one or more such antigenic peptides.

In one preferred embodiment the present invention relates to one or more antigenic peptides or antigenic polypeptides comprising a sequence encoded by the plasmid cp32-8 (NC_000953) of *Borrelia burgdorferi* B31, or to one or more MHC-peptide complexes or MHC multimers, comprising one or more such antigenic peptides.

In one preferred embodiment the present invention relates to one or more antigenic peptides or antigenic polypeptides comprising a sequence encoded by the plasmid cp32-9 (NC_000954) of *Borrelia burgdorferi* B31, or to one or more MHC-peptide complexes or MHC multimers, comprising one or more such antigenic peptides.

In one preferred embodiment the present invention relates to one or more antigenic peptides or antigenic polypeptides comprising a sequence encoded by the genome (NC_008277) of *Borrelia afzelii* PKo, or to one or more MHC-peptide complexes or MHC multimers, comprising one or more such antigenic peptides.

In one preferred embodiment the present invention relates to one or more antigenic peptides or antigenic polypeptides comprising a sequence encoded by the plasmid lp25 (NC_008569) of *Borrelia afzelii* PKo, or to one or more MHC-peptide complexes or MHC multimers, comprising one or more such antigenic peptides.

In one preferred embodiment the present invention relates to one or more antigenic peptides or antigenic polypeptides comprising a sequence encoded by the plasmid lp28 (NC_0085698) of *Borrelia afzelii* PKo, or to one or more MHC-peptide complexes or MHC multimers, comprising one or more such antigenic peptides.

In one preferred embodiment the present invention relates to one or more antigenic peptides or antigenic polypeptides comprising a sequence encoded by the plasmid lp32 (NC_008567) of *Borrelia afzelii* PKo, or to one or more MHC-peptide complexes or MHC multimers, comprising one or more such antigenic peptides.

In one preferred embodiment the present invention relates to one or more antigenic peptides or antigenic polypeptides comprising a sequence encoded by the plasmid lp34 (NC_008566) of *Borrelia afzelii* PKo, or to one or more MHC-peptide complexes or MHC multimers, comprising one or more such antigenic peptides.

In one preferred embodiment the present invention relates to one or more antigenic peptides or antigenic polypeptides comprising a sequence encoded by the plasmid lp60 (NC_008564) of *Borrelia afzelii* PKo, or to one or more MHC-peptide complexes or MHC multimers, comprising one or more such antigenic peptides.

In one preferred embodiment the present invention relates to one or more antigenic peptides or antigenic polypeptides comprising a sequence encoded by the plasmid lp60-2 (NC_008565) of *Borrelia afzelii* PKo, or to one or more MHC-peptide complexes or MHC multimers, comprising one or more such antigenic peptides.

In one preferred embodiment the present invention relates to one or more antigenic peptides or antigenic polypeptides comprising a sequence encoded by the plasmid cp27 (NC_008274) of *Borrelia afzelii* PKo, or to one or more MHC-peptide complexes or MHC multimers, comprising one or more such antigenic peptides.

In one preferred embodiment the present invention relates to one or more antigenic peptides or antigenic polypeptides comprising a sequence encoded by the plasmid cp30 (NC_008273) of *Borrelia afzelii* PKo, or to one or more MHC-peptide complexes or MHC multimers, comprising one or more such antigenic peptides.

In one preferred embodiment the present invention relates to one or more antigenic peptides or antigenic polypeptides comprising a sequence encoded by the genome (NC_006156) of *Borrelia garinii* PBi, or to one or more MHC-peptide complexes or MHC multimers, comprising one or more such antigenic peptides.

In one preferred embodiment the present invention relates to one or more antigenic peptides or antigenic polypeptides comprising a sequence encoded by the plasmid Ip54 (NC_006129) of *Borrelia garinii* PBi, or to one or more MHC-peptide complexes or MHC multimers, comprising one or more such antigenic peptides.

In one preferred embodiment the present invention relates to one or more antigenic peptides or antigenic polypeptides comprising a sequence encoded by the plasmid cp26 (NC_006128) of *Borrelia garinii* PBi, or to one or more MHC-peptide complexes or MHC multimers, comprising one or more such antigenic peptides.

In another preferred embodiment the present invention relates to one or more antigenic peptides or antigenic polypeptides comprising a sequence encoded by variable plasmid segments not finally assembled to whole plasmids of *Borrelia garinii* PBi, or to one or more MHC-peptide complexes or MHC multimers, comprising one or more such antigenic peptides. These variable plasmid segments not finally assembled to whole plasmids can in one preferred embodiment be selected from the group consisting of NT_108239, NT_108263, NT_108262, NT_108261, NT_108260, NT_108259, NT_108258, NT_108257, NT_108256, NT_108255, NT_108254, NT_108253 NT_108252, NT_108251, NT_108250, NT_108249, NT_108248, NT_108247, NT_108246, NT_108245, NT_108244, NT_108243, NT_108242, NT_108241, NT_108240, NT_108238, NT_108237, NT_108236, NT_108235, NT_108234, NT_108233, NT_108232, NT_108231, NT_108230, NT_108229, NT_108228 and NT_108227.

In yet another embodiment the present invention relates to one or more antigenic peptides or antigenic polypeptides, optionally comprised in one or more MHC-peptide complexes or MHC multimers, where the antigenic peptides or antigenic polypeptides comprise a sequence encoded by a *Borrelia* genome and/or plasmid from one or more of the *Borrelia* species or subspecies: *Borrelia anserina*, *Borrelia barbouri*, *Borrelia afzelii*, *Borrelia afzelii* ACA-1, *Borrelia afzelii* K78, *Borrelia afzelii* PKo, *Borrelia andersonii*, *Borrelia bissettii*, *Borrelia burgdorferi*, *Borrelia burgdorferi* 118a, *Borrelia burgdorferi* 156a, *Borrelia burgdorferi* 29805, *Borrelia burgdorferi* 64b, *Borrelia burgdorferi* 72a, *Borrelia burgdorferi* 80a, *Borrelia burgdorferi* 94a, *Borrelia burgdorferi* B31, *Borrelia burgdorferi* Bo126, *Borrelia burgdorferi* CA-11.2a, *Borrelia burgdorferi* WI91-23, *Borrelia burgdorferi* ZS7, *Borrelia californiensis*, *Borrelia garinii*, *Borrelia garinii* PBi, *Borrelia garinii* PBr, *Borrelia* genomosp. 1, *Borrelia* genomosp. 2, *Borrelia japonica*, *Borrelia lusitaniae*, *Borrelia spielmanii*, *Borrelia spielmanii* A14S, *Borrelia tanukii*, *Borrelia turdi*, *Borrelia valaisiana*, *Borrelia valaisiana* VS116, Candidatus *Borrelia texasensis*, *Borrelia* sp. AA4Pool, *Borrelia* sp. AI-1, *Borrelia* sp. B31, *Borrelia* sp. BC-1, *Borrelia* sp. CA1133, *Borrelia* sp. CA1176, *Borrelia* sp. CA128, *Borrelia* sp. CA13, *Borrelia* sp. CA134, *Borrelia* sp. CA142, *Borrelia* sp. CA20, *Borrelia* sp. CA27, *Borrelia* sp. CA28, *Borrelia* sp. CA29, *Borrelia* sp. CA31, *Borrelia* sp. CA33, *Borrelia* sp. CA370, *Borrelia* sp. CA372, *Borrelia* sp. CA378, *Borrelia* sp. CA388, *Borrelia* sp. CA393, *Borrelia* sp. CA394, *Borrelia* sp. CA395, *Borrelia* sp. CA399, *Borrelia* sp. CA400, *Borrelia* sp. CA401, *Borrelia* sp. CA402, *Borrelia* sp. CA404, *Borrelia* sp. CA411, *Borrelia* sp. CA426, *Borrelia* sp. CA443, *Borrelia* sp. CA446, *Borrelia* sp. CA448, *Borrelia* sp. CA462, *Borrelia* sp. CA468, *Borrelia* sp. CA502, *Borrelia* sp. CA504, *Borrelia* sp. CA507, *Borrelia* sp. CA547, *Borrelia* sp. CA552, *Borrelia* sp. CA8, *Borrelia* sp. D22, *Borrelia* sp. D35, *Borrelia* sp. FD-1, *Borrelia* sp. FL18, *Borrelia* sp. FL27, *Borrelia* sp. FL35, *Borrelia* sp. FL42, *Borrelia* sp. HN6, *Borrelia* sp. HN7, *Borrelia* sp. HN8, *Borrelia* sp. HNM13, *Borrelia* sp. HNM14, *Borrelia* sp. HNM19, *Borrelia* sp. IA1, *Borrelia* sp. Ir-3519, *Borrelia* sp. Ir-4721, *Borrelia* sp. Ir-4812, *Borrelia* sp. Ir-5215, *Borrelia* sp. LV5, *Borrelia* sp. MI-2, *Borrelia* sp. MI-5, *Borrelia* sp. MI-6, *Borrelia* sp. MI-8, *Borrelia* sp. MI-9, *Borrelia* sp. MOD-1, *Borrelia* sp. MOD-5, *Borrelia* sp. MOK-3a, *Borrelia* sp. MOS-1b, *Borrelia* sp. NE49, *Borrelia* sp. NE581, *Borrelia* sp. PHaP, *Borrelia* sp. PSigII, *Borrelia* sp. SCGT-10, *Borrelia* sp. SCGT-8a, *Borrelia* sp. SCI-2, *Borrelia* sp. SCW-30h, *Borrelia* sp. SI-1, *Borrelia* sp. SI-10, *Borrelia* sp. SM-1, *Borrelia* sp. SV1, *Borrelia* sp. W97F51, *Borrelia* sp. Z41293, *Borrelia* sp. Z41493, *Borrelia coriaceae*, *Borrelia crocidurae*, *Borrelia duttonii*, *Borrelia duttonii* Ly, *Borrelia hermsii*, *Borrelia hermsii* DAH, *Borrelia hispanica*, *Borrelia lonestari*, *Borrelia miyamotoi*, *Borrelia parkeri*, *Borrelia persica*, *Borrelia recurrentis*, *Borrelia recurrentis* A1, *Borrelia sinica*, *Borrelia theileri*, *Borrelia turcica*, *Borrelia turicatae*, *Borrelia turicatae* 91E135, *Borrelia* sp., *Borrelia* sp. 'Lake Gaillard', *Borrelia* sp. 000133, *Borrelia* sp. 010298, *Borrelia* sp. 10MT, *Borrelia* sp. 5145, *Borrelia* sp. 57Nsk, *Borrelia* sp. 5MT, *Borrelia* sp. 6T04-2, *Borrelia* sp. BR, *Borrelia* sp. BR 2007, *Borrelia* sp. C5-N52, *Borrelia* sp. CB-A1, *Borrelia* sp. CB-A11, *Borrelia* sp. CB-A3, *Borrelia* sp. EFL-S0100110, *Borrelia* sp. IK/23, *Borrelia* sp. IM/16, *Borrelia* sp. IM/19, *Borrelia* sp. KR1, *Borrelia* sp. KR3, *Borrelia* sp. LB-2001, *Borrelia* sp. LB-M56, *Borrelia* sp. LB-W100, *Borrelia* sp. MK-N61, *Borrelia* sp. NR-N8, *Borrelia* sp. OkME1, *Borrelia* sp. PAnz, *Borrelia* sp. PJes, *Borrelia* sp. PMai, *Borrelia* sp. PMew, *Borrelia* sp. R57, *Borrelia* sp. strain Spain, *Borrelia* sp. TA1, *Borrelia* sp. TM, *Borrelia* sp. TM1 and *Borrelia* sp. TM2. These peptides can e.g. be 8 mers, 9 mers, 10 mers, 11 mers, 12 mers, 13 mers, 14 mers, 15 mers or 16 mers.

*Borrelia* Proteome

In another preferred embodiment the present invention relates to one or more antigenic peptides or antigenic polypeptides comprising a fragment of the sequence from one or more proteins from *Borrelia bulgdorferi* B31, or to one or more MHC-peptide complexes or MHC multimers, comprising one or more such antigenic peptides. The one or more proteins can be selected from the proteins listed in FIG. 27 and FIG. 38. These fragments can e.g. be 8 mers, 9 mers, 10 mers, 11 mers, 12 mers, 13 mers, 14 mers, 15 mers or 16 mers.

In another preferred embodiment the present invention relates to one or more antigenic peptides or antigenic polypeptides comprising a fragment of the sequence from one or more proteins from *Borrelia afzelii* Pko, or to one or more MHC-peptide complexes or MHC multimers, comprising one or more such antigenic peptides. The one or more proteins can be selected from the proteins listed in FIG. 28 and FIG. 38. These fragments can e.g. be 8 mers, 9 mers, 10 mers, 11 mers, 12 mers, 13 mers, 14 mers, 15 mers or 16 mers.

In another preferred embodiment the present invention relates to one or more antigenic peptides or antigenic polypeptides comprising a fragment of the sequence from one or more proteins from *Borrelia garinii* PBi, or to one or more MHC-peptide complexes or MHC multimers, comprising one or more such antigenic peptides. The one or more proteins can be selected from the proteins listed in FIG. 29 and FIG. 38. These fragments can e.g. be 8 mers, 9 mers, 10 mers, 11 mers, 12 mers, 13 mers, 14 mers, 15 mers or 16 mers.

In another preferred embodiment the present invention relates to one or more antigenic peptides or antigenic polypeptides comprising a fragment of the sequence from one or more proteins listed in FIG. 30 and FIG. 38, or to one or more MHC-peptide complexes or MHC multimers, comprising one or more such antigenic peptides. These fragments can e.g. be 8 mers, 9 mers, 10 mers, 11 mers, 12 mers, 13 mers, 14 mers, 15 mers or 16 mers.

In yet another preferred embodiment the present invention relates to one or more antigenic peptides or antigenic polypeptides or MHC-peptide complexes containing such antigenic peptides, where the antigenic peptides or antigenic polypeptides comprise a fragment of the sequence from one or more protein(s) from one or more of the *Borrelia* species or subspecies: *Borrelia anserina*, *Borrelia barbouri*, *Borrelia afzelii*, *Borrelia afzelii* ACA-1, *Borrelia afzelii* K78, *Borrelia afzelii* PKo, *Borrelia andersonii*, *Borrelia bissettii*, *Borrelia burgdorferi*, *Borrelia burgdorferi* 118a, *Borrelia burgdorferi* 156a, *Borrelia burgdorferi* 29805, *Borrelia burgdorferi* 64b, *Borrelia burgdorferi* 72a, *Borrelia burgdorferi* 80a, *Borrelia burgdorferi* 94a, *Borrelia burgdorferi* B31, *Borrelia burgdorferi* Bo126, *Borrelia burgdorferi* CA-11.2a, *Borrelia burgdorferi* W191-23, *Borrelia burgdorferi* ZS7, *Borrelia californiensis*, *Borrelia garinii*, *Borrelia garinii* PBi, *Borrelia garinii* PBr, *Borrelia* genomosp. 1, *Borrelia* genomosp. 2, *Borrelia japonica*, *Borrelia lusitaniae*, *Borrelia spielmanii*, *Borrelia spielmanii* A14S, *Borrelia tanukii*, *Borrelia turdi*, *Borrelia valaisiana*, *Borrelia valaisiana* VS116, Candidatus *Borrelia texasensis*, *Borrelia* sp. AA4Pool, *Borrelia* sp. AI-1, *Borrelia* sp. B31, *Borrelia* sp. BC-1, *Borrelia* sp. CA1133, *Borrelia* sp. CA1176, *Borrelia* sp. CA128, *Borrelia* sp. CA13, *Borrelia* sp. CA134, *Borrelia* sp. CA142, *Borrelia* sp. CA20, *Borrelia* sp. CA22, *Borrelia* sp. CA27, *Borrelia* sp. CA28, *Borrelia* sp. CA29, *Borrelia* sp. CA31, *Borrelia* sp. CA33, *Borrelia* sp. CA370, *Borrelia* sp. CA372, *Borrelia* sp. CA378, *Borrelia* sp. CA388, *Borrelia* sp. CA393, *Borrelia* sp. CA394, *Borrelia* sp. CA395, *Borrelia* sp. CA399, *Borrelia* sp. CA400, *Borrelia* sp. CA401, *Borrelia* sp. CA402, *Borrelia* sp. CA404, *Borrelia* sp. CA411, *Borrelia* sp. CA426, *Borrelia* sp. CA443, *Borrelia* sp. CA446, *Borrelia* sp. CA448, *Borrelia* sp. CA462, *Borrelia* sp. CA468, *Borrelia* sp. CA502, *Borrelia* sp. CA504, *Borrelia* sp. CA507, *Borrelia* sp. CA547, *Borrelia* sp. CA552, *Borrelia* sp. CA8, *Borrelia* sp. D22, *Borrelia* sp. D35, *Borrelia* sp. FD-1, *Borrelia* sp. FL18, *Borrelia* sp. FL27, *Borrelia* sp. FL35, *Borrelia* sp. FL42, *Borrelia* sp. HN6, *Borrelia* sp. HN7, *Borrelia* sp. HN8, *Borrelia* sp. HNM13, *Borrelia* sp. HNM14, *Borrelia* sp. HNM19, *Borrelia* sp. IA1, *Borrelia* sp. Ir-3519, *Borrelia* sp. Ir-4721, *Borrelia* sp. Ir-4812, *Borrelia* sp. Ir-5215, *Borrelia* sp. LV5, *Borrelia* sp. MI-2, *Borrelia* sp. MI-5, *Borrelia* sp. MI-6, *Borrelia* sp. MI-8, *Borrelia* sp. MI-9, *Borrelia* sp. MOD-1, *Borrelia* sp. MOD-5, *Borrelia* sp. MOK-3a, *Borrelia* sp. MOS-1b, *Borrelia* sp. NE49, *Borrelia* sp. NE581, *Borrelia* sp. PHaP, *Borrelia* sp. PSigII, *Borrelia* sp. SCGT-10, *Borrelia* sp. SCGT-8a, *Borrelia* sp. SCI-2, *Borrelia* sp. SCW-30h, *Borrelia* sp. SI-1, *Borrelia* sp. SI-10, *Borrelia* sp. SM-1, *Borrelia* sp. SV1, *Borrelia* sp. W97F51, *Borrelia* sp. Z41293, *Borrelia* sp. Z41493, *Borrelia coriaceae*, *Borrelia crocidurae*, *Borrelia duttonii*, *Borrelia duttonii* Ly, *Borrelia hermsii*, *Borrelia hermsii* DAH, *Borrelia hispanica*, *Borrelia lonestari*, *Borrelia miyamotoi*, *Borrelia parkeri*, *Borrelia persica*, *Borrelia recurrentis*, *Borrelia recurrentis* A1, *Borrelia sinica*, *Borrelia theileri*, *Borrelia turcica*, *Borrelia turicatae*, *Borrelia turicatae* 91E135, *Borrelia* sp., *Borrelia* sp. 'Lake Gaillard', *Borrelia* sp. 000133, *Borrelia* sp. 010298, *Borrelia* sp. 10MT, *Borrelia* sp. 5145, *Borrelia* sp. 57Nsk, *Borrelia* sp. 5MT, *Borrelia* sp. 6T04-2, *Borrelia* sp. BR, *Borrelia* sp. BR 2007, *Borrelia* sp. C5-N52, *Borrelia* sp. CB-A1, *Borrelia* sp. CB-A11, *Borrelia* sp. CB-A3, *Borrelia* sp. EFL-S0100110, *Borrelia* sp. IK/23, *Borrelia* sp. IM/16, *Borrelia* sp. IM/19, *Borrelia* sp. KR1, *Borrelia* sp. KR3, *Borrelia* sp. LB-2001, *Borrelia* sp. LB-M56, *Borrelia* sp. LB-W100, *Borrelia* sp. MK-N61, *Borrelia* sp. NR-N8, *Borrelia* sp. OkME1, *Borrelia* sp. PAnz, *Borrelia* sp. PJes, *Borrelia* sp. PMai, *Borrelia* sp. PMew, *Borrelia* sp. R57, *Borrelia* sp. strain Spain, *Borrelia* sp. TA1, *Borrelia* sp. TM, *Borrelia* sp. TM1 and *Borrelia* sp. TM2. These peptides can e.g. be 8 mers, 9 mers, 10 mers, 11 mers, 12 mers, 13 mers, 14 mers, 15 mers or 16 mers.

*Borrelia* Class I Antigen Peptide Fragments

In one preferred embodiment the present invention relates to one or more MHC-peptide complexes or MHC multimers comprising one or more *Borrelia* class I antigen peptide fragments or to the *Borrelia* class I antigen peptide fragments themselves.

In one preferred embodiment the present invention relates to one or more MHC-peptide complexes or MHC multimers comprising one or more *Borrelia* class I antigen peptide fragments, wherein said peptide fragments are 8 mers, 9 mers, 10 mers and/or 11 mers.

In one preferred embodiment the present invention relates to one or more antigenic peptides or antigenic polypeptides being *Borrelia* class I antigen peptide fragments, wherein said peptide fragments are 8 mers, 9 mers, 10 mers and/or 11 mers.

In one preferred embodiment the present invention relates to one or more MHC-peptide complexes or MHC multimers comprising one or more *Borrelia* class I antigen peptide fragments or to the *Borrelia* class I antigenic peptide fragments themselves, wherein said peptide fragments are 8 mers, 9 mers, 10 mers and/or 11 mers of a protein from or encoded by *Borrelia burgdorferi* such as *Borrelia burgdorferi* B31.

In one preferred embodiment the present invention relates to one or more MHC-peptide complexes or MHC multimers comprising one or more *Borrelia* class I antigen peptide fragments or to the *Borrelia* class I antigenic peptide fragments themselves, wherein said peptide fragments are 8 mers, 9 mers, 10 mers and/or 11 mers of a protein from or encoded by *Borrelia afzelii* such as *Borrelia afzelii* PKo.

In one preferred embodiment the present invention relates to one or more MHC-peptide complexes or MHC multimers comprising one or more *Borrelia* class I antigen peptide fragments or to the *Borrelia* class I antigenic peptide fragments themselves, wherein said peptide fragments are 8 mers, 9 mers, 10 mers and/or 11 mers of a protein from or encoded by *Borrelia garinii* such as *Borrelia garinii* PBi.

In one preferred embodiment the present invention relates to one or more MHC-peptide complexes or MHC multimers comprising one or more *Borrelia* class I antigen peptide fragments or to the *Borrelia* class I antigenic peptide fragments themselves, wherein said peptide fragments are 8 mers, 9 mers, 10 mers and/or 11 mers of a protein from or encoded by *Borrelia anserina*, *Borrelia barbouri*, *Borrelia afzelii*, *Borrelia afzelii* ACA-1, *Borrelia afzelii* K78, *Bor*- relia afzelii PKo, Borrelia andersonii, Borrelia bissettii, Borrelia burgdorferi, Borrelia burgdorferi 118a, Borrelia burgdorferi 156a, Borrelia burgdorferi 29805, Borrelia burgdorferi 64b, Borrelia burgdorferi 72a, Borrelia burgdorferi 80a, Borrelia burgdorferi 94a, Borrelia burgdorferi B31, Borrelia burgdorferi Bo126, Borrelia burgdorferi CA-11.2a, Borrelia burgdorferi W191-23, Borrelia burgdorferi ZS7, Borrelia californiensis, Borrelia garinii, Borrelia garinii PBi, Borrelia garinii PBr, Borrelia genomosp. 1, Borrelia genomosp. 2, Borrelia japonica, Borrelia lusitaniae, Borrelia spielmanii, Borrelia spielmanii A14S, Borrelia tanukii, Borrelia turdi, Borrelia valaisiana, Borrelia valaisiana VS116, Candidatus Borrelia texasensis, Borrelia sp. AA4Pool, Borrelia sp. AI-1, Borrelia sp. B31, Borrelia sp. BC-1, Borrelia sp. CA1133, Borrelia sp. CA1176, Borrelia sp. CA128, Borrelia sp. CA13, Borrelia sp. CA134, Borrelia sp. CA142, Borrelia sp. CA20, Borrelia sp. CA22, Borrelia sp. CA27, Borrelia sp. CA28, Borrelia sp. CA29, Borrelia sp. CA31, Borrelia sp. CA33, Borrelia sp. CA370, Borrelia sp. CA372, Borrelia sp. CA378, Borrelia sp. CA388, Borrelia sp. CA393, Borrelia sp. CA394, Borrelia sp. CA395, Borrelia sp. CA399, Borrelia sp. CA400, Borrelia sp. CA401, Borrelia sp. CA402, Borrelia sp. CA404, Borrelia sp. CA411, Borrelia sp. CA426, Borrelia sp. CA443, Borrelia sp. CA446, Borrelia sp. CA448, Borrelia sp. CA462, Borrelia sp. CA468, Borrelia sp. CA502, Borrelia sp. CA504, Borrelia sp. CA507, Borrelia sp. CA547, Borrelia sp. CA552, Borrelia sp. CA8, Borrelia sp. D22, Borrelia sp. D35, Borrelia sp. FD-1, Borrelia sp. FL18, Borrelia sp. FL27, Borrelia sp. FL35, Borrelia sp. FL42, Borrelia sp. HN6, Borrelia sp. HN7, Borrelia sp. HN8, Borrelia sp. HNM13, Borrelia sp. HNM14, Borrelia sp. HNM19, Borrelia sp. IA1, Borrelia sp. Ir-3519, Borrelia sp. Ir-4721, Borrelia sp. Ir-4812, Borrelia sp. Ir-5215, Borrelia sp. LV5, Borrelia sp. MI-2, Borrelia sp. MI-5, Borrelia sp. MI-6, Borrelia sp. MI-8, Borrelia sp. MI-9, Borrelia sp. MOD-1, Borrelia sp. MOD-5, Borrelia sp. MOK-3a, Borrelia sp. MOS-1b, Borrelia sp. NE49, Borrelia sp. NE581, Borrelia sp. PHaP, Borrelia sp. PSigII, Borrelia sp. SCGT-10, Borrelia sp. SCGT-8a, Borrelia sp. SCI-2, Borrelia sp. SCW-30h, Borrelia sp. SI-1, Borrelia sp. SI-10, Borrelia sp. SM-1, Borrelia sp. SV1, Borrelia sp. W97F51, Borrelia sp. Z41293, Borrelia sp. Z41493, Borrelia coriaceae, Borrelia crocidurae, Borrelia duttonii, Borrelia duttonii Ly, Borrelia hermsii, Borrelia hermsii DAH, Borrelia hispanica, Borrelia lonestari, Borrelia miyamotoi, Borrelia parkeri, Borrelia persica, Borrelia recurrentis, Borrelia recurrentis A1, Borrelia sinica, Borrelia theileri, Borrelia turcica, Borrelia turicatae, Borrelia turicatae 91E135, Borrelia sp., Borrelia sp. 'Lake Gaillard', Borrelia sp. 000133, Borrelia sp. 010298, Borrelia sp. 10MT, Borrelia sp. 5145, Borrelia sp. 57Nsk, Borrelia sp. 5MT, Borrelia sp. 6T04-2, Borrelia sp. BR, Borrelia sp. BR 2007, Borrelia sp. C5-N52, Borrelia sp. CB-A1, Borrelia sp. CB-A11, Borrelia sp. CB-A3, Borrelia sp. EFL-S0100110, Borrelia sp. IK/23, Borrelia sp. IM/16, Borrelia sp. IM/19, Borrelia sp. KR1, Borrelia sp. KR3, Borrelia sp. LB-2001, Borrelia sp. LB-M56, Borrelia sp. LB-W100, Borrelia sp. MK-N61, Borrelia sp. NR-N8, Borrelia sp. OkME1, Borrelia sp. PAnz, Borrelia sp. PJes, Borrelia sp. PMai, Borrelia sp. PMew, Borrelia sp. R57, Borrelia sp. strain Spain, Borrelia sp. TA1, Borrelia sp. TM, Borrelia sp. TM1 and/or Borrelia sp. TM2.

In another preferred embodiment the present invention relates to one or more MHC-peptide complexes or MHC multimers comprising one or more Borrelia class I antigen peptide fragments or to the Borrelia class I antigenic peptide fragments themselves, where the peptide fragments are selected from the peptides listed in FIG. 31, FIG. 32, FIG. 39, FIG. 40, FIG. 41, FIG. 42, Table A, Table B and Table C.

Borrelia Class II Antigen Peptide Fragments

In one preferred embodiment the present invention relates to one or more MHC-peptide complexes or MHC multimers comprising one or more Borrelia class II antigen peptide fragments, or to the Borrelia class II antigen peptide fragments themselves.

In one preferred embodiment the present invention relates to one or more MHC-peptide complexes or MHC multimers comprising one or more Borrelia class II antigen peptide fragments, or to the Borrelia class II antigen peptide fragments themselves, wherein said peptide fragments are 13 mers, 14 mers, 15 mers and/or 16 mers.

In one preferred embodiment the present invention relates to one or more MHC-peptide complexes or MHC multimers comprising one or more Borrelia class II antigen peptide fragments, or to the Borrelia class II antigen peptide fragments themselves, wherein said peptide fragments are 13 mers, 14 mers, 15 mers and/or 16 mers of a protein from or encoded by Borrelia burgdorferi such as Borrelia burgdorferi B31.

In one preferred embodiment the present invention relates to one or more MHC-peptide complexes or MHC multimers comprising one or more Borrelia class II antigen peptide fragments, or to the Borrelia class II antigen peptide fragments themselves, wherein said peptide fragments are 13 mers, 14 mers, 15 mers and/or 16 mers of a protein from or encoded by Borrelia afzelii such as Borrelia afzelii PKo.

In one preferred embodiment the present invention relates to one or more MHC-peptide complexes or MHC multimers comprising one or more Borrelia class II antigen peptide fragments, or to the Borrelia class II antigen peptide fragments themselves, wherein said peptide fragments are 13 mers, 14 mers, 15 mers and/or 16 mers of a protein from or encoded by Borrelia garinii such as Borrelia garinii PBi.

In one preferred embodiment the present invention relates to one or more MHC-peptide complexes or MHC multimers comprising one or more Borrelia class II antigen peptide fragments, or to the Borrelia class II antigen peptide fragments themselves, wherein said peptide fragments are 13 mers, 14 mers, 15 mers and/or 16 mers of a protein from or encoded by Borrelia anserina, Borrelia barbouri, Borrelia afzelii, Borrelia afzelii ACA-1, Borrelia afzelii K78, Borrelia afzelii PKo, Borrelia andersonii, Borrelia bissettii, Borrelia burgdorferi, Borrelia burgdorferi 118a, Borrelia burgdorferi 156a, Borrelia burgdorferi 29805, Borrelia burgdorferi 64b, Borrelia burgdorferi 72a, Borrelia burgdorferi 80a, Borrelia burgdorferi 94a, Borrelia burgdorferi B31, Borrelia burgdorferi Bo126, Borrelia burgdorferi CA-11.2a, Borrelia burgdorferi W191-23, Borrelia burgdorferi ZS7, Borrelia californiensis, Borrelia garinii, Borrelia garinii PBi, Borrelia garinii PBr, Borrelia genomosp. 1, Borrelia genomosp. 2, Borrelia japonica, Borrelia lusitaniae, Borrelia spielmanii, Borrelia spielmanii A14S, Borrelia tanukii, Borrelia turdi, Borrelia valaisiana, Borrelia valaisiana VS116, Candidatus Borrelia texasensis, Borrelia sp. AA4Pool, Borrelia sp. AI-1, Borrelia sp. B31, Borrelia sp. BC-1, Borrelia sp. CA1133, Borrelia sp. CA1176, Borrelia sp. CA128, Borrelia sp. CA13, Borrelia sp. CA134, Borrelia sp. CA142, Borrelia sp. CA20, Borrelia sp. CA22, Borrelia sp. CA27, Borrelia sp. CA28, Borrelia sp. CA29, Borrelia sp. CA31, Borrelia sp. CA33, Borrelia sp. CA370, Borrelia sp. CA372, Borrelia sp. CA378, Borrelia sp. CA388, Borrelia sp. CA393, Borrelia sp. CA394, Borrelia sp. CA395, Borrelia sp. CA399, Borrelia sp. CA400, Borrelia sp. CA401, *Borrelia* sp. CA402, *Borrelia* sp. CA404, *Borrelia* sp. CA411, *Borrelia* sp. CA426, *Borrelia* sp. CA443, *Borrelia* sp. CA446, *Borrelia* sp. CA448, *Borrelia* sp. CA462, *Borrelia* sp. CA468, *Borrelia* sp. CA502, *Borrelia* sp. CA504, *Borrelia* sp. CA507, *Borrelia* sp. CA547, *Borrelia* sp. CA552, *Borrelia* sp. CA8, *Borrelia* sp. D22, *Borrelia* sp. D35, *Borrelia* sp. FD-1, *Borrelia* sp. FL18, *Borrelia* sp. FL27, *Borrelia* sp. FL35, *Borrelia* sp. FL42, *Borrelia* sp. HN6, *Borrelia* sp. HN7, *Borrelia* sp. HN8, *Borrelia* sp. HNM13, *Borrelia* sp. HNM14, *Borrelia* sp. HNM19, *Borrelia* sp. IA1, *Borrelia* sp. Ir-3519, *Borrelia* sp. Ir-4721, *Borrelia* sp. Ir-4812, *Borrelia* sp. Ir-5215, *Borrelia* sp. LV5, *Borrelia* sp. MI-2, *Borrelia* sp. MI-5, *Borrelia* sp. MI-6, *Borrelia* sp. MI-8, *Borrelia* sp. MI-9, *Borrelia* sp. MOD-1, *Borrelia* sp. MOD-5, *Borrelia* sp. MOK-3a, *Borrelia* sp. MOS-1b, *Borrelia* sp. NE49, *Borrelia* sp. NE581, *Borrelia* sp. PHaP, *Borrelia* sp. PSigII, *Borrelia* sp. SCGT-10, *Borrelia* sp. SCGT-8a, *Borrelia* sp. SCI-2, *Borrelia* sp. SCW-30h, *Borrelia* sp. SI-1, *Borrelia* sp. SI-10, *Borrelia* sp. SM-1, *Borrelia* sp. SV1, *Borrelia* sp. W97F51, *Borrelia* sp. Z41293, *Borrelia* sp. Z41493, *Borrelia coriaceae, Borrelia crocidurae, Borrelia duttonii, Borrelia duttonii* Ly, *Borrelia hermsii, Borrelia hermsii* DAH, *Borrelia hispanica, Borrelia lonestari, Borrelia miyamotoi, Borrelia parkeri, Borrelia persica, Borrelia recurrentis, Borrelia recurrentis* A1, *Borrelia sinica, Borrelia theileri, Borrelia turcica, Borrelia turicatae, Borrelia turicatae* 91E135, *Borrelia* sp., *Borrelia* sp. 'Lake Gaillard', *Borrelia* sp. 000133, *Borrelia* sp. 010298, *Borrelia* sp. 10MT, *Borrelia* sp. 5145, *Borrelia* sp. 57Nsk, *Borrelia* sp. 5MT, *Borrelia* sp. 6T04-2, *Borrelia* sp. BR, *Borrelia* sp. BR 2007, *Borrelia* sp. C5-N52, *Borrelia* sp. CB-A1, *Borrelia* sp. CB-A11, *Borrelia* sp. CB-A3, *Borrelia* sp. EFL-S0100110, *Borrelia* sp. IK/23, *Borrelia* sp. IM/16, *Borrelia* sp. IM/19, *Borrelia* sp. KR1, *Borrelia* sp. KR3, *Borrelia* sp. LB-2001, *Borrelia* sp. LB-M56, *Borrelia* sp. LB-W100, *Borrelia* sp. MK-N61, *Borrelia* sp. NR-N8, *Borrelia* sp. OkME1, *Borrelia* sp. PAnz, *Borrelia* sp. PJes, *Borrelia* sp. PMai, *Borrelia* sp. PMew, *Borrelia* sp. R57, *Borrelia* sp. strain Spain, *Borrelia* sp. TA1, *Borrelia* sp. TM, *Borrelia* sp. TM1 and/or *Borrelia* sp. TM2.

In another preferred embodiment the present invention relates to one or more MHC-peptide complexes or MHC multimers comprising one or more *Borrelia* class II antigen peptide fragments selected from the peptides listed in FIG. 33, FIG. 34, FIG. 39, FIG. 40, FIG. 41, FIG. 42, Table A, Table B and Table C.

In another preferred embodiment the present invention relates to one or more *Borrelia* class II antigenic peptide fragments selected from the peptides listed in FIG. 33, FIG. 34, FIG. 39, FIG. 40, FIG. 41, FIG. 42, Table A, Table B and Table C.

*Borrelia* class II antigen peptide fragments comprising a conserved core peptide. MHC class 2 proteins typically bind peptides with a total length of 13-18 amino acids, comprising a 9'-mer core motif containing the important amino acid anchor residues. However the total length is not strictly defined, as opposed to most MHC class 1 molecules.

The putative binding peptide sequences only describe the central part of the peptide including the 9-mer core motif; in other words, the peptide sequences shown represent the core of the binding peptide with a few important flanking amino acids, which in some cases may be of considerably length generating binding peptides longer than the 13-16 amino acids.

In another preferred embodiment the present invention relates to one or more MHC-peptide complexes or MHC multimers comprising one or more *Borrelia* class II antigen peptide fragments comprising one or more of the 9 mer core peptides listed in FIG. 34.

In another preferred embodiment the present invention relates to one or more *Borrelia* class II antigen peptide fragments comprising one or more of the 9 mer core peptides listed in FIG. 34.

The above mentioned 9 mer core peptides can be part of one or more 13 mers, 14 mers, 15 mers, 16 mers, 17 mers, 18 mers, 19 mers, 20 mers, 21 mers, 22 mers, 23, mers, 24 mers or 25 mer.

The 9 mer core peptides can have different positions in the 13 mers, 14 mers, 15 mers, 16 mers, 17 mers, 18 mers, 19 mers, 20 mers, 21 mers, 22 mers, 23, mers, 24 mers or 25 mer.

In one preferred embodiment the 9 mer starts at position 1 from the N-terminus of the 13 mer.

In one preferred embodiment the 9 mer starts at position 2 from the N-terminus of the 13 mer.

In one preferred embodiment the 9 mer starts at position 3 from the N-terminus of the 13 mer.

In one preferred embodiment the 9 mer starts at position 4 from the N-terminus of the 13 mer.

In one preferred embodiment the 9 mer starts at position 5 from the N-terminus of the 13 mer.

In one preferred embodiment the 9 mer starts at position 1 from the N-terminus of the 14 mer.

In one preferred embodiment the 9 mer starts at position 2 from the N-terminus of the 14 mer.

In one preferred embodiment the 9 mer starts at position 3 from the N-terminus of the 14 mer.

In one preferred embodiment the 9 mer starts at position 4 from the N-terminus of the 14 mer.

In one preferred embodiment the 9 mer starts at position 5 from the N-terminus of the 14 mer.

In one preferred embodiment the 9 mer starts at position 6 from the N-terminus of the 14 mer.

In one preferred embodiment the 9 mer starts at position 1 from the N-terminus of the 15 mer.

In one preferred embodiment the 9 mer starts at position 2 from the N-terminus of the 15 mer.

In one preferred embodiment the 9 mer starts at position 3 from the N-terminus of the 15 mer.

In one preferred embodiment the 9 mer starts at position 4 from the N-terminus of the 15 mer.

In one preferred embodiment the 9 mer starts at position 5 from the N-terminus of the 15 mer.

In one preferred embodiment the 9 mer starts at position 6 from the N-terminus of the 15 mer.

In one preferred embodiment the 9 mer starts at position 7 from the N-terminus of the 15 mer.

In one preferred embodiment the 9 mer starts at position 1 from the N-terminus of the 16 mer.

In one preferred embodiment the 9 mer starts at position 2 from the N-terminus of the 16 mer.

In one preferred embodiment the 9 mer starts at position 3 from the N-terminus of the 16 mer.

In one preferred embodiment the 9 mer starts at position 4 from the N-terminus of the 16 mer.

In one preferred embodiment the 9 mer starts at position 5 from the N-terminus of the 16 mer.

In one preferred embodiment the 9 mer starts at position 6 from the N-terminus of the 16 mer.

In one preferred embodiment the 9 mer starts at position 7 from the N-terminus of the 16 mer.

In one preferred embodiment the 9 mer starts at position 8 from the N-terminus of the 16 mer.

In one preferred embodiment the 9 mer starts at position 1 from the N-terminus of the 17 mer.
In one preferred embodiment the 9 mer starts at position 2 from the N-terminus of the 17 mer.
In one preferred embodiment the 9 mer starts at position 3 from the N-terminus of the 17 mer.
In one preferred embodiment the 9 mer starts at position 4 from the N-terminus of the 17 mer.
In one preferred embodiment the 9 mer starts at position 5 from the N-terminus of the 17 mer.
In one preferred embodiment the 9 mer starts at position 6 from the N-terminus of the 17 mer.
In one preferred embodiment the 9 mer starts at position 7 from the N-terminus of the 17 mer.
In one preferred embodiment the 9 mer starts at position 8 from the N-terminus of the 17 mer.
In one preferred embodiment the 9 mer starts at position 9 from the N-terminus of the 17 mer.
In one preferred embodiment the 9 mer starts at position 1 from the N-terminus of the 18 mer.
In one preferred embodiment the 9 mer starts at position 2 from the N-terminus of the 18 mer.
In one preferred embodiment the 9 mer starts at position 3 from the N-terminus of the 18 mer.
In one preferred embodiment the 9 mer starts at position 4 from the N-terminus of the 18 mer.
In one preferred embodiment the 9 mer starts at position 5 from the N-terminus of the 18 mer.
In one preferred embodiment the 9 mer starts at position 6 from the N-terminus of the 18 mer.
In one preferred embodiment the 9 mer starts at position 7 from the N-terminus of the 18 mer.
In one preferred embodiment the 9 mer starts at position 8 from the N-terminus of the 18 mer.
In one preferred embodiment the 9 mer starts at position 9 from the N-terminus of the 18 mer.
In one preferred embodiment the 9 mer starts at position 10 from the N-terminus of the 18 mer.
In one preferred embodiment the 9 mer starts at position 1 from the N-terminus of the 19 mer.
In one preferred embodiment the 9 mer starts at position 2 from the N-terminus of the 19 mer.
In one preferred embodiment the 9 mer starts at position 3 from the N-terminus of the 19 mer.
In one preferred embodiment the 9 mer starts at position 4 from the N-terminus of the 19 mer.
In one preferred embodiment the 9 mer starts at position 5 from the N-terminus of the 19 mer.
In one preferred embodiment the 9 mer starts at position 6 from the N-terminus of the 19 mer.
In one preferred embodiment the 9 mer starts at position 7 from the N-terminus of the 19 mer.
In one preferred embodiment the 9 mer starts at position 8 from the N-terminus of the 19 mer.
In one preferred embodiment the 9 mer starts at position 9 from the N-terminus of the 19 mer.
In one preferred embodiment the 9 mer starts at position 10 from the N-terminus of the 19 mer.
In one preferred embodiment the 9 mer starts at position 11 from the N-terminus of the 19 mer.
In one preferred embodiment the 9 mer starts at position 1 from the N-terminus of the 20 mer.
In one preferred embodiment the 9 mer starts at position 2 from the N-terminus of the 20 mer.
In one preferred embodiment the 9 mer starts at position 3 from the N-terminus of the 20 mer.
In one preferred embodiment the 9 mer starts at position 4 from the N-terminus of the 20 mer.
In one preferred embodiment the 9 mer starts at position 5 from the N-terminus of the 20 mer.
In one preferred embodiment the 9 mer starts at position 6 from the N-terminus of the 20 mer.
In one preferred embodiment the 9 mer starts at position 7 from the N-terminus of the 20 mer.
In one preferred embodiment the 9 mer starts at position 8 from the N-terminus of the 20 mer.
In one preferred embodiment the 9 mer starts at position 9 from the N-terminus of the 20 mer.
In one preferred embodiment the 9 mer starts at position 10 from the N-terminus of the 20 mer.
In one preferred embodiment the 9 mer starts at position 11 from the N-terminus of the 20 mer.
In one preferred embodiment the 9 mer starts at position 12 from the N-terminus of the 20 mer.
In one preferred embodiment the 9 mer starts at position 1 from the N-terminus of the 21 mer, 22 mer, 23 mer, 24 mer or 25 mer.
In one preferred embodiment the 9 mer starts at position 2 from the N-terminus of the 21 mer, 22 mer, 23 mer, 24 mer or 25 mer.
In one preferred embodiment the 9 mer starts at position 3 from the N-terminus of the 21 mer, 22 mer, 23 mer, 24 mer or 25 mer.
In one preferred embodiment the 9 mer starts at position 4 from the N-terminus of the 21 mer, 22 mer, 23 mer, 24 mer or 25 mer.
In one preferred embodiment the 9 mer starts at position 5 from the N-terminus of the 21 mer, 22 mer, 23 mer, 24 mer or 25 mer.
In one preferred embodiment the 9 mer starts at position 6 from the N-terminus of the 21 mer, 22 mer, 23 mer, 24 mer or 25 mer.
In one preferred embodiment the 9 mer starts at position 7 from the N-terminus of the 21 mer, 22 mer, 23 mer, 24 mer or 25 mer.
In one preferred embodiment the 9 mer starts at position 8 from the N-terminus of the 21 mer, 22 mer, 23 mer, 24 mer or 25 mer.
In one preferred embodiment the 9 mer starts at position 9 from the N-terminus of the 21 mer, 22 mer, 23 mer, 24 mer or 25 mer.
In one preferred embodiment the 9 mer starts at position 10 from the N-terminus of the 21 mer, 22 mer, 23 mer, 24 mer or 25 mer.
In one preferred embodiment the 9 mer starts at position 11 from the N-terminus of the 21 mer, 22 mer, 23 mer, 24 mer or 25 mer.
In one preferred embodiment the 9 mer starts at position 12 from the N-terminus of the 21 mer, 22 mer, 23 mer, 24 mer or 25 mer.
In one preferred embodiment the 9 mer starts at position 13 from the N-terminus of the 21 mer, 22 mer, 23 mer, 24 mer or 25 mer.
In one preferred embodiment the 9 mer starts at position 14 from the N-terminus of the 22 mer, 23 mer, 24 mer or 25 mer.
In one preferred embodiment the 9 mer starts at position 15 from the N-terminus of the 23 mer, 24 mer or 25 mer.
In one preferred embodiment the 9 mer starts at position 16 from the N-terminus of the 24 mer or 25 mer.
In one preferred embodiment the 9 mer starts at position 17 from the N-terminus of the 25 mer.

The amino acids surrounding the 9 mer core peptides in the 13 mers, 14 mers, 15 mers, 16 mers, 17 mers, 18 mers, 19 mers, 20 mers, 21 mers, 22 mers, 23 mers, 24 mers and/or 25 mers can be any amino acids.

Peptide Fragments with Amino Acid Substitutions

The present invention further relates to one or more antigenic *borrelia* peptides that have one or more amino acid substitutions such as 1, 2, 3, 4, 5, 6, 7, or 8.

The present invention also relates to one or more MHC-peptide complexes or MHC multimers, wherein the one or more antigenic *borrelia* peptides have one or more amino acid substitutions such as 1, 2, 3, 4, 5, 6, 7, or 8.

In one embodiment the one or more amino acid substitutions are within the amino acid anchor motif. In another embodiment the one or more amino acid substitutions are outside the amino acid anchor motif. In one embodiment the one or more amino acid substitutions are within the 9 mer core motif. In another embodiment the one or more amino acid substitutions are outside the 9 mer core motif.

In a preferred embodiment these amino acid substitutions comprise substitution with an "equivalent amino acid residue". An "equivalent amino acid residue" refers to an amino acid residue capable of replacing another amino acid residue in a polypeptide without substantially altering the structure and/or functionality of the polypeptide. Equivalent amino acids thus have similar properties such as bulkiness of the side-chain, side chain polarity (polar or non-polar), hydrophobicity (hydrophobic or hydrophilic), pH (acidic, neutral or basic) and side chain organization of carbon molecules (aromatic/aliphatic). As such, "equivalent amino acid residues" can be regarded as "conservative amino acid substitutions".

The classification of equivalent amino acids refers in one embodiment to the following classes: 1) HRK, 2) DENQ, 3) C, 4) STPAG, 5) MILV and 6) FYW.

Within the meaning of the term "equivalent amino acid substitution" as applied herein, one amino acid may be substituted for another, in one embodiment, within the groups of amino acids indicated herein below:

Amino acids having polar side chains (Asp, Glu, Lys, Arg, His, Asn, Gln, Ser, Thr, Tyr, and Cys,)

Amino acids having non-polar side chains (Gly, Ala, Val, Leu, Ile, Phe, Trp, Pro, and Met)

Amino acids having aliphatic side chains (Gly, Ala Val, Leu, Ile)

Amino acids having cyclic side chains (Phe, Tyr, Trp, His, Pro)

Amino acids having aromatic side chains (Phe, Tyr, Trp)

Amino acids having acidic side chains (Asp, Glu)

Amino acids having basic side chains (Lys, Arg, His)

Amino acids having amide side chains (Asn, Gln)

Amino acids having hydroxy side chains (Ser, Thr)

Amino acids having sulphor-containing side chains (Cys, Met),

Neutral, weakly hydrophobic amino acids (Pro, Ala, Gly, Ser, Thr)

Hydrophilic, acidic amino acids (Gln, Asn, Glu, Asp), and

Hydrophobic amino acids (Leu, Ile, Val)

A Venn diagram is another method for grouping of amino acids according to their properties (Livingstone & Barton, *CABIOS*, 9, 745-756, 1993). In another preferred embodiment one or more amino acids may be substituted with another within the same Venn diagram group.

In another preferred embodiment these amino acid substitutions comprise substitution with a "non-equivalent amino acid residue". Non-equivalent amino acid residues are amino acid residues with dissimilar properties to the properties of the amino acid they substitute according to the groupings described above.

In one preferred embodiment the amino acid substitutions increases the affinity of the peptide for the MHC molecule and thereby increase the stability of the MHC-peptide complex.

In another preferred embodiment the amino acid substitutions decreases the affinity of the peptide for the MHC molecule and thereby increase the stability of the MHC-peptide complex.

In one preferred embodiment the amino acid substitutions increases the overall affinity of one or more T-cell receptors for the MHC-peptide complex containing the modified antigenic peptide.

In another preferred embodiment the amino acid substitutions decreases the overall affinity of one or more T-cell receptors for the MHC-peptide complex containing the modified antigenic peptide.

Gene Variants

The present invention further relates to one or more MHC-peptide complexes or MHC multimers, wherein the one or more antigenic *borrelia* peptides are encoded by one or more gene variants.

The present invention also relates to one or more antigenic *borrelia* peptides that are encoded by one or more gene variants.

The term "variant gene" refers to nucleic acid molecules that encode a polypeptide having an amino acid sequence that is a modification of the polypeptides according to the present invention. Such variants include naturally-occurring polymorphisms of genes according to the present invention, as well as synthetic genes that contain conservative amino acid substitutions of the amino acid sequence of a polypeptide according to the present invention. Additional variant forms of genes are nucleic acid molecules that contain insertions or deletions of the nucleotide sequences described herein. A variant gene according to the present invention can be identified by determining whether the gene hybridizes with a nucleic acid molecule having the nucleotide sequence of a polypeptide according to the present invention, or its complement, under stringent conditions.

Antigenic Peptides

The present invention relates in one embodiment to antigenic peptides derived from *Borrelia* antigens. The one or more antigenic peptides can in one embodiment comprise one or more fragments from one or more *Borrelia* antigens capable of interacting with one or more MHC class 1 molecules. The one or more antigenic peptides can in another embodiment comprise one or more fragments from one or more *Borrelia* antigens capable of interacting with one or more MHC class 2 molecules.

The antigenic peptides can be generated from any *Borrelia* antigen such as the *Borrelia* antigens listed in this application including the *Borrelia* antigens listed in FIG. 27, FIG. 28, FIG. 29, FIG. 30, FIG. 38 and FIG. 43.

MHC Class I and MHC Class II molecules have different structures, as described above, and therefore have different restrictions on the size of the peptide which may be accommodated. In general, MHC Class I molecules will accommodate peptides of from about 8 amino acids in length to about 11 amino acids. MHC Class II molecules will in general accommodate peptides of from about 13 amino acids in length to about 16 amino acids but may also accommodate longer peptides.

The antigenic peptides can in one embodiment be generated by computational prediction e.g. using NetMHC (www.cbs.dtu.dk/services/NetMHC/) or by selection of specific 8, 9, 10, 11, 13, 14, 15 or 16 amino acid sequences. FIG. 31, FIG. 32, FIG. 33, FIG. 34, FIG. 36, FIG. 37, FIG. 39, FIG. 40, FIG. 41, FIG. 42, FIG. 43, FIG. 44, FIG. 45, table A, table B and table C comprise antigen peptides including Borrelia antigenic peptides.

The present invention relates to one or more antigenic peptides and/or one or more MHC multimers, MHC-peptide complexes and/or one or more antigenic polypeptides comprising one or more antigenic peptides such as the antigenic peptides listed in the figures and/or tables in this application (comprising SEQ ID NO 1 to SEQ ID NO 217791) and/or the antigenic peptides characterized by item 1 to 735 herein below.

The one or more antigenic peptides can in one embodiment comprise or consist of a fragment of one or more antigenic peptides listed in the figures and tables of this application (SEQ ID NO 1 to SEQ ID NO 217791) and/or the antigenic peptides characterized by item 1 to 735 herein below, such as a fragment consisting of 1, 2, 3, 4, 5, 6, 7, 8, 9, 10, 11, 12, 13, 14, 15 or 16 amino acids.

It is to be understood that said items are not meant to be limiting to the peptide according to the present invention in that said peptide may consist of more than said 8 to 16 amino acids, but at least comprising said 8 to 16 amino acids.

Thus, in another embodiment the antigenic peptide listed in figures and/or tables in this application (including SEQ ID NO 1 to SEQ ID NO 217791) and/or the antigenic peptides characterized by item 1 to 735 herein below can be a fragment or part of a larger antigenic polypeptide, wherein the larger antigenic polypeptide may be of a total length of 9, such as 10, for example 11, such as 12, for example 13, such as 14, for example 15, such as 16, for example 17, such as 18, for example 19, such as 20, for example 21, such as 22, for example 23, such as 24, for example 25, such as 26, for example 27, such as 28, for example 29, such as 30, for example 31, such as 32, for example 33, such as 34, for example 35, such as 36, for example 37, such as 38, for example 39, such as 40 amino acids, wherein 8 to 16 of said amino acids are defined in the items below. In another embodiment, the larger polypeptide may be of a total length of between 20 to 30, such as 30-40, for example 40-50, such as 50-60, for example 60-70, such as 70-80, for example 80-90, such as 90-100, for example 100-150, such as 150-200, for example 200-250, such as 250-300, for example 300-500, such as 500-1000, for example 1000-2000, such as 2000-3000, for example 3000-4000, such as 4000-5000, for example 5000-10,000, such as 10,000-20,000, for example 20,000-30,000, such as 30,000-40,000, for example 40,000-50,000, such as 50,000-75,000, for example 75,000-100,000, such as 100,000-250,000, for example 250,000-,500,000, such as 500,000-1,000,000 amino acids.

In one embodiment the antigenic peptides listed in the figures and/or tables of this application (SEQ ID NO 1 to SEQ ID NO 217791) are modified by one or more type(s) of post-translational modifications such as one or more of the post-translational modifications listed in the items (item 1 to 735) herein below. The same or different types of post-translational modification can occur on one or more amino acids in the antigenic peptide. Thus, in one embodiment, any one amino acid may be modified once, twice or three times with the same or different types of modifications. Furthermore, said identical and/or different modification may be present on 1, 2, 3, 4, 5, 6, 7, 8, 9, 10, 11, 12, 13, 14, 15, 16, 17 or 18 of the amino acid residues of the peptide according to the present invention as defined in the items below. In addition, modifications may also be present on amino acid residues outside said 8 to 16 amino acids, in case the peptide is part of a larger protein.

Preferred Borrelia afzelii fragments of Osp C capable of interacting with one or more MHC class 1 and/or MHC class 2 molecules are listed in Table A.

TABLE A

Prediction of MHC class

TABLE A-continued

Prediction of MHC class 1 and 2 *Borrelia afzelii* OspC peptide binders. Prediction of 8-, 9-, 10-, 11-, 13-, 14-, 15-, 16-mer peptides were generated using the program displayed in FIG. 2.

TNADKTKG; NADKTKGA; ADKTKGAE; DKTKGAEE; KTKGAEEL; TKGAEELG;
KGAEELGK; GAEELGKL; AEELGKLF; EELGKLFK; ELGKLFKS; LGKLFKSV;
GKLFKSVE; KLFKSVEG; LFKSVEGL; FKSVEGLV; KSVEGLVK; SVEGLVKA;
VEGLVKAA; EGLVKAAQ; GLVKAAQE; LVKAAQEA; VKAAQEAL; KAAQEALT;
AAQEALTN; AQEALTNS; QEALTNSV; EALTNSVK; ALTNSVKE; LTNSVHEL;
TNSVKELT; NSVHELTS; SVHELTSP; VKELTSPV; KELTSPVV; ELTSPVVA;
LTSPVVAE; TSPVVAES; SPVVAESP; PVVAESPK; VVAESPKK; VAESPKKP 9 mers:
MKKNTLSAI; HKNTLSAIL; KNTLSAILM; NTLSAILMT; TLSAILMTL; LSAILMTLF;
SAILMTLFM; AILMTLFLF; ILMTLFLFT; LMTLFLFTS; MTLFLFISC; TLFLFISCN;
LFLFISCNN; FLFISCNNS; LFTSCNNSG; FISCNNSGK; ISCNNSGKG; SCNNSGKGG;
CNNSGKGGD; NNSGKGGDS; NSGKGGDSA; SGKGGDSAS; GKGGDSAST; KGGDSASTN;
GGDSASTNP; GDSASTNPA; DSASTNPAD; SASTNPADE; ASTNPADES; STNPADESA;
TNPADESAK; NPADESAKG; PADESAKGP; ADESAKGPN; DESAKGPNL; ESAKGPNLT;
SAKGPNLTE; AKGPNLTEI; KGPNLTEIS; GPNLTEISK; PNLTEISKK; NLTEISKKI;
LTEISKKIT; TEISKKITD; EISKKITDS; ISKKITDSN; SKKITDSNA; KKITDSNAF;
KITDSNAFV; ITDSNAFVL; TDSNAFVLA; DSATAFVLAV; SNAFVLAVK; NAFVLAVKE;
AFVLAVKEV; FVLAVKEVE; VLAVKEVET; LAVKEVETL; AVKEVETLV; VKEVETLVS;
KEVETLVSS; EVETLVSSI; VETLVSSID; ETLVSSIDE; TLVSSIDEL; LVSSIDELA;
VSSIDELAN; SSIDELANK; SIDELANKA; IDELANKAI; DELANKAIG; ELANKAIGK;
LANKAIGKK; ANKAIGKKI; NKAIGKKIQ; KAIGKKIQQ; AIGKKIQQN; IGKKIQQNG;
GKKIQQNGL; KKIQQNGLG; KIQQNGLGA; IQQNGLGAE; QQNGLGAEA; QNGLGAEAN;
NGLGAEANR; GLGAEANRN; LGAEANRNE; GAEANRNES; AEANRNESL; EANRNESLL;
ANRNESLLA; NRNESLLAG; RNESLLAGV; NESLLAGVH; ESLLAGVHE; SLLAGVHEI;
LLAGVHEIS; LAGVHEIST; AGVHEISTL; GVHEISTLI; VHEISTLIT; HEISTLITE;
EISTLITEK; ISTLITEKL; STLITEKLS; TLITEKLSK; LITEKLSKL; ITEKLSKLK;
TEKLSKLKN; EKLSKLKNS; KLSKLKNSG; LSKLKNSGE; SKLKNSGEL; KLKNSGELK;
LKNSGELKA; KNSGELKAK; NSGELKAKI; SGELKAKIE; GELKAKIED; ELKAKIEDA;
LKAKIEDAK; KAKIEDAKK; AKIEDAKKC; KIEDAKKCS; IEDAKKCSE; EDAKKCSEE;
DAKKCSEEF; AKKCSEEFT; KKCSEEFTN; KCSEEFTNK; CSEEFTNKL; SEEFTNKLR;
EEFTNKLRV; EFTNKLRVS; FTNHLRVSH; TNKLRVSHA; NKLRVSHAD; KLRVSHADL;
LRVSHADLG; RVSHADLGK; VSHADLGKQ; SHADLGKQG; HADLGKQGV; ADLGKQGVN;
DLGKQGVND; LGKQGVNDD; GKQGVNDDD; KQGVNDDDA; QGVNDDDAK; GVNDDDAKK;
VNDDDAKKA; NDDDAKKAI; DDDAKKAIL; DDAKKAILK; DAKKAILKT; AKKAILKTN;
KKAILKTNA; KAILKTNAD; AILKTNADK; ILKTNADKT; LKTNADKTK; KTNADKTKG;
TNADKTKGA; NADKTKGAE; ADKTKGAEE; DKTKGAEEL; KTKGAEELG; TKGAEELGK;
KGAEELGKL; GAEELGKLF; AEELGKLFK; EELGKLFKS; ELGKLFKSV; LGKLFKSVE;
GKLFKSVEG; KLFKSVEGL; LFKSVEGLV; FKSVEGLVK; KSVEGLVKA; SVEGLVKAA;
VEGLVKAAQ; EGLVKAAQE; GLVKAAQEA; LVKAAQEAL; VKAAQEALT; KAAQEALTN;
AAQEALTNS; AQEALTNSV; QEALTNSVK; EALTNSVHE; ALTNSVKEL; LTNSVKELT;
TNSVKELTS; NSVKELTSP; SVHELTSPV; VKELTSPVV; KELTSPVVA; ELTSPVVAE;
LTSPVVAES; TSPVVAESP; SPVVAESPK; PVVAESPKK; VVAESPKKP 10 mers:
MKKNTLSAIL; KKNTLSAILM; KNTLSAILMT; ATTLSAILMTL; TLSAILMTLF;
LSAILMTLFL; SAILMTLFLF; AILMTLFMFT; ILMTLFLFTS; LMTLFLFISC;
MTLFLFISCN; TLFLFISCNN; LFLFISCNNS; FLFISCNNSG; LFISCNNSGK;
FISCNNSGKG; ISCNNSGKGG; SCNNSGKGGD; CNNSGKGGDS; NNSGKGGDSA;
NSGKGGDSAS; SGKGGDSAST; GKGGDSASTN; KGGDSASTNP; GGDSASTNPA;
GDSASTNPAD; DSASTNPADE; SASTNPADES; ASTNPADESA; STNPADESAK;
TNPADESAKG; ATADESAKGP; PADESAKGPN; ADESAKGPNL; DESAKGPNLT;
ESAKGPNLTE; SAKGPNLTEI; AKGPNLTEIS; KGPNLTEISK; GPNLTEISKK;
PNLTEISKKI; NLTEISKKIT; LTEISKKITD; TEISKKITDS; EISKKITDSN;
ISKKITDSNA; SKKITDSNAF; KKITDSNAFV; KITDSNAIVI; ITDSNAFVLA;
TDSNAFVLAV; DSNAFVLAVK; SNAFVLAVHE; NAFVLAVKEV; AFVLAVKEVE;
FVLAVKEVET; VLAVKEVETL; LAVKEVETLV; AVHEVETLVS; VKEVETLVSS;
KEVETLVSSI; EVETLVSSID; VETLVSSIDE; ETLVSSIDEL; TLVSSIDELA;
LVSSIDELAN; VSSIDELANK; SSIDELANHA; SIDELANKAI; IDELANHAIG;
DELANHAIGK; ELANHAIGKK; LANHAIGKKI; ANKAIGKKIQ; NHAIGKKIQQ;
KAIGKKIQQN; AIGKKIQQNG; IGKKIQQNGL; GKKIQQNGLG; KKIQQNGLGA;
KIQQNGLGAE; IQQNGLGAEA; QQNGLGAEAN; QNGLGAEANR; NGLGAEANRN;
GLGAEARRNE; LGAEANRNES; GAEANRNESL; AEANRNESLL; EANRNESLLA;
ANRNESLLAG; NRNESLLAGV; RNESLLAGVH; NESLLAGVRE; ESLLAGVHEI;
SLLAGVHEIS; LLAGVHEIST; LAGVHEISTL; AGVHEISTLI; GVHEISTLIT;
VHEISTLITE; HEISTLITEK; EISTLITEKL; ISTLITEKLS; STLITEKLSK;
TLITEKLSKL; LITEKLSKLK; ITEKLSKLKN; TEKLSKLKNS; EKLSKLKNSG;
KLSKLKNSGE; LSKLKNSGEL; SKLKNSGELK; KLKNSGELKA; LKNSGELKAK;
KNSGELKAKI; NSGELKAKIE; SGELKAKIED; GELKAKIEDA; ELKAKIEDAK;
LKAKIEDAKK; KAKIEDAKKC; AKIEDAKKCS; KIEDAKKCSE; IEDAKKCSEE;
EDAKKCSEEF; DAKKCSEEFT; AKKCSEEFTN; KKCSEEFTNK; KCSEEFTWKL;
CSEEFTNKLR; SEEFTNHLRV; EEFTNHLRVS; EFTNKLRVSH; FTNKLRVSHA;
TNKLRVSHAD; NKLRVSHADL; KLRVSHADLG; LRVSHADLGK; RVSHADLGKQ;
VSHADLGKQG; SHADLGKQGV; HADLGKQGVN; ADLGKQGVND; DLGKQGVNDD;
LGKQGVNDDD; GKQGVNDDDA; KQGVNDDDAK; QGVNDDDAKK; GVNDDDAKKA;

TABLE A-continued

Prediction of MHC class 1 and 2 *Borrelia afzelii* OspC peptide binders. Prediction of 8-, 9-, 10-, 11-, 13-, 14-, 15-, 16-mer peptides were generated using the program displayed in FIG. 2.

VNDDDAKKAI; NDDDAKHAIL; DDDAKHAILK; DDAKKAILKT; DAKKAILKTN;
AKHAILKTMA; KHAILKTMAD; KAILKTNADK; AILKTMADKT; ILKTMADKTK;
LKTMADKTKG; KTMADKTKGA; TMADKTKGAE; NADKTKGAEE; ADKTKGAEEL;
DKTKGAEELG; KTKGAEELGK; TKGAEELGKL; KGAEELGKLF; GAEELGKLFK;
AEELGKLFKS; EELGKLFKSV; ELGKLFKSVE; LGKLFKSVEG; GKLFKSVEGL;
KLFKSVEGLV; LFKSVEGLVK; FKSVEGLVKA; KSVEGLVKAA; SVEGLVEAAQ;
VEGLVKAAQE; EGLVEAAQEA; GLVEAAQEAL; LVHAAQEALT; VKAAQEALTN;
KAAQEALTNS; AAQEALTNSV; AQEALTNSVK; QEALTNSVHE; EALTNSVHEL;
ALTNSVKELT; LTNSVHELTS; TNSVHELTSP; NSVHELTSPV; SVHELTSPVV;
VKELTSPVVA; KELTSPVVAE; ELTSPVVAES; LTSPVVAESP; TSPVVAESPK;
SPVVAESPKK; PVVAESPKKP 11 mers:
MHKNTLSAILM; KKNTLSAILMT; KNTLSAILMTL; NTLSAILMTLF; TLSAILMTLFL;
LSAILMTLFLF; SAILMTLFLFI; AILMTLFLFIS; ILMTLFLFISC; LMTLFLFISCN;
MTLFLFISCNN; TLFLFISCNNS; LFLFISCNNSG; FLFTSCNNSGK; LFISCNNSGKG;
FISCNNSGKGG; ISCNNSGKGGD; SCNNSGKGGDS; CNNSGKGGDSA; NNSGKGGDSAS;
NSGKGGDSAST; SGKGGDSASTN; GKGGDSASTNP; KGGDSASTNPA; GGDSASTNPAD;
GDSASTNPADE; DSASTNPADES; SASTNPADESA; ASTNPADESAK; STNPADESAKG;
TNPADESAKGP; NPADESAKGPN; PADESAKGPNL; ADESAKGPNLT; DESAKGPNLTE;
ESAKGPNLTEI; SAKGPNLTEIS; AKGPNLTEISK; KGPNLTEISKK; GPNLTEISKKI;
PNLTEISKKIT; NLTEISKKITD; LTEISKKITDS; TEISKKITDSN; EISKKITDSNA;
ISKKITDSNAF; SKKITDSNAFV; KKITDSNAIVI; KITDSNAFVLA; ITDSNAFVLAV;
TDSNAFVLAVK; DSNAFVLAVHE; SNAFVLAVKEV; NAFVLAVKEVE; AFVLAVKEVET;
FVLAVKEVETL; VLAVKEVETLV; LAVKEVETLVS; AVEEVETLVSS; VKEVETLVSSI;
KEVETLVSSID; EVETLVSSIDE; VETLVSSIDEL; ETLVSSIDELA; TLVSSIDELAN;
LVSSIDELAMK; VSSIDELANHA; SSIDELANKAI; SIDELANHAIG; IDELANHAIGK;
DELANHAIGKK; ELANHAIGKKI; LANHAIGKKIQ; ANHAIGKKIQQ; NHAIGKKIQQN;
KAIGKKIQQNG; AIGKKIQQNGL; IGKKIQQNGLG; GKKIQQNGLGA; KKIQQNGLGAE;
KIQQNGLGAEA; IQQNGLGAEAN; QQNGLGAEANR; QNGLGAEANRN; NGLGAEANRNE;
GLGAEANRNES; LGAEANRNESL; GAEANRNESLL; AEANRNESLLA; EANRNESLLAG;
ANRNESLLAGV; NRNESLLAGVH; RNESLLAGVRE; NESLLAGVHEI; ESLLAGVHEIS;
SLLAGVHEIST; LLAGVHEISTL; LAGVHEISTLI; AGVHEISTLIT; GVHEISTLITE;
VHEISTLITEK; HEISTLITEKL; EISTLITEKLS; ISTLITEKLSK; STLITEKLSKL;
TLITEKLSKLK; LITEKLSKLKN; ITEKLSKLKNS; TEKLSKLKNSG; EKLSKLKNSGE;
KLSKLKNSGEL; LSKLKNSGELK; SKLKNSGELKA; KLKNSGELKAK; LKNSGELKAKI;
KNSGELKAKIE; NSGELKAKIED; SGELKAKIEDA; GELKAKIEDAK; ELKAKIEDAKK;
LKAKIEDAKKC; KAKIEDAKKCS; AKIEDAKKCSE; KIEDAKKCSEE; IEDAKKCSEEF;
EDAKKCSEEFT; DAKKCSEEFTN; AKKCSEEFTNK; KKCSEEFTNKL; KCSEEFTNHLR;
CSEEFTNKLRV; SEEFTNKLRVS; EEFTNHLRVSH; EFTNKLRVSHA; FTNKLRVSHAD;
TNKLRVSHADL; NHLRVSHADLG; KLRVSHADLGK; LRVSHADLGKQ; RVSHADLGKQG;
VSHADLGKQGV; SHADLGKQGVN; HADLGKQGVND; ADLGKQGVNDD; DLGKQGVNDDD;
LGKQGVNDDDA; GKQGVNDDDAK; KQGVNDDDAKK; QGVNDDDAKKA; GVNDDDAKKAI;
VNDDDAKKAIL; NDDLAKKAILK; DDDAKKAILKT; DDAKKAILKTN; DAKKAILKTNA;
AKKAILKTNAD; KKAILKTNADK; KAILKTNADKT; AILKTNADKTK; ILKTNADKTKG;
LKTNADKTKGA; KTNADKTKGAE; TNADKTKGAEE; NADKTKGAEEL; ADKTKGAEELG;
DKTKGAEELGK; KTKGAEELGKL; TKGAEIMGKLF; KGAEELGKLFK; GAEELGKLFKS;
AEELGKLFKSV; EELGKLFKSVE; ELGKLFKSVEG; LGKLFKSVEGL; GKLFKSVEGLV;
KLFKSVEGLVK; LFKSVEGLVKA; FKSVEGLVKAA; KSVEGLVKAAQ; SVEGLVKAAQE;
VEGLVKAAQEA; EGLVKAAQEAL; GLVKAAQEALT; LVKAAQEALTN; VKAAQEALTNS;
KAAQEALTNSV; AAQEALTNSVK; AQEALTNSVKE; QEALTNSVHEL; EALTNSVHELT;
ALTNSVKELTS; LTNSVKELTSP; TNSVHELTSPV; NSVKELTSPVV; SVKELTSPVVA;
VKELTSPVVAE; KELTSPVVAES; ELTSPVVAESP; LTSPVVAESPK; TSPVVAESPKK;
SPVVAESPKKP;

13 mers:
MKKNTLSAILMTL; HKNTLSAILMTLF; KNTLSAILMTLFL; AUMSAILMTLFLF;
TLSAILMTLFLIT; LSAILMTLFLITS; SAILMTLFLFISC; AILMTLFLFISCN;
ILMTLFLFISCAMT LMTLFLFISCNNS; MTLFLFTSCNNSG; TLFLFISCNNSGK;
LFLFISCNNSGKG; FLFISCNNSGKGG; LFTSCNNSGKGGD; FISCNNSGKGGDS;
ISCNNSGKGGDSA; SCNNSGKGGDSAS; CNNSGKGGDSAST; NNSGKGGDSASTN;
NSGKGGDSASTNP; SGKGGDSASTNPA; GKGGDSASTNPAD; KGGDSASTNPADE;
GGDSASTNPADES; GDSASTNPADESA; DSASTNPADESAK; SASTNPADESAKG;
ASTNPADESAKGP; STNPADESAKGPN; TNPADESAKGPNL; NPADESAKGPNLT;
PADESAKGPNLTE; ADESAKGPNLTEI; DESAKGPNLTEIS; ESAKGPNLTEISK;
SAKGTAMTEISKK; AKGPNLTEISKKI; KGPNLTEISKKIT; GPNLTEISKKITD;
PNLTEISKKITDS; NLTEISKKITDSN; LTEISKKITDSNA; TEISKKITDSNAF;
EISKKITDSNAFV; ISKKITDSNAFVL; SKKITDSNAFVLA; KKITDSNAFVLAV;
KITDSNAFVLAVK; ITDSNAFVLAVHE; TDSNAFVLAVKEV; DSNAFVLAVKEVE;
SNAFVLAVKEVET; NAFVLAVKEVETL; AFVLAVKEVETLVS; FVLAVKEVETLVSS;
VLAVKEVETLVSS; LAVKEVETLVSSI; AVHEVETLVSSID; VKEVETLVSSIDE;
KEVETLVSSIDEL; EVETLVSSIDELA; VETLVSSIDELAN; ETLVSSIDELANK;
TLVSSIDELANKA; LVSSIDELANKAI; VSSIDELANKAIG; SSIDELANKAIGK;
SIDELANKAIGKK; IDELANKAIGKKI; DELANKAIGKKIQ; ELANKAIGKKIQQ;
LANKAIGKKIQQN; AAWAIGKKIQQNG; NKAIGKKIQQNGL; KAIGKKIQQNGLG;

TABLE A-continued

Prediction of MHC class 1 and 2 *Borrelia afzelii* OspC peptide binders. Prediction of 8-, 9-, 10-, 11-, 13-, 14-, 15-, 16-mer peptides were generated using the program displayed in FIG. 2.

AIGKKIQQNGLGA; IGKKIQQNGLGAE; GKKIQQNGLGAEA; KKIQQNGLGAEAN;
KIQQNGLGAEANR; IQQNGLGAEANRN; QQNGLGAEANRNE; QNGLGAEANRNES;
NGLGAEANRNESL; GLGAEANRNESLL; LGAEANRNESLLA; GAEANRNESLLAG;
AEANRNESLLAGV; EANRNESLLAGVH; AAMNESLLAGVHE; NRNESLLAGVHEI;
RNESLLAGVHEIS; NESLLAGVHEIST; ESLLAGVHEISTL; SLLAGVHEISTLI;
LLAGVHEISTLIT; LAGVHEISTLITE; AGVHEISTLITEK; GVHEISTLITEKL;
VHEISTLITEKLS; HEISTLITEKLSK; EISTLITEKLSKL; ISTLITEKLSKLK;
STLITEKLSKLKN; TLITEKLSKLKNS; LITEKLSKLKNSG; ITEKLSKLKNSGE;
TEKLSKLKNSGEL; EKLSKLKNSGELK; KLSKLKNSGELKA; LSKLKNSGELKAK;
SKLKNSGELKAKI; KLKNSGELKAKIE; LKNSGELKAKIED; KNSGELKAKIEDA;
NSGELKAKIEDAK; SGELKAKIEDAKK; GELKAKIEDAKKC; ELKAKIEDAKKCS;
LKAKIEDAKKCSE; KAKIEDAKKCSEE; AKIEDAKKCSEEF; KIEDAKKCSEEFT;
IEDAKKCSEEFTN; EDAKKCSEEFTNK; DAKKCSEEFTNKL; AKKCSEEFTNKLR;
KKCSEEFTNKLRV; KCSEEFTNKLRVS; CSEEFTNHLRVSH; SEEFTNKLRVSHA;
EEFTNKLRVSHAD; EFTNKLRVSHADL; FTNHLRVSHADLG; TAMMRVSHADLGK;
NKLRVSHADLGKQ; KLRVSHADLGKQG; LRVSHADLGKQGV; RVSHADLGKQGVN;
VSHADLGKQGVND; SHADLGKQGVNDD; HADLGKQGVNDDD; ADLGKQGVNDDDA;
DLGKQGVNDDDAK; LGKQGVNDDDAKK; GKQGVNDDDAKKA; KQGVNDDLAKKAI;
QGVNDDLAKKAIL; GVNDDDAKKAILK; VNDDDAKKAILKT; NDDLAKKAILKTN;
DDLAKKAILKTNA; DEAKKAILKTNAD; DAKKAILKTNADK; AKKAILKTNADKT;
KKAILKTNADKTK; KAILKTNADKTKG; AILKTNADKTKGA; ILKTNADKTKGAE;
LKTNADKTKGAEE; KTNADKTKGAEEL; TNADKTKGAEELG; NADKTKGAEELGK;
ADKTKGAEELGKL; DKTKGAEELGKLF; KTKGAEELGKLFK; TKGAEELGKLFKS;
KGAEELGKLFKSV; GAEELGHLFKSVE; AEELGKLFKSVEG; EELGKLFKSVEGL;
ELGKLFKSVEGLV; LGKLFKSVEGLVK; GKLFKSVEGLVKA; KLFKSVEGLVKAA;
LFKSVEGLVKAAQ; FKSVEGLVKAAQE; KSVEGLVKAAQEA; SVEGLVKAAQEAL;
VEGLVKAAQEALT; EGLVKAAQEALTN; GLVKAAQEALTNS; LVKAAQEALTNSV;
VKAAQEALTNSVK; KAAQEALTNSVHE; AAQEALTNSVHEL; AQEALTNSVKELT;
QEALTNSVKELTS; EALTNSVHELTSP; ALTNSVHELTSPV; LTNSVKELTSPVV;
TNSVKELTSPVVA; NSVKELTSPVVAE; SVHELTSPVVAES; VKELTSPVVAESP;
KELTSPVVAESPK; ELTSPVVAESPKK; LTSPVVAESPKKP 14 mers:
MKKNTLSAILMTLF; KKNTLSAILMTLFM; KNTLSAILMTLFLF; AUMSAILMTLFLFT;
TLSAILMTLFLFIS; LSAILMTLFLFISC; SAILMTLFLFTSCN; AILMTLFLFISCNN;
ILMTLFLFISCNNS; LMTLFLFISCNNSG; MTLFLFTSCNNSGK; TLFLFISCNNSGKG;
LFLFISCNNSGKGG; FLFISCNNSGKGGD; LFTSCNNSGKGGDS; FISCNNSGKGDSA;
ISCNNSGKGGDSAS; SCNNSGKGGDSAST; CNNSGKGGDSASTN; NNSGKGGDSASTNP;
NSGKGGDSASTNPA; SGKGGDSASTNPAD; GKGGDSASTNPADE; KGGDSASTNPADES;
GGDSASTNPADESA; GDSASTNPADESAK; DSASTNPADESAKG; SASTNPADESAKGP;
ASTNPADESAKGPN; STNPADESAKGPNL; TNPADESAKGPNLT; ATADESAKGPNLTE;
PADESAKGPNLTEI; ADESAKGPNLTEIS; DESAKGPNLTEISK; ESAKGPNLTEISKK;
SANGTNLTEISKKI; AKGPNLTEISKKIT; KGPNLTEISKKITD; GPNLTEISKKITDS;
PNLTEISKKITDSN; NLTEISKKITDSNA; LTEISKKITDSNAF; TEISKKITDSNAFV;
EISKKITDSNAFVL; ISKKITDSNAFVLA; SKKITDSNAITLAV; KKITDSNAFVLAVK;
KITDSNAFVLAVKE; ITDSNAFVLAVKEV; TDSNAFVLAVKEVE; DSNAFVLAVKEVET;
SNAFVLAVKEVETL; NAFVLAVKEVETLV; AFVLAVKEVETLVS; FVLAVKEVETLVSS;
VLAVKEVETLVSSI; LAVKEVETLVSSID; AVHEVETLVSSIDE; VKEVETLVSSIDEL;
KEVETLVSSIDELA; EVETLVSSIDELAN; VETLVSSIDELANK; ETLVSSIDELANKA;
TLVSSIDELANKAI; LVSSIDELANKAIG; VSSIDELANKAIGK; SSIDELANKAIGKK;
SIDELANKAIGKKI; IDELANKAIGKKIQ; DELANKAIGKKIQQ; ELANKAIGKKIQQN;
LANKAIGKKIQQNG; ANKAIGKKIQQNGL; NKAIGKKIQQNGLG; KAIGKKIQQNGLGA;
AIGKKIQQNGLGAE; IGKKIQQNGLGAEA; GKKIQQNGLGAEAN; KKIQQNGLGAEANR;
KIQQNGLGAEANRN; IQQNGLGAEANRNE; QQNGLGAEAAMNES; QNGLGAEANRNESL;
NGLGAEANRNESLL; GLGAEANRNESLLA; LGAEANRNESLLAG; GAEANRNESLLAGV;
AEANRNESLLAGVH; EANRNESLLAGVHE; AAMNESLLAGVHEI; NRNESLLAGVHEIS;
RNESLLAGVHEIST; NESLLAGVHEISTL; ESLLAGVHEISTLI; SLLAGVHEISTLIT;
LLAGVHEISTLITE; LAGVHEISTLITEK; AGVHEISTLITEKL; GVHEISTLITEKLS;
VHEISTLITEKLSK; HEISTLITEKLSKL; EISTLITEKLSKLK; ISTLITEKLSKIEN;
STLITEKLSKLKNS; TLITEKLSKLKNSG; LITEKLSKLKNSGE; ITEKLSKLKNSGEL;
TEKLSKLKNSGELK; EKLSKLKNSGELKA; KLSKLKNSGELKAK; LSKLKNSGELKAKI;
SKLKNSGELKAKIE; KLKNSGELKAKIED; LKNSGELKAKIEDA; KNSGELKAKIEDAK;
NSGELKAKIEDAKK; SGELKAKIEDAKKC; GELKAKIEDAKKCS; ELKAKIEDAKKCSE;
LKAKIEDAKKCSEE; KAKIEDAKKCSEEF; AKIEDAKKCSEEFT; KIEDAKKCSEEFTN;
IEDAKKCSEEFTNK; EDAKKCSEEFTNKL; DAKKCSEEFTNKLR; AKKCSEEFTNHLRV;
KKCSEEFTNKLRVS; KCSEEFTNKLRVSH; CSEEFTNHLRVSHA; SEEFTNHLRVSHAD;
EEFTNKLRVSHADL; EFTNKLRVSHADLG; FTNHLRVSHADLGK; TNKLRVSHADLGKQ;
NKLRVSHADLGKQG; KLRVSHADLGKQGV; LRVSHADLGKQGVN; RVSHADLGKQGVND;
VSHADLGKQGVNDD; SHALEGKQGVNEED; HADLGKQGVNDDDA; ADLGKQGVNDDDAK;
DLGKQGVNDDDAKK; LGKQGVNDDLAKKA; GKQGVNDDLAKKAI; KQGVNDDLAKKAIL;
QGVNDDLAKKAILK; GVNDDLAKKAILKT; VNDDDAKKAILKTN; NDDDAKKAILKTNA;
DDLAKKAILKTNAD; Dnomflummuirgc; DAKKAILKTNADKT; AKKAILKTNADKTK;
KKAILKTNADKTKG; KAILKTNADKTKGA; AILKTNADKTKGAE; ILKTNADKTKGAEE;
LKTNADKTKGAEEL; KTNADKTKGAEELG; TNADKTKGAEELGK; NADKTKGAEELGKL;
ADKTKGAEELGKLF; DKTKGAEELGKLFK; KTKGAEELGKLFKS; TKGAEELGKLFKSV;

TABLE A-continued

Prediction of MHC class 1 and 2 *Borrelia afzelii* OspC peptide binders. Prediction of 8-, 9-, 10-, 11-, 13-, 14-, 15-, 16-mer peptides were generated using the program displayed in FIG. 2.

KGAEELGKLFKSVE; GAEELGKLFKSVEG; AEELGKLFKSVEGL; EELGKLFKSVEGLV;
ELGKLFKSVEGLVK; LGKLFKSVEGLVKA; GKLFKSVEGLVKAA; KLFKSVEGLVKAAQ;
LFKSVEGLVKAAQE; FKSVEGLVKAAQEA; KSVEGLVKAAQEAL; SVEGLVKAAQEALT;
VEGLVKAAQEALTN; EGLVKAAQEALTNS; GLVKAAQEALTNSV; LVKAAQEALTNSVK;
VKAAQEALTNSVKE; KAAQEALTNSVKEL; AAQEALTNSVKELT; AQEALTNSVKELTS;
QEALTNSVKELTSP; EALTNSVKELTSPV; ALTNSVKELTSPVV; LTNSVKELTSPVVA;
TNSVKELTSPVVAE; NSVKELTSPVVAES; SVKELTSPVVAESP; VKELTSPVVAESPK;
KELTSPVVAESPKK; ELTSPVVAESPKKP 15 mers:
MKKNTLSAILMTLFL; KKNTLSAILMTLFLF; KNTLSAILMTLFLFI; NTLSAILMTLFLFIS;
TLSAILMTLFLFISC; LSAILMTLFLFISCN; SAILMTLFLFISCNN; AILMTLFLFISCNNS;
ILMTLFLFISCNNSG; LMTLFLFISCNNSGK; MTLFLFISCNNSGKG; TLFLFISCNNSGKGG;
LFLFISCNNSGKGGD; FLFISCNNSGKGGDS; LFISCNNSGKGGDSA; FISCNNSGKGGDSAS;
ISCNNSGKGGDSAST; SCNNSGKGGDSASTN; CNNSGKGGDSASTNP; NNSGKGGDSASTNPA;
NSGKGGDSASTNPAD; SGKGGDSASTNPADE; GKGGDSASTNPADES; KGGDSASTNPADESA;
GGDSASTNPADESAK; GDSASTNPADESAKG; DSASTNPADESAKGP; SASTNPADESAKGPN;
ASTNPADESAKGPNL; STNPADESAKGPNLT; TNPADESAKGPNLTE; NPADESAKGPNLTEI;
PADESAKGPNLTEIS; ADESAKGPNLTEISK; DESAKGPNLTEISKK; ESAKGPNLTEISKKI;
SAKGPNLTEISKKIT; AKGPNLTEISKKITD; KGPNLTEISKKITDS; GPNLTEISKKITDSN;
PNLTEISKKITDSNA; NLTEISKKITDSNAF; LTEISKKITDSNAFV; TEISKKITDSNAFVL;
EISKKITDSNAFVLA; ISKKITDSNAFVLAV; SKKITDSNAFVLAVK; KKITDSNAFVLAVKE;
KITDSNAFVLAVKEV; ITDSNAFVLAVKEVE; TDSNAFVLAVKEVET; DSNAFVLAVKEVETL;
SNAFVLAVKEVETLV; NAFVLAVKEVETLVS; AFVLAVKEVETLVSS; FVLAVKEVETLVSSI;
VLAVKEVETLVSSID; LAVKEVETLVSSIDE; AVKEVETLVSSIDEL; VKEVETLVSSIDELA;
KEVETLVSSIDELAN; EVETLVSSIDELANK; VETLVSSIDELANKA; ETLVSSIDELANKAI;
TLVSSIDELANKAIG; LVSSIDELANKAIGK; VSSIDELANKAIGKK; SSIDELANKAIGKKI;
SIDELANKAIGKKIQ; IDELANKAIGKKIQQ; DELANKAIGKKIQQN; ELANKAIGKKIQQNG;
LANKAIGKKIQQNGL; ANKAIGKKIQQNGLG; NKAIGKKIQQNGLGA; KAIGKKIQQNGLGAE;
AIGKKIQQNGLGAEA; IGKKIQQNGLGAEAN; GKKIQQNGLGAEANR; KKIQQNGLGAEANRN;
KIQQNGLGAEANRNE; IQQNGLGAEANRNES; QQNGLGAEANRNESL; QNGLGAEANRNESLL;
NGLGAEANRNESLLA; GLGAEANRNESLLAG; LGAEANRNESLLAGV; GAEANRNESLLAGVH;
AEANRNESLLAGVHE; EANRNESLLAGVHEI; ANRNESLLAGVHEIS; NRNESLLAGVHEIST;
RNESLLAGVHEISTL; NESLLAGVHEISTLI; ESLLAGVHEISTLIT; SLLAGVHEISTLITE;
LLAGVHEISTLITEK; LAGVHEISTLITEKL; AGVHEISTLITEKLS; GVHEISTLITEKLSK;
VHEISTLITEKLSKL; HEISTLITEKLSKLK; EISTLITEKLSKLKN; ISTLITEKLSKLKNS;
STLITEKLSKLKNSG; TLITEKLSKLKNSGE; LITEKLSKLKNSGEL; ITEKLSKLKNSGELK;
TEKLSKLKNSGELKA; EKLSKLKNSGELKAK; KLSKLKNSGELKAKI; LSKLKNSGELKAKIE;
SKLKNSGELKAKIED; KLKNSGELKAKIEDA; LKNSGELKAKIEDAK; KNSGELKAKIEDAKK;
NSGELKAKIEDAKKC; SGELKAKIEDAKKCS; GELKAKIEDAKKCSE; ELKAKIEDAKKCSEE;
LKAKIEDAKKCSEEF; KAKIEDAKKCSEEFT; AKIEDAKKCSEEFTN; KIEDAKKCSEEFTNK;
IEDAKKCSEEFTNKL; EDAKKCSEEFTNKLR; DAKKCSEEFTNKLRV; AKKCSEEFTNKLRVS;
KKCSEEFTNKLRVSH; KCSEEFTNKLRVSHA; CSEEFTNKLRVSHAD; SEEFTNKLRVSHADL;
EEFTNKLRVSHADLG; EFTNKLRVSHADLGK; FTNKLRVSHADLGKQ; TNKLRVSHADLGKQG;
NKLRVSHADLGKQGV; KLRVSHADLGKQGVN; LRVSHADLGKQGVND; RVSHADLGKQGVNDD;
VSHADLGKQGVNDDD; SHADLGKQGVNDDDA; HADLGKQGVNDDDAK; ADLGKQGVNDDDAKK;
DLGKQGVNDDDAKKA; LGKQGVNDDDAKKAI; GKQGVNDDDAKKAIL; KQGVNDDDAKKAILK;
QGVNDDDAKKAILKT; GVNDDDAKKAILKTN; VNDDDAKKAILKTNA; NDDDAKKAILKTNAD;
DDDAKKAILKTNADK; DDAKKAILKTNADKT; DAKKAILKTNADKTK; AKKAILKTNADKTKG;
KKAILKTNADKTKGA; KAILKTNADKTKGAE; AILKTNADKTKGAEE; ILKTNADKTKGAEEL;
LKTNADKTKGAEELG; KTNADKTKGAEELGK; TNADKTKGAEELGKL; NADKTKGAEELGKLF;
ADKTKGAEELGKLFK; DKTKGAEELGKLFKS; KTKGAEELGKLFKSV; TKGAEELGKLFKSVE;
KGAEELGKLFKSVEG; GAEELGKLFKSVEGL; AEELGKLFKSVEGLV; EELGKLFKSVEGLVK;
ELGKLFKSVEGLVKA; LGKLFKSVEGLVKAA; GKLFKSVEGLVKAAQ; KLFKSVEGLVKAAQE;
LFKSVEGLVKAAQEA; FKSVEGLVKAAQEAL; KSVEGLVKAAQEALT; SVEGLVKAAQEALTN;
VEGLVKAAQEALTNS; EGLVKAAQEALTNSV; GLVKAAQEALTNSVK; LVKAAQEALTNSVKE;
VKAAQEALTNSVKEL; KAAQEALTNSVKELT; AAQEALTNSVKELTS; AQEALTNSVKELTSP;
QEALTNSVKELTSPV; EALTNSVKELTSPVV; ALTNSVKELTSPVVA; LTNSVKELTSPVVAE;
TNSVKELTSPVVAES; NSVKELTSPVVAESP; SVKELTSPVVAESPK; VKELTSPVVAESPKK;
KELTSPVVAESPKKP 16 mers:
MKKNTLSAILMTLFLF; KKNTLSAILMTLFLFI; KNTLSAILMTLFLFIS;
NTLSAILMTLFLFISC; TLSAILMTLFLFISCN; LSAILMTLFLFISCNN;
SAILMTLFLFISCNNS; AILMTLFLFISCNNSG; ILMTLFLFISCNNSGK;
LMTLFLFISCNNSGKG; MTLFLFISCNNSGKGG; TLFLFISCNNSGKGGD;
LFLFISCNNSGKGGDS; FLFISCNNSGKGGDSA; LFISCNNSGKGGDSAS;
FISCNNSGKGGDSAST; ISCNNSGKGGDSASTN; SCNNSGKGGDSASTNP;
CNNSGKGGDSASTNPA; NNSGKGGDSASTNPAD; NSGKGGDSASTNPADE;
SGKGGDSASTNPADES; GKGGDSASTNPADESA; KGGDSASTNPADESAK;
GGDSASTNPADESAKG; GDSASTNPADESAKGP; DSASTNPADESAKGPN;
SASTNPADESAKGPNL; ASTNPADESAKGPNLT; STNPADESAKGPNLTE;
TNPADESAKGPNLTEI; NPADESAKGPNLTEIS; PADESAKGPNLTEISK;
ADESAKGPNLTEISKK; DESAKGPNLTEISKKI; ESAKGPNLTEISKKIT;
SAKGPNLTEISKKITD; AKGPNLTEISKKITDS; KGPNLTEISKKITDSN;

TABLE A-continued

Prediction of MHC class 1 and 2 *Borrelia afzelii* OspC peptide binders. Prediction of 8-, 9-, 10-, 11-, 13-, 14-, 15-, 16-mer peptides were generated using the program displayed in FIG. 2.

GPNLTEISKKITDSNA; PNLTEISKKITDSNAF; NLTEISKKITDSNAFV;
LTEISKKITDSNAFVL; TEISKKITDSNAFVLA; EISKKITDSNAFVLAV;
ISKKITDSNAFVLAVK; SKKITDSNAFVLAVKE; KKITDSNAFVLAVKEV;
KITDSNAFVLAVKEVE; ITDSNAFVLAVKEVET; TDSNAFVLAVKEVETL;
DSNAFVLAVKEVETLV; SNAFVLAVKEVETLVS; NAFVLAVKEVETLVSS;
AFVLAVKEVETLVSSI; FVLAVKEVETLVSSID; VLAVKEVETLVSSIDE;
LAVKEVETLVSSIDEL; AVKEVETLVSSIDELA; VKEVETLVSSIDELAN;
KEVETLVSSIDELANK; EVETLVSSIDELANKA; VETLVSSIDELANKAI;
ETLVSSIDELANKAIG; TLVSSIDELANKAIGK; LVSSIDELANKAIGKK;
VSSIDELANKAIGKKI; SSIDELANKAIGKKIQ; SIDELANKAIGKKIQQ;
IDELANKAIGKKIQQN; DELANKAIGKKIQQNG; ELANKAIGKKIQQNGL;
LANKAIGKKIQQNGLG; ANKAIGKKIQQNGLGA; NKAIGKKIQQNGLGAE;
KAIGKKIQQNGLGAEA; AIGKKIQQNGLGAEAN; IGKKIQQNGLGAEANR;
GKKIQQNGLGAEANRN; KKIQQNGLGAEANRNE; KIQQNGLGAEANRNES;
IQQNGLGAEANRNESL; QQNGLGAEANRNESLL; QNGLGAEANRNESLLA;
NGLGAEANRNESLLAG; GLGAEANRNESLLAGV; LGAEANRNESLLAGVH;
GAEANRNESLLAGVHE; AEANRNESLLAGVHEI; EANRNESLLAGVHEIS;
ANRNESLLAGVHEIST; NRNESLLAGVHEISTL; RNESLLAGVHEISTLI;
NESLLAGVHEISTLIT; ESLLAGVHEISTLITE; SLLAGVHEISTLITEK;
LLAGVHEISTLITEKL; LAGVHEISTLITEKLS; AGVHEISTLITEKLSK;
GVHEISTLITEKLSKL; VHEISTLITEKLSKLK; HEISTLITEKLSKLKN;
EISTLITEKLSKLKNS; ISTLITEKLSKLKNSG; STLITEKLSKLKNSGE;
TLITEKLSKLKNSGEL; LITEKLSKLKNSGELK; ITEKLSKLKNSGELKA;
TEKLSKLKNSGELKAK; EKLSKLKNSGELKAKI; KLSKLKNSGELKAKIE;
LSKLKNSGELKAKIED; SKLKNSGELKAKIEDA; KLKNSGELKAKIEDAK;
LKNSGELKAKIEDAKK; KNSGELKAKIEDAKKC; NSGELKAKIEDAKKCS;
SGELKAKIEDAKKCSE; GELKAKIEDAKKCSEE; ELKAKIEDAKKCSEEF;
LKAKIEDAKKCSEEFT; KAKIEDAKKCSEEFTN; AKIEDAKKCSEEFTNK;
KIEDAKKCSEEFTNKL; IEDAKKCSEEFTNKLR; EDAKKCSEEFTNKLRV;
DAKKCSEEFTNKLRVS; AKKCSEEFTNKLRVSH; KKCSEEFTNKLRVSHA;
KCSEEFTNKLRVSHAD; CSEEFTNKLRVSHADL; SEEFTNKLRVSHADLG;
EEFTNKLRVSHADLGK; EFTNKLRVSHADLGKQ; FTNKLRVSHADLGKQG;
TNKLRVSHADLGKQGV; NKLRVSHADLGKQGVN; KLRVSHADLGKQGVND;
LRVSHADLGKQGVNDD; RVSHADLGKQGVNDDD; VSHADLGKQGVNDDDA;
SHADLGKQGVNDDDAK; HADLGKQGVNDDDAKK; ADLGKQGVNDDDAKKA;
DLGKQGVNDDDAKKAI; LGKQGVNDDDAKKAIL; GKQGVNDDDAKKAILK;
KQGVNDDDAKKAILKT; QGVNDDDAKKAILKTN; GVNDDDAKKAILKTNA;
VNDDDAKKAILKTNAD; NDDDAKKAILKTNADK; DDDAKKAILKTNADKT;
DDAKKAILKTNADKTK; DAKKAILKTNADKTKG; AKKAILKTNADKTKGA;
KKAILKTNADKTKGAE; KAILKTNADKTKGAEE; AILKTNADKTKGAEEL;
ILKTNADKTKGAEELG; LKTNADKTKGAEELGK; KTNADKTKGAEELGKL;
TNADKTKGAEELGKLF; NADKTKGAEELGKLFK; ADKTKGAEELGKLFKS;
DKTKGAEELGKLFKSV; KTKGAEELGKLFKSVE; TKGAEELGKLFKSVEG;
KGAEELGKLFKSVEGL; GAEELGKLFKSVEGLV; AEELGKLFKSVEGLVK;
EELGKLFKSVEGLVKA; ELGKLFKSVEGLVKAA; LGKLFKSVEGLVKAAQ;
GKLFKSVEGLVKAAQE; KLFKSVEGLVKAAQEA; LFKSVEGLVKAAQEAL;
FKSVEGLVKAAQEALT; KSVEGLVKAAQEALTN; SVEGLVKAAQEALTNS;
VEGLVKAAQEALTNSV; EGLVKAAQEALTNSVK; GLVKAAQEALTNSVKE;
LVKAAQEALTNSVKEL; VKAAQEALTNSVKELT; KAAQEALTNSVKELTS;
AAQEALTNSVKELTSP; AQEALTNSVKELTSPV; QEALTNSVKELTSPVV;
EALTNSVKELTSPVVA; ALTNSVKELTSPVVAE; LTNSVKELTSPVVAES;
TNSVKELTSPVVAESP; NSVKELTSPVVAESPK; SVKELTSPVVAESPKK;
VKELTSPVVAESPKKP

Preferred *Borrelia burgdorferi* fragments of Osp A capable of interacting with one or more MHC molecules are listed in Table B.

TABLE B

Prediction of *Borrelia burgdorferi* OspA protein specific MHC class 1, 8-, 9-,10-, 11-mer peptide binders for 24 MHC class 1 alleles (see FIG. 10) using the www.cbs.dtu.dk/services/NetMHC/ database. The MHC class 1 molecules for which no binders were found are not listed.

| | | |
|---|---|---|
| CAA44492.1\| Outer surface protein A [*Borrelia burgdorferi*] SEQ ID NO: 9 SEQ ID NOS: 179139-179392 | HLA-A0101 | |
| | HLA-A0201 | YLLGIGLIL |
| | | FTLEGTLAA |
| | | KTSTLTISV |
| | | FTKEDTITV |
| | | ALIACKQNV |
| | | LLGIGLILA |
| | | SLEATVDKL |
| | | ILKSGEITV |
| | | KVTEGTVVL |
| | | STLDEKNSV |
| | | TLVSKKVTL |
| | | GIGLILALI |
| | | YLLGIGLILA |
| | | TLDEKNSVSV |
| | | ALDDSDTTQA |
| | | LLGIGLILAL |
| | | NILKSGEITV |
| | | TLAADGKTTL |
| | | VLKDFTLEGT |
| | | YSLEATVDKL |
| | | YLLGIGLILAL |
| | | LVFTKEDTITV |
| | | LLGIGLILALI |
| | | ILALIACKQNV |
| | | STLDEKNSVSV |
| | | ALDDSDTTQAT |
| | | VLKDFTLEGTL |
| | | SLEATVDKLEL |
| | | ILKSGEITVAL |
| | | ALIACKQNVST |
| | | TTLKVTEGTVV |
| | | LAADGKTTLKV |
| | | LIACKQNVSTL |
| | HLA-A0301 | VVLSKNILK |
| | | KTKNLVFTK |
| | | LVSKKVTLK |
| | | LILALIACK |
| | | LTISVNSQK |
| | | KAVEITTLK |
| | | AADGKTTLK |
| | | ISVNSQKTK |
| | | RANGTRLEY |
| | | SQTKFEIFK |
| | | KSDGSGKAK |
| | | TQATKKTGK |
| | | MTELVSKEK |
| | | TLVSKKVTLK |
| | | TLTISVNSQK |
| | | TVVLSKNILK |
| | | GLILALIACK |
| | | TLKELKNALK |
| | | LSQTKFEIFK |
| | | LAADGKTTLK |
| | | VTEGTVVLSK |
| | | KLELKGTSDK |
| | | TTQATKKTGK |
| | | GMTELVSKEK |
| | | KYSLEATVDK |
| | | KQNVSTLDEK |
| | | TIADDLSQTK |
| | | TISVNSQKTK |
| | | KEDAKTLVSK |
| | | GSGKAKEVLK |
| | | KTIVRANGTR |
| | | GTLEGEKTDK |
| | | GKAVEITTLK |
| | | GTRLEYTDIK |
| | | VSKKVTLKDK |
| | | IKSDGSGKAK |
| | | TLAADGKTTLK |
| | | STLTISVNSQK |
| | | KTLVSKKVTLK |
| | | KVTEGTVVLSK |
| | | TTLKELKNALK |
| | | LTISVNSQKTK |
| | | GTVVLSKNILK |
| | | FTKEDTITVQK |
| | | IVRANGTRLEY |
| | | TLKDKSSTEEK |
| | | LVSKKVTLKDK |
| | | KFNEKGETSEK |
| | | LTIADDLSQTK |
| | | SQKTKNLVFTK |
| | | KSSTEEKFNEK |
| | | ATKKTGKWDSK |
| | HLA-A1101 | VVLSKNILK |
| | | KTKNLVFTK |
| | | SQTKFEIFK |
| | | LTISVNSQK |
| | | ATVDKLELK |
| | | LILALTACK |
| | | STEEKFNEK |
| | | KAVEITTLK |
| | | LVSKKVTLK |
| | | MTELVSKEK |
| | | AADGKTTLK |
| | | SAGTNLEGK |
| | | YSLEATVDK |
| | | GSGTLEGEK |
| | | TQATKKTGK |
| | | RANGTRLEY |
| | | IADDLSQTK |
| | | ISVNSQKTK |
| | | KSDGSGKAK |
| | | GGMTELVSK |
| | | TEGTVVLSK |
| | | EITTLKELK |
| | | TIVRANGTR |
| | | TVVLSKNILK |
| | | TTQATKKTGK |
| | | TIADDLSQTK |
| | | VTEGTVVLSK |
| | | LSQTKFEIFK |
| | | SSTEEKFNEK |
| | | GLILALIACK |
| | | KQNVSTLDEK |
| | | TLTISVNSQK |
| | | TLVSKKVTLK |
| | | TISVNSQKTK |
| | | LAADGKTTLK |
| | | GMTELVSKEK |
| | | TLKELKNALK |
| | | KTIVRANGTR |
| | | GSGKAKEVLK |
| | | GTLEGEKTDK |
| | | VSKKVTLKDK |
| | | GTRLEYTDIK |
| | | KLELKGTSDK |
| | | DSAGTNLEGK |
| | | STLTISVNSQK |
| | | TTLKELKNALK |
| | | KVTEGTVVLSK |
| | | KTLVSKKVTLK |
| | | GTVVLSKNILK |
| | | LTIADDLSQTK |
| | | TLAADGKTTLK |
| | | AVEITTLKELK |
| | | LTISVNSQKTK |

TABLE B-continued

Prediction of *Borrelia burgdorferi* OspA protein specific MHC class 1, 8-, 9-, 10-, 11-mer peptide binders for 24 MHC class 1 alleles (see FIG. 10) using the www.cbs.dtu.dk/services/NetMHC/ database. The MHC class 1 molecules for which no binders were found are not listed.

|  |  |
|---|---|
|  | SQKTKNLVFTK |
|  | KSSTEEKFNEK |
|  | ATKKTGKWDSK |
|  | TLKDKSSTEEK |
|  | FTKEDTITVQK |
|  | TLEGTLAADGK |
|  | LVSKKVTLKDK |
|  | MTELVSKEKDK |
|  | DLSQTKFEIFK |
|  | YTDIKSDGSGK |
|  | LVSKEKDKDGK |
|  | KFNEKGETSEK |
|  | IGLILALIACK |
| HLA-A2402 | KYLLGIGLI |
|  | KWDSKTSTL |
|  | KYDSAGTNL |
|  | KYLLGIGLIL |
|  | KWDSKTSTLTI |
|  | KYSLEATVDKL |
| HLA-A2902 | IVRANGTRLEY |
|  | TIADDLSQTKF |
| HLA-A6801 | LTISVNSQK |
|  | ETSEKTIVR |
|  | MTELVSKEK |
|  | EITTLKELK |
|  | TIVRANGTR |
|  | KAVEITTLK |
|  | DAKTLVSKK |
|  | KTKNLVFTK |
|  | STEEKFNEK |
|  | ATVDKLELK |
|  | LVSKKVTLK |
|  | SQTKFEIFK |
|  | YSLEATVDK |
|  | EGTLAADGK |
|  | ISVNSQKTK |
|  | LILALIACK |
|  | DIKSDGSGK |
|  | VVLSKNILK |
|  | EDAKTLVSK |
|  | DSDTTQATK |
|  | SAGTNLEGK |
|  | TVVLSKNILK |
|  | TLTISVNSQK |
|  | EATVDKLELK |
|  | TIADDLSQTK |
|  | DSAGTNLEGK |
|  | TTQATKKTGK |
|  | LAADGKTTLK |
|  | KTIVRANGTR |
|  | TISVNSQKTK |
|  | TLVSKKVTLK |
|  | SSTEEKFNEK |
|  | TLKELKNALK |
|  | LSQTKFEIFK |
|  | VTEGTVVLSK |
|  | EDAKTLVSKK |
|  | DSDTTQATKK |
|  | GLILALTACK |
| HLA-B0702 | IVRANGTRL |
|  | KVTEGTVVL |
|  | LAADGKTTL |
|  | LPGGMTELV |
|  | TVVLSKNIL |
|  | KAVEITTLKEL |
| HLA-B0801 | TLKELKNAL |
|  | ILKSGEITVAL |
|  | YLLGIGLILAL |
|  | TLKVTEGTVVL |
| HLA-B1501 | SQKTKNLVF |
|  | RANGTRLEY |
|  | YLLGIGLIL |
|  | KVTEGTVVL |
|  | TLKELKNAL |
|  | KAKEVLKDF |
|  | IVRANGTRL |
|  | LGIGLILAL |
|  | TLAADGKTTL |
|  | IVRANGTRLEY |
|  | YLLGIGLILAL |
|  | VQKYDSAGTNL |
|  | ILKSGEITVAL |
|  | VSKEKDKDGKY |
|  | VLKDFTLEGTL |
|  | TLKVTEGTVVL |
|  | VNSQKTKNLVF |
| HLA-B2705 | KKYLLGIGL |
|  | VRANGTRLEY |
|  | GKWDSKTSTL |
|  | KKYLLGIGLIL |
| HLA-B3501 | LAADGKTTL |
|  | RANGTRLEY |
|  | FTLEGTLAA |
|  | TVVLSKNIL |
|  | VALDDSDTT |
|  | YLLGIGLIL |
|  | LPGGMTELV |
|  | IADDLSQTKE |
|  | LPGGMTELVS |
|  | LKVTEGTVVL |
|  | YSLEATVDKL |
|  | YLLGIGLILAL |
|  | NSVSVDLPGGM |
|  | IVRANGTRLEY |
|  | TIADDLSQTKF |
|  | KAVEITTLKEL |
| HLA-B4403 | KEVLKDFTL |
|  | GEITVALDD |
|  | KEKDKDGKY |
|  | KEDAKTLVS |
|  | GEITVALDDS |
|  | KEDTITVQKY |
|  | GEITVALDDSD |
|  | KEVLKDFTLEG |
| HLA-B5101 | LPGGMTELV |
| HLA-B5701 | TTQATKKTGKW |

Preferred *Borrelia garinii* fragments of FlaB capable of interacting with one or more MHC molecules are listed in Table C.

TABLE C

Prediction of *Borrelia garinii* FlaB protein specific MHC class 2, 15-mer peptide binders for 14 MHC class 2 alleles (see FIG. 10) using the www.cbs.dtu.dk/services/NetMHCII/ database. The MHC class 2 molecules for which no binders were found are not listed.

| BAD18055.1 FlaB protein [*Borrelia garinii*] SEQ ID NO: 15 | HLA-A0101 | NQDEAIAVNIY ELAVQSGNGTY |
|---|---|---|
|  | HLA-A0201 | SQASWTLRV QLTDEINRI |
|  |  | AQAAQTAPV |
| SEQ ID NOS:179393- 179552 |  | AIAVNIYAA SLAKIENAI |
|  |  | AVNIYAANV |
|  |  | AQYNQMHML |
|  |  | TTVDANTSL |
|  |  | SQGGVNSPV |
|  |  | QTAPVQEGV |

TABLE C-continued

Prediction of *Borrelia garinii* FlaB protein specific MHC class 2, 15-mer peptide binders for 14 MHC class 2 alleles (see FIG. 10) using thewww.cbs.dtu.dk/services/NetMHCII/ database. The MHC class 2 molecules for which no binders were found are not listed.

|  |  |
|---|---|
|  | NIYAANVANL |
|  | NLNEVEKVLV |
|  | VLVRMKELAV |
|  | QLTDEINRIA |
|  | NLFSGEGAQA |
|  | IAVNIYAANV |
|  | SLSGSQASWTL |
|  | MLSNKSASQNV |
|  | AIAVNIYAANV |
|  | SQASWTLRVHV |
|  | GMQPAKINTPA |
|  | KVLVRMKELAV |
|  | SLAKIENAIRM |
|  | NLFSGEGAQAA |
| HLA-A0301 | NQMHMLSNK |
|  | GSQASWTLR |
|  | TVDANTSLAK |
|  | YNQMHMLSNK |
|  | LSGSQASWTLR |
|  | TTVDANTSLAK |
|  | LSNKSASQNVR |
| HLA-A1101 | NQMHMLSNK |
|  | GSQASWTLR |
|  | AVQSGNGTY |
|  | TVDANTSLAK |
|  | YNQMHMLSNK |
|  | EVEKVLVRMK |
|  | TTVDANTSLAK |
|  | TTEGNLNEVEK |
|  | TAEELGMQPAK |
|  | TSLAKIENAIR |
|  | QYNQMHMLSNK |
|  | LSGSQASWTLR |
|  | LSNKSASQNVR |
| HLA-A2402 | IYAANVANL |
|  | YAANVANLF |
|  | IYAANVANLF |
|  | TYSDADRGSI |
|  | IYAANVANLFS |
| HLA-A2902 | AVQSGNGTY |
|  | YAANVANLF |
|  | ELAVQSGNGTY |
|  | EINRIADQAQY |
| HLA-A6801 | LAKIENAIR |
|  | EGNLNEVEK |
|  | YAANVANLF |
|  | NGTYSDADR |
|  | GSQASWTLR |
|  | NQMHMLSNK |
|  | TSKAINFIQ |
|  | NKSASQNVR |
|  | EVEKVLVRMK |
|  | SLAKIENAIR |
|  | TVDANTSLAK |
|  | NTSKAINFIQ |
|  | SGSQASWTLR |
|  | TTVDANTSLA |
|  | TTVDANTSLAK |
|  | TTEGNLNEVEK |
|  | EIEQLTDEINR |
|  | LSNKSASQNVR |
|  | TSLAKIENAIR |
|  | EINRIADQAQY |
|  | NLNEVEKVLVR |
|  | LSGSQASWTLR |
|  | TAEELGMQPAK |
|  | QYNQMHMLSNK |
|  | NIYAANVANLF |
|  | QTAPVQEGVQQ |
| HLA-B0702 | SPVNVTTTV |
|  | QPAKINTPA |
|  | QPAPATAPS |
|  | LVRMKELAV |
|  | TPASLSGSQ |
|  | APSQGGVNS |
|  | APATAPSQG |
|  | APVQEGVQQ |
|  | TPASLSGSQA |
|  | SPVNVTTTVD |
|  | APSQGGVNSP |
|  | QPAKINTPAS |
|  | APSQGGVNSPV |
|  | QPAKINTPASL |
|  | APATAPSQGGV |
|  | SPVNVTTTVDA |
|  | TPASLSGSQAS |
| HLA-B0801 | KVLVRMKEL |
|  | VEKVLVRMKEL |
| HLA-B1501 | YAANVANLF |
|  | AVQSGNGTY |
|  | AQAAQTAPV |
|  | AQYNQMHML |
|  | SQGGVNSPV |
|  | SLSGSQASW |
|  | SQASWTLRV |
|  | IQIEIEQLT |
|  | LAVQSGNGTY |
|  | SQASWTLRVH |
|  | SQNVRTAEEL |
|  | VQQEGAQQPA |
|  | INRIADQAQY |
|  | AQAAQTAPVQ |
|  | MQPAKINTPA |
|  | ELAVQSGNGTY |
|  | NIYAANVANLF |
|  | NQDEAIAVNIY |
|  | SLSGSQASWTL |
| HLA-B2705 | NRIADQAQY |
| HLA-B3501 | YAANVANLF |
|  | QPAPATAPS |
|  | SPVNVTTTV |
|  | DEAIAVNIY |
|  | TTVDANTSL |
|  | LAVQSGNGT |
|  | QPAKINTPA |
|  | AVQSGNGTY |
|  | QASWTLRVH |
|  | IAVNIYAAN |
|  | LAVQSGNGTY |
|  | IADQAQYNQM |
|  | QPAKINTPAS |
|  | LAKIENAIRM |
|  | QPAPATAPSQ |
|  | YAANVANLFS |
|  | TAEELGMQPA |
|  | EAIAVNIYAA |
|  | QAQYNQMHML |
|  | TPASLSGSQA |
|  | SPVNVTTTVD |
|  | TPASLSGSQAS |
|  | ELAVQSGNGTY |
|  | NQDEAIAVNIY |
|  | QPAKINTPASL |
|  | IAVNIYAANVA |
|  | NIYAANVANLF |
|  | SPVNVTTTVDA |
|  | EINRIADQAQY |
|  | IADQAQYNQMH |
|  | APSQGGVNSPV |
|  | LAVQSGNGTYS |
| HLA-B4403 | EELGMQPAKI |
|  | NEVEKVLVRM |
|  | DEINRIADQA |
|  | DEINRIADQAQ |

TABLE C-continued

Prediction of *Borrelia garinii* FlaB protein
specific MHC class 2, 15-mer peptide
binders for 14 MHC class 2 alleles (see FIG. 10)
using thewww.cbs.dtu.dk/services/NetMHCII/
database. The MHC class 2 molecules for which
no binders were found are not listed.

| | |
|---|---|
| HLA-B5101 | SPVNVTTTV |
| | APATAPSQGGV |
| | APSQGGVNSPV |
| HLA-B5701 | ASLSGSQASW |

Choice of MHC Allele for Generation of MHC Monomers and MHC Multimers

More than 600 MHC alleles (class 1 and 2) are known in humans; for many of these, the peptide binding characteristics are known. FIG. 3 presents an updated list of the HLA class 1 alleles. The frequency of the different HLA alleles varies considerably, also between different ethnic groups (FIG. 4). Thus it is of outmost importance to carefully select the MHC alleles that corresponds to the population that one wish to study.

The Combined Choice of Peptide, MHC and Carrier.

Above it has been described how to generate binding peptides, and which MHC alleles are available. Below it is further described how one may modify the binding peptides in order to increase the stability, affinity, specificity and other features of the MHC-peptide complex or the MHC multimer. In the following it is described what characteristics of binding peptides and MHC alleles are important when using the MHC-peptide complex or MHC-multimer for different purposes.

A first preferred embodiment employs binding peptides of particularly high affinity for the MHC proteins. This may be done in order to increase the stability of the MHC-peptide complex. A higher affinity of the binding peptide for the MHC proteins may in some instances also result in increased rigidity of the MHC-peptide complex, which in turn often will result in higher affinity and/or specificity of the MHC-peptide complex for the T-cell receptor. A higher affinity and specificity will in turn have consequences for the immunogenicity and allergenicity, as well as possible side-effects of the MHC-peptide complex in e.g. the body.

Binding peptides of particularly high affinity for the MHC proteins may be identified by several means, including the following.

Incubation of candidate binding peptides and MHC proteins, followed by analysis of the resulting complexes to identify those binding peptides that have most frequently been associated with MHC proteins. The binding peptides that have most frequently been associated with MHC proteins typically will represent high-affinity binding peptides. The identification of binding peptides with particularly high-affinity may involve enrichment of binding peptides, e.g. incubation of candidate peptides with immobilized MHC molecules, removal of non-binding peptides by e.g. washing, elution of binding peptides. This pool of peptides enriched for binding to the chosen MHC molecules may then be identified e.g. by mass spectrometry or HPLC and amino acid sequencing or the pool can be further enriched by another round of incubation with immobilized MHC.

Candidate binding peptides may be compared to consensus sequences for the binding to a specific MHC allele. Thus, for a given class 1 allele, the consensus 8'mer sequence may be given by the sequence "$X_1$-$X_2$-$X_3$-$X_4$-$X_5$-$X_6$-$X_7$-$X_8$", where each of the $X_1$-$X_8$ amino acids can be chosen from a specific subset of amino acids, as described above.

Those binding peptides that correlate the best with the consensus sequence are expected to have particularly high affinity for the MHC allele in question.

Based on a large data set of affinities of binding peptides for specific MHC alleles, software programs (often involving neural networks) have been developed that allow a relatively accurate prediction of the affinity of a given candidate binding peptide for a given MHC allele. By examining candidate binding peptides using such software programs, one can identify binding peptides of expected high-affinity for the MHC molecule.

A second preferred embodiment employs binding peptides with medium affinity for the MHC molecule. A medium affinity of the peptide for the MHC protein will often lead to lower physical and chemical stability of the MHC-peptide complex, which can be an advantage for certain applications. As an example, it is often desirable to administer a drug on a daily basis due to convenience. An MHC-peptide complex-based drug with high stability in the body would not allow this. In contrast a binding peptide with medium or low affinity for the MHC protein can be an advantage for such applications, since these functional MHC-peptide molecules will be cleared more rapidly from the body due to their lower stability.

For some applications where some level of cross-talk is desired, e.g. in applications where the target is a number of T cell clones that interact with a number of structurally related MHC-peptide complexes, e.g. MHC-peptide complexes containing binding peptides from different strains of a given species, a medium or low affinity of the binding peptide for the MHC protein can be an advantage. Thus, these MHC-peptide complexes are often more structurally flexible, allowing the MHC-peptide complexes to interact with several structurally related TCRs.

The affinity of a given peptide for a MHC protein, predicted by a software program or by its similarity to a consensus sequence, should only be considered a guideline to its real affinity. Moreover, the affinity can vary a lot depending on the conditions in the environment, e.g. the affinity in blood may be very different from the affinity in a biochemical assay. Further, in the context of a MHC multimer, the flexibility of the MHC-peptide complex can sometimes be an important parameter for overall avidity.

In summary, a lot of factors must be considered for the choice of binding peptides in a certain application. Some applications benefit from the use of all possible binding peptides for an antigen ("total approach"), other applications benefit from the selective choice of just a few binding peptides. Depending on the application, the affinity of the binding peptide for MHC protein is preferably high, medium, or low; the physical and/or chemical stability of the MHC-peptide complex is preferably high, medium or low; the binding peptide is preferably a very common or very rare epitope in a given population; etc.

It is obvious from the above preferred embodiments that most or all of the binding peptides generated by the total approach have important applications. In other words, in order to make relevant MHC multimers that suit the different applications with regard to e.g. personalized or general targeting, or with regard to affinity, avidity, specificity, immunogenicity, stimulatory efficiency, or stability, one must be able to choose from the whole set of binding peptides generated by the total approach Loading of the Peptide into the MHC Multimer Loading of the peptides into the MHCmer being either MHC class 1 or class 2 can be performed in a number of ways depending on the source of the peptide and the MHC, and depending on the application. MHC class 2 molecules can in principle be loaded with peptides in similar ways as MHC class 1. However, due to complex instability the most successful approach have been to make the complexes recombinant in toto in eukaryotic cells from a gene construct encoding the following form (3 chain-flexible linker-α chain-flexible linker-antigenic peptide.

The antigenic peptide may be added to the other peptide chain(s) at different times and in different forms, as follows.

a) Loading of Antigenic Peptide During MHC Complex Folding a1) Antigenic Peptide is Added as a Free Peptide MHC class I molecules are most often loaded with peptide during assembly in vitro by the individual components in a folding reaction i.e. consisting of purified recombinant heavy chain α with the purified recombinant β2 microglobulin and a peptide or a peptide mix.

a2) Antigenic Peptide is Part of a Recombinant Protein Construct

Alternatively the peptide to be folded into the binding groove can be encoded together with e.g. the α heavy chain or fragment hereof by a gene construct having the structure, heavy chain-flexible linker- peptide. This recombinant molecule is then folded in vitro with β2-microglobulin.

b) Antigenic Peptide Replaces Another Antigenic Peptide by an Exchange Reaction.

b1) Exchange Reaction "in Solution"

Loading of desired peptide can also be made by an in vitro exchange reaction where a peptide already in place in the binding groove are being exchanged by another peptide species.

b2) Exchange Reaction "In Situ"

Peptide exchange reactions can also take place when the parent molecule is attached to other molecules, structures, surfaces, artificial or natural membranes and nano-particles.

b3) Aided Exchange Reaction.

This method can be refined by making the parent construct with a peptide containing a meta-stable amino acid analog that is split by either light or chemically induction thereby leaving the parent structure free for access of the desired peptide in the binding groove.

b4) Display by In Vivo Loading

Loading of MHC class I and II molecules expressed on the cell surface with the desired peptides can be performed by an exchange reaction. Alternatively cells can be transfected by the peptides themselves or by the mother proteins that are then being processed leading to an in vivo analogous situation where the peptides are bound in the groove during the natural cause of MHC expression by the transfected cells. In the case of professional antigen presenting cells e.g. dendritic cells, macrophages, Langerhans cells, the proteins and peptides can be taken up by the cells themselves by phagocytosis and then bound to the MHC complexes the natural way and expressed on the cell surface in the correct MHC context.

Other Features of Product

In one preferred embodiment the MHC multimer is between 50,000 Da and 1,000,000 Da, such as from 50,000 Da to 980,000; for example from 50,000 Da to 960,000; such as from 50,000 Da to 940,000; for example from 50,000 Da to 920,000; such as from 50,000 Da to 900,000; for example from 50,000 Da to 880,000; such as from 50,000 Da to 860,000; for example from 50,000 Da to 840,000; such as from 50,000 Da to 820,000; for example from 50,000 Da to 800,000; such as from 50,000 Da to 780,000; for example from 50,000 Da to 760,000; such as from 50,000 Da to 740,000; for example from 50,000 Da to 720,000; such as from 50,000 Da to 700,000; for example from 50,000 Da to 680,000; such as from 50,000 Da to 660,000; for example from 50,000 Da to 640,000; such as from 50,000 Da to 620,000; for example from 50,000 Da to 600,000; such as from 50,000 Da to 580,000; for example from 50,000 Da to 560,000; such as from 50,000 Da to 540,000; for example from 50,000 Da to 520,000; such as from 50,000 Da to 500,000; for example from 50,000 Da to 480,000; such as from 50,000 Da to 460,000; for example from 50,000 Da to 440,000; such as from 50,000 Da to 420,000; for example from 50,000 Da to 400,000; such as from 50,000 Da to 380,000; for example from 50,000 Da to 360,000; such as from 50,000 Da to 340,000; for example from 50,000 Da to 320,000; such as from 50,000 Da to 300,000; for example from 50,000 Da to 280,000; such as from 50,000 Da to 260,000; for example from 50,000 Da to 240,000; such as from 50,000 Da to 220,000; for example from 50,000 Da to 200,000; such as from 50,000 Da to 180,000; for example from 50,000 Da to 160,000; such as from 50,000 Da to 140,000; for example from 50,000 Da to 120,000; such as from 50,000 Da to 100,000; for example from 50,000 Da to 80,000; such as from 50,000 Da to 60,000; such as from 100,000 Da to 980,000; for example from 100,000 Da to 960,000; such as from 100,000 Da to 940,000; for example from 100,000 Da to 920,000; such as from 100,000 Da to 900,000; for example from 100,000 Da to 880,000; such as from 100,000 Da to 860,000; for example from 100,000 Da to 840,000; such as from 100,000 Da to 820,000; for example from 100,000 Da to 800,000; such as from 100,000 Da to 780,000; for example from 100,000 Da to 760,000; such as from 100,000 Da to 740,000; for example from 100,000 Da to 720,000; such as from 100,000 Da to 700,000; for example from 100,000 Da to 680,000; such as from 100,000 Da to 660,000; for example from 100,000 Da to 640,000; such as from 100,000 Da to 620,000; for example from 100,000 Da to 600,000; such as from 100,000 Da to 580,000; for example from 100,000 Da to 560,000; such as from 100,000 Da to 540,000; for example from 100,000 Da to 520,000; such as from 100,000 Da to 500,000; for example from 100,000 Da to 480,000; such as from 100,000 Da to 460,000; for example from 100,000 Da to 440,000; such as from 100,000 Da to 420,000; for example from 100,000 Da to 400,000; such as from 100,000 Da to 380,000; for example from 100,000 Da to 360,000; such as from 100,000 Da to 340,000; for example from 100,000 Da to 320,000; such as from 100,000 Da to 300,000; for example from 100,000 Da to 280,000; such as from 100,000 Da to 260,000; for example from 100,000 Da to 240,000; such as from 100,000 Da to 220,000; for example from 100,000 Da to 200,000; such as from 100,000 Da to 180,000; for example from 100,000 Da to 160,000; such as from 100,000 Da to 140,000; for example from 100,000 Da to 120,000; such as from 150,000 Da to 980,000; for example from 150,000 Da to 960,000; such as from 150,000 Da to 940,000; for example from 150,000 Da to 920,000; such as from 150,000 Da to 900,000; for example from 150,000 Da to 880,000; such as from 150,000 Da to 860,000; for example from 150,000 Da to 840,000; such as from 150,000 Da to 820,000; for example from 150,000 Da to 800,000; such as from 150,000 Da to 780,000; for example from 150,000 Da to 760,000; such as from 150,000 Da to 740,000; for example from 150,000 Da to 720,000; such as from 150,000 Da to 700,000; for example from 150,000 Da to 680,000; such as from 150,000 Da to 660,000; for example from 150,000 Da to 640,000; such as from 150,000 Da to 620,000; for example from 150,000 Da to 600,000; such as from 150,000 Da to 580,000; for example from 150,000 Da to 560,000; such as from 150,000 Da to 540,000; for example from 150,000 Da to 520,000; such as from 150,000 Da to 500,000; for example from 150,000 Da to 480,000; such as from 150,000 Da to 460,000; for example from 150,000 Da to 440,000; such as from 150,000 Da to 420,000; for example from 150,000 Da to 400,000; such as from 150,000 Da to 380,000; for example from 150,000 Da to 360,000; such as from 150,000 Da to 340,000; for example from 150,000 Da to 320,000; such as from 150,000 Da to 300,000; for example from 150,000 Da to 280,000; such as from 150,000 Da to 260,000; for example from 150,000 Da to 240,000; such as from 150,000 Da to 220,000; for example from 150,000 Da to 200,000; such as from 150,000 Da to 180,000; for example from 150,000 Da to 160,000.

In another preferred embodiment the MHC multimer is between 1,000,000 Da and 3,000,000 Da, such as from 1,000,000 Da to 2,800,000; for example from 1,000,000 Da to 2,600,000; such as from 1,000,000 Da to 2,400,000; for example from 1,000,000 Da to 2,200,000; such as from 1,000,000 Da to 2,000,000; for example from 1,000,000 Da to 1,800,000; such as from 1,000,000 Da to 1,600,000; for example from 1,000,000 Da to 1,400,000.

Above it was described how to design and produce the key components of the MHC multimers, i.e. the MHC-peptide complex. In the following it is described how to generate the MHC monomer or MHC multimer products of the present invention.

Number of MHC Complexes Pr Multimer

A non-exhaustive list of possible MHC mono- and multimers illustrates the possibilities. 'n' indicates the number of MHC complexes comprised in the multimer:
a) n=1, Monomers
b) n=2, Dimers, multimerization can be based on IgG scaffold, streptavidin with two MHC's, coiled-coil dimerization e.g. Fos.Jun dimerization
c) n=3, Trimers, multimerization can be based on streptavidin as scaffold with three MHC's, TNFalpha-MHC hybrids, triplex DNA-MHC conjugates or other trimer structures
d) n=4, Tetramers, multimerization can be based on streptavidin with all four binding sites occupied by MHC molecules or based on dimeric IgA
e) n=5, Pentamers, multimerization can take place around a pentameric coil-coil structure
f) n=6, Hexamers
g) n=7, Heptamers
h) n=8-12, Octa-dodecamers, multimerization can take place using Streptactin
i) n=10, Decamers, multimerization can take place using IgM
j) 1<n<100, Dextramers, as multimerization domain polymers such as polypeptide, polysaccharides and Dextrans can be used.
k) 1<n<1000, Multimerization can make use of dendritic cells (DC), antigen-presenting cells (APC), micelles, liposomes, beads, surfaces e.g. microtiterplate, tubes, microarray devices, micro-fluidic systems
l) 1<n, n in billions or trillions or higher, multimerization take place on beads, and surfaces e.g. microtiterplate, tubes, microarray devices, micro-fluidic systems MHC multimers thus include MHC-dimers, MHC-trimers, MHC-tetramers, MHC-pentamers, MHC-hexamers, as well as organic molecules, cells, membranes, polymers and particles that comprise two or more MHC-peptide complexes. Example organic molecule-based multimers include functionalized cyclic structures such as benzene rings where e.g. a benzene ring is functionalized and covalently linked to e.g. three MHC complexes; example cell-based MHC multimers include dendritic cells and antigen presenting cells (APCs); example membrane-based MHC multimers include liposomes and micelles carrying MHC-peptide complexes in their membranes; example polymer-based MHC multimers include MHC-dextramers (dextran to which a number of MHC-peptide complexes are covalently or non-covalently attached) and example particles include beads or other solid supports with MHC complexes immobilized on the surface. Obviously, any kind of multimerization domain can be used, including any kind of cell, polymer, protein or other molecular structure, or particles and solid supports.

MHC Origin

Any of the three components of a MHC complex can be of any of the below mentioned origins. The list is non-exhaustive. A complete list would encompass all Chordate species. By origin is meant that the sequence is identical or highly homologous to a naturally occurring sequence of the specific species.

List of origins:
Human
Mouse
Primate
   Chimpansee
   Gorilla
   Orang Utan
Monkey
   Macaques
Porcine (Swine/Pig)
Bovine (Cattle/Antilopes)
Equine (Horse)
Camelides (Camels)
Ruminants (Deears)
Canine (Dog)
Feline (Cat)
Bird
   Chicken
   Turkey
Fish
Reptiles
Amphibians Generation of MHC Multimers Different approaches to the generation of various types of MHC multimers are described in U.S. Pat. No. 5,635,363 (Altmann et al.), patent application WO 02/072631 A2 (Winther et al.), patent application WO 99/42597, US patent 2004209295, U.S. Pat. No. 5,635,363, and is described elsewhere in the present patent application as well. In brief, MHC multimers can be generated by first expressing and purifying the individual protein components of the MHC protein, and then combining the MHC protein components and the peptide, to form the MHC-peptide complex. Then an appropriate number of MHC-peptide complexes are linked together by covalent or non-covalent bonds to a multimerization domain. This can be done by chemical reactions between reactive groups of the multimerization domain (e.g. vinyl sulfone functionalities on a dextran polymer) and reactive groups on the MHC protein (e.g. amino groups on the protein surface), or by non-covalent interaction between a part of the MHC protein (e.g. a biotinylated peptide component) and the multimerization domain (e.g. four binding sites for biotin on the strepavidin tetrameric protein). As an alternative, the MHC multimer can be formed by the non-covalent association of amino acid helices fused to one component of the MHC protein, to form a pentameric MHC multimer, held together by five helices in a coiled-coil structure making up the multimerization domain.

Appropriate chemical reactions for the covalent coupling of MHC and the multimerization domain include nucleophilic substitution by activation of electrophiles (e.g. acylation such as amide formation, pyrazolone formation, isoxazolone formation; alkylation; vinylation; disulfide formation), addition to carbon-hetero multiple bonds (e.g. alkene formation by reaction of phosphonates with aldehydes or ketones; arylation; alkylation of arenes/hetarenes by reaction with alkyl boronates or enolethers), nucleophilic substitution using activation of nucleophiles (e.g. condensations; alkylation of aliphatic halides or tosylates with enolethers or enamines), and cycloadditions.

Appropriate molecules, capable of providing non-covalent interactions between the multimerization domain and the MHC-peptide complex, involve the following molecule pairs and molecules: streptavidin/biotin, avidin/biotin, antibody/antigen, DNA/DNA, DNA/PNA, DNA/RNA, PNA/PNA, LNA/DNA, leucine zipper e.g. Fos/Jun, IgG dimeric protein, IgM multivalent protein, acid/base coiled-coil helices, chelate/metal ion-bound chelate, streptavidin (SA) and avidin and derivatives thereof, biotin, immunoglobulins, antibodies (monoclonal, polyclonal, and recombinant), antibody fragments and derivatives thereof, leucine zipper domain of AP-1 (jun and fos), hexa-his (metal chelate moiety), hexa-hat GST (glutathione S-transferase) glutathione affinity, Calmodulin-binding peptide (CBP), Strep-tag, Cellulose Binding Domain, Maltose Binding Protein, S-Peptide Tag, Chitin Binding Tag, Immuno-reactive Epitopes, Epitope Tags, E2Tag, HA Epitope Tag, Myc Epitope, FLAG Epitope, AU1 and AU5 Epitopes, Glu-Glu Epitope, KT3 Epitope, IRS Epitope, Btag Epitope, Protein Kinase-C Epitope, VSV Epitope, lectins that mediate binding to a diversity of compounds, including carbohydrates, lipids and proteins, e.g. Con A (*Canavalia ensiformis*) or WGA (wheat germ agglutinin) and tetranectin or Protein A or G (antibody affinity). Combinations of such binding entities are also comprised. In particular, when the MHC complex is tagged, the binding entity can be an "anti-tag". By "anti-tag" is meant an antibody binding to the tag and any other molecule capable of binding to such tag.

Generation of Components of MHC

When employing MHC multimers for diagnostic purposes, it is preferable to use a MHC allele that corresponds to the tissue type of the person or animal to be diagnosed. Once the MHC allele has been chosen, a peptide derived from the antigenic protein may be chosen. The choice will depend on factors such as known or expected binding affinity of the MHC protein and the various possible peptide fragments that may be derived from the full sequence of the antigenic peptide, and will depend on the expected or known binding affinity and specificity of the MHC-peptide complex for the TCR. Preferably, the affinity of the peptide for the MHC molecule, and the affinity and specificity of the MHC-peptide complex for the TCR, should be high.

Similar considerations apply to the choice of MHC allele and peptide for therapeutic and vaccine purposes. In addition, for some of these applications the effect of binding the MHC multimer to the TCR is also important. Thus, in these cases the effect on the T-cell's general state must be considered, e.g. it must be decided whether the desired end result is apoptosis or proliferation of the T-cell.

Likewise, it must be decided whether stability is important. For some applications low stability may be an advantage, e.g. when a short-term effect is desired; in other instances, a long-term effect is desired and MHC multimers of high stability is desired. Stabilities of the MHC protein and of the MHC-peptide complex may be modified as described elsewhere herein.

Finally, modifications to the protein structure may be advantageous for some diagnostics purposes, because of e.g. increased stability, while in for vaccine purposes modifications to the MHC protein structure may induce undesired allergenic responses.

Generation of Protein Chains of MHC

Generation of MHC Class I Heavy Chain and $\beta$2-Microglobulin

MHC class I heavy chain (HC) and $\beta$2-microglobulin ($\beta$2m) can be obtained from a variety of sources.
  a) Natural sources by means of purification from eukaryotic cells naturally expressing the MHC class 1 or $\beta$2m molecules in question.
  b) The molecules can be obtained by recombinant means e.g. using.
    a. in vitro translation of mRNA obtained from cells naturally expressing the MHC or $\beta$2m molecules in question
    b. by expression and purification of HC and/or $\beta$2m gene transfected cells of mammalian, yeast, bacterial or other origin. This last method will normally be the method of choice. The genetic material used for transfection/transformation can be:
      i. of natural origin isolated from cells, tissue or organisms
      ii. of synthetical origin i.e. synthetic genes identical to the natural DNA sequence or it could be modified to introduce molecular changes or to ease recombinant expression.
      The genetic material can encode all or only a fragment of $\beta$2m, all or only a fragment of MHC class 1 heavy chain. Of special interest are MHC class 1 heavy chain fragments consisting of, the complete chain minus the intramembrane domain, a chain consisting of only the extracellular $\alpha$1 and $\alpha\lambda$ class 1 heavy chain domains, or any of the mentioned $\beta$2m and heavy chain fragments containing modified or added designer domain(s) or sequence(s).

Generation of MHC Class 2 $\alpha$- and $\beta$-Chains

MHC class 2 $\alpha$- and $\beta$-chains can be obtained from a variety of sources:
  a) Natural sources by means of purification from eukaryotic cells naturally expressing the MHC class 2 molecules in question.
  b) By recombinant means e.g. using:
    a. in vitro translation of mRNA obtained from cells naturally expressing the MHC class 2 molecules in question
    b. By purification from MHC class 2 gene transfected cells of mammalian, yeast, bacterial or other origin. This last method will normally be the method of choice. The genetic material used for transfection/transformation can be
      i. of natural origin isolated from cells, tissue or organisms
      ii. of synthetical origin i.e. synthetic genes identical to the natural DNA sequence or it could be modified to introduce molecular changes or to ease recombinant expression.

The genetic material can encode all or only a fragment of MHC class 2 α- and β-chains. Of special interest are MHC class 2 α- and β-chain fragments consisting of, the complete α- and β-chains minus the intramembrane domains of either or both chains; and α- and β-chains consisting of only the extracellular domains of either or both, i.e α1 plus α2 and β1 plus β2 domains, respectively. The genetic material can be modified to encode the interesting MHC class 2 molecule fragments consisting of domains starting from the amino terminal in consecutive order, MHC class 2 β1 plus MHC class 2 α1 plus MHC class 1 α3 domains or in alternative order, MHC class 2 α1 plus MHC class 2 β1 plus MHC class 1 α3 domains.

Lastly, the genetic material can encode any of the above mentioned MHC class 2 α- and β-chain molecules or fragments containing modified or added designer domain(s) or sequence(s).

c) The MHC material may also be of exclusively synthetic origin manufactured by solid phase protein synthesis. Any of the above mentioned molecules can be made this way.

Modified MHC I or MHC II Complexes

MHC I and MHC II complexes modified in any way as described above, can bind TCR. Modifications include mutations (substitutions, deletions or insertions of natural or non-natural amino acids, or any other organic molecule. The mutations are not limited to those that increase the stability of the MHC complex, and could be introduced anywhere in the MHC complex. One example of special interest is mutations introduced in the α3 subunit of MHC I heavy chain. The α3-subunit interacts with CD8 molecules on the surface of T cells. To minimize binding of MHC multimer to CD8 molecules on the surface of non-specific T cells, amino acids in α3 domain involved in the interaction with CD8 can be mutated. Such a mutation can result in altered or abrogated binding of MHC to CD8 molecules. Another example of special interest is mutations in areas of the β2-domain of MHC II molecules responsible for binding CD4 molecules.

Another embodiment is chemically modified MHC complexes where the chemical modification could be introduced anywhere in the complex, e.g. a MHC complex where the peptide in the peptide-binding cleft has a dinitrophenyl group attached. Modified MHC complexes could also be MHC I or MHC II fusion proteins where the fusion protein is not necessarily more stable than the native protein. Of special interest is MHC complexes fused with genes encoding an amino acid sequence capable of being biotinylated with a Bir A enzyme (Schatz, P. J.,(1993), Biotechnology 11(10):1138-1143). This biotinylation sequence could be fused with the COOH-terminal of β2m or the heavy chain of MHC I molecules or the COOH-terminal of either the α-chain or β-chain of MHC II. Similarly, other sequences capable of being enzymatically or chemically modified can be fused to the $NH_2$ or COOH-terminal ends of the MHC complex.

Stabilization of Empty MHC Complexes and MHC-Peptide Complexes

Classical MHC complexes are in nature embedded in the membrane. A preferred embodiment includes multimers comprising a soluble form of MHC II or I where the transmembrane and cytosolic domains of the membrane-anchored MHC complexes are removed. The removal of the membrane-anchoring parts of the molecules can influence the stability of the MHC complexes. The stability of MHC complexes is an important parameter when generating and using MHC multimers.

MHC I complexes consist of a single membrane-anchored heavy chain that contains the complete peptide binding groove and is stable in the soluble form when complexed with β2m. The long-term stability is dependent on the binding of peptide in the peptide-binding groove. Without a peptide in the peptide binding groove the heavy chain and β2m tend to dissociate. Similarly, peptides with high affinity for binding in the peptide-binding groove will typically stabilize the soluble form of the MHC complex while peptides with low affinity for the peptide-binding groove will typically have a smaller stabilizing effect.

In contrast, MHC II complexes consist of two membrane-anchored chains of almost equal size. When not attached to the cell membrane the two chains tend to dissociate and are therefore not stable in the soluble form unless a high affinity peptide is bound in the peptide-binding groove or the two chains are held together in another way.

In nature MHC I molecules consist of a heavy chain combined with β2m, and a peptide of typically 8-11 amino acids. Herein, MHC I molecules also include molecules consisting of a heavy chain and β2m (empty MHC), or a heavy chain combined with a peptide or a truncated heavy chain comprising α1 and α2 subunits combined with a peptide, or a full-length or truncated heavy chain combined with a full-length or truncated β2m chain. These MHC I molecules can be produced in E. coli as recombinant proteins, purified and refolded in vitro (Garboczi et al., (1992), Proc. Natl. Acad. Sci. 89, 3429-33). Alternatively, insect cell systems or mammalian cell systems can be used. To produce stable MHC I complexes and thereby generate reliable MHC I multimers several strategies can be followed. Stabilization strategies for MHC I complexes are described in the following.

Stabilization Strategies for MHC I Complexes

Generation of Covalent Protein-Fusions

MHC I molecules can be stabilized by introduction of one or more linkers between the individual components of the MHC I complex. This could be a complex consisting of a heavy chain fused with β2m through a linker and a soluble peptide, a heavy chain fused to β2m through a linker, a heavy chain/β2m dimer covalently linked to a peptide through a linker to either heavy chain or β2m, and where there can or can not be a linker between the heavy chain and β2m, a heavy chain fused to a peptide through a linker, or the α1 and α2 subunits of the heavy chain fused to a peptide through a linker. In all of these example protein-fusions, each of the heavy chain, β2m and the peptide can be truncated.

The linker could be a flexible linker, e.g. made of glycine and serine and e.g. between 5-20 residues long. The linker could also be rigid with a defined structure, e.g. made of amino acids like glutamate, alanine, lysine, and leucine creating e.g. a more rigid structure.

In heavy chain-β2m fusion proteins the COOH terminus of β2m can be covalently linked to the $NH_2$ terminus of the heavy chain, or the $NH_2$ terminus of β2m can be linked to the COOH terminus of the heavy chain. The fusion-protein can also comprise a β2m domain, or a truncated β2m domain, inserted into the heavy chain, to form a fusion-protein of the form "heavy chain (first part)-β2m-heavy chain (last part)".

Likewise, the fusion-protein can comprise a heavy chain domain, or a truncated heavy chain, inserted into the β2m chain, to form a fusion-protein of the form "β2m (first part)-heavy chain-β2m (last part)".

In peptide-β2m fusion proteins the COOH terminus of the peptide is preferable linked to the NH$_2$ terminus of β2m but the peptide can also be linked to the COOH terminal of β2m via its NH$_2$ terminus. In heavy chain-peptide fusion proteins it is preferred to fuse the NH$_2$ terminus of the heavy chain to the COOH terminus of the peptide, but the fusion can also be between the COOH terminus of the heavy chain and the NH$_2$ terminus of the peptide. In heavy chain-β2m-peptide fusion proteins the NH$_2$ terminus of the heavy chain can be fused to the COOH terminus of β2m and the NH$_2$ terminus of β2m can be fused to the COOH terminus of the peptide.

Non-Covalent Stabilization by Binding to an Unnatural Component

Non-covalent binding of unnatural components to the MHC I complexes can lead to increased stability. The unnatural component can bind to both the heavy chain and the β2m, and in this way promote the assemble of the complex, and/or stabilize the formed complex. Alternatively, the unnatural component can bind to either β2m or heavy chain, and in this way stabilize the polypeptide in its correct conformation, and in this way increase the affinity of the heavy chain for β2m and/or peptide, or increase the affinity of β2m for peptide.

Here, unnatural components mean antibodies, peptides, aptamers or any other molecule with the ability to bind peptides stretches of the MHC complex. Antibody is here to be understood as truncated or full-length antibodies (of isotype IgG, IgM, IgA, IgE), Fab, scFv or bi-Fab fragments or diabodies.

An example of special interest is an antibody binding the MHC I molecule by interaction with the heavy chain as well as β2m. The antibody can be a bispecific antibody that binds with one arm to the heavy chain and the other arm to the β2m of the MHC complex. Alternatively the antibody can be monospecific, and bind at the interface between heavy chain and β2m.

Another example of special interest is an antibody binding the heavy chain but only when the heavy chain is correct folded. Correct folded is here a conformation where the MHC complex is able to bind and present peptide in such a way that a restricted T cell can recognize the MHC-peptide complex and be activated. This type of antibody can be an antibody like the one produced by the clone W6/32 (M0736 from Dako, Denmark) that recognizes a conformational epitope on intact human and some monkey MHC complexes containing β2m, heavy chain and peptide.

Generation of Modified Proteins or Protein Components

One way to improve stability of a MHC I complex am to increase the affinity of the binding peptide for the MHC complex. This can be done by mutation/substitution of amino acids at relevant positions in the peptide, by chemical modifications of amino acids at relevant positions in the peptide or introduction by synthesis of non-natural amino acids at relevant positions in the peptide. Alternatively, mutations, chemical modifications, insertion of natural or non-natural amino acids or deletions could be introduced in the peptide binding cleft, i.e. in the binding pockets that accommodate peptide side chains responsible for anchoring the peptide to the peptide binding cleft. Moreover, reactive groups can be introduced into the antigenic peptide; before, during or upon binding of the peptide, the reactive groups can react with amino acid residues of the peptide binding cleft, thus covalently linking the peptide to the binding pocket.

Mutations/substitutions, chemical modifications, insertion of natural or non-natural amino acids or deletions could also be introduced in the heavy chain and/or β2m at positions outside the peptide-binding cleft. By example, it has been shown that substitution of XX with YY in position nn of human β$_2$m enhance the biochemical stability of MHC Class I molecule complexes and thus may lead to more efficient antigen presentation of subdominant peptide epitopes.

A preferred embodiment is removal of "unwanted cysteine residues" in the heavy chain by mutation, chemical modification, amino acid exchange or deletion. "Unwanted cysteine residues" is here to be understood as cysteines not involved in the correct folding of the final MHC I molecule. The presence of cysteine not directly involved in the formation of correctly folded MHC I molecules can lead to formation of intra molecular disulfide bridges resulting in a non correct folded MHC complex during in vitro refolding.

Another method for covalent stabilization of MHC I complex am to covalently attach a linker between two of the subunits of the MHC complex. This can be a linker between peptide and heavy chain or between heavy chain and beta2microglobulin.

Stabilization Strategies for MHC II Complexes

MHC II molecules as used herein are defined as classical MHC II molecule consisting of a α-chain and a β-chain combined with a peptide. It could also be a molecule only consisting of α-chain and β-chain (α/β dimer or empty MHC II), a truncated α-chain (e.g. α1 domain alone) combined with full-length β-chain either empty or loaded with a peptide, a truncated β-chain (e.g. (β1 domain alone) combined with a full-length α-chain either empty or loaded with a peptide or a truncated α-chain combined with a truncated β-chain (e.g. α1 and β1 domain) either empty or loaded with a peptide.

In contrast to MHC I molecules MHC II molecules are not easily refolded in vitro. Only some MHC II alleles may be produced in *E. coli* followed by refolding in vitro.

Therefore preferred expression systems for production of MHC II molecules are eukaryotic systems where refolding after expression of protein is not necessary. Such expression systems could be stable *Drosophila* cell transfectants, baculovirus infected insect cells, CHO cells or other mammalian cell lines suitable for expression of proteins.

Stabilization of soluble MHC II molecules is even more important than for MHC I molecules since both α- and β-chain are participants in formation of the peptide binding groove and tend to dissociate when not embedded in the cell membrane.

Generation of Covalent Protein-Fusions.

MHC II complexes can be stabilized by introduction of one or more linkers between the individual components of the MHC II complex. This can be a α/β dimer with a linker between α-chain and β-chain; a α/β dimer covalently linked to the peptide via a linker to either the α-chain or β-chain; a α/β dimer, covalently linked by a linker between the α-chain and β-chain, and where the dimer is covalently linked to the peptide; a α/β dimer with a linker between α-chain and β-chain, where the dimer is combined with a peptide covalently linked to either α-chain or β-chain.

The linker can be a flexible linker, e.g. made of glycine and serine, and is typically between 5-20 residues long, but can be shorter or longer. The linker can also be more rigid with a more defined structure, e.g. made of amino acids like glutamate, alanine, lysine, and leucine.

The peptides can be linked to the $NH_2$— or COOH-terminus of either α-chain or β-chain. Of special interest are peptides linked to the $NH_2$-terminus of the β-chain via their COOH-terminus, since the linker required is shorter than if the peptide is linked to the COOH-terminus of the β-chain.

Linkage of α-chain to β-chain can be via the COOH-terminus of the β-chain to the $NH_2$-terminus of the α-chain or from the COOH-terminus of the α-chain to the $NH_2$-terminus of the β-chain.

In a three-molecule fusion protein consisting of α-chain, β-chain and peptide a preferred construct is where one linker connect the COOH-terminus of the β-chain with the $NH_2$-terminus of the α-chain and another linker connects the COOH-terminal of the peptide with the $NH_2$-terminal of the β-chain. Alternatively one linker joins the COOH-terminus of the α-chain with the $NH_2$-terminus of the β-chain and the second linker joins the $NH_2$-terminus of the peptide with the COOH-terminus of the β-chain. The three peptides of the MHC complex can further be linked as described above for the three peptides of the MHC complex, including internal fusion points for the proteins.

Non-Covalent Stabilization by Binding Ligand.

Non-covalent binding of ligands to the MHC II complex can promote assembly of α- and β-chain by bridging the two chains, or by binding to either of the α- or β-chains, and in this way stabilize the conformation of α or β, that binds β or α, respectively, and/or that binds the peptide. Ligands here mean antibodies, peptides, aptamers or any other molecules with the ability to bind proteins.

A particular interesting example is an antibody binding the MHC complex distal to the interaction site with TCR, i.e. distal to the peptide-binding cleft. An antibody in this example can be any truncated or full length antibody of any isotype (e.g. IgG, IgM, IgA or IgE), a bi-Fab fragment or a diabody. The antibody could be bispecific with one arm binding to the α-chain and the other arm binding to the β-chain. Alternatively the antibody could be monospecific and directed to a sequence fused to the α-chain as well as to the β-chain.

Another example of interest is an antibody binding more central in the MHC II molecule, but still interacting with both α- and β-chain. Preferable the antibody binds a conformational epitope, thereby forcing the MHC molecule into a correct folded configuration. The antibody can be bispecific binding with one arm to the α-chain and the other arm to the β-chain. Alternatively the antibody is monospecific and binds to a surface of the complex that involves both the α- and β-chain, e.g. both the α2- and β2-domain or both the α1- and β1-domain.

The antibodies described above can be substituted with any other ligand that binds at the α-/β-chain interface, e.g. peptides and aptamers. The ligand can also bind the peptide, although, in this case it is important that the ligand does not interfere with the interaction of the peptide or binding cleft with the TCR.

Non-Covalent Stabilization by Induced Multimerization.

In nature the anchoring of the α- and β-chains in the cell membrane stabilizes the MHC II complexes considerably. As mentioned above, a similar concept for stabilization of the α/β-dimer was employed by attachment of the MHC II chains to the Fc regions of an antibody, leading to a stable α/β-dimer, where α and β are held together by the tight interactions between two Fc domains of an antibody. Other dimerization domains can be used as well.

In one other example of special interest MHC II molecules are incorporated into artificial membrane spheres like liposomes or lipospheres. MHC II molecules can be incorporated as monomers in the membrane or as dimers like the MHC II-antibody constructs describes above. In addition to stabilization of the MHC II complex an increased avidity is obtained. The stabilization of the dimer will in most cases also stabilize the trimeric MHC-peptide complex.

Induced multimerization can also be achieved by biotinylation of α- as well as β-chain and the two chains brought together by binding to streptavidin. Long flexible linkers such as extended glycine-serine tracts can be used to extend both chains, and the chains can be biotinylated at the end of such extended linkers. Then streptavidin can be used as a scaffold to bring the chains together in the presence of the peptide, while the flexible linkers still allow the chains to orientate properly.

Generation of Modified Proteins or Protein Components

Stability of MHC II complexes can be increased by covalent modifications of the protein. One method is to increase the affinity of the peptide for the MHC complex. This can be done by exchange of the natural amino acids with other natural or non-natural amino acids at relevant positions in the peptide or by chemical modifications of amino acids at relevant positions in the peptide. Alternatively, mutations, chemical modifications, insertion of natural or non-natural amino acids or deletions can be introduced in the peptide-binding cleft.

Mutations, chemical modifications, insertion of natural or non-natural amino acids or deletions can alternatively be introduced in α- and/or β-chain at positions outside the peptide-binding cleft.

In this respect a preferred embodiment is to replace the hydrophobic transmembrane regions of α-chain and β-chain by leucine zipper dimerisation domains (e.g. Fos-Jun leucine zipper; acid-base coiled-coil structure) to promote assembly of α-chain and β-chain.

Another preferred embodiment is to introduce one or more cysteine residues by amino acid exchange at the COOH-terminal of both α-chain and β-chain, to create disulfide bridges between the two chains upon assembly of the MHC complex. Another embodiment is removal of "unwanted cysteine residues" in either of the chains by mutation, chemical modification, amino acid exchange or deletion. "Unwanted cysteine residues" is here to be understood as cysteines not involved in correct folding of the MHC II-peptide complex. The presence of cysteines not directly involved in the formation of correctly folded MHC II complexes can lead to formation of intra molecular disulfide bridges and incorrectly folded MHC complexes.

MHC II complexes can also be stabilized by chemically linking together the subunits and the peptide. That can be a linker between peptide and α-chain, between peptide and β-chain, between α-chain and β-chain, and combination thereof.

Such linkages can be introduced prior to folding by linking two of the complex constituents together, then folding this covalent hetero-dimer in the presence of the third constituent. An advantage of this method is that it only requires complex formation between two, rather than three species.

Another possibility is to allow all three constituents to fold, and then to introduce covalent cross-links on the folded MHC-complex, stabilizing the structure. An advantage of this method is that the two chains and the peptide will be correctly positioned relatively to each other when the cross linkages are introduced.

Other Stabilization of MHC I and/or MHC II Complexes

Stabilization with Soluble Additives.

The stability of proteins in aqueous solution depends on the composition of the solution. Addition of salts, detergents organic solvent, polymers etc. can influence the stability. Salts, detergents, organic solvent, polymers and any other soluble additives can be added to increase the stability of MHC complexes. Of special interest are additives that increase surface tension of the MHC molecule without binding the molecule. Examples are sucrose, mannose, glycine, betaine, alanine, glutamine, glutamic acid and ammoniumsulfate. Glycerol, mannitol and sorbitol are also included in this group even though they are able to bind polar regions.

Another group of additives of special interest are able to increase surface tension of the MHC molecule and simultaneously interact with charged groups in the protein. Examples are $MgSO_4$, NaCl, polyethylenglycol, 2-methyl-2,4-pentandiol and guanidiniumsulfate.

Correct formation of MHC complexes is dependent on binding of peptide in the peptide-binding cleft; the bound peptide appears to stabilize the complex in its correct conformation. Addition of molar excess of peptide will force the equilibrium towards correctly folded MHC-peptide complexes. Likewise is excess Iβ2m also expected to drive the folding process in direction of correct folded MHC I complexes. Therefore peptide identical to the peptide bound in the peptide-binding cleft and/or β2m are included as stabilizing soluble additives.

Other additives of special interest for stabilization of MHC II molecules are BSA, fetal and bovine calf serum or individual protein components in serum with a protein stabilizing effect.

All of the above mentioned soluble additives can be added to any solution containing MHC complexes in order to increase the stability of the molecule. This can be during the refolding process, to the formed MHC complex, to the soluble MHC monomer, to a solution of MHC multimers comprising one or more MHC complexes or to solutions used during analysis of MHC specific T cells with MHC multimers.

Other additives of special interest for stabilization of MHC molecules are BSA, fetal and bovine calf serum or individual protein components in serum with a protein stabilizing effect.

Chemically Modified MHC I and II Complexes

There are a number of amino acids that are particularly reactive towards chemical cross linkers. In the following, chemical reactions are described that are particularly preferable for the cross-linking or modification of MHC I or MHC II complexes. The amino group at the N-terminal of both chains and of the peptide, as well as amino groups of lysine side chains, are nucleophilic and can be used in a number of chemical reactions, including nucleophilic substitution by activation of electrophiles (e.g. acylation such as amide formation, pyrazolone formation, isoxazolone formation; alkylation; vinylation; disulfide formation), addition to carbon-hetero multiple bonds (e.g. alkene formation by reaction of phosphonates with aldehydes or ketones; arylation; alkylation of arenes/hetarenes by reaction with alkyl boronates or enolethers), nucleophilic substitution using activation of nucleophiles (e.g. condensations; alkylation of aliphatic halides or tosylates with enolethers or enamines), and cycloadditions. Example reagents that can be used in a reaction with the amino groups are activated carboxylic acids such as NHS-ester, tetra and pentafluoro phenolic esters, anhydrides, acid chlorides and fluorides, to form stable amide bonds. Likewise, sulphonyl chlorides can react with these amino groups to form stable sulphone-amides. Iso-Cyanates can also react with amino groups to form stable ureas, and isothiocyanates can be used to introduce thio-urea linkages.

Aldehydes, such as formaldehyde and glutardialdehyde will react with amino groups to form shiff's bases, than can be further reduced to secondary amines. The guanidino group on the side chain of arginine will undergo similar reactions with the same type of reagents.

Another very useful amino acid is cysteine. The thiol on the side chain is readily alkylated by maleimides, vinyl sulphones and halides to form stable thioethers, and reaction with other thiols will give rise to disulphides.

Carboxylic acids at the C-terminal of both chains and peptide, as well as on the side chains of glutamic and aspartic acid, can also be used to introduce cross-links. They will require activation with reagents such as carbodiimides, and can then react with amino groups to give stable amides.

Thus, a large number of chemistries can be employed to form covalent cross-links. The crucial point is that the chemical reagents are bi-functional, being capable of reacting with two amino acid residues.

They can be either homo bi-functional, possessing two identical reactive moieties, such as glutardialdehyde or can be hetero bi-functional with two different reactive moieties, such as GMBS (MaleimidoButyryloxy-Succinimide ester).

Alternatively, two or more reagents can be used; i.e. GMBS can be used to introduce maleimides on the α-chain, and iminothiolane can be used to introduce thiols on the β-chain; the malemide and thiol can then form a thioether link between the two chains.

For the present invention some types of cross-links are particularly useful. The folded MHC-complex can be reacted with dextrans possessing a large number (up to many hundreds) of vinyl sulphones. These can react with lysine residues on both the α and β chains as well as with lysine residues on the peptide protruding from the binding site, effectively cross linking the entire MHC-complex. Such cross linking is indeed a favored reaction because as the first lysine residue reacts with the dextran, the MHC-complex becomes anchored to the dextran favoring further reactions between the MHC complex and the dextran multimerization domain.

Another great advantage of this dextran chemistry is that it can be combined with fluorochrome labelling; i.e. the dextran is reacted both with one or several MHC-complexes and one or more fluorescent protein such as APC.

Another valuable approach is to combine the molecular biological tools described above with chemical cross linkers. As an example, one or more lysine residues can be inserted into the α-chain, juxtaposed with glutamic acids in the β-chain, where after the introduced amino groups and carboxylic acids are reacted by addition of carbodiimide. Such reactions are usually not very effective in water, unless as in this case, the groups are well positioned towards reaction. This implies that one avoids excessive reactions that could otherwise end up denaturing or changing the conformation of the MHC-complex.

Likewise a dextran multimerization domain can be cross-linked with appropriately modified MHC-complexes; i.e. one or both chains of the MHC complex can be enriched with lysine residues, increasing reactivity towards the vinylsulphone dextran. The lysine's can be inserted at positions opposite the peptide binding cleft, orienting the MHC-complexes favorably for T-cell recognition.

Another valuable chemical tool is to use extended and flexible cross-linkers. An extended linker will allow the two chains to interact with little or no strain resulting from the linker that connects them, while keeping the chains in the vicinity of each other should the complex dissociate. An excess of peptide should further favor reformation of dissociated MHC-complex.

Other TCR Binding Molecules

MHC I and MHC II complexes bind to TCRs. However, other molecules also bind TCR. Some TCR-binding molecules are described in the following. MHC I and MHC II complexes binding to TCRs may be substituted with other molecules capable of binding TCR or molecules that have homology to the classical MHC molecules and therefore potentially could be TCR binding molecules. These other TCR binding or MHC like molecules include:

Non-Classical MHC Complexes and Other MHC-Like Molecules

Non-classical MHC complexes include protein products of MHC Ib and MHC IIb genes. MHC Ib genes encode β2m-associated cell-surface molecules but show little polymorphism in contrast to classical MHC class I genes. Protein products of MHC class Ib genes include HLA-E, HLA-G, HLA-F, HLA-H, MIC A, MIC B, ULBP-1, ULBP-2, ULBP-3 in humans and H2-M, H2-Q, H2-T and Rae1 in mice.

Non-classical MHC II molecules (protein products of MHC IIb genes) include HLA-DM, HLA-DO in humans and H2-DM and H2-DO in mice that are involved in regulation of peptide loading into MHC II molecules.

Another MHC-like molecule of special interest is the MHC I-like molecule CD1. CD1 is similar to MHC I molecules in its organization of subunits and association with β2m but presents glycolipids and lipids instead of peptides.

Artificial Molecules Capable of Binding Specific TCRs

Of special interest are antibodies that bind TCRs. Antibodies herein include full length antibodies of isotype IgG, IgM, IgE, IgA and truncated versions of these, antibody fragments like Fab fragments and scFv. Antibodies also include antibodies of antibody fragments displayed on various supramolecular structures or solid supports, including filamentous phages, yeast, mammalian cells, fungi, artificial cells or micelles, and beads with various surface chemistries.

Peptide Binding TCR

Another embodiment of special interest is peptides that bind TCRs. Peptides herein include peptides composed of natural, non-natural and/or chemically modified amino acids with a length of 8-20 amino acid. The peptides could also be longer than 20 amino acids or shorter than 8 amino acids. The peptides can or can not have a defined tertiary structure.

Aptamers

Aptamers are another preferred group of TCR ligands. Aptamers are herein understood as natural nucleic acids (e.g. RNA and DNA) or unnatural nucleic acids (e.g. PNA, LNA, morpholinos) capable of binding TCR. The aptamer molecules consist of natural or modified nucleotides in various lengths.

Other TCR-binding molecules can be ankyrin repeat proteins or other repeat proteins, Avimers, or small chemical molecules, as long as they are capable of binding TCR with a dissociation constant smaller than $10^{-3}$ M.

Verification of Correctly Folded MHC-Peptide Complexes

Quantitative ELISA and Other Techniques to Quantify Correctly Folded MHC Complexes When producing MHC multimers, it is desirable to determine the degree of correctly folded MHC.

The fraction or amount of functional and/or correctly folded MHC can be tested in a number of different ways, including:

Measurement of correctly folded MHC in a quantitative ELISA, e.g. where the MHC bind to immobilized molecules recognizing the correctly folded complex.

Measurement of functional MHC in an assay where the total protein concentration is measured before functional MHC is captured, by binding to e.g. immobilized TCR, and the excess, non-bound protein are measured. If the dissociation constant for the interaction is known, the amount of total and the amount of non-bound protein can be determined. From these numbers, the fraction of functional MHC complex can be determined.

Measurement of functional MHC complex by a non-denaturing gel-shift assay, where functional MHC complexes bind to TCR (or another molecule that recognize correctly folded MHC complex), and thereby shifts the TCR to another position in the gel.

Multimerization Domain

A number of MHC complexes associate with a multimerization domain to form a MHC multimer. The size of the multimerization domain spans a wide range, from multimerisation domains based on small organic molecule scaffolds to large multimers based on a cellular structure or solid support. The multimerization domain may thus be based on different types of carriers or scaffolds, and likewise, the attachment of MHC complexes to the multimerization domain may involve covalent or non-covalent linkers. Characteristics of different kinds of multimerization domains are described below.

Molecular Weight of Multimerization Domain.

In one embodiment the multimerization domain(s) in the present invention is preferably less than 1,000 Da (small molecule scaffold). Examples include short peptides (e.g. comprising 10 amino acids), and various small molecule scaffolds (e.g. aromatic ring structures).

In another embodiment the multimerization domain(s) is preferably between 1,000 Da and 10,000 Da (small molecule scaffold, small peptides, small polymers). Examples include polycyclic structures of both aliphatic and aromatic compounds, peptides comprising e.g. 10-100 amino acids, and other polymers such as dextran, polyethylenglycol, and polyureas.

In another embodiment the multimerization domain(s) is between 10,000 Da and 100,000 Da (Small molecule scaffold, polymers e.g. dextran, streptavidin, IgG, pentamer structure). Examples include proteins and large polypeptides, small molecule scaffolds such as steroids, dextran, dimeric streptavidin, and multi-subunit proteins such as used in Pentamers.

In another embodiment the multimerization domain(s) is preferably between 100,000 Da and 1,000,000 Da (Small molecule scaffold, polymers e.g. dextran, streptavidin, IgG, pentamer structure). Typical examples include larger polymers such as dextran (used in e.g. Dextramers), and streptavidin tetramers.

In another embodiment the multimerization domain(s) is preferably larger than 1,000,000 Da (Small molecule scaffold, polymers e.g. dextran, streptavidin, IgG, pentamer structure, cells, liposomes, artificial lipid bilayers, polystyrene beads and other beads. Most examples of this size involve cells or cell-based structures such as micelles and liposomes, as well as beads and other solid supports.

As mentioned elsewhere herein multimerisation domains can comprise carrier molecules, scaffolds or combinations of the two.

Type of Multimerization Domain.

In principle any kind of carrier or scaffold can be used as multimerization domain, including any kind of cell, polymer, protein or other molecular structure, or particles and solid supports. Below different types and specific examples of multimerization domains are listed.

Cell. Cells can be used as carriers. Cells can be either alive and mitotic active, alive and mitotic inactive as a result of irradiation or chemically treatment, or the cells may be dead. The MHC expression may be natural (i.e. not stimulated) or may be induced/stimulated by e.g. Inf-γ. Of special interest are natural antigen presenting cells (APCs) such as dendritic cells, macrophages, Kupfer cells, Langerhans cells, B-cells and any MHC expressing cell either naturally expressing, being transfected or being a hybridoma.

Cell-like structures. Cell-like carriers include membrane-based structures carrying MHC-peptide complexes in their membranes such as micelles, liposomes, and other structures of membranes, and phages such as filamentous phages.

Solid support. Solid support includes beads, particulate matters and other surfaces. A preferred embodiment include beads (magnetic or non-magnetic beads) that carry electrophilic groups e.g. divinyl sulfone activated polysaccharide, polystyrene beads that have been functionalized with tosyl-activated esters, magnetic polystyrene beads functionalized with tosyl-activated esters), and where MHC complexes may be covalently immobilized to these by reaction of nucleophiles comprised within the MHC complex with the electrophiles of the beads. Beads may be made of sepharose, sephacryl, polystyrene, agarose, polysaccharide, polycarbamate or any other kind of beads that can be suspended in aqueous buffer.

Another embodiment includes surfaces, i.e. solid supports and particles carrying immobilized MHC complexes on the surface. Of special interest are wells of a microtiter plate or other plate formats, reagent tubes, glass slides or other supports for use in microarray analysis, tubings or channels of micro fluidic chambers or devices, Biacore chips and beads Molecule. Multimerization domains may also be molecules or complexes of molecules held together by non-covalent bonds. The molecules constituting the multimerization domain can be small organic molecules or large polymers, and may be flexible linear molecules or rigid, globular structures such as e.g. proteins. Different kinds of molecules used in multimerization domains are described below.

Small organic molecules. Small organic molecules here includes steroids, peptides, linear or cyclic structures, and aromatic or aliphatic structures, and many others. The prototypical small organic scaffold is a functionalized benzene ring, i.e. a benzene ring functionalized with a number of reactive groups such as amines, to which a number of MHC molecules may be covalently linked. However, the types of reactive groups constituting the linker connecting the MHC complex and the multimerization domain, as well as the type of scaffold structure, can be chosen from a long list of chemical structures. A non-comprehensive list of scaffold structures are listed below.

Typical scaffolds include aromatic structures, benzodiazepines, hydantoins, piperazines, indoles, furans, thiazoles, steroids, diketopiperazines, morpholines, tropanes, coumarines, qinolines, pyrroles, oxazoles, amino acid precursors, cyclic or aromatic ring structures, and many others.

Typical carriers include linear and branched polymers such as peptides, polysaccharides, nucleic acids, and many others. Multimerization domains based on small organic or polymer molecules thus include a wealth of different structures, including small compact molecules, linear structures, polymers, polypeptides, polyureas, polycarbamates, cyclic structures, natural compound derivatives, alpha-, beta-, gamma-, and omega-peptides, mono-, di- and tri-substituted peptides, L- and D-form peptides, cyclohexane- and cyclopentane-backbone modified beta-peptides, vinylogous polypeptides, glycopolypeptides, polyamides, vinylogous sulfonamide peptide, Polysulfonamide-conjugated peptide (i.e., having prosthetic groups), Polyesters, Polysaccharides such as dextran and aminodextran, polycarbamates, polycarbonates, polyureas, poly-peptidylphosphonates, Azatides, peptoids (oligo N-substituted glycines), Polyethers, ethoxyformacetal oligomers, poly-thioethers, polyethylene, glycols (PEG), polyethylenes, polydisulfides, polyarylene sulfides, Polynucleotides, PNAs, LNAs, Morpholinos, oligo pyrrolinone, polyoximes, Polyimines, Polyethyleneimine, Polyacetates, Polystyrenes, Polyacetylene, Polyvinyl, Lipids, Phospholipids, Glycolipids, polycycles, (aliphatic), polycycles (aromatic), polyheterocycles, Proteoglycan, Polysiloxanes, Polyisocyanides, Polyisocyanates, polymethacrylates, Monofunctional, Difunctional, Trifunctional and Oligofunctional open-chain hydrocarbons, Monofunctional, Difunctional, Trifunctional and Oligofunctional Nonaromat Carbocycles, Monocyclic, Bicyclic, Tricyclic and Polycyclic Hydrocarbons, Bridged Polycyclic Hydrocarbones, Monofunctional, Difunctional, Trifunctional and Oligofunctional Nonaromatic, Heterocycles, Monocyclic, Bicyclic, Tricyclic and Polycyclic Heterocycles, bridged Polycyclic Heterocycles, Monofunctional, Difunctional, Trifunctional and Oligofunctional Aromatic Carbocycles, Monocyclic, Bicyclic, Tricyclic and Polycyclic Aromatic Carbocycles, Monofunctional, Difunctional, Trifunctional and Oligofunctional Aromatic Hetero-cycles. Monocyclic, Bicyclic, Tricyclic and Polycyclic Hetero-cycles. Chelates, fullerenes, and any combination of the above and many others.

Biological polymers. Biological molecules here include peptides, proteins (including antibodies, coiled-coil helices, streptavidin and many others), nucleic acids such as DNA and RNA, and polysaccharides such as dextran. The biological polymers may be reacted with MHC complexes (e.g. a number of MHC complexes chemically coupled to e.g. the amino groups of a protein), or may be linked through e.g. DNA duplex formation between a carrier DNA molecule and a number of DNA oligonucleotides each coupled to a MHC complex. Another type of multimerization domain based on a biological polymer is the streptavidin-based tetramer, where a streptavidin binds up to four biotinylated MHC complexes, as described above (see Background of the invention).

Self-assembling multimeric structures. Several examples of commercial MHC multimers exist where the multimer is formed through self-assembling. Thus, the Pentamers are formed through formation of a coiled-coil structure that holds together 5 MHC complexes in an apparently planar structure. In a similar way, the Streptamers are based on the Streptactin protein which oligomerizes to form a MHC multimer comprising several MHC complexes (see Background of the invention).

In the following, alternative ways to make MHC multimers based on a molecule multimerization domain are described. They involve one or more of the abovementoned types of multimerization domains.

MHC dextramers can be made by coupling MHC complexes to dextran via a streptavidin-biotin interaction. In principle, biotin-streptavdin can be replaced by any dimerization domain, where one half of the dimerization domain is coupled to the MHC-peptide complex and the other half is coupled to dextran. For example, an acidic helix (one half of a coiled-coil dimer) is coupled or fused to MHC, and a basic helix (other half of a coiled-coil dimmer) is coupled to dextran. Mixing the two results in MHC binding to dextran by forming the acid/base coiled-coil structure.

Antibodies can be used as scaffolds by using their capacity to bind to a carefully selected antigen found naturally or added as a tag to a part of the MHC molecule not involved in peptide binding. For example, IgG and IgE will be able to bind two MHC molecules, IgM having a pentameric structure will be able to bind 10 MHC molecules. The antibodies can be full-length or truncated; a standard antibody-fragment includes the Fab2 fragment.

Peptides involved in coiled-coil structures can act as scaffold by making stable dimeric, trimeric, tetrameric and pentameric interactions. Examples hereof are the Fos-Jun heterodimeric coiled coil, the *E. coli* homo-trimeric coiled-coil domain Lpp-56, the engineered Trp-zipper protein forming a discrete, stable, α-helical pentamer in water at physiological pH.

Further examples of suitable scaffolds, carriers and linkers are streptavidin (SA) and avidin and derivatives thereof, biotin, immunoglobulins, antibodies (monoclonal, polyclonal, and recombinant), antibody fragments and derivatives thereof, leucine zipper domain of AP-1 (jun and fos), hexa-his (metal chelate moiety), hexa-hat GST (glutathione S-tranferase), glutathione, Calmodulin-binding peptide (CBP), Strep-tag, Cellulose Binding Domain, Maltose Binding Protein, S-Peptide Tag, Chitin Binding Tag, Immunoreactive Epitopes, Epitope Tags, E2Tag, HA Epitope Tag, Myc Epitope, FLAG Epitope, AU1 and AU5 Epitopes, Glu-Glu Epitope, KT3 Epitope, IRS Epitope, Btag Epitope, Protein Kinase-C Epitope, VSV Epitope, lectins that mediate binding to a diversity of compounds, including carbohydrates, lipids and proteins, e.g. Con A (*Canavalia ensiformis*) or WGA (wheat germ agglutinin) and tetranectin or Protein A or G (antibody affinity). Combinations of such binding entities are also comprised. Non-limiting examples are streptavidin-biotin and jun-fos. In particular, when the MHC molecule is tagged, the binding entity may be an "anti-tag". By "anti-tag" is meant an antibody binding to the tag, or any other molecule capable of binding to such tag.

MHC complexes can be multimerized by other means than coupling or binding to a multimerization domain. Thus, the multimerization domain may be formed during the multimerization of MHCs. One such method is to extend the bound antigenic peptide with dimerization domains. One end of the antigenic peptide is extended with dimerization domain A (e.g. acidic helix, half of a coiled-coil dimer) and the other end is extended with dimerization domain B (e.g. basic helix, other half of a coiled-coil dimer). When MHC complexes are loaded/mixed with these extended peptides the following multimer structure will be formed: A-MHC-BA-MHC-BA-MHC-B etc. The antigenic peptides in the mixture can either be identical or a mixture of peptides with comparable extended dimerization domains. Alternatively both ends of a peptide are extended with the same dimerization domain A and another peptide (same amino acid sequence or a different amino acid sequence) is extended with dimerization domain B. When MHC and peptides are mixed the following structures are formed: A-MHC-AB-MHC-BA-MHC-AB-MHC-B etc. Multimerization of MHC complexes by extension of peptides are restricted to MHC II molecules since the peptide binding groove of MHC I molecules is typically closed in both ends thereby limiting the size of peptide that can be embedded in the groove, and therefore preventing the peptide from extending out of the groove.

Another multimerization approach applicable to both MHC I and MHC II complexes is based on extension of N- and C-terminal of the MHC complex. For example the N-terminal of the MHC complex is extended with dimerization domain A and the C-terminal is extended with dimerization domain B. When MHC complexes are incubated together they pair with each other and form multimers like: A-MHC-BA-MHC-BA-MHC-BA-MHC-B etc. Alternatively the N-terminal and the C-terminal of a MHC complex are both extended with dimerization domain A and the N-terminal and C-terminal of another preparation of MHC complex (either the same or a different MHC) are extended with dimerization domain B. When these two types of MHC complexes are incubated together multimers will be formed: A-MHC-AB-MHC-BA-MHC-AB-MHC-B etc.

In all the above-described examples the extension can be either chemically coupled to the peptide/MHC complex or introduced as extension by gene fusion.

Dimerization domain AB can be any molecule pair able to bind to each other, such as acid/base coiled-coil helices, antibody-antigen, DNA-DNA, PNA-PNA, DNA-PNA, DNA-RNA, LNA-DNA, leucine zipper e.g. Fos/Jun, streptavidin-biotin and other molecule pairs as described elsewhere herein.

Linker Molecules

A number of MHC complexes associate with a multimerization domain to form a MHC multimer. The attachment of MHC complexes to the multimerization domain may involve covalent or non-covalent linkers, and may involve small reactive groups as well as large protein-protein interactions.

The coupling of multimerization domains and MHC complexes involve the association of an entity X (attached to or part of the multimerization domain) and an entity Y (attached to or part of the MHC complex). Thus, the linker that connects the multimerization domain and the MHC complex comprises an XY portion.

Covalent linker. The XY linkage can be covalent, in which case X and Y are reactive groups. In this case, X can be a nucleophilic group (such as —NH$_2$, —OH, —SH, —NH—NH$_2$), and Y an electrophilic group (such as CHO, COOH, CO) that react to form a covalent bond XY; or Y can be a nucleophilic group and X an electrophilic group that react to form a covalent bond XY. Other possibilities exist, e.g either of the reactive groups can be a radical, capable of reacting with the other reactive group. A number of reactive groups X and Y, and the bonds that are formed upon reaction of X and Y, are shown in FIG. 5.

X and Y can be reactive groups naturally comprised within the multimerization domain and/or the MHC complex, or they can be artificially added reactive groups. Thus, linkers containing reactive groups can be linked to either of the multimerization domain and MHC complex; subsequently the introduced reactive group(s) can be used to covalently link the multimerization domain and MHC complex.

Example natural reactive groups of MHC complexes include amino acid side chains comprising —NH$_2$, —OH, —SH, and —NH—. Example natural reactive groups of multimerization domains include hydroxyls of polysaccharides such as dextrans, but also include amino acid side chains comprising —NH$_2$, —OH, —SH, and —NH— of polypeptides, when the polypeptide is used as a multimerization domain. In some MHC multimers, one of the polypeptides of the MHC complex (i.e. the β2M, heavy chain or the antigenic peptide) is linked by a protein fusion to the multimerization domain. Thus, during the translation of the fusion protein, an acyl group (reactive group X or Y) and an amino group (reactive group Y or X) react to form an amide bond. Example MHC multimers where the bond between the multimerization domain and the MHC complex is covalent and results from reaction between natural reactive groups, include MHC-pentamers (described in US patent 2004209295) and MHC-dimers, where the linkage between multimerization domain and MHC complex is in both cases generated during the translation of the fusion protein.

Example artificial reactive groups include reactive groups that are attached to the multimerization domain or MHC complex, through association of a linker molecule comprising the reactive group. The activation of dextran by reaction of the dextran hydroxyls with divinyl sulfone, introduces a reactive vinyl group that can react with e.g. amines of the MHC complex, to form an amine that now links the multimerization domain (the dextran polymer) and the MHC complex. An alternative activation of the dextran multimerization domain involves a multistep reaction that results in the decoration of the dextran with maleimide groups, as described in the patent Siiman et al. U.S. Pat. No. 6,387,622. In this approach, the amino groups of MHC complexes are converted to —SH groups, capable of reacting with the maleimide groups of the activated dextran. Thus, in the latter example, both the reactive group of the multimerization domain (the maleimide) and the reactive group of the MHC complex (the thiol) are artificially introduced.

Sometimes activating reagents are used in order to make the reactive groups more reactive. For example, acids such as glutamate or aspartate can be converted to activated esters by addition of e.g. carbodiimid and NHS or nitrophenol, or by converting the acid moiety to a tosyl-activated ester. The activated ester reacts efficiently with a nucleophile such as —NH$_2$, —SH, —OH, etc.

For the purpose of this invention, the multimerization domains (including small organic scaffold molecules, proteins, protein complexes, polymers, beads, liposomes, micelles, cells) that form a covalent bond with the MHC complexes can be divided into separate groups, depending on the nature of the reactive group that the multimerization domain contains. One group comprise multimerization domains that carry nucleophilic groups (e.g. —NH$_2$, —OH, —SH, —CN, —NH—NH$_2$), exemplified by polysaccharides, polypeptides containing e.g. lysine, serine, and cysteine; another group of multimerization domains carry electrophilic groups (e.g. —COOH, —CHO, —CO, NHS-ester, tosyl-activated ester, and other activated esters, acid-anhydrides), exemplified by polypeptides containing e.g. glutamate and aspartate, or vinyl sulfone activated dextran; yet another group of multimerization domains carry radicals or conjugated double bonds.

The multimerization domains appropriate for this invention thus include those that contain any of the reactive groups shown in FIG. 5 or that can react with other reactive groups to form the bonds shown in FIG. 5.

Likewise, MHC complexes can be divided into separate groups, depending on the nature of the reactive group comprised within the MHC complex. One group comprise MHCs that carry nucleophilic groups (e.g. —NH$_2$, —OH, —SH, —CN, —NH—NH$_2$), e.g. lysine, serine, and cysteine; another group of MHCs carry electrophilic groups (e.g. —COOH, —CHO, —CO, NHS-ester, tosyl-activated ester, and other activated esters, acid-anhydrides), exemplified by e.g. glutamate and aspartate; yet another group of MHCs carry radicals or conjugated double bonds.

The reactive groups of the MHC complex are either carried by the amino acids of the MHC-peptide complex (and may be comprised by any of the peptides of the MHC-peptide complex, including the antigenic peptide), or alternatively, the reactive group of the MHC complex has been introduced by covalent or non-covalent attachment of a molecule containing the appropriate reactive group.

Preferred reactive groups in this regard include —CSO$_2$OH, phenylchloride, —SH, —SS, aldehydes, hydroxyls, isocyanate, thiols, amines, esters, thioesters, carboxylic acids, triple bonds, double bonds, ethers, acid chlorides, phosphates, imidazoles, halogenated aromatic rings, any precursors thereof, or any protected reactive groups, and many others. Example pairs of reactive groups, and the resulting bonds formed, are shown in FIG. 5.

Reactions that may be employed include acylation (formation of amide, pyrazolone, isoxazolone, pyrimidine, comarine, quinolinon, phthalhydrazide, diketopiperazine, benzodiazepinone, and hydantoin), alkylation, vinylation, disulfide formation, Wittig reaction, Horner-Wittig-Emmans reaction, arylation (formation of biaryl or vinylarene), condensation reactions, cycloadditions ((2+4), (3+2)), addition to carbon-carbon multiple bonds, cycloaddition to multiple bonds, addition to carbon-hetero multiple bonds, nucleophilic aromatic substitution, transition metal catalyzed reactions, and may involve formation of ethers, thioethers, secondary amines, tertiary amines, beta-hydroxy ethers, beta-hydroxy thioethers, beta-hydroxy amines, beta-amino ethers, amides, thioamides, oximes, sulfonamides, di- and tri-functional compounds, substituted aromatic compounds, vinyl substituted aromatic compounds, alkyn substituted aromatic compounds, biaryl compounds, hydrazines, hydroxylamine ethers, substituted cycloalkenes, substituted cyclodienes, substituted 1, 2, 3 triazoles, substituted cycloalkenes, beta-hydroxy ketones, beta-hydroxy aldehydes, vinyl ketones, vinyl aldehydes, substituted alkenes, substituted alkenes, substituted amines, and many others.

MHC dextramers can be made by covalent coupling of MHC complexes to the dextran backbone, e.g. by chemical coupling of MHC complexes to dextran backbones. The MHC complexes can be coupled through either heavy chain or β2-microglobulin if the MHC complexes are MHC I or through α-chain or β-chain if the MHC complexes are MHC II. MHC complexes can be coupled as folded complexes comprising heavy chain/beta2microglobulin or α-chain/β-chain or either combination together with peptide in the peptide-binding cleft. Alternatively either of the protein chains can be coupled to dextran and then folded in vitro together with the other chain of the MHC complex not coupled to dextran and together with peptide. Direct coupling of MHC complexes to dextran multimerization domain can be via an amino group or via a sulphide group. Either group can be a natural component of the MHC complex or attached to the MHC complex chemically. Alternatively, a cysteine may be introduced into the genes of either chain of the MHC complex.

Another way to covalently link MHC complexes to dextran multimerization domains is to use the antigenic peptide as a linker between MHC and dextran. Linker containing antigenic peptide at one end is coupled to dextran. Antigenic peptide here means a peptide able to bind MHC complexes in the peptide-binding cleft. As an example, 10 or more antigenic peptides may be coupled to one dextran molecule. When MHC complexes are added to such peptide-dextran construct the MHC complexes will bind the antigenic peptides and thereby MHC-peptide complexes are displayed around the dextran multimerization domain. The antigenic peptides can be identical or different from each other. Similarly MHC complexes can be either identical or different from each other as long as they are capable of binding one or more of the peptides on the dextran multimerization domain.

Non-covalent linker. The linker that connects the multimerization domain and the MHC complex comprises an XY portion. Above different kinds of covalent linkages XY were described. However, the XY linkage can also be non-covalent.

Non-covalent XY linkages can comprise natural dimerization pairs such as antigen-antibody pairs, DNA-DNA interactions, or can include natural interactions between small molecules and proteins, e.g. between biotin and streptavidin. Artificial XY examples include XY pairs such as $His_6$ tag (X) interacting with Ni-NTA (Y) and PNA-PNA interactions.

Protein-protein interactions. The non-covalent linker may comprise a complex of two or more polypeptides or proteins, held together by non-covalent interactions. Example polypeptides and proteins belonging to this group include Fos/Jun, Acid/Base coiled coil structure, antibody/antigen (where the antigen is a peptide), and many others.

A preferred embodiment involving non-covalent interactions between polypeptides and/or proteins are represented by the Pentamer structure described in US patent 2004209295.

Another preferred embodiment involves the use of antibodies, with affinity for the surface of MHC opposite to the peptide-binding groove. Thus, an anti-MHC antibody, with its two binding site, will bind two MHC complexes and in this way generate a bivalent MHC multimer. In addition, the antibody can stabilize the MHC complex through the binding interactions. This is particularly relevant for MHC class II complexes, as these are less stable than class I MHC complexes.

Polynucleotide-polynucleotide interactions. The non-covalent linker may comprise nucleotides that interact non-covalently. Example interactions include PNA/PNA, DNA/DNA, RNA/RNA, LNA/DNA, and any other nucleic acid duplex structure, and any combination of such natural and unnatural polynucleotides such as DNA/PNA, RNA/DNA, and PNA/LNA.

Protein-small molecule interactions. The non-covalent linker may comprise a macromolecule (e.g. protein, polynucleotide) and a small molecule ligand of the macromolecule. The interaction may be natural (i.e., found in Nature, such as the Streptavidin/biotin interaction) or non-natural (e.g. His-tag peptide/Ni-NTA interaction). Example interactions include Streptavidin/biotin and anti-biotin antibody/biotin.

Combinations—non-covalent linker molecules. Other combinations of proteins, polynucleotides, small organic molecules, and other molecules, may be used to link the MHC to the multimerization domain. These other combinations include protein-DNA interactions (e.g. DNA binding protein such as the gene regulatory protein CRP interacting with its DNA recognition sequence), RNA aptamer-protein interactions (e.g. RNA aptamer specific for growth hormone interacting with growth hormone)

Synthetic molecule-synthetic molecule interaction. The non-covalent linker may comprise a complex of two or more organic molecules, held together by non-covalent interactions. Example interactions are two chelate molecules binding to the same metal ion (e.g. EDTA-$Ni^{++}$-NTA), or a short polyhistidine peptide (e.g. $His_6$) bound to NTA-$N^{++}$.

In another preferred embodiment the multimerization domain is a bead. The bead is covalently or non-covalently coated with MHC multimers or single MHC complexes, through non-cleavable or cleavable linkers. As an example, the bead can be coated with streptavidin monomers, which in turn are associated with biotinylated MHC complexes; or the bead can be coated with streptavidin tetramers, each of which are associated with 0, 1, 2, 3, or 4 biotinylated MHC complexes; or the bead can be coated with MHC-dextramers where e.g. the reactive groups of the MHC-dextramer (e.g. the divinyl sulfone-activated dextran backbone) has reacted with nucleophilic groups on the bead, to form a covalent linkage between the dextran of the dextramer and the beads.

In another preferred embodiment, the MHC multimers described above (e.g. where the multimerization domain is a bead) further contains a flexible or rigid, and water soluble, linker that allows for the immobilized MHC complexes to interact efficiently with cells, such as T-cells with affinity for the MHC complexes. In yet another embodiment, the linker is cleavable, allowing for release of the MHC complexes from the bead. If T-cells have been immobilized, by binding to the MHC complexes, the T-cells can very gently be released by cleavage of this cleavable linker. Appropriate cleavable linkers are shown in FIG. 6. Most preferably, the linker is cleaved at physiological conditions, allowing for the integrity of the isolated cells.

Further examples of linker molecules that may be employed in the present invention include Calmodulin-binding peptide (CBP), 6×HIS, Protein A, Protein G, biotin, Avidine, Streptavidine, Strep-tag, Cellulose Binding Domain, Maltose Binding Protein, S-Peptide Tag, Chitin Binding Tag, Immuno-reactive Epitopes, Epitope Tags, GST tagged proteins, E2Tag, HA Epitope Tag, Myc Epitope, FLAG Epitope, AU1 and AU5 Epitopes, Glu-Glu Epitope, KT3 Epitope, IRS Epitope, Btag Epitope, Protein Kinase-C Epitope, VSV Epitope.

The list of dimerization- and multimerization domains, described elsewhere in this document, define alternative non-covalent linkers between the multimerization domain and the MHC complex.

The abovementioned dimerization- and multimerization domains represent specific binding interactions. Another type of non-covalent interactions involves the non-specific adsorption of e.g. proteins onto surfaces. As an example, the non-covalent adsorption of proteins onto glass beads represents this class of XY interactions. Likewise, the interaction of MHC complexes (comprising full-length polypeptide chains, including the transmembrane portion) with the cell membrane of for example dendritic cells is an example of a non-covalent, primarily non-specific XY interaction.

In some of the abovementioned embodiments, several multimerization domains (e.g. streptavidin tetramers bound to biotinylated MHC complexes) are linked to another multimerization domain (e.g. the bead). For the purpose of this invention we shall call both the smaller and the bigger multimerization domain, as well as the combined multimerization domain, for multimerization domain.

Additional Features of MHC Multimer, Antigenic Peptide or Antigenic Polypeptide Product Additional components may be coupled to carrier or added as individual components not coupled to carrier.

Attachment of Biologically Active Molecules to MHC Multimers

Engagement of MHC complex to the specific T cell receptor leads to a signaling cascade in the T cell. However, T-cells normally respond to a single signal stimulus by going into apoptosis. T cells needs a second signal in order to become activated and start development into a specific activation state e.g. become an active cytotoxic T cell, helper T cell or regulatory T cell.

It is to be understood that the MHC multimer of the invention may further comprise one or more additional substituents. The definition of the terms "one or more", "a plurality", "a", "an", and "the" also apply here. Such biologically active molecules may be attached to the construct in order to affect the characteristics of the constructs, e.g. with respect to binding properties, effects, MHC molecule specificities, solubility, stability, or detectability. For instance, spacing could be provided between the MHC complexes, one or both chromophores of a Fluorescence Resonance Energy Transfer (FRET) donor/acceptor pair could be inserted, functional groups could be attached, or groups having a biological activity could be attached.

MHC multimers can be covalently or non-covalently associated with various molecules: having adjuvant effects; being immune targets e.g. antigens; having biological activity e.g. enzymes, regulators of receptor activity, receptor ligands, immune potentiators, drugs, toxins, co-receptors, proteins and peptides in general; sugar moieties; lipid groups; nucleic acids including siRNA; nano particles; small molecules. In the following these molecules are collectively called biologically active molecules. Such molecules can be attached to the MHC multimer using the same principles as those described for attachment of MHC complexes to multimerisation domains as described elsewhere herein. In brief, attachment can be done by chemical reactions between reactive groups on the biologically active molecule and reactive groups of the multimerisation domain and/or between reactive groups on the biologically active molecule and reactive groups of the MHC-peptide complex. Alternatively, attachment is done by non-covalent interaction between part of the multimerisation domain and part of the biological active molecule or between part of the MHC-peptide complex and part of the biological active molecule. In both covalent and non-covalent attachment of the biologically molecule to the multimerisation domain a linker molecule can connect the two. The linker molecule can be covalent or non-covalent attached to both molecules. Examples of linker molecules are described elsewhere herein. Some of the MHCmer structures better allows these kind of modifications than others.

Biological active molecules can be attached repetitively aiding to recognition by and stimulation of the innate immune system via Toll or other receptors.

MHC multimers carrying one or more additional groups can be used as therapeutic or vaccine reagents.

In particular, the biologically active molecule may be selected from:
  proteins such as MHC Class I-like proteins like MIC A, MIC B, CD1d, HLA E, HLA F, HLA G, HLA H, ULBP-1, ULBP-2, and ULBP-3,
  co-stimulatory molecules such as CD2, CD3, CD4, CD5, CD8, CD9, CD27, CD28, CD30, CD69, CD134 (OX40), CD137 (4-1BB), CD147, CDw150 (SLAM), CD152 (CTLA-4), CD153 (CD30L), CD40L (CD154), NKG2D, ICOS, HVEM, HLA Class II, PD-1, Fas (CD95), FasL expressed on T and/or NK cells, CD40, CD48, CD58, CD70, CD72, 67.1 (CD80), B7.2 (CD86), B7RP-1, B7-H3, PD-L1, PD-L2, CD134L, CD137L, ICOSL, LIGHT expressed on APC and/or tumour cells,
  cell modulating molecules such as CD16, NKp30, NKp44, NKp46, NKp80, 2B4, KIR, LIR, CD94/NKG2A, CD94/NKG2C expressed on NK cells, IFN-alpha, IFN-beta, IFN-gamma, IL-1, IL-2, IL-3, IL-4, IL-6, IL-7, IL-8, IL-10, IL-11, IL-12, IL-15, CSFs (colony-stimulating factors), vitamin D3, IL-2 toxins, cyclosporin, FK-506, rapamycin, TGF-beta, clotrimazole, nitrendipine, and charybdotoxin,
  accessory molecules such as LFA-1, CD11a/18, CD54 (ICAM-1), CD106 (VCAM), and CD49a,b,c,d,e,f/CD29 (VLA-4),
  adhesion molecules such as ICAM-1, ICAM-2, GlyCAM-1, CD34, anti-LFA-1, anti-CD44, anti-beta7, chemokines, CXCR4, CCR5, anti-selectin L, anti-selectin E, and anti-selectin P,
  toxic molecules selected from toxins, enzymes, antibodies, radioisotopes, chemiluminescent substances, bioluminescent substances, polymers, metal particles, and haptens, such as cyclophosphamide, methrotrexate, Azathioprine, mizoribine, 15-deoxuspergualin, neomycin, staurosporine, genestein, herbimycin A, *Pseudomonas* exotoxin A, saporin, Rituxan, Ricin, gemtuzumab ozogamicin, Shiga toxin, heavy metals like inorganic and organic mercurials, and FN18-CRM9, radioisotopes such as incorporated isotopes of iodide, cobalt, selenium, tritium, and phosphor, and haptens such as DNP, and digoxiginin, and combinations of any of the foregoing, as well as antibodies (monoclonal, polyclonal, and recombinant) to the foregoing, where relevant. Antibody derivatives or fragments thereof may also be used.

Biological active molecules as described above may also be attached to antigenic peptide products or antigenic polypeptide products using same principles for attachment.

Design and Generation of Product to be Used for Immune Monitoring, Diagnosis, Therapy or Vaccination The product of the present invention may be used for immune monitoring, diagnosis, therapy and/or vaccination. The generation of product may follow some or all of the following general steps.

1. Design of antigenic peptides
2. Choice of MHC allele
3. Generation of product
4. Validation and optimization of product Production of a MHC Multimer, Antigenic Peptide or Antigenic Polypeptide Diagnostic or Immune Monitoring Reagent May Follow Some or all of the Following Steps.

1. Identify disease of interest. Most relevant diseases in this regard are infectious-, auto immune-related diseases.
2. Identify relevant protein antigen(s). This may be individual proteins, a group of proteins from a given tissue or subgroups of proteins from an organism.
3. Identify the protein sequence. Amino acid sequences can be directly found in databases or deduced from gene- or mRNA sequence e.g. using the following link www.ncbi.nlm.nih.gov/Genbank/index.html. If not in databases relevant proteins or genes encoding relevant proteins may be isolated and sequenced. In some cases only DNA sequences will be available without knowing which part of the sequence is protein coding. Then the DNA sequence is translated into amino acid sequence in all reading frames.
4. Choose MHC allele(s). Decide on needed MHC allele population coverage. If a broad coverage of a given population is needed (i.e. when a generally applicable reagents are sought) the most frequently expressed MHC alleles by the population of interest may be chosen e.g. using the database www.allelefrequencies.net/test/default1.asp or epitope.liai.org:8080/tools/population/iedb_input.
   In case of personalized medicine the patient is tissue typed (HLA type) and then MHC alleles may be selected according to that.
5. Run the general peptide epitope generator program described elsewhere herein on all selected amino acid sequences from step 3, thereby generating all possible epitopes of defined length (8'-, 9'-, 10'-, 11'-, 13'-, 14'-, 15' and/or 16'-mers). This procedure is particularly useful when the amino acid sequence is derived from a DNA sequence not knowing the protein encoding areas.
6. If searching for broadly applicable epitope sequences, a good alternative to step 5 is to run the "intelligent" peptide epitope prediction programs on the selected amino acid sequences of step 3 using the selected MHC alleles from step 4 e.g. using epitope prediction programs like www.syfpeithi.de/, www.cbs.dtu.dk/services/NetMHC/, and www.cbs.dtu.dk/services/NetMHCII/. This step can also be used supplementary to step 5 by running selected or all epitopes from the general peptide epitope generator program through one or more of the intelligent peptide epitope prediction programs.
7. If searching for broadly applicable epitope sequences, one may choose to select the epitopes with highest binding score, or the most likely proteolytic products of the species in question for the chosen MHC alleles and run them through the BLAST program (www.ncbi.nlm.nih.gov/blast/Blast.cgi) to validate the uniqueness of the peptides. If the peptide sequences are present in other species, evaluate the potential risk of disease states caused by the non-relevant species in relation to causing false positive results. If considered being a potential problem for evaluating the future analysis outcome, leave out the peptide. Preferably, choose unique peptide sequences only present in the selected protein.
8. Produce selected peptides as described elsewhere herein, e.g. by standard organic synthesis, and optionally test for binding to the desired MHC alleles by e.g in vitro folding, peptide exchange of already preloaded MHC complexes or another method able to test for peptide binding to MHC I or II molecules.
9. Generate desired MHC multimer by covalently or non-covalently attaching MHC-peptide complex(es) to multimerization domain, and optionally attach a fluorophore to the MHC multimer, as described elsewhere herein. Optionally, test efficacy in detecting specific T-cells using e.g. the methods described in the section "Detection".
   The MHC multimer reagents may be used in a diagnostic procedure or kit for testing patient and control samples e.g. by flow cytometry, immune histochemistry, Elispot or other methods as described herein.

In some applications it is desirable to identify epitopes that covers several species and/or strains. E.g. the protein Bap A from *Borrelia* bacteria is very heterologous among *Borrelia* strains meaning that the amino acid sequence of this protein isolated from *Borrelia* different *Borrelia* isolates are varies. In such cases the amino acid sequence from several strains can be aligned e.g. using protein alignment programs (e.g. Vector NTI from Invitrogen) and a homologous sequence for all strains can be identified. This homologous sequence can be run through the general peptide epitope generator program and/or the "intelligent" peptide epitope prediction programs as described above to identify epitopes able to bind selected MHC alleles. The identified epitope may not necessarily have 100% homology to amino acid stretches in any of the proteins selected for alignment. The selected epitopes can be used for generation of MHC multimer diagnostic, immune monitoring or therapeutic reagents.

Production of a MHC Multimer Vaccine or Therapeutic Reagent May Follow Some or all of the Following Steps.

1. As step 1-8 above for diagnostic reagent.
9. Select additional molecules (e.g. biologically active molecules, toxins) to attach to the MHC multimer as described elsewhere herein. The additional molecules can have different functionalities as e.g. adjuvants, specific activators, toxins etc.

10. Test the therapeutic reagent following general guidelines
11. Use for therapy Processes Involving Mhc Multimers, Antigenic Peptides and/or Antigenic Polypeptides.

The present invention relates to methods for detecting the presence of MHC-peptide recognising cells in a sample comprising the steps of
(a) providing a sample suspected of comprising MHC-peptide recognising cells,
(b) contacting the sample with a MHC multimer as defined above, and
(c) determining any binding of the MHC multimer Binding indicates the presence of MHC-peptide recognising cells.
or
(a) providing a sample suspected of comprising MHC-peptide recognising cells,
(b) contacting the sample with an antigenic peptide or antigenic polypeptide, and
(c) determining any binding of the MHC multimer generated as a consequence of addition of antigenic peptide or antigenic polypeptide.

Binding indicates the presence of MHC-peptide recognising cells.

Such methods are a powerful tool in diagnosing various diseases. Establishing a diagnosis is important in several ways. A diagnosis provides information about the disease, thus the patient can be offered a suitable treatment regime. Also, establishing a more specific diagnosis may give important information about a subtype of a disease for which a particular treatment will be beneficial (i.e. various subtypes of diseases may involve display of different peptides which are recognised by MHC-peptide recognising cells, and thus treatment can be targeted effectively against a particular subtype). In this way, it may also be possible to gain information about aberrant cells, which emerge through the progress of the disease or condition, or to investigate whether and how T-cell specificity is affected. The binding of the MHC multimer makes possible these options, since the binding is indicative for the presence of the MHC-peptide recognising cells in the sample, and accordingly the presence of MHC multimers displaying the peptide.

The present invention also relates to methods for monitoring MHC-peptide recognising cells comprising the steps of
(a) providing a sample suspected of comprising MHC-peptide recognising cells,
(b) contacting the sample with a MHC multimer as defined above, and
(c) determining any binding of the MHC multimer, thereby monitoring MHC-peptide recognising cells.
Or
(a) providing a sample suspected of comprising MHC-peptide recognising cells,
(b) contacting the sample with an antigenic peptide or antigenic polypeptide as defined above, and
(c) determining any binding of the MHC multimer generated as a consequence of contacting sample with antigenic peptide or antigenic polypeptide, thereby monitoring MHC-peptide recognising cells.

Such methods are a powerful tool in monitoring the progress of a disease, e.g. to closely follow the effect of a treatment. The method can i.a. be used to manage or control the disease in a better way, to ensure the patient receives the optimum treatment regime, to adjust the treatment, to confirm remission or recurrence, and to ensure the patient is not treated with a medicament which does not cure or alleviate the disease. In this way, it may also be possible to monitor aberrant cells, which emerge through the progress of the disease or condition, or to investigate whether and how T-cell specificity is affected during treatment. The binding of the MHC multimer makes possible these options, since the binding is indicative for the presence of the MHC-peptide recognising cells in the sample, and accordingly the presence of MHC multimers displaying the peptide.

The present invention also relates to methods for establishing a prognosis of a disease involving MHC-peptide recognising cells comprising the steps of
(a) providing a sample suspected of comprising MHC-peptide recognising cells,
(b) contacting the sample with a MHC multimer as defined above, and
(c) determining any binding of the MHC multimer, thereby establishing a prognosis of a disease involving MHC-peptide recognising cells.
Or
(a) providing a sample suspected of comprising MHC-peptide recognising cells,
(b) contacting the sample with an antigenic peptide or antigenic polypeptide as defined above, and
(c) determining any binding of the MHC multimer generated as a consequence of contacting sample with antigenic peptide or antigenic polypeptide, thereby establishing a prognosis of a disease involving MHC-peptide recognising cells.

Such methods are a valuable tool in order to manage diseases, i.a. to ensure the patient is not treated without effect, to ensure the disease is treated in the optimum way, and to predict the chances of survival or cure. In this way, it may also be possible to gain information about aberrant cells, which emerge through the progress of the disease or condition, or to investigate whether and how T-cell specificity is affected, thereby being able to establish a prognosis. The binding of the MHC multimer makes possible these options, since the binding is indicative for the presence of the MHC-peptide recognising cells in the sample, and accordingly the presence of MHC-peptide complexes displaying the peptide.

The present invention also relates to methods for determining the status of a disease involving MHC-peptide recognising cells comprising the steps of
(a) providing a sample suspected of comprising MHC-peptide recognising cells,
(b) contacting the sample with a MHC multimer as defined above, and
(c) determining any binding of the MHC multimer, thereby determining the status of a disease involving MHC-peptide recognising cells.
Or
(a) providing a sample suspected of comprising MHC-peptide recognising cells,
(b) contacting the sample with an antigenic peptide or antigenic polypeptide as defined above, and
(c) determining any binding of the MHC multimer generated as a consequence of contacting sample with antigenic peptide or antigenic polypeptide, thereby establishing a prognosis of a disease involving MHC-peptide recognising cells.

Such methods are a valuable tool in managing and controlling various diseases. A disease could, e.g. change from one stage to another, and thus it is important to be able to determine the disease status. In this way, it may also be possible to gain information about aberrant cells which emerge through the progress of the disease or condition, or to investigate whether and how T-cell specificity is affected, thereby determining the status of a disease or condition. The binding of the MHC-peptide complex makes possible these options, since the binding is indicative for the presence of the MHC-peptide recognising cells in the sample, and accordingly the presence of MHC-peptide complexes displaying the peptide.

The present invention also relates to methods for the diagnosis of a disease involving MHC-peptide recognising cells comprising the steps of
(a) providing a sample suspected of comprising MHC-peptide recognising cells,
(b) contacting the sample with a MHC multimer as defined above, and
(c) determining any binding of the MHC multimer, thereby diagnosing a disease involving MHC-peptide recognising cells.
Or
(a) providing a sample suspected of comprising MHC-peptide recognising cells,
(b) contacting the sample with an antigenic peptide or antigenic polypeptide as defined above, and
(c) determining any binding of the MHC multimer generated as a consequence of contacting sample with antigenic peptide or antigenic polypeptide, thereby establishing a prognosis of a disease involving MHC-peptide recognising cells.

Such diagnostic methods are a powerful tool in the diagnosis of various diseases. Establishing a diagnosis is important in several ways. A diagnosis gives information about the disease, thus the patient can be offered a suitable treatment regime. Also, establishing a more specific diagnosis may give important information about a subtype of a disease for which a particular treatment will be beneficial (i.e. various subtypes of diseases may involve display of different peptides which are recognised by MHC-peptide recognising cells, and thus treatment can be targeted effectively against a particular subtype). Valuable information may also be obtained about aberrant cells emerging through the progress of the disease or condition as well as whether and how T-cell specificity is affected. The binding of the MHC multimer makes possible these options, since the binding is indicative for the presence of the MHC-peptide recognising cells in the sample, and accordingly the presence of MHC multimers displaying the peptide.

The present invention also relates to methods of correlating cellular morphology with the presence of MHC-peptide recognising cells in a sample comprising the steps of
(a) providing a sample suspected of comprising MHC-peptide recognising cells,
(b) contacting the sample with a MHC multimer as defined above, and
(c) determining any binding of the MHC multimer, thereby correlating the binding of the MHC-peptide multimer with the cellular morphology.

Such methods are especially valuable as applied in the field of histochemical methods, as the binding pattern and distribution of the MHC multimers can be observed directly. In such methods, the sample is treated so as to preserve the morphology of the individual cells of the sample. The information gained is important i.a. in diagnostic procedures as sites affected can be observed directly.

The present invention also relates to methods for determining the effectiveness of a medicament against a disease involving MHC-peptide recognising cells comprising the steps of
(a) providing a sample from a subject receiving treatment with a medicament,
(b) contacting the sample with a MHC multimer as defined herein, and
(c) determining any binding of the MHC multimer, thereby determining the effectiveness of the medicament.
Or
(a) providing a sample from a subject receiving treatment with a medicament,
(b) contacting the sample with an antigenic peptide or antigenic polypeptide as defined herein, and
(c) determining any binding of the MHC multimer generated as a consequence of contacting sample with antigenic peptide, thereby determining the effectiveness of the medicament.

Such methods are a valuable tool in several ways. The methods may be used to determine whether a treatment is effectively combating the disease. The method may also provide information about aberrant cells which emerge through the progress of the disease or condition as well as whether and how T-cell specificity is affected, thereby providing information of the effectiveness of a medicament in question. The binding of the MHC multimer makes possible these options, since the binding is indicative for the presence of the MHC-peptide recognising cells in the sample, and accordingly the presence of MHC multimers displaying the peptide.

The present invention also relates to methods for manipulating MHC-peptide recognising cells populations comprising the steps of
(a) providing a sample comprising MHC-peptide recognising cells,
(b) contacting the sample with a MHC multimer immobilised onto a solid support as defined above,
(c) isolating the relevant MHC-peptide recognising cells, and
(d) expanding such cells to a clinically relevant number, with or without further manipulation.

Such ex vivo methods are a powerful tool to generate antigen-specific, long-lived human effector T-cell populations that, when re-introduced to the subject, enable killing of target cells and has a great potential for use in immunotherapy applications against various types of cancer and infectious diseases.

As used everywhere herein, the term "MHC-peptide recognising cells" are intended to mean such which are able to recognise and bind to MHC multimers. The intended meaning of "MHC multimers" is given above. Such MHC-peptide recognising cells may also be called MHC-peptide recognising cell clones, target cells, target MHC-peptide recognising cells, target MHC molecule recognising cells, MHC molecule receptors, MHC receptors, MHC peptide specific receptors, or peptide-specific cells. The term "MHC-peptide recognising cells" is intended to include all subsets of normal, abnormal and defect cells, which recognise and bind to the MHC molecule. Actually, it is the receptor on the MHC-peptide recognising cell that binds to the MHC molecule.

As described above, in diseases and various conditions, peptides are displayed by means of MHC multimers, which are recognised by the immune system, and cells targeting such MHC multimers are produced (MHC-peptide recognising cells). Thus, the presence of such MHC protein recognising cells is a direct indication of the presence of MHC multimers displaying the peptides recognised by the MHC protein recognising cells. The peptides displayed are indicative and may involved in various diseases and conditions.

For instance, such MHC-peptide recognising cells may be involved in diseases of inflammatory, auto-immune, allergic, viral, cancerous, infectious, allo- or xenogene (graft versus host and host versus graft) origin.

The MHC multimers, antigenic polypeptides and antigenic peptides of the present invention have numerous uses and are a valuable and powerful tools e.g. in the fields of therapy, diagnosis, prognosis, monitoring, stratification, and determining the status of diseases or conditions. Thus, the MHC multimers, antigenic polypeptides and/or antigenic peptides may be applied in the various methods involving the detection of MHC-peptide recognising cells.

Furthermore, the present invention relates to compositions comprising the MHC multimers, antigenic polypeptides and/or antigenic peptides in a solubilising medium. The present invention also relates to compositions comprising the MHC multimers, antigenic polypeptides and/or antigenic peptides immobilised onto a solid or semi-solid support.

The MHC multimers, antigenic polypeptides and/or antigenic peptides can be used in a number of applications, including analyses such as flow cytometry, immunohistochemistry (IHC), and ELISA-like analyses, and can be used for diagnostic, prognostic or therapeutic purposes including autologous cancer therapy or vaccines such as HIV vaccine or cancer vaccine.

The MHC multimers are very suitable as detection systems. Thus, the present invention relates to the use of the MHC multimers as defined herein as detection systems.

In another aspect, the present invention relates to the general use of antigenic, antigenic polypeptides peptides, MHC-peptide complexes and multimers of such MHC-peptide complexes in various methods. These methods include therapeutic methods, diagnostic methods, prognostic methods, methods for determining the progress and status of a disease or condition, and methods for the stratification of a patient.

The MHC multimers, antigenic polypeptides and/or antigenic peptides of the present invention are also of value in testing the expected efficacy of medicaments against or for the treatment of various diseases. Thus, the present invention relates to methods of testing the effect of medicaments or treatments, the methods comprising detecting the binding of the MHC multimers to MHC-peptide recognising cells and establishing the effectiveness of the medicament or the treatment in question based on the specificity of the MHC-peptide recognising cells.

As mentioned above, the present invention also relates generally to the field of therapy. Thus, the present invention relates per se to the antigenic peptides, antigenic polypeptides and/or the MHC multimer as defined herein for use as medicaments, and to the antigenic peptides, antigenic polypeptides and the MHC multimers for use in in vivo and ex vivo therapy.

The present invention relates to therapeutic compositions comprising as active ingredients the MHC multimers, antigenic polypeptides and/or the antigenic peptides as defined herein.

An important aspect of the present invention is therapeutic compositions comprising as active ingredients effective amounts of MHC-peptide recognising cells obtained using the MHC multimers as defined herein to isolate relevant MHC-peptide recognising cells, and expanding such cells to a clinically relevant number.

The present invention further relates to methods for treating, preventing or alleviating diseases, methods for inducing anergy of cells, as well as to methods for up-regulating, down-regulating, modulating, stimulating, inhibiting, restoring, enhancing and/or otherwise manipulating immune responses.

The invention also relates to methods for obtaining MHC-peptide recognising cells by using the MHC multimers as described herein.

Also encompassed by the present invention are methods for preparing the therapeutic compositions of the invention.

The present invention is also directed to generating MHC multimers for detecting and analysing receptors on MHC-peptide recognising cells, such as epitope specific T-cell clones or other immune competent effector cells.

It is a further object of the present invention to provide new and powerful strategies for the development of curative vaccines. This in turn will improve the possibilities for directed and efficient immune manipulations against diseases caused by tumour genesis or infection by pathogenic agent like viruses and bacteria. HIV is an important example. The ability to generate and optionally attach recombinant MHC multimers to multimerization domains, such as scaffolds and/or carrier molecules, will enable the development of a novel analytical and therapeutical tool for monitoring immune responses and contribute to a rational platform for novel therapy and "vaccine" applications.

Therapeutic compositions (e.g. "therapeutical vaccines") that stimulate specific T-cell proliferation by peptide-specific stimulation is indeed a possibility within the present invention. Thus, quantitative analysis and ligand-based detection of specific T-cells that proliferate by the peptide specific stimulation should be performed simultaneously to monitoring the generated response.

Application of MHC Multimer, Antigenic Peptides and Antigenic Polypeptides in Immune Monitoring, Diagnostics, Therapy, Vaccine MHC multimers, antigenic polypeptides and antigenic peptides as described herein can be used to identify and isolate specific T cells in a wide array of applications. In principle all kind of samples possessing T cells can be analyzed using MHC multimers, antigenic peptides and/or antigenic polypeptides creating one or more MHC multimers in sample.

MHC multimers detect antigen-specific T cells of the various T cell subsets. T cells are pivotal for mounting an adaptive immune response. It is therefore of importance to be able to measure the number of specific T cells when performing a monitoring of a given immune response. Typically, the adaptive immune response is monitored by measuring the specific antibody response, which is only one of the effector arms of the immune system. This can lead to miss-interpretation of the actual clinical immune status.

In many cases intruders of the organism can hide away inside the cells, which can not provoke a humoral response. In other cases, e.g. in the case of certain viruses the intruder mutates fast, particularly in the genes encoding the proteins that are targets for the humoral response. Examples include the influenza and HIV viruses. The high rate of mutagenesis renders the humoral response unable to cope with the infection. In these cases the immune system relies on the cellular immune response. When developing vaccines against such targets one needs to provoke the cellular response in order to get an efficient vaccine.

MHC multimers, antigenic peptides and/or antigenic polypeptides comprising antigenic peptides can be used for monitoring immune responses elicited by vaccines.

One preferred embodiment of the present invention is monitoring the effect of vaccines against infectious disease, e.g. vaccines against Lyme Borreliosis. Lyme Borreliosis is a dangerous, multisystem and multiorgan disease caused by infection with the bacterial spirochete *Borrelia burgdorferi* senso lato and therefore the possibilities of prophylaxis are of great importance. Many *Borrelia* vaccines aim at eliciting an antibody response, but since the *Borrelia* bacteria have proven to be able to go inside cells a vaccine eliciting a cellular cytotoxic response is desirable. MHC multimers can be used to monitor the effectiveness of such a vaccine, where MHC multimers are any MHC multimer that can be added to a sample or one or more MHC multimers generated in sample by addition of antigenic peptide or antigenic polypeptide.

MHC multimers, antigenic peptides and/or antigenic polypeptides themself can also be valuable as a *Borrelia* vaccine in order to elicit a cellular immune response.

In one embodiment of the present invention MHC multimers having many MHC molecules attached to the multimerisation domain are used as vaccine. Such MHC multimers are able to bind several TCR simultaneously thereby crosslinking the receptors resulting in activation of the T cell in question. Example MHC multimers usefull as vaccine are MHC dextramers where many MHC molecules are coupled to dextran. In principle any MHC multimer as described elsewhere herein that are able to bind several TCR's simultaneously can be used.

In another embodiment of the present invention antigenic peptides and/or antigenic polypeptides are used as a vaccine eliciting a T cell responses directed against the peptide(s). Following administration of such vaccine antigenic peptides and/or antigenic polypeptides are taken up by antigen presenting cells, processed inside cell and displayed as MHC-peptide complexes on the surface of the antigen presenting cells thereby generating cell-based MHC multimers in sample. Such antigen presenting cells displaying antigenic peptide by MHC molecules may then bind TCR on antigen specific T cells and elicit a specific T cell immune response against the antigenic peptides.

In a *Borrelia* vaccine the antigenic peptides used as vaccine themselves, comprised in antigenic polypeptides or bound in the peptide binding cleft of MHC molecules in MHC multimers are derived from antigenic *Borrelia* proteins. In vaccines against other infectious agents peptides derived from antigenic proteins of the relevant pathogen are used.

To further enhance the MHC-peptide specific stimulation of the T cell bound, T cell stimulatory molecules can be coupled to the multimerisation domain together with MHC or may be added as soluble adjuvant together with the MHC multimer, antigenic peptide and/or antigenic polypeptide. Example T cell stimulatory molecules include but are not limited to IL-2, CD80 (B7.1), CD86 (B7.2), anti-CD28 antibody, CD40, CD37ligand (4-1BBL), IL-6, IL-15,IL-21, IFN-γ, IFN-α, IFN-β, CD27 ligand, CD30 ligand, IL-23, IL-1α and IL-1β.

One or more T cell stimulatory molecules may be added together with or coupled to MHC multimer, antigenic peptide and/or antigenic polypeptide. Likewise other adjuvants or molecules enhancing or otherwise affecting the cellular, humoral or innate immune response may be coupled to or added together with the MHC multimer, antigenic peptide and/or antigenic polypeptide vaccine.

The number of antigen-specific cytotoxic T cells can be used as surrogate markers for the overall wellness of the immune system. The immune system can be compromised severely by natural causes such as HIV infections or big traumas or by immuno suppressive therapy in relation to transplantation. The efficacy of an anti HIV treatment can be evaluated by studying the number of common antigen-specific cytotoxic T cells, specific against for example Cytomegalovirus (CMV) and Epstein-Barr virus. In this case the measured T cells can be conceived as surrogate markers. The treatment can then be corrected accordingly and a prognosis can be made.

A similar situation is found for patients undergoing transplantation as they are severely immune compromised due to pharmaceutical immune suppression to avoid organ rejection. The suppression can lead to outbreak of opportunistic infections caused by reactivation of otherwise dormant viruses residing in the transplanted patients or the grafts. This can be the case for CMV and EBV viruses. Therefore measurement of the number of virus specific T cells can be used to give a prognosis for the outcome of the transplantation and adjustment of the immune suppressive treatment. Similarly, the BK virus has been implied as a causative reagent for kidney rejection. Therefore measurement of BK-virus specific T cells can have prognostic value. Measurement of *Borrelia* bacteria specific T cells or T cells specific for other latent bacterial infections can also have a prognostic value.

MHC multimers, antigenic peptide and/or antigenic polypeptide can be of importance in diagnosis of infections caused by bacteria, virus and parasites that hide away inside cells. Serum titers can be very low and direct measurement of the disease-causing organisms by PCR can be very difficult because the host cells are not identified or are inaccessible. Other clinical symptoms of a chronical infection can be unrecognizable in an otherwise healthy individuals, even though such persons still are disease-carriers and at risk of becoming spontaneously ill if being compromised by other diseases or stress.

MHC multimers, antigenic peptide and/or antigenic polypeptide can be of importance in diagnosis of infections caused by bacteria, virus and parasites especially those hiding inside cells. Clinical symptoms of a chronic infection can be unrecognizable in otherwise healthy individuals, even though such persons still are disease-carriers and at risk of becoming spontaneously ill if being compromised by other diseases or stress. In some acute infections the clinical symptoms are similar to clinical symptoms of completely unrelated diseases and therefore diagnosis of the disease is difficult based on clinical symptoms alone. Many infectious agents can be detected directly eg by measurement in serum. However, serum titers of the infectious agent can for other infectious agents be very low and therefore hard to measure. For intracellular pathogens direct measurement of the disease-causing organisms by e.g. PCR can be very difficult because the host cells are not identified or are inaccessible. Instead of detecting the infectious agent directly the immune response elicited by the infections agent may be measured.

Infections caused by extracellular bacteria and parasites often mediate a humoral immune response that can be monitored by measuring the specific antibody response. An alternative to measure antibodies could be measurement of CD4+ T cells which are important for establishing a humoral response.

Likewise infections caused by virus, intracellular bacteria or other infectious agents able to go inside cells can be detected by measurement of CD8+ T cells specific for the infectious agent.

An example of an infectious disease where MHC multimers, antigenic peptide and/or antigenic polypeptide could be usefull is in diagnosis of Borreliosis also called Lyme disease caused by *Borrelia* bacteria. *Borrelia* bacteria are very difficult to detect directly due to low serum titers and their ability to stay inside cells of unknown origin. Clinical symptoms caused by infection with *Borrelia* bacteria depend on the type of bacteria and are similar to clinical symptoms of other diseases. *Borrelia* specific CD4+ and CD8+ T cells can be measured in serum, cerebrospinal fluid and/or joint fluid from infected individuals. The presence of a *Borrelia* infection can be measured using MHC multimers able to detect *Borrelia* specific T cells in liquid samples, preferably blood, from patients suspected to have borreliosis. Such MHC multimers may be added directly to sample or alternatively antigenic peptide and/or antigenic polypeptide may be added to sample and then cell-based MHC multimer generated in sample as described elsewhere herein.

Other bacterial infections where MHC multimers could be usefull for diagnosis is infections caused by intracellular bacteria like *Brucella, Bartonella, Mycobacterium, Listeria, Rickettsia, Chlamydia* and *Salmonella*.

MHC multimers can in principle be applied to diagnosis of any infection caused by an infectious agent eliciting a cellular immune response by measurement of antigen-specific T cells or changes in the amount antigen-specific T cells in the circulation.

Antigen-specific T helper cells and regulatory T cells have been implicated in the development of autoimmune disorders. In most cases the timing of events leading to autoimmune disease is unknown and the exact role of the immune cells not clear. Use of MHC multimers to study these diseases will lead to greater understanding of the disease-causing scenario and make provisions for development of therapies and vaccines for these diseases.

Therapeutic use of MHC multimers, antigenic peptide and/or antigenic polypeptide is possible, either directly or as part of therapeutic vaccines. In therapies involving T cells, e.g. treatment with in vitro amplified antigen-specific effector T cells, the T cells often do not home effectively to the correct target sites but ends up in undesired parts of the body. If the molecules responsible for interaction with the correct homing receptor can be identified these can be added to the MHC multimer making a dual, triple or multiple molecular structure that are able to aid the antigen-specific T cells home to the correct target, as the MHC multimer will bind to the specific T cell and the additional molecules will mediate binding to the target cells.

In a preferable embodiment, MHC multimers bound to other functional molecules are employed to directly block, regulate or kill the targeted cells.

In a preferable embodiment, MHC multimers bound to other functional molecules are employed to directly block, regulate or kill these cells.

In another aspect of the present invention modulation of regulatory T cells could be part of a treatment. In diseases where the function of regulatory T cells is understood it may be possible to directly block, regulate or kill these regulatory cells by means of MHC multimers that besides MHC-peptide complexes also features other functional molecules. The MHC multimers specifically recognize the target regulatory T cells and direct the action of the other functional molecules to this target T cell.

Diseases

MHC multimers, antigenic peptides and/or antigenic polypeptides can be used in immune monitoring, diagnostics, prognostics, therapy and vaccines for many different diseases, including but not limited to the diseases listed in the following.

a) Infectious diseases caused by virus such as,

Adenovirus (subgropus A-F), BK-virus, CMV (Cytomegalo virus, HHV-5), EBV (Epstein Barr Virus, HHV-4), HBV (Hepatitis B Virus), HCV (Hepatitis C virus), HHV-6a and b (Human Herpes Virus-6a and b), HHV-7, HHV-8, HSV-1 (Herpes simplex virus-1, HHV-1), HSV-2 (HHV-2), JC-virus, SV-40 (Simian virus 40), VZV (Varizella-Zoster-Virus, HHV-3), Parvovirus B19, Haemophilus influenza, HIV-1 (Human immunodeficiency Virus-1), HTLV-1 (Human T-lymphotrophic virus-1), HPV (Human Papillomavirus giving rise to clinical manifestions such as Hepatitis, AIDS, Measles, Pox, Chicken pox, Rubella, Herpes and others.

b) Infectious diseases caused by bacteria such as,

Gram positive bacteria, gram negative bacteria, intracellular bacterium, extracellular bacterium, *Mycobacterium tuberculosis, Mycobacterium bovis, Mycobacterium avium* subsp. *Paratuberculosis, Borrelia burgdorferi, Borrelia garinii, Borrelia afzelii*, other spirochetes, *Helicobacter pylori, Streptococcus pneumoniae, Listeria monocytogenes, Histoplasma capsulatum, Bartonella henselae, Bartonella quintana* giving rise to clinical manifestations such as Tuberculosis, Pneumonia, Stomach ulcers, *Paratuberculosis* and others.

c) Infectious diseases caused by fungus such as,

*Aspergillus fumigatus, Candida albicans, Cryptococcus neoformans, Pneumocystis carinii* giving rise to clinical manifestations such as skin-, nail-, and mucosal infections, Meningitis, Sepsis and others.

d) Parasitic diseases caused by parasites such as,

*Plasmodium falciparum, Plasmodium vivax, Plasmodium malariae, Schistosoma mansoni, Schistosoma japonicum, Schistosoma haematobium, Trypanosoma cruzi, Trypanosoma rhodesiense, Trypanosoma gambiense, Leishmania donovani*, and *Leishmania tropica*.

e) Allergic diseases caused by allergens such as,

Birch, Hazel, Elm, Ragweed, Wormwood, Grass, Mould, Dust Mite giving rise to clinical manifestations such as Asthma.

f) Transplantation-related diseases caused by reactions to minor histocompatibility antigens such as HA-1, HA-8, USP9Y, SMCY, TPR-protein, HB-1Y and other antigens in relation to, Graft-versus-host-related disease, allo- or xenogene reactions i.e. graft-versus-host and host-versus-graft disease.

g) Cancerous diseases associated with antigens such as

Survivin, Survivin-2B, Livin/ML-IAP, Bcl-2, Mcl-1, Bcl-X(L), Mucin-1, NY-ESO-1, Telomerase, CEA, MART-1, HER-2/neu, bcr-abl, PSA, PSCA, Tyrosinase, p53, hTRT, Leukocyte Proteinase-3, hTRT, gp100, MAGE antigens, GASC, JMJD2C, JARD2 (JMJ), JHDM3a, WT-1, CA 9, Protein kinases, where the cancerous diseases include malignant melanoma, renal carcinoma, breast cancer, lung cancer, cancer of the uterus, cervical cancer, prostatic cancer, pancreatic cancer, brain cancer, head and neck cancer, leukemia, cutaneous lymphoma, hepatic carcinoma, colorectal cancer, bladder cancer.

h) Autoimmune and inflammatory diseases, associated with antigens such as GAD64, Collagen, human cartilage glycoprotein 39, β-amyloid, Aβ42, APP, Presenilin 1, where the autoimmune and inflammatory diseases include Diabetes type 1, Rheumatoid arthritis, Alzheimer, chronic inflammatory bowel disease, Crohn's disease, ulcerative colitis uterosa, Multiple Sclerosis, Psoriasis Approaches to the Analysis or Treatment of Diseases For each application of a MHC multimer, antigenic peptide or antigenic polypeptide, a number of choices must be made. These include:

A. Disease (to be e.g. treated, prevented, diagnosed, monitored).

B. Application (e.g. analyze by flow cytometry, isolate specific cells, induce an immune response)

C. Label (e.g. should the MHC multimer be labelled with a fluorophore or a chromophore)

D. Biologically active molecule (e.g. should a biologically active molecule such as an interleukin be added or chemically linked to the complex)

E. Peptide sequence (e.g. decide on the sequence of one or more antigenic peptide to be complexed with MHC, encoded in antigenic polypeptide or used as product itself)

F. MHC (e.g. use a MHC allele that does not interfere with the patient's immune system in an undesired way. This step is directly relevant for use of MHC multimers but also indirectly applicable when using antigenic peptide or polypeptide since these will following addition to assay/individual bind MHC molecules in sample/individual generating MHC multimer in sample/individual as described elsewhere herein).

A number of diseases $A_1$-$A_n$, relevant in connection with MHC multimers, antigenic peptide or antigenic polypeptide, have been described herein; a number of applications $B_1$-$B_n$, relevant in connection with MHC multimers, antigenic peptide or antigenic polypeptide, have been described herein; a number of Labels $C_1$-$C_n$, relevant in connection with MHC multimers, have been described herein; a number of biologically active molecules $D_1$-$D_n$, relevant in connection with MHC multimers antigenic peptide or antigenic polypeptide, have been described herein; a number of peptide sequences $E_1$-$E_n$, relevant in connection with MHC multimers, antigenic peptide or antigenic polypeptide, have been described herein; and a number of MHC molecules $F_1$-$F_n$, relevant in connection with MHC multimers, have been described herein.

Thus, each approach involves a choice to be made regarding all or some of the parameters A-F. A given application and the choices it involves can thus be described as follows:

$$Ai \times Bi \times Ci \times Di \times Ei \times Fi$$

Where i specifies a number between 1 and n. n is different for different choices A, B, C, D, E, or F. Consequently, the present invention describes a large number of approaches to the diagnosis, monitoring, prognosis, therapeutic or vaccine treatment of diseases. The total number of approaches, as defined by these parameters, are $$n(A) \times n(B) \times n(C) \times n(D) \times n(E) \times n(F),$$

where n(A) describes the number of different diseases A described herein, n(B) describes the number of different applications B described herein, etc.

Detection

Diagnostic procedures, immune monitoring and some therapeutic processes of the present invention all involve identification and/or enumeration and/or isolation of antigen-specific T cells. Identification and enumeration of antigen-specific T cells may be done in a number of ways, and several assays are currently employed to provide this information.

In the following it is described how MHC multimers, antigenic peptides and/or antigenic polypeptides as described in the present invention can be used to detect specific T cell receptors (TCRs) and thereby antigen-specific T cells in a variety of methods and assays. In the present invention detection includes detection of the presence of antigen-specific TCR/T cells in a sample, detection of and isolation of cells or entities with antigen-specific TCR from a sample and detection and enrichment of cells or entities with antigen-specific TCR in a sample.

The sample may be a biological sample including solid tissue, solid tissue section and fluid samples such as, but not limited to, whole blood, serum, plasma, nasal secretions, sputum, urine, sweat, saliva, transdermal exudates, pharyngeal exudates, bronchoalveolar lavage, tracheal aspirations, cerebrospinal fluid, synovial fluid, fluid from joints, vitreous fluid, vaginal or urethral secretions, semen, or the like. Herein, disaggregated cellular tissues such as, for example, hair, skin, synovial tissue, tissue biopsies and nail scrapings are also considered as biological samples.

Many of the assays and methods described in the present invention are particularly useful for assaying T-cells in blood samples. Blood samples includes but is not limited to whole blood samples or blood processed to remove erythrocytes and platelets (e.g., by Ficoll density centrifugation or other such methods known to one of skill in the art) and the remaining PBMC sample, which includes the T-cells of interest, as well as B-cells, macrophages and dendritic cells, is used directly. Also included are blood samples processed in other ways e.g. isolating various subsets of blood cells by selecting or deselecting cells or entities in blood.

In order to be able to detect specific T cells by MHC multimers, labels and marker molecules can be used.

Marker Molecules

Marker molecules are molecules or complexes of molecules that bind to other molecules. Marker molecules thus may bind to molecules on entities, including the desired entities as well as undesired entities. Labeling molecules are molecules that may be detected in a certain analysis, i.e. the labeling molecules provide a signal detectable by the used method. Marker molecules, linked to labeling molecules, constitute detection molecules. Likewise labeling molecules linked to MHC multimers also constitute detection molecules but in contrast to detection molecules made up of marker and labelling molecule labeled MHC multimers are specific for TCR. Sometimes a marker molecule in itself provides a detectable signal, wherefore attachment to a labeling molecule is not necessary.

Marker molecules are typically antibodies or antibody fragments but can also be aptamers, proteins, peptides, small organic molecules, natural compounds (e.g. steroids), non-peptide polymers, or any other molecules that specifically and efficiently bind to other molecules are also marker molecules.

Labelling Molecules

Labelling molecules are molecules that can be detected in a certain analysis, i.e. the labelling molecules provide a signal detectable by the used method. The amount of labelling molecules can be quantified.

The labelling molecule is preferably such which is directly or indirectly detectable.

The labelling molecule may be any labelling molecule suitable for direct or indirect detection. By the term "direct" is meant that the labelling molecule can be detected per se without the need for a secondary molecule, i.e. is a "primary" labelling molecule. By the term "indirect" is meant that the labelling molecule can be detected by using one or more "secondary" molecules, i.e. the detection is performed by the detection of the binding of the secondary molecule(s) to the primary molecule.

The labelling molecule may further be attached via a suitable linker. Linkers suitable for attachment to labelling molecules would be readily known by the person skilled in the art and as described elsewhere herein for attachment of MHC molecules to multimerisation domains.

Examples of such suitable labelling compounds are fluorescent labels, enzyme labels, radioisotopes, chemiluminescent labels, bioluminescent labels, polymers, metal particles, haptens, antibodies, and dyes.

The labelling compound may suitably be selected:
from fluorescent labels such as 5-(and 6)-carboxyfluorescein, 5- or 6-carboxy-fluorescein, 6-(fluorescein)-5-(and 6)-carboxamido hexanoic acid, fluorescein isothio-cyanate (FITC), rhodamine, tetramethylrhodamine, and dyes such as Cy2, Cy3, and Cy5, optionally substituted coumarin including AMCA, PerCP, phycobiliproteins including R-phycoerythrin (RPE) and allophycoerythrin (APC), Texas Red, Princeton Red, Green fluorescent protein (GFP) and analogues thereof, and conjugates of R-phycoerythrin or allophycoerythrin and e.g. Cy5 or Texas Red, and inorganic fluorescent labels based on semiconductor nanocrystals (like quantum dot and Qdot™ nanocrystals), and time-resolved fluorescent labels based on lanthanides like Eu3+ and Sm3+, from haptens such as DNP, biotin, and digoxiginin,
from enzymic labels such as horse radish peroxidase (HRP), alkaline phosphatase (AP), beta-galactosidase (GAL), glucose-6-phosphate dehydrogenase, beta-N-acetyl-glucosaminidase, R-glucuronidase, invertase, Xanthine Oxidase, firefly luciferase and glucose oxidase (GO),
from luminiscence labels such as luminol, isoluminol, acridinium esters, 1,2-dioxetanes and pyridopyridazines, and
from radioactivity labels such as incorporated isotopes of iodide, cobalt, selenium, tritium, and phosphor.

Radioactive labels may in particular be interesting in connection with labelling of the peptides harboured by the MHC multimers.

Different principles of labelling and detection exist, based on the specific property of the labelling molecule. Examples of different types of labelling are emission of radioactive radiation (radionuclide, isotopes), absorption of light (e.g. dyes, chromophores), emission of light after excitation (fluorescence from fluorochromes), NMR (nuclear magnetic resonance form paramagnetic molecules) and reflection of light (scatter from e.g. such as gold-, plastic- or glass-beads/particles of various sizes and shapes). Alternatively, the labelling molecules can have an enzymatic activity, by which they catalyze a reaction between chemicals in the near environment of the labelling molecules, producing a signal, which include production of light (chemi-luminescence), precipitation of chromophor dyes, or precipitates that can be detected by an additional layer of detection molecules. The enzymatic product can deposit at the location of the enzyme or, in a cell based analysis system, react with the membrane of the cell or diffuse into the cell to which it is attached. Examples of labelling molecules and associated detection principles are shown in table 2 below.

TABLE 2

Examples of labeling molecules and associated detection principles.

| Labelling substance | Effect | Assay-principle |
| --- | --- | --- |
| Fluorochromes | emission of light having a specific spectra | ▫Photometry, Microscopy, spectroscopy PMT, photographic film, CCD's (Color-Capture Device or Charge-coupled device). |
| Radionuclide | irradiation, α, β or gamma ▫ rays | Scintillation counting, GM-tube, photographic film, excitation of phosphor-imager screen |
| Enzyme; HRP, (horse reddish peroxidase), peroxidases in general | catalysis of $H_2O_2$ reduction using luminol as Oxygen acceptor, resulting in oxidized luminal + light catalysis of $H_2O_2$ reduction using a soluble dye, or molecule containing a hapten, such as a biotin residue as Oxygen acceptor, resulting in precipitation. The habten can be recognized by a detection molecule. | ▫Photometry, Microscopy, spectroscopy PMT, photographic film, CCD's (Colour-Capture Device or Charge-coupled device), Secondary label linked antibody |
| Particles; gold, polystyrene beads, pollen and other particles | Change of scatter, reflection and transparency of the associated entity | Microscopy, cytometry, electron microscopy PMT's, light detecting devices, flowcytometry scatter |
| AP (Alkaline Phosphatase) | Catalyze a chemical conversion of a non-detectable to a precipitated detectable molecule, such as a dye or a hapten | ▫Photometry, Microscopy, spectroscopy Secondary label linked antibody |
| Ionophores or chelating chemical compounds binding to specific ions, e.g. $Ca^{2+}$ | Change in absorption and emission spectrums when binding. Change in intensity | ▫Photometry, Cytometry, spectroscopy |
| Lanthanides | Fluorescence Phosphorescence Paramagnetic | ▫photometry, cytometry, spectroscopy NMR (Nuclear magnetic resonance) |

TABLE 2-continued

Examples of labeling molecules and associated detection principles.

| Labelling substance | Effect | Assay-principle |
| --- | --- | --- |
| DNA fluorescing stains | Propidium iodide<br>Hoechst stain<br>DAPI<br>AMC<br>DraQ5 ™<br>Acridine orange<br>7-AAD | ▫Photometry, cytometry, spectroscopy |

Labelling molecules can be used to label MHC multimers as well as other reagents used together with MHC multimers, e.g. antibodies, aptamers or other proteins or molecules able to bind specific structures in another protein, in sugars, in DNA or in other molecules. In the following molecules able to bind a specific structure in another molecule are named a marker.

Labelling molecules can be attached to a given MHC multimer or any other protein marker by covalent linkage as described for attachment of MHC multimers to multimerization domains elsewhere herein. The attachment can be directly between reactive groups in the labelling molecule and reactive groups in the marker molecule or the attachment can be through a linker covalently attached to labelling molecule and marker, both as described elsewhere herein. When labelling MHC multimers the label can be attached either to the MHC complex (heavy chain, (32nn or peptide) or to the multimerization domain.

In particular,
one or more labelling molecules may be attached to the carrier molecule, or one or more labelling molecules may be attached to one or more of the scaffolds, or one or more labelling compounds may be attached to one or more of the MHC complexes, or one or more labelling compounds may be attached to the carrier molecule and/or one or more of the scaffolds and/or one or more of the MHC complexes, or one or more labelling compounds may be attached to the peptide harboured by the MHC molecule.

A single labelling molecule on a marker does not always generate sufficient signal intensity. The signal intensity can be improved by assembling single label molecules into large multi-labelling compounds, containing two or more label molecule residues. Generation of multi-label compounds can be achieved by covalent or non-covalent, association of labelling molecules with a major structural molecule. Examples of such structures are synthetic or natural polymers (e.g. dextramers), proteins (e.g. streptavidin), or polymers. The labelling molecules in a multi-labelling compound can all be of the same type or can be a mixture of different labelling molecules.

In some applications, it may be advantageous to apply different MHC complexes, either as a combination or in individual steps. Such different MHC multimers can be differently labelled (i.e. by labelling with different labelling compounds) enabling visualisation of different target MHC-peptide recognising cells. Thus, if several different MHC multimers with different labelling compounds are present, it is possible simultaneously to identify more than one specific receptor, if each of the MHC multimers presents a different peptide.

Detection principles, such as listed in Table 2, can be applied to flow cytometry, stationary cytometry, and batch-based analysis. Most batch-based approaches can use any of the labelling substances depending on the purpose of the assay. Flow cytometry primarily employs fluorescence, whereas stationary cytometry primarily employs light absorption, e.g. dyes or chromophore deposit from enzymatic activity. In the following section, principles involving fluorescence detection will be exemplified for flow cytometry, and principles involving chromophore detection will be exemplified in the context of stationary cytometry. However, the labelling molecules can be applied to any of the analyses described in this invention.

Labelling Molecules of Particular Utility in Flow Cytometry:

In flow cytometry the typical label is detected by its fluorescence. Most often a positive detection is based on the presents of light from a single fluorochrome, but in other techniques the signal is detected by a shift in wavelength of emitted light; as in FRET based techniques, where the exited fluorochrome transfer its energy to an adjacent bound fluorochrome that emits light, or when using $Ca^{2+}$ chelating fluorescent props, which change the emission (and absorption) spectra upon binding to calcium. Preferably labelling molecules employed in flowcytometry are illustrated in Table 3 and 4 and described in the following.

Simple Fluorescent Labels:
Fluor dyes, Pacific Blue™, Pacific Orange™, Cascade Yellow™,
AlexaFluor®(AF);
  AF405, AF488, AF500, AF514, AF532, AF546, AF555, AF568, AF594, AF610, AF633, AF635, AF647, AF680, AF700, AF710, AF750, AF800
Quantum Dot based dyes, QDot® Nanocrystals (Invitrogen, MolecularProbs)
  Qdot®525, Qdot®565, Qdot®585, Qdot®605, Qdot®655, Qdot®705, Qdot®800
DyLight™ Dyes (Pierce) (DL);
  DL549, DL649, DL680, DL800
Fluorescein (Flu) or any derivate of that, ex. FITC
Cy-Dyes
  Cy2, Cy3, Cy3.5, Cy5, Cy5.5, Cy7
Fluorescent Proteins;
  RPE, PerCp, APC
  Green fluorescent proteins;
    GFP and GFP-derived mutant proteins; BFP, CFP, YFP, DsRed, T1, Dimer2, mRFP1, MBanana, mOrange, dTomato, tdTomato, mTangerine, mStrawberry, mCherry
Tandem dyes:
  RPE-Cy5, RPE-Cy5.5, RPE-Cy7, RPE-AlexaFluor® tandem conjugates; RPE-Alexa610, RPE-TxRed
  APC-Aleca600, APC-Alexa610, APC-Alexa750, APC-Cy5, APC-Cy5.5
Ionophors; ion chelating fluorescent props
  Props that change wavelength when binding a specific ion, such as Calcium Props that change intensity when binding to a specific ion, such as Calcium Combinations of fluorochromes on the same marker. Thus, the marker is not identified by a single fluorochrome but by a code of identification being a specific combination of fluorochromes, as well as inter related ratio of intensities.

Example: Antibody Ab1 and Ab2, are conjugated to both. FITC and BP but Ab1 have 1 FITC to 1 BP whereas Ab2 have 2 FITC to 1 BP. Each antibody may then be identified individually by the relative intensity of each fluorochrome. Any such combinations of n fluorochromes with m different ratios can be generated.

TABLE 3

Examples of preferable fluorochromes

| Fluorofor/Fluorochrome | Excitation nm | Emission nm |
|---|---|---|
| 2-(4'-maleimidylanilino)naphthalene-6-sulfonic acid, sodium salt | 322 | 417 |
| 5-((((2-iodoacetyl)amino)ethyl)amino)naphthalene-1-sulfonic acid | 336 | 490 |
| Pyrene-1-butanoic acid | 340 | 376 |
| AlexaFluor 350 (7-amino-6-sulfonic acid-4-methyl coumarin-3-acetic acid) | 346 | 442 |
| AMCA (7-amino-4-methyl coumarin-3-acetic acid) | 353 | 442 |
| 7-hydroxy-4-methyl coumarin-3-acetic acid | 360 | 455 |
| Marina Blue (6,8-difluoro-7-hydroxy-4-methyl coumarin-3-acetic acid) | 362 | 459 |
| 7-dimethylamino-coumarin-4-acetic acid | 370 | 459 |
| Fluorescamin-N-butyl amine adduct | 380 | 464 |
| 7-hydroxy-coumarine-3-carboxylic acid | 386 | 448 |
| CascadeBlue (pyrene-trisulphonic acid acetyl azide) | 396 | 410 |
| Cascade Yellow | 409 | 558 |
| Pacific Blue (6,8 difluoro-7-hydroxy coumarin-3-carboxylic acid) | 416 | 451 |
| 7-diethylamino-coumarin-3-carboxylic acid | 420 | 468 |
| N-(((4-azidobenzoyl)amino)ethyl)-4-amino-3,6-disulfo-1,8-naphthalimide, dipotassium salt | 426 | 534 |
| Alexa Fluor 430 | 434 | 539 |
| 3-perylenedodecanoic acid | 440 | 448 |
| 8-hydroxypyrene-1,3,6-trisulfonic acid, trisodium salt | 454 | 511 |
| 12-(N-(7-nitrobenz-2-oxa-1,3-diazol-4-yl)amino)dodecanoic acid | 467 | 536 |
| N, N'-dimethyl-N- (iodoacetyl)-N'-(7-nitrobenz-2-oxa-1,3-diazol-4-yl)ethylenediamine | 478 | 541 |
| Oregon Green 488 (difluoro carboxy fluorescein) | 488 | 518 |
| 5-iodoacetamidofluorescein | 492 | 515 |
| Propidium iodide-DNA adduct | 493 | 636 |
| Carboxy fluorescein | 495 | 519 |

TABLE 4

Examples of preferable fluorochrome families

| Fluorochrome family | Example fluorochrome |
|---|---|
| AlexaFluor® (AF) | AF®350, AF405, AF430, AF488, AF500, AF514, AF532, AF546, AF555, AF568, AF594, AF610, AF633, AF635, AF647, AF680, AF700, AF710, AF750, AF800 |
| Quantum Dot (Qdot®) based dyes | Qdot®525, Qdot®565, Qdot®585, Qdot®605, Qdot®655, Qdot®705, Qdot®800 |
| DyLight™ Dyes (DL) | DL549, DL649, DL680, DL800 |
| Small fluorescing dyes | FITC, Pacific Blue™, Pacific Orange™, Cascade Yellow™, Marina blue™, DSred, DSred-2, 7-AAD, TO-Pro-3, |
| Cy-Dyes | Cy2, Cy3, Cy3.5, Cy5, Cy5.5, Cy7 |
| Phycobili Proteins: | R-Phycoerythrin (RPE), PerCP, Allophycocyanin (APC), B-Phycoerythrin, C-Phycocyanin |
| Fluorescent Proteins | (E)GFP and GFP ((enhanced) green fluorescent protein) derived mutant proteins; BFP, CFP, YFP, DsRed, T1, Dimer2, mRFP1, MBanana, mOrange, dTomato, tdTomato, mTangerine, mStrawberry, mCherry |
| Tandem dyes with RPE | RPE-Cy5, RPE-Cy5.5, RPE-Cy7, RPE-AlexaFluor® tandem conjugates; RPE-Alexa610, RPE-TxRed |
| Tandem dyes with APC | APC-Aleca600, APC-Alexa610, APC-Alexa750, APC-Cy5, APC-Cy5.5 |
| Calcium dyes | Indo-1-Ca2+ Indo-2-Ca2+ |

Preferably Labelling Molecules Employed in Stationary Cytometry and IHC

Enzymatic labelling, as exemplified in Table 5:
  Horse radish peroxidase; reduces peroxides ($H_2O_2$), and the signal is generated by the Oxygen acceptor when being oxidized.
    Precipitating dyes; Dyes that when they are reduced they are soluble, and precipitate when oxidized, generating a coloured deposit at the site of the reaction.
    Precipitating agent, carrying a chemical residue, a hapten, for second layer binding of marker molecules, for amplification of the primary signal.
    Luminol reaction, generating a light signal at the site of reaction.
  Other enzymes, such as Alkaline Phosphatase, capable of converting a chemical compound from a non-detectable molecule to a precipitated detectable molecule, which can be coloured, or carries a hapten as described above.

Fluorescent labels, as exemplified in Table 3 and 4; as those described for Flow cytometry are likewise important for used in stationary cytometry, such as in fluorescent microscopy.

TABLE 5

Examples of preferable labels for stationary cytometry

| Label | Enzyme substrate, Oxygen acceptor Chromogen/ precipitating agent | Precipitate or Residue, hapten* for secondary detection layer | Binding partner to hapten |
|---|---|---|---|
| HRP | diaminobenzidine (DAB) | Colored precipitate | — |
| HRP | 3-amino-9-ethyl-carbazole (AEC+) | Colored precipitate | — |
| AP | Fast red dye | Red precipitate | — |
| HRP | biotinyl tyramide | Exposed Biotin residue | Streptavidin, avidine |
| HRP | fluorescein tyramide | Exposed Fluorescein residue | Anti-Fluorecein Antibody |
| "Enzyme" | Substrate that when reacted precipitate | Primary label; being a dye, chemiluminescence's, or exposure of a hapten | Secondary label in case the primary label is a hapten |

Detection Methods and Principles

MHC multimers can be used to detect T-cell receptors (TCR) e.g. T-cells carrying specific TCR. For example, the MHC multimers can be labelled with fluorophores and used in flow cytometer, the MHC multimers can be labelled with chromophores, in order to specifically stain specific T-cells carrying TCRs that specifically bind the MHC multimer in question in e.g. sections of solid tissues using IHC.

ELISA and ELISA-like analyses can be performed with MHC multimers that are labelled with e.g. chromophores, fluorophores or enzymes.

MHC multimers can be used in a wide range os other methods using various principles. In the following methods and principles using MHC multimers for detection of TCR are outlined.

Detection of TCRs with MHC multimers may be direct or indirect.

Direct Detection

Direct detection of TCRs is detection directly of the binding interaction between the specific T cell receptor and the MHC multimer. The MHC multimer may be generated and then added to sample or alternatively MHC multimers are generated in sample by addition of antigenic peptide and MHC molecules attached to multimerization domain to sample.

Direct detection includes detection of TCR when TCR is attached to lipid bilayer (e.g. T cells), when TCR is attached to or in a solid medium or when TCR is in solution.

Direct Detection of TCR Attached to Lipid Bilayer

One type of TCRs to detect and measure are TCRs attached to lipid bilayer including but not limited to naturally occurring T cells (from blood, spleen, lymphnode, brain or any other tissue containing T cells), TCR transfected cells, T cell hybridomas, TCRs embedded in liposomes or any other membrane structure. In the following methods for direct detection of entities of TCRs attached to lipid bilayer will be described and any entity consisting of TCR attached to lipid bilayer will be referred to as T cells.

T cells can be directly detected either when in a fluid solution or when immobilized to a solid support.

Direct Detection of T Cells in Fluid Sample.

T cells can be detected in fluid samples using the methods described below including but not limited to detection of T cells in culture media, in buffers, in water or in other liquids and also suspensions of disrupted tissues e.g. homogenized tissue resuspended in the fluids described above. T cells in fluid samples can be detected individually or detected as populations of T cells. In the following different methods for direct detection of T cells in fluid samples are described.

Direct Detection of Individual T Cells

Direct Detection of Individual T Cells Using Flow Cytometry.

An example of direct detection of individual T cells by flow cytometry is measurement of antigen specific T cells using MHC multimers like Tetramers, Pentamers, Dextramers or similar types of reagents.

Briefly, a suspension of T cells are added MHC multimers, the sample washed and then the amount of MHC multimer bound to each cell are measured. Bound MHC multimers may be labelled directly or measured through addition and binding of labelled marker molecules. The sample is analyzed using a flow cytometer, able to detect and count individual cells passing in a stream through a laser beam. For identification of specific T cells using MHC multimers, cells are stained with fluorescently labeled MHC multimer by incubating cells with fluorochrome labelled MHC multimer and then forcing the cells with a large volume of liquid through a nozzle creating a stream of spaced cells. Each cell passes through a laser beam and any fluorochrome bound to the cell is excited and thereby fluoresces. Sensitive photomultipliers detect emitted fluorescence, providing information about the amount of MHC multimer bound to the cell. By this method MHC multimers can be used to identify specific T cell populations in liquid samples such as blood, CSF, synovial fluid, cell cultures or any other liquid sample containing T cells.

When analyzing blood samples whole blood can be used with or without lysis of red blood cells. Alternatively lymphocytes can be purified from blood before flow cytometry analysis e.g. using a standard procedure like a Ficoll-Hypaque gradient. Another possibility is to isolate lymphocytes, subgroups of lymphocytes, T cells or subgroups of T cells from the blood sample for example by affinity purification like binding to antibody coated surfaces, followed by elution of bound cells. This purified lymphocyte or T cell population can then be used for flow cytometry analysis together with MHC multimers.

Instead of actively isolating T cells or subgroups of lymphocytes unwanted cells like B cells, NK cells or any other unwanted cells or substances can be removed prior to the analysis. One way to do this is by affinity purification e.g. using columns or beads or other surfaces coated with antibodies specific for the unwanted cells. Alternatively, specific antibodies recognizing the unwanted cells can be added to the blood sample together with complement proteins, thereby killing cells recognized by the antibodies.

Various gating reagents can be included in the analysis. Gating reagents here means labeled antibodies or other labeled marker molecules identifying subsets of cells by binding to unique surface proteins. Preferred gating reagents when using MHC multimers are antibodies or other marker molecules directed against CD3, CD4, and CD8 identifying major subsets of T cells. Other preferred gating reagents are antibodies or marker molecules specifically binding CD14, CD15, CD19, CD25, CD56, CD27, CD28, CD45, CD45RA, CD45RO, CCR7, CCR5, CD62L, Foxp3, CD95, CD127, CD7, CD57, CD154 or other specific proteins or molecules unique for different lymphocytes of the immune system.

Following labelling with MHC multimers and before analysis on a flow cytometer stained cells can be treated with a fixation reagent e.g. formaldehyde to cross-link bound MHC multimer to the cell surface. Stained cells can also be analyzed directly without fixation.

The number of cells in a sample can vary. When the target cells are rare, it is preferable to analyze large amounts of cells. In contrast, fewer cells are required when looking at T cell lines or samples containing many cells of the target cell type.

The flow cytometer can be equipped to separate and collect particular types of cells. This is called cell sorting. MHC multimers in combination with sorting on a flowcytometer can be used to isolate specific T cell populations. Isolated specific T cell populations can then be further manipulated as described elsewhere herein, e.g. expanded in vitro. This can be useful in autologous cancer therapy.

Amounts of MHC-peptide specific T cells in a blood sample can be determined by flow cytometry by calculating the amount of MHC multimer labeled cells in a given volumen of sample with a given cell density and then back calculate. Exact enumeration of specific T cells is better achieved by incubating sample with MHC multimers (and optionally gating reagents) together with an exact amount of counting beads followed by flow cytometry analysis. Counting beads is here to be understood as any fluorescent bead with a size that can be visualized in a sample containing T cells by flow cytometry. The beads could e.g. be made of polystyrene with a size of about 1-10 µm. They could also be made of agarose, polyacrylamide, silica, or any other material, and have any size between 0.1 µm and 100 µm. The counting beads are used as reference population to measure the exact volume of analyzed sample. The sample are analyzed on a flow cytometer and the amount of MHC-specific T cell detected can then be correlated with the amount of counting beads in the same volume of the sample and an exact number of MHC-peptide specific T cells determined using the following equation:

Concentration of MHC-specific $T$-cell in sample=
(number of MHC-peptide specific $T$ cells counted/number of counting beads counted)×concentration of counting beads in sample Alternatively MHC multimers are added to one tube (below denoted tube 1) together with sample and counting beads are added to a separate tube (below denoted tube 2) containing the same sample but no MHC multimers. To both tubes one or more gating reagents are added able to identify other cell subsets in sample e.g. CD3+, CD4+, CD8+, CD19+, CD56+ cells. The exact amount of one of the cell subsets for which gating reagents are included are then calculated from the tube containing counting beads. For example if CD8+ cells are measured in both tubes the following equation can be used to determine the exact concentration of CD8+ cells in the sample:

(((number of CD8+ cells counted (tube 2))/(number of counting beads counted (tube 2)))×(concentration of counting beads in sample)=exact concentration of CD8+ cells in sample The exact concentration of CD8+ cells in sample are then used to determine the exact concentration of MHC-specific T cells in sample using the equation:

(Calculated exact concentration of CD8+ cells in sample (calculated from tube 2))×(MHC-specific $T$ cells counted as percentage of CD8+ events counted in sample (tube 1))=concentration of MHC-specific $T$-cell in sample Direct Detection of Individual T Cells in Fluid Sample by Microscopy A suspension of T cells are added MHC multimers, the sample washed and then the amount of MHC multimer bound to each cell are measured. Bound MHC multimers may be labelled directly or labelled through addition of labelled marker molecules. The sample is then spread out on a slide or similar in a thin layer able to distinguish individual cells and labelled cells identified using a microscope. Depending on the type of label different types of microscopes may be used, e.g. if fluorescent labels are used a fluorescent microscope is used for the analysis. For example MHC multimers can be labeled with a flourochrome or bound MHC multimer detected with a fluorescent antibody. Cells with bound fluorescent MHC multimers can then be visualized using an immunofluorescence microscope or a confocal fluorescence microscope.

Direct Detection of Populations of T Cells

Cell suspensions are added labeled MHC multimer, samples are washed and then total signal from label are measured. The MHC multimers may be labeled themselves or detected through a labeled marker molecule.

Cell suspensions are added labeled MHC multimer, samples are washed and then signal from label are amplified and then total signal from label and/or amplifier are measured.

Direct Detection of Immobilized T Cells.

T cells may be immobilized and then detected directly. Immobilization can be on solid support, in solid tissue or in fixator (e.g. paraffin, a sugar matrix or another medium fixing the T cells).

Direct Detection of T Cells Immobilized on Solid Support.

In a number of applications, it may be advantageous to immobilize the T cell onto a solid or semi-solid support. Such support may be any which is suited for immobilisation, separation etc. Non-limiting examples include particles, beads, biodegradable particles, sheets, gels, filters, membranes (e. g. nylon membranes), fibres, capillaries, needles, microtitre strips, tubes, plates or wells, combs, pipette tips, micro arrays, chips, slides, or indeed any solid surface material. The solid or semi-solid support may be labelled, if this is desired. The support may also have scattering properties or sizes, which enable discrimination among supports of the same nature, e.g. particles of different sizes or scattering properties, colour or intensities.

Conveniently the support may be made of glass, silica, latex, plastic or any polymeric material. The support may also be made from a biodegradable material.

Generally speaking, the nature of the support is not critical and a variety of materials may be used. The surface of support may be hydrophobic or hydrophilic.

Preferred are materials presenting a high surface area for binding of the T cells. Such supports may for example be porous or particulate e.g. particles, beads, fibres, webs, sinters or sieves. Particulate materials like particles and beads are generally preferred due to their greater binding capacity. Particularly polymeric beads and particles may be of interest.

Conveniently, a particulate support (e.g. beads or particles) may be substantially spherical. The size of the particulate support is not critical, but it may for example have a diameter of at least 1 µm and preferably at least 2 µm, and have a maximum diameter of preferably not more than 10 µm and more preferably not more than 6 µm. For example, particulate supports having diameters of 2.8 µm and 4.5 µm will work well.

An example of a particulate support is monodisperse particles, i.e. such which are substantially uniform in size (e. g. size having a diameter standard deviation of less than 5%). Such have the advantage that they provide very uniform reproducibility of reaction. Monodisperse particles, e.g. made of a polymeric material, produced by the technique described in U.S. Pat. No. 4,336,173 (ref. 25) are especially suitable.

Non-magnetic polymer beads may also be applicable. Such are available from a wide range of manufactures, e.g. Dynal Particles AS, Qiagen, Amersham Biosciences, Serotec, Seradyne, Merck, Nippon Paint, Chemagen, Promega, Prolabo, Polysciences, Agowa, and Bangs Laboratories.

Another example of a suitable support is magnetic beads or particles. The term "magnetic" as used everywhere herein is intended to mean that the support is capable of having a magnetic moment imparted to it when placed in a magnetic field, and thus is displaceable under the action of that magnetic field. In other words, a support comprising magnetic beads or particles may readily be removed by magnetic aggregation, which provides a quick, simple and efficient way of separating out the beads or particles from a solution. Magnetic beads and particles may suitably be paramagnetic or superparamagnetic. Superparamagnetic beads and particles are e.g. described in EP 0 106 873 (Sintef, ref. 26). Magnetic beads and particles are available from several manufacturers, e.g. Dynal Biotech ASA (Oslo, Norway, previously Dynal AS, e.g. Dynabeads®).

The support may suitably have a functionalised surface. Different types of functionalisation include making the surface of the support positively or negatively charged, or hydrophilic or hydrophobic. This applies in particular to beads and particles. Various methods therefore are e.g. described in U.S. Pat. No. 4,336,173 (ref. 25), U.S. Pat. No. 4,459,378 (ref. 27) and U.S. Pat. No. 4,654,267 (ref. 28).

Immobilized T cells may be detected in several ways including:

Direct Detection of T Cells Directly Immobilized on Solid Support.

T cells may be directly immobilized on solid support e.g. by non-specific adhesion. Then MHC multimers are added to the immobilized T cells thereby allowing specific T cells to bind the MHC multimers. Bound MHC multimer may be measured through label directly attached to the multimer or through labeled marker molecules. Individual T cells may be detected if the method for analysis is able to distinguish individual labelled cells, e.g. cells are immobilized in a monolayer on a cell culture well or a glass slide. Following staining with labelled multimer a digital picture is taken and labelled cells identified and counted. Alternatively a population of T cells is detected by measurement of total signal from all labelled T cells, e.g. cells are plated to wells of a microtiter plate, stained with labelled MHC multimer and total signal from each well are measured.

Direct Detection of T Cells Immobilized on Solid Support Through Linker Molecule T cells can also be immobilized to solid support through a linker molecule. The linker molecule can be an antibody specific for the T cell, a MHC multimer, or any molecule capable of binding T cells. In any case the linker may be attached directly to the solid support, to the solid support through another linker, or the linker molecule may be embedded in a matrix, e.g. a sugar matrix.

Then MHC multimers are added to the immobilized T cells thereby allowing specific T cells to bind the MHC multimers. Bound MHC multimer may be measured through label directly attached to the multimer or through labeled marker molecules. Individual T cells may be detected if the method for analysis is able to distinguish individual labelled cells, e.g. a digital picture is taken and labelled cells identified and counted.

By using a specific MHC multimer both for the immobilization of the T-cells and for the labelling of immobilized cells (e.g. by labelling immobilized cells with chromophore- or fluorophore-labelled MHC multimer), a very high analytical specificity may be achieved because of the low background noise that results.

Alternatively a population of T cells is detected by measurement of total signal from all labeled T cells.

Immuno Profiling: Phenotyping T Cell Sample Using MHC Multimer Beads or Arrays.

Different MHC multimers are immobilized to different beads with different characteristics (e.g. different size, different fluorophores or different fluorescence intensities) where each kind of bead has a specific type of MHC multimer molecule immobilized. The immobilization may be direct or through a linker molecule as described above. The amount of bound T cells to a specific population of beads can be analyzed, thereby phenotyping the sample. The TCR on the T cell is defined by the MHC multimer and hence the bead to which it binds.

Likewise, MHC multimers can be immobilized in an array, e.g. on a glass plate or pin array so that the position in the array specifies the identity of the MHC multimer. Again, the immobilization may be direct or through a linker molecule as described above. After addition of T cells, the amount of bound T cells at a specified position in the array can be determined by addition of a label or labelled marker that binds to cells in general, or that binds specifically to the cells of interest. For example, the cells may be generally labelled by the addition of a labelled molecule that binds to all kinds of cells, or specific cell types, e.g. CD4+ T-cells, may be labelled with anti-CD4 antibodies that are labelled with e.g. a chromophore or fluorophore. Either of these approaches allow a phenotyping of the sample. An example for the use of immuno profiling is given below.

Profiling of an individual's disease-specific T-cell repertoire.

Mass profiling of the T-cells of an individual may be done by first immobilizing specific MHC multimers (e.g. $10-10^6$ different MHC multimers, each comprising a specific MHC-peptide combination) in an array (e.g. a glass plate), adding e.g. a blood sample from the individual, and then after washing the unbound cells off, label the immobilized cells. Positions in the array of particularly high staining indicate MHC-peptide combinations that recognize specific T-cells of particularly high abundance or affinity. Thus, an immuno profiling of the individual with regard to the tested MHC-peptide combinations is achieved. A similar profiling of an individuals disease may be made using MHC multimers immobilized to different beads as described above.

Whether the profiling is performed using beads or arrays, the profiling may entail a number of diseases, a specific disease, a set of specific antigens implicated in one or more diseases, or a specific antigen (e.g. implicated in a specific disease or set of diseases).

In a preferred embodiment, an individual's immuno profile for a particular antigen is obtained. Thus, peptides corresponding to all possible 8'-, 9'- 10'- and 11'-mer peptide sequences derived from the peptide antigen sequence are generated, for example by standard organic synthesis or combinatorial chemistry, and the corresponding MHC multimers are produced, using one or more of the class I MHC-alleles of the individual in question. Further, peptides of e.g. 13, 14, 15, 16 and up to 25 amino acids length may be generated, for example by organic synthesis or combinatorial chemistry, corresponding to all 13', 14', 15', 16' and up to 25'-mers of the antigen, and the corresponding class II MHC multimers are produced, using one or more of the class II MHC-alleles of the individual in question. For a complete profiling for this particular antigen, all of the HLA-alleles of the individual in question should be used for the generation of the array; i.e., if the HLA class I haplotype of the individual is HLA-A*02, HLA-A*03, HLA-B*08 and HLA-B*07, all these HLA class I alleles should be combined with every tested peptide and similarly for all HLA class II alleles of the given individual.

Based on the profile, a personalized drug, -vaccine or -diagnostic test may be produced.

The principle described above may also be employed to distinguish between the immune response raised against a disease (e.g. an infection with a bacterium or the formation of a tumour), and the immune response raised against a vaccine for the same disease (in the example, a vaccine against the bacterium or the tumour). Most vaccines consists of subcomponents of the pathogen/tumour they are directed against and/or are designed to elicit an immune response different from the natural occurring immune response i.e. the T cell epitopes of the two immune responses differs. Thus, by establishing the immuno profile, using a comprehensive array (i.e. an array that comprises all possible epitopes from one or more antigen(s)) or a subset of these epitopes, it is possible to deduce whether the immune response has been generated against the disease or the vaccine, or against both the disease and the vaccine. If the vaccine raises a response against a particular epitope or a particular set of epitopes, the corresponding positions in the array will give rise to high signals (compared to the remaining positions). Similarly a natural generated immune response will be directed against other and/or more particular epitopes and therefore give rise to high signals in other positions and/or more positions in the array. When an individual is vaccinated the immuno profile will reflect the effect of the vaccination on the immune response, and even if the individual has encountered the disease before and has generated a general immune response towards this disease, it will still be possible to deduce from the profiling whether this individual also has generated a specific response against the vaccine.

In another preferred embodiment, an individual's immuno profile for a set of antigens implicated in a specific disease is obtained. A subset of epitopes from a number of antigens is used. Thus, this is not a comprehensive profiling of this individual with regard to these antigens, but careful selection of the epitopes used may ensure that the profiling data can be used afterwards to choose between e.g. a limited set of vaccines available, or the data can be used to evaluate the immune response of the individual following an infection, where the epitopes used have been selected in order to avoid interference from related infectious diseases.

As above, a personalized drug, -vaccine or -diagnostic test may be produced. based on the information obtained from the immuno profiling.

In yet another preferred embodiment, the array comprising all possible 8'-, 9'-10'- and 11'-mer peptide sequences derived from a given peptide antigen, and all 13, 14, 15 and 16'-mers of the same antigen, are synthesized and assembled in MHC multimers, and immobilized in an array. Then, the ability of the individual peptide to form a complex with MHC is tested.

As an example, one may add labelled W6/32 antibody, an antibody that binds correctly folded MHC I heavy chain, when this heavy chain is assembled together with antigenic peptide and beta2microglobulin, and which therefore can be used to detect formation of MHC-peptide complex, as binding of W6/32 antibody is usually considered a strong indication that the MHC-peptide complex has been formed. The ability of different peptides to enter into a MHC-peptide complex may also be promoted by the addition to the array of T-cells. Specific T-cells will drive the formation of the corresponding specific MHC-peptide complexes. Thus, after addition of T-cells to the array, the MHC-peptide complex integrity can be examined by addition of the labelled W6/32 antibody or other antibodies specific for correct conformation. Positions on the array that have strong signals indicate that the peptide that was added to MHC and immobilized at this position, was capable of forming the MHC-peptide complex in the presence of specific T-cells. Alternatively, the binding of the specific T-cells to the corresponding MHC-peptide complexes may be detected directly through a labelled antibody specific for the T cell.

Direct Detection of Immobilized T Cells Followed by Sorting

Specific T cells or specific T cell subsets can be isolated from a sample containing other T cells, T cell subsets and/or other cells by immobilization of the wanted specific T cells in sample to solid support as described above followed by washing and elution. For example, MHC multimers are immobilized to a support e.g. beads, immunotubes, wells of a microtiterplate, CD, microchip or similar as described elsewhere herein, then a suspension of T cells (the sample) are added allowing specific T cells to bind MHC multimer molecules. Following washing bound T cells are recovered/eluted (e.g. using acid or competition with one or more competitor molecules) and counted.

Specific T-cells can e.g. be isolated through the use of bead-based MHC multimers. Bead-based MHC multimers are beads whereto monomer MHC-peptide complexes or MHC multimers are immobilized.

The isolated T cells can following elution optionally be manipulated further before final use. For example the isolated cells can be activated (to differentiate or proliferate), they can undergo induced apoptosis, or undesired cells of the isolated cell population can be removed. Then, the manipulated cell population can be re-introduced into the patient from which the sample originate, or can be introduced into another patient. A typical cell sorting experiment, based on bead-based MHC multimers, would follow some of the steps of the general procedure outlined in general terms in the following:

Acquire the sample, e.g. a cell sample from the blood or bone marrow of a cancer patient.

Block the sample with a protein solution, e.g. BSA or skim milk.

Block the beads coated with MHC complexes or MHC multimers, with BSA or skim milk.

Mix MHC-coated beads and the cell sample, and incubate.

Wash the beads with washing buffer, to remove unbound cells and non-specifically bound cells.

Isolate the immobilized cells, by either cleavage of the linker that connects MHC complex/MHC multimer and bead; or alternatively, release the cells by a change in pH, salt-concentration addition of competitive binding molecule or the like. Preferably, the cells are released under conditions that do not disrupt the integrity of the cells. Manipulate the isolated cells (e.g. induce apoptosis, proliferation or differentiation)

Direct Detection of T Cells in Solid Tissue.

Direct Detection of T Cells in Solid Tissue In Vitro.

Example direct detection of T cells in solid tissue in vitro include but is not limited til Immunohistochemistry (IHC). IHC is here referred to as the detection of antigens in solid tissue by antibodies or other marker molecules labelled with a labelling molecule as described elsewhere herein.

For in vitro methods of the present invention solid tissue includes tissue, tissue biopsies, frozen tissue or tissue biopsies, paraffin embedded tissue or tissue biopsies and sections of either of the above mentioned. In a preferred method of this invention sections of fixed or frozen tissues are incubated with MHC multimer, allowing MHC multimer to bind to specific T cells in the tissue section. The MHC multimer may be labeled directly or through a labeled marker molecule. As an example, the MHC multimer can be labeled with a tag that can be recognized by e.g. a secondary antibody, optionally labeled with HRP or another label. The bound MHC multimer is then detected by its fluorescence or absorbance (for fluorophore or chromophore), or by addition of an enzyme-labeled antibody directed against this tag, or another component of the MHC multimer (e.g. one of the protein chains, a label on the multimerization domain). The enzyme can be Horse Raddish Peroxidase (HRP) or Alkaline Phosphatase (AP), both of which convert a colorless substrate into a colored reaction product in situ. This colored deposit identifies the binding site of the MHC multimer, and can be visualized under a light microscope. The MHC multimer can also be directly labeled with e.g. HRP or AP, and used in IHC without an additional antibody.

The tissue sections may derive from blocks of tissue or tissue biopsies embedded in paraffin, and tissue sections from this paraffin-tissue block fixed in formalin before staining. This procedure may influence the structure of the TCR in the fixed T cells and thereby influence the ability to recognize specific MHC complexes. In this case, the native structure of TCR needs to be at least partly preserved in the fixed tissue. Fixation of tissue therefore should be gentle. Alternatively, the staining is performed on frozen tissue sections, and the fixation is done after MHC multimer staining.

Direct Detection of T Cells in Solid Tissue In Vivo

For in vivo detection of T cells labeled MHC multimers are injected in to the body of the individual to be investigated. The MHC multimers may be labeled with e.g. a paramagnetic isotope. Using a magnetic resonance imaging (MRI) scanner or electron spin resonance (ESR) scanner MHC multimer binding T cells can then be measured and localized. In general, any conventional method for diagnostic imaging visualization can be utilized. Usually gamma and positron emitting radioisotopes are used for camera and paramagnetic isotopes for MRI.

The methods described above for direct detection of TCR embedded in lipid bilayers collectively called T cells using MHC multimers also applies to detection of TCR in solution and detection of TCR attached to or in a solid medium. Though detection of individual TCRs may not be possible when TCR is in solution.

Indirect Detection of TCR

Indirect detection of TCR is primarily usefull for detection of TCRs embedded in lipid bilayer, preferably natural occurring T cells, T cell hybridomas or transfected T cells. MHC multimers used for the indirect detection may be generated and then added to sample. Alternatively MHC multimers are generated in sample by addition of antigenic peptide and/or antigenic polypeptide to sample and optionally also addition of MHC molecules, components of MHC molecules or MHC molecules coupled to carrier. For example when antigenic peptide and/or antigenic polypeptide is added to a sample containing antigen presenting cells, the antigenic peptide and/or antigenic polypeptide are taken up by antigen presenting cells in sample, processed inside cells and displayed on their surface by binding MHC molecules, or the antigenic peptides added are bound directly to MHC molecules displayed on the surface of antigen presenting cells by exchange with peptide already present in the peptide binding cleft of the MHC molecules.

In indirect detection, the number or activity of T cells are measured, by detection of events that are the result of TCR-MHC-peptide complex interaction. Interaction between MHC multimer and T cell may stimulate the T cell resulting in activation of T cells, in cell division and proliferation of T cell populations or alternatively result in inactivation of T cells. All these mechanism can be measured using various detection methods.

Indirect Detection of T Cells by Measurement of Activation.

MHC multimers, e.g. antigen presenting cells, can stimulate T cells resulting in activation of the stimulated T cells. Activation of T cell can be detected by measurement of production of specific soluble factor from the stimulated T cell, e.g. production of cytokines like INFγ and IL2. Stimulation of T cells can also be detected by measurement of changes in expression of specific surface receptors, or by measurement of T cell effector functions.

Measurement of activation of T cells involves the following steps:

a) Antigenic peptide is added to a sample of T cells containing antigen presenting cells, preferably a suspension of cells e.g. blood. The antigenic peptide have to be able to bind MHC I or MHC II molecules of one or more antigen presenting cells in the sample thereby generating one or more cell based MHC multimer(s) in sample. Alternatively, antigenic polypeptide protein or protein fragment containing one or more antigenic peptides sequences is added to such sample. The protein/protein fragments antigenic polypeptide is then taken up by antigen presenting cells in sample, processed into antigenic peptides and presented by MHC I or MHC II molecules on the surface of antigen presenting cells thereby creating cell based MHC multimers in the sample. Several different antigenic peptides or antigenic proteins polypeptides may be added to the sample. The peptide-loaded antigen presenting cells (the cell based MHC multimers) can then stimulate specific T cells in sample, and thereby induce the production of soluble factor, up- or down-regulation of surface receptors, or mediate other changes in the T cell, e.g. enhancing effector functions.

Alternatively, one or more MHC multimer(s) containing one or more antigenic peptide(s) are added to a sample containing T cells, preferably a suspension of cells, to stimulate MHC multimer specific T cells in sample and thereby induce production of soluble factor, up- or down-regulation of surface receptor and/or other changes in the T cell.

Following addition of antigenic peptide, antigenic protein antigenic polypeptide or MHC multimer to sample, a second soluble factor, e.g. cytokine and/or growth factor(s) may optionally be added to facilitate continued activation and expansion of antigen-specific T cells b) Detection of the presence of produced soluble factor, the presence/absence of surface receptor or detection of effector function.

Correlate the measured result with presence of T cells. The measured signal/response indicates the presence of specific T cells that have been stimulated with particular MHC multimer. The signal/response of a T lymphocyte population is a measure of the overall response in sample.

The frequency of specific T cells able to respond to a given MHC multimer can be determined by including a limiting-dilution culture in the assay also called a Limiting dilution assay.

The limiting-dilution culture method involves the following steps:

i. Sample of T cells in suspension are plated into culture wells at increasing dilutions.

ii. Antigen presenting cells are provided into the sample if not already in sample and then antigenic peptide or protein polypeptide containing one or more antigenic peptide sequence(s) is added to the sample as described above thereby creating cell based MHC multimers in sample able to stimulate antigen-specific T cells in the sample. Alternatively, already generated MHC multimers are added to sample to stimulate specific T cells.

Optionally growth factors, cytokines or other factors helping T cells to proliferate are added.

iii. Cells are allowed to grow and proliferate (½— several days). Each well that initially contained a specific T cell will make a response to the MHC multimer and divide.

iv. Wells are tested for a specific response e.g. production of soluble factors, cell proliferation, cytotoxicity or other effector functions.

The assay is replicated with different numbers of T cells in the sample, and each well that originally contained a specific T cell will make a response to the MHC multimer. The frequency of specific T cells in the sample equals the reciprocal of the number of cells added to each well when 37% of the wells are negative, because due to Poisson distribution each well then on average contained one specific T cell at the beginning of the culture.

Optionally step i) and ii) from above maybe reversed, e.g. adding sample containing T cells in various dilutions to wells or containers containing MHC multimer, antigenic peptide, antigenic peptide+antigen presenting cells, antigenic polypeptide or antigenic polypeptide+antigen presenting cells or MHC multimer.

In the following various methods to measure production of specific soluble factor, expression of surface receptors, effector functions or proliferation is described.

Indirect Detection of T Cells by Measurement of Production of Soluble Factors.

Indirect Detection of T Cells by Measurement of Secreted Soluble Factors.

Secreted soluble factors can be measured directly in fluid suspension or the soluble factor captured by immobilization on solid support and then detected or an effect of the secreted soluble factor can be detected.

Examples of such detection methods are interferon gamma release assays (IGRA's) like Quantiferon, enzyme-linked immunospot (ELISPOT) and cytokine flow cytometry (CFC), where INF-γ released from antigen stimulated T cells are measured. Principles of the various and alternative assays are described in more details below.

Indirect Detection of T Cells by Measurement of Secreted Soluble Factor Directly in Fluid Sample.

A sample of T cells are added MHC multimer or antigenic peptide MHC multimer and/or antigenic peptide and/or antigenic polypeptide as described above to induce production and secretion of soluble factors from antigen-specific T cells. The secreted soluble factors can be measured directly in the supernatant using e.g. mass spectrometry.

Indirect Detection of T Cells by Capture of Secreted Soluble Factor on Solid Support.

A sample of T cells are added MHC multimer and/or, antigenic peptide and/or antigenic protein antigenic polypeptide as described above to induce production and secretion of soluble factors from antigen-specific T cells. Secreted soluble factors in the supernatant are then immobilized on a solid support either directly or through a linker as described for immobilization of T cells elsewhere herein. Then immobilized soluble factors can be detected using labeled marker molecules.

Soluble factors secreted from individual T cells can be detected using ELISPOT assays or related techniques. The principle is capturing of the secreted soluble factors locally by marker molecules, e.g antibodies specific for the soluble factor. Soluble factor recognised by marker molecules are immobilised on a solid support together with T cells and soluble factors secreted by individual T cells are thereby captured in the proximity of each T cell. Bound soluble factor can then be measured using labelled marker molecules specific for the captured soluble factor. The number of T cells that has given rise to labelled spots on solid support can then be enumerated and these spots indicate the presence of specific T cells that have been stimulated with particular MHC multimer and/or antigenic peptide and/or antigenic polypeptide.

Soluble factors secreted from a population of T cells are detected by capture and detection of soluble factor secreted from the entire population of specific T cells. In this case soluble factor do not have to be captured locally close to each T cell but the secreted soluble factors my be captured and detected in the same well or container as where the T cells are, or supernatant containing secreted soluble factor transferred to another solid support with marker molecules for capture e.g. beads or wells of ELISA plate. An example of such an assay is QuantiFERON or QuantiFERON like assays measuring secretion of INF-γ from antigen stimulated T cells.

Indirect Detection of T Cells Immobilized to Solid Support in a Defined Pattern.

Different MHC multimers, or MHC-peptide complexes are immobilized to a support to form a spatial array in a defined pattern, where the position specifies the identity of the MHC multimer/MHC-peptide complex immobilized at this position. Marker molecules able to bind T cell secreted soluble factors are co-spotted together with MHC multimer/MHC-peptide complex. Such marker molecules can e.g. be antibodies specific for cytokines like INFγ or IL-2. The immobilization may be direct or through a linker molecule as described above. Then a suspension of labeled T cells are added or passed over the array of MHC multimers/MHC-peptide complexes and specific T cells will bind to the immobilized MHC multimers/MHC-peptide complexes and upon binding be stimulated to secrete soluble factors e.g. cytokines like INFγ ord IL-2. Soluble factors secreted by individual T cells are then captured in the proximity of each T cell and bound soluble factor can be measured using labelled marker molecule specific for the soluble factor. The number and position of different specific T cells that has given rise to labelled spots on solid support can then be identified and enumerated. In this way T cells bound to defined areas of the support are analyzed, thereby, phenotyping the sample. Each individual T cell is defined by the TCR it expose and depending on these TCRs each entity will bind to different types of MHC multimers/MHC-peptide complexes immobilized at defined positions on the solid support.

Alternatively to MHC multimers or MHC-peptide complexes antigenic peptides or antigenic polypeptides can be immobilized to a support to form a spatial array in a defined pattern, where the position specifies the identity of the antigenic peptide/antigenic polypeptide immobilized. As described above marker molecules able to bind T cell secreted soluble factors are co-spotted together with antigenic peptide/antigenic polypeptide. Before or together with addition of the suspension of T cells, MHC molecules, components of MHC molecules or MHC molecules attached to carrier are added to the array thereby generating MHC multimers. Then antigen specific T cells in sample are detected as described above.

Indirect Detection of T Cells by Measurement of Secreted Soluble Factor on Surface of T Cell An alternative way to detect secretion of soluble factor from individual cells is to use soluble factor capture on the surface of the T cell secreting the soluble factor. This can be done by using a bispecific capture molecule able to bind a component on the surface of the T cell with one part of the capture molecule and bind the secreted soluble factor by another part of the capture molecule. Example useful capture molecules are bispecific antibodies in which two different heavy- and light chain pairs from different antibodies are combined in one antibody resulting in an antibody molecule with the two antigen-binding sites recognizing different ligands.

Activated T cells in a sample can then be detected by adding the bispecific capture molecules to the sample. These molecules will then bind all T cells with on part of the molecule. T cells secreting soluble factor (due to activation) will then capture the secreted soluble factor on their surface by the soluble factor binding part of the capture molecule. Bound soluble factor can then be detected by addition of a labelled marker molecule specific for the soluble factor in question.

Indirect Detection of T Cells by Measurement of Effect of Secreted Soluble Factor.

Secreted soluble factors can be measured and quantified indirectly by measurement of the effect of the soluble factor on other cell systems. Briefly, a sample of T cells are added MHC multimer or antigenic peptide MHC multimer and/or antigenic peptide and/or antigenic polypeptide as described above to induce secretion of soluble factors from antigen-specific T cells. The supernatant containing secreted soluble factor are transferred to another cell system and the effect measured. The soluble factor may induce proliferation, secretion of other soluble factors, expression/downregulation of receptors, or the soluble factor may have cytotoxic effects on these other cells. All effects can be measured as described elsewhere herein.

Indirect Detection of T Cells by Measurement of Produced Soluble Factors Intracellularly Production of soluble factors can be measured intracellularly using flow cytometry. Often cytokines are measured and the method is therefore referred to as cytokine flow cytometry (CFC). The principles are described below.

Soluble factor production by stimulated T cells can also be measured intracellular by e.g. flow cytometry. This can be done using block of secretion of soluble factor (e.g. by monensin), permeabilization of cell (by e.g. saponine) followed by immunofluorescent staining. The method involves the following steps: 1) Stimulation of T cells e.g. by binding specific MHC multimers: The MHC multimers may be generated and added to sample containing T cells or antigenic peptide or protein polypeptide containing antigenic peptide sequences can be added to sample and MHC multimers generated in sample as described elsewhere herein. An example of usefull MHC multimers for stimulation of specific T cells is antigen presenting cells displaying MHC molecules containing antigenic peptide. A reagent able to block extracellular secretion of cytokine is added during stimulation, e.g. monensin that interrupt intracellular transport processes leading to accumulation of produced soluble factor, e.g. cytokine in the Golgi complex. Other soluble factors may be added to the T cell sample during stimulation to enhance activation and/or expansion. This other soluble factor can be cytokine and or growth factors. 2) addition of one or more labelled marker molecules able to detect special surface receptors (e.g. marker molecules able to bind CD8, CD4, CD3, CD27, CD28, CD2). 3) Fixation of cell membrane using mild fixator followed by permeabilization of cell membrane e.g. by saponine. 4) Addition of labelled marker specific for the produced soluble factor to be determined, e.g. INFγ, IL-2, IL-4, IL-10. 5) Measurement of labelled cells using a flow cytometer.

An alternative to this procedure is to trap secreted soluble factors on the surface of the secreting T cell as described elsewhere herein or as described by Manz, R. et al., Proc. Natl. Acad. Sci. USA 92:1921 (1995).

Indirect Detection of T Cells by Measurement of Expression of Receptors

Activation of T cells can be detected by measurement of expression and/or down regulation of specific surface receptors. The method includes the following steps. A sample of T cells are added MHC multimer, antigenic peptide or protein containing antigenic peptide as described elsewhere herein antigenic polypeptide to stimulate T cell and thereby induce expression or downregulation of specific surface receptors on antigen-specific T cells. These receptors include but are not limited to CD28, CD27, CCR7, CD45RO, CD45RA, IL2-receptor, CD62L, CCR5. Their expression level can be detected by addition of labelled marker specific for the desired receptor and then measure the amount of labeled cells using flow cytometry, microscopy, immobilization of activated T cell on solid support or any other method like those described for direct detection of TCR.

Indirect Detection of T Cells by Measurement of Effector Function

Activation of T cells can be detected indirectly by measurement of effector functions. A sample of T cells are added MHC multimer, antigenic peptide or antigenic polypeptide protein containing antigenic peptide as described elsewhere herein to stimulate T cell and thereby induce one or more effector functions of the antigen-specific T cells. The one or more effector function(s) are then measured. For example activation of antigen-specific CD8 positive T cells can be determined by measurement of killing of target cells, i.e. cells displaying specific MHC-peptide complexes recognized by the activated antigen-specific CD8 positive T cell. This method is often referred to as cytotoxicity assays or CTL killing assays and involves the following steps:

1) Sample containing antigen-specific CD8 positive cells are stimulated by addition of MHC multimer, antigenic peptide or antigenic polypeptide protein containing antigenic peptide as described elsewhere herein. 2) Another sample containing live target cells displaying MHC I molecules containing specific antigenic peptide are added labelled molecules that can be taken up by live cells but that are not spontaneously released by the target cells following uptake e.g. radioactive labelled compounds. 3) Stimulated and activated T cells from step 1 are then added to target cells of step 2. target cells displaying the MHC complexes containing specific antigenic peptide(s) are then killed releasing labelled compound from the target cells and the presence of this labelled compound may be detected in the supernatant of mixtures of target and cytoxic cells. Alternatively, amount of labelled compound in cells that are not killed by the CD8 positive T cells are measured, by removing labelled compound released by killed target cells followed by measurement of label inside remaining cells either directly or by release of the labelled compound from these remaining cells.

Indirect Detection of T Cells by Measurement of Proliferation

T cells can be stimulated to proliferate upon binding specific MHC multimers. Proliferation of T cells can be measured several ways including but not limited to:
  Detection of mRNA
  Proliferation of T cells can be detected by measurement of mRNA inside cell. Cell division and proliferation requires production of new protein in each cell which as an initial step requires production of mRNA encoding the proteins to be synthesized.
  A sample of T cells are added MHC multimer or antigenic peptide MHC multimer and/or antigenic peptide and/or antigenic polypeptide as described above to induce proliferation of antigen-specific T cells. Detection of levels of mRNA inside the proliferating T cells can be done by quantitative PCR and indirectly measure activation of a T cell population as a result of interaction with MHC multimer. An example is measurement of cytokine mRNA by in situ hybridization.
  Detection of Incorporation of Thymidine
  The proliferative capacity of T cells in response to stimulation by MHC multimer can be determined by a radioactive assay based on incorporation of [$^3$H]thymidine ([$^3$H]TdR) into newly generated DNA followed by measurement of radioactive signal.
  Detection of Incorporation of BrdU
  T cell proliferation can also be detected by of incorporation of bromo-2'-deoxyuridine (BrdU) followed by measurement of incorporated BrdU using a labeled anti-BrdU antibody in an ELISA based analysis.
Viability of cells may be measured by measurement ATP in a cell culture.

Indirect Detection of T Cells by Measurement of Inactivation

Not all MHC multimers will lead to activation of the T cells they bind. Under certain circumstances some MHC multimers may rather inactivate the T cells they bind to.

Indirect Detection of T Cells by Measurement of Effect of Blockade of TCR

Inactivation of T cells by MHC multimers may be measured be measuring the effect of blocking TCR on antigen-specific T cells. MHC multimers, e.g. MHC-peptide complexes coupled to IgG scaffold can block the TCR of an antigen-specific T cell by binding the TCR, thereby prevent the blocked T cell receptor interacting with e.g. antigen presenting cells. Blockade of TCRs of a T cell can be detected in any of the above described methods for detection of TCR by addition of an unlabeled blocking MHC multimer together with the labelled MHC multimer and then measuring the effect of the blockade on the readout.

Indirect Detection of T Cells by Measurement of Induction of Apoptosis

Inactivation of T cells by MHC multimers may be measured be measuring apoptosis of the antigen-specific T cell. Binding of some MHC multimers to specific T cells may lead to induction of apoptosis. Inactivation of T cells by binding MHC multimer may therefore be detected by measuring apoptosis in the T cell population. Methods to measure apoptosis in T cells include but are not limited to measurement of the following:
  DNA fragmentation
  Alterations in membrane asymmetry (phosphatidylserine translocation)
  Activation of apoptotic caspases
  Release of cytochrome C and AIF from mitochondria into the cytoplasm Positive Control Experiments for the Use of MHC Multimers in Flow Cytometry and Related Techniques When performing flow cytometry experiments, or when using similar technologies, it is important to include appropriate positive and negative controls. In addition to establishing proper conditions for the experiments, positive and negative control reagents can also be used to evaluate the quality (e.g. specificity and affinity) and stability (e.g. shelf life) of produced MHC multimers.

The quality and stability of a given MHC multimer can be tested in a number of different ways, including:
  Measurement of specific MHC multimer binding to beads, other types of solid support, or micelles and liposomes, to which TCR's have been immobilized. Other kinds of molecules that recognize specifically the MHC-peptide complex can be immobilized and used as well. Depending on the nature of the solid support or membrane structure to which the TCR is immobilized, the TCR can be full-length (i.e. comprise the intracellular- and intra-membrane domains), or can be truncated (e.g. only comprise the extracellular domains). Likewise, the TCR can be recombinant, and can be chemically or enzymatically modified.
  Measurement of MHC multimer binding to beads, other types of solid support, or micelles and liposomes, to which aptamers, antibodies or other kinds of molecules that recognize correctly folded MHC-peptide complexes have been immobilized.
  Measurement of specific MHC multimer binding to specific cell lines (e.g. T-cell lines) displaying MHC multimer-binding molecules, e.g. displaying TCRs with appropriate specificity and affinity for the MHC multimer in question.
  Measurement of specific MHC multimer binding to cells in blood samples, preparations of purified lymphocytes (HPBMCs), or other bodily fluids that contain cells carrying receptor molecules specific for the MHC multimer in question.

Measurement of specific MHC multimer binding to soluble TCRs, aptamers, antibodies, or other soluble MHC-peptide complex-binding molecules, by density-gradient centrifugation (e.g. in CsCl) or by size exclusion chromatography, PAGE or other type of chromatographic method.

Measurement of specific MHC binding to TCRs, aptamers, antibodies, streptavidin, or other MHC-peptide complex-binding molecules immobilized on a solid surface (e.g. a microtiter plate). The degree of MHC multimer binding can be visualized with a secondary component that binds the MHC multimer, e.g. a biotinylated fluorophore in cases where the MHC multimer contains streptavidin proteins, not fully loaded with biotin. Alternatively, the secondary component is unlabelled, and a labelled second component-specific compound is employed (e.g. EnVision System, Dako) for visualization. This solid surface can be beads, immunotubes, microtiter plates act. The principle for purification are basically the same I.e. T cells are added to the solid with immobilized MHC'mer, non-binding T cells are washed away and MHC-peptide specific T cells can be retrieved by elution with mild acid or a competitive binding reagent.

Measurement of specific MHC multimer binding to TCRs, aptamers, antibodies, streptavidin, or other MHC-peptide complex-binding molecules immobilized on a solid surface (e.g. a microtiter plate) visualized with a secondary component specific to MHC multimer (e.g. TCRs, aptamers, antibodies, streptavidin, or other MHC-peptide binding complex-binding molecules). Alternatively the secondary receptor is unlabelled, and a labelled second receptor-specific compound is employed (e.g. EnVision System, Dako) before visualization.

In the above mentioned approaches, positive control reagents include MHC multimers comprising correctly folded MHC, complexed with an appropriate peptide that allows the MHC multimer to interact specifically and efficiently with its cognate TCR. Negative control reagents include empty MHC multimers, or correctly folded MHC multimers complexed with so-called nonsense peptides that support a correct conformation of the MHC-peptide complex, but that do not efficiently bind TCRs through the peptide-binding site of the MHC complex.

Negative Control Reagents and Negative Control Experiments for the Use of MHC Multimers in Flow Cytometry and Related Techniques Experiments with MHC multimers require a negative control in order to determine background staining with MHC multimer. Background staining can be due to unwanted binding of any of the individual components of the MHC multimer, e.g., MHC complex or individual components of the MHC complex, multimerization domain or label molecules. The unwanted binding can be to any surface or intracellular protein or other cellular structure of any cell in the test sample, e.g. undesired binding to B cells, NK cells or T cells. Unwanted binding to certain cells or certain components on cells can normally be corrected for during the analysis, by staining with antibodies that bind to unique surface markers of these specific cells, and thus identifies these as false positives, or alternatively, that bind to other components of the target cells, and thus identifies these cells as true positives. A negative control reagent can be used in any experiment involving MHC multimers, e.g. flow cytometry analysis, other cytometric methods, immunohistochemistry (IHC) and ELISA. Negative control reagents include the following:

MHC complexes or MHC multimers comprising MHC complexes carrying nonsense peptides. A nonsense peptide is here to be understood as a peptide that binds the MHC protein efficiently, but that does not support binding of the resultant MHC-peptide complex to the desired TCR. An example nonsense peptide is a peptide with an amino acid sequence different from the linear sequence of any peptide derived from any known protein. When choosing an appropriate nonsense peptide the following points are taken into consideration. The peptide should ideally have appropriate amino acids at relevant positions that can anchor the peptide to the peptide-binding groove of the MHC. The remaining amino acids should ideally be chosen in such a way that possible binding to TCR (through interactions with the peptide or peptide-binding site of MHC) are minimized. The peptide should ideally be soluble in water to make proper folding with MHC alpha chain and β2m possible in aqueous buffer. The length of the peptide should ideally match the type and allele of MHC complex. The final peptide sequence should ideally be taken through a blast search or similar analysis, to ensure that it is not identical with any peptide sequence found in any known naturally occurring proteins.

MHC complexes or MHC multimers comprising MHC complexes carrying a chemically modified peptide in the peptide-binding groove. The modification should ideally allow proper conformation of the MHC-peptide structure, yet should not allow efficient interaction of the peptide or peptide-binding site of MHC with the TCR.

MHC complexes or MHC multimers comprising MHC complexes carrying a naturally occurring peptide different from the peptide used for analysis of specific T cells in the sample. When choosing the appropriate natural peptide the following should be taken into consideration. The peptide in complex with the MHC protein should ideally not be likely to bind a TCR of any T cell in the sample with such an affinity that it can be detected with the applied analysis method. The peptide should ideally be soluble in water to make proper folding with MHC alpha chain and β2m possible in aqueous buffer. The length of the peptide should match the type and allele of MHC complex.

Empty MHC complexes or MHC multimers comprising empty MHC complexes, meaning any correctly folded MHC complex without a peptide in the peptide-binding groove.

MHC heavy chain or MHC multimers comprising MHC heavy chain, where MHC heavy chain should be understood as full-length MHC I or MHC II heavy chain or any truncated version of MHC I or MHC II heavy chain. The MHC heavy chains can be either folded or unfolded. Of special interest is MHC I alpha chains containing the α3 domain that binds CD8 molecules on cytotoxic T cells. Another embodiment of special interest is MHC II β chains containing the β2 domain that binds CD4 on the surface of helper T cells.

Beta2microglobulin or subunits of beta2microglobulin, or MHC multimers comprising Beta2microglobulin or subunits of beta2microglobulin, folded or unfolded.

MHC-like complexes or MHC multimers comprising MHC-like complexes, folded or unfolded. An example could be CD1 molecules that are able to bind peptides in a peptide-binding groove that can be recognized by T cells (Russano et al. (2007). CD1-restricted recognition of exogenous and self-lipid antigens by duodenal gammadelta+ T lymphocytes. J Immunol. 178(6):3620-6)

Multimerization domains without MHC or MHC-like molecules, e.g. dextran, streptavidin, IgG, coiled-coil-domain liposomes.

Labels, e.g. FITC, PE, APC, pacific blue, cascade yellow, or any other label listed elsewhere herein.

Negative controls 1-4 can provide information about potentially undesired binding of the MHC multimer, through interaction of a surface of the MHC-peptide complex different from the peptide-binding groove and its surroundings. Negative control 5 and 6 can provide information about binding through interactions through the MHC I or MHC II proteins (in the absence of peptide). Negative control 7 can provide information about binding through surfaces of the MHC complex that is not unique to the MHC complex. Negative controls 8 and 9 provide information about potential undesired interactions between non-MHC-peptide complex components of the MHC multimer and cell constituents.

Minimization of Undesired Binding of the MHC Multimer

Identification of MHC-peptide specific T cells can give rise to background signals due to unwanted binding to cells that do not carry TCRs. This undesired binding can result from binding to cells or other material, by various components of the MHC multimer, e.g. the dextran in a MHC dextramer construct, the labelling molecule (e.g. FITC), or surface regions of the MHC-peptide complex that do not include the peptide and the peptide-binding cleft.

MHC-peptide complexes bind to specific T cells through interaction with at least two receptors in the cell membrane of the T-cell. These two receptors are the T-cell receptor (TCR) and CD8 for MHC I-peptide complexes and TCR and CD4 receptor protein for MHC II-peptide complexes. Therefore, a particularly interesting example of undesired binding of a MHC multimer is its binding to the CD8 or CD4 molecules of T cells that do not carry a TCR specific for the actual MHC-peptide complex. The interaction of CD8 or CD4 molecules with the MHC is not very strong; however, because of the avidity gained from the binding of several MHC complexes of a MHC multimer, the interaction between the MHC multimer and several CD8 or CD4 receptors potentially can result in undesired but efficient binding of the MHC multimer to these T cells. In an analytical experiment this would give rise to an unwanted background signal; in a cell sorting experiment undesired cells might become isolated. Other particular interesting examples of undesired binding is binding to lymphoid cells different from T cells, e.g. NK-cells, B-cells, monocytes, dendritic cells, and granulocytes like eosinophils, neutrophils and basophiles.

Apart from the MHC complex, other components in the MHC multimer can give rise to unspecific binding. Of special interest are the multimerization domain, multimerization domain molecules, and labelling molecules.

One way to overcome the problem with unwanted binding is to include negative controls in the experiment and subtract this signal from signals derived from the analyzed sample, as described elsewhere in the invention.

Alternatively, unwanted binding could be minimized or eliminated during the experiment. Methods to minimize or eliminate background signals include:

Mutations in areas of the MHC complex responsible for binding to unwanted cells can be introduced. Mutations here mean substitution, insertion, or deletion of natural or non-natural amino acids. Sub-domains in the MHC complex can be responsible for unwanted binding of the MHC multimer to cells without a TCR specific for the MHC-peptide complex contained in the MHC multimer. One example of special interest is a small region in the α3-domain of the α-chain of MHC I molecules that is responsible for binding to CD8 on all cytotoxic T cells. Mutations in this area can alter or completely abolish the interaction between CD8 on cytotoxic T cells and MHC multimer (Neveu et al. (2006) Int Immunol. 18, 1139-45). Similarly a sub domain in the β2 domain of the β-chain of MHC II molecules is responsible for binding CD4 molecules on all CD4 positive T cells. Mutations in this sub domain can alter or completely abolish the interaction between MHC II and CD4.

Another embodiment is to mutate other areas of MHC I/MHC II complexes that are involved in interactions with T cell surface receptors different from TCR, CD8 and CD4, or that bind surface receptors on B cells, NK cells, Eosiniophils, Neutrophils, Basophiles, Dendritic cells or monocytes.

Chemical alterations in areas of the MHC complex responsible for binding to unwanted cells can be employed in order to minimize unwanted binding of MHC multimer to irrelevant cells. Chemical alteration here means any chemical modification of one or more amino acids. Regions in MHC complexes that are of special interest are as mentioned above the α3 domain of the α-chain in MHC I molecules and β2 domains in the β-chain of MHC II molecules. Other regions in MHC I/MHC II molecules that can be chemically modified to decrease the extent of undesired binding are regions involved in interaction with T cell surface receptors different from TCR, CD8 and CD4, or that bind surface receptors on B cells, NK cells, Eosiniophils, Neutrophils, Basophiles, Dendritic cells or monocytes.

Another method to minimize undesired binding involves the addition of one or more components of a MHC multimer, predicted to be responsible for the unwanted binding. The added component is not labeled, or carries a label different from the label of the MHC multimer used for analysis. Of special interest is addition of MHC multimers that contain nonsense peptides, i.e. peptides that interact efficiently with the MHC protein, but that expectably do not support specific binding of the MHC multimer to the TCR in question. Another example of interest is addition of soluble MHC complexes not coupled to a multimerization domain, and with or without peptide bound in the peptide binding cleft. In another embodiment, individual components of the MHC complex can be added to the sample, e.g. I α-chain or subunits of MHC I α-chain either folded or unfolded, beta2microglobulin or subunits thereof either folded or unfolded, α/β-chain of MHC II or subunits thereof either folded or unfolded. Any of the above mentioned individual components can also be attached to a multimerization domain identical or different from the one used in the MHC multimer employed in the analysis.

Of special interest is also addition of multimerization domain similar or identical to the multimerization domain used in the MHC multimer or individual components of the multimerization domain.

Reagents able to identify specific cell types either by selection or exclusion can be included in the analysis to help identify the population of T cells of interest, and in this way deselect the signal arising from binding of the MHC multimer to undesired cells.

Of special interest is the use of appropriate gating reagents in flow cytometry experiments. Thus, fluorescent antibodies directed against specific surface markers can be used for identification of specific subpopulations of cells, and in this way help to deselect signals resulting from MHC multimers binding to undesired cells. Gating reagents of special interest that helps identify the subset of T cells of interest when using MHC I multimers are reagents binding to CD3 and CD8 identifying all cytotoxic T cells. These reagents are preferably antibodies but can be any labeled molecule capable of binding CD3 or CD8. Gating reagents directed against CD3 and CD8 are preferably used together. As they stain overlapping cell populations they are preferably labeled with distinct fluorochromes. However, they can also be used individually in separate samples. In experiments with MHC II multimers reagents binding to CD3 and CD4 identifying T helper cells can be used. These reagents are preferably antibodies but can be any labeled molecule capable of binding CD3 or CD4. Gating reagents directed against CD3 and CD4 are preferable used together. As they stain overlapping cell populations they are preferably labeled with distinct fluorochromes. However, they can also be used individually in separate samples.

Other gating reagents of special interest in experiments with any MHC multimer, are reagents binding to the cell surface markers CD2, CD27, CD28, CD45RA, CD45RO, CD62L and CCR7. These surface markers are unique to T cells in various differentiation states. Co staining with either of these reagents or combinations thereof together with MHC multimers helps to select MHC multimer binding T cells expressing a correct TCR. These reagents can also be combined with reagents directed against CD3, CD4 and/or CD8.

Another flow cytometric method of special interest to remove signals from MHC multimer stained cells not expressing the specific TCR, is to introduce an exclusion gate. Antibodies or other reagents specific for surface markers unique to the unwanted cells are labeled with a fluorochrome and added to the test sample together with the MHC multimer. The number of antibodies or surface marker specific reagents are not limited to one but can be two, three, four, five, six, seven, eight, nine, ten or more individual reagents recognizing different surface markers, all of which are unique to the unwanted cells. During or after collection of data all events representing cells labeled with these antibodies are dumped in the same gate and removed from the dataset. This is possible because all the antibodies/reagents that bind to the wrong cells are labeled with the same fluorochrome.

Reagents of special interest that exclude irrelevant cells include reagents against CD45 expressed on red blood cells, CD19 expressed on B cells, CD56 expressed on NK cells, CD4 expressed on T helper cells and CD8 expressed on cytotoxic T cells, CD14 expressed on monocytes and CD15 expressed on granulocytes and monocytes.

Vaccine Treatment

For the purpose of making vaccines it can be desirable to employ MHC multimers that comprise a polymer such as dextran, or that are cell-based (e.g. specialized dendritic cells such as described by Banchereau and Palucka, Nature Reviews, Immunology, 2005, vol. 5, p. 296-306).

Preventive vaccination leading to prophylaxis/sterile immunity by inducing memory in the immune system may be obtained by immunizing/vaccinating an individual or animal with MHC alone, or with MHC in combination with other molecules as mentioned elsewhere in the patent.

Vaccine antigens can be administered alone

Vaccine can be administered in combination with adjuvant(s).
   Adjuvant can be mixed with vaccine component or administered alone, simultaneously or in any order.
   Adjuvant can be administered by the same route as the other vaccine components Vaccine administered more than once may change composition from $1^{st}$ administration to the $2^{nd}$, $3^{rd}$, etc.

Vaccine administered more than once can be administered by alternating routes

Vaccine components can be administered alone or in combinations by the same route or by alternating/mixed routes Vaccine can be administered by the following routes
   Cutaneously
   Subcutaneously (SC)
   Intramuscular (IM)
   Intravenous (IV)
   Per-oral (PO)
   Inter peritoneally
   Pulmonally
   Vaginally
   Rectally Therapeutic vaccination i.e. vaccination "teaching" the immune system to fight an existing infection or disease, may be obtained by immunizing/vaccinating an individual or animal with MHC alone, or with MHC in combination with other molecules as mentioned elsewhere in the patent.

Vaccine antigens can be administered alone

Vaccine can be administered in combination with adjuvant(s).
   Adjuvant can be mixed with vaccine component or administered alone, simultaneously or in any order.
   Adjuvant can be administered by the same route as the other vaccine components Vaccine administered more than once may change composition from $1^{st}$ administration to the $2^{nd}$, $3^{rd}$, etc.

Vaccine administered more than once can be administered by alternating routes

Vaccine components can be administered alone or in combinations by the same route or by alternating/mixed routes Vaccine can be administered by the following routes
   Cutaneously
   Subcutaneously (SC)
   Intramuscular (IM)
   Intravenous (IV)
   Per-oral (PO)
   Inter peritoneally
   Pulmonally
   Vaginally
   Rectally Therapeutic Treatment Therapeutic treatment includes the use of MHC molecules alone or in any molecular combination mentioned elsewhere in the patent application for the purpose of treating a disease in any state. Treatment may be in the form of Per-orally intake
  Pills
  Capsules
Injections
  Systemic
  Local
Jet-infusion (micro-drops, micro-spheres, micro-beads) through skin
Drinking solution, suspension or gel
Inhalation
Nose-drops
Eye-drops
Ear-drops
Skin application as ointment, gel or creme
Vaginal application as ointment, gel, crème or washing
Gastro-Intestinal flushing
Rectal washings or by use of suppositories
Treatment can be performed as
  Single intake, injection, application, washing
  Multiple intake, injection, application, washing
    On single day basis
    Over prolonged time as days, month, years
Treatment dose and regimen can be modified during the course The Variation in Peptide Epitope Usage Among Individuals Must be Considered when Developing Personalized Medicine Based on Antigenic Peptides and/or MHC Complexes.

The immune system is very complex. Each individual has a very large repertoire of specific T cells (on the order of $10^6$-$10^9$ different T cell specificities, differing in the identity of the T cell receptor), which again is only a small subset of the total T cell repertoire of a population of individuals. It is estimated that the Caucasian population represents a T cell diversity of $10^{19}$-$10^{12}$.

The T cell receptor recognizes MHC peptide complexes, embedded in the cell membrane. Each individual has between 3 and 6 MHC I alleles and 3 and 8 MHC II alleles. Each of these MHC alleles forms complexes with short antigenic peptides generated by proteolytic degradation and prematurely terminated protein synthesis. Individuals of a population differ in their pattern of peptide degradation. The MHC allele diversity described above combined with this variation among individuals' proteolytic metabolism further enhances the variation among different individuals' immune responses. As a result, each individual has its own characteristic immune response profile, comprising its unique set of alleles and peptide combinations.

This is important when designing an antigenic peptide-based or a MHC multimer-based immune monitoring reagent or immunotherapeutic agent. If an agent is sought that should be generally applicable to the majority of individuals in a population, one should try to identify peptide epitopes and MHC alleles that are common to the majority of individuals of a population. As described elsewhere in this application, such peptide epitopes can be identified through computerized search algorithms and/or experimental testing of a large set of individuals.

This approach will be advantageous in many cases, but because of the variability among immune response profiles of different individuals, is likely to be inefficient in certain individuals, because of these individuals' non-average profile. In these latter cases one may have to turn to personalized medicine. In the case of immune monitoring and immunotherapy, this may involve testing a large number of different epitopes from a given antigen, in order to find peptide epitopes that applies to the given individual.

When considering the patient population as a whole, a large fraction of the epitopes that theoretically may be generated from a given antigen, for use as a free antigenic peptide agent or to be included in a MHC I or MHC II multimer reagent, are therefore of relevance in personalized medicine. For the individual patient only a small fraction of these will be efficient; and in order to make generally applicable diagnostics, vaccines or therapeutics, even less epitopes are of relevance. Only in the case where one wants to generate a therapeutic agent or diagnostic reagent that is applicable to the majority of individuals of a population can the large majority of epitope sequences be said to be irrelevant, and those identified by computerized search algorithms and experimental testing be said to be the only epitopes of value. For the odd individual with the odd immune response these disregarded peptide epitopes may be the epitopes that provide an efficient diagnostic reagent or cures that individual from a deadly disease. In conclusion, a large fraction of the theoretical epitopes that can be generated from an antigen are of great practical value for use in personalized diagnostics, vaccines and therapeutics.

Items
1. A peptide of between 8 to 16 consecutive amino acids, comprising at least 8 of amino acid number $X_1$-$X_2$-$X_3$-$X_4$-$X_5$-$X_6$-$X_7$-$X_8$-$X_9$-$X_{10}$-$X_{11}$-$X_{12}$-$X_{13}$-$X_{14}$-$X_{15}$-$X_{16}$
2. The peptide according to item 1, wherein $X_1$ is alanine
3. The peptide according to item 1, wherein $X_1$ is arginine
4. The peptide according to item 1, wherein $X_1$ is asparagine
5. The peptide according to item 1, wherein $X_1$ is aspartic acid
6. The peptide according to item 1, wherein $X_1$ is cysteine
7. The peptide according to item 1, wherein $X_1$ is glutamic acid
8. The peptide according to item 1, wherein $X_1$ is glutamine
9. The peptide according to item 1, wherein $X_1$ is glycine
10. The peptide according to item 1, wherein $X_1$ is histidine
11. The peptide according to item 1, wherein $X_1$ is isoleucine
12. The peptide according to item 1, wherein $X_1$ is leucine
13. The peptide according to item 1, wherein $X_1$ is lysine
14. The peptide according to item 1, wherein $X_1$ is methionine
15. The peptide according to item 1, wherein $X_1$ is phenylalanine
16. The peptide according to item 1, wherein $X_1$ is proline
17. The peptide according to item 1, wherein $X_1$ is serine
18. The peptide according to item 1, wherein $X_1$ is threonine
19. The peptide according to item 1, wherein $X_1$ is tryptophan
20. The peptide according to item 1, wherein $X_1$ is tyrosine
21. The peptide according to item 1, wherein $X_1$ is valine
22. The peptide according to item 1, wherein $X_2$ is alanine
23. The peptide according to item 1, wherein $X_2$ is arginine
24. The peptide according to item 1, wherein $X_2$ is asparagine 25. The peptide according to item 1, wherein $X_2$ is aspartic acid
26. The peptide according to item 1, wherein $X_2$ is cysteine
27. The peptide according to item 1, wherein $X_2$ is glutamic acid
28. The peptide according to item 1, wherein $X_2$ is glutamine
29. The peptide according to item 1, wherein $X_2$ is glycine
30. The peptide according to item 1, wherein $X_2$ is histidine
31. The peptide according to item 1, wherein $X_2$ is isoleucine
32. The peptide according to item 1, wherein $X_2$ is leucine
33. The peptide according to item 1, wherein $X_2$ is lysine
34. The peptide according to item 1, wherein $X_2$ is methionine
35. The peptide according to item 1, wherein $X_2$ is phenylalanine
36. The peptide according to item 1, wherein $X_2$ is proline
37. The peptide according to item 1, wherein $X_2$ is serine
38. The peptide according to item 1, wherein $X_2$ is threonine
39. The peptide according to item 1, wherein $X_2$ is tryptophan
40. The peptide according to item 1, wherein $X_2$ is tyrosine
41. The peptide according to item 1, wherein $X_2$ is valine
42. The peptide according to item 1, wherein $X_3$ is alanine
43. The peptide according to item 1, wherein $X_3$ is arginine
44. The peptide according to item 1, wherein $X_3$ is asparagine
45. The peptide according to item 1, wherein $X_3$ is aspartic acid
46. The peptide according to item 1, wherein $X_3$ is cysteine
47. The peptide according to item 1, wherein $X_3$ is glutamic acid
48. The peptide according to item 1, wherein $X_3$ is glutamine
49. The peptide according to item 1, wherein $X_3$ is glycine
50. The peptide according to item 1, wherein $X_3$ is histidine
51. The peptide according to item 1, wherein $X_3$ is isoleucine
52. The peptide according to item 1, wherein $X_3$ is leucine
53. The peptide according to item 1, wherein $X_3$ is lysine
54. The peptide according to item 1, wherein $X_3$ is methionine
55. The peptide according to item 1, wherein $X_3$ is phenylalanine
56. The peptide according to item 1, wherein $X_3$ is proline
57. The peptide according to item 1, wherein $X_3$ is serine
58. The peptide according to item 1, wherein $X_3$ is threonine
59. The peptide according to item 1, wherein $X_3$ is tryptophan
60. The peptide according to item 1, wherein $X_3$ is tyrosine
61. The peptide according to item 1, wherein $X_3$ is valine
62. The peptide according to item 1, wherein $X_4$ is alanine
63. The peptide according to item 1, wherein $X_4$ is arginine
64. The peptide according to item 1, wherein $X_4$ is asparagine
65. The peptide according to item 1, wherein $X_4$ is aspartic acid
66. The peptide according to item 1, wherein $X_4$ is cysteine
67. The peptide according to item 1, wherein $X_4$ is glutamic acid
68. The peptide according to item 1, wherein $X_4$ is glutamine
69. The peptide according to item 1, wherein $X_4$ is glycine
70. The peptide according to item 1, wherein $X_4$ is histidine
71. The peptide according to item 1, wherein $X_4$ is isoleucine
72. The peptide according to item 1, wherein $X_4$ is leucine
73. The peptide according to item 1, wherein $X_4$ is lysine
74. The peptide according to item 1, wherein $X_4$ is methionine
75. The peptide according to item 1, wherein $X_4$ is phenylalanine
76. The peptide according to item 1, wherein $X_4$ is proline
77. The peptide according to item 1, wherein $X_4$ is serine
78. The peptide according to item 1, wherein $X_4$ is threonine
79. The peptide according to item 1, wherein $X_4$ is tryptophan
80. The peptide according to item 1, wherein $X_4$ is tyrosine
81. The peptide according to item 1, wherein $X_4$ is valine
82. The peptide according to item 1, wherein $X_5$ is alanine
83. The peptide according to item 1, wherein $X_5$ is arginine
84. The peptide according to item 1, wherein $X_5$ is asparagine
85. The peptide according to item 1, wherein $X_5$ is aspartic acid
86. The peptide according to item 1, wherein $X_5$ is cysteine
87. The peptide according to item 1, wherein $X_5$ is glutamic acid
88. The peptide according to item 1, wherein $X_5$ is glutamine
89. The peptide according to item 1, wherein $X_5$ is glycine
90. The peptide according to item 1, wherein $X_5$ is histidine
91. The peptide according to item 1, wherein $X_5$ is isoleucine
92. The peptide according to item 1, wherein $X_5$ is leucine
93. The peptide according to item 1, wherein $X_5$ is lysine
94. The peptide according to item 1, wherein $X_5$ is methionine
95. The peptide according to item 1, wherein $X_5$ is phenylalanine
96. The peptide according to item 1, wherein $X_5$ is proline
97. The peptide according to item 1, wherein $X_5$ is serine
98. The peptide according to item 1, wherein $X_5$ is threonine
99. The peptide according to item 1, wherein $X_5$ is tryptophan
100. The peptide according to item 1, wherein $X_5$ is tyrosine
101. The peptide according to item 1, wherein $X_5$ is valine
102. The peptide according to item 1, wherein $X_6$ is alanine
103. The peptide according to item 1, wherein $X_6$ is arginine
104. The peptide according to item 1, wherein $X_6$ is asparagine 105. The peptide according to item 1, wherein $X_6$ is aspartic acid
106. The peptide according to item 1, wherein $X_6$ is cysteine
107. The peptide according to item 1, wherein $X_6$ is glutamic acid
108. The peptide according to item 1, wherein $X_6$ is glutamine
109. The peptide according to item 1, wherein $X_6$ is glycine
110. The peptide according to item 1, wherein $X_6$ is histidine
111. The peptide according to item 1, wherein $X_6$ is isoleucine
112. The peptide according to item 1, wherein $X_6$ is leucine
113. The peptide according to item 1, wherein $X_6$ is lysine
114. The peptide according to item 1, wherein $X_6$ is methionine
115. The peptide according to item 1, wherein $X_6$ is phenylalanine
116. The peptide according to item 1, wherein $X_6$ is proline
117. The peptide according to item 1, wherein $X_6$ is serine
118. The peptide according to item 1, wherein $X_6$ is threonine
119. The peptide according to item 1, wherein $X_6$ is tryptophan
120. The peptide according to item 1, wherein $X_6$ is tyrosine
121. The peptide according to item 1, wherein $X_6$ is valine
122. The peptide according to item 1, wherein $X_7$ is alanine
123. The peptide according to item 1, wherein $X_7$ is arginine
124. The peptide according to item 1, wherein $X_7$ is asparagine
125. The peptide according to item 1, wherein $X_7$ is aspartic acid
126. The peptide according to item 1, wherein $X_7$ is cysteine
127. The peptide according to item 1, wherein $X_7$ is glutamic acid
128. The peptide according to item 1, wherein $X_7$ is glutamine
129. The peptide according to item 1, wherein $X_7$ is glycine
130. The peptide according to item 1, wherein $X_7$ is histidine
131. The peptide according to item 1, wherein $X_7$ is isoleucine
132. The peptide according to item 1, wherein $X_7$ is leucine
133. The peptide according to item 1, wherein $X_7$ is lysine
134. The peptide according to item 1, wherein $X_7$ is methionine
135. The peptide according to item 1, wherein $X_7$ is phenylalanine
136. The peptide according to item 1, wherein $X_7$ is proline
137. The peptide according to item 1, wherein $X_7$ is serine
138. The peptide according to item 1, wherein $X_7$ is threonine
139. The peptide according to item 1, wherein $X_7$ is tryptophan
140. The peptide according to item 1, wherein $X_7$ is tyrosine
141. The peptide according to item 1, wherein $X_7$ is valine
142. The peptide according to item 1, wherein $X_8$ is alanine
143. The peptide according to item 1, wherein $X_8$ is arginine
144. The peptide according to item 1, wherein $X_8$ is asparagine
145. The peptide according to item 1, wherein $X_8$ is aspartic acid
146. The peptide according to item 1, wherein $X_8$ is cysteine
147. The peptide according to item 1, wherein $X_8$ is glutamic acid
148. The peptide according to item 1, wherein $X_8$ is glutamine
149. The peptide according to item 1, wherein $X_8$ is glycine
150. The peptide according to item 1, wherein $X_8$ is an histidine
151. The peptide according to item 1, wherein $X_8$ is isoleucine
152. The peptide according to item 1, wherein $X_8$ is leucine
153. The peptide according to item 1, wherein $X_8$ is lysine
154. The peptide according to item 1, wherein $X_8$ is methionine
155. The peptide according to item 1, wherein $X_8$ is phenylalanine
156. The peptide according to item 1, wherein $X_8$ is proline
157. The peptide according to item 1, wherein $X_8$ is serine
158. The peptide according to item 1, wherein $X_8$ is threonine
159. The peptide according to item 1, wherein $X_8$ is tryptophan
160. The peptide according to item 1, wherein $X_8$ is tyrosine
161. The peptide according to item 1, wherein $X_8$ is valine
162. The peptide according to item 1, wherein $X_9$ is alanine
163. The peptide according to item 1, wherein $X_9$ is arginine
164. The peptide according to item 1, wherein $X_9$ is asparagine
165. The peptide according to item 1, wherein $X_9$ is aspartic acid
166. The peptide according to item 1, wherein $X_9$ is cysteine
167. The peptide according to item 1, wherein $X_9$ is glutamic acid
168. The peptide according to item 1, wherein $X_9$ is glutamine
169. The peptide according to item 1, wherein $X_9$ is glycine
170. The peptide according to item 1, wherein $X_9$ is an histidine
171. The peptide according to item 1, wherein $X_9$ is isoleucine
172. The peptide according to item 1, wherein $X_9$ is leucine
173. The peptide according to item 1, wherein $X_9$ is lysine
174. The peptide according to item 1, wherein $X_9$ is methionine
175. The peptide according to item 1, wherein $X_9$ is phenylalanine
176. The peptide according to item 1, wherein $X_9$ is proline 177. The peptide according to item 1, wherein $X_9$ is serine
178. The peptide according to item 1, wherein $X_9$ is threonine
179. The peptide according to item 1, wherein $X_9$ is tryptophan
180. The peptide according to item 1, wherein $X_9$ is tyrosine
181. The peptide according to item 1, wherein $X_9$ is valine
182. The peptide according to item 1, wherein $X_9$ is alanine
183. The peptide according to item 1, wherein $X_9$ is arginine
184. The peptide according to item 1, wherein $X_9$ is asparagine
185. The peptide according to item 1, wherein $X_9$ is aspartic acid
186. The peptide according to item 1, wherein $X_9$ is cysteine
187. The peptide according to item 1, wherein $X_9$ is glutamic acid
188. The peptide according to item 1, wherein $X_9$ is glutamine
189. The peptide according to item 1, wherein $X_9$ is glycine
190. The peptide according to item 1, wherein $X_9$ is an histidine
191. The peptide according to item 1, wherein $X_9$ is isoleucine
192. The peptide according to item 1, wherein $X_9$ is leucine
193. The peptide according to item 1, wherein $X_9$ is lysine
194. The peptide according to item 1, wherein $X_9$ is methionine
195. The peptide according to item 1, wherein $X_9$ is phenylalanine
196. The peptide according to item 1, wherein $X_9$ is proline
197. The peptide according to item 1, wherein $X_9$ is serine
198. The peptide according to item 1, wherein $X_9$ is threonine
199. The peptide according to item 1, wherein $X_9$ is tryptophan
200. The peptide according to item 1, wherein $X_9$ is tyrosine
201. The peptide according to item 1, wherein $X_9$ is valine
202. The peptide according to item 1, wherein $X_{10}$ is alanine
203. The peptide according to item 1, wherein $X_{10}$ is arginine
204. The peptide according to item 1, wherein $X_{10}$ is asparagine
205. The peptide according to item 1, wherein $X_{10}$ is aspartic acid
206. The peptide according to item 1, wherein $X_{10}$ is cysteine
207. The peptide according to item 1, wherein $X_{10}$ is glutamic acid
208. The peptide according to item 1, wherein $X_{10}$ is glutamine
209. The peptide according to item 1, wherein $X_{10}$ is glycine
210. The peptide according to item 1, wherein $X_{10}$ is an histidine
211. The peptide according to item 1, wherein $X_{10}$ is isoleucine
212. The peptide according to item 1, wherein $X_{10}$ is leucine
213. The peptide according to item 1, wherein $X_{10}$ is lysine
214. The peptide according to item 1, wherein $X_{10}$ is methionine
215. The peptide according to item 1, wherein $X_{10}$ is phenylalanine
216. The peptide according to item 1, wherein $X_{10}$ is proline
217. The peptide according to item 1, wherein $X_{10}$ is serine
218. The peptide according to item 1, wherein $X_{10}$ is threonine
219. The peptide according to item 1, wherein $X_{10}$ is tryptophan
220. The peptide according to item 1, wherein $X_{10}$ is tyrosine
221. The peptide according to item 1, wherein $X_{10}$ is valine
222. The peptide according to item 1, wherein $X_{11}$ is alanine
223. The peptide according to item 1, wherein $X_{11}$ is arginine
224. The peptide according to item 1, wherein $X_{11}$ is asparagine
225. The peptide according to item 1, wherein $X_{11}$ is aspartic acid
226. The peptide according to item 1, wherein $X_{11}$ is cysteine
227. The peptide according to item 1, wherein $X_{11}$ is glutamic acid
228. The peptide according to item 1, wherein $X_{11}$ is glutamine
229. The peptide according to item 1, wherein $X_{11}$ is glycine
230. The peptide according to item 1, wherein $X_{11}$ is an histidine
231. The peptide according to item 1, wherein $X_{11}$ is isoleucine
232. The peptide according to item 1, wherein $X_{11}$ is leucine
233. The peptide according to item 1, wherein $X_{11}$ is lysine
234. The peptide according to item 1, wherein $X_{11}$ is methionine
235. The peptide according to item 1, wherein $X_{11}$ is phenylalanine
236. The peptide according to item 1, wherein $X_{11}$ is proline
237. The peptide according to item 1, wherein $X_{11}$ is serine
238. The peptide according to item 1, wherein $X_{11}$ is threonine
239. The peptide according to item 1, wherein $X_{11}$ is tryptophan
240. The peptide according to item 1, wherein $X_{11}$ is tyrosine
241. The peptide according to item 1, wherein $X_{11}$ is valine
242. The peptide according to item 1, wherein $X_{12}$ is alanine
243. The peptide according to item 1, wherein $X_{12}$ is arginine
244. The peptide according to item 1, wherein $X_{12}$ is asparagine
245. The peptide according to item 1, wherein $X_{12}$ is aspartic acid 246. The peptide according to item 1, wherein $X_{12}$ is cysteine
247. The peptide according to item 1, wherein $X_{12}$ is glutamic acid
248. The peptide according to item 1, wherein $X_{12}$ is glutamine
249. The peptide according to item 1, wherein $X_{12}$ is glycine
250. The peptide according to item 1, wherein $X_{12}$ is histidine
251. The peptide according to item 1, wherein $X_{12}$ is isoleucine
252. The peptide according to item 1, wherein $X_{12}$ is leucine
253. The peptide according to item 1, wherein $X_{12}$ is lysine
254. The peptide according to item 1, wherein $X_{12}$ is methionine
255. The peptide according to item 1, wherein $X_{12}$ is phenylalanine
256. The peptide according to item 1, wherein $X_{12}$ is proline
257. The peptide according to item 1, wherein $X_{12}$ is serine
258. The peptide according to item 1, wherein $X_{12}$ is threonine
259. The peptide according to item 1, wherein $X_{12}$ is tryptophan
260. The peptide according to item 1, wherein $X_{12}$ is tyrosine
261. The peptide according to item 1, wherein $X_{12}$ is valine
262. The peptide according to item 1, wherein $X_{13}$ is alanine
263. The peptide according to item 1, wherein $X_{13}$ is arginine
264. The peptide according to item 1, wherein $X_{13}$ is asparagine
265. The peptide according to item 1, wherein $X_{13}$ is aspartic acid
266. The peptide according to item 1, wherein $X_{13}$ is cysteine
267. The peptide according to item 1, wherein $X_{13}$ is glutamic acid
268. The peptide according to item 1, wherein $X_{13}$ is glutamine
269. The peptide according to item 1, wherein $X_{13}$ is glycine
270. The peptide according to item 1, wherein $X_{13}$ is histidine
271. The peptide according to item 1, wherein $X_{13}$ is isoleucine
272. The peptide according to item 1, wherein $X_{13}$ is leucine
273. The peptide according to item 1, wherein $X_{13}$ is lysine
274. The peptide according to item 1, wherein $X_{13}$ is methionine
275. The peptide according to item 1, wherein $X_{13}$ is phenylalanine
276. The peptide according to item 1, wherein $X_{13}$ is proline
277. The peptide according to item 1, wherein $X_{13}$ is serine
278. The peptide according to item 1, wherein $X_{13}$ is threonine
279. The peptide according to item 1, wherein $X_{13}$ is tryptophan
280. The peptide according to item 1, wherein $X_{13}$ is tyrosine
281. The peptide according to item 1, wherein $X_{13}$ is valine
282. The peptide according to item 1, wherein $X_{14}$ is alanine
283. The peptide according to item 1, wherein $X_{14}$ is arginine
284. The peptide according to item 1, wherein $X_{14}$ is asparagine
285. The peptide according to item 1, wherein $X_{14}$ is aspartic acid
286. The peptide according to item 1, wherein $X_{14}$ is cysteine
287. The peptide according to item 1, wherein $X_{14}$ is glutamic acid
288. The peptide according to item 1, wherein $X_{14}$ is glutamine
289. The peptide according to item 1, wherein $X_{14}$ is glycine
290. The peptide according to item 1, wherein $X_{14}$ is histidine
291. The peptide according to item 1, wherein $X_{14}$ is isoleucine
292. The peptide according to item 1, wherein $X_{14}$ is leucine
293. The peptide according to item 1, wherein $X_{14}$ is lysine
294. The peptide according to item 1, wherein $X_{14}$ is methionine
295. The peptide according to item 1, wherein $X_{14}$ is phenylalanine
296. The peptide according to item 1, wherein $X_{14}$ is proline
297. The peptide according to item 1, wherein $X_{14}$ is serine
298. The peptide according to item 1, wherein $X_{14}$ is threonine
299. The peptide according to item 1, wherein $X_{14}$ is tryptophan
300. The peptide according to item 1, wherein $X_{14}$ is tyrosine
301. The peptide according to item 1, wherein $X_{14}$ is valine
302. The peptide according to item 1, wherein $X_{15}$ is alanine
303. The peptide according to item 1, wherein $X_{15}$ is arginine
304. The peptide according to item 1, wherein $X_{15}$ is asparagine
305. The peptide according to item 1, wherein $X_{15}$ is aspartic acid
306. The peptide according to item 1, wherein $X_{15}$ is cysteine
307. The peptide according to item 1, wherein $X_{15}$ is glutamic acid
308. The peptide according to item 1, wherein $X_{15}$ is glutamine
309. The peptide according to item 1, wherein $X_{15}$ is glycine
310. The peptide according to item 1, wherein $X_{15}$ is histidine
311. The peptide according to item 1, wherein $X_{15}$ is isoleucine 312. The peptide according to item 1, wherein $X_{15}$ is leucine
313. The peptide according to item 1, wherein $X_{15}$ is lysine
314. The peptide according to item 1, wherein $X_{15}$ is methionine
315. The peptide according to item 1, wherein $X_{15}$ is phenylalanine
316. The peptide according to item 1, wherein $X_{15}$ is proline
317. The peptide according to item 1, wherein $X_{15}$ is serine
318. The peptide according to item 1, wherein $X_{15}$ is threonine
319. The peptide according to item 1, wherein $X_{15}$ is tryptophan
320. The peptide according to item 1, wherein $X_{15}$ is tyrosine
321. The peptide according to item 1, wherein $X_{15}$ is valine
322. The peptide according to item 1, wherein $X_{16}$ is alanine
323. The peptide according to item 1, wherein $X_{16}$ is arginine
324. The peptide according to item 1, wherein $X_{16}$ is asparagine
325. The peptide according to item 1, wherein $X_{16}$ is aspartic acid
326. The peptide according to item 1, wherein $X_{16}$ is cysteine
327. The peptide according to item 1, wherein $X_{16}$ is glutamic acid
328. The peptide according to item 1, wherein $X_{16}$ is glutamine
329. The peptide according to item 1, wherein $X_{16}$ is glycine
330. The peptide according to item 1, wherein $X_{16}$ is histidine
331. The peptide according to item 1, wherein $X_{16}$ is isoleucine
332. The peptide according to item 1, wherein $X_{16}$ is leucine
333. The peptide according to item 1, wherein $X_{16}$ is lysine
334. The peptide according to item 1, wherein $X_{16}$ is methionine
335. The peptide according to item 1, wherein $X_{16}$ is phenylalanine
336. The peptide according to item 1, wherein $X_{16}$ is proline
337. The peptide according to item 1, wherein $X_{16}$ is serine
338. The peptide according to item 1, wherein $X_{16}$ is threonine
339. The peptide according to item 1, wherein $X_{16}$ is tryptophan
340. The peptide according to item 1, wherein $X_{16}$ is tyrosine
341. The peptide according to item 1, wherein $X_{16}$ is valine
342. The peptide according to any of items 2, 22, 42, 62, 82, 102, 122, 142, 162, 182, 202, 222, 242, 262, 282, 302 or 322, wherein the alanine is D-alanine
343. The peptide according to any of items 2, 22, 42, 62, 82, 102, 122, 142, 162, 182, 202, 222, 242, 262, 282, 302 or 322, wherein the alanine is L-alanine
344. The peptide according to any of items 3, 23, 43, 63, 83, 103, 123, 143, 163, 183, 203, 223, 243, 263, 283, 303 or 323, wherein the arginine is D-arginine
345. The peptide according to any of items 3, 23, 43, 63, 83, 103, 123, 143, 163, 183, 203, 223, 243, 263, 283, 303 or 323, wherein the arginine is L-arginine
346. The peptide according to any of items 4, 24, 44, 64, 84, 104, 124, 144, 164, 184, 204, 224, 244, 264, 284, 304 or 324, wherein the asparagine is D-asparagine
347. The peptide according to any of items 4, 24, 44, 64, 84, 104, 124, 144, 164, 184, 204, 224, 244, 264, 284, 304 or 324, wherein the asparagine is L-asparagine
348. The peptide according to any of items 5, 25, 45, 65, 85, 105, 125, 145, 165, 185, 205, 225, 245, 265, 285, 305 or 325, wherein the aspartic acid is D-aspartic acid
349. The peptide according to any of items 5, 25, 45, 65, 85, 105, 125, 145, 165, 185, 205, 225, 245, 265, 285, 305 or 325, wherein the aspartic acid is L-aspartic acid
350. The peptide according to any of items 6, 26, 46, 66, 86, 106, 126, 146, 166, 186, 206, 226, 246, 266, 286, 306 or 326, wherein the cysteine is D-cysteine
351. The peptide according to any of items 6, 26, 46, 66, 86, 106, 126, 146, 166, 186, 206, 226, 246, 266, 286, 306 or 326, wherein the cysteine is L-cysteine
352. The peptide according to any of items 7, 27, 47, 67, 87, 107, 127, 147, 167, 187, 207, 227, 247, 267, 287, 307 or 327, wherein the glutamic acid is D-glutamic acid
353. The peptide according to any of items 7, 27, 47, 67, 87, 107, 127, 147, 167, 187, 207, 227, 247, 267, 287, 307 or 327, wherein the glutamic acid is L-glutamic acid
354. The peptide according to any of items 8, 28, 48, 68, 88, 108, 128, 148, 168, 188, 208, 228, 248, 268, 288, 308 or 328, wherein the glutamine is D-glutamine
355. The peptide according to any of items 8, 28, 48, 68, 88, 108, 128, 148, 168, 188, 208, 228, 248, 268, 288, 308 or 328, wherein the glutamine is L-glutamine
356. The peptide according to any of items 9, 29, 49, 69, 89, 109, 129, 149, 169, 189, 209, 229, 249, 269, 289, 309 or 329, wherein the glycine is D-glycine
357. The peptide according to any of items 9, 29, 49, 69, 89, 109, 129, 149, 169, 189, 209, 229, 249, 269, 289, 309 or 329, wherein the glycine is L-glycine
358. The peptide according to any of items 10, 30, 50, 70, 90, 110, 130, 150, 170, 190, 210, 230, 250, 270, 290, 310 or 330, wherein the histidine is D-histidine
359. The peptide according to any of items 10, 30, 50, 70, 90, 110, 130, 150, 170, 190, 210, 230, 250, 270, 290, 310 or 330, wherein the histidine is L-histidine
360. The peptide according to any of items 11, 31, 51, 71, 91, 111, 131, 151, 171, 191, 211, 231, 251, 271, 291, 311 or 331, wherein the isoleucine is D-isoleucine
361. The peptide according to any of items 11, 31, 51, 71, 91, 111, 131, 151, 171, 191, 211, 231, 251, 271, 291, 311 or 331, wherein the isoleucine is L-isoleucine
362. The peptide according to any of items 12, 32, 52, 72, 92, 112, 132, 152, 172, 192, 212, 232, 252, 272, 292, 312 or 332, wherein the leucine is D-leucine
363. The peptide according to any of items 12, 32, 52, 72, 92, 112, 132, 152, 172, 192, 212, 232, 252, 272, 292, 312 or 332, wherein the leucine is L-leucine
364. The peptide according to any of items 13, 33, 53, 73, 93, 113, 133, 153, 173, 193, 213, 233, 253, 273, 293, 313 or 333, wherein the lysine is D-lysine 365. The peptide according to any of items 13, 33, 53, 73, 93, 113, 133, 153, 173, 193, 213, 233, 253, 273, 293, 313 or 333, wherein the lysine is L-lysine
366. The peptide according to any of items 14, 34, 54, 74, 94, 114, 134, 154, 174, 194, 214, 234, 254, 274, 294, 314 or 334, wherein the methionine is D-methionine
367. The peptide according to any of items 14, 34, 54, 74, 94, 114, 134, 154, 174, 194, 214, 234, 254, 274, 294, 314 or 334, wherein the methionine is L-methionine
368. The peptide according to any of items 15, 35, 55, 75, 95, 115, 135, 155, 175, 195, 215, 235, 255, 275, 295, 315 or 335, wherein the phenylalanine is D-phenylalanine
369. The peptide according to any of items 15, 35, 55, 75, 95, 115, 135, 155, 175, 195, 215, 235, 255, 275, 295, 315 or 335, wherein the phenylalanine is L-phenylalanine
370. The peptide according to any of items 16, 36, 56, 76, 96, 116, 136, 156, 176, 196, 216, 236, 256, 276, 296, 316 or 336, wherein the proline is D-proline
371. The peptide according to any of items 16, 36, 56, 76, 96, 116, 136, 156, 176, 196, 216, 236, 256, 276, 296, 316 or 336, wherein the proline is L-proline
372. The peptide according to any of items 17, 37, 57, 77, 97, 117, 137, 157, 177, 197, 217, 237, 257, 277, 297, 317 or 337, wherein the serine is D-serine
373. The peptide according to any of items 17, 37, 57, 77, 97, 117, 137, 157, 177, 197, 217, 237, 257, 277, 297, 317 or 337, wherein the serine is L-serine
374. The peptide according to any of items 18, 38, 58, 78, 98, 118, 138, 158, 178, 198, 218, 238, 258, 278, 298, 318 or 338, wherein the threonine is D-threonine
375. The peptide according to any of items 18, 38, 58, 78, 98, 118, 138, 158, 178, 198, 218, 238, 258, 278, 298, 318 or 338, wherein the threonine is L-threonine
376. The peptide according to any of items 19, 39, 59, 79, 99, 119, 139, 159, 179, 199, 219, 239, 259, 279, 299, 319 or 339, wherein the tryptophan is D-tryptophan
377. The peptide according to any of items 19, 39, 59, 79, 99, 119, 139, 159, 179, 199, 219, 239, 259, 279, 299, 319 or 339, wherein the tryptophan is L-tryptophan
378. The peptide according to any of items 20, 40, 60, 80, 100, 120, 140, 160, 180, 200, 220, 240, 260, 280, 300, 320 or 340, wherein the tyrosine is D-tyrosine
379. The peptide according to any of items 20, 40, 60, 80, 100, 120, 140, 160, 180, 200, 220, 240, 260, 280, 300, 320 or 340, wherein the tyrosine is L-tyrosine
380. The peptide according to any of items 21, 41, 61, 81, 101, 121, 141, 161, 181, 201, 221, 241, 261, 281, 301, 321 or 341, wherein the valine is D-valine
381. The peptide according to any of items 21, 41, 61, 81, 101, 121, 141, 161, 181, 201, 221, 241, 261, 281, 301, 321 or 341, wherein the valine is L-valine
382. The peptide according to item 1 to 381, wherein one or more of said amino acid residues are modified, such as post-translationally modified or co-translationally modified
383. The peptide according to item 382, wherein said modification is acetylation of one or more amino acid residues
384. The peptide according to item 382, wherein said modification is phosphorylation of one or more amino acid residues
385. The peptide according to item 382, wherein said modification is glycosylation of one or more amino acid residues
386. The peptide according to item 382, wherein said modification is non-enzymatic glycosylation (or glycation) of one or more amino acid residues
387. The peptide according to item 382, wherein said modification is methylation of one or more amino acid residues
388. The peptide according to item 382, wherein said modification is amidation of one or more amino acid residues
389. The peptide according to item 382, wherein said modification is deamidation of one or more amino acid residues
390. The peptide according to item 382, wherein said modification is succinimide formation of one or more amino acid residues
391. The peptide according to item 382, wherein said modification is biotinylation of one or more amino acid residues
392. The peptide according to item 382, wherein said modification is formylation of one or more amino acid residues
393. The peptide according to item 382, wherein said modification is carboxylation of one or more amino acid residues
394. The peptide according to item 382, wherein said modification is carbamylation of one or more amino acid residues
395. The peptide according to item 382, wherein said modification is hydroxylation of one or more amino acid residues
396. The peptide according to item 382, wherein said modification is iodination of one or more amino acid residues
397. The peptide according to item 382, wherein said modification is isoprenylation (or prenylation or lipidation or lipoylation) of one or more amino acid residues
398. The peptide according to item 382, wherein said modification is GPI (glycosyl phosphatidylinositol) anchor formation of one or more amino acid residues
399. The peptide according to item 382, wherein said modification is myristoylation of one or more amino acid residues
400. The peptide according to item 382, wherein said modification is farnesylation of one or more amino acid residues
401. The peptide according to item 382, wherein said modification is geranylgeranylation of one or more amino acid residues
402. The peptide according to item 382, wherein said modification is covalent attachment of nucleotides or derivates thereof to one or more amino acid residues
403. The peptide according to item 382, wherein said modification is ADP-ribosylation of one or more amino acid residues
404. The peptide according to item 382, wherein said modification is flavin attachment to one or more amino acid residues
405. The peptide according to item 382, wherein said modification is oxidation of one or more amino acid residues
406. The peptide according to item 382, wherein said modification is oxidative deamination of one or more amino acid residues
407. The peptide according to item 382, wherein said modification is deamination of one or more amino acid residues 408. The peptide according to item 382, wherein said modification is palmitoylation of one or more amino acid residues
409. The peptide according to item 382, wherein said modification is pegylation of one or more amino acid residues
410. The peptide according to item 382, wherein said modification is attachment of phosphatidyl-inositol of one or more amino acid residues
411. The peptide according to item 382, wherein said modification is phosphopantetheinylation of one or more amino acid residues
412. The peptide according to item 382, wherein said modification is polysialylation of one or more amino acid residues
413. The peptide according to item 382, wherein said modification is sulfation of one or more amino acid residues
414. The peptide according to item 382, wherein said modification is selenoylation of one or more amino acid residues
415. The peptide according to item 382, wherein said modification is arginylation of one or more amino acid residues
416. The peptide according to item 382, wherein said modification is glutamylation or polyglutamylation of one or more amino acid residues
417. The peptide according to item 382, wherein said modification is glycylation or polyglycylation of one or more amino acid residues
418. The peptide according to item 382, wherein said modification is acylation (or alkanoylation) of one or more amino acid residues
419. The peptide according to item 382, wherein said modification is Methylidene-imidazolone (MIO) formation of one or more amino acid residues
420. The peptide according to item 382, wherein said modification is p-Hydroxybenzylidene-imidazolone formation of one or more amino acid residues
421. The peptide according to item 382, wherein said modification is Lysine tyrosyl quinone (LTQ) formation of one or more amino acid residues
422. The peptide according to item 382, wherein said modification is Topaquinone (TPQ) formation of one or more amino acid residues
423. The peptide according to item 382, wherein said modification is Porphyrin ring linkage of one or more amino acid residues
424. The peptide according to item 382, wherein said modification is glypiation (addition of glycosyl phosphatidyl inositol) of one or more amino acid residues
425. The peptide according to item 382, wherein said modification is addition of heme to one or more amino acid residues
426. The peptide according to item 382, wherein said modification is ubiquitination of one or more amino acid residues
427. The peptide according to item 382, wherein said modification is SUMOylation (Small Ubiquitin-like Modifier) of one or more amino acid residues
428. The peptide according to item 382, wherein said modification is ISGylation of one or more amino acid residues
429. The peptide according to item 382, wherein said modification is citrullination (or deimination) of one or more amino acid residues
430. The peptide according to item 382, wherein said modification is the formation of pyroglutamic acid (or pidolic acid) of one or more amino acid residues
431. The peptide according to item 382, wherein said modification is formation of disulfide bridges (or disulfide bond or SS-bond or persulfide connection) between two amino acid residues
432. The peptide according to item 382, wherein said modification is formation of a desmosine cross-link between two or more amino acid residues
433. The peptide according to item 382, wherein said modification is transglutamination between two or more amino acid residues
434. The peptide according to item 1, wherein any of $X_1$, $X_2$, $X_3$, $X_4$, $X_5$, $X_6$, $X_7$, $X_8$, $X_9$, $X_{10}$, $X_{11}$, $X_{12}$, $X_{13}$, $X_{14}$, $X_{15}$ and/or $X_{16}$ is an uncommon or modified amino acid
435. The peptide according to item 434, wherein said uncommon amino acid is acetylalanine
436. The peptide according to item 434, wherein said uncommon amino acid is acetylaspartic acid
437. The peptide according to item 434, wherein said uncommon amino acid is acetylcysteine
438. The peptide according to item 434, wherein said uncommon amino acid is acetylglutamic acid
439. The peptide according to item 434, wherein said uncommon amino acid is acetylglutamine
440. The peptide according to item 434, wherein said uncommon amino acid is acetylglycine
441. The peptide according to item 434, wherein said uncommon amino acid is acetylisoleucine
442. The peptide according to item 434, wherein said uncommon amino acid is acetyllysine
443. The peptide according to item 434, wherein said uncommon amino acid is acetylmethionine
444. The peptide according to item 434, wherein said uncommon amino acid is acetylproline
445. The peptide according to item 434, wherein said uncommon amino acid is acetylserine
446. The peptide according to item 434, wherein said uncommon amino acid is acetylthreonine
447. The peptide according to item 434, wherein said uncommon amino acid is acetyltyrosine
448. The peptide according to item 434, wherein said uncommon amino acid is acetylvaline
449. The peptide according to item 434, wherein said uncommon amino acid is acetyllysine
450. The peptide according to item 434, wherein said uncommon amino acid is acetylcysteine
451. The peptide according to item 434, wherein said uncommon amino acid is alanine amide
452. The peptide according to item 434, wherein said uncommon amino acid is arginine amide
453. The peptide according to item 434, wherein said uncommon amino acid is asparagine amide
454. The peptide according to item 434, wherein said uncommon amino acid is aspartic acid amide
455. The peptide according to item 434, wherein said uncommon amino acid is cysteine amide
456. The peptide according to item 434, wherein said uncommon amino acid is glutamine amide
457. The peptide according to item 434, wherein said uncommon amino acid is glutamic acid amide
458. The peptide according to item 434, wherein said uncommon amino acid is glycine amide
459. The peptide according to item 434, wherein said uncommon amino acid is histidine amide 460. The peptide according to item 434, wherein said uncommon amino acid is isoleucine amide
461. The peptide according to item 434, wherein said uncommon amino acid is leucine amide
462. The peptide according to item 434, wherein said uncommon amino acid is lysine amide
463. The peptide according to item 434, wherein said uncommon amino acid is methionine amide
464. The peptide according to item 434, wherein said uncommon amino acid is phenylalanine amide
465. The peptide according to item 434, wherein said uncommon amino acid is proline amide
466. The peptide according to item 434, wherein said uncommon amino acid is serine amide
467. The peptide according to item 434, wherein said uncommon amino acid is threonine amide
468. The peptide according to item 434, wherein said uncommon amino acid is tryptophan amide
469. The peptide according to item 434, wherein said uncommon amino acid is tyrosine amide
470. The peptide according to item 434, wherein said uncommon amino acid is valine amide
471. The peptide according to item 434, wherein said uncommon amino acid is an amino acid alcohol
472. The peptide according to item 434, wherein said uncommon amino acid is Aminobenzoic Acid
473. The peptide according to item 434, wherein said uncommon amino acid is Aminobutyric Acid
474. The peptide according to item 434, wherein said uncommon amino acid is Aminocyanobutyric acid
475. The peptide according to item 434, wherein said uncommon amino acid is Aminocyanopropionic acid
476. The peptide according to item 434, wherein said uncommon amino acid is Aminocyclohexanoic acid
477. The peptide according to item 434, wherein said uncommon amino acid is Aminocyclopropanoic acid
478. The peptide according to item 434, wherein said uncommon amino acid is Aminocylopentanoic acid
479. The peptide according to item 434, wherein said uncommon amino acid is Aminodecanoic acid
480. The peptide according to item 434, wherein said uncommon amino acid is Aminododecanoic acid
481. The peptide according to item 434, wherein said uncommon amino acid is Aminohexanoic acid
482. The peptide according to item 434, wherein said uncommon amino acid is Aminoisobutyric acid
483. The peptide according to item 434, wherein said uncommon amino acid is Aminomethylbenzoic acid
484. The peptide according to item 434, wherein said uncommon amino acid is Aminomethylcyclohexanoic acid
485. The peptide according to item 434, wherein said uncommon amino acid is Aminononanoic acid
486. The peptide according to item 434, wherein said uncommon amino acid is Aminooctanoic acid
487. The peptide according to item 434, wherein said uncommon amino acid is Aminophenylalanine
488. The peptide according to item 434, wherein said uncommon amino acid is Amino Salicylic acid
489. The peptide according to item 434, wherein said uncommon amino acid is 2-Amino-2-Thiazoline-4-carboxylic acid
490. The peptide according to item 434, wherein said uncommon amino acid is Aminoundecanoic acid
491. The peptide according to item 434, wherein said uncommon amino acid is Aminovaleric acid
492. The peptide according to item 434, wherein said uncommon amino acid is 4-Benzoylphenylalanine
493. The peptide according to item 434, wherein said uncommon amino acid is Biphenylalanine
494. The peptide according to item 434, wherein said uncommon amino acid is Bromophenylalanine
495. The peptide according to item 434, wherein said uncommon amino acid is gamma-Carboxyglutamic acid
496. The peptide according to item 434, wherein said uncommon amino acid is canavanine
497. The peptide according to item 434, wherein said uncommon amino acid is Carnitine
498. The peptide according to item 434, wherein said uncommon amino acid is Chlorophenylalanine
499. The peptide according to item 434, wherein said uncommon amino acid is Chlorotyrosine
500. The peptide according to item 434, wherein said uncommon amino acid is Cine
501. The peptide according to item 434, wherein said uncommon amino acid is Citrulline
502. The peptide according to item 434, wherein said uncommon amino acid is 4-Cyano-2-Aminobutyric acid
503. The peptide according to item 434, wherein said uncommon amino acid is Cyclohexylalanine
504. The peptide according to item 434, wherein said uncommon amino acid is Cyclohexylglycine
505. The peptide according to item 434, wherein said uncommon amino acid is Diaminobenzoic acid
506. The peptide according to item 434, wherein said uncommon amino acid is 2,4-Diaminobutyric acid
507. The peptide according to item 434, wherein said uncommon amino acid is 2,3-Diaminopropionic acid
508. The peptide according to item 434, wherein said uncommon amino acid is Dibutylglycine
509. The peptide according to item 434, wherein said uncommon amino acid is Diethylglycine
510. The peptide according to item 434, wherein said uncommon amino acid is Dihydrotryptophan
511. The peptide according to item 434, wherein said uncommon amino acid is Dipropylglycine
512. The peptide according to item 434, wherein said uncommon amino acid is Fluorophenylalanine
513. The peptide according to item 434, wherein said uncommon amino acid is formylmethionine
514. The peptide according to item 434, wherein said uncommon amino acid is formylglycine
515. The peptide according to item 434, wherein said uncommon amino acid is formyllysine
516. The peptide according to item 434, wherein said uncommon amino acid is farnesylcysteine
517. The peptide according to item 434, wherein said uncommon amino acid is hydroxyfarnesylcysteine
518. The peptide according to item 434, wherein said uncommon amino acid is Homoalanine
519. The peptide according to item 434, wherein said uncommon amino acid is Homoarginine
520. The peptide according to item 434, wherein said uncommon amino acid is Homoasparagine
521. The peptide according to item 434, wherein said uncommon amino acid is Homoaspartic acid
522. The peptide according to item 434, wherein said uncommon amino acid is Homoglutamic acid
523. The peptide according to item 434, wherein said uncommon amino acid is Homoglutamine 524. The peptide according to item 434, wherein said uncommon amino acid is Homoisoleucine
525. The peptide according to item 434, wherein said uncommon amino acid is Homophenylalanine
526. The peptide according to item 434, wherein said uncommon amino acid is Homoserine
527. The peptide according to item 434, wherein said uncommon amino acid is Homotyrosine
528. The peptide according to item 434, wherein said uncommon amino acid is Hydroxyproline
529. The peptide according to item 434, wherein said uncommon amino acid is Hydroxylysine
530. The peptide according to item 434, wherein said uncommon amino acid is 2-Indanylglycine
531. The peptide according to item 434, wherein said uncommon amino acid is 2-Indolecarboxylic acid
532. The peptide according to item 434, wherein said uncommon amino acid is Indoleglycine
533. The peptide according to item 434, wherein said uncommon amino acid is Iodophenylalanine
534. The peptide according to item 434, wherein said uncommon amino acid is Isonipecotic Acid
535. The peptide according to item 434, wherein said uncommon amino acid is Kynurenine
536. The peptide according to item 434, wherein said uncommon amino acid is β-(S-Benzyl)Mercapto-β,β-cyclopentamethylene propionic acid
537. The peptide according to item 434, wherein said uncommon amino acid is Methyltyrosine
538. The peptide according to item 434, wherein said uncommon amino acid is Methylphenylalanine
539. The peptide according to item 434, wherein said uncommon amino acid is methylalanine
540. The peptide according to item 434, wherein said uncommon amino acid is trimethylalanine
541. The peptide according to item 434, wherein said uncommon amino acid is methylglycine
542. The peptide according to item 434, wherein said uncommon amino acid is methylmethionine
543. The peptide according to item 434, wherein said uncommon amino acid is methylphenylalanine
544. The peptide according to item 434, wherein said uncommon amino acid is dimethylproline
545. The peptide according to item 434, wherein said uncommon amino acid is dimethylarginine
546. The peptide according to item 434, wherein said uncommon amino acid is methylarginine
547. The peptide according to item 434, wherein said uncommon amino acid is methylasparagine
548. The peptide according to item 434, wherein said uncommon amino acid is methylglutamine
549. The peptide according to item 434, wherein said uncommon amino acid is methylhistidine
550. The peptide according to item 434, wherein said uncommon amino acid is trimethyllysine
551. The peptide according to item 434, wherein said uncommon amino acid is dimethyllysine
552. The peptide according to item 434, wherein said uncommon amino acid is methyllysine
553. The peptide according to item 434, wherein said uncommon amino acid is methylcysteine
554. The peptide according to item 434, wherein said uncommon amino acid is glutamic acid 5-methyl ester
555. The peptide according to item 434, wherein said uncommon amino acid is Naphthylalanine
556. The peptide according to item 434, wherein said uncommon amino acid is Nipecotic acid
557. The peptide according to item 434, wherein said uncommon amino acid is Nitrophenylalanine
558. The peptide according to item 434, wherein said uncommon amino acid is Norleucine
559. The peptide according to item 434, wherein said uncommon amino acid is Norvaline
560. The peptide according to item 434, wherein said uncommon amino acid is Octahydroindolecarboxylic acid
561. The peptide according to item 434, wherein said uncommon amino acid is ornithine
562. The peptide according to item 434, wherein said uncommon amino acid is Penicillamine
563. The peptide according to item 434, wherein said uncommon amino acid is Phenylglycine
564. The peptide according to item 434, wherein said uncommon amino acid is phosphocysteine
565. The peptide according to item 434, wherein said uncommon amino acid is phosphohistidine
566. The peptide according to item 434, wherein said uncommon amino acid is phosphoserine
567. The peptide according to item 434, wherein said uncommon amino acid is phosphothreonine
568. The peptide according to item 434, wherein said uncommon amino acid is phosphotyrosine
569. The peptide according to item 434, wherein said uncommon amino acid is phosphoarginine
570. The peptide according to item 434, wherein said uncommon amino acid is (phospho-5'-adenosine)-tyrosine
571. The peptide according to item 434, wherein said uncommon amino acid is phosphopantetheine-serine
572. The peptide according to item 434, wherein said uncommon amino acid is (phospho-5'-RNA)-serine
573. The peptide according to item 434, wherein said uncommon amino acid is (phospho-5'-adenosine)-lysine
574. The peptide according to item 434, wherein said uncommon amino acid is (phospho-5'-guanosine)-lysine
575. The peptide according to item 434, wherein said uncommon amino acid is (phospho-5'-DNA)-serine
576. The peptide according to item 434, wherein said uncommon amino acid is (phospho-5'-RNA)-tyrosine
577. The peptide according to item 434, wherein said uncommon amino acid is (phospho-5'-adenosine)-threonine
578. The peptide according to item 434, wherein said uncommon amino acid is (phospho-5'-DNA)-tyrosine
579. The peptide according to item 434, wherein said uncommon amino acid is (phospho-5'-DNA)-threonine
580. The peptide according to item 434, wherein said uncommon amino acid is (phospho-5'-uridine)-tyrosine
581. The peptide according to item 434, wherein said uncommon amino acid is 4-Phosphonomethylphenylalanine
582. The peptide according to item 434, wherein said uncommon amino acid is palmitoylcysteine
583. The peptide according to item 434, wherein said uncommon amino acid is palmitoyllysine
584. The peptide according to item 434, wherein said uncommon amino acid is palmitoylthreonine
585. The peptide according to item 434, wherein said uncommon amino acid is palmitoylserine
586. The peptide according to item 434, wherein said uncommon amino acid is palmitoylcysteine 587. The peptide according to item 434, wherein said uncommon amino acid is phycoerythrobilin-bis-cysteine
588. The peptide according to item 434, wherein said uncommon amino acid is phycourobilin-bis-cysteine
589. The peptide according to item 434, wherein said uncommon amino acid is pyrrolidone-5-carboxylic acid
590. The peptide according to item 434, wherein said uncommon amino acid is Pipericolic Acid
591. The peptide according to item 434, wherein said uncommon amino acid is Propargylglycine
592. The peptide according to item 434, wherein said uncommon amino acid is Pyridinylalanine
593. The peptide according to item 434, wherein said uncommon amino acid is pyroglutamic acid
594. The peptide according to item 434, wherein said uncommon amino acid is Sarcosine
595. The peptide according to item 434, wherein said uncommon amino acid is Tert-Leucine
596. The peptide according to item 434, wherein said uncommon amino acid is Tetrahydoisoquinoline-3-carboxylic acid
597. The peptide according to item 434, wherein said uncommon amino acid is Thiazolidinecarboxylic acid
598. The peptide according to item 434, wherein said uncommon amino acid is Thyronine
599. The peptide according to item 434, wherein said uncommon amino acid is selenocysteine
600. The peptide according to item 434, wherein said uncommon amino acid is selenomethionine
601. The peptide according to item 434, wherein said uncommon amino acid is erythro-beta-hydroxyasparagine
602. The peptide according to item 434, wherein said uncommon amino acid is erythro-beta-hydroxyaspartic acid
603. The peptide according to item 434, wherein said uncommon amino acid is gamma-carboxyglutamic acid
604. The peptide according to item 434, wherein said uncommon amino acid is aspartic 4-phosphoric anhydride
605. The peptide according to item 434, wherein said uncommon amino acid is 2'-[3-carboxamido-3-(trimethylammonio)propyl]histidine
606. The peptide according to item 434, wherein said uncommon amino acid is glucuronoylglycine
607. The peptide according to item 434, wherein said uncommon amino acid is geranylgeranylcysteine
608. The peptide according to item 434, wherein said uncommon amino acid is myristoylglycine
609. The peptide according to item 434, wherein said uncommon amino acid is myristoyllysine
610. The peptide according to item 434, wherein said uncommon amino acid is cysteine methyl disulfide
611. The peptide according to item 434, wherein said uncommon amino acid is diacylglycerolcysteine
612. The peptide according to item 434, wherein said uncommon amino acid is isoglutamylcysteine
613. The peptide according to item 434, wherein said uncommon amino acid is cysteinylhistidine
614. The peptide according to item 434, wherein said uncommon amino acid is lanthionine
615. The peptide according to item 434, wherein said uncommon amino acid is mesolanthionine
616. The peptide according to item 434, wherein said uncommon amino acid is methyllanthionine
617. The peptide according to item 434, wherein said uncommon amino acid is cysteinyltyrosine
618. The peptide according to item 434, wherein said uncommon amino acid is carboxylysine
619. The peptide according to item 434, wherein said uncommon amino acid is carboxyethyllysine
620. The peptide according to item 434, wherein said uncommon amino acid is (4-amino-2-hydroxybutyl)-lysine
621. The peptide according to item 434, wherein said uncommon amino acid is biotinyllysine
622. The peptide according to item 434, wherein said uncommon amino acid is lipoyllysine
623. The peptide according to item 434, wherein said uncommon amino acid is pyridoxal phosphate-lysine
624. The peptide according to item 434, wherein said uncommon amino acid is retinal-lysine
625. The peptide according to item 434, wherein said uncommon amino acid is allysine
626. The peptide according to item 434, wherein said uncommon amino acid is lysinoalanine
627. The peptide according to item 434, wherein said uncommon amino acid is isoglutamyllysine
628. The peptide according to item 434, wherein said uncommon amino acid is glycyllysine
629. The peptide according to item 434, wherein said uncommon amino acid is isoaspartylglycine
630. The peptide according to item 434, wherein said uncommon amino acid is pyruvic acid
631. The peptide according to item 434, wherein said uncommon amino acid is phenyllactic acid
632. The peptide according to item 434, wherein said uncommon amino acid is oxobutanoic acid
633. The peptide according to item 434, wherein said uncommon amino acid is succinyltryptophan
634. The peptide according to item 434, wherein said uncommon amino acid is phycocyanobilincysteine
635. The peptide according to item 434, wherein said uncommon amino acid is phycoerythrobilincysteine
636. The peptide according to item 434, wherein said uncommon amino acid is phytochromobilincysteine
637. The peptide according to item 434, wherein said uncommon amino acid is heme-bis-cysteine
638. The peptide according to item 434, wherein said uncommon amino acid is heme-cysteine
639. The peptide according to item 434, wherein said uncommon amino acid is tetrakis-cysteinyl iron
640. The peptide according to item 434, wherein said uncommon amino acid is tetrakis-cysteinyl diiron disulfide
641. The peptide according to item 434, wherein said uncommon amino acid is tris-cysteinyl triiron trisulfide
642. The peptide according to item 434, wherein said uncommon amino acid is tris-cysteinyl triiron tetrasulfide
643. The peptide according to item 434, wherein said uncommon amino acid is tetrakis-cysteinyl tetrairon tetrasulfide
644. The peptide according to item 434, wherein said uncommon amino acid is cysteinyl homocitryl molybdenum-heptairon-nonasulfide
645. The peptide according to item 434, wherein said uncommon amino acid is cysteinyl molybdopterin
646. The peptide according to item 434, wherein said uncommon amino acid is (8alpha-FAD)-cysteine
647. The peptide according to item 434, wherein said uncommon amino acid is (8alpha-FAD)-histidine 648. The peptide according to item 434, wherein said uncommon amino acid is (8alpha-FAD)-tyrosine
649. The peptide according to item 434, wherein said uncommon amino acid is dihydroxyphenylalanine
650. The peptide according to item 434, wherein said uncommon amino acid is topaquinone
651. The peptide according to item 434, wherein said uncommon amino acid is tryptophyl quinine
652. The peptide according to item 434, wherein said uncommon amino acid is (tryptophan)-tryptophyl quinone
653. The peptide according to item 434, wherein said uncommon amino acid is glycosylasparagine
654. The peptide according to item 434, wherein said uncommon amino acid is glycosylcysteine
655. The peptide according to item 434, wherein said uncommon amino acid is glycosylhydroxylysine
656. The peptide according to item 434, wherein said uncommon amino acid is glycosylserine
657. The peptide according to item 434, wherein said uncommon amino acid is glycosylthreonine
658. The peptide according to item 434, wherein said uncommon amino acid is glycosyltryptophan
659. The peptide according to item 434, wherein said uncommon amino acid is glycosyltyrosine
660. The peptide according to item 434, wherein said uncommon amino acid is asparaginyl-glycosylphosphatidylinositolethanolamine
661. The peptide according to item 434, wherein said uncommon amino acid is aspartyl-glycosylphosphatidylinositolethanolamine
662. The peptide according to item 434, wherein said uncommon amino acid is cysteinyl-glycosylphosphatidylinositolethanolamine
663. The peptide according to item 434, wherein said uncommon amino acid is glycyl-glycosylphosphatidylinositolethanolamine
664. The peptide according to item 434, wherein said uncommon amino acid is seryl-glycosylphosphatidylinositolethanolamine
665. The peptide according to item 434, wherein said uncommon amino acid is seryl-glycosylsphingolipidinositolethanolamine
666. The peptide according to item 434, wherein said uncommon amino acid is (phosphoribosyl dephosphocoenzyme A)-serine
667. The peptide according to item 434, wherein said uncommon amino acid is (ADP-ribosyl)-arginine
668. The peptide according to item 434, wherein said uncommon amino acid is (ADP-ribosyl)-cysteine
669. The peptide according to item 434, wherein said uncommon amino acid is glutamyl-glycerylphosphorylethanolamine
670. The peptide according to item 434, wherein said uncommon amino acid is sulfocysteine
671. The peptide according to item 434, wherein said uncommon amino acid is sulfotyrosine
672. The peptide according to item 434, wherein said uncommon amino acid is bromohistidine
673. The peptide according to item 434, wherein said uncommon amino acid is bromophenylalanine
674. The peptide according to item 434, wherein said uncommon amino acid is triiodothyronine
675. The peptide according to item 434, wherein said uncommon amino acid is thyroxine
676. The peptide according to item 434, wherein said uncommon amino acid is bromotryptophan
677. The peptide according to item 434, wherein said uncommon amino acid is dehydroalanine
678. The peptide according to item 434, wherein said uncommon amino acid is dehydrobutyrine
679. The peptide according to item 434, wherein said uncommon amino acid is dehydrotyrosine
680. The peptide according to item 434, wherein said uncommon amino acid is seryl-imidazolinone glycine
681. The peptide according to item 434, wherein said uncommon amino acid is oxoalanine
682. The peptide according to item 434, wherein said uncommon amino acid is alanyl-imidazolinone glycine
683. The peptide according to item 434, wherein said uncommon amino acid is allo-isoleucine
684. The peptide according to item 434, wherein said uncommon amino acid is isoglutamyl-polyglycine
685. The peptide according to item 434, wherein said uncommon amino acid is isoglutamyl-polyglutamic acid
686. The peptide according to item 434, wherein said uncommon amino acid is aminovinyl-cysteine
687. The peptide according to item 434, wherein said uncommon amino acid is (aminovinyl)-methyl-cysteine
688. The peptide according to item 434, wherein said uncommon amino acid is cysteine sulfenic acid
689. The peptide according to item 434, wherein said uncommon amino acid is glycyl-cysteine
690. The peptide according to item 434, wherein said uncommon amino acid is hydroxycinnamyl-cysteine
691. The peptide according to item 434, wherein said uncommon amino acid is chondroitin sulfate glucuronyl-galactosyl-galactosyl-xylosyl-serine
692. The peptide according to item 434, wherein said uncommon amino acid is dermatan sulfate glucuronyl-galactosyl-galactosyl-xylosyl-serine
693. The peptide according to item 434, wherein said uncommon amino acid is heparan sulfate glucuronyl-galactosyl-galactosyl-xylosyl-serine
694. The peptide according to item 434, wherein said uncommon amino acid is glycosyl-hydroxyproline
695. The peptide according to item 434, wherein said uncommon amino acid is hydroxy-arginine
696. The peptide according to item 434, wherein said uncommon amino acid is isoaspartyl-cysteine
697. The peptide according to item 434, wherein said uncommon amino acid is alpha-mannosyl-tryptophan
698. The peptide according to item 434, wherein said uncommon amino acid is mureinyl-lysine
699. The peptide according to item 434, wherein said uncommon amino acid is chondroitin sulfate-aspartic acid ester
700. The peptide according to item 434, wherein said uncommon amino acid is (6-FMN)-cysteine
701. The peptide according to item 434, wherein said uncommon amino acid is diphytanylglycerol diether-cysteine
702. The peptide according to item 434, wherein said uncommon amino acid is bis-cysteinyl bis-histidino diiron disulfide
703. The peptide according to item 434, wherein said uncommon amino acid is hexakis-cysteinyl hexairon hexasulfide
704. The peptide according to item 434, wherein said uncommon amino acid is cysteine glutathione disulfide
705. The peptide according to item 434, wherein said uncommon amino acid is nitrosyl-cysteine 706. The peptide according to item 434, wherein said uncommon amino acid is (ADP-ribosyl)-asparagine
707. The peptide according to item 434, wherein said uncommon amino acid is beta-methylthioaspartic acid
708. The peptide according to item 434, wherein said uncommon amino acid is (lysine)-topaquinone
709. The peptide according to item 434, wherein said uncommon amino acid is hydroxymethyl-asparagine
710. The peptide according to item 434, wherein said uncommon amino acid is (ADP-ribosyl)-serine
711. The peptide according to item 434, wherein said uncommon amino acid is cysteine oxazolecarboxylic acid
712. The peptide according to item 434, wherein said uncommon amino acid is cysteine oxazolinecarboxylic acid
713. The peptide according to item 434, wherein said uncommon amino acid is glycine oxazolecarboxylic acid
714. The peptide according to item 434, wherein said uncommon amino acid is glycine thiazolecarboxylic acid
715. The peptide according to item 434, wherein said uncommon amino acid is serine thiazolecarboxylic acid
716. The peptide according to item 434, wherein said uncommon amino acid is phenylalanine thiazolecarboxylic acid
717. The peptide according to item 434, wherein said uncommon amino acid is cysteine thiazolecarboxylic acid
718. The peptide according to item 434, wherein said uncommon amino acid is lysine thiazolecarboxylic acid
719. The peptide according to item 434, wherein said uncommon amino acid is keratan sulfate glucuronyl-galactosyl-galactosyl-xylosyl-threonine
720. The peptide according to item 434, wherein said uncommon amino acid is selenocysteinyl molybdopterin guanine dinucleotide
721. The peptide according to item 434, wherein said uncommon amino acid is histidyl-tyrosine
722. The peptide according to item 434, wherein said uncommon amino acid is methionine sulfone
723. The peptide according to item 434, wherein said uncommon amino acid is dipyrrolylmethanemethyl-cysteine
724. The peptide according to item 434, wherein said uncommon amino acid is glutamyl-tyrosine
725. The peptide according to item 434, wherein said uncommon amino acid is glutamyl-poly-glutamic acid
726. The peptide according to item 434, wherein said uncommon amino acid is cysteine sulfinic acid
727. The peptide according to item 434, wherein said uncommon amino acid is trihydroxyphenylalanine
728. The peptide according to item 434, wherein said uncommon amino acid is (sn-1-glycerophosphoryl)-serine
729. The peptide according to item 434, wherein said uncommon amino acid is thioglycine
730. The peptide according to item 434, wherein said uncommon amino acid is heme P460-bis-cysteine-tyrosine
731. The peptide according to item 434, wherein said uncommon amino acid is tris-cysteinyl-cysteine persulfido-bis-glutamato-histidino tetrairon disulfide trioxide
732. The peptide according to item 434, wherein said uncommon amino acid is cysteine persulfide 733. The peptide according to item 434, wherein said uncommon amino acid is Lactic acid (2-hydroxypropanoic acid)
734. The peptide according to any of items 434 to 733, wherein said uncommon amino acid is the L-enantiomer
735. The peptide according to any of items 434 to 733, wherein said uncommon amino acid is the D-enantiomer Index to Sequence List The sequences in the figures and tables are included in the sequence list. The sequences have the SEQ ID NO's indicated below—the sequences in each figure or table are consecutively numbered.

FIG. 30:
SEQ ID NO 1-44

| FIG. 31: | |
|---|---|
| Antigen designation in Table 19 | SEQ ID NO |
| NP_212517.1 Basic membrane protein A (bmpA) [*Borrelia burgdorferi* B31] | 45-1366 |
| NP_212516.1 Basic membrane protein B (bmpB) [*Borrelia burgdorferi* B31 | 1367-2696 |
| NP_212518.1 Basic membrane protein C (bmpC) [*Borrelia burgdorferi* B31 | 2697-4074 |
| NP_212519.1B Basic membrane protein D (bmpD) [*Borrelia burgdorferi* B31 | 4075-5480 |
| AAC70056.1 Decorin binding protein A; DbpA [*Borrelia afzelii* | 5481-6126 |
| AAC70057.1 Decorin binding protein A; DbpA [*Borrelia garinii*] | 6127-6836 |
| AAC70021.1 Decorin binding protein B; DbpB [*Borrelia burgdorferi*] | 6837-7522 |
| NP_212694.1 Heat shock protein 90 [*Borrelia burgdorferi* B31] | 7523-10087 |
| CAA44492.1| Outer surface protein A [*Borrelia burgdorferi*] | 10088-11149 |
| |BAA22351.1| Outer surface protein B [*Borrelia garinii*] | 11150-12307 |
| AAM22469.1| Outer surface protein C [*Borrelia afzelii*] | 12308-13117 |
| AAC62927.1| OspE-related lipoprotein [*Borrelia garinii*] | 13118-13799 |
| CAA57806.1| Outer surface protein G [*Borrelia burgdorferi*] | 13800-14549 |
| AAC44770.1| FlaA protein (*Borrelia burgdorferi*) | 14550-15879 |
| AAU07005.1| flagellar filament 41 kDa core protein [*Borrelia garinii* PBi] | 15880-17189 |
| 1L8W|A Chain A, Crystal Structure Of Lyme Disease Variable Surface Antigen Vise Of *Borrelia Burgdorferi* | 17190-18547 |
| CAA57807.1 Associated protein A (BapA)[*Borrelia burgdorferi*] | 18548-19189 |
| Seq19 | 19190-20455 |
| Seq 20 | 20456-22321 |
| Seq 21 | 22322-23355 |
| Seq 22 | 23356-24473 |
| Seq 23 | 24474-25783 |
| Seq 24 | 25784-27861 |
| Seq 25 | 27862-28855 |
| Seq 26 | 28856-31653 |
| Seq 27 | 31564-33623 |
| Seq 28 | 33624-35913 |
| Seq 29 | 35914-36939 |
| Seq 30 | 36940-38333 |
| Seq 31 | 38334-38919 |
| Seq 32 | 38920-39737 |
| Seq 33 | 39738-40611 |
| Seq 34 | 40612-42220 |
| Seq 35 | 42221-43880 |
| Seq 36 | 43881-44898 |
| Seq 37 | 44899-45904 |
| Seq 38 | 45905-46606 |
| Seq 39 | 46607-47212 |
| Seq 40 | 47213-48406 |
| Seq 41 | 48407-49644 |
| Seq 42 | 49645-51050 |
| Seq 43 | 51051-52424 |
| Seq 44 | 52425-54050 |

FIG. 32

| Antigen designation | SEQ ID NO |
|---|---|
| NP_212517.1; Basic membrane protein A (bmpA) [*Borrelia burgdorferi* B31; Seq1 | 54051-54446 |
| NP_212516.1; Basic membrane protein B (bmpB) [*Borrelia burgdorferi* B31; Seq2 | 54447-54934 |
| NP_212518.1; Basic membrane protein C (bmpC) [*Borrelia burgdorferi* B31; Seq3 | 54935-55486 |
| NP_212519.1B; Basic membrane protein D (bmpD) [*Borrelia burgdorferi* B31; Seq4 | 55487-56052 |
| AAC70056.1; Decorin binding protein A; DbpA [*Borrelia afzelii*; Seq5 | 56053-56237 |
| AAC70057.1; Decorin binding protein A; DbpA [*Borrelia garinii*] ; Seq6 | 56238-56436 |
| AAC70021.1; Decorin binding protein B; DbpB [*Borrelia burgdorferi*] ; Seq7 | 56437-56639 |
| NP_212694.1; Heat shock protein 90 [*Borrelia burgdorferi* B31] ; Seq8 | 56640-57579 |
| CAA44492.1| Outer surface protein A [*Borrelia burgdorferi*] ; Seq9 | 57580-57833 |
| |BAA22351.1| Outer surface protein B [*Borrelia garinii*] ; Seq 10 | 57834-58137 |
| AAM22469.1| Outer surface protein C [*Borrelia afzelii*] ; Seq 11 | 58138-58345 |
| AAC62927.1| OspE-related lipoprotein [*Borrelia garinii*] ; Seq12 | 58346-58523 |
| CAA57806.1| Outer surface protein G [*Borrelia burgdorferi*] ; Seq13 | 58524-58669 |
| AAC44770.1| FlaA protein (*Borrelia burgdorferi*) ; Seq14 | 58670-59232 |
| BAD18055.1 ; FlaB protein [*Borrelia garinii*] ; Seq15 | 59233-59392 |
| AAU07005.1| flagellar filament 41 kDa core protein [*Borrelia garinii* PBi] ; Seq16 | 59393-59741 |
| 1L8W|A Chain A, Crystal Structure Of Lyme Disease Variable Surface Antigen VlsE1 Of *Borrelia Burgdorferi*; Seq17 | 59742-60008 |
| CAA57807.1; Associated protein A (BapA)[*Borrelia burgdorferi*]; Seq18 | 60009-60203 |
| AAL25643.1, P37-47 [*Borrelia burgdorferi*]; Seq19 | 60204-60500 |
| NP_212481.1| fibronectin/fibrinogen-binding protein, putative [*Borrelia burgdorferi* B31]; Seq20 | 60501-61184 |
| AAC44656.1| P30 *Borrelia burgdorferi*; Seq21 | 61185-61566 |
| NP_045619.1| immunogenic protein P37, putative [*Borrelia burgdorferi* B31]; Seq22 | 61567-61910 |
| NP_212281.1| flagellin [*Borrelia burgdorferi* B31]; Seq23 | 61911-62261 |
| NP_212463.1| oligopeptide ABC transporter, periplasmic oligopeptide-binding protein (oppA-2) ; [*Borrelia burgdorferi* B31]; Seq24 | 62262-63060 |
| AAC44381.1| outer membrane porin protein Oms28 precursor; Seq25 | 63061-63322 |
| CAA49829.1| p93 [*Borrelia burgdorferi*]; Seq26 | 63323-64135 |
| NP_212375.1| glycerol kinase (glpK) [*Borrelia burgdorferi* B31]; Seq27 | 64136-64773 |
| NP_212342.1| hypothetical protein BB0208 [*Borrelia burgdorferi* B31]; Seq28 | 64774-65881 |
| NP_045482.1| hypothetical protein BBG22 [*Borrelia burgdorferi* B31]; Seq29 | 65882-66290 |
| NP_212885.1| hypothetical protein BB0751 [*Borrelia burgdorferi* B31]; Seq30 | 66291-66734 |
| AAC67038.1| predicted coding region BB0689 [*Borrelia burgdorferi* B31]; Seq31 | 66735-66934 |
| NP_045709.1| lipoprotein BBA36[*Borrelia burgdorferi* B31]; Seq32 | 66935-67186 |
| AA193789.1| lipoprotein BBA36 (homolog 67%)[*Borrelia garinii* PBi]; Seq33 | 67187-67422 |
| NP_045739.1| BBA66 antigen, P35, putative [*Borrelia burgdorferi* B31]; Seq34 | 67423-67916 |
| AA193824.1|BBA66 antigen, P35, putative [*Borrelia garinii* PBi]; Seq35 | 67917-68425 |
| NP_045742.1| hypothetical protein BBA69 [*Borrelia burgdorferi* B31]; Seq36 | 68426-68757 |
| AA193826.1| conserved hypothetical protein BBA69[*Borrelia garinii* PBi]; Seq37; | 68758-69026 |
| NP_045573.1| hypothetical protein BBI42 [*Borrelia burgdorferi* B31]; Seq38 | 69027-69299 |
| NP_051318.1| revA protein[*Borrelia burgdorferi* B31]; Seq39 | 69300-69486 |
| NP_045737.1| BBA64 antigen, P35 [*Borrelia burgdorferi* B31]; Seq40 | 69487-69835 |
| AA193822.1| BBA64 antigen, P35 [*Borrelia garinii* PBi]; Seq41 | 69836-70189 |
| AAL84596.1| BBK32 [*Borrelia burgdorferi*]; Seq42 | 70190-70651 |
| AAL84590.1| BBK32 [*Borrelia afzelii*]; Seq43 | 70652-71087 |
| AAL84595.1| BBK32 [*Borrelia garinii*]; Seq44 | 71088-71575 |

FIG. 33

| Antigen designation | SEQ ID NO |
|---|---|
| NP_212517.1 Basic membrane protein A (bmpA) [*Borrelia burgdorferi* B31 | 71576-72877 |
| NP_212516.1 Basic membrane protein B (bmpB) [*Borrelia burgdorferi* B31 | 72848-74187 |
| NP_212518.1 Basic membrane protein C (bmpC) [*Borrelia burgdorferi* B31 | 74188-75545 |
| NP_212519.1B Basic membrane protein D (bmpD) [*Borrelia burgdorferi* B31 | 75546-76931 |
| AAC70056.1 Decorin binding protein A; DbpA [*Borrelia afzelii* | 76932-77557 |
| AAC70057.1 Decorin binding protein A; DbpA [*Borrelia garinii*] | 77558-78247 |
| AAC70021.1 Decorin binding protein B; DbpB [*Borrelia burgdorferi*] | 78248-78913 |
| NP_212694.1 Heat shock protein 90 [*Borrelia burgdorferi* B31] | 78914-81459 |
| CAA44492.1| Outer surface protein A [*Borrelia burgdorferi*] | 81460-82502 |
| |BAA22351.1| Outer surface protein B [*Borrelia garinii*] | 82503-83640 |
| AAM22469.1| Outer surface protein C [*Borrelia afzelii*] | 83641-84430 |
| AA062927.1| OspE-related lipoprotein [*Borrelia garinii*] | 84431-85092 |
| CAA57806.1| Outer surface protein G [*Borrelia burgdorferi*] | 85093-85822 |
| AAC44770.1| FlaA protein (*Borrelia burgdorferi*) | 85823-87132 |
| AAU07005.1| flagellar filament 41 kDa core protein [*Borrelia garinii* PBi] | 87133-88422 |
| 1L8W|A Chain A, Crystal Structure Of Lyme Disease Variable Surface Antigen VlsE Of *Borrelia Burgdorferi* | 88423-89760 |
| CAA57807.1 Associated protein A (BapA)[*Borrelia burgdorferi*] | 89761-90382 |
| AAL25643.1, P37-47 [*Borrelia burgdorferi*]; Seq19 | 90383-91628 |
| NP_212481.1| fibronectin/fibrinogen-binding protein, putative [*Borrelia burgdorferi* B31]; Seq20 | 91629-93474 |
| AAC44656.1| P30 *Borrelia burgdorferi*; Seq21 | 93475-94488 |
| NP_045619.1| immunogenic protein P37, putative [*Borrelia burgdorferi* B31]; Seq22 | 94489-95586 |
| NP_212281.1| flagellin [*Borrelia burgdorferi* B31]; Seq23 | 95587-96876 |
| NP_212463.1| oligopeptide ABC transporter, periplasmic oligopeptide-binding protein (oppA-2) ; [*Borrelia burgdorferi* B31]; Seq24 | 96877-98934 |
| AAC44381.1| outer membrane porin protein Oms28 precursor; Seq25 | 98935-99908 |
| CAA49829.1| p93 [*Borrelia burgdorferi*]; Seq26 | 99909-102686 |
| NP_212375.1| glycerol kinase (glpK) [*Borrelia burgdorferi* B31]; Seq27 | 102687-104636 |
| NP_212342.1| hypothetical protein BB0208 [*Borrelia burgdorferi* B31]; Seq28 | 104637-106906 |
| NP_045482.1| hypothetical protein BBG22 [*Borrelia burgdorferi* B31]; Seq29 | 106907-107912 |
| NP_212885.1| hypothetical protein BB0751 [*Borrelia burgdorferi* B31]; Seq30 | 107913-109286 |
| AAC67038.1| predicted coding region BB0689 [*Borrelia burgdorferi* B31]; Seq31 | 109287-109852 |

FIG. 33

| Antigen designation | SEQ ID NO |
|---|---|
| NP_045709.1| lipoprotein BBA36[*Borrelia burgdorferi* B31]; Seq32 | 109853-110650 |
| AA193789.1| lipoprotein BBA36 (homolog 67%)[*Borrelia garinii* PBi]; Seq33 | 110651-111504 |
| NP_045739.1| BBA66 antigen, P35, putative [*Borrelia burgdorferi* B31]; Seq34 | 111505-113094 |
| AA193824.1| BBA66 antigen, P35, putative [*Borrelia garinii* PBi]; Seq35 | 113095-114736 |
| NP_045742.1| hypothetical protein BBA69 [*Borrelia burgdorferi* B31]; Seq36 | 114737-116378 |
| AA193826.1| conserved hypothetical protein BBA69[*Borrelia garinii* PBi]; Seq37; | 116379-117364 |
| NP_045573.1| hypothetical protein BBI42 [*Borrelia burgdorferi* B31]; Seq38 | 117365-118046 |
| NP_051318.1| revA protein[*Borrelia burgdorferi* B31]; Seq39 | 118047-118632 |
| NP_045737.1| BBA64 antigen, P35 [*Borrelia burgdorferi* B31]; Seq40 | 118633-119806 |
| AA193822.1| BBA64 antigen, P35 [*Borrelia garinii* PBi]; Seq41 | 119807-121024 |
| AAL84596.1| BBK32 [*Borrelia burgdorferi*]; Seq42 | 121025-122410 |
| AAL84590.1| BBK32 [*Borrelia afzelii*]; Seq43 | 122411-123764 |
| AAL84595.1| BBK32 [*Borrelia garinii*]; Seq44 | 123765-125370 |

FIG. 34

| Antigen designation | SEQ ID NO |
|---|---|
| NP_212517.1 Basic membrane protein A (bmpA) [*Borrelia burgdorferi* B31 Seq1 | 125371-126024 |
| NP_212516.1 Basic membrane protein B (bmpB) [*Borrelia burgdorferi* B31 Seq2 | 126025-126584 |
| NP_212518.1 Basic membrane protein C (bmpC) [*Borrelia burgdorferi* B31 Seq3 | 126585-127288 |
| NP_212519.1B Basic membrane protein D (bmpD) [*Borrelia burgdorferi* B31 Seq4 | 127289-127904 |
| AAC70056.1 Decorin binding protein A DbpA [*Borrelia afzelii* Seq5 | 127905-128186 |
| AAC70057.1 Decorin binding protein A DbpA [*Borrelia garinii*] Seq6 | 128187-128428 |
| AAC70021.1 Decorin binding protein B DbpB [*Borrelia burgdorferi*] Seq7 | 128429-128684 |
| NP_212694.1 Heat shock protein 90 [*Borrelia burgdorferi* B31] Seq8 | 128685-129678 |
| CAA44492.1| Outer surface protein A [*Borrelia burgdorferi*] Seq9 | 129679-129984 |
| |BAA22351.1| Outer surface protein B [*Borrelia garinii*] Seq 10 | 129985-130282 |
| AAM22469.1| Outer surface protein C [*Borrelia afzelii*] Seq 11 | 130283-130498 |
| AAC62927.1| OspE-related lipoprotein [*Borrelia garinii*] Seq12 | 130499-130870 |
| CAA57806.1| Outer surface protein G [*Borrelia burgdorferi*] Seq13 | 130871-131040 |
| AAC44770.1| FlaA protein (*Borrelia burgdorferi*) Seq14 | 131041-131966 |
| BAD18055.1 FlaB protein [*Borrelia garinii*] Seq15 | 131967-132356 |
| AAU07005.1| flagellar filament 41 kDa core protein [*Borrelia garinii* PBi] Seq16 | 132357-132940 |
| 1L8W|A Chain A, Crystal Structure Of Lyme Disease Variable Surface Antigen VlsE1 Of *Borrelia Burgdorferi* Seq17 | 132941-133116 |
| CAA57807.1 Associated protein A (BapA)[*Borrelia burgdorferi*] Seq18 | 133117-133398 |
| AAL25643.1, P37-47 [*Borrelia burgdorferi*] Seq19 | 133399-133708 |
| NP_212481.1| fibronectin/fibrinogen-binding protein, putative [*Borrelia burgdorferi* B31] Seq20 | 133709-134764 |
| AAC44656.1| P30 *Borrelia burgdorferi* Seq21 | 134765-135226 |
| NP_045619.1| immunogenic protein P37, putative [*Borrelia burgdorferi* B31] Seq22 | 135227-135614 |
| NP_212281.1| flagellin [*Borrelia burgdorferi* B31] Seq23 | 135615-136268 |

FIG. 34

| Antigen designation | SEQ ID NO |
|---|---|
| NP_212463.1| oligopeptide ABC transporter, periplasmic oligopeptide-binding protein (oppA-2) [*Borrelia burgdorferi* B31] Seq24 | 136269-137092 |
| AAC44381.1| outer membrane porin protein Oms28 precursor Seq25 | 137093-137570 |
| CAA49829.1| p93 [*Borrelia burgdorferi*] Seq26 | 137571-138312 |
| NP_212375.1| glycerol kinase (glpK) [*Borrelia burgdorferi* B31] Seq27 | 138313-139244 |
| NP_212342.1| hypothetical protein BB0208 [*Borrelia burgdorferi* B31] Seq28 | 139245-139616 |
| NP_045482.1| hypothetical protein BBG22 [*Borrelia burgdorferi* B31] Seq29 | 139617-140010 |
| NP_212885.1| hypothetical protein BB0751 [*Borrelia burgdorferi* B31] Seq30 | 140011-140476 |
| AAC67038.1| predicted coding region BB0689 [*Borrelia burgdorferi* B31] Seq31 | 140477-140768 |
| NP_045709.1| lipoprotein BBA36[*Borrelia burgdorferi* B31]Seq32 | 140769-141052 |
| AA193789.1| lipoprotein BBA36 (homolog 67%)[*Borrelia garinii* PBi]Seq33 | 141053-141368 |
| NP_045739.1| BBA66 antigen, P35, putative [*Borrelia burgdorferi* B31] Seq34 | 141369-142034 |
| AA193824.1| BBA66 antigen, P35, putative [*Borrelia garinii* PBi] Seq35 | 142035-142838 |
| NP_045742.1| hypothetical protein BBA69 [*Borrelia burgdorferi* B31] Seq36 | 142839-143178 |
| AA193826.1| conserved hypothetical protein BBA69[*Borrelia garinii* PBi] Seq37 | 143179-143468 |
| NP_045573.1| hypothetical protein BBI42 [*Borrelia burgdorferi* B31] Seq38 | 143469-143852 |
| NP_051318.1| revA protein[*Borrelia burgdorferi* B31] Seq39 | 143853-144042 |
| NP_045737.1| BBA64 antigen, P35 [*Borrelia burgdorferi* B31] Seq40 | 144043-144728 |
| AA193822.1| BBA64 antigen, P35 [*Borrelia garinii* PBi] Seq41 | 144729-145414 |
| AAL84596.1| BBK32 [*Borrelia burgdorferi*] Seq42 | 145415-145890 |
| AAL84590.1| BBK32 [*Borrelia afzelii*] Seq43 | 145891-146426 |
| AAL84595.1| BBK32 [*Borrelia garinii*] Seq44 | 146427-146962 |

FIG. 38

| Antigen | SEQ ID NO |
|---|---|
| <ABX71745 CRASP-2,*Borrelia Burgdorferi*> | 146963 |
| <CAH10086 CRASP-1,*Borrelia garinii*> | 146964 |
| <AAU07022 4-alpha-glucanotransferase,*Borrelia garinii* PBi> | 146965 |
| <CAA59725 outer surface protein A,*Borrelia afzelii*> | 146966 |
| <CAA59727 outer surface protein A,*Borrelia garinii*> | 146967 |
| <YP_853838 outer surface protein B,*Borrelia afzelii* PKo> | 146968 |
| <NP_045689 outer surface protein B,*Borrelia burgdorferi* B31> | 146969 |
| AAN87995 OspC,*Borrelia garinii*> | 146970 |
| <NP_047005 outer surface protein C, *Borrelia burgdorferi* B31> | 146971 |
| <CAF34024 outer surface protein VlsE,*Borrelia garinii*> | 146972 |
| <CAF34027 outer surface protein VlsE,*Borrelia afzelii* PKo> | 146973 |

FIG. 39

| Antigen | SEQ ID NO |
|---|---|
| <ABX71745 CRASP-2,*Borrelia Burgdorferi*> | 146974-148805 |
| <CAH10086 CRASP-1,*Borrelia garinii*> | 148806-150757 |
| <AAU07022 4-alpha-glucanotransferase,*Borrelia garinii* PBi> | 150758-154717 |

FIG. 39

| Antigen | SEQ ID NO |
|---|---|
| <CAA59727 outer surface protein A,*Borrelia garinii*> | 154718-156821 |
| <CAA59725 outer surface protein A,*Borrelia afzelii*> | 156822-158917 |
| <YP_853838 outer surface protein B,*Borrelia afzelii* PKo> | 158918-161221 |
| <NP_045689 outer surface protein B,*Borrelia burgdorferi* B31> | 161222-163501 |
| AAN87995 OspC,*Borrelia garinii*> | 163502-165005 |
| <NP_047005 outer surface protein C, *Borrelia burgdorferi* B31> | 165006-166597 |
| <CAF34024 outer surface protein VlsE,*Borrelia garinii*> | 166598-168853 |
| <CAF34027 outer surface protein VlsE,*Borrelia afzelii* PKo> | 168854-171149 |

FIG. 40

| Antigen | SEQ ID NO |
|---|---|
| <ABX71745 CRASP-2;Protein;*Borrelia burgdorferi*>Class 1 and 2 | 171150-171695 |
| <NP_045689 outer surface protein B;Protein;*Borrelia burgdorferi* B31>Class 1 and 2 | 171696-172134 |
| <NP_047005 outer surface protein C;Protein;*Borrelia burgdorferi* B31>Class 1 and 2 | 172135-172552 |
| <CAA59725 outer surface protein A;Protein;*Borrelia afzelii*>Class 1 and 2 | 172553-172996 |
| <YP_853838 outer surface protein B;Protein;*Borrelia afzelii* PKo> Class 1 and 2 | 172997-173522 |
| <CAF34027 outer surface protein VlsE;Protein;*Borrelia afzelii* PKo>Class 1 and 2 | 173523-174053 |
| <CAH10086 CRASP-1;Protein;*Borrelia garinii*> Class 1 and 2 | 174054-174491 |
| <AAU07022 4-alpha-glucanotransferase;Protein;*Borrelia garinii* PBi>Class 1 and 2 | 174492-176082 |
| <CAA59727 outer surface protein A;Protein;*Borrelia garinii*> Class 1 and 2 | 176083-176568 |
| <AAN87995 Outer Surface Protein C;Protein;*Borrelia garinii*> Class 1 and 2 | 176569-176943 |
| <CAF34024 outer surface protein VlsE;Protein;*Borrelia garinii*> Class 1 and 2 | 176944-177458 |

FIG. 41

The peptides listed in FIG. 41 are identical to the ones listed in FIG. 40.

FIG. 42

| Peptide | SEQ ID NO |
|---|---|
| <OspA 7;Protein;*Borrelia* species>FTLEGTLAA | 177459 |
| <OspA 8;Protein;*Borrelia* species>TLVSKKVIL | 177460 |
| <OspB 8;Protein;*Borrelia* species>IMLEGNLV | 177461 |
| <OspB 9;Protein;*Borrelia* species>TMSITDDL | 177462 |
| <OspC 7;Protein;*Borrelia* species>LMTLFLFI | 177463 |
| <OspC 8;Protein;*Borrelia* species>LLAGAYAI | 177464 |
| <FlaB 6;Protein;*Borrelia* species>QASWILRV | 177465 |
| <FlaB 7;Protein;*Borrelia* species>IAVNIYAA | 177466 |
| <VlsE 8;Protein;*Borrelia* species>LSAIVTAA | 177467 |
| <VlsE 9;Protein;*Borrelia* species>ILSAIVTA | 177468 |
| <OspG 6;Protein;*Borrelia* species>IICAVFVL | 177469 |
| <FlaA 6;Protein;*Borrelia* species>IWSNPNYI | 177470 |
| <OspE 4;Protein;*Borrelia* species>IICAVFVL | 177471 |
| <OspE 5;Protein;*Borrelia* species>FSEFTVNI | 177472 |
| <BmpA 3;Protein;*Borrelia* species>MYSDGIDI | 177473 |
| <BmpA 4;Protein;*Borrelia* species>LAPNNVIT | 177474 |
| <BmpB 3;Protein;*Borrelia* species>LIGVVFRI | 177475 |
| <BmpB 4;Protein;*Borrelia* species>VGDALYLI | 177476 |
| <BmpC 3;Protein;*Borrelia* species>MTEDAYEV | 177477 |
| <BmpC 4;Protein;*Borrelia* species>LNQDQSYI | 177478 |
| <BmpD 2;Protein;*Borrelia* species>MYGYEAGA | 177479 |
| <BmpD 3;Protein;*Borrelia* species>LAPNNVLV | 177480 |
| <DbpA 3;Protein;*Borrelia* species>ILKAKIKA | 177481 |
| <DbpA 4;Protein;*Borrelia* species>TADGIIAI | 177482 |
| <DbpB 2;Protein;*Borrelia* species>LAACNFGL | 177483 |
| <DbpB 3;Protein;*Borrelia* species>LVACSIGL | 177484 |
| <BapA 4;Protein;*Borrelia* species>LFILSLSA | 177485 |
| <CRASP-1a;Protein;*Borrelia* species>KLNIIKLNI | 177486 |
| <CRASP-1b;Protein;*Borrelia* species>LNYEIEKI | 177487 |
| <CRASP-1c;Protein;*Borrelia* species>KLNILTTIL | 177488 |
| <CRASP-2a;Protein;*Borrelia* species>MLISISLL | 177489 |
| <CRASP-2b;Protein;*Borrelia* species>LIDDFAIEL | 177490 |
| <CRASP-2c;Protein;*Borrelia* species>LSCDVSRL | 177491 |
| <MalQ 4;Protein;*Borrelia* species>LLDFASFV | 177492 |
| <MalQ 5;Protein;*Borrelia* species>LNTNEDFV | 177493 |
| <MalQ 6;Protein;*Borrelia* species>IAYDSADV | 177494 |
| <BmpA 5;Protein;*Borrelia* species>IVFLSCSGK | 177495 |
| <BmpA 6;Protein;*Borrelia* species>FLTGYIAAK | 177496 |
| <BmpB 5;Protein;*Borrelia* species>EIFIKQILK | 177497 |
| <BmpB 6;Protein;*Borrelia* species>ALYLITGEY | 177498 |
| <BmpC 5;Protein;*Borrelia* species>KEMARFMYK | 177499 |
| <BmpC 6;Protein;*Borrelia* species>YIAAKMSRK | 177500 |
| <BmpD 5;Protein;*Borrelia* species>SLMYSLIKK | 177501 |
| <BmpD 6;Protein;*Borrelia* species>RSTASNMYR | 177502 |
| <DbpA 5;Protein;*Borrelia* species>IIAIVKVMK | 177503 |
| <DbpA 6;Protein;*Borrelia* species>FINTQTGSK | 177504 |
| <DbpB 5;Protein;*Borrelia* species>FTGLKTGSK | 177505 |
| <DbpB 6;Protein;*Borrelia* species>LFEAFTGLK | 177506 |
| <HSP90 6;Protein;*Borrelia* species>LLTSGMPSK | 177507 |
| <OspA 7;Protein;*Borrelia* species>LILALIACK | 177508 |
| <OspA 8;Protein;*Borrelia* species>KTKNLVFTK | 177509 |
| <OspA 9;Protein;*Borrelia* species>ISVNSQKTK | 177510 |
| <OspB 9;Protein;*Borrelia* species>VTLKKEIEK | 177511 |
| <OspB 10;Protein;*Borrelia* species>RINGTTLEY | 177512 |
| <OspB 11;Protein;*Borrelia* species>MTDADNATK | 177513 |
| <OspC 9;Protein;*Borrelia* species>LANKAIGKK | 177514 |
| <OspC 10;Protein;*Borrelia* species>ILMTLFLFI | 177515 |
| <OspC 11;Protein;*Borrelia* species>AISTLITEK | 177516 |
| <OspE 6;Protein;*Borrelia* species>GSFKTSLYY | 177517 |
| <OspE 7;Protein;*Borrelia* species>NLGTLVIRK | 177518 |
| <OspG 7;Protein;*Borrelia* species>VFVLIISCK | 177519 |
| <FlaA 7;Protein;*Borrelia* species>RVSKSHSSK | 177520 |
| <FlaB 8;Protein;*Borrelia* species>SINAANLSK | 177521 |
| <FlaB 9;Protein;*Borrelia* species>KINTPASLS | 177522 |
| <FlaB 10;Protein;*Borrelia* species>SQASRNTSK | 177523 |
| <FlaB 11;Protein;*Borrelia* species>FQNRLESIK | 177524 |
| <VlsE 10;Protein;*Borrelia* species>AVSGEQILK | 177525 |
| <VlsE 11;Protein;*Borrelia* species>AIVLRGLAK | 177526 |
| <BapA 5;Protein;*Borrelia* species>KQILADLPK | 177527 |
| <BapA 6;Protein;*Borrelia* species>QLNSDKIDY | 177528 |
| <CRASP-1d;Protein;*Borrelia* species>RIIYSSLNY | 177529 |
| <CRASP-1e;Protein;*Borrelia* species>SSLNYEIEK | 177530 |
| <CRASP-2d;Protein;*Borrelia* species>RSRYNNFYK | 177531 |
| <CRASP-2e;Protein;*Borrelia* species>ESFDVISSK | 177532 |
| <CRASP-2f;Protein;*Borrelia* species>LIALKCIVK | 177533 |
| <MalQ 1;Protein;*Borrelia* species>RSFEKFKKK | 177534 |
| <MalQ 2;Protein;*Borrelia* species>FLFASSQSY | 177535 |
| <MalQ 3;Protein;*Borrelia* species>RINLNLKRK | 177536 |
| <Artificial;Protein> | 177537 |
| <Artificial;Protein> | 177538 |

Table A: SEQ ID NO 177539-179138
Table B SEQ ID NO 179139-179392
Table C SEQ ID NO 179393-179552

FIG. 36 SEQ ID NO 179553-180345
FIG. 37 SEQ ID NO 180346-180857
FIG. 43 SEQ ID NO 180858-216339
FIG. 44 SEQ ID NO 216340-216404
FIG. 45 SEQ ID NO 216405-216469
FIG. 36 SEQ ID NO 216470-217262
FIG. 37 SEQ ID NO 217263-217774

EXAMPLES

Example 1

This example describes how to make a MHC class I complex with a peptide in the peptide binding-groove using in vitro refolding. The MHC-complex in this example consisted of light chain β2m, the MHC class I Heavy Chain allele HLA-A*0201 (a truncated version in which the intracellular and transmembrane domains have been deleted) and the peptide QLFEELQEL (SEQ ID NO 217775).

MHC I-complexes consists of 3 components; Light Chain (β2m), Heavy Chain and a peptide of typically 8-10 amino acids. In this example MHC-complexes was generated by in vitro refolding of heavy chain, β2m and peptide in a buffer containing reduced and oxidized glutathione. By incubation in this buffer a non-covalent complex between Heavy Chain, β2m and peptide was formed. Heavy chain and β2m was expressed as inclusion bodies in *E. coli* prior to in vitro refolding following standard procedures as described in Garboczi et al., (1996), Nature 384, 134-141. Following refolding the MHC complexes was biotinylated using BirA enzyme able to biotinylate a specific amino acid residue in a recognition sequence fused to the C-terminal of the Heavy Chain by genetic fusion. Monomer MHC complexes was then purified by size exclusion chromatography.

1. 200 ml of refolding buffer (100 mM Tris, 400 mM L-arginin-HCL, 2 mM NaEDTA, 0.5 mM oxidized Gluthathione, 5 mM reduced Glutathione, pH 8.0) was supplied with protease inhibitors PMSF (phenylmethylsulphonyl fluoride), Pepstatin A and Leupeptin (to a final concentration of 1 mM, 1 mg/l and 1 mg/l, respectively). The refolding buffer was placed at 10° C. on a stirrer.
2. 12 mg of peptide QLFEELQEL (SEQ ID NO 217775) was dissolved in DMSO or another suitable solvent (300-500 μl), and added drop-wise to the refolding buffer at vigorous stirring.
3. 4.4 mg of human Light Chain β2m was added drop-wise to the refolding buffer at vigorous stirring.
4. 6.2 mg of Heavy Chain HLA-A*0201 (supplied with DTT to a concentration of 0.1 mM) was added drop-wise to the refolding buffer at vigorous stirring.
5. The folding reaction was placed at 10° C. at slow stirring for 4-8 hours.
6. After 4-8 hours, step 3 and 4 was repeated and the folding reaction is placed at 10° C. at slow stirring O/N.
7. Step 3 and 4 was repeated, and the folding reaction is placed at 10° C. at slow stirring for 6-8 hours.
Optionally, steps 5-7 may be done in less time, e.g. a total of 0.5-5 hours.
8. After 6-8 hours the folding reaction was filtrated through a 0.2 μm filter to remove aggregates.
9. The folding reaction was concentrated O/N at 10° C. shaking gently in a suitable concentrator with a 5000 mw cut-off filter. The folding reaction was concentrated to approximately 5-10 ml. (Optionally the filtrate can be stored at 4° C. and reused for another folding with the same peptide and heavy chain.)
10. The concentrated folding reaction was buffer-exchanged at least 8 times, into a MHC-buffer (20 mM Tris-HCl, 50 mM NaCl, pH 8.0) and concentrated (at 10° C. in a suitable concentrator with a 5000 mw cut-off filter) down to approximately 1 ml.
11. The heavy chain part of the MHC-complex was biotinylated by mixing the following components: approximately 1000 μl folded MHC-complex, 100 μl each of Biomix-A, Biomix-B and d-Biotin (all 3 from Biotin Protein Ligase Kit from Avidity, 10 μl birA enzyme (3 mg/ml, from Biotin Protein Ligase Kit from Avidity, 0.5 μl Pepstatin A (2 mg/ml) and 0.5 μl Leupeptin (2 mg/ml). The above was gently mixed and incubated O/N at room temperature.
12. The biotinylated and folded MHC-complex solution was centrifuged for 5 min. at 1700×g, room temperature.
13. Correctly folded MHC-complex was separated and purified from excess biotin, excess β2m, excess heavy chain and aggregates thereof, by size exclusion chromatography on a column that separates proteins in the 10-100 kDa range. Correctly folded monomer MHC-complex was eluted with a MHC-buffer (20 mM Tris-HCl, 50 mM NaCl, pH 8.0). The elution profile consisted of 4 peaks, corresponding to aggregated Heavy Chain, correctly folded monomer MHC-complex, β2m and excess biotin and peptide (See FIG. 7).
14. Fractions containing the folded MHC-complex were pooled and concentrated to approximately 1 ml in a suitable concentrator with a 5000 mw cut-off filter. The protein-concentration was estimated from its absorption at 280 nm.
15. Folded MHC-complex can optionally be stored stored at −170° C. before further use.
16. The grade of biotinylation was analyzed by a SDS PAGE SHIFT-assay with Streptavidin (FIG. 8) and correct folding was confirmed by ELISA, using the antibody W6/32 that recognizes correctly folded MHC-peptide complex.
17.

The above procedure may be used for folding any MHC I complexes consisting of any β2m, any heavy chain and any peptide approx. 8-11 amino acids long. Either of the components can be truncated or otherwise modified. The above procedure can also be used for generation of "empty" MHC I complexes consisting of β2m and heavy chain without peptide.

Example 2

This example describes how to generate soluble biotinylated MHC II complexes using a baculovirus expression system, where the MHC II complex was DR4 consisting of the α-chain DRA1*0101 and the β-chain DRB1*0401 as described by Svendsen et al., (2004), J. Immunol. 173(11): 7037-45. Briefly, the hydrophobic transmembrane regions of the DRα and DRβ chains of DR4 were replaced by leucine zipper dimerization domains from the transcription factors Fos and Jun to promote DR α/β assembly. This was done by ligating cytoplasmic cDNA sequences of DRA1*0101 and DRB1*0401 to fos- and jun-encoding sequences. A birA site GLNDIFEAQKIEWH (SEQ ID NO 217788) was added to the 3' end of the DRA1*0101-fos template. Covalently bound peptide AGFKGEQGPKGEP (SEQ ID NO 217789) derived from collagen II amino acid 261-273 were genetically attached by a flexible linker peptide to the N terminus of the DRβ-chain. Finally, the modified DRA1*0101 and DRB1*0401 inserts were cloned into the expression vector pAcAb3. The pAcAB3-DRA1*0101/DRB1*0401 plasmids were cotransfected with linearized baculovirus DNA (BD Pharmingen; BaculoGold kit) into Sf9 insect cells, according to the manufacturer's instructions. Following two rounds of plaque purification, clonal virus isolates were further amplified three times before preparation of high-titer virus ($10^8$-$10^{10}$/ml). These stocks were used to infect High Five or serum-free Sf21 insect cells (Invitrogen Life Technologies, Carlsbad, Calif.) for protein production. Spinner cultures (2-3×$10^6$ cells/ml) were infected at a multiplicity of infection of 1-3 in a volume of 150 ml per 2 L spinner flask. Supernatants were harvested and proteinase inhibitor tablets (Roche, Basel, Switzerland) were added before affinity purification on MiniLeak-Low columns (Kem-En-Tec) coupled with the anti-HLA-DR monoclonal antibody L243. HLA-DR4 complexes were eluted with diethylamine (pH 11) into neutralization buffer (2 M Tris, pH 6.5) and immediately buffer exchanged and concentrated in PBS, 0.01% NaN$_3$, using Millipore (Bedford, Mass.) concentrators. The purity of protein was confirmed by SDS-PAGE. The purified DR4 complexes were biotinylated in vitro as described for MHC I complexes elsewhere herein. These complexes may now be used for coupling to any dimerization domain, e.g. divynylsulfone activated dextran 270 coupled with SA and a fluorochrome.

Example 3

This example describes how to generate empty biotinylated MHC II complexes using a baculovirus expression system, where the MHC II complex consist of any α-chain and any β-chain, including truncated and otherwise modified versions of the two. Briefly, The hydrophobic transmembrane regions of the DRα and DRβ chains of MHC II are replaced by leucine zipper dimerization domains from the transcription factors Fos and Jun to promote DR α/β assembly. This is done by ligating cytoplasmic cDNA sequences of DRα and DRβ to fos- and jun-encoding sequences. A birA site GLNDIFEAQKIEWH (SEQ ID NO 217788) is added to the 3' end of either the DRα-fos/DRα-jun or the DRβ-jun/DRβ-fos template. The modified DRα and DRβ inserts is cloned into the expression vector pAcAb3 and cotransfected with linearized baculovirus DNA into Sf9 insect cells, according to the manufacturer's instructions. Following rounds of plaque purification, clonal virus isolates is further amplified before preparation of high-titer virus. These stocks are used to infect High Five or serum-free Sf21 insect cells (Invitrogen Life Technologies, Carlsbad, Calif.) for protein production, e.g. as Spinner cultures. Supernatants are harvested and proteinase inhibitors added before affinity purification, e.g. using a MiniLeak-Low columns (Kem-En-Tec) coupled with anti-MHC II antibody. The purified MHC II complexes is biotinylated in vitro as described for MHC I complexes elsewhere herein. These biotinylated MHC II complexes may now be used for coupling to any dimerization domain, e.g. divynylsulfone activated dextran 270 coupled with SA and a fluorochrome.

Example 4

This example describes how to generate biotinylated MHC II complexes using a cell based protein expression system, where the MHC II complex consist of any α-chain and any β-chain, including truncated and otherwise modified versions of the two. The MHC II complex may also have a peptide bound in the peptide binding cleft.

The hydrophobic transmembrane regions of the MHC II α-chain and MHC II β-chain are replaced by leucine zipper dimerization domains from the transcription factors Fos and Jun to promote α/β chain assembly. This is done by ligating cytoplasmic cDNA sequences of α-chain and β-chain to fos- and jun-encoding sequences. A birA site GLNDIFEAQKIEWH (SEQ ID NO 217788) is added to the 3' end of the DRα-fos template. Optionally covalently bound peptide is genetically attached by a flexible linker peptide to the N terminus of the DRβ-chain. The modified DRα and DRβ inserts is cloned into a suitable expression vector and transfected into a cell line capable of protein expression, e.g. insect cells, CHO cells or similar. Transfected cells are grown in culture, supernatants are harvested and proteinase inhibitors added before affinity purification, e.g. using a MiniLeak-Low columns (Kem-En-Tec) coupled with anti-MHC II antibody. Alternatively the expressed MHC II complexes may be purified by anion- or cation-exchange chromatography. The purified MHC II complexes is biotinylated in vitro as described for MHC I complexes elsewhere herein. These biotinylated MHC II complexes may now be used for coupling to any dimerization domain, e.g. divynylsulfone activated dextran 270 coupled with SA and a fluorochrome.

Example 5

This is an example of how to make a MHC multimer that is a tetramer and where the MHC are attached to the multimerization domain through a non-covalent interaction The multimerization domain consist of Streptavidin. The MHC molecule was biotinylated DR4 consisting of the α-chain DRA1*0101 and the β-chain DRB1*0401 and the peptide AGFKGEQGPKGEP (SEQ ID NO 217789) derived from collagen II amino acid 261-273. The biotinylated MHC-peptide complexes was generated as described in a previous example herein.

Fluorescent DR4-peptide tetramer complexes were assembled by addition of ultra-avidin-R-PE (Leinco Technologies, St. Louis, Mo.) at a final molar ratio of biotinylated to DR4-peptide ultra-avidin-R-PE of 6:1. The resulting DR4-peptide multimer complexes were subjected to size exclusion on a Superdex-200 column to separate the tetramer complexes from protein aggregates and lower molecular weight complexes and excess fre DR4-peptide. The tetramer complexes were concentrated using Centicon-30 concentrators and stored at 0.1-0.3 mg/ml in a mixture of protease inhibitors.

These complexes could be used to detect specific T cells in a flow cytometry assay as described by Svendsen et al. (2004) Tracking of Proinflammatory Collagen-Specific T cells in Early and Late Collagen-Induced Arthritis in Humanized mice. J. Immunol. 173:7037-7045.

Example 6

This is and example of generation of a multimerization domain. The multimerization domain is an activated divinylsylfone-dextran (270 kDa) (VS-dex270) was coupled with streptavidin (SA) and labelled with Allophycocyanin (APC).

1. Streptavidin (approx. 100 mg SA/ml in 10 mM HEPES, 0.1M NaCl, pH 7.85) was dialysed with gentle stirring for 2 days against 10 mM HEPES, 0.1M NaCl, pH 7.85 (20 fold excess volume) at 2-8° C. with 1 buffer change/day.
2. 5 ml of APC from a homogen suspension (approx. 10 mg/ml) was centrifuged 40 min. at 3000 rpm. The supernatant was discharged and the precipitate dissolved in 5 ml of 10 mM HEPES, 0.1M NaCl, pH 7.85. This APC solution was dialysed with gentle stirring in the dark for 2 days against 10 mM HEPES, 0.1M NaCl, pH 7.85 (20 fold excess volume) at 2-8° C. with 1 buffer change/day.

3. The APC-solution was concentrated to 1 ml and the concentration measured to 47 g/L at UV 650 nm. The A650/A278-ratio was measured to 4.2.
4. The SA-solution was filtrated through a 0.45 µm filter and the protein concentration was measured to 61.8 g SNL at UV 278 nm.
5. Conjugation: The reagents was mixed to a total volume of 500 µl in the following order with 8.1 mol SA/mol Dex and 27 mol APC/mol Dex.:
   a) 90 µl water
   b) 160 µl activated VS-dex270
   c) 23 µl SA (61.8 g/L)~8.1 equivalents,
   d) 177 µl APC (47 g/L)~27 equivalents,
   e) 50 µl of 100 mM HEPES, 1M NaCl, pH 8

The reaction was placed in a water bath with stirring at 30° C. in the dark for 18 hours.
6. The coupling was stopped by adding 50 µl 0.1M ethanolamine, pH 8.0.
7. The conjugate was purified on a Sephacryl S-200 column with 10 mM HEPES, 0.1M NaCl buffer, pH 7.2.
8. 3 peaks were collected (peak 1: APC-SA-dex270; peak 2: Free APC; peak 3: Free SA). Volume, UV A650 and UV A278 were measured.
9. The concentration of dextran270, APC/Dex and SA/Dex were calculated to $22.4 \times 10^{-8}$ M; 3.48 and 9.54 respectively.
10. The conjugate were added $NaN_3$ and BSA to a final concentration of 15 mM and 1% respectively. The volume was adjusted with 10 mM HEPES, 0.1M NaCl, pH 7.2 to a final concentration of $16 \times 10^{-8}$M Dex270.
11. The conjugate were kept at 2-8° C. in dark until further use.

Example 7

This is and example of generation of a multimerization domain. The multimerization domain is an activated divinylsylfone-dextran(270 kDa)(VS-dex270) was coupled with streptavidin (SA) and the label is R-phycoerythrin (RPE).

The coupling procedure described for coupling of SA and APC to VS-dex270 (as described elsewhere herein) were followed with the exception that APC were replaced with RPE

Example 8

This is an example of how to couple MHC-peptide complexes to a multimerization domain, where the multimerization domain is dextran.

This example describes how to couple an empty MHC or a MHC-complex to a dextran multimerization domain through a non-covalent coupling, to generate a MHC-dextramer. The MHC-dextramer in this example consisted of APC-streptavidin (APC-SA)-conjugated 270 kDA dextran and a biotinylated, folded MHC-complex composed of β2m, HLA-A*0201 heavy chain and the peptide NLVPMVATV (SEQ ID NO 217779). The APC-SA conjugated 270 kDA dextran contained 3.7 molecules of SA per dextran (each SA can bind 3 MHC-complexes) and the concentration was $16 \times 10^{-8}$ M. The concentration of the HLA-A*0201/NLVPMVATV-complex (SEQ ID NO 217779) was 4 mg/ml (1 µg=20,663 pmol). The molecular concentration of the MHC-complex was $8.27 \times 10^{-5}$M.

The MHC-complex was attached to the dextran by a non-covalent Biotin-Streptavidin interaction between the biotinylated Heavy Chain part of the MHC-complex and the SA, conjugated to dextran.

Here follows a protocol for how to produce 1000 µl of a MHC-dextramer solution with a final concentration of approximately $32 \times 10^{-9}$M:
1. 200 µL 270 kDA vinylsulfone-activated dextran, corresponding to $3.2 \times 10^{-11}$ mol, and 4 µl MHC-complex, corresponding to $3.55 \times 10^{-10}$ mol was mixed and incubated at room temperature in the dark for 30 min.
2. A buffer of 0.05M Tris-HCl, 15 mM $NaN_3$, 1% BSA, pH 7.2 was added to a total volume of 1000 µl.
3. The resulting MHC-dextramer preparation may now be used in flow cytometry experiments.

Example 9

This is an example of how to make and use MHC multimers that are trimers consisting of a streptavidin multimerization domain with 3 biotinylated MHC complexes and 1 flourophore molecule attached to the biotin binding pockets of streptavidin. MHC complexes consisting of HLA-A*0201 heavy chain, beta2microglobulin and NLVPMVATV (SEQ ID NO 217779) peptide or the negative control peptide GLAGDVSAV (SEQ ID NO 217778) were generated as described elsewhere herein. The fluorophore in this example was Fluorescein-linker molecules as shown in FIG. 9. Each of these molecules consist of a linker-biotin molecule mounted with 4 trippel fluorescein-linker molecules. The linker-biotin molecule was here H-L30-Lys($NH_2$)-L30-Lys($NH_2$)-L30-Lys($NH_2$)L300Lys(caproylamidobiotin)-$NH_2$ where L30 was a 30 atom large linker and L300 was a 300 atom large linker. Both L30 and L300 was composed of multiple L15 linkers with the structure shown in FIG. 9B. Linker-biotin molecules were generated as follows: Downloaded Boc-L300-Lys(Fmoc) resin (100 mg) was deprotected and subjected to coupling with Boc-Lys(2ClZ)—OH, Boc-L30-OH, Boc-Lys(2ClZ)—OH, Boc-L30-OH, Boc-Lys(2ClZ)—OH then Boc-L30-OH. The resin was Fmoc deprotected and reacted twice (2×2 h) with caproylamido biotin NHS ester (25 mg in 0.5 mL NMP+25 microL DIPEA). The resin was washed with TFA and the product cleaved off with TFA:TFMSA:mCresol:thioanisol (6:2:1:1), 1 mL, precipitated with diethyl ether and purified by RP-HPLC. MS calculated for $C_{300}H_{544}N_{64}O_{137}S$ is 7272.009 Da, found 7271.19 Da.

Alternatively linker-biotin molecule was H-L60-Lys($NH_2$)-L60-Lys($NH_2$)-L60-Lys($NH_2$)L300Lys(caproylamidobiotin)-$NH_2$ and made from downloaded Boc-L300-Lys(Fmoc) resin (100 mg), and then prepared analogously to H-L30-Lys($NH_2$)-L30-Lys($NH_2$)-L30-Lys($NH_2$)L300Lys(caproylamidobiotin)-$NH_2$. MS calculated for $C_{360}H_{652}N_{76}O_{167}S$ is 8749.5848 Da and was found to be 7271.19 Da. Yield 3 mg. The trippel fluorescein-linker molecules was here betaalanin-L90-Lys(Flu)-L90-Lys(Flu)-L90-Lys(Flu)-$NH_2$ where Lys=Lysine, Flu=Fluorescein and L90 is a 90 atom linker (se FIG. 9 for further details). The trippel-fluorescein-linker molecule was generated as follows: Downloaded Boc-Lys(Fmoc) resin, 2 g, was Boc deprotected and subjected to 3× coupling with Boc-L30-OH, Boc-Lys(Fmoc)-OH, 3×Boc-L30-OH, Boc-Lys(Fmoc)-OH, 3×Boc-L30-OH. The three Fmoc groups were removed and carboxyfluorescein, 301 mg, activated with HATU, 274 mg, and DIPEA, 139 µL, in 8 mL NMP, was added to the resin twice for 30 min. The resin was Boc deprotected and subjected to 2×30 min coupling with beta-alanine-N,N-diacetic acid benzyl ester, followed by 5 min treatment with 20% piperidine in NMP. The resin was washed with DCM, then TFA and the product was cleaved off the resin, precipitated with diethyl ether and purified by RP-HPLC. Yield was 621 mg. MS calculated for C268H402N44O116 is 6096.384 Da, while MS found was 6096 Da.

Biotin-linker molecule were coupled together with 4 trippel fluorescein-linker molecules as follows: (500 nmol) was dissolved in 88 microliter NMP+2 µl pyridine and activated for 10 min at room temperature (conversion to cyclic anhydride) by addition of 10 N,N' diisopropylcarbodiimide. Following activation the trippel fluorescein-linker was precipitated with diethyl ether and redissolved in 100 microliter NMP containing 10 nmol biotin-linker. Once dissolved the coupling was initiated by addition of 5 diisopropyl ethyl amine, and was complete after 30 min.

Streptavidin and Fluorescein-linker molecules are then mixed in a molar ration of 1:1 and incubated for ½ hour. Then MHC complexes are added in 3-fold molar excess in respect to streptavidin and incubated for another ½ hour. Alternatively, MHC complexes are added first, then Fluorescein-linker molecules or MHC complexes are mixed with Fluorescein-linker molecules before addition to Streptavidin.

These MHC multimers are then used to stain CMV specific T cells in a flow Cytometry experiment. $1 \times 10^6$ purified HPBMC from a donor with T cells specific for HLA-A*0201(NLVPMVATV) (SEQ ID NO 217779) are incubated with 10 µl of each of the two HLA-A*0201 (peptide)/Fluorescein constructs described above for 10 minutes in the dark at room temperature with a cell concentration of $2 \times 10^7$ cells/ml. 10 µl of mouse-anti-human CD8/PB (clone DK25 from Dako) are added and the incubation continued for another 20 minutes at 4° C. in the dark. The samples are then washed by adding 2 ml PBS; pH=7.2 followed by centrifugation for 5 minutes at 200×g and the supernatant removed. The cells are resuspended in 400-500 µl PBS; pH=7.2 and analyzed on a flowcytometer.

In the above described example the Fluorescein-linker is as shown in FIG. 9 but the linker molecule can be any linker molecule as described in patent application WO 2007/015168 A2 (Lohse (2007)) or alternatively chemical biotinylated fluorochrom can be used instead of Fluorescein-linker molecules. The MHC complexes described in this example is a MHC I molecule composed of HLA-A*0201 heavy chain, beta2microglobulin and NLVPMVATV (SEQ ID NO 217779) peptide but can in principle be any MHC complex or MHC like molecule as described elsewhere herein.

Example 10

This is an example of how to make and use MHC multimers that are trimers. This is an example of how to make MHC multimers consisting of a streptavidin multimerization domain with 3 biotinylated MHC complexes attached to the biotin binding pockets of streptavidin and how to use such trimer MHC complexes to detect specific T cells by direct detection of individual cells in a flow cytometry experiment by addition of a biotinylated flourophore molecule. In this example the fluorophore is Fluorescein linker molecules constructed as described elsewhere herein.

MHC complexes consisting of HLA-A*0201 heavy chain, beta2microglobulin and peptide are generated as described elsewhere. MHC complexes are incubated with streptavidin in a molar ratio of 3:1 for 1/2 hour.

These trimer MHC multimers are then used to stain CMV specific T cells in a flow Cytometry experiment. $1 \times 10^6$ purified HPBMC from a donor with T cells specific for HLA-A*0201(NLVPMVATV) (SEQ ID NO 217779) are incubated with 10 µl HLA-A*0201(peptide) multimer construct for 10 minutes in the dark at room temperature with a cell concentration of $2 \times 10^7$ cells/ml. Then Fluorescein linker molecules (as described in Example 9) are added and incubation continued for 5 minutes. 10 µl mouse-anti-human CD8/PB antibody (clone DK25 from Dako) is added and the incubation continued for another 20 minutes at 4° C. in the dark. The samples are then washed by addition of 2 ml PBS; pH=7.2 followed by centrifugation for 5 minutes at 200×g and the supernatant removed. Cells are resuspended in 400-500 µl PBS; pH=7.2 and analyzed on a flowcytometer.

In this example the Fluorescein-linker is as shown in FIG. 9 but the linker molecule can be any linker molecule as described in Lohse, Jesper, (2007), WO 2007/015168 A2 or alternative chemically biotinylated fluorochrome may be used. The MHC complexes described in this example is a MHC I molecule composed of HLA-A*0201 heavy chain, beta2microglobulin and NLVPMVATV (SEQ ID NO 217779) peptide but can in principle be any MHC complex or MHC like molecule as described elsewhere herein.

Example 11

This is an example of how to make MHC multimers where the multimerization domain is dextran and the MHC complexes are chemically conjugated to the dextran multimerization domain.

MHC complexes consisting of HLA-A*0201 heavy chain, beta2microglobulin and NLVPMVATV (SEQ ID NO 217779) peptide or the negative control peptide GLAGDVSAV (SEQ ID NO 217778) are generated as described elsewhere herein. Dextran with a molecular weight of 270 kDa is activated with divinylsulfone. Activated Dextran is then incubated with MHC and RPE in a 0.05 M NaCHO$_3$ buffer; pH=9.5 with a molar ratio between MHC and Dextran of 30-60 and a molar ratio between RPE and dextran of 3-7:1 The mixture is placed in a water bath at 30° C. for 16 hours. Excess flourochrome, MHC and dextran are removed by FPLC using a sephacryl S-300 column.

These MHC/RPE dextramers are then used to stain CMV specific T cells in a flow Cytometry experiment. Briefly, $1 \times 10^6$ purified HPBMC from a donor with T cells specific for HLA-A*0201(NLVPMVATV) (SEQ ID NO 217779) are incubated with 10 µl of each of the two HLA-A*0201 (peptide)/RPE constructs described above for 10 minutes in the dark at room temperature with a cell concentration of $2 \times 10^7$ cells/ml. 10 µl mouse-anti-human CD8/PB antibody (clone DK25 from Dako) are added and the incubation continued for another 20 minutes at 4° C. in the dark. The samples are then washed by adding 2 ml PBS; pH=7.2 followed by centrifugation for 5 minutes at 200×g and the supernatant removed. The cells are then resuspended in 400-500 µl PBS; pH=7.2 and analyzed on a flow cytometer.

Example 12

This is an example of how to make MHC multimers where the multimerization domain is dextran and MHC complexes are MHC I molecules chemically conjugated to dextran multimerization domain and the dextran multimerization domain also have fluorochrome chemically coupled.

Human beta2microglobulin is coupled to dextran as follows. Dextran with a molecular weight of 270 kDa is activated with divinylsulfone. Activated dextran is incubated with human beta2microglobulin and RPE in a 0.05 M NaCHO$_3$ buffer; pH=9.5 with a molar ratio between beta2microglobulin and Dextran of 30-60 and a molar ratio between RPE and dextran of 3-7:1. The molar ratio of the final product is preferable 4-6 RPE and 15-24 beta2microglobulin per dextran. The mixture is placed in a water bath at 30° C. for 16 hours. Excess flourochrome, beta2microglobulin and dextran are removed by FPLC using a sephacryl S-300 column. The beta2microglobulin-RPE-dextran construct is then refolded in vitro together with heavy chain and peptide using the following procedure. 200 ml refolding buffer (100 mM Tris, 400 mM L-arginin-HCL, 2 mM NaEDTA, 0.5 mM oxidized Gluthathione, 5 mM reduced Glutathione, pH 8.0) supplied with protease inhibitors PMSF, Pepstatin A and Leupeptin (to a final concentration of 1 mM, 1 mg/l and 1 mg/l, respectively) is made and cooled to 10° C. 12 mg NLVPMVATV (SEQ ID NO 217779) peptide is dissolved in DMSO and added to the refolding buffer together with 20-30 mg beta2microglobulin-RPE-dex and 6 mg HLA-A*0201 heavy chain. Incubation at 10° C. for 4-8 hours, then 20-30 mg beta2microglobulin-RPE-dex and 6 mg HLA-A*0201 heavy chain is added and incubation continued for 4-8 hours. Another 20-30 mg beta2microglobulin-RPE-dex and 6 mg HLA-A*0201 heavy chain is added and incubation continued for 6-8 hours. The folding reaction is filtrated through a 0.2 μm filter to remove larger aggregates and then buffer exchanged into a buffer containing 20 mM Tris-HCl, 50 nM NaCl; pH=8.0 followed by concentration to 1-2 ml sample. Dextran-RPE-MHC complexes are then separated from excess heavy chain and peptide by size exclusion chromatography using a sephacryl S-300, S-400 or sephacryl S-500 column.

These MHC/RPE dextramers may be used to stain CMV specific T cells in a flow Cytometry experiment. Briefly, 1×10$^6$ purified HPBMC from a donor with T cells specific for HLA-A*0201(NLVPMVATV) (SEQ ID NO 217779) are incubated with 10 μl of each of the two HLA-A*0201 (peptide)/RPE constructs described above for 10 minutes in the dark at room temperature with a cell concentration of 2×10$^7$ cells/ml. 10 μl of mouse-anti-human CD8/PB antibody (clone DK25 from Dako) are added and the incubation continued for another 20 minutes at 4° C. in the dark. The samples are then washed by adding 2 ml PBS; pH=7.2 followed by centrifugation for 5 minutes at 200×g and the supernatant removed. The cells are then resuspended in 400-500 μl PBS; pH=7.2 and analyzed on a flowcytometer.

Example 13

The preparation of a Pentamer is described in e.g. (United States Patent application 20040209295). Briefly, the following steps lead to a fluorescent Pentamer reagent:

The following is a detailed example for cloning, expressing, and purifying a pentameric class I MHC complex, which comprises a chimeric fusion of .beta.2m with COMP. The chimeric .beta.2m-COMP protein is expressed in E. coli insoluble inclusion bodies in E. coli and subsequently assembled as pentameric .beta.2m-COMP in vitro. The pentameric class I MHC peptide complex is then formed in a second refolding reaction by combining .beta.2m-COMP pentamers and the human MHC class I .alpha. molecule known as HLA-A*0201, in the presence of an appropriate synthetic binding peptide representing the T cell antigen. In this example, a well characterized antigen derived from Epstein-Barr virus BMLF1 protein, GLCTLVAML (SEQ ID NO 217782) (a.a. 289-297), is used. The resultant complex is labelled with a fluorescent entity and used as a staining reagent for detecting antigen-specific T cells from a mixed lymphocyte population, in a flow cytometry application.

The strategy involves the sequential cloning into pET-24c vector of .beta.2m, yielding a construct referred to as pETBMC01, followed by the insertion of the oligomerisation domain of cartilage oligomeric matrix protein (COMP) with a biotin acceptor sequence (BP) for site-specific biotinylation with the biotin-protein ligase BirA, yielding a construct referred to as pETBMC02. Thirdly a polyglycine linker is cloned in between .beta.2m and COMP, yielding a construct referred to as pETBMC03, and finally, a serine-residue is removed by site-directed mutagenesis, which serine residue precedes the poly-glycine linker, to give the final .beta.2m-COMP/pET-24c construct, referred to as pETBMC04 (see also FIG. 3). Removal of the serine residue is carried out to avoid steric hindrance when the .beta.2m molecule is associated with the MHC class I chain protein.

The extracellular portion of .beta.2m comprises of 99 amino acids (equivalent to Ile1-Met99 of the mature protein) encoded by 74 bp-370 bp of the DNA sequence. This region of the .beta.2m sequence is amplified from a normal human lymphocyte cDNA library, by polymerase chain reaction (PCR)

beta.2m PCR product is purified from the above reaction mix using a QIAquick® PCR purification kit according to the manufacturers instructions (Qiagen). 200 ng of purified PCR product and 1 .mu·g pET-24c vector (Novagen) are each digested with BamH I (10 U) and Nde I (10 U) restriction enzymes (New England Biolabs, NEB) for 4 h at 37.degree. C., in accordance with the manufacturers instructions, and purified.

The gel-purified insert and vector DNA are ligated at a 1:3 molar ratio (vector:insert, 50 ng: 7.5 ng) using T4 DNA ligase (5 U; Bioline), in T4 DNA ligase buffer (as supplied) for 16 hrs at 16.degree. C.

The ligation mixtures and appropriate controls are subsequently transformed into XL1-Blue strain competent E. coli cells, according to the manufacturers instructions (Stratagene). Successful transformants are selected by plating the cells on Luria-Bertani (LB) agar plates containing 30 .mu·g/nnl kanamycin, and incubating overnight at 37.degree. C.

A selection of single colonies from the bacterial transformation plates are screened by PCR with T7 promoter [SEQ ID NO: 4] (1 .mu·M) and T7 terminator [SEQ ID NO: 5] (1 .mu·M) primers (Sigma Genosys, see Appendix I for primer sequences), which are complementary to regions of the pET vector flanking the cloning site. Amplification is carried out using Taq DNA polymerase (1 U, Bioline) in Taq reaction buffer (as supplied), supplemented with 2 mM MgSO.sub.4 and 0.2 mM dNTPs, using 25 thermal-cycling reactions as detailed above. Successful transformants generated a DNA fragment of approximately 500 bp, ascertained by 1.5% agarose gel electrophoresis.

Bacterial transformants that generated the correct size of PCR products are inoculated into 6 ml of sterile LB-kanamycin medium and incubated overnight at 37.degree. C. with 200 rpm shaking. pETBMC01 plasmid DNA is recovered from the bacterial cultures using a QIAprep® Spin Mini-prep kit according to the manufacturers instructions (Qiagen). The presence of the .beta.2m fragment in these plasmids is further verified by automated DNA sequencing.

The sequence of the oligomerisation domain of COMP is obtained from the Genbank database (accession #1705995) and a region encoding the coiled-coil domain (amino acids 21-85) is selected based on self-association experiments of COMP (Efinov et al., FEBS Letters 341:54-58 (1994)). A biotin acceptor sequence 'BP': SLNDIFEAQKIEWHE [SEQ ID NO: 6] is incorporated at the C terminus and an additional 14 amino acid linker, PQPQPKPQPKPEPET [SEQ ID NO:7] is included to provide a physical separation between the COMP oligomerising domain and BP.

The whole region is synthesized using the overlapping complementary oligonucleotides, and purified COMP-BP and 1 .mu·g pETBMC01 vector are digested for 4 hrs at 37.degree. C. using Hind III (10 U) and Xho I (10 U) restriction enzymes (NEB), as described in Section 1.1. The digestion products are purified, ligated, transformed and PCR screened as in Section 1.1. Plasmids positive from the screen are purified and sequenced as described in Section 1.1.

The poly-glycine linker is synthesized by annealing overlapping oligonucleotides. Since the nucleotide sequence of the polyGlycine linker only incorporates the 5' overhang of the cut BamH I restriction site, and the 3' overhang of the cut Hind III nucleotide recognition motifs, there is no need to digest the annealed product to produce the complementary single-stranded overhangs suitable for subsequent ligation. The oligonucleotides are phosphorylated and annealed as described in Section 1.2.

pETBMC02 is digested with BamH I (10 U) and Hind III (10 U). Ligation of the annealed poly-glycine linker into pETBMC02 was as described previously (Section 1.1), assuming 96 fmoles of annealed oligonucleotide/.mu·l. The transformation and PCR-screening reactions are as described in Section 1.1, but in addition, the presence of an inserted linker is verified by a restriction enzyme digestion of the PCR screen product to ascertain the presence or absence of a Sal I restriction site. Successful transformants are not susceptible to Sal I digestion, given the removal of the site from the plasmid vector backbone. Purification of pETBMC03 and automated sequencing is as described in Section 1.1.

Analysis of X-ray crystallography models of MHC class I molecules reveal that the C terminus of .beta.2m closely abuts the .alpha.3 domain of the .alpha. chain. It is therefore desirable to achieve maximum flexibility at the start of the poly-glycine linker.

The extracellular portion of HLA-A*0201 .alpha. chain (EMBL M84379) comprises of 276 amino acids (equivalent to Gly1-Pro276 of the mature protein) encoded by bases 73-900 of the messenger RNA sequence. This region of the A*0201 sequence is amplified from a normal human lymphocyte cDNA library by PCR, using the primers A25#1 [SEQ ID NO: 20] and A25#2 [SEQ ID NO: 21] which incorporated NcoI and BamHI restriction sites respectively. The procedure for cloning the A*0201 insert into Nco I/BamH I-digested pET-11d vector (Novagen) is essentially as described for .beta.2m in Section 1.1.

An identical procedure is carried out to produce either .beta.2m-COMP or A*0201 .alpha. chain proteins. Plasmid DNA is transformed into an E. coli expression host strain in preparation for a large scale bacterial prep. Protein is produced as insoluble inclusion bodies within the bacterial cells, and is recovered by sonication. Purified inclusion bodies are solubilised in denaturing buffer and stored at −80.degree. C. until required.

Purified plasmid DNA is transformed into the BL21(DE3) pLysS E. coli strain, which carries a chromosomal copy of the T7 RNA polymerase required to drive protein expression from pET-based constructs. Transformations into BL21 (DE3)pLysS competent cells (Stratagene) are carried out with appropriate controls.

A single bacterial transformant colony is innoculated into 60 ml sterile LB medium, containing appropriate antibiotics for selection, and left to stand overnight in a warm room (.about.24.degree. C.) The resulting overnight culture is added to 6 litres of LB and grown at 37.degree. C. with shaking (.about.240 rpm), up to mid-log phase (OD-.sub.600=0.3-0.4). Protein expression is induced at this stage by addition of 1.0 ml of 1M IPTG to each flask. The cultures are left for a further 4 h at 37.degree. C. with shaking, after which the cells are harvested by centrifugation and the supernatant discarded.

The bacterial cell pellet is resuspended in ice-cold balanced salt solution and sonicated (XL series sonicator; Misonix Inc., USA) in a small glass beaker on ice in order to lyse the cells and release the protein inclusion bodies. Once the cells are completely lysed the inclusion bodies are spun down in 50 ml polycarbonate Oak Ridge centrifuge tubes in a Beckman high-speed centrifuge (J2 series) at 15,000 rpm for 10 min. The inclusion bodies are then washed three times in chilled Triton® wash This is followed by a final wash in detergent-free wash buffer.

The resultant purified protein preparation is solubilised in 20-50 ml of 8 M urea buffer, containing 50 mM MES, pH 6.5, 0.1 mM EDTA and 1 mM DTT, and left on an end-over-end rotator overnight at 4.degree. C. Insoluble particles are removed by centrifugation and the protein yield is determined using Bradford's protein assay reagent (Bio-Rad Laboratories) and by comparison with known standards. Urea-solubilised protein is dispensed in 10 mg aliquots and stored at −80.degree. C. for future use.

Assembly of .beta.2m-COMP from the urea-solubilised inclusion bodies is performed by diluting the protein into 20 mM CAPS buffer, pH 11.0, containing 0.2 M sodium chloride and 1 mM EDTA, to give a final protein concentration of 1.5 mg/ml. The protein is oxidised at room temperature by addition of oxidised and reduced glutathione to final concentrations of 20 mM and 2 mM, respectively. Following an overnight incubation, disulphide bond formation is analysed by non-reducing SDS-PAGE on 10% bis-tricine gels (Invitrogen).

The protein mixture is subsequently buffer exchanged into 20 mM Tris, pH 8.0, 50 mM sodium chloride ('S200 buffer'), and concentrated to a final volume of 4.5 ml, in preparation for enzymatic biotinylation with BirA (Affinity, Denver, Colo.). 0.5 ml of 10.times. BirA reaction buffer (as supplied) is added, and recombinant BirA enzyme at 10 .mu·M final concentration, supplemented with 10 mM ATP, pH 7.0. A selection of protease inhibitors is also used to preserve the proteins: 0.2 mM PMSF, 2 .mu·g/ml pepstatin and 2 .mu·g/ml leupeptin. The reaction is left for 4 hours at room temperature.

Biotinylated .beta.2m-COMP is purified by size exclusion chromatography (SEC) on a Superdex®200 HR 26/60 column (Amersham Biosciences), running S200 buffer.

500 ml of refolding buffer is prepared as follows: 100 mM Tris, pH 8.0, 400 mM Larginine hydrochloride, 2 mM EDTA, 5 mM reduced glutathione and 0.5 mM oxidised glutathione, dissolved in deionised water and left stirring at 4.degree. C. 15 mg of lyophilised synthetic peptide GLCTL- VAML (SEQ ID NO 217782) is dissolved in 0.5 ml dimethylsulfoxide and added to the refolding buffer whilst stirring. 50 mg of biotinylated pentameric .beta.2m-COMP and 30 mg of A*0201 .alpha. chain is added sequentially, injected through a 23 gauge hypodermic needle directly into the vigorously-stirred buffer, to ensure adequate dispersion. The refolding mixture is then left stirring gently for 16 hours at 4.degree. C.

The protein refolding mixture is subsequently concentrated from 500 ml to 20 ml using a MiniKros hollow fibre ultrafiltration cartridge (Spectrum Labs, Rancho Dominguez, Calif.) with a 30 kD molecular weight cutoff. Further concentration of the complex from 20 ml to 5 ml is carried out in Centricon Plus-20 centrifugal concentrators (30 kD molecular weight cut-off) according to the manufacturers instructions, followed by buffer exchange into S200 buffer using disposable PD10 desalting columns (Amersham Biosciences), according to the manufacturers instructions. Final volume is 7.5 ml. The concentrated protein refold mixture is first purified by SEC on a Superdex® 200 HR 26/60 gel filtration chromatography column, as in Section 4.2. Fractions containing protein complexes in the region of 310 kD is collected.

Fractions collected from SEC are pooled and subjected to further purification by anion exchange chromatography on a MonoQ® HR 5/5 column (Amersham Biosciences), running a salt gradient from 0-0.5 M sodium chloride in 20 mM Tris over 15 column volumes. The dominant peak is collected. Protein recovery is determined using the Bradford assay.

Since each streptavidin molecule is able to bind up to 4 biotin entities, final labelling with phycoerythrin (PE)-conjugated streptavidin is carried out in a molar ratio of 1:0.8, streptavidin to biotinylated pentamer complex respectively, taking into account the initial biotinylation efficiency measurement made for .beta.2m-COMP in Section 4.2. The total required amount of pentamer complex is subdivided (e.g. into 5 equal amounts) and titrated successively into streptavidin-PE. The concentration of A*0201 pentamer-streptavidin complex is adjusted to 1 mg/ml with phosphate buffered saline (PBS), supplemented with 0.01% azide and 1% BSA.

This resultant fluorescent Pentamer reagent is stored at 4.degree. C.

Example 14

Prediction of MHC Class 1 Peptide Binders for Human Cancer Protein BclX(L) Using Directed Approach This example describes the directed approach, applied to a known protein sequence, the cancer protein BclX(L) encoded by the human genome. The purpose is to predict BclX(L) peptide sequences that binds to MHC class 1 molecules for use in construction of MHC'mers designed to be used for analytical, diagnostic, prognostic, therapeutic and vaccine purposes, through the interaction of the MHC-'mers with human BclX(L) specific T-cells. Prediction is carried out using the known preferences of the 42 HLA class 1 alleles included in the www.cbs.dtu.dk/services/NetMHC/database (FIG. 10).

The result of the prediction software is used to find all strong and weak 8-, 9-, 10- and 11-mer peptide binders of the 42 HLA class 1 alleles. The result can be seen in FIG. 36. The MHC class 1 alleles for whom no binders are predicted are omitted from the list. The listed peptides are ranked according to decreased binding affinity for the individual MHC alleles. Strong binders are defined as binders with an affinity value of less than 50 nM and weak binders with a value of less than 500 nM. Only peptides defined as weak or strong binders are shown.

Example 15

Prediction of MHC Class 2 Peptide Binders for Human Cancer Protein BclX(L) Using Directed Approach This example describes the directed approach, applied to a known protein sequence, the cancer protein BclX(L) encoded by the human genome. The purpose is to predict BclX(L) peptide sequences that binds to MHC class 2 molecules for use in construction of MHC'mers designed to be used for analytical, diagnostic, prognostic, therapeutic and vaccine purposes, through the interaction of the MHC-'mers with human BclX(L) specific T-cells. Prediction is carried out using the known preferences of the 14 HLA class 2 alleles included in the www.cbs.dtu.dk/services/NetMHCII/database (FIG. 10).

The result of the prediction software is used to find all strong and weak 15-mer peptide binders of the 14 HLA class 2 alleles. It also finds the important central nonamer core peptide sequence of each binding peptide. The result can be seen in FIG. 37. The MHC class 2 alleles for whom no binders are predicted are omitted from the list. The listed peptides are ranked according to decreased binding affinity for the individual MHC alleles. Strong binders are defined as binders with an affinity value of less than 50 nM and weak binders with a value of less than 500 nM. Only peptides defined as weak or strong binders are shown.

Example 16

Prediction of MHC Class 1 and 2 *Borrelia afzelii* OspC Peptide Binders

This example describes the prediction of MHC class 1 and 2 *Borrelia afzelii* OspC peptide sequences for use in construction of MHC'mers designed to be used for analytical, diagnostic, prognostic, therapeutic and vaccine purposes, through the interaction of the MHC'mers with *Borrelia afzelii* OspC-specific T-cells. The amino acid sequence of *Borrelia afzelii* OspC protein was found and retrieved from NCBI protein database (www.ncbi.nlm.nih.gov). Prediction of the 8-, 9-, 10-, 11-, 13-, 14-, 15- and 16-mer peptide sequences are carried out using the peptide generation software program described in FIG. 2. The outcome is shown in table A.

Example 17

Prediction of MHC Class 1 *Borrelia burgdorferi* OspA Peptide Binders

This example describes the directed approach, applied to a known protein sequence, the *Borrelia burgdorferi* protein OspA encoded by the *Borrelia* genome. The purpose was to predict OspA peptide sequences that binds to MHC class 1 molecules for use in construction of MHC'mers designed to be used for analytical, diagnostic, prognostic, therapeutic and vaccine purposes, through the interaction of the MHC-'mers with human OspA specific T-cells. The amino acid sequence of *Borrelia burgdorferi* OspA protein was found and retrieved from NCBI protein database (www.ncbi.nlm.nih.gov) Prediction was carried out using the known preferences of the 42 HLA class 1 alleles included in the www.cbs.dtu.dk/services/NetMHC/database (FIG. 10).

The result of the prediction software was used to find all strong and weak 8-, 9-, 10- and 11-mer peptide binders of the 42 HLA class 1 alleles. The result can be seen in table B. The MHC class 1 alleles for whom no binders are predicted are omitted from the list. The listed peptides are ranked according to decreased binding affinity for the individual MHC alleles. Strong binders are defined as binders with an affinity value of less than 50 nM and weak binders with a value of less than 500 nM. Only peptides defined as weak or strong binders are shown.

Example 18

Prediction of MHC Class 1 *Borrelia garinii* FlaB Peptide Binders

This example describes the directed approach, applied to a known protein sequence, the *Borrelia garinii* protein FlaB encoded by the *Borrelia* genome. The purpose was to predict FlaB peptide sequences that binds to MHC class 1 molecules for use in construction of MHC'mers designed to be used for analytical, diagnostic, prognostic, therapeutic and vaccine purposes, through the interaction of the MHC'mers with human FlaB specific T-cells. The amino acid sequence of *Borrelia burgdorferi* OspA protein was found and retrieved from NCBI protein database (www.ncbi.nlm.nih.gov). Prediction was carried out using the known preferences of the 42 HLA class 1 alleles included in the www.cbs.dtu.dk/ services/NetMHC/database (FIG. 10).

The result of the prediction software was used to find all strong and weak 8-, 9-, 10- and 11-mer peptide binders of the 42 HLA class 1 alleles. The result can be seen in table C. The MHC class 1 alleles for whom no binders are predicted are omitted from the list. The listed peptides are ranked according to decreased binding affinity for the individual MHC alleles. Strong binders are defined as binders with an affinity value of less than 50 nM and weak binders with a value of less than 500 nM. Only peptides defined as weak or strong binders are shown.

Example 19

Test of Predicted BclX(L) 10-Mer Binding Peptide Functionality in ELISPOT

In example 14 the best binding BclX(L) 10-mer peptide for HLA-A*0201 was identified to be YLNDHLEPWI. This peptide has then been tested in ELISPOT to see if it were able to detect the presence Bcl-X(L)-specific, CD8 positive T cells in PBL (Peripheral Blood Lymphocytes) from a breast cancer patient. PBL from a breast cancer patient was analyzed by ELISPOT ex vivo either with or without the Bcl-X(L)173-182 peptide (YLNDHLEPWII), 106 PBL/well in doublets. The number of spots was counted using the Immunospot Series 2.0 Analyzer (CTL Analysers). The result is given as number of spots above the pictures of the result as shown in FIG. 11 and it clearly shows the presence of BclX(L) specific T-cells and thereby the functionality of the peptide as compared to the absence of added peptide.

This example is from Cancer Immunol Immunother April; 56(4)527-33.

Example 20

Test of Predicted BclX(L) 10-Mer Binding Peptide Functionality in Flow Cytometry In example 14 the best binding BclX(L) 10-mer peptide for HLA-A*0201 was identified to be YLNDHLEPWI. In the present example the functionality of the peptide is shown in a flow cytometric analysis of PBL from the patient was analyzed ex vivo by Flow cytometry to identify Bcl-X(L) 173-182 specific CD8 T cells using the dextramer complex HLA-A2/Bcl-X(L)173-182-APC, 7-AAD-PerCP, CD3-FITC, and CD8-APC-Cy7. The dextramer complex HLA-A2/HIV-1 pol476-484-APC was used as negative control. The result (FIG. 12) clearly demonstrate that a MHC Dextramer HLA-A*0201/YLNRHLHTWI complex detects BclX(L) antigen-specific CD-8 cells in the patient sample at a level of 0.03% as compared with the negative control using HIV specific MHC Dextramer.

This example is from Cancer Immunol Immunother April; 56(4)527-33.

Example 21

Use of BclX(L) Specific MHC Dextramer for Sorting of Antigen-Specific CD8 T Cells from Patient Sample The antigen-specific CD8 positive T-cells of example 20 were sorted out during the flow cytometric analysis using the MHC Dextramer HLA-A*0201/YLNDHLEPWI. The detectable population of dextramer positive CD8 T cells was sorted as single cells into 96 well plates using the following protocol:

Small lymphocytes were gated by forward and side scatter profile, before cloning according to CD8/MHC-multimer double staining. CD8/MHC-multimer double-positive cells were sorted as single cells into 96 well plates (Nunc) already containing $10^5$ cloning mix cells/well. The cloning mix was prepared containing $10^6$ irradiated (20 Gy) lymphocytes from three healthy donors per ml in X-vivo with 5% heat-inactivated human serum, 25 mM HEPES buffer (GibcoBRL), 1 μg/ml phytohemagglutinin (PHA) (Peprotech) and 120 U/ml IL-2. The cloning mix was incubated for two hours at 37° C./5% $CO_2$, prior to cloning. After cloning, the plates were incubated at 37° C./5% $CO_2$. Every 3-4 days 50 μl fresh media were added containing IL-2 to a final concentration of 120 U/ml. Following 10-14 days of incubation, growing clones were further expanded using cloning mix cells. Consequently, each of the growing clones were transferred (split) into two or three wells (depending on the number of growing cells) of a new 96 well plate containing $5\times10^4$ cloning mix cells/well. Clones that were not growing at this time were incubated for another week with IL-2, and then expanded. Subsequently, the specificity of the growing clones was tested in a $^{51}$Cr-release assay or by FACS.

Out of twenty isolated dextramer positive CD8 T cells, ten were able to be expanded into T-cell clones.

This example is from Cancer Immunol Immunother April; 56(4)527-33.

Example 22

Demonstration of Specific Cytolytic Activity of Isolated BclX(L) Specific CD8 T-Cells.

This is an example of a CTL killing assay.

The ten expanded T cell clones isolated by Flow sorting as shown in example 21 were tested for their specificity by analysis in a standard 51-Cr release assay. For this purpose, T2 cells loaded with either Bcl-X(L)173-182 peptide or an irrelevant peptide (BA4697-105, GLQHWVPEL (SEQ ID NO 217777)) were used as target cells. Five CD8 T-cell clones (Clone 8, 9, 10, 11, and 12) effectively lysed T2 cells pulsed with Bcl-X(L)173-182 without killing of T2 cells pulsed with an irrelevant peptide (FIG. 13). One of these BclX(L)173-182 specific CD8 T-cell clones [Clone 9] were expanded for further analyses. The remaining five expanded clones (Clone 7, 13, 15, 17, and 18) did not show specific lysis against T2 cells pulsed with Bcl-X(L)173-182 peptide (FIG. 13).

This example is from Cancer Immunol Immunother April; 56(4)527-33.

Example 23

Demonstration of the Cytotoxic Capacity of a BclX(L) 173-182 Specific CD8 T Cell Clone Isolated by Flow Aided Sorting of Antigen (HLA-A*0201/YLNRHLHTWI) Specific T Cells.

The Bcl-X(L)173-182 specific clone 9 from example 22 was expanded for additional 2 weeks before the cytotoxic potential was examined further in 51Cr-release assays. Two assays were performed a Cell lysis of T2 cells pulsed with Bcl-X(L)173-182 peptide or an irrelevant peptide (BA4697-105, GLQHWVPEL (SEQ ID NO 217777)) in three E:T ratios. b Cell lysis of T2 cells pulsed with different concentrations of Bcl-X(L)173-182 peptide at the E:T ratio 1:1 The result is given in FIG. 14. As can be seen the presence of the specific peptide is necessary to get killing of the target cell and the effect of the peptide is significant even at low concentrations.

This example is from Cancer Immunol Immunother April; 56(4)527-33.

Example 24

Synthesis of a Comprehensive Library of Antigenic Peptides of Variable Size Derived from a Full-Length Antigen Sequence.

In this example it is described how virtually all of the possible 8'- to 20'-mer peptide epitopes of an antigen may be synthetically prepared by modification of the standard Fmoc peptide synthesis protocol.

N-(-amino acids are incorporated into a peptide of the desired sequence with one end of the sequence remaining attached to a solid support matrix. All soluble reagents can be removed from the peptide-solid support matrix by filtration and washed away at the end of each coupling step. After each of the coupling steps, and after the removal of reagents, a fraction of the generated peptides are removed and recovered from the polymeric support by cleavage of the cleavable linker that links the growing peptide to solid support.

The solid support can be a synthetic polymer that bears reactive groups such as —OH. These groups are made so that they can react easily with the carboxyl group of an N-(-protected amino acid, thereby covalently binding it to the polymer. The amino protecting group can then be removed and a second N-(-protected amino acid can be coupled to the attached amino acid. These steps are repeated until the desired sequence is obtained. At the end of the synthesis, a different reagent is applied to cleave the bond between the C-terminal amino acid and the polymer support; the peptide then goes into solution and can be obtained from the solution.

Initially, the first Fmoc amino acid (starting at the C-terminal end of the antigen sequence) is coupled to a precursor molecule on an insoluble support resin via an acid labile linker. Deprotection of Fmoc is accomplished by treatment of the amino acid with a base, usually piperidine. Before coupling the next amino acid, a fraction of the synthesized peptide (for example 0.1%) is detached from the solid support, and recovered. Then additional beads carrying only the precursor molecule including the linker (for example corresponding to 0.1% of the total amount of solid support in the reaction) is added. Then the next Fmoc amino acid is coupled utilizing a pre-activated species or in situ activation.

This cycle of amino acid coupling, removal of reagents, detachment of a small fraction of synthesized peptide and recovery of these, and activation of the immobilized peptide to prepare for the next round of coupling, goes on until the entire antigen sequence has been processed.

The recovered peptides thus represent different fragments of the antigen, with varying lengths. The peptide pool thus contains most or all of the possible peptide epitopes of the antigen, and may be used in the preparation of MHC multimers as a pool.

The entire process, including the detachment of a fraction of the peptides after each round of coupling, follows standard Fmoc peptide synthesis protocols, and involves weak acids such as TFA or TMSBr, typical scavengers such as thiol compounds, phenol and water, and involves standard protecting groups.

Example 25

This is an example of how MHC multimers may be used for diagnosis of Lyme Disease in blood samples from humans infected with *Borrelia* bacteria.

In this example the MHC multimer used are MHC complexes coupled to fluorophor-labelled dextran (Dextramers). The dextramers are used for direct detection of TCR in flow Cytometry. The antigen origin is *Borrelia*, thus, immune monitoring of a *Borrelia* infection.

Lyme disease is caused by infection by *Borrelia* bacteria. During acute infection *Borrelia* specific activated T cells will be present in increased amounts in an activated state compared to healthy individuals. The presences of an increased amount of activated *Borrelia* specific T cells may thereby act as a surrogate marker for infection with *Borrelia* bacterium. MHC multimers carrying *Borrelia* specific antigenic peptides is in this example used to detect the presence of *Borrelia* specific T cells in the blood of patients infected with *Borrelia*.

Purified MHC-peptide complexes consisting of HLA-A*0201 heavy chain, human beta2microglobulin and peptide derived from regions in Outer surface protein A (Table B) or Flagellin B (Table C) conserved among the three species *Borrelia burgdorferi*, *Borrelia garinii* and *Borrelia afzelii* or a negative control peptide are generated by in vitro refolding, purified and biotinylated as described elsewhere herein. Biotinylated MHC-peptide complexes are then coupled to a 270 kDa dextran multimerization domain labelled with APC by interaction with streptavidin (SA) on the dextran multimerization domain. The dextran-APC-SA multimerization domain is generated as described elsewhere herein. MHC-peptide complexes are added in an amount corresponding to a ratio of three MHC-peptide molecules per SA molecule and each molecule dextran contains 3.7 SA molecule and 8.95 molecules APC. The final concentration of dextran is 3.8×10e-8 M. The following MHC(peptide)/APC dextran constructs are made:

1. APC-SA conjugated 270 kDa dextran coupled with HLA-A*0201 in complex with beta2microglobulin and the peptide ALIACKQNV derived from OspA.
2. APC-SA conjugated 270 kDa dextran coupled with HLA-A*0201 in complex with beta2microglobulin and the peptide FTKEDTIT derived from OspA.
3. APC-SA conjugated 270 kDa dextran coupled with HLA-A*0201 in complex with beta2microglobulin and the peptide SIQIEIEQL derived from Fla B 4. APC-SA conjugated 270 kDa dextran coupled with HLA-A*0201 in complex with beta2microglobulin and the peptide NLNEVEKVL derived from Fla B
5. APC-SA conjugated 270 kDa dextran coupled with HLA-A*0201 in complex with beta2microglobulin and the peptide SLAKIENAI derived from Fla B
6. APC-SA conjugated 270 kDa dextran coupled with HLA-A*0201 in complex with beta2microglobulin and the non-sense peptide GLAGDVSAV (SEQ ID NO 217778).

The binding of the above described MHC(peptide)/APC dextran is used to determine the presence of Osp A or Fla B specific T cells in the blood from *Borrelia* infected individuals by flow cytometry following a standard flow cytometry protocol. Blood from a patient with Lyme disease is isolated and 100 ul of this blood is incubated with 10 µl of each of the MHC(peptide)/APC dextran constructs described above for 10 minutes in the dark at room temperature. 5 µl of each of each of the antibodies mouse-anti-human CD3/PB (clone UCHT1 from Dako), mouse-anti-human CD4/FITC (clone MT310 from Dako) and mouse-anti-human CD8/PE (clone DK25 from Dako) are added and the incubation continues for another 20 minutes at 4° C. in the dark. The samples are then washed by adding 2 ml PBS; pH=7.2 followed by centrifugation for 5 minutes at 300×g and the supernatant removed. The washing step is repeated twice. The washed cells are resuspended in 400-500 µl PBS+1% BSA; pH=7.2 and analyzed on flowcytometer.

The presence of cells labeled with anti-CD3/PB, anti-CD8/PE and the MHC(peptide)/APC dextran constructs 1, 2, 3, 4 and 5 described above and thereby the presence of *Borrelia* specific T cells indicate that the patient are infected with *Borrelia* bacteria. Blood analysed with MHC(peptide)/APC dextran construct 6 show no staining of CD3 and CD8 positive cells with this MHC(peptide)/APC dextran construct. The result is shown in FIG. 15.

The sensitivity of the above described diagnostic test may be enhanced by addition of labeled antibodies specific for activation markers expressed in or on the surface of the *Borrelia* specific T cells.

We conclude that the MHC(peptide)/APC dextran constructs can be used to detect the presence of *Borrelia* specific T cells in the blood of patients infected with *Borrelia*.

Example 26

This is an example of how MHC multimers may be used for diagnosis of Lyme Disease in blood samples from humans infected with *Borrelia* bacteria.

In this example the MHC multimer used are MHC complexes coupled to the fluorophor-labelled multimerisation domain Streptavidin (SA), used for direct detection of TCR in flow Cytometry. The antigen origin is *Borrelia*, thus, immune monitoring of a *Borrelia* infection.

Lyme disease is caused by infection by *Borrelia* bacteria. During acute infection *Borrelia* specific activated T cells will be present in increased amounts in an activated state compared to healthy individuals. The presences of an increased amount of activated *Borrelia* specific T cells may thereby act as a surrogate marker for infection with *Borrelia* bacterium. MHC multimers carrying *Borrelia* specific antigenic peptides is in this example used to detect the presence of *Borrelia* specific T cells in the blood of patients infected with *Borrelia*.

Purified MHC-peptide complexes consisting of HLA-A*0201 heavy chain, human beta2microglobulin and peptide derived from regions in Outer surface protein A (Table B) or Flagellin B (Table C) conserved among the three species *Borrelia burgdorferi*, *Borrelia garinii* and *Borrelia afzelii* or a negative control peptide were generated by in vitro refolding, purified and biotinylated as described elsewhere herein. Biotinylated MHC-peptide complexes are then coupled SA labelled with APC. MHC-peptide complexes were added in an amount corresponding to a ratio of 5 MHC-peptide molecules per SA molecule. Then SA/APC carrying four MHC complexes were purified from free SA, free monomeric MHC complex, SA carrying three, two and one MHC complexes.

The following SA-MHC(peptide)/APC tetramers are made:
7. APC-SA coupled with HLA-A*0201 in complex with beta2microglobulin and the peptide ALIACKQNV derived from OspA.
8. APC-SA coupled with HLA-A*0201 in complex with beta2microglobulin and the peptide FTKEDTIT derived from OspA.
9. APC-SA coupled with HLA-A*0201 in complex with beta2microglobulin and the peptide SIQIEIEQL derived from Fla B.
10. APC-SA coupled with HLA-A*0201 in complex with beta2microglobulin and the peptide NLNEVEKVL derived from Fla B.
11. APC-SA coupled with HLA-A*0201 in complex with beta2microglobulin and the peptide SLAKIENAI derived from Fla B.
12. APC-SA coupled with HLA-A*0201 in complex with beta2microglobulin and the non-sense peptide GLAGDVSAV (SEQ ID NO 217778).

The binding of the above described MHC(peptide)/APC dextran can be used to determine the presence of Osp A or Fla B specific T cells in the blood from *Borrelia* infected individuals by flow cytometry following a standard flow cytometry protocol. Blood from a patient with Lyme disease is isolated and 100 ul of this blood is incubated with either of the four SA-MHC(peptide)/APC tetramers described above for 10 minutes in the dark at room temperature. 5 µl of each of each of the antibodies mouse-anti-human CD3/PB (clone UCHT1 from Dako) and mouse-anti-human CD8/PE (clone DK25 from Dako) are added and the incubation continued for another 20 minutes at 4° C. in the dark. The samples are then washed by adding 2 ml PBS; pH=7.2 followed by centrifugation for 5 minutes at 200×g and the supernatant removed. The washing step is repeated. The washed cells are resuspended in 400-500 µl PBS; pH=7.2 and analyzed on flowcytometer.

The presence of cells labeled with anti-CD3/PB, anti-CD8/PE and either of the SA-MHC(peptide)/APC tetramers 7, 8, 9, 10 or 11 described above and thereby the presence of *Borrelia* specific T cells will indicate that the patient are infected with *Borrelia* bacteria. Blood analysed with SA-MHC(peptide)/APC tetramers 12 should show no staining of CD3 and CD8 positive cells with this SA-MHC(peptide)/APC tetramer.

The sensitivity of the above described diagnostic test may be enhanced by addition of labeled antibodies specific for activation markers expressed in or on the surface of the *Borrelia* specific T cells.

We conclude that the APC-SA coupled MHC(peptide) constructs may be used to detect the presence of *Borrelia* specific T cells in the blood of patients infected with *Borrelia*.

Example 27

This is an example of how MHC multimers may be used for diagnosis of Lyme Disease in blood samples from humans infected with *Borrelia* bacteria.

In this example the MHC multimer used are MHC complexes coupled to any fluorophor-labelled multimerisation as described elsewhere herein. The MHC multimers are used for direct detection of TCR in flow cytometry. The antigen origin is *Borrelia*, thus, immune monitoring of a *Borrelia* infection.

Lyme disease is caused by infection by *Borrelia* bacteria. During acute infection *Borrelia* specific activated T cells will be present in increased amounts in an activated state compared to healthy individuals. The presences of an increased amount of activated *Borrelia* specific T cells may thereby act as a surrogate marker for infection with *Borrelia* bacterium. MHC multimers carrying *Borrelia* specific antigenic peptides is in this example used to detect the presence of *Borrelia* specific T cells in the blood of patients infected with *Borrelia*.

Purified MHC-peptide complexes consisting of HLA-A*0201 heavy chain, human beta2microglobulin and peptide derived from regions in Outer surface protein A (Table B) or Flagellin B (Table C) conserved among the three species *Borrelia burgdorferi*, *Borrelia garinii* and *Borrelia afzelii* or a negative control peptide were generated by in vitro refolding and purified or purified from antigen presenting cells. MHC-peptide complexes are then coupled to a multimerisation domain together with APC.

The following MHC(peptide)/APC multimers are made:
13. APC-multimerisation domain coupled with HLA-A*0201 in complex with beta2microglobulin and the peptide ALIACKQNV derived from OspA.
14. APC-multimerisation domain coupled coupled with HLA-A*0201 in complex with beta2microglobulin and the peptide FTKEDTIT derived from OspA.
15. APC-multimerisation domain coupled coupled with HLA-A*0201 in complex with beta2microglobulin and the peptide SIQIEIEQL derived from Fla B.
16. APC-multimerisation domain coupled coupled with HLA-A*0201 in complex with beta2microglobulin and the peptide NLNEVEKVL derived from Fla B.
17. APC-multimerisation domain coupled coupled with HLA-A*0201 in complex with beta2microglobulin and the peptide SLAKIENAI derived from Fla B.
18. APC-multimerisation domain coupled with HLA-A*0201 in complex with beta2microglobulin and the non-sense peptide GLAGDVSAV (SEQ ID NO 217778).

The binding of the above described MHC(peptide)/APC multimers can be used to determine the presence of Osp A or Fla B specific T cells in the blood from *Borrelia* infected individuals by flow cytometry following a standard flow cytometry protocol. Blood from a patient with Lyme disease is isolated and 100 ul of this blood is incubated with either of the four MHC(peptide)/APC multimers described above for 10 minutes in the dark at room temperature. 5 µl of each of each of the antibodies mouse-anti-human CD3/PB (clone UCHT1 from Dako) and mouse-anti-human CD8/PE (clone DK25 from Dako) are added and the incubation continued for another 20 minutes at 4° C. in the dark. The samples are then washed by adding 2 ml PBS; pH=7.2 followed by centrifugation for 5 minutes at 200×g and the supernatant removed. The washing step is repeated. The washed cells are resuspended in 400-500 µl PBS; pH=7.2 and analyzed on flowcytometer.

The presence of cells labeled with anti-CD3/PB, anti-CD8/PE and either of the MHC(peptide)/APC multimers 13, 14, 15, 16 or 17 described above and thereby the presence of *Borrelia* specific T cells will indicate that the patient are infected with *Borrelia* bacteria. Blood analysed with MHC (peptide)/APC multimer 18 should show no staining of CD3 and CD8 positive cells with this SA-MHC(peptide)/APC multimer.

The sensitivity of the above described diagnostic test may be enhanced by addition of labeled antibodies specific for activation markers expressed in or on the surface of the *Borrelia* specific T cells.

We conclude that the APC-multimerisation domain coupled MHC(peptide) constructs may be used to detect the presence of *Borrelia* specific T cells in the blood of patients infected with *Borrelia*.

Example 28

This is an example of how MHC multimers may be used for diagnosis of Lyme Disease in blood samples from humans infected with *Borrelia* bacteria.

In this example the MHC multimer used are MHC complexes coupled to fluorophor-labelled dextran (Dextramers). The dextramers are used for direct detection of TCR in flow Cytometry. The antigen origin is *Borrelia*, thus, immune monitoring of a *Borrelia* infection.

Lyme disease is caused by infection by *Borrelia* bacteria. During acute infection *Borrelia* specific activated T cells will be present in increased amounts in an activated state compared to healthy individuals. The presences of an increased amount of activated *Borrelia* specific T cells may thereby act as a surrogate marker for infection with *Borrelia* bacterium. MHC multimers carrying *Borrelia* specific antigenic peptides is in this example used to detect the presence of *Borrelia* specific T cells in the blood of patients infected with *Borrelia*.

Purified MHC-peptide complexes consisting of HLA-A*0301 heavy chain, human beta2microglobulin and peptide derived from regions in Outer surface protein C (Table A) conserved among the three species *Borrelia burgdorferi*, *Borrelia garinii* and *Borrelia afzelii* or a negative control peptide were generated by in vitro refolding, purified and biotinylated as described elsewhere herein. Biotinylated MHC-peptide complexes were then coupled to a 270 kDa dextran multimerization domain labelled with APC by interaction with streptavidin (SA) on the dextran multimerization domain. The dextran-APC-SA multimerization domain was generated as described elsewhere herein. MHC-peptide complexes were added in an amount corresponding to a ratio of three MHC-peptide molecules per SA molecule and each molecule dextran contained 3.7 SA molecule and 8.95 molecules APC. The final concentration of dextran was 3.8×10e-8 M. The following MHC(peptide)/APC dextran constructs were made:
19. APC-SA conjugated 270 kDa dextran coupled with HLA-A*0301 in complex with beta2microglobulin and the peptide TLITEKLSK derived from OspC.
20. APC-SA conjugated 270 kDa dextran coupled with HLA-A*0301 in complex with beta2microglobulin and the peptide ELANKAIGK derived from OspC.
21. APC-SA conjugated 270 kDa dextran coupled with HLA-A*0301 in complex with beta2microglobulin and the HIV peptide QVPLRPMTYK.

The binding of the above described MHC(peptide)/APC dextran can be used to determine the presence of Osp C specific T cells in the blood from *Borrelia* infected individuals by flow cytometry following a standard flow cytometry protocol.

Blood from a patient with Lyme disease is isolated and 100 ul of this blood is incubated with 10 μl of one of the MHC(peptide)/APC dextran constructs described above for 10 minutes in the dark at room temperature. 5 μl of each of each of the antibodies mouse-anti-human CD3/PB (clone UCHT1 from Dako) and mouse-anti-human CD8/PE (clone DK25 from Dako) are added and the incubation continued for another 20 minutes at 4° C. in the dark. The samples are then washed by adding 2 ml PBS; pH=7.2 followed by centrifugation for 5 minutes at 200×g and the supernatant removed. The washing step is repeated. The washed cells are resuspended in 400-500 μl PBS; pH=7.2 and analyzed on flowcytometer.

The presence of cells labeled with anti-CD3/PB, anti-CD8/PE and either of the MHC(peptide)/APC dextran constructs 19 or 20 described above and thereby the presence of *Borrelia* specific T cells will indicate that the patient are infected with *Borrelia* bacteria. Blood analysed with MHC (peptide)/APC dextran construct 21 should show no staining of CD3 and CD8 positive cells with this MHC(peptide)/APC dextran construct.

The sensitivity of the above described diagnostic test may be enhanced by addition of labeled antibodies specific for activation markers expressed in or on the surface of the *Borrelia* specific T cells.

We conclude that the APC-SA conjugated 270 kDa dextran coupled MHC(peptide) constructs may be used to detect the presence of *Borrelia* specific T cells in the blood of patients infected with *Borrelia*.

Example 29

This is an example of how MHC multimers may be used for diagnosis of Lyme Disease in blood samples from humans infected with *Borrelia* bacteria.

In this example the MHC multimer used are MHC complexes coupled to the fluorophor-labelled multimerisation domain Streptavidin (SA), used for direct detection of TCR in flow Cytometry. The antigen origin is *Borrelia*, thus, immune monitoring of a *Borrelia* infection.

Lyme disease is caused by infection by *Borrelia* bacteria. During acute infection *Borrelia* specific activated T cells will be present in increased amounts in an activated state compared to healthy individuals. The presences of an increased amount of activated *Borrelia* specific T cells may thereby act as a surrogate marker for infection with *Borrelia* bacterium. MHC multimers carrying *Borrelia* specific antigenic peptides is in this example used to detect the presence of *Borrelia* specific T cells in the blood of patients infected with *Borrelia*.

Purified MHC-peptide complexes consisting of HLA-A*0301 heavy chain, human beta2microglobulin and peptide derived from regions in Outer surface protein C (Table A) conserved among the three species *Borrelia burgdorferi*, *Borrelia garinii* and *Borrelia afzelii* or a negative control peptide were generated by in vitro refolding, purified and biotinylated as described elsewhere herein. Biotinylated MHC-peptide complexes are then coupled SA labelled with APC. MHC-peptide complexes were added in an amount corresponding to a ratio of 5 MHC-peptide molecules per SA molecule. Then SA/APC carrying four MHC complexes were purified from free SA, free monomeric MHC complex, SA carrying three, two and one MHC complexes.

The following SA-MHC(peptide)/APC tetramers are made:
22. APC-SA coupled with HLA-A*0301 in complex with beta2microglobulin and the peptide TLITEKLSK derived from OspC.
23. APC-SA coupled with HLA-A*0301 in complex with beta2microglobulin and the peptide ELANKAIGK derived from OspC.
24. APC-SA coupled with HLA-A*0201 in complex with beta2microglobulin and the HIV peptide QVPLRPMTYK.

The binding of the above described MHC(peptide)/APC dextran can be used to determine the presence of Osp C specific T cells in the blood from *Borrelia* infected individuals by flow cytometry following a standard flow cytometry protocol.

Blood from a patient with Lyme disease is isolated and 100 ul of this blood is incubated with either of the four SA-MHC(peptide)/APC tetramers described above for 10 minutes in the dark at room temperature. 5 μl of each of each of the antibodies mouse-anti-human CD3/PB (clone UCHT1 from Dako) and mouse-anti-human CD8/PE (clone DK25 from Dako) are added and the incubation continued for another 20 minutes at 4° C. in the dark. The samples are then washed by adding 2 ml PBS; pH=7.2 followed by centrifugation for 5 minutes at 200×g and the supernatant removed. The washing step is repeated. The washed cells are resuspended in 400-500 μl PBS; pH=7.2 and analyzed on flowcytometer.

The presence of cells labeled with anti-CD3/PB, anti-CD8/PE and either of the SA-MHC(peptide)/APC tetramers 22 or 23 described above and thereby the presence of *Borrelia* specific T cells will indicate that the patient are infected with *Borrelia* bacteria. Blood analysed with SA-MHC(peptide)/APC tetramers 24 should show no staining of CD3 and CD8 positive cells with this SA-MHC(peptide)/APC tetramer.

The sensitivity of the above described diagnostic test may be enhanced by addition of labeled antibodies specific for activation markers expressed in or on the surface of the *Borrelia* specific T cells.

We conclude that the APC-SA coupled MHC(peptide) constructs may be used to detect the presence of *Borrelia* specific T cells in the blood of patients infected with *Borrelia*.

Example 30

This is an example of how MHC multimers may be used for diagnosis of Lyme Disease in blood samples from humans infected with *Borrelia* bacteria.

In this example the MHC multimer used are MHC complexes coupled to any fluorophor-labelled multimerisation as described elsewhere herein. The MHC multimers are used for direct detection of TCR in flow cytometry. The antigen origin is *Borrelia*, thus, immune monitoring of a *Borrelia* infection.

Lyme disease is caused by infection by *Borrelia* bacteria. During acute infection *Borrelia* specific activated T cells will be present in increased amounts in an activated state compared to healthy individuals. The presences of an increased amount of activated *Borrelia* specific T cells may thereby act as a surrogate marker for infection with *Borrelia* bacterium. MHC multimers carrying *Borrelia* specific antigenic peptides is in this example used to detect the presence of *Borrelia* specific T cells in the blood of patients infected with *Borrelia*.

Purified MHC-peptide complexes consisting of HLA-A*0201 heavy chain, human beta2microglobulin and peptide derived from regions in Outer surface protein C (Table A) conserved among the three species *Borrelia burgdorferi*, *Borrelia garinii* and *Borrelia afzelii* or a negative control peptide were generated by in vitro refolding and purified or purified from antigen presenting cells. MHC-peptide complexes are then coupled to a multimerisation domain together with APC.

The following MHC(peptide)/APC multimers are made:
25. APC-multimerisation domain coupled with HLA-A*0201 in complex with beta2microglobulin and the peptide TLITEKLSK derived from OspC.
26. APC-multimerisation domain coupled with HLA-A*0201 in complex with beta2microglobulin and the peptide ELANKAIG derived from OspC.
27. APC-multimerisation domain coupled with HLA-A*0201 in complex with beta2microglobulin and the HIV peptide QVPLRPMTYK.

The binding of the above described MHC(peptide)/APC multimers can be used to determine the presence of Osp C specific T cells in the blood from *Borrelia* infected individuals by flow cytometry following a standard flow cytometry protocol. Blood from a patient with Lyme disease is isolated and 100 ul of this blood is incubated with either of the four MHC(peptide)/APC multimers described above for 10 minutes in the dark at room temperature. 5 μl of each of each of the antibodies mouse-anti-human CD3/PB (clone UCHT1 from Dako) and mouse-anti-human CD8/PE (clone DK25 from Dako) are added and the incubation continued for another 20 minutes at 4° C. in the dark. The samples are then washed by adding 2 ml PBS; pH=7.2 followed by centrifugation for 5 minutes at 200×g and the supernatant removed. The washing step is repeated. The washed cells are resuspended in 400-500 μl PBS; pH=7.2 and analyzed on flowcytometer.

The presence of cells labeled with anti-CD3/PB, anti-CD8/PE and either of the MHC(peptide)/APC multimers 25 or 26 described above and thereby the presence of *Borrelia* specific T cells will indicate that the patient are infected with *Borrelia* bacteria. Blood analysed with MHC(peptide)/APC multimer 27 should show no staining of CD3 and CD8 positive cells with this SA-MHC(peptide)/APC multimer.

The sensitivity of the above described diagnostic test may be enhanced by addition of labeled antibodies specific for activation markers expressed in or on the surface of the *Borrelia* specific T cells.

We conclude that the APC-multimerisation domain coupled MHC(peptide) constructs may be used to detect the presence of *Borrelia* specific T cells in the blood of patients infected with *Borrelia.*

Example 31

This is an example of measurement of antigen reactive T-Cells by IFN-γ capture in blood samples by ELISPOT.

This is an example of indirect detection of TCR, where individual cells are immobilized and measured by a chromogen assay.

The example provides a sensitive assay for the detection of T-cells reactive to an antigen by detecting a soluble factor whose secretion is induced by stimulation of the T-cell by the antigen.

A summary flow chart of the method is shown in FIG. 35. In brief, peripheral blood is diluted threefold in Dulbecco's phosphate buffered saline (DPBS), underlain with 15 ml of Ficoll (Pharmacia Ficoll-Paque #17-0840-02, Piscataway, N.J.) per 40 ml diluted blood in a 50 ml polypropylene centrifuge tube, and spun at 2000 RPM for 20 minutes in a Beckman CS-6R centrifuge (Beckman Inc., Palo Alto, Calif.). The buffy layer at the DPBS/Ficoll interface is removed, washed twice with DPBS and once with human tissue culture medium (hTCM: aMEM+5% heat inactivated human AB serum (Ultraserum, BioWhittaker, Walkersville, Md.), penicillin/streptomycin, 1-glutamine) at low RCF to remove platelets. Sixty percent of the PBMCs are resuspended in freezing medium (10% dimethyl sulfoxide (Sigma Chemical Co., St. Louis, Mo.), 90% fetal bovine serum to a concentration of $5\times10^6$ cells/ml, frozen in a programmable Cryo-Med (New Baltimore, Mich.) cell freezer, and stored under liquid nitrogen until needed.

The purified PBMCs are plated at $2\times10^5$ cells/well at a volume of 0.1 ml in 96 well Costar cell culture plates. An equal volume of antigen at 10 μg/ml is added to triplicate or sextuplet sets of wells and the plate is incubated in a 37° C., 5% $CO_2$ incubator. On day five, 10 μl/well of 100 U/ml stock recombinant IL-2 (Advanced Biotechnologies Inc., Columbia, Md.) is added to each well. On day 8, frozen PBMCs are thawed, washed in DPBS+0.5% bovine serum albumin (BSA) to remove DMSO, resuspended to a concentration of $4\times10^6$ cells/ml in hTCM, and γ-irradiated (3,000 RADS). Fifty microliters/well are dispensed along with 50 μl of the appropriate antigen at a stock concentration of 40 μl/ml to give a final antigen concentration of 10 μg/ml.

To prepare a capture plate, IFN-γ capture antibody (monoclonal mouse anti-human IFN-g, Endogen # M700A, Cambridge, Mass.) is diluted to 10 μg/ml in sterile 0.1 M $Na(CO_3)_2$ pH 8.2 buffer, aliquotted at 50 μl/well in flat bottomed 96 well sterile microtiter plates (Corning Costar Corp.), and incubated at 4° C. for a minimum of 24 hours. Prior to use, excess antibody is removed and wells are washed twice with dPBS+1% Tween 20 (PBST). To block further nonspecific protein binding, plates are incubated with 250 μl/well of PBS+5% BSA at room temperature for 1 hour. After discarding the blocking solution, wells are washed once with PBST (0.1% Tween), followed by hTCM in preparation for the antigen stimulated cells.

On day 9 of the assay, twenty four hours after the second antigen stimulation, the stimulation plate is spun for 5 minutes at 1500 RPM in a Beckman CS-6R centrifuge and 90 μl of supernatant is carefully removed from each well with a micropipette. The pelleted cells are resuspended in 100 μl of hTCM, pooled in sterile tubes (Corning Costar corp sterile ClusterTAb #4411, Cambridge, Mass.), mixed and transferred into an equal number of wells of an anti IFN-γ capture plate. Capture plates are incubated undisturbed at 37° C. for 16-20 hours. At the end of the IFN-γ secretion phase, the cells are discarded and the plates are washed three times with 0.1% PBST. A final aliquot of PBST is added to the wells for ten minutes, removed, and 100 μl of a 1:500 dilution of rabbit anti-human IFN-γ polyclonal antibody (Endogen # P700, Cambridge, Mass.) in PBST+1% BSA is added to each well for 3.5 hours at room temperature with gentle rocking. Unbound anti-IFN-γ polyclonal antibody is removed by three washes with PBST, followed by a wash with 250 μl of 1×Tris-buffered saline+0.05% Tween 20 (TBST). Next, a 100 μl aliquot of 1:5000 alkaline phosphatase-conjugated mouse anti-rabbit polyclonal antibody (Jackson Immunological #211-055-109, West Grove, Pa.) diluted in TBST is added to each well and incubated at room temperature for 1.5-2 hours with gentle rocking. Excess enzyme-conjugated antibody is removed by three washes with PBST and two washes with alkaline phosphatase buffer (APB=0.1 M NaCl, 0.05 M MgCl.sub.2, 0.1 M Tris HCl, pH 9.5) followed by addition of the substrate mix of p-Toluidine salt and nitroblue tetrazolium chloride (BCIP/NBT, GIBCO BRL #18280-016, Gaithersburg, Md.). To stop the calorimetric reaction, plates were washed three times in dH$_2$O, inverted to minimize deposition of dust in the wells, and dried overnight at 28° C. in a dust free drying oven.

Images of the spots corresponding to the lymphokine secreted by individual antigen-stimulated T cells are captured with a CCD video camera and the image is analyzed by NIH image software. Captured images are enhanced using the Look Up Table which contrasts the images. Thresholding is then applied to every image and a wand tool is used to highlight the border to effectively subtract the edge of the well so that background counts won't be high and artificial. Density slicing over a narrow range is then used to highlight the spots produced from secreting cells. Pixel limits are set to subtract out small debris and large particles, and the number of spots falling within the prescribed pixel range are counted by the software program. Totals from each well are then manually recorded for future analysis. Alternatively, spots can be counted by other commercially available or customized software applications, or may be quantitated manually by a technician using standard light microscopy. Spots can also be counted manually under a light microscope.

We conclude that the protocol detailed above can be used for the enumeration of single IFN-γ secreting T cells.

Example 32

This is an example of measurement of antigen reactive T-Cells by IFN-γ capture in blood samples by ELISPOT.

This is an example of indirect detection of TCR, where individual cells are immobilized and measured by a chromogen assay. The antigenic peptide origin is a library of antigens.

The example provides a sensitive assay for the detection of T-cells reactive to the antigen of a library generated as described in example 24, by detecting a soluble factor whose secretion is induced by stimulation of the T-cell by the antigen.

This example is similar to the experiment above. PMBC are isolated, prepared and stored as described in the example above.

The purified PBMCs are plated at $2\times10^5$ cells/well at a volume of 0.1 ml in 96 well Costar cell culture plates. An equal volume of antigens from the library, at 10 µg/ml is added to triplicate or sextuplet sets of wells and the plate is incubated in a 37° C., 5% CO$_2$ incubator. On day five, 10 µl/well of 100 U/ml stock recombinant IL-2 is added to each well. On day 8, frozen PBMCs are thawed, washed in DPBS+0.5% BSA to remove DMSO, resuspended to a concentration of $4\times10^6$ cells/ml in hTCM, and γ-irradiated (3,000 RADS). 50 µl/well are dispensed along with 50 µl of the appropriate antigen at a stock concentration of 40 µl/ml to give a final antigen concentration of 10 µg/ml.

A capture plate with IFN-γ antibody is prepared, washed and blocked as described in the example above.

On day 9 of the assay, twenty four hours after the second antigen stimulation, the stimulation plate is spun for 5 minutes at 1500 RPM and 90 µl of supernatant is carefully removed from each well with a micropipette. The pelleted cells are resuspended in 100 µl of hTCM, pooled in sterile tubes, mixed and transferred into an equal number of wells of an anti IFN-γ capture plate. Capture plates are incubated undisturbed at 37° C. for 16-20 hours. At the end of the IFN-γ secretion phase, the cells are discarded and the plates are washed three times with 0.1% PBST. A final aliquot of PBST is added to the wells for ten minutes, removed, and 100 µl of a 1:500 dilution of rabbit anti-human IFN-γ polyclonal antibody in PBST+1% BSA is added to each well for 3.5 hours at room temperature with gentle rocking. Unbound anti-IFN-γ polyclonal antibody is removed by three washes with PBST, followed by a wash with 250 µl of 1×Tris-buffered saline+0.05% Tween 20 (TBST). Next, a 100 µl aliquot of 1:5000 alkaline phosphatase-conjugated mouse anti-rabbit polyclonal antibody diluted in TBST is added to each well and incubated at room temperature for 1.5-2 hours with gentle rocking. Excess enzyme-conjugated antibody is removed by three washes with PBST and two washes with alkaline phosphatase followed by addition of the substrate mix of p-Toluidine salt and nitroblue tetrazolium chloride. To stop the calorimetric reaction, plates were washed three times in dH$_2$O, inverted to minimize deposition of dust in the wells, and dried overnight at 28° C. in a dust free drying oven.

Images of the spots corresponding to the lymphokine secreted by individual antigen-stimulated T cells are captured with a CCD video camera and the image is analyzed as described in the example above We conclude that the experiment detailed above can be used for the enumeration of single IFN-γ secreting T cells in blood.

Example 33

This is an example of measurement of antigen reactive T-Cells by IFN-γ capture in blood samples from *Borrelia* patients by ELISPOT.

This is an example of indirect detection of TCR, where individual cells are immobilized and measured by a chromogen assay. The antigenic peptide origin is *Borrelia*, thus, immune monitoring of *Borrelia*.

The example provides a sensitive assay for the detection of T-cells reactive to the antigen OspC by detecting a soluble factor whose secretion is induced by stimulation of the T-cell by the antigen.

This example is similar to the experiment above. PBMCs from *Borrelia* patients are isolated, prepared and stored as described in the example above.

The purified PBMCs are plated at $2\times10^5$ cells/well at a volume of 0.1 ml in 96 well Costar cell culture plates. An equal volume of a mix of antigenic peptides from OspC protein, at 10 µg/ml is added to triplicate or sextuplet sets of wells and the plate is incubated in a 37° C., 5% CO$_2$ incubator. On day five, 10 µl/well of 100 U/ml stock recombinant IL-2 is added to each well. On day 8, frozen PBMCs are thawed, washed in DPBS+0.5% BSA to remove DMSO, resuspended to a concentration of $4\times10^6$ cells/ml in hTCM, and γ-irradiated (3,000 RADS). 50 µl/well are dispensed along with 50 µl of the appropriate antigen at a stock concentration of 40 µl/ml to give a final antigen concentration of 10 µg/ml.

A capture plate with IFN-γ antibody is prepared, washed and blocked as described in the example above.

On day 9 of the assay, twenty four hours after the second antigen stimulation, the stimulation plate is spun for 5 minutes at 1500 RPM and 90 µl of supernatant is carefully removed from each well with a micropipette. The pelleted cells are resuspended in 100 µl of hTCM, pooled in sterile tubes, mixed and transferred into an equal number of wells of an anti IFN-γ capture plate. Capture plates are incubated undisturbed at 37° C. for 16-20 hours. At the end of the IFN-γ secretion phase, the cells are discarded and the plates are washed three times with 0.1% PBST. A final aliquot of PBST is added to the wells for ten minutes, removed, and 100 µl of a 1:500 dilution of rabbit anti-human IFN-γ polyclonal antibody in PBST+1% BSA is added to each well for 3.5 hours at room temperature with gentle rocking. Unbound anti-IFN-γ polyclonal antibody is removed by three washes with PBST, followed by a wash with 250 µl of 1×Tris-buffered saline+0.05% Tween 20 (TBST). Next, a 100 µl aliquot of 1:5000 alkaline phosphatase-conjugated mouse anti-rabbit polyclonal antibody diluted in TBST is added to each well and incubated at room temperature for 1.5-2 hours with gentle rocking. Excess enzyme-conjugated antibody is removed by three washes with PBST and two washes with alkaline phosphatase followed by addition of the substrate mix of p-Toluidine salt and nitroblue tetrazolium chloride. To stop the calorimetric reaction, plates were washed three times in dH$_2$O, inverted to minimize deposition of dust in the wells, and dried overnight at 28° C. in a dust free drying oven.

Images of the spots corresponding to the lymphokine secreted by individual antigen-stimulated T cells are captured with a CCD video camera and the image is analyzed as described in the example above We conclude that the experiment detailed above can be used for the enumeration of single IFN-γ secreting T cells in blood from *Borrelia* patients.

Example 34

This is an example of how antigen-specific T-cells can be detected using a direct detection method detecting T cell immobilized in solid tissue. In this example MHC dextramers are used to detect antigen-specific T cells on frozen tissue sections using enzymatic chromogenic precipitation detection.

Equilibrate the cryosection tissue (e.g. section of spleen from transgenic mice) to −20° C. in the cryostate. Cut 5 µm sections and then dry sections on slides at room temperature. Store slides frozen until use at −20° C.

Equilibrate frozen sections to room temperature. Fix with acetone for 5 min. Immediately after fixation transfer slides to TBS buffer (50 mM Tris-HCL pH 7.6, 150 mM NaCl) for 10 min.

Incubate slides with FITC-conjugated MHC-dextramers at appropriate dilution (1:40-1:80) and incubate for 30 min at room temperature. Other dilution ranges, as well as incubation time and temperature, may be desirable.

Decant solution and gently tap slides against filter paper, submerge in TBS buffer. Decant and wash for 10 min in TBS buffer.

Incubate with rabbit polyclonal anti-FITC antibody (Dako P5100) at 1:100 dilution in TBS at room temperature for 30 min.

Repeat step 5 and 6.

Incubate with Envision anti-Rabbit HRP (Dako K4003) at room temperature for 30 min. Other visualization systems may be used.

Repeat step 5 and 6.

Develop with DAB+(Dako K3468) in fume hood for 10 min. Other substrates may be used Rinse slides in tap-water for 5 min.

Counterstain with hematoxylin (Dako S3309) for 2 min.

Repeat step 12, mount slides.

The slides stained with MHC-Dextramers can now be evaluated by microscopy.

Example 35

This is an example of how antigen-specific T-cells can be detected using a direct detection method detecting T cell immobilized in solid tissue. In this example MHC dextramers are used to detect antigen-specific T cells on paraffin embedded tissue sections using enzymatic chromogenic precipitation detection.

Formaldehyde fixed paraffin-embedded tissue are cut in section and mounted on the glass slice, for subsequent IHC staining with MHC-dextramers. Tissue fixed and prepared according to other protocols may be used as well. E.g. fresh tissue, lightly fixed tissue section (e.g. tissue fixed in 2% formaldehyde) or formalin-fixed, paraffin-embedded tissue section.

Optimal staining may require target retrieval treatment with enzymes as well as heating in a suitable buffer before incubation with antibodies and MHC-dextramer. The sample is stained for DNA using DAPI stain, followed by incubated with an antigen-specific MHCdex/FITC reagent, followed by addition of anti-FITC antibody labeled with HRP.

Then the substrate for HRP, "DAP" is added and the reaction allows to progress. The sample is analyzed by light microscopy for the present of a colored precipitate on the cells (DAPI stained nucleus) positive for the specific MHC/dex reagent.

A digital image of the stained sample is obtained, and this can be analyzed manually in the same way as by microscopy. However, a digital image may be used for automatic determination of where and how many cells that are positive, related to the total amount of cells, determined by the DAPI staining, or other criteria or stainings.

Example 36

This example describes how the quality of a MHC multimer can be tested. The MHC multimer is in this example a MHC-dextramer, and the test involves specific binding of the MHC-dextramer to TCRs immobilized on beads.

Recombinant TCRs (CMV3 TCRs; Soluble CMVpp65 (NLVPMVATV)-specific (SEQ ID NO 217779) TCR protein) specific for the MHC-peptide complex HLA-A*0201 (NLVPMVATV) (SEQ ID NO 217779), where the letters in parenthesis denote the peptide complexed to the MHC-allel HLA-A*0201, were obtained from Altor Biosciences. The TCRs were dimers linked together via an IgG framework.

The purity of the TCRs was verified by SDS PAGE and was between 95-100% pure. The quality of the TCRs was verified by their ability to recognize the relevant MHC-dextramer and not irrelevant MHC dextramers in ELISA experiments (data not shown).

Carboxylate-modified beads were coupled with dimeric TCR (CMV3 TCRs; Soluble CMVpp65(NLVPMVATV)-specific TCR protein (SEQ ID NO 217779)), incubated with fluorescently labeled MHC-dextramers and the extend of cell staining analysed by flow cytometry, as follows:

Immobilization of TCR on Carboxylate Beads:

$3 \times 10^9$ Carboxylate-modified beads, Duke Scientific Corporation, XPR-1536, 4 µm, lot:4394 were washed in 2×500 µl Wash buffer 1 (0.05% Tetronic 1307, 0.1M MES-buffer (2-[N-morpholino]ethanesulfonic acid), pH 6.0), centrifuged 4 min at 15000 g, and the supernatant was discarded.

125 µl EDAC/Sulfo-NHS (50 mM EDAC (1-ethyl-3-(3-dimethylaminopropyl)carbodiimide), 50 mM Sulfo-NHS, in Wash buffer 1) was added to the beads, and the suspension incubated at room temperature for 20 min.

Beads were washed in 2×250 µl Wash buffer 1 and centrifuged 2 min at 15000 g, and the supernatant was discarded.

TCR was added in various concentrations from 0 µg to 20 µg, and incubated with slow shaking overnight at 4° C.

Beads were centrifuged 4 min at 15000 g, and the supernatant discarded.

Beads were washed in 2×500 µl Wash buffer 1 and centrifuged 4 min at 1500 g, and the supernatant was discarded.

125 µl 120 mM Glycin in Wash buffer 1 was added, and resuspended beads incubated for 1 hour at room temperature.

Beads were washed in 2×500 µl phosphate-buffered saline (PBS) pH 7.2, 0.5% Tetronic 1307, and centrifuged 2 min at 15000 g, and the supernatant was discarded. Beads were resuspended in 250 µl PBS pH 7.2, 0.05% Tetronic 1307.

Bead concentration after resuspension was $1.2 \times 10^7$ beads/µl. Beads coated with TCR were stored at 2-8° C. until further use.

Flow Cytometry Analysis:

20 µl beads ($1.2 \times 10^7$ beads/pp coated with 0-20 µg TCRs, as described above were washed in 200 µl Wash buffer 2 (5% FCS, PBS, pH 7.4).

Beads were centrifuged 3 min at 12000 g, and the supernatant was discarded, and beads resuspended in 50 µl Wash buffer 2.

10 µl MHC-dextramers were added, and samples were incubated 15 min. at room temperature in the dark.

Samples were washed in 1 ml Wash buffer 2, centrifuged at 300 g for 5 min. The supernatant was discarded, and pellet resuspended in 0.4 ml PBS pH 7.4, and kept at 4° C. in the dark until analysis on flow cytometer.

Samples were analysed by flow cytometry on a CyAn instrument.

The results are shown in FIG. 18. Beads coated with 2-20 µg TCR all showed positive staining with the specific HLA-A*0201(NLVPMVATV)/RPE (SEQ ID NO 217779) and not with an irrelevant HLA-A*0201(ILKEPVHGV)/RPE (SEQ ID NO 217780) dextramer. It can be concluded that carboxylate beads coated with dimeric TCRs can be used to test the quality of the MHC-dextramers.

Example 37

This example describes how the quality of a MHC multimer can be tested. The MHC multimer was in this example a MHC-dextramer, and the test involved specific binding of the MHC-dextramer to monomeric and dimeric TCRs immobilized to different kind of beads.

Binding of MHC-dextramer to carboxylated beads coated with monomeric TCR: Recombinant monomeric TCRs (CMV3 TCRs; Soluble CMVpp65(NLVPMVATV)-specific TCR protein (SEQ ID NO 217779)) specific for the MHC-peptide complex HLA-A*0201(NLVPMVATV) (SEQ ID NO 217779), were obtained from Altor Biosciences. The purity of the TCRs were verified by SDS PAGE. The quality of the TCRs were verified by their ability to recognize the relevant MHC-dextramer and not irrelevant MHC dextramers in ELISA experiments (data not shown).

Carboxylate modified beads were coupled with monomeric TCR (CMV3 TCRs; Soluble CMVpp65(NLVPMVATV)-specific TCR protein (SEQ ID NO 217779)), incubated with fluorescently labeled MHC-dextramers and the extend of cell staining analysed by flow cytometry, as described in Example 8. 0-20 µg of monomeric TCRs were coupled to Carboxylate modified beads.

Flow cytometry analysis of beads coupled with 0-20 µg of monomeric TCRs showed a slightly stronger signal when stained with the relevant HLA-A*0201(NLVPMVATV) (SEQ ID NO 217779) dextramer than with an irrelevant MHC-dextramer (data not shown). It might be desirable to coat the beads with larger amounts of monomeric TCRs in order to increase the signal difference between relevant and irrelevant MHC-dextramer.

Beads couples with 0 µg of monomeric TCRs showed identical signal when stained with relevant and irrelevant MHC-dextramers.

We conclude that the monomeric TCRs coupled to Carboxylate modified beads can be used as positive control for the MHC-dextramer.

Binding of MHC-Dextramer to Streptavidin Beads Coupled with Biotinylated Monomeric TCR:

Recombinant monomeric, biotinylated TCRs (CMV3 TCRs; Soluble CMVpp65(NLVPMVATV)-specific TCR protein (SEQ ID NO 217779)) specific for the MHC-peptide complex HLA-A*0201(NLVPMVATV) (SEQ ID NO 217779), were obtained from Altor Biosciences.

The purity of the TCRs were verified by SDS PAGE. The quality of the TCRs were verified by their ability to recognize the relevant MHC-dextramer and not irrelevant MHC dextramers in ELISA experiments (data not shown).

Streptavidin beads were coupled with monomeric biotinylated TCR (CMV3 TCRs; Soluble CMVpp65(NLVPMVATV)-specific TCR protein (SEQ ID NO 217779)), incubated with fluorescently labeled MHC-dextramers and the extend of cell staining analysed by flow cytometry.

Immobilization of TCR on Streptavidin Beads:

$2 \times 10^6$ Streptavidin Coated Compel Magnetic beads, Bangs laboratories, CM01N, lot: 6998, were washed in 2×500 µl phosphate-buffered saline (PBS) pH 7.2 centrifuged 5 min at 15000 g, and then the supernatant was discarded.

Beads were resuspended in 50 µl PBS pH 7.2.

0-4 µg TCRs was added. Incubated at room temperature for 30 min.

Beads were washed in 2×500 µl PBS, pH 7.2. Centrifuged 5 min at 15000 g, and the supernatant was discarded.

Beads were resuspended in 100 µl PBS pH 7.2.

Bead concentration after resuspension was $2 \times 10^4$ beads/µl. Beads coated with TCRs were stored at 2-8° C. until further use.

Flow Cytometry Analysis:

50 µl streptavidin beads ($1 \times 10^6$ beads) coated with 0-4 µg TCRs were added 10 µl MHC-dextramers, and samples were incubated at 4° C. for 1 hour.

2×500 µl PBS pH 7.2 was added, and samples were centrifuged for 5 min at 15000 g, and supernatant discarded.

Beads were resuspended in 500 µl PBS pH 7.2 and kept at 4° C. in the dark until analysis on a flow cytometer.

Samples were analysed by flow cytometry on a CyAn instrument.

Beads were stained with HLA-A*0201(NLVPMVATV (SEQ ID NO 217779))-dextramers specific for the TCR and with irrelevant MHC-dextramers not able to bind the TCR. Flow cytometry analysis of beads coupled with >0 µg TCRs showed a slightly stronger signal when stained with the relevant MHC-dextramer than with the irrelevant MHC-dextramer (data not shown). The staining intensity was identical when beads conjugated with 0 µg TCR were stained with either specific or non-specific MHC-dextramers. We conclude that the monomeric biotinylated TCRs bound to streptavidin coated beads can be used as positive control for the MHC-dextramer.

Binding of MHC-Dextramers to Amine-Modified Beads Coupled with Monomeric or Dimeric TCRs:

Recombinant monomeric or dimeric TCRs (CMV3 TCRs; Soluble CMVpp65(NLVPMVATV (SEQ ID NO 217779))-specific TCR protein) specific for the MHC-peptide complex HLA-A*0201(NLVPMVATV(SEQ ID NO 217779)), were obtained from Altor Biosciences.

The purity of the TCRs were verified by SDS PAGE. The quality of the TCRs were verified by their ability to recognize the relevant MHC-dextramer and not irrelevant MHC dextramers in ELISA experiments (data not shown).

Amine-modified beads were coupled with dimeric TCR (CMV3 TCRs; Soluble CMVpp65(NLVPMVATV (SEQ ID NO 217779))-specific TCR protein).

Immobilization of TCR on Amine Modified Beads:

$3 \times 10^9$ Amine modified beads, Duke Scentific XPR-1536, 4 µm, lot:4393 were washed in 2×500 µl phosphate-buffered saline (PBS) pH 7.5 centrifuged 4 min at 15000 g, and then the supernatant was discarded.

Resuspend beads in 0.3 ml PBS pH 7.5

25 µl 20 mM solution of SPDP (N-Succinimidyl 3-(2-pyridyldithio) propionate) in DMSO was added to the beads, and the suspension incubated at room temperature for 30 min.

Beads were washed in 2×1 ml PBS containing 1 mM EDTA, pH 7.5. Centrifuged 4 min at 15000 g, and the supernatant was discarded.

Resuspend beads in 0.3 ml PBS containing 1 mM EDTA, pH 7.5.

10 mg dithiothritol (DTT) was added, and suspension incubated at room temperature for 30 min.

Beads were washed in 2×1 ml PBS, pH 7.5. Centrifuged 4 min at 15000 g, and the supernatant was discarded.

Sedimented beads were added a freshly prepared SPDP-derivatized protein prepared according to the following outlines (step 14-15):

Treat protein (in this example dimeric TCR) 2-5 mg/ml, in 0.1 ml carbonate buffer, pH 8 with 10 µl 20 mM solution of SPDP in DMSO at room temperature for 30 min.

Remove excess reagent by passing through a small desalting column in PBS pH 7.5, or by rapid dialyse against PBS pH 7.5.

Add >1 mg SPDS-protein per $10^9$ beads, to the SPDP derivatized and reduced bead preparation from paragraph 13. 0-1 mg of SPDS-protein per $10^9$ beads might be desirable.

Resuspend beads in the SPDP-protein solution. Incubate with slow shaking overnight at 4° C.

Beads were washed in 2×1 ml PBS pH 7.5. Centrifuged 4 min at 15000 g, and the supernatant was discarded.

Resuspend beads in 250 µl PBS pH 7.5.

Bead concentration after resuspension was $1.2 \times 10^7$ beads/µl. Beads coated with TCRs were stored at 2-8° C. The quality of MHC-dextramer can now be analysed by examining the degree of binding of specific MHC-dextramer to the TCR-coated beads, versus the binding of irrelevant MHC-dextramer to the TCR coated beads.

Various reaction conditions (e.g various protein:bead ratios) and assay for optimal coupling yield can be explored. The latter can be done by using an ELISA technique (incubate protein/bead conjugated with an appropriate anti-protein enzyme conjugated (e.g. HRP Peroxidase) followed by washing and colour development with a suitable substrate (e.g. TMB/Peroxide)) or by flow cytometry (e.g. a fluorescence labelled anti-protein (in this example MHC multimer HLA-A*0201(NLVPMVATV (SEQ ID NO 217779))) to assess level of covalently bound protein to amine-modified beads.

We conclude that the TCRs coupled to amine-modified beads coupled can be used as positive controls for the MHC Dextramer as described in Example 38 and 39.

Example 38

This example describes how TCR-coated beads can be used as internal, positive controls when analysing suspensions of Human Peripheral Blood Mononuclear Cells (HPBMCs), whole blood samples or any other cell sample of interest. The MHC multimer employed in this example is a MHC-dextramer.

In this example TCR-coated carboxylated beads generated as described in Example 8 were added to a sample containing either HPBMCs or whole peripheral blood.

HPBMCs and TCR-beads were incubated with fluorescently labelled MHC-dextramers and the extent of cell staining analysed by flow cytometry according to this general staining procedure:

Transfer $1-3 \times 10^6$ lymphoid cells (PBMC or splenocytes) to a 12×75 mm polystyrene test tube. Other cells of interest can be used. Allocate only $2-5 \times 10^5$ cells per tube when staining T-cell clones or cell lines due to the high frequency of antigen-specific T cells Add 2 ml 0.01 mol/L PBS containing 5% fetal calf serum and centrifuge at 300×g for 5 minutes. Remove supernatant and resuspend cells in remaining liquid.

Add 10 µl of MHC Dextramer and mix gently with a vortex mixer. Incubate in the dark at room temperature for 10 minutes.

Add an optimally titrated amount of anti-CD8 antibody conjugated with a relevant flourochrome (e.g. Dako clone DK25 for human lymphocytes or clone YTS169.4/KT15 for mouse lymphocytes). Incubate in the dark at 2-8° C. for 20 min.

Add 2 ml of 0.01 mol/L PBS containing 5% fetal calf serum and centrifuge at 300×g for 5 minutes.

Resuspend pellet in an appropriate fluid for flow cytometry, e.g. 0.4 ml PBS. Analyse on a flow cytometer or store at 2-8° C. in the dark until analysis. Do not store longer than 2 hours before analysis.

Human peripheral whole blood and TCR-beads were incubated with fluorescently labelled MHC-dextramers and the extent of cell staining analysed by flow cytometry as follows:

Transfer 100 µL whole blood to a 12×75 mm polystyrene test tube.

Add 10 µl of MHC Dextramer and mix with a vortex mixer. Incubate in the dark at room temperature for 10 minutes.

Add an optimally titrated amount of anti-CD8 antibody (e.g. Dako clone DK25) conjugated with a relevant fluorochromes and mix well. Continue incubation at 2-8° C. in the dark for 20 minutes.

Add 2 mL EasyLyse™ working solution (Code No. S2364) and incubate for 10 minutes. Centrifuge for 5 minutes at 300×g and aspirate supernatant.

Add 2 mL 0.01 mol/L PBS and centrifuge for 5 minutes at 300×g and aspirate supernatant.

Resuspend pellet in an appropriate fluid for flow cytometry, e.g. 0.4 mL PBS, and analyze on a flow cytometer or store at 2-8° C. in the dark until analysis. Do not store longer than 2 hours before analysis.

FIG. 19 shows examples of TCR-beads added into whole blood or HPBMC samples. In both experiments it is possible, by forward- vs. side-scatter measurements, to distinguish TCR-beads from cell populations in the sample. Region R1 is TCR-beads, and region R2 is lymphocyte cell population of interest in the analysis of MHC positive T cells.

The size and conditions of coating of beads might be optimized. The size of beads or labelling of beads (e.g. flourescent labelling) can be optimized to allow separation of cells of interest in the sample. In this example the forward- vs. side-scatter dot plot has been used for gating of cell populations of interest. Other parameters (e.g. fluorescence intensity) for cell populations of interest can be used.

Human peripheral whole blood and other cells (e.g. HPBMCs) can be stained with MHC Dextramers simultaneously with immuno-phenotyping of relevant antigens. The staining procedure describes the use of labelled CD8 antibody together with MHC dextramers; additional antibodies for detection of other extracellular antigens can be added. Likewise, detection of intracellular antigens can be performed simultaneously with MHC-detection (for protocol, see IntraStain procedure, cat no. K2311, Dako. Additional washing step prior to IntraStain Reagent A is essential for good results using MHC Dextramers together with this IntraStain procedure).

Example 39

This example describes how TCR-coated beads can be used as internal, positive controls when analysing suspensions of Human Peripheral Blood Mononuclear Cells (HPBMCs), whole blood samples or any cell sample of interest. The MHC multimer employed in this example is a MHC-tetramer.

In this example TCR-coated beads as described in Example 37 and 38 are added to a sample containing either HPBMCs or whole peripheral blood.

HPBMCs/whole peripheral blood and TCR-beads are incubated with fluorescently labelled MHC-tetramers and the extent of cell staining is analysed by flow cytometry according to staining procedures as described for Tetramers in the product insert by Beckman Coulter.

Example 40

This example describes how TCR-coated beads can be used as internal, positive controls when analysing suspensions of Human Peripheral Blood Mononuclear Cells (HPBMCs), blood samples (red blood cell depleted) or any cell sample of interest. The MHC multimer employed in this example is a MHC-pentamer.

In this example TCR-coated beads as described in Example 37 and 38 are added to a sample containing either HPBMCs or blood.

HPBMCs/blood sample and TCR-beads are incubated with fluorescently labelled MHC-pentamers and the extent of cell staining is analysed by flow cytometry according to staining procedures as described for Petramers in the product insert by ProImmune.

Example 41

This example describes how it can be examined whether a MHC multimer is correctly folded. The MHC multimer is in this example a MHC-dextramer, and the test involves specific binding of the MHC-dextramer to antibodies immobilized on beads.

Beads were coated with the antibody clone W6/32. W6/32 is an antibody recognizing all human MHC I HLA-A, B and, C alleles but only when they are in the correct conformation and properly loaded with antigenic peptide. The protocol for immobilization of proteins on carboxylate beads described elsewhere herein was followed. In the following these W6/32 antibody coated carboxylated beads are referred to as W/32-beads.

W6/32-beads were incubated with fluorescently labeled MHC-dextramers and the extent of cell staining analyzed by flow cytometry. The staining procedure described in example 37 was followed.

W6/32-beads incubated with correctly folded MHC-dextramers showed efficient staining. Experiments with W6/32-beads incubated with unfolded heavy chain attached to fluorescently labelled dextran, or a fluorescently labelled dextran without MHC complex attached, showed less fluorescence intensity compared to W6/32-beads incubated with correct folded MHC-dextramer.

We conclude that beads coupled with the antibody clone W6/32 can be used as positive control for all MHC alleles recognized by this antibody.

Other antibodies, or other types of molecules such as DNA aptamers recognizing correctly folded MHCs or parts of MHC could be used in similar experiments.

Example 42

This example describes how the quality of the MHC multimer can be tested. The example also describes how MHC multimers can be used for detection of TCR immobilized to solid support.

The MHC multimer in this example is a MHC-dextramer, and the test involves specific binding of the MHC-dextramer to TCRs or other MHC-recognizing molecules. Experiments can be performed with any kind of TCRs or MHC-recognizing molecules immobilized on a bead or other solid support.

Procedures as described in examples elsewhere herein can be used, depending on the chemistry of the MHC recognizing molecules and type of solid support. Procedures for coupling of molecules and type of solid support can be chosen and optimized according to the chemistry of the molecules and solid support.

Alternatively, the experiments could be performed without including solid supports, e.g. by performing immuno-precipitation of formed MHC multimer-TCR complexes.

Example 43

This example describes how the quality of a MHC multimer can be tested. The example also describes how MHC multimers can be used for detection of a specific T-cell line.

The MHC multimer in this example is a MHC-dextramer, and the test involves specific binding of the MHC-dextramer to a cell line that expresses specific TCRs and displays these on the cell surface.

A transfected Jurkat T cell line (JT3A) from Altor Biosciences specific for the MHC complex HLA-A*0201 (NLVPMVATV (SEQ ID NO 217779)) was evaluated as positive control for the MHC-dextramer HLA-A*0201 (NLVPMVATV (SEQ ID NO 217779)). The cells were cultured and treated to express TCR just before evaluation. Under the conditions used, 20-50% of the cells were expected to express and display TCR. After stimulation the cells were incubated with fluorescently labeled MHC-dextramers and the extent of cell staining analyzed by flow cytometry, as follows:

JT3A cells growing in log phase were incubated at room temperature for 2-3 hours to express TCRs (The TCRs are not stable expressed at 37° C.).

After 3 hours cells were centrifuged for 5 min at 400 g, and the supernatant was discarded.

Cells were washed in PBS pH 7.4+5% FCS, and centrifuged for 5 min at 400 g. The supernatant was discarded, and cells resuspended in proper volume PBS pH 7.4+5% FCS for counting in a Bürker chamber.

$1 \times 10^6$ cells per sample in 100 µl PBS pH 7.4+5% FCS were added to each sample tube.

10 µl MHC-dextramers were added. Incubation for 30 min at 4° C. in the dark.

5 µl anti-CD3 was added to each sample. Further incubation for 30 min at 4° C. in the dark.

Samples were washed in 2 ml PBS, centrifuged for 5 min at 300 g. Supernatant discarded and sample resuspended in 0.4 ml PBS pH 7.4.

Samples were kept at 2-8° C. in the dark until analysis on flow cytometer.

Samples were analyzed by flow cytometry on a CyAn instrument.

Data were analyzed by the Summit software. Stimulated JT3A cells were stained with the specific MHC-dextramer HLA-A*0201(NLVPMVATV (SEQ ID NO 217779)) and anti-CD3. Another sample of cells were stained with the irrelevant MHC-dextramer HLA-A*0201(GILGFVFTL) and anti-CD3. The cells stained with HLA-A*0201 (GILGFVFTL) had weak signals (low fluorescent intensity), and therefore regarded as the negative population. A boundary was introduced in the dot plot, to mark the negative population. Cells with fluorescence higher than the negative boundary were hereafter regarded positive. 19% and 0.25% of the cells were regarded positive when stained with the relevant and irrelevant MHC-dextramer, respectively. See table below.

| MHC-complex | Percentage of positive cells |
|---|---|
| HLA-A*0201(NLVPMVATV) (SEQ ID NO 217779) | 19% |
| HLA-A*0201(GILGFVFTL) | 0.25% |

The results thus correlate well with the expected 20-50% HLA-A*0201(NLVPMVATV) (SEQ ID NO 217779) positive JT3A cells after stimulation. We conclude that the transfected Jurkat cell line (JT3A) can be used as positive control for the MHC-dextramer.

Example 44

This example describes how the quality of a MHC multimer can be tested. The example also describes how MHC multimers can be used for detection of specific T-cell lines.

The MHC multimer in this example is a MHC-dextramer, and the test involves specific binding of the MHC-dextramer to cell preparations expressing TCRs.

Three different peptide specific T-cell preparations of Human cytotoxic T lymphocyte lines specific for viral peptides were incubated with fluorescently labeled MHC-dextramers and the extent of cell staining analyzed by flow cytometry. The following T-cell preparations were examined: (NLV) specific for MHC-dextramer HLA-A*0201 (NLVPMVATV) (SEQ ID NO 217779), (IPSI) specific for MHC-dextramer B*3501(IPSINVHHY) and (GLC) specific for MHC-dextramer A*0201(GLCLVALM).

Cells were added 1 ml RPMI and then transfer to a tube with 9 ml RPMI. Cells were centrifuged for 5 min at 300 g, and the supernatant was discarded.

Cells were washed in 10 ml PBS pH 7.4+5% FCS, and centrifuged for 5 min at 300 g, and the supernatant was discarded.

$1 \times 10^6$ cells per sample in 100 µl PBS pH 7.4+5% FCS were added to sample tubes. 10 µl MHC Dextramers were added, and incubated at room temperature in the dark for 10 min.

5 µl anti-CD3 and anti-CD8 were added to each sample. Further incubation for 20 min at 4° C. in the dark.

Samples were washed in 2 ml PBS pH 7.4+5% FCS and centrifuged for 5 min at 300 g, and the supernatant was discarded.

Pellets were resuspended in 0.4 ml PBS pH 7.4.

Samples were kept in the dark at 2-8° C. until analysis on a flow cytometer.

Samples were analyzed by flow cytometry on a CyAn instrument.

Data were analyzed by the Summit software. The cell preparations were stained with anti-CD3, anti-CD8, the respective specific MHC-dextramer, or an irrelevant MHC-dextramer. Anti-CD3 positive cells were positively gated and anti-CD8 vs. MHC-dextramer were depicted in a dot plot. The main population of anti-CD8 positive cells stained with the irrelevant MHC-dextramer was regarded as negative, and a boundary was introduced in the dot plot to mark the negative population. Anti-CD8 positive cells with fluorescence higher than the negative boundary were regarded positive. In the NLV and IPSI cell preparations, approximately 95% of the $CD8^+$ cells were positive for the relevant MHC dextramer. 45% of the $CD8^+$ GLC cells were positive for relevant MHC Dextramers, see table below. Cell preparations were not stained by the irrelevant MHC-dextramer.

We conclude that the different peptide specific T-cell preparations can be used as positive controls for the relevant MHC-dextramer.

| Cell preparation | MHC-complex | Percentage of positive cells |
|---|---|---|
| NLV | HLA-A*0201(NLVPMVATV) (SEQ ID NO 217779) | 97% |
|  | HLA-B*3501(IPSINVHHY) | 0.02% |
| IPSI | HLA-B*3501(IPSINVHHY) | 95% |
|  | HLA-A*0201(NLVPMVATV) (SEQ ID NO 217779) | 0.01% |
| GLC | HLA-A*0201(GLCLVALM) | 45% |
|  | HLA-A*0201(ILKEPVHGV) (SEQ ID NO 217780) | 0.1% |

Example 45

This example describes how the quality of the MHC multimer can be tested. The example also describes how MHC multimers can be used for detection of specific T-cell lines.

The MHC multimer in this example is a MHC-dextramer, and the test involves specific binding of the MHC-dextramer to cell lines or other preparations expressing TCRs or MHC-recognizing molecules.

Experiments can be performed with any kind of TCRs or MHC-recognizing molecules displayed on cells (e.g. a cell line or a cell preparation).

Procedures as described in Example 43 and 44 can be used with any kind of TCRs or MHC-recognizing molecules displayed on cells. Stimulation of cells has to be optimized for the specific experiments (e.g. stimulation with chemicals and/or temperature to express the TCR prior to analysis).

Results can be analyzed as in Example 43 and 44 and cell preparations stained with relevant MHC-dextramers will extent higher signal intensity than when stained with irrevant MHC-dextramers.

Example 46

This example describes how the quality of the MHC multimer can be tested. The example also describes how MHC multimers can be used for detection of TCR immobilized to solid support or attached to other molecule.

The MHC multimer in this example is a MHC-dextramer, and the test involves specific binding of the MHC-dextramer to TCRs or MHC recognizing motifs immobilized or expressed on molecules detectable in flow cytometry.

The experiments can be performed with any kind of molecule detectable in flow cytometry. MHC-recognizing molecules can be displayed on beads, cells, or other entities that are amenable to flow cytometry analysis.

MHC-recognizing molecules can be displayed on entities amenable in flow cytometry either naturally or artificially (e.g. chemical coupling). Procedures as described in the above examples can be applied, depending on the nature of the molecules. Alternatively procedures optimized for the specific molecule can be applied.

Molecules can be stained with fluorescently labeled MHC-dextramers and the extent of cell staining can be analyzed by flow cytometry. Molecules stained with relevant MHC-dextramers will extent higher signal intensity than when stained with irrelevant MHC-dextramers.

Example 47

This example describes how the quantity of correctly folded MHC can be determined by ELISA assay. The test involves specific binding of the MHC to anti-HLA-ABC antibody, clone W6/32. W6/32 is an antibody recognizing all human MHC I HLA-A, B and C alleles but only when they are in the correct conformation and properly loaded with antigenic peptide.

The ELISA can be carried out as follows. A preparation of MHC complexes is incubated in wells of a microtiter plate pre-coated with W6/32 antibody following standard ELISA procedure regarding washes, blocking etc. A secondary antibody recognizing MHC (e.g. anti-$\beta_2$m) is used for visualization. The secondary antibody can be labeled, e.g. with Horse raddish Peroxidase or it can be unlabelled, and a labeled compound specific for the secondary antibody is then employed (e.g. EnVision System) before visualization.. A compound for visualization is added, e.g. TMB One-Substrate System when Peroxidase enzyme is the label. The chromogenic intensity is measured and the result from the ELISA assay is evaluated. In parallel a standard curve of is generated, e.g. consisting of various concentrations of correctly folded MHC complexes. The chromogenic intensity of the tested MHC sample can now be converted to actual concentrations of correctly folded MHC using the standard curve. We conclude that the ELISA assay together with a standard curve can be used to quantify correctly folded MHC.

Example 48

This example describes how the quantity of correctly folded MHC can be determined by ELISA assay. The test involves specific binding of MHC complexes to a molecule recognizing correctly folded MHC (e.g. antibody, TCR, aptamers, or other MHC-peptide complex binding molecules).

As described elsewhere the quantity of correctly folded MHC can be measured in an ELISA assay using a molecule specific for correctly folded MHC complexes either for catching of the testet MHC complex preparation or for detection of it. The result obtained from bound MHC complex in the sample tested is correlated to a standard curve for determination of concentration. The ELISA assay can be conducted and optimized by various measures depending on the reagent and enzyme used.

Example 49

This example describes how the quantity of correctly folded MHC can be determined by competitive ELISA assay. The example also describes how MHC multimers can be used for detection of TCR immobilized to solid support.

The test involves specific binding of MHC complexes to a molecule recognizing correctly folded MHC (e.g. antibody, TCR, aptamers, or other MHC-peptide complex binding molecules). The analysis is carried out as follows. A preparation of correctly folded MHC of known concentration is immobilized in wells of a microtiter plate. A mixture of a molecule recognizing correctly folded MHC (e.g. the antibody W6/32) and soluble MHC complex, containing a mixture of correctly and non-correctly folded MHC, is added to the microtiter plate. The molecules recognizing correctly folded MHC will now attach to either the immobilized MHC or the correctly folded MHC in the soluble fraction. The amount of molecules recognizing correctly folded MHC bound to the immobilized MHC in the microtiter plate is measured, e.g. by addition of a secondary labeled or unlabeled antibody specific for the molecule recognizing correctly folded MHC. Depending on the characteristic of the secondary antibody visualization is performed. The result of the ELISA assay is evaluated. The amount of bound molecules specific for correctly folded MHC complexes is inversely proportional to the quantity of correctly folded MHC in the soluble fraction. The quantity of correctly folded MHC in the soluble fraction can be measured using a standard curve, obtained using known amounts of a pure preparation of MHC complexes and constant amount of molecules recognizing correctly folded MHC.

We conclude that an indirect competitive ELISA can be used to quantify correctly folded MHC.

Example 50

This example describes how the quantity of correctly folded MHC can be determined by competitive ELISA assay. The example also describes how MHC multimers can be used for detection of TCR immobilized to solid support.

The test involves specific binding of MHC complexes to a molecule recognizing correctly folded MHC (e.g. antibody, TCR, aptamers, or other MHC-peptide complex binding molecules).

The analysis is carried out as follows. Molecules recognizing correctly folded MHC are immobilized in wells of a microtiter plate. A preparation of in vitro folded MHC complexes is mixed with a known amount of labeled correctly folded MHC and the mixture added to the microtiter plate. The correctly folded MHC in the mixture will now compete for binding to the molecules recognizing correctly folded MHC immobilized in the microtiter plate. The amount of bound labeled MHC can now be visualized and measured. The result is inversely proportional to the quantity of correctly folded MHC in the mixture. The quantity of correctly folded MHC in the mixture can be measured using a standard curve, obtained using known amounts of a pure preparation of MHC mixed with a constant amount of labeled MHC.

Example 51

This example describes how the quantity of correctly folded MHC can be determined by competitive ELISA assay. The example also describes how MHC multimers can be used for detection of TCR immobilized to solid support.

The test involves specific binding of the MHC to a molecule recognizing correctly folded MHC (e.g. antibody, TCR, aptamers, or other MHC-peptide complex binding molecules) or to molecules recognizing MHC, correctly as well as non-correctly folded (e.g. antibody, TCR, aptamers, or other MHC-peptide complex binding molecules).

A preparation of MHC complexes are immobilized in a microtiter plate and incubated with a labeled molecule recognizing MHC, correctly as well as non-correctly folded (in the following referred to as recognizing all MHC complexes).

Then an unlabeled molecule recognizing correctly folded MHC is added in major excess. These molecules will displace all the MHC recognizing molecules added in step 1 that binds correctly folded MHC complexes.

The amount of bound labeled molecule recognizing all MHC can now be visualized and measured.

The result is inversely proportional to the quantity of correctly folded MHC. The quantity of correctly folded MHC can be measured using a standard curve, obtained using known amounts of a MHC incubated with labeled molecule recognizing all MHC.

Example 52

This example describes how the quantity of correctly folded MHC can be determined. The test involves specific binding of MHC complexes to anti-HLA-ABC antibody, clone W6/32. In this example W6/32 antibody is immobilized on magnetic beads.

The protein concentration in a purified preparation of MHC complexes is determined by spectofotometric measurement of $OD_{280}$. Other techniques can be used as well, e.g. BCA (bicinchoninic acid) assay or SDS-PAGE gel.

To measure the proportion of correctly folded MHC, a sample of the MHC complex preparation is incubated with W6/32 antibody coated magnetic beads.

After incubation the beads are sedimented or captured by a magnet and excess supernatant is withdrawn.

The concentration of protein in the supernatant is measured as in step 1.

The proportion of correctly folded MHC complex is calculated as follows:
  X: Total protein concentration (step 1)
  Y: Protein concentration after capture of correctly folded MHC (step 4)

% of correct folded MHC=(1−(Y/X))*100%

Ex. X=10 mg/ml
Y=2 mg/ml
  % of correct folded MHC=(1−(2 mg/ml/10 mg/ml))
    *100%=80%

The proportion of correctly folded MHC can be used as quality parameter, to measure the variation from production to production of a specific MHC-peptide complex.

Example 53

This example describes how the quantity of correctly folded MHC can be determined. The example also describes how MHC multimers can be used for detection of TCR immobilized to solid support.

The test involves specific binding of MHC complexes to a molecule recognizing correctly folded MHC (e.g. antibody, TCR, aptamers, or other MHC-peptide complex binding molecules). The MHC recognizing molecules can be immobilized to a solid support (e.g. beads, microtiter plate or gel material).

The protein concentration in a purified preparation of MHC complexes is determined by spectofotometric measurement of $OD_{280}$. Other techniques can be used as well, e.g. BCA (bicinchoninic acid) assay or SDS-PAGE gel.

To measure the proportion of correctly folded MHC, a sample of the MHC complex preparation is incubated with a molecule recognizing correctly folded MHC complex immobilized to a solid support.

After incubation supernatant is withdrawn.

The concentration of protein in the supernatant is measured as in step 1.

The proportion of correctly folded MHC complex is calculated as follows:
  X: Total protein concentration (step 1)
  Y: Protein concentration after capture of correctly folded MHC (step 4)

% of correct folded MHC=(1−(Y/X))*100%

Ex. X=10 mg/ml
Y=2 mg/ml $$\% \text{ of correct folded } MHC = (1 - (2 \text{ mg/ml} / 10 \text{ mg/ml})) * 100\% = 80\%$$

The proportion of correctly folded MHC can be used as quality parameter, to measure the variation from production to production of a specific MHC-peptide complex.

Example 54

This example describes how the quantity of correctly folded MHC can be determined. The test involves specific binding of MHC complexes to anti-HLA-ABC antibody, clone W6/32. In this example W6/32 antibody is immobilized on magnetic beads.

A preparation of MHC complexes is incubated with W6/32 antibody coated magnetic beads and all correctly folded MHCs are thereby captured.

After incubation the beads are sedimented or captured by magnet, d the supernatant withdrawn and the amount of non-bound MHC complex (equal to not correctly folded MHC complex) is determined by ELISA.

To measure the quantity of MHC complexes in solution before and after incubation with W6/32 antibody coated magnetic beads an ELISA assay is applied. A microtiter plate is coated with an antibody recognizing all MHC complexes correct as well as non-correct folded.

Samples of MHC complex before and after incubation with W6/32 antibody coated magnetic beads are added to the coated microtiter plate.

A labeled secondary antibody recognizing MHC (e.g. anti-$\beta_2$m) is used for visualization. Alternatively the secondary antibody is unlabelled, and a labeled molecule specific for the secondary antibody is employed (e.g. EnVision System) before visualization.

The proportion between results from the sample after incubation with W6/32 antibody coated magnetic beads and the sample before incubation with W6/32 antibody coated magnetic beads is a measure of the amount of non correct folded MHC complex and thereby an indirect measure of the amount of correct folded MHC complex. To obtain exact values for the amount of MHC complex in each sample a standard curve can be generated.

Example 55

This example describes how the quantity of correctly folded MHC in a sample can be determined. The example also describes how MHC multimers can be used for detection of TCR immobilized to solid support.

The test involves specific binding of MHC complexes to a molecule recognizing correctly folded MHC complex (e.g. antibody, TCR, aptamers, or other MHC-peptide complex binding molecules). The MHC recognizing molecules can be immobilized to any solid support (e.g. beads, microtiter plate or gel material). Correctly folded MHC complex in a sample is captured by addition of the sample to the immobilized MHC-binding molecule, then non-bound MHC-complex (equal to not correctly folded MHC complex) is removed. The proportion of MHC complex in the two fractions (before and after incubation with immobilized MHC-specific molecule) can be evaluated by any method capable of determination of the total amount of MHC complex (folded or unfolded).

Example 56

This example describes how the quantity of correctly folded MHC in a sample can be determined. The test involves specific binding of MHC complex to a molecule recognizing correctly folded MHC (e.g. antibody, TCR, aptamers, or other MHC-peptide complex binding molecules). The specific binding is evaluated by native protein gel electrophoresis.

A preparation of in vitro folded and purified MHC complex is incubated with a molecule recognizing correctly folded MHC, e.g. the antibody W6/32.

The product is analysed by native protein gel electrophoresis (lane 1) together with a sample of in vitro folded and purified MHC complex not incubated with MHC recognizing molecule (lane 2), and a sample of the molecule recognizing correctly folded MHC (lane 3). In the protein gel the different proteins are separated according to size. The various protein products are visualized in the gel e.g. by Comassie blue staining, isotope or chemiluminescence. In the sample with MHC complex and MHC-binding molecule correctly folded MHC complex will bind the MHC-binding molecule and appear in the protein gel as one or more large bands in the top of the gel. In contrast non-correctly folded MHC complex will appear as monomer lower in the gel. The fraction of not correctly folded MHC (lane 1) can now be compared with the total amount of MHC in the sample (lane 2) and the difference between the two correlates with the amount of correctly folded MHC complex in the sample. The results can be evaluated in different manners to determine the quantity of correctly folded MHC, e.g. comparison of intensity to the intensity of products of known concentration.

Example 57

This example describes how to verify that a MHC-complex is correctly folded by a sandwich-ELISA assay. W6/32 mouse-anti-HLA-ABC antibody (Dako M0736), that recognizes a conformational epitope on correctly folded MHC-complex, was used as coating-antibody. HRP-conjugated rabbit anti-$\beta$2m (Dako PO174) was used for visualization.

Wells of a microtiter plate was pre-coated with W6/32 antibody (Dako M0736, 5 µg/ml in 0.1M NaHCO$_3$, 1 mM MgCl$_2$, pH 9.8, 50 µl/well) following a standard ELISA procedure regarding washes and blocking etc.

After addition of 50 µl of 0.5M Tris-HCl, 0.1 M NaCl, 0.1% Tween 20, 0.01% Bronidox, pH 7.2 to each well, 50 µl of a sample of purified folded MHC-complex (in a concentration of approx. 0.4 mg/ml) was added to two wells in to columns in the microtiter plate, diluted 2-fold down the column and incubated 2 hours at 4° C. Light chain $\beta$2m (0.15 mg/ml in 0.5M Tris-HCl, 0.1 M NaCl, 0.1% Tween 20, 0.01% Bronidox, pH 7.2) was used as negative control and the cell-line KG-1a, expressing HLA-A*30, HLA-A*31 and HLA-B*35 heavy chains, was used as positive control (10$^6$ cells/well).

After a standard ELISA wash, 50 µl of the detecting antibody; HRP-conjugated rabbit anti-$\beta$2m (Dako PO174), diluted 1:2500 in 1% Skimmed Milk in 0.5M Tris-HCl, 0.1 M NaCl, 0.1% Tween 20, 0.01% Bronidox, pH 7.2 was added to each well. The plate was incubated 1 hour at 4° C.

After a standard ELISA wash, 50 µl of an amplifying antibody; HRP-Dextran500-conjugated goat anti-rabbit (Dako DM0106), diluted 1:2000 in 1% Skimmed Milk in 0.5M Tris-HCl, 0.1 M NaCl, 0.1% Tween 20, 0.01% Bronidox, 1% mouse serum (Dako X0190) pH 7.2 was added. The plate was incubated 30 min. at 20° C.

After a standard ELISA wash, 50 µl of Dako S1599 (TMB+Substrat Chromogen) was added to each well for visualization.

After 10 min. the visualization reaction was stopped with 50 µl 0.5M H$_2$SO$_4$/well. The chromogenic intensity was measured at OD$_{450}$ and the result from the ELISA assay evaluated.

As shown in FIG. 17 the OD$_{450}$ values from wells with MHC complex was more than 6 times higher than OD$_{450}$ values from wells with the negative control $\beta$2m. This ELISA procedure can be used to verify the presence of correctly folded MHC-peptide complexes in a preparation of MHC complexes.

Example 58

This example describes the generation and application of negative controls, where the MHC complex is HLA-A*0201 loaded with either of the nonsense peptides GLAGDVSAV (SEQ ID NO 217778) or ALIAPVHAV (SEQ ID NO 217781) and these MHC complexes are coupled to a 270 kDa dextran multimerization domain. The nonsense peptides have an amino acid sequence different from the linear sequence of any peptide derived from any known naturally occurring protein. This was analyzed by a blast search. The amino acids at position 2 and 9 can serve as anchor residues when binding to HLA-A*0201 molecules.

Purified MHC(peptide) molecules consisting of the allele HLA-A*0201, human beta2microglobulin and peptide was generated by in vitro refolding, purified and biotinylated as described elsewhere herein. Biotinylated HLA-A*0201 (peptide) was mixed with APC-SA-conjugated 270 kDa dextran in an amount corresponding to a ratio of three biotinylated HLA-A*0201(peptide) molecules per SA molecule and incubated for 30 minutes in the dark at room temperature. The APC-SA-conjugated 270 kDa dextran contained 9 molecules APC and 3.7 molecules SA per dextran molecule. Following incubation the mixture was diluted into a buffer containing 0.05M Tris/HCl, 15 nM NaN$_3$ and 1% BSA to a final concentration of $3.8 \times 10^{-8}$ M dextran.

By this procedure the following MHC multimer constructs were made: A negative control construct comprising APC-SA-conjugated 270 kDa dextran and biotinylated HLA-A*0201 in complex with beta2microglobulin and the nonsense peptide GLAGDVSAV ((SEQ ID NO 217778) nonsense peptide 1).

A negative control construct comprising APC-SA-conjugated 270 kDa dextran and biotinylated HLA-A*0201 in complex with beta2microglobulin and the nonsense peptide ALIAPVHAV ((SEQ ID NO 217781) nonsense peptide 2).

A construct comprising APC-SA-conjugated 270 kDa dextran and biotinylated HLA-A*0201 in complex with beta2microglobulin and the peptide NLVPMVATV (SEQ ID NO 217779) derived from pp65 protein from human cytomegalovirus (HCMV).

A construct comprising APC-SA-conjugated 270 kDa dextran and biotinylated HLA-A*0201 in complex with beta2microglobulin and the peptide GLCTLVAML (SEQ ID NO 217782) derived from BMLF-1 protein from Epstein Barr virus (EBV).

A construct comprising APC-SA-conjugated 270 kDa dextran and biotinylated HLA-A*0201 in complex with beta2microglobulin and the peptide ILKEPVHGV (SEQ ID NO 217780) Reverse Transcriptase from Human Immunodeficiency Virus (HIV).

The binding of the HLA-A*0201(peptide)/APC dextran constructs to Human Peripheral Blood Mononuclear Cells (HPBMC) from various donors was analyzed by flow cytometry following a standard flow cytometry protocol. Briefly, HPBMC from the blood of 9 individual donors were isolated, by a standard protocol using Ficoll-Hypaque. $1 \times 10^6$ purified HPBMC at a concentration of $2 \times 10^7$ cells/ml were incubated with 10 µl of one of the HLA-A*0201 (peptide)/APC dextran constructs described above for 10 minutes in the dark at room temperature. 10 µl of each of the antibodies mouse-anti-human CD3/PE (clone UCHT1 from Dako) and mouse-anti-human CD8/PB (clone DK25 from Dako) were added and the incubation continued for another 20 minutes at 4° C. in the dark. The samples were then washed by adding 2 ml PBS; pH=7.2 followed by centrifugation for 5 minutes at 200×g and the supernatant removed. The cells were then resuspended in 400-500 µl PBS; pH=7.2 and analyzed on a CYAN ADP flowcytometer.

Donor 1-5 were known to have detectable T cells specific for HLA-A*0201(NLVPMVATV) (SEQ ID NO 217779) and no detectable T cells specific for HLA-A*0201 (ILKEPVHGV) (SEQ ID NO 217780) while donor 6 were known not to have detectable specific T cells for either HLA-A*0201(NLVPMVATV) (SEQ ID NO 217779) nor HLA-A*0201(ILKEPVHGV) (SEQ ID NO 217780). Lymphocytes from these 6 donors were stained with MHC multimer construct 1, 2, 3, and 5. Donor 1-5 showed positive staining with MHC multimer construct 3 as expected while no staining was observed with the either of the negative control MHC complex constructs 1 and 2 or with MHC complex construct 5. An example showing the staining patterns for donor 2 is shown in FIG. 20. No specific staining was observed of lymphocytes from donor 6 with either of the MHC multimer constructs.

Donor 7-8 known to have detectable T cells specific for HLA-A*0201(GLCTLVAML) (SEQ ID NO 217782) and no detectable T cells recognizing HLA-A*0201(ILKEPVHGV) (SEQ ID NO 217780) and donor 9 having no detectable T cells specific for either HLA-A*0201(GLCTLVAML) (SEQ ID NO 217782) nor HLA-A*0201(ILKEPVHGV) (SEQ ID NO 217780) were all stained with MHC multimer construct 1, 2, 4, and 5. Donor 7 and 8 demonstrated efficient staining with MHC multimer construct 4 as expected while no staining was observed with the other MHC multimer constructs tested. No staining was observed of lymphocytes from donor 9 with either of the MHC multimer constructs tested. A summary of the results is shown in FIG. 21.

In conclusion this experiment demonstrates that the negative MHC multimer constructs 1 and 2 did not stain any specific T cells in lymphocyte preparations from 10 different donors. Donors known to have specific T cells for either HLA-A*0201(GLCTLVAML) (SEQ ID NO 217782) or HLA-A*0201(NLVPMVATV) (SEQ ID NO 217779) also demonstrated positive staining with the corresponding MHC multimer constructs 3 and 4. None of the 10 donors were infected with HIV and as expected did not appear to have T cells specific for HLA-A*0201 in complex with the HIV derived peptide ILKEPVHGV (SEQ ID NO 217780), and as expected none of these donors showed staining with MHC multimere construct 5. MHC multimer construct 1 and 2 are therefore suitable negative controls when using HLA-A*0201(peptide) multimers for detection of specific T cells in Flow Cytometry.

Example 59

This is an example of how to generate and use negative controls, where the MHC complex is any MHC I or MHC II complex of human, mouse, rabbit, rat, swine or monkey origin loaded with a nonsense peptide. A nonsense peptide is here to be understood as a peptide having an amino acid sequence different from any peptide derived from any known naturally occurring protein, and preferably is not recognized by any T cell when presented by a MHC complex. The nonsense peptide has amino acid residues at relevant positions that anchor the peptide to the peptide-binding groove of the MHC complex. The MHC(nonsense peptide) complex is coupled to a 270 kDa dextran multimerization domain.

Purified MHC(peptide) molecules consisting of the alpha chain, human beta2microglobulin and peptide is generated by in vitro refolding, purified and biotinylated as described elsewhere. Biotinylated MHC(peptide) is mixed with APC-SA-conjugated 270 kDa dextran in amounts corresponding to a ratio of three biotinylated MHC(peptide) molecules per SA molecule and incubated for 30 minutes in the dark at room temperature. The APC-SA-conjugated 270 kDa dextran contains 9 molecules APC and 3.7 molecules SA per dextran molecule. Following incubation the mixture is diluted into a buffer containing 0.05M Tris/HCl, 15 nM NaN$_3$ and 1% BSA to a final concentration of $3.8 \times 10^{-8}$ M dextran.

By this procedure the following MHC complex constructs are made:

A negative control construct comprising APC-SA-conjugated 270 kDa dextran and biotinylated alpha chain in complex with beta2microglobulin and a corresponding nonsense peptide. A nonsense peptide is here to be understood as a peptide with an amino acid sequence different from any peptide derived from any known naturally occurring protein and the nonsense peptide is not recognized by any T cell when presented by a MHC complex.

A construct comprising APC-SA-conjugated 270 kDa dextran and biotinylated alpha chain in complex with beta2microglobulin and a peptide derived from a known protein.

The binding of the MHC(peptide)/APC dextran constructs to Human Peripheral Blood Mononuclear Cells (HPBMC) from various donors is analyzed by flow cytometry following a standard flow cytometry protocol. Briefly, HPBMC from the blood of 9 individual donors are isolated by a standard protocol using Ficoll-Hypaque. $1 \times 10^6$ purified HPBMC at a concentration of $2 \times 10^7$ cells/ml is incubated with 10 µl of one of the MHC(peptide)/APC dextran constructs described above for 10 minutes in the dark at room temperature. 10 µl of each of the antibodies mouse-anti-human CD3/PE (clone UCHT1 from Dako) and mouse-anti-human CD8/PB (clone DK25 from Dako) are added and the incubation continued for another 20 minutes at 4° C. in the dark. The samples are then washed by adding 2 ml PBS; pH=7.2 followed by centrifugation for 5 minutes at 200×g and the supernatant removed. The washed cells are resuspended in 400-500 µl PBS; pH=7.2 and analyzed on a CYAN ADP flowcytometer.

The staining patterns of flow cytometry analysis with the two MHC(peptide)/APC constructs 1 and 2 are compared. There will be no staining observed with construct 1.

Example 60

This is an example of how to generate negative controls, where the MHC complexes is any MHC I or MHC II molecule of human, mouse, rabbit, rat, swine, monkey or any other origin loaded with a nonsense peptide and where the MHC(nonsense peptide) complexes are coupled to any multimerization domain. A nonsense peptide is here to be understood as a peptide that have an amino acid sequence different from any peptide derived from any known naturally occurring protein and cannot be recognized by any T cell when presented by a MHC complex. The nonsense peptide carries amino acid residues at relevant positions that anchor the peptide to the peptide-binding groove of the MHC complex.

The MHC(nonsense peptide) complex can be made as described elsewhere herein, and can then be coupled to a relevant multimerization domain. The labelling of the multimerization domain can be optimized depending on later use of the negative control e.g. in flow cytometry analysis, IHC, ELISA or similar.

Example 61

This example describes the generation of a negative control, where the MHC complex is HLA-A*0201 coupled to a 270 kDa dextran, and where the MHC is loaded with the peptide ILAKFLHWL that have pivaloyl coupled to Lysine at position 4. ILAKFLHWL is a peptide derived from telomerase and is known to bind HLA-A*0201. Pivaloyl is a small molecule that confers high sterical hindrance. Because pivaloyl is placed at a central position in the peptide it is likely to inhibit or completely abrogate the interaction with a specific TCR, because TCR-recognition is normally directed to the middle of the peptide when bound in the peptide-binding cleft. In the following the pivaloyl-modified peptide will be designated ILAK$^P$FLHWL.

Purified HLA-A*0201(ILAK$^P$FLHWL) molecules consisting of the HLA-A*0201 heavy chain, human beta2microglobulin and ILAKFLHWL peptide is generated by in vitro refolding, purified and biotinylated as described elsewhere herein. Biotinylated HLA-A*0201(ILAK$^P$FLHWL) molecules are mixed with flourochrome-SA-conjugated 270 kDa dextran molecules. The resulting HLA-A*0201(ILAK$^P$FLHWL)/flourochrome-carrying dextran molecules can be used as negative controls in e.g. flow cytometric analysis.

Example 62

This example describes the generation of a negative control, where the MHC complex is any MHC I or MHC II molecule of human, mouse, rabbit, rat, swine, monkey or any other origin loaded with the peptide ILAKFLHWL and coupled to any multimerization domain labeled with fluorochrome, HRP or any other label. Purified MHC(ILAK$^P$FLHWL) complexes consisting of the heavy chain, human beta2microglobulin and ILAKFLHWL peptide is generated by in vitro refolding, purified and biotinylated as described elsewhere herein. Biotinylated MHC(ILAK$^P$FLHWL) complexes are mixed with labeled multimerization domain, thereby generating MHC(ILAK$^P$FLHWL) multimers. The MHC(ILAK$^P$FLHWL) multimers may be used as negative controls in e.g. flow cytometric analysis, IHC, ELISA or similar.

Example 63

This example describes the generation of a negative control where the MHC is HLA-A*0201 loaded with the peptide ILKEPVHGV (SEQ ID NO 217780) and coupled to a 270 kDa dextran multimerization domain. The peptide ILKEPVHGV (SEQ ID NO 217780) is derived from HIV. HLA-A*0201(ILKEPVHGV) (SEQ ID NO 217780) complexes are generated, biotinylated and coupled with a labeled dextran multimerization domain as described elsewhere herein. Then these HLA-A*0201(ILKEPVHGV) (SEQ ID NO 217780)-dextran conjugates are used as negative controls in experiments with samples from humans that are HLA-A*0201 positive and not infected by HIV, because it is not likely that they have T cell's with a TCR specific for HLA-A*0201(ILKEPVHGV) (SEQ ID NO 217780) in amounts that can be detected by MHC multimer reagents. The conjugates can also be used as negative control in samples from humans that are HLA-A*0201 negative or in samples from other species.

Example 64

This example describes the generation of a negative control. CD8 molecules on the surface of cytotoxic T-cells bind MHC I complexes by interaction with amino acids in the α3 domain of the heavy chain. When using MHC multimers this interaction can result in MHC multimer binding to CD8 positive T-cells that are not restricted by the MHC(peptide) complex in the MHC multimer. In this example a proper negative control showing these false positive cells is described. Such a negative control can consist of MHC I heavy chain or truncated versions of MHC I heavy chain bound to any multimerization domain. The heavy chain can be folded or unfolded, and can have a peptide bound in the peptide binding groove but does not have to comprise a peptide. A MHC I heavy chain-multimerization domain can be made in a way similar to what is described for the generation of MHC I-multimerization domains. Briefly, purified MHC I heavy chain is expressed as inclusion bodies in *E. coli* and purified by general procedures. The heavy chain is refolded in vitro, purified and biotinylated, or the heavy chain can be biotinylated directly without refolding. Biotinylated heavy chain is coupled to any multimerization domain. The multimerization domain can be labeled with any suitable label or can be unlabeled depending on later use. Such a negative control can be used in experiments with MHC I multimers, e.g. in flow cytometry analysis, IHC, or ELISA.

Example 65

This example describes how to identify specific T cells in a blood sample with MHC multimers using flow cytometry analysis without lysis of red blood cells and without washing the cells after staining. MHC complexes in this example consisted of HLA-A*0201 heavy chain, human beta2microglobulin and different peptides, and the MHC complexes were coupled to a 270 kDa dextran multimerization domain.

Purified MHC-peptide complexes consisting of human heavy chain, human beta2microglobulin and peptide were generated by in vitro refolding, purified and biotinylated as described elsewhere herein. Biotinylated MHC-peptide complexes were then coupled to a 270 kDa dextran multimerization domain labelled with PE by interaction with streptavidin (SA) on the dextran multimerization domain. The SA-PE-dextran was made as described elsewhere herein. MHC-peptide complexes was added in an amount corresponding to a ratio of three MHC-peptide molecules per SA molecule and each molecule dextran contained 6.1 SA molecule and 3.9 molecules PE. The final concentration of dextran was 3.8×10e-8 M. The following constructs were made:

PE conjugated 270 kDa dextran coupled with HLA-A*0101 in complex with beta2microglobulin and the peptide VTEHDTLLY (SEQ ID NO 217783) derived from Human Cytomegalo Virus (HCMV).

PE conjugated 270 kDa dextran coupled with HLA-A*0101 in complex with beta2microglobulin and the peptide IVDCLTEMY (SEQ ID NO 217784) derived from ubiquitin specific peptidase 9 (USP9).

PE conjugated 270 kDa dextran coupled with HLA-A*0201 in complex with beta2microglobulin and the peptide NLVPMVATV (SEQ ID NO 217779) derived from Human Cytomegalo Virus (HCMV).

PE conjugated 270 kDa dextran coupled with HLA-A*0201 in complex with beta2microglobulin and the peptide ILKEPVHGV (SEQ ID NO 217780) derived from Human Immunodeficiency Virus (HIV).

PE/SA conjugated 270 kDa dextran coupled with HLA-B*0207 in complex with beta2microglobulin and the peptide TPRVTGGGAM (SEQ ID NO 217785) derived from Human Cytomegalo Virus (HCMV).

PE conjugated 270 kDa dextran coupled with HLA-B*0207 in complex with beta2microglobulin and the peptide RPHERNGFTVL (SEQ ID NO 217786) derived from Human Cytomegalo Virus (HCMV).

PE conjugated 270 kDa dextran coupled with HLA-B*0207 in complex with beta2microglobulin and the peptide TPGPGVRYPL (SEQ ID NO 217787) derived from Human Immunodeficiency Virus (HIV).

These seven MHC multimer constructs were used for detection of specific T cells in flow cytometry analysis using a no-lyse no-wash procedure. Blood samples from three individual donors were analyzed. The donors had previously been screened for the presence of specific T cells using a general staining procedure including lysis and wash of the cell sample, and donor one turned out to be positive for HLA*0201 in complex with the peptide NLVPMVATV (SEQ ID NO 217779), donor two were positive for HLA*0101 in complex with the peptide VTEHDTLLY (SEQ ID NO 217783) and donor three were positive for HLA-B*0207 in complex with the peptides TPRVTGG-GAM (SEQ ID NO 217785) and RPHERNGFTVL (SEQ ID NO 217786). In this experiment blood from each donor were analyzed with the MHC multimer construct they were supposed to have specific T cells restricted for and with MHC multimers of same haplotype but carrying a negative control peptide. The negative control peptides were either derived from HIV or the self-protein USP 9. Self-protein here means a naturally occurring protein in normal cells of a human individual. Normal healthy donors not infected with HIV are not expected to have specific T cells recognizing HIV derived peptides or peptides derived from self-proteins in complex with any HLA molecule in an amount detectable with this analysis method.

The blood was stained as follows:
100 μl EDTA stabilized blood were incubated with 5 μl MHC(peptide)/PE dextran for 5 minutes at room temperature. Anti-CD45/PB, anti-CD3/FITC and anti-CD8/APC antibody in an amount of 0.4-1.2 μg/sample was added to each tube and the incubation continued for another 15 minutes. 850 μl PBS; pH=7.2 was added and the sample analyzed on a CyAn ADP flowcytometry instrument with a speed of 150 μl/minute. A total of 20.000 CD8 positive cells were acquired. During analysis CD45/PB antibody was used to set a trigger discriminator to allow the flow cytometer to distinguish between red blood cells and stained white blood cells (see FIG. 22A). Furthermore CD3/FITC antibody was used to select CD3 positive cells in a second gating strategy (see FIG. 22B).

Blood from donor one showed specific staining with HLA-A*0201(NLVPMVATV) (SEQ ID NO 217779) multimer (construct 3) while no staining of specific T cells was observed with the negative control HLA-A*0201 (ILKEPVHGV) (SEQ ID NO 217780) multimer (construct 4). Donor two showed specific staining with HLA-A*0101 (VTEHDTLLY) (SEQ ID NO 217783) multimer (construct 1) and no staining was observed with the negative control HLA-A*0101(IVDCLTEMY) (SEQ ID NO 217784) multimer (construct 2). In blood from donor three a population of T cells were stained with HLA-B*0207(TPRVTGGGAM) (SEQ ID NO 217785) multimer (construct 5) and another population with HLA-B*0207(RPHERNGFTVL) (SEQ ID NO 217786) multimer (construct 6) while no specific staining was observed with the negative control HLA-B*0207 (TPGPGVRYPL) (SEQ ID NO 217787) multimer (construct 7). The results are shown in FIG. 23.

We have shown that MHC multimers of three different haplotypes can be used to identify specific T cells in blood samples from three different donors using an approach without lysing red blood cells and without wash following staining with MHC multimer. This method is simple, fast and interfere as little as possible with cells in the blood sample.

Example 66

This example describes how to identify specific T cells in a blood sample with MHC multimers using flow cytometry analysis without lysis of red blood cells and without washing cells upon staining. The MHC complex is here any MHC I or MHC II molecule of human, rodent, bovine, monkey or any other origin loaded with any peptide able to bind the peptide-binding cleft of the MHC complex and where the MHC-peptide complexes are coupled to any multimerization domain.

Purified MHC-peptide complexes is generated as described elsewhere herein and coupled to any multimerization domain labelled with a fluorescent dye, preferable FITC, PE, APC, pacific blue, cascade yellow or any other flour chrome. These MHC multimers are used for detection of specific T cells by flow cytometry using the following procedure:

EDTA stabilized blood are incubated with MHC multimer at room temperature. The amount of blood analyzed is preferable 50-150 µl but could be any volume ranging from 1-1000 µl. The amount of MHC multimer depends on the multimer construct and the volume of blood and should be determined by titration prior to this type of experiment. The incubation time with MHC multimer is preferably 5-20 minutes but could be anything between 0 minutes and 1 hour. Then anti-CD45/CY, anti-CD3/APC and anti-CD8/PB antibody is added and the incubation continued. The incubation time is preferably 5-20 minutes but can be anything between 1 minute and 1 hour. The amount of antibody is preferable 0.4-1.2 µg/100 µl blood but these limits can be extended and should be determined by titration prior to this kind of experiments. The antibodies can be labelled with any fluorochrome as long as the fluorochrome is different from the fluorochrome on the MHC multimer. Next PBS; pH=7.0-8.0 is added and the sample analyzed by a flowcytometer. The amount of PBS added is preferable 500-1000 µl but can also be more than 1000 µl and less than 500 µl. During analysis anti-CD45 antibody is used to set a trigger discriminator to allow the flow cytometer to distinguish between red blood cells and stained white blood cells. Different gating strategies can then be applied to analyse data. Preferably cells are first gated on CD3 positive cells and then for CD8 positive cells, but can also be gated only for CD8 positive cells of only for CD3 positive cells. Alternatively "dump" gates can be applied excluding unwanted cells, e.g. B-cells, CD4-positive cells, NK-cells.

In the above example MHC multimers are added prior to antibodies but MHC multimers and antibodies can also be added simultaneously to the blood sample and incubated for preferably 5-30 minutes but the incubation time can be anything between 1 minute and 2 hours.

This method can be used to identify specific T cells in blood samples from different donors using an approach without lysing red blood cells and without wash following staining with MHC multimer. This method is simple, fast and interfere as little as possible with cells in the blood sample

Example 67

This example illustrates how MHC multimers together with counting beads was used for exact numeration of MHC-peptide specific T cells in a flow cytometry analysis whit no lyses of red blood cells and no washing steps during or after staining. Counting beads in this example was CytoCount™, Count Control Beads from Dako that are polystyrene Fluorospheres with a diameter of 5.2 µm. The MHC multimer consisted of HLA-A*0101 heavy chain complexed with human beta2microgloblin and a peptide and the MHC-peptide complexes were coupled to a 270 kDa dextran multimerization domain labelled with PE. MHC multimers were generated as described elsewhere herein and the following two constructs were made:

PE conjugated 270 kDa dextran coupled with HLA-A*0101 in complex with beta2microglobulin and the peptide VTEHDTLLY (SEQ ID NO 217783) derived from Human Cytomegalo Virus (HCMV).

PE conjugated 270 kDa dextran coupled with HLA-A*0101 in complex with beta2microglobulin and the peptide IVDCLTEMY (SEQ ID NO 217784) derived from ubiquitin specific peptidase 9 (USP9).

Construct 2 is a negative control for construct 1 in this example and both were used for detection of specific T cells by flow cytometry using a no-lyse no-wash procedure: 100 µl of EDTA stabilized blood from a donor positive for HLA*0101 in complex with the peptide VTEHDTLLY were incubated with 5 µl MHC multimer for 5 minutes at room temperature. Anti-CD45/CY, anti-CD3/PB and anti-CD8/APC antibody in an amount of 0.4-1.2 µg/sample was added and the incubation continued for another 15 minutes. 850 µl PBS; pH=7.2 was added together with precise 50 µl Cyto-Count beads 1028 bead/µl and the sample analyzed on a CyAn ADP flowcytometry instrument with a speed of 150 µl/minute. A total of 20.000 CD8 positive cells were acquired. During analysis CD45/CY antibody was used to set a trigger discriminator to allow the flow cytometer to distinguish between red blood cells and stained white blood cells. A dot plot was made for each sample showing MHC multimer vs CD8 positive events (see FIGS. 24 A and B). Based on the negative control a gate containing events representing CD8 positive T cells specific for MHC multimer was defined. Similarly histogram plots for each sample were made showing FITC signal vs counts (FIGS. 24 C and D). In these histograms the amount of beads in the analyzed sample were identified since the beads in contrast to the cells emit light in the FITC channel. In principle the beads could be visualized in any fluorochrome channel because they emit light in all channels but it was important to visualize the beads in a channel where there was no interfering signal from labelled cells.

The concentration of T cells specific for HLA-A*0101 (VTEHDTLLY) (SEQ ID NO 217783) multimer (construct 1) in the blood sample were determined using the counting beads as an internal standard. Events obtained from staining with the negative control MHC multimer, construct 2, were defined as background signals and subtracted from the result obtained from staining with construct 1.

Concentration of HLA-A*0101(VTEHDTLLY) (SEQ ID NO 217783) specific T cells in the blood sample=((Count of MHC multimer+CD8+positive cells, construct 1×concentration of beads x dilution factor of beads)/counted beads))−((Counted MHC multimer+CD8+ cells, construct 2×concentration of beads×dilution factor of beads)/counted beads)=992.6 cells/ml For details see FIG. 24.

This experiment demonstrated how CytoCount™ counting beads together with MHC multimers could be used to determine the exact concentration of MHC-peptide specific T cells in a blood sample using a no-lyse no-wash method.

Example 68

This example describes an analysis of specific T cells in blood using MHC multimers where MHC multimers together with antibodies are pre-mixed and embedded in a matrix material to retain and immobilize the reagents prior to use. In this example the matrix was composed of Trehalose and Fructose and the MHC complex consisted of HLA-A*0101 heavy chain complexed with human beta2microglobulin and peptide. The MHC-peptide complexes were coupled to a 270 kDa dextran multimerization domain.

Purified MHC-peptide complexes consisting of heavy chain, human beta2microglobulin and peptide were generated by in vitro refolding, purified and biotinylated as described elsewhere herein. Biotinylated MHC(peptide) complexes were coupled to a 270 kDa dextran multimerization domain labelled with PE, thereby generating PE labelled MHC multimers. The following MHC multimer constructs were made:

PE conjugated 270 kDa dextran coupled with HLA-A*0101 in complex with beta2microglobulin and the peptide VTEHDTLLY (SEQ ID NO 217783) derived from Human Cytomegalo Virus (HCMV).

PE conjugated 270 kDa dextran coupled with HLA-A*0101 in complex with beta2microglobulin and the negative control peptide IVDCLTEMY (SEQ ID NO 217784) derived from ubiquitin specific peptidase 9 (USP9).

Tubes with a matrix material to retain and immobilize the above described MHC multimer constructs together with antibodies relevant for later flow cytometer analysis were made. The matrix material was made to retain MHC multimer and antibody in the container when dry but release them into the sample medium when a sample containing cells of interest was added to the tube.

Experimentally, solutions of 20% Fructose in water and 20% Trehalose in water were made and mixed in a 1:1 ratio. 15 µl of this mixture were transferred to two 5 ml Falcon tubes. A premix of antibodies were made consisting of 40 µl anti-CD8 Alexa700 labelled antibody in a concentration of 25 µg/ml+40 µl anti-CD3 Pacific Blue labelled antibody in a concentration of 100 µg/ml+160 µl anti-CD45 Cascade Yellow labelled antibody in a concentration of 200 µg/ml. 12 µl of this mixture were added to each Falcon tube together with 3 µl of either of the two MHC multimer constructs. 100 µl butylated hydroxytoluen (BHT) with a concentration of 99 mg/L were added. The mixtures were dried under vacuum a 2-8° C. over night. 100 µl EDTA stabilized blood from a donor with T cells specific for HLA-A*0101 complexed with the peptide VTEHDTLLY (SEQ ID NO 217783) were added to each of the two tubes. As a control experiment 6 µl of the antibody premix described above were transferred to two empty 5 ml Falcon tubes together with 3 µl of either of the MHC multimer constructs and 100 µl blood from the same donor. All four tubes were incubated for 15 minutes at room temperature. Then 900 µl PBS; pH=7.2 was added and the sample analyzed on a CyAn ADP flowcytometer instrument.

A total of 20.000 CD8 positive cells were acquired for each sample. During analysis CD45/CY antibody was used to set a trigger discriminator to allow the flow cytometer to distinguish between red blood cells and stained white blood cells.

As expected and shown in FIG. 25 a population of CD8 positive and HLA-A*0101(VTEHDTLLY) (SEQ ID NO 217783) multimer positive cells were observed in the two samples stained with construct 1. The amount of specific T cells detected in the matrix sample was comparable to the amount of specific T cells detected in the control sample without matrix material. No HLA-A*0101(IVDCLTEMY) (SEQ ID NO 217784) multimer specific CD8 positive cells were observed in the two samples stained with the negative control MHC multimer construct 2.

This experiment demonstrates that the MHC multimer constructs used in this experiment can be embedded in a sugar matrix and later used for analysis of specific T cells in a blood sample and that this method gives results comparable to results obtained from a no-lyse no-wash staining procedure.

Example 69

This example describes an analysis of specific T cells in blood or other samples with cells in solution using MHC multimers where MHC multimers together with antibodies are pre-mixed and embedded in a matrix material to retain and immobilize the reagents prior to use. In this example the matrix is composed of Trehalose and Fructose and the MHC multimer is any MHC I, MHC II or MHC like molecule.

Tubes with a matrix material to retain and immobilize MHC multimer constructs together with antibodies relevant for later flow cytometer analysis are made. The matrix material is made to retain MHC multimer and antibody in the container when dry but release them into the sample medium when a sample containing cells of interest is added to the tube. The matrix is preferable water-soluble sugar mixtures but can be any contiguous mass releasing its components upon addition of aqueous solution. The matrix embedding medium can comprise one or more compounds including carbohydrates, polymers, small proteins etc. Examples of carbohydrates for use in the matrix include saccharose, arabinose, ribulose, fructose, sorbose, glucose, mannose, gulose, galactose, sucrose, lactose, maltose, trehalose, raffinose and melizitose. Examples of suitable polymers for use in matrix include polyvinyl alcohols, polyethylene glycols, polyethylene imines, polyacryl amides, polyaziridines, glycols, polyacrylic acids, esters or derivatives thereof. Examples of small proteins include BSA, other albumins or protein fragments.

The matrix-embedding medium is transferred to tubes preferable 5 ml tubes or other tubes usable in flow cytometry. Fluorochrome antibodies are added and here means any antibody useable for gating when analysing samples with T lymphocytes. Preferable antibodies are directed against CD8, CD4, CD3, CD45, CD27, CD28, CD45RA, CD45R0 and CD62L. Then MHC multimer constructs are added but can also be added simultaneously with the antibodies or before the antibodies. Addition of MHC multimer is not restricted to one type of MHC multimer but several different MHC multimers can be added to the same tube and thereby embedded in the same matrix sample. Optionally scavengers for oxygen-derived radicals can be added. Examples of such radical scavengers are ascorbic acid, beta-carotene, bilirubin, butylated hydroxytoluene, butylated hydroxyanisol, tert-butylhydroquinone, d-alpha-tocopherol, trolox and hydroxyanisol. The matrix mixtures are then dried under vacuum a 2-8° C. over night.

Cell samples in solution are added to the dry or semidry matrix tubes. Cell samples here means any sample containing specific T cells. That is preferable whole blood, homogenized spleen, lymph nodes, tumors or similar or purified lymphocytes from any of the above. The samples are incubated at room temperature for 1 minute to 2 hours, preferable 10-30 minutes. They can also be incubated at 4° C. or 37° C. or any temperature in between those two. The samples are analyzed on a flowcytometry instrument.

As an alternative to the above described method MHC multimers can be added to the sample after addition of cell sample thereby only embedding antibodies and not MHC multimer in the matrix. Similarly only MHC multimer are embedded in the matrix and antibodies added after addition of cell sample.

For enumeration of specific T cells in the samples counting beads can be embedded in the matrix medium. The beads are then added before, together with or after adding antibodies and MHC multimer. Alternatively counting beads are added following incubation with cell sample. The exact amount of specific T cells are determined as described elsewhere herein.

Example 70

This is an example of how to make and use MHC multimers where the multimerization domain is dextran and the MHC complexes are chemically conjugated to the dextran multimerization domain.

MHC complexes consisting of HLA-A*0201 heavy chain, beta2microglobulin and NLVPMVATV (SEQ ID NO 217779) peptide or the negative control peptide GLAGDVSAV (SEQ ID NO 217778) are generated as described elsewhere herein. Dextran with a molecular weight of 270 kDa is activated with divinylsulfone. Activated Dextran is then incubated with MHC and RPE in a 0.05 M NaCHO$_3$ buffer; pH=9.5 with a molar ratio between MHC and Dextran of 30-60 and a molar ratio between RPE and dextran of 3-7:1 The mixture is placed in a water bath at 30° C. for 16 hours. Excess flourochrome, MHC and dextran are removed by FPLC using a sephacryl S-300 column.

These MHC/RPE dextramers are then used to stain CMV specific T cells in a flow Cytometry experiment. Briefly, 1×10$^6$ purified HPBMC from a donor with T cells specific for HLA-A*0201(NLVPMVATV) (SEQ ID NO 217779) are incubated with 10 µl of each of the two HLA-A*0201 (peptide)/RPE constructs described above for 10 minutes in the dark at room temperature with a cell concentration of 2×10$^7$ cells/ml. 10 µl mouse-anti-human CD8/PB antibody (clone DK25 from Dako) are added and the incubation continued for another 20 minutes at 4° C. in the dark. The samples are then washed by adding 2 ml PBS; pH=7.2 followed by centrifugation for 5 minutes at 200×g and the supernatant removed. The cells are then resuspended in 400-500 µl PBS; pH=7.2 and analyzed on a flow cytometer.

Example 71

This is an example of how to make and use MHC multimers where the multimerization domain is dextran and MHC complexes are MHC I molecules chemically conjugated to dextran multimerization domain and the dextran multimerization domain also have fluorochrome chemically coupled.

Human beta2microglobulin is coupled to dextran as follows. Dextran with a molecular weight of 270 kDa is activated with divinylsulfone. Activated dextran is incubated with human beta2microglobulin and RPE in a 0.05 M NaCHO$_3$ buffer; pH=9.5 with a molar ratio between beta2microglobulin and Dextran of 30-60 and a molar ratio between RPE and dextran of 3-7:1. The molar ratio of the final product is preferable 4-6 RPE and 15-24 beta2microglobulin per dextran. The mixture is placed in a water bath at 30° C. for 16 hours. Excess flourochrome, beta2microglobulin and dextran are removed by FPLC using a sephacryl S-300 column. The beta2microglobulin-RPE-dextran construct is then refolded in vitro together with heavy chain and peptide using the following procedure. 200 ml refolding buffer (100 mM Tris, 400 mM L-arginin-HCL, 2 mM NaEDTA, 0.5 mM oxidized Gluthathione, 5 mM reduced Glutathione, pH 8.0) supplied with protease inhibitors PMSF, Pepstatin A and Leupeptin (to a final concentration of 1 mM, 1 mg/l and 1 mg/l, respectively) is made and cooled to 10° C. 12 mg NLVPMVATV (SEQ ID NO 217779) peptide is dissolved in DMSO and added to the refolding buffer together with 20-30 mg beta2microglobulin-RPE-dex and 6 mg HLA-A*0201 heavy chain. Incubation at 10° C. for 4-8 hours, then 20-30 mg beta2microglobulin-RPE-dex and 6 mg HLA-A*0201 heavy chain is added and incubation continued for 4-8 hours.

Another 20-30 mg beta2microglobulin-RPE-dex and 6 mg HLA-A*0201 heavy chain is added and incubation continued for 6-8 hours. The folding reaction is filtrated through a 0.2 µm filter to remove larger aggregates and then buffer exchanged into a buffer containing 20 mM Tris-HCl, 50 nM NaCl; pH=8.0 followed by concentration to 1-2 ml sample. Dextran-RPE-MHC complexes are then separated from excess heavy chain and peptide by size exclusion chromatography using a sephacryl S-300, S-400 or sephacryl S-500 column.

These MHC/RPE dextramers can be used to stain CMV specific T cells in a flow Cytometry experiment. Briefly, 1×10$^6$ purified HPBMC from a donor with T cells specific for HLA-A*0201(NLVPMVATV (SEQ ID NO 217779)) are incubated with 10 µl of each of the two HLA-A*0201 (peptide)/RPE constructs described above for 10 minutes in the dark at room temperature with a cell concentration of 2×10$^7$ cells/ml. 10 µl of mouse-anti-human CD8/PB antibody (clone DK25 from Dako) are added and the incubation continued for another 20 minutes at 4° C. in the dark. The samples are then washed by adding 2 ml PBS; pH=7.2 followed by centrifugation for 5 minutes at 200×g and the supernatant removed. The cells are then resuspended in 400-500 µl PBS; pH=7.2 and analyzed on a flowcytometer.

Example 72

This is an example of how MHC multimers may be used for diagnosis of Lyme Disease in blood samples from humans infected with *Borrelia* bacteria. The MHC multimer used are MHC complexes coupled to labeled dextran.

Lyme disease is caused by infection by *Borrelia* bacteria. During acute infection *Borrelia* specific activated T cells will be present in increased amounts in an activated state compared to healthy individuals. The presences of an increased amount of activated *Borrelia* specific T cells may thereby act as a surrogate marker for infection with *Borrelia* bacterium. MHC multimers carrying *Borrelia* specific antigenic peptides is in this example used to detect the presence of *Borrelia* specific T cells in the blood of a patient infected with *Borrelia*.

Purified MHC-peptide complexes consisting of HLA-A*0201 heavy chain, human beta2microglobulin and peptide derived from regions in Outer surface protein B conserved among the three species *Borrelia burgdorferi*, *Borrelia garinii* and *Borrelia afzelii* or a negative control peptide were generated by in vitro refolding, purified and biotinylated as described elsewhere herein. Biotinylated MHC-peptide complexes were then coupled to a 270 kDa dextran multimerization domain labelled with APC by interaction with streptavidin (SA) on the dextran multimerization domain. The dextran-APC-SA multimerization domain was generated as described elsewhere herein. MHC-peptide complexes were added in an amount corresponding to a ratio of three MHC-peptide molecules per SA molecule and each molecule dextran contained 3.7 SA molecule and 8.95 molecules APC. The final concentration of dextran was 3.8×10e-8 M. The following MHC(peptide)/APC dextran constructs were made:

APC-SA conjugated 270 kDa dextran coupled with HLA-A*0201 in complex with beta2microglobulin and the peptide FLTDGTITV derived from OspB.

APC-SA conjugated 270 kDa dextran coupled with HLA-A*0201 in complex with beta2microglobulin and the peptide SITDDLNTI derived from OspB.

APC-SA conjugated 270 kDa dextran coupled with HLA-A*0201 in complex with beta2microglobulin and the peptide KIKDFVFLT derived from OspB APC-SA conjugated 270 kDa dextran coupled with HLA-A*0201 in complex with beta2microglobulin and the nonsense peptide GLAGDVSAV (SEQ ID NO 217778).

The binding of the above described MHC(peptide)/APC dextran can be used to determine the presence of Osp B specific T cells in the blood from *Borrelia* infected individuals by flow cytometry following a standard flow cytometry protocol.

Blood from a patient with Lyme disease is isolated and 100 ul of this blood is incubated with 10 μl of one of the MHC(peptide)/APC dextran constructs described above for 10 minutes in the dark at room temperature. 5 μl of each of each of the antibodies mouse-anti-human CD3/PB (clone UCHT1 from Dako) and mouse-anti-human CD8/PE (clone DK25 from Dako) are added and the incubation continued for another 20 minutes at 4° C. in the dark. The samples are then washed by adding 2 ml PBS; pH=7.2 followed by centrifugation for 5 minutes at 200×g and the supernatant removed. The washing step is repeated. The washed cells are resuspended in 400-500 μl PBS; pH=7.2 and analyzed on flowcytometer.

The presence of cells labeled with anti-CD3/PB, anti-CD8/PE and either of the MHC(peptide)/APC dextran constructs 1, 2 or 3 described above and thereby the presence of *Borrelia* specific T cells will indicate that the patient are infected with *Borrelia* bacteria. Blood analysed with MHC (peptide)/APC dextran construct 4 should show no staining of CD3 and CD8 positive cells with this MHC(peptide)/APC dextran construct.

The sensitivity of the above described diagnostic test may be enhanced by addition of labeled antibodies specific for activation markers expressed in or on the surface of the *Borrelia* specific T cells.

Example 73

This is an example of how MHC multimers may be used for diagnosis of Lyme Disease in blood samples from humans infected with *Borrelia* bacteria. The MHC multimer used are MHC complexes coupled to the multimerisation domain Streptavidin (SA). Lyme disease is caused by infection by *Borrelia* bacteria. During acute infection *Borrelia* specific activated T cells will be present in increased amounts in an activated state compared to healthy individuals. The presences of an increased amount of activated *Borrelia* specific T cells may thereby act as a surrogate marker for infection with *Borrelia* bacterium. MHC multimers carrying *Borrelia* specific antigenic peptides is in this example used to detect the presence of *Borrelia* specific T cells in the blood of patients infected with *Borrelia.*

Purified MHC-peptide complexes consisting of HLA-A*0201 heavy chain, human beta2microglobulin and peptide derived from regions in Outer surface protein B conserved among the three species *Borrelia burgdorferi, Borrelia garinii* and *Borrelia afzelii* or a negative control peptide were generated by in vitro refolding, purified and biotinylated as described elsewhere herein. Biotinylated MHC-peptide complexes are then coupled SA labelled with APC. MHC-peptide complexes were added in an amount corresponding to a ratio of 5 MHC-peptide molecules per SA molecule. Then SA/APC carrying four MHC complexes were purified from free SA, free monomeric MHC complex, SA carrying three, two and one MHC complexes.

The following SA-MHC(peptide)/APC tetramers are made:

APC-SA coupled with HLA-A*0201 in complex with beta2microglobulin and the peptide FLTDGTITV derived from OspB.

APC-SA coupled with HLA-A*0201 in complex with beta2microglobulin and the peptide SITDDLNTI derived from OspB.

APC-SA coupled with HLA-A*0201 in complex with beta2microglobulin and the peptide KIKDFVFLT derived from OspB APC-SA coupled with HLA-A*0201 in complex with beta2microglobulin and the non-sense peptide GLAGDVSAV (SEQ ID NO 217778).

The binding of the above described MHC(peptide)/APC dextran can be used to determine the presence of Osp B specific T cells in the blood from *Borrelia* infected individuals by flow cytometry following a standard flow cytometry protocol.

Blood from a patient with Lyme disease is isolated and 100 ul of this blood is incubated with either of the four SA-MHC(peptide)/APC tetramers described above for 10 minutes in the dark at room temperature. 5 μl of each of each of the antibodies mouse-anti-human CD3/PB (clone UCHT1 from Dako) and mouse-anti-human CD8/PE (clone DK25 from Dako) are added and the incubation continued for another 20 minutes at 4° C. in the dark. The samples are then washed by adding 2 ml PBS; pH=7.2 followed by centrifugation for 5 minutes at 200×g and the supernatant removed. The washing step is repeated. The washed cells are resuspended in 400-500 μl PBS; pH=7.2 and analyzed on flowcytometer.

The presence of cells labeled with anti-CD3/PB, anti-CD8/PE and either of the SA-MHC(peptide)/APC tetramers 1, 2 or 3 described above and thereby the presence of *Borrelia* specific T cells will indicate that the patient are infected with *Borrelia* bacteria. Blood analysed with SA-MHC(peptide)/APC tetramers 4 should show no staining of CD3 and CD8 positive cells with this SA-MHC(peptide)/APC tetramer.

The sensitivity of the above described diagnostic test may be enhanced by addition of labeled antibodies specific for activation markers expressed in or on the surface of the *Borrelia* specific T cells.

Example 74

This is an example of how MHC multimers may be used for diagnosis of Lyme Disease in blood samples from humans infected with *Borrelia* bacteria. The MHC multimer used MHC complexes coupled to any multimerisation as described elsewhere herein. Lyme disease is caused by infection by *Borrelia* bacteria. During acute infection *Borrelia* specific activated T cells will be present in increased amounts in an activated state compared to healthy individuals. The presences of an increased amount of activated *Borrelia* specific T cells may thereby act as a surrogate marker for infection with *Borrelia* bacterium. MHC multimers carrying *Borrelia* specific antigenic peptides is in this example used to detect the presence of *Borrelia* specific T cells in the blood of a patient infected with *Borrelia*.

Purified MHC-peptide complexes consisting of HLA-A*0201 heavy chain, human beta2microglobulin and peptide derived from regions in Outer surface protein B conserved among the three species *Borrelia burgdorferi, Borrelia garinii* and *Borrelia afzelii* or a negative control peptide were generated by in vitro refolding and purified or purified from antigen presenting cells. MHC-peptide complexes are then coupled to a multimerisation domain together with APC.

The following MHC(peptide)/APC multimers are made:

APC-multimerisation domain coupled with HLA-A*0201 in complex with beta2microglobulin and the peptide FLTDGTITV derived from OspB.

APC-multimerisation domain coupled coupled with HLA-A*0201 in complex with beta2microglobulin and the peptide SITDDLNTI derived from OspB.

APC-multimerisation domain coupled coupled with HLA-A*0201 in complex with beta2microglobulin and the peptide KIKDFVFLT derived from OspB APC-multimerisation domain coupled coupled with HLA-A*0201 in complex with beta2microglobulin and the non-sense peptide GLAGDVSAV (SEQ ID NO 217778).

The binding of the above described MHC(peptide)/APC multimers can be used to determine the presence of Osp B specific T cells in the blood from *Borrelia* infected individuals by flow cytometry following a standard flow cytometry protocol. Blood from a patient with Lyme disease is isolated and 100 ul of this blood is incubated with either of the four MHC(peptide)/APC multimers described above for 10 minutes in the dark at room temperature. 5 µl of each of each of the antibodies mouse-anti-human CD3/PB (clone UCHT1 from Dako) and mouse-anti-human CD8/PE (clone DK25 from Dako) are added and the incubation continued for another 20 minutes at 4° C. in the dark. The samples are then washed by adding 2 ml PBS; pH=7.2 followed by centrifugation for 5 minutes at 200×g and the supernatant removed. The washing step is repeated. The washed cells are resuspended in 400-500 µl PBS; pH=7.2 and analyzed on flowcytometer.

The presence of cells labeled with anti-CD3/PB, anti-CD8/PE and either of the MHC(peptide)/APC multimers 1, 2 or 3 described above and thereby the presence of *Borrelia* specific T cells will indicate that the patient are infected with *Borrelia* bacteria. Blood analysed with MHC(peptide)/APC multimer 4 should show no staining of CD3 and CD8 positive cells with this SA-MHC(peptide)/APC tetramer.

The sensitivity of the above described diagnostic test may be enhanced by addition of labeled antibodies specific for activation markers expressed in or on the surface of the *Borrelia* specific T cells.

Example 75

This is an example of how MHC multimers may be used for diagnosis of Lyme Disease in blood samples from humans infected with *Borrelia* bacteria. This is an example of indirect detection of individual specific T cells by measurement of produced soluble factor.

The MHC multimer used are antigen presenting cells expressing MHC molecules complexed with peptides derived from *Borrelia* antigen.

Lyme disease is caused by infection by *Borrelia* bacteria. During acute infection *Borrelia* specific activated T cells will be present in increased amounts in an activated state compared to healthy individuals. The presences of an increased amount of activated *Borrelia* specific T cells may thereby act as a surrogate marker for infection with *Borrelia* bacterium. MHC multimers carrying *Borrelia* specific antigenic peptides is in this example used to detect the presence of *Borrelia* specific T cells in the blood of a patient infected with *Borrelia*.

Activated effector T cells can be detected directly, via their secretion of cytokines, when presented with specific antigens. In this example the activation of individual effector T cells is detected by measurement of cytokines secreted from each individual T cell by capturing of the secreted cytokines in the proximity of each cell. The effector T cells secrete specific cytokine in response to stimulation by peptides from the *Borrelia* antigen OspB when these peptides are presented by antigen presenting cells, briefly:

A patient's blood sample is collected ficoll purified using a Vacutainer Cell Preparation Tubes™, which are spun to separate white blood cells, known as peripheral blood mononuclear cells (PBMCs)

PBMCs are washed in culture media to remove any background interference, counted to correct for a patient's immune status, and added in even amounts to the wells of a 96-well microtiter plate. These plate wells are pre-coated with a monoclonal antibody specific for the cytokine INFγ released by effector T cells in response to contact with specific antigens presented on antigen presenting cells (e.g. B cells that are a population in the PBMC pool)

The peptides FLTDGTITV, SITDDLNTI and KIKDFVFLT all derived from OspB from *Borrelia* bacteria are added to the appropriate wells to stimulate cytokine release (positive and nil controls are used as internal assay controls). A negative control is a non-sense peptide unable to stimulate antigen-specific T cells.

The assay plate is placed in a $CO_2$ incubator overnight to allow the effector T cells to encounter the antigen.

The plates are washed, removing both the T cells and the antigen from the wells and leaving any T cell secreted cytokine captured by the antibodies lining the wells.

An enzyme-conjugated secondary antibody that binds to another epitope on the captured cytokine is then added and incubated for 1 hour at room temperature.

The plates are washed to remove unbound secondary antibody.

Coloured spots are generated by the conjugated enzyme upon application of a colorimetric substrate. These spots reveal a footprint of the antigen-specific effector T cells in the sample.

The spots are counted to determine the number of T cells in the sample that reacted to the antigen relative to the negative control, thereby identifying infection.

Example 76

This is an example of how MHC multimers may be used for diagnosis of Lyme Disease in blood samples from humans infected with *Borrelia* bacteria. This is an example of indirect detection of a population of specific T cells by measurement of produced soluble factor.

The MHC multimer used are antigen presenting cells expressing MHC molecules complexed with peptides derived from *Borrelia* antigen.

Lyme disease is caused by infection by *Borrelia* bacteria. During acute infection *Borrelia* specific activated T cells will be present in increased amounts in an activated state compared to healthy individuals. The presences of an increased amount of activated *Borrelia* specific T cells may thereby act as a surrogate marker for infection with *Borrelia* bacterium. MHC multimers carrying *Borrelia* specific antigenic peptides is in this example used to detect the presence of *Borrelia* specific T cells in the blood of a patient infected with *Borrelia*.

Activated effector T cells can be detected directly, via their secretion of cytokines, when presented with specific antigens. In this example the activation of a pool of effector T cells is detected by measurement of cytokines secreted from the activated T cells in the analysed sample. In this example the effector T cells secrete the cytokine INFγ in response to stimulation by peptides derived from the *Borrelia* antigen OspB when these peptides are presented by antigen presenting cells.

Briefly, the procedure is as follows: Blood is collected in a heparin-containing tube, then the sample is aliquotated into the wells of a microtiterplate. Appropriate wells are incubated with the peptides FLTDGTITV, SITDDLNTI and KIKDFVFLT all derived from OspB from *Borrelia* bacteria within 12 hours of blood collection. Mix on a shaker, incubate for a day-ish. The supernatant plasma, is transferred to wells of another microtiterplate in various dilutions. The wells of the microtiterplate are previously coated with antibody specific for INFγ. An IFN-gamma standard dilution series is included as positive control. Mix, incubate, wash six times. An enzyme-conjugated secondary antibody that binds to another epitope on the captured INF is then added and incubated for 1 hour at room temperature Add enzyme substrate solution, incubate, add enzyme stopping solution. The OD of each well is determined. The OD value may be correlated to the amount of INF-gamma in the sample which is a surrogate marker for the presence of activated *Borrelia* specific T cells in the sample. The presence of activated *Borrelia* specific T cells in the sample is a surrogate marker for infection Example 77

This is an example of how MHC multimers may be used for diagnosis of Lyme Disease in blood samples from humans infected with *Borrelia* bacteria. The MHC multimer used are MHC complexes coupled to labeled dextran, where the MHC molecules are complexed with peptides derived from *Borrelia* antigen.

Lyme disease is caused by infection by *Borrelia* bacteria. During acute infection *Borrelia* specific activated T cells will be present in increased amounts in an activated state compared to healthy individuals. The presences of an increased amount of activated *Borrelia* specific T cells may thereby act as a surrogate marker for infection with *Borrelia* bacterium. MHC multimers carrying *Borrelia* specific antigenic peptides is in this example used to detect the presence of *Borrelia* specific T cells in the blood of a patient infected with *Borrelia*.

Activated effector T cells can be detected directly, via their production of cytokines, when presented with specific antigens. In this example the activation of individual effector T cells is detected by measurement of the intracellular production of cytokines in individual T cell in response to stimulation by peptides from the *Borrelia* antigen OspB when these peptides are presented by antigen presenting cells.

Briefly, a patient's blood sample is collected ficoll purified using a Vacutainer Cell Preparation Tubes™, which are spun to separate white blood cells, known as peripheral blood mononuclear cells (PBMCs)

PBMCs are washed in culture media to remove any background interference, counted to correct for a patient's immune status, and added in even amounts to the wells of cell culture plate.

The peptides FLTDGTITV, SITDDLNTI and KIKDFVFLT all derived from OspB from *Borrelia* bacteria are added to the appropriate wells to stimulate cytokine release (positive and nil controls are used as internal assay controls). A negative control is a non-sense peptide unable to stimulate antigen-specific T cells.

The assay plate is placed in a $CO_2$ incubator overnight to allow the effector T cells to encounter the antigen.

T cells from each well of the plate is transferred to 12×75 mm polystyrene test tubes and then analysed by flow cytometry using a procedure allowing for intracellular staining:

5 µl of each of each of the antibodies mouse-anti-human CD3/PB (clone UCHT1 from Dako) and mouse-anti-human CD8/PE (clone DK25 from Dako) are added to each sample and incubated for 20 minutes at room temperature in the dark. The samples are then washed by adding 2 ml PBS; pH=7.2 followed by centrifugation for 5 minutes at 200×g and the supernatant removed.

5 µl of each of each of the antibodies mouse-anti-human CD3/PB (clone UCHT1 from Dako) and mouse-anti-human CD8/PE (clone DK25 from Dako) are added to each sample and incubated for 20 minutes at room temperature in the dark.

The samples are then washed by adding 2 ml PBS; pH=7.2 followed by centrifugation for 5 minutes at 200×g and the supernatant removed.

Fixative is added. Mix gently with a vortex mixer to ensure that the cells are in suspension.

Incubate in the dark at room temperature for 15 minutes.

The samples are then washed by adding 2 ml PBS; pH=7.2 followed by centrifugation for 5 minutes at 200×g and then aspirate the supernatant, leaving approximately 50 µL of fluid. Mix thoroughly to ensure that the cells are in suspension.

Permeabilization reagent is added, to each test tube. Add an appropriate volume of fluorochrome-conjugated antibody specific for the intracellular antigen to be stained. Mix gently to ensure that the cells are in suspension.

Incubate in the dark at room temperature for 15 minutes.

The samples are then washed by adding 2 ml PBS; pH=7.2 followed by centrifugation for 5 minutes at 200×g and the supernatant removed.

Resuspend the pellet in an appropriate fluid for flow cytometric analysis.

Analyze on a flow cytometer

The presence of cells labeled with anti-CD3/PB, anti-CD8/PE and the antibody used for intracellular staining are cells that have been activated by *Borrelia* antigens and are thereby *Borrelia* specific T cells. The presence of activated *Borrelia* specific T cells in the sample is a surrogate marker for infection.

The sensitivity of the above described diagnostic test may be enhanced by addition of flourochrome labeled MHC multimers able to measure antigen-specific T cells and/or by addition of labeled antibodies specific for activation markers expressed in or on the surface of the *Borrelia* specific T cells.

Example 78

This is an example of a CTL killing assay.

T cell clones can be tested for specificity for a given *Borrelia* derived antigenic peptide able to bind a given HLA molecule using a CTL killing assay. In this example expanded T cell clones are tested for specificity for the *Borrelia* derived Outer surface protein C (OspC) by analysis in a standard 51-Cr release assay. For this purpose, T2 cells expressing HLA-A*0201 molecules on their surface are loaded with either TLVSSIDEL peptide derived from OspC and able to bind HLA-A*0201 (se FIG. 32) or an irrelevant peptide GLAGDVSAV and used as target cells. CD8 T-cell clones that effectively lyse T2 cells pulsed with TLVSSIDEL without killing of T2 cells pulsed with the irrelevant peptide GLAGDVSAV are T cell clones specific for the OspC derived epitope TLVSSIDEL. Clones that do not show specific lysis against T2 cells pulsed with TLVSSIDEL peptide are not specific for OspC.

Example 79

This is an example of a CTL killing assay.

T cell clones can be tested for specificity for a given *Borrelia* derived antigenic peptide able to bind a given HLA molecule using a CTL killing assay. In this example expanded T cell clones are tested for specificity for any *Borrelia* derived protein by analysis in a standard 51-Cr release assay. For this purpose, T2 cells expressing HLA-A*0201 or any other cell type expressing specific HLA molecules are loaded with either antigenic peptides derived from *Borrelia* proteins and able to bind HLA molecules in question or an irrelevant peptide and used as target cells. CD8 T-cell clones that effectively lyse T2 cells pulsed with antigenic peptides derived from *Borrelia* proteins without killing of T2 cells pulsed with the irrelevant peptide are T cell clones specific for the tested *Borrelia* protein. Clones that do not show specific lysis against T2 cells pulsed with *Borrelia* derived antigenic peptide are not specific for OspC.

Example 80

This is an example of indirect detection of a population of T cells, where cells in suspension are induced to produce soluble factor. The soluble factor produced is a cytokine (IFN-γ) and is detected by a chromogen assay using anti-cytokine antibodies. The antigenic peptides origin is *Borrelia* bacteria.

Blood from patients suspected to have *Borrelia* infection are withdrawn and the presence of IFN-γ releasing T cells are detected as described in the following.

The procedure used in this example is a whole blood INF-γ assay (QuantiFERON [QFT]; Cellestis, Carnegie, Australia) and involves two stages: (1) overnight incubation of whole blood with antigens and (2) measurement of IFN-γ production in harvested plasma samples by ELISA.

Briefly, the procedure is as follows:

Within 12 hours of collection, 1-ml aliquots of blood samples are dispensed into 24-well tissue culture plates and antigens are added to appropriate wells. Three drops of saline (nil control) or phytohemagglutinin (5 μg/ml; mitogen-positive control), and 100 μl of a peptide cocktail, are added to separate wells to give a final peptide concentration of 1 μg/ml. The peptide cocktail contain 10 antigenic peptides selected from the *Borrelia* antigen OspB. The 10 peptides are able to bind different HLA class 2 molecules and have the following sequences:

KKYLLGFALVLALIA; DTVKLFNDTKIFISK; SKVFKKQGSLTEETE; TAVWSDTSNTLTVSA; ETYDSSNTKVASKVF; MKKYLLGFALVLALI; TKAVETLKNGIMLEG; KAVETLKNGIMLEGN; TLEYSDMTNDENATK and ITVQNYDTAGTKLAG (see FIG. 34).

Blood samples were incubated with antigens for 16 to 24 hours at 37° C. before harvesting about 300 μl of plasma from above the settled blood cells.

The concentration of IFN-γ produced in the four plasma samples from each subject, as a result of stimulation of specific T cells with antigen presenting cells displaying the above listed peptides, is determined by QuantiFERON-CMI ELISA or another IFN-γ measuring ELISA assay following the manufacturers instructions.

Samples from up to 16 subjects are tested in each ELISA run, which also included a set of standards that are measured in duplicate. For an ELISA run to be valid, strict performance criteria (coefficient of variation less than 15% and correlation coefficient for the standard curve greater than 0.98) had to be met. ELISA data for the *Borrelia*-specific antigen OspB and the nil and mitogen controls are converted to international units per milliliter on the basis of the IFN-γ standard curve generated for each ELISA plate. For an individual's test to be deemed valid, their response to at least one antigen (OspB or mitogen) has to be at least 0.25 IU of IFN-γ per milliliter above that of their nil control (five times the limit of detection for the ELISA). Results for OspB are expressed as the concentration of detected minus the concentration of in the respective nil control plasma.

The presence of IFN-γ in blood of the tested individual indicates the presence of activated T cells specific for one or more of the investigated peptide epitopes from the *Borrelia* antigen OspB tested and can be regarded as a surrogate marker for infection with *Borrelia* bacteria.

Example 81

This is an example of indirect detection of a population of T cells, where cells in suspension are induced to produce soluble factor. The soluble factor produced is a cytokine (IFN-γ) and is detected by a chromogen assay using anti-cytokine antibodies. The antigenic peptides origin is *Borrelia* bacteria.

Blood from patients suspected to have *Borrelia* infection are withdrawn and the presence of IFN-γ releasing T cells are detected as described in the following.

The procedure used in this example is a whole blood IFN-γ assay (QuantiFERON [QFT]; Cellestis, Carnegie, Australia) and involves two stages: (1) overnight incubation of whole blood with antigens and (2) measurement of IFN-γ production in harvested plasma samples by ELISA.

Briefly, the procedure is as follows:

Within 12 hours of collection, 1-ml aliquots of blood samples are dispensed into 24-well tissue culture plates and antigens are added to appropriate wells. Three drops of saline (nil control) or phytohemagglutinin (5 μg/ml; mitogen-positive control), and 100 μl of a peptide cocktail, are added to separate wells to give a final peptide concentration of 1 μg/ml. The peptide cocktail contain 10-20 antigenic peptides selected from one or more *Borrelia* antigen(s). The 10-20 peptides are able to bind different HLA class 1 and/or 2 molecules and have sequences selected from the lists of *Borrelia* derived antigenic peptide sequences enclosed in this application.

Blood samples were incubated with antigens for 16 to 24 hours at 37° C. before harvesting about 300 µl of plasma from above the settled blood cells.

The concentration of IFN-γ produced in the four plasma samples from each subject, as a result of stimulation of specific T cells with antigen presenting cells displaying the above listed peptides, is determined by QuantiFERON-CMI ELISA or another IFN-γ measuring ELISA assay following the manufacturers instructions.

Samples from up to 16 subjects are tested in each ELISA run, which also included a set of standards that are measured in duplicate. For an ELISA run to be valid, strict performance criteria (coefficient of variation less than 15% and correlation coefficient for the standard curve greater than 0.98) had to be met. ELISA data for the *Borrelia*-specific antigen(s) and the nil and mitogen controls are converted to international units per milliliter on the basis of the IFN-γ (standard curve generated for each ELISA plate. For an individual's test to be deemed valid, their response to at least one antigen (*Borrelia* antigen or mitogen) has to be at least 0.25 IU of IFN-γ per milliliter above that of their nil control (five times the limit of detection for the ELISA). Results for *Borrelia* antigen(s) are expressed as the concentration of IFN-γ detected minus the concentration of IFN-γ in the respective nil control plasma.

The presence of IFN-γ in blood of the tested individual indicates the presence of activated T cells specific for one or more of the investigated antigenic peptide epitopes from the *Borrelia* antigen(s) tested and can be regarded as a surrogate marker for infection with *Borrelia* bacteria.

Example 82

This is an example of indirect detection of a population of T cells, where cells in suspension are induced to produce soluble factor. The soluble factor produced is a cytokine (IFN-γ) and is detected by a chromogen assay using anti-cytokine antibodies. The antigenic peptides origin is *Borrelia* bacteria.

Blood from patients suspected to have *Borrelia* infection are withdrawn and the presence of IFN-γ releasing T cells are detected as described in the following.

The procedure used in this example is a whole blood IFN-γ assay (QuantiFERON [QFT]; Cellestis, Carnegie, Australia) and involves two stages: (1) overnight incubation of whole blood with antigens and (2) measurement of IFN-γ production in harvested plasma samples by ELISA.

Briefly, the procedure is as follows:

Within 12 hours of collection, 1-ml aliquots of blood samples are dispensed into 24-well tissue culture plates and antigens are added to appropriate wells. Three drops of saline (nil control) or phytohemagglutinin (5 µg/ml; mitogen-positive control), and 100 µl of a peptide cocktail, are added to separate wells to give a final peptide concentration of 1 µg/ml. The peptide cocktail contain 10-20 antigenic polypeptides selected from one or more *Borrelia* antigen(s). The 10-20 peptides comprises antigenic peptides able to bind different HLA class 1 and/or 2 molecules and these antigenic peptides have sequences selected from the lists of *Borrelia* derived antigenic peptide sequences enclosed in this application.

Blood samples were incubated with antigens for 16 to 24 hours at 37° C. before harvesting about 300 µl of plasma from above the settled blood cells.

The concentration of IFN-γ produced in the four plasma samples from each subject, as a result of stimulation of specific T cells with antigen presenting cells displaying the above listed peptides, is determined by QuantiFERON-CMI ELISA or another IFN-γ measuring ELISA assay following the manufacturers instructions.

Samples from up to 16 subjects are tested in each ELISA run, which also included a set of standards that are measured in duplicate. For an ELISA run to be valid, strict performance criteria (coefficient of variation less than 15% and correlation coefficient for the standard curve greater than 0.98) had to be met. ELISA data for the *Borrelia*-specific antigen(s) and the nil and mitogen controls are converted to international units per milliliter on the basis of the standard curve generated for each ELISA plate. For an individual's test to be deemed valid, their response to at least one antigen (*Borrelia* antigen or mitogen) has to be at least 0.25 IU of IFN-γ per milliliter above that of their nil control (five times the limit of detection for the ELISA). Results for *Borrelia* antigen(s) are expressed as the concentration of IFN-γ detected minus the concentration of IFN-γ in the respective nil control plasma.

The presence of IFN-γ in blood of the tested individual indicates the presence of activated T cells specific for one or more of the investigated antigenic polypeptide epitopes from the *Borrelia* antigen(s) tested and can be regarded as a surrogate marker for infection with *Borrelia* bacteria.

Example 83

This is an example of how *Borrelia* derived antigenic polypeptides can be used for vaccination of Gerbils.

To ascertain whether cross-protection between different OspC families was possible, OspC proteins were purified from *B. burgdorferi* strain ZS7 (OspC family 1), *B. afzelii* strain PKO (OspC family 7) and *B. garinii* strain W (OspC family 10) and used as immunogens in the gerbil model of Lyme borreliosis against a challenge with *B. afzelii* strain Orth (OspC family 5). To test protection within a family, the OspC from strain H7

(OspC family 5) was used as an immunogen against strain Orth. The OspC from strain H7 belongs to the same serovar and RFLP-type as the OspC from strain Orth.

Gerbils were given either a single, subcutaneous immunization of purified OspC (20 .mu·g protein/200 .mu·l, adjuvanted with TiterMax # R-1 (CytRx), that is, were prepared as a water-in-oil (squalene) emulsion with a synthetic immunomodulator (copolymer CRL89-41) or two intraperitoneal injections of OspC (10 .mu·g protein/500 .mu·l) adjuvanted with aluminium hydroxide. The purified antigens were prepared from strains by methods described in U.S. patent application Ser. No. 07/903,580, the contents of which were previously incorporated above by reference. Three and a half weeks after the first immunization, blood samples were taken from the eye and plasma prepared so that the antibody response to the immunogen at the time of the challenge could be ascertained (unimmunized control animals were likewise treated). Four weeks after the first immunization, the animals were challenged intraperitoneally with 10.sup.4 cells (25-100 ID.sub.50) of strain Orth, as were a group of unimmunized control animals. The challenge suspension was also titrated in unimmunized gerbils to determine the dose required to infect 50% of the animals. After a further two weeks, the animals challenged with the 10.sup.4 dose were killed and the bladder, heart, kidneys and spleens cultured in BSK medium. Cultures were inspected for spirochetes at weekly intervals, from the second to the sixth week post-inoculation, by dark-field microscopy. Blood also was taken and the resultant plasma analyzed by western blotting for sero-conversion, i.e. the development of antibodies post-challenge to antigens from strain Orth other than the immunogen. There was good agreement between the cultural and serological tests used to ascertain which animals were infected. Only serological testing was used for the ID(50) determinations but in this instance the animals were bled three weeks post-challenge, the extra time being given to ensure that the antibody response in infected gerbils was sufficiently strong to be easily detected.

There were no signs of cross-protection between species i.e. OspC proteins from OspC families 1 (*B. burgdorferi*) and (*B. garinii*) were ineffective as immunogens against the challenge strain Orth (*B. afzelii*). Likewise there was no sign of cross-protection between different OspC families of the same species i.e. the OspC protein from an OspC family 7 isolate (*B. afzelii* strain PKO) was ineffective as an immunogen against a challenge with strain Orth which expresses an OspC protein from OspC family 5. By contrast, immunization with the OspC protein from strain H7 (OspC family 5) was effective against a challenge strain Orth (OspC family 5). These data indicate that cross-protection between the OspC families is unlikely and that protection within a family is possible. A multivalent vaccine comprising one or more types of OspC proteins from each of the OspC families should be sufficient to protect against most Lyme disease *Borrelia* strains.

This example is modified from patent WO94/25596.

Example 84

This is an example of how a *Borrelia* derived antigenic polypeptide can be used for vaccination of Gerbils.

In this example the antigenic polypeptide is the first 86 amino acids of the *Borrelia* Outer surface protein G (OspG). The amino acids sequences used is MNKKMKNLII-CAVFVLIISCKIDASSEDLKQNVKEKVEGFLD-KELMQGDDPNNSLFNPP PVL-PASSHDNTPVLKAVQAKDGGQQEG and is derived from *Borrelia burgdorferi* strain ZS7. Genes encoding the antigenic polypeptide with this sequence are synthesized e.g. using Gene Assembler™ gene synthesis platform (made by GeneArt) and cloned into a suitable expression vector. Then this plasmid is transformed into *E. coli*, expressed and purified using standard procedures known by persons skilled in the art.

This OspG(1-86) antigenic polypeptide are used as immunogens in the gerbil model of Lyme borreliosis against a challenge with *Borrelia burgdorferi*.

Gerbils were given either a single, subcutaneous immunization of purified OspG(1-86) (20 .mu·g protein/200 .mu·l, adjuvanted with TiterMax # R-1 (CytRx), that is, were prepared as a water-in-oil (squalene) emulsion with a synthetic immunomodulator (copolymer CRL89-41) or two intraperitoneal injections of OspG(1-86) (10 .mu·g protein/500 .mu·l) adjuvanted with aluminium hydroxide.

Three and a half weeks after the first immunization, blood samples are taken from the eye and plasma prepared so that the antibody response to the immunogen at the time of the challenge can be ascertained (unimmunized control animals were likewise treated). Four weeks after the first immunization, the animals are challenged intraperitoneally with 10.sup.4 cells (25-100 ID.sub.50) of a *Borrelia burgdorferi* strain (e.g. ZS7 or B31). The challenge suspension is also titrated in unimmunized gerbils to determine the dose required to infect 50% of the animals. After a further two weeks, the animals challenged with the 10.sup.4 dose are killed and the bladder, heart, kidneys and spleens cultured in BSK medium. Cultures are inspected for spirochetes at weekly intervals, from the second to the sixth week post-inoculation, by dark-field microscopy. Only serological testing was used for the ID(50) determinations but in this instance the animals are bled three weeks post-challenge, the extra time being given to ensure that the antibody response in infected gerbils is sufficiently strong to be easily detected.

It is expected that vaccination with the OspG(1-86) protein is effective against a challenge strain ZS7 and may also be effective against challenge with other strains since these strains have homologous sequences of the first 86 amino acids of the OspG proteins.

Example 85

This is an example of how several *Borrelia* derived antigenic polypeptide can be used for vaccination of Gerbils.

In this example 10 different antigenic polypeptides with sequences derived from 1-10 different *borrelia* proteins are used to generate a vaccine against Lyme disease. Each sequence is selected to be homologous among many *Borrelia* species and strains. Genes encoding the antigenic polypeptides with these sequences are synthesized e.g. using Gene Assembler™ gene synthesis platform (made by GeneArt) and cloned into a suitable expression vectors. Then these plasmids are transformed into *E. coli*, expressed and purified using standard procedures known by persons skilled in the art. The antigenic polypeptides are used as immunogens in the gerbil model of Lyme borreliosis against a challenge with *Borrelia burgdorferi*, *Borrelia garinii* and/or *Borrelia afzelii*.

Gerbils were given either a single, subcutaneous immunization of purified antigenic polypeptides (each 20 .mu·g protein/200 .mu·l, adjuvanted with TiterMax # R-1 (CytRx), that is, were prepared as a water-in-oil (squalene) emulsion with a synthetic immunomodulator (copolymer CRL89-41) or two intraperitoneal injections of antigenic polypeptide (each 10 .mu·g protein/500 .mu·l) adjuvanted with aluminium hydroxide. Three and a half weeks after the first immunization, blood samples are taken from the eye and plasma prepared so that the antibody response to the immunogen at the time of the challenge can be ascertained (unimmunized control animals were likewise treated). Four weeks after the first immunization, the animals are challenged intraperitoneally with 10.sup.4 cells (25-100 ID.sub.50) of a *Borrelia burgdorferi*, *Borrelia garinii* and/or *Borrelia afzelii* strain(s). The challenge suspension is also titrated in unimmunized gerbils to determine the dose required to infect 50% of the animals. After a further two weeks, the animals challenged with the 10.sup.4 dose are killed and the bladder, heart, kidneys and spleens cultured in BSK medium. Cultures are inspected for spirochetes at weekly intervals, from the second to the sixth week post-inoculation, by dark-field microscopy.

Only serological testing was used for the ID(50) determinations but in this instance the animals are bled three weeks post-challenge, the extra time being given to ensure that the antibody response in infected gerbils is sufficiently strong to be easily detected.

It is expected that vaccination with these antigenic polypeptides are effective against a challenge a wide range of *Borrelia* species and strain since these strains have homologous sequences of the amino acid sequence of the selected antigenic polypeptides.

A multivalent vaccine comprising one or more types of *Borrelia* derived proteins s should be sufficient to protect against most Lyme disease *Borrelia* strains. In general antigenic polypeptides comprising one/or more antigenic peptides sequence(s) as described herein can be used.

Example 86

This is an example of how several *Borrelia* derived antigenic polypeptide can be used for vaccination of humans against Lyme disease.

In this example 10-20 different antigenic polypeptides with sequences derived from 1-20 different *Borrelia* proteins are used to generate a vaccine against Lyme disease.

Each sequence is selected to be homologous among many *Borrelia* species and strains.

Genes encoding the antigenic polypeptides with these sequences are synthesized, expressed and produced.

The antigenic polypeptides are used as vaccine components in humans

To protect against *Borrelia burgdorferi, Borrelia garinii* and/or *Borrelia afzelii* strains.

The antigenic polypeptides are given in doses suitable for humans and together with an adjuvant usefull in humans. The vaccine is given either as a single dose or as multiple doses.

It is expected that vaccination with these antigenic polypeptides are effective against a challenge a wide range of *Borrelia* species and strain since these strains have homologous sequences of the amino acid sequence of the selected antigenic polypeptides.

A multivalent vaccine comprising one or more types of *Borrelia* derived proteins s should be sufficient to protect humans against most Lyme disease *Borrelia* strains. In general antigenic polypeptides comprising one/or more *Borrelia* derived antigenic peptide sequences as described in the present application can be used.

Example 87

This is an example of how several *Borrelia* derived antigenic peptides can be used for vaccination of humans against Lyme disease.

In this example 10-20 different antigenic peptides with sequences derived from 1-20 different *Borrelia* proteins are used to generate a vaccine against Lyme disease. Each sequence is selected to be homologous among many *Borrelia* species and strains.

Genes encoding the antigenic peptides with these sequences are synthesized, expressed and produced.

The antigenic peptides are used as vaccine components in humans

To protect against *Borrelia burgdorferi, Borrelia garinii* and/or *Borrelia afzelii* strains.

The antigenic peptides are given in doses suitable for humans and together with an adjuvant usefull in humans. The vaccine is given either as a single dose or as multiple doses.

It is expected that vaccination with these antigenic peptides are effective against a challenge a wide range of *Borrelia* species and strain since these strains have homologous sequences of the amino acid sequence of the selected antigenic peptides. A multivalent vaccine comprising one or more types of *Borrelia* derived proteins s should be sufficient to protect humans against most Lyme disease *Borrelia* strains. In general any antigenic peptides comprising *Borrelia* derived amino acid sequences as described in the present application can be used.

Example 88

This is an example of how MHC multimers can be used as a *Borrelia* vaccine for monkeys.

The vaccine is composed of a Dextran (270 kDa) carrier that has been derivatized by attaching Strepavidin (on average 8.6 Strepavidin molecules/Dextran molecule). Attached to the carrier are human HLA class 1 and 2 molecules containing antigenic peptides derived from the *Borrelia* antigen Basic membrane protein A (BmpA). The attached HLA-peptide complexes are:

HLA-A*0201(YLAPDNVIT), HLA-A*0101(YSDEIDIIH), HLA-B*0702(APDNVITST), HLA-DRB1*0401 (IELVLKESSSNSYLS), HLA-BRB1*1501(MNKILLLILLESIVF) and HLA-DRB1*1101(SDLIWLIGYRFSDVA).

A single full dose of the final vaccine corresponds to, 100 µg of each MHC class 1; 113.5 □g of HLA class 2; 3×25.8 µg HSP70 and 3×162.2 µg dextran (corresponding to a total of approx 300 µg MHC multimer/kg body weight for a monkey of 3.5 kg) and consist of a 1:1:1 mixture of the following three MHC multimers:

MHC Multimer 1:

HLA-A*0101(YSDEIDIIH)+HLA-DR*0401(IELVLKESSSNSYLS)+HSP70+Dextran carrier, in the molar ratio 10/10/4/1

MHC Multimer 2:

HLA-A*0201(YLAPDNVIT)+HLA-DR*1501 (MNKILLLILLESIVF)+HSP70+Dextran carrier, in the molar ratio 10/10/4/1

MHC Multimer 2:

HLA-B*0702(APDNVITST)+HLA-DRB1*1101(SDLIWLIGYRFSDVA)+HSP70+Dextran carrier, in the molar ratio 10/10/4/1

Administration:

The MHC multimer mix is emulsified with the adjuvant Titermax Gold as specified by the manufacturer and administered as intramuscular injections at time points 0, 4, 8, and 16 weeks such that a full dose is given at 0 weeks and half-full dose at 4, 8, and 16 5 weeks. This vaccine may give protection against infection with *Borrelia* bacteria.

Example 89

This is an example of how MHC multimers can be used as a *Borrelia* vaccine for monkeys.

The vaccine is composed of an antigen presenting cell (APC) e.g. a Dendritic cell expressing the HLA class 1 molecules HLA-A*0101 and HLA-B*0702. The APC is loaded with antigenic peptides derived from the *Borrelia* protein Basic membrane protein A (BmpA) by incubation with the peptides for 2-5 hours at 37° C. The amino acid sequence of the peptides are YSDEIDIIH and APDNVITST (se FIG. 32).

Administration:

The peptide loaded APC are added the adjuvant Titermax Gold as specified by the manufacturer and administered as intramuscular injections at time points 0, 4, 8, and 16 weeks. This vaccine may give protection against infection with *Borrelia* bacteria.

SEQUENCE LISTING (217791 sequences)

SEQ ID NO: 1 - protein, 339 aa, Borrelia burgdorferi
MNKILLLILLESIVFLSCSGKGSLGSEIPKVSLIIDGTFDDKSFNESALNGVKKVKEEFKIELVLKESSSNSYLSDLEGLKDAGSDLIWLIGYRFSDVAKVAALQNPDMKYAIIDPIYSNDPIPANLVGMTFRAQEGAFLTGYIAAKLSKTGKIGFLGGIEGEIVDAFRYGYEAGAKYANKDIKISTQYIGSFADLEAGRSVATRMYSDEIDIIHHAAGLGGIGAIEVAKELGSGHYIIGVDEDQAYLAPDNVITSTTKDVGRALNIFTSNHLKTNTFEGGKLINYGLKEGVVGFVRNPKMISFELEKEIDNLSSKIINKEIIVPSNKESYEKFLKEFI

SEQ ID NO: 2 - protein, 341 aa, Borrelia burgdorferi
MRIVIFIFGILLTSCFSRNGIESSSKKIKISMLVDGVLDDKSFNSSANEALLRLKKDFPENIEEVFSCAISGVYSSYVSDLDNLKRNGSDLIWLVGYMLTDASLLVSSENPKISYGIIDPIYGDDVQIPENLIAVVFRVEQGAFLAGYIAAKKSFSGKIGFIGGMKGNIVDAFRYGYESGAKYANKDIEIISEYSNSFSDVDIGRTIASKMYSKGIDVIHFAAGLAGIGVIETAKNLGDGYYVIGADQDQSYLAPKNFITSVIKNIGDALYLITGEYIKNNNVWEGGKVVQMGLRDGVIGLPNANEFEYIKVLERKIINKEIIVPCNQEEYEIFIKQILKL

SEQ ID NO: 3 - protein, 353 aa, Borrelia burgdorferi
MFKRFIFITLSLLVFACFKSNKKSIKSDKVVVGVLAHGSFYDKGYNQSVHDGVVKLRDNFGIKLITKSLRPYPIEGKRLLTVDEAMTEDAYEVQKNPLNLFWLIGYRFSDLSVKLSYERPDIYYGIIDAFDYGDIQVPKNSLAIKFRNEEAAFLAGYIAAKMSRKEKIGFLTGPMSEHVKDFKFGFKAGIFYANPKLRLVSKKAPSLFDKEKGKAMALFMYKEDKVGVIFPIAGITGLGVYDAAKELGPKYYVIGLNQDQSYIAPQNVITSIIKDIGKVIYSISSEYINNRVFKGGIIIDRGLKEGVIEIVKDPDVLNNRLVDEVIDLENKIISGEIIVPDSEYAFDLFKSKL

SEQ ID NO: 4 - protein, 360 aa, Borrelia burgdorferi
MDNYYEIYFLYFFIKSKEDIFMLKKVYYFLIFLFIVACSSSDDGKSEAKTVSLIVDGAFDDKGFNESSSKAIRKLKADLNINIIEKASTGNSYLGDIANLEDGNSNLIWGIGFRLSDILFQRASENVSVNYAIIEGVYDEIQIPKNLLNISFRSEEVAFLAGYFASKASKTGKIGFVGGVRGKVLESFMYGYEAGAKYANSNIKVVSQYVGTFGDFGLGRSTASNMYRDGVDIIFAAAGLSGIGVIEAAKELGPDHYIIGVDQDQSYLAPNNVIVSAVKKVDSLMYSLTKKYLETGVLDGGKTMFLGLKEDGLGLVLNENLKSNYSEIYNKSLKIGQSIMNGIIKVPYDKVSYFVLQMEN

SEQ ID NO: 5 - protein, 170 aa, Borrelia afzelii
MIKYNKIILTLTLLASLLAACSLTGKARLESSVKDITNEIEKAIKEAEDAGVKTDAFTETQTGGKVGGSQIRAAKIRVADLTIKFLEATEEETITFKENGAGEEDFSGIYDLILNAAKAVEKIGMQGMKQAVEEAAKEKPKTTADGIIAIVKVMKAKVENIKEKQTKNQK

SEQ ID NO: 6 - protein, 186 aa, Borrelia garinii
MIKYNKILLKLSLIVSLLVACGLTGETKIRLESSAQEIKDEINKIKANAKKEGVKFEAFTNTQTGSKISEKPEFILKAKIKAIQVAERFVKAIKEEAEKLKKSGSSGAFSAMYDLMIDVSKPLEEIGIQKMTGTVTKEAEKTPPTTADGIIAIAQAMEEKLNNVNKKQHDALKNLEEKANTAATTT

SEQ ID NO: 7 - protein, 180 aa, Borrelia burgdorferi
SIVIALFFKLLVACSIGLVERTNAALESSSKDLKNKILKIKKEATGKGVLFEAFTGLKTGSKVTSGGLALREAKVQAIVETGKFLKIIEEEALKLKETGNSGQFLAMFDLMLEVVESLEDVGIIGLKARVLEESKNNPINTAERLLAAKAQIENQLKVVKEKQNIENGGEKKNNKSKKKK

SEQ ID NO: 8 - protein, 650 aa, Borrelia burgdorferi B31
MILIFYFKQIALFIIFRLCYIIKKVKIKLKRKSCMKKQFDTEVNDLLYLIIHSLYSHKEIFLRELISNASDAIDKLKFLSLTNEKFKNIALEPKIEISFDDKSILIKDNGIGMDEQDLTNHLGVIAKSGTKEFINNLKQDEKKSASLIGQFGVGFYSAFIVSEKVEVTSKKALESDAYIWSSDGKTGYEIEKAKKEESGTEIKLYLNKEGLEYANKWKIQEIIKKYSNHINYPIYIKYSEPIMKDGKQEGIEEKEEKLNETTALWTKNKSEIKAEEYNEFYKNTTFDYENPLMHIHTKAEGNLEYTNLFYVPSKAPYDLYYPNTKPGVKLFINRIFITDSEGSLLPNYLRFIKGIIDCQDLPLNVSREILQQNKILSKIKSSSVKKILSELEKLSKKNPEKFSEFSKEFGRCIKEGVYSDFENREKLISLIRFKSSSVDGFVSFKEYKERMNESQKSIYYITGGKENILKENPIVAAYKEKGFEILIMDDELDEAILNLIPEYEGLKLKAINKNETSNELKDENFKKIEEEFKDTLTKVKEILKDHIKEVNLSATLIKEPSAIIIDSNDPTYQMQKIMLSMGQEVKEIKPILELNPNNKIVQNLKNLEPEKLEKISILLFEEAMLTSGMPSKNPGKFINIINEFIEKDFL

SEQ ID NO: 9 - protein, 274 aa, Borrelia burgdorferi
MKKYLLGIGLILALIACKQNVSTLDEKNSVSVDLPGGMTELVSKEKDKDGKYSLEATVDKLELKGTSDKNNGSGTLEGEKTDKSKVKLTIADDLSQTKFEIFKEDAKTLVSKKVTLKDKSSTEEKFNEKGETSEKTIVRANGTRLEYTDIKSDGSGKAKEVLKDFTLEGTLAADGKTTLKVTEGTVVLSKNILKSGEITVALDDSDTTQATKKTGKWDSKTSTLTISVNSQKTKNLVFTKEDTITVQKYDSAGTNLEGKAVEITTLKELKNALK

SEQ ID NO: 10 - protein, 298 aa, Borrelia garinii
MKKYLLGFALVLALIACGQKGAEPKHNDQEVEDSKKDQKDASKKDLPLVTEDTVKLFNDTKIFISKEKNKDGKYELRATVDTVELKGVADKNDGSGGKLEGVKSDQSKVTMSITDDLNTITVETYDSSNTKVASKVFKKQGSLTEETEETYKTGKLSTKKITRTNGTTLEYSDMTNDENATKAVETLKNGIMLEGNLVGGKTSVEIKEGTVTLKKEIEKAGTVKLFLDDTSSGSTKKTAVWSDTSNTLTVSADSKKIKDFVFLTDGTITVQNYDTAGTKLAGTATEIKDLEALKAALK

SEQ ID NO: 11 - protein, 211 aa, Borrelia afzelii
MKKNTLSAILMTLFLFISCNNSGKGGDSASTNPADESAKGPNLTEISKKITDSNAFVLAVKEVETLVSSIDELANKAIGKKIQQNGLGAEANRNESLLAGVHEISTLITEKLSKLKNSGELKAKIEDAKKCSEEFTNKLRVSHADLGKQGVNDDDAKKAILKTNADKTKGAEELGKLFKSVEGLVKAAQEALTNSVKELTSPVVAESPKKP

SEQ ID NO: 12 - protein, 179 aa, Borrelia garinii
MNKKMKMFIICAVFVLISSCGNFRSSLSDQGSLSDQGSLSDQGSLSDQGGLSGQASSDTIKFSEFTVNIKNKKDNNGDWSNLGTLVIRKEQDGVETGLNVIGTINGQLRGHSATFFCIEEAEVNNFVKAMTNVGSFKTSLYYGYKEEQSSTNGIKGKEITTKIETINNSEHITFSGDKI

SEQ ID NO: 13 - protein, 196 aa, Borrelia burgdorferi
MNKKMKNLIICAVFVLIISCKIDASSEDLKQNVKEKVEGFLDKELMQGDDPNNSLFNPPPVLPASSHDNTPVLKAVQAKDGGQQEGKEEKEKEIQELKDKIDKRKKELEEARKKFQEFKEQVESATGESTEKVKKQGNIGQKALKYAKELGVNGSYSVNDGTNTNDFVKKVIDDALKNIEEELEKLAEPQNIEDKK

SEQ ID NO: 14 - protein, 341 aa, Borrelia burgdorferi
MKRKAKSILFFLLSTVLFAQETDGLAEGSKRAEPGELVLDFAELARDPSSTRLDLTNYVDYVYSGASGIVKPEDMVVDLGINNWSVLLTPSARLQAYVKNSVVAPAVVKSESKRYAGDTILGVRVLFPSYSQSSAMIMPPFKIPFYSGESGNQFLGKGLIDNIKTMKEIKVSVYSLGYEIDLEVLFEDMNGMEYAYSMGTLKFKGWADLIWSNPNYIPNISSRIIKDDVPNYPLASSKMRFKAFRVSKSHSSKVKNFIFYVKDLRVLYDKLSVSIDSDIDSESVFKVYETSGTESLRKLKAHETFKRVLKLREKISIAEGSFQNFVEKIESEKPEESSPKN

SEQ ID NO: 15 - protein, 199 aa, Borrelia garinii
NTSKAINFIQTTEGNLNEVEKVLVRMKELAVQSGNGTYSDADRGSIQIEIEQLTDEINRIADQAQYNQMHMLSNKSASQNVRTAEELGMQPAKINTPASLSGSQASWTLRVHVGANQDEAIAVNIYAANVANLFSGEGAQAAQTAPVQEGVQQEGAQQPAPATAPSQGGVNSPVNVTTTVDANTSLAKIENAIRMISDQ

SEQ ID NO: 16 - protein, 336 aa, Borrelia garinii PBi
MIINHNTSAINASRNNSINAANLSKTQEKLSSGYRINRASDDAAGMGVSGKINAQIRGLSQASRNTSKAINFIQTTEGNLNEVEKVLVRMKELAVQSGNGTYSDADRGSIQIEIEQLTDEINRIADQAQYNQMHMLSNKSASQNVRTAEELGMQPAKINTPASLSGSQASWTLRVHVGANQDEAIAVNIYAANVANLFSGEGSQAAQTAPVQEGAQQEGAQQPAPATAPSQGGVNSPVNVTTTVDANTSLAKIENAIRMISDQRANLGAFQNRLESIKDSTEYAIENLKASYAQIKDATMTDEVVASTTNSILTQSAMAMIAQANQVPQYVLSLLR

SEQ ID NO: 17 - protein, 348 aa, Borrelia Burgdorferi
  CONFLICT 266: Xaa can be any naturally occurring amino acid
  CONFLICT 281: Xaa can be any naturally occurring amino acid
  VARIANT 266, 281: Xaa = Any Amino Acid
MRGSHHHHHHGSSQVADKDDPTNKFYQSVIQLGNGFLDVFTSFGGLVAEAFGFKSDPKKSDVKTYFTTVAAKLEKTKTDLNSLPKEKSDISSTTGKPDSTGSVGTAVEGAIKEVSELLDKLVKAVKTAEGASSGTAAIGEVVADADAAKVADKASVKGIAKGIKEIVEAAGGSEKLKAVAAAKGENNKGAGKLFGKAGAAAHGDSEAASKAAGAVSAVSGEQILSAIVTAADAAEQDGKKPEEAKNPIAAAIGDKDGGAEFGQDEXKKDDQIAAAIALRGXAKDGKFAVKDGEKEKAEGAIKGAAESAVRKVLGAITGLIGDAVSSGLRKVGDSVKAASKETPPALNK

SEQ ID NO: 18 - protein, 169 aa, Borrelia burgdorferi
MKKISLLIFLFLFVVSLSANIEENYTETKRAFSKEDFNLINKRLDNYDFKNEYEKSHVFSDAPRIRGDLRKIGIKEKSVFLDALEAIEYLIKIKISTDSIFLSEDMIRLIGSYPDSIFNYLIQLNSDKIDYAEKYGDNARNNFKKDYSEDKANTVKQILKQILADLPKD

SEQ ID NO: 19 - protein, 325 aa, Borrelia burgdorferi
MCAFLLLNLVNCKFDSLNLSTKSVDDKNNSIAKLLQHLSKSEDQANKTSTSEDQKELEITENKEQEHEKLSQVAQHAPNSKIEKVKSDGKPVPGDKILSSNKDIYNSYIPEVKEEIVYEILEEVIIPETKIPEITEEVIMPIPQTIDFYIEPRPISSFLTQGTSPSITSTIKSYKELAKEKINNGLNIVQKITQNIDNITENLNSKETPKEISGKEVEEKITHPIFDHITGSGNNPGQDSISNTWGEGLEIGGDSNFFTNLEEVRSSIRTKIKVSDGTEQTKDKVEIDEIIEDLQKLKEFLEKLKKYLKDTNNLSAIEESVKGLS

SEQ ID NO: 20 - protein, 475 aa, Borrelia burgdorferi B31
MIKMSLNYTEINTLIKEIPFTNSLITKIIQPDYKSLVLEIYNKIDNKKFKILICLNPNTTRFHITKKNFKKNALKLRFSDFLKSKIQNGKIIKAFQMKNERIISLEILQKDMIILFIKLWPSSPNIIATNSNFKILDAYYRRPKIKETTGEIFLKAKEIHESNKMSDKKIMELKEEYNNTSYTSYSEFLENYYESLNDQIKKTNIKELLIEKYKKELIVLEKRIDSLKQQIKLLENIENEKEKGELILLNINKIQKGIKEINLLNYKEEKIKISLNQSLSPKENALQYFKAYKKGKNSFKTIQNQLKDNLDKFNLIQSKITMLKVENLIPEEEYNQEKTAIKEKEKTPKIGLHFTYCGFEILIGRNAKENDKLLRHCVKGNDYWLHTRDYPGAYVFIKNQKNKTPSLDVLLGAGNLCVFYTKLAKKSGKADLYYTQVKNLRRVKNKKLGLVIPKAEKNLHIKLDENLIKKIKNQT

SEQ ID NO: 21 - protein, 267 aa, Borrelia burgdorferi
MKLQRSLSLIIFSLTVLCCDNKERKEGVSTKISLGAEPRSLDPQLAEDNVASKMIDTLYRGIVTGDPNTGGHKPGLAKGWETSSDGTAYPFYLRDNLTWSDGVAITAEGIRKSYLRILNKETGSTYVDMVKSIIKNGQEYFDGQVTDSELGIRAIDSKTLEITLASPKPYFIDLLVHQSFIPVPVHVTDKYGQNWTSPENMVTSGPFKLKERIPSEKYVFEKDNKYYDSNEVELEEITFYTTNDSSTAYKMYVNEELDAILVPYPQI

SEQ ID NO: 22 - protein, 288 aa, Borrelia burgdorferi B31
MNLINKLFILTILFSSVISCKLYKKITYNADQVIDKLKSNNGSFNTLKSNDDSKRSGRKPRSVDNTYMDQDTGKKPLMADMQPDMQNDNSSSNHTLQVNIQDNEASEARNIMTEIESSKEEYNRINEDLAKVKASLDKIKSLLSTAKSYLEQTRRGVGSSKANLALLPSLEEAIAKVKSNHASADTHCNDAIAALKRAKNDFEYAQRKADRALEEALSNSNASRHESYYYAGYHQFMADAKASMSSTKSLLEVAKNKQKELNENMTKTNKDFQELNDIYKKLQDMDSR

SEQ ID NO: 23 - protein, 336 aa, Borrelia burgdorferi B31
MIINHNTSAINASRNNGINAANLSKTQEKLSSGYRINRASDDAAGMGVSGKINAQIRGLSQASRNTSKAINFIQTTEGNLNEVEKVLVRMKELAVQSGNGTYSDADRGSIQIEIEQLTDEINRIADQAQYNQMHMLSNKSASQNVRTAEELGMQPAKINTPASLSGSQASWTLRVHVGANQDEAIAVNIYAANVANLFSGEGAQTAQAAPVQEGVQQEGAQQPAPATAPSQGGVNSPVNVTTTVDANTSLAKIENAIRMISDQRANLGAFQNRLESIKNSTEYAIENLKASYAQIKDATMTDEVVAATTNSILTQSAMAMIAQANQVPQYVLSLLR

SEQ ID NO: 24 - protein, 528 aa, Borrelia burgdorferi B31
MKLQRSLFLIIFFLTFLCCNNKERKEGVSFKISLGAEPSSLDPQLAEDNVASKMIDTMFRGIVTGDPNTGGNKPGLAKGWDISSDGTVYTFNLREKITWSDGVAITAEGIRKSYLRILNKETGSKYVEMVKSVIKNGQKYFDGQVTDSELGIRAIDEKTLEITLESPKPYFIDMLVHQSFIPVPVHVTEKYGQNWTSPENMVTSGPFKLKERIPNEKYVFEKNNKYYDSNEVELEEITFYTTNDSSTAYKMYENEELDAIFGSIPPDLIKNLKLRSDYYSSAVNAIYFYAFNTHIKPLDNVKIRKALTLAIDRETLTYKVLDNGTTPTRRATPNFSSYSYAKSLELFNPEIAKTLLAEAGYPNGNGFPILKLKYNTNEANKKICEFIQNQWKKNLNIDVELENEEWTTYLNTKANGNYEIARAGWIGDYADPLTFLSIFTQGYTQFSSHNYSNPEYNELIKKSDLELDPIKRQDILRQAEEIIIEKDFPIAPIYIYGNSYLFRNDKWTGWNTNILERFDLSQLKLKNK

SEQ ID NO: 25 - protein, 257 aa, Borrelia
MTKIFSNLIINGLLFGFVSLNVFADSNNANILKPQSNVLEHSDQKDNKKLDQKDQVNQALDTINKVTEDVSSKLEGVRESSLELVESNDAGVVKKFVGSMSLMSDVAKGTVVASQEATIVAKCSGMVAEGANKVVEMSKKAVQETQKAVSVAGEATFLIEKQIMLNKSPNNKELELTKEEFAKVDEVKETLMASERALDETVQEAQKVLNMVNGLNPSNKDQVLAKKDVRKAISNVVKVAQGARDLTKVMAISLYMR

SEQ ID NO: 26 - protein, 708 aa, Borrelia burgdorferi
MKKMLLIFSFFLIFLNGFPLNARKVDKEKLKDFVNMDLEFVNYKGPYDSTNTYEQIVGIGEFLARPLTNSNSNSSYYGKYFINRFIDDQDKKASVDVFSISSKSELDSILNLRRILTGYIIKSFDYDRSSAELIAKVITIYNAVYRGDLDYYKGFYIEPALKSLTKENAGLSRVYSQWAGKTQIFIPLKKDILSGNIESDIDIDSLVTDKVIAALLSENEAGVNFARDITDIQGETHKADQDKIDTELDNIHESDSNITETIENLRDQLEKATDEEHKKEIESQVDAKKKEKEELDKKAINLDKAQQKLDSAEDNLDVQRDTVREKIQEDINEINKEKNLPKPGDVSSPKVDKQLQIKESLEDLQEQLKEAGDENQKREIEKQIEIKKRDEELLKSKDGKVSKDYEALDLDRELSKASSKEKSKVKEEEITKGKSRASLGDLNNDKNLMLPEDQKLPEDKKLDSKLDGKKEFKPVSEVEKLDKISKSNNNEVGKLSPLDKPSYDDIDSKEEVDNKAINLQKIDPKVKDQTTSLNEDLDKDLTTMSIDSSSPVFLEVIDPITNLGTLQLIDLNTGVRLKESTQQGIQRYGIYEREKDLVVIKMDSGKAKLQILNKLENLKVVSESNFEINKNSSLYVDSKMILAAVRDKDDSNAWRLAKFSPKNLDEFILSENKILPFTSFSVRKNFIYLQDELKNLVILDVNTLKKVK

SEQ ID NO: 27 - protein, 501 aa, Borrelia burgdorferi B31
MKYILSIDQGTTSSRAMVFDKNANIKGFAQKEFTQIYPQPSWVEHDPTEIWGSQLGVITEAMANARILPNEIDAIGITNQRETTVIWEKNTGKPIYNAIVWQDRRTAKICDQLKKEGKDKIILEKTGLVLDSYFSGTKIMWILDNVEGARQRAENGELCFGTIDTWILWNLTQKKEHATDYSNASRTLLLNIKTLEWDDELLSILNVPRAILPELKESSTIYGKTDKALFGAEIPIAGIAGDQFAATFGQACLKKGMAKNTYGTGCFLTVNIGKEPIISHDKLLTSIAWGRKKSVTYVLEGSVFIGGAVIQWLRDGLEFFRKSSDAEALASSVSDNGGVYFVPAFVGLGAPHWDSYARGTIIGITRGSTKAHITRAALESIAFQSFDILNTMKKSIPNFEIQELRVDGGASQNNLLMQFQADLLECKVVRPKITETTALGAAYLAGLATGYWQSAEEIVSLWQVDKIFEPSMPKNQKEKLLENWNKAVGKAKSWIQNSHSS

SEQ ID NO: 28 - protein, 581 aa, Borrelia burgdorferi B31
  Xaa can be any naturally occurring amino acid
  VARIANT 230: Xaa = Any Amino Acid
MKTIKKDSEFYDSLATLKKHINKYIEEKVLKYSISSQLYKLEKPEIIELIKISNDYEKEKNAFNTSLEECYYKNTQNEAIKKWILEIVRNKNFIQISKEANLNTKKLGTTYKLKSSNFLKLIEIQNSPYYSQEKKDIYKQIILNFSSNINIDSLEQTIDILVAVRNRNKIKILNILNKNLKYRPENQKVFKSSLTNKESRLIKLKRMLILTYWPVGCLSKNIFIKILIKXYKYLEEEILALKYNEILNYLRALKTLSLNEIFYKGSSKNISFNYFFSDFTQYAPKDFQDTLKCYLYVIEKTITKKYLTWFFKDKISNNWESFIDALEYIEKHKLINIKEKIKEIITAKFQTEDFFISFDKTNFNPYESSIFKERYIKSAFLEIIMHYVKKNSQNIETYGWIAFYIYADNKDKKIFCQRMKEFFKSKTFEIQNQIFVYFLSFYPNIEYKHFKFISDILLYLDENKITIPKKIIKIQKINPNQLDYQKSYLLIKSLKTRSRILKIIIKNIRFNLIEKLEDENEKKLLPAMCYLIYCENLVELKNNRKIKSNEKNSLLEFISFFKTKLKQKINFKKELMKSKGI

SEQ ID NO: 29 - protein, 265 aa, Borrelia burgdorferi B31
MITQQDYTEIKKKLENTKTRIQFRNGNKIDSLGYQGSLGEPILLKDKLTFSICDGKNIDNRKEYEITKNAPSLDSLIEYLEHMILFFLEKTPVGTLTAKFAMEGSILTRSKLIQAFTNTNKFCIPDGRSLPSNCYAYKVLGISSAPKLSGRFLRHYDSGGSTDSDGTRSLGHTQEDSYKNHDHDLDFSRINFKGKLVKRMTMIYRSADTWYTWYWAEEIMSPFITGYSYEEIDPEYLLPPFTSQSGSKETKPKNTCYISFYRYDL

SEQ ID NO: 30 - protein, 357 aa, Borrelia burgdorferi B31
MDLLDLLEKEKQINKNKGVFMTKPKIFSINKEKIKILIIVVLTSTFLLGIIFSNENKVARILEEKFFDFDFNLISKIETELEGTLTKLGKDWILTYNKQNIPVDNKKVNSLIKALDELQKNKLVSRDQKKHKELGIGENPSFKLFDNNNKLLTEIFVGKSGEGDSRLAYIKGSDENVYLTKNIFLSYKGNSYNTFSDTTLFQEKNTKLENLSFKIIRKLNKENENNINNNYEIISKDGLYFLNNQKMTKERPLNIIAEFKADGLEIDKSKIDDYNLQYKIEVKWSNKSVNNIEVYFNKNEENDKDILIKKDKDEYYYTTSKWTFFDVFDLEKKLTEKDDISSNDNQEDHHEHHNNAD

SEQ ID NO: 31 - protein, 155 aa, Borrelia burgdorferi B31
MKKLIIIFTLFLSQACNLSTMHKIDTKEDMKILYSEIAELRKKLNLNHLEIDDTLEKVAKEYAIKLGENRTITHTLFGTTPMQRIHKYDQSFNLTREILASGIELNRVVNAWLNSPSHKEALINTDTDKIGGYRLKTTDNIDIFVVLFGKRKYKN

SEQ ID NO: 32 - protein, 213 aa, Borrelia burgdorferi B31
MMQRISILLMLLAVFSCKQFGDVKSLTEIDSGNGIPLVVSDVVKDLIPKEISLTPEEAEKLESLKVFLKDAMSVNGREEALKAEYEKSYKEFFDWLSKDVNRQKEFISSFDNISSIVSKAVDASKKRRPTEQQSLGFKEYVCYKIKNSKGEALSLFFQKVVDAFGADPYKKDNDESVQKPVKCNEEIFKVIKKVLTESESNNELKNLKNYGNV

SEQ ID NO: 33 - protein, 227 aa, Borrelia garinii PBi
MKRISILSILLLLLLFSCKQYGDVKSLTEVATDLEDDNSFASGSVESKDQIIEKGPVLTSEEFERLEALKTFLKDAMGVNGREGDTKAEYEKSYKEFFDWLSKDVNRQKEFVSFFNNICGIITKAVDASKKRYNSNPKSLGFNEYVCYDIKTRTGDDLSLFFQKVADAFGTQEYKNKDEDDENNQKPEKCNEEIFKVIKRVFTESENNNELANLKNLNSYNLNSNNK

SEQ ID NO: 34 - protein, 411 aa, Borrelia burgdorferi B31
MKIKPLIQLKLLGLFLFSCTIDANLNEDYKNKVKGILNKAADDQETTSADTNSNAAKNIPIADNDKVAAELKKQSQAAKTVAAAPNKGSQNQPQTTPNKGSQNQQAAPSPQLQSLSFSADLSNLPKTTAARAASLTKQRIPIQAVTTVPGNTRTFNSRNSGLPTFALNYSFSQPTRQQTNSSSAVQTTTSSGSKLQTLKNELIRAISEEKNKTQNNFGFRETYDQFKMKDSAFELLDVISSAKVYDRSYAPQLNSNTPEAENERNKFYALMDFDQYKIEQFGSIMEALYNENQNHSLIRELMISGLGTQISFELALEEINKKIEIFNQDYLNAKINSFDFTMKLKELKSKLNQILDKRKEWSRQADGLIANASSNSSLSDSKSLAEYIKKRYLDNMQNARQSVLEAYISIM

SEQ ID NO: 35 - protein, 424 aa, Borrelia garinii PBi
MSSCTIDANLNKDYKNKVEELLNSSTDDQAKISINTGSNATKNKTNIKVAGLQKNTQSKKNNNLQGLNPANQVNPGNPMQIANQANQANQANQANQANQASQASQASQVASSASQASPVASPATNVQATPPKQIASAQAIQTVPNNTSTPNQSIIKPQQYTFSSSFSQPTSQTNFNNSQSNNVLTNYRHQTQPSFVVPVYSGNSPLQKLKNNLLRRIAEEKNKTHNHGFRETYDQFKMKDSAFTLLDVISNISVFDRGSAPQLSSNTPEAESERNRLYAMMDFDQAKTTEFGSIMNILYQENQNHSLIRSLIISGLGIQISLESTLEEIEKKIESFNTQYLNTIINSYTFKDKLKELESKLNSILAEKKEWLNYADAIITNTSSNSKRNDPQSLGQYIKNKYLDKMQDARQSALDLYLNITEIR

SEQ ID NO: 36 - protein, 263 aa, Borrelia burgdorferi B31
MKKAKLNIIKINIITMILTLICISCAPFNKINPKANENTKLKKNTRLKKPANPGENIQNFKDKSGDLGASDEKFMGTTASELKAIGKELEDRKNQYDIQIAKITNEESNLLDTYIRAYELANENEKMLLKRFLLSSLDYKKENIETLKEILEKLINNYENDPKIAANFLYRIALDIQLKLEKHLKSINEKLDTLSKENSKEDLEALLEQVKSALQLQEKFKKTLNKTLEDYRKNTNNIQENKVLAEHFNKYYKDSDSLQSAFY

SEQ ID NO: 37 - protein, 260 aa, Borrelia garinii PBi
MKKTKLNIIKLNILTTTLTLICISCAVNKIDPEPKSKTNKKENIKNFVNKFQDLEPSKKQNKDLEPLREKYPEATASKLETTLKILEAQKEKENIEIAKIDNTQIDFLKTFKTDPHDSLPEDEKMQMKKIIYSSLNYETEKIKILQEILEKLDKNLQHKKIAKNFIYDIPIIIQSRLDIISKVIKNPIKDELQILNQKEIEELLMRIESELKIKENFKKALNKTIDAYNQDSENIKTSAEQLEKHINENYKEFNSLKPIY

SEQ ID NO: 38 - protein, 184 aa, Borrelia burgdorferi B31
MRILVGVCIIALALLGCYLPDNQEQAVQTFFENSESSDMGSDEIVTEGIFSSLKLYASEHRLLVEIKKTLISLKDPNYRGVVLPVSDYNEEYFNKFFLDLGSEQSKDLIKLFIMVKNEQNNNKFMRIVRWLYSCIEELYSPDIKYSGEEGSPEYYRNMPRPTAYQQYLKVKRYDYNRPVPILPT

SEQ ID NO: 39 - protein, 160 aa, Borrelia burgdorferi B31
MRNKNIFKLFFASMLFVMACKAYVEEKKEIDSLMEDVLALVNDSSGGKFKDYKDKINELKENLKDIGNAELKEKLLNLQNSFQDKLAAKLAALKAAKNTIENITDKDQDISKRKIWSEAKLVGVTVPLLGSNTSGNGDKMSKNAVEQIDKVIKFLEEGTN

SEQ ID NO: 40 - protein, 307 aa, Borrelia burgdorferi B31
MKDNILKNNKLIAIFLLHVLTVLILISCSLEVKDSNESKKHKKEKRKGKVENLLVAINNLKNPTKPAAGKNKANSKASKQKNNPNANANNAPKKILDPEVAKLIQKILDRSENIIQISEMDSSRGEPNDQFGMRAEIFSKIFFNANSTVHFDSHEYTEERRMLYTSLNFNEGKIFNLGQILSKLSQDSNYRGLVKETLINRGFSIQLAMEEISAKILNVKDKLQQLNKPNLETLYNDFEKLTSLKEKWLKDTDDLIDEYNTNPDLQTDVSKLNDTLRSKNSRAQFANIHDIILDLVNTTTNILAPIQ

SEQ ID NO: 41 - protein, 318 aa, Borrelia garinii PBi
MKNNKLIAIFLLHILTGLILLSCSLEVNQDDNQEKQKKAKTKTSKSENNSSKMKKLSKNAKNKKPTVDNLLVAINTLKNPPKTAGKNKSNSAAALKQPNNANALKQIDPEAKELIQKILERSEDIVQISEIDANKGEPDDQFEMKAEIFSKIFFNAGSTVTFDDNEYVNERRILYTSLNFNENKILNLGKILSKLSQDSNYRSLVKEILINRGFSIQLAIEEISLRTLNVKDKIQHLNKPNLKTLYHDFNKLIPLKEKWLKDVDDIIKDYNANPELRTDISKLNDYIISKNSKAQFTDIHNIILNLINTTTNILAPIQ

SEQ ID NO: 42 - protein, 360 aa, Borrelia burgdorferi
MKKVKSKYLALGLLFGFISCDLFIRYEMKEESPGLFDKGNSILETSEESIKKPMNKKGKGKIARKKGKSKVSRKEPYIHSLKRDSANKSNFLQKNVILEEESLKTELLKEQSETRKEKIQKQQDEYKGMTQGSLNSLSGESGELKETIESNEIDITIDSDLRPKSSLQDIAGSNSISYTDEIEEEDYARYYLDEDDEDDEYYEDDYEEIRLSNRYQSYLEGVKYNVDSAINTINKIYDTYTLFSTKLTQMYSTRLDNLAKAKAKEEAAKFTKEDLEKNFKTLLNYIQVSVKTAANFVYINDTHAKRKLENIEAEIKTLIAKIKEQSNLYEAYKAIVTSILLMRDSLKEVQGIIDKNGVWY

SEQ ID NO: 43 - protein, 352 aa, Borrelia afzelii
MKIKSKCLALGLLFGFISCDLFIRDEIKEKSLGLCDEESSILETGDKSVKKSLNKKGKDKVARKKVEGNAVKKDPFNHHVKRESVNNSNLSQKNVISEEEILKTKLLRERPETRKEEIQKQQDEHKRMLQGSLSFLSGESGELKDTIESNEIDFTIDSDLRLKSDLQAISGSNSISYTDEIEEEDYDQYSLEEDYYYDGETRLSNRYESYLEGVKYNVSSAIKTIVKIYDNYTLLSTKQTQMYSTRLDNLAKAKAREEAKKFTKEELEKDLKTLLNYIQVSARTATNFVYAREIYSKRKLDAIETEIKNLILKIKGQSDLYEAYKAIVRSILLMKDSLKIIEIVIDKNGVWY

SEQ ID NO: 44 - protein, 360 aa, Borrelia garinii
MKKVKSKYLALGLLFGFISCDLFIRYEMKEESPGLFDKGNSILETSEESIKKPMNKKGKGKIARKNGKSKVSGKEPFIHSFKRDAANKSNFLQKNVMLEEESLKTELLKEQSETRKEKIQKQQDEYKGMTKGSLNSLSGESGELKETIESNEIDITIDSDLRPKSSLQDIAGSNSISYTDEIEEEDYARYYLDEDDEDDEYYEDDYEEIRLSNRYQSYLEGVKYNVDSAINTINKIYDTYTLFSTKLTQMYSTRLDNLAKAKAKEEAAKFTKEDLEKNFKTLLNYIQVSVKTATNFVYINEMHAKRKLENIEAKIKTLIAKIKEKSNLYSAYKAIVSSILLMRDSLKEVQYAIDKNGIWY

SEQ ID NO: 45 - protein, 8 aa, Borrelia burgdorferi B31
MNKILLLI

SEQ ID NO: 46 - protein, 8 aa, Borrelia burgdorferi B31
NKILLLIL

SEQ ID NO: 47 - protein, 8 aa, Borrelia burgdorferi B31
KILLLILL

SEQ ID NO: 48 - protein, 8 aa, Borrelia burgdorferi B31
ILLLILLE

SEQ ID NO: 49 - protein, 8 aa, Borrelia burgdorferi B31
LLLILLES

SEQ ID NO: 50 - protein, 8 aa, Borrelia burgdorferi B31
LLILLESI

SEQ ID NO: 51 - protein, 8 aa, Borrelia burgdorferi B31
LILLESIV

SEQ ID NO: 52 - protein, 8 aa, Borrelia burgdorferi B31
ILLESIVF

SEQ ID NO: 53 - protein, 8 aa, Borrelia burgdorferi B31
LLESIVFL

SEQ ID NO: 54 - protein, 8 aa, Borrelia burgdorferi B31
LESIVFLS

SEQ ID NO: 55 - protein, 8 aa, Borrelia burgdorferi B31
ESIVFLSC

SEQ ID NO: 56 - protein, 8 aa, Borrelia burgdorferi B31
SIVFLSCS

SEQ ID NO: 57 - protein, 8 aa, Borrelia burgdorferi B31
IVFLSCSG

SEQ ID NO: 58 - protein, 8 aa, Borrelia burgdorferi B31
VFLSCSGK

SEQ ID NO: 59 - protein, 8 aa, Borrelia burgdorferi B31
FLSCSGKG

SEQ ID NO: 60 - protein, 8 aa, Borrelia burgdorferi B31
LSCSGKGS

SEQ ID NO: 61 - protein, 8 aa, Borrelia burgdorferi B31
SCSGKGSL

SEQ ID NO: 62 - protein, 8 aa, Borrelia burgdorferi B31
CSGKGSLG

SEQ ID NO: 63 - protein, 8 aa, Borrelia burgdorferi B31
SGKGSLGS

SEQ ID NO: 64 - protein, 8 aa, Borrelia burgdorferi B31
GKGSLGSE

SEQ ID NO: 65 - protein, 8 aa, Borrelia burgdorferi B31
KGSLGSEI

SEQ ID NO: 66 - protein, 8 aa, Borrelia burgdorferi B31
GSLGSEIP

SEQ ID NO: 67 - protein, 8 aa, Borrelia burgdorferi B31
SLGSEIPK

SEQ ID NO: 68 - protein, 8 aa, Borrelia burgdorferi B31
LGSEIPKV

SEQ ID NO: 69 - protein, 8 aa, Borrelia burgdorferi B31
GSEIPKVS

SEQ ID NO: 70 - protein, 8 aa, Borrelia burgdorferi B31
SEIPKVSL

SEQ ID NO: 71 - protein, 8 aa, Borrelia burgdorferi B31
EIPKVSLI

SEQ ID NO: 72 - protein, 8 aa, Borrelia burgdorferi B31
IPKVSLII

SEQ ID NO: 73 - protein, 8 aa, Borrelia burgdorferi B31
PKVSLIID

SEQ ID NO: 74 - protein, 8 aa, Borrelia burgdorferi B31
KVSLIIDG

SEQ ID NO: 75 - protein, 8 aa, Borrelia burgdorferi B31
VSLIIDGT

SEQ ID NO: 76 - protein, 8 aa, Borrelia burgdorferi B31
SLIIDGTF

SEQ ID NO: 77 - protein, 8 aa, Borrelia burgdorferi B31
LIIDGTFD

SEQ ID NO: 78 - protein, 8 aa, Borrelia burgdorferi B31
IIDGTFDD

SEQ ID NO: 79 - protein, 8 aa, Borrelia burgdorferi B31
IDGTFDDK

SEQ ID NO: 80 - protein, 8 aa, Borrelia burgdorferi B31
DGTFDDKS

SEQ ID NO: 81 - protein, 8 aa, Borrelia burgdorferi B31
GTFDDKSF

SEQ ID NO: 82 - protein, 8 aa, Borrelia burgdorferi B31
TFDDKSFN

SEQ ID NO: 83 - protein, 8 aa, Borrelia burgdorferi B31
FDDKSFNE

SEQ ID NO: 84 - protein, 8 aa, Borrelia burgdorferi B31
DDKSFNES

SEQ ID NO: 85 - protein, 8 aa, Borrelia burgdorferi B31
DKSFNESA

SEQ ID NO: 86 - protein, 8 aa, Borrelia burgdorferi B31
KSFNESAL

SEQ ID NO: 87 - protein, 8 aa, Borrelia burgdorferi B31
SFNESALN

SEQ ID NO: 88 - protein, 8 aa, Borrelia burgdorferi B31
FNESALNG

SEQ ID NO: 89 - protein, 8 aa, Borrelia burgdorferi B31
NESALNGV

SEQ ID NO: 90 - protein, 8 aa, Borrelia burgdorferi B31
ESALNGVK

SEQ ID NO: 91 - protein, 8 aa, Borrelia burgdorferi B31
SALNGVKK

SEQ ID NO: 92 - protein, 8 aa, Borrelia burgdorferi B31
ALNGVKKV

SEQ ID NO: 93 - protein, 8 aa, Borrelia burgdorferi B31
LNGVKKVK

SEQ ID NO: 94 - protein, 8 aa, Borrelia burgdorferi B31
NGVKKVKE

SEQ ID NO: 95 - protein, 8 aa, Borrelia burgdorferi B31
GVKKVKEE

SEQ ID NO: 96 - protein, 8 aa, Borrelia burgdorferi B31
VKKVKEEF

SEQ ID NO: 97 - protein, 8 aa, Borrelia burgdorferi B31
KKVKEEFK

SEQ ID NO: 98 - protein, 8 aa, Borrelia burgdorferi B31
KVKEEFKI

SEQ ID NO: 99 - protein, 8 aa, Borrelia burgdorferi B31
VKEEFKIE

SEQ ID NO: 100 - protein, 8 aa, Borrelia burgdorferi B31
KEEFKIEL

SEQ ID NO: 101 - protein, 8 aa, Borrelia burgdorferi B31
EEFKIELV

SEQ ID NO: 102 - protein, 8 aa, Borrelia burgdorferi B31
EFKIELVL

SEQ ID NO: 103 - protein, 8 aa, Borrelia burgdorferi B31
FKIELVLK

SEQ ID NO: 104 - protein, 8 aa, Borrelia burgdorferi B31
KIELVLKE

SEQ ID NO: 105 - protein, 8 aa, Borrelia burgdorferi B31
IELVLKES

SEQ ID NO: 106 - protein, 8 aa, Borrelia burgdorferi B31
ELVLKESS

SEQ ID NO: 107 - protein, 8 aa, Borrelia burgdorferi B31
LVLKESSS

SEQ ID NO: 108 - protein, 8 aa, Borrelia burgdorferi B31
VLKESSSN

SEQ ID NO: 109 - protein, 8 aa, Borrelia burgdorferi B31
LKESSSNS

SEQ ID NO: 110 - protein, 8 aa, Borrelia burgdorferi B31
KESSSNSY

SEQ ID NO: 111 - protein, 8 aa, Borrelia burgdorferi B31
ESSSNSYL

SEQ ID NO: 112 - protein, 8 aa, Borrelia burgdorferi B31
SSSNSYLS

SEQ ID NO: 113 - protein, 8 aa, Borrelia burgdorferi B31
SSNSYLSD

SEQ ID NO: 114 - protein, 8 aa, Borrelia burgdorferi B31
SNSYLSDL

SEQ ID NO: 115 - protein, 8 aa, Borrelia burgdorferi B31
NSYLSDLE

SEQ ID NO: 116 - protein, 8 aa, Borrelia burgdorferi B31
SYLSDLEG

SEQ ID NO: 117 - protein, 8 aa, Borrelia burgdorferi B31
YLSDLEGL

SEQ ID NO: 118 - protein, 8 aa, Borrelia burgdorferi B31
LSDLEGLK

SEQ ID NO: 119 - protein, 8 aa, Borrelia burgdorferi B31
SDLEGLKD

SEQ ID NO: 120 - protein, 8 aa, Borrelia burgdorferi B31
DLEGLKDA

SEQ ID NO: 121 - protein, 8 aa, Borrelia burgdorferi B31
LEGLKDAG

SEQ ID NO: 122 - protein, 8 aa, Borrelia burgdorferi B31
EGLKDAGS

SEQ ID NO: 123 - protein, 8 aa, Borrelia burgdorferi B31
GLKDAGSD

SEQ ID NO: 124 - protein, 8 aa, Borrelia burgdorferi B31
LKDAGSDL

SEQ ID NO: 125 - protein, 8 aa, Borrelia burgdorferi B31
KDAGSDLI

SEQ ID NO: 126 - protein, 8 aa, Borrelia burgdorferi B31
DAGSDLIW

SEQ ID NO: 127 - protein, 8 aa, Borrelia burgdorferi B31
AGSDLIWL

SEQ ID NO: 128 - protein, 8 aa, Borrelia burgdorferi B31
GSDLIWLI

SEQ ID NO: 129 - protein, 8 aa, Borrelia burgdorferi B31
SDLIWLIG

SEQ ID NO: 130 - protein, 8 aa, Borrelia burgdorferi B31
DLIWLIGY

SEQ ID NO: 131 - protein, 8 aa, Borrelia burgdorferi B31
LIWLIGYR

SEQ ID NO: 132 - protein, 8 aa, Borrelia burgdorferi B31
IWLIGYRF

SEQ ID NO: 133 - protein, 8 aa, Borrelia burgdorferi B31
WLIGYRFS

SEQ ID NO: 134 - protein, 8 aa, Borrelia burgdorferi B31
LIGYRFSD

SEQ ID NO: 135 - protein, 8 aa, Borrelia burgdorferi B31
IGYRFSDV

SEQ ID NO: 136 - protein, 8 aa, Borrelia burgdorferi B31
GYRFSDVA

SEQ ID NO: 137 - protein, 8 aa, Borrelia burgdorferi B31
YRFSDVAK

SEQ ID NO: 138 - protein, 8 aa, Borrelia burgdorferi B31
RFSDVAKV

SEQ ID NO: 139 - protein, 8 aa, Borrelia burgdorferi B31
FSDVAKVA

SEQ ID NO: 140 - protein, 8 aa, Borrelia burgdorferi B31
SDVAKVAA

SEQ ID NO: 141 - protein, 8 aa, Borrelia burgdorferi B31
DVAKVAAL

SEQ ID NO: 142 - protein, 8 aa, Borrelia burgdorferi B31
VAKVAALQ

SEQ ID NO: 143 - protein, 8 aa, Borrelia burgdorferi B31
AKVAALQN

SEQ ID NO: 144 - protein, 8 aa, Borrelia burgdorferi B31
KVAALQNP

SEQ ID NO: 145 - protein, 8 aa, Borrelia burgdorferi B31
VAALQNPD

SEQ ID NO: 146 - protein, 8 aa, Borrelia burgdorferi B31
AALQNPDM

SEQ ID NO: 147 - protein, 8 aa, Borrelia burgdorferi B31
ALQNPDMK

SEQ ID NO: 148 - protein, 8 aa, Borrelia burgdorferi B31
LQNPDMKY

SEQ ID NO: 149 - protein, 8 aa, Borrelia burgdorferi B31
QNPDMKYA

SEQ ID NO: 150 - protein, 8 aa, Borrelia burgdorferi B31
NPDMKYAI

SEQ ID NO: 151 - protein, 8 aa, Borrelia burgdorferi B31
PDMKYAII

SEQ ID NO: 152 - protein, 8 aa, Borrelia burgdorferi B31
DMKYAIID

SEQ ID NO: 153 - protein, 8 aa, Borrelia burgdorferi B31
MKYAIIDP

SEQ ID NO: 154 - protein, 8 aa, Borrelia burgdorferi B31
KYAIIDPI

SEQ ID NO: 155 - protein, 8 aa, Borrelia burgdorferi B31
YAIIDPIY

SEQ ID NO: 156 - protein, 8 aa, Borrelia burgdorferi B31
AIIDPIYS

SEQ ID NO: 157 - protein, 8 aa, Borrelia burgdorferi B31
IIDPIYSN

SEQ ID NO: 158 - protein, 8 aa, Borrelia burgdorferi B31
IDPIYSND

SEQ ID NO: 159 - protein, 8 aa, Borrelia burgdorferi B31
DPIYSNDP

SEQ ID NO: 160 - protein, 8 aa, Borrelia burgdorferi B31
PIYSNDPI

SEQ ID NO: 161 - protein, 8 aa, Borrelia burgdorferi B31
IYSNDPIP

SEQ ID NO: 162 - protein, 8 aa, Borrelia burgdorferi B31
YSNDPIPA

SEQ ID NO: 163 - protein, 8 aa, Borrelia burgdorferi B31
SNDPIPAN

SEQ ID NO: 164 - protein, 8 aa, Borrelia burgdorferi B31
NDPIPANL

SEQ ID NO: 165 - protein, 8 aa, Borrelia burgdorferi B31
DPIPANLV

SEQ ID NO: 166 - protein, 8 aa, Borrelia burgdorferi B31
PIPANLVG

SEQ ID NO: 167 - protein, 8 aa, Borrelia burgdorferi B31
IPANLVGM

SEQ ID NO: 168 - protein, 8 aa, Borrelia burgdorferi B31
PANLVGMT

SEQ ID NO: 169 - protein, 8 aa, Borrelia burgdorferi B31
ANLVGMTF

SEQ ID NO: 170 - protein, 8 aa, Borrelia burgdorferi B31
NLVGMTFR

SEQ ID NO: 171 - protein, 8 aa, Borrelia burgdorferi B31
LVGMTFRA

SEQ ID NO: 172 - protein, 8 aa, Borrelia burgdorferi B31
VGMTFRAQ

SEQ ID NO: 173 - protein, 8 aa, Borrelia burgdorferi B31
GMTFRAQE

SEQ ID NO: 174 - protein, 8 aa, Borrelia burgdorferi B31
MTFRAQEG

SEQ ID NO: 175 - protein, 8 aa, Borrelia burgdorferi B31
TFRAQEGA

SEQ ID NO: 176 - protein, 8 aa, Borrelia burgdorferi B31
FRAQEGAF

SEQ ID NO: 177 - protein, 8 aa, Borrelia burgdorferi B31
RAQEGAFL

SEQ ID NO: 178 - protein, 8 aa, Borrelia burgdorferi B31
AQEGAFLT

SEQ ID NO: 179 - protein, 8 aa, Borrelia burgdorferi B31
QEGAFLTG

SEQ ID NO: 180 - protein, 8 aa, Borrelia burgdorferi B31
EGAFLTGY

SEQ ID NO: 181 - protein, 8 aa, Borrelia burgdorferi B31
GAFLTGYI

SEQ ID NO: 182 - protein, 8 aa, Borrelia burgdorferi B31
AFLTGYIA

SEQ ID NO: 183 - protein, 8 aa, Borrelia burgdorferi B31
FLTGYIAA

SEQ ID NO: 184 - protein, 8 aa, Borrelia burgdorferi B31
LTGYIAAK

SEQ ID NO: 185 - protein, 8 aa, Borrelia burgdorferi B31
TGYIAAKL

SEQ ID NO: 186 - protein, 8 aa, Borrelia burgdorferi B31
GYIAAKLS

SEQ ID NO: 187 - protein, 8 aa, Borrelia burgdorferi B31
YIAAKLSK

SEQ ID NO: 188 - protein, 8 aa, Borrelia burgdorferi B31
IAAKLSKT

SEQ ID NO: 189 - protein, 8 aa, Borrelia burgdorferi B31
AAKLSKTG

SEQ ID NO: 190 - protein, 8 aa, Borrelia burgdorferi B31
AKLSKTGK

SEQ ID NO: 191 - protein, 8 aa, Borrelia burgdorferi B31
KLSKTGKI

SEQ ID NO: 192 - protein, 8 aa, Borrelia burgdorferi B31
LSKTGKIG

SEQ ID NO: 193 - protein, 8 aa, Borrelia burgdorferi B31
SKTGKIGF

SEQ ID NO: 194 - protein, 8 aa, Borrelia burgdorferi B31
KTGKIGFL

SEQ ID NO: 195 - protein, 8 aa, Borrelia burgdorferi B31
TGKIGFLG

SEQ ID NO: 196 - protein, 8 aa, Borrelia burgdorferi B31
GKIGFLGG

SEQ ID NO: 197 - protein, 8 aa, Borrelia burgdorferi B31
KIGFLGGI

SEQ ID NO: 198 - protein, 8 aa, Borrelia burgdorferi B31
IGFLGGIE

SEQ ID NO: 199 - protein, 8 aa, Borrelia burgdorferi B31
GFLGGIEG

SEQ ID NO: 200 - protein, 8 aa, Borrelia burgdorferi B31
FLGGIEGE

SEQ ID NO: 201 - protein, 8 aa, Borrelia burgdorferi B31
LGGIEGEI

SEQ ID NO: 202 - protein, 8 aa, Borrelia burgdorferi B31
GGIEGEIV

SEQ ID NO: 203 - protein, 8 aa, Borrelia burgdorferi B31
GIEGEIVD

SEQ ID NO: 204 - protein, 8 aa, Borrelia burgdorferi B31
IEGEIVDA

SEQ ID NO: 205 - protein, 8 aa, Borrelia burgdorferi B31
EGEIVDAF

SEQ ID NO: 206 - protein, 8 aa, Borrelia burgdorferi B31
GEIVDAFR

SEQ ID NO: 207 - protein, 8 aa, Borrelia burgdorferi B31
EIVDAFRY

SEQ ID NO: 208 - protein, 8 aa, Borrelia burgdorferi B31
IVDAFRYG

SEQ ID NO: 209 - protein, 8 aa, Borrelia burgdorferi B31
VDAFRYGY

SEQ ID NO: 210 - protein, 8 aa, Borrelia burgdorferi B31
DAFRYGYE

SEQ ID NO: 211 - protein, 8 aa, Borrelia burgdorferi B31
AFRYGYEA

SEQ ID NO: 212 - protein, 8 aa, Borrelia burgdorferi B31
FRYGYEAG

SEQ ID NO: 213 - protein, 8 aa, Borrelia burgdorferi B31
RYGYEAGA

SEQ ID NO: 214 - protein, 8 aa, Borrelia burgdorferi B31
YGYEAGAK

SEQ ID NO: 215 - protein, 8 aa, Borrelia burgdorferi B31
GYEAGAKY

SEQ ID NO: 216 - protein, 8 aa, Borrelia burgdorferi B31
YEAGAKYA

SEQ ID NO: 217 - protein, 8 aa, Borrelia burgdorferi B31
EAGAKYAN

SEQ ID NO: 218 - protein, 8 aa, Borrelia burgdorferi B31
AGAKYANK

SEQ ID NO: 219 - protein, 8 aa, Borrelia burgdorferi B31
GAKYANKD

SEQ ID NO: 220 - protein, 8 aa, Borrelia burgdorferi B31
AKYANKDI

SEQ ID NO: 221 - protein, 8 aa, Borrelia burgdorferi B31
KYANKDIK

SEQ ID NO: 222 - protein, 8 aa, Borrelia burgdorferi B31
YANKDIKI

SEQ ID NO: 223 - protein, 8 aa, Borrelia burgdorferi B31
ANKDIKIS

SEQ ID NO: 224 - protein, 8 aa, Borrelia burgdorferi B31
NKDIKIST

SEQ ID NO: 225 - protein, 8 aa, Borrelia burgdorferi B31
KDIKISTQ

SEQ ID NO: 226 - protein, 8 aa, Borrelia burgdorferi B31
DIKISTQY

SEQ ID NO: 227 - protein, 8 aa, Borrelia burgdorferi B31
IKISTQYI

SEQ ID NO: 228 - protein, 8 aa, Borrelia burgdorferi B31
KISTQYIG

SEQ ID NO: 229 - protein, 8 aa, Borrelia burgdorferi B31
ISTQYIGS

SEQ ID NO: 230 - protein, 8 aa, Borrelia burgdorferi B31
STQYIGSF

SEQ ID NO: 231 - protein, 8 aa, Borrelia burgdorferi B31
TQYIGSFA

SEQ ID NO: 232 - protein, 8 aa, Borrelia burgdorferi B31
QYIGSFAD

SEQ ID NO: 233 - protein, 8 aa, Borrelia burgdorferi B31
YIGSFADL

SEQ ID NO: 234 - protein, 8 aa, Borrelia burgdorferi B31
IGSFADLE

SEQ ID NO: 235 - protein, 8 aa, Borrelia burgdorferi B31
GSFADLEA

SEQ ID NO: 236 - protein, 8 aa, Borrelia burgdorferi B31
SFADLEAG

SEQ ID NO: 237 - protein, 8 aa, Borrelia burgdorferi B31
FADLEAGR

SEQ ID NO: 238 - protein, 8 aa, Borrelia burgdorferi B31
ADLEAGRS

SEQ ID NO: 239 - protein, 8 aa, Borrelia burgdorferi B31
DLEAGRSV

SEQ ID NO: 240 - protein, 8 aa, Borrelia burgdorferi B31
LEAGRSVA

SEQ ID NO: 241 - protein, 8 aa, Borrelia burgdorferi B31
EAGRSVAT

SEQ ID NO: 242 - protein, 8 aa, Borrelia burgdorferi B31
AGRSVATR

SEQ ID NO: 243 - protein, 8 aa, Borrelia burgdorferi B31
GRSVATRM

SEQ ID NO: 244 - protein, 8 aa, Borrelia burgdorferi B31
RSVATRMY

SEQ ID NO: 245 - protein, 8 aa, Borrelia burgdorferi B31
SVATRMYS

SEQ ID NO: 246 - protein, 8 aa, Borrelia burgdorferi B31
VATRMYSD

SEQ ID NO: 247 - protein, 8 aa, Borrelia burgdorferi B31
ATRMYSDE

SEQ ID NO: 248 - protein, 8 aa, Borrelia burgdorferi B31
TRMYSDEI

SEQ ID NO: 249 - protein, 8 aa, Borrelia burgdorferi B31
RMYSDEID

SEQ ID NO: 250 - protein, 8 aa, Borrelia burgdorferi B31
MYSDEIDI

SEQ ID NO: 251 - protein, 8 aa, Borrelia burgdorferi B31
YSDEIDII

SEQ ID NO: 252 - protein, 8 aa, Borrelia burgdorferi B31
SDEIDIIH

SEQ ID NO: 253 - protein, 8 aa, Borrelia burgdorferi B31
DEIDIIHH

SEQ ID NO: 254 - protein, 8 aa, Borrelia burgdorferi B31
EIDIIHHA

SEQ ID NO: 255 - protein, 8 aa, Borrelia burgdorferi B31
IDIIHHAA

SEQ ID NO: 256 - protein, 8 aa, Borrelia burgdorferi B31
DIIHHAAG

SEQ ID NO: 257 - protein, 8 aa, Borrelia burgdorferi B31
IIHHAAGL

SEQ ID NO: 258 - protein, 8 aa, Borrelia burgdorferi B31
IHHAAGLG

SEQ ID NO: 259 - protein, 8 aa, Borrelia burgdorferi B31
HHAAGLGG

SEQ ID NO: 260 - protein, 8 aa, Borrelia burgdorferi B31
HAAGLGGI

SEQ ID NO: 261 - protein, 8 aa, Borrelia burgdorferi B31
AAGLGGIG

SEQ ID NO: 262 - protein, 8 aa, Borrelia burgdorferi B31
AGLGGIGA

SEQ ID NO: 263 - protein, 8 aa, Borrelia burgdorferi B31
GLGGIGAI

SEQ ID NO: 264 - protein, 8 aa, Borrelia burgdorferi B31
LGGIGAIE

SEQ ID NO: 265 - protein, 8 aa, Borrelia burgdorferi B31
GGIGAIEV

SEQ ID NO: 266 - protein, 8 aa, Borrelia burgdorferi B31
GIGAIEVA

SEQ ID NO: 267 - protein, 8 aa, Borrelia burgdorferi B31
IGAIEVAK

SEQ ID NO: 268 - protein, 8 aa, Borrelia burgdorferi B31
GAIEVAKE

SEQ ID NO: 269 - protein, 8 aa, Borrelia burgdorferi B31
AIEVAKEL

SEQ ID NO: 270 - protein, 8 aa, Borrelia burgdorferi B31
IEVAKELG

SEQ ID NO: 271 - protein, 8 aa, Borrelia burgdorferi B31
EVAKELGS

SEQ ID NO: 272 - protein, 8 aa, Borrelia burgdorferi B31
VAKELGSG

SEQ ID NO: 273 - protein, 8 aa, Borrelia burgdorferi B31
AKELGSGH

SEQ ID NO: 274 - protein, 8 aa, Borrelia burgdorferi B31
KELGSGHY

SEQ ID NO: 275 - protein, 8 aa, Borrelia burgdorferi B31
ELGSGHYI

SEQ ID NO: 276 - protein, 8 aa, Borrelia burgdorferi B31
LGSGHYII

SEQ ID NO: 277 - protein, 8 aa, Borrelia burgdorferi B31
GSGHYIIG

SEQ ID NO: 278 - protein, 8 aa, Borrelia burgdorferi B31
SGHYIIGV

SEQ ID NO: 279 - protein, 8 aa, Borrelia burgdorferi B31
GHYIIGVD

SEQ ID NO: 280 - protein, 8 aa, Borrelia burgdorferi B31
HYIIGVDE

SEQ ID NO: 281 - protein, 8 aa, Borrelia burgdorferi B31
YIIGVDED

SEQ ID NO: 282 - protein, 8 aa, Borrelia burgdorferi B31
IIGVDEDQ

SEQ ID NO: 283 - protein, 8 aa, Borrelia burgdorferi B31
IGVDEDQA

SEQ ID NO: 284 - protein, 8 aa, Borrelia burgdorferi B31
GVDEDQAY

SEQ ID NO: 285 - protein, 8 aa, Borrelia burgdorferi B31
VDEDQAYL

SEQ ID NO: 286 - protein, 8 aa, Borrelia burgdorferi B31
DEDQAYLA

SEQ ID NO: 287 - protein, 8 aa, Borrelia burgdorferi B31
EDQAYLAP

SEQ ID NO: 288 - protein, 8 aa, Borrelia burgdorferi B31
DQAYLAPD

SEQ ID NO: 289 - protein, 8 aa, Borrelia burgdorferi B31
QAYLAPDN

SEQ ID NO: 290 - protein, 8 aa, Borrelia burgdorferi B31
AYLAPDNV

SEQ ID NO: 291 - protein, 8 aa, Borrelia burgdorferi B31
YLAPDNVI

SEQ ID NO: 292 - protein, 8 aa, Borrelia burgdorferi B31
LAPDNVIT

SEQ ID NO: 293 - protein, 8 aa, Borrelia burgdorferi B31
APDNVITS

SEQ ID NO: 294 - protein, 8 aa, Borrelia burgdorferi B31
PDNVITST

SEQ ID NO: 295 - protein, 8 aa, Borrelia burgdorferi B31
DNVITSTT

SEQ ID NO: 296 - protein, 8 aa, Borrelia burgdorferi B31
NVITSTTK

SEQ ID NO: 297 - protein, 8 aa, Borrelia burgdorferi B31
VITSTTKD

SEQ ID NO: 298 - protein, 8 aa, Borrelia burgdorferi B31
ITSTTKDV

SEQ ID NO: 299 - protein, 8 aa, Borrelia burgdorferi B31
TSTTKDVG

SEQ ID NO: 300 - protein, 8 aa, Borrelia burgdorferi B31
STTKDVGR

SEQ ID NO: 301 - protein, 8 aa, Borrelia burgdorferi B31
TTKDVGRA

SEQ ID NO: 302 - protein, 8 aa, Borrelia burgdorferi B31
TKDVGRAL

SEQ ID NO: 303 - protein, 8 aa, Borrelia burgdorferi B31
KDVGRALN

SEQ ID NO: 304 - protein, 8 aa, Borrelia burgdorferi B31
DVGRALNI

SEQ ID NO: 305 - protein, 8 aa, Borrelia burgdorferi B31
VGRALNIF

SEQ ID NO: 306 - protein, 8 aa, Borrelia burgdorferi B31
GRALNIFT

SEQ ID NO: 307 - protein, 8 aa, Borrelia burgdorferi B31
RALNIFTS

SEQ ID NO: 308 - protein, 8 aa, Borrelia burgdorferi B31
ALNIFTSN

SEQ ID NO: 309 - protein, 8 aa, Borrelia burgdorferi B31
LNIFTSNH

SEQ ID NO: 310 - protein, 8 aa, Borrelia burgdorferi B31
NIFTSNHL

SEQ ID NO: 311 - protein, 8 aa, Borrelia burgdorferi B31
IFTSNHLK

SEQ ID NO: 312 - protein, 8 aa, Borrelia burgdorferi B31
FTSNHLKT

SEQ ID NO: 313 - protein, 8 aa, Borrelia burgdorferi B31
TSNHLKTN

SEQ ID NO: 314 - protein, 8 aa, Borrelia burgdorferi B31
SNHLKTNT

SEQ ID NO: 315 - protein, 8 aa, Borrelia burgdorferi B31
NHLKTNTF

SEQ ID NO: 316 - protein, 8 aa, Borrelia burgdorferi B31
HLKTNTFE

SEQ ID NO: 317 - protein, 8 aa, Borrelia burgdorferi B31
LKTNTFEG

SEQ ID NO: 318 - protein, 8 aa, Borrelia burgdorferi B31
KTNTFEGG

SEQ ID NO: 319 - protein, 8 aa, Borrelia burgdorferi B31
TNTFEGGK

SEQ ID NO: 320 - protein, 8 aa, Borrelia burgdorferi B31
NTFEGGKL

SEQ ID NO: 321 - protein, 8 aa, Borrelia burgdorferi B31
TFEGGKLI

SEQ ID NO: 322 - protein, 8 aa, Borrelia burgdorferi B31
FEGGKLIN

SEQ ID NO: 323 - protein, 8 aa, Borrelia burgdorferi B31
EGGKLINY

SEQ ID NO: 324 - protein, 8 aa, Borrelia burgdorferi B31
GGKLINYG

SEQ ID NO: 325 - protein, 8 aa, Borrelia burgdorferi B31
GKLINYGL

SEQ ID NO: 326 - protein, 8 aa, Borrelia burgdorferi B31
KLINYGLK

SEQ ID NO: 327 - protein, 8 aa, Borrelia burgdorferi B31
LINYGLKE

SEQ ID NO: 328 - protein, 8 aa, Borrelia burgdorferi B31
INYGLKEG

SEQ ID NO: 329 - protein, 8 aa, Borrelia burgdorferi B31
NYGLKEGV

SEQ ID NO: 330 - protein, 8 aa, Borrelia burgdorferi B31
YGLKEGVV

SEQ ID NO: 331 - protein, 8 aa, Borrelia burgdorferi B31
GLKEGVVG

SEQ ID NO: 332 - protein, 8 aa, Borrelia burgdorferi B31
LKEGVVGF

SEQ ID NO: 333 - protein, 8 aa, Borrelia burgdorferi B31
KEGVVGFV

SEQ ID NO: 334 - protein, 8 aa, Borrelia burgdorferi B31
EGVVGFVR

SEQ ID NO: 335 - protein, 8 aa, Borrelia burgdorferi B31
GVVGFVRN

SEQ ID NO: 336 - protein, 8 aa, Borrelia burgdorferi B31
VVGFVRNP

SEQ ID NO: 337 - protein, 8 aa, Borrelia burgdorferi B31
VGFVRNPK

SEQ ID NO: 338 - protein, 8 aa, Borrelia burgdorferi B31
GFVRNPKM

SEQ ID NO: 339 - protein, 8 aa, Borrelia burgdorferi B31
FVRNPKMI

SEQ ID NO: 340 - protein, 8 aa, Borrelia burgdorferi B31
VRNPKMIS

SEQ ID NO: 341 - protein, 8 aa, Borrelia burgdorferi B31
RNPKMISF

SEQ ID NO: 342 - protein, 8 aa, Borrelia burgdorferi B31
NPKMISFE

SEQ ID NO: 343 - protein, 8 aa, Borrelia burgdorferi B31
PKMISFEL

SEQ ID NO: 344 - protein, 8 aa, Borrelia burgdorferi B31
KMISFELE

SEQ ID NO: 345 - protein, 8 aa, Borrelia burgdorferi B31
MISFELEK

SEQ ID NO: 346 - protein, 8 aa, Borrelia burgdorferi B31
ISFELEKE

SEQ ID NO: 347 - protein, 8 aa, Borrelia burgdorferi B31
SFELEKEI

SEQ ID NO: 348 - protein, 8 aa, Borrelia burgdorferi B31
FELEKEID

SEQ ID NO: 349 - protein, 8 aa, Borrelia burgdorferi B31
ELEKEIDN

SEQ ID NO: 350 - protein, 8 aa, Borrelia burgdorferi B31
LEKEIDNL

SEQ ID NO: 351 - protein, 8 aa, Borrelia burgdorferi B31
EKEIDNLS

SEQ ID NO: 352 - protein, 8 aa, Borrelia burgdorferi B31
KEIDNLSS

SEQ ID NO: 353 - protein, 8 aa, Borrelia burgdorferi B31
EIDNLSSK

SEQ ID NO: 354 - protein, 8 aa, Borrelia burgdorferi B31
IDNLSSKI

SEQ ID NO: 355 - protein, 8 aa, Borrelia burgdorferi B31
DNLSSKII

SEQ ID NO: 356 - protein, 8 aa, Borrelia burgdorferi B31
NLSSKIIN

SEQ ID NO: 357 - protein, 8 aa, Borrelia burgdorferi B31
LSSKIINK

SEQ ID NO: 358 - protein, 8 aa, Borrelia burgdorferi B31
SSKIINKE

SEQ ID NO: 359 - protein, 8 aa, Borrelia burgdorferi B31
SKIINKEI

SEQ ID NO: 360 - protein, 8 aa, Borrelia burgdorferi B31
KIINKEII

SEQ ID NO: 361 - protein, 8 aa, Borrelia burgdorferi B31
IINKEIIV

SEQ ID NO: 362 - protein, 8 aa, Borrelia burgdorferi B31
INKEIIVP

SEQ ID NO: 363 - protein, 8 aa, Borrelia burgdorferi B31
NKEIIVPS

SEQ ID NO: 364 - protein, 8 aa, Borrelia burgdorferi B31
KEIIVPSN

SEQ ID NO: 365 - protein, 8 aa, Borrelia burgdorferi B31
EIIVPSNK

SEQ ID NO: 366 - protein, 8 aa, Borrelia burgdorferi B31
IIVPSNKE

SEQ ID NO: 367 - protein, 8 aa, Borrelia burgdorferi B31
IVPSNKES

SEQ ID NO: 368 - protein, 8 aa, Borrelia burgdorferi B31
VPSNKESY

SEQ ID NO: 369 - protein, 8 aa, Borrelia burgdorferi B31
PSNKESYE

SEQ ID NO: 370 - protein, 8 aa, Borrelia burgdorferi B31
SNKESYEK

SEQ ID NO: 371 - protein, 8 aa, Borrelia burgdorferi B31
NKESYEKF

SEQ ID NO: 372 - protein, 8 aa, Borrelia burgdorferi B31
KESYEKFL

SEQ ID NO: 373 - protein, 8 aa, Borrelia burgdorferi B31
ESYEKFLK

SEQ ID NO: 374 - protein, 8 aa, Borrelia burgdorferi B31
SYEKFLKE

SEQ ID NO: 375 - protein, 8 aa, Borrelia burgdorferi B31
YEKFLKEF

SEQ ID NO: 376 - protein, 8 aa, Borrelia burgdorferi B31
EKFLKEFI

SEQ ID NO: 377 - protein, 9 aa, Borrelia burgdorferi B31
MNKILLLIL

SEQ ID NO: 378 - protein, 9 aa, Borrelia burgdorferi B31
NKILLLILL

SEQ ID NO: 379 - protein, 9 aa, Borrelia burgdorferi B31
KILLLILLE

SEQ ID NO: 380 - protein, 9 aa, Borrelia burgdorferi B31
ILLLILLES

SEQ ID NO: 381 - protein, 9 aa, Borrelia burgdorferi B31
LLLILLESI

SEQ ID NO: 382 - protein, 9 aa, Borrelia burgdorferi B31
LLILLESIV

SEQ ID NO: 383 - protein, 9 aa, Borrelia burgdorferi B31
LILLESIVF

SEQ ID NO: 384 - protein, 9 aa, Borrelia burgdorferi B31
ILLESIVFL

SEQ ID NO: 385 - protein, 9 aa, Borrelia burgdorferi B31
LLESIVFLS

SEQ ID NO: 386 - protein, 9 aa, Borrelia burgdorferi B31
LESIVFLSC

SEQ ID NO: 387 - protein, 9 aa, Borrelia burgdorferi B31
ESIVFLSCS

SEQ ID NO: 388 - protein, 9 aa, Borrelia burgdorferi B31
SIVFLSCSG

SEQ ID NO: 389 - protein, 9 aa, Borrelia burgdorferi B31
IVFLSCSGK

SEQ ID NO: 390 - protein, 9 aa, Borrelia burgdorferi B31
VFLSCSGKG

SEQ ID NO: 391 - protein, 9 aa, Borrelia burgdorferi B31
FLSCSGKGS

SEQ ID NO: 392 - protein, 9 aa, Borrelia burgdorferi B31
LSCSGKGSL

SEQ ID NO: 393 - protein, 9 aa, Borrelia burgdorferi B31
SCSGKGSLG

SEQ ID NO: 394 - protein, 9 aa, Borrelia burgdorferi B31
CSGKGSLGS

SEQ ID NO: 395 - protein, 9 aa, Borrelia burgdorferi B31
SGKGSLGSE

SEQ ID NO: 396 - protein, 9 aa, Borrelia burgdorferi B31
GKGSLGSEI

SEQ ID NO: 397 - protein, 9 aa, Borrelia burgdorferi B31
KGSLGSEIP

SEQ ID NO: 398 - protein, 9 aa, Borrelia burgdorferi B31
GSLGSEIPK

SEQ ID NO: 399 - protein, 9 aa, Borrelia burgdorferi B31
SLGSEIPKV

SEQ ID NO: 400 - protein, 9 aa, Borrelia burgdorferi B31
LGSEIPKVS

SEQ ID NO: 401 - protein, 9 aa, Borrelia burgdorferi B31
GSEIPKVSL

SEQ ID NO: 402 - protein, 9 aa, Borrelia burgdorferi B31
SEIPKVSLI

SEQ ID NO: 403 - protein, 9 aa, Borrelia burgdorferi B31
EIPKVSLII

SEQ ID NO: 404 - protein, 9 aa, Borrelia burgdorferi B31
IPKVSLIID

SEQ ID NO: 405 - protein, 9 aa, Borrelia burgdorferi B31
PKVSLIIDG

SEQ ID NO: 406 - protein, 9 aa, Borrelia burgdorferi B31
KVSLIIDGT

SEQ ID NO: 407 - protein, 9 aa, Borrelia burgdorferi B31
VSLIIDGTF

SEQ ID NO: 408 - protein, 9 aa, Borrelia burgdorferi B31
SLIIDGTFD

SEQ ID NO: 409 - protein, 9 aa, Borrelia burgdorferi B31
LIIDGTFDD

SEQ ID NO: 410 - protein, 9 aa, Borrelia burgdorferi B31
IIDGTFDDK

SEQ ID NO: 411 - protein, 9 aa, Borrelia burgdorferi B31
IDGTFDDKS

SEQ ID NO: 412 - protein, 9 aa, Borrelia burgdorferi B31
DGTFDDKSF

SEQ ID NO: 413 - protein, 9 aa, Borrelia burgdorferi B31
GTFDDKSFN

SEQ ID NO: 414 - protein, 9 aa, Borrelia burgdorferi B31
TFDDKSFNE

SEQ ID NO: 415 - protein, 9 aa, Borrelia burgdorferi B31
FDDKSFNES

SEQ ID NO: 416 - protein, 9 aa, Borrelia burgdorferi B31
DDKSFNESA

SEQ ID NO: 417 - protein, 9 aa, Borrelia burgdorferi B31
DKSFNESAL

SEQ ID NO: 418 - protein, 9 aa, Borrelia burgdorferi B31
KSFNESALN

SEQ ID NO: 419 - protein, 9 aa, Borrelia burgdorferi B31
SFNESALNG

SEQ ID NO: 420 - protein, 9 aa, Borrelia burgdorferi B31
FNESALNGV

SEQ ID NO: 421 - protein, 9 aa, Borrelia burgdorferi B31
NESALNGVK

SEQ ID NO: 422 - protein, 9 aa, Borrelia burgdorferi B31
ESALNGVKK

SEQ ID NO: 423 - protein, 9 aa, Borrelia burgdorferi B31
SALNGVKKV

SEQ ID NO: 424 - protein, 9 aa, Borrelia burgdorferi B31
ALNGVKKVK

SEQ ID NO: 425 - protein, 9 aa, Borrelia burgdorferi B31
LNGVKKVKE

SEQ ID NO: 426 - protein, 9 aa, Borrelia burgdorferi B31
NGVKKVKEE

SEQ ID NO: 427 - protein, 9 aa, Borrelia burgdorferi B31
GVKKVKEEF

SEQ ID NO: 428 - protein, 9 aa, Borrelia burgdorferi B31
VKKVKEEFK

SEQ ID NO: 429 - protein, 9 aa, Borrelia burgdorferi B31
KKVKEEFKI

SEQ ID NO: 430 - protein, 9 aa, Borrelia burgdorferi B31
KVKEEFKIE

SEQ ID NO: 431 - protein, 9 aa, Borrelia burgdorferi B31
VKEEFKIEL

SEQ ID NO: 432 - protein, 9 aa, Borrelia burgdorferi B31
KEEFKIELV

SEQ ID NO: 433 - protein, 9 aa, Borrelia burgdorferi B31
EEFKIELVL

SEQ ID NO: 434 - protein, 9 aa, Borrelia burgdorferi B31
EFKIELVLK

SEQ ID NO: 435 - protein, 9 aa, Borrelia burgdorferi B31
FKIELVLKE

SEQ ID NO: 436 - protein, 9 aa, Borrelia burgdorferi B31
KIELVLKES

SEQ ID NO: 437 - protein, 9 aa, Borrelia burgdorferi B31
IELVLKESS

SEQ ID NO: 438 - protein, 9 aa, Borrelia burgdorferi B31
ELVLKESSS

SEQ ID NO: 439 - protein, 9 aa, Borrelia burgdorferi B31
LVLKESSSN

SEQ ID NO: 440 - protein, 9 aa, Borrelia burgdorferi B31
VLKESSSNS

SEQ ID NO: 441 - protein, 9 aa, Borrelia burgdorferi B31
LKESSSNSY

SEQ ID NO: 442 - protein, 9 aa, Borrelia burgdorferi B31
KESSSNSYL

SEQ ID NO: 443 - protein, 9 aa, Borrelia burgdorferi B31
ESSSNSYLS

SEQ ID NO: 444 - protein, 9 aa, Borrelia burgdorferi B31
SSSNSYLSD

SEQ ID NO: 445 - protein, 9 aa, Borrelia burgdorferi B31
SSNSYLSDL

SEQ ID NO: 446 - protein, 9 aa, Borrelia burgdorferi B31
SNSYLSDLE

SEQ ID NO: 447 - protein, 9 aa, Borrelia burgdorferi B31
NSYLSDLEG

SEQ ID NO: 448 - protein, 9 aa, Borrelia burgdorferi B31
SYLSDLEGL

SEQ ID NO: 449 - protein, 9 aa, Borrelia burgdorferi B31
YLSDLEGLK

SEQ ID NO: 450 - protein, 9 aa, Borrelia burgdorferi B31
LSDLEGLKD

SEQ ID NO: 451 - protein, 9 aa, Borrelia burgdorferi B31
SDLEGLKDA

SEQ ID NO: 452 - protein, 9 aa, Borrelia burgdorferi B31
DLEGLKDAG

SEQ ID NO: 453 - protein, 9 aa, Borrelia burgdorferi B31
LEGLKDAGS

SEQ ID NO: 454 - protein, 9 aa, Borrelia burgdorferi B31
EGLKDAGSD

SEQ ID NO: 455 - protein, 9 aa, Borrelia burgdorferi B31
GLKDAGSDL

SEQ ID NO: 456 - protein, 9 aa, Borrelia burgdorferi B31
LKDAGSDLI

SEQ ID NO: 457 - protein, 9 aa, Borrelia burgdorferi B31
KDAGSDLIW

SEQ ID NO: 458 - protein, 9 aa, Borrelia burgdorferi B31
DAGSDLIWL

SEQ ID NO: 459 - protein, 9 aa, Borrelia burgdorferi B31
AGSDLIWLI

SEQ ID NO: 460 - protein, 9 aa, Borrelia burgdorferi B31
GSDLIWLIG

SEQ ID NO: 461 - protein, 9 aa, Borrelia burgdorferi B31
SDLIWLIGY

SEQ ID NO: 462 - protein, 9 aa, Borrelia burgdorferi B31
DLIWLIGYR

SEQ ID NO: 463 - protein, 9 aa, Borrelia burgdorferi B31
LIWLIGYRF

SEQ ID NO: 464 - protein, 9 aa, Borrelia burgdorferi B31
IWLIGYRFS

SEQ ID NO: 465 - protein, 9 aa, Borrelia burgdorferi B31
WLIGYRFSD

SEQ ID NO: 466 - protein, 9 aa, Borrelia burgdorferi B31
LIGYRFSDV

SEQ ID NO: 467 - protein, 9 aa, Borrelia burgdorferi B31
IGYRFSDVA

SEQ ID NO: 468 - protein, 9 aa, Borrelia burgdorferi B31
GYRFSDVAK

SEQ ID NO: 469 - protein, 9 aa, Borrelia burgdorferi B31
YRFSDVAKV

SEQ ID NO: 470 - protein, 9 aa, Borrelia burgdorferi B31
RFSDVAKVA

SEQ ID NO: 471 - protein, 9 aa, Borrelia burgdorferi B31
FSDVAKVAA

SEQ ID NO: 472 - protein, 9 aa, Borrelia burgdorferi B31
SDVAKVAAL

SEQ ID NO: 473 - protein, 9 aa, Borrelia burgdorferi B31
DVAKVAALQ

SEQ ID NO: 474 - protein, 9 aa, Borrelia burgdorferi B31
VAKVAALQN

SEQ ID NO: 475 - protein, 9 aa, Borrelia burgdorferi B31
AKVAALQNP

SEQ ID NO: 476 - protein, 9 aa, Borrelia burgdorferi B31
KVAALQNPD

SEQ ID NO: 477 - protein, 9 aa, Borrelia burgdorferi B31
VAALQNPDM

SEQ ID NO: 478 - protein, 9 aa, Borrelia burgdorferi B31
AALQNPDMK

SEQ ID NO: 479 - protein, 9 aa, Borrelia burgdorferi B31
ALQNPDMKY

SEQ ID NO: 480 - protein, 9 aa, Borrelia burgdorferi B31
LQNPDMKYA

SEQ ID NO: 481 - protein, 9 aa, Borrelia burgdorferi B31
QNPDMKYAI

SEQ ID NO: 482 - protein, 9 aa, Borrelia burgdorferi B31
NPDMKYAII

SEQ ID NO: 483 - protein, 9 aa, Borrelia burgdorferi B31
PDMKYAIID

SEQ ID NO: 484 - protein, 9 aa, Borrelia burgdorferi B31
DMKYAIIDP

SEQ ID NO: 485 - protein, 9 aa, Borrelia burgdorferi B31
MKYAIIDPI

SEQ ID NO: 486 - protein, 9 aa, Borrelia burgdorferi B31
KYAIIDPIY

SEQ ID NO: 487 - protein, 9 aa, Borrelia burgdorferi B31
YAIIDPIYS

SEQ ID NO: 488 - protein, 9 aa, Borrelia burgdorferi B31
AIIDPIYSN

SEQ ID NO: 489 - protein, 9 aa, Borrelia burgdorferi B31
IIDPIYSND

SEQ ID NO: 490 - protein, 9 aa, Borrelia burgdorferi B31
IDPIYSNDP

SEQ ID NO: 491 - protein, 9 aa, Borrelia burgdorferi B31
DPIYSNDPI

SEQ ID NO: 492 - protein, 9 aa, Borrelia burgdorferi B31
PIYSNDPIP

SEQ ID NO: 493 - protein, 9 aa, Borrelia burgdorferi B31
IYSNDPIPA

SEQ ID NO: 494 - protein, 9 aa, Borrelia burgdorferi B31
YSNDPIPAN

SEQ ID NO: 495 - protein, 9 aa, Borrelia burgdorferi B31
SNDPIPANL

SEQ ID NO: 496 - protein, 9 aa, Borrelia burgdorferi B31
NDPIPANLV

SEQ ID NO: 497 - protein, 9 aa, Borrelia burgdorferi B31
DPIPANLVG

SEQ ID NO: 498 - protein, 9 aa, Borrelia burgdorferi B31
PIPANLVGM

SEQ ID NO: 499 - protein, 9 aa, Borrelia burgdorferi B31
IPANLVGMT

SEQ ID NO: 500 - protein, 9 aa, Borrelia burgdorferi B31
PANLVGMTF

SEQ ID NO: 501 - protein, 9 aa, Borrelia burgdorferi B31
ANLVGMTFR

SEQ ID NO: 502 - protein, 9 aa, Borrelia burgdorferi B31
NLVGMTFRA

SEQ ID NO: 503 - protein, 9 aa, Borrelia burgdorferi B31
LVGMTFRAQ

SEQ ID NO: 504 - protein, 9 aa, Borrelia burgdorferi B31
VGMTFRAQE

SEQ ID NO: 505 - protein, 9 aa, Borrelia burgdorferi B31
GMTFRAQEG

SEQ ID NO: 506 - protein, 9 aa, Borrelia burgdorferi B31
MTFRAQEGA

SEQ ID NO: 507 - protein, 9 aa, Borrelia burgdorferi B31
TFRAQEGAF

SEQ ID NO: 508 - protein, 9 aa, Borrelia burgdorferi B31
FRAQEGAFL

SEQ ID NO: 509 - protein, 9 aa, Borrelia burgdorferi B31
RAQEGAFLT

SEQ ID NO: 510 - protein, 9 aa, Borrelia burgdorferi B31
AQEGAFLTG

SEQ ID NO: 511 - protein, 9 aa, Borrelia burgdorferi B31
QEGAFLTGY

SEQ ID NO: 512 - protein, 9 aa, Borrelia burgdorferi B31
EGAFLTGYI

SEQ ID NO: 513 - protein, 9 aa, Borrelia burgdorferi B31
GAFLTGYIA

SEQ ID NO: 514 - protein, 9 aa, Borrelia burgdorferi B31
AFLTGYIAA

SEQ ID NO: 515 - protein, 9 aa, Borrelia burgdorferi B31
FLTGYIAAK

SEQ ID NO: 516 - protein, 9 aa, Borrelia burgdorferi B31
LTGYIAAKL

SEQ ID NO: 517 - protein, 9 aa, Borrelia burgdorferi B31
TGYIAAKLS

SEQ ID NO: 518 - protein, 9 aa, Borrelia burgdorferi B31
GYIAAKLSK

SEQ ID NO: 519 - protein, 9 aa, Borrelia burgdorferi B31
YIAAKLSKT

SEQ ID NO: 520 - protein, 9 aa, Borrelia burgdorferi B31
IAAKLSKTG

SEQ ID NO: 521 - protein, 9 aa, Borrelia burgdorferi B31
AAKLSKTGK

SEQ ID NO: 522 - protein, 9 aa, Borrelia burgdorferi B31
AKLSKTGKI

SEQ ID NO: 523 - protein, 9 aa, Borrelia burgdorferi B31
KLSKTGKIG

SEQ ID NO: 524 - protein, 9 aa, Borrelia burgdorferi B31
LSKTGKIGF

SEQ ID NO: 525 - protein, 9 aa, Borrelia burgdorferi B31
SKTGKIGFL

SEQ ID NO: 526 - protein, 9 aa, Borrelia burgdorferi B31
KTGKIGFLG

SEQ ID NO: 527 - protein, 9 aa, Borrelia burgdorferi B31
TGKIGFLGG

SEQ ID NO: 528 - protein, 9 aa, Borrelia burgdorferi B31
GKIGFLGGI

SEQ ID NO: 529 - protein, 9 aa, Borrelia burgdorferi B31
KIGFLGGIE

SEQ ID NO: 530 - protein, 9 aa, Borrelia burgdorferi B31
IGFLGGIEG

SEQ ID NO: 531 - protein, 9 aa, Borrelia burgdorferi B31
GFLGGIEGE

SEQ ID NO: 532 - protein, 9 aa, Borrelia burgdorferi B31
FLGGIEGEI

SEQ ID NO: 533 - protein, 9 aa, Borrelia burgdorferi B31
LGGIEGEIV

SEQ ID NO: 534 - protein, 9 aa, Borrelia burgdorferi B31
GGIEGEIVD

SEQ ID NO: 535 - protein, 9 aa, Borrelia burgdorferi B31
GIEGEIVDA

SEQ ID NO: 536 - protein, 9 aa, Borrelia burgdorferi B31
IEGEIVDAF

SEQ ID NO: 537 - protein, 9 aa, Borrelia burgdorferi B31
EGEIVDAFR

SEQ ID NO: 538 - protein, 9 aa, Borrelia burgdorferi B31
GEIVDAFRY

SEQ ID NO: 539 - protein, 9 aa, Borrelia burgdorferi B31
EIVDAFRYG

SEQ ID NO: 540 - protein, 9 aa, Borrelia burgdorferi B31
IVDAFRYGY

SEQ ID NO: 541 - protein, 9 aa, Borrelia burgdorferi B31
VDAFRYGYE

SEQ ID NO: 542 - protein, 9 aa, Borrelia burgdorferi B31
DAFRYGYEA

SEQ ID NO: 543 - protein, 9 aa, Borrelia burgdorferi B31
AFRYGYEAG

SEQ ID NO: 544 - protein, 9 aa, Borrelia burgdorferi B31
FRYGYEAGA

SEQ ID NO: 545 - protein, 9 aa, Borrelia burgdorferi B31
RYGYEAGAK

SEQ ID NO: 546 - protein, 9 aa, Borrelia burgdorferi B31
YGYEAGAKY

SEQ ID NO: 547 - protein, 9 aa, Borrelia burgdorferi B31
GYEAGAKYA

SEQ ID NO: 548 - protein, 9 aa, Borrelia burgdorferi B31
YEAGAKYAN

SEQ ID NO: 549 - protein, 9 aa, Borrelia burgdorferi B31
EAGAKYANK

SEQ ID NO: 550 - protein, 9 aa, Borrelia burgdorferi B31
AGAKYANKD

SEQ ID NO: 551 - protein, 9 aa, Borrelia burgdorferi B31
GAKYANKDI

SEQ ID NO: 552 - protein, 9 aa, Borrelia burgdorferi B31
AKYANKDIK

SEQ ID NO: 553 - protein, 9 aa, Borrelia burgdorferi B31
KYANKDIKI

SEQ ID NO: 554 - protein, 9 aa, Borrelia burgdorferi B31
YANKDIKIS

SEQ ID NO: 555 - protein, 9 aa, Borrelia burgdorferi B31
ANKDIKIST

SEQ ID NO: 556 - protein, 9 aa, Borrelia burgdorferi B31
NKDIKISTQ

SEQ ID NO: 557 - protein, 9 aa, Borrelia burgdorferi B31
KDIKISTQY

SEQ ID NO: 558 - protein, 9 aa, Borrelia burgdorferi B31
DIKISTQYI

SEQ ID NO: 559 - protein, 9 aa, Borrelia burgdorferi B31
IKISTQYIG

SEQ ID NO: 560 - protein, 9 aa, Borrelia burgdorferi B31
KISTQYIGS

SEQ ID NO: 561 - protein, 9 aa, Borrelia burgdorferi B31
ISTQYIGSF

SEQ ID NO: 562 - protein, 9 aa, Borrelia burgdorferi B31
STQYIGSFA

SEQ ID NO: 563 - protein, 9 aa, Borrelia burgdorferi B31
TQYIGSFAD

SEQ ID NO: 564 - protein, 9 aa, Borrelia burgdorferi B31
QYIGSFADL

SEQ ID NO: 565 - protein, 9 aa, Borrelia burgdorferi B31
YIGSFADLE

SEQ ID NO: 566 - protein, 9 aa, Borrelia burgdorferi B31
IGSFADLEA

SEQ ID NO: 567 - protein, 9 aa, Borrelia burgdorferi B31
GSFADLEAG

SEQ ID NO: 568 - protein, 9 aa, Borrelia burgdorferi B31
SFADLEAGR

SEQ ID NO: 569 - protein, 9 aa, Borrelia burgdorferi B31
FADLEAGRS

SEQ ID NO: 570 - protein, 9 aa, Borrelia burgdorferi B31
ADLEAGRSV

SEQ ID NO: 571 - protein, 9 aa, Borrelia burgdorferi B31
DLEAGRSVA

SEQ ID NO: 572 - protein, 9 aa, Borrelia burgdorferi B31
LEAGRSVAT

SEQ ID NO: 573 - protein, 9 aa, Borrelia burgdorferi B31
EAGRSVATR

SEQ ID NO: 574 - protein, 9 aa, Borrelia burgdorferi B31
AGRSVATRM

SEQ ID NO: 575 - protein, 9 aa, Borrelia burgdorferi B31
GRSVATRMY

SEQ ID NO: 576 - protein, 9 aa, Borrelia burgdorferi B31
RSVATRMYS

SEQ ID NO: 577 - protein, 9 aa, Borrelia burgdorferi B31
SVATRMYSD

SEQ ID NO: 578 - protein, 9 aa, Borrelia burgdorferi B31
VATRMYSDE

SEQ ID NO: 579 - protein, 9 aa, Borrelia burgdorferi B31
ATRMYSDEI

SEQ ID NO: 580 - protein, 9 aa, Borrelia burgdorferi B31
TRMYSDEID

SEQ ID NO: 581 - protein, 9 aa, Borrelia burgdorferi B31
RMYSDEIDI

SEQ ID NO: 582 - protein, 9 aa, Borrelia burgdorferi B31
MYSDEIDII

SEQ ID NO: 583 - protein, 9 aa, Borrelia burgdorferi B31
YSDEIDIIH

SEQ ID NO: 584 - protein, 9 aa, Borrelia burgdorferi B31
SDEIDIIHH

SEQ ID NO: 585 - protein, 9 aa, Borrelia burgdorferi B31
DEIDIIHHA

SEQ ID NO: 586 - protein, 9 aa, Borrelia burgdorferi B31
EIDIIHHAA

SEQ ID NO: 587 - protein, 9 aa, Borrelia burgdorferi B31
IDIIHHAAG

SEQ ID NO: 588 - protein, 9 aa, Borrelia burgdorferi B31
DIIHHAAGL

SEQ ID NO: 589 - protein, 9 aa, Borrelia burgdorferi B31
IIHHAAGLG

SEQ ID NO: 590 - protein, 9 aa, Borrelia burgdorferi B31
IHHAAGLGG

SEQ ID NO: 591 - protein, 9 aa, Borrelia burgdorferi B31
HHAAGLGGI

SEQ ID NO: 592 - protein, 9 aa, Borrelia burgdorferi B31
HAAGLGGIG

SEQ ID NO: 593 - protein, 9 aa, Borrelia burgdorferi B31
AAGLGGIGA

SEQ ID NO: 594 - protein, 9 aa, Borrelia burgdorferi B31
AGLGGIGAI

SEQ ID NO: 595 - protein, 9 aa, Borrelia burgdorferi B31
GLGGIGAIE

SEQ ID NO: 596 - protein, 9 aa, Borrelia burgdorferi B31
LGGIGAIEV

SEQ ID NO: 597 - protein, 9 aa, Borrelia burgdorferi B31
GGIGAIEVA

SEQ ID NO: 598 - protein, 9 aa, Borrelia burgdorferi B31
GIGAIEVAK

SEQ ID NO: 599 - protein, 9 aa, Borrelia burgdorferi B31
IGAIEVAKE

SEQ ID NO: 600 - protein, 9 aa, Borrelia burgdorferi B31
GAIEVAKEL

SEQ ID NO: 601 - protein, 9 aa, Borrelia burgdorferi B31
AIEVAKELG

SEQ ID NO: 602 - protein, 9 aa, Borrelia burgdorferi B31
IEVAKELGS

SEQ ID NO: 603 - protein, 9 aa, Borrelia burgdorferi B31
EVAKELGSG

SEQ ID NO: 604 - protein, 9 aa, Borrelia burgdorferi B31
VAKELGSGH

SEQ ID NO: 605 - protein, 9 aa, Borrelia burgdorferi B31
AKELGSGHY

SEQ ID NO: 606 - protein, 9 aa, Borrelia burgdorferi B31
KELGSGHYI

SEQ ID NO: 607 - protein, 9 aa, Borrelia burgdorferi B31
ELGSGHYII

SEQ ID NO: 608 - protein, 9 aa, Borrelia burgdorferi B31
LGSGHYIIG

SEQ ID NO: 609 - protein, 9 aa, Borrelia burgdorferi B31
GSGHYIIGV

SEQ ID NO: 610 - protein, 9 aa, Borrelia burgdorferi B31
SGHYIIGVD

SEQ ID NO: 611 - protein, 9 aa, Borrelia burgdorferi B31
GHYIIGVDE

SEQ ID NO: 612 - protein, 9 aa, Borrelia burgdorferi B31
HYIIGVDED

SEQ ID NO: 613 - protein, 9 aa, Borrelia burgdorferi B31
YIIGVDEDQ

SEQ ID NO: 614 - protein, 9 aa, Borrelia burgdorferi B31
IIGVDEDQA

SEQ ID NO: 615 - protein, 9 aa, Borrelia burgdorferi B31
IGVDEDQAY

SEQ ID NO: 616 - protein, 9 aa, Borrelia burgdorferi B31
GVDEDQAYL

SEQ ID NO: 617 - protein, 9 aa, Borrelia burgdorferi B31
VDEDQAYLA

SEQ ID NO: 618 - protein, 9 aa, Borrelia burgdorferi B31
DEDQAYLAP

SEQ ID NO: 619 - protein, 9 aa, Borrelia burgdorferi B31
EDQAYLAPD

SEQ ID NO: 620 - protein, 9 aa, Borrelia burgdorferi B31
DQAYLAPDN

SEQ ID NO: 621 - protein, 9 aa, Borrelia burgdorferi B31
QAYLAPDNV

SEQ ID NO: 622 - protein, 9 aa, Borrelia burgdorferi B31
AYLAPDNVI

SEQ ID NO: 623 - protein, 9 aa, Borrelia burgdorferi B31
YLAPDNVIT

SEQ ID NO: 624 - protein, 9 aa, Borrelia burgdorferi B31
LAPDNVITS

SEQ ID NO: 625 - protein, 9 aa, Borrelia burgdorferi B31
APDNVITST

SEQ ID NO: 626 - protein, 9 aa, Borrelia burgdorferi B31
PDNVITSTT

SEQ ID NO: 627 - protein, 9 aa, Borrelia burgdorferi B31
DNVITSTTK

SEQ ID NO: 628 - protein, 9 aa, Borrelia burgdorferi B31
NVITSTTKD

SEQ ID NO: 629 - protein, 9 aa, Borrelia burgdorferi B31
VITSTTKDV

SEQ ID NO: 630 - protein, 9 aa, Borrelia burgdorferi B31
ITSTTKDVG

SEQ ID NO: 631 - protein, 9 aa, Borrelia burgdorferi B31
TSTTKDVGR

SEQ ID NO: 632 - protein, 9 aa, Borrelia burgdorferi B31
STTKDVGRA

SEQ ID NO: 633 - protein, 9 aa, Borrelia burgdorferi B31
TTKDVGRAL

SEQ ID NO: 634 - protein, 9 aa, Borrelia burgdorferi B31
TKDVGRALN

SEQ ID NO: 635 - protein, 9 aa, Borrelia burgdorferi B31
KDVGRALNI

SEQ ID NO: 636 - protein, 9 aa, Borrelia burgdorferi B31
DVGRALNIF

SEQ ID NO: 637 - protein, 9 aa, Borrelia burgdorferi B31
VGRALNIFT

SEQ ID NO: 638 - protein, 9 aa, Borrelia burgdorferi B31
GRALNIFTS

SEQ ID NO: 639 - protein, 9 aa, Borrelia burgdorferi B31
RALNIFTSN

SEQ ID NO: 640 - protein, 9 aa, Borrelia burgdorferi B31
ALNIFTSNH

SEQ ID NO: 641 - protein, 9 aa, Borrelia burgdorferi B31
LNIFTSNHL

SEQ ID NO: 642 - protein, 9 aa, Borrelia burgdorferi B31
NIFTSNHLK

SEQ ID NO: 643 - protein, 9 aa, Borrelia burgdorferi B31
IFTSNHLKT

SEQ ID NO: 644 - protein, 9 aa, Borrelia burgdorferi B31
FTSNHLKTN

SEQ ID NO: 645 - protein, 9 aa, Borrelia burgdorferi B31
TSNHLKTNT

SEQ ID NO: 646 - protein, 9 aa, Borrelia burgdorferi B31
SNHLKTNTF

SEQ ID NO: 647 - protein, 9 aa, Borrelia burgdorferi B31
NHLKTNTFE

SEQ ID NO: 648 - protein, 9 aa, Borrelia burgdorferi B31
HLKTNTFEG

SEQ ID NO: 649 - protein, 9 aa, Borrelia burgdorferi B31
LKTNTFEGG

SEQ ID NO: 650 - protein, 9 aa, Borrelia burgdorferi B31
KTNTFEGGK

SEQ ID NO: 651 - protein, 9 aa, Borrelia burgdorferi B31
TNTFEGGKL

SEQ ID NO: 652 - protein, 9 aa, Borrelia burgdorferi B31
NTFEGGKLI

SEQ ID NO: 653 - protein, 9 aa, Borrelia burgdorferi B31
TFEGGKLIN

SEQ ID NO: 654 - protein, 9 aa, Borrelia burgdorferi B31
FEGGKLINY

SEQ ID NO: 655 - protein, 9 aa, Borrelia burgdorferi B31
EGGKLINYG

SEQ ID NO: 656 - protein, 9 aa, Borrelia burgdorferi B31
GGKLINYGL

SEQ ID NO: 657 - protein, 9 aa, Borrelia burgdorferi B31
GKLINYGLK

SEQ ID NO: 658 - protein, 9 aa, Borrelia burgdorferi B31
KLINYGLKE

SEQ ID NO: 659 - protein, 9 aa, Borrelia burgdorferi B31
LINYGLKEG

SEQ ID NO: 660 - protein, 9 aa, Borrelia burgdorferi B31
INYGLKEGV

SEQ ID NO: 661 - protein, 9 aa, Borrelia burgdorferi B31
NYGLKEGVV

SEQ ID NO: 662 - protein, 9 aa, Borrelia burgdorferi B31
YGLKEGVVG

SEQ ID NO: 663 - protein, 9 aa, Borrelia burgdorferi B31
GLKEGVVGF

SEQ ID NO: 664 - protein, 9 aa, Borrelia burgdorferi B31
LKEGVVGFV

SEQ ID NO: 665 - protein, 9 aa, Borrelia burgdorferi B31
KEGVVGFVR

SEQ ID NO: 666 - protein, 9 aa, Borrelia burgdorferi B31
EGVVGFVRN

SEQ ID NO: 667 - protein, 9 aa, Borrelia burgdorferi B31
GVVGFVRNP

SEQ ID NO: 668 - protein, 9 aa, Borrelia burgdorferi B31
VVGFVRNPK

SEQ ID NO: 669 - protein, 9 aa, Borrelia burgdorferi B31
VGFVRNPKM

SEQ ID NO: 670 - protein, 9 aa, Borrelia burgdorferi B31
GFVRNPKMI

SEQ ID NO: 671 - protein, 9 aa, Borrelia burgdorferi B31
FVRNPKMIS

SEQ ID NO: 672 - protein, 9 aa, Borrelia burgdorferi B31
VRNPKMISF

SEQ ID NO: 673 - protein, 9 aa, Borrelia burgdorferi B31
RNPKMISFE

SEQ ID NO: 674 - protein, 9 aa, Borrelia burgdorferi B31
NPKMISFEL

SEQ ID NO: 675 - protein, 9 aa, Borrelia burgdorferi B31
PKMISFELE

SEQ ID NO: 676 - protein, 9 aa, Borrelia burgdorferi B31
KMISFELEK

SEQ ID NO: 677 - protein, 9 aa, Borrelia burgdorferi B31
MISFELEKE

SEQ ID NO: 678 - protein, 9 aa, Borrelia burgdorferi B31
ISFELEKEI

SEQ ID NO: 679 - protein, 9 aa, Borrelia burgdorferi B31
SFELEKEID

SEQ ID NO: 680 - protein, 9 aa, Borrelia burgdorferi B31
FELEKEIDN

SEQ ID NO: 681 - protein, 9 aa, Borrelia burgdorferi B31
ELEKEIDNL

SEQ ID NO: 682 - protein, 9 aa, Borrelia burgdorferi B31
LEKEIDNLS

SEQ ID NO: 683 - protein, 9 aa, Borrelia burgdorferi B31
EKEIDNLSS

SEQ ID NO: 684 - protein, 9 aa, Borrelia burgdorferi B31
KEIDNLSSK

SEQ ID NO: 685 - protein, 9 aa, Borrelia burgdorferi B31
EIDNLSSKI

SEQ ID NO: 686 - protein, 9 aa, Borrelia burgdorferi B31
IDNLSSKII

SEQ ID NO: 687 - protein, 9 aa, Borrelia burgdorferi B31
DNLSSKIIN

SEQ ID NO: 688 - protein, 9 aa, Borrelia burgdorferi B31
NLSSKIINK

SEQ ID NO: 689 - protein, 9 aa, Borrelia burgdorferi B31
LSSKIINKE

SEQ ID NO: 690 - protein, 9 aa, Borrelia burgdorferi B31
SSKIINKEI

SEQ ID NO: 691 - protein, 9 aa, Borrelia burgdorferi B31
SKIINKEII

SEQ ID NO: 692 - protein, 9 aa, Borrelia burgdorferi B31
KIINKEIIV

SEQ ID NO: 693 - protein, 9 aa, Borrelia burgdorferi B31
IINKEIIVP

SEQ ID NO: 694 - protein, 9 aa, Borrelia burgdorferi B31
INKEIIVPS

SEQ ID NO: 695 - protein, 9 aa, Borrelia burgdorferi B31
NKEIIVPSN

SEQ ID NO: 696 - protein, 9 aa, Borrelia burgdorferi B31
KEIIVPSNK

SEQ ID NO: 697 - protein, 9 aa, Borrelia burgdorferi B31
EIIVPSNKE

SEQ ID NO: 698 - protein, 9 aa, Borrelia burgdorferi B31
IIVPSNKES

SEQ ID NO: 699 - protein, 9 aa, Borrelia burgdorferi B31
IVPSNKESY

SEQ ID NO: 700 - protein, 9 aa, Borrelia burgdorferi B31
VPSNKESYE

SEQ ID NO: 701 - protein, 9 aa, Borrelia burgdorferi B31
PSNKESYEK

SEQ ID NO: 702 - protein, 9 aa, Borrelia burgdorferi B31
SNKESYEKF

SEQ ID NO: 703 - protein, 9 aa, Borrelia burgdorferi B31
NKESYEKFL

SEQ ID NO: 704 - protein, 9 aa, Borrelia burgdorferi B31
KESYEKFLK

SEQ ID NO: 705 - protein, 9 aa, Borrelia burgdorferi B31
ESYEKFLKE

SEQ ID NO: 706 - protein, 9 aa, Borrelia burgdorferi B31
SYEKFLKEF

SEQ ID NO: 707 - protein, 9 aa, Borrelia burgdorferi B31
YEKFLKEFI

SEQ ID NO: 708 - protein, 10 aa, Borrelia burgdorferi B31
MNKILLLILL

SEQ ID NO: 709 - protein, 10 aa, Borrelia burgdorferi B31
NKILLLILLE

SEQ ID NO: 710 - protein, 10 aa, Borrelia burgdorferi B31
KILLLILLES

SEQ ID NO: 711 - protein, 10 aa, Borrelia burgdorferi B31
ILLLILLESI

SEQ ID NO: 712 - protein, 10 aa, Borrelia burgdorferi B31
LLLILLESIV

SEQ ID NO: 713 - protein, 10 aa, Borrelia burgdorferi B31
LLILLESIVF

SEQ ID NO: 714 - protein, 10 aa, Borrelia burgdorferi B31
LILLESIVFL

SEQ ID NO: 715 - protein, 10 aa, Borrelia burgdorferi B31
ILLESIVFLS

SEQ ID NO: 716 - protein, 10 aa, Borrelia burgdorferi B31
LLESIVFLSC

SEQ ID NO: 717 - protein, 10 aa, Borrelia burgdorferi B31
LESIVFLSCS

SEQ ID NO: 718 - protein, 10 aa, Borrelia burgdorferi B31
ESIVFLSCSG

SEQ ID NO: 719 - protein, 10 aa, Borrelia burgdorferi B31
SIVFLSCSGK

SEQ ID NO: 720 - protein, 10 aa, Borrelia burgdorferi B31
IVFLSCSGKG

SEQ ID NO: 721 - protein, 10 aa, Borrelia burgdorferi B31
VFLSCSGKGS

SEQ ID NO: 722 - protein, 10 aa, Borrelia burgdorferi B31
FLSCSGKGSL

SEQ ID NO: 723 - protein, 10 aa, Borrelia burgdorferi B31
LSCSGKGSLG

SEQ ID NO: 724 - protein, 10 aa, Borrelia burgdorferi B31
SCSGKGSLGS

SEQ ID NO: 725 - protein, 10 aa, Borrelia burgdorferi B31
CSGKGSLGSE

SEQ ID NO: 726 - protein, 10 aa, Borrelia burgdorferi B31
SGKGSLGSEI

SEQ ID NO: 727 - protein, 10 aa, Borrelia burgdorferi B31
GKGSLGSEIP

SEQ ID NO: 728 - protein, 10 aa, Borrelia burgdorferi B31
KGSLGSEIPK

SEQ ID NO: 729 - protein, 10 aa, Borrelia burgdorferi B31
GSLGSEIPKV

SEQ ID NO: 730 - protein, 10 aa, Borrelia burgdorferi B31
SLGSEIPKVS

SEQ ID NO: 731 - protein, 10 aa, Borrelia burgdorferi B31
LGSEIPKVSL

SEQ ID NO: 732 - protein, 10 aa, Borrelia burgdorferi B31
GSEIPKVSLI

SEQ ID NO: 733 - protein, 10 aa, Borrelia burgdorferi B31
SEIPKVSLII

SEQ ID NO: 734 - protein, 10 aa, Borrelia burgdorferi B31
EIPKVSLIID

SEQ ID NO: 735 - protein, 10 aa, Borrelia burgdorferi B31
IPKVSLIIDG

SEQ ID NO: 736 - protein, 10 aa, Borrelia burgdorferi B31
PKVSLIIDGT

SEQ ID NO: 737 - protein, 10 aa, Borrelia burgdorferi B31
KVSLIIDGTF

SEQ ID NO: 738 - protein, 10 aa, Borrelia burgdorferi B31
VSLIIDGTFD

SEQ ID NO: 739 - protein, 10 aa, Borrelia burgdorferi B31
SLIIDGTFDD

SEQ ID NO: 740 - protein, 10 aa, Borrelia burgdorferi B31
LIIDGTFDDK

SEQ ID NO: 741 - protein, 10 aa, Borrelia burgdorferi B31
IIDGTFDDKS

SEQ ID NO: 742 - protein, 10 aa, Borrelia burgdorferi B31
IDGTFDDKSF

SEQ ID NO: 743 - protein, 10 aa, Borrelia burgdorferi B31
DGTFDDKSFN

SEQ ID NO: 744 - protein, 10 aa, Borrelia burgdorferi B31
GTFDDKSFNE

SEQ ID NO: 745 - protein, 10 aa, Borrelia burgdorferi B31
TFDDKSFNES

SEQ ID NO: 746 - protein, 10 aa, Borrelia burgdorferi B31
FDDKSFNESA

SEQ ID NO: 747 - protein, 10 aa, Borrelia burgdorferi B31
DDKSFNESAL

SEQ ID NO: 748 - protein, 10 aa, Borrelia burgdorferi B31
DKSFNESALN

SEQ ID NO: 749 - protein, 10 aa, Borrelia burgdorferi B31
KSFNESALNG

SEQ ID NO: 750 - protein, 10 aa, Borrelia burgdorferi B31
SFNESALNGV

SEQ ID NO: 751 - protein, 10 aa, Borrelia burgdorferi B31
FNESALNGVK

SEQ ID NO: 752 - protein, 10 aa, Borrelia burgdorferi B31
NESALNGVKK

SEQ ID NO: 753 - protein, 10 aa, Borrelia burgdorferi B31
ESALNGVKKV

SEQ ID NO: 754 - protein, 10 aa, Borrelia burgdorferi B31
SALNGVKKVK

SEQ ID NO: 755 - protein, 10 aa, Borrelia burgdorferi B31
ALNGVKKVKE

SEQ ID NO: 756 - protein, 10 aa, Borrelia burgdorferi B31
LNGVKKVKEE

SEQ ID NO: 757 - protein, 10 aa, Borrelia burgdorferi B31
NGVKKVKEEF

SEQ ID NO: 758 - protein, 10 aa, Borrelia burgdorferi B31
GVKKVKEEFK

SEQ ID NO: 759 - protein, 10 aa, Borrelia burgdorferi B31
VKKVKEEFKI

SEQ ID NO: 760 - protein, 10 aa, Borrelia burgdorferi B31
KKVKEEFKIE

SEQ ID NO: 761 - protein, 10 aa, Borrelia burgdorferi B31
KVKEEFKIEL

SEQ ID NO: 762 - protein, 10 aa, Borrelia burgdorferi B31
VKEEFKIELV

SEQ ID NO: 763 - protein, 10 aa, Borrelia burgdorferi B31
KEEFKIELVL

SEQ ID NO: 764 - protein, 10 aa, Borrelia burgdorferi B31
EEFKIELVLK

SEQ ID NO: 765 - protein, 10 aa, Borrelia burgdorferi B31
EFKIELVLKE

SEQ ID NO: 766 - protein, 10 aa, Borrelia burgdorferi B31
FKIELVLKES

SEQ ID NO: 767 - protein, 10 aa, Borrelia burgdorferi B31
KIELVLKESS

SEQ ID NO: 768 - protein, 10 aa, Borrelia burgdorferi B31
IELVLKESSS

SEQ ID NO: 769 - protein, 10 aa, Borrelia burgdorferi B31
ELVLKESSSN

SEQ ID NO: 770 - protein, 10 aa, Borrelia burgdorferi B31
LVLKESSSNS

SEQ ID NO: 771 - protein, 10 aa, Borrelia burgdorferi B31
VLKESSSNSY

SEQ ID NO: 772 - protein, 10 aa, Borrelia burgdorferi B31
LKESSSNSYL

SEQ ID NO: 773 - protein, 10 aa, Borrelia burgdorferi B31
KESSSNSYLS

SEQ ID NO: 774 - protein, 10 aa, Borrelia burgdorferi B31
ESSSNSYLSD

SEQ ID NO: 775 - protein, 10 aa, Borrelia burgdorferi B31
SSSNSYLSDL

SEQ ID NO: 776 - protein, 10 aa, Borrelia burgdorferi B31
SSNSYLSDLE

SEQ ID NO: 777 - protein, 10 aa, Borrelia burgdorferi B31
SNSYLSDLEG

SEQ ID NO: 778 - protein, 10 aa, Borrelia burgdorferi B31
NSYLSDLEGL

SEQ ID NO: 779 - protein, 10 aa, Borrelia burgdorferi B31
SYLSDLEGLK

SEQ ID NO: 780 - protein, 10 aa, Borrelia burgdorferi B31
YLSDLEGLKD

SEQ ID NO: 781 - protein, 10 aa, Borrelia burgdorferi B31
LSDLEGLKDA

SEQ ID NO: 782 - protein, 10 aa, Borrelia burgdorferi B31
SDLEGLKDAG

SEQ ID NO: 783 - protein, 10 aa, Borrelia burgdorferi B31
DLEGLKDAGS

SEQ ID NO: 784 - protein, 10 aa, Borrelia burgdorferi B31
LEGLKDAGSD

SEQ ID NO: 785 - protein, 10 aa, Borrelia burgdorferi B31
EGLKDAGSDL

SEQ ID NO: 786 - protein, 10 aa, Borrelia burgdorferi B31
GLKDAGSDLI

SEQ ID NO: 787 - protein, 10 aa, Borrelia burgdorferi B31
LKDAGSDLIW

SEQ ID NO: 788 - protein, 10 aa, Borrelia burgdorferi B31
KDAGSDLIWL

SEQ ID NO: 789 - protein, 10 aa, Borrelia burgdorferi B31
DAGSDLIWLI

SEQ ID NO: 790 - protein, 10 aa, Borrelia burgdorferi B31
AGSDLIWLIG

SEQ ID NO: 791 - protein, 10 aa, Borrelia burgdorferi B31
GSDLIWLIGY

SEQ ID NO: 792 - protein, 10 aa, Borrelia burgdorferi B31
SDLIWLIGYR

SEQ ID NO: 793 - protein, 10 aa, Borrelia burgdorferi B31
DLIWLIGYRF

SEQ ID NO: 794 - protein, 10 aa, Borrelia burgdorferi B31
LIWLIGYRFS

SEQ ID NO: 795 - protein, 10 aa, Borrelia burgdorferi B31
IWLIGYRFSD

SEQ ID NO: 796 - protein, 10 aa, Borrelia burgdorferi B31
WLIGYRFSDV

SEQ ID NO: 797 - protein, 10 aa, Borrelia burgdorferi B31
LIGYRFSDVA

SEQ ID NO: 798 - protein, 10 aa, Borrelia burgdorferi B31
IGYRFSDVAK

SEQ ID NO: 799 - protein, 10 aa, Borrelia burgdorferi B31
GYRFSDVAKV

SEQ ID NO: 800 - protein, 10 aa, Borrelia burgdorferi B31
YRFSDVAKVA

SEQ ID NO: 801 - protein, 10 aa, Borrelia burgdorferi B31
RFSDVAKVAA

SEQ ID NO: 802 - protein, 10 aa, Borrelia burgdorferi B31
FSDVAKVAAL

SEQ ID NO: 803 - protein, 10 aa, Borrelia burgdorferi B31
SDVAKVAALQ

SEQ ID NO: 804 - protein, 10 aa, Borrelia burgdorferi B31
DVAKVAALQN

SEQ ID NO: 805 - protein, 10 aa, Borrelia burgdorferi B31
VAKVAALQNP

SEQ ID NO: 806 - protein, 10 aa, Borrelia burgdorferi B31
AKVAALQNPD

SEQ ID NO: 807 - protein, 10 aa, Borrelia burgdorferi B31
KVAALQNPDM

SEQ ID NO: 808 - protein, 10 aa, Borrelia burgdorferi B31
VAALQNPDMK

SEQ ID NO: 809 - protein, 10 aa, Borrelia burgdorferi B31
AALQNPDMKY

SEQ ID NO: 810 - protein, 10 aa, Borrelia burgdorferi B31
ALQNPDMKYA

SEQ ID NO: 811 - protein, 10 aa, Borrelia burgdorferi B31
LQNPDMKYAI

SEQ ID NO: 812 - protein, 10 aa, Borrelia burgdorferi B31
QNPDMKYAII

SEQ ID NO: 813 - protein, 10 aa, Borrelia burgdorferi B31
NPDMKYAIID

SEQ ID NO: 814 - protein, 10 aa, Borrelia burgdorferi B31
PDMKYAIIDP

SEQ ID NO: 815 - protein, 10 aa, Borrelia burgdorferi B31
DMKYAIIDPI

SEQ ID NO: 816 - protein, 10 aa, Borrelia burgdorferi B31
MKYAIIDPIY

SEQ ID NO: 817 - protein, 10 aa, Borrelia burgdorferi B31
KYAIIDPIYS

SEQ ID NO: 818 - protein, 10 aa, Borrelia burgdorferi B31
YAIIDPIYSN

SEQ ID NO: 819 - protein, 10 aa, Borrelia burgdorferi B31
AIIDPIYSND

SEQ ID NO: 820 - protein, 10 aa, Borrelia burgdorferi B31
IIDPIYSNDP

SEQ ID NO: 821 - protein, 10 aa, Borrelia burgdorferi B31
IDPIYSNDPI

SEQ ID NO: 822 - protein, 10 aa, Borrelia burgdorferi B31
DPIYSNDPIP

SEQ ID NO: 823 - protein, 10 aa, Borrelia burgdorferi B31
PIYSNDPIPA

SEQ ID NO: 824 - protein, 10 aa, Borrelia burgdorferi B31
IYSNDPIPAN

SEQ ID NO: 825 - protein, 10 aa, Borrelia burgdorferi B31
YSNDPIPANL

SEQ ID NO: 826 - protein, 10 aa, Borrelia burgdorferi B31
SNDPIPANLV

SEQ ID NO: 827 - protein, 10 aa, Borrelia burgdorferi B31
NDPIPANLVG

SEQ ID NO: 828 - protein, 10 aa, Borrelia burgdorferi B31
DPIPANLVGM

SEQ ID NO: 829 - protein, 10 aa, Borrelia burgdorferi B31
PIPANLVGMT

SEQ ID NO: 830 - protein, 10 aa, Borrelia burgdorferi B31
IPANLVGMTF

SEQ ID NO: 831 - protein, 10 aa, Borrelia burgdorferi B31
PANLVGMTFR

SEQ ID NO: 832 - protein, 10 aa, Borrelia burgdorferi B31
ANLVGMTFRA

SEQ ID NO: 833 - protein, 10 aa, Borrelia burgdorferi B31
NLVGMTFRAQ

SEQ ID NO: 834 - protein, 10 aa, Borrelia burgdorferi B31
LVGMTFRAQE

SEQ ID NO: 835 - protein, 10 aa, Borrelia burgdorferi B31
VGMTFRAQEG

SEQ ID NO: 836 - protein, 10 aa, Borrelia burgdorferi B31
GMTFRAQEGA

SEQ ID NO: 837 - protein, 10 aa, Borrelia burgdorferi B31
MTFRAQEGAF

SEQ ID NO: 838 - protein, 10 aa, Borrelia burgdorferi B31
TFRAQEGAFL

SEQ ID NO: 839 - protein, 10 aa, Borrelia burgdorferi B31
FRAQEGAFLT

SEQ ID NO: 840 - protein, 10 aa, Borrelia burgdorferi B31
RAQEGAFLTG

SEQ ID NO: 841 - protein, 10 aa, Borrelia burgdorferi B31
AQEGAFLTGY

SEQ ID NO: 842 - protein, 10 aa, Borrelia burgdorferi B31
QEGAFLTGYI

SEQ ID NO: 843 - protein, 10 aa, Borrelia burgdorferi B31
EGAFLTGYIA

SEQ ID NO: 844 - protein, 10 aa, Borrelia burgdorferi B31
GAFLTGYIAA

SEQ ID NO: 845 - protein, 10 aa, Borrelia burgdorferi B31
AFLTGYIAAK

SEQ ID NO: 846 - protein, 10 aa, Borrelia burgdorferi B31
FLTGYIAAKL

SEQ ID NO: 847 - protein, 10 aa, Borrelia burgdorferi B31
LTGYIAAKLS

SEQ ID NO: 848 - protein, 10 aa, Borrelia burgdorferi B31
TGYIAAKLSK

SEQ ID NO: 849 - protein, 10 aa, Borrelia burgdorferi B31
GYIAAKLSKT

SEQ ID NO: 850 - protein, 10 aa, Borrelia burgdorferi B31
YIAAKLSKTG

SEQ ID NO: 851 - protein, 10 aa, Borrelia burgdorferi B31
IAAKLSKTGK

SEQ ID NO: 852 - protein, 10 aa, Borrelia burgdorferi B31
AAKLSKTGKI

SEQ ID NO: 853 - protein, 10 aa, Borrelia burgdorferi B31
AKLSKTGKIG

SEQ ID NO: 854 - protein, 10 aa, Borrelia burgdorferi B31
KLSKTGKIGF

SEQ ID NO: 855 - protein, 10 aa, Borrelia burgdorferi B31
LSKTGKIGFL

SEQ ID NO: 856 - protein, 10 aa, Borrelia burgdorferi B31
SKTGKIGFLG

SEQ ID NO: 857 - protein, 10 aa, Borrelia burgdorferi B31
KTGKIGFLGG

SEQ ID NO: 858 - protein, 10 aa, Borrelia burgdorferi B31
TGKIGFLGGI

SEQ ID NO: 859 - protein, 10 aa, Borrelia burgdorferi B31
GKIGFLGGIE

SEQ ID NO: 860 - protein, 10 aa, Borrelia burgdorferi B31
KIGFLGGIEG

SEQ ID NO: 861 - protein, 10 aa, Borrelia burgdorferi B31
IGFLGGIEGE

SEQ ID NO: 862 - protein, 10 aa, Borrelia burgdorferi B31
GFLGGIEGEI

SEQ ID NO: 863 - protein, 10 aa, Borrelia burgdorferi B31
FLGGIEGEIV

SEQ ID NO: 864 - protein, 10 aa, Borrelia burgdorferi B31
LGGIEGEIVD

SEQ ID NO: 865 - protein, 10 aa, Borrelia burgdorferi B31
GGIEGEIVDA

SEQ ID NO: 866 - protein, 10 aa, Borrelia burgdorferi B31
GIEGEIVDAF

SEQ ID NO: 867 - protein, 10 aa, Borrelia burgdorferi B31
IEGEIVDAFR

SEQ ID NO: 868 - protein, 10 aa, Borrelia burgdorferi B31
EGEIVDAFRY

SEQ ID NO: 869 - protein, 10 aa, Borrelia burgdorferi B31
GEIVDAFRYG

SEQ ID NO: 870 - protein, 10 aa, Borrelia burgdorferi B31
EIVDAFRYGY

SEQ ID NO: 871 - protein, 10 aa, Borrelia burgdorferi B31
IVDAFRYGYE

SEQ ID NO: 872 - protein, 10 aa, Borrelia burgdorferi B31
VDAFRYGYEA

SEQ ID NO: 873 - protein, 10 aa, Borrelia burgdorferi B31
DAFRYGYEAG

SEQ ID NO: 874 - protein, 10 aa, Borrelia burgdorferi B31
AFRYGYEAGA

SEQ ID NO: 875 - protein, 10 aa, Borrelia burgdorferi B31
FRYGYEAGAK

SEQ ID NO: 876 - protein, 10 aa, Borrelia burgdorferi B31
RYGYEAGAKY

SEQ ID NO: 877 - protein, 10 aa, Borrelia burgdorferi B31
YGYEAGAKYA

SEQ ID NO: 878 - protein, 10 aa, Borrelia burgdorferi B31
GYEAGAKYAN

SEQ ID NO: 879 - protein, 10 aa, Borrelia burgdorferi B31
YEAGAKYANK

SEQ ID NO: 880 - protein, 10 aa, Borrelia burgdorferi B31
EAGAKYANKD

SEQ ID NO: 881 - protein, 10 aa, Borrelia burgdorferi B31
AGAKYANKDI

SEQ ID NO: 882 - protein, 10 aa, Borrelia burgdorferi B31
GAKYANKDIK

SEQ ID NO: 883 - protein, 10 aa, Borrelia burgdorferi B31
AKYANKDIKI

SEQ ID NO: 884 - protein, 10 aa, Borrelia burgdorferi B31
KYANKDIKIS

SEQ ID NO: 885 - protein, 10 aa, Borrelia burgdorferi B31
YANKDIKIST

SEQ ID NO: 886 - protein, 10 aa, Borrelia burgdorferi B31
ANKDIKISTQ

SEQ ID NO: 887 - protein, 10 aa, Borrelia burgdorferi B31
NKDIKISTQY

SEQ ID NO: 888 - protein, 10 aa, Borrelia burgdorferi B31
KDIKISTQYI

SEQ ID NO: 889 - protein, 10 aa, Borrelia burgdorferi B31
DIKISTQYIG

SEQ ID NO: 890 - protein, 10 aa, Borrelia burgdorferi B31
IKISTQYIGS

SEQ ID NO: 891 - protein, 10 aa, Borrelia burgdorferi B31
KISTQYIGSF

SEQ ID NO: 892 - protein, 10 aa, Borrelia burgdorferi B31
ISTQYIGSFA

SEQ ID NO: 893 - protein, 10 aa, Borrelia burgdorferi B31
STQYIGSFAD

SEQ ID NO: 894 - protein, 10 aa, Borrelia burgdorferi B31
TQYIGSFADL

SEQ ID NO: 895 - protein, 10 aa, Borrelia burgdorferi B31
QYIGSFADLE

SEQ ID NO: 896 - protein, 10 aa, Borrelia burgdorferi B31
YIGSFADLEA

SEQ ID NO: 897 - protein, 10 aa, Borrelia burgdorferi B31
IGSFADLEAG

SEQ ID NO: 898 - protein, 10 aa, Borrelia burgdorferi B31
GSFADLEAGR

SEQ ID NO: 899 - protein, 10 aa, Borrelia burgdorferi B31
SFADLEAGRS

SEQ ID NO: 900 - protein, 10 aa, Borrelia burgdorferi B31
FADLEAGRSV

SEQ ID NO: 901 - protein, 10 aa, Borrelia burgdorferi B31
ADLEAGRSVA

SEQ ID NO: 902 - protein, 10 aa, Borrelia burgdorferi B31
DLEAGRSVAT

SEQ ID NO: 903 - protein, 10 aa, Borrelia burgdorferi B31
LEAGRSVATR

SEQ ID NO: 904 - protein, 10 aa, Borrelia burgdorferi B31
EAGRSVATRM

SEQ ID NO: 905 - protein, 10 aa, Borrelia burgdorferi B31
AGRSVATRMY

SEQ ID NO: 906 - protein, 10 aa, Borrelia burgdorferi B31
GRSVATRMYS

SEQ ID NO: 907 - protein, 10 aa, Borrelia burgdorferi B31
RSVATRMYSD

SEQ ID NO: 908 - protein, 10 aa, Borrelia burgdorferi B31
SVATRMYSDE

SEQ ID NO: 909 - protein, 10 aa, Borrelia burgdorferi B31
VATRMYSDEI

SEQ ID NO: 910 - protein, 10 aa, Borrelia burgdorferi B31
ATRMYSDEID

SEQ ID NO: 911 - protein, 10 aa, Borrelia burgdorferi B31
TRMYSDEIDI

SEQ ID NO: 912 - protein, 10 aa, Borrelia burgdorferi B31
RMYSDEIDII

SEQ ID NO: 913 - protein, 10 aa, Borrelia burgdorferi B31
MYSDEIDIIH

SEQ ID NO: 914 - protein, 10 aa, Borrelia burgdorferi B31
YSDEIDIIHH

SEQ ID NO: 915 - protein, 10 aa, Borrelia burgdorferi B31
SDEIDIIHHA

SEQ ID NO: 916 - protein, 10 aa, Borrelia burgdorferi B31
DEIDIIHHAA

SEQ ID NO: 917 - protein, 10 aa, Borrelia burgdorferi B31
EIDIIHHAAG

SEQ ID NO: 918 - protein, 10 aa, Borrelia burgdorferi B31
IDIIHHAAGL

SEQ ID NO: 919 - protein, 10 aa, Borrelia burgdorferi B31
DIIHHAAGLG

SEQ ID NO: 920 - protein, 10 aa, Borrelia burgdorferi B31
IIHHAAGLGG

SEQ ID NO: 921 - protein, 10 aa, Borrelia burgdorferi B31
IHHAAGLGGI

SEQ ID NO: 922 - protein, 10 aa, Borrelia burgdorferi B31
HHAAGLGGIG

SEQ ID NO: 923 - protein, 10 aa, Borrelia burgdorferi B31
HAAGLGGIGA

SEQ ID NO: 924 - protein, 10 aa, Borrelia burgdorferi B31
AAGLGGIGAI

SEQ ID NO: 925 - protein, 10 aa, Borrelia burgdorferi B31
AGLGGIGAIE

SEQ ID NO: 926 - protein, 10 aa, Borrelia burgdorferi B31
GLGGIGAIEV

SEQ ID NO: 927 - protein, 10 aa, Borrelia burgdorferi B31
LGGIGAIEVA

SEQ ID NO: 928 - protein, 10 aa, Borrelia burgdorferi B31
GGIGAIEVAK

SEQ ID NO: 929 - protein, 10 aa, Borrelia burgdorferi B31
GIGAIEVAKE

SEQ ID NO: 930 - protein, 10 aa, Borrelia burgdorferi B31
IGAIEVAKEL

SEQ ID NO: 931 - protein, 10 aa, Borrelia burgdorferi B31
GAIEVAKELG

SEQ ID NO: 932 - protein, 10 aa, Borrelia burgdorferi B31
AIEVAKELGS

SEQ ID NO: 933 - protein, 10 aa, Borrelia burgdorferi B31
IEVAKELGSG

SEQ ID NO: 934 - protein, 10 aa, Borrelia burgdorferi B31
EVAKELGSGH

SEQ ID NO: 935 - protein, 10 aa, Borrelia burgdorferi B31
VAKELGSGHY

SEQ ID NO: 936 - protein, 10 aa, Borrelia burgdorferi B31
AKELGSGHYI

SEQ ID NO: 937 - protein, 10 aa, Borrelia burgdorferi B31
KELGSGHYII

SEQ ID NO: 938 - protein, 10 aa, Borrelia burgdorferi B31
ELGSGHYIIG

SEQ ID NO: 939 - protein, 10 aa, Borrelia burgdorferi B31
LGSGHYIIGV

SEQ ID NO: 940 - protein, 10 aa, Borrelia burgdorferi B31
GSGHYIIGVD

SEQ ID NO: 941 - protein, 10 aa, Borrelia burgdorferi B31
SGHYIIGVDE

SEQ ID NO: 942 - protein, 10 aa, Borrelia burgdorferi B31
GHYIIGVDED

SEQ ID NO: 943 - protein, 10 aa, Borrelia burgdorferi B31
HYIIGVDEDQ

SEQ ID NO: 944 - protein, 10 aa, Borrelia burgdorferi B31
YIIGVDEDQA

SEQ ID NO: 945 - protein, 10 aa, Borrelia burgdorferi B31
IIGVDEDQAY

SEQ ID NO: 946 - protein, 10 aa, Borrelia burgdorferi B31
IGVDEDQAYL

SEQ ID NO: 947 - protein, 10 aa, Borrelia burgdorferi B31
GVDEDQAYLA

SEQ ID NO: 948 - protein, 10 aa, Borrelia burgdorferi B31
VDEDQAYLAP

SEQ ID NO: 949 - protein, 10 aa, Borrelia burgdorferi B31
DEDQAYLAPD

SEQ ID NO: 950 - protein, 10 aa, Borrelia burgdorferi B31
EDQAYLAPDN

SEQ ID NO: 951 - protein, 10 aa, Borrelia burgdorferi B31
DQAYLAPDNV

SEQ ID NO: 952 - protein, 10 aa, Borrelia burgdorferi B31
QAYLAPDNVI

SEQ ID NO: 953 - protein, 10 aa, Borrelia burgdorferi B31
AYLAPDNVIT

SEQ ID NO: 954 - protein, 10 aa, Borrelia burgdorferi B31
YLAPDNVITS

SEQ ID NO: 955 - protein, 10 aa, Borrelia burgdorferi B31
LAPDNVITST

SEQ ID NO: 956 - protein, 10 aa, Borrelia burgdorferi B31
APDNVITSTT

SEQ ID NO: 957 - protein, 10 aa, Borrelia burgdorferi B31
PDNVITSTTK

SEQ ID NO: 958 - protein, 10 aa, Borrelia burgdorferi B31
DNVITSTTKD

SEQ ID NO: 959 - protein, 10 aa, Borrelia burgdorferi B31
NVITSTTKDV

SEQ ID NO: 960 - protein, 10 aa, Borrelia burgdorferi B31
VITSTTKDVG

SEQ ID NO: 961 - protein, 10 aa, Borrelia burgdorferi B31
ITSTTKDVGR

SEQ ID NO: 962 - protein, 10 aa, Borrelia burgdorferi B31
TSTTKDVGRA

SEQ ID NO: 963 - protein, 10 aa, Borrelia burgdorferi B31
STTKDVGRAL

SEQ ID NO: 964 - protein, 10 aa, Borrelia burgdorferi B31
TTKDVGRALN

SEQ ID NO: 965 - protein, 10 aa, Borrelia burgdorferi B31
TKDVGRALNI

SEQ ID NO: 966 - protein, 10 aa, Borrelia burgdorferi B31
KDVGRALNIF

SEQ ID NO: 967 - protein, 10 aa, Borrelia burgdorferi B31
DVGRALNIFT

SEQ ID NO: 968 - protein, 10 aa, Borrelia burgdorferi B31
VGRALNIFTS

SEQ ID NO: 969 - protein, 10 aa, Borrelia burgdorferi B31
GRALNIFTSN

SEQ ID NO: 970 - protein, 10 aa, Borrelia burgdorferi B31
RALNIFTSNH

SEQ ID NO: 971 - protein, 10 aa, Borrelia burgdorferi B31
ALNIFTSNHL

SEQ ID NO: 972 - protein, 10 aa, Borrelia burgdorferi B31
LNIFTSNHLK

SEQ ID NO: 973 - protein, 10 aa, Borrelia burgdorferi B31
NIFTSNHLKT

SEQ ID NO: 974 - protein, 10 aa, Borrelia burgdorferi B31
IFTSNHLKTN

SEQ ID NO: 975 - protein, 10 aa, Borrelia burgdorferi B31
FTSNHLKTNT

SEQ ID NO: 976 - protein, 10 aa, Borrelia burgdorferi B31
TSNHLKTNTF

SEQ ID NO: 977 - protein, 10 aa, Borrelia burgdorferi B31
SNHLKTNTFE

SEQ ID NO: 978 - protein, 10 aa, Borrelia burgdorferi B31
NHLKTNTFEG

SEQ ID NO: 979 - protein, 10 aa, Borrelia burgdorferi B31
HLKTNTFEGG

SEQ ID NO: 980 - protein, 10 aa, Borrelia burgdorferi B31
LKTNTFEGGK

SEQ ID NO: 981 - protein, 10 aa, Borrelia burgdorferi B31
KTNTFEGGKL

SEQ ID NO: 982 - protein, 10 aa, Borrelia burgdorferi B31
TNTFEGGKLI

SEQ ID NO: 983 - protein, 10 aa, Borrelia burgdorferi B31
NTFEGGKLIN

SEQ ID NO: 984 - protein, 10 aa, Borrelia burgdorferi B31
TFEGGKLINY

SEQ ID NO: 985 - protein, 10 aa, Borrelia burgdorferi B31
FEGGKLINYG

SEQ ID NO: 986 - protein, 10 aa, Borrelia burgdorferi B31
EGGKLINYGL

SEQ ID NO: 987 - protein, 10 aa, Borrelia burgdorferi B31
GGKLINYGLK

SEQ ID NO: 988 - protein, 10 aa, Borrelia burgdorferi B31
GKLINYGLKE

SEQ ID NO: 989 - protein, 10 aa, Borrelia burgdorferi B31
KLINYGLKEG

SEQ ID NO: 990 - protein, 10 aa, Borrelia burgdorferi B31
LINYGLKEGV

SEQ ID NO: 991 - protein, 10 aa, Borrelia burgdorferi B31
INYGLKEGVV

SEQ ID NO: 992 - protein, 10 aa, Borrelia burgdorferi B31
NYGLKEGVVG

SEQ ID NO: 993 - protein, 10 aa, Borrelia burgdorferi B31
YGLKEGVVGF

SEQ ID NO: 994 - protein, 10 aa, Borrelia burgdorferi B31
GLKEGVVGFV

SEQ ID NO: 995 - protein, 10 aa, Borrelia burgdorferi B31
LKEGVVGFVR

SEQ ID NO: 996 - protein, 10 aa, Borrelia burgdorferi B31
KEGVVGFVRN

SEQ ID NO: 997 - protein, 10 aa, Borrelia burgdorferi B31
EGVVGFVRNP

SEQ ID NO: 998 - protein, 10 aa, Borrelia burgdorferi B31
GVVGFVRNPK

SEQ ID NO: 999 - protein, 10 aa, Borrelia burgdorferi B31
VVGFVRNPKM

SEQ ID NO: 1000 - protein, 10 aa, Borrelia burgdorferi B31
VGFVRNPKMI

SEQ ID NO: 1001 - protein, 10 aa, Borrelia burgdorferi B31
GFVRNPKMIS

SEQ ID NO: 1002 - protein, 10 aa, Borrelia burgdorferi B31
FVRNPKMISF

SEQ ID NO: 1003 - protein, 10 aa, Borrelia burgdorferi B31
VRNPKMISFE

SEQ ID NO: 1004 - protein, 10 aa, Borrelia burgdorferi B31
RNPKMISFEL

SEQ ID NO: 1005 - protein, 10 aa, Borrelia burgdorferi B31
NPKMISFELE

SEQ ID NO: 1006 - protein, 10 aa, Borrelia burgdorferi B31
PKMISFELEK

SEQ ID NO: 1007 - protein, 10 aa, Borrelia burgdorferi B31
KMISFELEKE

SEQ ID NO: 1008 - protein, 10 aa, Borrelia burgdorferi B31
MISFELEKEI

SEQ ID NO: 1009 - protein, 10 aa, Borrelia burgdorferi B31
ISFELEKEID

SEQ ID NO: 1010 - protein, 10 aa, Borrelia burgdorferi B31
SFELEKEIDN

SEQ ID NO: 1011 - protein, 10 aa, Borrelia burgdorferi B31
FELEKEIDNL

SEQ ID NO: 1012 - protein, 10 aa, Borrelia burgdorferi B31
ELEKEIDNLS

SEQ ID NO: 1013 - protein, 10 aa, Borrelia burgdorferi B31
LEKEIDNLSS

SEQ ID NO: 1014 - protein, 10 aa, Borrelia burgdorferi B31
EKEIDNLSSK

SEQ ID NO: 1015 - protein, 10 aa, Borrelia burgdorferi B31
KEIDNLSSKI

SEQ ID NO: 1016 - protein, 10 aa, Borrelia burgdorferi B31
EIDNLSSKII

SEQ ID NO: 1017 - protein, 10 aa, Borrelia burgdorferi B31
IDNLSSKIIN

SEQ ID NO: 1018 - protein, 10 aa, Borrelia burgdorferi B31
DNLSSKIINK

SEQ ID NO: 1019 - protein, 10 aa, Borrelia burgdorferi B31
NLSSKIINKE

SEQ ID NO: 1020 - protein, 10 aa, Borrelia burgdorferi B31
LSSKIINKEI

SEQ ID NO: 1021 - protein, 10 aa, Borrelia burgdorferi B31
SSKIINKEII

SEQ ID NO: 1022 - protein, 10 aa, Borrelia burgdorferi B31
SKIINKEIIV

SEQ ID NO: 1023 - protein, 10 aa, Borrelia burgdorferi B31
KIINKEIIVP

SEQ ID NO: 1024 - protein, 10 aa, Borrelia burgdorferi B31
IINKEIIVPS

SEQ ID NO: 1025 - protein, 10 aa, Borrelia burgdorferi B31
INKEIIVPSN

SEQ ID NO: 1026 - protein, 10 aa, Borrelia burgdorferi B31
NKEIIVPSNK

SEQ ID NO: 1027 - protein, 10 aa, Borrelia burgdorferi B31
KEIIVPSNKE

SEQ ID NO: 1028 - protein, 10 aa, Borrelia burgdorferi B31
EIIVPSNKES

SEQ ID NO: 1029 - protein, 10 aa, Borrelia burgdorferi B31
IIVPSNKESY

SEQ ID NO: 1030 - protein, 10 aa, Borrelia burgdorferi B31
IVPSNKESYE

SEQ ID NO: 1031 - protein, 10 aa, Borrelia burgdorferi B31
VPSNKESYEK

SEQ ID NO: 1032 - protein, 10 aa, Borrelia burgdorferi B31
PSNKESYEKF

SEQ ID NO: 1033 - protein, 10 aa, Borrelia burgdorferi B31
SNKESYEKFL

SEQ ID NO: 1034 - protein, 10 aa, Borrelia burgdorferi B31
NKESYEKFLK

SEQ ID NO: 1035 - protein, 10 aa, Borrelia burgdorferi B31
KESYEKFLKE

SEQ ID NO: 1036 - protein, 10 aa, Borrelia burgdorferi B31
ESYEKFLKEF

SEQ ID NO: 1037 - protein, 10 aa, Borrelia burgdorferi B31
SYEKFLKEFI

SEQ ID NO: 1038 - protein, 11 aa, Borrelia burgdorferi B31
MNKILLLILLE

SEQ ID NO: 1039 - protein, 11 aa, Borrelia burgdorferi B31
NKILLLILLES

SEQ ID NO: 1040 - protein, 11 aa, Borrelia burgdorferi B31
KILLLILLESI

SEQ ID NO: 1041 - protein, 11 aa, Borrelia burgdorferi B31
ILLLILLESIV

SEQ ID NO: 1042 - protein, 11 aa, Borrelia burgdorferi B31
LLLILLESIVF

SEQ ID NO: 1043 - protein, 11 aa, Borrelia burgdorferi B31
LLILLESIVFL

SEQ ID NO: 1044 - protein, 11 aa, Borrelia burgdorferi B31
LILLESIVFLS

SEQ ID NO: 1045 - protein, 11 aa, Borrelia burgdorferi B31
ILLESIVFLSC

SEQ ID NO: 1046 - protein, 11 aa, Borrelia burgdorferi B31
LLESIVFLSCS

SEQ ID NO: 1047 - protein, 11 aa, Borrelia burgdorferi B31
LESIVFLSCSG

SEQ ID NO: 1048 - protein, 11 aa, Borrelia burgdorferi B31
ESIVFLSCSGK

SEQ ID NO: 1049 - protein, 11 aa, Borrelia burgdorferi B31
SIVFLSCSGKG

SEQ ID NO: 1050 - protein, 11 aa, Borrelia burgdorferi B31
IVFLSCSGKGS

SEQ ID NO: 1051 - protein, 11 aa, Borrelia burgdorferi B31
VFLSCSGKGSL

SEQ ID NO: 1052 - protein, 11 aa, Borrelia burgdorferi B31
FLSCSGKGSLG

SEQ ID NO: 1053 - protein, 11 aa, Borrelia burgdorferi B31
LSCSGKGSLGS

SEQ ID NO: 1054 - protein, 11 aa, Borrelia burgdorferi B31
SCSGKGSLGSE

SEQ ID NO: 1055 - protein, 11 aa, Borrelia burgdorferi B31
CSGKGSLGSEI

SEQ ID NO: 1056 - protein, 11 aa, Borrelia burgdorferi B31
SGKGSLGSEIP

SEQ ID NO: 1057 - protein, 11 aa, Borrelia burgdorferi B31
GKGSLGSEIPK

SEQ ID NO: 1058 - protein, 11 aa, Borrelia burgdorferi B31
KGSLGSEIPKV

SEQ ID NO: 1059 - protein, 11 aa, Borrelia burgdorferi B31
GSLGSEIPKVS

SEQ ID NO: 1060 - protein, 11 aa, Borrelia burgdorferi B31
SLGSEIPKVSL

SEQ ID NO: 1061 - protein, 11 aa, Borrelia burgdorferi B31
LGSEIPKVSLI

SEQ ID NO: 1062 - protein, 11 aa, Borrelia burgdorferi B31
GSEIPKVSLII

SEQ ID NO: 1063 - protein, 11 aa, Borrelia burgdorferi B31
SEIPKVSLIID

SEQ ID NO: 1064 - protein, 11 aa, Borrelia burgdorferi B31
EIPKVSLIIDG

SEQ ID NO: 1065 - protein, 11 aa, Borrelia burgdorferi B31
IPKVSLIIDGT

SEQ ID NO: 1066 - protein, 11 aa, Borrelia burgdorferi B31
PKVSLIIDGTF

SEQ ID NO: 1067 - protein, 11 aa, Borrelia burgdorferi B31
KVSLIIDGTFD

SEQ ID NO: 1068 - protein, 11 aa, Borrelia burgdorferi B31
VSLIIDGTFDD

SEQ ID NO: 1069 - protein, 11 aa, Borrelia burgdorferi B31
SLIIDGTFDDK

SEQ ID NO: 1070 - protein, 11 aa, Borrelia burgdorferi B31
LIIDGTFDDKS

SEQ ID NO: 1071 - protein, 11 aa, Borrelia burgdorferi B31
IIDGTFDDKSF

SEQ ID NO: 1072 - protein, 11 aa, Borrelia burgdorferi B31
IDGTFDDKSFN

SEQ ID NO: 1073 - protein, 11 aa, Borrelia burgdorferi B31
DGTFDDKSFNE

SEQ ID NO: 1074 - protein, 11 aa, Borrelia burgdorferi B31
GTFDDKSFNES

SEQ ID NO: 1075 - protein, 11 aa, Borrelia burgdorferi B31
TFDDKSFNESA

SEQ ID NO: 1076 - protein, 11 aa, Borrelia burgdorferi B31
FDDKSFNESAL

SEQ ID NO: 1077 - protein, 11 aa, Borrelia burgdorferi B31
DDKSFNESALN

SEQ ID NO: 1078 - protein, 11 aa, Borrelia burgdorferi B31
DKSFNESALNG

SEQ ID NO: 1079 - protein, 11 aa, Borrelia burgdorferi B31
KSFNESALNGV

SEQ ID NO: 1080 - protein, 11 aa, Borrelia burgdorferi B31
SFNESALNGVK

SEQ ID NO: 1081 - protein, 11 aa, Borrelia burgdorferi B31
FNESALNGVKK

SEQ ID NO: 1082 - protein, 11 aa, Borrelia burgdorferi B31
NESALNGVKKV

SEQ ID NO: 1083 - protein, 11 aa, Borrelia burgdorferi B31
ESALNGVKKVK

SEQ ID NO: 1084 - protein, 11 aa, Borrelia burgdorferi B31
SALNGVKKVKE

SEQ ID NO: 1085 - protein, 11 aa, Borrelia burgdorferi B31
ALNGVKKVKEE

SEQ ID NO: 1086 - protein, 11 aa, Borrelia burgdorferi B31
LNGVKKVKEEF

SEQ ID NO: 1087 - protein, 11 aa, Borrelia burgdorferi B31
NGVKKVKEEFK

SEQ ID NO: 1088 - protein, 11 aa, Borrelia burgdorferi B31
GVKKVKEEFKI

SEQ ID NO: 1089 - protein, 11 aa, Borrelia burgdorferi B31
VKKVKEEFKIE

SEQ ID NO: 1090 - protein, 11 aa, Borrelia burgdorferi B31
KKVKEEFKIEL

SEQ ID NO: 1091 - protein, 11 aa, Borrelia burgdorferi B31
KVKEEFKIELV

SEQ ID NO: 1092 - protein, 11 aa, Borrelia burgdorferi B31
VKEEFKIELVL

SEQ ID NO: 1093 - protein, 11 aa, Borrelia burgdorferi B31
KEEFKIELVLK

SEQ ID NO: 1094 - protein, 11 aa, Borrelia burgdorferi B31
EEFKIELVLKE

SEQ ID NO: 1095 - protein, 11 aa, Borrelia burgdorferi B31
EFKIELVLKES

SEQ ID NO: 1096 - protein, 11 aa, Borrelia burgdorferi B31
FKIELVLKESS

SEQ ID NO: 1097 - protein, 11 aa, Borrelia burgdorferi B31
KIELVLKESSS

SEQ ID NO: 1098 - protein, 11 aa, Borrelia burgdorferi B31
IELVLKESSSN

SEQ ID NO: 1099 - protein, 11 aa, Borrelia burgdorferi B31
ELVLKESSSNS

SEQ ID NO: 1100 - protein, 11 aa, Borrelia burgdorferi B31
LVLKESSSNSY

SEQ ID NO: 1101 - protein, 11 aa, Borrelia burgdorferi B31
VLKESSSNSYL

SEQ ID NO: 1102 - protein, 11 aa, Borrelia burgdorferi B31
LKESSSNSYLS

SEQ ID NO: 1103 - protein, 11 aa, Borrelia burgdorferi B31
KESSSNSYLSD

SEQ ID NO: 1104 - protein, 11 aa, Borrelia burgdorferi B31
ESSSNSYLSDL

SEQ ID NO: 1105 - protein, 11 aa, Borrelia burgdorferi B31
SSSNSYLSDLE

SEQ ID NO: 1106 - protein, 11 aa, Borrelia burgdorferi B31
SSNSYLSDLEG

SEQ ID NO: 1107 - protein, 11 aa, Borrelia burgdorferi B31
SNSYLSDLEGL

SEQ ID NO: 1108 - protein, 11 aa, Borrelia burgdorferi B31
NSYLSDLEGLK

SEQ ID NO: 1109 - protein, 11 aa, Borrelia burgdorferi B31
SYLSDLEGLKD

SEQ ID NO: 1110 - protein, 11 aa, Borrelia burgdorferi B31
YLSDLEGLKDA

SEQ ID NO: 1111 - protein, 11 aa, Borrelia burgdorferi B31
LSDLEGLKDAG

SEQ ID NO: 1112 - protein, 11 aa, Borrelia burgdorferi B31
SDLEGLKDAGS

SEQ ID NO: 1113 - protein, 11 aa, Borrelia burgdorferi B31
DLEGLKDAGSD

SEQ ID NO: 1114 - protein, 11 aa, Borrelia burgdorferi B31
LEGLKDAGSDL

SEQ ID NO: 1115 - protein, 11 aa, Borrelia burgdorferi B31
EGLKDAGSDLI

SEQ ID NO: 1116 - protein, 11 aa, Borrelia burgdorferi B31
GLKDAGSDLIW

SEQ ID NO: 1117 - protein, 11 aa, Borrelia burgdorferi B31
LKDAGSDLIWL

SEQ ID NO: 1118 - protein, 11 aa, Borrelia burgdorferi B31
KDAGSDLIWLI

SEQ ID NO: 1119 - protein, 11 aa, Borrelia burgdorferi B31
DAGSDLIWLIG

SEQ ID NO: 1120 - protein, 11 aa, Borrelia burgdorferi B31
AGSDLIWLIGY

SEQ ID NO: 1121 - protein, 11 aa, Borrelia burgdorferi B31
GSDLIWLIGYR

SEQ ID NO: 1122 - protein, 11 aa, Borrelia burgdorferi B31
SDLIWLIGYRF

SEQ ID NO: 1123 - protein, 11 aa, Borrelia burgdorferi B31
DLIWLIGYRFS

SEQ ID NO: 1124 - protein, 11 aa, Borrelia burgdorferi B31
LIWLIGYRFSD

SEQ ID NO: 1125 - protein, 11 aa, Borrelia burgdorferi B31
IWLIGYRFSDV

SEQ ID NO: 1126 - protein, 11 aa, Borrelia burgdorferi B31
WLIGYRFSDVA

SEQ ID NO: 1127 - protein, 11 aa, Borrelia burgdorferi B31
LIGYRFSDVAK

SEQ ID NO: 1128 - protein, 11 aa, Borrelia burgdorferi B31
IGYRFSDVAKV

SEQ ID NO: 1129 - protein, 11 aa, Borrelia burgdorferi B31
GYRFSDVAKVA

SEQ ID NO: 1130 - protein, 11 aa, Borrelia burgdorferi B31
YRFSDVAKVAA

SEQ ID NO: 1131 - protein, 11 aa, Borrelia burgdorferi B31
RFSDVAKVAAL

SEQ ID NO: 1132 - protein, 11 aa, Borrelia burgdorferi B31
FSDVAKVAALQ

SEQ ID NO: 1133 - protein, 11 aa, Borrelia burgdorferi B31
SDVAKVAALQN

SEQ ID NO: 1134 - protein, 11 aa, Borrelia burgdorferi B31
DVAKVAALQNP

SEQ ID NO: 1135 - protein, 11 aa, Borrelia burgdorferi B31
VAKVAALQNPD

SEQ ID NO: 1136 - protein, 11 aa, Borrelia burgdorferi B31
AKVAALQNPDM

SEQ ID NO: 1137 - protein, 11 aa, Borrelia burgdorferi B31
KVAALQNPDMK

SEQ ID NO: 1138 - protein, 11 aa, Borrelia burgdorferi B31
VAALQNPDMKY

SEQ ID NO: 1139 - protein, 11 aa, Borrelia burgdorferi B31
AALQNPDMKYA

SEQ ID NO: 1140 - protein, 11 aa, Borrelia burgdorferi B31
ALQNPDMKYAI

SEQ ID NO: 1141 - protein, 11 aa, Borrelia burgdorferi B31
LQNPDMKYAII

SEQ ID NO: 1142 - protein, 11 aa, Borrelia burgdorferi B31
QNPDMKYAIID

SEQ ID NO: 1143 - protein, 11 aa, Borrelia burgdorferi B31
NPDMKYAIIDP

SEQ ID NO: 1144 - protein, 11 aa, Borrelia burgdorferi B31
PDMKYAIIDPI

SEQ ID NO: 1145 - protein, 11 aa, Borrelia burgdorferi B31
DMKYAIIDPIY

SEQ ID NO: 1146 - protein, 11 aa, Borrelia burgdorferi B31
MKYAIIDPIYS

SEQ ID NO: 1147 - protein, 11 aa, Borrelia burgdorferi B31
KYAIIDPIYSN

SEQ ID NO: 1148 - protein, 11 aa, Borrelia burgdorferi B31
YAIIDPIYSND

SEQ ID NO: 1149 - protein, 11 aa, Borrelia burgdorferi B31
AIIDPIYSNDP

SEQ ID NO: 1150 - protein, 11 aa, Borrelia burgdorferi B31
IIDPIYSNDPI

SEQ ID NO: 1151 - protein, 11 aa, Borrelia burgdorferi B31
IDPIYSNDPIP

SEQ ID NO: 1152 - protein, 11 aa, Borrelia burgdorferi B31
DPIYSNDPIPA

SEQ ID NO: 1153 - protein, 11 aa, Borrelia burgdorferi B31
PIYSNDPIPAN

SEQ ID NO: 1154 - protein, 11 aa, Borrelia burgdorferi B31
IYSNDPIPANL

SEQ ID NO: 1155 - protein, 11 aa, Borrelia burgdorferi B31
YSNDPIPANLV

SEQ ID NO: 1156 - protein, 11 aa, Borrelia burgdorferi B31
SNDPIPANLVG

SEQ ID NO: 1157 - protein, 11 aa, Borrelia burgdorferi B31
NDPIPANLVGM

SEQ ID NO: 1158 - protein, 11 aa, Borrelia burgdorferi B31
DPIPANLVGMT

SEQ ID NO: 1159 - protein, 11 aa, Borrelia burgdorferi B31
PIPANLVGMTF

SEQ ID NO: 1160 - protein, 11 aa, Borrelia burgdorferi B31
IPANLVGMTFR

SEQ ID NO: 1161 - protein, 11 aa, Borrelia burgdorferi B31
PANLVGMTFRA

SEQ ID NO: 1162 - protein, 11 aa, Borrelia burgdorferi B31
ANLVGMTFRAQ

SEQ ID NO: 1163 - protein, 11 aa, Borrelia burgdorferi B31
NLVGMTFRAQE

SEQ ID NO: 1164 - protein, 11 aa, Borrelia burgdorferi B31
LVGMTFRAQEG

SEQ ID NO: 1165 - protein, 11 aa, Borrelia burgdorferi B31
VGMTFRAQEGA

SEQ ID NO: 1166 - protein, 11 aa, Borrelia burgdorferi B31
GMTFRAQEGAF

SEQ ID NO: 1167 - protein, 11 aa, Borrelia burgdorferi B31
MTFRAQEGAFL

SEQ ID NO: 1168 - protein, 11 aa, Borrelia burgdorferi B31
TFRAQEGAFLT

SEQ ID NO: 1169 - protein, 11 aa, Borrelia burgdorferi B31
FRAQEGAFLTG

SEQ ID NO: 1170 - protein, 11 aa, Borrelia burgdorferi B31
RAQEGAFLTGY

SEQ ID NO: 1171 - protein, 11 aa, Borrelia burgdorferi B31
AQEGAFLTGYI

SEQ ID NO: 1172 - protein, 11 aa, Borrelia burgdorferi B31
QEGAFLTGYIA

SEQ ID NO: 1173 - protein, 11 aa, Borrelia burgdorferi B31
EGAFLTGYIAA

SEQ ID NO: 1174 - protein, 11 aa, Borrelia burgdorferi B31
GAFLTGYIAAK

SEQ ID NO: 1175 - protein, 11 aa, Borrelia burgdorferi B31
AFLTGYIAAKL

SEQ ID NO: 1176 - protein, 11 aa, Borrelia burgdorferi B31
FLTGYIAAKLS

SEQ ID NO: 1177 - protein, 11 aa, Borrelia burgdorferi B31
LTGYIAAKLSK

SEQ ID NO: 1178 - protein, 11 aa, Borrelia burgdorferi B31
TGYIAAKLSKT

SEQ ID NO: 1179 - protein, 11 aa, Borrelia burgdorferi B31
GYIAAKLSKTG

SEQ ID NO: 1180 - protein, 11 aa, Borrelia burgdorferi B31
YIAAKLSKTGK

SEQ ID NO: 1181 - protein, 11 aa, Borrelia burgdorferi B31
IAAKLSKTGKI

SEQ ID NO: 1182 - protein, 11 aa, Borrelia burgdorferi B31
AAKLSKTGKIG

SEQ ID NO: 1183 - protein, 11 aa, Borrelia burgdorferi B31
AKLSKTGKIGF

SEQ ID NO: 1184 - protein, 11 aa, Borrelia burgdorferi B31
KLSKTGKIGFL

SEQ ID NO: 1185 - protein, 11 aa, Borrelia burgdorferi B31
LSKTGKIGFLG

SEQ ID NO: 1186 - protein, 11 aa, Borrelia burgdorferi B31
SKTGKIGFLGG

SEQ ID NO: 1187 - protein, 11 aa, Borrelia burgdorferi B31
KTGKIGFLGGI

SEQ ID NO: 1188 - protein, 11 aa, Borrelia burgdorferi B31
TGKIGFLGGIE

SEQ ID NO: 1189 - protein, 11 aa, Borrelia burgdorferi B31
GKIGFLGGIEG

SEQ ID NO: 1190 - protein, 11 aa, Borrelia burgdorferi B31
KIGFLGGIEGE

SEQ ID NO: 1191 - protein, 11 aa, Borrelia burgdorferi B31
IGFLGGIEGEI

SEQ ID NO: 1192 - protein, 11 aa, Borrelia burgdorferi B31
GFLGGIEGEIV

SEQ ID NO: 1193 - protein, 11 aa, Borrelia burgdorferi B31
FLGGIEGEIVD

SEQ ID NO: 1194 - protein, 11 aa, Borrelia burgdorferi B31
LGGIEGEIVDA

SEQ ID NO: 1195 - protein, 11 aa, Borrelia burgdorferi B31
GGIEGEIVDAF

SEQ ID NO: 1196 - protein, 11 aa, Borrelia burgdorferi B31
GIEGEIVDAFR

SEQ ID NO: 1197 - protein, 11 aa, Borrelia burgdorferi B31
IEGEIVDAFRY

SEQ ID NO: 1198 - protein, 11 aa, Borrelia burgdorferi B31
EGEIVDAFRYG

SEQ ID NO: 1199 - protein, 11 aa, Borrelia burgdorferi B31
GEIVDAFRYGY

SEQ ID NO: 1200 - protein, 11 aa, Borrelia burgdorferi B31
EIVDAFRYGYE

SEQ ID NO: 1201 - protein, 11 aa, Borrelia burgdorferi B31
IVDAFRYGYEA

SEQ ID NO: 1202 - protein, 11 aa, Borrelia burgdorferi B31
VDAFRYGYEAG

SEQ ID NO: 1203 - protein, 11 aa, Borrelia burgdorferi B31
DAFRYGYEAGA

SEQ ID NO: 1204 - protein, 11 aa, Borrelia burgdorferi B31
AFRYGYEAGAK

SEQ ID NO: 1205 - protein, 11 aa, Borrelia burgdorferi B31
FRYGYEAGAKY

SEQ ID NO: 1206 - protein, 11 aa, Borrelia burgdorferi B31
RYGYEAGAKYA

SEQ ID NO: 1207 - protein, 11 aa, Borrelia burgdorferi B31
YGYEAGAKYAN

SEQ ID NO: 1208 - protein, 11 aa, Borrelia burgdorferi B31
GYEAGAKYANK

SEQ ID NO: 1209 - protein, 11 aa, Borrelia burgdorferi B31
YEAGAKYANKD

SEQ ID NO: 1210 - protein, 11 aa, Borrelia burgdorferi B31
EAGAKYANKDI

SEQ ID NO: 1211 - protein, 11 aa, Borrelia burgdorferi B31
AGAKYANKDIK

SEQ ID NO: 1212 - protein, 11 aa, Borrelia burgdorferi B31
GAKYANKDIKI

SEQ ID NO: 1213 - protein, 11 aa, Borrelia burgdorferi B31
AKYANKDIKIS

SEQ ID NO: 1214 - protein, 11 aa, Borrelia burgdorferi B31
KYANKDIKIST

SEQ ID NO: 1215 - protein, 11 aa, Borrelia burgdorferi B31
YANKDIKISTQ

SEQ ID NO: 1216 - protein, 11 aa, Borrelia burgdorferi B31
ANKDIKISTQY

SEQ ID NO: 1217 - protein, 11 aa, Borrelia burgdorferi B31
NKDIKISTQYI

SEQ ID NO: 1218 - protein, 11 aa, Borrelia burgdorferi B31
KDIKISTQYIG

SEQ ID NO: 1219 - protein, 11 aa, Borrelia burgdorferi B31
DIKISTQYIGS

SEQ ID NO: 1220 - protein, 11 aa, Borrelia burgdorferi B31
IKISTQYIGSF

SEQ ID NO: 1221 - protein, 11 aa, Borrelia burgdorferi B31
KISTQYIGSFA

SEQ ID NO: 1222 - protein, 11 aa, Borrelia burgdorferi B31
ISTQYIGSFAD

SEQ ID NO: 1223 - protein, 11 aa, Borrelia burgdorferi B31
STQYIGSFADL

SEQ ID NO: 1224 - protein, 11 aa, Borrelia burgdorferi B31
TQYIGSFADLE

SEQ ID NO: 1225 - protein, 11 aa, Borrelia burgdorferi B31
QYIGSFADLEA

SEQ ID NO: 1226 - protein, 11 aa, Borrelia burgdorferi B31
YIGSFADLEAG

SEQ ID NO: 1227 - protein, 11 aa, Borrelia burgdorferi B31
IGSFADLEAGR

SEQ ID NO: 1228 - protein, 11 aa, Borrelia burgdorferi B31
GSFADLEAGRS

SEQ ID NO: 1229 - protein, 11 aa, Borrelia burgdorferi B31
SFADLEAGRSV

SEQ ID NO: 1230 - protein, 11 aa, Borrelia burgdorferi B31
FADLEAGRSVA

SEQ ID NO: 1231 - protein, 11 aa, Borrelia burgdorferi B31
ADLEAGRSVAT

SEQ ID NO: 1232 - protein, 11 aa, Borrelia burgdorferi B31
DLEAGRSVATR

SEQ ID NO: 1233 - protein, 11 aa, Borrelia burgdorferi B31
LEAGRSVATRM

SEQ ID NO: 1234 - protein, 11 aa, Borrelia burgdorferi B31
EAGRSVATRMY

SEQ ID NO: 1235 - protein, 11 aa, Borrelia burgdorferi B31
AGRSVATRMYS

SEQ ID NO: 1236 - protein, 11 aa, Borrelia burgdorferi B31
GRSVATRMYSD

SEQ ID NO: 1237 - protein, 11 aa, Borrelia burgdorferi B31
RSVATRMYSDE

SEQ ID NO: 1238 - protein, 11 aa, Borrelia burgdorferi B31
SVATRMYSDEI

SEQ ID NO: 1239 - protein, 11 aa, Borrelia burgdorferi B31
VATRMYSDEID

SEQ ID NO: 1240 - protein, 11 aa, Borrelia burgdorferi B31
ATRMYSDEIDI

SEQ ID NO: 1241 - protein, 11 aa, Borrelia burgdorferi B31
TRMYSDEIDII

SEQ ID NO: 1242 - protein, 11 aa, Borrelia burgdorferi B31
RMYSDEIDIIH

SEQ ID NO: 1243 - protein, 11 aa, Borrelia burgdorferi B31
MYSDEIDIIHH

SEQ ID NO: 1244 - protein, 11 aa, Borrelia burgdorferi B31
YSDEIDIIHHA

SEQ ID NO: 1245 - protein, 11 aa, Borrelia burgdorferi B31
SDEIDIIHHAA

SEQ ID NO: 1246 - protein, 11 aa, Borrelia burgdorferi B31
DEIDIIHHAAG

SEQ ID NO: 1247 - protein, 11 aa, Borrelia burgdorferi B31
EIDIIHHAAGL

SEQ ID NO: 1248 - protein, 11 aa, Borrelia burgdorferi B31
IDIIHHAAGLG

SEQ ID NO: 1249 - protein, 11 aa, Borrelia burgdorferi B31
DIIHHAAGLGG

SEQ ID NO: 1250 - protein, 11 aa, Borrelia burgdorferi B31
IIHHAAGLGGI

SEQ ID NO: 1251 - protein, 11 aa, Borrelia burgdorferi B31
IHHAAGLGGIG

SEQ ID NO: 1252 - protein, 11 aa, Borrelia burgdorferi B31
HHAAGLGGIGA

SEQ ID NO: 1253 - protein, 11 aa, Borrelia burgdorferi B31
HAAGLGGIGAI

SEQ ID NO: 1254 - protein, 11 aa, Borrelia burgdorferi B31
AAGLGGIGAIE

SEQ ID NO: 1255 - protein, 11 aa, Borrelia burgdorferi B31
AGLGGIGAIEV

SEQ ID NO: 1256 - protein, 11 aa, Borrelia burgdorferi B31
GLGGIGAIEVA

SEQ ID NO: 1257 - protein, 11 aa, Borrelia burgdorferi B31
LGGIGAIEVAK

SEQ ID NO: 1258 - protein, 11 aa, Borrelia burgdorferi B31
GGIGAIEVAKE

SEQ ID NO: 1259 - protein, 11 aa, Borrelia burgdorferi B31
GIGAIEVAKEL

SEQ ID NO: 1260 - protein, 11 aa, Borrelia burgdorferi B31
IGAIEVAKELG

SEQ ID NO: 1261 - protein, 11 aa, Borrelia burgdorferi B31
GAIEVAKELGS

SEQ ID NO: 1262 - protein, 11 aa, Borrelia burgdorferi B31
AIEVAKELGSG

SEQ ID NO: 1263 - protein, 11 aa, Borrelia burgdorferi B31
IEVAKELGSGH

SEQ ID NO: 1264 - protein, 11 aa, Borrelia burgdorferi B31
EVAKELGSGHY

SEQ ID NO: 1265 - protein, 11 aa, Borrelia burgdorferi B31
VAKELGSGHYI

SEQ ID NO: 1266 - protein, 11 aa, Borrelia burgdorferi B31
AKELGSGHYII

SEQ ID NO: 1267 - protein, 11 aa, Borrelia burgdorferi B31
KELGSGHYIIG

SEQ ID NO: 1268 - protein, 11 aa, Borrelia burgdorferi B31
ELGSGHYIIGV

SEQ ID NO: 1269 - protein, 11 aa, Borrelia burgdorferi B31
LGSGHYIIGVD

SEQ ID NO: 1270 - protein, 11 aa, Borrelia burgdorferi B31
GSGHYIIGVDE

SEQ ID NO: 1271 - protein, 11 aa, Borrelia burgdorferi B31
SGHYIIGVDED

SEQ ID NO: 1272 - protein, 11 aa, Borrelia burgdorferi B31
GHYIIGVDEDQ

SEQ ID NO: 1273 - protein, 11 aa, Borrelia burgdorferi B31
HYIIGVDEDQA

SEQ ID NO: 1274 - protein, 11 aa, Borrelia burgdorferi B31
YIIGVDEDQAY

SEQ ID NO: 1275 - protein, 11 aa, Borrelia burgdorferi B31
IIGVDEDQAYL

SEQ ID NO: 1276 - protein, 11 aa, Borrelia burgdorferi B31
IGVDEDQAYLA

SEQ ID NO: 1277 - protein, 11 aa, Borrelia burgdorferi B31
GVDEDQAYLAP

SEQ ID NO: 1278 - protein, 11 aa, Borrelia burgdorferi B31
VDEDQAYLAPD

SEQ ID NO: 1279 - protein, 11 aa, Borrelia burgdorferi B31
DEDQAYLAPDN

SEQ ID NO: 1280 - protein, 11 aa, Borrelia burgdorferi B31
EDQAYLAPDNV

SEQ ID NO: 1281 - protein, 11 aa, Borrelia burgdorferi B31
DQAYLAPDNVI

SEQ ID NO: 1282 - protein, 11 aa, Borrelia burgdorferi B31
QAYLAPDNVIT

SEQ ID NO: 1283 - protein, 11 aa, Borrelia burgdorferi B31
AYLAPDNVITS

SEQ ID NO: 1284 - protein, 11 aa, Borrelia burgdorferi B31
YLAPDNVITST

SEQ ID NO: 1285 - protein, 11 aa, Borrelia burgdorferi B31
LAPDNVITSTT

SEQ ID NO: 1286 - protein, 11 aa, Borrelia burgdorferi B31
APDNVITSTTK

SEQ ID NO: 1287 - protein, 11 aa, Borrelia burgdorferi B31
PDNVITSTTKD

SEQ ID NO: 1288 - protein, 11 aa, Borrelia burgdorferi B31
DNVITSTTKDV

SEQ ID NO: 1289 - protein, 11 aa, Borrelia burgdorferi B31
NVITSTTKDVG

SEQ ID NO: 1290 - protein, 11 aa, Borrelia burgdorferi B31
VITSTTKDVGR

SEQ ID NO: 1291 - protein, 11 aa, Borrelia burgdorferi B31
ITSTTKDVGRA

SEQ ID NO: 1292 - protein, 11 aa, Borrelia burgdorferi B31
TSTTKDVGRAL

SEQ ID NO: 1293 - protein, 11 aa, Borrelia burgdorferi B31
STTKDVGRALN

SEQ ID NO: 1294 - protein, 11 aa, Borrelia burgdorferi B31
TTKDVGRALNI

SEQ ID NO: 1295 - protein, 11 aa, Borrelia burgdorferi B31
TKDVGRALNIF

SEQ ID NO: 1296 - protein, 11 aa, Borrelia burgdorferi B31
KDVGRALNIFT

SEQ ID NO: 1297 - protein, 11 aa, Borrelia burgdorferi B31
DVGRALNIFTS

SEQ ID NO: 1298 - protein, 11 aa, Borrelia burgdorferi B31
VGRALNIFTSN

SEQ ID NO: 1299 - protein, 11 aa, Borrelia burgdorferi B31
GRALNIFTSNH

SEQ ID NO: 1300 - protein, 11 aa, Borrelia burgdorferi B31
RALNIFTSNHL

SEQ ID NO: 1301 - protein, 11 aa, Borrelia burgdorferi B31
ALNIFTSNHLK

SEQ ID NO: 1302 - protein, 11 aa, Borrelia burgdorferi B31
LNIFTSNHLKT

SEQ ID NO: 1303 - protein, 11 aa, Borrelia burgdorferi B31
NIFTSNHLKTN

SEQ ID NO: 1304 - protein, 11 aa, Borrelia burgdorferi B31
IFTSNHLKTNT

SEQ ID NO: 1305 - protein, 11 aa, Borrelia burgdorferi B31
FTSNHLKTNTF

SEQ ID NO: 1306 - protein, 11 aa, Borrelia burgdorferi B31
TSNHLKTNTFE

SEQ ID NO: 1307 - protein, 11 aa, Borrelia burgdorferi B31
SNHLKTNTFEG

SEQ ID NO: 1308 - protein, 11 aa, Borrelia burgdorferi B31
NHLKTNTFEGG

SEQ ID NO: 1309 - protein, 11 aa, Borrelia burgdorferi B31
HLKTNTFEGGK

SEQ ID NO: 1310 - protein, 11 aa, Borrelia burgdorferi B31
LKTNTFEGGKL

SEQ ID NO: 1311 - protein, 11 aa, Borrelia burgdorferi B31
KTNTFEGGKLI

SEQ ID NO: 1312 - protein, 11 aa, Borrelia burgdorferi B31
TNTFEGGKLIN

SEQ ID NO: 1313 - protein, 11 aa, Borrelia burgdorferi B31
NTFEGGKLINY

SEQ ID NO: 1314 - protein, 11 aa, Borrelia burgdorferi B31
TFEGGKLINYG

SEQ ID NO: 1315 - protein, 11 aa, Borrelia burgdorferi B31
FEGGKLINYGL

SEQ ID NO: 1316 - protein, 11 aa, Borrelia burgdorferi B31
EGGKLINYGLK

SEQ ID NO: 1317 - protein, 11 aa, Borrelia burgdorferi B31
GGKLINYGLKE

SEQ ID NO: 1318 - protein, 11 aa, Borrelia burgdorferi B31
GKLINYGLKEG

SEQ ID NO: 1319 - protein, 11 aa, Borrelia burgdorferi B31
KLINYGLKEGV

SEQ ID NO: 1320 - protein, 11 aa, Borrelia burgdorferi B31
LINYGLKEGVV

SEQ ID NO: 1321 - protein, 11 aa, Borrelia burgdorferi B31
INYGLKEGVVG

SEQ ID NO: 1322 - protein, 11 aa, Borrelia burgdorferi B31
NYGLKEGVVGF

SEQ ID NO: 1323 - protein, 11 aa, Borrelia burgdorferi B31
YGLKEGVVGFV

SEQ ID NO: 1324 - protein, 11 aa, Borrelia burgdorferi B31
GLKEGVVGFVR

SEQ ID NO: 1325 - protein, 11 aa, Borrelia burgdorferi B31
LKEGVVGFVRN

SEQ ID NO: 1326 - protein, 11 aa, Borrelia burgdorferi B31
KEGVVGFVRNP

SEQ ID NO: 1327 - protein, 11 aa, Borrelia burgdorferi B31
EGVVGFVRNPK

SEQ ID NO: 1328 - protein, 11 aa, Borrelia burgdorferi B31
GVVGFVRNPKM

SEQ ID NO: 1329 - protein, 11 aa, Borrelia burgdorferi B31
VVGFVRNPKMI

SEQ ID NO: 1330 - protein, 11 aa, Borrelia burgdorferi B31
VGFVRNPKMIS

SEQ ID NO: 1331 - protein, 11 aa, Borrelia burgdorferi B31
GFVRNPKMISF

SEQ ID NO: 1332 - protein, 11 aa, Borrelia burgdorferi B31
FVRNPKMISFE

SEQ ID NO: 1333 - protein, 11 aa, Borrelia burgdorferi B31
VRNPKMISFEL

SEQ ID NO: 1334 - protein, 11 aa, Borrelia burgdorferi B31
RNPKMISFELE

SEQ ID NO: 1335 - protein, 11 aa, Borrelia burgdorferi B31
NPKMISFELEK

SEQ ID NO: 1336 - protein, 11 aa, Borrelia burgdorferi B31
PKMISFELEKE

SEQ ID NO: 1337 - protein, 11 aa, Borrelia burgdorferi B31
KMISFELEKEI

SEQ ID NO: 1338 - protein, 11 aa, Borrelia burgdorferi B31
MISFELEKEID

SEQ ID NO: 1339 - protein, 11 aa, Borrelia burgdorferi B31
ISFELEKEIDN

SEQ ID NO: 1340 - protein, 11 aa, Borrelia burgdorferi B31
SFELEKEIDNL

SEQ ID NO: 1341 - protein, 11 aa, Borrelia burgdorferi B31
FELEKEIDNLS

SEQ ID NO: 1342 - protein, 11 aa, Borrelia burgdorferi B31
ELEKEIDNLSS

SEQ ID NO: 1343 - protein, 11 aa, Borrelia burgdorferi B31
LEKEIDNLSSK

SEQ ID NO: 1344 - protein, 11 aa, Borrelia burgdorferi B31
EKEIDNLSSKI

SEQ ID NO: 1345 - protein, 11 aa, Borrelia burgdorferi B31
KEIDNLSSKII

SEQ ID NO: 1346 - protein, 11 aa, Borrelia burgdorferi B31
EIDNLSSKIIN

SEQ ID NO: 1347 - protein, 11 aa, Borrelia burgdorferi B31
IDNLSSKIINK

SEQ ID NO: 1348 - protein, 11 aa, Borrelia burgdorferi B31
DNLSSKIINKE

SEQ ID NO: 1349 - protein, 11 aa, Borrelia burgdorferi B31
NLSSKIINKEI

SEQ ID NO: 1350 - protein, 11 aa, Borrelia burgdorferi B31
LSSKIINKEII

SEQ ID NO: 1351 - protein, 11 aa, Borrelia burgdorferi B31
SSKIINKEIIV

SEQ ID NO: 1352 - protein, 11 aa, Borrelia burgdorferi B31
SKIINKEIIVP

SEQ ID NO: 1353 - protein, 11 aa, Borrelia burgdorferi B31
KIINKEIIVPS

SEQ ID NO: 1354 - protein, 11 aa, Borrelia burgdorferi B31
IINKEIIVPSN

SEQ ID NO: 1355 - protein, 11 aa, Borrelia burgdorferi B31
INKEIIVPSNK

SEQ ID NO: 1356 - protein, 11 aa, Borrelia burgdorferi B31
NKEIIVPSNKE

SEQ ID NO: 1357 - protein, 11 aa, Borrelia burgdorferi B31
KEIIVPSNKES

SEQ ID NO: 1358 - protein, 11 aa, Borrelia burgdorferi B31
EIIVPSNKESY

SEQ ID NO: 1359 - protein, 11 aa, Borrelia burgdorferi B31
IIVPSNKESYE

SEQ ID NO: 1360 - protein, 11 aa, Borrelia burgdorferi B31
IVPSNKESYEK

SEQ ID NO: 1361 - protein, 11 aa, Borrelia burgdorferi B31
VPSNKESYEKF

SEQ ID NO: 1362 - protein, 11 aa, Borrelia burgdorferi B31
PSNKESYEKFL

SEQ ID NO: 1363 - protein, 11 aa, Borrelia burgdorferi B31
SNKESYEKFLK

SEQ ID NO: 1364 - protein, 11 aa, Borrelia burgdorferi B31
NKESYEKFLKE

SEQ ID NO: 1365 - protein, 11 aa, Borrelia burgdorferi B31
KESYEKFLKEF

SEQ ID NO: 1366 - protein, 11 aa, Borrelia burgdorferi B31
ESYEKFLKEFI

SEQ ID NO: 1367 - protein, 8 aa, Borrelia burgdorferi B31
MRIVIFIF

SEQ ID NO: 1368 - protein, 8 aa, Borrelia burgdorferi B31
RIVIFIFG

SEQ ID NO: 1369 - protein, 8 aa, Borrelia burgdorferi B31
IVIFIFGI

SEQ ID NO: 1370 - protein, 8 aa, Borrelia burgdorferi B31
VIFIFGIL

SEQ ID NO: 1371 - protein, 8 aa, Borrelia burgdorferi B31
IFIFGILL

SEQ ID NO: 1372 - protein, 8 aa, Borrelia burgdorferi B31
FIFGILLT

SEQ ID NO: 1373 - protein, 8 aa, Borrelia burgdorferi B31
IFGILLTS

SEQ ID NO: 1374 - protein, 8 aa, Borrelia burgdorferi B31
FGILLTSC

SEQ ID NO: 1375 - protein, 8 aa, Borrelia burgdorferi B31
GILLTSCF

SEQ ID NO: 1376 - protein, 8 aa, Borrelia burgdorferi B31
ILLTSCFS

SEQ ID NO: 1377 - protein, 8 aa, Borrelia burgdorferi B31
LLTSCFSR

SEQ ID NO: 1378 - protein, 8 aa, Borrelia burgdorferi B31
LTSCFSRN

SEQ ID NO: 1379 - protein, 8 aa, Borrelia burgdorferi B31
TSCFSRNG

SEQ ID NO: 1380 - protein, 8 aa, Borrelia burgdorferi B31
SCFSRNGI

SEQ ID NO: 1381 - protein, 8 aa, Borrelia burgdorferi B31
CFSRNGIE

SEQ ID NO: 1382 - protein, 8 aa, Borrelia burgdorferi B31
FSRNGIES

SEQ ID NO: 1383 - protein, 8 aa, Borrelia burgdorferi B31
SRNGIESS

SEQ ID NO: 1384 - protein, 8 aa, Borrelia burgdorferi B31
RNGIESSS

SEQ ID NO: 1385 - protein, 8 aa, Borrelia burgdorferi B31
NGIESSSK

SEQ ID NO: 1386 - protein, 8 aa, Borrelia burgdorferi B31
GIESSSKK

SEQ ID NO: 1387 - protein, 8 aa, Borrelia burgdorferi B31
IESSSKKI

SEQ ID NO: 1388 - protein, 8 aa, Borrelia burgdorferi B31
ESSSKKIK

SEQ ID NO: 1389 - protein, 8 aa, Borrelia burgdorferi B31
SSSKKIKI

SEQ ID NO: 1390 - protein, 8 aa, Borrelia burgdorferi B31
SSKKIKIS

SEQ ID NO: 1391 - protein, 8 aa, Borrelia burgdorferi B31
SKKIKISM

SEQ ID NO: 1392 - protein, 8 aa, Borrelia burgdorferi B31
KKIKISML

SEQ ID NO: 1393 - protein, 8 aa, Borrelia burgdorferi B31
KIKISMLV

SEQ ID NO: 1394 - protein, 8 aa, Borrelia burgdorferi B31
IKISMLVD

SEQ ID NO: 1395 - protein, 8 aa, Borrelia burgdorferi B31
KISMLVDG

SEQ ID NO: 1396 - protein, 8 aa, Borrelia burgdorferi B31
ISMLVDGV

SEQ ID NO: 1397 - protein, 8 aa, Borrelia burgdorferi B31
SMLVDGVL

SEQ ID NO: 1398 - protein, 8 aa, Borrelia burgdorferi B31
MLVDGVLD

SEQ ID NO: 1399 - protein, 8 aa, Borrelia burgdorferi B31
LVDGVLDD

SEQ ID NO: 1400 - protein, 8 aa, Borrelia burgdorferi B31
VDGVLDDK

SEQ ID NO: 1401 - protein, 8 aa, Borrelia burgdorferi B31
DGVLDDKS

SEQ ID NO: 1402 - protein, 8 aa, Borrelia burgdorferi B31
GVLDDKSF

SEQ ID NO: 1403 - protein, 8 aa, Borrelia burgdorferi B31
VLDDKSFN

SEQ ID NO: 1404 - protein, 8 aa, Borrelia burgdorferi B31
LDDKSFNS

SEQ ID NO: 1405 - protein, 8 aa, Borrelia burgdorferi B31
DDKSFNSS

SEQ ID NO: 1406 - protein, 8 aa, Borrelia burgdorferi B31
DKSFNSSA

SEQ ID NO: 1407 - protein, 8 aa, Borrelia burgdorferi B31
KSFNSSAN

SEQ ID NO: 1408 - protein, 8 aa, Borrelia burgdorferi B31
SFNSSANE

SEQ ID NO: 1409 - protein, 8 aa, Borrelia burgdorferi B31
FNSSANEA

SEQ ID NO: 1410 - protein, 8 aa, Borrelia burgdorferi B31
NSSANEAL

SEQ ID NO: 1411 - protein, 8 aa, Borrelia burgdorferi B31
SSANEALL

SEQ ID NO: 1412 - protein, 8 aa, Borrelia burgdorferi B31
SANEALLR

SEQ ID NO: 1413 - protein, 8 aa, Borrelia burgdorferi B31
ANEALLRL

SEQ ID NO: 1414 - protein, 8 aa, Borrelia burgdorferi B31
NEALLRLK

SEQ ID NO: 1415 - protein, 8 aa, Borrelia burgdorferi B31
EALLRLKK

SEQ ID NO: 1416 - protein, 8 aa, Borrelia burgdorferi B31
ALLRLKKD

SEQ ID NO: 1417 - protein, 8 aa, Borrelia burgdorferi B31
LLRLKKDF

SEQ ID NO: 1418 - protein, 8 aa, Borrelia burgdorferi B31
LRLKKDFP

SEQ ID NO: 1419 - protein, 8 aa, Borrelia burgdorferi B31
RLKKDFPE

SEQ ID NO: 1420 - protein, 8 aa, Borrelia burgdorferi B31
LKKDFPEN

SEQ ID NO: 1421 - protein, 8 aa, Borrelia burgdorferi B31
KKDFPENI

SEQ ID NO: 1422 - protein, 8 aa, Borrelia burgdorferi B31
KDFPENIE

SEQ ID NO: 1423 - protein, 8 aa, Borrelia burgdorferi B31
DFPENIEE

SEQ ID NO: 1424 - protein, 8 aa, Borrelia burgdorferi B31
FPENIEEV

SEQ ID NO: 1425 - protein, 8 aa, Borrelia burgdorferi B31
PENIEEVF

SEQ ID NO: 1426 - protein, 8 aa, Borrelia burgdorferi B31
ENIEEVFS

SEQ ID NO: 1427 - protein, 8 aa, Borrelia burgdorferi B31
NIEEVFSC

SEQ ID NO: 1428 - protein, 8 aa, Borrelia burgdorferi B31
IEEVFSCA

SEQ ID NO: 1429 - protein, 8 aa, Borrelia burgdorferi B31
EEVFSCAI

SEQ ID NO: 1430 - protein, 8 aa, Borrelia burgdorferi B31
EVFSCAIS

SEQ ID NO: 1431 - protein, 8 aa, Borrelia burgdorferi B31
VFSCAISG

SEQ ID NO: 1432 - protein, 8 aa, Borrelia burgdorferi B31
FSCAISGV

SEQ ID NO: 1433 - protein, 8 aa, Borrelia burgdorferi B31
SCAISGVY

SEQ ID NO: 1434 - protein, 8 aa, Borrelia burgdorferi B31
CAISGVYS

SEQ ID NO: 1435 - protein, 8 aa, Borrelia burgdorferi B31
AISGVYSS

SEQ ID NO: 1436 - protein, 8 aa, Borrelia burgdorferi B31
ISGVYSSY

SEQ ID NO: 1437 - protein, 8 aa, Borrelia burgdorferi B31
SGVYSSYV

SEQ ID NO: 1438 - protein, 8 aa, Borrelia burgdorferi B31
GVYSSYVS

SEQ ID NO: 1439 - protein, 8 aa, Borrelia burgdorferi B31
VYSSYVSD

SEQ ID NO: 1440 - protein, 8 aa, Borrelia burgdorferi B31
YSSYVSDL

SEQ ID NO: 1441 - protein, 8 aa, Borrelia burgdorferi B31
SSYVSDLD

SEQ ID NO: 1442 - protein, 8 aa, Borrelia burgdorferi B31
SYVSDLDN

SEQ ID NO: 1443 - protein, 8 aa, Borrelia burgdorferi B31
YVSDLDNL

SEQ ID NO: 1444 - protein, 8 aa, Borrelia burgdorferi B31
VSDLDNLK

SEQ ID NO: 1445 - protein, 8 aa, Borrelia burgdorferi B31
SDLDNLKR

SEQ ID NO: 1446 - protein, 8 aa, Borrelia burgdorferi B31
DLDNLKRN

SEQ ID NO: 1447 - protein, 8 aa, Borrelia burgdorferi B31
LDNLKRNG

SEQ ID NO: 1448 - protein, 8 aa, Borrelia burgdorferi B31
DNLKRNGS

SEQ ID NO: 1449 - protein, 8 aa, Borrelia burgdorferi B31
NLKRNGSD

SEQ ID NO: 1450 - protein, 8 aa, Borrelia burgdorferi B31
LKRNGSDL

SEQ ID NO: 1451 - protein, 8 aa, Borrelia burgdorferi B31
KRNGSDLI

SEQ ID NO: 1452 - protein, 8 aa, Borrelia burgdorferi B31
RNGSDLIW

SEQ ID NO: 1453 - protein, 8 aa, Borrelia burgdorferi B31
NGSDLIWL

SEQ ID NO: 1454 - protein, 8 aa, Borrelia burgdorferi B31
GSDLIWLV

SEQ ID NO: 1455 - protein, 8 aa, Borrelia burgdorferi B31
SDLIWLVG

SEQ ID NO: 1456 - protein, 8 aa, Borrelia burgdorferi B31
DLIWLVGY

SEQ ID NO: 1457 - protein, 8 aa, Borrelia burgdorferi B31
LIWLVGYM

SEQ ID NO: 1458 - protein, 8 aa, Borrelia burgdorferi B31
IWLVGYML

SEQ ID NO: 1459 - protein, 8 aa, Borrelia burgdorferi B31
WLVGYMLT

SEQ ID NO: 1460 - protein, 8 aa, Borrelia burgdorferi B31
LVGYMLTD

SEQ ID NO: 1461 - protein, 8 aa, Borrelia burgdorferi B31
VGYMLTDA

SEQ ID NO: 1462 - protein, 8 aa, Borrelia burgdorferi B31
GYMLTDAS

SEQ ID NO: 1463 - protein, 8 aa, Borrelia burgdorferi B31
YMLTDASL

SEQ ID NO: 1464 - protein, 8 aa, Borrelia burgdorferi B31
MLTDASLL

SEQ ID NO: 1465 - protein, 8 aa, Borrelia burgdorferi B31
LTDASLLV

SEQ ID NO: 1466 - protein, 8 aa, Borrelia burgdorferi B31
TDASLLVS

SEQ ID NO: 1467 - protein, 8 aa, Borrelia burgdorferi B31
DASLLVSS

SEQ ID NO: 1468 - protein, 8 aa, Borrelia burgdorferi B31
ASLLVSSE

SEQ ID NO: 1469 - protein, 8 aa, Borrelia burgdorferi B31
SLLVSSEN

SEQ ID NO: 1470 - protein, 8 aa, Borrelia burgdorferi B31
LLVSSENP

SEQ ID NO: 1471 - protein, 8 aa, Borrelia burgdorferi B31
LVSSENPK

SEQ ID NO: 1472 - protein, 8 aa, Borrelia burgdorferi B31
VSSENPKI

SEQ ID NO: 1473 - protein, 8 aa, Borrelia burgdorferi B31
SSENPKIS

SEQ ID NO: 1474 - protein, 8 aa, Borrelia burgdorferi B31
SENPKISY

SEQ ID NO: 1475 - protein, 8 aa, Borrelia burgdorferi B31
ENPKISYG

SEQ ID NO: 1476 - protein, 8 aa, Borrelia burgdorferi B31
NPKISYGI

SEQ ID NO: 1477 - protein, 8 aa, Borrelia burgdorferi B31
PKISYGII

SEQ ID NO: 1478 - protein, 8 aa, Borrelia burgdorferi B31
KISYGIID

SEQ ID NO: 1479 - protein, 8 aa, Borrelia burgdorferi B31
ISYGIIDP

SEQ ID NO: 1480 - protein, 8 aa, Borrelia burgdorferi B31
SYGIIDPI

SEQ ID NO: 1481 - protein, 8 aa, Borrelia burgdorferi B31
YGIIDPIY

SEQ ID NO: 1482 - protein, 8 aa, Borrelia burgdorferi B31
GIIDPIYG

SEQ ID NO: 1483 - protein, 8 aa, Borrelia burgdorferi B31
IIDPIYGD

SEQ ID NO: 1484 - protein, 8 aa, Borrelia burgdorferi B31
IDPIYGDD

SEQ ID NO: 1485 - protein, 8 aa, Borrelia burgdorferi B31
DPIYGDDV

SEQ ID NO: 1486 - protein, 8 aa, Borrelia burgdorferi B31
PIYGDDVQ

SEQ ID NO: 1487 - protein, 8 aa, Borrelia burgdorferi B31
IYGDDVQI

SEQ ID NO: 1488 - protein, 8 aa, Borrelia burgdorferi B31
YGDDVQIP

SEQ ID NO: 1489 - protein, 8 aa, Borrelia burgdorferi B31
GDDVQIPE

SEQ ID NO: 1490 - protein, 8 aa, Borrelia burgdorferi B31
DDVQIPEN

SEQ ID NO: 1491 - protein, 8 aa, Borrelia burgdorferi B31
DVQIPENL

SEQ ID NO: 1492 - protein, 8 aa, Borrelia burgdorferi B31
VQIPENLI

SEQ ID NO: 1493 - protein, 8 aa, Borrelia burgdorferi B31
QIPENLIA

SEQ ID NO: 1494 - protein, 8 aa, Borrelia burgdorferi B31
IPENLIAV

SEQ ID NO: 1495 - protein, 8 aa, Borrelia burgdorferi B31
PENLIAVV

SEQ ID NO: 1496 - protein, 8 aa, Borrelia burgdorferi B31
ENLIAVVF

SEQ ID NO: 1497 - protein, 8 aa, Borrelia burgdorferi B31
NLIAVVFR

SEQ ID NO: 1498 - protein, 8 aa, Borrelia burgdorferi B31
LIAVVFRV

SEQ ID NO: 1499 - protein, 8 aa, Borrelia burgdorferi B31
IAVVFRVE

SEQ ID NO: 1500 - protein, 8 aa, Borrelia burgdorferi B31
AVVFRVEQ

SEQ ID NO: 1501 - protein, 8 aa, Borrelia burgdorferi B31
VVFRVEQG

SEQ ID NO: 1502 - protein, 8 aa, Borrelia burgdorferi B31
VFRVEQGA

SEQ ID NO: 1503 - protein, 8 aa, Borrelia burgdorferi B31
FRVEQGAF

SEQ ID NO: 1504 - protein, 8 aa, Borrelia burgdorferi B31
RVEQGAFL

SEQ ID NO: 1505 - protein, 8 aa, Borrelia burgdorferi B31
VEQGAFLA

SEQ ID NO: 1506 - protein, 8 aa, Borrelia burgdorferi B31
EQGAFLAG

SEQ ID NO: 1507 - protein, 8 aa, Borrelia burgdorferi B31
QGAFLAGY

SEQ ID NO: 1508 - protein, 8 aa, Borrelia burgdorferi B31
GAFLAGYI

SEQ ID NO: 1509 - protein, 8 aa, Borrelia burgdorferi B31
AFLAGYIA

SEQ ID NO: 1510 - protein, 8 aa, Borrelia burgdorferi B31
FLAGYIAA

SEQ ID NO: 1511 - protein, 8 aa, Borrelia burgdorferi B31
LAGYIAAK

SEQ ID NO: 1512 - protein, 8 aa, Borrelia burgdorferi B31
AGYIAAKK

SEQ ID NO: 1513 - protein, 8 aa, Borrelia burgdorferi B31
GYIAAKKS

SEQ ID NO: 1514 - protein, 8 aa, Borrelia burgdorferi B31
YIAAKKSF

SEQ ID NO: 1515 - protein, 8 aa, Borrelia burgdorferi B31
IAAKKSFS

SEQ ID NO: 1516 - protein, 8 aa, Borrelia burgdorferi B31
AAKKSFSG

SEQ ID NO: 1517 - protein, 8 aa, Borrelia burgdorferi B31
AKKSFSGK

SEQ ID NO: 1518 - protein, 8 aa, Borrelia burgdorferi B31
KKSFSGKI

SEQ ID NO: 1519 - protein, 8 aa, Borrelia burgdorferi B31
KSFSGKIG

SEQ ID NO: 1520 - protein, 8 aa, Borrelia burgdorferi B31
SFSGKIGF

SEQ ID NO: 1521 - protein, 8 aa, Borrelia burgdorferi B31
FSGKIGFI

SEQ ID NO: 1522 - protein, 8 aa, Borrelia burgdorferi B31
SGKIGFIG

SEQ ID NO: 1523 - protein, 8 aa, Borrelia burgdorferi B31
GKIGFIGG

SEQ ID NO: 1524 - protein, 8 aa, Borrelia burgdorferi B31
KIGFIGGM

SEQ ID NO: 1525 - protein, 8 aa, Borrelia burgdorferi B31
IGFIGGMK

SEQ ID NO: 1526 - protein, 8 aa, Borrelia burgdorferi B31
GFIGGMKG

SEQ ID NO: 1527 - protein, 8 aa, Borrelia burgdorferi B31
FIGGMKGN

SEQ ID NO: 1528 - protein, 8 aa, Borrelia burgdorferi B31
IGGMKGNI

SEQ ID NO: 1529 - protein, 8 aa, Borrelia burgdorferi B31
GGMKGNIV

SEQ ID NO: 1530 - protein, 8 aa, Borrelia burgdorferi B31
GMKGNIVD

SEQ ID NO: 1531 - protein, 8 aa, Borrelia burgdorferi B31
MKGNIVDA

SEQ ID NO: 1532 - protein, 8 aa, Borrelia burgdorferi B31
KGNIVDAF

SEQ ID NO: 1533 - protein, 8 aa, Borrelia burgdorferi B31
GNIVDAFR

SEQ ID NO: 1534 - protein, 8 aa, Borrelia burgdorferi B31
NIVDAFRY

SEQ ID NO: 1535 - protein, 8 aa, Borrelia burgdorferi B31
IVDAFRYG

SEQ ID NO: 1536 - protein, 8 aa, Borrelia burgdorferi B31
VDAFRYGY

SEQ ID NO: 1537 - protein, 8 aa, Borrelia burgdorferi B31
DAFRYGYE

SEQ ID NO: 1538 - protein, 8 aa, Borrelia burgdorferi B31
AFRYGYES

SEQ ID NO: 1539 - protein, 8 aa, Borrelia burgdorferi B31
FRYGYESG

SEQ ID NO: 1540 - protein, 8 aa, Borrelia burgdorferi B31
RYGYESGA

SEQ ID NO: 1541 - protein, 8 aa, Borrelia burgdorferi B31
YGYESGAK

SEQ ID NO: 1542 - protein, 8 aa, Borrelia burgdorferi B31
GYESGAKY

SEQ ID NO: 1543 - protein, 8 aa, Borrelia burgdorferi B31
YESGAKYA

SEQ ID NO: 1544 - protein, 8 aa, Borrelia burgdorferi B31
ESGAKYAN

SEQ ID NO: 1545 - protein, 8 aa, Borrelia burgdorferi B31
SGAKYANK

SEQ ID NO: 1546 - protein, 8 aa, Borrelia burgdorferi B31
GAKYANKD

SEQ ID NO: 1547 - protein, 8 aa, Borrelia burgdorferi B31
AKYANKDI

SEQ ID NO: 1548 - protein, 8 aa, Borrelia burgdorferi B31
KYANKDIE

SEQ ID NO: 1549 - protein, 8 aa, Borrelia burgdorferi B31
YANKDIEI

SEQ ID NO: 1550 - protein, 8 aa, Borrelia burgdorferi B31
ANKDIEII

SEQ ID NO: 1551 - protein, 8 aa, Borrelia burgdorferi B31
NKDIEIIS

SEQ ID NO: 1552 - protein, 8 aa, Borrelia burgdorferi B31
KDIEIISE

SEQ ID NO: 1553 - protein, 8 aa, Borrelia burgdorferi B31
DIEIISEY

SEQ ID NO: 1554 - protein, 8 aa, Borrelia burgdorferi B31
IEIISEYS

SEQ ID NO: 1555 - protein, 8 aa, Borrelia burgdorferi B31
EIISEYSN

SEQ ID NO: 1556 - protein, 8 aa, Borrelia burgdorferi B31
IISEYSNS

SEQ ID NO: 1557 - protein, 8 aa, Borrelia burgdorferi B31
ISEYSNSF

SEQ ID NO: 1558 - protein, 8 aa, Borrelia burgdorferi B31
SEYSNSFS

SEQ ID NO: 1559 - protein, 8 aa, Borrelia burgdorferi B31
EYSNSFSD

SEQ ID NO: 1560 - protein, 8 aa, Borrelia burgdorferi B31
YSNSFSDV

SEQ ID NO: 1561 - protein, 8 aa, Borrelia burgdorferi B31
SNSFSDVD

SEQ ID NO: 1562 - protein, 8 aa, Borrelia burgdorferi B31
NSFSDVDI

SEQ ID NO: 1563 - protein, 8 aa, Borrelia burgdorferi B31
SFSDVDIG

SEQ ID NO: 1564 - protein, 8 aa, Borrelia burgdorferi B31
FSDVDIGR

SEQ ID NO: 1565 - protein, 8 aa, Borrelia burgdorferi B31
SDVDIGRT

SEQ ID NO: 1566 - protein, 8 aa, Borrelia burgdorferi B31
DVDIGRTI

SEQ ID NO: 1567 - protein, 8 aa, Borrelia burgdorferi B31
VDIGRTIA

SEQ ID NO: 1568 - protein, 8 aa, Borrelia burgdorferi B31
DIGRTIAS

SEQ ID NO: 1569 - protein, 8 aa, Borrelia burgdorferi B31
IGRTIASK

SEQ ID NO: 1570 - protein, 8 aa, Borrelia burgdorferi B31
GRTIASKM

SEQ ID NO: 1571 - protein, 8 aa, Borrelia burgdorferi B31
RTIASKMY

SEQ ID NO: 1572 - protein, 8 aa, Borrelia burgdorferi B31
TIASKMYS

SEQ ID NO: 1573 - protein, 8 aa, Borrelia burgdorferi B31
IASKMYSK

SEQ ID NO: 1574 - protein, 8 aa, Borrelia burgdorferi B31
ASKMYSKG

SEQ ID NO: 1575 - protein, 8 aa, Borrelia burgdorferi B31
SKMYSKGI

SEQ ID NO: 1576 - protein, 8 aa, Borrelia burgdorferi B31
KMYSKGID

SEQ ID NO: 1577 - protein, 8 aa, Borrelia burgdorferi B31
MYSKGIDV

SEQ ID NO: 1578 - protein, 8 aa, Borrelia burgdorferi B31
YSKGIDVI

SEQ ID NO: 1579 - protein, 8 aa, Borrelia burgdorferi B31
SKGIDVIH

SEQ ID NO: 1580 - protein, 8 aa, Borrelia burgdorferi B31
KGIDVIHF

SEQ ID NO: 1581 - protein, 8 aa, Borrelia burgdorferi B31
GIDVIHFA

SEQ ID NO: 1582 - protein, 8 aa, Borrelia burgdorferi B31
IDVIHFAA

SEQ ID NO: 1583 - protein, 8 aa, Borrelia burgdorferi B31
DVIHFAAG

SEQ ID NO: 1584 - protein, 8 aa, Borrelia burgdorferi B31
VIHFAAGL

SEQ ID NO: 1585 - protein, 8 aa, Borrelia burgdorferi B31
IHFAAGLA

SEQ ID NO: 1586 - protein, 8 aa, Borrelia burgdorferi B31
HFAAGLAG

SEQ ID NO: 1587 - protein, 8 aa, Borrelia burgdorferi B31
FAAGLAGI

SEQ ID NO: 1588 - protein, 8 aa, Borrelia burgdorferi B31
AAGLAGIG

SEQ ID NO: 1589 - protein, 8 aa, Borrelia burgdorferi B31
AGLAGIGV

SEQ ID NO: 1590 - protein, 8 aa, Borrelia burgdorferi B31
GLAGIGVI

SEQ ID NO: 1591 - protein, 8 aa, Borrelia burgdorferi B31
LAGIGVIE

SEQ ID NO: 1592 - protein, 8 aa, Borrelia burgdorferi B31
AGIGVIET

SEQ ID NO: 1593 - protein, 8 aa, Borrelia burgdorferi B31
GIGVIETA

SEQ ID NO: 1594 - protein, 8 aa, Borrelia burgdorferi B31
IGVIETAK

SEQ ID NO: 1595 - protein, 8 aa, Borrelia burgdorferi B31
GVIETAKN

SEQ ID NO: 1596 - protein, 8 aa, Borrelia burgdorferi B31
VIETAKNL

SEQ ID NO: 1597 - protein, 8 aa, Borrelia burgdorferi B31
IETAKNLG

SEQ ID NO: 1598 - protein, 8 aa, Borrelia burgdorferi B31
ETAKNLGD

SEQ ID NO: 1599 - protein, 8 aa, Borrelia burgdorferi B31
TAKNLGDG

SEQ ID NO: 1600 - protein, 8 aa, Borrelia burgdorferi B31
AKNLGDGY

SEQ ID NO: 1601 - protein, 8 aa, Borrelia burgdorferi B31
KNLGDGYY

SEQ ID NO: 1602 - protein, 8 aa, Borrelia burgdorferi B31
NLGDGYYV

SEQ ID NO: 1603 - protein, 8 aa, Borrelia burgdorferi B31
LGDGYYVI

SEQ ID NO: 1604 - protein, 8 aa, Borrelia burgdorferi B31
GDGYYVIG

SEQ ID NO: 1605 - protein, 8 aa, Borrelia burgdorferi B31
DGYYVIGA

SEQ ID NO: 1606 - protein, 8 aa, Borrelia burgdorferi B31
GYYVIGAD

SEQ ID NO: 1607 - protein, 8 aa, Borrelia burgdorferi B31
YYVIGADQ

SEQ ID NO: 1608 - protein, 8 aa, Borrelia burgdorferi B31
YVIGADQD

SEQ ID NO: 1609 - protein, 8 aa, Borrelia burgdorferi B31
VIGADQDQ

SEQ ID NO: 1610 - protein, 8 aa, Borrelia burgdorferi B31
IGADQDQS

SEQ ID NO: 1611 - protein, 8 aa, Borrelia burgdorferi B31
GADQDQSY

SEQ ID NO: 1612 - protein, 8 aa, Borrelia burgdorferi B31
ADQDQSYL

SEQ ID NO: 1613 - protein, 8 aa, Borrelia burgdorferi B31
DQDQSYLA

SEQ ID NO: 1614 - protein, 8 aa, Borrelia burgdorferi B31
QDQSYLAP

SEQ ID NO: 1615 - protein, 8 aa, Borrelia burgdorferi B31
DQSYLAPK

SEQ ID NO: 1616 - protein, 8 aa, Borrelia burgdorferi B31
QSYLAPKN

SEQ ID NO: 1617 - protein, 8 aa, Borrelia burgdorferi B31
SYLAPKNF

SEQ ID NO: 1618 - protein, 8 aa, Borrelia burgdorferi B31
YLAPKNFI

SEQ ID NO: 1619 - protein, 8 aa, Borrelia burgdorferi B31
LAPKNFIT

SEQ ID NO: 1620 - protein, 8 aa, Borrelia burgdorferi B31
APKNFITS

SEQ ID NO: 1621 - protein, 8 aa, Borrelia burgdorferi B31
PKNFITSV

SEQ ID NO: 1622 - protein, 8 aa, Borrelia burgdorferi B31
KNFITSVI

SEQ ID NO: 1623 - protein, 8 aa, Borrelia burgdorferi B31
NFITSVIK

SEQ ID NO: 1624 - protein, 8 aa, Borrelia burgdorferi B31
FITSVIKN

SEQ ID NO: 1625 - protein, 8 aa, Borrelia burgdorferi B31
ITSVIKNI

SEQ ID NO: 1626 - protein, 8 aa, Borrelia burgdorferi B31
TSVIKNIG

SEQ ID NO: 1627 - protein, 8 aa, Borrelia burgdorferi B31
SVIKNIGD

SEQ ID NO: 1628 - protein, 8 aa, Borrelia burgdorferi B31
VIKNIGDA

SEQ ID NO: 1629 - protein, 8 aa, Borrelia burgdorferi B31
IKNIGDAL

SEQ ID NO: 1630 - protein, 8 aa, Borrelia burgdorferi B31
KNIGDALY

SEQ ID NO: 1631 - protein, 8 aa, Borrelia burgdorferi B31
NIGDALYL

SEQ ID NO: 1632 - protein, 8 aa, Borrelia burgdorferi B31
IGDALYLI

SEQ ID NO: 1633 - protein, 8 aa, Borrelia burgdorferi B31
GDALYLIT

SEQ ID NO: 1634 - protein, 8 aa, Borrelia burgdorferi B31
DALYLITG

SEQ ID NO: 1635 - protein, 8 aa, Borrelia burgdorferi B31
ALYLITGE

SEQ ID NO: 1636 - protein, 8 aa, Borrelia burgdorferi B31
LYLITGEY

SEQ ID NO: 1637 - protein, 8 aa, Borrelia burgdorferi B31
YLITGEYI

SEQ ID NO: 1638 - protein, 8 aa, Borrelia burgdorferi B31
LITGEYIK

SEQ ID NO: 1639 - protein, 8 aa, Borrelia burgdorferi B31
ITGEYIKN

SEQ ID NO: 1640 - protein, 8 aa, Borrelia burgdorferi B31
TGEYIKNN

SEQ ID NO: 1641 - protein, 8 aa, Borrelia burgdorferi B31
GEYIKNNN

SEQ ID NO: 1642 - protein, 8 aa, Borrelia burgdorferi B31
EYIKNNNV

SEQ ID NO: 1643 - protein, 8 aa, Borrelia burgdorferi B31
YIKNNNVW

SEQ ID NO: 1644 - protein, 8 aa, Borrelia burgdorferi B31
IKNNNVWE

SEQ ID NO: 1645 - protein, 8 aa, Borrelia burgdorferi B31
KNNNVWEG

SEQ ID NO: 1646 - protein, 8 aa, Borrelia burgdorferi B31
NNNVWEGG

SEQ ID NO: 1647 - protein, 8 aa, Borrelia burgdorferi B31
NNVWEGGK

SEQ ID NO: 1648 - protein, 8 aa, Borrelia burgdorferi B31
NVWEGGKV

SEQ ID NO: 1649 - protein, 8 aa, Borrelia burgdorferi B31
VWEGGKVV

SEQ ID NO: 1650 - protein, 8 aa, Borrelia burgdorferi B31
WEGGKVVQ

SEQ ID NO: 1651 - protein, 8 aa, Borrelia burgdorferi B31
EGGKVVQM

SEQ ID NO: 1652 - protein, 8 aa, Borrelia burgdorferi B31
GGKVVQMG

SEQ ID NO: 1653 - protein, 8 aa, Borrelia burgdorferi B31
GKVVQMGL

SEQ ID NO: 1654 - protein, 8 aa, Borrelia burgdorferi B31
KVVQMGLR

SEQ ID NO: 1655 - protein, 8 aa, Borrelia burgdorferi B31
VVQMGLRD

SEQ ID NO: 1656 - protein, 8 aa, Borrelia burgdorferi B31
VQMGLRDG

SEQ ID NO: 1657 - protein, 8 aa, Borrelia burgdorferi B31
QMGLRDGV

SEQ ID NO: 1658 - protein, 8 aa, Borrelia burgdorferi B31
MGLRDGVI

SEQ ID NO: 1659 - protein, 8 aa, Borrelia burgdorferi B31
GLRDGVIG

SEQ ID NO: 1660 - protein, 8 aa, Borrelia burgdorferi B31
LRDGVIGL

SEQ ID NO: 1661 - protein, 8 aa, Borrelia burgdorferi B31
RDGVIGLP

SEQ ID NO: 1662 - protein, 8 aa, Borrelia burgdorferi B31
DGVIGLPN

SEQ ID NO: 1663 - protein, 8 aa, Borrelia burgdorferi B31
GVIGLPNA

SEQ ID NO: 1664 - protein, 8 aa, Borrelia burgdorferi B31
VIGLPNAN

SEQ ID NO: 1665 - protein, 8 aa, Borrelia burgdorferi B31
IGLPNANE

SEQ ID NO: 1666 - protein, 8 aa, Borrelia burgdorferi B31
GLPNANEF

SEQ ID NO: 1667 - protein, 8 aa, Borrelia burgdorferi B31
LPNANEFE

SEQ ID NO: 1668 - protein, 8 aa, Borrelia burgdorferi B31
PNANEFEY

SEQ ID NO: 1669 - protein, 8 aa, Borrelia burgdorferi B31
NANEFEYI

SEQ ID NO: 1670 - protein, 8 aa, Borrelia burgdorferi B31
ANEFEYIK

SEQ ID NO: 1671 - protein, 8 aa, Borrelia burgdorferi B31
NEFEYIKV

SEQ ID NO: 1672 - protein, 8 aa, Borrelia burgdorferi B31
EFEYIKVL

SEQ ID NO: 1673 - protein, 8 aa, Borrelia burgdorferi B31
FEYIKVLE

SEQ ID NO: 1674 - protein, 8 aa, Borrelia burgdorferi B31
EYIKVLER

SEQ ID NO: 1675 - protein, 8 aa, Borrelia burgdorferi B31
YIKVLERK

SEQ ID NO: 1676 - protein, 8 aa, Borrelia burgdorferi B31
IKVLERKI

SEQ ID NO: 1677 - protein, 8 aa, Borrelia burgdorferi B31
KVLERKII

SEQ ID NO: 1678 - protein, 8 aa, Borrelia burgdorferi B31
VLERKIIN

SEQ ID NO: 1679 - protein, 8 aa, Borrelia burgdorferi B31
LERKIINK

SEQ ID NO: 1680 - protein, 8 aa, Borrelia burgdorferi B31
ERKIINKE

SEQ ID NO: 1681 - protein, 8 aa, Borrelia burgdorferi B31
RKIINKEI

SEQ ID NO: 1682 - protein, 8 aa, Borrelia burgdorferi B31
KIINKEII

SEQ ID NO: 1683 - protein, 8 aa, Borrelia burgdorferi B31
IINKEIIV

SEQ ID NO: 1684 - protein, 8 aa, Borrelia burgdorferi B31
INKEIIVP

SEQ ID NO: 1685 - protein, 8 aa, Borrelia burgdorferi B31
NKEIIVPC

SEQ ID NO: 1686 - protein, 8 aa, Borrelia burgdorferi B31
KEIIVPCN

SEQ ID NO: 1687 - protein, 8 aa, Borrelia burgdorferi B31
EIIVPCNQ

SEQ ID NO: 1688 - protein, 8 aa, Borrelia burgdorferi B31
IIVPCNQE

SEQ ID NO: 1689 - protein, 8 aa, Borrelia burgdorferi B31
IVPCNQEE

SEQ ID NO: 1690 - protein, 8 aa, Borrelia burgdorferi B31
VPCNQEEY

SEQ ID NO: 1691 - protein, 8 aa, Borrelia burgdorferi B31
PCNQEEYE

SEQ ID NO: 1692 - protein, 8 aa, Borrelia burgdorferi B31
CNQEEYEI

SEQ ID NO: 1693 - protein, 8 aa, Borrelia burgdorferi B31
NQEEYEIF

SEQ ID NO: 1694 - protein, 8 aa, Borrelia burgdorferi B31
QEEYEIFI

SEQ ID NO: 1695 - protein, 8 aa, Borrelia burgdorferi B31
EEYEIFIK

SEQ ID NO: 1696 - protein, 8 aa, Borrelia burgdorferi B31
EYEIFIKQ

SEQ ID NO: 1697 - protein, 8 aa, Borrelia burgdorferi B31
YEIFIKQI

SEQ ID NO: 1698 - protein, 8 aa, Borrelia burgdorferi B31
EIFIKQIL

SEQ ID NO: 1699 - protein, 8 aa, Borrelia burgdorferi B31
IFIKQILK

SEQ ID NO: 1700 - protein, 8 aa, Borrelia burgdorferi B31
FIKQILKL

SEQ ID NO: 1701 - protein, 9 aa, Borrelia burgdorferi B31
MRIVIFIFG

SEQ ID NO: 1702 - protein, 9 aa, Borrelia burgdorferi B31
RIVIFIFGI

SEQ ID NO: 1703 - protein, 9 aa, Borrelia burgdorferi B31
IVIFIFGIL

SEQ ID NO: 1704 - protein, 9 aa, Borrelia burgdorferi B31
VIFIFGILL

SEQ ID NO: 1705 - protein, 9 aa, Borrelia burgdorferi B31
IFIFGILLT

SEQ ID NO: 1706 - protein, 9 aa, Borrelia burgdorferi B31
FIFGILLTS

SEQ ID NO: 1707 - protein, 9 aa, Borrelia burgdorferi B31
IFGILLTSC

SEQ ID NO: 1708 - protein, 9 aa, Borrelia burgdorferi B31
FGILLTSCF

SEQ ID NO: 1709 - protein, 9 aa, Borrelia burgdorferi B31
GILLTSCFS

SEQ ID NO: 1710 - protein, 9 aa, Borrelia burgdorferi B31
ILLTSCFSR

SEQ ID NO: 1711 - protein, 9 aa, Borrelia burgdorferi B31
LLTSCFSRN

SEQ ID NO: 1712 - protein, 9 aa, Borrelia burgdorferi B31
LTSCFSRNG

SEQ ID NO: 1713 - protein, 9 aa, Borrelia burgdorferi B31
TSCFSRNGI

SEQ ID NO: 1714 - protein, 9 aa, Borrelia burgdorferi B31
SCFSRNGIE

SEQ ID NO: 1715 - protein, 9 aa, Borrelia burgdorferi B31
CFSRNGIES

SEQ ID NO: 1716 - protein, 9 aa, Borrelia burgdorferi B31
FSRNGIESS

SEQ ID NO: 1717 - protein, 9 aa, Borrelia burgdorferi B31
SRNGIESSS

SEQ ID NO: 1718 - protein, 9 aa, Borrelia burgdorferi B31
RNGIESSSK

SEQ ID NO: 1719 - protein, 9 aa, Borrelia burgdorferi B31
NGIESSSKK

SEQ ID NO: 1720 - protein, 9 aa, Borrelia burgdorferi B31
GIESSSKKI

SEQ ID NO: 1721 - protein, 9 aa, Borrelia burgdorferi B31
IESSSKKIK

SEQ ID NO: 1722 - protein, 9 aa, Borrelia burgdorferi B31
ESSSKKIKI

SEQ ID NO: 1723 - protein, 9 aa, Borrelia burgdorferi B31
SSSKKIKIS

SEQ ID NO: 1724 - protein, 9 aa, Borrelia burgdorferi B31
SSKKIKISM

SEQ ID NO: 1725 - protein, 9 aa, Borrelia burgdorferi B31
SKKIKISML

SEQ ID NO: 1726 - protein, 9 aa, Borrelia burgdorferi B31
KKIKISMLV

SEQ ID NO: 1727 - protein, 9 aa, Borrelia burgdorferi B31
KIKISMLVD

SEQ ID NO: 1728 - protein, 9 aa, Borrelia burgdorferi B31
IKISMLVDG

SEQ ID NO: 1729 - protein, 9 aa, Borrelia burgdorferi B31
KISMLVDGV

SEQ ID NO: 1730 - protein, 9 aa, Borrelia burgdorferi B31
ISMLVDGVL

SEQ ID NO: 1731 - protein, 9 aa, Borrelia burgdorferi B31
SMLVDGVLD

SEQ ID NO: 1732 - protein, 9 aa, Borrelia burgdorferi B31
MLVDGVLDD

SEQ ID NO: 1733 - protein, 9 aa, Borrelia burgdorferi B31
LVDGVLDDK

SEQ ID NO: 1734 - protein, 9 aa, Borrelia burgdorferi B31
VDGVLDDKS

SEQ ID NO: 1735 - protein, 9 aa, Borrelia burgdorferi B31
DGVLDDKSF

SEQ ID NO: 1736 - protein, 9 aa, Borrelia burgdorferi B31
GVLDDKSFN

SEQ ID NO: 1737 - protein, 9 aa, Borrelia burgdorferi B31
VLDDKSFNS

SEQ ID NO: 1738 - protein, 9 aa, Borrelia burgdorferi B31
LDDKSFNSS

SEQ ID NO: 1739 - protein, 9 aa, Borrelia burgdorferi B31
DDKSFNSSA

SEQ ID NO: 1740 - protein, 9 aa, Borrelia burgdorferi B31
DKSFNSSAN

SEQ ID NO: 1741 - protein, 9 aa, Borrelia burgdorferi B31
KSFNSSANE

SEQ ID NO: 1742 - protein, 9 aa, Borrelia burgdorferi B31
SFNSSANEA

SEQ ID NO: 1743 - protein, 9 aa, Borrelia burgdorferi B31
FNSSANEAL

SEQ ID NO: 1744 - protein, 9 aa, Borrelia burgdorferi B31
NSSANEALL

SEQ ID NO: 1745 - protein, 9 aa, Borrelia burgdorferi B31
SSANEALLR

SEQ ID NO: 1746 - protein, 9 aa, Borrelia burgdorferi B31
SANEALLRL

SEQ ID NO: 1747 - protein, 9 aa, Borrelia burgdorferi B31
ANEALLRLK

SEQ ID NO: 1748 - protein, 9 aa, Borrelia burgdorferi B31
NEALLRLKK

SEQ ID NO: 1749 - protein, 9 aa, Borrelia burgdorferi B31
EALLRLKKD

SEQ ID NO: 1750 - protein, 9 aa, Borrelia burgdorferi B31
ALLRLKKDF

SEQ ID NO: 1751 - protein, 9 aa, Borrelia burgdorferi B31
LLRLKKDFP

SEQ ID NO: 1752 - protein, 9 aa, Borrelia burgdorferi B31
LRLKKDFPE

SEQ ID NO: 1753 - protein, 9 aa, Borrelia burgdorferi B31
RLKKDFPEN

SEQ ID NO: 1754 - protein, 9 aa, Borrelia burgdorferi B31
LKKDFPENI

SEQ ID NO: 1755 - protein, 9 aa, Borrelia burgdorferi B31
KKDFPENIE

SEQ ID NO: 1756 - protein, 9 aa, Borrelia burgdorferi B31
KDFPENIEE

SEQ ID NO: 1757 - protein, 9 aa, Borrelia burgdorferi B31
DFPENIEEV

SEQ ID NO: 1758 - protein, 9 aa, Borrelia burgdorferi B31
FPENIEEVF

SEQ ID NO: 1759 - protein, 9 aa, Borrelia burgdorferi B31
PENIEEVFS

SEQ ID NO: 1760 - protein, 9 aa, Borrelia burgdorferi B31
ENIEEVFSC

SEQ ID NO: 1761 - protein, 9 aa, Borrelia burgdorferi B31
NIEEVFSCA

SEQ ID NO: 1762 - protein, 9 aa, Borrelia burgdorferi B31
IEEVFSCAI

SEQ ID NO: 1763 - protein, 9 aa, Borrelia burgdorferi B31
EEVFSCAIS

SEQ ID NO: 1764 - protein, 9 aa, Borrelia burgdorferi B31
EVFSCAISG

SEQ ID NO: 1765 - protein, 9 aa, Borrelia burgdorferi B31
VFSCAISGV

SEQ ID NO: 1766 - protein, 9 aa, Borrelia burgdorferi B31
FSCAISGVY

SEQ ID NO: 1767 - protein, 9 aa, Borrelia burgdorferi B31
SCAISGVYS

SEQ ID NO: 1768 - protein, 9 aa, Borrelia burgdorferi B31
CAISGVYSS

SEQ ID NO: 1769 - protein, 9 aa, Borrelia burgdorferi B31
AISGVYSSY

SEQ ID NO: 1770 - protein, 9 aa, Borrelia burgdorferi B31
ISGVYSSYV

SEQ ID NO: 1771 - protein, 9 aa, Borrelia burgdorferi B31
SGVYSSYVS

SEQ ID NO: 1772 - protein, 9 aa, Borrelia burgdorferi B31
GVYSSYVSD

SEQ ID NO: 1773 - protein, 9 aa, Borrelia burgdorferi B31
VYSSYVSDL

SEQ ID NO: 1774 - protein, 9 aa, Borrelia burgdorferi B31
YSSYVSDLD

SEQ ID NO: 1775 - protein, 9 aa, Borrelia burgdorferi B31
SSYVSDLDN

SEQ ID NO: 1776 - protein, 9 aa, Borrelia burgdorferi B31
SYVSDLDNL

SEQ ID NO: 1777 - protein, 9 aa, Borrelia burgdorferi B31
YVSDLDNLK

SEQ ID NO: 1778 - protein, 9 aa, Borrelia burgdorferi B31
VSDLDNLKR

SEQ ID NO: 1779 - protein, 9 aa, Borrelia burgdorferi B31
SDLDNLKRN

SEQ ID NO: 1780 - protein, 9 aa, Borrelia burgdorferi B31
DLDNLKRNG

SEQ ID NO: 1781 - protein, 9 aa, Borrelia burgdorferi B31
LDNLKRNGS

SEQ ID NO: 1782 - protein, 9 aa, Borrelia burgdorferi B31
DNLKRNGSD

SEQ ID NO: 1783 - protein, 9 aa, Borrelia burgdorferi B31
NLKRNGSDL

SEQ ID NO: 1784 - protein, 9 aa, Borrelia burgdorferi B31
LKRNGSDLI

SEQ ID NO: 1785 - protein, 9 aa, Borrelia burgdorferi B31
KRNGSDLIW

SEQ ID NO: 1786 - protein, 9 aa, Borrelia burgdorferi B31
RNGSDLIWL

SEQ ID NO: 1787 - protein, 9 aa, Borrelia burgdorferi B31
NGSDLIWLV

SEQ ID NO: 1788 - protein, 9 aa, Borrelia burgdorferi B31
GSDLIWLVG

SEQ ID NO: 1789 - protein, 9 aa, Borrelia burgdorferi B31
SDLIWLVGY

SEQ ID NO: 1790 - protein, 9 aa, Borrelia burgdorferi B31
DLIWLVGYM

SEQ ID NO: 1791 - protein, 9 aa, Borrelia burgdorferi B31
LIWLVGYML

SEQ ID NO: 1792 - protein, 9 aa, Borrelia burgdorferi B31
IWLVGYMLT

SEQ ID NO: 1793 - protein, 9 aa, Borrelia burgdorferi B31
WLVGYMLTD

SEQ ID NO: 1794 - protein, 9 aa, Borrelia burgdorferi B31
LVGYMLTDA

SEQ ID NO: 1795 - protein, 9 aa, Borrelia burgdorferi B31
VGYMLTDAS

SEQ ID NO: 1796 - protein, 9 aa, Borrelia burgdorferi B31
GYMLTDASL

SEQ ID NO: 1797 - protein, 9 aa, Borrelia burgdorferi B31
YMLTDASLL

SEQ ID NO: 1798 - protein, 9 aa, Borrelia burgdorferi B31
MLTDASLLV

SEQ ID NO: 1799 - protein, 9 aa, Borrelia burgdorferi B31
LTDASLLVS

SEQ ID NO: 1800 - protein, 9 aa, Borrelia burgdorferi B31
TDASLLVSS

SEQ ID NO: 1801 - protein, 9 aa, Borrelia burgdorferi B31
DASLLVSSE

SEQ ID NO: 1802 - protein, 9 aa, Borrelia burgdorferi B31
ASLLVSSEN

SEQ ID NO: 1803 - protein, 9 aa, Borrelia burgdorferi B31
SLLVSSENP

SEQ ID NO: 1804 - protein, 9 aa, Borrelia burgdorferi B31
LLVSSENPK

SEQ ID NO: 1805 - protein, 9 aa, Borrelia burgdorferi B31
LVSSENPKI

SEQ ID NO: 1806 - protein, 9 aa, Borrelia burgdorferi B31
VSSENPKIS

SEQ ID NO: 1807 - protein, 9 aa, Borrelia burgdorferi B31
SSENPKISY

SEQ ID NO: 1808 - protein, 9 aa, Borrelia burgdorferi B31
SENPKISYG

SEQ ID NO: 1809 - protein, 9 aa, Borrelia burgdorferi B31
ENPKISYGI

SEQ ID NO: 1810 - protein, 9 aa, Borrelia burgdorferi B31
NPKISYGII

SEQ ID NO: 1811 - protein, 9 aa, Borrelia burgdorferi B31
PKISYGIID

SEQ ID NO: 1812 - protein, 9 aa, Borrelia burgdorferi B31
KISYGIIDP

SEQ ID NO: 1813 - protein, 9 aa, Borrelia burgdorferi B31
ISYGIIDPI

SEQ ID NO: 1814 - protein, 9 aa, Borrelia burgdorferi B31
SYGIIDPIY

SEQ ID NO: 1815 - protein, 9 aa, Borrelia burgdorferi B31
YGIIDPIYG

SEQ ID NO: 1816 - protein, 9 aa, Borrelia burgdorferi B31
GIIDPIYGD

SEQ ID NO: 1817 - protein, 9 aa, Borrelia burgdorferi B31
IIDPIYGDD

SEQ ID NO: 1818 - protein, 9 aa, Borrelia burgdorferi B31
IDPIYGDDV

SEQ ID NO: 1819 - protein, 9 aa, Borrelia burgdorferi B31
DPIYGDDVQ

SEQ ID NO: 1820 - protein, 9 aa, Borrelia burgdorferi B31
PIYGDDVQI

SEQ ID NO: 1821 - protein, 9 aa, Borrelia burgdorferi B31
IYGDDVQIP

SEQ ID NO: 1822 - protein, 9 aa, Borrelia burgdorferi B31
YGDDVQIPE

SEQ ID NO: 1823 - protein, 9 aa, Borrelia burgdorferi B31
GDDVQIPEN

SEQ ID NO: 1824 - protein, 9 aa, Borrelia burgdorferi B31
DDVQIPENL

SEQ ID NO: 1825 - protein, 9 aa, Borrelia burgdorferi B31
DVQIPENLI

SEQ ID NO: 1826 - protein, 9 aa, Borrelia burgdorferi B31
VQIPENLIA

SEQ ID NO: 1827 - protein, 9 aa, Borrelia burgdorferi B31
QIPENLIAV

SEQ ID NO: 1828 - protein, 9 aa, Borrelia burgdorferi B31
IPENLIAVV

SEQ ID NO: 1829 - protein, 9 aa, Borrelia burgdorferi B31
PENLIAVVF

SEQ ID NO: 1830 - protein, 9 aa, Borrelia burgdorferi B31
ENLIAVVFR

SEQ ID NO: 1831 - protein, 9 aa, Borrelia burgdorferi B31
NLIAVVFRV

SEQ ID NO: 1832 - protein, 9 aa, Borrelia burgdorferi B31
LIAVVFRVE

SEQ ID NO: 1833 - protein, 9 aa, Borrelia burgdorferi B31
IAVVFRVEQ

SEQ ID NO: 1834 - protein, 9 aa, Borrelia burgdorferi B31
AVVFRVEQG

SEQ ID NO: 1835 - protein, 9 aa, Borrelia burgdorferi B31
VVFRVEQGA

SEQ ID NO: 1836 - protein, 9 aa, Borrelia burgdorferi B31
VFRVEQGAF

SEQ ID NO: 1837 - protein, 9 aa, Borrelia burgdorferi B31
FRVEQGAFL

SEQ ID NO: 1838 - protein, 9 aa, Borrelia burgdorferi B31
RVEQGAFLA

SEQ ID NO: 1839 - protein, 9 aa, Borrelia burgdorferi B31
VEQGAFLAG

SEQ ID NO: 1840 - protein, 9 aa, Borrelia burgdorferi B31
EQGAFLAGY

SEQ ID NO: 1841 - protein, 9 aa, Borrelia burgdorferi B31
QGAFLAGYI

SEQ ID NO: 1842 - protein, 9 aa, Borrelia burgdorferi B31
GAFLAGYIA

SEQ ID NO: 1843 - protein, 9 aa, Borrelia burgdorferi B31
AFLAGYIAA

SEQ ID NO: 1844 - protein, 9 aa, Borrelia burgdorferi B31
FLAGYIAAK

SEQ ID NO: 1845 - protein, 9 aa, Borrelia burgdorferi B31
LAGYIAAKK

SEQ ID NO: 1846 - protein, 9 aa, Borrelia burgdorferi B31
AGYIAAKKS

SEQ ID NO: 1847 - protein, 9 aa, Borrelia burgdorferi B31
GYIAAKKSF

SEQ ID NO: 1848 - protein, 9 aa, Borrelia burgdorferi B31
YIAAKKSFS

SEQ ID NO: 1849 - protein, 9 aa, Borrelia burgdorferi B31
IAAKKSFSG

SEQ ID NO: 1850 - protein, 9 aa, Borrelia burgdorferi B31
AAKKSFSGK

SEQ ID NO: 1851 - protein, 9 aa, Borrelia burgdorferi B31
AKKSFSGKI

SEQ ID NO: 1852 - protein, 9 aa, Borrelia burgdorferi B31
KKSFSGKIG

SEQ ID NO: 1853 - protein, 9 aa, Borrelia burgdorferi B31
KSFSGKIGF

SEQ ID NO: 1854 - protein, 9 aa, Borrelia burgdorferi B31
SFSGKIGFI

SEQ ID NO: 1855 - protein, 9 aa, Borrelia burgdorferi B31
FSGKIGFIG

SEQ ID NO: 1856 - protein, 9 aa, Borrelia burgdorferi B31
SGKIGFIGG

SEQ ID NO: 1857 - protein, 9 aa, Borrelia burgdorferi B31
GKIGFIGGM

SEQ ID NO: 1858 - protein, 9 aa, Borrelia burgdorferi B31
KIGFIGGMK

SEQ ID NO: 1859 - protein, 9 aa, Borrelia burgdorferi B31
IGFIGGMKG

SEQ ID NO: 1860 - protein, 9 aa, Borrelia burgdorferi B31
GFIGGMKGN

SEQ ID NO: 1861 - protein, 9 aa, Borrelia burgdorferi B31
FIGGMKGNI

SEQ ID NO: 1862 - protein, 9 aa, Borrelia burgdorferi B31
IGGMKGNIV

SEQ ID NO: 1863 - protein, 9 aa, Borrelia burgdorferi B31
GGMKGNIVD

SEQ ID NO: 1864 - protein, 9 aa, Borrelia burgdorferi B31
GMKGNIVDA

SEQ ID NO: 1865 - protein, 9 aa, Borrelia burgdorferi B31
MKGNIVDAF

SEQ ID NO: 1866 - protein, 9 aa, Borrelia burgdorferi B31
KGNIVDAFR

SEQ ID NO: 1867 - protein, 9 aa, Borrelia burgdorferi B31
GNIVDAFRY

SEQ ID NO: 1868 - protein, 9 aa, Borrelia burgdorferi B31
NIVDAFRYG

SEQ ID NO: 1869 - protein, 9 aa, Borrelia burgdorferi B31
IVDAFRYGY

SEQ ID NO: 1870 - protein, 9 aa, Borrelia burgdorferi B31
VDAFRYGYE

SEQ ID NO: 1871 - protein, 9 aa, Borrelia burgdorferi B31
DAFRYGYES

SEQ ID NO: 1872 - protein, 9 aa, Borrelia burgdorferi B31
AFRYGYESG

SEQ ID NO: 1873 - protein, 9 aa, Borrelia burgdorferi B31
FRYGYESGA

SEQ ID NO: 1874 - protein, 9 aa, Borrelia burgdorferi B31
RYGYESGAK

SEQ ID NO: 1875 - protein, 9 aa, Borrelia burgdorferi B31
YGYESGAKY

SEQ ID NO: 1876 - protein, 9 aa, Borrelia burgdorferi B31
GYESGAKYA

SEQ ID NO: 1877 - protein, 9 aa, Borrelia burgdorferi B31
YESGAKYAN

SEQ ID NO: 1878 - protein, 9 aa, Borrelia burgdorferi B31
ESGAKYANK

SEQ ID NO: 1879 - protein, 9 aa, Borrelia burgdorferi B31
SGAKYANKD

SEQ ID NO: 1880 - protein, 9 aa, Borrelia burgdorferi B31
GAKYANKDI

SEQ ID NO: 1881 - protein, 9 aa, Borrelia burgdorferi B31
AKYANKDIE

SEQ ID NO: 1882 - protein, 9 aa, Borrelia burgdorferi B31
KYANKDIEI

SEQ ID NO: 1883 - protein, 9 aa, Borrelia burgdorferi B31
YANKDIEII

SEQ ID NO: 1884 - protein, 9 aa, Borrelia burgdorferi B31
ANKDIEIIS

SEQ ID NO: 1885 - protein, 9 aa, Borrelia burgdorferi B31
NKDIEIISE

SEQ ID NO: 1886 - protein, 9 aa, Borrelia burgdorferi B31
KDIEIISEY

SEQ ID NO: 1887 - protein, 9 aa, Borrelia burgdorferi B31
DIEIISEYS

SEQ ID NO: 1888 - protein, 9 aa, Borrelia burgdorferi B31
IEIISEYSN

SEQ ID NO: 1889 - protein, 9 aa, Borrelia burgdorferi B31
EIISEYSNS

SEQ ID NO: 1890 - protein, 9 aa, Borrelia burgdorferi B31
IISEYSNSF

SEQ ID NO: 1891 - protein, 9 aa, Borrelia burgdorferi B31
ISEYSNSFS

SEQ ID NO: 1892 - protein, 9 aa, Borrelia burgdorferi B31
SEYSNSFSD

SEQ ID NO: 1893 - protein, 9 aa, Borrelia burgdorferi B31
EYSNSFSDV

SEQ ID NO: 1894 - protein, 9 aa, Borrelia burgdorferi B31
YSNSFSDVD

SEQ ID NO: 1895 - protein, 9 aa, Borrelia burgdorferi B31
SNSFSDVDI

SEQ ID NO: 1896 - protein, 9 aa, Borrelia burgdorferi B31
NSFSDVDIG

SEQ ID NO: 1897 - protein, 9 aa, Borrelia burgdorferi B31
SFSDVDIGR

SEQ ID NO: 1898 - protein, 9 aa, Borrelia burgdorferi B31
FSDVDIGRT

SEQ ID NO: 1899 - protein, 9 aa, Borrelia burgdorferi B31
SDVDIGRTI

SEQ ID NO: 1900 - protein, 9 aa, Borrelia burgdorferi B31
DVDIGRTIA

SEQ ID NO: 1901 - protein, 9 aa, Borrelia burgdorferi B31
VDIGRTIAS

SEQ ID NO: 1902 - protein, 9 aa, Borrelia burgdorferi B31
DIGRTIASK

SEQ ID NO: 1903 - protein, 9 aa, Borrelia burgdorferi B31
IGRTIASKM

SEQ ID NO: 1904 - protein, 9 aa, Borrelia burgdorferi B31
GRTIASKMY

SEQ ID NO: 1905 - protein, 9 aa, Borrelia burgdorferi B31
RTIASKMYS

SEQ ID NO: 1906 - protein, 9 aa, Borrelia burgdorferi B31
TIASKMYSK

SEQ ID NO: 1907 - protein, 9 aa, Borrelia burgdorferi B31
IASKMYSKG

SEQ ID NO: 1908 - protein, 9 aa, Borrelia burgdorferi B31
ASKMYSKGI

SEQ ID NO: 1909 - protein, 9 aa, Borrelia burgdorferi B31
SKMYSKGID

SEQ ID NO: 1910 - protein, 9 aa, Borrelia burgdorferi B31
KMYSKGIDV

SEQ ID NO: 1911 - protein, 9 aa, Borrelia burgdorferi B31
MYSKGIDVI

SEQ ID NO: 1912 - protein, 9 aa, Borrelia burgdorferi B31
YSKGIDVIH

SEQ ID NO: 1913 - protein, 9 aa, Borrelia burgdorferi B31
SKGIDVIHF

SEQ ID NO: 1914 - protein, 9 aa, Borrelia burgdorferi B31
KGIDVIHFA

SEQ ID NO: 1915 - protein, 9 aa, Borrelia burgdorferi B31
GIDVIHFAA

SEQ ID NO: 1916 - protein, 9 aa, Borrelia burgdorferi B31
IDVIHFAAG

SEQ ID NO: 1917 - protein, 9 aa, Borrelia burgdorferi B31
DVIHFAAGL

SEQ ID NO: 1918 - protein, 9 aa, Borrelia burgdorferi B31
VIHFAAGLA

SEQ ID NO: 1919 - protein, 9 aa, Borrelia burgdorferi B31
IHFAAGLAG

SEQ ID NO: 1920 - protein, 9 aa, Borrelia burgdorferi B31
HFAAGLAGI

SEQ ID NO: 1921 - protein, 9 aa, Borrelia burgdorferi B31
FAAGLAGIG

SEQ ID NO: 1922 - protein, 9 aa, Borrelia burgdorferi B31
AAGLAGIGV

SEQ ID NO: 1923 - protein, 9 aa, Borrelia burgdorferi B31
AGLAGIGVI

SEQ ID NO: 1924 - protein, 9 aa, Borrelia burgdorferi B31
GLAGIGVIE

SEQ ID NO: 1925 - protein, 9 aa, Borrelia burgdorferi B31
LAGIGVIET

SEQ ID NO: 1926 - protein, 9 aa, Borrelia burgdorferi B31
AGIGVIETA

SEQ ID NO: 1927 - protein, 9 aa, Borrelia burgdorferi B31
GIGVIETAK

SEQ ID NO: 1928 - protein, 9 aa, Borrelia burgdorferi B31
IGVIETAKN

SEQ ID NO: 1929 - protein, 9 aa, Borrelia burgdorferi B31
GVIETAKNL

SEQ ID NO: 1930 - protein, 9 aa, Borrelia burgdorferi B31
VIETAKNLG

SEQ ID NO: 1931 - protein, 9 aa, Borrelia burgdorferi B31
IETAKNLGD

SEQ ID NO: 1932 - protein, 9 aa, Borrelia burgdorferi B31
ETAKNLGDG

SEQ ID NO: 1933 - protein, 9 aa, Borrelia burgdorferi B31
TAKNLGDGY

SEQ ID NO: 1934 - protein, 9 aa, Borrelia burgdorferi B31
AKNLGDGYY

SEQ ID NO: 1935 - protein, 9 aa, Borrelia burgdorferi B31
KNLGDGYYV

SEQ ID NO: 1936 - protein, 9 aa, Borrelia burgdorferi B31
NLGDGYYVI

SEQ ID NO: 1937 - protein, 9 aa, Borrelia burgdorferi B31
LGDGYYVIG

SEQ ID NO: 1938 - protein, 9 aa, Borrelia burgdorferi B31
GDGYYVIGA

SEQ ID NO: 1939 - protein, 9 aa, Borrelia burgdorferi B31
DGYYVIGAD

SEQ ID NO: 1940 - protein, 9 aa, Borrelia burgdorferi B31
GYYVIGADQ

SEQ ID NO: 1941 - protein, 9 aa, Borrelia burgdorferi B31
YYVIGADQD

SEQ ID NO: 1942 - protein, 9 aa, Borrelia burgdorferi B31
YVIGADQDQ

SEQ ID NO: 1943 - protein, 9 aa, Borrelia burgdorferi B31
VIGADQDQS

SEQ ID NO: 1944 - protein, 9 aa, Borrelia burgdorferi B31
IGADQDQSY

SEQ ID NO: 1945 - protein, 9 aa, Borrelia burgdorferi B31
GADQDQSYL

SEQ ID NO: 1946 - protein, 9 aa, Borrelia burgdorferi B31
ADQDQSYLA

SEQ ID NO: 1947 - protein, 9 aa, Borrelia burgdorferi B31
DQDQSYLAP

SEQ ID NO: 1948 - protein, 9 aa, Borrelia burgdorferi B31
QDQSYLAPK

SEQ ID NO: 1949 - protein, 9 aa, Borrelia burgdorferi B31
DQSYLAPKN

SEQ ID NO: 1950 - protein, 9 aa, Borrelia burgdorferi B31
QSYLAPKNF

SEQ ID NO: 1951 - protein, 9 aa, Borrelia burgdorferi B31
SYLAPKNFI

SEQ ID NO: 1952 - protein, 9 aa, Borrelia burgdorferi B31
YLAPKNFIT

SEQ ID NO: 1953 - protein, 9 aa, Borrelia burgdorferi B31
LAPKNFITS

SEQ ID NO: 1954 - protein, 9 aa, Borrelia burgdorferi B31
APKNFITSV

SEQ ID NO: 1955 - protein, 9 aa, Borrelia burgdorferi B31
PKNFITSVI

SEQ ID NO: 1956 - protein, 9 aa, Borrelia burgdorferi B31
KNFITSVIK

SEQ ID NO: 1957 - protein, 9 aa, Borrelia burgdorferi B31
NFITSVIKN

SEQ ID NO: 1958 - protein, 9 aa, Borrelia burgdorferi B31
FITSVIKNI

SEQ ID NO: 1959 - protein, 9 aa, Borrelia burgdorferi B31
ITSVIKNIG

SEQ ID NO: 1960 - protein, 9 aa, Borrelia burgdorferi B31
TSVIKNIGD

SEQ ID NO: 1961 - protein, 9 aa, Borrelia burgdorferi B31
SVIKNIGDA

SEQ ID NO: 1962 - protein, 9 aa, Borrelia burgdorferi B31
VIKNIGDAL

SEQ ID NO: 1963 - protein, 9 aa, Borrelia burgdorferi B31
IKNIGDALY

SEQ ID NO: 1964 - protein, 9 aa, Borrelia burgdorferi B31
KNIGDALYL

SEQ ID NO: 1965 - protein, 9 aa, Borrelia burgdorferi B31
NIGDALYLI

SEQ ID NO: 1966 - protein, 9 aa, Borrelia burgdorferi B31
IGDALYLIT

SEQ ID NO: 1967 - protein, 9 aa, Borrelia burgdorferi B31
GDALYLITG

SEQ ID NO: 1968 - protein, 9 aa, Borrelia burgdorferi B31
DALYLITGE

SEQ ID NO: 1969 - protein, 9 aa, Borrelia burgdorferi B31
ALYLITGEY

SEQ ID NO: 1970 - protein, 9 aa, Borrelia burgdorferi B31
LYLITGEYI

SEQ ID NO: 1971 - protein, 9 aa, Borrelia burgdorferi B31
YLITGEYIK

SEQ ID NO: 1972 - protein, 9 aa, Borrelia burgdorferi B31
LITGEYIKN

SEQ ID NO: 1973 - protein, 9 aa, Borrelia burgdorferi B31
ITGEYIKNN

SEQ ID NO: 1974 - protein, 9 aa, Borrelia burgdorferi B31
TGEYIKNNN

SEQ ID NO: 1975 - protein, 9 aa, Borrelia burgdorferi B31
GEYIKNNNV

SEQ ID NO: 1976 - protein, 9 aa, Borrelia burgdorferi B31
EYIKNNNVW

SEQ ID NO: 1977 - protein, 9 aa, Borrelia burgdorferi B31
YIKNNNVWE

SEQ ID NO: 1978 - protein, 9 aa, Borrelia burgdorferi B31
IKNNNVWEG

SEQ ID NO: 1979 - protein, 9 aa, Borrelia burgdorferi B31
KNNNVWEGG

SEQ ID NO: 1980 - protein, 9 aa, Borrelia burgdorferi B31
NNNVWEGGK

SEQ ID NO: 1981 - protein, 9 aa, Borrelia burgdorferi B31
NNVWEGGKV

SEQ ID NO: 1982 - protein, 9 aa, Borrelia burgdorferi B31
NVWEGGKVV

SEQ ID NO: 1983 - protein, 9 aa, Borrelia burgdorferi B31
VWEGGKVVQ

SEQ ID NO: 1984 - protein, 9 aa, Borrelia burgdorferi B31
WEGGKVVQM

SEQ ID NO: 1985 - protein, 9 aa, Borrelia burgdorferi B31
EGGKVVQMG

SEQ ID NO: 1986 - protein, 9 aa, Borrelia burgdorferi B31
GGKVVQMGL

SEQ ID NO: 1987 - protein, 9 aa, Borrelia burgdorferi B31
GKVVQMGLR

SEQ ID NO: 1988 - protein, 9 aa, Borrelia burgdorferi B31
KVVQMGLRD

SEQ ID NO: 1989 - protein, 9 aa, Borrelia burgdorferi B31
VVQMGLRDG

SEQ ID NO: 1990 - protein, 9 aa, Borrelia burgdorferi B31
VQMGLRDGV

SEQ ID NO: 1991 - protein, 9 aa, Borrelia burgdorferi B31
QMGLRDGVI

SEQ ID NO: 1992 - protein, 9 aa, Borrelia burgdorferi B31
MGLRDGVIG

SEQ ID NO: 1993 - protein, 9 aa, Borrelia burgdorferi B31
GLRDGVIGL

SEQ ID NO: 1994 - protein, 9 aa, Borrelia burgdorferi B31
LRDGVIGLP

SEQ ID NO: 1995 - protein, 9 aa, Borrelia burgdorferi B31
RDGVIGLPN

SEQ ID NO: 1996 - protein, 9 aa, Borrelia burgdorferi B31
DGVIGLPNA

SEQ ID NO: 1997 - protein, 9 aa, Borrelia burgdorferi B31
GVIGLPNAN

SEQ ID NO: 1998 - protein, 9 aa, Borrelia burgdorferi B31
VIGLPNANE

SEQ ID NO: 1999 - protein, 9 aa, Borrelia burgdorferi B31
IGLPNANEF

SEQ ID NO: 2000 - protein, 9 aa, Borrelia burgdorferi B31
GLPNANEFE

SEQ ID NO: 2001 - protein, 9 aa, Borrelia burgdorferi B31
LPNANEFEY

SEQ ID NO: 2002 - protein, 9 aa, Borrelia burgdorferi B31
PNANEFEYI

SEQ ID NO: 2003 - protein, 9 aa, Borrelia burgdorferi B31
NANEFEYIK

SEQ ID NO: 2004 - protein, 9 aa, Borrelia burgdorferi B31
ANEFEYIKV

SEQ ID NO: 2005 - protein, 9 aa, Borrelia burgdorferi B31
NEFEYIKVL

SEQ ID NO: 2006 - protein, 9 aa, Borrelia burgdorferi B31
EFEYIKVLE

SEQ ID NO: 2007 - protein, 9 aa, Borrelia burgdorferi B31
FEYIKVLER

SEQ ID NO: 2008 - protein, 9 aa, Borrelia burgdorferi B31
EYIKVLERK

SEQ ID NO: 2009 - protein, 9 aa, Borrelia burgdorferi B31
YIKVLERKI

SEQ ID NO: 2010 - protein, 9 aa, Borrelia burgdorferi B31
IKVLERKII

SEQ ID NO: 2011 - protein, 9 aa, Borrelia burgdorferi B31
KVLERKIIN

SEQ ID NO: 2012 - protein, 9 aa, Borrelia burgdorferi B31
VLERKIINK

SEQ ID NO: 2013 - protein, 9 aa, Borrelia burgdorferi B31
LERKIINKE

SEQ ID NO: 2014 - protein, 9 aa, Borrelia burgdorferi B31
ERKIINKEI

SEQ ID NO: 2015 - protein, 9 aa, Borrelia burgdorferi B31
RKIINKEII

SEQ ID NO: 2016 - protein, 9 aa, Borrelia burgdorferi B31
KIINKEIIV

SEQ ID NO: 2017 - protein, 9 aa, Borrelia burgdorferi B31
IINKEIIVP

SEQ ID NO: 2018 - protein, 9 aa, Borrelia burgdorferi B31
INKEIIVPC

SEQ ID NO: 2019 - protein, 9 aa, Borrelia burgdorferi B31
NKEIIVPCN

SEQ ID NO: 2020 - protein, 9 aa, Borrelia burgdorferi B31
KEIIVPCNQ

SEQ ID NO: 2021 - protein, 9 aa, Borrelia burgdorferi B31
EIIVPCNQE

SEQ ID NO: 2022 - protein, 9 aa, Borrelia burgdorferi B31
IIVPCNQEE

SEQ ID NO: 2023 - protein, 9 aa, Borrelia burgdorferi B31
IVPCNQEEY

SEQ ID NO: 2024 - protein, 9 aa, Borrelia burgdorferi B31
VPCNQEEYE

SEQ ID NO: 2025 - protein, 9 aa, Borrelia burgdorferi B31
PCNQEEYEI

SEQ ID NO: 2026 - protein, 9 aa, Borrelia burgdorferi B31
CNQEEYEIF

SEQ ID NO: 2027 - protein, 9 aa, Borrelia burgdorferi B31
NQEEYEIFI

SEQ ID NO: 2028 - protein, 9 aa, Borrelia burgdorferi B31
QEEYEIFIK

SEQ ID NO: 2029 - protein, 9 aa, Borrelia burgdorferi B31
EEYEIFIKQ

SEQ ID NO: 2030 - protein, 9 aa, Borrelia burgdorferi B31
EYEIFIKQI

SEQ ID NO: 2031 - protein, 9 aa, Borrelia burgdorferi B31
YEIFIKQIL

SEQ ID NO: 2032 - protein, 9 aa, Borrelia burgdorferi B31
EIFIKQILK

SEQ ID NO: 2033 - protein, 9 aa, Borrelia burgdorferi B31
IFIKQILKL

SEQ ID NO: 2034 - protein, 10 aa, Borrelia burgdorferi B31
MRIVIFIFGI

SEQ ID NO: 2035 - protein, 10 aa, Borrelia burgdorferi B31
RIVIFIFGIL

SEQ ID NO: 2036 - protein, 10 aa, Borrelia burgdorferi B31
IVIFIFGILL

SEQ ID NO: 2037 - protein, 10 aa, Borrelia burgdorferi B31
VIFIFGILLT

SEQ ID NO: 2038 - protein, 10 aa, Borrelia burgdorferi B31
IFIFGILLTS

SEQ ID NO: 2039 - protein, 10 aa, Borrelia burgdorferi B31
FIFGILLTSC

SEQ ID NO: 2040 - protein, 10 aa, Borrelia burgdorferi B31
IFGILLTSCF

SEQ ID NO: 2041 - protein, 10 aa, Borrelia burgdorferi B31
FGILLTSCFS

SEQ ID NO: 2042 - protein, 10 aa, Borrelia burgdorferi B31
GILLTSCFSR

SEQ ID NO: 2043 - protein, 10 aa, Borrelia burgdorferi B31
ILLTSCFSRN

SEQ ID NO: 2044 - protein, 10 aa, Borrelia burgdorferi B31
LLTSCFSRNG

SEQ ID NO: 2045 - protein, 10 aa, Borrelia burgdorferi B31
LTSCFSRNGI

SEQ ID NO: 2046 - protein, 10 aa, Borrelia burgdorferi B31
TSCFSRNGIE

SEQ ID NO: 2047 - protein, 10 aa, Borrelia burgdorferi B31
SCFSRNGIES

SEQ ID NO: 2048 - protein, 10 aa, Borrelia burgdorferi B31
CFSRNGIESS

SEQ ID NO: 2049 - protein, 10 aa, Borrelia burgdorferi B31
FSRNGIESSS

SEQ ID NO: 2050 - protein, 10 aa, Borrelia burgdorferi B31
SRNGIESSSK

SEQ ID NO: 2051 - protein, 10 aa, Borrelia burgdorferi B31
RNGIESSSKK

SEQ ID NO: 2052 - protein, 10 aa, Borrelia burgdorferi B31
NGIESSSKKI

SEQ ID NO: 2053 - protein, 10 aa, Borrelia burgdorferi B31
GIESSSKKIK

SEQ ID NO: 2054 - protein, 10 aa, Borrelia burgdorferi B31
IESSSKKIKI

SEQ ID NO: 2055 - protein, 10 aa, Borrelia burgdorferi B31
ESSSKKIKIS

SEQ ID NO: 2056 - protein, 10 aa, Borrelia burgdorferi B31
SSSKKIKISM

SEQ ID NO: 2057 - protein, 10 aa, Borrelia burgdorferi B31
SSKKIKISML

SEQ ID NO: 2058 - protein, 10 aa, Borrelia burgdorferi B31
SKKIKISMLV

SEQ ID NO: 2059 - protein, 10 aa, Borrelia burgdorferi B31
KKIKISMLVD

SEQ ID NO: 2060 - protein, 10 aa, Borrelia burgdorferi B31
KIKISMLVDG

SEQ ID NO: 2061 - protein, 10 aa, Borrelia burgdorferi B31
IKISMLVDGV

SEQ ID NO: 2062 - protein, 10 aa, Borrelia burgdorferi B31
KISMLVDGVL

SEQ ID NO: 2063 - protein, 10 aa, Borrelia burgdorferi B31
ISMLVDGVLD

SEQ ID NO: 2064 - protein, 10 aa, Borrelia burgdorferi B31
SMLVDGVLDD

SEQ ID NO: 2065 - protein, 10 aa, Borrelia burgdorferi B31
MLVDGVLDDK

SEQ ID NO: 2066 - protein, 10 aa, Borrelia burgdorferi B31
LVDGVLDDKS

SEQ ID NO: 2067 - protein, 10 aa, Borrelia burgdorferi B31
VDGVLDDKSF

SEQ ID NO: 2068 - protein, 10 aa, Borrelia burgdorferi B31
DGVLDDKSFN

SEQ ID NO: 2069 - protein, 10 aa, Borrelia burgdorferi B31
GVLDDKSFNS

SEQ ID NO: 2070 - protein, 10 aa, Borrelia burgdorferi B31
VLDDKSFNSS

SEQ ID NO: 2071 - protein, 10 aa, Borrelia burgdorferi B31
LDDKSFNSSA

SEQ ID NO: 2072 - protein, 10 aa, Borrelia burgdorferi B31
DDKSFNSSAN

SEQ ID NO: 2073 - protein, 10 aa, Borrelia burgdorferi B31
DKSFNSSANE

SEQ ID NO: 2074 - protein, 10 aa, Borrelia burgdorferi B31
KSFNSSANEA

SEQ ID NO: 2075 - protein, 10 aa, Borrelia burgdorferi B31
SFNSSANEAL

SEQ ID NO: 2076 - protein, 10 aa, Borrelia burgdorferi B31
FNSSANEALL

SEQ ID NO: 2077 - protein, 10 aa, Borrelia burgdorferi B31
NSSANEALLR

SEQ ID NO: 2078 - protein, 10 aa, Borrelia burgdorferi B31
SSANEALLRL

SEQ ID NO: 2079 - protein, 10 aa, Borrelia burgdorferi B31
SANEALLRLK

SEQ ID NO: 2080 - protein, 10 aa, Borrelia burgdorferi B31
ANEALLRLKK

SEQ ID NO: 2081 - protein, 10 aa, Borrelia burgdorferi B31
NEALLRLKKD

SEQ ID NO: 2082 - protein, 10 aa, Borrelia burgdorferi B31
EALLRLKKDF

SEQ ID NO: 2083 - protein, 10 aa, Borrelia burgdorferi B31
ALLRLKKDFP

SEQ ID NO: 2084 - protein, 10 aa, Borrelia burgdorferi B31
LLRLKKDFPE

SEQ ID NO: 2085 - protein, 10 aa, Borrelia burgdorferi B31
LRLKKDFPEN

SEQ ID NO: 2086 - protein, 10 aa, Borrelia burgdorferi B31
RLKKDFPENI

SEQ ID NO: 2087 - protein, 10 aa, Borrelia burgdorferi B31
LKKDFPENIE

SEQ ID NO: 2088 - protein, 10 aa, Borrelia burgdorferi B31
KKDFPENIEE

SEQ ID NO: 2089 - protein, 10 aa, Borrelia burgdorferi B31
KDFPENIEEV

SEQ ID NO: 2090 - protein, 10 aa, Borrelia burgdorferi B31
DFPENIEEVF

SEQ ID NO: 2091 - protein, 10 aa, Borrelia burgdorferi B31
FPENIEEVFS

SEQ ID NO: 2092 - protein, 10 aa, Borrelia burgdorferi B31
PENIEEVFSC

SEQ ID NO: 2093 - protein, 10 aa, Borrelia burgdorferi B31
ENIEEVFSCA

SEQ ID NO: 2094 - protein, 10 aa, Borrelia burgdorferi B31
NIEEVFSCAI

SEQ ID NO: 2095 - protein, 10 aa, Borrelia burgdorferi B31
IEEVFSCAIS

SEQ ID NO: 2096 - protein, 10 aa, Borrelia burgdorferi B31
EEVFSCAISG

SEQ ID NO: 2097 - protein, 10 aa, Borrelia burgdorferi B31
EVFSCAISGV

SEQ ID NO: 2098 - protein, 10 aa, Borrelia burgdorferi B31
VFSCAISGVY

SEQ ID NO: 2099 - protein, 10 aa, Borrelia burgdorferi B31
FSCAISGVYS

SEQ ID NO: 2100 - protein, 10 aa, Borrelia burgdorferi B31
SCAISGVYSS

SEQ ID NO: 2101 - protein, 10 aa, Borrelia burgdorferi B31
CAISGVYSSY

SEQ ID NO: 2102 - protein, 10 aa, Borrelia burgdorferi B31
AISGVYSSYV

SEQ ID NO: 2103 - protein, 10 aa, Borrelia burgdorferi B31
ISGVYSSYVS

SEQ ID NO: 2104 - protein, 10 aa, Borrelia burgdorferi B31
SGVYSSYVSD

SEQ ID NO: 2105 - protein, 10 aa, Borrelia burgdorferi B31
GVYSSYVSDL

SEQ ID NO: 2106 - protein, 10 aa, Borrelia burgdorferi B31
VYSSYVSDLD

SEQ ID NO: 2107 - protein, 10 aa, Borrelia burgdorferi B31
YSSYVSDLDN

SEQ ID NO: 2108 - protein, 10 aa, Borrelia burgdorferi B31
SSYVSDLDNL

SEQ ID NO: 2109 - protein, 10 aa, Borrelia burgdorferi B31
SYVSDLDNLK

SEQ ID NO: 2110 - protein, 10 aa, Borrelia burgdorferi B31
YVSDLDNLKR

SEQ ID NO: 2111 - protein, 10 aa, Borrelia burgdorferi B31
VSDLDNLKRN

SEQ ID NO: 2112 - protein, 10 aa, Borrelia burgdorferi B31
SDLDNLKRNG

SEQ ID NO: 2113 - protein, 10 aa, Borrelia burgdorferi B31
DLDNLKRNGS

SEQ ID NO: 2114 - protein, 10 aa, Borrelia burgdorferi B31
LDNLKRNGSD

SEQ ID NO: 2115 - protein, 10 aa, Borrelia burgdorferi B31
DNLKRNGSDL

SEQ ID NO: 2116 - protein, 10 aa, Borrelia burgdorferi B31
NLKRNGSDLI

SEQ ID NO: 2117 - protein, 10 aa, Borrelia burgdorferi B31
LKRNGSDLIW

SEQ ID NO: 2118 - protein, 10 aa, Borrelia burgdorferi B31
KRNGSDLIWL

SEQ ID NO: 2119 - protein, 10 aa, Borrelia burgdorferi B31
RNGSDLIWLV

SEQ ID NO: 2120 - protein, 10 aa, Borrelia burgdorferi B31
NGSDLIWLVG

SEQ ID NO: 2121 - protein, 10 aa, Borrelia burgdorferi B31
GSDLIWLVGY

SEQ ID NO: 2122 - protein, 10 aa, Borrelia burgdorferi B31
SDLIWLVGYM

SEQ ID NO: 2123 - protein, 10 aa, Borrelia burgdorferi B31
DLIWLVGYML

SEQ ID NO: 2124 - protein, 10 aa, Borrelia burgdorferi B31
LIWLVGYMLT

SEQ ID NO: 2125 - protein, 10 aa, Borrelia burgdorferi B31
IWLVGYMLTD

SEQ ID NO: 2126 - protein, 10 aa, Borrelia burgdorferi B31
WLVGYMLTDA

SEQ ID NO: 2127 - protein, 10 aa, Borrelia burgdorferi B31
LVGYMLTDAS

SEQ ID NO: 2128 - protein, 10 aa, Borrelia burgdorferi B31
VGYMLTDASL

SEQ ID NO: 2129 - protein, 10 aa, Borrelia burgdorferi B31
GYMLTDASLL

SEQ ID NO: 2130 - protein, 10 aa, Borrelia burgdorferi B31
YMLTDASLLV

SEQ ID NO: 2131 - protein, 10 aa, Borrelia burgdorferi B31
MLTDASLLVS

SEQ ID NO: 2132 - protein, 10 aa, Borrelia burgdorferi B31
LTDASLLVSS

SEQ ID NO: 2133 - protein, 10 aa, Borrelia burgdorferi B31
TDASLLVSSE

SEQ ID NO: 2134 - protein, 10 aa, Borrelia burgdorferi B31
DASLLVSSEN

SEQ ID NO: 2135 - protein, 10 aa, Borrelia burgdorferi B31
ASLLVSSENP

SEQ ID NO: 2136 - protein, 10 aa, Borrelia burgdorferi B31
SLLVSSENPK

SEQ ID NO: 2137 - protein, 10 aa, Borrelia burgdorferi B31
LLVSSENPKI

SEQ ID NO: 2138 - protein, 10 aa, Borrelia burgdorferi B31
LVSSENPKIS

SEQ ID NO: 2139 - protein, 10 aa, Borrelia burgdorferi B31
VSSENPKISY

SEQ ID NO: 2140 - protein, 10 aa, Borrelia burgdorferi B31
SSENPKISYG

SEQ ID NO: 2141 - protein, 10 aa, Borrelia burgdorferi B31
SENPKISYGI

SEQ ID NO: 2142 - protein, 10 aa, Borrelia burgdorferi B31
ENPKISYGII

SEQ ID NO: 2143 - protein, 10 aa, Borrelia burgdorferi B31
NPKISYGIID

SEQ ID NO: 2144 - protein, 10 aa, Borrelia burgdorferi B31
PKISYGIIDP

SEQ ID NO: 2145 - protein, 10 aa, Borrelia burgdorferi B31
KISYGIIDPI

SEQ ID NO: 2146 - protein, 10 aa, Borrelia burgdorferi B31
ISYGIIDPIY

SEQ ID NO: 2147 - protein, 10 aa, Borrelia burgdorferi B31
SYGIIDPIYG

SEQ ID NO: 2148 - protein, 10 aa, Borrelia burgdorferi B31
YGIIDPIYGD

SEQ ID NO: 2149 - protein, 10 aa, Borrelia burgdorferi B31
GIIDPIYGDD

SEQ ID NO: 2150 - protein, 10 aa, Borrelia burgdorferi B31
IIDPIYGDDV

SEQ ID NO: 2151 - protein, 10 aa, Borrelia burgdorferi B31
IDPIYGDDVQ

SEQ ID NO: 2152 - protein, 10 aa, Borrelia burgdorferi B31
DPIYGDDVQI

SEQ ID NO: 2153 - protein, 10 aa, Borrelia burgdorferi B31
PIYGDDVQIP

SEQ ID NO: 2154 - protein, 10 aa, Borrelia burgdorferi B31
IYGDDVQIPE

SEQ ID NO: 2155 - protein, 10 aa, Borrelia burgdorferi B31
YGDDVQIPEN

SEQ ID NO: 2156 - protein, 10 aa, Borrelia burgdorferi B31
GDDVQIPENL

SEQ ID NO: 2157 - protein, 10 aa, Borrelia burgdorferi B31
DDVQIPENLI

SEQ ID NO: 2158 - protein, 10 aa, Borrelia burgdorferi B31
DVQIPENLIA

SEQ ID NO: 2159 - protein, 10 aa, Borrelia burgdorferi B31
VQIPENLIAV

SEQ ID NO: 2160 - protein, 10 aa, Borrelia burgdorferi B31
QIPENLIAVV

SEQ ID NO: 2161 - protein, 10 aa, Borrelia burgdorferi B31
IPENLIAVVF

SEQ ID NO: 2162 - protein, 10 aa, Borrelia burgdorferi B31
PENLIAVVFR

SEQ ID NO: 2163 - protein, 10 aa, Borrelia burgdorferi B31
ENLIAVVFRV

SEQ ID NO: 2164 - protein, 10 aa, Borrelia burgdorferi B31
NLIAVVFRVE

SEQ ID NO: 2165 - protein, 10 aa, Borrelia burgdorferi B31
LIAVVFRVEQ

SEQ ID NO: 2166 - protein, 10 aa, Borrelia burgdorferi B31
IAVVFRVEQG

SEQ ID NO: 2167 - protein, 10 aa, Borrelia burgdorferi B31
AVVFRVEQGA

SEQ ID NO: 2168 - protein, 10 aa, Borrelia burgdorferi B31
VVFRVEQGAF

SEQ ID NO: 2169 - protein, 10 aa, Borrelia burgdorferi B31
VFRVEQGAFL

SEQ ID NO: 2170 - protein, 10 aa, Borrelia burgdorferi B31
FRVEQGAFLA

SEQ ID NO: 2171 - protein, 10 aa, Borrelia burgdorferi B31
RVEQGAFLAG

SEQ ID NO: 2172 - protein, 10 aa, Borrelia burgdorferi B31
VEQGAFLAGY

SEQ ID NO: 2173 - protein, 10 aa, Borrelia burgdorferi B31
EQGAFLAGYI

SEQ ID NO: 2174 - protein, 10 aa, Borrelia burgdorferi B31
QGAFLAGYIA

SEQ ID NO: 2175 - protein, 10 aa, Borrelia burgdorferi B31
GAFLAGYIAA

SEQ ID NO: 2176 - protein, 10 aa, Borrelia burgdorferi B31
AFLAGYIAAK

SEQ ID NO: 2177 - protein, 10 aa, Borrelia burgdorferi B31
FLAGYIAAKK

SEQ ID NO: 2178 - protein, 10 aa, Borrelia burgdorferi B31
LAGYIAAKKS

SEQ ID NO: 2179 - protein, 10 aa, Borrelia burgdorferi B31
AGYIAAKKSF

SEQ ID NO: 2180 - protein, 10 aa, Borrelia burgdorferi B31
GYIAAKKSFS

SEQ ID NO: 2181 - protein, 10 aa, Borrelia burgdorferi B31
YIAAKKSFSG

SEQ ID NO: 2182 - protein, 10 aa, Borrelia burgdorferi B31
IAAKKSFSGK

SEQ ID NO: 2183 - protein, 10 aa, Borrelia burgdorferi B31
AAKKSFSGKI

SEQ ID NO: 2184 - protein, 10 aa, Borrelia burgdorferi B31
AKKSFSGKIG

SEQ ID NO: 2185 - protein, 10 aa, Borrelia burgdorferi B31
KKSFSGKIGF

SEQ ID NO: 2186 - protein, 10 aa, Borrelia burgdorferi B31
KSFSGKIGFI

SEQ ID NO: 2187 - protein, 10 aa, Borrelia burgdorferi B31
SFSGKIGFIG

SEQ ID NO: 2188 - protein, 10 aa, Borrelia burgdorferi B31
FSGKIGFIGG

SEQ ID NO: 2189 - protein, 10 aa, Borrelia burgdorferi B31
SGKIGFIGGM

SEQ ID NO: 2190 - protein, 10 aa, Borrelia burgdorferi B31
GKIGFIGGMK

SEQ ID NO: 2191 - protein, 10 aa, Borrelia burgdorferi B31
KIGFIGGMKG

SEQ ID NO: 2192 - protein, 10 aa, Borrelia burgdorferi B31
IGFIGGMKGN

SEQ ID NO: 2193 - protein, 10 aa, Borrelia burgdorferi B31
GFIGGMKGNI

SEQ ID NO: 2194 - protein, 10 aa, Borrelia burgdorferi B31
FIGGMKGNIV

SEQ ID NO: 2195 - protein, 10 aa, Borrelia burgdorferi B31
IGGMKGNIVD

SEQ ID NO: 2196 - protein, 10 aa, Borrelia burgdorferi B31
GGMKGNIVDA

SEQ ID NO: 2197 - protein, 10 aa, Borrelia burgdorferi B31
GMKGNIVDAF

SEQ ID NO: 2198 - protein, 10 aa, Borrelia burgdorferi B31
MKGNIVDAFR

SEQ ID NO: 2199 - protein, 10 aa, Borrelia burgdorferi B31
KGNIVDAFRY

SEQ ID NO: 2200 - protein, 10 aa, Borrelia burgdorferi B31
GNIVDAFRYG

SEQ ID NO: 2201 - protein, 10 aa, Borrelia burgdorferi B31
NIVDAFRYGY

SEQ ID NO: 2202 - protein, 10 aa, Borrelia burgdorferi B31
IVDAFRYGYE

SEQ ID NO: 2203 - protein, 10 aa, Borrelia burgdorferi B31
VDAFRYGYES

SEQ ID NO: 2204 - protein, 10 aa, Borrelia burgdorferi B31
DAFRYGYESG

SEQ ID NO: 2205 - protein, 10 aa, Borrelia burgdorferi B31
AFRYGYESGA

SEQ ID NO: 2206 - protein, 10 aa, Borrelia burgdorferi B31
FRYGYESGAK

SEQ ID NO: 2207 - protein, 10 aa, Borrelia burgdorferi B31
RYGYESGAKY

SEQ ID NO: 2208 - protein, 10 aa, Borrelia burgdorferi B31
YGYESGAKYA

SEQ ID NO: 2209 - protein, 10 aa, Borrelia burgdorferi B31
GYESGAKYAN

SEQ ID NO: 2210 - protein, 10 aa, Borrelia burgdorferi B31
YESGAKYANK

SEQ ID NO: 2211 - protein, 10 aa, Borrelia burgdorferi B31
ESGAKYANKD

SEQ ID NO: 2212 - protein, 10 aa, Borrelia burgdorferi B31
SGAKYANKDI

SEQ ID NO: 2213 - protein, 10 aa, Borrelia burgdorferi B31
GAKYANKDIE

SEQ ID NO: 2214 - protein, 10 aa, Borrelia burgdorferi B31
AKYANKDIEI

SEQ ID NO: 2215 - protein, 10 aa, Borrelia burgdorferi B31
KYANKDIEII

SEQ ID NO: 2216 - protein, 10 aa, Borrelia burgdorferi B31
YANKDIEIIS

SEQ ID NO: 2217 - protein, 10 aa, Borrelia burgdorferi B31
ANKDIEIISE

SEQ ID NO: 2218 - protein, 10 aa, Borrelia burgdorferi B31
NKDIEIISEY

SEQ ID NO: 2219 - protein, 10 aa, Borrelia burgdorferi B31
KDIEIISEYS

SEQ ID NO: 2220 - protein, 10 aa, Borrelia burgdorferi B31
DIEIISEYSN

SEQ ID NO: 2221 - protein, 10 aa, Borrelia burgdorferi B31
IEIISEYSNS

SEQ ID NO: 2222 - protein, 10 aa, Borrelia burgdorferi B31
EIISEYSNSF

SEQ ID NO: 2223 - protein, 10 aa, Borrelia burgdorferi B31
IISEYSNSFS

SEQ ID NO: 2224 - protein, 10 aa, Borrelia burgdorferi B31
ISEYSNSFSD

SEQ ID NO: 2225 - protein, 10 aa, Borrelia burgdorferi B31
SEYSNSFSDV

SEQ ID NO: 2226 - protein, 10 aa, Borrelia burgdorferi B31
EYSNSFSDVD

SEQ ID NO: 2227 - protein, 10 aa, Borrelia burgdorferi B31
YSNSFSDVDI

SEQ ID NO: 2228 - protein, 10 aa, Borrelia burgdorferi B31
SNSFSDVDIG

SEQ ID NO: 2229 - protein, 10 aa, Borrelia burgdorferi B31
NSFSDVDIGR

SEQ ID NO: 2230 - protein, 10 aa, Borrelia burgdorferi B31
SFSDVDIGRT

SEQ ID NO: 2231 - protein, 10 aa, Borrelia burgdorferi B31
FSDVDIGRTI

SEQ ID NO: 2232 - protein, 10 aa, Borrelia burgdorferi B31
SDVDIGRTIA

SEQ ID NO: 2233 - protein, 10 aa, Borrelia burgdorferi B31
DVDIGRTIAS

SEQ ID NO: 2234 - protein, 10 aa, Borrelia burgdorferi B31
VDIGRTIASK

SEQ ID NO: 2235 - protein, 10 aa, Borrelia burgdorferi B31
DIGRTIASKM

SEQ ID NO: 2236 - protein, 10 aa, Borrelia burgdorferi B31
IGRTIASKMY

SEQ ID NO: 2237 - protein, 10 aa, Borrelia burgdorferi B31
GRTIASKMYS

SEQ ID NO: 2238 - protein, 10 aa, Borrelia burgdorferi B31
RTIASKMYSK

SEQ ID NO: 2239 - protein, 10 aa, Borrelia burgdorferi B31
TIASKMYSKG

SEQ ID NO: 2240 - protein, 10 aa, Borrelia burgdorferi B31
IASKMYSKGI

SEQ ID NO: 2241 - protein, 10 aa, Borrelia burgdorferi B31
ASKMYSKGID

SEQ ID NO: 2242 - protein, 10 aa, Borrelia burgdorferi B31
SKMYSKGIDV

SEQ ID NO: 2243 - protein, 10 aa, Borrelia burgdorferi B31
KMYSKGIDVI

SEQ ID NO: 2244 - protein, 10 aa, Borrelia burgdorferi B31
MYSKGIDVIH

SEQ ID NO: 2245 - protein, 10 aa, Borrelia burgdorferi B31
YSKGIDVIHF

SEQ ID NO: 2246 - protein, 10 aa, Borrelia burgdorferi B31
SKGIDVIHFA

SEQ ID NO: 2247 - protein, 10 aa, Borrelia burgdorferi B31
KGIDVIHFAA

SEQ ID NO: 2248 - protein, 10 aa, Borrelia burgdorferi B31
GIDVIHFAAG

SEQ ID NO: 2249 - protein, 10 aa, Borrelia burgdorferi B31
IDVIHFAAGL

SEQ ID NO: 2250 - protein, 10 aa, Borrelia burgdorferi B31
DVIHFAAGLA

SEQ ID NO: 2251 - protein, 10 aa, Borrelia burgdorferi B31
VIHFAAGLAG

SEQ ID NO: 2252 - protein, 10 aa, Borrelia burgdorferi B31
IHFAAGLAGI

SEQ ID NO: 2253 - protein, 10 aa, Borrelia burgdorferi B31
HFAAGLAGIG

SEQ ID NO: 2254 - protein, 10 aa, Borrelia burgdorferi B31
FAAGLAGIGV

SEQ ID NO: 2255 - protein, 10 aa, Borrelia burgdorferi B31
AAGLAGIGVI

SEQ ID NO: 2256 - protein, 10 aa, Borrelia burgdorferi B31
AGLAGIGVIE

SEQ ID NO: 2257 - protein, 10 aa, Borrelia burgdorferi B31
GLAGIGVIET

SEQ ID NO: 2258 - protein, 10 aa, Borrelia burgdorferi B31
LAGIGVIETA

SEQ ID NO: 2259 - protein, 10 aa, Borrelia burgdorferi B31
AGIGVIETAK

SEQ ID NO: 2260 - protein, 10 aa, Borrelia burgdorferi B31
GIGVIETAKN

SEQ ID NO: 2261 - protein, 10 aa, Borrelia burgdorferi B31
IGVIETAKNL

SEQ ID NO: 2262 - protein, 10 aa, Borrelia burgdorferi B31
GVIETAKNLG

SEQ ID NO: 2263 - protein, 10 aa, Borrelia burgdorferi B31
VIETAKNLGD

SEQ ID NO: 2264 - protein, 10 aa, Borrelia burgdorferi B31
IETAKNLGDG

SEQ ID NO: 2265 - protein, 10 aa, Borrelia burgdorferi B31
ETAKNLGDGY

SEQ ID NO: 2266 - protein, 10 aa, Borrelia burgdorferi B31
TAKNLGDGYY

SEQ ID NO: 2267 - protein, 10 aa, Borrelia burgdorferi B31
AKNLGDGYYV

SEQ ID NO: 2268 - protein, 10 aa, Borrelia burgdorferi B31
KNLGDGYYVI

SEQ ID NO: 2269 - protein, 10 aa, Borrelia burgdorferi B31
NLGDGYYVIG

SEQ ID NO: 2270 - protein, 10 aa, Borrelia burgdorferi B31
LGDGYYVIGA

SEQ ID NO: 2271 - protein, 10 aa, Borrelia burgdorferi B31
GDGYYVIGAD

SEQ ID NO: 2272 - protein, 10 aa, Borrelia burgdorferi B31
DGYYVIGADQ

SEQ ID NO: 2273 - protein, 10 aa, Borrelia burgdorferi B31
GYYVIGADQD

SEQ ID NO: 2274 - protein, 10 aa, Borrelia burgdorferi B31
YYVIGADQDQ

SEQ ID NO: 2275 - protein, 10 aa, Borrelia burgdorferi B31
YVIGADQDQS

SEQ ID NO: 2276 - protein, 10 aa, Borrelia burgdorferi B31
VIGADQDQSY

SEQ ID NO: 2277 - protein, 10 aa, Borrelia burgdorferi B31
IGADQDQSYL

SEQ ID NO: 2278 - protein, 10 aa, Borrelia burgdorferi B31
GADQDQSYLA

SEQ ID NO: 2279 - protein, 10 aa, Borrelia burgdorferi B31
ADQDQSYLAP

SEQ ID NO: 2280 - protein, 10 aa, Borrelia burgdorferi B31
DQDQSYLAPK

SEQ ID NO: 2281 - protein, 10 aa, Borrelia burgdorferi B31
QDQSYLAPKN

SEQ ID NO: 2282 - protein, 10 aa, Borrelia burgdorferi B31
DQSYLAPKNF

SEQ ID NO: 2283 - protein, 10 aa, Borrelia burgdorferi B31
QSYLAPKNFI

SEQ ID NO: 2284 - protein, 10 aa, Borrelia burgdorferi B31
SYLAPKNFIT

SEQ ID NO: 2285 - protein, 10 aa, Borrelia burgdorferi B31
YLAPKNFITS

SEQ ID NO: 2286 - protein, 10 aa, Borrelia burgdorferi B31
LAPKNFITSV

SEQ ID NO: 2287 - protein, 10 aa, Borrelia burgdorferi B31
APKNFITSVI

SEQ ID NO: 2288 - protein, 10 aa, Borrelia burgdorferi B31
PKNFITSVIK

SEQ ID NO: 2289 - protein, 10 aa, Borrelia burgdorferi B31
KNFITSVIKN

SEQ ID NO: 2290 - protein, 10 aa, Borrelia burgdorferi B31
NFITSVIKNI

SEQ ID NO: 2291 - protein, 10 aa, Borrelia burgdorferi B31
FITSVIKNIG

SEQ ID NO: 2292 - protein, 10 aa, Borrelia burgdorferi B31
ITSVIKNIGD

SEQ ID NO: 2293 - protein, 10 aa, Borrelia burgdorferi B31
TSVIKNIGDA

SEQ ID NO: 2294 - protein, 10 aa, Borrelia burgdorferi B31
SVIKNIGDAL

SEQ ID NO: 2295 - protein, 10 aa, Borrelia burgdorferi B31
VIKNIGDALY

SEQ ID NO: 2296 - protein, 10 aa, Borrelia burgdorferi B31
IKNIGDALYL

SEQ ID NO: 2297 - protein, 10 aa, Borrelia burgdorferi B31
KNIGDALYLI

SEQ ID NO: 2298 - protein, 10 aa, Borrelia burgdorferi B31
NIGDALYLIT

SEQ ID NO: 2299 - protein, 10 aa, Borrelia burgdorferi B31
IGDALYLITG

SEQ ID NO: 2300 - protein, 10 aa, Borrelia burgdorferi B31
GDALYLITGE

SEQ ID NO: 2301 - protein, 10 aa, Borrelia burgdorferi B31
DALYLITGEY

SEQ ID NO: 2302 - protein, 10 aa, Borrelia burgdorferi B31
ALYLITGEYI

SEQ ID NO: 2303 - protein, 10 aa, Borrelia burgdorferi B31
LYLITGEYIK

SEQ ID NO: 2304 - protein, 10 aa, Borrelia burgdorferi B31
YLITGEYIKN

SEQ ID NO: 2305 - protein, 10 aa, Borrelia burgdorferi B31
LITGEYIKNN

SEQ ID NO: 2306 - protein, 10 aa, Borrelia burgdorferi B31
ITGEYIKNNN

SEQ ID NO: 2307 - protein, 10 aa, Borrelia burgdorferi B31
TGEYIKNNNV

SEQ ID NO: 2308 - protein, 10 aa, Borrelia burgdorferi B31
GEYIKNNNVW

SEQ ID NO: 2309 - protein, 10 aa, Borrelia burgdorferi B31
EYIKNNNVWE

SEQ ID NO: 2310 - protein, 10 aa, Borrelia burgdorferi B31
YIKNNNVWEG

SEQ ID NO: 2311 - protein, 10 aa, Borrelia burgdorferi B31
IKNNNVWEGG

SEQ ID NO: 2312 - protein, 10 aa, Borrelia burgdorferi B31
KNNNVWEGGK

SEQ ID NO: 2313 - protein, 10 aa, Borrelia burgdorferi B31
NNNVWEGGKV

SEQ ID NO: 2314 - protein, 10 aa, Borrelia burgdorferi B31
NNVWEGGKVV

SEQ ID NO: 2315 - protein, 10 aa, Borrelia burgdorferi B31
NVWEGGKVVQ

SEQ ID NO: 2316 - protein, 10 aa, Borrelia burgdorferi B31
VWEGGKVVQM

SEQ ID NO: 2317 - protein, 10 aa, Borrelia burgdorferi B31
WEGGKVVQMG

SEQ ID NO: 2318 - protein, 10 aa, Borrelia burgdorferi B31
EGGKVVQMGL

SEQ ID NO: 2319 - protein, 10 aa, Borrelia burgdorferi B31
GGKVVQMGLR

SEQ ID NO: 2320 - protein, 10 aa, Borrelia burgdorferi B31
GKVVQMGLRD

SEQ ID NO: 2321 - protein, 10 aa, Borrelia burgdorferi B31
KVVQMGLRDG

SEQ ID NO: 2322 - protein, 10 aa, Borrelia burgdorferi B31
VVQMGLRDGV

SEQ ID NO: 2323 - protein, 10 aa, Borrelia burgdorferi B31
VQMGLRDGVI

SEQ ID NO: 2324 - protein, 10 aa, Borrelia burgdorferi B31
QMGLRDGVIG

SEQ ID NO: 2325 - protein, 10 aa, Borrelia burgdorferi B31
MGLRDGVIGL

SEQ ID NO: 2326 - protein, 10 aa, Borrelia burgdorferi B31
GLRDGVIGLP

SEQ ID NO: 2327 - protein, 10 aa, Borrelia burgdorferi B31
LRDGVIGLPN

SEQ ID NO: 2328 - protein, 10 aa, Borrelia burgdorferi B31
RDGVIGLPNA

SEQ ID NO: 2329 - protein, 10 aa, Borrelia burgdorferi B31
DGVIGLPNAN

SEQ ID NO: 2330 - protein, 10 aa, Borrelia burgdorferi B31
GVIGLPNANE

SEQ ID NO: 2331 - protein, 10 aa, Borrelia burgdorferi B31
VIGLPNANEF

SEQ ID NO: 2332 - protein, 10 aa, Borrelia burgdorferi B31
IGLPNANEFE

SEQ ID NO: 2333 - protein, 10 aa, Borrelia burgdorferi B31
GLPNANEFEY

SEQ ID NO: 2334 - protein, 10 aa, Borrelia burgdorferi B31
LPNANEFEYI

SEQ ID NO: 2335 - protein, 10 aa, Borrelia burgdorferi B31
PNANEFEYIK

SEQ ID NO: 2336 - protein, 10 aa, Borrelia burgdorferi B31
NANEFEYIKV

SEQ ID NO: 2337 - protein, 10 aa, Borrelia burgdorferi B31
ANEFEYIKVL

SEQ ID NO: 2338 - protein, 10 aa, Borrelia burgdorferi B31
NEFEYIKVLE

SEQ ID NO: 2339 - protein, 10 aa, Borrelia burgdorferi B31
EFEYIKVLER

SEQ ID NO: 2340 - protein, 10 aa, Borrelia burgdorferi B31
FEYIKVLERK

SEQ ID NO: 2341 - protein, 10 aa, Borrelia burgdorferi B31
EYIKVLERKI

SEQ ID NO: 2342 - protein, 10 aa, Borrelia burgdorferi B31
YIKVLERKII

SEQ ID NO: 2343 - protein, 10 aa, Borrelia burgdorferi B31
IKVLERKIIN

SEQ ID NO: 2344 - protein, 10 aa, Borrelia burgdorferi B31
KVLERKIINK

SEQ ID NO: 2345 - protein, 10 aa, Borrelia burgdorferi B31
VLERKIINKE

SEQ ID NO: 2346 - protein, 10 aa, Borrelia burgdorferi B31
LERKIINKEI

SEQ ID NO: 2347 - protein, 10 aa, Borrelia burgdorferi B31
ERKIINKEII

SEQ ID NO: 2348 - protein, 10 aa, Borrelia burgdorferi B31
RKIINKEIIV

SEQ ID NO: 2349 - protein, 10 aa, Borrelia burgdorferi B31
KIINKEIIVP

SEQ ID NO: 2350 - protein, 10 aa, Borrelia burgdorferi B31
IINKEIIVPC

SEQ ID NO: 2351 - protein, 10 aa, Borrelia burgdorferi B31
INKEIIVPCN

SEQ ID NO: 2352 - protein, 10 aa, Borrelia burgdorferi B31
NKEIIVPCNQ

SEQ ID NO: 2353 - protein, 10 aa, Borrelia burgdorferi B31
KEIIVPCNQE

SEQ ID NO: 2354 - protein, 10 aa, Borrelia burgdorferi B31
EIIVPCNQEE

SEQ ID NO: 2355 - protein, 10 aa, Borrelia burgdorferi B31
IIVPCNQEEY

SEQ ID NO: 2356 - protein, 10 aa, Borrelia burgdorferi B31
IVPCNQEEYE

SEQ ID NO: 2357 - protein, 10 aa, Borrelia burgdorferi B31
VPCNQEEYEI

SEQ ID NO: 2358 - protein, 10 aa, Borrelia burgdorferi B31
PCNQEEYEIF

SEQ ID NO: 2359 - protein, 10 aa, Borrelia burgdorferi B31
CNQEEYEIFI

SEQ ID NO: 2360 - protein, 10 aa, Borrelia burgdorferi B31
NQEEYEIFIK

SEQ ID NO: 2361 - protein, 10 aa, Borrelia burgdorferi B31
QEEYEIFIKQ

SEQ ID NO: 2362 - protein, 10 aa, Borrelia burgdorferi B31
EEYEIFIKQI

SEQ ID NO: 2363 - protein, 10 aa, Borrelia burgdorferi B31
EYEIFIKQIL

SEQ ID NO: 2364 - protein, 10 aa, Borrelia burgdorferi B31
YEIFIKQILK

SEQ ID NO: 2365 - protein, 10 aa, Borrelia burgdorferi B31
EIFIKQILKL

SEQ ID NO: 2366 - protein, 11 aa, Borrelia burgdorferi B31
MRIVIFIFGIL

SEQ ID NO: 2367 - protein, 11 aa, Borrelia burgdorferi B31
RIVIFIFGILL

SEQ ID NO: 2368 - protein, 11 aa, Borrelia burgdorferi B31
IVIFIFGILLT

SEQ ID NO: 2369 - protein, 11 aa, Borrelia burgdorferi B31
VIFIFGILLTS

SEQ ID NO: 2370 - protein, 11 aa, Borrelia burgdorferi B31
IFIFGILLTSC

SEQ ID NO: 2371 - protein, 11 aa, Borrelia burgdorferi B31
FIFGILLTSCF

SEQ ID NO: 2372 - protein, 11 aa, Borrelia burgdorferi B31
IFGILLTSCFS

SEQ ID NO: 2373 - protein, 11 aa, Borrelia burgdorferi B31
FGILLTSCFSR

SEQ ID NO: 2374 - protein, 11 aa, Borrelia burgdorferi B31
GILLTSCFSRN

SEQ ID NO: 2375 - protein, 11 aa, Borrelia burgdorferi B31
ILLTSCFSRNG

SEQ ID NO: 2376 - protein, 11 aa, Borrelia burgdorferi B31
LLTSCFSRNGI

SEQ ID NO: 2377 - protein, 11 aa, Borrelia burgdorferi B31
LTSCFSRNGIE

SEQ ID NO: 2378 - protein, 11 aa, Borrelia burgdorferi B31
TSCFSRNGIES

SEQ ID NO: 2379 - protein, 11 aa, Borrelia burgdorferi B31
SCFSRNGIESS

SEQ ID NO: 2380 - protein, 11 aa, Borrelia burgdorferi B31
CFSRNGIESSS

SEQ ID NO: 2381 - protein, 11 aa, Borrelia burgdorferi B31
FSRNGIESSSK

SEQ ID NO: 2382 - protein, 11 aa, Borrelia burgdorferi B31
SRNGIESSSKK

SEQ ID NO: 2383 - protein, 11 aa, Borrelia burgdorferi B31
RNGIESSSKKI

SEQ ID NO: 2384 - protein, 11 aa, Borrelia burgdorferi B31
NGIESSSKKIK

SEQ ID NO: 2385 - protein, 11 aa, Borrelia burgdorferi B31
GIESSSKKIKI

SEQ ID NO: 2386 - protein, 11 aa, Borrelia burgdorferi B31
IESSSKKIKIS

SEQ ID NO: 2387 - protein, 11 aa, Borrelia burgdorferi B31
ESSSKKIKISM

SEQ ID NO: 2388 - protein, 11 aa, Borrelia burgdorferi B31
SSSKKIKISML

SEQ ID NO: 2389 - protein, 11 aa, Borrelia burgdorferi B31
SSKKIKISMLV

SEQ ID NO: 2390 - protein, 11 aa, Borrelia burgdorferi B31
SKKIKISMLVD

SEQ ID NO: 2391 - protein, 11 aa, Borrelia burgdorferi B31
KKIKISMLVDG

SEQ ID NO: 2392 - protein, 11 aa, Borrelia burgdorferi B31
KIKISMLVDGV

SEQ ID NO: 2393 - protein, 11 aa, Borrelia burgdorferi B31
IKISMLVDGVL

SEQ ID NO: 2394 - protein, 11 aa, Borrelia burgdorferi B31
KISMLVDGVLD

SEQ ID NO: 2395 - protein, 11 aa, Borrelia burgdorferi B31
ISMLVDGVLDD

SEQ ID NO: 2396 - protein, 11 aa, Borrelia burgdorferi B31
SMLVDGVLDDK

SEQ ID NO: 2397 - protein, 11 aa, Borrelia burgdorferi B31
MLVDGVLDDKS

SEQ ID NO: 2398 - protein, 11 aa, Borrelia burgdorferi B31
LVDGVLDDKSF

SEQ ID NO: 2399 - protein, 11 aa, Borrelia burgdorferi B31
VDGVLDDKSFN

SEQ ID NO: 2400 - protein, 11 aa, Borrelia burgdorferi B31
DGVLDDKSFNS

SEQ ID NO: 2401 - protein, 11 aa, Borrelia burgdorferi B31
GVLDDKSFNSS

SEQ ID NO: 2402 - protein, 11 aa, Borrelia burgdorferi B31
VLDDKSFNSSA

SEQ ID NO: 2403 - protein, 11 aa, Borrelia burgdorferi B31
LDDKSFNSSAN

SEQ ID NO: 2404 - protein, 11 aa, Borrelia burgdorferi B31
DDKSFNSSANE

SEQ ID NO: 2405 - protein, 11 aa, Borrelia burgdorferi B31
DKSFNSSANEA

SEQ ID NO: 2406 - protein, 11 aa, Borrelia burgdorferi B31
KSFNSSANEAL

SEQ ID NO: 2407 - protein, 11 aa, Borrelia burgdorferi B31
SFNSSANEALL

SEQ ID NO: 2408 - protein, 11 aa, Borrelia burgdorferi B31
FNSSANEALLR

SEQ ID NO: 2409 - protein, 11 aa, Borrelia burgdorferi B31
NSSANEALLRL

SEQ ID NO: 2410 - protein, 11 aa, Borrelia burgdorferi B31
SSANEALLRLK

SEQ ID NO: 2411 - protein, 11 aa, Borrelia burgdorferi B31
SANEALLRLKK

SEQ ID NO: 2412 - protein, 11 aa, Borrelia burgdorferi B31
ANEALLRLKKD

SEQ ID NO: 2413 - protein, 11 aa, Borrelia burgdorferi B31
NEALLRLKKDF

SEQ ID NO: 2414 - protein, 11 aa, Borrelia burgdorferi B31
EALLRLKKDFP

SEQ ID NO: 2415 - protein, 11 aa, Borrelia burgdorferi B31
ALLRLKKDFPE

SEQ ID NO: 2416 - protein, 11 aa, Borrelia burgdorferi B31
LLRLKKDFPEN

SEQ ID NO: 2417 - protein, 11 aa, Borrelia burgdorferi B31
LRLKKDFPENI

SEQ ID NO: 2418 - protein, 11 aa, Borrelia burgdorferi B31
RLKKDFPENIE

SEQ ID NO: 2419 - protein, 11 aa, Borrelia burgdorferi B31
LKKDFPENIEE

SEQ ID NO: 2420 - protein, 11 aa, Borrelia burgdorferi B31
KKDFPENIEEV

SEQ ID NO: 2421 - protein, 11 aa, Borrelia burgdorferi B31
KDFPENIEEVF

SEQ ID NO: 2422 - protein, 11 aa, Borrelia burgdorferi B31
DFPENIEEVFS

SEQ ID NO: 2423 - protein, 11 aa, Borrelia burgdorferi B31
FPENIEEVFSC

SEQ ID NO: 2424 - protein, 11 aa, Borrelia burgdorferi B31
PENIEEVFSCA

SEQ ID NO: 2425 - protein, 11 aa, Borrelia burgdorferi B31
ENIEEVFSCAI

SEQ ID NO: 2426 - protein, 11 aa, Borrelia burgdorferi B31
NIEEVFSCAIS

SEQ ID NO: 2427 - protein, 11 aa, Borrelia burgdorferi B31
IEEVFSCAISG

SEQ ID NO: 2428 - protein, 11 aa, Borrelia burgdorferi B31
EEVFSCAISGV

SEQ ID NO: 2429 - protein, 11 aa, Borrelia burgdorferi B31
EVFSCAISGVY

SEQ ID NO: 2430 - protein, 11 aa, Borrelia burgdorferi B31
VFSCAISGVYS

SEQ ID NO: 2431 - protein, 11 aa, Borrelia burgdorferi B31
FSCAISGVYSS

SEQ ID NO: 2432 - protein, 11 aa, Borrelia burgdorferi B31
SCAISGVYSSY

SEQ ID NO: 2433 - protein, 11 aa, Borrelia burgdorferi B31
CAISGVYSSYV

SEQ ID NO: 2434 - protein, 11 aa, Borrelia burgdorferi B31
AISGVYSSYVS

SEQ ID NO: 2435 - protein, 11 aa, Borrelia burgdorferi B31
ISGVYSSYVSD

SEQ ID NO: 2436 - protein, 11 aa, Borrelia burgdorferi B31
SGVYSSYVSDL

SEQ ID NO: 2437 - protein, 11 aa, Borrelia burgdorferi B31
GVYSSYVSDLD

SEQ ID NO: 2438 - protein, 11 aa, Borrelia burgdorferi B31
VYSSYVSDLDN

SEQ ID NO: 2439 - protein, 11 aa, Borrelia burgdorferi B31
YSSYVSDLDNL

SEQ ID NO: 2440 - protein, 11 aa, Borrelia burgdorferi B31
SSYVSDLDNLK

SEQ ID NO: 2441 - protein, 11 aa, Borrelia burgdorferi B31
SYVSDLDNLKR

SEQ ID NO: 2442 - protein, 11 aa, Borrelia burgdorferi B31
YVSDLDNLKRN

SEQ ID NO: 2443 - protein, 11 aa, Borrelia burgdorferi B31
VSDLDNLKRNG

SEQ ID NO: 2444 - protein, 11 aa, Borrelia burgdorferi B31
SDLDNLKRNGS

SEQ ID NO: 2445 - protein, 11 aa, Borrelia burgdorferi B31
DLDNLKRNGSD

SEQ ID NO: 2446 - protein, 11 aa, Borrelia burgdorferi B31
LDNLKRNGSDL

SEQ ID NO: 2447 - protein, 11 aa, Borrelia burgdorferi B31
DNLKRNGSDLI

SEQ ID NO: 2448 - protein, 11 aa, Borrelia burgdorferi B31
NLKRNGSDLIW

SEQ ID NO: 2449 - protein, 11 aa, Borrelia burgdorferi B31
LKRNGSDLIWL

SEQ ID NO: 2450 - protein, 11 aa, Borrelia burgdorferi B31
KRNGSDLIWLV

SEQ ID NO: 2451 - protein, 11 aa, Borrelia burgdorferi B31
RNGSDLIWLVG

SEQ ID NO: 2452 - protein, 11 aa, Borrelia burgdorferi B31
NGSDLIWLVGY

SEQ ID NO: 2453 - protein, 11 aa, Borrelia burgdorferi B31
GSDLIWLVGYM

SEQ ID NO: 2454 - protein, 11 aa, Borrelia burgdorferi B31
SDLIWLVGYML

SEQ ID NO: 2455 - protein, 11 aa, Borrelia burgdorferi B31
DLIWLVGYMLT

SEQ ID NO: 2456 - protein, 11 aa, Borrelia burgdorferi B31
LIWLVGYMLTD

SEQ ID NO: 2457 - protein, 11 aa, Borrelia burgdorferi B31
IWLVGYMLTDA

SEQ ID NO: 2458 - protein, 11 aa, Borrelia burgdorferi B31
WLVGYMLTDAS

SEQ ID NO: 2459 - protein, 11 aa, Borrelia burgdorferi B31
LVGYMLTDASL

SEQ ID NO: 2460 - protein, 11 aa, Borrelia burgdorferi B31
VGYMLTDASLL

SEQ ID NO: 2461 - protein, 11 aa, Borrelia burgdorferi B31
GYMLTDASLLV

SEQ ID NO: 2462 - protein, 11 aa, Borrelia burgdorferi B31
YMLTDASLLVS

SEQ ID NO: 2463 - protein, 11 aa, Borrelia burgdorferi B31
MLTDASLLVSS

SEQ ID NO: 2464 - protein, 11 aa, Borrelia burgdorferi B31
LTDASLLVSSE

SEQ ID NO: 2465 - protein, 11 aa, Borrelia burgdorferi B31
TDASLLVSSEN

SEQ ID NO: 2466 - protein, 11 aa, Borrelia burgdorferi B31
DASLLVSSENP

SEQ ID NO: 2467 - protein, 11 aa, Borrelia burgdorferi B31
ASLLVSSENPK

SEQ ID NO: 2468 - protein, 11 aa, Borrelia burgdorferi B31
SLLVSSENPKI

SEQ ID NO: 2469 - protein, 11 aa, Borrelia burgdorferi B31
LLVSSENPKIS

SEQ ID NO: 2470 - protein, 11 aa, Borrelia burgdorferi B31
LVSSENPKISY

SEQ ID NO: 2471 - protein, 11 aa, Borrelia burgdorferi B31
VSSENPKISYG

SEQ ID NO: 2472 - protein, 11 aa, Borrelia burgdorferi B31
SSENPKISYGI

SEQ ID NO: 2473 - protein, 11 aa, Borrelia burgdorferi B31
SENPKISYGII

SEQ ID NO: 2474 - protein, 11 aa, Borrelia burgdorferi B31
ENPKISYGIID

SEQ ID NO: 2475 - protein, 11 aa, Borrelia burgdorferi B31
NPKISYGIIDP

SEQ ID NO: 2476 - protein, 11 aa, Borrelia burgdorferi B31
PKISYGIIDPI

SEQ ID NO: 2477 - protein, 11 aa, Borrelia burgdorferi B31
KISYGIIDPIY

SEQ ID NO: 2478 - protein, 11 aa, Borrelia burgdorferi B31
ISYGIIDPIYG

SEQ ID NO: 2479 - protein, 11 aa, Borrelia burgdorferi B31
SYGIIDPIYGD

SEQ ID NO: 2480 - protein, 11 aa, Borrelia burgdorferi B31
YGIIDPIYGDD

SEQ ID NO: 2481 - protein, 11 aa, Borrelia burgdorferi B31
GIIDPIYGDDV

SEQ ID NO: 2482 - protein, 11 aa, Borrelia burgdorferi B31
IIDPIYGDDVQ

SEQ ID NO: 2483 - protein, 11 aa, Borrelia burgdorferi B31
IDPIYGDDVQI

SEQ ID NO: 2484 - protein, 11 aa, Borrelia burgdorferi B31
DPIYGDDVQIP

SEQ ID NO: 2485 - protein, 11 aa, Borrelia burgdorferi B31
PIYGDDVQIPE

SEQ ID NO: 2486 - protein, 11 aa, Borrelia burgdorferi B31
IYGDDVQIPEN

SEQ ID NO: 2487 - protein, 11 aa, Borrelia burgdorferi B31
YGDDVQIPENL

SEQ ID NO: 2488 - protein, 11 aa, Borrelia burgdorferi B31
GDDVQIPENLI

SEQ ID NO: 2489 - protein, 11 aa, Borrelia burgdorferi B31
DDVQIPENLIA

SEQ ID NO: 2490 - protein, 11 aa, Borrelia burgdorferi B31
DVQIPENLIAV

SEQ ID NO: 2491 - protein, 11 aa, Borrelia burgdorferi B31
VQIPENLIAVV

SEQ ID NO: 2492 - protein, 11 aa, Borrelia burgdorferi B31
QIPENLIAVVF

SEQ ID NO: 2493 - protein, 11 aa, Borrelia burgdorferi B31
IPENLIAVVFR

SEQ ID NO: 2494 - protein, 11 aa, Borrelia burgdorferi B31
PENLIAVVFRV

SEQ ID NO: 2495 - protein, 11 aa, Borrelia burgdorferi B31
ENLIAVVFRVE

SEQ ID NO: 2496 - protein, 11 aa, Borrelia burgdorferi B31
NLIAVVFRVEQ

SEQ ID NO: 2497 - protein, 11 aa, Borrelia burgdorferi B31
LIAVVFRVEQG

SEQ ID NO: 2498 - protein, 11 aa, Borrelia burgdorferi B31
IAVVFRVEQGA

SEQ ID NO: 2499 - protein, 11 aa, Borrelia burgdorferi B31
AVVFRVEQGAF

SEQ ID NO: 2500 - protein, 11 aa, Borrelia burgdorferi B31
VVFRVEQGAFL

SEQ ID NO: 2501 - protein, 11 aa, Borrelia burgdorferi B31
VFRVEQGAFLA

SEQ ID NO: 2502 - protein, 11 aa, Borrelia burgdorferi B31
FRVEQGAFLAG

SEQ ID NO: 2503 - protein, 11 aa, Borrelia burgdorferi B31
RVEQGAFLAGY

SEQ ID NO: 2504 - protein, 11 aa, Borrelia burgdorferi B31
VEQGAFLAGYI

SEQ ID NO: 2505 - protein, 11 aa, Borrelia burgdorferi B31
EQGAFLAGYIA

SEQ ID NO: 2506 - protein, 11 aa, Borrelia burgdorferi B31
QGAFLAGYIAA

SEQ ID NO: 2507 - protein, 11 aa, Borrelia burgdorferi B31
GAFLAGYIAAK

SEQ ID NO: 2508 - protein, 11 aa, Borrelia burgdorferi B31
AFLAGYIAAKK

SEQ ID NO: 2509 - protein, 11 aa, Borrelia burgdorferi B31
FLAGYIAAKKS

SEQ ID NO: 2510 - protein, 11 aa, Borrelia burgdorferi B31
LAGYIAAKKSF

SEQ ID NO: 2511 - protein, 11 aa, Borrelia burgdorferi B31
AGYIAAKKSFS

SEQ ID NO: 2512 - protein, 11 aa, Borrelia burgdorferi B31
GYIAAKKSFSG

SEQ ID NO: 2513 - protein, 11 aa, Borrelia burgdorferi B31
YIAAKKSFSGK

SEQ ID NO: 2514 - protein, 11 aa, Borrelia burgdorferi B31
IAAKKSFSGKI

SEQ ID NO: 2515 - protein, 11 aa, Borrelia burgdorferi B31
AAKKSFSGKIG

SEQ ID NO: 2516 - protein, 11 aa, Borrelia burgdorferi B31
AKKSFSGKIGF

SEQ ID NO: 2517 - protein, 11 aa, Borrelia burgdorferi B31
KKSFSGKIGFI

SEQ ID NO: 2518 - protein, 11 aa, Borrelia burgdorferi B31
KSFSGKIGFIG

SEQ ID NO: 2519 - protein, 11 aa, Borrelia burgdorferi B31
SFSGKIGFIGG

SEQ ID NO: 2520 - protein, 11 aa, Borrelia burgdorferi B31
FSGKIGFIGGM

SEQ ID NO: 2521 - protein, 11 aa, Borrelia burgdorferi B31
SGKIGFIGGMK

SEQ ID NO: 2522 - protein, 11 aa, Borrelia burgdorferi B31
GKIGFIGGMKG

SEQ ID NO: 2523 - protein, 11 aa, Borrelia burgdorferi B31
KIGFIGGMKGN

SEQ ID NO: 2524 - protein, 11 aa, Borrelia burgdorferi B31
IGFIGGMKGNI

SEQ ID NO: 2525 - protein, 11 aa, Borrelia burgdorferi B31
GFIGGMKGNIV

SEQ ID NO: 2526 - protein, 11 aa, Borrelia burgdorferi B31
FIGGMKGNIVD

SEQ ID NO: 2527 - protein, 11 aa, Borrelia burgdorferi B31
IGGMKGNIVDA

SEQ ID NO: 2528 - protein, 11 aa, Borrelia burgdorferi B31
GGMKGNIVDAF

SEQ ID NO: 2529 - protein, 11 aa, Borrelia burgdorferi B31
GMKGNIVDAFR

SEQ ID NO: 2530 - protein, 11 aa, Borrelia burgdorferi B31
MKGNIVDAFRY

SEQ ID NO: 2531 - protein, 11 aa, Borrelia burgdorferi B31
KGNIVDAFRYG

SEQ ID NO: 2532 - protein, 11 aa, Borrelia burgdorferi B31
GNIVDAFRYGY

SEQ ID NO: 2533 - protein, 11 aa, Borrelia burgdorferi B31
NIVDAFRYGYE

SEQ ID NO: 2534 - protein, 11 aa, Borrelia burgdorferi B31
IVDAFRYGYES

SEQ ID NO: 2535 - protein, 11 aa, Borrelia burgdorferi B31
VDAFRYGYESG

SEQ ID NO: 2536 - protein, 11 aa, Borrelia burgdorferi B31
DAFRYGYESGA

SEQ ID NO: 2537 - protein, 11 aa, Borrelia burgdorferi B31
AFRYGYESGAK

SEQ ID NO: 2538 - protein, 11 aa, Borrelia burgdorferi B31
FRYGYESGAKY

SEQ ID NO: 2539 - protein, 11 aa, Borrelia burgdorferi B31
RYGYESGAKYA

SEQ ID NO: 2540 - protein, 11 aa, Borrelia burgdorferi B31
YGYESGAKYAN

SEQ ID NO: 2541 - protein, 11 aa, Borrelia burgdorferi B31
GYESGAKYANK

SEQ ID NO: 2542 - protein, 11 aa, Borrelia burgdorferi B31
YESGAKYANKD

SEQ ID NO: 2543 - protein, 11 aa, Borrelia burgdorferi B31
ESGAKYANKDI

SEQ ID NO: 2544 - protein, 11 aa, Borrelia burgdorferi B31
SGAKYANKDIE

SEQ ID NO: 2545 - protein, 11 aa, Borrelia burgdorferi B31
GAKYANKDIEI

SEQ ID NO: 2546 - protein, 11 aa, Borrelia burgdorferi B31
AKYANKDIEII

SEQ ID NO: 2547 - protein, 11 aa, Borrelia burgdorferi B31
KYANKDIEIIS

SEQ ID NO: 2548 - protein, 11 aa, Borrelia burgdorferi B31
YANKDIEIISE

SEQ ID NO: 2549 - protein, 11 aa, Borrelia burgdorferi B31
ANKDIEIISEY

SEQ ID NO: 2550 - protein, 11 aa, Borrelia burgdorferi B31
NKDIEIISEYS

SEQ ID NO: 2551 - protein, 11 aa, Borrelia burgdorferi B31
KDIEIISEYSN

SEQ ID NO: 2552 - protein, 11 aa, Borrelia burgdorferi B31
DIEIISEYSNS

SEQ ID NO: 2553 - protein, 11 aa, Borrelia burgdorferi B31
IEIISEYSNSF

SEQ ID NO: 2554 - protein, 11 aa, Borrelia burgdorferi B31
EIISEYSNSFS

SEQ ID NO: 2555 - protein, 11 aa, Borrelia burgdorferi B31
IISEYSNSFSD

SEQ ID NO: 2556 - protein, 11 aa, Borrelia burgdorferi B31
ISEYSNSFSDV

SEQ ID NO: 2557 - protein, 11 aa, Borrelia burgdorferi B31
SEYSNSFSDVD

SEQ ID NO: 2558 - protein, 11 aa, Borrelia burgdorferi B31
EYSNSFSDVDI

SEQ ID NO: 2559 - protein, 11 aa, Borrelia burgdorferi B31
YSNSFSDVDIG

SEQ ID NO: 2560 - protein, 11 aa, Borrelia burgdorferi B31
SNSFSDVDIGR

SEQ ID NO: 2561 - protein, 11 aa, Borrelia burgdorferi B31
NSFSDVDIGRT

SEQ ID NO: 2562 - protein, 11 aa, Borrelia burgdorferi B31
SFSDVDIGRTI

SEQ ID NO: 2563 - protein, 11 aa, Borrelia burgdorferi B31
FSDVDIGRTIA

SEQ ID NO: 2564 - protein, 11 aa, Borrelia burgdorferi B31
SDVDIGRTIAS

SEQ ID NO: 2565 - protein, 11 aa, Borrelia burgdorferi B31
DVDIGRTIASK

SEQ ID NO: 2566 - protein, 11 aa, Borrelia burgdorferi B31
VDIGRTIASKM

SEQ ID NO: 2567 - protein, 11 aa, Borrelia burgdorferi B31
DIGRTIASKMY

SEQ ID NO: 2568 - protein, 11 aa, Borrelia burgdorferi B31
IGRTIASKMYS

SEQ ID NO: 2569 - protein, 11 aa, Borrelia burgdorferi B31
GRTIASKMYSK

SEQ ID NO: 2570 - protein, 11 aa, Borrelia burgdorferi B31
RTIASKMYSKG

SEQ ID NO: 2571 - protein, 11 aa, Borrelia burgdorferi B31
TIASKMYSKGI

SEQ ID NO: 2572 - protein, 11 aa, Borrelia burgdorferi B31
IASKMYSKGID

SEQ ID NO: 2573 - protein, 11 aa, Borrelia burgdorferi B31
ASKMYSKGIDV

SEQ ID NO: 2574 - protein, 11 aa, Borrelia burgdorferi B31
SKMYSKGIDVI

SEQ ID NO: 2575 - protein, 11 aa, Borrelia burgdorferi B31
KMYSKGIDVIH

SEQ ID NO: 2576 - protein, 11 aa, Borrelia burgdorferi B31
MYSKGIDVIHF

SEQ ID NO: 2577 - protein, 11 aa, Borrelia burgdorferi B31
YSKGIDVIHFA

SEQ ID NO: 2578 - protein, 11 aa, Borrelia burgdorferi B31
SKGIDVIHFAA

SEQ ID NO: 2579 - protein, 11 aa, Borrelia burgdorferi B31
KGIDVIHFAAG

SEQ ID NO: 2580 - protein, 11 aa, Borrelia burgdorferi B31
GIDVIHFAAGL

SEQ ID NO: 2581 - protein, 11 aa, Borrelia burgdorferi B31
IDVIHFAAGLA

SEQ ID NO: 2582 - protein, 11 aa, Borrelia burgdorferi B31
DVIHFAAGLAG

SEQ ID NO: 2583 - protein, 11 aa, Borrelia burgdorferi B31
VIHFAAGLAGI

SEQ ID NO: 2584 - protein, 11 aa, Borrelia burgdorferi B31
IHFAAGLAGIG

SEQ ID NO: 2585 - protein, 11 aa, Borrelia burgdorferi B31
HFAAGLAGIGV

SEQ ID NO: 2586 - protein, 11 aa, Borrelia burgdorferi B31
FAAGLAGIGVI

SEQ ID NO: 2587 - protein, 11 aa, Borrelia burgdorferi B31
AAGLAGIGVIE

SEQ ID NO: 2588 - protein, 11 aa, Borrelia burgdorferi B31
AGLAGIGVIET

SEQ ID NO: 2589 - protein, 11 aa, Borrelia burgdorferi B31
GLAGIGVIETA

SEQ ID NO: 2590 - protein, 11 aa, Borrelia burgdorferi B31
LAGIGVIETAK

SEQ ID NO: 2591 - protein, 11 aa, Borrelia burgdorferi B31
AGIGVIETAKN

SEQ ID NO: 2592 - protein, 11 aa, Borrelia burgdorferi B31
GIGVIETAKNL

SEQ ID NO: 2593 - protein, 11 aa, Borrelia burgdorferi B31
IGVIETAKNLG

SEQ ID NO: 2594 - protein, 11 aa, Borrelia burgdorferi B31
GVIETAKNLGD

SEQ ID NO: 2595 - protein, 11 aa, Borrelia burgdorferi B31
VIETAKNLGDG

SEQ ID NO: 2596 - protein, 11 aa, Borrelia burgdorferi B31
IETAKNLGDGY

SEQ ID NO: 2597 - protein, 11 aa, Borrelia burgdorferi B31
ETAKNLGDGYY

SEQ ID NO: 2598 - protein, 11 aa, Borrelia burgdorferi B31
TAKNLGDGYYV

SEQ ID NO: 2599 - protein, 11 aa, Borrelia burgdorferi B31
AKNLGDGYYVI

SEQ ID NO: 2600 - protein, 11 aa, Borrelia burgdorferi B31
KNLGDGYYVIG

SEQ ID NO: 2601 - protein, 11 aa, Borrelia burgdorferi B31
NLGDGYYVIGA

SEQ ID NO: 2602 - protein, 11 aa, Borrelia burgdorferi B31
LGDGYYVIGAD

SEQ ID NO: 2603 - protein, 11 aa, Borrelia burgdorferi B31
GDGYYVIGADQ

SEQ ID NO: 2604 - protein, 11 aa, Borrelia burgdorferi B31
DGYYVIGADQD

SEQ ID NO: 2605 - protein, 11 aa, Borrelia burgdorferi B31
GYYVIGADQDQ

SEQ ID NO: 2606 - protein, 11 aa, Borrelia burgdorferi B31
YYVIGADQDQS

SEQ ID NO: 2607 - protein, 11 aa, Borrelia burgdorferi B31
YVIGADQDQSY

SEQ ID NO: 2608 - protein, 11 aa, Borrelia burgdorferi B31
VIGADQDQSYL

SEQ ID NO: 2609 - protein, 11 aa, Borrelia burgdorferi B31
IGADQDQSYLA

SEQ ID NO: 2610 - protein, 11 aa, Borrelia burgdorferi B31
GADQDQSYLAP

SEQ ID NO: 2611 - protein, 11 aa, Borrelia burgdorferi B31
ADQDQSYLAPK

SEQ ID NO: 2612 - protein, 11 aa, Borrelia burgdorferi B31
DQDQSYLAPKN

SEQ ID NO: 2613 - protein, 11 aa, Borrelia burgdorferi B31
QDQSYLAPKNF

SEQ ID NO: 2614 - protein, 11 aa, Borrelia burgdorferi B31
DQSYLAPKNFI

SEQ ID NO: 2615 - protein, 11 aa, Borrelia burgdorferi B31
QSYLAPKNFIT

SEQ ID NO: 2616 - protein, 11 aa, Borrelia burgdorferi B31
SYLAPKNFITS

SEQ ID NO: 2617 - protein, 11 aa, Borrelia burgdorferi B31
YLAPKNFITSV

SEQ ID NO: 2618 - protein, 11 aa, Borrelia burgdorferi B31
LAPKNFITSVI

SEQ ID NO: 2619 - protein, 11 aa, Borrelia burgdorferi B31
APKNFITSVIK

SEQ ID NO: 2620 - protein, 11 aa, Borrelia burgdorferi B31
PKNFITSVIKN

SEQ ID NO: 2621 - protein, 11 aa, Borrelia burgdorferi B31
KNFITSVIKNI

SEQ ID NO: 2622 - protein, 11 aa, Borrelia burgdorferi B31
NFITSVIKNIG

SEQ ID NO: 2623 - protein, 11 aa, Borrelia burgdorferi B31
FITSVIKNIGD

SEQ ID NO: 2624 - protein, 11 aa, Borrelia burgdorferi B31
ITSVIKNIGDA

SEQ ID NO: 2625 - protein, 11 aa, Borrelia burgdorferi B31
TSVIKNIGDAL

SEQ ID NO: 2626 - protein, 11 aa, Borrelia burgdorferi B31
SVIKNIGDALY

SEQ ID NO: 2627 - protein, 11 aa, Borrelia burgdorferi B31
VIKNIGDALYL

SEQ ID NO: 2628 - protein, 11 aa, Borrelia burgdorferi B31
IKNIGDALYLI

SEQ ID NO: 2629 - protein, 11 aa, Borrelia burgdorferi B31
KNIGDALYLIT

SEQ ID NO: 2630 - protein, 11 aa, Borrelia burgdorferi B31
NIGDALYLITG

SEQ ID NO: 2631 - protein, 11 aa, Borrelia burgdorferi B31
IGDALYLITGE

SEQ ID NO: 2632 - protein, 11 aa, Borrelia burgdorferi B31
GDALYLITGEY

SEQ ID NO: 2633 - protein, 11 aa, Borrelia burgdorferi B31
DALYLITGEYI

SEQ ID NO: 2634 - protein, 11 aa, Borrelia burgdorferi B31
ALYLITGEYIK

SEQ ID NO: 2635 - protein, 11 aa, Borrelia burgdorferi B31
LYLITGEYIKN

SEQ ID NO: 2636 - protein, 11 aa, Borrelia burgdorferi B31
YLITGEYIKNN

SEQ ID NO: 2637 - protein, 11 aa, Borrelia burgdorferi B31
LITGEYIKNNN

SEQ ID NO: 2638 - protein, 11 aa, Borrelia burgdorferi B31
ITGEYIKNNNV

SEQ ID NO: 2639 - protein, 11 aa, Borrelia burgdorferi B31
TGEYIKNNNVW

SEQ ID NO: 2640 - protein, 11 aa, Borrelia burgdorferi B31
GEYIKNNNVWE

SEQ ID NO: 2641 - protein, 11 aa, Borrelia burgdorferi B31
EYIKNNNVWEG

SEQ ID NO: 2642 - protein, 11 aa, Borrelia burgdorferi B31
YIKNNNVWEGG

SEQ ID NO: 2643 - protein, 11 aa, Borrelia burgdorferi B31
IKNNNVWEGGK

SEQ ID NO: 2644 - protein, 11 aa, Borrelia burgdorferi B31
KNNNVWEGGKV

SEQ ID NO: 2645 - protein, 11 aa, Borrelia burgdorferi B31
NNNVWEGGKVV

SEQ ID NO: 2646 - protein, 11 aa, Borrelia burgdorferi B31
NNVWEGGKVVQ

SEQ ID NO: 2647 - protein, 11 aa, Borrelia burgdorferi B31
NVWEGGKVVQM

SEQ ID NO: 2648 - protein, 11 aa, Borrelia burgdorferi B31
VWEGGKVVQMG

SEQ ID NO: 2649 - protein, 11 aa, Borrelia burgdorferi B31
WEGGKVVQMGL

SEQ ID NO: 2650 - protein, 11 aa, Borrelia burgdorferi B31
EGGKVVQMGLR

SEQ ID NO: 2651 - protein, 11 aa, Borrelia burgdorferi B31
GGKVVQMGLRD

SEQ ID NO: 2652 - protein, 11 aa, Borrelia burgdorferi B31
GKVVQMGLRDG

SEQ ID NO: 2653 - protein, 11 aa, Borrelia burgdorferi B31
KVVQMGLRDGV

SEQ ID NO: 2654 - protein, 11 aa, Borrelia burgdorferi B31
VVQMGLRDGVI

SEQ ID NO: 2655 - protein, 11 aa, Borrelia burgdorferi B31
VQMGLRDGVIG

SEQ ID NO: 2656 - protein, 11 aa, Borrelia burgdorferi B31
QMGLRDGVIGL

SEQ ID NO: 2657 - protein, 11 aa, Borrelia burgdorferi B31
MGLRDGVIGLP

SEQ ID NO: 2658 - protein, 11 aa, Borrelia burgdorferi B31
GLRDGVIGLPN

SEQ ID NO: 2659 - protein, 11 aa, Borrelia burgdorferi B31
LRDGVIGLPNA

SEQ ID NO: 2660 - protein, 11 aa, Borrelia burgdorferi B31
RDGVIGLPNAN

SEQ ID NO: 2661 - protein, 11 aa, Borrelia burgdorferi B31
DGVIGLPNANE

SEQ ID NO: 2662 - protein, 11 aa, Borrelia burgdorferi B31
GVIGLPNANEF

SEQ ID NO: 2663 - protein, 11 aa, Borrelia burgdorferi B31
VIGLPNANEFE

SEQ ID NO: 2664 - protein, 11 aa, Borrelia burgdorferi B31
IGLPNANEFEY

SEQ ID NO: 2665 - protein, 11 aa, Borrelia burgdorferi B31
GLPNANEFEYI

SEQ ID NO: 2666 - protein, 11 aa, Borrelia burgdorferi B31
LPNANEFEYIK

SEQ ID NO: 2667 - protein, 11 aa, Borrelia burgdorferi B31
PNANEFEYIKV

SEQ ID NO: 2668 - protein, 11 aa, Borrelia burgdorferi B31
NANEFEYIKVL

SEQ ID NO: 2669 - protein, 11 aa, Borrelia burgdorferi B31
ANEFEYIKVLE

SEQ ID NO: 2670 - protein, 11 aa, Borrelia burgdorferi B31
NEFEYIKVLER

SEQ ID NO: 2671 - protein, 11 aa, Borrelia burgdorferi B31
EFEYIKVLERK

SEQ ID NO: 2672 - protein, 11 aa, Borrelia burgdorferi B31
FEYIKVLERKI

SEQ ID NO: 2673 - protein, 11 aa, Borrelia burgdorferi B31
EYIKVLERKII

SEQ ID NO: 2674 - protein, 11 aa, Borrelia burgdorferi B31
YIKVLERKIIN

SEQ ID NO: 2675 - protein, 11 aa, Borrelia burgdorferi B31
IKVLERKIINK

SEQ ID NO: 2676 - protein, 11 aa, Borrelia burgdorferi B31
KVLERKIINKE

SEQ ID NO: 2677 - protein, 11 aa, Borrelia burgdorferi B31
VLERKIINKEI

SEQ ID NO: 2678 - protein, 11 aa, Borrelia burgdorferi B31
LERKIINKEII

SEQ ID NO: 2679 - protein, 11 aa, Borrelia burgdorferi B31
ERKIINKEIIV

SEQ ID NO: 2680 - protein, 11 aa, Borrelia burgdorferi B31
RKIINKEIIVP

SEQ ID NO: 2681 - protein, 11 aa, Borrelia burgdorferi B31
KIINKEIIVPC

SEQ ID NO: 2682 - protein, 11 aa, Borrelia burgdorferi B31
IINKEIIVPCN

SEQ ID NO: 2683 - protein, 11 aa, Borrelia burgdorferi B31
INKEIIVPCNQ

SEQ ID NO: 2684 - protein, 11 aa, Borrelia burgdorferi B31
NKEIIVPCNQE

SEQ ID NO: 2685 - protein, 11 aa, Borrelia burgdorferi B31
KEIIVPCNQEE

SEQ ID NO: 2686 - protein, 11 aa, Borrelia burgdorferi B31
EIIVPCNQEEY

SEQ ID NO: 2687 - protein, 11 aa, Borrelia burgdorferi B31
IIVPCNQEEYE

SEQ ID NO: 2688 - protein, 11 aa, Borrelia burgdorferi B31
IVPCNQEEYEI

SEQ ID NO: 2689 - protein, 11 aa, Borrelia burgdorferi B31
VPCNQEEYEIF

SEQ ID NO: 2690 - protein, 11 aa, Borrelia burgdorferi B31
PCNQEEYEIFI

SEQ ID NO: 2691 - protein, 11 aa, Borrelia burgdorferi B31
CNQEEYEIFIK

SEQ ID NO: 2692 - protein, 11 aa, Borrelia burgdorferi B31
NQEEYEIFIKQ

SEQ ID NO: 2693 - protein, 11 aa, Borrelia burgdorferi B31
QEEYEIFIKQI

SEQ ID NO: 2694 - protein, 11 aa, Borrelia burgdorferi B31
EEYEIFIKQIL

SEQ ID NO: 2695 - protein, 11 aa, Borrelia burgdorferi B31
EYEIFIKQILK

SEQ ID NO: 2696 - protein, 11 aa, Borrelia burgdorferi B31
YEIFIKQILKL

SEQ ID NO: 2697 - protein, 8 aa, Borrelia burgdorferi B31
MFKRFIFI

SEQ ID NO: 2698 - protein, 8 aa, Borrelia burgdorferi B31
FKRFIFIT

SEQ ID NO: 2699 - protein, 8 aa, Borrelia burgdorferi B31
KRFIFITL

SEQ ID NO: 2700 - protein, 8 aa, Borrelia burgdorferi B31
RFIFITLS

SEQ ID NO: 2701 - protein, 8 aa, Borrelia burgdorferi B31
FIFITLSL

SEQ ID NO: 2702 - protein, 8 aa, Borrelia burgdorferi B31
IFITLSLL

SEQ ID NO: 2703 - protein, 8 aa, Borrelia burgdorferi B31
FITLSLLV

SEQ ID NO: 2704 - protein, 8 aa, Borrelia burgdorferi B31
ITLSLLVF

SEQ ID NO: 2705 - protein, 8 aa, Borrelia burgdorferi B31
TLSLLVFA

SEQ ID NO: 2706 - protein, 8 aa, Borrelia burgdorferi B31
LSLLVFAC

SEQ ID NO: 2707 - protein, 8 aa, Borrelia burgdorferi B31
SLLVFACF

SEQ ID NO: 2708 - protein, 8 aa, Borrelia burgdorferi B31
LLVFACFK

SEQ ID NO: 2709 - protein, 8 aa, Borrelia burgdorferi B31
LVFACFKS

SEQ ID NO: 2710 - protein, 8 aa, Borrelia burgdorferi B31
VFACFKSN

SEQ ID NO: 2711 - protein, 8 aa, Borrelia burgdorferi B31
FACFKSNK

SEQ ID NO: 2712 - protein, 8 aa, Borrelia burgdorferi B31
ACFKSNKK

SEQ ID NO: 2713 - protein, 8 aa, Borrelia burgdorferi B31
CFKSNKKS

SEQ ID NO: 2714 - protein, 8 aa, Borrelia burgdorferi B31
FKSNKKSI

SEQ ID NO: 2715 - protein, 8 aa, Borrelia burgdorferi B31
KSNKKSIK

SEQ ID NO: 2716 - protein, 8 aa, Borrelia burgdorferi B31
SNKKSIKS

SEQ ID NO: 2717 - protein, 8 aa, Borrelia burgdorferi B31
NKKSIKSD

SEQ ID NO: 2718 - protein, 8 aa, Borrelia burgdorferi B31
KKSIKSDK

SEQ ID NO: 2719 - protein, 8 aa, Borrelia burgdorferi B31
KSIKSDKV

SEQ ID NO: 2720 - protein, 8 aa, Borrelia burgdorferi B31
SIKSDKVV

SEQ ID NO: 2721 - protein, 8 aa, Borrelia burgdorferi B31
IKSDKVVV

SEQ ID NO: 2722 - protein, 8 aa, Borrelia burgdorferi B31
KSDKVVVG

SEQ ID NO: 2723 - protein, 8 aa, Borrelia burgdorferi B31
SDKVVVGV

SEQ ID NO: 2724 - protein, 8 aa, Borrelia burgdorferi B31
DKVVVGVL

SEQ ID NO: 2725 - protein, 8 aa, Borrelia burgdorferi B31
KVVVGVLA

SEQ ID NO: 2726 - protein, 8 aa, Borrelia burgdorferi B31
VVVGVLAH

SEQ ID NO: 2727 - protein, 8 aa, Borrelia burgdorferi B31
VVGVLAHG

SEQ ID NO: 2728 - protein, 8 aa, Borrelia burgdorferi B31
VGVLAHGS

SEQ ID NO: 2729 - protein, 8 aa, Borrelia burgdorferi B31
GVLAHGSF

SEQ ID NO: 2730 - protein, 8 aa, Borrelia burgdorferi B31
VLAHGSFY

SEQ ID NO: 2731 - protein, 8 aa, Borrelia burgdorferi B31
LAHGSFYD

SEQ ID NO: 2732 - protein, 8 aa, Borrelia burgdorferi B31
AHGSFYDK

SEQ ID NO: 2733 - protein, 8 aa, Borrelia burgdorferi B31
HGSFYDKG

SEQ ID NO: 2734 - protein, 8 aa, Borrelia burgdorferi B31
GSFYDKGY

SEQ ID NO: 2735 - protein, 8 aa, Borrelia burgdorferi B31
SFYDKGYN

SEQ ID NO: 2736 - protein, 8 aa, Borrelia burgdorferi B31
FYDKGYNQ

SEQ ID NO: 2737 - protein, 8 aa, Borrelia burgdorferi B31
YDKGYNQS

SEQ ID NO: 2738 - protein, 8 aa, Borrelia burgdorferi B31
DKGYNQSV

SEQ ID NO: 2739 - protein, 8 aa, Borrelia burgdorferi B31
KGYNQSVH

SEQ ID NO: 2740 - protein, 8 aa, Borrelia burgdorferi B31
GYNQSVHD

SEQ ID NO: 2741 - protein, 8 aa, Borrelia burgdorferi B31
YNQSVHDG

SEQ ID NO: 2742 - protein, 8 aa, Borrelia burgdorferi B31
NQSVHDGV

SEQ ID NO: 2743 - protein, 8 aa, Borrelia burgdorferi B31
QSVHDGVV

SEQ ID NO: 2744 - protein, 8 aa, Borrelia burgdorferi B31
SVHDGVVK

SEQ ID NO: 2745 - protein, 8 aa, Borrelia burgdorferi B31
VHDGVVKL

SEQ ID NO: 2746 - protein, 8 aa, Borrelia burgdorferi B31
HDGVVKLR

SEQ ID NO: 2747 - protein, 8 aa, Borrelia burgdorferi B31
DGVVKLRD

SEQ ID NO: 2748 - protein, 8 aa, Borrelia burgdorferi B31
GVVKLRDN

SEQ ID NO: 2749 - protein, 8 aa, Borrelia burgdorferi B31
VVKLRDNF

SEQ ID NO: 2750 - protein, 8 aa, Borrelia burgdorferi B31
VKLRDNFG

SEQ ID NO: 2751 - protein, 8 aa, Borrelia burgdorferi B31
KLRDNFGI

SEQ ID NO: 2752 - protein, 8 aa, Borrelia burgdorferi B31
LRDNFGIK

SEQ ID NO: 2753 - protein, 8 aa, Borrelia burgdorferi B31
RDNFGIKL

SEQ ID NO: 2754 - protein, 8 aa, Borrelia burgdorferi B31
DNFGIKLI

SEQ ID NO: 2755 - protein, 8 aa, Borrelia burgdorferi B31
NFGIKLIT

SEQ ID NO: 2756 - protein, 8 aa, Borrelia burgdorferi B31
FGIKLITK

SEQ ID NO: 2757 - protein, 8 aa, Borrelia burgdorferi B31
GIKLITKS

SEQ ID NO: 2758 - protein, 8 aa, Borrelia burgdorferi B31
IKLITKSL

SEQ ID NO: 2759 - protein, 8 aa, Borrelia burgdorferi B31
KLITKSLR

SEQ ID NO: 2760 - protein, 8 aa, Borrelia burgdorferi B31
LITKSLRP

SEQ ID NO: 2761 - protein, 8 aa, Borrelia burgdorferi B31
ITKSLRPY

SEQ ID NO: 2762 - protein, 8 aa, Borrelia burgdorferi B31
TKSLRPYP

SEQ ID NO: 2763 - protein, 8 aa, Borrelia burgdorferi B31
KSLRPYPI

SEQ ID NO: 2764 - protein, 8 aa, Borrelia burgdorferi B31
SLRPYPIE

SEQ ID NO: 2765 - protein, 8 aa, Borrelia burgdorferi B31
LRPYPIEG

SEQ ID NO: 2766 - protein, 8 aa, Borrelia burgdorferi B31
RPYPIEGK

SEQ ID NO: 2767 - protein, 8 aa, Borrelia burgdorferi B31
PYPIEGKR

SEQ ID NO: 2768 - protein, 8 aa, Borrelia burgdorferi B31
YPIEGKRL

SEQ ID NO: 2769 - protein, 8 aa, Borrelia burgdorferi B31
PIEGKRLL

SEQ ID NO: 2770 - protein, 8 aa, Borrelia burgdorferi B31
IEGKRLLT

SEQ ID NO: 2771 - protein, 8 aa, Borrelia burgdorferi B31
EGKRLLTV

SEQ ID NO: 2772 - protein, 8 aa, Borrelia burgdorferi B31
GKRLLTVD

SEQ ID NO: 2773 - protein, 8 aa, Borrelia burgdorferi B31
KRLLTVDE

SEQ ID NO: 2774 - protein, 8 aa, Borrelia burgdorferi B31
RLLTVDEA

SEQ ID NO: 2775 - protein, 8 aa, Borrelia burgdorferi B31
LLTVDEAM

SEQ ID NO: 2776 - protein, 8 aa, Borrelia burgdorferi B31
LTVDEAMT

SEQ ID NO: 2777 - protein, 8 aa, Borrelia burgdorferi B31
TVDEAMTE

SEQ ID NO: 2778 - protein, 8 aa, Borrelia burgdorferi B31
VDEAMTED

SEQ ID NO: 2779 - protein, 8 aa, Borrelia burgdorferi B31
DEAMTEDA

SEQ ID NO: 2780 - protein, 8 aa, Borrelia burgdorferi B31
EAMTEDAY

SEQ ID NO: 2781 - protein, 8 aa, Borrelia burgdorferi B31
AMTEDAYE

SEQ ID NO: 2782 - protein, 8 aa, Borrelia burgdorferi B31
MTEDAYEV

SEQ ID NO: 2783 - protein, 8 aa, Borrelia burgdorferi B31
TEDAYEVQ

SEQ ID NO: 2784 - protein, 8 aa, Borrelia burgdorferi B31
EDAYEVQK

SEQ ID NO: 2785 - protein, 8 aa, Borrelia burgdorferi B31
DAYEVQKN

SEQ ID NO: 2786 - protein, 8 aa, Borrelia burgdorferi B31
AYEVQKNP

SEQ ID NO: 2787 - protein, 8 aa, Borrelia burgdorferi B31
YEVQKNPL

SEQ ID NO: 2788 - protein, 8 aa, Borrelia burgdorferi B31
EVQKNPLN

SEQ ID NO: 2789 - protein, 8 aa, Borrelia burgdorferi B31
VQKNPLNL

SEQ ID NO: 2790 - protein, 8 aa, Borrelia burgdorferi B31
QKNPLNLF

SEQ ID NO: 2791 - protein, 8 aa, Borrelia burgdorferi B31
KNPLNLFW

SEQ ID NO: 2792 - protein, 8 aa, Borrelia burgdorferi B31
NPLNLFWL

SEQ ID NO: 2793 - protein, 8 aa, Borrelia burgdorferi B31
PLNLFWLI

SEQ ID NO: 2794 - protein, 8 aa, Borrelia burgdorferi B31
LNLFWLIG

SEQ ID NO: 2795 - protein, 8 aa, Borrelia burgdorferi B31
NLFWLIGY

SEQ ID NO: 2796 - protein, 8 aa, Borrelia burgdorferi B31
LFWLIGYR

SEQ ID NO: 2797 - protein, 8 aa, Borrelia burgdorferi B31
FWLIGYRF

SEQ ID NO: 2798 - protein, 8 aa, Borrelia burgdorferi B31
WLIGYRFS

SEQ ID NO: 2799 - protein, 8 aa, Borrelia burgdorferi B31
LIGYRFSD

SEQ ID NO: 2800 - protein, 8 aa, Borrelia burgdorferi B31
IGYRFSDL

SEQ ID NO: 2801 - protein, 8 aa, Borrelia burgdorferi B31
GYRFSDLS

SEQ ID NO: 2802 - protein, 8 aa, Borrelia burgdorferi B31
YRFSDLSV

SEQ ID NO: 2803 - protein, 8 aa, Borrelia burgdorferi B31
RFSDLSVK

SEQ ID NO: 2804 - protein, 8 aa, Borrelia burgdorferi B31
FSDLSVKL

SEQ ID NO: 2805 - protein, 8 aa, Borrelia burgdorferi B31
SDLSVKLS

SEQ ID NO: 2806 - protein, 8 aa, Borrelia burgdorferi B31
DLSVKLSY

SEQ ID NO: 2807 - protein, 8 aa, Borrelia burgdorferi B31
LSVKLSYE

SEQ ID NO: 2808 - protein, 8 aa, Borrelia burgdorferi B31
SVKLSYER

SEQ ID NO: 2809 - protein, 8 aa, Borrelia burgdorferi B31
VKLSYERP

SEQ ID NO: 2810 - protein, 8 aa, Borrelia burgdorferi B31
KLSYERPD

SEQ ID NO: 2811 - protein, 8 aa, Borrelia burgdorferi B31
LSYERPDI

SEQ ID NO: 2812 - protein, 8 aa, Borrelia burgdorferi B31
SYERPDIY

SEQ ID NO: 2813 - protein, 8 aa, Borrelia burgdorferi B31
YERPDIYY

SEQ ID NO: 2814 - protein, 8 aa, Borrelia burgdorferi B31
ERPDIYYG

SEQ ID NO: 2815 - protein, 8 aa, Borrelia burgdorferi B31
RPDIYYGI

SEQ ID NO: 2816 - protein, 8 aa, Borrelia burgdorferi B31
PDIYYGII

SEQ ID NO: 2817 - protein, 8 aa, Borrelia burgdorferi B31
DIYYGIID

SEQ ID NO: 2818 - protein, 8 aa, Borrelia burgdorferi B31
IYYGIIDA

SEQ ID NO: 2819 - protein, 8 aa, Borrelia burgdorferi B31
YYGIIDAF

SEQ ID NO: 2820 - protein, 8 aa, Borrelia burgdorferi B31
YGIIDAFD

SEQ ID NO: 2821 - protein, 8 aa, Borrelia burgdorferi B31
GIIDAFDY

SEQ ID NO: 2822 - protein, 8 aa, Borrelia burgdorferi B31
IIDAFDYG

SEQ ID NO: 2823 - protein, 8 aa, Borrelia burgdorferi B31
IDAFDYGD

SEQ ID NO: 2824 - protein, 8 aa, Borrelia burgdorferi B31
DAFDYGDI

SEQ ID NO: 2825 - protein, 8 aa, Borrelia burgdorferi B31
AFDYGDIQ

SEQ ID NO: 2826 - protein, 8 aa, Borrelia burgdorferi B31
FDYGDIQV

SEQ ID NO: 2827 - protein, 8 aa, Borrelia burgdorferi B31
DYGDIQVP

SEQ ID NO: 2828 - protein, 8 aa, Borrelia burgdorferi B31
YGDIQVPK

SEQ ID NO: 2829 - protein, 8 aa, Borrelia burgdorferi B31
GDIQVPKN

SEQ ID NO: 2830 - protein, 8 aa, Borrelia burgdorferi B31
DIQVPKNS

SEQ ID NO: 2831 - protein, 8 aa, Borrelia burgdorferi B31
IQVPKNSL

SEQ ID NO: 2832 - protein, 8 aa, Borrelia burgdorferi B31
QVPKNSLA

SEQ ID NO: 2833 - protein, 8 aa, Borrelia burgdorferi B31
VPKNSLAI

SEQ ID NO: 2834 - protein, 8 aa, Borrelia burgdorferi B31
PKNSLAIK

SEQ ID NO: 2835 - protein, 8 aa, Borrelia burgdorferi B31
KNSLAIKF

SEQ ID NO: 2836 - protein, 8 aa, Borrelia burgdorferi B31
NSLAIKFR

SEQ ID NO: 2837 - protein, 8 aa, Borrelia burgdorferi B31
SLAIKFRN

SEQ ID NO: 2838 - protein, 8 aa, Borrelia burgdorferi B31
LAIKFRNE

SEQ ID NO: 2839 - protein, 8 aa, Borrelia burgdorferi B31
AIKFRNEE

SEQ ID NO: 2840 - protein, 8 aa, Borrelia burgdorferi B31
IKFRNEEA

SEQ ID NO: 2841 - protein, 8 aa, Borrelia burgdorferi B31
KFRNEEAA

SEQ ID NO: 2842 - protein, 8 aa, Borrelia burgdorferi B31
FRNEEAAF

SEQ ID NO: 2843 - protein, 8 aa, Borrelia burgdorferi B31
RNEEAAFL

SEQ ID NO: 2844 - protein, 8 aa, Borrelia burgdorferi B31
NEEAAFLA

SEQ ID NO: 2845 - protein, 8 aa, Borrelia burgdorferi B31
EEAAFLAG

SEQ ID NO: 2846 - protein, 8 aa, Borrelia burgdorferi B31
EAAFLAGY

SEQ ID NO: 2847 - protein, 8 aa, Borrelia burgdorferi B31
AAFLAGYI

SEQ ID NO: 2848 - protein, 8 aa, Borrelia burgdorferi B31
AFLAGYIA

SEQ ID NO: 2849 - protein, 8 aa, Borrelia burgdorferi B31
FLAGYIAA

SEQ ID NO: 2850 - protein, 8 aa, Borrelia burgdorferi B31
LAGYIAAK

SEQ ID NO: 2851 - protein, 8 aa, Borrelia burgdorferi B31
AGYIAAKM

SEQ ID NO: 2852 - protein, 8 aa, Borrelia burgdorferi B31
GYIAAKMS

SEQ ID NO: 2853 - protein, 8 aa, Borrelia burgdorferi B31
YIAAKMSR

SEQ ID NO: 2854 - protein, 8 aa, Borrelia burgdorferi B31
IAAKMSRK

SEQ ID NO: 2855 - protein, 8 aa, Borrelia burgdorferi B31
AAKMSRKE

SEQ ID NO: 2856 - protein, 8 aa, Borrelia burgdorferi B31
AKMSRKEK

SEQ ID NO: 2857 - protein, 8 aa, Borrelia burgdorferi B31
KMSRKEKI

SEQ ID NO: 2858 - protein, 8 aa, Borrelia burgdorferi B31
MSRKEKIG

SEQ ID NO: 2859 - protein, 8 aa, Borrelia burgdorferi B31
SRKEKIGF

SEQ ID NO: 2860 - protein, 8 aa, Borrelia burgdorferi B31
RKEKIGFL

SEQ ID NO: 2861 - protein, 8 aa, Borrelia burgdorferi B31
KEKIGFLT

SEQ ID NO: 2862 - protein, 8 aa, Borrelia burgdorferi B31
EKIGFLTG

SEQ ID NO: 2863 - protein, 8 aa, Borrelia burgdorferi B31
KIGFLTGP

SEQ ID NO: 2864 - protein, 8 aa, Borrelia burgdorferi B31
IGFLTGPM

SEQ ID NO: 2865 - protein, 8 aa, Borrelia burgdorferi B31
GFLTGPMS

SEQ ID NO: 2866 - protein, 8 aa, Borrelia burgdorferi B31
FLTGPMSE

SEQ ID NO: 2867 - protein, 8 aa, Borrelia burgdorferi B31
LTGPMSEH

SEQ ID NO: 2868 - protein, 8 aa, Borrelia burgdorferi B31
TGPMSEHV

SEQ ID NO: 2869 - protein, 8 aa, Borrelia burgdorferi B31
GPMSEHVK

SEQ ID NO: 2870 - protein, 8 aa, Borrelia burgdorferi B31
PMSEHVKD

SEQ ID NO: 2871 - protein, 8 aa, Borrelia burgdorferi B31
MSEHVKDF

SEQ ID NO: 2872 - protein, 8 aa, Borrelia burgdorferi B31
SEHVKDFK

SEQ ID NO: 2873 - protein, 8 aa, Borrelia burgdorferi B31
EHVKDFKF

SEQ ID NO: 2874 - protein, 8 aa, Borrelia burgdorferi B31
HVKDFKFG

SEQ ID NO: 2875 - protein, 8 aa, Borrelia burgdorferi B31
VKDFKFGF

SEQ ID NO: 2876 - protein, 8 aa, Borrelia burgdorferi B31
KDFKFGFK

SEQ ID NO: 2877 - protein, 8 aa, Borrelia burgdorferi B31
DFKFGFKA

SEQ ID NO: 2878 - protein, 8 aa, Borrelia burgdorferi B31
FKFGFKAG

SEQ ID NO: 2879 - protein, 8 aa, Borrelia burgdorferi B31
KFGFKAGI

SEQ ID NO: 2880 - protein, 8 aa, Borrelia burgdorferi B31
FGFKAGIF

SEQ ID NO: 2881 - protein, 8 aa, Borrelia burgdorferi B31
GFKAGIFY

SEQ ID NO: 2882 - protein, 8 aa, Borrelia burgdorferi B31
FKAGIFYA

SEQ ID NO: 2883 - protein, 8 aa, Borrelia burgdorferi B31
KAGIFYAN

SEQ ID NO: 2884 - protein, 8 aa, Borrelia burgdorferi B31
AGIFYANP

SEQ ID NO: 2885 - protein, 8 aa, Borrelia burgdorferi B31
GIFYANPK

SEQ ID NO: 2886 - protein, 8 aa, Borrelia burgdorferi B31
IFYANPKL

SEQ ID NO: 2887 - protein, 8 aa, Borrelia burgdorferi B31
FYANPKLR

SEQ ID NO: 2888 - protein, 8 aa, Borrelia burgdorferi B31
YANPKLRL

SEQ ID NO: 2889 - protein, 8 aa, Borrelia burgdorferi B31
ANPKLRLV

SEQ ID NO: 2890 - protein, 8 aa, Borrelia burgdorferi B31
NPKLRLVS

SEQ ID NO: 2891 - protein, 8 aa, Borrelia burgdorferi B31
PKLRLVSK

SEQ ID NO: 2892 - protein, 8 aa, Borrelia burgdorferi B31
KLRLVSKK

SEQ ID NO: 2893 - protein, 8 aa, Borrelia burgdorferi B31
LRLVSKKA

SEQ ID NO: 2894 - protein, 8 aa, Borrelia burgdorferi B31
RLVSKKAP

SEQ ID NO: 2895 - protein, 8 aa, Borrelia burgdorferi B31
LVSKKAPS

SEQ ID NO: 2896 - protein, 8 aa, Borrelia burgdorferi B31
VSKKAPSL

SEQ ID NO: 2897 - protein, 8 aa, Borrelia burgdorferi B31
SKKAPSLF

SEQ ID NO: 2898 - protein, 8 aa, Borrelia burgdorferi B31
KKAPSLFD

SEQ ID NO: 2899 - protein, 8 aa, Borrelia burgdorferi B31
KAPSLFDK

SEQ ID NO: 2900 - protein, 8 aa, Borrelia burgdorferi B31
APSLFDKE

SEQ ID NO: 2901 - protein, 8 aa, Borrelia burgdorferi B31
PSLFDKEK

SEQ ID NO: 2902 - protein, 8 aa, Borrelia burgdorferi B31
SLFDKEKG

SEQ ID NO: 2903 - protein, 8 aa, Borrelia burgdorferi B31
LFDKEKGK

SEQ ID NO: 2904 - protein, 8 aa, Borrelia burgdorferi B31
FDKEKGKA

SEQ ID NO: 2905 - protein, 8 aa, Borrelia burgdorferi B31
DKEKGKAM

SEQ ID NO: 2906 - protein, 8 aa, Borrelia burgdorferi B31
KEKGKAMA

SEQ ID NO: 2907 - protein, 8 aa, Borrelia burgdorferi B31
EKGKAMAL

SEQ ID NO: 2908 - protein, 8 aa, Borrelia burgdorferi B31
KGKAMALF

SEQ ID NO: 2909 - protein, 8 aa, Borrelia burgdorferi B31
GKAMALFM

SEQ ID NO: 2910 - protein, 8 aa, Borrelia burgdorferi B31
KAMALFMY

SEQ ID NO: 2911 - protein, 8 aa, Borrelia burgdorferi B31
AMALFMYK

SEQ ID NO: 2912 - protein, 8 aa, Borrelia burgdorferi B31
MALFMYKE

SEQ ID NO: 2913 - protein, 8 aa, Borrelia burgdorferi B31
ALFMYKED

SEQ ID NO: 2914 - protein, 8 aa, Borrelia burgdorferi B31
LFMYKEDK

SEQ ID NO: 2915 - protein, 8 aa, Borrelia burgdorferi B31
FMYKEDKV

SEQ ID NO: 2916 - protein, 8 aa, Borrelia burgdorferi B31
MYKEDKVG

SEQ ID NO: 2917 - protein, 8 aa, Borrelia burgdorferi B31
YKEDKVGV

SEQ ID NO: 2918 - protein, 8 aa, Borrelia burgdorferi B31
KEDKVGVI

SEQ ID NO: 2919 - protein, 8 aa, Borrelia burgdorferi B31
EDKVGVIF

SEQ ID NO: 2920 - protein, 8 aa, Borrelia burgdorferi B31
DKVGVIFP

SEQ ID NO: 2921 - protein, 8 aa, Borrelia burgdorferi B31
KVGVIFPI

SEQ ID NO: 2922 - protein, 8 aa, Borrelia burgdorferi B31
VGVIFPIA

SEQ ID NO: 2923 - protein, 8 aa, Borrelia burgdorferi B31
GVIFPIAG

SEQ ID NO: 2924 - protein, 8 aa, Borrelia burgdorferi B31
VIFPIAGI

SEQ ID NO: 2925 - protein, 8 aa, Borrelia burgdorferi B31
IFPIAGIT

SEQ ID NO: 2926 - protein, 8 aa, Borrelia burgdorferi B31
FPIAGITG

SEQ ID NO: 2927 - protein, 8 aa, Borrelia burgdorferi B31
PIAGITGL

SEQ ID NO: 2928 - protein, 8 aa, Borrelia burgdorferi B31
IAGITGLG

SEQ ID NO: 2929 - protein, 8 aa, Borrelia burgdorferi B31
AGITGLGV

SEQ ID NO: 2930 - protein, 8 aa, Borrelia burgdorferi B31
GITGLGVY

SEQ ID NO: 2931 - protein, 8 aa, Borrelia burgdorferi B31
ITGLGVYD

SEQ ID NO: 2932 - protein, 8 aa, Borrelia burgdorferi B31
TGLGVYDA

SEQ ID NO: 2933 - protein, 8 aa, Borrelia burgdorferi B31
GLGVYDAA

SEQ ID NO: 2934 - protein, 8 aa, Borrelia burgdorferi B31
LGVYDAAK

SEQ ID NO: 2935 - protein, 8 aa, Borrelia burgdorferi B31
GVYDAAKE

SEQ ID NO: 2936 - protein, 8 aa, Borrelia burgdorferi B31
VYDAAKEL

SEQ ID NO: 2937 - protein, 8 aa, Borrelia burgdorferi B31
YDAAKELG

SEQ ID NO: 2938 - protein, 8 aa, Borrelia burgdorferi B31
DAAKELGP

SEQ ID NO: 2939 - protein, 8 aa, Borrelia burgdorferi B31
AAKELGPK

SEQ ID NO: 2940 - protein, 8 aa, Borrelia burgdorferi B31
AKELGPKY

SEQ ID NO: 2941 - protein, 8 aa, Borrelia burgdorferi B31
KELGPKYY

SEQ ID NO: 2942 - protein, 8 aa, Borrelia burgdorferi B31
ELGPKYYV

SEQ ID NO: 2943 - protein, 8 aa, Borrelia burgdorferi B31
LGPKYYVI

SEQ ID NO: 2944 - protein, 8 aa, Borrelia burgdorferi B31
GPKYYVIG

SEQ ID NO: 2945 - protein, 8 aa, Borrelia burgdorferi B31
PKYYVIGL

SEQ ID NO: 2946 - protein, 8 aa, Borrelia burgdorferi B31
KYYVIGLN

SEQ ID NO: 2947 - protein, 8 aa, Borrelia burgdorferi B31
YYVIGLNQ

SEQ ID NO: 2948 - protein, 8 aa, Borrelia burgdorferi B31
YVIGLNQD

SEQ ID NO: 2949 - protein, 8 aa, Borrelia burgdorferi B31
VIGLNQDQ

SEQ ID NO: 2950 - protein, 8 aa, Borrelia burgdorferi B31
IGLNQDQS

SEQ ID NO: 2951 - protein, 8 aa, Borrelia burgdorferi B31
GLNQDQSY

SEQ ID NO: 2952 - protein, 8 aa, Borrelia burgdorferi B31
LNQDQSYI

SEQ ID NO: 2953 - protein, 8 aa, Borrelia burgdorferi B31
NQDQSYIA

SEQ ID NO: 2954 - protein, 8 aa, Borrelia burgdorferi B31
QDQSYIAP

SEQ ID NO: 2955 - protein, 8 aa, Borrelia burgdorferi B31
DQSYIAPQ

SEQ ID NO: 2956 - protein, 8 aa, Borrelia burgdorferi B31
QSYIAPQN

SEQ ID NO: 2957 - protein, 8 aa, Borrelia burgdorferi B31
SYIAPQNV

SEQ ID NO: 2958 - protein, 8 aa, Borrelia burgdorferi B31
YIAPQNVI

SEQ ID NO: 2959 - protein, 8 aa, Borrelia burgdorferi B31
IAPQNVIT

SEQ ID NO: 2960 - protein, 8 aa, Borrelia burgdorferi B31
APQNVITS

SEQ ID NO: 2961 - protein, 8 aa, Borrelia burgdorferi B31
PQNVITSI

SEQ ID NO: 2962 - protein, 8 aa, Borrelia burgdorferi B31
QNVITSII

SEQ ID NO: 2963 - protein, 8 aa, Borrelia burgdorferi B31
NVITSIIK

SEQ ID NO: 2964 - protein, 8 aa, Borrelia burgdorferi B31
VITSIIKD

SEQ ID NO: 2965 - protein, 8 aa, Borrelia burgdorferi B31
ITSIIKDI

SEQ ID NO: 2966 - protein, 8 aa, Borrelia burgdorferi B31
TSIIKDIG

SEQ ID NO: 2967 - protein, 8 aa, Borrelia burgdorferi B31
SIIKDIGK

SEQ ID NO: 2968 - protein, 8 aa, Borrelia burgdorferi B31
IIKDIGKV

SEQ ID NO: 2969 - protein, 8 aa, Borrelia burgdorferi B31
IKDIGKVI

SEQ ID NO: 2970 - protein, 8 aa, Borrelia burgdorferi B31
KDIGKVIY

SEQ ID NO: 2971 - protein, 8 aa, Borrelia burgdorferi B31
DIGKVIYS

SEQ ID NO: 2972 - protein, 8 aa, Borrelia burgdorferi B31
IGKVIYSI

SEQ ID NO: 2973 - protein, 8 aa, Borrelia burgdorferi B31
GKVIYSIS

SEQ ID NO: 2974 - protein, 8 aa, Borrelia burgdorferi B31
KVIYSISS

SEQ ID NO: 2975 - protein, 8 aa, Borrelia burgdorferi B31
VIYSISSE

SEQ ID NO: 2976 - protein, 8 aa, Borrelia burgdorferi B31
IYSISSEY

SEQ ID NO: 2977 - protein, 8 aa, Borrelia burgdorferi B31
YSISSEYI

SEQ ID NO: 2978 - protein, 8 aa, Borrelia burgdorferi B31
SISSEYIN

SEQ ID NO: 2979 - protein, 8 aa, Borrelia burgdorferi B31
ISSEYINN

SEQ ID NO: 2980 - protein, 8 aa, Borrelia burgdorferi B31
SSEYINNR

SEQ ID NO: 2981 - protein, 8 aa, Borrelia burgdorferi B31
SEYINNRV

SEQ ID NO: 2982 - protein, 8 aa, Borrelia burgdorferi B31
EYINNRVF

SEQ ID NO: 2983 - protein, 8 aa, Borrelia burgdorferi B31
YINNRVFK

SEQ ID NO: 2984 - protein, 8 aa, Borrelia burgdorferi B31
INNRVFKG

SEQ ID NO: 2985 - protein, 8 aa, Borrelia burgdorferi B31
NNRVFKGG

SEQ ID NO: 2986 - protein, 8 aa, Borrelia burgdorferi B31
NRVFKGGI

SEQ ID NO: 2987 - protein, 8 aa, Borrelia burgdorferi B31
RVFKGGII

SEQ ID NO: 2988 - protein, 8 aa, Borrelia burgdorferi B31
VFKGGIII

SEQ ID NO: 2989 - protein, 8 aa, Borrelia burgdorferi B31
FKGGIIID

SEQ ID NO: 2990 - protein, 8 aa, Borrelia burgdorferi B31
KGGIIIDR

SEQ ID NO: 2991 - protein, 8 aa, Borrelia burgdorferi B31
GGIIIDRG

SEQ ID NO: 2992 - protein, 8 aa, Borrelia burgdorferi B31
GIIIDRGL

SEQ ID NO: 2993 - protein, 8 aa, Borrelia burgdorferi B31
IIIDRGLK

SEQ ID NO: 2994 - protein, 8 aa, Borrelia burgdorferi B31
IIDRGLKE

SEQ ID NO: 2995 - protein, 8 aa, Borrelia burgdorferi B31
IDRGLKEG

SEQ ID NO: 2996 - protein, 8 aa, Borrelia burgdorferi B31
DRGLKEGV

SEQ ID NO: 2997 - protein, 8 aa, Borrelia burgdorferi B31
RGLKEGVI

SEQ ID NO: 2998 - protein, 8 aa, Borrelia burgdorferi B31
GLKEGVIE

SEQ ID NO: 2999 - protein, 8 aa, Borrelia burgdorferi B31
LKEGVIEI

SEQ ID NO: 3000 - protein, 8 aa, Borrelia burgdorferi B31
KEGVIEIV

SEQ ID NO: 3001 - protein, 8 aa, Borrelia burgdorferi B31
EGVIEIVK

SEQ ID NO: 3002 - protein, 8 aa, Borrelia burgdorferi B31
GVIEIVKD

SEQ ID NO: 3003 - protein, 8 aa, Borrelia burgdorferi B31
VIEIVKDP

SEQ ID NO: 3004 - protein, 8 aa, Borrelia burgdorferi B31
IEIVKDPD

SEQ ID NO: 3005 - protein, 8 aa, Borrelia burgdorferi B31
EIVKDPDV

SEQ ID NO: 3006 - protein, 8 aa, Borrelia burgdorferi B31
IVKDPDVL

SEQ ID NO: 3007 - protein, 8 aa, Borrelia burgdorferi B31
VKDPDVLN

SEQ ID NO: 3008 - protein, 8 aa, Borrelia burgdorferi B31
KDPDVLNN

SEQ ID NO: 3009 - protein, 8 aa, Borrelia burgdorferi B31
DPDVLNNR

SEQ ID NO: 3010 - protein, 8 aa, Borrelia burgdorferi B31
PDVLNNRL

SEQ ID NO: 3011 - protein, 8 aa, Borrelia burgdorferi B31
DVLNNRLV

SEQ ID NO: 3012 - protein, 8 aa, Borrelia burgdorferi B31
VLNNRLVD

SEQ ID NO: 3013 - protein, 8 aa, Borrelia burgdorferi B31
LNNRLVDE

SEQ ID NO: 3014 - protein, 8 aa, Borrelia burgdorferi B31
NNRLVDEV

SEQ ID NO: 3015 - protein, 8 aa, Borrelia burgdorferi B31
NRLVDEVI

SEQ ID NO: 3016 - protein, 8 aa, Borrelia burgdorferi B31
RLVDEVID

SEQ ID NO: 3017 - protein, 8 aa, Borrelia burgdorferi B31
LVDEVIDL

SEQ ID NO: 3018 - protein, 8 aa, Borrelia burgdorferi B31
VDEVIDLE

SEQ ID NO: 3019 - protein, 8 aa, Borrelia burgdorferi B31
DEVIDLEN

SEQ ID NO: 3020 - protein, 8 aa, Borrelia burgdorferi B31
EVIDLENK

SEQ ID NO: 3021 - protein, 8 aa, Borrelia burgdorferi B31
VIDLENKI

SEQ ID NO: 3022 - protein, 8 aa, Borrelia burgdorferi B31
IDLENKII

SEQ ID NO: 3023 - protein, 8 aa, Borrelia burgdorferi B31
DLENKIIS

SEQ ID NO: 3024 - protein, 8 aa, Borrelia burgdorferi B31
LENKIISG

SEQ ID NO: 3025 - protein, 8 aa, Borrelia burgdorferi B31
ENKIISGE

SEQ ID NO: 3026 - protein, 8 aa, Borrelia burgdorferi B31
NKIISGEI

SEQ ID NO: 3027 - protein, 8 aa, Borrelia burgdorferi B31
KIISGEII

SEQ ID NO: 3028 - protein, 8 aa, Borrelia burgdorferi B31
IISGEIIV

SEQ ID NO: 3029 - protein, 8 aa, Borrelia burgdorferi B31
ISGEIIVP

SEQ ID NO: 3030 - protein, 8 aa, Borrelia burgdorferi B31
SGEIIVPD

SEQ ID NO: 3031 - protein, 8 aa, Borrelia burgdorferi B31
GEIIVPDS

SEQ ID NO: 3032 - protein, 8 aa, Borrelia burgdorferi B31
EIIVPDSE

SEQ ID NO: 3033 - protein, 8 aa, Borrelia burgdorferi B31
IIVPDSEY

SEQ ID NO: 3034 - protein, 8 aa, Borrelia burgdorferi B31
IVPDSEYA

SEQ ID NO: 3035 - protein, 8 aa, Borrelia burgdorferi B31
VPDSEYAF

SEQ ID NO: 3036 - protein, 8 aa, Borrelia burgdorferi B31
PDSEYAFD

SEQ ID NO: 3037 - protein, 8 aa, Borrelia burgdorferi B31
DSEYAFDL

SEQ ID NO: 3038 - protein, 8 aa, Borrelia burgdorferi B31
SEYAFDLF

SEQ ID NO: 3039 - protein, 8 aa, Borrelia burgdorferi B31
EYAFDLFK

SEQ ID NO: 3040 - protein, 8 aa, Borrelia burgdorferi B31
YAFDLFKS

SEQ ID NO: 3041 - protein, 8 aa, Borrelia burgdorferi B31
AFDLFKSK

SEQ ID NO: 3042 - protein, 8 aa, Borrelia burgdorferi B31
FDLFKSKL

SEQ ID NO: 3043 - protein, 9 aa, Borrelia burgdorferi B31
MFKRFIFIT

SEQ ID NO: 3044 - protein, 9 aa, Borrelia burgdorferi B31
FKRFIFITL

SEQ ID NO: 3045 - protein, 9 aa, Borrelia burgdorferi B31
KRFIFITLS

SEQ ID NO: 3046 - protein, 9 aa, Borrelia burgdorferi B31
RFIFITLSL

SEQ ID NO: 3047 - protein, 9 aa, Borrelia burgdorferi B31
FIFITLSLL

SEQ ID NO: 3048 - protein, 9 aa, Borrelia burgdorferi B31
IFITLSLLV

SEQ ID NO: 3049 - protein, 9 aa, Borrelia burgdorferi B31
FITLSLLVF

SEQ ID NO: 3050 - protein, 9 aa, Borrelia burgdorferi B31
ITLSLLVFA

SEQ ID NO: 3051 - protein, 9 aa, Borrelia burgdorferi B31
TLSLLVFAC

SEQ ID NO: 3052 - protein, 9 aa, Borrelia burgdorferi B31
LSLLVFACF

SEQ ID NO: 3053 - protein, 9 aa, Borrelia burgdorferi B31
SLLVFACFK

SEQ ID NO: 3054 - protein, 9 aa, Borrelia burgdorferi B31
LLVFACFKS

SEQ ID NO: 3055 - protein, 9 aa, Borrelia burgdorferi B31
LVFACFKSN

SEQ ID NO: 3056 - protein, 9 aa, Borrelia burgdorferi B31
VFACFKSNK

SEQ ID NO: 3057 - protein, 9 aa, Borrelia burgdorferi B31
FACFKSNKK

SEQ ID NO: 3058 - protein, 9 aa, Borrelia burgdorferi B31
ACFKSNKKS

SEQ ID NO: 3059 - protein, 9 aa, Borrelia burgdorferi B31
CFKSNKKSI

SEQ ID NO: 3060 - protein, 9 aa, Borrelia burgdorferi B31
FKSNKKSIK

SEQ ID NO: 3061 - protein, 9 aa, Borrelia burgdorferi B31
KSNKKSIKS

SEQ ID NO: 3062 - protein, 9 aa, Borrelia burgdorferi B31
SNKKSIKSD

SEQ ID NO: 3063 - protein, 9 aa, Borrelia burgdorferi B31
NKKSIKSDK

SEQ ID NO: 3064 - protein, 9 aa, Borrelia burgdorferi B31
KKSIKSDKV

SEQ ID NO: 3065 - protein, 9 aa, Borrelia burgdorferi B31
KSIKSDKVV

SEQ ID NO: 3066 - protein, 9 aa, Borrelia burgdorferi B31
SIKSDKVVV

SEQ ID NO: 3067 - protein, 9 aa, Borrelia burgdorferi B31
IKSDKVVVG

SEQ ID NO: 3068 - protein, 9 aa, Borrelia burgdorferi B31
KSDKVVVGV

SEQ ID NO: 3069 - protein, 9 aa, Borrelia burgdorferi B31
SDKVVVGVL

SEQ ID NO: 3070 - protein, 9 aa, Borrelia burgdorferi B31
DKVVVGVLA

SEQ ID NO: 3071 - protein, 9 aa, Borrelia burgdorferi B31
KVVVGVLAH

SEQ ID NO: 3072 - protein, 9 aa, Borrelia burgdorferi B31
VVVGVLAHG

SEQ ID NO: 3073 - protein, 9 aa, Borrelia burgdorferi B31
VVGVLAHGS

SEQ ID NO: 3074 - protein, 9 aa, Borrelia burgdorferi B31
VGVLAHGSF

SEQ ID NO: 3075 - protein, 9 aa, Borrelia burgdorferi B31
GVLAHGSFY

SEQ ID NO: 3076 - protein, 9 aa, Borrelia burgdorferi B31
VLAHGSFYD

SEQ ID NO: 3077 - protein, 9 aa, Borrelia burgdorferi B31
LAHGSFYDK

SEQ ID NO: 3078 - protein, 9 aa, Borrelia burgdorferi B31
AHGSFYDKG

SEQ ID NO: 3079 - protein, 9 aa, Borrelia burgdorferi B31
HGSFYDKGY

SEQ ID NO: 3080 - protein, 9 aa, Borrelia burgdorferi B31
GSFYDKGYN

SEQ ID NO: 3081 - protein, 9 aa, Borrelia burgdorferi B31
SFYDKGYNQ

SEQ ID NO: 3082 - protein, 9 aa, Borrelia burgdorferi B31
FYDKGYNQS

SEQ ID NO: 3083 - protein, 9 aa, Borrelia burgdorferi B31
YDKGYNQSV

SEQ ID NO: 3084 - protein, 9 aa, Borrelia burgdorferi B31
DKGYNQSVH

SEQ ID NO: 3085 - protein, 9 aa, Borrelia burgdorferi B31
KGYNQSVHD

SEQ ID NO: 3086 - protein, 9 aa, Borrelia burgdorferi B31
GYNQSVHDG

SEQ ID NO: 3087 - protein, 9 aa, Borrelia burgdorferi B31
YNQSVHDGV

SEQ ID NO: 3088 - protein, 9 aa, Borrelia burgdorferi B31
NQSVHDGVV

SEQ ID NO: 3089 - protein, 9 aa, Borrelia burgdorferi B31
QSVHDGVVK

SEQ ID NO: 3090 - protein, 9 aa, Borrelia burgdorferi B31
SVHDGVVKL

SEQ ID NO: 3091 - protein, 9 aa, Borrelia burgdorferi B31
VHDGVVKLR

SEQ ID NO: 3092 - protein, 9 aa, Borrelia burgdorferi B31
HDGVVKLRD

SEQ ID NO: 3093 - protein, 9 aa, Borrelia burgdorferi B31
DGVVKLRDN

SEQ ID NO: 3094 - protein, 9 aa, Borrelia burgdorferi B31
GVVKLRDNF

SEQ ID NO: 3095 - protein, 9 aa, Borrelia burgdorferi B31
VVKLRDNFG

SEQ ID NO: 3096 - protein, 9 aa, Borrelia burgdorferi B31
VKLRDNFGI

SEQ ID NO: 3097 - protein, 9 aa, Borrelia burgdorferi B31
KLRDNFGIK

SEQ ID NO: 3098 - protein, 9 aa, Borrelia burgdorferi B31
LRDNFGIKL

SEQ ID NO: 3099 - protein, 9 aa, Borrelia burgdorferi B31
RDNFGIKLI

SEQ ID NO: 3100 - protein, 9 aa, Borrelia burgdorferi B31
DNFGIKLIT

SEQ ID NO: 3101 - protein, 9 aa, Borrelia burgdorferi B31
NFGIKLITK

SEQ ID NO: 3102 - protein, 9 aa, Borrelia burgdorferi B31
FGIKLITKS

SEQ ID NO: 3103 - protein, 9 aa, Borrelia burgdorferi B31
GIKLITKSL

SEQ ID NO: 3104 - protein, 9 aa, Borrelia burgdorferi B31
IKLITKSLR

SEQ ID NO: 3105 - protein, 9 aa, Borrelia burgdorferi B31
KLITKSLRP

SEQ ID NO: 3106 - protein, 9 aa, Borrelia burgdorferi B31
LITKSLRPY

SEQ ID NO: 3107 - protein, 9 aa, Borrelia burgdorferi B31
ITKSLRPYP

SEQ ID NO: 3108 - protein, 9 aa, Borrelia burgdorferi B31
TKSLRPYPI

SEQ ID NO: 3109 - protein, 9 aa, Borrelia burgdorferi B31
KSLRPYPIE

SEQ ID NO: 3110 - protein, 9 aa, Borrelia burgdorferi B31
SLRPYPIEG

SEQ ID NO: 3111 - protein, 9 aa, Borrelia burgdorferi B31
LRPYPIEGK

SEQ ID NO: 3112 - protein, 9 aa, Borrelia burgdorferi B31
RPYPIEGKR

SEQ ID NO: 3113 - protein, 9 aa, Borrelia burgdorferi B31
PYPIEGKRL

SEQ ID NO: 3114 - protein, 9 aa, Borrelia burgdorferi B31
YPIEGKRLL

SEQ ID NO: 3115 - protein, 9 aa, Borrelia burgdorferi B31
PIEGKRLLT

SEQ ID NO: 3116 - protein, 9 aa, Borrelia burgdorferi B31
IEGKRLLTV

SEQ ID NO: 3117 - protein, 9 aa, Borrelia burgdorferi B31
EGKRLLTVD

SEQ ID NO: 3118 - protein, 9 aa, Borrelia burgdorferi B31
GKRLLTVDE

SEQ ID NO: 3119 - protein, 9 aa, Borrelia burgdorferi B31
KRLLTVDEA

SEQ ID NO: 3120 - protein, 9 aa, Borrelia burgdorferi B31
RLLTVDEAM

SEQ ID NO: 3121 - protein, 9 aa, Borrelia burgdorferi B31
LLTVDEAMT

SEQ ID NO: 3122 - protein, 9 aa, Borrelia burgdorferi B31
LTVDEAMTE

SEQ ID NO: 3123 - protein, 9 aa, Borrelia burgdorferi B31
TVDEAMTED

SEQ ID NO: 3124 - protein, 9 aa, Borrelia burgdorferi B31
VDEAMTEDA

SEQ ID NO: 3125 - protein, 9 aa, Borrelia burgdorferi B31
DEAMTEDAY

SEQ ID NO: 3126 - protein, 9 aa, Borrelia burgdorferi B31
EAMTEDAYE

SEQ ID NO: 3127 - protein, 9 aa, Borrelia burgdorferi B31
AMTEDAYEV

SEQ ID NO: 3128 - protein, 9 aa, Borrelia burgdorferi B31
MTEDAYEVQ

SEQ ID NO: 3129 - protein, 9 aa, Borrelia burgdorferi B31
TEDAYEVQK

SEQ ID NO: 3130 - protein, 9 aa, Borrelia burgdorferi B31
EDAYEVQKN

SEQ ID NO: 3131 - protein, 9 aa, Borrelia burgdorferi B31
DAYEVQKNP

SEQ ID NO: 3132 - protein, 9 aa, Borrelia burgdorferi B31
AYEVQKNPL

SEQ ID NO: 3133 - protein, 9 aa, Borrelia burgdorferi B31
YEVQKNPLN

SEQ ID NO: 3134 - protein, 9 aa, Borrelia burgdorferi B31
EVQKNPLNL

SEQ ID NO: 3135 - protein, 9 aa, Borrelia burgdorferi B31
VQKNPLNLF

SEQ ID NO: 3136 - protein, 9 aa, Borrelia burgdorferi B31
QKNPLNLFW

SEQ ID NO: 3137 - protein, 9 aa, Borrelia burgdorferi B31
KNPLNLFWL

SEQ ID NO: 3138 - protein, 9 aa, Borrelia burgdorferi B31
NPLNLFWLI

SEQ ID NO: 3139 - protein, 9 aa, Borrelia burgdorferi B31
PLNLFWLIG

SEQ ID NO: 3140 - protein, 9 aa, Borrelia burgdorferi B31
LNLFWLIGY

SEQ ID NO: 3141 - protein, 9 aa, Borrelia burgdorferi B31
NLFWLIGYR

SEQ ID NO: 3142 - protein, 9 aa, Borrelia burgdorferi B31
LFWLIGYRF

SEQ ID NO: 3143 - protein, 9 aa, Borrelia burgdorferi B31
FWLIGYRFS

SEQ ID NO: 3144 - protein, 9 aa, Borrelia burgdorferi B31
WLIGYRFSD

SEQ ID NO: 3145 - protein, 9 aa, Borrelia burgdorferi B31
LIGYRFSDL

SEQ ID NO: 3146 - protein, 9 aa, Borrelia burgdorferi B31
IGYRFSDLS

SEQ ID NO: 3147 - protein, 9 aa, Borrelia burgdorferi B31
GYRFSDLSV

SEQ ID NO: 3148 - protein, 9 aa, Borrelia burgdorferi B31
YRFSDLSVK

SEQ ID NO: 3149 - protein, 9 aa, Borrelia burgdorferi B31
RFSDLSVKL

SEQ ID NO: 3150 - protein, 9 aa, Borrelia burgdorferi B31
FSDLSVKLS

SEQ ID NO: 3151 - protein, 9 aa, Borrelia burgdorferi B31
SDLSVKLSY

SEQ ID NO: 3152 - protein, 9 aa, Borrelia burgdorferi B31
DLSVKLSYE

SEQ ID NO: 3153 - protein, 9 aa, Borrelia burgdorferi B31
LSVKLSYER

SEQ ID NO: 3154 - protein, 9 aa, Borrelia burgdorferi B31
SVKLSYERP

SEQ ID NO: 3155 - protein, 9 aa, Borrelia burgdorferi B31
VKLSYERPD

SEQ ID NO: 3156 - protein, 9 aa, Borrelia burgdorferi B31
KLSYERPDI

SEQ ID NO: 3157 - protein, 9 aa, Borrelia burgdorferi B31
LSYERPDIY

SEQ ID NO: 3158 - protein, 9 aa, Borrelia burgdorferi B31
SYERPDIYY

SEQ ID NO: 3159 - protein, 9 aa, Borrelia burgdorferi B31
YERPDIYYG

SEQ ID NO: 3160 - protein, 9 aa, Borrelia burgdorferi B31
ERPDIYYGI

SEQ ID NO: 3161 - protein, 9 aa, Borrelia burgdorferi B31
RPDIYYGII

SEQ ID NO: 3162 - protein, 9 aa, Borrelia burgdorferi B31
PDIYYGIID

SEQ ID NO: 3163 - protein, 9 aa, Borrelia burgdorferi B31
DIYYGIIDA

SEQ ID NO: 3164 - protein, 9 aa, Borrelia burgdorferi B31
IYYGIIDAF

SEQ ID NO: 3165 - protein, 9 aa, Borrelia burgdorferi B31
YYGIIDAFD

SEQ ID NO: 3166 - protein, 9 aa, Borrelia burgdorferi B31
YGIIDAFDY

SEQ ID NO: 3167 - protein, 9 aa, Borrelia burgdorferi B31
GIIDAFDYG

SEQ ID NO: 3168 - protein, 9 aa, Borrelia burgdorferi B31
IIDAFDYGD

SEQ ID NO: 3169 - protein, 9 aa, Borrelia burgdorferi B31
IDAFDYGDI

SEQ ID NO: 3170 - protein, 9 aa, Borrelia burgdorferi B31
DAFDYGDIQ

SEQ ID NO: 3171 - protein, 9 aa, Borrelia burgdorferi B31
AFDYGDIQV

SEQ ID NO: 3172 - protein, 9 aa, Borrelia burgdorferi B31
FDYGDIQVP

SEQ ID NO: 3173 - protein, 9 aa, Borrelia burgdorferi B31
DYGDIQVPK

SEQ ID NO: 3174 - protein, 9 aa, Borrelia burgdorferi B31
YGDIQVPKN

SEQ ID NO: 3175 - protein, 9 aa, Borrelia burgdorferi B31
GDIQVPKNS

SEQ ID NO: 3176 - protein, 9 aa, Borrelia burgdorferi B31
DIQVPKNSL

SEQ ID NO: 3177 - protein, 9 aa, Borrelia burgdorferi B31
IQVPKNSLA

SEQ ID NO: 3178 - protein, 9 aa, Borrelia burgdorferi B31
QVPKNSLAI

SEQ ID NO: 3179 - protein, 9 aa, Borrelia burgdorferi B31
VPKNSLAIK

SEQ ID NO: 3180 - protein, 9 aa, Borrelia burgdorferi B31
PKNSLAIKF

SEQ ID NO: 3181 - protein, 9 aa, Borrelia burgdorferi B31
KNSLAIKFR

SEQ ID NO: 3182 - protein, 9 aa, Borrelia burgdorferi B31
NSLAIKFRN

SEQ ID NO: 3183 - protein, 9 aa, Borrelia burgdorferi B31
SLAIKFRNE

SEQ ID NO: 3184 - protein, 9 aa, Borrelia burgdorferi B31
LAIKFRNEE

SEQ ID NO: 3185 - protein, 9 aa, Borrelia burgdorferi B31
AIKFRNEEA

SEQ ID NO: 3186 - protein, 9 aa, Borrelia burgdorferi B31
IKFRNEEAA

SEQ ID NO: 3187 - protein, 9 aa, Borrelia burgdorferi B31
KFRNEEAAF

SEQ ID NO: 3188 - protein, 9 aa, Borrelia burgdorferi B31
FRNEEAAFL

SEQ ID NO: 3189 - protein, 9 aa, Borrelia burgdorferi B31
RNEEAAFLA

SEQ ID NO: 3190 - protein, 9 aa, Borrelia burgdorferi B31
NEEAAFLAG

SEQ ID NO: 3191 - protein, 9 aa, Borrelia burgdorferi B31
EEAAFLAGY

SEQ ID NO: 3192 - protein, 9 aa, Borrelia burgdorferi B31
EAAFLAGYI

SEQ ID NO: 3193 - protein, 9 aa, Borrelia burgdorferi B31
AAFLAGYIA

SEQ ID NO: 3194 - protein, 9 aa, Borrelia burgdorferi B31
AFLAGYIAA

SEQ ID NO: 3195 - protein, 9 aa, Borrelia burgdorferi B31
FLAGYIAAK

SEQ ID NO: 3196 - protein, 9 aa, Borrelia burgdorferi B31
LAGYIAAKM

SEQ ID NO: 3197 - protein, 9 aa, Borrelia burgdorferi B31
AGYIAAKMS

SEQ ID NO: 3198 - protein, 9 aa, Borrelia burgdorferi B31
GYIAAKMSR

SEQ ID NO: 3199 - protein, 9 aa, Borrelia burgdorferi B31
YIAAKMSRK

SEQ ID NO: 3200 - protein, 9 aa, Borrelia burgdorferi B31
IAAKMSRKE

SEQ ID NO: 3201 - protein, 9 aa, Borrelia burgdorferi B31
AAKMSRKEK

SEQ ID NO: 3202 - protein, 9 aa, Borrelia burgdorferi B31
AKMSRKEKI

SEQ ID NO: 3203 - protein, 9 aa, Borrelia burgdorferi B31
KMSRKEKIG

SEQ ID NO: 3204 - protein, 9 aa, Borrelia burgdorferi B31
MSRKEKIGF

SEQ ID NO: 3205 - protein, 9 aa, Borrelia burgdorferi B31
SRKEKIGFL

SEQ ID NO: 3206 - protein, 9 aa, Borrelia burgdorferi B31
RKEKIGFLT

SEQ ID NO: 3207 - protein, 9 aa, Borrelia burgdorferi B31
KEKIGFLTG

SEQ ID NO: 3208 - protein, 9 aa, Borrelia burgdorferi B31
EKIGFLTGP

SEQ ID NO: 3209 - protein, 9 aa, Borrelia burgdorferi B31
KIGFLTGPM

SEQ ID NO: 3210 - protein, 9 aa, Borrelia burgdorferi B31
IGFLTGPMS

SEQ ID NO: 3211 - protein, 9 aa, Borrelia burgdorferi B31
GFLTGPMSE

SEQ ID NO: 3212 - protein, 9 aa, Borrelia burgdorferi B31
FLTGPMSEH

SEQ ID NO: 3213 - protein, 9 aa, Borrelia burgdorferi B31
LTGPMSEHV

SEQ ID NO: 3214 - protein, 9 aa, Borrelia burgdorferi B31
TGPMSEHVK

SEQ ID NO: 3215 - protein, 9 aa, Borrelia burgdorferi B31
GPMSEHVKD

SEQ ID NO: 3216 - protein, 9 aa, Borrelia burgdorferi B31
PMSEHVKDF

SEQ ID NO: 3217 - protein, 9 aa, Borrelia burgdorferi B31
MSEHVKDFK

SEQ ID NO: 3218 - protein, 9 aa, Borrelia burgdorferi B31
SEHVKDFKF

SEQ ID NO: 3219 - protein, 9 aa, Borrelia burgdorferi B31
EHVKDFKFG

SEQ ID NO: 3220 - protein, 9 aa, Borrelia burgdorferi B31
HVKDFKFGF

SEQ ID NO: 3221 - protein, 9 aa, Borrelia burgdorferi B31
VKDFKFGFK

SEQ ID NO: 3222 - protein, 9 aa, Borrelia burgdorferi B31
KDFKFGFKA

SEQ ID NO: 3223 - protein, 9 aa, Borrelia burgdorferi B31
DFKFGFKAG

SEQ ID NO: 3224 - protein, 9 aa, Borrelia burgdorferi B31
FKFGFKAGI

SEQ ID NO: 3225 - protein, 9 aa, Borrelia burgdorferi B31
KFGFKAGIF

SEQ ID NO: 3226 - protein, 9 aa, Borrelia burgdorferi B31
FGFKAGIFY

SEQ ID NO: 3227 - protein, 9 aa, Borrelia burgdorferi B31
GFKAGIFYA

SEQ ID NO: 3228 - protein, 9 aa, Borrelia burgdorferi B31
FKAGIFYAN

SEQ ID NO: 3229 - protein, 9 aa, Borrelia burgdorferi B31
KAGIFYANP

SEQ ID NO: 3230 - protein, 9 aa, Borrelia burgdorferi B31
AGIFYANPK

SEQ ID NO: 3231 - protein, 9 aa, Borrelia burgdorferi B31
GIFYANPKL

SEQ ID NO: 3232 - protein, 9 aa, Borrelia burgdorferi B31
IFYANPKLR

SEQ ID NO: 3233 - protein, 9 aa, Borrelia burgdorferi B31
FYANPKLRL

SEQ ID NO: 3234 - protein, 9 aa, Borrelia burgdorferi B31
YANPKLRLV

SEQ ID NO: 3235 - protein, 9 aa, Borrelia burgdorferi B31
ANPKLRLVS

SEQ ID NO: 3236 - protein, 9 aa, Borrelia burgdorferi B31
NPKLRLVSK

SEQ ID NO: 3237 - protein, 9 aa, Borrelia burgdorferi B31
PKLRLVSKK

SEQ ID NO: 3238 - protein, 9 aa, Borrelia burgdorferi B31
KLRLVSKKA

SEQ ID NO: 3239 - protein, 9 aa, Borrelia burgdorferi B31
LRLVSKKAP

SEQ ID NO: 3240 - protein, 9 aa, Borrelia burgdorferi B31
RLVSKKAPS

SEQ ID NO: 3241 - protein, 9 aa, Borrelia burgdorferi B31
LVSKKAPSL

SEQ ID NO: 3242 - protein, 9 aa, Borrelia burgdorferi B31
VSKKAPSLF

SEQ ID NO: 3243 - protein, 9 aa, Borrelia burgdorferi B31
SKKAPSLFD

SEQ ID NO: 3244 - protein, 9 aa, Borrelia burgdorferi B31
KKAPSLFDK

SEQ ID NO: 3245 - protein, 9 aa, Borrelia burgdorferi B31
KAPSLFDKE

SEQ ID NO: 3246 - protein, 9 aa, Borrelia burgdorferi B31
APSLFDKEK

SEQ ID NO: 3247 - protein, 9 aa, Borrelia burgdorferi B31
PSLFDKEKG

SEQ ID NO: 3248 - protein, 9 aa, Borrelia burgdorferi B31
SLFDKEKGK

SEQ ID NO: 3249 - protein, 9 aa, Borrelia burgdorferi B31
LFDKEKGKA

SEQ ID NO: 3250 - protein, 9 aa, Borrelia burgdorferi B31
FDKEKGKAM

SEQ ID NO: 3251 - protein, 9 aa, Borrelia burgdorferi B31
DKEKGKAMA

SEQ ID NO: 3252 - protein, 9 aa, Borrelia burgdorferi B31
KEKGKAMAL

SEQ ID NO: 3253 - protein, 9 aa, Borrelia burgdorferi B31
EKGKAMALF

SEQ ID NO: 3254 - protein, 9 aa, Borrelia burgdorferi B31
KGKAMALFM

SEQ ID NO: 3255 - protein, 9 aa, Borrelia burgdorferi B31
GKAMALFMY

SEQ ID NO: 3256 - protein, 9 aa, Borrelia burgdorferi B31
KAMALFMYK

SEQ ID NO: 3257 - protein, 9 aa, Borrelia burgdorferi B31
AMALFMYKE

SEQ ID NO: 3258 - protein, 9 aa, Borrelia burgdorferi B31
MALFMYKED

SEQ ID NO: 3259 - protein, 9 aa, Borrelia burgdorferi B31
ALFMYKEDK

SEQ ID NO: 3260 - protein, 9 aa, Borrelia burgdorferi B31
LFMYKEDKV

SEQ ID NO: 3261 - protein, 9 aa, Borrelia burgdorferi B31
FMYKEDKVG

SEQ ID NO: 3262 - protein, 9 aa, Borrelia burgdorferi B31
MYKEDKVGV

SEQ ID NO: 3263 - protein, 9 aa, Borrelia burgdorferi B31
YKEDKVGVI

SEQ ID NO: 3264 - protein, 9 aa, Borrelia burgdorferi B31
KEDKVGVIF

SEQ ID NO: 3265 - protein, 9 aa, Borrelia burgdorferi B31
EDKVGVIFP

SEQ ID NO: 3266 - protein, 9 aa, Borrelia burgdorferi B31
DKVGVIFPI

SEQ ID NO: 3267 - protein, 9 aa, Borrelia burgdorferi B31
KVGVIFPIA

SEQ ID NO: 3268 - protein, 9 aa, Borrelia burgdorferi B31
VGVIFPIAG

SEQ ID NO: 3269 - protein, 9 aa, Borrelia burgdorferi B31
GVIFPIAGI

SEQ ID NO: 3270 - protein, 9 aa, Borrelia burgdorferi B31
VIFPIAGIT

SEQ ID NO: 3271 - protein, 9 aa, Borrelia burgdorferi B31
IFPIAGITG

SEQ ID NO: 3272 - protein, 9 aa, Borrelia burgdorferi B31
FPIAGITGL

SEQ ID NO: 3273 - protein, 9 aa, Borrelia burgdorferi B31
PIAGITGLG

SEQ ID NO: 3274 - protein, 9 aa, Borrelia burgdorferi B31
IAGITGLGV

SEQ ID NO: 3275 - protein, 9 aa, Borrelia burgdorferi B31
AGITGLGVY

SEQ ID NO: 3276 - protein, 9 aa, Borrelia burgdorferi B31
GITGLGVYD

SEQ ID NO: 3277 - protein, 9 aa, Borrelia burgdorferi B31
ITGLGVYDA

SEQ ID NO: 3278 - protein, 9 aa, Borrelia burgdorferi B31
TGLGVYDAA

SEQ ID NO: 3279 - protein, 9 aa, Borrelia burgdorferi B31
GLGVYDAAK

SEQ ID NO: 3280 - protein, 9 aa, Borrelia burgdorferi B31
LGVYDAAKE

SEQ ID NO: 3281 - protein, 9 aa, Borrelia burgdorferi B31
GVYDAAKEL

SEQ ID NO: 3282 - protein, 9 aa, Borrelia burgdorferi B31
VYDAAKELG

SEQ ID NO: 3283 - protein, 9 aa, Borrelia burgdorferi B31
YDAAKELGP

SEQ ID NO: 3284 - protein, 9 aa, Borrelia burgdorferi B31
DAAKELGPK

SEQ ID NO: 3285 - protein, 9 aa, Borrelia burgdorferi B31
AAKELGPKY

SEQ ID NO: 3286 - protein, 9 aa, Borrelia burgdorferi B31
AKELGPKYY

SEQ ID NO: 3287 - protein, 9 aa, Borrelia burgdorferi B31
KELGPKYYV

SEQ ID NO: 3288 - protein, 9 aa, Borrelia burgdorferi B31
ELGPKYYVI

SEQ ID NO: 3289 - protein, 9 aa, Borrelia burgdorferi B31
LGPKYYVIG

SEQ ID NO: 3290 - protein, 9 aa, Borrelia burgdorferi B31
GPKYYVIGL

SEQ ID NO: 3291 - protein, 9 aa, Borrelia burgdorferi B31
PKYYVIGLN

SEQ ID NO: 3292 - protein, 9 aa, Borrelia burgdorferi B31
KYYVIGLNQ

SEQ ID NO: 3293 - protein, 9 aa, Borrelia burgdorferi B31
YYVIGLNQD

SEQ ID NO: 3294 - protein, 9 aa, Borrelia burgdorferi B31
YVIGLNQDQ

SEQ ID NO: 3295 - protein, 9 aa, Borrelia burgdorferi B31
VIGLNQDQS

SEQ ID NO: 3296 - protein, 9 aa, Borrelia burgdorferi B31
IGLNQDQSY

SEQ ID NO: 3297 - protein, 9 aa, Borrelia burgdorferi B31
GLNQDQSYI

SEQ ID NO: 3298 - protein, 9 aa, Borrelia burgdorferi B31
LNQDQSYIA

SEQ ID NO: 3299 - protein, 9 aa, Borrelia burgdorferi B31
NQDQSYIAP

SEQ ID NO: 3300 - protein, 9 aa, Borrelia burgdorferi B31
QDQSYIAPQ

SEQ ID NO: 3301 - protein, 9 aa, Borrelia burgdorferi B31
DQSYIAPQN

SEQ ID NO: 3302 - protein, 9 aa, Borrelia burgdorferi B31
QSYIAPQNV

SEQ ID NO: 3303 - protein, 9 aa, Borrelia burgdorferi B31
SYIAPQNVI

SEQ ID NO: 3304 - protein, 9 aa, Borrelia burgdorferi B31
YIAPQNVIT

SEQ ID NO: 3305 - protein, 9 aa, Borrelia burgdorferi B31
IAPQNVITS

SEQ ID NO: 3306 - protein, 9 aa, Borrelia burgdorferi B31
APQNVITSI

SEQ ID NO: 3307 - protein, 9 aa, Borrelia burgdorferi B31
PQNVITSII

SEQ ID NO: 3308 - protein, 9 aa, Borrelia burgdorferi B31
QNVITSIIK

SEQ ID NO: 3309 - protein, 9 aa, Borrelia burgdorferi B31
NVITSIIKD

SEQ ID NO: 3310 - protein, 9 aa, Borrelia burgdorferi B31
VITSIIKDI

SEQ ID NO: 3311 - protein, 9 aa, Borrelia burgdorferi B31
ITSIIKDIG

SEQ ID NO: 3312 - protein, 9 aa, Borrelia burgdorferi B31
TSIIKDIGK

SEQ ID NO: 3313 - protein, 9 aa, Borrelia burgdorferi B31
SIIKDIGKV

SEQ ID NO: 3314 - protein, 9 aa, Borrelia burgdorferi B31
IIKDIGKVI

SEQ ID NO: 3315 - protein, 9 aa, Borrelia burgdorferi B31
IKDIGKVIY

SEQ ID NO: 3316 - protein, 9 aa, Borrelia burgdorferi B31
KDIGKVIYS

SEQ ID NO: 3317 - protein, 9 aa, Borrelia burgdorferi B31
DIGKVIYSI

SEQ ID NO: 3318 - protein, 9 aa, Borrelia burgdorferi B31
IGKVIYSIS

SEQ ID NO: 3319 - protein, 9 aa, Borrelia burgdorferi B31
GKVIYSISS

SEQ ID NO: 3320 - protein, 9 aa, Borrelia burgdorferi B31
KVIYSISSE

SEQ ID NO: 3321 - protein, 9 aa, Borrelia burgdorferi B31
VIYSISSEY

SEQ ID NO: 3322 - protein, 9 aa, Borrelia burgdorferi B31
IYSISSEYI

SEQ ID NO: 3323 - protein, 9 aa, Borrelia burgdorferi B31
YSISSEYIN

SEQ ID NO: 3324 - protein, 9 aa, Borrelia burgdorferi B31
SISSEYINN

SEQ ID NO: 3325 - protein, 9 aa, Borrelia burgdorferi B31
ISSEYINNR

SEQ ID NO: 3326 - protein, 9 aa, Borrelia burgdorferi B31
SSEYINNRV

SEQ ID NO: 3327 - protein, 9 aa, Borrelia burgdorferi B31
SEYINNRVF

SEQ ID NO: 3328 - protein, 9 aa, Borrelia burgdorferi B31
EYINNRVFK

SEQ ID NO: 3329 - protein, 9 aa, Borrelia burgdorferi B31
YINNRVFKG

SEQ ID NO: 3330 - protein, 9 aa, Borrelia burgdorferi B31
INNRVFKGG

SEQ ID NO: 3331 - protein, 9 aa, Borrelia burgdorferi B31
NNRVFKGGI

SEQ ID NO: 3332 - protein, 9 aa, Borrelia burgdorferi B31
NRVFKGGII

SEQ ID NO: 3333 - protein, 9 aa, Borrelia burgdorferi B31
RVFKGGIII

SEQ ID NO: 3334 - protein, 9 aa, Borrelia burgdorferi B31
VFKGGIIID

SEQ ID NO: 3335 - protein, 9 aa, Borrelia burgdorferi B31
FKGGIIIDR

SEQ ID NO: 3336 - protein, 9 aa, Borrelia burgdorferi B31
KGGIIIDRG

SEQ ID NO: 3337 - protein, 9 aa, Borrelia burgdorferi B31
GGIIIDRGL

SEQ ID NO: 3338 - protein, 9 aa, Borrelia burgdorferi B31
GIIIDRGLK

SEQ ID NO: 3339 - protein, 9 aa, Borrelia burgdorferi B31
IIIDRGLKE

SEQ ID NO: 3340 - protein, 9 aa, Borrelia burgdorferi B31
IIDRGLKEG

SEQ ID NO: 3341 - protein, 9 aa, Borrelia burgdorferi B31
IDRGLKEGV

SEQ ID NO: 3342 - protein, 9 aa, Borrelia burgdorferi B31
DRGLKEGVI

SEQ ID NO: 3343 - protein, 9 aa, Borrelia burgdorferi B31
RGLKEGVIE

SEQ ID NO: 3344 - protein, 9 aa, Borrelia burgdorferi B31
GLKEGVIEI

SEQ ID NO: 3345 - protein, 9 aa, Borrelia burgdorferi B31
LKEGVIEIV

SEQ ID NO: 3346 - protein, 9 aa, Borrelia burgdorferi B31
KEGVIEIVK

SEQ ID NO: 3347 - protein, 9 aa, Borrelia burgdorferi B31
EGVIEIVKD

SEQ ID NO: 3348 - protein, 9 aa, Borrelia burgdorferi B31
GVIEIVKDP

SEQ ID NO: 3349 - protein, 9 aa, Borrelia burgdorferi B31
VIEIVKDPD

SEQ ID NO: 3350 - protein, 9 aa, Borrelia burgdorferi B31
IEIVKDPDV

SEQ ID NO: 3351 - protein, 9 aa, Borrelia burgdorferi B31
EIVKDPDVL

SEQ ID NO: 3352 - protein, 9 aa, Borrelia burgdorferi B31
IVKDPDVLN

SEQ ID NO: 3353 - protein, 9 aa, Borrelia burgdorferi B31
VKDPDVLNN

SEQ ID NO: 3354 - protein, 9 aa, Borrelia burgdorferi B31
KDPDVLNNR

SEQ ID NO: 3355 - protein, 9 aa, Borrelia burgdorferi B31
DPDVLNNRL

SEQ ID NO: 3356 - protein, 9 aa, Borrelia burgdorferi B31
PDVLNNRLV

SEQ ID NO: 3357 - protein, 9 aa, Borrelia burgdorferi B31
DVLNNRLVD

SEQ ID NO: 3358 - protein, 9 aa, Borrelia burgdorferi B31
VLNNRLVDE

SEQ ID NO: 3359 - protein, 9 aa, Borrelia burgdorferi B31
LNNRLVDEV

SEQ ID NO: 3360 - protein, 9 aa, Borrelia burgdorferi B31
NNRLVDEVI

SEQ ID NO: 3361 - protein, 9 aa, Borrelia burgdorferi B31
NRLVDEVID

SEQ ID NO: 3362 - protein, 9 aa, Borrelia burgdorferi B31
RLVDEVIDL

SEQ ID NO: 3363 - protein, 9 aa, Borrelia burgdorferi B31
LVDEVIDLE

SEQ ID NO: 3364 - protein, 9 aa, Borrelia burgdorferi B31
VDEVIDLEN

SEQ ID NO: 3365 - protein, 9 aa, Borrelia burgdorferi B31
DEVIDLENK

SEQ ID NO: 3366 - protein, 9 aa, Borrelia burgdorferi B31
EVIDLENKI

SEQ ID NO: 3367 - protein, 9 aa, Borrelia burgdorferi B31
VIDLENKII

SEQ ID NO: 3368 - protein, 9 aa, Borrelia burgdorferi B31
IDLENKIIS

SEQ ID NO: 3369 - protein, 9 aa, Borrelia burgdorferi B31
DLENKIISG

SEQ ID NO: 3370 - protein, 9 aa, Borrelia burgdorferi B31
LENKIISGE

SEQ ID NO: 3371 - protein, 9 aa, Borrelia burgdorferi B31
ENKIISGEI

SEQ ID NO: 3372 - protein, 9 aa, Borrelia burgdorferi B31
NKIISGEII

SEQ ID NO: 3373 - protein, 9 aa, Borrelia burgdorferi B31
KIISGEIIV

SEQ ID NO: 3374 - protein, 9 aa, Borrelia burgdorferi B31
IISGEIIVP

SEQ ID NO: 3375 - protein, 9 aa, Borrelia burgdorferi B31
ISGEIIVPD

SEQ ID NO: 3376 - protein, 9 aa, Borrelia burgdorferi B31
SGEIIVPDS

SEQ ID NO: 3377 - protein, 9 aa, Borrelia burgdorferi B31
GEIIVPDSE

SEQ ID NO: 3378 - protein, 9 aa, Borrelia burgdorferi B31
EIIVPDSEY

SEQ ID NO: 3379 - protein, 9 aa, Borrelia burgdorferi B31
IIVPDSEYA

SEQ ID NO: 3380 - protein, 9 aa, Borrelia burgdorferi B31
IVPDSEYAF

SEQ ID NO: 3381 - protein, 9 aa, Borrelia burgdorferi B31
VPDSEYAFD

SEQ ID NO: 3382 - protein, 9 aa, Borrelia burgdorferi B31
PDSEYAFDL

SEQ ID NO: 3383 - protein, 9 aa, Borrelia burgdorferi B31
DSEYAFDLF

SEQ ID NO: 3384 - protein, 9 aa, Borrelia burgdorferi B31
SEYAFDLFK

SEQ ID NO: 3385 - protein, 9 aa, Borrelia burgdorferi B31
EYAFDLFKS

SEQ ID NO: 3386 - protein, 9 aa, Borrelia burgdorferi B31
YAFDLFKSK

SEQ ID NO: 3387 - protein, 9 aa, Borrelia burgdorferi B31
AFDLFKSKL

SEQ ID NO: 3388 - protein, 10 aa, Borrelia burgdorferi B31
MFKRFIFITL

SEQ ID NO: 3389 - protein, 10 aa, Borrelia burgdorferi B31
FKRFIFITLS

SEQ ID NO: 3390 - protein, 10 aa, Borrelia burgdorferi B31
KRFIFITLSL

SEQ ID NO: 3391 - protein, 10 aa, Borrelia burgdorferi B31
RFIFITLSLL

SEQ ID NO: 3392 - protein, 10 aa, Borrelia burgdorferi B31
FIFITLSLLV

SEQ ID NO: 3393 - protein, 10 aa, Borrelia burgdorferi B31
IFITLSLLVF

SEQ ID NO: 3394 - protein, 10 aa, Borrelia burgdorferi B31
FITLSLLVFA

SEQ ID NO: 3395 - protein, 10 aa, Borrelia burgdorferi B31
ITLSLLVFAC

SEQ ID NO: 3396 - protein, 10 aa, Borrelia burgdorferi B31
TLSLLVFACF

SEQ ID NO: 3397 - protein, 10 aa, Borrelia burgdorferi B31
LSLLVFACFK

SEQ ID NO: 3398 - protein, 10 aa, Borrelia burgdorferi B31
SLLVFACFKS

SEQ ID NO: 3399 - protein, 10 aa, Borrelia burgdorferi B31
LLVFACFKSN

SEQ ID NO: 3400 - protein, 10 aa, Borrelia burgdorferi B31
LVFACFKSNK

SEQ ID NO: 3401 - protein, 10 aa, Borrelia burgdorferi B31
VFACFKSNKK

SEQ ID NO: 3402 - protein, 10 aa, Borrelia burgdorferi B31
FACFKSNKKS

SEQ ID NO: 3403 - protein, 10 aa, Borrelia burgdorferi B31
ACFKSNKKSI

SEQ ID NO: 3404 - protein, 10 aa, Borrelia burgdorferi B31
CFKSNKKSIK

SEQ ID NO: 3405 - protein, 10 aa, Borrelia burgdorferi B31
FKSNKKSIKS

SEQ ID NO: 3406 - protein, 10 aa, Borrelia burgdorferi B31
KSNKKSIKSD

SEQ ID NO: 3407 - protein, 10 aa, Borrelia burgdorferi B31
SNKKSIKSDK

SEQ ID NO: 3408 - protein, 10 aa, Borrelia burgdorferi B31
NKKSIKSDKV

SEQ ID NO: 3409 - protein, 10 aa, Borrelia burgdorferi B31
KKSIKSDKVV

SEQ ID NO: 3410 - protein, 10 aa, Borrelia burgdorferi B31
KSIKSDKVVV

SEQ ID NO: 3411 - protein, 10 aa, Borrelia burgdorferi B31
SIKSDKVVVG

SEQ ID NO: 3412 - protein, 10 aa, Borrelia burgdorferi B31
IKSDKVVVGV

SEQ ID NO: 3413 - protein, 10 aa, Borrelia burgdorferi B31
KSDKVVVGVL

SEQ ID NO: 3414 - protein, 10 aa, Borrelia burgdorferi B31
SDKVVVGVLA

SEQ ID NO: 3415 - protein, 10 aa, Borrelia burgdorferi B31
DKVVVGVLAH

SEQ ID NO: 3416 - protein, 10 aa, Borrelia burgdorferi B31
KVVVGVLAHG

SEQ ID NO: 3417 - protein, 10 aa, Borrelia burgdorferi B31
VVVGVLAHGS

SEQ ID NO: 3418 - protein, 10 aa, Borrelia burgdorferi B31
VVGVLAHGSF

SEQ ID NO: 3419 - protein, 10 aa, Borrelia burgdorferi B31
VGVLAHGSFY

SEQ ID NO: 3420 - protein, 10 aa, Borrelia burgdorferi B31
GVLAHGSFYD

SEQ ID NO: 3421 - protein, 10 aa, Borrelia burgdorferi B31
VLAHGSFYDK

SEQ ID NO: 3422 - protein, 10 aa, Borrelia burgdorferi B31
LAHGSFYDKG

SEQ ID NO: 3423 - protein, 10 aa, Borrelia burgdorferi B31
AHGSFYDKGY

SEQ ID NO: 3424 - protein, 10 aa, Borrelia burgdorferi B31
HGSFYDKGYN

SEQ ID NO: 3425 - protein, 10 aa, Borrelia burgdorferi B31
GSFYDKGYNQ

SEQ ID NO: 3426 - protein, 10 aa, Borrelia burgdorferi B31
SFYDKGYNQS

SEQ ID NO: 3427 - protein, 10 aa, Borrelia burgdorferi B31
FYDKGYNQSV

SEQ ID NO: 3428 - protein, 10 aa, Borrelia burgdorferi B31
YDKGYNQSVH

SEQ ID NO: 3429 - protein, 10 aa, Borrelia burgdorferi B31
DKGYNQSVHD

SEQ ID NO: 3430 - protein, 10 aa, Borrelia burgdorferi B31
KGYNQSVHDG

SEQ ID NO: 3431 - protein, 10 aa, Borrelia burgdorferi B31
GYNQSVHDGV

SEQ ID NO: 3432 - protein, 10 aa, Borrelia burgdorferi B31
YNQSVHDGVV

SEQ ID NO: 3433 - protein, 10 aa, Borrelia burgdorferi B31
NQSVHDGVVK

SEQ ID NO: 3434 - protein, 10 aa, Borrelia burgdorferi B31
QSVHDGVVKL

SEQ ID NO: 3435 - protein, 10 aa, Borrelia burgdorferi B31
SVHDGVVKLR

SEQ ID NO: 3436 - protein, 10 aa, Borrelia burgdorferi B31
VHDGVVKLRD

SEQ ID NO: 3437 - protein, 10 aa, Borrelia burgdorferi B31
HDGVVKLRDN

SEQ ID NO: 3438 - protein, 10 aa, Borrelia burgdorferi B31
DGVVKLRDNF

SEQ ID NO: 3439 - protein, 10 aa, Borrelia burgdorferi B31
GVVKLRDNFG

SEQ ID NO: 3440 - protein, 10 aa, Borrelia burgdorferi B31
VVKLRDNFGI

SEQ ID NO: 3441 - protein, 10 aa, Borrelia burgdorferi B31
VKLRDNFGIK

SEQ ID NO: 3442 - protein, 10 aa, Borrelia burgdorferi B31
KLRDNFGIKL

SEQ ID NO: 3443 - protein, 10 aa, Borrelia burgdorferi B31
LRDNFGIKLI

SEQ ID NO: 3444 - protein, 10 aa, Borrelia burgdorferi B31
RDNFGIKLIT

SEQ ID NO: 3445 - protein, 10 aa, Borrelia burgdorferi B31
DNFGIKLITK

SEQ ID NO: 3446 - protein, 10 aa, Borrelia burgdorferi B31
NFGIKLITKS

SEQ ID NO: 3447 - protein, 10 aa, Borrelia burgdorferi B31
FGIKLITKSL

SEQ ID NO: 3448 - protein, 10 aa, Borrelia burgdorferi B31
GIKLITKSLR

SEQ ID NO: 3449 - protein, 10 aa, Borrelia burgdorferi B31
IKLITKSLRP

SEQ ID NO: 3450 - protein, 10 aa, Borrelia burgdorferi B31
KLITKSLRPY

SEQ ID NO: 3451 - protein, 10 aa, Borrelia burgdorferi B31
LITKSLRPYP

SEQ ID NO: 3452 - protein, 10 aa, Borrelia burgdorferi B31
ITKSLRPYPI

SEQ ID NO: 3453 - protein, 10 aa, Borrelia burgdorferi B31
TKSLRPYPIE

SEQ ID NO: 3454 - protein, 10 aa, Borrelia burgdorferi B31
KSLRPYPIEG

SEQ ID NO: 3455 - protein, 10 aa, Borrelia burgdorferi B31
SLRPYPIEGK

SEQ ID NO: 3456 - protein, 10 aa, Borrelia burgdorferi B31
LRPYPIEGKR

SEQ ID NO: 3457 - protein, 10 aa, Borrelia burgdorferi B31
RPYPIEGKRL

SEQ ID NO: 3458 - protein, 10 aa, Borrelia burgdorferi B31
PYPIEGKRLL

SEQ ID NO: 3459 - protein, 10 aa, Borrelia burgdorferi B31
YPIEGKRLLT

SEQ ID NO: 3460 - protein, 10 aa, Borrelia burgdorferi B31
PIEGKRLLTV

SEQ ID NO: 3461 - protein, 10 aa, Borrelia burgdorferi B31
IEGKRLLTVD

SEQ ID NO: 3462 - protein, 10 aa, Borrelia burgdorferi B31
EGKRLLTVDE

SEQ ID NO: 3463 - protein, 10 aa, Borrelia burgdorferi B31
GKRLLTVDEA

SEQ ID NO: 3464 - protein, 10 aa, Borrelia burgdorferi B31
KRLLTVDEAM

SEQ ID NO: 3465 - protein, 10 aa, Borrelia burgdorferi B31
RLLTVDEAMT

SEQ ID NO: 3466 - protein, 10 aa, Borrelia burgdorferi B31
LLTVDEAMTE

SEQ ID NO: 3467 - protein, 10 aa, Borrelia burgdorferi B31
LTVDEAMTED

SEQ ID NO: 3468 - protein, 10 aa, Borrelia burgdorferi B31
TVDEAMTEDA

SEQ ID NO: 3469 - protein, 10 aa, Borrelia burgdorferi B31
VDEAMTEDAY

SEQ ID NO: 3470 - protein, 10 aa, Borrelia burgdorferi B31
DEAMTEDAYE

SEQ ID NO: 3471 - protein, 10 aa, Borrelia burgdorferi B31
EAMTEDAYEV

SEQ ID NO: 3472 - protein, 10 aa, Borrelia burgdorferi B31
AMTEDAYEVQ

SEQ ID NO: 3473 - protein, 10 aa, Borrelia burgdorferi B31
MTEDAYEVQK

SEQ ID NO: 3474 - protein, 10 aa, Borrelia burgdorferi B31
TEDAYEVQKN

SEQ ID NO: 3475 - protein, 10 aa, Borrelia burgdorferi B31
EDAYEVQKNP

SEQ ID NO: 3476 - protein, 10 aa, Borrelia burgdorferi B31
DAYEVQKNPL

SEQ ID NO: 3477 - protein, 10 aa, Borrelia burgdorferi B31
AYEVQKNPLN

SEQ ID NO: 3478 - protein, 10 aa, Borrelia burgdorferi B31
YEVQKNPLNL

SEQ ID NO: 3479 - protein, 10 aa, Borrelia burgdorferi B31
EVQKNPLNLF

SEQ ID NO: 3480 - protein, 10 aa, Borrelia burgdorferi B31
VQKNPLNLFW

SEQ ID NO: 3481 - protein, 10 aa, Borrelia burgdorferi B31
QKNPLNLFWL

SEQ ID NO: 3482 - protein, 10 aa, Borrelia burgdorferi B31
KNPLNLFWLI

SEQ ID NO: 3483 - protein, 10 aa, Borrelia burgdorferi B31
NPLNLFWLIG

SEQ ID NO: 3484 - protein, 10 aa, Borrelia burgdorferi B31
PLNLFWLIGY

SEQ ID NO: 3485 - protein, 10 aa, Borrelia burgdorferi B31
LNLFWLIGYR

SEQ ID NO: 3486 - protein, 10 aa, Borrelia burgdorferi B31
NLFWLIGYRF

SEQ ID NO: 3487 - protein, 10 aa, Borrelia burgdorferi B31
LFWLIGYRFS

SEQ ID NO: 3488 - protein, 10 aa, Borrelia burgdorferi B31
FWLIGYRFSD

SEQ ID NO: 3489 - protein, 10 aa, Borrelia burgdorferi B31
WLIGYRFSDL

SEQ ID NO: 3490 - protein, 10 aa, Borrelia burgdorferi B31
LIGYRFSDLS

SEQ ID NO: 3491 - protein, 10 aa, Borrelia burgdorferi B31
IGYRFSDLSV

SEQ ID NO: 3492 - protein, 10 aa, Borrelia burgdorferi B31
GYRFSDLSVK

SEQ ID NO: 3493 - protein, 10 aa, Borrelia burgdorferi B31
YRFSDLSVKL

SEQ ID NO: 3494 - protein, 10 aa, Borrelia burgdorferi B31
RFSDLSVKLS

SEQ ID NO: 3495 - protein, 10 aa, Borrelia burgdorferi B31
FSDLSVKLSY

SEQ ID NO: 3496 - protein, 10 aa, Borrelia burgdorferi B31
SDLSVKLSYE

SEQ ID NO: 3497 - protein, 10 aa, Borrelia burgdorferi B31
DLSVKLSYER

SEQ ID NO: 3498 - protein, 10 aa, Borrelia burgdorferi B31
LSVKLSYERP

SEQ ID NO: 3499 - protein, 10 aa, Borrelia burgdorferi B31
SVKLSYERPD

SEQ ID NO: 3500 - protein, 10 aa, Borrelia burgdorferi B31
VKLSYERPDI

SEQ ID NO: 3501 - protein, 10 aa, Borrelia burgdorferi B31
KLSYERPDIY

SEQ ID NO: 3502 - protein, 10 aa, Borrelia burgdorferi B31
LSYERPDIYY

SEQ ID NO: 3503 - protein, 10 aa, Borrelia burgdorferi B31
SYERPDIYYG

SEQ ID NO: 3504 - protein, 10 aa, Borrelia burgdorferi B31
YERPDIYYGI

SEQ ID NO: 3505 - protein, 10 aa, Borrelia burgdorferi B31
ERPDIYYGII

SEQ ID NO: 3506 - protein, 10 aa, Borrelia burgdorferi B31
RPDIYYGIID

SEQ ID NO: 3507 - protein, 10 aa, Borrelia burgdorferi B31
PDIYYGIIDA

SEQ ID NO: 3508 - protein, 10 aa, Borrelia burgdorferi B31
DIYYGIIDAF

SEQ ID NO: 3509 - protein, 10 aa, Borrelia burgdorferi B31
IYYGIIDAFD

SEQ ID NO: 3510 - protein, 10 aa, Borrelia burgdorferi B31
YYGIIDAFDY

SEQ ID NO: 3511 - protein, 10 aa, Borrelia burgdorferi B31
YGIIDAFDYG

SEQ ID NO: 3512 - protein, 10 aa, Borrelia burgdorferi B31
GIIDAFDYGD

SEQ ID NO: 3513 - protein, 10 aa, Borrelia burgdorferi B31
IIDAFDYGDI

SEQ ID NO: 3514 - protein, 10 aa, Borrelia burgdorferi B31
IDAFDYGDIQ

SEQ ID NO: 3515 - protein, 10 aa, Borrelia burgdorferi B31
DAFDYGDIQV

SEQ ID NO: 3516 - protein, 10 aa, Borrelia burgdorferi B31
AFDYGDIQVP

SEQ ID NO: 3517 - protein, 10 aa, Borrelia burgdorferi B31
FDYGDIQVPK

SEQ ID NO: 3518 - protein, 10 aa, Borrelia burgdorferi B31
DYGDIQVPKN

SEQ ID NO: 3519 - protein, 10 aa, Borrelia burgdorferi B31
YGDIQVPKNS

SEQ ID NO: 3520 - protein, 10 aa, Borrelia burgdorferi B31
GDIQVPKNSL

SEQ ID NO: 3521 - protein, 10 aa, Borrelia burgdorferi B31
DIQVPKNSLA

SEQ ID NO: 3522 - protein, 10 aa, Borrelia burgdorferi B31
IQVPKNSLAI

SEQ ID NO: 3523 - protein, 10 aa, Borrelia burgdorferi B31
QVPKNSLAIK

SEQ ID NO: 3524 - protein, 10 aa, Borrelia burgdorferi B31
VPKNSLAIKF

SEQ ID NO: 3525 - protein, 10 aa, Borrelia burgdorferi B31
PKNSLAIKFR

SEQ ID NO: 3526 - protein, 10 aa, Borrelia burgdorferi B31
KNSLAIKFRN

SEQ ID NO: 3527 - protein, 10 aa, Borrelia burgdorferi B31
NSLAIKFRNE

SEQ ID NO: 3528 - protein, 10 aa, Borrelia burgdorferi B31
SLAIKFRNEE

SEQ ID NO: 3529 - protein, 10 aa, Borrelia burgdorferi B31
LAIKFRNEEA

SEQ ID NO: 3530 - protein, 10 aa, Borrelia burgdorferi B31
AIKFRNEEAA

SEQ ID NO: 3531 - protein, 10 aa, Borrelia burgdorferi B31
IKFRNEEAAF

SEQ ID NO: 3532 - protein, 10 aa, Borrelia burgdorferi B31
KFRNEEAAFL

SEQ ID NO: 3533 - protein, 10 aa, Borrelia burgdorferi B31
FRNEEAAFLA

SEQ ID NO: 3534 - protein, 10 aa, Borrelia burgdorferi B31
RNEEAAFLAG

SEQ ID NO: 3535 - protein, 10 aa, Borrelia burgdorferi B31
NEEAAFLAGY

SEQ ID NO: 3536 - protein, 10 aa, Borrelia burgdorferi B31
EEAAFLAGYI

SEQ ID NO: 3537 - protein, 10 aa, Borrelia burgdorferi B31
EAAFLAGYIA

SEQ ID NO: 3538 - protein, 10 aa, Borrelia burgdorferi B31
AAFLAGYIAA

SEQ ID NO: 3539 - protein, 10 aa, Borrelia burgdorferi B31
AFLAGYIAAK

SEQ ID NO: 3540 - protein, 10 aa, Borrelia burgdorferi B31
FLAGYIAAKM

SEQ ID NO: 3541 - protein, 10 aa, Borrelia burgdorferi B31
LAGYIAAKMS

SEQ ID NO: 3542 - protein, 10 aa, Borrelia burgdorferi B31
AGYIAAKMSR

SEQ ID NO: 3543 - protein, 10 aa, Borrelia burgdorferi B31
GYIAAKMSRK

SEQ ID NO: 3544 - protein, 10 aa, Borrelia burgdorferi B31
YIAAKMSRKE

SEQ ID NO: 3545 - protein, 10 aa, Borrelia burgdorferi B31
IAAKMSRKEK

SEQ ID NO: 3546 - protein, 10 aa, Borrelia burgdorferi B31
AAKMSRKEKI

SEQ ID NO: 3547 - protein, 10 aa, Borrelia burgdorferi B31
AKMSRKEKIG

SEQ ID NO: 3548 - protein, 10 aa, Borrelia burgdorferi B31
KMSRKEKIGF

SEQ ID NO: 3549 - protein, 10 aa, Borrelia burgdorferi B31
MSRKEKIGFL

SEQ ID NO: 3550 - protein, 10 aa, Borrelia burgdorferi B31
SRKEKIGFLT

SEQ ID NO: 3551 - protein, 10 aa, Borrelia burgdorferi B31
RKEKIGFLTG

SEQ ID NO: 3552 - protein, 10 aa, Borrelia burgdorferi B31
KEKIGFLTGP

SEQ ID NO: 3553 - protein, 10 aa, Borrelia burgdorferi B31
EKIGFLTGPM

SEQ ID NO: 3554 - protein, 10 aa, Borrelia burgdorferi B31
KIGFLTGPMS

SEQ ID NO: 3555 - protein, 10 aa, Borrelia burgdorferi B31
IGFLTGPMSE

SEQ ID NO: 3556 - protein, 10 aa, Borrelia burgdorferi B31
GFLTGPMSEH

SEQ ID NO: 3557 - protein, 10 aa, Borrelia burgdorferi B31
FLTGPMSEHV

SEQ ID NO: 3558 - protein, 10 aa, Borrelia burgdorferi B31
LTGPMSEHVK

SEQ ID NO: 3559 - protein, 10 aa, Borrelia burgdorferi B31
TGPMSEHVKD

SEQ ID NO: 3560 - protein, 10 aa, Borrelia burgdorferi B31
GPMSEHVKDF

SEQ ID NO: 3561 - protein, 10 aa, Borrelia burgdorferi B31
PMSEHVKDFK

SEQ ID NO: 3562 - protein, 10 aa, Borrelia burgdorferi B31
MSEHVKDFKF

SEQ ID NO: 3563 - protein, 10 aa, Borrelia burgdorferi B31
SEHVKDFKFG

SEQ ID NO: 3564 - protein, 10 aa, Borrelia burgdorferi B31
EHVKDFKFGF

SEQ ID NO: 3565 - protein, 10 aa, Borrelia burgdorferi B31
HVKDFKFGFK

SEQ ID NO: 3566 - protein, 10 aa, Borrelia burgdorferi B31
VKDFKFGFKA

SEQ ID NO: 3567 - protein, 10 aa, Borrelia burgdorferi B31
KDFKFGFKAG

SEQ ID NO: 3568 - protein, 10 aa, Borrelia burgdorferi B31
DFKFGFKAGI

SEQ ID NO: 3569 - protein, 10 aa, Borrelia burgdorferi B31
FKFGFKAGIF

SEQ ID NO: 3570 - protein, 10 aa, Borrelia burgdorferi B31
KFGFKAGIFY

SEQ ID NO: 3571 - protein, 10 aa, Borrelia burgdorferi B31
FGFKAGIFYA

SEQ ID NO: 3572 - protein, 10 aa, Borrelia burgdorferi B31
GFKAGIFYAN

SEQ ID NO: 3573 - protein, 10 aa, Borrelia burgdorferi B31
FKAGIFYANP

SEQ ID NO: 3574 - protein, 10 aa, Borrelia burgdorferi B31
KAGIFYANPK

SEQ ID NO: 3575 - protein, 10 aa, Borrelia burgdorferi B31
AGIFYANPKL

SEQ ID NO: 3576 - protein, 10 aa, Borrelia burgdorferi B31
GIFYANPKLR

SEQ ID NO: 3577 - protein, 10 aa, Borrelia burgdorferi B31
IFYANPKLRL

SEQ ID NO: 3578 - protein, 10 aa, Borrelia burgdorferi B31
FYANPKLRLV

SEQ ID NO: 3579 - protein, 10 aa, Borrelia burgdorferi B31
YANPKLRLVS

SEQ ID NO: 3580 - protein, 10 aa, Borrelia burgdorferi B31
ANPKLRLVSK

SEQ ID NO: 3581 - protein, 10 aa, Borrelia burgdorferi B31
NPKLRLVSKK

SEQ ID NO: 3582 - protein, 10 aa, Borrelia burgdorferi B31
PKLRLVSKKA

SEQ ID NO: 3583 - protein, 10 aa, Borrelia burgdorferi B31
KLRLVSKKAP

SEQ ID NO: 3584 - protein, 10 aa, Borrelia burgdorferi B31
LRLVSKKAPS

SEQ ID NO: 3585 - protein, 10 aa, Borrelia burgdorferi B31
RLVSKKAPSL

SEQ ID NO: 3586 - protein, 10 aa, Borrelia burgdorferi B31
LVSKKAPSLF

SEQ ID NO: 3587 - protein, 10 aa, Borrelia burgdorferi B31
VSKKAPSLFD

SEQ ID NO: 3588 - protein, 10 aa, Borrelia burgdorferi B31
SKKAPSLFDK

SEQ ID NO: 3589 - protein, 10 aa, Borrelia burgdorferi B31
KKAPSLFDKE

SEQ ID NO: 3590 - protein, 10 aa, Borrelia burgdorferi B31
KAPSLFDKEK

SEQ ID NO: 3591 - protein, 10 aa, Borrelia burgdorferi B31
APSLFDKEKG

SEQ ID NO: 3592 - protein, 10 aa, Borrelia burgdorferi B31
PSLFDKEKGK

SEQ ID NO: 3593 - protein, 10 aa, Borrelia burgdorferi B31
SLFDKEKGKA

SEQ ID NO: 3594 - protein, 10 aa, Borrelia burgdorferi B31
LFDKEKGKAM

SEQ ID NO: 3595 - protein, 10 aa, Borrelia burgdorferi B31
FDKEKGKAMA

SEQ ID NO: 3596 - protein, 10 aa, Borrelia burgdorferi B31
DKEKGKAMAL

SEQ ID NO: 3597 - protein, 10 aa, Borrelia burgdorferi B31
KEKGKAMALF

SEQ ID NO: 3598 - protein, 10 aa, Borrelia burgdorferi B31
EKGKAMALFM

SEQ ID NO: 3599 - protein, 10 aa, Borrelia burgdorferi B31
KGKAMALFMY

SEQ ID NO: 3600 - protein, 10 aa, Borrelia burgdorferi B31
GKAMALFMYK

SEQ ID NO: 3601 - protein, 10 aa, Borrelia burgdorferi B31
KAMALFMYKE

SEQ ID NO: 3602 - protein, 10 aa, Borrelia burgdorferi B31
AMALFMYKED

SEQ ID NO: 3603 - protein, 10 aa, Borrelia burgdorferi B31
MALFMYKEDK

SEQ ID NO: 3604 - protein, 10 aa, Borrelia burgdorferi B31
ALFMYKEDKV

SEQ ID NO: 3605 - protein, 10 aa, Borrelia burgdorferi B31
LFMYKEDKVG

SEQ ID NO: 3606 - protein, 10 aa, Borrelia burgdorferi B31
FMYKEDKVGV

SEQ ID NO: 3607 - protein, 10 aa, Borrelia burgdorferi B31
MYKEDKVGVI

SEQ ID NO: 3608 - protein, 10 aa, Borrelia burgdorferi B31
YKEDKVGVIF

SEQ ID NO: 3609 - protein, 10 aa, Borrelia burgdorferi B31
KEDKVGVIFP

SEQ ID NO: 3610 - protein, 10 aa, Borrelia burgdorferi B31
EDKVGVIFPI

SEQ ID NO: 3611 - protein, 10 aa, Borrelia burgdorferi B31
DKVGVIFPIA

SEQ ID NO: 3612 - protein, 10 aa, Borrelia burgdorferi B31
KVGVIFPIAG

SEQ ID NO: 3613 - protein, 10 aa, Borrelia burgdorferi B31
VGVIFPIAGI

SEQ ID NO: 3614 - protein, 10 aa, Borrelia burgdorferi B31
GVIFPIAGIT

SEQ ID NO: 3615 - protein, 10 aa, Borrelia burgdorferi B31
VIFPIAGITG

SEQ ID NO: 3616 - protein, 10 aa, Borrelia burgdorferi B31
IFPIAGITGL

SEQ ID NO: 3617 - protein, 10 aa, Borrelia burgdorferi B31
FPIAGITGLG

SEQ ID NO: 3618 - protein, 10 aa, Borrelia burgdorferi B31
PIAGITGLGV

SEQ ID NO: 3619 - protein, 10 aa, Borrelia burgdorferi B31
IAGITGLGVY

SEQ ID NO: 3620 - protein, 10 aa, Borrelia burgdorferi B31
AGITGLGVYD

SEQ ID NO: 3621 - protein, 10 aa, Borrelia burgdorferi B31
GITGLGVYDA

SEQ ID NO: 3622 - protein, 10 aa, Borrelia burgdorferi B31
ITGLGVYDAA

SEQ ID NO: 3623 - protein, 10 aa, Borrelia burgdorferi B31
TGLGVYDAAK

SEQ ID NO: 3624 - protein, 10 aa, Borrelia burgdorferi B31
GLGVYDAAKE

SEQ ID NO: 3625 - protein, 10 aa, Borrelia burgdorferi B31
LGVYDAAKEL

SEQ ID NO: 3626 - protein, 10 aa, Borrelia burgdorferi B31
GVYDAAKELG

SEQ ID NO: 3627 - protein, 10 aa, Borrelia burgdorferi B31
VYDAAKELGP

SEQ ID NO: 3628 - protein, 10 aa, Borrelia burgdorferi B31
YDAAKELGPK

SEQ ID NO: 3629 - protein, 10 aa, Borrelia burgdorferi B31
DAAKELGPKY

SEQ ID NO: 3630 - protein, 10 aa, Borrelia burgdorferi B31
AAKELGPKYY

SEQ ID NO: 3631 - protein, 10 aa, Borrelia burgdorferi B31
AKELGPKYYV

SEQ ID NO: 3632 - protein, 10 aa, Borrelia burgdorferi B31
KELGPKYYVI

SEQ ID NO: 3633 - protein, 10 aa, Borrelia burgdorferi B31
ELGPKYYVIG

SEQ ID NO: 3634 - protein, 10 aa, Borrelia burgdorferi B31
LGPKYYVIGL

SEQ ID NO: 3635 - protein, 10 aa, Borrelia burgdorferi B31
GPKYYVIGLN

SEQ ID NO: 3636 - protein, 10 aa, Borrelia burgdorferi B31
PKYYVIGLNQ

SEQ ID NO: 3637 - protein, 10 aa, Borrelia burgdorferi B31
KYYVIGLNQD

SEQ ID NO: 3638 - protein, 10 aa, Borrelia burgdorferi B31
YYVIGLNQDQ

SEQ ID NO: 3639 - protein, 10 aa, Borrelia burgdorferi B31
YVIGLNQDQS

SEQ ID NO: 3640 - protein, 10 aa, Borrelia burgdorferi B31
VIGLNQDQSY

SEQ ID NO: 3641 - protein, 10 aa, Borrelia burgdorferi B31
IGLNQDQSYI

SEQ ID NO: 3642 - protein, 10 aa, Borrelia burgdorferi B31
GLNQDQSYIA

SEQ ID NO: 3643 - protein, 10 aa, Borrelia burgdorferi B31
LNQDQSYIAP

SEQ ID NO: 3644 - protein, 10 aa, Borrelia burgdorferi B31
NQDQSYIAPQ

SEQ ID NO: 3645 - protein, 10 aa, Borrelia burgdorferi B31
QDQSYIAPQN

SEQ ID NO: 3646 - protein, 10 aa, Borrelia burgdorferi B31
DQSYIAPQNV

SEQ ID NO: 3647 - protein, 10 aa, Borrelia burgdorferi B31
QSYIAPQNVI

SEQ ID NO: 3648 - protein, 10 aa, Borrelia burgdorferi B31
SYIAPQNVIT

SEQ ID NO: 3649 - protein, 10 aa, Borrelia burgdorferi B31
YIAPQNVITS

SEQ ID NO: 3650 - protein, 10 aa, Borrelia burgdorferi B31
IAPQNVITSI

SEQ ID NO: 3651 - protein, 10 aa, Borrelia burgdorferi B31
APQNVITSII

SEQ ID NO: 3652 - protein, 10 aa, Borrelia burgdorferi B31
PQNVITSIIK

SEQ ID NO: 3653 - protein, 10 aa, Borrelia burgdorferi B31
QNVITSIIKD

SEQ ID NO: 3654 - protein, 10 aa, Borrelia burgdorferi B31
NVITSIIKDI

SEQ ID NO: 3655 - protein, 10 aa, Borrelia burgdorferi B31
VITSIIKDIG

SEQ ID NO: 3656 - protein, 10 aa, Borrelia burgdorferi B31
ITSIIKDIGK

SEQ ID NO: 3657 - protein, 10 aa, Borrelia burgdorferi B31
TSIIKDIGKV

SEQ ID NO: 3658 - protein, 10 aa, Borrelia burgdorferi B31
SIIKDIGKVI

SEQ ID NO: 3659 - protein, 10 aa, Borrelia burgdorferi B31
IIKDIGKVIY

SEQ ID NO: 3660 - protein, 10 aa, Borrelia burgdorferi B31
IKDIGKVIYS

SEQ ID NO: 3661 - protein, 10 aa, Borrelia burgdorferi B31
KDIGKVIYSI

SEQ ID NO: 3662 - protein, 10 aa, Borrelia burgdorferi B31
DIGKVIYSIS

SEQ ID NO: 3663 - protein, 10 aa, Borrelia burgdorferi B31
IGKVIYSISS

SEQ ID NO: 3664 - protein, 10 aa, Borrelia burgdorferi B31
GKVIYSISSE

SEQ ID NO: 3665 - protein, 10 aa, Borrelia burgdorferi B31
KVIYSISSEY

SEQ ID NO: 3666 - protein, 10 aa, Borrelia burgdorferi B31
VIYSISSEYI

SEQ ID NO: 3667 - protein, 10 aa, Borrelia burgdorferi B31
IYSISSEYIN

SEQ ID NO: 3668 - protein, 10 aa, Borrelia burgdorferi B31
YSISSEYINN

SEQ ID NO: 3669 - protein, 10 aa, Borrelia burgdorferi B31
SISSEYINNR

SEQ ID NO: 3670 - protein, 10 aa, Borrelia burgdorferi B31
ISSEYINNRV

SEQ ID NO: 3671 - protein, 10 aa, Borrelia burgdorferi B31
SSEYINNRVF

SEQ ID NO: 3672 - protein, 10 aa, Borrelia burgdorferi B31
SEYINNRVFK

SEQ ID NO: 3673 - protein, 10 aa, Borrelia burgdorferi B31
EYINNRVFKG

SEQ ID NO: 3674 - protein, 10 aa, Borrelia burgdorferi B31
YINNRVFKGG

SEQ ID NO: 3675 - protein, 10 aa, Borrelia burgdorferi B31
INNRVFKGGI

SEQ ID NO: 3676 - protein, 10 aa, Borrelia burgdorferi B31
NNRVFKGGII

SEQ ID NO: 3677 - protein, 10 aa, Borrelia burgdorferi B31
NRVFKGGIII

SEQ ID NO: 3678 - protein, 10 aa, Borrelia burgdorferi B31
RVFKGGIIID

SEQ ID NO: 3679 - protein, 10 aa, Borrelia burgdorferi B31
VFKGGIIIDR

SEQ ID NO: 3680 - protein, 10 aa, Borrelia burgdorferi B31
FKGGIIIDRG

SEQ ID NO: 3681 - protein, 10 aa, Borrelia burgdorferi B31
KGGIIIDRGL

SEQ ID NO: 3682 - protein, 10 aa, Borrelia burgdorferi B31
GGIIIDRGLK

SEQ ID NO: 3683 - protein, 10 aa, Borrelia burgdorferi B31
GIIIDRGLKE

SEQ ID NO: 3684 - protein, 10 aa, Borrelia burgdorferi B31
IIIDRGLKEG

SEQ ID NO: 3685 - protein, 10 aa, Borrelia burgdorferi B31
IIDRGLKEGV

SEQ ID NO: 3686 - protein, 10 aa, Borrelia burgdorferi B31
IDRGLKEGVI

SEQ ID NO: 3687 - protein, 10 aa, Borrelia burgdorferi B31
DRGLKEGVIE

SEQ ID NO: 3688 - protein, 10 aa, Borrelia burgdorferi B31
RGLKEGVIEI

SEQ ID NO: 3689 - protein, 10 aa, Borrelia burgdorferi B31
GLKEGVIEIV

SEQ ID NO: 3690 - protein, 10 aa, Borrelia burgdorferi B31
LKEGVIEIVK

SEQ ID NO: 3691 - protein, 10 aa, Borrelia burgdorferi B31
KEGVIEIVKD

SEQ ID NO: 3692 - protein, 10 aa, Borrelia burgdorferi B31
EGVIEIVKDP

SEQ ID NO: 3693 - protein, 10 aa, Borrelia burgdorferi B31
GVIEIVKDPD

SEQ ID NO: 3694 - protein, 10 aa, Borrelia burgdorferi B31
VIEIVKDPDV

SEQ ID NO: 3695 - protein, 10 aa, Borrelia burgdorferi B31
IEIVKDPDVL

SEQ ID NO: 3696 - protein, 10 aa, Borrelia burgdorferi B31
EIVKDPDVLN

SEQ ID NO: 3697 - protein, 10 aa, Borrelia burgdorferi B31
IVKDPDVLNN

SEQ ID NO: 3698 - protein, 10 aa, Borrelia burgdorferi B31
VKDPDVLNNR

SEQ ID NO: 3699 - protein, 10 aa, Borrelia burgdorferi B31
KDPDVLNNRL

SEQ ID NO: 3700 - protein, 10 aa, Borrelia burgdorferi B31
DPDVLNNRLV

SEQ ID NO: 3701 - protein, 10 aa, Borrelia burgdorferi B31
PDVLNNRLVD

SEQ ID NO: 3702 - protein, 10 aa, Borrelia burgdorferi B31
DVLNNRLVDE

SEQ ID NO: 3703 - protein, 10 aa, Borrelia burgdorferi B31
VLNNRLVDEV

SEQ ID NO: 3704 - protein, 10 aa, Borrelia burgdorferi B31
LNNRLVDEVI

SEQ ID NO: 3705 - protein, 10 aa, Borrelia burgdorferi B31
NNRLVDEVID

SEQ ID NO: 3706 - protein, 10 aa, Borrelia burgdorferi B31
NRLVDEVIDL

SEQ ID NO: 3707 - protein, 10 aa, Borrelia burgdorferi B31
RLVDEVIDLE

SEQ ID NO: 3708 - protein, 10 aa, Borrelia burgdorferi B31
LVDEVIDLEN

SEQ ID NO: 3709 - protein, 10 aa, Borrelia burgdorferi B31
VDEVIDLENK

SEQ ID NO: 3710 - protein, 10 aa, Borrelia burgdorferi B31
DEVIDLENKI

SEQ ID NO: 3711 - protein, 10 aa, Borrelia burgdorferi B31
EVIDLENKII

SEQ ID NO: 3712 - protein, 10 aa, Borrelia burgdorferi B31
VIDLENKIIS

SEQ ID NO: 3713 - protein, 10 aa, Borrelia burgdorferi B31
IDLENKIISG

SEQ ID NO: 3714 - protein, 10 aa, Borrelia burgdorferi B31
DLENKIISGE

SEQ ID NO: 3715 - protein, 10 aa, Borrelia burgdorferi B31
LENKIISGEI

SEQ ID NO: 3716 - protein, 10 aa, Borrelia burgdorferi B31
ENKIISGEII

SEQ ID NO: 3717 - protein, 10 aa, Borrelia burgdorferi B31
NKIISGEIIV

SEQ ID NO: 3718 - protein, 10 aa, Borrelia burgdorferi B31
KIISGEIIVP

SEQ ID NO: 3719 - protein, 10 aa, Borrelia burgdorferi B31
IISGEIIVPD

SEQ ID NO: 3720 - protein, 10 aa, Borrelia burgdorferi B31
ISGEIIVPDS

SEQ ID NO: 3721 - protein, 10 aa, Borrelia burgdorferi B31
SGEIIVPDSE

SEQ ID NO: 3722 - protein, 10 aa, Borrelia burgdorferi B31
GEIIVPDSEY

SEQ ID NO: 3723 - protein, 10 aa, Borrelia burgdorferi B31
EIIVPDSEYA

SEQ ID NO: 3724 - protein, 10 aa, Borrelia burgdorferi B31
IIVPDSEYAF

SEQ ID NO: 3725 - protein, 10 aa, Borrelia burgdorferi B31
IVPDSEYAFD

SEQ ID NO: 3726 - protein, 10 aa, Borrelia burgdorferi B31
VPDSEYAFDL

SEQ ID NO: 3727 - protein, 10 aa, Borrelia burgdorferi B31
PDSEYAFDLF

SEQ ID NO: 3728 - protein, 10 aa, Borrelia burgdorferi B31
DSEYAFDLFK

SEQ ID NO: 3729 - protein, 10 aa, Borrelia burgdorferi B31
SEYAFDLFKS

SEQ ID NO: 3730 - protein, 10 aa, Borrelia burgdorferi B31
EYAFDLFKSK

SEQ ID NO: 3731 - protein, 10 aa, Borrelia burgdorferi B31
YAFDLFKSKL

SEQ ID NO: 3732 - protein, 11 aa, Borrelia burgdorferi B31
MFKRFIFITLS

SEQ ID NO: 3733 - protein, 11 aa, Borrelia burgdorferi B31
FKRFIFITLSL

SEQ ID NO: 3734 - protein, 11 aa, Borrelia burgdorferi B31
KRFIFITLSLL

SEQ ID NO: 3735 - protein, 11 aa, Borrelia burgdorferi B31
RFIFITLSLLV

SEQ ID NO: 3736 - protein, 11 aa, Borrelia burgdorferi B31
FIFITLSLLVF

SEQ ID NO: 3737 - protein, 11 aa, Borrelia burgdorferi B31
IFITLSLLVFA

SEQ ID NO: 3738 - protein, 11 aa, Borrelia burgdorferi B31
FITLSLLVFAC

SEQ ID NO: 3739 - protein, 11 aa, Borrelia burgdorferi B31
ITLSLLVFACF

SEQ ID NO: 3740 - protein, 11 aa, Borrelia burgdorferi B31
TLSLLVFACFK

SEQ ID NO: 3741 - protein, 11 aa, Borrelia burgdorferi B31
LSLLVFACFKS

SEQ ID NO: 3742 - protein, 11 aa, Borrelia burgdorferi B31
SLLVFACFKSN

SEQ ID NO: 3743 - protein, 11 aa, Borrelia burgdorferi B31
LLVFACFKSNK

SEQ ID NO: 3744 - protein, 11 aa, Borrelia burgdorferi B31
LVFACFKSNKK

SEQ ID NO: 3745 - protein, 11 aa, Borrelia burgdorferi B31
VFACFKSNKKS

SEQ ID NO: 3746 - protein, 11 aa, Borrelia burgdorferi B31
FACFKSNKKSI

SEQ ID NO: 3747 - protein, 11 aa, Borrelia burgdorferi B31
ACFKSNKKSIK

SEQ ID NO: 3748 - protein, 11 aa, Borrelia burgdorferi B31
CFKSNKKSIKS

SEQ ID NO: 3749 - protein, 11 aa, Borrelia burgdorferi B31
FKSNKKSIKSD

SEQ ID NO: 3750 - protein, 11 aa, Borrelia burgdorferi B31
KSNKKSIKSDK

SEQ ID NO: 3751 - protein, 11 aa, Borrelia burgdorferi B31
SNKKSIKSDKV

SEQ ID NO: 3752 - protein, 11 aa, Borrelia burgdorferi B31
NKKSIKSDKVV

SEQ ID NO: 3753 - protein, 11 aa, Borrelia burgdorferi B31
KKSIKSDKVVV

SEQ ID NO: 3754 - protein, 11 aa, Borrelia burgdorferi B31
KSIKSDKVVVG

SEQ ID NO: 3755 - protein, 11 aa, Borrelia burgdorferi B31
SIKSDKVVVGV

SEQ ID NO: 3756 - protein, 11 aa, Borrelia burgdorferi B31
IKSDKVVVGVL

SEQ ID NO: 3757 - protein, 11 aa, Borrelia burgdorferi B31
KSDKVVVGVLA

SEQ ID NO: 3758 - protein, 11 aa, Borrelia burgdorferi B31
SDKVVVGVLAH

SEQ ID NO: 3759 - protein, 11 aa, Borrelia burgdorferi B31
DKVVVGVLAHG

SEQ ID NO: 3760 - protein, 11 aa, Borrelia burgdorferi B31
KVVVGVLAHGS

SEQ ID NO: 3761 - protein, 11 aa, Borrelia burgdorferi B31
VVVGVLAHGSF

SEQ ID NO: 3762 - protein, 11 aa, Borrelia burgdorferi B31
VVGVLAHGSFY

SEQ ID NO: 3763 - protein, 11 aa, Borrelia burgdorferi B31
VGVLAHGSFYD

SEQ ID NO: 3764 - protein, 11 aa, Borrelia burgdorferi B31
GVLAHGSFYDK

SEQ ID NO: 3765 - protein, 11 aa, Borrelia burgdorferi B31
VLAHGSFYDKG

SEQ ID NO: 3766 - protein, 11 aa, Borrelia burgdorferi B31
LAHGSFYDKGY

SEQ ID NO: 3767 - protein, 11 aa, Borrelia burgdorferi B31
AHGSFYDKGYN

SEQ ID NO: 3768 - protein, 11 aa, Borrelia burgdorferi B31
HGSFYDKGYNQ

SEQ ID NO: 3769 - protein, 11 aa, Borrelia burgdorferi B31
GSFYDKGYNQS

SEQ ID NO: 3770 - protein, 11 aa, Borrelia burgdorferi B31
SFYDKGYNQSV

SEQ ID NO: 3771 - protein, 11 aa, Borrelia burgdorferi B31
FYDKGYNQSVH

SEQ ID NO: 3772 - protein, 11 aa, Borrelia burgdorferi B31
YDKGYNQSVHD

SEQ ID NO: 3773 - protein, 11 aa, Borrelia burgdorferi B31
DKGYNQSVHDG

SEQ ID NO: 3774 - protein, 11 aa, Borrelia burgdorferi B31
KGYNQSVHDGV

SEQ ID NO: 3775 - protein, 11 aa, Borrelia burgdorferi B31
GYNQSVHDGVV

SEQ ID NO: 3776 - protein, 11 aa, Borrelia burgdorferi B31
YNQSVHDGVVK

SEQ ID NO: 3777 - protein, 11 aa, Borrelia burgdorferi B31
NQSVHDGVVKL

SEQ ID NO: 3778 - protein, 11 aa, Borrelia burgdorferi B31
QSVHDGVVKLR

SEQ ID NO: 3779 - protein, 11 aa, Borrelia burgdorferi B31
SVHDGVVKLRD

SEQ ID NO: 3780 - protein, 11 aa, Borrelia burgdorferi B31
VHDGVVKLRDN

SEQ ID NO: 3781 - protein, 11 aa, Borrelia burgdorferi B31
HDGVVKLRDNF

SEQ ID NO: 3782 - protein, 11 aa, Borrelia burgdorferi B31
DGVVKLRDNFG

SEQ ID NO: 3783 - protein, 11 aa, Borrelia burgdorferi B31
GVVKLRDNFGI

SEQ ID NO: 3784 - protein, 11 aa, Borrelia burgdorferi B31
VVKLRDNFGIK

SEQ ID NO: 3785 - protein, 11 aa, Borrelia burgdorferi B31
VKLRDNFGIKL

SEQ ID NO: 3786 - protein, 11 aa, Borrelia burgdorferi B31
KLRDNFGIKLI

SEQ ID NO: 3787 - protein, 11 aa, Borrelia burgdorferi B31
LRDNFGIKLIT

SEQ ID NO: 3788 - protein, 11 aa, Borrelia burgdorferi B31
RDNFGIKLITK

SEQ ID NO: 3789 - protein, 11 aa, Borrelia burgdorferi B31
DNFGIKLITKS

SEQ ID NO: 3790 - protein, 11 aa, Borrelia burgdorferi B31
NFGIKLITKSL

SEQ ID NO: 3791 - protein, 11 aa, Borrelia burgdorferi B31
FGIKLITKSLR

SEQ ID NO: 3792 - protein, 11 aa, Borrelia burgdorferi B31
GIKLITKSLRP

SEQ ID NO: 3793 - protein, 11 aa, Borrelia burgdorferi B31
IKLITKSLRPY

SEQ ID NO: 3794 - protein, 11 aa, Borrelia burgdorferi B31
KLITKSLRPYP

SEQ ID NO: 3795 - protein, 11 aa, Borrelia burgdorferi B31
LITKSLRPYPI

SEQ ID NO: 3796 - protein, 11 aa, Borrelia burgdorferi B31
ITKSLRPYPIE

SEQ ID NO: 3797 - protein, 11 aa, Borrelia burgdorferi B31
TKSLRPYPIEG

SEQ ID NO: 3798 - protein, 11 aa, Borrelia burgdorferi B31
KSLRPYPIEGK

SEQ ID NO: 3799 - protein, 11 aa, Borrelia burgdorferi B31
SLRPYPIEGKR

SEQ ID NO: 3800 - protein, 11 aa, Borrelia burgdorferi B31
LRPYPIEGKRL

SEQ ID NO: 3801 - protein, 11 aa, Borrelia burgdorferi B31
RPYPIEGKRLL

SEQ ID NO: 3802 - protein, 11 aa, Borrelia burgdorferi B31
PYPIEGKRLLT

SEQ ID NO: 3803 - protein, 11 aa, Borrelia burgdorferi B31
YPIEGKRLLTV

SEQ ID NO: 3804 - protein, 11 aa, Borrelia burgdorferi B31
PIEGKRLLTVD

SEQ ID NO: 3805 - protein, 11 aa, Borrelia burgdorferi B31
IEGKRLLTVDE

SEQ ID NO: 3806 - protein, 11 aa, Borrelia burgdorferi B31
EGKRLLTVDEA

SEQ ID NO: 3807 - protein, 11 aa, Borrelia burgdorferi B31
GKRLLTVDEAM

SEQ ID NO: 3808 - protein, 11 aa, Borrelia burgdorferi B31
KRLLTVDEAMT

SEQ ID NO: 3809 - protein, 11 aa, Borrelia burgdorferi B31
RLLTVDEAMTE

SEQ ID NO: 3810 - protein, 11 aa, Borrelia burgdorferi B31
LLTVDEAMTED

SEQ ID NO: 3811 - protein, 11 aa, Borrelia burgdorferi B31
LTVDEAMTEDA

SEQ ID NO: 3812 - protein, 11 aa, Borrelia burgdorferi B31
TVDEAMTEDAY

SEQ ID NO: 3813 - protein, 11 aa, Borrelia burgdorferi B31
VDEAMTEDAYE

SEQ ID NO: 3814 - protein, 11 aa, Borrelia burgdorferi B31
DEAMTEDAYEV

SEQ ID NO: 3815 - protein, 11 aa, Borrelia burgdorferi B31
EAMTEDAYEVQ

SEQ ID NO: 3816 - protein, 11 aa, Borrelia burgdorferi B31
AMTEDAYEVQK

SEQ ID NO: 3817 - protein, 11 aa, Borrelia burgdorferi B31
MTEDAYEVQKN

SEQ ID NO: 3818 - protein, 11 aa, Borrelia burgdorferi B31
TEDAYEVQKNP

SEQ ID NO: 3819 - protein, 11 aa, Borrelia burgdorferi B31
EDAYEVQKNPL

SEQ ID NO: 3820 - protein, 11 aa, Borrelia burgdorferi B31
DAYEVQKNPLN

SEQ ID NO: 3821 - protein, 11 aa, Borrelia burgdorferi B31
AYEVQKNPLNL

SEQ ID NO: 3822 - protein, 11 aa, Borrelia burgdorferi B31
YEVQKNPLNLF

SEQ ID NO: 3823 - protein, 11 aa, Borrelia burgdorferi B31
EVQKNPLNLFW

SEQ ID NO: 3824 - protein, 11 aa, Borrelia burgdorferi B31
VQKNPLNLFWL

SEQ ID NO: 3825 - protein, 11 aa, Borrelia burgdorferi B31
QKNPLNLFWLI

SEQ ID NO: 3826 - protein, 11 aa, Borrelia burgdorferi B31
KNPLNLFWLIG

SEQ ID NO: 3827 - protein, 11 aa, Borrelia burgdorferi B31
NPLNLFWLIGY

SEQ ID NO: 3828 - protein, 11 aa, Borrelia burgdorferi B31
PLNLFWLIGYR

SEQ ID NO: 3829 - protein, 11 aa, Borrelia burgdorferi B31
LNLFWLIGYRF

SEQ ID NO: 3830 - protein, 11 aa, Borrelia burgdorferi B31
NLFWLIGYRFS

SEQ ID NO: 3831 - protein, 11 aa, Borrelia burgdorferi B31
LFWLIGYRFSD

SEQ ID NO: 3832 - protein, 11 aa, Borrelia burgdorferi B31
FWLIGYRFSDL

SEQ ID NO: 3833 - protein, 11 aa, Borrelia burgdorferi B31
WLIGYRFSDLS

SEQ ID NO: 3834 - protein, 11 aa, Borrelia burgdorferi B31
LIGYRFSDLSV

SEQ ID NO: 3835 - protein, 11 aa, Borrelia burgdorferi B31
IGYRFSDLSVK

SEQ ID NO: 3836 - protein, 11 aa, Borrelia burgdorferi B31
GYRFSDLSVKL

SEQ ID NO: 3837 - protein, 11 aa, Borrelia burgdorferi B31
YRFSDLSVKLS

SEQ ID NO: 3838 - protein, 11 aa, Borrelia burgdorferi B31
RFSDLSVKLSY

SEQ ID NO: 3839 - protein, 11 aa, Borrelia burgdorferi B31
FSDLSVKLSYE

SEQ ID NO: 3840 - protein, 11 aa, Borrelia burgdorferi B31
SDLSVKLSYER

SEQ ID NO: 3841 - protein, 11 aa, Borrelia burgdorferi B31
DLSVKLSYERP

SEQ ID NO: 3842 - protein, 11 aa, Borrelia burgdorferi B31
LSVKLSYERPD

SEQ ID NO: 3843 - protein, 11 aa, Borrelia burgdorferi B31
SVKLSYERPDI

SEQ ID NO: 3844 - protein, 11 aa, Borrelia burgdorferi B31
VKLSYERPDIY

SEQ ID NO: 3845 - protein, 11 aa, Borrelia burgdorferi B31
KLSYERPDIYY

SEQ ID NO: 3846 - protein, 11 aa, Borrelia burgdorferi B31
LSYERPDIYYG

SEQ ID NO: 3847 - protein, 11 aa, Borrelia burgdorferi B31
SYERPDIYYGI

SEQ ID NO: 3848 - protein, 11 aa, Borrelia burgdorferi B31
YERPDIYYGII

SEQ ID NO: 3849 - protein, 11 aa, Borrelia burgdorferi B31
ERPDIYYGIID

SEQ ID NO: 3850 - protein, 11 aa, Borrelia burgdorferi B31
RPDIYYGIIDA

SEQ ID NO: 3851 - protein, 11 aa, Borrelia burgdorferi B31
PDIYYGIIDAF

SEQ ID NO: 3852 - protein, 11 aa, Borrelia burgdorferi B31
DIYYGIIDAFD

SEQ ID NO: 3853 - protein, 11 aa, Borrelia burgdorferi B31
IYYGIIDAFDY

SEQ ID NO: 3854 - protein, 11 aa, Borrelia burgdorferi B31
YYGIIDAFDYG

SEQ ID NO: 3855 - protein, 11 aa, Borrelia burgdorferi B31
YGIIDAFDYGD

SEQ ID NO: 3856 - protein, 11 aa, Borrelia burgdorferi B31
GIIDAFDYGDI

SEQ ID NO: 3857 - protein, 11 aa, Borrelia burgdorferi B31
IIDAFDYGDIQ

SEQ ID NO: 3858 - protein, 11 aa, Borrelia burgdorferi B31
IDAFDYGDIQV

SEQ ID NO: 3859 - protein, 11 aa, Borrelia burgdorferi B31
DAFDYGDIQVP

SEQ ID NO: 3860 - protein, 11 aa, Borrelia burgdorferi B31
AFDYGDIQVPK

SEQ ID NO: 3861 - protein, 11 aa, Borrelia burgdorferi B31
FDYGDIQVPKN

SEQ ID NO: 3862 - protein, 11 aa, Borrelia burgdorferi B31
DYGDIQVPKNS

SEQ ID NO: 3863 - protein, 11 aa, Borrelia burgdorferi B31
YGDIQVPKNSL

SEQ ID NO: 3864 - protein, 11 aa, Borrelia burgdorferi B31
GDIQVPKNSLA

SEQ ID NO: 3865 - protein, 11 aa, Borrelia burgdorferi B31
DIQVPKNSLAI

SEQ ID NO: 3866 - protein, 11 aa, Borrelia burgdorferi B31
IQVPKNSLAIK

SEQ ID NO: 3867 - protein, 11 aa, Borrelia burgdorferi B31
QVPKNSLAIKF

SEQ ID NO: 3868 - protein, 11 aa, Borrelia burgdorferi B31
VPKNSLAIKFR

SEQ ID NO: 3869 - protein, 11 aa, Borrelia burgdorferi B31
PKNSLAIKFRN

SEQ ID NO: 3870 - protein, 11 aa, Borrelia burgdorferi B31
KNSLAIKFRNE

SEQ ID NO: 3871 - protein, 11 aa, Borrelia burgdorferi B31
NSLAIKFRNEE

SEQ ID NO: 3872 - protein, 11 aa, Borrelia burgdorferi B31
SLAIKFRNEEA

SEQ ID NO: 3873 - protein, 11 aa, Borrelia burgdorferi B31
LAIKFRNEEAA

SEQ ID NO: 3874 - protein, 11 aa, Borrelia burgdorferi B31
AIKFRNEEAAF

SEQ ID NO: 3875 - protein, 11 aa, Borrelia burgdorferi B31
IKFRNEEAAFL

SEQ ID NO: 3876 - protein, 11 aa, Borrelia burgdorferi B31
KFRNEEAAFLA

SEQ ID NO: 3877 - protein, 11 aa, Borrelia burgdorferi B31
FRNEEAAFLAG

SEQ ID NO: 3878 - protein, 11 aa, Borrelia burgdorferi B31
RNEEAAFLAGY

SEQ ID NO: 3879 - protein, 11 aa, Borrelia burgdorferi B31
NEEAAFLAGYI

SEQ ID NO: 3880 - protein, 11 aa, Borrelia burgdorferi B31
EEAAFLAGYIA

SEQ ID NO: 3881 - protein, 11 aa, Borrelia burgdorferi B31
EAAFLAGYIAA

SEQ ID NO: 3882 - protein, 11 aa, Borrelia burgdorferi B31
AAFLAGYIAAK

SEQ ID NO: 3883 - protein, 11 aa, Borrelia burgdorferi B31
AFLAGYIAAKM

SEQ ID NO: 3884 - protein, 11 aa, Borrelia burgdorferi B31
FLAGYIAAKMS

SEQ ID NO: 3885 - protein, 11 aa, Borrelia burgdorferi B31
LAGYIAAKMSR

SEQ ID NO: 3886 - protein, 11 aa, Borrelia burgdorferi B31
AGYIAAKMSRK

SEQ ID NO: 3887 - protein, 11 aa, Borrelia burgdorferi B31
GYIAAKMSRKE

SEQ ID NO: 3888 - protein, 11 aa, Borrelia burgdorferi B31
YIAAKMSRKEK

SEQ ID NO: 3889 - protein, 11 aa, Borrelia burgdorferi B31
IAAKMSRKEKI

SEQ ID NO: 3890 - protein, 11 aa, Borrelia burgdorferi B31
AAKMSRKEKIG

SEQ ID NO: 3891 - protein, 11 aa, Borrelia burgdorferi B31
AKMSRKEKIGF

SEQ ID NO: 3892 - protein, 11 aa, Borrelia burgdorferi B31
KMSRKEKIGFL

SEQ ID NO: 3893 - protein, 11 aa, Borrelia burgdorferi B31
MSRKEKIGFLT

SEQ ID NO: 3894 - protein, 11 aa, Borrelia burgdorferi B31
SRKEKIGFLTG

SEQ ID NO: 3895 - protein, 11 aa, Borrelia burgdorferi B31
RKEKIGFLTGP

SEQ ID NO: 3896 - protein, 11 aa, Borrelia burgdorferi B31
KEKIGFLTGPM

SEQ ID NO: 3897 - protein, 11 aa, Borrelia burgdorferi B31
EKIGFLTGPMS

SEQ ID NO: 3898 - protein, 11 aa, Borrelia burgdorferi B31
KIGFLTGPMSE

SEQ ID NO: 3899 - protein, 11 aa, Borrelia burgdorferi B31
IGFLTGPMSEH

SEQ ID NO: 3900 - protein, 11 aa, Borrelia burgdorferi B31
GFLTGPMSEHV

SEQ ID NO: 3901 - protein, 11 aa, Borrelia burgdorferi B31
FLTGPMSEHVK

SEQ ID NO: 3902 - protein, 11 aa, Borrelia burgdorferi B31
LTGPMSEHVKD

SEQ ID NO: 3903 - protein, 11 aa, Borrelia burgdorferi B31
TGPMSEHVKDF

SEQ ID NO: 3904 - protein, 11 aa, Borrelia burgdorferi B31
GPMSEHVKDFK

SEQ ID NO: 3905 - protein, 11 aa, Borrelia burgdorferi B31
PMSEHVKDFKF

SEQ ID NO: 3906 - protein, 11 aa, Borrelia burgdorferi B31
MSEHVKDFKFG

SEQ ID NO: 3907 - protein, 11 aa, Borrelia burgdorferi B31
SEHVKDFKFGF

SEQ ID NO: 3908 - protein, 11 aa, Borrelia burgdorferi B31
EHVKDFKFGFK

SEQ ID NO: 3909 - protein, 11 aa, Borrelia burgdorferi B31
HVKDFKFGFKA

SEQ ID NO: 3910 - protein, 11 aa, Borrelia burgdorferi B31
VKDFKFGFKAG

SEQ ID NO: 3911 - protein, 11 aa, Borrelia burgdorferi B31
KDFKFGFKAGI

SEQ ID NO: 3912 - protein, 11 aa, Borrelia burgdorferi B31
DFKFGFKAGIF

SEQ ID NO: 3913 - protein, 11 aa, Borrelia burgdorferi B31
FKFGFKAGIFY

SEQ ID NO: 3914 - protein, 11 aa, Borrelia burgdorferi B31
KFGFKAGIFYA

SEQ ID NO: 3915 - protein, 11 aa, Borrelia burgdorferi B31
FGFKAGIFYAN

SEQ ID NO: 3916 - protein, 11 aa, Borrelia burgdorferi B31
GFKAGIFYANP

SEQ ID NO: 3917 - protein, 11 aa, Borrelia burgdorferi B31
FKAGIFYANPK

SEQ ID NO: 3918 - protein, 11 aa, Borrelia burgdorferi B31
KAGIFYANPKL

SEQ ID NO: 3919 - protein, 11 aa, Borrelia burgdorferi B31
AGIFYANPKLR

SEQ ID NO: 3920 - protein, 11 aa, Borrelia burgdorferi B31
GIFYANPKLRL

SEQ ID NO: 3921 - protein, 11 aa, Borrelia burgdorferi B31
IFYANPKLRLV

SEQ ID NO: 3922 - protein, 11 aa, Borrelia burgdorferi B31
FYANPKLRLVS

SEQ ID NO: 3923 - protein, 11 aa, Borrelia burgdorferi B31
YANPKLRLVSK

SEQ ID NO: 3924 - protein, 11 aa, Borrelia burgdorferi B31
ANPKLRLVSKK

SEQ ID NO: 3925 - protein, 11 aa, Borrelia burgdorferi B31
NPKLRLVSKKA

SEQ ID NO: 3926 - protein, 11 aa, Borrelia burgdorferi B31
PKLRLVSKKAP

SEQ ID NO: 3927 - protein, 11 aa, Borrelia burgdorferi B31
KLRLVSKKAPS

SEQ ID NO: 3928 - protein, 11 aa, Borrelia burgdorferi B31
LRLVSKKAPSL

SEQ ID NO: 3929 - protein, 11 aa, Borrelia burgdorferi B31
RLVSKKAPSLF

SEQ ID NO: 3930 - protein, 11 aa, Borrelia burgdorferi B31
LVSKKAPSLFD

SEQ ID NO: 3931 - protein, 11 aa, Borrelia burgdorferi B31
VSKKAPSLFDK

SEQ ID NO: 3932 - protein, 11 aa, Borrelia burgdorferi B31
SKKAPSLFDKE

SEQ ID NO: 3933 - protein, 11 aa, Borrelia burgdorferi B31
KKAPSLFDKEK

SEQ ID NO: 3934 - protein, 11 aa, Borrelia burgdorferi B31
KAPSLFDKEKG

SEQ ID NO: 3935 - protein, 11 aa, Borrelia burgdorferi B31
APSLFDKEKGK

SEQ ID NO: 3936 - protein, 11 aa, Borrelia burgdorferi B31
PSLFDKEKGKA

SEQ ID NO: 3937 - protein, 11 aa, Borrelia burgdorferi B31
SLFDKEKGKAM

SEQ ID NO: 3938 - protein, 11 aa, Borrelia burgdorferi B31
LFDKEKGKAMA

SEQ ID NO: 3939 - protein, 11 aa, Borrelia burgdorferi B31
FDKEKGKAMAL

SEQ ID NO: 3940 - protein, 11 aa, Borrelia burgdorferi B31
DKEKGKAMALF

SEQ ID NO: 3941 - protein, 11 aa, Borrelia burgdorferi B31
KEKGKAMALFM

SEQ ID NO: 3942 - protein, 11 aa, Borrelia burgdorferi B31
EKGKAMALFMY

SEQ ID NO: 3943 - protein, 11 aa, Borrelia burgdorferi B31
KGKAMALFMYK

SEQ ID NO: 3944 - protein, 11 aa, Borrelia burgdorferi B31
GKAMALFMYKE

SEQ ID NO: 3945 - protein, 11 aa, Borrelia burgdorferi B31
KAMALFMYKED

SEQ ID NO: 3946 - protein, 11 aa, Borrelia burgdorferi B31
AMALFMYKEDK

SEQ ID NO: 3947 - protein, 11 aa, Borrelia burgdorferi B31
MALFMYKEDKV

SEQ ID NO: 3948 - protein, 11 aa, Borrelia burgdorferi B31
ALFMYKEDKVG

SEQ ID NO: 3949 - protein, 11 aa, Borrelia burgdorferi B31
LFMYKEDKVGV

SEQ ID NO: 3950 - protein, 11 aa, Borrelia burgdorferi B31
FMYKEDKVGVI

SEQ ID NO: 3951 - protein, 11 aa, Borrelia burgdorferi B31
MYKEDKVGVIF

SEQ ID NO: 3952 - protein, 11 aa, Borrelia burgdorferi B31
YKEDKVGVIFP

SEQ ID NO: 3953 - protein, 11 aa, Borrelia burgdorferi B31
KEDKVGVIFPI

SEQ ID NO: 3954 - protein, 11 aa, Borrelia burgdorferi B31
EDKVGVIFPIA

SEQ ID NO: 3955 - protein, 11 aa, Borrelia burgdorferi B31
DKVGVIFPIAG

SEQ ID NO: 3956 - protein, 11 aa, Borrelia burgdorferi B31
KVGVIFPIAGI

SEQ ID NO: 3957 - protein, 11 aa, Borrelia burgdorferi B31
VGVIFPIAGIT

SEQ ID NO: 3958 - protein, 11 aa, Borrelia burgdorferi B31
GVIFPIAGITG

SEQ ID NO: 3959 - protein, 11 aa, Borrelia burgdorferi B31
VIFPIAGITGL

SEQ ID NO: 3960 - protein, 11 aa, Borrelia burgdorferi B31
IFPIAGITGLG

SEQ ID NO: 3961 - protein, 11 aa, Borrelia burgdorferi B31
FPIAGITGLGV

SEQ ID NO: 3962 - protein, 11 aa, Borrelia burgdorferi B31
PIAGITGLGVY

SEQ ID NO: 3963 - protein, 11 aa, Borrelia burgdorferi B31
IAGITGLGVYD

SEQ ID NO: 3964 - protein, 11 aa, Borrelia burgdorferi B31
AGITGLGVYDA

SEQ ID NO: 3965 - protein, 11 aa, Borrelia burgdorferi B31
GITGLGVYDAA

SEQ ID NO: 3966 - protein, 11 aa, Borrelia burgdorferi B31
ITGLGVYDAAK

SEQ ID NO: 3967 - protein, 11 aa, Borrelia burgdorferi B31
TGLGVYDAAKE

SEQ ID NO: 3968 - protein, 11 aa, Borrelia burgdorferi B31
GLGVYDAAKEL

SEQ ID NO: 3969 - protein, 11 aa, Borrelia burgdorferi B31
LGVYDAAKELG

SEQ ID NO: 3970 - protein, 11 aa, Borrelia burgdorferi B31
GVYDAAKELGP

SEQ ID NO: 3971 - protein, 11 aa, Borrelia burgdorferi B31
VYDAAKELGPK

SEQ ID NO: 3972 - protein, 11 aa, Borrelia burgdorferi B31
YDAAKELGPKY

SEQ ID NO: 3973 - protein, 11 aa, Borrelia burgdorferi B31
DAAKELGPKYY

SEQ ID NO: 3974 - protein, 11 aa, Borrelia burgdorferi B31
AAKELGPKYYV

SEQ ID NO: 3975 - protein, 11 aa, Borrelia burgdorferi B31
AKELGPKYYVI

SEQ ID NO: 3976 - protein, 11 aa, Borrelia burgdorferi B31
KELGPKYYVIG

SEQ ID NO: 3977 - protein, 11 aa, Borrelia burgdorferi B31
ELGPKYYVIGL

SEQ ID NO: 3978 - protein, 11 aa, Borrelia burgdorferi B31
LGPKYYVIGLN

SEQ ID NO: 3979 - protein, 11 aa, Borrelia burgdorferi B31
GPKYYVIGLNQ

SEQ ID NO: 3980 - protein, 11 aa, Borrelia burgdorferi B31
PKYYVIGLNQD

SEQ ID NO: 3981 - protein, 11 aa, Borrelia burgdorferi B31
KYYVIGLNQDQ

SEQ ID NO: 3982 - protein, 11 aa, Borrelia burgdorferi B31
YYVIGLNQDQS

SEQ ID NO: 3983 - protein, 11 aa, Borrelia burgdorferi B31
YVIGLNQDQSY

SEQ ID NO: 3984 - protein, 11 aa, Borrelia burgdorferi B31
VIGLNQDQSYI

SEQ ID NO: 3985 - protein, 11 aa, Borrelia burgdorferi B31
IGLNQDQSYIA

SEQ ID NO: 3986 - protein, 11 aa, Borrelia burgdorferi B31
GLNQDQSYIAP

SEQ ID NO: 3987 - protein, 11 aa, Borrelia burgdorferi B31
LNQDQSYIAPQ

SEQ ID NO: 3988 - protein, 11 aa, Borrelia burgdorferi B31
NQDQSYIAPQN

SEQ ID NO: 3989 - protein, 11 aa, Borrelia burgdorferi B31
QDQSYIAPQNV

SEQ ID NO: 3990 - protein, 11 aa, Borrelia burgdorferi B31
DQSYIAPQNVI

SEQ ID NO: 3991 - protein, 11 aa, Borrelia burgdorferi B31
QSYIAPQNVIT

SEQ ID NO: 3992 - protein, 11 aa, Borrelia burgdorferi B31
SYIAPQNVITS

SEQ ID NO: 3993 - protein, 11 aa, Borrelia burgdorferi B31
YIAPQNVITSI

SEQ ID NO: 3994 - protein, 11 aa, Borrelia burgdorferi B31
IAPQNVITSII

SEQ ID NO: 3995 - protein, 11 aa, Borrelia burgdorferi B31
APQNVITSIIK

SEQ ID NO: 3996 - protein, 11 aa, Borrelia burgdorferi B31
PQNVITSIIKD

SEQ ID NO: 3997 - protein, 11 aa, Borrelia burgdorferi B31
QNVITSIIKDI

SEQ ID NO: 3998 - protein, 11 aa, Borrelia burgdorferi B31
NVITSIIKDIG

SEQ ID NO: 3999 - protein, 11 aa, Borrelia burgdorferi B31
VITSIIKDIGK

SEQ ID NO: 4000 - protein, 11 aa, Borrelia burgdorferi B31
ITSIIKDIGKV

SEQ ID NO: 4001 - protein, 11 aa, Borrelia burgdorferi B31
TSIIKDIGKVI

SEQ ID NO: 4002 - protein, 11 aa, Borrelia burgdorferi B31
SIIKDIGKVIY

SEQ ID NO: 4003 - protein, 11 aa, Borrelia burgdorferi B31
IIKDIGKVIYS

SEQ ID NO: 4004 - protein, 11 aa, Borrelia burgdorferi B31
IKDIGKVIYSI

SEQ ID NO: 4005 - protein, 11 aa, Borrelia burgdorferi B31
KDIGKVIYSIS

SEQ ID NO: 4006 - protein, 11 aa, Borrelia burgdorferi B31
DIGKVIYSISS

SEQ ID NO: 4007 - protein, 11 aa, Borrelia burgdorferi B31
IGKVIYSISSE

SEQ ID NO: 4008 - protein, 11 aa, Borrelia burgdorferi B31
GKVIYSISSEY

SEQ ID NO: 4009 - protein, 11 aa, Borrelia burgdorferi B31
KVIYSISSEYI

SEQ ID NO: 4010 - protein, 11 aa, Borrelia burgdorferi B31
VIYSISSEYIN

SEQ ID NO: 4011 - protein, 11 aa, Borrelia burgdorferi B31
IYSISSEYINN

SEQ ID NO: 4012 - protein, 11 aa, Borrelia burgdorferi B31
YSISSEYINNR

SEQ ID NO: 4013 - protein, 11 aa, Borrelia burgdorferi B31
SISSEYINNRV

SEQ ID NO: 4014 - protein, 11 aa, Borrelia burgdorferi B31
ISSEYINNRVF

SEQ ID NO: 4015 - protein, 11 aa, Borrelia burgdorferi B31
SSEYINNRVFK

SEQ ID NO: 4016 - protein, 11 aa, Borrelia burgdorferi B31
SEYINNRVFKG

SEQ ID NO: 4017 - protein, 11 aa, Borrelia burgdorferi B31
EYINNRVFKGG

SEQ ID NO: 4018 - protein, 11 aa, Borrelia burgdorferi B31
YINNRVFKGGI

SEQ ID NO: 4019 - protein, 11 aa, Borrelia burgdorferi B31
INNRVFKGGII

SEQ ID NO: 4020 - protein, 11 aa, Borrelia burgdorferi B31
NNRVFKGGIII

SEQ ID NO: 4021 - protein, 11 aa, Borrelia burgdorferi B31
NRVFKGGIIID

SEQ ID NO: 4022 - protein, 11 aa, Borrelia burgdorferi B31
RVFKGGIIIDR

SEQ ID NO: 4023 - protein, 11 aa, Borrelia burgdorferi B31
VFKGGIIIDRG

SEQ ID NO: 4024 - protein, 11 aa, Borrelia burgdorferi B31
FKGGIIIDRGL

SEQ ID NO: 4025 - protein, 11 aa, Borrelia burgdorferi B31
KGGIIIDRGLK

SEQ ID NO: 4026 - protein, 11 aa, Borrelia burgdorferi B31
GGIIIDRGLKE

SEQ ID NO: 4027 - protein, 11 aa, Borrelia burgdorferi B31
GIIIDRGLKEG

SEQ ID NO: 4028 - protein, 11 aa, Borrelia burgdorferi B31
IIIDRGLKEGV

SEQ ID NO: 4029 - protein, 11 aa, Borrelia burgdorferi B31
IIDRGLKEGVI

SEQ ID NO: 4030 - protein, 11 aa, Borrelia burgdorferi B31
IDRGLKEGVIE

SEQ ID NO: 4031 - protein, 11 aa, Borrelia burgdorferi B31
DRGLKEGVIEI

SEQ ID NO: 4032 - protein, 11 aa, Borrelia burgdorferi B31
RGLKEGVIEIV

SEQ ID NO: 4033 - protein, 11 aa, Borrelia burgdorferi B31
GLKEGVIEIVK

SEQ ID NO: 4034 - protein, 11 aa, Borrelia burgdorferi B31
LKEGVIEIVKD

SEQ ID NO: 4035 - protein, 11 aa, Borrelia burgdorferi B31
KEGVIEIVKDP

SEQ ID NO: 4036 - protein, 11 aa, Borrelia burgdorferi B31
EGVIEIVKDPD

SEQ ID NO: 4037 - protein, 11 aa, Borrelia burgdorferi B31
GVIEIVKDPDV

SEQ ID NO: 4038 - protein, 11 aa, Borrelia burgdorferi B31
VIEIVKDPDVL

SEQ ID NO: 4039 - protein, 11 aa, Borrelia burgdorferi B31
IEIVKDPDVLN

SEQ ID NO: 4040 - protein, 11 aa, Borrelia burgdorferi B31
EIVKDPDVLNN

SEQ ID NO: 4041 - protein, 11 aa, Borrelia burgdorferi B31
IVKDPDVLNNR

SEQ ID NO: 4042 - protein, 11 aa, Borrelia burgdorferi B31
VKDPDVLNNRL

SEQ ID NO: 4043 - protein, 11 aa, Borrelia burgdorferi B31
KDPDVLNNRLV

SEQ ID NO: 4044 - protein, 11 aa, Borrelia burgdorferi B31
DPDVLNNRLVD

SEQ ID NO: 4045 - protein, 11 aa, Borrelia burgdorferi B31
PDVLNNRLVDE

SEQ ID NO: 4046 - protein, 11 aa, Borrelia burgdorferi B31
DVLNNRLVDEV

SEQ ID NO: 4047 - protein, 11 aa, Borrelia burgdorferi B31
VLNNRLVDEVI

SEQ ID NO: 4048 - protein, 11 aa, Borrelia burgdorferi B31
LNNRLVDEVID

SEQ ID NO: 4049 - protein, 11 aa, Borrelia burgdorferi B31
NNRLVDEVIDL

SEQ ID NO: 4050 - protein, 11 aa, Borrelia burgdorferi B31
NRLVDEVIDLE

SEQ ID NO: 4051 - protein, 11 aa, Borrelia burgdorferi B31
RLVDEVIDLEN

SEQ ID NO: 4052 - protein, 11 aa, Borrelia burgdorferi B31
LVDEVIDLENK

SEQ ID NO: 4053 - protein, 11 aa, Borrelia burgdorferi B31
VDEVIDLENKI

SEQ ID NO: 4054 - protein, 11 aa, Borrelia burgdorferi B31
DEVIDLENKII

SEQ ID NO: 4055 - protein, 11 aa, Borrelia burgdorferi B31
EVIDLENKIIS

SEQ ID NO: 4056 - protein, 11 aa, Borrelia burgdorferi B31
VIDLENKIISG

SEQ ID NO: 4057 - protein, 11 aa, Borrelia burgdorferi B31
IDLENKIISGE

SEQ ID NO: 4058 - protein, 11 aa, Borrelia burgdorferi B31
DLENKIISGEI

SEQ ID NO: 4059 - protein, 11 aa, Borrelia burgdorferi B31
LENKIISGEII

SEQ ID NO: 4060 - protein, 11 aa, Borrelia burgdorferi B31
ENKIISGEIIV

SEQ ID NO: 4061 - protein, 11 aa, Borrelia burgdorferi B31
NKIISGEIIVP

SEQ ID NO: 4062 - protein, 11 aa, Borrelia burgdorferi B31
KIISGEIIVPD

SEQ ID NO: 4063 - protein, 11 aa, Borrelia burgdorferi B31
IISGEIIVPDS

SEQ ID NO: 4064 - protein, 11 aa, Borrelia burgdorferi B31
ISGEIIVPDSE

SEQ ID NO: 4065 - protein, 11 aa, Borrelia burgdorferi B31
SGEIIVPDSEY

SEQ ID NO: 4066 - protein, 11 aa, Borrelia burgdorferi B31
GEIIVPDSEYA

SEQ ID NO: 4067 - protein, 11 aa, Borrelia burgdorferi B31
EIIVPDSEYAF

SEQ ID NO: 4068 - protein, 11 aa, Borrelia burgdorferi B31
IIVPDSEYAFD

SEQ ID NO: 4069 - protein, 11 aa, Borrelia burgdorferi B31
IVPDSEYAFDL

SEQ ID NO: 4070 - protein, 11 aa, Borrelia burgdorferi B31
VPDSEYAFDLF

SEQ ID NO: 4071 - protein, 11 aa, Borrelia burgdorferi B31
PDSEYAFDLFK

SEQ ID NO: 4072 - protein, 11 aa, Borrelia burgdorferi B31
DSEYAFDLFKS

SEQ ID NO: 4073 - protein, 11 aa, Borrelia burgdorferi B31
SEYAFDLFKSK

SEQ ID NO: 4074 - protein, 11 aa, Borrelia burgdorferi B31
EYAFDLFKSKL

SEQ ID NO: 4075 - protein, 8 aa, Borrelia burgdorferi B31
MDNYYEIY

SEQ ID NO: 4076 - protein, 8 aa, Borrelia burgdorferi B31
DNYYEIYF

SEQ ID NO: 4077 - protein, 8 aa, Borrelia burgdorferi B31
NYYEIYFL

SEQ ID NO: 4078 - protein, 8 aa, Borrelia burgdorferi B31
YYEIYFLY

SEQ ID NO: 4079 - protein, 8 aa, Borrelia burgdorferi B31
YEIYFLYF

SEQ ID NO: 4080 - protein, 8 aa, Borrelia burgdorferi B31
EIYFLYFF

SEQ ID NO: 4081 - protein, 8 aa, Borrelia burgdorferi B31
IYFLYFFI

SEQ ID NO: 4082 - protein, 8 aa, Borrelia burgdorferi B31
YFLYFFIK

SEQ ID NO: 4083 - protein, 8 aa, Borrelia burgdorferi B31
FLYFFIKS

SEQ ID NO: 4084 - protein, 8 aa, Borrelia burgdorferi B31
LYFFIKSK

SEQ ID NO: 4085 - protein, 8 aa, Borrelia burgdorferi B31
YFFIKSKE

SEQ ID NO: 4086 - protein, 8 aa, Borrelia burgdorferi B31
FFIKSKED

SEQ ID NO: 4087 - protein, 8 aa, Borrelia burgdorferi B31
FIKSKEDI

SEQ ID NO: 4088 - protein, 8 aa, Borrelia burgdorferi B31
IKSKEDIF

SEQ ID NO: 4089 - protein, 8 aa, Borrelia burgdorferi B31
KSKEDIFM

SEQ ID NO: 4090 - protein, 8 aa, Borrelia burgdorferi B31
SKEDIFML

SEQ ID NO: 4091 - protein, 8 aa, Borrelia burgdorferi B31
KEDIFMLK

SEQ ID NO: 4092 - protein, 8 aa, Borrelia burgdorferi B31
EDIFMLKK

SEQ ID NO: 4093 - protein, 8 aa, Borrelia burgdorferi B31
DIFMLKKV

SEQ ID NO: 4094 - protein, 8 aa, Borrelia burgdorferi B31
IFMLKKVY

SEQ ID NO: 4095 - protein, 8 aa, Borrelia burgdorferi B31
FMLKKVYY

SEQ ID NO: 4096 - protein, 8 aa, Borrelia burgdorferi B31
MLKKVYYF

SEQ ID NO: 4097 - protein, 8 aa, Borrelia burgdorferi B31
LKKVYYFL

SEQ ID NO: 4098 - protein, 8 aa, Borrelia burgdorferi B31
KKVYYFLI

SEQ ID NO: 4099 - protein, 8 aa, Borrelia burgdorferi B31
KVYYFLIF

SEQ ID NO: 4100 - protein, 8 aa, Borrelia burgdorferi B31
VYYFLIFL

SEQ ID NO: 4101 - protein, 8 aa, Borrelia burgdorferi B31
YYFLIFLF

SEQ ID NO: 4102 - protein, 8 aa, Borrelia burgdorferi B31
YFLIFLFI

SEQ ID NO: 4103 - protein, 8 aa, Borrelia burgdorferi B31
FLIFLFIV

SEQ ID NO: 4104 - protein, 8 aa, Borrelia burgdorferi B31
LIFLFIVA

SEQ ID NO: 4105 - protein, 8 aa, Borrelia burgdorferi B31
IFLFIVAC

SEQ ID NO: 4106 - protein, 8 aa, Borrelia burgdorferi B31
FLFIVACS

SEQ ID NO: 4107 - protein, 8 aa, Borrelia burgdorferi B31
LFIVACSS

SEQ ID NO: 4108 - protein, 8 aa, Borrelia burgdorferi B31
FIVACSSS

SEQ ID NO: 4109 - protein, 8 aa, Borrelia burgdorferi B31
IVACSSSD

SEQ ID NO: 4110 - protein, 8 aa, Borrelia burgdorferi B31
VACSSSDD

SEQ ID NO: 4111 - protein, 8 aa, Borrelia burgdorferi B31
ACSSSDDG

SEQ ID NO: 4112 - protein, 8 aa, Borrelia burgdorferi B31
CSSSDDGK

SEQ ID NO: 4113 - protein, 8 aa, Borrelia burgdorferi B31
SSSDDGKS

SEQ ID NO: 4114 - protein, 8 aa, Borrelia burgdorferi B31
SSDDGKSE

SEQ ID NO: 4115 - protein, 8 aa, Borrelia burgdorferi B31
SDDGKSEA

SEQ ID NO: 4116 - protein, 8 aa, Borrelia burgdorferi B31
DDGKSEAK

SEQ ID NO: 4117 - protein, 8 aa, Borrelia burgdorferi B31
DGKSEAKT

SEQ ID NO: 4118 - protein, 8 aa, Borrelia burgdorferi B31
GKSEAKTV

SEQ ID NO: 4119 - protein, 8 aa, Borrelia burgdorferi B31
KSEAKTVS

SEQ ID NO: 4120 - protein, 8 aa, Borrelia burgdorferi B31
SEAKTVSL

SEQ ID NO: 4121 - protein, 8 aa, Borrelia burgdorferi B31
EAKTVSLI

SEQ ID NO: 4122 - protein, 8 aa, Borrelia burgdorferi B31
AKTVSLIV

SEQ ID NO: 4123 - protein, 8 aa, Borrelia burgdorferi B31
KTVSLIVD

SEQ ID NO: 4124 - protein, 8 aa, Borrelia burgdorferi B31
TVSLIVDG

SEQ ID NO: 4125 - protein, 8 aa, Borrelia burgdorferi B31
VSLIVDGA

SEQ ID NO: 4126 - protein, 8 aa, Borrelia burgdorferi B31
SLIVDGAF

SEQ ID NO: 4127 - protein, 8 aa, Borrelia burgdorferi B31
LIVDGAFD

SEQ ID NO: 4128 - protein, 8 aa, Borrelia burgdorferi B31
IVDGAFDD

SEQ ID NO: 4129 - protein, 8 aa, Borrelia burgdorferi B31
VDGAFDDK

SEQ ID NO: 4130 - protein, 8 aa, Borrelia burgdorferi B31
DGAFDDKG

SEQ ID NO: 4131 - protein, 8 aa, Borrelia burgdorferi B31
GAFDDKGF

SEQ ID NO: 4132 - protein, 8 aa, Borrelia burgdorferi B31
AFDDKGFN

SEQ ID NO: 4133 - protein, 8 aa, Borrelia burgdorferi B31
FDDKGFNE

SEQ ID NO: 4134 - protein, 8 aa, Borrelia burgdorferi B31
DDKGFNES

SEQ ID NO: 4135 - protein, 8 aa, Borrelia burgdorferi B31
DKGFNESS

SEQ ID NO: 4136 - protein, 8 aa, Borrelia burgdorferi B31
KGFNESSS

SEQ ID NO: 4137 - protein, 8 aa, Borrelia burgdorferi B31
GFNESSSK

SEQ ID NO: 4138 - protein, 8 aa, Borrelia burgdorferi B31
FNESSSKA

SEQ ID NO: 4139 - protein, 8 aa, Borrelia burgdorferi B31
NESSSKAI

SEQ ID NO: 4140 - protein, 8 aa, Borrelia burgdorferi B31
ESSSKAIR

SEQ ID NO: 4141 - protein, 8 aa, Borrelia burgdorferi B31
SSSKAIRK

SEQ ID NO: 4142 - protein, 8 aa, Borrelia burgdorferi B31
SSKAIRKL

SEQ ID NO: 4143 - protein, 8 aa, Borrelia burgdorferi B31
SKAIRKLK

SEQ ID NO: 4144 - protein, 8 aa, Borrelia burgdorferi B31
KAIRKLKA

SEQ ID NO: 4145 - protein, 8 aa, Borrelia burgdorferi B31
AIRKLKAD

SEQ ID NO: 4146 - protein, 8 aa, Borrelia burgdorferi B31
IRKLKADL

SEQ ID NO: 4147 - protein, 8 aa, Borrelia burgdorferi B31
RKLKADLN

SEQ ID NO: 4148 - protein, 8 aa, Borrelia burgdorferi B31
KLKADLNI

SEQ ID NO: 4149 - protein, 8 aa, Borrelia burgdorferi B31
LKADLNIN

SEQ ID NO: 4150 - protein, 8 aa, Borrelia burgdorferi B31
KADLNINI

SEQ ID NO: 4151 - protein, 8 aa, Borrelia burgdorferi B31
ADLNINII

SEQ ID NO: 4152 - protein, 8 aa, Borrelia burgdorferi B31
DLNINIIE

SEQ ID NO: 4153 - protein, 8 aa, Borrelia burgdorferi B31
LNINIIEK

SEQ ID NO: 4154 - protein, 8 aa, Borrelia burgdorferi B31
NINIIEKA

SEQ ID NO: 4155 - protein, 8 aa, Borrelia burgdorferi B31
INIIEKAS

SEQ ID NO: 4156 - protein, 8 aa, Borrelia burgdorferi B31
NIIEKAST

SEQ ID NO: 4157 - protein, 8 aa, Borrelia burgdorferi B31
IIEKASTG

SEQ ID NO: 4158 - protein, 8 aa, Borrelia burgdorferi B31
IEKASTGN

SEQ ID NO: 4159 - protein, 8 aa, Borrelia burgdorferi B31
EKASTGNS

SEQ ID NO: 4160 - protein, 8 aa, Borrelia burgdorferi B31
KASTGNSY

SEQ ID NO: 4161 - protein, 8 aa, Borrelia burgdorferi B31
ASTGNSYL

SEQ ID NO: 4162 - protein, 8 aa, Borrelia burgdorferi B31
STGNSYLG

SEQ ID NO: 4163 - protein, 8 aa, Borrelia burgdorferi B31
TGNSYLGD

SEQ ID NO: 4164 - protein, 8 aa, Borrelia burgdorferi B31
GNSYLGDI

SEQ ID NO: 4165 - protein, 8 aa, Borrelia burgdorferi B31
NSYLGDIA

SEQ ID NO: 4166 - protein, 8 aa, Borrelia burgdorferi B31
SYLGDIAN

SEQ ID NO: 4167 - protein, 8 aa, Borrelia burgdorferi B31
YLGDIANL

SEQ ID NO: 4168 - protein, 8 aa, Borrelia burgdorferi B31
LGDIANLE

SEQ ID NO: 4169 - protein, 8 aa, Borrelia burgdorferi B31
GDIANLED

SEQ ID NO: 4170 - protein, 8 aa, Borrelia burgdorferi B31
DIANLEDG

SEQ ID NO: 4171 - protein, 8 aa, Borrelia burgdorferi B31
IANLEDGN

SEQ ID NO: 4172 - protein, 8 aa, Borrelia burgdorferi B31
ANLEDGNS

SEQ ID NO: 4173 - protein, 8 aa, Borrelia burgdorferi B31
NLEDGNSN

SEQ ID NO: 4174 - protein, 8 aa, Borrelia burgdorferi B31
LEDGNSNL

SEQ ID NO: 4175 - protein, 8 aa, Borrelia burgdorferi B31
EDGNSNLI

SEQ ID NO: 4176 - protein, 8 aa, Borrelia burgdorferi B31
DGNSNLIW

SEQ ID NO: 4177 - protein, 8 aa, Borrelia burgdorferi B31
GNSNLIWG

SEQ ID NO: 4178 - protein, 8 aa, Borrelia burgdorferi B31
NSNLIWGI

SEQ ID NO: 4179 - protein, 8 aa, Borrelia burgdorferi B31
SNLIWGIG

SEQ ID NO: 4180 - protein, 8 aa, Borrelia burgdorferi B31
NLIWGIGF

SEQ ID NO: 4181 - protein, 8 aa, Borrelia burgdorferi B31
LIWGIGFR

SEQ ID NO: 4182 - protein, 8 aa, Borrelia burgdorferi B31
IWGIGFRL

SEQ ID NO: 4183 - protein, 8 aa, Borrelia burgdorferi B31
WGIGFRLS

SEQ ID NO: 4184 - protein, 8 aa, Borrelia burgdorferi B31
GIGFRLSD

SEQ ID NO: 4185 - protein, 8 aa, Borrelia burgdorferi B31
IGFRLSDI

SEQ ID NO: 4186 - protein, 8 aa, Borrelia burgdorferi B31
GFRLSDIL

SEQ ID NO: 4187 - protein, 8 aa, Borrelia burgdorferi B31
FRLSDILF

SEQ ID NO: 4188 - protein, 8 aa, Borrelia burgdorferi B31
RLSDILFQ

SEQ ID NO: 4189 - protein, 8 aa, Borrelia burgdorferi B31
LSDILFQR

SEQ ID NO: 4190 - protein, 8 aa, Borrelia burgdorferi B31
SDILFQRA

SEQ ID NO: 4191 - protein, 8 aa, Borrelia burgdorferi B31
DILFQRAS

SEQ ID NO: 4192 - protein, 8 aa, Borrelia burgdorferi B31
ILFQRASE

SEQ ID NO: 4193 - protein, 8 aa, Borrelia burgdorferi B31
LFQRASEN

SEQ ID NO: 4194 - protein, 8 aa, Borrelia burgdorferi B31
FQRASENV

SEQ ID NO: 4195 - protein, 8 aa, Borrelia burgdorferi B31
QRASENVS

SEQ ID NO: 4196 - protein, 8 aa, Borrelia burgdorferi B31
RASENVSV

SEQ ID NO: 4197 - protein, 8 aa, Borrelia burgdorferi B31
ASENVSVN

SEQ ID NO: 4198 - protein, 8 aa, Borrelia burgdorferi B31
SENVSVNY

SEQ ID NO: 4199 - protein, 8 aa, Borrelia burgdorferi B31
ENVSVNYA

SEQ ID NO: 4200 - protein, 8 aa, Borrelia burgdorferi B31
NVSVNYAI

SEQ ID NO: 4201 - protein, 8 aa, Borrelia burgdorferi B31
VSVNYAII

SEQ ID NO: 4202 - protein, 8 aa, Borrelia burgdorferi B31
SVNYAIIE

SEQ ID NO: 4203 - protein, 8 aa, Borrelia burgdorferi B31
VNYAIIEG

SEQ ID NO: 4204 - protein, 8 aa, Borrelia burgdorferi B31
NYAIIEGV

SEQ ID NO: 4205 - protein, 8 aa, Borrelia burgdorferi B31
YAIIEGVY

SEQ ID NO: 4206 - protein, 8 aa, Borrelia burgdorferi B31
AIIEGVYD

SEQ ID NO: 4207 - protein, 8 aa, Borrelia burgdorferi B31
IIEGVYDE

SEQ ID NO: 4208 - protein, 8 aa, Borrelia burgdorferi B31
IEGVYDEI

SEQ ID NO: 4209 - protein, 8 aa, Borrelia burgdorferi B31
EGVYDEIQ

SEQ ID NO: 4210 - protein, 8 aa, Borrelia burgdorferi B31
GVYDEIQI

SEQ ID NO: 4211 - protein, 8 aa, Borrelia burgdorferi B31
VYDEIQIP

SEQ ID NO: 4212 - protein, 8 aa, Borrelia burgdorferi B31
YDEIQIPK

SEQ ID NO: 4213 - protein, 8 aa, Borrelia burgdorferi B31
DEIQIPKN

SEQ ID NO: 4214 - protein, 8 aa, Borrelia burgdorferi B31
EIQIPKNL

SEQ ID NO: 4215 - protein, 8 aa, Borrelia burgdorferi B31
IQIPKNLL

SEQ ID NO: 4216 - protein, 8 aa, Borrelia burgdorferi B31
QIPKNLLN

SEQ ID NO: 4217 - protein, 8 aa, Borrelia burgdorferi B31
IPKNLLNI

SEQ ID NO: 4218 - protein, 8 aa, Borrelia burgdorferi B31
PKNLLNIS

SEQ ID NO: 4219 - protein, 8 aa, Borrelia burgdorferi B31
KNLLNISF

SEQ ID NO: 4220 - protein, 8 aa, Borrelia burgdorferi B31
NLLNISFR

SEQ ID NO: 4221 - protein, 8 aa, Borrelia burgdorferi B31
LLNISFRS

SEQ ID NO: 4222 - protein, 8 aa, Borrelia burgdorferi B31
LNISFRSE

SEQ ID NO: 4223 - protein, 8 aa, Borrelia burgdorferi B31
NISFRSEE

SEQ ID NO: 4224 - protein, 8 aa, Borrelia burgdorferi B31
ISFRSEEV

SEQ ID NO: 4225 - protein, 8 aa, Borrelia burgdorferi B31
SFRSEEVA

SEQ ID NO: 4226 - protein, 8 aa, Borrelia burgdorferi B31
FRSEEVAF

SEQ ID NO: 4227 - protein, 8 aa, Borrelia burgdorferi B31
RSEEVAFL

SEQ ID NO: 4228 - protein, 8 aa, Borrelia burgdorferi B31
SEEVAFLA

SEQ ID NO: 4229 - protein, 8 aa, Borrelia burgdorferi B31
EEVAFLAG

SEQ ID NO: 4230 - protein, 8 aa, Borrelia burgdorferi B31
EVAFLAGY

SEQ ID NO: 4231 - protein, 8 aa, Borrelia burgdorferi B31
VAFLAGYF

SEQ ID NO: 4232 - protein, 8 aa, Borrelia burgdorferi B31
AFLAGYFA

SEQ ID NO: 4233 - protein, 8 aa, Borrelia burgdorferi B31
FLAGYFAS

SEQ ID NO: 4234 - protein, 8 aa, Borrelia burgdorferi B31
LAGYFASK

SEQ ID NO: 4235 - protein, 8 aa, Borrelia burgdorferi B31
AGYFASKA

SEQ ID NO: 4236 - protein, 8 aa, Borrelia burgdorferi B31
GYFASKAS

SEQ ID NO: 4237 - protein, 8 aa, Borrelia burgdorferi B31
YFASKASK

SEQ ID NO: 4238 - protein, 8 aa, Borrelia burgdorferi B31
FASKASKT

SEQ ID NO: 4239 - protein, 8 aa, Borrelia burgdorferi B31
ASKASKTG

SEQ ID NO: 4240 - protein, 8 aa, Borrelia burgdorferi B31
SKASKTGK

SEQ ID NO: 4241 - protein, 8 aa, Borrelia burgdorferi B31
KASKTGKI

SEQ ID NO: 4242 - protein, 8 aa, Borrelia burgdorferi B31
ASKTGKIG

SEQ ID NO: 4243 - protein, 8 aa, Borrelia burgdorferi B31
SKTGKIGF

SEQ ID NO: 4244 - protein, 8 aa, Borrelia burgdorferi B31
KTGKIGFV

SEQ ID NO: 4245 - protein, 8 aa, Borrelia burgdorferi B31
TGKIGFVG

SEQ ID NO: 4246 - protein, 8 aa, Borrelia burgdorferi B31
GKIGFVGG

SEQ ID NO: 4247 - protein, 8 aa, Borrelia burgdorferi B31
KIGFVGGV

SEQ ID NO: 4248 - protein, 8 aa, Borrelia burgdorferi B31
IGFVGGVR

SEQ ID NO: 4249 - protein, 8 aa, Borrelia burgdorferi B31
GFVGGVRG

SEQ ID NO: 4250 - protein, 8 aa, Borrelia burgdorferi B31
FVGGVRGK

SEQ ID NO: 4251 - protein, 8 aa, Borrelia burgdorferi B31
VGGVRGKV

SEQ ID NO: 4252 - protein, 8 aa, Borrelia burgdorferi B31
GGVRGKVL

SEQ ID NO: 4253 - protein, 8 aa, Borrelia burgdorferi B31
GVRGKVLE

SEQ ID NO: 4254 - protein, 8 aa, Borrelia burgdorferi B31
VRGKVLES

SEQ ID NO: 4255 - protein, 8 aa, Borrelia burgdorferi B31
RGKVLESF

SEQ ID NO: 4256 - protein, 8 aa, Borrelia burgdorferi B31
GKVLESFM

SEQ ID NO: 4257 - protein, 8 aa, Borrelia burgdorferi B31
KVLESFMY

SEQ ID NO: 4258 - protein, 8 aa, Borrelia burgdorferi B31
VLESFMYG

SEQ ID NO: 4259 - protein, 8 aa, Borrelia burgdorferi B31
LESFMYGY

SEQ ID NO: 4260 - protein, 8 aa, Borrelia burgdorferi B31
ESFMYGYE

SEQ ID NO: 4261 - protein, 8 aa, Borrelia burgdorferi B31
SFMYGYEA

SEQ ID NO: 4262 - protein, 8 aa, Borrelia burgdorferi B31
FMYGYEAG

SEQ ID NO: 4263 - protein, 8 aa, Borrelia burgdorferi B31
MYGYEAGA

SEQ ID NO: 4264 - protein, 8 aa, Borrelia burgdorferi B31
YGYEAGAK

SEQ ID NO: 4265 - protein, 8 aa, Borrelia burgdorferi B31
GYEAGAKY

SEQ ID NO: 4266 - protein, 8 aa, Borrelia burgdorferi B31
YEAGAKYA

SEQ ID NO: 4267 - protein, 8 aa, Borrelia burgdorferi B31
EAGAKYAN

SEQ ID NO: 4268 - protein, 8 aa, Borrelia burgdorferi B31
AGAKYANS

SEQ ID NO: 4269 - protein, 8 aa, Borrelia burgdorferi B31
GAKYANSN

SEQ ID NO: 4270 - protein, 8 aa, Borrelia burgdorferi B31
AKYANSNI

SEQ ID NO: 4271 - protein, 8 aa, Borrelia burgdorferi B31
KYANSNIK

SEQ ID NO: 4272 - protein, 8 aa, Borrelia burgdorferi B31
YANSNIKV

SEQ ID NO: 4273 - protein, 8 aa, Borrelia burgdorferi B31
ANSNIKVV

SEQ ID NO: 4274 - protein, 8 aa, Borrelia burgdorferi B31
NSNIKVVS

SEQ ID NO: 4275 - protein, 8 aa, Borrelia burgdorferi B31
SNIKVVSQ

SEQ ID NO: 4276 - protein, 8 aa, Borrelia burgdorferi B31
NIKVVSQY

SEQ ID NO: 4277 - protein, 8 aa, Borrelia burgdorferi B31
IKVVSQYV

SEQ ID NO: 4278 - protein, 8 aa, Borrelia burgdorferi B31
KVVSQYVG

SEQ ID NO: 4279 - protein, 8 aa, Borrelia burgdorferi B31
VVSQYVGT

SEQ ID NO: 4280 - protein, 8 aa, Borrelia burgdorferi B31
VSQYVGTF

SEQ ID NO: 4281 - protein, 8 aa, Borrelia burgdorferi B31
SQYVGTFG

SEQ ID NO: 4282 - protein, 8 aa, Borrelia burgdorferi B31
QYVGTFGD

SEQ ID NO: 4283 - protein, 8 aa, Borrelia burgdorferi B31
YVGTFGDF

SEQ ID NO: 4284 - protein, 8 aa, Borrelia burgdorferi B31
VGTFGDFG

SEQ ID NO: 4285 - protein, 8 aa, Borrelia burgdorferi B31
GTFGDFGL

SEQ ID NO: 4286 - protein, 8 aa, Borrelia burgdorferi B31
TFGDFGLG

SEQ ID NO: 4287 - protein, 8 aa, Borrelia burgdorferi B31
FGDFGLGR

SEQ ID NO: 4288 - protein, 8 aa, Borrelia burgdorferi B31
GDFGLGRS

SEQ ID NO: 4289 - protein, 8 aa, Borrelia burgdorferi B31
DFGLGRST

SEQ ID NO: 4290 - protein, 8 aa, Borrelia burgdorferi B31
FGLGRSTA

SEQ ID NO: 4291 - protein, 8 aa, Borrelia burgdorferi B31
GLGRSTAS

SEQ ID NO: 4292 - protein, 8 aa, Borrelia burgdorferi B31
LGRSTASN

SEQ ID NO: 4293 - protein, 8 aa, Borrelia burgdorferi B31
GRSTASNM

SEQ ID NO: 4294 - protein, 8 aa, Borrelia burgdorferi B31
RSTASNMY

SEQ ID NO: 4295 - protein, 8 aa, Borrelia burgdorferi B31
STASNMYR

SEQ ID NO: 4296 - protein, 8 aa, Borrelia burgdorferi B31
TASNMYRD

SEQ ID NO: 4297 - protein, 8 aa, Borrelia burgdorferi B31
ASNMYRDG

SEQ ID NO: 4298 - protein, 8 aa, Borrelia burgdorferi B31
SNMYRDGV

SEQ ID NO: 4299 - protein, 8 aa, Borrelia burgdorferi B31
NMYRDGVD

SEQ ID NO: 4300 - protein, 8 aa, Borrelia burgdorferi B31
MYRDGVDI

SEQ ID NO: 4301 - protein, 8 aa, Borrelia burgdorferi B31
YRDGVDII

SEQ ID NO: 4302 - protein, 8 aa, Borrelia burgdorferi B31
RDGVDIIF

SEQ ID NO: 4303 - protein, 8 aa, Borrelia burgdorferi B31
DGVDIIFA

SEQ ID NO: 4304 - protein, 8 aa, Borrelia burgdorferi B31
GVDIIFAA

SEQ ID NO: 4305 - protein, 8 aa, Borrelia burgdorferi B31
VDIIFAAA

SEQ ID NO: 4306 - protein, 8 aa, Borrelia burgdorferi B31
DIIFAAAG

SEQ ID NO: 4307 - protein, 8 aa, Borrelia burgdorferi B31
IIFAAAGL

SEQ ID NO: 4308 - protein, 8 aa, Borrelia burgdorferi B31
IFAAAGLS

SEQ ID NO: 4309 - protein, 8 aa, Borrelia burgdorferi B31
FAAAGLSG

SEQ ID NO: 4310 - protein, 8 aa, Borrelia burgdorferi B31
AAAGLSGI

SEQ ID NO: 4311 - protein, 8 aa, Borrelia burgdorferi B31
AAGLSGIG

SEQ ID NO: 4312 - protein, 8 aa, Borrelia burgdorferi B31
AGLSGIGV

SEQ ID NO: 4313 - protein, 8 aa, Borrelia burgdorferi B31
GLSGIGVI

SEQ ID NO: 4314 - protein, 8 aa, Borrelia burgdorferi B31
LSGIGVIE

SEQ ID NO: 4315 - protein, 8 aa, Borrelia burgdorferi B31
SGIGVIEA

SEQ ID NO: 4316 - protein, 8 aa, Borrelia burgdorferi B31
GIGVIEAA

SEQ ID NO: 4317 - protein, 8 aa, Borrelia burgdorferi B31
IGVIEAAK

SEQ ID NO: 4318 - protein, 8 aa, Borrelia burgdorferi B31
GVIEAAKE

SEQ ID NO: 4319 - protein, 8 aa, Borrelia burgdorferi B31
VIEAAKEL

SEQ ID NO: 4320 - protein, 8 aa, Borrelia burgdorferi B31
IEAAKELG

SEQ ID NO: 4321 - protein, 8 aa, Borrelia burgdorferi B31
EAAKELGP

SEQ ID NO: 4322 - protein, 8 aa, Borrelia burgdorferi B31
AAKELGPD

SEQ ID NO: 4323 - protein, 8 aa, Borrelia burgdorferi B31
AKELGPDH

SEQ ID NO: 4324 - protein, 8 aa, Borrelia burgdorferi B31
KELGPDHY

SEQ ID NO: 4325 - protein, 8 aa, Borrelia burgdorferi B31
ELGPDHYI

SEQ ID NO: 4326 - protein, 8 aa, Borrelia burgdorferi B31
LGPDHYII

SEQ ID NO: 4327 - protein, 8 aa, Borrelia burgdorferi B31
GPDHYIIG

SEQ ID NO: 4328 - protein, 8 aa, Borrelia burgdorferi B31
PDHYIIGV

SEQ ID NO: 4329 - protein, 8 aa, Borrelia burgdorferi B31
DHYIIGVD

SEQ ID NO: 4330 - protein, 8 aa, Borrelia burgdorferi B31
HYIIGVDQ

SEQ ID NO: 4331 - protein, 8 aa, Borrelia burgdorferi B31
YIIGVDQD

SEQ ID NO: 4332 - protein, 8 aa, Borrelia burgdorferi B31
IIGVDQDQ

SEQ ID NO: 4333 - protein, 8 aa, Borrelia burgdorferi B31
IGVDQDQS

SEQ ID NO: 4334 - protein, 8 aa, Borrelia burgdorferi B31
GVDQDQSY

SEQ ID NO: 4335 - protein, 8 aa, Borrelia burgdorferi B31
VDQDQSYL

SEQ ID NO: 4336 - protein, 8 aa, Borrelia burgdorferi B31
DQDQSYLA

SEQ ID NO: 4337 - protein, 8 aa, Borrelia burgdorferi B31
QDQSYLAP

SEQ ID NO: 4338 - protein, 8 aa, Borrelia burgdorferi B31
DQSYLAPN

SEQ ID NO: 4339 - protein, 8 aa, Borrelia burgdorferi B31
QSYLAPNN

SEQ ID NO: 4340 - protein, 8 aa, Borrelia burgdorferi B31
SYLAPNNV

SEQ ID NO: 4341 - protein, 8 aa, Borrelia burgdorferi B31
YLAPNNVI

SEQ ID NO: 4342 - protein, 8 aa, Borrelia burgdorferi B31
LAPNNVIV

SEQ ID NO: 4343 - protein, 8 aa, Borrelia burgdorferi B31
APNNVIVS

SEQ ID NO: 4344 - protein, 8 aa, Borrelia burgdorferi B31
PNNVIVSA

SEQ ID NO: 4345 - protein, 8 aa, Borrelia burgdorferi B31
NNVIVSAV

SEQ ID NO: 4346 - protein, 8 aa, Borrelia burgdorferi B31
NVIVSAVK

SEQ ID NO: 4347 - protein, 8 aa, Borrelia burgdorferi B31
VIVSAVKK

SEQ ID NO: 4348 - protein, 8 aa, Borrelia burgdorferi B31
IVSAVKKV

SEQ ID NO: 4349 - protein, 8 aa, Borrelia burgdorferi B31
VSAVKKVD

SEQ ID NO: 4350 - protein, 8 aa, Borrelia burgdorferi B31
SAVKKVDS

SEQ ID NO: 4351 - protein, 8 aa, Borrelia burgdorferi B31
AVKKVDSL

SEQ ID NO: 4352 - protein, 8 aa, Borrelia burgdorferi B31
VKKVDSLM

SEQ ID NO: 4353 - protein, 8 aa, Borrelia burgdorferi B31
KKVDSLMY

SEQ ID NO: 4354 - protein, 8 aa, Borrelia burgdorferi B31
KVDSLMYS

SEQ ID NO: 4355 - protein, 8 aa, Borrelia burgdorferi B31
VDSLMYSL

SEQ ID NO: 4356 - protein, 8 aa, Borrelia burgdorferi B31
DSLMYSLT

SEQ ID NO: 4357 - protein, 8 aa, Borrelia burgdorferi B31
SLMYSLTK

SEQ ID NO: 4358 - protein, 8 aa, Borrelia burgdorferi B31
LMYSLTKK

SEQ ID NO: 4359 - protein, 8 aa, Borrelia burgdorferi B31
MYSLTKKY

SEQ ID NO: 4360 - protein, 8 aa, Borrelia burgdorferi B31
YSLTKKYL

SEQ ID NO: 4361 - protein, 8 aa, Borrelia burgdorferi B31
SLTKKYLE

SEQ ID NO: 4362 - protein, 8 aa, Borrelia burgdorferi B31
LTKKYLET

SEQ ID NO: 4363 - protein, 8 aa, Borrelia burgdorferi B31
TKKYLETG

SEQ ID NO: 4364 - protein, 8 aa, Borrelia burgdorferi B31
KKYLETGV

SEQ ID NO: 4365 - protein, 8 aa, Borrelia burgdorferi B31
KYLETGVL

SEQ ID NO: 4366 - protein, 8 aa, Borrelia burgdorferi B31
YLETGVLD

SEQ ID NO: 4367 - protein, 8 aa, Borrelia burgdorferi B31
LETGVLDG

SEQ ID NO: 4368 - protein, 8 aa, Borrelia burgdorferi B31
ETGVLDGG

SEQ ID NO: 4369 - protein, 8 aa, Borrelia burgdorferi B31
TGVLDGGK

SEQ ID NO: 4370 - protein, 8 aa, Borrelia burgdorferi B31
GVLDGGKT

SEQ ID NO: 4371 - protein, 8 aa, Borrelia burgdorferi B31
VLDGGKTM

SEQ ID NO: 4372 - protein, 8 aa, Borrelia burgdorferi B31
LDGGKTMF

SEQ ID NO: 4373 - protein, 8 aa, Borrelia burgdorferi B31
DGGKTMFL

SEQ ID NO: 4374 - protein, 8 aa, Borrelia burgdorferi B31
GGKTMFLG

SEQ ID NO: 4375 - protein, 8 aa, Borrelia burgdorferi B31
GKTMFLGL

SEQ ID NO: 4376 - protein, 8 aa, Borrelia burgdorferi B31
KTMFLGLK

SEQ ID NO: 4377 - protein, 8 aa, Borrelia burgdorferi B31
TMFLGLKE

SEQ ID NO: 4378 - protein, 8 aa, Borrelia burgdorferi B31
MFLGLKED

SEQ ID NO: 4379 - protein, 8 aa, Borrelia burgdorferi B31
FLGLKEDG

SEQ ID NO: 4380 - protein, 8 aa, Borrelia burgdorferi B31
LGLKEDGL

SEQ ID NO: 4381 - protein, 8 aa, Borrelia burgdorferi B31
GLKEDGLG

SEQ ID NO: 4382 - protein, 8 aa, Borrelia burgdorferi B31
LKEDGLGL

SEQ ID NO: 4383 - protein, 8 aa, Borrelia burgdorferi B31
KEDGLGLV

SEQ ID NO: 4384 - protein, 8 aa, Borrelia burgdorferi B31
EDGLGLVL

SEQ ID NO: 4385 - protein, 8 aa, Borrelia burgdorferi B31
DGLGLVLN

SEQ ID NO: 4386 - protein, 8 aa, Borrelia burgdorferi B31
GLGLVLNE

SEQ ID NO: 4387 - protein, 8 aa, Borrelia burgdorferi B31
LGLVLNEN

SEQ ID NO: 4388 - protein, 8 aa, Borrelia burgdorferi B31
GLVLNENL

SEQ ID NO: 4389 - protein, 8 aa, Borrelia burgdorferi B31
LVLNENLK

SEQ ID NO: 4390 - protein, 8 aa, Borrelia burgdorferi B31
VLNENLKS

SEQ ID NO: 4391 - protein, 8 aa, Borrelia burgdorferi B31
LNENLKSN

SEQ ID NO: 4392 - protein, 8 aa, Borrelia burgdorferi B31
NENLKSNY

SEQ ID NO: 4393 - protein, 8 aa, Borrelia burgdorferi B31
ENLKSNYS

SEQ ID NO: 4394 - protein, 8 aa, Borrelia burgdorferi B31
NLKSNYSE

SEQ ID NO: 4395 - protein, 8 aa, Borrelia burgdorferi B31
LKSNYSEI

SEQ ID NO: 4396 - protein, 8 aa, Borrelia burgdorferi B31
KSNYSEIY

SEQ ID NO: 4397 - protein, 8 aa, Borrelia burgdorferi B31
SNYSEIYN

SEQ ID NO: 4398 - protein, 8 aa, Borrelia burgdorferi B31
NYSEIYNK

SEQ ID NO: 4399 - protein, 8 aa, Borrelia burgdorferi B31
YSEIYNKS

SEQ ID NO: 4400 - protein, 8 aa, Borrelia burgdorferi B31
SEIYNKSL

SEQ ID NO: 4401 - protein, 8 aa, Borrelia burgdorferi B31
EIYNKSLK

SEQ ID NO: 4402 - protein, 8 aa, Borrelia burgdorferi B31
IYNKSLKI

SEQ ID NO: 4403 - protein, 8 aa, Borrelia burgdorferi B31
YNKSLKIG

SEQ ID NO: 4404 - protein, 8 aa, Borrelia burgdorferi B31
NKSLKIGQ

SEQ ID NO: 4405 - protein, 8 aa, Borrelia burgdorferi B31
KSLKIGQS

SEQ ID NO: 4406 - protein, 8 aa, Borrelia burgdorferi B31
SLKIGQSI

SEQ ID NO: 4407 - protein, 8 aa, Borrelia burgdorferi B31
LKIGQSIM

SEQ ID NO: 4408 - protein, 8 aa, Borrelia burgdorferi B31
KIGQSIMN

SEQ ID NO: 4409 - protein, 8 aa, Borrelia burgdorferi B31
IGQSIMNG

SEQ ID NO: 4410 - protein, 8 aa, Borrelia burgdorferi B31
GQSIMNGI

SEQ ID NO: 4411 - protein, 8 aa, Borrelia burgdorferi B31
QSIMNGII

SEQ ID NO: 4412 - protein, 8 aa, Borrelia burgdorferi B31
SIMNGIIK

SEQ ID NO: 4413 - protein, 8 aa, Borrelia burgdorferi B31
IMNGIIKV

SEQ ID NO: 4414 - protein, 8 aa, Borrelia burgdorferi B31
MNGIIKVP

SEQ ID NO: 4415 - protein, 8 aa, Borrelia burgdorferi B31
NGIIKVPY

SEQ ID NO: 4416 - protein, 8 aa, Borrelia burgdorferi B31
GIIKVPYD

SEQ ID NO: 4417 - protein, 8 aa, Borrelia burgdorferi B31
IIKVPYDK

SEQ ID NO: 4418 - protein, 8 aa, Borrelia burgdorferi B31
IKVPYDKV

SEQ ID NO: 4419 - protein, 8 aa, Borrelia burgdorferi B31
KVPYDKVS

SEQ ID NO: 4420 - protein, 8 aa, Borrelia burgdorferi B31
VPYDKVSY

SEQ ID NO: 4421 - protein, 8 aa, Borrelia burgdorferi B31
PYDKVSYF

SEQ ID NO: 4422 - protein, 8 aa, Borrelia burgdorferi B31
YDKVSYFV

SEQ ID NO: 4423 - protein, 8 aa, Borrelia burgdorferi B31
DKVSYFVL

SEQ ID NO: 4424 - protein, 8 aa, Borrelia burgdorferi B31
KVSYFVLQ

SEQ ID NO: 4425 - protein, 8 aa, Borrelia burgdorferi B31
VSYFVLQM

SEQ ID NO: 4426 - protein, 8 aa, Borrelia burgdorferi B31
SYFVLQME

SEQ ID NO: 4427 - protein, 8 aa, Borrelia burgdorferi B31
YFVLQMEN

SEQ ID NO: 4428 - protein, 9 aa, Borrelia burgdorferi B31
MDNYYEIYF

SEQ ID NO: 4429 - protein, 9 aa, Borrelia burgdorferi B31
DNYYEIYFL

SEQ ID NO: 4430 - protein, 9 aa, Borrelia burgdorferi B31
NYYEIYFLY

SEQ ID NO: 4431 - protein, 9 aa, Borrelia burgdorferi B31
YYEIYFLYF

SEQ ID NO: 4432 - protein, 9 aa, Borrelia burgdorferi B31
YEIYFLYFF

SEQ ID NO: 4433 - protein, 9 aa, Borrelia burgdorferi B31
EIYFLYFFI

SEQ ID NO: 4434 - protein, 9 aa, Borrelia burgdorferi B31
IYFLYFFIK

SEQ ID NO: 4435 - protein, 9 aa, Borrelia burgdorferi B31
YFLYFFIKS

SEQ ID NO: 4436 - protein, 9 aa, Borrelia burgdorferi B31
FLYFFIKSK

SEQ ID NO: 4437 - protein, 9 aa, Borrelia burgdorferi B31
LYFFIKSKE

SEQ ID NO: 4438 - protein, 9 aa, Borrelia burgdorferi B31
YFFIKSKED

SEQ ID NO: 4439 - protein, 9 aa, Borrelia burgdorferi B31
FFIKSKEDI

SEQ ID NO: 4440 - protein, 9 aa, Borrelia burgdorferi B31
FIKSKEDIF

SEQ ID NO: 4441 - protein, 9 aa, Borrelia burgdorferi B31
IKSKEDIFM

SEQ ID NO: 4442 - protein, 9 aa, Borrelia burgdorferi B31
KSKEDIFML

SEQ ID NO: 4443 - protein, 9 aa, Borrelia burgdorferi B31
SKEDIFMLK

SEQ ID NO: 4444 - protein, 9 aa, Borrelia burgdorferi B31
KEDIFMLKK

SEQ ID NO: 4445 - protein, 9 aa, Borrelia burgdorferi B31
EDIFMLKKV

SEQ ID NO: 4446 - protein, 9 aa, Borrelia burgdorferi B31
DIFMLKKVY

SEQ ID NO: 4447 - protein, 9 aa, Borrelia burgdorferi B31
IFMLKKVYY

SEQ ID NO: 4448 - protein, 9 aa, Borrelia burgdorferi B31
FMLKKVYYF

SEQ ID NO: 4449 - protein, 9 aa, Borrelia burgdorferi B31
MLKKVYYFL

SEQ ID NO: 4450 - protein, 9 aa, Borrelia burgdorferi B31
LKKVYYFLI

SEQ ID NO: 4451 - protein, 9 aa, Borrelia burgdorferi B31
KKVYYFLIF

SEQ ID NO: 4452 - protein, 9 aa, Borrelia burgdorferi B31
KVYYFLIFL

SEQ ID NO: 4453 - protein, 9 aa, Borrelia burgdorferi B31
VYYFLIFLF

SEQ ID NO: 4454 - protein, 9 aa, Borrelia burgdorferi B31
YYFLIFLFI

SEQ ID NO: 4455 - protein, 9 aa, Borrelia burgdorferi B31
YFLIFLFIV

SEQ ID NO: 4456 - protein, 9 aa, Borrelia burgdorferi B31
FLIFLFIVA

SEQ ID NO: 4457 - protein, 9 aa, Borrelia burgdorferi B31
LIFLFIVAC

SEQ ID NO: 4458 - protein, 9 aa, Borrelia burgdorferi B31
IFLFIVACS

SEQ ID NO: 4459 - protein, 9 aa, Borrelia burgdorferi B31
FLFIVACSS

SEQ ID NO: 4460 - protein, 9 aa, Borrelia burgdorferi B31
LFIVACSSS

SEQ ID NO: 4461 - protein, 9 aa, Borrelia burgdorferi B31
FIVACSSSD

SEQ ID NO: 4462 - protein, 9 aa, Borrelia burgdorferi B31
IVACSSSDD

SEQ ID NO: 4463 - protein, 9 aa, Borrelia burgdorferi B31
VACSSSDDG

SEQ ID NO: 4464 - protein, 9 aa, Borrelia burgdorferi B31
ACSSSDDGK

SEQ ID NO: 4465 - protein, 9 aa, Borrelia burgdorferi B31
CSSSDDGKS

SEQ ID NO: 4466 - protein, 9 aa, Borrelia burgdorferi B31
SSSDDGKSE

SEQ ID NO: 4467 - protein, 9 aa, Borrelia burgdorferi B31
SSDDGKSEA

SEQ ID NO: 4468 - protein, 9 aa, Borrelia burgdorferi B31
SDDGKSEAK

SEQ ID NO: 4469 - protein, 9 aa, Borrelia burgdorferi B31
DDGKSEAKT

SEQ ID NO: 4470 - protein, 9 aa, Borrelia burgdorferi B31
DGKSEAKTV

SEQ ID NO: 4471 - protein, 9 aa, Borrelia burgdorferi B31
GKSEAKTVS

SEQ ID NO: 4472 - protein, 9 aa, Borrelia burgdorferi B31
KSEAKTVSL

SEQ ID NO: 4473 - protein, 9 aa, Borrelia burgdorferi B31
SEAKTVSLI

SEQ ID NO: 4474 - protein, 9 aa, Borrelia burgdorferi B31
EAKTVSLIV

SEQ ID NO: 4475 - protein, 9 aa, Borrelia burgdorferi B31
AKTVSLIVD

SEQ ID NO: 4476 - protein, 9 aa, Borrelia burgdorferi B31
KTVSLIVDG

SEQ ID NO: 4477 - protein, 9 aa, Borrelia burgdorferi B31
TVSLIVDGA

SEQ ID NO: 4478 - protein, 9 aa, Borrelia burgdorferi B31
VSLIVDGAF

SEQ ID NO: 4479 - protein, 9 aa, Borrelia burgdorferi B31
SLIVDGAFD

SEQ ID NO: 4480 - protein, 9 aa, Borrelia burgdorferi B31
LIVDGAFDD

SEQ ID NO: 4481 - protein, 9 aa, Borrelia burgdorferi B31
IVDGAFDDK

SEQ ID NO: 4482 - protein, 9 aa, Borrelia burgdorferi B31
VDGAFDDKG

SEQ ID NO: 4483 - protein, 9 aa, Borrelia burgdorferi B31
DGAFDDKGF

SEQ ID NO: 4484 - protein, 9 aa, Borrelia burgdorferi B31
GAFDDKGFN

SEQ ID NO: 4485 - protein, 9 aa, Borrelia burgdorferi B31
AFDDKGFNE

SEQ ID NO: 4486 - protein, 9 aa, Borrelia burgdorferi B31
FDDKGFNES

SEQ ID NO: 4487 - protein, 9 aa, Borrelia burgdorferi B31
DDKGFNESS

SEQ ID NO: 4488 - protein, 9 aa, Borrelia burgdorferi B31
DKGFNESSS

SEQ ID NO: 4489 - protein, 9 aa, Borrelia burgdorferi B31
KGFNESSSK

SEQ ID NO: 4490 - protein, 9 aa, Borrelia burgdorferi B31
GFNESSSKA

SEQ ID NO: 4491 - protein, 9 aa, Borrelia burgdorferi B31
FNESSSKAI

SEQ ID NO: 4492 - protein, 9 aa, Borrelia burgdorferi B31
NESSSKAIR

SEQ ID NO: 4493 - protein, 9 aa, Borrelia burgdorferi B31
ESSSKAIRK

SEQ ID NO: 4494 - protein, 9 aa, Borrelia burgdorferi B31
SSSKAIRKL

SEQ ID NO: 4495 - protein, 9 aa, Borrelia burgdorferi B31
SSKAIRKLK

SEQ ID NO: 4496 - protein, 9 aa, Borrelia burgdorferi B31
SKAIRKLKA

SEQ ID NO: 4497 - protein, 9 aa, Borrelia burgdorferi B31
KAIRKLKAD

SEQ ID NO: 4498 - protein, 9 aa, Borrelia burgdorferi B31
AIRKLKADL

SEQ ID NO: 4499 - protein, 9 aa, Borrelia burgdorferi B31
IRKLKADLN

SEQ ID NO: 4500 - protein, 9 aa, Borrelia burgdorferi B31
RKLKADLNI

SEQ ID NO: 4501 - protein, 9 aa, Borrelia burgdorferi B31
KLKADLNIN

SEQ ID NO: 4502 - protein, 9 aa, Borrelia burgdorferi B31
LKADLNINI

SEQ ID NO: 4503 - protein, 9 aa, Borrelia burgdorferi B31
KADLNINII

SEQ ID NO: 4504 - protein, 9 aa, Borrelia burgdorferi B31
ADLNINIIE

SEQ ID NO: 4505 - protein, 9 aa, Borrelia burgdorferi B31
DLNINIIEK

SEQ ID NO: 4506 - protein, 9 aa, Borrelia burgdorferi B31
LNINIIEKA

SEQ ID NO: 4507 - protein, 9 aa, Borrelia burgdorferi B31
NINIIEKAS

SEQ ID NO: 4508 - protein, 9 aa, Borrelia burgdorferi B31
INIIEKAST

SEQ ID NO: 4509 - protein, 9 aa, Borrelia burgdorferi B31
NIIEKASTG

SEQ ID NO: 4510 - protein, 9 aa, Borrelia burgdorferi B31
IIEKASTGN

SEQ ID NO: 4511 - protein, 9 aa, Borrelia burgdorferi B31
IEKASTGNS

SEQ ID NO: 4512 - protein, 9 aa, Borrelia burgdorferi B31
EKASTGNSY

SEQ ID NO: 4513 - protein, 9 aa, Borrelia burgdorferi B31
KASTGNSYL

SEQ ID NO: 4514 - protein, 9 aa, Borrelia burgdorferi B31
ASTGNSYLG

SEQ ID NO: 4515 - protein, 9 aa, Borrelia burgdorferi B31
STGNSYLGD

SEQ ID NO: 4516 - protein, 9 aa, Borrelia burgdorferi B31
TGNSYLGDI

SEQ ID NO: 4517 - protein, 9 aa, Borrelia burgdorferi B31
GNSYLGDIA

SEQ ID NO: 4518 - protein, 9 aa, Borrelia burgdorferi B31
NSYLGDIAN

SEQ ID NO: 4519 - protein, 9 aa, Borrelia burgdorferi B31
SYLGDIANL

SEQ ID NO: 4520 - protein, 9 aa, Borrelia burgdorferi B31
YLGDIANLE

SEQ ID NO: 4521 - protein, 9 aa, Borrelia burgdorferi B31
LGDIANLED

SEQ ID NO: 4522 - protein, 9 aa, Borrelia burgdorferi B31
GDIANLEDG

SEQ ID NO: 4523 - protein, 9 aa, Borrelia burgdorferi B31
DIANLEDGN

SEQ ID NO: 4524 - protein, 9 aa, Borrelia burgdorferi B31
IANLEDGNS

SEQ ID NO: 4525 - protein, 9 aa, Borrelia burgdorferi B31
ANLEDGNSN

SEQ ID NO: 4526 - protein, 9 aa, Borrelia burgdorferi B31
NLEDGNSNL

SEQ ID NO: 4527 - protein, 9 aa, Borrelia burgdorferi B31
LEDGNSNLI

SEQ ID NO: 4528 - protein, 9 aa, Borrelia burgdorferi B31
EDGNSNLIW

SEQ ID NO: 4529 - protein, 9 aa, Borrelia burgdorferi B31
DGNSNLIWG

SEQ ID NO: 4530 - protein, 9 aa, Borrelia burgdorferi B31
GNSNLIWGI

SEQ ID NO: 4531 - protein, 9 aa, Borrelia burgdorferi B31
NSNLIWGIG

SEQ ID NO: 4532 - protein, 9 aa, Borrelia burgdorferi B31
SNLIWGIGF

SEQ ID NO: 4533 - protein, 9 aa, Borrelia burgdorferi B31
NLIWGIGFR

SEQ ID NO: 4534 - protein, 9 aa, Borrelia burgdorferi B31
LIWGIGFRL

SEQ ID NO: 4535 - protein, 9 aa, Borrelia burgdorferi B31
IWGIGFRLS

SEQ ID NO: 4536 - protein, 9 aa, Borrelia burgdorferi B31
WGIGFRLSD

SEQ ID NO: 4537 - protein, 9 aa, Borrelia burgdorferi B31
GIGFRLSDI

SEQ ID NO: 4538 - protein, 9 aa, Borrelia burgdorferi B31
IGFRLSDIL

SEQ ID NO: 4539 - protein, 9 aa, Borrelia burgdorferi B31
GFRLSDILF

SEQ ID NO: 4540 - protein, 9 aa, Borrelia burgdorferi B31
FRLSDILFQ

SEQ ID NO: 4541 - protein, 9 aa, Borrelia burgdorferi B31
RLSDILFQR

SEQ ID NO: 4542 - protein, 9 aa, Borrelia burgdorferi B31
LSDILFQRA

SEQ ID NO: 4543 - protein, 9 aa, Borrelia burgdorferi B31
SDILFQRAS

SEQ ID NO: 4544 - protein, 9 aa, Borrelia burgdorferi B31
DILFQRASE

SEQ ID NO: 4545 - protein, 9 aa, Borrelia burgdorferi B31
ILFQRASEN

SEQ ID NO: 4546 - protein, 9 aa, Borrelia burgdorferi B31
LFQRASENV

SEQ ID NO: 4547 - protein, 9 aa, Borrelia burgdorferi B31
FQRASENVS

SEQ ID NO: 4548 - protein, 9 aa, Borrelia burgdorferi B31
QRASENVSV

SEQ ID NO: 4549 - protein, 9 aa, Borrelia burgdorferi B31
RASENVSVN

SEQ ID NO: 4550 - protein, 9 aa, Borrelia burgdorferi B31
ASENVSVNY

SEQ ID NO: 4551 - protein, 9 aa, Borrelia burgdorferi B31
SENVSVNYA

SEQ ID NO: 4552 - protein, 9 aa, Borrelia burgdorferi B31
ENVSVNYAI

SEQ ID NO: 4553 - protein, 9 aa, Borrelia burgdorferi B31
NVSVNYAII

SEQ ID NO: 4554 - protein, 9 aa, Borrelia burgdorferi B31
VSVNYAIIE

SEQ ID NO: 4555 - protein, 9 aa, Borrelia burgdorferi B31
SVNYAIIEG

SEQ ID NO: 4556 - protein, 9 aa, Borrelia burgdorferi B31
VNYAIIEGV

SEQ ID NO: 4557 - protein, 9 aa, Borrelia burgdorferi B31
NYAIIEGVY

SEQ ID NO: 4558 - protein, 9 aa, Borrelia burgdorferi B31
YAIIEGVYD

SEQ ID NO: 4559 - protein, 9 aa, Borrelia burgdorferi B31
AIIEGVYDE

SEQ ID NO: 4560 - protein, 9 aa, Borrelia burgdorferi B31
IIEGVYDEI

SEQ ID NO: 4561 - protein, 9 aa, Borrelia burgdorferi B31
IEGVYDEIQ

SEQ ID NO: 4562 - protein, 9 aa, Borrelia burgdorferi B31
EGVYDEIQI

SEQ ID NO: 4563 - protein, 9 aa, Borrelia burgdorferi B31
GVYDEIQIP

SEQ ID NO: 4564 - protein, 9 aa, Borrelia burgdorferi B31
VYDEIQIPK

SEQ ID NO: 4565 - protein, 9 aa, Borrelia burgdorferi B31
YDEIQIPKN

SEQ ID NO: 4566 - protein, 9 aa, Borrelia burgdorferi B31
DEIQIPKNL

SEQ ID NO: 4567 - protein, 9 aa, Borrelia burgdorferi B31
EIQIPKNLL

SEQ ID NO: 4568 - protein, 9 aa, Borrelia burgdorferi B31
IQIPKNLLN

SEQ ID NO: 4569 - protein, 9 aa, Borrelia burgdorferi B31
QIPKNLLNI

SEQ ID NO: 4570 - protein, 9 aa, Borrelia burgdorferi B31
IPKNLLNIS

SEQ ID NO: 4571 - protein, 9 aa, Borrelia burgdorferi B31
PKNLLNISF

SEQ ID NO: 4572 - protein, 9 aa, Borrelia burgdorferi B31
KNLLNISFR

SEQ ID NO: 4573 - protein, 9 aa, Borrelia burgdorferi B31
NLLNISFRS

SEQ ID NO: 4574 - protein, 9 aa, Borrelia burgdorferi B31
LLNISFRSE

SEQ ID NO: 4575 - protein, 9 aa, Borrelia burgdorferi B31
LNISFRSEE

SEQ ID NO: 4576 - protein, 9 aa, Borrelia burgdorferi B31
NISFRSEEV

SEQ ID NO: 4577 - protein, 9 aa, Borrelia burgdorferi B31
ISFRSEEVA

SEQ ID NO: 4578 - protein, 9 aa, Borrelia burgdorferi B31
SFRSEEVAF

SEQ ID NO: 4579 - protein, 9 aa, Borrelia burgdorferi B31
FRSEEVAFL

SEQ ID NO: 4580 - protein, 9 aa, Borrelia burgdorferi B31
RSEEVAFLA

SEQ ID NO: 4581 - protein, 9 aa, Borrelia burgdorferi B31
SEEVAFLAG

SEQ ID NO: 4582 - protein, 9 aa, Borrelia burgdorferi B31
EEVAFLAGY

SEQ ID NO: 4583 - protein, 9 aa, Borrelia burgdorferi B31
EVAFLAGYF

SEQ ID NO: 4584 - protein, 9 aa, Borrelia burgdorferi B31
VAFLAGYFA

SEQ ID NO: 4585 - protein, 9 aa, Borrelia burgdorferi B31
AFLAGYFAS

SEQ ID NO: 4586 - protein, 9 aa, Borrelia burgdorferi B31
FLAGYFASK

SEQ ID NO: 4587 - protein, 9 aa, Borrelia burgdorferi B31
LAGYFASKA

SEQ ID NO: 4588 - protein, 9 aa, Borrelia burgdorferi B31
AGYFASKAS

SEQ ID NO: 4589 - protein, 9 aa, Borrelia burgdorferi B31
GYFASKASK

SEQ ID NO: 4590 - protein, 9 aa, Borrelia burgdorferi B31
YFASKASKT

SEQ ID NO: 4591 - protein, 9 aa, Borrelia burgdorferi B31
FASKASKTG

SEQ ID NO: 4592 - protein, 9 aa, Borrelia burgdorferi B31
ASKASKTGK

SEQ ID NO: 4593 - protein, 9 aa, Borrelia burgdorferi B31
SKASKTGKI

SEQ ID NO: 4594 - protein, 9 aa, Borrelia burgdorferi B31
KASKTGKIG

SEQ ID NO: 4595 - protein, 9 aa, Borrelia burgdorferi B31
ASKTGKIGF

SEQ ID NO: 4596 - protein, 9 aa, Borrelia burgdorferi B31
SKTGKIGFV

SEQ ID NO: 4597 - protein, 9 aa, Borrelia burgdorferi B31
KTGKIGFVG

SEQ ID NO: 4598 - protein, 9 aa, Borrelia burgdorferi B31
TGKIGFVGG

SEQ ID NO: 4599 - protein, 9 aa, Borrelia burgdorferi B31
GKIGFVGGV

SEQ ID NO: 4600 - protein, 9 aa, Borrelia burgdorferi B31
KIGFVGGVR

SEQ ID NO: 4601 - protein, 9 aa, Borrelia burgdorferi B31
IGFVGGVRG

SEQ ID NO: 4602 - protein, 9 aa, Borrelia burgdorferi B31
GFVGGVRGK

SEQ ID NO: 4603 - protein, 9 aa, Borrelia burgdorferi B31
FVGGVRGKV

SEQ ID NO: 4604 - protein, 9 aa, Borrelia burgdorferi B31
VGGVRGKVL

SEQ ID NO: 4605 - protein, 9 aa, Borrelia burgdorferi B31
GGVRGKVLE

SEQ ID NO: 4606 - protein, 9 aa, Borrelia burgdorferi B31
GVRGKVLES

SEQ ID NO: 4607 - protein, 9 aa, Borrelia burgdorferi B31
VRGKVLESF

SEQ ID NO: 4608 - protein, 9 aa, Borrelia burgdorferi B31
RGKVLESFM

SEQ ID NO: 4609 - protein, 9 aa, Borrelia burgdorferi B31
GKVLESFMY

SEQ ID NO: 4610 - protein, 9 aa, Borrelia burgdorferi B31
KVLESFMYG

SEQ ID NO: 4611 - protein, 9 aa, Borrelia burgdorferi B31
VLESFMYGY

SEQ ID NO: 4612 - protein, 9 aa, Borrelia burgdorferi B31
LESFMYGYE

SEQ ID NO: 4613 - protein, 9 aa, Borrelia burgdorferi B31
ESFMYGYEA

SEQ ID NO: 4614 - protein, 9 aa, Borrelia burgdorferi B31
SFMYGYEAG

SEQ ID NO: 4615 - protein, 9 aa, Borrelia burgdorferi B31
FMYGYEAGA

SEQ ID NO: 4616 - protein, 9 aa, Borrelia burgdorferi B31
MYGYEAGAK

SEQ ID NO: 4617 - protein, 9 aa, Borrelia burgdorferi B31
YGYEAGAKY

SEQ ID NO: 4618 - protein, 9 aa, Borrelia burgdorferi B31
GYEAGAKYA

SEQ ID NO: 4619 - protein, 9 aa, Borrelia burgdorferi B31
YEAGAKYAN

SEQ ID NO: 4620 - protein, 9 aa, Borrelia burgdorferi B31
EAGAKYANS

SEQ ID NO: 4621 - protein, 9 aa, Borrelia burgdorferi B31
AGAKYANSN

SEQ ID NO: 4622 - protein, 9 aa, Borrelia burgdorferi B31
GAKYANSNI

SEQ ID NO: 4623 - protein, 9 aa, Borrelia burgdorferi B31
AKYANSNIK

SEQ ID NO: 4624 - protein, 9 aa, Borrelia burgdorferi B31
KYANSNIKV

SEQ ID NO: 4625 - protein, 9 aa, Borrelia burgdorferi B31
YANSNIKVV

SEQ ID NO: 4626 - protein, 9 aa, Borrelia burgdorferi B31
ANSNIKVVS

SEQ ID NO: 4627 - protein, 9 aa, Borrelia burgdorferi B31
NSNIKVVSQ

SEQ ID NO: 4628 - protein, 9 aa, Borrelia burgdorferi B31
SNIKVVSQY

SEQ ID NO: 4629 - protein, 9 aa, Borrelia burgdorferi B31
NIKVVSQYV

SEQ ID NO: 4630 - protein, 9 aa, Borrelia burgdorferi B31
IKVVSQYVG

SEQ ID NO: 4631 - protein, 9 aa, Borrelia burgdorferi B31
KVVSQYVGT

SEQ ID NO: 4632 - protein, 9 aa, Borrelia burgdorferi B31
VVSQYVGTF

SEQ ID NO: 4633 - protein, 9 aa, Borrelia burgdorferi B31
VSQYVGTFG

SEQ ID NO: 4634 - protein, 9 aa, Borrelia burgdorferi B31
SQYVGTFGD

SEQ ID NO: 4635 - protein, 9 aa, Borrelia burgdorferi B31
QYVGTFGDF

SEQ ID NO: 4636 - protein, 9 aa, Borrelia burgdorferi B31
YVGTFGDFG

SEQ ID NO: 4637 - protein, 9 aa, Borrelia burgdorferi B31
VGTFGDFGL

SEQ ID NO: 4638 - protein, 9 aa, Borrelia burgdorferi B31
GTFGDFGLG

SEQ ID NO: 4639 - protein, 9 aa, Borrelia burgdorferi B31
TFGDFGLGR

SEQ ID NO: 4640 - protein, 9 aa, Borrelia burgdorferi B31
FGDFGLGRS

SEQ ID NO: 4641 - protein, 9 aa, Borrelia burgdorferi B31
GDFGLGRST

SEQ ID NO: 4642 - protein, 9 aa, Borrelia burgdorferi B31
DFGLGRSTA

SEQ ID NO: 4643 - protein, 9 aa, Borrelia burgdorferi B31
FGLGRSTAS

SEQ ID NO: 4644 - protein, 9 aa, Borrelia burgdorferi B31
GLGRSTASN

SEQ ID NO: 4645 - protein, 9 aa, Borrelia burgdorferi B31
LGRSTASNM

SEQ ID NO: 4646 - protein, 9 aa, Borrelia burgdorferi B31
GRSTASNMY

SEQ ID NO: 4647 - protein, 9 aa, Borrelia burgdorferi B31
RSTASNMYR

SEQ ID NO: 4648 - protein, 9 aa, Borrelia burgdorferi B31
STASNMYRD

SEQ ID NO: 4649 - protein, 9 aa, Borrelia burgdorferi B31
TASNMYRDG

SEQ ID NO: 4650 - protein, 9 aa, Borrelia burgdorferi B31
ASNMYRDGV

SEQ ID NO: 4651 - protein, 9 aa, Borrelia burgdorferi B31
SNMYRDGVD

SEQ ID NO: 4652 - protein, 9 aa, Borrelia burgdorferi B31
NMYRDGVDI

SEQ ID NO: 4653 - protein, 9 aa, Borrelia burgdorferi B31
MYRDGVDII

SEQ ID NO: 4654 - protein, 9 aa, Borrelia burgdorferi B31
YRDGVDIIF

SEQ ID NO: 4655 - protein, 9 aa, Borrelia burgdorferi B31
RDGVDIIFA

SEQ ID NO: 4656 - protein, 9 aa, Borrelia burgdorferi B31
DGVDIIFAA

SEQ ID NO: 4657 - protein, 9 aa, Borrelia burgdorferi B31
GVDIIFAAA

SEQ ID NO: 4658 - protein, 9 aa, Borrelia burgdorferi B31
VDIIFAAAG

SEQ ID NO: 4659 - protein, 9 aa, Borrelia burgdorferi B31
DIIFAAAGL

SEQ ID NO: 4660 - protein, 9 aa, Borrelia burgdorferi B31
IIFAAAGLS

SEQ ID NO: 4661 - protein, 9 aa, Borrelia burgdorferi B31
IFAAAGLSG

SEQ ID NO: 4662 - protein, 9 aa, Borrelia burgdorferi B31
FAAAGLSGI

SEQ ID NO: 4663 - protein, 9 aa, Borrelia burgdorferi B31
AAAGLSGIG

SEQ ID NO: 4664 - protein, 9 aa, Borrelia burgdorferi B31
AAGLSGIGV

SEQ ID NO: 4665 - protein, 9 aa, Borrelia burgdorferi B31
AGLSGIGVI

SEQ ID NO: 4666 - protein, 9 aa, Borrelia burgdorferi B31
GLSGIGVIE

SEQ ID NO: 4667 - protein, 9 aa, Borrelia burgdorferi B31
LSGIGVIEA

SEQ ID NO: 4668 - protein, 9 aa, Borrelia burgdorferi B31
SGIGVIEAA

SEQ ID NO: 4669 - protein, 9 aa, Borrelia burgdorferi B31
GIGVIEAAK

SEQ ID NO: 4670 - protein, 9 aa, Borrelia burgdorferi B31
IGVIEAAKE

SEQ ID NO: 4671 - protein, 9 aa, Borrelia burgdorferi B31
GVIEAAKEL

SEQ ID NO: 4672 - protein, 9 aa, Borrelia burgdorferi B31
VIEAAKELG

SEQ ID NO: 4673 - protein, 9 aa, Borrelia burgdorferi B31
IEAAKELGP

SEQ ID NO: 4674 - protein, 9 aa, Borrelia burgdorferi B31
EAAKELGPD

SEQ ID NO: 4675 - protein, 9 aa, Borrelia burgdorferi B31
AAKELGPDH

SEQ ID NO: 4676 - protein, 9 aa, Borrelia burgdorferi B31
AKELGPDHY

SEQ ID NO: 4677 - protein, 9 aa, Borrelia burgdorferi B31
KELGPDHYI

SEQ ID NO: 4678 - protein, 9 aa, Borrelia burgdorferi B31
ELGPDHYII

SEQ ID NO: 4679 - protein, 9 aa, Borrelia burgdorferi B31
LGPDHYIIG

SEQ ID NO: 4680 - protein, 9 aa, Borrelia burgdorferi B31
GPDHYIIGV

SEQ ID NO: 4681 - protein, 9 aa, Borrelia burgdorferi B31
PDHYIIGVD

SEQ ID NO: 4682 - protein, 9 aa, Borrelia burgdorferi B31
DHYIIGVDQ

SEQ ID NO: 4683 - protein, 9 aa, Borrelia burgdorferi B31
HYIIGVDQD

SEQ ID NO: 4684 - protein, 9 aa, Borrelia burgdorferi B31
YIIGVDQDQ

SEQ ID NO: 4685 - protein, 9 aa, Borrelia burgdorferi B31
IIGVDQDQS

SEQ ID NO: 4686 - protein, 9 aa, Borrelia burgdorferi B31
IGVDQDQSY

SEQ ID NO: 4687 - protein, 9 aa, Borrelia burgdorferi B31
GVDQDQSYL

SEQ ID NO: 4688 - protein, 9 aa, Borrelia burgdorferi B31
VDQDQSYLA

SEQ ID NO: 4689 - protein, 9 aa, Borrelia burgdorferi B31
DQDQSYLAP

SEQ ID NO: 4690 - protein, 9 aa, Borrelia burgdorferi B31
QDQSYLAPN

SEQ ID NO: 4691 - protein, 9 aa, Borrelia burgdorferi B31
DQSYLAPNN

SEQ ID NO: 4692 - protein, 9 aa, Borrelia burgdorferi B31
QSYLAPNNV

SEQ ID NO: 4693 - protein, 9 aa, Borrelia burgdorferi B31
SYLAPNNVI

SEQ ID NO: 4694 - protein, 9 aa, Borrelia burgdorferi B31
YLAPNNVIV

SEQ ID NO: 4695 - protein, 9 aa, Borrelia burgdorferi B31
LAPNNVIVS

SEQ ID NO: 4696 - protein, 9 aa, Borrelia burgdorferi B31
APNNVIVSA

SEQ ID NO: 4697 - protein, 9 aa, Borrelia burgdorferi B31
PNNVIVSAV

SEQ ID NO: 4698 - protein, 9 aa, Borrelia burgdorferi B31
NNVIVSAVK

SEQ ID NO: 4699 - protein, 9 aa, Borrelia burgdorferi B31
NVIVSAVKK

SEQ ID NO: 4700 - protein, 9 aa, Borrelia burgdorferi B31
VIVSAVKKV

SEQ ID NO: 4701 - protein, 9 aa, Borrelia burgdorferi B31
IVSAVKKVD

SEQ ID NO: 4702 - protein, 9 aa, Borrelia burgdorferi B31
VSAVKKVDS

SEQ ID NO: 4703 - protein, 9 aa, Borrelia burgdorferi B31
SAVKKVDSL

SEQ ID NO: 4704 - protein, 9 aa, Borrelia burgdorferi B31
AVKKVDSLM

SEQ ID NO: 4705 - protein, 9 aa, Borrelia burgdorferi B31
VKKVDSLMY

SEQ ID NO: 4706 - protein, 9 aa, Borrelia burgdorferi B31
KKVDSLMYS

SEQ ID NO: 4707 - protein, 9 aa, Borrelia burgdorferi B31
KVDSLMYSL

SEQ ID NO: 4708 - protein, 9 aa, Borrelia burgdorferi B31
VDSLMYSLT

SEQ ID NO: 4709 - protein, 9 aa, Borrelia burgdorferi B31
DSLMYSLTK

SEQ ID NO: 4710 - protein, 9 aa, Borrelia burgdorferi B31
SLMYSLTKK

SEQ ID NO: 4711 - protein, 9 aa, Borrelia burgdorferi B31
LMYSLTKKY

SEQ ID NO: 4712 - protein, 9 aa, Borrelia burgdorferi B31
MYSLTKKYL

SEQ ID NO: 4713 - protein, 9 aa, Borrelia burgdorferi B31
YSLTKKYLE

SEQ ID NO: 4714 - protein, 9 aa, Borrelia burgdorferi B31
SLTKKYLET

SEQ ID NO: 4715 - protein, 9 aa, Borrelia burgdorferi B31
LTKKYLETG

SEQ ID NO: 4716 - protein, 9 aa, Borrelia burgdorferi B31
TKKYLETGV

SEQ ID NO: 4717 - protein, 9 aa, Borrelia burgdorferi B31
KKYLETGVL

SEQ ID NO: 4718 - protein, 9 aa, Borrelia burgdorferi B31
KYLETGVLD

SEQ ID NO: 4719 - protein, 9 aa, Borrelia burgdorferi B31
YLETGVLDG

SEQ ID NO: 4720 - protein, 9 aa, Borrelia burgdorferi B31
LETGVLDGG

SEQ ID NO: 4721 - protein, 9 aa, Borrelia burgdorferi B31
ETGVLDGGK

SEQ ID NO: 4722 - protein, 9 aa, Borrelia burgdorferi B31
TGVLDGGKT

SEQ ID NO: 4723 - protein, 9 aa, Borrelia burgdorferi B31
GVLDGGKTM

SEQ ID NO: 4724 - protein, 9 aa, Borrelia burgdorferi B31
VLDGGKTMF

SEQ ID NO: 4725 - protein, 9 aa, Borrelia burgdorferi B31
LDGGKTMFL

SEQ ID NO: 4726 - protein, 9 aa, Borrelia burgdorferi B31
DGGKTMFLG

SEQ ID NO: 4727 - protein, 9 aa, Borrelia burgdorferi B31
GGKTMFLGL

SEQ ID NO: 4728 - protein, 9 aa, Borrelia burgdorferi B31
GKTMFLGLK

SEQ ID NO: 4729 - protein, 9 aa, Borrelia burgdorferi B31
KTMFLGLKE

SEQ ID NO: 4730 - protein, 9 aa, Borrelia burgdorferi B31
TMFLGLKED

SEQ ID NO: 4731 - protein, 9 aa, Borrelia burgdorferi B31
MFLGLKEDG

SEQ ID NO: 4732 - protein, 9 aa, Borrelia burgdorferi B31
FLGLKEDGL

SEQ ID NO: 4733 - protein, 9 aa, Borrelia burgdorferi B31
LGLKEDGLG

SEQ ID NO: 4734 - protein, 9 aa, Borrelia burgdorferi B31
GLKEDGLGL

SEQ ID NO: 4735 - protein, 9 aa, Borrelia burgdorferi B31
LKEDGLGLV

SEQ ID NO: 4736 - protein, 9 aa, Borrelia burgdorferi B31
KEDGLGLVL

SEQ ID NO: 4737 - protein, 9 aa, Borrelia burgdorferi B31
EDGLGLVLN

SEQ ID NO: 4738 - protein, 9 aa, Borrelia burgdorferi B31
DGLGLVLNE

SEQ ID NO: 4739 - protein, 9 aa, Borrelia burgdorferi B31
GLGLVLNEN

SEQ ID NO: 4740 - protein, 9 aa, Borrelia burgdorferi B31
LGLVLNENL

SEQ ID NO: 4741 - protein, 9 aa, Borrelia burgdorferi B31
GLVLNENLK

SEQ ID NO: 4742 - protein, 9 aa, Borrelia burgdorferi B31
LVLNENLKS

SEQ ID NO: 4743 - protein, 9 aa, Borrelia burgdorferi B31
VLNENLKSN

SEQ ID NO: 4744 - protein, 9 aa, Borrelia burgdorferi B31
LNENLKSNY

SEQ ID NO: 4745 - protein, 9 aa, Borrelia burgdorferi B31
NENLKSNYS

SEQ ID NO: 4746 - protein, 9 aa, Borrelia burgdorferi B31
ENLKSNYSE

SEQ ID NO: 4747 - protein, 9 aa, Borrelia burgdorferi B31
NLKSNYSEI

SEQ ID NO: 4748 - protein, 9 aa, Borrelia burgdorferi B31
LKSNYSEIY

SEQ ID NO: 4749 - protein, 9 aa, Borrelia burgdorferi B31
KSNYSEIYN

SEQ ID NO: 4750 - protein, 9 aa, Borrelia burgdorferi B31
SNYSEIYNK

SEQ ID NO: 4751 - protein, 9 aa, Borrelia burgdorferi B31
NYSEIYNKS

SEQ ID NO: 4752 - protein, 9 aa, Borrelia burgdorferi B31
YSEIYNKSL

SEQ ID NO: 4753 - protein, 9 aa, Borrelia burgdorferi B31
SEIYNKSLK

SEQ ID NO: 4754 - protein, 9 aa, Borrelia burgdorferi B31
EIYNKSLKI

SEQ ID NO: 4755 - protein, 9 aa, Borrelia burgdorferi B31
IYNKSLKIG

SEQ ID NO: 4756 - protein, 9 aa, Borrelia burgdorferi B31
YNKSLKIGQ

SEQ ID NO: 4757 - protein, 9 aa, Borrelia burgdorferi B31
NKSLKIGQS

SEQ ID NO: 4758 - protein, 9 aa, Borrelia burgdorferi B31
KSLKIGQSI

SEQ ID NO: 4759 - protein, 9 aa, Borrelia burgdorferi B31
SLKIGQSIM

SEQ ID NO: 4760 - protein, 9 aa, Borrelia burgdorferi B31
LKIGQSIMN

SEQ ID NO: 4761 - protein, 9 aa, Borrelia burgdorferi B31
KIGQSIMNG

SEQ ID NO: 4762 - protein, 9 aa, Borrelia burgdorferi B31
IGQSIMNGI

SEQ ID NO: 4763 - protein, 9 aa, Borrelia burgdorferi B31
GQSIMNGII

SEQ ID NO: 4764 - protein, 9 aa, Borrelia burgdorferi B31
QSIMNGIIK

SEQ ID NO: 4765 - protein, 9 aa, Borrelia burgdorferi B31
SIMNGIIKV

SEQ ID NO: 4766 - protein, 9 aa, Borrelia burgdorferi B31
IMNGIIKVP

SEQ ID NO: 4767 - protein, 9 aa, Borrelia burgdorferi B31
MNGIIKVPY

SEQ ID NO: 4768 - protein, 9 aa, Borrelia burgdorferi B31
NGIIKVPYD

SEQ ID NO: 4769 - protein, 9 aa, Borrelia burgdorferi B31
GIIKVPYDK

SEQ ID NO: 4770 - protein, 9 aa, Borrelia burgdorferi B31
IIKVPYDKV

SEQ ID NO: 4771 - protein, 9 aa, Borrelia burgdorferi B31
IKVPYDKVS

SEQ ID NO: 4772 - protein, 9 aa, Borrelia burgdorferi B31
KVPYDKVSY

SEQ ID NO: 4773 - protein, 9 aa, Borrelia burgdorferi B31
VPYDKVSYF

SEQ ID NO: 4774 - protein, 9 aa, Borrelia burgdorferi B31
PYDKVSYFV

SEQ ID NO: 4775 - protein, 9 aa, Borrelia burgdorferi B31
YDKVSYFVL

SEQ ID NO: 4776 - protein, 9 aa, Borrelia burgdorferi B31
DKVSYFVLQ

SEQ ID NO: 4777 - protein, 9 aa, Borrelia burgdorferi B31
KVSYFVLQM

SEQ ID NO: 4778 - protein, 9 aa, Borrelia burgdorferi B31
VSYFVLQME

SEQ ID NO: 4779 - protein, 9 aa, Borrelia burgdorferi B31
SYFVLQMEN

SEQ ID NO: 4780 - protein, 10 aa, Borrelia burgdorferi B31
MDNYYEIYFL

SEQ ID NO: 4781 - protein, 10 aa, Borrelia burgdorferi B31
DNYYEIYFLY

SEQ ID NO: 4782 - protein, 10 aa, Borrelia burgdorferi B31
NYYEIYFLYF

SEQ ID NO: 4783 - protein, 10 aa, Borrelia burgdorferi B31
YYEIYFLYFF

SEQ ID NO: 4784 - protein, 10 aa, Borrelia burgdorferi B31
YEIYFLYFFI

SEQ ID NO: 4785 - protein, 10 aa, Borrelia burgdorferi B31
EIYFLYFFIK

SEQ ID NO: 4786 - protein, 10 aa, Borrelia burgdorferi B31
IYFLYFFIKS

SEQ ID NO: 4787 - protein, 10 aa, Borrelia burgdorferi B31
YFLYFFIKSK

SEQ ID NO: 4788 - protein, 10 aa, Borrelia burgdorferi B31
FLYFFIKSKE

SEQ ID NO: 4789 - protein, 10 aa, Borrelia burgdorferi B31
LYFFIKSKED

SEQ ID NO: 4790 - protein, 10 aa, Borrelia burgdorferi B31
YFFIKSKEDI

SEQ ID NO: 4791 - protein, 10 aa, Borrelia burgdorferi B31
FFIKSKEDIF

SEQ ID NO: 4792 - protein, 10 aa, Borrelia burgdorferi B31
FIKSKEDIFM

SEQ ID NO: 4793 - protein, 10 aa, Borrelia burgdorferi B31
IKSKEDIFML

SEQ ID NO: 4794 - protein, 10 aa, Borrelia burgdorferi B31
KSKEDIFMLK

SEQ ID NO: 4795 - protein, 10 aa, Borrelia burgdorferi B31
SKEDIFMLKK

SEQ ID NO: 4796 - protein, 10 aa, Borrelia burgdorferi B31
KEDIFMLKKV

SEQ ID NO: 4797 - protein, 10 aa, Borrelia burgdorferi B31
EDIFMLKKVY

SEQ ID NO: 4798 - protein, 10 aa, Borrelia burgdorferi B31
DIFMLKKVYY

SEQ ID NO: 4799 - protein, 10 aa, Borrelia burgdorferi B31
IFMLKKVYYF

SEQ ID NO: 4800 - protein, 10 aa, Borrelia burgdorferi B31
FMLKKVYYFL

SEQ ID NO: 4801 - protein, 10 aa, Borrelia burgdorferi B31
MLKKVYYFLI

SEQ ID NO: 4802 - protein, 10 aa, Borrelia burgdorferi B31
LKKVYYFLIF

SEQ ID NO: 4803 - protein, 10 aa, Borrelia burgdorferi B31
KKVYYFLIFL

SEQ ID NO: 4804 - protein, 10 aa, Borrelia burgdorferi B31
KVYYFLIFLF

SEQ ID NO: 4805 - protein, 10 aa, Borrelia burgdorferi B31
VYYFLIFLFI

SEQ ID NO: 4806 - protein, 10 aa, Borrelia burgdorferi B31
YYFLIFLFIV

SEQ ID NO: 4807 - protein, 10 aa, Borrelia burgdorferi B31
YFLIFLFIVA

SEQ ID NO: 4808 - protein, 10 aa, Borrelia burgdorferi B31
FLIFLFIVAC

SEQ ID NO: 4809 - protein, 10 aa, Borrelia burgdorferi B31
LIFLFIVACS

SEQ ID NO: 4810 - protein, 10 aa, Borrelia burgdorferi B31
IFLFIVACSS

SEQ ID NO: 4811 - protein, 10 aa, Borrelia burgdorferi B31
FLFIVACSSS

SEQ ID NO: 4812 - protein, 10 aa, Borrelia burgdorferi B31
LFIVACSSSD

SEQ ID NO: 4813 - protein, 10 aa, Borrelia burgdorferi B31
FIVACSSSDD

SEQ ID NO: 4814 - protein, 10 aa, Borrelia burgdorferi B31
IVACSSSDDG

SEQ ID NO: 4815 - protein, 10 aa, Borrelia burgdorferi B31
VACSSSDDGK

SEQ ID NO: 4816 - protein, 10 aa, Borrelia burgdorferi B31
ACSSSDDGKS

SEQ ID NO: 4817 - protein, 10 aa, Borrelia burgdorferi B31
CSSSDDGKSE

SEQ ID NO: 4818 - protein, 10 aa, Borrelia burgdorferi B31
SSSDDGKSEA

SEQ ID NO: 4819 - protein, 10 aa, Borrelia burgdorferi B31
SSDDGKSEAK

SEQ ID NO: 4820 - protein, 10 aa, Borrelia burgdorferi B31
SDDGKSEAKT

SEQ ID NO: 4821 - protein, 10 aa, Borrelia burgdorferi B31
DDGKSEAKTV

SEQ ID NO: 4822 - protein, 10 aa, Borrelia burgdorferi B31
DGKSEAKTVS

SEQ ID NO: 4823 - protein, 10 aa, Borrelia burgdorferi B31
GKSEAKTVSL

SEQ ID NO: 4824 - protein, 10 aa, Borrelia burgdorferi B31
KSEAKTVSLI

SEQ ID NO: 4825 - protein, 10 aa, Borrelia burgdorferi B31
SEAKTVSLIV

SEQ ID NO: 4826 - protein, 10 aa, Borrelia burgdorferi B31
EAKTVSLIVD

SEQ ID NO: 4827 - protein, 10 aa, Borrelia burgdorferi B31
AKTVSLIVDG

SEQ ID NO: 4828 - protein, 10 aa, Borrelia burgdorferi B31
KTVSLIVDGA

SEQ ID NO: 4829 - protein, 10 aa, Borrelia burgdorferi B31
TVSLIVDGAF

SEQ ID NO: 4830 - protein, 10 aa, Borrelia burgdorferi B31
VSLIVDGAFD

SEQ ID NO: 4831 - protein, 10 aa, Borrelia burgdorferi B31
SLIVDGAFDD

SEQ ID NO: 4832 - protein, 10 aa, Borrelia burgdorferi B31
LIVDGAFDDK

SEQ ID NO: 4833 - protein, 10 aa, Borrelia burgdorferi B31
IVDGAFDDKG

SEQ ID NO: 4834 - protein, 10 aa, Borrelia burgdorferi B31
VDGAFDDKGF

SEQ ID NO: 4835 - protein, 10 aa, Borrelia burgdorferi B31
DGAFDDKGFN

SEQ ID NO: 4836 - protein, 10 aa, Borrelia burgdorferi B31
GAFDDKGFNE

SEQ ID NO: 4837 - protein, 10 aa, Borrelia burgdorferi B31
AFDDKGFNES

SEQ ID NO: 4838 - protein, 10 aa, Borrelia burgdorferi B31
FDDKGFNESS

SEQ ID NO: 4839 - protein, 10 aa, Borrelia burgdorferi B31
DDKGFNESSS

SEQ ID NO: 4840 - protein, 10 aa, Borrelia burgdorferi B31
DKGFNESSSK

SEQ ID NO: 4841 - protein, 10 aa, Borrelia burgdorferi B31
KGFNESSSKA

SEQ ID NO: 4842 - protein, 10 aa, Borrelia burgdorferi B31
GFNESSSKAI

SEQ ID NO: 4843 - protein, 10 aa, Borrelia burgdorferi B31
FNESSSKAIR

SEQ ID NO: 4844 - protein, 10 aa, Borrelia burgdorferi B31
NESSSKAIRK

SEQ ID NO: 4845 - protein, 10 aa, Borrelia burgdorferi B31
ESSSKAIRKL

SEQ ID NO: 4846 - protein, 10 aa, Borrelia burgdorferi B31
SSSKAIRKLK

SEQ ID NO: 4847 - protein, 10 aa, Borrelia burgdorferi B31
SSKAIRKLKA

SEQ ID NO: 4848 - protein, 10 aa, Borrelia burgdorferi B31
SKAIRKLKAD

SEQ ID NO: 4849 - protein, 10 aa, Borrelia burgdorferi B31
KAIRKLKADL

SEQ ID NO: 4850 - protein, 10 aa, Borrelia burgdorferi B31
AIRKLKADLN

SEQ ID NO: 4851 - protein, 10 aa, Borrelia burgdorferi B31
IRKLKADLNI

SEQ ID NO: 4852 - protein, 10 aa, Borrelia burgdorferi B31
RKLKADLNIN

SEQ ID NO: 4853 - protein, 10 aa, Borrelia burgdorferi B31
KLKADLNINI

SEQ ID NO: 4854 - protein, 10 aa, Borrelia burgdorferi B31
LKADLNINII

SEQ ID NO: 4855 - protein, 10 aa, Borrelia burgdorferi B31
KADLNINIIE

SEQ ID NO: 4856 - protein, 10 aa, Borrelia burgdorferi B31
ADLNINIIEK

SEQ ID NO: 4857 - protein, 10 aa, Borrelia burgdorferi B31
DLNINIIEKA

SEQ ID NO: 4858 - protein, 10 aa, Borrelia burgdorferi B31
LNINIIEKAS

SEQ ID NO: 4859 - protein, 10 aa, Borrelia burgdorferi B31
NINIIEKAST

SEQ ID NO: 4860 - protein, 10 aa, Borrelia burgdorferi B31
INIIEKASTG

SEQ ID NO: 4861 - protein, 10 aa, Borrelia burgdorferi B31
NIIEKASTGN

SEQ ID NO: 4862 - protein, 10 aa, Borrelia burgdorferi B31
IIEKASTGNS

SEQ ID NO: 4863 - protein, 10 aa, Borrelia burgdorferi B31
IEKASTGNSY

SEQ ID NO: 4864 - protein, 10 aa, Borrelia burgdorferi B31
EKASTGNSYL

SEQ ID NO: 4865 - protein, 10 aa, Borrelia burgdorferi B31
KASTGNSYLG

SEQ ID NO: 4866 - protein, 10 aa, Borrelia burgdorferi B31
ASTGNSYLGD

SEQ ID NO: 4867 - protein, 10 aa, Borrelia burgdorferi B31
STGNSYLGDI

SEQ ID NO: 4868 - protein, 10 aa, Borrelia burgdorferi B31
TGNSYLGDIA

SEQ ID NO: 4869 - protein, 10 aa, Borrelia burgdorferi B31
GNSYLGDIAN

SEQ ID NO: 4870 - protein, 10 aa, Borrelia burgdorferi B31
NSYLGDIANL

SEQ ID NO: 4871 - protein, 10 aa, Borrelia burgdorferi B31
SYLGDIANLE

SEQ ID NO: 4872 - protein, 10 aa, Borrelia burgdorferi B31
YLGDIANLED

SEQ ID NO: 4873 - protein, 10 aa, Borrelia burgdorferi B31
LGDIANLEDG

SEQ ID NO: 4874 - protein, 10 aa, Borrelia burgdorferi B31
GDIANLEDGN

SEQ ID NO: 4875 - protein, 10 aa, Borrelia burgdorferi B31
DIANLEDGNS

SEQ ID NO: 4876 - protein, 10 aa, Borrelia burgdorferi B31
IANLEDGNSN

SEQ ID NO: 4877 - protein, 10 aa, Borrelia burgdorferi B31
ANLEDGNSNL

SEQ ID NO: 4878 - protein, 10 aa, Borrelia burgdorferi B31
NLEDGNSNLI

SEQ ID NO: 4879 - protein, 10 aa, Borrelia burgdorferi B31
LEDGNSNLIW

SEQ ID NO: 4880 - protein, 10 aa, Borrelia burgdorferi B31
EDGNSNLIWG

SEQ ID NO: 4881 - protein, 10 aa, Borrelia burgdorferi B31
DGNSNLIWGI

SEQ ID NO: 4882 - protein, 10 aa, Borrelia burgdorferi B31
GNSNLIWGIG

SEQ ID NO: 4883 - protein, 10 aa, Borrelia burgdorferi B31
NSNLIWGIGF

SEQ ID NO: 4884 - protein, 10 aa, Borrelia burgdorferi B31
SNLIWGIGFR

SEQ ID NO: 4885 - protein, 10 aa, Borrelia burgdorferi B31
NLIWGIGFRL

SEQ ID NO: 4886 - protein, 10 aa, Borrelia burgdorferi B31
LIWGIGFRLS

SEQ ID NO: 4887 - protein, 10 aa, Borrelia burgdorferi B31
IWGIGFRLSD

SEQ ID NO: 4888 - protein, 10 aa, Borrelia burgdorferi B31
WGIGFRLSDI

SEQ ID NO: 4889 - protein, 10 aa, Borrelia burgdorferi B31
GIGFRLSDIL

SEQ ID NO: 4890 - protein, 10 aa, Borrelia burgdorferi B31
IGFRLSDILF

SEQ ID NO: 4891 - protein, 10 aa, Borrelia burgdorferi B31
GFRLSDILFQ

SEQ ID NO: 4892 - protein, 10 aa, Borrelia burgdorferi B31
FRLSDILFQR

SEQ ID NO: 4893 - protein, 10 aa, Borrelia burgdorferi B31
RLSDILFQRA

SEQ ID NO: 4894 - protein, 10 aa, Borrelia burgdorferi B31
LSDILFQRAS

SEQ ID NO: 4895 - protein, 10 aa, Borrelia burgdorferi B31
SDILFQRASE

SEQ ID NO: 4896 - protein, 10 aa, Borrelia burgdorferi B31
DILFQRASEN

SEQ ID NO: 4897 - protein, 10 aa, Borrelia burgdorferi B31
ILFQRASENV

SEQ ID NO: 4898 - protein, 10 aa, Borrelia burgdorferi B31
LFQRASENVS

SEQ ID NO: 4899 - protein, 10 aa, Borrelia burgdorferi B31
FQRASENVSV

SEQ ID NO: 4900 - protein, 10 aa, Borrelia burgdorferi B31
QRASENVSVN

SEQ ID NO: 4901 - protein, 10 aa, Borrelia burgdorferi B31
RASENVSVNY

SEQ ID NO: 4902 - protein, 10 aa, Borrelia burgdorferi B31
ASENVSVNYA

SEQ ID NO: 4903 - protein, 10 aa, Borrelia burgdorferi B31
SENVSVNYAI

SEQ ID NO: 4904 - protein, 10 aa, Borrelia burgdorferi B31
ENVSVNYAII

SEQ ID NO: 4905 - protein, 10 aa, Borrelia burgdorferi B31
NVSVNYAIIE

SEQ ID NO: 4906 - protein, 10 aa, Borrelia burgdorferi B31
VSVNYAIIEG

SEQ ID NO: 4907 - protein, 10 aa, Borrelia burgdorferi B31
SVNYAIIEGV

SEQ ID NO: 4908 - protein, 10 aa, Borrelia burgdorferi B31
VNYAIIEGVY

SEQ ID NO: 4909 - protein, 10 aa, Borrelia burgdorferi B31
NYAIIEGVYD

SEQ ID NO: 4910 - protein, 10 aa, Borrelia burgdorferi B31
YAIIEGVYDE

SEQ ID NO: 4911 - protein, 10 aa, Borrelia burgdorferi B31
AIIEGVYDEI

SEQ ID NO: 4912 - protein, 10 aa, Borrelia burgdorferi B31
IIEGVYDEIQ

SEQ ID NO: 4913 - protein, 10 aa, Borrelia burgdorferi B31
IEGVYDEIQI

SEQ ID NO: 4914 - protein, 10 aa, Borrelia burgdorferi B31
EGVYDEIQIP

SEQ ID NO: 4915 - protein, 10 aa, Borrelia burgdorferi B31
GVYDEIQIPK

SEQ ID NO: 4916 - protein, 10 aa, Borrelia burgdorferi B31
VYDEIQIPKN

SEQ ID NO: 4917 - protein, 10 aa, Borrelia burgdorferi B31
YDEIQIPKNL

SEQ ID NO: 4918 - protein, 10 aa, Borrelia burgdorferi B31
DEIQIPKNLL

SEQ ID NO: 4919 - protein, 10 aa, Borrelia burgdorferi B31
EIQIPKNLLN

SEQ ID NO: 4920 - protein, 10 aa, Borrelia burgdorferi B31
IQIPKNLLNI

SEQ ID NO: 4921 - protein, 10 aa, Borrelia burgdorferi B31
QIPKNLLNIS

SEQ ID NO: 4922 - protein, 10 aa, Borrelia burgdorferi B31
IPKNLLNISF

SEQ ID NO: 4923 - protein, 10 aa, Borrelia burgdorferi B31
PKNLLNISFR

SEQ ID NO: 4924 - protein, 10 aa, Borrelia burgdorferi B31
KNLLNISFRS

SEQ ID NO: 4925 - protein, 10 aa, Borrelia burgdorferi B31
NLLNISFRSE

SEQ ID NO: 4926 - protein, 10 aa, Borrelia burgdorferi B31
LLNISFRSEE

SEQ ID NO: 4927 - protein, 10 aa, Borrelia burgdorferi B31
LNISFRSEEV

SEQ ID NO: 4928 - protein, 10 aa, Borrelia burgdorferi B31
NISFRSEEVA

SEQ ID NO: 4929 - protein, 10 aa, Borrelia burgdorferi B31
ISFRSEEVAF

SEQ ID NO: 4930 - protein, 10 aa, Borrelia burgdorferi B31
SFRSEEVAFL

SEQ ID NO: 4931 - protein, 10 aa, Borrelia burgdorferi B31
FRSEEVAFLA

SEQ ID NO: 4932 - protein, 10 aa, Borrelia burgdorferi B31
RSEEVAFLAG

SEQ ID NO: 4933 - protein, 10 aa, Borrelia burgdorferi B31
SEEVAFLAGY

SEQ ID NO: 4934 - protein, 10 aa, Borrelia burgdorferi B31
EEVAFLAGYF

SEQ ID NO: 4935 - protein, 10 aa, Borrelia burgdorferi B31
EVAFLAGYFA

SEQ ID NO: 4936 - protein, 10 aa, Borrelia burgdorferi B31
VAFLAGYFAS

SEQ ID NO: 4937 - protein, 10 aa, Borrelia burgdorferi B31
AFLAGYFASK

SEQ ID NO: 4938 - protein, 10 aa, Borrelia burgdorferi B31
FLAGYFASKA

SEQ ID NO: 4939 - protein, 10 aa, Borrelia burgdorferi B31
LAGYFASKAS

SEQ ID NO: 4940 - protein, 10 aa, Borrelia burgdorferi B31
AGYFASKASK

SEQ ID NO: 4941 - protein, 10 aa, Borrelia burgdorferi B31
GYFASKASKT

SEQ ID NO: 4942 - protein, 10 aa, Borrelia burgdorferi B31
YFASKASKTG

SEQ ID NO: 4943 - protein, 10 aa, Borrelia burgdorferi B31
FASKASKTGK

SEQ ID NO: 4944 - protein, 10 aa, Borrelia burgdorferi B31
ASKASKTGKI

SEQ ID NO: 4945 - protein, 10 aa, Borrelia burgdorferi B31
SKASKTGKIG

SEQ ID NO: 4946 - protein, 10 aa, Borrelia burgdorferi B31
KASKTGKIGF

SEQ ID NO: 4947 - protein, 10 aa, Borrelia burgdorferi B31
ASKTGKIGFV

SEQ ID NO: 4948 - protein, 10 aa, Borrelia burgdorferi B31
SKTGKIGFVG

SEQ ID NO: 4949 - protein, 10 aa, Borrelia burgdorferi B31
KTGKIGFVGG

SEQ ID NO: 4950 - protein, 10 aa, Borrelia burgdorferi B31
TGKIGFVGGV

SEQ ID NO: 4951 - protein, 10 aa, Borrelia burgdorferi B31
GKIGFVGGVR

SEQ ID NO: 4952 - protein, 10 aa, Borrelia burgdorferi B31
KIGFVGGVRG

SEQ ID NO: 4953 - protein, 10 aa, Borrelia burgdorferi B31
IGFVGGVRGK

SEQ ID NO: 4954 - protein, 10 aa, Borrelia burgdorferi B31
GFVGGVRGKV

SEQ ID NO: 4955 - protein, 10 aa, Borrelia burgdorferi B31
FVGGVRGKVL

SEQ ID NO: 4956 - protein, 10 aa, Borrelia burgdorferi B31
VGGVRGKVLE

SEQ ID NO: 4957 - protein, 10 aa, Borrelia burgdorferi B31
GGVRGKVLES

SEQ ID NO: 4958 - protein, 10 aa, Borrelia burgdorferi B31
GVRGKVLESF

SEQ ID NO: 4959 - protein, 10 aa, Borrelia burgdorferi B31
VRGKVLESFM

SEQ ID NO: 4960 - protein, 10 aa, Borrelia burgdorferi B31
RGKVLESFMY

SEQ ID NO: 4961 - protein, 10 aa, Borrelia burgdorferi B31
GKVLESFMYG

SEQ ID NO: 4962 - protein, 10 aa, Borrelia burgdorferi B31
KVLESFMYGY

SEQ ID NO: 4963 - protein, 10 aa, Borrelia burgdorferi B31
VLESFMYGYE

SEQ ID NO: 4964 - protein, 10 aa, Borrelia burgdorferi B31
LESFMYGYEA

SEQ ID NO: 4965 - protein, 10 aa, Borrelia burgdorferi B31
ESFMYGYEAG

SEQ ID NO: 4966 - protein, 10 aa, Borrelia burgdorferi B31
SFMYGYEAGA

SEQ ID NO: 4967 - protein, 10 aa, Borrelia burgdorferi B31
FMYGYEAGAK

SEQ ID NO: 4968 - protein, 10 aa, Borrelia burgdorferi B31
MYGYEAGAKY

SEQ ID NO: 4969 - protein, 10 aa, Borrelia burgdorferi B31
YGYEAGAKYA

SEQ ID NO: 4970 - protein, 10 aa, Borrelia burgdorferi B31
GYEAGAKYAN

SEQ ID NO: 4971 - protein, 10 aa, Borrelia burgdorferi B31
YEAGAKYANS

SEQ ID NO: 4972 - protein, 10 aa, Borrelia burgdorferi B31
EAGAKYANSN

SEQ ID NO: 4973 - protein, 10 aa, Borrelia burgdorferi B31
AGAKYANSNI

SEQ ID NO: 4974 - protein, 10 aa, Borrelia burgdorferi B31
GAKYANSNIK

SEQ ID NO: 4975 - protein, 10 aa, Borrelia burgdorferi B31
AKYANSNIKV

SEQ ID NO: 4976 - protein, 10 aa, Borrelia burgdorferi B31
KYANSNIKVV

SEQ ID NO: 4977 - protein, 10 aa, Borrelia burgdorferi B31
YANSNIKVVS

SEQ ID NO: 4978 - protein, 10 aa, Borrelia burgdorferi B31
ANSNIKVVSQ

SEQ ID NO: 4979 - protein, 10 aa, Borrelia burgdorferi B31
NSNIKVVSQY

SEQ ID NO: 4980 - protein, 10 aa, Borrelia burgdorferi B31
SNIKVVSQYV

SEQ ID NO: 4981 - protein, 10 aa, Borrelia burgdorferi B31
NIKVVSQYVG

SEQ ID NO: 4982 - protein, 10 aa, Borrelia burgdorferi B31
IKVVSQYVGT

SEQ ID NO: 4983 - protein, 10 aa, Borrelia burgdorferi B31
KVVSQYVGTF

SEQ ID NO: 4984 - protein, 10 aa, Borrelia burgdorferi B31
VVSQYVGTFG

SEQ ID NO: 4985 - protein, 10 aa, Borrelia burgdorferi B31
VSQYVGTFGD

SEQ ID NO: 4986 - protein, 10 aa, Borrelia burgdorferi B31
SQYVGTFGDF

SEQ ID NO: 4987 - protein, 10 aa, Borrelia burgdorferi B31
QYVGTFGDFG

SEQ ID NO: 4988 - protein, 10 aa, Borrelia burgdorferi B31
YVGTFGDFGL

SEQ ID NO: 4989 - protein, 10 aa, Borrelia burgdorferi B31
VGTFGDFGLG

SEQ ID NO: 4990 - protein, 10 aa, Borrelia burgdorferi B31
GTFGDFGLGR

SEQ ID NO: 4991 - protein, 10 aa, Borrelia burgdorferi B31
TFGDFGLGRS

SEQ ID NO: 4992 - protein, 10 aa, Borrelia burgdorferi B31
FGDFGLGRST

SEQ ID NO: 4993 - protein, 10 aa, Borrelia burgdorferi B31
GDFGLGRSTA

SEQ ID NO: 4994 - protein, 10 aa, Borrelia burgdorferi B31
DFGLGRSTAS

SEQ ID NO: 4995 - protein, 10 aa, Borrelia burgdorferi B31
FGLGRSTASN

SEQ ID NO: 4996 - protein, 10 aa, Borrelia burgdorferi B31
GLGRSTASNM

SEQ ID NO: 4997 - protein, 10 aa, Borrelia burgdorferi B31
LGRSTASNMY

SEQ ID NO: 4998 - protein, 10 aa, Borrelia burgdorferi B31
GRSTASNMYR

SEQ ID NO: 4999 - protein, 10 aa, Borrelia burgdorferi B31
RSTASNMYRD

SEQ ID NO: 5000 - protein, 10 aa, Borrelia burgdorferi B31
STASNMYRDG

SEQ ID NO: 5001 - protein, 10 aa, Borrelia burgdorferi B31
TASNMYRDGV

SEQ ID NO: 5002 - protein, 10 aa, Borrelia burgdorferi B31
ASNMYRDGVD

SEQ ID NO: 5003 - protein, 10 aa, Borrelia burgdorferi B31
SNMYRDGVDI

SEQ ID NO: 5004 - protein, 10 aa, Borrelia burgdorferi B31
NMYRDGVDII

SEQ ID NO: 5005 - protein, 10 aa, Borrelia burgdorferi B31
MYRDGVDIIF

SEQ ID NO: 5006 - protein, 10 aa, Borrelia burgdorferi B31
YRDGVDIIFA

SEQ ID NO: 5007 - protein, 10 aa, Borrelia burgdorferi B31
RDGVDIIFAA

SEQ ID NO: 5008 - protein, 10 aa, Borrelia burgdorferi B31
DGVDIIFAAA

SEQ ID NO: 5009 - protein, 10 aa, Borrelia burgdorferi B31
GVDIIFAAAG

SEQ ID NO: 5010 - protein, 10 aa, Borrelia burgdorferi B31
VDIIFAAAGL

SEQ ID NO: 5011 - protein, 10 aa, Borrelia burgdorferi B31
DIIFAAAGLS

SEQ ID NO: 5012 - protein, 10 aa, Borrelia burgdorferi B31
IIFAAAGLSG

SEQ ID NO: 5013 - protein, 10 aa, Borrelia burgdorferi B31
IFAAAGLSGI

SEQ ID NO: 5014 - protein, 10 aa, Borrelia burgdorferi B31
FAAAGLSGIG

SEQ ID NO: 5015 - protein, 10 aa, Borrelia burgdorferi B31
AAAGLSGIGV

SEQ ID NO: 5016 - protein, 10 aa, Borrelia burgdorferi B31
AAGLSGIGVI

SEQ ID NO: 5017 - protein, 10 aa, Borrelia burgdorferi B31
AGLSGIGVIE

SEQ ID NO: 5018 - protein, 10 aa, Borrelia burgdorferi B31
GLSGIGVIEA

SEQ ID NO: 5019 - protein, 10 aa, Borrelia burgdorferi B31
LSGIGVIEAA

SEQ ID NO: 5020 - protein, 10 aa, Borrelia burgdorferi B31
SGIGVIEAAK

SEQ ID NO: 5021 - protein, 10 aa, Borrelia burgdorferi B31
GIGVIEAAKE

SEQ ID NO: 5022 - protein, 10 aa, Borrelia burgdorferi B31
IGVIEAAKEL

SEQ ID NO: 5023 - protein, 10 aa, Borrelia burgdorferi B31
GVIEAAKELG

SEQ ID NO: 5024 - protein, 10 aa, Borrelia burgdorferi B31
VIEAAKELGP

SEQ ID NO: 5025 - protein, 10 aa, Borrelia burgdorferi B31
IEAAKELGPD

SEQ ID NO: 5026 - protein, 10 aa, Borrelia burgdorferi B31
EAAKELGPDH

SEQ ID NO: 5027 - protein, 10 aa, Borrelia burgdorferi B31
AAKELGPDHY

SEQ ID NO: 5028 - protein, 10 aa, Borrelia burgdorferi B31
AKELGPDHYI

SEQ ID NO: 5029 - protein, 10 aa, Borrelia burgdorferi B31
KELGPDHYII

SEQ ID NO: 5030 - protein, 10 aa, Borrelia burgdorferi B31
ELGPDHYIIG

SEQ ID NO: 5031 - protein, 10 aa, Borrelia burgdorferi B31
LGPDHYIIGV

SEQ ID NO: 5032 - protein, 10 aa, Borrelia burgdorferi B31
GPDHYIIGVD

SEQ ID NO: 5033 - protein, 10 aa, Borrelia burgdorferi B31
PDHYIIGVDQ

SEQ ID NO: 5034 - protein, 10 aa, Borrelia burgdorferi B31
DHYIIGVDQD

SEQ ID NO: 5035 - protein, 10 aa, Borrelia burgdorferi B31
HYIIGVDQDQ

SEQ ID NO: 5036 - protein, 10 aa, Borrelia burgdorferi B31
YIIGVDQDQS

SEQ ID NO: 5037 - protein, 10 aa, Borrelia burgdorferi B31
IIGVDQDQSY

SEQ ID NO: 5038 - protein, 10 aa, Borrelia burgdorferi B31
IGVDQDQSYL

SEQ ID NO: 5039 - protein, 10 aa, Borrelia burgdorferi B31
GVDQDQSYLA

SEQ ID NO: 5040 - protein, 10 aa, Borrelia burgdorferi B31
VDQDQSYLAP

SEQ ID NO: 5041 - protein, 10 aa, Borrelia burgdorferi B31
DQDQSYLAPN

SEQ ID NO: 5042 - protein, 10 aa, Borrelia burgdorferi B31
QDQSYLAPNN

SEQ ID NO: 5043 - protein, 10 aa, Borrelia burgdorferi B31
DQSYLAPNNV

SEQ ID NO: 5044 - protein, 10 aa, Borrelia burgdorferi B31
QSYLAPNNVI

SEQ ID NO: 5045 - protein, 10 aa, Borrelia burgdorferi B31
SYLAPNNVIV

SEQ ID NO: 5046 - protein, 10 aa, Borrelia burgdorferi B31
YLAPNNVIVS

SEQ ID NO: 5047 - protein, 10 aa, Borrelia burgdorferi B31
LAPNNVIVSA

SEQ ID NO: 5048 - protein, 10 aa, Borrelia burgdorferi B31
APNNVIVSAV

SEQ ID NO: 5049 - protein, 10 aa, Borrelia burgdorferi B31
PNNVIVSAVK

SEQ ID NO: 5050 - protein, 10 aa, Borrelia burgdorferi B31
NNVIVSAVKK

SEQ ID NO: 5051 - protein, 10 aa, Borrelia burgdorferi B31
NVIVSAVKKV

SEQ ID NO: 5052 - protein, 10 aa, Borrelia burgdorferi B31
VIVSAVKKVD

SEQ ID NO: 5053 - protein, 10 aa, Borrelia burgdorferi B31
IVSAVKKVDS

SEQ ID NO: 5054 - protein, 10 aa, Borrelia burgdorferi B31
VSAVKKVDSL

SEQ ID NO: 5055 - protein, 10 aa, Borrelia burgdorferi B31
SAVKKVDSLM

SEQ ID NO: 5056 - protein, 10 aa, Borrelia burgdorferi B31
AVKKVDSLMY

SEQ ID NO: 5057 - protein, 10 aa, Borrelia burgdorferi B31
VKKVDSLMYS

SEQ ID NO: 5058 - protein, 10 aa, Borrelia burgdorferi B31
KKVDSLMYSL

SEQ ID NO: 5059 - protein, 10 aa, Borrelia burgdorferi B31
KVDSLMYSLT

SEQ ID NO: 5060 - protein, 10 aa, Borrelia burgdorferi B31
VDSLMYSLTK

SEQ ID NO: 5061 - protein, 10 aa, Borrelia burgdorferi B31
DSLMYSLTKK

SEQ ID NO: 5062 - protein, 10 aa, Borrelia burgdorferi B31
SLMYSLTKKY

SEQ ID NO: 5063 - protein, 10 aa, Borrelia burgdorferi B31
LMYSLTKKYL

SEQ ID NO: 5064 - protein, 10 aa, Borrelia burgdorferi B31
MYSLTKKYLE

SEQ ID NO: 5065 - protein, 10 aa, Borrelia burgdorferi B31
YSLTKKYLET

SEQ ID NO: 5066 - protein, 10 aa, Borrelia burgdorferi B31
SLTKKYLETG

SEQ ID NO: 5067 - protein, 10 aa, Borrelia burgdorferi B31
LTKKYLETGV

SEQ ID NO: 5068 - protein, 10 aa, Borrelia burgdorferi B31
TKKYLETGVL

SEQ ID NO: 5069 - protein, 10 aa, Borrelia burgdorferi B31
KKYLETGVLD

SEQ ID NO: 5070 - protein, 10 aa, Borrelia burgdorferi B31
KYLETGVLDG

SEQ ID NO: 5071 - protein, 10 aa, Borrelia burgdorferi B31
YLETGVLDGG

SEQ ID NO: 5072 - protein, 10 aa, Borrelia burgdorferi B31
LETGVLDGGK

SEQ ID NO: 5073 - protein, 10 aa, Borrelia burgdorferi B31
ETGVLDGGKT

SEQ ID NO: 5074 - protein, 10 aa, Borrelia burgdorferi B31
TGVLDGGKTM

SEQ ID NO: 5075 - protein, 10 aa, Borrelia burgdorferi B31
GVLDGGKTMF

SEQ ID NO: 5076 - protein, 10 aa, Borrelia burgdorferi B31
VLDGGKTMFL

SEQ ID NO: 5077 - protein, 10 aa, Borrelia burgdorferi B31
LDGGKTMFLG

SEQ ID NO: 5078 - protein, 10 aa, Borrelia burgdorferi B31
DGGKTMFLGL

SEQ ID NO: 5079 - protein, 10 aa, Borrelia burgdorferi B31
GGKTMFLGLK

SEQ ID NO: 5080 - protein, 10 aa, Borrelia burgdorferi B31
GKTMFLGLKE

SEQ ID NO: 5081 - protein, 10 aa, Borrelia burgdorferi B31
KTMFLGLKED

SEQ ID NO: 5082 - protein, 10 aa, Borrelia burgdorferi B31
TMFLGLKEDG

SEQ ID NO: 5083 - protein, 10 aa, Borrelia burgdorferi B31
MFLGLKEDGL

SEQ ID NO: 5084 - protein, 10 aa, Borrelia burgdorferi B31
FLGLKEDGLG

SEQ ID NO: 5085 - protein, 10 aa, Borrelia burgdorferi B31
LGLKEDGLGL

SEQ ID NO: 5086 - protein, 10 aa, Borrelia burgdorferi B31
GLKEDGLGLV

SEQ ID NO: 5087 - protein, 10 aa, Borrelia burgdorferi B31
LKEDGLGLVL

SEQ ID NO: 5088 - protein, 10 aa, Borrelia burgdorferi B31
KEDGLGLVLN

SEQ ID NO: 5089 - protein, 10 aa, Borrelia burgdorferi B31
EDGLGLVLNE

SEQ ID NO: 5090 - protein, 10 aa, Borrelia burgdorferi B31
DGLGLVLNEN

SEQ ID NO: 5091 - protein, 10 aa, Borrelia burgdorferi B31
GLGLVLNENL

SEQ ID NO: 5092 - protein, 10 aa, Borrelia burgdorferi B31
LGLVLNENLK

SEQ ID NO: 5093 - protein, 10 aa, Borrelia burgdorferi B31
GLVLNENLKS

SEQ ID NO: 5094 - protein, 10 aa, Borrelia burgdorferi B31
LVLNENLKSN

SEQ ID NO: 5095 - protein, 10 aa, Borrelia burgdorferi B31
VLNENLKSNY

SEQ ID NO: 5096 - protein, 10 aa, Borrelia burgdorferi B31
LNENLKSNYS

SEQ ID NO: 5097 - protein, 10 aa, Borrelia burgdorferi B31
NENLKSNYSE

SEQ ID NO: 5098 - protein, 10 aa, Borrelia burgdorferi B31
ENLKSNYSEI

SEQ ID NO: 5099 - protein, 10 aa, Borrelia burgdorferi B31
NLKSNYSEIY

SEQ ID NO: 5100 - protein, 10 aa, Borrelia burgdorferi B31
LKSNYSEIYN

SEQ ID NO: 5101 - protein, 10 aa, Borrelia burgdorferi B31
KSNYSEIYNK

SEQ ID NO: 5102 - protein, 10 aa, Borrelia burgdorferi B31
SNYSEIYNKS

SEQ ID NO: 5103 - protein, 10 aa, Borrelia burgdorferi B31
NYSEIYNKSL

SEQ ID NO: 5104 - protein, 10 aa, Borrelia burgdorferi B31
YSEIYNKSLK

SEQ ID NO: 5105 - protein, 10 aa, Borrelia burgdorferi B31
SEIYNKSLKI

SEQ ID NO: 5106 - protein, 10 aa, Borrelia burgdorferi B31
EIYNKSLKIG

SEQ ID NO: 5107 - protein, 10 aa, Borrelia burgdorferi B31
IYNKSLKIGQ

SEQ ID NO: 5108 - protein, 10 aa, Borrelia burgdorferi B31
YNKSLKIGQS

SEQ ID NO: 5109 - protein, 10 aa, Borrelia burgdorferi B31
NKSLKIGQSI

SEQ ID NO: 5110 - protein, 10 aa, Borrelia burgdorferi B31
KSLKIGQSIM

SEQ ID NO: 5111 - protein, 10 aa, Borrelia burgdorferi B31
SLKIGQSIMN

SEQ ID NO: 5112 - protein, 10 aa, Borrelia burgdorferi B31
LKIGQSIMNG

SEQ ID NO: 5113 - protein, 10 aa, Borrelia burgdorferi B31
KIGQSIMNGI

SEQ ID NO: 5114 - protein, 10 aa, Borrelia burgdorferi B31
IGQSIMNGII

SEQ ID NO: 5115 - protein, 10 aa, Borrelia burgdorferi B31
GQSIMNGIIK

SEQ ID NO: 5116 - protein, 10 aa, Borrelia burgdorferi B31
QSIMNGIIKV

SEQ ID NO: 5117 - protein, 10 aa, Borrelia burgdorferi B31
SIMNGIIKVP

SEQ ID NO: 5118 - protein, 10 aa, Borrelia burgdorferi B31
IMNGIIKVPY

SEQ ID NO: 5119 - protein, 10 aa, Borrelia burgdorferi B31
MNGIIKVPYD

SEQ ID NO: 5120 - protein, 10 aa, Borrelia burgdorferi B31
NGIIKVPYDK

SEQ ID NO: 5121 - protein, 10 aa, Borrelia burgdorferi B31
GIIKVPYDKV

SEQ ID NO: 5122 - protein, 10 aa, Borrelia burgdorferi B31
IIKVPYDKVS

SEQ ID NO: 5123 - protein, 10 aa, Borrelia burgdorferi B31
IKVPYDKVSY

SEQ ID NO: 5124 - protein, 10 aa, Borrelia burgdorferi B31
KVPYDKVSYF

SEQ ID NO: 5125 - protein, 10 aa, Borrelia burgdorferi B31
VPYDKVSYFV

SEQ ID NO: 5126 - protein, 10 aa, Borrelia burgdorferi B31
PYDKVSYFVL

SEQ ID NO: 5127 - protein, 10 aa, Borrelia burgdorferi B31
YDKVSYFVLQ

SEQ ID NO: 5128 - protein, 10 aa, Borrelia burgdorferi B31
DKVSYFVLQM

SEQ ID NO: 5129 - protein, 10 aa, Borrelia burgdorferi B31
KVSYFVLQME

SEQ ID NO: 5130 - protein, 10 aa, Borrelia burgdorferi B31
VSYFVLQMEN

SEQ ID NO: 5131 - protein, 11 aa, Borrelia burgdorferi B31
MDNYYEIYFLY

SEQ ID NO: 5132 - protein, 11 aa, Borrelia burgdorferi B31
DNYYEIYFLYF

SEQ ID NO: 5133 - protein, 11 aa, Borrelia burgdorferi B31
NYYEIYFLYFF

SEQ ID NO: 5134 - protein, 11 aa, Borrelia burgdorferi B31
YYEIYFLYFFI

SEQ ID NO: 5135 - protein, 11 aa, Borrelia burgdorferi B31
YEIYFLYFFIK

SEQ ID NO: 5136 - protein, 11 aa, Borrelia burgdorferi B31
EIYFLYFFIKS

SEQ ID NO: 5137 - protein, 11 aa, Borrelia burgdorferi B31
IYFLYFFIKSK

SEQ ID NO: 5138 - protein, 11 aa, Borrelia burgdorferi B31
YFLYFFIKSKE

SEQ ID NO: 5139 - protein, 11 aa, Borrelia burgdorferi B31
FLYFFIKSKED

SEQ ID NO: 5140 - protein, 11 aa, Borrelia burgdorferi B31
LYFFIKSKEDI

SEQ ID NO: 5141 - protein, 11 aa, Borrelia burgdorferi B31
YFFIKSKEDIF

SEQ ID NO: 5142 - protein, 11 aa, Borrelia burgdorferi B31
FFIKSKEDIFM

SEQ ID NO: 5143 - protein, 11 aa, Borrelia burgdorferi B31
FIKSKEDIFML

SEQ ID NO: 5144 - protein, 11 aa, Borrelia burgdorferi B31
IKSKEDIFMLK

SEQ ID NO: 5145 - protein, 11 aa, Borrelia burgdorferi B31
KSKEDIFMLKK

SEQ ID NO: 5146 - protein, 11 aa, Borrelia burgdorferi B31
SKEDIFMLKKV

SEQ ID NO: 5147 - protein, 11 aa, Borrelia burgdorferi B31
KEDIFMLKKVY

SEQ ID NO: 5148 - protein, 11 aa, Borrelia burgdorferi B31
EDIFMLKKVYY

SEQ ID NO: 5149 - protein, 11 aa, Borrelia burgdorferi B31
DIFMLKKVYYF

SEQ ID NO: 5150 - protein, 11 aa, Borrelia burgdorferi B31
IFMLKKVYYFL

SEQ ID NO: 5151 - protein, 11 aa, Borrelia burgdorferi B31
FMLKKVYYFLI

SEQ ID NO: 5152 - protein, 11 aa, Borrelia burgdorferi B31
MLKKVYYFLIF

SEQ ID NO: 5153 - protein, 11 aa, Borrelia burgdorferi B31
LKKVYYFLIFL

SEQ ID NO: 5154 - protein, 11 aa, Borrelia burgdorferi B31
KKVYYFLIFLF

SEQ ID NO: 5155 - protein, 11 aa, Borrelia burgdorferi B31
KVYYFLIFLFI

SEQ ID NO: 5156 - protein, 11 aa, Borrelia burgdorferi B31
VYYFLIFLFIV

SEQ ID NO: 5157 - protein, 11 aa, Borrelia burgdorferi B31
YYFLIFLFIVA

SEQ ID NO: 5158 - protein, 11 aa, Borrelia burgdorferi B31
YFLIFLFIVAC

SEQ ID NO: 5159 - protein, 11 aa, Borrelia burgdorferi B31
FLIFLFIVACS

SEQ ID NO: 5160 - protein, 11 aa, Borrelia burgdorferi B31
LIFLFIVACSS

SEQ ID NO: 5161 - protein, 11 aa, Borrelia burgdorferi B31
IFLFIVACSSS

SEQ ID NO: 5162 - protein, 11 aa, Borrelia burgdorferi B31
FLFIVACSSSD

SEQ ID NO: 5163 - protein, 11 aa, Borrelia burgdorferi B31
LFIVACSSSDD

SEQ ID NO: 5164 - protein, 11 aa, Borrelia burgdorferi B31
FIVACSSSDDG

SEQ ID NO: 5165 - protein, 11 aa, Borrelia burgdorferi B31
IVACSSSDDGK

SEQ ID NO: 5166 - protein, 11 aa, Borrelia burgdorferi B31
VACSSSDDGKS

SEQ ID NO: 5167 - protein, 11 aa, Borrelia burgdorferi B31
ACSSSDDGKSE

SEQ ID NO: 5168 - protein, 11 aa, Borrelia burgdorferi B31
CSSSDDGKSEA

SEQ ID NO: 5169 - protein, 11 aa, Borrelia burgdorferi B31
SSSDDGKSEAK

SEQ ID NO: 5170 - protein, 11 aa, Borrelia burgdorferi B31
SSDDGKSEAKT

SEQ ID NO: 5171 - protein, 11 aa, Borrelia burgdorferi B31
SDDGKSEAKTV

SEQ ID NO: 5172 - protein, 11 aa, Borrelia burgdorferi B31
DDGKSEAKTVS

SEQ ID NO: 5173 - protein, 11 aa, Borrelia burgdorferi B31
DGKSEAKTVSL

SEQ ID NO: 5174 - protein, 11 aa, Borrelia burgdorferi B31
GKSEAKTVSLI

SEQ ID NO: 5175 - protein, 11 aa, Borrelia burgdorferi B31
KSEAKTVSLIV

SEQ ID NO: 5176 - protein, 11 aa, Borrelia burgdorferi B31
SEAKTVSLIVD

SEQ ID NO: 5177 - protein, 11 aa, Borrelia burgdorferi B31
EAKTVSLIVDG

SEQ ID NO: 5178 - protein, 11 aa, Borrelia burgdorferi B31
AKTVSLIVDGA

SEQ ID NO: 5179 - protein, 11 aa, Borrelia burgdorferi B31
KTVSLIVDGAF

SEQ ID NO: 5180 - protein, 11 aa, Borrelia burgdorferi B31
TVSLIVDGAFD

SEQ ID NO: 5181 - protein, 11 aa, Borrelia burgdorferi B31
VSLIVDGAFDD

SEQ ID NO: 5182 - protein, 11 aa, Borrelia burgdorferi B31
SLIVDGAFDDK

SEQ ID NO: 5183 - protein, 11 aa, Borrelia burgdorferi B31
LIVDGAFDDKG

SEQ ID NO: 5184 - protein, 11 aa, Borrelia burgdorferi B31
IVDGAFDDKGF

SEQ ID NO: 5185 - protein, 11 aa, Borrelia burgdorferi B31
VDGAFDDKGFN

SEQ ID NO: 5186 - protein, 11 aa, Borrelia burgdorferi B31
DGAFDDKGFNE

SEQ ID NO: 5187 - protein, 11 aa, Borrelia burgdorferi B31
GAFDDKGFNES

SEQ ID NO: 5188 - protein, 11 aa, Borrelia burgdorferi B31
AFDDKGFNESS

SEQ ID NO: 5189 - protein, 11 aa, Borrelia burgdorferi B31
FDDKGFNESSS

SEQ ID NO: 5190 - protein, 11 aa, Borrelia burgdorferi B31
DDKGFNESSSK

SEQ ID NO: 5191 - protein, 11 aa, Borrelia burgdorferi B31
DKGFNESSSKA

SEQ ID NO: 5192 - protein, 11 aa, Borrelia burgdorferi B31
KGFNESSSKAI

SEQ ID NO: 5193 - protein, 11 aa, Borrelia burgdorferi B31
GFNESSSKAIR

SEQ ID NO: 5194 - protein, 11 aa, Borrelia burgdorferi B31
FNESSSKAIRK

SEQ ID NO: 5195 - protein, 11 aa, Borrelia burgdorferi B31
NESSSKAIRKL

SEQ ID NO: 5196 - protein, 11 aa, Borrelia burgdorferi B31
ESSSKAIRKLK

SEQ ID NO: 5197 - protein, 11 aa, Borrelia burgdorferi B31
SSSKAIRKLKA

SEQ ID NO: 5198 - protein, 11 aa, Borrelia burgdorferi B31
SSKAIRKLKAD

SEQ ID NO: 5199 - protein, 11 aa, Borrelia burgdorferi B31
SKAIRKLKADL

SEQ ID NO: 5200 - protein, 11 aa, Borrelia burgdorferi B31
KAIRKLKADLN

SEQ ID NO: 5201 - protein, 11 aa, Borrelia burgdorferi B31
AIRKLKADLNI

SEQ ID NO: 5202 - protein, 11 aa, Borrelia burgdorferi B31
IRKLKADLNIN

SEQ ID NO: 5203 - protein, 11 aa, Borrelia burgdorferi B31
RKLKADLNINI

SEQ ID NO: 5204 - protein, 11 aa, Borrelia burgdorferi B31
KLKADLNINII

SEQ ID NO: 5205 - protein, 11 aa, Borrelia burgdorferi B31
LKADLNINIIE

SEQ ID NO: 5206 - protein, 11 aa, Borrelia burgdorferi B31
KADLNINIIEK

SEQ ID NO: 5207 - protein, 11 aa, Borrelia burgdorferi B31
ADLNINIIEKA

SEQ ID NO: 5208 - protein, 11 aa, Borrelia burgdorferi B31
DLNINIIEKAS

SEQ ID NO: 5209 - protein, 11 aa, Borrelia burgdorferi B31
LNINIIEKAST

SEQ ID NO: 5210 - protein, 11 aa, Borrelia burgdorferi B31
NINIIEKASTG

SEQ ID NO: 5211 - protein, 11 aa, Borrelia burgdorferi B31
INIIEKASTGN

SEQ ID NO: 5212 - protein, 11 aa, Borrelia burgdorferi B31
NIIEKASTGNS

SEQ ID NO: 5213 - protein, 11 aa, Borrelia burgdorferi B31
IIEKASTGNSY

SEQ ID NO: 5214 - protein, 11 aa, Borrelia burgdorferi B31
IEKASTGNSYL

SEQ ID NO: 5215 - protein, 11 aa, Borrelia burgdorferi B31
EKASTGNSYLG

SEQ ID NO: 5216 - protein, 11 aa, Borrelia burgdorferi B31
KASTGNSYLGD

SEQ ID NO: 5217 - protein, 11 aa, Borrelia burgdorferi B31
ASTGNSYLGDI

SEQ ID NO: 5218 - protein, 11 aa, Borrelia burgdorferi B31
STGNSYLGDIA

SEQ ID NO: 5219 - protein, 11 aa, Borrelia burgdorferi B31
TGNSYLGDIAN

SEQ ID NO: 5220 - protein, 11 aa, Borrelia burgdorferi B31
GNSYLGDIANL

SEQ ID NO: 5221 - protein, 11 aa, Borrelia burgdorferi B31
NSYLGDIANLE

SEQ ID NO: 5222 - protein, 11 aa, Borrelia burgdorferi B31
SYLGDIANLED

SEQ ID NO: 5223 - protein, 11 aa, Borrelia burgdorferi B31
YLGDIANLEDG

SEQ ID NO: 5224 - protein, 11 aa, Borrelia burgdorferi B31
LGDIANLEDGN

SEQ ID NO: 5225 - protein, 11 aa, Borrelia burgdorferi B31
GDIANLEDGNS

SEQ ID NO: 5226 - protein, 11 aa, Borrelia burgdorferi B31
DIANLEDGNSN

SEQ ID NO: 5227 - protein, 11 aa, Borrelia burgdorferi B31
IANLEDGNSNL

SEQ ID NO: 5228 - protein, 11 aa, Borrelia burgdorferi B31
ANLEDGNSNLI

SEQ ID NO: 5229 - protein, 11 aa, Borrelia burgdorferi B31
NLEDGNSNLIW

SEQ ID NO: 5230 - protein, 11 aa, Borrelia burgdorferi B31
LEDGNSNLIWG

SEQ ID NO: 5231 - protein, 11 aa, Borrelia burgdorferi B31
EDGNSNLIWGI

SEQ ID NO: 5232 - protein, 11 aa, Borrelia burgdorferi B31
DGNSNLIWGIG

SEQ ID NO: 5233 - protein, 11 aa, Borrelia burgdorferi B31
GNSNLIWGIGF

SEQ ID NO: 5234 - protein, 11 aa, Borrelia burgdorferi B31
NSNLIWGIGFR

SEQ ID NO: 5235 - protein, 11 aa, Borrelia burgdorferi B31
SNLIWGIGFRL

SEQ ID NO: 5236 - protein, 11 aa, Borrelia burgdorferi B31
NLIWGIGFRLS

SEQ ID NO: 5237 - protein, 11 aa, Borrelia burgdorferi B31
LIWGIGFRLSD

SEQ ID NO: 5238 - protein, 11 aa, Borrelia burgdorferi B31
IWGIGFRLSDI

SEQ ID NO: 5239 - protein, 11 aa, Borrelia burgdorferi B31
WGIGFRLSDIL

SEQ ID NO: 5240 - protein, 11 aa, Borrelia burgdorferi B31
GIGFRLSDILF

SEQ ID NO: 5241 - protein, 11 aa, Borrelia burgdorferi B31
IGFRLSDILFQ

SEQ ID NO: 5242 - protein, 11 aa, Borrelia burgdorferi B31
GFRLSDILFQR

SEQ ID NO: 5243 - protein, 11 aa, Borrelia burgdorferi B31
FRLSDILFQRA

SEQ ID NO: 5244 - protein, 11 aa, Borrelia burgdorferi B31
RLSDILFQRAS

SEQ ID NO: 5245 - protein, 11 aa, Borrelia burgdorferi B31
LSDILFQRASE

SEQ ID NO: 5246 - protein, 11 aa, Borrelia burgdorferi B31
SDILFQRASEN

SEQ ID NO: 5247 - protein, 11 aa, Borrelia burgdorferi B31
DILFQRASENV

SEQ ID NO: 5248 - protein, 11 aa, Borrelia burgdorferi B31
ILFQRASENVS

SEQ ID NO: 5249 - protein, 11 aa, Borrelia burgdorferi B31
LFQRASENVSV

SEQ ID NO: 5250 - protein, 11 aa, Borrelia burgdorferi B31
FQRASENVSVN

SEQ ID NO: 5251 - protein, 11 aa, Borrelia burgdorferi B31
QRASENVSVNY

SEQ ID NO: 5252 - protein, 11 aa, Borrelia burgdorferi B31
RASENVSVNYA

SEQ ID NO: 5253 - protein, 11 aa, Borrelia burgdorferi B31
ASENVSVNYAI

SEQ ID NO: 5254 - protein, 11 aa, Borrelia burgdorferi B31
SENVSVNYAII

SEQ ID NO: 5255 - protein, 11 aa, Borrelia burgdorferi B31
ENVSVNYAIIE

SEQ ID NO: 5256 - protein, 11 aa, Borrelia burgdorferi B31
NVSVNYAIIEG

SEQ ID NO: 5257 - protein, 11 aa, Borrelia burgdorferi B31
VSVNYAIIEGV

SEQ ID NO: 5258 - protein, 11 aa, Borrelia burgdorferi B31
SVNYAIIEGVY

SEQ ID NO: 5259 - protein, 11 aa, Borrelia burgdorferi B31
VNYAIIEGVYD

SEQ ID NO: 5260 - protein, 11 aa, Borrelia burgdorferi B31
NYAIIEGVYDE

SEQ ID NO: 5261 - protein, 11 aa, Borrelia burgdorferi B31
YAIIEGVYDEI

SEQ ID NO: 5262 - protein, 11 aa, Borrelia burgdorferi B31
AIIEGVYDEIQ

SEQ ID NO: 5263 - protein, 11 aa, Borrelia burgdorferi B31
IIEGVYDEIQI

SEQ ID NO: 5264 - protein, 11 aa, Borrelia burgdorferi B31
IEGVYDEIQIP

SEQ ID NO: 5265 - protein, 11 aa, Borrelia burgdorferi B31
EGVYDEIQIPK

SEQ ID NO: 5266 - protein, 11 aa, Borrelia burgdorferi B31
GVYDEIQIPKN

SEQ ID NO: 5267 - protein, 11 aa, Borrelia burgdorferi B31
VYDEIQIPKNL

SEQ ID NO: 5268 - protein, 11 aa, Borrelia burgdorferi B31
YDEIQIPKNLL

SEQ ID NO: 5269 - protein, 11 aa, Borrelia burgdorferi B31
DEIQIPKNLLN

SEQ ID NO: 5270 - protein, 11 aa, Borrelia burgdorferi B31
EIQIPKNLLNI

SEQ ID NO: 5271 - protein, 11 aa, Borrelia burgdorferi B31
IQIPKNLLNIS

SEQ ID NO: 5272 - protein, 11 aa, Borrelia burgdorferi B31
QIPKNLLNISF

SEQ ID NO: 5273 - protein, 11 aa, Borrelia burgdorferi B31
IPKNLLNISFR

SEQ ID NO: 5274 - protein, 11 aa, Borrelia burgdorferi B31
PKNLLNISFRS

SEQ ID NO: 5275 - protein, 11 aa, Borrelia burgdorferi B31
KNLLNISFRSE

SEQ ID NO: 5276 - protein, 11 aa, Borrelia burgdorferi B31
NLLNISFRSEE

SEQ ID NO: 5277 - protein, 11 aa, Borrelia burgdorferi B31
LLNISFRSEEV

SEQ ID NO: 5278 - protein, 11 aa, Borrelia burgdorferi B31
LNISFRSEEVA

SEQ ID NO: 5279 - protein, 11 aa, Borrelia burgdorferi B31
NISFRSEEVAF

SEQ ID NO: 5280 - protein, 11 aa, Borrelia burgdorferi B31
ISFRSEEVAFL

SEQ ID NO: 5281 - protein, 11 aa, Borrelia burgdorferi B31
SFRSEEVAFLA

SEQ ID NO: 5282 - protein, 11 aa, Borrelia burgdorferi B31
FRSEEVAFLAG

SEQ ID NO: 5283 - protein, 11 aa, Borrelia burgdorferi B31
RSEEVAFLAGY

SEQ ID NO: 5284 - protein, 11 aa, Borrelia burgdorferi B31
SEEVAFLAGYF

SEQ ID NO: 5285 - protein, 11 aa, Borrelia burgdorferi B31
EEVAFLAGYFA

SEQ ID NO: 5286 - protein, 11 aa, Borrelia burgdorferi B31
EVAFLAGYFAS

SEQ ID NO: 5287 - protein, 11 aa, Borrelia burgdorferi B31
VAFLAGYFASK

SEQ ID NO: 5288 - protein, 11 aa, Borrelia burgdorferi B31
AFLAGYFASKA

SEQ ID NO: 5289 - protein, 11 aa, Borrelia burgdorferi B31
FLAGYFASKAS

SEQ ID NO: 5290 - protein, 11 aa, Borrelia burgdorferi B31
LAGYFASKASK

SEQ ID NO: 5291 - protein, 11 aa, Borrelia burgdorferi B31
AGYFASKASKT

SEQ ID NO: 5292 - protein, 11 aa, Borrelia burgdorferi B31
GYFASKASKTG

SEQ ID NO: 5293 - protein, 11 aa, Borrelia burgdorferi B31
YFASKASKTGK

SEQ ID NO: 5294 - protein, 11 aa, Borrelia burgdorferi B31
FASKASKTGKI

SEQ ID NO: 5295 - protein, 11 aa, Borrelia burgdorferi B31
ASKASKTGKIG

SEQ ID NO: 5296 - protein, 11 aa, Borrelia burgdorferi B31
SKASKTGKIGF

SEQ ID NO: 5297 - protein, 11 aa, Borrelia burgdorferi B31
KASKTGKIGFV

SEQ ID NO: 5298 - protein, 11 aa, Borrelia burgdorferi B31
ASKTGKIGFVG

SEQ ID NO: 5299 - protein, 11 aa, Borrelia burgdorferi B31
SKTGKIGFVGG

SEQ ID NO: 5300 - protein, 11 aa, Borrelia burgdorferi B31
KTGKIGFVGGV

SEQ ID NO: 5301 - protein, 11 aa, Borrelia burgdorferi B31
TGKIGFVGGVR

SEQ ID NO: 5302 - protein, 11 aa, Borrelia burgdorferi B31
GKIGFVGGVRG

SEQ ID NO: 5303 - protein, 11 aa, Borrelia burgdorferi B31
KIGFVGGVRGK

SEQ ID NO: 5304 - protein, 11 aa, Borrelia burgdorferi B31
IGFVGGVRGKV

SEQ ID NO: 5305 - protein, 11 aa, Borrelia burgdorferi B31
GFVGGVRGKVL

SEQ ID NO: 5306 - protein, 11 aa, Borrelia burgdorferi B31
FVGGVRGKVLE

SEQ ID NO: 5307 - protein, 11 aa, Borrelia burgdorferi B31
VGGVRGKVLES

SEQ ID NO: 5308 - protein, 11 aa, Borrelia burgdorferi B31
GGVRGKVLESF

SEQ ID NO: 5309 - protein, 11 aa, Borrelia burgdorferi B31
GVRGKVLESFM

SEQ ID NO: 5310 - protein, 11 aa, Borrelia burgdorferi B31
VRGKVLESFMY

SEQ ID NO: 5311 - protein, 11 aa, Borrelia burgdorferi B31
RGKVLESFMYG

SEQ ID NO: 5312 - protein, 11 aa, Borrelia burgdorferi B31
GKVLESFMYGY

SEQ ID NO: 5313 - protein, 11 aa, Borrelia burgdorferi B31
KVLESFMYGYE

SEQ ID NO: 5314 - protein, 11 aa, Borrelia burgdorferi B31
VLESFMYGYEA

SEQ ID NO: 5315 - protein, 11 aa, Borrelia burgdorferi B31
LESFMYGYEAG

SEQ ID NO: 5316 - protein, 11 aa, Borrelia burgdorferi B31
ESFMYGYEAGA

SEQ ID NO: 5317 - protein, 11 aa, Borrelia burgdorferi B31
SFMYGYEAGAK

SEQ ID NO: 5318 - protein, 11 aa, Borrelia burgdorferi B31
FMYGYEAGAKY

SEQ ID NO: 5319 - protein, 11 aa, Borrelia burgdorferi B31
MYGYEAGAKYA

SEQ ID NO: 5320 - protein, 11 aa, Borrelia burgdorferi B31
YGYEAGAKYAN

SEQ ID NO: 5321 - protein, 11 aa, Borrelia burgdorferi B31
GYEAGAKYANS

SEQ ID NO: 5322 - protein, 11 aa, Borrelia burgdorferi B31
YEAGAKYANSN

SEQ ID NO: 5323 - protein, 11 aa, Borrelia burgdorferi B31
EAGAKYANSNI

(The sequence listing continues in the following parts.)

The invention claimed is:

1. An isolated MHC multimer comprising (a-b-P)n, wherein n>1 and P is a peptide derived from a *Borrelia* Decorin Binding Protein A,
   wherein a is at least the extracellular portion of an HLA*02 heavy chain and b is β2 microglobulin,
   wherein a and b together form a functional MHC complex encoded by an HLA-A*02 allele, whereto the peptide P is bound, forming a MHC peptide complex,
   wherein the HLA*02 allele is selected from the group consisting of HLA-A*0201, HLA-A*0202, HLA-A*0203, HLA-A*0211, and HLA-A*0216,
   wherein each MHC peptide complex of said MHC multimer is associated with one or more multimerization domains, with the proviso that the one or more multimerization domains is not a cell, and
   wherein in each MHC peptide complex, the sequence of P is selected from the group consisting of SEQ ID NOS: 5751 (GIYDLILNA), 5655 (TLLASLLAA), and 5767 (GMQGMKQAV).

2. A method for generating the isolated MHC multimer according to claim 1, said method comprising the steps of
   i) providing one or more peptides P;
   ii) providing one or more functional MHC complexes,
   iii) providing one or more multimerization domains, and
   iv) contacting or reacting the one or more peptides P and the one or more functional MHC complexes and the one or more multimerization domains simultaneously or sequentially, in any order, thereby obtaining MHC multimers according to the present invention.

3. A composition comprising a plurality of isolated MHC multimers according to claim 1, wherein the isolated MHC multimers are identical or different, and a carrier.

4. A kit comprising an isolated MHC multimer according to claim 1, or the composition according to claim 3, and at least one additional component.

5. A vaccine comprising one or more isolated MHC multimers according to claim 1.

6. The kit according to claim 4, wherein said at least one additional component is a positive control.

7. The kit according to claim 4, wherein said at least one additional component is instructions for use.

8. The isolated MHC multimer according to claim 1, wherein said one or more multimerization domains comprise a soluble polysaccharide carrier molecule.

9. The isolated MHC multimer according to claim 1, wherein said MHC multimer is a soluble MHC multimer.

10. The isolated MHC multimer according to claim 1, wherein the one or more multimerization domains comprise an isolated cell membrane or isolated lipid bilayer.

11. The isolated MHC multimer according to claim 1, wherein each P is SEQ ID NO 5751.

12. The isolated MHC multimer according to claim 1, wherein said one or more multimerization domains is selected from the group consisting of scaffolds, carriers, organic molecules and substituted organic molecules, membranes, liposomes or micelles, polymers, polysaccharides, dextran moieties, IgG domains, coiled-coil polypeptide structures, DNA duplexes, nucleic acid duplexes, PNA-PNA, PNA-DNA, DNA-RNA, avidins, streptavidins, antibodies, small organic molecules, proteins, a solid support, and biological polymers.

* * * * *